(12) United States Patent
Ayalon-Soffer et al.

(10) Patent No.: US 7,842,459 B2
(45) Date of Patent: Nov. 30, 2010

(54) NUCLEOTIDE AND AMINO ACID SEQUENCES, AND ASSAYS AND METHODS OF USE THEREOF FOR DIAGNOSIS

(75) Inventors: Michal Ayalon-Soffer, Ramat-HaSharon (IL); Sarah Pollock, Tel-Aviv (IL); Ronen Shemesh, Modlin (IL); Rotem Sorek, Rechovot (IL); Zurit Levine, Herzlia (IL); Zipi Shaqed, Tel-Aviv (IL); Amir Toporik, Azur (IL); Gad S. Cojocaru, Ramat-HaSharon (IL); Dvir Dahary, Tel-Aviv (IL); Guy Kol, Givat Shmuel (IL); Pinchas Akiva, Ramat-Gan (IL); Amit Novik, Beit-HaSharon (IL); Sergey Nemzer, RaAnana (IL); Alexander Diber, LeZion (IL); Maxim Shklar, Tel-Aviv (IL); Osnat Sella-Tavor, Kfar Kish (IL); Lily Bazak, Givataim (IL); Ariel Farkash, Haifa (IL); Yossi Cohen, Banstead (GB)

(73) Assignee: Compugen Ltd., Tel Aviv (IL)

( * ) Notice: Subject to any disclaimer, the term of this patent is extended or adjusted under 35 U.S.C. 154(b) by 1560 days.

(21) Appl. No.: 11/051,646

(22) Filed: Jan. 27, 2005

(65) Prior Publication Data

US 2010/0120022 A1 May 13, 2010

Related U.S. Application Data

(60) Provisional application No. 60/628,666, filed on Nov. 18, 2004, provisional application No. 60/539,129, filed on Jan. 27, 2004, provisional application No. 60/539,128, filed on Jan. 27, 2004.

(51) Int. Cl.
*C12Q 1/68* (2006.01)
*C07H 21/02* (2006.01)
*C07H 21/04* (2006.01)
*C12P 19/34* (2006.01)

(52) U.S. Cl. .......... 435/6; 435/91.2; 536/23.1; 536/24.3

(58) Field of Classification Search ............... None
See application file for complete search history.

(56) References Cited

U.S. PATENT DOCUMENTS

| | | | |
|---|---|---|---|
| 4,469,863 A | 9/1984 | Ts'o et al. | 536/27 |
| 4,476,301 A | 10/1984 | Imbach et al. | 536/27 |
| 5,023,243 A | 6/1991 | Tullis | 514/44 |
| 5,034,506 A | 7/1991 | Summerton et al. | 528/391 |
| 5,166,315 A | 11/1992 | Summerton et al. | 528/406 |

(Continued)

OTHER PUBLICATIONS

GenBank Accession No. J04177 (Oct. 1994).*

(Continued)

*Primary Examiner*—Teresa E Strzelecka
(74) *Attorney, Agent, or Firm*—Mintz Levin Cohn Ferris Glovsky and Popeo, P.C.; Ivor R. Elrifi; David E. Johnson

(57) ABSTRACT

Novel splice variant nucleic acid sequences. The novel splice variants and their nucleic acid sequences according to the present invention may optionally be used for diagnosis of a variant-detectable disease as described herein.

5 Claims, 71 Drawing Sheets

U.S. PATENT DOCUMENTS

Figure 23:
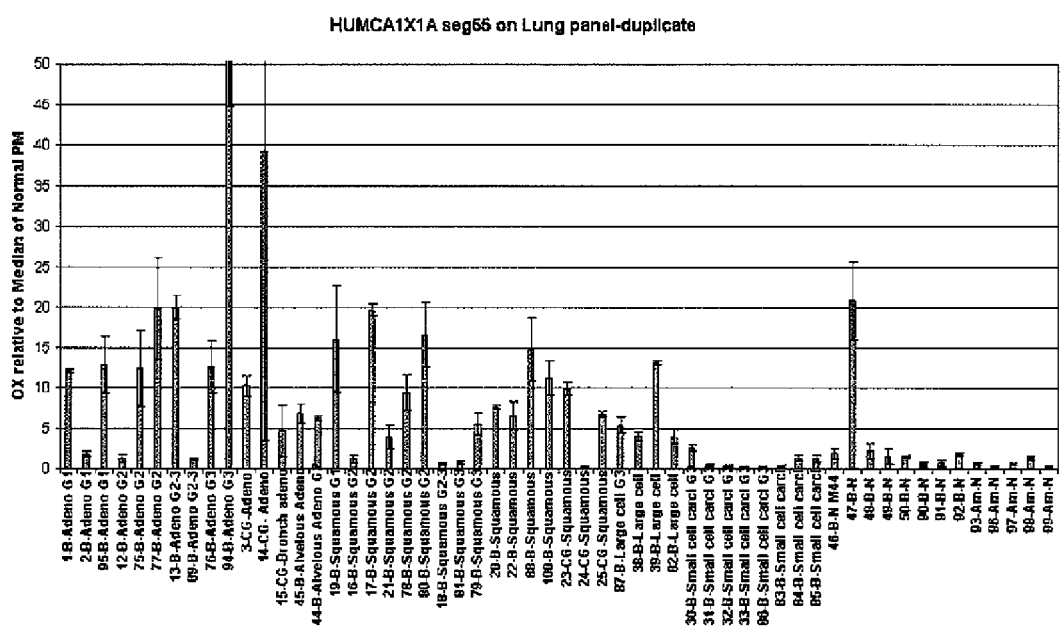

| | | | |
|---|---|---|---|
| 5,177,196 A | 1/1993 | Meyer, Jr. et al. | 536/22.1 |
| 5,185,444 A | 2/1993 | Summerton et al. | 544/81 |
| 5,188,897 A | 2/1993 | Suhadolnik et al. | 428/402.2 |
| 5,214,134 A | 5/1993 | Weis et al. | 536/25.3 |
| 5,216,141 A | 6/1993 | Benner | 536/27.13 |
| 5,235,033 A | 8/1993 | Summerton et al. | 528/391 |
| 5,264,423 A | 11/1993 | Cohen et al. | 514/44 |
| 5,264,562 A | 11/1993 | Matteucci | 536/23.1 |
| 5,264,564 A | 11/1993 | Matteucci | 536/23.1 |
| 5,276,019 A | 1/1994 | Cohen et al. | 514/44 |
| 5,278,302 A | 1/1994 | Caruthers et al. | 536/24.5 |
| 5,286,717 A | 2/1994 | Cohen et al. | 514/44 |
| 5,321,131 A | 6/1994 | Agrawal et al. | 536/25.34 |
| 5,399,676 A | 3/1995 | Froehler | 536/23.1 |
| 5,405,938 A | 4/1995 | Summerton et al. | 528/406 |
| 5,405,939 A | 4/1995 | Suhadolnik et al. | 530/322 |
| 5,434,257 A | 7/1995 | Matteucci et al. | 536/24.3 |
| 5,453,496 A | 9/1995 | Caruthers et al. | 536/24.5 |
| 5,455,233 A | 10/1995 | Spielvogel et al. | 514/44 |
| 5,466,677 A | 11/1995 | Baxter et al. | 514/44 |
| 5,470,967 A | 11/1995 | Huie et al. | 536/24.3 |
| 5,476,925 A | 12/1995 | Letsinger et al. | 536/23.1 |
| 5,489,677 A | 2/1996 | Sanghvi et al. | 536/22.1 |
| 5,519,126 A | 5/1996 | Hecht | 536/24.3 |
| 5,536,821 A | 7/1996 | Agrawal et al. | 536/22.1 |
| 5,539,082 A | 7/1996 | Nielsen et al. | 530/300 |
| 5,541,306 A | 7/1996 | Agrawal et al. | 536/22.1 |
| 5,541,307 A | 7/1996 | Cook et al. | 536/23.1 |
| 5,550,111 A | 8/1996 | Suhadolnik et al. | 514/44 |
| 5,561,225 A | 10/1996 | Maddry et al. | 536/23.1 |
| 5,563,253 A | 10/1996 | Agrawal et al. | 536/22.1 |
| 5,571,799 A | 11/1996 | Tkachuk et al. | 514/47 |
| 5,587,361 A | 12/1996 | Cook et al. | 514/44 |
| 5,596,086 A | 1/1997 | Matteucci et al. | 536/22.1 |
| 5,602,240 A | 2/1997 | De Mesmaeker et al. | 536/22.1 |
| 5,608,046 A | 3/1997 | Cook et al. | 536/23.1 |
| 5,610,289 A | 3/1997 | Cook et al. | 536/25.34 |
| 5,618,704 A | 4/1997 | Sanghvi et al. | 435/91.5 |
| 5,623,070 A | 4/1997 | Cook et al. | 536/27.6 |
| 5,625,050 A | 4/1997 | Beaton et al. | 536/24.1 |
| 5,633,360 A | 5/1997 | Bischofberger et al. | 536/22.1 |
| 5,663,312 A | 9/1997 | Chaturvedula | 536/22.1 |
| 5,677,437 A | 10/1997 | Teng et al. | 536/23.1 |
| 5,677,439 A | 10/1997 | Weis et al. | 536/23.1 |
| 5,714,331 A | 2/1998 | Buchardt et al. | 435/6 |
| 5,719,262 A | 2/1998 | Buchardt et al. | 530/300 |
| 6,303,374 B1 | 10/2001 | Zhang et al. | 435/375 |

OTHER PUBLICATIONS

GenBank Accession No. AC093150.3 (Dec. 2002).*
New England Biolabs Catalog (p. 121, 1998/99).*
Fischer, H. et al., Carcinogenesis, vol. 22, pp. 875-878 (2001).*
Stratagene Catalog, p. 39 (1988).*
Fahrlander et al., "Amplifying DNA Probe Signals: A 'Christmas Tree' Approach", *Bio/Technol.*, 6:1165-1168 (1988).
Cheung et al., "Natural variation in human gene expression assessed in lymphoblastoid cells", *Nat. Gen.*, 33:422-425 (2003).
Enard et al., "Intra- and interspecific variation in primate gene expression patterns", *Science*, 296:340-343 (2002).
GenBank Accession No. AC093150, May 2, 2003, pp. 1-59.
Xiang et al., "Amine-modified random primers to label probes for DNA microarrays", *Nat. Biotechnol.*, 20:738-742 (2002).

* cited by examiner

Figure 1: Schematic description of the cancer biomarker selection engine.
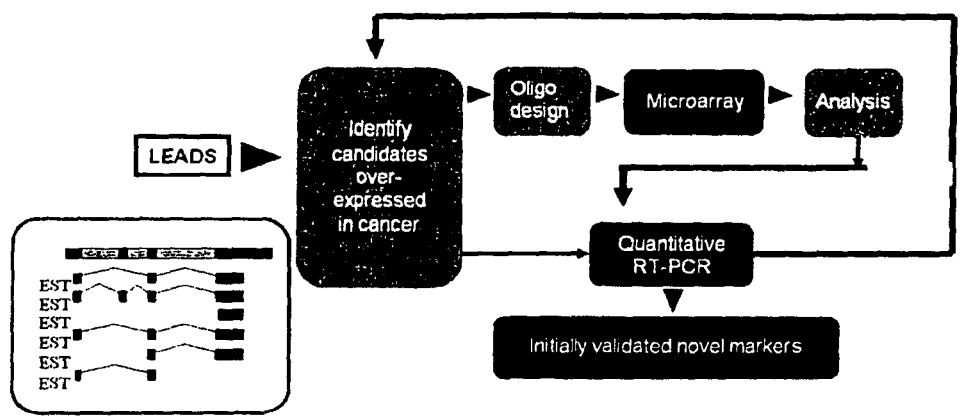
Figure 2: Schematic illustration, depicting grouping of transcripts of a given contig based on presence or absence of unique sequence regions.
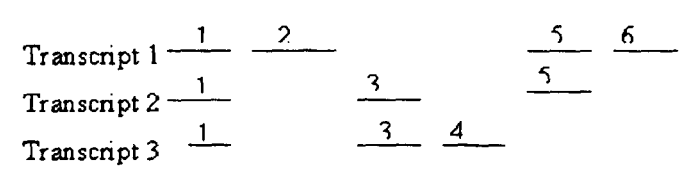

Figure 3 - Cancer and cell-line vs. normal tissue expression
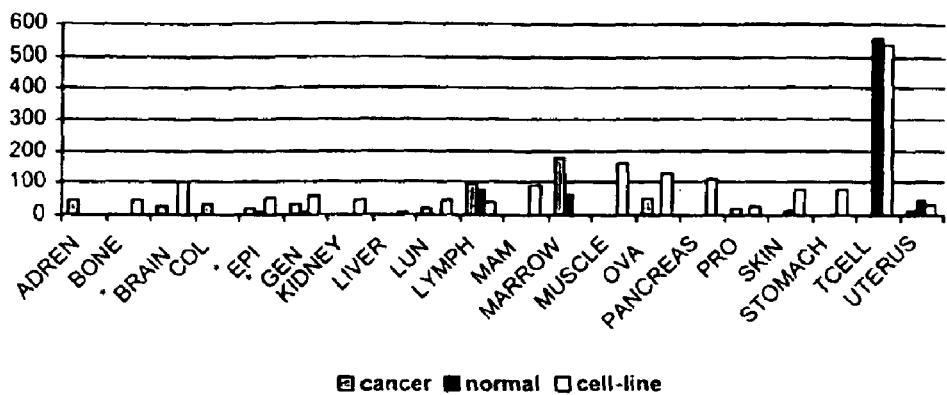
Figure 4 - Expression of ESTs in each category, as "parts per million"
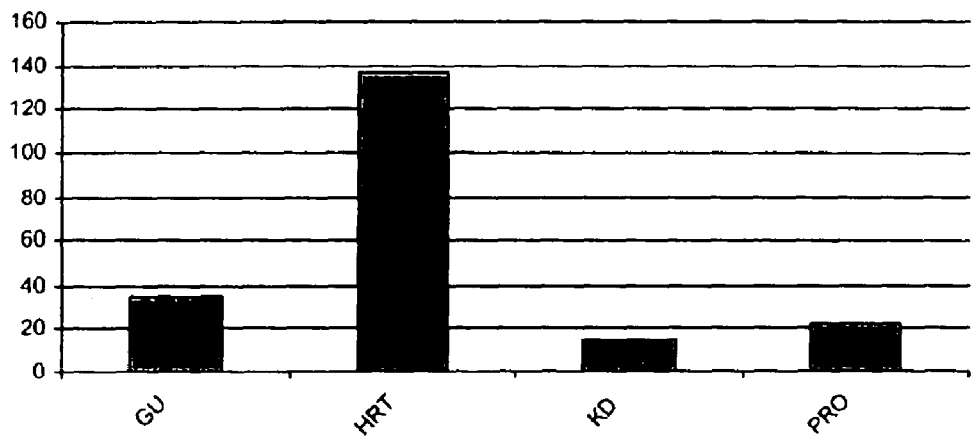
tissues, skin malignancies and uterine malignancies.

Figure 5 - Cancer and cell-line vs. normal tissue expression
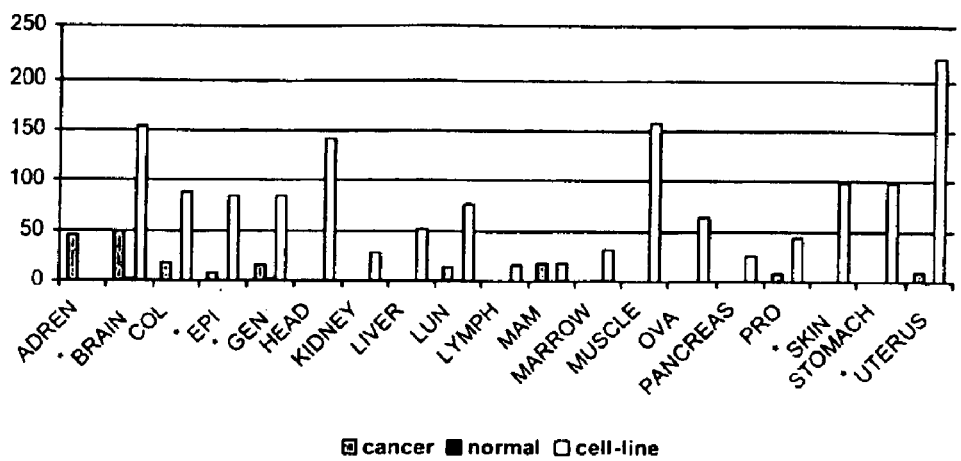
Figure 6 - Expression of ESTs in each category, as "parts per million"
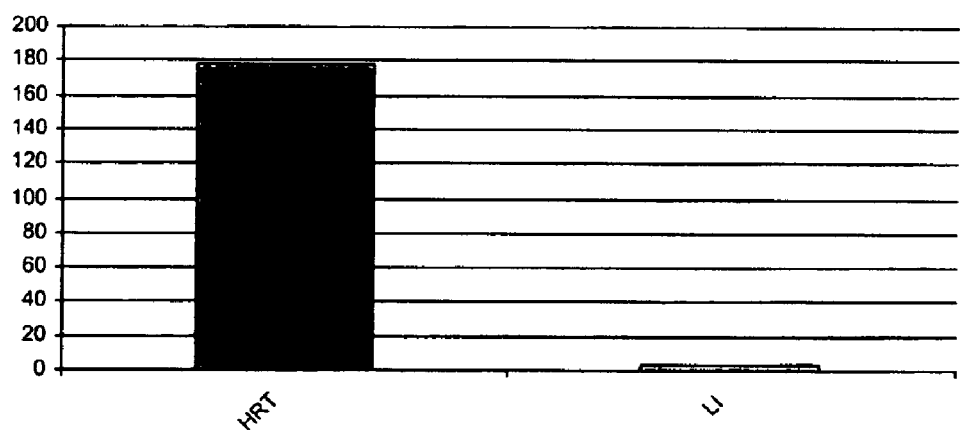
Figure 7 - Expression of ESTs in each category, as "parts per million"
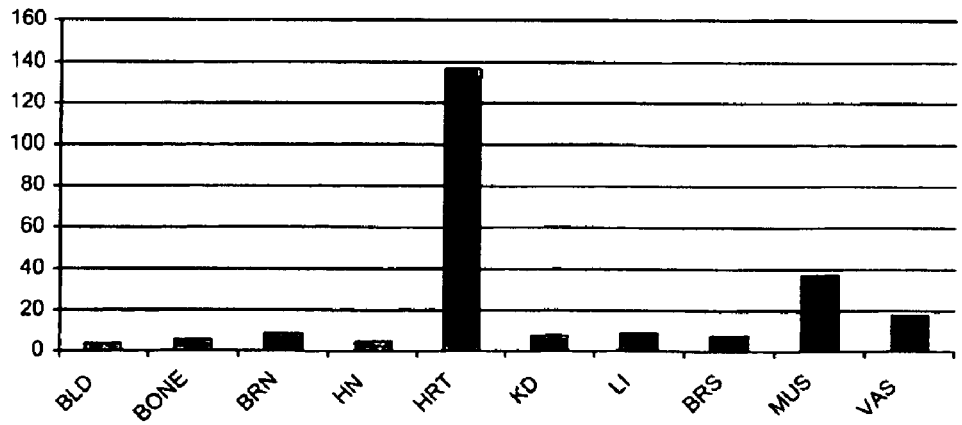

*Figure 8 - Cancer and cell-line vs. normal tissue expression*
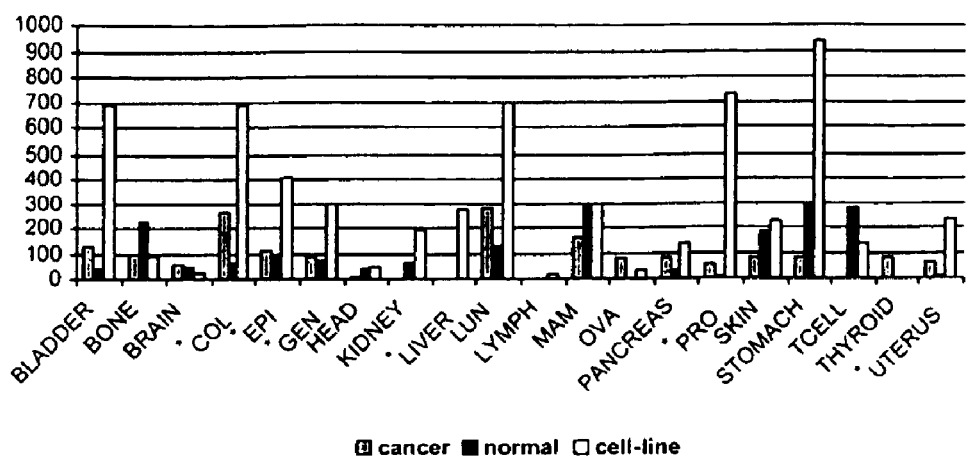
*Figure 9 - Cancer and cell-line vs. normal tissue expression*
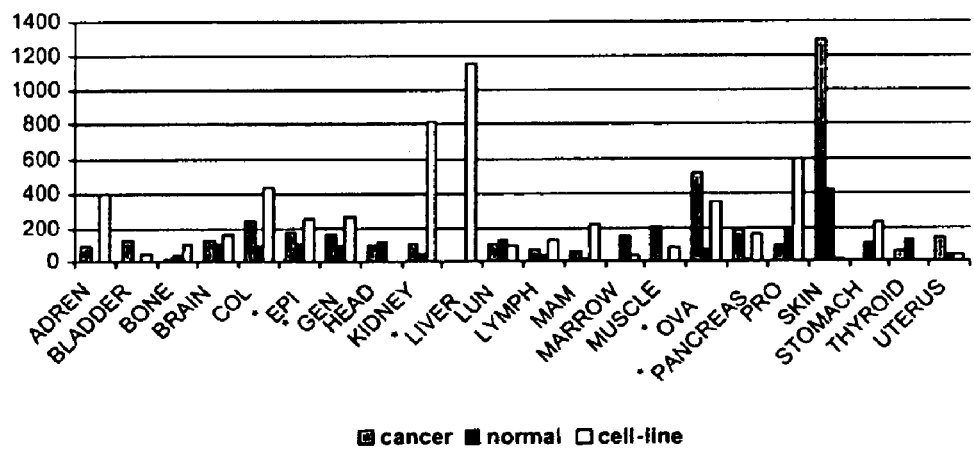

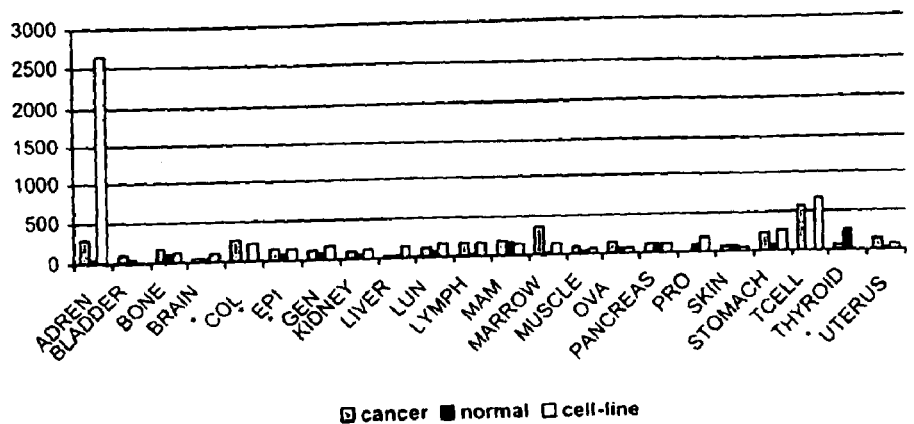
Figure 10 - Cancer and cell-line vs. normal tissue expression
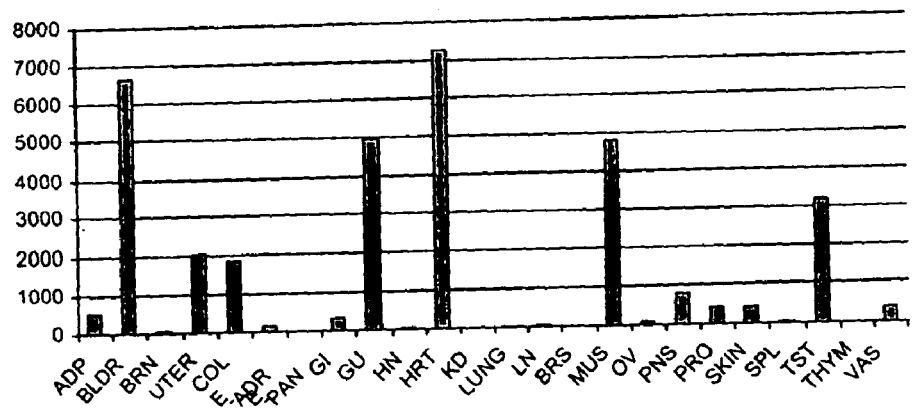
Figure 11 - Expression of ESTs in each category, as "parts per million"

Figure 12 - Expression of oligonucleotides in various tissues, prob 202222_s_at
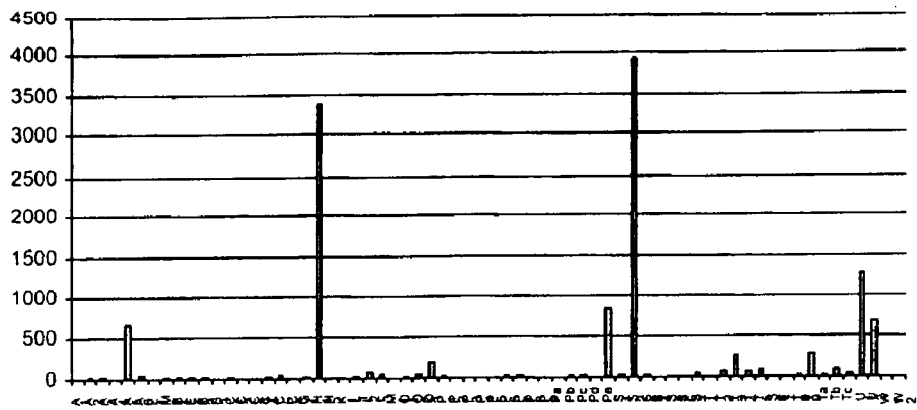
Figure 13 - Expression of oligonucleotides in various tissues, prob 214027_x_at
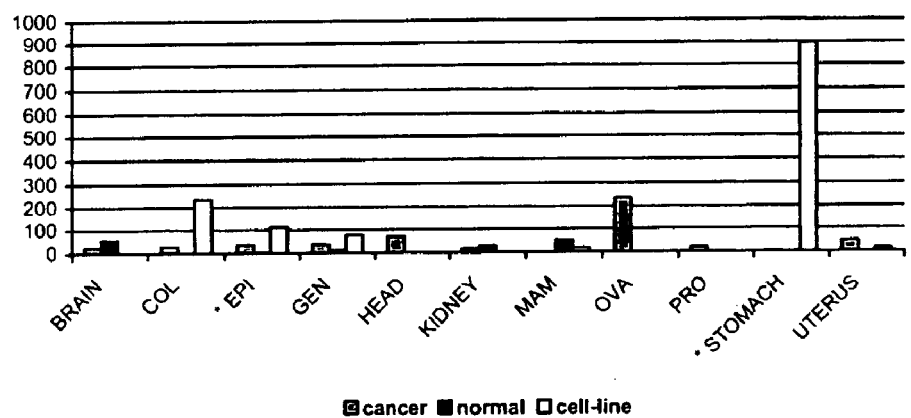
Figure 14 - Cancer and cell-line vs. normal tissue expression
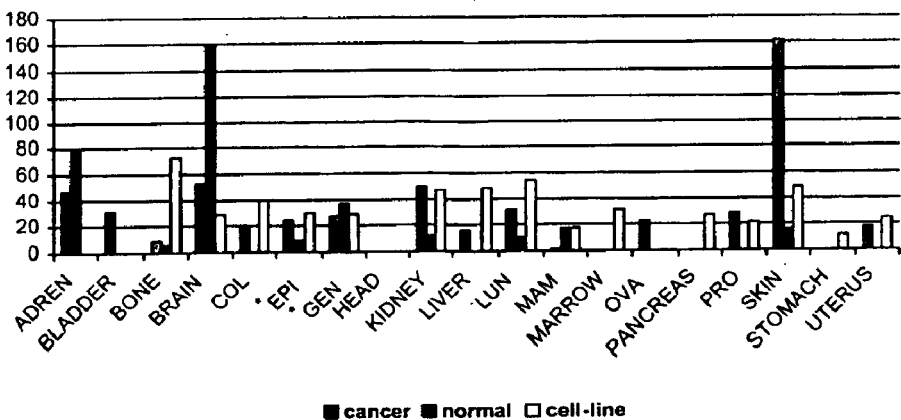

*Figure 15 - Cancer and cell-line vs. normal tissue expression*
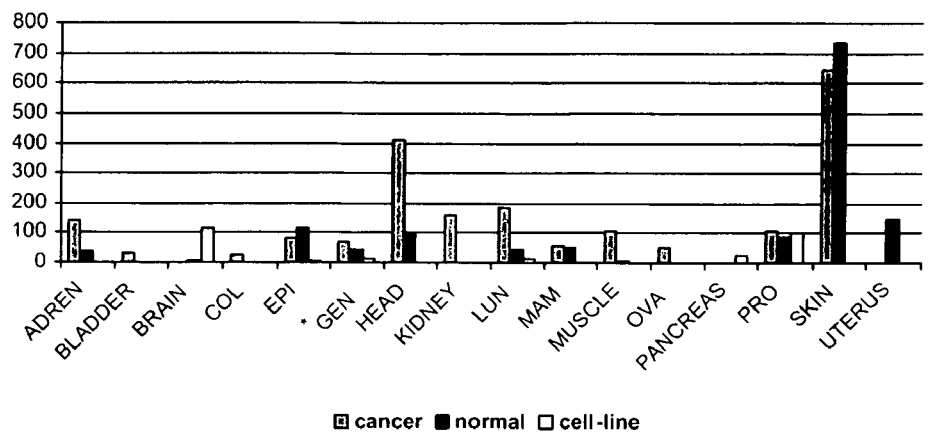
*Figure 16 - Cancer and cell-line vs. normal tissue expression*
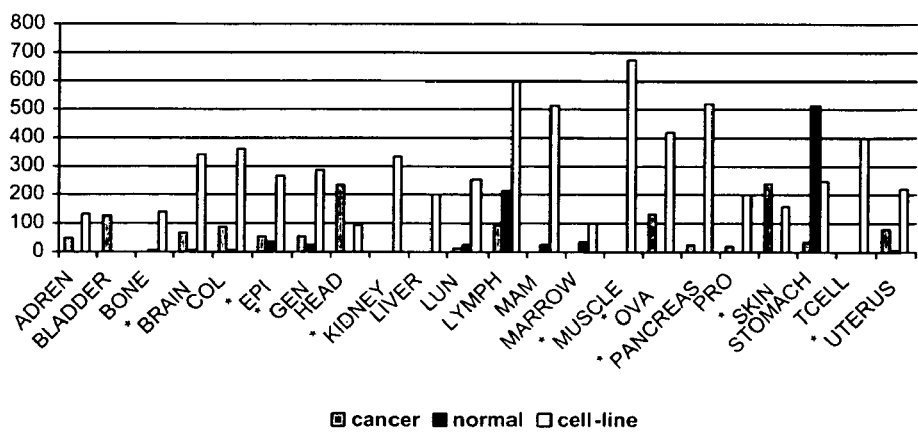

*Figure 17 - Cancer and cell-line vs. normal tissue expression*
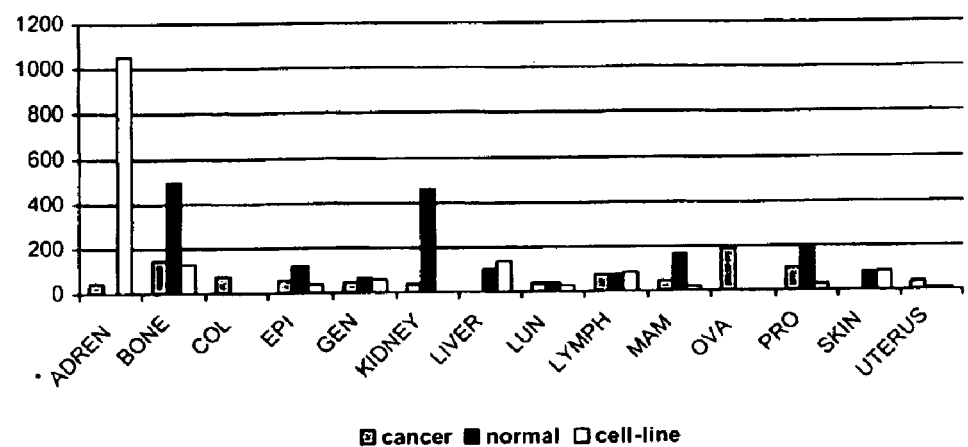
*Figure 18 - Cancer and cell-line vs. normal tissue expression*
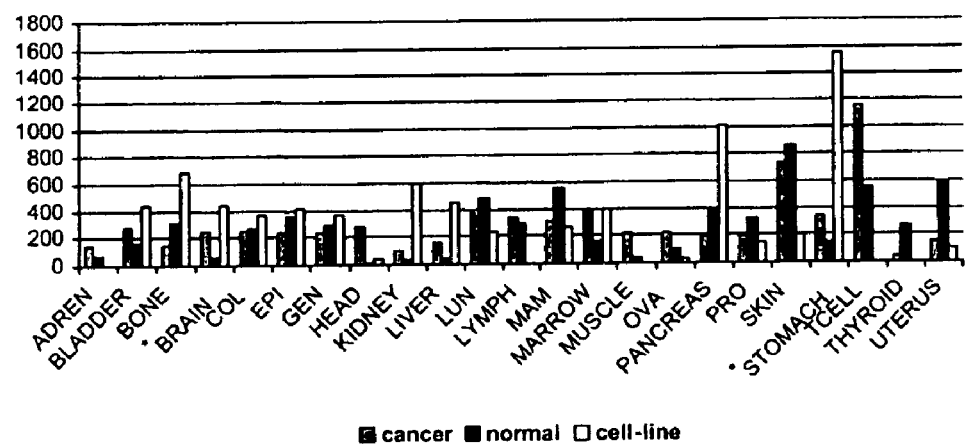

Figure 19 - Cancer and cell-line vs. normal tissue expression
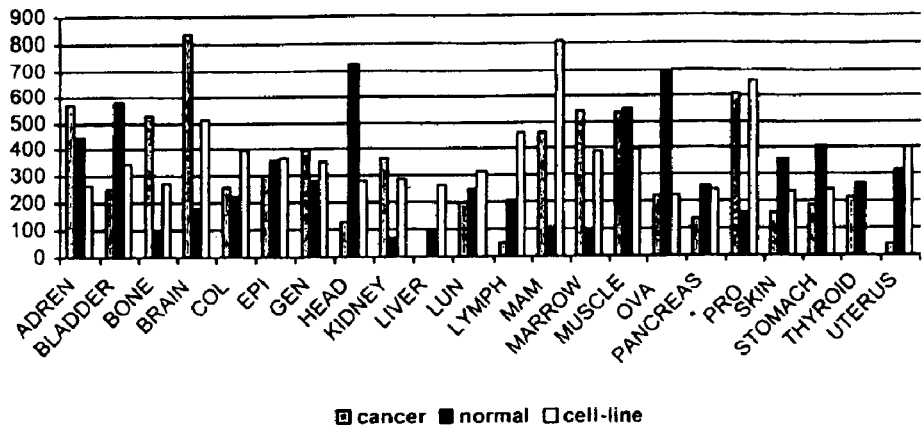
Figure 20 - Cancer and cell-line vs. normal tissue expression
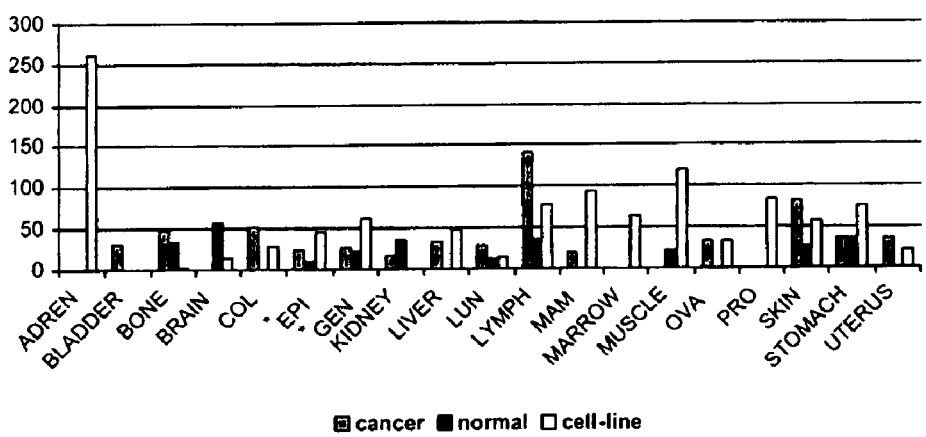
Figure 21 - Cancer and cell-line vs. normal tissue expression
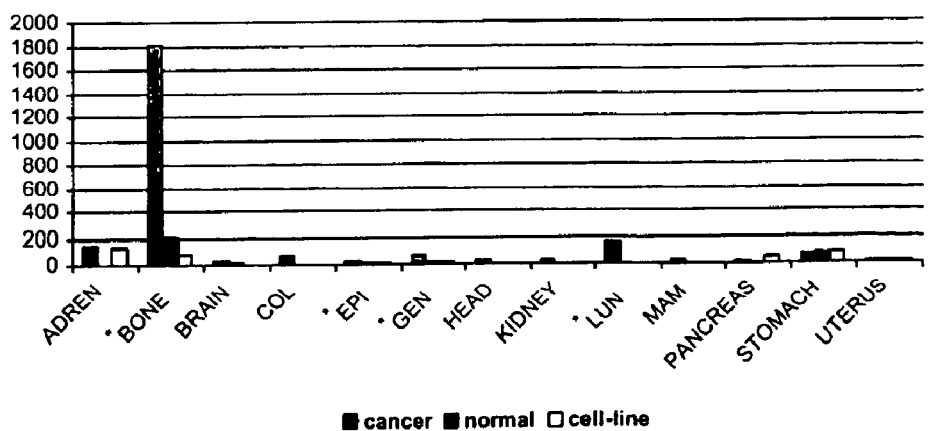

*Figure 22* Expression of Homo sapiens collagen, type XI, alpha 1 (COL11A1) HUMCA1X1A transcripts which are detectable by amplicon as depicted in sequence name HUMCA1X1A seg55 in normal and cancerous lung tissues
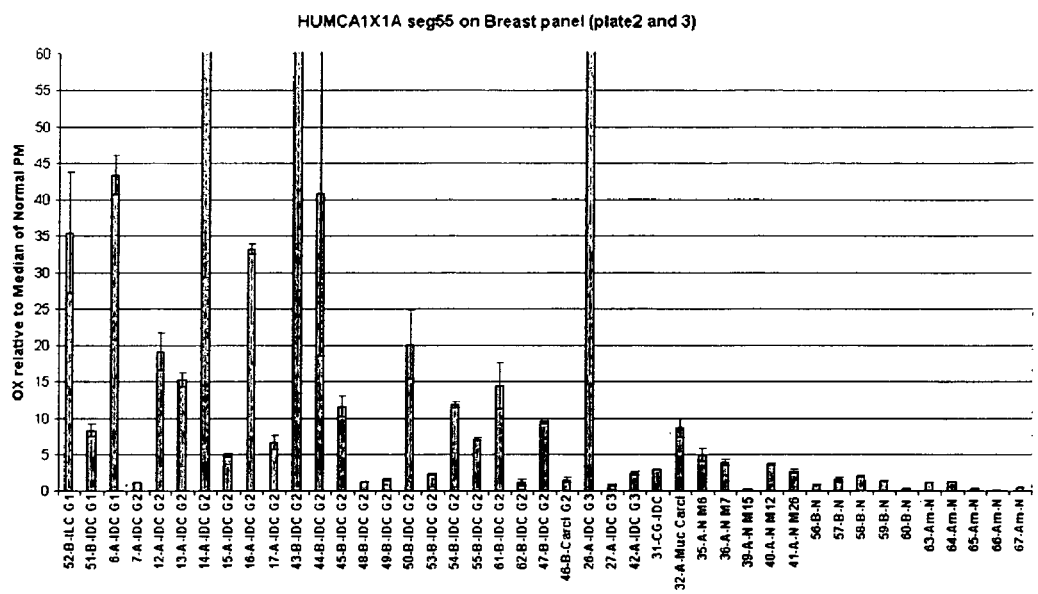

Figure 24 histogram showing over expression of the above-indicated Kinesin heavy chain isoform 5C transcripts in cancerous lung samples relative to the normal samples. Values represent the average of duplicate experiments. Error bars indicate the minimal and maximal values obtained
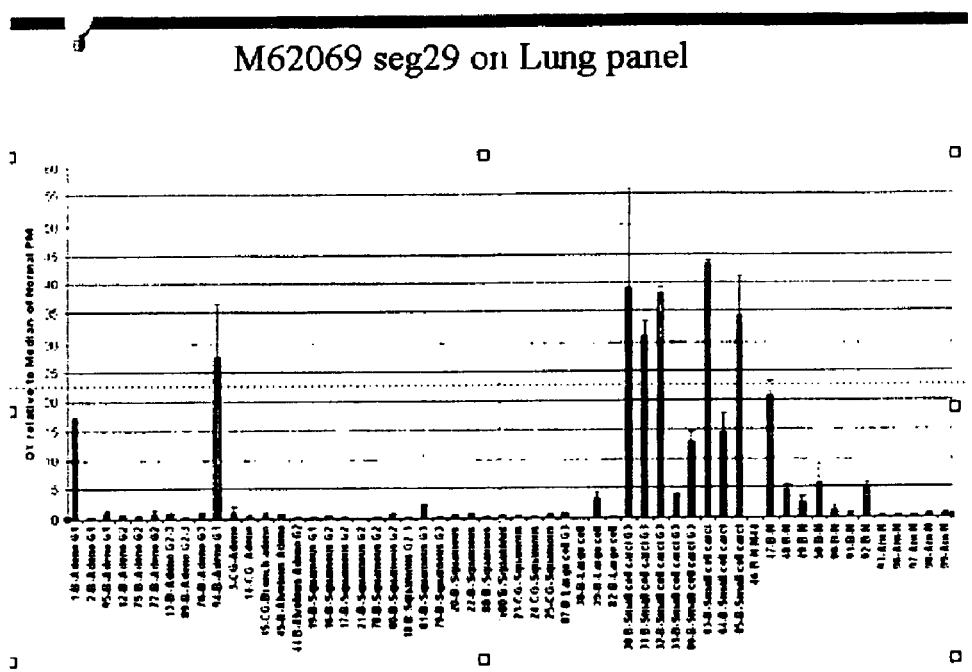
Figure 25 - Cancer and cell-line vs. normal tissue expression
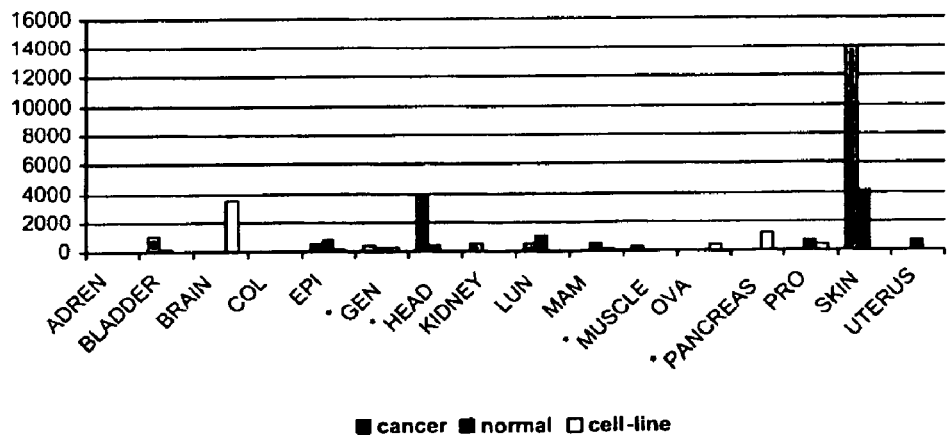

Figure 26 - Cancer and cell-line vs. normal tissue expression
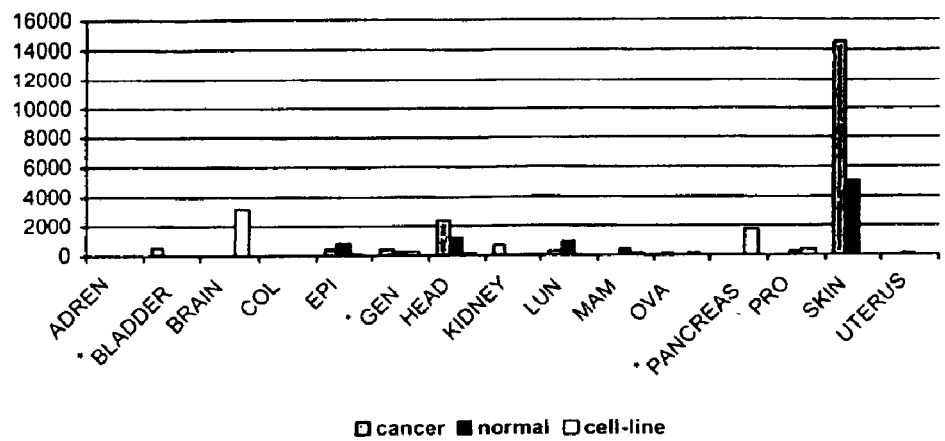
Figure 27 - Cancer and cell-line vs. normal tissue expression
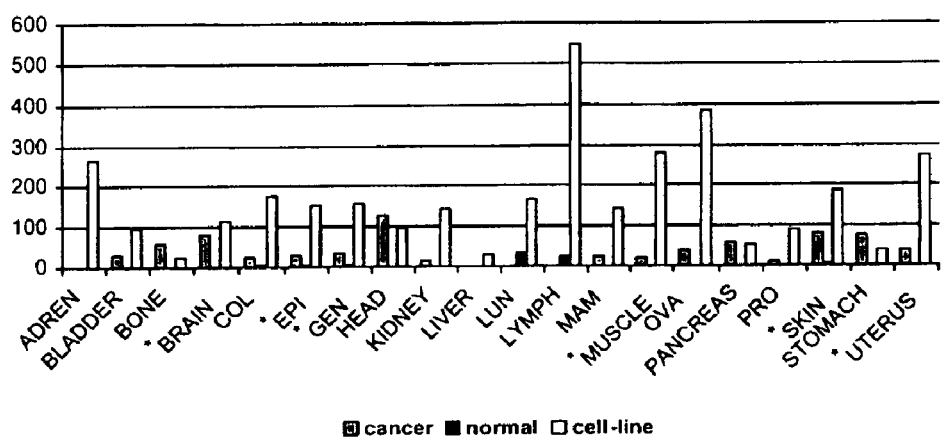
Figure 28 - Cancer and cell-line vs. normal tissue expression
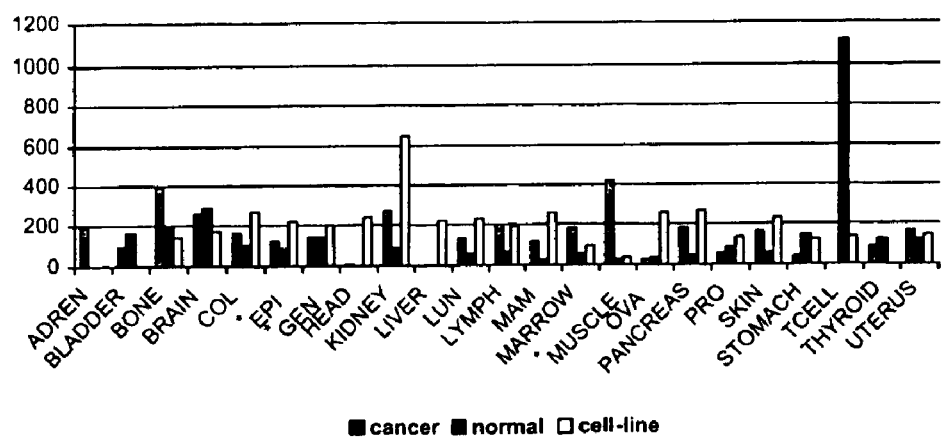

Figure 29 - Cancer and cell-line vs. normal tissue expression
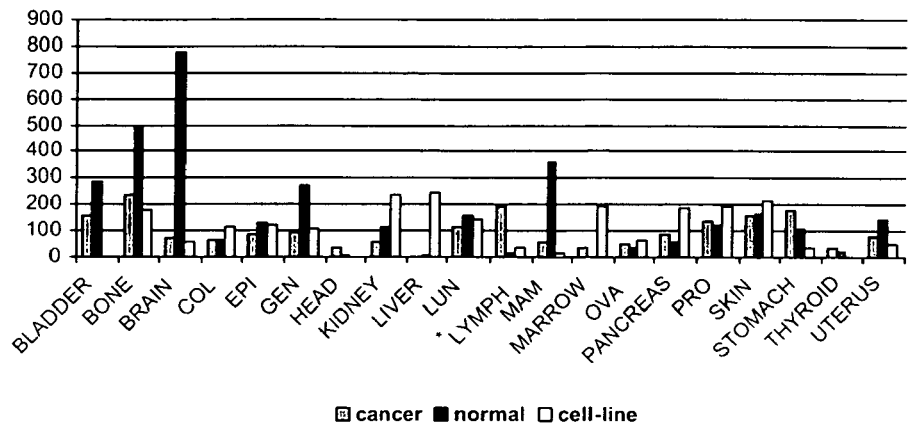
Figure 30 - Cancer and cell-line vs. normal tissue expression
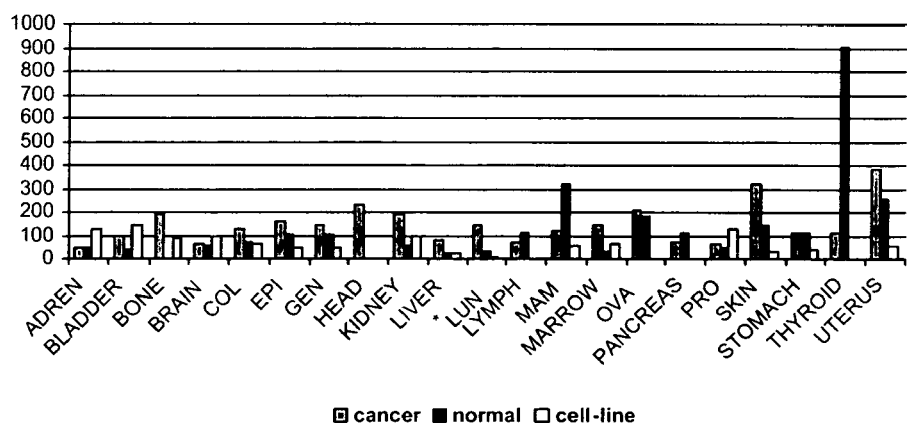
Figure- 31- Cancer and cell-line vs. normal tissue expression
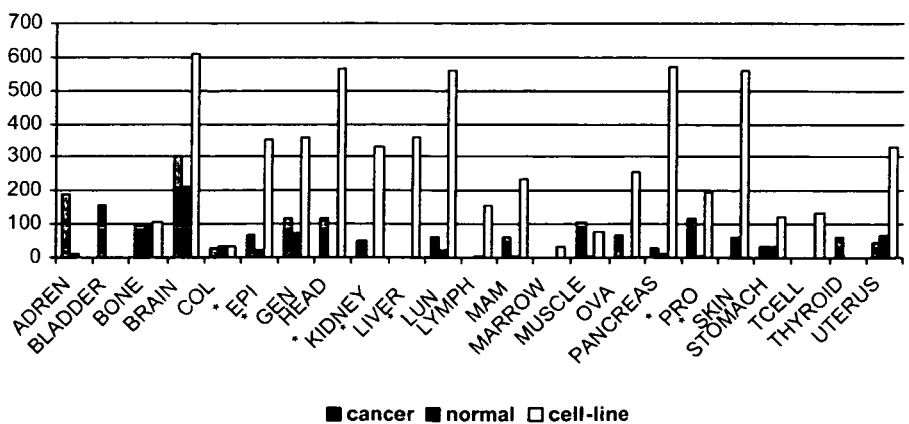

Figure 32 - Cancer and cell-line vs. normal tissue expression
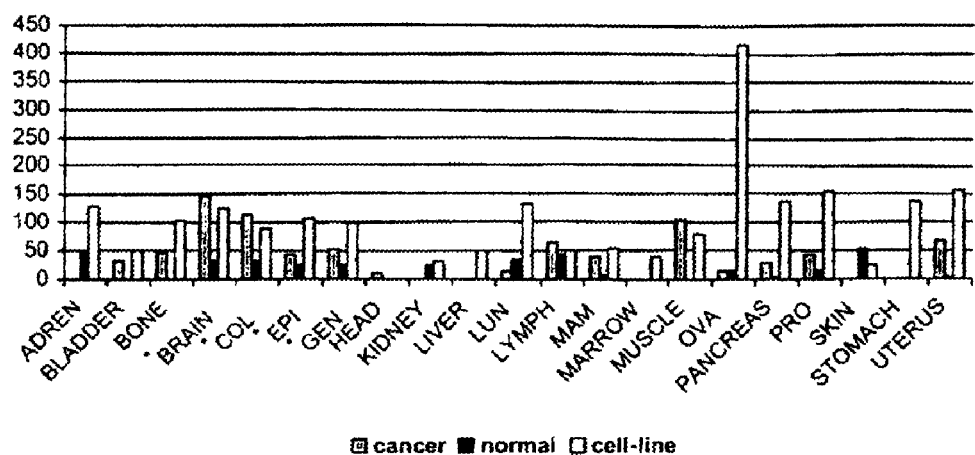
Figure 33 - Cancer and cell-line vs. normal tissue expression
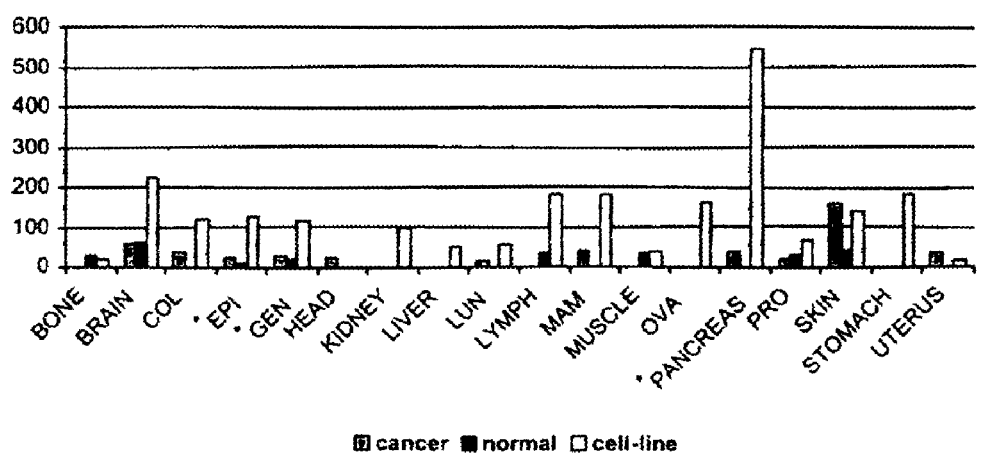

Figure 34 - Cancer and cell-line vs. normal tissue expression
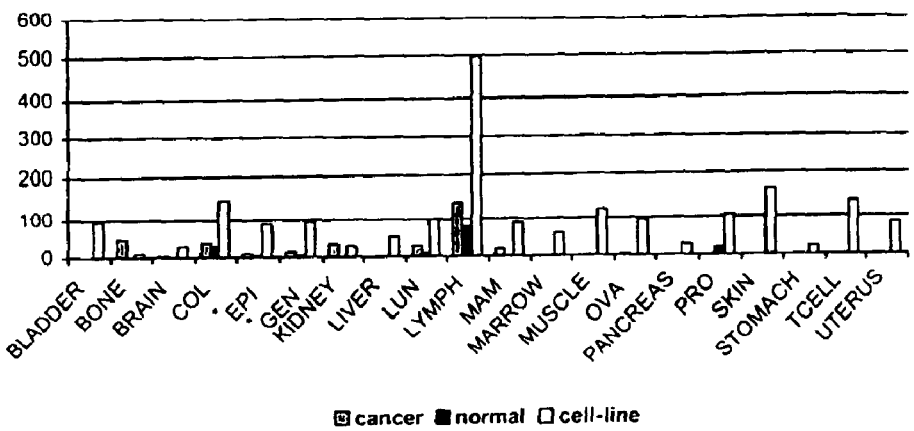
Figure 35 - Cancer and cell-line vs. normal tissue expression
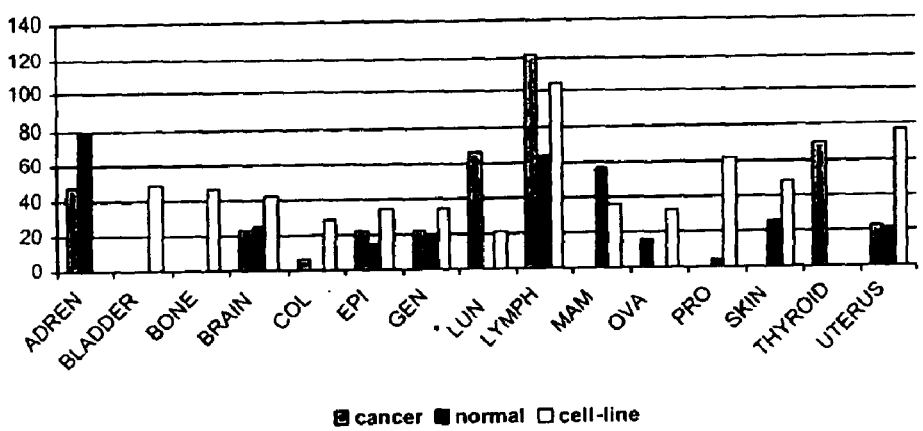
Figure 36 - Cancer and cell-line vs. normal tissue expression
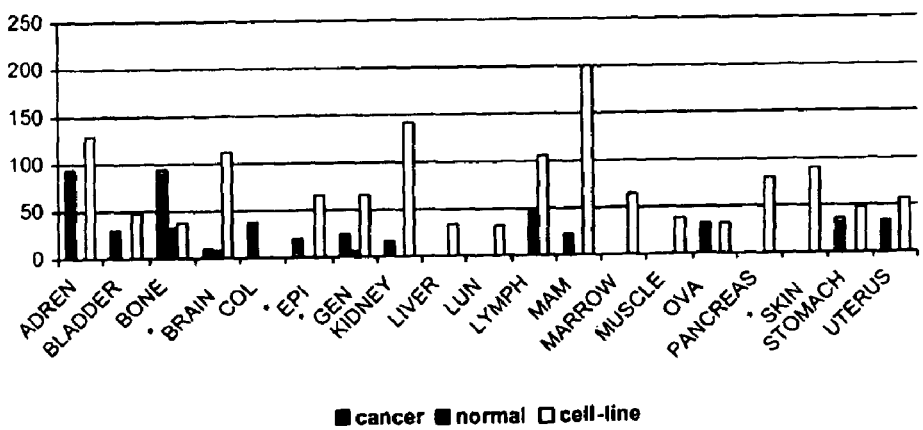

Figure 37 - Cancer and cell-line vs. normal tissue expression
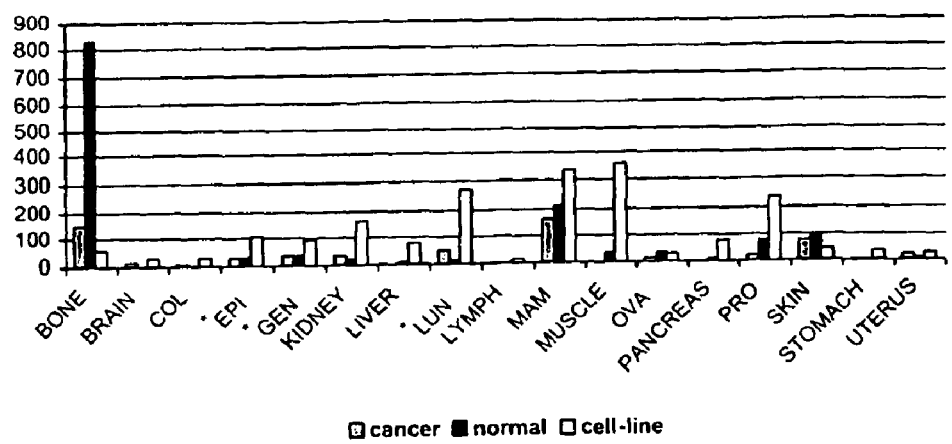
Figure 38 - Cancer and cell-line vs. normal tissue expression
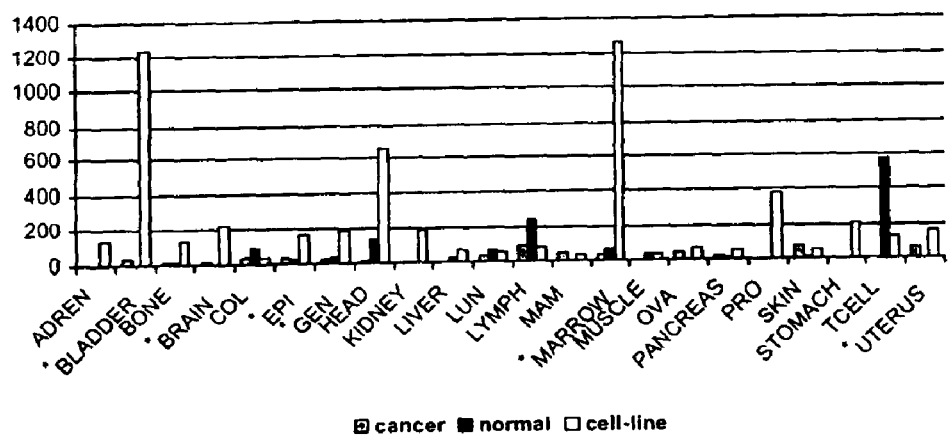

Figure 39 - Cancer and cell-line vs. normal tissue expression
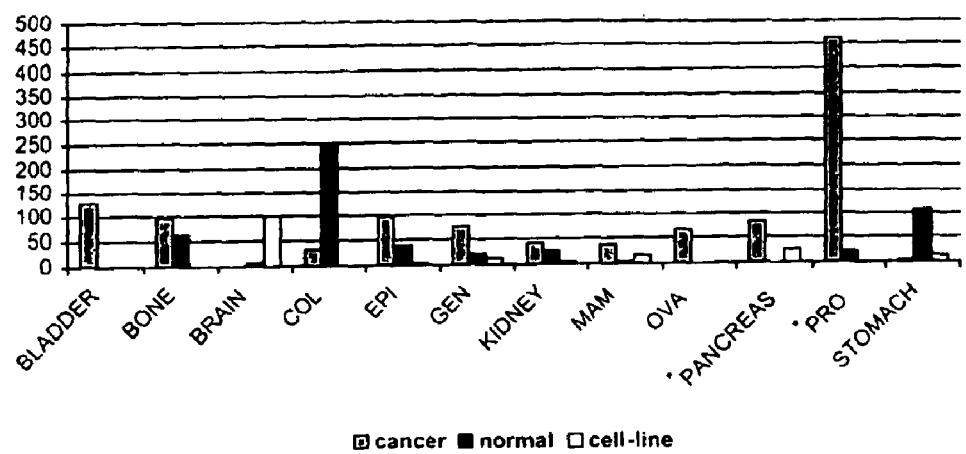
Figure 40 - Cancer and cell-line vs. normal tissue expression
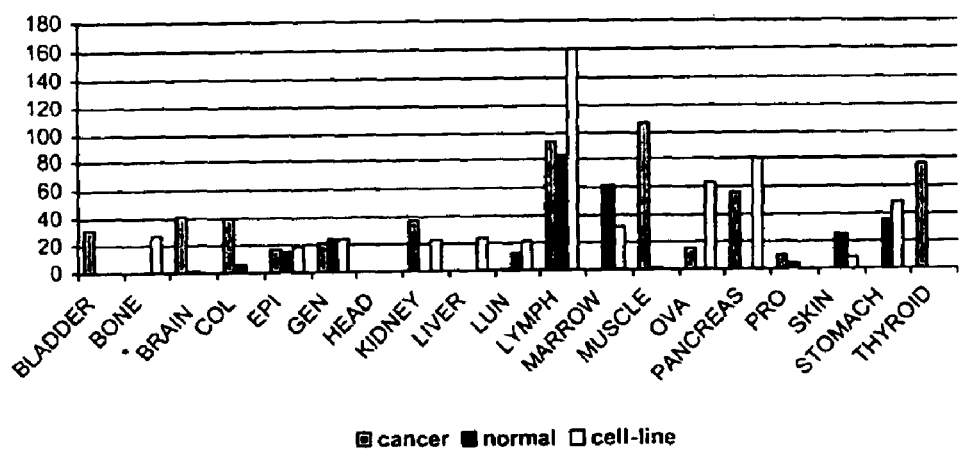

Figure 41 - Cancer and cell-line vs. normal tissue expression
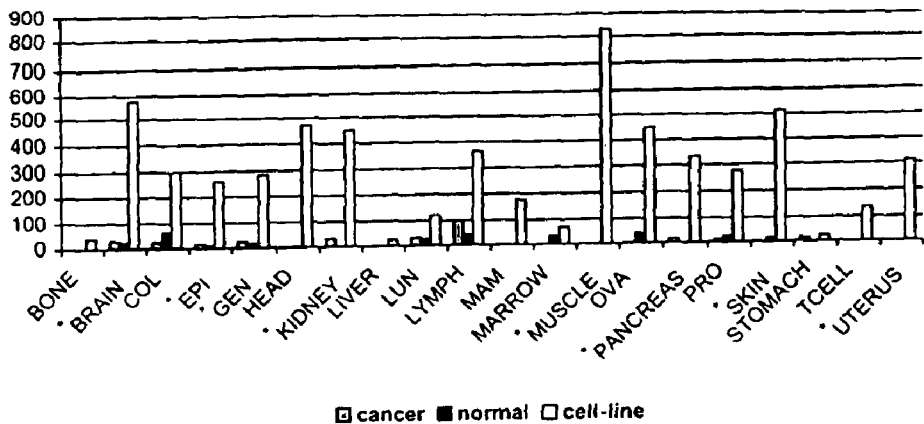
Figure 42 - Cancer and cell-line vs. normal tissue expression
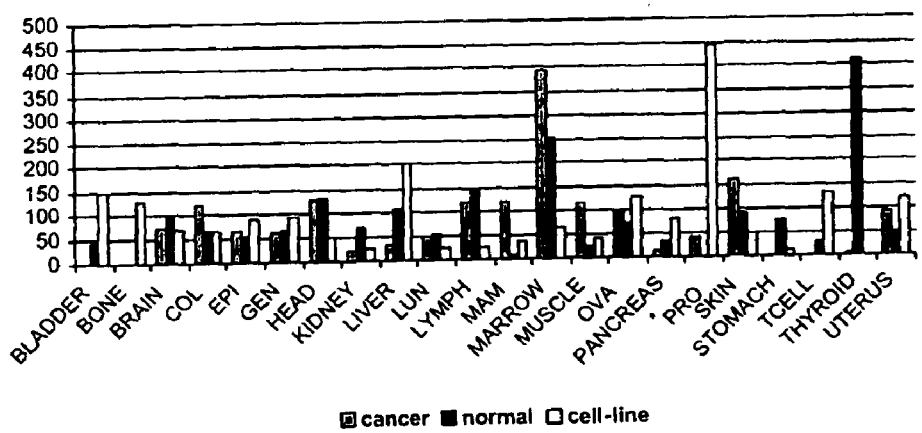
Figure 43 - Cancer and cell-line vs. normal tissue expression
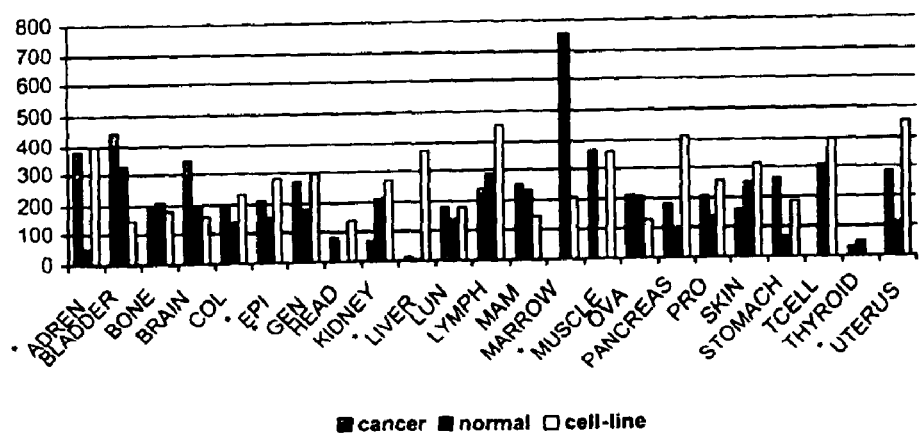

Figure 44 - Cancer and cell-line vs. normal tissue expression
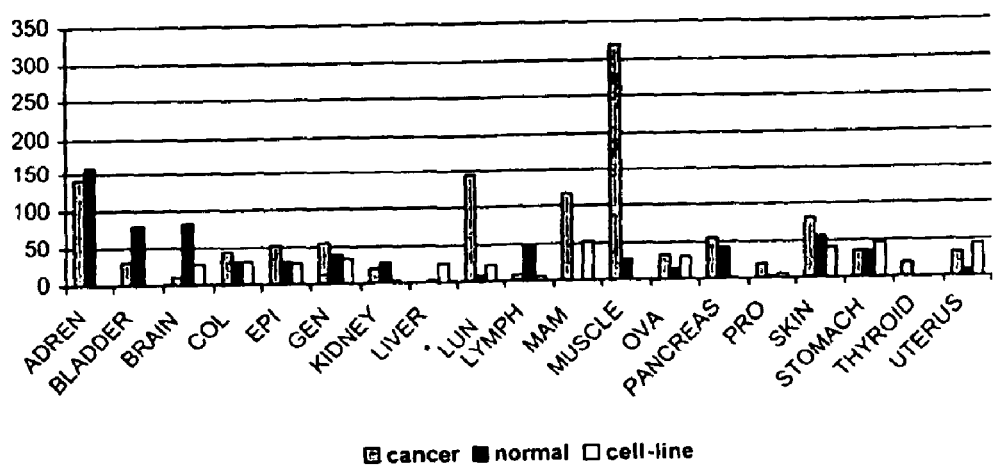
Figure 45 - Cancer and cell-line vs. normal tissue expression
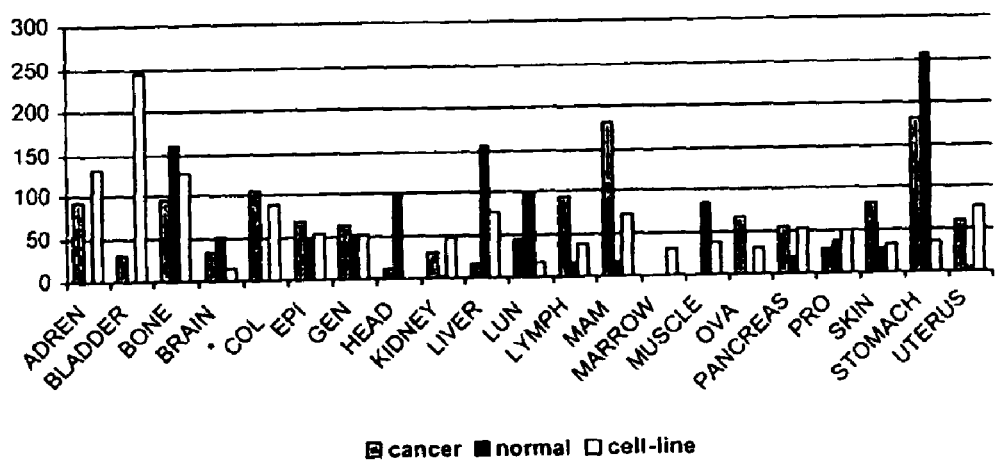

Figure 46 - Cancer and cell-line vs. normal tissue expression
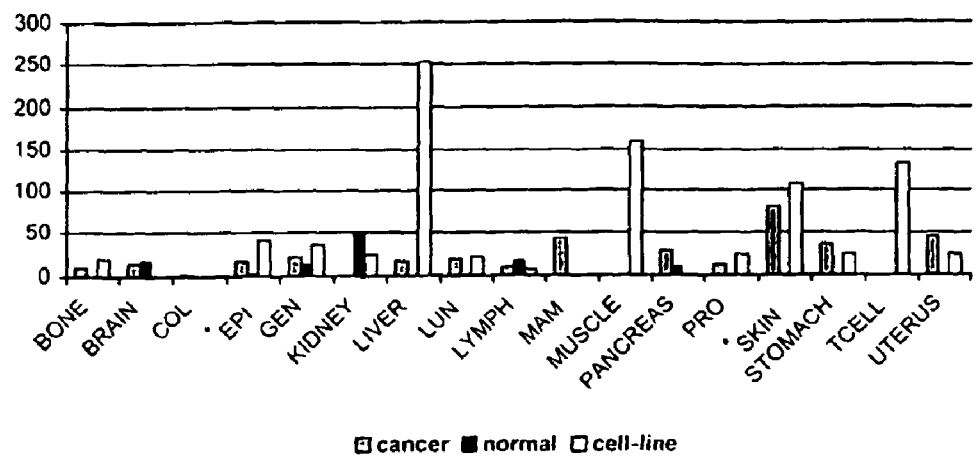
Figure 47 - Cancer and cell-line vs. normal tissue expression
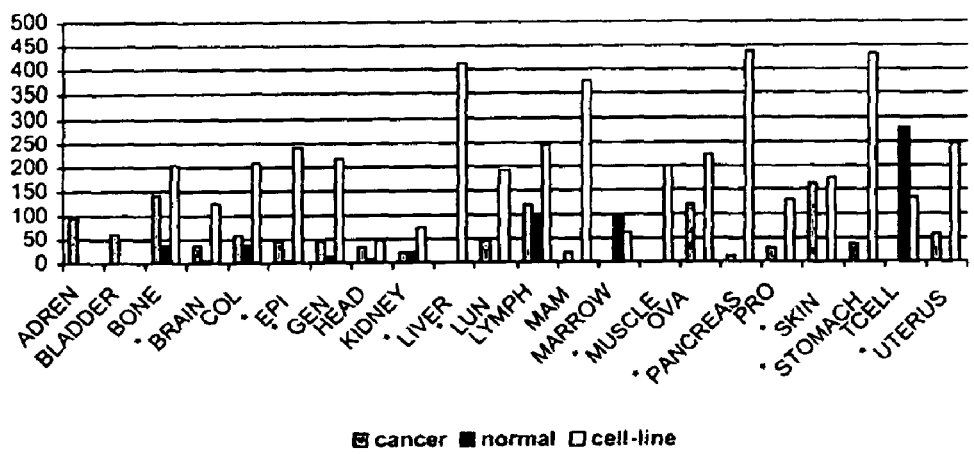

Figure 48 - Cancer and cell-line vs. normal tissue expression
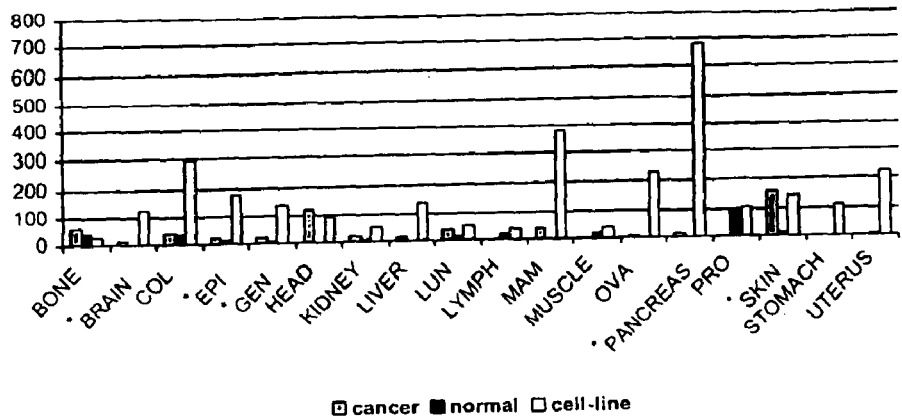
Figure 49 - Cancer and cell-line vs. normal tissue expression
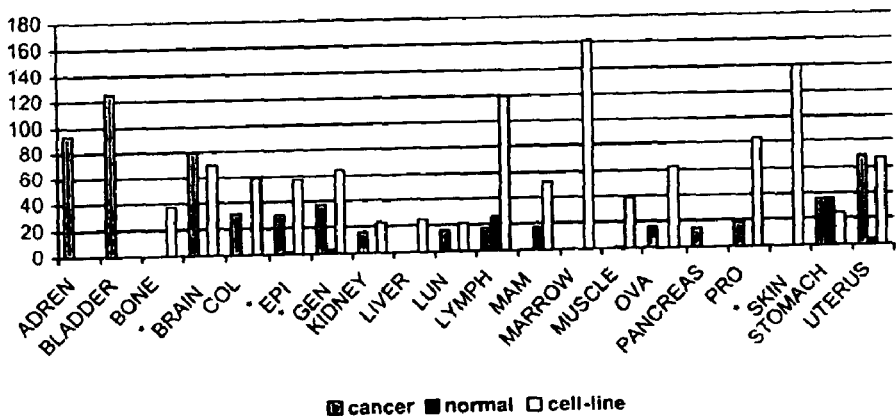
Figure 50 - Cancer and cell-line vs. normal tissue expression
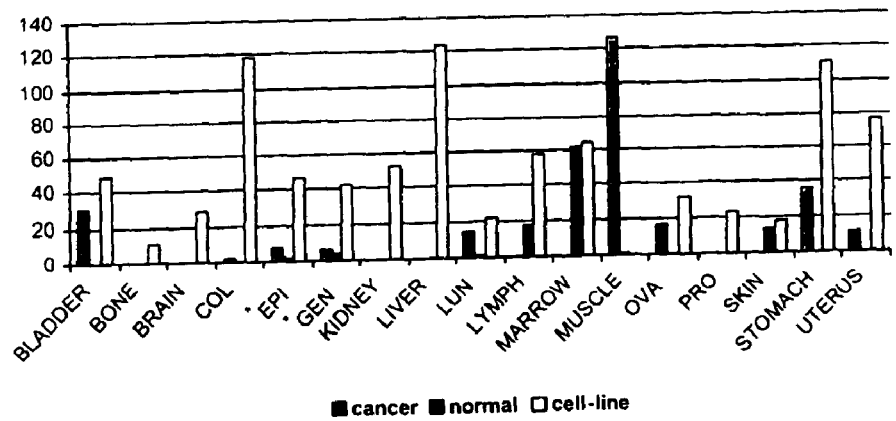

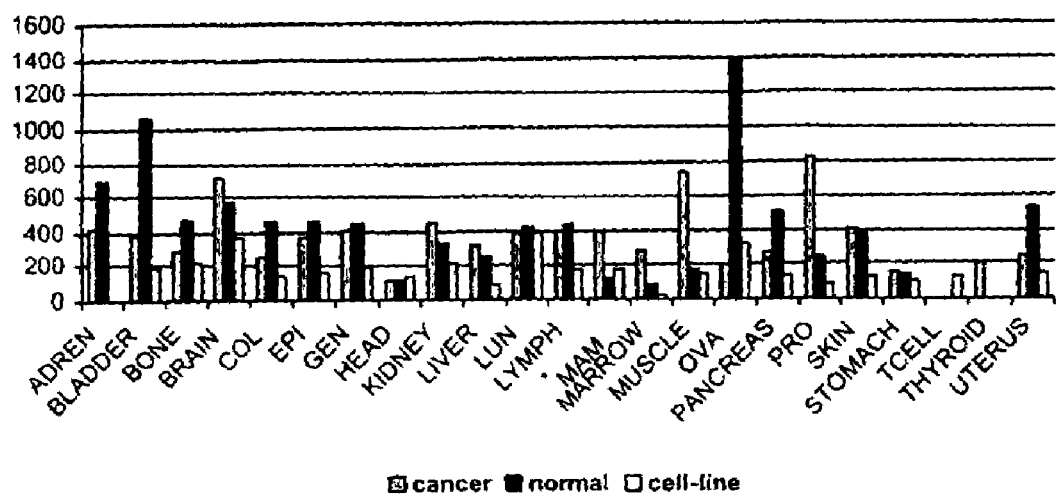
Figure 51 - Cancer and cell-line vs. normal tissue expression
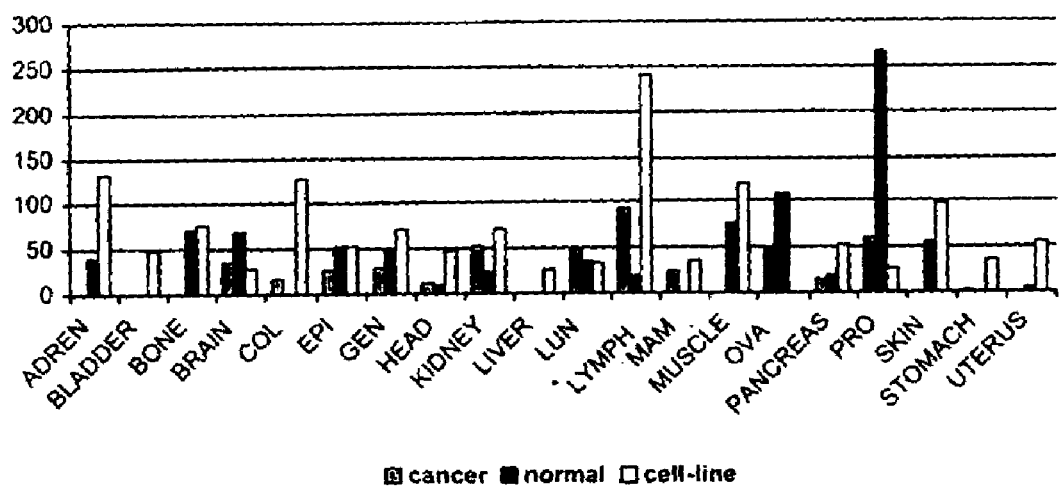
Figure 52 - Cancer and cell-line vs. normal tissue expression Figure 53 - Expression of ESTs in each category, as "parts per million"
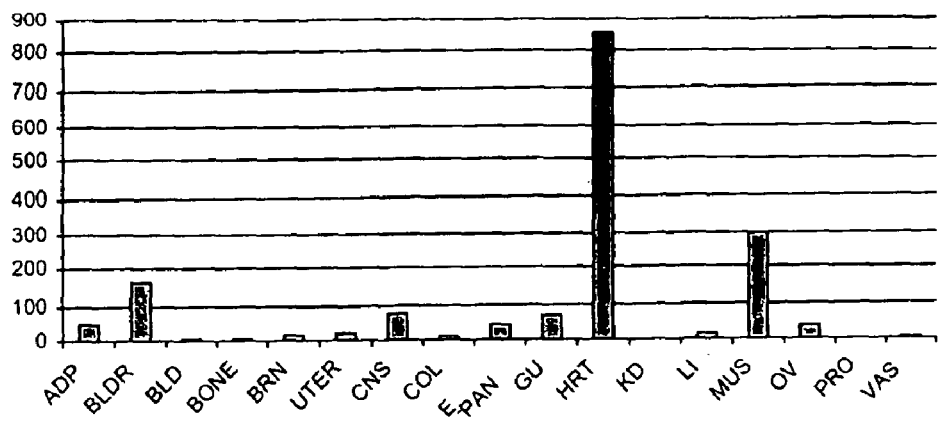
Figure 54 - Expression of oligonucleotides in various tissues, prob 205610_at
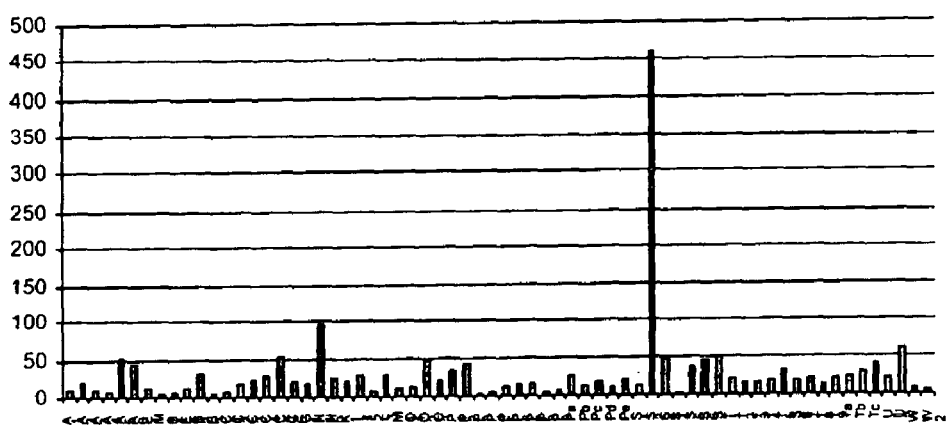
Figure 55 - Cancer and cell-line vs. normal tissue expression
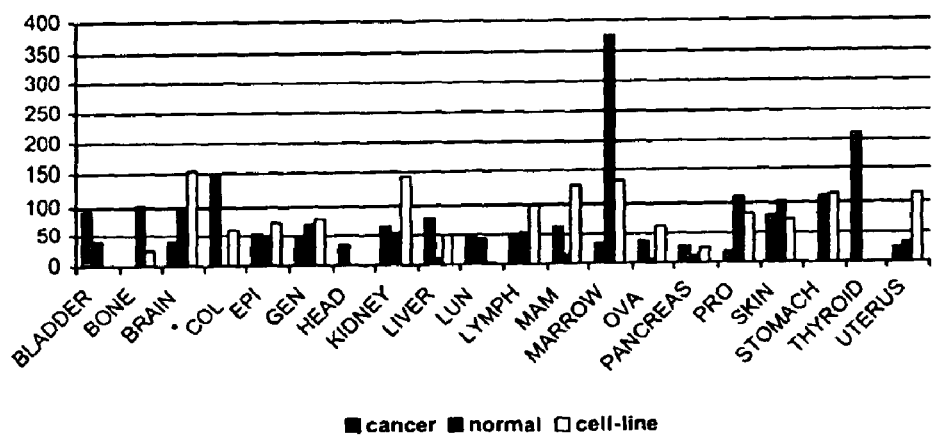

Figure 56 - Cancer and cell-line vs. normal tissue expression
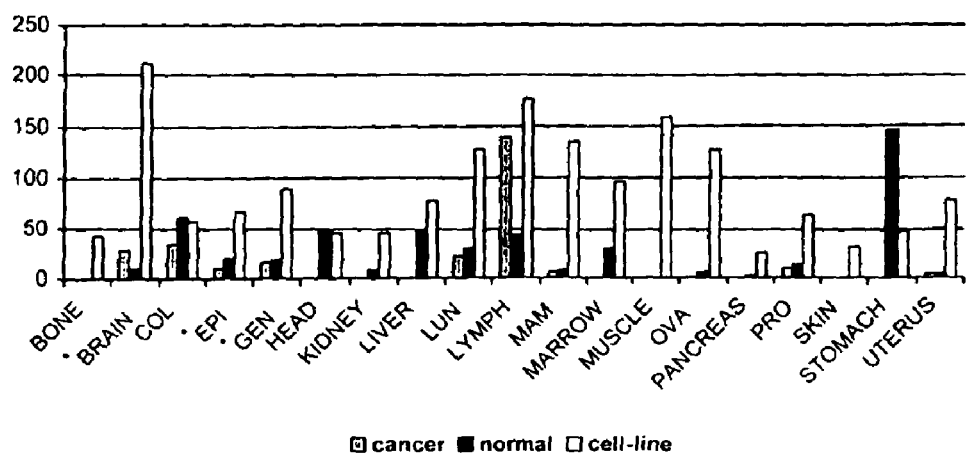
Figure 57 - Cancer and cell-line vs. normal tissue expression
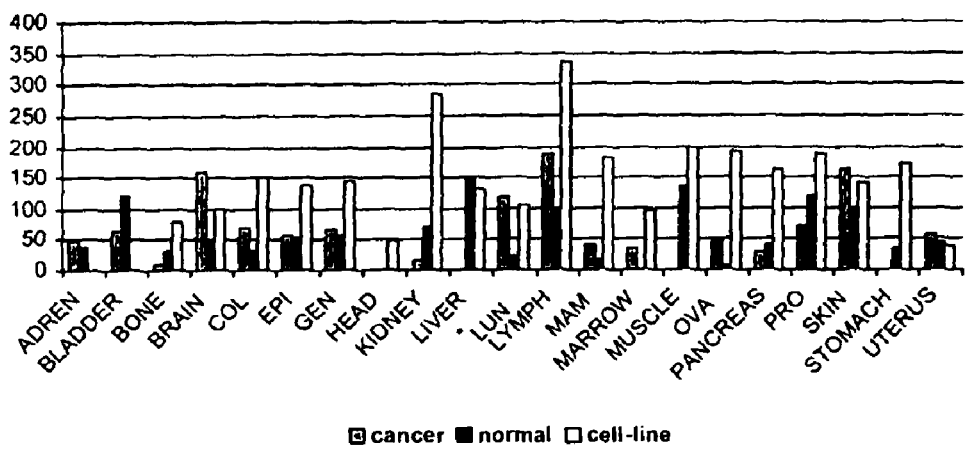

Figure 58 - Cancer and cell-line vs. normal tissue expression
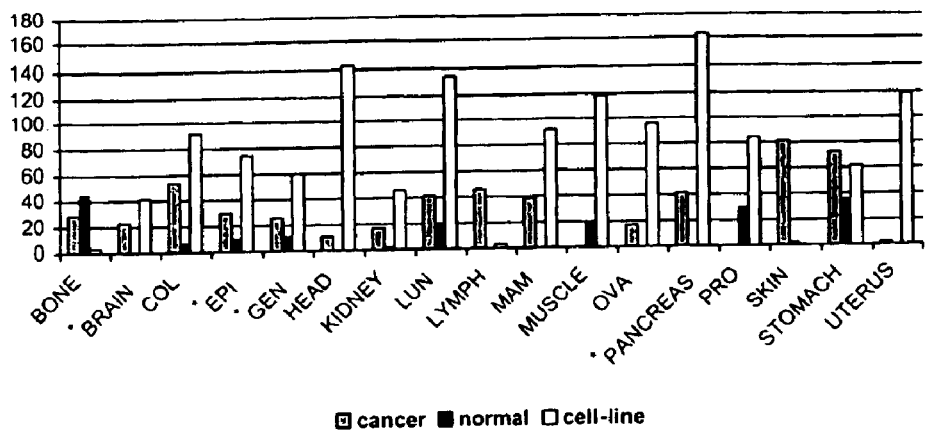
Figure 59 - Cancer and cell-line vs. normal tissue expression
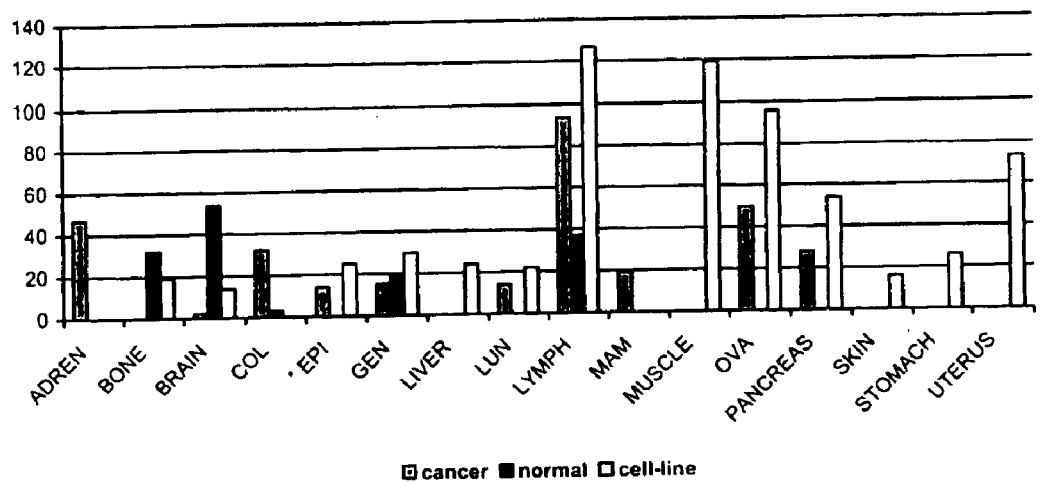
Figure 60 - Cancer and cell-line vs. normal tissue expression
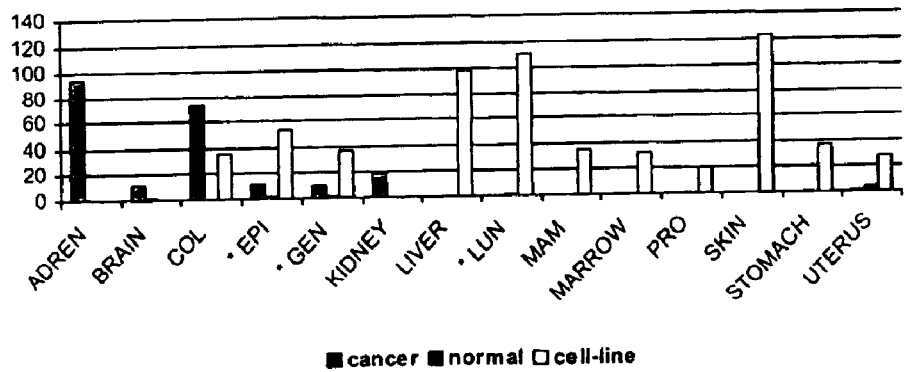

*Figure 61 - Cancer and cell-line vs. normal tissue expression*
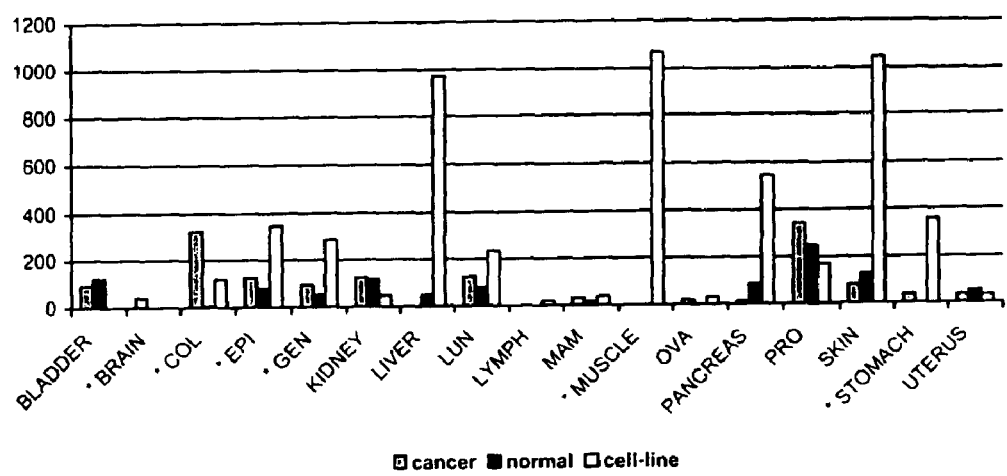
*Figure 62 - Cancer and cell-line vs. normal tissue expression*
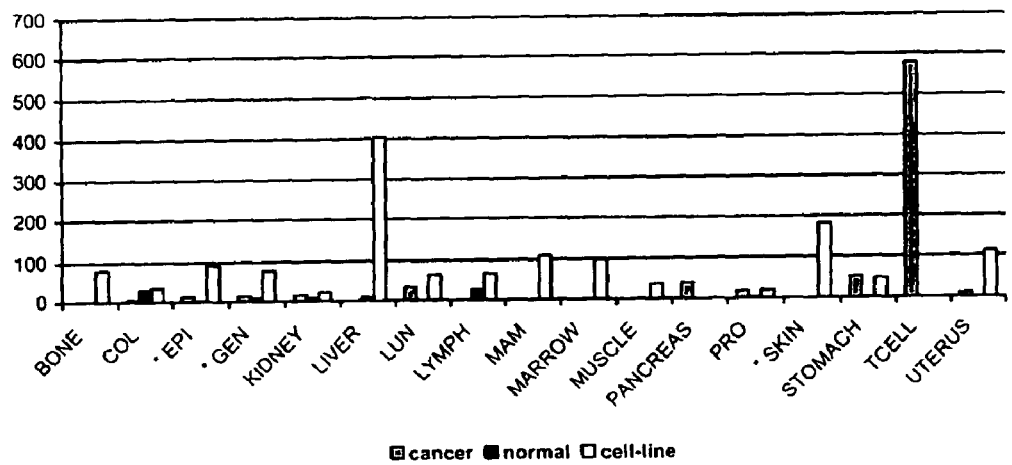

Figure 63 - Expression of ESTs in each category, as "parts per million"
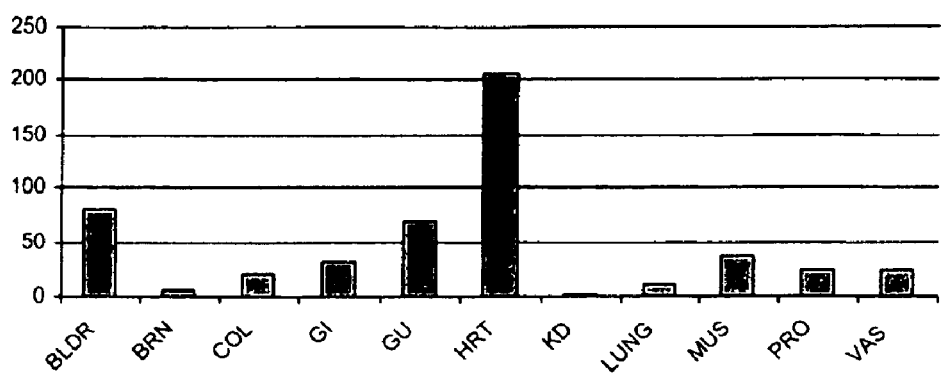
Figure 64 - Cancer and cell-line vs. normal tissue expression
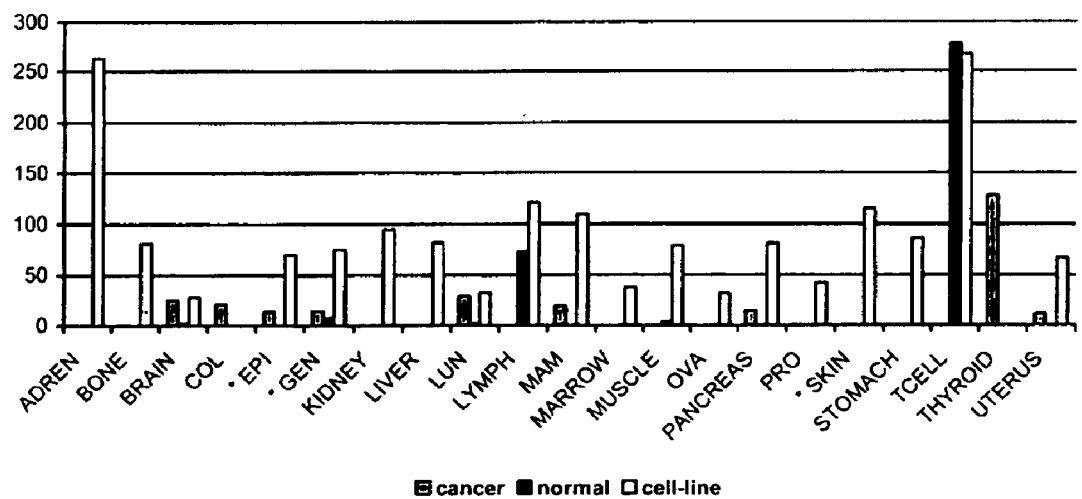

Figure 65 - Expression of ESTs in each category, as "parts per million"
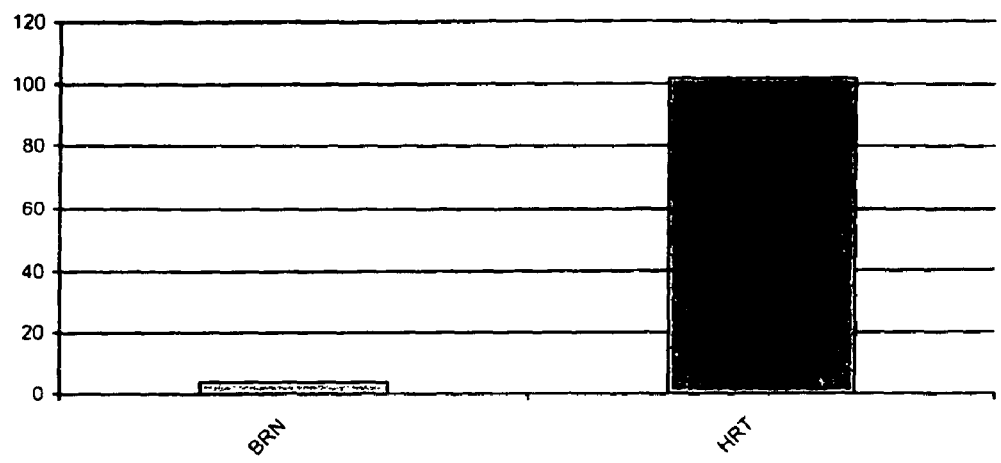
Figure 66 - Cancer and cell-line vs. normal tissue expression
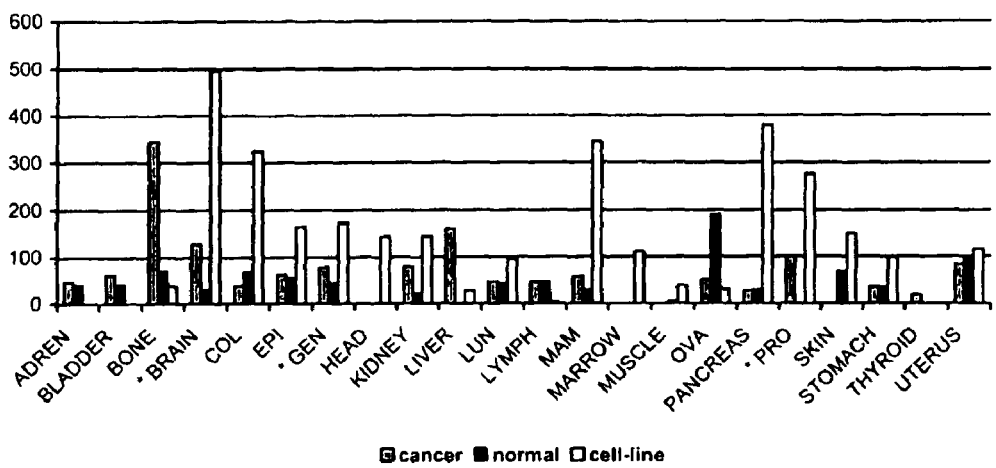

Figure 67 - Cancer and cell-line vs. normal tissue expression
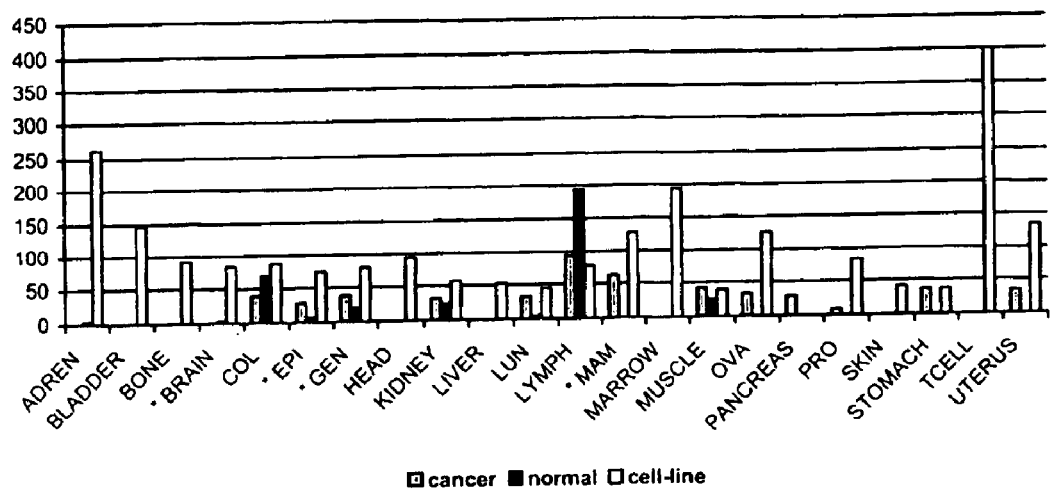
Figure 68 - Cancer and cell-line vs. normal tissue expression
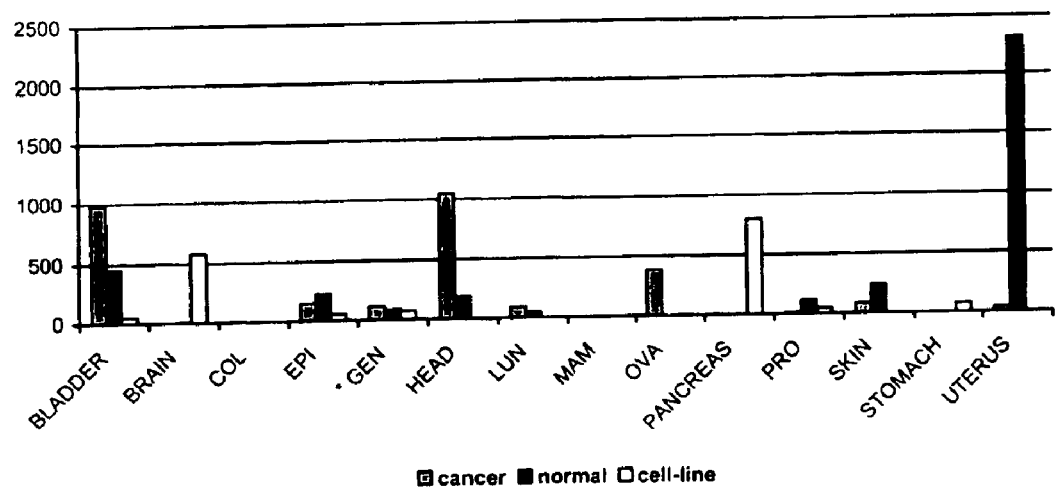

Figure 69 - Cancer and cell-line vs. normal tissue expression
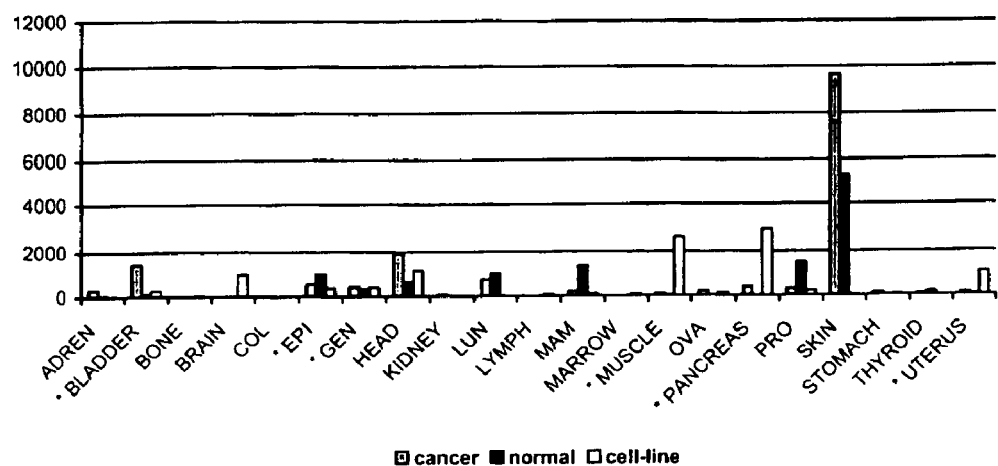
Figure 70 - Cancer and cell-line vs. normal tissue expression
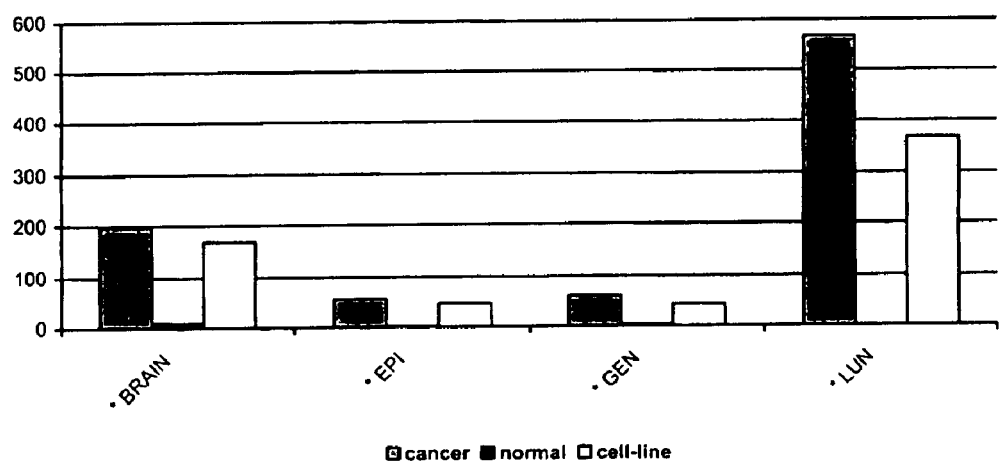

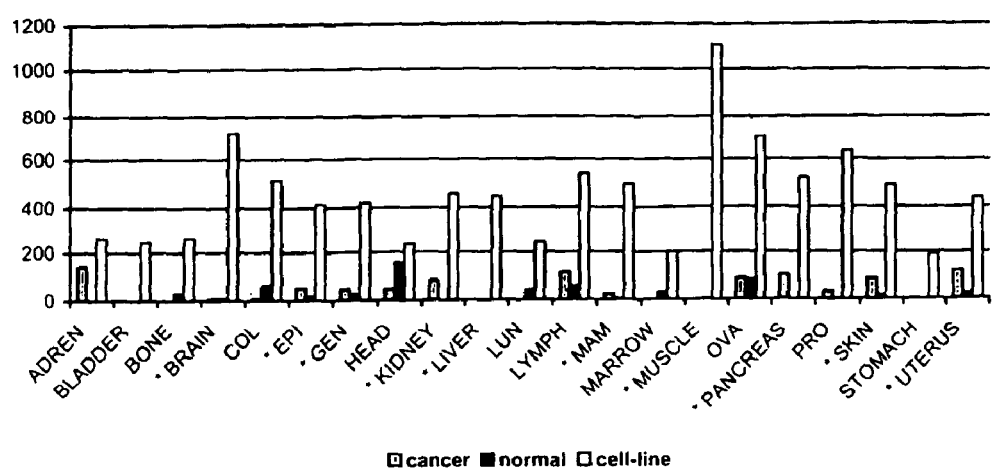
Figure 71 - Cancer and cell-line vs. normal tissue expression
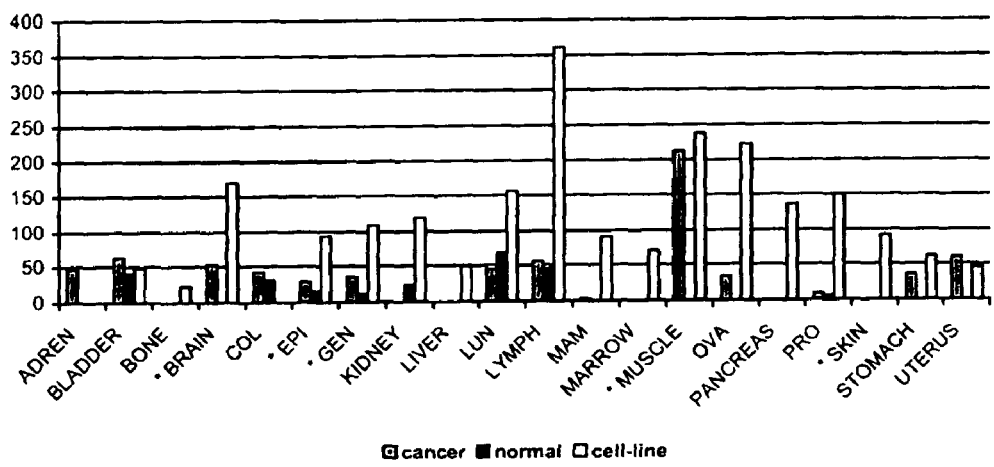
Figure 72 - Cancer and cell-line vs. normal tissue expression Figure 73 - Cancer and cell-line vs. normal tissue expression
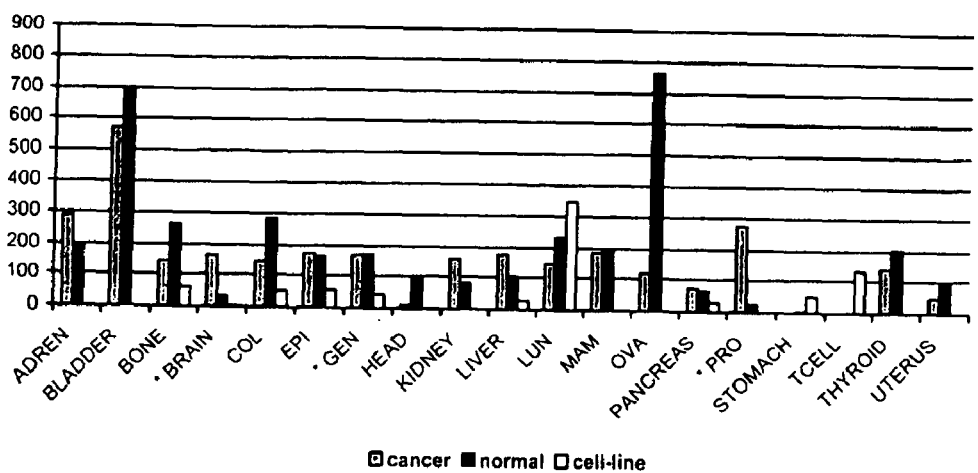
Figure 74 - Cancer and cell-line vs. normal tissue expression
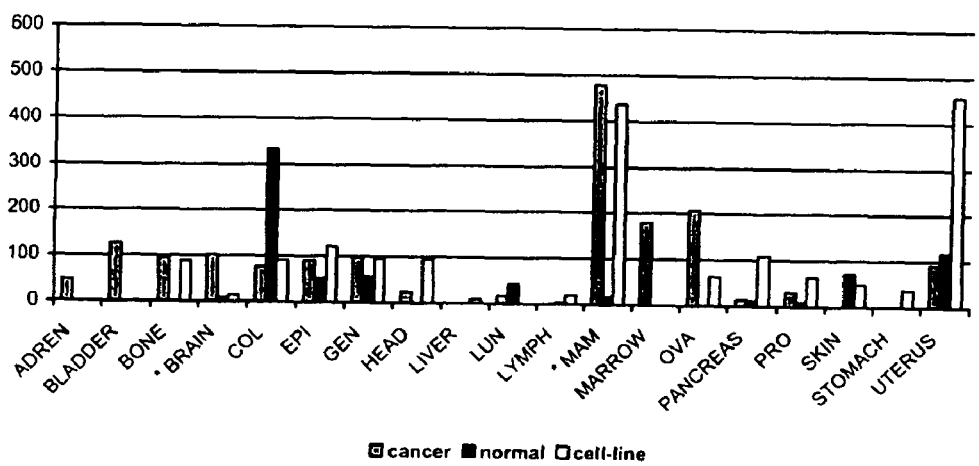

Figure 75 - Cancer and cell-line vs. normal tissue expression
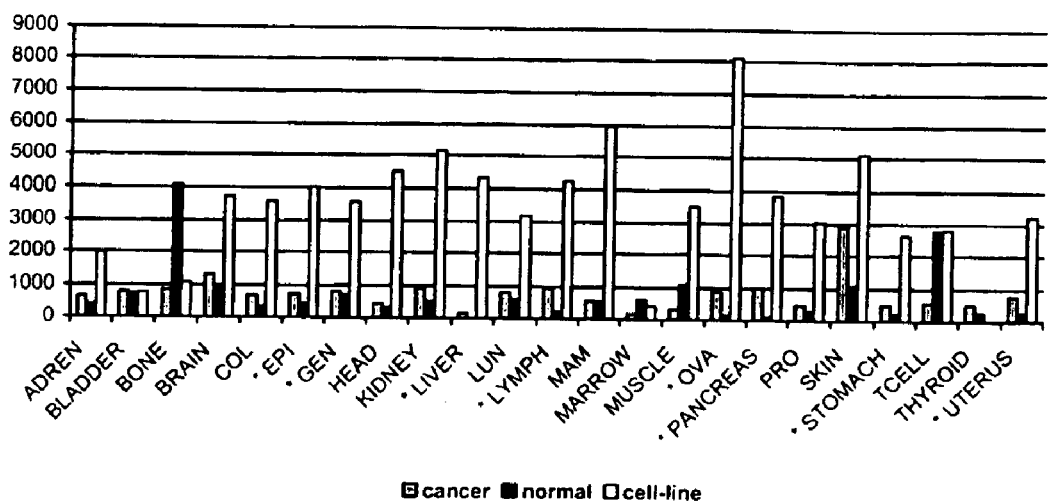
Figure 76 - Cancer and cell-line vs. normal tissue expression
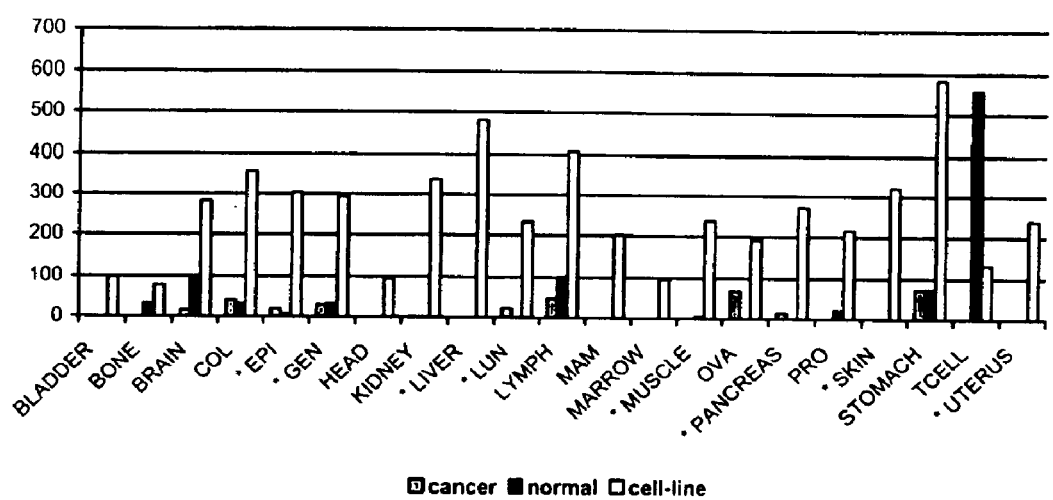

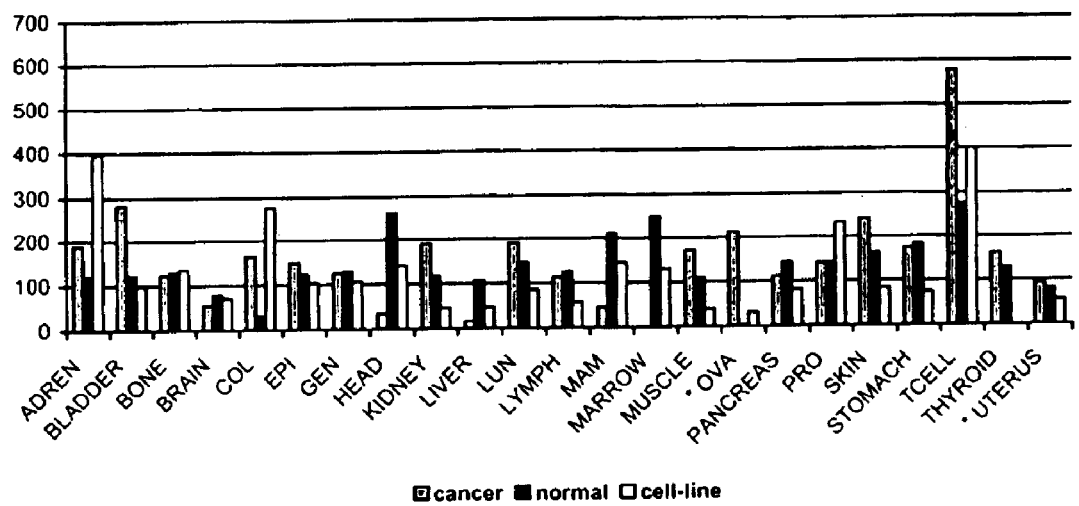
Figure 77 - Cancer and cell-line vs. normal tissue expression
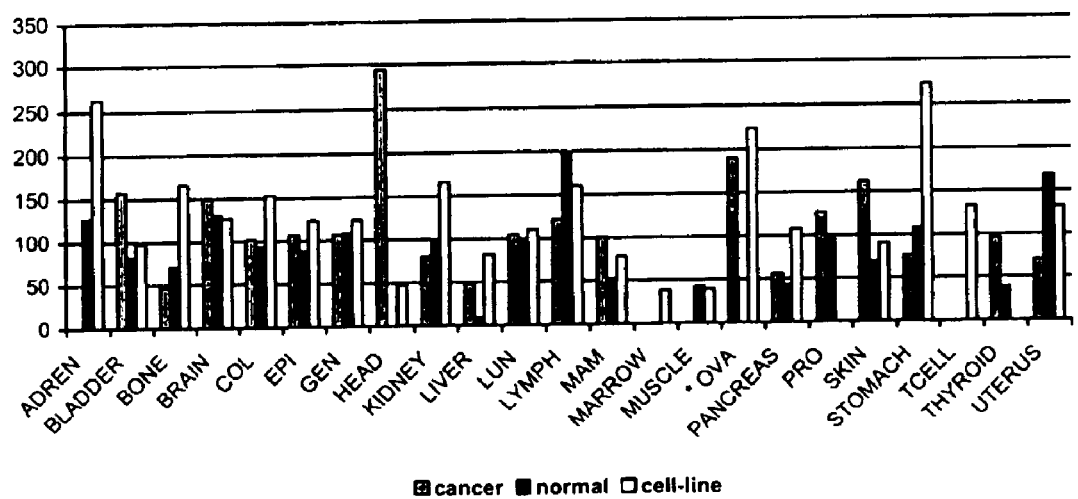
Figure 78 - Cancer and cell-line vs. normal tissue expression

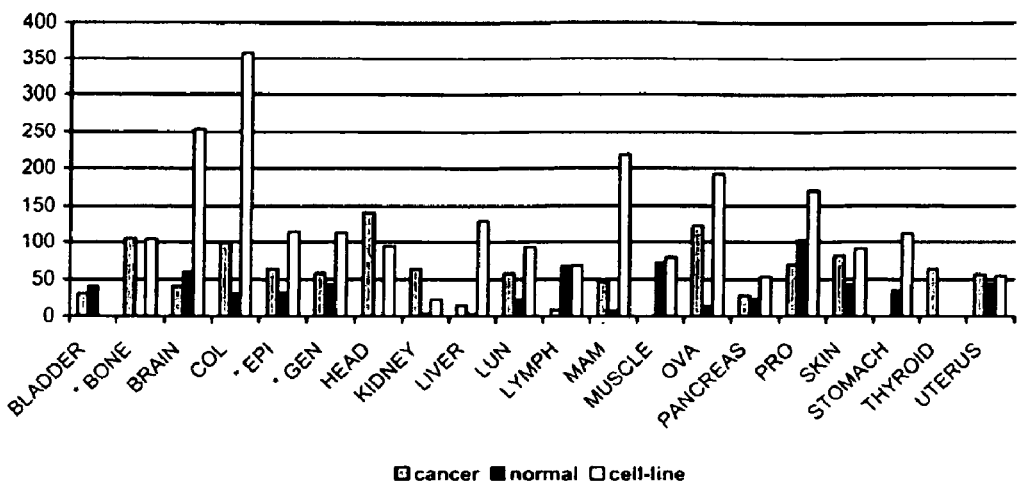
Figure 79 - Cancer and cell-line vs. normal tissue expression
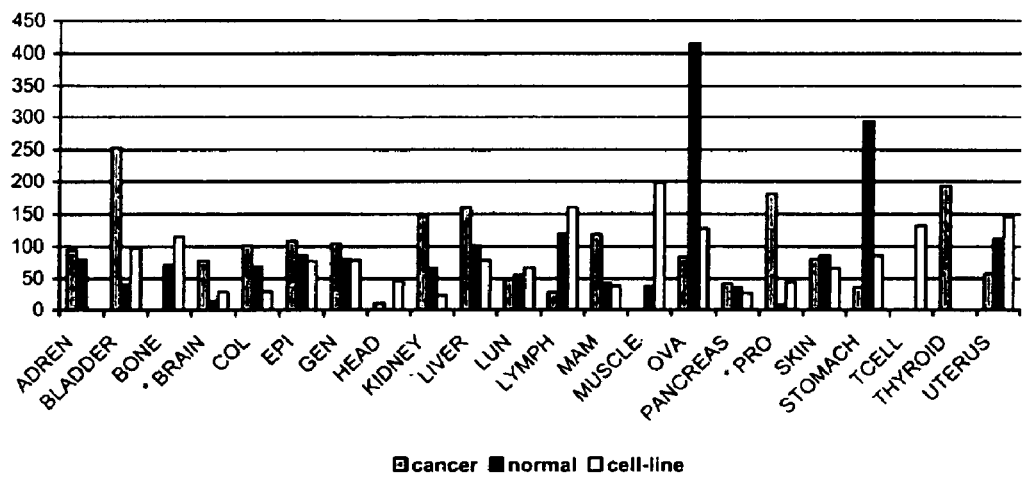
Figure 80 - Cancer and cell-line vs. normal tissue expression

*Figure 81 - Cancer and cell-line vs. normal tissue expression*
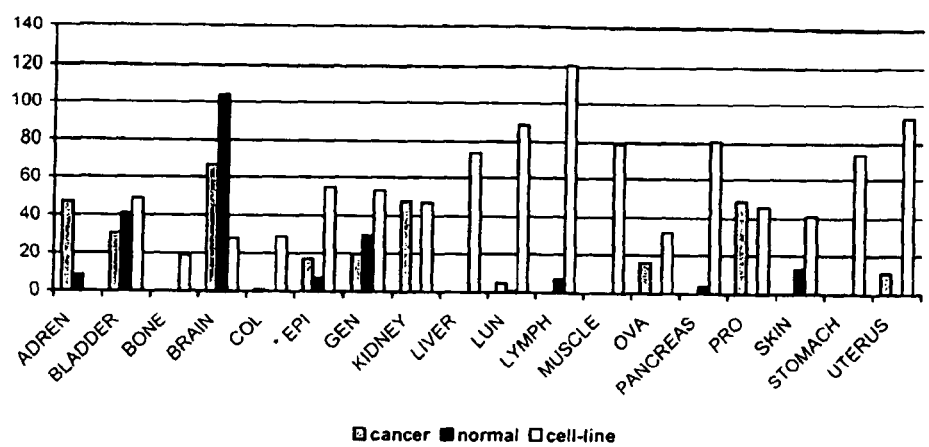
*Figure 82 - Cancer and cell-line vs. normal tissue expression*
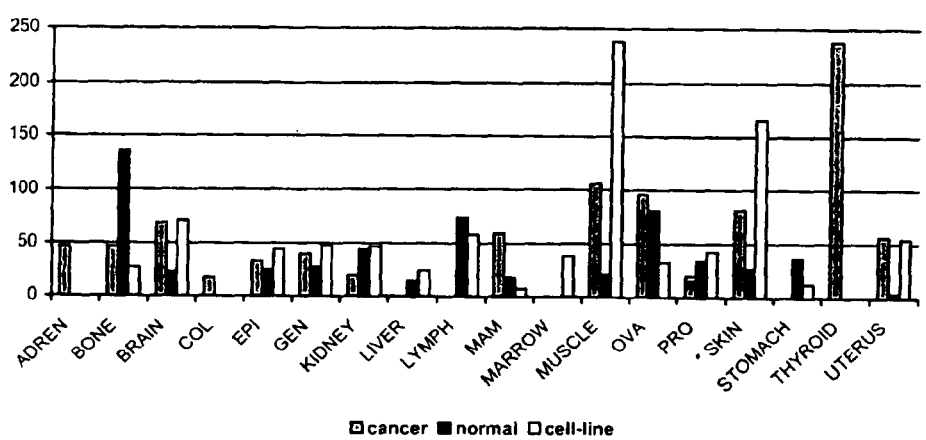

Figure 83 - Cancer and cell-line vs. normal tissue expression
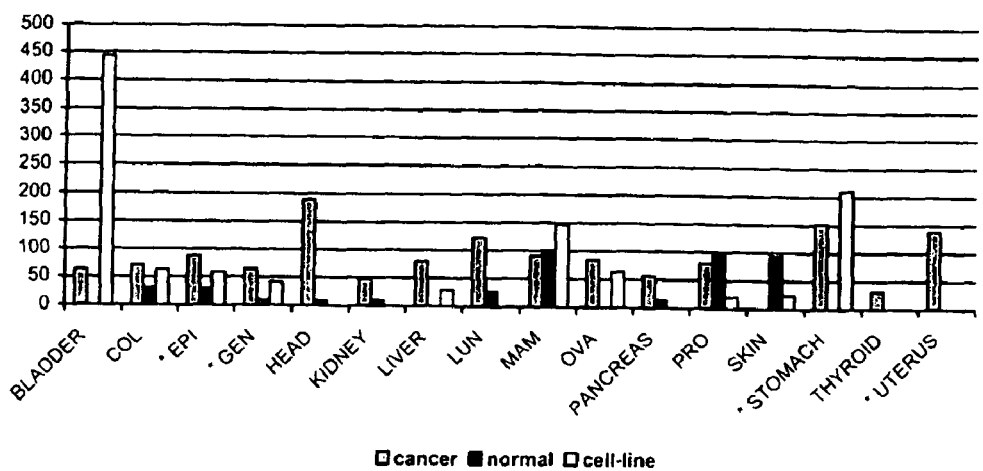
Figure 84 - Cancer and cell-line vs. normal tissue expression
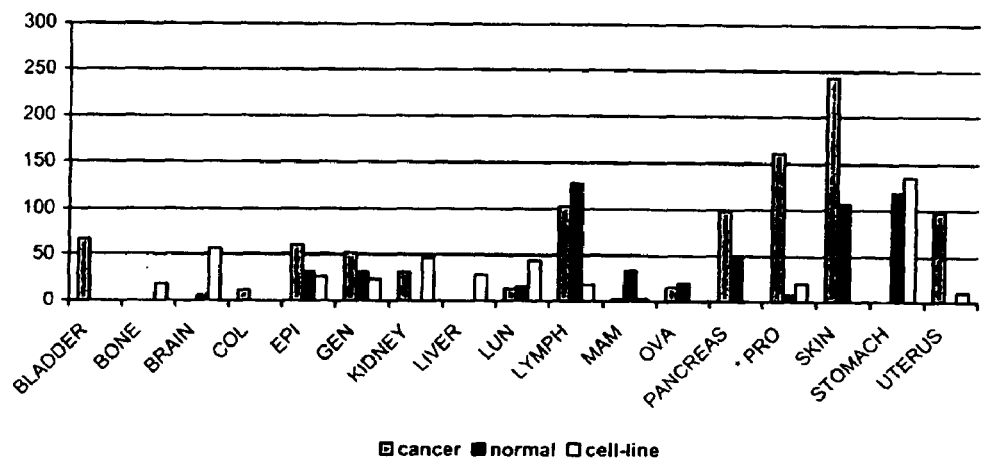

*Figure 85 - Cancer and cell-line vs. normal tissue expression*
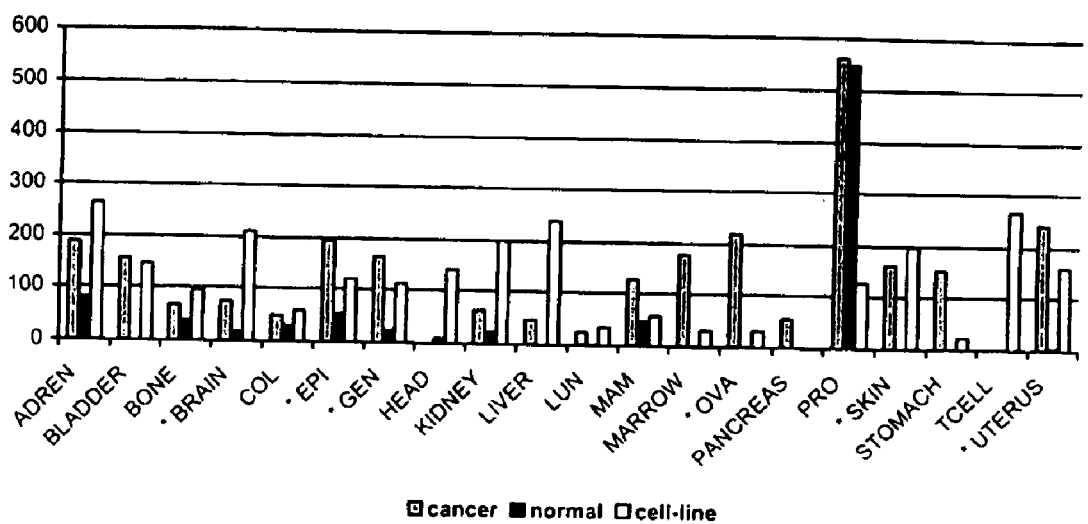
*Figure 86 - Cancer and cell-line vs. normal tissue expression*
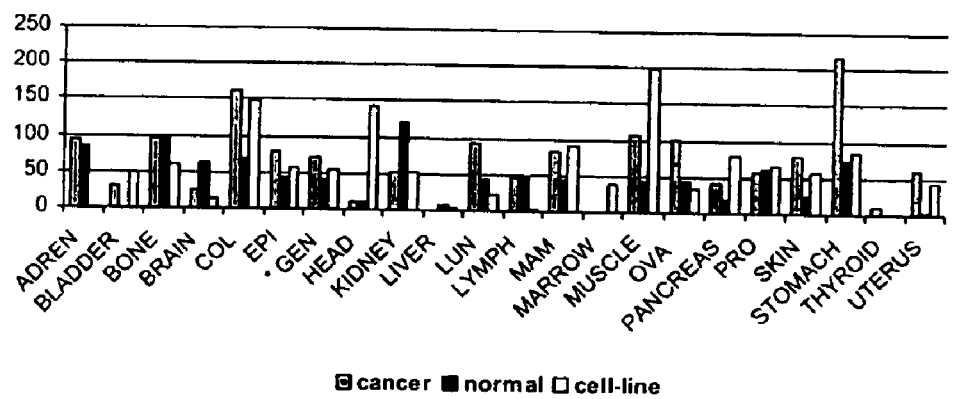

*Figure 87 - Cancer and cell-line vs. normal tissue expression*
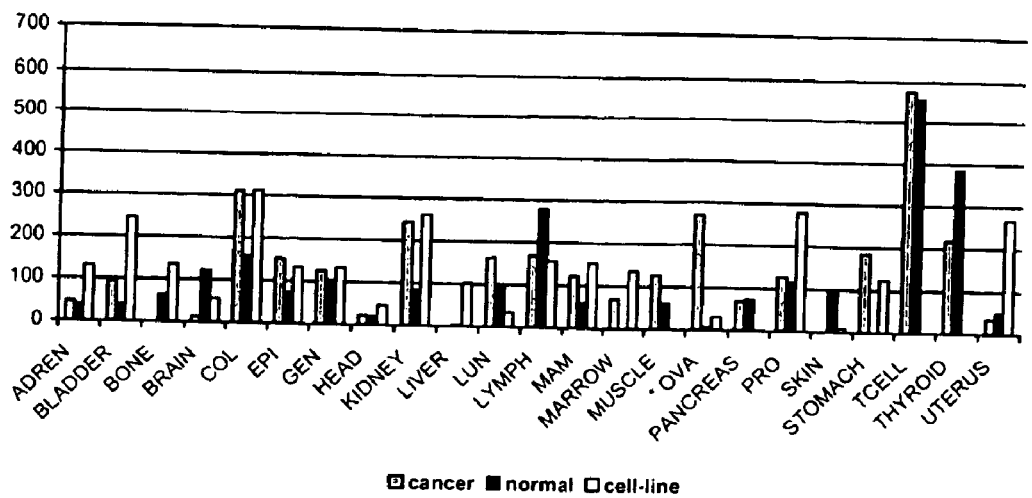
*Figure 88 - Cancer and cell-line vs. normal tissue expression*
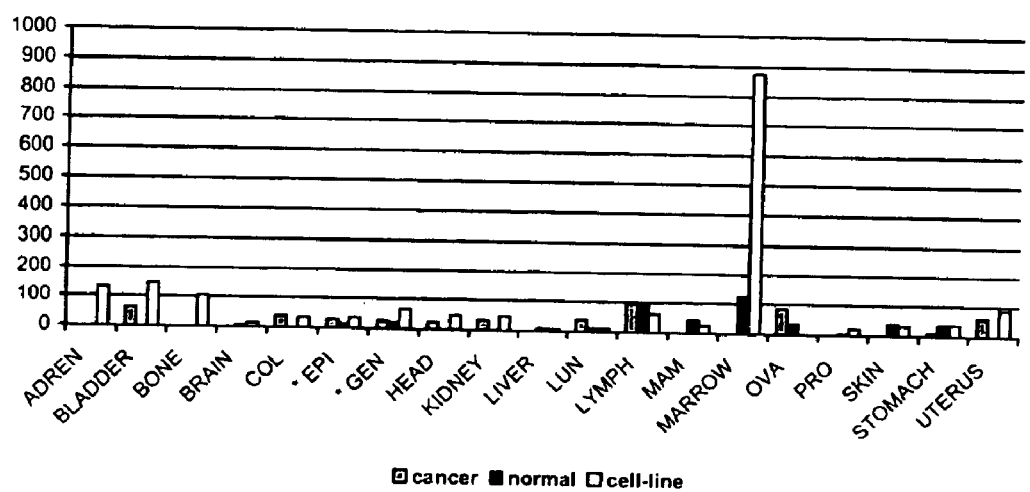

Figure 89 - Cancer and cell-line vs. normal tissue expression
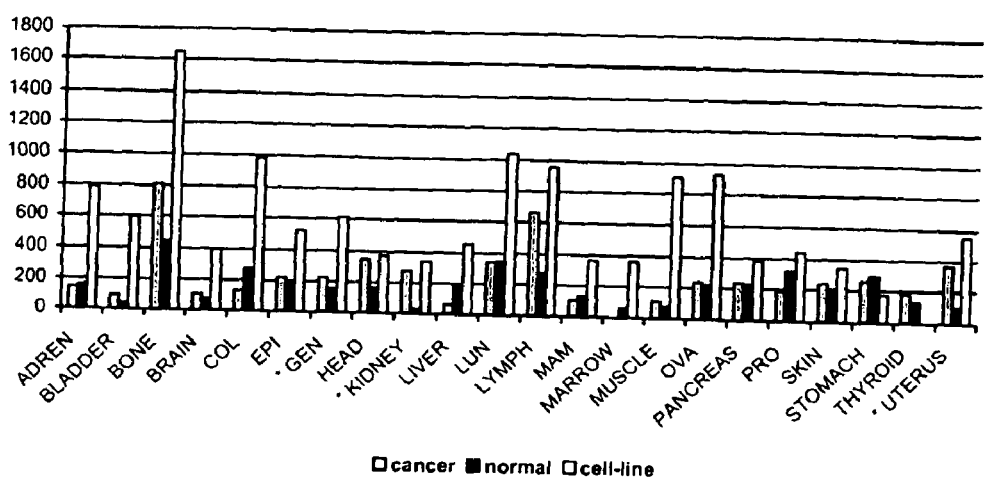
Figure 90 - Cancer and cell-line vs. normal tissue expression
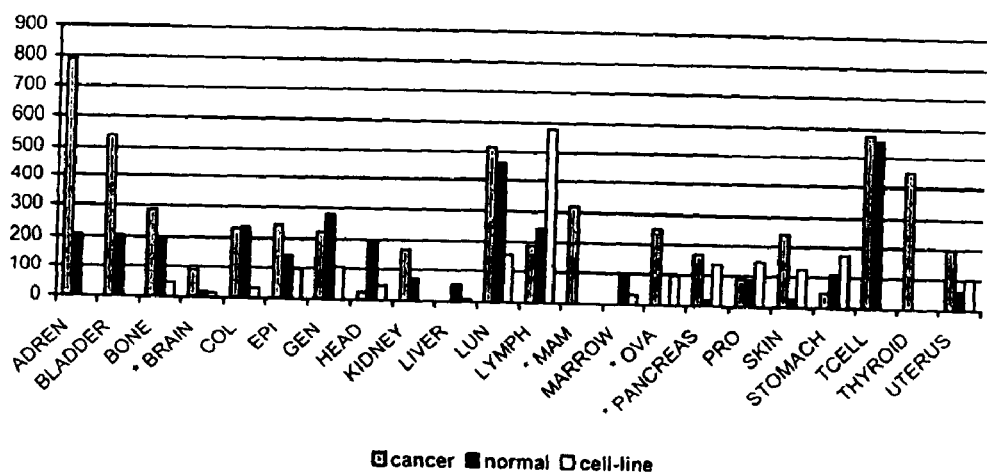

Figure 91 - Cancer and cell-line vs. normal tissue expression
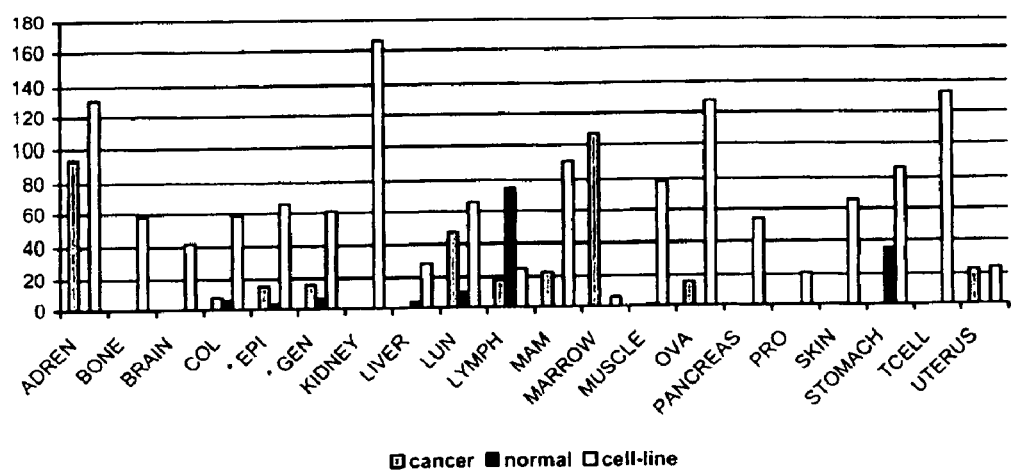
Figure 92 - Cancer and cell-line vs. normal tissue expression
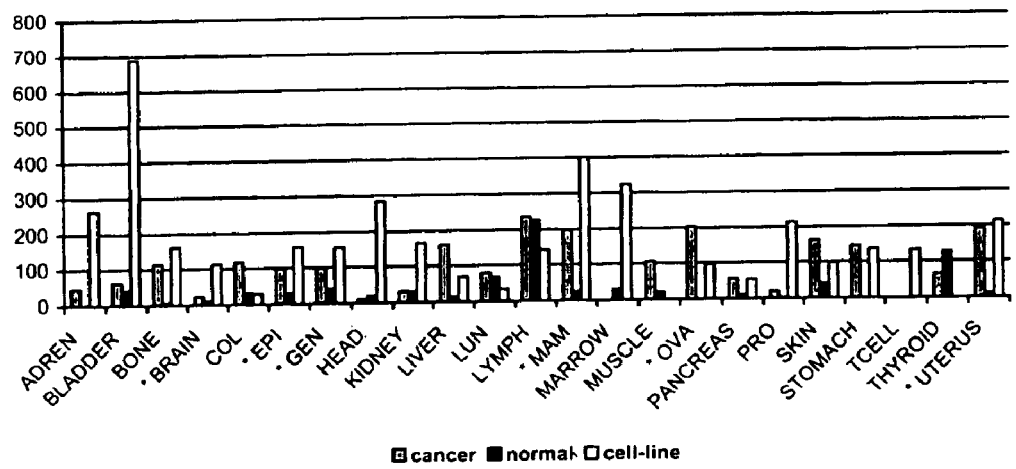

Figure 93 - Cancer and cell-line vs. normal tissue expression
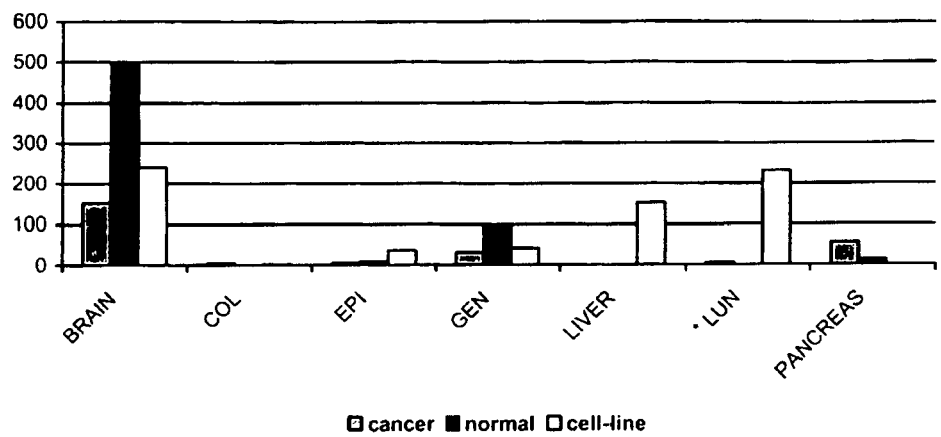
Figure 94 - Cancer and cell-line vs. normal tissue expression
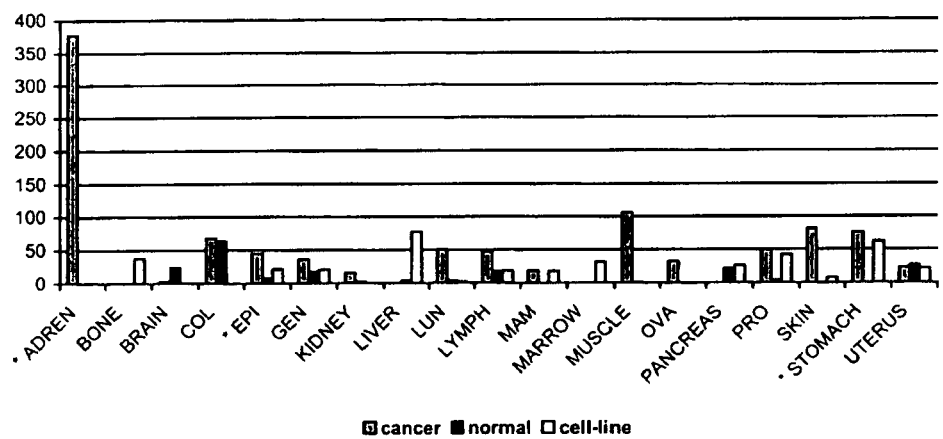

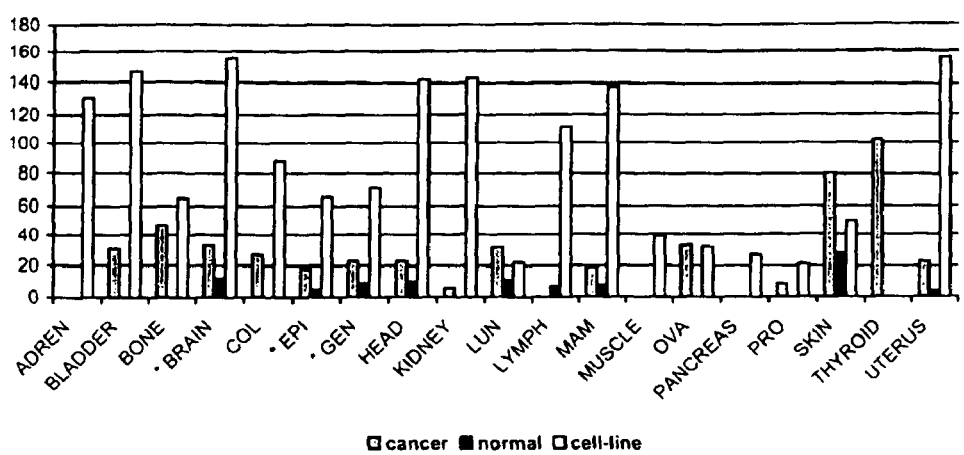
Figure 95 - Cancer and cell-line vs. normal tissue expression
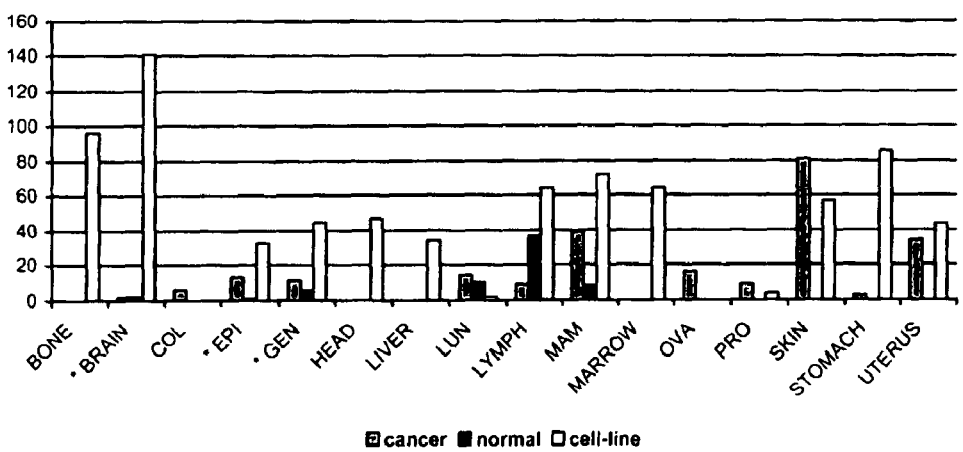
Figure 96 - Cancer and cell-line vs. normal tissue expression

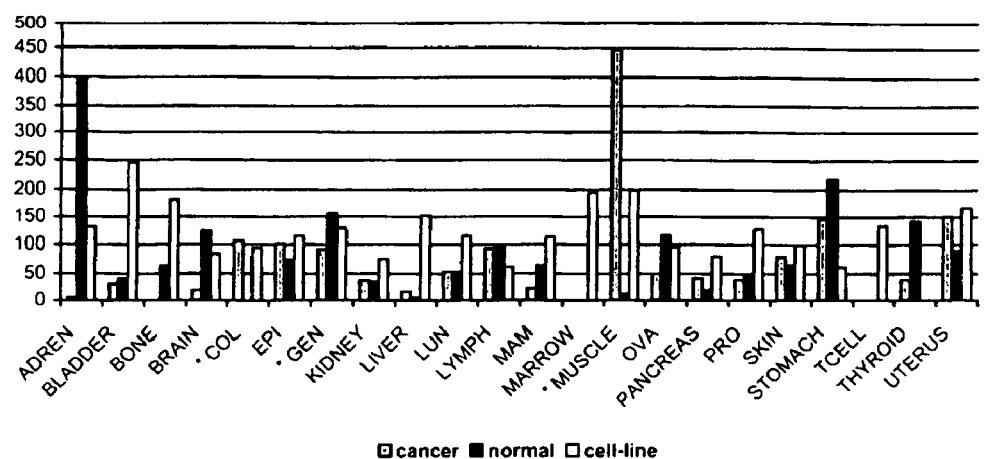
Figure 97 - Cancer and cell-line vs. normal tissue expression
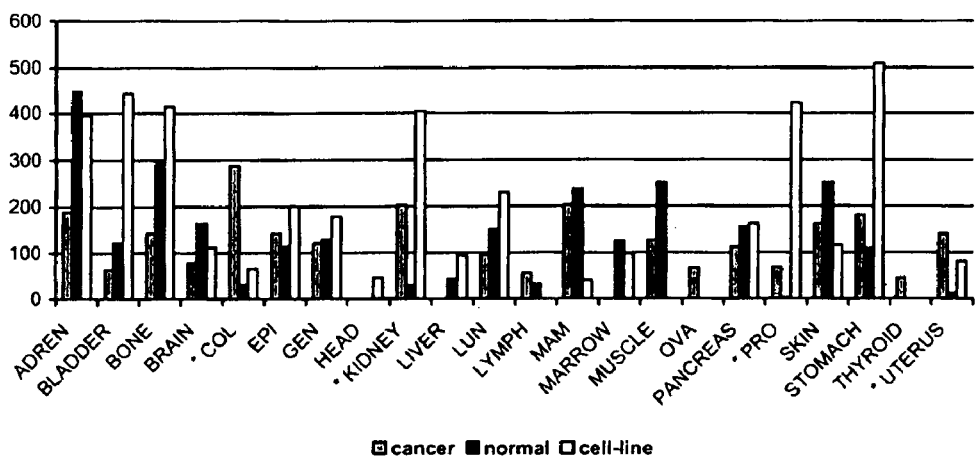
Figure 98 - Cancer and cell-line vs. normal tissue expression Figure 99 - Cancer and cell-line vs. normal tissue expression
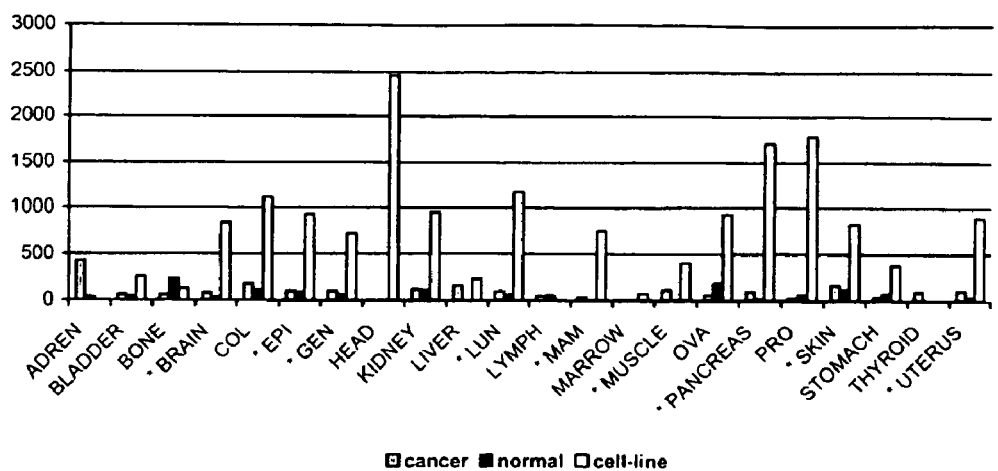
Figure 100 - Cancer and cell-line vs. normal tissue expression
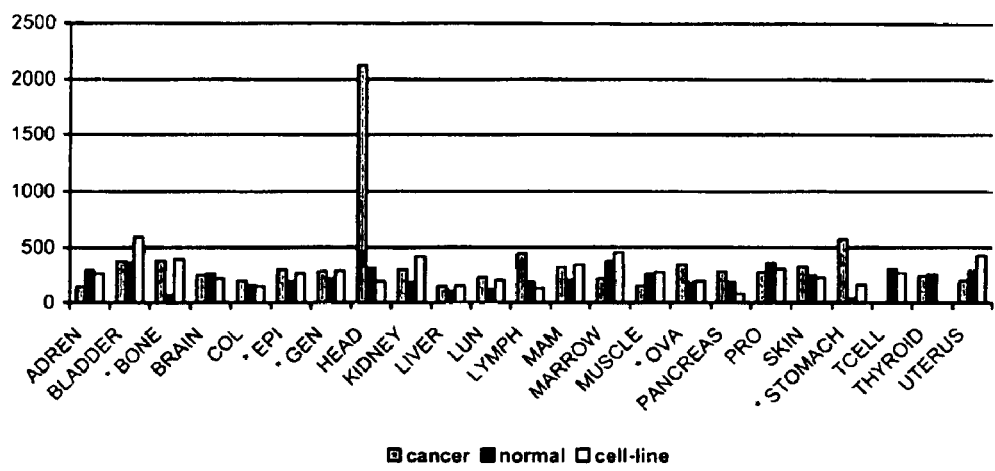

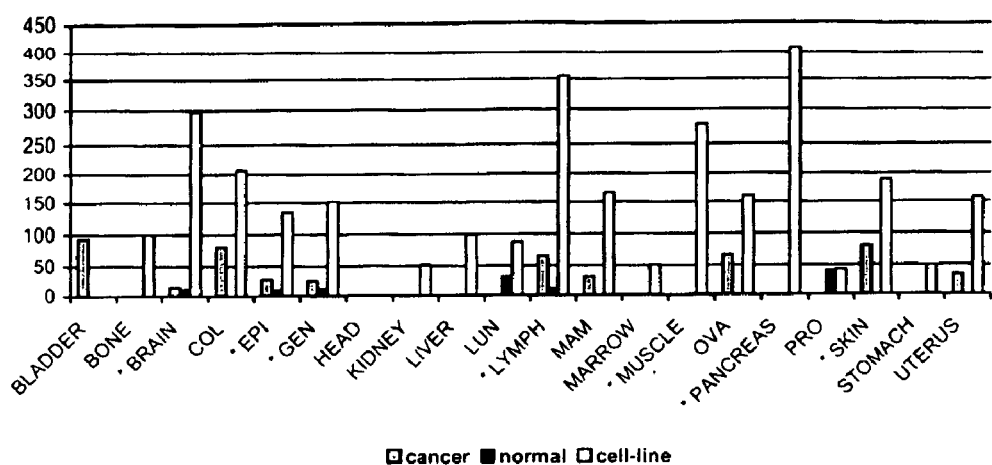
Figure 101 - Cancer and cell-line vs. normal tissue expression
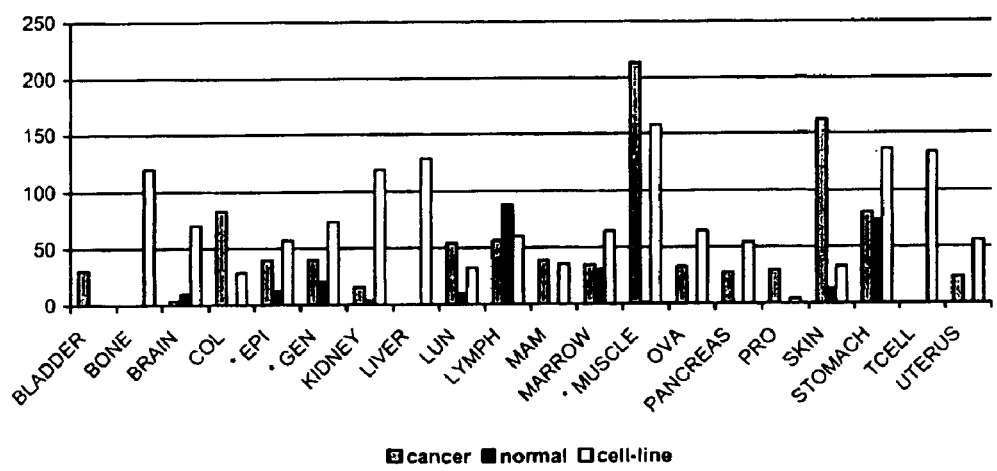
Figure 102 - Cancer and cell-line vs. normal tissue expression Figure 103
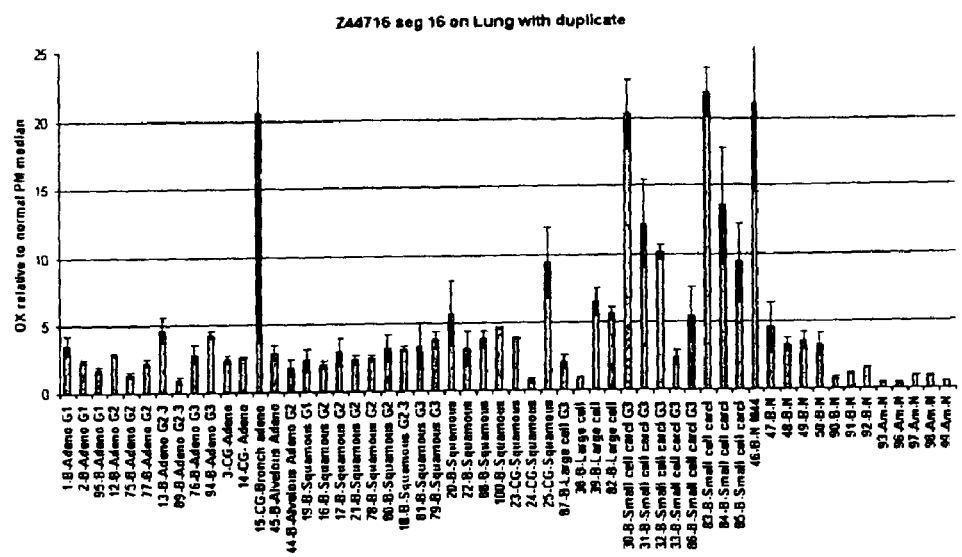
Figure 104 - Cancer and cell-line vs. normal tissue expression
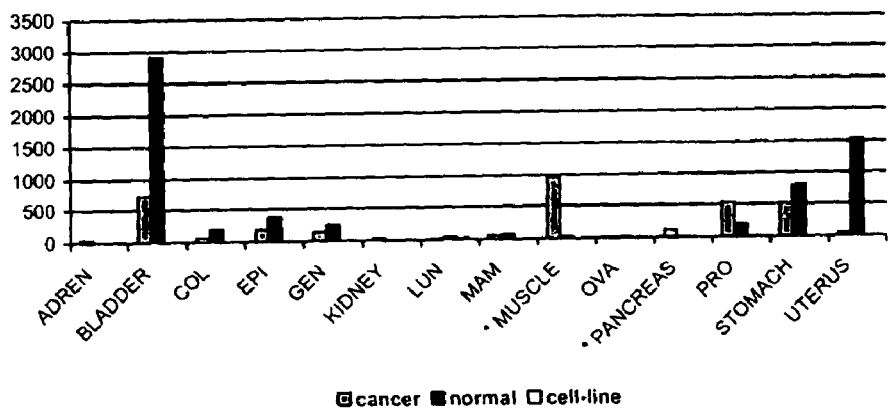

Figure 105 - Cancer and cell-line vs. normal tissue expression
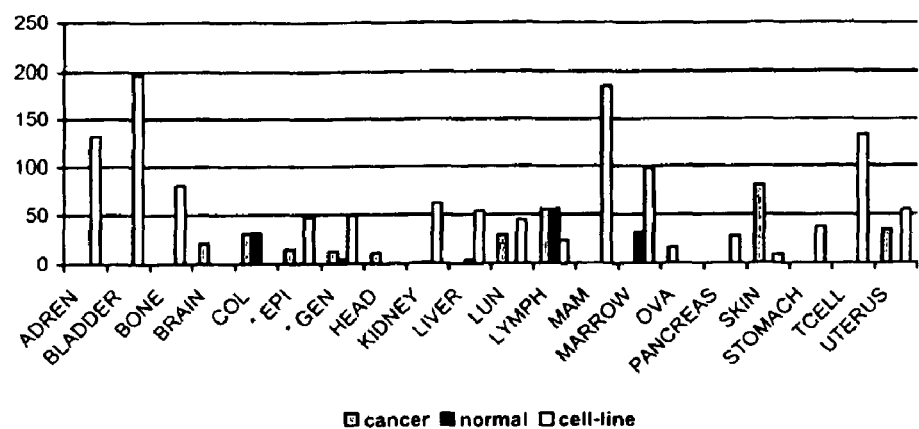
Figure 106 - Expression of ESTs in each category, as "parts per million"
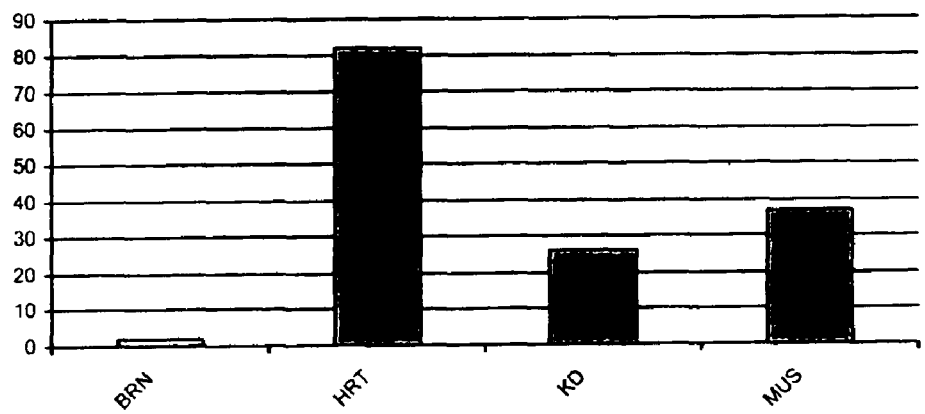

Figure 107 - Expression of ESTs in each category, as "parts per million"
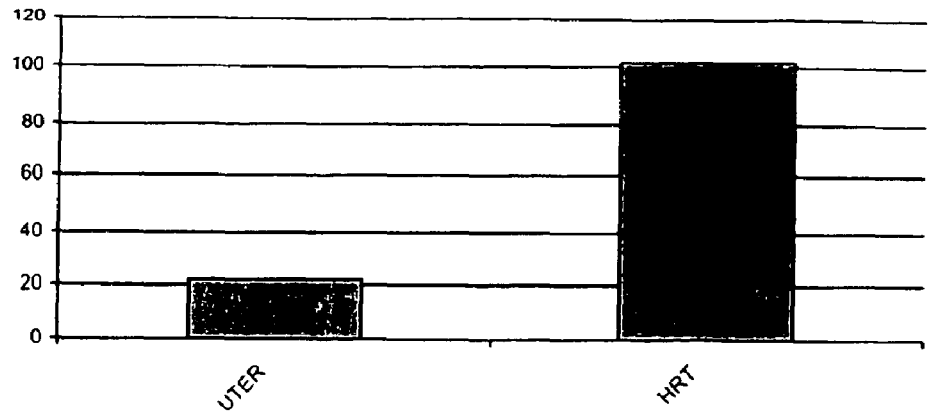
Figure 108 - Expression of ESTs in each category, as "parts per million"
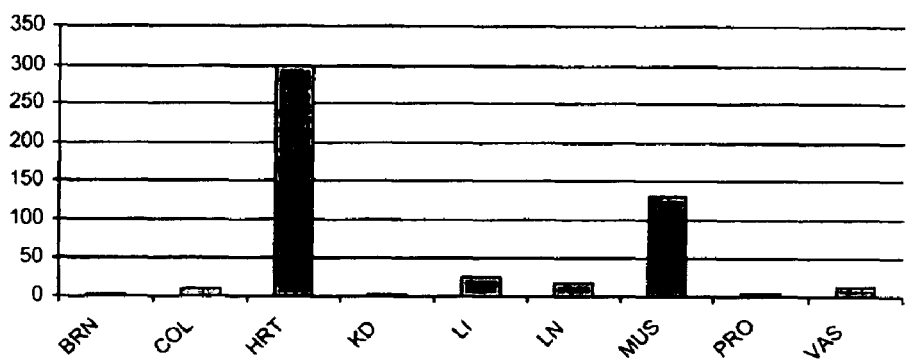
Figure 109 - Expression of oligonucleotides in various tissues, prob 207066_at
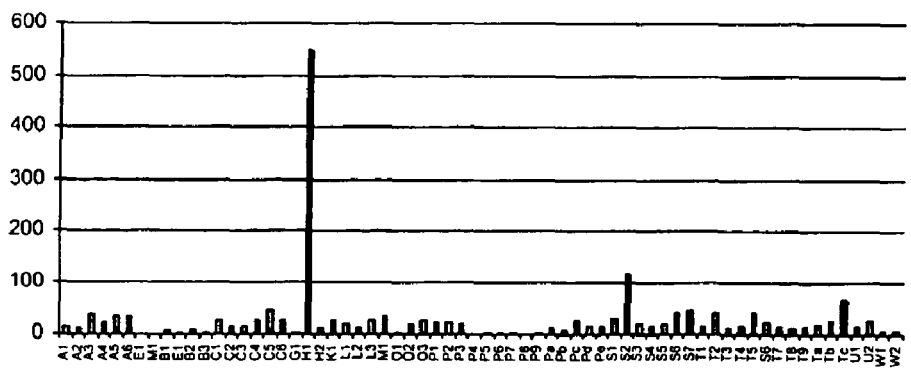

Figure 110 - Expression of ESTs in each category, as "parts per million"
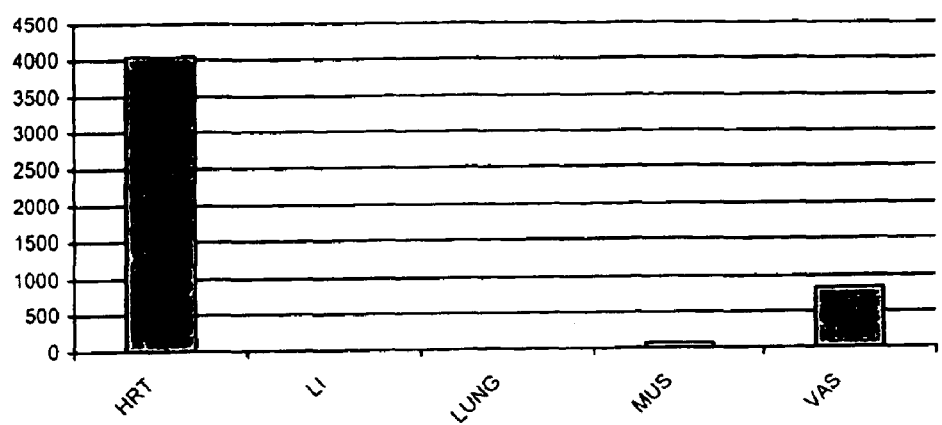
Figure 111 - Expression of oligonucleotides in various tissues, prob 204737_s_at
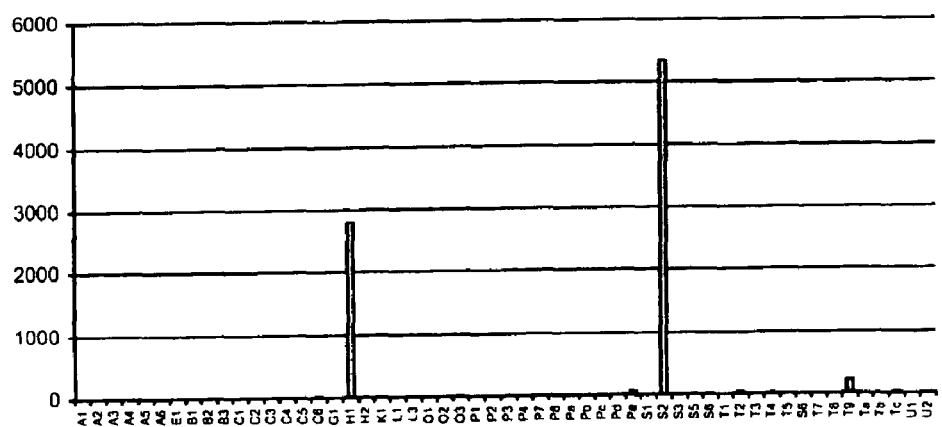

Figure 112 - Expression of oligonucleotides in various tissues, prob 216265_x_at
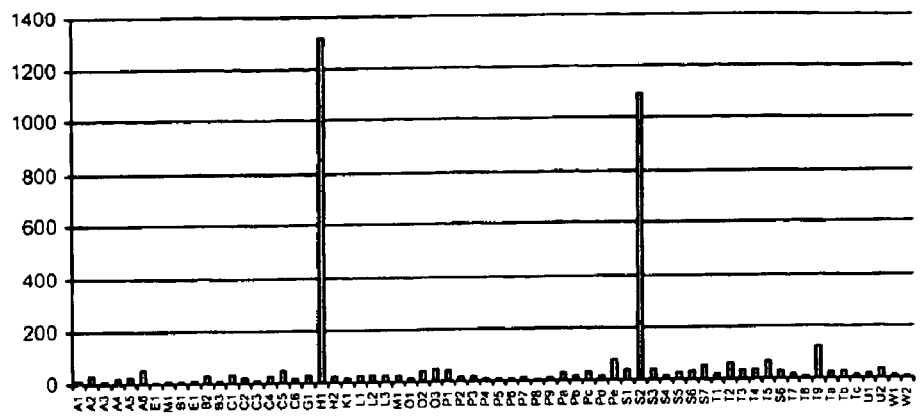
Figure 113 - Cancer and cell-line vs. normal tissue expression
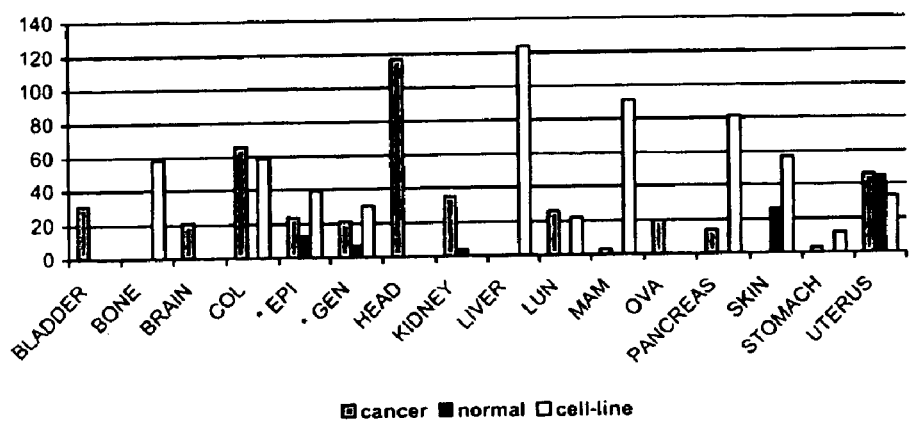

Figure 114 - Cancer and cell-line vs. normal tissue expression
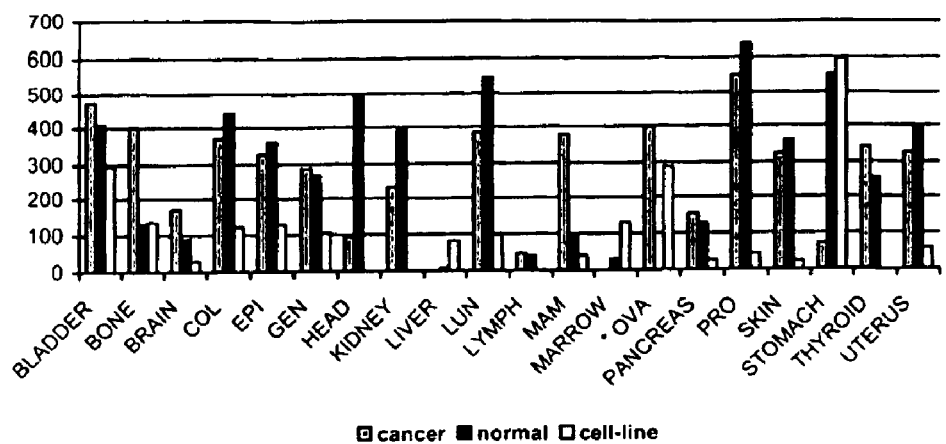
Figure 115 - Cancer and cell-line vs. normal tissue expression
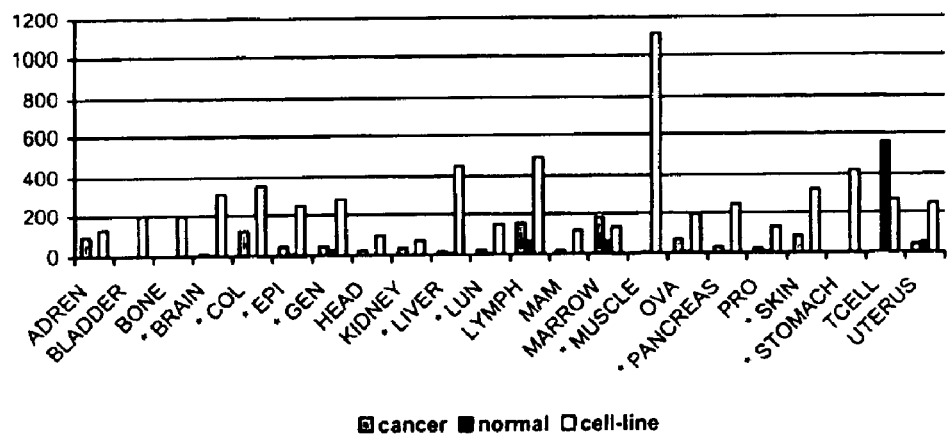

Figure 116 - Cancer and cell-line vs. normal tissue expression
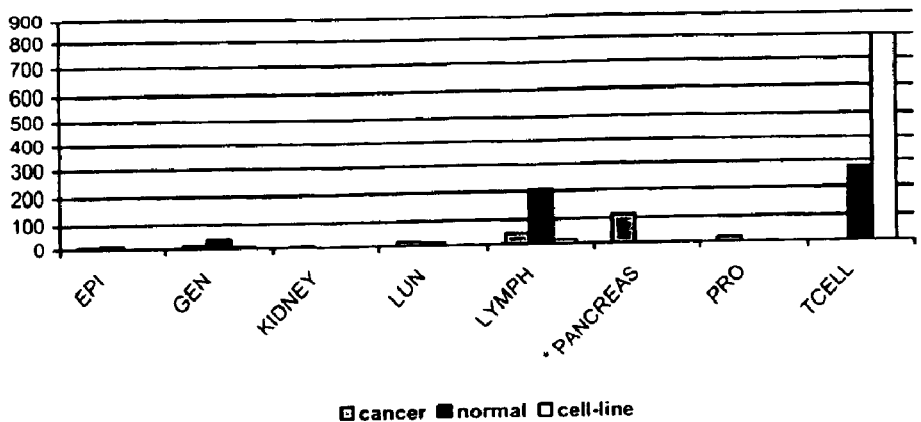
Figure 117 - Cancer and cell-line vs. normal tissue expression
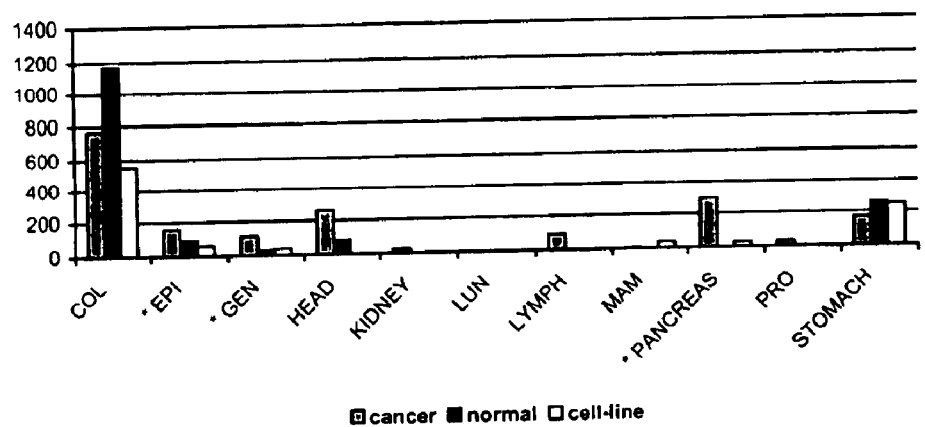
Figure 118 - Cancer and cell-line vs. normal tissue expression
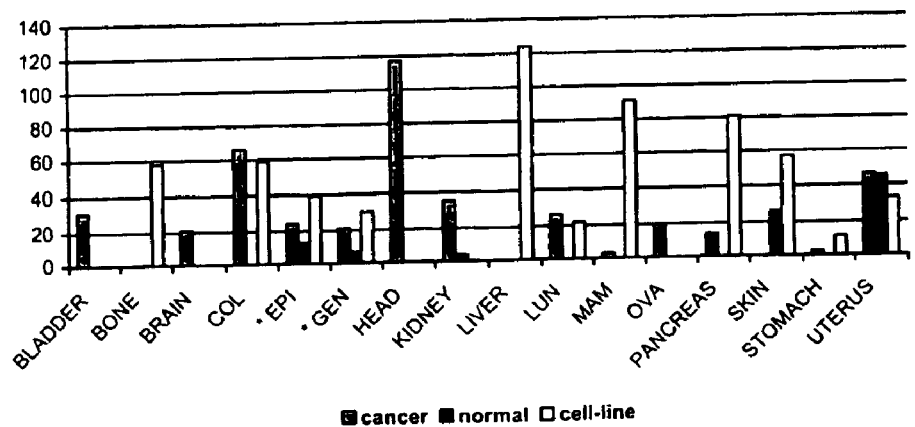

Figure 119 - Cancer and cell-line vs. normal tissue expression
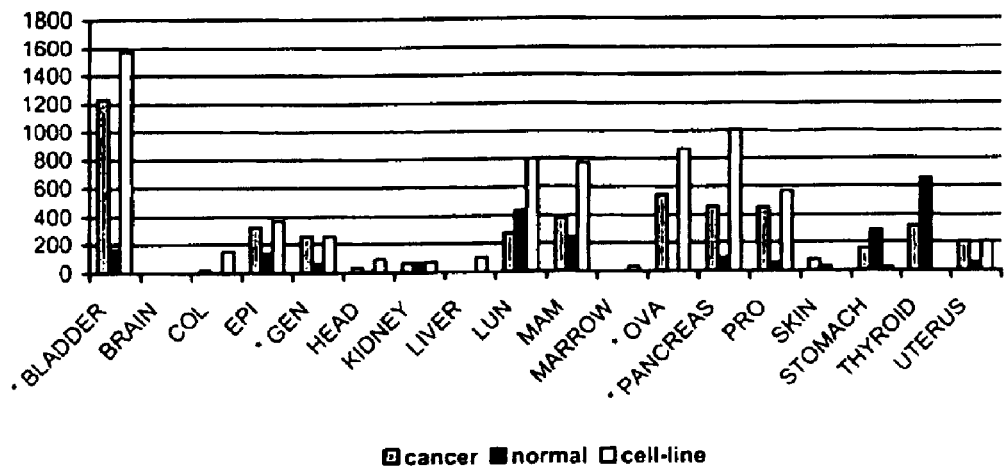
Figure 120 - Cancer and cell-line vs. normal tissue expression
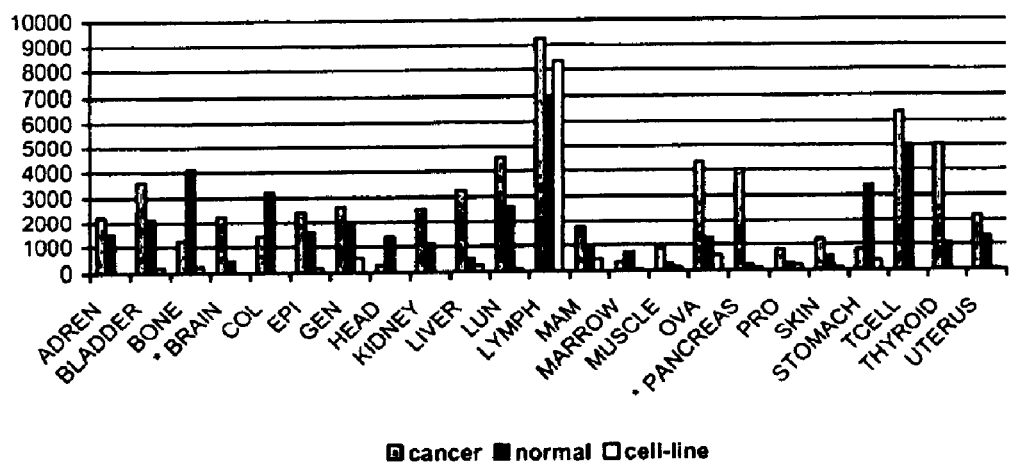

Figure 121 - Cancer and cell-line vs. normal tissue expression
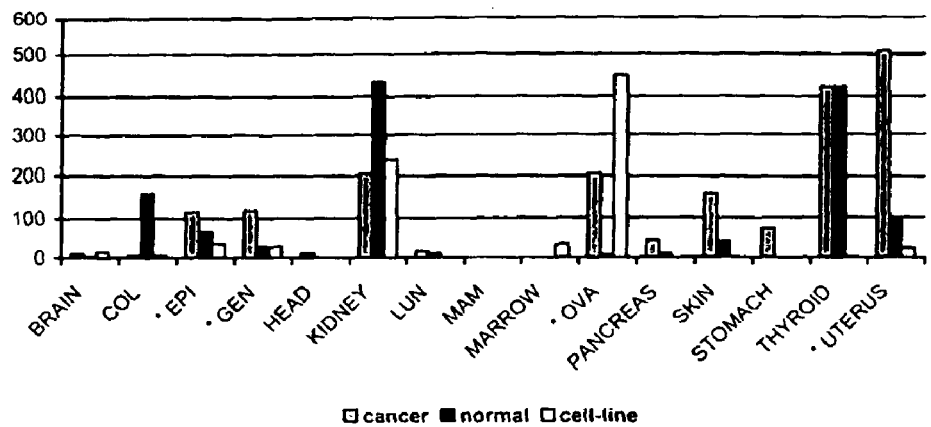
Figure 122
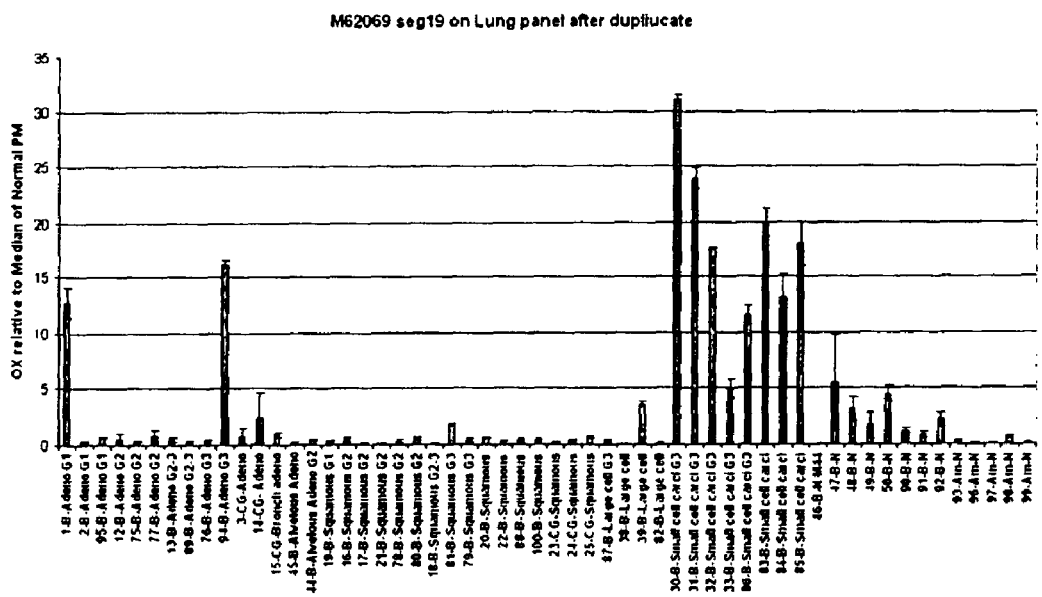

Figure 123 - Cancer and cell-line vs. normal tissue expression
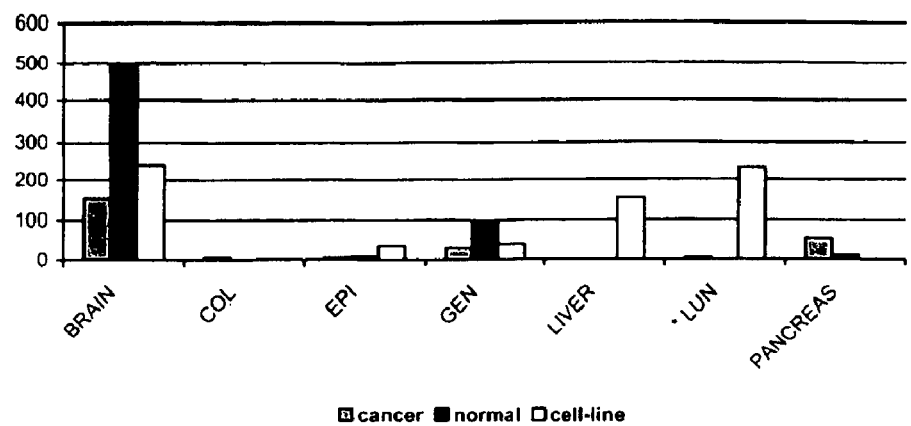
Figure 124 - Cancer and cell-line vs. normal tissue expression
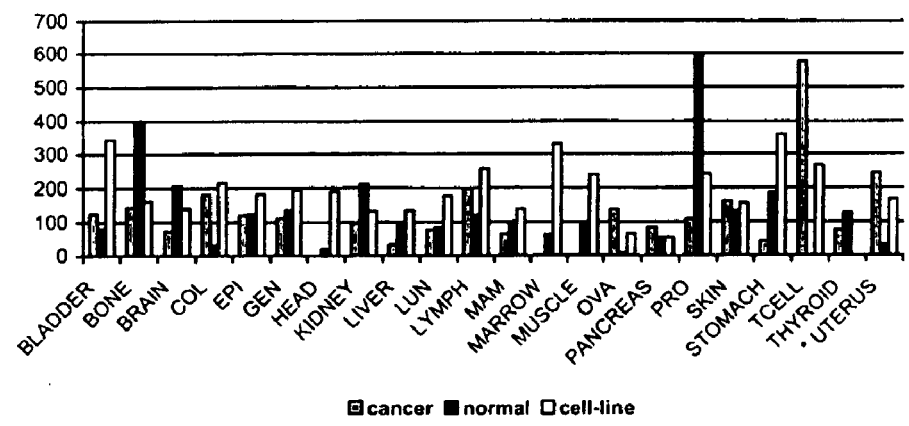

Figure 125 - Cancer and cell-line vs. normal tissue expression
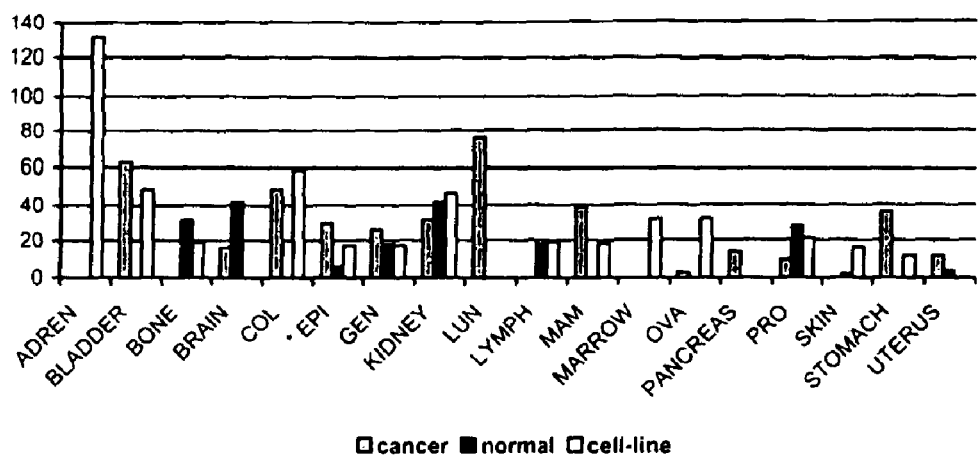
Figure 126 - Cancer and cell-line vs. normal tissue expression
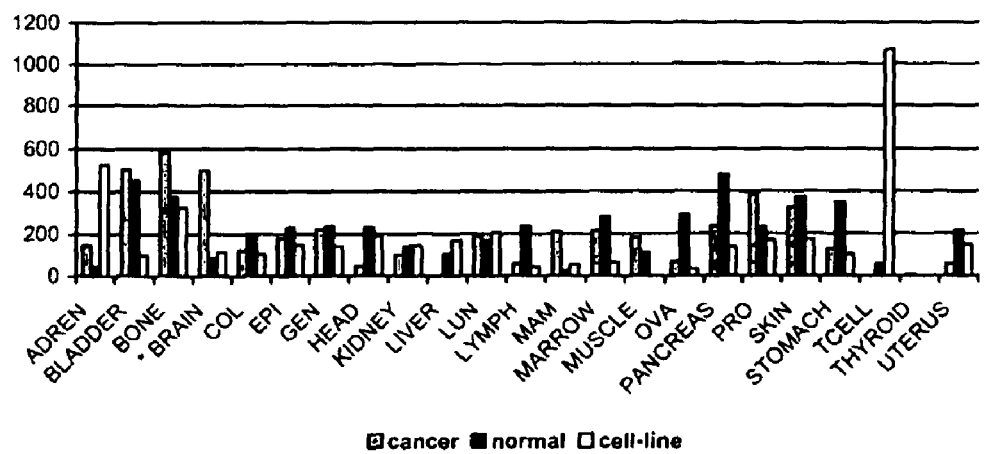

Figure 127 - Cancer and cell-line vs. normal tissue expression
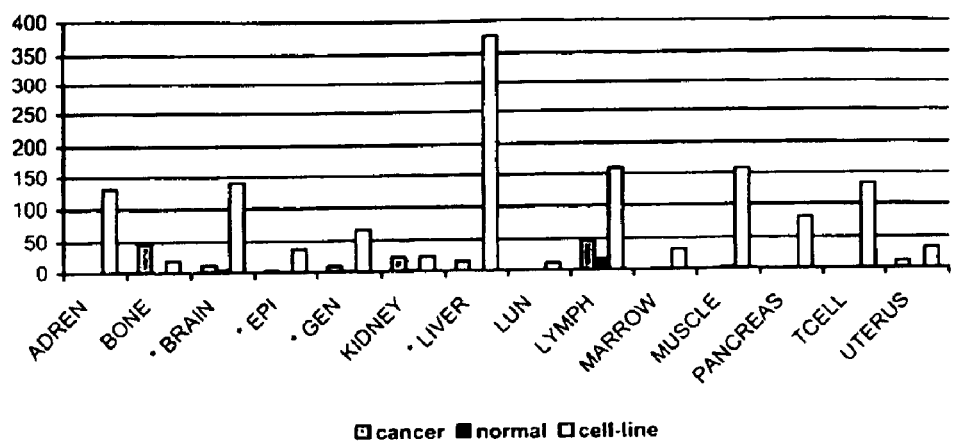
Figure 128 - Cancer and cell-line vs. normal tissue expression
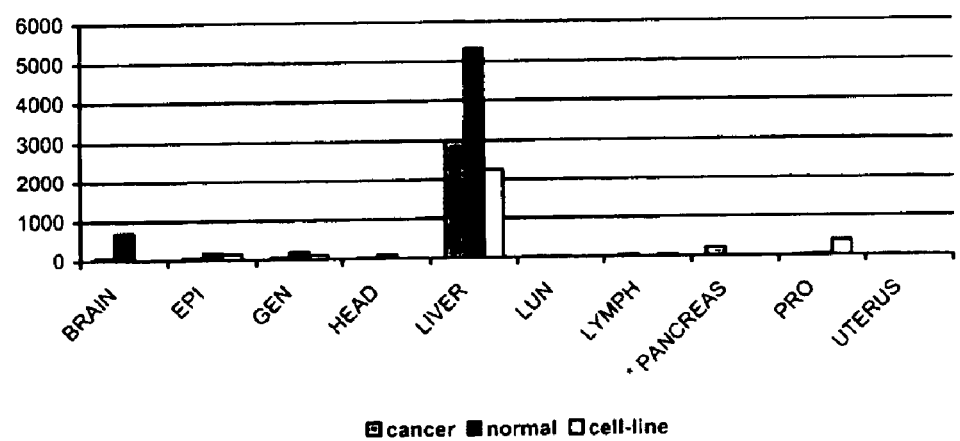

Figure 129 - Cancer and cell-line vs. normal tissue expression
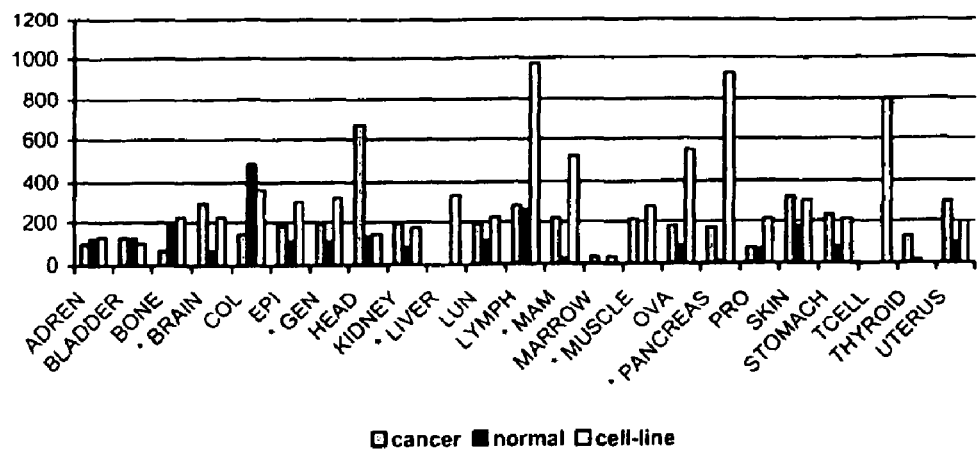
Figure 130 - Expression of ESTs in each category, as "parts per million"
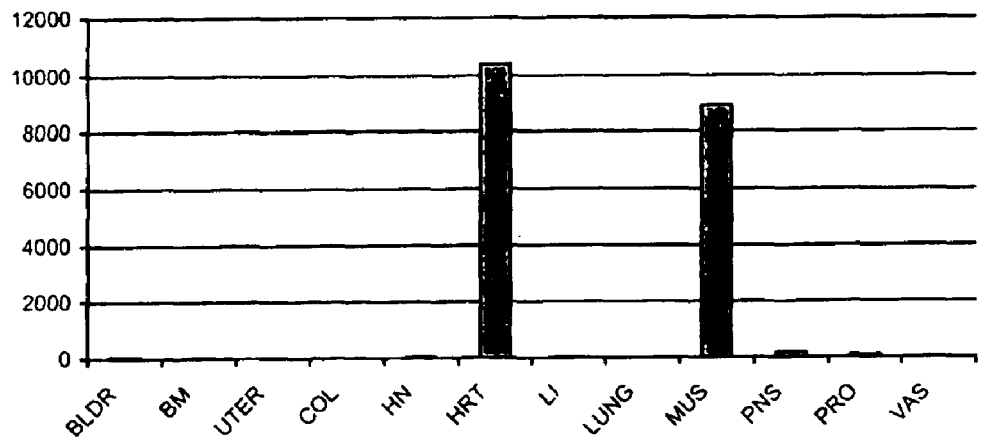

Figure131 - Expression of oligonucleotides in various tissues, prob 204179_at
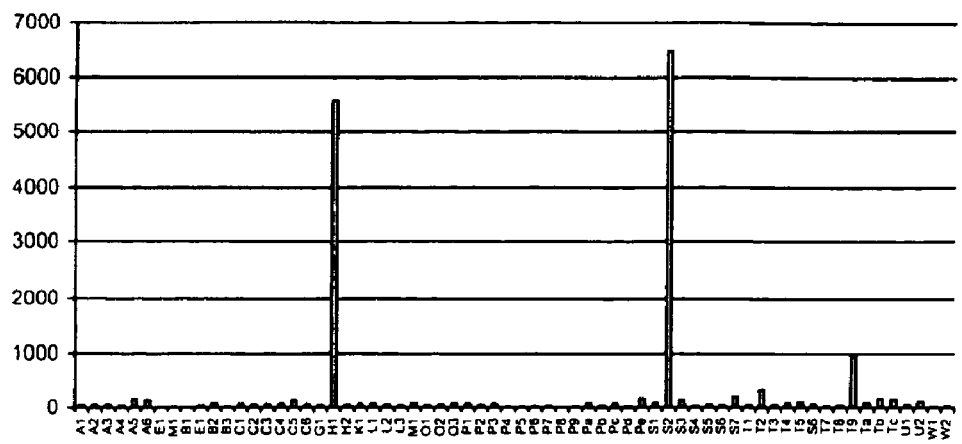
Figure 132 - Cancer and cell-line vs. normal tissue expression
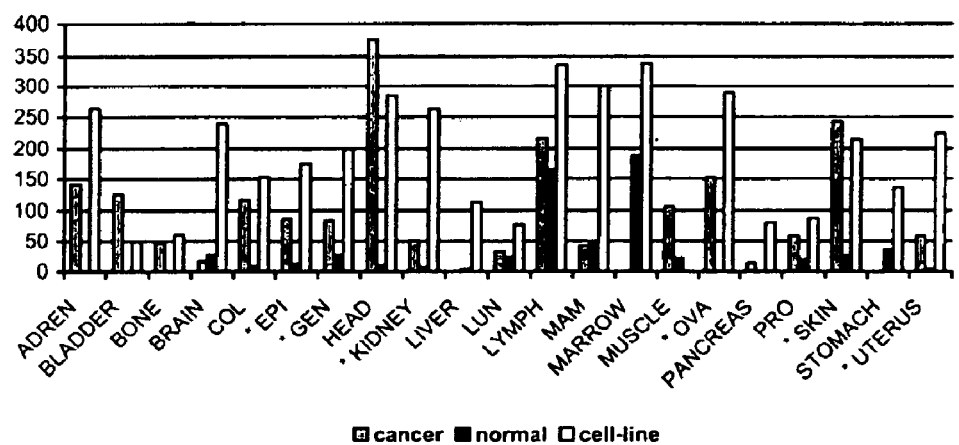

Figure 133 - Cancer and cell-line vs. normal tissue expression
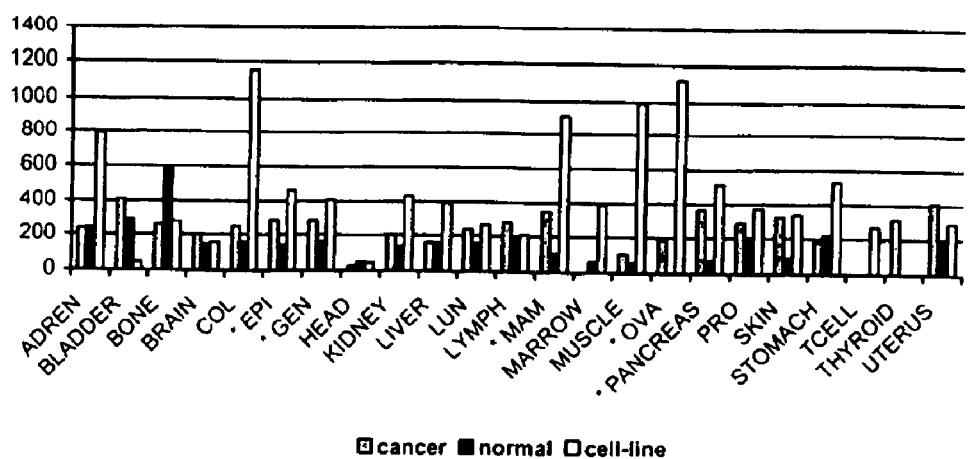
Figure 134 - Cancer and cell-line vs. normal tissue expression
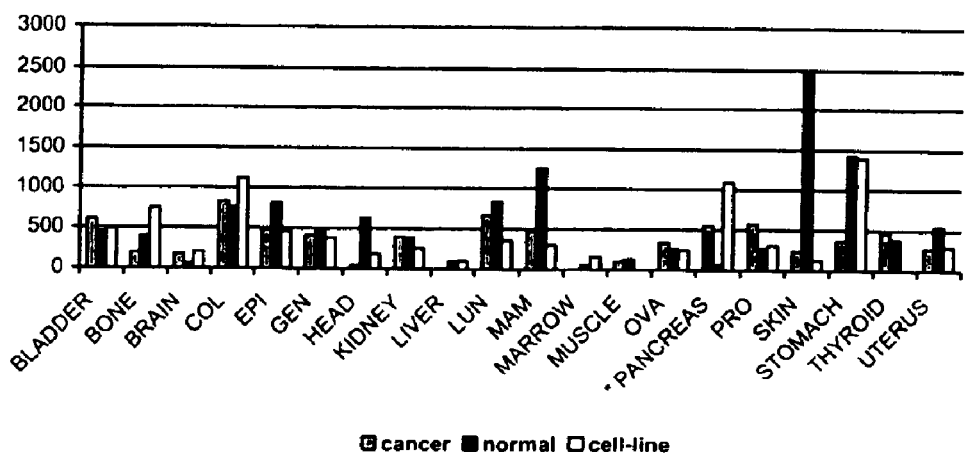

Figure 135 - Cancer and cell-line vs. normal tissue expression
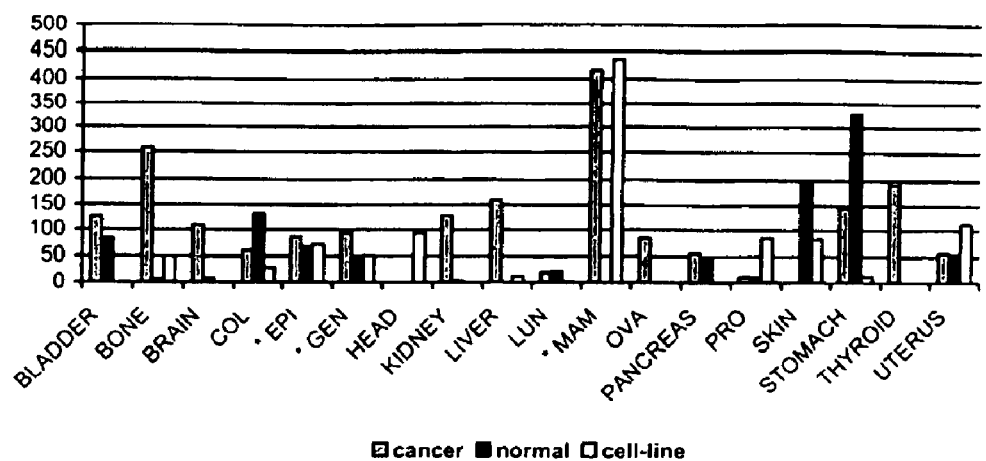
Figure 136 - Cancer and cell-line vs. normal tissue expression
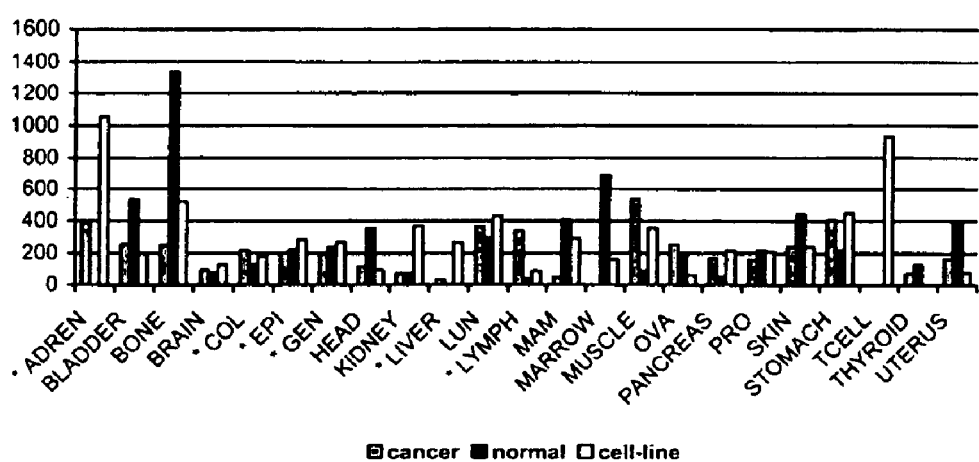

*Figure 137 - Cancer and cell-line vs. normal tissue expression*
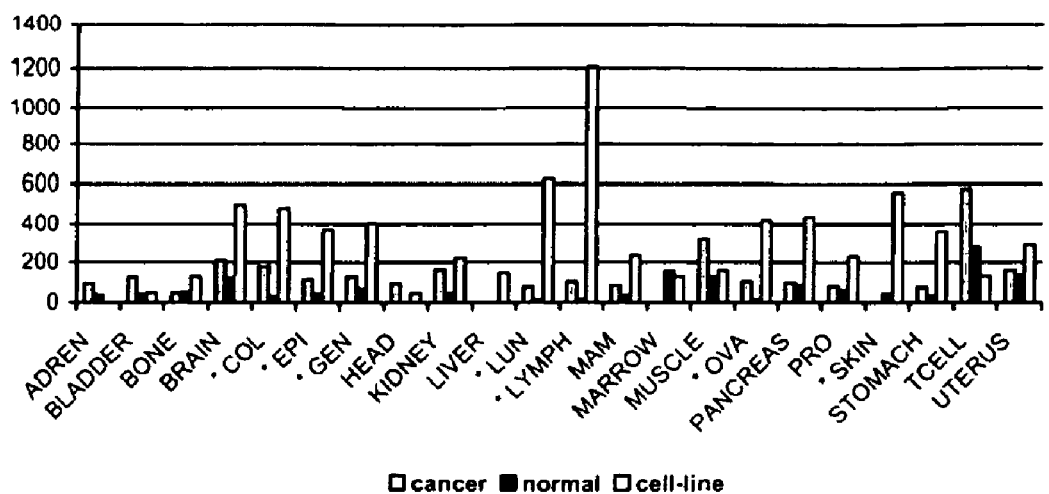
Figure 138 - Cancer and cell-line vs. normal tissue expression
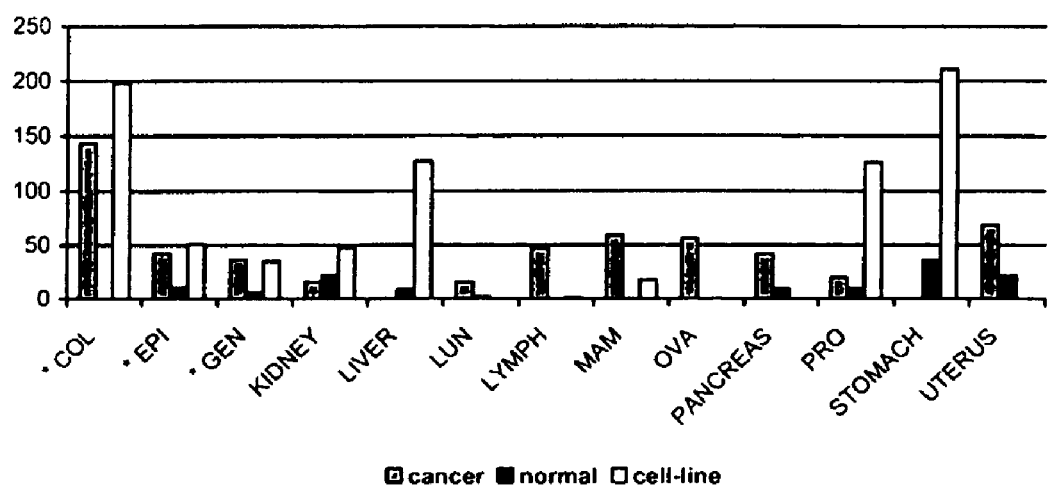

Figure 139 - Cancer and cell-line vs. normal tissue expression
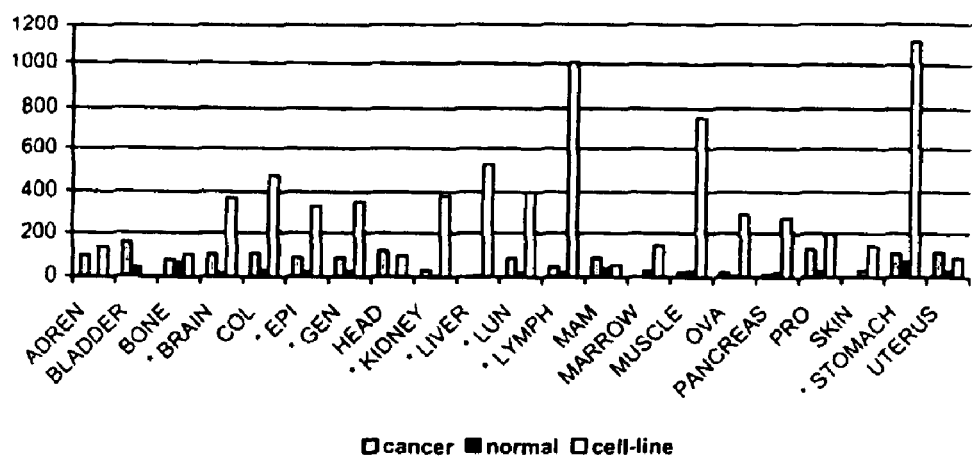
Figure 140 - Cancer and cell-line vs. normal tissue expression
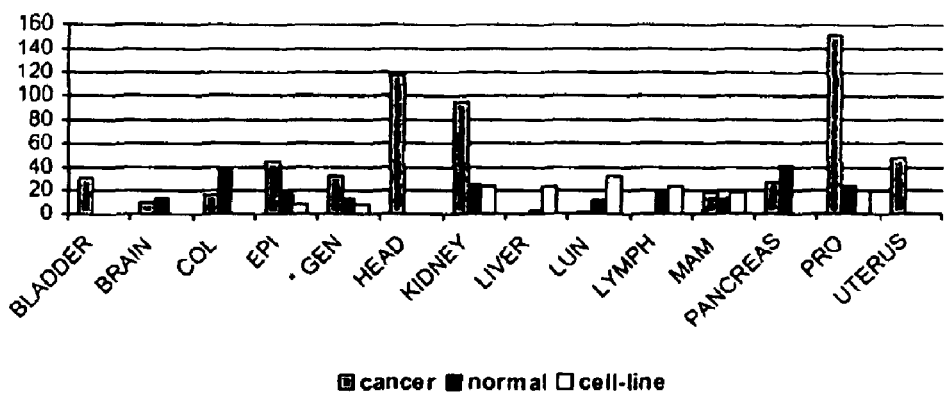

Figure 141 - Cancer and cell-line vs. normal tissue expression
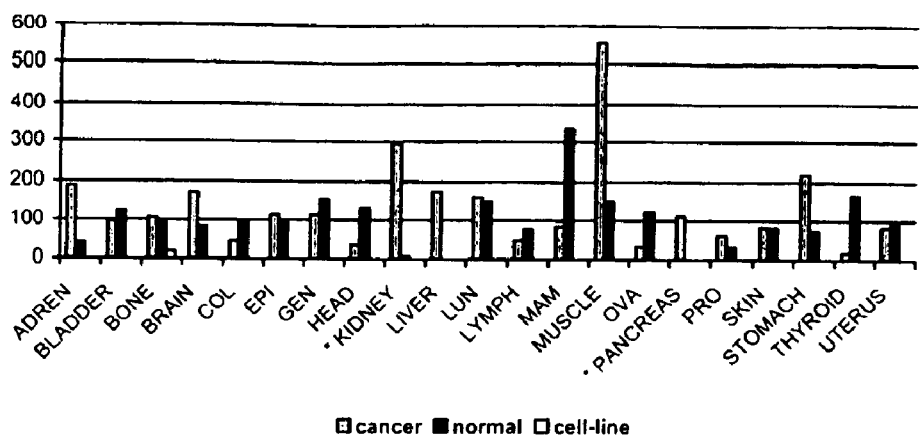
Figure 142 - Expression of ESTs in each category, as "parts per million"
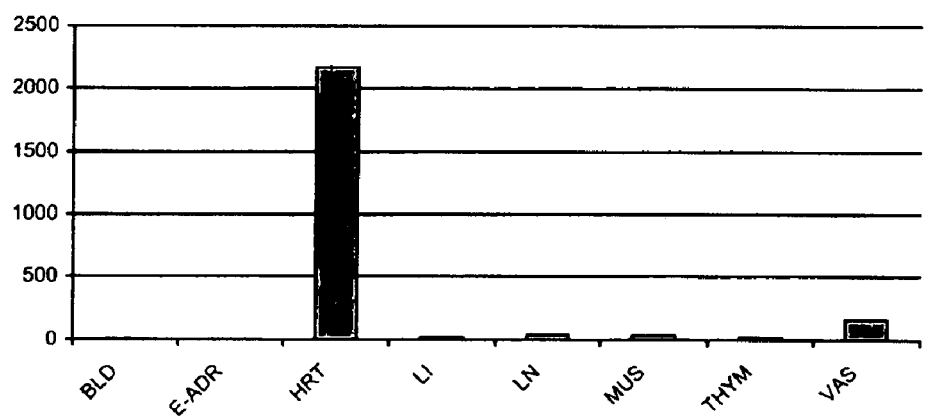

Figure +143 - Expression of oligonucleotides in various tissues, prob 208040_s_at
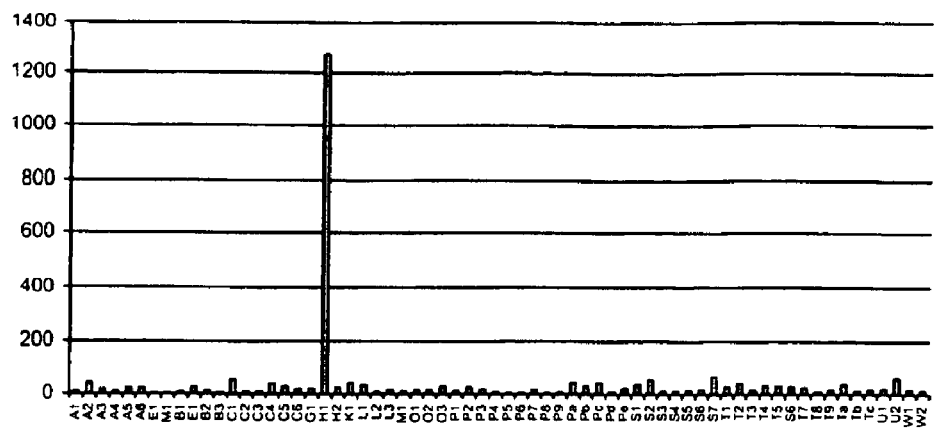
Figure 144 - Expression of ESTs in each category, as "parts per million"
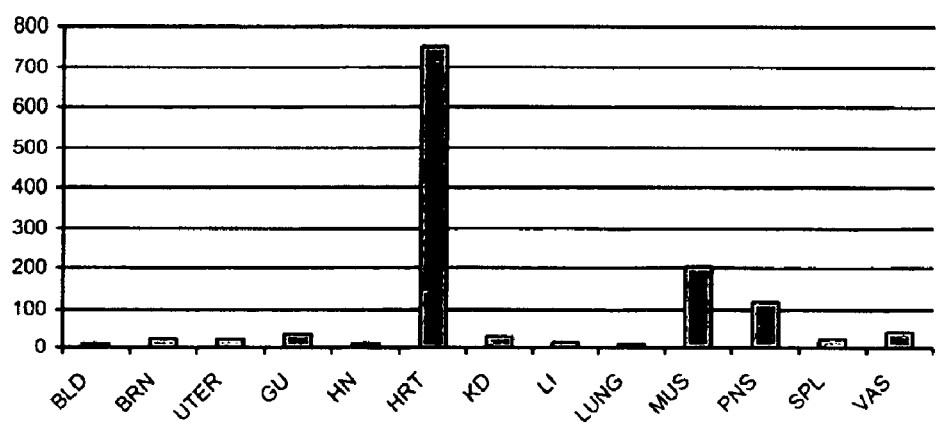

Figure 145 - Expression of oligonucleotides in various tissues, prob 205826_at
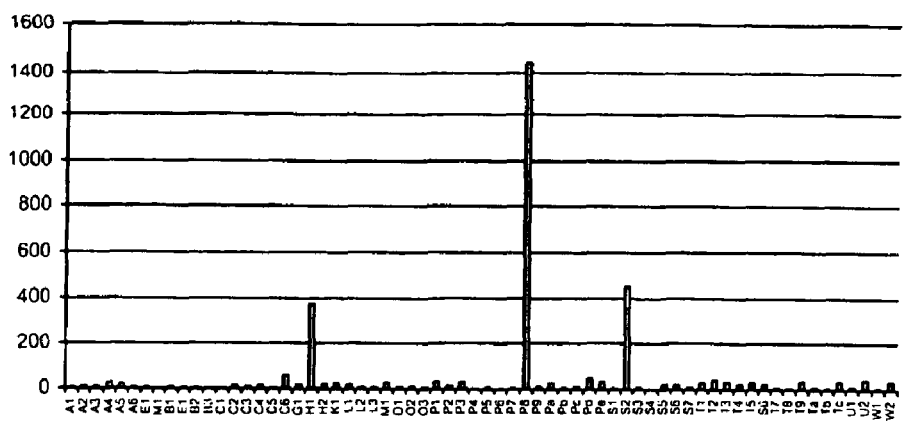
Figure 146 - Cancer and cell-line vs. normal tissue expression
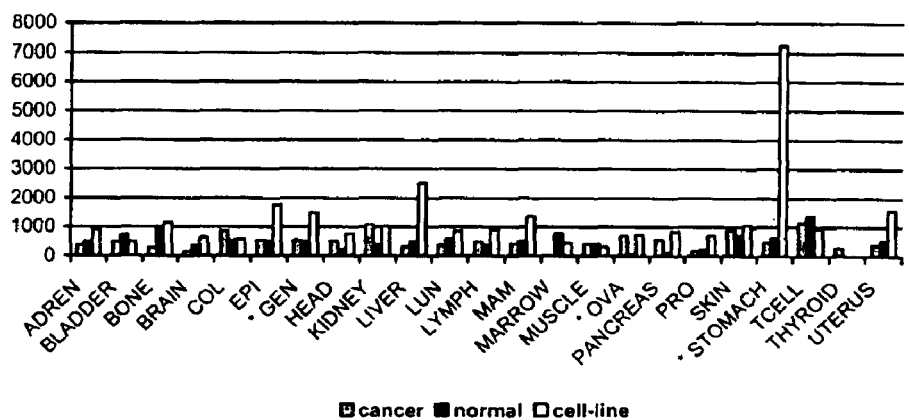

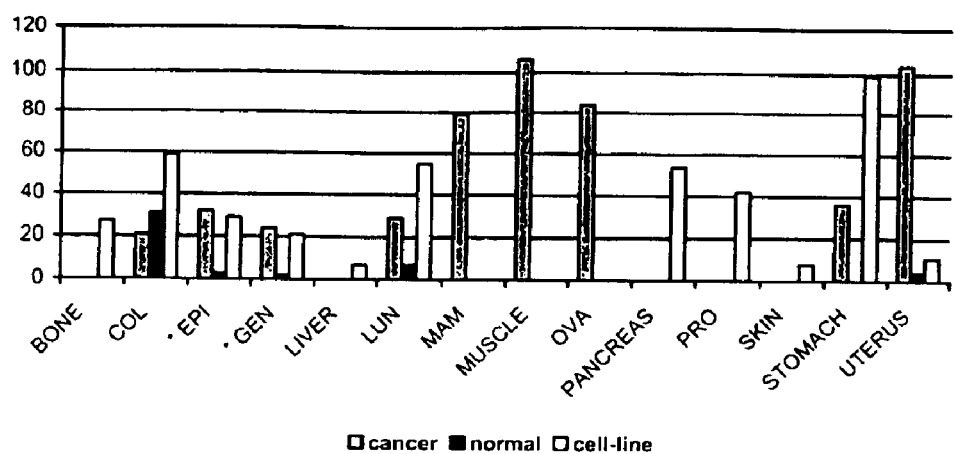
Figure 147 - Cancer and cell-line vs. normal tissue expression
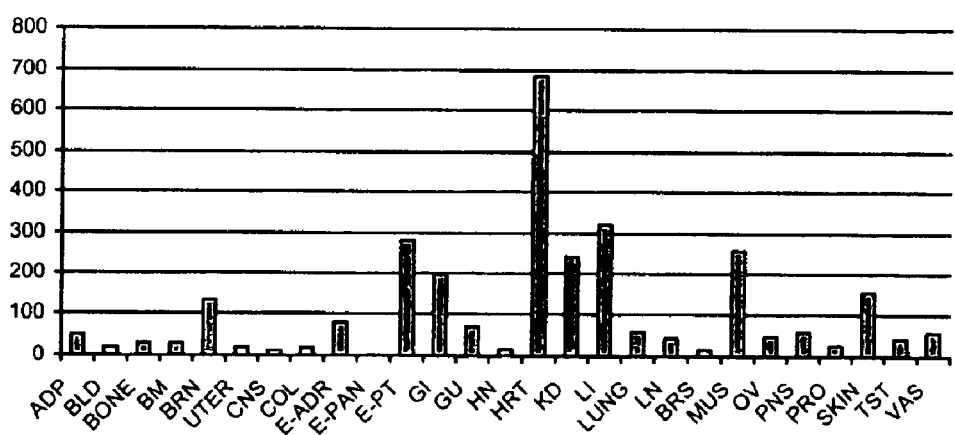
Figure 148 - Expression of ESTs in each category, as "parts per million"

Figure 149 - Expression of oligonucleotides in various tissues, prob 208813_at
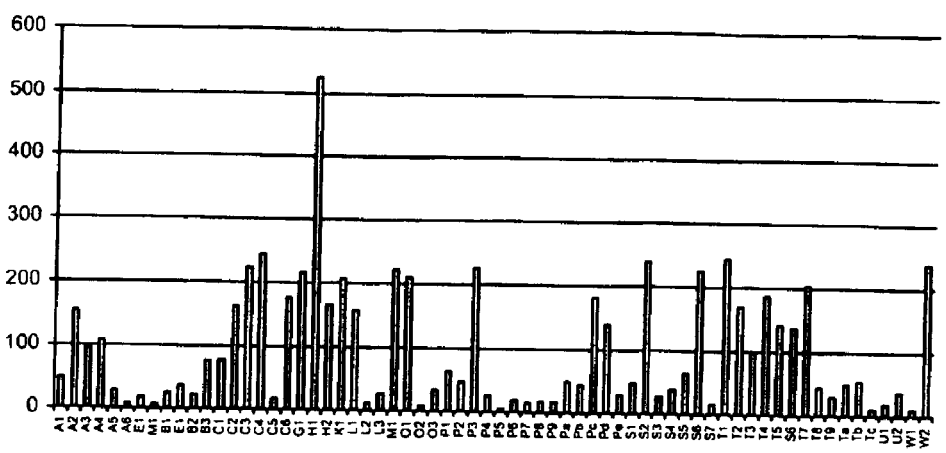
Figure 150 - Cancer and cell-line vs. normal tissue expression
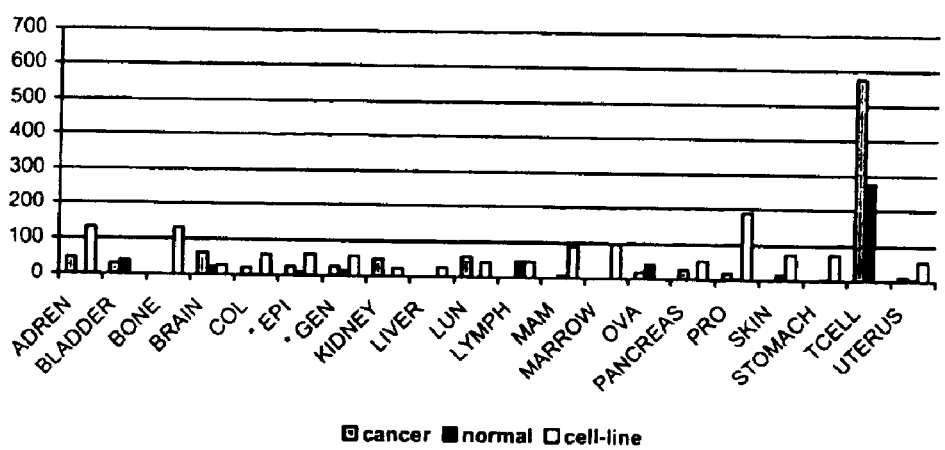

Figure 151 - Cancer and cell-line vs. normal tissue expression
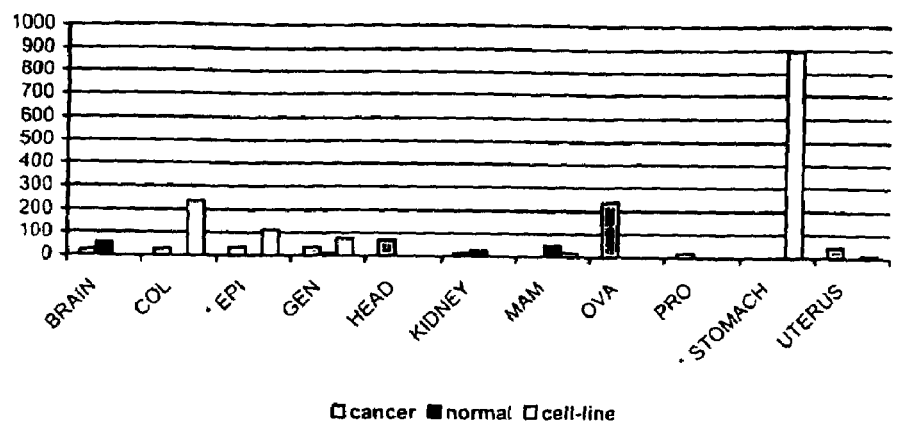
Figure 152 - Cancer and cell-line vs. normal tissue expression
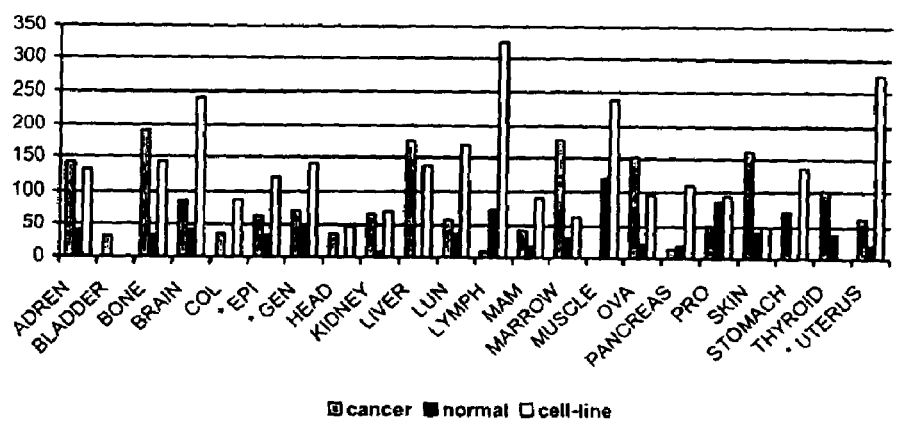

NUCLEOTIDE AND AMINO ACID SEQUENCES, AND ASSAYS AND METHODS OF USE THEREOF FOR DIAGNOSIS

CROSS-REFERENCE TO RELATED APPLICATION(S)

This application is related to Novel Nucleotide and Amino Acid Sequences, and Assays and Methods of use thereof for Diagnosis, and claims priority to the below U.S. provisional applications which are incorporated by reference herein:

Application No. 60/628,666 filed Nov. 18, 2004—Novel Nucleotide Sequences, Use as Diagnostic Markers, and Assays and Methods of Use thereof.

Application No. 60/539,129 filed Jan. 27, 2004—Methods and Systems for Annotating Biomolecular Sequences Application No. 60/539,128 filed Jan. 27, 2004—Evolutionary Conserved Spliced Sequences and Methods and Systems for Identifying thereof

FIELD OF THE INVENTION

The present invention is related to novel nucleotide sequences that are useful as diagnostic markers, and assays and methods of use thereof.

BACKGROUND OF THE INVENTION

Nucleic Acid Testing (NAT) is a subset of molecular diagnostic markers, based on testing for the presence of a nucleic acid sequence in a sample, associated with a certain condition (most often a clinical pathology). The sample could be a body fluid, a tissue sample, a body secretion or any other sample obtained from a patient which could contain the targeted nucleic acids.

Traditionally, NAT diagnosis has been used for the diagnosis of infectious diseases. Particularly, it has been used for the diagnosis of HIV, Hepatitis C Virus (HCV), Hepatitis B Virus (HBV), *Chlamydia trachomatis, Neisseria gonorrhoeae* and *Mycobacteria tuberculosis*. In recent years NAT diagnosis has expanded to noninfectious diseases, for example, for the diagnosis of prostate cancer based on DD3 (PCA3). DD3 (PCA3) is a very prostate cancer-specific gene. It has shown a great diagnostic value for prostate cancer by measuring quantitatively the DD3 (PCA3) transcript in urine sediments obtained after prostatic massage. DD3 (PCA3) is a non-coding transcript, therefore diagnosis in the protein level is not possible. More NAT markers for more cancers in addition to prostate cancer are currently pursued.

NAT diagnostic markers have at least four advantages on protein based diagnostic modalities:

1. They are likely to be more sensitive and specific (as has been shown for diagnostic kits for HIV and HCV). This finding could be related to at least two things:
   a. The test analyte could be amplified (e.g. with PCR)
   b. The detection method is sequence specific rather than epitope specific
2. They allow diagnosis even if a differentially expressed transcript is non-coding (as in the case of DD3 (PCA3))
3. The research tools for the discovery of novel NAT markers are much more advanced and robust than for protein markers (e.g. advanced DNA chip technology compared with protein chip technology)
4. NAT analytes are sometimes found in body secretions and/or body fluids and therefore could replace the need for a tissue biopsy when a serum marker is not available.

However, NAT markers suffer from a few disadvantages including:

1. The analyte itself is quite an unstable molecule (certainly when compared with a protein).
2. The analyte itself is by nature not physiologically secreted, therefore it is not always easily found in samples.

NAT markers development for noninfectious diseases was not pursued for a long time, which was mostly a result of expensive and not fully developed detection methods on one hand and intellectual property barriers on the other. With the advance in technology and expiration of key patents in the field, the industry is investing more and more resources in that direction and it seems that NAT based tests are going to be much more prevalent for noninfectious diseases in the future.

SUMMARY OF THE INVENTION

The present invention overcomes deficiencies of the background art by providing novel variants that are suitable for use with NAT and/or nucleic acid hybridization methods and assays, which may optionally be used as diagnostic markers. Collectively, methods and assays that are suitable for detecting a nucleic acid sequence (oligonucleotides) are referred to herein as "oligonucleotide detection technologies", including but not limited to NAT and hybridization technologies. The markers of the present invention may optionally be used with any such oligonucleotide detection technology.

The markers are useful for detecting variant-detectable diseases (marker-detectable diseases), wherein these diseases and/or pathological states and/or conditions are described in greater detail below with regard to the different clusters (genes) below.

Preferably these variants are useful as diagnostic markers for variant-detectable diseases.

According to one embodiment of the present invention markers are specifically released to the bloodstream under disease conditions according to one of the above differential variant marker conditions.

The present invention therefore also relates to diagnostic assays for disease detection optionally and preferably in a sample taken from a subject (patient), which is more preferably some type of blood sample or body secretion sample. The assays are optionally NAT (nucleic acid amplification technology)-based assays, such as PCR for example (or variations thereof such as real-time PCR for example). The assays may also optionally encompass nucleic acid hybridization assays. The assays may optionally be qualitative or quantitative.

The present invention also relates to kits based upon such diagnostic methods or assays.

In certain embodiments, the sample taken from the subject can be selected from one or more of blood, serum, plasma, blood cells, urine, sputum, saliva, stool, spinal fluid, lymph fluid, the external sections of the skin, respiratory, intestinal, and genitourinary tracts, tears, milk, neuronal tissue, pleural fluid, peritoneal fluid, cyst fluid, including ovarian cyst fluid, and any human organ and tissue.

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant nucleic acid sequence in a biological sample, comprising: hybridizing the isolated nucleic acid molecules or oligonucleotide fragments of at least about 12 nucleotides thereof to a nucleic acid material of a biological sample and detecting a hybridization complex; wherein the presence of a hybridization complex correlates with the presence of a splice variant nucleic acid sequence in the biological sample.

According to the present invention, the splice variant nucleic acid sequences described herein are non-limiting examples of markers for diagnosing the below described disease condition(s). Each splice variant nucleic acid sequence marker of the present invention can be used alone or in combination, for various uses, including but not limited to, prognosis, prediction, screening, early diagnosis, determination of progression, therapy selection and treatment monitoring of one of the above-described diseases.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

Although optionally any method may be used to detect the presence (for example in the blood) and/or differential expression of this marker, optionally a NAT-based technology is used. Therefore, optionally and preferably, any nucleic acid molecule capable of selectively hybridizing to a nucleic acid of a splice variant marker as previously defined is also encompassed within the present invention.

According to other preferred embodiments of the present invention, a splice variant nucleic acid sequence or a fragment thereof, may be featured as a biomarker for detecting a variant-detectable disease, such that a biomarker may optionally comprise any of the above.

According to still other preferred embodiments, the present invention optionally and preferably encompasses any amino acid sequence or fragment thereof encoded by a nucleic acid sequence as described herein. The present invention also optionally and preferably encompasses any nucleic acid sequence or fragment thereof, or amino acid sequence or fragment thereof, corresponding to a splice variant nucleic acid sequence of the present invention as described above, optionally for any application.

According to still other optional but preferred embodiments of the present invention, a variant according to the present invention may be a marker for one or more of the diseases and/or pathologies as described above.

Information is given in the text with regard to SNPs (single nucleotide polymorphisms). A description of the abbreviations is as follows. "T→C", for example, means that the SNP results in a change at the position given in the table from T to C. Similarly, "M→Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows to construct links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number.

Information is given with regard to overexpression of a cluster in cancer based on ESTs. A key to the p values with regard to the analysis of such overexpression is as follows:

library-based statistics: P-value without including the level of expression in cell-lines (P1)

library based statistics: P-value including the level of expression in cell-lines (P2)

EST clone statistics: P-value without including the level of expression in cell-lines (SP1)

EST clone statistics: predicted overexpression ratio without including the level of expression in cell-lines (R3)

EST clone statistics: P-value including the level of expression in cell-lines (SP2)

EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. The microarray fabrication procedure is described in detail in Materials and Experimental Procedures section herein.

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below:

"BONE" for "bone";
"COL" for "colon";
"EPI" for "epithelial";
"GEN" for "general";
"LIVER" for "liver";
"LUN" for "lung";
"LYMPH" for "lymph nodes";
"MARROW" for "bone marrow";
"OVA" for "ovary";
"PANCREAS" for "pancreas";
"PRO" for "prostate";
"STOMACH" for "stomach";
"TCELL" for "T cells";
"THYROID" for "Thyroid";
"MAM" for "breast";
"BRAIN" for "brain";

"UTERUS" for "uterus";
"SKIN" for "skin";
"KIDNEY" for "kidney";
"MUSCLE" for "muscle";
"ADREN" for "adrenal";
"HEAD" for "head and neck";
"BLADDER" for "bladder";

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

ASSAYS, TERMS AND DEFINITIONS

As used herein the phrase "disease" includes any type of pathology and/or damage, including both chronic and acute damage, as well as a progress from acute to chronic damage.

The term "marker" in the context of the present invention refers to a nucleic acid fragment, which is differentially present in a sample taken from patients having one of the above-described diseases or conditions, as compared to a comparable sample taken from subjects who do not have one the above-described diseases or conditions.

The phrase "differentially present" refers to differences in the quantity of a marker present in a sample taken from patients having one of the above-described diseases or conditions as compared to a comparable sample taken from patients who do not have one of the above-described diseases or conditions. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. It should be noted that if the marker is detectable in one sample and not detectable in the other, then such a marker can be considered to be differentially present. Optionally, a relatively low amount of up-regulation may serve as the marker, as described above. One of ordinary skill in the art could easily determine such relative levels of the markers; further guidance is provided in the description of each individual marker below.

The term "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the term "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide of the present invention in a biological sample obtained from the subject, wherein the level determined can be correlated with predisposition to, or presence or absence of the disease.

As used herein, the term "level" refers to expression levels of RNA or to DNA copy number of a marker of the present invention.

Typically the level of the marker in a biological sample obtained from the subject is different (i.e., increased or decreased) from the level of the same variant in a similar sample obtained from a healthy individual.

As used herein "a biological sample" refers to a sample of tissue or fluid isolated from a subject, including but not limited to, for example, plasma, serum, spinal fluid, lymph fluid, the external sections of the skin, respiratory, intestinal, and genitourinary tracts, tears, saliva, sputum, milk, whole blood or any blood fraction, blood cells, tumors, neuronal tissue, organs or any other types of tissue, any sample obtained by lavage (for example of the bronchial system), and also samples of in vivo cell culture constituents.

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage.

Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification, and/or a decreased expression, of the variant as opposed to the normal tissues.

A "test amount" of a marker refers to an amount of a marker present in a sample being tested. A test amount can be either in absolute amount (e.g., microgram/ml) or a relative amount (e.g., relative intensity of signals).

A "diagnostic amount" of a marker refers to an amount of a marker in a subject's sample that is consistent with a diagnosis of a variant-detectable disease. A diagnostic amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with variant-detectable disease or a person without variant-detectable disease. A control amount can be either in absolute amount (e.g., microgram/ml) or a relative amount (e.g., relative intensity of signals).

"Substrate" refers to a solid phase onto which an adsorbent can be provided (e.g., by attachment, deposition, etc.)

"Adsorbent" refers to any material capable of adsorbing a marker. The term "adsorbent" is used herein to refer both to a single material ("monoplex adsorbent") (e.g., a compound or functional group) to which the marker is exposed, and to a plurality of different materials ("multiplex adsorbent") to which the marker is exposed. The adsorbent materials in a multiplex adsorbent are referred to as "adsorbent species." For example, an addressable location on a probe substrate can comprise a multiplex adsorbent characterized by many different adsorbent species (e.g., anion exchange materials, metal chelators, or antibodies), having different binding characteristics. Substrate material itself can also contribute to adsorbing a marker and may be considered part of an "adsorbent."

"Adsorption" or "retention" refers to the detectable binding between an absorbent and a marker either before or after washing with an eluant (selectivity threshold modifier) or a washing solution.

"Eluant" or "washing solution" refers to an agent that can be used to mediate adsorption of a marker to an adsorbent. Eluants and washing solutions can be used to wash and remove unbound materials from the probe substrate surface.

"Detect" refers to identifying the presence, absence or amount of the object to be detected.

"Detectable moiety" or a "label" refers to a composition detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, or nucleic acid molecules with a sequence complementary to a target. The detectable moiety often generates a measurable signal, such as a radioactive, chromogenic, or fluorescent signal, that can be used to quantify the amount of bound detectable moiety in a sample. The detectable moiety can be incorporated in or attached to a primer or probe either covalently, or through ionic, van der Waals or hydrogen bonds, e.g., incorporation of radioactive nucleotides, or biotinylated nucleotides that are recognized by streptavadin. The detectable moiety may be directly or indirectly detectable. Indirect detection can involve the binding of a second directly or indirectly detectable moiety to the detectable moiety. For example, the detectable moiety can be a nucleotide sequence, which is the binding partner for a complementary sequence, to which it can specifically hybridize. The binding partner may itself be directly detectable, for example, the partner may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Nucleic Acids

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Thus, the present invention encompasses nucleic acid sequences described hereinabove; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or artificially induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

Thus, the present invention also encompasses polypeptides encoded by the polynucleotide sequences of the present invention. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the SEG (protein) program), scoring matrix is BLOSUM62 for proteins, word size is 3, E value is 10, gap costs are 11, 1 (initialization and extension), and number of alignments shown is 50. Finally, the present invention also encompasses fragments of the above described polypeptides and polypeptides having mutations, such as deletions, insertions or substitutions of one or more amino acids, either naturally occurring or artificially induced, either randomly or in a targeted fashion.

As mentioned hereinabove, biomolecular sequences uncovered using the methodology of the present invention can be efficiently utilized as tissue or pathological markers and as putative drugs or drug targets for treating or preventing a disease.

Oligonucleotides designed for carrying out the methods of the present invention for any of the sequences provided herein (designed as described above) can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases.

The oligonucleotides of the present invention may comprise heterocylic nucleosides consisting of purine and pyrimidine bases, bonded in a 3' to 5' phosphodiester linkage.

Preferably used oligonucleotides are those modified at one or more of backbone, internucleoside linkages or bases, as is broadly described hereinunder. Such modifications can oftentimes facilitate oligonucleotide uptake and resistivity to intracellular conditions.

Specific non-limiting examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, for example, are those modified in both sugar and the internucleoside linkage, i.e., the backbone, of the nucleotide units are replaced with novel groups. The base units are maintained for complementation with the appropriate polynucleotide target. An example for such an oligonucleotide mimetic includes but is not limited to peptide nucleic acid (PNA). A PNA oligonucleotide refers to an oligonucleotide where the sugar-backbone is replaced with an amide containing backbone, in particular an aminoethylglycine backbone. The bases are retained and are bound directly or indirectly to aza nitrogen atoms of the amide portion of the backbone. United States patents that teach the preparation of PNA compounds include, but are not limited to, U.S. Pat. Nos. 5,539,082; 5,714,331; and 5,719,262, each of which is herein incorporated by reference. Other non-limiting backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases include those disclosed in U.S. Pat. No. 3,687,808, those disclosed in The Concise Encyclopedia Of Polymer Science and Engineering, pages 858-859, Kroschwitz, J. I., ed. John Wiley & Sons, 1990, those disclosed by Englisch et al., Angewandte Chemie, International Edition, 1991, 30, 613, and those disclosed by Sanghvi, Y. S., Chapter 15, Antisense Research and Applications, pages 289-302, Crooke, S. T. and Lebleu, B., ed., CRC Press, 1993. Such bases are particularly useful for increasing the binding affinity of the oligomeric compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. [Sanghvi Y S et al. (1993) Antisense Research and Applications, CRC Press, Boca Raton 276-278] and are optional but preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy-cholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

DESCRIPTION OF PREFERRED EMBODIMENTS

The present invention provides novel variants, which may optionally be used as diagnostic markers.

Preferably these variants are useful as diagnostic markers for variant-detectable diseases.

Differential variant markers are collectively described as "variant disease markers".

Hybridization Assays

Detection of a nucleic acid of interest in a biological sample may optionally be effected by hybridization-based assays using an oligonucleotide probe (non-limiting examples of probes according to the present invention are described in greater detail below).

Hybridization based assays which allow the detection of a variant of interest (i.e., DNA or RNA) in a biological sample rely on the use of oligonucleotide which can be 10, 15, 20, or 30 to 100 nucleotides long preferably from 10 to 50, more preferably from 40 to 50 nucleotides long.

Hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif] can be attached to the oligonucleotides.

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Although the present invention is not specifically dependent on the use of a label for the detection of a particular nucleic acid sequence, such a label might be beneficial, by increasing the sensitivity of the detection.

Furthermore, it enables automation. Probes can be labeled according to numerous well known methods (Sambrook et al., 1989, supra). Non-limiting examples of radioactive labels include $^3$H, $^{14}$C, $^{32}$P, and $^{35}$S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

As commonly known, radioactive nucleotides can be incorporated into probes of the invention by several methods. Non-limiting examples thereof include kinasing the 5' ends of the probes using gamma ATP and polynucleotide kinase, using the Klenow fragment of Pol I of *E. coli* in the presence of radioactive dNTP (i.e. uniformly labeled DNA probe using random oligonucleotide primers in low-melt gels), using the SP6/T7 system to transcribe a DNA segment in the presence of one or more radioactive NTP, and the like.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Probes of the invention can be utilized with naturally occurring sugar-phosphate backbones as well as modified backbones including phosphorothioates, dithionates, alkyl phosphonates and a-nucleotides and the like. Modified sugar-phosphate backbones are generally taught by Miller, 1988, Ann. Reports Med. Chem. 23:295 and Moran et al., 1987, Nucleic acid molecule. Acids Res., 14:5019. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

Polymerase chain reaction (PCR) is carried out in accordance with known techniques, as described for example, in U.S. Pat. Nos. 4,683,195; 4,7683,202; 4,800,159; and 4,965,188 (the disclosures of all three U.S. patents are incorporated herein by reference). In general, PCR involves a treatment of a nucleic acid sample (e.g., in the presence of a heat stable DNA polymerase) under hybridizing conditions, with one oligonucleotide primer for each strand of the specific sequence to be detected. An extension product of each primer which is synthesized is complementary to each of the two nucleic acid strands, with the primers sufficiently complementary to each strand of the specific sequence to hybridize therewith. The extension product synthesized from each primer can also serve as a template for further synthesis of extension products using the same primers. Following a sufficient number of rounds of synthesis of extension products, the sample is analyzed to assess whether the sequence or sequences to be detected are present. Detection of the amplified sequence may be carried out by visualization following EtBr staining of the DNA following gel electrophores, or using a detectable label in accordance with known techniques, and the like. For a review of PCR techniques, see PCR Protocols, A Guide to Methods and Amplifications, Michael et al. Eds, Acad. Press, 1990.

As used herein, a "primer" defines an oligonucleotide which is capable of annealing to a target sequence, thereby creating a double stranded region which can serve as an initiation point for DNA synthesis under suitable conditions.

Ligase chain reaction (LCR) is carried out in accordance with known techniques (Weiss, 1991, Science 254:1292). Adaptation of the protocol to meet the desired needs can be carried out by a person of ordinary skill. Strand displacement amplification (SDA) is also carried out in accordance with known techniques or adaptations thereof to meet the 1 5 particular needs (Walker et al., 1992, Proc. Natl. Acad. Sci. USA 89:392-396; and ibid., 1992, Nucleic Acids Res. 20:1691-1696).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. In general, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (see below and in Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

Oligonucleotide Probes

Oligonucleotides according to the present invention may optionally be used as molecular probes as described herein. Such probes are useful for hybridization assays, and also for NAT assays (as primers, for example).

Thus, the present invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

Typically, detection of a nucleic acid of interest in a biological sample is effected by hybridization-based assays using an oligonucleotide probe.

The term "oligonucleotide" refers to a single stranded or double stranded oligomer or polymer of ribonucleic acid (RNA) or deoxyribonucleic acid (DNA) or mimetics thereof. This term includes oligonucleotides composed of naturally-occurring bases, sugars and covalent internucleoside linkages (e.g., backbone) as well as oligonucleotides having non-naturally-occurring portions which function similarly to respective naturally-occurring portions. An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

The oligonucleotide of the present invention is of at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466, 677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). A PNA oligonucleotide refers to an oligonucleotide where the sugar-backbone is replaced with an amide containing backbone, in particular an aminoethylglycine backbone. The bases are retained and are bound directly or indirectly to aza nitrogen atoms of the amide portion of the backbone. United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et al., Angewandte Chemie, International Edition, 1991, 30, 613, and those disclosed by Sanghvi, Y. S., Chapter 15, Antisense Research and Applications, pages 289-302, Crooke, S. T. and Lebleu, B., ed., CRC Press, 1993. Such bases are particularly useful for increasing the binding affinity of the oligomeric compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. [Sanghvi Y S et al. (1993) Antisense Research and Applications, CRC Press, Boca Raton 276-278] and are presently preferred base substitutions, even more particularly when combined with 2'-O-methoxyethyl sugar modifications.

It will be appreciated that oligonucleotides of the present invention may include further modifications which increase bioavailability, therapeutic efficacy and reduce cytotoxicity. Such modifications are described in Younes (2002) Current Pharmaceutical Design 8:1451-1466.

The isolated polynucleotides of the present invention can optionally be detected (and optionally quantified) by using hybridization assays. Thus, the isolated polynucleotides of the present invention are preferably hybridizable with any of the above described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and 5×10$^6$ cpm $^{32}$P labeled probe, at 65° C., with a final wash solution of 1×SSC and 0.1% SDS and final wash at 50° C.

Hybridization based assays which allow the detection of the biomarkers of the present invention (i.e., DNA or RNA) in a biological sample rely on the use of oligonucleotides which can be 10, 15, 20, or 30 to 100 nucleotides long, preferably from 10 to 50, and more preferably from 40 to 50 nucleotides.

Hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACI, 0.01 M sodium phosphate (pH 6.8), 1 mM EDTA (pH 7.6), 0.5% SDS, 100 μg/ml denatured salmon sperm DNA and 0.1% nonfat dried milk, hybridization temperature of 1-1.5° C. below the $T_m$, final wash solution of 3 M TMACI, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACI, 0.01 M sodium phosphate (pH 6.8), 1 mM EDTA (pH 7.6), 0.5% SDS, 100 μg/ml denatured salmon sperm DNA and 0.1% nonfat dried milk, hybridization temperature of 2-2.5° C. below the $T_m$, final wash solution of 3 M TMACI, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACI, 0.01 M sodium phosphate (pH 6.8), 1 mM EDTA (pH 7.6), 0.5% SDS, 100 μg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample (target).

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, Fluor X (Amersham) and others [e.g., Kricka et al. (1992), Academic Press San Diego, Calif] can be attached to the oligonucleotides.

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Although the present invention is not specifically dependent on the use of a label for the detection of a particular nucleic acid sequence, such a label might be beneficial, by increasing the sensitivity of the detection.

Furthermore, it enables automation. Probes can be labeled according to numerous well known methods (Sambrook et al., 1989, supra). Non-limiting examples of radioactive labels include 3H, 14C, 32P, and 35S, Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

As commonly known, radioactive nucleotides can be incorporated into probes of the invention by several methods. Non-limiting examples thereof include kinasing the 5' ends of the probes using gamma ATP and polynucleotide kinase, using the Klenow fragment of Pol I of *E. coli* in the presence of radioactive dNTP (i.e. uniformly labeled DNA probe using random oligonucleotide primers in low-melt gels), using the SP6/T7 system to transcribe a DNA segment in the presence of one or more radioactive NTP, and the like.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Probes of the invention can be utilized with naturally occurring sugar-phosphate backbones as well as modified backbones including phosphorothioates, dithionates, alkyl phosphonates and a-nucleotides and the like. Modified sugar-phosphate backbones are generally taught by Miller, 1988, Ann. Reports Med. Chem. 23:295 and Moran et al., 1987, Nucleic acid molecule. Acids Res., 14:5019. Probes of the invention can be constructed of either ribonucleic acid (RNA) or deoxyribonucleic acid (DNA), and preferably of DNA.

Detection (and optionally quantification) of a nucleic acid of interest in a biological sample may also optionally be effected by NAT-based assays, which involve nucleic acid amplification technology, such as PCR for example (or variations thereof such as real-time PCR for example).

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

Polymerase chain reaction (PCR) is carried out in accordance with known techniques, as described for example, in U.S. Pat. Nos. 4,683,195; 4,7683,202; 4,800,159; and 4,965, 188 (the disclosures of all three U.S. patents are incorporated herein by reference). In general, PCR involves a treatment of a nucleic acid sample (e.g., in the presence of a heat stable DNA polymerase) under hybridizing conditions, with one oligonucleotide primer for each strand of the specific sequence to be detected. An extension product of each primer which is synthesized is complementary to each of the two nucleic acid strands, with the primers sufficiently complementary to each strand of the specific sequence to hybridize therewith. The extension product synthesized from each primer can also serve as a template for further synthesis of extension products using the same primers. Following a sufficient number of rounds of synthesis of extension products, the sample is analyzed to assess whether the sequence or sequences to be detected are present. Detection of the amplified sequence may be carried out by visualization following EtBr staining of the DNA following gel electrophores, or using a detectable label in accordance with known techniques, and the like. For a review of PCR techniques, see PCR Protocols, A Guide to Methods and Amplifications, Michael et al. Eds, Acad. Press, 1990.

As used herein, a "primer" defines an oligonucleotide which is capable of annealing to a target sequence, thereby creating a double stranded region which can serve as an initiation point for DNA synthesis under suitable conditions.

Ligase chain reaction (LCR) is carried out in accordance with known techniques (Weiss, 1991, Science 254:1292). Adaptation of the protocol to meet the desired needs can be carried out by a person of ordinary skill. Strand displacement amplification (SDA) is also carried out in accordance with known techniques or adaptations thereof to meet the 1 5 particular needs (Walker et al., 1992, Proc. NatI. Acad. Sci. USA 89:392-396; and ibid., 1992, Nucleic Acids Res. 20:1691-1696).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. In general, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (see below and in Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity [see Sazani and Kole (2003), supra].

Polymerase chain reaction (PCR)-based methods may be used to identify the presence of mRNA of the markers of the present invention. For PCR-based methods a pair of oligonucleotides is used, which is specifically hybridizable with the polynucleotide sequences described hereinabove in an opposite orientation so as to direct exponential amplification of a portion thereof (including the hereinabove described sequence alteration) in a nucleic acid amplification reaction. For example, oligonucleotide pairs of primers specifically hybridizable with nucleic acid sequences according to the present invention are described in greater detail with regard to the Examples below.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Hybridization to oligonucleotide arrays may be also used to determine expression of the biomarkers of the present invention (hybridization itself is described above). Such screening has been undertaken in the BRCA1 gene and in the protease gene of HIV-1 virus [see Hacia et al., (1996) Nat Genet. 1996; 14(4):441-447; Shoemaker et al., (1996) Nat Genet. 1996; 14(4):450-456; Kozal et al., (1996) Nat Med 1996; 2(7):753-759]. Optionally and preferably, such hybridization is combined with amplification as described herein.

The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. For example, Manz et al. (1993) Adv in Chromatogr 1993; 33:1-66 describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for ferretin light chain variant detectable disease both rapidly and easily.

According to various preferred embodiments of the methods of the present invention, determining the presence and/or level of any specific nucleic or amino acid in a biological sample obtained from, for example, a patient is effected by any one of a variety of methods including, but not limited to, a signal amplification method, a direct detection method and detection of at least one sequence change.

The signal amplification methods according to various preferred embodiments of the present invention may amplify, for example, a DNA molecule or an RNA molecule. Signal amplification methods which might be used as part of the present invention include, but are not limited to PCR, LCR (LAR), Self-Sustained Synthetic Reaction (3SR/NASBA) or a Q-Beta (Qβ) Replicase reaction.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] described by Barany, Proc. Natl. Acad. Sci., 88:189 (1991); Barany, PCR Methods and Applic., 1:5 (1991); and Wu and Wallace, Genomics 4:560 (1989) has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes; see for example Segev, PCT Publication No. W09001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) (Guatelli et al., Proc. Natl. Acad. Sci., 87:1874-1878, 1990), with an erratum at Proc. Natl. Acad. Sci., 87:7797, 1990) is a transcription-based in vitro amplification system (Kwok et al., Proc. Natl. Acad. Sci., 86:1173-1177, 1989) that can exponentially amplify RNA sequences at a uniform temperature. The amplified RNA can then be utilized for mutation detection (Fahy et al., PCR Meth. Appl., 1:25-33, 1991). In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction (Mullis, PCR Methods Applic., 1:1, 1991). If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect (Kwok et al., Nucl. Acids Res., 18:999, 1990)

A similar 3'-mismatch strategy is used with greater effect to prevent ligation in the LCR (Barany, PCR Meth. Applic., 1:5, 1991). Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Traditional methods of direct detection including Northern and Southern band RNase protection assays usually require the use of radioactivity and are not amenable to automation. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR) (Duck et al., BioTech., 9:142, 1990), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), described by Urdea et al., Gene 61:253-264 (1987), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC) (Gogos et al., Nucl. Acids Res., 18:6807-6817, 1990). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations (Eckstein and Lilley (eds.), Nucleic Acids and Molecular Biology, vol. 2, Springer-Verlag, Heidelberg, 1988). Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered (Barlow and Lehrach, Trends Genet., 3:167, 1987). Recently, endonucleases encoded by group I introns have been discovered that might have greater than 12 base-pair specificity (Perlman and Butow, Science 246:1106, 1989), but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations (Conner et al., Proc. Natl. Acad. Sci., 80:278-282, 1983). The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes (Vogelstein et al., N. Eng. J. Med., 319:525-532, 1988; and Farr et al., Proc. Natl. Acad. Sci., 85:1629-1633, 1988), and gsp/gip oncogenes (Lyons et al., Science 249:655-659, 1990). Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE (Abrams et al., Genomics 7:463-475, 1990). Attaching a GC clamp to one primer is critical to ensure that the amplified sequence has a low dissociation temperature (Sheffield et al., Proc. Natl. Acad. Sci., 86:232-236, 1989; and Lerman and Silverstein, Meth. Enzymol., 155:482-501, 1987). Modifications of the technique have been developed, using temperature gradients (Wartell et al., Nucl. Acids Res., 18:2699-2701, 1990), and the method can be also applied to RNA:RNA duplexes (Smith et al., Genomics 3:217-223, 1988).

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE) (Borrensen et al., Proc. Natl. Acad. Sci. USA 88:8405, 1991). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient (Scholz, et al., Hum. Mol. Genet. 2:2155, 1993). TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues (reviewed by Hayashi, PCR Meth. Appl., 1:34-38, 1991) and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations (Orita, et al., Genomics 5:874-879, 1989).

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations (Liu and Sommer, PCR Methods Appli., 4:97, 1994). The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for the mutation or mutations in any of the genes listed above, such as, for example, the reduced folate carrier (RFC) gene, in tumor cells or in cells derived from a cancer patient is effected by a single strand conformational polymorphism (SSCP) technique, such as cDNA-SSCP or genomic DNA-SSCP. However, alternative methods can be employed, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

The following sections relate to Candidate Marker Examples (first section).

CANDIDATE MARKER EXAMPLES SECTION

This Section relates to Examples of sequences according to the present invention, including illustrative methods of selection thereof.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1

Identification of Differentially Expressed Gene Products

Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to:

Tissue origin

Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.

Protocol of library construction—various methods are known in the art for library construction including normalized library construction; non-normalized library construction; subtracted libraries; ORESTES and others. It will be appreciated that at times the protocol of library construction is not indicated.

The following rules are followed:

EST libraries originating from identical biological samples are considered as a single library.

EST libraries which include above-average levels of DNA contamination are eliminated.

Dry computation—development of engines which are capable of identifying genes and splice variants that are temporally and spacially expressed.

Clusters (genes) having at least five sequences including at least two sequences from the tissue of interest are analyzed.

Example 2

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The Algorithm—

Clone counting: For counting EST clones each library protocol class was given a weight based on our belief of how much the protocol reflects real expression levels:
(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{\frac{c+1}{C}}{\frac{n+1}{N}}$$

where:
c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.
Libraries/sequences originating from tumor tissues are counted as well as libraries originating from cancer cell-lines ("normal" cell-lines were ignored).
Only libraries/sequences originating from tumor tissues are counted Example 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:
1. Each cluster includes at least 2 libraries from the tissue T. At least 3 clones (weighed—as described above) from tissue T in the cluster; and
2. Clones from the tissue T are at least 40% from all the clones participating in the tested cluster Fisher exact test P-values were computed both for library and weighted clone counts to check that the counts are statistically significant.

Example 4

Identification of Splice Variants Over Expressed in Cancer of Clusters which are not Over Expressed in Cancer Cancer-specific splice variants containing a unique region were identified.

Identification of Unique Sequence Regions in Splice Variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:
(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:
(i) Aligned to the genome; and
(ii) Regions supported by more than 2 ESTs.

The Algorithm

Each unique sequence region divides the set of transcripts into 2 groups:
(i) Transcripts containing this region (group TA).
(ii) Transcripts not containing this region (group TB).

The set of EST clones of every cluster is divided into 3 groups:
(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:
S1 is significantly enriched by cancer EST clones compared to S2; and
S1 is significantly enriched by cancer EST clones compared to cluster background (S1+S2+S3).

Identification of unique sequence regions and division of the group of transcripts accordingly is illustrated in FIG. 2. Each of these unique sequence regions corresponds to a segment, also termed herein a "node".

Region 1: common to all transcripts, thus it is not considered; Region 2: specific to Transcript 1: T__1 unique regions (2+6) against T__2+3 unique regions (3+4); Region 3: specific to Transcripts 2+3: T__2+3 unique regions (3+4) against T1 unique regions (2+6); Region 4: specific to Transcript 3: T__3 unique regions (4) against T1+2 unique regions (2+5+6); Region 5: specific to Transcript 1+2: T__1+2 unique regions (2+5+6) against T3 unique regions (4); Region 6: specific to Transcript 1: same as region 2.

Example 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:

(i) 3 spliced ESTs; or
(ii) 2 spliced ESTs from 2 libraries;
(iii) 10 unspliced ESTs from 2 libraries, or
(iv) 3 libraries.

Actual Marker Examples

The following examples relate to specific actual marker examples. It should be noted that Figure and Table numbering is restarted within each example related to a particular Cluster, as indicated by the titles below. Before the cluster descriptions, there is provided a description of the categories into which each cluster falls with regard to diagnostic utility or utilities.

Heart
Z24779
C03950
C03218
AA436634
D62617
H79892
AL600896
AA722065
H88495_PEA_3
Z30117_PEA_1
Z18303_PEA_1
HSACMHCP_PEA_1
HUMANFB_PEA_1
ChipColon
HUMCA1XIA
R10078
H41850
HSB6PR
R49883
D11793
Z44716
HSCDC2
Z20721
HUMRAP1GAP
HUMCEA
R00317_PEA_1
D12335_PEA_1
T47019
S56200_PEA_1
ChipOvary
D11793
D11495
T78438
HSCDC2
HUMPROTP
HSAPHOL
HUMPAX8A
N23262
HSHE4MR_PEA_1
HSMRP1
Z38148_PEA_1
Z43749_PEA_1
Z39337_PEA_2_PEA_1
ChipBreast
Z39788
HUMCA1XIA
Z44103
R36629
R10078
W01871
R20779
R49883
R14741
HSCDC2
T11628_PEA_1
ChipLungAll
Z39788
HUMCA1XIA
F10611
Z45766
N69694
Z40569
M85976
T07775
Z44103
HUMPFK
W01871
H41850
HSB6PR
T86235
AA318609
R14741
HUMGRP5E
Z44716
T78438
HUMDNAPOLD
HSCDC2
HUMPROTP
T11832

HUMTLEII
M62246
M79217_PEA_1
M62096_PEA_1
F09066
T99080_PEA_4
HUMHOXAB_PEA_1
Z43749_PEA_1
ChipLungAC
HUMCA1XIA
Z44103
HUMPFK
D11793
T86235
T78438
T11628_PEA_1
ChipLungSCC
Z39788
F10611
Z45766
N69694
Z40569
M85976
T07775
R10078
HUMPFK
W01871
T86235
AA318609
R14741
HUMGRP5E
Z44716
HUMDNAPOLD
HSCDC2
HSCYTK
HUMPROTP
T11832
HUMTLEII
M62246
HUMRAP1GAP
M79217_PEA_1
M62096_PEA_1
F09066
T99080_PEA_4
HUMHOXAB_PEA_1

Z43749_PEA_1
ChipLungSQ
HUMCA1XIA
HUMKERK5A
F10611
Z44103
W01871
H41850
HSB6PR
T86235
AA318609
HSCDC2
T11832
M62246
HUMCEA_PEA_1
S56200_PEA_1
TAA_GEN
AA056634
HUMCA1XIA
HUMKER56K
HSBMYB
HUMKERK5A
N50847
T51634
F10611
Z45766
N69694
Z40569
M85976
D12232
R36629
R10078
HUMPFK
W01871
R60180
M78378
AA604379
HUMMPP2X
R20779
HSB6PR
D11793
T55968
T86235
D11495
HSU03911

Z19129
HSKERELP
Z44716
Z40494
HSAE2
T78438
T93947
HUMASH1A
T66935
R34204
D12392
HUMDNAPOLD
T78346
Z21997
HSCDC2
HUMPKM2L
HSCYTK
W25389
Z25166
T41334
T11832
M79251
HUMETR103
F13779
AA563651
T06117
HUMSTPK13
R82331
HUMCYCB
D11717
T07560
HUMPAX8A
Z20721
T19724
AA091457
HUMKERMII
R34187
HUMGGTX_PEA_1
HUMCEA_PEA_1
R00317_PEA_1
D12335_PEA_1
T46984_PEA_1
Z38219_PEA_1
Z28497_PEA_1
HSRR2SS_PEA_1

HUMHOXAB_PEA_1
Z43749_PEA_1
HSLDHAR_PEA_3
R31990_PEA_1
HSUDGM_PEA_1
AA056634
HUMCA1XIA
HSBMYB
N50847
T51634
F10611
Z45766
N69694
Z40569
M85976
D12232
R36629
R10078
HUMPFK
W01871
R60180
M78378
AA604379
HUMMPP2X
R20779
T49823
D11793
T55968
T86235
D11495
HSU03911
AA318609
HSKERELP
Z44716
Z40494
T78438
T93947
HUMASH1A
T66935
R34204
D12392
HUMDNAPOLD
T78346
Z21997
HSCDC2

T86345
HUMPKM2L
W25389
Z25166
T11832
M79251
F13779
AA563651
HUMSTPK13
R82331
HUMCYCB
R17570
D11717
HUMPAX8A
Z20721
T19724
M62246
AA091457
R34187
HUMCEA_PEA_1
R00317_PEA_1
D12335_PEA_1
T46984_PEA_1
Z38219_PEA_1
Z28497_PEA_1
HSRR2SS_PEA_1
HUMHOXAB_PEA_1
Z43749_PEA_1
Z39337_PEA_2_PEA_1
R31990_PEA_1
HSUDGM_PEA_1
TAA_OVA
HSBMYB
D11793
T78438
T10374
T78346
HUMPKM2L
Z25166
T59832
R82331
M78445
M77903
HUMPAX8A
T19724
HUMKERMII
HSHE4MR_PEA_1
HSMRP1
T46984_PEA_1
Z38219_PEA_1
HSLDHAR_PEA_3
TAA_PRO
R47363
M78378
T07259
HSEF2
D11495
HSAE2
M85927
R52151
Z19214
HUMETR103
TAA_MAM
Z19204
HUMIFN15K
T78438
T78346
Z21997
HSCDC2
T59832
HUMCYCB
T07560
Z20721
T46984_PEA_1
TAA_COL
T10476
M85976
D12232
Z38489
D11495
Z19129
Z19214
D11717
R00317_PEA_1
Z38219_PEA_1
Z28497_PEA_1
HSRR2SS_PEA_1
TAA_LUN
T08538
HUMCA1XIA

T51634
Z44103
HUMTIA1E
M78378
R20779
R01445
HUMASH1A
Z21997
AA563651
HUMSTPK13
M62117
D12335_PEA_1
Z38219_PEA_1
HSRR2SS_PEA_1
TAA_BLADDER
HUMKERK5A
R36629
HSKERELP
HUMKERMII
TAA_KIDNEY
HSBMYB
R60180
M78378
T41334
Z19214
HUMCYCB
T19724
HUMVWF_PEA_1
D12335_PEA_1
TAA_UTERUS
HSBMYB
T51634
D12232
R36629
R60180
AA604379
HUMMPP2X
D11495
HSKERELP
R34204
T78346
Z21997
HUMPKM2L
T41334
Z19214
HUMSTPK13
R82331
HUMCYCB
M77903
HUMPAX8A
T19724
M62189
HSHE4MR_PEA_1
Z43749_PEA_1
TAA_PANCREAS
AA056634
R47363
HUMKER56K
HSBMYB
HUMKERK5A
N50847
T51634
R60180
D11793
T55968
HSKERELP
Z40494
Z21997
HUMPKM2L
T59832
HUMSTPK13
HUMCYCB
T07560
HUMKERMII
HSTCRT3E
HUMVWF_PEA_1
HUMCEA_PEA_1
R13007
HUMMHGM
T47019
S95936_PEA_1
T46984_PEA_1
HSRR2SS_PEA_1
TAA_BRAIN
AA056634
HSBMYB
T51634
Z45766
Z40569
M85976

R36629
R10078
R60180
HSCD44E
AA604379
HUMMPP2X
R49883
T55968
T86235
HUMIFN15K
Z40494
HSAE2
T93947
HUMASH1A
M85927
HUMDNAPOLD
T78346
Z21997
HSCDC2
W25389
HUMETR103
T59832
R82331
HUMCYCB
D11717
T07560
M78001
R34187
D12335_PEA_1
HUMMHGM
HSRR2SS_PEA_1
TAA_SKIN
HSBMYB
T51634
R10078
R60180
M78378
AA604379
HUMMPP2X
T49823
T55968
T86235
Z40494
D12392
HUMDNAPOLD
Z21997
F13779
R20420
HUMSTPK13
R82331
HUMCYCB
T19724
Z38219_PEA_1
HSRR2SS_PEA_1
TAA_STOMACH
T51634
HSCD44E
R34204
T86345
HUMPKM2L
Z25166
D11717
D12335_PEA_1
HSRR2SS_PEA_1
Z39337_PEA_2_PEA_1
HSLDHAR_PEA_3

Description for Cluster Z45766

Cluster Z45766 features 17 transcript(s) and 37 segment(s) of interest, the names for which are given in Tables 1 and 2, respectively, the sequences themselves are given at the end of the application. The selected protein variants are given in Table 3.

TABLE 1

| Transcripts of interest |
| --- |
| Transcript Name |
| Z45766_T0 (SEQ ID NO: 1) |
| Z45766_T1 (SEQ ID NO: 2) |
| Z45766_T3 (SEQ ID NO: 3) |
| Z45766_T7 (SEQ ID NO: 4) |
| Z45766_T9 (SEQ ID NO: 5) |
| Z45766_T10 (SEQ ID NO: 6) |
| Z45766_T11 (SEQ ID NO: 7) |
| Z45766_T12 (SEQ ID NO: 8) |
| Z45766_T15 (SEQ ID NO: 9) |
| Z45766_T16 (SEQ ID NO: 10) |
| Z45766_T17 (SEQ ID NO: 11) |
| Z45766_T18 (SEQ ID NO: 12) |
| Z45766_T21 (SEQ ID NO: 13) |
| Z45766_T22 (SEQ ID NO: 14) |
| Z45766_T25 (SEQ ID NO: 15) |
| Z45766_T27 (SEQ ID NO: 16) |
| Z45766_T28 (SEQ ID NO: 17) |

TABLE 2

| Segments of interest |
| --- |
| Segment Name |
| Z45766_node_4 (SEQ ID NO: 18) |
| Z45766_node_8 (SEQ ID NO: 19) |
| Z45766_node_9 (SEQ ID NO: 20) |

TABLE 2-continued

Segments of interest
Segment Name

Z45766_node_12 (SEQ ID NO: 21)
Z45766_node_16 (SEQ ID NO: 22)
Z45766_node_17 (SEQ ID NO: 23)
Z45766_node_19 (SEQ ID NO: 24)
Z45766_node_22 (SEQ ID NO: 25)
Z45766_node_24 (SEQ ID NO: 26)
Z45766_node_28 (SEQ ID NO: 27)
Z45766_node_30 (SEQ ID NO: 28)
Z45766_node_33 (SEQ ID NO: 29)
Z45766_node_34 (SEQ ID NO: 30)
Z45766_node_37 (SEQ ID NO: 31)
Z45766_node_39 (SEQ ID NO: 32)
Z45766_node_42 (SEQ ID NO: 33)
Z45766_node_44 (SEQ ID NO: 34)
Z45766_node_45 (SEQ ID NO: 35)
Z45766_node_46 (SEQ ID NO: 36)
Z45766_node_47 (SEQ ID NO: 37)
Z45766_node_51 (SEQ ID NO: 38)
Z45766_node_53 (SEQ ID NO: 39)
Z45766_node_55 (SEQ ID NO: 40)
Z45766_node_0 (SEQ ID NO: 41)
Z45766_node_2 (SEQ ID NO: 42)
Z45766_node_6 (SEQ ID NO: 43)
Z45766_node_15 (SEQ ID NO: 44)
Z45766_node_20 (SEQ ID NO: 45)
Z45766_node_21 (SEQ ID NO: 46)
Z45766_node_23 (SEQ ID NO: 47)
Z45766_node_25 (SEQ ID NO: 48)
Z45766_node_26 (SEQ ID NO: 49)
Z45766_node_31 (SEQ ID NO: 50)
Z45766_node_38 (SEQ ID NO: 51)
Z45766_node_41 (SEQ ID NO: 52)
Z45766_node_50 (SEQ ID NO: 53)
Z45766_node_52 (SEQ ID NO: 54)

TABLE 3

Proteins of interest

| Protein Name | Corresponding Transcript(s) |
|---|---|
| Z45766_P2 | Z45766_T7 (SEQ ID NO: 4) |
| Z45766_P4 | Z45766_T9 (SEQ ID NO: 5) |
| Z45766_P5 | Z45766_T10 (SEQ ID NO: 6) |
| Z45766_P6 | Z45766_T11 (SEQ ID NO: 7) |
| Z45766_P7 | Z45766_T12 (SEQ ID NO: 8) |
| Z45766_P8 | Z45766_T21 (SEQ ID NO: 13) |
| Z45766_P9 | Z45766_T15 (SEQ ID NO: 9) |
| Z45766_P10 | Z45766_T16 (SEQ ID NO: 10) |
| Z45766_P11 | Z45766_T17 (SEQ ID NO: 11) |
| Z45766_P12 | Z45766_T18 (SEQ ID NO: 12) |
| Z45766_P14 | Z45766_T22 (SEQ ID NO: 14) |
| Z45766_P16 | Z45766_T25 (SEQ ID NO: 15) |
| Z45766_P17 | Z45766_T27 (SEQ ID NO: 16) |
| Z45766_P18 | Z45766_T28 (SEQ ID NO: 17) |
| Z45766_P19 | Z45766_T0 (SEQ ID NO: 1); Z45766_T1 (SEQ ID NO: 2); Z45766_T3 (SEQ ID NO: 3) |

These sequences are variants of the known protein G2 and S phase expressed protein 1 (SwissProt accession identifier GTSE_HUMAN; known also according to the synonyms B99 homolog), referred to herein as the previously known protein.

Protein G2 and S phase expressed protein 1 is known or believed to have the following function(s): May be involved in p53-induced cell cycle arrest in G2/M phase by interfering with microtubule rearrangements that are required to enter mitosis. Overexpression delays G2/M phase progression. The sequence for protein G2 and S phase expressed protein 1 is given at the end of the application, as "G2 and S phase expressed protein 1 amino acid sequence". Known polymorphisms for this sequence are as shown in Table 4.

TABLE 4

Amino acid mutations for Known Protein

| SNP position(s) on amino acid sequence | Comment |
|---|---|
| 259 | V -> I |
| 506 | R -> W |

Protein G2 and S phase expressed protein 1 localization is believed to be Cytoplasmic. Associated with microtubules.

The following GO Annotation(s) apply to the previously known protein. The following annotation(s) were found: G2 phase of mitotic cell cycle; DNA damage response, induction of cell arrest by p53; microtubule-based process, which are annotation(s) related to Biological Process; and cytoplasmic microtubule, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster Z45766 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 3 below refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 3 and Table 5. This cluster is overexpressed (at least at a minimum level) in the following pathological conditions: brain malignant tumors, epithelial malignant tumors and a mixture of malignant tumors from different tissues.

TABLE 5

Normal tissue distribution

| Name of Tissue | Number |
|---|---|
| Adrenal | 0 |
| Bone | 0 |
| Brain | 0 |
| Colon | 0 |
| Epithelial | 4 |
| General | 6 |
| Kidney | 2 |
| Liver | 0 |
| Lung | 0 |
| lymph nodes | 75 |
| Breast | 0 |
| bone marrow | 62 |
| Muscle | 0 |
| Ovary | 0 |
| Pancreas | 0 |
| Prostate | 0 |
| Skin | 13 |
| Stomach | 0 |
| T cells | 557 |
| Uterus | 45 |

TABLE 6

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| Bone | 1 | 1.2e−01 | 1 | 1.0 | 4.9e−01 | 2.0 |
| Brain | 5.8e−02 | 8.9e−03 | 4.8e−02 | 6.8 | 4.4e−05 | 12.1 |
| Colon | 3.6e−02 | 6.5e−02 | 4.9e−01 | 2.1 | 5.9e−01 | 1.8 |
| epithelial | 6.2e−04 | 1.7e−06 | 7.5e−03 | 3.3 | 4.0e−06 | 5.4 |
| general | 2.1e−08 | 4.5e−15 | 1.4e−06 | 4.0 | 3.2e−15 | 5.7 |
| kidney | 9.5e−01 | 8.0e−01 | 1 | 0.9 | 4.9e−01 | 1.7 |
| Liver | 1 | 4.7e−01 | 1 | 1.0 | 1 | 1.1 |
| Lung | 2.4e−01 | 9.1e−02 | 4.1e−01 | 2.7 | 9.0e−02 | 4.2 |
| Lymph nodes | 4.5e−01 | 6.3e−01 | 5.5e−01 | 1.2 | 7.9e−01 | 0.8 |
| Breast | 5.9e−01 | 2.8e−01 | 1 | 1.1 | 3.8e−01 | 1.7 |
| bone marrow | 6.4e−01 | 8.5e−01 | 3.8e−01 | 2.2 | 9.0e−01 | 0.6 |
| muscle | 1 | 2.9e−01 | 1 | 1.0 | 2.3e−02 | 4.1 |
| Ovary | 3.8e−01 | 1.6e−01 | 3.2e−01 | 2.4 | 1.6e−01 | 3.1 |
| pancreas | 1 | 1.8e−01 | 1 | 1.0 | 7.7e−02 | 3.7 |
| prostate | 7.3e−01 | 4.6e−01 | 4.5e−01 | 2.0 | 4.2e−01 | 2.0 |
| Skin | 9.2e−01 | 2.0e−01 | 1 | 0.5 | 7.8e−02 | 1.6 |
| stomach | 1 | 1.9e−01 | 1 | 1.0 | 2.6e−01 | 2.5 |
| T cells | 3.3e−01 | 5.0e−01 | 1 | 0.3 | 7.8e−01 | 0.6 |
| Uterus | 6.3e−01 | 5.9e−01 | 9.6e−01 | 0.5 | 9.0e−01 | 0.7 |

As noted above, cluster Z45766 features 37 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z45766_node_4 (SEQ ID NO:18) according to the present invention is supported by 1 libraries. The number of libraries was determined as previously described. This segment can be found in the following transcript(s): Z45766_T28 (SEQ ID NO:17). Table 7 below describes the starting and ending position of this segment on each transcript.

TABLE 7

Segment location on transcripts

| Transcript name | Segment starting position | Segment ending position |
|---|---|---|
| Z45766_T28 (SEQ ID NO: 17) | 1 | 197 |

This segment can be found in a non-coding region of transcript(s) that are related to the following protein(s): Z45766_P18.

Segment cluster Z45766_node_8 (SEQ ID NO:19) according to the present invention is supported by 39 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13), Z45766_T22 (SEQ ID NO:14) and Z45766_T25 (SEQ ID NO:15). Table 8 below describes the starting and ending position of this segment on each transcript.

TABLE 8

Segment location on transcripts

| Transcript name | Segment starting position | Segment ending position |
|---|---|---|
| Z45766_T0 (SEQ ID NO: 1) | 252 | 458 |
| Z45766_T1 (SEQ ID NO: 2) | 252 | 458 |
| Z45766_T3 (SEQ ID NO: 3) | 252 | 458 |
| Z45766_T7 (SEQ ID NO: 4) | 194 | 400 |
| Z45766_T9 (SEQ ID NO: 5) | 252 | 458 |
| Z45766_T10 (SEQ ID NO: 6) | 252 | 458 |
| Z45766_T11 (SEQ ID NO: 7) | 252 | 458 |
| Z45766_T12 (SEQ ID NO: 8) | 252 | 458 |
| Z45766_T15 (SEQ ID NO: 9) | 252 | 458 |
| Z45766_T18 (SEQ ID NO: 12) | 252 | 458 |
| Z45766_T21 (SEQ ID NO: 13) | 252 | 458 |
| Z45766_T22 (SEQ ID NO: 14) | 252 | 458 |
| Z45766_T25 (SEQ ID NO: 15) | 252 | 458 |

This segment can be found in both coding and non-coding regions of transcript(s) as follows. The segment can be found in a non-coding region of transcript(s) that are related to the following protein(s): Z45766_P2. This segment can also be found in the following protein(s): Z45766_P19, Z45766_P4, Z45766_P5, Z45766_P6, Z45766_P7, Z45766_P9, Z45766_P12, Z45766_P8, Z45766_P14 and Z45766_P16, since it is in the coding region for the corresponding transcript.

Segment cluster Z45766_node_9 (SEQ ID NO:20) according to the present invention is supported by 44 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13) and Z45766_T22 (SEQ ID NO:14). Table 9 below describes the starting and ending position of this segment on each transcript.

TABLE 9

Segment location on transcripts

| Transcript name | Segment starting position | Segment ending position |
|---|---|---|
| Z45766_T0 (SEQ ID NO: 1) | 459 | 876 |
| Z45766_T1 (SEQ ID NO: 2) | 459 | 876 |
| Z45766_T3 (SEQ ID NO: 3) | 459 | 876 |
| Z45766_T7 (SEQ ID NO: 4) | 401 | 818 |
| Z45766_T9 (SEQ ID NO: 5) | 459 | 876 |
| Z45766_T10 (SEQ ID NO: 6) | 459 | 876 |
| Z45766_T11 (SEQ ID NO: 7) | 459 | 876 |
| Z45766_T12 (SEQ ID NO: 8) | 459 | 876 |
| Z45766_T15 (SEQ ID NO: 9) | 459 | 876 |
| Z45766_T18 (SEQ ID NO: 12) | 459 | 876 |
| Z45766_T21 (SEQ ID NO: 13) | 459 | 876 |
| Z45766_T22 (SEQ ID NO: 14) | 459 | 876 |

This segment can be found in the following protein(s): Z45766_P19, Z45766_P2, Z45766_P4, Z45766_P5, Z45766_P6, Z45766_P7, Z45766_P9, Z45766_P12, Z45766_P8 and Z45766_P14.

Segment cluster Z45766_node_12 (SEQ ID NO:21) according to the present invention is supported by 27 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13) and Z45766_T22 (SEQ ID NO:14). Table 10 below describes the starting and ending position of this segment on each transcript.

TABLE 10

Segment location on transcripts

| Transcript name | Segment starting position | Segment ending position |
| --- | --- | --- |
| Z45766_T0 (SEQ ID NO: 1) | 877 | 1041 |
| Z45766_T1 (SEQ ID NO: 2) | 877 | 1041 |
| Z45766_T3 (SEQ ID NO: 3) | 877 | 1041 |
| Z45766_T7 (SEQ ID NO: 4) | 819 | 983 |
| Z45766_T9 (SEQ ID NO: 5) | 877 | 1041 |
| Z45766_T10 (SEQ ID NO: 6) | 877 | 1041 |
| Z45766_T11 (SEQ ID NO: 7) | 877 | 1041 |
| Z45766_T12 (SEQ ID NO: 8) | 877 | 1041 |
| Z45766_T15 (SEQ ID NO: 9) | 877 | 1041 |
| Z45766_T18 (SEQ ID NO: 12) | 877 | 1041 |
| Z45766_T21 (SEQ ID NO: 13) | 877 | 1041 |
| Z45766_T22 (SEQ ID NO: 14) | 877 | 1041 |

This segment can be found in the following protein(s): Z45766_P19, Z45766_P2, Z45766_P4, Z45766_P5, Z45766_P6, Z45766_P7, Z45766_P9, Z45766_P12, Z45766_P8 and Z45766_P14.

Segment cluster Z45766_node__16 (SEQ ID NO:22) according to the present invention is supported by 33 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T15 (SEQ ID NO:9), Z45766_T18 (SEQ ID NO:12), Z45766_T21 (SEQ ID NO:13), Z45766_T22 (SEQ ID NO:14) and Z45766_T28 (SEQ ID NO:17). Table 11 below describes the starting and ending position of this segment on each transcript.

TABLE 11

Segment location on transcripts

| Transcript name | Segment starting position | Segment ending position |
| --- | --- | --- |
| Z45766_T0 (SEQ ID NO: 1) | 1042 | 1165 |
| Z45766_T1 (SEQ ID NO: 2) | 1042 | 1165 |
| Z45766_T3 (SEQ ID NO: 3) | 1042 | 1165 |
| Z45766_T7 (SEQ ID NO: 4) | 984 | 1107 |
| Z45766_T9 (SEQ ID NO: 5) | 1042 | 1165 |
| Z45766_T10 (SEQ ID NO: 6) | 1042 | 1165 |
| Z45766_T11 (SEQ ID NO: 7) | 1042 | 1165 |
| Z45766_T15 (SEQ ID NO: 9) | 1042 | 1165 |
| Z45766_T18 (SEQ ID NO: 12) | 1042 | 1165 |
| Z45766_T21 (SEQ ID NO: 13) | 1042 | 1165 |
| Z45766_T22 (SEQ ID NO: 14) | 1042 | 1165 |
| Z45766_T28 (SEQ ID NO: 17) | 303 | 426 |

This segment can be found in both coding and non-coding regions of transcript(s) as follows. The segment can be found in a non-coding region of transcript(s) that are related to the following protein(s): Z45766_P18. This segment can also be found in the following protein(s): Z45766_P19, Z45766_P2, Z45766_P4, Z45766_P5, Z45766_P6, Z45766_P9, Z45766_P12, Z45766_P8 and Z45766_P14, since it is in the coding region for the corresponding transcript.

Segment cluster Z45766_node__17 (SEQ ID NO:23) according to the present invention is supported by 1 libraries. The number of libraries was determined as previously described. This segment can be found in the following transcript(s): Z45766_T28 (SEQ ID NO:17). Table 12 below describes the starting and ending position of this segment on each transcript.

TABLE 12

Segment location on transcripts

| Transcript name | Segment starting position | Segment ending position |
| --- | --- | --- |
| Z45766_T28 (SEQ ID NO: 17) | 427 | 800 |

This segment can be found in the following protein(s): Z45766_P18.

Segment cluster Z45766_node__19 (SEQ ID NO:24) according to the present invention is supported by 36 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13) and Z45766_T22 (SEQ ID NO:14). Table 13 below describes the starting and ending position of this segment on each transcript.

TABLE 13

Segment location on transcripts

| Transcript name | Segment starting position | Segment ending position |
| --- | --- | --- |
| Z45766_T0 (SEQ ID NO: 1) | 1166 | 1311 |
| Z45766_T1 (SEQ ID NO: 2) | 1166 | 1311 |
| Z45766_T3 (SEQ ID NO: 3) | 1166 | 1311 |
| Z45766_T7 (SEQ ID NO: 4) | 1108 | 1253 |
| Z45766_T9 (SEQ ID NO: 5) | 1166 | 1311 |
| Z45766_T10 (SEQ ID NO: 6) | 1166 | 1311 |
| Z45766_T11 (SEQ ID NO: 7) | 1166 | 1311 |
| Z45766_T12 (SEQ ID NO: 8) | 1042 | 1187 |
| Z45766_T15 (SEQ ID NO: 9) | 1166 | 1311 |
| Z45766_T18 (SEQ ID NO: 12) | 1166 | 1311 |
| Z45766_T21 (SEQ ID NO: 13) | 1166 | 1311 |
| Z45766_T22 (SEQ ID NO: 14) | 1166 | 1311 |

This segment can be found in the following protein(s): Z45766_P19, Z45766_P2, Z45766_P4, Z45766_P5, Z45766_P6, Z45766_P7, Z45766_P9, Z45766_P12, Z45766_P8 and Z45766_P14.

Segment cluster Z45766_node__22 (SEQ ID NO:25) according to the present invention is supported by 29 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T18 (SEQ ID NO:12), Z45766_T21 (SEQ ID NO:13) and Z45766_T22 (SEQ ID NO:14). Table 14 below describes the starting and ending position of this segment on each transcript.

TABLE 14

Segment location on transcripts

| Transcript name | Segment starting position | Segment ending position |
|---|---|---|
| Z45766_T0 (SEQ ID NO: 1) | 1425 | 1546 |
| Z45766_T1 (SEQ ID NO: 2) | 1425 | 1546 |
| Z45766_T3 (SEQ ID NO: 3) | 1425 | 1546 |
| Z45766_T7 (SEQ ID NO: 4) | 1367 | 1488 |
| Z45766_T9 (SEQ ID NO: 5) | 1425 | 1546 |
| Z45766_T10 (SEQ ID NO: 6) | 1312 | 1433 |
| Z45766_T11 (SEQ ID NO: 7) | 1425 | 1546 |
| Z45766_T12 (SEQ ID NO: 8) | 1301 | 1422 |
| Z45766_T18 (SEQ ID NO: 12) | 1425 | 1546 |
| Z45766_T21 (SEQ ID NO: 13) | 1425 | 1546 |
| Z45766_T22 (SEQ ID NO: 14) | 1425 | 1546 |

This segment can be found in both coding and non-coding regions of transcript(s) as follows. The segment can be found in a non-coding region of transcript(s) that are related to the following protein(s): Z45766_P7. This segment can also be found in the following protein(s): Z45766_P19, Z45766_P2, Z45766_P4, Z45766_P5, Z45766_P6, Z45766_P12, Z45766_P8 and Z45766_P14, since it is in the coding region for the corresponding transcript.

Segment cluster Z45766_node_24 (SEQ ID NO:26) according to the present invention is supported by 5 libraries. The number of libraries was determined as previously described. This segment can be found in the following transcript(s): Z45766_T21 (SEQ ID NO:13) and Z45766_T22 (SEQ ID NO:14). Table 15 below describes the starting and ending position of this segment on each transcript.

TABLE 15

Segment location on transcripts

| Transcript name | Segment starting position | Segment ending position |
|---|---|---|
| Z45766_T21 (SEQ ID NO: 13) | 1661 | 2136 |
| Z45766_T22 (SEQ ID NO: 14) | 1547 | 2022 |

This segment can be found in both coding and non-coding regions of transcript(s) as follows. The segment can be found in a non-coding region of transcript(s) that are related to the following protein(s): Z45766_P8. This segment can also be found in the following protein(s): Z45766_P14, since it is in the coding region for the corresponding transcript.

Segment cluster Z45766_node_28 (SEQ ID NO:27) according to the present invention is supported by 2 libraries. The number of libraries was determined as previously described. This segment can be found in the following transcript(s): Z45766_T16 (SEQ ID NO:10). Table 16 below describes the starting and ending position of this segment on each transcript.

TABLE 16

Segment location on transcripts

| Transcript name | Segment starting position | Segment ending position |
|---|---|---|
| Z45766_T16 (SEQ ID NO: 10) | 1 | 547 |

This segment can be found in the following protein(s): Z45766_P10.

Segment cluster Z45766_node_30 (SEQ ID NO:28) according to the present invention is supported by 3 libraries. The number of libraries was determined as previously described. This segment can be found in the following transcript(s): Z45766_T17 (SEQ ID NO:11) and Z45766_T27 (SEQ ID NO:16). Table 17 below describes the starting and ending position of this segment on each transcript.

TABLE 17

Segment location on transcripts

| Transcript name | Segment starting position | Segment ending position |
|---|---|---|
| Z45766_T17 (SEQ ID NO: 11) | 1 | 670 |
| Z45766_T27 (SEQ ID NO: 16) | 1 | 670 |

This segment can be found in the following protein(s): Z45766_P11 and Z45766_P17.

Segment cluster Z45766_node_33 (SEQ ID NO:29) according to the present invention is supported by 34 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T16 (SEQ ID NO:10), Z45766_T17 (SEQ ID NO:11), Z45766_T18 (SEQ ID NO:12) and Z45766_T27 (SEQ ID NO:16). Table 18 below describes the starting and ending position of this segment on each transcript.

TABLE 18

Segment location on transcripts

| Transcript name | Segment starting position | Segment ending position |
|---|---|---|
| Z45766_T0 (SEQ ID NO: 1) | 1620 | 1838 |
| Z45766_T1 (SEQ ID NO: 2) | 1620 | 1838 |
| Z45766_T3 (SEQ ID NO: 3) | 1620 | 1838 |
| Z45766_T7 (SEQ ID NO: 4) | 1562 | 1780 |
| Z45766_T9 (SEQ ID NO: 5) | 1620 | 1838 |
| Z45766_T10 (SEQ ID NO: 6) | 1507 | 1725 |
| Z45766_T11 (SEQ ID NO: 7) | 1620 | 1838 |
| Z45766_T12 (SEQ ID NO: 8) | 1496 | 1714 |
| Z45766_T16 (SEQ ID NO: 10) | 621 | 839 |
| Z45766_T17 (SEQ ID NO: 11) | 744 | 962 |
| Z45766_T18 (SEQ ID NO: 12) | 1620 | 1838 |
| Z45766_T27 (SEQ ID NO: 16) | 744 | 962 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 19.

TABLE 19

Oligonucleotides related to this segment

| Oligonucleotide name | Overexpressed in cancers | Chip reference |
|---|---|---|
| N36531_0_15_0 | lung malignant tumors | LUN |

This segment can be found in both coding and non-coding regions of transcript(s) as follows. The segment can be found in a non-coding region of transcript(s) that are related to the following protein(s): Z45766_P5 and Z45766_P7. This segment can also be found in the following protein(s): Z45766_P19, Z45766_P2, Z45766_P4, Z45766_P6, Z45766_P10, Z45766_P11, Z45766_P12 and Z45766_P17, since it is in the coding region for the corresponding transcript.

Segment cluster Z45766_node_34 (SEQ ID NO:30) according to the present invention is supported by 4 libraries. The number of libraries was determined as previously described. This segment can be found in the following transcript(s): Z45766_T27 (SEQ ID NO:16). Table 20 below describes the starting and ending position of this segment on each transcript.

TABLE 20

Segment location on transcripts

| Transcript name | Segment starting position | Segment ending position |
|---|---|---|
| Z45766_T27 (SEQ ID NO: 16) | 963 | 1604 |

This segment can be found in the following protein(s): Z45766_P17.

Segment cluster Z45766_node_37 (SEQ ID NO:31) according to the present invention is supported by 43 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T10 (SEQ ID NO:6), Z45766_T11 (SEQ ID NO:7), Z45766_T12 (SEQ ID NO:8), Z45766_T16 (SEQ ID NO:10), Z45766_T17 (SEQ ID NO:11) and Z45766_T18 (SEQ ID NO:12). Table 21 below describes the starting and ending position of this segment on each transcript.

TABLE 21

Segment location on transcripts

| Transcript name | Segment starting position | Segment ending position |
|---|---|---|
| Z45766_T0 (SEQ ID NO: 1) | 1839 | 1981 |
| Z45766_T1 (SEQ ID NO: 2) | 1839 | 1981 |
| Z45766_T3 (SEQ ID NO: 3) | 1839 | 1981 |
| Z45766_T7 (SEQ ID NO: 4) | 1781 | 1923 |
| Z45766_T10 (SEQ ID NO: 6) | 1726 | 1868 |
| Z45766_T11 (SEQ ID NO: 7) | 1839 | 1981 |
| Z45766_T12 (SEQ ID NO: 8) | 1715 | 1857 |
| Z45766_T16 (SEQ ID NO: 10) | 840 | 982 |
| Z45766_T17 (SEQ ID NO: 11) | 963 | 1105 |
| Z45766_T18 (SEQ ID NO: 12) | 1839 | 1981 |

This segment can be found in both coding and non-coding regions of transcript(s) as follows. The segment can be found in a non-coding region of transcript(s) that are related to the following protein(s): Z45766_P5 and Z45766_P7. This segment can also be found in the following protein(s): Z45766_P19, Z45766_P2, Z45766_P6, Z45766_P10, Z45766_P11 and Z45766_P12, since it is in the coding region for the corresponding transcript.

Segment cluster Z45766_node_39 (SEQ ID NO:32) according to the present invention is supported by 5 libraries. The number of libraries was determined as previously described. This segment can be found in the following transcript(s): Z45766_T18 (SEQ ID NO:12). Table 22 below describes the starting and ending position of this segment on each transcript.

TABLE 22

Segment location on transcripts

| Transcript name | Segment starting position | Segment ending position |
|---|---|---|
| Z45766_T18 (SEQ ID NO: 12) | 2041 | 2321 |

This segment can be found in the following protein(s): Z45766_P12.

Segment cluster Z45766_node_42 (SEQ ID NO:33) according to the present invention is supported by 36 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T12 (SEQ ID NO:8), Z45766_T16 (SEQ ID NO:10) and Z45766_T17 (SEQ ID NO:11). Table 23 below describes the starting and ending position of this segment on each transcript.

TABLE 23

Segment location on transcripts

| Transcript name | Segment starting position | Segment ending position |
|---|---|---|
| Z45766_T0 (SEQ ID NO: 1) | 2113 | 2250 |
| Z45766_T1 (SEQ ID NO: 2) | 2113 | 2250 |
| Z45766_T3 (SEQ ID NO: 3) | 2113 | 2250 |
| Z45766_T7 (SEQ ID NO: 4) | 2055 | 2192 |
| Z45766_T9 (SEQ ID NO: 5) | 1911 | 2048 |
| Z45766_T10 (SEQ ID NO: 6) | 2000 | 2137 |
| Z45766_T12 (SEQ ID NO: 8) | 1989 | 2126 |
| Z45766_T16 (SEQ ID NO: 10) | 1114 | 1251 |
| Z45766_T17 (SEQ ID NO: 11) | 1237 | 1374 |

This segment can be found in both coding and non-coding regions of transcript(s) as follows. The segment can be found in a non-coding region of transcript(s) that are related to the following protein(s): Z45766_P4, Z45766_P5 and Z45766_P7. This segment can also be found in the following protein(s): Z45766_P19, Z45766_P2, Z45766_P10 and Z45766_P11, since it is in the coding region for the corresponding transcript.

Segment cluster Z45766_node_44 (SEQ ID NO:34) according to the present invention is supported by 29 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T12 (SEQ ID NO:8), Z45766_T16 (SEQ ID NO:10) and Z45766_T17 (SEQ ID NO:11). Table 24 below describes the starting and ending position of this segment on each transcript.

TABLE 24

Segment location on transcripts

| Transcript name | Segment starting position | Segment ending position |
|---|---|---|
| Z45766_T0 (SEQ ID NO: 1) | 2251 | 2453 |
| Z45766_T1 (SEQ ID NO: 2) | 2251 | 2453 |
| Z45766_T3 (SEQ ID NO: 3) | 2251 | 2453 |

TABLE 24-continued

Segment location on transcripts

| Transcript name | Segment starting position | Segment ending position |
|---|---|---|
| Z45766_T7 (SEQ ID NO: 4) | 2193 | 2395 |
| Z45766_T9 (SEQ ID NO: 5) | 2049 | 2251 |
| Z45766_T10 (SEQ ID NO: 6) | 2138 | 2340 |
| Z45766_T12 (SEQ ID NO: 8) | 2127 | 2329 |
| Z45766_T16 (SEQ ID NO: 10) | 1252 | 1454 |
| Z45766_T17 (SEQ ID NO: 11) | 1375 | 1577 |

This segment can be found in both coding and non-coding regions of transcript(s) as follows. The segment can be found in a non-coding region of transcript(s) that are related to the following protein(s): Z45766_P4, Z45766_P5 and Z45766_P7. This segment can also be found in the following protein(s): Z45766_P19, Z45766_P2, Z45766_P10 and Z45766_P11, since it is in the coding region for the corresponding transcript.

Segment cluster Z45766_node_45 (SEQ ID NO:35) according to the present invention is supported by 26 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T16 (SEQ ID NO:10) and Z45766_T17 (SEQ ID NO:11). Table 25 below describes the starting and ending position of this segment on each transcript.

TABLE 25

Segment location on transcripts

| Transcript name | Segment starting position | Segment ending position |
|---|---|---|
| Z45766_T0 (SEQ ID NO: 1) | 2454 | 2648 |
| Z45766_T1 (SEQ ID NO: 2) | 2454 | 2648 |
| Z45766_T3 (SEQ ID NO: 3) | 2454 | 2648 |
| Z45766_T7 (SEQ ID NO: 4) | 2396 | 2590 |
| Z45766_T9 (SEQ ID NO: 5) | 2252 | 2446 |
| Z45766_T10 (SEQ ID NO: 6) | 2341 | 2535 |
| Z45766_T11 (SEQ ID NO: 7) | 2041 | 2235 |
| Z45766_T12 (SEQ ID NO: 8) | 2330 | 2524 |
| Z45766_T16 (SEQ ID NO: 10) | 1455 | 1649 |
| Z45766_T17 (SEQ ID NO: 11) | 1578 | 1772 |

This segment can be found in both coding and non-coding regions of transcript(s) as follows. The segment can be found in a non-coding region of transcript(s) that are related to the following protein(s): Z45766_P19, Z45766_P2, Z45766_P4, Z45766_P5, Z45766_P7, Z45766_P10 and Z45766_P11. This segment can also be found in the following protein(s): Z45766_P6, since it is in the coding region for the corresponding transcript.

Segment cluster Z45766_node_46 (SEQ ID NO:36) according to the present invention is supported by 34 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T16 (SEQ ID NO:10) and Z45766_T17 (SEQ ID NO:11). Table 26 below describes the starting and ending position of this segment on each transcript.

TABLE 26

Segment location on transcripts

| Transcript name | Segment starting position | Segment ending position |
|---|---|---|
| Z45766_T0 (SEQ ID NO: 1) | 2649 | 2796 |
| Z45766_T1 (SEQ ID NO: 2) | 2649 | 2796 |
| Z45766_T3 (SEQ ID NO: 3) | 2649 | 2796 |
| Z45766_T7 (SEQ ID NO: 4) | 2591 | 2738 |
| Z45766_T9 (SEQ ID NO: 5) | 2447 | 2594 |
| Z45766_T10 (SEQ ID NO: 6) | 2536 | 2683 |
| Z45766_T11 (SEQ ID NO: 7) | 2236 | 2383 |
| Z45766_T12 (SEQ ID NO: 8) | 2525 | 2672 |
| Z45766_T16 (SEQ ID NO: 10) | 1650 | 1797 |
| Z45766_T17 (SEQ ID NO: 11) | 1773 | 1920 |

This segment can be found in a non-coding region of transcript(s) that are related to the following protein(s): Z45766_P19, Z45766_P2, Z45766_P4, Z45766_P5, Z45766_P6, Z45766_P7, Z45766_P10 and Z45766_P11.

Segment cluster Z45766_node_47 (SEQ ID NO:37) according to the present invention is supported by 56 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10) and Z45766_T17 (SEQ ID NO:11). Table 27 below describes the starting and ending position of this segment on each transcript.

TABLE 27

| Transcript name | Segment starting position | Segment ending position |
|---|---|---|
| Z45766_T0 (SEQ ID NO: 1) | 2797 | 3936 |
| Z45766_T1 (SEQ ID NO: 2) | 2797 | 3936 |
| Z45766_T3 (SEQ ID NO: 3) | 2797 | 3936 |
| Z45766_T7 (SEQ ID NO: 4) | 2739 | 3878 |
| Z45766_T9 (SEQ ID NO: 5) | 2595 | 3734 |
| Z45766_T10 (SEQ ID NO: 6) | 2684 | 3823 |
| Z45766_T11 (SEQ ID NO: 7) | 2384 | 3523 |
| Z45766_T12 (SEQ ID NO: 8) | 2673 | 3812 |
| Z45766_T15 (SEQ ID NO: 9) | 1401 | 2540 |
| Z45766_T16 (SEQ ID NO: 10) | 1798 | 2937 |
| Z45766_T17 (SEQ ID NO: 11) | 1921 | 3060 |

This segment can be found in both coding and non-coding regions of transcript(s) as follows. The segment can be found in a non-coding region of transcript(s) that are related to the following protein(s): Z45766_P19, Z45766_P2, Z45766_P4, Z45766_P5, Z45766_P6, Z45766_P7, Z45766_P10 and Z45766_P11. This segment can also be found in the following protein(s): Z45766_P9, since it is in the coding region for the corresponding transcript.

Segment cluster Z45766_node_51 (SEQ ID NO:38) according to the present invention is supported by 21 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10), Z45766_T17 (SEQ ID NO:11) and Z45766_T25 (SEQ ID NO:15). Table 28 below describes the starting and ending position of this segment on each transcript.

TABLE 28

Segment location on transcripts

| Transcript name | Segment starting position | Segment ending position |
|---|---|---|
| Z45766_T0 (SEQ ID NO: 1) | 3965 | 4087 |
| Z45766_T1 (SEQ ID NO: 2) | 3965 | 4087 |
| Z45766_T3 (SEQ ID NO: 3) | 3937 | 4059 |
| Z45766_T7 (SEQ ID NO: 4) | 3907 | 4029 |
| Z45766_T9 (SEQ ID NO: 5) | 3763 | 3885 |
| Z45766_T10 (SEQ ID NO: 6) | 3852 | 3974 |
| Z45766_T11 (SEQ ID NO: 7) | 3552 | 3674 |
| Z45766_T12 (SEQ ID NO: 8) | 3841 | 3963 |
| Z45766_T15 (SEQ ID NO: 9) | 2569 | 2691 |
| Z45766_T16 (SEQ ID NO: 10) | 2966 | 3088 |
| Z45766_T17 (SEQ ID NO: 11) | 3089 | 3211 |
| Z45766_T25 (SEQ ID NO: 15) | 487 | 609 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 29.

TABLE 29

Oligonucleotides related to this segment

| Oligonucleotide name | Overexpressed in cancers | Chip reference |
|---|---|---|
| Z45766_0_0_72773 | lung malignant tumors | LUN |

This segment can be found in both coding and non-coding regions of transcript(s) as follows. The segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P10 and Z45766_P11. This segment can also be found in the following protein(s): Z45766_P16, since it is in the coding region for the corresponding transcript.

Segment cluster Z45766_node_53 (SEQ ID NO:39) according to the present invention is supported by 22 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10), Z45766_T17 (SEQ ID NO:11) and Z45766_T25 (SEQ ID NO:15). Table 30 below describes the starting and ending position of this segment on each transcript.

TABLE 30

Segment location on transcripts

| Transcript name | Segment starting position | Segment ending position |
|---|---|---|
| Z45766_T0 (SEQ ID NO: 1) | 4135 | 4383 |
| Z45766_T1 (SEQ ID NO: 2) | 4135 | 4383 |
| Z45766_T3 (SEQ ID NO: 3) | 4107 | 4355 |
| Z45766_T7 (SEQ ID NO: 4) | 4077 | 4325 |
| Z45766_T9 (SEQ ID NO: 5) | 3933 | 4181 |

TABLE 30-continued

Segment location on transcripts

| Transcript name | Segment starting position | Segment ending position |
|---|---|---|
| Z45766_T10 (SEQ ID NO: 6) | 4022 | 4270 |
| Z45766_T11 (SEQ ID NO: 7) | 3722 | 3970 |
| Z45766_T12 (SEQ ID NO: 8) | 4011 | 4259 |
| Z45766_T15 (SEQ ID NO: 9) | 2739 | 2987 |
| Z45766_T16 (SEQ ID NO: 10) | 3136 | 3384 |
| Z45766_T17 (SEQ ID NO: 11) | 3259 | 3507 |
| Z45766_T25 (SEQ ID NO: 15) | 657 | 905 |

This segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P10, Z45766_P11 and Z45766_P16.

Segment cluster Z45766_node_55 (SEQ ID NO:40) according to the present invention is supported by 18 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10), Z45766_T17 (SEQ ID NO:11) and Z45766_T25 (SEQ ID NO:15). Table 31 below describes the starting and ending position of this segment on each transcript.

TABLE 31

Segment location on transcripts

| Transcript name | Segment starting position | Segment ending position |
|---|---|---|
| Z45766_T0 (SEQ ID NO: 1) | 4384 | 4552 |
| Z45766_T1 (SEQ ID NO: 2) | 4384 | 4683 |
| Z45766_T3 (SEQ ID NO: 3) | 4356 | 4524 |
| Z45766_T7 (SEQ ID NO: 4) | 4326 | 4494 |
| Z45766_T9 (SEQ ID NO: 5) | 4182 | 4350 |
| Z45766_T10 (SEQ ID NO: 6) | 4271 | 4439 |
| Z45766_T11 (SEQ ID NO: 7) | 3971 | 4139 |
| Z45766_T12 (SEQ ID NO: 8) | 4260 | 4428 |
| Z45766_T15 (SEQ ID NO: 9) | 2988 | 3156 |
| Z45766_T16 (SEQ ID NO: 10) | 3385 | 3553 |
| Z45766_T17 (SEQ ID NO: 11) | 3508 | 3676 |
| Z45766_T25 (SEQ ID NO: 15) | 906 | 1074 |

This segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P10, Z45766_P11 and Z45766_P16.

According to an optional embodiment of the present invention, short segments related to the above cluster are also provided. These segments are up to about 120 bp in length, and so are included in a separate description.

Segment cluster Z45766_node_0 (SEQ ID NO:41) according to the present invention is supported by 4 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13), Z45766_T22 (SEQ ID NO:14) and Z45766_T25 (SEQ ID NO:15). Table 32 below describes the starting and ending position of this segment on each transcript.

TABLE 32

Segment location on transcripts

| Transcript name | Segment starting position | Segment ending position |
| --- | --- | --- |
| Z45766_T0 (SEQ ID NO: 1) | 1 | 93 |
| Z45766_T1 (SEQ ID NO: 2) | 1 | 93 |
| Z45766_T3 (SEQ ID NO: 3) | 1 | 93 |
| Z45766_T7 (SEQ ID NO: 4) | 1 | 93 |
| Z45766_T9 (SEQ ID NO: 5) | 1 | 93 |
| Z45766_T10 (SEQ ID NO: 6) | 1 | 93 |
| Z45766_T11 (SEQ ID NO: 7) | 1 | 93 |
| Z45766_T12 (SEQ ID NO: 8) | 1 | 93 |
| Z45766_T15 (SEQ ID NO: 9) | 1 | 93 |
| Z45766_T18 (SEQ ID NO: 12) | 1 | 93 |
| Z45766_T21 (SEQ ID NO: 13) | 1 | 93 |
| Z45766_T22 (SEQ ID NO: 14) | 1 | 93 |
| Z45766_T25 (SEQ ID NO: 15) | 1 | 93 |

This segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P12, Z45766_P8, Z45766_P14 and Z45766_P16.

Segment cluster Z45766_node_2 (SEQ ID NO:42) according to the present invention is supported by 25 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13), Z45766_T22 (SEQ ID NO:14) and Z45766_T25 (SEQ ID NO:15). Table 33 below describes the starting and ending position of this segment on each transcript.

TABLE 33

Segment location on transcripts

| Transcript name | Segment starting position | Segment ending position |
| --- | --- | --- |
| Z45766_T0 (SEQ ID NO: 1) | 94 | 193 |
| Z45766_T1 (SEQ ID NO: 2) | 94 | 193 |
| Z45766_T3 (SEQ ID NO: 3) | 94 | 193 |
| Z45766_T7 (SEQ ID NO: 4) | 94 | 193 |
| Z45766_T9 (SEQ ID NO: 5) | 94 | 193 |
| Z45766_T10 (SEQ ID NO: 6) | 94 | 193 |
| Z45766_T11 (SEQ ID NO: 7) | 94 | 193 |
| Z45766_T12 (SEQ ID NO: 8) | 94 | 193 |
| Z45766_T15 (SEQ ID NO: 9) | 94 | 193 |
| Z45766_T18 (SEQ ID NO: 12) | 94 | 193 |
| Z45766_T21 (SEQ ID NO: 13) | 94 | 193 |
| Z45766_T22 (SEQ ID NO: 14) | 94 | 193 |
| Z45766_T25 (SEQ ID NO: 15) | 94 | 193 |

This segment can be found in both coding and non-coding regions of transcript(s) as follows. The segment can be found in a non-coding region of transcript(s) that are related to the following protein(s): Z45766_P2. This segment can also be found in the following protein(s): Z45766_P19, Z45766_P4, Z45766_P5, Z45766_P6, Z45766_P7, Z45766_P9, Z45766_P12, Z45766_P8, Z45766_P14 and Z45766_P16, since it is in the coding region for the corresponding transcript.

Segment cluster Z45766_node_6 (SEQ ID NO:43) according to the present invention is supported by 29 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13), Z45766_T22 (SEQ ID NO:14) and Z45766_T25 (SEQ ID NO:15). Table 34 below describes the starting and ending position of this segment on each transcript.

TABLE 34

Segment location on transcripts

| Transcript name | Segment starting position | Segment ending position |
| --- | --- | --- |
| Z45766_T0 (SEQ ID NO: 1) | 194 | 251 |
| Z45766_T1 (SEQ ID NO: 2) | 194 | 251 |
| Z45766_T3 (SEQ ID NO: 3) | 194 | 251 |
| Z45766_T9 (SEQ ID NO: 5) | 194 | 251 |
| Z45766_T10 (SEQ ID NO: 6) | 194 | 251 |
| Z45766_T11 (SEQ ID NO: 7) | 194 | 251 |
| Z45766_T12 (SEQ ID NO: 8) | 194 | 251 |
| Z45766_T15 (SEQ ID NO: 9) | 194 | 251 |
| Z45766_T18 (SEQ ID NO: 12) | 194 | 251 |
| Z45766_T21 (SEQ ID NO: 13) | 194 | 251 |
| Z45766_T22 (SEQ ID NO: 14) | 194 | 251 |
| Z45766_T25 (SEQ ID NO: 15) | 194 | 251 |

This segment can be found in the following protein(s): Z45766_P19, Z45766_P4, Z45766_P5, Z45766_P6, Z45766_P7, Z45766_P9, Z45766_P12, Z45766_P8, Z45766_P14 and Z45766_P16.

Segment cluster Z45766_node_15 (SEQ ID NO:44) according to the present invention is supported by 1 libraries. The number of libraries was determined as previously described. This segment can be found in the following transcript(s): Z45766_T28 (SEQ ID NO:17). Table 35 below describes the starting and ending position of this segment on each transcript.

TABLE 35

Segment location on transcripts

| Transcript name | Segment starting position | Segment ending position |
| --- | --- | --- |
| Z45766_T28 (SEQ ID NO: 17) | 198 | 302 |

This segment can be found in a non-coding region of transcript(s) that are related to the following protein(s): Z45766_P18.

Segment cluster Z45766_node_20 (SEQ ID NO:45) according to the present invention is supported by 36 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T11 (SEQ ID NO:7), Z45766_T12 (SEQ ID NO:8), Z45766_T15 (SEQ ID NO:9), Z45766_T18 (SEQ ID NO:12), Z45766_T21 (SEQ ID NO:13) and Z45766_T22 (SEQ ID NO:14). Table 36 below describes the starting and ending position of this segment on each transcript.

TABLE 36

Segment location on transcripts

| Transcript name | Segment starting position | Segment ending position |
| --- | --- | --- |
| Z45766_T0 (SEQ ID NO: 1) | 1312 | 1400 |
| Z45766_T1 (SEQ ID NO: 2) | 1312 | 1400 |
| Z45766_T3 (SEQ ID NO: 3) | 1312 | 1400 |
| Z45766_T7 (SEQ ID NO: 4) | 1254 | 1342 |
| Z45766_T9 (SEQ ID NO: 5) | 1312 | 1400 |
| Z45766_T11 (SEQ ID NO: 7) | 1312 | 1400 |
| Z45766_T12 (SEQ ID NO: 8) | 1188 | 1276 |
| Z45766_T15 (SEQ ID NO: 9) | 1312 | 1400 |
| Z45766_T18 (SEQ ID NO: 12) | 1312 | 1400 |
| Z45766_T21 (SEQ ID NO: 13) | 1312 | 1400 |
| Z45766_T22 (SEQ ID NO: 14) | 1312 | 1400 |

This segment can be found in the following protein(s): Z45766_P19, Z45766_P2, Z45766_P4, Z45766_P6, Z45766_P7, Z45766_P9, Z45766_P12, Z45766_P8 and Z45766_P14.

Segment cluster Z45766_node_21 (SEQ ID NO:46) according to the present invention can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T11 (SEQ ID NO:7), Z45766_T12 (SEQ ID NO:8), Z45766_T18 (SEQ ID NO:12), Z45766_T21 (SEQ ID NO:13) and Z45766_T22 (SEQ ID NO:14). Table 37 below describes the starting and ending position of this segment on each transcript.

TABLE 37

Segment location on transcripts

| Transcript name | Segment starting position | Segment ending position |
| --- | --- | --- |
| Z45766_T0 (SEQ ID NO: 1) | 1401 | 1424 |
| Z45766_T1 (SEQ ID NO: 2) | 1401 | 1424 |
| Z45766_T3 (SEQ ID NO: 3) | 1401 | 1424 |
| Z45766_T7 (SEQ ID NO: 4) | 1343 | 1366 |
| Z45766_T9 (SEQ ID NO: 5) | 1401 | 1424 |
| Z45766_T11 (SEQ ID NO: 7) | 1401 | 1424 |
| Z45766_T12 (SEQ ID NO: 8) | 1277 | 1300 |
| Z45766_T18 (SEQ ID NO: 12) | 1401 | 1424 |
| Z45766_T21 (SEQ ID NO: 13) | 1401 | 1424 |
| Z45766_T22 (SEQ ID NO: 14) | 1401 | 1424 |

This segment can be found in the following protein(s): Z45766_P19, Z45766_P2, Z45766_P4, Z45766_P6, Z45766_P7, Z45766_P12, Z45766_P8 and Z45766_P14.

Segment cluster Z45766_node_23 (SEQ ID NO:47) according to the present invention is supported by 3 libraries. The number of libraries was determined as previously described. This segment can be found in the following transcript(s): Z45766_T21 (SEQ ID NO:13). Table 38 below describes the starting and ending position of this segment on each transcript.

TABLE 38

Segment location on transcripts

| Transcript name | Segment starting position | Segment ending position |
| --- | --- | --- |
| Z45766_T21 (SEQ ID NO: 13) | 1547 | 1660 |

This segment can be found in the following protein(s): Z45766_P8.

Segment cluster Z45766_node_25 (SEQ ID NO:48) according to the present invention can be found in the following transcript(s): Z45766_T21 (SEQ ID NO:13) and Z45766_T22 (SEQ ID NO:14). Table 39 below describes the starting and ending position of this segment on each transcript.

TABLE 39

Segment location on transcripts

| Transcript name | Segment starting position | Segment ending position |
| --- | --- | --- |
| Z45766_T21 (SEQ ID NO: 13) | 2137 | 2141 |
| Z45766_T22 (SEQ ID NO: 14) | 2023 | 2027 |

This segment can be found in a non-coding region of transcript(s) that are related to the following protein(s): Z45766_P8 and Z45766_P14.

Segment cluster Z45766_node_26 (SEQ ID NO:49) according to the present invention is supported by 2 libraries. The number of libraries was determined as previously described. This segment can be found in the following transcript(s): Z45766_T21 (SEQ ID NO:13) and Z45766_T22 (SEQ ID NO:14). Table 40 below describes the starting and ending position of this segment on each transcript.

TABLE 40

Segment location on transcripts

| Transcript name | Segment starting position | Segment ending position |
| --- | --- | --- |
| Z45766_T21 (SEQ ID NO: 13) | 2142 | 2209 |
| Z45766_T22 (SEQ ID NO: 14) | 2028 | 2095 |

This segment can be found in a non-coding region of transcript(s) that are related to the following protein(s): Z45766_P8 and Z45766_P14.

Segment cluster Z45766_node_31 (SEQ ID NO:50) according to the present invention is supported by 28 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T16 (SEQ ID NO:10), Z45766_T17 (SEQ ID NO:11), Z45766_T18 (SEQ ID NO:12) and Z45766_T27 (SEQ ID NO:16). Table 41 below describes the starting and ending position of this segment on each transcript.

TABLE 41

Segment location on transcripts

| Transcript name | Segment starting position | Segment ending position |
|---|---|---|
| Z45766_T0 (SEQ ID NO: 1) | 1547 | 1619 |
| Z45766_T1 (SEQ ID NO: 2) | 1547 | 1619 |
| Z45766_T3 (SEQ ID NO: 3) | 1547 | 1619 |
| Z45766_T7 (SEQ ID NO: 4) | 1489 | 1561 |
| Z45766_T9 (SEQ ID NO: 5) | 1547 | 1619 |
| Z45766_T10 (SEQ ID NO: 6) | 1434 | 1506 |
| Z45766_T11 (SEQ ID NO: 7) | 1547 | 1619 |
| Z45766_T12 (SEQ ID NO: 8) | 1423 | 1495 |
| Z45766_T16 (SEQ ID NO: 10) | 548 | 620 |
| Z45766_T17 (SEQ ID NO: 11) | 671 | 743 |
| Z45766_T18 (SEQ ID NO: 12) | 1547 | 1619 |
| Z45766_T27 (SEQ ID NO: 16) | 671 | 743 |

This segment can be found in both coding and non-coding regions of transcript(s) as follows. The segment can be found in a non-coding region of transcript(s) that are related to the following protein(s): Z45766_P5 and Z45766_P7. This segment can also be found in the following protein(s): Z45766_P19, Z45766_P2, Z45766_P4, Z45766_P6, Z45766_P10, Z45766_P11, Z45766_P12 and Z45766_P17, since it is in the coding region for the corresponding transcript.

Segment cluster Z45766_node_38 (SEQ ID NO:51) according to the present invention is supported by 37 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T10 (SEQ ID NO:6), Z45766_T11 (SEQ ID NO:7), Z45766_T12 (SEQ ID NO:8), Z45766_T16 (SEQ ID NO:10), Z45766_T17 (SEQ ID NO:11) and Z45766_T18 (SEQ ID NO:12). Table 42 below describes the starting and ending position of this segment on each transcript.

TABLE 42

Segment location on transcripts

| Transcript name | Segment starting position | Segment ending position |
|---|---|---|
| Z45766_T0 (SEQ ID NO: 1) | 1982 | 2040 |
| Z45766_T1 (SEQ ID NO: 2) | 1982 | 2040 |
| Z45766_T3 (SEQ ID NO: 3) | 1982 | 2040 |
| Z45766_T7 (SEQ ID NO: 4) | 1924 | 1982 |
| Z45766_T10 (SEQ ID NO: 6) | 1869 | 1927 |
| Z45766_T11 (SEQ ID NO: 7) | 1982 | 2040 |
| Z45766_T12 (SEQ ID NO: 8) | 1858 | 1916 |
| Z45766_T16 (SEQ ID NO: 10) | 983 | 1041 |
| Z45766_T17 (SEQ ID NO: 11) | 1106 | 1164 |
| Z45766_T18 (SEQ ID NO: 12) | 1982 | 2040 |

This segment can be found in both coding and non-coding regions of transcript(s) as follows. The segment can be found in a non-coding region of transcript(s) that are related to the following protein(s): Z45766_P5 and Z45766_P7. This segment can also be found in the following protein(s): Z45766_P19, Z45766_P2, Z45766_P6, Z45766_P10, Z45766_P11 and Z45766_P12, since it is in the coding region for the corresponding transcript.

Segment cluster Z45766_node_41 (SEQ ID NO:52) according to the present invention is supported by 32 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T12 (SEQ ID NO:8), Z45766_T16 (SEQ ID NO:10) and Z45766_T17 (SEQ ID NO:11). Table 43 below describes the starting and ending position of this segment on each transcript.

TABLE 43

Segment location on transcripts

| Transcript name | Segment starting position | Segment ending position |
|---|---|---|
| Z45766_T0 (SEQ ID NO: 1) | 2041 | 2112 |
| Z45766_T1 (SEQ ID NO: 2) | 2041 | 2112 |
| Z45766_T3 (SEQ ID NO: 3) | 2041 | 2112 |
| Z45766_T7 (SEQ ID NO: 4) | 1983 | 2054 |
| Z45766_T9 (SEQ ID NO: 5) | 1839 | 1910 |
| Z45766_T10 (SEQ ID NO: 6) | 1928 | 1999 |
| Z45766_T12 (SEQ ID NO: 8) | 1917 | 1988 |
| Z45766_T16 (SEQ ID NO: 10) | 1042 | 1113 |
| Z45766_T17 (SEQ ID NO: 11) | 1165 | 1236 |

This segment can be found in both coding and non-coding regions of transcript(s) as follows. The segment can be found in a non-coding region of transcript(s) that are related to the following protein(s): Z45766_P5 and Z45766_P7. This segment can also be found in the following protein(s): Z45766_P19, Z45766_P2, Z45766_P4, Z45766_P10 and Z45766_P11, since it is in the coding region for the corresponding transcript.

Segment cluster Z45766_node_50 (SEQ ID NO:53) according to the present invention is supported by 18 libraries. The number of libraries was determined as previously described. This segment can be found in the following transcript(s): Z45766_T0 (SEQ ID NO:1), Z45766_T1 (SEQ ID NO:2), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10), Z45766_T17 (SEQ ID NO:11) and Z45766_T25 (SEQ ID NO:15). Table 44 below describes the starting and ending position of this segment on each transcript.

TABLE 44

Segment location on transcripts

| Transcript name | Segment starting position | Segment ending position |
|---|---|---|
| Z45766_T0 (SEQ ID NO: 1) | 3937 | 3964 |
| Z45766_T1 (SEQ ID NO: 2) | 3937 | 3964 |
| Z45766_T7 (SEQ ID NO: 4) | 3879 | 3906 |
| Z45766_T9 (SEQ ID NO: 5) | 3735 | 3762 |
| Z45766_T10 (SEQ ID NO: 6) | 3824 | 3851 |
| Z45766_T11 (SEQ ID NO: 7) | 3524 | 3551 |
| Z45766_T12 (SEQ ID NO: 8) | 3813 | 3840 |
| Z45766_T15 (SEQ ID NO: 9) | 2541 | 2568 |
| Z45766_T16 (SEQ ID NO: 10) | 2938 | 2965 |
| Z45766_T17 (SEQ ID NO: 11) | 3061 | 3088 |
| Z45766_T25 (SEQ ID NO: 15) | 459 | 486 |

This segment can be found in both coding and non-coding regions of transcript(s) as follows. The segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P10 and Z45766_P11. This segment can also be found in the following protein(s): Z45766_P16, since it is in the coding region for the corresponding transcript.

Segment cluster Z45766_node_52 (SEQ ID NO:54) according to the present invention is supported by 21 libraries. The number of libraries was determined as previously described. This segment can be found in the following transcript(s): Z45766_T0 (SEQ ID NO:1), Z45766_T1 (SEQ ID NO:2), Z45766_T3 (SEQ ID NO:3), Z45766_T7 (SEQ ID NO:4), Z45766_T9 (SEQ ID NO:5), Z45766_T10 (SEQ ID NO:6), Z45766_T11 (SEQ ID NO:7), Z45766_T12 (SEQ ID NO:8), Z45766_T15 (SEQ ID NO:9), Z45766_T16 (SEQ ID NO:10), Z45766_T17 (SEQ ID NO:11) and Z45766_T25 (SEQ ID NO:15). Table 45 below describes the starting and ending position of this segment on each transcript.

TABLE 45

Segment location on transcripts

| Transcript name | Segment starting position | Segment ending position |
|---|---|---|
| Z45766_T0 (SEQ ID NO: 1) | 4088 | 4134 |
| Z45766_T1 (SEQ ID NO: 2) | 4088 | 4134 |
| Z45766_T3 (SEQ ID NO: 3) | 4060 | 4106 |
| Z45766_T7 (SEQ ID NO: 4) | 4030 | 4076 |
| Z45766_T9 (SEQ ID NO: 5) | 3886 | 3932 |
| Z45766_T10 (SEQ ID NO: 6) | 3975 | 4021 |
| Z45766_T11 (SEQ ID NO: 7) | 3675 | 3721 |
| Z45766_T12 (SEQ ID NO: 8) | 3964 | 4010 |
| Z45766_T15 (SEQ ID NO: 9) | 2692 | 2738 |
| Z45766_T16 (SEQ ID NO: 10) | 3089 | 3135 |
| Z45766_T17 (SEQ ID NO: 11) | 3212 | 3258 |
| Z45766_T25 (SEQ ID NO: 15) | 610 | 656 |

This segment can be found in a non-coding region of transcript(s) that are related to the following protein(s): Z45766_P19, Z45766_P2, Z45766_P4, Z45766_P5, Z45766_P6, Z45766_P7, Z45766_P9, Z45766_P10, Z45766_P11 and Z45766_P16.

Description for Cluster AA436634

Cluster AA436634 features 1 transcript(s) and 1 segment(s) of interest, the names for which are given in Tables 46 and 47, respectively, the sequences themselves are given at the end of the application.

TABLE 46

Transcripts of interest
Transcript Name

AA436634_T0 (SEQ ID NO: 55)

TABLE 47

Segments of interest
Segment Name

AA436634_note_0 (SEQ ID NO: 56)

The heart-selective diagnostic marker prediction engine provided the following results with regard to cluster AA436634. Predictions were made for selective expression of transcripts of this contig in heart tissue, according to the previously described methods. The numbers on the y-axis of the FIG. 4 below refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 4, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 39.1; the ratio of expression of the cluster in heart specific ESTs to the overall expression of the cluster in muscle-specific ESTs which was found to be 74; and fisher exact test P-values were computed both for library and weighted clone counts to check that the counts are statistically significant, and were found to be 1.10E-05.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 39.1, which clearly supports specific expression in heart tissue.

As noted above, cluster AA436634 features 1 segment(s), which were listed in Table 47 above and for which the sequence(s) are given at the end of the application. These segment(s) are portions of nucleic acid sequence(s) which are described herein separately because they are of particular interest. A description of each segment according to the present invention is now provided.

Segment cluster AA436634_node_0 (SEQ ID NO:56) according to the present invention is supported by 18 libraries. The number of libraries was determined as previously described. This segment can be found in the following transcript(s): AA436634_T0 (SEQ ID NO:55). Table 49 below describes the starting and ending position of this segment on each transcript.

TABLE 49

Segment location on transcripts

| Transcript name | Segment starting position | Segment ending position |
|---|---|---|
| AA436634_T0 (SEQ ID NO: 55) | 1 | 860 |

The previously-described transcripts for these segment(s) do not code for protein.

Description for Cluster AA604379

Cluster AA604379 features 4 transcript(s) and 22 segment(s) of interest, the names for which are given in Tables 50 and 51, respectively, the sequences themselves are given at the end of the application. The selected protein variants are given in Table 52.

TABLE 50

Transcripts of interest
Transcript Name

AA604379_T4 (SEQ ID NO: 57)
AA604379_T5 (SEQ ID NO: 58)
AA604379_T6 (SEQ ID NO: 59)
AA604379_T10 (SEQ ID NO: 60)

TABLE 51

Segments of interest
Segment Name

AA604379_node_2 (SEQ ID NO: 61)
AA604379_node_14 (SEQ ID NO: 62)
AA604379_node_19 (SEQ ID NO: 63)
AA604379_node_21 (SEQ ID NO: 64)
AA604379_node_22 (SEQ ID NO: 65)
AA604379_node_25 (SEQ ID NO: 66)
AA604379_node_27 (SEQ ID NO: 67)
AA604379_node_0 (SEQ ID NO: 68)
AA604379_node_3 (SEQ ID NO: 69)
AA604379_node_4 (SEQ ID NO: 70)
AA604379_node_5 (SEQ ID NO: 71)
AA604379_node_6 (SEQ ID NO: 72)
AA604379_node_10 (SEQ ID NO: 73)
AA604379_node_11 (SEQ ID NO: 74)
AA604379_node_12 (SEQ ID NO: 75)
AA604379_node_13 (SEQ ID NO: 76)
AA604379_node_16 (SEQ ID NO: 77)
AA604379_node_18 (SEQ ID NO: 78)
AA604379_node_20 (SEQ ID NO: 79)
AA604379_node_23 (SEQ ID NO: 80)
AA604379_node_24 (SEQ ID NO: 81)
AA604379_node_26 (SEQ ID NO: 82)

TABLE 52

Proteins of interest

| Protein Name | Corresponding Transcript(s) |
|---|---|
| AA604379_P1 | AA604379_T4 (SEQ ID NO: 57) |
| AA604379_P3 | AA604379_T5 (SEQ ID NO: 58); AA604379_T6 (SEQ ID NO: 59) |
| AA604379_P4 | AA604379_T10 (SEQ ID NO: 60) |

Cluster AA604379 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 5 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 5 and Table 53. This cluster is overexpressed (at least at a minimum level) in the following pathological conditions: brain malignant tumors, epithelial malignant tumors, a mixture of malignant tumors from different

TABLE 53

Normal tissue distribution

| Name of Tissue | Number |
|---|---|
| adrenal | 0 |
| Brain | 2 |
| Colon | 0 |
| epithelial | 0 |
| general | 2 |
| head and neck | 0 |
| Kidney | 0 |
| Liver | 0 |
| Lung | 0 |
| Lymph nodes | 0 |
| Breast | 0 |

TABLE 53-continued

Normal tissue distribution

| Name of Tissue | Number |
|---|---|
| bone marrow | 0 |
| muscle | 0 |
| Ovary | 0 |
| pancreas | 0 |
| prostate | 0 |
| Skin | 0 |
| stomach | 0 |
| Uterus | 0 |

TABLE 54

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| Brain | 2.8e−03 | 1.3e−03 | 9.4e−03 | 9.1 | 6.2e−07 | 10.5 |
| Colon | 1.7e−01 | 1.5e−01 | 7.0e−01 | 1.6 | 3.5e−01 | 2.0 |
| epithelial | 2.4e−03 | 1.1e−07 | 2.2e−02 | 6.7 | 1.9e−11 | 26.7 |
| general | 4.9e−07 | 1.8e−14 | 1.2e−05 | 7.0 | 5.0e−27 | 18.6 |
| head and neck | 1 | 5.0e−01 | 1 | 1.0 | 4.2e−01 | 1.7 |
| Kidney | 1 | 5.1e−01 | 1 | 1.0 | 7.0e−01 | 1.5 |
| Liver | 1 | 4.5e−01 | 1 | 1.0 | 4.8e−01 | 1.9 |
| Lung | 5.0e−01 | 2.5e−01 | 4.1e−01 | 2.4 | 2.1e−02 | 3.5 |
| Lymph nodes | 1 | 3.1e−01 | 1 | 1.0 | 1 | 1.7 |
| Breast | 5.9e−01 | 3.0e−01 | 6.9e−01 | 1.5 | 6.8e−01 | 1.4 |
| bone marrow | 1 | 6.7e−01 | 1 | 1.0 | 5.3e−01 | 1.9 |
| muscle | 1 | 2.9e−01 | 1 | 1.0 | 2.3e−02 | 4.1 |
| Ovary | 1 | 6.5e−01 | 1 | 1.0 | 5.9e−01 | 1.6 |
| pancreas | 1 | 4.4e−01 | 1 | 1.0 | 5.3e−01 | 1.9 |
| prostate | 7.3e−01 | 3.6e−01 | 6.7e−01 | 1.5 | 4.2e−01 | 2.0 |
| Skin | 1 | 6.9e−02 | 1 | 1.0 | 4.9e−03 | 3.8 |
| stomach | 1 | 2.7e−01 | 1 | 1.0 | 1.6e−01 | 2.5 |
| Uterus | 4.7e−01 | 1.4e−01 | 6.6e−01 | 1.5 | 9.4e−03 | 3.7 |

As noted above, cluster AA604379 features 22 segment(s), which were listed in Table 51 above and for which the sequence(s) are given at the end of the application. These segment(s) are portions of nucleic acid sequence(s) which are described herein separately because they are of particular interest. A description of each segment according to the present invention is now provided.

Segment cluster AA604379_node_2 (SEQ ID NO:61) according to the present invention is supported by 63 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 55 below describes the starting and ending position of this segment on each transcript.

TABLE 55

Segment location on transcripts

| Transcript name | Segment starting position | Segment ending position |
|---|---|---|
| AA604379_T4 (SEQ ID NO: 57) | 75 | 222 |
| AA604379_T5 (SEQ ID NO: 58) | 75 | 222 |
| AA604379_T6 (SEQ ID NO: 59) | 75 | 222 |
| AA604379_T10 (SEQ ID NO: 60) | 75 | 222 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node__14 (SEQ ID NO:62) according to the present invention is supported by 55 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 56 below describes the starting and ending position of this segment on each transcript.

TABLE 56

Segment location on transcripts

| Transcript name | Segment starting position | Segment ending position |
|---|---|---|
| AA604379_T4 (SEQ ID NO: 57) | 560 | 699 |
| AA604379_T5 (SEQ ID NO: 58) | 560 | 699 |
| AA604379_T6 (SEQ ID NO: 59) | 560 | 699 |
| AA604379_T10 (SEQ ID NO: 60) | 498 | 637 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node__19 (SEQ ID NO:63) according to the present invention is supported by 6 libraries. The number of libraries was determined as previously described. This segment can be found in the following transcript(s): AA604379_T5 (SEQ ID NO:58) and AA604379_T10 (SEQ ID NO:60). Table 57 below describes the starting and ending position of this segment on each transcript.

TABLE 57

Segment location on transcripts

| Transcript name | Segment starting position | Segment ending position |
|---|---|---|
| AA604379_T5 (SEQ ID NO: 58) | 871 | 1119 |
| AA604379_T10 (SEQ ID NO: 60) | 809 | 1057 |

This segment can be found in both coding and non-coding regions of transcript(s) as follows. The segment can be found in a non-coding region of transcript(s) that are related to the following protein(s): AA604379_P3. This segment can also be found in the following protein(s): AA604379_P4, since it is in the coding region for the corresponding transcript.

Segment cluster AA604379_node__21 (SEQ ID NO:64) according to the present invention is supported by 10 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 58 below describes the starting and ending position of this segment on each transcript.

TABLE 58

Segment location on transcripts

| Transcript name | Segment starting position | Segment ending position |
|---|---|---|
| AA604379_T4 (SEQ ID NO: 57) | 841 | 1129 |
| AA604379_T5 (SEQ ID NO: 58) | 1165 | 1453 |
| AA604379_T6 (SEQ ID NO: 59) | 916 | 1204 |
| AA604379_T10 (SEQ ID NO: 60) | 1103 | 1391 |

This segment can be found in both coding and non-coding regions of transcript(s) as follows. The segment can be found in a non-coding region of transcript(s) that are related to the following protein(s): AA604379_P1 and AA604379_P3. This segment can also be found in the following protein(s): AA604379_P4, since it is in the coding region for the corresponding transcript.

Segment cluster AA604379_node__22 (SEQ ID NO:65) according to the present invention is supported by 38 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 59 below describes the starting and ending position of this segment on each transcript.

TABLE 59

Segment location on transcripts

| Transcript name | Segment starting position | Segment ending position |
|---|---|---|
| AA604379_T4 (SEQ ID NO: 57) | 1130 | 1321 |
| AA604379_T5 (SEQ ID NO: 58) | 1454 | 1645 |
| AA604379_T6 (SEQ ID NO: 59) | 1205 | 1396 |
| AA604379_T10 (SEQ ID NO: 60) | 1392 | 1583 |

This segment can be found in a non-coding region of transcript(s) that are related to the following protein(s): AA604379_P1, AA604379_P3 and AA604379_P4.

Segment cluster AA604379_node__25 (SEQ ID NO:66) according to the present invention is supported by 44 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 60 below describes the starting and ending position of this segment on each transcript.

TABLE 60

Segment location on transcripts

| Transcript name | Segment starting position | Segment ending position |
|---|---|---|
| AA604379_T4 (SEQ ID NO: 57) | 1495 | 1688 |
| AA604379_T5 (SEQ ID NO: 58) | 1819 | 2012 |
| AA604379_T6 (SEQ ID NO: 59) | 1570 | 1763 |
| AA604379_T10 (SEQ ID NO: 60) | 1757 | 1950 |

This segment can be found in a non-coding region of transcript(s) that are related to the following protein(s): AA604379_P1, AA604379_P3 and AA604379_P4.

Segment cluster AA604379_node__27 (SEQ ID NO:67) according to the present invention is supported by 41 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 61 below describes the starting and ending position of this segment on each transcript.

TABLE 61

Segment location on transcripts

| Transcript name | Segment starting position | Segment ending position |
|---|---|---|
| AA604379_T4 (SEQ ID NO: 57) | 1703 | 1833 |
| AA604379_T5 (SEQ ID NO: 58) | 2027 | 2157 |
| AA604379_T6 (SEQ ID NO: 59) | 1778 | 1908 |
| AA604379_T10 (SEQ ID NO: 60) | 1965 | 2095 |

This segment can be found in a non-coding region of transcript(s) that are related to the following protein(s): AA604379_P1, AA604379_P3 and AA604379_P4.

According to an optional embodiment of the present invention, short segments related to the above cluster are also provided. These segments are up to about 120 bp in length, and so are included in a separate description.

Segment cluster AA604379_node__0 (SEQ ID NO:68) according to the present invention is supported by 48 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 62 below describes the starting and ending position of this segment on each transcript.

TABLE 62

Segment location on transcripts

| Transcript name | Segment starting position | Segment ending position |
|---|---|---|
| AA604379_T4 (SEQ ID NO: 57) | 1 | 74 |
| AA604379_T5 (SEQ ID NO: 58) | 1 | 74 |
| AA604379_T6 (SEQ ID NO: 59) | 1 | 74 |
| AA604379_T10 (SEQ ID NO: 60) | 1 | 74 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node__3 (SEQ ID NO:69) according to the present invention is supported by 65 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 63 below describes the starting and ending position of this segment on each transcript.

TABLE 63

Segment location on transcripts

| Transcript name | Segment starting position | Segment ending position |
|---|---|---|
| AA604379_T4 (SEQ ID NO: 57) | 223 | 322 |
| AA604379_T5 (SEQ ID NO: 58) | 223 | 322 |
| AA604379_T6 (SEQ ID NO: 59) | 223 | 322 |
| AA604379_T10 (SEQ ID NO: 60) | 223 | 322 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node__4 (SEQ ID NO:70) according to the present invention can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 64 below describes the starting and ending position of this segment on each transcript.

TABLE 64

Segment location on transcripts

| Transcript name | Segment starting position | Segment ending position |
|---|---|---|
| AA604379_T4 (SEQ ID NO: 57) | 323 | 341 |
| AA604379_T5 (SEQ ID NO: 58) | 323 | 341 |
| AA604379_T6 (SEQ ID NO: 59) | 323 | 341 |
| AA604379_T10 (SEQ ID NO: 60) | 323 | 341 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node__5 (SEQ ID NO:71) according to the present invention is supported by 58 libraries. The number of libraries was determined as previously described. This segment can be found in the following transcript(s): AA604379_T4 (SEQ ID NO:57), AA604379_T5 (SEQ ID NO:58) and AA604379__6 (SEQ ID NO:59). Table 65 below describes the starting and ending position of this segment on each transcript.

TABLE 65

Segment location on transcripts

| Transcript name | Segment starting position | Segment ending position |
|---|---|---|
| AA604379_T4 (SEQ ID NO: 57) | 342 | 380 |
| AA604379_T5 (SEQ ID NO: 58) | 342 | 380 |
| AA604379_T6 (SEQ ID NO: 59) | 342 | 380 |

This segment can be found in the following protein(s): AA604379_P1 and AA604379_P3.

Segment cluster AA604379_node__6 (SEQ ID NO:72) according to the present invention can be found in the following transcript(s): AA604379_4 (SEQ ID NO:57), AA604379_5 (SEQ ID NO:58) and AA604379_T6 (SEQ ID NO:59). Table 66 below describes the starting and ending position of this segment on each transcript.

TABLE 66

Segment location on transcripts

| Transcript name | Segment starting position | Segment ending position |
| --- | --- | --- |
| AA604379_T4 (SEQ ID NO: 57) | 381 | 403 |
| AA604379_T5 (SEQ ID NO: 58) | 381 | 403 |
| AA604379_T6 (SEQ ID NO: 59) | 381 | 403 |

This segment can be found in the following protein(s): AA604379_P1 and AA604379_P3.

Segment cluster AA604379_node_10 (SEQ ID NO:73) according to the present invention is supported by 59 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 67 below describes the starting and ending position of this segment on each transcript.

TABLE 67

Segment location on transcripts

| Transcript name | Segment starting position | Segment ending position |
| --- | --- | --- |
| AA604379_T4 (SEQ ID NO: 57) | 404 | 450 |
| AA604379_T5 (SEQ ID NO: 58) | 404 | 450 |
| AA604379_T6 (SEQ ID NO: 59) | 404 | 450 |
| AA604379_T10 (SEQ ID NO: 60) | 342 | 388 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node_11 (SEQ ID NO:74) according to the present invention is supported by 58 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 68 below describes the starting and ending position of this segment on each transcript.

TABLE 68

Segment location on transcripts

| Transcript name | Segment starting position | Segment ending position |
| --- | --- | --- |
| AA604379_T4 (SEQ ID NO: 57) | 451 | 486 |
| AA604379_T5 (SEQ ID NO: 58) | 451 | 486 |
| AA604379_T6 (SEQ ID NO: 59) | 451 | 486 |
| AA604379_T10 (SEQ ID NO: 60) | 389 | 424 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node_12 (SEQ ID NO:75) according to the present invention is supported by 57 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 69 below describes the starting and ending position of this segment on each transcript.

TABLE 69

Segment location on transcripts

| Transcript name | Segment starting position | Segment ending position |
| --- | --- | --- |
| AA604379_T4 (SEQ ID NO: 57) | 487 | 520 |
| AA604379_T5 (SEQ ID NO: 58) | 487 | 520 |
| AA604379_T6 (SEQ ID NO: 59) | 487 | 520 |
| AA604379_T10 (SEQ ID NO: 60) | 425 | 458 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node_13 (SEQ ID NO:76) according to the present invention is supported by 54 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 70 below describes the starting and ending position of this segment on each transcript.

TABLE 70

Segment location on transcripts

| Transcript name | Segment starting position | Segment ending position |
| --- | --- | --- |
| AA604379_T4 (SEQ ID NO: 57) | 521 | 559 |
| AA604379_T5 (SEQ ID NO: 58) | 521 | 559 |
| AA604379_T6 (SEQ ID NO: 59) | 521 | 559 |
| AA604379_T10 (SEQ ID NO: 60) | 459 | 497 |

This segment can be found in both coding and non-coding regions of transcript(s) as follows. The segment can be found in a non-coding region of transcript(s) that are related to the following protein(s): AA604379_P4. This segment can also be found in the following protein(s): AA604379_P1 and AA604379_P3, since it is in the coding region for the corresponding transcript.

Segment cluster AA604379_node_16 (SEQ ID NO:77) according to the present invention is supported by 46 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 71 below describes the starting and ending position of this segment on each transcript.

TABLE 71

Segment location on transcripts

| Transcript name | Segment starting position | Segment ending position |
| --- | --- | --- |
| AA604379_T4 (SEQ ID NO: 57) | 700 | 795 |
| AA604379_T5 (SEQ ID NO: 58) | 700 | 795 |
| AA604379_T6 (SEQ ID NO: 59) | 700 | 795 |
| AA604379_T10 (SEQ ID NO: 60) | 638 | 733 |

This segment can be found in the following protein(s): AA604379_P1, AA604379_P3 and AA604379_P4.

Segment cluster AA604379_node_18 (SEQ ID NO:78) according to the present invention is supported by 6 libraries. The number of libraries was determined as previously described. This segment can be found in the following transcript(s): AA604379_5 (SEQ ID NO:58), AA604379_T6 (SEQ ID NO:59) and AA604379_10 (SEQ ID NO:60). Table 72 below describes the starting and ending position of this segment on each transcript.

TABLE 72

Segment location on transcripts

| Transcript name | Segment starting position | Segment ending position |
| --- | --- | --- |
| AA604379_T5 (SEQ ID NO: 58) | 796 | 870 |
| AA604379_T6 (SEQ ID NO: 59) | 796 | 870 |
| AA604379_T10 (SEQ ID NO: 60) | 734 | 808 |

This segment can be found in the following protein(s): AA604379_P3 and AA604379_P4.

Segment cluster AA604379_node_20 (SEQ ID NO:79) according to the present invention is supported by 32 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 73 below describes the starting and ending position of this segment on each transcript.

TABLE 73

Segment location on transcripts

| Transcript name | Segment starting position | Segment ending position |
| --- | --- | --- |
| AA604379_T4 (SEQ ID NO: 57) | 796 | 840 |
| AA604379_T5 (SEQ ID NO: 58) | 1120 | 1164 |
| AA604379_T6 (SEQ ID NO: 59) | 871 | 915 |
| AA604379_T10 (SEQ ID NO: 60) | 1058 | 1102 |

This segment can be found in both coding and non-coding regions of transcript(s) as follows. The segment can be found in a non-coding region of transcript(s) that are related to the following protein(s): AA604379_P3. This segment can also be found in the following protein(s): AA604379_P1 and AA604379_P4, since it is in the coding region for the corresponding transcript.

Segment cluster AA604379_node_23 (SEQ ID NO:80) according to the present invention is supported by 37 libraries. The number of libraries was determined as previously described. This segment can be found in the following transcript(s): AA604379_T4 (SEQ ID NO:57), AA604379_T5 (SEQ ID NO:58), AA604379_T6 (SEQ ID NO:59) and AA604379_T10 (SEQ ID NO:60). Table 74 below describes the starting and ending position of this segment on each transcript.

TABLE 74

Segment location on transcripts

| Transcript name | Segment starting position | Segment ending position |
| --- | --- | --- |
| AA604379_T4 (SEQ ID NO: 57) | 1322 | 1375 |
| AA604379_T5 (SEQ ID NO: 58) | 1646 | 1699 |
| AA604379_T6 (SEQ ID NO: 59) | 1397 | 1450 |
| AA604379_T10 (SEQ ID NO: 60) | 1584 | 1637 |

This segment can be found in a non-coding region of transcript(s) that are related to the following protein(s): AA604379_P1, AA604379_P3 and AA604379_P4.

Segment cluster AA604379_node_24 (SEQ ID NO:81) according to the present invention is supported by 45 libraries. The number of libraries was determined as previously described. This segment can be found in the following transcript(s): AA604379_4 (SEQ ID NO:57), AA604379_T5 (SEQ ID NO:58), AA604379_T6 (SEQ ID NO:59) and AA604379_T10 (SEQ ID NO:60). Table 75 below describes the starting and ending position of this segment on each transcript.

TABLE 75

Segment location on transcripts

| Transcript name | Segment starting position | Segment ending position |
| --- | --- | --- |
| AA604379_T4 (SEQ ID NO: 57) | 1376 | 1494 |
| AA604379_T5 (SEQ ID NO: 58) | 1700 | 1818 |
| AA604379_T6 (SEQ ID NO: 59) | 1451 | 1569 |
| AA604379_T10 (SEQ ID NO: 60) | 1638 | 1756 |

This segment can be found in a non-coding region of transcript(s) that are related to the following protein(s): AA604379_P1, AA604379_P3 and AA604379_P4.

Segment cluster AA604379_node_26 (SEQ ID NO:82) according to the present invention can be found in the following transcript(s): AA604379_4 (SEQ ID NO:57), AA604379_5 (SEQ ID NO:58), AA604379_T6 (SEQ ID NO:59) and AA604379_T10 (SEQ ID NO:60). Table 76 below describes the starting and ending position of this segment on each transcript.

TABLE 76

Segment location on transcripts

| Transcript name | Segment starting position | Segment ending position |
| --- | --- | --- |
| AA604379_T4 (SEQ ID NO: 57) | 1689 | 1702 |
| AA604379_T5 (SEQ ID NO: 58) | 2013 | 2026 |
| AA604379_T6 (SEQ ID NO: 59) | 1764 | 1777 |
| AA604379_T10 (SEQ ID NO: 60) | 1951 | 1964 |

This segment can be found in a non-coding region of transcript(s) that are related to the following protein(s): AA604379_P1, AA604379_P3 and AA604379_P4.

Description for Cluster C03218

Cluster C03218 features 6 transcript(s) and 7 segment(s) of interest, the names for which are given in Tables 77 and 78, respectively, the sequences themselves are given at the end of the application.

TABLE 77

Transcripts of interest
Transcript Name

C03218_T0 (SEQ ID NO: 83)
C03218_T1 (SEQ ID NO: 84)
C03218_T2 (SEQ ID NO: 85)
C03218_T3 (SEQ ID NO: 86)
C03218_T4 (SEQ ID NO: 87)
C03218_T5 (SEQ ID NO: 88)

TABLE 78

Segments of interest
Segment Name

C03218_node_0 (SEQ ID NO: 89)
C03218_node_7 (SEQ ID NO: 90)
C03218_node_8 (SEQ ID NO: 91)
C03218_node_10 (SEQ ID NO: 92)
C03218_node_2 (SEQ ID NO: 93)
C03218_node_4 (SEQ ID NO: 94)
C03218_node_5 (SEQ ID NO: 95)

The heart-selective diagnostic marker prediction engine provided the following results with regard to cluster C03218. Predictions were made for selective expression of transcripts of this contig in heart tissue, according to the previously described methods. The numbers on the y-axis of the first FIG. 6 below refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 6, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 130.1; the ratio of expression of the cluster in heart specific ESTs to the overall expression of the cluster in muscle-specific ESTs which was found to be 96.2; and fisher exact test P-values were computed both for library and weighted clone counts to check that the counts are statistically significant, and were found to be 1.70E-08.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 130.1, which clearly supports specific expression in heart tissue.

As noted above, cluster C03218 features 7 segment(s), which were listed in Table 78 above and for which the sequence(s) are given at the end of the application. These segment(s) are portions of nucleic acid sequence(s) which are described herein separately because they are of particular interest. A description of each segment according to the present invention is now provided.

Segment cluster C03218_node_0 (SEQ ID NO:89) according to the present invention is supported by 6 libraries. The number of libraries was determined as previously described. This segment can be found in the following transcript(s): C03218_T0 (SEQ ID NO:83), C03218_T1 (SEQ ID NO:84), C03218_T2 (SEQ ID NO:85), C03218_T3 (SEQ ID NO:86), C03218_T4 (SEQ ID NO:87) and C03218_T5 (SEQ ID NO:88). Table 80 below describes the starting and ending position of this segment on each transcript.

TABLE 80

Segment location on transcripts

| Transcript name | Segment starting position | Segment ending position |
|---|---|---|
| C03218_T0 (SEQ ID NO: 83) | 1 | 174 |
| C03218_T1 (SEQ ID NO: 84) | 1 | 174 |
| C03218_T2 (SEQ ID NO: 85) | 1 | 174 |
| C03218_T3 (SEQ ID NO: 86) | 1 | 174 |
| C03218_T4 (SEQ ID NO: 87) | 1 | 174 |
| C03218_T5 (SEQ ID NO: 88) | 1 | 174 |

The previously-described transcripts for these segment(s) do not code for protein.

Segment cluster C03218_node_7 (SEQ ID NO:90) according to the present invention is supported by 4 libraries. The number of libraries was determined as previously described. This segment can be found in the following transcript(s): C03218_T0 (SEQ ID NO:83), C03218_T1 (SEQ ID NO:84), C03218_T2 (SEQ ID NO:85) and C03218_T3 (SEQ ID NO:86). Table 81 below describes the starting and ending position of this segment on each transcript.

TABLE 81

Segment location on transcripts

| Transcript name | Segment starting position | Segment ending position |
|---|---|---|
| C03218_T0 (SEQ ID NO: 83) | 290 | 994 |
| C03218_T1 (SEQ ID NO: 84) | 306 | 1010 |
| C03218_T2 (SEQ ID NO: 85) | 418 | 1122 |
| C03218_T3 (SEQ ID NO: 86) | 306 | 1010 |

The previously-described transcripts for these segment(s) do not code for protein.

Segment cluster C03218_node_8 (SEQ ID NO:91) according to the present invention is supported by 2 libraries. The number of libraries was determined as previously described. This segment can be found in the following transcript(s): C03218_T0 (SEQ ID NO:83), C03218_T1 (SEQ ID NO:84) and C03218_T2 (SEQ ID NO:85). Table 82 below describes the starting and ending position of this segment on each transcript.

TABLE 82

Segment location on transcripts

| Transcript name | Segment starting position | Segment ending position |
|---|---|---|
| C03218_T0 (SEQ ID NO: 83) | 995 | 2410 |
| C03218_T1 (SEQ ID NO: 84) | 1011 | 2426 |
| C03218_T2 (SEQ ID NO: 85) | 1123 | 2538 |

The previously-described transcripts for these segment(s) do not code for protein.

Segment cluster C03218_node_10 (SEQ ID NO:92) according to the present invention is supported by 4 libraries. The number of libraries was determined as previously described. This segment can be found in the following transcript(s): C03218_T3 (SEQ ID NO:86), C03218_T4 (SEQ ID NO:87) and C03218_T5 (SEQ ID NO:88). Table 83 below describes the starting and ending position of this segment on each transcript.

TABLE 83

| Segment location on transcripts | | |
| --- | --- | --- |
| Transcript name | Segment starting position | Segment ending position |
| C03218_T3 (SEQ ID NO: 86) | 1011 | 1779 |
| C03218_T4 (SEQ ID NO: 87) | 175 | 943 |
| C03218_T5 (SEQ ID NO: 88) | 290 | 1058 |

The previously-described transcripts for these segment(s) do not code for protein.

According to an optional embodiment of the present invention, short segments related to the above cluster are also provided. These segments are up to about 120 bp in length, and so are included in a separate description.

Segment cluster C03218_node_2 (SEQ ID NO:93) according to the present invention is supported by 1 libraries. The number of libraries was determined as previously described. This segment can be found in the following transcript(s): C03218_T2 (SEQ ID NO:85). Table 84 below describes the starting and ending position of this segment on each transcript.

TABLE 84

| Segment location on transcripts | | |
| --- | --- | --- |
| Transcript name | Segment starting position | Segment ending position |
| C03218_T2 (SEQ ID NO: 85) | 175 | 286 |

The previously-described transcripts for these segment(s) do not code for protein.

Segment cluster C03218_node_4 (SEQ ID NO:94) according to the present invention can be found in the following transcript(s): C03218_T1 (SEQ ID NO:84), C03218_T2 (SEQ ID NO:85) and C03218_T3 (SEQ ID NO:86). Table 85 below describes the starting and ending position of this segment on each transcript.

TABLE 85

| Segment location on transcripts | | |
| --- | --- | --- |
| Transcript name | Segment starting position | Segment ending position |
| C03218_T1 (SEQ ID NO: 84) | 175 | 190 |
| C03218_T2 (SEQ ID NO: 85) | 287 | 302 |
| C03218_T3 (SEQ ID NO: 86) | 175 | 190 |

The previously-described transcripts for these segment(s) do not code for protein.

Segment cluster C03218_node_5 (SEQ ID NO:95) according to the present invention is supported by 5 libraries. The number of libraries was determined as previously described. This segment can be found in the following transcript(s): C03218_T0 (SEQ ID NO:83), C03218_T1 (SEQ ID NO:84), C03218_T2 (SEQ ID NO:85), C03218_T3 (SEQ ID NO:86) and C03218_T5 (SEQ ID NO:88). Table 86 below describes the starting and ending position of this segment on each transcript.

TABLE 86

| Segment location on transcripts | | |
| --- | --- | --- |
| Transcript name | Segment starting position | Segment ending position |
| C03218_T0 (SEQ ID NO: 83) | 175 | 289 |
| C03218_T1 (SEQ ID NO: 84) | 191 | 305 |
| C03218_T2 (SEQ ID NO: 85) | 303 | 417 |
| C03218_T3 (SEQ ID NO: 86) | 191 | 305 |
| C03218_T5 (SEQ ID NO: 88) | 175 | 289 |

The previously-described transcripts for these segment(s) do not code for protein.

Description for Cluster C03950

Cluster C03950 features 5 transcript(s) and 34 segment(s) of interest, the names for which are given in Tables 87 and 88, respectively, the sequences themselves are given at the end of the application. The selected protein variants are given in Table 89.

TABLE 87

| Transcripts of interest Transcript Name |
| --- |
| C03950_T0 (SEQ ID NO: 96) |
| C03950_T7 (SEQ ID NO: 97) |
| C03950_T8 (SEQ ID NO: 98) |
| C03950_T9 (SEQ ID NO: 99) |
| C03950_T13 (SEQ ID NO: 100) |

TABLE 88

| Segments of interest Segment Name |
| --- |
| C03950_node_4 (SEQ ID NO: 101) |
| C03950_node_8 (SEQ ID NO: 102) |
| C03950_node_13 (SEQ ID NO: 103) |
| C03950_node_25 (SEQ ID NO: 104) |
| C03950_node_29 (SEQ ID NO: 105) |
| C03950_node_36 (SEQ ID NO: 106) |
| C03950_node_47 (SEQ ID NO: 107) |
| C03950_node_48 (SEQ ID NO: 108) |
| C03950_node_57 (SEQ ID NO: 109) |
| C03950_node_63 (SEQ ID NO: 110) |
| C03950_node_67 (SEQ ID NO: 111) |
| C03950_node_71 (SEQ ID NO: 112) |
| C03950_node_77 (SEQ ID NO: 113) |
| C03950_node_0 (SEQ ID NO: 114) |
| C03950_node_1 (SEQ ID NO: 115) |
| C03950_node_2 (SEQ ID NO: 116) |
| C03950_node_6 (SEQ ID NO: 117) |
| C03950_node_11 (SEQ ID NO: 118) |
| C03950_node_15 (SEQ ID NO: 119) |
| C03950_node_17 (SEQ ID NO: 120) |
| C03950_node_21 (SEQ ID NO: 121) |
| C03950_node_23 (SEQ ID NO: 122) |
| C03950_node_32 (SEQ ID NO: 123) |
| C03950_node_34 (SEQ ID NO: 124) |
| C03950_node_38 (SEQ ID NO: 125) |
| C03950_node_40 (SEQ ID NO: 126) |
| C03950_node_42 (SEQ ID NO: 127) |
| C03950_node_45 (SEQ ID NO: 128) |
| C03950_node_50 (SEQ ID NO: 129) |

TABLE 88-continued

Segments of interest
Segment Name

C03950_node_59 (SEQ ID NO: 130)
C03950_node_61 (SEQ ID NO: 131)
C03950_node_65 (SEQ ID NO: 132)
C03950_node_69 (SEQ ID NO: 133)
C03950_node_73 (SEQ ID NO: 134)

TABLE 89

Proteins of interest

| Protein Name | Corresponding Transcript(s) |
|---|---|
| C03950_P7 | C03950_T7 (SEQ ID NO: 97) |
| C03950_P8 | C03950_T8 (SEQ ID NO: 98) |
| C03950_P9 | C03950_T9 (SEQ ID NO: 99) |
| C03950_P13 | C03950_T13 (SEQ ID NO: 100) |
| C03950_P14 | C03950_T0 (SEQ ID NO: 96) |

The heart-selective diagnostic marker prediction engine provided the following results with regard to cluster C03950. Predictions were made for selective expression of transcripts of this contig in heart tissue, according to the previously described methods. The numbers on the y-axis of the first FIG. 7 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 7, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 9.5; the ratio of expression of the cluster in heart specific ESTs to the overall expression of the cluster in muscle-specific ESTs which was found to be 3.7; and fisher exact test P-values were computed both for library and weighted clone counts to check that the counts are statistically significant, and were found to be 1.40E-03.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 9.5, which clearly supports specific expression in heart tissue.

As noted above, cluster C03950 features 34 segment(s), which were listed in Table 88 above and for which the sequence(s) are given at the end of the application. These segment(s) are portions of nucleic acid sequence(s) which are described herein separately because they are of particular interest. A description of each segment according to the present invention is now provided.

Segment cluster C03950_node_4 (SEQ ID NO:101) according to the present invention is supported by 10 libraries. The number of libraries was determined as previously described. This segment can be found in the following transcript(s): C03950_T7 (SEQ ID NO:97), C03950_T8 (SEQ ID NO:98), C03950_T9 (SEQ ID NO:99) and C03950_T13 (SEQ ID NO:100). Table 90 below describes the starting and ending position of this segment on each transcript.

TABLE 90

Segment location on transcripts

| Transcript name | Segment starting position | Segment ending position |
|---|---|---|
| C03950_T7 (SEQ ID NO: 97) | 122 | 289 |
| C03950_T8 (SEQ ID NO: 98) | 122 | 289 |
| C03950_T9 (SEQ ID NO: 99) | 122 | 289 |
| C03950_T13 (SEQ ID NO: 100) | 135 | 302 |

This segment can be found in the following protein(s): C03950_P7, C03950_P8, C03950_P9 and C03950_P13.

Segment cluster C03950_node_8 (SEQ ID NO:102) according to the present invention is supported by 5 libraries. The number of libraries was determined as previously described. This segment can be found in the following transcript(s): C03950_T0 (SEQ ID NO:96). Table 91 below describes the starting and ending position of this segment on each transcript.

TABLE 91

Segment location on transcripts

| Transcript name | Segment starting position | Segment ending position |
|---|---|---|
| C03950_T0 (SEQ ID NO: 96) | 1 | 428 |

This segment can be found in the following protein(s): C03950_P14.

Segment cluster C03950_node_13 (SEQ ID NO:103) according to the present invention is supported by 3 libraries. The number of libraries was determined as previously described. This segment can be found in the following transcript(s): C03950_T13 (SEQ ID NO:100). Table 92 below describes the starting and ending position of this segment on each transcript.

TABLE 92

Segment location on transcripts

| Transcript name | Segment starting position | Segment ending position |
|---|---|---|
| C03950_T13 (SEQ ID NO: 100) | 505 | 1232 |

This segment can be found in the following protein(s): C03950_P13.

Segment cluster C03950_node_25 (SEQ ID NO:104) according to the present invention is supported by 8 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 93 below describes the starting and ending position of this segment on each transcript.

TABLE 93

Segment location on transcripts

| Transcript name | Segment starting position | Segment ending position |
| --- | --- | --- |
| C03950_T0 (SEQ ID NO: 96) | 932 | 1070 |
| C03950_T7 (SEQ ID NO: 97) | 886 | 1024 |
| C03950_T8 (SEQ ID NO: 98) | 886 | 1024 |
| C03950_T9 (SEQ ID NO: 99) | 886 | 1024 |

This segment can be found in the following protein(s): C03950_P14, C03950_P7, C03950_P8 and C03950_P9.

Segment cluster C03950_node_29 (SEQ ID NO:105) according to the present invention is supported by 10 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 94 below describes the starting and ending position of this segment on each transcript.

TABLE 94

Segment location on transcripts

| Transcript name | Segment starting position | Segment ending position |
| --- | --- | --- |
| C03950_T0 (SEQ ID NO: 96) | 1071 | 1215 |
| C03950_T7 (SEQ ID NO: 97) | 1025 | 1169 |
| C03950_T8 (SEQ ID NO: 98) | 1025 | 1169 |
| C03950_T9 (SEQ ID NO: 99) | 1025 | 1169 |

This segment can be found in the following protein(s): C03950_P14, C03950_P7, C03950_P8 and C03950_P9.

Segment cluster C03950_node_36 (SEQ ID NO:106) according to the present invention is supported by 10 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 95 below describes the starting and ending position of this segment on each transcript.

TABLE 95

Segment location on transcripts

| Transcript name | Segment starting position | Segment ending position |
| --- | --- | --- |
| C03950_T0 (SEQ ID NO: 96) | 1416 | 1565 |
| C03950_T7 (SEQ ID NO: 97) | 1370 | 1519 |
| C03950_T8 (SEQ ID NO: 98) | 1370 | 1519 |
| C03950_T9 (SEQ ID NO: 99) | 1370 | 1519 |

This segment can be found in the following protein(s): C03950_P14, C03950_P7, C03950_P8 and C03950_P9.

Segment cluster C03950_node_47 (SEQ ID NO:107) according to the present invention is supported by 19 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 96 below describes the starting and ending position of this segment on each transcript.

TABLE 96

Segment location on transcripts

| Transcript name | Segment starting position | Segment ending position |
| --- | --- | --- |
| C03950_T0 (SEQ ID NO: 96) | 1861 | 2055 |
| C03950_T7 (SEQ ID NO: 97) | 1815 | 2009 |
| C03950_T8 (SEQ ID NO: 98) | 1815 | 2009 |
| C03950_T9 (SEQ ID NO: 99) | 1815 | 2009 |

This segment can be found in the following protein(s): C03950_P14, C03950_P7, C03950_P8 and C03950_P9.

Segment cluster C03950_node_48 (SEQ ID NO:108) according to the present invention is supported by 2 libraries. The number of libraries was determined as previously described. This segment can be found in the following transcript(s): C03950_T9 (SEQ ID NO:99). Table 97 below describes the starting and ending position of this segment on each transcript.

TABLE 97

Segment location on transcripts

| Transcript name | Segment starting position | Segment ending position |
| --- | --- | --- |
| C03950_T9 (SEQ ID NO: 99) | 2010 | 2343 |

This segment can be found in the following protein(s): C03950_P9.

Segment cluster C03950_node_57 (SEQ ID NO:109) according to the present invention is supported by 8 libraries. The number of libraries was determined as previously described. This segment can be found in the following transcript(s): C03950_T7 (SEQ ID NO:97). Table 98 below describes the starting and ending position of this segment on each transcript.

TABLE 98

Segment location on transcripts

| Transcript name | Segment starting position | Segment ending position |
| --- | --- | --- |
| C03950_T7 (SEQ ID NO: 97) | 2115 | 2306 |

This segment can be found in the following protein(s): C03950_P7.

Segment cluster C03950_node_63 (SEQ ID NO:110) according to the present invention is supported by 2 libraries. The number of libraries was determined as previously described. This segment can be found in the following transcript(s): C03950_T0 (SEQ ID NO:96) and C03950_T8 (SEQ ID NO:98). Table 99 below describes the starting and ending position of this segment on each transcript.

TABLE 99

Segment location on transcripts

| Transcript name | Segment starting position | Segment ending position |
| --- | --- | --- |
| C03950_T0 (SEQ ID NO: 96) | 2267 | 2399 |
| C03950_T8 (SEQ ID NO: 98) | 2221 | 2353 |

This segment can be found in the following protein(s): C03950_P14 and C03950_P8.

Segment cluster C03950_node__67 (SEQ ID NO:111) according to the present invention is supported by 3 libraries. The number of libraries was determined as previously described. This segment can be found in the following transcript(s): C03950_T8 (SEQ ID NO:98). Table 100 below describes the starting and ending position of this segment on each transcript.

TABLE 100

| | Segment location on transcripts | |
|---|---|---|
| Transcript name | Segment starting position | Segment ending position |
| C03950_T8 (SEQ ID NO: 98) | 2464 | 2762 |

This segment can be found in the following protein(s): C03950_P8.

Segment cluster C03950_node__71 (SEQ ID NO:112) according to the present invention is supported by 4 libraries. The number of libraries was determined as previously described. This segment can be found in the following transcript(s): C03950_T0 (SEQ ID NO:96). Table 101 below describes the starting and ending position of this segment on each transcript.

TABLE 101

| | Segment location on transcripts | |
|---|---|---|
| Transcript name | Segment starting position | Segment ending position |
| C03950_T0 (SEQ ID NO: 96) | 2570 | 2739 |

This segment can be found in the following protein(s): C03950_P14.

Segment cluster C03950_node__77 (SEQ ID NO:113) according to the present invention is supported by 8 libraries. The number of libraries was determined as previously described. This segment can be found in the following transcript(s): C03950_T0 (SEQ ID NO:96). Table 102 below describes the starting and ending position of this segment on each transcript.

TABLE 102

| | Segment location on transcripts | |
|---|---|---|
| Transcript name | Segment starting position | Segment ending position |
| C03950_T0 (SEQ ID NO: 96) | 2819 | 3341 |

This segment can be found in the following protein(s): C03950_P14.

According to an optional embodiment of the present invention, short segments related to the above cluster are also provided. These segments are up to about 120 bp in length, and so are included in a separate description.

Segment cluster C03950_node__0 (SEQ ID NO:114) according to the present invention is supported by 1 libraries. The number of libraries was determined as previously described. This segment can be found in the following transcript(s): C03950_T13 (SEQ ID NO:100). Table 103 below describes the starting and ending position of this segment on each transcript.

TABLE 103

| | Segment location on transcripts | |
|---|---|---|
| Transcript name | Segment starting position | Segment ending position |
| C03950_T13 (SEQ ID NO: 100) | 1 | 39 |

This segment can be found in the following protein(s): C03950_P13.

Segment cluster C03950_node__1 (SEQ ID NO:115) according to the present invention is supported by 3 libraries. The number of libraries was determined as previously described. This segment can be found in the following transcript(s): C03950_T7 (SEQ ID NO:97), C03950_T8 (SEQ ID NO:98) and C03950_T9 (SEQ ID NO:99). Table 104 below describes the starting and ending position of this segment on each transcript.

TABLE 104

| | Segment location on transcripts | |
|---|---|---|
| Transcript name | Segment starting position | Segment ending position |
| C03950_T7 (SEQ ID NO: 97) | 1 | 26 |
| C03950_T8 (SEQ ID NO: 98) | 1 | 26 |
| C03950_T9 (SEQ ID NO: 99) | 1 | 26 |

This segment can be found in the following protein(s): C03950_P7, C03950_P8 and C03950_P9.

Segment cluster C03950_node__2 (SEQ ID NO:116) according to the present invention is supported by 8 libraries. The number of libraries was determined as previously described. This segment can be found in the following transcript(s): C03950_T7 (SEQ ID NO:97), C03950_T8 (SEQ ID NO:98), C03950_T9 (SEQ ID NO:99) and C03950_T13 (SEQ ID NO:100). Table 105 below describes the starting and ending position of this segment on each transcript.

TABLE 105

| | Segment location on transcripts | |
|---|---|---|
| Transcript name | Segment starting position | Segment ending position |
| C03950_T7 (SEQ ID NO: 97) | 27 | 121 |
| C03950_T8 (SEQ ID NO: 98) | 27 | 121 |
| C03950_T9 (SEQ ID NO: 99) | 27 | 121 |
| C03950_T13 (SEQ ID NO: 100) | 40 | 134 |

This segment can be found in the following protein(s): C03950_P7, C03950_P8, C03950_P9 and C03950_P13.

Segment cluster C03950_node__6 (SEQ ID NO:117) according to the present invention is supported by 9 libraries. The number of libraries was determined as previously described. This segment can be found in the following transcript(s): C03950_T7 (SEQ ID NO:97), C03950_T8 (SEQ ID NO:98), C03950_T9 (SEQ ID NO:99) and C03950_T13 (SEQ ID NO:100). Table 106 below describes the starting and ending position of this segment on each transcript.

TABLE 106

Segment location on transcripts

| Transcript name | Segment starting position | Segment ending position |
|---|---|---|
| C03950_T7 (SEQ ID NO: 97) | 290 | 382 |
| C03950_T8 (SEQ ID NO: 98) | 290 | 382 |
| C03950_T9 (SEQ ID NO: 99) | 290 | 382 |
| C03950_T13 (SEQ ID NO: 100) | 303 | 395 |

This segment can be found in the following protein(s): C03950_P7, C03950_P8, C03950_P9 and C03950_P13.

Segment cluster C03950_node_11 (SEQ ID NO:118) according to the present invention is supported by 12 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98), C03950_T9 (SEQ ID NO:99) and C03950_T13 (SEQ ID NO:100). Table 107 below describes the starting and ending position of this segment on each transcript.

TABLE 107

Segment location on transcripts

| Transcript name | Segment starting position | Segment ending position |
|---|---|---|
| C03950_T0 (SEQ ID NO: 96) | 429 | 537 |
| C03950_T7 (SEQ ID NO: 97) | 383 | 491 |
| C03950_T8 (SEQ ID NO: 98) | 383 | 491 |
| C03950_T9 (SEQ ID NO: 99) | 383 | 491 |
| C03950_T13 (SEQ ID NO: 100) | 396 | 504 |

This segment can be found in the following protein(s): C03950_P14, C03950_P7, C03950_P8, C03950_P9 and C03950_P13.

Segment cluster C03950_node_15 (SEQ ID NO:119) according to the present invention is supported by 11 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 108 below describes the starting and ending position of this segment on each transcript.

TABLE 108

Segment location on transcripts

| Transcript name | Segment starting position | Segment ending position |
|---|---|---|
| C03950_T0 (SEQ ID NO: 96) | 538 | 623 |
| C03950_T7 (SEQ ID NO: 97) | 492 | 577 |
| C03950_T8 (SEQ ID NO: 98) | 492 | 577 |
| C03950_T9 (SEQ ID NO: 99) | 492 | 577 |

This segment can be found in the following protein(s): C03950_P14, C03950_P7, C03950_P8 and C03950_P9.

Segment cluster C03950_node_17 (SEQ ID NO:120) according to the present invention is supported by 11 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 109 below describes the starting and ending position of this segment on each transcript.

TABLE 109

Segment location on transcripts

| Transcript name | Segment starting position | Segment ending position |
|---|---|---|
| C03950_T0 (SEQ ID NO: 96) | 624 | 721 |
| C03950_T7 (SEQ ID NO: 97) | 578 | 675 |
| C03950_T8 (SEQ ID NO: 98) | 578 | 675 |
| C03950_T9 (SEQ ID NO: 99) | 578 | 675 |

This segment can be found in the following protein(s): C03950_P14, C03950_P7, C03950_P8 and C03950_P9.

Segment cluster C03950_node_21 (SEQ ID NO:121) according to the present invention is supported by 11 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 110 below describes the starting and ending position of this segment on each transcript.

TABLE 110

Segment location on transcripts

| Transcript name | Segment starting position | Segment ending position |
|---|---|---|
| C03950_T0 (SEQ ID NO: 96) | 722 | 832 |
| C03950_T7 (SEQ ID NO: 97) | 676 | 786 |
| C03950_T8 (SEQ ID NO: 98) | 676 | 786 |
| C03950_T9 (SEQ ID NO: 99) | 676 | 786 |

This segment can be found in the following protein(s): C03950_P14, C03950_P7, C03950_P8 and C03950_P9.

Segment cluster C03950_node_23 (SEQ ID NO:122) according to the present invention is supported by 9 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 111 below describes the starting and ending position of this segment on each transcript.

TABLE 111

Segment location on transcripts

| Transcript name | Segment starting position | Segment ending position |
|---|---|---|
| C03950_T0 (SEQ ID NO: 96) | 833 | 931 |
| C03950_T7 (SEQ ID NO: 97) | 787 | 885 |
| C03950_T8 (SEQ ID NO: 98) | 787 | 885 |
| C03950_T9 (SEQ ID NO: 99) | 787 | 885 |

This segment can be found in the following protein(s): C03950_P14, C03950_P7, C03950_P8 and C03950_P9.

Segment cluster C03950_node_32 (SEQ ID NO:123) according to the present invention is supported by 10 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 112 below describes the starting and ending position of this segment on each transcript.

TABLE 112

Segment location on transcripts

| Transcript name | Segment starting position | Segment ending position |
|---|---|---|
| C03950_T0 (SEQ ID NO: 96) | 1216 | 1320 |
| C03950_T7 (SEQ ID NO: 97) | 1170 | 1274 |
| C03950_T8 (SEQ ID NO: 98) | 1170 | 1274 |
| C03950_T9 (SEQ ID NO: 99) | 1170 | 1274 |

This segment can be found in the following protein(s): C03950_P14, C03950_P7, C03950_P8 and C03950_P9.

Segment cluster C03950_node_34 (SEQ ID NO:124) according to the present invention is supported by 10 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 113 below describes the starting and ending position of this segment on each transcript.

TABLE 113

Segment location on transcripts

| Transcript name | Segment starting position | Segment ending position |
|---|---|---|
| C03950_T0 (SEQ ID NO: 96) | 1321 | 1415 |
| C03950_T7 (SEQ ID NO: 97) | 1275 | 1369 |
| C03950_T8 (SEQ ID NO: 98) | 1275 | 1369 |
| C03950_T9 (SEQ ID NO: 99) | 1275 | 1369 |

This segment can be found in the following protein(s): C03950_P14, C03950_P7, C03950_P8 and C03950_P9.

Segment cluster C03950_node_38 (SEQ ID NO:125) according to the present invention is supported by 9 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 114 below describes the starting and ending position of this segment on each transcript.

TABLE 114

Segment location on transcripts

| Transcript name | Segment starting position | Segment ending position |
|---|---|---|
| C03950_T0 (SEQ ID NO: 96) | 1566 | 1652 |
| C03950_T7 (SEQ ID NO: 97) | 1520 | 1606 |
| C03950_T8 (SEQ ID NO: 98) | 1520 | 1606 |
| C03950_T9 (SEQ ID NO: 99) | 1520 | 1606 |

This segment can be found in the following protein(s): C03950_P14, C03950_P7, C03950_P8 and C03950_P9.

Segment cluster C03950_node_40 (SEQ ID NO:126) according to the present invention is supported by 10 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 115 below describes the starting and ending position of this segment on each transcript.

TABLE 115

Segment location on transcripts

| Transcript name | Segment starting position | Segment ending position |
|---|---|---|
| C03950_T0 (SEQ ID NO: 96) | 1653 | 1709 |
| C03950_T7 (SEQ ID NO: 97) | 1607 | 1663 |
| C03950_T8 (SEQ ID NO: 98) | 1607 | 1663 |
| C03950_T9 (SEQ ID NO: 99) | 1607 | 1663 |

This segment can be found in the following protein(s): C03950_P14, C03950_P7, C03950_P8 and C03950_P9.

Segment cluster C03950_node_42 (SEQ ID NO:127) according to the present invention is supported by 13 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 116 below describes the starting and ending position of this segment on each transcript.

TABLE 116

Segment location on transcripts

| Transcript name | Segment starting position | Segment ending position |
|---|---|---|
| C03950_T0 (SEQ ID NO: 96) | 1710 | 1802 |
| C03950_T7 (SEQ ID NO: 97) | 1664 | 1756 |
| C03950_T8 (SEQ ID NO: 98) | 1664 | 1756 |
| C03950_T9 (SEQ ID NO: 99) | 1664 | 1756 |

This segment can be found in the following protein(s): C03950_P14, C03950_P7, C03950_P8 and C03950_P9.

Segment cluster C03950_node_45 (SEQ ID NO:128) according to the present invention is supported by 13 libraries. The number of libraries was determined as previously described. This segment can be found in the following transcript(s): C03950_T0 (SEQ ID NO:96), C03950_T7 (SEQ ID NO:97), C03950_T8 (SEQ ID NO:98) and C03950_T9 (SEQ ID NO:99). Table 117 below describes the starting and ending position of this segment on each transcript.

TABLE 117

Segment location on transcripts

| Transcript name | Segment starting position | Segment ending position |
|---|---|---|
| C03950_T0 SEQ ID NO:96 | 1803 | 1860 |
| C03950_T7 SEQ ID NO:97 | 1757 | 1814 |
| C03950_T8 SEQ ID NO:98 | 1757 | 1814 |
| C03950_T9 SEQ ID NO:99 | 1757 | 1814 |

This segment can be found in the following protein(s): C03950_P14, C03950_P7, C03950_P8 and C03950_P9.

Segment cluster C03950_node_50 (SEQ ID NO:129) according to the present invention is supported by 15 libraries. The number of libraries was determined as previously described. This segment can be found in the following transcript(s): C03950_T0 (SEQ ID NO:96), C03950_T7 (SEQ ID NO:97) and C03950_T8 (SEQ ID NO:98). Table 118 below describes the starting and ending position of this segment on each transcript.

TABLE 118

| | Segment location on transcripts | |
|---|---|---|
| Transcript name | Segment starting position | Segment ending position |
| C03950_T0 (SEQ ID NO: 96) | 2056 | 2160 |
| C03950_T7 (SEQ ID NO: 97) | 2010 | 2114 |
| C03950_T8 (SEQ ID NO: 98) | 2010 | 2114 |

This segment can be found in the following protein(s): C03950_P14, C03950_P7 and C03950_P8.

Segment cluster C03950_node_59 (SEQ ID NO:130) according to the present invention is supported by 0 libraries. The number of libraries was determined as previously described. This segment can be found in the following transcript(s): C03950_T0 (SEQ ID NO:96) and C03950_T8 (SEQ ID NO:98). Table 119 below describes the starting and ending position of this segment on each transcript.

TABLE 119

| | Segment location on transcripts | |
|---|---|---|
| Transcript name | Segment starting position | Segment ending position |
| C03950_T0 (SEQ ID NO: 96) | 2161 | 2213 |
| C03950_T8 (SEQ ID NO: 98) | 2115 | 2167 |

This segment can be found in the following protein(s): C03950_P14 and C03950_P8.

Segment cluster C03950_node_61 (SEQ ID NO:131) according to the present invention is supported by 0 libraries. The number of libraries was determined as previously described. This segment can be found in the following transcript(s): C03950_T0 (SEQ ID NO:96) and C03950_T8 (SEQ ID NO:98). Table 120 below describes the starting and ending position of this segment on each transcript.

TABLE 120

| | Segment location on transcripts | |
|---|---|---|
| Transcript name | Segment starting position | Segment ending position |
| C03950_T0 (SEQ ID NO: 96) | 2214 | 2266 |
| C03950_T8 (SEQ ID NO: 98) | 2168 | 2220 |

This segment can be found in the following protein(s): C03950_P14 and C03950_P8.

Segment cluster C03950_node_65 (SEQ ID NO:132) according to the present invention is supported by 3 libraries. The number of libraries was determined as previously described. This segment can be found in the following transcript(s): C03950_T0 (SEQ ID NO:96) and C03950_T8 (SEQ ID NO:98). Table 121 below describes the starting and ending position of this segment on each transcript.

TABLE 121

| | Segment location on transcripts | |
|---|---|---|
| Transcript name | Segment starting position | Segment ending position |
| C03950_T0 (SEQ ID NO: 96) | 2400 | 2509 |
| C03950_T8 (SEQ ID NO: 98) | 2354 | 2463 |

TABLE 121-continued

| | Segment location on transcripts | |
|---|---|---|
| Transcript name | Segment starting position | Segment ending position |

This segment can be found in the following protein(s): C03950_P14 and C03950_P8.

Segment cluster C03950_node_69 (SEQ ID NO:133) according to the present invention is supported by 2 libraries. The number of libraries was determined as previously described. This segment can be found in the following transcript(s): C03950_T0 (SEQ ID NO:96). Table 122 below describes the starting and ending position of this segment on each transcript.

TABLE 122

| | Segment location on transcripts | |
|---|---|---|
| Transcript name | Segment starting position | Segment ending position |
| C03950_T0 (SEQ ID NO: 96) | 2510 | 2569 |

This segment can be found in the following protein(s): C03950_P14.

Segment cluster C03950_node_73 (SEQ ID NO:134) according to the present invention is supported by 4 libraries. The number of libraries was determined as previously described. This segment can be found in the following transcript(s): C03950_T0 (SEQ ID NO:96). Table 123 below describes the starting and ending position of this segment on each transcript.

TABLE 123

| | Segment location on transcripts | |
|---|---|---|
| Transcript name | Segment starting position | Segment ending position |
| C03950_T0 (SEQ ID NO: 96) | 2740 | 2818 |

This segment can be found in the following protein(s): C03950_P14.

Description for Cluster D11495

Cluster D11495 features 6 transcript(s) and 20 segment(s) of interest, the names for which are given in Tables 1 and 2, respectively, the sequences themselves are given at the end of the application. The selected protein variants are given in Table 126.

TABLE 124

| Transcripts of interest |
|---|
| Transcript Name |
| D11495_T6 (SEQ ID NO: 135) |
| D11495_T11 (SEQ ID NO: 136) |
| D11495_T17 (SEQ ID NO: 137) |
| D11495_T18 (SEQ ID NO: 138) |
| D11495_T19 (SEQ ID NO: 139) |
| D11495_T20 (SEQ ID NO: 140) |

TABLE 125

Segments of interest
Segment Name

D11495_node_0 (SEQ ID NO: 141)
D11495_node_5 (SEQ ID NO: 142)
D11495_node_11 (SEQ ID NO: 143)
D11495_node_21 (SEQ ID NO: 144)
D11495_node_23 (SEQ ID NO: 145)
D11495_node_25 (SEQ ID NO: 146)
D11495_node_27 (SEQ ID NO: 147)
D11495_node_1 (SEQ ID NO: 148)
D11495_node_3 (SEQ ID NO: 149)
D11495_node_4 (SEQ ID NO: 150)
D11495_node_7 (SEQ ID NO: 151)
D11495_node_8 (SEQ ID NO: 152)
D11495_node_9 (SEQ ID NO: 153)
D11495_node_10 (SEQ ID NO: 154)
D11495_node_13 (SEQ ID NO: 155)
D11495_node_14 (SEQ ID NO: 156)
D11495_node_15 (SEQ ID NO: 157)
D11495_node_16 (SEQ ID NO: 158)
D11495_node_22 (SEQ ID NO: 159)
D11495_node_24 (SEQ ID NO: 160)

TABLE 126

Proteins of interest

| Protein Name | Corresponding Transcript(s) |
|---|---|
| D11495_P4 | D11495_T6 (SEQ ID NO: 135); D11495_T11 (SEQ ID NO: 136) |
| D11495_P13 | D11495_T18 (SEQ ID NO: 138) |
| D11495_P14 | D11495_T19 (SEQ ID NO: 139) |

These sequences are variants of the known protein NAD (SwissProt accession identifier NQO1_HUMAN; known also according to the synonyms P; EC 1.6.99.2; Quinone reductase 1; QR1; DT-diaphorase; DTD; Azoreductase; Phylloquinone reductase; Menadione reductase), referred to herein as the previously known protein.

Protein NAD is known or believed to have the following function(s): The enzyme apparently serves as a quinone reductase in connection with conjugation reactions of hydroquinones involved in detoxification pathways as well as in biosynthetic processes such as the vitamin K-dependent gamma-carboxylation of glutamate residues in prothrombin synthesis. The sequence for protein NAD is given at the end of the application, as "NAD amino acid sequence". Known polymorphisms for this sequence are as shown in Table 127.

TABLE 127

Amino acid mutations for Known Protein

| SNP position(s) on amino acid sequence | Comment |
|---|---|
| 139 | R -> W (in dbSNP: 4986998). /FTId = VAR_016170. |
| 187 | P -> S (lack of activity; dbSNP: 1800566). /FTId = VAR_008384. |

Protein NAD localization is believed to be Cytoplasmic.

The following GO Annotation(s) apply to the previously known protein. The following annotation(s) were found: electron transport; xenobiotic metabolism; nitric oxide biosynthesis; synaptic transmission, cholinergic; detoxification response, which are annotation(s) related to Biological Process; NAD(P)H dehydrogenase (quinone); cytochrome b5 reductase; oxidoreductase, which are annotation(s) related to Molecular Function; and cytoplasm, which are annotation(s) related to Cellular Component.

The GO assignment relies on information from one or more of the SwissProt/TremB1 Protein knowledgebase, available from expasy.ch/sprot/ or Locuslink, available from ncbi.nlm.nih.gov/projects/LocusLink/.

Cluster D11495 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 8 below refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 8 and Table 128. This cluster is overexpressed (at least at a minimum level) in the following pathological conditions: colorectal cancer, epithelial malignant tumors, a mixture of malignant tumors from different tissues, hepatocellular carcinoma, prostate cancer and uterine malignancies.

TABLE 128

Normal tissue distribution

| Name of Tissue | Number |
|---|---|
| Bladder | 41 |
| Bone | 226 |
| Brain | 49 |
| Colon | 63 |
| epithelial | 85 |
| general | 72 |
| head and neck | 40 |
| kidney | 62 |
| liver | 0 |
| lung | 132 |
| lymph nodes | 1 |
| breast | 290 |
| ovary | 0 |
| pancreas | 35 |
| prostate | 8 |
| skin | 188 |
| stomach | 293 |
| T cells | 278 |
| Thyroid | 0 |
| uterus | 9 |

TABLE 129

P values and ratios for expression in cancerous tissue

| Name of Tissue | P1 | P2 | SP1 | R3 | SP2 | R4 |
|---|---|---|---|---|---|---|
| bladder | 2.3e−01 | 1.2e−01 | 2.8e−01 | 2.0 | 6.6e−03 | 2.6 |
| bone | 3.7e−01 | 3.2e−01 | 9.3e−01 | 0.5 | 9.8e−01 | 0.5 |
| brain | 4.0e−01 | 4.2e−01 | 5.0e−01 | 1.1 | 6.7e−01 | 0.9 |
| colon | 1.5e−02 | 4.5e−03 | 2.6e−02 | 2.1 | 1.1e−03 | 3.4 |
| epithelial | 3.6e−02 | 2.3e−05 | 7.5e−02 | 1.2 | 5.8e−19 | 2.8 |
| general | 2.7e−02 | 2.0e−06 | 3.7e−02 | 1.2 | 5.1e−28 | 2.5 |
| head and neck | 3.4e−01 | 4.1e−01 | 1 | 0.8 | 7.5e−01 | 1.0 |
| kidney | 8.5e−01 | 8.0e−01 | 1 | 0.3 | 3.8e−01 | 0.7 |
| liver | 1 | 7.0e−03 | 1 | 1.0 | 2.6e−02 | 4.9 |
| lung | 7.3e−01 | 6.8e−01 | 2.8e−02 | 1.2 | 5.8e−08 | 2.4 |
| lymph nodes | 9.2e−01 | 8.0e−01 | 1 | 0.9 | 5.8e−01 | 1.6 |
| breast | 6.7e−01 | 2.8e−01 | 8.9e−01 | 0.5 | 7.2e−01 | 0.7 |
| ovary | 1.3e−01 | 9.4e−02 | 1.5e−01 | 3.3 | 2.0e−01 | 2.8 |
| pancreas | 4.7e−01 | 2.8e−01 | 1.3e−01 | 1.5 | 4.4e−02 | 2.1 |
| prostate | 7.9e−01 | 4.7e−01 | 9.1e−02 | 2.8 | 9.8e−06 | 3.9 |
| skin | 6.3e−01 | 4.7e−01 | 8.8e−01 | 0.5 | 3.6e−01 | 0.5 |
| stomach | 4.9e−01 | 1.6e−01 | 9.9e−01 | 0.4 | 6.2e−03 | 1.7 |

TABLE 129-continued

P values and ratios for expression in cancerous tissue

| Name of Tissue | P1 | P2 | SP1 | R3 | SP2 | R4 |
|---|---|---|---|---|---|---|
| T cells | 5.0e−01 | 6.7e−01 | 1 | 0.5 | 9.2e−01 | 0.7 |
| Thyroid | 2.3e−01 | 2.3e−01 | 6.7e−01 | 1.6 | 6.7e−01 | 1.6 |
| uterus | 2.8e−01 | 7.7e−02 | 1.3e−01 | 2.3 | 3.1e−03 | 4.5 |

As noted above, cluster D11495 features 20 segment(s), which were listed in Table 125 above and for which the sequence(s) are given at the end of the application. These segment(s) are portions of nucleic acid sequence(s) which are described herein separately because they are of particular interest. A description of each segment according to the present invention is now provided.

Segment cluster D11495_node_0 (SEQ ID NO:141) according to the present invention is supported by 203 libraries. The number of libraries was determined as previously described. This segment can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 130 below describes the starting and ending position of this segment on each transcript.

TABLE 130

Segment location on transcripts

| Transcript name | Segment starting position | Segment ending position |
|---|---|---|
| D11495_T6 (SEQ ID NO: 135) | 1 | 367 |
| D11495_T11 (SEQ ID NO: 136) | 1 | 367 |
| D11495_T18 (SEQ ID NO: 138) | 1 | 367 |
| D11495_T19 (SEQ ID NO: 139) | 1 | 367 |

This segment can be found in the following protein(s): D11495_P4, D11495_P13 and D11495_P14.

Segment cluster D11495_node_5 (SEQ ID NO:142) according to the present invention is supported by 238 libraries. The number of libraries was determined as previously described. This segment can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 131 below describes the starting and ending position of this segment on each transcript.

TABLE 131

Segment location on transcripts

| Transcript name | Segment starting position | Segment ending position |
|---|---|---|
| D11495_T6 (SEQ ID NO: 135) | 415 | 536 |
| D11495_T11 (SEQ ID NO: 136) | 415 | 536 |
| D11495_T18 (SEQ ID NO: 138) | 415 | 536 |
| D11495_T19 (SEQ ID NO: 139) | 415 | 536 |

This segment can be found in the following protein(s): D11495_P4, D11495_P13 and D11495_P14.

Segment cluster D11495_node_11 (SEQ ID NO:143) according to the present invention is supported by 2 libraries. The number of libraries was determined as previously described. This segment can be found in the following transcript(s): D11495_T19 (SEQ ID NO:139). Table 132 below describes the starting and ending position of this segment on each transcript.

TABLE 132

Segment location on transcripts

| Transcript name | Segment starting position | Segment ending position |
|---|---|---|
| D11495_T19 (SEQ ID NO: 139) | 668 | 841 |

This segment can be found in the following protein(s): D11495_P14.

Segment cluster D11495_node_21 (SEQ ID NO:144) according to the present invention is supported by 1 libraries. The number of libraries was determined as previously described. This segment can be found in the following transcript(s): D11495_T17 (SEQ ID NO:137) and D11495_T20 (SEQ ID NO:140). Table 133 below describes the starting and ending position of this segment on each transcript.

TABLE 133

Segment location on transcripts

| Transcript name | Segment starting position | Segment ending position |
|---|---|---|
| D11495_T17 (SEQ ID NO: 137) | 1 | 267 |
| D11495_T20 (SEQ ID NO: 140) | 1 | 267 |

The previously-described transcripts for these segment(s) do not code for protein.

Segment cluster D11495_node_23 (SEQ ID NO:145) according to the present invention is supported by 251 libraries. The number of libraries was determined as previously described. This segment can be found in the following transcript(s): D11495_T6 (SEQ ID NO:135), D11495_T11 (SEQ ID NO:136), D11495_T17 (SEQ ID NO:137) and D11495_T20 (SEQ ID NO:140). Table 134 below describes the starting and ending position of this segment on each transcript.

TABLE 134

Segment location on transcripts

| Transcript name | Segment starting position | Segment ending position |
|---|---|---|
| D11495_T6 (SEQ ID NO: 135) | 805 | 1285 |
| D11495_T11 (SEQ ID NO: 136) | 805 | 1222 |
| D11495_T17 (SEQ ID NO: 137) | 291 | 771 |
| D11495_T20 (SEQ ID NO: 140) | 291 | 708 |

This segment can be found in the following protein(s): D11495_P4.

Segment cluster D11495_node_25 (SEQ ID NO:146) according to the present invention is supported by 142 libraries. The number of libraries was determined as previously described. This segment can be found in the following transcript(s): D11495_T6 (SEQ ID NO:135) and D11495_T17 (SEQ ID NO:137). Table 135 below describes the starting and ending position of this segment on each transcript.

TABLE 135

| Transcript name | Segment starting position | Segment ending position |
|---|---|---|
| D11495_T6 (SEQ ID NO: 135) | 1302 | 2662 |
| D11495_T17 (SEQ ID NO: 137) | 788 | 2148 |

This segment can be found in a non-coding region of transcript(s) that are related to the following protein(s): D11495_P4.

Segment cluster D11495_node_27 (SEQ ID NO:147) according to the present invention is supported by 7 libraries. The number of libraries was determined as previously described. This segment can be found in the following transcript(s): D11495_T18 (SEQ ID NO:138). Table 136 below describes the starting and ending position of this segment on each transcript.

TABLE 136

| Transcript name | Segment starting position | Segment ending position |
|---|---|---|
| D11495_T18 (SEQ ID NO: 138) | 668 | 1490 |

This segment can be found in the following protein(s): D11495_P13.

According to an optional embodiment of the present invention, short segments related to the above cluster are also provided. These segments are up to about 120 bp in length, and so are included in a separate description.

Segment cluster D11495_node_1 (SEQ ID NO:148) according to the present invention can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 137 below describes the starting and ending position of this segment on each transcript.

TABLE 137

| Transcript name | Segment starting position | Segment ending position |
|---|---|---|
| D11495_T6 (SEQ ID NO: 135) | 368 | 371 |
| D11495_T11 (SEQ ID NO: 136) | 368 | 371 |
| D11495_T18 (SEQ ID NO: 138) | 368 | 371 |
| D11495_T19 (SEQ ID NO: 139) | 368 | 371 |

This segment can be found in the following protein(s): D11495_P4, D11495_P13 and D11495_P14.

Segment cluster D11495_node_3 (SEQ ID NO:149) according to the present invention can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 138 below describes the starting and ending position of this segment on each transcript.

TABLE 138

| Transcript name | Segment starting position | Segment ending position |
|---|---|---|
| D11495_T6 (SEQ ID NO: 135) | 372 | 378 |
| D11495_T11 (SEQ ID NO: 136) | 372 | 378 |
| D11495_T18 (SEQ ID NO: 138) | 372 | 378 |
| D11495_T19 (SEQ ID NO: 139) | 372 | 378 |

This segment can be found in the following protein(s): D11495_P4, D11495_P13 and D11495_P14.

Segment cluster D11495_node_4 (SEQ ID NO:150) according to the present invention is supported by 224 libraries. The number of libraries was determined as previously described. This segment can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 139 below describes the starting and ending position of this segment on each transcript.

TABLE 139

| Transcript name | Segment starting position | Segment ending position |
|---|---|---|
| D11495_T6 (SEQ ID NO: 135) | 379 | 414 |
| D11495_T11 (SEQ ID NO: 136) | 379 | 414 |
| D11495_T18 (SEQ ID NO: 138) | 379 | 414 |
| D11495_T19 (SEQ ID NO: 139) | 379 | 414 |

This segment can be found in the following protein(s): D11495_P4, D11495_P13 and D11495_P14.

Segment cluster D11495_node_7 (SEQ ID NO:151) according to the present invention is supported by 212 libraries. The number of libraries was determined as previously described. This segment can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 140 below describes the starting and ending position of this segment on each transcript.

TABLE 140

| Transcript name | Segment starting position | Segment ending position |
|---|---|---|
| D11495_T6 (SEQ ID NO: 135) | 537 | 614 |
| D11495_T11 (SEQ ID NO: 136) | 537 | 614 |
| D11495_T18 (SEQ ID NO: 138) | 537 | 614 |
| D11495_T19 (SEQ ID NO: 139) | 537 | 614 |

This segment can be found in the following protein(s): D11495_P4, D11495_P13 and D11495_P14.

Segment cluster D11495_node_8 (SEQ ID NO:152) according to the present invention can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 141 below describes the starting and ending position of this segment on each transcript.

TABLE 141

| Segment location on transcripts | | |
| --- | --- | --- |
| Transcript name | Segment starting position | Segment ending position |
| D11495_T6 (SEQ ID NO: 135) | 615 | 623 |
| D11495_T11 (SEQ ID NO: 136) | 615 | 623 |
| D11495_T18 (SEQ ID NO: 138) | 615 | 623 |
| D11495_T19 (SEQ ID NO: 139) | 615 | 623 |

This segment can be found in the following protein(s): D11495_P4, D11495_P13 and D11495_P14.

Segment cluster D11495_node_9 (SEQ ID NO:153) according to the present invention is supported by 196 libraries. The number of libraries was determined as previously described. This segment can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 142 below describes the starting and ending position of this segment on each transcript.

TABLE 142

| Segment location on transcripts | | |
| --- | --- | --- |
| Transcript name | Segment starting position | Segment ending position |
| D11495_T6 (SEQ ID NO: 135) | 624 | 650 |
| D11495_T11 (SEQ ID NO: 136) | 624 | 650 |
| D11495_T18 (SEQ ID NO: 138) | 624 | 650 |
| D11495_T19 (SEQ ID NO: 139) | 624 | 650 |

This segment can be found in the following protein(s): D11495_P4, D11495_P13 and D11495_P14.

Segment cluster D11495_node_10 (SEQ ID NO:154) according to the present invention can be found in the following transcript(s): D11495_T6 (SEQ ID NO:135), D11495_T11 (SEQ ID NO:136), D11495_T18 (SEQ ID NO:138) and D11495_T19 (SEQ ID NO:139). Table 143 below describes the starting and ending position of this segment on each transcript.

TABLE 143

| Segment location on transcripts | | |
| --- | --- | --- |
| Transcript name | Segment starting position | Segment ending position |
| D11495_T6 (SEQ ID NO: 135) | 651 | 667 |
| D11495_T11 (SEQ ID NO: 136) | 651 | 667 |
| D11495_T18 (SEQ ID NO: 138) | 651 | 667 |
| D11495_T19 (SEQ ID NO: 139) | 651 | 667 |

This segment can be found in the following protein(s): D11495_P4, D11495_P13 and D11495_P14.

Segment cluster D11495_node_13 (SEQ ID NO:155) according to the present invention can be found in the following transcript(s): D11495_T6 (SEQ ID NO:135) and D11495_T11 (SEQ ID NO:136). Table 144 below describes the starting and ending position of this segment on each transcript.

TABLE 144

| Segment location on transcripts | | |
| --- | --- | --- |
| Transcript name | Segment starting position | Segment ending position |
| D11495_T6 (SEQ ID NO: 135) | 668 | 679 |
| D11495_T11 (SEQ ID NO: 136) | 668 | 679 |

This segment can be found in the following protein(s): D11495_P4.

Segment cluster D11495_node_14 (SEQ ID NO:156) according to the present invention is supported by 174 libraries. The number of libraries was determined as previously described. This segment can be found in the following transcript(s): D11495_T6 (SEQ ID NO:135) and D11495_T11 (SEQ ID NO:136). Table 145 below describes the starting and ending position of this segment on each transcript.

TABLE 145

| Segment location on transcripts | | |
| --- | --- | --- |
| Transcript name | Segment starting position | Segment ending position |
| D11495_T6 (SEQ ID NO: 135) | 680 | 711 |
| D11495_T11 (SEQ ID NO: 136) | 680 | 711 |

This segment can be found in the following protein(s): D11495_P4.

Segment cluster D11495_node_15 (SEQ ID NO:157) according to the present invention is supported by 184 libraries. The number of libraries was determined as previously described. This segment can be found in the following transcript(s): D11495_T6 (SEQ ID NO:135) and D11495_T11 (SEQ ID NO:136). Table 146 below describes the starting and ending position of this segment on each transcript.

TABLE 146

| Segment location on transcripts | | |
| --- | --- | --- |
| Transcript name | Segment starting position | Segment ending position |
| D11495_T6 (SEQ ID NO: 135) | 712 | 759 |
| D11495_T11 (SEQ ID NO: 136) | 712 | 759 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 147.

TABLE 147

| Oligonucleotides related to this segment | | |
| --- | --- | --- |
| Oligonucleotide name | Overexpressed in cancers | Chip reference |
| D11495_0_0_0 | ovarian carcinoma | OVA |

This segment can be found in the following protein(s): D11495_P4.

Segment cluster D11495_node_16 (SEQ ID NO:158) according to the present invention can be found in the following transcript(s): D11495_T6 (SEQ ID NO:135) and D11495_T11 (SEQ ID NO:136). Table 148 below describes the starting and ending position of this segment on each transcript.

TABLE 148

Segment location on transcripts

| Transcript name | Segment starting position | Segment ending position |
|---|---|---|
| D11495_T6 (SEQ ID NO: 135) | 760 | 781 |
| D11495_T11 (SEQ ID NO: 136) | 760 | 781 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 149.

TABLE 149

Oligonucleotides related to this segment

| Oligonucleotide name | Overexpressed in cancers | Chip reference |
|---|---|---|
| D11495_0_0_0 | ovarian carcinoma | OVA |

This segment can be found in the following protein(s): D11495_P4.

Segment cluster D11495_node_22 (SEQ ID NO:159) according to the present invention can be found in the following transcript(s): D11495_T6 (SEQ ID NO:135), D11495_T11 (SEQ ID NO:136), D11495_T17 (SEQ ID NO:137) and D11495_T20 (SEQ ID NO:140). Table 150 below describes the starting and ending position of this segment on each transcript.

TABLE 150

Segment location on transcripts

| Transcript name | Segment starting position | Segment ending position |
|---|---|---|
| D11495_T6 (SEQ ID NO: 135) | 782 | 804 |
| D11495_T11 (SEQ ID NO: 136) | 782 | 804 |
| D11495_T17 (SEQ ID NO: 137) | 268 | 290 |
| D11495_T20 (SEQ ID NO: 140) | 268 | 290 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 151.

TABLE 151

Oligonucleotides related to this segment

| Oligonucleotide name | Overexpressed in cancers | Chip reference |
|---|---|---|
| D11495_0_0_0 | ovarian carcinoma | OVA |

This segment can be found in the following protein(s): D11495_P4.

Segment cluster D11495_node_24 (SEQ ID NO:160) according to the present invention can be found in the following transcript(s): D11495_T6 (SEQ ID NO:135) and D11495_T17 (SEQ ID NO:137). Table 152 below describes the starting and ending position of this segment on each transcript.

TABLE 152

Segment location on transcripts

| Transcript name | Segment starting position | Segment ending position |
|---|---|---|
| D11495_T6 (SEQ ID NO: 135) | 1286 | 1301 |
| D11495_T17 (SEQ ID NO: 137) | 772 | 787 |

This segment can be found in a non-coding region of transcript(s) that are related to the following protein(s): D11495_P4.

Description for Cluster D11793

Cluster D11793 features 11 transcript(s) and 53 segment(s) of interest, the names for which are given in Tables 153 and 154, respectively, the sequences themselves are given at the end of the application. The selected protein variants are given in Table 155.

TABLE 153

Transcripts of interest
Transcript Name

D11793_T5 (SEQ ID NO: 161)
D11793_T6 (SEQ ID NO: 162)
D11793_T10 (SEQ ID NO: 163)
D11793_T14 (SEQ ID NO: 164)
D11793_T18 (SEQ ID NO: 165)
D11793_T24 (SEQ ID NO: 166)
D11793_T32 (SEQ ID NO: 167)
D11793_T40 (SEQ ID NO: 168)
D11793_T41 (SEQ ID NO: 169)
D11793_T42 (SEQ ID NO: 170)
D11793_T43 (SEQ ID NO: 171)

TABLE 154

Segments of interest
Segment Name

D11793_node_0 (SEQ ID NO: 172)
D11793_node_2 (SEQ ID NO: 173)
D11793_node_4 (SEQ ID NO: 174)
D11793_node_5 (SEQ ID NO: 175)
D11793_node_7 (SEQ ID NO: 176)
D11793_node_9 (SEQ ID NO: 177)
D11793_node_11 (SEQ ID NO: 178)
D11793_node_13 (SEQ ID NO: 179)
D11793_node_18 (SEQ ID NO: 180)
D11793_node_19 (SEQ ID NO: 181)
D11793_node_37 (SEQ ID NO: 182)
D11793_node_63 (SEQ ID NO: 183)
D11793_node_1 (SEQ ID NO: 184)
D11793_node_8 (SEQ ID NO: 185)
D11793_node_12 (SEQ ID NO: 186)
D11793_node_14 (SEQ ID NO: 187)
D11793_node_15 (SEQ ID NO: 188)
D11793_node_16 (SEQ ID NO: 189)
D11793_node_17 (SEQ ID NO: 190)
D11793_node_20 (SEQ ID NO: 191)
D11793_node_21 (SEQ ID NO: 192)
D11793_node_22 (SEQ ID NO: 193)
D11793_node_23 (SEQ ID NO: 194)
D11793_node_24 (SEQ ID NO: 195)
D11793_node_25 (SEQ ID NO: 196)
D11793_node_26 (SEQ ID NO: 197)
D11793_node_27 (SEQ ID NO: 198)
D11793_node_28 (SEQ ID NO: 199)

TABLE 154-continued

Segments of interest
Segment Name

D11793_node_31 (SEQ ID NO: 200)
D11793_node_34 (SEQ ID NO: 201)
D11793_node_38 (SEQ ID NO: 202)
D11793_node_40 (SEQ ID NO: 203)
D11793_node_41 (SEQ ID NO: 204)
D11793_node_42 (SEQ ID NO: 205)
D11793_node_43 (SEQ ID NO: 206)
D11793_node_44 (SEQ ID NO: 207)
D11793_node_45 (SEQ ID NO: 208)
D11793_node_46 (SEQ ID NO: 209)
D11793_node_47 (SEQ ID NO: 210)
D11793_node_48 (SEQ ID NO: 211)
D11793_node_49 (SEQ ID NO: 212)
D11793_node_50 (SEQ ID NO: 213)
D11793_node_51 (SEQ ID NO: 214)
D11793_node_52 (SEQ ID NO: 215)
D11793_node_53 (SEQ ID NO: 216)
D11793_node_54 (SEQ ID NO: 217)
D11793_node_55 (SEQ ID NO: 218)
D11793_node_57 (SEQ ID NO: 219)
D11793_node_58 (SEQ ID NO: 220)
D11793_node_59 (SEQ ID NO: 221)
D11793_node_60 (SEQ ID NO: 222)
D11793_node_61 (SEQ ID NO: 223)
D11793_node_62 (SEQ ID NO: 224)

TABLE 155

Proteins of interest

| Protein Name | Corresponding Transcript(s) |
|---|---|
| D11793_P6 | D11793_T10 (SEQ ID NO: 163) |
| D11793_P9 | D11793_T14 (SEQ ID NO: 164); |
|  | D11793_T32 (SEQ ID NO: 167) |
| D11793_P11 | D11793_T18 (SEQ ID NO: 165) |
| D11793_P13 | D11793_T24 (SEQ ID NO: 166) |
| D11793_P26 | D11793_T40 (SEQ ID NO: 168) |
| D11793_P27 | D11793_T41 (SEQ ID NO: 169) |
| D11793_P28 | D11793_T42 (SEQ ID NO: 170) |
| D11793_P29 | D11793_T5 (SEQ ID NO: 161); |
|  | D11793_T6 (SEQ ID NO: 162) |

These sequences are variants of the known protein Solute carrier family 2, facilitated glucose transporter, member 1 (SwissProt accession identifier GTR1_HUMAN; known also according to the synonyms Glucose transporter type 1, erythrocyte/brain; HepG2 glucose transporter), referred to herein as the previously known protein.

Protein Solute carrier family 2, facilitated glucose transporter, member 1 is known or believed to have the following function(s): Facilitative glucose transporter. This isoform may be responsible for constitutive or basal glucose uptake. Has a very broad substrate specificity; can transport a wide range of aldoses including both pentoses and hexoses. The sequence for protein Solute carrier family 2, facilitated glucose transporter, member 1 is given at the end of the application, as "Solute carrier family 2, facilitated glucose transporter, member 1 amino acid sequence". Known polymorphisms for this sequence are as shown in Table 156.

TABLE 156

Amino acid mutations for Known Protein

| SNP position(s) on amino acid sequence | Comment |
|---|---|
| 66 | S -> F (in GLUT1 deficiency). /FTId = VAR_013283. |
| 91 | G -> D (in GLUT1 deficiency; significantly decreases the transport of 3-O-methyl-D-glucose). /FTId = VAR_013182. |
| 126 | R -> H (in GLUT1 deficiency; significantly decreases the transport of 3-O-methyl-D-glucose and dehydroascorbic acid). /FTId = VAR_013183. |
| 126 | R -> L (in GLUT1 deficiency; compound heterozygote with V-256). /FTId = VAR_013184. |
| 146 | E -> K (in GLUT1 deficiency). /FTId = VAR_013284. |
| 256 | K -> E (in GLUT1 deficiency; compound heterozygote with L-126). /FTId = VAR_013185. |
| 310 | T -> I (in GLUT1 deficiency). /FTId = VAR_013285. |
| 333 | R -> W (in GLUT1 deficiency). /FTId = VAR_013286. |
| 152 | F -> L |

Protein Solute carrier family 2, facilitated glucose transporter, member 1 localization is believed to be Integral membrane protein. Localizes primarily at the cell surface (By similarity).

The following GO Annotation(s) apply to the previously known protein. The following annotation(s) were found: carbohydrate transport; glucose transport, which are annotation(s) related to Biological Process; transporter; sugar porter; glucose transporter, which are annotation(s) related to Molecular Function; and membrane fraction; membrane; integral membrane protein, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster D11793 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 9 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 9 and Table 157. This cluster is overexpressed (at least at a minimum level) in the following pathological conditions: epithelial malignant tumors, a mixture of malignant tumors from different tissues, hepatocellular carcinoma, ovarian carcinoma and pancreas carcinoma.

TABLE 157

Normal tissue distribution

| Name of Tissue | Number |
|---|---|
| adrenal | 0 |
| bladder | 0 |
| bone | 32 |
| brain | 105 |
| colon | 94 |
| epithelial | 110 |
| general | 90 |
| head and neck | 121 |
| kidney | 47 |

TABLE 157-continued

Normal tissue distribution

| Name of Tissue | Number |
| --- | --- |
| liver | 0 |
| lung | 127 |
| lymph nodes | 37 |
| breast | 13 |
| bone marrow | 156 |
| muscle | 1 |
| ovary | 72 |
| pancreas | 10 |
| prostate | 188 |
| skin | 416 |
| stomach | 109 |
| Thyroid | 128 |
| uterus | 40 |

TABLE 158

P values and ratios for expression in cancerous tissue

| Name of Tissue | P1 | P2 | SP1 | R3 | SP2 | R4 |
| --- | --- | --- | --- | --- | --- | --- |
| adrenal | 4.2e−01 | 1.9e−01 | 2.1e−01 | 3.4 | 4.4e−02 | 4.5 |
| bladder | 7.0e−02 | 5.8e−02 | 1.0e−01 | 4.1 | 1.5e−01 | 3.3 |
| bone | 5.5e−01 | 8.6e−01 | 1 | 0.6 | 4.2e−01 | 1.6 |
| brain | 5.5e−01 | 5.6e−01 | 4.2e−01 | 1.1 | 1.7e−01 | 1.0 |
| colon | 9.3e−02 | 1.3e−01 | 1.0e−01 | 1.6 | 2.6e−02 | 1.8 |
| epithelial | 1.1e−02 | 4.8e−03 | 6.1e−04 | 1.5 | 1.6e−08 | 1.7 |
| general | 3.6e−03 | 1.7e−04 | 1.3e−07 | 1.6 | 5.4e−26 | 2.2 |
| head and neck | 3.7e−01 | 5.6e−01 | 1 | 0.9 | 1 | 0.6 |
| kidney | 6.9e−01 | 5.2e−01 | 2.8e−01 | 1.6 | 5.4e−05 | 2.5 |
| liver | 1 | 1.9e−01 | 1 | 1.0 | 4.7e−08 | 3.7 |
| lung | 5.6e−01 | 7.7e−01 | 7.2e−01 | 0.9 | 8.1e−01 | 0.6 |
| lymph nodes | 3.3e−01 | 1.1e−01 | 6.3e−01 | 1.7 | 1.3e−01 | 1.6 |
| breast | 6.6e−01 | 6.4e−01 | 3.3e−01 | 1.8 | 5.3e−02 | 1.6 |
| bone marrow | 6.7e−01 | 8.0e−01 | 1 | 0.2 | 9.9e−01 | 0.3 |
| muscle | 1.0e−01 | 4.0e−02 | 2.2e−02 | 11.4 | 2.3e−02 | 6.6 |
| ovary | 2.4e−01 | 1.6e−01 | 6.0e−04 | 3.8 | 1.0e−03 | 3.7 |
| pancreas | 2.3e−01 | 3.1e−02 | 1.2e−04 | 2.5 | 5.1e−05 | 4.5 |
| prostate | 8.8e−01 | 8.8e−01 | 9.4e−01 | 0.4 | 2.3e−01 | 0.7 |
| skin | 5.0e−01 | 6.9e−01 | 3.9e−04 | 0.6 | 1 | 0.1 |
| stomach | 8.0e−01 | 4.0e−01 | 1 | 0.2 | 3.2e−01 | 1.2 |
| Thyroid | 4.6e−01 | 4.6e−01 | 8.9e−01 | 0.7 | 8.9e−01 | 0.7 |
| uterus | 5.0e−02 | 3.7e−02 | 3.6e−02 | 2.0 | 1.4e−01 | 1.5 |

As noted above, cluster D11793 features 53 segment(s), which were listed in Table 154 above and for which the sequence(s) are given at the end of the application. These segment(s) are portions of nucleic acid sequence(s) which are described herein separately because they are of particular interest. A description of each segment according to the present invention is now provided.

Segment cluster D11793_node_0 (SEQ ID NO:172) according to the present invention is supported by 107 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T40 (SEQ ID NO:168) and D11793_T42 (SEQ ID NO:170). Table 159 below describes the starting and ending position of this segment on each transcript.

TABLE 159

Segment location on transcripts

| Transcript name | Segment starting position | Segment ending position |
| --- | --- | --- |
| D11793_T5 (SEQ ID NO: 161) | 1 | 134 |
| D11793_T6 (SEQ ID NO: 162) | 1 | 134 |
| D11793_T10 (SEQ ID NO: 163) | 1 | 134 |
| D11793_T14 (SEQ ID NO: 164) | 1 | 134 |
| D11793_T18 (SEQ ID NO: 165) | 1 | 134 |
| D11793_T40 (SEQ ID NO: 168) | 1 | 134 |
| D11793_T42 (SEQ ID NO: 170) | 1 | 134 |

This segment can be found in a non-coding region of transcript(s) that are related to the following protein(s): D11793_P29, D11793_P6, D11793_P9, D11793_P11, D11793_P26 and D11793_P28.

Segment cluster D11793_node_2 (SEQ ID NO:173) according to the present invention is supported by 123 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T40 (SEQ ID NO:168) and D11793_T42 (SEQ ID NO:170). Table 160 below describes the starting and ending position of this segment on each transcript.

TABLE 160

Segment location on transcripts

| Transcript name | Segment starting position | Segment ending position |
| --- | --- | --- |
| D11793_T5 (SEQ ID NO: 161) | 162 | 297 |
| D11793_T6 (SEQ ID NO: 162) | 162 | 297 |
| D11793_T10 (SEQ ID NO: 163) | 162 | 297 |
| D11793_T14 (SEQ ID NO: 164) | 162 | 297 |
| D11793_T18 (SEQ ID NO: 165) | 162 | 297 |
| D11793_T40 (SEQ ID NO: 168) | 162 | 297 |
| D11793_T42 (SEQ ID NO: 170) | 162 | 297 |

This segment can be found in both coding and non-coding regions of transcript(s) as follows. The segment can be found in a non-coding region of transcript(s) that are related to the following protein(s): D11793_P9, D11793_P11 and D11793_P28. This segment can also be found in the following protein(s): D11793_P29, D11793_P6 and D11793_P26, since it is in the coding region for the corresponding transcript.

Segment cluster D11793_node_4 (SEQ ID NO:174) according to the present invention is supported by 14 libraries. The number of libraries was determined as previously described. This segment can be found in the following transcript(s): D11793_T41 (SEQ ID NO:169). Table 161 below describes the starting and ending position of this segment on each transcript.

TABLE 161

Segment location on transcripts

| Transcript name | Segment starting position | Segment ending position |
| --- | --- | --- |
| D11793_T41 (SEQ ID NO: 169) | 1 | 2371 |

66Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 162.

TABLE 162

Oligonucleotides related to this segment

| Oligonucleotide name | Overexpressed in cancers | Chip reference |
|---|---|---|
| D11793_0_0_2955 | colorectal cancer | Colon |

This segment can be found in the following protein(s): D11793_P27.

Segment cluster D11793_node_5 (SEQ ID NO:175) according to the present invention is supported by 11 libraries. The number of libraries was determined as previously described. This segment can be found in the following transcript(s): D11793_T41 (SEQ ID NO:169) and D11793_T42 (SEQ ID NO:170). Table 163 below describes the starting and ending position of this segment on each transcript.

TABLE 163

Segment location on transcripts

| Transcript name | Segment starting position | Segment ending position |
|---|---|---|
| D11793_T41 (SEQ ID NO: 169) | 2372 | 3065 |
| D11793_T42 (SEQ ID NO: 170) | 298 | 991 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 164.

TABLE 164

Oligonucleotides related to this segment

| Oligonucleotide name | Overexpressed in cancers | Chip reference |
|---|---|---|
| D11793_0_0_2956 | lung malignant tumors | LUN |
| D11793_0_0_2956 | ovarian carcinoma | OVA |

This segment can be found in both coding and non-coding regions of transcript(s) as follows. The segment can be found in a non-coding region of transcript(s) that are related to the following protein(s): D11793_P27. This segment can also be found in the following protein(s): D11793_P28, since it is in the coding region for the corresponding transcript.

Segment cluster D11793_node_7 (SEQ ID NO:176) according to the present invention is supported by 4 libraries. The number of libraries was determined as previously described. This segment can be found in the following transcript(s): D11793_T24 (SEQ ID NO:166) and D11793_T43 (SEQ ID NO:171). Table 165 below describes the starting and ending position of this segment on each transcript.

TABLE 165

Segment location on transcripts

| Transcript name | Segment starting position | Segment ending position |
|---|---|---|
| D11793_T24 (SEQ ID NO: 166) | 1 | 632 |
| D11793_T43 (SEQ ID NO: 171) | 1 | 632 |

This segment can be found in a non-coding region of transcript(s) that are related to the following protein(s): D11793_P13.

Segment cluster D11793_node_9 (SEQ ID NO:177) according to the present invention is supported by 6 libraries. The number of libraries was determined as previously described. This segment can be found in the following transcript(s): D11793_T40 (SEQ ID NO:168) and D11793_T43 (SEQ ID NO:171). Table 166 below describes the starting and ending position of this segment on each transcript.

TABLE 166

Segment location on transcripts

| Transcript name | Segment starting position | Segment ending position |
|---|---|---|
| D11793_T40 (SEQ ID NO: 168) | 394 | 1072 |
| D11793_T43 (SEQ ID NO: 171) | 729 | 1407 |

This segment can be found in the following protein(s): D11793_P26.

Segment cluster D11793_node_11 (SEQ ID NO:178) according to the present invention is supported by 2 libraries. The number of libraries was determined as previously described. This segment can be found in the following transcript(s): D11793_T32 (SEQ ID NO:167). Table 167 below describes the starting and ending position of this segment on each transcript.

TABLE 167

Segment location on transcripts

| Transcript name | Segment starting position | Segment ending position |
|---|---|---|
| D11793_T32 (SEQ ID NO: 167) | 1 | 457 |

This segment can be found in a non-coding region of transcript(s) that are related to the following protein(s): D11793_P9.

Segment cluster D11793_node_13 (SEQ ID NO:179) according to the present invention is supported by 116 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 168 below describes the starting and ending position of this segment on each transcript.

TABLE 168

Segment location on transcripts

| Transcript name | Segment starting position | Segment ending position |
| --- | --- | --- |
| D11793_T5 (SEQ ID NO: 161) | 432 | 554 |
| D11793_T6 (SEQ ID NO: 162) | 432 | 554 |
| D11793_T10 (SEQ ID NO: 163) | 432 | 554 |
| D11793_T14 (SEQ ID NO: 164) | 432 | 554 |
| D11793_T18 (SEQ ID NO: 165) | 432 | 554 |
| D11793_T24 (SEQ ID NO: 166) | 767 | 889 |
| D11793_T32 (SEQ ID NO: 167) | 496 | 618 |

This segment can be found in both coding and non-coding regions of transcript(s) as follows. The segment can be found in a non-coding region of transcript(s) that are related to the following protein(s): D11793_P9 and D11793_P11. This segment can also be found in the following protein(s): D11793_P29, D11793_P6 and D11793_P13, since it is in the coding region for the corresponding transcript.

Segment cluster D11793_node_18 (SEQ ID NO:180) according to the present invention is supported by 138 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 169 below describes the starting and ending position of this segment on each transcript.

TABLE 169

Segment location on transcripts

| Transcript name | Segment starting position | Segment ending position |
| --- | --- | --- |
| D11793_T5 (SEQ ID NO: 161) | 675 | 795 |
| D11793_T6 (SEQ ID NO: 162) | 675 | 795 |
| D11793_T10 (SEQ ID NO: 163) | 675 | 795 |
| D11793_T14 (SEQ ID NO: 164) | 675 | 795 |
| D11793_T18 (SEQ ID NO: 165) | 675 | 795 |
| D11793_T24 (SEQ ID NO: 166) | 1010 | 1130 |
| D11793_T32 (SEQ ID NO: 167) | 918 | 1038 |

This segment can be found in both coding and non-coding regions of transcript(s) as follows. The segment can be found in a non-coding region of transcript(s) that are related to the following protein(s): D11793_P9 and D11793_P11. This segment can also be found in the following protein(s): D11793_P29, D11793_P6 and D11793_P13, since it is in the coding region for the corresponding transcript.

Segment cluster D11793_node_19 (SEQ ID NO:181) according to the present invention is supported by 6 libraries. The number of libraries was determined as previously described. This segment can be found in the following transcript(s): D11793_T14 (SEQ ID NO:164), D11793_T18 (SEQ ID NO:165) and D11793_T32 (SEQ ID NO:167). Table 170 below describes the starting and ending position of this segment on each transcript.

TABLE 170

Segment location on transcripts

| Transcript name | Segment starting position | Segment ending position |
| --- | --- | --- |
| D11793_T14 (SEQ ID NO: 164) | 796 | 1385 |
| D11793_T18 (SEQ ID NO: 165) | 796 | 1385 |
| D11793_T32 (SEQ ID NO: 167) | 1039 | 1628 |

This segment can be found in a non-coding region of transcript(s) that are related to the following protein(s): D11793_P9 and D11793_P11.

Segment cluster D11793_node_37 (SEQ ID NO:182) according to the present invention is supported by 125 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 171 below describes the starting and ending position of this segment on each transcript.

TABLE 171

Segment location on transcripts

| Transcript name | Segment starting position | Segment ending position |
| --- | --- | --- |
| D11793_T5 (SEQ ID NO: 161) | 1354 | 1530 |
| D11793_T6 (SEQ ID NO: 162) | 1354 | 1530 |
| D11793_T10 (SEQ ID NO: 163) | 1446 | 1622 |
| D11793_T14 (SEQ ID NO: 164) | 1944 | 2120 |
| D11793_T18 (SEQ ID NO: 165) | 2036 | 2212 |
| D11793_T24 (SEQ ID NO: 166) | 1689 | 1865 |
| D11793_T32 (SEQ ID NO: 167) | 2187 | 2363 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_63 (SEQ ID NO:183) according to the present invention is supported by 204 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 172 below describes the starting and ending position of this segment on each transcript.

TABLE 172

Segment location on transcripts

| Transcript name | Segment starting position | Segment ending position |
| --- | --- | --- |
| D11793_T5 (SEQ ID NO: 161) | 2480 | 3777 |
| D11793_T6 (SEQ ID NO: 162) | 2480 | 3417 |
| D11793_T10 (SEQ ID NO: 163) | 2572 | 2735 |
| D11793_T14 (SEQ ID NO: 164) | 3070 | 3233 |
| D11793_T18 (SEQ ID NO: 165) | 3162 | 3325 |

TABLE 172-continued

Segment location on transcripts

| Transcript name | Segment starting position | Segment ending position |
|---|---|---|
| D11793_T24 (SEQ ID NO: 166) | 2815 | 2978 |
| D11793_T32 (SEQ ID NO: 167) | 3313 | 3476 |

This segment can be found in a non-coding region of transcript(s) that are related to the following protein(s): D11793_P29, D11793_P6, D11793_P9, D11793_P11 and D11793_P13.

According to an optional embodiment of the present invention, short segments related to the above cluster are also provided. These segments are up to about 120 bp in length, and so are included in a separate description.

Segment cluster D11793_node_1 (SEQ ID NO:184) according to the present invention is supported by 114 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T40 (SEQ ID NO:168) and D11793_T42 (SEQ ID NO:170). Table 173 below describes the starting and ending position of this segment on each transcript.

TABLE 173

Segment location on transcripts

| Transcript name | Segment starting position | Segment ending position |
|---|---|---|
| D11793_T5 (SEQ ID NO: 161) | 135 | 161 |
| D11793_T6 (SEQ ID NO: 162) | 135 | 161 |
| D11793_T10 (SEQ ID NO: 163) | 135 | 161 |
| D11793_T14 (SEQ ID NO: 164) | 135 | 161 |
| D11793_T18 (SEQ ID NO: 165) | 135 | 161 |
| D11793_T40 (SEQ ID NO: 168) | 135 | 161 |
| D11793_T42 (SEQ ID NO: 170) | 135 | 161 |

This segment can be found in a non-coding region of transcript(s) that are related to the following protein(s): D11793_P29, D11793_P6, D11793_P9, D11793_P11, D11793_P26 and D11793_P28.

Segment cluster D11793_node_8 (SEQ ID NO:185) according to the present invention is supported by 118 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166), D11793_T40 (SEQ ID NO:168) and D11793_T43 (SEQ ID NO:171). Table 174 below describes the starting and ending position of this segment on each transcript.

TABLE 174

Segment location on transcripts

| Transcript name | Segment starting position | Segment ending position |
|---|---|---|
| D11793_T5 (SEQ ID NO: 161) | 298 | 393 |
| D11793_T6 (SEQ ID NO: 162) | 298 | 393 |
| D11793_T10 (SEQ ID NO: 163) | 298 | 393 |

TABLE 174-continued

Segment location on transcripts

| Transcript name | Segment starting position | Segment ending position |
|---|---|---|
| D11793_T14 (SEQ ID NO: 164) | 298 | 393 |
| D11793_T18 (SEQ ID NO: 165) | 298 | 393 |
| D11793_T24 (SEQ ID NO: 166) | 633 | 728 |
| D11793_T40 (SEQ ID NO: 168) | 298 | 393 |
| D11793_T43 (SEQ ID NO: 171) | 633 | 728 |

This segment can be found in both coding and non-coding regions of transcript(s) as follows. The segment can be found in a non-coding region of transcript(s) that are related to the following protein(s): D11793_P9 and D11793_P11. This segment can also be found in the following protein(s): D11793_P29, D11793_P6, D11793_P13 and D11793_P26, since it is in the coding region for the corresponding transcript.

Segment cluster D11793_node_12 (SEQ ID NO:186) according to the present invention is supported by 104 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 175 below describes the starting and ending position of this segment on each transcript.

TABLE 175

Segment location on transcripts

| Transcript name | Segment starting position | Segment ending position |
|---|---|---|
| D11793_T5 (SEQ ID NO: 161) | 394 | 431 |
| D11793_T6 (SEQ ID NO: 162) | 394 | 431 |
| D11793_T10 (SEQ ID NO: 163) | 394 | 431 |
| D11793_T14 (SEQ ID NO: 164) | 394 | 431 |
| D11793_T18 (SEQ ID NO: 165) | 394 | 431 |
| D11793_T24 (SEQ ID NO: 166) | 729 | 766 |
| D11793_T32 (SEQ ID NO: 167) | 458 | 495 |

This segment can be found in both coding and non-coding regions of transcript(s) as follows. The segment can be found in a non-coding region of transcript(s) that are related to the following protein(s): D11793_P9 and D11793_P11. This segment can also be found in the following protein(s): D11793_P29, D11793_P6 and D11793_P13, since it is in the coding region for the corresponding transcript.

Segment cluster D11793_node_14 (SEQ ID NO:187) according to the present invention is supported by 2 libraries. The number of libraries was determined as previously described. This segment can be found in the following transcript(s): D11793_T32 (SEQ ID NO:167). Table 176 below describes the starting and ending position of this segment on each transcript.

TABLE 176

Segment location on transcripts

| Transcript name | Segment starting position | Segment ending position |
|---|---|---|
| D11793_T32 (SEQ ID NO: 167) | 619 | 723 |

This segment can be found in a non-coding region of transcript(s) that are related to the following protein(s): D11793_P9.

Segment cluster D11793_node_15 (SEQ ID NO:188) according to the present invention, is supported by 4 libraries. The number of libraries was determined as previously described. This segment can be found in the following transcript(s): D11793_T32 (SEQ ID NO:167). Table 177 below describes the starting and ending position of this segment on each transcript.

TABLE 177

| Segment location on transcripts | | |
| --- | --- | --- |
| Transcript name | Segment starting position | Segment ending position |
| D11793_T32 (SEQ ID NO: 167) | 724 | 797 |

This segment can be found in a non-coding region of transcript(s) that are related to the following protein(s): D11793_P9.

Segment cluster D11793_node_16 (SEQ ID NO:189) according to the present invention is supported by 126 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 178 below describes the starting and ending position of this segment on each transcript.

TABLE 178

| Segment location on transcripts | | |
| --- | --- | --- |
| Transcript name | Segment starting position | Segment ending position |
| D11793_T5 (SEQ ID NO: 161) | 555 | 629 |
| D11793_T6 (SEQ ID NO: 162) | 555 | 629 |
| D11793_T10 (SEQ ID NO: 163) | 555 | 629 |
| D11793_T14 (SEQ ID NO: 164) | 555 | 629 |
| D11793_T18 (SEQ ID NO: 165) | 555 | 629 |
| D11793_T24 (SEQ ID NO: 166) | 890 | 964 |
| D11793_T32 (SEQ ID NO: 167) | 798 | 872 |

This segment can be found in both coding and non-coding regions of transcript(s) as follows. The segment can be found in a non-coding region of transcript(s) that are related to the following protein(s): D11793_P9 and D11793_P1. This segment can also be found in the following protein(s): D11793_P29, D11793_P6 and D11793_P13, since it is in the coding region for the corresponding transcript.

Segment cluster D11793_node_17 (SEQ ID NO:190) according to the present invention is supported by 130 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 179 below describes the starting and ending position of this segment on each transcript.

TABLE 179

| Segment location on transcripts | | |
| --- | --- | --- |
| Transcript name | Segment starting position | Segment ending position |
| D11793_T5 (SEQ ID NO: 161) | 630 | 674 |
| D11793_T6 (SEQ ID NO: 162) | 630 | 674 |
| D11793_T10 (SEQ ID NO: 163) | 630 | 674 |
| D11793_T14 (SEQ ID NO: 164) | 630 | 674 |
| D11793_T18 (SEQ ID NO: 165) | 630 | 674 |
| D11793_T24 (SEQ ID NO: 166) | 965 | 1009 |
| D11793_T32 (SEQ ID NO: 167) | 873 | 917 |

This segment can be found in both coding and non-coding regions of transcript(s) as follows. The segment can be found in a non-coding region of transcript(s) that are related to the following protein(s): D11793_P9 and D11793_P111. This segment can also be found in the following protein(s): D11793_P29, D11793_P6 and D11793_P13, since it is in the coding region for the corresponding transcript.

Segment cluster D11793_node_20 (SEQ ID NO:191) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 180 below describes the starting and ending position of this segment on each transcript.

TABLE 180

| Segment location on transcripts | | |
| --- | --- | --- |
| Transcript name | Segment starting position | Segment ending position |
| D11793_T5 (SEQ ID NO: 161) | 796 | 820 |
| D11793_T6 (SEQ ID NO: 162) | 796 | 820 |
| D11793_T10 (SEQ ID NO: 163) | 796 | 820 |
| D11793_T14 (SEQ ID NO: 164) | 1386 | 1410 |
| D11793_T18 (SEQ ID NO: 165) | 1386 | 1410 |
| D11793_T24 (SEQ ID NO: 166) | 1131 | 1155 |
| D11793_T32 (SEQ ID NO: 167) | 1629 | 1653 |

This segment can be found in both coding and non-coding regions of transcript(s) as follows. The segment can be found in a non-coding region of transcript(s) that are related to the following protein(s): D11793_P11. This segment can also be found in the following protein(s): D11793_P29, D11793_P6, D11793_P9 and D11793_P13, since it is in the coding region for the corresponding transcript.

Segment cluster D11793_node_21 (SEQ ID NO:192) according to the present invention is supported by 120 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 181 below describes the starting and ending position of this segment on each transcript.

TABLE 181

Segment location on transcripts

| Transcript name | Segment starting position | Segment ending position |
|---|---|---|
| D11793_T5 (SEQ ID NO: 161) | 821 | 893 |
| D11793_T6 (SEQ ID NO: 162) | 821 | 893 |
| D11793_T10 (SEQ ID NO: 163) | 821 | 893 |
| D11793_T14 (SEQ ID NO: 164) | 1411 | 1483 |
| D11793_T18 (SEQ ID NO: 165) | 1411 | 1483 |
| D11793_T24 (SEQ ID NO: 166) | 1156 | 1228 |
| D11793_T32 (SEQ ID NO: 167) | 1654 | 1726 |

This segment can be found in both coding and non-coding regions of transcript(s) as follows. The segment can be found in a non-coding region of transcript(s) that are related to the following protein(s): D11793_P11. This segment can also be found in the following protein(s): D11793_P29, D11793_P6, D11793_P9 and D11793_P13, since it is in the coding region for the corresponding transcript.

Segment cluster D11793_node_22 (SEQ ID NO:193) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 182 below describes the starting and ending position of this segment on each transcript.

TABLE 182

Segment location on transcripts

| Transcript name | Segment starting position | Segment ending position |
|---|---|---|
| D11793_T5 (SEQ ID NO: 161) | 894 | 902 |
| D11793_T6 (SEQ ID NO: 162) | 894 | 902 |
| D11793_T10 (SEQ ID NO: 163) | 894 | 902 |
| D11793_T14 (SEQ ID NO: 164) | 1484 | 1492 |
| D11793_T18 (SEQ ID NO: 165) | 1484 | 1492 |
| D11793_T24 (SEQ ID NO: 166) | 1229 | 1237 |
| D11793_T32 (SEQ ID NO: 167) | 1727 | 1735 |

This segment can be found in both coding and non-coding regions of transcript(s) as follows. The segment can be found in a non-coding region of transcript(s) that are related to the following protein(s): D11793_P11. This segment can also be found in the following protein(s): D11793_P29, D11793_P6, D11793_P9 and D11793_P13, since it is in the coding region for the corresponding transcript.

Segment cluster D11793_node_23 (SEQ ID NO:194) according to the present invention is supported by 107 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 183 below describes the starting and ending position of this segment on each transcript.

TABLE 183

Segment location on transcripts

| Transcript name | Segment starting position | Segment ending position |
|---|---|---|
| D11793_T5 (SEQ ID NO: 161) | 903 | 958 |
| D11793_T6 (SEQ ID NO: 162) | 903 | 958 |
| D11793_T10 (SEQ ID NO: 163) | 903 | 958 |
| D11793_T14 (SEQ ID NO: 164) | 1493 | 1548 |
| D11793_T18 (SEQ ID NO: 165) | 1493 | 1548 |
| D11793_T24 (SEQ ID NO: 166) | 1238 | 1293 |
| D11793_T32 (SEQ ID NO: 167) | 1736 | 1791 |

This segment can be found in both coding and non-coding regions of transcript(s) as follows. The segment can be found in a non-coding region of transcript(s) that are related to the following protein(s): D11793_P11. This segment can also be found in the following protein(s): D11793_P29, D11793_P6, D11793_P9 and D11793_P13, since it is in the coding region for the corresponding transcript.

Segment cluster D11793_node_24 (SEQ ID NO:195) according to the present invention is supported by 4 libraries. The number of libraries was determined as previously described. This segment can be found in the following transcript(s): D11793_T10 (SEQ ID NO:163) and D11793_T18 (SEQ ID NO:165). Table 184 below describes the starting and ending position of this segment on each transcript.

TABLE 184

Segment location on transcripts

| Transcript name | Segment starting position | Segment ending position |
|---|---|---|
| D11793_T10 (SEQ ID NO: 163) | 959 | 1050 |
| D11793_T18 (SEQ ID NO: 165) | 1549 | 1640 |

This segment can be found in both coding and non-coding regions of transcript(s) as follows. The segment can be found in a non-coding region of transcript(s) that are related to the following protein(s): D11793_P11. This segment can also be found in the following protein(s): D11793_P6, since it is in the coding region for the corresponding transcript.

Segment cluster D11793_node_25 (SEQ ID NO:196) according to the present invention is supported by 110 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 185 below describes the starting and ending position of this segment on each transcript.

TABLE 185

Segment location on transcripts

| Transcript name | Segment starting position | Segment ending position |
|---|---|---|
| D11793_T5 (SEQ ID NO: 161) | 959 | 1035 |
| D11793_T6 (SEQ ID NO: 162) | 959 | 1035 |
| D11793_T10 (SEQ ID NO: 163) | 1051 | 1127 |
| D11793_T14 (SEQ ID NO: 164) | 1549 | 1625 |
| D11793_T18 (SEQ ID NO: 165) | 1641 | 1717 |

TABLE 185-continued

Segment location on transcripts

| Transcript name | Segment starting position | Segment ending position |
|---|---|---|
| D11793_T24 (SEQ ID NO: 166) | 1294 | 1370 |
| D11793_T32 (SEQ ID NO: 167) | 1792 | 1868 |

This segment can be found in the following protein(s): D11793_P29, D11793_P6, D11793_P9, D11793_P11 and D11793_P13.

Segment cluster D11793_node_26 (SEQ ID NO:197) according to the present invention is supported by 102 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 186 below describes the starting and ending position of this segment on each transcript.

TABLE 186

Segment location on transcripts

| Transcript name | Segment starting position | Segment ending position |
|---|---|---|
| D11793_T5 (SEQ ID NO: 161) | 1036 | 1062 |
| D11793_T6 (SEQ ID NO: 162) | 1036 | 1062 |
| D11793_T10 (SEQ ID NO: 163) | 1128 | 1154 |
| D11793_T14 (SEQ ID NO: 164) | 1626 | 1652 |
| D11793_T18 (SEQ ID NO: 165) | 1718 | 1744 |
| D11793_T24 (SEQ ID NO: 166) | 1371 | 1397 |
| D11793_T32 (SEQ ID NO: 167) | 1869 | 1895 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_27 (SEQ ID NO:198) according to the present invention is supported by 104 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 187 below describes the starting and ending position of this segment on each transcript.

TABLE 187

Segment location on transcripts

| Transcript name | Segment starting position | Segment ending position |
|---|---|---|
| D11793_T5 (SEQ ID NO: 161) | 1063 | 1128 |
| D11793_T6 (SEQ ID NO: 162) | 1063 | 1128 |
| D11793_T10 (SEQ ID NO: 163) | 1155 | 1220 |
| D11793_T14 (SEQ ID NO: 164) | 1653 | 1718 |
| D11793_T18 (SEQ ID NO: 165) | 1745 | 1810 |

TABLE 187-continued

Segment location on transcripts

| Transcript name | Segment starting position | Segment ending position |
|---|---|---|
| D11793_T24 (SEQ ID NO: 166) | 1398 | 1463 |
| D11793_T32 (SEQ ID NO: 167) | 1896 | 1961 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_28 (SEQ ID NO:199) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 188 below describes the starting and ending position of this segment on each transcript.

TABLE 188

Segment location on transcripts

| Transcript name | Segment starting position | Segment ending position |
|---|---|---|
| D11793_T5 (SEQ ID NO: 161) | 1129 | 1146 |
| D11793_T6 (SEQ ID NO: 162) | 1129 | 1146 |
| D11793_T10 (SEQ ID NO: 163) | 1221 | 1238 |
| D11793_T14 (SEQ ID NO: 164) | 1719 | 1736 |
| D11793_T18 (SEQ ID NO: 165) | 1811 | 1828 |
| D11793_T24 (SEQ ID NO: 166) | 1464 | 1481 |
| D11793_T32 (SEQ ID NO: 167) | 1962 | 1979 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_31 (SEQ ID NO:200) according to the present invention is supported by 100 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 189 below describes the starting and ending position of this segment on each transcript.

TABLE 189

Segment location on transcripts

| Transcript name | Segment starting position | Segment ending position |
|---|---|---|
| D11793_T5 (SEQ ID NO: 161) | 1147 | 1251 |
| D11793_T6 (SEQ ID NO: 162) | 1147 | 1251 |
| D11793_T10 (SEQ ID NO: 163) | 1239 | 1343 |

TABLE 189-continued

Segment location on transcripts

| Transcript name | Segment starting position | Segment ending position |
|---|---|---|
| D11793_T14 (SEQ ID NO: 164) | 1737 | 1841 |
| D11793_T18 (SEQ ID NO: 165) | 1829 | 1933 |
| D11793_T24 (SEQ ID NO: 166) | 1482 | 1586 |
| D11793_T32 (SEQ ID NO: 167) | 1980 | 2084 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_34 (SEQ ID NO:201) according to the present invention is supported by 94 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 190 below describes the starting and ending position of this segment on each transcript.

TABLE 190

Segment location on transcripts

| Transcript name | Segment starting position | Segment ending position |
|---|---|---|
| D11793_T5 (SEQ ID NO: 161) | 1252 | 1353 |
| D11793_T6 (SEQ ID NO: 162) | 1252 | 1353 |
| D11793_T10 (SEQ ID NO: 163) | 1344 | 1445 |
| D11793_T14 (SEQ ID NO: 164) | 1842 | 1943 |
| D11793_T18 (SEQ ID NO: 165) | 1934 | 2035 |
| D11793_T24 (SEQ ID NO: 166) | 1587 | 1688 |
| D11793_T32 (SEQ ID NO: 167) | 2085 | 2186 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_38 (SEQ ID NO:202) according to the present invention is supported by 91 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 191 below describes the starting and ending position of this segment on each transcript.

TABLE 191

Segment location on transcripts

| Transcript name | Segment starting position | Segment ending position |
|---|---|---|
| D11793_T5 (SEQ ID NO: 161) | 1531 | 1557 |
| D11793_T6 (SEQ ID NO: 162) | 1531 | 1557 |
| D11793_T10 (SEQ ID NO: 163) | 1623 | 1649 |
| D11793_T14 (SEQ ID NO: 164) | 2121 | 2147 |
| D11793_T18 (SEQ ID NO: 165) | 2213 | 2239 |
| D11793_T24 (SEQ ID NO: 166) | 1866 | 1892 |
| D11793_T32 (SEQ ID NO: 167) | 2364 | 2390 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_40 (SEQ ID NO:203) according to the present invention is supported by 102 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 192 below describes the starting and ending position of this segment on each transcript.

TABLE 192

Segment location on transcripts

| Transcript name | Segment starting position | Segment ending position |
|---|---|---|
| D11793_T5 (SEQ ID NO: 161) | 1558 | 1605 |
| D11793_T6 (SEQ ID NO: 162) | 1558 | 1605 |
| D11793_T10 (SEQ ID NO: 163) | 1650 | 1697 |
| D11793_T14 (SEQ ID NO: 164) | 2148 | 2195 |
| D11793_T18 (SEQ ID NO: 165) | 2240 | 2287 |
| D11793_T24 (SEQ ID NO: 166) | 1893 | 1940 |
| D11793_T32 (SEQ ID NO: 167) | 2391 | 2438 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_41 (SEQ ID NO:204) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 193 below describes the starting and ending position of this segment on each transcript.

TABLE 193

Segment location on transcripts

| Transcript name | Segment starting position | Segment ending position |
|---|---|---|
| D11793_T5 (SEQ ID NO: 161) | 1606 | 1622 |
| D11793_T6 (SEQ ID NO: 162) | 1606 | 1622 |
| D11793_T10 (SEQ ID NO: 163) | 1698 | 1714 |
| D11793_T14 (SEQ ID NO: 164) | 2196 | 2212 |
| D11793_T18 (SEQ ID NO: 165) | 2288 | 2304 |
| D11793_T24 (SEQ ID NO: 166) | 1941 | 1957 |
| D11793_T32 (SEQ ID NO: 167) | 2439 | 2455 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_42 (SEQ ID NO:205) according to the present invention is supported by 106 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 194 below describes the starting and ending position of this segment on each transcript.

TABLE 194

Segment location on transcripts

| Transcript name | Segment starting position | Segment ending position |
|---|---|---|
| D11793_T5 (SEQ ID NO: 161) | 1623 | 1655 |
| D11793_T6 (SEQ ID NO: 162) | 1623 | 1655 |
| D11793_T10 (SEQ ID NO: 163) | 1715 | 1747 |
| D11793_T14 (SEQ ID NO: 164) | 2213 | 2245 |
| D11793_T18 (SEQ ID NO: 165) | 2305 | 2337 |
| D11793_T24 (SEQ ID NO: 166) | 1958 | 1990 |
| D11793_T32 (SEQ ID NO: 167) | 2456 | 2488 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_43 (SEQ ID NO:206) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 195 below describes the starting and ending position of this segment on each transcript.

TABLE 195

Segment location on transcripts

| Transcript name | Segment starting position | Segment ending position |
|---|---|---|
| D11793_T5 (SEQ ID NO: 161) | 1656 | 1676 |
| D11793_T6 (SEQ ID NO: 162) | 1656 | 1676 |
| D11793_T10 (SEQ ID NO: 163) | 1748 | 1768 |
| D11793_T14 (SEQ ID NO: 164) | 2246 | 2266 |
| D11793_T18 (SEQ ID NO: 165) | 2338 | 2358 |
| D11793_T24 (SEQ ID NO: 166) | 1991 | 2011 |
| D11793_T32 (SEQ ID NO: 167) | 2489 | 2509 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_44 (SEQ ID NO:207) according to the present invention is supported by 106 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 196 below describes the starting and ending position of this segment on each transcript.

TABLE 196

Segment location on transcripts

| Transcript name | Segment starting position | Segment ending position |
|---|---|---|
| D11793_T5 (SEQ ID NO: 161) | 1677 | 1712 |
| D11793_T6 (SEQ ID NO: 162) | 1677 | 1712 |
| D11793_T10 (SEQ ID NO: 163) | 1769 | 1804 |
| D11793_T14 (SEQ ID NO: 164) | 2267 | 2302 |
| D11793_T18 (SEQ ID NO: 165) | 2359 | 2394 |
| D11793_T24 (SEQ ID NO: 166) | 2012 | 2047 |
| D11793_T32 (SEQ ID NO: 167) | 2510 | 2545 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node_45 (SEQ ID NO:208) according to the present invention is supported by 126 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 197 below describes the starting and ending position of this segment on each transcript.

TABLE 197

Segment location on transcripts

| Transcript name | Segment starting position | Segment ending position |
|---|---|---|
| D11793_T5 (SEQ ID NO: 161) | 1713 | 1782 |
| D11793_T6 (SEQ ID NO: 162) | 1713 | 1782 |
| D11793_T10 (SEQ ID NO: 163) | 1805 | 1874 |
| D11793_T14 (SEQ ID NO: 164) | 2303 | 2372 |
| D11793_T18 (SEQ ID NO: 165) | 2395 | 2464 |
| D11793_T24 (SEQ ID NO: 166) | 2048 | 2117 |
| D11793_T32 (SEQ ID NO: 167) | 2546 | 2615 |

This segment can be found in both coding and non-coding regions of transcript(s) as follows. The segment can be found in a non-coding region of transcript(s) that are related to the following protein(s): D11793_P6. This segment can also be found in the following protein(s): D11793_P29, D11793_P9, D11793_P11 and D11793_P13, since it is in the coding region for the corresponding transcript.

Segment cluster D11793_node__46 (SEQ ID NO:209) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 198 below describes the starting and ending position of this segment on each transcript.

TABLE 198

Segment location on transcripts

| Transcript name | Segment starting position | Segment ending position |
|---|---|---|
| D11793_T5 (SEQ ID NO: 161) | 1783 | 1792 |
| D11793_T6 (SEQ ID NO: 162) | 1783 | 1792 |
| D11793_T10 (SEQ ID NO: 163) | 1875 | 1884 |
| D11793_T14 (SEQ ID NO: 164) | 2373 | 2382 |
| D11793_T18 (SEQ ID NO: 165) | 2465 | 2474 |
| D11793_T24 (SEQ ID NO: 166) | 2118 | 2127 |
| D11793_T32 (SEQ ID NO: 167) | 2616 | 2625 |

This segment can be found in a non-coding region of transcript(s) that are related to the following protein(s): D11793_P29, D11793_P6, D11793_P9, D11793_P11 and D11793_P13.

Segment cluster D11793_node__47 (SEQ ID NO:210) according to the present invention is supported by 121 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 199 below describes the starting and ending position of this segment on each transcript.

TABLE 199

Segment location on transcripts

| Transcript name | Segment starting position | Segment ending position |
|---|---|---|
| D11793_T5 (SEQ ID NO: 161) | 1793 | 1820 |
| D11793_T6 (SEQ ID NO: 162) | 1793 | 1820 |
| D11793_T10 (SEQ ID NO: 163) | 1885 | 1912 |
| D11793_T14 (SEQ ID NO: 164) | 2383 | 2410 |
| D11793_T18 (SEQ ID NO: 165) | 2475 | 2502 |
| D11793_T24 (SEQ ID NO: 166) | 2128 | 2155 |
| D11793_T32 (SEQ ID NO: 167) | 2626 | 2653 |

This segment can be found in a non-coding region of transcript(s) that are related to the following protein(s): D11793_P29, D11793_P6, D11793_P9, D11793_P11 and D11793_P13.

Segment cluster D11793_node__48 (SEQ ID NO:211) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 200 below describes the starting and ending position of this segment on each transcript.

TABLE 200

Segment location on transcripts

| Transcript name | Segment starting position | Segment ending position |
|---|---|---|
| D11793_T5 (SEQ ID NO: 161) | 1821 | 1824 |
| D11793_T6 (SEQ ID NO: 162) | 1821 | 1824 |
| D11793_T10 (SEQ ID NO: 163) | 1913 | 1916 |
| D11793_T14 (SEQ ID NO: 164) | 2411 | 2414 |
| D11793_T18 (SEQ ID NO: 165) | 2503 | 2506 |
| D11793_T24 (SEQ ID NO: 166) | 2156 | 2159 |
| D11793_T32 (SEQ ID NO: 167) | 2654 | 2657 |

This segment can be found in a non-coding region of transcript(s) that are related to the following protein(s): D11793_P29, D11793_P6, D11793_P9, D11793_P11 and D11793_P13.

Segment cluster D11793_node__49 (SEQ ID NO:212) according to the present invention is supported by 131 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 201 below describes the starting and ending position of this segment on each transcript.

TABLE 201

Segment location on transcripts

| Transcript name | Segment starting position | Segment ending position |
|---|---|---|
| D11793_T5 (SEQ ID NO: 161) | 1825 | 1868 |
| D11793_T6 (SEQ ID NO: 162) | 1825 | 1868 |
| D11793_T10 (SEQ ID NO: 163) | 1917 | 1960 |
| D11793_T14 (SEQ ID NO: 164) | 2415 | 2458 |
| D11793_T18 (SEQ ID NO: 165) | 2507 | 2550 |
| D11793_T24 (SEQ ID NO: 166) | 2160 | 2203 |
| D11793_T32 (SEQ ID NO: 167) | 2658 | 2701 |

This segment can be found in a non-coding region of transcript(s) that are related to the following protein(s): D11793_P29, D11793_P6, D11793_P9, D11793_P11 and D11793_P13.

Segment cluster D11793_node_50 (SEQ ID NO:213) according to the present invention is supported by 158 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 202 below describes the starting and ending position of this segment on each transcript.

TABLE 202

Segment location on transcripts

| Transcript name | Segment starting position | Segment ending position |
| --- | --- | --- |
| D11793_T5 (SEQ ID NO: 161) | 1869 | 1932 |
| D11793_T6 (SEQ ID NO: 162) | 1869 | 1932 |
| D11793_T10 (SEQ ID NO: 163) | 1961 | 2024 |
| D11793_T14 (SEQ ID NO: 164) | 2459 | 2522 |
| D11793_T18 (SEQ ID NO: 165) | 2551 | 2614 |
| D11793_T24 (SEQ ID NO: 166) | 2204 | 2267 |
| D11793_T32 (SEQ ID NO: 167) | 2702 | 2765 |

This segment can be found in a non-coding region of transcript(s) that are related to the following protein(s): D11793_P29, D11793_P6, D11793_P9, D11793_P11 and D11793_P13.

Segment cluster D11793_node_51 (SEQ ID NO:214) according to the present invention is supported by 182 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 203 below describes the starting and ending position of this segment on each transcript.

TABLE 203

Segment location on transcripts

| Transcript name | Segment starting position | Segment ending position |
| --- | --- | --- |
| D11793_T5 (SEQ ID NO: 161) | 1933 | 2002 |
| D11793_T6 (SEQ ID NO: 162) | 1933 | 2002 |
| D11793_T10 (SEQ ID NO: 163) | 2025 | 2094 |
| D11793_T14 (SEQ ID NO: 164) | 2523 | 2592 |
| D11793_T18 (SEQ ID NO: 165) | 2615 | 2684 |
| D11793_T24 (SEQ ID NO: 166) | 2268 | 2337 |
| D11793_T32 (SEQ ID NO: 167) | 2766 | 2835 |

This segment can be found in a non-coding region of transcript(s) that are related to the following protein(s): D11793_P29, D11793_P6, D11793_P9, D11793_P11 and D11793_P13.

Segment cluster D11793_node_52 (SEQ ID NO:215) according to the present invention is supported by 190 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 204 below describes the starting and ending position of this segment on each transcript.

TABLE 204

Segment location on transcripts

| Transcript name | Segment starting position | Segment ending position |
| --- | --- | --- |
| D11793_T5 (SEQ ID NO: 161) | 2003 | 2054 |
| D11793_T6 (SEQ ID NO: 162) | 2003 | 2054 |
| D11793_T10 (SEQ ID NO: 163) | 2095 | 2146 |
| D11793_T14 (SEQ ID NO: 164) | 2593 | 2644 |
| D11793_T18 (SEQ ID NO: 165) | 2685 | 2736 |
| D11793_T24 (SEQ ID NO: 166) | 2338 | 2389 |
| D11793_T32 (SEQ ID NO: 167) | 2836 | 2887 |

This segment can be found in a non-coding region of transcript(s) that are related to the following protein(s): D11793_P29, D11793_P6, D11793_P9, D11793_P11 and D11793_P13.

Segment cluster D11793_node_53 (SEQ ID NO:216) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 205 below describes the starting and ending position of this segment on each transcript.

TABLE 205

Segment location on transcripts

| Transcript name | Segment starting position | Segment ending position |
| --- | --- | --- |
| D11793_T5 (SEQ ID NO: 161) | 2055 | 2078 |
| D11793_T6 (SEQ ID NO: 162) | 2055 | 2078 |
| D11793_T10 (SEQ ID NO: 163) | 2147 | 2170 |
| D11793_T14 (SEQ ID NO: 164) | 2645 | 2668 |
| D11793_T18 (SEQ ID NO: 165) | 2737 | 2760 |
| D11793_T24 (SEQ ID NO: 166) | 2390 | 2413 |
| D11793_T32 (SEQ ID NO: 167) | 2888 | 2911 |

This segment can be found in a non-coding region of transcript(s) that are related to the following protein(s): D11793_P29, D11793_P6, D11793_P9, D11793_P11 and D11793_P13.

Segment cluster D11793_node_54 (SEQ ID NO:217) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 206 below describes the starting and ending position of this segment on each transcript.

TABLE 206

Segment location on transcripts

| Transcript name | Segment starting position | Segment ending position |
|---|---|---|
| D11793_T5 (SEQ ID NO: 161) | 2079 | 2097 |
| D11793_T6 (SEQ ID NO: 162) | 2079 | 2097 |
| D11793_T10 (SEQ ID NO: 163) | 2171 | 2189 |
| D11793_T14 (SEQ ID NO: 164) | 2669 | 2687 |
| D11793_T18 (SEQ ID NO: 165) | 2761 | 2779 |
| D11793_T24 (SEQ ID NO: 166) | 2414 | 2432 |
| D11793_T32 (SEQ ID NO: 167) | 2912 | 2930 |

This segment can be found in a non-coding region of transcript(s) that are related to the following protein(s): D11793_P29, D11793_P6, D11793_P9, D11793_P11 and D11793_P13.

Segment cluster D11793_node_55 (SEQ ID NO:218) according to the present invention is supported by 195 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 207 below describes the starting and ending position of this segment on each transcript.

TABLE 207

Segment location on transcripts

| Transcript name | Segment starting position | Segment ending position |
|---|---|---|
| D11793_T5 (SEQ ID NO: 161) | 2098 | 2146 |
| D11793_T6 (SEQ ID NO: 162) | 2098 | 2146 |
| D11793_T10 (SEQ ID NO: 163) | 2190 | 2238 |
| D11793_T14 (SEQ ID NO: 164) | 2688 | 2736 |
| D11793_T18 (SEQ ID NO: 165) | 2780 | 2828 |
| D11793_T24 (SEQ ID NO: 166) | 2433 | 2481 |
| D11793_T32 (SEQ ID NO: 167) | 2931 | 2979 |

This segment can be found in a non-coding region of transcript(s) that are related to the following protein(s): D11793_P29, D11793_P6, D11793_P9, D11793_P11 and D11793_P13.

Segment cluster D11793_node_57 (SEQ ID NO:219) according to the present invention is supported by 236 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 208 below describes the starting and ending position of this segment on each transcript.

TABLE 208

Segment location on transcripts

| Transcript name | Segment starting position | Segment ending position |
|---|---|---|
| D11793_T5 (SEQ ID NO: 161) | 2147 | 2249 |
| D11793_T6 (SEQ ID NO: 162) | 2147 | 2249 |
| D11793_T10 (SEQ ID NO: 163) | 2239 | 2341 |
| D11793_T14 (SEQ ID NO: 164) | 2737 | 2839 |
| D11793_T18 (SEQ ID NO: 165) | 2829 | 2931 |
| D11793_T24 (SEQ ID NO: 166) | 2482 | 2584 |
| D11793_T32 (SEQ ID NO: 167) | 2980 | 3082 |

This segment can be found in a non-coding region of transcript(s) that are related to the following protein(s): D11793_P29, D11793_P6, D11793_P9, D11793_P11 and D11793_P13.

Segment cluster D11793_node_58 (SEQ ID NO:220) according to the present invention is supported by 229 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 209 below describes the starting and ending position of this segment on each transcript.

TABLE 209

Segment location on transcripts

| Transcript name | Segment starting position | Segment ending position |
|---|---|---|
| D11793_T5 (SEQ ID NO: 161) | 2250 | 2331 |
| D11793_T6 (SEQ ID NO: 162) | 2250 | 2331 |
| D11793_T10 (SEQ ID NO: 163) | 2342 | 2423 |
| D11793_T14 (SEQ ID NO: 164) | 2840 | 2921 |
| D11793_T18 (SEQ ID NO: 165) | 2932 | 3013 |
| D11793_T24 (SEQ ID NO: 166) | 2585 | 2666 |
| D11793_T32 (SEQ ID NO: 167) | 3083 | 3164 |

This segment can be found in a non-coding region of transcript(s) that are related to the following protein(s): D11793_P29, D11793_P6, D11793_P9, D11793_P11 and D11793_P13.

Segment cluster D11793_node_59 (SEQ ID NO:221) according to the present invention is supported by 218 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 210 below describes the starting and ending position of this segment on each transcript.

TABLE 210

Segment location on transcripts

| Transcript name | Segment starting position | Segment ending position |
|---|---|---|
| D11793_T5 (SEQ ID NO: 161) | 2332 | 2385 |
| D11793_T6 (SEQ ID NO: 162) | 2332 | 2385 |
| D11793_T10 (SEQ ID NO: 163) | 2424 | 2477 |
| D11793_T14 (SEQ ID NO: 164) | 2922 | 2975 |

TABLE 210-continued

Segment location on transcripts

| Transcript name | Segment starting position | Segment ending position |
|---|---|---|
| D11793_T18 (SEQ ID NO: 165) | 3014 | 3067 |
| D11793_T24 (SEQ ID NO: 166) | 2667 | 2720 |
| D11793_T32 (SEQ ID NO: 167) | 3165 | 3218 |

This segment can be found in a non-coding region of transcript(s) that are related to the following protein(s): D11793_P29, D11793_P6, D11793_P9, D11793_P11 and D11793_P13.

Segment cluster D11793_node_60 (SEQ ID NO:222) according to the present invention is supported by 197 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 211 below describes the starting and ending position of this segment on each transcript.

TABLE 211

Segment location on transcripts

| Transcript name | Segment starting position | Segment ending position |
|---|---|---|
| D11793_T5 (SEQ ID NO: 161) | 2386 | 2436 |
| D11793_T6 (SEQ ID NO: 162) | 2386 | 2436 |
| D11793_T10 (SEQ ID NO: 163) | 2478 | 2528 |
| D11793_T14 (SEQ ID NO: 164) | 2976 | 3026 |
| D11793_T18 (SEQ ID NO: 165) | 3068 | 3118 |
| D11793_T24 (SEQ ID NO: 166) | 2721 | 2771 |
| D11793_T32 (SEQ ID NO: 167) | 3219 | 3269 |

This segment can be found in a non-coding region of transcript(s) that are related to the following protein(s): D11793_P29, D11793_P6, D11793_P9, D11793_P11 and D11793_P13.

Segment cluster D11793_node_61 (SEQ ID NO:223) according to the present invention is supported by 190 libraries. The number of libraries was determined as previously described. This segment can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 212 below describes the starting and ending position of this segment on each transcript.

TABLE 212

Segment location on transcripts

| Transcript name | Segment starting position | Segment ending position |
|---|---|---|
| D11793_T5 (SEQ ID NO: 161) | 2437 | 2469 |
| D11793_T6 (SEQ ID NO: 162) | 2437 | 2469 |
| D11793_T10 (SEQ ID NO: 163) | 2529 | 2561 |
| D11793_T14 (SEQ ID NO: 164) | 3027 | 3059 |
| D11793_T18 (SEQ ID NO: 165) | 3119 | 3151 |
| D11793_T24 (SEQ ID NO: 166) | 2772 | 2804 |
| D11793_T32 (SEQ ID NO: 167) | 3270 | 3302 |

This segment can be found in a non-coding region of transcript(s) that are related to the following protein(s): D11793_P29, D11793_P6, D11793_P9, D11793_P11 and D11793_P13.

Segment cluster D11793_node_62 (SEQ ID NO:224) according to the present invention can be found in the following transcript(s): D11793_T5 (SEQ ID NO:161), D11793_T6 (SEQ ID NO:162), D11793_T10 (SEQ ID NO:163), D11793_T14 (SEQ ID NO:164), D11793_T18 (SEQ ID NO:165), D11793_T24 (SEQ ID NO:166) and D11793_T32 (SEQ ID NO:167). Table 213 below describes the starting and ending position of this segment on each transcript.

TABLE 213

Segment location on transcripts

| Transcript name | Segment starting position | Segment ending position |
|---|---|---|
| D11793_T5 (SEQ ID NO: 161) | 2470 | 2479 |
| D11793_T6 (SEQ ID NO: 162) | 2470 | 2479 |
| D11793_T10 (SEQ ID NO: 163) | 2562 | 2571 |
| D11793_T14 (SEQ ID NO: 164) | 3060 | 3069 |
| D11793_T18 (SEQ ID NO: 165) | 3152 | 3161 |
| D11793_T24 (SEQ ID NO: 166) | 2805 | 2814 |
| D11793_T32 (SEQ ID NO: 167) | 3303 | 3312 |

This segment can be found in a non-coding region of transcript(s) that are related to the following protein(s): D11793_P29, D11793_P6, D11793_P9, D11793_P11 and D11793_P13.

Description for Cluster D12232

Cluster D12232 features 7 transcript(s) and 48 segment(s) of interest, the names for which are given in Tables 214 and 215, respectively, the sequences themselves are given at the end of the application. The selected protein variants are given in Table 216.

TABLE 214

Transcripts of interest
Transcript Name

D12232_T10 (SEQ ID NO: 225)
D12232_T13 (SEQ ID NO: 226)
D12232_T15 (SEQ ID NO: 227)
D12232_T18 (SEQ ID NO: 228)
D12232_T21 (SEQ ID NO: 229)
D12232_T22 (SEQ ID NO: 230)
D12232_T23 (SEQ ID NO: 231)

TABLE 215

Segments of interest
Segment Name

D12232_node_0 (SEQ ID NO: 232)
D12232_node_1 (SEQ ID NO: 233)
D12232_node_17 (SEQ ID NO: 234)
D12232_node_25 (SEQ ID NO: 235)
D12232_node_27 (SEQ ID NO: 236)
D12232_node_30 (SEQ ID NO: 237)
D12232_node_32 (SEQ ID NO: 238)
D12232_node_40 (SEQ ID NO: 239)
D12232_node_41 (SEQ ID NO: 240)
D12232_node_43 (SEQ ID NO: 241)
D12232_node_49 (SEQ ID NO: 242)
D12232_node_53 (SEQ ID NO: 243)
D12232_node_55 (SEQ ID NO: 244)
D12232_node_60 (SEQ ID NO: 245)

TABLE 215-continued

| Segments of interest |
|---|
| Segment Name |
| D12232_node_63 (SEQ ID NO: 246) |
| D12232_node_69 (SEQ ID NO: 247) |
| D12232_node_73 (SEQ ID NO: 248) |
| D12232_node_75 (SEQ ID NO: 249) |
| D12232_node_77 (SEQ ID NO: 250) |
| D12232_node_80 (SEQ ID NO: 251) |
| D12232_node_82 (SEQ ID NO: 252) |
| D12232_node_85 (SEQ ID NO: 253) |
| D12232_node_87 (SEQ ID NO: 254) |
| D12232_node_6 (SEQ ID NO: 255) |
| D12232_node_7 (SEQ ID NO: 256) |
| D12232_node_12 (SEQ ID NO: 257) |
| D12232_node_14 (SEQ ID NO: 258) |
| D12232_node_15 (SEQ ID NO: 259) |
| D12232_node_18 (SEQ ID NO: 260) |
| D12232_node_19 (SEQ ID NO: 261) |
| D12232_node_20 (SEQ ID NO: 262) |
| D12232_node_22 (SEQ ID NO: 263) |
| D12232_node_34 (SEQ ID NO: 264) |
| D12232_node_36 (SEQ ID NO: 265) |
| D12232_node_38 (SEQ ID NO: 266) |
| D12232_node_45 (SEQ ID NO: 267) |
| D12232_node_47 (SEQ ID NO: 268) |
| D12232_node_51 (SEQ ID NO: 269) |
| D12232_node_58 (SEQ ID NO: 270) |
| D12232_node_62 (SEQ ID NO: 271) |
| D12232_node_65 (SEQ ID NO: 272) |
| D12232_node_67 (SEQ ID NO: 273) |
| D12232_node_71 (SEQ ID NO: 274) |
| D12232_node_72 (SEQ ID NO: 275) |
| D12232_node_79 (SEQ ID NO: 276) |
| D12232_node_83 (SEQ ID NO: 277) |
| D12232_node_84 (SEQ ID NO: 278) |
| D12232_node_86 (SEQ ID NO: 279) |

TABLE 216

Proteins of interest

| Protein Name | Corresponding Transcript(s) |
|---|---|
| D12232_P5 | D12232_T10 (SEQ ID NO: 225) |
| D12232_P9 | D12232_T13 (SEQ ID NO: 226) |
| D12232_P11 | D12232_T15 (SEQ ID NO: 227) |
| D12232_P14 | D12232_T18 (SEQ ID NO: 228) |

These sequences are variants of the known protein Bifunctional aminoacyl-tRNA synthetase [Includes: Glutamyl-tRNA synthetase (EC 6.1.1.17) (Glutamate-tRNA ligase); Prolyl-tRNA synthetase (EC 6.1.1.15) (Proline-tRNA ligase)] (SwissProt accession identifier SYEP_HUMAN), referred to herein as the previously known protein.

The sequence for protein Bifunctional aminoacyl-tRNA synthetase [Includes: Glutamyl-tRNA synthetase (EC 6.1.1.17) (Glutamate-tRNA ligase); Prolyl-tRNA synthetase (EC 6.1.1.15) (Proline-tRNA ligase)] is given at the end of the application, as "Bifunctional aminoacyl-tRNA synthetase [Includes: Glutamyl-tRNA synthetase (EC 6.1.1.17) (Glutamate-tRNA ligase); Prolyl-tRNA synthetase (EC 6.1.1.15) (Proline-tRNA ligase)] amino acid sequence".

The following GO Annotation(s) apply to the previously known protein. The following annotation(s) were found: protein complex assembly, which are annotation(s) related to Biological Process; and soluble fraction; cytoplasm, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster D12232 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 10 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 10 and Table 217. This cluster is overexpressed (at least at a minimum level) in the following pathological conditions: adrenal cortical carcinoma, colorectal cancer, epithelial malignant tumors, a mixture of malignant tumors from different tissues and uterine malignancies.

TABLE 217

Normal tissue distribution

| Name of Tissue | Number |
|---|---|
| adrenal | 44 |
| bladder | 41 |
| bone | 97 |
| brain | 47 |
| colon | 9 |
| epithelial | 66 |
| general | 75 |
| kidney | 44 |
| liver | 19 |
| lung | 72 |
| lymph nodes | 33 |
| breast | 180 |
| bone marrow | 31 |
| muscle | 46 |
| ovary | 72 |
| pancreas | 113 |
| prostate | 108 |
| skin | 83 |
| stomach | 73 |
| T cells | 0 |
| Thyroid | 270 |
| uterus | 22 |

TABLE 218

P values and ratios for expression in cancerous tissue

| Name of Tissue | P1 | P2 | SP1 | R3 | SP2 | R4 |
|---|---|---|---|---|---|---|
| adrenal | 2.7e−02 | 1.6e−02 | 3.9e−02 | 3.9 | 1.1e−06 | 3.8 |
| bladder | 5.4e−01 | 6.3e−01 | 4.1e−01 | 1.7 | 6.2e−01 | 1.2 |
| bone | 3.7e−01 | 3.2e−01 | 4.6e−01 | 1.5 | 4.2e−01 | 1.3 |
| brain | 7.6e−01 | 7.7e−01 | 6.7e−01 | 1.0 | 2.5e−01 | 0.9 |
| colon | 1.5e−03 | 1.1e−03 | 1.5e−03 | 6.3 | 1.5e−03 | 6.0 |
| epithelial | 3.5e−03 | 9.5e−04 | 5.5e−05 | 1.9 | 4.5e−07 | 2.0 |
| general | 7.2e−04 | 5.7e−06 | 2.7e−05 | 1.6 | 3.6e−12 | 1.8 |
| kidney | 3.8e−01 | 3.9e−01 | 2.8e−01 | 1.8 | 2.0e−01 | 1.8 |
| liver | 4.4e−01 | 2.7e−01 | 1 | 0.9 | 1.1e−01 | 2.0 |
| lung | 8.1e−01 | 7.2e−01 | 2.4e−01 | 0.9 | 5.0e−02 | 1.7 |
| lymph nodes | 1.6e−01 | 4.3e−01 | 7.3e−02 | 3.6 | 1.3e−02 | 1.9 |
| breast | 6.0e−01 | 5.8e−01 | 5.5e−01 | 1.1 | 6.9e−01 | 0.8 |
| bone marrow | 3.4e−01 | 4.1e−01 | 6.0e−02 | 6.2 | 8.7e−02 | 2.7 |
| muscle | 5.2e−01 | 2.9e−01 | 3.8e−01 | 1.9 | 3.0e−01 | 1.6 |
| ovary | 1.7e−01 | 1.5e−01 | 2.7e−01 | 1.7 | 3.8e−01 | 1.5 |
| pancreas | 1.4e−01 | 9.1e−02 | 4.9e−01 | 0.9 | 5.2e−01 | 0.9 |
| prostate | 8.7e−01 | 9.0e−01 | 1 | 0.2 | 8.9e−01 | 0.5 |
| skin | 5.9e−01 | 6.5e−01 | 6.6e−01 | 1.0 | 9.1e−01 | 0.5 |
| stomach | 2.9e−01 | 3.9e−01 | 1.5e−01 | 2.1 | 5.0e−02 | 2.1 |

TABLE 218-continued

P values and ratios for expression in cancerous tissue

| Name of Tissue | P1 | P2 | SP1 | R3 | SP2 | R4 |
|---|---|---|---|---|---|---|
| T cells | 5.0e−01 | 3.3e−01 | 3.3e−01 | 3.1 | 1.4e−01 | 2.2 |
| Thyroid | 6.7e−01 | 6.7e−01 | 9.6e−01 | 0.5 | 9.6e−01 | 0.5 |
| uterus | 1.7e−03 | 1.2e−02 | 3.6e−02 | 2.8 | 7.0e−02 | 2.5 |

As noted above, cluster D12232 features 48 segment(s), which were listed in Table 215 above and for which the sequence(s) are given at the end of the application. These segment(s) are portions of nucleic acid sequence(s) which are described herein separately because they are of particular interest. A description of each segment according to the present invention is now provided.

Segment cluster D12232_node_0 (SEQ ID NO:232) according to the present invention is supported by 12 libraries. The number of libraries was determined as previously described. This segment can be found in the following transcript(s): D12232_T13 (SEQ ID NO:226) and D12232_T18 (SEQ ID NO:228). Table 219 below describes the starting and ending position of this segment on each transcript.

TABLE 219

Segment location on transcripts

| Transcript name | Segment starting position | Segment ending position |
|---|---|---|
| D12232_T13 (SEQ ID NO: 226) | 1 | 172 |
| D12232_T18 (SEQ ID NO: 228) | 1 | 172 |

This segment can be found in a non-coding region of transcript(s) that are related to the following protein(s): D12232_P9 and D12232_P14.

Segment cluster D12232_node_1 (SEQ ID NO:233) according to the present invention is supported by 86 libraries. The number of libraries was determined as previously described. This segment can be found in the following transcript(s): D12232_T13 (SEQ ID NO:226) and D12232_T18 (SEQ ID NO:228). Table 220 below describes the starting and ending position of this segment on each transcript.

TABLE 220

Segment location on transcripts

| Transcript name | Segment starting position | Segment ending position |
|---|---|---|
| D12232_T13 (SEQ ID NO: 226) | 173 | 321 |
| D12232_T18 (SEQ ID NO: 228) | 173 | 321 |

This segment can be found in the following protein(s): D12232_P9 and D12232_P14.

Segment cluster D12232_node_17 (SEQ ID NO:234) according to the present invention is supported by 2 libraries. The number of libraries was determined as previously described. This segment can be found in the following transcript(s): D12232_T10 (SEQ ID NO:225). Table 221 below describes the starting and ending position of this segment on each transcript.

TABLE 221

Segment location on transcripts

| Transcript name | Segment starting position | Segment ending position |
|---|---|---|
| D12232_T10 (SEQ ID NO: 225) | 1 | 741 |

This segment can be found in a non-coding region of transcript(s) that are related to the following protein(s): D12232_P5.

Segment cluster D12232_node_25 (SEQ ID NO:235) according to the present invention is supported by 77 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 222 below describes the starting and ending position of this segment on each transcript.

TABLE 222

Segment location on transcripts

| Transcript name | Segment starting position | Segment ending position |
|---|---|---|
| D12232_T10 (SEQ ID NO: 225) | 977 | 1103 |
| D12232_T13 (SEQ ID NO: 226) | 899 | 1025 |
| D12232_T18 (SEQ ID NO: 228) | 899 | 1025 |

This segment can be found in the following protein(s): D12232_P5, D12232_P9 and D12232_P14.

Segment cluster D12232_node_27 (SEQ ID NO:236) according to the present invention is supported by 67 libraries. The number of libraries was determined as previously described. This segment can be found in the following transcript(s): D12232_T11 (SEQ ID NO:225), D12232_T13 (SEQ ID NO:226) and D12232_T18 (SEQ ID NO:228). Table 223 below describes the starting and ending position of this segment on each transcript.

TABLE 223

Segment location on transcripts

| Transcript name | Segment starting position | Segment ending position |
|---|---|---|
| D12232_T10 (SEQ ID NO: 225) | 1104 | 1296 |
| D12232_T13 (SEQ ID NO: 226) | 1026 | 1218 |
| D12232_T18 (SEQ ID NO: 228) | 1026 | 1218 |

This segment can be found in the following protein(s): D12232_P5, D12232_P9 and D12232_P14.

Segment cluster D12232_node_30 (SEQ ID NO:237) according to the present invention is supported by 54 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 224 below describes the starting and ending position of this segment on each transcript.

TABLE 224

Segment location on transcripts

| Transcript name | Segment starting position | Segment ending position |
|---|---|---|
| D12232_T10 (SEQ ID NO: 225) | 1297 | 1468 |
| D12232_T13 (SEQ ID NO: 226) | 1219 | 1390 |
| D12232_T18 (SEQ ID NO: 228) | 1219 | 1390 |

This segment can be found in the following protein(s): D12232_P5, D12232_P9 and D12232_P14.

Segment cluster D12232_node_32 (SEQ ID NO:238) according to the present invention is supported by 43 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 225 below describes the starting and ending position of this segment on each transcript.

TABLE 225

Segment location on transcripts

| Transcript name | Segment starting position | Segment ending position |
|---|---|---|
| D12232_T10 (SEQ ID NO: 225) | 1469 | 1702 |
| D12232_T13 (SEQ ID NO: 226) | 1391 | 1624 |
| D12232_T18 (SEQ ID NO: 228) | 1391 | 1624 |

This segment can be found in the following protein(s): D12232_P5, D12232_P9 and D12232_P14.

Segment cluster D12232_node_40 (SEQ ID NO:239) according to the present invention is supported by 2 libraries. The number of libraries was determined as previously described. This segment can be found in the following transcript(s): D12232_T15 (SEQ ID NO:227). Table 226 below describes the starting and ending position of this segment on each transcript.

TABLE 226

Segment location on transcripts

| Transcript name | Segment starting position | Segment ending position |
|---|---|---|
| D12232_T15 (SEQ ID NO: 227) | 1 | 463 |

This segment can be found in a non-coding region of transcript(s) that are related to the following protein(s): D12232_P11.

Segment cluster D12232_node_41 (SEQ ID NO:240) according to the present invention is supported by 45 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 227 below describes the starting and ending position of this segment on each transcript.

TABLE 227

Segment location on transcripts

| Transcript name | Segment starting position | Segment ending position |
|---|---|---|
| D12232_T10 (SEQ ID NO: 225) | 1959 | 2095 |
| D12232_T13 (SEQ ID NO: 226) | 1881 | 2017 |
| D12232_T15 (SEQ ID NO: 227) | 464 | 600 |
| D12232_T18 (SEQ ID NO: 228) | 1881 | 2017 |

This segment can be found in the following protein(s): D12232_P5, D12232_P9, D12232_P11 and D12232_P14.

Segment cluster D12232_node_43 (SEQ ID NO:241) according to the present invention is supported by 52 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 228 below describes the starting and ending position of this segment on each transcript.

TABLE 228

Segment location on transcripts

| Transcript name | Segment starting position | Segment ending position |
|---|---|---|
| D12232_T10 (SEQ ID NO: 225) | 2096 | 2303 |
| D12232_T13 (SEQ ID NO: 226) | 2018 | 2225 |
| D12232_T15 (SEQ ID NO: 227) | 601 | 808 |
| D12232_T18 (SEQ ID NO: 228) | 2018 | 2225 |

This segment can be found in the following protein(s): D12232_P5, D12232_P9, D12232_P11 and D12232_P14.

Segment cluster D12232_node_49 (SEQ ID NO:242) according to the present invention is supported by 101 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 229 below describes the starting and ending position of this segment on each transcript.

TABLE 229

Segment location on transcripts

| Transcript name | Segment starting position | Segment ending position |
|---|---|---|
| D12232_T10 (SEQ ID NO: 225) | 2535 | 2798 |
| D12232_T13 (SEQ ID NO: 226) | 2457 | 2720 |
| D12232_T15 (SEQ ID NO: 227) | 1040 | 1303 |
| D12232_T18 (SEQ ID NO: 228) | 2457 | 2720 |

This segment can be found in the following protein(s): D12232_P5, D12232_P9, D12232_P11 and D12232_P14.

Segment cluster D12232_node_53 (SEQ ID NO:243) according to the present invention is supported by 107 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 230 below describes the starting and ending position of this segment on each transcript.

TABLE 230

Segment location on transcripts

| Transcript name | Segment starting position | Segment ending position |
|---|---|---|
| D12232_T10 (SEQ ID NO: 225) | 2895 | 3128 |
| D12232_T13 (SEQ ID NO: 226) | 2817 | 3050 |
| D12232_T15 (SEQ ID NO: 227) | 1400 | 1633 |
| D12232_T18 (SEQ ID NO: 228) | 2817 | 3050 |

This segment can be found in the following protein(s): D12232_P5, D12232_P9, D12232_P11 and D12232_P14.

Segment cluster D12232_node_55 (SEQ ID NO:244) according to the present invention is supported by 109 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 231 below describes the starting and ending position of this segment on each transcript.

TABLE 231

Segment location on transcripts

| Transcript name | Segment starting position | Segment ending position |
|---|---|---|
| D12232_T10 (SEQ ID NO: 225) | 3129 | 3391 |
| D12232_T13 (SEQ ID NO: 226) | 3051 | 3313 |
| D12232_T15 (SEQ ID NO: 227) | 1634 | 1896 |
| D12232_T18 (SEQ ID NO: 228) | 3051 | 3313 |

This segment can be found in the following protein(s): D12232_P5, D12232_P9, D12232_P11 and D12232_P14.

Segment cluster D12232_node_60 (SEQ ID NO:245) according to the present invention is supported by 106 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 232 below describes the starting and ending position of this segment on each transcript.

TABLE 232

Segment location on transcripts

| Transcript name | Segment starting position | Segment ending position |
|---|---|---|
| D12232_T10 (SEQ ID NO: 225) | 3444 | 3653 |
| D12232_T13 (SEQ ID NO: 226) | 3366 | 3575 |
| D12232_T15 (SEQ ID NO: 227) | 1949 | 2158 |
| D12232_T18 (SEQ ID NO: 228) | 3366 | 3575 |

This segment can be found in the following protein(s): D12232_P5, D12232_P9, D12232_P11 and D12232_P14.

Segment cluster D12232_node_63 (SEQ ID NO:246) according to the present invention is supported by 1 libraries. The number of libraries was determined as previously described. This segment can be found in the following transcript(s): D12232_T18 (SEQ ID NO:228). Table 233 below describes the starting and ending position of this segment on each transcript.

TABLE 233

Segment location on transcripts

| Transcript name | Segment starting position | Segment ending position |
|---|---|---|
| D12232_T18 (SEQ ID NO: 228) | 3649 | 3910 |

This segment can be found in the following protein(s): D12232_P14.

Segment cluster D12232_node_69 (SEQ ID NO:247) according to the present invention is supported by 97 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 234 below describes the starting and ending position of this segment on each transcript.

TABLE 234

Segment location on transcripts

| Transcript name | Segment starting position | Segment ending position |
|---|---|---|
| D12232_T10 (SEQ ID NO: 225) | 3909 | 4064 |
| D12232_T13 (SEQ ID NO: 226) | 3831 | 3986 |
| D12232_T15 (SEQ ID NO: 227) | 2414 | 2569 |

This segment can be found in the following protein(s): D12232_P5, D12232_P9 and D12232_P11.

Segment cluster D12232_node_73 (SEQ ID NO:248) according to the present invention is supported by 103 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 235 below describes the starting and ending position of this segment on each transcript.

TABLE 235

Segment location on transcripts

| Transcript name | Segment starting position | Segment ending position |
|---|---|---|
| D12232_T10 (SEQ ID NO: 225) | 4093 | 4262 |
| D12232_T13 (SEQ ID NO: 226) | 4015 | 4184 |
| D12232_T15 (SEQ ID NO: 227) | 2598 | 2767 |

This segment can be found in the following protein(s): D12232_P5, D12232_P9 and D12232_P11.

Segment cluster D12232_node_75 (SEQ ID NO:249) according to the present invention is supported by 123 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 236 below describes the starting and ending position of this segment on each transcript.

TABLE 236

Segment location on transcripts

| Transcript name | Segment starting position | Segment ending position |
|---|---|---|
| D12232_T10 (SEQ ID NO: 225) | 4263 | 4436 |
| D12232_T13 (SEQ ID NO: 226) | 4185 | 4358 |
| D12232_T15 (SEQ ID NO: 227) | 2768 | 2941 |

This segment can be found in the following protein(s): D12232_P5, D12232_P9 and D12232_P11.

Segment cluster D12232_node_77 (SEQ ID NO:250) according to the present invention is supported by 155 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 237 below describes the starting and ending position of this segment on each transcript.

TABLE 237

Segment location on transcripts

| Transcript name | Segment starting position | Segment ending position |
|---|---|---|
| D12232_T10 (SEQ ID NO: 225) | 4437 | 4597 |
| D12232_T13 (SEQ ID NO: 226) | 4359 | 4519 |
| D12232_T15 (SEQ ID NO: 227) | 2942 | 3102 |

This segment can be found in the following protein(s): D12232_P5, D12232_P9 and D12232_P11.

Segment cluster D12232_node_80 (SEQ ID NO:251) according to the present invention is supported by 1 libraries. The number of libraries was determined as previously described. This segment can be found in the following transcript(s): D12232_T13 (SEQ ID NO:226). Table 238 below describes the starting and ending position of this segment on each transcript.

TABLE 238

Segment location on transcripts

| Transcript name | Segment starting position | Segment ending position |
|---|---|---|
| D12232_T13 (SEQ ID NO: 226) | 4599 | 4747 |

This segment can be found in the following protein(s): D12232_P9.

Segment cluster D12232_node_82 (SEQ ID NO:252) according to the present invention is supported by 13 libraries. The number of libraries was determined as previously described. This segment can be found in the following transcript(s): D12232_T21 (SEQ ID NO:229), D12232_T22 (SEQ ID NO:230) and D12232_T23 (SEQ ID NO:231). Table 239 below describes the starting and ending position of this segment on each transcript.

TABLE 239

Segment location on transcripts

| Transcript name | Segment starting position | Segment ending position |
|---|---|---|
| D12232_T21 (SEQ ID NO: 229) | 1 | 1141 |
| D12232_T22 (SEQ ID NO: 230) | 1 | 1141 |
| D12232_T23 (SEQ ID NO: 231) | 1 | 1141 |

The previously-described transcripts for these segment(s) do not code for protein.

Segment cluster D12232_node_85 (SEQ ID NO:253) according to the present invention is supported by 181 libraries. The number of libraries was determined as previously described. This segment can be found in the following transcript(s): D12232_T10 (SEQ ID NO:225), D12232_T15 (SEQ ID NO:227), D12232_T21 (SEQ ID NO:229), D12232_T22 (SEQ ID NO:230) and D12232_T23 (SEQ ID NO:231). Table 240 below describes the starting and ending position of this segment on each transcript.

TABLE 240

Segment location on transcripts

| Transcript name | Segment starting position | Segment ending position |
|---|---|---|
| D12232_T10 (SEQ ID NO: 225) | 4742 | 5097 |
| D12232_T15 (SEQ ID NO: 227) | 3247 | 3602 |
| D12232_T21 (SEQ ID NO: 229) | 1207 | 1562 |
| D12232_T22 (SEQ ID NO: 230) | 1207 | 1562 |
| D12232_T23 (SEQ ID NO: 231) | 1308 | 1663 |

This segment can be found in the following protein(s): D12232_P5 and D12232_P11.

Segment cluster D12232_node_87 (SEQ ID NO:254) according to the present invention is supported by 2 libraries. The number of libraries was determined as previously described. This segment can be found in the following transcript(s): D12232_T22 (SEQ ID NO:230). Table 241 below describes the starting and ending position of this segment on each transcript.

TABLE 241

Segment location on transcripts

| Transcript name | Segment starting position | Segment ending position |
|---|---|---|
| D12232_T22 (SEQ ID NO: 230) | 1568 | 1855 |

The previously-described transcripts for these segment(s) do not code for protein.

According to an optional embodiment of the present invention, short segments related to the above cluster are also provided. These segments are up to about 120 bp in length, and so are included in a separate description.

Segment cluster D12232_node_6 (SEQ ID NO:255) according to the present invention can be found in the following transcript(s): D12232_T13 (SEQ ID NO:226) and D12232_T18 (SEQ ID NO:228). Table 242 below describes the starting and ending position of this segment on each transcript.

TABLE 242

Segment location on transcripts

| Transcript name | Segment starting position | Segment ending position |
|---|---|---|
| D12232_T13 (SEQ ID NO: 226) | 322 | 339 |
| D12232_T18 (SEQ ID NO: 228) | 322 | 339 |

This segment can be found in the following protein(s): D12232_P9 and D12232_P14.

Segment cluster D12232_node_7 (SEQ ID NO:256) according to the present invention is supported by 88 libraries. The number of libraries was determined as previously described. This segment can be found in the following transcript(s): D12232_T13 (SEQ ID NO:226) and D12232_T18 (SEQ ID NO:228). Table 243 below describes the starting and ending position of this segment on each transcript.

TABLE 243

Segment location on transcripts

| Transcript name | Segment starting position | Segment ending position |
|---|---|---|
| D12232_T13 (SEQ ID NO: 226) | 340 | 406 |
| D12232_T18 (SEQ ID NO: 228) | 340 | 406 |

This segment can be found in the following protein(s): D12232_P9 and D12232_P14.

Segment cluster D12232_node_12 (SEQ ID NO:257) according to the present invention is supported by 89 libraries. The number of libraries was determined as previously described. This segment can be found in the following transcript(s): D12232_T13 (SEQ ID NO:226) and D12232_T18 (SEQ ID NO:228). Table 244 below describes the starting and ending position of this segment on each transcript.

TABLE 244

Segment location on transcripts

| Transcript name | Segment starting position | Segment ending position |
|---|---|---|
| D12232_T13 (SEQ ID NO: 226) | 407 | 506 |
| D12232_T18 (SEQ ID NO: 228) | 407 | 506 |

This segment can be found in the following protein(s): D12232_P9 and D12232_P14.

Segment cluster D12232_node_14 (SEQ ID NO:258) according to the present invention is supported by 76 libraries. The number of libraries was determined as previously described. This segment can be found in the following transcript(s): D12232_T13 (SEQ ID NO:226) and D12232_T18 (SEQ ID NO:228). Table 245 below describes the starting and ending position of this segment on each transcript.

TABLE 245

Segment location on transcripts

| Transcript name | Segment starting position | Segment ending position |
|---|---|---|
| D12232_T13 (SEQ ID NO: 226) | 507 | 583 |
| D12232_T18 (SEQ ID NO: 228) | 507 | 583 |

This segment can be found in the following protein(s): D12232_P9 and D12232_P14.

Segment cluster D12232_node_15 (SEQ ID NO:259) according to the present invention is supported by 79 libraries. The number of libraries was determined as previously described. This segment can be found in the following transcript(s): D12232_T13 (SEQ ID NO:226) and D12232_T18 (SEQ ID NO:228). Table 246 below describes the starting and ending position of this segment on each transcript.

TABLE 246

Segment location on transcripts

| Transcript name | Segment starting position | Segment ending position |
|---|---|---|
| D12232_T13 (SEQ ID NO: 226) | 584 | 663 |
| D12232_T18 (SEQ ID NO: 228) | 584 | 663 |

This segment can be found in the following protein(s): D12232_P9 and D12232_P14.

Segment cluster D12232_node_18 (SEQ ID NO:260) according to the present invention can be found in the following transcript(s): D12232_T10 (SEQ ID NO:225), D12232_T13 (SEQ ID NO:226) and D12232_T18 (SEQ ID NO:228). Table 247 below describes the starting and ending position of this segment on each transcript.

TABLE 247

Segment location on transcripts

| Transcript name | Segment starting position | Segment ending position |
|---|---|---|
| D12232_T10 (SEQ ID NO: 225) | 742 | 761 |
| D12232_T13 (SEQ ID NO: 226) | 664 | 683 |
| D12232_T18 (SEQ ID NO: 228) | 664 | 683 |

This segment can be found in both coding and non-coding regions of transcript(s) as follows. The segment can be found in a non-coding region of transcript(s) that are related to the following protein(s): D12232_P5. This segment can also be found in the following protein(s): D12232_P9 and D12232_P14, since it is in the coding region for the corresponding transcript.

Segment cluster D12232_node_19 (SEQ ID NO:261) according to the present invention is supported by 81 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 248 below describes the starting and ending position of this segment on each transcript.

TABLE 248

Segment location on transcripts

| Transcript name | Segment starting position | Segment ending position |
|---|---|---|
| D12232_T10 (SEQ ID NO: 225) | 762 | 864 |
| D12232_T13 (SEQ ID NO: 226) | 684 | 786 |
| D12232_T18 (SEQ ID NO: 228) | 684 | 786 |

This segment can be found in both coding and non-coding regions of transcript(s) as follows. The segment can be found in a non-coding region of transcript(s) that are related to the following protein(s): D12232_P5. This segment can also be found in the following protein(s): D12232_P9 and D12232_P14, since it is in the coding region for the corresponding transcript.

Segment cluster D12232_node_20 (SEQ ID NO:262) according to the present invention can be found in the following transcript(s): D12232_T10 (SEQ ID NO:225), D12232_T13 (SEQ ID NO:226) and D12232_T18 (SEQ ID NO:228). Table 249 below describes the starting and ending position of this segment on each transcript.

TABLE 249

| | Segment location on transcripts | |
|---|---|---|
| Transcript name | Segment starting position | Segment ending position |
| D12232_T10 (SEQ ID NO: 225) | 865 | 881 |
| D12232_T13 (SEQ ID NO: 226) | 787 | 803 |
| D12232_T18 (SEQ ID NO: 228) | 787 | 803 |

This segment can be found in both coding and non-coding regions of transcript(s) as follows. The segment can be found in a non-coding region of transcript(s) that are related to the following protein(s): D12232_P5. This segment can also be found in the following protein(s): D12232_P9 and D12232_P14, since it is in the coding region for the corresponding transcript.

Segment cluster D12232_node_22 (SEQ ID NO:263) according to the present invention is supported by 76 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 250 below describes the starting and ending position of this segment on each transcript.

TABLE 250

| | Segment location on transcripts | |
|---|---|---|
| Transcript name | Segment starting position | Segment ending position |
| D12232_T10 (SEQ ID NO: 225) | 882 | 976 |
| D12232_T13 (SEQ ID NO: 226) | 804 | 898 |
| D12232_T18 (SEQ ID NO: 228) | 804 | 898 |

This segment can be found in the following protein(s): D12232_P5, D12232_P9 and D12232_P14.

Segment cluster D12232_node_34 (SEQ ID NO:264) according to the present invention is supported by 36 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 251 below describes the starting and ending position of this segment on each transcript.

TABLE 251

| | Segment location on transcripts | |
|---|---|---|
| Transcript name | Segment starting position | Segment ending position |
| D12232_T10 (SEQ ID NO: 225) | 1703 | 1787 |
| D12232_T13 (SEQ ID NO: 226) | 1625 | 1709 |
| D12232_T18 (SEQ ID NO: 228) | 1625 | 1709 |

This segment can be found in the following protein(s): D12232_P5, D12232_P9 and D12232_P14.

Segment cluster D12232_node_36 (SEQ ID NO:265) according to the present invention is supported by 40 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 252 below describes the starting and ending position of this segment on each transcript.

TABLE 252

| | Segment location on transcripts | |
|---|---|---|
| Transcript name | Segment starting position | Segment ending position |
| D12232_T10 (SEQ ID NO: 225) | 1788 | 1847 |
| D12232_T13 (SEQ ID NO: 226) | 1710 | 1769 |
| D12232_T18 (SEQ ID NO: 228) | 1710 | 1769 |

This segment can be found in the following protein(s): D12232_P5, D12232_P9 and D12232_P14.

Segment cluster D12232_node_38 (SEQ ID NO:266) according to the present invention is supported by 40 libraries. The number of libraries was determined as previously described. This segment can be found in the following transcript(s): D12232_T10 (SEQ ID NO:225), D12232_T13 (SEQ ID NO:226) and D12232_T18 (SEQ ID NO:228). Table 253 below describes the starting and ending position of this segment on each transcript.

TABLE 253

| | Segment location on transcripts | |
|---|---|---|
| Transcript name | Segment starting position | Segment ending position |
| D12232_T10 (SEQ ID NO: 225) | 1848 | 1958 |
| D12232_T13 (SEQ ID NO: 226) | 1770 | 1880 |
| D12232_T18 (SEQ ID NO: 228) | 1770 | 1880 |

This segment can be found in the following protein(s): D12232_P5, D12232_P9 and D12232_P14.

Segment cluster D12232_node_45 (SEQ ID NO:267) according to the present invention is supported by 52 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 254 below describes the starting and ending position of this segment on each transcript.

TABLE 254

| | Segment location on transcripts | |
|---|---|---|
| Transcript name | Segment starting position | Segment ending position |
| D12232_T10 (SEQ ID NO: 225) | 2304 | 2416 |
| D12232_T13 (SEQ ID NO: 226) | 2226 | 2338 |
| D12232_T15 (SEQ ID NO: 227) | 809 | 921 |
| D12232_T18 (SEQ ID NO: 228) | 2226 | 2338 |

This segment can be found in the following protein(s): D12232_P5, D12232_P9, D12232_P11 and D12232_P14.

Segment cluster D12232_node_47 (SEQ ID NO:268) according to the present invention is supported by 65 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 255 below describes the starting and ending position of this segment on each transcript.

TABLE 255

| Segment location on transcripts | | |
|---|---|---|
| Transcript name | Segment starting position | Segment ending position |
| D12232_T10 (SEQ ID NO: 225) | 2417 | 2534 |
| D12232_T13 (SEQ ID NO: 226) | 2339 | 2456 |
| D12232_T15 (SEQ ID NO: 227) | 922 | 1039 |
| D12232_T18 (SEQ ID NO: 228) | 2339 | 2456 |

This segment can be found in the following protein(s): D12232_P5, D12232_P9, D12232_P11 and D12232_P14.

Segment cluster D12232_node_51 (SEQ ID NO:269) according to the present invention is supported by 93 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 256 below describes the starting and ending position of this segment on each transcript.

TABLE 256

| Segment location on transcripts | | |
|---|---|---|
| Transcript name | Segment starting position | Segment ending position |
| D12232_T10 (SEQ ID NO: 225) | 2799 | 2894 |
| D12232_T13 (SEQ ID NO: 226) | 2721 | 2816 |
| D12232_T15 (SEQ ID NO: 227) | 1304 | 1399 |
| D12232_T18 (SEQ ID NO: 228) | 2721 | 2816 |

This segment can be found in the following protein(s): D12232_P5, D12232_P9, D12232_P11 and D12232_P14.

Segment cluster D12232_node_58 (SEQ ID NO:270) according to the present invention is supported by 72 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 257 below describes the starting and ending position of this segment on each transcript.

TABLE 257

| Segment location on transcripts | | |
|---|---|---|
| Transcript name | Segment starting position | Segment ending position |
| D12232_T10 (SEQ ID NO: 225) | 3392 | 3443 |
| D12232_T13 (SEQ ID NO: 226) | 3314 | 3365 |
| D12232_T15 (SEQ ID NO: 227) | 1897 | 1948 |
| D12232_T18 (SEQ ID NO: 228) | 3314 | 3365 |

This segment can be found in the following protein(s): D12232_P5, D12232_P9, D12232_P11 and D12232_P14.

Segment cluster D12232_node_62 (SEQ ID NO:271) according to the present invention is supported by 76 libraries. The number of libraries was determined as previously described. This segment can be found in the following transcript(s): D12232_T10 (SEQ ID NO:225), D12232_T13 (SEQ ID NO:226), D12232_T15 (SEQ ID NO:227) and D12232_T18 (SEQ ID NO:228). Table 258 below describes the starting and ending position of this segment on each transcript.

TABLE 258

| Segment location on transcripts | | |
|---|---|---|
| Transcript name | Segment starting position | Segment ending position |
| D12232_T10 (SEQ ID NO: 225) | 3654 | 3726 |
| D12232_T13 (SEQ ID NO: 226) | 3576 | 3648 |
| D12232_T15 (SEQ ID NO: 227) | 2159 | 2231 |
| D12232_T18 (SEQ ID NO: 228) | 3576 | 3648 |

This segment can be found in the following protein(s): D12232_P5, D12232_P9, D12232_P11 and D12232_P14.

Segment cluster D12232_node_65 (SEQ ID NO:272) according to the present invention is supported by 84 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 259 below describes the starting and ending position of this segment on each transcript.

TABLE 259

| Segment location on transcripts | | |
|---|---|---|
| Transcript name | Segment starting position | Segment ending position |
| D12232_T10 (SEQ ID NO: 225) | 3727 | 3806 |
| D12232_T13 (SEQ ID NO: 226) | 3649 | 3728 |
| D12232_T15 (SEQ ID NO: 227) | 2232 | 2311 |

This segment can be found in the following protein(s): D12232_P5, D12232_P9 and D12232_P11.

Segment cluster D12232_node_67 (SEQ ID NO:273) according to the present invention is supported by 90 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 260 below describes the starting and ending position of this segment on each transcript.

TABLE 260

| Segment location on transcripts | | |
|---|---|---|
| Transcript name | Segment starting position | Segment ending position |
| D12232_T10 (SEQ ID NO: 225) | 3807 | 3908 |
| D12232_T13 (SEQ ID NO: 226) | 3729 | 3830 |
| D12232_T15 (SEQ ID NO: 227) | 2312 | 2413 |

This segment can be found in the following protein(s): D12232_P5, D12232_P9 and D12232_P11.

Segment cluster D12232_node_71 (SEQ ID NO:274) according to the present invention can be found in the following transcript(s): D12232_T10 (SEQ ID NO:225), D12232_T13 (SEQ ID NO:226) and D12232_T15 (SEQ ID NO:227). Table 261 below describes the starting and ending position of this segment on each transcript.

TABLE 261

Segment location on transcripts

| Transcript name | Segment starting position | Segment ending position |
|---|---|---|
| D12232_T10 (SEQ ID NO: 225) | 4065 | 4087 |
| D12232_T13 (SEQ ID NO: 226) | 3987 | 4009 |
| D12232_T15 (SEQ ID NO: 227) | 2570 | 2592 |

This segment can be found in the following protein(s): D12232_P5, D12232_P9 and D12232_P11.

Segment cluster D12232_node_72 (SEQ ID NO:275) according to the present invention can be found in the following transcript(s): D12232_T10 (SEQ ID NO:225), D12232_T13 (SEQ ID NO:226) and D12232_T15 (SEQ ID NO:227). Table 262 below describes the starting and ending position of this segment on each transcript.

TABLE 262

Segment location on transcripts

| Transcript name | Segment starting position | Segment ending position |
|---|---|---|
| D12232_T10 (SEQ ID NO: 225) | 4088 | 4092 |
| D12232_T13 (SEQ ID NO: 226) | 4010 | 4014 |
| D12232_T15 (SEQ ID NO: 227) | 2593 | 2597 |

This segment can be found in the following protein(s): D12232_P5, D12232_P9 and D12232_P11.

Segment cluster D12232_node_79 (SEQ ID NO:276) according to the present invention is supported by 158 libraries. The number of libraries was determined as previously described. This segment can be found in the following transcript(s): D12232_T10 (SEQ ID NO:225), D12232_T13 (SEQ ID NO:226) and D12232_T15 (SEQ ID NO:227). Table 263 below describes the starting and ending position of this segment on each transcript.

TABLE 263

Segment location on transcripts

| Transcript name | Segment starting position | Segment ending position |
|---|---|---|
| D12232_T10 (SEQ ID NO: 225) | 4598 | 4676 |
| D12232_T13 (SEQ ID NO: 226) | 4520 | 4598 |
| D12232_T15 (SEQ ID NO: 227) | 3103 | 3181 |

This segment can be found in the following protein(s): D12232_P5, D12232_P9 and D12232_P11.

Segment cluster D12232_node_83 (SEQ ID NO:277) according to the present invention is supported by 168 libraries. The number of libraries was determined as previously described. This segment can be found in the following transcript(s): D12232_T10 (SEQ ID NO:225), D12232_T15 (SEQ ID NO:227), D12232_T21 (SEQ ID NO:229), D12232_T22 (SEQ ID NO:230) and D12232_T23 (SEQ ID NO:231). Table 264 below describes the starting and ending position of this segment on each transcript.

TABLE 264

Segment location on transcripts

| Transcript name | Segment starting position | Segment ending position |
|---|---|---|
| D12232_T10 (SEQ ID NO: 225) | 4677 | 4741 |
| D12232_T15 (SEQ ID NO: 227) | 3182 | 3246 |
| D12232_T21 (SEQ ID NO: 229) | 1142 | 1206 |
| D12232_T22 (SEQ ID NO: 230) | 1142 | 1206 |
| D12232_T23 (SEQ ID NO: 231) | 1142 | 1206 |

This segment can be found in the following protein(s): D12232_P5 and D12232_P11.

Segment cluster D12232_node_84 (SEQ ID NO:278) according to the present invention is supported by 3 libraries. The number of libraries was determined as previously described. This segment can be found in the following transcript(s): D12232_T23 (SEQ ID NO:231). Table 265 below describes the starting and ending position of this segment on each transcript.

TABLE 265

Segment location on transcripts

| Transcript name | Segment starting position | Segment ending position |
|---|---|---|
| D12232_T23 (SEQ ID NO: 231) | 1207 | 1307 |

The previously-described transcripts for these segment(s) do not code for protein.

Segment cluster D12232_node_86 (SEQ ID NO:279) according to the present invention can be found in the following transcript(s): D12232_T22 (SEQ ID NO:230). Table 266 below describes the starting and ending position of this segment on each transcript.

TABLE 266

Segment location on transcripts

| Transcript name | Segment starting position | Segment ending position |
|---|---|---|
| D12232_T22 (SEQ ID NO: 230) | 1563 | 1567 |

The previously-described transcripts for these segment(s) do not code for protein.

Description for Cluster F00120

Cluster F00120 features 1 transcript(s) and 73 segment(s) of interest, the names for which are given in Tables 267 and 268, respectively, the sequences themselves are given at the end of the application. The selected protein variants are given in Table 269.

TABLE 267

Transcripts of interest
Transcript Name

F00120_T15 (SEQ ID NO: 280)

TABLE 268

Segments of interest
Segment Name

F00120_node_4 (SEQ ID NO: 281)
F00120_node_45 (SEQ ID NO: 282)
F00120_node_0 (SEQ ID NO: 283)
F00120_node_1 (SEQ ID NO: 284)
F00120_node_2 (SEQ ID NO: 285)
F00120_node_3 (SEQ ID NO: 286)
F00120_node_5 (SEQ ID NO: 287)
F00120_node_6 (SEQ ID NO: 288)
F00120_node_7 (SEQ ID NO: 289)
F00120_node_8 (SEQ ID NO: 290)
F00120_node_9 (SEQ ID NO: 291)
F00120_node_11 (SEQ ID NO: 292)
F00120_node_12 (SEQ ID NO: 293)
F00120_node_13 (SEQ ID NO: 294)
F00120_node_14 (SEQ ID NO: 295)
F00120_node_15 (SEQ ID NO: 296)
F00120_node_16 (SEQ ID NO: 297)
F00120_node_17 (SEQ ID NO: 298)
F00120_node_20 (SEQ ID NO: 299)
F00120_node_23 (SEQ ID NO: 300)
F00120_node_24 (SEQ ID NO: 301)
F00120_node_26 (SEQ ID NO: 302)
F00120_node_27 (SEQ ID NO: 303)
F00120_node_28 (SEQ ID NO: 304)
F00120_node_29 (SEQ ID NO: 305)
F00120_node_32 (SEQ ID NO: 306)
F00120_node_33 (SEQ ID NO: 307)
F00120_node_36 (SEQ ID NO: 308)
F00120_node_37 (SEQ ID NO: 309)
F00120_node_38 (SEQ ID NO: 310)
F00120_node_39 (SEQ ID NO: 311)
F00120_node_44 (SEQ ID NO: 312)
F00120_node_46 (SEQ ID NO: 313)
F00120_node_48 (SEQ ID NO: 314)
F00120_node_49 (SEQ ID NO: 315)
F00120_node_51 (SEQ ID NO: 316)
F00120_node_52 (SEQ ID NO: 317)
F00120_node_53 (SEQ ID NO: 318)
F00120_node_54 (SEQ ID NO: 319)
F00120_node_55 (SEQ ID NO: 320)
F00120_node_56 (SEQ ID NO: 321)
F00120_node_57 (SEQ ID NO: 322)
F00120_node_58 (SEQ ID NO: 323)
F00120_node_59 (SEQ ID NO: 324)
F00120_node_60 (SEQ ID NO: 325)
F00120_node_61 (SEQ ID NO: 326)
F00120_node_62 (SEQ ID NO: 327)
F00120_node_63 (SEQ ID NO: 328)
F00120_node_64 (SEQ ID NO: 329)
F00120_node_65 (SEQ ID NO: 330)
F00120_node_66 (SEQ ID NO: 331)
F00120_node_67 (SEQ ID NO: 332)
F00120_node_68 (SEQ ID NO: 333)
F00120_node_69 (SEQ ID NO: 334)
F00120_node_70 (SEQ ID NO: 335)
F00120_node_71 (SEQ ID NO: 336)
F00120_node_72 (SEQ ID NO: 337)
F00120_node_73 (SEQ ID NO: 338)
F00120_node_74 (SEQ ID NO: 339)
F00120_node_75 (SEQ ID NO: 340)
F00120_node_76 (SEQ ID NO: 341)
F00120_node_77 (SEQ ID NO: 342)
F00120_node_78 (SEQ ID NO: 343)
F00120_node_79 (SEQ ID NO: 344)
F00120_node_80 (SEQ ID NO: 345)
F00120_node_81 (SEQ ID NO: 346)
F00120_node_82 (SEQ ID NO: 347)
F00120_node_83 (SEQ ID NO: 348)
F00120_node_84 (SEQ ID NO: 349)
F00120_node_86 (SEQ ID NO: 350)
F00120_node_87 (SEQ ID NO: 351)
F00120_node_88 (SEQ ID NO: 352)
F00120_node_89 (SEQ ID NO: 353)

TABLE 269

Proteins of interest

| Protein Name | Corresponding Transcript(s) |
|---|---|
| F00120_P9 | F00120_T15 (SEQ ID NO: 280) |

These sequences are variants of the known protein Desmin (SwissProt accession identifier DESM_HUMAN), referred to herein as the previously known protein.

Protein Desmin is known or believed to have the following function(s): Desmin are class-III intermediate filaments found in muscle cells. In adult striated muscle they form a fibrous network connecting myofibrils to each other and to the plasma membrane from the periphery of the Z-line structures. The sequence for protein Desmin is given at the end of the application, as "Desmin amino acid sequence". Known polymorphisms for this sequence are as shown in Table 270.

TABLE 270

Amino acid mutations for Known Protein

| SNP position(s) on amino acid sequence | Comment |
|---|---|
| 172-178 | Missing (in CSM; severe form). /FTId = VAR_009188. |
| 336 | A -> P (in CSM; mild adult-onset). /FTId = VAR_007900. |
| 344 | L -> P (in CSM; distal onset). /FTId = VAR_009189. |
| 359 | A -> P (in CSM; heterozygous with Ile-391 gives a severe childhood-onset). /FTId = VAR_007901. |
| 392 | N -> I (in CSM; heterozygous with Pro-358 gives a severe childhood-onset). /FTId = VAR_007902. |
| 22-24 | GFP -> VFS |
| 38 | G -> P |
| 118-122 | FANYI -> SPIYM |
| 134 | Missing |

Protein Desmin localization is believed to be Cytoplasmic.

The following GO Annotation(s) apply to the previously known protein. The following annotation(s) were found: muscle contraction; cytoskeleton organization and biogenesis; control of heart, which are annotation(s) related to Biological Process; structural protein of cytoskeleton, which are annotation(s) related to Molecular Function; and intermediate filament, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

The heart-selective diagnostic marker prediction engine provided the following results with regard to cluster F00120. Predictions were made for selective expression of transcripts of this contig in heart tissue, according to the previously described methods. The numbers on the y-axis of FIG. 11 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 11, concerning the number of heart-specific clones in libraries/sequences; as well as with regard to the histogram in FIGS. 12-13, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 5.2; the ratio of expression of the cluster in heart specific ESTs to the overall expression of the cluster in muscle-specific ESTs which was found to be 1.5; and fisher exact test P-values were computed both for library and weighted clone counts to check that the counts are statistically significant, and were found to be 3.20E-73.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 5.2, which clearly supports specific expression in heart tissue.

As noted above, cluster F00120 features 73 segment(s), which were listed in Table 268 above and for which the sequence(s) are given at the end of the application. These segment(s) are portions of nucleic acid sequence(s) which are described herein separately because they are of particular interest. A description of each segment according to the present invention is now provided.

Segment cluster F00120_node_4 (SEQ ID NO:281) according to the present invention is supported by 114 libraries. The number of libraries was determined as previously described. This segment can be found in the following transcript(s): F00120_T15 (SEQ ID NO:280). Table 271 below describes the starting and ending position of this segment on each transcript.

TABLE 271

| | Segment location on transcripts | |
|---|---|---|
| Transcript name | Segment starting position | Segment ending position |
| F00120_T15 (SEQ ID NO: 280) | 189 | 326 |

This segment can be found in the following protein(s): F00120_P9.

Segment cluster F00120_node_45 (SEQ ID NO:282) according to the present invention is supported by 46 libraries. The number of libraries was determined as previously described. This segment can be found in the following transcript(s): F00120_T15 (SEQ ID NO:280). Table 272 below describes the starting and ending position of this segment on each transcript.

TABLE 272

| | Segment location on transcripts | |
|---|---|---|
| Transcript name | Segment starting position | Segment ending position |
| F00120_T15 (SEQ ID NO:280) | 1439 | 3161 |

This segment can be found in the following protein(s): F00120_P9.

According to an optional embodiment of the present invention, short segments related to the above cluster are also provided. These segments are up to about 120 bp in length, and so are included in a separate description.

Segment cluster F00120_node_0 (SEQ ID NO:283) according to the present invention is supported by 84 libraries. The number of libraries was determined as previously described. This segment can be found in the following transcript(s): F00120_T15 (SEQ ID NO:280). Table 273 below describes the starting and ending position of this segment on each transcript.

TABLE 273

| | Segment location on transcripts | |
|---|---|---|
| Transcript name | Segment starting position | Segment ending position |
| F00120_T15 (SEQ ID NO: 280) | 1 | 111 |

This segment can be found in a non-coding region of transcript(s) that are related to the following protein(s): F00120_P9.

Segment cluster F00120_node_1 (SEQ ID NO:284) according to the present invention can be found in the following transcript(s): F00120_T15 (SEQ ID NO:280). Table 274 below describes the starting and ending position of this segment on each transcript.

TABLE 274

| | Segment location on transcripts | |
|---|---|---|
| Transcript name | Segment starting position | Segment ending position |
| F00120_T15 (SEQ ID NO: 280) | 112 | 132 |

This segment can be found in a non-coding region of transcript(s) that are related to the following protein(s): F00120_P9.

Segment cluster F00120_node_2 (SEQ ID NO:285) according to the present invention is supported by 94 libraries. The number of libraries was determined as previously described. This segment can be found in the following transcript(s): F00120_T15 (SEQ ID NO:280). Table 275 below describes the starting and ending position of this segment on each transcript.

TABLE 275

| | Segment location on transcripts | |
|---|---|---|
| Transcript name | Segment starting position | Segment ending position |
| F00120_T15 (SEQ ID NO: 280) | 133 | 180 |

This segment can be found in the following protein(s): F00120_P9.

Segment cluster F00120_node_3 (SEQ ID NO:286) according to the present invention can be found in the following transcript(s): F00120_T15 (SEQ ID NO:280). Table 276 below describes the starting and ending position of this segment on each transcript.

TABLE 276

Segment location on transcripts

| Transcript name | Segment starting position | Segment ending position |
|---|---|---|
| F00120_T15 (SEQ ID NO: 280) | 181 | 188 |

This segment can be found in the following protein(s): F00120_P9.

Segment cluster F00120_node_5 (SEQ ID NO:287) according to the present invention is supported by 109 libraries. The number of libraries was determined as previously described. This segment can be found in the following transcript(s): F00120_T15 (SEQ ID NO:280). Table 277 below describes the starting and ending position of this segment on each transcript.

TABLE 277

Segment location on transcripts

| Transcript name | Segment starting position | Segment ending position |
|---|---|---|
| F00120_T15 (SEQ ID NO: 280) | 327 | 369 |

This segment can be found in the following protein(s): F00120_P9.

Segment cluster F00120_node_6 (SEQ ID NO:288) according to the present invention can be found in the following transcript(s): F00120_T15 (SEQ ID NO:280). Table 278 below describes the starting and ending position of this segment on each transcript.

TABLE 278

Segment location on transcripts

| Transcript name | Segment starting position | Segment ending position |
|---|---|---|
| F00120_T15 (SEQ ID NO: 280) | 370 | 386 |

This segment can be found in the following protein(s): F00120_P9.

Segment cluster F00120_node_7 (SEQ ID NO:289) according to the present invention can be found in the following transcript(s): F00120_T15 (SEQ ID NO:280). Table 279 below describes the starting and ending position of this segment on each transcript.

TABLE 279

Segment location on transcripts

| Transcript name | Segment starting position | Segment ending position |
|---|---|---|
| F00120_T15 (SEQ ID NO: 280) | 387 | 392 |

This segment can be found in the following protein(s): F00120_P9.

Segment cluster F00120_node_8 (SEQ ID NO:290) according to the present invention is supported by 113 libraries. The number of libraries was determined as previously described. This segment can be found in the following transcript(s): F00120_T15 (SEQ ID NO:280). Table 280 below describes the starting and ending position of this segment on each transcript.

TABLE 280

Segment location on transcripts

| Transcript name | Segment starting position | Segment ending position |
|---|---|---|
| F00120_T15 (SEQ ID NO: 280) | 393 | 449 |

This segment can be found in the following protein(s): F00120_P9.

Segment cluster F00120_node_9 (SEQ ID NO:291) according to the present invention is supported by 120 libraries. The number of libraries was determined as previously described. This segment can be found in the following transcript(s): F00120_T15 (SEQ ID NO:280). Table 281 below describes the starting and ending position of this segment on each transcript.

TABLE 281

Segment location on transcripts

| Transcript name | Segment starting position | Segment ending position |
|---|---|---|
| F00120_T15 (SEQ ID NO: 280) | 450 | 492 |

This segment can be found in the following protein(s): F00120_P9.

Segment cluster F00120_node_11 (SEQ ID NO:292) according to the present invention is supported by 127 libraries. The number of libraries was determined as previously described. This segment can be found in the following transcript(s): F00120_T15 (SEQ ID NO:280). Table 282 below describes the starting and ending position of this segment on each transcript.

TABLE 282

Segment location on transcripts

| Transcript name | Segment starting position | Segment ending position |
|---|---|---|
| F00120_T15 (SEQ ID NO: 280) | 493 | 525 |

This segment can be found in the following protein(s): F00120_P9.

Segment cluster F00120_node_12 (SEQ ID NO:293) according to the present invention can be found in the following transcript(s): F00120_T15 (SEQ ID NO:280). Table 283 below describes the starting and ending position of this segment on each transcript.

TABLE 283

Segment location on transcripts

| Transcript name | Segment starting position | Segment ending position |
|---|---|---|
| F00120_T15 (SEQ ID NO: 280) | 526 | 531 |

This segment can be found in the following protein(s): F00120_P9.

Segment cluster F00120_node_13 (SEQ ID NO:294) according to the present invention is supported by 152 libraries. The number of libraries was determined as previously described. This segment can be found in the following transcript(s): F00120_T15 (SEQ ID NO:280). Table 284 below describes the starting and ending position of this segment on each transcript.

TABLE 284

Segment location on transcripts

| Transcript name | Segment starting position | Segment ending position |
|---|---|---|
| F00120_T15 (SEQ ID NO: 280) | 532 | 609 |

This segment can be found in the following protein(s): F00120_P9.

Segment cluster F00120_node_14 (SEQ ID NO:295) according to the present invention can be found in the following transcript(s): F00120_T15 (SEQ ID NO:280). Table 285 below describes the starting and ending position of this segment on each transcript.

TABLE 285

Segment location on transcripts

| Transcript name | Segment starting position | Segment ending position |
|---|---|---|
| F00120_T15 (SEQ ID NO: 280) | 610 | 618 |

This segment can be found in the following protein(s): F00120_P9.

Segment cluster F00120_node_15 (SEQ ID NO:296) according to the present invention can be found in the following transcript(s): F00120_T15 (SEQ ID NO:280). Table 286 below describes the starting and ending position of this segment on each transcript.

TABLE 286

Segment location on transcripts

| Transcript name | Segment starting position | Segment ending position |
|---|---|---|
| F00120_T15 (SEQ ID NO: 280) | 619 | 624 |

This segment can be found in the following protein(s): F00120_P9.

Segment cluster F00120_node_16 (SEQ ID NO:297) according to the present invention can be found in the following transcript(s): F00120_T15 (SEQ ID NO:280). Table 287 below describes the starting and ending position of this segment on each transcript.

TABLE 287

Segment location on transcripts

| Transcript name | Segment starting position | Segment ending position |
|---|---|---|
| F00120_T15 (SEQ ID NO: 280) | 625 | 628 |

This segment can be found in the following protein(s): F00120_P9.

Segment cluster F00120_node_17 (SEQ ID NO:298) according to the present invention is supported by 178 libraries. The number of libraries was determined as previously described. This segment can be found in the following transcript(s): F00120_T15 (SEQ ID NO:280). Table 288 below describes the starting and ending position of this segment on each transcript.

TABLE 288

Segment location on transcripts

| Transcript name | Segment starting position | Segment ending position |
|---|---|---|
| F00120_T15 (SEQ ID NO: 280) | 629 | 728 |

This segment can be found in the following protein(s): F00120_P9.

Segment cluster F00120_node_20 (SEQ ID NO:299) according to the present invention is supported by 190 libraries. The number of libraries was determined as previously described. This segment can be found in the following transcript(s): F00120_T15 (SEQ ID NO:280). Table 289 below describes the starting and ending position of this segment on each transcript.

TABLE 289

Segment location on transcripts

| Transcript name | Segment starting position | Segment ending position |
|---|---|---|
| F00120_T15 (SEQ ID NO: 280) | 729 | 789 |

This segment can be found in the following protein(s): F00120_P9.

Segment cluster F00120_node_23 (SEQ ID NO:300) according to the present invention can be found in the following transcript(s): F00120_T15 (SEQ ID NO:280). Table 290 below describes the starting and ending position of this segment on each transcript.

TABLE 290

Segment location on transcripts

| Transcript name | Segment starting position | Segment ending position |
|---|---|---|
| F00120_T15 (SEQ ID NO: 280) | 790 | 811 |

This segment can be found in the following protein(s): F00120_P9.

Segment cluster F00120_node_24 (SEQ ID NO:301) according to the present invention is supported by 221 libraries. The number of libraries was determined as previously described. This segment can be found in the following transcript(s): F00120_T15 (SEQ ID NO:280). Table 291 below describes the starting and ending position of this segment on each transcript.

TABLE 291

Segment location on transcripts

| Transcript name | Segment starting position | Segment ending position |
|---|---|---|
| F00120_T15 (SEQ ID NO: 280) | 812 | 885 |

This segment can be found in the following protein(s): F00120_P9.

Segment cluster F00120_node_26 (SEQ ID NO:302) according to the present invention is supported by 236 libraries. The number of libraries was determined as previously described. This segment can be found in the following transcript(s): F00120_T15 (SEQ ID NO:280). Table 292 below describes the starting and ending position of this segment on each transcript.

TABLE 292

Segment location on transcripts

| Transcript name | Segment starting position | Segment ending position |
|---|---|---|
| F00120_T15 (SEQ ID NO: 280) | 886 | 930 |

This segment can be found in the following protein(s): F00120_P9.

Segment cluster F00120_node_27 (SEQ ID NO:303) according to the present invention is supported by 241 libraries. The number of libraries was determined as previously described. This segment can be found in the following transcript(s): F00120_T15 (SEQ ID NO:280). Table 293 below describes the starting and ending position of this segment on each transcript.

TABLE 293

Segment location on transcripts

| Transcript name | Segment starting position | Segment ending position |
|---|---|---|
| F00120_T15 (SEQ ID NO: 280) | 931 | 974 |

This segment can be found in the following protein(s): F00120_P9.

Segment cluster F00120_node_28 (SEQ ID NO:304) according to the present invention is supported by 254 libraries. The number of libraries was determined as previously described. This segment can be found in the following transcript(s): F00120_T15 (SEQ ID NO:280). Table 294 below describes the starting and ending position of this segment on each transcript.

TABLE 294

Segment location on transcripts

| Transcript name | Segment starting position | Segment ending position |
|---|---|---|
| F00120_T15 (SEQ ID NO: 280) | 975 | 1029 |

This segment can be found in the following protein(s): F00120_P9.

Segment cluster F00120_node_29 (SEQ ID NO:305) according to the present invention can be found in the following transcript(s): F00120_T15 (SEQ ID NO:280). Table 295 below describes the starting and ending position of this segment on each transcript.

TABLE 295

Segment location on transcripts

| Transcript name | Segment starting position | Segment ending position |
|---|---|---|
| F00120_T15 (SEQ ID NO: 280) | 1030 | 1047 |

This segment can be found in the following protein(s): F00120_P9.

Segment cluster F00120_node_32 (SEQ ID NO:306) according to the present invention is supported by 269 libraries. The number of libraries was determined as previously described. This segment can be found in the following transcript(s): F00120_T15 (SEQ ID NO:280). Table 296 below describes the starting and ending position of this segment on each transcript.

TABLE 296

Segment location on transcripts

| Transcript name | Segment starting position | Segment ending position |
|---|---|---|
| F00120_T15 (SEQ ID NO: 280) | 1048 | 1098 |

This segment can be found in the following protein(s): F00120_P9.

Segment cluster F00120_node_33 (SEQ ID NO:307) according to the present invention is supported by 288 libraries. The number of libraries was determined as previously described. This segment can be found in the following transcript(s): F00120_T15 (SEQ ID NO:280). Table 297 below describes the starting and ending position of this segment on each transcript.

TABLE 297

Segment location on transcripts

| Transcript name | Segment starting position | Segment ending position |
|---|---|---|
| F00120_T15 (SEQ ID NO: 280) | 1099 | 1173 |

This segment can be found in the following protein(s): F00120_P9.

Segment cluster F00120_node_36 (SEQ ID NO:308) according to the present invention is supported by 330 libraries. The number of libraries was determined as previously described. This segment can be found in the following transcript(s): F00120_T15 (SEQ ID NO:280). Table 298 below describes the starting and ending position of this segment on each transcript.

TABLE 298

Segment location on transcripts

| Transcript name | Segment starting position | Segment ending position |
|---|---|---|
| F00120_T15 (SEQ ID NO: 280) | 1174 | 1290 |

This segment can be found in the following protein(s): F00120_P9.

Segment cluster F00120_node_37 (SEQ ID NO:309) according to the present invention is supported by 309 libraries. The number of libraries was determined as previously described. This segment can be found in the following transcript(s): F00120_T15 (SEQ ID NO:280). Table 299 below describes the starting and ending position of this segment on each transcript.

TABLE 299

| Segment location on transcripts | | |
|---|---|---|
| Transcript name | Segment starting position | Segment ending position |
| F00120_T15 (SEQ ID NO: 280) | 1291 | 1329 |

This segment can be found in the following protein(s): F00120_P9.

Segment cluster F00120_node_38 (SEQ ID NO:310) according to the present invention is supported by 324 libraries. The number of libraries was determined as previously described. This segment can be found in the following transcript(s): F00120_T15 (SEQ ID NO:280). Table 300 below describes the starting and ending position of this segment on each transcript.

TABLE 300

| Segment location on transcripts | | |
|---|---|---|
| Transcript name | Segment starting position | Segment ending position |
| F00120_T15 (SEQ ID NO: 280) | 1330 | 1381 |

This segment can be found in the following protein(s): F00120_P9.

Segment cluster F00120_node_39 (SEQ ID NO:311) according to the present invention can be found in the following transcript(s): F00120_T15 (SEQ ID NO:280). Table 301 below describes the starting and ending position of this segment on each transcript.

TABLE 301

| Segment location on transcripts | | |
|---|---|---|
| Transcript name | Segment starting position | Segment ending position |
| F00120_T15 (SEQ ID NO: 280) | 1382 | 1394 |

This segment can be found in the following protein(s): F00120_P9.

Segment cluster F00120_node_44 (SEQ ID NO:312) according to the present invention is supported by 316 libraries. The number of libraries was determined as previously described. This segment can be found in the following transcript(s): F00120_T15 (SEQ ID NO:280). Table 302 below describes the starting and ending position of this segment on each transcript.

TABLE 302

| Segment location on transcripts | | |
|---|---|---|
| Transcript name | Segment starting position | Segment ending position |
| F00120_T15 (SEQ ID NO: 280) | 1395 | 1438 |

This segment can be found in the following protein(s): F00120_P9.

Segment cluster F00120_node_46 (SEQ ID NO:313) according to the present invention is supported by 20 libraries. The number of libraries was determined as previously described. This segment can be found in the following transcript(s): F00120_T15 (SEQ ID NO:280). Table 303 below describes the starting and ending position of this segment on each transcript.

TABLE 303

| Segment location on transcripts | | |
|---|---|---|
| Transcript name | Segment starting position | Segment ending position |
| F00120_T15 (SEQ ID NO: 280) | 3162 | 3237 |

This segment can be found in a non-coding region of transcript(s) that are related to the following protein(s): F00120_P9.

Segment cluster F00120_node_48 (SEQ ID NO:314) according to the present invention is supported by 21 libraries. The number of libraries was determined as previously described. This segment can be found in the following transcript(s): F00120_T15 (SEQ ID NO:280). Table 304 below describes the starting and ending position of this segment on each transcript.

TABLE 304

| Segment location on transcripts | | |
|---|---|---|
| Transcript name | Segment starting position | Segment ending position |
| F00120_T15 (SEQ ID NO: 280) | 3238 | 3285 |

This segment can be found in a non-coding region of transcript(s) that are related to the following protein(s): F00120_P9.

Segment cluster F00120_node_49 (SEQ ID NO:315) according to the present invention is supported by 344 libraries. The number of libraries was determined as previously described. This segment can be found in the following transcript(s): F00120_T15 (SEQ ID NO:280). Table 305 below describes the starting and ending position of this segment on each transcript.

TABLE 305

| Segment location on transcripts | | |
|---|---|---|
| Transcript name | Segment starting position | Segment ending position |
| F00120_T15 (SEQ ID NO: 280) | 3286 | 3368 |

This segment can be found in a non-coding region of transcript(s) that are related to the following protein(s): F00120_P9.

Segment cluster F00120_node_51 (SEQ ID NO:316) according to the present invention is supported by 331 libraries. The number of libraries was determined as previously described. This segment can be found in the following transcript(s): F00120_T15 (SEQ ID NO:280). Table 306 below describes the starting and ending position of this segment on each transcript.

TABLE 306

| | Segment location on transcripts | |
|---|---|---|
| Transcript name | Segment starting position | Segment ending position |
| F00120_T15 (SEQ ID NO: 280) | 3369 | 3401 |

This segment can be found in a non-coding region of transcript(s) that are related to the following protein(s): F00120_P9.

Segment cluster F00120_node_52 (SEQ ID NO:317) according to the present invention can be found in the following transcript(s): F00120_T15 (SEQ ID NO:280). Table 307 below describes the starting and ending position of this segment on each transcript.

TABLE 307

| | Segment location on transcripts | |
|---|---|---|
| Transcript name | Segment starting position | Segment ending position |
| F00120_T15 (SEQ ID NO: 280) | 3402 | 3416 |

This segment can be found in a non-coding region of transcript(s) that are related to the following protein(s): F00120_P9.

Segment cluster F00120_node_53 (SEQ ID NO:318) according to the present invention can be found in the following transcript(s): F00120_T15 (SEQ ID NO:280). Table 308 below describes the starting and ending position of this segment on each transcript.

TABLE 308

| | Segment location on transcripts | |
|---|---|---|
| Transcript name | Segment starting position | Segment ending position |
| F00120_T15 (SEQ ID NO: 280) | 3417 | 3423 |

This segment can be found in a non-coding region of transcript(s) that are related to the following protein(s): F00120_P9.

Segment cluster F00120_node_54 (SEQ ID NO:319) according to the present invention can be found in the following transcript(s): F00120_T15 (SEQ ID NO:280). Table 309 below describes the starting and ending position of this segment on each transcript.

TABLE 309

| | Segment location on transcripts | |
|---|---|---|
| Transcript name | Segment starting position | Segment ending position |
| F00120_T15 (SEQ ID NO: 280) | 3424 | 3430 |

This segment can be found in a non-coding region of transcript(s) that are related to the following protein(s): F00120_P9.

Segment cluster F00120_node_55 (SEQ ID NO:320) according to the present invention can be found in the following transcript(s): F00120_T15 (SEQ ID NO:280). Table 310 below describes the starting and ending position of this segment on each transcript.

TABLE 310

| | Segment location on transcripts | |
|---|---|---|
| Transcript name | Segment starting position | Segment ending position |
| F00120_T15 (SEQ ID NO: 280) | 3431 | 3448 |

This segment can be found in a non-coding region of transcript(s) that are related to the following protein(s): F00120_P9.

Segment cluster F00120_node_56 (SEQ ID NO:321) according to the present invention can be found in the following transcript(s): F00120_T15 (SEQ ID NO:280). Table 311 below describes the starting and ending position of this segment on each transcript.

TABLE 311

| | Segment location on transcripts | |
|---|---|---|
| Transcript name | Segment starting position | Segment ending position |
| F00120_T15 (SEQ ID NO: 280) | 3449 | 3464 |

This segment can be found in a non-coding region of transcript(s) that are related to the following protein(s): F00120_P9.

Segment cluster F00120_node_57 (SEQ ID NO:322) according to the present invention can be found in the following transcript(s): F00120_T15 (SEQ ID NO:280). Table 312 below describes the starting and ending position of this segment on each transcript.

TABLE 312

| | Segment location on transcripts | |
|---|---|---|
| Transcript name | Segment starting position | Segment ending position |
| F00120_T15 (SEQ ID NO: 280) | 3465 | 3470 |

This segment can be found in a non-coding region of transcript(s) that are related to the following protein(s): F00120_P9.

Segment cluster F00120_node_58 (SEQ ID NO:323) according to the present invention can be found in the following transcript(s): F00120_T15 (SEQ ID NO:280). Table 313 below describes the starting and ending position of this segment on each transcript.

TABLE 313

Segment location on transcripts

| Transcript name | Segment starting position | Segment ending position |
|---|---|---|
| F00120_T15 (SEQ ID NO: 280) | 3471 | 3487 |

This segment can be found in a non-coding region of transcript(s) that are related to the following protein(s): F00120_P9.

Segment cluster F00120_node_59 (SEQ ID NO:324) according to the present invention can be found in the following transcript(s): F00120_T15 (SEQ ID NO:280). Table 314 below describes the starting and ending position of this segment on each transcript.

TABLE 314

Segment location on transcripts

| Transcript name | Segment starting position | Segment ending position |
|---|---|---|
| F00120_T15 (SEQ ID NO: 280) | 3488 | 3509 |

This segment can be found in a non-coding region of transcript(s) that are related to the following protein(s): F00120_P9.

Segment cluster F00120_node_60 (SEQ ID NO:325) according to the present invention can be found in the following transcript(s): F00120_T15 (SEQ ID NO:280). Table 315 below describes the starting and ending position of this segment on each transcript.

TABLE 315

Segment location on transcripts

| Transcript name | Segment starting position | Segment ending position |
|---|---|---|
| F00120_T15 (SEQ ID NO: 280) | 3510 | 3517 |

This segment can be found in a non-coding region of transcript(s) that are related to the following protein(s): F00120_P9.

Segment cluster F00120_node_61 (SEQ ID NO:326) according to the present invention is supported by 332 libraries. The number of libraries was determined as previously described. This segment can be found in the following transcript(s): F00120_T15 (SEQ ID NO:280). Table 316 below describes the starting and ending position of this segment on each transcript.

TABLE 316

Segment location on transcripts

| Transcript name | Segment starting position | Segment ending position |
|---|---|---|
| F00120_T15 (SEQ ID NO: 280) | 3518 | 3544 |

This segment can be found in a non-coding region of transcript(s) that are related to the following protein(s): F00120_P9.

Segment cluster F00120_node_62 (SEQ ID NO:327) according to the present invention can be found in the following transcript(s): F00120_T15 (SEQ ID NO:280). Table 317 below describes the starting and ending position of this segment on each transcript.

TABLE 317

Segment location on transcripts

| Transcript name | Segment starting position | Segment ending position |
|---|---|---|
| F00120_T15 (SEQ ID NO: 280) | 3545 | 3554 |

This segment can be found in a non-coding region of transcript(s) that are related to the following protein(s): F00120_P9.

Segment cluster F00120_node_63 (SEQ ID NO:328) according to the present invention can be found in the following transcript(s): F00120_T15 (SEQ ID NO:280). Table 318 below describes the starting and ending position of this segment on each transcript.

TABLE 318

Segment location on transcripts

| Transcript name | Segment starting position | Segment ending position |
|---|---|---|
| F00120_T15 (SEQ ID NO: 280) | 3555 | 3565 |

This segment can be found in a non-coding region of transcript(s) that are related to the following protein(s): F00120_P9.

Segment cluster F00120_node_64 (SEQ ID NO:329) according to the present invention can be found in the following transcript(s): F00120_T15 (SEQ ID NO:280). Table 319 below describes the starting and ending position of this segment on each transcript.

TABLE 319

Segment location on transcripts

| Transcript name | Segment starting position | Segment ending position |
|---|---|---|
| F00120_T15 (SEQ ID NO: 280) | 3566 | 3572 |

This segment can be found in a non-coding region of transcript(s) that are related to the following protein(s): F00120_P9.

Segment cluster F00120_node_65 (SEQ ID NO:330) according to the present invention can be found in the following transcript(s): F00120_T15 (SEQ ID NO:280). Table 320 below describes the starting and ending position of this segment on each transcript.

TABLE 320

| | Segment location on transcripts | |
|---|---|---|
| Transcript name | Segment starting position | Segment ending position |
| F00120_T15 (SEQ ID NO: 280) | 3573 | 3590 |

This segment can be found in a non-coding region of transcript(s) that are related to the following protein(s): F00120_P9.

Segment cluster F00120_node_66 (SEQ ID NO:331) according to the present invention is supported by 323 libraries. The number of libraries was determined as previously described. This segment can be found in the following transcript(s): F00120_T15 (SEQ ID NO:280). Table 321 below describes the starting and ending position of this segment on each transcript.

TABLE 321

| | Segment location on transcripts | |
|---|---|---|
| Transcript name | Segment starting position | Segment ending position |
| F00120_T15 (SEQ ID NO: 280) | 3591 | 3623 |

This segment can be found in a non-coding region of transcript(s) that are related to the following protein(s): F00120_P9.

Segment cluster F00120_node_67 (SEQ ID NO:332) according to the present invention can be found in the following transcript(s): F00120_T15 (SEQ ID NO:280). Table 322 below describes the starting and ending position of this segment on each transcript.

TABLE 322

| | Segment location on transcripts | |
|---|---|---|
| Transcript name | Segment starting position | Segment ending position |
| F00120_T15 (SEQ ID NO: 280) | 3624 | 3636 |

This segment can be found in a non-coding region of transcript(s) that are related to the following protein(s): F00120_P9.

Segment cluster F00120_node_68 (SEQ ID NO:333) according to the present invention is supported by 311 libraries. The number of libraries was determined as previously described. This segment can be found in the following transcript(s): F00120_T15 (SEQ ID NO:280). Table 323 below describes the starting and ending position of this segment on each transcript.

TABLE 323

| | Segment location on transcripts | |
|---|---|---|
| Transcript name | Segment starting position | Segment ending position |
| F00120_T15 (SEQ ID NO: 280) | 3637 | 3672 |

This segment can be found in a non-coding region of transcript(s) that are related to the following protein(s): F00120_P9.

Segment cluster F00120_node_69 (SEQ ID NO:334) according to the present invention can be found in the following transcript(s): F00120_T15 (SEQ ID NO:280). Table 324 below describes the starting and ending position of this segment on each transcript.

TABLE 324

| | Segment location on transcripts | |
|---|---|---|
| Transcript name | Segment starting position | Segment ending position |
| F00120_T15 (SEQ ID NO: 280) | 3673 | 3676 |

This segment can be found in a non-coding region of transcript(s) that are related to the following protein(s): F00120_P9.

Segment cluster F00120_node_70 (SEQ ID NO:335) according to the present invention can be found in the following transcript(s): F00120_T15 (SEQ ID NO:280). Table 325 below describes the starting and ending position of this segment on each transcript.

TABLE 325

| | Segment location on transcripts | |
|---|---|---|
| Transcript name | Segment starting position | Segment ending position |
| F00120_T15 (SEQ ID NO: 280) | 3677 | 3699 |

This segment can be found in a non-coding region of transcript(s) that are related to the following protein(s): F00120_P9.

Segment cluster F00120_node_71 (SEQ ID NO:336) according to the present invention can be found in the following transcript(s): F00120_T15 (SEQ ID NO:280). Table 326 below describes the starting and ending position of this segment on each transcript.

TABLE 326

| | Segment location on transcripts | |
|---|---|---|
| Transcript name | Segment starting position | Segment ending position |
| F00120_T15 (SEQ ID NO: 280) | 3700 | 3715 |

This segment can be found in a non-coding region of transcript(s) that are related to the following protein(s): F00120_P9.

Segment cluster F00120_node_72 (SEQ ID NO:337) according to the present invention can be found in the following transcript(s): F00120_T15 (SEQ ID NO:280). Table 327 below describes the starting and ending position of this segment on each transcript.

TABLE 327

| | Segment location on transcripts | |
|---|---|---|
| Transcript name | Segment starting position | Segment ending position |
| F00120_T15 (SEQ ID NO: 280) | 3716 | 3737 |

This segment can be found in a non-coding region of transcript(s) that are related to the following protein(s): F00120_P9.

Segment cluster F00120_node_73 (SEQ ID NO:338) according to the present invention is supported by 333 libraries. The number of libraries was determined as previously described. This segment can be found in the following transcript(s): F00120_T15 (SEQ ID NO:280). Table 328 below describes the starting and ending position of this segment on each transcript.

TABLE 328

Segment location on transcripts

| Transcript name | Segment starting position | Segment ending position |
|---|---|---|
| F00120_T15 (SEQ ID NO: 280) | 3738 | 3784 |

This segment can be found in a non-coding region of transcript(s) that are related to the following protein(s): F00120_P9.

Segment cluster F00120_node_74 (SEQ ID NO:339) according to the present invention is supported by 324 libraries. The number of libraries was determined as previously described. This segment can be found in the following transcript(s): F00120_T15 (SEQ ID NO:280). Table 329 below describes the starting and ending position of this segment on each transcript.

TABLE 329

Segment location on transcripts

| Transcript name | Segment starting position | Segment ending position |
|---|---|---|
| F00120_T15 (SEQ ID NO: 280) | 3785 | 3827 |

This segment can be found in a non-coding region of transcript(s) that are related to the following protein(s): F00120_P9.

Segment cluster F00120_node_75 (SEQ ID NO:340) according to the present invention is supported by 321 libraries. The number of libraries was determined as previously described. This segment can be found in the following transcript(s): F00120_T15 (SEQ ID NO:280). Table 330 below describes the starting and ending position of this segment on each transcript.

TABLE 330

Segment location on transcripts

| Transcript name | Segment starting position | Segment ending position |
|---|---|---|
| F00120_T15 (SEQ ID NO: 280) | 3828 | 3858 |

This segment can be found in a non-coding region of transcript(s) that are related to the following protein(s): F00120_P9.

Segment cluster F00120_node_76 (SEQ ID NO:341) according to the present invention is supported by 327 libraries. The number of libraries was determined as previously described. This segment can be found in the following transcript(s): F00120_T15 (SEQ ID NO:280). Table 331 below describes the starting and ending position of this segment on each transcript.

TABLE 331

Segment location on transcripts

| Transcript name | Segment starting position | Segment ending position |
|---|---|---|
| F00120_T15 (SEQ ID NO: 280) | 3859 | 3954 |

This segment can be found in a non-coding region of transcript(s) that are related to the following protein(s): F00120_P9.

Segment cluster F00120_node_77 (SEQ ID NO:342) according to the present invention can be found in the following transcript(s): F00120_T15 (SEQ ID NO:280). Table 332 below describes the starting and ending position of this segment on each transcript.

TABLE 332

Segment location on transcripts

| Transcript name | Segment starting position | Segment ending position |
|---|---|---|
| F00120_T15 (SEQ ID NO: 280) | 3955 | 3958 |

This segment can be found in a non-coding region of transcript(s) that are related to the following protein(s): F00120_P9.

Segment cluster F00120_node_78 (SEQ ID NO:343) according to the present invention can be found in the following transcript(s): F00120_T15 (SEQ ID NO:280). Table 333 below describes the starting and ending position of this segment on each transcript.

TABLE 333

Segment location on transcripts

| Transcript name | Segment starting position | Segment ending position |
|---|---|---|
| F00120_T15 (SEQ ID NO: 280) | 3959 | 3966 |

This segment can be found in a non-coding region of transcript(s) that are related to the following protein(s): F00120_P9.

Segment cluster F00120_node_79 (SEQ ID NO:344) according to the present invention can be found in the following transcript(s): F00120_T15 (SEQ ID NO:280). Table 334 below describes the starting and ending position of this segment on each transcript.

TABLE 334

Segment location on transcripts

| Transcript name | Segment starting position | Segment ending position |
|---|---|---|
| F00120_T15 (SEQ ID NO: 280) | 3967 | 3972 |

This segment can be found in a non-coding region of transcript(s) that are related to the following protein(s): F00120_P9.

Segment cluster F00120_node_80 (SEQ ID NO:345) according to the present invention is supported by 292 libraries. The number of libraries was determined as previously described. This segment can be found in the following transcript(s): F00120_T15 (SEQ ID NO:280). Table 335 below describes the starting and ending position of this segment on each transcript.

TABLE 335

Segment location on transcripts

| Transcript name | Segment starting position | Segment ending position |
|---|---|---|
| F00120_T15 (SEQ ID NO: 280) | 3973 | 4029 |

This segment can be found in a non-coding region of transcript(s) that are related to the following protein(s): F00120_P9.

Segment cluster F00120_node_81 (SEQ ID NO:346) according to the present invention can be found in the following transcript(s): F00120_T15 (SEQ ID NO:280). Table 336 below describes the starting and ending position of this segment on each transcript.

TABLE 336

Segment location on transcripts

| Transcript name | Segment starting position | Segment ending position |
|---|---|---|
| F00120_T15 (SEQ ID NO: 280) | 4030 | 4036 |

This segment can be found in a non-coding region of transcript(s) that are related to the following protein(s): F00120_P9.

Segment cluster F00120_node_82 (SEQ ID NO:347) according to the present invention can be found in the following transcript(s): F00120_T15 (SEQ ID NO:280). Table 337 below describes the starting and ending position of this segment on each transcript.

TABLE 337

Segment location on transcripts

| Transcript name | Segment starting position | Segment ending position |
|---|---|---|
| F00120_T15 (SEQ ID NO: 280) | 4037 | 4052 |

This segment can be found in a non-coding region of transcript(s) that are related to the following protein(s): F00120_P9.

Segment cluster F00120_node_83 (SEQ ID NO:348) according to the present invention can be found in the following transcript(s): F00120_T15 (SEQ ID NO:280). Table 338 below describes the starting and ending position of this segment on each transcript.

TABLE 338

Segment location on transcripts

| Transcript name | Segment starting position | Segment ending position |
|---|---|---|
| F00120_T15 (SEQ ID NO: 280) | 4053 | 4062 |

This segment can be found in a non-coding region of transcript(s) that are related to the following protein(s): F00120_P9.

Segment cluster F00120_node_84 (SEQ ID NO:349) according to the present invention can be found in the following transcript(s): F00120_T15 (SEQ ID NO:280). Table 339 below describes the starting and ending position of this segment on each transcript.

TABLE 339

Segment location on transcripts

| Transcript name | Segment starting position | Segment ending position |
|---|---|---|
| F00120_T15 (SEQ ID NO: 280) | 4063 | 4076 |

This segment can be found in a non-coding region of transcript(s) that are related to the following protein(s): F00120_P9.

Segment cluster F00120_node_86 (SEQ ID NO:350) according to the present invention can be found in the following transcript(s): F00120_T15 (SEQ ID NO:280). Table 340 below describes the starting and ending position of this segment on each transcript.

TABLE 340

Segment location on transcripts

| Transcript name | Segment starting position | Segment ending position |
|---|---|---|
| F00120_T15 (SEQ ID NO: 280) | 4077 | 4090 |

This segment can be found in a non-coding region of transcript(s) that are related to the following protein(s): F00120_P9.

Segment cluster F00120_node_87 (SEQ ID NO:351) according to the present invention can be found in the following transcript(s): F00120_T15 (SEQ ID NO:280). Table 341 below describes the starting and ending position of this segment on each transcript.

TABLE 341

Segment location on transcripts

| Transcript name | Segment starting position | Segment ending position |
|---|---|---|
| F00120_T15 (SEQ ID NO: 280) | 4091 | 4094 |

This segment can be found in a non-coding region of transcript(s) that are related to the following protein(s): F00120_P9.

Segment cluster F00120_node_88 (SEQ ID NO:352) according to the present invention can be found in the following transcript(s): F00120_T15 (SEQ ID NO:280). Table 342 below describes the starting and ending position of this segment on each transcript.

TABLE 342

Segment location on transcripts

| Transcript name | Segment starting position | Segment ending position |
|---|---|---|
| F00120_T15 (SEQ ID NO: 280) | 4095 | 4116 |

This segment can be found in a non-coding region of transcript(s) that are related to the following protein(s): F00120_P9.

Segment cluster F00120_node_89 (SEQ ID NO:353) according to the present invention is supported by 192 libraries. The number of libraries was determined as previously described. This segment can be found in the following transcript(s): F00120_T15 (SEQ ID NO:280). Table 343 below describes the starting and ending position of this segment on each transcript.

TABLE 343

Segment location on transcripts

| Transcript name | Segment starting position | Segment ending position |
|---|---|---|
| F00120_T15 (SEQ ID NO: 280) | 4117 | 4182 |

This segment can be found in a non-coding region of transcript(s) that are related to the following protein(s): F00120_P9.

Description for Cluster F10611

Cluster F10611 features 30 transcript(s) and 76 segment(s) of interest, the names for which are given in Tables 344 and 345, respectively, the sequences themselves are given at the end of the application. The selected protein variants are given in Table 346.

TABLE 344

Transcripts of interest
Transcript Name

F10611_T0 (SEQ ID NO: 354)
F10611_T1 (SEQ ID NO: 355)
F10611_T2 (SEQ ID NO: 356)
F10611_T3 (SEQ ID NO: 357)
F10611_T4 (SEQ ID NO: 358)
F10611_T5 (SEQ ID NO: 359)
F10611_T6 (SEQ ID NO: 360)
F10611_T7 (SEQ ID NO: 361)
F10611_T8 (SEQ ID NO: 362)
F10611_T9 (SEQ ID NO: 363)
F10611_T10 (SEQ ID NO: 364)
F10611_T11 (SEQ ID NO: 365)
F10611_T12 (SEQ ID NO: 366)
F10611_T13 (SEQ ID NO: 367)
F10611_T14 (SEQ ID NO: 368)
F10611_T15 (SEQ ID NO: 369)
F10611_T16 (SEQ ID NO: 370)
F10611_T17 (SEQ ID NO: 371)
F10611_T19 (SEQ ID NO: 372)
F10611_T20 (SEQ ID NO: 373)
F10611_T21 (SEQ ID NO: 374)
F10611_T22 (SEQ ID NO: 375)
F10611_T23 (SEQ ID NO: 376)
F10611_T24 (SEQ ID NO: 377)
F10611_T25 (SEQ ID NO: 378)
F10611_T26 (SEQ ID NO: 379)
F10611_T27 (SEQ ID NO: 380)
F10611_T28 (SEQ ID NO: 381)
F10611_T31 (SEQ ID NO: 382)
F10611_T32 (SEQ ID NO: 383)

TABLE 345

Segments of interest
Segment Name

F10611_node_4 (SEQ ID NO: 384)
F10611_node_6 (SEQ ID NO: 385)

TABLE 345-continued

Segments of interest
Segment Name

F10611_node_11 (SEQ ID NO: 386)
F10611_node_16 (SEQ ID NO: 387)
F10611_node_18 (SEQ ID NO: 388)
F10611_node_19 (SEQ ID NO: 389)
F10611_node_22 (SEQ ID NO: 390)
F10611_node_25 (SEQ ID NO: 391)
F10611_node_26 (SEQ ID NO: 392)
F10611_node_29 (SEQ ID NO: 393)
F10611_node_30 (SEQ ID NO: 394)
F10611_node_31 (SEQ ID NO: 395)
F10611_node_34 (SEQ ID NO: 396)
F10611_node_38 (SEQ ID NO: 397)
F10611_node_44 (SEQ ID NO: 398)
F10611_node_46 (SEQ ID NO: 399)
F10611_node_56 (SEQ ID NO: 400)
F10611_node_59 (SEQ ID NO: 401)
F10611_node_63 (SEQ ID NO: 402)
F10611_node_66 (SEQ ID NO: 403)
F10611_node_68 (SEQ ID NO: 404)
F10611_node_70 (SEQ ID NO: 405)
F10611_node_73 (SEQ ID NO: 406)
F10611_node_81 (SEQ ID NO: 407)
F10611_node_83 (SEQ ID NO: 408)
F10611_node_85 (SEQ ID NO: 409)
F10611_node_93 (SEQ ID NO: 410)
F10611_node_94 (SEQ ID NO: 411)
F10611_node_95 (SEQ ID NO: 412)
F10611_node_99 (SEQ ID NO: 413)
F10611_node_102 (SEQ ID NO: 414)
F10611_node_104 (SEQ ID NO: 415)
F10611_node_105 (SEQ ID NO: 416)
F10611_node_111 (SEQ ID NO: 417)
F10611_node_119 (SEQ ID NO: 418)
F10611_node_122 (SEQ ID NO: 419)
F10611_node_125 (SEQ ID NO: 420)
F10611_node_126 (SEQ ID NO: 421)
F10611_node_127 (SEQ ID NO: 422)
F10611_node_0 (SEQ ID NO: 423)
F10611_node_2 (SEQ ID NO: 424)
F10611_node_7 (SEQ ID NO: 425)
F10611_node_9 (SEQ ID NO: 426)
F10611_node_13 (SEQ ID NO: 427)
F10611_node_15 (SEQ ID NO: 428)
F10611_node_20 (SEQ ID NO: 429)
F10611_node_23 (SEQ ID NO: 430)
F10611_node_28 (SEQ ID NO: 431)
F10611_node_32 (SEQ ID NO: 432)
F10611_node_33 (SEQ ID NO: 433)
F10611_node_36 (SEQ ID NO: 434)
F10611_node_40 (SEQ ID NO: 435)
F10611_node_42 (SEQ ID NO: 436)
F10611_node_50 (SEQ ID NO: 437)
F10611_node_52 (SEQ ID NO: 438)
F10611_node_54 (SEQ ID NO: 439)
F10611_node_57 (SEQ ID NO: 440)
F10611_node_61 (SEQ ID NO: 441)
F10611_node_64 (SEQ ID NO: 442)
F10611_node_71 (SEQ ID NO: 443)
F10611_node_75 (SEQ ID NO: 444)
F10611_node_77 (SEQ ID NO: 445)
F10611_node_78 (SEQ ID NO: 446)
F10611_node_79 (SEQ ID NO: 447)
F10611_node_87 (SEQ ID NO: 448)
F10611_node_89 (SEQ ID NO: 449)
F10611_node_91 (SEQ ID NO: 450)
F10611_node_98 (SEQ ID NO: 451)
F10611_node_100 (SEQ ID NO: 452)
F10611_node_107 (SEQ ID NO: 453)
F10611_node_109 (SEQ ID NO: 454)
F10611_node_113 (SEQ ID NO: 455)
F10611_node_114 (SEQ ID NO: 456)
F10611_node_116 (SEQ ID NO: 457)
F10611_node_117 (SEQ ID NO: 458)
F10611_node_121 (SEQ ID NO: 459)

TABLE 346

Proteins of interest

| Protein Name | Corresponding Transcript(s) |
|---|---|
| F10611_P2 | F10611_T1 (SEQ ID NO: 355) |
| F10611_P3 | F10611_T2 (SEQ ID NO: 356); F10611_T19 (SEQ ID NO: 372) |
| F10611_P4 | F10611_T3 (SEQ ID NO: 357) |
| F10611_P5 | F10611_T4 (SEQ ID NO: 358) |
| F10611_P6 | F10611_T5 (SEQ ID NO: 359) |
| F10611_P7 | F10611_T6 (SEQ ID NO: 360) |
| F10611_P8 | F10611_T7 (SEQ ID NO: 361) |
| F10611_P9 | F10611_T8 (SEQ ID NO: 362) |
| F10611_P10 | F10611_T9 (SEQ ID NO: 363); F10611_T22 (SEQ ID NO: 375) |
| F10611_P11 | F10611_T10 (SEQ ID NO: 364) |
| F10611_P12 | F10611_T11 (SEQ ID NO: 365) |
| F10611_P13 | F10611_T12 (SEQ ID NO: 366) |
| F10611_P14 | F10611_T13 (SEQ ID NO: 367) |
| F10611_P15 | F10611_T14 (SEQ ID NO: 368) |
| F10611_P16 | F10611_T15 (SEQ ID NO: 369) |
| F10611_P17 | F10611_T16 (SEQ ID NO: 370) |
| F10611_P18 | F10611_T17 (SEQ ID NO: 371) |
| F10611_P19 | F10611_T20 (SEQ ID NO: 373) |
| F10611_P20 | F10611_T21 (SEQ ID NO: 374); F10611_T23 (SEQ ID NO: 376) |
| F10611_P21 | F10611_T24 (SEQ ID NO: 377) |
| F10611_P22 | F10611_T25 (SEQ ID NO: 378) |
| F10611_P23 | F10611_T26 (SEQ ID NO: 379) |
| F10611_P24 | F10611_T27 (SEQ ID NO: 380) |
| F10611_P25 | F10611_T28 (SEQ ID NO: 381) |
| F10611_P27 | F10611_T31 (SEQ ID NO: 382) |
| F10611_P29 | F10611_T0 (SEQ ID NO: 354) |

Cluster F10611 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 14 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 14 and Table 347. This cluster is overexpressed (at least at a minimum level) in the following pathological conditions: epithelial malignant tumors and a mixture of malignant tumors from different tissues.

TABLE 347

Normal tissue distribution

| Name of Tissue | Number |
|---|---|
| adrenal | 80 |
| bladder | 0 |
| Bone | 6 |
| Brain | 159 |
| Colon | 0 |
| epithelial | 8 |
| general | 37 |
| head and neck | 0 |
| kidney | 11 |
| Liver | 0 |
| Lung | 10 |
| Breast | 17 |
| bone marrow | 0 |
| Ovary | 0 |
| pancreas | 0 |
| prostate | 0 |
| Skin | 16 |
| stomach | 0 |
| Uterus | 0 |

TABLE 348

P values and ratios for expression in cancerous tissue

| Name of Tissue | P1 | P2 | SP1 | R3 | SP2 | R4 |
|---|---|---|---|---|---|---|
| adrenal | 7.4e−01 | 7.8e−01 | 8.4e−01 | 0.7 | 9.0e−01 | 0.6 |
| bladder | 3.1e−01 | 3.8e−01 | 5.6e−01 | 1.8 | 6.8e−01 | 1.5 |
| Bone | 5.5e−01 | 1.4e−01 | 1 | 1.1 | 2.4e−01 | 2.3 |
| Brain | 7.6e−01 | 7.8e−01 | 1 | 0.4 | 1 | 0.3 |
| Colon | 8.2e−02 | 4.4e−02 | 7.0e−01 | 1.7 | 5.9e−01 | 1.9 |
| epithelial | 1.5e−04 | 3.5e−05 | 1.7e−02 | 2.8 | 2.1e−03 | 2.9 |
| general | 9.0e−04 | 6.9e−05 | 9.6e−01 | 0.7 | 9.6e−01 | 0.7 |
| head and neck | 1.2e−01 | 2.1e−01 | 0.0e+00 | 0.0 | 0.0e+00 | 0.0 |
| kidney | 4.3e−01 | 3.6e−01 | 2.0e−01 | 2.2 | 1.7e−01 | 2.2 |
| Liver | 1.8e−01 | 4.5e−01 | 1 | 1.3 | 4.8e−01 | 1.9 |
| Lung | 3.0e−01 | 1.3e−01 | 3.7e−01 | 2.1 | 1.3e−01 | 2.7 |
| breast | 8.2e−01 | 8.1e−01 | 1 | 0.7 | 8.2e−01 | 0.9 |
| bone marrow | 1 | 6.7e−01 | 1 | 1.0 | 5.3e−01 | 1.9 |
| Ovary | 2.6e−01 | 3.0e−01 | 6.8e−01 | 1.7 | 7.7e−01 | 1.4 |
| pancreas | 1 | 4.4e−01 | 1 | 1.0 | 5.3e−01 | 1.9 |
| prostate | 5.3e−01 | 4.6e−01 | 3.0e−01 | 2.5 | 3.2e−01 | 2.3 |
| Skin | 1.9e−01 | 1.9e−01 | 5.5e−02 | 5.9 | 1.1e−01 | 1.7 |
| stomach | 1 | 6.7e−01 | 1 | 1.0 | 8.0e−01 | 1.3 |
| uterus | 1.2e−01 | 6.3e−02 | 6.6e−01 | 1.8 | 5.1e−01 | 1.9 |

As noted above, cluster F10611 features 76 segment(s), which were listed in Table 345 above and for which the sequence(s) are given at the end of the application. These segment(s) are portions of nucleic acid sequence(s) which are described herein separately because they are of particular interest. A description of each segment according to the present invention is now provided.

Segment cluster F10611_node_4 (SEQ ID NO:384) according to the present invention is supported by 25 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T24 (SEQ ID NO:377) and F10611_T27 (SEQ ID NO:380). Table 349 below describes the starting and ending position of this segment on each transcript.

TABLE 349

Segment location on transcripts

| Transcript name | Segment starting position | Segment ending position |
|---|---|---|
| F10611_T0 (SEQ ID NO: 354) | 168 | 309 |
| F10611_T1 (SEQ ID NO: 355) | 168 | 309 |
| F10611_T2 (SEQ ID NO: 356) | 168 | 309 |

TABLE 349-continued

Segment location on transcripts

| Transcript name | Segment starting position | Segment ending position |
|---|---|---|
| F10611_T3 (SEQ ID NO: 357) | 168 | 309 |
| F10611_T4 (SEQ ID NO: 358) | 168 | 309 |
| F10611_T5 (SEQ ID NO: 359) | 168 | 309 |
| F10611_T6 (SEQ ID NO: 360) | 168 | 309 |
| F10611_T7 (SEQ ID NO: 361) | 168 | 309 |
| F10611_T8 (SEQ ID NO: 362) | 168 | 309 |
| F10611_T9 (SEQ ID NO: 363) | 168 | 309 |
| F10611_T10 (SEQ ID NO: 364) | 168 | 309 |
| F10611_T11 (SEQ ID NO: 365) | 168 | 309 |
| F10611_T12 (SEQ ID NO: 366) | 168 | 309 |
| F10611_T13 (SEQ ID NO: 367) | 168 | 309 |
| F10611_T14 (SEQ ID NO: 368) | 168 | 309 |
| F10611_T15 (SEQ ID NO: 369) | 168 | 309 |
| F10611_T16 (SEQ ID NO: 370) | 168 | 309 |
| F10611_T17 (SEQ ID NO: 371) | 168 | 309 |
| F10611_T19 (SEQ ID NO: 372) | 168 | 309 |
| F10611_T20 (SEQ ID NO: 373) | 168 | 309 |
| F10611_T24 (SEQ ID NO: 377) | 168 | 309 |
| F10611_T27 (SEQ ID NO: 380) | 168 | 309 |

This segment can be found in both coding and non-coding regions of transcript(s) as follows. The segment can be found in a non-coding region of transcript(s) that are related to the following protein(s): F10611_P10 and F10611_P24. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18, F10611_P19 and F10611_P21, since it is in the coding region for the corresponding transcript.

Segment cluster F10611_node_6 (SEQ ID NO:385) according to the present invention is supported by 26 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T24 (SEQ ID NO:377) and F10611_T27 (SEQ ID NO:380). Table 350 below describes the starting and ending position of this segment on each transcript.

TABLE 350

Segment location on transcripts

| Transcript name | Segment starting position | Segment ending position |
|---|---|---|
| F10611_T0 (SEQ ID NO: 354) | 310 | 457 |
| F10611_T1 (SEQ ID NO: 355) | 310 | 457 |
| F10611_T2 (SEQ ID NO: 356) | 310 | 457 |
| F10611_T3 (SEQ ID NO: 357) | 310 | 457 |
| F10611_T4 (SEQ ID NO: 358) | 310 | 457 |
| F10611_T5 (SEQ ID NO: 359) | 310 | 457 |
| F10611_T6 (SEQ ID NO: 360) | 310 | 457 |
| F10611_T7 (SEQ ID NO: 361) | 310 | 457 |
| F10611_T8 (SEQ ID NO: 362) | 310 | 457 |
| F10611_T9 (SEQ ID NO: 363) | 310 | 457 |
| F10611_T10 (SEQ ID NO: 364) | 310 | 457 |
| F10611_T11 (SEQ ID NO: 365) | 310 | 457 |
| F10611_T12 (SEQ ID NO: 366) | 310 | 457 |
| F10611_T13 (SEQ ID NO: 367) | 310 | 457 |
| F10611_T14 (SEQ ID NO: 368) | 310 | 457 |
| F10611_T15 (SEQ ID NO: 369) | 310 | 457 |
| F10611_T16 (SEQ ID NO: 370) | 310 | 457 |
| F10611_T17 (SEQ ID NO: 371) | 310 | 457 |
| F10611_T19 (SEQ ID NO: 372) | 310 | 457 |
| F10611_T20 (SEQ ID NO: 373) | 310 | 457 |
| F10611_T24 (SEQ ID NO: 377) | 310 | 457 |
| F10611_T27 (SEQ ID NO: 380) | 310 | 457 |

This segment can be found in both coding and non-coding regions of transcript(s) as follows. The segment can be found in a non-coding region of transcript(s) that are related to the following protein(s): F10611_P10 and F10611_P24. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18, F10611_P19 and F10611_P21, since it is in the coding region for the corresponding transcript.

Segment cluster F10611_node_11 (SEQ ID NO:386) according to the present invention is supported by 28 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372) and F10611_T20 (SEQ ID NO:373). Table 351 below describes the starting and ending position of this segment on each transcript.

TABLE 351

Segment location on transcripts

| Transcript name | Segment starting position | Segment ending position |
|---|---|---|
| F10611_T0 (SEQ ID NO: 354) | 588 | 730 |
| F10611_T1 (SEQ ID NO: 355) | 588 | 730 |
| F10611_T2 (SEQ ID NO: 356) | 588 | 730 |
| F10611_T3 (SEQ ID NO: 357) | 588 | 730 |
| F10611_T4 (SEQ ID NO: 358) | 588 | 730 |
| F10611_T5 (SEQ ID NO: 359) | 588 | 730 |
| F10611_T6 (SEQ ID NO: 360) | 588 | 730 |
| F10611_T7 (SEQ ID NO: 361) | 588 | 730 |
| F10611_T8 (SEQ ID NO: 362) | 588 | 730 |
| F10611_T9 (SEQ ID NO: 363) | 588 | 730 |
| F10611_T10 (SEQ ID NO: 364) | 588 | 730 |
| F10611_T11 (SEQ ID NO: 365) | 588 | 730 |

TABLE 351-continued

Segment location on transcripts

| Transcript name | Segment starting position | Segment ending position |
|---|---|---|
| F10611_T12 (SEQ ID NO: 366) | 588 | 730 |
| F10611_T13 (SEQ ID NO: 367) | 588 | 730 |
| F10611_T14 (SEQ ID NO: 368) | 588 | 730 |
| F10611_T15 (SEQ ID NO: 369) | 588 | 730 |
| F10611_T16 (SEQ ID NO: 370) | 588 | 730 |
| F10611_T17 (SEQ ID NO: 371) | 588 | 730 |
| F10611_T19 (SEQ ID NO: 372) | 588 | 730 |
| F10611_T20 (SEQ ID NO: 373) | 588 | 730 |

This segment can be found in both coding and non-coding regions of transcript(s) as follows. The segment can be found in a non-coding region of transcript(s) that are related to the following protein(s): F10611_P10. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18 and F10611_P19, since it is in the coding region for the corresponding transcript.

Segment cluster F10611_node_16 (SEQ ID NO:387) according to the present invention is supported by 39 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372) and F10611_T20 (SEQ ID NO:373). Table 352 below describes the starting and ending position of this segment on each transcript.

TABLE 352

Segment location on transcripts

| Transcript name | Segment starting position | Segment ending position |
|---|---|---|
| F10611_T0 (SEQ ID NO: 354) | 825 | 1028 |
| F10611_T1 (SEQ ID NO: 355) | 825 | 1028 |
| F10611_T2 (SEQ ID NO: 356) | 825 | 1028 |
| F10611_T3 (SEQ ID NO: 357) | 825 | 1028 |
| F10611_T4 (SEQ ID NO: 358) | 825 | 1028 |
| F10611_T5 (SEQ ID NO: 359) | 825 | 1028 |
| F10611_T6 (SEQ ID NO: 360) | 825 | 1028 |
| F10611_T7 (SEQ ID NO: 361) | 825 | 1028 |
| F10611_T8 (SEQ ID NO: 362) | 825 | 1028 |
| F10611_T9 (SEQ ID NO: 363) | 825 | 1028 |
| F10611_T10 (SEQ ID NO: 364) | 825 | 1028 |
| F10611_T11 (SEQ ID NO: 365) | 839 | 1042 |
| F10611_T12 (SEQ ID NO: 366) | 825 | 1028 |
| F10611_T13 (SEQ ID NO: 367) | 825 | 1028 |
| F10611_T14 (SEQ ID NO: 368) | 825 | 1028 |
| F10611_T15 (SEQ ID NO: 369) | 825 | 1028 |
| F10611_T16 (SEQ ID NO: 370) | 825 | 1028 |
| F10611_T17 (SEQ ID NO: 371) | 825 | 1028 |

TABLE 352-continued

Segment location on transcripts

| Transcript name | Segment starting position | Segment ending position |
|---|---|---|
| F10611_T19 (SEQ ID NO: 372) | 825 | 1028 |
| F10611_T20 (SEQ ID NO: 373) | 825 | 1028 |

This segment can be found in both coding and non-coding regions of transcript(s) as follows. The segment can be found in a non-coding region of transcript(s) that are related to the following protein(s): F10611_P10 and F10611_P12. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P13, F10611_P14, F10611_P15, F10611_P16, F10611_P17, F10611_P18 and F10611_P19, since it is in the coding region for the corresponding transcript.

Segment cluster F10611_node_18 (SEQ ID NO:388) according to the present invention is supported by 35 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372) and F10611_T20 (SEQ ID NO:373). Table 353 below describes the starting and ending position of this segment on each transcript.

TABLE 353

Segment location on transcripts

| Transcript name | Segment starting position | Segment ending position |
|---|---|---|
| F10611_T0 (SEQ ID NO: 354) | 1029 | 1182 |
| F10611_T1 (SEQ ID NO: 355) | 1029 | 1182 |
| F10611_T2 (SEQ ID NO: 356) | 1029 | 1182 |
| F10611_T3 (SEQ ID NO: 357) | 1029 | 1182 |
| F10611_T4 (SEQ ID NO: 358) | 1029 | 1182 |
| F10611_T5 (SEQ ID NO: 359) | 1029 | 1182 |
| F10611_T6 (SEQ ID NO: 360) | 1029 | 1182 |
| F10611_T7 (SEQ ID NO: 361) | 1029 | 1182 |
| F10611_T8 (SEQ ID NO: 362) | 1029 | 1182 |
| F10611_T9 (SEQ ID NO: 363) | 1029 | 1182 |
| F10611_T10 (SEQ ID NO: 364) | 1029 | 1182 |
| F10611_T11 (SEQ ID NO: 365) | 1043 | 1196 |
| F10611_T12 (SEQ ID NO: 366) | 1029 | 1182 |
| F10611_T13 (SEQ ID NO: 367) | 1029 | 1182 |
| F10611_T14 (SEQ ID NO: 368) | 1029 | 1182 |
| F10611_T15 (SEQ ID NO: 369) | 1029 | 1182 |
| F10611_T16 (SEQ ID NO: 370) | 1029 | 1182 |
| F10611_T17 (SEQ ID NO: 371) | 1029 | 1182 |
| F10611_T19 (SEQ ID NO: 372) | 1029 | 1182 |
| F10611_T20 (SEQ ID NO: 373) | 1029 | 1182 |

This segment can be found in both coding and non-coding regions of transcript(s) as follows. The segment can be found in a non-coding region of transcript(s) that are related to the following protein(s): F10611_P10 and F10611_P12. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P13, F10611_P14, F10611_P15, F10611_P16, F10611_P17, F10611_P18 and F10611_P19, since it is in the coding region for the corresponding transcript.

Segment cluster F10611_node_19 (SEQ ID NO:389) according to the present invention is supported by 2 libraries. The number of libraries was determined as previously described. This segment can be found in the following transcript(s): F10611_T10 (SEQ ID NO:364). Table 354 below describes the starting and ending position of this segment on each transcript.

TABLE 354

Segment location on transcripts

| Transcript name | Segment starting position | Segment ending position |
|---|---|---|
| F10611_T10 (SEQ ID NO: 364) | 1183 | 1807 |

This segment can be found in the following protein(s): F10611_P11.

Segment cluster F10611_node_22 (SEQ ID NO:390) according to the present invention is supported by 7 libraries. The number of libraries was determined as previously described. This segment can be found in the following transcript(s): F10611_T22 (SEQ ID NO:375) and F10611_T23 (SEQ ID NO:376). Table 355 below describes the starting and ending position of this segment on each transcript.

TABLE 355

Segment location on transcripts

| Transcript name | Segment starting position | Segment ending position |
|---|---|---|
| F10611_T22 (SEQ ID NO: 375) | 1 | 273 |
| F10611_T23 (SEQ ID NO: 376) | 1 | 273 |

This segment can be found in a non-coding region of transcript(s) that are related to the following protein(s): F10611_P10 and F10611_P20.

Segment cluster F10611_node_25 (SEQ ID NO:391) according to the present invention is supported by 4 libraries. The number of libraries was determined as previously described. This segment can be found in the following transcript(s): F10611_T21 (SEQ ID NO:374) and F10611_T31 (SEQ ID NO:382). Table 356 below describes the starting and ending position of this segment on each transcript.

TABLE 356

Segment location on transcripts

| Transcript name | Segment starting position | Segment ending position |
|---|---|---|
| F10611_T21 (SEQ ID NO: 374) | 1 | 506 |
| F10611_T31 (SEQ ID NO: 382) | 1 | 506 |

This segment can be found in a non-coding region of transcript(s) that are related to the following protein(s): F10611_P20 and F10611_P27.

Segment cluster F10611_node_26 (SEQ ID NO:392) according to the present invention is supported by 40 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T21 (SEQ ID NO:374), F10611_T22 (SEQ ID NO:375), F10611_T23 (SEQ ID NO:376) and F10611_T31 (SEQ ID NO:382). Table 357 below describes the starting and ending position of this segment on each transcript.

TABLE 357

Segment location on transcripts

| Transcript name | Segment starting position | Segment ending position |
|---|---|---|
| F10611_T0 (SEQ ID NO: 354) | 1183 | 1366 |
| F10611_T1 (SEQ ID NO: 355) | 1183 | 1366 |
| F10611_T2 (SEQ ID NO: 356) | 1183 | 1366 |
| F10611_T3 (SEQ ID NO: 357) | 1183 | 1366 |
| F10611_T4 (SEQ ID NO: 358) | 1183 | 1366 |
| F10611_T5 (SEQ ID NO: 359) | 1183 | 1366 |
| F10611_T6 (SEQ ID NO: 360) | 1183 | 1366 |
| F10611_T7 (SEQ ID NO: 361) | 1183 | 1366 |
| F10611_T8 (SEQ ID NO: 362) | 1295 | 1478 |
| F10611_T10 (SEQ ID NO: 364) | 1920 | 2103 |
| F10611_T11 (SEQ ID NO: 365) | 1197 | 1380 |
| F10611_T12 (SEQ ID NO: 366) | 1183 | 1366 |
| F10611_T13 (SEQ ID NO: 367) | 1183 | 1366 |
| F10611_T14 (SEQ ID NO: 368) | 1183 | 1366 |
| F10611_T15 (SEQ ID NO: 369) | 1183 | 1366 |
| F10611_T16 (SEQ ID NO: 370) | 1183 | 1366 |
| F10611_T17 (SEQ ID NO: 371) | 1183 | 1366 |
| F10611_T19 (SEQ ID NO: 372) | 1183 | 1366 |
| F10611_T20 (SEQ ID NO: 373) | 1183 | 1366 |
| F10611_T21 (SEQ ID NO: 374) | 507 | 690 |
| F10611_T22 (SEQ ID NO: 375) | 274 | 457 |
| F10611_T23 (SEQ ID NO: 376) | 340 | 523 |
| F10611_T31 (SEQ ID NO: 382) | 507 | 690 |

This segment can be found in both coding and non-coding regions of transcript(s) as follows. The segment can be found in a non-coding region of transcript(s) that are related to the following protein(s): F10611_P9, F10611_P11, F10611_P12, F10611_P20, F10611_P10 and F10611_P27. This segment can also be found in the following protein(s): F10611_P29, F10611_P2, F10611_P3, F10611_P4, F10611_P5, F10611_P6, F10611_P7, F10611_P8, F10611_P13, F10611_P14, F10611_P15, F10611_P16, F10611_P17, F10611_P18 and F10611_P19, since it is in the coding region for the corresponding transcript.

Segment cluster F10611_node_29 (SEQ ID NO:393) according to the present invention is supported by 11 libraries. The number of libraries was determined as previously described. This segment can be found in the following transcript(s): F10611_T2 (SEQ ID NO:356), F10611_T8 (SEQ ID NO:362), F10611_T10 (SEQ ID NO:364), F10611_T11 (SEQ ID NO:365), F10611_T19 (SEQ ID NO:372), F10611_T21 (SEQ ID NO:374) and F10611_T23 (SEQ ID NO:376). Table 358 below describes the starting and ending position of this segment on each transcript.

TABLE 358

Segment location on transcripts

| Transcript name | Segment starting position | Segment ending position |
|---|---|---|
| F10611_T2 (SEQ ID NO: 356) | 1473 | 2380 |
| F10611_T8 (SEQ ID NO: 362) | 1585 | 2492 |
| F10611_T10 (SEQ ID NO: 364) | 2210 | 3117 |
| F10611_T11 (SEQ ID NO: 365) | 1487 | 2394 |
| F10611_T19 (SEQ ID NO: 372) | 1473 | 2380 |
| F10611_T21 (SEQ ID NO: 374) | 797 | 1704 |
| F10611_T23 (SEQ ID NO: 376) | 630 | 1537 |

This segment can be found in both coding and non-coding regions of transcript(s) as follows. The segment can be found in a non-coding region of transcript(s) that are related to the following protein(s): F10611_P9, F10611_P11 and F10611_P12. This segment can also be found in the following protein(s): F10611_P3 and F10611_P20, since it is in the coding region for the corresponding transcript.

Segment cluster F10611_node_30 (SEQ ID NO:394) according to the present invention is supported by 17 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T21 (SEQ ID NO:374), F10611_T22 (SEQ ID NO:375), F10611_T23 (SEQ ID NO:376) and F10611_T31 (SEQ ID NO:382). Table 359 below describes the starting and ending position of this segment on each transcript.

TABLE 359

Segment location on transcripts

| Transcript name | Segment starting position | Segment ending position |
|---|---|---|
| F10611_T0 (SEQ ID NO: 354) | 1473 | 1616 |
| F10611_T1 (SEQ ID NO: 355) | 1473 | 1616 |
| F10611_T2 (SEQ ID NO: 356) | 2381 | 2524 |
| F10611_T3 (SEQ ID NO: 357) | 1473 | 1616 |
| F10611_T4 (SEQ ID NO: 358) | 1473 | 1616 |
| F10611_T5 (SEQ ID NO: 359) | 1473 | 1616 |
| F10611_T6 (SEQ ID NO: 360) | 1473 | 1616 |
| F10611_T7 (SEQ ID NO: 361) | 1473 | 1616 |
| F10611_T8 (SEQ ID NO: 362) | 2493 | 2636 |
| F10611_T9 (SEQ ID NO: 363) | 1289 | 1432 |
| F10611_T10 (SEQ ID NO: 364) | 3118 | 3261 |
| F10611_T11 (SEQ ID NO: 365) | 2395 | 2538 |
| F10611_T12 (SEQ ID NO: 366) | 1473 | 1616 |
| F10611_T13 (SEQ ID NO: 367) | 1473 | 1616 |
| F10611_T14 (SEQ ID NO: 368) | 1473 | 1616 |
| F10611_T15 (SEQ ID NO: 369) | 1473 | 1616 |
| F10611_T16 (SEQ ID NO: 370) | 1473 | 1616 |
| F10611_T17 (SEQ ID NO: 371) | 1473 | 1616 |
| F10611_T19 (SEQ ID NO: 372) | 2381 | 2524 |
| F10611_T20 (SEQ ID NO: 373) | 1473 | 1616 |
| F10611_T21 (SEQ ID NO: 374) | 1705 | 1848 |
| F10611_T22 (SEQ ID NO: 375) | 564 | 707 |
| F10611_T23 (SEQ ID NO: 376) | 1538 | 1681 |
| F10611_T31 (SEQ ID NO: 382) | 797 | 940 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 360.

TABLE 360

Oligonucleotides related to this segment

| Oligonucleotide name | Overexpressed in cancers | Chip reference |
|---|---|---|
| F10611_0_0_6660 | lung malignant tumors | LUN |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P8, F10611_P10, F10611_P13, F10611_P14, F10611_P15, F10611_P16, F10611_P17, F10611_P18, F10611_P19 and F10611_P27, since it is in the coding region for the corresponding transcript.

Segment cluster F10611_node_31 (SEQ ID NO:395) according to the present invention is supported by 6 libraries. The number of libraries was determined as previously described. This segment can be found in the following transcript(s): F10611_T2 (SEQ ID NO:356), F10611_T8 (SEQ ID NO:362), F10611_T10 (SEQ ID NO:364), F10611_T11 (SEQ ID NO:365), F10611_T21 (SEQ ID NO:374), F10611_T23 (SEQ ID NO:376) and F10611_T31 (SEQ ID NO:382). Table 361 below describes the starting and ending position of this segment on each transcript.

TABLE 361

Segment location on transcripts

| Transcript name | Segment starting position | Segment ending position |
|---|---|---|
| F10611_T2 (SEQ ID NO: 356) | 2525 | 3794 |
| F10611_T8 (SEQ ID NO: 362) | 2637 | 3906 |
| F10611_T10 (SEQ ID NO: 364) | 3262 | 4531 |
| F10611_T11 (SEQ ID NO: 365) | 2539 | 3808 |
| F10611_T21 (SEQ ID NO: 374) | 1849 | 3118 |
| F10611_T23 (SEQ ID NO: 376) | 1682 | 2951 |
| F10611_T31 (SEQ ID NO: 382) | 941 | 2210 |

This segment can be found in both coding and non-coding regions of transcript(s) as follows. The segment can be found in a non-coding region of transcript(s) that are related to the following protein(s): F10611_P3, F10611_P9, F10611_P1, F10611_P12 and F10611_P20. This segment can also be found in the following protein(s): F10611_P27, since it is in the coding region for the corresponding transcript.

Segment cluster F10611_node_34 (SEQ ID NO:396) according to the present invention is supported by 2 libraries. The number of libraries was determined as previously described. This segment can be found in the following transcript(s): F10611_T19 (SEQ ID NO:372), F10611_T20 (SEQ ID NO:373) and F10611_T31 (SEQ ID NO:382). Table 362 below describes the starting and ending position of this segment on each transcript.

TABLE 362

Segment location on transcripts

| Transcript name | Segment starting position | Segment ending position |
|---|---|---|
| F10611_T19 (SEQ ID NO: 372) | 2645 | 3020 |
| F10611_T20 (SEQ ID NO: 373) | 1737 | 2112 |
| F10611_T31 (SEQ ID NO: 382) | 2331 | 2706 |

This segment can be found in both coding and non-coding regions of transcript(s) as follows. The segment can be found in a non-coding region of transcript(s) that are related to the following protein(s): F10611_P3 and F10611_P27. This segment can also be found in the following protein(s): F10611_P19, since it is in the coding region for the corresponding transcript.

Segment cluster F10611_node_38 (SEQ ID NO:397) according to the present invention is supported by 14 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 363 below describes the starting and ending position of this segment on each transcript.

TABLE 363

Segment location on transcripts

| Transcript name | Segment starting position | Segment ending position |
|---|---|---|
| F10611_T0 (SEQ ID NO: 354) | 1737 | 1907 |
| F10611_T1 (SEQ ID NO: 355) | 1737 | 1907 |
| F10611_T2 (SEQ ID NO: 356) | 3971 | 4141 |
| F10611_T3 (SEQ ID NO: 357) | 1737 | 1907 |
| F10611_T4 (SEQ ID NO: 358) | 1737 | 1907 |
| F10611_T5 (SEQ ID NO: 359) | 1737 | 1907 |
| F10611_T6 (SEQ ID NO: 360) | 1737 | 1907 |
| F10611_T8 (SEQ ID NO: 362) | 4083 | 4253 |
| F10611_T9 (SEQ ID NO: 363) | 1553 | 1723 |
| F10611_T10 (SEQ ID NO: 364) | 4708 | 4878 |
| F10611_T11 (SEQ ID NO: 365) | 3985 | 4155 |
| F10611_T12 (SEQ ID NO: 366) | 1737 | 1907 |
| F10611_T13 (SEQ ID NO: 367) | 1737 | 1907 |
| F10611_T14 (SEQ ID NO: 368) | 1737 | 1907 |
| F10611_T15 (SEQ ID NO: 369) | 1737 | 1907 |
| F10611_T16 (SEQ ID NO: 370) | 1737 | 1907 |
| F10611_T17 (SEQ ID NO: 371) | 1737 | 1907 |
| F10611_T21 (SEQ ID NO: 374) | 3295 | 3465 |

TABLE 363-continued

Segment location on transcripts

| Transcript name | Segment starting position | Segment ending position |
|---|---|---|
| F10611_T22 (SEQ ID NO: 375) | 828 | 998 |
| F10611_T23 (SEQ ID NO: 376) | 3128 | 3298 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 364.

TABLE 364

Oligonucleotides related to this segment

| Oligonucleotide name | Overexpressed in cancers | Chip reference |
|---|---|---|
| F10611_0_0_6662 | lung malignant tumors | LUN |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_44 (SEQ ID NO:398) according to the present invention is supported by 12 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 365 below describes the starting and ending position of this segment on each transcript.

TABLE 365

Segment location on transcripts

| Transcript name | Segment starting position | Segment ending position |
|---|---|---|
| F10611_T0 (SEQ ID NO: 354) | 2013 | 2153 |
| F10611_T1 (SEQ ID NO: 355) | 2013 | 2153 |
| F10611_T2 (SEQ ID NO: 356) | 4247 | 4387 |
| F10611_T3 (SEQ ID NO: 357) | 2013 | 2153 |
| F10611_T4 (SEQ ID NO: 358) | 2013 | 2153 |
| F10611_T5 (SEQ ID NO: 359) | 2013 | 2153 |
| F10611_T6 (SEQ ID NO: 360) | 2013 | 2153 |
| F10611_T8 (SEQ ID NO: 362) | 4359 | 4499 |
| F10611_T9 (SEQ ID NO: 363) | 1829 | 1969 |

TABLE 365-continued

Segment location on transcripts

| Transcript name | Segment starting position | Segment ending position |
|---|---|---|
| F10611_T10 (SEQ ID NO: 364) | 4984 | 5124 |
| F10611_T11 (SEQ ID NO: 365) | 4261 | 4401 |
| F10611_T12 (SEQ ID NO: 366) | 2013 | 2153 |
| F10611_T13 (SEQ ID NO: 367) | 2013 | 2153 |
| F10611_T14 (SEQ ID NO: 368) | 2013 | 2153 |
| F10611_T15 (SEQ ID NO: 369) | 2013 | 2153 |
| F10611_T16 (SEQ ID NO: 370) | 2013 | 2153 |
| F10611_T17 (SEQ ID NO: 371) | 2013 | 2153 |
| F10611_T21 (SEQ ID NO: 374) | 3571 | 3711 |
| F10611_T22 (SEQ ID NO: 375) | 1104 | 1244 |
| F10611_T23 (SEQ ID NO: 376) | 3404 | 3544 |

This segment can be found in both coding and non-coding regions of transcript(s) as follows. The segment can be found in a non-coding region of transcript(s) that are related to the following protein(s): F10611_P3, F10611_P9, F10611_P1, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_46 (SEQ ID NO:399) according to the present invention is supported by 7 libraries. The number of libraries was determined as previously described. This segment can be found in the following transcript(s): F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 366 below describes the starting and ending position of this segment on each transcript.

TABLE 366

Segment location on transcripts

| Transcript name | Segment starting position | Segment ending position |
|---|---|---|
| F10611_T1 (SEQ ID NO: 355) | 2154 | 2279 |
| F10611_T2 (SEQ ID NO: 356) | 4388 | 4513 |
| F10611_T3 (SEQ ID NO: 357) | 2154 | 2279 |
| F10611_T4 (SEQ ID NO: 358) | 2154 | 2279 |
| F10611_T5 (SEQ ID NO: 359) | 2154 | 2279 |
| F10611_T6 (SEQ ID NO: 360) | 2154 | 2279 |
| F10611_T8 (SEQ ID NO: 362) | 4500 | 4625 |
| F10611_T9 (SEQ ID NO: 363) | 1970 | 2095 |
| F10611_T10 (SEQ ID NO: 364) | 5125 | 5250 |
| F10611_T11 (SEQ ID NO: 365) | 4402 | 4527 |
| F10611_T12 (SEQ ID NO: 366) | 2154 | 2279 |
| F10611_T13 (SEQ ID NO: 367) | 2154 | 2279 |
| F10611_T14 (SEQ ID NO: 368) | 2154 | 2279 |
| F10611_T15 (SEQ ID NO: 369) | 2154 | 2279 |
| F10611_T16 (SEQ ID NO: 370) | 2154 | 2279 |
| F10611_T17 (SEQ ID NO: 371) | 2154 | 2279 |
| F10611_T21 (SEQ ID NO: 374) | 3712 | 3837 |
| F10611_T22 (SEQ ID NO: 375) | 1245 | 1370 |
| F10611_T23 (SEQ ID NO: 376) | 3545 | 3670 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_56 (SEQ ID NO:400) according to the present invention is supported by 6 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 367 below describes the starting and ending position of this segment on each transcript.

TABLE 367

Segment location on transcripts

| Transcript name | Segment starting position | Segment ending position |
|---|---|---|
| F10611_T0 (SEQ ID NO: 354) | 2477 | 2607 |
| F10611_T1 (SEQ ID NO: 355) | 2603 | 2733 |
| F10611_T2 (SEQ ID NO: 356) | 4837 | 4967 |
| F10611_T3 (SEQ ID NO: 357) | 2603 | 2733 |
| F10611_T4 (SEQ ID NO: 358) | 2603 | 2733 |
| F10611_T5 (SEQ ID NO: 359) | 2603 | 2733 |
| F10611_T6 (SEQ ID NO: 360) | 2603 | 2733 |
| F10611_T8 (SEQ ID NO: 362) | 4949 | 5079 |
| F10611_T9 (SEQ ID NO: 363) | 2419 | 2549 |
| F10611_T10 (SEQ ID NO: 364) | 5574 | 5704 |
| F10611_T11 (SEQ ID NO: 365) | 4851 | 4981 |
| F10611_T12 (SEQ ID NO: 366) | 2603 | 2733 |
| F10611_T13 (SEQ ID NO: 367) | 2603 | 2733 |
| F10611_T14 (SEQ ID NO: 368) | 2603 | 2733 |
| F10611_T15 (SEQ ID NO: 369) | 2603 | 2733 |
| F10611_T16 (SEQ ID NO: 370) | 2603 | 2733 |
| F10611_T17 (SEQ ID NO: 371) | 2603 | 2733 |
| F10611_T21 (SEQ ID NO: 374) | 4161 | 4291 |
| F10611_T22 (SEQ ID NO: 375) | 1694 | 1824 |
| F10611_T23 (SEQ ID NO: 376) | 3994 | 4124 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 368.

TABLE 368

Oligonucleotides related to this segment

| Oligonucleotide name | Overexpressed in cancers | Chip reference |
|---|---|---|
| F10611_0_0_6663 | lung malignant tumors | LUN |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_59 (SEQ ID NO:401) according to the present invention is supported by 7 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 369 below describes the starting and ending position of this segment on each transcript.

TABLE 369

Segment location on transcripts

| Transcript name | Segment starting position | Segment ending position |
|---|---|---|
| F10611_T0 (SEQ ID NO: 354) | 2652 | 2849 |
| F10611_T1 (SEQ ID NO: 355) | 2778 | 2975 |
| F10611_T2 (SEQ ID NO: 356) | 5012 | 5209 |
| F10611_T3 (SEQ ID NO: 357) | 2778 | 2975 |
| F10611_T4 (SEQ ID NO: 358) | 2778 | 2975 |
| F10611_T5 (SEQ ID NO: 359) | 2778 | 2975 |
| F10611_T6 (SEQ ID NO: 360) | 2778 | 2975 |
| F10611_T8 (SEQ ID NO: 362) | 5124 | 5321 |
| F10611_T9 (SEQ ID NO: 363) | 2594 | 2791 |
| F10611_T10 (SEQ ID NO: 364) | 5749 | 5946 |
| F10611_T11 (SEQ ID NO: 365) | 5026 | 5223 |
| F10611_T12 (SEQ ID NO: 366) | 2778 | 2975 |
| F10611_T13 (SEQ ID NO: 367) | 2778 | 2975 |
| F10611_T15 (SEQ ID NO: 369) | 2778 | 2975 |
| F10611_T16 (SEQ ID NO: 370) | 2778 | 2975 |
| F10611_T17 (SEQ ID NO: 371) | 2778 | 2975 |
| F10611_T21 (SEQ ID NO: 374) | 4336 | 4533 |
| F10611_T22 (SEQ ID NO: 375) | 1869 | 2066 |
| F10611_T23 (SEQ ID NO: 376) | 4169 | 4366 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P18, since it is in the coding region for the corresponding transcript.

Segment cluster F10611_node_63 (SEQ ID NO:402) according to the present invention is supported by 8 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 370 below describes the starting and ending position of this segment on each transcript.

TABLE 370

Segment location on transcripts

| Transcript name | Segment starting position | Segment ending position |
|---|---|---|
| F10611_T0 (SEQ ID NO: 354) | 2904 | 3101 |
| F10611_T1 (SEQ ID NO: 355) | 3030 | 3227 |
| F10611_T2 (SEQ ID NO: 356) | 5264 | 5461 |
| F10611_T3 (SEQ ID NO: 357) | 3030 | 3227 |
| F10611_T4 (SEQ ID NO: 358) | 3030 | 3227 |
| F10611_T5 (SEQ ID NO: 359) | 3030 | 3227 |
| F10611_T6 (SEQ ID NO: 360) | 3030 | 3227 |
| F10611_T8 (SEQ ID NO: 362) | 5376 | 5573 |
| F10611_T9 (SEQ ID NO: 363) | 2846 | 3043 |
| F10611_T10 (SEQ ID NO: 364) | 6001 | 6198 |
| F10611_T11 (SEQ ID NO: 365) | 5278 | 5475 |
| F10611_T12 (SEQ ID NO: 366) | 3030 | 3227 |
| F10611_T13 (SEQ ID NO: 367) | 3030 | 3227 |
| F10611_T15 (SEQ ID NO: 369) | 3030 | 3227 |
| F10611_T16 (SEQ ID NO: 370) | 3030 | 3227 |
| F10611_T17 (SEQ ID NO: 371) | 3030 | 3227 |
| F10611_T21 (SEQ ID NO: 374) | 4588 | 4785 |
| F10611_T22 (SEQ ID NO: 375) | 2121 | 2318 |
| F10611_T23 (SEQ ID NO: 376) | 4421 | 4618 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P18, since it is in the coding region for the corresponding transcript.

Segment cluster F10611_node_66 (SEQ ID NO:403) according to the present invention is supported by 9 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375) and F10611_T23 (SEQ ID NO:376). Table 371 below describes the starting and ending position of this segment on each transcript.

TABLE 371

Segment location on transcripts

| Transcript name | Segment starting position | Segment ending position |
|---|---|---|
| F10611_T0 (SEQ ID NO: 354) | 3102 | 3295 |
| F10611_T1 (SEQ ID NO: 355) | 3228 | 3421 |
| F10611_T2 (SEQ ID NO: 356) | 5462 | 5655 |
| F10611_T3 (SEQ ID NO: 357) | 3228 | 3421 |
| F10611_T4 (SEQ ID NO: 358) | 3228 | 3421 |
| F10611_T5 (SEQ ID NO: 359) | 3228 | 3421 |
| F10611_T6 (SEQ ID NO: 360) | 3228 | 3421 |
| F10611_T8 (SEQ ID NO: 362) | 5574 | 5767 |
| F10611_T9 (SEQ ID NO: 363) | 3044 | 3237 |
| F10611_T10 (SEQ ID NO: 364) | 6199 | 6392 |
| F10611_T11 (SEQ ID NO: 365) | 5476 | 5669 |
| F10611_T12 (SEQ ID NO: 366) | 3228 | 3421 |
| F10611_T13 (SEQ ID NO: 367) | 3228 | 3421 |
| F10611_T15 (SEQ ID NO: 369) | 3228 | 3421 |
| F10611_T16 (SEQ ID NO: 370) | 3228 | 3421 |
| F10611_T21 (SEQ ID NO: 374) | 4786 | 4979 |
| F10611_T22 (SEQ ID NO: 375) | 2319 | 2512 |
| F10611_T23 (SEQ ID NO: 376) | 4619 | 4812 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16 and F10611_P17, since it is in the coding region for the corresponding transcript.

Segment cluster F10611_node_68 (SEQ ID NO:404) according to the present invention is supported by 9 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375) and F10611_T23 (SEQ ID NO:376). Table 372 below describes the starting and ending position of this segment on each transcript.

TABLE 372

Segment location on transcripts

| Transcript name | Segment starting position | Segment ending position |
|---|---|---|
| F10611_T0 (SEQ ID NO: 354) | 3296 | 3431 |
| F10611_T1 (SEQ ID NO: 355) | 3422 | 3557 |
| F10611_T2 (SEQ ID NO: 356) | 5656 | 5791 |
| F10611_T3 (SEQ ID NO: 357) | 3422 | 3557 |
| F10611_T4 (SEQ ID NO: 358) | 3422 | 3557 |
| F10611_T5 (SEQ ID NO: 359) | 3422 | 3557 |
| F10611_T6 (SEQ ID NO: 360) | 3422 | 3557 |
| F10611_T8 (SEQ ID NO: 362) | 5768 | 5903 |

TABLE 372-continued

Segment location on transcripts

| Transcript name | Segment starting position | Segment ending position |
|---|---|---|
| F10611_T9 (SEQ ID NO: 363) | 3238 | 3373 |
| F10611_T10 (SEQ ID NO: 364) | 6393 | 6528 |
| F10611_T11 (SEQ ID NO: 365) | 5670 | 5805 |
| F10611_T12 (SEQ ID NO: 366) | 3422 | 3557 |
| F10611_T13 (SEQ ID NO: 367) | 3422 | 3557 |
| F10611_T15 (SEQ ID NO: 369) | 3422 | 3557 |
| F10611_T16 (SEQ ID NO: 370) | 3422 | 3557 |
| F10611_T21 (SEQ ID NO: 374) | 4980 | 5115 |
| F10611_T22 (SEQ ID NO: 375) | 2513 | 2648 |
| F10611_T23 (SEQ ID NO: 376) | 4813 | 4948 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16 and F10611_P17, since it is in the coding region for the corresponding transcript.

Segment cluster F10611_node_70 (SEQ ID NO:405) according to the present invention is supported by 1 libraries. The number of libraries was determined as previously described. This segment can be found in the following transcript(s): F10611_T25 (SEQ ID NO:378). Table 373 below describes the starting and ending position of this segment on each transcript.

TABLE 373

Segment location on transcripts

| Transcript name | Segment starting position | Segment ending position |
|---|---|---|
| F10611_T25 (SEQ ID NO: 378) | 1 | 206 |

This segment can be found in a non-coding region of transcript(s) that are related to the following protein(s): F10611_P22.

Segment cluster F10611_node_73 (SEQ ID NO:406) according to the present invention is supported by 5 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375), F10611_T23 (SEQ ID NO:376) and F10611_T25 (SEQ ID NO:378). Table 374 below describes the starting and ending position of this segment on each transcript.

TABLE 374

Segment location on transcripts

| Transcript name | Segment starting position | Segment ending position |
|---|---|---|
| F10611_T0 (SEQ ID NO: 354) | 3537 | 3677 |
| F10611_T1 (SEQ ID NO: 355) | 3663 | 3803 |
| F10611_T2 (SEQ ID NO: 356) | 5897 | 6037 |
| F10611_T3 (SEQ ID NO: 357) | 3663 | 3803 |
| F10611_T4 (SEQ ID NO: 358) | 3663 | 3803 |
| F10611_T5 (SEQ ID NO: 359) | 3663 | 3803 |
| F10611_T6 (SEQ ID NO: 360) | 3663 | 3803 |
| F10611_T8 (SEQ ID NO: 362) | 6009 | 6149 |
| F10611_T9 (SEQ ID NO: 363) | 3479 | 3619 |
| F10611_T10 (SEQ ID NO: 364) | 6634 | 6774 |
| F10611_T11 (SEQ ID NO: 365) | 5911 | 6051 |
| F10611_T12 (SEQ ID NO: 366) | 3663 | 3803 |
| F10611_T13 (SEQ ID NO: 367) | 3663 | 3803 |
| F10611_T15 (SEQ ID NO: 369) | 3663 | 3803 |
| F10611_T16 (SEQ ID NO: 370) | 3663 | 3803 |
| F10611_T21 (SEQ ID NO: 374) | 5221 | 5361 |
| F10611_T22 (SEQ ID NO: 375) | 2754 | 2894 |
| F10611_T23 (SEQ ID NO: 376) | 5054 | 5194 |
| F10611_T25 (SEQ ID NO: 378) | 312 | 452 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P22, since it is in the coding region for the corresponding transcript.

Segment cluster F10611_node_81 (SEQ ID NO:407) according to the present invention is supported by 9 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 375 below describes the starting and ending position of this segment on each transcript.

TABLE 375

Segment location on transcripts

| Transcript name | Segment starting position | Segment ending position |
|---|---|---|
| F10611_T0 (SEQ ID NO: 354) | 3949 | 4113 |
| F10611_T1 (SEQ ID NO: 355) | 4030 | 4194 |
| F10611_T2 (SEQ ID NO: 356) | 6264 | 6428 |
| F10611_T3 (SEQ ID NO: 357) | 4030 | 4194 |
| F10611_T4 (SEQ ID NO: 358) | 4030 | 4194 |
| F10611_T5 (SEQ ID NO: 359) | 4030 | 4194 |
| F10611_T6 (SEQ ID NO: 360) | 4030 | 4194 |
| F10611_T8 (SEQ ID NO: 362) | 6376 | 6540 |
| F10611_T9 (SEQ ID NO: 363) | 3846 | 4010 |
| F10611_T10 (SEQ ID NO: 364) | 7001 | 7165 |
| F10611_T11 (SEQ ID NO: 365) | 6278 | 6442 |
| F10611_T12 (SEQ ID NO: 366) | 4030 | 4194 |
| F10611_T13 (SEQ ID NO: 367) | 4030 | 4194 |
| F10611_T15 (SEQ ID NO: 369) | 4030 | 4194 |
| F10611_T16 (SEQ ID NO: 370) | 4030 | 4194 |
| F10611_T21 (SEQ ID NO: 374) | 5588 | 5752 |
| F10611_T22 (SEQ ID NO: 375) | 3121 | 3285 |
| F10611_T23 (SEQ ID NO: 376) | 5421 | 5585 |
| F10611_T24 (SEQ ID NO: 377) | 814 | 978 |
| F10611_T25 (SEQ ID NO: 378) | 679 | 843 |
| F10611_T26 (SEQ ID NO: 379) | 208 | 372 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21, F10611_P22 and F10611_P23, since it is in the coding region for the corresponding transcript.

Segment cluster F10611_node_83 (SEQ ID NO:408) according to the present invention is supported by 11 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 376 below describes the starting and ending position of this segment on each transcript.

TABLE 376

Segment location on transcripts

| Transcript name | Segment starting position | Segment ending position |
|---|---|---|
| F10611_T0 (SEQ ID NO: 354) | 4114 | 4251 |
| F10611_T1 (SEQ ID NO: 355) | 4195 | 4332 |
| F10611_T2 (SEQ ID NO: 356) | 6429 | 6566 |
| F10611_T3 (SEQ ID NO: 357) | 4195 | 4332 |
| F10611_T4 (SEQ ID NO: 358) | 4195 | 4332 |
| F10611_T5 (SEQ ID NO: 359) | 4195 | 4332 |
| F10611_T6 (SEQ ID NO: 360) | 4195 | 4332 |
| F10611_T8 (SEQ ID NO: 362) | 6541 | 6678 |
| F10611_T9 (SEQ ID NO: 363) | 4011 | 4148 |
| F10611_T10 (SEQ ID NO: 364) | 7166 | 7303 |
| F10611_T11 (SEQ ID NO: 365) | 6443 | 6580 |
| F10611_T12 (SEQ ID NO: 366) | 4195 | 4332 |
| F10611_T13 (SEQ ID NO: 367) | 4195 | 4332 |
| F10611_T15 (SEQ ID NO: 369) | 4195 | 4332 |
| F10611_T16 (SEQ ID NO: 370) | 4195 | 4332 |

TABLE 376-continued

Segment location on transcripts

| Transcript name | Segment starting position | Segment ending position |
|---|---|---|
| F10611_T21 (SEQ ID NO: 374) | 5753 | 5890 |
| F10611_T22 (SEQ ID NO: 375) | 3286 | 3423 |
| F10611_T23 (SEQ ID NO: 376) | 5586 | 5723 |
| F10611_T24 (SEQ ID NO: 377) | 979 | 1116 |
| F10611_T25 (SEQ ID NO: 378) | 844 | 981 |
| F10611_T26 (SEQ ID NO: 379) | 373 | 510 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21, F10611_P22 and F10611_P23, since it is in the coding region for the corresponding transcript.

Segment cluster F10611_node_85 (SEQ ID NO:409) according to the present invention is supported by 13 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T11 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 377 below describes the starting and ending position of this segment on each transcript.

TABLE 377

Segment location on transcripts

| Transcript name | Segment starting position | Segment ending position |
|---|---|---|
| F10611_T0 (SEQ ID NO: 354) | 4252 | 4432 |
| F10611_T1 (SEQ ID NO: 355) | 4333 | 4513 |
| F10611_T2 (SEQ ID NO: 356) | 6567 | 6747 |
| F10611_T3 (SEQ ID NO: 357) | 4333 | 4513 |
| F10611_T4 (SEQ ID NO: 358) | 4333 | 4513 |
| F10611_T5 (SEQ ID NO: 359) | 4333 | 4513 |
| F10611_T6 (SEQ ID NO: 360) | 4333 | 4513 |
| F10611_T8 (SEQ ID NO: 362) | 6679 | 6859 |
| F10611_T9 (SEQ ID NO: 363) | 4149 | 4329 |
| F10611_T10 (SEQ ID NO: 364) | 7304 | 7484 |
| F10611_T11 (SEQ ID NO: 365) | 6581 | 6761 |
| F10611_T12 (SEQ ID NO: 366) | 4333 | 4513 |
| F10611_T13 (SEQ ID NO: 367) | 4333 | 4513 |
| F10611_T15 (SEQ ID NO: 369) | 4333 | 4513 |
| F10611_T16 (SEQ ID NO: 370) | 4333 | 4513 |
| F10611_T21 (SEQ ID NO: 374) | 5891 | 6071 |
| F10611_T22 (SEQ ID NO: 375) | 3424 | 3604 |
| F10611_T23 (SEQ ID NO: 376) | 5724 | 5904 |
| F10611_T24 (SEQ ID NO: 377) | 1117 | 1297 |
| F10611_T25 (SEQ ID NO: 378) | 982 | 1162 |
| F10611_T26 (SEQ ID NO: 379) | 511 | 691 |

This segment can be found in both coding and non-coding regions of transcript(s) as follows. The segment can be found in a non-coding region of transcript(s) that are related to the following protein(s): F10611_P3, F10611_P9, F10611_P1, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21, F10611_P22 and F10611_P23, since it is in the coding region for the corresponding transcript.

Segment cluster F10611_node_93 (SEQ ID NO:410) according to the present invention is supported by 2 libraries. The number of libraries was determined as previously described. This segment can be found in the following transcript(s): F10611_T28 (SEQ ID NO:381) and F10611_T32 (SEQ ID NO:383). Table 378 below describes the starting and ending position of this segment on each transcript.

TABLE 378

Segment location on transcripts

| Transcript name | Segment starting position | Segment ending position |
|---|---|---|
| F10611_T28 (SEQ ID NO: 381) | 1 | 187 |
| F10611_T32 (SEQ ID NO: 383) | 1 | 187 |

This segment can be found in a non-coding region of transcript(s) that are related to the following protein(s): F10611_P25.

Segment cluster F10611_node_94 (SEQ ID NO:411) according to the present invention is supported by 21 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T28 (SEQ ID NO:381) and F10611_T32 (SEQ ID NO:383). Table 379 below describes the starting and ending position of this segment on each transcript.

TABLE 379

Segment location on transcripts

| Transcript name | Segment starting position | Segment ending position |
|---|---|---|
| F10611_T0 (SEQ ID NO: 354) | 4630 | 4799 |
| F10611_T1 (SEQ ID NO: 355) | 4711 | 4880 |
| F10611_T2 (SEQ ID NO: 356) | 6945 | 7114 |
| F10611_T3 (SEQ ID NO: 357) | 4711 | 4880 |
| F10611_T4 (SEQ ID NO: 358) | 4711 | 4880 |
| F10611_T5 (SEQ ID NO: 359) | 4711 | 4880 |
| F10611_T6 (SEQ ID NO: 360) | 4711 | 4880 |
| F10611_T8 (SEQ ID NO: 362) | 7057 | 7226 |
| F10611_T9 (SEQ ID NO: 363) | 4527 | 4696 |
| F10611_T10 (SEQ ID NO: 364) | 7682 | 7851 |
| F10611_T11 (SEQ ID NO: 365) | 6959 | 7128 |

TABLE 379-continued

Segment location on transcripts

| Transcript name | Segment starting position | Segment ending position |
|---|---|---|
| F10611_T12 (SEQ ID NO: 366) | 4711 | 4880 |
| F10611_T13 (SEQ ID NO: 367) | 4711 | 4880 |
| F10611_T15 (SEQ ID NO: 369) | 4711 | 4880 |
| F10611_T21 (SEQ ID NO: 374) | 6269 | 6438 |
| F10611_T22 (SEQ ID NO: 375) | 3802 | 3971 |
| F10611_T23 (SEQ ID NO: 376) | 6102 | 6271 |
| F10611_T24 (SEQ ID NO: 377) | 1495 | 1664 |
| F10611_T25 (SEQ ID NO: 378) | 1360 | 1529 |
| F10611_T26 (SEQ ID NO: 379) | 889 | 1058 |
| F10611_T28 (SEQ ID NO: 381) | 188 | 357 |
| F10611_T32 (SEQ ID NO: 383) | 188 | 357 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 380.

TABLE 380

Oligonucleotides related to this segment

| Oligonucleotide name | Overexpressed in cancers | Chip reference |
|---|---|---|
| F10611_0_10_0 | lung malignant tumors | LUN |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P11, F10611_P13, F10611_P14, F10611_P16, F10611_P21, F10611_P22, F10611_P23 and F10611_P25, since it is in the coding region for the corresponding transcript.

Segment cluster F10611_node_95 (SEQ ID NO:412) according to the present invention is supported by 6 libraries. The number of libraries was determined as previously described. This segment can be found in the following transcript(s): F10611_T15 (SEQ ID NO:369) and F10611_T32 (SEQ ID NO:383). Table 381 below describes the starting and ending position of this segment on each transcript.

TABLE 381

Segment location on transcripts

| Transcript name | Segment starting position | Segment ending position |
|---|---|---|
| F10611_T15 (SEQ ID NO: 369) | 4881 | 5476 |
| F10611_T32 (SEQ ID NO: 383) | 358 | 953 |

This segment can be found in the following protein(s): F10611_P16.

Segment cluster F10611_node_99 (SEQ ID NO:413) according to the present invention is supported by 3 libraries. The number of libraries was determined as previously described. This segment can be found in the following transcript(s): F10611_T4 (SEQ ID NO:358). Table 382 below describes the starting and ending position of this segment on each transcript.

TABLE 382

Segment location on transcripts

| Transcript name | Segment starting position | Segment ending position |
|---|---|---|
| F10611_T4 (SEQ ID NO: 358) | 4926 | 5353 |

This segment can be found in the following protein(s): F10611_P5.

Segment cluster F10611_node_102 (SEQ ID NO:414) according to the present invention is supported by 19 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379) and F10611_T28 (SEQ ID NO:381). Table 383 below describes the starting and ending position of this segment on each transcript.

TABLE 383

Segment location on transcripts

| Transcript name | Segment starting position | Segment ending position |
|---|---|---|
| F10611_T0 (SEQ ID NO: 354) | 4881 | 5016 |
| F10611_T1 (SEQ ID NO: 355) | 4962 | 5097 |
| F10611_T2 (SEQ ID NO: 356) | 7196 | 7331 |
| F10611_T3 (SEQ ID NO: 357) | 5007 | 5142 |
| F10611_T4 (SEQ ID NO: 358) | 5435 | 5570 |
| F10611_T6 (SEQ ID NO: 360) | 4962 | 5097 |
| F10611_T8 (SEQ ID NO: 362) | 7308 | 7443 |
| F10611_T9 (SEQ ID NO: 363) | 4778 | 4913 |
| F10611_T10 (SEQ ID NO: 364) | 7933 | 8068 |
| F10611_T11 (SEQ ID NO: 365) | 7210 | 7345 |
| F10611_T12 (SEQ ID NO: 366) | 4962 | 5097 |
| F10611_T13 (SEQ ID NO: 367) | 4962 | 5097 |
| F10611_T21 (SEQ ID NO: 374) | 6520 | 6655 |
| F10611_T22 (SEQ ID NO: 375) | 4053 | 4188 |
| F10611_T23 (SEQ ID NO: 376) | 6353 | 6488 |
| F10611_T24 (SEQ ID NO: 377) | 1746 | 1881 |
| F10611_T25 (SEQ ID NO: 378) | 1611 | 1746 |
| F10611_T26 (SEQ ID NO: 379) | 1140 | 1275 |
| F10611_T28 (SEQ ID NO: 381) | 439 | 574 |

This segment can be found in both coding and non-coding regions of transcript(s) as follows. The segment can be found in a non-coding region of transcript(s) that are related to the following protein(s): F10611_P3, F10611_P5, F10611_P9, F10611_P11, F10611_P12 and F10611_P20. This segment can also be found in the following protein(s): F10611_P29, F10611_P2, F10611_P4, F10611_P7, F10611_P10, F10611_P13, F10611_P14, F10611_P21, F10611_P22, F10611_P23 and F10611_P25, since it is in the coding region for the corresponding transcript.

Segment cluster F10611_node_104 (SEQ ID NO:415) according to the present invention is supported by 4 libraries.

The number of libraries was determined as previously described. This segment can be found in the following transcript(s): F10611_T27 (SEQ ID NO:380). Table 384 below describes the starting and ending position of this segment on each transcript.

Table 384—Segment Location on Transcripts

TABLE 384

| Segment location on transcripts | | |
|---|---|---|
| Transcript name | Segment starting position | Segment ending position |
| F10611_T27 (SEQ ID NO: 380) | 458 | 734 |

This segment can be found in a non-coding region of transcript(s) that are related to the following protein(s): F10611_P24.

Segment cluster F10611_node__105 (SEQ ID NO:416) according to the present invention is supported by 23 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 385 below describes the starting and ending position of this segment on each transcript.

TABLE 385

| Segment location on transcripts | | |
|---|---|---|
| Transcript name | Segment starting position | Segment ending position |
| F10611_T0 (SEQ ID NO: 354) | 5017 | 5156 |
| F10611_T1 (SEQ ID NO: 355) | 5098 | 5237 |
| F10611_T2 (SEQ ID NO: 356) | 7332 | 7471 |
| F10611_T3 (SEQ ID NO: 357) | 5143 | 5282 |
| F10611_T4 (SEQ ID NO: 358) | 5571 | 5710 |
| F10611_T5 (SEQ ID NO: 359) | 4962 | 5101 |
| F10611_T6 (SEQ ID NO: 360) | 5098 | 5237 |
| F10611_T8 (SEQ ID NO: 362) | 7444 | 7583 |
| F10611_T9 (SEQ ID NO: 363) | 4914 | 5053 |
| F10611_T10 (SEQ ID NO: 364) | 8069 | 8208 |
| F10611_T11 (SEQ ID NO: 365) | 7346 | 7485 |
| F10611_T12 (SEQ ID NO: 366) | 5098 | 5237 |
| F10611_T13 (SEQ ID NO: 367) | 5098 | 5237 |
| F10611_T21 (SEQ ID NO: 374) | 6656 | 6795 |
| F10611_T22 (SEQ ID NO: 375) | 4189 | 4328 |
| F10611_T23 (SEQ ID NO: 376) | 6489 | 6628 |
| F10611_T24 (SEQ ID NO: 377) | 1882 | 2021 |
| F10611_T25 (SEQ ID NO: 378) | 1747 | 1886 |
| F10611_T26 (SEQ ID NO: 379) | 1276 | 1415 |
| F10611_T27 (SEQ ID NO: 380) | 735 | 874 |
| F10611_T28 (SEQ ID NO: 381) | 575 | 714 |

This segment can be found in both coding and non-coding regions of transcript(s) as follows. The segment can be found in a non-coding region of transcript(s) that are related to the following protein(s): F10611_P3, F10611_P5, F10611_P9, F10611_P11, F10611_P12, F10611_P20 and F10611_P24. This segment can also be found in the following protein(s): F10611_P29, F10611_P2, F10611_P4, F10611_P6, F10611_P7, F10611_P10, F10611_P13, F10611_P14, F10611_P21, F10611_P22, F10611_P23 and F10611_P25, since it is in the coding region for the corresponding transcript.

Segment cluster F10611_node__111 (SEQ ID NO:417) according to the present invention is supported by 28 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 386 below describes the starting and ending position of this segment on each transcript.

TABLE 386

| Segment location on transcripts | | |
|---|---|---|
| Transcript name | Segment starting position | Segment ending position |
| F10611_T0 (SEQ ID NO: 354) | 5359 | 5487 |
| F10611_T1 (SEQ ID NO: 355) | 5440 | 5568 |
| F10611_T2 (SEQ ID NO: 356) | 7674 | 7802 |
| F10611_T3 (SEQ ID NO: 357) | 5485 | 5613 |
| F10611_T4 (SEQ ID NO: 358) | 5913 | 6041 |
| F10611_T5 (SEQ ID NO: 359) | 5304 | 5432 |
| F10611_T6 (SEQ ID NO: 360) | 5440 | 5568 |
| F10611_T8 (SEQ ID NO: 362) | 7786 | 7914 |
| F10611_T9 (SEQ ID NO: 363) | 5256 | 5384 |
| F10611_T10 (SEQ ID NO: 364) | 8411 | 8539 |
| F10611_T11 (SEQ ID NO: 365) | 7688 | 7816 |
| F10611_T12 (SEQ ID NO: 366) | 5440 | 5568 |
| F10611_T13 (SEQ ID NO: 367) | 5440 | 5568 |
| F10611_T21 (SEQ ID NO: 374) | 6998 | 7126 |
| F10611_T22 (SEQ ID NO: 375) | 4531 | 4659 |
| F10611_T23 (SEQ ID NO: 376) | 6831 | 6959 |
| F10611_T24 (SEQ ID NO: 377) | 2224 | 2352 |
| F10611_T25 (SEQ ID NO: 378) | 2089 | 2217 |
| F10611_T26 (SEQ ID NO: 379) | 1618 | 1746 |
| F10611_T27 (SEQ ID NO: 380) | 1077 | 1205 |
| F10611_T28 (SEQ ID NO: 381) | 917 | 1045 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P1, F10611_P12 and F10611_P20. This segment can also be found in the following protein(s): F10611_P29, F10611_P2, F10611_P4, F10611_P7, F10611_P10, F10611_P13, F10611_P14, F10611_P21, F10611_P22, F10611_P23, F10611_P24 and F10611_P25, since it is in the coding region for the corresponding transcript.

Segment cluster F10611_node__119 (SEQ ID NO:418) according to the present invention is supported by 19 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 387 below describes the starting and ending position of this segment on each transcript.

TABLE 387

Segment location on transcripts

| Transcript name | Segment starting position | Segment ending position |
| --- | --- | --- |
| F10611_T0 (SEQ ID NO: 354) | 5648 | 5827 |
| F10611_T1 (SEQ ID NO: 355) | 5729 | 5908 |
| F10611_T2 (SEQ ID NO: 356) | 7963 | 8142 |
| F10611_T3 (SEQ ID NO: 357) | 5774 | 5953 |
| F10611_T4 (SEQ ID NO: 358) | 6202 | 6381 |
| F10611_T5 (SEQ ID NO: 359) | 5593 | 5772 |
| F10611_T6 (SEQ ID NO: 360) | 5729 | 5908 |
| F10611_T8 (SEQ ID NO: 362) | 8075 | 8254 |
| F10611_T9 (SEQ ID NO: 363) | 5545 | 5724 |
| F10611_T10 (SEQ ID NO: 364) | 8700 | 8879 |
| F10611_T11 (SEQ ID NO: 365) | 7977 | 8156 |
| F10611_T21 (SEQ ID NO: 374) | 7287 | 7466 |
| F10611_T22 (SEQ ID NO: 375) | 4820 | 4999 |
| F10611_T23 (SEQ ID NO: 376) | 7120 | 7299 |
| F10611_T24 (SEQ ID NO: 377) | 2513 | 2692 |
| F10611_T25 (SEQ ID NO: 378) | 2378 | 2557 |
| F10611_T26 (SEQ ID NO: 379) | 1907 | 2086 |
| F10611_T27 (SEQ ID NO: 380) | 1366 | 1545 |
| F10611_T28 (SEQ ID NO: 381) | 1206 | 1385 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P11, F10611_P12 and F10611_P20. This segment can also be found in the following protein(s): F10611_P29, F10611_P2, F10611_P4, F10611_P7, F10611_P10, F10611_P21, F10611_P22, F10611_P23, F10611_P24 and F10611_P25, since it is in the coding region for the corresponding transcript.

Segment cluster F10611_node__122 (SEQ ID NO:419) according to the present invention is supported by 24 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 388 below describes the starting and ending position of this segment on each transcript.

TABLE 388

Segment location on transcripts

| Transcript name | Segment starting position | Segment ending position |
| --- | --- | --- |
| F10611_T0 (SEQ ID NO: 354) | 5828 | 6130 |
| F10611_T1 (SEQ ID NO: 355) | 5909 | 6211 |
| F10611_T2 (SEQ ID NO: 356) | 8143 | 8445 |
| F10611_T3 (SEQ ID NO: 357) | 5954 | 6256 |
| F10611_T4 (SEQ ID NO: 358) | 6382 | 6684 |
| F10611_T5 (SEQ ID NO: 359) | 5773 | 6075 |
| F10611_T6 (SEQ ID NO: 360) | 5936 | 6238 |
| F10611_T8 (SEQ ID NO: 362) | 8255 | 8557 |
| F10611_T9 (SEQ ID NO: 363) | 5725 | 6027 |
| F10611_T10 (SEQ ID NO: 364) | 8880 | 9182 |
| F10611_T11 (SEQ ID NO: 365) | 8157 | 8459 |
| F10611_T21 (SEQ ID NO: 374) | 7467 | 7769 |
| F10611_T22 (SEQ ID NO: 375) | 5000 | 5302 |
| F10611_T23 (SEQ ID NO: 376) | 7300 | 7602 |
| F10611_T24 (SEQ ID NO: 377) | 2693 | 2995 |
| F10611_T25 (SEQ ID NO: 378) | 2558 | 2860 |
| F10611_T26 (SEQ ID NO: 379) | 2087 | 2389 |
| F10611_T27 (SEQ ID NO: 380) | 1546 | 1848 |
| F10611_T28 (SEQ ID NO: 381) | 1386 | 1688 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P11, F10611_P12 and F10611_P20. This segment can also be found in the following protein(s): F10611_P29, F10611_P2, F10611_P4, F10611_P7, F10611_P10, F10611_P21, F10611_P22, F10611_P23, F10611_P24 and F10611_P25, since it is in the coding region for the corresponding transcript.

Segment cluster F10611_node__125 (SEQ ID NO:420) according to the present invention is supported by 33 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 389 below describes the starting and ending position of this segment on each transcript.

TABLE 389

Segment location on transcripts

| Transcript name | Segment starting position | Segment ending position |
| --- | --- | --- |
| F10611_T0 (SEQ ID NO: 354) | 6131 | 6371 |
| F10611_T1 (SEQ ID NO: 355) | 6212 | 6452 |
| F10611_T2 (SEQ ID NO: 356) | 8446 | 8686 |
| F10611_T3 (SEQ ID NO: 357) | 6257 | 6497 |
| F10611_T4 (SEQ ID NO: 358) | 6685 | 6925 |
| F10611_T5 (SEQ ID NO: 359) | 6076 | 6316 |
| F10611_T6 (SEQ ID NO: 360) | 6239 | 6479 |
| F10611_T8 (SEQ ID NO: 362) | 8558 | 8798 |
| F10611_T9 (SEQ ID NO: 363) | 6028 | 6268 |
| F10611_T10 (SEQ ID NO: 364) | 9183 | 9423 |
| F10611_T11 (SEQ ID NO: 365) | 8460 | 8700 |

TABLE 389-continued

Segment location on transcripts

| Transcript name | Segment starting position | Segment ending position |
|---|---|---|
| F10611_T21 (SEQ ID NO: 374) | 7770 | 8010 |
| F10611_T22 (SEQ ID NO: 375) | 5303 | 5543 |
| F10611_T23 (SEQ ID NO: 376) | 7603 | 7843 |
| F10611_T24 (SEQ ID NO: 377) | 2996 | 3236 |
| F10611_T25 (SEQ ID NO: 378) | 2861 | 3101 |
| F10611_T26 (SEQ ID NO: 379) | 2390 | 2630 |
| F10611_T27 (SEQ ID NO: 380) | 1849 | 2089 |
| F10611_T28 (SEQ ID NO: 381) | 1689 | 1929 |

This segment can be found in both coding and non-coding regions of transcript(s) as follows. The segment can be found in a non-coding region of transcript(s) that are related to the following protein(s): F10611_P2, F10611_P3, F10611_P4, F10611_P5, F10611_P6, F10611_P7, F10611_P9, F10611_P10, F10611_P11, F10611_P12, F10611_P20, F10611_P21, F10611_P22, F10611_P23, F10611_P24 and F10611_P25. This segment can also be found in the following protein(s): F10611_P29, since it is in the coding region for the corresponding transcript.

Segment cluster F10611_node__126 (SEQ ID NO:421) according to the present invention is supported by 141 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 390 below describes the starting and ending position of this segment on each transcript.

TABLE 390

Segment location on transcripts

| Transcript name | Segment starting position | Segment ending position |
|---|---|---|
| F10611_T0 (SEQ ID NO: 354) | 6372 | 8060 |
| F10611_T1 (SEQ ID NO: 355) | 6453 | 8141 |
| F10611_T2 (SEQ ID NO: 356) | 8687 | 10375 |
| F10611_T3 (SEQ ID NO: 357) | 6498 | 8186 |
| F10611_T4 (SEQ ID NO: 358) | 6926 | 8614 |
| F10611_T5 (SEQ ID NO: 359) | 6317 | 8005 |
| F10611_T6 (SEQ ID NO: 360) | 6480 | 8168 |
| F10611_T7 (SEQ ID NO: 361) | 1645 | 3333 |
| F10611_T8 (SEQ ID NO: 362) | 8799 | 10487 |
| F10611_T9 (SEQ ID NO: 363) | 6269 | 7957 |
| F10611_T10 (SEQ ID NO: 364) | 9424 | 11112 |
| F10611_T11 (SEQ ID NO: 365) | 8701 | 10389 |
| F10611_T21 (SEQ ID NO: 374) | 8011 | 9699 |
| F10611_T22 (SEQ ID NO: 375) | 5544 | 7232 |
| F10611_T23 (SEQ ID NO: 376) | 7844 | 9532 |
| F10611_T24 (SEQ ID NO: 377) | 3237 | 4925 |
| F10611_T25 (SEQ ID NO: 378) | 3102 | 4790 |
| F10611_T26 (SEQ ID NO: 379) | 2631 | 4319 |
| F10611_T27 (SEQ ID NO: 380) | 2090 | 3778 |
| F10611_T28 (SEQ ID NO: 381) | 1930 | 3618 |

This segment can be found in both coding and non-coding regions of transcript(s) as follows. The segment can be found in a non-coding region of transcript(s) that are related to the following protein(s): F10611_P29, F10611_P2, F10611_P3, F10611_P4, F10611_P5, F10611_P6, F10611_P7, F10611_P9, F10611_P10, F10611_P11, F10611_P12, F10611_P20, F10611_P21, F10611_P22, F10611_P23, F10611_P24 and F10611_P25. This segment can also be found in the following protein(s): F10611_P8, since it is in the coding region for the corresponding transcript.

Segment cluster F10611_node__127 (SEQ ID NO:422) according to the present invention is supported by 92 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T14 (SEQ ID NO:368), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 391 below describes the starting and ending position of this segment on each transcript.

TABLE 391

Segment location on transcripts

| Transcript name | Segment starting position | Segment ending position |
|---|---|---|
| F10611_T0 (SEQ ID NO: 354) | 8061 | 8600 |
| F10611_T1 (SEQ ID NO: 355) | 8142 | 8681 |
| F10611_T2 (SEQ ID NO: 356) | 10376 | 10915 |
| F10611_T3 (SEQ ID NO: 357) | 8187 | 8726 |
| F10611_T4 (SEQ ID NO: 358) | 8615 | 9154 |
| F10611_T5 (SEQ ID NO: 359) | 8006 | 8545 |
| F10611_T6 (SEQ ID NO: 360) | 8169 | 8708 |
| F10611_T7 (SEQ ID NO: 361) | 3334 | 3873 |
| F10611_T8 (SEQ ID NO: 362) | 10488 | 11027 |
| F10611_T9 (SEQ ID NO: 363) | 7958 | 8497 |
| F10611_T10 (SEQ ID NO: 364) | 11113 | 11652 |
| F10611_T11 (SEQ ID NO: 365) | 10390 | 10929 |
| F10611_T14 (SEQ ID NO: 368) | 2734 | 3273 |
| F10611_T21 (SEQ ID NO: 374) | 9700 | 10239 |
| F10611_T22 (SEQ ID NO: 375) | 7233 | 7772 |
| F10611_T23 (SEQ ID NO: 376) | 9533 | 10072 |
| F10611_T24 (SEQ ID NO: 377) | 4926 | 5465 |
| F10611_T25 (SEQ ID NO: 378) | 4791 | 5330 |
| F10611_T26 (SEQ ID NO: 379) | 4320 | 4859 |
| F10611_T27 (SEQ ID NO: 380) | 3779 | 4318 |
| F10611_T28 (SEQ ID NO: 381) | 3619 | 4158 |

This segment can be found in both coding and non-coding regions of transcript(s) as follows. The segment can be found in a non-coding region of transcript(s) that are related to the following protein(s): F10611_P29, F10611_P2, F10611_P3, F10611_P4, F10611_P5, F10611_P6, F10611_P7, F10611_P8, F10611_P9, F10611_P10, F10611_P11, F10611_P12, F10611_P20, F10611_P21, F10611_P22, F10611_P23, F10611_P24 and F10611_P25. This segment can also be found in the following protein(s): F10611_P15, since it is in the coding region for the corresponding transcript.

According to an optional embodiment of the present invention, short segments related to the above cluster are also provided. These segments are up to about 120 bp in length, and so are included in a separate description.

Segment cluster F10611_node_0 (SEQ ID NO:423) according to the present invention is supported by 19 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T24 (SEQ ID NO:377) and F10611_T27 (SEQ ID NO:380). Table 392 below describes the starting and ending position of this segment on each transcript.

TABLE 392

Segment location on transcripts

| Transcript name | Segment starting position | Segment ending position |
|---|---|---|
| F10611_T0 (SEQ ID NO: 354) | 1 | 58 |
| F10611_T1 (SEQ ID NO: 355) | 1 | 58 |
| F10611_T2 (SEQ ID NO: 356) | 1 | 58 |
| F10611_T3 (SEQ ID NO: 357) | 1 | 58 |
| F10611_T4 (SEQ ID NO: 358) | 1 | 58 |
| F10611_T5 (SEQ ID NO: 359) | 1 | 58 |
| F10611_T6 (SEQ ID NO: 360) | 1 | 58 |
| F10611_T7 (SEQ ID NO: 361) | 1 | 58 |
| F10611_T8 (SEQ ID NO: 362) | 1 | 58 |
| F10611_T9 (SEQ ID NO: 363) | 1 | 58 |
| F10611_T10 (SEQ ID NO: 364) | 1 | 58 |
| F10611_T11 (SEQ ID NO: 365) | 1 | 58 |
| F10611_T12 (SEQ ID NO: 366) | 1 | 58 |
| F10611_T13 (SEQ ID NO: 367) | 1 | 58 |
| F10611_T14 (SEQ ID NO: 368) | 1 | 58 |
| F10611_T15 (SEQ ID NO: 369) | 1 | 58 |
| F10611_T16 (SEQ ID NO: 370) | 1 | 58 |
| F10611_T17 (SEQ ID NO: 371) | 1 | 58 |
| F10611_T19 (SEQ ID NO: 372) | 1 | 58 |
| F10611_T20 (SEQ ID NO: 373) | 1 | 58 |
| F10611_T24 (SEQ ID NO: 377) | 1 | 58 |
| F10611_T27 (SEQ ID NO: 380) | 1 | 58 |

This segment can be found in both coding and non-coding regions of transcript(s) as follows. The segment can be found in a non-coding region of transcript(s) that are related to the following protein(s): F10611_P29, F10611_P2, F10611_P4, F10611_P5, F10611_P6, F10611_P7, F10611_P10, F10611_P12, F10611_P13, F10611_P14, F10611_P16, F10611_P17, F10611_P18, F10611_P21 and F10611_P24. This segment can also be found in the following protein(s): F10611_P3, F10611_P8, F10611_P9, F10611_P11, F10611_P15 and F10611_P19, since it is in the coding region for the corresponding transcript.

Segment cluster F10611_node_2 (SEQ ID NO:424) according to the present invention is supported by 21 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T24 (SEQ ID NO:377) and F10611_T27 (SEQ ID NO:380). Table 393 below describes the starting and ending position of this segment on each transcript.

TABLE 393

Segment location on transcripts

| Transcript name | Segment starting position | Segment ending position |
|---|---|---|
| F10611_T0 (SEQ ID NO: 354) | 59 | 167 |
| F10611_T1 (SEQ ID NO: 355) | 59 | 167 |
| F10611_T2 (SEQ ID NO: 356) | 59 | 167 |
| F10611_T3 (SEQ ID NO: 357) | 59 | 167 |
| F10611_T4 (SEQ ID NO: 358) | 59 | 167 |
| F10611_T5 (SEQ ID NO: 359) | 59 | 167 |
| F10611_T6 (SEQ ID NO: 360) | 59 | 167 |
| F10611_T7 (SEQ ID NO: 361) | 59 | 167 |
| F10611_T8 (SEQ ID NO: 362) | 59 | 167 |
| F10611_T9 (SEQ ID NO: 363) | 59 | 167 |
| F10611_T10 (SEQ ID NO: 364) | 59 | 167 |
| F10611_T11 (SEQ ID NO: 365) | 59 | 167 |
| F10611_T12 (SEQ ID NO: 366) | 59 | 167 |
| F10611_T13 (SEQ ID NO: 367) | 59 | 167 |
| F10611_T14 (SEQ ID NO: 368) | 59 | 167 |
| F10611_T15 (SEQ ID NO: 369) | 59 | 167 |
| F10611_T16 (SEQ ID NO: 370) | 59 | 167 |
| F10611_T17 (SEQ ID NO: 371) | 59 | 167 |
| F10611_T19 (SEQ ID NO: 372) | 59 | 167 |
| F10611_T20 (SEQ ID NO: 373) | 59 | 167 |
| F10611_T24 (SEQ ID NO: 377) | 59 | 167 |
| F10611_T27 (SEQ ID NO: 380) | 59 | 167 |

This segment can be found in both coding and non-coding regions of transcript(s) as follows. The segment can be found in a non-coding region of transcript(s) that are related to the following protein(s): F10611_P10 and F10611_P24. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18, F10611_P19 and F10611_P21, since it is in the coding region for the corresponding transcript.

Segment cluster F10611_node_7 (SEQ ID NO:425) according to the present invention is supported by 23 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373) and F10611_T24 (SEQ ID NO:377). Table 394 below describes the starting and ending position of this segment on each transcript.

TABLE 394

Segment location on transcripts

| Transcript name | Segment starting position | Segment ending position |
|---|---|---|
| F10611_T0 (SEQ ID NO: 354) | 458 | 485 |
| F10611_T1 (SEQ ID NO: 355) | 458 | 485 |
| F10611_T2 (SEQ ID NO: 356) | 458 | 485 |
| F10611_T3 (SEQ ID NO: 357) | 458 | 485 |
| F10611_T4 (SEQ ID NO: 358) | 458 | 485 |
| F10611_T5 (SEQ ID NO: 359) | 458 | 485 |
| F10611_T6 (SEQ ID NO: 360) | 458 | 485 |
| F10611_T7 (SEQ ID NO: 361) | 458 | 485 |
| F10611_T8 (SEQ ID NO: 362) | 458 | 485 |
| F10611_T9 (SEQ ID NO: 363) | 458 | 485 |
| F10611_T10 (SEQ ID NO: 364) | 458 | 485 |
| F10611_T11 (SEQ ID NO: 365) | 458 | 485 |
| F10611_T12 (SEQ ID NO: 366) | 458 | 485 |
| F10611_T13 (SEQ ID NO: 367) | 458 | 485 |
| F10611_T14 (SEQ ID NO: 368) | 458 | 485 |
| F10611_T15 (SEQ ID NO: 369) | 458 | 485 |
| F10611_T16 (SEQ ID NO: 370) | 458 | 485 |
| F10611_T17 (SEQ ID NO: 371) | 458 | 485 |
| F10611_T19 (SEQ ID NO: 372) | 458 | 485 |
| F10611_T20 (SEQ ID NO: 373) | 458 | 485 |
| F10611_T24 (SEQ ID NO: 377) | 458 | 485 |

This segment can be found in both coding and non-coding regions of transcript(s) as follows. The segment can be found in a non-coding region of transcript(s) that are related to the following protein(s): F10611_P10. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18, F10611_P19 and F10611_P21, since it is in the coding region for the corresponding transcript.

Segment cluster F10611_node_9 (SEQ ID NO:426) according to the present invention is supported by 24 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373) and F10611_T24 (SEQ ID NO:377). Table 395 below describes the starting and ending position of this segment on each transcript.

TABLE 395

Segment location on transcripts

| Transcript name | Segment starting position | Segment ending position |
|---|---|---|
| F10611_T0 (SEQ ID NO: 354) | 486 | 587 |
| F10611_T1 (SEQ ID NO: 355) | 486 | 587 |
| F10611_T2 (SEQ ID NO: 356) | 486 | 587 |
| F10611_T3 (SEQ ID NO: 357) | 486 | 587 |
| F10611_T4 (SEQ ID NO: 358) | 486 | 587 |
| F10611_T5 (SEQ ID NO: 359) | 486 | 587 |
| F10611_T6 (SEQ ID NO: 360) | 486 | 587 |
| F10611_T7 (SEQ ID NO: 361) | 486 | 587 |
| F10611_T8 (SEQ ID NO: 362) | 486 | 587 |
| F10611_T9 (SEQ ID NO: 363) | 486 | 587 |
| F10611_T10 (SEQ ID NO: 364) | 486 | 587 |
| F10611_T11 (SEQ ID NO: 365) | 486 | 587 |
| F10611_T12 (SEQ ID NO: 366) | 486 | 587 |
| F10611_T13 (SEQ ID NO: 367) | 486 | 587 |
| F10611_T14 (SEQ ID NO: 368) | 486 | 587 |
| F10611_T15 (SEQ ID NO: 369) | 486 | 587 |
| F10611_T16 (SEQ ID NO: 370) | 486 | 587 |
| F10611_T17 (SEQ ID NO: 371) | 486 | 587 |
| F10611_T19 (SEQ ID NO: 372) | 486 | 587 |
| F10611_T20 (SEQ ID NO: 373) | 486 | 587 |
| F10611_T24 (SEQ ID NO: 377) | 486 | 587 |

This segment can be found in both coding and non-coding regions of transcript(s) as follows. The segment can be found in a non-coding region of transcript(s) that are related to the following protein(s): F10611_P10. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18, F10611_P19 and F10611_P21, since it is in the coding region for the corresponding transcript.

Segment cluster F10611_node_13 (SEQ ID NO:427) according to the present invention is supported by 29 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372) and F10611_T20 (SEQ ID NO:373). Table 396 below describes the starting and ending position of this segment on each transcript.

TABLE 396

Segment location on transcripts

| Transcript name | Segment starting position | Segment ending position |
|---|---|---|
| F10611_T0 (SEQ ID NO: 354) | 731 | 824 |
| F10611_T1 (SEQ ID NO: 355) | 731 | 824 |
| F10611_T2 (SEQ ID NO: 356) | 731 | 824 |
| F10611_T3 (SEQ ID NO: 357) | 731 | 824 |
| F10611_T4 (SEQ ID NO: 358) | 731 | 824 |
| F10611_T5 (SEQ ID NO: 359) | 731 | 824 |

TABLE 396-continued

Segment location on transcripts

| Transcript name | Segment starting position | Segment ending position |
|---|---|---|
| F10611_T6 (SEQ ID NO: 360) | 731 | 824 |
| F10611_T7 (SEQ ID NO: 361) | 731 | 824 |
| F10611_T8 (SEQ ID NO: 362) | 731 | 824 |
| F10611_T9 (SEQ ID NO: 363) | 731 | 824 |
| F10611_T10 (SEQ ID NO: 364) | 731 | 824 |
| F10611_T11 (SEQ ID NO: 365) | 731 | 824 |
| F10611_T12 (SEQ ID NO: 366) | 731 | 824 |
| F10611_T13 (SEQ ID NO: 367) | 731 | 824 |
| F10611_T14 (SEQ ID NO: 368) | 731 | 824 |
| F10611_T15 (SEQ ID NO: 369) | 731 | 824 |
| F10611_T16 (SEQ ID NO: 370) | 731 | 824 |
| F10611_T17 (SEQ ID NO: 371) | 731 | 824 |
| F10611_T19 (SEQ ID NO: 372) | 731 | 824 |
| F10611_T20 (SEQ ID NO: 373) | 731 | 824 |

This segment can be found in both coding and non-coding regions of transcript(s) as follows. The segment can be found in a non-coding region of transcript(s) that are related to the following protein(s): F10611_P10. This segment can also be found in the following protein(s): F10611_P29, F10611_P2, F10611_P3, F10611_P4, F10611_P5, F10611_P6, F10611_P7, F10611_P8, F10611_P9, F10611_P11, F10611_P12, F10611_P13, F10611_P14, F10611_P15, F10611_P16, F10611_P17, F10611_P18 and F10611_P19, since it is in the coding region for the corresponding transcript.

Segment cluster F10611_node_15 (SEQ ID NO:428) according to the present invention can be found in the following transcript(s): F10611_T11 (SEQ ID NO:365). Table 397 below describes the starting and ending position of this segment on each transcript.

TABLE 397

Segment location on transcripts

| Transcript name | Segment starting position | Segment ending position |
|---|---|---|
| F10611_T11 (SEQ ID NO: 365) | 825 | 838 |

This segment can be found in the following protein(s): F10611_P12.

Segment cluster F10611_node_20 (SEQ ID NO:429) according to the present invention is supported by 2 libraries. The number of libraries was determined as previously described. This segment can be found in the following transcript(s): F10611_T8 (SEQ ID NO:362) and F10611_T10 (SEQ ID NO:364). Table 398 below describes the starting and ending position of this segment on each transcript.

TABLE 398

Segment location on transcripts

| Transcript name | Segment starting position | Segment ending position |
|---|---|---|
| F10611_T8 (SEQ ID NO: 362) | 1183 | 1294 |
| F10611_T10 (SEQ ID NO: 364) | 1808 | 1919 |

This segment can be found in both coding and non-coding regions of transcript(s) as follows. The segment can be found in a non-coding region of transcript(s) that are related to the following protein(s): F10611_P11. This segment can also be found in the following protein(s): F10611_P9, since it is in the coding region for the corresponding transcript.

Segment cluster F10611_node_23 (SEQ ID NO:430) according to the present invention is supported by 4 libraries. The number of libraries was determined as previously described. This segment can be found in the following transcript(s): F10611_T23 (SEQ ID NO:376). Table 399 below describes the starting and ending position of this segment on each transcript.

TABLE 399

Segment location on transcripts

| Transcript name | Segment starting position | Segment ending position |
|---|---|---|
| F10611_T23 (SEQ ID NO: 376) | 274 | 339 |

This segment can be found in a non-coding region of transcript(s) that are related to the following protein(s): F10611_P20.

Segment cluster F10611_node_28 (SEQ ID NO:431) according to the present invention is supported by 29 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T21 (SEQ ID NO:374), F10611_T22 (SEQ ID NO:375), F10611_T23 (SEQ ID NO:376) and F10611_T31 (SEQ ID NO:382). Table 400 below describes the starting and ending position of this segment on each transcript.

TABLE 400

Segment location on transcripts

| Transcript name | Segment starting position | Segment ending position |
|---|---|---|
| F10611_T0 (SEQ ID NO: 354) | 1367 | 1472 |
| F10611_T1 (SEQ ID NO: 355) | 1367 | 1472 |
| F10611_T2 (SEQ ID NO: 356) | 1367 | 1472 |
| F10611_T3 (SEQ ID NO: 357) | 1367 | 1472 |
| F10611_T4 (SEQ ID NO: 358) | 1367 | 1472 |
| F10611_T5 (SEQ ID NO: 359) | 1367 | 1472 |
| F10611_T6 (SEQ ID NO: 360) | 1367 | 1472 |
| F10611_T7 (SEQ ID NO: 361) | 1367 | 1472 |
| F10611_T8 (SEQ ID NO: 362) | 1479 | 1584 |
| F10611_T9 (SEQ ID NO: 363) | 1183 | 1288 |
| F10611_T10 (SEQ ID NO: 364) | 2104 | 2209 |
| F10611_T11 (SEQ ID NO: 365) | 1381 | 1486 |
| F10611_T12 (SEQ ID NO: 366) | 1367 | 1472 |
| F10611_T13 (SEQ ID NO: 367) | 1367 | 1472 |
| F10611_T14 (SEQ ID NO: 368) | 1367 | 1472 |
| F10611_T15 (SEQ ID NO: 369) | 1367 | 1472 |
| F10611_T16 (SEQ ID NO: 370) | 1367 | 1472 |
| F10611_T17 (SEQ ID NO: 371) | 1367 | 1472 |
| F10611_T19 (SEQ ID NO: 372) | 1367 | 1472 |
| F10611_T20 (SEQ ID NO: 373) | 1367 | 1472 |
| F10611_T21 (SEQ ID NO: 374) | 691 | 796 |

TABLE 400-continued

Segment location on transcripts

| Transcript name | Segment starting position | Segment ending position |
|---|---|---|
| F10611_T22 (SEQ ID NO: 375) | 458 | 563 |
| F10611_T23 (SEQ ID NO: 376) | 524 | 629 |
| F10611_T31 (SEQ ID NO: 382) | 691 | 796 |

This segment can be found in both coding and non-coding regions of transcript(s) as follows. The segment can be found in a non-coding region of transcript(s) that are related to the following protein(s): F10611_P9, F10611_P11 and F10611_P12. This segment can also be found in the following protein(s): F10611_P29, F10611_P2, F10611_P3, F10611_P4, F10611_P5, F10611_P6, F10611_P7, F10611_P8, F10611_P10, F10611_P13, F10611_P14, F10611_P15, F10611_P16, F10611_P17, F10611_P18, F10611_P19, F10611_P20 and F10611_P27, since it is in the coding region for the corresponding transcript.

Segment cluster F10611_node_32 (SEQ ID NO:432) according to the present invention is supported by 12 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T7 (SEQ ID NO:361), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T21 (SEQ ID NO:374), F10611_T22 (SEQ ID NO:375), F10611_T23 (SEQ ID NO:376) and F10611_T31 (SEQ ID NO:382). Table 401 below describes the starting and ending position of this segment on each transcript.

TABLE 401

Segment location on transcripts

| Transcript name | Segment starting position | Segment ending position |
|---|---|---|
| F10611_T0 (SEQ ID NO: 354) | 1617 | 1644 |
| F10611_T1 (SEQ ID NO: 355) | 1617 | 1644 |
| F10611_T2 (SEQ ID NO: 356) | 3795 | 3822 |
| F10611_T3 (SEQ ID NO: 357) | 1617 | 1644 |
| F10611_T4 (SEQ ID NO: 358) | 1617 | 1644 |
| F10611_T5 (SEQ ID NO: 359) | 1617 | 1644 |
| F10611_T6 (SEQ ID NO: 360) | 1617 | 1644 |
| F10611_T7 (SEQ ID NO: 361) | 1617 | 1644 |
| F10611_T8 (SEQ ID NO: 362) | 3907 | 3934 |
| F10611_T9 (SEQ ID NO: 363) | 1433 | 1460 |
| F10611_T10 (SEQ ID NO: 364) | 4532 | 4559 |
| F10611_T11 (SEQ ID NO: 365) | 3809 | 3836 |
| F10611_T12 (SEQ ID NO: 366) | 1617 | 1644 |
| F10611_T13 (SEQ ID NO: 367) | 1617 | 1644 |
| F10611_T14 (SEQ ID NO: 368) | 1617 | 1644 |
| F10611_T15 (SEQ ID NO: 369) | 1617 | 1644 |
| F10611_T16 (SEQ ID NO: 370) | 1617 | 1644 |
| F10611_T17 (SEQ ID NO: 371) | 1617 | 1644 |
| F10611_T19 (SEQ ID NO: 372) | 2525 | 2552 |
| F10611_T20 (SEQ ID NO: 373) | 1617 | 1644 |
| F10611_T21 (SEQ ID NO: 374) | 3119 | 3146 |
| F10611_T22 (SEQ ID NO: 375) | 708 | 735 |

TABLE 401-continued

Segment location on transcripts

| Transcript name | Segment starting position | Segment ending position |
|---|---|---|
| F10611_T23 (SEQ ID NO: 376) | 2952 | 2979 |
| F10611_T31 (SEQ ID NO: 382) | 2211 | 2238 |

This segment can be found in both coding and non-coding regions of transcript(s) as follows. The segment can be found in a non-coding region of transcript(s) that are related to the following protein(s): F10611_P3, F10611_P9, F10611_P11, F10611_P12, F10611_P20 and F10611_P27. This segment can also be found in the following protein(s): F10611_P29, F10611_P2, F10611_P4, F10611_P5, F10611_P6, F10611_P7, F10611_P8, F10611_P10, F10611_P13, F10611_P14, F10611_P15, F10611_P16, F10611_P17, F10611_P18 and F10611_P19, since it is in the coding region for the corresponding transcript.

Segment cluster F10611_node_33 (SEQ ID NO:433) according to the present invention is supported by 13 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T19 (SEQ ID NO:372), F10611_T20 (SEQ ID NO:373), F10611_T21 (SEQ ID NO:374), F10611_T22 (SEQ ID NO:375), F10611_T23 (SEQ ID NO:376) and F10611_T31 (SEQ ID NO:382). Table 402 below describes the starting and ending position of this segment on each transcript.

TABLE 402

Segment location on transcripts

| Transcript name | Segment starting position | Segment ending position |
|---|---|---|
| F10611_T0 (SEQ ID NO: 354) | 1645 | 1736 |
| F10611_T1 (SEQ ID NO: 355) | 1645 | 1736 |
| F10611_T2 (SEQ ID NO: 356) | 3823 | 3914 |
| F10611_T3 (SEQ ID NO: 357) | 1645 | 1736 |
| F10611_T4 (SEQ ID NO: 358) | 1645 | 1736 |
| F10611_T5 (SEQ ID NO: 359) | 1645 | 1736 |
| F10611_T6 (SEQ ID NO: 360) | 1645 | 1736 |
| F10611_T8 (SEQ ID NO: 362) | 3935 | 4026 |
| F10611_T9 (SEQ ID NO: 363) | 1461 | 1552 |
| F10611_T10 (SEQ ID NO: 364) | 4560 | 4651 |
| F10611_T11 (SEQ ID NO: 365) | 3837 | 3928 |
| F10611_T12 (SEQ ID NO: 366) | 1645 | 1736 |
| F10611_T13 (SEQ ID NO: 367) | 1645 | 1736 |
| F10611_T14 (SEQ ID NO: 368) | 1645 | 1736 |
| F10611_T15 (SEQ ID NO: 369) | 1645 | 1736 |
| F10611_T16 (SEQ ID NO: 370) | 1645 | 1736 |
| F10611_T17 (SEQ ID NO: 371) | 1645 | 1736 |
| F10611_T19 (SEQ ID NO: 372) | 2553 | 2644 |
| F10611_T20 (SEQ ID NO: 373) | 1645 | 1736 |
| F10611_T21 (SEQ ID NO: 374) | 3147 | 3238 |
| F10611_T22 (SEQ ID NO: 375) | 736 | 827 |
| F10611_T23 (SEQ ID NO: 376) | 2980 | 3071 |
| F10611_T31 (SEQ ID NO: 382) | 2239 | 2330 |

This segment can be found in both coding and non-coding regions of transcript(s) as follows. The segment can be found in a non-coding region of transcript(s) that are related to the following protein(s): F10611_P3, F10611_P9, F10611_P11, F10611_P12, F10611_P20 and F10611_P27. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17, F10611_P18 and F10611_P19, since it is in the coding region for the corresponding transcript.

Segment cluster F10611_node_36 (SEQ ID NO:434) according to the present invention is supported by 1 libraries. The number of libraries was determined as previously described. This segment can be found in the following transcript(s): F10611_T2 (SEQ ID NO:356), F10611_T8 (SEQ ID NO:362), F10611_T10 (SEQ ID NO:364), F10611_T1 (SEQ ID NO:365), F10611_T21 (SEQ ID NO:374) and F10611_T23 (SEQ ID NO:376). Table 403 below describes the starting and ending position of this segment on each transcript.

TABLE 403

Segment location on transcripts

| Transcript name | Segment starting position | Segment ending position |
| --- | --- | --- |
| F10611_T2 (SEQ ID NO: 356) | 3915 | 3970 |
| F10611_T8 (SEQ ID NO: 362) | 4027 | 4082 |
| F10611_T10 (SEQ ID NO: 364) | 4652 | 4707 |
| F10611_T11 (SEQ ID NO: 365) | 3929 | 3984 |
| F10611_T21 (SEQ ID NO: 374) | 3239 | 3294 |
| F10611_T23 (SEQ ID NO: 376) | 3072 | 3127 |

This segment can be found in a non-coding region of transcript(s) that are related to the following protein(s): F10611_P3, F10611_P9, F10611_P11, F10611_P12 and F10611_P20.

Segment cluster F10611_node_40 (SEQ ID NO:435) according to the present invention is supported by 13 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 404 below describes the starting and ending position of this segment on each transcript.

TABLE 404

Segment location on transcripts

| Transcript name | Segment starting position | Segment ending position |
| --- | --- | --- |
| F10611_T0 (SEQ ID NO: 354) | 1908 | 1958 |
| F10611_T1 (SEQ ID NO: 355) | 1908 | 1958 |
| F10611_T2 (SEQ ID NO: 356) | 4142 | 4192 |
| F10611_T3 (SEQ ID NO: 357) | 1908 | 1958 |
| F10611_T4 (SEQ ID NO: 358) | 1908 | 1958 |
| F10611_T5 (SEQ ID NO: 359) | 1908 | 1958 |
| F10611_T6 (SEQ ID NO: 360) | 1908 | 1958 |
| F10611_T8 (SEQ ID NO: 362) | 4254 | 4304 |
| F10611_T9 (SEQ ID NO: 363) | 1724 | 1774 |
| F10611_T10 (SEQ ID NO: 364) | 4879 | 4929 |
| F10611_T11 (SEQ ID NO: 365) | 4156 | 4206 |
| F10611_T12 (SEQ ID NO: 366) | 1908 | 1958 |
| F10611_T13 (SEQ ID NO: 367) | 1908 | 1958 |
| F10611_T14 (SEQ ID NO: 368) | 1908 | 1958 |
| F10611_T15 (SEQ ID NO: 369) | 1908 | 1958 |
| F10611_T16 (SEQ ID NO: 370) | 1908 | 1958 |
| F10611_T17 (SEQ ID NO: 371) | 1908 | 1958 |
| F10611_T21 (SEQ ID NO: 374) | 3466 | 3516 |
| F10611_T22 (SEQ ID NO: 375) | 999 | 1049 |
| F10611_T23 (SEQ ID NO: 376) | 3299 | 3349 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_42 (SEQ ID NO:436) according to the present invention is supported by 12 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 405 below describes the starting and ending position of this segment on each transcript.

TABLE 405

Segment location on transcripts

| Transcript name | Segment starting position | Segment ending position |
| --- | --- | --- |
| F10611_T0 (SEQ ID NO: 354) | 1959 | 2012 |
| F10611_T1 (SEQ ID NO: 355) | 1959 | 2012 |
| F10611_T2 (SEQ ID NO: 356) | 4193 | 4246 |
| F10611_T3 (SEQ ID NO: 357) | 1959 | 2012 |
| F10611_T4 (SEQ ID NO: 358) | 1959 | 2012 |
| F10611_T5 (SEQ ID NO: 359) | 1959 | 2012 |
| F10611_T6 (SEQ ID NO: 360) | 1959 | 2012 |
| F10611_T8 (SEQ ID NO: 362) | 4305 | 4358 |
| F10611_T9 (SEQ ID NO: 363) | 1775 | 1828 |
| F10611_T10 (SEQ ID NO: 364) | 4930 | 4983 |
| F10611_T11 (SEQ ID NO: 365) | 4207 | 4260 |
| F10611_T12 (SEQ ID NO: 366) | 1959 | 2012 |

TABLE 405-continued

Segment location on transcripts

| Transcript name | Segment starting position | Segment ending position |
|---|---|---|
| F10611_T13 (SEQ ID NO: 367) | 1959 | 2012 |
| F10611_T14 (SEQ ID NO: 368) | 1959 | 2012 |
| F10611_T15 (SEQ ID NO: 369) | 1959 | 2012 |
| F10611_T16 (SEQ ID NO: 370) | 1959 | 2012 |
| F10611_T17 (SEQ ID NO: 371) | 1959 | 2012 |
| F10611_T21 (SEQ ID NO: 374) | 3517 | 3570 |
| F10611_T22 (SEQ ID NO: 375) | 1050 | 1103 |
| F10611_T23 (SEQ ID NO: 376) | 3350 | 3403 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_50 (SEQ ID NO:437) according to the present invention is supported by 7 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 406 below describes the starting and ending position of this segment on each transcript.

TABLE 406

Segment location on transcripts

| Transcript name | Segment starting position | Segment ending position |
|---|---|---|
| F10611_T0 (SEQ ID NO: 354) | 2154 | 2249 |
| F10611_T1 (SEQ ID NO: 355) | 2280 | 2375 |
| F10611_T2 (SEQ ID NO: 356) | 4514 | 4609 |
| F10611_T3 (SEQ ID NO: 357) | 2280 | 2375 |
| F10611_T4 (SEQ ID NO: 358) | 2280 | 2375 |
| F10611_T5 (SEQ ID NO: 359) | 2280 | 2375 |
| F10611_T6 (SEQ ID NO: 360) | 2280 | 2375 |
| F10611_T8 (SEQ ID NO: 362) | 4626 | 4721 |
| F10611_T9 (SEQ ID NO: 363) | 2096 | 2191 |
| F10611_T10 (SEQ ID NO: 364) | 5251 | 5346 |
| F10611_T11 (SEQ ID NO: 365) | 4528 | 4623 |
| F10611_T12 (SEQ ID NO: 366) | 2280 | 2375 |
| F10611_T13 (SEQ ID NO: 367) | 2280 | 2375 |
| F10611_T14 (SEQ ID NO: 368) | 2280 | 2375 |
| F10611_T15 (SEQ ID NO: 369) | 2280 | 2375 |
| F10611_T16 (SEQ ID NO: 370) | 2280 | 2375 |
| F10611_T17 (SEQ ID NO: 371) | 2280 | 2375 |
| F10611_T21 (SEQ ID NO: 374) | 3838 | 3933 |
| F10611_T22 (SEQ ID NO: 375) | 1371 | 1466 |
| F10611_T23 (SEQ ID NO: 376) | 3671 | 3766 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_52 (SEQ ID NO:438) according to the present invention is supported by 5 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 407 below describes the starting and ending position of this segment on each transcript.

TABLE 407

Segment location on transcripts

| Transcript name | Segment starting position | Segment ending position |
|---|---|---|
| F10611_T0 (SEQ ID NO: 354) | 2250 | 2366 |
| F10611_T1 (SEQ ID NO: 355) | 2376 | 2492 |
| F10611_T2 (SEQ ID NO: 356) | 4610 | 4726 |
| F10611_T3 (SEQ ID NO: 357) | 2376 | 2492 |
| F10611_T4 (SEQ ID NO: 358) | 2376 | 2492 |
| F10611_T5 (SEQ ID NO: 359) | 2376 | 2492 |
| F10611_T6 (SEQ ID NO: 360) | 2376 | 2492 |
| F10611_T8 (SEQ ID NO: 362) | 4722 | 4838 |
| F10611_T9 (SEQ ID NO: 363) | 2192 | 2308 |
| F10611_T10 (SEQ ID NO: 364) | 5347 | 5463 |
| F10611_T11 (SEQ ID NO: 365) | 4624 | 4740 |
| F10611_T12 (SEQ ID NO: 366) | 2376 | 2492 |
| F10611_T13 (SEQ ID NO: 367) | 2376 | 2492 |
| F10611_T14 (SEQ ID NO: 368) | 2376 | 2492 |
| F10611_T15 (SEQ ID NO: 369) | 2376 | 2492 |
| F10611_T16 (SEQ ID NO: 370) | 2376 | 2492 |
| F10611_T17 (SEQ ID NO: 371) | 2376 | 2492 |
| F10611_T21 (SEQ ID NO: 374) | 3934 | 4050 |
| F10611_T22 (SEQ ID NO: 375) | 1467 | 1583 |
| F10611_T23 (SEQ ID NO: 376) | 3767 | 3883 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_54 (SEQ ID NO:439) according to the present invention is supported by 5 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T1 (SEQ ID NO:365), F10611_T12 (SEQ ID NO:366), F10611_T13 (SEQ ID NO:367), F10611_T14 (SEQ ID NO:368), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 408 below describes the starting and ending position of this segment on each transcript.

TABLE 408

Segment location on transcripts

| Transcript name | Segment starting position | Segment ending position |
|---|---|---|
| F10611_T0 (SEQ ID NO: 354) | 2367 | 2476 |
| F10611_T1 (SEQ ID NO: 355) | 2493 | 2602 |
| F10611_T2 (SEQ ID NO: 356) | 4727 | 4836 |
| F10611_T3 (SEQ ID NO: 357) | 2493 | 2602 |
| F10611_T4 (SEQ ID NO: 358) | 2493 | 2602 |
| F10611_T5 (SEQ ID NO: 359) | 2493 | 2602 |
| F10611_T6 (SEQ ID NO: 360) | 2493 | 2602 |
| F10611_T8 (SEQ ID NO: 362) | 4839 | 4948 |
| F10611_T9 (SEQ ID NO: 363) | 2309 | 2418 |
| F10611_T10 (SEQ ID NO: 364) | 5464 | 5573 |
| F10611_T11 (SEQ ID NO: 365) | 4741 | 4850 |
| F10611_T12 (SEQ ID NO: 366) | 2493 | 2602 |
| F10611_T13 (SEQ ID NO: 367) | 2493 | 2602 |
| F10611_T14 (SEQ ID NO: 368) | 2493 | 2602 |
| F10611_T15 (SEQ ID NO: 369) | 2493 | 2602 |
| F10611_T16 (SEQ ID NO: 370) | 2493 | 2602 |
| F10611_T17 (SEQ ID NO: 371) | 2493 | 2602 |
| F10611_T21 (SEQ ID NO: 374) | 4051 | 4160 |
| F10611_T22 (SEQ ID NO: 375) | 1584 | 1693 |
| F10611_T23 (SEQ ID NO: 376) | 3884 | 3993 |

This segment can be found in both coding and non-coding regions of transcript(s) as follows. The segment can be found in a non-coding region of transcript(s) that are related to the following protein(s): F10611_P3, F10611_P9, F10611_P1, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P15, F10611_P16, F10611_P17 and F10611_P18, since it is in the coding region for the corresponding transcript.

Segment cluster F10611_node_57 (SEQ ID NO:440) according to the present invention is supported by 4 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 409 below describes the starting and ending position of this segment on each transcript.

TABLE 409

Segment location on transcripts

| Transcript name | Segment starting position | Segment ending position |
|---|---|---|
| F10611_T0 (SEQ ID NO: 354) | 2608 | 2651 |
| F10611_T1 (SEQ ID NO: 355) | 2734 | 2777 |
| F10611_T2 (SEQ ID NO: 356) | 4968 | 5011 |
| F10611_T3 (SEQ ID NO: 357) | 2734 | 2777 |
| F10611_T4 (SEQ ID NO: 358) | 2734 | 2777 |
| F10611_T5 (SEQ ID NO: 359) | 2734 | 2777 |
| F10611_T6 (SEQ ID NO: 360) | 2734 | 2777 |
| F10611_T8 (SEQ ID NO: 362) | 5080 | 5123 |
| F10611_T9 (SEQ ID NO: 363) | 2550 | 2593 |
| F10611_T10 (SEQ ID NO: 364) | 5705 | 5748 |
| F10611_T11 (SEQ ID NO: 365) | 4982 | 5025 |
| F10611_T12 (SEQ ID NO: 366) | 2734 | 2777 |
| F10611_T13 (SEQ ID NO: 367) | 2734 | 2777 |
| F10611_T15 (SEQ ID NO: 369) | 2734 | 2777 |
| F10611_T16 (SEQ ID NO: 370) | 2734 | 2777 |
| F10611_T17 (SEQ ID NO: 371) | 2734 | 2777 |
| F10611_T21 (SEQ ID NO: 374) | 4292 | 4335 |
| F10611_T22 (SEQ ID NO: 375) | 1825 | 1868 |
| F10611_T23 (SEQ ID NO: 376) | 4125 | 4168 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 410.

TABLE 410

Oligonucleotides related to this segment

| Oligonucleotide name | Overexpressed in cancers | Chip reference |
|---|---|---|
| F10611_0_0_6663 | lung malignant tumors | LUN |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P18, since it is in the coding region for the corresponding transcript.

Segment cluster F10611_node_61 (SEQ ID NO:441) according to the present invention is supported by 8 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T17 (SEQ ID NO:371), F10611_T21 (SEQ ID NO:374), F10611_T22 (SEQ ID NO:375) and F10611_T23 (SEQ ID NO:376). Table 411 below describes the starting and ending position of this segment on each transcript.

TABLE 411

Segment location on transcripts

| Transcript name | Segment starting position | Segment ending position |
|---|---|---|
| F10611_T0 (SEQ ID NO: 354) | 2850 | 2903 |
| F10611_T1 (SEQ ID NO: 355) | 2976 | 3029 |
| F10611_T2 (SEQ ID NO: 356) | 5210 | 5263 |
| F10611_T3 (SEQ ID NO: 357) | 2976 | 3029 |
| F10611_T4 (SEQ ID NO: 358) | 2976 | 3029 |
| F10611_T5 (SEQ ID NO: 359) | 2976 | 3029 |
| F10611_T6 (SEQ ID NO: 360) | 2976 | 3029 |
| F10611_T8 (SEQ ID NO: 362) | 5322 | 5375 |
| F10611_T9 (SEQ ID NO: 363) | 2792 | 2845 |
| F10611_T10 (SEQ ID NO: 364) | 5947 | 6000 |
| F10611_T11 (SEQ ID NO: 365) | 5224 | 5277 |
| F10611_T12 (SEQ ID NO: 366) | 2976 | 3029 |
| F10611_T13 (SEQ ID NO: 367) | 2976 | 3029 |
| F10611_T15 (SEQ ID NO: 369) | 2976 | 3029 |
| F10611_T16 (SEQ ID NO: 370) | 2976 | 3029 |
| F10611_T17 (SEQ ID NO: 371) | 2976 | 3029 |
| F10611_T21 (SEQ ID NO: 374) | 4534 | 4587 |
| F10611_T22 (SEQ ID NO: 375) | 2067 | 2120 |
| F10611_T23 (SEQ ID NO: 376) | 4367 | 4420 |

This segment can be found in both coding and non-coding regions of transcript(s) as follows. The segment can be found in a non-coding region of transcript(s) that are related to the following protein(s): F10611_P3, F10611_P9, F10611_P111, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P18, since it is in the coding region for the corresponding transcript.

Segment cluster F10611_node_64 (SEQ ID NO:442) according to the present invention can be found in the following transcript(s): F10611_T17 (SEQ ID NO:371). Table 412 below describes the starting and ending position of this segment on each transcript.

TABLE 412

Segment location on transcripts

| Transcript name | Segment starting position | Segment ending position |
|---|---|---|
| F10611_T17 (SEQ ID NO: 371) | 3228 | 3247 |

This segment can be found in the following protein(s): F10611_P18.

Segment cluster F10611_node_71 (SEQ ID NO:443) according to the present invention is supported by 7 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375), F10611_T23 (SEQ ID NO:376) and F10611_T25 (SEQ ID NO:378). Table 413 below describes the starting and ending position of this segment on each transcript.

TABLE 413

Segment location on transcripts

| Transcript name | Segment starting position | Segment ending position |
|---|---|---|
| F10611_T0 (SEQ ID NO: 354) | 3432 | 3536 |
| F10611_T1 (SEQ ID NO: 355) | 3558 | 3662 |
| F10611_T2 (SEQ ID NO: 356) | 5792 | 5896 |
| F10611_T3 (SEQ ID NO: 357) | 3558 | 3662 |
| F10611_T4 (SEQ ID NO: 358) | 3558 | 3662 |
| F10611_T5 (SEQ ID NO: 359) | 3558 | 3662 |
| F10611_T6 (SEQ ID NO: 360) | 3558 | 3662 |
| F10611_T8 (SEQ ID NO: 362) | 5904 | 6008 |
| F10611_T9 (SEQ ID NO: 363) | 3374 | 3478 |
| F10611_T10 (SEQ ID NO: 364) | 6529 | 6633 |
| F10611_T11 (SEQ ID NO: 365) | 5806 | 5910 |
| F10611_T12 (SEQ ID NO: 366) | 3558 | 3662 |
| F10611_T13 (SEQ ID NO: 367) | 3558 | 3662 |
| F10611_T15 (SEQ ID NO: 369) | 3558 | 3662 |
| F10611_T16 (SEQ ID NO: 370) | 3558 | 3662 |
| F10611_T21 (SEQ ID NO: 374) | 5116 | 5220 |
| F10611_T22 (SEQ ID NO: 375) | 2649 | 2753 |
| F10611_T23 (SEQ ID NO: 376) | 4949 | 5053 |
| F10611_T25 (SEQ ID NO: 378) | 207 | 311 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17 and F10611_P22, since it is in the coding region for the corresponding transcript.

Segment cluster F10611_node_75 (SEQ ID NO:444) according to the present invention is supported by 7 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T11 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377) and F10611_T25 (SEQ ID NO:378). Table 414 below describes the starting and ending position of this segment on each transcript.

TABLE 414

Segment location on transcripts

| Transcript name | Segment starting position | Segment ending position |
|---|---|---|
| F10611_T0 (SEQ ID NO: 354) | 3678 | 3785 |
| F10611_T1 (SEQ ID NO: 355) | 3804 | 3911 |
| F10611_T2 (SEQ ID NO: 356) | 6038 | 6145 |
| F10611_T3 (SEQ ID NO: 357) | 3804 | 3911 |
| F10611_T4 (SEQ ID NO: 358) | 3804 | 3911 |
| F10611_T5 (SEQ ID NO: 359) | 3804 | 3911 |
| F10611_T6 (SEQ ID NO: 360) | 3804 | 3911 |
| F10611_T8 (SEQ ID NO: 362) | 6150 | 6257 |
| F10611_T9 (SEQ ID NO: 363) | 3620 | 3727 |

TABLE 414-continued

Segment location on transcripts

| Transcript name | Segment starting position | Segment ending position |
|---|---|---|
| F10611_T10 (SEQ ID NO: 364) | 6775 | 6882 |
| F10611_T11 (SEQ ID NO: 365) | 6052 | 6159 |
| F10611_T12 (SEQ ID NO: 366) | 3804 | 3911 |
| F10611_T13 (SEQ ID NO: 367) | 3804 | 3911 |
| F10611_T15 (SEQ ID NO: 369) | 3804 | 3911 |
| F10611_T16 (SEQ ID NO: 370) | 3804 | 3911 |
| F10611_T21 (SEQ ID NO: 374) | 5362 | 5469 |
| F10611_T22 (SEQ ID NO: 375) | 2895 | 3002 |
| F10611_T23 (SEQ ID NO: 376) | 5195 | 5302 |
| F10611_T24 (SEQ ID NO: 377) | 588 | 695 |
| F10611_T25 (SEQ ID NO: 378) | 453 | 560 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21 and F10611_P22, since it is in the coding region for the corresponding transcript.

Segment cluster F10611_node_77 (SEQ ID NO:445) according to the present invention is supported by 1 libraries. The number of libraries was determined as previously described. This segment can be found in the following transcript(s): F10611_T26 (SEQ ID NO:379). Table 415 below describes the starting and ending position of this segment on each transcript.

TABLE 415

Segment location on transcripts

| Transcript name | Segment starting position | Segment ending position |
|---|---|---|
| F10611_T26 (SEQ ID NO: 379) | 1 | 44 |

This segment can be found in a non-coding region of transcript(s) that are related to the following protein(s): F10611_P23.

Segment cluster F10611_node_78 (SEQ ID NO:446) according to the present invention is supported by 2 libraries. The number of libraries was determined as previously described. This segment can be found in the following transcript(s): F10611_T0 (SEQ ID NO:354) and F10611_T26 (SEQ ID NO:379). Table 416 below describes the starting and ending position of this segment on each transcript.

TABLE 416

Segment location on transcripts

| Transcript name | Segment starting position | Segment ending position |
|---|---|---|
| F10611_T0 (SEQ ID NO: 354) | 3786 | 3830 |
| F10611_T26 (SEQ ID NO: 379) | 45 | 89 |

This segment can be found in both coding and non-coding regions of transcript(s) as follows. The segment can be found in a non-coding region of transcript(s) that are related to the following protein(s): F10611_P23. This segment can also be found in the following protein(s): F10611_P29, since it is in the coding region for the corresponding transcript.

Segment cluster F10611_node_79 (SEQ ID NO:447) according to the present invention is supported by 8 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 417 below describes the starting and ending position of this segment on each transcript.

TABLE 417

Segment location on transcripts

| Transcript name | Segment starting position | Segment ending position |
|---|---|---|
| F10611_T0 (SEQ ID NO: 354) | 3831 | 3948 |
| F10611_T1 (SEQ ID NO: 355) | 3912 | 4029 |
| F10611_T2 (SEQ ID NO: 356) | 6146 | 6263 |
| F10611_T3 (SEQ ID NO: 357) | 3912 | 4029 |
| F10611_T4 (SEQ ID NO: 358) | 3912 | 4029 |
| F10611_T5 (SEQ ID NO: 359) | 3912 | 4029 |
| F10611_T6 (SEQ ID NO: 360) | 3912 | 4029 |
| F10611_T8 (SEQ ID NO: 362) | 6258 | 6375 |
| F10611_T9 (SEQ ID NO: 363) | 3728 | 3845 |
| F10611_T10 (SEQ ID NO: 364) | 6883 | 7000 |
| F10611_T11 (SEQ ID NO: 365) | 6160 | 6277 |
| F10611_T12 (SEQ ID NO: 366) | 3912 | 4029 |
| F10611_T13 (SEQ ID NO: 367) | 3912 | 4029 |
| F10611_T15 (SEQ ID NO: 369) | 3912 | 4029 |
| F10611_T16 (SEQ ID NO: 370) | 3912 | 4029 |
| F10611_T21 (SEQ ID NO: 374) | 5470 | 5587 |
| F10611_T22 (SEQ ID NO: 375) | 3003 | 3120 |
| F10611_T23 (SEQ ID NO: 376) | 5303 | 5420 |
| F10611_T24 (SEQ ID NO: 377) | 696 | 813 |
| F10611_T25 (SEQ ID NO: 378) | 561 | 678 |
| F10611_T26 (SEQ ID NO: 379) | 90 | 207 |

This segment can be found in both coding and non-coding regions of transcript(s) as follows. The segment can be found in a non-coding region of transcript(s) that are related to the following protein(s): F10611_P3, F10611_P9, F10611_P11, F10611_P12, F10611_P20 and F10611_P23. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21 and F10611_P22, since it is in the coding region for the corresponding transcript.

Segment cluster F10611_node_87 (SEQ ID NO:448) according to the present invention is supported by 11 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T11 (SEQ ID NO:369), F10611_T16 (SEQ ID NO:370), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 418 below describes the starting and ending position of this segment on each transcript.

TABLE 418

Segment location on transcripts

| Transcript name | Segment starting position | Segment ending position |
|---|---|---|
| F10611_T0 (SEQ ID NO: 354) | 4433 | 4524 |
| F10611_T1 (SEQ ID NO: 355) | 4514 | 4605 |
| F10611_T2 (SEQ ID NO: 356) | 6748 | 6839 |
| F10611_T3 (SEQ ID NO: 357) | 4514 | 4605 |
| F10611_T4 (SEQ ID NO: 358) | 4514 | 4605 |
| F10611_T5 (SEQ ID NO: 359) | 4514 | 4605 |
| F10611_T6 (SEQ ID NO: 360) | 4514 | 4605 |
| F10611_T8 (SEQ ID NO: 362) | 6860 | 6951 |
| F10611_T9 (SEQ ID NO: 363) | 4330 | 4421 |
| F10611_T10 (SEQ ID NO: 364) | 7485 | 7576 |
| F10611_T11 (SEQ ID NO: 365) | 6762 | 6853 |
| F10611_T12 (SEQ ID NO: 366) | 4514 | 4605 |
| F10611_T13 (SEQ ID NO: 367) | 4514 | 4605 |
| F10611_T15 (SEQ ID NO: 369) | 4514 | 4605 |
| F10611_T16 (SEQ ID NO: 370) | 4514 | 4605 |
| F10611_T21 (SEQ ID NO: 374) | 6072 | 6163 |
| F10611_T22 (SEQ ID NO: 375) | 3605 | 3696 |
| F10611_T23 (SEQ ID NO: 376) | 5905 | 5996 |
| F10611_T24 (SEQ ID NO: 377) | 1298 | 1389 |
| F10611_T25 (SEQ ID NO: 378) | 1163 | 1254 |
| F10611_T26 (SEQ ID NO: 379) | 692 | 783 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P17, F10611_P21, F10611_P22 and F10611_P23, since it is in the coding region for the corresponding transcript.

Segment cluster F10611_node_89 (SEQ ID NO:449) according to the present invention is supported by 2 libraries. The number of libraries was determined as previously described. This segment can be found in the following transcript(s): F10611_T16 (SEQ ID NO:370). Table 419 below describes the starting and ending position of this segment on each transcript.

TABLE 419

Segment location on transcripts

| Transcript name | Segment starting position | Segment ending position |
|---|---|---|
| F10611_T16 (SEQ ID NO: 370) | 4606 | 4695 |

This segment can be found in the following protein(s): F10611_P17.

Segment cluster F10611_node_91 (SEQ ID NO:450) according to the present invention is supported by 12 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T15 (SEQ ID NO:369), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378) and F10611_T26 (SEQ ID NO:379). Table 420 below describes the starting and ending position of this segment on each transcript.

TABLE 420

Segment location on transcripts

| Transcript name | Segment starting position | Segment ending position |
|---|---|---|
| F10611_T0 (SEQ ID NO: 354) | 4525 | 4629 |
| F10611_T1 (SEQ ID NO: 355) | 4606 | 4710 |
| F10611_T2 (SEQ ID NO: 356) | 6840 | 6944 |
| F10611_T3 (SEQ ID NO: 357) | 4606 | 4710 |
| F10611_T4 (SEQ ID NO: 358) | 4606 | 4710 |
| F10611_T5 (SEQ ID NO: 359) | 4606 | 4710 |
| F10611_T6 (SEQ ID NO: 360) | 4606 | 4710 |
| F10611_T8 (SEQ ID NO: 362) | 6952 | 7056 |
| F10611_T9 (SEQ ID NO: 363) | 4422 | 4526 |
| F10611_T10 (SEQ ID NO: 364) | 7577 | 7681 |
| F10611_T11 (SEQ ID NO: 365) | 6854 | 6958 |
| F10611_T12 (SEQ ID NO: 366) | 4606 | 4710 |
| F10611_T13 (SEQ ID NO: 367) | 4606 | 4710 |
| F10611_T15 (SEQ ID NO: 369) | 4606 | 4710 |
| F10611_T21 (SEQ ID NO: 374) | 6164 | 6268 |
| F10611_T22 (SEQ ID NO: 375) | 3697 | 3801 |
| F10611_T23 (SEQ ID NO: 376) | 5997 | 6101 |
| F10611_T24 (SEQ ID NO: 377) | 1390 | 1494 |
| F10611_T25 (SEQ ID NO: 378) | 1255 | 1359 |
| F10611_T26 (SEQ ID NO: 379) | 784 | 888 |

This segment can be found in both coding and non-coding regions of transcript(s) as follows. The segment can be found in a non-coding region of transcript(s) that are related to the following protein(s): F10611_P3, F10611_P9, F10611_P11, F10611_P12 and F10611_P20. This segment can also be found in the following protein(s): F10611_P29, F10611_P2, F10611_P4, F10611_P5, F10611_P6, F10611_P7, F10611_P10, F10611_P13, F10611_P14, F10611_P16, F10611_P21, F10611_P22 and F10611_P23, since it is in the coding region for the corresponding transcript.

Segment cluster F10611_node_98 (SEQ ID NO:451) according to the present invention is supported by 5 libraries. The number of libraries was determined as previously described. This segment can be found in the following transcript(s): F10611_T3 (SEQ ID NO:357) and F10611_T4 (SEQ ID NO:358). Table 421 below describes the starting and ending position of this segment on each transcript.

TABLE 421

Segment location on transcripts

| Transcript name | Segment starting position | Segment ending position |
|---|---|---|
| F10611_T3 (SEQ ID NO: 357) | 4881 | 4925 |
| F10611_T4 (SEQ ID NO: 358) | 4881 | 4925 |

This segment can be found in the following protein(s): F10611_P4 and F10611_P5.

Segment cluster F10611_node_100 (SEQ ID NO:452) according to the present invention is supported by 17 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379) and F10611_T28 (SEQ ID NO:381). Table 422 below describes the starting and ending position of this segment on each transcript.

TABLE 422

Segment location on transcripts

| Transcript name | Segment starting position | Segment ending position |
|---|---|---|
| F10611_T0 (SEQ ID NO: 354) | 4800 | 4880 |
| F10611_T1 (SEQ ID NO: 355) | 4881 | 4961 |
| F10611_T2 (SEQ ID NO: 356) | 7115 | 7195 |
| F10611_T3 (SEQ ID NO: 357) | 4926 | 5006 |
| F10611_T4 (SEQ ID NO: 358) | 5354 | 5434 |
| F10611_T5 (SEQ ID NO: 359) | 4881 | 4961 |
| F10611_T6 (SEQ ID NO: 360) | 4881 | 4961 |
| F10611_T8 (SEQ ID NO: 362) | 7227 | 7307 |
| F10611_T9 (SEQ ID NO: 363) | 4697 | 4777 |
| F10611_T10 (SEQ ID NO: 364) | 7852 | 7932 |
| F10611_T11 (SEQ ID NO: 365) | 7129 | 7209 |
| F10611_T12 (SEQ ID NO: 366) | 4881 | 4961 |
| F10611_T13 (SEQ ID NO: 367) | 4881 | 4961 |
| F10611_T21 (SEQ ID NO: 374) | 6439 | 6519 |
| F10611_T22 (SEQ ID NO: 375) | 3972 | 4052 |
| F10611_T23 (SEQ ID NO: 376) | 6272 | 6352 |
| F10611_T24 (SEQ ID NO: 377) | 1665 | 1745 |
| F10611_T25 (SEQ ID NO: 378) | 1530 | 1610 |
| F10611_T26 (SEQ ID NO: 379) | 1059 | 1139 |
| F10611_T28 (SEQ ID NO: 381) | 358 | 438 |

This segment can be found in both coding and non-coding regions of transcript(s) as follows. The segment can be found in a non-coding region of transcript(s) that are related to the following protein(s): F10611_P3, F10611_P5, F10611_P9, F10611_P11, F10611_P12 and F10611_P20. This segment can also be found in the following protein(s): F10611_P29, F10611_P2, F10611_P4, F10611_P6, F10611_P7, F10611_P10, F10611_P13, F10611_P14, F10611_P21, F10611_P22, F10611_P23 and F10611_P25, since it is in the coding region for the corresponding transcript.

Segment cluster F10611_node_107 (SEQ ID NO:453) according to the present invention is supported by 24 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 423 below describes the starting and ending position of this segment on each transcript.

TABLE 423

Segment location on transcripts

| Transcript name | Segment starting position | Segment ending position |
|---|---|---|
| F10611_T0 (SEQ ID NO: 354) | 5157 | 5249 |
| F10611_T1 (SEQ ID NO: 355) | 5238 | 5330 |
| F10611_T2 (SEQ ID NO: 356) | 7472 | 7564 |
| F10611_T3 (SEQ ID NO: 357) | 5283 | 5375 |
| F10611_T4 (SEQ ID NO: 358) | 5711 | 5803 |
| F10611_T5 (SEQ ID NO: 359) | 5102 | 5194 |
| F10611_T6 (SEQ ID NO: 360) | 5238 | 5330 |
| F10611_T8 (SEQ ID NO: 362) | 7584 | 7676 |
| F10611_T9 (SEQ ID NO: 363) | 5054 | 5146 |
| F10611_T10 (SEQ ID NO: 364) | 8209 | 8301 |
| F10611_T11 (SEQ ID NO: 365) | 7486 | 7578 |
| F10611_T12 (SEQ ID NO: 366) | 5238 | 5330 |
| F10611_T13 (SEQ ID NO: 367) | 5238 | 5330 |
| F10611_T21 (SEQ ID NO: 374) | 6796 | 6888 |
| F10611_T22 (SEQ ID NO: 375) | 4329 | 4421 |
| F10611_T23 (SEQ ID NO: 376) | 6629 | 6721 |
| F10611_T24 (SEQ ID NO: 377) | 2022 | 2114 |
| F10611_T25 (SEQ ID NO: 378) | 1887 | 1979 |
| F10611_T26 (SEQ ID NO: 379) | 1416 | 1508 |
| F10611_T27 (SEQ ID NO: 380) | 875 | 967 |
| F10611_T28 (SEQ ID NO: 381) | 715 | 807 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P11, F10611_P12 and F10611_P20. This segment can also be found in the following protein(s): F10611_P29, F10611_P2, F10611_P4, F10611_P7, F10611_P10, F10611_P13, F10611_P14, F10611_P21, F10611_P22, F10611_P23, F10611_P24 and F10611_P25, since it is in the coding region for the corresponding transcript.

Segment cluster F10611_node_109 (SEQ ID NO:454) according to the present invention is supported by 25 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 424 below describes the starting and ending position of this segment on each transcript.

TABLE 424

Segment location on transcripts

| Transcript name | Segment starting position | Segment ending position |
|---|---|---|
| F10611_T0 (SEQ ID NO: 354) | 5250 | 5358 |
| F10611_T1 (SEQ ID NO: 355) | 5331 | 5439 |
| F10611_T2 (SEQ ID NO: 356) | 7565 | 7673 |
| F10611_T3 (SEQ ID NO: 357) | 5376 | 5484 |

TABLE 424-continued

Segment location on transcripts

| Transcript name | Segment starting position | Segment ending position |
|---|---|---|
| F10611_T4 (SEQ ID NO: 358) | 5804 | 5912 |
| F10611_T5 (SEQ ID NO: 359) | 5195 | 5303 |
| F10611_T6 (SEQ ID NO: 360) | 5331 | 5439 |
| F10611_T8 (SEQ ID NO: 362) | 7677 | 7785 |
| F10611_T9 (SEQ ID NO: 363) | 5147 | 5255 |
| F10611_T10 (SEQ ID NO: 364) | 8302 | 8410 |
| F10611_T11 (SEQ ID NO: 365) | 7579 | 7687 |
| F10611_T12 (SEQ ID NO: 366) | 5331 | 5439 |
| F10611_T13 (SEQ ID NO: 367) | 5331 | 5439 |
| F10611_T21 (SEQ ID NO: 374) | 6889 | 6997 |
| F10611_T22 (SEQ ID NO: 375) | 4422 | 4530 |
| F10611_T23 (SEQ ID NO: 376) | 6722 | 6830 |
| F10611_T24 (SEQ ID NO: 377) | 2115 | 2223 |
| F10611_T25 (SEQ ID NO: 378) | 1980 | 2088 |
| F10611_T26 (SEQ ID NO: 379) | 1509 | 1617 |
| F10611_T27 (SEQ ID NO: 380) | 968 | 1076 |
| F10611_T28 (SEQ ID NO: 381) | 808 | 916 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P11, F10611_P12 and F10611_P20. This segment can also be found in the following protein(s): F10611_P29, F10611_P2, F10611_P4, F10611_P7, F10611_P10, F10611_P13, F10611_P14, F10611_P21, F10611_P22, F10611_P23, F10611_P24 and F10611_P25, since it is in the coding region for the corresponding transcript.

Segment cluster F10611_node__113 (SEQ ID NO:455) according to the present invention is supported by 21 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T13 (SEQ ID NO:367), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 425 below describes the starting and ending position of this segment on each transcript.

TABLE 425

Segment location on transcripts

| Transcript name | Segment starting position | Segment ending position |
|---|---|---|
| F10611_T0 (SEQ ID NO: 354) | 5488 | 5568 |
| F10611_T1 (SEQ ID NO: 355) | 5569 | 5649 |
| F10611_T2 (SEQ ID NO: 356) | 7803 | 7883 |
| F10611_T3 (SEQ ID NO: 357) | 5614 | 5694 |
| F10611_T4 (SEQ ID NO: 358) | 6042 | 6122 |
| F10611_T5 (SEQ ID NO: 359) | 5433 | 5513 |
| F10611_T6 (SEQ ID NO: 360) | 5569 | 5649 |
| F10611_T8 (SEQ ID NO: 362) | 7915 | 7995 |
| F10611_T9 (SEQ ID NO: 363) | 5385 | 5465 |
| F10611_T10 (SEQ ID NO: 364) | 8540 | 8620 |
| F10611_T11 (SEQ ID NO: 365) | 7817 | 7897 |
| F10611_T12 (SEQ ID NO: 366) | 5569 | 5649 |
| F10611_T13 (SEQ ID NO: 367) | 5569 | 5649 |
| F10611_T21 (SEQ ID NO: 374) | 7127 | 7207 |
| F10611_T22 (SEQ ID NO: 375) | 4660 | 4740 |
| F10611_T23 (SEQ ID NO: 376) | 6960 | 7040 |
| F10611_T24 (SEQ ID NO: 377) | 2353 | 2433 |
| F10611_T25 (SEQ ID NO: 378) | 2218 | 2298 |
| F10611_T26 (SEQ ID NO: 379) | 1747 | 1827 |
| F10611_T27 (SEQ ID NO: 380) | 1206 | 1286 |
| F10611_T28 (SEQ ID NO: 381) | 1046 | 1126 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P1, F10611_P12 and F10611_P20. This segment can also be found in the following protein(s): F10611_P29, F10611_P2, F10611_P4, F10611_P7, F10611_P10, F10611_P13, F10611_P14, F10611_P21, F10611_P22, F10611_P23, F10611_P24 and F10611_P25, since it is in the coding region for the corresponding transcript.

Segment cluster F10611_node__114 (SEQ ID NO:456) according to the present invention is supported by 1 libraries. The number of libraries was determined as previously described. This segment can be found in the following transcript(s): F10611_T13 (SEQ ID NO:367). Table 426 below describes the starting and ending position of this segment on each transcript.

TABLE 426

Segment location on transcripts

| Transcript name | Segment starting position | Segment ending position |
|---|---|---|
| F10611_T13 (SEQ ID NO: 367) | 5650 | 5691 |

This segment can be found in the following protein(s): F10611_P14.

Segment cluster F10611_node__116 (SEQ ID NO:457) according to the present invention is supported by 18 libraries. The number of libraries was determined as previously described. This segment can be found in the following transcript(s): F10611_T0 (SEQ ID NO:354), F10611_T1 (SEQ ID NO:355), F10611_T2 (SEQ ID NO:356), F10611_T3 (SEQ ID NO:357), F10611_T4 (SEQ ID NO:358), F10611_T5 (SEQ ID NO:359), F10611_T6 (SEQ ID NO:360), F10611_T8 (SEQ ID NO:362), F10611_T9 (SEQ ID NO:363), F10611_T10 (SEQ ID NO:364), F10611_T11 (SEQ ID NO:365), F10611_T12 (SEQ ID NO:366), F10611_T21 (SEQ ID NO:374), F10611_T22 (SEQ ID NO:375), F10611_T23 (SEQ ID NO:376), F10611_T24 (SEQ ID NO:377), F10611_T25 (SEQ ID NO:378), F10611_T26 (SEQ ID NO:379), F10611_T27 (SEQ ID NO:380) and F10611_T28 (SEQ ID NO:381). Table 427 below describes the starting and ending position of this segment on each transcript.

TABLE 427

| Segment location on transcripts | | |
|---|---|---|
| Transcript name | Segment starting position | Segment ending position |
| F10611_T0 (SEQ ID NO: 354) | 5569 | 5647 |
| F10611_T1 (SEQ ID NO: 355) | 5650 | 5728 |
| F10611_T2 (SEQ ID NO: 356) | 7884 | 7962 |
| F10611_T3 (SEQ ID NO: 357) | 5695 | 5773 |
| F10611_T4 (SEQ ID NO: 358) | 6123 | 6201 |
| F10611_T5 (SEQ ID NO: 359) | 5514 | 5592 |
| F10611_T6 (SEQ ID NO: 360) | 5650 | 5728 |
| F10611_T8 (SEQ ID NO: 362) | 7996 | 8074 |
| F10611_T9 (SEQ ID NO: 363) | 5466 | 5544 |
| F10611_T10 (SEQ ID NO: 364) | 8621 | 8699 |
| F10611_T11 (SEQ ID NO: 365) | 7898 | 7976 |
| F10611_T12 (SEQ ID NO: 366) | 5650 | 5728 |
| F10611_T21 (SEQ ID NO: 374) | 7208 | 7286 |
| F10611_T22 (SEQ ID NO: 375) | 4741 | 4819 |
| F10611_T23 (SEQ ID NO: 376) | 7041 | 7119 |
| F10611_T24 (SEQ ID NO: 377) | 2434 | 2512 |
| F10611_T25 (SEQ ID NO: 378) | 2299 | 2377 |
| F10611_T26 (SEQ ID NO: 379) | 1828 | 1906 |
| F10611_T27 (SEQ ID NO: 380) | 1287 | 1365 |
| F10611_T28 (SEQ ID NO: 381) | 1127 | 1205 |

This segment can be found in both coding and non-coding regions of transcript(s) as follows. The segment can be found in a non-coding region of transcript(s) that are related to the following protein(s): F10611_P3, F10611_P5, F10611_P6, F10611_P9, F10611_P11, F10611_P12 and F10611_P20. This segment can also be found in the following protein(s): F10611_P29, F10611_P2, F10611_P4, F10611_P7, F10611_P10, F10611_P13, F10611_P21, F10611_P22, F10611_P23, F10611_P24 and F10611_P25, since it is in the coding region for the corresponding transcript.

Segment cluster F10611_node_117 (SEQ ID NO:458) according to the present invention is supported by 1 libraries. The number of libraries was determined as previously described. This segment can be found in the following transcript(s): F10611_T12 (SEQ ID NO:366). Table 428 below describes the starting and ending position of this segment on each transcript.

TABLE 428

| Segment location on transcripts | | |
|---|---|---|
| Transcript name | Segment starting position | Segment ending position |
| F10611_T12 (SEQ ID NO: 366) | 5729 | 5756 |

This segment can be found in the following protein(s): F10611_P13.

Segment cluster F10611_node_121 (SEQ ID NO:459) according to the present invention is supported by 1 libraries. The number of libraries was determined as previously described. This segment can be found in the following transcript(s): F10611_T6 (SEQ ID NO:360). Table 429 below describes the starting and ending position of this segment on each transcript.

TABLE 429

| Segment location on transcripts | | |
|---|---|---|
| Transcript name | Segment starting position | Segment ending position |
| F10611_T6 (SEQ ID NO: 360) | 5909 | 5935 |

This segment can be found in the following protein(s): F10611_P7.

Description for Cluster H41850

Cluster H41850 features 1 transcript(s) and 22 segment(s) of interest, the names for which are given in Tables 430 and 431, respectively, the sequences themselves are given at the end of the application. The selected protein variants are given in Table 432.

TABLE 430

| Transcripts of interest |
|---|
| Transcript Name |
| H41850_T5 (SEQ ID NO: 460) |

TABLE 431

| Segments of interest |
|---|
| Segment Name |
| H41850_node_0 (SEQ ID NO: 461) |
| H41850_node_3 (SEQ ID NO: 462) |
| H41850_node_11 (SEQ ID NO: 463) |
| H41850_node_16 (SEQ ID NO: 464) |
| H41850_node_24 (SEQ ID NO: 465) |
| H41850_node_34 (SEQ ID NO: 466) |
| H41850_node_36 (SEQ ID NO: 467) |
| H41850_node_37 (SEQ ID NO: 468) |
| H41850_node_5 (SEQ ID NO: 469) |
| H41850_node_6 (SEQ ID NO: 470) |
| H41850_node_7 (SEQ ID NO: 471) |
| H41850_node_8 (SEQ ID NO: 472) |
| H41850_node_12 (SEQ ID NO: 473) |
| H41850_node_15 (SEQ ID NO: 474) |
| H41850_node_17 (SEQ ID NO: 475) |
| H41850_node_18 (SEQ ID NO: 476) |
| H41850_node_22 (SEQ ID NO: 477) |
| H41850_node_25 (SEQ ID NO: 478) |
| H41850_node_26 (SEQ ID NO: 479) |
| H41850_node_28 (SEQ ID NO: 480) |
| H41850_node_29 (SEQ ID NO: 481) |
| H41850_node_30 (SEQ ID NO: 482) |

TABLE 432

| Proteins of interest | |
|---|---|
| Protein Name | Corresponding Transcript(s) |
| H41850_P6 | H41850_T5 (SEQ ID NO: 460) |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 433.

TABLE 433

| Oligonucleotides related to this cluster | | |
| --- | --- | --- |
| Oligonucleotide name | Overexpressed in cancers | Chip reference |
| R54113_0_0_32847 | colorectal cancer | Colon |
| R54113_0_0_32847 | lung malignant tumors | LUN |

As noted above, cluster H41850 features 22 segment(s), which were listed in Table 431 above and for which the sequence(s) are given at the end of the application. These segment(s) are portions of nucleic acid sequence(s) which are described herein separately because they are of particular interest. A description of each segment according to the present invention is now provided.

Segment cluster H41850_node_0 (SEQ ID NO:461) according to the present invention is supported by 34 libraries. The number of libraries was determined as previously described. This segment can be found in the following transcript(s): H41850_T5 (SEQ ID NO:460). Table 434 below describes the starting and ending position of this segment on each transcript.

TABLE 434

| Segment location on transcripts | | |
| --- | --- | --- |
| Transcript name | Segment starting position | Segment ending position |
| H41850_T5 (SEQ ID NO: 460) | 1 | 173 |

This segment can be found in a non-coding region of transcript(s) that are related to the following protein(s): H41850_P6.

Segment cluster H41850_node_3 (SEQ ID NO:462) according to the present invention is supported by 48 libraries. The number of libraries was determined as previously described. This segment can be found in the following transcript(s): H41850_T5 (SEQ ID NO:460). Table 435 below describes the starting and ending position of this segment on each transcript.

TABLE 435

| Segment location on transcripts | | |
| --- | --- | --- |
| Transcript name | Segment starting position | Segment ending position |
| H41850_T5 (SEQ ID NO: 460) | 174 | 333 |

This segment can be found in a non-coding region of transcript(s) that are related to the following protein(s): H41850_P6.

Segment cluster H41850_node_11 (SEQ ID NO:463) according to the present invention is supported by 41 libraries. The number of libraries was determined as previously described. This segment can be found in the following transcript(s): H41850_T5 (SEQ ID NO:460). Table 436 below describes the starting and ending position of this segment on each transcript.

TABLE 436

| Segment location on transcripts | | |
| --- | --- | --- |
| Transcript name | Segment starting position | Segment ending position |
| H41850_T5 (SEQ ID NO: 460) | 421 | 548 |

This segment can be found in a non-coding region of transcript(s) that are related to the following protein(s): H41850_P6.

Segment cluster H41850_node_16 (SEQ ID NO:464) according to the present invention is supported by 17 libraries. The number of libraries was determined as previously described. This segment can be found in the following transcript(s): H41850_T5 (SEQ ID NO:460). Table 437 below describes the starting and ending position of this segment on each transcript.

TABLE 437

| Segment location on transcripts | | |
| --- | --- | --- |
| Transcript name | Segment starting position | Segment ending position |
| H41850_T5 (SEQ ID NO: 460) | 623 | 1155 |

This segment can be found in the following protein(s): H41850_P6.

Segment cluster H41850_node_24 (SEQ ID NO:465) according to the present invention is supported by 45 libraries. The number of libraries was determined as previously described. This segment can be found in the following transcript(s): H41850_T5 (SEQ ID NO:460). Table 438 below describes the starting and ending position of this segment on each transcript.

TABLE 438

| Segment location on transcripts | | |
| --- | --- | --- |
| Transcript name | Segment starting position | Segment ending position |
| H41850_T5 (SEQ ID NO: 460) | 1326 | 1463 |

This segment can be found in the following protein(s): H41850_P6.

Segment cluster H41850_node_34 (SEQ ID NO:466) according to the present invention is supported by 28 libraries. The number of libraries was determined as previously described. This segment can be found in the following transcript(s): H41850_T5 (SEQ ID NO:460). Table 439 below describes the starting and ending position of this segment on each transcript.

TABLE 439

| Segment location on transcripts | | |
| --- | --- | --- |
| Transcript name | Segment starting position | Segment ending position |
| H41850_T5 (SEQ ID NO: 460) | 1680 | 1808 |

This segment can be found in the following protein(s): H41850_P6.

Segment cluster H41850_node_36 (SEQ ID NO:467) according to the present invention is supported by 35 libraries. The number of libraries was determined as previously described. This segment can be found in the following transcript(s): H41850_T5 (SEQ ID NO:460). Table 440 below describes the starting and ending position of this segment on each transcript.

TABLE 440

| | Segment location on transcripts | |
|---|---|---|
| Transcript name | Segment starting position | Segment ending position |
| H41850_T5 (SEQ ID NO: 460) | 1809 | 1966 |

This segment can be found in the following protein(s): H41850_P6.

Segment cluster H41850_node_37 (SEQ ID NO:468) according to the present invention is supported by 55 libraries. The number of libraries was determined as previously described. This segment can be found in the following transcript(s): H41850_T5 (SEQ ID NO:460). Table 441 below describes the starting and ending position of this segment on each transcript.

TABLE 441

| | Segment location on transcripts | |
|---|---|---|
| Transcript name | Segment starting position | Segment ending position |
| H41850_T5 (SEQ ID NO: 460) | 1967 | 2634 |

This segment can be found in the following protein(s): H41850_P6.

According to an optional embodiment of the present invention, short segments related to the above cluster are also provided. These segments are up to about 120 bp in length, and so are included in a separate description.

Segment cluster H41850_node_5 (SEQ ID NO:469) according to the present invention can be found in the following transcript(s): H41850_T5 (SEQ ID NO:460). Table 442 below describes the starting and ending position of this segment on each transcript.

TABLE 442

| | Segment location on transcripts | |
|---|---|---|
| Transcript name | Segment starting position | Segment ending position |
| H41850_T5 (SEQ ID NO: 460) | 334 | 338 |

This segment can be found in a non-coding region of transcript(s) that are related to the following protein(s): H41850_P6.

Segment cluster H41850_node_6 (SEQ ID NO:470) according to the present invention is supported by 41 libraries. The number of libraries was determined as previously described. This segment can be found in the following transcript(s): H41850_T5 (SEQ ID NO:460). Table 443 below describes the starting and ending position of this segment on each transcript.

TABLE 443

| | Segment location on transcripts | |
|---|---|---|
| Transcript name | Segment starting position | Segment ending position |
| H41850_T5 (SEQ ID NO: 460) | 339 | 384 |

This segment can be found in a non-coding region of transcript(s) that are related to the following protein(s): H41850_P6.

Segment cluster H41850_node_7 (SEQ ID NO:471) according to the present invention is supported by 33 libraries. The number of libraries was determined as previously described. This segment can be found in the following transcript(s): H41850_T5 (SEQ ID NO:460). Table 444 below describes the starting and ending position of this segment on each transcript.

TABLE 444

| | Segment location on transcripts | |
|---|---|---|
| Transcript name | Segment starting position | Segment ending position |
| H41850_T5 (SEQ ID NO: 460) | 385 | 410 |

This segment can be found in a non-coding region of transcript(s) that are related to the following protein(s): H41850_P6.

Segment cluster H41850_node_8 (SEQ ID NO:472) according to the present invention can be found in the following transcript(s): H41850_T5 (SEQ ID NO:460). Table 445 below describes the starting and ending position of this segment on each transcript.

TABLE 445

| | Segment location on transcripts | |
|---|---|---|
| Transcript name | Segment starting position | Segment ending position |
| H41850_T5 (SEQ ID NO: 460) | 411 | 420 |

This segment can be found in a non-coding region of transcript(s) that are related to the following protein(s): H41850_P6.

Segment cluster H41850_node_12 (SEQ ID NO:473) according to the present invention can be found in the following transcript(s): H41850_T5 (SEQ ID NO:460). Table 446 below describes the starting and ending position of this segment on each transcript.

TABLE 446

| | Segment location on transcripts | |
|---|---|---|
| Transcript name | Segment starting position | Segment ending position |
| H41850_T5 (SEQ ID NO: 460) | 549 | 571 |

This segment can be found in a non-coding region of transcript(s) that are related to the following protein(s): H41850_P6.

Segment cluster H41850_node_15 (SEQ ID NO:474) according to the present invention is supported by 42 libraries. The number of libraries was determined as previously described. This segment can be found in the following transcript(s): H41850_T5 (SEQ ID NO:460). Table 447 below describes the starting and ending position of this segment on each transcript.

TABLE 447

| Segment location on transcripts | | |
|---|---|---|
| Transcript name | Segment starting position | Segment ending position |
| H41850_T5 (SEQ ID NO: 460) | 572 | 622 |

This segment can be found in a non-coding region of transcript(s) that are related to the following protein(s): H41850_P6.

Segment cluster H41850_node_17 (SEQ ID NO:475) according to the present invention is supported by 43 libraries. The number of libraries was determined as previously described. This segment can be found in the following transcript(s): H41850_T5 (SEQ ID NO:460). Table 448 below describes the starting and ending position of this segment on each transcript.

TABLE 448

| Segment location on transcripts | | |
|---|---|---|
| Transcript name | Segment starting position | Segment ending position |
| H41850_T5 (SEQ ID NO: 460) | 1156 | 1182 |

This segment can be found in the following protein(s): H41850_P6.

Segment cluster H41850_node_18 (SEQ ID NO:476) according to the present invention is supported by 51 libraries. The number of libraries was determined as previously described. This segment can be found in the following transcript(s): H41850_T5 (SEQ ID NO:460). Table 449 below describes the starting and ending position of this segment on each transcript.

TABLE 449

| Segment location on transcripts | | |
|---|---|---|
| Transcript name | Segment starting position | Segment ending position |
| H41850_T5 (SEQ ID NO: 460) | 1183 | 1250 |

This segment can be found in the following protein(s): H41850_P6.

Segment cluster H41850_node_22 (SEQ ID NO:477) according to the present invention is supported by 46 libraries. The number of libraries was determined as previously described. This segment can be found in the following transcript(s): H41850_T5 (SEQ ID NO:460). Table 450 below describes the starting and ending position of this segment on each transcript.

TABLE 450

| Segment location on transcripts | | |
|---|---|---|
| Transcript name | Segment starting position | Segment ending position |
| H41850_T5 (SEQ ID NO: 460) | 1251 | 1325 |

This segment can be found in the following protein(s): H41850_P6.

Segment cluster H41850_node_25 (SEQ ID NO:478) according to the present invention can be found in the following transcript(s): H41850_T5 (SEQ ID NO:460). Table 451 below describes the starting and ending position of this segment on each transcript.

TABLE 451

| Segment location on transcripts | | |
|---|---|---|
| Transcript name | Segment starting position | Segment ending position |
| H41850_T5 (SEQ ID NO: 460) | 1464 | 1470 |

This segment can be found in the following protein(s): H41850_P6.

Segment cluster H41850_node_26 (SEQ ID NO:479) according to the present invention is supported by 44 libraries. The number of libraries was determined as previously described. This segment can be found in the following transcript(s): H41850_T5 (SEQ ID NO:460). Table 452 below describes the starting and ending position of this segment on each transcript.

TABLE 452

| Segment location on transcripts | | |
|---|---|---|
| Transcript name | Segment starting position | Segment ending position |
| H41850_T5 (SEQ ID NO: 460) | 1471 | 1546 |

This segment can be found in the following protein(s): H41850_P6.

Segment cluster H41850_node_28 (SEQ ID NO:480) according to the present invention is supported by 44 libraries. The number of libraries was determined as previously described. This segment can be found in the following transcript(s): H41850_T5 (SEQ ID NO:460). Table 453 below describes the starting and ending position of this segment on each transcript.

TABLE 453

| Segment location on transcripts | | |
|---|---|---|
| Transcript name | Segment starting position | Segment ending position |
| H41850_T5 (SEQ ID NO: 460) | 1547 | 1595 |

This segment can be found in the following protein(s): H41850_P6.

Segment cluster H41850_node_29 (SEQ ID NO:481) according to the present invention is supported by 22 libraries. The number of libraries was determined as previously described. This segment can be found in the following transcript(s): H41850_T5 (SEQ ID NO:460). Table 454 below describes the starting and ending position of this segment on each transcript.

TABLE 454

Segment location on transcripts

| Transcript name | Segment starting position | Segment ending position |
|---|---|---|
| H41850_T5 (SEQ ID NO: 460) | 1596 | 1630 |

This segment can be found in the following protein(s): H41850_P6.

Segment cluster H41850_node_30 (SEQ ID NO:482) according to the present invention is supported by 11 libraries. The number of libraries was determined as previously described. This segment can be found in the following transcript(s): H41850_T5 (SEQ ID NO:460). Table 455 below describes the starting and ending position of this segment on each transcript.

TABLE 455

Segment location on transcripts

| Transcript name | Segment starting position | Segment ending position |
|---|---|---|
| H41850_T5 (SEQ ID NO: 460) | 1631 | 1679 |

This segment can be found in the following protein(s): H41850_P6.

Description for Cluster HSB6PR

Cluster HSB6PR features 3 transcript(s) and 17 segment(s) of interest, the names for which are given in Tables 456 and 457, respectively, the sequences themselves are given at the end of the application. The selected protein variants are given in Table 458.

TABLE 456

Transcripts of interest
Transcript Name

HSB6PR_T2 (SEQ ID NO: 483)
HSB6PR_T4 (SEQ ID NO: 484)
HSB6PR_T6 (SEQ ID NO: 485)

TABLE 457

Segments of interest
Segment Name

HSB6PR_node_1 (SEQ ID NO: 486)
HSB6PR_node_6 (SEQ ID NO: 487)
HSB6PR_node_10 (SEQ ID NO: 488)
HSB6PR_node_12 (SEQ ID NO: 489)
HSB6PR_node_14 (SEQ ID NO: 490)
HSB6PR_node_15 (SEQ ID NO: 491)
HSB6PR_node_17 (SEQ ID NO: 492)
HSB6PR_node_32 (SEQ ID NO: 493)
HSB6PR_node_35 (SEQ ID NO: 494)
HSB6PR_node_37 (SEQ ID NO: 495)
HSB6PR_node_39 (SEQ ID NO: 496)
HSB6PR_node_0 (SEQ ID NO: 497)
HSB6PR_node_4 (SEQ ID NO: 498)
HSB6PR_node_8 (SEQ ID NO: 499)
HSB6PR_node_33 (SEQ ID NO: 500)
HSB6PR_node_36 (SEQ ID NO: 501)
HSB6PR_node_38 (SEQ ID NO: 502)

TABLE 458

Proteins of interest

| Protein Name | Corresponding Transcript(s) |
|---|---|
| HSB6PR_P2 | HSB6PR_T2 (SEQ ID NO: 483) |
| HSB6PR_P4 | HSB6PR_T4 (SEQ ID NO: 484) |
| HSB6PR_P6 | HSB6PR_T6 (SEQ ID NO: 485) |

These sequences are variants of the known protein Plakophilin 1 (SwissProt accession identifier PKP1_HUMAN; known also according to the synonyms Band-6-protein; B6P), referred to herein as the previously known protein.

Protein Plakophilin 1 is known or believed to have the following function(s): SEEMS TO PLAY A ROLE IN JUNCTIONAL PLAQUES. The sequence for protein Plakophilin 1 is given at the end of the application, as "Plakophilin 1 amino acid sequence". Known polymorphisms for this sequence are as shown in Table 459.

TABLE 459

Amino acid mutations for Known Protein

| SNP position(s) on amino acid sequence | Comment |
|---|---|
| 154 | R -> G |
| 216-222 | PPISCNK -> RHLLQQ |
| 462 | V -> E |
| 496 | Q -> K |
| 506 | T -> P |
| 553 | L -> S |

Protein Plakophilin 1 localization is believed to be Nuclear. Isoform 1 is also associated with desmosomes.

The following GO Annotation(s) apply to the previously known protein. The following annotation(s) were found: cell adhesion; signal transduction, which are annotation(s) related to Biological Process; intermediate filament binding; structural protein of epidermis, which are annotation(s) related to Molecular Function; and nucleus; cytoskeleton; desmosome, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HSB6PR can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 15 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 15 and Table 460. This cluster is overexpressed (at least at a minimum level) in the following pathological conditions: a mixture of malignant tumors from different tissues.

TABLE 460

Normal tissue distribution

| Name of Tissue | Number |
|---|---|
| adrenal | 40 |
| bladder | 0 |
| brain | 6 |
| colon | 0 |
| epithelial | 116 |
| general | 43 |
| head and neck | 101 |
| kidney | 0 |
| lung | 42 |
| breast | 52 |
| muscle | 9 |
| ovary | 0 |
| pancreas | 0 |
| prostate | 88 |
| skin | 739 |
| uterus | 145 |

TABLE 461

P values and ratios for expression in cancerous tissue

| Name of Tissue | P1 | P2 | SP1 | R3 | SP2 | R4 |
|---|---|---|---|---|---|---|
| adrenal | 6.9e−01 | 7.3e−01 | 2.5e−01 | 1.7 | 3.7e−01 | 1.4 |
| bladder | 3.1e−01 | 3.8e−01 | 5.6e−01 | 1.8 | 6.8e−01 | 1.5 |
| brain | 7.6e−01 | 6.1e−01 | 1 | 0.4 | 3.1e−03 | 1.7 |
| colon | 1.7e−01 | 1.7e−01 | 7.0e−01 | 1.7 | 7.7e−01 | 1.5 |
| epithelial | 1.1e−01 | 5.4e−01 | 9.7e−01 | 0.6 | 1 | 0.4 |
| general | 3.8e−03 | 1.3e−01 | 2.8e−03 | 1.4 | 6.9e−01 | 0.9 |
| head and neck | 8.4e−02 | 1.8e−01 | 2.6e−01 | 2.5 | 7.4e−01 | 1.1 |
| kidney | 6.5e−01 | 7.2e−01 | 4.4e−03 | 2.4 | 2.8e−02 | 1.9 |
| lung | 2.8e−01 | 5.9e−01 | 6.2e−03 | 2.8 | 1.6e−01 | 1.5 |
| breast | 8.3e−01 | 8.7e−01 | 6.3e−01 | 1.1 | 8.5e−01 | 0.7 |
| muscle | 4.0e−01 | 4.8e−01 | 1.5e−01 | 4.5 | 3.9e−01 | 1.7 |
| ovary | 3.8e−01 | 4.2e−01 | 3.2e−01 | 2.4 | 4.5e−01 | 1.9 |
| pancreas | 1 | 4.4e−01 | 1 | 1.0 | 5.3e−01 | 1.9 |
| prostate | 7.4e−01 | 7.6e−01 | 4.2e−01 | 1.2 | 4.1e−01 | 1.1 |
| skin | 5.2e−01 | 6.3e−01 | 6.9e−01 | 0.2 | 1 | 0.0 |
| uterus | 7.0e−01 | 7.7e−01 | 1 | 0.2 | 1 | 0.2 |

As noted above, cluster HSB6PR features 17 segment(s), which were listed in Table 457 above and for which the sequence(s) are given at the end of the application. These segment(s) are portions of nucleic acid sequence(s) which are described herein separately because they are of particular interest. A description of each segment according to the present invention is now provided.

Segment cluster HSB6PR_node_1 (SEQ ID NO:486) according to the present invention is supported by 12 libraries. The number of libraries was determined as previously described. This segment can be found in the following transcript(s): HSB6PR_T4 (SEQ ID NO:484). Table 462 below describes the starting and ending position of this segment on each transcript.

TABLE 462

Segment location on transcripts

| Transcript name | Segment starting position | Segment ending position |
|---|---|---|
| HSB6PR_T4 (SEQ ID NO: 484) | 119 | 454 |

This segment can be found in the following protein(s): HSB6PR_P4.

Segment cluster HSB6PR_node_6 (SEQ ID NO:487) according to the present invention is supported by 15 libraries. The number of libraries was determined as previously described. This segment can be found in the following transcript(s): HSB6PR_T4 (SEQ ID NO:484). Table 463 below describes the starting and ending position of this segment on each transcript.

TABLE 463

Segment location on transcripts

| Transcript name | Segment starting position | Segment ending position |
|---|---|---|
| HSB6PR_T4 (SEQ ID NO: 484) | 559 | 953 |

This segment can be found in the following protein(s): HSB6PR_P4.

Segment cluster HSB6PR_node_10 (SEQ ID NO:488) according to the present invention is supported by 17 libraries. The number of libraries was determined as previously described. This segment can be found in the following transcript(s): HSB6PR_T4 (SEQ ID NO:484) and HSB6PR_T6 (SEQ ID NO:485). Table 464 below describes the starting and ending position of this segment on each transcript.

TABLE 464

Segment location on transcripts

| Transcript name | Segment starting position | Segment ending position |
|---|---|---|
| HSB6PR_T4 (SEQ ID NO: 484) | 954 | 1098 |
| HSB6PR_T6 (SEQ ID NO: 485) | 44 | 188 |

This segment can be found in the following protein(s): HSB6PR_P4 and HSB6PR_P6.

Segment cluster HSB6PR_node_12 (SEQ ID NO:489) according to the present invention is supported by 20 libraries. The number of libraries was determined as previously described. This segment can be found in the following transcript(s): HSB6PR_T4 (SEQ ID NO:484) and HSB6PR_T6 (SEQ ID NO:485). Table 465 below describes the starting and ending position of this segment on each transcript.

TABLE 465

Segment location on transcripts

| Transcript name | Segment starting position | Segment ending position |
|---|---|---|
| HSB6PR_T4 (SEQ ID NO: 484) | 1099 | 1306 |
| HSB6PR_T6 (SEQ ID NO: 485) | 189 | 396 |

This segment can be found in the following protein(s): HSB6PR_P4 and HSB6PR_P6.

Segment cluster HSB6PR_node_14 (SEQ ID NO:490) according to the present invention is supported by 23 libraries. The number of libraries was determined as previously described. This segment can be found in the following transcript(s): HSB6PR_T4 (SEQ ID NO:484) and HSB6PR_T6 (SEQ ID NO:485). Table 466 below describes the starting and ending position of this segment on each transcript.

TABLE 466

| Segment location on transcripts | | |
|---|---|---|
| Transcript name | Segment starting position | Segment ending position |
| HSB6PR_T4 (SEQ ID NO: 484) | 1307 | 1484 |
| HSB6PR_T6 (SEQ ID NO: 485) | 397 | 574 |

This segment can be found in the following protein(s): HSB6PR_P4 and HSB6PR_P6.

Segment cluster HSB6PR_node_15 (SEQ ID NO:491) according to the present invention is supported by 1 libraries. The number of libraries was determined as previously described. This segment can be found in the following transcript(s): HSB6PR_T4 (SEQ ID NO:484). Table 467 below describes the starting and ending position of this segment on each transcript.

TABLE 467

| Segment location on transcripts | | |
|---|---|---|
| Transcript name | Segment starting position | Segment ending position |
| HSB6PR_T4 (SEQ ID NO: 484) | 1485 | 1687 |

This segment can be found in the following protein(s): HSB6PR_P4.

Segment cluster HSB6PR_node_17 (SEQ ID NO:492) according to the present invention is supported by 1 libraries. The number of libraries was determined as previously described. This segment can be found in the following transcript(s): HSB6PR_T6 (SEQ ID NO:485). Table 468 below describes the starting and ending position of this segment on each transcript.

TABLE 468

| Segment location on transcripts | | |
|---|---|---|
| Transcript name | Segment starting position | Segment ending position |
| HSB6PR_T6 (SEQ ID NO: 485) | 575 | 932 |

This segment can be found in the following protein(s): HSB6PR_P6.

Segment cluster HSB6PR_node_32 (SEQ ID NO:493) according to the present invention is supported by 9 libraries. The number of libraries was determined as previously described. This segment can be found in the following transcript(s): HSB6PR_T2 (SEQ ID NO:483). Table 469 below describes the starting and ending position of this segment on each transcript.

TABLE 469

| Segment location on transcripts | | |
|---|---|---|
| Transcript name | Segment starting position | Segment ending position |
| HSB6PR_T2 (SEQ ID NO: 483) | 1 | 1485 |

This segment can be found in a non-coding region of transcript(s) that are related to the following protein(s): HSB6PR_P2.

Segment cluster HSB6PR_node_35 (SEQ ID NO:494) according to the present invention is supported by 13 libraries. The number of libraries was determined as previously described. This segment can be found in the following transcript(s): HSB6PR_T2 (SEQ ID NO:483). Table 470 below describes the starting and ending position of this segment on each transcript.

TABLE 470

| Segment location on transcripts | | |
|---|---|---|
| Transcript name | Segment starting position | Segment ending position |
| HSB6PR_T2 (SEQ ID NO: 483) | 1593 | 1764 |

This segment can be found in a non-coding region of transcript(s) that are related to the following protein(s): HSB6PR_P2.

Segment cluster HSB6PR_node_37 (SEQ ID NO:495) according to the present invention is supported by 167 libraries. The number of libraries was determined as previously described. This segment can be found in the following transcript(s): HSB6PR_T2 (SEQ ID NO:483). Table 471 below describes the starting and ending position of this segment on each transcript.

TABLE 471

| Segment location on transcripts | | |
|---|---|---|
| Transcript name | Segment starting position | Segment ending position |
| HSB6PR_T2 (SEQ ID NO: 483) | 1787 | 4246 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 472.

TABLE 472

| Oligonucleotides related to this segment | | |
|---|---|---|
| Oligonucleotide name | Overexpressed in cancers | Chip reference |
| HSB6PR_0_1_9501 | colorectal cancer | Colon |
| HSB6PR_0_1_9501 | lung malignant tumors | LUN |

This segment can be found in the following protein(s): HSB6PR_P2.

Segment cluster HSB6PR_node_39 (SEQ ID NO:496) according to the present invention is supported by 73 libraries. The number of libraries was determined as previously described. This segment can be found in the following transcript(s): HSB6PR_T2 (SEQ ID NO:483). Table 473 below describes the starting and ending position of this segment on each transcript.

TABLE 473

Segment location on transcripts

| Transcript name | Segment starting position | Segment ending position |
|---|---|---|
| HSB6PR_T2 (SEQ ID NO: 483) | 4300 | 4517 |

This segment can be found in a non-coding region of transcript(s) that are related to the following protein(s): HSB6PR_P2.

According to an optional embodiment of the present invention, short segments related to the above cluster are also provided. These segments are up to about 120 bp in length, and so are included in a separate description.

Segment cluster HSB6PR_node_0 (SEQ ID NO:497) according to the present invention is supported by 10 libraries. The number of libraries was determined as previously described. This segment can be found in the following transcript(s): HSB6PR_T4 (SEQ ID NO:484). Table 474 below describes the starting and ending position of this segment on each transcript.

TABLE 474

Segment location on transcripts

| Transcript name | Segment starting position | Segment ending position |
|---|---|---|
| HSB6PR_T4 (SEQ ID NO: 484) | 1 | 118 |

This segment can be found in a non-coding region of transcript(s) that are related to the following protein(s): HSB6PR_P4.

Segment cluster HSB6PR_node_4 (SEQ ID NO:498) according to the present invention is supported by 11 libraries. The number of libraries was determined as previously described. This segment can be found in the following transcript(s): HSB6PR_T4 (SEQ ID NO:484). Table 475 below describes the starting and ending position of this segment on each transcript.

TABLE 475

Segment location on transcripts

| Transcript name | Segment starting position | Segment ending position |
|---|---|---|
| HSB6PR_T4 (SEQ ID NO: 484) | 455 | 558 |

This segment can be found in the following protein(s): HSB6PR_P4.

Segment cluster HSB6PR_node_8 (SEQ ID NO:499) according to the present invention is supported by 1 libraries. The number of libraries was determined as previously described. This segment can be found in the following transcript(s): HSB6PR_T6 (SEQ ID NO:485). Table 476 below describes the starting and ending position of this segment on each transcript.

TABLE 476

Segment location on transcripts

| Transcript name | Segment starting position | Segment ending position |
|---|---|---|
| HSB6PR_T6 (SEQ ID NO: 485) | 1 | 43 |

This segment can be found in the following protein(s): HSB6PR_P6.

Segment cluster HSB6PR_node_33 (SEQ ID NO:500) according to the present invention is supported by 16 libraries. The number of libraries was determined as previously described. This segment can be found in the following transcript(s): HSB6PR_T2 (SEQ ID NO:483). Table 477 below describes the starting and ending position of this segment on each transcript.

TABLE 477

Segment location on transcripts

| Transcript name | Segment starting position | Segment ending position |
|---|---|---|
| HSB6PR_T2 (SEQ ID NO: 483) | 1486 | 1592 |

This segment can be found in a non-coding region of transcript(s) that are related to the following protein(s): HSB6PR_P2.

Segment cluster HSB6PR_node_36 (SEQ ID NO:501) according to the present invention can be found in the following transcript(s): HSB6PR_T2 (SEQ ID NO:483). Table 478 below describes the starting and ending position of this segment on each transcript.

TABLE 478

Segment location on transcripts

| Transcript name | Segment starting position | Segment ending position |
|---|---|---|
| HSB6PR_T2 (SEQ ID NO: 483) | 1765 | 1786 |

This segment can be found in a non-coding region of transcript(s) that are related to the following protein(s): HSB6PR_P2.

Segment cluster HSB6PR_node_38 (SEQ ID NO:502) according to the present invention is supported by 70 libraries. The number of libraries was determined as previously described. This segment can be found in the following transcript(s): HSB6PR_T2 (SEQ ID NO:483). Table 479 below describes the starting and ending position of this segment on each transcript.

TABLE 479

Segment location on transcripts

| Transcript name | Segment starting position | Segment ending position |
|---|---|---|
| HSB6PR_T2 (SEQ ID NO: 483) | 4247 | 4299 |

This segment can be found in a non-coding region of transcript(s) that are related to the following protein(s): HSB6PR_P2.

241

Description for Cluster HSBMYB

Cluster HSBMYB features 3 transcript(s) and 36 segment(s) of interest, the names for which are given in Tables 480 and 481, respectively, the sequences themselves are given at the end of the application. The selected protein variants are given in Table 482.

TABLE 480

Transcripts of interest
Transcript Name

HSBMYB_T23 (SEQ ID NO: 503)
HSBMYB_T24 (SEQ ID NO: 504)
HSBMYB_T26 (SEQ ID NO: 505)

TABLE 481

Segments of interest
Segment Name

HSBMYB_node_0 (SEQ ID NO: 506)
HSBMYB_node_11 (SEQ ID NO: 507)
HSBMYB_node_15 (SEQ ID NO: 508)
HSBMYB_node_18 (SEQ ID NO: 509)
HSBMYB_node_21 (SEQ ID NO: 510)
HSBMYB_node_22 (SEQ ID NO: 511)
HSBMYB_node_25 (SEQ ID NO: 512)
HSBMYB_node_26 (SEQ ID NO: 513)
HSBMYB_node_28 (SEQ ID NO: 514)
HSBMYB_node_33 (SEQ ID NO: 515)
HSBMYB_node_40 (SEQ ID NO: 516)
HSBMYB_node_47 (SEQ ID NO: 517)
HSBMYB_node_50 (SEQ ID NO: 518)
HSBMYB_node_52 (SEQ ID NO: 519)
HSBMYB_node_2 (SEQ ID NO: 520)
HSBMYB_node_5 (SEQ ID NO: 521)
HSBMYB_node_7 (SEQ ID NO: 522)
HSBMYB_node_8 (SEQ ID NO: 523)
HSBMYB_node_17 (SEQ ID NO: 524)
HSBMYB_node_29 (SEQ ID NO: 525)
HSBMYB_node_30 (SEQ ID NO: 526)
HSBMYB_node_31 (SEQ ID NO: 527)
HSBMYB_node_32 (SEQ ID NO: 528)
HSBMYB_node_34 (SEQ ID NO: 529)
HSBMYB_node_35 (SEQ ID NO: 530)
HSBMYB_node_36 (SEQ ID NO: 531)
HSBMYB_node_37 (SEQ ID NO: 532)
HSBMYB_node_38 (SEQ ID NO: 533)
HSBMYB_node_41 (SEQ ID NO: 534)
HSBMYB_node_42 (SEQ ID NO: 535)
HSBMYB_node_46 (SEQ ID NO: 536)
HSBMYB_node_49 (SEQ ID NO: 537)
HSBMYB_node_51 (SEQ ID NO: 538)
HSBMYB_node_53 (SEQ ID NO: 539)
HSBMYB_node_54 (SEQ ID NO: 540)
HSBMYB_node_55 (SEQ ID NO: 541)

TABLE 482

Proteins of interest

| Protein Name | Corresponding Transcript(s) |
|---|---|
| HSBMYB_P20 | HSBMYB_T23 (SEQ ID NO: 503) |
| HSBMYB_P21 | HSBMYB_T24 (SEQ ID NO: 504) |
| HSBMYB_P23 | HSBMYB_T26 (SEQ ID NO: 505) |

These sequences are variants of the known protein Myb-related protein B (SwissProt accession identifier MYB-B_HUMAN; known also according to the synonyms B-Myb), referred to herein as the previously known protein.

242

The sequence for protein Myb-related protein B is given at the end of the application, as "Myb-related protein B amino acid sequence". Protein Myb-related protein B localization is believed to be Nuclear.

The following GO Annotation(s) apply to the previously known protein. The following annotation(s) were found: cell cycle control; transcription regulation; transcription, from Pol II promoter; anti-apoptosis; developmental processes, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HSBMYB can be used as a diagnostic marker according to overexpression of transcripts of this cluster in cancer. Expression of such transcripts in normal tissues is also given according to the previously described methods. The term "number" in the left hand column of the table and the numbers on the y-axis of Figure refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 16 and Table 483. This cluster is overexpressed (at least at a minimum level) in the following pathological conditions: brain malignant tumors, epithelial malignant tumors, a mixture of malignant tumors from different tissues, kidney malignant tumors, myosarcoma, ovarian carcinoma, pancreas carcinoma, skin malignancies and uterine malignancies.

TABLE 483

Normal tissue distribution

| Name of Tissue | Number |
|---|---|
| Adrenal | 0 |
| Bladder | 0 |
| Bone | 6 |
| Brain | 10 |
| Colon | 6 |
| epithelial | 32 |
| general | 24 |
| head and neck | 0 |
| kidney | 0 |
| Liver | 0 |
| Lung | 30 |
| Lymph nodes | 216 |
| Breast | 26 |
| bone marrow | 31 |
| muscle | 1 |
| Ovary | 0 |
| pancreas | 0 |
| prostate | 0 |
| Skin | 0 |
| stomach | 513 |
| T cells | 0 |
| Uterus | 9 |

TABLE 484

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 4.6e−01 | 2.2 | 2.9e−01 | 2.7 |
| bladder | 1.2e−01 | 1.8e−01 | 1.0e−01 | 4.1 | 2.1e−01 | 2.9 |

TABLE 484-continued

P values and ratios for expression in cancerous tissue

| Name of Tissue | P1 | P2 | SP1 | R3 | SP2 | R4 |
|---|---|---|---|---|---|---|
| Bone | 9.2e−01 | 3.1e−01 | 1 | 0.8 | 8.3e−02 | 2.7 |
| Brain | 1.3e−02 | 1.4e−03 | 4.9e−03 | 5.3 | 5.4e−12 | 9.2 |
| Colon | 5.2e−02 | 3.5e−02 | 1.2e−01 | 3.1 | 9.3e−03 | 2.9 |
| epithelial | 9.4e−07 | 1.6e−11 | 2.8e−02 | 1.6 | 1.4e−18 | 4.6 |
| general | 1.6e−10 | 3.0e−23 | 9.1e−05 | 2.0 | 2.0e−56 | 6.5 |
| head and neck | 1.4e−01 | 1.2e−01 | 2.1e−01 | 3.3 | 3.2e−01 | 2.3 |
| kidney | 1 | 3.5e−01 | 1 | 1.0 | 6.7e−03 | 3.6 |
| Liver | 1 | 4.5e−01 | 1 | 1.0 | 5.3e−02 | 2.8 |
| Lung | 7.4e−01 | 3.9e−01 | 8.8e−01 | 0.6 | 1.9e−03 | 1.5 |
| Lymph nodes | 3.3e−01 | 1.1e−01 | 9.2e−01 | 0.5 | 1.7e−02 | 0.9 |
| Breast | 8.0e−01 | 4.0e−01 | 1 | 0.7 | 4.1e−03 | 2.2 |
| bone marrow | 8.6e−01 | 5.7e−01 | 1 | 0.5 | 3.6e−01 | 1.9 |
| muscle | 4.0e−01 | 1.7e−01 | 1 | 0.9 | 1.1e−07 | 3.7 |
| Ovary | 2.4e−01 | 1.1e−01 | 4.7e−02 | 3.3 | 3.7e−03 | 5.3 |
| pancreas | 9.5e−02 | 6.5e−03 | 1.8e−01 | 3.7 | 1.4e−06 | 10.9 |
| prostate | 5.3e−01 | 2.6e−01 | 4.5e−01 | 2.0 | 4.2e−02 | 3.5 |
| Skin | 3.5e−03 | 2.3e−05 | 2.9e−03 | 19.1 | 5.9e−05 | 10.7 |
| stomach | 3.5e−01 | 3.0e−01 | 1 | 0.1 | 1 | 0.3 |
| T cells | 1 | 6.7e−01 | 1 | 1.0 | 3.7e−01 | 1.8 |
| Uterus | 1.5e−02 | 1.6e−03 | 5.6e−02 | 2.9 | 2.5e−03 | 4.5 |

As noted above, cluster HSBMYB features 36 segment(s), which were listed in Table 481 above and for which the sequence(s) are given at the end of the application. These segment(s) are portions of nucleic acid sequence(s) which are described herein separately because they are of particular interest. A description of each segment according to the present invention is now provided.

Segment cluster HSBMYB_node_0 (SEQ ID NO:506) according to the present invention is supported by 44 libraries. The number of libraries was determined as previously described. This segment can be found in the following transcript(s): HSBMYB_T23 (SEQ ID NO:503). Table 485 below describes the starting and ending position of this segment on each transcript.

TABLE 485

Segment location on transcripts

| Transcript name | Segment starting position | Segment ending position |
|---|---|---|
| HSBMYB_T23 (SEQ ID NO: 503) | 1 | 256 |

This segment can be found in the following protein(s): HSBMYB_P20.

Segment cluster HSBMYB_node_11 (SEQ ID NO:507) according to the present invention is supported by 76 libraries. The number of libraries was determined as previously described. This segment can be found in the following transcript(s): HSBMYB_T23 (SEQ ID NO:503). Table 486 below describes the starting and ending position of this segment on each transcript.

TABLE 486

Segment location on transcripts

| Transcript name | Segment starting position | Segment ending position |
|---|---|---|
| HSBMYB_T23 (SEQ ID NO: 503) | 516 | 736 |

This segment can be found in the following protein(s): HSBMYB_P20.

Segment cluster HSBMYB_node_15 (SEQ ID NO:508) according to the present invention is supported by 71 libraries. The number of libraries was determined as previously described. This segment can be found in the following transcript(s): HSBMYB_T23 (SEQ ID NO:503). Table 487 below describes the starting and ending position of this segment on each transcript.

TABLE 487

Segment location on transcripts

| Transcript name | Segment starting position | Segment ending position |
|---|---|---|
| HSBMYB_T23 (SEQ ID NO: 503) | 737 | 899 |

This segment can be found in the following protein(s): HSBMYB_P20.

Segment cluster HSBMYB_node_18 (SEQ ID NO:509) according to the present invention is supported by 76 libraries. The number of libraries was determined as previously described. This segment can be found in the following transcript(s): HSBMYB_T23 (SEQ ID NO:503). Table 488 below describes the starting and ending position of this segment on each transcript.

TABLE 488

Segment location on transcripts

| Transcript name | Segment starting position | Segment ending position |
|---|---|---|
| HSBMYB_T23 (SEQ ID NO: 503) | 1009 | 1187 |

This segment can be found in the following protein(s): HSBMYB_P20.

Segment cluster HSBMYB_node_21 (SEQ ID NO:510) according to the present invention is supported by 88 libraries. The number of libraries was determined as previously described. This segment can be found in the following transcript(s): HSBMYB_T23 (SEQ ID NO:503). Table 489 below describes the starting and ending position of this segment on each transcript.

TABLE 489

Segment location on transcripts

| Transcript name | Segment starting position | Segment ending position |
|---|---|---|
| HSBMYB_T23 (SEQ ID NO: 503) | 1188 | 1475 |

This segment can be found in the following protein(s): HSBMYB_P20.

Segment cluster HSBMYB_node_22 (SEQ ID NO:511) according to the present invention is supported by 79 libraries. The number of libraries was determined as previously described. This segment can be found in the following transcript(s): HSBMYB_T23 (SEQ ID NO:503). Table 490 below describes the starting and ending position of this segment on each transcript.

TABLE 490

| Transcript name | Segment location on transcripts | |
|---|---|---|
| | Segment starting position | Segment ending position |
| HSBMYB_T23 (SEQ ID NO: 503) | 1476 | 1601 |

This segment can be found in the following protein(s): HSBMYB_P20.

Segment cluster HSBMYB_node_25 (SEQ ID NO:512) according to the present invention is supported by 81 libraries. The number of libraries was determined as previously described. This segment can be found in the following transcript(s): HSBMYB_T23 (SEQ ID NO:503). Table 491 below describes the starting and ending position of this segment on each transcript.

TABLE 491

| Transcript name | Segment location on transcripts | |
|---|---|---|
| | Segment starting position | Segment ending position |
| HSBMYB_T23 (SEQ ID NO: 503) | 1602 | 1741 |

This segment can be found in the following protein(s): HSBMYB_P20.

Segment cluster HSBMYB_node_26 (SEQ ID NO:513) according to the present invention is supported by 1 libraries. The number of libraries was determined as previously described. This segment can be found in the following transcript(s): HSBMYB_T23 (SEQ ID NO:503). Table 492 below describes the starting and ending position of this segment on each transcript.

TABLE 492

| Transcript name | Segment location on transcripts | |
|---|---|---|
| | Segment starting position | Segment ending position |
| HSBMYB_T23 (SEQ ID NO: 503) | 1742 | 1911 |

This segment can be found in the following protein(s): HSBMYB_P20.

Segment cluster HSBMYB_node_28 (SEQ ID NO:514) according to the present invention is supported by 6 libraries. The number of libraries was determined as previously described. This segment can be found in the following transcript(s): HSBMYB_T24 (SEQ ID NO:504). Table 493 below describes the starting and ending position of this segment on each transcript.

TABLE 493

| Transcript name | Segment location on transcripts | |
|---|---|---|
| | Segment starting position | Segment ending position |
| HSBMYB_T24 (SEQ ID NO: 504) | 1 | 2191 |

This segment can be found in a non-coding region of transcript(s) that are related to the following protein(s): HSBMYB_P21.

Segment cluster HSBMYB_node_33 (SEQ ID NO:515) according to the present invention is supported by 12 libraries. The number of libraries was determined as previously described. This segment can be found in the following transcript(s): HSBMYB_T24 (SEQ ID NO:504). Table 494 below describes the starting and ending position of this segment on each transcript.

TABLE 494

| Transcript name | Segment location on transcripts | |
|---|---|---|
| | Segment starting position | Segment ending position |
| HSBMYB_T24 (SEQ ID NO: 504) | 2296 | 3657 |

This segment can be found in the following protein(s): HSBMYB_P21.

Segment cluster HSBMYB_node_40 (SEQ ID NO:516) according to the present invention is supported by 4 libraries. The number of libraries was determined as previously described. This segment can be found in the following transcript(s): HSBMYB_T26 (SEQ ID NO:505). Table 495 below describes the starting and ending position of this segment on each transcript.

TABLE 495

| Transcript name | Segment location on transcripts | |
|---|---|---|
| | Segment starting position | Segment ending position |
| HSBMYB_T26 (SEQ ID NO: 505) | 1 | 850 |

This segment can be found in a non-coding region of transcript(s) that are related to the following protein(s): HSBMYB_P23.

Segment cluster HSBMYB_node_47 (SEQ ID NO:517) according to the present invention is supported by 125 libraries. The number of libraries was determined as previously described. This segment can be found in the following transcript(s): HSBMYB_T24 (SEQ ID NO:504) and HSBMYB_T26 (SEQ ID NO:505). Table 496 below describes the starting and ending position of this segment on each transcript.

TABLE 496

| Transcript name | Segment location on transcripts | |
|---|---|---|
| | Segment starting position | Segment ending position |
| HSBMYB_T24 (SEQ ID NO: 504) | 3965 | 4085 |
| HSBMYB_T26 (SEQ ID NO: 505) | 985 | 1105 |

This segment can be found in the following protein(s): HSBMYB_P21 and HSBMYB_P23.

Segment cluster HSBMYB_node_50 (SEQ ID NO:518) according to the present invention is supported by 147 libraries. The number of libraries was determined as previously described. This segment can be found in the following transcript(s): HSBMYB_T24 (SEQ ID NO:504) and HSBMYB_T26 (SEQ ID NO:505). Table 497 below describes the starting and ending position of this segment on each transcript.

TABLE 497

Segment location on transcripts

| Transcript name | Segment starting position | Segment ending position |
|---|---|---|
| HSBMYB_T24 (SEQ ID NO: 504) | 4127 | 4312 |
| HSBMYB_T26 (SEQ ID NO: 505) | 1147 | 1332 |

This segment can be found in the following protein(s): HSBMYB_P21 and HSBMYB_P23.

Segment cluster HSBMYB_node__52 (SEQ ID NO:519) according to the present invention is supported by 127 libraries. The number of libraries was determined as previously described. This segment can be found in the following transcript(s): HSBMYB_T24 (SEQ ID NO:504) and HSBMYB_T26 (SEQ ID NO:505). Table 498 below describes the starting and ending position of this segment on each transcript.

TABLE 498

Segment location on transcripts

| Transcript name | Segment starting position | Segment ending position |
|---|---|---|
| HSBMYB_T24 (SEQ ID NO: 504) | 4338 | 4478 |
| HSBMYB_T26 (SEQ ID NO: 505) | 1358 | 1498 |

This segment can be found in a non-coding region of transcript(s) that are related to the following protein(s): HSBMYB_P21 and HSBMYB_P23.

According to an optional embodiment of the present invention, short segments related to the above cluster are also provided. These segments are up to about 120 bp in length, and so are included in a separate description.

Segment cluster HSBMYB_node__2 (SEQ ID NO:520) according to the present invention is supported by 54 libraries. The number of libraries was determined as previously described. This segment can be found in the following transcript(s): HSBMYB_T23 (SEQ ID NO:503). Table 499 below describes the starting and ending position of this segment on each transcript.

TABLE 499

Segment location on transcripts

| Transcript name | Segment starting position | Segment ending position |
|---|---|---|
| HSBMYB_T23 (SEQ ID NO: 503) | 257 | 350 |

This segment can be found in the following protein(s): HSBMYB_P20.

Segment cluster HSBMYB_node__5 (SEQ ID NO:521) according to the present invention is supported by 56 libraries. The number of libraries was determined as previously described. This segment can be found in the following transcript(s): HSBMYB_T23 (SEQ ID NO:503). Table 500 below describes the starting and ending position of this segment on each transcript.

TABLE 500

Segment location on transcripts

| Transcript name | Segment starting position | Segment ending position |
|---|---|---|
| HSBMYB_T23 (SEQ ID NO: 503) | 351 | 422 |

This segment can be found in the following protein(s): HSBMYB_P20.

Segment cluster HSBMYB_node__7 (SEQ ID NO:522) according to the present invention is supported by 63 libraries. The number of libraries was determined as previously described. This segment can be found in the following transcript(s): HSBMYB_T23 (SEQ ID NO:503). Table 501 below describes the starting and ending position of this segment on each transcript.

TABLE 501

Segment location on transcripts

| Transcript name | Segment starting position | Segment ending position |
|---|---|---|
| HSBMYB_T23 (SEQ ID NO: 503) | 423 | 501 |

This segment can be found in the following protein(s): HSBMYB_P20.

Segment cluster HSBMYB_node__8 (SEQ ID NO:523) according to the present invention can be found in the following transcript(s): HSBMYB_T23 (SEQ ID NO:503). Table 502 below describes the starting and ending position of this segment on each transcript.

TABLE 502

Segment location on transcripts

| Transcript name | Segment starting position | Segment ending position |
|---|---|---|
| HSBMYB_T23 (SEQ ID NO: 503) | 502 | 515 |

This segment can be found in the following protein(s): HSBMYB_P20.

Segment cluster HSBMYB_node__17 (SEQ ID NO:524) according to the present invention is supported by 67 libraries. The number of libraries was determined as previously described. This segment can be found in the following transcript(s): HSBMYB_T23 (SEQ ID NO:503). Table 503 below describes the starting and ending position of this segment on each transcript.

TABLE 503

Segment location on transcripts

| Transcript name | Segment starting position | Segment ending position |
|---|---|---|
| HSBMYB_T23 (SEQ ID NO: 503) | 900 | 1008 |

This segment can be found in the following protein(s): HSBMYB_P20.

Segment cluster HSBMYB_node__29 (SEQ ID NO:525) according to the present invention can be found in the following transcript(s): HSBMYB_T24 (SEQ ID NO:504). Table 504 below describes the starting and ending position of this segment on each transcript.

TABLE 504

Segment location on transcripts

| Transcript name | Segment starting position | Segment ending position |
|---|---|---|
| HSBMYB_T24 (SEQ ID NO: 504) | 2192 | 2215 |

This segment can be found in a non-coding region of transcript(s) that are related to the following protein(s): HSB-MYB_P21.

Segment cluster HSBMYB_node__30 (SEQ ID NO:526) according to the present invention can be found in the following transcript(s): HSBMYB_T24 (SEQ ID NO:504). Table 505 below describes the starting and ending position of this segment on each transcript.

TABLE 505

Segment location on transcripts

| Transcript name | Segment starting position | Segment ending position |
|---|---|---|
| HSBMYB_T24 (SEQ ID NO: 504) | 2216 | 2233 |

This segment can be found in a non-coding region of transcript(s) that are related to the following protein(s): HSB-MYB_P21.

Segment cluster HSBMYB_node__31 (SEQ ID NO:527) according to the present invention is supported by 78 libraries. The number of libraries was determined as previously described. This segment can be found in the following transcript(s): HSBMYB_T24 (SEQ ID NO:504). Table 506 below describes the starting and ending position of this segment on each transcript.

TABLE 506

Segment location on transcripts

| Transcript name | Segment starting position | Segment ending position |
|---|---|---|
| HSBMYB_T24 (SEQ ID NO: 504) | 2234 | 2291 |

This segment can be found in a non-coding region of transcript(s) that are related to the following protein(s): HSB-MYB_P21.

Segment cluster HSBMYB_node__32 (SEQ ID NO:528) according to the present invention can be found in the following transcript(s): HSBMYB_T24 (SEQ ID NO:504). Table 507 below describes the starting and ending position of this segment on each transcript.

TABLE 507

Segment location on transcripts

| Transcript name | Segment starting position | Segment ending position |
|---|---|---|
| HSBMYB_T24 (SEQ ID NO: 504) | 2292 | 2295 |

This segment can be found in a non-coding region of transcript(s) that are related to the following protein(s): HSB-MYB_P21.

Segment cluster HSBMYB_node__34 (SEQ ID NO:529) according to the present invention is supported by 6 libraries. The number of libraries was determined as previously described. This segment can be found in the following transcript(s): HSBMYB_T24 (SEQ ID NO:504). Table 508 below describes the starting and ending position of this segment on each transcript.

TABLE 508

Segment location on transcripts

| Transcript name | Segment starting position | Segment ending position |
|---|---|---|
| HSBMYB_T24 (SEQ ID NO: 504) | 3658 | 3710 |

This segment can be found in the following protein(s): HSBMYB_P21.

Segment cluster HSBMYB_node__35 (SEQ ID NO:530) according to the present invention can be found in the following transcript(s): HSBMYB_T24 (SEQ ID NO:504). Table 509 below describes the starting and ending position of this segment on each transcript.

TABLE 509

Segment location on transcripts

| Transcript name | Segment starting position | Segment ending position |
|---|---|---|
| HSBMYB_T24 (SEQ ID NO: 504) | 3711 | 3716 |

This segment can be found in the following protein(s): HSBMYB_P21.

Segment cluster HSBMYB_node__36 (SEQ ID NO:531) according to the present invention is supported by 77 libraries. The number of libraries was determined as previously described. This segment can be found in the following transcript(s): HSBMYB_T24 (SEQ ID NO:504). Table 510 below describes the starting and ending position of this segment on each transcript.

TABLE 510

Segment location on transcripts

| Transcript name | Segment starting position | Segment ending position |
|---|---|---|
| HSBMYB_T24 (SEQ ID NO: 504) | 3717 | 3768 |

This segment can be found in the following protein(s): HSBMYB_P21.

Segment cluster HSBMYB_node__37 (SEQ ID NO:532) according to the present invention is supported by 83 libraries. The number of libraries was determined as previously described. This segment can be found in the following transcript(s): HSBMYB_T24 (SEQ ID NO:504). Table 511 below describes the starting and ending position of this segment on each transcript.

TABLE 511

Segment location on transcripts

| Transcript name | Segment starting position | Segment ending position |
|---|---|---|
| HSBMYB_T24 (SEQ ID NO: 504) | 3769 | 3797 |

This segment can be found in the following protein(s): HSBMYB_P21.

Segment cluster HSBMYB_node_38 (SEQ ID NO:533) according to the present invention is supported by 82 libraries. The number of libraries was determined as previously described. This segment can be found in the following transcript(s): HSBMYB_T24 (SEQ ID NO:504). Table 512 below describes the starting and ending position of this segment on each transcript.

TABLE 512

Segment location on transcripts

| Transcript name | Segment starting position | Segment ending position |
|---|---|---|
| HSBMYB_T24 (SEQ ID NO: 504) | 3798 | 3830 |

This segment can be found in the following protein(s): HSBMYB_P21.

Segment cluster HSBMYB_node_41 (SEQ ID NO:534) according to the present invention can be found in the following transcript(s): HSBMYB_T24 (SEQ ID NO:504) and HSBMYB_T26 (SEQ ID NO:505). Table 513 below describes the starting and ending position of this segment on each transcript.

TABLE 513

Segment location on transcripts

| Transcript name | Segment starting position | Segment ending position |
|---|---|---|
| HSBMYB_T24 (SEQ ID NO: 504) | 3831 | 3855 |
| HSBMYB_T26 (SEQ ID NO: 505) | 851 | 875 |

This segment can be found in both coding and non-coding regions of transcript(s) as follows. The segment can be found in a non-coding region of transcript(s) that are related to the following protein(s): HSBMYB_P23. This segment can also be found in the following protein(s): HSBMYB_P21, since it is in the coding region for the corresponding transcript.

Segment cluster HSBMYB_node_42 (SEQ ID NO:535) according to the present invention is supported by 100 libraries. The number of libraries was determined as previously described. This segment can be found in the following transcript(s): HSBMYB_T24 (SEQ ID NO:504) and HSBMYB_T26 (SEQ ID NO:505). Table 514 below describes the starting and ending position of this segment on each transcript.

TABLE 514

Segment location on transcripts

| Transcript name | Segment starting position | Segment ending position |
|---|---|---|
| HSBMYB_T24 (SEQ ID NO: 504) | 3856 | 3935 |
| HSBMYB_T26 (SEQ ID NO: 505) | 876 | 955 |

This segment can be found in the following protein(s): HSBMYB_P21 and HSBMYB_P23.

Segment cluster HSBMYB_node_46 (SEQ ID NO:536) according to the present invention is supported by 93 libraries. The number of libraries was determined as previously described. This segment can be found in the following transcript(s): HSBMYB_T24 (SEQ ID NO:504) and HSBMYB_T26 (SEQ ID NO:505). Table 515 below describes the starting and ending position of this segment on each transcript.

TABLE 515

Segment location on transcripts

| Transcript name | Segment starting position | Segment ending position |
|---|---|---|
| HSBMYB_T24 (SEQ ID NO: 504) | 3936 | 3964 |
| HSBMYB_T26 (SEQ ID NO: 505) | 956 | 984 |

This segment can be found in the following protein(s): HSBMYB_P21 and HSBMYB_P23.

Segment cluster HSBMYB_node_49 (SEQ ID NO:537) according to the present invention is supported by 129 libraries. The number of libraries was determined as previously described. This segment can be found in the following transcript(s): HSBMYB_T24 (SEQ ID NO:504) and HSBMYB_T26 (SEQ ID NO:505). Table 516 below describes the starting and ending position of this segment on each transcript.

TABLE 516

Segment location on transcripts

| Transcript name | Segment starting position | Segment ending position |
|---|---|---|
| HSBMYB_T24 (SEQ ID NO: 504) | 4086 | 4126 |
| HSBMYB_T26 (SEQ ID NO: 505) | 1106 | 1146 |

This segment can be found in the following protein(s): HSBMYB_P21 and HSBMYB_P23.

Segment cluster HSBMYB_node_51 (SEQ ID NO:538) according to the present invention can be found in the following transcript(s): HSBMYB_T24 (SEQ ID NO:504) and HSBMYB_T26 (SEQ ID NO:505). Table 517 below describes the starting and ending position of this segment on each transcript.

TABLE 517

Segment location on transcripts

| Transcript name | Segment starting position | Segment ending position |
|---|---|---|
| HSBMYB_T24 (SEQ ID NO: 504) | 4313 | 4337 |
| HSBMYB_T26 (SEQ ID NO: 505) | 1333 | 1357 |

This segment can be found in a non-coding region of transcript(s) that are related to the following protein(s): HSBMYB_P21 and HSBMYB_P23.

Segment cluster HSBMYB_node_53 (SEQ ID NO:539) according to the present invention can be found in the following transcript(s): HSBMYB_T24 (SEQ ID NO:504) and HSBMYB_T26 (SEQ ID NO:505). Table 518 below describes the starting and ending position of this segment on each transcript.

TABLE 518

Segment location on transcripts

| Transcript name | Segment starting position | Segment ending position |
|---|---|---|
| HSBMYB_T24 (SEQ ID NO: 504) | 4479 | 4501 |
| HSBMYB_T26 (SEQ ID NO: 505) | 1499 | 1521 |

This segment can be found in a non-coding region of transcript(s) that are related to the following protein(s): HSBMYB_P21 and HSBMYB_P23.

Segment cluster HSBMYB_node_54 (SEQ ID NO:540) according to the present invention is supported by 118 libraries. The number of libraries was determined as previously described. This segment can be found in the following transcript(s): HSBMYB_T24 (SEQ ID NO:504) and HSBMYB_T26 (SEQ ID NO:505). Table 519 below describes the starting and ending position of this segment on each transcript.

TABLE 519

Segment location on transcripts

| Transcript name | Segment starting position | Segment ending position |
|---|---|---|
| HSBMYB_T24 (SEQ ID NO: 504) | 4502 | 4563 |
| HSBMYB_T26 (SEQ ID NO: 505) | 1522 | 1583 |

This segment can be found in a non-coding region of transcript(s) that are related to the following protein(s): HSBMYB_P21 and HSBMYB_P23.

Segment cluster HSBMYB_node_55 (SEQ ID NO:541) according to the present invention is supported by 101 libraries. The number of libraries was determined as previously described. This segment can be found in the following transcript(s): HSBMYB_T24 (SEQ ID NO:504) and HSBMYB_T26 (SEQ ID NO:505). Table 520 below describes the starting and ending position of this segment on each transcript.

TABLE 520

Segment location on transcripts

| Transcript name | Segment starting position | Segment ending position |
|---|---|---|
| HSBMYB_T24 (SEQ ID NO: 504) | 4564 | 4625 |
| HSBMYB_T26 (SEQ ID NO: 505) | 1584 | 1645 |

This segment can be found in a non-coding region of transcript(s) that are related to the following protein(s): HSBMYB_P21 and HSBMYB_P23.

Description for Cluster HSCALLA

Cluster HSCALLA features 10 transcript(s) and 36 segment(s) of interest, the names for which are given in Tables 521 and 522, respectively, the sequences themselves are given at the end of the application. The selected protein variants are given in Table 523.

TABLE 521

Transcripts of interest
Transcript Name

HSCALLA_T6 (SEQ ID NO: 542)
HSCALLA_T7 (SEQ ID NO: 543)
HSCALLA_T8 (SEQ ID NO: 544)
HSCALLA_T9 (SEQ ID NO: 545)
HSCALLA_T10 (SEQ ID NO: 546)
HSCALLA_T12 (SEQ ID NO: 547)
HSCALLA_T14 (SEQ ID NO: 548)
HSCALLA_T20 (SEQ ID NO: 549)
HSCALLA_T24 (SEQ ID NO: 550)
HSCALLA_T26 (SEQ ID NO: 551)

TABLE 522

Segments of interest
Segment Name

HSCALLA_node_0 (SEQ ID NO: 552)
HSCALLA_node_6 (SEQ ID NO: 553)
HSCALLA_node_8 (SEQ ID NO: 554)
HSCALLA_node_11 (SEQ ID NO: 555)
HSCALLA_node_13 (SEQ ID NO: 556)
HSCALLA_node_15 (SEQ ID NO: 557)
HSCALLA_node_16 (SEQ ID NO: 558)
HSCALLA_node_18 (SEQ ID NO: 559)
HSCALLA_node_23 (SEQ ID NO: 560)
HSCALLA_node_25 (SEQ ID NO: 561)
HSCALLA_node_26 (SEQ ID NO: 562)
HSCALLA_node_27 (SEQ ID NO: 563)
HSCALLA_node_30 (SEQ ID NO: 564)
HSCALLA_node_40 (SEQ ID NO: 565)
HSCALLA_node_42 (SEQ ID NO: 566)
HSCALLA_node_46 (SEQ ID NO: 567)
HSCALLA_node_50 (SEQ ID NO: 568)
HSCALLA_node_60 (SEQ ID NO: 569)
HSCALLA_node_63 (SEQ ID NO: 570)
HSCALLA_node_78 (SEQ ID NO: 571)
HSCALLA_node_2 (SEQ ID NO: 572)
HSCALLA_node_7 (SEQ ID NO: 573)
HSCALLA_node_20 (SEQ ID NO: 574)
HSCALLA_node_33 (SEQ ID NO: 575)
HSCALLA_node_35 (SEQ ID NO: 576)
HSCALLA_node_37 (SEQ ID NO: 577)
HSCALLA_node_39 (SEQ ID NO: 578)
HSCALLA_node_44 (SEQ ID NO: 579)
HSCALLA_node_48 (SEQ ID NO: 580)
HSCALLA_node_52 (SEQ ID NO: 581)
HSCALLA_node_54 (SEQ ID NO: 582)
HSCALLA_node_56 (SEQ ID NO: 583)
HSCALLA_node_58 (SEQ ID NO: 584)
HSCALLA_node_65 (SEQ ID NO: 585)
HSCALLA_node_69 (SEQ ID NO: 586)
HSCALLA_node_71 (SEQ ID NO: 587)

TABLE 523

Proteins of interest

| Protein Name | Corresponding Transcript(s) |
|---|---|
| HSCALLA_P1 | HSCALLA_T20 (SEQ ID NO: 549) |
| HSCALLA_P2 | HSCALLA_T12 (SEQ ID NO: 547) |
| HSCALLA_P4 | HSCALLA_T14 (SEQ ID NO: 548) |
| HSCALLA_P8 | HSCALLA_T24 (SEQ ID NO: 550) |
| HSCALLA_P9 | HSCALLA_T26 (SEQ ID NO: 551) |
| HSCALLA_P11 | HSCALLA_T6 (SEQ ID NO: 542); |
|  | HSCALLA_T7 (SEQ ID NO: 543); |
|  | HSCALLA_T8 (SEQ ID NO: 544); |

TABLE 523-continued

Proteins of interest

| Protein Name | Corresponding Transcript(s) |
|---|---|
| | HSCALLA_T9 (SEQ ID NO: 545); |
| | HSCALLA_T10 (SEQ ID NO: 546) |

These sequences are variants of the known protein Neprilysin (SwissProt accession identifier NEP_HUMAN; known also according to the synonyms EC 3.4.24.11; Neutral endopeptidase; NEP; Enkephalinase; Common acute lymphocytic leukemia antigen; CALLA; Neutral endopeptidase 24.11; CD10), referred to herein as the previously known protein.

Protein Neprilysin is known or believed to have the following function(s): Thermolysin-like specificity, but is almost confined on acting on polypeptides of up to 30 amino acids. Biologically important in the destruction of opioid peptides such as Met- and Leu-enkephalins by cleavage of a Gly-Phe bond. The sequence for protein Neprilysin is given at the end of the application, as "Neprilysin amino acid sequence". Known polymorphisms for this sequence are as shown in Table 524.

TABLE 524

Amino acid mutations for Known Protein

| SNP position(s) on amino acid sequence | Comment |
|---|---|
| 25 | P -> R |
| 43 | T -> R |
| 80 | T -> R |
| 303 | T -> R |

Protein Neprilysin localization is believed to be Type II membrane protein.

The previously known protein also has the following indication(s) and/or potential therapeutic use(s): Inflammation. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Enkephalinase stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Opthalmological; GI inflammatory/bowel disorders; Anti-inflammatory; Anticancer; Antimigraine.

The following GO Annotation(s) apply to the previously known protein. The following annotation(s) were found: proteolysis and peptidolysis; cell-cell signaling, which are annotation(s) related to Biological Process; metallopeptidase, which are annotation(s) related to Molecular Function; and integral plasma membrane protein, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HSCALLA can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 17 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 17 and Table 525. This cluster is overexpressed (at least at a minimum level) in the following pathological conditions: adrenal cortical carcinoma.

TABLE 525

Normal tissue distribution

| Name of Tissue | Number |
|---|---|
| Adrenal | 0 |
| Bone | 498 |
| Colon | 0 |
| epithelial | 117 |
| General | 66 |
| Kidney | 466 |
| Liver | 97 |
| Lung | 40 |
| Lymph nodes | 75 |
| Breast | 158 |
| Ovary | 0 |
| Prostate | 192 |
| Skin | 83 |
| Uterus | 13 |

TABLE 526

P values and ratios for expression in cancerous tissue

| Name of Tissue | P1 | P2 | SP1 | R3 | SP2 | R4 |
|---|---|---|---|---|---|---|
| Adrenal | 4.2e–01 | 1.9e–01 | 4.6e–01 | 2.2 | 3.6e–03 | 3.6 |
| Bone | 4.9e–01 | 4.2e–01 | 9.9e–01 | 0.3 | 1 | 0.3 |
| Colon | 7.2e–02 | 1.1e–01 | 1.7e–01 | 2.9 | 2.7e–01 | 2.3 |
| epithelial | 6.1e–01 | 6.3e–01 | 1 | 0.4 | 1 | 0.4 |
| General | 8.1e–01 | 5.1e–01 | 1 | 0.5 | 1 | 0.6 |
| Kidney | 8.2e–01 | 8.5e–01 | 1 | 0.1 | 1 | 0.1 |
| Liver | 8.2e–01 | 8.1e–01 | 1 | 0.3 | 6.3e–01 | 0.7 |
| Lung | 3.0e–01 | 1.9e–01 | 7.8e–01 | 0.9 | 7.7e–01 | 0.8 |
| lymph nodes | 6.3e–01 | 4.6e–01 | 8.1e–01 | 1.0 | 6.8e–01 | 1.0 |
| Breast | 8.2e–01 | 8.5e–01 | 9.6e–01 | 0.4 | 9.9e–01 | 0.4 |
| Ovary | 3.8e–01 | 4.2e–01 | 1.5e–02 | 1.9 | 5.4e–02 | 1.6 |
| Prostate | 8.7e–01 | 8.8e–01 | 9.4e–01 | 0.5 | 9.9e–01 | 0.4 |
| Skin | 8.5e–01 | 1.9e–01 | 1 | 0.1 | 6.6e–01 | 0.6 |
| Uterus | 4.4e–01 | 5.3e–01 | 2.9e–01 | 1.6 | 4.1e–01 | 1.2 |

As noted above, cluster HSCALLA features 36 segment(s), which were listed in Table 522 above and for which the sequence(s) are given at the end of the application. These segment(s) are portions of nucleic acid sequence(s) which are described herein separately because they are of particular interest. A description of each segment according to the present invention is now provided.

Segment cluster HSCALLA_node_0 (SEQ ID NO:552) according to the present invention is supported by 2 libraries. The number of libraries was determined as previously described. This segment can be found in the following transcript(s): HSCALLA_T6 (SEQ ID NO:542). Table 527 below describes the starting and ending position of this segment on each transcript.

TABLE 527

Segment location on transcripts

| Transcript name | Segment starting position | Segment ending position |
|---|---|---|
| HSCALLA_T6 (SEQ ID NO: 542) | 1 | 123 |

This segment can be found in a non-coding region of transcript(s) that are related to the following protein(s): HSCALLA_P11.

Segment cluster HSCALLA_node_6 (SEQ ID NO:553) according to the present invention is supported by 5 libraries. The number of libraries was determined as previously described. This segment can be found in the following transcript(s): HSCALLA_T12 (SEQ ID NO:547), HSCALLA_T24 (SEQ ID NO:550) and HSCALLA_T26 (SEQ ID NO:551). Table 528 below describes the starting and ending position of this segment on each transcript.

TABLE 528

Segment location on transcripts

| Transcript name | Segment starting position | Segment ending position |
|---|---|---|
| HSCALLA_T12 (SEQ ID NO: 547) | 1 | 214 |
| HSCALLA_T24 (SEQ ID NO: 550) | 1 | 214 |
| HSCALLA_T26 (SEQ ID NO: 551) | 1 | 214 |

This segment can be found in a non-coding region of transcript(s) that are related to the following protein(s): HSCALLA_P2, HSCALLA_P8 and HSCALLA_P9.

Segment cluster HSCALLA_node_8 (SEQ ID NO:554) according to the present invention is supported by 13 libraries. The number of libraries was determined as previously described. This segment can be found in the following transcript(s): HSCALLA_T12 (SEQ ID NO:547), HSCALLA_T24 (SEQ ID NO:550) and HSCALLA_T26 (SEQ ID NO:551). Table 529 below describes the starting and ending position of this segment on each transcript.

TABLE 529

Segment location on transcripts

| Transcript name | Segment starting position | Segment ending position |
|---|---|---|
| HSCALLA_T12 (SEQ ID NO: 547) | 276 | 446 |
| HSCALLA_T24 (SEQ ID NO: 550) | 276 | 446 |
| HSCALLA_T26 (SEQ ID NO: 551) | 276 | 446 |

This segment can be found in a non-coding region of transcript(s) that are related to the following protein(s): HSCALLA_P2, HSCALLA_P8 and HSCALLA_P9.

Segment cluster HSCALLA_node_11 (SEQ ID NO:555) according to the present invention is supported by 1 libraries. The number of libraries was determined as previously described. This segment can be found in the following transcript(s): HSCALLA_T10 (SEQ ID NO:546). Table 530 below describes the starting and ending position of this segment on each transcript.

TABLE 530

Segment location on transcripts

| Transcript name | Segment starting position | Segment ending position |
|---|---|---|
| HSCALLA_T10 (SEQ ID NO: 546) | 1 | 293 |

This segment can be found in a non-coding region of transcript(s) that are related to the following protein(s): HSCALLA_P11.

Segment cluster HSCALLA_node_13 (SEQ ID NO:556) according to the present invention is supported by 1 libraries. The number of libraries was determined as previously described. This segment can be found in the following transcript(s): HSCALLA_T9 (SEQ ID NO:545). Table 531 below describes the starting and ending position of this segment on each transcript.

TABLE 531

Segment location on transcripts

| Transcript name | Segment starting position | Segment ending position |
|---|---|---|
| HSCALLA_T9 (SEQ ID NO: 545) | 1 | 602 |

This segment can be found in a non-coding region of transcript(s) that are related to the following protein(s): HSCALLA_P11.

Segment cluster HSCALLA_node_15 (SEQ ID NO:557) according to the present invention is supported by 3 libraries. The number of libraries was determined as previously described. This segment can be found in the following transcript(s): HSCALLA_T7 (SEQ ID NO:543) and HSCALLA_T8 (SEQ ID NO:544). Table 532 below describes the starting and ending position of this segment on each transcript.

TABLE 532

Segment location on transcripts

| Transcript name | Segment starting position | Segment ending position |
|---|---|---|
| HSCALLA_T7 (SEQ ID NO: 543) | 1 | 268 |
| HSCALLA_T8 (SEQ ID NO: 544) | 1 | 268 |

This segment can be found in a non-coding region of transcript(s) that are related to the following protein(s): HSCALLA_P11.

Segment cluster HSCALLA_node_16 (SEQ ID NO:558) according to the present invention is supported by 2 libraries. The number of libraries was determined as previously described. This segment can be found in the following transcript(s): HSCALLA_T7 (SEQ ID NO:543). Table 533 below describes the starting and ending position of this segment on each transcript.

TABLE 533

Segment location on transcripts

| Transcript name | Segment starting position | Segment ending position |
|---|---|---|
| HSCALLA_T7 (SEQ ID NO: 543) | 269 | 518 |

This segment can be found in a non-coding region of transcript(s) that are related to the following protein(s): HSCALLA_P11.

Segment cluster HSCALLA_node_18 (SEQ ID NO:559) according to the present invention is supported by 32 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T20 (SEQ ID NO:549), HSCALLA_T24 (SEQ ID NO:550) and HSCALLA_T26 (SEQ ID NO:551). Table 534 below describes the starting and ending position of this segment on each transcript.

TABLE 534

Segment location on transcripts

| Transcript name | Segment starting position | Segment ending position |
| --- | --- | --- |
| HSCALLA_T6 (SEQ ID NO: 542) | 124 | 293 |
| HSCALLA_T7 (SEQ ID NO: 543) | 519 | 688 |
| HSCALLA_T8 (SEQ ID NO: 544) | 269 | 438 |
| HSCALLA_T9 (SEQ ID NO: 545) | 603 | 772 |
| HSCALLA_T10 (SEQ ID NO: 546) | 294 | 463 |
| HSCALLA_T12 (SEQ ID NO: 547) | 447 | 616 |
| HSCALLA_T20 (SEQ ID NO: 549) | 111 | 280 |
| HSCALLA_T24 (SEQ ID NO: 550) | 447 | 616 |
| HSCALLA_T26 (SEQ ID NO: 551) | 447 | 616 |

This segment can be found in both coding and non-coding regions of transcript(s) as follows. The segment can be found in a non-coding region of transcript(s) that are related to the following protein(s): HSCALLA_P2. This segment can also be found in the following protein(s): HSCALLA_P11, HSCALLA_P1, HSCALLA_P8 and HSCALLA_P9, since it is in the coding region for the corresponding transcript.

Segment cluster HSCALLA_node_23 (SEQ ID NO:560) according to the present invention is supported by 6 libraries. The number of libraries was determined as previously described. This segment can be found in the following transcript(s): HSCALLA_T26 (SEQ ID NO:551). Table 535 below describes the starting and ending position of this segment on each transcript.

TABLE 535

Segment location on transcripts

| Transcript name | Segment starting position | Segment ending position |
| --- | --- | --- |
| HSCALLA_T26 (SEQ ID NO: 551) | 653 | 1327 |

This segment can be found in the following protein(s): HSCALLA_P9.

Segment cluster HSCALLA_node_25 (SEQ ID NO:561) according to the present invention is supported by 1 libraries. The number of libraries was determined as previously described. This segment can be found in the following transcript(s): HSCALLA_T14 (SEQ ID NO:548). Table 536 below describes the starting and ending position of this segment on each transcript.

TABLE 536

Segment location on transcripts

| Transcript name | Segment starting position | Segment ending position |
| --- | --- | --- |
| HSCALLA_T14 (SEQ ID NO: 548) | 1 | 145 |

This segment can be found in a non-coding region of transcript(s) that are related to the following protein(s): HSCALLA_P4.

Segment cluster HSCALLA_node_26 (SEQ ID NO:562) according to the present invention is supported by 2 libraries. The number of libraries was determined as previously described. This segment can be found in the following transcript(s): HSCALLA_T12 (SEQ ID NO:547) and HSCALLA_T14 (SEQ ID NO:548). Table 537 below describes the starting and ending position of this segment on each transcript.

TABLE 537

Segment location on transcripts

| Transcript name | Segment starting position | Segment ending position |
| --- | --- | --- |
| HSCALLA_T12 (SEQ ID NO: 547) | 653 | 836 |
| HSCALLA_T14 (SEQ ID NO: 548) | 146 | 329 |

This segment can be found in both coding and non-coding regions of transcript(s) as follows. The segment can be found in a non-coding region of transcript(s) that are related to the following protein(s): HSCALLA_P4. This segment can also be found in the following protein(s): HSCALLA_P2, since it is in the coding region for the corresponding transcript.

Segment cluster HSCALLA_node_27 (SEQ ID NO:563) according to the present invention is supported by 1 libraries. The number of libraries was determined as previously described. This segment can be found in the following transcript(s): HSCALLA_T14 (SEQ ID NO:548). Table 538 below describes the starting and ending position of this segment on each transcript.

TABLE 538

Segment location on transcripts

| Transcript name | Segment starting position | Segment ending position |
| --- | --- | --- |
| HSCALLA_T14 (SEQ ID NO: 548) | 330 | 488 |

This segment can be found in a non-coding region of transcript(s) that are related to the following protein(s): HSCALLA_P4.

Segment cluster HSCALLA_node_30 (SEQ ID NO:564) according to the present invention is supported by 36 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548), HSCALLA_T20 (SEQ ID NO:549) and HSCALLA_T24 (SEQ ID NO:550). Table 539 below describes the starting and ending position of this segment on each transcript.

TABLE 539

Segment location on transcripts

| Transcript name | Segment starting position | Segment ending position |
|---|---|---|
| HSCALLA_T6 (SEQ ID NO: 542) | 330 | 491 |
| HSCALLA_T7 (SEQ ID NO: 543) | 725 | 886 |
| HSCALLA_T8 (SEQ ID NO: 544) | 475 | 636 |
| HSCALLA_T9 (SEQ ID NO: 545) | 809 | 970 |
| HSCALLA_T10 (SEQ ID NO: 546) | 500 | 661 |
| HSCALLA_T12 (SEQ ID NO: 547) | 837 | 998 |
| HSCALLA_T14 (SEQ ID NO: 548) | 489 | 650 |
| HSCALLA_T20 (SEQ ID NO: 549) | 317 | 478 |
| HSCALLA_T24 (SEQ ID NO: 550) | 653 | 814 |

This segment can be found in the following protein(s): HSCALLA_P11, HSCALLA_P2, HSCALLA_P4, HSCALLA_P1 and HSCALLA_P8.

Segment cluster HSCALLA_node_40 (SEQ ID NO:565) according to the present invention is supported by 1 libraries. The number of libraries was determined as previously described. This segment can be found in the following transcript(s): HSCALLA_P2 (SEQ ID NO:550). Table 540 below describes the starting and ending position of this segment on each transcript.

TABLE 540

Segment location on transcripts

| Transcript name | Segment starting position | Segment ending position |
|---|---|---|
| HSCALLA_T24 (SEQ ID NO: 550) | 1177 | 1644 |

This segment can be found in the following protein(s): HSCALLA_P8.

Segment cluster HSCALLA_node_42 (SEQ ID NO:566) according to the present invention is supported by 26 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 541 below describes the starting and ending position of this segment on each transcript.

TABLE 541

Segment location on transcripts

| Transcript name | Segment starting position | Segment ending position |
|---|---|---|
| HSCALLA_T6 (SEQ ID NO: 542) | 854 | 988 |
| HSCALLA_T7 (SEQ ID NO: 543) | 1249 | 1383 |
| HSCALLA_T8 (SEQ ID NO: 544) | 999 | 1133 |
| HSCALLA_T9 (SEQ ID NO: 545) | 1333 | 1467 |
| HSCALLA_T10 (SEQ ID NO: 546) | 1024 | 1158 |
| HSCALLA_T12 (SEQ ID NO: 547) | 1361 | 1495 |
| HSCALLA_T14 (SEQ ID NO: 548) | 1013 | 1147 |
| HSCALLA_T20 (SEQ ID NO: 549) | 841 | 975 |

This segment can be found in the following protein(s): HSCALLA_P11, HSCALLA_P2, HSCALLA_P4 and HSCALLA_P1.

Segment cluster HSCALLA_node_46 (SEQ ID NO:567) according to the present invention is supported by 25 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 542 below describes the starting and ending position of this segment on each transcript.

TABLE 542

Segment location on transcripts

| Transcript name | Segment starting position | Segment ending position |
|---|---|---|
| HSCALLA_T6 (SEQ ID NO: 542) | 1091 | 1227 |
| HSCALLA_T7 (SEQ ID NO: 543) | 1486 | 1622 |
| HSCALLA_T8 (SEQ ID NO: 544) | 1236 | 1372 |
| HSCALLA_T9 (SEQ ID NO: 545) | 1570 | 1706 |
| HSCALLA_T10 (SEQ ID NO: 546) | 1261 | 1397 |
| HSCALLA_T12 (SEQ ID NO: 547) | 1598 | 1734 |
| HSCALLA_T14 (SEQ ID NO: 548) | 1250 | 1386 |
| HSCALLA_T20 (SEQ ID NO: 549) | 1078 | 1214 |

This segment can be found in the following protein(s): HSCALLA_P11, HSCALLA_P2, HSCALLA_P4 and HSCALLA_P1.

Segment cluster HSCALLA_node_50 (SEQ ID NO:568) according to the present invention is supported by 25 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 543 below describes the starting and ending position of this segment on each transcript.

TABLE 543

Segment location on transcripts

| Transcript name | Segment starting position | Segment ending position |
|---|---|---|
| HSCALLA_T6 (SEQ ID NO: 542) | 1322 | 1450 |
| HSCALLA_T7 (SEQ ID NO: 543) | 1717 | 1845 |
| HSCALLA_T8 (SEQ ID NO: 544) | 1467 | 1595 |
| HSCALLA_T9 (SEQ ID NO: 545) | 1801 | 1929 |
| HSCALLA_T10 (SEQ ID NO: 546) | 1492 | 1620 |
| HSCALLA_T12 (SEQ ID NO: 547) | 1829 | 1957 |
| HSCALLA_T14 (SEQ ID NO: 548) | 1481 | 1609 |
| HSCALLA_T20 (SEQ ID NO: 549) | 1309 | 1437 |

This segment can be found in the following protein(s): HSCALLA_P11, HSCALLA_P2, HSCALLA_P4 and HSCALLA_P1.

Segment cluster HSCALLA_node_60 (SEQ ID NO:569) according to the present invention is supported by 30 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 544 below describes the starting and ending position of this segment on each transcript.

TABLE 544

Segment location on transcripts

| Transcript name | Segment starting position | Segment ending position |
|---|---|---|
| HSCALLA_T6 (SEQ ID NO: 542) | 1794 | 1913 |
| HSCALLA_T7 (SEQ ID NO: 543) | 2189 | 2308 |
| HSCALLA_T8 (SEQ ID NO: 544) | 1939 | 2058 |
| HSCALLA_T9 (SEQ ID NO: 545) | 2273 | 2392 |
| HSCALLA_T10 (SEQ ID NO: 546) | 1964 | 2083 |
| HSCALLA_T12 (SEQ ID NO: 547) | 2301 | 2420 |
| HSCALLA_TI4 (SEQ ID NO: 548) | 1953 | 2072 |
| HSCALLA_T20 (SEQ ID NO: 549) | 1781 | 1900 |

This segment can be found in the following protein(s): HSCALLA_P11, HSCALLA_P2, HSCALLA_P4 and HSCALLA_P1.

Segment cluster HSCALLA_node__63 (SEQ ID NO:570) according to the present invention is supported by 31 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 545 below describes the starting and ending position of this segment on each transcript.

TABLE 545

Segment location on transcripts

| Transcript name | Segment starting position | Segment ending position |
|---|---|---|
| HSCALLA_T6 (SEQ ID NO: 542) | 1914 | 2047 |
| HSCALLA_T7 (SEQ ID NO: 543) | 2309 | 2442 |
| HSCALLA_T8 (SEQ ID NO: 544) | 2059 | 2192 |
| HSCALLA_T9 (SEQ ID NO: 545) | 2393 | 2526 |
| HSCALLA_T10 (SEQ ID NO: 546) | 2084 | 2217 |
| HSCALLA_T12 (SEQ ID NO: 547) | 2421 | 2554 |
| HSCALLA_T14 (SEQ ID NO: 548) | 2073 | 2206 |
| HSCALLA_T20 (SEQ ID NO: 549) | 1901 | 2034 |

This segment can be found in the following protein(s): HSCALLA_P11, HSCALLA_P2, HSCALLA_P4 and HSCALLA_P1.

Segment cluster HSCALLA_node__78 (SEQ ID NO:571) according to the present invention is supported by 247 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 546 below describes the starting and ending position of this segment on each transcript.

TABLE 546

Segment location on transcripts

| Transcript name | Segment starting position | Segment ending position |
|---|---|---|
| HSCALLA_T6 (SEQ ID NO: 542) | 2287 | 5633 |
| HSCALLA_T7 (SEQ ID NO: 543) | 2682 | 6028 |
| HSCALLA_T8 (SEQ ID NO: 544) | 2432 | 5778 |
| HSCALLA_T9 (SEQ ID NO: 545) | 2766 | 6112 |
| HSCALLA_T10 (SEQ ID NO: 546) | 2457 | 5803 |
| HSCALLA_T12 (SEQ ID NO: 547) | 2794 | 6140 |
| HSCALLA_T14 (SEQ ID NO: 548) | 2446 | 5792 |
| HSCALLA_T20 (SEQ ID NO: 549) | 2274 | 2990 |

This segment can be found in the following protein(s): HSCALLA_P11, HSCALLA_P2, HSCALLA_P4 and HSCALLA_P1.

According to an optional embodiment of the present invention, short segments related to the above cluster are also provided. These segments are up to about 120 bp in length, and so are included in a separate description.

Segment cluster HSCALLA_node__2 (SEQ ID NO:572) according to the present invention is supported by 7 libraries. The number of libraries was determined as previously described. This segment can be found in the following transcript(s): HSCALLA_T20 (SEQ ID NO:549). Table 547 below describes the starting and ending position of this segment on each transcript.

TABLE 547

Segment location on transcripts

| Transcript name | Segment starting position | Segment ending position |
|---|---|---|
| HSCALLA_T20 (SEQ ID NO: 549) | 1 | 110 |

This segment can be found in a non-coding region of transcript(s) that are related to the following protein(s): HSCALLA_P1.

Segment cluster HSCALLA_node__7 (SEQ ID NO:573) according to the present invention is supported by 3 libraries. The number of libraries was determined as previously described. This segment can be found in the following transcript(s): HSCALLA_T12 (SEQ ID NO:547), HSCALLA_T24 (SEQ ID NO:550) and HSCALLA_T26 (SEQ ID NO:551). Table 548 below describes the starting and ending position of this segment on each transcript.

TABLE 548

Segment location on transcripts

| Transcript name | Segment starting position | Segment ending position |
|---|---|---|
| HSCALLA_T12 (SEQ ID NO: 547) | 215 | 275 |
| HSCALLA_T24 (SEQ ID NO: 550) | 215 | 275 |
| HSCALLA_T26 (SEQ ID NO: 551) | 215 | 275 |

This segment can be found in a non-coding region of transcript(s) that are related to the following protein(s): HSCALLA_P2, HSCALLA_P8 and HSCALLA_P9.

Segment cluster HSCALLA_node__20 (SEQ ID NO:574) according to the present invention is supported by 31 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T20 (SEQ ID NO:549), HSCALLA_T24 (SEQ ID NO:550) and HSCALLA_T26 (SEQ ID NO:551). Table 549 below describes the starting and ending position of this segment on each transcript.

TABLE 549

Segment location on transcripts

| Transcript name | Segment starting position | Segment ending position |
|---|---|---|
| HSCALLA_T6 (SEQ ID NO: 542) | 294 | 329 |
| HSCALLA_T7 (SEQ ID NO: 543) | 689 | 724 |
| HSCALLA_T8 (SEQ ID NO: 544) | 439 | 474 |
| HSCALLA_T9 (SEQ ID NO: 545) | 773 | 808 |
| HSCALLA_T10 (SEQ ID NO: 546) | 464 | 499 |
| HSCALLA_T12 (SEQ ID NO: 547) | 617 | 652 |
| HSCALLA_T20 (SEQ ID NO: 549) | 281 | 316 |
| HSCALLA_T24 (SEQ ID NO: 550) | 617 | 652 |
| HSCALLA_T26 (SEQ ID NO: 551) | 617 | 652 |

This segment can be found in both coding and non-coding regions of transcript(s) as follows. The segment can be found in a non-coding region of transcript(s) that are related to the following protein(s): HSCALLA_P2. This segment can also be found in the following protein(s): HSCALLA_P11, HSCALLA_P1, HSCALLA_P8 and HSCALLA_P9, since it is in the coding region for the corresponding transcript.

Segment cluster HSCALLA_node__33 (SEQ ID NO:575) according to the present invention is supported by 33 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548), HSCALLA_T20 (SEQ ID NO:549) and HSCALLA_T24 (SEQ ID NO:550). Table 550 below describes the starting and ending position of this segment on each transcript.

TABLE 550

Segment location on transcripts

| Transcript name | Segment starting position | Segment ending position |
|---|---|---|
| HSCALLA_T6 (SEQ ID NO: 542) | 492 | 572 |
| HSCALLA_T7 (SEQ ID NO: 543) | 887 | 967 |
| HSCALLA_T8 (SEQ ID NO: 544) | 637 | 717 |
| HSCALLA_T9 (SEQ ID NO: 545) | 971 | 1051 |
| HSCALLA_T10 (SEQ ID NO: 546) | 662 | 742 |
| HSCALLA_T12 (SEQ ID NO: 547) | 999 | 1079 |
| HSCALLA_T14 (SEQ ID NO: 548) | 651 | 731 |
| HSCALLA_T20 (SEQ ID NO: 549) | 479 | 559 |
| HSCALLA_T24 (SEQ ID NO: 550) | 815 | 895 |

This segment can be found in the following protein(s): HSCALLA_P11, HSCALLA_P2, HSCALLA_P4, HSCALLA_P1 and HSCALLA_P8.

Segment cluster HSCALLA_node__35 (SEQ ID NO:576) according to the present invention is supported by 33 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548), HSCALLA_T20 (SEQ ID NO:549) and HSCALLA_T24 (SEQ ID NO:550). Table 551 below describes the starting and ending position of this segment on each transcript.

TABLE 551

Segment location on transcripts

| Transcript name | Segment starting position | Segment ending position |
|---|---|---|
| HSCALLA_T6 (SEQ ID NO: 542) | 573 | 668 |
| HSCALLA_T7 (SEQ ID NO: 543) | 968 | 1063 |
| HSCALLA_T8 (SEQ ID NO: 544) | 718 | 813 |
| HSCALLA_T9 (SEQ ID NO: 545) | 1052 | 1147 |
| HSCALLA_T10 (SEQ ID NO: 546) | 743 | 838 |
| HSCALLA_T12 (SEQ ID NO: 547) | 1080 | 1175 |
| HSCALLA_T14 (SEQ ID NO: 548) | 732 | 827 |
| HSCALLA_T20 (SEQ ID NO: 549) | 560 | 655 |
| HSCALLA_T24 (SEQ ID NO: 550) | 896 | 991 |

This segment can be found in the following protein(s): HSCALLA_P11, HSCALLA_P2, HSCALLA_P4, HSCALLA_P1 and HSCALLA_P8.

Segment cluster HSCALLA_node__37 (SEQ ID NO:577) according to the present invention is supported by 24 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548), HSCALLA_T20 (SEQ ID NO:549) and HSCALLA_T24 (SEQ ID NO:550). Table 552 below describes the starting and ending position of this segment on each transcript.

TABLE 552

Segment location on transcripts

| Transcript name | Segment starting position | Segment ending position |
|---|---|---|
| HSCALLA_T6 (SEQ ID NO: 542) | 669 | 787 |
| HSCALLA_T7 (SEQ ID NO: 543) | 1064 | 1182 |
| HSCALLA_T8 (SEQ ID NO: 544) | 814 | 932 |
| HSCALLA_T9 (SEQ ID NO: 545) | 1148 | 1266 |
| HSCALLA_T10 (SEQ ID NO: 546) | 839 | 957 |
| HSCALLA_T12 (SEQ ID NO: 547) | 1176 | 1294 |
| HSCALLA_T14 (SEQ ID NO: 548) | 828 | 946 |
| HSCALLA_T20 (SEQ ID NO: 549) | 656 | 774 |
| HSCALLA_T24 (SEQ ID NO: 550) | 992 | 1110 |

This segment can be found in the following protein(s): HSCALLA_P11, HSCALLA_P2, HSCALLA_P4, HSCALLA_P1 and HSCALLA_P8.

Segment cluster HSCALLA_node__39 (SEQ ID NO:578) according to the present invention is supported by 20 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548), HSCALLA_T20 (SEQ ID NO:549) and HSCALLA_T24 (SEQ ID NO:550). Table 553 below describes the starting and ending position of this segment on each transcript.

TABLE 553

Segment location on transcripts

| Transcript name | Segment starting position | Segment ending position |
|---|---|---|
| HSCALLA_T6 (SEQ ID NO: 542) | 788 | 853 |
| HSCALLA_T7 (SEQ ID NO: 543) | 1183 | 1248 |
| HSCALLA_T8 (SEQ ID NO: 544) | 933 | 998 |
| HSCALLA_T9 (SEQ ID NO: 545) | 1267 | 1332 |
| HSCALLA_T10 (SEQ ID NO: 546) | 958 | 1023 |
| HSCALLA_T12 (SEQ ID NO: 547) | 1295 | 1360 |
| HSCALLA_T14 (SEQ ID NO: 548) | 947 | 1012 |
| HSCALLA_T20 (SEQ ID NO: 549) | 775 | 840 |
| HSCALLA_T24 (SEQ ID NO: 550) | 1111 | 1176 |

This segment can be found in the following protein(s): HSCALLA_P11, HSCALLA_P2, HSCALLA_P4, HSCALLA_P1 and HSCALLA_P8.

Segment cluster HSCALLA_node__44 (SEQ ID NO:579) according to the present invention is supported by 24 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 554 below describes the starting and ending position of this segment on each transcript.

TABLE 554

Segment location on transcripts

| Transcript name | Segment starting position | Segment ending position |
|---|---|---|
| HSCALLA_T6 (SEQ ID NO: 542) | 989 | 1090 |
| HSCALLA_T7 (SEQ ID NO: 543) | 1384 | 1485 |
| HSCALLA_T8 (SEQ ID NO: 544) | 1134 | 1235 |
| HSCALLA_T9 (SEQ ID NO: 545) | 1468 | 1569 |
| HSCALLA_T10 (SEQ ID NO: 546) | 1159 | 1260 |
| HSCALLA_T12 (SEQ ID NO: 547) | 1496 | 1597 |
| HSCALLA_T14 (SEQ ID NO: 548) | 1148 | 1249 |
| HSCALLA_T20 (SEQ ID NO: 549) | 976 | 1077 |

This segment can be found in the following protein(s): HSCALLA_P11, HSCALLA_P2, HSCALLA_P4 and HSCALLA_P1.

Segment cluster HSCALLA_node__48 (SEQ ID NO:580) according to the present invention is supported by 24 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 555 below describes the starting and ending position of this segment on each transcript.

TABLE 555

Segment location on transcripts

| Transcript name | Segment starting position | Segment ending position |
|---|---|---|
| HSCALLA_T6 (SEQ ID NO: 542) | 1228 | 1321 |
| HSCALLA_T7 (SEQ ID NO: 543) | 1623 | 1716 |
| HSCALLA_T8 (SEQ ID NO: 544) | 1373 | 1466 |
| HSCALLA_T9 (SEQ ID NO: 545) | 1707 | 1800 |
| HSCALLA_T10 (SEQ ID NO: 546) | 1398 | 1491 |
| HSCALLA_T12 (SEQ ID NO: 547) | 1735 | 1828 |
| HSCALLA_T14 (SEQ ID NO: 548) | 1387 | 1480 |
| HSCALLA_T20 (SEQ ID NO: 549) | 1215 | 1308 |

This segment can be found in the following protein(s): HSCALLA_P11, HSCALLA_P2, HSCALLA_P4 and HSCALLA_P1.

Segment cluster HSCALLA_node__52 (SEQ ID NO:581) according to the present invention is supported by 24 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 556 below describes the starting and ending position of this segment on each transcript.

TABLE 556

Segment location on transcripts

| Transcript name | Segment starting position | Segment ending position |
|---|---|---|
| HSCALLA_T6 (SEQ ID NO: 542) | 1451 | 1549 |
| HSCALLA_T7 (SEQ ID NO: 543) | 1846 | 1944 |
| HSCALLA_T8 (SEQ ID NO: 544) | 1596 | 1694 |
| HSCALLA_T9 (SEQ ID NO: 545) | 1930 | 2028 |
| HSCALLA_T10 (SEQ ID NO: 546) | 1621 | 1719 |
| HSCALLA_T12 (SEQ ID NO: 547) | 1958 | 2056 |
| HSCALLA_T14 (SEQ ID NO: 548) | 1610 | 1708 |
| HSCALLA_T20 (SEQ ID NO: 549) | 1438 | 1536 |

This segment can be found in the following protein(s): HSCALLA_P11, HSCALLA_P2, HSCALLA_P4 and HSCALLA_P1.

Segment cluster HSCALLA_node__54 (SEQ ID NO:582) according to the present invention is supported by 26 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 557 below describes the starting and ending position of this segment on each transcript.

TABLE 557

Segment location on transcripts

| Transcript name | Segment starting position | Segment ending position |
|---|---|---|
| HSCALLA_T6 (SEQ ID NO: 542) | 1550 | 1630 |
| HSCALLA_T7 (SEQ ID NO: 543) | 1945 | 2025 |
| HSCALLA_T8 (SEQ ID NO: 544) | 1695 | 1775 |

TABLE 557-continued

Segment location on transcripts

| Transcript name | Segment starting position | Segment ending position |
|---|---|---|
| HSCALLA_T9 (SEQ ID NO: 545) | 2029 | 2109 |
| HSCALLA_T10 (SEQ ID NO: 546) | 1720 | 1800 |
| HSCALLA_T12 (SEQ ID NO: 547) | 2057 | 2137 |
| HSCALLA_T14 (SEQ ID NO: 548) | 1709 | 1789 |
| HSCALLA_T20 (SEQ ID NO: 549) | 1537 | 1617 |

This segment can be found in the following protein(s): HSCALLA_P11, HSCALLA_P2, HSCALLA_P4 and HSCALLA_P1.

Segment cluster HSCALLA_node_56 (SEQ ID NO:583) according to the present invention is supported by 29 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 558 below describes the starting and ending position of this segment on each transcript.

TABLE 558

Segment location on transcripts

| Transcript name | Segment starting position | Segment ending position |
|---|---|---|
| HSCALLA_T6 (SEQ ID NO: 542) | 1631 | 1734 |
| HSCALLA_T7 (SEQ ID NO: 543) | 2026 | 2129 |
| HSCALLA_T8 (SEQ ID NO: 544) | 1776 | 1879 |
| HSCALLA_T9 (SEQ ID NO: 545) | 2110 | 2213 |
| HSCALLA_T10 (SEQ ID NO: 546) | 1801 | 1904 |
| HSCALLA_T12 (SEQ ID NO: 547) | 2138 | 2241 |
| HSCALLA_T14 (SEQ ID NO: 548) | 1790 | 1893 |
| HSCALLA_T20 (SEQ ID NO: 549) | 1618 | 1721 |

This segment can be found in the following protein(s): HSCALLA_P11, HSCALLA_P2, HSCALLA_P4 and HSCALLA_P1.

Segment cluster HSCALLA_node_58 (SEQ ID NO:584) according to the present invention is supported by 30 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 559 below describes the starting and ending position of this segment on each transcript.

TABLE 559

Segment location on transcripts

| Transcript name | Segment starting position | Segment ending position |
|---|---|---|
| HSCALLA_T6 (SEQ ID NO: 542) | 1735 | 1793 |
| HSCALLA_T7 (SEQ ID NO: 543) | 2130 | 2188 |
| HSCALLA_T8 (SEQ ID NO: 544) | 1880 | 1938 |
| HSCALLA_T9 (SEQ ID NO: 545) | 2214 | 2272 |
| HSCALLA_T10 (SEQ ID NO: 546) | 1905 | 1963 |

TABLE 559-continued

Segment location on transcripts

| Transcript name | Segment starting position | Segment ending position |
|---|---|---|
| HSCALLA_T12 (SEQ ID NO: 547) | 2242 | 2300 |
| HSCALLA_T14 (SEQ ID NO: 548) | 1894 | 1952 |
| HSCALLA_T20 (SEQ ID NO: 549) | 1722 | 1780 |

This segment can be found in the following protein(s): HSCALLA_P11, HSCALLA_P2, HSCALLA_P4 and HSCALLA_P1.

Segment cluster HSCALLA_node_65 (SEQ ID NO:585) according to the present invention is supported by 25 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 560 below describes the starting and ending position of this segment on each transcript.

TABLE 560

Segment location on transcripts

| Transcript name | Segment starting position | Segment ending position |
|---|---|---|
| HSCALLA_T6 (SEQ ID NO: 542) | 2048 | 2113 |
| HSCALLA_T7 (SEQ ID NO: 543) | 2443 | 2508 |
| HSCALLA_T8 (SEQ ID NO: 544) | 2193 | 2258 |
| HSCALLA_T9 (SEQ ID NO: 545) | 2527 | 2592 |
| HSCALLA_T10 (SEQ ID NO: 546) | 2218 | 2283 |
| HSCALLA_T12 (SEQ ID NO: 547) | 2555 | 2620 |
| HSCALLA_T14 (SEQ ID NO: 548) | 2207 | 2272 |
| HSCALLA_T20 (SEQ ID NO: 549) | 2035 | 2100 |

This segment can be found in the following protein(s): HSCALLA_P11, HSCALLA_P2, HSCALLA_P4 and HSCALLA_P1.

Segment cluster HSCALLA_node_69 (SEQ ID NO:586) according to the present invention is supported by 32 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 561 below describes the starting and ending position of this segment on each transcript.

TABLE 561

Segment location on transcripts

| Transcript name | Segment starting position | Segment ending position |
|---|---|---|
| HSCALLA_T6 (SEQ ID NO: 542) | 2114 | 2209 |
| HSCALLA_T7 (SEQ ID NO: 543) | 2509 | 2604 |
| HSCALLA_T8 (SEQ ID NO: 544) | 2259 | 2354 |
| HSCALLA_T9 (SEQ ID NO: 545) | 2593 | 2688 |
| HSCALLA_T10 (SEQ ID NO: 546) | 2284 | 2379 |
| HSCALLA_T12 (SEQ ID NO: 547) | 2621 | 2716 |

TABLE 561-continued

Segment location on transcripts

| Transcript name | Segment starting position | Segment ending position |
|---|---|---|
| HSCALLA_T14 (SEQ ID NO: 548) | 2273 | 2368 |
| HSCALLA_T20 (SEQ ID NO: 549) | 2101 | 2196 |

This segment can be found in the following protein(s): HSCALLA_P11, HSCALLA_P2, HSCALLA_P4 and HSCALLA_P1.

Segment cluster HSCALLA_node_71 (SEQ ID NO:587) according to the present invention is supported by 34 libraries. The number of libraries was determined as previously described. This segment can be found in the following transcript(s): HSCALLA_T6 (SEQ ID NO:542), HSCALLA_T7 (SEQ ID NO:543), HSCALLA_T8 (SEQ ID NO:544), HSCALLA_T9 (SEQ ID NO:545), HSCALLA_T10 (SEQ ID NO:546), HSCALLA_T12 (SEQ ID NO:547), HSCALLA_T14 (SEQ ID NO:548) and HSCALLA_T20 (SEQ ID NO:549). Table 562 below describes the starting and ending position of this segment on each transcript.

TABLE 562

Segment location on transcripts

| Transcript name | Segment starting position | Segment ending position |
|---|---|---|
| HSCALLA_T6 (SEQ ID NO: 542) | 2210 | 2286 |
| HSCALLA_T7 (SEQ ID NO: 543) | 2605 | 2681 |
| HSCALLA_T8 (SEQ ID NO: 544) | 2355 | 2431 |
| HSCALLA_T9 (SEQ ID NO: 545) | 2689 | 2765 |
| HSCALLA_T10 (SEQ ID NO: 546) | 2380 | 2456 |
| HSCALLA_T12 (SEQ ID NO: 547) | 2717 | 2793 |
| HSCALLA_T14 (SEQ ID NO: 548) | 2369 | 2445 |
| HSCALLA_T20 (SEQ ID NO: 549) | 2197 | 2273 |

This segment can be found in the following protein(s): HSCALLA_P11, HSCALLA_P2, HSCALLA_P4 and HSCALLA_P1.

Description for Cluster HSCD44E

Cluster HSCD44E features 30 transcript(s) and 66 segment(s) of interest, the names for which are given in Tables 563 and 564, respectively, the sequences themselves are given at the end of the application. The selected protein variants are given in Table 565.

TABLE 563

Transcripts of interest
Transcript Name

HSCD44E_T1 (SEQ ID NO: 588)
HSCD44E_T3 (SEQ ID NO: 589)
HSCD44E_T6 (SEQ ID NO: 590)
HSCD44E_T7 (SEQ ID NO: 591)
HSCD44E_T8 (SEQ ID NO: 592)
HSCD44E_T10 (SEQ ID NO: 593)
HSCD44E_T12 (SEQ ID NO: 594)
HSCD44E_T13 (SEQ ID NO: 595)
HSCD44E_T16 (SEQ ID NO: 596)
HSCD44E_T22 (SEQ ID NO: 597)
HSCD44E_T26 (SEQ ID NO: 598)
HSCD44E_T32 (SEQ ID NO: 599)
HSCD44E_T34 (SEQ ID NO: 600)
HSCD44E_T35 (SEQ ID NO: 601)
HSCD44E_T36 (SEQ ID NO: 602)
HSCD44E_T38 (SEQ ID NO: 603)

TABLE 563-continued

Transcripts of interest
Transcript Name

HSCD44E_T39 (SEQ ID NO: 604)
HSCD44E_T40 (SEQ ID NO: 605)
HSCD44E_T45 (SEQ ID NO: 606)
HSCD44E_T46 (SEQ ID NO: 607)
HSCD44E_T47 (SEQ ID NO: 608)
HSCD44E_T57 (SEQ ID NO: 609)
HSCD44E_T63 (SEQ ID NO: 610)
HSCD44E_T65 (SEQ ID NO: 611)
HSCD44E_T68 (SEQ ID NO: 612)
HSCD44E_T69 (SEQ ID NO: 613)
HSCD44E_T72 (SEQ ID NO: 614)
HSCD44E_T73 (SEQ ID NO: 615)
HSCD44E_T82 (SEQ ID NO: 616)
HSCD44E_T83 (SEQ ID NO: 617)

TABLE 564

Segments of interest
Segment Name

HSCD44E_node_0 (SEQ ID NO: 618)
HSCD44E_node_4 (SEQ ID NO: 619)
HSCD44E_node_6 (SEQ ID NO: 620)
HSCD44E_node_16 (SEQ ID NO: 621)
HSCD44E_node_23 (SEQ ID NO: 622)
HSCD44E_node_29 (SEQ ID NO: 623)
HSCD44E_node_32 (SEQ ID NO: 624)
HSCD44E_node_34 (SEQ ID NO: 625)
HSCD44E_node_35 (SEQ ID NO: 626)
HSCD44E_node_36 (SEQ ID NO: 627)
HSCD44E_node_39 (SEQ ID NO: 628)
HSCD44E_node_41 (SEQ ID NO: 629)
HSCD44E_node_46 (SEQ ID NO: 630)
HSCD44E_node_48 (SEQ ID NO: 631)
HSCD44E_node_50 (SEQ ID NO: 632)
HSCD44E_node_52 (SEQ ID NO: 633)
HSCD44E_node_53 (SEQ ID NO: 634)
HSCD44E_node_54 (SEQ ID NO: 635)
HSCD44E_node_55 (SEQ ID NO: 636)
HSCD44E_node_57 (SEQ ID NO: 637)
HSCD44E_node_61 (SEQ ID NO: 638)
HSCD44E_node_66 (SEQ ID NO: 639)
HSCD44E_node_68 (SEQ ID NO: 640)
HSCD44E_node_69 (SEQ ID NO: 641)
HSCD44E_node_73 (SEQ ID NO: 642)
HSCD44E_node_90 (SEQ ID NO: 643)
HSCD44E_node_92 (SEQ ID NO: 644)
HSCD44E_node_93 (SEQ ID NO: 645)
HSCD44E_node_94 (SEQ ID NO: 646)
HSCD44E_node_2 (SEQ ID NO: 647)
HSCD44E_node_7 (SEQ ID NO: 648)
HSCD44E_node_8 (SEQ ID NO: 649)
HSCD44E_node_10 (SEQ ID NO: 650)
HSCD44E_node_11 (SEQ ID NO: 651)
HSCD44E_node_12 (SEQ ID NO: 652)
HSCD44E_node_13 (SEQ ID NO: 653)
HSCD44E_node_17 (SEQ ID NO: 654)
HSCD44E_node_18 (SEQ ID NO: 655)
HSCD44E_node_19 (SEQ ID NO: 656)
HSCD44E_node_20 (SEQ ID NO: 657)
HSCD44E_node_24 (SEQ ID NO: 658)
HSCD44E_node_25 (SEQ ID NO: 659)
HSCD44E_node_30 (SEQ ID NO: 660)
HSCD44E_node_31 (SEQ ID NO: 661)
HSCD44E_node_37 (SEQ ID NO: 662)
HSCD44E_node_40 (SEQ ID NO: 663)
HSCD44E_node_42 (SEQ ID NO: 664)
HSCD44E_node_43 (SEQ ID NO: 665)
HSCD44E_node_47 (SEQ ID NO: 666)
HSCD44E_node_49 (SEQ ID NO: 667)
HSCD44E_node_58 (SEQ ID NO: 668)
HSCD44E_node_59 (SEQ ID NO: 669)
HSCD44E_node_64 (SEQ ID NO: 670)

TABLE 564-continued

Segments of interest
Segment Name

HSCD44E_node_65 (SEQ ID NO: 671)
HSCD44E_node_67 (SEQ ID NO: 672)
HSCD44E_node_74 (SEQ ID NO: 673)
HSCD44E_node_75 (SEQ ID NO: 674)
HSCD44E_node_77 (SEQ ID NO: 675)
HSCD44E_node_79 (SEQ ID NO: 676)
HSCD44E_node_80 (SEQ ID NO: 677)
HSCD44E_node_82 (SEQ ID NO: 678)
HSCD44E_node_83 (SEQ ID NO: 679)
HSCD44E_node_84 (SEQ ID NO: 680)
HSCD44E_node_85 (SEQ ID NO: 681)
HSCD44E_node_86 (SEQ ID NO: 682)
HSCD44E_node_91 (SEQ ID NO: 683)

TABLE 565

Proteins of interest

| Protein Name | Corresponding Transcript(s) |
|---|---|
| HSCD44E_P2 | HSCD44E_T1 (SEQ ID NO: 588); HSCD44E_T7 (SEQ ID NO: 591); HSCD44E_T8 (SEQ ID NO: 592); HSCD44E_T34 (SEQ ID NO: 600); HSCD44E_T35 (SEQ ID NO: 601); HSCD44E_T36 (SEQ ID NO: 602); HSCD44E_T38 (SEQ ID NO: 603); HSCD44E_T39 (SEQ ID NO: 604); HSCD44E_T40 (SEQ ID NO: 605); HSCD44E_T63 (SEQ ID NO: 610) |
| HSCD44E_P4 | HSCD44E_T3 (SEQ ID NO: 589) |
| HSCD44E_P6 | HSCD44E_T6 (SEQ ID NO: 590) |
| HSCD44E_P8 | HSCD44E_T10 (SEQ ID NO: 593) |
| HSCD44E_P10 | HSCD44E_T12 (SEQ ID NO: 594); HSCD44E_T13 (SEQ ID NO: 595); HSCD44E_T16 (SEQ ID NO: 596); HSCD44E_T22 (SEQ ID NO: 597); HSCD44E_T65 (SEQ ID NO: 611); HSCD44E_T68 (SEQ ID NO: 612); HSCD44E_T69 (SEQ ID NO: 613) |
| HSCD44E_P18 | HSCD44E_T26 (SEQ ID NO: 598) |
| HSCD44E_P28 | HSCD44E_T45 (SEQ ID NO: 606) |
| HSCD44E_P29 | HSCD44E_T47 (SEQ ID NO: 608) |
| HSCD44E_P40 | HSCD44E_T72 (SEQ ID NO: 614) |
| HSCD44E_P41 | HSCD44E_T73 (SEQ ID NO: 615) |

These sequences are variants of the known protein CD44 antigen precursor (SwissProt accession identifier CD44_HUMAN; known also according to the synonyms Phagocytic glycoprotein I; PGP-1; HUTCH-I; Extracellular matrix receptor-III; ECMR-III; GP90 lymphocyte homing/adhesion receptor; Hermes antigen; Hyaluronate receptor; Heparan sulfate proteoglycan; Epican; CDw44), referred to herein as the previously known protein.

Protein CD44 antigen precursor is known or believed to have the following function(s): Receptor for hyaluronic acid (HA). Mediates cell-cell and cell-matrix interactions through its affinity for HA, and possibly also through its affinity for other ligands such as osteopontin, collagens, and matrix matalloproteinases (MMPs). Adhesion with HA plays an important role in cell migration, tumor growth and progression. Also involved in lymphocyte activation, recirculation and homing, and in hematopoiesis. Altered expression or dysfunction causes numerous pathogenic phenotypes. Great protein heterogeneity due to numerous alternative splicing and post-translational modification events. The sequence for protein CD44 antigen precursor is given at the end of the application, as "CD44 antigen precursor amino acid sequence". Known polymorphisms for this sequence are as shown in Table 566.

TABLE 566

Amino acid mutations for Known Protein

| SNP position(s) on amino acid sequence | Comment |
|---|---|
| 46 | R -> P (in In(A) antigen). /FTId = VAR_006490. |
| 26 | I -> M |
| 109 | S -> Y |
| 221 | A -> R |
| 410 | E -> V |
| 417 | R -> K |
| 555 | T -> H |
| 620 | G -> E |

Protein CD44 antigen precursor localization is believed to be Type I membrane protein.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD44 antagonist; DNA antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Immunoconjugate; Anti-inflammatory; Antiarthritic, immunological; Monoclonal antibody, humanized.

The following GO Annotation(s) apply to the previously known protein. The following annotation(s) were found: cell adhesion; cell-matrix adhesion; cell-cell adhesion, which are annotation(s) related to Biological Process; receptor; collagen binding; hyaluronic acid binding, which are annotation(s) related to Molecular Function; and integral plasma membrane protein; membrane, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HSCD44E can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 18 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 18 and Table 567. This cluster is overexpressed (at least at a minimum level) in the following pathological conditions: brain malignant tumors and gastric carcinoma.

TABLE 567

Normal tissue distribution

| Name of Tissue | Number |
|---|---|
| Adrenal | 80 |
| Bladder | 164 |
| Bone | 307 |
| Brain | 60 |
| Colon | 258 |
| Epithelial | 345 |
| General | 298 |
| head and neck | 20 |
| Kidney | 35 |
| Liver | 48 |
| Lung | 479 |
| lymph nodes | 286 |
| Breast | 549 |
| bone marrow | 156 |
| Muscle | 48 |
| Ovary | 101 |
| Pancreas | 393 |
| Prostate | 315 |
| Skin | 868 |
| Stomach | 146 |
| T cells | 557 |
| Thyroid | 257 |
| Uterus | 586 |

TABLE 568

P values and ratios for expression in cancerous tissue

| Name of Tissue | P1 | P2 | SP1 | R3 | SP2 | R4 |
|---|---|---|---|---|---|---|
| Adrenal | 3.8e–01 | 4.6e–01 | 4.2e–01 | 1.6 | 5.7e–01 | 1.2 |
| Bladder | 3.1e–01 | 2.2e–01 | 2.6e–01 | 1.4 | 1.2e–01 | 1.6 |
| Bone | 2.9e–01 | 1.3e–01 | 9.2e–01 | 0.5 | 7.0e–02 | 1.1 |
| Brain | 2.8e–02 | 1.8e–02 | 2.3e–06 | 2.9 | 8.5e–13 | 3.7 |
| Colon | 5.3e–01 | 4.5e–01 | 6.2e–01 | 0.9 | 4.8e–01 | 1.0 |
| epithelial | 1.1e–01 | 1.7e–01 | 1 | 0.7 | 7.4e–01 | 0.9 |
| General | 1.2e–01 | 2.7e–01 | 1 | 0.7 | 4.7e–01 | 0.9 |
| head and neck | 1.4e–01 | 1.9e–01 | 2.1e–01 | 3.1 | 4.2e–01 | 1.7 |
| Kidney | 3.6e–01 | 2.9e–01 | 1.4e–01 | 2.2 | 1.2e–04 | 2.9 |
| Liver | 3.3e–01 | 9.9e–02 | 1 | 2.1 | 6.4e–03 | 1.7 |
| Lung | 6.6e–01 | 7.4e–01 | 8.3e–01 | 0.7 | 9.9e–01 | 0.6 |
| lymph nodes | 4.8e–01 | 6.5e–01 | 4.4e–01 | 0.7 | 1 | 0.2 |
| Breast | 2.1e–01 | 1.9e–01 | 9.5e–01 | 0.5 | 9.7e–01 | 0.4 |
| bone marrow | 1.8e–01 | 3.8e–01 | 2.8e–01 | 2.3 | 5.8e–02 | 1.1 |
| Muscle | 5.2e–01 | 6.1e–01 | 1.1e–01 | 3.5 | 5.1e–01 | 1.1 |
| Ovary | 6.9e–01 | 6.5e–01 | 9.9e–02 | 1.2 | 2.4e–01 | 1.0 |
| pancreas | 3.2e–01 | 3.6e–01 | 9.9e–01 | 0.4 | 2.2e–01 | 0.5 |
| Prostate | 8.3e–01 | 8.5e–01 | 9.4e–01 | 0.5 | 9.7e–01 | 0.5 |
| Skin | 3.9e–01 | 5.9e–01 | 7.3e–01 | 0.2 | 1 | 0.2 |
| Stomach | 5.5e–01 | 5.0e–01 | 1.4e–01 | 0.6 | 2.1e–09 | 5.0 |
| T cells | 1 | 5.0e–01 | 3.9e–01 | 1.7 | 9.3e–01 | 0.6 |
| Thyroid | 5.6e–01 | 5.6e–01 | 1 | 0.5 | 1 | 0.5 |
| Uterus | 2.9e–01 | 5.0e–01 | 1 | 0.3 | 1 | 0.2 |

As noted above, cluster HSCD44E features 66 segment(s), which were listed in Table 564 above and for which the sequence(s) are given at the end of the application. These segment(s) are portions of nucleic acid sequence(s) which are described herein separately because they are of particular interest. A description of each segment according to the present invention is now provided.

Segment cluster HSCD44E_node_0 (SEQ ID NO:618) according to the present invention is supported by 3 libraries. The number of libraries was determined as previously described. This segment can be found in the following transcript(s): HSCD44E_T35 (SEQ ID NO:601), HSCD44E_T82 (SEQ ID NO:616) and HSCD44E_T83 (SEQ ID NO:617). Table 569 below describes the starting and ending position of this segment on each transcript.

TABLE 569

Segment location on transcripts

| Transcript name | Segment starting position | Segment ending position |
|---|---|---|
| HSCD44E_T35 (SEQ ID NO: 601) | 1 | 138 |
| HSCD44E_T82 (SEQ ID NO: 616) | 1 | 138 |
| HSCD44E_T83 (SEQ ID NO: 617) | 1 | 138 |

This segment can be found in a non-coding region of transcript(s) that are related to the following protein(s): HSCD44E_P2.

Segment cluster HSCD44E_node_4 (SEQ ID NO:619) according to the present invention is supported by 2 libraries. The number of libraries was determined as previously described. This segment can be found in the following transcript(s): HSCD44E_T82 (SEQ ID NO:616) and HSCD44E_T83 (SEQ ID NO:617). Table 570 below describes the starting and ending position of this segment on each transcript.

TABLE 570

Segment location on transcripts

| Transcript name | Segment starting position | Segment ending position |
|---|---|---|
| HSCD44E_T82 (SEQ ID NO: 616) | 139 | 475 |
| HSCD44E_T83 (SEQ ID NO: 617) | 195 | 531 |

The previously-described transcripts for these segment(s) do not code for protein.

Segment cluster HSCD44E_node_6 (SEQ ID NO:620) according to the present invention is supported by 133 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 571 below describes the starting and ending position of this segment on each transcript.

TABLE 571

Segment location on transcripts

| Transcript name | Segment starting position | Segment ending position |
|---|---|---|
| HSCD44E_T1 (SEQ ID NO: 588) | 1 | 333 |
| HSCD44E_T3 (SEQ ID NO: 589) | 1 | 333 |
| HSCD44E_T6 (SEQ ID NO: 590) | 1 | 333 |
| HSCD44E_T7 (SEQ ID NO: 591) | 1 | 333 |
| HSCD44E_T8 (SEQ ID NO: 592) | 1 | 333 |
| HSCD44E_T10 (SEQ ID NO: 593) | 1 | 333 |
| HSCD44E_T12 (SEQ ID NO: 594) | 1 | 333 |
| HSCD44E_T13 (SEQ ID NO: 595) | 1 | 333 |

TABLE 571-continued

Segment location on transcripts

| Transcript name | Segment starting position | Segment ending position |
|---|---|---|
| HSCD44E_T16 (SEQ ID NO: 596) | 1 | 333 |
| HSCD44E_T22 (SEQ ID NO: 597) | 1 | 333 |
| HSCD44E_T26 (SEQ ID NO: 598) | 1 | 333 |
| HSCD44E_T34 (SEQ ID NO: 600) | 1 | 333 |
| HSCD44E_T38 (SEQ ID NO: 603) | 1 | 333 |
| HSCD44E_T63 (SEQ ID NO: 610) | 1 | 333 |
| HSCD44E_T65 (SEQ ID NO: 611) | 1 | 333 |
| HSCD44E_T68 (SEQ ID NO: 612) | 1 | 333 |
| HSCD44E_T69 (SEQ ID NO: 613) | 1 | 333 |
| HSCD44E_T72 (SEQ ID NO: 614) | 1 | 333 |
| HSCD44E_T73 (SEQ ID NO: 615) | 1 | 333 |

This segment can be found in both coding and non-coding regions of transcript(s) as follows. The segment can be found in a non-coding region of transcript(s) that are related to the following protein(s): HSCD44E_P2, HSCD44E_P4, HSCD44E_P6, HSCD44E_P8, HSCD44E_P10, HSCD44E_P18 and HSCD44E_P40. This segment can also be found in the following protein(s): HSCD44E_P41, since it is in the coding region for the corresponding transcript.

Segment cluster HSCD44E_node_16 (SEQ ID NO:621) according to the present invention is supported by 3 libraries. The number of libraries was determined as previously described. This segment can be found in the following transcript(s): HSCD44E_T36 (SEQ ID NO:602). Table 572 below describes the starting and ending position of this segment on each transcript.

TABLE 572

Segment location on transcripts

| Transcript name | Segment starting position | Segment ending position |
|---|---|---|
| HSCD44E_T36 (SEQ ID NO: 602) | 1 | 593 |

This segment can be found in a non-coding region of transcript(s) that are related to the following protein(s): HSCD44E_P2.

Segment cluster HSCD44E_node_23 (SEQ ID NO:622) according to the present invention is supported by 2 libraries. The number of libraries was determined as previously described. This segment can be found in the following transcript(s): HSCD44E_T39 (SEQ ID NO:604). Table 573 below describes the starting and ending position of this segment on each transcript.

TABLE 573

Segment location on transcripts

| Transcript name | Segment starting position | Segment ending position |
|---|---|---|
| HSCD44E_T39 (SEQ ID NO: 604) | 1 | 477 |

This segment can be found in a non-coding region of transcript(s) that are related to the following protein(s): HSCD44E_P2.

Segment cluster HSCD44E_node_29 (SEQ ID NO:623) according to the present invention is supported by 204 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 574 below describes the starting and ending position of this segment on each transcript.

TABLE 574

Segment location on transcripts

| Transcript name | Segment starting position | Segment ending position |
|---|---|---|
| HSCD44E_T1 (SEQ ID NO: 588) | 871 | 1008 |
| HSCD44E_T3 (SEQ ID NO: 589) | 871 | 1008 |
| HSCD44E_T6 (SEQ ID NO: 590) | 871 | 1008 |
| HSCD44E_T7 (SEQ ID NO: 591) | 871 | 1008 |
| HSCD44E_T8 (SEQ ID NO: 592) | 871 | 1008 |
| HSCD44E_T10 (SEQ ID NO: 593) | 871 | 1008 |
| HSCD44E_T12 (SEQ ID NO: 594) | 871 | 1008 |
| HSCD44E_T13 (SEQ ID NO: 595) | 871 | 1008 |
| HSCD44E_T16 (SEQ ID NO: 596) | 871 | 1008 |
| HSCD44E_T22 (SEQ ID NO: 597) | 871 | 1008 |
| HSCD44E_T26 (SEQ ID NO: 598) | 871 | 1008 |
| HSCD44E_T34 (SEQ ID NO: 600) | 737 | 874 |
| HSCD44E_T35 (SEQ ID NO: 601) | 508 | 645 |
| HSCD44E_T36 (SEQ ID NO: 602) | 797 | 934 |
| HSCD44E_T39 (SEQ ID NO: 604) | 547 | 684 |
| HSCD44E_T63 (SEQ ID NO: 610) | 871 | 1008 |
| HSCD44E_T65 (SEQ ID NO: 611) | 871 | 1008 |
| HSCD44E_T68 (SEQ ID NO: 612) | 871 | 1008 |
| HSCD44E_T69 (SEQ ID NO: 613) | 871 | 1008 |
| HSCD44E_T72 (SEQ ID NO: 614) | 871 | 1008 |
| HSCD44E_T73 (SEQ ID NO: 615) | 871 | 1008 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node_32 (SEQ ID NO:624) according to the present invention is supported by 14 libraries. The number of libraries was determined as previously described. This segment can be found in the following transcript(s): HSCD44E_T72 (SEQ ID NO:614) and HSCD44E_T73 (SEQ ID NO:615). Table 575 below describes the starting and ending position of this segment on each transcript.

TABLE 575

Segment location on transcripts

| Transcript name | Segment starting position | Segment ending position |
|---|---|---|
| HSCD44E_T72 (SEQ ID NO: 614) | 1102 | 2405 |
| HSCD44E_T73 (SEQ ID NO: 615) | 1102 | 1136 |

This segment can be found in both coding and non-coding regions of transcript(s) as follows. The segment can be found in a non-coding region of transcript(s) that are related to the following protein(s): HSCD44E_P41. This segment can also be found in the following protein(s): HSCD44E_P40, since it is in the coding region for the corresponding transcript.

Segment cluster HSCD44E_node__34 (SEQ ID NO:625) according to the present invention is supported by 24 libraries. The number of libraries was determined as previously described. This segment can be found in the following transcript(s): HSCD44E_T32 (SEQ ID NO:599). Table 576 below describes the starting and ending position of this segment on each transcript.

TABLE 576

Segment location on transcripts

| Transcript name | Segment starting position | Segment ending position |
|---|---|---|
| HSCD44E_T32 (SEQ ID NO: 599) | 1 | 2249 |

The previously-described transcripts for these segment(s) do not code for protein.

Segment cluster HSCD44E_node__35 (SEQ ID NO:626) according to the present invention is supported by 25 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 577 below describes the starting and ending position of this segment on each transcript.

TABLE 577

Segment location on transcripts

| Transcript name | Segment starting position | Segment ending position |
|---|---|---|
| HSCD44E_T1 (SEQ ID NO: 588) | 1102 | 1230 |
| HSCD44E_T12 (SEQ ID NO: 594) | 1102 | 1230 |
| HSCD44E_T13 (SEQ ID NO: 595) | 1102 | 1230 |
| HSCD44E_T16 (SEQ ID NO: 596) | 1102 | 1230 |
| HSCD44E_T22 (SEQ ID NO: 597) | 1102 | 1230 |
| HSCD44E_T26 (SEQ ID NO: 598) | 1102 | 1230 |
| HSCD44E_T32 (SEQ ID NO: 599) | 2250 | 2378 |
| HSCD44E_T34 (SEQ ID NO: 600) | 968 | 1096 |
| HSCD44E_T35 (SEQ ID NO: 601) | 739 | 867 |
| HSCD44E_T36 (SEQ ID NO: 602) | 1028 | 1156 |
| HSCD44E_T39 (SEQ ID NO: 604) | 778 | 906 |
| HSCD44E_T63 (SEQ ID NO: 610) | 1102 | 1230 |
| HSCD44E_T65 (SEQ ID NO: 611) | 1102 | 1230 |
| HSCD44E_T68 (SEQ ID NO: 612) | 1102 | 1230 |
| HSCD44E_T69 (SEQ ID NO: 613) | 1102 | 1230 |

This segment can be found in both coding and non-coding regions of transcript(s) as follows. The segment can be found in a non-coding region of transcript(s) that are related to the following protein(s): HSCD44E_P2 and HSCD44E_P18. This segment can also be found in the following protein(s): HSCD44E_P10, since it is in the coding region for the corresponding transcript.

Segment cluster HSCD44E_node__36 (SEQ ID NO:627) according to the present invention is supported by 29 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 578 below describes the starting and ending position of this segment on each transcript.

TABLE 578

Segment location on transcripts

| Transcript name | Segment starting position | Segment ending position |
|---|---|---|
| HSCD44E_T1 (SEQ ID NO: 588) | 1231 | 1724 |
| HSCD44E_T12 (SEQ ID NO: 594) | 1231 | 1724 |
| HSCD44E_T13 (SEQ ID NO: 595) | 1231 | 1724 |
| HSCD44E_T16 (SEQ ID NO: 596) | 1231 | 1724 |
| HSCD44E_T22 (SEQ ID NO: 597) | 1231 | 1724 |
| HSCD44E_T26 (SEQ ID NO: 598) | 1231 | 1724 |
| HSCD44E_T32 (SEQ ID NO: 599) | 2379 | 2872 |
| HSCD44E_T34 (SEQ ID NO: 600) | 1097 | 1590 |
| HSCD44E_T35 (SEQ ID NO: 601) | 868 | 1361 |
| HSCD44E_T36 (SEQ ID NO: 602) | 1157 | 1650 |
| HSCD44E_T39 (SEQ ID NO: 604) | 907 | 1400 |
| HSCD44E_T63 (SEQ ID NO: 610) | 1231 | 1724 |
| HSCD44E_T65 (SEQ ID NO: 611) | 1231 | 1724 |
| HSCD44E_T68 (SEQ ID NO: 612) | 1231 | 1724 |
| HSCD44E_T69 (SEQ ID NO: 613) | 1231 | 1724 |

This segment can be found in both coding and non-coding regions of transcript(s) as follows. The segment can be found in a non-coding region of transcript(s) that are related to the following protein(s): HSCD44E_P2 and HSCD44E_P18. This segment can also be found in the following protein(s): HSCD44E_P10, since it is in the coding region for the corresponding transcript.

Segment cluster HSCD44E_node__39 (SEQ ID NO:628) according to the present invention is supported by 26 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 579 below describes the starting and ending position of this segment on each transcript.

TABLE 579

Segment location on transcripts

| Transcript name | Segment starting position | Segment ending position |
|---|---|---|
| HSCD44E_T1 (SEQ ID NO: 588) | 1840 | 2149 |
| HSCD44E_T12 (SEQ ID NO: 594) | 1840 | 2149 |
| HSCD44E_T13 (SEQ ID NO: 595) | 1840 | 2149 |
| HSCD44E_T16 (SEQ ID NO: 596) | 1840 | 2149 |
| HSCD44E_T22 (SEQ ID NO: 597) | 1840 | 2149 |
| HSCD44E_T26 (SEQ ID NO: 598) | 1840 | 2149 |
| HSCD44E_T32 (SEQ ID NO: 599) | 2988 | 3297 |
| HSCD44E_T34 (SEQ ID NO: 600) | 1706 | 2015 |
| HSCD44E_T35 (SEQ ID NO: 601) | 1477 | 1786 |
| HSCD44E_T36 (SEQ ID NO: 602) | 1766 | 2075 |
| HSCD44E_T39 (SEQ ID NO: 604) | 1516 | 1825 |
| HSCD44E_T63 (SEQ ID NO: 610) | 1840 | 2149 |
| HSCD44E_T65 (SEQ ID NO: 611) | 1840 | 2149 |
| HSCD44E_T68 (SEQ ID NO: 612) | 1840 | 2149 |
| HSCD44E_T69 (SEQ ID NO: 613) | 1840 | 2149 |

This segment can be found in a non-coding region of transcript(s) that are related to the following protein(s): HSCD44E_P2, HSCD44E_P10 and HSCD44E_P18.

Segment cluster HSCD44E_node_41 (SEQ ID NO:629) according to the present invention is supported by 14 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 580 below describes the starting and ending position of this segment on each transcript.

TABLE 580

Segment location on transcripts

| Transcript name | Segment starting position | Segment ending position |
|---|---|---|
| HSCD44E_T1 (SEQ ID NO: 588) | 2225 | 2476 |
| HSCD44E_T12 (SEQ ID NO: 594) | 2225 | 2476 |
| HSCD44E_T13 (SEQ ID NO: 595) | 2225 | 2476 |
| HSCD44E_T16 (SEQ ID NO: 596) | 2225 | 2476 |
| HSCD44E_T22 (SEQ ID NO: 597) | 2225 | 2476 |
| HSCD44E_T26 (SEQ ID NO: 598) | 2225 | 2476 |
| HSCD44E_T32 (SEQ ID NO: 599) | 3373 | 3624 |
| HSCD44E_T34 (SEQ ID NO: 600) | 2091 | 2342 |
| HSCD44E_T35 (SEQ ID NO: 601) | 1862 | 2113 |
| HSCD44E_T36 (SEQ ID NO: 602) | 2151 | 2402 |
| HSCD44E_T39 (SEQ ID NO: 604) | 1901 | 2152 |
| HSCD44E_T63 (SEQ ID NO: 610) | 2225 | 2476 |
| HSCD44E_T65 (SEQ ID NO: 611) | 2225 | 2476 |
| HSCD44E_T68 (SEQ ID NO: 612) | 2225 | 2476 |
| HSCD44E_T69 (SEQ ID NO: 613) | 2225 | 2476 |

This segment can be found in a non-coding region of transcript(s) that are related to the following protein(s): HSCD44E_P2, HSCD44E_P10 and HSCD44E_P18.

Segment cluster HSCD44E_node_46 (SEQ ID NO:630) according to the present invention is supported by 10 libraries. The number of libraries was determined as previously described. This segment can be found in the following transcript(s): HSCD44E_T40 (SEQ ID NO:605). Table 581 below describes the starting and ending position of this segment on each transcript.

TABLE 581

Segment location on transcripts

| Transcript name | Segment starting position | Segment ending position |
|---|---|---|
| HSCD44E_T40 (SEQ ID NO: 605) | 1 | 1113 |

This segment can be found in a non-coding region of transcript(s) that are related to the following protein(s): HSCD44E_P2.

Segment cluster HSCD44E_node_48 (SEQ ID NO:631) according to the present invention is supported by 9 libraries. The number of libraries was determined as previously described. This segment can be found in the following transcript(s): HSCD44E_T1 (SEQ ID NO:588), HSCD44E_T7 (SEQ ID NO:591), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T40 (SEQ ID NO:605), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 582 below describes the starting and ending position of this segment on each transcript.

TABLE 582

Segment location on transcripts

| Transcript name | Segment starting position | Segment ending position |
|---|---|---|
| HSCD44E_T1 (SEQ ID NO: 588) | 2717 | 3191 |
| HSCD44E_T7 (SEQ ID NO: 591) | 1315 | 1789 |
| HSCD44E_T12 (SEQ ID NO: 594) | 2717 | 3191 |
| HSCD44E_T13 (SEQ ID NO: 595) | 2717 | 3191 |
| HSCD44E_T16 (SEQ ID NO: 596) | 2717 | 3191 |
| HSCD44E_T22 (SEQ ID NO: 597) | 2717 | 3191 |
| HSCD44E_T26 (SEQ ID NO: 598) | 2717 | 3191 |
| HSCD44E_T32 (SEQ ID NO: 599) | 3865 | 4339 |
| HSCD44E_T34 (SEQ ID NO: 600) | 2583 | 3057 |
| HSCD44E_T35 (SEQ ID NO: 601) | 2354 | 2828 |
| HSCD44E_T36 (SEQ ID NO: 602) | 2643 | 3117 |
| HSCD44E_T39 (SEQ ID NO: 604) | 2393 | 2867 |
| HSCD44E_T40 (SEQ ID NO: 605) | 1228 | 1702 |
| HSCD44E_T63 (SEQ ID NO: 610) | 2717 | 3191 |
| HSCD44E_T65 (SEQ ID NO: 611) | 2717 | 3191 |
| HSCD44E_T68 (SEQ ID NO: 612) | 2717 | 3191 |
| HSCD44E_T69 (SEQ ID NO: 613) | 2717 | 3191 |

This segment can be found in a non-coding region of transcript(s) that are related to the following protein(s): HSCD44E_P2, HSCD44E_P10 and HSCD44E_P18.

Segment cluster HSCD44E_node_50 (SEQ ID NO:632) according to the present invention is supported by 23 libraries. The number of libraries was determined as previously described. This segment can be found in the following transcript(s): HSCD44E_T69 (SEQ ID NO:613). Table 583 below describes the starting and ending position of this segment on each transcript.

TABLE 583

Segment location on transcripts

| Transcript name | Segment starting position | Segment ending position |
| --- | --- | --- |
| HSCD44E_T69 (SEQ ID NO: 613) | 3309 | 5242 |

This segment can be found in a non-coding region of transcript(s) that are related to the following protein(s): HSCD44E_P10.

Segment cluster HSCD44E_node__52 (SEQ ID NO:633) according to the present invention is supported by 34 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611) and HSCD44E_T68 (SEQ ID NO:612). Table 584 below describes the starting and ending position of this segment on each transcript.

TABLE 584

Segment location on transcripts

| Transcript name | Segment starting position | Segment ending position |
| --- | --- | --- |
| HSCD44E_T1 (SEQ ID NO: 588) | 3309 | 3437 |
| HSCD44E_T3 (SEQ ID NO: 589) | 1459 | 1587 |
| HSCD44E_T6 (SEQ ID NO: 590) | 1333 | 1461 |
| HSCD44E_T7 (SEQ ID NO: 591) | 1907 | 2035 |
| HSCD44E_T8 (SEQ ID NO: 592) | 1102 | 1230 |
| HSCD44E_T10 (SEQ ID NO: 593) | 1432 | 1560 |
| HSCD44E_T12 (SEQ ID NO: 594) | 3309 | 3437 |
| HSCD44E_T13 (SEQ ID NO: 595) | 3309 | 3437 |
| HSCD44E_T16 (SEQ ID NO: 596) | 3309 | 3437 |
| HSCD44E_T22 (SEQ ID NO: 597) | 3309 | 3437 |
| HSCD44E_T26 (SEQ ID NO: 598) | 3309 | 3437 |
| HSCD44E_T32 (SEQ ID NO: 599) | 4457 | 4585 |
| HSCD44E_T34 (SEQ ID NO: 600) | 3175 | 3303 |
| HSCD44E_T35 (SEQ ID NO: 601) | 2946 | 3074 |
| HSCD44E_T36 (SEQ ID NO: 602) | 3235 | 3363 |
| HSCD44E_T38 (SEQ ID NO: 603) | 1076 | 1204 |
| HSCD44E_T39 (SEQ ID NO: 604) | 2985 | 3113 |
| HSCD44E_T40 (SEQ ID NO: 605) | 1820 | 1948 |
| HSCD44E_T63 (SEQ ID NO: 610) | 3309 | 3437 |
| HSCD44E_T65 (SEQ ID NO: 611) | 3309 | 3437 |
| HSCD44E_T68 (SEQ ID NO: 612) | 3309 | 3437 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4, HSCD44E_P6 and HSCD44E_P8, since it is in the coding region for the corresponding transcript.

Segment cluster HSCD44E_node__53 (SEQ ID NO:634) according to the present invention is supported by 39 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611) and HSCD44E_T68 (SEQ ID NO:612). Table 585 below describes the starting and ending position of this segment on each transcript.

TABLE 585

Segment location on transcripts

| Transcript name | Segment starting position | Segment ending position |
| --- | --- | --- |
| HSCD44E_T1 (SEQ ID NO: 588) | 3438 | 4581 |
| HSCD44E_T3 (SEQ ID NO: 589) | 1588 | 2731 |
| HSCD44E_T6 (SEQ ID NO: 590) | 1462 | 2605 |
| HSCD44E_T7 (SEQ ID NO: 591) | 2036 | 3179 |
| HSCD44E_T8 (SEQ ID NO: 592) | 1231 | 2374 |
| HSCD44E_T10 (SEQ ID NO: 593) | 1561 | 2704 |
| HSCD44E_T12 (SEQ ID NO: 594) | 3438 | 4581 |
| HSCD44E_T13 (SEQ ID NO: 595) | 3438 | 4581 |
| HSCD44E_T16 (SEQ ID NO: 596) | 3438 | 4581 |
| HSCD44E_T22 (SEQ ID NO: 597) | 3438 | 4581 |
| HSCD44E_T26 (SEQ ID NO: 598) | 3438 | 4581 |
| HSCD44E_T32 (SEQ ID NO: 599) | 4586 | 5729 |
| HSCD44E_T34 (SEQ ID NO: 600) | 3304 | 4447 |
| HSCD44E_T35 (SEQ ID NO: 601) | 3075 | 4218 |
| HSCD44E_T36 (SEQ ID NO: 602) | 3364 | 4507 |
| HSCD44E_T38 (SEQ ID NO: 603) | 1205 | 2348 |
| HSCD44E_T39 (SEQ ID NO: 604) | 3114 | 4257 |
| HSCD44E_T40 (SEQ ID NO: 605) | 1949 | 3092 |
| HSCD44E_T63 (SEQ ID NO: 610) | 3438 | 4581 |
| HSCD44E_T65 (SEQ ID NO: 611) | 3438 | 4581 |
| HSCD44E_T68 (SEQ ID NO: 612) | 3438 | 4581 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4, HSCD44E_P6 and HSCD44E_P8, since it is in the coding region for the corresponding transcript.

Segment cluster HSCD44E_node__54 (SEQ ID NO:635) according to the present invention is supported by 36 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611) and HSCD44E_T68 (SEQ ID NO:612). Table 586 below describes the starting and ending position of this segment on each transcript.

TABLE 586

Segment location on transcripts

| Transcript name | Segment starting position | Segment ending position |
|---|---|---|
| HSCD44E_T1 (SEQ ID NO: 588) | 4582 | 4908 |
| HSCD44E_T3 (SEQ ID NO: 589) | 2732 | 3058 |
| HSCD44E_T6 (SEQ ID NO: 590) | 2606 | 2932 |
| HSCD44E_T7 (SEQ ID NO: 591) | 3180 | 3506 |
| HSCD44E_T8 (SEQ ID NO: 592) | 2375 | 2701 |
| HSCD44E_T10 (SEQ ID NO: 593) | 2705 | 3031 |
| HSCD44E_T12 (SEQ ID NO: 594) | 4582 | 4908 |
| HSCD44E_T13 (SEQ ID NO: 595) | 4582 | 4908 |
| HSCD44E_T16 (SEQ ID NO: 596) | 4582 | 4908 |
| HSCD44E_T22 (SEQ ID NO: 597) | 4582 | 4908 |
| HSCD44E_T26 (SEQ ID NO: 598) | 4582 | 4908 |
| HSCD44E_T32 (SEQ ID NO: 599) | 5730 | 6056 |
| HSCD44E_T34 (SEQ ID NO: 600) | 4448 | 4774 |
| HSCD44E_T35 (SEQ ID NO: 601) | 4219 | 4545 |
| HSCD44E_T36 (SEQ ID NO: 602) | 4508 | 4834 |
| HSCD44E_T38 (SEQ ID NO: 603) | 2349 | 2675 |
| HSCD44E_T39 (SEQ ID NO: 604) | 4258 | 4584 |
| HSCD44E_T40 (SEQ ID NO: 605) | 3093 | 3419 |
| HSCD44E_T63 (SEQ ID NO: 610) | 4582 | 4908 |
| HSCD44E_T65 (SEQ ID NO: 611) | 4582 | 4908 |
| HSCD44E_T68 (SEQ ID NO: 612) | 4582 | 4908 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2 and HSCD44E_P18, since it is in the coding region for the corresponding transcript.

Segment cluster HSCD44E_node__55 (SEQ ID NO:636) according to the present invention is supported by 36 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611) and HSCD44E_T68 (SEQ ID NO:612). Table 587 below describes the starting and ending position of this segment on each transcript.

TABLE 587

Segment location on transcripts

| Transcript name | Segment starting position | Segment ending position |
|---|---|---|
| HSCD44E_T1 (SEQ ID NO: 588) | 4909 | 5040 |
| HSCD44E_T3 (SEQ ID NO: 589) | 3059 | 3190 |

TABLE 587-continued

Segment location on transcripts

| Transcript name | Segment starting position | Segment ending position |
|---|---|---|
| HSCD44E_T6 (SEQ ID NO: 590) | 2933 | 3064 |
| HSCD44E_T7 (SEQ ID NO: 591) | 3507 | 3638 |
| HSCD44E_T8 (SEQ ID NO: 592) | 2702 | 2833 |
| HSCD44E_T10 (SEQ ID NO: 593) | 3032 | 3163 |
| HSCD44E_T12 (SEQ ID NO: 594) | 4909 | 5040 |
| HSCD44E_T13 (SEQ ID NO: 595) | 4909 | 5040 |
| HSCD44E_T16 (SEQ ID NO: 596) | 4909 | 5040 |
| HSCD44E_T22 (SEQ ID NO: 597) | 4909 | 5040 |
| HSCD44E_T26 (SEQ ID NO: 598) | 4909 | 5040 |
| HSCD44E_T32 (SEQ ID NO: 599) | 6057 | 6188 |
| HSCD44E_T34 (SEQ ID NO: 600) | 4775 | 4906 |
| HSCD44E_T35 (SEQ ID NO: 601) | 4546 | 4677 |
| HSCD44E_T36 (SEQ ID NO: 602) | 4835 | 4966 |
| HSCD44E_T38 (SEQ ID NO: 603) | 2676 | 2807 |
| HSCD44E_T39 (SEQ ID NO: 604) | 4585 | 4716 |
| HSCD44E_T40 (SEQ ID NO: 605) | 3420 | 3551 |
| HSCD44E_T63 (SEQ ID NO: 610) | 4909 | 5040 |
| HSCD44E_T65 (SEQ ID NO: 611) | 4909 | 5040 |
| HSCD44E_T68 (SEQ ID NO: 612) | 4909 | 5040 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2 and HSCD44E_P18, since it is in the coding region for the corresponding transcript.

Segment cluster HSCD44E_node__57 (SEQ ID NO:637) according to the present invention is supported by 6 libraries. The number of libraries was determined as previously described. This segment can be found in the following transcript(s): HSCD44E_T45 (SEQ ID NO:606) and HSCD44E_T47 (SEQ ID NO:608). Table 588 below describes the starting and ending position of this segment on each transcript.

TABLE 588

Segment location on transcripts

| Transcript name | Segment starting position | Segment ending position |
|---|---|---|
| HSCD44E_T45 (SEQ ID NO: 606) | 1 | 1344 |
| HSCD44E_T47 (SEQ ID NO: 608) | 1 | 1344 |

This segment can be found in a non-coding region of transcript(s) that are related to the following protein(s): HSCD44E_P28 and HSCD44E_P29.

Segment cluster HSCD44E_node__61 (SEQ ID NO:638) according to the present invention is supported by 5 libraries. The number of libraries was determined as previously described. This segment can be found in the following transcript(s): HSCD44E_T46 (SEQ ID NO:607). Table 589 below describes the starting and ending position of this segment on each transcript.

TABLE 589

Segment location on transcripts

| Transcript name | Segment starting position | Segment ending position |
|---|---|---|
| HSCD44E_T46 (SEQ ID NO: 607) | 1 | 893 |

The previously-described transcripts for these segment(s) do not code for protein.

Segment cluster HSCD44E_node__66 (SEQ ID NO:639) according to the present invention is supported by 12 libraries. The number of libraries was determined as previously described. This segment can be found in the following transcript(s): HSCD44E_T12 (SEQ ID NO:594), HSCD44E_T16 (SEQ ID NO:596) and HSCD44E_T46 (SEQ ID NO:607). Table 590 below describes the starting and ending position of this segment on each transcript.

TABLE 590

Segment location on transcripts

| Transcript name | Segment starting position | Segment ending position |
|---|---|---|
| HSCD44E_T12 (SEQ ID NO: 594) | 5329 | 6423 |
| HSCD44E_T16 (SEQ ID NO: 596) | 5329 | 6423 |
| HSCD44E_T46 (SEQ ID NO: 607) | 894 | 1988 |

This segment can be found in a non-coding region of transcript(s) that are related to the following protein(s): HSCD44E_P10.

Segment cluster HSCD44E_node__68 (SEQ ID NO:640) according to the present invention is supported by 89 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610) and HSCD44E_T68 (SEQ ID NO:612). Table 591 below describes the starting and ending position of this segment on each transcript.

TABLE 591

Segment location on transcripts

| Transcript name | Segment starting position | Segment ending position |
|---|---|---|
| HSCD44E_T1 (SEQ ID NO: 588) | 5251 | 5436 |
| HSCD44E_T3 (SEQ ID NO: 589) | 3401 | 3586 |
| HSCD44E_T6 (SEQ ID NO: 590) | 3275 | 3460 |
| HSCD44E_T7 (SEQ ID NO: 591) | 3849 | 4034 |
| HSCD44E_T8 (SEQ ID NO: 592) | 3044 | 3229 |
| HSCD44E_T10 (SEQ ID NO: 593) | 3374 | 3559 |
| HSCD44E_T12 (SEQ ID NO: 594) | 6442 | 6627 |
| HSCD44E_T13 (SEQ ID NO: 595) | 5251 | 5436 |
| HSCD44E_T16 (SEQ ID NO: 596) | 6442 | 6627 |
| HSCD44E_T26 (SEQ ID NO: 598) | 5251 | 5436 |
| HSCD44E_T32 (SEQ ID NO: 599) | 6399 | 6584 |
| HSCD44E_T34 (SEQ ID NO: 600) | 5117 | 5302 |
| HSCD44E_T35 (SEQ ID NO: 601) | 4888 | 5073 |
| HSCD44E_T36 (SEQ ID NO: 602) | 5177 | 5362 |
| HSCD44E_T38 (SEQ ID NO: 603) | 3018 | 3203 |
| HSCD44E_T39 (SEQ ID NO: 604) | 4927 | 5112 |
| HSCD44E_T40 (SEQ ID NO: 605) | 3762 | 3947 |
| HSCD44E_T45 (SEQ ID NO: 606) | 1555 | 1740 |
| HSCD44E_T46 (SEQ ID NO: 607) | 2007 | 2192 |
| HSCD44E_T47 (SEQ ID NO: 608) | 1465 | 1650 |
| HSCD44E_T63 (SEQ ID NO: 610) | 5251 | 5436 |
| HSCD44E_T68 (SEQ ID NO: 612) | 5251 | 5436 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__69 (SEQ ID NO:641) according to the present invention is supported by 11 libraries. The number of libraries was determined as previously described. This segment can be found in the following transcript(s): HSCD44E_T13 (SEQ ID NO:595) and HSCD44E_T16 (SEQ ID NO:596). Table 592 below describes the starting and ending position of this segment on each transcript.

TABLE 592

Segment location on transcripts

| Transcript name | Segment starting position | Segment ending position |
|---|---|---|
| HSCD44E_T13 (SEQ ID NO: 595) | 5437 | 6834 |
| HSCD44E_T16 (SEQ ID NO: 596) | 6628 | 8025 |

This segment can be found in a non-coding region of transcript(s) that are related to the following protein(s): HSCD44E_P10.

Segment cluster HSCD44E_node__73 (SEQ ID NO:642) according to the present invention is supported by 15 libraries. The number of libraries was determined as previously described. This segment can be found in the following transcript(s): HSCD44E_T13 (SEQ ID NO:595) and HSCD44E_T16 (SEQ ID NO:596). Table 593 below describes the starting and ending position of this segment on each transcript.

TABLE 593

Segment location on transcripts

| Transcript name | Segment starting position | Segment ending position |
|---|---|---|
| HSCD44E_T13 (SEQ ID NO: 595) | 6835 | 8082 |
| HSCD44E_T16 (SEQ ID NO: 596) | 8026 | 9273 |

This segment can be found in a non-coding region of transcript(s) that are related to the following protein(s): HSCD44E_P10.

Segment cluster HSCD44E_node_90 (SEQ ID NO:643) according to the present invention is supported by 10 libraries. The number of libraries was determined as previously described. This segment can be found in the following transcript(s): HSCD44E_T57 (SEQ ID NO:609). Table 594 below describes the starting and ending position of this segment on each transcript.

TABLE 594

Segment location on transcripts

| Transcript name | Segment starting position | Segment ending position |
|---|---|---|
| HSCD44E_T57 (SEQ ID NO: 609) | 1 | 1715 |

The previously-described transcripts for these segment(s) do not code for protein.

Segment cluster HSCD44E_node_92 (SEQ ID NO:644) according to the present invention is supported by 413 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T57 (SEQ ID NO:609), HSCD44E_T63 (SEQ ID NO:610) and HSCD44E_T65 (SEQ ID NO:611). Table 595 below describes the starting and ending position of this segment on each transcript.

TABLE 595

Segment location on transcripts

| Transcript name | Segment starting position | Segment ending position |
|---|---|---|
| HSCD44E_T1 (SEQ ID NO: 588) | 5726 | 6978 |
| HSCD44E_T3 (SEQ ID NO: 589) | 3876 | 5128 |
| HSCD44E_T6 (SEQ ID NO: 590) | 3750 | 5002 |
| HSCD44E_T7 (SEQ ID NO: 591) | 4324 | 5576 |
| HSCD44E_T8 (SEQ ID NO: 592) | 3519 | 4771 |
| HSCD44E_T10 (SEQ ID NO: 593) | 3849 | 5101 |
| HSCD44E_T12 (SEQ ID NO: 594) | 6917 | 8169 |
| HSCD44E_T13 (SEQ ID NO: 595) | 8372 | 9624 |
| HSCD44E_T16 (SEQ ID NO: 596) | 9563 | 10815 |
| HSCD44E_T22 (SEQ ID NO: 597) | 5522 | 6774 |
| HSCD44E_T26 (SEQ ID NO: 598) | 5819 | 7071 |
| HSCD44E_T32 (SEQ ID NO: 599) | 6874 | 8126 |
| HSCD44E_T34 (SEQ ID NO: 600) | 5592 | 6844 |
| HSCD44E_T35 (SEQ ID NO: 601) | 5363 | 6615 |
| HSCD44E_T36 (SEQ ID NO: 602) | 5652 | 6904 |
| HSCD44E_T38 (SEQ ID NO: 603) | 3493 | 4745 |
| HSCD44E_T39 (SEQ ID NO: 604) | 5402 | 6654 |
| HSCD44E_T40 (SEQ ID NO: 605) | 4237 | 5489 |
| HSCD44E_T45 (SEQ ID NO: 606) | 2030 | 3282 |
| HSCD44E_T46 (SEQ ID NO: 607) | 2482 | 3734 |

TABLE 595-continued

Segment location on transcripts

| Transcript name | Segment starting position | Segment ending position |
|---|---|---|
| HSCD44E_T47 (SEQ ID NO: 608) | 1940 | 3192 |
| HSCD44E_T57 (SEQ ID NO: 609) | 1791 | 3043 |
| HSCD44E_T63 (SEQ ID NO: 610) | 5726 | 5992 |
| HSCD44E_T65 (SEQ ID NO: 611) | 5522 | 5788 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node_93 (SEQ ID NO:645) according to the present invention is supported by 458 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608) and HSCD44E_T57 (SEQ ID NO:609). Table 596 below describes the starting and ending position of this segment on each transcript.

TABLE 596

Segment location on transcripts

| Transcript name | Segment starting position | Segment ending position |
|---|---|---|
| HSCD44E_T1 (SEQ ID NO: 588) | 6979 | 8644 |
| HSCD44E_T3 (SEQ ID NO: 589) | 5129 | 6794 |
| HSCD44E_T6 (SEQ ID NO: 590) | 5003 | 6668 |
| HSCD44E_T7 (SEQ ID NO: 591) | 5577 | 7242 |
| HSCD44E_T8 (SEQ ID NO: 592) | 4772 | 6437 |
| HSCD44E_T10 (SEQ ID NO: 593) | 5102 | 6767 |
| HSCD44E_T12 (SEQ ID NO: 594) | 8170 | 9835 |
| HSCD44E_T13 (SEQ ID NO: 595) | 9625 | 11290 |
| HSCD44E_T16 (SEQ ID NO: 596) | 10816 | 12481 |
| HSCD44E_T22 (SEQ ID NO: 597) | 6775 | 8440 |
| HSCD44E_T26 (SEQ ID NO: 598) | 7072 | 8737 |
| HSCD44E_T32 (SEQ ID NO: 599) | 8127 | 9792 |
| HSCD44E_T34 (SEQ ID NO: 600) | 6845 | 8510 |
| HSCD44E_T35 (SEQ ID NO: 601) | 6616 | 8281 |
| HSCD44E_T36 (SEQ ID NO: 602) | 6905 | 8570 |
| HSCD44E_T38 (SEQ ID NO: 603) | 4746 | 6411 |
| HSCD44E_T39 (SEQ ID NO: 604) | 6655 | 8320 |
| HSCD44E_T40 (SEQ ID NO: 605) | 5490 | 7155 |
| HSCD44E_T45 (SEQ ID NO: 606) | 3283 | 4948 |
| HSCD44E_T46 (SEQ ID NO: 607) | 3735 | 5400 |
| HSCD44E_T47 (SEQ ID NO: 608) | 3193 | 4858 |
| HSCD44E_T57 (SEQ ID NO: 609) | 3044 | 4709 |

This segment can be found in a non-coding region of transcript(s) that are related to the following protein(s): HSCD44E_P2, HSCD44E_P4, HSCD44E_P6, HSCD44E_P8, HSCD44E_P10, HSCD44E_P18, HSCD44E_P28 and HSCD44E_P29.

Segment cluster HSCD44E_node_94 (SEQ ID NO:646) according to the present invention is supported by 216 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608) and HSCD44E_T57 (SEQ ID NO:609). Table 597 below describes the starting and ending position of this segment on each transcript.

TABLE 597

Segment location on transcripts

| Transcript name | Segment starting position | Segment ending position |
|---|---|---|
| HSCD44E_T1 (SEQ ID NO: 588) | 8645 | 8925 |
| HSCD44E_T3 (SEQ ID NO: 589) | 6795 | 7075 |
| HSCD44E_T6 (SEQ ID NO: 590) | 6669 | 6949 |
| HSCD44E_T7 (SEQ ID NO: 591) | 7243 | 7523 |
| HSCD44E_T8 (SEQ ID NO: 592) | 6438 | 6718 |
| HSCD44E_T10 (SEQ ID NO: 593) | 6768 | 7048 |
| HSCD44E_T12 (SEQ ID NO: 594) | 9836 | 10116 |
| HSCD44E_T13 (SEQ ID NO: 595) | 11291 | 11571 |
| HSCD44E_T16 (SEQ ID NO: 596) | 12482 | 12762 |
| HSCD44E_T22 (SEQ ID NO: 597) | 8441 | 8721 |
| HSCD44E_T26 (SEQ ID NO: 598) | 8738 | 9018 |
| HSCD44E_T32 (SEQ ID NO: 599) | 9793 | 10073 |
| HSCD44E_T34 (SEQ ID NO: 600) | 8511 | 8791 |
| HSCD44E_T35 (SEQ ID NO: 601) | 8282 | 8562 |
| HSCD44E_T36 (SEQ ID NO: 602) | 8571 | 8851 |
| HSCD44E_T38 (SEQ ID NO: 603) | 6412 | 6692 |
| HSCD44E_T39 (SEQ ID NO: 604) | 8321 | 8601 |
| HSCD44E_T40 (SEQ ID NO: 605) | 7156 | 7436 |
| HSCD44E_T45 (SEQ ID NO: 606) | 4949 | 5229 |
| HSCD44E_T46 (SEQ ID NO: 607) | 5401 | 5681 |
| HSCD44E_T47 (SEQ ID NO: 608) | 4859 | 5139 |
| HSCD44E_T57 (SEQ ID NO: 609) | 4710 | 4990 |

This segment can be found in a non-coding region of transcript(s) that are related to the following protein(s): HSCD44E_P2, HSCD44E_P4, HSCD44E_P6, HSCD44E_P8, HSCD44E_P10, HSCD44E_P18, HSCD44E_P28 and HSCD44E_P29.

According to an optional embodiment of the present invention, short segments related to the above cluster are also provided. These segments are up to about 120 bp in length, and so are included in a separate description.

Segment cluster HSCD44E_node_2 (SEQ ID NO:647) according to the present invention is supported by 1 libraries. The number of libraries was determined as previously described. This segment can be found in the following transcript(s): HSCD44E_T83 (SEQ ID NO:617). Table 598 below describes the starting and ending position of this segment on each transcript.

TABLE 598

Segment location on transcripts

| Transcript name | Segment starting position | Segment ending position |
|---|---|---|
| HSCD44E_T83 (SEQ ID NO: 617) | 139 | 194 |

The previously-described transcripts for these segment(s) do not code for protein.

Segment cluster HSCD44E_node_7 (SEQ ID NO:648) according to the present invention is supported by 160 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T22 (SEQ ID NO:600), HSCD44E_T38 (SEQ ID NO:603), HSCD44E_T34 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 599 below describes the starting and ending position of this segment on each transcript.

TABLE 599

Segment location on transcripts

| Transcript name | Segment starting position | Segment ending position |
|---|---|---|
| HSCD44E_T1 (SEQ ID NO: 588) | 334 | 430 |
| HSCD44E_T3 (SEQ ID NO: 589) | 334 | 430 |
| HSCD44E_T6 (SEQ ID NO: 590) | 334 | 430 |
| HSCD44E_T7 (SEQ ID NO: 591) | 334 | 430 |
| HSCD44E_T8 (SEQ ID NO: 592) | 334 | 430 |
| HSCD44E_T10 (SEQ ID NO: 593) | 334 | 430 |
| HSCD44E_T12 (SEQ ID NO: 594) | 334 | 430 |
| HSCD44E_T13 (SEQ ID NO: 595) | 334 | 430 |
| HSCD44E_T16 (SEQ ID NO: 596) | 334 | 430 |
| HSCD44E_T22 (SEQ ID NO: 597) | 334 | 430 |
| HSCD44E_T26 (SEQ ID NO: 598) | 334 | 430 |
| HSCD44E_T34 (SEQ ID NO: 600) | 334 | 430 |
| HSCD44E_T38 (SEQ ID NO: 603) | 334 | 430 |
| HSCD44E_T63 (SEQ ID NO: 610) | 334 | 430 |
| HSCD44E_T65 (SEQ ID NO: 611) | 334 | 430 |
| HSCD44E_T68 (SEQ ID NO: 612) | 334 | 430 |
| HSCD44E_T69 (SEQ ID NO: 613) | 334 | 430 |
| HSCD44E_T72 (SEQ ID NO: 614) | 334 | 430 |
| HSCD44E_T73 (SEQ ID NO: 615) | 334 | 430 |

This segment can be found in both coding and non-coding regions of transcript(s) as follows. The segment can be found in a non-coding region of transcript(s) that are related to the following protein(s): HSCD44E_P2, HSCD44E_P4, HSCD44E_P6, HSCD44E_P8, HSCD44E_P10, HSCD44E_P18 and HSCD44E_P40. This segment can also be found in the following protein(s): HSCD44E_P41, since it is in the coding region for the corresponding transcript.

Segment cluster HSCD44E_node_8 (SEQ ID NO:649) according to the present invention is supported by 168 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 600 below describes the starting and ending position of this segment on each transcript.

TABLE 600

Segment location on transcripts

| Transcript name | Segment starting position | Segment ending position |
|---|---|---|
| HSCD44E_T1 (SEQ ID NO: 588) | 431 | 501 |
| HSCD44E_T3 (SEQ ID NO: 589) | 431 | 501 |
| HSCD44E_T6 (SEQ ID NO: 590) | 431 | 501 |
| HSCD44E_T7 (SEQ ID NO: 591) | 431 | 501 |
| HSCD44E_T8 (SEQ ID NO: 592) | 431 | 501 |
| HSCD44E_T10 (SEQ ID NO: 593) | 431 | 501 |
| HSCD44E_T12 (SEQ ID NO: 594) | 431 | 501 |
| HSCD44E_T13 (SEQ ID NO: 595) | 431 | 501 |
| HSCD44E_T16 (SEQ ID NO: 596) | 431 | 501 |
| HSCD44E_T22 (SEQ ID NO: 597) | 431 | 501 |
| HSCD44E_T26 (SEQ ID NO: 598) | 431 | 501 |
| HSCD44E_T34 (SEQ ID NO: 600) | 431 | 501 |
| HSCD44E_T38 (SEQ ID NO: 603) | 431 | 501 |
| HSCD44E_T63 (SEQ ID NO: 610) | 431 | 501 |
| HSCD44E_T65 (SEQ ID NO: 611) | 431 | 501 |
| HSCD44E_T68 (SEQ ID NO: 612) | 431 | 501 |
| HSCD44E_T69 (SEQ ID NO: 613) | 431 | 501 |
| HSCD44E_T72 (SEQ ID NO: 614) | 431 | 501 |
| HSCD44E_T73 (SEQ ID NO: 615) | 431 | 501 |

This segment can be found in both coding and non-coding regions of transcript(s) as follows. The segment can be found in a non-coding region of transcript(s) that are related to the following protein(s): HSCD44E_P2 and HSCD44E_P18. This segment can also be found in the following protein(s): HSCD44E_P4, HSCD44E_P6, HSCD44E_P8, HSCD44E_P10, HSCD44E_P40 and HSCD44E_P41, since it is in the coding region for the corresponding transcript.

Segment cluster HSCD44E_node_10 (SEQ ID NO:650) according to the present invention is supported by 171 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 601 below describes the starting and ending position of this segment on each transcript.

TABLE 601

Segment location on transcripts

| Transcript name | Segment starting position | Segment ending position |
|---|---|---|
| HSCD44E_T1 (SEQ ID NO: 588) | 502 | 528 |
| HSCD44E_T3 (SEQ ID NO: 589) | 502 | 528 |
| HSCD44E_T6 (SEQ ID NO: 590) | 502 | 528 |
| HSCD44E_T7 (SEQ ID NO: 591) | 502 | 528 |
| HSCD44E_T8 (SEQ ID NO: 592) | 502 | 528 |
| HSCD44E_T10 (SEQ ID NO: 593) | 502 | 528 |
| HSCD44E_T12 (SEQ ID NO: 594) | 502 | 528 |
| HSCD44E_T13 (SEQ ID NO: 595) | 502 | 528 |
| HSCD44E_T16 (SEQ ID NO: 596) | 502 | 528 |
| HSCD44E_T22 (SEQ ID NO: 597) | 502 | 528 |
| HSCD44E_T26 (SEQ ID NO: 598) | 502 | 528 |
| HSCD44E_T34 (SEQ ID NO: 600) | 502 | 528 |
| HSCD44E_T35 (SEQ ID NO: 601) | 139 | 165 |
| HSCD44E_T38 (SEQ ID NO: 603) | 502 | 528 |
| HSCD44E_T63 (SEQ ID NO: 610) | 502 | 528 |
| HSCD44E_T65 (SEQ ID NO: 611) | 502 | 528 |
| HSCD44E_T68 (SEQ ID NO: 612) | 502 | 528 |
| HSCD44E_T69 (SEQ ID NO: 613) | 502 | 528 |
| HSCD44E_T72 (SEQ ID NO: 614) | 502 | 528 |
| HSCD44E_T73 (SEQ ID NO: 615) | 502 | 528 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node_11 (SEQ ID NO:651) according to the present invention is supported by 173 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 602 below describes the starting and ending position of this segment on each transcript.

TABLE 602

Segment location on transcripts

| Transcript name | Segment starting position | Segment ending position |
|---|---|---|
| HSCD44E_T1 (SEQ ID NO: 588) | 529 | 573 |
| HSCD44E_T3 (SEQ ID NO: 589) | 529 | 573 |
| HSCD44E_T6 (SEQ ID NO: 590) | 529 | 573 |
| HSCD44E_T7 (SEQ ID NO: 591) | 529 | 573 |
| HSCD44E_T8 (SEQ ID NO: 592) | 529 | 573 |
| HSCD44E_T10 (SEQ ID NO: 593) | 529 | 573 |
| HSCD44E_T12 (SEQ ID NO: 594) | 529 | 573 |

TABLE 602-continued

Segment location on transcripts

| Transcript name | Segment starting position | Segment ending position |
|---|---|---|
| HSCD44E_T13 (SEQ ID NO: 595) | 529 | 573 |
| HSCD44E_T16 (SEQ ID NO: 596) | 529 | 573 |
| HSCD44E_T22 (SEQ ID NO: 597) | 529 | 573 |
| HSCD44E_T26 (SEQ ID NO: 598) | 529 | 573 |
| HSCD44E_T34 (SEQ ID NO: 600) | 529 | 573 |
| HSCD44E_T35 (SEQ ID NO: 601) | 166 | 210 |
| HSCD44E_T38 (SEQ ID NO: 603) | 529 | 573 |
| HSCD44E_T63 (SEQ ID NO: 610) | 529 | 573 |
| HSCD44E_T65 (SEQ ID NO: 611) | 529 | 573 |
| HSCD44E_T68 (SEQ ID NO: 612) | 529 | 573 |
| HSCD44E_T69 (SEQ ID NO: 613) | 529 | 573 |
| HSCD44E_T72 (SEQ ID NO: 614) | 529 | 573 |
| HSCD44E_T73 (SEQ ID NO: 615) | 529 | 573 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__12 (SEQ ID NO:652) according to the present invention is supported by 149 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 603 below describes the starting and ending position of this segment on each transcript.

TABLE 603

Segment location on transcripts

| Transcript name | Segment starting position | Segment ending position |
|---|---|---|
| HSCD44E_T1 (SEQ ID NO: 588) | 574 | 610 |
| HSCD44E_T3 (SEQ ID NO: 589) | 574 | 610 |
| HSCD44E_T6 (SEQ ID NO: 590) | 574 | 610 |
| HSCD44E_T7 (SEQ ID NO: 591) | 574 | 610 |
| HSCD44E_T8 (SEQ ID NO: 592) | 574 | 610 |
| HSCD44E_T10 (SEQ ID NO: 593) | 574 | 610 |
| HSCD44E_T12 (SEQ ID NO: 594) | 574 | 610 |
| HSCD44E_T13 (SEQ ID NO: 595) | 574 | 610 |
| HSCD44E_T16 (SEQ ID NO: 596) | 574 | 610 |
| HSCD44E_T22 (SEQ ID NO: 597) | 574 | 610 |
| HSCD44E_T26 (SEQ ID NO: 598) | 574 | 610 |
| HSCD44E_T34 (SEQ ID NO: 600) | 574 | 610 |
| HSCD44E_T35 (SEQ ID NO: 601) | 211 | 247 |
| HSCD44E_T38 (SEQ ID NO: 603) | 574 | 610 |
| HSCD44E_T63 (SEQ ID NO: 610) | 574 | 610 |
| HSCD44E_T65 (SEQ ID NO: 611) | 574 | 610 |
| HSCD44E_T68 (SEQ ID NO: 612) | 574 | 610 |
| HSCD44E_T69 (SEQ ID NO: 613) | 574 | 610 |
| HSCD44E_T72 (SEQ ID NO: 614) | 574 | 610 |
| HSCD44E_T73 (SEQ ID NO: 615) | 574 | 610 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__13 (SEQ ID NO:653) according to the present invention is supported by 149 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T38 (SEQ ID NO:603), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 604 below describes the starting and ending position of this segment on each transcript.

TABLE 604

Segment location on transcripts

| Transcript name | Segment starting position | Segment ending position |
|---|---|---|
| HSCD44E_T1 (SEQ ID NO: 588) | 611 | 667 |
| HSCD44E_T3 (SEQ ID NO: 589) | 611 | 667 |
| HSCD44E_T6 (SEQ ID NO: 590) | 611 | 667 |
| HSCD44E_T7 (SEQ ID NO: 591) | 611 | 667 |
| HSCD44E_T8 (SEQ ID NO: 592) | 611 | 667 |
| HSCD44E_T10 (SEQ ID NO: 593) | 611 | 667 |
| HSCD44E_T12 (SEQ ID NO: 594) | 611 | 667 |
| HSCD44E_T13 (SEQ ID NO: 595) | 611 | 667 |
| HSCD44E_T16 (SEQ ID NO: 596) | 611 | 667 |
| HSCD44E_T22 (SEQ ID NO: 597) | 611 | 667 |
| HSCD44E_T26 (SEQ ID NO: 598) | 611 | 667 |
| HSCD44E_T34 (SEQ ID NO: 600) | 611 | 667 |
| HSCD44E_T35 (SEQ ID NO: 601) | 248 | 304 |
| HSCD44E_T38 (SEQ ID NO: 603) | 611 | 667 |
| HSCD44E_T63 (SEQ ID NO: 610) | 611 | 667 |
| HSCD44E_T65 (SEQ ID NO: 611) | 611 | 667 |
| HSCD44E_T68 (SEQ ID NO: 612) | 611 | 667 |
| HSCD44E_T69 (SEQ ID NO: 613) | 611 | 667 |
| HSCD44E_T72 (SEQ ID NO: 614) | 611 | 667 |
| HSCD44E_T73 (SEQ ID NO: 615) | 611 | 667 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__17 (SEQ ID NO:654) according to the present invention is supported by 157 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T35 (SEQ ID NO:601), HSCD44E_T36 (SEQ ID NO:602), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 605 below describes the starting and ending position of this segment on each transcript.

TABLE 605

Segment location on transcripts

| Transcript name | Segment starting position | Segment ending position |
|---|---|---|
| HSCD44E_T1 (SEQ ID NO: 588) | 668 | 710 |
| HSCD44E_T3 (SEQ ID NO: 589) | 668 | 710 |
| HSCD44E_T6 (SEQ ID NO: 590) | 668 | 710 |
| HSCD44E_T7 (SEQ ID NO: 591) | 668 | 710 |
| HSCD44E_T8 (SEQ ID NO: 592) | 668 | 710 |
| HSCD44E_T10 (SEQ ID NO: 593) | 668 | 710 |
| HSCD44E_T12 (SEQ ID NO: 594) | 668 | 710 |
| HSCD44E_T13 (SEQ ID NO: 595) | 668 | 710 |
| HSCD44E_T16 (SEQ ID NO: 596) | 668 | 710 |
| HSCD44E_T22 (SEQ ID NO: 597) | 668 | 710 |
| HSCD44E_T26 (SEQ ID NO: 598) | 668 | 710 |
| HSCD44E_T35 (SEQ ID NO: 601) | 305 | 347 |
| HSCD44E_T36 (SEQ ID NO: 602) | 594 | 636 |
| HSCD44E_T63 (SEQ ID NO: 610) | 668 | 710 |
| HSCD44E_T65 (SEQ ID NO: 611) | 668 | 710 |
| HSCD44E_T68 (SEQ ID NO: 612) | 668 | 710 |
| HSCD44E_T69 (SEQ ID NO: 613) | 668 | 710 |
| HSCD44E_T72 (SEQ ID NO: 614) | 668 | 710 |
| HSCD44E_T73 (SEQ ID NO: 615) | 668 | 710 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__18 (SEQ ID NO:655) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T35 (SEQ ID NO:601), HSCD44E_T36 (SEQ ID NO:602), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 606 below describes the starting and ending position of this segment on each transcript.

TABLE 606

Segment location on transcripts

| Transcript name | Segment starting position | Segment ending position |
|---|---|---|
| HSCD44E_T1 (SEQ ID NO: 588) | 711 | 723 |
| HSCD44E_T3 (SEQ ID NO: 589) | 711 | 723 |
| HSCD44E_T6 (SEQ ID NO: 590) | 711 | 723 |
| HSCD44E_T7 (SEQ ID NO: 591) | 711 | 723 |
| HSCD44E_T8 (SEQ ID NO: 592) | 711 | 723 |
| HSCD44E_T10 (SEQ ID NO: 593) | 711 | 723 |
| HSCD44E_T12 (SEQ ID NO: 594) | 711 | 723 |
| HSCD44E_T13 (SEQ ID NO: 595) | 711 | 723 |
| HSCD44E_T16 (SEQ ID NO: 596) | 711 | 723 |
| HSCD44E_T22 (SEQ ID NO: 597) | 711 | 723 |
| HSCD44E_T26 (SEQ ID NO: 598) | 711 | 723 |
| HSCD44E_T35 (SEQ ID NO: 601) | 348 | 360 |
| HSCD44E_T36 (SEQ ID NO: 602) | 637 | 649 |
| HSCD44E_T63 (SEQ ID NO: 610) | 711 | 723 |
| HSCD44E_T65 (SEQ ID NO: 611) | 711 | 723 |
| HSCD44E_T68 (SEQ ID NO: 612) | 711 | 723 |
| HSCD44E_T69 (SEQ ID NO: 613) | 711 | 723 |
| HSCD44E_T72 (SEQ ID NO: 614) | 711 | 723 |
| HSCD44E_T73 (SEQ ID NO: 615) | 711 | 723 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__19 (SEQ ID NO:656) according to the present invention is supported by 161 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T35 (SEQ ID NO:601), HSCD44E_T36 (SEQ ID NO:602), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 607 below describes the starting and ending position of this segment on each transcript.

TABLE 607

Segment location on transcripts

| Transcript name | Segment starting position | Segment ending position |
|---|---|---|
| HSCD44E_T1 (SEQ ID NO: 588) | 724 | 749 |
| HSCD44E_T3 (SEQ ID NO: 589) | 724 | 749 |
| HSCD44E_T6 (SEQ ID NO: 590) | 724 | 749 |
| HSCD44E_T7 (SEQ ID NO: 591) | 724 | 749 |
| HSCD44E_T8 (SEQ ID NO: 592) | 724 | 749 |
| HSCD44E_T10 (SEQ ID NO: 593) | 724 | 749 |

TABLE 607-continued

Segment location on transcripts

| Transcript name | Segment starting position | Segment ending position |
|---|---|---|
| HSCD44E_T12 (SEQ ID NO: 594) | 724 | 749 |
| HSCD44E_T13 (SEQ ID NO: 595) | 724 | 749 |
| HSCD44E_T16 (SEQ ID NO: 596) | 724 | 749 |
| HSCD44E_T22 (SEQ ID NO: 597) | 724 | 749 |
| HSCD44E_T26 (SEQ ID NO: 598) | 724 | 749 |
| HSCD44E_T35 (SEQ ID NO: 601) | 361 | 386 |
| HSCD44E_T36 (SEQ ID NO: 602) | 650 | 675 |
| HSCD44E_T63 (SEQ ID NO: 610) | 724 | 749 |
| HSCD44E_T65 (SEQ ID NO: 611) | 724 | 749 |
| HSCD44E_T68 (SEQ ID NO: 612) | 724 | 749 |
| HSCD44E_T69 (SEQ ID NO: 613) | 724 | 749 |
| HSCD44E_T72 (SEQ ID NO: 614) | 724 | 749 |
| HSCD44E_T73 (SEQ ID NO: 615) | 724 | 749 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node_20 (SEQ ID NO:657) according to the present invention is supported by 167 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T35 (SEQ ID NO:601), HSCD44E_T36 (SEQ ID NO:602), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 608 below describes the starting and ending position of this segment on each transcript.

TABLE 608

Segment location on transcripts

| Transcript name | Segment starting position | Segment ending position |
|---|---|---|
| HSCD44E_T1 (SEQ ID NO: 588) | 750 | 801 |
| HSCD44E_T3 (SEQ ID NO: 589) | 750 | 801 |
| HSCD44E_T6 (SEQ ID NO: 590) | 750 | 801 |
| HSCD44E_T7 (SEQ ID NO: 591) | 750 | 801 |
| HSCD44E_T8 (SEQ ID NO: 592) | 750 | 801 |
| HSCD44E_T10 (SEQ ID NO: 593) | 750 | 801 |
| HSCD44E_T12 (SEQ ID NO: 594) | 750 | 801 |
| HSCD44E_T13 (SEQ ID NO: 595) | 750 | 801 |
| HSCD44E_T16 (SEQ ID NO: 596) | 750 | 801 |
| HSCD44E_T22 (SEQ ID NO: 597) | 750 | 801 |
| HSCD44E_T26 (SEQ ID NO: 598) | 750 | 801 |
| HSCD44E_T35 (SEQ ID NO: 601) | 387 | 438 |
| HSCD44E_T36 (SEQ ID NO: 602) | 676 | 727 |
| HSCD44E_T63 (SEQ ID NO: 610) | 750 | 801 |
| HSCD44E_T65 (SEQ ID NO: 611) | 750 | 801 |
| HSCD44E_T68 (SEQ ID NO: 612) | 750 | 801 |
| HSCD44E_T69 (SEQ ID NO: 613) | 750 | 801 |
| HSCD44E_T72 (SEQ ID NO: 614) | 750 | 801 |
| HSCD44E_T73 (SEQ ID NO: 615) | 750 | 801 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node_24 (SEQ ID NO:658) according to the present invention is supported by 168 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 609 below describes the starting and ending position of this segment on each transcript.

TABLE 609

Segment location on transcripts

| Transcript name | Segment starting position | Segment ending position |
|---|---|---|
| HSCD44E_T1 (SEQ ID NO: 588) | 802 | 836 |
| HSCD44E_T3 (SEQ ID NO: 589) | 802 | 836 |
| HSCD44E_T6 (SEQ ID NO: 590) | 802 | 836 |
| HSCD44E_T7 (SEQ ID NO: 591) | 802 | 836 |
| HSCD44E_T8 (SEQ ID NO: 592) | 802 | 836 |
| HSCD44E_T10 (SEQ ID NO: 593) | 802 | 836 |
| HSCD44E_T12 (SEQ ID NO: 594) | 802 | 836 |
| HSCD44E_T13 (SEQ ID NO: 595) | 802 | 836 |
| HSCD44E_T16 (SEQ ID NO: 596) | 802 | 836 |
| HSCD44E_T22 (SEQ ID NO: 597) | 802 | 836 |
| HSCD44E_T26 (SEQ ID NO: 598) | 802 | 836 |
| HSCD44E_T34 (SEQ ID NO: 600) | 668 | 702 |
| HSCD44E_T35 (SEQ ID NO: 601) | 439 | 473 |
| HSCD44E_T36 (SEQ ID NO: 602) | 728 | 762 |
| HSCD44E_T39 (SEQ ID NO: 604) | 478 | 512 |
| HSCD44E_T63 (SEQ ID NO: 610) | 802 | 836 |
| HSCD44E_T65 (SEQ ID NO: 611) | 802 | 836 |
| HSCD44E_T68 (SEQ ID NO: 612) | 802 | 836 |
| HSCD44E_T69 (SEQ ID NO: 613) | 802 | 836 |
| HSCD44E_T72 (SEQ ID NO: 614) | 802 | 836 |
| HSCD44E_T73 (SEQ ID NO: 615) | 802 | 836 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__25 (SEQ ID NO:659) according to the present invention is supported by 167 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 610 below describes the starting and ending position of this segment on each transcript.

TABLE 610

Segment location on transcripts

| Transcript name | Segment starting position | Segment ending position |
| --- | --- | --- |
| HSCD44E_T1 (SEQ ID NO: 588) | 837 | 870 |
| HSCD44E_T3 (SEQ ID NO: 589) | 837 | 870 |
| HSCD44E_T6 (SEQ ID NO: 590) | 837 | 870 |
| HSCD44E_T7 (SEQ ID NO: 591) | 837 | 870 |
| HSCD44E_T8 (SEQ ID NO: 592) | 837 | 870 |
| HSCD44E_T10 (SEQ ID NO: 593) | 837 | 870 |
| HSCD44E_T12 (SEQ ID NO: 594) | 837 | 870 |
| HSCD44E_T13 (SEQ ID NO: 595) | 837 | 870 |
| HSCD44E_T16 (SEQ ID NO: 596) | 837 | 870 |
| HSCD44E_T22 (SEQ ID NO: 597) | 837 | 870 |
| HSCD44E_T26 (SEQ ID NO: 598) | 837 | 870 |
| HSCD44E_T34 (SEQ ID NO: 600) | 703 | 736 |
| HSCD44E_T35 (SEQ ID NO: 601) | 474 | 507 |
| HSCD44E_T36 (SEQ ID NO: 602) | 763 | 796 |
| HSCD44E_T39 (SEQ ID NO: 604) | 513 | 546 |
| HSCD44E_T63 (SEQ ID NO: 610) | 837 | 870 |
| HSCD44E_T65 (SEQ ID NO: 611) | 837 | 870 |
| HSCD44E_T68 (SEQ ID NO: 612) | 837 | 870 |
| HSCD44E_T69 (SEQ ID NO: 613) | 837 | 870 |
| HSCD44E_T72 (SEQ ID NO: 614) | 837 | 870 |
| HSCD44E_T73 (SEQ ID NO: 615) | 837 | 870 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__30 (SEQ ID NO:660) according to the present invention is supported by 188 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 611 below describes the starting and ending position of this segment on each transcript.

TABLE 611

Segment location on transcripts

| Transcript name | Segment starting position | Segment ending position |
| --- | --- | --- |
| HSCD44E_T1 (SEQ ID NO: 588) | 1009 | 1050 |
| HSCD44E_T3 (SEQ ID NO: 589) | 1009 | 1050 |
| HSCD44E_T6 (SEQ ID NO: 590) | 1009 | 1050 |
| HSCD44E_T7 (SEQ ID NO: 591) | 1009 | 1050 |
| HSCD44E_T8 (SEQ ID NO: 592) | 1009 | 1050 |
| HSCD44E_T10 (SEQ ID NO: 593) | 1009 | 1050 |
| HSCD44E_T12 (SEQ ID NO: 594) | 1009 | 1050 |
| HSCD44E_T13 (SEQ ID NO: 595) | 1009 | 1050 |
| HSCD44E_T16 (SEQ ID NO: 596) | 1009 | 1050 |
| HSCD44E_T22 (SEQ ID NO: 597) | 1009 | 1050 |
| HSCD44E_T26 (SEQ ID NO: 598) | 1009 | 1050 |
| HSCD44E_T34 (SEQ ID NO: 600) | 875 | 916 |
| HSCD44E_T35 (SEQ ID NO: 601) | 646 | 687 |
| HSCD44E_T36 (SEQ ID NO: 602) | 935 | 976 |
| HSCD44E_T39 (SEQ ID NO: 604) | 685 | 726 |
| HSCD44E_T63 (SEQ ID NO: 610) | 1009 | 1050 |
| HSCD44E_T65 (SEQ ID NO: 611) | 1009 | 1050 |
| HSCD44E_T68 (SEQ ID NO: 612) | 1009 | 1050 |
| HSCD44E_T69 (SEQ ID NO: 613) | 1009 | 1050 |
| HSCD44E_T72 (SEQ ID NO: 614) | 1009 | 1050 |
| HSCD44E_T73 (SEQ ID NO: 615) | 1009 | 1050 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node__31 (SEQ ID NO:661) according to the present invention is supported by 187 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T63 (SEQ ID NO:610), HSCD44E_T65 (SEQ ID NO:611), HSCD44E_T68 (SEQ ID NO:612), HSCD44E_T69 (SEQ ID NO:613), HSCD44E_T72 (SEQ ID NO:614) and HSCD44E_T73 (SEQ ID NO:615). Table 612 below describes the starting and ending position of this segment on each transcript.

TABLE 612

Segment location on transcripts

| Transcript name | Segment starting position | Segment ending position |
|---|---|---|
| HSCD44E_T1 (SEQ ID NO: 588) | 1051 | 1101 |
| HSCD44E_T3 (SEQ ID NO: 589) | 1051 | 1101 |
| HSCD44E_T6 (SEQ ID NO: 590) | 1051 | 1101 |
| HSCD44E_T7 (SEQ ID NO: 591) | 1051 | 1101 |
| HSCD44E_T8 (SEQ ID NO: 592) | 1051 | 1101 |
| HSCD44E_T10 (SEQ ID NO: 593) | 1051 | 1101 |
| HSCD44E_T12 (SEQ ID NO: 594) | 1051 | 1101 |
| HSCD44E_T13 (SEQ ID NO: 595) | 1051 | 1101 |
| HSCD44E_T16 (SEQ ID NO: 596) | 1051 | 1101 |
| HSCD44E_T22 (SEQ ID NO: 597) | 1051 | 1101 |
| HSCD44E_T26 (SEQ ID NO: 598) | 1051 | 1101 |
| HSCD44E_T34 (SEQ ID NO: 600) | 917 | 967 |
| HSCD44E_T35 (SEQ ID NO: 601) | 688 | 738 |
| HSCD44E_T36 (SEQ ID NO: 602) | 977 | 1027 |
| HSCD44E_T38 (SEQ ID NO: 603) | 668 | 718 |
| HSCD44E_T39 (SEQ ID NO: 604) | 727 | 777 |
| HSCD44E_T63 (SEQ ID NO: 610) | 1051 | 1101 |
| HSCD44E_T65 (SEQ ID NO: 611) | 1051 | 1101 |
| HSCD44E_T68 (SEQ ID NO: 612) | 1051 | 1101 |
| HSCD44E_T69 (SEQ ID NO: 613) | 1051 | 1101 |
| HSCD44E_T72 (SEQ ID NO: 614) | 1051 | 1101 |
| HSCD44E_T73 (SEQ ID NO: 615) | 1051 | 1101 |

This segment can be found in both coding and non-coding regions of transcript(s) as follows. The segment can be found in a non-coding region of transcript(s) that are related to the following protein(s): HSCD44E_P2, HSCD44E_P18 and HSCD44E_P41. This segment can also be found in the following protein(s): HSCD44E_P4, HSCD44E_P6, HSCD44E_P8, HSCD44E_P10 and HSCD44E_P40, since it is in the coding region for the corresponding transcript.

Segment cluster HSCD44E_node_37 (SEQ ID NO:662) according to the present invention is supported by 22 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 613 below describes the starting and ending position of this segment on each transcript.

TABLE 613

Segment location on transcripts

| Transcript name | Segment starting position | Segment ending position |
|---|---|---|
| HSCD44E_T1 (SEQ ID NO: 588) | 1725 | 1839 |
| HSCD44E_T12 (SEQ ID NO: 594) | 1725 | 1839 |
| HSCD44E_T13 (SEQ ID NO: 595) | 1725 | 1839 |
| HSCD44E_T16 (SEQ ID NO: 596) | 1725 | 1839 |
| HSCD44E_T22 (SEQ ID NO: 597) | 1725 | 1839 |
| HSCD44E_T26 (SEQ ID NO: 598) | 1725 | 1839 |
| HSCD44E_T32 (SEQ ID NO: 599) | 2873 | 2987 |
| HSCD44E_T34 (SEQ ID NO: 600) | 1591 | 1705 |
| HSCD44E_T35 (SEQ ID NO: 601) | 1362 | 1476 |
| HSCD44E_T36 (SEQ ID NO: 602) | 1651 | 1765 |
| HSCD44E_T39 (SEQ ID NO: 604) | 1401 | 1515 |
| HSCD44E_T63 (SEQ ID NO: 610) | 1725 | 1839 |
| HSCD44E_T65 (SEQ ID NO: 611) | 1725 | 1839 |
| HSCD44E_T68 (SEQ ID NO: 612) | 1725 | 1839 |
| HSCD44E_T69 (SEQ ID NO: 613) | 1725 | 1839 |

This segment can be found in a non-coding region of transcript(s) that are related to the following protein(s): HSCD44E_P2, HSCD44E_P10 and HSCD44E_P18.

Segment cluster HSCD44E_node_40 (SEQ ID NO:663) according to the present invention is supported by 6 libraries. The number of libraries was determined as previously described. This segment can be found in the following transcript(s): HSCD44E_T1 (SEQ ID NO:588), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 614 below describes the starting and ending position of this segment on each transcript.

TABLE 614

Segment location on transcripts

| Transcript name | Segment starting position | Segment ending position |
|---|---|---|
| HSCD44E_T1 (SEQ ID NO: 588) | 2150 | 2224 |
| HSCD44E_T12 (SEQ ID NO: 594) | 2150 | 2224 |
| HSCD44E_T13 (SEQ ID NO: 595) | 2150 | 2224 |
| HSCD44E_T16 (SEQ ID NO: 596) | 2150 | 2224 |
| HSCD44E_T22 (SEQ ID NO: 597) | 2150 | 2224 |
| HSCD44E_T26 (SEQ ID NO: 598) | 2150 | 2224 |
| HSCD44E_T32 (SEQ ID NO: 599) | 3298 | 3372 |
| HSCD44E_T34 (SEQ ID NO: 600) | 2016 | 2090 |
| HSCD44E_T35 (SEQ ID NO: 601) | 1787 | 1861 |
| HSCD44E_T36 (SEQ ID NO: 602) | 2076 | 2150 |
| HSCD44E_T39 (SEQ ID NO: 604) | 1826 | 1900 |
| HSCD44E_T63 (SEQ ID NO: 610) | 2150 | 2224 |
| HSCD44E_T65 (SEQ ID NO: 611) | 2150 | 2224 |
| HSCD44E_T68 (SEQ ID NO: 612) | 2150 | 2224 |
| HSCD44E_T69 (SEQ ID NO: 613) | 2150 | 2224 |

This segment can be found in a non-coding region of transcript(s) that are related to the following protein(s): HSCD44E_P2, HSCD44E_P10 and HSCD44E_P18.

Segment cluster HSCD44E_node_42 (SEQ ID NO:664) according to the present invention is supported by 36 libraries. The number of libraries was determined as previously described. This segment can be found in the following transcript(s): HSCD44E_T1 (SEQ ID NO:588), HSCD44E_T3 (SEQ ID NO:589), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 615 below describes the starting and ending position of this segment on each transcript.

TABLE 615

Segment location on transcripts

| Transcript name | Segment starting position | Segment ending position |
|---|---|---|
| HSCD44E_T1 (SEQ ID NO: 588) | 2477 | 2503 |
| HSCD44E_T3 (SEQ ID NO: 589) | 1102 | 1128 |
| HSCD44E_T12 (SEQ ID NO: 594) | 2477 | 2503 |
| HSCD44E_T13 (SEQ ID NO: 595) | 2477 | 2503 |
| HSCD44E_T16 (SEQ ID NO: 596) | 2477 | 2503 |
| HSCD44E_T22 (SEQ ID NO: 597) | 2477 | 2503 |
| HSCD44E_T26 (SEQ ID NO: 598) | 2477 | 2503 |
| HSCD44E_T32 (SEQ ID NO: 599) | 3625 | 3651 |
| HSCD44E_T34 (SEQ ID NO: 600) | 2343 | 2369 |
| HSCD44E_T35 (SEQ ID NO: 601) | 2114 | 2140 |
| HSCD44E_T36 (SEQ ID NO: 602) | 2403 | 2429 |
| HSCD44E_T38 (SEQ ID NO: 603) | 719 | 745 |
| HSCD44E_T39 (SEQ ID NO: 604) | 2153 | 2179 |
| HSCD44E_T63 (SEQ ID NO: 610) | 2477 | 2503 |
| HSCD44E_T65 (SEQ ID NO: 611) | 2477 | 2503 |
| HSCD44E_T68 (SEQ ID NO: 612) | 2477 | 2503 |
| HSCD44E_T69 (SEQ ID NO: 613) | 2477 | 2503 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4, since it is in the coding region for the corresponding transcript.

Segment cluster HSCD44E_node__43 (SEQ ID NO:665) according to the present invention is supported by 41 libraries. The number of libraries was determined as previously described. This segment can be found in the following transcript(s): HSCD44E_T1 (SEQ ID NO:588), HSCD44E_T3 (SEQ ID NO:589), HSCD44E_T7 (SEQ ID NO:591), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 616 below describes the starting and ending position of this segment on each transcript.

TABLE 616

Segment location on transcripts

| Transcript name | Segment starting position | Segment ending position |
|---|---|---|
| HSCD44E_T1 (SEQ ID NO: 588) | 2504 | 2602 |
| HSCD44E_T3 (SEQ ID NO: 589) | 1129 | 1227 |
| HSCD44E_T7 (SEQ ID NO: 591) | 1102 | 1200 |
| HSCD44E_T10 (SEQ ID NO: 593) | 1102 | 1200 |
| HSCD44E_T12 (SEQ ID NO: 594) | 2504 | 2602 |
| HSCD44E_T13 (SEQ ID NO: 595) | 2504 | 2602 |
| HSCD44E_T16 (SEQ ID NO: 596) | 2504 | 2602 |
| HSCD44E_T22 (SEQ ID NO: 597) | 2504 | 2602 |
| HSCD44E_T26 (SEQ ID NO: 598) | 2504 | 2602 |

TABLE 616-continued

Segment location on transcripts

| Transcript name | Segment starting position | Segment ending position |
|---|---|---|
| HSCD44E_T32 (SEQ ID NO: 599) | 3652 | 3750 |
| HSCD44E_T34 (SEQ ID NO: 600) | 2370 | 2468 |
| HSCD44E_T35 (SEQ ID NO: 601) | 2141 | 2239 |
| HSCD44E_T36 (SEQ ID NO: 602) | 2430 | 2528 |
| HSCD44E_T38 (SEQ ID NO: 603) | 746 | 844 |
| HSCD44E_T39 (SEQ ID NO: 604) | 2180 | 2278 |
| HSCD44E_T63 (SEQ ID NO: 610) | 2504 | 2602 |
| HSCD44E_T65 (SEQ ID NO: 611) | 2504 | 2602 |
| HSCD44E_T68 (SEQ ID NO: 612) | 2504 | 2602 |
| HSCD44E_T69 (SEQ ID NO: 613) | 2504 | 2602 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4 and HSCD44E_P8, since it is in the coding region for the corresponding transcript.

Segment cluster HSCD44E_node__47 (SEQ ID NO:666) according to the present invention is supported by 30 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 617 below describes the starting and ending position of this segment on each transcript.

TABLE 617

Segment location on transcripts

| Transcript name | Segment starting position | Segment ending position |
|---|---|---|
| HSCD44E_T1 (SEQ ID NO: 588) | 2603 | 2716 |
| HSCD44E_T3 (SEQ ID NO: 589) | 1228 | 1341 |
| HSCD44E_T6 (SEQ ID NO: 590) | 1102 | 1215 |
| HSCD44E_T7 (SEQ ID NO: 591) | 1201 | 1314 |
| HSCD44E_T10 (SEQ ID NO: 593) | 1201 | 1314 |
| HSCD44E_T12 (SEQ ID NO: 594) | 2603 | 2716 |
| HSCD44E_T13 (SEQ ID NO: 595) | 2603 | 2716 |
| HSCD44E_T16 (SEQ ID NO: 596) | 2603 | 2716 |
| HSCD44E_T22 (SEQ ID NO: 597) | 2603 | 2716 |
| HSCD44E_T26 (SEQ ID NO: 598) | 2603 | 2716 |
| HSCD44E_T32 (SEQ ID NO: 599) | 3751 | 3864 |
| HSCD44E_T34 (SEQ ID NO: 600) | 2469 | 2582 |
| HSCD44E_T35 (SEQ ID NO: 601) | 2240 | 2353 |
| HSCD44E_T36 (SEQ ID NO: 602) | 2529 | 2642 |
| HSCD44E_T38 (SEQ ID NO: 603) | 845 | 958 |
| HSCD44E_T39 (SEQ ID NO: 604) | 2279 | 2392 |
| HSCD44E_T40 (SEQ ID NO: 605) | 1114 | 1227 |
| HSCD44E_T63 (SEQ ID NO: 610) | 2603 | 2716 |
| HSCD44E_T65 (SEQ ID NO: 611) | 2603 | 2716 |

TABLE 617-continued

Segment location on transcripts

| Transcript name | Segment starting position | Segment ending position |
|---|---|---|
| HSCD44E_T68 (SEQ ID NO: 612) | 2603 | 2716 |
| HSCD44E_T69 (SEQ ID NO: 613) | 2603 | 2716 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4, HSCD44E_P6 and HSCD44E_P8, since it is in the coding region for the corresponding transcript.

Segment cluster HSCD44E_node_49 (SEQ ID NO:667) according to the present invention is supported by 30 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T63 (SEQ ID NO:610), HSCD44E_T65 (SEQ ID NO:611), HSCD44E_T68 (SEQ ID NO:612) and HSCD44E_T69 (SEQ ID NO:613). Table 618 below describes the starting and ending position of this segment on each transcript.

TABLE 618

Segment location on transcripts

| Transcript name | Segment starting position | Segment ending position |
|---|---|---|
| HSCD44E_T1 (SEQ ID NO: 588) | 3192 | 3308 |
| HSCD44E_T3 (SEQ ID NO: 589) | 1342 | 1458 |
| HSCD44E_T6 (SEQ ID NO: 590) | 1216 | 1332 |
| HSCD44E_T7 (SEQ ID NO: 591) | 1790 | 1906 |
| HSCD44E_T10 (SEQ ID NO: 593) | 1315 | 1431 |
| HSCD44E_T12 (SEQ ID NO: 594) | 3192 | 3308 |
| HSCD44E_T13 (SEQ ID NO: 595) | 3192 | 3308 |
| HSCD44E_T16 (SEQ ID NO: 596) | 3192 | 3308 |
| HSCD44E_T22 (SEQ ID NO: 597) | 3192 | 3308 |
| HSCD44E_T26 (SEQ ID NO: 598) | 3192 | 3308 |
| HSCD44E_T32 (SEQ ID NO: 599) | 4340 | 4456 |
| HSCD44E_T34 (SEQ ID NO: 600) | 3058 | 3174 |
| HSCD44E_T35 (SEQ ID NO: 601) | 2829 | 2945 |
| HSCD44E_T36 (SEQ ID NO: 602) | 3118 | 3234 |
| HSCD44E_T38 (SEQ ID NO: 603) | 959 | 1075 |
| HSCD44E_T39 (SEQ ID NO: 604) | 2868 | 2984 |
| HSCD44E_T40 (SEQ ID NO: 605) | 1703 | 1819 |
| HSCD44E_T63 (SEQ ID NO: 610) | 3192 | 3308 |
| HSCD44E_T65 (SEQ ID NO: 611) | 3192 | 3308 |
| HSCD44E_T68 (SEQ ID NO: 612) | 3192 | 3308 |
| HSCD44E_T69 (SEQ ID NO: 613) | 3192 | 3308 |

This segment can be found in both coding and non-coding regions of transcript(s) as follows. The segment can be found in a non-coding region of transcript(s) that are related to the following protein(s): HSCD44E_P2, HSCD44E_P10 and HSCD44E_P18. This segment can also be found in the following protein(s): HSCD44E_P4, HSCD44E_P6 and HSCD44E_P8, since it is in the coding region for the corresponding transcript.

Segment cluster HSCD44E_node_58 (SEQ ID NO:668) according to the present invention is supported by 62 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 619 below describes the starting and ending position of this segment on each transcript.

TABLE 619

Segment location on transcripts

| Transcript name | Segment starting position | Segment ending position |
|---|---|---|
| HSCD44E_T1 (SEQ ID NO: 588) | 5041 | 5124 |
| HSCD44E_T3 (SEQ ID NO: 589) | 3191 | 3274 |
| HSCD44E_T6 (SEQ ID NO: 590) | 3065 | 3148 |
| HSCD44E_T7 (SEQ ID NO: 591) | 3639 | 3722 |
| HSCD44E_T8 (SEQ ID NO: 592) | 2834 | 2917 |
| HSCD44E_T10 (SEQ ID NO: 593) | 3164 | 3247 |
| HSCD44E_T12 (SEQ ID NO: 594) | 5041 | 5124 |
| HSCD44E_T13 (SEQ ID NO: 595) | 5041 | 5124 |
| HSCD44E_T16 (SEQ ID NO: 596) | 5041 | 5124 |
| HSCD44E_T22 (SEQ ID NO: 597) | 5041 | 5124 |
| HSCD44E_T26 (SEQ ID NO: 598) | 5041 | 5124 |
| HSCD44E_T32 (SEQ ID NO: 599) | 6189 | 6272 |
| HSCD44E_T34 (SEQ ID NO: 600) | 4907 | 4990 |
| HSCD44E_T35 (SEQ ID NO: 601) | 4678 | 4761 |
| HSCD44E_T36 (SEQ ID NO: 602) | 4967 | 5050 |
| HSCD44E_T38 (SEQ ID NO: 603) | 2808 | 2891 |
| HSCD44E_T39 (SEQ ID NO: 604) | 4717 | 4800 |
| HSCD44E_T40 (SEQ ID NO: 605) | 3552 | 3635 |
| HSCD44E_T45 (SEQ ID NO: 606) | 1345 | 1428 |
| HSCD44E_T47 (SEQ ID NO: 608) | 1345 | 1428 |
| HSCD44E_T63 (SEQ ID NO: 610) | 5041 | 5124 |
| HSCD44E_T65 (SEQ ID NO: 611) | 5041 | 5124 |
| HSCD44E_T68 (SEQ ID NO: 612) | 5041 | 5124 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node_59 (SEQ ID NO:669) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 620 below describes the starting and ending position of this segment on each transcript.

TABLE 620

Segment location on transcripts

| Transcript name | Segment starting position | Segment ending position |
|---|---|---|
| HSCD44E_T1 (SEQ ID NO: 588) | 5125 | 5142 |
| HSCD44E_T3 (SEQ ID NO: 589) | 3275 | 3292 |
| HSCD44E_T6 (SEQ ID NO: 590) | 3149 | 3166 |
| HSCD44E_T7 (SEQ ID NO: 591) | 3723 | 3740 |
| HSCD44E_T8 (SEQ ID NO: 592) | 2918 | 2935 |
| HSCD44E_T10 (SEQ ID NO: 593) | 3248 | 3265 |
| HSCD44E_T12 (SEQ ID NO: 594) | 5125 | 5142 |
| HSCD44E_T13 (SEQ ID NO: 595) | 5125 | 5142 |
| HSCD44E_T16 (SEQ ID NO: 596) | 5125 | 5142 |
| HSCD44E_T22 (SEQ ID NO: 597) | 5125 | 5142 |
| HSCD44E_T26 (SEQ ID NO: 598) | 5125 | 5142 |
| HSCD44E_T32 (SEQ ID NO: 599) | 6273 | 6290 |
| HSCD44E_T34 (SEQ ID NO: 600) | 4991 | 5008 |
| HSCD44E_T35 (SEQ ID NO: 601) | 4762 | 4779 |
| HSCD44E_T36 (SEQ ID NO: 602) | 5051 | 5068 |
| HSCD44E_T38 (SEQ ID NO: 603) | 2892 | 2909 |
| HSCD44E_T39 (SEQ ID NO: 604) | 4801 | 4818 |
| HSCD44E_T40 (SEQ ID NO: 605) | 3636 | 3653 |
| HSCD44E_T45 (SEQ ID NO: 606) | 1429 | 1446 |
| HSCD44E_T47 (SEQ ID NO: 608) | 1429 | 1446 |
| HSCD44E_T63 (SEQ ID NO: 610) | 5125 | 5142 |
| HSCD44E_T65 (SEQ ID NO: 611) | 5125 | 5142 |
| HSCD44E_T68 (SEQ ID NO: 612) | 5125 | 5142 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__64 (SEQ ID NO:670) according to the present invention is supported by 63 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T63 (SEQ ID NO:610), HSCD44E_T65 (SEQ ID NO:611) and HSCD44E_T68 (SEQ ID NO:612). Table 621 below describes the starting and ending position of this segment on each transcript.

TABLE 621

Segment location on transcripts

| Transcript name | Segment starting position | Segment ending position |
|---|---|---|
| HSCD44E_T1 (SEQ ID NO: 588) | 5143 | 5232 |
| HSCD44E_T3 (SEQ ID NO: 589) | 3293 | 3382 |
| HSCD44E_T6 (SEQ ID NO: 590) | 3167 | 3256 |
| HSCD44E_T7 (SEQ ID NO: 591) | 3741 | 3830 |
| HSCD44E_T8 (SEQ ID NO: 592) | 2936 | 3025 |
| HSCD44E_T10 (SEQ ID NO: 593) | 3266 | 3355 |
| HSCD44E_T12 (SEQ ID NO: 594) | 5143 | 5232 |
| HSCD44E_T13 (SEQ ID NO: 595) | 5143 | 5232 |
| HSCD44E_T16 (SEQ ID NO: 596) | 5143 | 5232 |
| HSCD44E_T22 (SEQ ID NO: 597) | 5143 | 5232 |
| HSCD44E_T26 (SEQ ID NO: 598) | 5143 | 5232 |
| HSCD44E_T32 (SEQ ID NO: 599) | 6291 | 6380 |
| HSCD44E_T34 (SEQ ID NO: 600) | 5009 | 5098 |
| HSCD44E_T35 (SEQ ID NO: 601) | 4780 | 4869 |
| HSCD44E_T36 (SEQ ID NO: 602) | 5069 | 5158 |
| HSCD44E_T38 (SEQ ID NO: 603) | 2910 | 2999 |
| HSCD44E_T39 (SEQ ID NO: 604) | 4819 | 4908 |
| HSCD44E_T40 (SEQ ID NO: 605) | 3654 | 3743 |
| HSCD44E_T45 (SEQ ID NO: 606) | 1447 | 1536 |
| HSCD44E_T63 (SEQ ID NO: 610) | 5143 | 5232 |
| HSCD44E_T65 (SEQ ID NO: 611) | 5143 | 5232 |
| HSCD44E_T68 (SEQ ID NO: 612) | 5143 | 5232 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18 and HSCD44E_P28, since it is in the coding region for the corresponding transcript.

Segment cluster HSCD44E_node__65 (SEQ ID NO:671) according to the present invention is supported by 3 libraries. The number of libraries was determined as previously described. This segment can be found in the following transcript(s): HSCD44E_T12 (SEQ ID NO:594) and HSCD44E_T16 (SEQ ID NO:596). Table 622 below describes the starting and ending position of this segment on each transcript.

TABLE 622

Segment location on transcripts

| Transcript name | Segment starting position | Segment ending position |
|---|---|---|
| HSCD44E_T12 (SEQ ID NO: 594) | 5233 | 5328 |
| HSCD44E_T16 (SEQ ID NO: 596) | 5233 | 5328 |

This segment can be found in a non-coding region of transcript(s) that are related to the following protein(s): HSCD44E_P10.

Segment cluster HSCD44E_node__67 (SEQ ID NO:672) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610) and HSCD44E_T68 (SEQ ID NO:612). Table 623 below describes the starting and ending position of this segment on each transcript.

TABLE 623

Segment location on transcripts

| Transcript name | Segment starting position | Segment ending position |
| --- | --- | --- |
| HSCD44E_T1 (SEQ ID NO: 588) | 5233 | 5250 |
| HSCD44E_T3 (SEQ ID NO: 589) | 3383 | 3400 |
| HSCD44E_T6 (SEQ ID NO: 590) | 3257 | 3274 |
| HSCD44E_T7 (SEQ ID NO: 591) | 3831 | 3848 |
| HSCD44E_T8 (SEQ ID NO: 592) | 3026 | 3043 |
| HSCD44E_T10 (SEQ ID NO: 593) | 3356 | 3373 |
| HSCD44E_T12 (SEQ ID NO: 594) | 6424 | 6441 |
| HSCD44E_T13 (SEQ ID NO: 595) | 5233 | 5250 |
| HSCD44E_T16 (SEQ ID NO: 596) | 6424 | 6441 |
| HSCD44E_T26 (SEQ ID NO: 598) | 5233 | 5250 |
| HSCD44E_T32 (SEQ ID NO: 599) | 6381 | 6398 |
| HSCD44E_T34 (SEQ ID NO: 600) | 5099 | 5116 |
| HSCD44E_T35 (SEQ ID NO: 601) | 4870 | 4887 |
| HSCD44E_T36 (SEQ ID NO: 602) | 5159 | 5176 |
| HSCD44E_T38 (SEQ ID NO: 603) | 3000 | 3017 |
| HSCD44E_T39 (SEQ ID NO: 604) | 4909 | 4926 |
| HSCD44E_T40 (SEQ ID NO: 605) | 3744 | 3761 |
| HSCD44E_T45 (SEQ ID NO: 606) | 1537 | 1554 |
| HSCD44E_T46 (SEQ ID NO: 607) | 1989 | 2006 |
| HSCD44E_T47 (SEQ ID NO: 608) | 1447 | 1464 |
| HSCD44E_T63 (SEQ ID NO: 610) | 5233 | 5250 |
| HSCD44E_T68 (SEQ ID NO: 612) | 5233 | 5250 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__74 (SEQ ID NO:673) according to the present invention is supported by 193 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 624 below describes the starting and ending position of this segment on each transcript.

TABLE 624

Segment location on transcripts

| Transcript name | Segment starting position | Segment ending position |
| --- | --- | --- |
| HSCD44E_T1 (SEQ ID NO: 588) | 5437 | 5476 |
| HSCD44E_T3 (SEQ ID NO: 589) | 3587 | 3626 |
| HSCD44E_T6 (SEQ ID NO: 590) | 3461 | 3500 |
| HSCD44E_T7 (SEQ ID NO: 591) | 4035 | 4074 |
| HSCD44E_T8 (SEQ ID NO: 592) | 3230 | 3269 |
| HSCD44E_T10 (SEQ ID NO: 593) | 3560 | 3599 |
| HSCD44E_T12 (SEQ ID NO: 594) | 6628 | 6667 |
| HSCD44E_T13 (SEQ ID NO: 595) | 8083 | 8122 |
| HSCD44E_T16 (SEQ ID NO: 596) | 9274 | 9313 |
| HSCD44E_T22 (SEQ ID NO: 597) | 5233 | 5272 |
| HSCD44E_T26 (SEQ ID NO: 598) | 5437 | 5476 |
| HSCD44E_T32 (SEQ ID NO: 599) | 6585 | 6624 |
| HSCD44E_T34 (SEQ ID NO: 600) | 5303 | 5342 |
| HSCD44E_T35 (SEQ ID NO: 601) | 5074 | 5113 |
| HSCD44E_T36 (SEQ ID NO: 602) | 5363 | 5402 |
| HSCD44E_T38 (SEQ ID NO: 603) | 3204 | 3243 |
| HSCD44E_T39 (SEQ ID NO: 604) | 5113 | 5152 |
| HSCD44E_T40 (SEQ ID NO: 605) | 3948 | 3987 |
| HSCD44E_T45 (SEQ ID NO: 606) | 1741 | 1780 |
| HSCD44E_T46 (SEQ ID NO: 607) | 2193 | 2232 |
| HSCD44E_T47 (SEQ ID NO: 608) | 1651 | 1690 |
| HSCD44E_T63 (SEQ ID NO: 610) | 5437 | 5476 |
| HSCD44E_T65 (SEQ ID NO: 611) | 5233 | 5272 |
| HSCD44E_T68 (SEQ ID NO: 612) | 5437 | 5476 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__75 (SEQ ID NO:674) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 625 below describes the starting and ending position of this segment on each transcript.

TABLE 625

Segment location on transcripts

| Transcript name | Segment starting position | Segment ending position |
| --- | --- | --- |
| HSCD44E_T1 (SEQ ID NO: 588) | 5477 | 5499 |
| HSCD44E_T3 (SEQ ID NO: 589) | 3627 | 3649 |
| HSCD44E_T6 (SEQ ID NO: 590) | 3501 | 3523 |
| HSCD44E_T7 (SEQ ID NO: 591) | 4075 | 4097 |

TABLE 625-continued

Segment location on transcripts

| Transcript name | Segment starting position | Segment ending position |
|---|---|---|
| HSCD44E_T8 (SEQ ID NO: 592) | 3270 | 3292 |
| HSCD44E_T10 (SEQ ID NO: 593) | 3600 | 3622 |
| HSCD44E_T12 (SEQ ID NO: 594) | 6668 | 6690 |
| HSCD44E_T13 (SEQ ID NO: 595) | 8123 | 8145 |
| HSCD44E_T16 (SEQ ID NO: 596) | 9314 | 9336 |
| HSCD44E_T22 (SEQ ID NO: 597) | 5273 | 5295 |
| HSCD44E_T26 (SEQ ID NO: 598) | 5477 | 5499 |
| HSCD44E_T32 (SEQ ID NO: 599) | 6625 | 6647 |
| HSCD44E_T34 (SEQ ID NO: 600) | 5343 | 5365 |
| HSCD44E_T35 (SEQ ID NO: 601) | 5114 | 5136 |
| HSCD44E_T36 (SEQ ID NO: 602) | 5403 | 5425 |
| HSCD44E_T38 (SEQ ID NO: 603) | 3244 | 3266 |
| HSCD44E_T39 (SEQ ID NO: 604) | 5153 | 5175 |
| HSCD44E_T40 (SEQ ID NO: 605) | 3988 | 4010 |
| HSCD44E_T45 (SEQ ID NO: 606) | 1781 | 1803 |
| HSCD44E_T46 (SEQ ID NO: 607) | 2233 | 2255 |
| HSCD44E_T47 (SEQ ID NO: 608) | 1691 | 1713 |
| HSCD44E_T63 (SEQ ID NO: 610) | 5477 | 5499 |
| HSCD44E_T65 (SEQ ID NO: 611) | 5273 | 5295 |
| HSCD44E_T68 (SEQ ID NO: 612) | 5477 | 5499 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__77 (SEQ ID NO:675) according to the present invention is supported by 2 libraries. The number of libraries was determined as previously described. This segment can be found in the following transcript(s): HSCD44E_T26 (SEQ ID NO:598). Table 626 below describes the starting and ending position of this segment on each transcript.

TABLE 626

Segment location on transcripts

| Transcript name | Segment starting position | Segment ending position |
|---|---|---|
| HSCD44E_T26 (SEQ ID NO: 598) | 5500 | 5592 |

This segment can be found in the following protein(s): HSCD44E_P18.

Segment cluster HSCD44E_node__79 (SEQ ID NO:676) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 627 below describes the starting and ending position of this segment on each transcript.

TABLE 627

Segment location on transcripts

| Transcript name | Segment starting position | Segment ending position |
|---|---|---|
| HSCD44E_T1 (SEQ ID NO: 588) | 5500 | 5523 |
| HSCD44E_T3 (SEQ ID NO: 589) | 3650 | 3673 |
| HSCD44E_T6 (SEQ ID NO: 590) | 3524 | 3547 |
| HSCD44E_T7 (SEQ ID NO: 591) | 4098 | 4121 |
| HSCD44E_T8 (SEQ ID NO: 592) | 3293 | 3316 |
| HSCD44E_T10 (SEQ ID NO: 593) | 3623 | 3646 |
| HSCD44E_T12 (SEQ ID NO: 594) | 6691 | 6714 |
| HSCD44E_T13 (SEQ ID NO: 595) | 8146 | 8169 |
| HSCD44E_T16 (SEQ ID NO: 596) | 9337 | 9360 |
| HSCD44E_T22 (SEQ ID NO: 597) | 5296 | 5319 |
| HSCD44E_T26 (SEQ ID NO: 598) | 5593 | 5616 |
| HSCD44E_T32 (SEQ ID NO: 599) | 6648 | 6671 |
| HSCD44E_T34 (SEQ ID NO: 600) | 5366 | 5389 |
| HSCD44E_T35 (SEQ ID NO: 601) | 5137 | 5160 |
| HSCD44E_T36 (SEQ ID NO: 602) | 5426 | 5449 |
| HSCD44E_T38 (SEQ ID NO: 603) | 3267 | 3290 |
| HSCD44E_T39 (SEQ ID NO: 604) | 5176 | 5199 |
| HSCD44E_T40 (SEQ ID NO: 605) | 4011 | 4034 |
| HSCD44E_T45 (SEQ ID NO: 606) | 1804 | 1827 |
| HSCD44E_T46 (SEQ ID NO: 607) | 2256 | 2279 |
| HSCD44E_T47 (SEQ ID NO: 608) | 1714 | 1737 |
| HSCD44E_T63 (SEQ ID NO: 610) | 5500 | 5523 |
| HSCD44E_T65 (SEQ ID NO: 611) | 5296 | 5319 |
| HSCD44E_T68 (SEQ ID NO: 612) | 5500 | 5523 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__80 (SEQ ID NO:677) according to the present invention is supported by 206 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 628 below describes the starting and ending position of this segment on each transcript.

TABLE 628

Segment location on transcripts

| Transcript name | Segment starting position | Segment ending position |
|---|---|---|
| HSCD44E_T1 (SEQ ID NO: 588) | 5524 | 5571 |
| HSCD44E_T3 (SEQ ID NO: 589) | 3674 | 3721 |
| HSCD44E_T6 (SEQ ID NO: 590) | 3548 | 3595 |
| HSCD44E_T7 (SEQ ID NO: 591) | 4122 | 4169 |
| HSCD44E_T8 (SEQ ID NO: 592) | 3317 | 3364 |
| HSCD44E_T10 (SEQ ID NO: 593) | 3647 | 3694 |
| HSCD44E_T12 (SEQ ID NO: 594) | 6715 | 6762 |
| HSCD44E_T13 (SEQ ID NO: 595) | 8170 | 8217 |
| HSCD44E_T16 (SEQ ID NO: 596) | 9361 | 9408 |
| HSCD44E_T22 (SEQ ID NO: 597) | 5320 | 5367 |
| HSCD44E_T26 (SEQ ID NO: 598) | 5617 | 5664 |
| HSCD44E_T32 (SEQ ID NO: 599) | 6672 | 6719 |
| HSCD44E_T34 (SEQ ID NO: 600) | 5390 | 5437 |
| HSCD44E_T35 (SEQ ID NO: 601) | 5161 | 5208 |
| HSCD44E_T36 (SEQ ID NO: 602) | 5450 | 5497 |
| HSCD44E_T38 (SEQ ID NO: 603) | 3291 | 3338 |
| HSCD44E_T39 (SEQ ID NO: 604) | 5200 | 5247 |
| HSCD44E_T40 (SEQ ID NO: 605) | 4035 | 4082 |
| HSCD44E_T45 (SEQ ID NO: 606) | 1828 | 1875 |
| HSCD44E_T46 (SEQ ID NO: 607) | 2280 | 2327 |
| HSCD44E_T47 (SEQ ID NO: 608) | 1738 | 1785 |
| HSCD44E_T63 (SEQ ID NO: 610) | 5524 | 5571 |
| HSCD44E_T65 (SEQ ID NO: 611) | 5320 | 5367 |
| HSCD44E_T68 (SEQ ID NO: 612) | 5524 | 5571 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__82 (SEQ ID NO:678) according to the present invention is supported by 207 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 629 below describes the starting and ending position of this segment on each transcript.

TABLE 629

Segment location on transcripts

| Transcript name | Segment starting position | Segment ending position |
|---|---|---|
| HSCD44E_T1 (SEQ ID NO: 588) | 5572 | 5597 |
| HSCD44E_T3 (SEQ ID NO: 589) | 3722 | 3747 |
| HSCD44E_T6 (SEQ ID NO: 590) | 3596 | 3621 |
| HSCD44E_T7 (SEQ ID NO: 591) | 4170 | 4195 |
| HSCD44E_T8 (SEQ ID NO: 592) | 3365 | 3390 |
| HSCD44E_T10 (SEQ ID NO: 593) | 3695 | 3720 |
| HSCD44E_T12 (SEQ ID NO: 594) | 6763 | 6788 |
| HSCD44E_T13 (SEQ ID NO: 595) | 8218 | 8243 |
| HSCD44E_T16 (SEQ ID NO: 596) | 9409 | 9434 |
| HSCD44E_T22 (SEQ ID NO: 597) | 5368 | 5393 |
| HSCD44E_T26 (SEQ ID NO: 598) | 5665 | 5690 |
| HSCD44E_T32 (SEQ ID NO: 599) | 6720 | 6745 |
| HSCD44E_T34 (SEQ ID NO: 600) | 5438 | 5463 |
| HSCD44E_T35 (SEQ ID NO: 601) | 5209 | 5234 |
| HSCD44E_T36 (SEQ ID NO: 602) | 5498 | 5523 |
| HSCD44E_T38 (SEQ ID NO: 603) | 3339 | 3364 |
| HSCD44E_T39 (SEQ ID NO: 604) | 5248 | 5273 |
| HSCD44E_T40 (SEQ ID NO: 605) | 4083 | 4108 |
| HSCD44E_T45 (SEQ ID NO: 606) | 1876 | 1901 |
| HSCD44E_T46 (SEQ ID NO: 607) | 2328 | 2353 |
| HSCD44E_T47 (SEQ ID NO: 608) | 1786 | 1811 |
| HSCD44E_T63 (SEQ ID NO: 610) | 5572 | 5597 |
| HSCD44E_T65 (SEQ ID NO: 611) | 5368 | 5393 |
| HSCD44E_T68 (SEQ ID NO: 612) | 5572 | 5597 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node__83 (SEQ ID NO:679) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 630 below describes the starting and ending position of this segment on each transcript.

TABLE 630

Segment location on transcripts

| Transcript name | Segment starting position | Segment ending position |
|---|---|---|
| HSCD44E_T1 (SEQ ID NO: 588) | 5598 | 5622 |
| HSCD44E_T3 (SEQ ID NO: 589) | 3748 | 3772 |
| HSCD44E_T6 (SEQ ID NO: 590) | 3622 | 3646 |
| HSCD44E_T7 (SEQ ID NO: 591) | 4196 | 4220 |
| HSCD44E_T8 (SEQ ID NO: 592) | 3391 | 3415 |
| HSCD44E_T10 (SEQ ID NO: 593) | 3721 | 3745 |

TABLE 630-continued

Segment location on transcripts

| Transcript name | Segment starting position | Segment ending position |
|---|---|---|
| HSCD44E_T12 (SEQ ID NO: 594) | 6789 | 6813 |
| HSCD44E_T13 (SEQ ID NO: 595) | 8244 | 8268 |
| HSCD44E_T16 (SEQ ID NO: 596) | 9435 | 9459 |
| HSCD44E_T22 (SEQ ID NO: 597) | 5394 | 5418 |
| HSCD44E_T26 (SEQ ID NO: 598) | 5691 | 5715 |
| HSCD44E_T32 (SEQ ID NO: 599) | 6746 | 6770 |
| HSCD44E_T34 (SEQ ID NO: 600) | 5464 | 5488 |
| HSCD44E_T35 (SEQ ID NO: 601) | 5235 | 5259 |
| HSCD44E_T36 (SEQ ID NO: 602) | 5524 | 5548 |
| HSCD44E_T38 (SEQ ID NO: 603) | 3365 | 3389 |
| HSCD44E_T39 (SEQ ID NO: 604) | 5274 | 5298 |
| HSCD44E_T40 (SEQ ID NO: 605) | 4109 | 4133 |
| HSCD44E_T45 (SEQ ID NO: 606) | 1902 | 1926 |
| HSCD44E_T46 (SEQ ID NO: 607) | 2354 | 2378 |
| HSCD44E_T47 (SEQ ID NO: 608) | 1812 | 1836 |
| HSCD44E_T63 (SEQ ID NO: 610) | 5598 | 5622 |
| HSCD44E_T65 (SEQ ID NO: 611) | 5394 | 5418 |
| HSCD44E_T68 (SEQ ID NO: 612) | 5598 | 5622 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node_84 (SEQ ID NO:680) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 631 below describes the starting and ending position of this segment on each transcript.

TABLE 631

Segment location on transcripts

| Transcript name | Segment starting position | Segment ending position |
|---|---|---|
| HSCD44E_T1 (SEQ ID NO: 588) | 5623 | 5634 |
| HSCD44E_T3 (SEQ ID NO: 589) | 3773 | 3784 |
| HSCD44E_T6 (SEQ ID NO: 590) | 3647 | 3658 |
| HSCD44E_T7 (SEQ ID NO: 591) | 4221 | 4232 |
| HSCD44E_T8 (SEQ ID NO: 592) | 3416 | 3427 |
| HSCD44E_T10 (SEQ ID NO: 593) | 3746 | 3757 |
| HSCD44E_T12 (SEQ ID NO: 594) | 6814 | 6825 |
| HSCD44E_T13 (SEQ ID NO: 595) | 8269 | 8280 |
| HSCD44E_T16 (SEQ ID NO: 596) | 9460 | 9471 |
| HSCD44E_T22 (SEQ ID NO: 597) | 5419 | 5430 |

TABLE 631-continued

Segment location on transcripts

| Transcript name | Segment starting position | Segment ending position |
|---|---|---|
| HSCD44E_T26 (SEQ ID NO: 598) | 5716 | 5727 |
| HSCD44E_T32 (SEQ ID NO: 599) | 6771 | 6782 |
| HSCD44E_T34 (SEQ ID NO: 600) | 5489 | 5500 |
| HSCD44E_T35 (SEQ ID NO: 601) | 5260 | 5271 |
| HSCD44E_T36 (SEQ ID NO: 602) | 5549 | 5560 |
| HSCD44E_T38 (SEQ ID NO: 603) | 3390 | 3401 |
| HSCD44E_T39 (SEQ ID NO: 604) | 5299 | 5310 |
| HSCD44E_T40 (SEQ ID NO: 605) | 4134 | 4145 |
| HSCD44E_T45 (SEQ ID NO: 606) | 1927 | 1938 |
| HSCD44E_T46 (SEQ ID NO: 607) | 2379 | 2390 |
| HSCD44E_T47 (SEQ ID NO: 608) | 1837 | 1848 |
| HSCD44E_T63 (SEQ ID NO: 610) | 5623 | 5634 |
| HSCD44E_T65 (SEQ ID NO: 611) | 5419 | 5430 |
| HSCD44E_T68 (SEQ ID NO: 612) | 5623 | 5634 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node_85 (SEQ ID NO:681) according to the present invention can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T63 (SEQ ID NO:610), HSCD44E_T65 (SEQ ID NO:611) and HSCD44E_T68 (SEQ ID NO:612). Table 632 below describes the starting and ending position of this segment on each transcript.

TABLE 632

Segment location on transcripts

| Transcript name | Segment starting position | Segment ending position |
|---|---|---|
| HSCD44E_T1 (SEQ ID NO: 588) | 5635 | 5650 |
| HSCD44E_T3 (SEQ ID NO: 589) | 3785 | 3800 |
| HSCD44E_T6 (SEQ ID NO: 590) | 3659 | 3674 |
| HSCD44E_T7 (SEQ ID NO: 591) | 4233 | 4248 |
| HSCD44E_T8 (SEQ ID NO: 592) | 3428 | 3443 |
| HSCD44E_T10 (SEQ ID NO: 593) | 3758 | 3773 |
| HSCD44E_T12 (SEQ ID NO: 594) | 6826 | 6841 |
| HSCD44E_T13 (SEQ ID NO: 595) | 8281 | 8296 |
| HSCD44E_T16 (SEQ ID NO: 596) | 9472 | 9487 |
| HSCD44E_T22 (SEQ ID NO: 597) | 5431 | 5446 |
| HSCD44E_T26 (SEQ ID NO: 598) | 5728 | 5743 |
| HSCD44E_T32 (SEQ ID NO: 599) | 6783 | 6798 |
| HSCD44E_T34 (SEQ ID NO: 600) | 5501 | 5516 |
| HSCD44E_T35 (SEQ ID NO: 601) | 5272 | 5287 |

TABLE 632-continued

Segment location on transcripts

| Transcript name | Segment starting position | Segment ending position |
|---|---|---|
| HSCD44E_T36 (SEQ ID NO: 602) | 5561 | 5576 |
| HSCD44E_T38 (SEQ ID NO: 603) | 3402 | 3417 |
| HSCD44E_T39 (SEQ ID NO: 604) | 5311 | 5326 |
| HSCD44E_T40 (SEQ ID NO: 605) | 4146 | 4161 |
| HSCD44E_T45 (SEQ ID NO: 606) | 1939 | 1954 |
| HSCD44E_T46 (SEQ ID NO: 607) | 2391 | 2406 |
| HSCD44E_T47 (SEQ ID NO: 608) | 1849 | 1864 |
| HSCD44E_T63 (SEQ ID NO: 610) | 5635 | 5650 |
| HSCD44E_T65 (SEQ ID NO: 611) | 5431 | 5446 |
| HSCD44E_T68 (SEQ ID NO: 612) | 5635 | 5650 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Segment cluster HSCD44E_node_86 (SEQ ID NO:682) according to the present invention can be found in the following transcript(s): HSCD44E_T68 (SEQ ID NO:612). Table 633 below describes the starting and ending position of this segment on each transcript.

TABLE 633

Segment location on transcripts

| Transcript name | Segment starting position | Segment ending position |
|---|---|---|
| HSCD44E_T68 (SEQ ID NO: 612) | 5651 | 5672 |

This segment can be found in a non-coding region of transcript(s) that are related to the following protein(s): HSCD44E_P10.

Segment cluster HSCD44E_node_91 (SEQ ID NO:683) according to the present invention is supported by 223 libraries. The number of libraries was determined as previously described. This segment can be found in the following transcript(s): HSCD44E_T1 (SEQ ID NO:588), HSCD44E_T3 (SEQ ID NO:589), HSCD44E_T6 (SEQ ID NO:590), HSCD44E_T7 (SEQ ID NO:591), HSCD44E_T8 (SEQ ID NO:592), HSCD44E_T10 (SEQ ID NO:593), HSCD44E_T12 (SEQ ID NO:594), HSCD44E_T13 (SEQ ID NO:595), HSCD44E_T16 (SEQ ID NO:596), HSCD44E_T22 (SEQ ID NO:597), HSCD44E_T26 (SEQ ID NO:598), HSCD44E_T32 (SEQ ID NO:599), HSCD44E_T34 (SEQ ID NO:600), HSCD44E_T35 (SEQ ID NO:601), HSCD44E_T36 (SEQ ID NO:602), HSCD44E_T38 (SEQ ID NO:603), HSCD44E_T39 (SEQ ID NO:604), HSCD44E_T40 (SEQ ID NO:605), HSCD44E_T45 (SEQ ID NO:606), HSCD44E_T46 (SEQ ID NO:607), HSCD44E_T47 (SEQ ID NO:608), HSCD44E_T57 (SEQ ID NO:609), HSCD44E_T63 (SEQ ID NO:610) and HSCD44E_T65 (SEQ ID NO:611). Table 634 below describes the starting and ending position of this segment on each transcript.

TABLE 634

Segment location on transcripts

| Transcript name | Segment starting position | Segment ending position |
|---|---|---|
| HSCD44E_T1 (SEQ ID NO: 588) | 5651 | 5725 |
| HSCD44E_T3 (SEQ ID NO: 589) | 3801 | 3875 |
| HSCD44E_T6 (SEQ ID NO: 590) | 3675 | 3749 |
| HSCD44E_T7 (SEQ ID NO: 591) | 4249 | 4323 |
| HSCD44E_T8 (SEQ ID NO: 592) | 3444 | 3518 |
| HSCD44E_T10 (SEQ ID NO: 593) | 3774 | 3848 |
| HSCD44E_T12 (SEQ ID NO: 594) | 6842 | 6916 |
| HSCD44E_T13 (SEQ ID NO: 595) | 8297 | 8371 |
| HSCD44E_T16 (SEQ ID NO: 596) | 9488 | 9562 |
| HSCD44E_T22 (SEQ ID NO: 597) | 5447 | 5521 |
| HSCD44E_T26 (SEQ ID NO: 598) | 5744 | 5818 |
| HSCD44E_T32 (SEQ ID NO: 599) | 6799 | 6873 |
| HSCD44E_T34 (SEQ ID NO: 600) | 5517 | 5591 |
| HSCD44E_T35 (SEQ ID NO: 601) | 5288 | 5362 |
| HSCD44E_T36 (SEQ ID NO: 602) | 5577 | 5651 |
| HSCD44E_T38 (SEQ ID NO: 603) | 3418 | 3492 |
| HSCD44E_T39 (SEQ ID NO: 604) | 5327 | 5401 |
| HSCD44E_T40 (SEQ ID NO: 605) | 4162 | 4236 |
| HSCD44E_T45 (SEQ ID NO: 606) | 1955 | 2029 |
| HSCD44E_T46 (SEQ ID NO: 607) | 2407 | 2481 |
| HSCD44E_T47 (SEQ ID NO: 608) | 1865 | 1939 |
| HSCD44E_T57 (SEQ ID NO: 609) | 1716 | 1790 |
| HSCD44E_T63 (SEQ ID NO: 610) | 5651 | 5725 |
| HSCD44E_T65 (SEQ ID NO: 611) | 5447 | 5521 |

This segment can be found in both coding and non-coding regions of transcript(s) as follows. The segment can be found in a non-coding region of transcript(s) that are related to the following protein(s): HSCD44E_P4, HSCD44E_P6, HSCD44E_P8 and HSCD44E_P10. This segment can also be found in the following protein(s): HSCD44E_P2, HSCD44E_P18, HSCD44E_P28 and HSCD44E_P29, since it is in the coding region for the corresponding transcript.

Description for Cluster HSEF2

Cluster HSEF2 features 9 transcript(s) and 137 segment(s) of interest, the names for which are given in Tables 635 and 636, respectively, the sequences themselves are given at the end of the application. The selected protein variants are given in Table 637.

TABLE 635

Transcripts of interest
Transcript Name

HSEF2_T13 (SEQ ID NO: 684)
HSEF2_T19 (SEQ ID NO: 685)
HSEF2_T30 (SEQ ID NO: 686)
HSEF2_T38 (SEQ ID NO: 687)
HSEF2_T42 (SEQ ID NO: 688)
HSEF2_T47 (SEQ ID NO: 689)
HSEF2_T71 (SEQ ID NO: 690)
HSEF2_T82 (SEQ ID NO: 691)
HSEF2_T85 (SEQ ID NO: 692)

TABLE 636

Segments of interest
Segment Name

HSEF2_node_32 (SEQ ID NO: 693)
HSEF2_node_41 (SEQ ID NO: 694)
HSEF2_node_55 (SEQ ID NO: 695)
HSEF2_node_65 (SEQ ID NO: 696)
HSEF2_node_74 (SEQ ID NO: 697)
HSEF2_node_111 (SEQ ID NO: 698)

TABLE 636-continued

Segments of interest
Segment Name

HSEF2_node_153 (SEQ ID NO: 699)
HSEF2_node_0 (SEQ ID NO: 700)
HSEF2_node_2 (SEQ ID NO: 701)
HSEF2_node_3 (SEQ ID NO: 702)
HSEF2_node_4 (SEQ ID NO: 703)
HSEF2_node_5 (SEQ ID NO: 704)
HSEF2_node_8 (SEQ ID NO: 705)
HSEF2_node_9 (SEQ ID NO: 706)
HSEF2_node_10 (SEQ ID NO: 707)
HSEF2_node_11 (SEQ ID NO: 708)
HSEF2_node_12 (SEQ ID NO: 709)
HSEF2_node_13 (SEQ ID NO: 710)
HSEF2_node_15 (SEQ ID NO: 711)
HSEF2_node_16 (SEQ ID NO: 712)
HSEF2_node_17 (SEQ ID NO: 713)
HSEF2_node_18 (SEQ ID NO: 714)
HSEF2_node_21 (SEQ ID NO: 715)
HSEF2_node_22 (SEQ ID NO: 716)
HSEF2_node_23 (SEQ ID NO: 717)
HSEF2_node_24 (SEQ ID NO: 718)
HSEF2_node_25 (SEQ ID NO: 719)
HSEF2_node_26 (SEQ ID NO: 720)
HSEF2_node_30 (SEQ ID NO: 721)
HSEF2_node_31 (SEQ ID NO: 722)
HSEF2_node_33 (SEQ ID NO: 723)
HSEF2_node_34 (SEQ ID NO: 724)
HSEF2_node_35 (SEQ ID NO: 725)
HSEF2_node_36 (SEQ ID NO: 726)
HSEF2_node_37 (SEQ ID NO: 727)
HSEF2_node_38 (SEQ ID NO: 728)
HSEF2_node_39 (SEQ ID NO: 729)
HSEF2_node_40 (SEQ ID NO: 730)
HSEF2_node_42 (SEQ ID NO: 731)
HSEF2_node_43 (SEQ ID NO: 732)
HSEF2_node_44 (SEQ ID NO: 733)
HSEF2_node_45 (SEQ ID NO: 734)
HSEF2_node_46 (SEQ ID NO: 735)
HSEF2_node_47 (SEQ ID NO: 736)
HSEF2_node_48 (SEQ ID NO: 737)
HSEF2_node_49 (SEQ ID NO: 738)
HSEF2_node_51 (SEQ ID NO: 739)
HSEF2_node_52 (SEQ ID NO: 740)
HSEF2_node_53 (SEQ ID NO: 741)
HSEF2_node_54 (SEQ ID NO: 742)
HSEF2_node_56 (SEQ ID NO: 743)
HSEF2_node_57 (SEQ ID NO: 744)
HSEF2_node_58 (SEQ ID NO: 745)
HSEF2_node_59 (SEQ ID NO: 746)
HSEF2_node_60 (SEQ ID NO: 747)
HSEF2_node_61 (SEQ ID NO: 748)
HSEF2_node_62 (SEQ ID NO: 749)
HSEF2_node_63 (SEQ ID NO: 750)
HSEF2_node_64 (SEQ ID NO: 751)
HSEF2_node_67 (SEQ ID NO: 752)
HSEF2_node_68 (SEQ ID NO: 753)
HSEF2_node_69 (SEQ ID NO: 754)
HSEF2_node_70 (SEQ ID NO: 755)
HSEF2_node_71 (SEQ ID NO: 756)
HSEF2_node_72 (SEQ ID NO: 757)
HSEF2_node_73 (SEQ ID NO: 758)
HSEF2_node_77 (SEQ ID NO: 759)
HSEF2_node_78 (SEQ ID NO: 760)
HSEF2_node_79 (SEQ ID NO: 761)
HSEF2_node_80 (SEQ ID NO: 762)
HSEF2_node_81 (SEQ ID NO: 763)
HSEF2_node_82 (SEQ ID NO: 764)
HSEF2_node_83 (SEQ ID NO: 765)
HSEF2_node_84 (SEQ ID NO: 766)
HSEF2_node_85 (SEQ ID NO: 767)
HSEF2_node_86 (SEQ ID NO: 768)
HSEF2_node_87 (SEQ ID NO: 769)
HSEF2_node_88 (SEQ ID NO: 770)
HSEF2_node_89 (SEQ ID NO: 771)
HSEF2_node_90 (SEQ ID NO: 772)
HSEF2_node_91 (SEQ ID NO: 773)
HSEF2_node_92 (SEQ ID NO: 774)
HSEF2_node_96 (SEQ ID NO: 775)
HSEF2_node_97 (SEQ ID NO: 776)
HSEF2_node_98 (SEQ ID NO: 777)
HSEF2_node_99 (SEQ ID NO: 778)
HSEF2_node_100 (SEQ ID NO: 779)
HSEF2_node_101 (SEQ ID NO: 780)
HSEF2_node_102 (SEQ ID NO: 781)
HSEF2_node_103 (SEQ ID NO: 782)
HSEF2_node_104 (SEQ ID NO: 783)
HSEF2_node_105 (SEQ ID NO: 784)
HSEF2_node_106 (SEQ ID NO: 785)
HSEF2_node_107 (SEQ ID NO: 786)
HSEF2_node_108 (SEQ ID NO: 787)
HSEF2_node_109 (SEQ ID NO: 788)
HSEF2_node_110 (SEQ ID NO: 789)
HSEF2_node_113 (SEQ ID NO: 790)
HSEF2_node_114 (SEQ ID NO: 791)
HSEF2_node_115 (SEQ ID NO: 792)
HSEF2_node_116 (SEQ ID NO: 793)
HSEF2_node_117 (SEQ ID NO: 794)
HSEF2_node_118 (SEQ ID NO: 795)
HSEF2_node_119 (SEQ ID NO: 796)
HSEF2_node_120 (SEQ ID NO: 797)
HSEF2_node_121 (SEQ ID NO: 798)
HSEF2_node_122 (SEQ ID NO: 799)
HSEF2_node_123 (SEQ ID NO: 800)
HSEF2_node_124 (SEQ ID NO: 801)
HSEF2_node_125 (SEQ ID NO: 802)
HSEF2_node_126 (SEQ ID NO: 803)
HSEF2_node_127 (SEQ ID NO: 804)
HSEF2_node_128 (SEQ ID NO: 805)
HSEF2_node_129 (SEQ ID NO: 806)
HSEF2_node_130 (SEQ ID NO: 807)
HSEF2_node_131 (SEQ ID NO: 808)
HSEF2_node_132 (SEQ ID NO: 809)
HSEF2_node_133 (SEQ ID NO: 810)
HSEF2_node_134 (SEQ ID NO: 811)
HSEF2_node_135 (SEQ ID NO: 812)
HSEF2_node_136 (SEQ ID NO: 813)
HSEF2_node_137 (SEQ ID NO: 814)
HSEF2_node_138 (SEQ ID NO: 815)
HSEF2_node_139 (SEQ ID NO: 816)
HSEF2_node_140 (SEQ ID NO: 817)
HSEF2_node_141 (SEQ ID NO: 818)
HSEF2_node_142 (SEQ ID NO: 819)
HSEF2_node_143 (SEQ ID NO: 820)
HSEF2_node_144 (SEQ ID NO: 821)
HSEF2_node_145 (SEQ ID NO: 822)
HSEF2_node_146 (SEQ ID NO: 823)
HSEF2_node_147 (SEQ ID NO: 824)
HSEF2_node_148 (SEQ ID NO: 825)
HSEF2_node_149 (SEQ ID NO: 826)
HSEF2_node_150 (SEQ ID NO: 827)
HSEF2_node_151 (SEQ ID NO: 828)
HSEF2_node_152 (SEQ ID NO: 829)

TABLE 637

Proteins of interest

| Protein Name | Corresponding Transcript(s) |
|---|---|
| HSEF2_P2 | HSEF2_T13 (SEQ ID NO: 684); HSEF2_T82 (SEQ ID NO: 691); HSEF2_T85 (SEQ ID NO: 692) |
| HSEF2_P6 | HSEF2_T47 (SEQ ID NO: 689) |
| HSEF2_P7 | HSEF2_T19 (SEQ ID NO: 685) |
| HSEF2_P15 | HSEF2_T30 (SEQ ID NO: 686) |
| HSEF2_P22 | HSEF2_T38 (SEQ ID NO: 687) |
| HSEF2_P26 | HSEF2_T42 (SEQ ID NO: 688) |
| HSEF2_P54 | HSEF2_T71 (SEQ ID NO: 690) |

These sequences are variants of the known protein Elongation factor 2 (SwissProt accession identifier EF2_HUMAN; known also according to the synonyms EF-2), referred to herein as the previously known protein.

Protein Elongation factor 2 is known or believed to have the following function(s): This protein promotes the GTP-dependent translocation of the nascent protein chain from the A-site to the P-site of the ribosome. The sequence for protein Elongation factor 2 is given at the end of the application, as "Elongation factor 2 amino acid sequence". Protein Elongation factor 2 localization is believed to be Cytoplasmic.

Cluster HSEF2 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 19 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 19 and Table 638. This cluster is overexpressed (at least at a minimum level) in the following pathological conditions: prostate cancer.

TABLE 638

Normal tissue distribution

| Name of Tissue | Number |
|---|---|
| Adrenal | 448 |
| Bladder | 574 |
| Bone | 97 |
| Brain | 177 |
| Colon | 223 |
| Epithelial | 358 |
| General | 281 |
| Head and neck | 730 |
| Kidney | 71 |
| Liver | 97 |
| Lung | 255 |
| lymph nodes | 207 |
| Breast | 109 |
| bone marrow | 94 |
| Muscle | 549 |
| Ovary | 692 |
| Pancreas | 259 |
| Prostate | 158 |
| Skin | 362 |
| Stomach | 410 |
| Thyroid | 270 |
| Uterus | 318 |

TABLE 639

P values and ratios for expression in cancerous tissue

| Name of Tissue | P1 | P2 | SP1 | R3 | SP2 | R4 |
|---|---|---|---|---|---|---|
| Adrenal | 6.5e−01 | 6.5e−01 | 3.4e−01 | 0.7 | 4.8e−01 | 0.7 |
| Bladder | 5.4e−01 | 5.9e−01 | 9.8e−01 | 0.4 | 9.8e−01 | 0.4 |
| Bone | 3.7e−01 | 4.3e−01 | 4.2e−03 | 2.1 | 1.6e−02 | 2.3 |
| Brain | 8.6e−02 | 1.4e−02 | 1.1e−18 | 3.0 | 1.2e−18 | 3.0 |
| Colon | 3.6e−01 | 3.9e−01 | 5.0e−01 | 1.0 | 3.0e−01 | 1.0 |
| epithelial | 4.0e−01 | 4.3e−01 | 9.5e−01 | 0.8 | 8.0e−01 | 0.9 |
| General | 8.2e−02 | 8.2e−02 | 9.1e−08 | 1.3 | 9.5e−08 | 1.3 |
| head and neck | 6.2e−01 | 5.8e−01 | 9.9e−01 | 0.3 | 9.9e−01 | 0.4 |
| Kidney | 8.7e−02 | 3.6e−02 | 1.3e−03 | 2.4 | 1.4e−03 | 2.8 |
| Liver | 7.5e−01 | 8.5e−01 | 1 | 0.3 | 2.4e−01 | 1.3 |
| Lung | 7.7e−01 | 8.0e−01 | 8.1e−01 | 0.5 | 4.3e−01 | 0.7 |
| lymph nodes | 5.5e−01 | 5.8e−01 | 9.8e−01 | 0.3 | 8.7e−02 | 1.0 |
| Breast | 1.1e−01 | 3.8e−02 | 6.5e−03 | 2.2 | 1.7e−04 | 2.5 |

TABLE 639-continued

P values and ratios for expression in cancerous tissue

| Name of Tissue | P1 | P2 | SP1 | R3 | SP2 | R4 |
|---|---|---|---|---|---|---|
| bone marrow | 5.7e−01 | 6.2e−01 | 4.7e−02 | 4.5 | 8.2e−03 | 2.9 |
| Muscle | 5.7e−01 | 5.7e−01 | 5.8e−01 | 0.4 | 7.9e−01 | 0.4 |
| Ovary | 8.0e−01 | 8.2e−01 | 1 | 0.2 | 1 | 0.2 |
| pancreas | 1.5e−01 | 2.0e−01 | 9.7e−01 | 0.4 | 9.2e−01 | 0.6 |
| prostate | 4.7e−01 | 3.9e−01 | 1.4e−05 | 2.8 | 3.6e−06 | 3.1 |
| Skin | 5.2e−01 | 6.1e−01 | 9.3e−01 | 0.5 | 9.7e−01 | 0.3 |
| stomach | 4.2e−01 | 7.2e−01 | 9.6e−01 | 0.3 | 9.5e−01 | 0.5 |
| Thyroid | 5.3e−01 | 5.3e−01 | 7.9e−01 | 0.9 | 7.9e−01 | 0.9 |
| Uterus | 7.0e−01 | 4.7e−01 | 1 | 0.2 | 9.1e−01 | 0.4 |

As noted above, cluster HSEF2 features 137 segment(s), which were listed in Table 636 above and for which the sequence(s) are given at the end of the application. These segment(s) are portions of nucleic acid sequence(s) which are described herein separately because they are of particular interest. A description of each segment according to the present invention is now provided.

Segment cluster HSEF2_node__32 (SEQ ID NO:693) according to the present invention is supported by 3 libraries. The number of libraries was determined as previously described. This segment can be found in the following transcript(s): HSEF2_T19 (SEQ ID NO:685) and HSEF2_T30 (SEQ ID NO:686). Table 640 below describes the starting and ending position of this segment on each transcript.

TABLE 640

Segment location on transcripts

| Transcript name | Segment starting position | Segment ending position |
|---|---|---|
| HSEF2__T19 (SEQ ID NO: 685) | 987 | 1480 |
| HSEF2__T30 (SEQ ID NO: 686) | 987 | 1480 |

This segment can be found in a non-coding region of transcript(s) that are related to the following protein(s): HSEF2_P7 and HSEF2_P15.

Segment cluster HSEF2_node__41 (SEQ ID NO:694) according to the present invention is supported by 3 libraries. The number of libraries was determined as previously described. This segment can be found in the following transcript(s): HSEF2_T30 (SEQ ID NO:686) and HSEF2_T38 (SEQ ID NO:687). Table 641 below describes the starting and ending position of this segment on each transcript.

TABLE 641

Segment location on transcripts

| Transcript name | Segment starting position | Segment ending position |
|---|---|---|
| HSEF2__T30 (SEQ ID NO: 686) | 1595 | 1953 |
| HSEF2__T38 (SEQ ID NO: 687) | 1101 | 1459 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P15, since it is in the coding region for the corresponding transcript.

Segment cluster HSEF2_node__55 (SEQ ID NO:695) according to the present invention is supported by 7 libraries.

The number of libraries was determined as previously described. This segment can be found in the following transcript(s): HSEF2_T13 (SEQ ID NO:684), HSEF2_T38 (SEQ ID NO:687), HSEF2_T82 (SEQ ID NO:691) and HSEF2_T85 (SEQ ID NO:692). Table 642 below describes the starting and ending position of this segment on each transcript.

TABLE 642

Segment location on transcripts

| Transcript name | Segment starting position | Segment ending position |
|---|---|---|
| HSEF2_T13 (SEQ ID NO: 684) | 1436 | 1882 |
| HSEF2_T38 (SEQ ID NO: 687) | 1795 | 2241 |
| HSEF2_T82 (SEQ ID NO: 691) | 1436 | 1882 |
| HSEF2_T85 (SEQ ID NO: 692) | 1436 | 1882 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, since it is in the coding region for the corresponding transcript.

Segment cluster HSEF2_node_65 (SEQ ID NO:696) according to the present invention is supported by 2 libraries. The number of libraries was determined as previously described. This segment can be found in the following transcript(s): HSEF2_T85 (SEQ ID NO:692). Table 643 below describes the starting and ending position of this segment on each transcript.

TABLE 643

Segment location on transcripts

| Transcript name | Segment starting position | Segment ending position |
|---|---|---|
| HSEF2_T85 (SEQ ID NO: 692) | 2142 | 2354 |

This segment can be found in a non-coding region of transcript(s) that are related to the following protein(s): HSEF2_P2.

Segment cluster HSEF2_node_74 (SEQ ID NO:697) according to the present invention is supported by 4 libraries. The number of libraries was determined as previously described. This segment can be found in the following transcript(s): HSEF2_T71 (SEQ ID NO:690) and HSEF2_T82 (SEQ ID NO:691). Table 644 below describes the starting and ending position of this segment on each transcript.

TABLE 644

Segment location on transcripts

| Transcript name | Segment starting position | Segment ending position |
|---|---|---|
| HSEF2_T71 (SEQ ID NO: 690) | 1803 | 2067 |
| HSEF2_T82 (SEQ ID NO: 691) | 2250 | 2514 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P54, since it is in the coding region for the corresponding transcript.

Segment cluster HSEF2_node_111 (SEQ ID NO:698) according to the present invention is supported by 2 libraries. The number of libraries was determined as previously described. This segment can be found in the following transcript(s): HSEF2_T42 (SEQ ID NO:688) and HSEF2_T47 (SEQ ID NO:689). Table 645 below describes the starting and ending position of this segment on each transcript.

TABLE 645

Segment location on transcripts

| Transcript name | Segment starting position | Segment ending position |
|---|---|---|
| HSEF2_T42 (SEQ ID NO: 688) | 2473 | 2690 |
| HSEF2_T47 (SEQ ID NO: 689) | 2553 | 2770 |

This segment can be found in both coding and non-coding regions of transcript(s) as follows. The segment can be found in a non-coding region of transcript(s) that are related to the following protein(s): HSEF2_P6. This segment can also be found in the following protein(s): HSEF2_P26, since it is in the coding region for the corresponding transcript.

Segment cluster HSEF2_node_153 (SEQ ID NO:699) according to the present invention is supported by 192 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 646 below describes the starting and ending position of this segment on each transcript.

TABLE 646

Segment location on transcripts

| Transcript name | Segment starting position | Segment ending position |
|---|---|---|
| HSEF2_T13 (SEQ ID NO: 684) | 3540 | 3616 |
| HSEF2_T19 (SEQ ID NO: 685) | 3587 | 3663 |
| HSEF2_T30 (SEQ ID NO: 686) | 3946 | 4022 |
| HSEF2_T38 (SEQ ID NO: 687) | 3899 | 3975 |

This segment can be found in a non-coding region of transcript(s) that are related to the following protein(s): HSEF2_P2, HSEF2_P7, HSEF2_P15 and HSEF2_P22.

According to an optional embodiment of the present invention, short segments related to the above cluster are also provided. These segments are up to about 120 bp in length, and so are included in a separate description.

Segment cluster HSEF2_node_0 (SEQ ID NO:700) according to the present invention is supported by 127 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 647 below describes the starting and ending position of this segment on each transcript.

TABLE 647

Segment location on transcripts

| Transcript name | Segment starting position | Segment ending position |
|---|---|---|
| HSEF2_T13 (SEQ ID NO: 684) | 1 | 92 |
| HSEF2_T19 (SEQ ID NO: 685) | 1 | 92 |
| HSEF2_T30 (SEQ ID NO: 686) | 1 | 92 |
| HSEF2_T38 (SEQ ID NO: 687) | 1 | 92 |
| HSEF2_T42 (SEQ ID NO: 688) | 1 | 92 |
| HSEF2_T47 (SEQ ID NO: 689) | 1 | 92 |
| HSEF2_T71 (SEQ ID NO: 690) | 1 | 92 |
| HSEF2_T82 (SEQ ID NO: 691) | 1 | 92 |
| HSEF2_T85 (SEQ ID NO: 692) | 1 | 92 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_2 (SEQ ID NO:701) according to the present invention is supported by 143 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 648 below describes the starting and ending position of this segment on each transcript.

TABLE 648

Segment location on transcripts

| Transcript name | Segment starting position | Segment ending position |
|---|---|---|
| HSEF2_T13 (SEQ ID NO: 684) | 93 | 130 |
| HSEF2_T19 (SEQ ID NO: 685) | 93 | 130 |
| HSEF2_T30 (SEQ ID NO: 686) | 93 | 130 |
| HSEF2_T38 (SEQ ID NO: 687) | 93 | 130 |
| HSEF2_T42 (SEQ ID NO: 688) | 93 | 130 |
| HSEF2_T47 (SEQ ID NO: 689) | 93 | 130 |
| HSEF2_T71 (SEQ ID NO: 690) | 93 | 130 |
| HSEF2_T82 (SEQ ID NO: 691) | 93 | 130 |
| HSEF2_T85 (SEQ ID NO: 692) | 93 | 130 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_3 (SEQ ID NO:702) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 649 below describes the starting and ending position of this segment on each transcript.

TABLE 649

Segment location on transcripts

| Transcript name | Segment starting position | Segment ending position |
|---|---|---|
| HSEF2_T13 (SEQ ID NO: 684) | 131 | 152 |
| HSEF2_T19 (SEQ ID NO: 685) | 131 | 152 |
| HSEF2_T30 (SEQ ID NO: 686) | 131 | 152 |
| HSEF2_T38 (SEQ ID NO: 687) | 131 | 152 |
| HSEF2_T42 (SEQ ID NO: 688) | 131 | 152 |
| HSEF2_T47 (SEQ ID NO: 689) | 131 | 152 |
| HSEF2_T71 (SEQ ID NO: 690) | 131 | 152 |
| HSEF2_T82 (SEQ ID NO: 691) | 131 | 152 |
| HSEF2_T85 (SEQ ID NO: 692) | 131 | 152 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_4 (SEQ ID NO:703) according to the present invention is supported by 166 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 650 below describes the starting and ending position of this segment on each transcript.

TABLE 650

Segment location on transcripts

| Transcript name | Segment starting position | Segment ending position |
|---|---|---|
| HSEF2_T13 (SEQ ID NO: 684) | 153 | 206 |
| HSEF2_T19 (SEQ ID NO: 685) | 153 | 206 |
| HSEF2_T30 (SEQ ID NO: 686) | 153 | 206 |
| HSEF2_T38 (SEQ ID NO: 687) | 153 | 206 |
| HSEF2_T42 (SEQ ID NO: 688) | 153 | 206 |
| HSEF2_T47 (SEQ ID NO: 689) | 153 | 206 |
| HSEF2_T71 (SEQ ID NO: 690) | 153 | 206 |
| HSEF2_T82 (SEQ ID NO: 691) | 153 | 206 |
| HSEF2_T85 (SEQ ID NO: 692) | 153 | 206 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_5 (SEQ ID NO:704) according to the present invention is supported by 187 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38

(SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 651 below describes the starting and ending position of this segment on each transcript.

TABLE 651

Segment location on transcripts

| Transcript name | Segment starting position | Segment ending position |
| --- | --- | --- |
| HSEF2_T13 (SEQ ID NO: 684) | 207 | 307 |
| HSEF2_T19 (SEQ ID NO: 685) | 207 | 307 |
| HSEF2_T30 (SEQ ID NO: 686) | 207 | 307 |
| HSEF2_T38 (SEQ ID NO: 687) | 207 | 307 |
| HSEF2_T42 (SEQ ID NO: 688) | 207 | 307 |
| HSEF2_T47 (SEQ ID NO: 689) | 207 | 307 |
| HSEF2_T71 (SEQ ID NO: 690) | 207 | 307 |
| HSEF2_T82 (SEQ ID NO: 691) | 207 | 307 |
| HSEF2_T85 (SEQ ID NO: 692) | 207 | 307 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_8 (SEQ ID NO:705) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 652 below describes the starting and ending position of this segment on each transcript.

TABLE 652

Segment location on transcripts

| Transcript name | Segment starting position | Segment ending position |
| --- | --- | --- |
| HSEF2_T13 (SEQ ID NO: 684) | 308 | 329 |
| HSEF2_T19 (SEQ ID NO: 685) | 308 | 329 |
| HSEF2_T30 (SEQ ID NO: 686) | 308 | 329 |
| HSEF2_T38 (SEQ ID NO: 687) | 308 | 329 |
| HSEF2_T42 (SEQ ID NO: 688) | 308 | 329 |
| HSEF2_T47 (SEQ ID NO: 689) | 308 | 329 |
| HSEF2_T71 (SEQ ID NO: 690) | 308 | 329 |
| HSEF2_T82 (SEQ ID NO: 691) | 308 | 329 |
| HSEF2_T85 (SEQ ID NO: 692) | 308 | 329 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_9 (SEQ ID NO:706) according to the present invention is supported by 197 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 653 below describes the starting and ending position of this segment on each transcript.

TABLE 653

Segment location on transcripts

| Transcript name | Segment starting position | Segment ending position |
| --- | --- | --- |
| HSEF2_T13 (SEQ ID NO: 684) | 330 | 400 |
| HSEF2_T19 (SEQ ID NO: 685) | 330 | 400 |
| HSEF2_T30 (SEQ ID NO: 686) | 330 | 400 |
| HSEF2_T38 (SEQ ID NO: 687) | 330 | 400 |
| HSEF2_T42 (SEQ ID NO: 688) | 330 | 400 |
| HSEF2_T47 (SEQ ID NO: 689) | 330 | 400 |
| HSEF2_T71 (SEQ ID NO: 690) | 330 | 400 |
| HSEF2_T82 (SEQ ID NO: 691) | 330 | 400 |
| HSEF2_T85 (SEQ ID NO: 692) | 330 | 400 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_10 (SEQ ID NO:707) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 654 below describes the starting and ending position of this segment on each transcript.

TABLE 654

Segment location on transcripts

| Transcript name | Segment starting position | Segment ending position |
| --- | --- | --- |
| HSEF2_T13 (SEQ ID NO: 684) | 401 | 421 |
| HSEF2_T19 (SEQ ID NO: 685) | 401 | 421 |
| HSEF2_T30 (SEQ ID NO: 686) | 401 | 421 |
| HSEF2_T38 (SEQ ID NO: 687) | 401 | 421 |
| HSEF2_T42 (SEQ ID NO: 688) | 401 | 421 |
| HSEF2_T47 (SEQ ID NO: 689) | 401 | 421 |
| HSEF2_T71 (SEQ ID NO: 690) | 401 | 421 |
| HSEF2_T82 (SEQ ID NO: 691) | 401 | 421 |
| HSEF2_T85 (SEQ ID NO: 692) | 401 | 421 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_11 (SEQ ID NO:708) according to the present invention is supported by 195 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 655 below describes the starting and ending position of this segment on each transcript.

TABLE 655

Segment location on transcripts

| Transcript name | Segment starting position | Segment ending position |
|---|---|---|
| HSEF2_T13 (SEQ ID NO: 684) | 422 | 450 |
| HSEF2_T19 (SEQ ID NO: 685) | 422 | 450 |
| HSEF2_T30 (SEQ ID NO: 686) | 422 | 450 |
| HSEF2_T38 (SEQ ID NO: 687) | 422 | 450 |
| HSEF2_T42 (SEQ ID NO: 688) | 422 | 450 |
| HSEF2_T47 (SEQ ID NO: 689) | 422 | 450 |
| HSEF2_T71 (SEQ ID NO: 690) | 422 | 450 |
| HSEF2_T82 (SEQ ID NO: 691) | 422 | 450 |
| HSEF2_T85 (SEQ ID NO: 692) | 422 | 450 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_12 (SEQ ID NO:709) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 656 below describes the starting and ending position of this segment on each transcript.

TABLE 656

Segment location on transcripts

| Transcript name | Segment starting position | Segment ending position |
|---|---|---|
| HSEF2_T13 (SEQ ID NO: 684) | 451 | 454 |
| HSEF2_T19 (SEQ ID NO: 685) | 451 | 454 |
| HSEF2_T30 (SEQ ID NO: 686) | 451 | 454 |
| HSEF2_T38 (SEQ ID NO: 687) | 451 | 454 |
| HSEF2_T42 (SEQ ID NO: 688) | 451 | 454 |
| HSEF2_T47 (SEQ ID NO: 689) | 451 | 454 |
| HSEF2_T71 (SEQ ID NO: 690) | 451 | 454 |
| HSEF2_T82 (SEQ ID NO: 691) | 451 | 454 |
| HSEF2_T85 (SEQ ID NO: 692) | 451 | 454 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_13 (SEQ ID NO:710) according to the present invention is supported by 196 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 657 below describes the starting and ending position of this segment on each transcript.

TABLE 657

Segment location on transcripts

| Transcript name | Segment starting position | Segment ending position |
|---|---|---|
| HSEF2_T13 (SEQ ID NO: 684) | 455 | 489 |
| HSEF2_T19 (SEQ ID NO: 685) | 455 | 489 |
| HSEF2_T30 (SEQ ID NO: 686) | 455 | 489 |
| HSEF2_T38 (SEQ ID NO: 687) | 455 | 489 |
| HSEF2_T42 (SEQ ID NO: 688) | 455 | 489 |
| HSEF2_T47 (SEQ ID NO: 689) | 455 | 489 |
| HSEF2_T71 (SEQ ID NO: 690) | 455 | 489 |
| HSEF2_T82 (SEQ ID NO: 691) | 455 | 489 |
| HSEF2_T85 (SEQ ID NO: 692) | 455 | 489 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_15 (SEQ ID NO:711) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 658 below describes the starting and ending position of this segment on each transcript.

TABLE 658

Segment location on transcripts

| Transcript name | Segment starting position | Segment ending position |
|---|---|---|
| HSEF2_T13 (SEQ ID NO: 684) | 490 | 512 |
| HSEF2_T19 (SEQ ID NO: 685) | 490 | 512 |
| HSEF2_T30 (SEQ ID NO: 686) | 490 | 512 |
| HSEF2_T38 (SEQ ID NO: 687) | 490 | 512 |
| HSEF2_T42 (SEQ ID NO: 688) | 490 | 512 |
| HSEF2_T47 (SEQ ID NO: 689) | 490 | 512 |
| HSEF2_T71 (SEQ ID NO: 690) | 490 | 512 |
| HSEF2_T82 (SEQ ID NO: 691) | 490 | 512 |
| HSEF2_T85 (SEQ ID NO: 692) | 490 | 512 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_16 (SEQ ID NO:712) according to the present invention is supported by 207 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 659 below describes the starting and ending position of this segment on each transcript.

TABLE 659

Segment location on transcripts

| Transcript name | Segment starting position | Segment ending position |
|---|---|---|
| HSEF2_T13 (SEQ ID NO: 684) | 513 | 541 |
| HSEF2_T19 (SEQ ID NO: 685) | 513 | 541 |
| HSEF2_T30 (SEQ ID NO: 686) | 513 | 541 |
| HSEF2_T38 (SEQ ID NO: 687) | 513 | 541 |
| HSEF2_T42 (SEQ ID NO: 688) | 513 | 541 |
| HSEF2_T47 (SEQ ID NO: 689) | 513 | 541 |
| HSEF2_T71 (SEQ ID NO: 690) | 513 | 541 |
| HSEF2_T82 (SEQ ID NO: 691) | 513 | 541 |
| HSEF2_T85 (SEQ ID NO: 692) | 513 | 541 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_17 (SEQ ID NO:713) according to the present invention is supported by 216 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 660 below describes the starting and ending position of this segment on each transcript.

TABLE 660

Segment location on transcripts

| Transcript name | Segment starting position | Segment ending position |
|---|---|---|
| HSEF2_T13 (SEQ ID NO: 684) | 542 | 599 |
| HSEF2_T19 (SEQ ID NO: 685) | 542 | 599 |
| HSEF2_T30 (SEQ ID NO: 686) | 542 | 599 |
| HSEF2_T38 (SEQ ID NO: 687) | 542 | 599 |
| HSEF2_T42 (SEQ ID NO: 688) | 542 | 599 |
| HSEF2_T47 (SEQ ID NO: 689) | 542 | 599 |
| HSEF2_T71 (SEQ ID NO: 690) | 542 | 599 |
| HSEF2_T82 (SEQ ID NO: 691) | 542 | 599 |
| HSEF2_T85 (SEQ ID NO: 692) | 542 | 599 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_18 (SEQ ID NO:714) according to the present invention is supported by 232 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 661 below describes the starting and ending position of this segment on each transcript.

TABLE 661

Segment location on transcripts

| Transcript name | Segment starting position | Segment ending position |
|---|---|---|
| HSEF2_T13 (SEQ ID NO: 684) | 600 | 701 |
| HSEF2_T19 (SEQ ID NO: 685) | 600 | 701 |
| HSEF2_T30 (SEQ ID NO: 686) | 600 | 701 |
| HSEF2_T38 (SEQ ID NO: 687) | 600 | 701 |
| HSEF2_T42 (SEQ ID NO: 688) | 600 | 701 |
| HSEF2_T47 (SEQ ID NO: 689) | 600 | 701 |
| HSEF2_171 (SEQ ID NO: 690) | 600 | 701 |
| HSEF2_T82 (SEQ ID NO: 691) | 600 | 701 |
| HSEF2_T85 (SEQ ID NO: 692) | 600 | 701 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_21 (SEQ ID NO:715) according to the present invention is supported by 230 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 662 below describes the starting and ending position of this segment on each transcript.

TABLE 662

Segment location on transcripts

| Transcript name | Segment starting position | Segment ending position |
|---|---|---|
| HSEF2_T13 (SEQ ID NO: 684) | 702 | 779 |
| HSEF2_T19 (SEQ ID NO: 685) | 702 | 779 |
| HSEF2_T30 (SEQ ID NO: 686) | 702 | 779 |
| HSEF2_T38 (SEQ ID NO: 687) | 779 | 779 |
| HSEF2_T42 (SEQ ID NO: 688) | 702 | 779 |
| HSEF2_T47 (SEQ ID NO: 689) | 702 | 779 |
| HSEF2_T71 (SEQ ID NO: 690) | 702 | 779 |
| HSEF2_T82 (SEQ ID NO: 691) | 702 | 779 |
| HSEF2_T85 (SEQ ID NO: 692) | 702 | 779 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_22 (SEQ ID NO:716) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 663 below describes the starting and ending position of this segment on each transcript.

TABLE 663

Segment location on transcripts

| Transcript name | Segment starting position | Segment ending position |
| --- | --- | --- |
| HSEF2_T13 (SEQ ID NO: 684) | 780 | 798 |
| HSEF2_T19 (SEQ ID NO: 685) | 780 | 798 |
| HSEF2_T30 (SEQ ID NO: 686) | 780 | 798 |
| HSEF2_T38 (SEQ ID NO: 687) | 780 | 798 |
| HSEF2_T42 (SEQ ID NO: 688) | 780 | 798 |
| HSEF2_T47 (SEQ ID NO: 689) | 780 | 798 |
| HSEF2_T71 (SEQ ID NO: 690) | 780 | 798 |
| HSEF2_T82 (SEQ ID NO: 691) | 780 | 798 |
| HSEF2_T85 (SEQ ID NO: 692) | 780 | 798 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_23 (SEQ ID NO:717) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 664 below describes the starting and ending position of this segment on each transcript.

TABLE 664

Segment location on transcripts

| Transcript name | Segment starting position | Segment ending position |
| --- | --- | --- |
| HSEF2_T13 (SEQ ID NO: 684) | 799 | 802 |
| HSEF2_T19 (SEQ ID NO: 685) | 799 | 802 |
| HSEF2_T30 (SEQ ID NO: 686) | 799 | 802 |
| HSEF2_T38 (SEQ ID NO: 687) | 799 | 802 |
| HSEF2_T42 (SEQ ID NO: 688) | 799 | 802 |
| HSEF2_T47 (SEQ ID NO: 689) | 799 | 802 |
| HSEF2_T71 (SEQ ID NO: 690) | 799 | 802 |
| HSEF2_T82 (SEQ ID NO: 691) | 799 | 802 |
| HSEF2_T85 (SEQ ID NO: 692) | 799 | 802 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_24 (SEQ ID NO:718) according to the present invention is supported by 217 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 665 below describes the starting and ending position of this segment on each transcript.

TABLE 665

Segment location on transcripts

| Transcript name | Segment starting position | Segment ending position |
| --- | --- | --- |
| HSEF2_T13 (SEQ ID NO: 684) | 803 | 836 |
| HSEF2_T19 (SEQ ID NO: 685) | 803 | 836 |
| HSEF2_T30 (SEQ ID NO: 686) | 803 | 836 |
| HSEF2_T38 (SEQ ID NO: 687) | 803 | 836 |
| HSEF2_T42 (SEQ ID NO: 688) | 803 | 836 |
| HSEF2_T47 (SEQ ID NO: 689) | 803 | 836 |
| HSEF2_T71 (SEQ ID NO: 690) | 803 | 836 |
| HSEF2_T82 (SEQ ID NO: 691) | 803 | 836 |
| HSEF2_T85 (SEQ ID NO: 692) | 803 | 836 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_25 (SEQ ID NO:719) according to the present invention is supported by 225 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 666 below describes the starting and ending position of this segment on each transcript.

TABLE 666

Segment location on transcripts

| Transcript name | Segment starting position | Segment ending position |
| --- | --- | --- |
| HSEF2_T13 (SEQ ID NO: 684) | 837 | 866 |
| HSEF2_T19 (SEQ ID NO: 685) | 837 | 866 |
| HSEF2_T30 (SEQ ID NO: 686) | 837 | 866 |
| HSEF2_T38 (SEQ ID NO: 687) | 837 | 866 |
| HSEF2_T42 (SEQ ID NO: 688) | 837 | 866 |
| HSEF2_T47 (SEQ ID NO: 689) | 837 | 866 |
| HSEF2_T71 (SEQ ID NO: 690) | 837 | 866 |
| HSEF2_T82 (SEQ ID NO: 691) | 837 | 866 |
| HSEF2_T85 (SEQ ID NO: 692) | 837 | 866 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_26 (SEQ ID NO:720) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 667 below describes the starting and ending position of this segment on each transcript.

TABLE 667

Segment location on transcripts

| Transcript name | Segment starting position | Segment ending position |
|---|---|---|
| HSEF2_T13 (SEQ ID NO: 684) | 867 | 880 |
| HSEF2_T19 (SEQ ID NO: 685) | 867 | 880 |
| HSEF2_T30 (SEQ ID NO: 686) | 867 | 880 |
| HSEF2_T38 (SEQ ID NO: 687) | 867 | 880 |
| HSEF2_T42 (SEQ ID NO: 688) | 867 | 880 |
| HSEF2_T47 (SEQ ID NO: 689) | 867 | 880 |
| HSEF2_T71 (SEQ ID NO: 690) | 867 | 880 |
| HSEF2_T82 (SEQ ID NO: 691) | 867 | 880 |
| HSEF2_T85 (SEQ ID NO: 692) | 867 | 880 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_30 (SEQ ID NO:721) according to the present invention is supported by 253 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 668 below describes the starting and ending position of this segment on each transcript.

TABLE 668

Segment location on transcripts

| Transcript name | Segment starting position | Segment ending position |
|---|---|---|
| HSEF2_T13 (SEQ ID NO: 684) | 881 | 979 |
| HSEF2_T19 (SEQ ID NO: 685) | 881 | 979 |
| HSEF2_T30 (SEQ ID NO: 686) | 881 | 979 |
| HSEF2_T38 (SEQ ID NO: 687) | 881 | 979 |
| HSEF2_T42 (SEQ ID NO: 688) | 881 | 979 |
| HSEF2_T47 (SEQ ID NO: 689) | 881 | 979 |
| HSEF2_T71 (SEQ ID NO: 690) | 881 | 979 |
| HSEF2_T82 (SEQ ID NO: 691) | 881 | 979 |
| HSEF2_T85 (SEQ ID NO: 692) | 881 | 979 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_31 (SEQ ID NO:722) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 669 below describes the starting and ending position of this segment on each transcript.

TABLE 669

Segment location on transcripts

| Transcript name | Segment starting position | Segment ending position |
|---|---|---|
| HSEF2_T13 (SEQ ID NO: 684) | 980 | 986 |
| HSEF2_T19 (SEQ ID NO: 685) | 980 | 986 |
| HSEF2_T30 (SEQ ID NO: 686) | 980 | 986 |
| HSEF2_T38 (SEQ ID NO: 687) | 980 | 986 |
| HSEF2_T42 (SEQ ID NO: 688) | 980 | 986 |
| HSEF2_T47 (SEQ ID NO: 689) | 980 | 986 |
| HSEF2_T71 (SEQ ID NO: 690) | 980 | 986 |
| HSEF2_T82 (SEQ ID NO: 691) | 980 | 986 |
| HSEF2_T85 (SEQ ID NO: 692) | 980 | 986 |

This segment can be found in both coding and non-coding regions of transcript(s) as follows. The segment can be found in a non-coding region of transcript(s) that are related to the following protein(s): HSEF2_P7, HSEF2_P15 and HSEF2_P22. This segment can also be found in the following protein(s): HSEF2_P2, HSEF2_P26, HSEF2_P6 and HSEF2_P54, since it is in the coding region for the corresponding transcript.

Segment cluster HSEF2_node_33 (SEQ ID NO:723) according to the present invention is supported by 222 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 670 below describes the starting and ending position of this segment on each transcript.

TABLE 670

Segment location on transcripts

| Transcript name | Segment starting position | Segment ending position |
|---|---|---|
| HSEF2_T13 (SEQ ID NO: 684) | 987 | 1013 |
| HSEF2_T19 (SEQ ID NO: 685) | 1481 | 1507 |
| HSEF2_T30 (SEQ ID NO: 686) | 1481 | 1507 |
| HSEF2_T38 (SEQ ID NO: 687) | 987 | 1013 |
| HSEF2_T42 (SEQ ID NO: 688) | 987 | 1013 |
| HSEF2_T47 (SEQ ID NO: 689) | 987 | 1013 |
| HSEF2_T71 (SEQ ID NO: 690) | 987 | 1013 |
| HSEF2_T82 (SEQ ID NO: 691) | 987 | 1013 |
| HSEF2_T85 (SEQ ID NO: 692) | 987 | 1013 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node__34 (SEQ ID NO:724) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 671 below describes the starting and ending position of this segment on each transcript.

TABLE 671

Segment location on transcripts

| Transcript name | Segment starting position | Segment ending position |
|---|---|---|
| HSEF2_T13 (SEQ ID NO: 684) | 1014 | 1019 |
| HSEF2_T19 (SEQ ID NO: 685) | 1508 | 1513 |
| HSEF2_T30 (SEQ ID NO: 686) | 1508 | 1513 |
| HSEF2_T38 (SEQ ID NO: 687) | 1014 | 1019 |
| HSEF2_T42 (SEQ ID NO: 688) | 1014 | 1019 |
| HSEF2_T47 (SEQ ID NO: 689) | 1014 | 1019 |
| HSEF2_T71 (SEQ ID NO: 690) | 1014 | 1019 |
| HSEF2_T82 (SEQ ID NO: 691) | 1014 | 1019 |
| HSEF2_T85 (SEQ ID NO: 692) | 1014 | 1019 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node__35 (SEQ ID NO:725) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 672 below describes the starting and ending position of this segment on each transcript.

TABLE 672

Segment location on transcripts

| Transcript name | Segment starting position | Segment ending position |
|---|---|---|
| HSEF2_T13 (SEQ ID NO: 684) | 1020 | 1026 |
| HSEF2_T19 (SEQ ID NO: 685) | 1514 | 1520 |
| HSEF2_T30 (SEQ ID NO: 686) | 1514 | 1520 |
| HSEF2_T38 (SEQ ID NO: 687) | 1020 | 1026 |
| HSEF2_T42 (SEQ ID NO: 688) | 1020 | 1026 |
| HSEF2_T47 (SEQ ID NO: 689) | 1020 | 1026 |
| HSEF2_T71 (SEQ ID NO: 690) | 1020 | 1026 |
| HSEF2_T82 (SEQ ID NO: 691) | 1020 | 1026 |
| HSEF2_T85 (SEQ ID NO: 692) | 1020 | 1026 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node__36 (SEQ ID NO:726) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 673 below describes the starting and ending position of this segment on each transcript.

TABLE 673

Segment location on transcripts

| Transcript name | Segment starting position | Segment ending position |
|---|---|---|
| HSEF2_T13 (SEQ ID NO: 684) | 1027 | 1031 |
| HSEF2_T19 (SEQ ID NO: 685) | 1521 | 1525 |
| HSEF2_T30 (SEQ ID NO: 686) | 1521 | 1525 |
| HSEF2_T38 (SEQ ID NO: 687) | 1027 | 1031 |
| HSEF2_T42 (SEQ ID NO: 688) | 1027 | 1031 |
| HSEF2_T47 (SEQ ID NO: 689) | 1027 | 1031 |
| HSEF2_T71 (SEQ ID NO: 690) | 1027 | 1031 |
| HSEF2_T82 (SEQ ID NO: 691) | 1027 | 1031 |
| HSEF2_T85 (SEQ ID NO: 692) | 1027 | 1031 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node__37 (SEQ ID NO:727) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 674 below describes the starting and ending position of this segment on each transcript.

TABLE 674

Segment location on transcripts

| Transcript name | Segment starting position | Segment ending position |
|---|---|---|
| HSEF2_T13 (SEQ ID NO: 684) | 1032 | 1043 |
| HSEF2_T19 (SEQ ID NO: 685) | 1526 | 1537 |
| HSEF2_T30 (SEQ ID NO: 686) | 1526 | 1537 |
| HSEF2_T38 (SEQ ID NO: 687) | 1032 | 1043 |
| HSEF2_T42 (SEQ ID NO: 688) | 1032 | 1043 |
| HSEF2_T47 (SEQ ID NO: 689) | 1032 | 1043 |
| HSEF2_T71 (SEQ ID NO: 690) | 1032 | 1043 |
| HSEF2_T82 (SEQ ID NO: 691) | 1032 | 1043 |
| HSEF2_T85 (SEQ ID NO: 692) | 1032 | 1043 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node_38 (SEQ ID NO:728) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 675 below describes the starting and ending position of this segment on each transcript.

TABLE 675

Segment location on transcripts

| Transcript name | Segment starting position | Segment ending position |
|---|---|---|
| HSEF2_T13 (SEQ ID NO: 684) | 1044 | 1067 |
| HSEF2_T19 (SEQ ID NO: 685) | 1538 | 1561 |
| HSEF2_T30 (SEQ ID NO: 686) | 1538 | 1561 |
| HSEF2_T38 (SEQ ID NO: 687) | 1044 | 1067 |
| HSEF2_T42 (SEQ ID NO: 688) | 1044 | 1067 |
| HSEF2_T47 (SEQ ID NO: 689) | 1044 | 1067 |
| HSEF2_T71 (SEQ ID NO: 690) | 1044 | 1067 |
| HSEF2_T82 (SEQ ID NO: 691) | 1044 | 1067 |
| HSEF2_T85 (SEQ ID NO: 692) | 1044 | 1067 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node_39 (SEQ ID NO:729) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 676 below describes the starting and ending position of this segment on each transcript.

TABLE 676

Segment location on transcripts

| Transcript name | Segment starting position | Segment ending position |
|---|---|---|
| HSEF2_T13 (SEQ ID NO: 684) | 1068 | 1083 |
| HSEF2_T19 (SEQ ID NO: 685) | 1562 | 1577 |
| HSEF2_T30 (SEQ ID NO: 686) | 1562 | 1577 |
| HSEF2_T38 (SEQ ID NO: 687) | 1068 | 1083 |
| HSEF2_T42 (SEQ ID NO: 688) | 1068 | 1083 |
| HSEF2_T47 (SEQ ID NO: 689) | 1068 | 1083 |
| HSEF2_T71 (SEQ ID NO: 690) | 1068 | 1083 |
| HSEF2_T82 (SEQ ID NO: 691) | 1068 | 1083 |
| HSEF2_T85 (SEQ ID NO: 692) | 1068 | 1083 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node_40 (SEQ ID NO:730) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 677 below describes the starting and ending position of this segment on each transcript.

TABLE 677

Segment location on transcripts

| Transcript name | Segment starting position | Segment ending position |
|---|---|---|
| HSEF2_T13 (SEQ ID NO: 684) | 1084 | 1100 |
| HSEF2_T19 (SEQ ID NO: 685) | 1578 | 1594 |
| HSEF2_T30 (SEQ ID NO: 686) | 1578 | 1594 |
| HSEF2_T38 (SEQ ID NO: 687) | 1084 | 1100 |
| HSEF2_T42 (SEQ ID NO: 688) | 1084 | 1100 |
| HSEF2_T47 (SEQ ID NO: 689) | 1084 | 1100 |
| HSEF2_T71 (SEQ ID NO: 690) | 1084 | 1100 |
| HSEF2_T82 (SEQ ID NO: 691) | 1084 | 1100 |
| HSEF2_T85 (SEQ ID NO: 692) | 1084 | 1100 |

This segment can be found in both coding and non-coding regions of transcript(s) as follows. The segment can be found in a non-coding region of transcript(s) that are related to the following protein(s): HSEF2_P15 and HSEF2_P22. This segment can also be found in the following protein(s): HSEF2_P2, HSEF2_P7, HSEF2_P26, HSEF2_P6 and HSEF2_P54, since it is in the coding region for the corresponding transcript.

Segment cluster HSEF2_node_42 (SEQ ID NO:731) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 678 below describes the starting and ending position of this segment on each transcript.

TABLE 678

Segment location on transcripts

| Transcript name | Segment starting position | Segment ending position |
|---|---|---|
| HSEF2_T13 (SEQ ID NO: 684) | 1101 | 1112 |
| HSEF2_T19 (SEQ ID NO: 685) | 1595 | 1606 |
| HSEF2_T30 (SEQ ID NO: 686) | 1954 | 1965 |
| HSEF2_T38 (SEQ ID NO: 687) | 1460 | 1471 |
| HSEF2_T42 (SEQ ID NO: 688) | 1101 | 1112 |
| HSEF2_T47 (SEQ ID NO: 689) | 1101 | 1112 |
| HSEF2_T71 (SEQ ID NO: 690) | 1101 | 1112 |
| HSEF2_T82 (SEQ ID NO: 691) | 1101 | 1112 |
| HSEF2_T85 (SEQ ID NO: 692) | 1101 | 1112 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__43 (SEQ ID NO:732) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 679 below describes the starting and ending position of this segment on each transcript.

TABLE 679

Segment location on transcripts

| Transcript name | Segment starting position | Segment ending position |
|---|---|---|
| HSEF2_T13 (SEQ ID NO: 684) | 1113 | 1135 |
| HSEF2_T19 (SEQ ID NO: 685) | 1607 | 1629 |
| HSEF2_T30 (SEQ ID NO: 686) | 1966 | 1988 |
| HSEF2_T38 (SEQ ID NO: 687) | 1472 | 1494 |
| HSEF2_T42 (SEQ ID NO: 688) | 1113 | 1135 |
| HSEF2_T47 (SEQ ID NO: 689) | 1113 | 1135 |
| HSEF2_T71 (SEQ ID NO: 690) | 1113 | 1135 |
| HSEF2_T82 (SEQ ID NO: 691) | 1113 | 1135 |
| HSEF2_T85 (SEQ ID NO: 692) | 1113 | 1135 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__44 (SEQ ID NO:733) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 680 below describes the starting and ending position of this segment on each transcript.

TABLE 680

Segment location on transcripts

| Transcript name | Segment starting position | Segment ending position |
|---|---|---|
| HSEF2_T13 (SEQ ID NO: 684) | 1136 | 1160 |
| HSEF2_T19 (SEQ ID NO: 685) | 1630 | 1654 |
| HSEF2_T30 (SEQ ID NO: 686) | 1989 | 2013 |
| HSEF2_T38 (SEQ ID NO: 687) | 1495 | 1519 |
| HSEF2_T42 (SEQ ID NO: 688) | 1136 | 1160 |
| HSEF2_T47 (SEQ ID NO: 689) | 1136 | 1160 |
| HSEF2_T71 (SEQ ID NO: 690) | 1136 | 1160 |
| HSEF2_T82 (SEQ ID NO: 691) | 1136 | 1160 |
| HSEF2_T85 (SEQ ID NO: 692) | 1136 | 1160 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__45 (SEQ ID NO:734) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 681 below describes the starting and ending position of this segment on each transcript.

TABLE 681

Segment location on transcripts

| Transcript name | Segment starting position | Segment ending position |
|---|---|---|
| HSEF2_T13 (SEQ ID NO: 684) | 1161 | 1170 |
| HSEF2_T19 (SEQ ID NO: 685) | 1655 | 1664 |
| HSEF2_T30 (SEQ ID NO: 686) | 2014 | 2023 |
| HSEF2_T38 (SEQ ID NO: 687) | 1520 | 1529 |
| HSEF2_T42 (SEQ ID NO: 688) | 1161 | 1170 |
| HSEF2_T47 (SEQ ID NO: 689) | 1161 | 1170 |
| HSEF2_T71 (SEQ ID NO: 690) | 1161 | 1170 |
| HSEF2_T82 (SEQ ID NO: 691) | 1161 | 1170 |
| HSEF2_T85 (SEQ ID NO: 692) | 1161 | 1170 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__46 (SEQ ID NO:735) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 682 below describes the starting and ending position of this segment on each transcript.

TABLE 682

Segment location on transcripts

| Transcript name | Segment starting position | Segment ending position |
|---|---|---|
| HSEF2_T13 (SEQ ID NO: 684) | 1171 | 1186 |
| HSEF2_T19 (SEQ ID NO: 685) | 1665 | 1680 |
| HSEF2_T30 (SEQ ID NO: 686) | 2024 | 2039 |
| HSEF2_T38 (SEQ ID NO: 687) | 1530 | 1545 |
| HSEF2_T42 (SEQ ID NO: 688) | 1171 | 1186 |
| HSEF2_T47 (SEQ ID NO: 689) | 1171 | 1186 |
| HSEF2_T71 (SEQ ID NO: 690) | 1171 | 1186 |

TABLE 682-continued

Segment location on transcripts

| Transcript name | Segment starting position | Segment ending position |
|---|---|---|
| HSEF2_T82 (SEQ ID NO: 691) | 1171 | 1186 |
| HSEF2_T85 (SEQ ID NO: 692) | 1171 | 1186 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node_47 (SEQ ID NO:736) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 683 below describes the starting and ending position of this segment on each transcript.

TABLE 683

Segment location on transcripts

| Transcript name | Segment starting position | Segment ending position |
|---|---|---|
| HSEF2_T13 (SEQ ID NO: 684) | 1187 | 1192 |
| HSEF2_T19 (SEQ ID NO: 685) | 1681 | 1686 |
| HSEF2_T30 (SEQ ID NO: 686) | 2040 | 2045 |
| HSEF2_T38 (SEQ ID NO: 687) | 1546 | 1551 |
| HSEF2_T42 (SEQ ID NO: 688) | 1187 | 1192 |
| HSEF2_T47 (SEQ ID NO: 689) | 1187 | 1192 |
| HSEF2_T71 (SEQ ID NO: 690) | 1187 | 1192 |
| HSEF2_T82 (SEQ ID NO: 691) | 1187 | 1192 |
| HSEF2_T85 (SEQ ID NO: 692) | 1187 | 1192 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node_48 (SEQ ID NO:737) according to the present invention is supported by 205 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 684 below describes the starting and ending position of this segment on each transcript.

TABLE 684

Segment location on transcripts

| Transcript name | Segment starting position | Segment ending position |
|---|---|---|
| HSEF2_T13 (SEQ ID NO: 684) | 1193 | 1230 |
| HSEF2_T19 (SEQ ID NO: 685) | 1687 | 1724 |
| HSEF2_T30 (SEQ ID NO: 686) | 2046 | 2083 |
| HSEF2_T38 (SEQ ID NO: 687) | 1552 | 1589 |
| HSEF2_T42 (SEQ ID NO: 688) | 1193 | 1230 |
| HSEF2_T47 (SEQ ID NO: 689) | 1193 | 1230 |
| HSEF2_T71 (SEQ ID NO: 690) | 1193 | 1230 |
| HSEF2_T82 (SEQ ID NO: 691) | 1193 | 1230 |
| HSEF2_T85 (SEQ ID NO: 692) | 1193 | 1230 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node_49 (SEQ ID NO:738) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 685 below describes the starting and ending position of this segment on each transcript.

TABLE 685

Segment location on transcripts

| Transcript name | Segment starting position | Segment ending position |
|---|---|---|
| HSEF2_T13 (SEQ ID NO: 684) | 1231 | 1239 |
| HSEF2_T19 (SEQ ID NO: 685) | 1725 | 1733 |
| HSEF2_T30 (SEQ ID NO: 686) | 2084 | 2092 |
| HSEF2_T38 (SEQ ID NO: 687) | 1590 | 1598 |
| HSEF2_T42 (SEQ ID NO: 688) | 1231 | 1239 |
| HSEF2_T47 (SEQ ID NO: 689) | 1231 | 1239 |
| HSEF2_T71 (SEQ ID NO: 690) | 1231 | 1239 |
| HSEF2_T82 (SEQ ID NO: 691) | 1231 | 1239 |
| HSEF2_T85 (SEQ ID NO: 692) | 1231 | 1239 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node_51 (SEQ ID NO:739) according to the present invention is supported by 199 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85

(SEQ ID NO:692). Table 686 below describes the starting and ending position of this segment on each transcript.

TABLE 686

Segment location on transcripts

| Transcript name | Segment starting position | Segment ending position |
|---|---|---|
| HSEF2_T13 (SEQ ID NO: 684) | 1240 | 1266 |
| HSEF2_T19 (SEQ ID NO: 685) | 1734 | 1760 |
| HSEF2_T30 (SEQ ID NO: 686) | 2093 | 2119 |
| HSEF2_T38 (SEQ ID NO: 687) | 1599 | 1625 |
| HSEF2_T42 (SEQ ID NO: 688) | 1240 | 1266 |
| HSEF2_T47 (SEQ ID NO: 689) | 1240 | 1266 |
| HSEF2_T71 (SEQ ID NO: 690) | 1240 | 1266 |
| HSEF2_T82 (SEQ ID NO: 691) | 1240 | 1266 |
| HSEF2_T85 (SEQ ID NO: 692) | 1240 | 1266 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__52 (SEQ ID NO:740) according to the present invention is supported by 217 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 687 below describes the starting and ending position of this segment on each transcript.

TABLE 687

Segment location on transcripts

| Transcript name | Segment starting position | Segment ending position |
|---|---|---|
| HSEF2_T13 (SEQ ID NO: 684) | 1267 | 1381 |
| HSEF2_T19 (SEQ ID NO: 685) | 1761 | 1875 |
| HSEF2_T30 (SEQ ID NO: 686) | 2120 | 2234 |
| HSEF2_T38 (SEQ ID NO: 687) | 1626 | 1740 |
| HSEF2_T42 (SEQ ID NO: 688) | 1267 | 1381 |
| HSEF2_T47 (SEQ ID NO: 689) | 1267 | 1381 |
| HSEF2_T71 (SEQ ID NO: 690) | 1267 | 1381 |
| HSEF2_T82 (SEQ ID NO: 691) | 1267 | 1381 |
| HSEF2_T85 (SEQ ID NO: 692) | 1267 | 1381 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__53 (SEQ ID NO:741) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 688 below describes the starting and ending position of this segment on each transcript.

TABLE 688

Segment location on transcripts

| Transcript name | Segment starting position | Segment ending position |
|---|---|---|
| HSEF2_T13 (SEQ ID NO: 684) | 1382 | 1403 |
| HSEF2_T19 (SEQ ID NO: 685) | 1876 | 1897 |
| HSEF2_T30 (SEQ ID NO: 686) | 2235 | 2256 |
| HSEF2_T38 (SEQ ID NO: 687) | 1741 | 1762 |
| HSEF2_T42 (SEQ ID NO: 688) | 1382 | 1403 |
| HSEF2_T47 (SEQ ID NO: 689) | 1382 | 1403 |
| HSEF2_T71 (SEQ ID NO: 690) | 1382 | 1403 |
| HSEF2_T82 (SEQ ID NO: 691) | 1382 | 1403 |
| HSEF2_T85 (SEQ ID NO: 692) | 1382 | 1403 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__54 (SEQ ID NO:742) according to the present invention is supported by 201 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 689 below describes the starting and ending position of this segment on each transcript.

TABLE 689

Segment location on transcripts

| Transcript name | Segment starting position | Segment ending position |
|---|---|---|
| HSEF2_T13 (SEQ ID NO: 684) | 1404 | 1435 |
| HSEF2_T19 (SEQ ID NO: 685) | 1898 | 1929 |
| HSEF2_T30 (SEQ ID NO: 686) | 2257 | 2288 |
| HSEF2_T38 (SEQ ID NO: 687) | 1763 | 1794 |
| HSEF2_T42 (SEQ ID NO: 688) | 1404 | 1435 |
| HSEF2_T47 (SEQ ID NO: 689) | 1404 | 1435 |
| HSEF2_T71 (SEQ ID NO: 690) | 1404 | 1435 |
| HSEF2_T82 (SEQ ID NO: 691) | 1404 | 1435 |
| HSEF2_T85 (SEQ ID NO: 692) | 1404 | 1435 |

This segment can be found in both coding and non-coding regions of transcript(s) as follows. The segment can be found in a non-coding region of transcript(s) that are related to the following protein(s): HSEF2_P22. This segment can also be found in the following protein(s): HSEF2_P2, HSEF2_P7, HSEF2_P15, HSEF2_P26, HSEF2_P6 and HSEF2_P54, since it is in the coding region for the corresponding transcript.

Segment cluster HSEF2_node__56 (SEQ ID NO:743) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 690 below describes the starting and ending position of this segment on each transcript.

TABLE 690

Segment location on transcripts

| Transcript name | Segment starting position | Segment ending position |
|---|---|---|
| HSEF2_T13 (SEQ ID NO: 684) | 1883 | 1903 |
| HSEF2_T19 (SEQ ID NO: 685) | 1930 | 1950 |
| HSEF2_T30 (SEQ ID NO: 686) | 2289 | 2309 |
| HSEF2_T38 (SEQ ID NO: 687) | 2242 | 2262 |
| HSEF2_T42 (SEQ ID NO: 688) | 1436 | 1456 |
| HSEF2_T47 (SEQ ID NO: 689) | 1436 | 1456 |
| HSEF2_T71 (SEQ ID NO: 690) | 1436 | 1456 |
| HSEF2_T82 (SEQ ID NO: 691) | 1883 | 1903 |
| HSEF2_T85 (SEQ ID NO: 692) | 1883 | 1903 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node__57 (SEQ ID NO:744) according to the present invention is supported by 227 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 691 below describes the starting and ending position of this segment on each transcript.

TABLE 691

Segment location on transcripts

| Transcript name | Segment starting position | Segment ending position |
|---|---|---|
| HSEF2_T13 (SEQ ID NO: 684) | 1904 | 1932 |
| HSEF2_T19 (SEQ ID NO: 685) | 1951 | 1979 |
| HSEF2_T30 (SEQ ID NO: 686) | 2310 | 2338 |
| HSEF2_T38 (SEQ ID NO: 687) | 2263 | 2291 |
| HSEF2_T42 (SEQ ID NO: 688) | 1457 | 1485 |
| HSEF2_T47 (SEQ ID NO: 689) | 1457 | 1485 |
| HSEF2_T71 (SEQ ID NO: 690) | 1457 | 1485 |
| HSEF2_T82 (SEQ ID NO: 691) | 1904 | 1932 |
| HSEF2_T85 (SEQ ID NO: 692) | 1904 | 1932 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node__58 (SEQ ID NO:745) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 692 below describes the starting and ending position of this segment on each transcript.

TABLE 692

Segment location on transcripts

| Transcript name | Segment starting position | Segment ending position |
|---|---|---|
| HSEF2_T13 (SEQ ID NO: 684) | 1933 | 1946 |
| HSEF2_T19 (SEQ ID NO: 685) | 1980 | 1993 |
| HSEF2_T30 (SEQ ID NO: 686) | 2339 | 2352 |
| HSEF2_T38 (SEQ ID NO: 687) | 2292 | 2305 |
| HSEF2_T42 (SEQ ID NO: 688) | 1486 | 1499 |
| HSEF2_T47 (SEQ ID NO: 689) | 1486 | 1499 |
| HSEF2_T71 (SEQ ID NO: 690) | 1486 | 1499 |
| HSEF2_T82 (SEQ ID NO: 691) | 1933 | 1946 |
| HSEF2_T85 (SEQ ID NO: 692) | 1933 | 1946 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node__59 (SEQ ID NO:746) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 693 below describes the starting and ending position of this segment on each transcript.

TABLE 693

Segment location on transcripts

| Transcript name | Segment starting position | Segment ending position |
|---|---|---|
| HSEF2_T13 (SEQ ID NO: 684) | 1947 | 1952 |
| HSEF2_T19 (SEQ ID NO: 685) | 1994 | 1999 |
| HSEF2_T30 (SEQ ID NO: 686) | 2353 | 2358 |
| HSEF2_T38 (SEQ ID NO: 687) | 2306 | 2311 |
| HSEF2_T42 (SEQ ID NO: 688) | 1500 | 1505 |
| HSEF2_T47 (SEQ ID NO: 689) | 1500 | 1505 |
| HSEF2_T71 (SEQ ID NO: 690) | 1500 | 1505 |
| HSEF2_T82 (SEQ ID NO: 691) | 1947 | 1952 |
| HSEF2_T85 (SEQ ID NO: 692) | 1947 | 1952 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node__60 (SEQ ID NO:747) according to the present invention is supported by 235 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 694 below describes the starting and ending position of this segment on each transcript.

TABLE 694

Segment location on transcripts

| Transcript name | Segment starting position | Segment ending position |
|---|---|---|
| HSEF2_T13 (SEQ ID NO: 684) | 1953 | 2006 |
| HSEF2_T19 (SEQ ID NO: 685) | 2000 | 2053 |
| HSEF2_T30 (SEQ ID NO: 686) | 2359 | 2412 |
| HSEF2_T38 (SEQ ID NO: 687) | 2312 | 2365 |
| HSEF2_T42 (SEQ ID NO: 688) | 1506 | 1559 |
| HSEF2_T47 (SEQ ID NO: 689) | 1506 | 1559 |
| HSEF2_T71 (SEQ ID NO: 690) | 1506 | 1559 |
| HSEF2_T82 (SEQ ID NO: 691) | 1953 | 2006 |
| HSEF2_T85 (SEQ ID NO: 692) | 1953 | 2006 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_61 (SEQ ID NO:748) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 695 below describes the starting and ending position of this segment on each transcript.

TABLE 695

Segment location on transcripts

| Transcript name | Segment starting position | Segment ending position |
|---|---|---|
| HSEF2_T13 (SEQ ID NO: 684) | 2007 | 2030 |
| HSEF2_T19 (SEQ ID NO: 685) | 2054 | 2077 |
| HSEF2_T30 (SEQ ID NO: 686) | 2413 | 2436 |
| HSEF2_T38 (SEQ ID NO: 687) | 2366 | 2389 |
| HSEF2_T42 (SEQ ID NO: 688) | 1560 | 1583 |
| HSEF2_T47 (SEQ ID NO: 689) | 1560 | 1583 |
| HSEF2_T71 (SEQ ID NO: 690) | 1560 | 1583 |
| HSEF2_T82 (SEQ ID NO: 691) | 2007 | 2030 |
| HSEF2_T85 (SEQ ID NO: 692) | 2007 | 2030 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_62 (SEQ ID NO:749) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 696 below describes the starting and ending position of this segment on each transcript.

TABLE 696

Segment location on transcripts

| Transcript name | Segment starting position | Segment ending position |
|---|---|---|
| HSEF2_T13 (SEQ ID NO: 684) | 2031 | 2036 |
| HSEF2_T19 (SEQ ID NO: 685) | 2078 | 2083 |
| HSEF2_T30 (SEQ ID NO: 686) | 2437 | 2442 |
| HSEF2_T38 (SEQ ID NO: 687) | 2390 | 2395 |
| HSEF2_T42 (SEQ ID NO: 688) | 1584 | 1589 |
| HSEF2_T47 (SEQ ID NO: 689) | 1584 | 1589 |
| HSEF2_T71 (SEQ ID NO: 690) | 1584 | 1589 |
| HSEF2_T82 (SEQ ID NO: 691) | 2031 | 2036 |
| HSEF2_T85 (SEQ ID NO: 692) | 2031 | 2036 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_63 (SEQ ID NO:750) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 697 below describes the starting and ending position of this segment on each transcript.

TABLE 697

Segment location on transcripts

| Transcript name | Segment starting position | Segment ending position |
|---|---|---|
| HSEF2_T13 (SEQ ID NO: 684) | 2037 | 2043 |
| HSEF2_T19 (SEQ ID NO: 685) | 2084 | 2090 |
| HSEF2_T30 (SEQ ID NO: 686) | 2443 | 2449 |
| HSEF2_T38 (SEQ ID NO: 687) | 2396 | 2402 |
| HSEF2_T42 (SEQ ID NO: 688) | 1590 | 1596 |
| HSEF2_T47 (SEQ ID NO: 689) | 1590 | 1596 |
| HSEF2_T71 (SEQ ID NO: 690) | 1590 | 1596 |
| HSEF2_T82 (SEQ ID NO: 691) | 2037 | 2043 |
| HSEF2_T85 (SEQ ID NO: 692) | 2037 | 2043 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_64 (SEQ ID NO:751) according to the present invention is supported by 258 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690), HSEF2_T82 (SEQ ID NO:691) and HSEF2_T85 (SEQ ID NO:692). Table 698 below describes the starting and ending position of this segment on each transcript.

TABLE 698

Segment location on transcripts

| Transcript name | Segment starting position | Segment ending position |
| --- | --- | --- |
| HSEF2_T13 (SEQ ID NO: 684) | 2044 | 2141 |
| HSEF2_T19 (SEQ ID NO: 685) | 2091 | 2188 |
| HSEF2_T30 (SEQ ID NO: 686) | 2450 | 2547 |
| HSEF2_T38 (SEQ ID NO: 687) | 2403 | 2500 |
| HSEF2_T42 (SEQ ID NO: 688) | 1597 | 1694 |
| HSEF2_T47 (SEQ ID NO: 689) | 1597 | 1694 |
| HSEF2_T71 (SEQ ID NO: 690) | 1597 | 1694 |
| HSEF2_T82 (SEQ ID NO: 691) | 2044 | 2141 |
| HSEF2_T85 (SEQ ID NO: 692) | 2044 | 2141 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_67 (SEQ ID NO:752) according to the present invention is supported by 234 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 699 below describes the starting and ending position of this segment on each transcript.

TABLE 699

Segment location on transcripts

| Transcript name | Segment starting position | Segment ending position |
| --- | --- | --- |
| HSEF2_T13 (SEQ ID NO: 684) | 2142 | 2168 |
| HSEF2_T19 (SEQ ID NO: 685) | 2189 | 2215 |
| HSEF2_T30 (SEQ ID NO: 686) | 2548 | 2574 |
| HSEF2_T38 (SEQ ID NO: 687) | 2501 | 2527 |
| HSEF2_T42 (SEQ ID NO: 688) | 1695 | 1721 |
| HSEF2_T47 (SEQ ID NO: 689) | 1695 | 1721 |
| HSEF2_T71 (SEQ ID NO: 690) | 1695 | 1721 |
| HSEF2_T82 (SEQ ID NO: 691) | 2142 | 2168 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_68 (SEQ ID NO:753) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 700 below describes the starting and ending position of this segment on each transcript.

TABLE 700

Segment location on transcripts

| Transcript name | Segment starting position | Segment ending position |
| --- | --- | --- |
| HSEF2_T13 (SEQ ID NO: 684) | 2169 | 2177 |
| HSEF2_T19 (SEQ ID NO: 685) | 2216 | 2224 |
| HSEF2_T30 (SEQ ID NO: 686) | 2575 | 2583 |
| HSEF2_T38 (SEQ ID NO: 687) | 2528 | 2536 |
| HSEF2_T42 (SEQ ID NO: 688) | 1722 | 1730 |
| HSEF2_T47 (SEQ ID NO: 689) | 1722 | 1730 |
| HSEF2_T71 (SEQ ID NO: 690) | 1722 | 1730 |
| HSEF2_T82 (SEQ ID NO: 691) | 2169 | 2177 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_69 (SEQ ID NO:754) according to the present invention is supported by 235 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 701 below describes the starting and ending position of this segment on each transcript.

TABLE 701

Segment location on transcripts

| Transcript name | Segment starting position | Segment ending position |
| --- | --- | --- |
| HSEF2_T13 (SEQ ID NO: 684) | 2178 | 2207 |
| HSEF2_T19 (SEQ ID NO: 685) | 2225 | 2254 |
| HSEF2_T30 (SEQ ID NO: 686) | 2584 | 2613 |
| HSEF2_T38 (SEQ ID NO: 687) | 2537 | 2566 |
| HSEF2_T42 (SEQ ID NO: 688) | 1731 | 1760 |
| HSEF2_T47 (SEQ ID NO: 689) | 1731 | 1760 |
| HSEF2_T71 (SEQ ID NO: 690) | 1731 | 1760 |
| HSEF2_T82 (SEQ ID NO: 691) | 2178 | 2207 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_70 (SEQ ID NO:755) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 702 below describes the starting and ending position of this segment on each transcript.

TABLE 702

Segment location on transcripts

| Transcript name | Segment starting position | Segment ending position |
|---|---|---|
| HSEF2_T13 (SEQ ID NO: 684) | 2208 | 2216 |
| HSEF2_T19 (SEQ ID NO: 685) | 2255 | 2263 |
| HSEF2_T30 (SEQ ID NO: 686) | 2614 | 2622 |
| HSEF2_T38 (SEQ ID NO: 687) | 2567 | 2575 |
| HSEF2_T42 (SEQ ID NO: 688) | 1761 | 1769 |
| HSEF2_T47 (SEQ ID NO: 689) | 1761 | 1769 |
| HSEF2_T71 (SEQ ID NO: 690) | 1761 | 1769 |
| HSEF2_T82 (SEQ ID NO: 691) | 2208 | 2216 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_71 (SEQ ID NO:756) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 703 below describes the starting and ending position of this segment on each transcript.

TABLE 703

Segment location on transcripts

| Transcript name | Segment starting position | Segment ending position |
|---|---|---|
| HSEF2_T13 (SEQ ID NO: 684) | 2217 | 2222 |
| HSEF2_T19 (SEQ ID NO: 685) | 2264 | 2269 |
| HSEF2_T30 (SEQ ID NO: 686) | 2623 | 2628 |
| HSEF2_T38 (SEQ ID NO: 687) | 2576 | 2581 |
| HSEF2_T42 (SEQ ID NO: 688) | 1770 | 1775 |
| HSEF2_T47 (SEQ ID NO: 689) | 1770 | 1775 |
| HSEF2_T71 (SEQ ID NO: 690) | 1770 | 1775 |
| HSEF2_T82 (SEQ ID NO: 691) | 2217 | 2222 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_72 (SEQ ID NO:757) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 704 below describes the starting and ending position of this segment on each transcript.

TABLE 704

Segment location on transcripts

| Transcript name | Segment starting position | Segment ending position |
|---|---|---|
| HSEF2_T13 (SEQ ID NO: 684) | 2223 | 2242 |
| HSEF2_T19 (SEQ ID NO: 685) | 2270 | 2289 |
| HSEF2_T30 (SEQ ID NO: 686) | 2629 | 2648 |
| HSEF2_T38 (SEQ ID NO: 687) | 2582 | 2601 |
| HSEF2_T42 (SEQ ID NO: 688) | 1776 | 1795 |
| HSEF2_T47 (SEQ ID NO: 689) | 1776 | 1795 |
| HSEF2_T71 (SEQ ID NO: 690) | 1776 | 1795 |
| HSEF2_T82 (SEQ ID NO: 691) | 2223 | 2242 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_73 (SEQ ID NO:758) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688), HSEF2_T47 (SEQ ID NO:689), HSEF2_T71 (SEQ ID NO:690) and HSEF2_T82 (SEQ ID NO:691). Table 705 below describes the starting and ending position of this segment on each transcript.

TABLE 705

Segment location on transcripts

| Transcript name | Segment starting position | Segment ending position |
|---|---|---|
| HSEF2_T13 (SEQ ID NO: 684) | 2243 | 2249 |
| HSEF2_T19 (SEQ ID NO: 685) | 2290 | 2296 |
| HSEF2_T30 (SEQ ID NO: 686) | 2649 | 2655 |
| HSEF2_T38 (SEQ ID NO: 687) | 2602 | 2608 |
| HSEF2_T42 (SEQ ID NO: 688) | 1796 | 1802 |
| HSEF2_T47 (SEQ ID NO: 689) | 1796 | 1802 |
| HSEF2_T71 (SEQ ID NO: 690) | 1796 | 1802 |
| HSEF2_T82 (SEQ ID NO: 691) | 2243 | 2249 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26, HSEF2_P6 and HSEF2_P54, since it is in the coding region for the corresponding transcript.

Segment cluster HSEF2_node_77 (SEQ ID NO:759) according to the present invention is supported by 256 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 706 below describes the starting and ending position of this segment on each transcript.

TABLE 706

Segment location on transcripts

| Transcript name | Segment starting position | Segment ending position |
|---|---|---|
| HSEF2_T13 (SEQ ID NO: 684) | 2250 | 2327 |
| HSEF2_T19 (SEQ ID NO: 685) | 2297 | 2374 |
| HSEF2_T30 (SEQ ID NO: 686) | 2656 | 2733 |
| HSEF2_T38 (SEQ ID NO: 687) | 2609 | 2686 |
| HSEF2_T42 (SEQ ID NO: 688) | 1803 | 1880 |
| HSEF2_T47 (SEQ ID NO: 689) | 1803 | 1880 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_78 (SEQ ID NO:760) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 707 below describes the starting and ending position of this segment on each transcript.

TABLE 707

Segment location on transcripts

| Transcript name | Segment starting position | Segment ending position |
|---|---|---|
| HSEF2_T13 (SEQ ID NO: 684) | 2328 | 2339 |
| HSEF2_T19 (SEQ ID NO: 685) | 2375 | 2386 |
| HSEF2_T30 (SEQ ID NO: 686) | 2734 | 2745 |
| HSEF2_T38 (SEQ ID NO: 687) | 2687 | 2698 |
| HSEF2_T42 (SEQ ID NO: 688) | 1881 | 1892 |
| HSEF2_T47 (SEQ ID NO: 689) | 1881 | 1892 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_79 (SEQ ID NO:761) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 708 below describes the starting and ending position of this segment on each transcript.

TABLE 708

Segment location on transcripts

| Transcript name | Segment starting position | Segment ending position |
|---|---|---|
| HSEF2_T13 (SEQ ID NO: 684) | 2340 | 2347 |
| HSEF2_T19 (SEQ ID NO: 685) | 2387 | 2394 |
| HSEF2_T30 (SEQ ID NO: 686) | 2746 | 2753 |
| HSEF2_T38 (SEQ ID NO: 687) | 2699 | 2706 |

TABLE 708-continued

Segment location on transcripts

| Transcript name | Segment starting position | Segment ending position |
|---|---|---|
| HSEF2_T42 (SEQ ID NO: 688) | 1893 | 1900 |
| HSEF2_T47 (SEQ ID NO: 689) | 1893 | 1900 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_80 (SEQ ID NO:762) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 709 below describes the starting and ending position of this segment on each transcript.

TABLE 709

Segment location on transcripts

| Transcript name | Segment starting position | Segment ending position |
|---|---|---|
| HSEF2_T13 (SEQ ID NO: 684) | 2348 | 2351 |
| HSEF2_T19 (SEQ ID NO: 685) | 2395 | 2398 |
| HSEF2_T30 (SEQ ID NO: 686) | 2754 | 2757 |
| HSEF2_T38 (SEQ ID NO: 687) | 2707 | 2710 |
| HSEF2_T42 (SEQ ID NO: 688) | 1901 | 1904 |
| HSEF2_T47 (SEQ ID NO: 689) | 1901 | 1904 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_81 (SEQ ID NO:763) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 710 below describes the starting and ending position of this segment on each transcript.

TABLE 710

Segment location on transcripts

| Transcript name | Segment starting position | Segment ending position |
|---|---|---|
| HSEF2_T13 (SEQ ID NO: 684) | 2352 | 2359 |
| HSEF2_T19 (SEQ ID NO: 685) | 2399 | 2406 |
| HSEF2_T30 (SEQ ID NO: 686) | 2758 | 2765 |
| HSEF2_T38 (SEQ ID NO: 687) | 2711 | 2718 |
| HSEF2_T42 (SEQ ID NO: 688) | 1905 | 1912 |
| HSEF2_T47 (SEQ ID NO: 689) | 1905 | 1912 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_82 (SEQ ID NO:764) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 711 below describes the starting and ending position of this segment on each transcript.

TABLE 711

Segment location on transcripts

| Transcript name | Segment starting position | Segment ending position |
|---|---|---|
| HSEF2_T13 (SEQ ID NO: 684) | 2360 | 2364 |
| HSEF2_T19 (SEQ ID NO: 685) | 2407 | 2411 |
| HSEF2_T30 (SEQ ID NO: 686) | 2766 | 2770 |
| HSEF2_T38 (SEQ ID NO: 687) | 2719 | 2723 |
| HSEF2_T42 (SEQ ID NO: 688) | 1913 | 1917 |
| HSEF2_T47 (SEQ ID NO: 689) | 1913 | 1917 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_83 (SEQ ID NO:765) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 712 below describes the starting and ending position of this segment on each transcript.

TABLE 712

Segment location on transcripts

| Transcript name | Segment starting position | Segment ending position |
|---|---|---|
| HSEF2_T13 (SEQ ID NO: 684) | 2365 | 2369 |
| HSEF2_T19 (SEQ ID NO: 685) | 2412 | 2416 |
| HSEF2_T30 (SEQ ID NO: 686) | 2771 | 2775 |
| HSEF2_T38 (SEQ ID NO: 687) | 2724 | 2728 |
| HSEF2_T42 (SEQ ID NO: 688) | 1918 | 1922 |
| HSEF2_T47 (SEQ ID NO: 689) | 1918 | 1922 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_84 (SEQ ID NO:766) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 713 below describes the starting and ending position of this segment on each transcript.

TABLE 713

Segment location on transcripts

| Transcript name | Segment starting position | Segment ending position |
|---|---|---|
| HSEF2_T13 (SEQ ID NO: 684) | 2370 | 2381 |
| HSEF2_T19 (SEQ ID NO: 685) | 2417 | 2428 |
| HSEF2_T30 (SEQ ID NO: 686) | 2776 | 2787 |
| HSEF2_T38 (SEQ ID NO: 687) | 2729 | 2740 |
| HSEF2_T42 (SEQ ID NO: 688) | 1923 | 1934 |
| HSEF2_T47 (SEQ ID NO: 689) | 1923 | 1934 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_85 (SEQ ID NO:767) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 714 below describes the starting and ending position of this segment on each transcript.

TABLE 714

Segment location on transcripts

| Transcript name | Segment starting position | Segment ending position |
|---|---|---|
| HSEF2_T13 (SEQ ID NO: 684) | 2382 | 2394 |
| HSEF2_T19 (SEQ ID NO: 685) | 2429 | 2441 |
| HSEF2_T30 (SEQ ID NO: 686) | 2788 | 2800 |
| HSEF2_T38 (SEQ ID NO: 687) | 2741 | 2753 |
| HSEF2_T42 (SEQ ID NO: 688) | 1935 | 1947 |
| HSEF2_T47 (SEQ ID NO: 689) | 1935 | 1947 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_86 (SEQ ID NO:768) according to the present invention is supported by 245 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 715 below describes the starting and ending position of this segment on each transcript.

TABLE 715

Segment location on transcripts

| Transcript name | Segment starting position | Segment ending position |
|---|---|---|
| HSEF2_T13 (SEQ ID NO: 684) | 2395 | 2426 |
| HSEF2_T19 (SEQ ID NO: 685) | 2442 | 2473 |
| HSEF2_T30 (SEQ ID NO: 686) | 2801 | 2832 |
| HSEF2_T38 (SEQ ID NO: 687) | 2754 | 2785 |
| HSEF2_T42 (SEQ ID NO: 688) | 1948 | 1979 |
| HSEF2_T47 (SEQ ID NO: 689) | 1948 | 1979 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_87 (SEQ ID NO:769) according to the present invention is supported by 250 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 716 below describes the starting and ending position of this segment on each transcript.

TABLE 716

Segment location on transcripts

| Transcript name | Segment starting position | Segment ending position |
|---|---|---|
| HSEF2_T13 (SEQ ID NO: 684) | 2427 | 2462 |
| HSEF2_T19 (SEQ ID NO: 685) | 2474 | 2509 |
| HSEF2_T30 (SEQ ID NO: 686) | 2833 | 2868 |
| HSEF2_T38 (SEQ ID NO: 687) | 2786 | 2821 |
| HSEF2_T42 (SEQ ID NO: 688) | 1980 | 2015 |
| HSEF2_T47 (SEQ ID NO: 689) | 1980 | 2015 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_88 (SEQ ID NO:770) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 717 below describes the starting and ending position of this segment on each transcript.

TABLE 717

Segment location on transcripts

| Transcript name | Segment starting position | Segment ending position |
|---|---|---|
| HSEF2_T13 (SEQ ID NO: 684) | 2463 | 2466 |
| HSEF2_T19 (SEQ ID NO: 685) | 2510 | 2513 |

TABLE 717-continued

Segment location on transcripts

| Transcript name | Segment starting position | Segment ending position |
|---|---|---|
| HSEF2_T30 (SEQ ID NO: 686) | 2869 | 2872 |
| HSEF2_T38 (SEQ ID NO: 687) | 2822 | 2825 |
| HSEF2_T42 (SEQ ID NO: 688) | 2016 | 2019 |
| HSEF2_T47 (SEQ ID NO: 689) | 2016 | 2019 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_89 (SEQ ID NO:771) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 718 below describes the starting and ending position of this segment on each transcript.

TABLE 718

Segment location on transcripts

| Transcript name | Segment starting position | Segment ending position |
|---|---|---|
| HSEF2_T13 (SEQ ID NO: 684) | 2467 | 2477 |
| HSEF2_T19 (SEQ ID NO: 685) | 2514 | 2524 |
| HSEF2_T30 (SEQ ID NO: 686) | 2873 | 2883 |
| HSEF2_T38 (SEQ ID NO: 687) | 2826 | 2836 |
| HSEF2_T42 (SEQ ID NO: 688) | 2020 | 2030 |
| HSEF2_T47 (SEQ ID NO: 689) | 2020 | 2030 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_90 (SEQ ID NO:772) according to the present invention is supported by 245 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 719 below describes the starting and ending position of this segment on each transcript.

TABLE 719

Segment location on transcripts

| Transcript name | Segment starting position | Segment ending position |
|---|---|---|
| HSEF2_T13 (SEQ ID NO: 684) | 2478 | 2516 |
| HSEF2_T19 (SEQ ID NO: 685) | 2525 | 2563 |

TABLE 719-continued

Segment location on transcripts

| Transcript name | Segment starting position | Segment ending position |
|---|---|---|
| HSEF2_T30 (SEQ ID NO: 686) | 2884 | 2922 |
| HSEF2_T38 (SEQ ID NO: 687) | 2837 | 2875 |
| HSEF2_T42 (SEQ ID NO: 688) | 2031 | 2069 |
| HSEF2_T47 (SEQ ID NO: 689) | 2031 | 2069 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_91 (SEQ ID NO:773) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 720 below describes the starting and ending position of this segment on each transcript.

TABLE 720

Segment location on transcripts

| Transcript name | Segment starting position | Segment ending position |
|---|---|---|
| HSEF2_T13 (SEQ ID NO: 684) | 2517 | 2537 |
| HSEF2_T19 (SEQ ID NO: 685) | 2564 | 2584 |
| HSEF2_T30 (SEQ ID NO: 686) | 2923 | 2943 |
| HSEF2_T38 (SEQ ID NO: 687) | 2876 | 2896 |
| HSEF2_T42 (SEQ ID NO: 688) | 2070 | 2090 |
| HSEF2_T47 (SEQ ID NO: 689) | 2070 | 2090 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_92 (SEQ ID NO:774) according to the present invention is supported by 240 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 721 below describes the starting and ending position of this segment on each transcript.

TABLE 721

Segment location on transcripts

| Transcript name | Segment starting position | Segment ending position |
|---|---|---|
| HSEF2_T13 (SEQ ID NO: 684) | 2538 | 2603 |
| HSEF2_T19 (SEQ ID NO: 685) | 2585 | 2650 |
| HSEF2_T30 (SEQ ID NO: 686) | 2944 | 3009 |

TABLE 721-continued

Segment location on transcripts

| Transcript name | Segment starting position | Segment ending position |
|---|---|---|
| HSEF2_T38 (SEQ ID NO: 687) | 2897 | 2962 |
| HSEF2_T42 (SEQ ID NO: 688) | 2091 | 2156 |
| HSEF2_T47 (SEQ ID NO: 689) | 2091 | 2156 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_96 (SEQ ID NO:775) according to the present invention is supported by 246 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 722 below describes the starting and ending position of this segment on each transcript.

TABLE 722

Segment location on transcripts

| Transcript name | Segment starting position | Segment ending position |
|---|---|---|
| HSEF2_T13 (SEQ ID NO: 684) | 2604 | 2703 |
| HSEF2_T19 (SEQ ID NO: 685) | 2651 | 2750 |
| HSEF2_T30 (SEQ ID NO: 686) | 3010 | 3109 |
| HSEF2_T38 (SEQ ID NO: 687) | 2963 | 3062 |
| HSEF2_T42 (SEQ ID NO: 688) | 2157 | 2256 |
| HSEF2_T47 (SEQ ID NO: 689) | 2157 | 2256 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_97 (SEQ ID NO:776) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 723 below describes the starting and ending position of this segment on each transcript.

TABLE 723

Segment location on transcripts

| Transcript name | Segment starting position | Segment ending position |
|---|---|---|
| HSEF2_T13 (SEQ ID NO: 684) | 2704 | 2709 |
| HSEF2_T19 (SEQ ID NO: 685) | 2751 | 2756 |
| HSEF2_T30 (SEQ ID NO: 686) | 3110 | 3115 |
| HSEF2_T38 (SEQ ID NO: 687) | 3063 | 3068 |

TABLE 723-continued

Segment location on transcripts

| Transcript name | Segment starting position | Segment ending position |
|---|---|---|
| HSEF2_T42 (SEQ ID NO: 688) | 2257 | 2262 |
| HSEF2_T47 (SEQ ID NO: 689) | 2257 | 2262 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_98 (SEQ ID NO:777) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 724 below describes the starting and ending position of this segment on each transcript.

TABLE 724

Segment location on transcripts

| Transcript name | Segment starting position | Segment ending position |
|---|---|---|
| HSEF2_T13 (SEQ ID NO: 684) | 2710 | 2728 |
| HSEF2_T19 (SEQ ID NO: 685) | 2757 | 2775 |
| HSEF2_T30 (SEQ ID NO: 686) | 3116 | 3134 |
| HSEF2_T38 (SEQ ID NO: 687) | 3069 | 3087 |
| HSEF2_T42 (SEQ ID NO: 688) | 2263 | 2281 |
| HSEF2_T47 (SEQ ID NO: 689) | 2263 | 2281 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_99 (SEQ ID NO:778) according to the present invention is supported by 215 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 725 below describes the starting and ending position of this segment on each transcript.

TABLE 725

Segment location on transcripts

| Transcript name | Segment starting position | Segment ending position |
|---|---|---|
| HSEF2_T13 (SEQ ID NO: 684) | 2729 | 2767 |
| HSEF2_T19 (SEQ ID NO: 685) | 2776 | 2814 |
| HSEF2_T30 (SEQ ID NO: 686) | 3135 | 3173 |
| HSEF2_T38 (SEQ ID NO: 687) | 3088 | 3126 |

TABLE 725-continued

Segment location on transcripts

| Transcript name | Segment starting position | Segment ending position |
|---|---|---|
| HSEF2_T42 (SEQ ID NO: 688) | 2282 | 2320 |
| HSEF2_T47 (SEQ ID NO: 689) | 2282 | 2320 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_100 (SEQ ID NO:779) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 726 below describes the starting and ending position of this segment on each transcript.

TABLE 726

Segment location on transcripts

| Transcript name | Segment starting position | Segment ending position |
|---|---|---|
| HSEF2_T13 (SEQ ID NO: 684) | 2768 | 2771 |
| HSEF2_T19 (SEQ ID NO: 685) | 2815 | 2818 |
| HSEF2_T30 (SEQ ID NO: 686) | 3174 | 3177 |
| HSEF2_T38 (SEQ ID NO: 687) | 3127 | 3130 |
| HSEF2_T42 (SEQ ID NO: 688) | 2321 | 2324 |
| HSEF2_T47 (SEQ ID NO: 689) | 2321 | 2324 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_101 (SEQ ID NO:780) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 727 below describes the starting and ending position of this segment on each transcript.

TABLE 727

Segment location on transcripts

| Transcript name | Segment starting position | Segment ending position |
|---|---|---|
| HSEF2_T13 (SEQ ID NO: 684) | 2772 | 2786 |
| HSEF2_T19 (SEQ ID NO: 685) | 2819 | 2833 |
| HSEF2_T30 (SEQ ID NO: 686) | 3178 | 3192 |
| HSEF2_T38 (SEQ ID NO: 687) | 3131 | 3145 |
| HSEF2_T42 (SEQ ID NO: 688) | 2325 | 2339 |
| HSEF2_T47 (SEQ ID NO: 689) | 2325 | 2339 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_102 (SEQ ID NO:781) according to the present invention is supported by 2 libraries. The number of libraries was determined as previously described. This segment can be found in the following transcript(s): HSEF2_T47 (SEQ ID NO:689). Table 728 below describes the starting and ending position of this segment on each transcript.

TABLE 728

Segment location on transcripts

| Transcript name | Segment starting position | Segment ending position |
|---|---|---|
| HSEF2_T47 (SEQ ID NO: 689) | 2340 | 2419 |

This segment can be found in the following protein(s): HSEF2_P6.

Segment cluster HSEF2_node_103 (SEQ ID NO:782) according to the present invention is supported by 236 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 729 below describes the starting and ending position of this segment on each transcript.

TABLE 729

Segment location on transcripts

| Transcript name | Segment starting position | Segment ending position |
|---|---|---|
| HSEF2_T13 (SEQ ID NO: 684) | 2787 | 2833 |
| HSEF2_T19 (SEQ ID NO: 685) | 2834 | 2880 |
| HSEF2_T30 (SEQ ID NO: 686) | 3193 | 3239 |
| HSEF2_T38 (SEQ ID NO: 687) | 3146 | 3192 |
| HSEF2_T42 (SEQ ID NO: 688) | 2340 | 2386 |
| HSEF2_T47 (SEQ ID NO: 689) | 2420 | 2466 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15, HSEF2_P22, HSEF2_P26 and HSEF2_P6, since it is in the coding region for the corresponding transcript.

Segment cluster HSEF2_node_104 (SEQ ID NO:783) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 730 below describes the starting and ending position of this segment on each transcript.

TABLE 730

Segment location on transcripts

| Transcript name | Segment starting position | Segment ending position |
|---|---|---|
| HSEF2_T13 (SEQ ID NO: 684) | 2834 | 2848 |
| HSEF2_T19 (SEQ ID NO: 685) | 2881 | 2895 |
| HSEF2_T30 (SEQ ID NO: 686) | 3240 | 3254 |
| HSEF2_T38 (SEQ ID NO: 687) | 3193 | 3207 |
| HSEF2_T42 (SEQ ID NO: 688) | 2387 | 2401 |
| HSEF2_T47 (SEQ ID NO: 689) | 2467 | 2481 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node_105 (SEQ ID NO:784) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 731 below describes the starting and ending position of this segment on each transcript.

TABLE 731

Segment location on transcripts

| Transcript name | Segment starting position | Segment ending position |
|---|---|---|
| HSEF2_T13 (SEQ ID NO: 684) | 2849 | 2854 |
| HSEF2_T19 (SEQ ID NO: 685) | 2896 | 2901 |
| HSEF2_T30 (SEQ ID NO: 686) | 3255 | 3260 |
| HSEF2_T38 (SEQ ID NO: 687) | 3208 | 3213 |
| HSEF2_T42 (SEQ ID NO: 688) | 2402 | 2407 |
| HSEF2_T47 (SEQ ID NO: 689) | 2482 | 2487 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node_106 (SEQ ID NO:785) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 732 below describes the starting and ending position of this segment on each transcript.

TABLE 732

Segment location on transcripts

| Transcript name | Segment starting position | Segment ending position |
|---|---|---|
| HSEF2_T13 (SEQ ID NO: 684) | 2855 | 2861 |
| HSEF2_T19 (SEQ ID NO: 685) | 2902 | 2908 |
| HSEF2_T30 (SEQ ID NO: 686) | 3261 | 3267 |
| HSEF2_T38 (SEQ ID NO: 687) | 3214 | 3220 |

TABLE 732-continued

Segment location on transcripts

| Transcript name | Segment starting position | Segment ending position |
|---|---|---|
| HSEF2_T42 (SEQ ID NO: 688) | 2408 | 2414 |
| HSEF2_T47 (SEQ ID NO: 689) | 2488 | 2494 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node__107 (SEQ ID NO:786) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 733 below describes the starting and ending position of this segment on each transcript.

TABLE 733

Segment location on transcripts

| Transcript name | Segment starting position | Segment ending position |
|---|---|---|
| HSEF2_T13 (SEQ ID NO: 684) | 2862 | 2866 |
| HSEF2_T19 (SEQ ID NO: 685) | 2909 | 2913 |
| HSEF2_T30 (SEQ ID NO: 686) | 3268 | 3272 |
| HSEF2_T38 (SEQ ID NO: 687) | 3221 | 3225 |
| HSEF2_T42 (SEQ ID NO: 688) | 2415 | 2419 |
| HSEF2_T47 (SEQ ID NO: 689) | 2495 | 2499 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node__108 (SEQ ID NO:787) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 734 below describes the starting and ending position of this segment on each transcript.

TABLE 734

Segment location on transcripts

| Transcript name | Segment starting position | Segment ending position |
|---|---|---|
| HSEF2_T13 (SEQ ID NO: 684) | 2867 | 2872 |
| HSEF2_T19 (SEQ ID NO: 685) | 2914 | 2919 |
| HSEF2_T30 (SEQ ID NO: 686) | 3273 | 3278 |
| HSEF2_T38 (SEQ ID NO: 687) | 3226 | 3231 |

TABLE 734-continued

Segment location on transcripts

| Transcript name | Segment starting position | Segment ending position |
|---|---|---|
| HSEF2_T42 (SEQ ID NO: 688) | 2420 | 2425 |
| HSEF2_T47 (SEQ ID NO: 689) | 2500 | 2505 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node__109 (SEQ ID NO:788) according to the present invention can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 735 below describes the starting and ending position of this segment on each transcript.

TABLE 735

Segment location on transcripts

| Transcript name | Segment starting position | Segment ending position |
|---|---|---|
| HSEF2_T13 (SEQ ID NO: 684) | 2873 | 2878 |
| HSEF2_T19 (SEQ ID NO: 685) | 2920 | 2925 |
| HSEF2_T30 (SEQ ID NO: 686) | 3279 | 3284 |
| HSEF2_T38 (SEQ ID NO: 687) | 3232 | 3237 |
| HSEF2_T42 (SEQ ID NO: 688) | 2426 | 2431 |
| HSEF2_T47 (SEQ ID NO: 689) | 2506 | 2511 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node__110 (SEQ ID NO:789) according to the present invention is supported by 258 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686), HSEF2_T38 (SEQ ID NO:687), HSEF2_T42 (SEQ ID NO:688) and HSEF2_T47 (SEQ ID NO:689). Table 736 below describes the starting and ending position of this segment on each transcript.

TABLE 736

Segment location on transcripts

| Transcript name | Segment starting position | Segment ending position |
|---|---|---|
| HSEF2_T13 (SEQ ID NO: 684) | 2879 | 2919 |
| HSEF2_T19 (SEQ ID NO: 685) | 2926 | 2966 |
| HSEF2_T30 (SEQ ID NO: 686) | 3285 | 3325 |

TABLE 736-continued

| Transcript name | Segment starting position | Segment ending position |
|---|---|---|
| HSEF2_T38 (SEQ ID NO: 687) | 3238 | 3278 |
| HSEF2_T42 (SEQ ID NO: 688) | 2432 | 2472 |
| HSEF2_T47 (SEQ ID NO: 689) | 2512 | 2552 |

This segment can be found in both coding and non-coding regions of transcript(s) as follows. The segment can be found in a non-coding region of transcript(s) that are related to the following protein(s): HSEF2_P2 and HSEF2_P6. This segment can also be found in the following protein(s): HSEF2_P7, HSEF2_P15, HSEF2_P22 and HSEF2_P26, since it is in the coding region for the corresponding transcript.

Segment cluster HSEF2_node__113 (SEQ ID NO:790) according to the present invention is supported by 262 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 737 below describes the starting and ending position of this segment on each transcript.

TABLE 737

| Transcript name | Segment starting position | Segment ending position |
|---|---|---|
| HSEF2_T13 (SEQ ID NO: 684) | 2920 | 2993 |
| HSEF2_T19 (SEQ ID NO: 685) | 2967 | 3040 |
| HSEF2_T30 (SEQ ID NO: 686) | 3326 | 3399 |
| HSEF2_T38 (SEQ ID NO: 687) | 3279 | 3352 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node__114 (SEQ ID NO:791) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 738 below describes the starting and ending position of this segment on each transcript.

TABLE 738

| Transcript name | Segment starting position | Segment ending position |
|---|---|---|
| HSEF2_T13 (SEQ ID NO: 684) | 2994 | 3000 |
| HSEF2_T19 (SEQ ID NO: 685) | 3041 | 3047 |
| HSEF2_T30 (SEQ ID NO: 686) | 3400 | 3406 |
| HSEF2_T38 (SEQ ID NO: 687) | 3353 | 3359 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node__115 (SEQ ID NO:792) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 739 below describes the starting and ending position of this segment on each transcript.

TABLE 739

| Transcript name | Segment starting position | Segment ending position |
|---|---|---|
| HSEF2_T13 (SEQ ID NO: 684) | 3001 | 3007 |
| HSEF2_T19 (SEQ ID NO: 685) | 3048 | 3054 |
| HSEF2_T30 (SEQ ID NO: 686) | 3407 | 3413 |
| HSEF2_T38 (SEQ ID NO: 687) | 3360 | 3366 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node__116 (SEQ ID NO:793) according to the present invention is supported by 241 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 740 below describes the starting and ending position of this segment on each transcript.

TABLE 740

| Transcript name | Segment starting position | Segment ending position |
|---|---|---|
| HSEF2_T13 (SEQ ID NO: 684) | 3008 | 3035 |
| HSEF2_T19 (SEQ ID NO: 685) | 3055 | 3082 |
| HSEF2_T30 (SEQ ID NO: 686) | 3414 | 3441 |
| HSEF2_T38 (SEQ ID NO: 687) | 3367 | 3394 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node__117 (SEQ ID NO:794) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 741 below describes the starting and ending position of this segment on each transcript.

TABLE 741

Segment location on transcripts

| Transcript name | Segment starting position | Segment ending position |
|---|---|---|
| HSEF2_T13 (SEQ ID NO: 684) | 3036 | 3042 |
| HSEF2_T19 (SEQ ID NO: 685) | 3083 | 3089 |
| HSEF2_T30 (SEQ ID NO: 686) | 3442 | 3448 |
| HSEF2_T38 (SEQ ID NO: 687) | 3395 | 3401 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node_118 (SEQ ID NO:795) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 742 below describes the starting and ending position of this segment on each transcript.

TABLE 742

Segment location on transcripts

| Transcript name | Segment starting position | Segment ending position |
|---|---|---|
| HSEF2_T13 (SEQ ID NO: 684) | 3043 | 3051 |
| HSEF2_T19 (SEQ ID NO: 685) | 3090 | 3098 |
| HSEF2_T30 (SEQ ID NO: 686) | 3449 | 3457 |
| HSEF2_T38 (SEQ ID NO: 687) | 3402 | 3410 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node_119 (SEQ ID NO:796) according to the present invention is supported by 226 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 743 below describes the starting and ending position of this segment on each transcript.

TABLE 743

Segment location on transcripts

| Transcript name | Segment starting position | Segment ending position |
|---|---|---|
| HSEF2_T13 (SEQ ID NO: 684) | 3052 | 3086 |
| HSEF2_T19 (SEQ ID NO: 685) | 3099 | 3133 |
| HSEF2_T30 (SEQ ID NO: 686) | 3458 | 3492 |
| HSEF2_T38 (SEQ ID NO: 687) | 3411 | 3445 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node_120 (SEQ ID NO:797) according to the present invention is supported by 254 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 744 below describes the starting and ending position of this segment on each transcript.

TABLE 744

Segment location on transcripts

| Transcript name | Segment starting position | Segment ending position |
|---|---|---|
| HSEF2_T13 (SEQ ID NO: 684) | 3087 | 3113 |
| HSEF2_T19 (SEQ ID NO: 685) | 3134 | 3160 |
| HSEF2_T30 (SEQ ID NO: 686) | 3493 | 3519 |
| HSEF2_T38 (SEQ ID NO: 687) | 3446 | 3472 |

This segment can be found in both coding and non-coding regions of transcript(s) as follows. The segment can be found in a non-coding region of transcript(s) that are related to the following protein(s): HSEF2_P2. This segment can also be found in the following protein(s): HSEF2_P7, HSEF2_P15 and HSEF2_P22, since it is in the coding region for the corresponding transcript.

Segment cluster HSEF2_node_121 (SEQ ID NO:798) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 745 below describes the starting and ending position of this segment on each transcript.

TABLE 745

Segment location on transcripts

| Transcript name | Segment starting position | Segment ending position |
|---|---|---|
| HSEF2_T13 (SEQ ID NO: 684) | 3114 | 3119 |
| HSEF2_T19 (SEQ ID NO: 685) | 3161 | 3166 |
| HSEF2_T30 (SEQ ID NO: 686) | 3520 | 3525 |
| HSEF2_T38 (SEQ ID NO: 687) | 3473 | 3478 |

This segment can be found in a non-coding region of transcript(s) that are related to the following protein(s): HSEF2_P2, HSEF2_P7, HSEF2_P15 and HSEF2_P22.

Segment cluster HSEF2_node_122 (SEQ ID NO:799) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 746 below describes the starting and ending position of this segment on each transcript.

TABLE 746

Segment location on transcripts

| Transcript name | Segment starting position | Segment ending position |
|---|---|---|
| HSEF2_T13 (SEQ ID NO: 684) | 3120 | 3129 |
| HSEF2_T19 (SEQ ID NO: 685) | 3167 | 3176 |
| HSEF2_T30 (SEQ ID NO: 686) | 3526 | 3535 |
| HSEF2_T38 (SEQ ID NO: 687) | 3479 | 3488 |

This segment can be found in a non-coding region of transcript(s) that are related to the following protein(s): HSEF2_P2, HSEF2_P7, HSEF2_P15 and HSEF2_P22.

Segment cluster HSEF2_node_123 (SEQ ID NO:800) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 747 below describes the starting and ending position of this segment on each transcript.

TABLE 747

Segment location on transcripts

| Transcript name | Segment starting position | Segment ending position |
|---|---|---|
| HSEF2_T13 (SEQ ID NO: 684) | 3130 | 3140 |
| HSEF2_T19 (SEQ ID NO: 685) | 3177 | 3187 |
| HSEF2_T30 (SEQ ID NO: 686) | 3536 | 3546 |
| HSEF2_T38 (SEQ ID NO: 687) | 3489 | 3499 |

This segment can be found in a non-coding region of transcript(s) that are related to the following protein(s): HSEF2_P2, HSEF2_P7, HSEF2_P15 and HSEF2_P22.

Segment cluster HSEF2_node_124 (SEQ ID NO:801) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 748 below describes the starting and ending position of this segment on each transcript.

TABLE 748

Segment location on transcripts

| Transcript name | Segment starting position | Segment ending position |
|---|---|---|
| HSEF2_T13 (SEQ ID NO: 684) | 3141 | 3144 |
| HSEF2_T19 (SEQ ID NO: 685) | 3188 | 3191 |
| HSEF2_T30 (SEQ ID NO: 686) | 3547 | 3550 |
| HSEF2_T38 (SEQ ID NO: 687) | 3500 | 3503 |

This segment can be found in a non-coding region of transcript(s) that are related to the following protein(s): HSEF2_P2, HSEF2_P7, HSEF2_P15 and HSEF2_P22.

Segment cluster HSEF2_node_125 (SEQ ID NO:802) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 749 below describes the starting and ending position of this segment on each transcript.

TABLE 749

Segment location on transcripts

| Transcript name | Segment starting position | Segment ending position |
|---|---|---|
| HSEF2_T13 (SEQ ID NO: 684) | 3145 | 3148 |
| HSEF2_T19 (SEQ ID NO: 685) | 3192 | 3195 |
| HSEF2_T30 (SEQ ID NO: 686) | 3551 | 3554 |
| HSEF2_T38 (SEQ ID NO: 687) | 3504 | 3507 |

This segment can be found in a non-coding region of transcript(s) that are related to the following protein(s): HSEF2_P2, HSEF2_P7, HSEF2_P15 and HSEF2_P22.

Segment cluster HSEF2_node_126 (SEQ ID NO:803) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 750 below describes the starting and ending position of this segment on each transcript.

TABLE 750

Segment location on transcripts

| Transcript name | Segment starting position | Segment ending position |
|---|---|---|
| HSEF2_T13 (SEQ ID NO: 684) | 3149 | 3157 |
| HSEF2_T19 (SEQ ID NO: 685) | 3196 | 3204 |
| HSEF2_T30 (SEQ ID NO: 686) | 3555 | 3563 |
| HSEF2_T38 (SEQ ID NO: 687) | 3508 | 3516 |

This segment can be found in a non-coding region of transcript(s) that are related to the following protein(s): HSEF2_P2, HSEF2_P7, HSEF2_P15 and HSEF2_P22.

Segment cluster HSEF2_node_127 (SEQ ID NO:804) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 751 below describes the starting and ending position of this segment on each transcript.

TABLE 751

Segment location on transcripts

| Transcript name | Segment starting position | Segment ending position |
|---|---|---|
| HSEF2_T13 (SEQ ID NO: 684) | 3158 | 3163 |
| HSEF2_T19 (SEQ ID NO: 685) | 3205 | 3210 |
| HSEF2_T30 (SEQ ID NO: 686) | 3564 | 3569 |
| HSEF2_T38 (SEQ ID NO: 687) | 3517 | 3522 |

This segment can be found in a non-coding region of transcript(s) that are related to the following protein(s): HSEF2_P2, HSEF2_P7, HSEF2_P15 and HSEF2_P22.

Segment cluster HSEF2_node_128 (SEQ ID NO:805) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 752 below describes the starting and ending position of this segment on each transcript.

TABLE 752

Segment location on transcripts

| Transcript name | Segment starting position | Segment ending position |
|---|---|---|
| HSEF2_T13 (SEQ ID NO: 684) | 3164 | 3169 |
| HSEF2_T19 (SEQ ID NO: 685) | 3211 | 3216 |
| HSEF2_T30 (SEQ ID NO: 686) | 3570 | 3575 |
| HSEF2_T38 (SEQ ID NO: 687) | 3523 | 3528 |

This segment can be found in a non-coding region of transcript(s) that are related to the following protein(s): HSEF2_P2, HSEF2_P7, HSEF2_P15 and HSEF2_P22.

Segment cluster HSEF2_node_129 (SEQ ID NO:806) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 753 below describes the starting and ending position of this segment on each transcript.

TABLE 753

Segment location on transcripts

| Transcript name | Segment starting position | Segment ending position |
|---|---|---|
| HSEF2_T13 (SEQ ID NO: 684) | 3170 | 3185 |
| HSEF2_T19 (SEQ ID NO: 685) | 3217 | 3232 |
| HSEF2_T30 (SEQ ID NO: 686) | 3576 | 3591 |
| HSEF2_T38 (SEQ ID NO: 687) | 3529 | 3544 |

This segment can be found in a non-coding region of transcript(s) that are related to the following protein(s): HSEF2_P2, HSEF2_P7, HSEF2_P15 and HSEF2_P22.

Segment cluster HSEF2_node_130 (SEQ ID NO:807) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 754 below describes the starting and ending position of this segment on each transcript.

TABLE 754

Segment location on transcripts

| Transcript name | Segment starting position | Segment ending position |
|---|---|---|
| HSEF2_T13 (SEQ ID NO: 684) | 3186 | 3192 |
| HSEF2_T19 (SEQ ID NO: 685) | 3233 | 3239 |
| HSEF2_T30 (SEQ ID NO: 686) | 3592 | 3598 |
| HSEF2_T38 (SEQ ID NO: 687) | 3545 | 3551 |

This segment can be found in a non-coding region of transcript(s) that are related to the following protein(s): HSEF2_P2, HSEF2_P7, HSEF2_P15 and HSEF2_P22.

Segment cluster HSEF2_node_131 (SEQ ID NO:808) according to the present invention is supported by 320 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 755 below describes the starting and ending position of this segment on each transcript.

TABLE 755

Segment location on transcripts

| Transcript name | Segment starting position | Segment ending position |
|---|---|---|
| HSEF2_T13 (SEQ ID NO: 684) | 3193 | 3223 |
| HSEF2_T19 (SEQ ID NO: 685) | 3240 | 3270 |
| HSEF2_T30 (SEQ ID NO: 686) | 3599 | 3629 |
| HSEF2_T38 (SEQ ID NO: 687) | 3552 | 3582 |

This segment can be found in a non-coding region of transcript(s) that are related to the following protein(s): HSEF2_P2, HSEF2_P7, HSEF2_P15 and HSEF2_P22.

Segment cluster HSEF2_node_132 (SEQ ID NO:809) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 756 below describes the starting and ending position of this segment on each transcript.

TABLE 756

Segment location on transcripts

| Transcript name | Segment starting position | Segment ending position |
|---|---|---|
| HSEF2_T13 (SEQ ID NO: 684) | 3224 | 3230 |
| HSEF2_T19 (SEQ ID NO: 685) | 3271 | 3277 |
| HSEF2_T30 (SEQ ID NO: 686) | 3630 | 3636 |
| HSEF2_T38 (SEQ ID NO: 687) | 3583 | 3589 |

This segment can be found in a non-coding region of transcript(s) that are related to the following protein(s): HSEF2_P2, HSEF2_P7, HSEF2_P15 and HSEF2_P22.

Segment cluster HSEF2_node_133 (SEQ ID NO:810) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 757 below describes the starting and ending position of this segment on each transcript.

TABLE 757

Segment location on transcripts

| Transcript name | Segment starting position | Segment ending position |
|---|---|---|
| HSEF2_T13 (SEQ ID NO: 684) | 3231 | 3244 |
| HSEF2_T19 (SEQ ID NO: 685) | 3278 | 3291 |
| HSEF2_T30 (SEQ ID NO: 686) | 3637 | 3650 |
| HSEF2_T38 (SEQ ID NO: 687) | 3590 | 3603 |

This segment can be found in a non-coding region of transcript(s) that are related to the following protein(s): HSEF2_P2, HSEF2_P7, HSEF2_P15 and HSEF2_P22.

Segment cluster HSEF2_node_134 (SEQ ID NO:811) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 758 below describes the starting and ending position of this segment on each transcript.

TABLE 758

Segment location on transcripts

| Transcript name | Segment starting position | Segment ending position |
|---|---|---|
| HSEF2_T13 (SEQ ID NO: 684) | 3245 | 3257 |
| HSEF2_T19 (SEQ ID NO: 685) | 3292 | 3304 |
| HSEF2_T30 (SEQ ID NO: 686) | 3651 | 3663 |
| HSEF2_T38 (SEQ ID NO: 687) | 3604 | 3616 |

This segment can be found in a non-coding region of transcript(s) that are related to the following protein(s): HSEF2_P2, HSEF2_P7, HSEF2_P15 and HSEF2_P22.

Segment cluster HSEF2_node_135 (SEQ ID NO:812) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 759 below describes the starting and ending position of this segment on each transcript.

TABLE 759

Segment location on transcripts

| Transcript name | Segment starting position | Segment ending position |
|---|---|---|
| HSEF2_T13 (SEQ ID NO: 684) | 3258 | 3271 |
| HSEF2_T19 (SEQ ID NO: 685) | 3305 | 3318 |
| HSEF2_T30 (SEQ ID NO: 686) | 3664 | 3677 |
| HSEF2_T38 (SEQ ID NO: 687) | 3617 | 3630 |

This segment can be found in a non-coding region of transcript(s) that are related to the following protein(s): HSEF2_P2, HSEF2_P7, HSEF2_P15 and HSEF2_P22.

Segment cluster HSEF2_node_136 (SEQ ID NO:813) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 760 below describes the starting and ending position of this segment on each transcript.

TABLE 760

Segment location on transcripts

| Transcript name | Segment starting position | Segment ending position |
|---|---|---|
| HSEF2_T13 (SEQ ID NO: 684) | 3272 | 3288 |
| HSEF2_T19 (SEQ ID NO: 685) | 3319 | 3335 |
| HSEF2_T30 (SEQ ID NO: 686) | 3678 | 3694 |
| HSEF2_T38 (SEQ ID NO: 687) | 3631 | 3647 |

This segment can be found in a non-coding region of transcript(s) that are related to the following protein(s): HSEF2_P2, HSEF2_P7, HSEF2_P15 and HSEF2_P22.

Segment cluster HSEF2_node_137 (SEQ ID NO:814) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 761 below describes the starting and ending position of this segment on each transcript.

TABLE 761

Segment location on transcripts

| Transcript name | Segment starting position | Segment ending position |
|---|---|---|
| HSEF2_T13 (SEQ ID NO: 684) | 3289 | 3309 |
| HSEF2_T19 (SEQ ID NO: 685) | 3336 | 3356 |
| HSEF2_T30 (SEQ ID NO: 686) | 3695 | 3715 |
| HSEF2_T38 (SEQ ID NO: 687) | 3648 | 3668 |

This segment can be found in a non-coding region of transcript(s) that are related to the following protein(s): HSEF2_P2, HSEF2_P7, HSEF2_P15 and HSEF2_P22.

Segment cluster HSEF2_node_138 (SEQ ID NO:815) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 762 below describes the starting and ending position of this segment on each transcript.

TABLE 762

Segment location on transcripts

| Transcript name | Segment starting position | Segment ending position |
|---|---|---|
| HSEF2_T13 (SEQ ID NO: 684) | 3310 | 3319 |
| HSEF2_T19 (SEQ ID NO: 685) | 3357 | 3366 |
| HSEF2_T30 (SEQ ID NO: 686) | 3716 | 3725 |
| HSEF2_T38 (SEQ ID NO: 687) | 3669 | 3678 |

This segment can be found in a non-coding region of transcript(s) that are related to the following protein(s): HSEF2_P2, HSEF2_P7, HSEF2_P15 and HSEF2_P22.

Segment cluster HSEF2_node_139 (SEQ ID NO:816) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 763 below describes the starting and ending position of this segment on each transcript.

TABLE 763

Segment location on transcripts

| Transcript name | Segment starting position | Segment ending position |
|---|---|---|
| HSEF2_T13 (SEQ ID NO: 684) | 3320 | 3323 |
| HSEF2_T19 (SEQ ID NO: 685) | 3367 | 3370 |
| HSEF2_T30 (SEQ ID NO: 686) | 3726 | 3729 |
| HSEF2_T38 (SEQ ID NO: 687) | 3679 | 3682 |

This segment can be found in a non-coding region of transcript(s) that are related to the following protein(s): HSEF2_P2, HSEF2_P7, HSEF2_P15 and HSEF2_P22.

Segment cluster HSEF2_node_140 (SEQ ID NO:817) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 764 below describes the starting and ending position of this segment on each transcript.

TABLE 764

Segment location on transcripts

| Transcript name | Segment starting position | Segment ending position |
|---|---|---|
| HSEF2_T13 (SEQ ID NO: 684) | 3324 | 3327 |
| HSEF2_T19 (SEQ ID NO: 685) | 3371 | 3374 |
| HSEF2_T30 (SEQ ID NO: 686) | 3730 | 3733 |
| HSEF2_T38 (SEQ ID NO: 687) | 3683 | 3686 |

This segment can be found in a non-coding region of transcript(s) that are related to the following protein(s): HSEF2_P2, HSEF2_P7, HSEF2_P15 and HSEF2_P22.

Segment cluster HSEF2_node_141 (SEQ ID NO:818) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 765 below describes the starting and ending position of this segment on each transcript.

TABLE 765

Segment location on transcripts

| Transcript name | Segment starting position | Segment ending position |
|---|---|---|
| HSEF2_T13 (SEQ ID NO: 684) | 3328 | 3349 |
| HSEF2_T19 (SEQ ID NO: 685) | 3375 | 3396 |
| HSEF2_T30 (SEQ ID NO: 686) | 3734 | 3755 |
| HSEF2_T38 (SEQ ID NO: 687) | 3687 | 3708 |

This segment can be found in a non-coding region of transcript(s) that are related to the following protein(s): HSEF2_P2, HSEF2_P7, HSEF2_P15 and HSEF2_P22.

Segment cluster HSEF2_node_142 (SEQ ID NO:819) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 766 below describes the starting and ending position of this segment on each transcript.

TABLE 766

Segment location on transcripts

| Transcript name | Segment starting position | Segment ending position |
|---|---|---|
| HSEF2_T13 (SEQ ID NO: 684) | 3350 | 3360 |
| HSEF2_T19 (SEQ ID NO: 685) | 3397 | 3407 |
| HSEF2_T30 (SEQ ID NO: 686) | 3756 | 3766 |
| HSEF2_T38 (SEQ ID NO: 687) | 3709 | 3719 |

This segment can be found in a non-coding region of transcript(s) that are related to the following protein(s): HSEF2_P2, HSEF2_P7, HSEF2_P15 and HSEF2_P22.

Segment cluster HSEF2_node_143 (SEQ ID NO:820) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 767 below describes the starting and ending position of this segment on each transcript.

TABLE 767

Segment location on transcripts

| Transcript name | Segment starting position | Segment ending position |
|---|---|---|
| HSEF2_T13 (SEQ ID NO: 684) | 3361 | 3366 |
| HSEF2_T19 (SEQ ID NO: 685) | 3408 | 3413 |
| HSEF2_T30 (SEQ ID NO: 686) | 3767 | 3772 |
| HSEF2_T38 (SEQ ID NO: 687) | 3720 | 3725 |

This segment can be found in a non-coding region of transcript(s) that are related to the following protein(s): HSEF2_P2, HSEF2_P7, HSEF2_P15 and HSEF2_P22.

Segment cluster HSEF2_node_144 (SEQ ID NO:821) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 768 below describes the starting and ending position of this segment on each transcript.

TABLE 768

Segment location on transcripts

| Transcript name | Segment starting position | Segment ending position |
|---|---|---|
| HSEF2_T13 (SEQ ID NO: 684) | 3367 | 3380 |
| HSEF2_T19 (SEQ ID NO: 685) | 3414 | 3427 |
| HSEF2_T30 (SEQ ID NO: 686) | 3773 | 3786 |
| HSEF2_T38 (SEQ ID NO: 687) | 3726 | 3739 |

This segment can be found in a non-coding region of transcript(s) that are related to the following protein(s): HSEF2_P2, HSEF2_P7, HSEF2_P15 and HSEF2_P22.

Segment cluster HSEF2_node_145 (SEQ ID NO:822) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 769 below describes the starting and ending position of this segment on each transcript.

TABLE 769

Segment location on transcripts

| Transcript name | Segment starting position | Segment ending position |
|---|---|---|
| HSEF2_T13 (SEQ ID NO: 684) | 3381 | 3387 |
| HSEF2_T19 (SEQ ID NO: 685) | 3428 | 3434 |
| HSEF2_T30 (SEQ ID NO: 686) | 3787 | 3793 |
| HSEF2_T38 (SEQ ID NO: 687) | 3740 | 3746 |

This segment can be found in a non-coding region of transcript(s) that are related to the following protein(s): HSEF2_P2, HSEF2_P7, HSEF2_P15 and HSEF2_P22.

Segment cluster HSEF2_node_146 (SEQ ID NO:823) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 770 below describes the starting and ending position of this segment on each transcript.

TABLE 770

Segment location on transcripts

| Transcript name | Segment starting position | Segment ending position |
|---|---|---|
| HSEF2_T13 (SEQ ID NO: 684) | 3388 | 3411 |
| HSEF2_T19 (SEQ ID NO: 685) | 3435 | 3458 |
| HSEF2_T30 (SEQ ID NO: 686) | 3794 | 3817 |
| HSEF2_T38 (SEQ ID NO: 687) | 3747 | 3770 |

This segment can be found in a non-coding region of transcript(s) that are related to the following protein(s): HSEF2_P2, HSEF2_P7, HSEF2_P15 and HSEF2_P22.

Segment cluster HSEF2_node_147 (SEQ ID NO:824) according to the present invention is supported by 272 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 771 below describes the starting and ending position of this segment on each transcript.

TABLE 771

Segment location on transcripts

| Transcript name | Segment starting position | Segment ending position |
|---|---|---|
| HSEF2_T13 (SEQ ID NO: 684) | 3412 | 3443 |
| HSEF2_T19 (SEQ ID NO: 685) | 3459 | 3490 |
| HSEF2_T30 (SEQ ID NO: 686) | 3818 | 3849 |
| HSEF2_T38 (SEQ ID NO: 687) | 3771 | 3802 |

This segment can be found in a non-coding region of transcript(s) that are related to the following protein(s): HSEF2_P2, HSEF2_P7, HSEF2_P15 and HSEF2_P22.

Segment cluster HSEF2_node_148 (SEQ ID NO:825) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 772 below describes the starting and ending position of this segment on each transcript.

TABLE 772

Segment location on transcripts

| Transcript name | Segment starting position | Segment ending position |
|---|---|---|
| HSEF2_T13 (SEQ ID NO: 684) | 3444 | 3450 |
| HSEF2_T19 (SEQ ID NO: 685) | 3491 | 3497 |
| HSEF2_T30 (SEQ ID NO: 686) | 3850 | 3856 |
| HSEF2_T38 (SEQ ID NO: 687) | 3803 | 3809 |

This segment can be found in a non-coding region of transcript(s) that are related to the following protein(s): HSEF2_P2, HSEF2_P7, HSEF2_P15 and HSEF2_P22.

Segment cluster HSEF2_node_149 (SEQ ID NO:826) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 773 below describes the starting and ending position of this segment on each transcript.

TABLE 773

Segment location on transcripts

| Transcript name | Segment starting position | Segment ending position |
|---|---|---|
| HSEF2_T13 (SEQ ID NO: 684) | 3451 | 3475 |
| HSEF2_T19 (SEQ ID NO: 685) | 3498 | 3522 |
| HSEF2_T30 (SEQ ID NO: 686) | 3857 | 3881 |
| HSEF2_T38 (SEQ ID NO: 687) | 3810 | 3834 |

This segment can be found in a non-coding region of transcript(s) that are related to the following protein(s): HSEF2_P2, HSEF2_P7, HSEF2_P15 and HSEF2_P22.

Segment cluster HSEF2_node_150 (SEQ ID NO:827) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 774 below describes the starting and ending position of this segment on each transcript.

TABLE 774

Segment location on transcripts

| Transcript name | Segment starting position | Segment ending position |
|---|---|---|
| HSEF2_T13 (SEQ ID NO: 684) | 3476 | 3490 |
| HSEF2_T19 (SEQ ID NO: 685) | 3523 | 3537 |
| HSEF2_T30 (SEQ ID NO: 686) | 3882 | 3896 |
| HSEF2_T38 (SEQ ID NO: 687) | 3835 | 3849 |

This segment can be found in a non-coding region of transcript(s) that are related to the following protein(s): HSEF2_P2, HSEF2_P7, HSEF2_P15 and HSEF2_P22.

Segment cluster HSEF2_node_151 (SEQ ID NO:828) according to the present invention can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 775 below describes the starting and ending position of this segment on each transcript.

TABLE 775

Segment location on transcripts

| Transcript name | Segment starting position | Segment ending position |
|---|---|---|
| HSEF2_T13 (SEQ ID NO: 684) | 3491 | 3507 |
| HSEF2_T19 (SEQ ID NO: 685) | 3538 | 3554 |
| HSEF2_T30 (SEQ ID NO: 686) | 3897 | 3913 |
| HSEF2_T38 (SEQ ID NO: 687) | 3850 | 3866 |

This segment can be found in a non-coding region of transcript(s) that are related to the following protein(s): HSEF2_P2, HSEF2_P7, HSEF2_P15 and HSEF2_P22.

Segment cluster HSEF2_node_152 (SEQ ID NO:829) according to the present invention is supported by 226 libraries. The number of libraries was determined as previously described. This segment can be found in the following transcript(s): HSEF2_T13 (SEQ ID NO:684), HSEF2_T19 (SEQ ID NO:685), HSEF2_T30 (SEQ ID NO:686) and HSEF2_T38 (SEQ ID NO:687). Table 776 below describes the starting and ending position of this segment on each transcript.

TABLE 776

Segment location on transcripts

| Transcript name | Segment starting position | Segment ending position |
|---|---|---|
| HSEF2_T13 (SEQ ID NO: 684) | 3508 | 3539 |
| HSEF2_T19 (SEQ ID NO: 685) | 3555 | 3586 |
| HSEF2_T30 (SEQ ID NO: 686) | 3914 | 3945 |
| HSEF2_T38 (SEQ ID NO: 687) | 3867 | 3898 |

This segment can be found in a non-coding region of transcript(s) that are related to the following protein(s): HSEF2_P2, HSEF2_P7, HSEF2_P15 and HSEF2_P22.

Description for Cluster HSU03911

Cluster HSU03911 features 6 transcript(s) and 33 segment(s) of interest, the names for which are given in Tables 777 and 778, respectively, the sequences themselves are given at the end of the application. The selected protein variants are given in Table 779.

TABLE 777

Transcripts of interest
Transcript Name

HSU03911_T1 (SEQ ID NO: 830)
HSU03911_T3 (SEQ ID NO: 831)
HSU03911_T11 (SEQ ID NO: 832)
HSU03911_T12 (SEQ ID NO: 833)
HSU03911_T17 (SEQ ID NO: 834)
HSU03911_T18 (SEQ ID NO: 835)

TABLE 778

Segments of interest
Segment Name

HSU03911_node_0 (SEQ ID NO: 836)
HSU03911_node_14 (SEQ ID NO: 837)
HSU03911_node_18 (SEQ ID NO: 838)
HSU03911_node_20 (SEQ ID NO: 839)
HSU03911_node_22 (SEQ ID NO: 840)
HSU03911_node_24 (SEQ ID NO: 841)
HSU03911_node_28 (SEQ ID NO: 842)
HSU03911_node_32 (SEQ ID NO: 843)
HSU03911_node_33 (SEQ ID NO: 844)
HSU03911_node_35 (SEQ ID NO: 845)
HSU03911_node_41 (SEQ ID NO: 846)
HSU03911_node_43 (SEQ ID NO: 847)
HSU03911_node_45 (SEQ ID NO: 848)
HSU03911_node_48 (SEQ ID NO: 849)
HSU03911_node_51 (SEQ ID NO: 850)
HSU03911_node_58 (SEQ ID NO: 851)
HSU03911_node_60 (SEQ ID NO: 852)
HSU03911_node_1 (SEQ ID NO: 853)
HSU03911_node_2 (SEQ ID NO: 854)
HSU03911_node_3 (SEQ ID NO: 855)
HSU03911_node_5 (SEQ ID NO: 856)
HSU03911_node_6 (SEQ ID NO: 857)
HSU03911_node_7 (SEQ ID NO: 858)
HSU03911_node_8 (SEQ ID NO: 859)
HSU03911_node_10 (SEQ ID NO: 860)
HSU03911_node_11 (SEQ ID NO: 861)
HSU03911_node_12 (SEQ ID NO: 862)
HSU03911_node_13 (SEQ ID NO: 863)
HSU03911_node_26 (SEQ ID NO: 864)
HSU03911_node_36 (SEQ ID NO: 865)
HSU03911_node_39 (SEQ ID NO: 866)
HSU03911_node_53 (SEQ ID NO: 867)
HSU03911_node_56 (SEQ ID NO: 868)

TABLE 779

Proteins of interest

| Protein Name | Corresponding Transcript(s) |
|---|---|
| HSU03911_P2 | HSU03911_T1 (SEQ ID NO: 830) |
| HSU03911_P4 | HSU03911_T3 (SEQ ID NO: 831) |
| HSU03911_P11 | HSU03911_T11 (SEQ ID NO: 832) |
| HSU03911_P12 | HSU03911_T12 (SEQ ID NO: 833) |

These sequences are variants of the known protein DNA mismatch repair protein Msh2 (SwissProt accession identifier MSH2_HUMAN), referred to herein as the previously known protein.

Protein DNA mismatch repair protein Msh2 is known or believed to have the following function(s): Involved in postreplication mismatch repair. Binds specifically to DNA containing mismatched nucleotides thus providing a target for the excision repair processes characteristic of postreplication mismatch repair. The sequence for protein DNA mismatch repair protein Msh2 is given at the end of the application, as "DNA mismatch repair protein Msh2 amino acid sequence". Known polymorphisms for this sequence are as shown in Table 780.

TABLE 780

Amino acid mutations for Known Protein

| SNP position(s) on amino acid sequence | Comment |
|---|---|
| 8 | T -> M. /FTId = VAR_013171. |
| 46 | H -> Q (in HNPCC1). /FTId = VAR_004470. |
| 96 | R -> H. /FTId = VAR_004471. |
| 139 | N -> S (in HNPCC1). /FTId = VAR_004472. |
| 145 | I -> M. /FTId = VAR_004473. |
| 161 | V -> D (in suspected HNPCC; could be a polymorphism). /FTId = VAR_012936. |
| 167 | D -> H. /FTId = VAR_004474. |
| 199 | C -> R (in glioma). /FTId = VAR_012937. |
| 216 | I -> V (in suspected HNPCC; could be a polymorphism). /FTId = VAR_012938. |
| 265-314 | Missing (in HNPCC1). /FTId = VAR_004475. |
| 305 | A -> T (in HNPCC1). /FTId = VAR_004476. |
| 322 | G -> D (common polymorphism; may be associated with increased colorectal cancer susceptibility; the equivalent substitution in yeast reduces the mismatch repair efficiency in vitro). /FTId = VAR_004477. |
| 323 | S -> C (in HNPCC1). /FTId = VAR_012939. |
| 390 | L -> F (may be associated with HNPCC; the equivalent substitution in yeast partially affects mismatch repair in vitro). /FTId = VAR_004478. |
| 419 | Q -> K (the equivalent substitution in yeast partially affects mismatch repair in vitro). /FTId = VAR_012940. |
| 506 | D -> Y (in CRC; sporadic; early onset; the equivalent substitution in yeast partially affects mismatch repair in vitro). /FTId = VAR_012941. |
| 524 | R -> P (in HNPCC1; defective in mismatch repair activity). /FTId = VAR_004479. |
| 554 | S -> R (in suspected HNPCC; could be a polymorphism). /FTId = VAR_012942. |
| 562 | E -> V (in HNPCC1). /FTId = VAR_004480. |
| 596 | N -> S. /FTId = VAR_012943. |
| 596 | Missing (in HNPCC1). /FTId = VAR_004481. |
| 622 | P -> L (in HNPCC1; the equivalent substitution in yeast causes loss of function in a mismatch repair assay). /FTId = VAR_004482. |
| 636 | A -> P (in HNPCC1; partial functional loss). /FTId = VAR_012944. |

TABLE 780-continued

Amino acid mutations for Known Protein

| SNP position(s) on amino acid sequence | Comment |
|---|---|
| 639 | H -> Y (in HNPCC1; the equivalent substitution in yeast does not affect mismatch repair efficiency in vitro). /FTId = VAR_004483. |
| 641 | C -> G. /FTId = VAR_004484. |
| 674 | G -> S (in HNPCC1; somatic mutation). /FTId = VAR_004485. |
| 688 | M -> I (in suspected HNPCC). /FTId = VAR_012945. |
| 692 | G -> R (in HNPCC1). /FTId = VAR_009250. |
| 697 | C -> F (in HNPCC1; the equivalent substitution in yeast causes loss of function in a mismatch repair assay). /FTId = VAR_004486. |
| 697 | C -> R (in HNPCC1). /FTId = VAR_009251. |
| 770 | I -> V. /FTId = VAR_004487. |
| 834 | A -> T (in HNPCC1). /FTId = VAR_004488. |
| 845 | K -> E (in HNPCC1). /FTId = VAR_013172. |
| 905 | T -> R (in HNPCC1). /FTId = VAR_004489. |

Protein DNA mismatch repair protein Msh2 localization is believed to be Nuclear (Potential).

The following GO Annotation(s) apply to the previously known protein. The following annotation(s) were found: mismatch repair; post-replication repair, which are annotation(s) related to Biological Process; DNA binding; damaged DNA binding; ATP binding, which are annotation(s) related to Molecular Function; and nucleus, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HSU03911 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 20 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 20 and Table 781. This cluster is overexpressed (at least at a minimum level) in the following pathological conditions: epithelial malignant tumors and a mixture of malignant tumors from different tissues.

TABLE 781

Normal tissue distribution

| Name of Tissue | Number |
|---|---|
| Adrenal | 0 |
| Bladder | 0 |
| Bone | 32 |
| Brain | 56 |
| Colon | 0 |
| Epithelial | 9 |
| General | 22 |
| Kidney | 35 |
| Liver | 0 |
| Lung | 11 |

TABLE 781-continued

Normal tissue distribution

| Name of Tissue | Number |
|---|---|
| Lymph nodes | 35 |
| Breast | 0 |
| Bone marrow | 0 |
| Muscle | 20 |
| Ovary | 0 |
| Prostate | 0 |
| Skin | 26 |
| Stomach | 36 |
| Uterus | 0 |

TABLE 782

P values and ratios for expression in cancerous tissue

| Name of Tissue | P1 | P2 | SP1 | R3 | SP2 | R4 |
|---|---|---|---|---|---|---|
| Adrenal | 1 | 4.6e-01 | 1 | 1.0 | 2.9e-01 | 2.7 |
| Bladder | 5.4e-01 | 6.0e-01 | 5.6e-01 | 1.8 | 6.8e-01 | 1.5 |
| Bone | 5.5e-01 | 7.3e-01 | 6.4e-01 | 1.2 | 9.1e-01 | 0.8 |
| Brain | 7.4e-01 | 7.8e-01 | 1 | 0.0 | 1 | 0.2 |
| Colon | 5.0e-02 | 3.9e-02 | 3.4e-01 | 2.6 | 3.5e-01 | 2.4 |
| epithelial | 1.3e-02 | 3.8e-04 | 1.7e-02 | 2.3 | 2.0e-04 | 3.0 |
| General | 2.3e-01 | 1.8e-03 | 3.1e-01 | 1.1 | 4.6e-05 | 1.9 |
| Kidney | 8.3e-01 | 8.9e-01 | 8.2e-01 | 0.7 | 9.1e-01 | 0.6 |
| Liver | 1.8e-01 | 1.2e-01 | 1 | 1.7 | 4.8e-01 | 1.9 |
| Lung | 6.8e-01 | 6.1e-01 | 3.7e-01 | 1.8 | 5.1e-01 | 1.4 |
| Lymph nodes | 6.3e-01 | 4.6e-01 | 7.3e-02 | 2.1 | 8.4e-02 | 1.9 |
| Breast | 5.9e-01 | 3.0e-01 | 6.9e-01 | 1.5 | 3.1e-01 | 1.6 |
| bone marrow | 1 | 4.2e-01 | 1 | 1.0 | 2.8e-01 | 2.8 |
| Muscle | 8.5e-01 | 6.1e-01 | 1 | 0.5 | 1.7e-01 | 2.0 |
| Ovary | 2.2e-01 | 1.6e-01 | 4.7e-01 | 1.9 | 4.5e-01 | 1.9 |
| prostate | 1 | 6.0e-01 | 1 | 1.0 | 3.2e-01 | 2.0 |
| Skin | 5.8e-01 | 6.6e-01 | 3.7e-01 | 2.3 | 2.5e-01 | 0.9 |
| stomach | 5.0e-01 | 2.1e-01 | 7.5e-01 | 1.0 | 5.0e-01 | 1.4 |
| Uterus | 4.7e-01 | 2.4e-01 | 2.9e-01 | 2.0 | 3.3e-01 | 2.0 |

As noted above, cluster HSU03911 features 33 segment(s), which were listed in Table 778 above and for which the sequence(s) are given at the end of the application. These segment(s) are portions of nucleic acid sequence(s) which are described herein separately because they are of particular interest. A description of each segment according to the present invention is now provided.

Segment cluster HSU03911_node_0 (SEQ ID NO:836) according to the present invention is supported by 65 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 783 below describes the starting and ending position of this segment on each transcript.

TABLE 783

Segment location on transcripts

| Transcript name | Segment starting position | Segment ending position |
|---|---|---|
| HSU03911_T1 (SEQ ID NO: 830) | 1 | 346 |
| HSU03911_T3 (SEQ ID NO: 831) | 1 | 346 |
| HSU03911_T11 (SEQ ID NO: 832) | 1 | 346 |

This segment can be found in the following protein(s): HSU03911_P2, HSU03911_P4 and HSU03911_P11.

Segment cluster HSU03911_node_14 (SEQ ID NO:837) according to the present invention is supported by 58 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 784 below describes the starting and ending position of this segment on each transcript.

TABLE 784

Segment location on transcripts

| Transcript name | Segment starting position | Segment ending position |
|---|---|---|
| HSU03911_T1 (SEQ ID NO: 830) | 741 | 875 |
| HSU03911_T3 (SEQ ID NO: 831) | 741 | 875 |
| HSU03911_T11 (SEQ ID NO: 832) | 741 | 875 |

This segment can be found in the following protein(s): HSU03911_P2, HSU03911_P4 and HSU03911_P11.

Segment cluster HSU03911_node_18 (SEQ ID NO:838) according to the present invention is supported by 57 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 785 below describes the starting and ending position of this segment on each transcript.

TABLE 785

Segment location on transcripts

| Transcript name | Segment starting position | Segment ending position |
|---|---|---|
| HSU03911_T1 (SEQ ID NO: 830) | 876 | 1022 |
| HSU03911_T3 (SEQ ID NO: 831) | 876 | 1022 |
| HSU03911_T11 (SEQ ID NO: 832) | 876 | 1022 |

This segment can be found in the following protein(s): HSU03911_P2, HSU03911_P4 and HSU03911_P11.

Segment cluster HSU03911_node_20 (SEQ ID NO:839) according to the present invention is supported by 46 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 786 below describes the starting and ending position of this segment on each transcript.

TABLE 786

Segment location on transcripts

| Transcript name | Segment starting position | Segment ending position |
|---|---|---|
| HSU03911_T1 (SEQ ID NO: 830) | 1023 | 1172 |
| HSU03911_T3 (SEQ ID NO: 831) | 1023 | 1172 |
| HSU03911_T11 (SEQ ID NO: 832) | 1023 | 1172 |

This segment can be found in the following protein(s): HSU03911_P2, HSU03911_P4 and HSU03911_P11.

Segment cluster HSU03911_node_22 (SEQ ID NO:840) according to the present invention is supported by 38 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 787 below describes the starting and ending position of this segment on each transcript.

TABLE 787

Segment location on transcripts

| Transcript name | Segment starting position | Segment ending position |
|---|---|---|
| HSU03911_T1 (SEQ ID NO: 830) | 1173 | 1306 |
| HSU03911_T3 (SEQ ID NO: 831) | 1173 | 1306 |
| HSU03911_T11 (SEQ ID NO: 832) | 1173 | 1306 |

This segment can be found in the following protein(s): HSU03911_P2, HSU03911_P4 and HSU03911_P11.

Segment cluster HSU03911_node_24 (SEQ ID NO:841) according to the present invention is supported by 42 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 788 below describes the starting and ending position of this segment on each transcript.

TABLE 788

Segment location on transcripts

| Transcript name | Segment starting position | Segment ending position |
|---|---|---|
| HSU03911_T1 (SEQ ID NO: 830) | 1307 | 1506 |
| HSU03911_T3 (SEQ ID NO: 831) | 1307 | 1506 |
| HSU03911_T11 (SEQ ID NO: 832) | 1307 | 1506 |

This segment can be found in the following protein(s): HSU03911_P2, HSU03911_P4 and HSU03911_P11.

Segment cluster HSU03911_node_28 (SEQ ID NO:842) according to the present invention is supported by 4 libraries. The number of libraries was determined as previously described. This segment can be found in the following transcript(s): HSU03911_T11 (SEQ ID NO:832). Table 789 below describes the starting and ending position of this segment on each transcript.

TABLE 789

Segment location on transcripts

| Transcript name | Segment starting position | Segment ending position |
|---|---|---|
| HSU03911_T11 (SEQ ID NO: 832) | 1617 | 2150 |

This segment can be found in the following protein(s): HSU03911_P1.

Segment cluster HSU03911_node_32 (SEQ ID NO:843) according to the present invention is supported by 2 libraries. The number of libraries was determined as previously described. This segment can be found in the following transcript(s): HSU03911_T12 (SEQ ID NO:833) and HSU03911_T17 (SEQ ID NO:834). Table 790 below describes the starting and ending position of this segment on each transcript.

TABLE 790

Segment location on transcripts

| Transcript name | Segment starting position | Segment ending position |
|---|---|---|
| HSU03911_T12 (SEQ ID NO: 833) | 1 | 384 |
| HSU03911_T17 (SEQ ID NO: 834) | 1 | 384 |

This segment can be found in a non-coding region of transcript(s) that are related to the following protein(s): HSU03911_P12.

Segment cluster HSU03911_node_33 (SEQ ID NO:844) according to the present invention is supported by 40 libraries. The number of libraries was determined as previously described. This segment can be found in the following transcript(s): HSU03911_T1 (SEQ ID NO:830), HSU03911_T3 (SEQ ID NO:831), HSU03911_T12 (SEQ ID NO:833) and HSU03911_T17 (SEQ ID NO:834). Table 791 below describes the starting and ending position of this segment on each transcript.

TABLE 791

Segment location on transcripts

| Transcript name | Segment starting position | Segment ending position |
|---|---|---|
| HSU03911_T1 (SEQ ID NO: 830) | 1617 | 1740 |
| HSU03911_T3 (SEQ ID NO: 831) | 1617 | 1740 |
| HSU03911_T12 (SEQ ID NO: 833) | 385 | 508 |
| HSU03911_T17 (SEQ ID NO: 834) | 385 | 508 |

This segment can be found in the following protein(s): HSU03911_P2, HSU03911_P4 and HSU03911_P12.

Segment cluster HSU03911_node_35 (SEQ ID NO:845) according to the present invention is supported by 42 libraries. The number of libraries was determined as previously described. This segment can be found in the following transcript(s): HSU03911_T1 (SEQ ID NO:830), HSU03911_T3 (SEQ ID NO:831), HSU03911_T12 (SEQ ID NO:833) and HSU03911_T17 (SEQ ID NO:834). Table 792 below describes the starting and ending position of this segment on each transcript.

TABLE 792

Segment location on transcripts

| Transcript name | Segment starting position | Segment ending position |
|---|---|---|
| HSU03911_T1 (SEQ ID NO: 830) | 1741 | 1891 |
| HSU03911_T3 (SEQ ID NO: 831) | 1741 | 1891 |
| HSU03911_T12 (SEQ ID NO: 833) | 509 | 659 |
| HSU03911_T17 (SEQ ID NO: 834) | 509 | 659 |

This segment can be found in the following protein(s): HSU03911_P2, HSU03911_P4 and HSU03911_P12.

Segment cluster HSU03911_node_41 (SEQ ID NO:846) according to the present invention is supported by 48 libraries. The number of libraries was determined as previously described. This segment can be found in the following transcript(s): HSU03911_T1 (SEQ ID NO:830), HSU03911_T3 (SEQ ID NO:831) and HSU03911_T12 (SEQ ID NO:833). Table 793 below describes the starting and ending position of this segment on each transcript.

TABLE 793

Segment location on transcripts

| Transcript name | Segment starting position | Segment ending position |
|---|---|---|
| HSU03911_T1 (SEQ ID NO: 830) | 1990 | 2235 |
| HSU03911_T3 (SEQ ID NO: 831) | 1990 | 2235 |
| HSU03911_T12 (SEQ ID NO: 833) | 758 | 1003 |

This segment can be found in the following protein(s): HSU03911_P2, HSU03911_P4 and HSU03911_P12.

Segment cluster HSU03911_node_43 (SEQ ID NO:847) according to the present invention is supported by 50 libraries. The number of libraries was determined as previously described. This segment can be found in the following transcript(s): HSU03911_T1 (SEQ ID NO:830), HSU03911_T3 (SEQ ID NO:831) and HSU03911_T12 (SEQ ID NO:833). Table 794 below describes the starting and ending position of this segment on each transcript.

TABLE 794

Segment location on transcripts

| Transcript name | Segment starting position | Segment ending position |
|---|---|---|
| HSU03911_T1 (SEQ ID NO: 830) | 2236 | 2440 |
| HSU03911_T3 (SEQ ID NO: 831) | 2236 | 2440 |
| HSU03911_T12 (SEQ ID NO: 833) | 1004 | 1208 |

This segment can be found in the following protein(s): HSU03911_P2, HSU03911_P4 and HSU03911_P12.

Segment cluster HSU03911_node_45 (SEQ ID NO:848) according to the present invention is supported by 66 libraries. The number of libraries was determined as previously described. This segment can be found in the following transcript(s): HSU03911_T1 (SEQ ID NO:830), HSU03911_T3 (SEQ ID NO:831) and HSU03911_T12 (SEQ ID NO:833). Table 795 below describes the starting and ending position of this segment on each transcript.

TABLE 795

Segment location on transcripts

| Transcript name | Segment starting position | Segment ending position |
|---|---|---|
| HSU03911_T1 (SEQ ID NO: 830) | 2441 | 2688 |
| HSU03911_T3 (SEQ ID NO: 831) | 2441 | 2688 |
| HSU03911_T12 (SEQ ID NO: 833) | 1209 | 1456 |

This segment can be found in the following protein(s): HSU03911_P2, HSU03911_P4 and HSU03911_P12.

Segment cluster HSU03911_node_48 (SEQ ID NO:849) according to the present invention is supported by 88 libraries. The number of libraries was determined as previously described. This segment can be found in the following transcript(s): HSU03911_T1 (SEQ ID NO:830), HSU03911_T3 (SEQ ID NO:831) and HSU03911_T12 (SEQ ID NO:833). Table 796 below describes the starting and ending position of this segment on each transcript.

TABLE 796

Segment location on transcripts

| Transcript name | Segment starting position | Segment ending position |
|---|---|---|
| HSU03911_T1 (SEQ ID NO: 830) | 2689 | 2864 |
| HSU03911_T3 (SEQ ID NO: 831) | 2689 | 2864 |
| HSU03911_T12 (SEQ ID NO: 833) | 1457 | 1632 |

This segment can be found in the following protein(s): HSU03911_P2, HSU03911_P4 and HSU03911_P12.

Segment cluster HSU03911_node_51 (SEQ ID NO:850) according to the present invention is supported by 101 libraries. The number of libraries was determined as previously described. This segment can be found in the following transcript(s): HSU03911_T12 (SEQ ID NO:833). Table 797 below describes the starting and ending position of this segment on each transcript.

TABLE 797

Segment location on transcripts

| Transcript name | Segment starting position | Segment ending position |
|---|---|---|
| HSU03911_T12 (SEQ ID NO: 833) | 1633 | 2090 |

This segment can be found in the following protein(s): HSU03911_P12.

Segment cluster HSU03911_node_58 (SEQ ID NO:851) according to the present invention is supported by 2 libraries. The number of libraries was determined as previously described. This segment can be found in the following transcript(s): HSU03911_T3 (SEQ ID NO:831) and HSU03911_T18 (SEQ ID NO:835). Table 798 below describes the starting and ending position of this segment on each transcript.

TABLE 798

Segment location on transcripts

| Transcript name | Segment starting position | Segment ending position |
|---|---|---|
| HSU03911_T3 (SEQ ID NO: 831) | 2983 | 3216 |
| HSU03911_T18 (SEQ ID NO: 835) | 91 | 324 |

This segment can be found in the following protein(s): HSU03911_P4.

Segment cluster HSU03911_node_60 (SEQ ID NO:852) according to the present invention is supported by 1 libraries. The number of libraries was determined as previously described. This segment can be found in the following transcript(s): HSU03911_T1 (SEQ ID NO:830). Table 799 below describes the starting and ending position of this segment on each transcript.

TABLE 799

Segment location on transcripts

| Transcript name | Segment starting position | Segment ending position |
|---|---|---|
| HSU03911_T1 (SEQ ID NO: 830) | 2983 | 3788 |

This segment can be found in the following protein(s): HSU03911_P2.

According to an optional embodiment of the present invention, short segments related to the above cluster are also provided. These segments are up to about 120 bp in length, and so are included in a separate description.

Segment cluster HSU03911_node_1 (SEQ ID NO:853) according to the present invention is supported by 64 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 800 below describes the starting and ending position of this segment on each transcript.

TABLE 800

Segment location on transcripts

| Transcript name | Segment starting position | Segment ending position |
|---|---|---|
| HSU03911_T1 (SEQ ID NO: 830) | 347 | 374 |
| HSU03911_T3 (SEQ ID NO: 831) | 347 | 374 |
| HSU03911_T11 (SEQ ID NO: 832) | 347 | 374 |

This segment can be found in the following protein(s): HSU03911_P2, HSU03911_P4 and HSU03911_P11.

Segment cluster HSU03911_node_2 (SEQ ID NO:854) according to the present invention can be found in the following transcript(s): HSU03911_T1 (SEQ ID NO:830), HSU03911_T3 (SEQ ID NO:831) and HSU03911_T11 (SEQ ID NO:832). Table 801 below describes the starting and ending position of this segment on each transcript.

TABLE 801

Segment location on transcripts

| Transcript name | Segment starting position | Segment ending position |
|---|---|---|
| HSU03911_T1 (SEQ ID NO: 830) | 375 | 394 |
| HSU03911_T3 (SEQ ID NO: 831) | 375 | 394 |
| HSU03911_T11 (SEQ ID NO: 832) | 375 | 394 |

This segment can be found in the following protein(s): HSU03911_P2, HSU03911_P4 and HSU03911_P11.

Segment cluster HSU03911_node_3 (SEQ ID NO:855) according to the present invention is supported by 66 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 802 below describes the starting and ending position of this segment on each transcript.

TABLE 802

Segment location on transcripts

| Transcript name | Segment starting position | Segment ending position |
|---|---|---|
| HSU03911_T1 (SEQ ID NO: 830) | 395 | 441 |
| HSU03911_T3 (SEQ ID NO: 831) | 395 | 441 |
| HSU03911_T11 (SEQ ID NO: 832) | 395 | 441 |

This segment can be found in the following protein(s): HSU03911_P2, HSU03911_P4 and HSU03911_P11.

Segment cluster HSU03911_node_5 (SEQ ID NO:856) according to the present invention is supported by 69 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 803 below describes the starting and ending position of this segment on each transcript.

TABLE 803

| | Segment location on transcripts | |
|---|---|---|
| Transcript name | Segment starting position | Segment ending position |
| HSU03911_T1 (SEQ ID NO: 830) | 442 | 494 |
| HSU03911_T3 (SEQ ID NO: 831) | 442 | 494 |
| HSU03911_T11 (SEQ ID NO: 832) | 442 | 494 |

This segment can be found in the following protein(s): HSU03911_P2, HSU03911_P4 and HSU03911_P11.

Segment cluster HSU03911_node_6 (SEQ ID NO:857) according to the present invention is supported by 63 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 804 below describes the starting and ending position of this segment on each transcript.

TABLE 804

| | Segment location on transcripts | |
|---|---|---|
| Transcript name | Segment starting position | Segment ending position |
| HSU03911_T1 (SEQ ID NO: 830) | 495 | 547 |
| HSU03911_T3 (SEQ ID NO: 831) | 495 | 547 |
| HSU03911_T11 (SEQ ID NO: 832) | 495 | 547 |

This segment can be found in the following protein(s): HSU03911_P2, HSU03911_P4 and HSU03911_P11.

Segment cluster HSU03911_node_7 (SEQ ID NO:858) according to the present invention is supported by 61 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 805 below describes the starting and ending position of this segment on each transcript.

TABLE 805

| | Segment location on transcripts | |
|---|---|---|
| Transcript name | Segment starting position | Segment ending position |
| HSU03911_T1 (SEQ ID NO: 830) | 548 | 587 |
| HSU03911_T3 (SEQ ID NO: 831) | 548 | 587 |
| HSU03911_T11 (SEQ ID NO: 832) | 548 | 587 |

This segment can be found in the following protein(s): HSU03911_P2, HSU03911_P4 and HSU03911_P11.

Segment cluster HSU03911_node_8 (SEQ ID NO:859) according to the present invention can be found in the following transcript(s): HSU03911_T1 (SEQ ID NO:830), HSU03911_T3 (SEQ ID NO:831) and HSU03911_T11 (SEQ ID NO:832). Table 806 below describes the starting and ending position of this segment on each transcript.

TABLE 806

| | Segment location on transcripts | |
|---|---|---|
| Transcript name | Segment starting position | Segment ending position |
| HSU03911_T1 (SEQ ID NO: 830) | 588 | 596 |
| HSU03911_T3 (SEQ ID NO: 831) | 588 | 596 |
| HSU03911_T11 (SEQ ID NO: 832) | 588 | 596 |

This segment can be found in the following protein(s): HSU03911_P2, HSU03911_P4 and HSU03911_P11.

Segment cluster HSU03911_node_10 (SEQ ID NO:860) according to the present invention can be found in the following transcript(s): HSU03911_T1 (SEQ ID NO:830), HSU03911_T3 (SEQ ID NO:831) and HSU03911_T11 (SEQ ID NO:832). Table 807 below describes the starting and ending position of this segment on each transcript.

TABLE 807

| | Segment location on transcripts | |
|---|---|---|
| Transcript name | Segment starting position | Segment ending position |
| HSU03911_T1 (SEQ ID NO: 830) | 597 | 606 |
| HSU03911_T3 (SEQ ID NO: 831) | 597 | 606 |
| HSU03911_T11 (SEQ ID NO: 832) | 597 | 606 |

This segment can be found in the following protein(s): HSU03911_P2, HSU03911_P4 and HSU03911_P11.

Segment cluster HSU03911_node_11 (SEQ ID NO:861) according to the present invention is supported by 61 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 808 below describes the starting and ending position of this segment on each transcript.

TABLE 808

| | Segment location on transcripts | |
|---|---|---|
| Transcript name | Segment starting position | Segment ending position |
| HSU03911_T1 (SEQ ID NO: 830) | 607 | 685 |
| HSU03911_T3 (SEQ ID NO: 831) | 607 | 685 |
| HSU03911_T11 (SEQ ID NO: 832) | 607 | 685 |

This segment can be found in the following protein(s): HSU03911_P2, HSU03911_P4 and HSU03911_P11.

Segment cluster HSU03911_node_12 (SEQ ID NO:862) according to the present invention can be found in the following transcript(s): HSU03911_T1 (SEQ ID NO:830), HSU03911_T3 (SEQ ID NO:831) and HSU03911_T11 (SEQ ID NO:832). Table 809 below describes the starting and ending position of this segment on each transcript.

TABLE 809

Segment location on transcripts

| Transcript name | Segment starting position | Segment ending position |
|---|---|---|
| HSU03911_T1 (SEQ ID NO: 830) | 686 | 710 |
| HSU03911_T3 (SEQ ID NO: 831) | 686 | 710 |
| HSU03911_T11 (SEQ ID NO: 832) | 686 | 710 |

This segment can be found in the following protein(s): HSU03911_P2, HSU03911_P4 and HSU03911_P11.

Segment cluster HSU03911_node_13 (SEQ ID NO:863) according to the present invention is supported by 56 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 810 below describes the starting and ending position of this segment on each transcript.

TABLE 810

Segment location on transcripts

| Transcript name | Segment starting position | Segment ending position |
|---|---|---|
| HSU03911_T1 (SEQ ID NO: 830) | 711 | 740 |
| HSU03911_T3 (SEQ ID NO: 831) | 711 | 740 |
| HSU03911_T11 (SEQ ID NO: 832) | 711 | 740 |

This segment can be found in the following protein(s): HSU03911_P2, HSU03911_P4 and HSU03911_P11.

Segment cluster HSU03911_node_26 (SEQ ID NO:864) according to the present invention is supported by 38 libraries. The number of libraries was determined as previously described. This segment can be found in the following transcript(s): HSU03911_T1 (SEQ ID NO:830), HSU03911_T3 (SEQ ID NO:831) and HSU03911_T11 (SEQ ID NO:832). Table 811 below describes the starting and ending position of this segment on each transcript.

TABLE 811

Segment location on transcripts

| Transcript name | Segment starting position | Segment ending position |
|---|---|---|
| HSU03911_T1 (SEQ ID NO: 830) | 1507 | 1616 |
| HSU03911_T3 (SEQ ID NO: 831) | 1507 | 1616 |
| HSU03911_T11 (SEQ ID NO: 832) | 1507 | 1616 |

This segment can be found in the following protein(s): HSU03911_P2, HSU03911_P4 and HSU03911_P11.

Segment cluster HSU03911_node_36 (SEQ ID NO:865) according to the present invention is supported by 2 libraries. The number of libraries was determined as previously described. This segment can be found in the following transcript(s): HSU03911_T17 (SEQ ID NO:834). Table 812 below describes the starting and ending position of this segment on each transcript.

TABLE 812

Segment location on transcripts

| Transcript name | Segment starting position | Segment ending position |
|---|---|---|
| HSU03911_T17 (SEQ ID NO: 834) | 660 | 707 |

The previously-described transcripts for these segment(s) do not code for protein.

Segment cluster HSU03911_node_39 (SEQ ID NO:866) according to the present invention is supported by 43 libraries. The number of libraries was determined as previously described. This segment can be found in the following transcript(s): HSU03911_T1 (SEQ ID NO:830), HSU03911_T3 (SEQ ID NO:831) and HSU03911_T12 (SEQ ID NO:833). Table 813 below describes the starting and ending position of this segment on each transcript.

TABLE 813

Segment location on transcripts

| Transcript name | Segment starting position | Segment ending position |
|---|---|---|
| HSU03911_T1 (SEQ ID NO: 830) | 1892 | 1989 |
| HSU03911_T3 (SEQ ID NO: 831) | 1892 | 1989 |
| HSU03911_T12 (SEQ ID NO: 833) | 660 | 757 |

This segment can be found in the following protein(s): HSU03911_P2, HSU03911_P4 and HSU03911_P12.

Segment cluster HSU03911_node_53 (SEQ ID NO:867) according to the present invention is supported by 3 libraries. The number of libraries was determined as previously described. This segment can be found in the following transcript(s): HSU03911_T1 (SEQ ID NO:830) and HSU03911_T3 (SEQ ID NO:831). Table 814 below describes the starting and ending position of this segment on each transcript.

TABLE 814

Segment location on transcripts

| Transcript name | Segment starting position | Segment ending position |
|---|---|---|
| HSU03911_T1 (SEQ ID NO: 830) | 2865 | 2982 |
| HSU03911_T3 (SEQ ID NO: 831) | 2865 | 2982 |

This segment can be found in the following protein(s): HSU03911_P2 and HSU03911_P4.

Segment cluster HSU03911_node_56 (SEQ ID NO:868) according to the present invention is supported by 1 libraries. The number of libraries was determined as previously described. This segment can be found in the following transcript(s): HSU03911_T18 (SEQ ID NO:835). Table 815 below describes the starting and ending position of this segment on each transcript.

TABLE 815

Segment location on transcripts

| Transcript name | Segment starting position | Segment ending position |
|---|---|---|
| HSU03911_T18 (SEQ ID NO: 835) | 1 | 90 |

The previously-described transcripts for these segment(s) do not code for protein.

Description for Cluster HUMCA1XIA

Cluster HUMCA1XIA features 1 transcript(s) and 26 segment(s) of interest, the names for which are given in Tables 816 and 817, respectively, the sequences themselves are given at the end of the application. The selected protein variants are given in Table 818.

TABLE 816

Transcripts of interest
Transcript Name

HUMCA1XIA_T18 (SEQ ID NO: 869)

TABLE 817

Segments of interest
Segment Name

HUMCA1XIA_node_0 (SEQ ID NO: 870)
HUMCA1XIA_node_2 (SEQ ID NO: 871)
HUMCA1XIA_node_4 (SEQ ID NO: 872)
HUMCA1XIA_node_6 (SEQ ID NO: 873)
HUMCA1XIA_node_8 (SEQ ID NO: 874)
HUMCA1XIA_node_18 (SEQ ID NO: 875)
HUMCA1XIA_node_55 (SEQ ID NO: 876)
HUMCA1XIA_node_11 (SEQ ID NO: 877)
HUMCA1XIA_node_15 (SEQ ID NO: 878)
HUMCA1XIA_node_19 (SEQ ID NO: 879)
HUMCA1XIA_node_21 (SEQ ID NO: 880)
HUMCA1XIA_node_23 (SEQ ID NO: 881)
HUMCA1XIA_node_25 (SEQ ID NO: 882)
HUMCA1XIA_node_27 (SEQ ID NO: 883)
HUMCA1XIA_node_29 (SEQ ID NO: 884)
HUMCA1XIA_node_31 (SEQ ID NO: 885)
HUMCA1XIA_node_33 (SEQ ID NO: 886)
HUMCA1XIA_node_35 (SEQ ID NO: 887)
HUMCA1XIA_node_37 (SEQ ID NO: 888)
HUMCA1XIA_node_39 (SEQ ID NO: 889)
HUMCA1XIA_node_41 (SEQ ID NO: 890)
HUMCA1XIA_node_43 (SEQ ID NO: 891)
HUMCA1XIA_node_45 (SEQ ID NO: 892)
HUMCA1XIA_node_47 (SEQ ID NO: 893)
HUMCA1XIA_node_49 (SEQ ID NO: 894)
HUMCA1XIA_node_51 (SEQ ID NO: 895)

TABLE 818

Proteins of interest

| Protein Name | Corresponding Transcript(s) |
|---|---|
| HUMCA1XIA_P15 | HUMCA1XIA_T18 (SEQ ID NO: 869) |

These sequences are variants of the known protein Collagen alpha 1 (SwissProt accession identifier CA1B_HUMAN; known also according to the synonyms XI), referred to herein as the previously known protein.

Protein Collagen alpha 1 is known or believed to have the following function(s): May play an important role in fibrillogenesis by controlling lateral growth of collagen II fibrils. The sequence for protein Collagen alpha 1 is given at the end of the application, as "Collagen alpha 1 amino acid sequence": Known polymorphisms for this sequence are as shown in Table 819.

TABLE 819

Amino acid mutations for Known Protein

| SNP position(s) on amino acid sequence | Comment |
|---|---|
| 625 | G -> V (in STL2). /FTId = VAR_013583. |
| 676 | G -> R (in STL2; overlapping phenotype with Marshall syndrome). /FTId = VAR_013584. |
| 921-926 | Missing (in STL2; overlapping phenotype with Marshall syndrome). /FTId = VAR_013585. |
| 1313-1315 | Missing (in STL2; overlapping phenotype with Marshall syndrome). /FTId = VAR_013586. |
| 1516 | G -> V (in STL2; overlapping phenotype with Marshall syndrome). /FTId = VAR_013587. |
| 941-944 | KDGL -> RMGC |
| 986 | Y -> H |
| 1074 | R -> P |
| 1142 | G -> D |
| 1218 | M -> W |
| 1758 | T -> A |
| 1786 | S -> N |

The following GO Annotation(s) apply to the previously known protein. The following annotation(s) were found: cartilage condensation; vision; hearing; cell-cell adhesion; extracellular matrix organization and biogenesis, which are annotation(s) related to Biological Process; extracellular matrix structural protein; extracellular matrix protein, adhesive, which are annotation(s) related to Molecular Function; and extracellular matrix; collagen; collagen type XI, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMCA1XIA can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 21 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 21 and Table 820. This cluster is overexpressed (at least at a minimum level) in the following pathological conditions: bone malignant tumors, epithelial malignant tumors, a mixture of malignant tumors from different tissues and lung malignant tumors.

TABLE 820

Normal tissue distribution

| Name of Tissue | Number |
|---|---|
| Adrenal | 0 |
| Bone | 207 |
| Brain | 13 |
| Colon | 0 |
| Epithelial | 11 |
| General | 11 |
| head and neck | 0 |
| Kidney | 0 |
| Lung | 0 |
| Breast | 8 |
| Pancreas | 0 |
| Stomach | 73 |
| Uterus | 9 |

TABLE 821

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 9.6e−02 | 3.4 | 8.2e−02 | 3.6 |
| Bone | 2.4e−01 | 6.3e−01 | 7.7e−10 | 4.3 | 5.3e−03 | 1.6 |
| Brain | 5.0e−01 | 6.9e−01 | 1.8e−01 | 2.1 | 4.2e−01 | 1.3 |
| Colon | 1.3e−02 | 2.9e−02 | 2.4e−01 | 3.0 | 3.5e−01 | 2.4 |
| epithelial | 3.9e−04 | 3.2e−03 | 1.3e−03 | 2.3 | 1.8e−02 | 1.7 |
| general | 5.6e−05 | 1.6e−03 | 9.5e−17 | 4.5 | 1.1e−09 | 2.8 |
| head and neck | 1.2e−01 | 2.1e−01 | 1 | 1.3 | 1 | 1.1 |
| kidney | 6.5e−01 | 7.2e−01 | 3.4e−01 | 2.4 | 4.9e−01 | 1.9 |
| Lung | 5.3e−02 | 9.1e−02 | 5.5e−05 | 7.3 | 5.0e−03 | 4.0 |
| breast | 4.3e−01 | 5.6e−01 | 6.9e−01 | 1.4 | 8.2e−01 | 1.1 |
| pancreas | 3.3e−01 | 1.8e−01 | 4.2e−01 | 2.4 | 1.5e−01 | 3.7 |
| stomach | 5.0e−01 | 6.1e−01 | 6.9e−01 | 1.0 | 6.7e−01 | 0.8 |
| uterus | 7.1e−01 | 7.0e−01 | 6.6e−01 | 1.1 | 6.4e−01 | 1.1 |

As noted above, cluster HUMCA1XIA features 26 segment(s), which were listed in Table 817 above and for which the sequence(s) are given at the end of the application. These segment(s) are portions of nucleic acid sequence(s) which are described herein separately because they are of particular interest. A description of each segment according to the present invention is now provided.

Segment cluster HUMCA1XIA_node_0 (SEQ ID NO:870) according to the present invention is supported by 13 libraries. The number of libraries was determined as previously described. This segment can be found in the following transcript(s): HUMCA1XIA_T18 (SEQ ID NO:869). Table 822 below describes the starting and ending position of this segment on each transcript.

TABLE 822

Segment location on transcripts

| Transcript name | Segment starting position | Segment ending position |
|---|---|---|
| HUMCA1XIA_T18 (SEQ ID NO: 869) | 1 | 424 |

This segment can be found in the following protein(s): HUMCA1XIA_P15.

Segment cluster HUMCA1XIA_node_2 (SEQ ID NO:871) according to the present invention is supported by 9 libraries. The number of libraries was determined as previously described. This segment can be found in the following transcript(s): HUMCA1XIA_T18 (SEQ ID NO:869). Table 823 below describes the starting and ending position of this segment on each transcript.

TABLE 823

Segment location on transcripts

| Transcript name | Segment starting position | Segment ending position |
|---|---|---|
| HUMCA1XIA_T18 (SEQ ID NO: 869) | 425 | 592 |

This segment can be found in the following protein(s): HUMCA1XIA_P15.

Segment cluster HUMCA1XIA_node_4 (SEQ ID NO:872) according to the present invention is supported by 5 libraries. The number of libraries was determined as previously described. This segment can be found in the following transcript(s): HUMCA1XIA_T18 (SEQ ID NO:869). Table 824 below describes the starting and ending position of this segment on each transcript.

TABLE 824

Segment location on transcripts

| Transcript name | Segment starting position | Segment ending position |
|---|---|---|
| HUMCA1XIA_T18 (SEQ ID NO: 869) | 593 | 806 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 825.

TABLE 825

Oligonucleotides related to this segment

| Oligonucleotide name | Overexpressed in cancers | Chip reference |
|---|---|---|
| HUMCA1XIA_0_18_0 | Breast malignant tumors | BRS |
| HUMCA1XIA_0_18_0 | colorectal cancer | Colon |
| HUMCA1XIA_0_18_0 | lung malignant tumors | LUN |

This segment can be found in the following protein(s): HUMCA1XIA_P15.

Segment cluster HUMCA1XIA_node_6 (SEQ ID NO:873) according to the present invention is supported by 5 libraries. The number of libraries was determined as previously described. This segment can be found in the following transcript(s): HUMCA1XIA_T18 (SEQ ID NO:869). Table 826 below describes the starting and ending position of this segment on each transcript.

TABLE 826

Segment location on transcripts

| Transcript name | Segment starting position | Segment ending position |
|---|---|---|
| HUMCA1XIA_T18 (SEQ ID NO: 869) | 807 | 969 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 827.

TABLE 827

Oligonucleotides related to this segment

| Oligonucleotide name | Overexpressed in cancers | Chip reference |
|---|---|---|
| HUMCA1XIA_0_18_0 | Breast malignant tumors | BRS |
| HUMCA1XIA_0_18_0 | colorectal cancer | Colon |
| HUMCA1XIA_0_18_0 | lung malignant tumors | LUN |

This segment can be found in the following protein(s): HUMCA1XIA_P15.

Segment cluster HUMCA1XIA_node_8 (SEQ ID NO:874) according to the present invention is supported by 5 libraries. The number of libraries was determined as previously described. This segment can be found in the following transcript(s): HUMCA1XIA_T18 (SEQ ID NO:869). Table 828 below describes the starting and ending position of this segment on each transcript.

TABLE 828

Segment location on transcripts

| Transcript name | Segment starting position | Segment ending position |
|---|---|---|
| HUMCA1XIA_T18 (SEQ ID NO: 869) | 970 | 1098 |

This segment can be found in the following protein(s): HUMCA1XIA_P15.

Segment cluster HUMCA1XIA_node_18 (SEQ ID NO:875) according to the present invention is supported by 6 libraries. The number of libraries was determined as previously described. This segment can be found in the following transcript(s): HUMCA1XIA_T18 (SEQ ID NO:869). Table 829 below describes the starting and ending position of this segment on each transcript.

TABLE 829

Segment location on transcripts

| Transcript name | Segment starting position | Segment ending position |
|---|---|---|
| HUMCA1XIA_T18 (SEQ ID NO: 869) | 1309 | 1522 |

This segment can be found in the following protein(s): HUMCA1XIA_P15.

Segment cluster HUMCA1XIA_node_55 (SEQ ID NO:876) according to the present invention is supported by 4 libraries. The number of libraries was determined as previously described. This segment can be found in the following transcript(s): HUMCA1XIA_T18 (SEQ ID NO:869). Table 830 below describes the starting and ending position of this segment on each transcript.

TABLE 830

Segment location on transcripts

| Transcript name | Segment starting position | Segment ending position |
|---|---|---|
| HUMCA1XIA_T18 (SEQ ID NO: 869) | 2461 | 3099 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 831.

TABLE 831

Oligonucleotides related to this segment

| Oligonucleotide name | Overexpressed in cancers | Chip reference |
|---|---|---|
| HUMCA1XIA_0_0_14909 | breast malignant tumors | BRS |

This segment can be found in the following protein(s): HUMCA1XIA_P15.

According to an optional embodiment of the present invention, short segments related to the above cluster are also provided. These segments are up to about 120 bp in length, and so are included in a separate description.

Segment cluster HUMCA1XIA_node_1 (SEQ ID NO:877) according to the present invention is supported by 3 libraries. The number of libraries was determined as previously described. This segment can be found in the following transcript(s): HUMCA1XIA_T18 (SEQ ID NO:869). Table 832 below describes the starting and ending position of this segment on each transcript.

TABLE 832

Segment location on transcripts

| Transcript name | Segment starting position | Segment ending position |
|---|---|---|
| HUMCA1XIA_T18 (SEQ ID NO: 869) | 1099 | 1215 |

This segment can be found in the following protein(s): HUMCA1XIA_P15.

Segment cluster HUMCA1XIA_node_15 (SEQ ID NO:878) according to the present invention is supported by 5 libraries. The number of libraries was determined as previously described. This segment can be found in the following transcript(s): HUMCA1XIA_T18 (SEQ ID NO:869). Table 833 below describes the starting and ending position of this segment on each transcript.

TABLE 833

Segment location on transcripts

| Transcript name | Segment starting position | Segment ending position |
|---|---|---|
| HUMCA1XIA_T18 (SEQ ID NO: 869) | 1216 | 1308 |

This segment can be found in the following protein(s): HUMCA1XIA_P15.

Segment cluster HUMCA1XIA_node_19 (SEQ ID NO:879) according to the present invention is supported by 3 libraries. The number of libraries was determined as previously described. This segment can be found in the following transcript(s): HUMCA1XIA_T18 (SEQ ID NO:869). Table 834 below describes the starting and ending position of this segment on each transcript.

TABLE 834

| Transcript name | Segment starting position | Segment ending position |
|---|---|---|
| HUMCA1XIA_T18 (SEQ ID NO: 869) | 1523 | 1563 |

Segment location on transcripts

This segment can be found in the following protein(s): HUMCA1XIA_P15.

Segment cluster HUMCA1XIA_node_21 (SEQ ID NO:880) according to the present invention is supported by 2 libraries. The number of libraries was determined as previously described. This segment can be found in the following transcript(s): HUMCA1XIA_T18 (SEQ ID NO:869). Table 835 below describes the starting and ending position of this segment on each transcript.

TABLE 835

Segment location on transcripts

| Transcript name | Segment starting position | Segment ending position |
|---|---|---|
| HUMCA1XIA_T18 (SEQ ID NO: 869) | 1564 | 1626 |

This segment can be found in the following protein(s): HUMCA1XIA_P15.

Segment cluster HUMCA1XIA_node_23 (SEQ ID NO:881) according to the present invention is supported by 3 libraries. The number of libraries was determined as previously described. This segment can be found in the following transcript(s): HUMCA1XIA_T18 (SEQ ID NO:869). Table 836 below describes the starting and ending position of this segment on each transcript.

TABLE 836

Segment location on transcripts

| Transcript name | Segment starting position | Segment ending position |
|---|---|---|
| HUMCA1XIA_T18 (SEQ ID NO: 869) | 1627 | 1668 |

This segment can be found in the following protein(s): HUMCA1XIA_P15.

Segment cluster HUMCA1XIA_node_25 (SEQ ID NO:882) according to the present invention is supported by 3 libraries. The number of libraries was determined as previously described. This segment can be found in the following transcript(s): HUMCA1XIA_T18 (SEQ ID NO:869). Table 837 below describes the starting and ending position of this segment on each transcript.

TABLE 837

Segment location on transcripts

| Transcript name | Segment starting position | Segment ending position |
|---|---|---|
| HUMCA1XIA_T18 (SEQ ID NO: 869) | 1669 | 1731 |

This segment can be found in the following protein(s): HUMCA1XIA_P15.

Segment cluster HUMCA1XIA_node_27 (SEQ ID NO:883) according to the present invention is supported by 2 libraries. The number of libraries was determined as previously described. This segment can be found in the following transcript(s): HUMCA1XIA_T18 (SEQ ID NO:869). Table 838 below describes the starting and ending position of this segment on each transcript.

TABLE 838

Segment location on transcripts

| Transcript name | Segment starting position | Segment ending position |
|---|---|---|
| HUMCA1XIA_T18 (SEQ ID NO: 869) | 1732 | 1806 |

This segment can be found in the following protein(s): HUMCA1XIA_P15.

Segment cluster HUMCA1XIA_node_29 (SEQ ID NO:884) according to the present invention is supported by 3 libraries. The number of libraries was determined as previously described. This segment can be found in the following transcript(s): HUMCA1XIA_T18 (SEQ ID NO:869). Table 839 below describes the starting and ending position of this segment on each transcript.

TABLE 839

Segment location on transcripts

| Transcript name | Segment starting position | Segment ending position |
|---|---|---|
| HUMCA1XIA_T18 (SEQ ID NO: 869) | 1807 | 1890 |

This segment can be found in the following protein(s): HUMCA1XIA_P15.

Segment cluster HUMCA1XIA_node_31 (SEQ ID NO:885) according to the present invention is supported by 3 libraries. The number of libraries was determined as previously described. This segment can be found in the following transcript(s): HUMCA1XIA_T18 (SEQ ID NO:869). Table 840 below describes the starting and ending position of this segment on each transcript.

TABLE 840

Segment location on transcripts

| Transcript name | Segment starting position | Segment ending position |
|---|---|---|
| HUMCA1XIA_T18 (SEQ ID NO: 869) | 1891 | 1947 |

This segment can be found in the following protein(s): HUMCA1XIA_P15.

Segment cluster HUMCA1XIA_node_33 (SEQ ID NO:886) according to the present invention is supported by 3 libraries. The number of libraries was determined as previously described. This segment can be found in the following transcript(s): HUMCA1XIA_T18 (SEQ ID NO:869). Table 841 below describes the starting and ending position of this segment on each transcript.

TABLE 841

| Transcript name | Segment location on transcripts | |
|---|---|---|
| | Segment starting position | Segment ending position |
| HUMCA1XIA_T18 (SEQ ID NO: 869) | 1948 | 2001 |

This segment can be found in the following protein(s): HUMCA1XIA_P15.

Segment cluster HUMCA1XIA_node_35 (SEQ ID NO:887) according to the present invention is supported by 4 libraries. The number of libraries was determined as previously described. This segment can be found in the following transcript(s): HUMCA1XIA_T18 (SEQ ID NO:869). Table 842 below describes the starting and ending position of this segment on each transcript.

TABLE 842

| Transcript name | Segment location on transcripts | |
|---|---|---|
| | Segment starting position | Segment ending position |
| HUMCA1XIA_T18 (SEQ ID NO: 869) | 2002 | 2055 |

This segment can be found in the following protein(s): HUMCA1XIA_P15.

Segment cluster HUMCA1XIA_node_37 (SEQ ID NO:888) according to the present invention is supported by 4 libraries. The number of libraries was determined as previously described. This segment can be found in the following transcript(s): HUMCA1XIA_T18 (SEQ ID NO:869). Table 843 below describes the starting and ending position of this segment on each transcript.

TABLE 843

| Transcript name | Segment location on transcripts | |
|---|---|---|
| | Segment starting position | Segment ending position |
| HUMCA1XIA_T18 (SEQ ID NO: 869) | 2056 | 2109 |

This segment can be found in the following protein(s): HUMCA1XIA_P15.

Segment cluster HUMCA1XIA_node_39 (SEQ ID NO:889) according to the present invention is supported by 5 libraries. The number of libraries was determined as previously described. This segment can be found in the following transcript(s): HUMCA1XIA_T18 (SEQ ID NO:869). Table 844 below describes the starting and ending position of this segment on each transcript.

TABLE 844

| Transcript name | Segment location on transcripts | |
|---|---|---|
| | Segment starting position | Segment ending position |
| HUMCA1XIA_T18 (SEQ ID NO: 869) | 2110 | 2163 |

This segment can be found in the following protein(s): HUMCA1XIA_P15.

Segment cluster HUMCA1XIA_node_41 (SEQ ID NO:890) according to the present invention is supported by 4 libraries. The number of libraries was determined as previously described. This segment can be found in the following transcript(s): HUMCA1XIA_T18 (SEQ ID NO:869). Table 845 below describes the starting and ending position of this segment on each transcript.

TABLE 845

| Transcript name | Segment location on transcripts | |
|---|---|---|
| | Segment starting position | Segment ending position |
| HUMCA1XIA_T18 (SEQ ID NO: 869) | 2164 | 2217 |

This segment can be found in the following protein(s): HUMCA1XIA_P15.

Segment cluster HUMCA1XIA_node_43 (SEQ ID NO:891) according to the present invention is supported by 5 libraries. The number of libraries was determined as previously described. This segment can be found in the following transcript(s): HUMCA1XIA_T18 (SEQ ID NO:869). Table 846 below describes the starting and ending position of this segment on each transcript.

TABLE 846

| Transcript name | Segment location on transcripts | |
|---|---|---|
| | Segment starting position | Segment ending position |
| HUMCA1XIA_T18 (SEQ ID NO: 869) | 2218 | 2262 |

This segment can be found in the following protein(s): HUMCA1XIA_P15.

Segment cluster HUMCA1XIA_node_45 (SEQ ID NO:892) according to the present invention is supported by 4 libraries. The number of libraries was determined as previously described. This segment can be found in the following transcript(s): HUMCA1XIA_T18 (SEQ ID NO:869). Table 847 below describes the starting and ending position of this segment on each transcript.

TABLE 847

| Transcript name | Segment location on transcripts | |
|---|---|---|
| | Segment starting position | Segment ending position |
| HUMCA1XIA_T18 (SEQ ID NO: 869) | 2263 | 2316 |

This segment can be found in the following protein(s): HUMCA1XIA_P15.

Segment cluster HUMCA1XIA_node_47 (SEQ ID NO:893) according to the present invention is supported by 5 libraries. The number of libraries was determined as previously described. This segment can be found in the following transcript(s): HUMCA1XIA_T18 (SEQ ID NO:869). Table 848 below describes the starting and ending position of this segment on each transcript.

TABLE 848

| | Segment location on transcripts | |
|---|---|---|
| Transcript name | Segment starting position | Segment ending position |
| HUMCA1XIA_T18 (SEQ ID NO: 869) | 2317 | 2361 |

This segment can be found in the following protein(s): HUMCA1XIA_P15.

Segment cluster HUMCA1XIA_node_49 (SEQ ID NO:894) according to the present invention is supported by 5 libraries. The number of libraries was determined as previously described. This segment can be found in the following transcript(s): HUMCA1XIA_T18 (SEQ ID NO:869). Table 849 below describes the starting and ending position of this segment on each transcript.

TABLE 849

| | Segment location on transcripts | |
|---|---|---|
| Transcript name | Segment starting position | Segment ending position |
| HUMCA1XIA_T18 (SEQ ID NO: 869) | 2362 | 2415 |

This segment can be found in the following protein(s): HUMCA1XIA_P15.

Segment cluster HUMCA1XIA_node_51 (SEQ ID NO:895) according to the present invention is supported by 7 libraries. The number of libraries was determined as previously described. This segment can be found in the following transcript(s): HUMCA1XIA_T18 (SEQ ID NO:869). Table 850 below describes the starting and ending position of this segment on each transcript.

TABLE 850

| | Segment location on transcripts | |
|---|---|---|
| Transcript name | Segment starting position | Segment ending position |
| HUMCA1XIA_T18 (SEQ ID NO: 869) | 2416 | 2460 |

This segment can be found in the following protein(s): HUMCA1XIA_P15.

Expression of *Homo sapiens* collagen, type XI, alpha 1 (COL11A1) HUMCA1X1A transcripts which are detectable by amplicon as depicted in sequence name HUMCA1X1A seg55 (SEQ ID NO:6889) in normal and cancerous breast tissues Expression of Homo sapiens collagen, type XI, alpha 1 (COL11A1) transcripts detectable by or according to HUMCA1X1 seg55, HUMCA1X1A seg55 (SEQ ID NO: 6889) amplicon(s) and primers HUMCAIXIA seg55F (SEQ ID NO: 6890) and HUMCAIXIA seg55R (SEQ ID NO: 6891) was measured by real time PCR. In parallel the expression of four housekeeping genes—PBGD (GenBank Accession No. BC019323 (SEQ ID NO: 6892); amplicon—PBGD-amplicon (SEQ ID NO: 6893)), HPRT1 (GenBank Accession No. NM_000194 (SEQ ID NO: 6894); amplicon—HPRT1-amplicon (SEQ ID NO: 6895)), SDHA (GenBank Accession No. NM_004168 (SEQ ID NO: 6896); amplicon—SDHA-amplicon (SEQ ID NO: 6897)), G6PD (GenBank Accession No. NM_000402 (SEQ ID NO: 6898); G6PD amplicon (SEQ ID NO: 6899)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67), to obtain a value of fold up-regulation for each sample relative to median of the normal PM samples.

FIG. 22 is a histogram showing over expression of the above-indicated *Homo sapiens* collagen, type XI, alpha 1 (COL11A1) transcripts in cancerous breast samples relative to the normal samples. Values represent the average of duplicate experiments. Error bars indicate the minimal and maximal values obtained.

As is evident from FIG. 22, the expression of Homo sapiens collagen, type XI, alpha 1 (COL11A1) transcripts detectable by the above amplicon(s) in cancer samples was significantly higher than in the non-cancerous samples (Sample Nos. 56-60, 63-67). Notably an over-expression of at least 5 fold was found in 18 out of 28 adenocarcinoma samples.

Primer pairs are also optionally and preferably encompassed within the present invention; for example, for the above experiment, the following primer pair was used as a non-limiting illustrative example only of a suitable primer pair: HUMCA1X1A seg55F forward primer SEQ ID NO: 6890; and HUMCA1X1A seg55R reverse primer SEQ ID NO: 6891.

The present invention also preferably encompasses any amplicon obtained through the use of any suitable primer pair; for example, for the above experiment, the following amplicon was obtained as a non-limiting illustrative example only of a suitable amplicon: HUMCA1X1A seg55.

```
Forward primer-HUMCA1X1A seg55F: SEQ ID NO: 6890
TTCTCATAGTATTCCATTGATTGGGTA Reverse primer-HUMCA1X1A seg55R: SEQ ID NO: 6891
CACCGGTATGGAGAATAGCGA Amplicon: SEQ ID NO: 6889
TTCTCATAGTATTCCATTGATTGGGTATACCAGGTTCTGTTTACTTTTAC

TTGGCAGTTGATAGAATAGGTGTAGTTTATACTTTTTCGCTATTCTCCAT

ACCGGTG
```

22

Expression of *Homo sapiens* collagen, type XI, alpha 1 (COL11A1) HUMCA1X1A transcripts which are detectable by amplicon as depicted in sequence name HUMCA1X1A seg55 in normal and cancerous lung tissues Expression of Homo sapiens collagen, type XI, alpha 1 (COL11A1) transcripts detectable by or according to seg55, HUMCA1XIA seg55 amplicon(s) and primers HUMCA1XIA seg55F and HUMCA1X1A seg55R was measured by real time PCR. In parallel the expression of four housekeeping genes—PBGD (GenBank Accession No. BC019323; amplicon—PBGD-amplicon), HPRT1 (GenBank Accession No. NM 000194; amplicon—HPRT1-amplicon), Ubiquitin (GenBank Accession No. BC000449; amplicon—Ubiquitin-amplicon) and SDHA (GenBank Accession No. NM 004168; amplicon—SDHA-amplicon) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99), to obtain a value of fold up-regulation for each sample relative to median of the normal PM samples.

FIG. 23 is a histogram showing over expression of the above-indicated *Homo sapiens* collagen, type XI, alpha 1 (COL11A1) transcripts in cancerous lung samples relative to the normal samples. Values represent the average of duplicate experiments. Error bars indicate the minimal and maximal values obtained.

As is evident from FIG. 23, the expression of Homo sapiens collagen, type XI, alpha 1 (COL11A1) transcripts detectable by the above amplicon(s) in cancer samples was significantly higher than in the non-cancerous samples (Sample Nos. 47-50, 90-93, 96-99). Notably an over-expression of at least 5 fold was found in 11 out of 15 adenocarcinoma samples, 11 out of 16 squamous cell carcinoma samples, and in 2 out of 4 large cell carcinoma samples.

Primer pairs are also optionally and preferably encompassed within the present invention; for example, for the above experiment, the following primer pair was used as a non-limiting illustrative example only of a suitable primer pair: HUMCA1X1A seg55F forward primer (SEQ ID NO:6890); and HUMCA1X1A seg55R reverse primer (SEQ ID NO:6891).

The present invention also preferably encompasses any amplicon obtained through the use of any suitable primer pair; for example, for the above experiment, the following amplicon was obtained as a non-limiting illustrative example only of a suitable amplicon: HUMCA1X1A seg55 (SEQ ID NO:6889).

```
Forward primer-HUMCA1X1A seg55F (SEQ ID NO: 6890):
TTCTCATAGTATTCCATTGATTGGGTA Reverse primer-HIMCA1X1A seg55R (SEQ ID NO: 6891):
CACCGGTATGGAGAATAGCGA Amplicon (SEQ ID NO: 6889):
TTCTCATAGTATTCCATTGATTGGGTATACCAGGTTCTGTTTACTTTTAC

TTGGCAGTTGATAGAATAGGTGTAGTTTATACTTTTTCGCTATTCTCCAT

ACCGGTG

22
```

Description for Cluster HUMKER56K

Cluster HUMKER56K features 6 transcript(s) and 60 segment(s) of interest, the names for which are given in Tables 851 and 852, respectively, the sequences themselves are given at the end of the application. The selected protein variants are given in Table 853.

TABLE 851

Transcripts of interest
Transcript Name

HUMKER56K_T10 (SEQ ID NO: 896)
HUMKER56K_T21 (SEQ ID NO: 897)
HUMKER56K_T24 (SEQ ID NO: 898)
HUMKER56K_T25 (SEQ ID NO: 899)
HUMKER56K_T36 (SEQ ID NO: 900)
HUMKER56K_T37 (SEQ ID NO: 901)

TABLE 852

Segments of interest
Segment Name

HUMKER56K_node_18 (SEQ ID NO: 902)
HUMKER56K_node_19 (SEQ ID NO: 903)
HUMKER56K_node_29 (SEQ ID NO: 904)
HUMKER56K_node_31 (SEQ ID NO: 905)
HUMKER56K_node_32 (SEQ ID NO: 906)
HUMKER56K_node_35 (SEQ ID NO: 907)
HUMKER56K_node_42 (SEQ ID NO: 908)
HUMKER56K_node_67 (SEQ ID NO: 909)
HUMKER56K_node_6 (SEQ ID NO: 910)
HUMKER56K_node_7 (SEQ ID NO: 911)
HUMKER56K_node_8 (SEQ ID NO: 912)
HUMKER56K_node_9 (SEQ ID NO: 913)
HUMKER56K_node_10 (SEQ ID NO: 914)
HUMKER56K_node_11 (SEQ ID NO: 915)
HUMKER56K_node_12 (SEQ ID NO: 916)
HUMKER56K_node_13 (SEQ ID NO: 917)
HUMKER56K_node_14 (SEQ ID NO: 918)
HUMKER56K_node_15 (SEQ ID NO: 919)
HUMKER56K_node_16 (SEQ ID NO: 920)
HUMKER56K_node_17 (SEQ ID NO: 921)
HUMKER56K_node_20 (SEQ ID NO: 922)
HUMKER56K_node_21 (SEQ ID NO: 923)
HUMKER56K_node_22 (SEQ ID NO: 924)
HUMKER56K_node_23 (SEQ ID NO: 925)
HUMKER56K_node_24 (SEQ ID NO: 926)
HUMKER56K_node_25 (SEQ ID NO: 927)
HUMKER56K_node_27 (SEQ ID NO: 928)
HUMKER56K_node_28 (SEQ ID NO: 929)
HUMKER56K_node_30 (SEQ ID NO: 930)
HUMKER56K_node_33 (SEQ ID NO: 931)
HUMKER56K_node_34 (SEQ ID NO: 932)
HUMKER56K_node_36 (SEQ ID NO: 933)
HUMKER56K_node_37 (SEQ ID NO: 934)
HUMKER56K_node_38 (SEQ ID NO: 935)
HUMKER56K_node_40 (SEQ ID NO: 936)
HUMKER56K_node_41 (SEQ ID NO: 937)
HUMKER56K_node_43 (SEQ ID NO: 938)
HUMKER56K_node_44 (SEQ ID NO: 939)
HUMKER56K_node_46 (SEQ ID NO: 940)
HUMKER56K_node_47 (SEQ ID NO: 941)
HUMKER56K_node_49 (SEQ ID NO: 942)
HUMKER56K_node_50 (SEQ ID NO: 943)
HUMKER56K_node_51 (SEQ ID NO: 944)
HUMKER56K_node_52 (SEQ ID NO: 945)
HUMKER56K_node_53 (SEQ ID NO: 946)
HUMKER56K_node_54 (SEQ ID NO: 947)
HUMKER56K_node_55 (SEQ ID NO: 948)
HUMKER56K_node_56 (SEQ ID NO: 949)
HUMKER56K_node_57 (SEQ ID NO: 950)
HUMKER56K_node_58 (SEQ ID NO: 951)
HUMKER56K_node_59 (SEQ ID NO: 952)
HUMKER56K_node_60 (SEQ ID NO: 953)
HUMKER56K_node_61 (SEQ ID NO: 954)
HUMKER56K_node_62 (SEQ ID NO: 955)
HUMKER56K_node_63 (SEQ ID NO: 956)
HUMKER56K_node_64 (SEQ ID NO: 957)
HUMKER56K_node_65 (SEQ ID NO: 958)
HUMKER56K_node_66 (SEQ ID NO: 959)
HUMKER56K_node_68 (SEQ ID NO: 960)
HUMKER56K_node_69 (SEQ ID NO: 961)

TABLE 853

Proteins of interest

| Protein Name | Corresponding Transcript(s) |
| --- | --- |
| HUMKER56K_P6 | HUMKER56K_T10 (SEQ ID NO: 896) |
| HUMKER56K_P17 | HUMKER56K_T21 (SEQ ID NO: 897) |
| HUMKER56K_P19 | HUMKER56K_T24 (SEQ ID NO: 898) |
| HUMKER56K_P20 | HUMKER56K_T25 (SEQ ID NO: 899); HUMKER56K_T36 (SEQ ID NO: 900) |
| HUMKER56K_P26 | HUMKER56K_T37 (SEQ ID NO: 901) |

These sequences are variants of the known protein Keratin, type II cytoskeletal 6A (SwissProt accession identifier K2CA_HUMAN; known also according to the synonyms Cytokeratin 6A; CK 6A; K6a keratin), referred to herein as the previously known protein.

Protein Keratin, type II cytoskeletal 6A is known or believed to have the following function(s): THERE ARE TWO TYPES OF CYTOSKELETAL AND MICROFIBRILLAR KERATIN: I (ACIDIC; 40-55 kDa) [K9 TO K20] AND II (NEUTRAL TO BASIC; 56-70 kDa) [K1 TO K8]. BOTH A BASIC AND AN ACIDIC KERATIN ARE REQUIRED FOR FILAMENT ASSEMBLY. The sequence for protein Keratin, type II cytoskeletal 6A is given at the end of the application, as "Keratin, type II cytoskeletal 6A amino acid sequence". Known polymorphisms for this sequence are as shown in Table 854.

TABLE 854

Amino acid mutations for Known Protein

| SNP position(s) on amino acid sequence | Comment |
|---|---|
| 170 | Missing (in PC1). /FTId = VAR_003878. |
| 173 | F -> V (in PC1). /FTId = VAR_017075. |
| 468 | L -> R (in PC1). /FTId = VAR_017076. |
| 471 | E -> K (in PC1). /FTId = VAR_017077. |
| 394 | I -> S |

The following GO Annotation(s) apply to the previously known protein. The following annotation(s) were found: ectoderm development, which are annotation(s) related to Biological Process; structural protein of cytoskeleton, which are annotation(s) related to Molecular Function; and intermediate filament, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMKER56K can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 25 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 25 and Table 855. This cluster is overexpressed (at least at a minimum level) in the following pathological conditions: a mixture of malignant tumors from different tissues, head and neck malignant tumors, myosarcoma and pancreas carcinoma.

TABLE 855

Normal tissue distribution

| Name of Tissue | Number |
|---|---|
| Adrenal | 40 |
| Bladder | 123 |
| Brain | 6 |
| Colon | 0 |
| Epithelial | 790 |
| General | 256 |

TABLE 855-continued

Normal tissue distribution

| Name of Tissue | Number |
|---|---|
| head and neck | 344 |
| Kidney | 0 |
| Lung | 1072 |
| Breast | 593 |
| Muscle | 7 |
| Ovary | 0 |
| Pancreas | 0 |
| Prostate | 663 |
| Skin | 4086 |
| Uterus | 723 |

TABLE 856

P values and ratios for expression in cancerous tissue

| Name of Tissue | P1 | P2 | SP1 | R3 | SP2 | R4 |
|---|---|---|---|---|---|---|
| Adrenal | 6.9e−01 | 7.3e−01 | 7.1e−01 | 1.1 | 7.8e−01 | 0.9 |
| Bladder | 7.5e−01 | 8.0e−01 | 6.9e−06 | 0.7 | 1.2e−03 | 0.5 |
| Brain | 7.6e−01 | 6.1e−01 | 1 | 0.3 | 1.7e−118 | 1.6 |
| Colon | 2.2e−01 | 2.7e−01 | 0.0e+00 | 0.0 | 0.0e+00 | 0.0 |
| Epithelial | 2.3e−01 | 6.4e−01 | 1 | 0.3 | 1 | 0.2 |
| General | 1.8e−03 | 4.1e−02 | 4.6e−12 | 0.9 | 2.0e−09 | 0.9 |
| head and neck | 2.4e−01 | 4.4e−01 | 5.1e−09 | 5.1 | 7.2e−03 | 1.7 |
| Kidney | 4.3e−01 | 5.3e−01 | 9.9e−09 | 2.4 | 5.3e−06 | 1.9 |
| Lung | 6.6e−01 | 8.7e−01 | 1 | 0.3 | 1 | 0.1 |
| Breast | 7.4e−01 | 6.4e−01 | 1 | 0.2 | 1 | 0.1 |
| Muscle | 4.0e−01 | 4.8e−01 | 3.2e−03 | 8.9 | 5.9e−02 | 2.9 |
| Ovary | 6.2e−01 | 4.2e−01 | 6.8e−01 | 1.5 | 2.4e−02 | 1.9 |
| Pancreas | 3.3e−01 | 6.9e−02 | 1.8e−01 | 3.7 | 1.5e−13 | 9.1 |
| Prostate | 7.5e−01 | 7.6e−01 | 1 | 0.1 | 1 | 0.1 |
| Skin | 4.9e−01 | 6.4e−01 | 6.3e−33 | 0.0 | 1 | 0.0 |
| Uterus | 8.0e−01 | 8.6e−01 | 1 | 0.0 | 1 | 0.0 |

As noted above, cluster HUMKER56K features 60 segment(s), which were listed in Table 852 above and for which the sequence(s) are given at the end of the application. These segment(s) are portions of nucleic acid sequence(s) which are described herein separately because they are of particular interest. A description of each segment according to the present invention is now provided.

Segment cluster HUMKER56K_node_18 (SEQ ID NO:902) according to the present invention is supported by 45 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 857 below describes the starting and ending position of this segment on each transcript.

TABLE 857

Segment location on transcripts

| Transcript name | Segment starting position | Segment ending position |
|---|---|---|
| HUMKER56K_T10 (SEQ ID NO: 896) | 484 | 641 |
| HUMKER56K_T21 (SEQ ID NO: 897) | 484 | 641 |
| HUMKER56K_T24 (SEQ ID NO: 898) | 484 | 641 |
| HUMKER56K_T25 (SEQ ID NO: 899) | 484 | 641 |

TABLE 857-continued

Segment location on transcripts

| Transcript name | Segment starting position | Segment ending position |
|---|---|---|
| HUMKER56K_T36 (SEQ ID NO: 900) | 484 | 641 |
| HUMKER56K_T37 (SEQ ID NO: 901) | 484 | 641 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_19 (SEQ ID NO:903) according to the present invention is supported by 7 libraries. The number of libraries was determined as previously described. This segment can be found in the following transcript(s): HUMKER56K_T10 (SEQ ID NO:896) and HUMKER56K_T36 (SEQ ID NO:900). Table 858 below describes the starting and ending position of this segment on each transcript.

TABLE 858

Segment location on transcripts

| Transcript name | Segment starting position | Segment ending position |
|---|---|---|
| HUMKER56K_T10 (SEQ ID NO: 896) | 642 | 1553 |
| HUMKER56K_T36 (SEQ ID NO: 900) | 642 | 1553 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, since it is in the coding region for the corresponding transcript.

Segment cluster HUMKER56K_node_29 (SEQ ID NO:904) according to the present invention is supported by 6 libraries. The number of libraries was determined as previously described. This segment can be found in the following transcript(s): HUMKER56K_T25 (SEQ ID NO:899), HUMKER56K_T36 (SEQ ID NO:900) and HUMKER56K_T37 (SEQ ID NO:901). Table 859 below describes the starting and ending position of this segment on each transcript.

TABLE 859

Segment location on transcripts

| Transcript name | Segment starting position | Segment ending position |
|---|---|---|
| HUMKER56K_T25 (SEQ ID NO: 899) | 918 | 1075 |
| HUMKER56K_T36 (SEQ ID NO: 900) | 1830 | 1987 |
| HUMKER56K_T37 (SEQ ID NO: 901) | 918 | 1075 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P26, since it is in the coding region for the corresponding transcript.

Segment cluster HUMKER56K_node_31 (SEQ ID NO:905) according to the present invention is supported by 4 libraries. The number of libraries was determined as previously described. This segment can be found in the following transcript(s): HUMKER56K_T24 (SEQ ID NO:898) and HUMKER56K_T37 (SEQ ID NO:901). Table 860 below describes the starting and ending position of this segment on each transcript.

TABLE 860

Segment location on transcripts

| Transcript name | Segment starting position | Segment ending position |
|---|---|---|
| HUMKER56K_T24 (SEQ ID NO: 898) | 1014 | 1137 |
| HUMKER56K_T37 (SEQ ID NO: 901) | 1172 | 1295 |

This segment can be found in both coding and non-coding regions of transcript(s) as follows. The segment can be found in a non-coding region of transcript(s) that are related to the following protein(s): HUMKER56K_P26. This segment can also be found in the following protein(s): HUMKER56K_P19, since it is in the coding region for the corresponding transcript.

Segment cluster HUMKER56K_node_32 (SEQ ID NO:906) according to the present invention is supported by 67 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 861 below describes the starting and ending position of this segment on each transcript.

TABLE 861

Segment location on transcripts

| Transcript name | Segment starting position | Segment ending position |
|---|---|---|
| HUMKER56K_T10 (SEQ ID NO: 896) | 1926 | 2046 |
| HUMKER56K_T21 (SEQ ID NO: 897) | 1014 | 1134 |
| HUMKER56K_T24 (SEQ ID NO: 898) | 1138 | 1258 |
| HUMKER56K_T25 (SEQ ID NO: 899) | 1172 | 1292 |
| HUMKER56K_T36 (SEQ ID NO: 900) | 2084 | 2204 |
| HUMKER56K_T37 (SEQ ID NO: 901) | 1296 | 1416 |

This segment can be found in both coding and non-coding regions of transcript(s) as follows. The segment can be found in a non-coding region of transcript(s) that are related to the following protein(s): HUMKER56K_P26. This segment can also be found in the following protein(s): HUMKER56K_P6, HUMKER56K_P17, HUMKER56K_P19 and HUMKER56K_P20, since it is in the coding region for the corresponding transcript.

Segment cluster HUMKER56K_node_35 (SEQ ID NO:907) according to the present invention is supported by 6 libraries. The number of libraries was determined as previously described. This segment can be found in the following transcript(s): HUMKER56K_T21 (SEQ ID NO: 897). Table 862 below describes the starting and ending position of this segment on each transcript.

TABLE 862

| | Segment location on transcripts | |
|---|---|---|
| Transcript name | Segment starting position | Segment ending position |
| HUMKER56K_T21 (SEQ ID NO: 897) | 1179 | 1678 |

This segment can be found in the following protein(s): HUMKER56K_P17.

Segment cluster HUMKER56K_node_42 (SEQ ID NO:908) according to the present invention is supported by 49 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 863 below describes the starting and ending position of this segment on each transcript.

TABLE 863

| | Segment location on transcripts | |
|---|---|---|
| Transcript name | Segment starting position | Segment ending position |
| HUMKER56K_T10 (SEQ ID NO: 896) | 2271 | 2398 |
| HUMKER56K_T21 (SEQ ID NO: 897) | 1859 | 1986 |
| HUMKER56K_T24 (SEQ ID NO: 898) | 1483 | 1610 |
| HUMKER56K_T25 (SEQ ID NO: 899) | 1517 | 1644 |
| HUMKER56K_T36 (SEQ ID NO: 900) | 2429 | 2556 |
| HUMKER56K_T37 (SEQ ID NO: 901) | 1641 | 1768 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_67 (SEQ ID NO:909) according to the present invention is supported by 43 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 864 below describes the starting and ending position of this segment on each transcript.

TABLE 864

| | Segment location on transcripts | |
|---|---|---|
| Transcript name | Segment starting position | Segment ending position |
| HUMKER56K_T10 (SEQ ID NO: 896) | 2903 | 3113 |
| HUMKER56K_T21 (SEQ ID NO: 897) | 2491 | 2701 |
| HUMKER56K_T24 (SEQ ID NO: 898) | 2115 | 2325 |
| HUMKER56K_T25 (SEQ ID NO: 899) | 2149 | 2359 |
| HUMKER56K_T36 (SEQ ID NO: 900) | 3061 | 3271 |
| HUMKER56K_T37 (SEQ ID NO: 901) | 2273 | 2483 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

According to an optional embodiment of the present invention, short segments related to the above cluster are also provided. These segments are up to about 120 bp in length, and so are included in a separate description.

Segment cluster HUMKER56K_node_6 (SEQ ID NO:910) according to the present invention is supported by 27 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 865 below describes the starting and ending position of this segment on each transcript.

TABLE 865

| | Segment location on transcripts | |
|---|---|---|
| Transcript name | Segment starting position | Segment ending position |
| HUMKER56K_T10 (SEQ ID NO: 896) | 1 | 93 |
| HUMKER56K_T21 (SEQ ID NO: 897) | 1 | 93 |
| HUMKER56K_T24 (SEQ ID NO: 898) | 1 | 93 |
| HUMKER56K_T25 (SEQ ID NO: 899) | 1 | 93 |
| HUMKER56K_T36 (SEQ ID NO: 900) | 1 | 93 |
| HUMKER56K_T37 (SEQ ID NO: 901) | 1 | 93 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_7 (SEQ ID NO:911) according to the present invention is supported by 31 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 866 below describes the starting and ending position of this segment on each transcript.

TABLE 866

Segment location on transcripts

| Transcript name | Segment starting position | Segment ending position |
|---|---|---|
| HUMKER56K_T10 (SEQ ID NO: 896) | 94 | 121 |
| HUMKER56K_T21 (SEQ ID NO: 897) | 94 | 121 |
| HUMKER56K_T24 (SEQ ID NO: 898) | 94 | 121 |
| HUMKER56K_T25 (SEQ ID NO: 899) | 94 | 121 |
| HUMKER56K_T36 (SEQ ID NO: 900) | 94 | 121 |
| HUMKER56K_T37 (SEQ ID NO: 901) | 94 | 121 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_8 (SEQ ID NO:912) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 867 below describes the starting and ending position of this segment on each transcript.

TABLE 867

Segment location on transcripts

| Transcript name | Segment starting position | Segment ending position |
|---|---|---|
| HUMKER56K_T10 (SEQ ID NO: 896) | 122 | 136 |
| HUMKER56K_T21 (SEQ ID NO: 897) | 122 | 136 |
| HUMKER56K_T24 (SEQ ID NO: 898) | 122 | 136 |
| HUMKER56K_T25 (SEQ ID NO: 899) | 122 | 136 |
| HUMKER56K_T36 (SEQ ID NO: 900) | 122 | 136 |
| HUMKER56K_T37 (SEQ ID NO: 901) | 122 | 136 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_9 (SEQ ID NO:913) according to the present invention is supported by 31 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 868 below describes the starting and ending position of this segment on each transcript.

TABLE 868

Segment location on transcripts

| Transcript name | Segment starting position | Segment ending position |
|---|---|---|
| HUMKER56K_T10 (SEQ ID NO: 896) | 137 | 168 |
| HUMKER56K_T21 (SEQ ID NO: 897) | 137 | 168 |
| HUMKER56K_T24 (SEQ ID NO: 898) | 137 | 168 |
| HUMKER56K_T25 (SEQ ID NO: 899) | 137 | 168 |
| HUMKER56K_T36 (SEQ ID NO: 900) | 137 | 168 |
| HUMKER56K_T37 (SEQ ID NO: 901) | 137 | 168 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_10 (SEQ ID NO:914) according to the present invention is supported by 28 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 869 below describes the starting and ending position of this segment on each transcript.

TABLE 869

Segment location on transcripts

| Transcript name | Segment starting position | Segment ending position |
|---|---|---|
| HUMKER56K_T10 (SEQ ID NO: 896) | 169 | 202 |
| HUMKER56K_T21 (SEQ ID NO: 897) | 169 | 202 |
| HUMKER56K_T24 (SEQ ID NO: 898) | 169 | 202 |
| HUMKER56K_T25 (SEQ ID NO: 899) | 169 | 202 |
| HUMKER56K_T36 (SEQ ID NO: 900) | 169 | 202 |
| HUMKER56K_T37 (SEQ ID NO: 901) | 169 | 202 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_11 (SEQ ID NO:915) according to the present invention is supported by 28 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 870 below describes the starting and ending position of this segment on each transcript.

TABLE 870

Segment location on transcripts

| Transcript name | Segment starting position | Segment ending position |
|---|---|---|
| HUMKER56K_T10 (SEQ ID NO: 896) | 203 | 274 |
| HUMKER56K_T21 (SEQ ID NO: 897) | 203 | 274 |
| HUMKER56K_T24 (SEQ ID NO: 898) | 203 | 274 |
| HUMKER56K_T25 (SEQ ID NO: 899) | 203 | 274 |
| HUMKER56K_T36 (SEQ ID NO: 900) | 203 | 274 |
| HUMKER56K_T37 (SEQ ID NO: 901) | 203 | 274 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_12 (SEQ ID NO:916) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 871 below describes the starting and ending position of this segment on each transcript.

TABLE 871

Segment location on transcripts

| Transcript name | Segment starting position | Segment ending position |
|---|---|---|
| HUMKER56K_T10 (SEQ ID NO: 896) | 275 | 298 |
| HUMKER56K_T21 (SEQ ID NO: 897) | 275 | 298 |
| HUMKER56K_T24 (SEQ ID NO: 898) | 275 | 298 |
| HUMKER56K_T25 (SEQ ID NO: 899) | 275 | 298 |
| HUMKER56K_T36 (SEQ ID NO: 900) | 275 | 298 |
| HUMKER56K_T37 (SEQ ID NO: 901) | 275 | 298 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_13 (SEQ ID NO:917) according to the present invention is supported by 31 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 872 below describes the starting and ending position of this segment on each transcript.

TABLE 872

Segment location on transcripts

| Transcript name | Segment starting position | Segment ending position |
|---|---|---|
| HUMKER56K_T10 (SEQ ID NO: 896) | 299 | 328 |
| HUMKER56K_T21 (SEQ ID NO: 897) | 299 | 328 |
| HUMKER56K_T24 (SEQ ID NO: 898) | 299 | 328 |
| HUMKER56K_T25 (SEQ ID NO: 899) | 299 | 328 |
| HUMKER56K_T36 (SEQ ID NO: 900) | 299 | 328 |
| HUMKER56K_T37 (SEQ ID NO: 901) | 299 | 328 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_14 (SEQ ID NO:918) according to the present invention is supported by 31 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 873 below describes the starting and ending position of this segment on each transcript.

TABLE 873

Segment location on transcripts

| Transcript name | Segment starting position | Segment ending position |
|---|---|---|
| HUMKER56K_T10 (SEQ ID NO: 896) | 329 | 370 |
| HUMKER56K_T21 (SEQ ID NO: 897) | 329 | 370 |
| HUMKER56K_T24 (SEQ ID NO: 898) | 329 | 370 |
| HUMKER56K_T25 (SEQ ID NO: 899) | 329 | 370 |
| HUMKER56K_T36 (SEQ ID NO: 900) | 329 | 370 |
| HUMKER56K_T37 (SEQ ID NO: 901) | 329 | 370 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_15 (SEQ ID NO:919) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 874 below describes the starting and ending position of this segment on each transcript.

TABLE 874

Segment location on transcripts

| Transcript name | Segment starting position | Segment ending position |
|---|---|---|
| HUMKER56K_T10 (SEQ ID NO: 896) | 371 | 381 |
| HUMKER56K_T21 (SEQ ID NO: 897) | 371 | 381 |
| HUMKER56K_T24 (SEQ ID NO: 898) | 371 | 381 |
| HUMKER56K_T25 (SEQ ID NO: 899) | 371 | 381 |
| HUMKER56K_T36 (SEQ ID NO: 900) | 371 | 381 |
| HUMKER56K_T37 (SEQ ID NO: 901) | 371 | 381 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_16 (SEQ ID NO:920) according to the present invention is supported by 33 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 875 below describes the starting and ending position of this segment on each transcript.

TABLE 875

Segment location on transcripts

| Transcript name | Segment starting position | Segment ending position |
|---|---|---|
| HUMKER56K_T10 (SEQ ID NO: 896) | 382 | 411 |
| HUMKER56K_T21 (SEQ ID NO: 897) | 382 | 411 |
| HUMKER56K_T24 (SEQ ID NO: 898) | 382 | 411 |
| HUMKER56K_T25 (SEQ ID NO: 899) | 382 | 411 |
| HUMKER56K_T36 (SEQ ID NO: 900) | 382 | 411 |
| HUMKER56K_T37 (SEQ ID NO: 901) | 382 | 411 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_17 (SEQ ID NO:921) according to the present invention is supported by 38 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 876 below describes the starting and ending position of this segment on each transcript.

TABLE 876

Segment location on transcripts

| Transcript name | Segment starting position | Segment ending position |
|---|---|---|
| HUMKER56K_T10 (SEQ ID NO: 896) | 412 | 483 |
| HUMKER56K_T21 (SEQ ID NO: 897) | 412 | 483 |
| HUMKER56K_T24 (SEQ ID NO: 898) | 412 | 483 |
| HUMKER56K_T25 (SEQ ID NO: 899) | 412 | 483 |
| HUMKER56K_T36 (SEQ ID NO: 900) | 412 | 483 |
| HUMKER56K_T37 (SEQ ID NO: 901) | 412 | 483 |

This segment can be found in both coding and non-coding regions of transcript(s) as follows. The segment can be found in a non-coding region of transcript(s) that are related to the following protein(s): HUMKER56K_P6 and HUMKER56K_P20. This segment can also be found in the following protein(s): HUMKER56K_P17, HUMKER56K_P19 and HUMKER56K_P26, since it is in the coding region for the corresponding transcript.

Segment cluster HUMKER56K_node_20 (SEQ ID NO:922) according to the present invention is supported by 58 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 877 below describes the starting and ending position of this segment on each transcript.

TABLE 877

Segment location on transcripts

| Transcript name | Segment starting position | Segment ending position |
|---|---|---|
| HUMKER56K_T10 (SEQ ID NO: 896) | 1554 | 1613 |
| HUMKER56K_T21 (SEQ ID NO: 897) | 642 | 701 |
| HUMKER56K_T24 (SEQ ID NO: 898) | 642 | 701 |
| HUMKER56K_T25 (SEQ ID NO: 899) | 642 | 701 |
| HUMKER56K_T36 (SEQ ID NO: 900) | 1554 | 1613 |
| HUMKER56K_T37 (SEQ ID NO: 901) | 642 | 701 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_21 (SEQ ID NO:923) according to the present invention is supported by 63 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 878 below describes the starting and ending position of this segment on each transcript.

TABLE 878

Segment location on transcripts

| Transcript name | Segment starting position | Segment ending position |
|---|---|---|
| HUMKER56K_T10 (SEQ ID NO: 896) | 1614 | 1673 |
| HUMKER56K_T21 (SEQ ID NO: 897) | 702 | 761 |
| HUMKER56K_T24 (SEQ ID NO: 898) | 702 | 761 |
| HUMKER56K_T25 (SEQ ID NO: 899) | 702 | 761 |
| HUMKER56K_T36 (SEQ ID NO: 900) | 1614 | 1673 |
| HUMKER56K_T37 (SEQ ID NO: 901) | 702 | 761 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_22 (SEQ ID NO:924) according to the present invention is supported by 67 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 879 below describes the starting and ending position of this segment on each transcript.

TABLE 879

Segment location on transcripts

| Transcript name | Segment starting position | Segment ending position |
|---|---|---|
| HUMKER56K_T10 (SEQ ID NO: 896) | 1674 | 1727 |
| HUMKER56K_T21 (SEQ ID NO: 897) | 762 | 815 |
| HUMKER56K_T24 (SEQ ID NO: 898) | 762 | 815 |
| HUMKER56K_T25 (SEQ ID NO: 899) | 762 | 815 |
| HUMKER56K_T36 (SEQ ID NO: 900) | 1674 | 1727 |
| HUMKER56K_T37 (SEQ ID NO: 901) | 762 | 815 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_23 (SEQ ID NO:925) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 880 below describes the starting and ending position of this segment on each transcript.

TABLE 880

Segment location on transcripts

| Transcript name | Segment starting position | Segment ending position |
|---|---|---|
| HUMKER56K_T10 (SEQ ID NO: 896) | 1728 | 1734 |
| HUMKER56K_T21 (SEQ ID NO: 897) | 816 | 822 |
| HUMKER56K_T24 (SEQ ID NO: 898) | 816 | 822 |
| HUMKER56K_T25 (SEQ ID NO: 899) | 816 | 822 |
| HUMKER56K_T36 (SEQ ID NO: 900) | 1728 | 1734 |
| HUMKER56K_T37 (SEQ ID NO: 901) | 816 | 822 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_24 (SEQ ID NO:926) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 881 below describes the starting and ending position of this segment on each transcript.

TABLE 881

Segment location on transcripts

| Transcript name | Segment starting position | Segment ending position |
|---|---|---|
| HUMKER56K_T10 (SEQ ID NO: 896) | 1735 | 1739 |
| HUMKER56K_T21 (SEQ ID NO: 897) | 823 | 827 |
| HUMKER56K_T24 (SEQ ID NO: 898) | 823 | 827 |
| HUMKER56K_T25 (SEQ ID NO: 899) | 823 | 827 |
| HUMKER56K_T36 (SEQ ID NO: 900) | 1735 | 1739 |
| HUMKER56K_T37 (SEQ ID NO: 901) | 823 | 827 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_25 (SEQ ID NO:927) according to the present invention is supported by 70 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 882 below describes the starting and ending position of this segment on each transcript.

TABLE 882

Segment location on transcripts

| Transcript name | Segment starting position | Segment ending position |
|---|---|---|
| HUMKER56K_T10 (SEQ ID NO: 896) | 1740 | 1768 |
| HUMKER56K_T21 (SEQ ID NO: 897) | 828 | 856 |
| HUMKER56K_T24 (SEQ ID NO: 898) | 828 | 856 |
| HUMKER56K_T25 (SEQ ID NO: 899) | 828 | 856 |
| HUMKER56K_T36 (SEQ ID NO: 900) | 1740 | 1768 |
| HUMKER56K_T37 (SEQ ID NO: 901) | 828 | 856 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_27 (SEQ ID NO:928) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 883 below describes the starting and ending position of this segment on each transcript.

TABLE 883

Segment location on transcripts

| Transcript name | Segment starting position | Segment ending position |
|---|---|---|
| HUMKER56K_T10 (SEQ ID NO: 896) | 1769 | 1790 |
| HUMKER56K_T21 (SEQ ID NO: 897) | 857 | 878 |
| HUMKER56K_T24 (SEQ ID NO: 898) | 857 | 878 |
| HUMKER56K_T25 (SEQ ID NO: 899) | 857 | 878 |
| HUMKER56K_T36 (SEQ ID NO: 900) | 1769 | 1790 |
| HUMKER56K_T37 (SEQ ID NO: 901) | 857 | 878 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_28 (SEQ ID NO:929) according to the present invention is supported by 69 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 884 below describes the starting and ending position of this segment on each transcript.

TABLE 884

Segment location on transcripts

| Transcript name | Segment starting position | Segment ending position |
|---|---|---|
| HUMKER56K_T10 (SEQ ID NO: 896) | 1791 | 1829 |
| HUMKER56K_T21 (SEQ ID NO: 897) | 879 | 917 |
| HUMKER56K_T24 (SEQ ID NO: 898) | 879 | 917 |
| HUMKER56K_T25 (SEQ ID NO: 899) | 879 | 917 |
| HUMKER56K_T36 (SEQ ID NO: 900) | 1791 | 1829 |
| HUMKER56K_T37 (SEQ ID NO: 901) | 879 | 917 |

This segment can be found in both coding and non-coding regions of transcript(s) as follows. The segment can be found in a non-coding region of transcript(s) that are related to the following protein(s): HUMKER56K_P20. This segment can also be found in the following protein(s): HUMKER56K_P6, HUMKER56K_P17, HUMKER56K_P19 and HUMKER56K_P26, since it is in the coding region for the corresponding transcript.

Segment cluster HUMKER56K_node_30 (SEQ ID NO:930) according to the present invention is supported by 70 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 885 below describes the starting and ending position of this segment on each transcript.

TABLE 885

Segment location on transcripts

| Transcript name | Segment starting position | Segment ending position |
|---|---|---|
| HUMKER56K_T10 (SEQ ID NO: 896) | 1830 | 1925 |
| HUMKER56K_T21 (SEQ ID NO: 897) | 918 | 1013 |
| HUMKER56K_T24 (SEQ ID NO: 898) | 918 | 1013 |
| HUMKER56K_T25 (SEQ ID NO: 899) | 1076 | 1171 |
| HUMKER56K_T36 (SEQ ID NO: 900) | 1988 | 2083 |
| HUMKER56K_T37 (SEQ ID NO: 901) | 1076 | 1171 |

This segment can be found in both coding and non-coding regions of transcript(s) as follows. The segment can be found in a non-coding region of transcript(s) that are related to the following protein(s): HUMKER56K_P26. This segment can also be found in the following protein(s): HUMKER56K_P6, HUMKER56K_P17, HUMKER56K_P19 and HUMKER56K_P20, since it is in the coding region for the corresponding transcript.

Segment cluster HUMKER56K_node_33 (SEQ ID NO:931) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 886 below describes the starting and ending position of this segment on each transcript.

TABLE 886

Segment location on transcripts

| Transcript name | Segment starting position | Segment ending position |
|---|---|---|
| HUMKER56K_T10 (SEQ ID NO: 896) | 2047 | 2066 |
| HUMKER56K_T21 (SEQ ID NO: 897) | 1135 | 1154 |
| HUMKER56K_T24 (SEQ ID NO: 898) | 1259 | 1278 |
| HUMKER56K_T25 (SEQ ID NO: 899) | 1293 | 1312 |
| HUMKER56K_T36 (SEQ ID NO: 900) | 2205 | 2224 |
| HUMKER56K_T37 (SEQ ID NO: 901) | 1417 | 1436 |

This segment can be found in both coding and non-coding regions of transcript(s) as follows. The segment can be found in a non-coding region of transcript(s) that are related to the following protein(s): HUMKER56K_P19 and HUMKER56K_P26. This segment can also be found in the following protein(s): HUMKER56K_P6, HUMKER56K_P17 and HUMKER56K_P20, since it is in the coding region for the corresponding transcript.

Segment cluster HUMKER56K_node_34 (SEQ ID NO:932) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 887 below describes the starting and ending position of this segment on each transcript.

TABLE 887

Segment location on transcripts

| Transcript name | Segment starting position | Segment ending position |
|---|---|---|
| HUMKER56K_T10 (SEQ ID NO: 896) | 2067 | 2090 |
| HUMKER56K_T21 (SEQ ID NO: 897) | 1155 | 1178 |
| HUMKER56K_T24 (SEQ ID NO: 898) | 1279 | 1302 |
| HUMKER56K_T25 (SEQ ID NO: 899) | 1313 | 1336 |
| HUMKER56K_T36 (SEQ ID NO: 900) | 2225 | 2248 |
| HUMKER56K_T37 (SEQ ID NO: 901) | 1437 | 1460 |

This segment can be found in both coding and non-coding regions of transcript(s) as follows. The segment can be found in a non-coding region of transcript(s) that are related to the following protein(s): HUMKER56K_P19 and HUMKER56K_P26. This segment can also be found in the following protein(s): HUMKER56K_P6, HUMKER56K_P17 and HUMKER56K_P20, since it is in the coding region for the corresponding transcript.

Segment cluster HUMKER56K_node_36 (SEQ ID NO:933) according to the present invention is supported by 55 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 888 below describes the starting and ending position of this segment on each transcript.

TABLE 888

Segment location on transcripts

| Transcript name | Segment starting position | Segment ending position |
|---|---|---|
| HUMKER56K_T10 (SEQ ID NO: 896) | 2091 | 2143 |
| HUMKER56K_T21 (SEQ ID NO: 897) | 1679 | 1731 |
| HUMKER56K_T24 (SEQ ID NO: 898) | 1303 | 1355 |
| HUMKER56K_T25 (SEQ ID NO: 899) | 1337 | 1389 |
| HUMKER56K_T36 (SEQ ID NO: 900) | 2249 | 2301 |
| HUMKER56K_T37 (SEQ ID NO: 901) | 1461 | 1513 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_37 (SEQ ID NO:934) according to the present invention is supported by 56 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 889 below describes the starting and ending position of this segment on each transcript.

TABLE 889

Segment location on transcripts

| Transcript name | Segment starting position | Segment ending position |
|---|---|---|
| HUMKER56K_T10 (SEQ ID NO: 896) | 2144 | 2190 |
| HUMKER56K_T21 (SEQ ID NO: 897) | 1732 | 1778 |
| HUMKER56K_T24 (SEQ ID NO: 898) | 1356 | 1402 |
| HUMKER56K_T25 (SEQ ID NO: 899) | 1390 | 1436 |
| HUMKER56K_T36 (SEQ ID NO: 900) | 2302 | 2348 |
| HUMKER56K_T37 (SEQ ID NO: 901) | 1514 | 1560 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_38 (SEQ ID NO:935) according to the present invention is supported by 46 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 890 below describes the starting and ending position of this segment on each transcript.

TABLE 890

Segment location on transcripts

| Transcript name | Segment starting position | Segment ending position |
|---|---|---|
| HUMKER56K_T10 (SEQ ID NO: 896) | 2191 | 2216 |
| HUMKER56K_T21 (SEQ ID NO: 897) | 1779 | 1804 |
| HUMKER56K_T24 (SEQ ID NO: 898) | 1403 | 1428 |
| HUMKER56K_T25 (SEQ ID NO: 899) | 1437 | 1462 |
| HUMKER56K_T36 (SEQ ID NO: 900) | 2349 | 2374 |
| HUMKER56K_T37 (SEQ ID NO: 901) | 1561 | 1586 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_40 (SEQ ID NO:936) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 891 below describes the starting and ending position of this segment on each transcript.

TABLE 891

Segment location on transcripts

| Transcript name | Segment starting position | Segment ending position |
|---|---|---|
| HUMKER56K_T10 (SEQ ID NO: 896) | 2217 | 2236 |
| HUMKER56K_T21 (SEQ ID NO: 897) | 1805 | 1824 |
| HUMKER56K_T24 (SEQ ID NO: 898) | 1429 | 1448 |
| HUMKER56K_T25 (SEQ ID NO: 899) | 1463 | 1482 |
| HUMKER56K_T36 (SEQ ID NO: 900) | 2375 | 2394 |
| HUMKER56K_T37 (SEQ ID NO: 901) | 1587 | 1606 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_41 (SEQ ID NO:937) according to the present invention is supported by 48 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 892 below describes the starting and ending position of this segment on each transcript.

TABLE 892

Segment location on transcripts

| Transcript name | Segment starting position | Segment ending position |
|---|---|---|
| HUMKER56K_T10 (SEQ ID NO: 896) | 2237 | 2270 |
| HUMKER56K_T21 (SEQ ID NO: 897) | 1825 | 1858 |
| HUMKER56K_T24 (SEQ ID NO: 898) | 1449 | 1482 |
| HUMKER56K_T25 (SEQ ID NO: 899) | 1483 | 1516 |
| HUMKER56K_T36 (SEQ ID NO: 900) | 2395 | 2428 |
| HUMKER56K_T37 (SEQ ID NO: 901) | 1607 | 1640 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_43 (SEQ ID NO:938) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 893 below describes the starting and ending position of this segment on each transcript.

TABLE 893

Segment location on transcripts

| Transcript name | Segment starting position | Segment ending position |
|---|---|---|
| HUMKER56K_T10 (SEQ ID NO: 896) | 2399 | 2414 |
| HUMKER56K_T21 (SEQ ID NO: 897) | 1987 | 2002 |
| HUMKER56K_T24 (SEQ ID NO: 898) | 1611 | 1626 |
| HUMKER56K_T25 (SEQ ID NO: 899) | 1645 | 1660 |
| HUMKER56K_T36 (SEQ ID NO: 900) | 2557 | 2572 |
| HUMKER56K_T37 (SEQ ID NO: 901) | 1769 | 1784 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_44 (SEQ ID NO:939) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 894 below describes the starting and ending position of this segment on each transcript.

TABLE 894

Segment location on transcripts

| Transcript name | Segment starting position | Segment ending position |
|---|---|---|
| HUMKER56K_T10 (SEQ ID NO: 896) | 2415 | 2437 |
| HUMKER56K_T21 (SEQ ID NO: 897) | 2003 | 2025 |
| HUMKER56K_T24 (SEQ ID NO: 898) | 1627 | 1649 |
| HUMKER56K_T25 (SEQ ID NO: 899) | 1661 | 1683 |
| HUMKER56K_T36 (SEQ ID NO: 900) | 2573 | 2595 |
| HUMKER56K_T37 (SEQ ID NO: 901) | 1785 | 1807 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_46 (SEQ ID NO:940) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 895 below describes the starting and ending position of this segment on each transcript.

TABLE 895

Segment location on transcripts

| Transcript name | Segment starting position | Segment ending position |
|---|---|---|
| HUMKER56K_T10 (SEQ ID NO: 896) | 2438 | 2462 |
| HUMKER56K_T21 (SEQ ID NO: 897) | 2026 | 2050 |
| HUMKER56K_T24 (SEQ ID NO: 898) | 1650 | 1674 |
| HUMKER56K_T25 (SEQ ID NO: 899) | 1684 | 1708 |
| HUMKER56K_T36 (SEQ ID NO: 900) | 2596 | 2620 |
| HUMKER56K_T37 (SEQ ID NO: 901) | 1808 | 1832 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_47 (SEQ ID NO:941) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 896 below describes the starting and ending position of this segment on each transcript.

TABLE 896

Segment location on transcripts

| Transcript name | Segment starting position | Segment ending position |
|---|---|---|
| HUMKER56K_T10 (SEQ ID NO: 896) | 2463 | 2472 |
| HUMKER56K_T21 (SEQ ID NO: 897) | 2051 | 2060 |
| HUMKER56K_T24 (SEQ ID NO: 898) | 1675 | 1684 |
| HUMKER56K_T25 (SEQ ID NO: 899) | 1709 | 1718 |
| HUMKER56K_T36 (SEQ ID NO: 900) | 2621 | 2630 |
| HUMKER56K_T37 (SEQ ID NO: 901) | 1833 | 1842 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_49 (SEQ ID NO:942) according to the present invention is supported by 53 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 897 below describes the starting and ending position of this segment on each transcript.

TABLE 897

Segment location on transcripts

| Transcript name | Segment starting position | Segment ending position |
|---|---|---|
| HUMKER56K_T10 (SEQ ID NO: 896) | 2473 | 2519 |
| HUMKER56K_T21 (SEQ ID NO: 897) | 2061 | 2107 |
| HUMKER56K_T24 (SEQ ID NO: 898) | 1685 | 1731 |
| HUMKER56K_T25 (SEQ ID NO: 899) | 1719 | 1765 |
| HUMKER56K_T36 (SEQ ID NO: 900) | 2631 | 2677 |
| HUMKER56K_T37 (SEQ ID NO: 901) | 1843 | 1889 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_50 (SEQ ID NO:943) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 898 below describes the starting and ending position of this segment on each transcript.

TABLE 898

Segment location on transcripts

| Transcript name | Segment starting position | Segment ending position |
|---|---|---|
| HUMKER56K_T10 (SEQ ID NO: 896) | 2520 | 2526 |
| HUMKER56K_T21 (SEQ ID NO: 897) | 2108 | 2114 |
| HUMKER56K_T24 (SEQ ID NO: 898) | 1732 | 1738 |
| HUMKER56K_T25 (SEQ ID NO: 899) | 1766 | 1772 |
| HUMKER56K_T36 (SEQ ID NO: 900) | 2678 | 2684 |
| HUMKER56K_T37 (SEQ ID NO: 901) | 1890 | 1896 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_51 (SEQ ID NO:944) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 899 below describes the starting and ending position of this segment on each transcript.

TABLE 899

Segment location on transcripts

| Transcript name | Segment starting position | Segment ending position |
|---|---|---|
| HUMKER56K_T10 (SEQ ID NO: 896) | 2527 | 2537 |
| HUMKER56K_T21 (SEQ ID NO: 897) | 2115 | 2125 |
| HUMKER56K_T24 (SEQ ID NO: 898) | 1739 | 1749 |
| HUMKER56K_T25 (SEQ ID NO: 899) | 1773 | 1783 |
| HUMKER56K_T36 (SEQ ID NO: 900) | 2685 | 2695 |
| HUMKER56K_T37 (SEQ ID NO: 901) | 1897 | 1907 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_52 (SEQ ID NO:945) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 900 below describes the starting and ending position of this segment on each transcript.

TABLE 900

Segment location on transcripts

| Transcript name | Segment starting position | Segment ending position |
|---|---|---|
| HUMKER56K_T10 (SEQ ID NO: 896) | 2538 | 2554 |
| HUMKER56K_T21 (SEQ ID NO: 897) | 2126 | 2142 |
| HUMKER56K_T24 (SEQ ID NO: 898) | 1750 | 1766 |
| HUMKER56K_T25 (SEQ ID NO: 899) | 1784 | 1800 |
| HUMKER56K_T36 (SEQ ID NO: 900) | 2696 | 2712 |
| HUMKER56K_T37 (SEQ ID NO: 901) | 1908 | 1924 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_53 (SEQ ID NO:946) according to the present invention is supported by 49 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 901 below describes the starting and ending position of this segment on each transcript.

TABLE 901

Segment location on transcripts

| Transcript name | Segment starting position | Segment ending position |
|---|---|---|
| HUMKER56K_T10 (SEQ ID NO: 896) | 2555 | 2583 |
| HUMKER56K_T21 (SEQ ID NO: 897) | 2143 | 2171 |
| HUMKER56K_T24 (SEQ ID NO: 898) | 1767 | 1795 |
| HUMKER56K_T25 (SEQ ID NO: 899) | 1801 | 1829 |
| HUMKER56K_T36 (SEQ ID NO: 900) | 2713 | 2741 |
| HUMKER56K_T37 (SEQ ID NO: 901) | 1925 | 1953 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_54 (SEQ ID NO:947) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 902 below describes the starting and ending position of this segment on each transcript.

TABLE 902

Segment location on transcripts

| Transcript name | Segment starting position | Segment ending position |
|---|---|---|
| HUMKER56K_T10 (SEQ ID NO: 896) | 2584 | 2605 |
| HUMKER56K_T21 (SEQ ID NO: 897) | 2172 | 2193 |
| HUMKER56K_T24 (SEQ ID NO: 898) | 1796 | 1817 |
| HUMKER56K_T25 (SEQ ID NO: 899) | 1830 | 1851 |
| HUMKER56K_T36 (SEQ ID NO: 900) | 2742 | 2763 |
| HUMKER56K_T37 (SEQ ID NO: 901) | 1954 | 1975 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_55 (SEQ ID NO:948) according to the present invention is supported by 49 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 903 below describes the starting and ending position of this segment on each transcript.

TABLE 903

Segment location on transcripts

| Transcript name | Segment starting position | Segment ending position |
|---|---|---|
| HUMKER56K_T10 (SEQ ID NO: 896) | 2606 | 2643 |
| HUMKER56K_T21 (SEQ ID NO: 897) | 2194 | 2231 |
| HUMKER56K_T24 (SEQ ID NO: 898) | 1818 | 1855 |
| HUMKER56K_T25 (SEQ ID NO: 899) | 1852 | 1889 |
| HUMKER56K_T36 (SEQ ID NO: 900) | 2764 | 2801 |
| HUMKER56K_T37 (SEQ ID NO: 901) | 1976 | 2013 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_56 (SEQ ID NO:949) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 904 below describes the starting and ending position of this segment on each transcript.

TABLE 904

Segment location on transcripts

| Transcript name | Segment starting position | Segment ending position |
|---|---|---|
| HUMKER56K_T10 (SEQ ID NO: 896) | 2644 | 2650 |
| HUMKER56K_T21 (SEQ ID NO: 897) | 2232 | 2238 |
| HUMKER56K_T24 (SEQ ID NO: 898) | 1856 | 1862 |
| HUMKER56K_T25 (SEQ ID NO: 899) | 1890 | 1896 |
| HUMKER56K_T36 (SEQ ID NO: 900) | 2802 | 2808 |
| HUMKER56K_T37 (SEQ ID NO: 901) | 2014 | 2020 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_57 (SEQ ID NO:950) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 905 below describes the starting and ending position of this segment on each transcript.

TABLE 905

Segment location on transcripts

| Transcript name | Segment starting position | Segment ending position |
|---|---|---|
| HUMKER56K_T10 (SEQ ID NO: 896) | 2651 | 2662 |
| HUMKER56K_T21 (SEQ ID NO: 897) | 2239 | 2250 |
| HUMKER56K_T24 (SEQ ID NO: 898) | 1863 | 1874 |
| HUMKER56K_T25 (SEQ ID NO: 899) | 1897 | 1908 |
| HUMKER56K_T36 (SEQ ID NO: 900) | 2809 | 2820 |
| HUMKER56K_T37 (SEQ ID NO: 901) | 2021 | 2032 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_58 (SEQ ID NO:951) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 906 below describes the starting and ending position of this segment on each transcript.

TABLE 906

| Transcript name | Segment starting position | Segment ending position |
|---|---|---|
| HUMKER56K_T10 (SEQ ID NO: 896) | 2663 | 2686 |
| HUMKER56K_T21 (SEQ ID NO: 897) | 2251 | 2274 |
| HUMKER56K_T24 (SEQ ID NO: 898) | 1875 | 1898 |
| HUMKER56K_T25 (SEQ ID NO: 899) | 1909 | 1932 |
| HUMKER56K_T36 (SEQ ID NO: 900) | 2821 | 2844 |
| HUMKER56K_T37 (SEQ ID NO: 901) | 2033 | 2056 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_59 (SEQ ID NO:952) according to the present invention is supported by 50 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 907 below describes the starting and ending position of this segment on each transcript.

TABLE 907

| Transcript name | Segment starting position | Segment ending position |
|---|---|---|
| HUMKER56K_T10 (SEQ ID NO: 896) | 2687 | 2748 |
| HUMKER56K_T21 (SEQ ID NO: 897) | 2275 | 2336 |
| HUMKER56K_T24 (SEQ ID NO: 898) | 1899 | 1960 |
| HUMKER56K_T25 (SEQ ID NO: 899) | 1933 | 1994 |
| HUMKER56K_T36 (SEQ ID NO: 900) | 2845 | 2906 |
| HUMKER56K_T37 (SEQ ID NO: 901) | 2057 | 2118 |

This segment can be found in both coding and non-coding regions of transcript(s) as follows. The segment can be found in a non-coding region of transcript(s) that are related to the following protein(s): HUMKER56K_P17, HUMKER56K_P19 and HUMKER56K_P26. This segment can also be found in the following protein(s): HUMKER56K_P6 and HUMKER56K_P20, since it is in the coding region for the corresponding transcript.

Segment cluster HUMKER56K_node_60 (SEQ ID NO:953) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 908 below describes the starting and ending position of this segment on each transcript.

TABLE 908

| Transcript name | Segment starting position | Segment ending position |
|---|---|---|
| HUMKER56K_T10 (SEQ ID NO: 896) | 2749 | 2756 |
| HUMKER56K_T21 (SEQ ID NO: 897) | 2337 | 2344 |
| HUMKER56K_T24 (SEQ ID NO: 898) | 1961 | 1968 |
| HUMKER56K_T25 (SEQ ID NO: 899) | 1995 | 2002 |
| HUMKER56K_T36 (SEQ ID NO: 900) | 2907 | 2914 |
| HUMKER56K_T37 (SEQ ID NO: 901) | 2119 | 2126 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_61 (SEQ ID NO:954) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 909 below describes the starting and ending position of this segment on each transcript.

TABLE 909

| Transcript name | Segment starting position | Segment ending position |
|---|---|---|
| HUMKER56K_T10 (SEQ ID NO: 896) | 2757 | 2762 |
| HUMKER56K_T21 (SEQ ID NO: 897) | 2345 | 2350 |
| HUMKER56K_T24 (SEQ ID NO: 898) | 1969 | 1974 |
| HUMKER56K_T25 (SEQ ID NO: 899) | 2003 | 2008 |
| HUMKER56K_T36 (SEQ ID NO: 900) | 2915 | 2920 |
| HUMKER56K_T37 (SEQ ID NO: 901) | 2127 | 2132 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_62 (SEQ ID NO:955) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 910 below describes the starting and ending position of this segment on each transcript.

TABLE 910

| Transcript name | Segment starting position | Segment ending position |
|---|---|---|
| HUMKER56K_T10 (SEQ ID NO: 896) | 2763 | 2776 |
| HUMKER56K_T21 (SEQ ID NO: 897) | 2351 | 2364 |

TABLE 910-continued

Segment location on transcripts

| Transcript name | Segment starting position | Segment ending position |
|---|---|---|
| HUMKER56K_T24 (SEQ ID NO: 898) | 1975 | 1988 |
| HUMKER56K_T25 (SEQ ID NO: 899) | 2009 | 2022 |
| HUMKER56K_T36 (SEQ ID NO: 900) | 2921 | 2934 |
| HUMKER56K_T37 (SEQ ID NO: 901) | 2133 | 2146 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_63 (SEQ ID NO:956) according to the present invention is supported by 42 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ. ID NO:899), HUMKER56K_T36 (SEQ ID NO:900) and HUMKER56K_T37 (SEQ ID NO:901). Table 911 below describes the starting and ending position of this segment on each transcript.

TABLE 911

Segment location on transcripts

| Transcript name | Segment starting position | Segment ending position |
|---|---|---|
| HUMKER56K_T10 (SEQ ID NO: 896) | 2777 | 2807 |
| HUMKER56K_T21 (SEQ ID NO: 897) | 2365 | 2395 |
| HUMKER56K_T24 (SEQ ID NO: 898) | 1989 | 2019 |
| HUMKER56K_T25 (SEQ ID NO: 899) | 2023 | 2053 |
| HUMKER56K_T36 (SEQ ID NO: 900) | 2935 | 2965 |
| HUMKER56K_T37 (SEQ ID NO: 901) | 2147 | 2177 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_64 (SEQ ID NO:957) according to the present invention is supported by 40 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 912 below describes the starting and ending position of this segment on each transcript.

TABLE 912

Segment location on transcripts

| Transcript name | Segment starting position | Segment ending position |
|---|---|---|
| HUMKER56K_T10 (SEQ ID NO: 896) | 2808 | 2844 |
| HUMKER56K_T21 (SEQ ID NO: 897) | 2396 | 2432 |
| HUMKER56K_T24 (SEQ ID NO: 898) | 2020 | 2056 |
| HUMKER56K_T25 (SEQ ID NO: 899) | 2054 | 2090 |
| HUMKER56K_T36 (SEQ ID NO: 900) | 2966 | 3002 |
| HUMKER56K_T37 (SEQ ID NO: 901) | 2178 | 2214 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_65 (SEQ ID NO:958) according to the present invention is supported by 39 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 913 below describes the starting and ending position of this segment on each transcript.

TABLE 913

Segment location on transcripts

| Transcript name | Segment starting position | Segment ending position |
|---|---|---|
| HUMKER56K_T10 (SEQ ID NO: 896) | 2845 | 2896 |
| HUMKER56K_T21 (SEQ ID NO: 897) | 2433 | 2484 |
| HUMKER56K_T24 (SEQ ID NO: 898) | 2057 | 2108 |
| HUMKER56K_T25 (SEQ ID NO: 899) | 2091 | 2142 |
| HUMKER56K_T36 (SEQ ID NO: 900) | 3003 | 3054 |
| HUMKER56K_T37 (SEQ ID NO: 901) | 2215 | 2266 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_66 (SEQ ID NO:959) according to the present invention can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 914 below describes the starting and ending position of this segment on each transcript.

TABLE 914

Segment location on transcripts

| Transcript name | Segment starting position | Segment ending position |
|---|---|---|
| HUMKER56K_T10 (SEQ ID NO: 896) | 2897 | 2902 |
| HUMKER56K_T21 (SEQ ID NO: 897) | 2485 | 2490 |
| HUMKER56K_T24 (SEQ ID NO: 898) | 2109 | 2114 |
| HUMKER56K_T25 (SEQ ID NO: 899) | 2143 | 2148 |
| HUMKER56K_T36 (SEQ ID NO: 900) | 3055 | 3060 |
| HUMKER56K_T37 (SEQ ID NO: 901) | 2267 | 2272 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_68 (SEQ ID NO:960) according to the present invention is supported by 32 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 915 below describes the starting and ending position of this segment on each transcript.

TABLE 915

Segment location on transcripts

| Transcript name | Segment starting position | Segment ending position |
|---|---|---|
| HUMKER56K_T10 (SEQ ID NO: 896) | 3114 | 3150 |
| HUMKER56K_T21 (SEQ ID NO: 897) | 2702 | 2738 |
| HUMKER56K_T24 (SEQ ID NO: 898) | 2326 | 2362 |
| HUMKER56K_T25 (SEQ ID NO: 899) | 2360 | 2396 |
| HUMKER56K_T36 (SEQ ID NO: 900) | 3272 | 3308 |
| HUMKER56K_T37 (SEQ ID NO: 901) | 2484 | 2520 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Segment cluster HUMKER56K_node_69 (SEQ ID NO:961) according to the present invention is supported by 31 libraries. The number of libraries was determined as previously described. This segment can be found in the following transcript(s): HUMKER56K_T10 (SEQ ID NO:896), HUMKER56K_T21 (SEQ ID NO:897), HUMKER56K_T24 (SEQ ID NO:898), HUMKER56K_T25 (SEQ ID NO:899), HUMKER56K_T36 (SEQ ID NO:900) and HUMKER56K_T37 (SEQ ID NO:901). Table 916 below describes the starting and ending position of this segment on each transcript.

TABLE 916

Segment location on transcripts

| Transcript name | Segment starting position | Segment ending position |
|---|---|---|
| HUMKER56K_T10 (SEQ ID NO: 896) | 3151 | 3260 |
| HUMKER56K_T21 (SEQ ID NO: 897) | 2739 | 2848 |
| HUMKER56K_T24 (SEQ ID NO: 898) | 2363 | 2472 |
| HUMKER56K_T25 (SEQ ID NO: 899) | 2397 | 2506 |
| HUMKER56K_T36 (SEQ ID NO: 900) | 3309 | 3418 |
| HUMKER56K_T37 (SEQ ID NO: 901) | 2521 | 2630 |

This segment can be found in a non-coding region of transcript(s) that are related to the following protein(s): HUMKER56K_P6, HUMKER56K_P17, HUMKER56K_P19, HUMKER56K_P20 and HUMKER56K_P26.

Description for Cluster HUMKERK5A

Cluster HUMKERK5A features 13 transcript(s) and 68 segment(s) of interest, the names for which are given in Tables 917 and 918, respectively, the sequences themselves are given at the end of the application. The selected protein variants are given in Table 919.

TABLE 917

| Transcripts of interest Transcript Name |
|---|
| HUMKERK5A_T1 (SEQ ID NO: 962) |
| HUMKERK5A_T14 (SEQ ID NO: 963) |
| HUMKERK5A_T15 (SEQ ID NO: 964) |
| HUMKERK5A_T20 (SEQ ID NO: 965) |
| HUMKERK5A_T24 (SEQ ID NO: 966) |
| HUMKERK5A_T26 (SEQ ID NO: 967) |
| HUMKERK5A_T27 (SEQ ID NO: 968) |
| HUMKERK5A_T29 (SEQ ID NO: 969) |
| HUMKERK5A_T31 (SEQ ID NO: 970) |
| HUMKERK5A_T33 (SEQ ID NO: 971) |
| HUMKERK5A_T39 (SEQ ID NO: 972) |
| HUMKERK5A_T40 (SEQ ID NO: 973) |
| HUMKERK5A_T53 (SEQ ID NO: 974) |

TABLE 918

| Segments of interest Segment Name |
|---|
| HUMKERK5A_node_4 (SEQ ID NO: 975) |
| HUMKERK5A_node_7 (SEQ ID NO: 976) |
| HUMKERK5A_node_33 (SEQ ID NO: 977) |
| HUMKERK5A_node_34 (SEQ ID NO: 978) |
| HUMKERK5A_node_36 (SEQ ID NO: 979) |
| HUMKERK5A_node_42 (SEQ ID NO: 980) |
| HUMKERK5A_node_47 (SEQ ID NO: 981) |
| HUMKERK5A_node_50 (SEQ ID NO: 982) |
| HUMKERK5A_node_74 (SEQ ID NO: 983) |
| HUMKERK5A_node_76 (SEQ ID NO: 984) |
| HUMKERK5A_node_2 (SEQ ID NO: 985) |
| HUMKERK5A_node_5 (SEQ ID NO: 986) |
| HUMKERK5A_node_6 (SEQ ID NO: 987) |
| HUMKERK5A_node_8 (SEQ ID NO: 988) |
| HUMKERK5A_node_9 (SEQ ID NO: 989) |
| HUMKERK5A_node_10 (SEQ ID NO: 990) |
| HUMKERK5A_node_11 (SEQ ID NO: 991) |
| HUMKERK5A_node_12 (SEQ ID NO: 992) |
| HUMKERK5A_node_13 (SEQ ID NO: 993) |
| HUMKERK5A_node_14 (SEQ ID NO: 994) |
| HUMKERK5A_node_15 (SEQ ID NO: 995) |
| HUMKERK5A_node_16 (SEQ ID NO: 996) |
| HUMKERK5A_node_18 (SEQ ID NO: 997) |

TABLE 918-continued

Segments of interest
Segment Name

HUMKERK5A_node_20 (SEQ ID NO: 998)
HUMKERK5A_node_21 (SEQ ID NO: 999)
HUMKERK5A_node_22 (SEQ ID NO: 1000)
HUMKERK5A_node_24 (SEQ ID NO: 1001)
HUMKERK5A_node_26 (SEQ ID NO: 1002)
HUMKERK5A_node_27 (SEQ ID NO: 1003)
HUMKERK5A_node_28 (SEQ ID NO: 1004)
HUMKERK5A_node_29 (SEQ ID NO: 1005)
HUMKERK5A_node_30 (SEQ ID NO: 1006)
HUMKERK5A_node_31 (SEQ ID NO: 1007)
HUMKERK5A_node_32 (SEQ ID NO: 1008)
HUMKERK5A_node_35 (SEQ ID NO: 1009)
HUMKERK5A_node_37 (SEQ ID NO: 1010)
HUMKERK5A_node_38 (SEQ ID NO: 1011)
HUMKERK5A_node_39 (SEQ ID NO: 1012)
HUMKERK5A_node_40 (SEQ ID NO: 1013)
HUMKERK5A_node_41 (SEQ ID NO: 1014)
HUMKERK5A_node_43 (SEQ ID NO: 1015)
HUMKERK5A_node_44 (SEQ ID NO: 1016)
HUMKERK5A_node_45 (SEQ ID NO: 1017)
HUMKERK5A_node_46 (SEQ ID NO: 1018)
HUMKERK5A_node_48 (SEQ ID NO: 1019)
HUMKERK5A_node_51 (SEQ ID NO: 1020)
HUMKERK5A_node_52 (SEQ ID NO: 1021)
HUMKERK5A_node_53 (SEQ ID NO: 1022)
HUMKERK5A_node_54 (SEQ ID NO: 1023)
HUMKERK5A_node_55 (SEQ ID NO: 1024)
HUMKERK5A_node_56 (SEQ ID NO: 1025)
HUMKERK5A_node_57 (SEQ ID NO: 1026)
HUMKERK5A_node_58 (SEQ ID NO: 1027)
HUMKERK5A_node_59 (SEQ ID NO: 1028)
HUMKERK5A_node_60 (SEQ ID NO: 1029)
HUMKERK5A_node_61 (SEQ ID NO: 1030)
HUMKERK5A_node_62 (SEQ ID NO: 1031)
HUMKERK5A_node_63 (SEQ ID NO: 1032)
HUMKERK5A_node_64 (SEQ ID NO: 1033)
HUMKERK5A_node_65 (SEQ ID NO: 1034)
HUMKERK5A_node_66 (SEQ ID NO: 1035)
HUMKERK5A_node_67 (SEQ ID NO: 1036)
HUMKERK5A_node_68 (SEQ ID NO: 1037)
HUMKERK5A_node_69 (SEQ ID NO: 1038)
HUMKERK5A_node_70 (SEQ ID NO: 1039)
HUMKERK5A_node_71 (SEQ ID NO: 1040)
HUMKERK5A_node_72 (SEQ ID NO: 1041)
HUMKERK5A_node_73 (SEQ ID NO: 1042)

TABLE 919

Proteins of interest

| Protein Name | Corresponding Transcript(s) |
| --- | --- |
| HUMKERK5A_P1 | HUMKERK5A_T1 (SEQ ID NO: 962) |
| HUMKERK5A_P9 | HUMKERK5A_T14 (SEQ ID NO: 963); HUMKERK5A_T33 (SEQ ID NO: 971) |
| HUMKERK5A_P10 | HUMKERK5A_T15 (SEQ ID NO: 964) |
| HUMKERK5A_P15 | HUMKERK5A_T20 (SEQ ID NO: 965); HUMKERK5A_T39 (SEQ ID NO: 972) |
| HUMKERK5A_P19 | HUMKERK5A_T24 (SEQ ID NO: 966); HUMKERK5A_T26 (SEQ ID NO: 967) |
| HUMKERK5A_P21 | HUMKERK5A_T27 (SEQ ID NO: 968) |
| HUMKERK5A_P23 | HUMKERK5A_T29 (SEQ ID NO: 969); HUMKERK5A_T40 (SEQ ID NO: 973) |
| HUMKERK5A_P25 | HUMKERK5A_T31 (SEQ ID NO: 970) |
| HUMKERK5A_P40 | HUMKERK5A_T53 (SEQ ID NO: 974) |

These sequences are variants of the known protein Keratin, type II cytoskeletal (SwissProt accession identifier K2C5_HUMAN; known also according to the synonyms Cytokeratin 5; K5; CK 5; 58 kDa cytokeratin), referred to herein as the previously known protein.

The sequence for protein Keratin, type II cytoskeletal 5 is given at the end of the application, as "Keratin, type II cytoskeletal 5 amino acid sequence". Known polymorphisms for this sequence are as shown in Table 920.

TABLE 920

Amino acid mutations for Known Protein

| SNP position(s) on amino acid sequence | Comment |
| --- | --- |
| 25 | P -> L (in MP-EBS). /FTId = VAR_010453. |
| 138 | G -> E. /FTId = VAR_003871. |
| 152 | P -> L (in WC-EBS). /FTId = VAR_010454. |
| 161 | I -> S (in WC-EBS). /FTId = VAR_003872. |
| 173 | K -> N (in K-EBS). /FTId = VAR_010455. |
| 175 | L -> F (in DM-EBS). /FTId = VAR_010456. |
| 176 | N -> S (in DM-EBS). /FTId = VAR_010457. |
| 179 | F -> S (in EBS). /FTId = VAR_010458. |
| 181 | S -> P (in DM-EBS; with laryngeal involvment). /FTId = VAR_010459. |
| 186 | V -> L (in K-EBS). /FTId = VAR_013829. |
| 193 | N -> K (in DM-EBS and WC-EBS). /FTId = VAR_003873. |
| 323 | V -> A (in K-EBS). /FTId = VAR_010460. |
| 325 | L -> P (in K-EBS). /FTId = VAR_010461. |
| 327 | M -> K (in WC-EBS). /FTId = VAR_010462. |
| 327 | M -> T (in WC-EBS). /FTId = VAR_003874. |
| 328 | D -> H (in WC-EBS). /FTId = VAR_010463. |
| 328 | D -> V (in WC-EBS). /FTId = VAR_010464. |
| 329 | N -> K (in WC-EBS). /FTId = VAR_010465. |
| 331 | R -> C (in WC-EBS). /FTId = VAR_003875. |
| 463 | L -> P (in K-EBS). /FTId = VAR_003876. |
| 467 | I -> T (in DM-EBS). /FTId = VAR_010466. |
| 475 | E -> G (in DM-EBS). /FTId = VAR_003877. |
| 477 | E -> K (in EBS). /FTId = VAR_010467. |
| 9-11 | FRS -> SGA |
| 79 | R -> S |
| 197 | D -> E |
| 261 | E -> Q |
| 271 | E -> H |
| 387 | T -> S |
| 528 | S -> G |
| 543 | G -> S |
| 558 | G -> S |

The following GO Annotation(s) apply to the previously known protein. The following annotation(s) were found: epidermal differentiation, which are annotation(s) related to Biological Process; structural protein of cytoskeleton, which are annotation(s) related to Molecular Function; and intermediate filament, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMKERK5A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 26 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 26 and Table 921. This cluster is overexpressed (at least at a minimum level) in the following pathological conditions: transitional cell carcinoma, a mixture of malignant tumors from different tissues and pancreas carcinoma.

TABLE 921

Normal tissue distribution

| Name of Tissue | Number |
| --- | --- |
| Adrenal | 0 |
| Bladder | 0 |
| Brain | 3 |
| Colon | 0 |
| Epithelial | 815 |
| General | 268 |
| head and neck | 1216 |
| Kidney | 22 |
| Lung | 954 |
| Breast | 466 |
| Ovary | 0 |
| pancreas | 0 |
| prostate | 203 |
| Skin | 5067 |
| Uterus | 159 |

TABLE 922

P values and ratios for expression in cancerous tissue

| Name of Tissue | P1 | P2 | SP1 | R3 | SP2 | R4 |
| --- | --- | --- | --- | --- | --- | --- |
| adrenal | 4.6e−01 | 5.0e−01 | 4.6e−01 | 2.2 | 5.3e−01 | 1.9 |
| bladder | 1.5e−01 | 2.1e−01 | 6.0e−05 | 4.1 | 1.4e−03 | 2.9 |
| Brain | 6.7e−01 | 4.9e−01 | 1 | 0.8 | 2.5e−109 | 2.5 |
| Colon | 3.1e−01 | 2.7e−01 | 1 | 1.0 | 1 | 1.0 |
| epithelial | 3.6e−01 | 7.8e−01 | 1 | 0.2 | 1 | 0.2 |
| general | 5.4e−03 | 9.7e−02 | 3.5e−05 | 0.7 | 1.5e−04 | 0.8 |
| Head and neck | 3.4e−02 | 7.5e−02 | 6.7e−02 | 1.2 | 9.2e−01 | 0.5 |
| kidney | 8.6e−01 | 9.0e−01 | 4.0e−09 | 1.2 | 5.8e−06 | 0.9 |
| Lung | 6.0e−01 | 8.6e−01 | 1 | 0.2 | 1 | 0.1 |
| Breast | 8.2e−01 | 8.5e−01 | 1 | 0.1 | 1 | 0.1 |
| Ovary | 2.2e−01 | 1.6e−01 | 1.5e−01 | 2.9 | 1.2e−01 | 3.1 |
| pancreas | 1 | 1.8e−01 | 1 | 1.0 | 1.4e−18 | 7.3 |
| prostate | 8.1e−01 | 8.5e−01 | 1 | 0.3 | 7.2e−01 | 0.5 |
| Skin | 4.7e−01 | 6.1e−01 | 3.3e−27 | 0.0 | 1 | 0.0 |
| Uterus | 3.3e−01 | 5.8e−01 | 1 | 0.4 | 1 | 0.2 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 923.

TABLE 923

Oligonucleotides related to this cluster

| Oligonucleotide name | Overexpressed in cancers | Chip reference |
| --- | --- | --- |
| HUMKERK5A_0_0_597 | lung malignant tumors | LUN |

As noted above, cluster HUMKERK5A features 68 segment(s), which were listed in Table 918 above and for which the sequence(s) are given at the end of the application. These segment(s) are portions of nucleic acid sequence(s) which are described herein separately because they are of particular interest. A description of each segment according to the present invention is now provided.

Segment cluster HUMKERK5A_node_4 (SEQ ID NO:975) according to the present invention is supported by 22 libraries. The number of libraries was determined as previously described. This segment can be found in the following transcript(s): HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972) and HUMKERK5A_T40 (SEQ ID NO:973). Table 924 below describes the starting and ending position of this segment on each transcript.

TABLE 924

Segment location on transcripts

| Transcript name | Segment starting position | Segment ending position |
| --- | --- | --- |
| HUMKERK5A_T14 (SEQ ID NO: 963) | 1 | 379 |
| HUMKERK5A_T15 (SEQ ID NO: 964) | 1 | 379 |
| HUMKERK5A_T20 (SEQ ID NO: 965) | 1 | 379 |
| HUMKERK5A_T24 (SEQ ID NO: 966) | 1 | 379 |
| HUMKERK5A_T26 (SEQ ID NO: 967) | 1 | 379 |
| HUMKERK5A_T29 (SEQ ID NO: 969) | 1 | 379 |
| HUMKERK5A_T33 (SEQ ID NO: 971) | 1 | 379 |
| HUMKERK5A_T39 (SEQ ID NO: 972) | 1 | 379 |
| HUMKERK5A_T40 (SEQ ID NO: 973) | 1 | 379 |

This segment can be found in a non-coding region of transcript(s) that are related to the following protein(s): HUMKERK5A_P9, HUMKERK5A_P10, HUMKERK5A_P15, HUMKERK5A_P19 and HUMKERK5A_P23.

Segment cluster HUMKERK5A_node_7 (SEQ ID NO:976) according to the present invention is supported by 32 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 925 below describes the starting and ending position of this segment on each transcript.

TABLE 925

Segment location on transcripts

| Transcript name | Segment starting position | Segment ending position |
| --- | --- | --- |
| HUMKERK5A_T1 (SEQ ID NO: 962) | 126 | 258 |
| HUMKERK5A_T14 (SEQ ID | 408 | 540 |

TABLE 925-continued

Segment location on transcripts

| Transcript name | Segment starting position | Segment ending position |
|---|---|---|
| HUMKERK5A_T15 (SEQ ID NO: 964) | 408 | 540 |
| HUMKERK5A_T20 (SEQ ID NO: 965) | 408 | 540 |
| HUMKERK5A_T24 (SEQ ID NO: 966) | 408 | 540 |
| HUMKERK5A_T26 (SEQ ID NO: 967) | 408 | 540 |
| HUMKERK5A_T27 (SEQ ID NO: 968) | 126 | 258 |
| HUMKERK5A_T29 (SEQ ID NO: 969) | 408 | 540 |
| HUMKERK5A_T33 (SEQ ID NO: 971) | 408 | 540 |
| HUMKERK5A_T39 (SEQ ID NO: 972) | 408 | 540 |
| HUMKERK5A_T40 (SEQ ID NO: 973) | 408 | 540 |
| HUMKERK5A_T53 (SEQ ID NO: 974) | 126 | 258 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_33 (SEQ ID NO:977) according to the present invention is supported by 5 libraries. The number of libraries was determined as previously described. This segment can be found in the following transcript(s): HUMKERK5A_T14 (SEQ ID NO:963) and HUMKERK5A_T33 (SEQ ID NO:971). Table 926 below describes the starting and ending position of this segment on each transcript.

TABLE 926

Segment location on transcripts

| Transcript name | Segment starting position | Segment ending position |
|---|---|---|
| HUMKERK5A_T14 (SEQ ID NO: 963) | 1319 | 1460 |
| HUMKERK5A_T33 (SEQ ID NO: 971) | 1319 | 1460 |

This segment can be found in the following protein(s): HUMKERK5A_P9.

Segment cluster HUMKERK5A_node_34 (SEQ ID NO:978) according to the present invention is supported by 74 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 927 below describes the starting and ending position of this segment on each transcript.

TABLE 927

Segment location on transcripts

| Transcript name | Segment starting position | Segment ending position |
|---|---|---|
| HUMKERK5A_T1 (SEQ ID NO: 962) | 1037 | 1197 |
| HUMKERK5A_T14 (SEQ ID NO: 963) | 1461 | 1621 |
| HUMKERK5A_T15 (SEQ ID NO: 964) | 1360 | 1520 |
| HUMKERK5A_T20 (SEQ ID NO: 965) | 1319 | 1479 |
| HUMKERK5A_T24 (SEQ ID NO: 966) | 1319 | 1479 |
| HUMKERK5A_T26 (SEQ ID NO: 967) | 1319 | 1479 |
| HUMKERK5A_T27 (SEQ ID NO: 968) | 524 | 684 |
| HUMKERK5A_T29 (SEQ ID NO: 969) | 1319 | 1479 |
| HUMKERK5A_T31 (SEQ ID NO: 970) | 567 | 727 |
| HUMKERK5A_T33 (SEQ ID NO: 971) | 1461 | 1621 |
| HUMKERK5A_T39 (SEQ ID NO: 972) | 1319 | 1479 |
| HUMKERK5A_T40 (SEQ ID NO: 973) | 1319 | 1479 |

This segment can be found in both coding and non-coding regions of transcript(s) as follows. The segment can be found in a non-coding region of transcript(s) that are related to the following protein(s): HUMKERK5A_P9. This segment can also be found in the following protein(s): HUMKERK5A_P1, HUMKERK5A_P10, HUMKERK5A_P15, HUMKERK5A_P19, HUMKERK5A_P21, HUMKERK5A_P23 and HUMKERK5A_P25, since it is in the coding region for the corresponding transcript.

Segment cluster HUMKERK5A_node_36 (SEQ ID NO:979) according to the present invention is supported by 6 libraries. The number of libraries was determined as previously described. This segment can be found in the following transcript(s): HUMKERK5A_T20 (SEQ ID NO:965), HUMKERK5A_T33 (SEQ ID NO:971) and HUMKERK5A_T39 (SEQ ID NO:972). Table 928 below describes the starting and ending position of this segment on each transcript.

TABLE 928

Segment location on transcripts

| Transcript name | Segment starting position | Segment ending position |
|---|---|---|
| HUMKERK5A_T20 (SEQ ID NO: 965) | 1484 | 1831 |
| HUMKERK5A_T33 (SEQ ID NO: 971) | 1626 | 1973 |

TABLE 928-continued

Segment location on transcripts

| Transcript name | Segment starting position | Segment ending position |
|---|---|---|
| HUMKERK5A_T39 (SEQ ID NO: 972) | 1484 | 1831 |

This segment can be found in both coding and non-coding regions of transcript(s) as follows. The segment can be found in a non-coding region of transcript(s) that are related to the following protein(s): HUMKERK5A_P9. This segment can also be found in the following protein(s): HUMKERK5A_P15, since it is in the coding region for the corresponding transcript.

Segment cluster HUMKERK5A_node_42 (SEQ ID NO:980) according to the present invention is supported by 8 libraries. The number of libraries was determined as previously described. This segment can be found in the following transcript(s): HUMKERK5A_T29 (SEQ ID NO:969), HUMKERK5A_T39 (SEQ ID NO:972) and HUMKERK5A_T40 (SEQ ID NO:973). Table 929 below describes the starting and ending position of this segment on each transcript.

TABLE 929

Segment location on transcripts

| Transcript name | Segment starting position | Segment ending position |
|---|---|---|
| HUMKERK5A_T29 (SEQ ID NO: 969) | 1610 | 1858 |
| HUMKERK5A_T39 (SEQ ID NO: 972) | 1967 | 2215 |
| HUMKERK5A_T40 (SEQ ID NO: 973) | 1610 | 1858 |

This segment can be found in both coding and non-coding regions of transcript(s) as follows. The segment can be found in a non-coding region of transcript(s) that are related to the following protein(s): HUMKERK5A_P15. This segment can also be found in the following protein(s): HUMKERK5A_P23, since it is in the coding region for the corresponding transcript.

Segment cluster HUMKERK5A_node_47 (SEQ ID NO:981) according to the present invention is supported by 12 libraries. The number of libraries was determined as previously described. This segment can be found in the following transcript(s): HUMKERK5A_T24 (SEQ ID NO:966), HUMKERK5A_T26 (SEQ ID NO:967) and HUMKERK5A_T40 (SEQ ID NO:973). Table 930 below describes the starting and ending position of this segment on each transcript.

TABLE 930

Segment location on transcripts

| Transcript name | Segment starting position | Segment ending position |
|---|---|---|
| HUMKERK5A_T24 (SEQ ID NO: 966) | 1831 | 2634 |
| HUMKERK5A_T26 (SEQ ID NO: 967) | 1813 | 2634 |

TABLE 930-continued

Segment location on transcripts

| Transcript name | Segment starting position | Segment ending position |
|---|---|---|
| HUMKERK5A_T40 (SEQ ID NO: 973) | 2080 | 2883 |

This segment can be found in both coding and non-coding regions of transcript(s) as follows. The segment can be found in a non-coding region of transcript(s) that are related to the following protein(s): HUMKERK5A_P23. This segment can also be found in the following protein(s): HUMKERK5A_P19, since it is in the coding region for the corresponding transcript.

Segment cluster HUMKERK5A_node_50 (SEQ ID NO:982) according to the present invention is supported by 14 libraries. The number of libraries was determined as previously described. This segment can be found in the following transcript(s): HUMKERK5A_T26 (SEQ ID NO:967). Table 931 below describes the starting and ending position of this segment on each transcript.

TABLE 931

Segment location on transcripts

| Transcript name | Segment starting position | Segment ending position |
|---|---|---|
| HUMKERK5A_T26 (SEQ ID NO: 967) | 2670 | 3226 |

This segment can be found in a non-coding region of transcript(s) that are related to the following protein(s): HUMKERK5A_P19.

Segment cluster HUMKERK5A_node_74 (SEQ ID NO:983) according to the present invention is supported by 38 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 932 below describes the starting and ending position of this segment on each transcript.

TABLE 932

Segment location on transcripts

| Transcript name | Segment starting position | Segment ending position |
|---|---|---|
| HUMKERK5A_T1 (SEQ ID NO: 962) | 2136 | 2248 |
| HUMKERK5A_T14 (SEQ ID NO: 963) | 2560 | 2672 |
| HUMKERK5A_T15 (SEQ ID NO: 964) | 2459 | 2571 |

TABLE 932-continued

Segment location on transcripts

| Transcript name | Segment starting position | Segment ending position |
|---|---|---|
| HUMKERK5A_T20 (SEQ ID NO: 965) | 2775 | 2887 |
| HUMKERK5A_T24 (SEQ ID NO: 966) | 3222 | 3334 |
| HUMKERK5A_T26 (SEQ ID NO: 967) | 3779 | 3891 |
| HUMKERK5A_T27 (SEQ ID NO: 968) | 1623 | 1735 |
| HUMKERK5A_T29 (SEQ ID NO: 969) | 2667 | 2779 |
| HUMKERK5A_T31 (SEQ ID NO: 970) | 1666 | 1778 |
| HUMKERK5A_T33 (SEQ ID NO: 971) | 2917 | 3029 |
| HUMKERK5A_T39 (SEQ ID NO: 972) | 3024 | 3136 |
| HUMKERK5A_T40 (SEQ ID NO: 973) | 3471 | 3583 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_76 (SEQ ID NO:984) according to the present invention is supported by 15 libraries. The number of libraries was determined as previously described. This segment can be found in the following transcript(s): HUMKERK5A_T53 (SEQ ID NO:974). Table 933 below describes the starting and ending position of this segment on each transcript.

TABLE 933

Segment location on transcripts

| Transcript name | Segment starting position | Segment ending position |
|---|---|---|
| HUMKERK5A_T53 (SEQ ID NO: 974) | 665 | 838 |

This segment can be found in the following protein(s): HUMKERK5A_P40.

According to an optional embodiment of the present invention, short segments related to the above cluster are also provided. These segments are up to about 120 bp in length, and so are included in a separate description.

Segment cluster HUMKERK5A_node_2 (SEQ ID NO:985) according to the present invention is supported by 1 libraries. The number of libraries was determined as previously described. This segment can be found in the following transcript(s): HUMKERK5A_T1 (SEQ ID NO:962), HUMKERK5A_T27 (SEQ ID NO:968) and HUMKERK5A_T53 (SEQ ID NO:974). Table 934 below describes the starting and ending position of this segment on each transcript.

TABLE 934

Segment location on transcripts

| Transcript name | Segment starting position | Segment ending position |
|---|---|---|
| HUMKERK5A_T1 (SEQ ID NO: 962) | 1 | 97 |
| HUMKERK5A_T27 (SEQ ID NO: 968) | 1 | 97 |
| HUMKERK5A_T53 (SEQ ID NO: 974) | 1 | 97 |

This segment can be found in a non-coding region of transcript(s) that are related to the following protein(s): HUMKERK5A_P1, HUMKERK5A_P21 and HUMKERK5A_P40.

Segment cluster HUMKERK5A_node_5 (SEQ ID NO:986) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 935 below describes the starting and ending position of this segment on each transcript.

TABLE 935

Segment location on transcripts

| Transcript name | Segment starting position | Segment ending position |
|---|---|---|
| HUMKERK5A_T1 (SEQ ID NO: 962) | 98 | 120 |
| HUMKERK5A_T14 (SEQ ID NO: 963) | 380 | 402 |
| HUMKERK5A_T15 (SEQ ID NO: 964) | 380 | 402 |
| HUMKERK5A_T20 (SEQ ID NO: 965) | 380 | 402 |
| HUMKERK5A_T24 (SEQ ID NO: 966) | 380 | 402 |
| HUMKERK5A_T26 (SEQ ID NO: 967) | 380 | 402 |
| HUMKERK5A_T27 (SEQ ID NO: 968) | 98 | 120 |
| HUMKERK5A_T29 (SEQ ID NO: 969) | 380 | 402 |
| HUMKERK5A_T33 (SEQ ID NO: 971) | 380 | 402 |
| HUMKERK5A_T39 (SEQ ID NO: 972) | 380 | 402 |
| HUMKERK5A_T40 (SEQ ID NO: 973) | 380 | 402 |
| HUMKERK5A_T53 (SEQ ID NO: 974) | 98 | 120 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_6 (SEQ ID NO:987) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 936 below describes the starting and ending position of this segment on each transcript.

TABLE 936

Segment location on transcripts

| Transcript name | Segment starting position | Segment ending position |
|---|---|---|
| HUMKERK5A_T1 (SEQ ID NO: 962) | 121 | 125 |
| HUMKERK5A_T14 (SEQ ID NO: 963) | 403 | 407 |
| HUMKERK5A_T15 (SEQ ID NO: 964) | 403 | 407 |
| HUMKERK5A_T20 (SEQ ID NO: 965) | 403 | 407 |
| HUMKERK5A_T24 (SEQ ID NO: 966) | 403 | 407 |
| HUMKERK5A_T26 (SEQ ID NO: 967) | 403 | 407 |
| HUMKERK5A_T27 (SEQ ID NO: 968) | 121 | 125 |
| HUMKERK5A_T29 (SEQ ID NO: 969) | 403 | 407 |
| HUMKERK5A_T33 (SEQ ID NO: 971) | 403 | 407 |
| HUMKERK5A_T39 (SEQ ID NO: 972) | 403 | 407 |
| HUMKERK5A_T40 (SEQ ID NO: 973) | 403 | 407 |
| HUMKERK5A_T53 (SEQ ID NO: 974) | 121 | 125 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_8 (SEQ ID NO:988) according to the present invention is supported by 34 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 937 below describes the starting and ending position of this segment on each transcript.

TABLE 937

Segment location on transcripts

| Transcript name | Segment starting position | Segment ending position |
|---|---|---|
| HUMKERK5A_T1 (SEQ ID NO: 962) | 259 | 294 |
| HUMKERK5A_T14 (SEQ ID NO: 963) | 541 | 576 |
| HUMKERK5A_T15 (SEQ ID NO: 964) | 541 | 576 |
| HUMKERK5A_T20 (SEQ ID NO: 965) | 541 | 576 |
| HUMKERK5A_T24 (SEQ ID NO: 966) | 541 | 576 |
| HUMKERK5A_T26 (SEQ ID NO: 967) | 541 | 576 |
| HUMKERK5A_T27 (SEQ ID NO: 968) | 259 | 294 |
| HUMKERK5A_T29 (SEQ ID NO: 969) | 541 | 576 |
| HUMKERK5A_T33 (SEQ ID NO: 971) | 541 | 576 |
| HUMKERK5A_T39 (SEQ ID NO: 972) | 541 | 576 |
| HUMKERK5A_T40 (SEQ ID NO: 973) | 541 | 576 |
| HUMKERK5A_T53 (SEQ ID NO: 974) | 259 | 294 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_9 (SEQ ID NO:989) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 938 below describes the starting and ending position of this segment on each transcript.

TABLE 938

Segment location on transcripts

| Transcript name | Segment starting position | Segment ending position |
|---|---|---|
| HUMKERK5A_T1 (SEQ ID NO: 962) | 295 | 318 |
| HUMKERK5A_T14 (SEQ ID NO: 963) | 577 | 600 |
| HUMKERK5A_T15 (SEQ ID NO: 964) | 577 | 600 |
| HUMKERK5A_T20 (SEQ ID NO: 965) | 577 | 600 |
| HUMKERK5A_T24 (SEQ ID NO: 966) | 577 | 600 |
| HUMKERK5A_T26 (SEQ ID NO: 967) | 577 | 600 |
| HUMKERK5A_T27 (SEQ ID NO: 968) | 295 | 318 |
| HUMKERK5A_T29 (SEQ ID NO: 969) | 577 | 600 |
| HUMKERK5A_T33 (SEQ ID NO: 971) | 577 | 600 |
| HUMKERK5A_T39 (SEQ ID NO: 972) | 577 | 600 |
| HUMKERK5A_T40 (SEQ ID NO: 973) | 577 | 600 |
| HUMKERK5A_T53 (SEQ ID NO: 974) | 295 | 318 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_10 (SEQ ID NO:990) according to the present invention is supported by 35 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 939 below describes the starting and ending position of this segment on each transcript.

TABLE 939

Segment location on transcripts

| Transcript name | Segment starting position | Segment ending position |
|---|---|---|
| HUMKERK5A_T1 (SEQ ID NO: 962) | 319 | 366 |
| HUMKERK5A_T14 (SEQ ID NO: 963) | 601 | 648 |
| HUMKERK5A_T15 (SEQ ID NO: 964) | 601 | 648 |
| HUMKERK5A_T20 (SEQ ID NO: 965) | 601 | 648 |
| HUMKERK5A_T24 (SEQ ID NO: 966) | 601 | 648 |
| HUMKERK5A_T26 (SEQ ID NO: 967) | 601 | 648 |
| HUMKERK5A_T27 (SEQ ID NO: 968) | 319 | 366 |
| HUMKERK5A_T29 (SEQ ID NO: 969) | 601 | 648 |
| HUMKERK5A_T33 (SEQ ID NO: 971) | 601 | 648 |
| HUMKERK5A_T39 (SEQ ID NO: 972) | 601 | 648 |
| HUMKERK5A_T40 (SEQ ID NO: 973) | 601 | 648 |
| HUMKERK5A_T53 (SEQ ID NO: 974) | 319 | 366 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P21, HUMKERK5A_P23 and HUMKERK5A_P40, since it is in the coding region for the corresponding transcript.

Segment cluster HUMKERK5A_node_11 (SEQ ID NO:991) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 940 below describes the starting and ending position of this segment on each transcript.

TABLE 940

Segment location on transcripts

| Transcript name | Segment starting position | Segment ending position |
|---|---|---|
| HUMKERK5A_T1 (SEQ ID NO: 962) | 367 | 386 |
| HUMKERK5A_T14 (SEQ ID NO: 963) | 649 | 668 |
| HUMKERK5A_l15 (SEQ ID NO: 964) | 649 | 668 |
| HUMKERK5A_T20 (SEQ ID NO: 965) | 649 | 668 |
| HUMKERK5A_T24 (SEQ ID NO: 966) | 649 | 668 |
| HUMKERK5A_T26 (SEQ ID NO: 967) | 649 | 668 |

TABLE 940-continued

Segment location on transcripts

| Transcript name | Segment starting position | Segment ending position |
| --- | --- | --- |
| HUMKERK5A_T29 (SEQ ID NO: 969) | 649 | 668 |
| HUMKERK5A_T33 (SEQ ID NO: 971) | 649 | 668 |
| HUMKERK5A_T39 (SEQ ID NO: 972) | 649 | 668 |
| HUMKERK5A_T40 (SEQ ID NO: 973) | 649 | 668 |
| HUMKERK5A_T53 (SEQ ID NO: 974) | 367 | 386 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_12 (SEQ ID NO:992) according to the present invention is supported by 37 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 941 below describes the starting and ending position of this segment on each transcript.

TABLE 941

Segment location on transcripts

| Transcript name | Segment starting position | Segment ending position |
| --- | --- | --- |
| HUMKERK5A_T1 (SEQ ID NO: 962) | 387 | 434 |
| HUMKERK5A_T14 (SEQ ID NO: 963) | 669 | 716 |
| HUMKERK5A_T15 (SEQ ID NO: 964) | 669 | 716 |
| HUMKERK5A_T20 (SEQ ID NO: 965) | 669 | 716 |
| HUMKERK5A_T24 (SEQ ID NO: 966) | 669 | 716 |
| HUMKERK5A_T26 (SEQ ID NO: 967) | 669 | 716 |
| HUMKERK5A_T29 (SEQ ID NO: 969) | 669 | 716 |
| HUMKERK5A_T33 (SEQ ID NO: 971) | 669 | 716 |
| HUMKERK5A_T39 (SEQ ID NO: 972) | 669 | 716 |
| HUMKERK5A_T40 (SEQ ID NO: 973) | 669 | 716 |
| HUMKERK5A_T53 (SEQ ID NO: 974) | 387 | 434 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_13 (SEQ ID NO:993) according to the present invention is supported by 45 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 942 below describes the starting and ending position of this segment on each transcript.

TABLE 942

Segment location on transcripts

| Transcript name | Segment starting position | Segment ending position |
| --- | --- | --- |
| HUMKERK5A_T1 (SEQ ID NO: 962) | 435 | 535 |
| HUMKERK5A_T14 (SEQ ID NO: 963) | 717 | 817 |
| HUMKERK5A_T15 (SEQ ID NO: 964) | 717 | 817 |
| HUMKERK5A_T20 (SEQ ID NO: 965) | 717 | 817 |
| HUMKERK5A_T24 (SEQ ID NO: 966) | 717 | 817 |
| HUMKERK5A_T26 (SEQ ID NO: 967) | 717 | 817 |
| HUMKERK5A_T29 (SEQ ID NO: 969) | 717 | 817 |
| HUMKERK5A_T33 (SEQ ID NO: 971) | 717 | 817 |
| HUMKERK5A_T39 (SEQ ID NO: 972) | 717 | 817 |
| HUMKERK5A_T40 (SEQ ID NO: 973) | 717 | 817 |
| HUMKERK5A_T53 (SEQ ID NO: 974) | 435 | 535 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_14 (SEQ ID NO:994) according to the present invention is supported by 53 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 943 below describes the starting and ending position of this segment on each transcript.

TABLE 943

Segment location on transcripts

| Transcript name | Segment starting position | Segment ending position |
|---|---|---|
| HUMKERK5A_T1 (SEQ ID NO: 962) | 536 | 631 |
| HUMKERK5A_T14 (SEQ ID NO: 963) | 818 | 913 |
| HUMKERK5A_T15 (SEQ ID NO: 964) | 818 | 913 |
| HUMKERK5A_T20 (SEQ ID NO: 965) | 818 | 913 |
| HUMKERK5A_T24 (SEQ ID NO: 966) | 818 | 913 |
| HUMKERK5A_T26 (SEQ ID NO: 967) | 818 | 913 |
| HUMKERK5A_T29 (SEQ ID NO: 969) | 818 | 913 |
| HUMKERK5A_T33 (SEQ ID NO: 971) | 818 | 913 |
| HUMKERK5A_T39 (SEQ ID NO: 972) | 818 | 913 |
| HUMKERK5A_T40 (SEQ ID NO: 973) | 818 | 913 |
| HUMKERK5A_T53 (SEQ ID NO: 974) | 536 | 631 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_15 (SEQ ID NO:995) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 944 below describes the starting and ending position of this segment on each transcript.

TABLE 944

Segment location on transcripts

| Transcript name | Segment starting position | Segment ending position |
|---|---|---|
| HUMKERK5A_T1 (SEQ ID NO: 962) | 632 | 643 |
| HUMKERK5A_T14 (SEQ ID NO: 963) | 914 | 925 |
| HUMKERK5A_T15 (SEQ ID NO: 964) | 914 | 925 |
| HUMKERK5A_T20 (SEQ ID NO: 965) | 914 | 925 |
| HUMKERK5A_T24 (SEQ ID NO: 966) | 914 | 925 |
| HUMKERK5A_T26 (SEQ ID NO: 967) | 914 | 925 |
| HUMKERK5A_T29 (SEQ ID NO: 969) | 914 | 925 |
| HUMKERK5A_T33 (SEQ ID NO: 971) | 914 | 925 |
| HUMKERK5A_T39 (SEQ ID NO: 972) | 914 | 925 |
| HUMKERK5A_T40 (SEQ ID NO: 973) | 914 | 925 |
| HUMKERK5A_T53 (SEQ ID NO: 974) | 632 | 643 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_16 (SEQ ID NO:996) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T33 (SEQ ID NO:971), HUMKERK5A_T39 (SEQ ID NO:972), HUMKERK5A_T40 (SEQ ID NO:973) and HUMKERK5A_T53 (SEQ ID NO:974). Table 945 below describes the starting and ending position of this segment on each transcript.

TABLE 945

Segment location on transcripts

| Transcript name | Segment starting position | Segment ending position |
|---|---|---|
| HUMKERK5A_T1 (SEQ ID NO: 962) | 644 | 664 |
| HUMKERK5A_T14 (SEQ ID NO: 963) | 926 | 946 |
| HUMKERK5A_T15 (SEQ ID NO: 964) | 926 | 946 |
| HUMKERK5A_T20 (SEQ ID NO: 965) | 926 | 946 |

TABLE 945-continued

Segment location on transcripts

| Transcript name | Segment starting position | Segment ending position |
|---|---|---|
| HUMKERK5A_T24 (SEQ ID NO: 966) | 926 | 946 |
| HUMKERK5A_T26 (SEQ ID NO: 967) | 926 | 946 |
| HUMKERK5A_T29 (SEQ ID NO: 969) | 926 | 946 |
| HUMKERK5A_T33 (SEQ ID NO: 971) | 926 | 946 |
| HUMKERK5A_T39 (SEQ ID NO: 972) | 926 | 946 |
| HUMKERK5A_T40 (SEQ ID NO: 973) | 926 | 946 |
| HUMKERK5A_T53 (SEQ ID NO: 974) | 644 | 664 |

This segment can be found in both coding and non-coding regions of transcript(s) as follows. The segment can be found in a non-coding region of transcript(s) that are related to the following protein(s): HUMKERK5A_P10. This segment can also be found in the following protein(s): HUMKERK5A_P1, HUMKERK5A_P9, HUMKERK5A_P15, HUMKERK5A_P19, HUMKERK5A_P23 and HUMKERK5A_P40, since it is in the coding region for the corresponding transcript.

Segment cluster HUMKERK5A_node_18 (SEQ ID NO:997) according to the present invention is supported by 2 libraries. The number of libraries was determined as previously described. This segment can be found in the following transcript(s): HUMKERK5A_T31 (SEQ ID NO:970). Table 946 below describes the starting and ending position of this segment on each transcript.

TABLE 946

Segment location on transcripts

| Transcript name | Segment starting position | Segment ending position |
|---|---|---|
| HUMKERK5A_T31 (SEQ ID NO: 970) | 1 | 84 |

This segment can be found in a non-coding region of transcript(s) that are related to the following protein(s): HUMKERK5A_P25.

Segment cluster HUMKERK5A_node_20 (SEQ ID NO:998) according to the present invention is supported by 52 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 947 below describes the starting and ending position of this segment on each transcript.

TABLE 947

Segment location on transcripts

| Transcript name | Segment starting position | Segment ending position |
|---|---|---|
| HUMKERK5A_T1 (SEQ ID NO: 962) | 665 | 751 |
| HUMKERK5A_T14 (SEQ ID NO: 963) | 947 | 1033 |
| HUMKERK5A_T15 (SEQ ID NO: 964) | 947 | 1033 |
| HUMKERK5A_T20 (SEQ ID NO: 965) | 947 | 1033 |
| HUMKERK5A_T24 (SEQ ID NO: 966) | 947 | 1033 |
| HUMKERK5A_T26 (SEQ ID NO: 967) | 947 | 1033 |
| HUMKERK5A_T29 (SEQ ID NO: 969) | 947 | 1033 |
| HUMKERK5A_T31 (SEQ ID NO: 970) | 85 | 171 |
| HUMKERK5A_T33 (SEQ ID NO: 971) | 947 | 1033 |
| HUMKERK5A_T39 (SEQ ID NO: 972) | 947 | 1033 |
| HUMKERK5A_T40 (SEQ ID NO: 973) | 947 | 1033 |

This segment can be found in both coding and non-coding regions of transcript(s) as follows. The segment can be found in a non-coding region of transcript(s) that are related to the following protein(s): HUMKERK5A_P10 and HUMKERK5A_P25. This segment can also be found in the following protein(s): HUMKERK5A_P1, HUMKERK5A_P9, HUMKERK5A_P15, HUMKERK5A_P19 and HUMKERK5A_P23, since it is in the coding region for the corresponding transcript.

Segment cluster HUMKERK5A_node_21 (SEQ ID NO:999) according to the present invention is supported by 66 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 948 below describes the starting and ending position of this segment on each transcript.

TABLE 948

Segment location on transcripts

| Transcript name | Segment starting position | Segment ending position |
|---|---|---|
| HUMKERK5A_T1 (SEQ ID NO: 962) | 752 | 867 |
| HUMKERK5A_T14 (SEQ ID NO: 963) | 1034 | 1149 |
| HUMKERK5A_T15 (SEQ ID NO: 964) | 1034 | 1149 |
| HUMKERK5A_T20 (SEQ ID NO: 965) | 1034 | 1149 |

TABLE 948-continued

| | Segment location on transcripts | |
|---|---|---|
| Transcript name | Segment starting position | Segment ending position |
| HUMKERK5A_T24 (SEQ ID NO: 966) | 1034 | 1149 |
| HUMKERK5A_T26 (SEQ ID NO: 967) | 1034 | 1149 |
| HUMKERK5A_T29 (SEQ ID NO: 969) | 1034 | 1149 |
| HUMKERK5A_T31 (SEQ ID NO: 970) | 172 | 287 |
| HUMKERK5A_T33 (SEQ ID NO: 971) | 1034 | 1149 |
| HUMKERK5A_T39 (SEQ ID NO: 972) | 1034 | 1149 |
| HUMKERK5A_T40 (SEQ ID NO: 973) | 1034 | 1149 |

This segment can be found in both coding and non-coding regions of transcript(s) as follows. The segment can be found in a non-coding region of transcript(s) that are related to the following protein(s): HUMKERK5A_P10 and HUMKERK5A_P25. This segment can also be found in the following protein(s): HUMKERK5A_P1, HUMKERK5A_P9, HUMKERK5A_P15, HUMKERK5A_P19 and HUMKERK5A_P23, since it is in the coding region for the corresponding transcript.

Segment cluster HUMKERK5A_node_22 (SEQ ID NO:1000) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 949 below describes the starting and ending position of this segment on each transcript.

TABLE 949

| | Segment location on transcripts | |
|---|---|---|
| Transcript name | Segment starting position | Segment ending position |
| HUMKERK5A_T1 (SEQ ID NO: 962) | 868 | 879 |
| HUMKERK5A_T14 (SEQ ID NO: 963) | 1150 | 1161 |
| HUMKERK5A_T15 (SEQ ID NO: 964) | 1150 | 1161 |
| HUMKERK5A_T20 (SEQ ID NO: 965) | 1150 | 1161 |
| HUMKERK5A_T24 (SEQ ID NO: 966) | 1150 | 1161 |
| HUMKERK5A_T26 (SEQ ID NO: 967) | 1150 | 1161 |
| HUMKERK5A_T29 (SEQ ID NO: 969) | 1150 | 1161 |
| HUMKERK5A_T31 (SEQ ID NO: 970) | 288 | 299 |

TABLE 949-continued

| | Segment location on transcripts | |
|---|---|---|
| Transcript name | Segment starting position | Segment ending position |
| HUMKERK5A_T33 (SEQ ID NO: 971) | 1150 | 1161 |
| HUMKERK5A_T39 (SEQ ID NO: 972) | 1150 | 1161 |
| HUMKERK5A_T40 (SEQ ID NO: 973) | 1150 | 1161 |

This segment can be found in both coding and non-coding regions of transcript(s) as follows. The segment can be found in a non-coding region of transcript(s) that are related to the following protein(s): HUMKERK5A_P10 and HUMKERK5A_P25. This segment can also be found in the following protein(s): HUMKERK5A_P1, HUMKERK5A_P9, HUMKERK5A_P15, HUMKERK5A_P19 and HUMKERK5A_P23, since it is in the coding region for the corresponding transcript.

Segment cluster HUMKERK5A_node_24 (SEQ ID NO:1001) according to the present invention is supported by 2 libraries. The number of libraries was determined as previously described. This segment can be found in the following transcript(s): HUMKERK5A_T15 (SEQ ID NO:964). Table 950 below describes the starting and ending position of this segment on each transcript.

TABLE 950

| | Segment location on transcripts | |
|---|---|---|
| Transcript name | Segment starting position | Segment ending position |
| HUMKERK5A_T15 (SEQ ID NO: 964) | 1162 | 1202 |

This segment can be found in a non-coding region of transcript(s) that are related to the following protein(s): HUMKERK5A_P10.

Segment cluster HUMKERK5A_node_26 (SEQ ID NO:1002) according to the present invention is supported by 64 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 951 below describes the starting and ending position of this segment on each transcript.

TABLE 951

Segment location on transcripts

| Transcript name | Segment starting position | Segment ending position |
|---|---|---|
| HUMKERK5A_T1 (SEQ ID NO: 962) | 880 | 931 |
| HUMKERK5A_T14 (SEQ ID NO: 963) | 1162 | 1213 |
| HUMKERK5A_T15 (SEQ ID NO: 964) | 1203 | 1254 |
| HUMKERK5A_T20 (SEQ ID NO: 965) | 1162 | 1213 |
| HUMKERK5A_T24 (SEQ ID NO: 966) | 1162 | 1213 |
| HUMKERK5A_T26 (SEQ ID NO: 967) | 1162 | 1213 |
| HUMKERK5A_T27 (SEQ ID NO: 968) | 367 | 418 |
| HUMKERK5A_T29 (SEQ ID NO: 969) | 1162 | 1213 |
| HUMKERK5A_T31 (SEQ ID NO: 970) | 300 | 351 |
| HUMKERK5A_T33 (SEQ ID NO: 971) | 1162 | 1213 |
| HUMKERK5A_T39 (SEQ ID NO: 972) | 1162 | 1213 |
| HUMKERK5A_T40 (SEQ ID NO: 973) | 1162 | 1213 |

This segment can be found in both coding and non-coding regions of transcript(s) as follows. The segment can be found in a non-coding region of transcript(s) that are related to the following protein(s): HUMKERK5A_P25. This segment can also be found in the following protein(s): HUMKERK5A_P1, HUMKERK5A_P9, HUMKERK5A_P10, HUMKERK5A_P15, HUMKERK5A_P19, HUMKERK5A_P21 and HUMKERK5A_P23, since it is in the coding region for the corresponding transcript.

Segment cluster HUMKERK5A_node_27 (SEQ ID NO:1003) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 952 below describes the starting and ending position of this segment on each transcript.

TABLE 952

Segment location on transcripts

| Transcript name | Segment starting position | Segment ending position |
|---|---|---|
| HUMKERK5A_T1 (SEQ ID NO: 962) | 932 | 940 |
| HUMKERK5A_T14 (SEQ ID NO: 963) | 1214 | 1222 |
| HUMKERK5A_T15 (SEQ ID NO: 964) | 1255 | 1263 |
| HUMKERK5A_T20 (SEQ ID NO: 965) | 1214 | 1222 |
| HUMKERK5A_T24 (SEQ ID NO: 966) | 1214 | 1222 |
| HUMKERK5A_T26 (SEQ ID NO: 967) | 1214 | 1222 |
| HUMKERK5A_T27 (SEQ ID NO: 968) | 419 | 427 |
| HUMKERK5A_T29 (SEQ ID NO: 969) | 1214 | 1222 |
| HUMKERK5A_T31 (SEQ ID NO: 970) | 352 | 360 |
| HUMKERK5A_T33 (SEQ ID NO: 971) | 1214 | 1222 |
| HUMKERK5A_T39 (SEQ ID NO: 972) | 1214 | 1222 |
| HUMKERK5A_T40 (SEQ ID NO: 973) | 1214 | 1222 |

This segment can be found in both coding and non-coding regions of transcript(s) as follows. The segment can be found in a non-coding region of transcript(s) that are related to the following protein(s): HUMKERK5A_P25. This segment can also be found in the following protein(s): HUMKERK5A_P1, HUMKERK5A_P9, HUMKERK5A_P10, HUMKERK5A_P15, HUMKERK5A_P19, HUMKERK5A_P21 and HUMKERK5A_P23, since it is in the coding region for the corresponding transcript.

Segment cluster HUMKERK5A_node_28 (SEQ ID NO:1004) according to the present invention is supported by 3 libraries. The number of libraries was determined as previously described. This segment can be found in the following transcript(s): HUMKERK5A_T31 (SEQ ID NO:970). Table 953 below describes the starting and ending position of this segment on each transcript.

TABLE 953

Segment location on transcripts

| Transcript name | Segment starting position | Segment ending position |
|---|---|---|
| HUMKERK5A_T31 (SEQ ID NO: 970) | 361 | 470 |

This segment can be found in a non-coding region of transcript(s) that are related to the following protein(s): HUMKERK5A_P25.

Segment cluster HUMKERK5A_node_29 (SEQ ID NO:1005) according to the present invention is supported by 65 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 954 below describes the starting and ending position of this segment on each transcript.

TABLE 954

Segment location on transcripts

| Transcript name | Segment starting position | Segment ending position |
|---|---|---|
| HUMKERK5A_T1 (SEQ ID NO: 962) | 941 | 967 |
| HUMKERK5A_T14 (SEQ ID NO: 963) | 1223 | 1249 |
| HUMKERK5A_T15 (SEQ ID NO: 964) | 1264 | 1290 |
| HUMKERK5A_T20 (SEQ ID NO: 965) | 1223 | 1249 |
| HUMKERK5A_T24 (SEQ ID NO: 966) | 1223 | 1249 |
| HUMKERK5A_T26 (SEQ ID NO: 967) | 1223 | 1249 |
| HUMKERK5A_T27 (SEQ ID NO: 968) | 428 | 454 |
| HUMKERK5A_T29 (SEQ ID NO: 969) | 1223 | 1249 |
| HUMKERK5A_T31 (SEQ ID NO: 970) | 471 | 497 |
| HUMKERK5A_T33 (SEQ ID NO: 971) | 1223 | 1249 |
| HUMKERK5A_T39 (SEQ ID NO: 972) | 1223 | 1249 |
| HUMKERK5A_T40 (SEQ ID NO: 973) | 1223 | 1249 |

This segment can be found in the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_30 (SEQ ID NO:1006) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 955 below describes the starting and ending position of this segment on each transcript.

TABLE 955

Segment location on transcripts

| Transcript name | Segment starting position | Segment ending position |
|---|---|---|
| HUMKERK5A_T1 (SEQ ID NO: 962) | 968 | 973 |
| HUMKERK5A_T14 (SEQ ID NO: 963) | 1250 | 1255 |
| HUMKERK5A_T15 (SEQ ID NO: 964) | 1291 | 1296 |
| HUMKERK5A_T20 (SEQ ID NO: 965) | 1250 | 1255 |
| HUMKERK5A_T24 (SEQ ID NO: 966) | 1250 | 1255 |
| HUMKERK5A_T26 (SEQ ID NO: 967) | 1250 | 1255 |
| HUMKERK5A_T27 (SEQ ID NO: 968) | 455 | 460 |
| HUMKERK5A_T29 (SEQ ID NO: 969) | 1250 | 1255 |
| HUMKERK5A_T31 (SEQ ID NO: 970) | 498 | 503 |
| HUMKERK5A_T33 (SEQ ID NO: 971) | 1250 | 1255 |
| HUMKERK5A_T39 (SEQ ID NO: 972) | 1250 | 1255 |
| HUMKERK5A_T40 (SEQ ID NO: 973) | 1250 | 1255 |

This segment can be found in the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_31 (SEQ ID NO:1007) according to the present invention is supported by 68 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 956 below describes the starting and ending position of this segment on each transcript.

TABLE 956

Segment location on transcripts

| Transcript name | Segment starting position | Segment ending position |
|---|---|---|
| HUMKERK5A_T1 (SEQ ID NO: 962) | 974 | 1000 |
| HUMKERK5A_T14 (SEQ ID NO: 963) | 1256 | 1282 |
| HUMKERK5A_T15 (SEQ ID NO: 964) | 1297 | 1323 |
| HUMKERK5A_T20 (SEQ ID NO: 965) | 1256 | 1282 |
| HUMKERK5A_T24 (SEQ ID NO: 966) | 1256 | 1282 |
| HUMKERK5A_T26 (SEQ ID NO: 967) | 1256 | 1282 |
| HUMKERK5A_T27 (SEQ ID NO: 968) | 461 | 487 |
| HUMKERK5A_T29 (SEQ ID NO: 969) | 1256 | 1282 |
| HUMKERK5A_T31 (SEQ ID NO: 970) | 504 | 530 |

TABLE 956-continued

Segment location on transcripts

| Transcript name | Segment starting position | Segment ending position |
|---|---|---|
| HUMKERK5A_T33 (SEQ ID NO: 971) | 1256 | 1282 |
| HUMKERK5A_T39 (SEQ ID NO: 972) | 1256 | 1282 |
| HUMKERK5A_T40 (SEQ ID NO: 973) | 1256 | 1282 |

This segment can be found in the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_32 (SEQ ID NO:1008) according to the present invention is supported by 67 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 957 below describes the starting and ending position of this segment on each transcript.

TABLE 957

Segment location on transcripts

| Transcript name | Segment starting position | Segment ending position |
|---|---|---|
| HUMKERK5A_T1 (SEQ ID NO: 962) | 1001 | 1036 |
| HUMKERK5A_T14 (SEQ ID NO: 963) | 1283 | 1318 |
| HUMKERK5A_T15 (SEQ ID NO: 964) | 1324 | 1359 |
| HUMKERK5A_T20 (SEQ ID NO: 965) | 1283 | 1318 |
| HUMKERK5A_T24 (SEQ ID NO: 966) | 1283 | 1318 |
| HUMKERK5A_T26 (SEQ ID NO: 967) | 1283 | 1318 |
| HUMKERK5A_T27 (SEQ ID NO: 968) | 488 | 523 |
| HUMKERK5A_T29 (SEQ ID NO: 969) | 1283 | 1318 |
| HUMKERK5A_T31 (SEQ ID NO: 970) | 531 | 566 |
| HUMKERK5A_T33 (SEQ ID NO: 971) | 1283 | 1318 |
| HUMKERK5A_T39 (SEQ ID NO: 972) | 1283 | 1318 |
| HUMKERK5A_T40 (SEQ ID NO: 973) | 1283 | 1318 |

This segment can be found in the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_35 (SEQ ID NO:1009) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 958 below describes the starting and ending position of this segment on each transcript.

TABLE 958

Segment location on transcripts

| Transcript name | Segment starting position | Segment ending position |
|---|---|---|
| HUMKERK5A_T1 (SEQ ID NO: 962) | 1198 | 1201 |
| HUMKERK5A_T14 (SEQ ID NO: 963) | 1622 | 1625 |
| HUMKERK5A_T15 (SEQ ID NO: 964) | 1521 | 1524 |
| HUMKERK5A_T20 (SEQ ID NO: 965) | 1480 | 1483 |
| HUMKERK5A_T24 (SEQ ID NO: 966) | 1480 | 1483 |
| HUMKERK5A_T26 (SEQ ID NO: 967) | 1480 | 1483 |
| HUMKERK5A_T27 (SEQ ID NO: 968) | 685 | 688 |
| HUMKERK5A_T29 (SEQ ID NO: 969) | 1480 | 1483 |
| HUMKERK5A_T31 (SEQ ID NO: 970) | 728 | 731 |
| HUMKERK5A_T33 (SEQ ID NO: 971) | 1622 | 1625 |
| HUMKERK5A_T39 (SEQ ID NO: 972) | 1480 | 1483 |
| HUMKERK5A_T40 (SEQ ID NO: 973) | 1480 | 1483 |

This segment can be found in both coding and non-coding regions of transcript(s) as follows. The segment can be found in a non-coding region of transcript(s) that are related to the following protein(s): HUMKERK5A_P9. This segment can also be found in the following protein(s): HUMKERK5A_P1, HUMKERK5A_P10, HUMKERK5A_P15, HUMKERK5A_P19, HUMKERK5A_P21, HUMKERK5A_P23 and HUMKERK5A_P25, since it is in the coding region for the corresponding transcript.

Segment cluster HUMKERK5A_node_37 (SEQ ID NO:1010) according to the present invention can be found in the following transcript(s): HUMKERK5A_T20 (SEQ ID NO:965), HUMKERK5A_T33 (SEQ ID NO:971) and HUMKERK5A_T39 (SEQ ID NO:972). Table 959 below describes the starting and ending position of this segment on each transcript.

TABLE 959

Segment location on transcripts

| Transcript name | Segment starting position | Segment ending position |
|---|---|---|
| HUMKERK5A_T20 (SEQ ID NO: 965) | 1832 | 1840 |
| HUMKERK5A_T33 (SEQ ID NO: 971) | 1974 | 1982 |
| HUMKERK5A_T39 (SEQ ID NO: 972) | 1832 | 1840 |

This segment can be found in a non-coding region of transcript(s) that are related to the following protein(s): HUMKERK5A_P15 and HUMKERK5A_P9.

Segment cluster HUMKERK5A_node_38 (SEQ ID NO:1011) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 960 below describes the starting and ending position of this segment on each transcript.

TABLE 960

Segment location on transcripts

| Transcript name | Segment starting position | Segment ending position |
|---|---|---|
| HUMKERK5A_T1 (SEQ ID NO: 962) | 1202 | 1223 |
| HUMKERK5A_T14 (SEQ ID NO: 963) | 1626 | 1647 |
| HUMKERK5A_T15 (SEQ ID NO: 964) | 1525 | 1546 |
| HUMKERK5A_T20 (SEQ ID NO: 965) | 1841 | 1862 |
| HUMKERK5A_T24 (SEQ ID NO: 966) | 1484 | 1505 |
| HUMKERK5A_T26 (SEQ ID NO: 967) | 1484 | 1505 |
| HUMKERK5A_T27 (SEQ ID NO: 968) | 689 | 710 |
| HUMKERK5A_T29 (SEQ ID NO: 969) | 1484 | 1505 |
| HUMKERK5A_T31 (SEQ ID NO: 970) | 732 | 753 |
| HUMKERK5A_T33 (SEQ ID NO: 971) | 1983 | 2004 |
| HUMKERK5A_T39 (SEQ ID NO: 972) | 1841 | 1862 |
| HUMKERK5A_T40 (SEQ ID NO: 973) | 1484 | 1505 |

This segment can be found in both coding and non-coding regions of transcript(s) as follows. The segment can be found in a non-coding region of transcript(s) that are related to the following protein(s): HUMKERK5A_P9 and HUMKERK5A_P15. This segment can also be found in the following protein(s): HUMKERK5A_P1, HUMKERK5A_P10, HUMKERK5A_P19, HUMKERK5A_P21, HUMKERK5A_P23 and HUMKERK5A_P25, since it is in the coding region for the corresponding transcript.

Segment cluster HUMKERK5A_node_39 (SEQ ID NO:1012) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 961 below describes the starting and ending position of this segment on each transcript.

TABLE 961

Segment location on transcripts

| Transcript name | Segment starting position | Segment ending position |
|---|---|---|
| HUMKERK5A_T1 (SEQ ID NO: 962) | 1224 | 1243 |
| HUMKERK5A_T14 (SEQ ID NO: 963) | 1648 | 1667 |
| HUMKERK5A_T15 (SEQ ID NO: 964) | 1547 | 1566 |
| HUMKERK5A_T20 (SEQ ID NO: 965) | 1863 | 1882 |
| HUMKERK5A_T24 (SEQ ID NO: 966) | 1506 | 1525 |
| HUMKERK5A_T26 (SEQ ID NO: 967) | 1506 | 1525 |
| HUMKERK5A_T27 (SEQ ID NO: 968) | 711 | 730 |
| HUMKERK5A_T29 (SEQ ID NO: 969) | 1506 | 1525 |
| HUMKERK5A_T31 (SEQ ID NO: 970) | 754 | 773 |
| HUMKERK5A_T33 (SEQ ID NO: 971) | 2005 | 2024 |
| HUMKERK5A_T39 (SEQ ID NO: 972) | 1863 | 1882 |
| HUMKERK5A_T40 (SEQ ID NO: 973) | 1506 | 1525 |

This segment can be found in both coding and non-coding regions of transcript(s) as follows. The segment can be found in a non-coding region of transcript(s) that are related to the following protein(s): HUMKERK5A_P9 and HUMKERK5A_P15. This segment can also be found in the following protein(s): HUMKERK5A_P1, HUMKERK5A_P10, HUMKERK5A_P19, HUMKERK5A_P21, HUMKERK5A_P23 and HUMKERK5A_P25, since it is in the coding region for the corresponding transcript.

Segment cluster HUMKERK5A_node_40 (SEQ ID NO:1013) according to the present invention is supported by 61 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968),
HUMKERK5A_T29 (SEQ ID NO:969),
HUMKERK5A_T31 (SEQ ID NO:970),
HUMKERK5A_T33 (SEQ ID NO:971),
HUMKERK5A_T39 (SEQ ID NO:972) and HUMKERK5A_T40 (SEQ ID NO:973). Table 962 below describes the starting and ending position of this segment on each transcript.

TABLE 962

Segment location on transcripts

| Transcript name | Segment starting position | Segment ending position |
|---|---|---|
| HUMKERK5A_T1 (SEQ ID NO: 962) | 1244 | 1280 |
| HUMKERK5A_T14 (SEQ ID NO: 963) | 1668 | 1704 |
| HUMKERK5A_T15 (SEQ ID NO: 964) | 1567 | 1603 |
| HUMKERK5A_T20 (SEQ ID NO: 965) | 1883 | 1919 |
| HUMKERK5A_T24 (SEQ ID NO: 966) | 1526 | 1562 |
| HUMKERK5A_T26 (SEQ ID NO: 967) | 1526 | 1562 |
| HUMKERK5A_T27 (SEQ ID NO: 968) | 731 | 767 |
| HUMKERK5A_T29 (SEQ ID NO: 969) | 1526 | 1562 |
| HUMKERK5A_T31 (SEQ ID NO: 970) | 774 | 810 |
| HUMKERK5A_T33 (SEQ ID NO: 971) | 2025 | 2061 |
| HUMKERK5A_T39 (SEQ ID NO: 972) | 1883 | 1919 |
| HUMKERK5A_T40 (SEQ ID NO: 973) | 1526 | 1562 |

This segment can be found in both coding and non-coding regions of transcript(s) as follows. The segment can be found in a non-coding region of transcript(s) that are related to the following protein(s): HUMKERK5A_P9 and HUMKERK5A_P15. This segment can also be found in the following protein(s): HUMKERK5A_P1, HUMKERK5A_P10, HUMKERK5A_P19, HUMKERK5A_P21, HUMKERK5A_P23 and HUMKERK5A_P25, since it is in the coding region for the corresponding transcript.

Segment cluster HUMKERK5A_node_41 (SEQ ID NO:1014) according to the present invention is supported by 61 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 963 below describes the starting and ending position of this segment on each transcript.

TABLE 963

Segment location on transcripts

| Transcript name | Segment starting position | Segment ending position |
|---|---|---|
| HUMKERK5A_T1 (SEQ ID NO: 962) | 1281 | 1327 |
| HUMKERK5A_T14 (SEQ ID NO: 963) | 1705 | 1751 |
| HUMKERK5A_T15 (SEQ ID NO: 964) | 1604 | 1650 |
| HUMKERK5A_T20 (SEQ ID NO: 965) | 1920 | 1966 |
| HUMKERK5A_T24 (SEQ ID NO: 966) | 1563 | 1609 |
| HUMKERK5A_T26 (SEQ ID NO: 967) | 1563 | 1609 |
| HUMKERK5A_T27 (SEQ ID NO: 968) | 768 | 814 |
| HUMKERK5A_T29 (SEQ ID NO: 969) | 1563 | 1609 |
| HUMKERK5A_T31 (SEQ ID NO: 970) | 811 | 857 |
| HUMKERK5A_T33 (SEQ ID NO: 971) | 2062 | 2108 |
| HUMKERK5A_T39 (SEQ ID NO: 972) | 1920 | 1966 |
| HUMKERK5A_T40 (SEQ ID NO: 973) | 1563 | 1609 |

This segment can be found in both coding and non-coding regions of transcript(s) as follows. The segment can be found in a non-coding region of transcript(s) that are related to the following protein(s): HUMKERK5A_P9 and HUMKERK5A_P15. This segment can also be found in the following protein(s): HUMKERK5A_P1, HUMKERK5A_P10, HUMKERK5A_P19, HUMKERK5A_P21, HUMKERK5A_P23 and HUMKERK5A_P25, since it is in the coding region for the corresponding transcript.

Segment cluster HUMKERK5A_node_43 (SEQ ID NO:1015) according to the present invention is supported by 63 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 964 below describes the starting and ending position of this segment on each transcript.

TABLE 964

Segment location on transcripts

| Transcript name | Segment starting position | Segment ending position |
|---|---|---|
| HUMKERK5A_T1 (SEQ ID NO: 962) | 1328 | 1402 |
| HUMKERK5A_T14 (SEQ ID NO: 963) | 1752 | 1826 |

TABLE 964-continued

Segment location on transcripts

| Transcript name | Segment starting position | Segment ending position |
|---|---|---|
| HUMKERK5A_T15 (SEQ ID NO: 964) | 1651 | 1725 |
| HUMKERK5A_T20 (SEQ ID NO: 965) | 1967 | 2041 |
| HUMKERK5A_T24 (SEQ ID NO: 966) | 1610 | 1684 |
| HUMKERK5A_T26 (SEQ ID NO: 967) | 1610 | 1684 |
| HUMKERK5A_T27 (SEQ ID NO: 968) | 815 | 889 |
| HUMKERK5A_T29 (SEQ ID NO: 969) | 1859 | 1933 |
| HUMKERK5A_T31 (SEQ ID NO: 970) | 858 | 932 |
| HUMKERK5A_T33 (SEQ ID NO: 971) | 2109 | 2183 |
| HUMKERK5A_T39 (SEQ ID NO: 972) | 2216 | 2290 |
| HUMKERK5A_T40 (SEQ ID NO: 973) | 1859 | 1933 |

This segment can be found in both coding and non-coding regions of transcript(s) as follows. The segment can be found in a non-coding region of transcript(s) that are related to the following protein(s): HUMKERK5A_P9, HUMKERK5A_P15 and HUMKERK5A_P23. This segment can also be found in the following protein(s): HUMKERK5A_P1, HUMKERK5A_P10, HUMKERK5A_P19, HUMKERK5A_P21 and HUMKERK5A_P25, since it is in the coding region for the corresponding transcript.

Segment cluster HUMKERK5A_node_44 (SEQ ID NO:1016) according to the present invention is supported by 63 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 965 below describes the starting and ending position of this segment on each transcript.

TABLE 965

Segment location on transcripts

| Transcript name | Segment starting position | Segment ending position |
|---|---|---|
| HUMKERK5A_T1 (SEQ ID NO: 962) | 1403 | 1456 |
| HUMKERK5A_T14 (SEQ ID NO: 963) | 1827 | 1880 |
| HUMKERK5A_T15 (SEQ ID NO: 964) | 1726 | 1779 |

TABLE 965-continued

Segment location on transcripts

| Transcript name | Segment starting position | Segment ending position |
|---|---|---|
| HUMKERK5A_T20 (SEQ ID NO: 965) | 2042 | 2095 |
| HUMKERK5A_T24 (SEQ ID NO: 966) | 1685 | 1738 |
| HUMKERK5A_T26 (SEQ ID NO: 967) | 1685 | 1738 |
| HUMKERK5A_T27 (SEQ ID NO: 968) | 890 | 943 |
| HUMKERK5A_T29 (SEQ ID NO: 969) | 1934 | 1987 |
| HUMKERK5A_T31 (SEQ ID NO: 970) | 933 | 986 |
| HUMKERK5A_T33 (SEQ ID NO: 971) | 2184 | 2237 |
| HUMKERK5A_T39 (SEQ ID NO: 972) | 2291 | 2344 |
| HUMKERK5A_T40 (SEQ ID NO: 973) | 1934 | 1987 |

This segment can be found in both coding and non-coding regions of transcript(s) as follows. The segment can be found in a non-coding region of transcript(s) that are related to the following protein(s): HUMKERK5A_P9, HUMKERK5A_P15 and HUMKERK5A_P23. This segment can also be found in the following protein(s): HUMKERK5A_P1, HUMKERK5A_P10, HUMKERK5A_P19, HUMKERK5A_P21 and HUMKERK5A_P25, since it is in the coding region for the corresponding transcript.

Segment cluster HUMKERK5A_node_45 (SEQ ID NO:1017) according to the present invention is supported by 70 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 966 below describes the starting and ending position of this segment on each transcript.

TABLE 966

Segment location on transcripts

| Transcript name | Segment starting position | segment ending position |
|---|---|---|
| HUMKERK5A_T1 (SEQ ID NO: 962) | 1457 | 1544 |
| HUMKERK5A_T14 (SEQ ID NO: 963) | 1881 | 1968 |
| HUMKERK5A_T15 (SEQ ID NO: 964) | 1780 | 1867 |
| HUMKERK5A_T20 (SEQ ID NO: 965) | 2096 | 2183 |

TABLE 966-continued

Segment location on transcripts

| Transcript name | Segment starting position | segment ending position |
|---|---|---|
| HUMKERK5A_T24 (SEQ ID NO: 966) | 1739 | 1826 |
| HUMKERK5A_T26 (SEQ ID NO: 967) | 1739 | 1826 |
| HUMKERK5A_T27 (SEQ ID NO: 968) | 944 | 1031 |
| HUMKERK5A_T29 (SEQ ID NO: 969) | 1988 | 2075 |
| HUMKERK5A_T31 (SEQ ID NO: 970) | 987 | 1074 |
| HUMKERK5A_T33 (SEQ ID NO: 971) | 2238 | 2325 |
| HUMKERK5A_T39 (SEQ ID NO: 972) | 2345 | 2432 |
| HUMKERK5A_T40 (SEQ ID NO: 973) | 1988 | 2075 |

This segment can be found in both coding and non-coding regions of transcript(s) as follows. The segment can be found in a non-coding region of transcript(s) that are related to the following protein(s): HUMKERK5A_P9, HUMKERK5A_P15 and HUMKERK5A_P23. This segment can also be found in the following protein(s): HUMKERK5A_P1, HUMKERK5A_P10, HUMKERK5A_P19, HUMKERK5A_P21 and HUMKERK5A_P25, since it is in the coding region for the corresponding transcript.

Segment cluster HUMKERK5A_node_46 (SEQ ID NO:1018) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 967 below describes the starting and ending position of this segment on each transcript.

TABLE 967

Segment location on transcripts

| Transcript name | Segment starting position | segment ending position |
|---|---|---|
| HUMKERK5A_T1 (SEQ ID NO: 962) | 1545 | 1548 |
| HUMKERK5A_T14 (SEQ ID NO: 963) | 1969 | 1972 |
| HUMKERK5A_T15 (SEQ ID NO: 964) | 1868 | 1871 |
| HUMKERK5A_T20 (SEQ ID NO: 965) | 2184 | 2187 |
| HUMKERK5A_T24 (SEQ ID NO: 966) | 1827 | 1830 |
| HUMKERK5A_T26 (SEQ ID NO: 967) | 1827 | 1830 |
| HUMKERK5A_T27 (SEQ ID NO: 968) | 1032 | 1035 |

TABLE 967-continued

Segment location on transcripts

| Transcript name | Segment starting position | segment ending position |
|---|---|---|
| HUMKERK5A_T29 (SEQ ID NO: 969) | 2076 | 2079 |
| HUMKERK5A_T31 (SEQ ID NO: 970) | 1075 | 1078 |
| HUMKERK5A_T33 (SEQ ID NO: 971) | 2326 | 2329 |
| HUMKERK5A_T39 (SEQ ID NO: 972) | 2433 | 2436 |
| HUMKERK5A_T40 (SEQ ID NO: 973) | 2076 | 2079 |

This segment can be found in both coding and non-coding regions of transcript(s) as follows. The segment can be found in a non-coding region of transcript(s) that are related to the following protein(s): HUMKERK5A_P9, HUMKERK5A_P15 and HUMKERK5A_P23. This segment can also be found in the following protein(s): HUMKERK5A_P1, HUMKERK5A_P10, HUMKERK5A_P19, HUMKERK5A_P21 and HUMKERK5A_P25, since it is in the coding region for the corresponding transcript.

Segment cluster HUMKERK5A_node_48 (SEQ ID NO:1019) according to the present invention is supported by 71 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 968 below describes the starting and ending position of this segment on each transcript.

TABLE 968

Segment location on transcripts

| Transcript name | Segment starting position | segment ending position |
|---|---|---|
| HUMKERK5A_T1 (SEQ ID NO: 962) | 1549 | 1583 |
| HUMKERK5A_T14 (SEQ ID NO: 963) | 1973 | 2007 |
| HUMKERK5A_T15 (SEQ ID NO: 964) | 1872 | 1906 |
| HUMKERK5A_T20 (SEQ ID NO: 965) | 2188 | 2222 |
| HUMKERK5A_T24 (SEQ ID NO: 966) | 2635 | 2669 |
| HUMKERK5A_T26 (SEQ ID NO: 967) | 2635 | 2669 |
| HUMKERK5A_T27 (SEQ ID NO: 968) | 1036 | 1070 |
| HUMKERK5A_T29 (SEQ ID NO: 969) | 2080 | 2114 |
| HUMKERK5A_T31 (SEQ ID NO: 970) | 1079 | 1113 |

TABLE 968-continued

Segment location on transcripts

| Transcript name | Segment starting position | segment ending position |
|---|---|---|
| HUMKERK5A_T33 (SEQ ID NO: 971) | 2330 | 2364 |
| HUMKERK5A_T39 (SEQ ID NO: 972) | 2437 | 2471 |
| HUMKERK5A_T40 (SEQ ID NO: 973) | 2884 | 2918 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_51 (SEQ ID NO:1020) according to the present invention is supported by 67 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 969 below describes the starting and ending position of this segment on each transcript.

TABLE 969

Segment location on transcripts

| Transcript name | Segment starting position | Segment ending position |
|---|---|---|
| HUMKERK5A_T1 (SEQ ID NO: 962) | 1584 | 1623 |
| HUMKERK5A_T14 (SEQ ID NO: 963) | 2008 | 2047 |
| HUMKERK5A_T15 (SEQ ID NO: 964) | 1907 | 1946 |
| HUMKERK5A_T20 (SEQ ID NO: 965) | 2223 | 2262 |
| HUMKERK5A_T24 (SEQ ID NO: 966) | 2670 | 2709 |
| HUMKERK5A_T26 (SEQ ID NO: 967) | 3227 | 3266 |
| HUMKERK5A_T27 (SEQ ID NO: 968) | 1071 | 1110 |
| HUMKERK5A_T29 (SEQ ID NO: 969) | 2115 | 2154 |
| HUMKERK5A_T31 (SEQ ID NO: 970) | 1114 | 1153 |
| HUMKERK5A_T33 (SEQ ID NO: 971) | 2365 | 2404 |
| HUMKERK5A_T39 (SEQ ID NO: 972) | 2472 | 2511 |

TABLE 969-continued

Segment location on transcripts

| Transcript name | Segment starting position | Segment ending position |
|---|---|---|
| HUMKERK5A_T40 (SEQ ID NO: 973) | 2919 | 2958 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_52 (SEQ ID NO:1021) according to the present invention is supported by 67 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 970 below describes the starting and ending position of this segment on each transcript.

TABLE 970

Segment location on transcripts

| Transcript name | Segment starting position | Segment ending position |
|---|---|---|
| HUMKERK5A_T1 (SEQ ID NO: 962) | 1624 | 1665 |
| HUMKERK5A_T14 (SEQ ID NO: 963) | 2048 | 2089 |
| HUMKERK5A_T15 (SEQ ID NO: 964) | 1947 | 1988 |
| HUMKERK5A_T20 (SEQ ID NO: 965) | 2263 | 2304 |
| HUMKERK5A_T24 (SEQ ID NO: 966) | 2710 | 2751 |
| HUMKERK5A_T26 (SEQ ID NO: 967) | 3267 | 3308 |
| HUMKERK5A_T27 (SEQ ID NO: 968) | 1111 | 1152 |
| HUMKERK5A_T29 (SEQ ID NO: 969) | 2155 | 2196 |
| HUMKERK5A_T31 (SEQ ID NO: 970) | 1154 | 1195 |
| HUMKERK5A_T33 (SEQ ID NO: 971) | 2405 | 2446 |
| HUMKERK5A_T39 (SEQ ID NO: 972) | 2512 | 2553 |
| HUMKERK5A_T40 (SEQ ID NO: 973) | 2959 | 3000 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_53 (SEQ ID NO:1022) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 971 below describes the starting and ending position of this segment on each transcript.

TABLE 971

Segment location on transcripts

| Transcript name | Segment starting position | Segment ending position |
|---|---|---|
| HUMKERK5A_T1 (SEQ ID NO: 962) | 1666 | 1676 |
| HUMKERK5A_T14 (SEQ ID NO: 963) | 2090 | 2100 |
| HUMKERK5A_T15 (SEQ ID NO: 964) | 1989 | 1999 |
| HUMKERK5A_T20 (SEQ ID NO: 965) | 2305 | 2315 |
| HUMKERK5A_T24 (SEQ ID NO: 966) | 2752 | 2762 |
| HUMKERK5A_T26 (SEQ ID NO: 967) | 3309 | 3319 |
| HUMKERK5A_T27 (SEQ ID NO: 968) | 1153 | 1163 |
| HUMKERK5A_T29 (SEQ ID NO: 969) | 2197 | 2207 |
| HUMKERK5A_T31 (SEQ ID NO: 970) | 1196 | 1206 |
| HUMKERK5A_T33 (SEQ ID NO: 971) | 2447 | 2457 |
| HUMKERK5A_T39 (SEQ ID NO: 972) | 2554 | 2564 |
| HUMKERK5A_T40 (SEQ ID NO: 973) | 3001 | 3011 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_54 (SEQ ID NO:1023) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 972 below describes the starting and ending position of this segment on each transcript.

TABLE 972

Segment location on transcripts

| Transcript name | Segment starting position | Segment ending position |
|---|---|---|
| HUMKERK5A_T1 (SEQ ID NO: 962) | 1677 | 1688 |
| HUMKERK5A_T14 (SEQ ID NO: 963) | 2101 | 2112 |
| HUMKERK5A_T15 (SEQ ID NO: 964) | 2000 | 2011 |
| HUMKERK5A_T20 (SEQ ID NO: 965) | 2316 | 2327 |
| HUMKERK5A_T24 (SEQ ID NO: 966) | 2763 | 2774 |
| HUMKERK5A_T26 (SEQ ID NO: 967) | 3320 | 3331 |
| HUMKERK5A_T27 (SEQ ID NO: 968) | 1164 | 1175 |
| HUMKERK5A_T29 (SEQ ID NO: 969) | 2208 | 2219 |
| HUMKERK5A_T31 (SEQ ID NO: 970) | 1207 | 1218 |
| HUMKERK5A_T33 (SEQ ID NO: 971) | 2458 | 2469 |
| HUMKERK5A_T39 (SEQ ID NO: 972) | 2565 | 2576 |
| HUMKERK5A_T40 (SEQ ID NO: 973) | 3012 | 3023 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_55 (SEQ ID NO:1024) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 973 below describes the starting and ending position of this segment on each transcript.

TABLE 973

Segment location on transcripts

| Transcript name | Segment starting position | Segment ending position |
|---|---|---|
| HUMKERK5A_T1 (SEQ ID NO: 962) | 1689 | 1694 |
| HUMKERK5A_T14 (SEQ ID NO: 963) | 2113 | 2118 |
| HUMKERK5A_T15 (SEQ ID NO: 964) | 2012 | 2017 |
| HUMKERK5A_T20 (SEQ ID NO: 965) | 2328 | 2333 |
| HUMKERK5A_T24 (SEQ ID NO: 966) | 2775 | 2780 |
| HUMKERK5A_T26 (SEQ ID NO: 967) | 3332 | 3337 |
| HUMKERK5A_T27 (SEQ ID NO: 968) | 1176 | 1181 |
| HUMKERK5A_T29 (SEQ ID NO: 969) | 2220 | 2225 |
| HUMKERK5A_T31 (SEQ ID NO: 970) | 1219 | 1224 |
| HUMKERK5A_T33 (SEQ ID NO: 971) | 2470 | 2475 |
| HUMKERK5A_T39 (SEQ ID NO: 972) | 2577 | 2582 |
| HUMKERK5A_T40 (SEQ ID NO: 973) | 3024 | 3029 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_56 (SEQ ID NO:1025) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 974 below describes the starting and ending position of this segment on each transcript.

TABLE 974

Segment location on transcripts

| Transcript name | Segment starting position | Segment ending position |
|---|---|---|
| HUMKERK5A_T1 (SEQ ID NO: 962) | 1695 | 1701 |
| HUMKERK5A_T14 (SEQ ID NO: 963) | 2119 | 2125 |
| HUMKERK5A_T15 (SEQ ID NO: 964) | 2018 | 2024 |
| HUMKERK5A_T20 (SEQ ID NO: 965) | 2334 | 2340 |
| HUMKERK5A_T24 (SEQ ID NO: 966) | 2781 | 2787 |
| HUMKERK5A_T26 (SEQ ID NO: 967) | 3338 | 3344 |
| HUMKERK5A_T27 (SEQ ID NO: 968) | 1182 | 1188 |
| HUMKERK5A_T29 (SEQ ID NO: 969) | 2226 | 2232 |
| HUMKERK5A_T31 (SEQ ID NO: 970) | 1225 | 1231 |
| HUMKERK5A_T33 (SEQ ID NO: 971) | 2476 | 2482 |
| HUMKERK5A_T39 (SEQ ID NO: 972) | 2583 | 2589 |
| HUMKERK5A_T40 (SEQ ID NO: 973) | 3030 | 3036 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_57 (SEQ ID NO:1026) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 975 below describes the starting and ending position of this segment on each transcript.

TABLE 975

Segment location on transcripts

| Transcript name | Segment starting position | Segment ending position |
|---|---|---|
| HUMKERK5A_T1 (SEQ ID NO: 962) | 1702 | 1705 |
| HUMKERK5A_T14 (SEQ ID NO: 963) | 2126 | 2129 |
| HUMKERK5A_T15 (SEQ ID NO: 964) | 2025 | 2028 |
| HUMKERK5A_T20 (SEQ ID NO: 965) | 2341 | 2344 |
| HUMKERK5A_T24 (SEQ ID NO: 966) | 2788 | 2791 |
| HUMKERK5A_T26 (SEQ ID NO: 967) | 3345 | 3348 |
| HUMKERK5A_T27 (SEQ ID NO: 968) | 1189 | 1192 |

TABLE 975-continued

Segment location on transcripts

| Transcript name | Segment starting position | Segment ending position |
|---|---|---|
| HUMKERK5A_T29 (SEQ ID NO: 969) | 2233 | 2236 |
| HUMKERK5A_T31 (SEQ ID NO: 970) | 1232 | 1235 |
| HUMKERK5A_T33 (SEQ ID NO: 971) | 2483 | 2486 |
| HUMKERK5A_T39 (SEQ ID NO: 972) | 2590 | 2593 |
| HUMKERK5A_T40 (SEQ ID NO: 973) | 3037 | 3040 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_58 (SEQ ID NO:1027) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 976 below describes the starting and ending position of this segment on each transcript.

TABLE 976

Segment location on transcripts

| Transcript name | Segment starting position | Segment ending position |
|---|---|---|
| HUMKERK5A_T1 (SEQ ID NO: 962) | 1706 | 1716 |
| HUMKERK5A_T14 (SEQ ID NO: 963) | 2130 | 2140 |
| HUMKERK5A_T15 (SEQ ID NO: 964) | 2029 | 2039 |
| HUMKERK5A_T20 (SEQ ID NO: 965) | 2345 | 2355 |
| HUMKERK5A_T24 (SEQ ID NO: 966) | 2792 | 2802 |
| HUMKERK5A_T26 (SEQ ID NO: 967) | 3349 | 3359 |
| HUMKERK5A_T27 (SEQ ID NO: 968) | 1193 | 1203 |
| HUMKERK5A_T29 (SEQ ID NO: 969) | 2237 | 2247 |
| HUMKERK5A_T31 (SEQ ID NO: 970) | 1236 | 1246 |
| HUMKERK5A_T33 (SEQ ID NO: 971) | 2487 | 2497 |
| HUMKERK5A_T39 (SEQ ID NO: 972) | 2594 | 2604 |

TABLE 976-continued

Segment location on transcripts

| Transcript name | Segment starting position | Segment ending position |
|---|---|---|
| HUMKERK5A_T40 (SEQ ID NO: 973) | 3041 | 3051 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_59 (SEQ ID NO:1028) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 977 below describes the starting and ending position of this segment on each transcript.

TABLE 977

Segment location on transcripts

| Transcript name | Segment starting position | Segment ending position |
|---|---|---|
| HUMKERK5A_T1 (SEQ ID NO: 962) | 1717 | 1739 |
| HUMKERK5A_T14 (SEQ ID NO: 963) | 2141 | 2163 |
| HUMKERK5A_T15 (SEQ ID NO: 964) | 2040 | 2062 |
| HUMKERK5A_T20 (SEQ ID NO: 965) | 2356 | 2378 |
| HUMKERK5A_T24 (SEQ ID NO: 966) | 2803 | 2825 |
| HUMKERK5A_T26 (SEQ ID NO: 967) | 3360 | 3382 |
| HUMKERK5A_T27 (SEQ ID NO: 968) | 1204 | 1226 |
| HUMKERK5A_T29 (SEQ ID NO: 969) | 2248 | 2270 |
| HUMKERK5A_T31 (SEQ ID NO: 970) | 1247 | 1269 |
| HUMKERK5A_T33 (SEQ ID NO: 971) | 2498 | 2520 |
| HUMKERK5A_T39 (SEQ ID NO: 972) | 2605 | 2627 |
| HUMKERK5A_T40 (SEQ ID NO: 973) | 3052 | 3074 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_60 (SEQ ID NO:1029) according to the present invention is supported by 55 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 978 below describes the starting and ending position of this segment on each transcript.

TABLE 978

Segment location on transcripts

| Transcript name | Segment starting position | Segment ending position |
|---|---|---|
| HUMKERK5A_T1 (SEQ ID NO: 962) | 1740 | 1779 |
| HUMKERK5A_T14 (SEQ ID NO: 963) | 2164 | 2203 |
| HUMKERK5A_T15 (SEQ ID NO: 964) | 2063 | 2102 |
| HUMKERK5A_T20 (SEQ ID NO: 965) | 2379 | 2418 |
| HUMKERK5A_T24 (SEQ ID NO: 966) | 2826 | 2865 |
| HUMKERK5A_T26 (SEQ ID NO: 967) | 3383 | 3422 |
| HUMKERK5A_T27 (SEQ ID NO: 968) | 1227 | 1266 |
| HUMKERK5A_T29 (SEQ ID NO: 969) | 2271 | 2310 |
| HUMKERK5A_T31 (SEQ ID NO: 970) | 1270 | 1309 |
| HUMKERK5A_T33 (SEQ ID NO: 971) | 2521 | 2560 |
| HUMKERK5A_T39 (SEQ ID NO: 972) | 2628 | 2667 |
| HUMKERK5A_T40 (SEQ ID NO: 973) | 3075 | 3114 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_61 (SEQ ID NO:1030) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 979 below describes the starting and ending position of this segment on each transcript.

TABLE 979

Segment location on transcripts

| Transcript name | Segment starting position | Segment ending position |
|---|---|---|
| HUMKERK5A_T1 (SEQ ID NO: 962) | 1780 | 1787 |
| HUMKERK5A_T14 (SEQ ID NO: 963) | 2204 | 2211 |
| HUMKERK5A_T15 (SEQ ID NO: 964) | 2103 | 2110 |
| HUMKERK5A_T20 (SEQ ID NO: 965) | 2419 | 2426 |
| HUMKERK5A_T24 (SEQ ID NO: 966) | 2866 | 2873 |
| HUMKERK5A_T26 (SEQ ID NO: 967) | 3423 | 3430 |
| HUMKERK5A_T27 (SEQ ID NO: 968) | 1267 | 1274 |
| HUMKERK5A_T29 (SEQ ID NO: 969) | 2311 | 2318 |
| HUMKERK5A_T31 (SEQ ID NO: 970) | 1310 | 1317 |
| HUMKERK5A_T33 (SEQ ID NO: 971) | 2561 | 2568 |
| HUMKERK5A_T39 (SEQ ID NO: 972) | 2668 | 2675 |
| HUMKERK5A_T40 (SEQ ID NO: 973) | 3115 | 3122 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_62 (SEQ ID NO:1031) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 980 below describes the starting and ending position of this segment on each transcript.

TABLE 980

Segment location on transcripts

| Transcript name | Segment starting position | Segment ending position |
|---|---|---|
| HUMKERK5A_T1 (SEQ ID NO: 962) | 1788 | 1795 |
| HUMKERK5A_T14 (SEQ ID NO: 963) | 2212 | 2219 |
| HUMKERK5A_T15 (SEQ ID NO: 964) | 2111 | 2118 |
| HUMKERK5A_T20 (SEQ ID NO: 965) | 2427 | 2434 |
| HUMKERK5A_T24 (SEQ ID NO: 966) | 2874 | 2881 |
| HUMKERK5A_T26 (SEQ ID NO: 967) | 3431 | 3438 |
| HUMKERK5A_T27 (SEQ ID NO: 968) | 1275 | 1282 |
| HUMKERK5A_T29 (SEQ ID NO: 969) | 2319 | 2326 |
| HUMKERK5A_T31 (SEQ ID NO: 970) | 1318 | 1325 |
| HUMKERK5A_T33 (SEQ ID NO: 971) | 2569 | 2576 |
| HUMKERK5A_T39 (SEQ ID NO: 972) | 2676 | 2683 |
| HUMKERK5A_T40 (SEQ ID NO: 973) | 3123 | 3130 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_63 (SEQ ID NO:1032) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 981 below describes the starting and ending position of this segment on each transcript.

TABLE 981

Segment location on transcripts

| Transcript name | Segment starting position | Segment ending position |
|---|---|---|
| HUMKERK5A_T1 (SEQ ID NO: 962) | 1796 | 1818 |
| HUMKERK5A_T14 (SEQ ID NO: 963) | 2220 | 2242 |
| HUMKERK5A_T15 (SEQ ID NO: 964) | 2119 | 2141 |
| HUMKERK5A_T20 (SEQ ID NO: 965) | 2435 | 2457 |
| HUMKERK5A_T24 (SEQ ID NO: 966) | 2882 | 2904 |
| HUMKERK5A_T26 (SEQ ID NO: 967) | 3439 | 3461 |
| HUMKERK5A_T27 (SEQ ID NO: 968) | 1283 | 1305 |
| HUMKERK5A_T29 (SEQ ID NO: 969) | 2327 | 2349 |
| HUMKERK5A_T31 (SEQ ID NO: 970) | 1326 | 1348 |
| HUMKERK5A_T33 (SEQ ID NO: 971) | 2577 | 2599 |
| HUMKERK5A_T39 (SEQ ID NO: 972) | 2684 | 2706 |
| HUMKERK5A_T40 (SEQ ID NO: 973) | 3131 | 3153 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_64 (SEQ ID NO:1033) according to the present invention is supported by 51 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 982 below describes the starting and ending position of this segment on each transcript.

TABLE 982

Segment location on transcripts

| Transcript name | Segment starting position | Segment ending position |
|---|---|---|
| HUMKERK5A_T1 (SEQ ID NO: 962) | 1819 | 1867 |
| HUMKERK5A_T14 (SEQ ID NO: 963) | 2243 | 2291 |
| HUMKERK5A_T15 (SEQ ID NO: 964) | 2142 | 2190 |
| HUMKERK5A_T20 (SEQ ID NO: 965) | 2458 | 2506 |
| HUMKERK5A_T24 (SEQ ID NO: 966) | 2905 | 2953 |

TABLE 982-continued

Segment location on transcripts

| Transcript name | Segment starting position | Segment ending position |
|---|---|---|
| HUMKERK5A_T26 (SEQ ID NO: 967) | 3462 | 3510 |
| HUMKERK5A_T27 (SEQ ID NO: 968) | 1306 | 1354 |
| HUMKERK5A_T29 (SEQ ID NO: 969) | 2350 | 2398 |
| HUMKERK5A_T31 (SEQ ID NO: 970) | 1349 | 1397 |
| HUMKERK5A_T33 (SEQ ID NO: 971) | 2600 | 2648 |
| HUMKERK5A_T39 (SEQ ID NO: 972) | 2707 | 2755 |
| HUMKERK5A_T40 (SEQ ID NO: 973) | 3154 | 3202 |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_65 (SEQ ID NO:1034) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 983 below describes the starting and ending position of this segment on each transcript.

TABLE 983

Segment location on transcripts

| Transcript name | Segment starting position | Segment ending position |
|---|---|---|
| HUMKERK5A_T1 (SEQ ID NO: 962) | 1868 | 1886 |
| HUMKERK5A_T14 (SEQ ID NO: 963) | 2292 | 2310 |
| HUMKERK5A_T15 (SEQ ID NO: 964) | 2191 | 2209 |
| HUMKERK5A_T20 (SEQ ID NO: 965) | 2507 | 2525 |
| HUMKERK5A_T24 (SEQ ID NO: 966) | 2954 | 2972 |
| HUMKERK5A_T26 (SEQ ID NO: 967) | 3511 | 3529 |
| HUMKERK5A_T27 (SEQ ID NO: 968) | 1355 | 1373 |
| HUMKERK5A_T29 (SEQ ID NO: 969) | 2399 | 2417 |
| HUMKERK5A_T31 (SEQ ID NO: 970) | 1398 | 1416 |
| HUMKERK5A_T33 (SEQ ID NO: 971) | 2649 | 2667 |
| HUMKERK5A_T39 (SEQ ID NO: 972) | 2756 | 2774 |
| HUMKERK5A_T40 (SEQ ID NO: 973) | 3203 | 3221 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 984.

TABLE 984

Oligonucleotides related to this segment

| Oligonucleotide name | Overexpressed in cancers | Chip reference |
|---|---|---|
| HUMKERK5A_0_0_594 | lung malignant tumors | LUN |

This segment can be found in both coding and non-coding regions of transcript(s) as follows. The segment can be found in a non-coding region of transcript(s) that are related to the following protein(s): HUMKERK5A_P9, HUMKERK5A_P15, HUMKERK5A_P19 and HUMKERK5A_P23. This segment can also be found in the following protein(s): HUMKERK5A_P1, HUMKERK5A_P10, HUMKERK5A_P21 and HUMKERK5A_P25, since it is in the coding region for the corresponding transcript.

Segment cluster HUMKERK5A_node_66 (SEQ ID NO:1035) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 985 below describes the starting and ending position of this segment on each transcript.

TABLE 985

Segment location on transcripts

| Transcript name | Segment starting position | Segment ending position |
|---|---|---|
| HUMKERK5A_T1 (SEQ ID NO: 962) | 1887 | 1903 |
| HUMKERK5A_T14 (SEQ ID NO: 963) | 2311 | 2327 |

TABLE 985-continued

Segment location on transcripts

| Transcript name | Segment starting position | Segment ending position |
|---|---|---|
| HUMKERK5A_T15 (SEQ ID NO: 964) | 2210 | 2226 |
| HUMKERK5A_T20 (SEQ ID NO: 965) | 2526 | 2542 |
| HUMKERK5A_T24 (SEQ ID NO: 966) | 2973 | 2989 |
| HUMKERK5A_T26 (SEQ ID NO: 967) | 3530 | 3546 |
| HUMKERK5A_T27 (SEQ ID NO: 968) | 1374 | 1390 |
| HUMKERK5A_T29 (SEQ ID NO: 969) | 2418 | 2434 |
| HUMKERK5A_T31 (SEQ ID NO: 970) | 1417 | 1433 |
| HUMKERK5A_T33 (SEQ ID NO: 971) | 2668 | 2684 |
| HUMKERK5A_T39 (SEQ ID NO: 972) | 2775 | 2791 |
| HUMKERK5A_T40 (SEQ ID NO: 973) | 3222 | 3238 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_67 (SEQ ID NO:1036) according to the present invention is supported by 54 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 986 below describes the starting and ending position of this segment on each transcript.

татBLE 986

Segment location on transcripts

| Transcript name | Segment starting position | Segment ending position |
|---|---|---|
| HUMKERK5A_T1 (SEQ ID NO: 962) | 1904 | 1940 |
| HUMKERK5A_T14 (SEQ ID NO: 963) | 2328 | 2364 |
| HUMKERK5A_T15 (SEQ ID NO: 964) | 2227 | 2263 |
| HUMKERK5A_T20 (SEQ ID NO: 965) | 2543 | 2579 |
| HUMKERK5A_T24 (SEQ ID NO: 966) | 2990 | 3026 |
| HUMKERK5A_T26 (SEQ ID NO: 967) | 3547 | 3583 |

TABLE 986-continued

Segment location on transcripts

| Transcript name | Segment starting position | Segment ending position |
|---|---|---|
| HUMKERK5A_T27 (SEQ ID NO: 968) | 1391 | 1427 |
| HUMKERK5A_T29 (SEQ ID NO: 969) | 2435 | 2471 |
| HUMKERK5A_T31 (SEQ ID NO: 970) | 1434 | 1470 |
| HUMKERK5A_T33 (SEQ ID NO: 971) | 2685 | 2721 |
| HUMKERK5A_T39 (SEQ ID NO: 972) | 2792 | 2828 |
| HUMKERK5A_T40 (SEQ ID NO: 973) | 3239 | 3275 |

This segment can be found in a non-coding region of transcripts(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_68 (SEQ ID NO:1037) according to the present invention is supported by 55 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 987 below describes the starting and ending position of this segment on each transcript.

TABLE 987

Segment location on transcripts

| Transcript name | Segment starting position | Segment ending position |
|---|---|---|
| HUMKERK5A_T1 (SEQ ID NO: 962) | 1941 | 1999 |
| HUMKERK5A_T14 (SEQ ID NO: 963) | 2365 | 2423 |
| HUMKERK5A_T15 (SEQ ID NO: 964) | 2264 | 2322 |
| HUMKERK5A_T20 (SEQ ID NO: 965) | 2580 | 2638 |
| HUMKERK5A_T24 (SEQ ID NO: 966) | 3027 | 3085 |
| HUMKERK5A_T26 (SEQ ID NO: 967) | 3584 | 3642 |
| HUMKERK5A_T27 (SEQ ID NO: 968) | 1428 | 1486 |
| HUMKERK5A_T29 (SEQ ID NO: 969) | 2472 | 2530 |
| HUMKERK5A_T31 (SEQ ID NO: 970) | 1471 | 1529 |
| HUMKERK5A_T33 (SEQ ID NO: 971) | 2722 | 2780 |
| HUMKERK5A_T39 (SEQ ID NO: 972) | 2829 | 2887 |

TABLE 987-continued

Segment location on transcripts

| Transcript name | Segment starting position | Segment ending position |
|---|---|---|
| HUMKERK5A_T40 (SEQ ID NO: 973) | 3276 | 3334 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_69 (SEQ ID NO:1038) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 988 below describes the starting and ending position of this segment on each transcript.

TABLE 988

Segment location on transcripts

| Transcript name | Segment starting position | Segment ending position |
|---|---|---|
| HUMKERK5A_T1 (SEQ ID NO: 962) | 2000 | 2012 |
| HUMKERK5A_T14 (SEQ ID NO: 963) | 2424 | 2436 |
| HUMKERK5A_T15 (SEQ ID NO: 964) | 2323 | 2335 |
| HUMKERK5A_T20 (SEQ ID NO: 965) | 2639 | 2651 |
| HUMKERK5A_T24 (SEQ ID NO: 966) | 3086 | 3098 |
| HUMKERK5A_T26 (SEQ ID NO: 967) | 3643 | 3655 |
| HUMKERK5A_T27 (SEQ ID NO: 968) | 1487 | 1499 |
| HUMKERK5A_T29 (SEQ ID NO: 969) | 2531 | 2543 |
| HUMKERK5A_T31 (SEQ ID NO: 970) | 1530 | 1542 |
| HUMKERK5A_T33 (SEQ ID NO: 971) | 2781 | 2793 |
| HUMKERK5A_T39 (SEQ ID NO: 972) | 2888 | 2900 |
| HUMKERK5A_T40 (SEQ ID NO: 973) | 3335 | 3347 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_70 (SEQ ID NO:1039) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 989 below describes the starting and ending position of this segment on each transcript.

TABLE 989

Segment location on transcripts

| Transcript name | Segment starting position | Segment ending position |
|---|---|---|
| HUMKERK5A_T1 (SEQ ID NO: 962) | 2013 | 2031 |
| HUMKERK5A_T14 (SEQ ID NO: 963) | 2437 | 2455 |
| HUMKERK5A_T15 (SEQ ID NO: 964) | 2336 | 2354 |
| HUMKERK5A_T20 (SEQ ID NO: 965) | 2652 | 2670 |
| HUMKERK5A_T24 (SEQ ID NO: 966) | 3099 | 3117 |
| HUMKERK5A_T26 (SEQ ID NO: 967) | 3656 | 3674 |
| HUMKERK5A_T27 (SEQ ID NO: 968) | 1500 | 1518 |
| HUMKERK5A_T29 (SEQ ID NO: 969) | 2544 | 2562 |
| HUMKERK5A_T31 (SEQ ID NO: 970) | 1543 | 1561 |
| HUMKERK5A_T33 (SEQ ID NO: 971) | 2794 | 2812 |
| HUMKERK5A_T39 (SEQ ID NO: 972) | 2901 | 2919 |
| HUMKERK5A_T40 (SEQ ID NO: 973) | 3348 | 3366 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_71 (SEQ ID NO:1040) according to the present invention is supported by 50 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 990 below describes the starting and ending position of this segment on each transcript.

TABLE 990

Segment location on transcripts

| Transcript name | Segment starting position | Segment ending position |
| --- | --- | --- |
| HUMKERK5A_T1 (SEQ ID NO: 962) | 2032 | 2093 |
| HUMKERK5A_T14 (SEQ ID NO: 963) | 2456 | 2517 |
| HUMKERK5A_T15 (SEQ ID NO: 964) | 2355 | 2416 |
| HUMKERK5A_T20 (SEQ ID NO: 965) | 2671 | 2732 |
| HUMKERK5A_T24 (SEQ ID NO: 966) | 3118 | 3179 |
| HUMKERK5A_T26 (SEQ ID NO: 967) | 3675 | 3736 |
| HUMKERK5A_T27 (SEQ ID NO: 968) | 1519 | 1580 |
| HUMKERK5A_T29 (SEQ ID NO: 969) | 2563 | 2624 |
| HUMKERK5A_T31 (SEQ ID NO: 970) | 1562 | 1623 |
| HUMKERK5A_T33 (SEQ ID NO: 971) | 2813 | 2874 |
| HUMKERK5A_T39 (SEQ ID NO: 972) | 2920 | 2981 |
| HUMKERK5A_T40 (SEQ ID NO: 973) | 3367 | 3428 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_72 (SEQ ID NO:1041) according to the present invention is supported by 42 libraries. The number of libraries was determined as previously described. This segment can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 991 below describes the starting and ending position of this segment on each transcript.

TABLE 991

Segment location on transcripts

| Transcript name | Segment starting position | Segment ending position |
| --- | --- | --- |
| HUMKERK5A_T1 (SEQ ID NO: 962) | 2094 | 2129 |
| HUMKERK5A_T14 (SEQ ID NO: 963) | 2518 | 2553 |
| HUMKERK5A_T15 (SEQ ID NO: 964) | 2417 | 2452 |
| HUMKERK5A_T20 (SEQ ID NO: 965) | 2733 | 2768 |
| HUMKERK5A_T24 (SEQ ID NO: 966) | 3180 | 3215 |
| HUMKERK5A_T26 (SEQ ID NO: 967) | 3737 | 3772 |
| HUMKERK5A_T27 (SEQ ID NO: 968) | 1581 | 1616 |
| HUMKERK5A_T29 (SEQ ID NO: 969) | 2625 | 2660 |
| HUMKERK5A_T31 (SEQ ID NO: 970) | 1624 | 1659 |
| HUMKERK5A_T33 (SEQ ID NO: 971) | 2875 | 2910 |
| HUMKERK5A_T39 (SEQ ID NO: 972) | 2982 | 3017 |
| HUMKERK5A_T40 (SEQ ID NO: 973) | 3429 | 3464 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Segment cluster HUMKERK5A_node_73 (SEQ ID NO:1042) according to the present invention can be found in the following transcript(s): HUMKERK5A_T1 (SEQ ID NO:962), HUMKERK5A_T14 (SEQ ID NO:963), HUMKERK5A_T15 (SEQ ID NO:964), HUMKERK5A_T20 (SEQ ID NO:965), HUMKERK5A_T24 (SEQ ID NO:966), HUMKERK5A_T26 (SEQ ID NO:967), HUMKERK5A_T27 (SEQ ID NO:968), HUMKERK5A_T29 (SEQ ID NO:969), HUMKERK5A_T31 (SEQ ID NO:970), HUMKERK5A_T33 (SEQ ID NO:971), HUMKERK5A_T39 (SEQ ID NO:972) and HUMKERK5A_T40 (SEQ ID NO:973). Table 992 below describes the starting and ending position of this segment on each transcript.

TABLE 992

Segment location on transcripts

| Transcript name | Segment starting position | Segment ending position |
| --- | --- | --- |
| HUMKERK5A_T1 (SEQ ID NO: 962) | 2130 | 2135 |
| HUMKERK5A_T14 (SEQ ID NO: 963) | 2554 | 2559 |
| HUMKERK5A_T15 (SEQ ID NO: 964) | 2453 | 2458 |
| HUMKERK5A_T20 (SEQ ID NO: 965) | 2769 | 2774 |
| HUMKERK5A_T24 (SEQ ID NO: 966) | 3216 | 3221 |
| HUMKERK5A_T26 (SEQ ID NO: 967) | 3773 | 3778 |
| HUMKERK5A_T27 (SEQ ID NO: 968) | 1617 | 1622 |
| HUMKERK5A_T29 (SEQ ID NO: 969) | 2661 | 2666 |
| HUMKERK5A_T31 (SEQ ID NO: 970) | 1660 | 1665 |

TABLE 992-continued

Segment location on transcripts

| Transcript name | Segment starting position | Segment ending position |
|---|---|---|
| HUMKERK5A_T33 (SEQ ID NO: 971) | 2911 | 2916 |
| HUMKERK5A_T39 (SEQ ID NO: 972) | 3018 | 3023 |
| HUMKERK5A_T40 (SEQ ID NO: 973) | 3465 | 3470 |

This segment can be found in a non-coding region of transcript(s) that are related to the following protein(s): HUMKERK5A_P1, HUMKERK5A_P9, HUMKERK5A_P10, HUMKERK5A_P15, HUMKERK5A_P19, HUMKERK5A_P21, HUMKERK5A_P23 and HUMKERK5A_P25.

Description for Cluster HUMMPP2X

Cluster HUMMPP2X features 5 transcript(s) and 29 segment(s) of interest, the names for which are given in Tables 993 and 994, respectively, the sequences themselves are given at the end of the application. The selected protein variants are given in Table 995.

TABLE 993

Transcripts of interest
Transcript Name

HUMMPP2X_T3 (SEQ ID NO: 1043)
HUMMPP2X_T9 (SEQ ID NO: 1044)
HUMMPP2X_T16 (SEQ ID NO: 1045)
HUMMPP2X_T22 (SEQ ID NO: 1046)
HUMMPP2X_T23 (SEQ ID NO: 1047)

TABLE 994

Segments of interest
Segment Name

HUMMPP2X_node_0 (SEQ ID NO: 1048)
HUMMPP2X_node_2 (SEQ ID NO: 1049)
HUMMPP2X_node_4 (SEQ ID NO: 1050)
HUMMPP2X_node_7 (SEQ ID NO: 1051)
HUMMPP2X_node_10 (SEQ ID NO: 1052)
HUMMPP2X_node_11 (SEQ ID NO: 1053)
HUMMPP2X_node_17 (SEQ ID NO: 1054)
HUMMPP2X_node_19 (SEQ ID NO: 1055)
HUMMPP2X_node_21 (SEQ ID NO: 1056)
HUMMPP2X_node_22 (SEQ ID NO: 1057)
HUMMPP2X_node_23 (SEQ ID NO: 1058)
HUMMPP2X_node_28 (SEQ ID NO: 1059)
HUMMPP2X_node_29 (SEQ ID NO: 1060)
HUMMPP2X_node_32 (SEQ ID NO: 1061)
HUMMPP2X_node_34 (SEQ ID NO: 1062)
HUMMPP2X_node_35 (SEQ ID NO: 1063)
HUMMPP2X_node_40 (SEQ ID NO: 1064)
HUMMPP2X_node_43 (SEQ ID NO: 1065)
HUMMPP2X_node_14 (SEQ ID NO: 1066)
HUMMPP2X_node_18 (SEQ ID NO: 1067)
HUMMPP2X_node_20 (SEQ ID NO: 1068)
HUMMPP2X_node_33 (SEQ ID NO: 1069)
HUMMPP2X_node_36 (SEQ ID NO: 1070)
HUMMPP2X_node_37 (SEQ ID NO: 1071)
HUMMPP2X_node_38 (SEQ ID NO: 1072)
HUMMPP2X_node_39 (SEQ ID NO: 1073)
HUMMPP2X_node_41 (SEQ ID NO: 1074)
HUMMPP2X_node_42 (SEQ ID NO: 1075)
HUMMPP2X_node_44 (SEQ ID NO: 1076)

TABLE 995

Proteins of interest

| Protein Name | Corresponding Transcript(s) |
|---|---|
| HUMMPP2X_P4 | HUMMPP2X_T3 (SEQ ID NO: 1043); HUMMPP2X_T9 (SEQ ID NO: 1044) |
| HUMMPP2X_P13 | HUMMPP2X_T16 (SEQ ID NO: 1045) |
| HUMMPP2X_P17 | HUMMPP2X_T23 (SEQ ID NO: 1047) |

These sequences are variants of the known protein Forkhead box protein M1 (SwissProt accession identifier FXM1_HUMAN; known also according to the synonyms Forkhead-related protein FKHL16; Hepatocyte nuclear factor 3 forkhead homolog 11; HNF-3/fork-head homolog-11; HFH-11; Winged helix factor from INS-1 cells; M-phase phosphoprotein 2; MPM-2 reactive phosphoprotein 2; Transcription factor Trident), referred to herein as the previously known protein.

Protein Forkhead box protein M1 is known or believed to have the following function(s): Transcriptional activatory factor. May play a role in the control of cell proliferation. The sequence for protein Forkhead box protein M1 is given at the end of the application, as "Forkhead box protein M1 amino acid sequence". Known polymorphisms for this sequence are as shown in Table 996.

TABLE 996

Amino acid mutations for Known Protein

| SNP position(s) on amino acid sequence | Comment |
|---|---|
| 3 | T -> A |
| 643 | S -> P |

Protein Forkhead box protein M1 localization is believed to be Nuclear.

The following GO Annotation(s) apply to the previously known protein. The following annotation(s) were found: transcription regulation; transcription, from Pol II promoter; oxidative stress response, which are annotation(s) related to Biological Process; transcription factor; RNA polymerase II transcription factor, which are annotation(s) related to Molecular Function; and nucleus, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMMPP2X can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 27 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 27 and Table 997. This cluster is overexpressed (at least at a minimum level) in the following pathological conditions: brain malignant tumors, epithelial malignant tumors, a mixture of malignant tumors from different tissues, myosarcoma, skin malignancies and uterine malignancies.

TABLE 997

Normal tissue distribution

| Name of Tissue | Number |
| --- | --- |
| Adrenal | 0 |
| Bladder | 0 |
| Bone | 0 |
| Brain | 0 |
| Colon | 6 |
| Epithelial | 6 |
| General | 4 |
| Head and neck | 0 |
| Kidney | 2 |
| Liver | 0 |
| Lung | 32 |
| lymph nodes | 26 |
| Breast | 0 |
| Muscle | 0 |
| Ovary | 0 |
| Pancreas | 0 |
| Prostate | 0 |
| Skin | 5 |
| Stomach | 0 |
| Uterus | 0 |

TABLE 998

P values and ratios for expression in cancerous tissue

| Name of Tissue | P1 | P2 | SP1 | R3 | SP2 | R4 |
| --- | --- | --- | --- | --- | --- | --- |
| Adrenal | 1 | 4.6e−01 | 1 | 1.0 | 2.9e−01 | 2.7 |
| Bladder | 5.4e−01 | 3.4e−01 | 5.6e−01 | 1.8 | 3.2e−01 | 2.4 |
| Bone | 9.1e−02 | 1.7e−01 | 4.0e−01 | 2.8 | 4.9e−01 | 2.0 |
| Brain | 7.8e−02 | 9.8e−04 | 5.2e−06 | 12.7 | 1.8e−08 | 21.3 |
| Colon | 2.5e−01 | 1.7e−01 | 7.0e−01 | 1.5 | 1.6e−01 | 2.0 |
| Epithelial | 1.4e−05 | 1.0e−09 | 3.8e−04 | 3.9 | 9.6e−18 | 11.1 |
| General | 6.2e−11 | 9.1e−21 | 2.7e−11 | 6.7 | 5.1e−50 | 18.1 |
| head and neck | 4.0e−02 | 4.5e−02 | 4.6e−01 | 2.3 | 4.2e−01 | 2.0 |
| Kidney | 8.6e−01 | 8.0e−01 | 5.8e−01 | 1.6 | 8.2e−02 | 2.1 |
| Liver | 1 | 3.1e−01 | 1 | 1.0 | 6.9e−01 | 1.5 |
| Lung | 8.5e−01 | 3.7e−01 | 1 | 0.3 | 4.5e−02 | 1.9 |
| lymph nodes | 8.5e−01 | 7.6e−01 | 1 | 0.4 | 2.6e−06 | 1.9 |
| Breast | 2.1e−01 | 2.9e−02 | 6.9e−01 | 1.5 | 1.7e−01 | 2.8 |
| Muscle | 2.3e−01 | 6.6e−02 | 1 | 2.2 | 1.4e−03 | 4.4 |
| Ovary | 4.0e−01 | 1.7e−01 | 4.7e−01 | 2.0 | 2.4e−02 | 3.8 |
| Pancreas | 9.5e−02 | 2.3e−02 | 3.2e−02 | 5.1 | 2.1e−02 | 5.5 |
| Prostate | 5.4e−01 | 2.7e−01 | 6.7e−01 | 1.5 | 2.4e−01 | 2.5 |
| Skin | 4.0e−01 | 8.7e−02 | 1.4e−01 | 5.0 | 2.4e−05 | 5.1 |
| Stomach | 1.1e−01 | 3.2e−01 | 2.5e−01 | 3.1 | 3.2e−01 | 2.0 |
| Uterus | 2.2e−02 | 5.2e−03 | 2.9e−01 | 2.6 | 2.0e−03 | 5.3 |

As noted above, cluster HUMMPP2X features 29 segment(s), which were listed in Table 994 above and for which the sequence(s) are given at the end of the application. These segment(s) are portions of nucleic acid sequence(s) which are described herein separately because they are of particular interest. A description of each segment according to the present invention is now provided.

Segment cluster HUMMPP2X_node_0 (SEQ ID NO:1048) according to the present invention is supported by 19 libraries. The number of libraries was determined as previously described. This segment can be found in the following transcript(s): HUMMPP2X_T3 (SEQ ID NO:1043) and HUMMPP2X_T16 (SEQ ID NO:1045). Table 999 below describes the starting and ending position of this segment on each transcript.

TABLE 999

Segment location on transcripts

| Transcript name | Segment starting position | Segment ending position |
| --- | --- | --- |
| HUMMPP2X_T3 (SEQ ID NO: 1043) | 1 | 220 |
| HUMMPP2X_T16 (SEQ ID NO: 1045) | 1 | 220 |

This segment can be found in a non-coding region of transcript(s) that are related to the following protein(s): HUMMPP2X_P4 and HUMMPP2X_P13.

Segment cluster HUMMPP2X_node_2 (SEQ ID NO:1049) according to the present invention is supported by 33 libraries. The number of libraries was determined as previously described. This segment can be found in the following transcript(s): HUMMPP2X_T3 (SEQ ID NO:1043) and HUMMPP2X_T16 (SEQ ID NO:1045). Table 1000 below describes the starting and ending position of this segment on each transcript.

TABLE 1000

Segment location on transcripts

| Transcript name | Segment starting position | Segment ending position |
| --- | --- | --- |
| HUMMPP2X_T3 (SEQ ID NO: 1043) | 221 | 769 |
| HUMMPP2X_T16 (SEQ ID NO: 1045) | 221 | 769 |

This segment can be found in both coding and non-coding regions of transcript(s) as follows. The segment can be found in a non-coding region of transcript(s) that are related to the following protein(s): HUMMPP2X_P4. This segment can also be found in the following protein(s): HUMMPP2X_P13, since it is in the coding region for the corresponding transcript.

Segment cluster HUMMPP2X_node_4 (SEQ ID NO:1050) according to the present invention is supported by 34 libraries. The number of libraries was determined as previously described. This segment can be found in the following transcript(s): HUMMPP2X_T3 (SEQ ID NO:1043) and HUMMPP2X_T16 (SEQ ID NO:1045). Table 1001 below describes the starting and ending position of this segment on each transcript.

TABLE 1001

Segment location on transcripts

| Transcript name | Segment starting position | Segment ending position |
| --- | --- | --- |
| HUMMPP2X_T3 (SEQ ID NO: 1043) | 770 | 921 |
| HUMMPP2X_T16 (SEQ ID NO: 1045) | 770 | 921 |

This segment can be found in both coding and non-coding regions of transcript(s) as follows. The segment can be found in a non-coding region of transcript(s) that are related to the following protein(s): HUMMPP2X_P4. This segment can also be found in the following protein(s): HUMMPP2X_P13, since it is in the coding region for the corresponding transcript.

Segment cluster HUMMPP2X_node_7 (SEQ ID NO:1051) according to the present invention is supported by 39 libraries. The number of libraries was determined as previously described. This segment can be found in the following transcript(s): HUMMPP2X_T3 (SEQ ID NO:1043) and HUMMPP2X_T16 (SEQ ID NO:1045). Table 1002 below describes the starting and ending position of this segment on each transcript.

TABLE 1002

Segment location on transcripts

| Transcript name | Segment starting position | Segment ending position |
|---|---|---|
| HUMMPP2X_T3 (SEQ ID NO: 1043) | 922 | 1113 |
| HUMMPP2X_T16 (SEQ ID NO: 1045) | 922 | 1113 |

This segment can be found in both coding and non-coding regions of transcript(s) as follows. The segment can be found in a non-coding region of transcript(s) that are related to the following protein(s): HUMMPP2X_P4. This segment can also be found in the following protein(s): HUMMPP2X_P13, since it is in the coding region for the corresponding transcript.

Segment cluster HUMMPP2X_node_10 (SEQ ID NO:1052) according to the present invention is supported by 3 libraries. The number of libraries was determined as previously described. This segment can be found in the following transcript(s): HUMMPP2X_T23 (SEQ ID NO:1047). Table 1003 below describes the starting and ending position of this segment on each transcript.

TABLE 1003

Segment location on transcripts

| Transcript name | Segment starting position | Segment ending position |
|---|---|---|
| HUMMPP2X_T23 (SEQ ID NO: 1047) | 1 | 257 |

This segment can be found in a non-coding region of transcript(s) that are related to the following protein(s): HUMMPP2X_P17.

Segment cluster HUMMPP2X_node_11 (SEQ ID NO:1053) according to the present invention is supported by 37 libraries. The number of libraries was determined as previously described. This segment can be found in the following transcript(s): HUMMPP2X_T3 (SEQ ID NO:1043), HUMMPP2X_T16 (SEQ ID NO:1045) and HUMMPP2X_T23 (SEQ ID NO:1047). Table 1004 below describes the starting and ending position of this segment on each transcript.

TABLE 1004

Segment location on transcripts

| Transcript name | Segment starting position | Segment ending position |
|---|---|---|
| HUMMPP2X_T3 (SEQ ID NO: 1043) | 1114 | 1242 |
| HUMMPP2X_T16 (SEQ ID NO: 1045) | 1114 | 1242 |
| HUMMPP2X_T23 (SEQ ID NO: 1047) | 258 | 386 |

This segment can be found in both coding and non-coding regions of transcript(s) as follows. The segment can be found in a non-coding region of transcript(s) that are related to the following protein(s): HUMMPP2X_P4. This segment can also be found in the following protein(s): HUMMPP2X_P13 and HUMMPP2X_P17, since it is in the coding region for the corresponding transcript.

Segment cluster HUMMPP2X_node_17 (SEQ ID NO:1054) according to the present invention is supported by 1 libraries. The number of libraries was determined as previously described. This segment can be found in the following transcript(s): HUMMPP2X_T9 (SEQ ID NO:1044). Table 1005 below describes the starting and ending position of this segment on each transcript.

TABLE 1005

Segment location on transcripts

| Transcript name | Segment starting position | Segment ending position |
|---|---|---|
| HUMMPP2X_T9 (SEQ ID NO: 1044) | 1 | 316 |

This segment can be found in a non-coding region of transcript(s) that are related to the following protein(s): HUMMPP2X_P4.

Segment cluster HUMMPP2X_node_19 (SEQ ID NO:1055) according to the present invention is supported by 2 libraries. The number of libraries was determined as previously described. This segment can be found in the following transcript(s): HUMMPP2X_T3 (SEQ ID NO:1043) and HUMMPP2X_T9 (SEQ ID NO:1044). Table 1006 below describes the starting and ending position of this segment on each transcript.

TABLE 1006

Segment location on transcripts

| Transcript name | Segment starting position | Segment ending position |
|---|---|---|
| HUMMPP2X_T3 (SEQ ID NO: 1043) | 1349 | 1480 |
| HUMMPP2X_T9 (SEQ ID NO: 1044) | 378 | 509 |

This segment can be found in a non-coding region of transcript(s) that are related to the following protein(s): HUMMPP2X_P4.

Segment cluster HUMMPP2X_node_21 (SEQ ID NO:1056) according to the present invention is supported by 1 libraries. The number of libraries was determined as previously described. This segment can be found in the following transcript(s): HUMMPP2X_T3 (SEQ ID NO:1043) and HUMMPP2X_T9 (SEQ ID NO:1044). Table 1007 below describes the starting and ending position of this segment on each transcript.

TABLE 1007

Segment location on transcripts

| Transcript name | Segment starting position | Segment ending position |
|---|---|---|
| HUMMPP2X_T3 (SEQ ID NO: 1043) | 1551 | 1737 |
| HUMMPP2X_T9 (SEQ ID NO: 1044) | 580 | 766 |

This segment can be found in a non-coding region of transcript(s) that are related to the following protein(s): HUMMPP2X_P4.

Segment cluster HUMMPP2X_node_22 (SEQ ID NO:1057) according to the present invention is supported by 41 libraries. The number of libraries was determined as previously described. This segment can be found in the following transcript(s): HUMMPP2X_T3 (SEQ ID NO:1043), HUMMPP2X_T9 (SEQ ID NO:1044), HUMMPP2X_T16 (SEQ ID NO:1045) and HUMMPP2X_T23 (SEQ ID NO:1047). Table 1008 below describes the starting and ending position of this segment on each transcript.

TABLE 1008

Segment location on transcripts

| Transcript name | Segment starting position | Segment ending position |
|---|---|---|
| HUMMPP2X_T3 (SEQ ID NO: 1043) | 1738 | 1913 |
| HUMMPP2X_T9 (SEQ ID NO: 1044) | 767 | 942 |
| HUMMPP2X_T16 (SEQ ID NO: 1045) | 1313 | 1488 |
| HUMMPP2X_T23 (SEQ ID NO: 1047) | 457 | 632 |

This segment can be found in the following protein(s): HUMMPP2X_P4, HUMMPP2X_P13 and HUMMPP2X_P17.

Segment cluster HUMMPP2X_node_23 (SEQ ID NO:1058) according to the present invention is supported by 1 libraries. The number of libraries was determined as previously described. This segment can be found in the following transcript(s): HUMMPP2X_T16 (SEQ ID NO:1045). Table 1009 below describes the starting and ending position of this segment on each transcript.

TABLE 1009

Segment location on transcripts

| Transcript name | Segment starting position | Segment ending position |
|---|---|---|
| HUMMPP2X_T16 (SEQ ID NO: 1045) | 1489 | 2059 |

This segment can be found in the following protein(s): HUMMPP2X_P13.

Segment cluster HUMMPP2X_node_28 (SEQ ID NO:1059) according to the present invention is supported by 2 libraries. The number of libraries was determined as previously described. This segment can be found in the following transcript(s): HUMMPP2X_T22 (SEQ ID NO:1046). Table 1010 below describes the starting and ending position of this segment on each transcript.

TABLE 1010

Segment location on transcripts

| Transcript name | Segment starting position | Segment ending position |
|---|---|---|
| HUMMPP2X_T22 (SEQ ID NO: 1046) | 1 | 587 |

The previously-described transcripts for these segment(s) do not code for protein.

Segment cluster HUMMPP2X_node_29 (SEQ ID NO:1060) according to the present invention is supported by 3 libraries. The number of libraries was determined as previously described. This segment can be found in the following transcript(s): HUMMPP2X_T22 (SEQ ID NO:1046) and HUMMPP2X_T23 (SEQ ID NO:1047). Table 1011 below describes the starting and ending position of this segment on each transcript.

TABLE 1011

Segment location on transcripts

| Transcript name | Segment starting position | Segment ending position |
|---|---|---|
| HUMMPP2X_T22 (SEQ ID NO: 1046) | 588 | 721 |
| HUMMPP2X_T23 (SEQ ID NO: 1047) | 633 | 766 |

This segment can be found in the following protein(s): HUMMPP2X_P17.

Segment cluster HUMMPP2X_node_32 (SEQ ID NO:1061) according to the present invention is supported by 56 libraries. The number of libraries was determined as previously described. This segment can be found in the following transcript(s): HUMMPP2X_T3 (SEQ ID NO:1043) and HUMMPP2X_T9 (SEQ ID NO:1044). Table 1012 below describes the starting and ending position of this segment on each transcript.

TABLE 1012

Segment location on transcripts

| Transcript name | Segment starting position | Segment ending position |
|---|---|---|
| HUMMPP2X_T3 (SEQ ID NO: 1043) | 1914 | 2081 |
| HUMMPP2X_T9 (SEQ ID NO: 1044) | 943 | 1110 |

This segment can be found in the following protein(s): HUMMPP2X_P4.

Segment cluster HUMMPP2X_node_34 (SEQ ID NO:1062) according to the present invention is supported by 73 libraries. The number of libraries was determined as previously described. This segment can be found in the following transcript(s): HUMMPP2X_T3 (SEQ ID NO:1043) and HUMMPP2X_T9 (SEQ ID NO:1044). Table 1013 below describes the starting and ending position of this segment on each transcript.

TABLE 1013

Segment location on transcripts

| Transcript name | Segment starting position | Segment ending position |
|---|---|---|
| HUMMPP2X_T3 (SEQ ID NO: 1043) | 2134 | 2671 |
| HUMMPP2X_T9 (SEQ ID NO: 1044) | 1163 | 1700 |

This segment can be found in the following protein(s): HUMMPP2X_P4.

Segment cluster HUMMPP2X_node_35 (SEQ ID NO:1063) according to the present invention is supported by 63 libraries. The number of libraries was determined as previously described. This segment can be found in the following transcript(s): HUMMPP2X_T3 (SEQ ID NO:1043) and HUMMPP2X_T9 (SEQ ID NO:1044). Table 1014 below describes the starting and ending position of this segment on each transcript.

TABLE 1014

Segment location on transcripts

| Transcript name | Segment starting position | Segment ending position |
|---|---|---|
| HUMMPP2X_T3 (SEQ ID NO: 1043) | 2672 | 2955 |
| HUMMPP2X_T9 (SEQ ID NO: 1044) | 1701 | 1984 |

This segment can be found in the following protein(s): HUMMPP2X_P4.

Segment cluster HUMMPP2X_node_40 (SEQ ID NO:1064) according to the present invention is supported by 99 libraries. The number of libraries was determined as previously described. This segment can be found in the following transcript(s): HUMMPP2X_T3 (SEQ ID NO:1043) and HUMMPP2X_T9 (SEQ ID NO:1044). Table 1015 below describes the starting and ending position of this segment on each transcript.

TABLE 1015

Segment location on transcripts

| Transcript name | Segment starting position | Segment ending position |
|---|---|---|
| HUMMPP2X_T3 (SEQ ID NO: 1043) | 3094 | 3555 |
| HUMMPP2X_T9 (SEQ ID NO: 1044) | 2123 | 2584 |

This segment can be found in a non-coding region of transcript(s) that are related to the following protein(s): HUMMPP2X_P4.

Segment cluster HUMMPP2X_node_43 (SEQ ID NO:1065) according to the present invention is supported by 81 libraries. The number of libraries was determined as previously described. This segment can be found in the following transcript(s): HUMMPP2X_T3 (SEQ ID NO:1043) and HUMMPP2X_T9 (SEQ ID NO:1044). Table 1016 below describes the starting and ending position of this segment on each transcript.

TABLE 1016

Segment location on transcripts

| Transcript name | Segment starting position | Segment ending position |
|---|---|---|
| HUMMPP2X_T3 (SEQ ID NO: 1043) | 3668 | 3831 |
| HUMMPP2X_T9 (SEQ ID NO: 1044) | 2697 | 2860 |

This segment can be found in a non-coding region of transcript(s) that are related to the following protein(s): HUMMPP2X_P4.

According to an optional embodiment of the present invention, short segments related to the above cluster are also provided. These segments are up to about 120 bp in length, and so are included in a separate description.

Segment cluster HUMMPP2X_node_14 (SEQ ID NO:1066) according to the present invention is supported by 18 libraries. The number of libraries was determined as previously described. This segment can be found in the following transcript(s): HUMMPP2X_T3 (SEQ ID NO:1043). Table 1017 below describes the starting and ending position of this segment on each transcript.

TABLE 1017

Segment location on transcripts

| Transcript name | Segment starting position | Segment ending position |
|---|---|---|
| HUMMPP2X_T3 (SEQ ID NO: 1043) | 1243 | 1287 |

This segment can be found in a non-coding region of transcript(s) that are related to the following protein(s): HUMMPP2X_P4.

Segment cluster HUMMPP2X_node_18 (SEQ ID NO:1067) according to the present invention is supported by 2 libraries. The number of libraries was determined as previously described. This segment can be found in the following transcript(s): HUMMPP2X_T3 (SEQ ID NO:1043) and HUMMPP2X_T9 (SEQ ID NO:1044). Table 1018 below describes the starting and ending position of this segment on each transcript.

TABLE 1018

Segment location on transcripts

| Transcript name | Segment starting position | Segment ending position |
|---|---|---|
| HUMMPP2X_T3 (SEQ ID NO: 1043) | 1288 | 1348 |
| HUMMPP2X_T9 (SEQ ID NO: 1044) | 317 | 377 |

This segment can be found in a non-coding region of transcript(s) that are related to the following protein(s): HUMMPP2X_P4.

Segment cluster HUMMPP2X_node_20 (SEQ ID NO:1068) according to the present invention is supported by 39 libraries. The number of libraries was determined as previously described. This segment can be found in the following transcript(s): HUMMPP2X_T3 (SEQ ID NO:1043), HUMMPP2X_T9 (SEQ ID NO:1044), HUMMPP2X_T16 (SEQ ID NO:1045) and HUMMPP2X_T23 (SEQ ID NO:1047). Table 1019 below describes the starting and ending position of this segment on each transcript.

TABLE 1019

Segment location on transcripts

| Transcript name | Segment starting position | Segment ending position |
|---|---|---|
| HUMMPP2X_T3 (SEQ ID NO: 1043) | 1481 | 1550 |
| HUMMPP2X_T9 (SEQ ID NO: 1044) | 510 | 579 |
| HUMMPP2X_T16 (SEQ ID NO: 1045) | 1243 | 1312 |
| HUMMPP2X_T23 (SEQ ID NO: 1047) | 387 | 456 |

This segment can be found in both coding and non-coding regions of transcript(s) as follows. The segment can be found in a non-coding region of transcript(s) that are related to the following protein(s): HUMMPP2X_P4. This segment can also be found in the following protein(s): HUMMPP2X_P13 and HUMMPP2X_P17, since it is in the coding region for the corresponding transcript.

Segment cluster HUMMPP2X_node_33 (SEQ ID NO:1069) according to the present invention is supported by 54 libraries. The number of libraries was determined as previously described. This segment can be found in the following transcript(s): HUMMPP2X_T3 (SEQ ID NO:1043) and HUMMPP2X_T9 (SEQ ID NO:1044). Table 1020 below describes the starting and ending position of this segment on each transcript.

TABLE 1020

Segment location on transcripts

| Transcript name | Segment starting position | Segment ending position |
|---|---|---|
| HUMMPP2X_T3 (SEQ ID NO: 1043) | 2082 | 2133 |
| HUMMPP2X_T9 (SEQ ID NO: 1044) | 1111 | 1162 |

This segment can be found in the following protein(s): HUMMPP2X_P4.

Segment cluster HUMMPP2X_node_36 (SEQ ID NO:1070) according to the present invention is supported by 42 libraries. The number of libraries was determined as previously described. This segment can be found in the following transcript(s): HUMMPP2X_T3 (SEQ ID NO:1043) and HUMMPP2X_T9 (SEQ ID NO:1044). Table 1021 below describes the starting and ending position of this segment on each transcript.

TABLE 1021

Segment location on transcripts

| Transcript name | Segment starting position | Segment ending position |
|---|---|---|
| HUMMPP2X_T3 (SEQ ID NO: 1043) | 2956 | 2992 |
| HUMMPP2X_T9 (SEQ ID NO: 1044) | 1985 | 2021 |

This segment can be found in a non-coding region of transcript(s) that are related to the following protein(s): HUMMPP2X_P4.

Segment cluster HUMMPP2X_node_37 (SEQ ID NO:1071) according to the present invention is supported by 51 libraries. The number of libraries was determined as previously described. This segment can be found in the following transcript(s): HUMMPP2X_T3 (SEQ ID NO:1043) and HUMMPP2X_T9 (SEQ ID NO:1044). Table 1022 below describes the starting and ending position of this segment on each transcript.

TABLE 1022

Segment location on transcripts

| Transcript name | Segment starting position | Segment ending position |
|---|---|---|
| HUMMPP2X_T3 (SEQ ID NO: 1043) | 2993 | 3079 |
| HUMMPP2X_T9 (SEQ ID NO: 1044) | 2022 | 2108 |

This segment can be found in a non-coding region of transcript(s) that are related to the following protein(s): HUMMPP2X_P4.

Segment cluster HUMMPP2X_node_38 (SEQ ID NO:1072) according to the present invention can be found in the following transcript(s): HUMMPP2X_T3 (SEQ ID NO:1043) and HUMMPP2X_T9 (SEQ ID NO:1044). Table 1023 below describes the starting and ending position of this segment on each transcript.

TABLE 1023

Segment location on transcripts

| Transcript name | Segment starting position | Segment ending position |
|---|---|---|
| HUMMPP2X_T3 (SEQ ID NO: 1043) | 3080 | 3085 |
| HUMMPP2X_T9 (SEQ ID NO: 1044) | 2109 | 2114 |

This segment can be found in a non-coding region of transcript(s) that are related to the following protein(s): HUMMPP2X_P4.

Segment cluster HUMMPP2X_node_39 (SEQ ID NO:1073) according to the present invention can be found in the following transcript(s): HUMMPP2X_T3 (SEQ ID NO:1043) and HUMMPP2X_T9 (SEQ ID NO:1044). Table 1024 below describes the starting and ending position of this segment on each transcript.

TABLE 1024

Segment location on transcripts

| Transcript name | Segment starting position | Segment ending position |
|---|---|---|
| HUMMPP2X_T3 (SEQ ID NO: 1043) | 3086 | 3093 |
| HUMMPP2X_T9 (SEQ ID NO: 1044) | 2115 | 2122 |

This segment can be found in a non-coding region of transcript(s) that are related to the following protein(s): HUMMPP2X_P4.

Segment cluster HUMMPP2X_node_41 (SEQ ID NO:1074) according to the present invention is supported by 86 libraries. The number of libraries was determined as previously described. This segment can be found in the following transcript(s): HUMMPP2X_T3 (SEQ ID NO:1043) and HUMMPP2X_T9 (SEQ ID NO:1044). Table 1025 below describes the starting and ending position of this segment on each transcript.

TABLE 1025

Segment location on transcripts

| Transcript name | Segment starting position | Segment ending position |
|---|---|---|
| HUMMPP2X_T3 (SEQ ID NO: 1043) | 3556 | 3644 |
| HUMMPP2X_T9 (SEQ ID NO: 1044) | 2585 | 2673 |

This segment can be found in a non-coding region of transcript(s) that are related to the following protein(s): HUMMPP2X_P4.

Segment cluster HUMMPP2X_node_42 (SEQ ID NO:1075) according to the present invention can be found in the following transcript(s): HUMMPP2X_T3 (SEQ ID NO:1043) and HUMMPP2X_T9 (SEQ ID NO:1044). Table 1026 below describes the starting and ending position of this segment on each transcript.

TABLE 1026

Segment location on transcripts

| Transcript name | Segment starting position | Segment ending position |
|---|---|---|
| HUMMPP2X_T3 (SEQ ID NO: 1043) | 3645 | 3667 |
| HUMMPP2X_T9 (SEQ ID NO: 1044) | 2674 | 2696 |

This segment can be found in a non-coding region of transcript(s) that are related to the following protein(s): HUMMPP2X_P4.

Segment cluster HUMMPP2X_node_44 (SEQ ID NO:1076) according to the present invention is supported by 72 libraries. The number of libraries was determined as previously described. This segment can be found in the following transcript(s): HUMMPP2X_T3 (SEQ ID NO:1043) and HUMMPP2X_T9 (SEQ ID NO:1044). Table 1027 below describes the starting and ending position of this segment on each transcript.

TABLE 1027

Segment location on transcripts

| Transcript name | Segment starting position | Segment ending position |
|---|---|---|
| HUMMPP2X_T3 (SEQ ID NO: 1043) | 3832 | 3897 |
| HUMMPP2X_T9 (SEQ ID NO: 1044) | 2861 | 2926 |

This segment can be found in a non-coding region of transcript(s) that are related to the following protein(s): HUMMPP2X_P4.

Description for Cluster HUMPFK

Cluster HUMPFK features 20 transcript(s) and 58 segment(s) of interest, the names for which are given in Tables 1028 and 1029, respectively, the sequences themselves are given at the end of the application. The selected protein variants are given in Table 1030.

TABLE 1028

Transcripts of interest
Transcript Name

HUMPFK_T1 (SEQ ID NO: 1077)
HUMPFK_T2 (SEQ ID NO: 1078)
HUMPFK_T4 (SEQ ID NO: 1079)
HUMPFK_T5 (SEQ ID NO: 1080)
HUMPFK_T6 (SEQ ID NO: 1081)
HUMPFK_T7 (SEQ ID NO: 1082)
HUMPFK_T8 (SEQ ID NO: 1083)
HUMPFK_T11 (SEQ ID NO: 1084)
HUMPFK_T12 (SEQ ID NO: 1085)
HUMPFK_T13 (SEQ ID NO: 1086)
HUMPFK_T14 (SEQ ID NO: 1087)
HUMPFK_T15 (SEQ ID NO: 1088)
HUMPFK_T16 (SEQ ID NO: 1089)
HUMPFK_T18 (SEQ ID NO: 1090)
HUMPFK_T26 (SEQ ID NO: 1091)
HUMPFK_T27 (SEQ ID NO: 1092)
HUMPFK_T30 (SEQ ID NO: 1093)
HUMPFK_T45 (SEQ ID NO: 1094)
HUMPFK_T49 (SEQ ID NO: 1095)
HUMPFK_T50 (SEQ ID NO: 1096)

TABLE 1029

Segments of interest
Segment Name

HUMPFK_node_0 (SEQ ID NO: 1097)
HUMPFK_node_5 (SEQ ID NO: 1098)
HUMPFK_node_14 (SEQ ID NO: 1099)
HUMPFK_node_17 (SEQ ID NO: 1100)
HUMPFK_node_19 (SEQ ID NO: 1101)
HUMPFK_node_23 (SEQ ID NO: 1102)
HUMPFK_node_25 (SEQ ID NO: 1103)
HUMPFK_node_26 (SEQ ID NO: 1104)
HUMPFK_node_27 (SEQ ID NO: 1105)
HUMPFK_node_29 (SEQ ID NO: 1106)
HUMPFK_node_38 (SEQ ID NO: 1107)
HUMPFK_node_44 (SEQ ID NO: 1108)
HUMPFK_node_48 (SEQ ID NO: 1109)
HUMPFK_node_49 (SEQ ID NO: 1110)
HUMPFK_node_54 (SEQ ID NO: 1111)
HUMPFK_node_57 (SEQ ID NO: 1112)
HUMPFK_node_58 (SEQ ID NO: 1113)
HUMPFK_node_59 (SEQ ID NO: 1114)
HUMPFK_node_60 (SEQ ID NO: 1115)
HUMPFK_node_61 (SEQ ID NO: 1116)
HUMPFK_node_62 (SEQ ID NO: 1117)
HUMPFK_node_63 (SEQ ID NO: 1118)
HUMPFK_node_64 (SEQ ID NO: 1119)
HUMPFK_node_65 (SEQ ID NO: 1120)
HUMPFK_node_83 (SEQ ID NO: 1121)
HUMPFK_node_91 (SEQ ID NO: 1122)
HUMPFK_node_93 (SEQ ID NO: 1123)
HUMPFK_node_99 (SEQ ID NO: 1124)
HUMPFK_node_102 (SEQ ID NO: 1125)
HUMPFK_node_104 (SEQ ID NO: 1126)
HUMPFK_node_3 (SEQ ID NO: 1127)
HUMPFK_node_6 (SEQ ID NO: 1128)
HUMPFK_node_12 (SEQ ID NO: 1129)
HUMPFK_node_16 (SEQ ID NO: 1130)
HUMPFK_node_21 (SEQ ID NO: 1131)
HUMPFK_node_28 (SEQ ID NO: 1132)
HUMPFK_node_31 (SEQ ID NO: 1133)
HUMPFK_node_33 (SEQ ID NO: 1134)
HUMPFK_node_34 (SEQ ID NO: 1135)
HUMPFK_node_36 (SEQ ID NO: 1136)
HUMPFK_node_40 (SEQ ID NO: 1137)
HUMPFK_node_42 (SEQ ID NO: 1138)
HUMPFK_node_47 (SEQ ID NO: 1139)
HUMPFK_node_50 (SEQ ID NO: 1140)
HUMPFK_node_51 (SEQ ID NO: 1141)
HUMPFK_node_53 (SEQ ID NO: 1142)
HUMPFK_node_67 (SEQ ID NO: 1143)
HUMPFK_node_69 (SEQ ID NO: 1144)
HUMPFK_node_73 (SEQ ID NO: 1145)
HUMPFK_node_74 (SEQ ID NO: 1146)
HUMPFK_node_78 (SEQ ID NO: 1147)
HUMPFK_node_79 (SEQ ID NO: 1148)
HUMPFK_node_81 (SEQ ID NO: 1149)
HUMPFK_node_82 (SEQ ID NO: 1150)
HUMPFK_node_87 (SEQ ID NO: 1151)
HUMPFK_node_89 (SEQ ID NO: 1152)
HUMPFK_node_101 (SEQ ID NO: 1153)
HUMPFK_node_103 (SEQ ID NO: 1154)

TABLE 1030

Proteins of interest

| Protein Name | Corresponding Transcript(s) |
|---|---|
| HUMPFK_P2 | HUMPFK_T1 (SEQ ID NO: 1077); |
|  | HUMPFK_T6 (SEQ ID NO: 1081); |
|  | HUMPFK_T11 (SEQ ID NO: 1084); |
|  | HUMPFK_T14 (SEQ ID NO: 1087) |
| HUMPFK_P3 | HUMPFK_T2 (SEQ ID NO: 1078) |
| HUMPFK_P4 | HUMPFK_T4 (SEQ ID NO: 1079) |
| HUMPFK_P5 | HUMPFK_T5 (SEQ ID NO: 1080) |
| HUMPFK_P6 | HUMPFK_T7 (SEQ ID NO: 1082); |

TABLE 1030-continued

Proteins of interest

| Protein Name | Corresponding Transcript(s) |
|---|---|
| | HUMPFK_T13 (SEQ ID NO: 1086) |
| HUMPFK_P7 | HUMPFK_T8 (SEQ ID NO: 1083) |
| HUMPFK_P8 | HUMPFK_T12 (SEQ ID NO: 1085); HUMPFK_T18 (SEQ ID NO: 1090) |
| HUMPFK_P9 | HUMPFK_T15 (SEQ ID NO: 1088) |
| HUMPFK_P10 | HUMPFK_T16 (SEQ ID NO: 1089); HUMPFK_T26 (SEQ ID NO: 1091) |
| HUMPFK_P13 | HUMPFK_T27 (SEQ ID NO: 1092); HUMPFK_T30 (SEQ ID NO: 1093) |
| HUMPFK_P25 | HUMPFK_T49 (SEQ ID NO: 1095) |
| HUMPFK_P26 | HUMPFK_T50 (SEQ ID NO: 1096) |

These sequences are variants of the known protein 6-phosphofructokinase, type C (SwissProt accession identifier K6PP_HUMAN; known also according to the synonyms EC 2.7.1.11; Phosphofructokinase 1; Phosphohexokinase; Phosphofructo-1-kinase isozyme C; PFK-C; 6-phosphofructokinase, platelet type), referred to herein as the previously known protein.

The sequence for protein 6-phosphofructokinase, type C is given at the end of the application, as "6-phosphofructokinase, type C amino acid sequence". Known polymorphisms for this sequence are as shown in Table 1031.

TABLE 1031

Amino acid mutations for Known Protein

| SNP position(s) on amino acid sequence | Comment |
|---|---|
| 484-485 | PG -> IP |
| 498 | Missing |
| 699 | A -> E |

The following GO Annotation(s) apply to the previously known protein. The following annotation(s) were found: glycolysis, which are annotation(s) related to Biological Process; magnesium binding; 6-phosphofructokinase; kinase; transferase, which are annotation(s) related to Molecular Function; and cytoplasm; 6-phosphofructokinase, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMPFK can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 28 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 28 and Table 1032. This cluster is overexpressed (at least at a minimum level) in the following pathological conditions: epithelial malignant tumors, a mixture of malignant tumors from different tissues and myosarcoma.

TABLE 1032

Normal tissue distribution

| Name of Tissue | Number |
|---|---|
| adrenal | 0 |
| bladder | 164 |
| Bone | 200 |
| Brain | 285 |
| Colon | 107 |
| epithelial | 84 |
| general | 144 |
| head and neck | 0 |
| kidney | 89 |
| Liver | 0 |
| Lung | 62 |
| Lymph nodes | 69 |
| Breast | 26 |
| bone marrow | 62 |
| muscle | 25 |
| Ovary | 36 |
| pancreas | 51 |
| prostate | 82 |
| Skin | 56 |
| stomach | 146 |
| T cells | 1115 |
| Thyroid | 128 |
| Uterus | 127 |

TABLE 1033

P values and ratios for expression in cancerous tissue

| Name of Tissue | P1 | P2 | SP1 | R3 | SP2 | R4 |
|---|---|---|---|---|---|---|
| adrenal | 4.2e-01 | 4.6e-01 | 4.4e-02 | 3.4 | 8.2e-02 | 2.7 |
| bladder | 7.1e-01 | 7.6e-01 | 8.7e-01 | 0.7 | 9.6e-01 | 0.5 |
| Bone | 1.4e-01 | 4.1e-01 | 1.6e-01 | 1.2 | 5.6e-01 | 0.9 |
| Brain | 5.7e-01 | 4.2e-01 | 7.2e-01 | 0.8 | 9.1e-01 | 0.7 |
| Colon | 6.7e-01 | 5.0e-01 | 3.5e-01 | 1.3 | 1.7e-01 | 1.4 |
| epithelial | 1.3e-01 | 8.8e-03 | 1.2e-02 | 1.4 | 1.4e-07 | 1.9 |
| general | 1.5e-01 | 8.6e-03 | 4.3e-01 | 1.0 | 5.6e-03 | 1.2 |
| head and neck | 1.2e-01 | 1.1e-01 | 1 | 1.1 | 2.4e-01 | 1.7 |
| kidney | 3.6e-01 | 3.5e-01 | 3.6e-02 | 1.7 | 3.9e-04 | 2.2 |
| Liver | 1 | 8.2e-02 | 1 | 1.0 | 5.3e-02 | 2.2 |
| Lung | 1.5e-01 | 4.2e-02 | 1.1e-01 | 1.8 | 6.1e-03 | 2.3 |
| Lymph nodes | 2.9e-01 | 2.2e-01 | 1.1e-01 | 2.5 | 4.5e-02 | 2.1 |
| Breast | 6.2e-01 | 3.0e-01 | 1.5e-01 | 1.6 | 2.4e-02 | 2.7 |
| bone marrow | 6.9e-01 | 7.5e-01 | 3.8e-01 | 2.2 | 4.1e-01 | 1.5 |
| muscle | 5.2e-01 | 2.9e-01 | 2.1e-03 | 5.2 | 3.7e-02 | 2.4 |
| Ovary | 6.7e-01 | 4.1e-01 | 7.6e-01 | 1.0 | 2.3e-01 | 1.4 |
| pancreas | 1.4e-01 | 3.3e-02 | 1.0e-02 | 2.0 | 1.2e-03 | 2.9 |
| prostate | 8.6e-01 | 7.3e-01 | 8.0e-01 | 0.6 | 6.3e-01 | 0.9 |
| Skin | 6.3e-01 | 3.5e-01 | 2.1e-01 | 2.5 | 1.6e-03 | 2.2 |
| stomach | 4.9e-01 | 8.2e-01 | 9.7e-01 | 0.4 | 8.3e-01 | 0.6 |
| T cells | 5.0e-01 | 6.7e-01 | 1 | 0.2 | 1 | 0.3 |
| Thyroid | 4.2e-01 | 4.2e-01 | 8.9e-01 | 0.8 | 8.9e-01 | 0.8 |
| Uterus | 4.5e-01 | 2.7e-01 | 3.4e-01 | 0.9 | 3.6e-01 | 1.0 |

As noted above, cluster HUMPFK features 58 segment(s), which were listed in Table 1029 above and for which the sequence(s) are given at the end of the application. These segment(s) are portions of nucleic acid sequence(s) which are described herein separately because they are of particular interest. A description of each segment according to the present invention is now provided.

Segment cluster HUMPFK_node_0 (SEQ ID NO:1097) according to the present invention is supported by 48 libraries. The number of libraries was determined as previously described. This segment can be found in the following transcript(s): HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092), HUMPFK_T30 (SEQ ID NO:1093), HUMPFK_T49 (SEQ ID NO:1095) and HUMPFK_T50 (SEQ ID NO:1096). Table 1034 below describes the starting and ending position of this segment on each transcript.

TABLE 1034

Segment location on transcripts

| Transcript name | Segment starting position | Segment ending position |
| --- | --- | --- |
| HUMPFK_T7 (SEQ ID NO: 1082) | 1 | 217 |
| HUMPFK_T8 (SEQ ID NO: 1083) | 1 | 217 |
| HUMPFK_T12 (SEQ ID NO: 1085) | 1 | 217 |
| HUMPFK_T13 (SEQ ID NO: 1086) | 1 | 217 |
| HUMPFK_T15 (SEQ ID NO: 1088) | 1 | 217 |
| HUMPFK_T16 (SEQ ID NO: 1089) | 1 | 217 |
| HUMPFK_T18 (SEQ ID NO: 1090) | 1 | 217 |
| HUMPFK_T26 (SEQ ID NO: 1091) | 1 | 217 |
| HUMPFK_T27 (SEQ ID NO: 1092) | 1 | 217 |
| HUMPFK_T30 (SEQ ID NO: 1093) | 1 | 217 |
| HUMPFK_T49 (SEQ ID NO: 1095) | 1 | 217 |
| HUMPFK_T50 (SEQ ID NO: 1096) | 1 | 217 |

This segment can be found in both coding and non-coding regions of transcript(s) as follows. The segment can be found in a non-coding region of transcript(s) that are related to the following protein(s): HUMPFK_P8 and HUMPFK_P9. This segment can also be found in the following protein(s): HUMPFK_P6, HUMPFK_P7, HUMPFK_P10, HUMPFK_P13, HUMPFK_P25 and HUMPFK_P26, since it is in the coding region for the corresponding transcript.

Segment cluster HUMPFK_node_5 (SEQ ID NO:1098) according to the present invention is supported by 7 libraries. The number of libraries was determined as previously described. This segment can be found in the following transcript(s): HUMPFK_T2 (SEQ ID NO:1078). Table 1035 below describes the starting and ending position of this segment on each transcript.

TABLE 1035

Segment location on transcripts

| Transcript name | Segment starting position | Segment ending position |
| --- | --- | --- |
| HUMPFK_T2 (SEQ ID NO: 1078) | 1 | 276 |

This segment can be found in a non-coding region of transcript(s) that are related to the following protein(s): HUMPFK_P3.

Segment cluster HUMPFK_node_14 (SEQ ID NO:1099) according to the present invention is supported by 1 libraries. The number of libraries was determined as previously described. This segment can be found in the following transcript(s): HUMPFK_T4 (SEQ ID NO:1079). Table 1036 below describes the starting and ending position of this segment on each transcript.

TABLE 1036

Segment location on transcripts

| Transcript name | Segment starting position | Segment ending position |
| --- | --- | --- |
| HUMPFK_T4 (SEQ ID NO: 1079) | 1 | 203 |

This segment can be found in the following protein(s): HUMPFK_P4.

Segment cluster HUMPFK_node_17 (SEQ ID NO:1100) according to the present invention is supported by 2 libraries. The number of libraries was determined as previously described. This segment can be found in the following transcript(s): HUMPFK_T49 (SEQ ID NO:1095). Table 1037 below describes the starting and ending position of this segment on each transcript.

TABLE 1037

Segment location on transcripts

| Transcript name | Segment starting position | Segment ending position |
| --- | --- | --- |
| HUMPFK_T49 (SEQ ID NO: 1095) | 370 | 572 |

This segment can be found in the following protein(s): HUMPFK_P25.

Segment cluster HUMPFK_node_19 (SEQ ID NO:1101) according to the present invention is supported by 1 libraries. The number of libraries was determined as previously described. This segment can be found in the following transcript(s): HUMPFK_T50 (SEQ ID NO:1096). Table 1038 below describes the starting and ending position of this segment on each transcript.

TABLE 1038

Segment location on transcripts

| Transcript name | Segment starting position | Segment ending position |
| --- | --- | --- |
| HUMPFK_T50 (SEQ ID NO: 1096) | 370 | 490 |

This segment can be found in the following protein(s): HUMPFK_P26.

Segment cluster HUMPFK_node_23 (SEQ ID NO:1102) according to the present invention is supported by 76 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1039 below describes the starting and ending position of this segment on each transcript.

TABLE 1039

Segment location on transcripts

| Transcript name | Segment starting position | Segment ending position |
|---|---|---|
| HUMPFK_T2 (SEQ ID NO: 1078) | 545 | 734 |
| HUMPFK_T4 (SEQ ID NO: 1079) | 282 | 471 |
| HUMPFK_T5 (SEQ ID NO: 1080) | 465 | 654 |
| HUMPFK_T7 (SEQ ID NO: 1082) | 370 | 559 |
| HUMPFK_T8 (SEQ ID NO: 1083) | 370 | 559 |
| HUMPFK_T12 (SEQ ID NO: 1085) | 370 | 559 |
| HUMPFK_T13 (SEQ ID NO: 1086) | 370 | 559 |
| HUMPFK_T15 (SEQ ID NO: 1088) | 370 | 559 |
| HUMPFK_T16 (SEQ ID NO: 1089) | 370 | 559 |
| HUMPFK_T18 (SEQ ID NO: 1090) | 370 | 559 |
| HUMPFK_T26 (SEQ ID NO: 1091) | 370 | 559 |
| HUMPFK_T27 (SEQ ID NO: 1092) | 370 | 559 |
| HUMPFK_T30 (SEQ ID NO: 1093) | 370 | 559 |

This segment can be found in both coding and non-coding regions of transcript(s) as follows. The segment can be found in a non-coding region of transcript(s) that are related to the following protein(s): HUMPFK_P8 and HUMPFK_P9. This segment can also be found in the following protein(s): HUMPFK_P3, HUMPFK_P4, HUMPFK_P5, HUMPFK_P6, HUMPFK_P7, HUMPFK_P10 and HUMPFK_P13, since it is in the coding region for the corresponding transcript.

Segment cluster HUMPFK_node__25 (SEQ ID NO:1103) according to the present invention is supported by 90 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1040 below describes the starting and ending position of this segment on each transcript.

TABLE 1040

Segment location on transcripts

| Transcript name | Segment starting position | Segment ending position |
|---|---|---|
| HUMPFK_T2 (SEQ ID NO: 1078) | 735 | 900 |
| HUMPFK_T4 (SEQ ID NO: 1079) | 472 | 637 |
| HUMPFK_T5 (SEQ ID NO: 1080) | 655 | 820 |
| HUMPFK_T7 (SEQ ID NO: 1082) | 560 | 725 |
| HUMPFK_T8 (SEQ ID NO: 1083) | 560 | 725 |
| HUMPFK_T12 (SEQ ID NO: 1085) | 560 | 725 |
| HUMPFK_T13 (SEQ ID NO: 1086) | 560 | 725 |
| HUMPFK_T15 (SEQ ID NO: 1088) | 560 | 725 |
| HUMPFK_T16 (SEQ ID NO: 1089) | 560 | 725 |
| HUMPFK_T18 (SEQ ID NO: 1090) | 560 | 725 |
| HUMPFK_T26 (SEQ ID NO: 1091) | 560 | 725 |
| HUMPFK_T27 (SEQ ID NO: 1092) | 560 | 725 |
| HUMPFK_T30 (SEQ ID NO: 1093) | 560 | 725 |

This segment can be found in both coding and non-coding regions of transcript(s) as follows. The segment can be found in a non-coding region of transcript(s) that are related to the following protein(s): HUMPFK_P8 and HUMPFK_P9. This segment can also be found in the following protein(s): HUMPFK_P3, HUMPFK_P4, HUMPFK_P5, HUMPFK_P6, HUMPFK_P7, HUMPFK_P10 and HUMPFK_P13, since it is in the coding region for the corresponding transcript.

Segment cluster HUMPFK_node__26 (SEQ ID NO:1104) according to the present invention is supported by 9 libraries. The number of libraries was determined as previously described. This segment can be found in the following transcript(s): HUMPFK_T12 (SEQ ID NO:1085), HUMPFK_T15 (SEQ ID NO:1088) and HUMPFK_T18 (SEQ ID NO:1090). Table 1041 below describes the starting and ending position of this segment on each transcript.

TABLE 1041

Segment location on transcripts

| Transcript name | Segment starting position | Segment ending position |
|---|---|---|
| HUMPFK_T12 (SEQ ID NO: 1085) | 726 | 1569 |
| HUMPFK_T15 (SEQ ID NO: 1088) | 726 | 1569 |
| HUMPFK_T18 (SEQ ID NO: 1090) | 726 | 1569 |

This segment can be found in a non-coding region of transcript(s) that are related to the following protein(s): HUMPFK_P8 and HUMPFK_P9.

Segment cluster HUMPFK_node__27 (SEQ ID NO:1105) according to the present invention is supported by 19 libraries. The number of libraries was determined as previously described. This segment can be found in the following transcript(s): HUMPFK_T12 (SEQ ID NO:1085) and HUMPFK_T15 (SEQ ID NO:1088). Table 1042 below describes the starting and ending position of this segment on each transcript.

TABLE 1042

Segment location on transcripts

| Transcript name | Segment starting position | Segment ending position |
|---|---|---|
| HUMPFK_T12 (SEQ ID NO: 1085) | 1570 | 1895 |
| HUMPFK_T15 (SEQ ID NO: 1088) | 1570 | 1895 |

This segment can be found in a non-coding region of transcript(s) that are related to the following protein(s): HUMPFK_P8 and HUMPFK_P9.

Segment cluster HUMPFK_node__29 (SEQ ID NO:1106) according to the present invention is supported by 1 libraries. The number of libraries was determined as previously described. This segment can be found in the following transcript(s): HUMPFK_T15 (SEQ ID NO:1088). Table 1043 below describes the starting and ending position of this segment on each transcript.

TABLE 1043

Segment location on transcripts

| Transcript name | Segment starting position | Segment ending position |
|---|---|---|
| HUMPFK_T15 (SEQ ID NO: 1088) | 1941 | 2082 |

This segment can be found in the following protein(s): HUMPFK_P9.

Segment cluster HUMPFK_node__38 (SEQ ID NO:1107) according to the present invention is supported by 102 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1044 below describes the starting and ending position of this segment on each transcript.

TABLE 1044

Segment location on transcripts

| Transcript name | Segment starting position | Segment ending position |
|---|---|---|
| HUMPFK_T2 (SEQ ID NO: 1078) | 1244 | 1369 |
| HUMPFK_T4 (SEQ ID NO: 1079) | 981 | 1106 |
| HUMPFK_T5 (SEQ ID NO: 1080) | 1164 | 1289 |
| HUMPFK_T7 (SEQ ID NO: 1082) | 1069 | 1194 |
| HUMPFK_T8 (SEQ ID NO: 1083) | 1069 | 1194 |
| HUMPFK_T12 (SEQ ID NO: 1085) | 2239 | 2364 |
| HUMPFK_T13 (SEQ ID NO: 1086) | 1069 | 1194 |
| HUMPFK_T15 (SEQ ID NO: 1088) | 2381 | 2506 |
| HUMPFK_T16 (SEQ ID NO: 1089) | 1069 | 1194 |
| HUMPFK_T18 (SEQ ID NO: 1090) | 1913 | 2038 |
| HUMPFK_T26 (SEQ ID NO: 1091) | 1069 | 1194 |
| HUMPFK_T27 (SEQ ID NO: 1092) | 1069 | 1194 |
| HUMPFK_T30 (SEQ ID NO: 1093) | 1069 | 1194 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node_44 (SEQ ID NO:1108) according to the present invention is supported by 113 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1045 below describes the starting and ending position of this segment on each transcript.

TABLE 1045

Segment location on transcripts

| Transcript name | Segment starting position | Segment ending position |
|---|---|---|
| HUMPFK_T2 (SEQ ID NO: 1078) | 1505 | 1651 |
| HUMPFK_T4 (SEQ ID NO: 1079) | 1242 | 1388 |
| HUMPFK_T5 (SEQ ID NO: 1080) | 1425 | 1571 |
| HUMPFK_T7 (SEQ ID NO: 1082) | 1330 | 1476 |
| HUMPFK_T8 (SEQ ID NO: 1083) | 1330 | 1476 |
| HUMPFK_T12 (SEQ ID NO: 1085) | 2500 | 2646 |
| HUMPFK_T13 (SEQ ID NO: 1086) | 1330 | 1476 |
| HUMPFK_T15 (SEQ ID NO: 1088) | 2642 | 2788 |
| HUMPFK_T16 (SEQ ID NO: 1089) | 1330 | 1476 |
| HUMPFK_T18 (SEQ ID NO: 1090) | 2174 | 2320 |

TABLE 1045-continued

Segment location on transcripts

| Transcript name | Segment starting position | Segment ending position |
|---|---|---|
| HUMPFK_T26 (SEQ ID NO: 1091) | 1330 | 1476 |
| HUMPFK_T27 (SEQ ID NO: 1092) | 1330 | 1476 |
| HUMPFK_T30 (SEQ ID NO: 1093) | 1330 | 1476 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node_48 (SEQ ID NO:1109) according to the present invention is supported by 3 libraries. The number of libraries was determined as previously described. This segment can be found in the following transcript(s): HUMPFK_T7 (SEQ ID NO:1082) and HUMPFK_T13 (SEQ ID NO:1086). Table 1046 below describes the starting and ending position of this segment on each transcript.

TABLE 1046

Segment location on transcripts

| Transcript name | Segment starting position | Segment ending position |
|---|---|---|
| HUMPFK_T7 (SEQ ID NO: 1082) | 1548 | 1761 |
| HUMPFK_T13 (SEQ ID NO: 1086) | 1548 | 1761 |

This segment can be found in the following protein(s): HUMPFK_P6.

Segment cluster HUMPFK_node_49 (SEQ ID NO:1110) according to the present invention is supported by 3 libraries. The number of libraries was determined as previously described. This segment can be found in the following transcript(s): HUMPFK_T7 (SEQ ID NO:1082) and HUMPFK_T13 (SEQ ID NO:1086). Table 1047 below describes the starting and ending position of this segment on each transcript.

TABLE 1047

Segment location on transcripts

| Transcript name | Segment starting position | Segment ending position |
|---|---|---|
| HUMPFK_T7 (SEQ ID NO: 1082) | 1762 | 3484 |
| HUMPFK_T13 (SEQ ID NO: 1086) | 1762 | 3484 |

This segment can be found in a non-coding region of transcript(s) that are related to the following protein(s): HUMPFK_P6.

Segment cluster HUMPFK_node_54 (SEQ ID NO:1111) according to the present invention is supported by 114 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1048 below describes the starting and ending position of this segment on each transcript.

TABLE 1048

Segment location on transcripts

| Transcript name | Segment starting position | Segment ending position |
|---|---|---|
| HUMPFK_T2 (SEQ ID NO: 1078) | 1826 | 1963 |
| HUMPFK_T4 (SEQ ID NO: 1079) | 1563 | 1700 |
| HUMPFK_T5 (SEQ ID NO: 1080) | 1746 | 1883 |
| HUMPFK_T7 (SEQ ID NO: 1082) | 3588 | 3725 |
| HUMPFK_T8 (SEQ ID NO: 1083) | 1651 | 1788 |
| HUMPFK_T12 (SEQ ID NO: 1085) | 2821 | 2958 |
| HUMPFK_T13 (SEQ ID NO: 1086) | 3588 | 3725 |
| HUMPFK_T15 (SEQ ID NO: 1088) | 2963 | 3100 |
| HUMPFK_T16 (SEQ ID NO: 1089) | 1651 | 1788 |
| HUMPFK_T18 (SEQ ID NO: 1090) | 2495 | 2632 |
| HUMPFK_T26 (SEQ ID NO: 1091) | 1651 | 1788 |
| HUMPFK_T27 (SEQ ID NO: 1092) | 1651 | 1788 |
| HUMPFK_T30 (SEQ ID NO: 1093) | 1651 | 1788 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1049.

TABLE 1049

Oligonucleotides related to this segment

| Oligonucleotide name | Overexpressed in cancers | Chip reference |
|---|---|---|
| HUMPFK_0_0_18405 | lung malignant tumors | LUN |

This segment can be found in both coding and non-coding regions of transcript(s) as follows. The segment can be found in a non-coding region of transcript(s) that are related to the following protein(s): HUMPFK_P6. This segment can also be found in the following protein(s): HUMPFK_P3, HUMPFK_P4, HUMPFK_P5, HUMPFK_P7, HUMPFK_P8, HUMPFK_P9, HUMPFK_P10 and HUMPFK_P13, since it is in the coding region for the corresponding transcript.

Segment cluster HUMPFK_node_57 (SEQ ID NO:1112) according to the present invention is supported by 35 libraries. The number of libraries was determined as previously described. This segment can be found in the following transcript(s): HUMPFK_T1 (SEQ ID NO:1077), HUMPFK_T6 (SEQ ID NO:1081), HUMPFK_T11 (SEQ ID NO:1084) and HUMPFK_T14 (SEQ ID NO:1087). Table 1050 below describes the starting and ending position of this segment on each transcript.

TABLE 1050

Segment location on transcripts

| Transcript name | Segment starting position | Segment ending position |
|---|---|---|
| HUMPFK_T1 (SEQ ID NO: 1077) | 1 | 2592 |
| HUMPFK_T6 (SEQ ID NO: 1081) | 1 | 2592 |
| HUMPFK_T11 (SEQ ID NO: 1084) | 1 | 2592 |
| HUMPFK_T14 (SEQ ID NO: 1087) | 1 | 2592 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1051.

TABLE 1051

Oligonucleotides related to this segment

| Oligonucleotide name | Overexpressed in cancers | Chip reference |
|---|---|---|
| HUMPFK_0_0_18405 | lung malignant tumors | LUN |
| HUMPFK_0_13_0 | lung malignant tumors | LUN |

This segment can be found in the following protein(s): HUMPFK_P2.

Segment cluster HUMPFK_node_58 (SEQ ID NO:1113) according to the present invention is supported by 27 libraries. The number of libraries was determined as previously described. This segment can be found in the following transcript(s): HUMPFK_T1 (SEQ ID NO:1077) and HUMPFK_T11 (SEQ ID NO:1084). Table 1052 below describes the starting and ending position of this segment on each transcript.

TABLE 1052

Segment location on transcripts

| Transcript name | Segment starting position | Segment ending position |
|---|---|---|
| HUMPFK_T1 (SEQ ID NO: 1077) | 2593 | 3217 |
| HUMPFK_T11 (SEQ ID NO: 1084) | 2593 | 3217 |

This segment can be found in a non-coding region of transcript(s) that are related to the following protein(s): HUMPFK_P2.

Segment cluster HUMPFK_node_59 (SEQ ID NO:1114) according to the present invention is supported by 19 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084) and HUMPFK_T14 (SEQ ID NO:1087). Table 1053 below describes the starting and ending position of this segment on each transcript.

TABLE 1053

Segment location on transcripts

| Transcript name | Segment starting position | Segment ending position |
|---|---|---|
| HUMPFK_T1 (SEQ ID NO: 1077) | 3218 | 3370 |
| HUMPFK_T6 (SEQ ID NO: 1081) | 2593 | 2745 |
| HUMPFK_T7 (SEQ ID NO: 1082) | 3726 | 3878 |
| HUMPFK_T8 (SEQ ID NO: 1083) | 1789 | 1941 |
| HUMPFK_T11 (SEQ ID NO: 1084) | 3218 | 3370 |
| HUMPFK_T14 (SEQ ID NO: 1087) | 2593 | 2745 |

This segment can be found in both coding and non-coding regions of transcript(s) as follows. The segment can be found in a non-coding region of transcript(s) that are related to the following protein(s): HUMPFK_P2 and HUMPFK_P6. This segment can also be found in the following protein(s): HUMPFK_P7, since it is in the coding region for the corresponding transcript.

Segment cluster HUMPFK_node__60 (SEQ ID NO:1115) according to the present invention is supported by 18 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082) and HUMPFK_T11 (SEQ ID NO:1084). Table 1054 below describes the starting and ending position of this segment on each transcript.

TABLE 1054

Segment location on transcripts

| Transcript name | Segment starting position | Segment ending position |
| --- | --- | --- |
| HUMPFK_T1 (SEQ ID NO: 1077) | 3371 | 3995 |
| HUMPFK_T6 (SEQ ID NO: 1081) | 2746 | 3370 |
| HUMPFK_T7 (SEQ ID NO: 1082) | 3879 | 4503 |
| HUMPFK_T11 (SEQ ID NO: 1084) | 3371 | 3995 |

This segment can be found in a non-coding region of transcript(s) that are related to the following protein(s): HUMPFK_P2 and HUMPFK_P6.

Segment cluster HUMPFK_node__61 (SEQ ID NO:1116) according to the present invention is supported by 15 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082), HUMPFK_T8 (SEQ ID NO:1.083), HUMPFK_T11 (SEQ ID NO:1084) and HUMPFK_T14 (SEQ ID NO:1087). Table 1055 below describes the starting and ending position of this segment on each transcript.

TABLE 1055

Segment location on transcripts

| Transcript name | Segment starting position | Segment ending position |
| --- | --- | --- |
| HUMPFK_T1 (SEQ ID NO: 1077) | 3996 | 4356 |
| HUMPFK_T6 (SEQ ID NO: 1081) | 3371 | 3731 |
| HUMPFK_T7 (SEQ ID NO: 1082) | 4504 | 4864 |
| HUMPFK_T8 (SEQ ID NO: 1083) | 1942 | 2302 |
| HUMPFK_T11 (SEQ ID NO: 1084) | 3996 | 4356 |
| HUMPFK_T14 (SEQ ID NO: 1087) | 2746 | 3106 |

This segment can be found in both coding and non-coding regions of transcript(s) as follows. The segment can be found in a non-coding region of transcript(s) that are related to the following protein(s): HUMPFK_P2 and HUMPFK_P6. This segment can also be found in the following protein(s): HUMPFK_P7, since it is in the coding region for the corresponding transcript.

Segment cluster HUMPFK_node__62 (SEQ ID NO:1117) according to the present invention is supported by 17 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084) and HUMPFK_T14 (SEQ ID NO:1087). Table 1056 below describes the starting and ending position of this segment on each transcript.

TABLE 1056

Segment location on transcripts

| Transcript name | Segment starting position | Segment ending position |
| --- | --- | --- |
| HUMPFK_T1 (SEQ ID NO: 1077) | 4357 | 4983 |
| HUMPFK_T6 (SEQ ID NO: 1081) | 3732 | 4358 |
| HUMPFK_T7 (SEQ ID NO: 1082) | 4865 | 5491 |
| HUMPFK_T8 (SEQ ID NO: 1083) | 2303 | 2929 |
| HUMPFK_T11 (SEQ ID NO: 1084) | 4357 | 4983 |
| HUMPFK_T14 (SEQ ID NO: 1087) | 3107 | 3733 |

This segment can be found in a non-coding region of transcript(s) that are related to the following protein(s): HUMPFK_P2, HUMPFK_P6 and HUMPFK_P7.

Segment cluster HUMPFK_node__63 (SEQ ID NO:1118) according to the present invention is supported by 13 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084) and HUMPFK_T14 (SEQ ID NO:1087). Table 1057 below describes the starting and ending position of this segment on each transcript.

TABLE 1057

Segment location on transcripts

| Transcript name | Segment starting position | Segment ending position |
| --- | --- | --- |
| HUMPFK_T1 (SEQ ID NO: 1077) | 4984 | 5159 |
| HUMPFK_T6 (SEQ ID NO: 1081) | 4359 | 4534 |
| HUMPFK_T7 (SEQ ID NO: 1082) | 5492 | 5667 |
| HUMPFK_T8 (SEQ ID NO: 1083) | 2930 | 3105 |
| HUMPFK_T11 (SEQ ID NO: 1084) | 4984 | 5159 |
| HUMPFK_T14 (SEQ ID NO: 1087) | 3734 | 3909 |

This segment can be found in a non-coding region of transcript(s) that are related to the following protein(s): HUMPFK_P2, HUMPFK_P6 and HUMPFK_P7.

Segment cluster HUMPFK_node__64 (SEQ ID NO:1119) according to the present invention is supported by 62 libraries. The number of libraries was determined as previously described. This segment can be found in the following transcript(s): HUMPFK_T1 (SEQ ID NO:1077), HUMPFK_T6 (SEQ ID NO:1081), HUMPFK_T7 (SEQ ID NO:1082), HUMPFK_T8 (SEQ ID NO:1083) and HUMPFK_T14 (SEQ ID NO:1087). Table 1058 below describes the starting and ending position of this segment on each transcript.

TABLE 1058

Segment location on transcripts

| Transcript name | Segment starting position | Segment ending position |
| --- | --- | --- |
| HUMPFK_T1 (SEQ ID NO: 1077) | 5160 | 7938 |
| HUMPFK_T6 (SEQ ID NO: 1081) | 4535 | 7313 |
| HUMPFK_T7 (SEQ ID NO: 1082) | 5668 | 8446 |
| HUMPFK_T8 (SEQ ID NO: 1083) | 3106 | 5884 |
| HUMPFK_T14 (SEQ ID NO: 1087) | 3910 | 6688 |

This segment can be found in a non-coding region of transcript(s) that are related to the following protein(s): HUMPFK_P2, HUMPFK_P6 and HUMPFK_P7.

Segment cluster HUMPFK_node__65 (SEQ ID NO:1120) according to the present invention is supported by 144 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1059 below describes the starting and ending position of this segment on each transcript.

TABLE 1059

Segment location on transcripts

| Transcript name | Segment starting position | Segment ending position |
| --- | --- | --- |
| HUMPFK_T1 (SEQ ID NO: 1077) | 7939 | 8103 |
| HUMPFK_T2 (SEQ ID NO: 1078) | 1964 | 2128 |
| HUMPFK_T4 (SEQ ID NO: 1079) | 1701 | 1865 |
| HUMPFK_T5 (SEQ ID NO: 1080) | 1884 | 2048 |
| HUMPFK_T6 (SEQ ID NO: 1081) | 7314 | 7478 |
| HUMPFK_T7 (SEQ ID NO: 1082) | 8447 | 8611 |
| HUMPFK_T8 (SEQ ID NO: 1083) | 5885 | 6049 |
| HUMPFK_T11 (SEQ ID NO: 1084) | 5160 | 5324 |
| HUMPFK_T12 (SEQ ID NO: 1085) | 2959 | 3123 |
| HUMPFK_T13 (SEQ ID NO: 1086) | 3726 | 3890 |
| HUMPFK_T14 (SEQ ID NO: 1087) | 6689 | 6853 |
| HUMPFK_T15 (SEQ ID NO: 1088) | 3101 | 3265 |
| HUMPFK_T16 (SEQ ID NO: 1089) | 1789 | 1953 |
| HUMPFK_T18 (SEQ ID NO: 1090) | 2633 | 2797 |
| HUMPFK_T26 (SEQ ID NO: 1091) | 1789 | 1953 |
| HUMPFK_T27 (SEQ ID NO: 1092) | 1789 | 1953 |
| HUMPFK_T30 (SEQ ID NO: 1093) | 1789 | 1953 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node__83 (SEQ ID NO:1121) according to the present invention is supported by 129 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088) and HUMPFK_T18 (SEQ ID NO:1090). Table 1060 below describes the starting and ending position of this segment on each transcript.

TABLE 1060

Segment location on transcripts

| Transcript name | Segment starting position | Segment ending position |
| --- | --- | --- |
| HUMPFK_T1 (SEQ ID NO: 1077) | 8642 | 8843 |
| HUMPFK_T2 (SEQ ID NO: 1078) | 2667 | 2868 |
| HUMPFK_T4 (SEQ ID NO: 1079) | 2404 | 2605 |
| HUMPFK_T5 (SEQ ID NO: 1080) | 2587 | 2788 |
| HUMPFK_T6 (SEQ ID NO: 1081) | 8017 | 8218 |
| HUMPFK_T7 (SEQ ID NO: 1082) | 9150 | 9351 |
| HUMPFK_T8 (SEQ ID NO: 1083) | 6588 | 6789 |
| HUMPFK_T11 (SEQ ID NO: 1084) | 5863 | 6064 |
| HUMPFK_T12 (SEQ ID NO: 1085) | 3662 | 3863 |
| HUMPFK_T13 (SEQ ID NO: 1086) | 4429 | 4630 |
| HUMPFK_T14 (SEQ ID NO: 1087) | 7392 | 7593 |
| HUMPFK_T15 (SEQ ID NO: 1088) | 3804 | 4005 |
| HUMPFK_T18 (SEQ ID NO: 1090) | 3336 | 3537 |

This segment can be found in a non-coding region of transcript(s) that are related to the following protein(s): HUMPFK_P2, HUMPFK_P3, HUMPFK_P4, HUMPFK_P5, HUMPFK_P6, HUMPFK_P7, HUMPFK_P8 and HUMPFK_P9.

Segment cluster HUMPFK_node__91 (SEQ ID NO:1122) according to the present invention is supported by 6 libraries. The number of libraries was determined as previously described. This segment can be found in the following transcript(s): HUMPFK_T16 (SEQ ID NO:1089), HUMPFK_T26 (SEQ ID NO:1091), HUMPFK_T27 (SEQ ID NO:1092), HUMPFK_T30 (SEQ ID NO:1093) and HUMPFK_T45 (SEQ ID NO:1094). Table 1061 below describes the starting and ending position of this segment on each transcript.

TABLE 1061

Segment location on transcripts

| Transcript name | Segment staring position | Segment ending position |
| --- | --- | --- |
| HUMPFK_T16 (SEQ ID NO: 1089) | 2444 | 2574 |
| HUMPFK_T26 (SEQ ID NO: 1091) | 2444 | 2574 |
| HUMPFK_T27 (SEQ ID NO: 1092) | 2331 | 2461 |
| HUMPFK_T30 (SEQ ID NO: 1093) | 2331 | 2461 |
| HUMPFK_T45 (SEQ ID NO: 1094) | 218 | 348 |

This segment can be found in both coding and non-coding regions of transcript(s) as follows. The segment can be found in a non-coding region of transcript(s) that are related to the following protein(s): HUMPFK_P10. This segment can also be found in the following protein(s): HUMPFK_P13, since it is in the coding region for the corresponding transcript.

Segment cluster HUMPFK_node__93 (SEQ ID NO:1123) according to the present invention is supported by 9 libraries. The number of libraries was determined as previously described. This segment can be found in the following transcript(s): HUMPFK_T16 (SEQ ID NO:1089) and HUMPFK_T45 (SEQ ID NO:1094). Table 1062 below describes the starting and ending position of this segment on each transcript.

TABLE 1062

Segment location on transcripts

| Transcript name | Segment starting position | Segment ending position |
|---|---|---|
| HUMPFK_T16 (SEQ ID NO: 1089) | 2575 | 6233 |
| HUMPFK_T45 (SEQ ID NO: 1094) | 349 | 4007 |

This segment can be found in a non-coding region of transcript(s) that are related to the following protein(s): HUMPFK_P10.

Segment cluster HUMPFK_node__99 (SEQ ID NO:1124) according to the present invention is supported by 4 libraries. The number of libraries was determined as previously described. This segment can be found in the following transcript(s): HUMPFK_T26 (SEQ ID NO:1091), HUMPFK_T27 (SEQ ID NO:1092) and HUMPFK_T30 (SEQ ID NO:1093). Table 1063 below describes the starting and ending position of this segment on each transcript.

TABLE 1063

Segment location on transcripts

| Transcript name | Segment starting position | Segment ending position |
|---|---|---|
| HUMPFK_T26 (SEQ ID NO: 1091) | 2575 | 2765 |
| HUMPFK_T27 (SEQ ID NO: 1092) | 2462 | 2652 |
| HUMPFK_T30 (SEQ ID NO: 1093) | 2462 | 2652 |

This segment can be found in both coding and non-coding regions of transcript(s) as follows. The segment can be found in a non-coding region of transcript(s) that are related to the following protein(s): HUMPFK_P10. This segment can also be found in the following protein(s): HUMPFK_P13, since it is in the coding region for the corresponding transcript.

Segment cluster HUMPFK_node__102 (SEQ ID NO:1125) according to the present invention is supported by 2 libraries. The number of libraries was determined as previously described. This segment can be found in the following transcript(s): HUMPFK_T26 (SEQ ID NO:1091), HUMPFK_T27 (SEQ ID NO:1092) and HUMPFK_T30 (SEQ ID NO:1093). Table 1064 below describes the starting and ending position of this segment on each transcript.

TABLE 1064

Segment location on transcripts

| Transcript name | Segment starting position | Segment ending position |
|---|---|---|
| HUMPFK_T26 (SEQ ID NO: 1091) | 2766 | 3519 |
| HUMPFK_T27 (SEQ ID NO: 1092) | 2653 | 3406 |
| HUMPFK_T30 (SEQ ID NO: 1093) | 2658 | 3411 |

This segment can be found in a non-coding region of transcript(s) that are related to the following protein(s): HUMPFK_P10 and HUMPFK_P13.

Segment cluster HUMPFK_node__104 (SEQ ID NO:1126) according to the present invention is supported by 1 libraries. The number of libraries was determined as previously described. This segment can be found in the following transcript(s): HUMPFK_T26 (SEQ ID NO:1091), HUMPFK_T27 (SEQ ID NO:1092) and HUMPFK_T30 (SEQ ID NO:1093). Table 1065 below describes the starting and ending position of this segment on each transcript.

TABLE 1065

Segment location on transcripts

| Transcript name | Segment starting position | Segment ending position |
|---|---|---|
| HUMPFK_T26 (SEQ ID NO: 1091) | 3545 | 3805 |
| HUMPFK_T27 (SEQ ID NO: 1092) | 3432 | 3692 |
| HUMPFK_T30 (SEQ ID NO: 1093) | 3412 | 3672 |

This segment can be found in a non-coding region of transcript(s) that are related to the following protein(s): HUMPFK_P10 and HUMPFK_P13.

According to an optional embodiment of the present invention, short segments related to the above cluster are also provided. These segments are up to about 120 bp in length, and so are included in a separate description.

Segment cluster HUMPFK_node__3 (SEQ ID NO:1127) according to the present invention is supported by 2 libraries. The number of libraries was determined as previously described. This segment can be found in the following transcript(s): HUMPFK_T5 (SEQ ID NO:1080). Table 1066 below describes the starting and ending position of this segment on each transcript.

TABLE 1066

Segment location on transcripts

| Transcript name | Segment starting position | Segment ending position |
|---|---|---|
| HUMPFK_T5 (SEQ ID NO: 1080) | 1 | 116 |

This segment can be found in a non-coding region of transcript(s) that are related to the following protein(s): HUMPFK_P5.

Segment cluster HUMPFK_node__6 (SEQ ID NO:1128) according to the present invention is supported by 12 libraries. The number of libraries was determined as previously described. This segment can be found in the following transcript(s): HUMPFK_T2 (SEQ ID NO:1078) and HUMPFK_T5 (SEQ ID NO:1080). Table 1067 below describes the starting and ending position of this segment on each transcript.

TABLE 1067

Segment location on transcripts

| Transcript name | Segment starting position | Segment ending position |
|---|---|---|
| HUMPFK_T2 (SEQ ID NO: 1078) | 277 | 392 |
| HUMPFK_T5 (SEQ ID NO: 1080) | 117 | 232 |

This segment can be found in both coding and non-coding regions of transcript(s) as follows. The segment can be found in a non-coding region of transcript(s) that are related to the following protein(s): HUMPFK_P3. This segment can also be found in the following protein(s): HUMPFK_P5, since it is in the coding region for the corresponding transcript.

Segment cluster HUMPFK_node__12 (SEQ ID NO:1129) according to the present invention is supported by 55 libraries. The number of libraries was determined as previously described. This segment can be found in the following transcript(s): HUMPFK_T2 (SEQ ID NO:1078), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092), HUMPFK_T30 (SEQ ID NO:1093), HUMPFK_T49 (SEQ ID NO:1095) and HUMPFK_T50 (SEQ ID NO:1096). Table 1068 below describes the starting and ending position of this segment on each transcript.

TABLE 1068

Segment location on transcripts

| Transcript name | Segment starting position | Segment ending position |
|---|---|---|
| HUMPFK_T2 (SEQ ID NO: 1078) | 393 | 466 |
| HUMPFK_T5 (SEQ ID NO: 1080) | 233 | 306 |
| HUMPFK_T7 (SEQ ID NO: 1082) | 218 | 291 |
| HUMPFK_T8 (SEQ ID NO: 1083) | 218 | 291 |
| HUMPFK_T12 (SEQ ID NO: 1085) | 218 | 291 |
| HUMPFK_T13 (SEQ ID NO: 1086) | 218 | 291 |
| HUMPFK_T15 (SEQ ID NO: 1088) | 218 | 291 |
| HUMPFK_T16 (SEQ ID NO: 1089) | 218 | 291 |
| HUMPFK_T18 (SEQ ID NO: 1090) | 218 | 291 |
| HUMPFK_T26 (SEQ ID NO: 1091) | 218 | 291 |
| HUMPFK_T27 (SEQ ID NO: 1092) | 218 | 291 |
| HUMPFK_T30 (SEQ ID NO: 1093) | 218 | 291 |
| HUMPFK_T49 (SEQ ID NO: 1095) | 218 | 291 |
| HUMPFK_T50 (SEQ ID NO: 1096) | 218 | 291 |

This segment can be found in both coding and non-coding regions of transcript(s) as follows. The segment can be found in a non-coding region of transcript(s) that are related to the following protein(s): HUMPFK_P8 and HUMPFK_P9. This segment can also be found in the following protein(s): HUMPFK_P3, HUMPFK_P5, HUMPFK_P6, HUMPFK_P7, HUMPFK_P10, HUMPFK_P13, HUMPFK_P25 and HUMPFK_P26, since it is in the coding region for the corresponding transcript.

Segment cluster HUMPFK_node__16 (SEQ ID NO:1130) according to the present invention is supported by 60 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:190), HUMPFK_T26 (SEQ ID NO:1091), HUMPFK_T27 (SEQ ID NO:1092), HUMPFK_T30 (SEQ ID NO:1093), HUMPFK_T49 (SEQ ID NO:1095) and HUMPFK_T50 (SEQ ID NO:1096). Table 1069 below describes the starting and ending position of this segment on each transcript.

TABLE 1069

Segment location on transcripts

| Transcript name | Segment starting position | Segment ending position |
|---|---|---|
| HUMPFK_T2 (SEQ ID NO: 1078) | 467 | 544 |
| HUMPFK_T4 (SEQ ID NO: 1079) | 204 | 281 |
| HUMPFK_T5 (SEQ ID NO: 1080) | 307 | 384 |
| HUMPFK_T7 (SEQ ID NO: 1082) | 292 | 369 |
| HUMPFK_T8 (SEQ ID NO: 1083) | 292 | 369 |
| HUMPFK_T12 (SEQ ID NO: 1085) | 292 | 369 |
| HUMPFK_T13 (SEQ ID NO: 1086) | 292 | 369 |

TABLE 1069-continued

Segment location on transcripts

| Transcript name | Segment starting position | Segment ending position |
|---|---|---|
| HUMPFK_T15 (SEQ ID NO: 1088) | 292 | 369 |
| HUMPFK_T16 (SEQ ID NO: 1089) | 292 | 369 |
| HUMPFK_T18 (SEQ ID NO: 1090) | 292 | 369 |
| HUMPFK_T26 (SEQ ID NO: 1091) | 292 | 369 |
| HUMPFK_T27 (SEQ ID NO: 1092) | 292 | 369 |
| HUMPFK_T30 (SEQ ID NO: 1093) | 292 | 369 |
| HUMPFK_T49 (SEQ ID NO: 1095) | 292 | 369 |
| HUMPFK_T50 (SEQ ID NO: 1096) | 292 | 369 |

This segment can be found in both coding and non-coding regions of transcript(s) as follows. The segment can be found in a non-coding region of transcript(s) that are related to the following protein(s): HUMPFK_P8 and HUMPFK_P9. This segment can also be found in the following protein(s): HUMPFK_P3, HUMPFK_P4, HUMPFK_P5, HUMPFK_P6, HUMPFK_P7, HUMPFK_P10, HUMPFK_P13, HUMPFK_P25 and HUMPFK_P26, since it is in the coding region for the corresponding transcript.

Segment cluster HUMPFK_node__21 (SEQ ID NO:1131) according to the present invention is supported by 1 libraries. The number of libraries was determined as previously described. This segment can be found in the following transcript(s): HUMPFK_T5 (SEQ ID NO:1080). Table 1070 below describes the starting and ending position of this segment on each transcript.

TABLE 1070

Segment location on transcripts

| Transcript name | Segment starting position | Segment ending position |
|---|---|---|
| HUMPFK_T5 (SEQ ID NO: 1080) | 385 | 464 |

This segment can be found in the following protein(s): HUMPFK_P5.

Segment cluster HUMPFK_node__28 (SEQ ID NO:1132) according to the present invention is supported by 94 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1071 below describes the starting and ending position of this segment on each transcript.

TABLE 1071

Segment location on transcripts

| Transcript name | Segment starting position | Segment ending position |
|---|---|---|
| HUMPFK_T2 (SEQ ID NO: 1078) | 901 | 945 |
| HUMPFK_T4 (SEQ ID NO: 1079) | 638 | 682 |
| HUMPFK_T5 (SEQ ID NO: 1080) | 821 | 865 |

TABLE 1071-continued

Segment location on transcripts

| Transcript name | Segment starting position | Segment ending position |
|---|---|---|
| HUMPFK_T7 (SEQ ID NO: 1082) | 726 | 770 |
| HUMPFK_T8 (SEQ ID NO: 1083) | 726 | 770 |
| HUMPFK_T12 (SEQ ID NO: 1085) | 1896 | 1940 |
| HUMPFK_T13 (SEQ ID NO: 1086) | 726 | 770 |
| HUMPFK_T15 (SEQ ID NO: 1088) | 1896 | 1940 |
| HUMPFK_T16 (SEQ ID NO: 1089) | 726 | 770 |
| HUMPFK_T18 (SEQ ID NO: 1090) | 1570 | 1614 |
| HUMPFK_T26 (SEQ ID NO: 1091) | 726 | 770 |
| HUMPFK_T27 (SEQ ID NO: 1092) | 726 | 770 |
| HUMPFK_T30 (SEQ ID NO: 1093) | 726 | 770 |

This segment can be found in both coding and non-coding regions of transcript(s) as follows. The segment can be found in a non-coding region of transcript(s) that are related to the following protein(s): HUMPFK_P9. This segment can also be found in the following protein(s): HUMPFK_P3, HUMPFK_P4, HUMPFK_P5, HUMPFK_P6, HUMPFK_P7, HUMPFK_P8, HUMPFK_P10 and HUMPFK_P13, since it is in the coding region for the corresponding transcript.

Segment cluster HUMPFK_node_31 (SEQ ID NO:1133) according to the present invention is supported by 98 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1072 below describes the starting and ending position of this segment on each transcript.

TABLE 1072

Segment location on transcripts

| Transcript name | Segment starting position | Segment ending position |
|---|---|---|
| HUMPFK_T2 (SEQ ID NO: 1078) | 946 | 1054 |
| HUMPFK_T4 (SEQ ID NO: 1079) | 683 | 791 |
| HUMPFK_T5 (SEQ ID NO: 1080) | 866 | 974 |
| HUMPFK_T7 (SEQ ID NO: 1082) | 771 | 879 |
| HUMPFK_T8 (SEQ ID NO: 1083) | 771 | 879 |
| HUMPFK_T12 (SEQ ID NO: 1085) | 1941 | 2049 |
| HUMPEK_T13 (SEQ ID NO: 1086) | 771 | 879 |
| HUMPFK_T15 (SEQ ID NO: 1088) | 2083 | 2191 |
| HUMPFK_T16 (SEQ ID NO: 1089) | 771 | 879 |
| HUMPFK_T18 (SEQ ID NO: 1090) | 1615 | 1723 |
| HUMPFK_T26 (SEQ ID NO: 1091) | 771 | 879 |
| HUMPFK_T27 (SEQ ID NO: 1092) | 771 | 879 |
| HUMPFK_T30 (SEQ ID NO: 1093) | 771 | 879 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node_33 (SEQ ID NO:1134) according to the present invention is supported by 96 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1073 below describes the starting and ending position of this segment on each transcript.

TABLE 1073

Segment location on transcripts

| Transcript name | Segment starting position | Segment ending position |
|---|---|---|
| HUMPFK_T2 (SEQ ID NO: 1078) | 1055 | 1094 |
| HUMPFK_T4 (SEQ ID NO: 1079) | 792 | 831 |
| HUMPFK_T5 (SEQ ID NO: 1080) | 975 | 1014 |
| HUMPFK_T7 (SEQ ID NO: 1082) | 880 | 919 |
| HUMPFK_T8 (SEQ ID NO: 1083) | 880 | 919 |
| HUMPFK_T12 (SEQ ID NO: 1085) | 2050 | 2089 |
| HUMPFK_T13 (SEQ ID NO: 1086) | 880 | 919 |
| HUMPFK_T15 (SEQ ID NO: 1088) | 2192 | 2231 |
| HUMPFK_T16 (SEQ ID NO: 1089) | 880 | 919 |
| HUMPFK_T18 (SEQ ID NO: 1090) | 1724 | 1763 |
| HUMPFK_T26 (SEQ ID NO: 1091) | 880 | 919 |
| HUMPFK_T27 (SEQ ID NO: 1092) | 880 | 919 |
| HUMPFK_T30 (SEQ ID NO: 1093) | 880 | 919 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node_34 (SEQ ID NO:1135) according to the present invention is supported by 100 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1074 below describes the starting and ending position of this segment on each transcript.

TABLE 1074

Segment location on transcripts

| Transcript name | Segment starting position | Segment ending position |
|---|---|---|
| HUMPFK_T2 (SEQ ID NO: 1078) | 1095 | 1150 |
| HUMPFK_T4 (SEQ ID NO: 1079) | 832 | 887 |
| HUMPFK_T5 (SEQ ID NO: 1080) | 1015 | 1070 |
| HUMPFK_T7 (SEQ ID NO: 1082) | 920 | 975 |
| HUMPFK_T8 (SEQ ID NO: 1083) | 920 | 975 |
| HUMPFK_T12 (SEQ ID NO: 1085) | 2090 | 2145 |
| HUMPFK_T13 (SEQ ID NO: 1086) | 920 | 975 |
| HUMPFK_T15 (SEQ ID NO: 1088) | 2232 | 2287 |
| HUMPFK_T16 (SEQ ID NO: 1089) | 920 | 975 |
| HUMPFK_T18 (SEQ ID NO: 1090) | 1764 | 1819 |
| HUMPFK_T26 (SEQ ID NO: 1091) | 920 | 975 |
| HUMPFK_T27 (SEQ ID NO: 1092) | 920 | 975 |
| HUMPFK_T30 (SEQ ID NO: 1093) | 920 | 975 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1075.

TABLE 1075

Oligonucleotides related to this segment

| Oligonucleotide name | Overexpressed in cancers | Chip reference |
|---|---|---|
| HUMPFK_0_13_0 | lung malignant tumors | LUN |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node__36 (SEQ ID NO:1136) according to the present invention is supported by 107 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1076 below describes the starting and ending position of this segment on each transcript.

TABLE 1076

Segment location on transcripts

| Transcript name | Segment starting position | Segment ending position |
|---|---|---|
| HUMPFK_T2 (SEQ ID NO: 1078) | 1151 | 1243 |
| HUMPFK_T4 (SEQ ID NO: 1079) | 888 | 980 |
| HUMPFK_T5 (SEQ ID NO: 1080) | 1071 | 1163 |
| HUMPFK_T7 (SEQ ID NO: 1082) | 976 | 1068 |
| HUMPFK_T8 (SEQ ID NO: 1083) | 976 | 1068 |
| HUMPFK_T12 (SEQ ID NO: 1085) | 2146 | 2238 |
| HUMPFK_T13 (SEQ ID NO: 1086) | 976 | 1068 |
| HUMPFK_T15 (SEQ ID NO: 1088) | 2288 | 2380 |
| HUMPFK_T16 (SEQ ID NO: 1089) | 976 | 1068 |
| HUMPFK_T18 (SEQ ID NO: 1090) | 1820 | 1912 |
| HUMPFK_T26 (SEQ ID NO: 1091) | 976 | 1068 |
| HUMPFK_T27 (SEQ ID NO: 1092) | 976 | 1068 |
| HUMPFK_T30 (SEQ ID NO: 1093) | 976 | 1068 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1077.

TABLE 1077

Oligonucleotides related to this segment

| Oligonucleotide name | Overexpressed in cancers | Chip reference |
|---|---|---|
| HUMPFK_0_13_0 | lung malignant tumors | LUN |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node__40 (SEQ ID NO:1137) according to the present invention is supported by 99 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1078 below describes the starting and ending position of this segment on each transcript.

TABLE 1078

Segment location on transcripts

| Transcript name | Segment starting position | Segment ending position |
|---|---|---|
| HUMPFK_T2 (SEQ ID NO: 1078) | 1370 | 1434 |
| HUMPFK_T4 (SEQ ID NO: 1079) | 1107 | 1171 |
| HUMPFK_T5 (SEQ ID NO: 1080) | 1290 | 1354 |
| HUMPFK_T7 (SEQ ID NO: 1082) | 1195 | 1259 |
| HUMPFK_T8 (SEQ ID NO: 1083) | 1195 | 1259 |
| HUMPFK_T12 (SEQ ID NO: 1085) | 2365 | 2429 |
| HUMPFK_T13 (SEQ ID NO: 1086) | 1195 | 1259 |
| HUMPFK_T15 (SEQ ID NO: 1088) | 2507 | 2571 |
| HUMPFK_T16 (SEQ ID NO: 1089) | 1195 | 1259 |
| HUMPFK_T18 (SEQ ID NO: 1090) | 2039 | 2103 |
| HUMPFK_T26 (SEQ ID NO: 1091) | 1195 | 1259 |
| HUMPFK_T27 (SEQ ID NO: 1092) | 1195 | 1259 |
| HUMPFK_T30 (SEQ ID NO: 1093) | 1195 | 1259 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node__42 (SEQ ID NO:1138) according to the present invention is supported by 103 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1079 below describes the starting and ending position of this segment on each transcript.

TABLE 1079

Segment location on transcripts

| Transcript name | Segment starting position | Segment ending position |
|---|---|---|
| HUMPFK_T2 (SEQ ID NO: 1078) | 1435 | 1504 |
| HUMPFK_T4 (SEQ ID NO: 1079) | 1172 | 1241 |
| HUMPFK_T5 (SEQ ID NO: 1080) | 1355 | 1424 |

TABLE 1079-continued

Segment location on transcripts

| Transcript name | Segment starting position | Segment ending position |
|---|---|---|
| HUMPFK_T7 (SEQ ID NO: 1082) | 1260 | 1329 |
| HUMPFK_T8 (SEQ ID NO: 1083) | 1260 | 1329 |
| HUMPFK_T12 (SEQ ID NO: 1085) | 2430 | 2499 |
| HUMPFK_T13 (SEQ ID NO: 1086) | 1260 | 1329 |
| HUMPFK_T15 (SEQ ID NO: 1088) | 2572 | 2641 |
| HUMPFK_T16 (SEQ ID NO: 1089) | 1260 | 1329 |
| HUMPFK_T18 (SEQ ID NO: 1090) | 2104 | 2173 |
| HUMPFK_T26 (SEQ ID NO: 1091) | 1260 | 1329 |
| HUMPFK_T27 (SEQ ID NO: 1092) | 1260 | 1329 |
| HUMPFK_T30 (SEQ ID NO: 1093) | 1260 | 1329 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node__47 (SEQ ID NO:1139) according to the present invention is supported by 108 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1080 below describes the starting and ending position of this segment on each transcript.

TABLE 1080

Segment location on transcripts

| Transcript name | Segment starting position | Segment ending position |
|---|---|---|
| HUMPFK_T2 (SEQ ID NO: 1078) | 1652 | 1722 |
| HUMPFK_T4 (SEQ ID NO: 1079) | 1389 | 1459 |
| HUMPFK_T5 (SEQ ID NO: 1080) | 1572 | 1642 |
| HUMPFK_T7 (SEQ ID NO: 1082) | 1477 | 1547 |
| HUMPFK_T8 (SEQ ID NO: 1083) | 1477 | 1547 |
| HUMPFK_T12 (SEQ ID NO: 1085) | 2647 | 2717 |
| HUMPFK_T13 (SEQ ID NO: 1086) | 1477 | 1547 |
| HUMPFK_T15 (SEQ ID NO: 1088) | 2789 | 2859 |
| HUMPFK_T16 (SEQ ID NO: 1089) | 1477 | 1547 |
| HUMPFK_T18 (SEQ ID NO: 1090) | 2321 | 2391 |
| HUMPFK_T26 (SEQ ID NO: 1091) | 1477 | 1547 |
| HUMPFK_T27 (SEQ ID NO: 1092) | 1477 | 1547 |
| HUMPFK_T30 (SEQ ID NO: 1093) | 1477 | 1547 |

This segment can be found in the following protein(s): HUMPFK_P3, HUMPFK_P4, HUMPFK_P5, HUMPFK_P6, HUMPFK_P7, HUMPFK_P8, HUMPFK_P9, HUMPFK_P10 and HUMPFK_P13.

Segment cluster HUMPFK_node__50 (SEQ ID NO:1140) according to the present invention can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1081 below describes the starting and ending position of this segment on each transcript.

TABLE 1081

Segment location on transcripts

| Transcript name | Segment starting position | Segment ending position |
|---|---|---|
| HUMPFK_T2 (SEQ ID NO: 1078) | 1723 | 1743 |
| HUMPFK_T4 (SEQ ID NO: 1079) | 1460 | 1480 |
| HUMPFK_T5 (SEQ ID NO: 1080) | 1643 | 1663 |
| HUMPFK_T7 (SEQ ID NO: 1082) | 3485 | 3505 |
| HUMPFK_T8 (SEQ ID NO: 1083) | 1548 | 1568 |
| HUMPFK_T12 (SEQ ID NO: 1085) | 2718 | 2738 |
| HUMPFK_T13 (SEQ ID NO: 1086) | 3485 | 3505 |
| HUMPFK_T15 (SEQ ID NO: 1088) | 2860 | 2880 |
| HUMPFK_T16 (SEQ ID NO: 1089) | 1548 | 1568 |
| HUMPFK_T18 (SEQ ID NO: 1090) | 2392 | 2412 |
| HUMPFK_T26 (SEQ ID NO: 1091) | 1548 | 1568 |
| HUMPFK_T27 (SEQ ID NO: 1092) | 1548 | 1568 |
| HUMPFK_T30 (SEQ ID NO: 1093) | 1548 | 1568 |

This segment can be found in both coding and non-coding regions of transcript(s) as follows. The segment can be found in a non-coding region of transcript(s) that are related to the following protein(s): HUMPFK_P6. This segment can also be found in the following protein(s): HUMPFK_P3, HUMPFK_P4, HUMPFK_P5, HUMPFK_P7, HUMPFK_P8, HUMPFK_P9, HUMPFK_P10 and HUMPFK_P13, since it is in the coding region for the corresponding transcript.

Segment cluster HUMPFK_node__51 (SEQ ID NO:1141) according to the present invention is supported by 109 libraries. The number of libraries was determined as previously described. This segment can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1082 below describes the starting and ending position of this segment on each transcript.

TABLE 1082

Segment location on transcripts

| Transcript name | Segment starting position | Segment ending position |
|---|---|---|
| HUMPFK_T2 (SEQ ID NO: 1078) | 1744 | 1810 |
| HUMPFK_T4 (SEQ ID NO: 1079) | 1481 | 1547 |
| HUMPFK_T5 (SEQ ID NO: 1080) | 1664 | 1730 |
| HUMPFK_T7 (SEQ ID NO: 1082) | 3506 | 3572 |
| HUMPFK_T8 (SEQ ID NO: 1083) | 1569 | 1635 |
| HUMPFK_T12 (SEQ ID NO: 1085) | 2739 | 2805 |
| HUMPFK_T13 (SEQ ID NO: 1086) | 3506 | 3572 |
| HUMPFK_T15 (SEQ ID NO: 1088) | 2881 | 2947 |
| HUMPFK_T16 (SEQ ID NO: 1089) | 1569 | 1635 |
| HUMPFK_T18 (SEQ ID NO: 1090) | 2413 | 2479 |
| HUMPFK_T26 (SEQ ID NO: 1091) | 1569 | 1635 |
| HUMPFK_T27 (SEQ ID NO: 1092) | 1569 | 1635 |
| HUMPFK_T30 (SEQ ID NO: 1093) | 1569 | 1635 |

This segment can be found in both coding and non-coding regions of transcript(s) as follows. The segment can be found in a non-coding region of transcript(s) that are related to the following protein(s): HUMPFK_P6. This segment can also be found in the following protein(s): HUMPFK_P3, HUMPFK_P4, HUMPFK_P5, HUMPFK_P7, HUMPFK_P8, HUMPFK_P9, HUMPFK_P10 and HUMPFK_P13, since it is in the coding region for the corresponding transcript.

Segment cluster HUMPFK_node__53 (SEQ ID NO:1142) according to the present invention can be found in the following transcript(s): HUMPFK_T2 (SEQ ID NO:1078), HUMPFK_T4 (SEQ ID NO:1079), HUMPFK_T5 (SEQ ID NO:1080), HUMPFK_T7 (SEQ ID NO:1082), HUMPFK_T8 (SEQ ID NO:1083), HUMPFK_T12 (SEQ ID NO:1085), HUMPFK_T13 (SEQ ID NO:1086), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1083 below describes the starting and ending position of this segment on each transcript.

TABLE 1083

Segment location on transcripts

| Transcript name | Segment starting position | Segment ending position |
|---|---|---|
| HUMPFK_T2 (SEQ ID NO: 1078) | 1811 | 1825 |
| HUMPFK_T4 (SEQ ID NO: 1079) | 1548 | 1562 |
| HUMPFK_T5 (SEQ ID NO: 1080) | 1731 | 1745 |
| HUMPFK_T7 (SEQ ID NO: 1082) | 3573 | 3587 |
| HUMPFK_T8 (SEQ ID NO: 1083) | 1636 | 1650 |
| HUMPFK_T12 (SEQ ID NO: 1085) | 2806 | 2820 |
| HUMPFK_T13 (SEQ ID NO: 1086) | 3573 | 3587 |
| HUMPFK_T15 (SEQ ID NO: 1088) | 2948 | 2962 |
| HUMPFK_T16 (SEQ ID NO: 1089) | 1636 | 1650 |
| HUMPFK_T18 (SEQ ID NO: 1090) | 2480 | 2494 |
| HUMPFK_T26 (SEQ ID NO: 1091) | 1636 | 1650 |
| HUMPFK_T27 (SEQ ID NO: 1092) | 1636 | 1650 |
| HUMPFK_T30 (SEQ ID NO: 1093) | 1636 | 1650 |

This segment can be found in both coding and non-coding regions of transcript(s) as follows. The segment can be found in a non-coding region of transcript(s) that are related to the following protein(s): HUMPFK_P6. This segment can also be found in the following protein(s): HUMPFK_P3, HUMPFK_P4, HUMPFK_P5, HUMPFK_P7, HUMPFK_P8, HUMPFK_P9, HUMPFK_P10 and HUMPFK_P13, since it is in the coding region for the corresponding transcript.

Segment cluster HUMPFK_node__67 (SEQ ID NO:1143) according to the present invention is supported by 137 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1084 below describes the starting and ending position of this segment on each transcript.

TABLE 1084

Segment location on transcripts

| Transcript name | Segment starting position | Segment ending position |
|---|---|---|
| HUMPFK_T1 (SEQ ID NO: 1077) | 8104 | 8165 |
| HUMPFK_T2 (SEQ ID NO: 1078) | 2129 | 2190 |
| HUMPFK_T4 (SEQ ID NO: 1079) | 1866 | 1927 |
| HUMPFK_T5 (SEQ ID NO: 1080) | 2049 | 2110 |
| HUMPFK_T6 (SEQ ID NO: 1081) | 7479 | 7540 |
| HUMPFK_T7 (SEQ ID NO: 1082) | 8612 | 8673 |
| HUMPFK_T8 (SEQ ID NO: 1083) | 6050 | 6111 |
| HUMPFK_T11 (SEQ ID NO: 1084) | 5325 | 5386 |
| HUMPFK_T12 (SEQ ID NO: 1085) | 3124 | 3185 |
| HUMPFK_T13 (SEQ ID NO: 1086) | 3891 | 3952 |
| HUMPFK_T14 (SEQ ID NO: 1087) | 6854 | 6915 |
| HUMPFK_T15 (SEQ ID NO: 1088) | 3266 | 3327 |
| HUMPFK_T16 (SEQ ID NO: 1089) | 1954 | 2015 |
| HUMPFK_T18 (SEQ ID NO: 1090) | 2798 | 2859 |
| HUMPFK_T26 (SEQ ID NO: 1091) | 1954 | 2015 |
| HUMPFK_T27 (SEQ ID NO: 1092) | 1954 | 2015 |
| HUMPFK_T30 (SEQ ID NO: 1093) | 1954 | 2015 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node__69 (SEQ ID NO:1144) according to the present invention is supported by 175 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1085 below describes the starting and ending position of this segment on each transcript.

TABLE 1085

Segment location on transcripts

| Transcript name | Segment starting position | Segment ending position |
|---|---|---|
| HUMPFK_T1 (SEQ ID NO: 1077) | 8166 | 8277 |
| HUMPFK_T2 (SEQ ID NO: 1078) | 2191 | 2302 |
| HUMPFK_T4 (SEQ ID NO: 1079) | 1928 | 2039 |
| HUMPFK_T5 (SEQ ID NO: 1080) | 2111 | 2222 |
| HUMPFK_T6 (SEQ ID NO: 1081) | 7541 | 7652 |
| HUMPFK_T7 (SEQ ID NO: 1082) | 8674 | 8785 |
| HUMPFK_T8 (SEQ ID NO: 1083) | 6112 | 6223 |
| HUMPFK_T11 (SEQ ID NO: 1084) | 5387 | 5498 |
| HUMPFK_T12 (SEQ ID NO: 1085) | 3186 | 3297 |
| HUMPFK_T13 (SEQ ID NO: 1086) | 3953 | 4064 |
| HUMPFK_T14 (SEQ ID NO: 1087) | 6916 | 7027 |
| HUMPFK_T15 (SEQ ID NO: 1088) | 3328 | 3439 |
| HUMPFK_T16 (SEQ ID NO: 1089) | 2016 | 2127 |
| HUMPFK_T18 (SEQ ID NO: 1090) | 2860 | 2971 |

TABLE 1085-continued

Segment location on transcripts

| Transcript name | Segment starting position | Segment ending position |
|---|---|---|
| HUMPFK_T26 (SEQ ID NO: 1091) | 2016 | 2127 |
| HUMPFK_T27 (SEQ ID NO: 1092) | 2016 | 2127 |
| HUMPFK_T30 (SEQ ID NO: 1093) | 2016 | 2127 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node__73 (SEQ ID NO:1145) according to the present invention is supported by 150 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1086 below describes the starting and ending position of this segment on each transcript.

TABLE 1086

Segment location on transcripts

| Transcript name | Segment starting position | Segment ending position |
|---|---|---|
| HUMPFK_T1 (SEQ ID NO: 1077) | 8278 | 8303 |
| HUMPFK_T2 (SEQ ID NO: 1078) | 2303 | 2328 |
| HUMPFK_T4 (SEQ ID NO: 1079) | 2040 | 2065 |
| HUMPFK_T5 (SEQ ID NO: 1080) | 2223 | 2248 |
| HUMPFK_T6 (SEQ ID NO: 1081) | 7653 | 7678 |
| HUMPFK_T7 (SEQ ID NO: 1082) | 8786 | 8811 |
| HUMPFK_T8 (SEQ ID NO: 1083) | 6224 | 6249 |
| HUMPFK_T11 (SEQ ID NO: 1084) | 5499 | 5524 |
| HUMPFK_T12 (SEQ ID NO: 1085) | 3298 | 3323 |
| HUMPFK_T13 (SEQ ID NO: 1086) | 4065 | 4090 |
| HUMPFK_T14 (SEQ ID NO: 1087) | 7028 | 7053 |
| HUMPFK_T15 (SEQ ID NO: 1088) | 3440 | 3465 |
| HUMPFK_T16 (SEQ ID NO: 1089) | 2128 | 2153 |
| HUMPFK_T18 (SEQ ID NO: 1090) | 2972 | 2997 |
| HUMPFK_T26 (SEQ ID NO: 1091) | 2128 | 2153 |
| HUMPFK_T27 (SEQ ID NO: 1092) | 2128 | 2153 |
| HUMPFK_T30 (SEQ ID NO: 1093) | 2128 | 2153 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node__74 (SEQ ID NO:1146) according to the present invention is supported by 159 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1087 below describes the starting and ending position of this segment on each transcript.

TABLE 1087

Segment location on transcripts

| Transcript name | Segment starting position | Segment ending position |
|---|---|---|
| HUMPFK_T1 (SEQ ID NO: 1077) | 8304 | 8377 |
| HUMPFK_T2 (SEQ ID NO: 1078) | 2329 | 2402 |
| HUMPFK_T4 (SEQ ID NO: 1079) | 2066 | 2139 |
| HUMPFK_T5 (SEQ ID NO: 1080) | 2249 | 2322 |
| HUMPFK_T6 (SEQ ID NO: 1081) | 7679 | 7752 |
| HUMPFK_T7 (SEQ ID NO: 1082) | 8812 | 8885 |
| HUMPFK_T8 (SEQ ID NO: 1083) | 6250 | 6323 |
| HUMPFK_T11 (SEQ ID NO: 1084) | 5525 | 5598 |
| HUMPFK_T12 (SEQ ID NO: 1085) | 3324 | 3397 |
| HUMPFK_T13 (SEQ ID NO: 1086) | 4091 | 4164 |
| HUMPFK_T14 (SEQ ID NO: 1087) | 7054 | 7127 |
| HUMPFK_T15 (SEQ ID NO: 1088) | 3466 | 3539 |
| HUMPFK_T16 (SEQ ID NO: 1089) | 2154 | 2227 |
| HUMPFK_T18 (SEQ ID NO: 1090) | 2998 | 3071 |
| HUMPFK_T26 (SEQ ID NO: 1091) | 2154 | 2227 |
| HUMPFK_T27 (SEQ ID NO: 1092) | 2154 | 2227 |
| HUMPFK_T30 (SEQ ID NO: 1093) | 2154 | 2227 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_PS, HUMPFK_P8, HUMPFK_P9, HUMPFK_P10 and HUMPFK_P13, since it is in the coding region for the corresponding transcript.

Segment cluster HUMPFK_node__78 (SEQ ID NO:1147) according to the present invention is supported by 155 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30

(SEQ ID NO:1093). Table 1088 below describes the starting and ending position of this segment on each transcript.

TABLE 1088

Segment location on transcripts

| Transcript name | Segment starting position | Segment ending position |
|---|---|---|
| HUMPFK_T1 (SEQ ID NO: 1077) | 8378 | 8457 |
| HUMPFK_T2 (SEQ ID NO: 1078) | 2403 | 2482 |
| HUMPFK_T4 (SEQ ID NO: 1079) | 2140 | 2219 |
| HUMPFK_T5 (SEQ ID NO: 1080) | 2323 | 2402 |
| HUMPFK_T6 (SEQ ID NO: 1081) | 7753 | 7832 |
| HUMPFK_T7 (SEQ ID NO: 1082) | 8886 | 8965 |
| HUMPFK_T8 (SEQ ID NO: 1083) | 6324 | 6403 |
| HUMPFK_T11 (SEQ ID NO: 1084) | 5599 | 5678 |
| HUMPFK_T12 (SEQ ID NO: 1085) | 3398 | 3477 |
| HUMPFK_T13 (SEQ ID NO: 1086) | 4165 | 4244 |
| HUMPFK_T14 (SEQ ID NO: 1087) | 7128 | 7207 |
| HUMPFK_T15 (SEQ ID NO: 1088) | 3540 | 3619 |
| HUMPFK_T16 (SEQ ID NO: 1089) | 2228 | 2307 |
| HUMPFK_T18 (SEQ ID NO: 1090) | 3072 | 3151 |
| HUMPFK_T26 (SEQ ID NO: 1091) | 2228 | 2307 |
| HUMPFK_T27 (SEQ ID NO: 1092) | 2228 | 2307 |
| HUMPFK_T30 (SEQ ID NO: 1093) | 2228 | 2307 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1089.

TABLE 1089

Oligonucleotides related to this segment

| Oligonucleotide name | Overexpressed in cancers | Chip reference |
|---|---|---|
| HUMPFK_0_13_0 | lung malignant tumors | LUN |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node_79 (SEQ ID NO:1148) according to the present invention can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088), HUMPFK_T16 (SEQ ID NO:1089), HUMPFK_T18 (SEQ ID NO:1090), HUMPFK_T26 (SEQ ID NO:1091), HUMPFK_T27 (SEQ ID NO:1092) and HUMPFK_T30 (SEQ ID NO:1093). Table 1090 below describes the starting and ending position of this segment on each transcript.

TABLE 1090

Segment location on transcripts

| Transcript name | Segment starting position | Segment ending position |
|---|---|---|
| HUMPFK_T1 (SEQ ID NO: 1077) | 8458 | 8480 |
| HUMPFK_T2 (SEQ ID NO: 1078) | 2483 | 2505 |
| HUMPFK_T4 (SEQ ID NO: 1079) | 2220 | 2242 |
| HUMPFK_T5 (SEQ ID NO: 1080) | 2403 | 2425 |
| HUMPFK_T6 (SEQ ID NO: 1081) | 7833 | 7855 |
| HUMPFK_T7 (SEQ ID NO: 1082) | 8966 | 8988 |
| HUMPFK_T8 (SEQ ID NO: 1083) | 6404 | 6426 |
| HUMPFK_T11 (SEQ ID NO: 1084) | 5679 | 5701 |
| HUMPFK_T12 (SEQ ID NO: 1085) | 3478 | 3500 |
| HUMPFK_T13 (SEQ ID NO: 1086) | 4245 | 4267 |
| HUMPFK_T14 (SEQ ID NO: 1087) | 7208 | 7230 |
| HUMPFK_T15 (SEQ ID NO: 1088) | 3620 | 3642 |
| HUMPFK_T16 (SEQ ID NO: 1089) | 2308 | 2330 |
| HUMPFK_T18 (SEQ ID NO: 1090) | 3152 | 3174 |
| HUMPFK_T26 (SEQ ID NO: 1091) | 2308 | 2330 |
| HUMPFK_T27 (SEQ ID NO: 1092) | 2308 | 2330 |
| HUMPFK_T30 (SEQ ID NO: 1093) | 2308 | 2330 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1091.

TABLE 1091

Oligonucleotides related to this segment

| Oligonucleotide name | Overexpressed in cancers | Chip reference |
|---|---|---|
| HUMPFK_0_13_0 | lung malignant tumors | LUN |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8, HUMPFK_P9, HUMPFK_P10 and HUMPFK_P13, since it is in the coding region for the corresponding transcript.

Segment cluster HUMPFK_node_81 (SEQ ID NO:1149) according to the present invention is supported by 137 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088) and HUMPFK_T18 (SEQ ID NO:1090). Table 1092 below describes the starting and ending position of this segment on each transcript.

TABLE 1092

Segment location on transcripts

| Transcript name | Segment starting position | Segment ending position |
|---|---|---|
| HUMPFK_T1 (SEQ ID NO: 1077) | 8481 | 8575 |
| HUMPFK_T2 (SEQ ID NO: 1078) | 2506 | 2600 |
| HUMPFK_T4 (SEQ ID NO: 1079) | 2243 | 2337 |
| HUMPFK_T5 (SEQ ID NO: 1080) | 2426 | 2520 |
| HUMPFK_T6 (SEQ ID NO: 1081) | 7856 | 7950 |
| HUMPFK_T7 (SEQ ID NO: 1082) | 8989 | 9083 |
| HUMPFK_T8 (SEQ ID NO: 1083) | 6427 | 6521 |
| HUMPFK_T11 (SEQ ID NO: 1084) | 5702 | 5796 |
| HUMPFK_T12 (SEQ ID NO: 1085) | 3501 | 3595 |
| HUMPFK_T13 (SEQ ID NO: 1086) | 4268 | 4362 |
| HUMPFK_T14 (SEQ ID NO: 1087) | 7231 | 7325 |
| HUMPFK_T15 (SEQ ID NO: 1088) | 3643 | 3737 |
| HUMPFK_T18 (SEQ ID NO: 1090) | 3175 | 3269 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8 and HUMPFK_P9, since it is in the coding region for the corresponding transcript.

Segment cluster HUMPFK_node_82 (SEQ ID NO:1150) according to the present invention is supported by 133 libraries. The number of libraries was determined as previously described. This segment can be found in the following transcript(s): HUMPFK_T1 (SEQ ID NO:1077), HUMPFK_T2 (SEQ ID NO:1078), HUMPFK_T4 (SEQ ID NO:1079), HUMPFK_T5 (SEQ ID NO:1080), HUMPFK_T6 (SEQ ID NO:1081), HUMPFK_T7 (SEQ ID NO:1082), HUMPFK_T8 (SEQ ID NO:1083), HUMPFK_T11 (SEQ ID NO:1084), HUMPFK_T12 (SEQ ID NO:1085), HUMPFK_T13 (SEQ ID NO:1086), HUMPFK_T14 (SEQ ID NO:1087), HUMPFK_T15 (SEQ ID NO:1088) and HUMPFK_T18 (SEQ ID NO:1090). Table 1093 below describes the starting and ending position of this segment on each transcript.

TABLE 1093

Segment location on transcripts

| Transcript name | Segment starting position | Segment ending position |
|---|---|---|
| HUMPFK_T1 (SEQ ID NO: 1077) | 8576 | 8641 |
| HUMPFK_T2 (SEQ ID NO: 1078) | 2601 | 2666 |
| HUMPFK_T4 (SEQ ID NO: 1079) | 2338 | 2403 |
| HUMPFK_T5 (SEQ ID NO: 1080) | 2521 | 2586 |
| HUMPFK_T6 (SEQ ID NO: 1081) | 7951 | 8016 |
| HUMPFK_T7 (SEQ ID NO: 1082) | 9084 | 9149 |
| HUMPFK_T8 (SEQ ID NO: 1083) | 6522 | 6587 |
| HUMPFK_T11 (SEQ ID NO: 1084) | 5797 | 5862 |
| HUMPFK_T12 (SEQ ID NO: 1085) | 3596 | 3661 |
| HUMPFK_T13 (SEQ ID NO: 1086) | 4363 | 4428 |
| HUMPFK_T14 (SEQ ID NO: 1087) | 7326 | 7391 |
| HUMPFK_T15 (SEQ ID NO: 1088) | 3738 | 3803 |
| HUMPFK_T18 (SEQ ID NO: 1090) | 3270 | 3335 |

This segment can be found in both coding and non-coding regions of transcript(s) as follows. The segment can be found in a non-coding region of transcript(s) that are related to the following protein(s): HUMPFK_P2, HUMPFK_P6 and HUMPFK_P7. This segment can also be found in the following protein(s): HUMPFK_P3, HUMPFK_P4, HUMPFK_P5, HUMPFK_P8 and HUMPFK_P9, since it is in the coding region for the corresponding transcript.

Segment cluster HUMPFK_node_87 (SEQ ID NO:1151) according to the present invention is supported by 1 libraries. The number of libraries was determined as previously described. This segment can be found in the following transcript(s): HUMPFK_T45 (SEQ ID NO:1094). Table 1094 below describes the starting and ending position of this segment on each transcript.

TABLE 1094

Segment location on transcripts

| Transcript name | Segment starting position | Segment ending position |
|---|---|---|
| HUMPFK_T45 (SEQ ID NO: 1094) | 1 | 104 |

The previously-described transcripts for these segment(s) do not code for protein.

Segment cluster HUMPFK_node_89 (SEQ ID NO:1152) according to the present invention is supported by 4 libraries. The number of libraries was determined as previously described. This segment can be found in the following transcript(s): HUMPFK_T16 (SEQ ID NO:1089), HUMPFK_T26 (SEQ ID NO:1091) and HUMPFK_T45 (SEQ ID NO:1094). Table 1095 below describes the starting and ending position of this segment on each transcript.

TABLE 1095

Segment location on transcripts

| Transcript name | Segment starting position | Segment ending position |
|---|---|---|
| HUMPFK_T16 (SEQ ID NO: 1089) | 2331 | 2443 |
| HUMPFK_T26 (SEQ ID NO: 1091) | 2331 | 2443 |
| HUMPFK_T45 (SEQ ID NO: 1094) | 105 | 217 |

This segment can be found in the following protein(s): HUMPFK_P10.

Segment cluster HUMPFK_node_101 (SEQ ID NO:1153) according to the present invention can be found in the following transcript(s): HUMPFK_T30 (SEQ ID NO:1093). Table 1096 below describes the starting and ending position of this segment on each transcript.

TABLE 1096

Segment location on transcripts

| Transcript name | Segment starting position | Segment ending position |
|---|---|---|
| HUMPFK_T30 (SEQ ID NO: 1093) | 2653 | 2657 |

This segment can be found in a non-coding region of transcript(s) that are related to the following protein(s): HUMPFK_P13.

Segment cluster HUMPFK_node_103 (SEQ ID NO:1154) according to the present invention can be found in the following transcript(s): HUMPFK_T26 (SEQ ID NO:1091) and HUMPFK_T27 (SEQ ID NO:1092). Table 1097 below describes the starting and ending position of this segment on each transcript.

TABLE 1097

Segment location on transcripts

| Transcript name | Segment starting position | Segment ending position |
|---|---|---|
| HUMPFK_T26 (SEQ ID NO: 1091) | 3520 | 3544 |
| HUMPFK_T27 (SEQ ID NO: 1092) | 3407 | 3431 |

This segment can be found in a non-coding region of transcript(s) that are related to the following protein(s): HUMPFK_P10 and HUMPFK_P13.

Description for Cluster HUMPRP0A

Cluster HUMPRP0A features 3 transcript(s) and 30 segment(s) of interest, the names for which are given in Tables 1098 and 1099, respectively, the sequences themselves are given at the end of the application. The selected protein variants are given in Table 1100.

TABLE 1098

Transcripts of interest
Transcript Name

HUMPRP0A_T3 (SEQ ID NO: 1155)
HUMPRP0A_T4 (SEQ ID NO: 1156)
HUMPRP0A_T5 (SEQ ID NO: 1157)

TABLE 1099

Segments of interest
Segment Name

HUMPRP0A_node_5 (SEQ ID NO: 1158)
HUMPRP0A_node_7 (SEQ ID NO: 1159)
HUMPRP0A_node_9 (SEQ ID NO: 1160)
HUMPRP0A_node_33 (SEQ ID NO: 1161)
HUMPRP0A_node_35 (SEQ ID NO: 1162)
HUMPRP0A_node_37 (SEQ ID NO: 1163)
HUMPRP0A_node_11 (SEQ ID NO: 1164)
HUMPRP0A_node_12 (SEQ ID NO: 1165)
HUMPRP0A_node_13 (SEQ ID NO: 1166)
HUMPRP0A_node_14 (SEQ ID NO: 1167)
HUMPRP0A_node_15 (SEQ ID NO: 1168)
HUMPRP0A_node_16 (SEQ ID NO: 1169)
HUMPRP0A_node_17 (SEQ ID NO: 1170)
HUMPRP0A_node_18 (SEQ ID NO: 1171)
HUMPRP0A_node_19 (SEQ ID NO: 1172)
HUMPRP0A_node_20 (SEQ ID NO: 1173)
HUMPRP0A_node_21 (SEQ ID NO: 1174)
HUMPRP0A_node_22 (SEQ ID NO: 1175)
HUMPRP0A_node_23 (SEQ ID NO: 1176)
HUMPRP0A_node_24 (SEQ ID NO: 1177)
HUMPRP0A_node_25 (SEQ ID NO: 1178)
HUMPRP0A_node_26 (SEQ ID NO: 1179)
HUMPRP0A_node_27 (SEQ ID NO: 1180)
HUMPRP0A_node_28 (SEQ ID NO: 1181)
HUMPRP0A_node_29 (SEQ ID NO: 1182)
HUMPRP0A_node_30 (SEQ ID NO: 1183)
HUMPRP0A_node_31 (SEQ ID NO: 1184)
HUMPRP0A_node_32 (SEQ ID NO: 1185)
HUMPRP0A_node_34 (SEQ ID NO: 1186)
HUMPRP0A_node_36 (SEQ ID NO: 1187)

TABLE 1100

Proteins of interest

| Protein Name | Corresponding Transcript(s) |
|---|---|
| HUMPRP0A_P1 | HUMPRP0A_T3 (SEQ ID NO: 1155); HUMPRP0A_T4 (SEQ ID NO: 1156); HUMPRP0A_T5 (SEQ ID NO: 1157) |

These sequences are variants of the known protein Major prion protein precursor (SwissProt accession identifier PRIO_HUMAN; known also according to the synonyms PrP; PrP27-30; PrP33-35C; ASCR; CD230 antigen), referred to herein as the previously known protein.

Protein Major prion protein precursor is known or believed to have the following function(s): The physiological function of PrP is not known. The sequence for protein Major prion protein precursor is given at the end of the application, as "Major prion protein precursor amino acid sequence". Known polymorphisms for this sequence are as shown in Table 1101.

TABLE 1101

Amino acid mutations for Known Protein

| SNP position(s) on amino acid sequence | Comment |
|---|---|
| 56-63 | Missing. /FTId = VAR_013763. |
| 102 | P -> L (in GSD and early-onset dementia). /FTId = VAR_006464. |
| 105 | P -> L (in GSD). /FTId = VAR_006465. |
| 117 | A -> V (linked to development of dementing Gerstmann-Straussler disease). /FTId = VAR_006466. |
| 129 | M -> V (polymorphism; determines the disease phenotype in patients who have a PrP mutation at position 178. Patients with Met develop FFI, those with Val develop CJD; dbSNP: 1799990). /FTId = VAR_006467. |
| 131 | G -> V (in GSD). /FTId = VAR_014264. |
| 171 | N -> S (in schizoaffective disorder). /FTId = VAR_006468. |
| 178 | D -> N (in FFI and CJD). /FTId = VAR_006469. |
| 180 | V -> I (in CJD). /FTId = VAR_006470. |
| 183 | T -> A (in familial spongiform encephalopathy). /FTId = VAR_006471. |
| 187 | H -> R (in GSD). /FTId = VAR_008746. |
| 188 | T -> K (in early-onset dementia; dementia associated to prion diseases). /FTId = VAR_008748. |
| 188 | T -> R. /FTId = VAR_008747. |
| 196 | E -> K (in CJD). /FTId = VAR_008749. |
| 198 | F -> S (in GSD; atypical form with neurofibrillary tangles). /FTId = VAR_006472. |
| 200 | E -> K (in CJD). /FTId = VAR_006473. |
| 202 | D -> N (in GSD). /FTId = VAR_008750. |
| 203 | V -> I (in CJD; it could be an extremely rare polymorphism). /FTId = VAR_008751. |
| 208 | R -> H (in CJD). /FTId = VAR_006474. |
| 210 | V -> I (in CJD). /FTId = VAR_006475. |
| 211 | E -> Q (in CJD). /FTId = VAR_008752. |
| 212 | Q -> P (in GSD). /FTId = VAR_008753. |
| 217 | Q -> R (in GSD; with neurofibrillary tangles). /FTId = VAR_006476. |
| 219 | E -> K (in dbSNP: 1800014). /FTId = VAR_006477. |
| 232 | M -> R (in CJD). /FTId = VAR_006478. |
| 238 | P -> S. /FTId = VAR_008754. |
| 118 | Missing |
| 227 | Q -> K |

Protein Major prion protein precursor localization is believed to be Attached to the membrane by a GPI-anchor.

The following GO Annotation(s) apply to the previously known protein. The following annotation(s) were found: metabolism, which are annotation(s) related to Biological Process.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMPRP0A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 29 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 29 and Table 1102. This cluster is overexpressed (at least at a minimum level) in the following pathological conditions: malignant tumors involving the lymph nodes.

TABLE 1102

Normal tissue distribution

| Name of Tissue | Number |
|---|---|
| Bladder | 287 |
| Bone | 498 |
| Brain | 779 |
| Colon | 63 |
| Epithelial | 130 |
| General | 277 |
| head and neck | 10 |
| Kidney | 112 |
| Liver | 4 |
| Lung | 159 |
| lymph nodes | 11 |
| Breast | 360 |
| bone marrow | 0 |
| Ovary | 36 |
| Pancreas | 55 |
| Prostate | 124 |
| Skin | 166 |
| Stomach | 109 |
| Thyroid | 25 |
| Uterus | 145 |

TABLE 1103

P values and ratios for expression in cancerous tissue

| Name of Tissue | P1 | P2 | SP1 | R3 | SP2 | R4 |
|---|---|---|---|---|---|---|
| bladder | 6.5e−01 | 6.9e−01 | 9.1e−01 | 0.5 | 9.9e−01 | 0.4 |
| bone | 4.9e−01 | 4.2e−01 | 9.5e−01 | 0.4 | 1 | 0.4 |
| brain | 5.7e−01 | 5.8e−01 | 1 | 0.1 | 1 | 0.1 |
| colon | 3.5e−01 | 3.6e−01 | 7.4e−01 | 1.0 | 5.9e−01 | 1.0 |
| epithelial | 7.0e−01 | 7.4e−01 | 9.9e−01 | 0.7 | 9.4e−01 | 0.8 |
| general | 8.9e−01 | 9.2e−01 | 1 | 0.3 | 1 | 0.3 |
| head and neck | 2.5e−01 | 4.1e−01 | 1 | 1.2 | 1 | 1.0 |
| kidney | 8.1e−01 | 8.3e−01 | 9.4e−01 | 0.6 | 5.3e−01 | 0.6 |
| liver | 9.2e−01 | 9.9e−02 | 1 | 0.9 | 3.7e−02 | 3.6 |
| lung | 7.2e−01 | 8.0e−01 | 7.9e−01 | 0.8 | 7.3e−01 | 0.7 |
| lymph nodes | 3.3e−01 | 6.1e−01 | 6.6e−03 | 4.1 | 3.7e−02 | 2.6 |
| breast | 8.0e−01 | 8.3e−01 | 1 | 0.3 | 1 | 0.2 |
| bone marrow | 4.3e−01 | 2.5e−01 | 1 | 2.1 | 2.3e−02 | 5.6 |
| ovary | 5.3e−01 | 4.4e−01 | 6.2e−01 | 1.2 | 5.7e−01 | 1.3 |
| pancreas | 1.4e−01 | 1.9e−01 | 3.0e−01 | 1.2 | 7.5e−02 | 1.3 |
| prostate | 6.8e−01 | 6.3e−01 | 5.6e−01 | 0.9 | 4.3e−01 | 0.9 |
| Skin | 4.6e−01 | 4.0e−01 | 6.1e−01 | 1.0 | 2.8e−01 | 0.7 |
| stomach | 6.1e−01 | 7.9e−01 | 3.7e−01 | 0.7 | 8.3e−01 | 0.6 |

TABLE 1103-continued

P values and ratios for expression in cancerous tissue

| Name of Tissue | P1 | P2 | SP1 | R3 | SP2 | R4 |
|---|---|---|---|---|---|---|
| Thyroid | 6.3e−01 | 6.3e−01 | 1 | 1.1 | 1 | 1.1 |
| uterus | 3.5e−01 | 4.4e−01 | 8.9e−01 | 0.6 | 9.6e−01 | 0.5 |

As noted above, cluster HUMPRP0A features 30 segment (s), which were listed in Table 1099 above and for which the sequence(s) are given at the end of the application. These segment(s) are portions of nucleic acid sequence(s) which are described herein separately because they are of particular interest. A description of each segment according to the present invention is now provided.

Segment cluster HUMPRP0A_node_5 (SEQ ID NO:1158) according to the present invention is supported by 4 libraries. The number of libraries was determined as previously described. This segment can be found in the following transcript(s): HUMPRP0A_T4 (SEQ ID NO:1156) and HUMPRP0A_T5 (SEQ ID NO:1157). Table 1104 below describes the starting and ending position of this segment on each transcript.

TABLE 1104

Segment location on transcripts

| Transcript name | Segment starting position | Segment ending position |
|---|---|---|
| HUMPRP0A_T4 (SEQ ID NO: 1156) | 1 | 207 |
| HUMPRP0A_T5 (SEQ ID NO: 1157) | 1 | 207 |

This segment can be found in a non-coding region of transcript(s) that are related to the following protein(s): HUMPRP0A_P1.

Segment cluster HUMPRP0A_node_7 (SEQ ID NO:1159) according to the present invention is supported by 1 libraries. The number of libraries was determined as previously described. This segment can be found in the following transcript(s): HUMPRP0A_T5 (SEQ ID NO:1157). Table 1105 below describes the starting and ending position of this segment on each transcript.

TABLE 1105

Segment location on transcripts

| Transcript name | Segment starting position | Segment ending position |
|---|---|---|
| HUMPRP0A_T5 (SEQ ID NO: 1157) | 208 | 388 |

This segment can be found in a non-coding region of transcript(s) that are related to the following protein(s): HUMPRP0A_P1.

Segment cluster HUMPRP0A_node_9 (SEQ ID NO:1160) according to the present invention is supported by 5 libraries. The number of libraries was determined as previously described. This segment can be found in the following transcript(s): HUMPRP0A_T3 (SEQ ID NO:1155). Table 1106 below describes the starting and ending position of this segment on each transcript.

TABLE 1106

Segment location on transcripts

| Transcript name | Segment starting position | Segment ending position |
|---|---|---|
| HUMPRP0A_T3 (SEQ ID NO: 1155) | 1 | 1491 |

This segment can be found in a non-coding region of transcript(s) that are related to the following protein(s): HUMPRP0A_P1.

Segment cluster HUMPRP0A_node_33 (SEQ ID NO:1161) according to the present invention is supported by 430 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1107 below describes the starting and ending position of this segment on each transcript.

TABLE 1107

Segment location on transcripts

| Transcript name | Segment starting position | Segment ending position |
|---|---|---|
| HUMPRP0A_T3 (SEQ ID NO: 1155) | 2071 | 3133 |
| HUMPRP0A_T4 (SEQ ID NO: 1156) | 787 | 1849 |
| HUMPRP0A_T5 (SEQ ID NO: 1157) | 968 | 2030 |

This segment can be found in the following protein(s): HUMPRP0A_P1.

Segment cluster HUMPRP0A_node_35 (SEQ ID NO:1162) according to the present invention is supported by 356 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1108 below describes the starting and ending position of this segment on each transcript.

TABLE 1108

Segment location on transcripts

| Transcript name | Segment starting position | Segment ending position |
|---|---|---|
| HUMPRP0A_T3 (SEQ ID NO: 1155) | 3152 | 3435 |
| HUMPRP0A_T4 (SEQ ID NO: 1156) | 1868 | 2151 |
| HUMPRP0A_T5 (SEQ ID NO: 1157) | 2049 | 2332 |

This segment can be found in a non-coding region of transcript(s) that are related to the following protein(s): HUMPRP0A_P1.

Segment cluster HUMPRP0A_node_37 (SEQ ID NO:1163) according to the present invention is supported by 309 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1109 below describes the starting and ending position of this segment on each transcript.

TABLE 1109

Segment location on transcripts

| Transcript name | Segment starting position | Segment ending position |
|---|---|---|
| HUMPRP0A_T3 (SEQ ID NO: 1155) | 3489 | 3874 |
| HUMPRP0A_T4 (SEQ ID NO: 1156) | 2205 | 2590 |
| HUMPRP0A_T5 (SEQ ID NO: 1157) | 2386 | 2771 |

This segment can be found in a non-coding region of transcript(s) that are related to the following protein(s): HUMPRP0A_P1.

According to an optional embodiment of the present invention, short segments related to the above cluster are also provided. These segments are up to about 120 bp in length, and so are included in a separate description.

Segment cluster HUMPRP0A_node_11 (SEQ ID NO:1164) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1110 below describes the starting and ending position of this segment on each transcript.

TABLE 1110

Segment location on transcripts

| Transcript name | Segment starting position | Segment ending position |
|---|---|---|
| HUMPRP0A_T3 (SEQ ID NO: 1155) | 1492 | 1510 |
| HUMPRP0A_T4 (SEQ ID NO: 1156) | 208 | 226 |
| HUMPRP0A_T5 (SEQ ID NO: 1157) | 389 | 407 |

This segment can be found in the following protein(s): HUMPRP0A_P1.

Segment cluster HUMPRP0A_node_12 (SEQ ID NO:1165) according to the present invention is supported by 141 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1111 below describes the starting and ending position of this segment on each transcript.

TABLE 1111

Segment location on transcripts

| Transcript name | Segment starting position | Segment ending position |
|---|---|---|
| HUMPRP0A_T3 (SEQ ID NO: 1155) | 1511 | 1545 |
| HUMPRP0A_T4 (SEQ ID NO: 1156) | 227 | 261 |
| HUMPRP0A_T5 (SEQ ID NO: 1157) | 408 | 442 |

This segment can be found in the following protein(s): HUMPRP0A_P1.

Segment cluster HUMPRP0A_node_13 (SEQ ID NO:1166) according to the present invention is supported by 146 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5

(SEQ ID NO:1157). Table 1112 below describes the starting and ending position of this segment on each transcript.

TABLE 1112

Segment location on transcripts

| Transcript name | Segment starting position | Segment ending position |
|---|---|---|
| HUMPRP0A_T3 (SEQ ID NO: 1155) | 1546 | 1598 |
| HUMPRP0A_T4 (SEQ ID NO: 1156) | 262 | 314 |
| HUMPRP0A_T5 (SEQ ID NO: 1157) | 443 | 495 |

This segment can be found in the following protein(s): HUMPRP0A_P1.

Segment cluster HUMPRP0A_node_14 (SEQ ID NO:1167) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1113 below describes the starting and ending position of this segment on each transcript.

TABLE 1113

Segment location on transcripts

| Transcript name | Segment starting position | Segment ending position |
|---|---|---|
| HUMPRP0A_T3 (SEQ ID NO: 1155) | 1599 | 1604 |
| HUMPRP0A_T4 (SEQ ID NO: 1156) | 315 | 320 |
| HUMPRP0A_T5 (SEQ ID NO: 1157) | 496 | 501 |

This segment can be found in the following protein(s): HUMPRP0A_P1.

Segment cluster HUMPRP0A_node_15 (SEQ ID NO:1168) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1114 below describes the starting and ending position of this segment on each transcript.

TABLE 1114

Segment location on transcripts

| Transcript name | Segment starting position | Segment ending position |
|---|---|---|
| HUMPRP0A_T3 (SEQ ID NO: 1155) | 1605 | 1608 |
| HUMPRP0A_T4 (SEQ ID NO: 1156) | 321 | 324 |
| HUMPRP0A_T5 (SEQ ID NO: 1157) | 502 | 505 |

This segment can be found in the following protein(s): HUMPRP0A_P1.

Segment cluster HUMPRP0A_node_16 (SEQ ID NO:1169) according to the present invention is supported by 145 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1115 below describes the starting and ending position of this segment on each transcript.

TABLE 1115

Segment location on transcripts

| Transcript name | Segment starting position | Segment ending position |
|---|---|---|
| HUMPRP0A_T3 (SEQ ID NO: 1155) | 1609 | 1661 |
| HUMPRP0A_T4 (SEQ ID NO: 1156) | 325 | 377 |
| HUMPRP0A_T5 (SEQ ID NO: 1157) | 506 | 558 |

This segment can be found in the following protein(s): HUMPRP0A_P1.

Segment cluster HUMPRP0A_node_17 (SEQ ID NO:1170) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1116 below describes the starting and ending position of this segment on each transcript.

TABLE 1116

Segment location on transcripts

| Transcript name | Segment starting position | Segment ending position |
|---|---|---|
| HUMPRP0A_T3 (SEQ ID NO: 1155) | 1662 | 1668 |
| HUMPRP0A_T4 (SEQ ID NO: 1156) | 378 | 384 |
| HUMPRP0A_T5 (SEQ ID NO: 1157) | 559 | 565 |

This segment can be found in the following protein(s): HUMPRP0A_P1.

Segment cluster HUMPRP0A_node_18 (SEQ ID NO:1171) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1117 below describes the starting and ending position of this segment on each transcript.

TABLE 1117

Segment location on transcripts

| Transcript name | Segment starting position | Segment ending position |
|---|---|---|
| HUMPRP0A_T3 (SEQ ID NO: 1155) | 1669 | 1685 |
| HUMPRP0A_T4 (SEQ ID NO: 1156) | 385 | 401 |
| HUMPRP0A_T5 (SEQ ID NO: 1157) | 566 | 582 |

This segment can be found in the following protein(s): HUMPRP0A_P1.

Segment cluster HUMPRP0A_node_19 (SEQ ID NO:1172) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1118 below describes the starting and ending position of this segment on each transcript.

TABLE 1118

Segment location on transcripts

| Transcript name | Segment starting position | Segment ending position |
|---|---|---|
| HUMPRP0A_T3 (SEQ ID NO: 1155) | 1686 | 1692 |
| HUMPRP0A_T4 (SEQ ID NO: 1156) | 402 | 408 |
| HUMPRP0A_T5 (SEQ ID NO: 1157) | 583 | 589 |

This segment can be found in the following protein(s): HUMPRP0A_P1.

Segment cluster HUMPRP0A_node_20 (SEQ ID NO:1173) according to the present invention is supported by 140 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1119 below describes the starting and ending position of this segment on each transcript.

TABLE 1119

Segment location on transcripts

| Transcript name | Segment starting position | Segment ending position |
|---|---|---|
| HUMPRP0A_T3 (SEQ ID NO: 1155) | 1693 | 1733 |
| HUMPRP0A_T4 (SEQ ID NO: 1156) | 409 | 449 |
| HUMPRP0A_T5 (SEQ ID NO: 1157) | 590 | 630 |

This segment can be found in the following protein(s): HUMPRP0A_P1.

Segment cluster HUMPRP0A_node_21 (SEQ ID NO:1174) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1120 below describes the starting and ending position of this segment on each transcript.

TABLE 1120

Segment location on transcripts

| Transcript name | Segment starting position | Segment ending position |
|---|---|---|
| HUMPRP0A_T3 (SEQ ID NO: 1155) | 1734 | 1750 |
| HUMPRP0A_T4 (SEQ ID NO: 1156) | 450 | 466 |
| HUMPRP0A_T5 (SEQ ID NO: 1157) | 631 | 647 |

This segment can be found in the following protein(s): HUMPRP0A_P1.

Segment cluster HUMPRP0A_node_22 (SEQ ID NO:1175) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1121 below describes the starting and ending position of this segment on each transcript.

TABLE 1121

Segment location on transcripts

| Transcript name | Segment starting position | Segment ending position |
|---|---|---|
| HUMPRP0A_T3 (SEQ ID NO: 1155) | 1751 | 1757 |
| HUMPRP0A_T4 (SEQ ID NO: 1156) | 467 | 473 |
| HUMPRP0A_T5 (SEQ ID NO: 1157) | 648 | 654 |

This segment can be found in the following protein(s): HUMPRP0A_P1.

Segment cluster HUMPRP0A_node_23 (SEQ ID NO:1176) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1122 below describes the starting and ending position of this segment on each transcript.

TABLE 1122

Segment location on transcripts

| Transcript name | Segment starting position | Segment ending position |
|---|---|---|
| HUMPRP0A_T3 (SEQ ID NO: 1155) | 1758 | 1764 |
| HUMPRP0A_T4 (SEQ ID NO: 1156) | 474 | 480 |
| HUMPRP0A_T5 (SEQ ID NO: 1157) | 655 | 661 |

This segment can be found in the following protein(s): HUMPRP0A_P1.

Segment cluster HUMPRP0A_node_24 (SEQ ID NO:1177) according to the present invention is supported by 117 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1123 below describes the starting and ending position of this segment on each transcript.

TABLE 1123

Segment location on transcripts

| Transcript name | Segment starting position | Segment ending position |
|---|---|---|
| HUMPRP0A_T3 (SEQ ID NO: 1155) | 1765 | 1825 |
| HUMPRP0A_T4 (SEQ ID NO: 1156) | 481 | 541 |
| HUMPRP0A_T5 (SEQ ID NO: 1157) | 662 | 722 |

This segment can be found in the following protein(s): HUMPRP0A_P1.

Segment cluster HUMPRP0A_node_25 (SEQ ID NO:1178) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1124 below describes the starting and ending position of this segment on each transcript.

TABLE 1124

Segment location on transcripts

| Transcript name | Segment starting position | Segment ending position |
|---|---|---|
| HUMPRP0A_T3 (SEQ ID NO: 1155) | 1826 | 1834 |
| HUMPRP0A_T4 (SEQ ID NO: 1156) | 542 | 550 |
| HUMPRP0A_T5 (SEQ ID NO: 1157) | 723 | 731 |

This segment can be found in the following protein(s): HUMPRP0A_P1.

Segment cluster HUMPRP0A_node_26 (SEQ ID NO:1179) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1125 below describes the starting and ending position of this segment on each transcript.

TABLE 1125

Segment location on transcripts

| Transcript name | Segment starting position | Segment ending position |
|---|---|---|
| HUMPRP0A_T3 (SEQ ID NO: 1155) | 1835 | 1853 |
| HUMPRP0A_T4 (SEQ ID NO: 1156) | 551 | 569 |
| HUMPRP0A_T5 (SEQ ID NO: 1157) | 732 | 750 |

This segment can be found in the following protein(s): HUMPRP0A_P1.

Segment cluster HUMPRP0A_node_27 (SEQ ID NO:1180) according to the present invention is supported by 128 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1126 below describes the starting and ending position of this segment on each transcript.

TABLE 1126

Segment location on transcripts

| Transcript name | Segment starting position | Segment ending position |
|---|---|---|
| HUMPRP0A_T3 (SEQ ID NO: 1155) | 1854 | 1919 |
| HUMPRP0A_T4 (SEQ ID NO: 1156) | 570 | 635 |
| HUMPRP0A_T5 (SEQ ID NO: 1157) | 751 | 816 |

This segment can be found in the following protein(s): HUMPRP0A_P1.

Segment cluster HUMPRP0A_node_28 (SEQ ID NO:1181) according to the present invention is supported by 132 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:157). Table 1127 below describes the starting and ending position of this segment on each transcript.

TABLE 1127

Segment location on transcripts

| Transcript name | Segment starting position | Segment ending position |
|---|---|---|
| HUMPRP0A_T3 (SEQ ID NO: 1155) | 1920 | 1954 |
| HUMPRP0A_T4 (SEQ ID NO: 1156) | 636 | 670 |
| HUMPRP0A_T5 (SEQ ID NO: 1157) | 817 | 851 |

This segment can be found in the following protein(s): HUMPRP0A_P1.

Segment cluster HUMPRP0A_node_29 (SEQ ID NO:1182) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1128 below describes the starting and ending position of this segment on each transcript.

TABLE 1128

Segment location on transcripts

| Transcript name | Segment starting position | Segment ending position |
|---|---|---|
| HUMPRP0A_T3 (SEQ ID NO: 1155) | 1955 | 1978 |
| HUMPRP0A_T4 (SEQ ID NO: 1156) | 671 | 694 |
| HUMPRP0A_T5 (SEQ ID NO: 1157) | 852 | 875 |

This segment can be found in the following protein(s): HUMPRP0A_P1.

Segment cluster HUMPRP0A_node_30 (SEQ ID NO:1183) according to the present invention is supported by 144 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1129 below describes the starting and ending position of this segment on each transcript.

TABLE 1129

Segment location on transcripts

| Transcript name | Segment starting position | Segment ending position |
|---|---|---|
| HUMPRP0A_T3 (SEQ ID NO: 1155) | 1979 | 2008 |
| HUMPRP0A_T4 (SEQ ID NO: 1156) | 695 | 724 |
| HUMPRP0A_T5 (SEQ ID NO: 1157) | 876 | 905 |

This segment can be found in the following protein(s): HUMPRP0A_P1.

Segment cluster HUMPRP0A_node_31 (SEQ ID NO:1184) according to the present invention is supported by 147 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1130 below describes the starting and ending position of this segment on each transcript.

TABLE 1130

Segment location on transcripts

| Transcript name | Segment starting position | Segment ending position |
|---|---|---|
| HUMPRP0A_T3 (SEQ ID NO: 1155) | 2009 | 2044 |
| HUMPRP0A_T4 (SEQ ID NO: 1156) | 725 | 760 |
| HUMPRP0A_T5 (SEQ ID NO: 1157) | 906 | 941 |

This segment can be found in the following protein(s): HUMPRP0A_P1.

Segment cluster HUMPRP0A_node_32 (SEQ ID NO:1185) according to the present invention is supported by 138 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1131 below describes the starting and ending position of this segment on each transcript.

TABLE 1131

Segment location on transcripts

| Transcript name | Segment starting position | Segment ending position |
|---|---|---|
| HUMPRP0A_T3 (SEQ ID NO: 1155) | 2045 | 2070 |
| HUMPRP0A_T4 (SEQ ID NO: 1156) | 761 | 786 |
| HUMPRP0A_T5 (SEQ ID NO: 1157) | 942 | 967 |

This segment can be found in the following protein(s): HUMPRP0A_P1.

Segment cluster HUMPRP0A_node_34 (SEQ ID NO:1186) according to the present invention can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1132 below describes the starting and ending position of this segment on each transcript.

TABLE 1132

Segment location on transcripts

| Transcript name | Segment starting position | Segment ending position |
|---|---|---|
| HUMPRP0A_T3 (SEQ ID NO: 1155) | 3134 | 3151 |
| HUMPRP0A_T4 (SEQ ID NO: 1156) | 1850 | 1867 |
| HUMPRP0A_T5 (SEQ ID NO: 1157) | 2031 | 2048 |

This segment can be found in a non-coding region of transcript(s) that are related to the following protein(s): HUMPRP0A_P1.

Segment cluster HUMPRP0A_node_36 (SEQ ID NO:1187) according to the present invention is supported by 258 libraries. The number of libraries was determined as previously described. This segment can be found in the following transcript(s): HUMPRP0A_T3 (SEQ ID NO:1155), HUMPRP0A_T4 (SEQ ID NO:1156) and HUMPRP0A_T5 (SEQ ID NO:1157). Table 1133 below describes the starting and ending position of this segment on each transcript.

TABLE 1133

Segment location on transcripts

| Transcript name | Segment starting position | Segment ending position |
|---|---|---|
| HUMPRP0A_T3 (SEQ ID NO: 1155) | 3436 | 3488 |
| HUMPRP0A_T4 (SEQ ID NO: 1156) | 2152 | 2204 |
| HUMPRP0A_T5 (SEQ ID NO: 1157) | 2333 | 2385 |

This segment can be found in a non-coding region of transcript(s) that are related to the following protein(s): HUMPRP0A_P1.

Description for Cluster HUMTIA1E

Cluster HUMTIA1E features 41 transcript(s) and 46 segment(s) of interest, the names for which are given in Tables 1134 and 1135, respectively, the sequences themselves are given at the end of the application. The selected protein variants are given in Table 1136.

TABLE 1134

Transcripts of interest
Transcript Name

HUMTIA1E_T0 (SEQ ID NO: 1188)
HUMTIA1E_T1 (SEQ ID NO: 1189)
HUMTIA1E_T2 (SEQ ID NO: 1190)
HUMTIA1E_T3 (SEQ ID NO: 1191)
HUMTIA1E_T6 (SEQ ID NO: 1192)
HUMTIA1E_T8 (SEQ ID NO: 1193)
HUMTIA1E_T9 (SEQ ID NO: 1194)
HUMTIA1E_T10 (SEQ ID NO: 1195)
HUMTIA1E_T11 (SEQ ID NO: 1196)
HUMTIA1E_T12 (SEQ ID NO: 1197)
HUMTIA1E_T13 (SEQ ID NO: 1198)
HUMTIA1E_T14 (SEQ ID NO: 1199)
HUMTIA1E_T15 (SEQ ID NO: 1200)
HUMTIA1E_T16 (SEQ ID NO: 1201)
HUMTIA1E_T17 (SEQ ID NO: 1202)
HUMTIA1E_T18 (SEQ ID NO: 1203)
HUMTIA1E_T19 (SEQ ID NO: 1204)
HUMTIA1E_T20 (SEQ ID NO: 1205)
HUMTIA1E_T21 (SEQ ID NO: 1206)
HUMTIA1E_T22 (SEQ ID NO: 1207)
HUMTIA1E_T23 (SEQ ID NO: 1208)
HUMTIA1E_T24 (SEQ ID NO: 1209)
HUMTIA1E_T26 (SEQ ID NO: 1210)
HUMTIA1E_T27 (SEQ ID NO: 1211)
HUMTIA1E_T28 (SEQ ID NO: 1212)
HUMTIA1E_T29 (SEQ ID NO: 1213)
HUMTIA1E_T32 (SEQ ID NO: 1214)
HUMTIA1E_T37 (SEQ ID NO: 1215)
HUMTIA1E_T40 (SEQ ID NO: 1216)
HUMTIA1E_T45 (SEQ ID NO: 1217)
HUMTIA1E_T46 (SEQ ID NO: 1218)
HUMTIA1E_T47 (SEQ ID NO: 1219)
HUMTIA1E_T48 (SEQ ID NO: 1220)
HUMTIA1E_T50 (SEQ ID NO: 1221)
HUMTIA1E_T51 (SEQ ID NO: 1222)
HUMTIA1E_T52 (SEQ ID NO: 1223)
HUMTIA1E_T55 (SEQ ID NO: 1224)
HUMTIA1E_T56 (SEQ ID NO: 1225)
HUMTIA1E_T57 (SEQ ID NO: 1226)
HUMTIA1E_T58 (SEQ ID NO: 1227)
HUMTIA1E_T60 (SEQ ID NO: 1228)

TABLE 1135

Segments of interest
Segment Name

HUMTIA1E_node_14 (SEQ ID NO: 1229)
HUMTIA1E_node_16 (SEQ ID NO: 1230)
HUMTIA1E_node_18 (SEQ ID NO: 1231)
HUMTIA1E_node_20 (SEQ ID NO: 1232)
HUMTIA1E_node_22 (SEQ ID NO: 1233)
HUMTIA1E_node_23 (SEQ ID NO: 1234)
HUMTIA1E_node_25 (SEQ ID NO: 1235)
HUMTIA1E_node_27 (SEQ ID NO: 1236)
HUMTIA1E_node_30 (SEQ ID NO: 1237)
HUMTIA1E_node_33 (SEQ ID NO: 1238)
HUMTIA1E_node_36 (SEQ ID NO: 1239)
HUMTIA1E_node_45 (SEQ ID NO: 1240)
HUMTIA1E_node_46 (SEQ ID NO: 1241)
HUMTIA1E_node_50 (SEQ ID NO: 1242)
HUMTIA1E_node_51 (SEQ ID NO: 1243)
HUMTIA1E_node_52 (SEQ ID NO: 1244)
HUMTIA1E_node_54 (SEQ ID NO: 1245)
HUMTIA1E_node_55 (SEQ ID NO: 1246)
HUMTIA1E_node_57 (SEQ ID NO: 1247)
HUMTIA1E_node_59 (SEQ ID NO: 1248)
HUMTIA1E_node_0 (SEQ ID NO: 1249)
HUMTIA1E_node_1 (SEQ ID NO: 1250)
HUMTIA1E_node_2 (SEQ ID NO: 1251)
HUMTIA1E_node_3 (SEQ ID NO: 1252)
HUMTIA1E_node_5 (SEQ ID NO: 1253)
HUMTIA1E_node_6 (SEQ ID NO: 1254)
HUMTIA1E_node_7 (SEQ ID NO: 1255)
HUMTIA1E_node_10 (SEQ ID NO: 1256)
HUMTIA1E_node_11 (SEQ ID NO: 1257)
HUMTIA1E_node_12 (SEQ ID NO: 1258)
HUMTIA1E_node_15 (SEQ ID NO: 1259)
HUMTIA1E_node_17 (SEQ ID NO: 1260)
HUMTIA1E_node_19 (SEQ ID NO: 1261)
HUMTIA1E_node_21 (SEQ ID NO: 1262)
HUMTIA1E_node_24 (SEQ ID NO: 1263)
HUMTIA1E_node_26 (SEQ ID NO: 1264)
HUMTIA1E_node_28 (SEQ ID NO: 1265)
HUMTIA1E_node_29 (SEQ ID NO: 1266)
HUMTIA1E_node_35 (SEQ ID NO: 1267)
HUMTIA1E_node_43 (SEQ ID NO: 1268)
HUMTIA1E_node_44 (SEQ ID NO: 1269)
HUMTIA1E_node_47 (SEQ ID NO: 1270)
HUMTIA1E_node_48 (SEQ ID NO: 1271)
HUMTIA1E_node_49 (SEQ ID NO: 1272)
HUMTIA1E_node_53 (SEQ ID NO: 1273)
HUMTIA1E_node_58 (SEQ ID NO: 1274)

TABLE 1136

Proteins of interest

| Protein Name | Corresponding Transcript(s) |
|---|---|
| HUMTIA1E_P1 | HUMTIA1E_T0 (SEQ ID NO: 1188); |
| | HUMTIA1E_T1 (SEQ ID NO: 1189); |
| | HUMTIA1E_T3 (SEQ ID NO: 1191); |
| | HUMTIA1E_T6 (SEQ ID NO: 1192); |
| | HUMTIA1E_T10 (SEQ ID NO: 1195); |
| | HUMTIA1E_T14 (SEQ ID NO: 1199); |
| | HUMTIA1E_T15 (SEQ ID NO: 1200); |
| | HUMTIA1E_T16 (SEQ ID NO: 1201); |
| | HUMTIA1E_T17 (SEQ ID NO: 1202); |
| | HUMTIA1E_T21 (SEQ ID NO: 1206); |
| | HUMTIA1E_T22 (SEQ ID NO: 1207); |
| | HUMTIA1E_T24 (SEQ ID NO: 1209); |
| | HUMTIA1E_T40 (SEQ ID NO: 1216); |
| | HUMTIA1E_T45 (SEQ ID NO: 1217); |
| | HUMTIA1E_T46 (SEQ ID NO: 1218); |
| | HUMTIA1E_T47 (SEQ ID NO: 1219); |
| | HUMTIA1E_T48 (SEQ ID NO: 1220) |
| HUMTIA1E_P2 | HUMTIA1E_T2 (SEQ ID NO: 1190); |
| | HUMTIA1E_T8 (SEQ ID NO: 1193); |
| | HUMTIA1E_T11 (SEQ ID NO: 1196); |

TABLE 1136-continued

Proteins of interest

| Protein Name | Corresponding Transcript(s) |
|---|---|
| | HUMTIA1E_T20 (SEQ ID NO: 1205); |
| | HUMTIA1E_T29 (SEQ ID NO: 1213) |
| HUMTIA1E_P5 | HUMTIA1E_T9 (SEQ ID NO: 1194); |
| | HUMTIA1E_T12 (SEQ ID NO: 1197); |
| | HUMTIA1E_T13 (SEQ ID NO: 1198); |
| | HUMTIA1E_T23 (SEQ ID NO: 1208); |
| | HUMTIA1E_T26 (SEQ ID NO: 1210); |
| | HUMTIA1E_T50 (SEQ ID NO: 1221); |
| | HUMTIA1E_T51 (SEQ ID NO: 1222); |
| | HUMTIA1E_T52 (SEQ ID NO: 1223); |
| | HUMTIA1E_T56 (SEQ ID NO: 1225) |
| HUMTIA1E_P6 | HUMTIA1E_T18 (SEQ ID NO: 1203); |
| | HUMTIA1E_T19 (SEQ ID NO: 1204); |
| | HUMTIA1E_T27 (SEQ ID NO: 1211) |
| HUMTIA1E_P7 | HUMTIA1E_T32 (SEQ ID NO: 1214); |
| | HUMTIA1E_T55 (SEQ ID NO: 1224) |
| HUMTIA1E_P8 | HUMTIA1E_T28 (SEQ ID NO: 1212) |
| HUMTIA1E_P9 | HUMTIA1E_T37 (SEQ ID NO: 1215) |
| HUMTIA1E_P14 | HUMTIA1E_T58 (SEQ ID NO: 1227) |
| HUMTIA1E_P15 | HUMTIA1E_T57 (SEQ ID NO: 1226) |
| HUMTIA1E_P16 | HUMTIA1E_T60 (SEQ ID NO: 1228) |

These sequences are variants of the known protein Nucleolysin TIA-1 (SwissProt accession identifier TIA1_HUMAN; known also according to the synonyms RNA-binding protein TIA-1; P40-TIA-1), referred to herein as the previously known protein.

Protein Nucleolysin TIA-1 is known or believed to have the following function(s): RNA-binding protein. Possesses nucleolytic activity against cytotoxic lymphocyte target cells. May be involved in apoptosis. The sequence for protein Nucleolysin TIA-1 is given at the end of the application, as "Nucleolysin TIA-1 amino acid sequence". Protein Nucleolysin TIA-1 localization is believed to be Cytoplasmic granules of cytolytic T-lymphocytes.

The following GO Annotation(s) apply to the previously known protein. The following annotation(s) were found: apoptosis; induction of apoptosis, which are annotation(s) related to Biological Process; and nucleic acid binding; RNA binding; poly(A) binding, which are annotation(s) related to Molecular Function.

The GO assignment relies on information from one or more of the SwissProt/TremB1 Protein knowledgebase, available from expasy.ch/sprot/; or Locuslink, available from ncbi.nlm.nih.gov/projects/LocusLink/.

Cluster HUMTIA1E can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 30 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 30 and Table 1137. This cluster is overexpressed (at least at a minimum level) in the following pathological conditions: lung malignant tumors.

TABLE 1137

Normal tissue distribution

| Name of Tissue | Number |
|---|---|
| Adrenal | 52 |
| Bladder | 41 |
| Bone | 0 |
| Brain | 57 |
| Colon | 69 |
| Epithelial | 103 |
| General | 102 |
| head and neck | 0 |
| Kidney | 53 |
| Liver | 24 |
| Lung | 36 |
| lymph nodes | 109 |
| Breast | 321 |
| bone marrow | 31 |
| Ovary | 182 |
| Pancreas | 113 |
| Prostate | 46 |
| Skin | 147 |
| Stomach | 109 |
| Thyroid | 902 |
| Uterus | 259 |

TABLE 1138

P values and ratios for expression in cancerous tissue

| Name of Tissue | P1 | P2 | SP1 | R3 | SP2 | R4 |
|---|---|---|---|---|---|---|
| Adrenal | 7.4e−01 | 6.0e−01 | 7.1e−01 | 0.9 | 5.5e−01 | 1.2 |
| Bladder | 3.3e−01 | 2.9e−01 | 4.1e−01 | 1.7 | 2.9e−01 | 1.7 |
| Bone | 1.8e−02 | 1.7e−02 | 2.6e−02 | 6.9 | 5.9e−02 | 4.6 |
| Brain | 5.0e−01 | 3.0e−01 | 4.7e−01 | 1.2 | 2.2e−01 | 1.4 |
| Colon | 1.6e−01 | 2.1e−01 | 3.1e−01 | 1.6 | 4.0e−01 | 1.4 |
| epithelial | 4.4e−02 | 3.4e−01 | 2.8e−03 | 1.4 | 5.6e−01 | 0.9 |
| General | 3.5e−02 | 3.4e−01 | 1.6e−03 | 1.3 | 7.7e−01 | 0.9 |
| head and neck | 2.1e−01 | 3.3e−01 | 2.1e−01 | 3.3 | 5.6e−01 | 1.7 |
| Kidney | 1.4e−01 | 1.8e−01 | 2.9e−02 | 2.5 | 6.0e−02 | 2.1 |
| Liver | 3.3e−01 | 6.0e−01 | 1 | 1.8 | 6.9e−01 | 1.1 |
| Lung | 1.8e−01 | 5.2e−01 | 9.6e−03 | 3.4 | 1.5e−01 | 1.7 |
| lymph nodes | 5.6e−01 | 8.0e−01 | 8.7e−01 | 0.7 | 9.9e−01 | 0.3 |
| Breast | 7.0e−01 | 7.8e−01 | 9.8e−01 | 0.5 | 1 | 0.4 |
| bone marrow | 5.9e−01 | 4.7e−01 | 1 | 2.8 | 5.5e−01 | 1.7 |
| Ovary | 4.9e−01 | 6.0e−01 | 5.3e−01 | 1.0 | 8.1e−01 | 0.7 |
| Pancreas | 1.4e−01 | 3.5e−01 | 8.8e−01 | 0.7 | 9.8e−01 | 0.5 |
| Prostate | 8.1e−01 | 7.9e−01 | 4.8e−01 | 1.1 | 2.8e−01 | 1.3 |
| Skin | 4.0e−01 | 5.3e−01 | 1.5e−01 | 2.1 | 9.9e−01 | 0.5 |
| Stomach | 4.9e−01 | 7.5e−01 | 6.6e−01 | 0.8 | 9.1e−01 | 0.6 |
| Thyroid | 5.7e−01 | 5.7e−01 | 1 | 0.2 | 1 | 0.2 |
| Uterus | 6.1e−01 | 7.2e−01 | 1.4e−01 | 1.1 | 7.4e−01 | 0.7 |

As noted above, cluster HUMTIA1E features 46 segment(s), which were listed in Table 1135 above and for which the sequence(s) are given at the end of the application. These segment(s) are portions of nucleic acid sequence(s) which are described herein separately because they are of particular interest. A description of each segment according to the present invention is now provided.

Segment cluster HUMTIA1E_node_14 (SEQ ID NO:1229) according to the present invention is supported by 1 libraries. The number of libraries was determined as previously described. This segment can be found in the following transcript(s): HUMTIA1E_T15 (SEQ ID NO:1200). Table 1139 below describes the starting and ending position of this segment on each transcript.

TABLE 1139

Segment location on transcripts

| Transcript name | Segment starting position | Segment ending position |
|---|---|---|
| HUMTIA1E_T15 (SEQ ID NO: 1200) | 1 | 615 |

This segment can be found in a non-coding region of transcript(s) that are related to the following protein(s): HUMTIA1E_P1.

Segment cluster HUMTIA1E_node_16 (SEQ ID NO:1230) according to the present invention is supported by 4 libraries. The number of libraries was determined as previously described. This segment can be found in the following transcript(s): HUMTIA1E_T3 (SEQ ID NO:1191), HUMTIA1E_T15 (SEQ ID NO:1200) and HUMTIA1E_T17 (SEQ ID NO:1202). Table 1140 below describes the starting and ending position of this segment on each transcript.

TABLE 1140

Segment location on transcripts

| Transcript name | Segment starting position | Segment ending position |
|---|---|---|
| HUMTIA1E_T3 (SEQ ID NO: 1191) | 565 | 736 |
| HUMTIA1E_T15 (SEQ ID NO: 1200) | 671 | 842 |
| HUMTIA1E_T17 (SEQ ID NO: 1202) | 323 | 494 |

This segment can be found in a non-coding region of transcript(s) that are related to the following protein(s): HUMTIA1E_P1.

Segment cluster HUMTIA1E_node_18 (SEQ ID NO:1231) according to the present invention is supported by 16 libraries. The number of libraries was determined as previously described. This segment can be found in the following transcript(s): HUMTIA1E_T0 (SEQ ID NO:1188), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223) and HUMTIA1E_T56 (SEQ ID NO:1225). Table 1141 below describes the starting and ending position of this segment on each transcript.

TABLE 1141

Segment location on transcripts

| Transcript name | Segment starting position | Segment ending position |
|---|---|---|
| HUMTIA1E_T0 (SEQ ID NO: 1188) | 598 | 1193 |
| HUMTIA1E_T2 (SEQ ID NO: 1190) | 598 | 1193 |
| HUMTIA1E_T3 (SEQ ID NO: 1191) | 770 | 1365 |
| HUMTIA1E_T6 (SEQ ID NO: 1192) | 593 | 1188 |
| HUMTIA1E_T8 (SEQ ID NO: 1193) | 598 | 1193 |
| HUMTIA1E_T9 (SEQ ID NO: 1194) | 598 | 1193 |
| HUMTIA1E_T11 (SEQ ID NO: 1196) | 598 | 1193 |
| HUMTIA1E_T12 (SEQ ID NO: 1197) | 598 | 1193 |
| HUMTIA1E_T13 (SEQ ID NO: 1198) | 598 | 1193 |
| HUMTIA1E_T14 (SEQ ID NO: 1199) | 598 | 1193 |
| HUMTIA1E_T15 (SEQ ID NO: 1200) | 876 | 1471 |
| HUMTIA1E_T16 (SEQ ID NO: 1201) | 501 | 1096 |
| HUMTIA1E_T17 (SEQ ID NO: 1202) | 528 | 1123 |
| HUMTIA1E_T18 (SEQ ID NO: 1203) | 598 | 1193 |
| HUMTIA1E_T19 (SEQ ID NO: 1204) | 598 | 1193 |
| HUMTIA1E_T20 (SEQ ID NO: 1205) | 598 | 1193 |
| HUMTIA1E_T23 (SEQ ID NO: 1208) | 598 | 1193 |
| HUMTIA1E_T24 (SEQ ID NO: 1209) | 598 | 1193 |
| HUMTIA1E_T26 (SEQ ID NO: 1210) | 598 | 1193 |
| HUMTIA1E_T27 (SEQ ID NO: 1211) | 598 | 1193 |
| HUMTIA1E_T28 (SEQ ID NO: 1212) | 598 | 1193 |
| HUMTIA1E_T29 (SEQ ID NO: 1213) | 598 | 1193 |
| HUMTIA1E_T40 (SEQ ID NO: 1216) | 598 | 1193 |
| HUMTIA1E_T45 (SEQ ID NO: 1217) | 598 | 1193 |
| HUMTIA1E_T46 (SEQ ID NO: 1218) | 598 | 1193 |
| HUMTIA1E_T47 (SEQ ID NO: 1219) | 598 | 1193 |
| HUMTIA1E_T48 (SEQ ID NO: 1220) | 598 | 1193 |
| HUMTIA1E_T50 (SEQ ID NO: 1221) | 598 | 1193 |
| HUMTIA1E_T51 (SEQ ID NO: 1222) | 598 | 1193 |
| HUMTIA1E_T52 (SEQ ID NO: 1223) | 598 | 1193 |
| HUMTIA1E_T56 (SEQ ID NO: 1225) | 598 | 1193 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, since it is in the coding region for the corresponding transcript.

Segment cluster HUMTIA1E_node_20 (SEQ ID NO:1232) according to the present invention is supported by 19 libraries. The number of libraries was determined as previously described. This segment can be found in the following transcript(s): HUMTIA1E_T0 (SEQ ID NO:1188), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223) and HUMTIA1E_T56 (SEQ ID NO:1225). Table 1142 below describes the starting and ending position of this segment on each transcript.

TABLE 1142

Segment location on transcripts

| Transcript name | Segment starting position | Segment ending position |
|---|---|---|
| HUMTIA1E_T0 (SEQ ID NO: 1188) | 1313 | 1833 |
| HUMTIA1E_T2 (SEQ ID NO: 1190) | 1313 | 1833 |
| HUMTIA1E_T3 (SEQ ID NO: 1191) | 1485 | 2005 |
| HUMTIA1E_T6 (SEQ ID NO: 1192) | 1308 | 1828 |
| HUMTIA1E_T8 (SEQ ID NO: 1193) | 1313 | 1833 |
| HUMTIA1E_T9 (SEQ ID NO: 1194) | 1313 | 1833 |
| HUMTIA1E_T11 (SEQ ID NO: 1196) | 1313 | 1833 |
| HUMTIA1E_T12 (SEQ ID NO: 1197) | 1313 | 1833 |
| HUMTIA1E_T13 (SEQ ID NO: 1198) | 1313 | 1833 |
| HUMTIA1E_T14 (SEQ ID NO: 1199) | 1313 | 1833 |
| HUMTIA1E_T15 (SEQ ID NO: 1200) | 1591 | 2111 |
| HUMTIA1E_T16 (SEQ ID NO: 1201) | 1216 | 1736 |
| HUMTIA1E_T17 (SEQ ID NO: 1202) | 1243 | 1763 |
| HUMTIA1E_T18 (SEQ ID NO: 1203) | 1313 | 1833 |
| HUMTIA1E_T19 (SEQ ID NO: 1204) | 1313 | 1833 |
| HUMTIA1E_T20 (SEQ ID NO: 1205) | 1313 | 1833 |
| HUMTIA1E_T21 (SEQ ID NO: 1206) | 621 | 1141 |
| HUMTIA1E_T23 (SEQ ID NO: 1208) | 1313 | 1833 |
| HUMTIA1E_T26 (SEQ ID NO: 1210) | 1313 | 1833 |
| HUMTIA1E_T27 (SEQ ID NO: 1211) | 1313 | 1833 |
| HUMTIA1E_T28 (SEQ ID NO: 1212) | 1313 | 1833 |
| HUMTIA1E_T29 (SEQ ID NO: 1213) | 1313 | 1833 |
| HUMTIA1E_T40 (SEQ ID NO: 1216) | 1313 | 1833 |
| HUMTIA1E_T45 (SEQ ID NO: 1217) | 1313 | 1833 |
| HUMTIA1E_T46 (SEQ ID NO: 1218) | 1313 | 1833 |
| HUMTIA1E_T47 (SEQ ID NO: 1219) | 1313 | 1833 |
| HUMTIA1E_T48 (SEQ ID NO: 1220) | 1313 | 1833 |
| HUMTIA1E_T50 (SEQ ID NO: 1221) | 1313 | 1833 |
| HUMTIA1E_T51 (SEQ ID NO: 1222) | 1313 | 1833 |
| HUMTIA1E_T52 (SEQ ID NO: 1223) | 1313 | 1833 |
| HUMTIA1E_T56 (SEQ ID NO: 1225) | 1313 | 1833 |

This segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8.

Segment cluster HUMTIA1E_node_22 (SEQ ID NO:1233) according to the present invention is supported by 30 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T26 (SEQ ID NO:1210), HUMTIA1E_T28 (SEQ ID NO:1212), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1143 below describes the starting and ending position of this segment on each transcript.

TABLE 1143

Segment location on transcripts

| Transcript name | Segment starting position | Segment ending position |
|---|---|---|
| HUMTIA1E_T0 (SEQ ID NO: 1188) | 1922 | 4087 |
| HUMTIA1E_T1 (SEQ ID NO: 1189) | 805 | 2970 |
| HUMTIA1E_T2 (SEQ ID NO: 1190) | 1922 | 4087 |
| HUMTIA1E_T3 (SEQ ID NO: 1191) | 2094 | 4259 |
| HUMTIA1E_T6 (SEQ ID NO: 1192) | 1917 | 4082 |
| HUMTIA1E_T8 (SEQ ID NO: 1193) | 1922 | 4087 |
| HUMTIA1E_T9 (SEQ ID NO: 1194) | 1922 | 4087 |
| HUMTIA1E_T10 (SEQ ID NO: 1195) | 653 | 2818 |
| HUMTIA1E_T11 (SEQ ID NO: 1196) | 1922 | 4087 |
| HUMTIA1E_T12 (SEQ ID NO: 1197) | 1922 | 4087 |
| HUMTIA1E_T13 (SEQ ID NO: 1198) | 1922 | 4087 |
| HUMTIA1E_T14 (SEQ ID NO: 1199) | 1922 | 4087 |
| HUMTIA1E_T15 (SEQ ID NO: 1200) | 2200 | 4365 |
| HUMTIA1E_T16 (SEQ ID NO: 1201) | 1825 | 3990 |
| HUMTIA1E_T17 (SEQ ID NO: 1202) | 1852 | 4017 |
| HUMTIA1E_T19 (SEQ ID NO: 1204) | 1922 | 4087 |
| HUMTIA1E_T20 (SEQ ID NO: 1205) | 1922 | 4087 |
| HUMTIA1E_T21 (SEQ ID NO: 1206) | 1230 | 3395 |
| HUMTIA1E_T22 (SEQ ID NO: 1207) | 551 | 2716 |
| HUMTIA1E_T23 (SEQ ID NO: 1208) | 1922 | 4087 |
| HUMTIA1E_T26 (SEQ ID NO: 1210) | 1922 | 4087 |
| HUMTIA1E_T28 (SEQ ID NO: 1212) | 1922 | 4087 |
| HUMTIA1E_T40 (SEQ ID NO: 1216) | 1922 | 4087 |
| HUMTIA1E_T45 (SEQ ID NO: 1217) | 1922 | 4087 |
| HUMTIA1E_T46 (SEQ ID NO: 1218) | 1922 | 4087 |
| HUMTIA1E_T47 (SEQ ID NO: 1219) | 1922 | 4087 |
| HUMTIA1E_T48 (SEQ ID NO: 1220) | 1922 | 4087 |
| HUMTIA1E_T50 (SEQ ID NO: 1221) | 1922 | 4087 |
| HUMTIA1E_T51 (SEQ ID NO: 1222) | 1922 | 4087 |
| HUMTIA1E_T52 (SEQ ID NO: 1223) | 1922 | 4087 |

This segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8.

Segment cluster HUMTIA1E_node_23 (SEQ ID NO:1234) according to the present invention is supported by 20 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T28 (SEQ ID NO:1212), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1144 below describes the starting and ending position of this segment on each transcript.

TABLE 1144

Segment location on transcripts

| Transcript name | Segment starting position | Segment ending position |
|---|---|---|
| HUMTIA1E_T0 (SEQ ID NO: 1188) | 4088 | 4262 |
| HUMTIA1E_T1 (SEQ ID NO: 1189) | 2971 | 3145 |
| HUMTIA1E_T2 (SEQ ID NO: 1190) | 4088 | 4262 |
| HUMTIA1E_T3 (SEQ ID NO: 1191) | 4260 | 4434 |
| HUMTIA1E_T6 (SEQ ID NO: 1192) | 4083 | 4257 |
| HUMTIA1E_T8 (SEQ ID NO: 1193) | 4088 | 4262 |
| HUMTIA1E_T9 (SEQ ID NO: 1194) | 4088 | 4262 |
| HUMTIA1E_T10 (SEQ ID NO: 1195) | 2819 | 2993 |
| HUMTIA1E_T11 (SEQ ID NO: 1196) | 4088 | 4262 |
| HUMTIA1E_T12 (SEQ ID NO: 1197) | 4088 | 4262 |
| HUMTIA1E_T13 (SEQ ID NO: 1198) | 4088 | 4262 |
| HUMTIA1E_T14 (SEQ ID NO: 1199) | 4088 | 4262 |
| HUMTIA1E_T15 (SEQ ID NO: 1200) | 4366 | 4540 |
| HUMTIA1E_T16 (SEQ ID NO: 1201) | 3991 | 4165 |
| HUMTIA1E_T17 (SEQ ID NO: 1202) | 4018 | 4192 |
| HUMTIA1E_T19 (SEQ ID NO: 1204) | 4088 | 4262 |
| HUMTIA1E_T20 (SEQ ID NO: 1205) | 4088 | 4262 |
| HUMTIA1E_T21 (SEQ ID NO: 1206) | 3396 | 3570 |
| HUMTIA1E_T22 (SEQ ID NO: 1207) | 2717 | 2891 |
| HUMTIA1E_T23 (SEQ ID NO: 1208) | 4088 | 4262 |
| HUMTIA1E_T24 (SEQ ID NO: 1209) | 1401 | 1575 |
| HUMTIA1E_T26 (SEQ ID NO: 1210) | 4088 | 4262 |
| HUMTIA1E_T28 (SEQ ID NO: 1212) | 4088 | 4262 |
| HUMTIA1E_T40 (SEQ ID NO: 1216) | 4088 | 4262 |
| HUMTIA1E_T45 (SEQ ID NO: 1217) | 4088 | 4262 |
| HUMTIA1E_T46 (SEQ ID NO: 1218) | 4088 | 4262 |
| HUMTIA1E_T47 (SEQ ID NO: 1219) | 4088 | 4262 |
| HUMTIA1E_T48 (SEQ ID NO: 1220) | 4088 | 4262 |
| HUMTIA1E_T50 (SEQ ID NO: 1221) | 4088 | 4262 |
| HUMTIA1E_T51 (SEQ ID NO: 1222) | 4088 | 4262 |
| HUMTIA1E_T52 (SEQ ID NO: 1223) | 4088 | 4262 |

This segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8.

Segment cluster HUMTIA1E_node_25 (SEQ ID NO:1235) according to the present invention is supported by 22 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T28 (SEQ ID NO:1212), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1145 below describes the starting and ending position of this segment on each transcript.

TABLE 1145

Segment location on transcripts

| Transcript name | Segment starting position | Segment ending position |
|---|---|---|
| HUMTIA1E_T0 (SEQ ID NO: 1188) | 4329 | 4550 |
| HUMTIA1E_T1 (SEQ ID NO: 1189) | 3212 | 3433 |
| HUMTIA1E_T2 (SEQ ID NO: 1190) | 4329 | 4550 |
| HUMTIA1E_T3 (SEQ ID NO: 1191) | 4501 | 4722 |
| HUMTIA1E_T6 (SEQ ID NO: 1192) | 4324 | 4545 |
| HUMTIA1E_T8 (SEQ ID NO: 1193) | 4329 | 4550 |
| HUMTIA1E_T9 (SEQ ID NO: 1194) | 4329 | 4550 |
| HUMTIA1E_T10 (SEQ ID NO: 1195) | 3060 | 3281 |
| HUMTIA1E_T11 (SEQ ID NO: 1196) | 4329 | 4550 |
| HUMTIA1E_T12 (SEQ ID NO: 1197) | 4329 | 4550 |
| HUMTIA1E_T13 (SEQ ID NO: 1198) | 4329 | 4550 |
| HUMTIA1E_T14 (SEQ ID NO: 1199) | 4329 | 4550 |
| HUMTIA1E_T15 (SEQ ID NO: 1200) | 4607 | 4828 |
| HUMTIA1E_T16 (SEQ ID NO: 1201) | 4232 | 4453 |
| HUMTIA1E_T17 (SEQ ID NO: 1202) | 4259 | 4480 |
| HUMTIA1E_T21 (SEQ ID NO: 1206) | 3637 | 3858 |
| HUMTIA1E_T22 (SEQ ID NO: 1207) | 2958 | 3179 |
| HUMTIA1E_T23 (SEQ ID NO: 1208) | 4329 | 4550 |
| HUMTIA1E_T24 (SEQ ID NO: 1209) | 1642 | 1863 |
| HUMTIA1E_T26 (SEQ ID NO: 1210) | 4329 | 4550 |
| HUMTIA1E_T28 (SEQ ID NO: 1212) | 4329 | 4550 |
| HUMTIA1E_T40 (SEQ ID NO: 1216) | 4329 | 4550 |
| HUMTIA1E_T45 (SEQ ID NO: 1217) | 4329 | 4550 |
| HUMTIA1E_T46 (SEQ ID NO: 1218) | 4329 | 4550 |
| HUMTIA1E_T47 (SEQ ID NO: 1219) | 4329 | 4550 |
| HUMTIA1E_T48 (SEQ ID NO: 1220) | 4329 | 4550 |
| HUMTIA1E_T50 (SEQ ID NO: 1221) | 4329 | 4550 |
| HUMTIA1E_T51 (SEQ ID NO: 1222) | 4329 | 4550 |
| HUMTIA1E_T52 (SEQ ID NO: 1223) | 4329 | 4550 |

This segment can be found in a non-coding region of transcript(s) that are related to the following protein(s): HUMTIA1E_P1, HUMTIA1E_P2, HUMTIA1E_P5 and HUMTIA1E_P8.

Segment cluster HUMTIA1E_node_27 (SEQ ID NO:1236) according to the present invention is supported by 30 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T28 (SEQ ID NO:1212), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1146 below describes the starting and ending position of this segment on each transcript.

TABLE 1146

Segment location on transcripts

| Transcript name | Segment starting position | Segment ending position |
|---|---|---|
| HUMTIA1E_T0 (SEQ ID NO: 1188) | 4605 | 5026 |
| HUMTIA1E_T1 (SEQ ID NO: 1189) | 3488 | 3909 |
| HUMTIA1E_T2 (SEQ ID NO: 1190) | 4605 | 5026 |
| HUMTIA1E_T3 (SEQ ID NO: 1191) | 4777 | 5198 |
| HUMTIA1E_T6 (SEQ ID NO: 1192) | 4600 | 5021 |
| HUMTIA1E_T8 (SEQ ID NO: 1193) | 4605 | 5026 |
| HUMTIA1E_T9 (SEQ ID NO: 1194) | 4605 | 5026 |
| HUMTIA1E_T10 (SEQ ID NO: 1195) | 3336 | 3757 |
| HUMTIA1E_T11 (SEQ ID NO: 1196) | 4605 | 5026 |
| HUMTIA1E_T12 (SEQ ID NO: 1197) | 4605 | 5026 |
| HUMTIA1E_T13 (SEQ ID NO: 1198) | 4605 | 5026 |
| HUMTIA1E_T14 (SEQ ID NO: 1199) | 4605 | 5026 |
| HUMTIA1E_T15 (SEQ ID NO: 1200) | 4883 | 5304 |
| HUMTIA1E_T16 (SEQ ID NO: 1201) | 4508 | 4929 |
| HUMTIA1E_T17 (SEQ ID NO: 1202) | 4535 | 4956 |
| HUMTIA1E_T21 (SEQ ID NO: 1206) | 3913 | 4334 |
| HUMTIA1E_T22 (SEQ ID NO: 1207) | 3234 | 3655 |
| HUMTIA1E_T23 (SEQ ID NO: 1208) | 4605 | 5026 |
| HUMTIA1E_T24 (SEQ ID NO: 1209) | 1918 | 2339 |
| HUMTIA1E_T26 (SEQ ID NO: 1210) | 4605 | 5026 |
| HUMTIA1E_T28 (SEQ ID NO: 1212) | 4605 | 5026 |
| HUMTIA1E_T40 (SEQ ID NO: 1216) | 4605 | 5026 |
| HUMTIA1E_T45 (SEQ ID NO: 1217) | 4605 | 5026 |
| HUMTIA1E_T46 (SEQ ID NO: 1218) | 4605 | 5026 |
| HUMTIA1E_T47 (SEQ ID NO: 1219) | 4605 | 5026 |
| HUMTIA1E_T48 (SEQ ID NO: 1220) | 4605 | 5026 |
| HUMTIA1E_T50 (SEQ ID NO: 1221) | 4605 | 5026 |
| HUMTIA1E_T51 (SEQ ID NO: 1222) | 4605 | 5026 |
| HUMTIA1E_T52 (SEQ ID NO: 1223) | 4605 | 5026 |

This segment can be found in both coding and non-coding regions of transcript(s) as follows. The segment can be found in a non-coding region of transcript(s) that are related to the following protein(s): HUMTIA1E_P2 and HUMTIA1E_P5. This segment can also be found in the following protein(s): and HUMTIA1E_P8, since it is in the coding region for the corresponding transcript.

Segment cluster HUMTIA1E_node_30 (SEQ ID NO:1237) according to the present invention is supported by 14 libraries. The number of libraries was determined as previously described. This segment can be found in the following transcript(s): HUMTIA1E_T51 (SEQ ID NO:1222), HUMTIA1E_T52 (SEQ ID NO:1223), HUMTIA1E_T56 (SEQ ID NO:1225), HUMTIA1E_T57 (SEQ ID NO:1226) and HUMTIA1E_T58 (SEQ ID NO:1227). Table 1147 below describes the starting and ending position of this segment on each transcript.

TABLE 1147

Segment location on transcripts

| Transcript name | Segment starting position | Segment ending position |
|---|---|---|
| HUMTIA1E_T51 (SEQ ID NO: 1222) | 5108 | 5431 |
| HUMTIA1E_T52 (SEQ ID NO: 1223) | 5108 | 5232 |
| HUMTIA1E_T56 (SEQ ID NO: 1225) | 2003 | 2127 |
| HUMTIA1E_T57 (SEQ ID NO: 1226) | 886 | 1010 |
| HUMTIA1E_T58 (SEQ ID NO: 1227) | 734 | 858 |

This segment can be found in both coding and non-coding regions of transcript(s) as follows. The segment can be found in a non-coding region of transcript(s) that are related to the following protein(s): HUMTIA1E_P5 and HUMTIA1E_P15. This segment can also be found in the following protein(s): HUMTIA1E_P14, since it is in the coding region for the corresponding transcript.

Segment cluster HUMTIA1E_node_33 (SEQ ID NO:1238) according to the present invention is supported by 5 libraries. The number of libraries was determined as previously described. This segment can be found in the following transcript(s): HUMTIA1E_T60 (SEQ ID NO:1228). Table 1148 below describes the starting and ending position of this segment on each transcript.

TABLE 1148

Segment location on transcripts

| Transcript name | Segment starting position | Segment ending position |
|---|---|---|
| HUMTIA1E_T60 (SEQ ID NO: 1228) | 1 | 937 |

This segment can be found in a non-coding region of transcript(s) that are related to the following protein(s): HUMTIA1E_P16.

Segment cluster HUMTIA1E_node_36 (SEQ ID NO:1239) according to the present invention is supported by 3 libraries. The number of libraries was determined as previously described. This segment can be found in the following transcript(s): HUMTIA1E_T51 (SEQ ID NO:1222) and HUMTIA1E_T60 (SEQ ID NO:1228). Table 1149 below describes the starting and ending position of this segment on each transcript.

TABLE 1149

Segment location on transcripts

| Transcript name | Segment starting position | Segment ending position |
|---|---|---|
| HUMTIA1E_T51 (SEQ ID NO: 1222) | 5455 | 6058 |
| HUMTIA1E_T60 (SEQ ID NO: 1228) | 938 | 1541 |

This segment can be found in both coding and non-coding regions of transcript(s) as follows. The segment can be found in a non-coding region of transcript(s) that are related to the following protein(s): HUMTIA1E_P5. This segment can also be found in the following protein(s): HUMTIA1E_P16, since it is in the coding region for the corresponding transcript.

Segment cluster HUMTIA1E_node_45 (SEQ ID NO:1240) according to the present invention is supported by 30 libraries. The number of libraries was determined as previously described. This segment can be found in the following transcript(s): HUMTIA1E_T2 (SEQ ID NO:1190), HUMTIA1E_T9 (SEQ ID NO:1194), HUMTIA1E_T11 (SEQ ID NO:1196), HUMTIA1E_T12 (SEQ ID NO:1197), HUMTIA1E_T13 (SEQ ID NO:1198), HUMTIA1E_T20 (SEQ ID NO:1205), HUMTIA1E_T23 (SEQ ID NO:1208), HUMTIA1E_T26 (SEQ ID NO:1210), HUMTIA1E_T29 (SEQ ID NO:1213), HUMTIA1E_T32 (SEQ ID NO:1214), HUMTIA1E_T37 (SEQ ID NO:1215), HUMTIA1E_T50 (SEQ ID NO:1221) and HUMTIA1E_T55 (SEQ ID NO:1224). Table 1150 below describes the starting and ending position of this segment on each transcript.

TABLE 1150

Segment location on transcripts

| Transcript name | Segment starting position | Segment ending position |
|---|---|---|
| HUMTIA1E_T2 (SEQ ID NO: 1190) | 5212 | 5344 |
| HUMTIA1E_T9 (SEQ ID NO: 1194) | 5212 | 5344 |
| HUMTIA1E_T11 (SEQ ID NO: 1196) | 5212 | 5344 |
| HUMTIA1E_T12 (SEQ ID NO: 1197) | 5212 | 5344 |
| HUMTIA1E_T13 (SEQ ID NO: 1198) | 5212 | 5344 |
| HUMTIA1E_T20 (SEQ ID NO: 1205) | 4514 | 4646 |
| HUMTIA1E_T23 (SEQ ID NO: 1208) | 5212 | 5344 |
| HUMTIA1E_T26 (SEQ ID NO: 1210) | 5212 | 5344 |
| HUMTIA1E_T29 (SEQ ID NO: 1213) | 2173 | 2305 |
| HUMTIA1E_T32 (SEQ ID NO: 1214) | 871 | 1003 |
| HUMTIA1E_T37 (SEQ ID NO: 1215) | 838 | 970 |
| HUMTIA1E_T50 (SEQ ID NO: 1221) | 5212 | 5344 |
| HUMTIA1E_T55 (SEQ ID NO: 1224) | 871 | 1003 |

This segment can be found in both coding and non-coding regions of transcript(s) as follows. The segment can be found in a non-coding region of transcript(s) that are related to the following protein(s): HUMTIA1E_P2 and HUMTIA1E_P5. This segment can also be found in the following protein(s): HUMTIA1E_P7 and HUMTIA1E_P9, since it is in the coding region for the corresponding transcript.

Segment cluster HUMTIA1E_node_46 (SEQ ID NO:1241) according to the present invention is supported by 7 libraries. The number of libraries was determined as previously described. This segment can be found in the following transcript(s): HUMTIA1E_T9 (SEQ ID NO:1194). Table 1151 below describes the starting and ending position of this segment on each transcript.

TABLE 1151

Segment location on transcripts

| Transcript name | Segment starting position | Segment ending position |
|---|---|---|
| HUMTIA1E_T9 (SEQ ID NO: 1194) | 5345 | 5597 |

This segment can be found in a non-coding region of transcript(s) that are related to the following protein(s): HUMTIA1E_P5.

Segment cluster HUMTIA1E_node_50 (SEQ ID NO:1242) according to the present invention is supported by 14 libraries. The number of libraries was determined as previously described. This segment can be found in the following transcript(s): HUMTIA1E_T12 (SEQ ID NO:1197), HUMTIA1E_T13 (SEQ ID NO:1198), HUMTIA1E_T32 (SEQ ID NO:1214), HUMTIA1E_T37 (SEQ ID NO:1215), HUMTIA1E_T50 (SEQ ID NO:1221) and HUMTIA1E_T55 (SEQ ID NO:1224). Table 1152 below describes the starting and ending position of this segment on each transcript.

TABLE 1152

Segment location on transcripts

| Transcript name | Segment starting position | Segment ending position |
|---|---|---|
| HUMTIA1E_T12 (SEQ ID NO: 1197) | 5526 | 6238 |
| HUMTIA1E_T13 (SEQ ID NO: 1198) | 5637 | 6349 |

TABLE 1152-continued

Segment location on transcripts

| Transcript name | Segment starting position | Segment ending position |
|---|---|---|
| HUMTIA1E_T32 (SEQ ID NO: 1214) | 1185 | 1897 |
| HUMTIA1E_T37 (SEQ ID NO: 1215) | 1152 | 1864 |
| HUMTIA1E_T50 (SEQ ID NO: 1221) | 5526 | 5612 |
| HUMTIA1E_T55 (SEQ ID NO: 1224) | 1185 | 1271 |

This segment can be found in a non-coding region of transcript(s) that are related to the following protein(s): HUMTIA1E_P5, HUMTIA1E_P7 and HUMTIA1E_P9.

Segment cluster HUMTIA1E_node_51 (SEQ ID NO:1243) according to the present invention is supported by 70 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219) and HUMTIA1E_T48 (SEQ ID NO:1220). Table 1153 below describes the starting and ending position of this segment on each transcript.

TABLE 1153

Segment location on transcripts

| Transcript name | Segment starting position | Segment ending position |
|---|---|---|
| HUMTIA1E_T0 (SEQ ID NO: 1188) | 5393 | 5516 |
| HUMTIA1E_T1 (SEQ ID NO: 1189) | 4276 | 4399 |
| HUMTIA1E_T2 (SEQ ID NO: 1190) | 5526 | 5649 |
| HUMTIA1E_T3 (SEQ ID NO: 1191) | 5565 | 5688 |
| HUMTIA1E_T6 (SEQ ID NO: 1192) | 5388 | 5511 |
| HUMTIA1E_T8 (SEQ ID NO: 1193) | 5337 | 5460 |
| HUMTIA1E_T9 (SEQ ID NO: 1194) | 5779 | 5902 |
| HUMTIA1E_T10 (SEQ ID NO: 1195) | 4124 | 4247 |
| HUMTIA1E_T11 (SEQ ID NO: 1196) | 5637 | 5760 |
| HUMTIA1E_T12 (SEQ ID NO: 1197) | 6239 | 6362 |
| HUMTIA1E_T13 (SEQ ID NO: 1198) | 6350 | 6473 |
| HUMTIA1E_T14 (SEQ ID NO: 1199) | 5393 | 5516 |
| HUMTIA1E_T15 (SEQ ID NO: 1200) | 5671 | 5794 |
| HUMTIA1E_T16 (SEQ ID NO: 1201) | 5296 | 5419 |
| HUMTIA1E_T17 (SEQ ID NO: 1202) | 5323 | 5446 |
| HUMTIA1E_T18 (SEQ ID NO: 1203) | 2288 | 2411 |
| HUMTIA1E_T19 (SEQ ID NO: 1204) | 4695 | 4818 |
| HUMTIA1E_T20 (SEQ ID NO: 1205) | 4828 | 4951 |
| HUMTIA1E_T21 (SEQ ID NO: 1206) | 4701 | 4824 |

TABLE 1153-continued

Segment location on transcripts

| Transcript name | Segment starting position | Segment ending position |
|---|---|---|
| HUMTIA1E_T22 (SEQ ID NO: 1207) | 4022 | 4145 |
| HUMTIA1E_T23 (SEQ ID NO: 1208) | 5526 | 5649 |
| HUMTIA1E_T24 (SEQ ID NO: 1209) | 2706 | 2829 |
| HUMTIA1E_T26 (SEQ ID NO: 1210) | 5526 | 5649 |
| HUMTIA1E_T27 (SEQ ID NO: 1211) | 2354 | 2477 |
| HUMTIA1E_T28 (SEQ ID NO: 1212) | 5393 | 5516 |
| HUMTIA1E_T29 (SEQ ID NO: 1213) | 2487 | 2610 |
| HUMTIA1E_T32 (SEQ ID NO: 1214) | 1898 | 2021 |
| HUMTIA1E_T37 (SEQ ID NO: 1215) | 1865 | 1988 |
| HUMTIA1E_T40 (SEQ ID NO: 1216) | 5393 | 5516 |
| HUMTIA1E_T45 (SEQ ID NO: 1217) | 5393 | 5516 |
| HUMTIA1E_T46 (SEQ ID NO: 1218) | 5393 | 5516 |
| HUMTIA1E_T47 (SEQ ID NO: 1219) | 5393 | 5516 |
| HUMTIA1E_T48 (SEQ ID NO: 1220) | 5393 | 5516 |

This segment can be found in both coding and non-coding regions of transcript(s) as follows. The segment can be found in a non-coding region of transcript(s) that are related to the following protein(s): HUMTIA1E_P5, and HUMTIA1E_P9. This segment can also be found in the following protein(s): HUMTIA1E_P1, HUMTIA1E_P2, HUMTIA1E_P6 and HUMTIA1E_P8, since it is in the coding region for the corresponding transcript.

Segment cluster HUMTIA1E_node_52 (SEQ ID NO:1244) according to the present invention is supported by 6 libraries. The number of libraries was determined as previously described. This segment can be found in the following transcript(s): HUMTIA1E_T23 (SEQ ID NO:1208). Table 1154 below describes the starting and ending position of this segment on each transcript.

TABLE 1154

Segment location on transcripts

| Transcript name | Segment starting position | Segment ending position |
|---|---|---|
| HUMTIA1E_T23 (SEQ ID NO: 1208) | 5650 | 5786 |

This segment can be found in a non-coding region of transcript(s) that are related to the following protein(s): HUMTIA1E_P5.

Segment cluster HUMTIA1E_node_54 (SEQ ID NO:1245) according to the present invention is supported by 7 libraries. The number of libraries was determined as previously described. This segment can be found in the following transcript(s): HUMTIA1E_T23 (SEQ ID NO:1208). Table 1155 below describes the starting and ending position of this segment on each transcript.

TABLE 1155

Segment location on transcripts

| Transcript name | Segment starting position | Segment ending position |
|---|---|---|
| HUMTIA1E_T23 (SEQ ID NO: 1208) | 5896 | 6525 |

This segment can be found in a non-coding region of transcript(s) that are related to the following protein(s): HUMTIA1E_P5.

Segment cluster HUMTIA1E_node_55 (SEQ ID NO:1246) according to the present invention is supported by 88 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219) and HUMTIA1E_T48 (SEQ ID NO:1220). Table 1156 below describes the starting and ending position of this segment on each transcript.

TABLE 1156

Segment location on transcripts

| Transcript name | Segment starting position | Segment ending position |
|---|---|---|
| HUMTIA1E_T0 (SEQ ID NO: 1188) | 5517 | 5662 |
| HUMTIA1E_T1 (SEQ ID NO: 1189) | 4400 | 4545 |
| HUMTIA1E_T2 (SEQ ID NO: 1190) | 5650 | 5795 |
| HUMTIA1E_T3 (SEQ ID NO: 1191) | 5689 | 5834 |
| HUMTIA1E_T6 (SEQ ID NO: 1192) | 5512 | 5657 |
| HUMTIA1E_T8 (SEQ ID NO: 1193) | 5461 | 5606 |
| HUMTIA1E_T9 (SEQ ID NO: 1194) | 5903 | 6048 |
| HUMTIA1E_T10 (SEQ ID NO: 1195) | 4248 | 4393 |
| HUMTIA1E_T11 (SEQ ID NO: 1196) | 5761 | 5906 |
| HUMTIA1E_T12 (SEQ ID NO: 1197) | 6363 | 6508 |
| HUMTIA1E_T13 (SEQ ID NO: 1198) | 6474 | 6619 |
| HUMTIA1E_T14 (SEQ ID NO: 1199) | 5517 | 5662 |
| HUMTIA1E_T15 (SEQ ID NO: 1200) | 5795 | 5940 |
| HUMTIA1E_T16 (SEQ ID NO: 1201) | 5420 | 5565 |
| HUMTIA1E_T17 (SEQ ID NO: 1202) | 5447 | 5592 |
| HUMTIA1E_T18 (SEQ ID NO: 1203) | 2412 | 2557 |
| HUMTIA1E_T19 (SEQ ID NO: 1204) | 4819 | 4964 |
| HUMTIA1E_T20 (SEQ ID NO: 1205) | 4952 | 5097 |
| HUMTIA1E_T21 (SEQ ID NO: 1206) | 4825 | 4970 |
| HUMTIA1E_T22 (SEQ ID NO: 1207) | 4146 | 4291 |
| HUMTIA1E_T23 (SEQ ID NO: 1208) | 6526 | 6671 |
| HUMTIA1E_T24 (SEQ ID NO: 1209) | 2830 | 2975 |
| HUMTIA1E_T26 (SEQ ID NO: 1210) | 5759 | 5904 |
| HUMTIA1E_T27 (SEQ ID NO: 1211) | 2478 | 2623 |
| HUMTIA1E_T28 (SEQ ID NO: 1212) | 5626 | 5771 |
| HUMTIA1E_T29 (SEQ ID NO: 1213) | 2611 | 2756 |
| HUMTIA1E_T32 (SEQ ID NO: 1214) | 2022 | 2167 |
| HUMTIA1E_T37 (SEQ ID NO: 1215) | 1989 | 2134 |
| HUMTIA1E_T40 (SEQ ID NO: 1216) | 5517 | 5662 |
| HUMTIA1E_T45 (SEQ ID NO: 1217) | 5517 | 5662 |
| HUMTIA1E_T46 (SEQ ID NO: 1218) | 5517 | 5662 |
| HUMTIA1E_T47 (SEQ ID NO: 1219) | 5517 | 5662 |
| HUMTIA1E_T48 (SEQ ID NO: 1220) | 5517 | 5662 |

This segment can be found in both coding and non-coding regions of transcript(s) as follows. The segment can be found in a non-coding region of transcript(s) that are related to the following protein(s): HUMTIA1E_P5, HUMTIA1E_P8, HUMTIA1E_P7 and HUMTIA1E_P9. This segment can also be found in the following protein(s): HUMTIA1E_P1, HUMTIA1E_P2 and HUMTIA1E_P6, since it is in the coding region for the corresponding transcript.

Segment cluster HUMTIA1E_node_57 (SEQ ID NO:1247) according to the present invention is supported by 153 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219) and HUMTIA1E_T48 (SEQ ID NO:1220). Table 1157 below describes the starting and ending position of this segment on each transcript.

TABLE 1157

Segment location on transcripts

| Transcript name | Segment starting position | Segment ending position |
|---|---|---|
| HUMTIA1E_T0 (SEQ ID NO: 1188) | 5663 | 6183 |
| HUMTIA1E_T1 (SEQ ID NO: 1189) | 4546 | 5066 |
| HUMTIA1E_T2 (SEQ ID NO: 1190) | 5796 | 6316 |
| HUMTIA1E_T3 (SEQ ID NO: 1191) | 5835 | 6355 |
| HUMTIA1E_T6 (SEQ ID NO: 1192) | 5658 | 6178 |
| HUMTIA1E_T8 (SEQ ID NO: 1193) | 5607 | 6127 |
| HUMTIA1E_T9 (SEQ ID NO: 1194) | 6049 | 6569 |
| HUMTIA1E_T10 (SEQ ID NO: 1195) | 4394 | 4914 |
| HUMTIA1E_T11 (SEQ ID NO: 1196) | 5907 | 6427 |
| HUMTIA1E_T12 (SEQ ID NO: 1197) | 6509 | 7029 |
| HUMTIA1E_T13 (SEQ ID NO: 1198) | 6620 | 7140 |
| HUMTIA1E_T14 (SEQ ID NO: 1199) | 5663 | 6183 |
| HUMTIA1E_T15 (SEQ ID NO: 1200) | 5941 | 6461 |
| HUMTIA1E_T16 (SEQ ID NO: 1201) | 5566 | 6086 |
| HUMTIA1E_T17 (SEQ ID NO: 1202) | 5593 | 6113 |
| HUMTIA1E_T18 (SEQ ID NO: 1203) | 2558 | 3078 |
| HUMTIA1E_T19 (SEQ ID NO: 1204) | 4965 | 5485 |
| HUMTIA1E_T20 (SEQ ID NO: 1205) | 5098 | 5618 |
| HUMTIA1E_T21 (SEQ ID NO: 1206) | 4971 | 5491 |
| HUMTIA1E_T22 (SEQ ID NO: 1207) | 4292 | 4812 |
| HUMTIA1E_T23 (SEQ ID NO: 1208) | 6672 | 7192 |
| HUMTIA1E_T24 (SEQ ID NO: 1209) | 2976 | 3496 |
| HUMTIA1E_T26 (SEQ ID NO: 1210) | 5905 | 6425 |
| HUMTIA1E_T27 (SEQ ID NO: 1211) | 2624 | 3144 |
| HUMTIA1E_T28 (SEQ ID NO: 1212) | 5772 | 6292 |
| HUMTIA1E_T29 (SEQ ID NO: 1213) | 2757 | 3277 |
| HUMTIA1E_T32 (SEQ ID NO: 1214) | 2168 | 2688 |
| HUMTIA1E_T37 (SEQ ID NO: 1215) | 2135 | 2655 |

TABLE 1157-continued

Segment location on transcripts

| Transcript name | Segment starting position | Segment ending position |
|---|---|---|
| HUMTIA1E_T40 (SEQ ID NO: 1216) | 5663 | 6183 |
| HUMTIA1E_T45 (SEQ ID NO: 1217) | 5663 | 6183 |
| HUMTIA1E_T46 (SEQ ID NO: 1218) | 5663 | 6183 |
| HUMTIA1E_T47 (SEQ ID NO: 1219) | 5663 | 6183 |
| HUMTIA1E_T48 (SEQ ID NO: 1220) | 5663 | 6183 |

This segment can be found in both coding and non-coding regions of transcript(s) as follows. The segment can be found in a non-coding region of transcript(s) that are related to the following protein(s): HUMTIA1E_P5, HUMTIA1E_P8, HUMTIA1E_P7 and HUMTIA1E_P9. This segment can also be found in the following protein(s): HUMTIA1E_P1, HUMTIA1E_P2 and HUMTIA1E_P6, since it is in the coding region for the corresponding transcript.

Segment cluster HUMTIA1E_node_59 (SEQ ID NO:1248) according to the present invention is supported by 381 libraries. The number of libraries was determined as previously described. This segment can be found in the following transcript(s): HUMTIA1E_T0 (SEQ ID NO:1188), HUMTIA1E_TI (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219) and HUMTIA1E_T48 (SEQ ID NO:1220). Table 1158 below describes the starting and ending position of this segment on each transcript.

TABLE 1158

Segment location on transcripts

| Transcript name | Segment starting position | Segment ending position |
|---|---|---|
| HUMTIA1E_T0 (SEQ ID NO: 1188) | 6243 | 9064 |
| HUMTIA1E_T1 (SEQ ID NO: 1189) | 5126 | 7947 |
| HUMTIA1E_T2 (SEQ ID NO: 1190) | 6376 | 9197 |
| HUMTIA1E_T3 (SEQ ID NO: 1191) | 6415 | 9236 |
| HUMTIA1E_T6 (SEQ ID NO: 1192) | 6238 | 9059 |
| HUMTIA1E_T8 (SEQ ID NO: 1193) | 6187 | 9008 |
| HUMTIA1E_T9 (SEQ ID NO: 1194) | 6629 | 9450 |
| HUMTIA1E_T10 (SEQ ID NO: 1195) | 4974 | 7795 |
| HUMTIA1E_T11 (SEQ ID NO: 1196) | 6487 | 9308 |
| HUMTIA1E_T12 (SEQ ID NO: 1197) | 7089 | 9910 |
| HUMTIA1E_T13 (SEQ ID NO: 1198) | 7200 | 10021 |

TABLE 1158-continued

Segment location on transcripts

| Transcript name | Segment starting position | Segment ending position |
|---|---|---|
| HUMTIA1E_T14 (SEQ ID NO: 1199) | 6243 | 8304 |
| HUMTIA1E_T15 (SEQ ID NO: 1200) | 6521 | 9342 |
| HUMTIA1E_T16 (SEQ ID NO: 1201) | 6146 | 8967 |
| HUMTIA1E_T17 (SEQ ID NO: 1202) | 6173 | 8994 |
| HUMTIA1E_T18 (SEQ ID NO: 1203) | 3138 | 5959 |
| HUMTIA1E_T19 (SEQ ID NO: 1204) | 5545 | 8366 |
| HUMTIA1E_T20 (SEQ ID NO: 1205) | 5678 | 8499 |
| HUMTIA1E_T21 (SEQ ID NO: 1206) | 5551 | 8372 |
| HUMTIA1E_T22 (SEQ ID NO: 1207) | 4872 | 7693 |
| HUMTIA1E_T23 (SEQ ID NO: 1208) | 7252 | 10073 |
| HUMTIA1E_T24 (SEQ ID NO: 1209) | 3556 | 6377 |
| HUMTIA1E_T26 (SEQ ID NO: 1210) | 6485 | 9306 |
| HUMTIA1E_T27 (SEQ ID NO: 1211) | 3204 | 6025 |
| HUMTIA1E_T28 (SEQ ID NO: 1212) | 6352 | 9173 |
| HUMTIA1E_T29 (SEQ ID NO: 1213) | 3337 | 6158 |
| HUMTIA1E_T32 (SEQ ID NO: 1214) | 2748 | 5569 |
| HUMTIA1E_T37 (SEQ ID NO: 1215) | 2715 | 5536 |
| HUMTIA1E_T40 (SEQ ID NO: 1216) | 6184 | 9005 |
| HUMTIA1E_T45 (SEQ ID NO: 1217) | 6243 | 7851 |
| HUMTIA1E_T46 (SEQ ID NO: 1218) | 6243 | 7653 |
| HUMTIA1E_T47 (SEQ ID NO: 1219) | 6243 | 6826 |
| HUMTIA1E_T48 (SEQ ID NO: 1220) | 6243 | 6331 |

This segment can be found in a non-coding region of transcript(s) that are related to the following protein(s): HUMTIA1E_P1, HUMTIA1E_P2, HUMTIA1E_P5, HUMTIA1E_P6, HUMTIA1E_P8, HUMTIA1E_P7 and HUMTIA1E_P9.

According to an optional embodiment of the present invention, short segments related to the above cluster are also provided. These segments are up to about 120 bp in length, and so are included in a separate description.

Segment cluster HUMTIA1E_node_0 (SEQ ID NO:1249) according to the present invention is supported by 2 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226)

and HUMTIA1E_T58 (SEQ ID NO:1227). Table 1159 below describes the starting and ending position of this segment on each transcript.

TABLE 1159

Segment location on transcripts

| Transcript name | Segment starting position | Segment ending position |
|---|---|---|
| HUMTIA1E_T0 (SEQ ID NO: 1188) | 1 | 55 |
| HUMTIA1E_T1 (SEQ ID NO: 1189) | 1 | 55 |
| HUMTIA1E_T2 (SEQ ID NO: 1190) | 1 | 55 |
| HUMTIA1E_T3 (SEQ ID NO: 1191) | 1 | 55 |
| HUMTIA1E_T6 (SEQ ID NO: 1192) | 1 | 55 |
| HUMTIA1E_T8 (SEQ ID NO: 1193) | 1 | 55 |
| HUMTIA1E_T9 (SEQ ID NO: 1194) | 1 | 55 |
| HUMTIA1E_T10 (SEQ ID NO: 1195) | 1 | 55 |
| HUMTIA1E_T11 (SEQ ID NO: 1196) | 1 | 55 |
| HUMTIA1E_T12 (SEQ ID NO: 1197) | 1 | 55 |
| HUMTIA1E_T13 (SEQ ID NO: 1198) | 1 | 55 |
| HUMTIA1E_T14 (SEQ ID NO: 1199) | 1 | 55 |
| HUMTIA1E_T16 (SEQ ID NO: 1201) | 1 | 55 |
| HUMTIA1E_T18 (SEQ ID NO: 1203) | 1 | 55 |
| HUMTIA1E_T19 (SEQ ID NO: 1204) | 1 | 55 |
| HUMTIA1E_T20 (SEQ ID NO: 1205) | 1 | 55 |
| HUMTIA1E_T21 (SEQ ID NO: 1206) | 1 | 55 |
| HUMTIA1E_T22 (SEQ ID NO: 1207) | 1 | 55 |
| HUMTIA1E_T23 (SEQ ID NO: 1208) | 1 | 55 |
| HUMTIA1E_T24 (SEQ ID NO: 1209) | 1 | 55 |
| HUMTIA1E_T26 (SEQ ID NO: 1210) | 1 | 55 |
| HUMTIA1E_T27 (SEQ ID NO: 1211) | 1 | 55 |
| HUMTIA1E_T28 (SEQ ID NO: 1212) | 1 | 55 |
| HUMTIA1E_T29 (SEQ ID NO: 1213) | 1 | 55 |
| HUMTIA1E_T32 (SEQ ID NO: 1214) | 1 | 55 |
| HUMTIA1E_T37 (SEQ ID NO: 1215) | 1 | 55 |
| HUMTIA1E_T40 (SEQ ID NO: 1216) | 1 | 55 |
| HUMTIA1E_T45 (SEQ ID NO: 1217) | 1 | 55 |
| HUMTIA1E_T46 (SEQ ID NO: 1218) | 1 | 55 |
| HUMTIA1E_T47 (SEQ ID NO: 1219) | 1 | 55 |
| HUMTIA1E_T48 (SEQ ID NO: 1220) | 1 | 55 |
| HUMTIA1E_T50 (SEQ ID NO: 1221) | 1 | 55 |
| HUMTIA1E_T51 (SEQ ID NO: 1222) | 1 | 55 |
| HUMTIA1E_T52 (SEQ ID NO: 1223) | 1 | 55 |
| HUMTIA1E_T55 (SEQ ID NO: 1224) | 1 | 55 |
| HUMTIA1E_T56 (SEQ ID NO: 1225) | 1 | 55 |
| HUMTIA1E_T57 (SEQ ID NO: 1226) | 1 | 55 |
| HUMTIA1E_T58 (SEQ ID NO: 1227) | 1 | 55 |

This segment can be found in a non-coding region of transcript(s) that are related to the following protein(s): HUMTIA1E_P1, HUMTIA1E_P2, HUMTIA1E_P5, HUMTIA1E_P6, HUMTIA1E_P8, HUMTIA1E_P7, HUMTIA1E_P9, HUMTIA1E_P15 and HUMTIA1E_P14.

Segment cluster HUMTIA1E_node_1 (SEQ ID NO:1250) according to the present invention is supported by 41 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1160 below describes the starting and ending position of this segment on each transcript.

TABLE 1160

Segment location on transcripts

| Transcript name | Segment starting position | Segment ending position |
|---|---|---|
| HUMTIA1E_T0 (SEQ ID NO: 1188) | 56 | 142 |
| HUMTIA1E_T1 (SEQ ID NO: 1189) | 56 | 142 |
| HUMTIA1E_T2 (SEQ ID NO: 1190) | 56 | 142 |
| HUMTIA1E_T3 (SEQ ID NO: 1191) | 56 | 142 |
| HUMTIA1E_T6 (SEQ ID NO: 1192) | 56 | 142 |
| HUMTIA1E_T8 (SEQ ID NO: 1193) | 56 | 142 |
| HUMTIA1E_T9 (SEQ ID NO: 1194) | 56 | 142 |
| HUMTIA1E_T10 (SEQ ID NO: 1195) | 56 | 142 |
| HUMTIA1E_T11 (SEQ ID NO: 1196) | 56 | 142 |
| HUMTIA1E_T12 (SEQ ID NO: 1197) | 56 | 142 |
| HUMTIA1E_T13 (SEQ ID NO: 1198) | 56 | 142 |
| HUMTIA1E_T14 (SEQ ID NO: 1199) | 56 | 142 |
| HUMTIA1E_T16 (SEQ ID NO: 1201) | 56 | 142 |
| HUMTIA1E_T18 (SEQ ID NO: 1203) | 56 | 142 |
| HUMTIA1E_T19 (SEQ ID NO: 1204) | 56 | 142 |
| HUMTIA1E_T20 (SEQ ID NO: 1205) | 56 | 142 |
| HUMTIA1E_T21 (SEQ ID NO: 1206) | 56 | 142 |
| HUMTIA1E_T22 (SEQ ID NO: 1207) | 56 | 142 |
| HUMTIA1E_T23 (SEQ ID NO: 1208) | 56 | 142 |
| HUMTIA1E_T24 (SEQ ID NO: 1209) | 56 | 142 |
| HUMTIA1E_T26 (SEQ ID NO: 1210) | 56 | 142 |
| HUMTIA1E_T27 (SEQ ID NO: 1211) | 56 | 142 |
| HUMTIA1E_T28 (SEQ ID NO: 1212) | 56 | 142 |
| HUMTIA1E_T29 (SEQ ID NO: 1213) | 56 | 142 |
| HUMTIA1E_T32 (SEQ ID NO: 1214) | 56 | 142 |
| HUMTIA1E_T37 (SEQ ID NO: 1215) | 56 | 142 |
| HUMTIA1E_T40 (SEQ ID NO: 1216) | 56 | 142 |
| HUMTIA1E_T45 (SEQ ID NO: 1217) | 56 | 142 |
| HUMTIA1E_T46 (SEQ ID NO: 1218) | 56 | 142 |
| HUMTIA1E_T47 (SEQ ID NO: 1219) | 56 | 142 |
| HUMTIA1E_T48 (SEQ ID NO: 1220) | 56 | 142 |
| HUMTIA1E_T50 (SEQ ID NO: 1221) | 56 | 142 |
| HUMTIA1E_T51 (SEQ ID NO: 1222) | 56 | 142 |
| HUMTIA1E_T52 (SEQ ID NO: 1223) | 56 | 142 |
| HUMTIA1E_T55 (SEQ ID NO: 1224) | 56 | 142 |
| HUMTIA1E_T56 (SEQ ID NO: 1225) | 56 | 142 |
| HUMTIA1E_T57 (SEQ ID NO: 1226) | 56 | 142 |
| HUMTIA1E_T58 (SEQ ID NO: 1227) | 56 | 142 |

This segment can be found in a non-coding region of transcript(s) that are related to the following protein(s): HUMTIA1E_P1, HUMTIA1E_P2, HUMTIA1E_P5, HUMTIA1E_P6, HUMTIA1E_P8, HUMTIA1E_P7, HUMTIA1E_P9, HUMTIA1E_P15 and HUMTIA1E_P14.

Segment cluster HUMTIA1E_node_2 (SEQ ID NO:1251) according to the present invention is supported by 52 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T18 (SEQ ID NO:1203), HUMTIA1E_T19 (SEQ ID NO:1204), HUMTIA1E_T20 (SEQ ID NO:1205), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1161 below describes the starting and ending position of this segment on each transcript.

TABLE 1161

Segment location on transcripts

| Transcript name | Segment starting position | Segment ending position |
| --- | --- | --- |
| HUMTIA1E_T0 (SEQ ID NO: 1188) | 143 | 238 |
| HUMTIA1E_T1 (SEQ ID NO: 1189) | 143 | 238 |
| HUMTIA1E_T2 (SEQ ID NO: 1190) | 143 | 238 |
| HUMTIA1E_T3 (SEQ ID NO: 1191) | 143 | 238 |
| HUMTIA1E_T6 (SEQ ID NO: 1192) | 143 | 238 |
| HUMTIA1E_T8 (SEQ ID NO: 1193) | 143 | 238 |
| HUMTIA1E_T9 (SEQ ID NO: 1194) | 143 | 238 |
| HUMTIA1E_T10 (SEQ ID NO: 1195) | 143 | 238 |
| HUMTIA1E_T11 (SEQ ID NO: 1196) | 143 | 238 |
| HUMTIA1E_T12 (SEQ ID NO: 1197) | 143 | 238 |
| HUMTIA1E_T13 (SEQ ID NO: 1198) | 143 | 238 |
| HUMTIA1E_T14 (SEQ ID NO: 1199) | 143 | 238 |
| HUMTIA1E_T16 (SEQ ID NO: 1201) | 143 | 238 |
| HUMTIA1E_T18 (SEQ ID NO: 1203) | 143 | 238 |
| HUMTIA1E_T19 (SEQ ID NO: 1204) | 143 | 238 |
| HUMTIA1E_T20 (SEQ ID NO: 1205) | 143 | 238 |
| HUMTIA1E_T22 (SEQ ID NO: 1207) | 143 | 238 |
| HUMTIA1E_T23 (SEQ ID NO: 1208) | 143 | 238 |
| HUMTIA1E_T24 (SEQ ID NO: 1209) | 143 | 238 |
| HUMTIA1E_T26 (SEQ ID NO: 1210) | 143 | 238 |
| HUMTIA1E_T27 (SEQ ID NO: 1211) | 143 | 238 |
| HUMTIA1E_T28 (SEQ ID NO: 1212) | 143 | 238 |
| HUMTIA1E_T29 (SEQ ID NO: 1213) | 143 | 238 |
| HUMTIA1E_T32 (SEQ ID NO: 1214) | 143 | 238 |
| HUMTIA1E_T37 (SEQ ID NO: 1215) | 143 | 238 |
| HUMTIA1E_T40 (SEQ ID NO: 1216) | 143 | 238 |
| HUMTIA1E_T45 (SEQ ID NO: 1217) | 143 | 238 |
| HUMTIA1E_T46 (SEQ ID NO: 1218) | 143 | 238 |
| HUMTIA1E_T47 (SEQ ID NO: 1219) | 143 | 238 |
| HUMTIA1E_T48 (SEQ ID NO: 1220) | 143 | 238 |
| HUMTIA1E_T50 (SEQ ID NO: 1221) | 143 | 238 |
| HUMTIA1E_T51 (SEQ ID NO: 1222) | 143 | 238 |
| HUMTIA1E_T52 (SEQ ID NO: 1223) | 143 | 238 |
| HUMTIA1E_T55 (SEQ ID NO: 1224) | 143 | 238 |
| HUMTIA1E_T56 (SEQ ID NO: 1225) | 143 | 238 |
| HUMTIA1E_T57 (SEQ ID NO: 1226) | 143 | 238 |
| HUMTIA1E_T58 (SEQ ID NO: 1227) | 143 | 238 |

This segment can be found in a non-coding region of transcript(s) that are related to the following protein(s): HUMTIA1E_P1, HUMTIA1E_P2, HUMTIA1E_P5, HUMTIA1E_P6, HUMTIA1E_P8, HUMTIA1E_P7, HUMTIA1E_P9, HUMTIA1E_P15 and HUMTIA1E_P14.

Segment cluster HUMTIA1E_node_3 (SEQ ID NO:1252) according to the present invention is supported by 53 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1162 below describes the starting and ending position of this segment on each transcript.

TABLE 1162

Segment location on transcripts

| Transcript name | Segment starting position | Segment ending position |
| --- | --- | --- |
| HUMTIA1E_T0 (SEQ ID NO: 1188) | 239 | 313 |
| HUMTIA1E_T1 (SEQ ID NO: 1189) | 239 | 313 |
| HUMTIA1E_T2 (SEQ ID NO: 1190) | 239 | 313 |
| HUMTIA1E_T3 (SEQ ID NO: 1191) | 239 | 313 |
| HUMTIA1E_T6 (SEQ ID NO: 1192) | 239 | 313 |
| HUMTIA1E_T8 (SEQ ID NO: 1193) | 239 | 313 |
| HUMTIA1E_T9 (SEQ ID NO: 1194) | 239 | 313 |
| HUMTIA1E_T10 (SEQ ID NO: 1195) | 239 | 313 |
| HUMTIA1E_T11 (SEQ ID NO: 1196) | 239 | 313 |
| HUMTIA1E_T12 (SEQ ID NO: 1197) | 239 | 313 |
| HUMTIA1E_T13 (SEQ ID NO: 1198) | 239 | 313 |
| HUMTIA1E_T14 (SEQ ID NO: 1199) | 239 | 313 |
| HUMTIA1E_T16 (SEQ ID NO: 1201) | 239 | 313 |
| HUMTIA1E_T18 (SEQ ID NO: 1203) | 239 | 313 |
| HUMTIA1E_T19 (SEQ ID NO: 1204) | 239 | 313 |
| HUMTIA1E_T20 (SEQ ID NO: 1205) | 239 | 313 |
| HUMTIA1E_T21 (SEQ ID NO: 1206) | 143 | 217 |
| HUMTIA1E_T22 (SEQ ID NO: 1207) | 239 | 313 |
| HUMTIA1E_T23 (SEQ ID NO: 1208) | 239 | 313 |
| HUMTIA1E_T24 (SEQ ID NO: 1209) | 239 | 313 |
| HUMTIA1E_T26 (SEQ ID NO: 1210) | 239 | 313 |
| HUMTIA1E_T27 (SEQ ID NO: 1211) | 239 | 313 |
| HUMTIA1E_T28 (SEQ ID NO: 1212) | 239 | 313 |
| HUMTIA1E_T29 (SEQ ID NO: 1213) | 239 | 313 |
| HUMTIA1E_T32 (SEQ ID NO: 1214) | 239 | 313 |
| HUMTIA1E_T37 (SEQ ID NO: 1215) | 239 | 313 |
| HUMTIA1E_T40 (SEQ ID NO: 1216) | 239 | 313 |
| HUMTIA1E_T45 (SEQ ID NO: 1217) | 239 | 313 |
| HUMTIA1E_T46 (SEQ ID NO: 1218) | 239 | 313 |
| HUMTIA1E_T47 (SEQ ID NO: 1219) | 239 | 313 |
| HUMTIA1E_T48 (SEQ ID NO: 1220) | 239 | 313 |
| HUMTIA1E_T50 (SEQ ID NO: 1221) | 239 | 313 |
| HUMTIA1E_T51 (SEQ ID NO: 1222) | 239 | 313 |

TABLE 1162-continued

Segment location on transcripts

| Transcript name | Segment starting position | Segment ending position |
|---|---|---|
| HUMTIA1E_T52 (SEQ ID NO: 1223) | 239 | 313 |
| HUMTIA1E_T55 (SEQ ID NO: 1224) | 239 | 313 |
| HUMTIA1E_T56 (SEQ ID NO: 1225) | 239 | 313 |
| HUMTIA1E_T57 (SEQ ID NO: 1226) | 239 | 313 |
| HUMTIA1E_T58 (SEQ ID NO: 1227) | 239 | 313 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_5 (SEQ ID NO:1253) according to the present invention is supported by 1 libraries. The number of libraries was determined as previously described. This segment can be found in the following transcript(s): HUMTIA1E_T17 (SEQ ID NO:1202). Table 1163 below describes the starting and ending position of this segment on each transcript.

TABLE 1163

Segment location on transcripts

| Transcript name | Segment starting position | Segment ending position |
|---|---|---|
| HUMTIA1E_T17 (SEQ ID NO: 1202) | 1 | 71 |

This segment can be found in a non-coding region of transcript(s) that are related to the following protein(s): HUMTIA1E_P1.

Segment cluster HUMTIA1E_node_6 (SEQ ID NO:1254) according to the present invention can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1164 below describes the starting and ending position of this segment on each transcript.

TABLE 1164

Segment location on transcripts

| Transcript name | Segment starting position | Segment ending position |
|---|---|---|
| HUMTIA1E_T0 (SEQ ID NO: 1188) | 314 | 323 |
| HUMTIA1E_T1 (SEQ ID NO: 1189) | 314 | 323 |
| HUMTIA1E_T2 (SEQ ID NO: 1190) | 314 | 323 |
| HUMTIA1E_T3 (SEQ ID NO: 1191) | 314 | 323 |
| HUMTIA1E_T6 (SEQ ID NO: 1192) | 314 | 323 |
| HUMTIA1E_T8 (SEQ ID NO: 1193) | 314 | 323 |
| HUMTIA1E_T9 (SEQ ID NO: 1194) | 314 | 323 |
| HUMTIA1E_T10 (SEQ ID NO: 1195) | 314 | 323 |
| HUMTIA1E_T11 (SEQ ID NO: 1196) | 314 | 323 |
| HUMTIA1E_T12 (SEQ ID NO: 1197) | 314 | 323 |
| HUMTIA1E_T13 (SEQ ID NO: 1198) | 314 | 323 |
| HUMTIA1E_T14 (SEQ ID NO: 1199) | 314 | 323 |
| HUMTIA1E_T17 (SEQ ID NO: 1202) | 72 | 81 |
| HUMTIA1E_T18 (SEQ ID NO: 1203) | 314 | 323 |
| HUMTIA1E_T19 (SEQ ID NO: 1204) | 314 | 323 |
| HUMTIA1E_T20 (SEQ ID NO: 1205) | 314 | 323 |
| HUMTIA1E_T21 (SEQ ID NO: 1206) | 218 | 227 |
| HUMTIA1E_T23 (SEQ ID NO: 1208) | 314 | 323 |
| HUMTIA1E_T24 (SEQ ID NO: 1209) | 314 | 323 |
| HUMTIA1E_T26 (SEQ ID NO: 1210) | 314 | 323 |
| HUMTIA1E_T27 (SEQ ID NO: 1211) | 314 | 323 |
| HUMTIA1E_T28 (SEQ ID NO: 1212) | 314 | 323 |
| HUMTIA1E_T29 (SEQ ID NO: 1213) | 314 | 323 |
| HUMTIA1E_T32 (SEQ ID NO: 1214) | 314 | 323 |
| HUMTIA1E_T37 (SEQ ID NO: 1215) | 314 | 323 |
| HUMTIA1E_T40 (SEQ ID NO: 1216) | 314 | 323 |
| HUMTIA1E_T45 (SEQ ID NO: 1217) | 314 | 323 |
| HUMTIA1E_T46 (SEQ ID NO: 1218) | 314 | 323 |
| HUMTIA1E_T47 (SEQ ID NO: 1219) | 314 | 323 |
| HUMTIA1E_T48 (SEQ ID NO: 1220) | 314 | 323 |
| HUMTIA1E_T50 (SEQ ID NO: 1221) | 314 | 323 |
| HUMTIA1E_T51 (SEQ ID NO: 1222) | 314 | 323 |
| HUMTIA1E_T52 (SEQ ID NO: 1223) | 314 | 323 |
| HUMTIA1E_T55 (SEQ ID NO: 1224) | 314 | 323 |
| HUMTIA1E_T56 (SEQ ID NO: 1225) | 314 | 323 |
| HUMTIA1E_T57 (SEQ ID NO: 1226) | 314 | 323 |
| HUMTIA1E_T58 (SEQ ID NO: 1227) | 314 | 323 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_7 (SEQ ID NO:1255) according to the present invention is supported by 53 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1165 below describes the starting and ending position of this segment on each transcript.

TABLE 1165

Segment location on transcripts

| Transcript name | Segment starting position | Segment ending position |
|---|---|---|
| HUMTIA1E_T0 (SEQ ID NO: 1188) | 324 | 410 |
| HUMTIA1E_T1 (SEQ ID NO: 1189) | 324 | 410 |
| HUMTIA1E_T2 (SEQ ID NO: 1190) | 324 | 410 |
| HUMTIA1E_T3 (SEQ ID NO: 1191) | 324 | 410 |
| HUMTIA1E_T6 (SEQ ID NO: 1192) | 324 | 410 |
| HUMTIA1E_T8 (SEQ ID NO: 1193) | 324 | 410 |
| HUMTIA1E_T9 (SEQ ID NO: 1194) | 324 | 410 |
| HUMTIA1E_T10 (SEQ ID NO: 1195) | 324 | 410 |
| HUMTIA1E_T11 (SEQ ID NO: 1196) | 324 | 410 |
| HUMTIA1E_T12 (SEQ ID NO: 1197) | 324 | 410 |
| HUMTIA1E_T13 (SEQ ID NO: 1198) | 324 | 410 |
| HUMTIA1E_T14 (SEQ ID NO: 1199) | 324 | 410 |
| HUMTIA1E_T17 (SEQ ID NO: 1202) | 82 | 168 |
| HUMTIA1E_T18 (SEQ ID NO: 1203) | 324 | 410 |
| HUMTIA1E_T19 (SEQ ID NO: 1204) | 324 | 410 |
| HUMTIA1E_T20 (SEQ ID NO: 1205) | 324 | 410 |
| HUMTIA1E_T21 (SEQ ID NO: 1206) | 228 | 314 |
| HUMTIA1E_T23 (SEQ ID NO: 1208) | 324 | 410 |
| HUMTIA1E_T24 (SEQ ID NO: 1209) | 324 | 410 |
| HUMTIA1E_T26 (SEQ ID NO: 1210) | 324 | 410 |
| HUMTIA1E_T27 (SEQ ID NO: 1211) | 324 | 410 |
| HUMTIA1E_T28 (SEQ ID NO: 1212) | 324 | 410 |
| HUMTIA1E_T29 (SEQ ID NO: 1213) | 324 | 410 |
| HUMTIA1E_T32 (SEQ ID NO: 1214) | 324 | 410 |
| HUMTIA1E_T37 (SEQ ID NO: 1215) | 324 | 410 |
| HUMTIA1E_T40 (SEQ ID NO: 1216) | 324 | 410 |
| HUMTIA1E_T45 (SEQ ID NO: 1217) | 324 | 410 |
| HUMTIA1E_T46 (SEQ ID NO: 1218) | 324 | 410 |
| HUMTIA1E_T47 (SEQ ID NO: 1219) | 324 | 410 |
| HUMTIA1E_T48 (SEQ ID NO: 1220) | 324 | 410 |
| HUMTIA1E_T50 (SEQ ID NO: 1221) | 324 | 410 |
| HUMTIA1E_T51 (SEQ ID NO: 1222) | 324 | 410 |
| HUMTIA1E_T52 (SEQ ID NO: 1223) | 324 | 410 |
| HUMTIA1E_T55 (SEQ ID NO: 1224) | 324 | 410 |
| HUMTIA1E_T56 (SEQ ID NO: 1225) | 324 | 410 |
| HUMTIA1E_T57 (SEQ ID NO: 1226) | 324 | 410 |
| HUMTIA1E_T58 (SEQ ID NO: 1227) | 324 | 410 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_10 (SEQ ID NO:1256) according to the present invention can be found in the following transcript(s): HUMTIA1E_T0 (SEQ ID NO:1188), HUMTIA1E_TL (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1166 below describes the starting and ending position of this segment on each transcript.

TABLE 1166

Segment location on transcripts

| Transcript name | Segment starting position | Segment ending position |
|---|---|---|
| HUMTIA1E_T0 (SEQ ID NO: 1188) | 411 | 414 |
| HUMTIA1E_T1 (SEQ ID NO: 1189) | 411 | 414 |
| HUMTIA1E_T2 (SEQ ID NO: 1190) | 411 | 414 |
| HUMTIA1E_T3 (SEQ ID NO: 1191) | 411 | 414 |
| HUMTIA1E_T6 (SEQ ID NO: 1192) | 411 | 414 |
| HUMTIA1E_T8 (SEQ ID NO: 1193) | 411 | 414 |
| HUMTIA1E_T9 (SEQ ID NO: 1194) | 411 | 414 |
| HUMTIA1E_T10 (SEQ ID NO: 1195) | 411 | 414 |
| HUMTIA1E_T11 (SEQ ID NO: 1196) | 411 | 414 |
| HUMTIA1E_T12 (SEQ ID NO: 1197) | 411 | 414 |
| HUMTIA1E_T13 (SEQ ID NO: 1198) | 411 | 414 |
| HUMTIA1E_T14 (SEQ ID NO: 1199) | 411 | 414 |
| HUMTIA1E_T16 (SEQ ID NO: 1201) | 314 | 317 |
| HUMTIA1E_T17 (SEQ ID NO: 1202) | 169 | 172 |
| HUMTIA1E_T18 (SEQ ID NO: 1203) | 411 | 414 |
| HUMTIA1E_T19 (SEQ ID NO: 1204) | 411 | 414 |
| HUMTIA1E_T20 (SEQ ID NO: 1205) | 411 | 414 |
| HUMTIA1E_T21 (SEQ ID NO: 1206) | 315 | 318 |
| HUMTIA1E_T22 (SEQ ID NO: 1207) | 314 | 317 |
| HUMTIA1E_T23 (SEQ ID NO: 1208) | 411 | 414 |
| HUMTIA1E_T24 (SEQ ID NO: 1209) | 411 | 414 |
| HUMTIA1E_T26 (SEQ ID NO: 1210) | 411 | 414 |
| HUMTIA1E_T27 (SEQ ID NO: 1211) | 411 | 414 |
| HUMTIA1E_T28 (SEQ ID NO: 1212) | 411 | 414 |
| HUMTIA1E_T29 (SEQ ID NO: 1213) | 411 | 414 |
| HUMTIA1E_T32 (SEQ ID NO: 1214) | 411 | 414 |
| HUMTIA1E_T37 (SEQ ID NO: 1215) | 411 | 414 |
| HUMTIA1E_T40 (SEQ ID NO: 1216) | 411 | 414 |
| HUMTIA1E_T45 (SEQ ID NO: 1217) | 411 | 414 |
| HUMTIA1E_T46 (SEQ ID NO: 1218) | 411 | 414 |
| HUMTIA1E_T47 (SEQ ID NO: 1219) | 411 | 414 |
| HUMTIA1E_T48 (SEQ ID NO: 1220) | 411 | 414 |
| HUMTIA1E_T50 (SEQ ID NO: 1221) | 411 | 414 |
| HUMTIA1E_T51 (SEQ ID NO: 1222) | 411 | 414 |
| HUMTIA1E_T52 (SEQ ID NO: 1223) | 411 | 414 |
| HUMTIA1E_T55 (SEQ ID NO: 1224) | 411 | 414 |

TABLE 1166-continued

Segment location on transcripts

| Transcript name | Segment starting position | Segment ending position |
|---|---|---|
| HUMTIA1E_T56 (SEQ ID NO: 1225) | 411 | 414 |
| HUMTIA1E_T57 (SEQ ID NO: 1226) | 411 | 414 |
| HUMTIA1E_T58 (SEQ ID NO: 1227) | 411 | 414 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_11 (SEQ ID NO:1257) according to the present invention is supported by 53 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1167 below describes the starting and ending position of this segment on each transcript.

TABLE 1167

Segment location on transcripts

| Transcript name | Segment starting position | Segment ending position |
|---|---|---|
| HUMTIA1E_T0 (SEQ ID NO: 1188) | 415 | 504 |
| HUMTIA1E_T1 (SEQ ID NO: 1189) | 415 | 504 |
| HUMTIA1E_T2 (SEQ ID NO: 1190) | 415 | 504 |
| HUMTIA1E_T3 (SEQ ID NO: 1191) | 415 | 504 |
| HUMTIA1E_T6 (SEQ ID NO: 1192) | 415 | 504 |
| HUMTIA1E_T8 (SEQ ID NO: 1193) | 415 | 504 |
| HUMTIA1E_T9 (SEQ ID NO: 1194) | 415 | 504 |

TABLE 1167-continued

Segment location on transcripts

| Transcript name | Segment starting position | Segment ending position |
|---|---|---|
| HUMTIA1E_T10 (SEQ ID NO: 1195) | 415 | 504 |
| HUMTIA1E_T11 (SEQ ID NO: 1196) | 415 | 504 |
| HUMTIA1E_T12 (SEQ ID NO: 1197) | 415 | 504 |
| HUMTIA1E_T13 (SEQ ID NO: 1198) | 415 | 504 |
| HUMTIA1E_T14 (SEQ ID NO: 1199) | 415 | 504 |
| HUMTIA1E_T16 (SEQ ID NO: 1201) | 318 | 407 |
| HUMTIA1E_T17 (SEQ ID NO: 1202) | 173 | 262 |
| HUMTIA1E_T18 (SEQ ID NO: 1203) | 415 | 504 |
| HUMTIA1E_T19 (SEQ ID NO: 1204) | 415 | 504 |
| HUMTIA1E_T20 (SEQ ID NO: 1205) | 415 | 504 |
| HUMTIA1E_T21 (SEQ ID NO: 1206) | 319 | 408 |
| HUMTIA1E_T22 (SEQ ID NO: 1207) | 318 | 407 |
| HUMTIA1E_T23 (SEQ ID NO: 1208) | 415 | 504 |
| HUMTIA1E_T24 (SEQ ID NO: 1209) | 415 | 504 |
| HUMTIA1E_T26 (SEQ ID NO: 1210) | 415 | 504 |
| HUMTIA1E_T27 (SEQ ID NO: 1211) | 415 | 504 |
| HUMTIA1E_T28 (SEQ ID NO: 1212) | 415 | 504 |
| HUMTIA1E_T29 (SEQ ID NO: 1213) | 415 | 504 |
| HUMTIA1E_T32 (SEQ ID NO: 1214) | 415 | 504 |
| HUMTIA1E_T37 (SEQ ID NO: 1215) | 415 | 504 |
| HUMTIA1E_T40 (SEQ ID NO: 1216) | 415 | 504 |
| HUMTIA1E_T45 (SEQ ID NO: 1217) | 415 | 504 |
| HUMTIA1E_T46 (SEQ ID NO: 1218) | 415 | 504 |
| HUMTIA1E_T47 (SEQ ID NO: 1219) | 415 | 504 |
| HUMTIA1E_T48 (SEQ ID NO: 1220) | 415 | 504 |
| HUMTIA1E_T50 (SEQ ID NO: 1221) | 415 | 504 |
| HUMTIA1E_T51 (SEQ ID NO: 1222) | 415 | 504 |
| HUMTIA1E_T52 (SEQ ID NO: 1223) | 415 | 504 |
| HUMTIA1E_T55 (SEQ ID NO: 1224) | 415 | 504 |
| HUMTIA1E_T56 (SEQ ID NO: 1225) | 415 | 504 |
| HUMTIA1E_T57 (SEQ ID NO: 1226) | 415 | 504 |
| HUMTIA1E_T58 (SEQ ID NO: 1227) | 415 | 504 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_12 (SEQ ID NO:1258) according to the present invention can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T8 (SEQ ID NO:1193), HUMTIA1E_T9 (SEQ ID NO:1194), HUMTIA1E_T0 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50

(SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1168 below describes the starting and ending position of this segment on each transcript.

TABLE 1168

Segment location on transcripts

| Transcript name | Segment starting position | Segment ending position |
|---|---|---|
| HUMTIA1E_T0 (SEQ ID NO: 1188) | 505 | 509 |
| HUMTIA1E_T1 (SEQ ID NO: 1189) | 505 | 509 |
| HUMTIA1E_T2 (SEQ ID NO: 1190) | 505 | 509 |
| HUMTIA1E_T3 (SEQ ID NO: 1191) | 505 | 509 |
| HUMTIA1E_T8 (SEQ ID NO: 1193) | 505 | 509 |
| HUMTIA1E_T9 (SEQ ID NO: 1194) | 505 | 509 |
| HUMTIA1E_T10 (SEQ ID NO: 1195) | 505 | 509 |
| HUMTIA1E_T11 (SEQ ID NO: 1196) | 505 | 509 |
| HUMTIA1E_T12 (SEQ ID NO: 1197) | 505 | 509 |
| HUMTIA1E_T13 (SEQ ID NO: 1198) | 505 | 509 |
| HUMTIA1E_T14 (SEQ ID NO: 1199) | 505 | 509 |
| HUMTIA1E_T16 (SEQ ID NO: 1201) | 408 | 412 |
| HUMTIA1E_T17 (SEQ ID NO: 1202) | 263 | 267 |
| HUMTIA1E_T18 (SEQ ID NO: 1203) | 505 | 509 |
| HUMTIA1E_T19 (SEQ ID NO: 1204) | 505 | 509 |
| HUMTIA1E_T20 (SEQ ID NO: 1205) | 505 | 509 |
| HUMTIA1E_T21 (SEQ ID NO: 1206) | 409 | 413 |
| HUMTIA1E_T23 (SEQ ID NO: 1208) | 505 | 509 |
| HUMTIA1E_T24 (SEQ ID NO: 1209) | 505 | 509 |
| HUMTIA1E_T26 (SEQ ID NO: 1210) | 505 | 509 |
| HUMTIA1E_T27 (SEQ ID NO: 1211) | 505 | 509 |
| HUMTIA1E_T28 (SEQ ID NO: 1212) | 505 | 509 |
| HUMTIA1E_T29 (SEQ ID NO: 1213) | 505 | 509 |
| HUMTIA1E_T32 (SEQ ID NO: 1214) | 505 | 509 |
| HUMTIA1E_T37 (SEQ ID NO: 1215) | 505 | 509 |
| HUMTIA1E_T40 (SEQ ID NO: 1216) | 505 | 509 |
| HUMTIA1E_T45 (SEQ ID NO: 1217) | 505 | 509 |
| HUMTIA1E_T46 (SEQ ID NO: 1218) | 505 | 509 |
| HUMTIA1E_T47 (SEQ ID NO: 1219) | 505 | 509 |
| HUMTIA1E_T48 (SEQ ID NO: 1220) | 505 | 509 |
| HUMTIA1E_T50 (SEQ ID NO: 1221) | 505 | 509 |
| HUMTIA1E_T51 (SEQ ID NO: 1222) | 505 | 509 |
| HUMTIA1E_T52 (SEQ ID NO: 1223) | 505 | 509 |
| HUMTIA1E_T55 (SEQ ID NO: 1224) | 505 | 509 |
| HUMTIA1E_T56 (SEQ ID NO: 1225) | 505 | 509 |
| HUMTIA1E_T57 (SEQ ID NO: 1226) | 505 | 509 |
| HUMTIA1E_T58 (SEQ ID NO: 1227) | 505 | 509 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_15 (SEQ ID NO:1259) according to the present invention is supported by 52 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1169 below describes the starting and ending position of this segment on each transcript.

TABLE 1169

Segment location on transcripts

| Transcript name | Segment starting position | Segment ending position |
|---|---|---|
| HUMTIA1E_T0 (SEQ ID NO: 1188) | 510 | 564 |
| HUMTIA1E_T1 (SEQ ID NO: 1189) | 510 | 564 |
| HUMTIA1E_T2 (SEQ ID NO: 1190) | 510 | 564 |
| HUMTIA1E_T3 (SEQ ID NO: 1191) | 510 | 564 |
| HUMTIA1E_T6 (SEQ ID NO: 1192) | 505 | 559 |
| HUMTIA1E_T8 (SEQ ID NO: 1193) | 510 | 564 |
| HUMTIA1E_T9 (SEQ ID NO: 1194) | 510 | 564 |
| HUMTIA1E_T10 (SEQ ID NO: 1195) | 510 | 564 |
| HUMTIA1E_T11 (SEQ ID NO: 1196) | 510 | 564 |
| HUMTIA1E_T12 (SEQ ID NO: 1197) | 510 | 564 |
| HUMTIA1E_T13 (SEQ ID NO: 1198) | 510 | 564 |
| HUMTIA1E_T14 (SEQ ID NO: 1199) | 510 | 564 |
| HUMTIA1E_T15 (SEQ ID NO: 1200) | 616 | 670 |
| HUMTIA1E_T16 (SEQ ID NO: 1201) | 413 | 467 |
| HUMTIA1E_T17 (SEQ ID NO: 1202) | 268 | 322 |
| HUMTIA1E_T18 (SEQ ID NO: 1203) | 510 | 564 |
| HUMTIA1E_T19 (SEQ ID NO: 1204) | 510 | 564 |
| HUMTIA1E_T20 (SEQ ID NO: 1205) | 510 | 564 |
| HUMTIA1E_T21 (SEQ ID NO: 1206) | 414 | 468 |
| HUMTIA1E_T22 (SEQ ID NO: 1207) | 408 | 462 |
| HUMTIA1E_T23 (SEQ ID NO: 1208) | 510 | 564 |
| HUMTIA1E_T24 (SEQ ID NO: 1209) | 510 | 564 |
| HUMTIA1E_T26 (SEQ ID NO: 1210) | 510 | 564 |
| HUMTIA1E_T27 (SEQ ID NO: 1211) | 510 | 564 |
| HUMTIA1E_T28 (SEQ ID NO: 1212) | 510 | 564 |
| HUMTIA1E_T29 (SEQ ID NO: 1213) | 510 | 564 |
| HUMTIA1E_T32 (SEQ ID NO: 1214) | 510 | 564 |
| HUMTIA1E_T37 (SEQ ID NO: 1215) | 510 | 564 |
| HUMTIA1E_T40 (SEQ ID NO: 1216) | 510 | 564 |
| HUMTIA1E_T45 (SEQ ID NO: 1217) | 510 | 564 |
| HUMTIA1E_T46 (SEQ ID NO: 1218) | 510 | 564 |
| HUMTIA1E_T47 (SEQ ID NO: 1219) | 510 | 564 |
| HUMTIA1E_T48 (SEQ ID NO: 1220) | 510 | 564 |
| HUMTIA1E_T50 (SEQ ID NO: 1221) | 510 | 564 |
| HUMTIA1E_T51 (SEQ ID NO: 1222) | 510 | 564 |
| HUMTIA1E_T52 (SEQ ID NO: 1223) | 510 | 564 |
| HUMTIA1E_T55 (SEQ ID NO: 1224) | 510 | 564 |
| HUMTIA1E_T56 (SEQ ID NO: 1225) | 510 | 564 |
| HUMTIA1E_T57 (SEQ ID NO: 1226) | 510 | 564 |
| HUMTIA1E_T58 (SEQ ID NO: 1227) | 510 | 564 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7, HUMTIA1E_P9, HUMTIA1E_P15 and HUMTIA1E_P14, since it is in the coding region for the corresponding transcript.

Segment cluster HUMTIA1E_node_17 (SEQ ID NO:1260) according to the present invention is supported by 35 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225) and HUMTIA1E_T57 (SEQ ID NO:1226). Table 1170 below describes the starting and ending position of this segment on each transcript.

TABLE 1170

| Segment location on transcripts | | |
|---|---|---|
| Transcript name | Segment starting position | Segment ending position |
| HUMTIA1E_T0 (SEQ ID NO: 1188) | 565 | 597 |
| HUMTIA1E_T1 (SEQ ID NO: 1189) | 565 | 597 |
| HUMTIA1E_T2 (SEQ ID NO: 1190) | 565 | 597 |
| HUMTIA1E_T3 (SEQ ID NO: 1191) | 737 | 769 |
| HUMTIA1E_T6 (SEQ ID NO: 1192) | 560 | 592 |
| HUMTIA1E_T8 (SEQ ID NO: 1193) | 565 | 597 |
| HUMTIA1E_T9 (SEQ ID NO: 1194) | 565 | 597 |
| HUMTIA1E_T11 (SEQ ID NO: 1196) | 565 | 597 |
| HUMTIA1E_T12 (SEQ ID NO: 1197) | 565 | 597 |
| HUMTIA1E_T13 (SEQ ID NO: 1198) | 565 | 597 |
| HUMTIA1E_T14 (SEQ ID NO: 1199) | 565 | 597 |
| HUMTIA1E_T15 (SEQ ID NO: 1200) | 843 | 875 |
| HUMTIA1E_T16 (SEQ ID NO: 1201) | 468 | 500 |
| HUMTIA1E_T17 (SEQ ID NO: 1202) | 495 | 527 |
| HUMTIA1E_T18 (SEQ ID NO: 1203) | 565 | 597 |
| HUMTIA1E_T19 (SEQ ID NO: 1204) | 565 | 597 |
| HUMTIA1E_T20 (SEQ ID NO: 1205) | 565 | 597 |
| HUMTIA1E_T21 (SEQ ID NO: 1206) | 469 | 501 |
| HUMTIA1E_T23 (SEQ ID NO: 1208) | 565 | 597 |
| HUMTIA1E_T24 (SEQ ID NO: 1209) | 565 | 597 |
| HUMTIA1E_T26 (SEQ ID NO: 1210) | 565 | 597 |
| HUMTIA1E_T27 (SEQ ID NO: 1211) | 565 | 597 |
| HUMTIA1E_T28 (SEQ ID NO: 1212) | 565 | 597 |
| HUMTIA1E_T29 (SEQ ID NO: 1213) | 565 | 597 |
| HUMTIA1E_T32 (SEQ ID NO: 1214) | 565 | 597 |
| HUMTIA1E_T40 (SEQ ID NO: 1216) | 565 | 597 |
| HUMTIA1E_T45 (SEQ ID NO: 1217) | 565 | 597 |
| HUMTIA1E_T46 (SEQ ID NO: 1218) | 565 | 597 |
| HUMTIA1E_T47 (SEQ ID NO: 1219) | 565 | 597 |
| HUMTIA1E_T48 (SEQ ID NO: 1220) | 565 | 597 |
| HUMTIA1E_T50 (SEQ ID NO: 1221) | 565 | 597 |
| HUMTIA1E_T51 (SEQ ID NO: 1222) | 565 | 597 |
| HUMTIA1E_T52 (SEQ ID NO: 1223) | 565 | 597 |
| HUMTIA1E_T55 (SEQ ID NO: 1224) | 565 | 597 |
| HUMTIA1E_T56 (SEQ ID NO: 1225) | 565 | 597 |
| HUMTIA1E_T57 (SEQ ID NO: 1226) | 565 | 597 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P6 and HUMTIA1E_P8. This segment can also be found in the following protein(s): HUMTIA1E_P5, HUMTIA1E_P7 and HUMTIA1E_P15, since it is in the coding region for the corresponding transcript.

Segment cluster HUMTIA1E_node_19 (SEQ ID NO:1261) according to the present invention is supported by 18 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T56 (SEQ ID NO:1225) and HUMTIA1E_T57 (SEQ ID NO:1226). Table 1171 below describes the starting and ending position of this segment on each transcript.

TABLE 1171

| Segment location on transcripts | | |
|---|---|---|
| Transcript name | Segment starting position | Segment ending position |
| HUMTIA1E_T0 (SEQ ID NO: 1188) | 1194 | 1312 |
| HUMTIA1E_T1 (SEQ ID NO: 1189) | 598 | 716 |
| HUMTIA1E_T2 (SEQ ID NO: 1190) | 1194 | 1312 |
| HUMTIA1E_T3 (SEQ ID NO: 1191) | 1366 | 1484 |
| HUMTIA1E_T6 (SEQ ID NO: 1192) | 1189 | 1307 |
| HUMTIA1E_T8 (SEQ ID NO: 1193) | 1194 | 1312 |
| HUMTIA1E_T9 (SEQ ID NO: 1194) | 1194 | 1312 |
| HUMTIA1E_T11 (SEQ ID NO: 1196) | 1194 | 1312 |
| HUMTIA1E_T12 (SEQ ID NO: 1197) | 1194 | 1312 |
| HUMTIA1E_T13 (SEQ ID NO: 1198) | 1194 | 1312 |

TABLE 1171-continued

Segment location on transcripts

| Transcript name | Segment starting position | Segment ending position |
| --- | --- | --- |
| HUMTIA1E_T14 (SEQ ID NO: 1199) | 1194 | 1312 |
| HUMTIA1E_T15 (SEQ ID NO: 1200) | 1472 | 1590 |
| HUMTIA1E_T16 (SEQ ID NO: 1201) | 1097 | 1215 |
| HUMTIA1E_T17 (SEQ ID NO: 1202) | 1124 | 1242 |
| HUMTIA1E_T18 (SEQ ID NO: 1203) | 1194 | 1312 |
| HUMTIA1E_T19 (SEQ ID NO: 1204) | 1194 | 1312 |
| HUMTIA1E_T20 (SEQ ID NO: 1205) | 1194 | 1312 |
| HUMTIA1E_T21 (SEQ ID NO: 1206) | 502 | 620 |
| HUMTIA1E_T23 (SEQ ID NO: 1208) | 1194 | 1312 |
| HUMTIA1E_T24 (SEQ ID NO: 1209) | 1194 | 1312 |
| HUMTIA1E_T26 (SEQ ID NO: 1210) | 1194 | 1312 |
| HUMTIA1E_T27 (SEQ ID NO: 1211) | 1194 | 1312 |
| HUMTIA1E_T28 (SEQ ID NO: 1212) | 1194 | 1312 |
| HUMTIA1E_T29 (SEQ ID NO: 1213) | 1194 | 1312 |
| HUMTIA1E_T40 (SEQ ID NO: 1216) | 1194 | 1312 |
| HUMTIA1E_T45 (SEQ ID NO: 1217) | 1194 | 1312 |
| HUMTIA1E_T46 (SEQ ID NO: 1218) | 1194 | 1312 |
| HUMTIA1E_T47 (SEQ ID NO: 1219) | 1194 | 1312 |
| HUMTIA1E_T48 (SEQ ID NO: 1220) | 1194 | 1312 |
| HUMTIA1E_T50 (SEQ ID NO: 1221) | 1194 | 1312 |
| HUMTIA1E_T51 (SEQ ID NO: 1222) | 1194 | 1312 |
| HUMTIA1E_T52 (SEQ ID NO: 1223) | 1194 | 1312 |
| HUMTIA1E_T56 (SEQ ID NO: 1225) | 1194 | 1312 |
| HUMTIA1E_T57 (SEQ ID NO: 1226) | 598 | 716 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8. This segment can also be found in the following protein(s): HUMTIA1E_P15, since it is in the coding region for the corresponding transcript.

Segment cluster HUMTIA1E_node_21 (SEQ ID NO:1262) according to the present invention is supported by 56 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1172 below describes the starting and ending position of this segment on each transcript.

TABLE 1172

Segment location on transcripts

| Transcript name | Segment starting position | Segment ending position |
| --- | --- | --- |
| HUMTIA1E_T0 (SEQ ID NO: 1188) | 1834 | 1921 |
| HUMTIA1E_T1 (SEQ ID NO: 1189) | 717 | 804 |
| HUMTIA1E_T2 (SEQ ID NO: 1190) | 1834 | 1921 |
| HUMTIA1E_T3 (SEQ ID NO: 1191) | 2006 | 2093 |
| HUMTIA1E_T6 (SEQ ID NO: 1192) | 1829 | 1916 |
| HUMTIA1E_T8 (SEQ ID NO: 1193) | 1834 | 1921 |
| HUMTIA1E_T9 (SEQ ID NO: 1194) | 1834 | 1921 |
| HUMTIA1E_T10 (SEQ ID NO: 1195) | 565 | 652 |
| HUMTIA1E_T11 (SEQ ID NO: 1196) | 1834 | 1921 |
| HUMTIA1E_T12 (SEQ ID NO: 1197) | 1834 | 1921 |
| HUMTIA1E_T13 (SEQ ID NO: 1198) | 1834 | 1921 |
| HUMTIA1E_T14 (SEQ ID NO: 1199) | 1834 | 1921 |
| HUMTIA1E_T15 (SEQ ID NO: 1200) | 2112 | 2199 |
| HUMTIA1E_T16 (SEQ ID NO: 1201) | 1737 | 1824 |
| HUMTIA1E_T17 (SEQ ID NO: 1202) | 1764 | 1851 |
| HUMTIA1E_T18 (SEQ ID NO: 1203) | 1834 | 1921 |
| HUMTIA1E_T19 (SEQ ID NO: 1204) | 1834 | 1921 |
| HUMTIA1E_T20 (SEQ ID NO: 1205) | 1834 | 1921 |
| HUMTIA1E_T21 (SEQ ID NO: 1206) | 1142 | 1229 |
| HUMTIA1E_T22 (SEQ ID NO: 1207) | 463 | 550 |
| HUMTIA1E_T23 (SEQ ID NO: 1208) | 1834 | 1921 |
| HUMTIA1E_T24 (SEQ ID NO: 1209) | 1313 | 1400 |
| HUMTIA1E_T26 (SEQ ID NO: 1210) | 1834 | 1921 |
| HUMTIA1E_T27 (SEQ ID NO: 1211) | 1834 | 1921 |
| HUMTIA1E_T28 (SEQ ID NO: 1212) | 1834 | 1921 |
| HUMTIA1E_T29 (SEQ ID NO: 1213) | 1834 | 1921 |
| HUMTIA1E_T32 (SEQ ID NO: 1214) | 598 | 685 |
| HUMTIA1E_T37 (SEQ ID NO: 1215) | 565 | 652 |
| HUMTIA1E_T40 (SEQ ID NO: 1216) | 1834 | 1921 |
| HUMTIA1E_T45 (SEQ ID NO: 1217) | 1834 | 1921 |
| HUMTIA1E_T46 (SEQ ID NO: 1218) | 1834 | 1921 |
| HUMTIA1E_T47 (SEQ ID NO: 1219) | 1834 | 1921 |
| HUMTIA1E_T48 (SEQ ID NO: 1220) | 1834 | 1921 |
| HUMTIA1E_T50 (SEQ ID NO: 1221) | 1834 | 1921 |
| HUMTIA1E_T51 (SEQ ID NO: 1222) | 1834 | 1921 |
| HUMTIA1E_T52 (SEQ ID NO: 1223) | 1834 | 1921 |
| HUMTIA1E_T55 (SEQ ID NO: 1224) | 598 | 685 |
| HUMTIA1E_T56 (SEQ ID NO: 1225) | 1834 | 1921 |
| HUMTIA1E_T57 (SEQ ID NO: 1226) | 717 | 804 |
| HUMTIA1E_T58 (SEQ ID NO: 1227) | 565 | 652 |

This segment can be found in both coding and non-coding regions of transcript(s) as follows. The segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8. This segment can also be found in the following protein(s): HUMTIA1E_P7, HUMTIA1E_P9, HUMTIA1E_P15 and HUMTIA1E_P14, since it is in the coding region for the corresponding transcript.

Segment cluster HUMTIA1E_node_24 (SEQ ID NO:1263) according to the present invention is supported by 26 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17

(SEQ ID NO:1202), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1173 below describes the starting and ending position of this segment on each transcript.

TABLE 1173

Segment location on transcripts

| Transcript name | Segment starting position | Segment ending position |
| --- | --- | --- |
| HUMTIA1E_T0 (SEQ ID NO: 1188) | 4263 | 4328 |
| HUMTIA1E_T1 (SEQ ID NO: 1189) | 3146 | 3211 |
| HUMTIA1E_T2 (SEQ ID NO: 1190) | 4263 | 4328 |
| HUMTIA1E_T3 (SEQ ID NO: 1191) | 4435 | 4500 |
| HUMTIA1E_T6 (SEQ ID NO: 1192) | 4258 | 4323 |
| HUMTIA1E_T8 (SEQ ID NO: 1193) | 4263 | 4328 |
| HUMTIA1E_T9 (SEQ ID NO: 1194) | 4263 | 4328 |
| HUMTIA1E_T10 (SEQ ID NO: 1195) | 2994 | 3059 |
| HUMTIA1E_T11 (SEQ ID NO: 1196) | 4263 | 4328 |
| HUMTIA1E_T12 (SEQ ID NO: 1197) | 4263 | 4328 |
| HUMTIA1E_T13 (SEQ ID NO: 1198) | 4263 | 4328 |
| HUMTIA1E_T14 (SEQ ID NO: 1199) | 4263 | 4328 |
| HUMTIA1E_T15 (SEQ ID NO: 1200) | 4541 | 4606 |
| HUMTIA1E_T16 (SEQ ID NO: 1201) | 4166 | 4231 |
| HUMTIA1E_T17 (SEQ ID NO: 1202) | 4193 | 4258 |
| HUMTIA1E_T19 (SEQ ID NO: 1204) | 4263 | 4328 |
| HUMTIA1E_T20 (SEQ ID NO: 1205) | 4263 | 4328 |
| HUMTIA1E_T21 (SEQ ID NO: 1206) | 3571 | 3636 |
| HUMTIA1E_T22 (SEQ ID NO: 1207) | 2892 | 2957 |
| HUMTIA1E_T23 (SEQ ID NO: 1208) | 4263 | 4328 |
| HUMTIA1E_T24 (SEQ ID NO: 1209) | 1576 | 1641 |
| HUMTIA1E_T26 (SEQ ID NO: 1210) | 4263 | 4328 |
| HUMTIA1E_T27 (SEQ ID NO: 1211) | 1922 | 1987 |
| HUMTIA1E_T28 (SEQ ID NO: 1212) | 4263 | 4328 |
| HUMTIA1E_T29 (SEQ ID NO: 1213) | 1922 | 1987 |
| HUMTIA1E_T40 (SEQ ID NO: 1216) | 4263 | 4328 |
| HUMTIA1E_T45 (SEQ ID NO: 1217) | 4263 | 4328 |
| HUMTIA1E_T46 (SEQ ID NO: 1218) | 4263 | 4328 |
| HUMTIA1E_T47 (SEQ ID NO: 1219) | 4263 | 4328 |
| HUMTIA1E_T48 (SEQ ID NO: 1220) | 4263 | 4328 |
| HUMTIA1E_T50 (SEQ ID NO: 1221) | 4263 | 4328 |
| HUMTIA1E_T51 (SEQ ID NO: 1222) | 4263 | 4328 |
| HUMTIA1E_T52 (SEQ ID NO: 1223) | 4263 | 4328 |

This segment can be found in a non-coding region of transcript(s) that are related to the following protein(s): HUMTIA1E_P1, HUMTIA1E_P2, HUMTIA1E_P5, HUMTIA1E_P6 and HUMTIA1E_P8.

Segment cluster HUMTIA1E_node_26 (SEQ ID NO:1264) according to the present invention is supported by 13 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T28 (SEQ ID NO:1212), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222) and HUMTIA1E_T52 (SEQ ID NO:1223). Table 1174 below describes the starting and ending position of this segment on each transcript.

TABLE 1174

Segment location on transcripts

| Transcript name | Segment starting position | Segment ending position |
| --- | --- | --- |
| HUMTIA1E_T0 (SEQ ID NO: 1188) | 4551 | 4604 |
| HUMTIA1E_T1 (SEQ ID NO: 1189) | 3434 | 3487 |
| HUMTIA1E_T2 (SEQ ID NO: 1190) | 4551 | 4604 |
| HUMTIA1E_T3 (SEQ ID NO: 1191) | 4723 | 4776 |
| HUMTIA1E_T6 (SEQ ID NO: 1192) | 4546 | 4599 |
| HUMTIA1E_T8 (SEQ ID NO: 1193) | 4551 | 4604 |
| HUMTIA1E_T9 (SEQ ID NO: 1194) | 4551 | 4604 |
| HUMTIA1E_T10 (SEQ ID NO: 1195) | 3282 | 3335 |
| HUMTIA1E_T11 (SEQ ID NO: 1196) | 4551 | 4604 |
| HUMTIA1E_T12 (SEQ ID NO: 1197) | 4551 | 4604 |
| HUMTIA1E_T13 (SEQ ID NO: 1198) | 4551 | 4604 |
| HUMTIA1E_T14 (SEQ ID NO: 1199) | 4551 | 4604 |
| HUMTIA1E_T15 (SEQ ID NO: 1200) | 4829 | 4882 |
| HUMTIA1E_T16 (SEQ ID NO: 1201) | 4454 | 4507 |
| HUMTIA1E_T17 (SEQ ID NO: 1202) | 4481 | 4534 |
| HUMTIA1E_T21 (SEQ ID NO: 1206) | 3859 | 3912 |
| HUMTIA1E_T22 (SEQ ID NO: 1207) | 3180 | 3233 |
| HUMTIA1E_T23 (SEQ ID NO: 1208) | 4551 | 4604 |
| HUMTIA1E_T24 (SEQ ID NO: 1209) | 1864 | 1917 |
| HUMTIA1E_T26 (SEQ ID NO: 1210) | 4551 | 4604 |
| HUMTIA1E_T28 (SEQ ID NO: 1212) | 4551 | 4604 |
| HUMTIA1E_T40 (SEQ ID NO: 1216) | 4551 | 4604 |
| HUMTIA1E_T45 (SEQ ID NO: 1217) | 4551 | 4604 |
| HUMTIA1E_T46 (SEQ ID NO: 1218) | 4551 | 4604 |
| HUMTIA1E_T47 (SEQ ID NO: 1219) | 4551 | 4604 |
| HUMTIA1E_T48 (SEQ ID NO: 1220) | 4551 | 4604 |
| HUMTIA1E_T50 (SEQ ID NO: 1221) | 4551 | 4604 |
| HUMTIA1E_T51 (SEQ ID NO: 1222) | 4551 | 4604 |
| HUMTIA1E_T52 (SEQ ID NO: 1223) | 4551 | 4604 |

This segment can be found in a non-coding region of transcript(s) that are related to the following protein(s): HUMTIA1E_P1, HUMTIA1E_P2, HUMTIA1E_P5 and HUMTIA1E_P8.

Segment cluster HUMTIA1E_node_28 (SEQ ID NO:1265) according to the present invention is supported by 73 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221), HUMTIA1E_T51 (SEQ ID NO:1222), HUMTIA1E_T52 (SEQ ID NO:1223), HUMTIA1E_T55 (SEQ ID NO:1224), HUMTIA1E_T56 (SEQ ID NO:1225), HUMTIA1E_T57 (SEQ ID NO:1226) and HUMTIA1E_T58 (SEQ ID NO:1227). Table 1175 below describes the starting and ending position of this segment on each transcript.

TABLE 1175

Segment location on transcripts

| Transcript name | Segment starting position | Segment ending position |
|---|---|---|
| HUMTIA1E_T0 (SEQ ID NO: 1188) | 5027 | 5102 |
| HUMTIA1E_T1 (SEQ ID NO: 1189) | 3910 | 3985 |
| HUMTIA1E_T2 (SEQ ID NO: 1190) | 5027 | 5102 |
| HUMTIA1E_T3 (SEQ ID NO: 1191) | 5199 | 5274 |
| HUMTIA1E_T6 (SEQ ID NO: 1192) | 5022 | 5097 |
| HUMTIA1E_T8 (SEQ ID NO: 1193) | 5027 | 5102 |
| HUMTIA1E_T9 (SEQ ID NO: 1194) | 5027 | 5102 |
| HUMTIA1E_T10 (SEQ ID NO: 1195) | 3758 | 3833 |
| HUMTIA1E_T11 (SEQ ID NO: 1196) | 5027 | 5102 |
| HUMTIA1E_T12 (SEQ ID NO: 1197) | 5027 | 5102 |
| HUMTIA1E_T13 (SEQ ID NO: 1198) | 5027 | 5102 |
| HUMTIA1E_T14 (SEQ ID NO: 1199) | 5027 | 5102 |
| HUMTIA1E_T15 (SEQ ID NO: 1200) | 5305 | 5380 |
| HUMTIA1E_T16 (SEQ ID NO: 1201) | 4930 | 5005 |
| HUMTIA1E_T17 (SEQ ID NO: 1202) | 4957 | 5032 |
| HUMTIA1E_T18 (SEQ ID NO: 1203) | 1922 | 1997 |
| HUMTIA1E_T19 (SEQ ID NO: 1204) | 4329 | 4404 |
| HUMTIA1E_T20 (SEQ ID NO: 1205) | 4329 | 4404 |
| HUMTIA1E_T21 (SEQ ID NO: 1206) | 4335 | 4410 |
| HUMTIA1E_T22 (SEQ ID NO: 1207) | 3656 | 3731 |
| HUMTIA1E_T23 (SEQ ID NO: 1208) | 5027 | 5102 |
| HUMTIA1E_T24 (SEQ ID NO: 1209) | 2340 | 2415 |
| HUMTIA1E_T26 (SEQ ID NO: 1210) | 5027 | 5102 |
| HUMTIA1E_T27 (SEQ ID NO: 1211) | 1988 | 2063 |
| HUMTIA1E_T28 (SEQ ID NO: 1212) | 5027 | 5102 |
| HUMTIA1E_T29 (SEQ ID NO: 1213) | 1988 | 2063 |
| HUMTIA1E_T32 (SEQ ID NO: 1214) | 686 | 761 |
| HUMTIA1E_T37 (SEQ ID NO: 1215) | 653 | 728 |
| HUMTIA1E_T40 (SEQ ID NO: 1216) | 5027 | 5102 |
| HUMTIA1E_T45 (SEQ ID NO: 1217) | 5027 | 5102 |
| HUMTIA1E_T46 (SEQ ID NO: 1218) | 5027 | 5102 |
| HUMTIA1E_T47 (SEQ ID NO: 1219) | 5027 | 5102 |
| HUMTIA1E_T48 (SEQ ID NO: 1220) | 5027 | 5102 |
| HUMTIA1E_T50 (SEQ ID NO: 1221) | 5027 | 5102 |
| HUMTIA1E_T51 (SEQ ID NO: 1222) | 5027 | 5102 |
| HUMTIA1E_T52 (SEQ ID NO: 1223) | 5027 | 5102 |
| HUMTIA1E_T55 (SEQ ID NO: 1224) | 686 | 761 |
| HUMTIA1E_T56 (SEQ ID NO: 1225) | 1922 | 1997 |
| HUMTIA1E_T57 (SEQ ID NO: 1226) | 805 | 880 |
| HUMTIA1E_T58 (SEQ ID NO: 1227) | 653 | 728 |

This segment can be found in both coding and non-coding regions of transcript(s) as follows. The segment can be found in a non-coding region of transcript(s) that are related to the following protein(s): HUMTIA1E_P2, HUMTIA1E_P5 and HUMTIA1E_P15. This segment can also be found in the following protein(s): HUMTIA1E_P1, HUMTIA1E_P6, HUMTIA1E_P8, HUMTIA1E_P7, HUMTIA1E_P9 and HUMTIA1E_P14, since it is in the coding region for the corresponding transcript.

Segment cluster HUMTIA1E_node_29 (SEQ ID NO:1266) according to the present invention can be found in the following transcript(s): HUMTIA1E_T8 (SEQ ID NO:1193), HUMTIA1E_T51 (SEQ ID NO:1222), HUMTIA1E_T52 (SEQ ID NO:1223), HUMTIA1E_T56 (SEQ ID NO:1225), HUMTIA1E_T57 (SEQ ID NO:1226) and HUMTIA1E_T58 (SEQ ID NO:1227). Table 1176 below describes the starting and ending position of this segment on each transcript.

TABLE 1176

Segment location on transcripts

| Transcript name | Segment starting position | Segment ending position |
|---|---|---|
| HUMTIA1E_T8 (SEQ ID NO: 1193) | 5103 | 5107 |
| HUMTIA1E_T51 (SEQ ID NO: 1222) | 5103 | 5107 |
| HUMTIA1E_T52 (SEQ ID NO: 1223) | 5103 | 5107 |
| HUMTIA1E_T56 (SEQ ID NO: 1225) | 1998 | 2002 |
| HUMTIA1E_T57 (SEQ ID NO: 1226) | 881 | 885 |
| HUMTIA1E_T58 (SEQ ID NO: 1227) | 729 | 733 |

This segment can be found in both coding and non-coding regions of transcript(s) as follows. The segment can be found in a non-coding region of transcript(s) that are related to the following protein(s): HUMTIA1E_P2, HUMTIA1E_P5 and HUMTIA1E_P15. This segment can also be found in the following protein(s): HUMTIA1E_P14, since it is in the coding region for the corresponding transcript.

Segment cluster HUMTIA1E_node_35 (SEQ ID NO:1267) according to the present invention can be found in the following transcript(s): HUMTIA1E_T51 (SEQ ID NO:1222). Table 1177 below describes the starting and ending position of this segment on each transcript.

TABLE 1177

Segment location on transcripts

| Transcript name | Segment starting position | Segment ending position |
|---|---|---|
| HUMTIA1E_T51 (SEQ ID NO: 1222) | 5432 | 5454 |

This segment can be found in a non-coding region of transcript(s) that are related to the following protein(s): HUMTIA1E_P5.

Segment cluster HUMTIA1E_node_43 (SEQ ID NO:1268) according to the present invention is supported by 64 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221) and HUMTIA1E_T55 (SEQ ID NO:1224). Table 1178 below describes the starting and ending position of this segment on each transcript.

TABLE 1178

Segment location on transcripts

| Transcript name | Segment starting position | Segment ending position |
|---|---|---|
| HUMTIA1E_T0 (SEQ ID NO: 1188) | 5103 | 5163 |
| HUMTIA1E_T1 (SEQ ID NO: 1189) | 3986 | 4046 |
| HUMTIA1E_T2 (SEQ ID NO: 1190) | 5103 | 5163 |
| HUMTIA1E_T3 (SEQ ID NO: 1191) | 5275 | 5335 |
| HUMTIA1E_T6 (SEQ ID NO: 1192) | 5098 | 5158 |
| HUMTIA1E_T9 (SEQ ID NO: 1194) | 5103 | 5163 |
| HUMTIA1E_T10 (SEQ ID NO: 1195) | 3834 | 3894 |
| HUMTIA1E_T11 (SEQ ID NO: 1196) | 5103 | 5163 |
| HUMTIA1E_T12 (SEQ ID NO: 1197) | 5103 | 5163 |
| HUMTIA1E_T13 (SEQ ID NO: 1198) | 5103 | 5163 |
| HUMTIA1E_T14 (SEQ ID NO: 1199) | 5103 | 5163 |
| HUMTIA1E_T15 (SEQ ID NO: 1200) | 5381 | 5441 |
| HUMTIA1E_T16 (SEQ ID NO: 1201) | 5006 | 5066 |
| HUMTIA1E_T17 (SEQ ID NO: 1202) | 5033 | 5093 |
| HUMTIA1E_T18 (SEQ ID NO: 1203) | 1998 | 2058 |
| HUMTIA1E_T19 (SEQ ID NO: 1204) | 4405 | 4465 |
| HUMTIA1E_T20 (SEQ ID NO: 1205) | 4405 | 4465 |
| HUMTIA1E_T21 (SEQ ID NO: 1206) | 4411 | 4471 |
| HUMTIA1E_T22 (SEQ ID NO: 1207) | 3732 | 3792 |
| HUMTIA1E_T23 (SEQ ID NO: 1208) | 5103 | 5163 |
| HUMTIA1E_T24 (SEQ ID NO: 1209) | 2416 | 2476 |
| HUMTIA1E_T26 (SEQ ID NO: 1210) | 5103 | 5163 |
| HUMTIA1E_T27 (SEQ ID NO: 1211) | 2064 | 2124 |
| HUMTIA1E_T28 (SEQ ID NO: 1212) | 5103 | 5163 |
| HUMTIA1E_T29 (SEQ ID NO: 1213) | 2064 | 2124 |
| HUMTIA1E_T32 (SEQ ID NO: 1214) | 762 | 822 |
| HUMTIA1E_T37 (SEQ ID NO: 1215) | 729 | 789 |
| HUMTIA1E_T40 (SEQ ID NO: 1216) | 5103 | 5163 |
| HUMTIA1E_T45 (SEQ ID NO: 1217) | 5103 | 5163 |
| HUMTIA1E_T46 (SEQ ID NO: 1218) | 5103 | 5163 |
| HUMTIA1E_T47 (SEQ ID NO: 1219) | 5103 | 5163 |
| HUMTIA1E_T48 (SEQ ID NO: 1220) | 5103 | 5163 |
| HUMTIA1E_T50 (SEQ ID NO: 1221) | 5103 | 5163 |
| HUMTIA1E_T55 (SEQ ID NO: 1224) | 762 | 822 |

This segment can be found in both coding and non-coding regions of transcript(s) as follows. The segment can be found in a non-coding region of transcript(s) that are related to the following protein(s): HUMTIA1E_P2 and HUMTIA1E_P5. This segment can also be found in the following protein(s): HUMTIA1E_P1, HUMTIA1E_P6, HUMTIA1E_P8, HUMTIA1E_P7 and HUMTIA1E_P9, since it is in the coding region for the corresponding transcript.

Segment cluster HUMTIA1E_node_44 (SEQ ID NO:1269) according to the present invention is supported by 65 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221) and HUMTIA1E_T55 (SEQ ID NO:1224). Table 1179 below describes the starting and ending position of this segment on each transcript.

TABLE 1179

Segment location on transcripts

| Transcript name | Segment starting position | Segment ending position |
|---|---|---|
| HUMTIA1E_T0 (SEQ ID NO: 1188) | 5164 | 5211 |
| HUMTIA1E_T1 (SEQ ID NO: 1189) | 4047 | 4094 |
| HUMTIA1E_T2 (SEQ ID NO: 1190) | 5164 | 5211 |
| HUMTIA1E_T3 (SEQ ID NO: 1191) | 5336 | 5383 |
| HUMTIA1E_T6 (SEQ ID NO: 1192) | 5159 | 5206 |
| HUMTIA1E_T8 (SEQ ID NO: 1193) | 5108 | 5155 |
| HUMTIA1E_T9 (SEQ ID NO: 1194) | 5164 | 5211 |
| HUMTIA1E_T10 (SEQ ID NO: 1195) | 3895 | 3942 |
| HUMTIA1E_T11 (SEQ ID NO: 1196) | 5164 | 5211 |
| HUMTIA1E_T12 (SEQ ID NO: 1197) | 5164 | 5211 |
| HUMTIA1E_T13 (SEQ ID NO: 1198) | 5164 | 5211 |
| HUMTIA1E_T14 (SEQ ID NO: 1199) | 5164 | 5211 |
| HUMTIA1E_T15 (SEQ ID NO: 1200) | 5442 | 5489 |
| HUMTIA1E_T16 (SEQ ID NO: 1201) | 5067 | 5114 |
| HUMTIA1E_T17 (SEQ ID NO: 1202) | 5094 | 5141 |
| HUMTIA1E_T18 (SEQ ID NO: 1203) | 2059 | 2106 |
| HUMTIA1E_T19 (SEQ ID NO: 1204) | 4466 | 4513 |
| HUMTIA1E_T20 (SEQ ID NO: 1205) | 4466 | 4513 |
| HUMTIA1E_T21 (SEQ ID NO: 1206) | 4472 | 4519 |
| HUMTIA1E_T22 (SEQ ID NO: 1207) | 3793 | 3840 |
| HUMTIA1E_T23 (SEQ ID NO: 1208) | 5164 | 5211 |
| HUMTIA1E_T24 (SEQ ID NO: 1209) | 2477 | 2524 |
| HUMTIA1E_T26 (SEQ ID NO: 1210) | 5164 | 5211 |
| HUMTIA1E_T27 (SEQ ID NO: 1211) | 2125 | 2172 |
| HUMTIA1E_T28 (SEQ ID NO: 1212) | 5164 | 5211 |
| HUMTIA1E_T29 (SEQ ID NO: 1213) | 2125 | 2172 |
| HUMTIA1E_T32 (SEQ ID NO: 1214) | 823 | 870 |
| HUMTIA1E_T37 (SEQ ID NO: 1215) | 790 | 837 |
| HUMTIA1E_T40 (SEQ ID NO: 1216) | 5164 | 5211 |
| HUMTIA1E_T45 (SEQ ID NO: 1217) | 5164 | 5211 |
| HUMTIA1E_T46 (SEQ ID NO: 1218) | 5164 | 5211 |
| HUMTIA1E_T47 (SEQ ID NO: 1219) | 5164 | 5211 |
| HUMTIA1E_T48 (SEQ ID NO: 1220) | 5164 | 5211 |
| HUMTIA1E_T50 (SEQ ID NO: 1221) | 5164 | 5211 |
| HUMTIA1E_T55 (SEQ ID NO: 1224) | 823 | 870 |

This segment can be found in both coding and non-coding regions of transcript(s) as follows. The segment can be found in a non-coding region of transcript(s) that are related to the following protein(s): HUMTIA1E_P2 and HUMTIA1E_P5. This segment can also be found in the following protein(s): HUMTIA1E_P1, HUMTIA1E_P6, HUMTIA1E_P8, HUMTIA1E_P7 and HUMTIA1E_P9, since it is in the coding region for the corresponding transcript.

Segment cluster HUMTIA1E_node_47 (SEQ ID NO:1270) according to the present invention is supported by 66 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221) and HUMTIA1E_T55 (SEQ ID NO:1224). Table 1180 below describes the starting and ending position of this segment on each transcript.

TABLE 1180

Segment location on transcripts

| Transcript name | Segment starting position | Segment ending position |
| --- | --- | --- |
| HUMTIA1E_T0 (SEQ ID NO: 1188) | 5212 | 5307 |
| HUMTIA1E_T1 (SEQ ID NO: 1189) | 4095 | 4190 |
| HUMTIA1E_T2 (SEQ ID NO: 1190) | 5345 | 5440 |
| HUMTIA1E_T3 (SEQ ID NO: 1191) | 5384 | 5479 |
| HUMTIA1E_T6 (SEQ ID NO: 1192) | 5207 | 5302 |
| HUMTIA1E_T8 (SEQ ID NO: 1193) | 5156 | 5251 |
| HUMTIA1E_T9 (SEQ ID NO: 1194) | 5598 | 5693 |
| HUMTIA1E_T10 (SEQ ID NO: 1195) | 3943 | 4038 |
| HUMTIA1E_T11 (SEQ ID NO: 1196) | 5345 | 5440 |
| HUMTIA1E_T12 (SEQ ID NO: 1197) | 5345 | 5440 |
| HUMTIA1E_T13 (SEQ ID NO: 1198) | 5345 | 5440 |
| HUMTIA1E_T14 (SEQ ID NO: 1199) | 5212 | 5307 |
| HUMTIA1E_T15 (SEQ ID NO: 1200) | 5490 | 5585 |
| HUMTIA1E_T16 (SEQ ID NO: 1201) | 5115 | 5210 |
| HUMTIA1E_T17 (SEQ ID NO: 1202) | 5142 | 5237 |
| HUMTIA1E_T18 (SEQ ID NO: 1203) | 2107 | 2202 |
| HUMTIA1E_T19 (SEQ ID NO: 1204) | 4514 | 4609 |
| HUMTIA1E_T20 (SEQ ID NO: 1205) | 4647 | 4742 |
| HUMTIA1E_T21 (SEQ ID NO: 1206) | 4520 | 4615 |
| HUMTIA1E_T22 (SEQ ID NO: 1207) | 3841 | 3936 |
| HUMTIA1E_T23 (SEQ ID NO: 1208) | 5345 | 5440 |
| HUMTIA1E_T24 (SEQ ID NO: 1209) | 2525 | 2620 |
| HUMTIA1E_T26 (SEQ ID NO: 1210) | 5345 | 5440 |
| HUMTIA1E_T27 (SEQ ID NO: 1211) | 2173 | 2268 |
| HUMTIA1E_T28 (SEQ ID NO: 1212) | 5212 | 5307 |
| HUMTIA1E_T29 (SEQ ID NO: 1213) | 2306 | 2401 |
| HUMTIA1E_T32 (SEQ ID NO: 1214) | 1004 | 1099 |
| HUMTIA1E_T37 (SEQ ID NO: 1215) | 971 | 1066 |
| HUMTIA1E_T40 (SEQ ID NO: 1216) | 5212 | 5307 |
| HUMTIA1E_T45 (SEQ ID NO: 1217) | 5212 | 5307 |
| HUMTIA1E_T46 (SEQ ID NO: 1218) | 5212 | 5307 |
| HUMTIA1E_T47 (SEQ ID NO: 1219) | 5212 | 5307 |
| HUMTIA1E_T48 (SEQ ID NO: 1220) | 5212 | 5307 |
| HUMTIA1E_T50 (SEQ ID NO: 1221) | 5345 | 5440 |
| HUMTIA1E_T55 (SEQ ID NO: 1224) | 1004 | 1099 |

This segment can be found in both coding and non-coding regions of transcript(s) as follows. The segment can be found in a non-coding region of transcript(s) that are related to the following protein(s): HUMTIA1E_P2, HUMTIA1E_P5, HUMTIA1E_P7 and HUMTIA1E_P9. This segment can also be found in the following protein(s): HUMTIA1E_P1, HUMTIA1E_P6 and HUMTIA1E_P8, since it is in the coding region for the corresponding transcript.

Segment cluster HUMTIA1E_node_48 (SEQ ID NO:1271) according to the present invention is supported by 6 libraries. The number of libraries was determined as previously described. This segment can be found in the following transcript(s): HUMTIA1E_T11 (SEQ ID NO:1196) and HUMTIA1E_T13 (SEQ ID NO:1198). Table 1181 below describes the starting and ending position of this segment on each transcript.

TABLE 1181

Segment location on transcripts

| Transcript name | Segment starting position | Segment ending position |
| --- | --- | --- |
| HUMTIA1E_T11 (SEQ ID NO: 1196) | 5441 | 5551 |
| HUMTIA1E_T13 (SEQ ID NO: 1198) | 5441 | 5551 |

This segment can be found in a non-coding region of transcript(s) that are related to the following protein(s): HUMTIA1E_P2 and HUMTIA1E_P5.

Segment cluster HUMTIA1E_node_49 (SEQ ID NO:1272) according to the present invention is supported by 61 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T40 (SEQ ID NO:1216), HUMTIA1E_T45 (SEQ ID NO:1217), HUMTIA1E_T46 (SEQ ID NO:1218), HUMTIA1E_T47 (SEQ ID NO:1219), HUMTIA1E_T48 (SEQ ID NO:1220), HUMTIA1E_T50 (SEQ ID NO:1221) and HUMTIA1E_T55 (SEQ ID NO:1224). Table 1182 below describes the starting and ending position of this segment on each transcript.

TABLE 1182

Segment location on transcripts

| Transcript name | Segment starting position | Segment ending position |
| --- | --- | --- |
| HUMTIA1E_T0 (SEQ ID NO: 1188) | 5308 | 5392 |
| HUMTIA1E_T1 (SEQ ID NO: 1189) | 4191 | 4275 |
| HUMTIA1E_T2 (SEQ ID NO: 1190) | 5441 | 5525 |

TABLE 1182-continued

Segment location on transcripts

| Transcript name | Segment starting position | Segment ending position |
|---|---|---|
| HUMTIA1E_T3 (SEQ ID NO: 1191) | 5480 | 5564 |
| HUMTIA1E_T6 (SEQ ID NO: 1192) | 5303 | 5387 |
| HUMTIA1E_T8 (SEQ ID NO: 1193) | 5252 | 5336 |
| HUMTIA1E_T9 (SEQ ID NO: 1194) | 5694 | 5778 |
| HUMTIA1E_T10 (SEQ ID NO: 1195) | 4039 | 4123 |
| HUMTIA1E_T11 (SEQ ID NO: 1196) | 5552 | 5636 |
| HUMTIA1E_T12 (SEQ ID NO: 1197) | 5441 | 5525 |
| HUMTIA1E_T13 (SEQ ID NO: 1198) | 5552 | 5636 |
| HUMTIA1E_T14 (SEQ ID NO: 1199) | 5308 | 5392 |
| HUMTIA1E_T15 (SEQ ID NO: 1200) | 5586 | 5670 |
| HUMTIA1E_T16 (SEQ ID NO: 1201) | 5211 | 5295 |
| HUMTIA1E_T17 (SEQ ID NO: 1202) | 5238 | 5322 |
| HUMTIA1E_T18 (SEQ ID NO: 1203) | 2203 | 2287 |
| HUMTIA1E_T19 (SEQ ID NO: 1204) | 4610 | 4694 |
| HUMTIA1E_T20 (SEQ ID NO: 1205) | 4743 | 4827 |
| HUMTIA1E_T21 (SEQ ID NO: 1206) | 4616 | 4700 |
| HUMTIA1E_T22 (SEQ ID NO: 1207) | 3937 | 4021 |
| HUMTIA1E_T23 (SEQ ID NO: 1208) | 5441 | 5525 |
| HUMTIA1E_T24 (SEQ ID NO: 1209) | 2621 | 2705 |
| HUMTIA1E_T26 (SEQ ID NO: 1210) | 5441 | 5525 |
| HUMTIA1E_T27 (SEQ ID NO: 1211) | 2269 | 2353 |
| HUMTIA1E_T28 (SEQ ID NO: 1212) | 5308 | 5392 |
| HUMTIA1E_T29 (SEQ ID NO: 1213) | 2402 | 2486 |
| HUMTIA1E_T32 (SEQ ID NO: 1214) | 1100 | 1184 |
| HUMTIA1E_T37 (SEQ ID NO: 1215) | 1067 | 1151 |
| HUMTIA1E_T40 (SEQ ID NO: 1216) | 5308 | 5392 |
| HUMTIA1E_T45 (SEQ ID NO: 1217) | 5308 | 5392 |
| HUMTIA1E_T46 (SEQ ID NO: 1218) | 5308 | 5392 |
| HUMTIA1E_T47 (SEQ ID NO: 1219) | 5308 | 5392 |
| HUMTIA1E_T48 (SEQ ID NO: 1220) | 5308 | 5392 |
| HUMTIA1E_T50 (SEQ ID NO: 1221) | 5441 | 5525 |
| HUMTIA1E_T55 (SEQ ID NO: 1224) | 1100 | 1184 |

This segment can be found in both coding and non-coding regions of transcript(s) as follows. The segment can be found in a non-coding region of transcript(s) that are related to the following protein(s): HUMTIA1E_P5, HUMTIA1E_P7 and HUMTIA1E_P9. This segment can also be found in the following protein(s): HUMTIA1E_P1, HUMTIA1E_P2, HUMTIA1E_P6 and HUMTIA1E_P8, since it is in the coding region for the corresponding transcript.

Segment cluster HUMTIA1E_node_53 (SEQ ID NO:1273) according to the present invention is supported by 8 libraries. The number of libraries was determined as previously described. This segment can be found in the following transcript(s): HUMTIA1E_T23 (SEQ ID NO:1208), HUMTIA1E_T26 (SEQ ID NO:1210) and HUMTIA1E_T28 (SEQ ID NO:1212). Table 1183 below describes the starting and ending position of this segment on each transcript.

TABLE 1183

Segment location on transcripts

| Transcript name | Segment starting position | Segment ending position |
|---|---|---|
| HUMTIA1E_T23 (SEQ ID NO: 1208) | 5787 | 5895 |
| HUMTIA1E_T26 (SEQ ID NO: 1210) | 5650 | 5758 |
| HUMTIA1E_T28 (SEQ ID NO: 1212) | 5517 | 5625 |

This segment can be found in both coding and non-coding regions of transcript(s) as follows. The segment can be found in a non-coding region of transcript(s) that are related to the following protein(s): HUMTIA1E_P5. This segment can also be found in the following protein(s): HUMTIA1E_P8, since it is in the coding region for the corresponding transcript.

Segment cluster HUMTIA1E_node_58 (SEQ ID NO:1274) according to the present invention is supported by 82 libraries. The number of libraries was determined as previously described. This segment can be found in the following transcript(s): HUMTIA1E_T0 (SEQ ID NO:1188), HUMTIA1E_T1 (SEQ ID NO:1189), HUMTIA1E_T2 (SEQ ID NO:1190), HUMTIA1E_T3 (SEQ ID NO:1191), HUMTIA1E_T6 (SEQ ID NO:1192), HUMTIA1E_T8 (SEQ ID NO:1193), HUMTIA1E_T9 (SEQ ID NO:1194), HUMTIA1E_T10 (SEQ ID NO:1195), HUMTIA1E_T11 (SEQ ID NO:1196), HUMTIA1E_T12 (SEQ ID NO:1197), HUMTIA1E_T13 (SEQ ID NO:1198), HUMTIA1E_T14 (SEQ ID NO:1199), HUMTIA1E_T15 (SEQ ID NO:1200), HUMTIA1E_T16 (SEQ ID NO:1201), HUMTIA1E_T17 (SEQ ID NO:1202), HUMTIA1E_T18 (SEQ ID NO:1203), HUMTIA1E_T19 (SEQ ID NO:1204), HUMTIA1E_T20 (SEQ ID NO:1205), HUMTIA1E_T21 (SEQ ID NO:1206), HUMTIA1E_T22 (SEQ ID NO:1207), HUMTIA1E_T23 (SEQ ID NO:1208), HUMTIA1E_T24 (SEQ ID NO:1209), HUMTIA1E_T26 (SEQ ID NO:1210), HUMTIA1E_T27 (SEQ ID NO:1211), HUMTIA1E_T28 (SEQ ID NO:1212), HUMTIA1E_T29 (SEQ ID NO:1213), HUMTIA1E_T32 (SEQ ID NO:1214), HUMTIA1E_T37 (SEQ ID NO:1215), HUMTIA1E_T45 (SEQ ID NO:1217), HUMTIA1E_T46 (SEQ ID NO:1218), HUMTIA1E_T47 (SEQ ID NO:1219) and HUMTIA1E_T48 (SEQ ID NO:1220). Table 1184 below describes the starting and ending position of this segment on each transcript.

TABLE 1184

Segment location on transcripts

| Transcript name | Segment starting position | Segment ending position |
|---|---|---|
| HUMTIA1E_T0 (SEQ ID NO: 1188) | 6184 | 6242 |
| HUMTIA1E_T1 (SEQ ID NO: 1189) | 5067 | 5125 |
| HUMTIA1E_T2 (SEQ ID NO: 1190) | 6317 | 6375 |
| HUMTIA1E_T3 (SEQ ID NO: 1191) | 6356 | 6414 |
| HUMTIA1E_T6 (SEQ ID NO: 1192) | 6179 | 6237 |
| HUMTIA1E_T8 (SEQ ID NO: 1193) | 6128 | 6186 |
| HUMTIA1E_T9 (SEQ ID NO: 1194) | 6570 | 6628 |
| HUMTIA1E_T10 (SEQ ID NO: 1195) | 4915 | 4973 |
| HUMTIA1E_T11 (SEQ ID NO: 1196) | 6428 | 6486 |
| HUMTIA1E_T12 (SEQ ID NO: 1197) | 7030 | 7088 |
| HUMTIA1E_T13 (SEQ ID NO: 1198) | 7141 | 7199 |
| HUMTIA1E_T14 (SEQ ID NO: 1199) | 6184 | 6242 |
| HUMTIA1E_T15 (SEQ ID NO: 1200) | 6462 | 6520 |
| HUMTIA1E_T16 (SEQ ID NO: 1201) | 6087 | 6145 |
| HUMTIA1E_T17 (SEQ ID NO: 1202) | 6114 | 6172 |
| HUMTIA1E_T18 (SEQ ID NO: 1203) | 3079 | 3137 |
| HUMTIA1E_T19 (SEQ ID NO: 1204) | 5486 | 5544 |
| HUMTIA1E_T20 (SEQ ID NO: 1205) | 5619 | 5677 |
| HUMTIA1E_T21 (SEQ ID NO: 1206) | 5492 | 5550 |
| HUMTIA1E_T22 (SEQ ID NO: 1207) | 4813 | 4871 |
| HUMTIA1E_T23 (SEQ ID NO: 1208) | 7193 | 7251 |
| HUMTIA1E_T24 (SEQ ID NO: 1209) | 3497 | 3555 |
| HUMTIA1E_T26 (SEQ ID NO: 1210) | 6426 | 6484 |
| HUMTIA1E_T27 (SEQ ID NO: 1211) | 3145 | 3203 |
| HUMTIA1E_T28 (SEQ ID NO: 1212) | 6293 | 6351 |
| HUMTIA1E_T29 (SEQ ID NO: 1213) | 3278 | 3336 |
| HUMTIA1E_T32 (SEQ ID NO: 1214) | 2689 | 2747 |
| HUMTIA1E_T37 (SEQ ID NO: 1215) | 2656 | 2714 |
| HUMTIA1E_T45 (SEQ ID NO: 1217) | 6184 | 6242 |
| HUMTIA1E_T46 (SEQ ID NO: 1218) | 6184 | 6242 |
| HUMTIA1E_T47 (SEQ ID NO: 1219) | 6184 | 6242 |
| HUMTIA1E_T48 (SEQ ID NO: 1220) | 6184 | 6242 |

This segment can be found in a non-coding region of transcript(s) that are related to the following protein(s):

HUMTIA1E_P1, HUMTIA1E_P2, HUMTIA1E_P5, HUMTIA1E_P6, HUMTIA1E_P8, HUMTIA1E_P7 and HUMTIA1E_P9.

Description for Cluster M62239

Cluster M62239 features 6 transcript(s) and 23 segment(s) of interest, the names for which are given in Tables 1185 and 1186, respectively, the sequences themselves are given at the end of the application. The selected protein variants are given in Table 1187.

TABLE 1185

Transcripts of interest
Transcript Name

M62239_T2 (SEQ ID NO: 1275)
M62239_T3 (SEQ ID NO: 1276)
M62239_T4 (SEQ ID NO: 1277)
M62239_T18 (SEQ ID NO: 1278)
M62239_T19 (SEQ ID NO: 1279)
M62239_T20 (SEQ ID NO: 1280)

TABLE 1186

Segments of interest
Segment Name

M62239_node_1 (SEQ ID NO: 1281)
M62239_node_4 (SEQ ID NO: 1282)
M62239_node_21 (SEQ ID NO: 1283)
M62239_node_27 (SEQ ID NO: 1284)
M62239_node_0 (SEQ ID NO: 1285)
M62239_node_2 (SEQ ID NO: 1286)
M62239_node_5 (SEQ ID NO: 1287)
M62239_node_7 (SEQ ID NO: 1288)
M62239_node_9 (SEQ ID NO: 1289)
M62239_node_10 (SEQ ID NO: 1290)
M62239_node_11 (SEQ ID NO: 1291)
M62239_node_12 (SEQ ID NO: 1292)
M62239_node_13 (SEQ ID NO: 1293)
M62239_node_16 (SEQ ID NO: 1294)
M62239_node_17 (SEQ ID NO: 1295)
M62239_node_18 (SEQ ID NO: 1296)
M62239_node_19 (SEQ ID NO: 1297)
M62239_node_20 (SEQ ID NO: 1298)
M62239_node_24 (SEQ ID NO: 1299)
M62239_node_28 (SEQ ID NO: 1300)
M62239_node_29 (SEQ ID NO: 1301)
M62239_node_33 (SEQ ID NO: 1302)
M62239_node_34 (SEQ ID NO: 1303)

TABLE 1187

Proteins of interest

| Protein Name | Corresponding Transcript(s) |
|---|---|
| M62239_P1 | M62239_T3 (SEQ ID NO: 1276) |
| M62239_P2 | M62239_T2 (SEQ ID NO: 1275) |
| M62239_P3 | M62239_T4 (SEQ ID NO: 1277) |
| M62239_P14 | M62239_T18 (SEQ ID NO: 1278) |
| M62239_P15 | M62239_T19 (SEQ ID NO: 1279) |

These sequences are variants of the known protein 40S ribosomal protein S10 (SwissProt accession identifier RS10_HUMAN), referred to herein as the previously known protein.

The sequence for protein 40S ribosomal protein S10 is given at the end of the application, as "40S ribosomal protein S10 amino acid sequence". Protein 40S ribosomal protein S10 localization is believed to be Cytoplasmic.

The following GO Annotation(s) apply to the previously known protein. The following annotation(s) were found: protein biosynthesis, which are annotation(s) related to Biological Process; RNA binding; structural protein of ribosome, which are annotation(s) related to Molecular Function; and cytosolic small ribosomal (40S) subunit, which are annotation(s) related to Cellular Component.

The GO assignment relies on information from one or more of the SwissProt/TremB1 Protein knowledgebase, available from expasy.ch/sprot/; or Locuslink, available from ncbi.nlm.nih.gov/projects/LocusLink/.

As noted above, cluster M62239 features 23 segment(s), which were listed in Table 1186 above and for which the sequence(s) are given at the end of the application. These segment(s) are portions of nucleic acid sequence(s) which are described herein separately because they are of particular interest. A description of each segment according to the present invention is now provided.

Segment cluster M62239_node_1 (SEQ ID NO:1281) according to the present invention is supported by 103 libraries. The number of libraries was determined as previously described. This segment can be found in the following transcript(s): M62239_T18 (SEQ ID NO:1278). Table 1188 below describes the starting and ending position of this segment on each transcript.

TABLE 1188

Segment location on transcripts

| Transcript name | Segment starting position | Segment ending position |
|---|---|---|
| M62239_T18 (SEQ ID NO: 1278) | 80 | 283 |

This segment can be found in a non-coding region of transcript(s) that are related to the following protein(s): M62239_P14.

Segment cluster M62239_node_4 (SEQ ID NO:1282) according to the present invention is supported by 4 libraries. The number of libraries was determined as previously described. This segment can be found in the following transcript(s): M62239_T2 (SEQ ID NO:1275) and M62239_T3 (SEQ ID NO:1276). Table 1189 below describes the starting and ending position of this segment on each transcript.

TABLE 1189

Segment location on transcripts

| Transcript name | Segment starting position | Segment ending position |
|---|---|---|
| M62239_T2 (SEQ ID NO: 1275) | 1 | 227 |
| M62239_T3 (SEQ ID NO: 1276) | 1 | 227 |

This segment can be found in a non-coding region of transcript(s) that are related to the following protein(s): M62239_P2 and M62239_P1.

Segment cluster M62239_node_21 (SEQ ID NO:1283) according to the present invention is supported by 4 libraries. The number of libraries was determined as previously described. This segment can be found in the following transcript(s): M62239_T18 (SEQ ID NO:1278) and M62239_T19 (SEQ ID NO:1279). Table 1190 below describes the starting and ending position of this segment on each transcript.

TABLE 1190

| | Segment location on transcripts | |
|---|---|---|
| Transcript name | Segment starting position | Segment ending position |
| M62239_T18 (SEQ ID NO: 1278) | 638 | 1165 |
| M62239_T19 (SEQ ID NO: 1279) | 402 | 929 |

This segment can be found in the following protein(s): M62239_P14 and M62239_P15.

Segment cluster M62239_node_27 (SEQ ID NO:1284) according to the present invention is supported by 6 libraries. The number of libraries was determined as previously described. This segment can be found in the following transcript(s): M62239_T20 (SEQ ID NO:1280). Table 1191 below describes the starting and ending position of this segment on each transcript.

TABLE 1191

| | Segment location on transcripts | |
|---|---|---|
| Transcript name | Segment starting position | Segment ending position |
| M62239_T20 (SEQ ID NO: 1280) | 1 | 520 |

The previously-described transcripts for these segment(s) do not code for protein.

According to an optional embodiment of the present invention, short segments related to the above cluster are also provided. These segments are up to about 120 bp in length, and so are included in a separate description.

Segment cluster M62239_node_0 (SEQ ID NO:1285) according to the present invention is supported by 146 libraries. The number of libraries was determined as previously described. This segment can be found in the following transcript(s): M62239_T18 (SEQ ID NO:1278) and M62239_T19 (SEQ ID NO:1279). Table 1192 below describes the starting and ending position of this segment on each transcript.

TABLE 1192

| | Segment location on transcripts | |
|---|---|---|
| Transcript name | Segment starting position | Segment ending position |
| M62239_T18 (SEQ ID NO: 1278) | 1 | 79 |
| M62239_T19 (SEQ ID NO: 1279) | 1 | 79 |

This segment can be found in both coding and non-coding regions of transcript(s) as follows. The segment can be found in a non-coding region of transcript(s) that are related to the following protein(s): M62239_P14. This segment can also be found in the following protein(s): M62239_P15, since it is in the coding region for the corresponding transcript.

Segment cluster M62239_node_2 (SEQ ID NO:1286) according to the present invention is supported by 99 libraries. The number of libraries was determined as previously described. This segment can be found in the following transcript(s): M62239_T18 (SEQ ID NO:1278). Table 1193 below describes the starting and ending position of this segment on each transcript.

TABLE 1193

| | Segment location on transcripts | |
|---|---|---|
| Transcript name | Segment starting position | Segment ending position |
| M62239_T18 (SEQ ID NO: 1278) | 284 | 315 |

This segment can be found in a non-coding region of transcript(s) that are related to the following protein(s): M62239_P14.

Segment cluster M62239_node_5 (SEQ ID NO:1287) according to the present invention is supported by 1 libraries. The number of libraries was determined as previously described. This segment can be found in the following transcript(s): M62239_T3 (SEQ ID NO:1276). Table 1194 below describes the starting and ending position of this segment on each transcript.

TABLE 1194

| | Segment location on transcripts | |
|---|---|---|
| Transcript name | Segment starting position | Segment ending position |
| M62239_T3 (SEQ ID NO: 1276) | 228 | 269 |

This segment can be found in the following protein(s): M62239_P1.

Segment cluster M62239_node_7 (SEQ ID NO:1288) according to the present invention is supported by 1 libraries. The number of libraries was determined as previously described. This segment can be found in the following transcript(s): M62239_T4 (SEQ ID NO:1277). Table 1195 below describes the starting and ending position of this segment on each transcript.

TABLE 1195

| | Segment location on transcripts | |
|---|---|---|
| Transcript name | Segment starting position | Segment ending position |
| M62239_T4 (SEQ ID NO: 1277) | 1 | 48 |

This segment can be found in the following protein(s): M62239_P3.

Segment cluster M62239_node_9 (SEQ ID NO:1289) according to the present invention is supported by 354 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1196 below describes the starting and ending position of this segment on each transcript.

TABLE 1196

| | Segment location on transcripts | |
|---|---|---|
| Transcript name | Segment starting position | Segment ending position |
| M62239_T2 (SEQ ID NO: 1275) | 228 | 278 |
| M62239_T3 (SEQ ID NO: 1276) | 270 | 320 |

TABLE 1196-continued

Segment location on transcripts

| Transcript name | Segment starting position | Segment ending position |
|---|---|---|
| M62239_T4 (SEQ ID NO: 1277) | 49 | 99 |
| M62239_T18 (SEQ ID NO: 1278) | 316 | 366 |
| M62239_T19 (SEQ ID NO: 1279) | 80 | 130 |

This segment can be found in the following protein(s): M62239_P2, M62239_P1, M62239_P3, M62239_P14 and M62239_P15.

Segment cluster M62239_node_10 (SEQ ID NO:1290) according to the present invention can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1197 below describes the starting and ending position of this segment on each transcript.

TABLE 1197

Segment location on transcripts

| Transcript name | Segment starting position | Segment ending position |
|---|---|---|
| M62239_T2 (SEQ ID NO: 1275) | 279 | 302 |
| M62239_T3 (SEQ ID NO: 1276) | 321 | 344 |
| M62239_T4 (SEQ ID NO: 1277) | 100 | 123 |
| M62239_T18 (SEQ ID NO: 1278) | 367 | 390 |
| M62239_T19 (SEQ ID NO: 1279) | 131 | 154 |

This segment can be found in the following protein(s): M62239_P2, M62239_P1, M62239_P3, M62239_P14 and M62239_P15.

Segment cluster M62239_node_11 (SEQ ID NO:1291) according to the present invention is supported by 364 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1198 below describes the starting and ending position of this segment on each transcript.

TABLE 1198

Segment location on transcripts

| Transcript name | Segment starting position | Segment ending position |
|---|---|---|
| M62239_T2 (SEQ ID NO: 1275) | 303 | 353 |
| M62239_T3 (SEQ ID NO: 1276) | 345 | 395 |
| M62239_T4 (SEQ ID NO: 1277) | 124 | 174 |
| M62239_T18 (SEQ ID NO: 1278) | 391 | 441 |
| M62239_T19 (SEQ ID NO: 1279) | 155 | 205 |

This segment can be found in the following protein(s): M62239_P2, M62239_P1, M62239_P3, M62239_P14 and M62239_P15.

Segment cluster M62239_node_12 (SEQ ID NO:1292) according to the present invention can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1199 below describes the starting and ending position of this segment on each transcript.

TABLE 1199

Segment location on transcripts

| Transcript name | Segment starting position | Segment ending position |
|---|---|---|
| M62239_T2 (SEQ ID NO: 1275) | 354 | 369 |
| M62239_T3 (SEQ ID NO: 1276) | 396 | 411 |
| M62239_T4 (SEQ ID NO: 1277) | 175 | 190 |
| M62239_T18 (SEQ ID NO: 1278) | 442 | 457 |
| M62239_T19 (SEQ ID NO: 1279) | 206 | 221 |

This segment can be found in the following protein(s): M62239_P2, M62239_P1, M62239_P3, M62239_P14 and M62239_P15.

Segment cluster M62239_node_13 (SEQ ID NO:1293) according to the present invention can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1200 below describes the starting and ending position of this segment on each transcript.

TABLE 1200

Segment location on transcripts

| Transcript name | Segment starting position | Segment ending position |
|---|---|---|
| M62239_T2 (SEQ ID NO: 1275) | 370 | 377 |
| M62239_T3 (SEQ ID NO: 1276) | 412 | 419 |
| M62239_T4 (SEQ ID NO: 1277) | 191 | 198 |
| M62239_T18 (SEQ ID NO: 1278) | 458 | 465 |
| M62239_T19 (SEQ ID NO: 1279) | 222 | 229 |

This segment can be found in the following protein(s): M62239_P2, M62239_P1, M62239_P3, M62239_P14 and M62239_P15.

Segment cluster M62239_node_16 (SEQ ID NO:1294) according to the present invention is supported by 410 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1201 below describes the starting and ending position of this segment on each transcript.

TABLE 1201

Segment location on transcripts

| Transcript name | Segment starting position | Segment ending position |
|---|---|---|
| M62239_T2 (SEQ ID NO: 1275) | 378 | 418 |
| M62239_T3 (SEQ ID NO: 1276) | 420 | 460 |
| M62239_T4 (SEQ ID NO: 1277) | 199 | 239 |
| M62239_T18 (SEQ ID NO: 1278) | 466 | 506 |
| M62239_T19 (SEQ ID NO: 1279) | 230 | 270 |

This segment can be found in the following protein(s): M62239_P2, M62239_P1, M62239_P3, M62239_P14 and M62239_P15.

Segment cluster M62239_node__17 (SEQ ID NO:1295) according to the present invention can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1202 below describes the starting and ending position of this segment on each transcript.

TABLE 1202

| Transcript name | Segment location on transcripts | |
|---|---|---|
| | Segment starting position | Segment ending position |
| M62239_T2 (SEQ ID NO: 1275) | 419 | 442 |
| M62239_T3 (SEQ ID NO: 1276) | 461 | 484 |
| M62239_T4 (SEQ ID NO: 1277) | 240 | 263 |
| M62239_T18 (SEQ ID NO: 1278) | 507 | 530 |
| M62239_T19 (SEQ ID NO: 1279) | 271 | 294 |

This segment can be found in the following protein(s): M62239_P2, M62239_P1, M62239_P3, M62239_P14 and M62239_P15.

Segment cluster M62239_node__18 (SEQ ID NO:1296) according to the present invention is supported by 426 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1203 below describes the starting and ending position of this segment on each transcript.

TABLE 1203

| Transcript name | Segment location on transcripts | |
|---|---|---|
| | Segment starting position | Segment ending position |
| M62239_T2 (SEQ ID NO: 1275) | 443 | 473 |
| M62239_T3 (SEQ ID NO: 1276) | 485 | 515 |
| M62239_T4 (SEQ ID NO: 1277) | 264 | 294 |
| M62239_T18 (SEQ ID NO: 1278) | 531 | 561 |
| M62239_T19 (SEQ ID NO: 1279) | 295 | 325 |

This segment can be found in the following protein(s): M62239_P2, M62239_P1, M62239_P3, M62239_P14 and M62239_P15.

Segment cluster M62239_node__19 (SEQ ID NO:1297) according to the present invention is supported by 476 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1204 below describes the starting and ending position of this segment on each transcript.

TABLE 1204

| Transcript name | Segment location on transcripts | |
|---|---|---|
| | Segment starting position | Segment ending position |
| M62239_T2 (SEQ ID NO: 1275) | 474 | 505 |
| M62239_T3 (SEQ ID NO: 1276) | 516 | 547 |
| M62239_T4 (SEQ ID NO: 1277) | 295 | 326 |

TABLE 1204-continued

| Transcript name | Segment location on transcripts | |
|---|---|---|
| | Segment starting position | Segment ending position |
| M62239_T18 (SEQ ID NO: 1278) | 562 | 593 |
| M62239_T19 (SEQ ID NO: 1279) | 326 | 357 |

This segment can be found in the following protein(s): M62239_P2, M62239_P1, M62239_P3, M62239_P14 and M62239_P15.

Segment cluster M62239_node__20 (SEQ ID NO:1298) according to the present invention is supported by 498 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277), M62239_T18 (SEQ ID NO:1278) and M62239_T19 (SEQ ID NO:1279). Table 1205 below describes the starting and ending position of this segment on each transcript.

TABLE 1205

| Transcript name | Segment location on transcripts | |
|---|---|---|
| | Segment starting position | Segment ending position |
| M62239_T2 (SEQ ID NO: 1275) | 506 | 549 |
| M62239_T3 (SEQ ID NO: 1276) | 548 | 591 |
| M62239_T4 (SEQ ID NO: 1277) | 327 | 370 |
| M62239_T18 (SEQ ID NO: 1278) | 594 | 637 |
| M62239_T19 (SEQ ID NO: 1279) | 358 | 401 |

This segment can be found in the following protein(s): M62239_P2, M62239_P1, M62239_P3, M62239_P14 and M62239_P15.

Segment cluster M62239_node__24 (SEQ ID NO:1299) according to the present invention is supported by 543 libraries. The number of libraries was determined as previously described. This segment can be found in the following transcript(s): M62239_T2 (SEQ ID NO:1275), M62239_T3 (SEQ ID NO:1276) and M62239_T4 (SEQ ID NO:1277). Table 1206 below describes the starting and ending position of this segment on each transcript.

TABLE 1206

| Transcript name | Segment location on transcripts | |
|---|---|---|
| | Segment starting position | Segment ending position |
| M62239_T2 (SEQ ID NO: 1275) | 550 | 627 |
| M62239_T3 (SEQ ID NO: 1276) | 592 | 669 |
| M62239_T4 (SEQ ID NO: 1277) | 371 | 448 |

This segment can be found in the following protein(s): M62239_P2, M62239_P1 and M62239_P3.

Segment cluster M62239_node__28 (SEQ ID NO:1300) according to the present invention is supported by 502 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277) and M62239_T20 (SEQ ID NO:1280). Table 1207 below describes the starting and ending position of this segment on each transcript.

TABLE 1207

| Segment location on transcripts | | |
|---|---|---|
| Transcript name | Segment starting position | Segment ending position |
| M62239_T2 (SEQ ID NO: 1275) | 628 | 679 |
| M62239_T3 (SEQ ID NO: 1276) | 670 | 721 |
| M62239_T4 (SEQ ID NO: 1277) | 449 | 500 |
| M62239_T20 (SEQ ID NO: 1280) | 521 | 572 |

This segment can be found in the following protein(s): M62239_P2, M62239_P1 and M62239_P3.

Segment cluster M62239_node_29 (SEQ ID NO:1301) according to the present invention can be found in the following transcript(s): M62239_T2 (SEQ ID NO:1275), M62239_T3 (SEQ ID NO:1276), M62239_T4 (SEQ ID NO:1277) and M62239_T20 (SEQ ID NO:1280). Table 1208 below describes the starting and ending position of this segment on each transcript.

TABLE 1208

| Segment location on transcripts | | |
|---|---|---|
| Transcript name | Segment starting position | Segment ending position |
| M62239_T2 (SEQ ID NO: 1275) | 680 | 683 |
| M62239_T3 (SEQ ID NO: 1276) | 722 | 725 |
| M62239_T4 (SEQ ID NO: 1277) | 501 | 504 |
| M62239_T20 (SEQ ID NO: 1280) | 573 | 576 |

This segment can be found in the following protein(s): M62239_P2, M62239_P1 and M62239_P3.

Segment cluster M62239_node_33 (SEQ ID NO:1302) according to the present invention is supported by 427 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277) and M62239_T20 (SEQ ID NO:1280). Table 1209 below describes the starting and ending position of this segment on each transcript.

TABLE 1209

| Segment location on transcripts | | |
|---|---|---|
| Transcript name | Segment starting position | Segment ending position |
| M62239_T2 (SEQ ID NO: 1275) | 684 | 717 |
| M62239_T3 (SEQ ID NO: 1276) | 726 | 759 |
| M62239_T4 (SEQ ID NO: 1277) | 505 | 538 |
| M62239_T20 (SEQ ID NO: 1280) | 577 | 610 |

This segment can be found in the following protein(s): M62239_P2, M62239_P1 and M62239_P3.

Segment cluster M62239_node_34 (SEQ ID NO:1303) according to the present invention is supported by 387 libraries. The number of libraries was determined as previously described. This segment can be found in the following transcript(s): M62239_T2 (SEQ ID NO:1275), M62239_T3 (SEQ ID NO:1276), M62239_T4 (SEQ ID NO:1277) and M62239_T20 (SEQ ID NO:1280). Table 1210 below describes the starting and ending position of this segment on each transcript.

TABLE 1210

| Segment location on transcripts | | |
|---|---|---|
| Transcript name | Segment starting position | Segment ending position |
| M62239_T2 (SEQ ID NO: 1275) | 718 | 777 |
| M62239_T3 (SEQ ID NO: 1276) | 760 | 819 |
| M62239_T4 (SEQ ID NO: 1277) | 539 | 598 |
| M62239_T20 (SEQ ID NO: 1280) | 611 | 670 |

This segment can be found in the following protein(s): M62239_P2, M62239_P1 and M62239_P3.

Description for Cluster M78378

Cluster M78378 features 8 transcript(s) and 49 segment(s) of interest, the names for which are given in Tables 1211 and 1212, respectively, the sequences themselves are given at the end of the application. The selected protein variants are given in Table 1213.

TABLE 1211

| Transcripts of interest |
|---|
| Transcript Name |
| M78378_T5 (SEQ ID NO: 1304) |
| M78378_T10 (SEQ ID NO: 1305) |
| M78378_T11 (SEQ ID NO: 1306) |
| M78378_T13 (SEQ ID NO: 1307) |
| M78378_T16 (SEQ ID NO: 1308) |
| M78378_T19 (SEQ ID NO: 1309) |
| M78378_T20 (SEQ ID NO: 1310) |
| M78378_T21 (SEQ ID NO: 1311) |

TABLE 1212

| Segments of interest |
|---|
| Segment Name |
| M78378_node_0 (SEQ ID NO: 1312) |
| M78378_node_1 (SEQ ID NO: 1313) |
| M78378_node_2 (SEQ ID NO: 1314) |
| M78378_node_4 (SEQ ID NO: 1315) |
| M78378_node_6 (SEQ ID NO: 1316) |
| M78378_node_7 (SEQ ID NO: 1317) |
| M78378_node_10 (SEQ ID NO: 1318) |
| M78378_node_15 (SEQ ID NO: 1319) |
| M78378_node_17 (SEQ ID NO: 1320) |
| M78378_node_22 (SEQ ID NO: 1321) |
| M78378_node_26 (SEQ ID NO: 1322) |
| M78378_node_27 (SEQ ID NO: 1323) |
| M78378_node_31 (SEQ ID NO: 1324) |
| M78378_node_34 (SEQ ID NO: 1325) |
| M78378_node_35 (SEQ ID NO: 1326) |
| M78378_node_52 (SEQ ID NO: 1327) |
| M78378_node_56 (SEQ ID NO: 1328) |
| M78378_node_58 (SEQ ID NO: 1329) |
| M78378_node_59 (SEQ ID NO: 1330) |
| M78378_node_3 (SEQ ID NO: 1331) |
| M78378_node_5 (SEQ ID NO: 1332) |
| M78378_node_8 (SEQ ID NO: 1333) |
| M78378_node_9 (SEQ ID NO: 1334) |
| M78378_node_20 (SEQ ID NO: 1335) |
| M78378_node_24 (SEQ ID NO: 1336) |
| M78378_node_25 (SEQ ID NO: 1337) |
| M78378_node_28 (SEQ ID NO: 1338) |
| M78378_node_29 (SEQ ID NO: 1339) |
| M78378_node_30 (SEQ ID NO: 1340) |
| M78378_node_32 (SEQ ID NO: 1341) |
| M78378_node_33 (SEQ ID NO: 1342) |
| M78378_node_36 (SEQ ID NO: 1343) |
| M78378_node_37 (SEQ ID NO: 1344) |
| M78378_node_38 (SEQ ID NO: 1345) |

TABLE 1212-continued

| Segments of interest |
| --- |
| Segment Name |
| M78378_node_39 (SEQ ID NO: 1346) |
| M78378_node_40 (SEQ ID NO: 1347) |
| M78378_node_41 (SEQ ID NO: 1348) |
| M78378_node_42 (SEQ ID NO: 1349) |
| M78378_node_43 (SEQ ID NO: 1350) |
| M78378_node_44 (SEQ ID NO: 1351) |
| M78378_node_45 (SEQ ID NO: 1352) |
| M78378_node_46 (SEQ ID NO: 1353) |
| M78378_node_49 (SEQ ID NO: 1354) |
| M78378_node_50 (SEQ ID NO: 1355) |
| M78378_node_51 (SEQ ID NO: 1356) |
| M78378_node_53 (SEQ ID NO: 1357) |
| M78378_node_54 (SEQ ID NO: 1358) |
| M78378_node_55 (SEQ ID NO: 1359) |
| M78378_node_57 (SEQ ID NO: 1360) |

TABLE 1213

| Proteins of interest | |
| --- | --- |
| Protein Name | Corresponding Transcript(s) |
| M78378_P4 | M78378_T19 (SEQ ID NO: 1309); M78378_T20 (SEQ ID NO: 1310) |
| M78378_P6 | M78378_T13 (SEQ ID NO: 1307); M78378_T16 (SEQ ID NO: 1308) |
| M78378_P11 | M78378_T21 (SEQ ID NO: 1311) |
| M78378_P23 | M78378_T5 (SEQ ID NO: 1304); M78378_T10 (SEQ ID NO: 1305); M78378_T11 (SEQ ID NO: 1306) |

These sequences are variants of the known protein Tubulin beta-4 chain (SwissProt accession identifier TBB4_HUMAN; known also according to the synonyms Tubulin beta-III), referred to herein as the previously known protein.

Protein Tubulin beta-4 chain is known or believed to have the following function(s): Tubulin is the major constituent of microtubules. It binds two moles of GTP, one at an exchangeable site on the beta chain and one at a nonexchangeable site on the alpha-chain. The sequence for protein Tubulin beta-4 chain is given at the end of the application, as "Tubulin beta-4 chain amino acid sequence". Known polymorphisms for this sequence are as shown in Table 1214.

TABLE 1214

| Amino acid mutations for Known Protein | |
| --- | --- |
| SNP position(s) on amino acid sequence | Comment |
| 275 | A -> R |

The following GO Annotation(s) apply to the previously known protein. The following annotation(s) were found: microtubule-based movement, which are annotation(s) related to Biological Process; structural protein of cytoskeleton; GTP binding, which are annotation(s) related to Molecular Function; and cytoskeleton; microtubule, which are annotation(s) related to Cellular Component.

The GO assignment relies on information from one or more of the SwissProt/TremBl Protein knowledgebase, available from expasy.ch/sprot/; or Locuslink, available from ncbi.nlm.nih.gov/projects/LocusLink/.

Cluster M78378 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 31 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 31 and Table 1215. This cluster is overexpressed (at least at a minimum level) in the following pathological conditions: epithelial malignant tumors, a mixture of malignant tumors from different tissues, kidney malignant tumors, hepatocellular carcinoma, lung malignant tumors, prostate cancer and skin malignancies.

31

TABLE 1215

| Normal tissue distribution | |
| --- | --- |
| Name of Tissue | Number |
| adrenal | 12 |
| bladder | 0 |
| Bone | 103 |
| Brain | 214 |
| Colon | 31 |
| epithelial | 24 |
| general | 75 |
| head and neck | 0 |
| kidney | 0 |
| Liver | 0 |
| Lung | 22 |
| Lymph nodes | 5 |
| Breast | 8 |
| bone marrow | 0 |
| muscle | 5 |
| Ovary | 0 |
| pancreas | 10 |
| prostate | 4 |
| Skin | 61 |
| stomach | 36 |
| T cells | 0 |
| Thyroid | 0 |
| Uterus | 68 |

TABLE 1216

| P values and ratios for expression in cancerous tissue | | | | | | |
| --- | --- | --- | --- | --- | --- | --- |
| Name of Tissue | P1 | P2 | SP1 | R3 | SP2 | R4 |
| adrenal | 6.4e−01 | 6.9e−01 | 4.4e−02 | 2.6 | 8.2e−02 | 2.1 |
| bladder | 4.9e−02 | 9.2e−02 | 5.7e−02 | 4.9 | 1.5e−01 | 3.3 |
| Bone | 7.0e−01 | 6.3e−01 | 6.7e−01 | 0.9 | 6.5e−01 | 1.0 |
| Brain | 2.0e−01 | 1.3e−01 | 8.9e−02 | 1.2 | 2.3e−05 | 1.5 |
| Colon | 5.6e−01 | 4.2e−01 | 7.8e−01 | 1.0 | 7.7e−01 | 1.0 |
| epithelial | 3.1e−02 | 1.5e−04 | 2.5e−04 | 2.1 | 2.6e−31 | 7.6 |
| general | 4.9e−02 | 7.5e−05 | 4.0e−04 | 1.4 | 3.0e−42 | 2.9 |
| head and neck | 4.3e−01 | 2.8e−01 | 4.6e−01 | 2.2 | 2.4e−02 | 2.0 |
| kidney | 2.7e−01 | 7.7e−02 | 2.0e−01 | 3.2 | 2.3e−03 | 4.5 |
| Liver | 1 | 8.2e−02 | 1 | 1.0 | 5.9e−03 | 5.1 |
| Lung | 3.4e−01 | 9.5e−02 | 1.9e−01 | 2.2 | 1.2e−09 | 7.2 |
| lymph nodes | 8.5e−01 | 6.1e−01 | 1 | 0.8 | 1.2e−02 | 2.5 |
| Breast | 2.9e−01 | 2.2e−01 | 3.3e−01 | 2.0 | 4.4e−02 | 2.0 |
| Bone marrow | 1 | 6.7e−01 | 1 | 1.0 | 5.3e−01 | 1.9 |
| muscle | 4.0e−01 | 1.7e−01 | 1.5e−01 | 5.2 | 5.9e−02 | 4.4 |
| Ovary | 4.0e−01 | 1.7e−01 | 2.2e−01 | 2.4 | 4.1e−02 | 3.7 |
| pancreas | 5.5e−01 | 4.0e−01 | 3.9e−01 | 1.9 | 4.6e−06 | 2.3 |
| prostate | 7.0e−01 | 5.9e−01 | 8.4e−03 | 2.5 | 2.4e−03 | 4.6 |
| Skin | 7.1e−01 | 4.1e−01 | 1 | 0.2 | 1.6e−09 | 4.8 |
| stomach | 5.0e−01 | 5.8e−01 | 7.5e−01 | 1.0 | 2.7e−01 | 1.1 |
| T cells | 1 | 6.7e−01 | 1 | 1.0 | 7.2e−01 | 1.4 |

TABLE 1216-continued

P values and ratios for expression in cancerous tissue

| Name of Tissue | P1 | P2 | SP1 | R3 | SP2 | R4 |
|---|---|---|---|---|---|---|
| Thyroid | 5.0e−01 | 5.0e−01 | 6.7e−01 | 1.5 | 6.7e−01 | 1.5 |
| Uterus | 5.2e−01 | 4.9e−01 | 8.2e−01 | 0.8 | 4.6e−02 | 1.4 |

As noted above, cluster M78378 features 49 segment(s), which were listed in Table 1212 above and for which the sequence(s) are given at the end of the application. These segment(s) are portions of nucleic acid sequence(s) which are described herein separately because they are of particular interest. A description of each segment according to the present invention is now provided.

Segment cluster M78378_node_0 (SEQ ID NO:1312) according to the present invention is supported by 5 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1217 below describes the starting and ending position of this segment on each transcript.

TABLE 1217

Segment location on transcripts

| Transcript name | Segment starting position | Segment ending position |
|---|---|---|
| M78378_T5 (SEQ ID NO: 1304) | 1 | 170 |
| M78378_T10 (SEQ ID NO: 1305) | 1 | 170 |
| M78378_T11 (SEQ ID NO: 1306) | 1 | 170 |

This segment can be found in a non-coding region of transcript(s) that are related to the following protein(s): M78378_P23.

Segment cluster M78378_node_1 (SEQ ID NO:1313) according to the present invention is supported by 18 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1218 below describes the starting and ending position of this segment on each transcript.

TABLE 1218

Segment location on transcripts

| Transcript name | Segment starting position | Segment ending position |
|---|---|---|
| M78378_T5 (SEQ ID NO: 1304) | 171 | 973 |
| M78378_T10 (SEQ ID NO: 1305) | 171 | 973 |
| M78378_T11 (SEQ ID NO: 1306) | 171 | 973 |

This segment can be found in a non-coding region of transcript(s) that are related to the following protein(s): M78378_P23.

Segment cluster M78378_node_2 (SEQ ID NO:1314) according to the present invention is supported by 37 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1219 below describes the starting and ending position of this segment on each transcript.

TABLE 1219

Segment location on transcripts

| Transcript name | Segment starting position | Segment ending position |
|---|---|---|
| M78378_T5 (SEQ ID NO: 1304) | 974 | 1232 |
| M78378_T10 (SEQ ID NO: 1305) | 974 | 1232 |
| M78378_T11 (SEQ ID NO: 1306) | 974 | 1232 |

This segment can be found in a non-coding region of transcript(s) that are related to the following protein(s): M78378_P23.

Segment cluster M78378_node_4 (SEQ ID NO:1315) according to the present invention is supported by 40 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1220 below describes the starting and ending position of this segment on each transcript.

TABLE 1220

Segment location on transcripts

| Transcript name | Segment starting position | Segment ending position |
|---|---|---|
| M78378_T5 (SEQ ID NO: 1304) | 1276 | 1460 |
| M78378_T10 (SEQ ID NO: 1305) | 1276 | 1460 |
| M78378_T11 (SEQ ID NO: 1306) | 1276 | 1460 |

This segment can be found in the following protein(s): M78378_P23.

Segment cluster M78378_node_6 (SEQ ID NO:1316) according to the present invention is supported by 60 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1221 below describes the starting and ending position of this segment on each transcript.

TABLE 1221

Segment location on transcripts

| Transcript name | Segment starting position | Segment ending position |
|---|---|---|
| M78378_T5 (SEQ ID NO: 1304) | 1493 | 2331 |
| M78378_T10 (SEQ ID NO: 1305) | 1493 | 2331 |
| M78378_T11 (SEQ ID NO: 1306) | 1493 | 2331 |

This segment can be found in the following protein(s): M78378_P23.

Segment cluster M78378_node_7 (SEQ ID NO:1317) according to the present invention is supported by 34 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1222 below describes the starting and ending position of this segment on each transcript.

TABLE 1222

Segment location on transcripts

| Transcript name | Segment starting position | Segment ending position |
|---|---|---|
| M78378_T5 (SEQ ID NO: 1304) | 2332 | 2649 |
| M78378_T10 (SEQ ID NO: 1305) | 2332 | 2649 |
| M78378_T11 (SEQ ID NO: 1306) | 2332 | 2649 |

This segment can be found in the following protein(s): M78378_P23.

Segment cluster M78378_node_10 (SEQ ID NO:1318) according to the present invention is supported by 40 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1223 below describes the starting and ending position of this segment on each transcript.

TABLE 1223

Segment location on transcripts

| Transcript name | Segment starting position | Segment ending position |
|---|---|---|
| M78378_T5 (SEQ ID NO: 1304) | 2713 | 2860 |
| M78378_T10 (SEQ ID NO: 1305) | 2713 | 2860 |
| M78378_T11 (SEQ ID NO: 1306) | 2713 | 2860 |

This segment can be found in a non-coding region of transcript(s) that are related to the following protein(s): M78378_P23.

Segment cluster M78378_node_15 (SEQ ID NO:1319) according to the present invention is supported by 4 libraries. The number of libraries was determined as previously described. This segment can be found in the following transcript(s): M78378_T13 (SEQ ID NO:1307). Table 1224 below describes the starting and ending position of this segment on each transcript.

TABLE 1224

Segment location on transcripts

| Transcript name | Segment starting position | Segment ending position |
|---|---|---|
| M78378_T13 (SEQ ID NO: 1307) | 1 | 305 |

This segment can be found in a non-coding region of transcript(s) that are related to the following protein(s): M78378_P6.

Segment cluster M78378_node_17 (SEQ ID NO:1320) according to the present invention is supported by 121 libraries. The number of libraries was determined as previously described. This segment can be found in the following transcript(s): M78378_T16 (SEQ ID NO:1308), M78378_T19 (SEQ ID NO:1309), M78378_T20 (SEQ ID NO:1310) and M78378_T21 (SEQ ID NO:1311). Table 1225 below describes the starting and ending position of this segment on each transcript.

TABLE 1225

Segment location on transcripts

| Transcript name | Segment starting position | Segment ending positon |
|---|---|---|
| M78378_T16 (SEQ ID NO: 1308) | 1 | 124 |
| M78378_T19 (SEQ ID NO: 1309) | 1 | 124 |
| M78378_T20 (SEQ ID NO: 1310) | 1 | 124 |
| M78378_T21 (SEQ ID NO: 1311) | 1 | 124 |

This segment can be found in a non-coding region of transcript(s) that are related to the following protein(s): M78378_P6, M78378_P4 and M78378_P11.

Segment cluster M78378_node_22 (SEQ ID NO:1321) according to the present invention is supported by 1 libraries. The number of libraries was determined as previously described. This segment can be found in the following transcript(s): M78378_T16 (SEQ ID NO:1308). Table 1226 below describes the starting and ending position of this segment on each transcript.

TABLE 1226

Segment location on transcripts

| Transcript name | Segment starting position | Segment ending position |
|---|---|---|
| M78378_T16 (SEQ ID NO: 1308) | 234 | 486 |

This segment can be found in a non-coding region of transcript(s) that are related to the following protein(s): M78378_P6.

Segment cluster M78378_node_26 (SEQ ID NO:1322) according to the present invention is supported by 1 libraries. The number of libraries was determined as previously described. This segment can be found in the following transcript(s): M78378_T5 (SEQ ID NO:1304), M78378_T10 (SEQ ID NO:1305) and M78378_T19 (SEQ ID NO:1309). Table 1227 below describes the starting and ending position of this segment on each transcript.

TABLE 1227

Segment location on transcripts

| Transcript name | Segment starting position | Segment ending position |
|---|---|---|
| M78378_T5 (SEQ ID NO: 1304) | 3081 | 3225 |
| M78378_T10 (SEQ ID NO: 1305) | 3081 | 3225 |
| M78378_T19 (SEQ ID NO: 1309) | 345 | 489 |

This segment can be found in a non-coding region of transcript(s) that are related to the following protein(s): M78378_P23 and M78378_P4.

Segment cluster M78378_node_27 (SEQ ID NO:1323) according to the present invention is supported by 7 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1228 below describes the starting and ending position of this segment on each transcript.

TABLE 1228

Segment location on transcripts

| Transcript name | Segment starting position | Segment ending position |
|---|---|---|
| M78378_T5 (SEQ ID NO: 1304) | 3226 | 3426 |
| M78378_T10 (SEQ ID NO: 1305) | 3226 | 3426 |
| M78378_T19 (SEQ ID NO: 1309) | 490 | 690 |
| M78378_T20 (SEQ ID NO: 1310) | 345 | 545 |

This segment can be found in a non-coding region of transcript(s) that are related to the following protein(s): M78378_P23 and M78378_P4.

Segment cluster M78378_node_31 (SEQ ID NO:1324) according to the present invention is supported by 8 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1229 below describes the starting and ending position of this segment on each transcript.

TABLE 1229

Segment location on transcripts

| Transcript name | Segment starting position | Segment ending position |
|---|---|---|
| M78378_T5 (SEQ ID NO: 1304) | 3550 | 3672 |
| M78378_T10 (SEQ ID NO: 1305) | 3550 | 3672 |
| M78378_T19 (SEQ ID NO: 1309) | 814 | 936 |
| M78378_T20 (SEQ ID NO: 1310) | 669 | 791 |

This segment can be found in a non-coding region of transcript(s) that are related to the following protein(s): M78378_P23 and M78378_P4.

Segment cluster M78378_node_34 (SEQ ID NO:1325) according to the present invention is supported by 8 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T19 (SEQ ID NO:1309), M78378_T20 (SEQ ID NO:1310) and M78378_T21 (SEQ ID NO:1311). Table 1230 below describes the starting and ending position of this segment on each transcript.

TABLE 1230

Segment location on transcripts

| Transcript name | Segment starting position | Segment ending position |
|---|---|---|
| M78378_T5 (SEQ ID NO: 1304) | 3832 | 4077 |
| M78378_T10 (SEQ ID NO: 1305) | 3832 | 4077 |
| M78378_T11 (SEQ ID NO: 1306) | 3081 | 3326 |
| M78378_T19 (SEQ ID NO: 1309) | 1096 | 1341 |
| M78378_T20 (SEQ ID NO: 1310) | 951 | 1196 |
| M78378_T21 (SEQ ID NO: 1311) | 345 | 590 |

This segment can be found in a non-coding region of transcript(s) that are related to the following protein(s): M78378_P23, M78378_P4 and M78378_P11.

Segment cluster M78378_node_35 (SEQ ID NO:1326) according to the present invention is supported by 4 libraries. The number of libraries was determined as previously described. This segment can be found in the following transcript(s): M78378_T5 (SEQ ID NO:1304), M78378_T19 (SEQ ID NO:1309) and M78378_T20 (SEQ ID NO:1310). Table 1231 below describes the starting and ending position of this segment on each transcript.

TABLE 1231

Segment location on transcripts

| Transcript name | Segment starting position | Segment ending position |
|---|---|---|
| M78378_T5 (SEQ ID NO: 1304) | 4078 | 4230 |
| M78378_T19 (SEQ ID NO: 1309) | 1342 | 1494 |
| M78378_T20 (SEQ ID NO: 1310) | 1197 | 1349 |

This segment can be found in both coding and non-coding regions of transcript(s) as follows. The segment can be found in a non-coding region of transcript(s) that are related to the following protein(s): M78378_P23. This segment can also be found in the following protein(s): M78378_P4, since it is in the coding region for the corresponding transcript.

Segment cluster M78378_node_52 (SEQ ID NO:1327) according to the present invention is supported by 147 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1232 below describes the starting and ending position of this segment on each transcript.

TABLE 1232

Segment location on transcripts

| Transcript name | Segment starting position | Segment ending position |
|---|---|---|
| M78378_T5 (SEQ ID NO: 1304) | 4616 | 4739 |
| M78378_T10 (SEQ ID NO: 1305) | 4463 | 4586 |
| M78378_T11 (SEQ ID NO: 1306) | 3712 | 3835 |
| M78378_T13 (SEQ ID NO: 1307) | 911 | 1034 |
| M78378_T16 (SEQ ID NO: 1308) | 983 | 1106 |
| M78378_T19 (SEQ ID NO: 1309) | 1880 | 2003 |
| M78378_T20 (SEQ ID NO: 1310) | 1735 | 1858 |
| M78378_T21 (SEQ ID NO: 1311) | 976 | 1099 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_56 (SEQ ID NO:1328) according to the present invention is supported by 179 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1233 below describes the starting and ending position of this segment on each transcript.

TABLE 1233

Segment location on transcripts

| Transcript name | Segment starting position | Segment ending position |
|---|---|---|
| M78378_T5 (SEQ ID NO: 1304) | 4914 | 5156 |
| M78378_T10 (SEQ ID NO: 1305) | 4761 | 5003 |
| M78378_T11 (SEQ ID NO: 1306) | 4010 | 4252 |
| M78378_T13 (SEQ ID NO: 1307) | 1209 | 1451 |
| M78378_T16 (SEQ ID NO: 1308) | 1281 | 1523 |
| M78378_T19 (SEQ ID NO: 1309) | 2178 | 2420 |
| M78378_T20 (SEQ ID NO: 1310) | 2033 | 2275 |
| M78378_T21 (SEQ ID NO: 1311) | 1274 | 1516 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_58 (SEQ ID NO:1329) according to the present invention is supported by 177 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1234 below describes the starting and ending position of this segment on each transcript.

TABLE 1234

Segment location on transcripts

| Transcript name | Segment starting position | Segment ending position |
|---|---|---|
| M78378_T5 (SEQ ID NO: 1304) | 5166 | 5395 |
| M78378_T10 (SEQ ID NO: 1305) | 5013 | 5242 |
| M78378_T11 (SEQ ID NO: 1306) | 4262 | 4491 |
| M78378_T13 (SEQ ID NO: 1307) | 1461 | 1690 |
| M78378_T16 (SEQ ID NO: 1308) | 1533 | 1762 |
| M78378_T19 (SEQ ID NO: 1309) | 2430 | 2659 |
| M78378_T20 (SEQ ID NO: 1310) | 2285 | 2514 |
| M78378_T21 (SEQ ID NO: 1311) | 1526 | 1755 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P1, since it is in the coding region for the corresponding transcript.

Segment cluster M78378_node_59 (SEQ ID NO:1330) according to the present invention is supported by 148 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1235 below describes the starting and ending position of this segment on each transcript.

TABLE 1235

Segment location on transcripts

| Transcript name | Segment starting position | Segment ending position |
|---|---|---|
| M78378_T5 (SEQ ID NO: 1304) | 5396 | 5601 |
| M78378_T10 (SEQ ID NO: 1305) | 5243 | 5448 |
| M78378_T11 (SEQ ID NO: 1306) | 4492 | 4697 |
| M78378_T13 (SEQ ID NO: 1307) | 1691 | 1896 |
| M78378_T16 (SEQ ID NO: 1308) | 1763 | 1968 |
| M78378_T19 (SEQ ID NO: 1309) | 2660 | 2865 |
| M78378_T20 (SEQ ID NO: 1310) | 2515 | 2720 |
| M78378_T21 (SEQ ID NO: 1311) | 1756 | 1961 |

This segment can be found in a non-coding region of transcript(s) that are related to the following protein(s): M78378_P23, M78378_P6, M78378_P4 and M78378_P11.

According to an optional embodiment of the present invention, short segments related to the above cluster are also provided. These segments are up to about 120 bp in length, and so are included in a separate description.

Segment cluster M78378_node_3 (SEQ ID NO:1331) according to the present invention is supported by 32 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1236 below describes the starting and ending position of this segment on each transcript.

TABLE 1236

Segment location on transcripts

| Transcript name | Segment starting position | Segment ending position |
|---|---|---|
| M78378_T5 (SEQ ID NO: 1304) | 1233 | 1275 |
| M78378_T10 (SEQ ID NO: 1305) | 1233 | 1275 |
| M78378_T11 (SEQ ID NO: 1306) | 1233 | 1275 |

This segment can be found in a non-coding region of transcript(s) that are related to the following protein(s): M78378_P23.

Segment cluster M78378_node_5 (SEQ ID NO:1332) according to the present invention is supported by 33 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1237 below describes the starting and ending position of this segment on each transcript.

TABLE 1237

Segment location on transcripts

| Transcript name | Segment starting position | Segment ending position |
|---|---|---|
| M78378_T5 (SEQ ID NO: 1304) | 1461 | 1492 |
| M78378_T10 (SEQ ID NO: 1305) | 1461 | 1492 |
| M78378_T11 (SEQ ID NO: 1306) | 1461 | 1492 |

This segment can be found in the following protein(s): M78378_P23.

Segment cluster M78378_node_8 (SEQ ID NO:1333) according to the present invention is supported by 28 libraries. The number of libraries was determined as previously described. This segment can be found in the following transcript(s): M78378_T5 (SEQ ID NO:1304), M78378_T10 (SEQ ID NO:1305) and M78378_T11 (SEQ ID NO:1306). Table 1238 below describes the starting and ending position of this segment on each transcript.

TABLE 1238

| Transcript name | Segment location on transcripts | |
|---|---|---|
| | Segment starting position | Segment ending position |
| M78378_T5 (SEQ ID NO: 1304) | 2650 | 2695 |
| M78378_T10 (SEQ ID NO: 1305) | 2650 | 2695 |
| M78378_T11 (SEQ ID NO: 1306) | 2650 | 2695 |

This segment can be found in a non-coding region of transcript(s) that are related to the following protein(s): M78378_P23.

Segment cluster M78378_node_9 (SEQ ID NO:1334) according to the present invention can be found in the following transcript(s): M78378_T5 (SEQ ID NO:1304), M78378_T10 (SEQ ID NO:1305) and M78378_T11 (SEQ ID NO:1306). Table 1239 below describes the starting and ending position of this segment on each transcript.

TABLE 1239

| Transcript name | Segment location on transcripts | |
|---|---|---|
| | Segment starting position | Segment ending position |
| M78378_T5 (SEQ ID NO: 1304) | 2696 | 2712 |
| M78378_T10 (SEQ ID NO: 1305) | 2696 | 2712 |
| M78378_T11 (SEQ ID NO: 1306) | 2696 | 2712 |

This segment can be found in a non-coding region of transcript(s) that are related to the following protein(s): M78378_P23.

Segment cluster M78378_node_20 (SEQ ID NO:1335) according to the present invention is supported by 144 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1240 below describes the starting and ending position of this segment on each transcript.

TABLE 1240

| Transcript name | Segment location on transcripts | |
|---|---|---|
| | Segment starting position | Segment ending position |
| M78378_T5 (SEQ ID NO: 1304) | 2861 | 2969 |
| M78378_T10 (SEQ ID NO: 1305) | 2861 | 2969 |
| M78378_T11 (SEQ ID NO: 1306) | 2861 | 2969 |
| M78378_T13 (SEQ ID NO: 1307) | 306 | 414 |
| M78378_T16 (SEQ ID NO: 1308) | 125 | 233 |
| M78378_T19 (SEQ ID NO: 1309) | 125 | 233 |
| M78378_T20 (SEQ ID NO: 1310) | 125 | 233 |
| M78378_T21 (SEQ ID NO: 1311) | 125 | 233 |

This segment can be found in a non-coding region of transcript(s) that are related to the following protein(s): M78378_P23, M78378_P6, M78378_P4 and M78378_P11.

Segment cluster M78378_node_24 (SEQ ID NO:1336) according to the present invention is supported by 148 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1241 below describes the starting and ending position of this segment on each transcript.

TABLE 1241

| Transcript name | Segment location on transcripts | |
|---|---|---|
| | Segment starting position | Segment ending position |
| M78378_T5 (SEQ ID NO: 1304) | 2970 | 3062 |
| M78378_T10 (SEQ ID NO: 1305) | 2970 | 3062 |
| M78378_T11 (SEQ ID NO: 1306) | 2970 | 3062 |
| M78378_T13 (SEQ ID NO: 1307) | 415 | 507 |
| M78378_T16 (SEQ ID NO: 1308) | 487 | 579 |
| M78378_T19 (SEQ ID NO: 1309) | 234 | 326 |
| M78378_T20 (SEQ ID NO: 1310) | 234 | 326 |
| M78378_T21 (SEQ ID NO: 1311) | 234 | 326 |

This segment can be found in both coding and non-coding regions of transcript(s) as follows. The segment can be found in a non-coding region of transcript(s) that are related to the following protein(s): M78378_P23, M78378_P4 and M78378_P11. This segment can also be found in the following protein(s): M78378_P6, since it is in the coding region for the corresponding transcript.

Segment cluster M78378_node_25 (SEQ ID NO:1337) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1242 below describes the starting and ending position of this segment on each transcript.

TABLE 1242

| Transcript name | Segment location on transcripts | |
|---|---|---|
| | Segment starting position | Segment ending position |
| M78378_T5 (SEQ ID NO: 1304) | 3063 | 3080 |
| M78378_T10 (SEQ ID NO: 1305) | 3063 | 3080 |
| M78378_T11 (SEQ ID NO: 1306) | 3063 | 3080 |
| M78378_T13 (SEQ ID NO: 1307) | 508 | 525 |
| M78378_T16 (SEQ ID NO: 1308) | 580 | 597 |
| M78378_T19 (SEQ ID NO: 1309) | 327 | 344 |
| M78378_T20 (SEQ ID NO: 1310) | 327 | 344 |
| M78378_T21 (SEQ ID NO: 1311) | 327 | 344 |

This segment can be found in both coding and non-coding regions of transcript(s) as follows. The segment can be found in a non-coding region of transcript(s) that are related to the following protein(s): M78378_P23, M78378_P4 and M78378_P11. This segment can also be found in the following protein(s): M78378_P6, since it is in the coding region for the corresponding transcript.

Segment cluster M78378_node_28 (SEQ ID NO:1338) according to the present invention is supported by 7 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1243 below describes the starting and ending position of this segment on each transcript.

TABLE 1243

Segment location on transcripts

| Transcript name | Segment starting position | Segment ending position |
|---|---|---|
| M78378_T5 (SEQ ID NO: 1304) | 3427 | 3467 |
| M78378_T10 (SEQ ID NO: 1305) | 3427 | 3467 |
| M78378_T19 (SEQ ID NO: 1309) | 691 | 731 |
| M78378_T20 (SEQ ID NO: 1310) | 546 | 586 |

This segment can be found in a non-coding region of transcript(s) that are related to the following protein(s): M78378_P23 and M78378_P4.

Segment cluster M78378_node_29 (SEQ ID NO:1339) according to the present invention is supported by 7 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1244 below describes the starting and ending position of this segment on each transcript.

TABLE 1244

Segment location on transcripts

| Transcript name | Segment starting position | Segment ending position |
|---|---|---|
| M78378_T5 (SEQ ID NO: 1304) | 3468 | 3506 |
| M78378_T10 (SEQ ID NO: 1305) | 3468 | 3506 |
| M78378_T19 (SEQ ID NO: 1309) | 732 | 770 |
| M78378_T20 (SEQ ID NO: 1310) | 587 | 625 |

This segment can be found in a non-coding region of transcript(s) that are related to the following protein(s): M78378_P23 and M78378_P4.

Segment cluster M78378_node_30 (SEQ ID NO:1340) according to the present invention is supported by 7 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1245 below describes the starting and ending position of this segment on each transcript.

TABLE 1245

Segment location on transcripts

| Transcript name | Segment starting position | Segment ending position |
|---|---|---|
| M78378_T5 (SEQ ID NO: 1304) | 3507 | 3549 |
| M78378_T10 (SEQ ID NO: 1305) | 3507 | 3549 |
| M78378_T19 (SEQ ID NO: 1309) | 771 | 813 |
| M78378_T20 (SEQ ID NO: 1310) | 626 | 668 |

This segment can be found in a non-coding region of transcript(s) that are related to the following protein(s): M78378_P23 and M78378_P4.

Segment cluster M78378_node_32 (SEQ ID NO:1341) according to the present invention is supported by 9 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1246 below describes the starting and ending position of this segment on each transcript.

TABLE 1246

Segment location on transcripts

| Transcript name | Segment starting position | Segment ending position |
|---|---|---|
| M78378_T5 (SEQ ID NO: 1304) | 3673 | 3713 |
| M78378_T10 (SEQ ID NO: 1305) | 3673 | 3713 |
| M78378_T19 (SEQ ID NO: 1309) | 937 | 977 |
| M78378_T20 (SEQ ID NO: 1310) | 792 | 832 |

This segment can be found in a non-coding region of transcript(s) that are related to the following protein(s): M78378_P23 and M78378_P4.

Segment cluster M78378_node_33 (SEQ ID NO:1342) according to the present invention is supported by 9 libraries. The number of libraries was determined as previously described. This segment can be found in the following transcript(s): M78378_T5 (SEQ ID NO:1304), M78378_T10 (SEQ ID NO:1305), M78378_T19 (SEQ ID NO:1309) and M78378_T20 (SEQ ID NO:1310). Table 1247 below describes the starting and ending position of this segment on each transcript.

TABLE 1247

Segment location on transcripts

| Transcript name | Segment starting position | Segment ending position |
|---|---|---|
| M78378_T5 (SEQ ID NO: 1304) | 3714 | 3831 |
| M78378_T10 (SEQ ID NO: 1305) | 3714 | 3831 |
| M78378_T19 (SEQ ID NO: 1309) | 978 | 1095 |
| M78378_T20 (SEQ ID NO: 1310) | 833 | 950 |

This segment can be found in a non-coding region of transcript(s) that are related to the following protein(s): M78378_P23 and M78378_P4.

Segment cluster M78378_node_36 (SEQ ID NO:1343) according to the present invention is supported by 138 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311).

Table 1248 below describes the starting and ending position of this segment on each transcript.

TABLE 1248

Segment location on transcripts

| Transcript name | Segment starting position | Segment ending position |
|---|---|---|
| M78378_T5 (SEQ ID NO: 1304) | 4231 | 4273 |
| M78378_T10 (SEQ ID NO: 1305) | 4078 | 4120 |
| M78378_T11 (SEQ ID NO: 1306) | 3327 | 3369 |
| M78378_T13 (SEQ ID NO: 1307) | 526 | 568 |
| M78378_T16 (SEQ ID NO: 1308) | 598 | 640 |
| M78378_T19 (SEQ ID NO: 1309) | 1495 | 1537 |
| M78378_T20 (SEQ ID NO: 1310) | 1350 | 1392 |
| M78378_T21 (SEQ ID NO: 1311) | 591 | 633 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_37 (SEQ ID NO:1344) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1249 below describes the starting and ending position of this segment on each transcript.

TABLE 1249

Segment location on transcripts

| Transcript name | Segment starting position | Segment ending position |
|---|---|---|
| M78378_T5 (SEQ ID NO: 1304) | 4274 | 4278 |
| M78378_T10 (SEQ ID NO: 1305) | 4121 | 4125 |
| M78378_T11 (SEQ ID NO: 1306) | 3370 | 3374 |
| M78378_T13 (SEQ ID NO: 1307) | 569 | 573 |
| M78378_T16 (SEQ ID NO: 1308) | 641 | 645 |
| M78378_T19 (SEQ ID NO: 1309) | 1538 | 1542 |
| M78378_T20 (SEQ ID NO: 1310) | 1393 | 1397 |
| M78378_T21 (SEQ ID NO: 1311) | 634 | 638 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_38 (SEQ ID NO:1345) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1250 below describes the starting and ending position of this segment on each transcript.

TABLE 1250

Segment location on transcripts

| Transcript name | Segment starting position | Segment ending position |
|---|---|---|
| M78378_T5 (SEQ ID NO: 1304) | 4279 | 4301 |
| M78378_T10 (SEQ ID NO: 1305) | 4126 | 4148 |
| M78378_T11 (SEQ ID NO: 1306) | 3375 | 3397 |
| M78378_T13 (SEQ ID NO: 1307) | 574 | 596 |
| M78378_T16 (SEQ ID NO: 1308) | 646 | 668 |
| M78378_T19 (SEQ ID NO: 1309) | 1543 | 1565 |
| M78378_T20 (SEQ ID NO: 1310) | 1398 | 1420 |
| M78378_T21 (SEQ ID NO: 1311) | 639 | 661 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_39 (SEQ ID NO:1346) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1251 below describes the starting and ending position of this segment on each transcript.

TABLE 1251

Segment location on transcripts

| Transcript name | Segment starting position | Segment ending position |
|---|---|---|
| M78378_T5 (SEQ ID NO: 1304) | 4302 | 4319 |
| M78378_T10 (SEQ ID NO: 1305) | 4149 | 4166 |
| M78378_T11 (SEQ ID NO: 1306) | 3398 | 3415 |
| M78378_T13 (SEQ ID NO: 1307) | 597 | 614 |
| M78378_T16 (SEQ ID NO: 1308) | 669 | 686 |
| M78378_T19 (SEQ ID NO: 1309) | 1566 | 1583 |
| M78378_T20 (SEQ ID NO: 1310) | 1421 | 1438 |
| M78378_T21 (SEQ ID NO: 1311) | 662 | 679 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_40 (SEQ ID NO:1347) according to the present invention is supported by 146 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1252 below describes the starting and ending position of this segment on each transcript.

TABLE 1252

Segment location on transcripts

| Transcript name | Segment starting position | Segment ending position |
|---|---|---|
| M78378_T5 (SEQ ID NO: 1304) | 4320 | 4376 |
| M78378_T10 (SEQ ID NO: 1305) | 4167 | 4223 |
| M78378_T11 (SEQ ID NO: 1306) | 3416 | 3472 |
| M78378_T13 (SEQ ID NO: 1307) | 615 | 671 |
| M78378_T16 (SEQ ID NO: 1308) | 687 | 743 |
| M78378_T19 (SEQ ID NO: 1309) | 1584 | 1640 |
| M78378_T20 (SEQ ID NO: 1310) | 1439 | 1495 |
| M78378_T21 (SEQ ID NO: 1311) | 680 | 736 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_41 (SEQ ID NO:1348) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1253 below describes the starting and ending position of this segment on each transcript.

TABLE 1253

Segment location on transcripts

| Transcript name | Segment starting position | Segment ending position |
|---|---|---|
| M78378_T5 (SEQ ID NO: 1304) | 4377 | 4389 |
| M78378_T10 (SEQ ID NO: 1305) | 4224 | 4236 |
| M78378_T11 (SEQ ID NO: 1306) | 3473 | 3485 |
| M78378_T13 (SEQ ID NO: 1307) | 672 | 684 |
| M78378_T16 (SEQ ID NO: 1308) | 744 | 756 |
| M78378_T19 (SEQ ID NO: 1309) | 1641 | 1653 |
| M78378_T20 (SEQ ID NO: 1310) | 1496 | 1508 |
| M78378_T21 (SEQ ID NO: 1311) | 737 | 749 |

This segment can be found in both coding and non-coding regions of transcript(s) as follows. The segment can be found in a non-coding region of transcript(s) that are related to the following protein(s): M78378_P23 and M78378_P11. This segment can also be found in the following protein(s): M78378_P6 and M78378_P4, since it is in the coding region for the corresponding transcript.

Segment cluster M78378_node_42 (SEQ ID NO:1349) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1254 below describes the starting and ending position of this segment on each transcript.

TABLE 1254

Segment location on transcripts

| Transcript name | Segment starting position | Segment ending position |
|---|---|---|
| M78378_T5 (SEQ ID NO: 1304) | 4390 | 4408 |
| M78378_T10 (SEQ ID NO: 1305) | 4237 | 4255 |
| M78378_T11 (SEQ ID NO: 1306) | 3486 | 3504 |
| M78378_T13 (SEQ ID NO: 1307) | 685 | 703 |
| M78378_T16 (SEQ ID NO: 1308) | 757 | 775 |
| M78378_T19 (SEQ ID NO: 1309) | 1654 | 1672 |
| M78378_T20 (SEQ ID NO: 1310) | 1509 | 1527 |
| M78378_T21 (SEQ ID NO: 1311) | 750 | 768 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_43 (SEQ ID NO:1350) according to the present invention is supported by 150 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1255 below describes the starting and ending position of this segment on each transcript.

TABLE 1255

Segment location on transcripts

| Transcript name | Segment starting position | Segment ending position |
|---|---|---|
| M78378_T5 (SEQ ID NO: 1304) | 4409 | 4456 |
| M78378_T10 (SEQ ID NO: 1305) | 4256 | 4303 |
| M78378_T11 (SEQ ID NO: 1306) | 3505 | 3552 |
| M78378_T13 (SEQ ID NO: 1307) | 704 | 751 |
| M78378_T16 (SEQ ID NO: 1308) | 776 | 823 |
| M78378_T19 (SEQ ID NO: 1309) | 1673 | 1720 |
| M78378_T20 (SEQ ID NO: 1310) | 1528 | 1575 |
| M78378_T21 (SEQ ID NO: 1311) | 769 | 816 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_44 (SEQ ID NO:1351) according to the present invention is supported by 156 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1256 below describes the starting and ending position of this segment on each transcript.

TABLE 1256

Segment location on transcripts

| Transcript name | Segment starting position | Segment ending position |
|---|---|---|
| M78378_T5 (SEQ ID NO: 1304) | 4457 | 4540 |
| M78378_T10 (SEQ ID NO: 1305) | 4304 | 4387 |
| M78378_T11 (SEQ ID NO: 1306) | 3553 | 3636 |
| M78378_T13 (SEQ ID NO: 1307) | 752 | 835 |
| M78378_T16 (SEQ ID NO: 1308) | 824 | 907 |
| M78378_T19 (SEQ ID NO: 1309) | 1721 | 1804 |
| M78378_T20 (SEQ ID NO: 1310) | 1576 | 1659 |
| M78378_T21 (SEQ ID NO: 1311) | 817 | 900 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P1, since it is in the coding region for the corresponding transcript.

Segment cluster M78378_node_45 (SEQ ID NO:1352) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1257 below describes the starting and ending position of this segment on each transcript.

TABLE 1257

Segment location on transcripts

| Transcript name | Segment starting position | Segment ending position |
|---|---|---|
| M78378_T5 (SEQ ID NO: 1304) | 4541 | 4555 |
| M78378_T10 (SEQ ID NO: 1305) | 4388 | 4402 |
| M78378_T11 (SEQ ID NO: 1306) | 3637 | 3651 |
| M78378_T13 (SEQ ID NO: 1307) | 836 | 850 |
| M78378_T16 (SEQ ID NO: 1308) | 908 | 922 |
| M78378_T19 (SEQ ID NO: 1309) | 1805 | 1819 |
| M78378_T20 (SEQ ID NO: 1310) | 1660 | 1674 |
| M78378_T21 (SEQ ID NO: 1311) | 901 | 915 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P1, since it is in the coding region for the corresponding transcript.

Segment cluster M78378_node_46 (SEQ ID NO:1353) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1258 below describes the starting and ending position of this segment on each transcript.

TABLE 1258

Segment location on transcripts

| Transcript name | Segment starting position | Segment ending position |
|---|---|---|
| M78378_T5 (SEQ ID NO: 1304) | 4556 | 4580 |
| M78378_T10 (SEQ ID NO: 1305) | 4403 | 4427 |
| M78378_T11 (SEQ ID NO: 1306) | 3652 | 3676 |
| M78378_T13 (SEQ ID NO: 1307) | 851 | 875 |
| M78378_T16 (SEQ ID NO: 1308) | 923 | 947 |
| M78378_T19 (SEQ ID NO: 1309) | 1820 | 1844 |
| M78378_T20 (SEQ ID NO: 1310) | 1675 | 1699 |
| M78378_T21 (SEQ ID NO: 1311) | 916 | 940 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_49 (SEQ ID NO:1354) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1259 below describes the starting and ending position of this segment on each transcript.

TABLE 1259

Segment location on transcripts

| Transcript name | Segment starting position | Segment ending position |
|---|---|---|
| M78378_T5 (SEQ ID NO: 1304) | 4581 | 4594 |
| M78378_T10 (SEQ ID NO: 1305) | 4428 | 4441 |
| M78378_T11 (SEQ ID NO: 1306) | 3677 | 3690 |
| M78378_T13 (SEQ ID NO: 1307) | 876 | 889 |
| M78378_T16 (SEQ ID NO: 1308) | 948 | 961 |
| M78378_T19 (SEQ ID NO: 1309) | 1845 | 1858 |
| M78378_T20 (SEQ ID NO: 1310) | 1700 | 1713 |
| M78378_T21 (SEQ ID NO: 1311) | 941 | 954 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_50 (SEQ ID NO:1355) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1260 below describes the starting and ending position of this segment on each transcript.

TABLE 1260

Segment location on transcripts

| Transcript name | Segment starting position | Segment ending position |
|---|---|---|
| M78378_T5 (SEQ ID NO: 1304) | 4595 | 4609 |
| M78378_T10 (SEQ ID NO: 1305) | 4442 | 4456 |
| M78378_T11 (SEQ ID NO: 1306) | 3691 | 3705 |
| M78378_T13 (SEQ ID NO: 1307) | 890 | 904 |
| M78378_T16 (SEQ ID NO: 1308) | 962 | 976 |
| M78378_T19 (SEQ ID NO: 1309) | 1859 | 1873 |
| M78378_T20 (SEQ ID NO: 1310) | 1714 | 1728 |
| M78378_T21 (SEQ ID NO: 1311) | 955 | 969 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_51 (SEQ ID NO:1356) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1261 below describes the starting and ending position of this segment on each transcript.

TABLE 1261

Segment location on transcripts

| Transcript name | Segment starting position | Segment ending position |
|---|---|---|
| M78378_T5 (SEQ ID NO: 1304) | 4610 | 4615 |
| M78378_T10 (SEQ ID NO: 1305) | 4457 | 4462 |
| M78378_T11 (SEQ ID NO: 1306) | 3706 | 3711 |
| M78378_T13 (SEQ ID NO: 1307) | 905 | 910 |
| M78378_T16 (SEQ ID NO: 1308) | 977 | 982 |
| M78378_T19 (SEQ ID NO: 1309) | 1874 | 1879 |
| M78378_T20 (SEQ ID NO: 1310) | 1729 | 1734 |
| M78378_T21 (SEQ ID NO: 1311) | 970 | 975 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_53 (SEQ ID NO:1357) according to the present invention is supported by 120 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1262 below describes the starting and ending position of this segment on each transcript.

TABLE 1262

Segment location on transcripts

| Transcript name | Segment starting position | Segment ending position |
|---|---|---|
| M78378_T5 (SEQ ID NO: 1304) | 4740 | 4776 |
| M78378_T10 (SEQ ID NO: 1305) | 4587 | 4623 |
| M78378_T11 (SEQ ID NO: 1306) | 3836 | 3872 |
| M78378_T13 (SEQ ID NO: 1307) | 1035 | 1071 |
| M78378_T16 (SEQ ID NO: 1308) | 1107 | 1143 |
| M78378_T19 (SEQ ID NO: 1309) | 2004 | 2040 |
| M78378_T20 (SEQ ID NO: 1310) | 1859 | 1895 |
| M78378_T21 (SEQ ID NO: 1311) | 1100 | 1136 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_54 (SEQ ID NO:1358) according to the present invention is supported by 128 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1263 below describes the starting and ending position of this segment on each transcript.

TABLE 1263

Segment location on transcripts

| Transcript name | Segment starting position | Segment ending position |
|---|---|---|
| M78378_T5 (SEQ ID NO: 1304) | 4777 | 4858 |
| M78378_T10 (SEQ ID NO: 1305) | 4624 | 4705 |
| M78378_T11 (SEQ ID NO: 1306) | 3873 | 3954 |
| M78378_T13 (SEQ ID NO: 1307) | 1072 | 1153 |
| M78378_T16 (SEQ ID NO: 1308) | 1144 | 1225 |
| M78378_T19 (SEQ ID NO: 1309) | 2041 | 2122 |
| M78378_T20 (SEQ ID NO: 1310) | 1896 | 1977 |
| M78378_T21 (SEQ ID NO: 1311) | 1137 | 1218 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Segment cluster M78378_node_55 (SEQ ID NO:1359) according to the present invention is supported by 127 libraries. The number of libraries was determined as previously described. This segment can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1264 below describes the starting and ending position of this segment on each transcript.

TABLE 1264

Segment location on transcripts

| Transcript name | Segment starting position | Segment ending position |
|---|---|---|
| M78378_T5 (SEQ ID NO: 1304) | 4859 | 4913 |
| M78378_T10 (SEQ ID NO: 1305) | 4706 | 4760 |
| M78378_T11 (SEQ ID NO: 1306) | 3955 | 4009 |
| M78378_T13 (SEQ ID NO: 1307) | 1154 | 1208 |
| M78378_T16 (SEQ ID NO: 1308) | 1226 | 1280 |
| M78378_T19 (SEQ ID NO: 1309) | 2123 | 2177 |
| M78378_T20 (SEQ ID NO: 1310) | 1978 | 2032 |
| M78378_T21 (SEQ ID NO: 1311) | 1219 | 1273 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P1, since it is in the coding region for the corresponding transcript.

Segment cluster M78378_node_57 (SEQ ID NO:1360) according to the present invention can be found in the following transcript(s): M78378_T5 (SEQ ID NO:1304), M78378_T10 (SEQ ID NO:1305), M78378_T11 (SEQ ID NO:1306), M78378_T13 (SEQ ID NO:1307), M78378_T16 (SEQ ID NO:1308), M78378_T19 (SEQ ID NO:1309), M78378_T20 (SEQ ID NO:1310) and M78378_T21 (SEQ ID NO:1311). Table 1265 below describes the starting and ending position of this segment on each transcript.

TABLE 1265

Segment location on transcripts

| Transcript name | Segment starting position | Segment ending position |
|---|---|---|
| M78378_T5 (SEQ ID NO: 1304) | 5157 | 5165 |
| M78378_T10 (SEQ ID NO: 1305) | 5004 | 5012 |
| M78378_T11 (SEQ ID NO: 1306) | 4253 | 4261 |
| M78378_T13 (SEQ ID NO: 1307) | 1452 | 1460 |
| M78378_T16 (SEQ ID NO: 1308) | 1524 | 1532 |
| M78378_T19 (SEQ ID NO: 1309) | 2421 | 2429 |
| M78378_T20 (SEQ ID NO: 1310) | 2276 | 2284 |
| M78378_T21 (SEQ ID NO: 1311) | 1517 | 1525 |

This segment can be found in both coding and non-coding regions of transcript(s) as follows. The segment can be found in a non-coding region of transcript(s) that are related to the following protein(s): M78378_P23. This segment can also be found in the following protein(s): M78378_P6, M78378_P4 and M78378_P11, since it is in the coding region for the corresponding transcript.

Description for Cluster M85976

Cluster M85976 features 16 transcript(s) and 37 segment(s) of interest, the names for which are given in Tables 1266 and 1267, respectively, the sequences themselves are given at the end of the application. The selected protein variants are given in Table 1268.

TABLE 1266

Transcripts of interest
Transcript Name

M85976_T1 (SEQ ID NO: 1361)
M85976_T2 (SEQ ID NO: 1362)

TABLE 1266-continued

Transcripts of interest
Transcript Name

M85976_T3 (SEQ ID NO: 1363)
M85976_T4 (SEQ ID NO: 1364)
M85976_T5 (SEQ ID NO: 1365)
M85976_T6 (SEQ ID NO: 1366)
M85976_T7 (SEQ ID NO: 1367)
M85976_T10 (SEQ ID NO: 1368)
M85976_T11 (SEQ ID NO: 1369)
M85976_T15 (SEQ ID NO: 1370)
M85976_T17 (SEQ ID NO: 1371)
M85976_T18 (SEQ ID NO: 1372)
M85976_T26 (SEQ ID NO: 1373)
M85976_T33 (SEQ ID NO: 1374)
M85976_T34 (SEQ ID NO: 1375)
M85976_T36 (SEQ ID NO: 1376)

TABLE 1267

Segments of interest
Segment Name

M85976_node_0 (SEQ ID NO: 1377)
M85976_node_3 (SEQ ID NO: 1378)
M85976_node_6 (SEQ ID NO: 1379)
M85976_node_26 (SEQ ID NO: 1380)
M85976_node_29 (SEQ ID NO: 1381)
M85976_node_30 (SEQ ID NO: 1382)
M85976_node_34 (SEQ ID NO: 1383)
M85976_node_37 (SEQ ID NO: 1384)
M85976_node_40 (SEQ ID NO: 1385)
M85976_node_41 (SEQ ID NO: 1386)
M85976_node_42 (SEQ ID NO: 1387)
M85976_node_55 (SEQ ID NO: 1388)
M85976_node_57 (SEQ ID NO: 1389)
M85976_node_58 (SEQ ID NO: 1390)
M85976_node_60 (SEQ ID NO: 1391)
M85976_node_61 (SEQ ID NO: 1392)
M85976_node_1 (SEQ ID NO: 1393)
M85976_node_4 (SEQ ID NO: 1394)
M85976_node_5 (SEQ ID NO: 1395)
M85976_node_10 (SEQ ID NO: 1396)
M85976_node_11 (SEQ ID NO: 1397)
M85976_node_12 (SEQ ID NO: 1398)
M85976_node_13 (SEQ ID NO: 1399)
M85976_node_16 (SEQ ID NO: 1400)
M85976_node_17 (SEQ ID NO: 1401)
M85976_node_19 (SEQ ID NO: 1402)
M85976_node_21 (SEQ ID NO: 1403)
M85976_node_33 (SEQ ID NO: 1404)
M85976_node_35 (SEQ ID NO: 1405)
M85976_node_36 (SEQ ID NO: 1406)
M85976_node_39 (SEQ ID NO: 1407)
M85976_node_45 (SEQ ID NO: 1408)
M85976_node_46 (SEQ ID NO: 1409)
M85976_node_47 (SEQ ID NO: 1410)
M85976_node_50 (SEQ ID NO: 1411)
M85976_node_51 (SEQ ID NO: 1412)
M85976_node_59 (SEQ ID NO: 1413)

TABLE 1268

Proteins of interest

| Protein Name | Corresponding Transcript(s) |
|---|---|
| M85976_P2 | M85976_T1 (SEQ ID NO: 1361); M85976_T2 (SEQ ID NO: 1362) |
| M85976_P3 | M85976_T3 (SEQ ID NO: 1363) |
| M85976_P4 | M85976_T4 (SEQ ID NO: 1364); M85976_T15 (SEQ ID NO: 1370); M85976_T26 (SEQ ID NO: 1373) |

TABLE 1268-continued

Proteins of interest

| Protein Name | Corresponding Transcript(s) |
|---|---|
| M85976_P5 | M85976_T5 (SEQ ID NO: 1365) |
| M85976_P6 | M85976_T6 (SEQ ID NO: 1366) |
| M85976_P7 | M85976_T7 (SEQ ID NO: 1367) |
| M85976_P10 | M85976_T10 (SEQ ID NO: 1368) |
| M85976_P11 | M85976_T11 (SEQ ID NO: 1369) |
| M85976_P15 | M85976_T17 (SEQ ID NO: 1371) |
| M85976_P16 | M85976_T18 (SEQ ID NO: 1372) |
| M85976_P25 | M85976_T33 (SEQ ID NO: 1374); |
|  | M85976_T34 (SEQ ID NO: 1375) |
| M85976_P26 | M85976_T36 (SEQ ID NO: 1376) |

These sequences are variants of the known protein Thimet oligopeptidase (SwissProt accession identifier MEPD_HUMAN; known also according to the synonyms EC 3.4.24.15; Endopeptidase 24.15; MP78), referred to herein as the previously known protein.

Protein Thimet oligopeptidase is known or believed to have the following function(s): Involved in the metabolism of neuropeptides under 20 amino acid residues long. Involved in cytoplasmic peptide degradation. Able to degrade the beta-amyloid precursor protein and generate amyloidogenic fragments. The sequence for protein Thimet oligopeptidase is given at the end of the application, as "Thimet oligopeptidase amino acid sequence". Protein Thimet oligopeptidase localization is believed to be Cytoplasmic.

The following GO Annotation(s) apply to the previously known protein. The following annotation(s) were found: metalloendopeptidase, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M85976 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 32 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 32 and Table 1269. This cluster is overexpressed (at least at a minimum level) in the following pathological conditions: brain malignant tumors, colorectal cancer, epithelial malignant tumors and a mixture of malignant tumors from different tissues. 32

TABLE 1269

Normal tissue distribution

| Name of Tissue | Number |
|---|---|
| Adrenal | 48 |
| Bladder | 0 |
| Bone | 0 |
| Brain | 31 |
| Colon | 31 |
| Epithelial | 26 |
| General | 25 |

TABLE 1269-continued

Normal tissue distribution

| Name of Tissue | Number |
|---|---|
| head and neck | 0 |
| Kidney | 26 |
| Liver | 0 |
| Lung | 36 |
| lymph nodes | 45 |
| Breast | 8 |
| bone marrow | 0 |
| Muscle | 0 |
| Ovary | 14 |
| Pancreas | 4 |
| Prostate | 14 |
| Skin | 53 |
| Stomach | 0 |
| Uterus | 4 |

TABLE 1270

P values and ratios for expression in cancerous tissue

| Name of Tissue | P1 | P2 | SP1 | R3 | SP2 | R4 |
|---|---|---|---|---|---|---|
| Adrenal | 8.3e-01 | 7.8e-01 | 1 | 0.5 | 7.8e-01 | 0.8 |
| Bladder | 5.4e-01 | 3.4e-01 | 5.6e-01 | 1.8 | 4.6e-01 | 1.9 |
| Bone | 3.3e-01 | 1.7e-02 | 4.0e-01 | 2.5 | 1.2e-01 | 3.7 |
| Brain | 1.3e-01 | 1.4e-01 | 1.2e-04 | 3.2 | 1.6e-05 | 3.1 |
| Colon | 8.7e-03 | 7.7e-03 | 1.9e-01 | 2.4 | 2.0e-01 | 2.2 |
| Epithelial | 1.4e-01 | 5.2e-03 | 6.2e-02 | 1.6 | 4.2e-06 | 2.5 |
| General | 1.1e-03 | 2.1e-07 | 5.8e-05 | 2.0 | 7.2e-15 | 2.9 |
| head and neck | 2.1e-01 | 3.3e-01 | 1 | 1.1 | 1 | 1.0 |
| Kidney | 8.9e-01 | 8.4e-01 | 1 | 0.5 | 9.1e-01 | 0.7 |
| Liver | 1 | 6.8e-01 | 1 | 1.0 | 4.8e-01 | 1.9 |
| Lung | 8.9e-01 | 5.3e-01 | 8.8e-01 | 0.5 | 8.5e-02 | 1.3 |
| lymph nodes | 4.5e-01 | 3.6e-01 | 6.3e-01 | 1.3 | 5.0e-01 | 1.2 |
| Breast | 8.7e-01 | 6.2e-01 | 4.7e-01 | 1.6 | 3.8e-01 | 1.7 |
| bone marrow | 1 | 6.7e-01 | 1 | 1.0 | 5.3e-01 | 2.1 |
| Muscle | 2.3e-01 | 6.6e-02 | 1.5e-01 | 6.8 | 5.9e-02 | 5.7 |
| Ovary | 8.9e-01 | 7.6e-01 | 6.8e-01 | 1.0 | 2.4e-02 | 1.6 |
| Pancreas | 3.8e-01 | 3.6e-01 | 1.8e-01 | 2.7 | 1.1e-02 | 3.3 |
| Prostate | 8.3e-01 | 6.9e-01 | 2.0e-01 | 1.9 | 4.2e-02 | 2.3 |
| Skin | 7.7e-01 | 6.9e-01 | 1 | 0.2 | 9.4e-01 | 0.4 |
| Stomach | 1 | 1.9e-01 | 1 | 1.0 | 8.4e-02 | 3.0 |
| Uterus | 6.4e-02 | 2.4e-02 | 8.5e-02 | 3.4 | 1.2e-02 | 4.2 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1271.

TABLE 1271

Oligonucleotides related to this cluster

| Oligonucleotide name | Overexpressed in cancers | Chip reference |
|---|---|---|
| M85976_0_0_26828 | lung malignant tumors | LUN |

As noted above, cluster M85976 features 37 segment(s), which were listed in Table 1267 above and for which the sequence(s) are given at the end of the application. These segment(s) are portions of nucleic acid sequence(s) which are described herein separately because they are of particular interest. A description of each segment according to the present invention is now provided.

Segment cluster M85976_node_0 (SEQ ID NO:1377) according to the present invention is supported by 53 libraries. The number of libraries was determined as previously described. This segment can be found in the following transcript(s): M85976_T18 (SEQ ID NO:1372) and M85976_T36 (SEQ ID NO:1376). Table 1272 below describes the starting and ending position of this segment on each transcript.

TABLE 1272

Segment location on transcripts

| Transcript name | Segment starting position | Segment ending position |
|---|---|---|
| M85976_T18 (SEQ ID NO: 1372) | 1 | 143 |
| M85976_T36 (SEQ ID NO: 1376) | 1 | 143 |

This segment can be found in a non-coding region of transcript(s) that are related to the following protein(s): M85976_P16 and M85976_P26.

Segment cluster M85976_node_3 (SEQ ID NO:1378) according to the present invention is supported by 67 libraries. The number of libraries was determined as previously described. This segment can be found in the following transcript(s): M85976_T18 (SEQ ID NO:1372) and M85976_T36 (SEQ ID NO:1376). Table 1273 below describes the starting and ending position of this segment on each transcript.

TABLE 1273

Segment location on transcripts

| Transcript name | Segment starting position | Segment ending position |
|---|---|---|
| M85976_T18 (SEQ ID NO: 1372) | 220 | 362 |
| M85976_T36 (SEQ ID NO: 1376) | 220 | 362 |

This segment can be found in the following protein(s): M85976_P16 and M85976_P26.

Segment cluster M85976_node_6 (SEQ ID NO:1379) according to the present invention is supported by 1 libraries. The number of libraries was determined as previously described. This segment can be found in the following transcript(s): M85976_T36 (SEQ ID NO:1376). Table 1274 below describes the starting and ending position of this segment on each transcript.

TABLE 1274

Segment location on transcripts

| Transcript name | Segment starting position | Segment ending position |
|---|---|---|
| M85976_T36 (SEQ ID NO: 1376) | 433 | 1445 |

This segment can be found in the following protein(s): M85976_P26.

Segment cluster M85976_node_26 (SEQ ID NO:1380) according to the present invention is supported by 73 libraries. The number of libraries was determined as previously described. This segment can be found in the following transcript(s): M85976_T18 (SEQ ID NO:1372). Table 1275 below describes the starting and ending position of this segment on each transcript.

TABLE 1275

Segment location on transcripts

| Transcript name | Segment starting position | Segment ending position |
|---|---|---|
| M85976_T18 (SEQ ID NO: 1372) | 793 | 953 |

This segment can be found in the following protein(s): M85976_P16.

Segment cluster M85976_node_29 (SEQ ID NO:1381) according to the present invention is supported by 10 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371) and M85976_T26 (SEQ ID NO:1373). Table 1276 below describes the starting and ending position of this segment on each transcript.

TABLE 1276

Segment location on transcripts

| Transcript name | Segment starting position | Segment ending position |
|---|---|---|
| M85976_T1 (SEQ ID NO: 1361) | 1 | 912 |
| M85976_T2 (SEQ ID NO: 1362) | 1 | 912 |
| M85976_T3 (SEQ ID NO: 1363) | 1 | 912 |
| M85976_T4 (SEQ ID NO: 1364) | 1 | 912 |
| M85976_T5 (SEQ ID NO: 1365) | 1 | 912 |
| M85976_T6 (SEQ ID NO: 1366) | 1 | 912 |
| M85976_T7 (SEQ ID NO: 1367) | 1 | 912 |
| M85976_T10 (SEQ ID NO: 1368) | 1 | 912 |
| M85976_T11 (SEQ ID NO: 1369) | 1 | 912 |
| M85976_T15 (SEQ ID NO: 1370) | 1 | 912 |
| M85976_T17 (SEQ ID NO: 1371) | 1 | 912 |
| M85976_T26 (SEQ ID NO: 1373) | 1 | 912 |

This segment can be found in both coding and non-coding regions of transcript(s) as follows. The segment can be found in a non-coding region of transcript(s) that are related to the following protein(s): M85976_P3 and M85976_P6. This segment can also be found in the following protein(s): M85976_P2, M85976_P4, M85976_P5, M85976_P7, M85976_P10, M85976_P11 and M85976_P15, since it is in the coding region for the corresponding transcript.

Segment cluster M85976_node_30 (SEQ ID NO:1382) according to the present invention is supported by 78 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1277 below describes the starting and ending position of this segment on each transcript.

TABLE 1277

Segment location on transcripts

| Transcript name | Segment starting position | Segment ending position |
| --- | --- | --- |
| M85976_T1 (SEQ ID NO: 1361) | 913 | 1048 |
| M85976_T2 (SEQ ID NO: 1362) | 913 | 1048 |
| M85976_T3 (SEQ ID NO: 1363) | 913 | 1048 |
| M85976_T4 (SEQ ID NO: 1364) | 913 | 1048 |
| M85976_T5 (SEQ ID NO: 1365) | 913 | 1048 |
| M85976_T6 (SEQ ID NO: 1366) | 913 | 1048 |
| M85976_T7 (SEQ ID NO: 1367) | 913 | 1048 |
| M85976_T10 (SEQ ID NO: 1368) | 913 | 1048 |
| M85976_T11 (SEQ ID NO: 1369) | 913 | 1048 |
| M85976_T15 (SEQ ID NO: 1370) | 913 | 1048 |
| M85976_T17 (SEQ ID NO: 1371) | 913 | 1048 |
| M85976_T18 (SEQ ID NO: 1372) | 954 | 1089 |
| M85976_T26 (SEQ ID NO: 1373) | 913 | 1048 |

This segment can be found in both coding and non-coding regions of transcript(s) as follows. The segment can be found in a non-coding region of transcript(s) that are related to the following protein(s): M85976_P3 and M85976_P6. This segment can also be found in the following protein(s): M85976_P2, M85976_P4, M85976_P5, M85976_P7, M85976_P10, M85976_P11, M85976_P15 and M85976_P16, since it is in the coding region for the corresponding transcript.

Segment cluster M85976_node_34 (SEQ ID NO:1383) according to the present invention is supported by 81 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1278 below describes the starting and ending position of this segment on each transcript.

TABLE 1278

Segment location on transcripts

| Transcript name | Segment starting position | Segment ending position |
| --- | --- | --- |
| M85976_T1 (SEQ ID NO: 1361) | 1087 | 1380 |
| M85976_T2 (SEQ ID NO: 1362) | 1087 | 1380 |
| M85976_T3 (SEQ ID NO: 1363) | 1087 | 1380 |
| M85976_T4 (SEQ ID NO: 1364) | 1087 | 1380 |
| M85976_T5 (SEQ ID NO: 1365) | 1087 | 1380 |
| M85976_T6 (SEQ ID NO: 1366) | 1087 | 1380 |
| M85976_T7 (SEQ ID NO: 1367) | 1087 | 1380 |
| M85976_T10 (SEQ ID NO: 1368) | 1087 | 1380 |
| M85976_T11 (SEQ ID NO: 1369) | 1087 | 1380 |
| M85976_T15 (SEQ ID NO: 1370) | 1087 | 1380 |
| M85976_T17 (SEQ ID NO: 1371) | 1087 | 1380 |
| M85976_T18 (SEQ ID NO: 1372) | 1128 | 1421 |
| M85976_T26 (SEQ ID NO: 1373) | 1087 | 1380 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1279.

TABLE 1279

Oligonucleotides related to this segment

| Oligonucleotide name | Overexpressed in cancers | Chip reference |
| --- | --- | --- |
| M85976_0_21_0 | lung malignant tumors | LUN |

This segment can be found in both coding and non-coding regions of transcript(s) as follows. The segment can be found in a non-coding region of transcript(s) that are related to the following protein(s): M85976_P3. This segment can also be found in the following protein(s): M85976_P2, M85976_P4, M85976_P5, M85976_P6, M85976_P7, M85976_P10, M85976_P11, M85976_P15 and M85976_P16, since it is in the coding region for the corresponding transcript.

Segment cluster M85976_node_37 (SEQ ID NO:1384) according to the present invention is supported by 7 libraries. The number of libraries was determined as previously described. This segment can be found in the following transcript(s): M85976_T3 (SEQ ID NO:1363), M85976_T7 (SEQ ID NO:1367) and M85976_T18 (SEQ ID NO:1372). Table 1280 below describes the starting and ending position of this segment on each transcript.

TABLE 1280

Segment location on transcripts

| Transcript name | Segment starting position | Segment ending position |
| --- | --- | --- |
| M85976_T3 (SEQ ID NO: 1363) | 1416 | 1849 |
| M85976_T7 (SEQ ID NO: 1367) | 1416 | 1849 |
| M85976_T18 (SEQ ID NO: 1372) | 1457 | 1890 |

This segment can be found in both coding and non-coding regions of transcript(s) as follows. The segment can be found in a non-coding region of transcript(s) that are related to the following protein(s): M85976_P3. This segment can also be found in the following protein(s): M85976_P7 and M85976_P16, since it is in the coding region for the corresponding transcript.

Segment cluster M85976_node_40 (SEQ ID NO:1385) according to the present invention is supported by 66 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1281 below describes the starting and ending position of this segment on each transcript.

TABLE 1281

Segment location on transcripts

| Transcript name | Segment starting position | Segment ending position |
| --- | --- | --- |
| M85976_T1 (SEQ ID NO: 1361) | 1435 | 1617 |
| M85976_T2 (SEQ ID NO: 1362) | 1435 | 1617 |
| M85976_T3 (SEQ ID NO: 1363) | 1869 | 2051 |
| M85976_T4 (SEQ ID NO: 1364) | 1435 | 1617 |

TABLE 1281-continued

| | Segment location on transcripts | |
|---|---|---|
| Transcript name | Segment starting position | Segment ending position |
| M85976_T5 (SEQ ID NO: 1365) | 1407 | 1589 |
| M85976_T6 (SEQ ID NO: 1366) | 1400 | 1582 |
| M85976_T7 (SEQ ID NO: 1367) | 1869 | 2051 |
| M85976_T10 (SEQ ID NO: 1368) | 1435 | 1617 |
| M85976_T11 (SEQ ID NO: 1369) | 1435 | 1617 |
| M85976_T15 (SEQ ID NO: 1370) | 1435 | 1617 |
| M85976_T17 (SEQ ID NO: 1371) | 1435 | 1617 |
| M85976_T18 (SEQ ID NO: 1372) | 1910 | 2092 |
| M85976_T26 (SEQ ID NO: 1373) | 1435 | 1617 |

This segment can be found in both coding and non-coding regions of transcript(s) as follows. The segment can be found in a non-coding region of transcript(s) that are related to the following protein(s): M85976_P7 and M85976_P16. This segment can also be found in the following protein(s): M85976_P2, M85976_P3, M85976_P4, M85976_P5, M85976_P6, M85976_P10, M85976_P11 and M85976_P15, since it is in the coding region for the corresponding transcript.

Segment cluster M85976_node_41 (SEQ ID NO:1386) according to the present invention is supported by 17 libraries. The number of libraries was determined as previously described. This segment can be found in the following transcript(s): M85976_T4 (SEQ ID NO:1364), M85976_T7 (SEQ ID NO:1367), M85976_T15 (SEQ ID NO:1370) and M85976_T26 (SEQ ID NO:1373). Table 1282 below describes the starting and ending position of this segment on each transcript.

TABLE 1282

| | Segment location on transcripts | |
|---|---|---|
| Transcript name | Segment starting position | Segment ending position |
| M85976_T4 (SEQ ID NO: 1364) | 1618 | 3477 |
| M85976_T7 (SEQ ID NO: 1367) | 2052 | 3911 |
| M85976_T15 (SEQ ID NO: 1370) | 1618 | 3477 |
| M85976_T26 (SEQ ID NO: 1373) | 1618 | 3477 |

This segment can be found in both coding and non-coding regions of transcript(s) as follows. The segment can be found in a non-coding region of transcript(s) that are related to the following protein(s): M85976_P7. This segment can also be found in the following protein(s): M85976_P4, since it is in the coding region for the corresponding transcript.

Segment cluster M85976_node_42 (SEQ ID NO:1387) according to the present invention is supported by 75 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1283 below describes the starting and ending position of this segment on each transcript.

TABLE 1283

| | Segment location on transcripts | |
|---|---|---|
| Transcript name | Segment starting position | Segment ending position |
| M85976_T1 (SEQ ID NO: 1361) | 1618 | 1804 |
| M85976_T2 (SEQ ID NO: 1362) | 1618 | 1804 |
| M85976_T3 (SEQ ID NO: 1363) | 2052 | 2238 |
| M85976_T4 (SEQ ID NO: 1364) | 3478 | 3664 |
| M85976_T5 (SEQ ID NO: 1365) | 1590 | 1776 |
| M85976_T6 (SEQ ID NO: 1366) | 1583 | 1769 |
| M85976_T7 (SEQ ID NO: 1367) | 3912 | 4098 |
| M85976_T10 (SEQ ID NO: 1368) | 1618 | 1804 |
| M85976_T11 (SEQ ID NO: 1369) | 1618 | 1804 |
| M85976_T15 (SEQ ID NO: 1370) | 3478 | 3664 |
| M85976_T17 (SEQ ID NO: 1371) | 1618 | 1804 |
| M85976_T18 (SEQ ID NO: 1372) | 2093 | 2279 |
| M85976_T26 (SEQ ID NO: 1373) | 3478 | 3664 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10, M85976_P11 and M85976_P15, since it is in the coding region for the corresponding transcript.

Segment cluster M85976_node_55 (SEQ ID NO:1388) according to the present invention is supported by 4 libraries. The number of libraries was determined as previously described. This segment can be found in the following transcript(s): M85976_T10 (SEQ ID NO:1368) and M85976_T15 (SEQ ID NO:1370). Table 1284 below describes the starting and ending position of this segment on each transcript.

TABLE 1284

| | Segment location on transcripts | |
|---|---|---|
| Transcript name | Segment starting position | Segment ending position |
| M85976_T10 (SEQ ID NO: 1368) | 2071 | 2244 |
| M85976_T15 (SEQ ID NO: 1370) | 3931 | 4104 |

This segment can be found in both coding and non-coding regions of transcript(s) as follows. The segment can be found in a non-coding region of transcript(s) that are related to the following protein(s): M85976_P4. This segment can also be found in the following protein(s): M85976_P10, since it is in the coding region for the corresponding transcript.

Segment cluster M85976_node_57 (SEQ ID NO:1389) according to the present invention is supported by 7 libraries. The number of libraries was determined as previously described. This segment can be found in the following transcript(s): M85976_T33 (SEQ ID NO:1374) and M85976_T34 (SEQ ID NO:1375). Table 1285 below describes the starting and ending position of this segment on each transcript.

TABLE 1285

Segment location on transcripts

| Transcript name | Segment starting position | Segment ending position |
|---|---|---|
| M85976_T33 (SEQ ID NO: 1374) | 1 | 578 |
| M85976_T34 (SEQ ID NO: 1375) | 1 | 578 |

This segment can be found in a non-coding region of transcript(s) that are related to the following protein(s): M85976_P25.

Segment cluster M85976_node_58 (SEQ ID NO:1390) according to the present invention is supported by 106 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T18 (SEQ ID NO:1372), M85976_T33 (SEQ ID NO:1374) and M85976_T34 (SEQ ID NO:1375). Table 1286 below describes the starting and ending position of this segment on each transcript.

TABLE 1286

Segment location on transcripts

| Transcript name | Segment starting position | Segment ending position |
|---|---|---|
| M85976_T1 (SEQ ID NO: 1361) | 2071 | 2204 |
| M85976_T2 (SEQ ID NO: 1362) | 2071 | 2204 |
| M85976_T3 (SEQ ID NO: 1363) | 2505 | 2638 |
| M85976_T4 (SEQ ID NO: 1364) | 3931 | 4064 |
| M85976_T5 (SEQ ID NO: 1365) | 2043 | 2176 |
| M85976_T6 (SEQ ID NO: 1366) | 2036 | 2169 |
| M85976_T7 (SEQ ID NO: 1367) | 4365 | 4498 |
| M85976_T10 (SEQ ID NO: 1368) | 2245 | 2378 |
| M85976_T11 (SEQ ID NO: 1369) | 2035 | 2168 |
| M85976_T15 (SEQ ID NO: 1370) | 4105 | 4238 |
| M85976_T18 (SEQ ID NO: 1372) | 2546 | 2679 |
| M85976_T33 (SEQ ID NO: 1374) | 579 | 712 |
| M85976_T34 (SEQ ID NO: 1375) | 579 | 712 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10, M85976_P11 and M85976_P25, since it is in the coding region for the corresponding transcript.

Segment cluster M85976_node_60 (SEQ ID NO:1391) according to the present invention is supported by 103 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T18 (SEQ ID NO:1372), M85976_T33 (SEQ ID NO:1374) and M85976_T34 (SEQ ID NO:1375). Table 1287 below describes the starting and ending position of this segment on each transcript.

TABLE 1287

Segment location on transcripts

| Transcript name | Segment starting position | Segment ending position |
|---|---|---|
| M85976_T1 (SEQ ID NO: 1361) | 2262 | 2451 |
| M85976_T2 (SEQ ID NO: 1362) | 2262 | 2451 |
| M85976_T3 (SEQ ID NO: 1363) | 2696 | 2885 |
| M85976_T4 (SEQ ID NO: 1364) | 4122 | 4311 |
| M85976_T5 (SEQ ID NO: 1365) | 2234 | 2423 |
| M85976_T6 (SEQ ID NO: 1366) | 2227 | 2416 |
| M85976_T7 (SEQ ID NO: 1367) | 4556 | 4745 |
| M85976_T10 (SEQ ID NO: 1368) | 2436 | 2625 |
| M85976_T11 (SEQ ID NO: 1369) | 2226 | 2415 |
| M85976_T15 (SEQ ID NO: 1370) | 4296 | 4485 |
| M85976_T18 (SEQ ID NO: 1372) | 2737 | 2926 |
| M85976_T33 (SEQ ID NO: 1374) | 770 | 959 |
| M85976_T34 (SEQ ID NO: 1375) | 770 | 959 |

This segment can be found in a non-coding region of transcript(s) that are related to the following protein(s): M85976_P2, M85976_P3, M85976_P4, M85976_P5, M85976_P6, M85976_P7, M85976_P10, M85976_P11, M85976_P16 and M85976_P25.

Segment cluster M85976_node_61 (SEQ ID NO:1392) according to the present invention is supported by 94 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372), M85976_T26 (SEQ ID NO:1373), M85976_T33 (SEQ ID NO:1374) and M85976_T34 (SEQ ID NO:1375). Table 1288 below describes the starting and ending position of this segment on each transcript.

TABLE 1288

Segment location on transcripts

| Transcript name | Segment starting position | Segment ending position |
|---|---|---|
| M85976_T1 (SEQ ID NO: 1361) | 2452 | 2553 |
| M85976_T2 (SEQ ID NO: 1362) | 2452 | 4765 |
| M85976_T3 (SEQ ID NO: 1363) | 2886 | 2987 |
| M85976_T4 (SEQ ID NO: 1364) | 4312 | 4413 |
| M85976_T5 (SEQ ID NO: 1365) | 2424 | 2525 |
| M85976_T6 (SEQ ID NO: 1366) | 2417 | 2518 |
| M85976_T7 (SEQ ID NO: 1367) | 4746 | 4847 |
| M85976_T10 (SEQ ID NO: 1368) | 2626 | 2727 |
| M85976_T11 (SEQ ID NO: 1369) | 2416 | 2517 |
| M85976_T15 (SEQ ID NO: 1370) | 4486 | 6799 |
| M85976_T17 (SEQ ID NO: 1371) | 1834 | 4147 |
| M85976_T18 (SEQ ID NO: 1372) | 2927 | 3028 |
| M85976_T26 (SEQ ID NO: 1373) | 3688 | 3789 |
| M85976_T33 (SEQ ID NO: 1374) | 960 | 1061 |
| M85976_T34 (SEQ ID NO: 1375) | 960 | 3273 |

This segment can be found in both coding and non-coding regions of transcript(s) as follows. The segment can be found in a non-coding region of transcript(s) that are related to the following protein(s): M85976_P2, M85976_P3, M85976_P4, M85976_P5, M85976_P6, M85976_P7, M85976_P10, M85976_P11, M85976_P16 and M85976_P25. This segment can also be found in the following protein(s): M85976_P15, since it is in the coding region for the corresponding transcript.

According to an optional embodiment of the present invention, short segments related to the above cluster are also provided. These segments are up to about 120 bp in length, and so are included in a separate description.

Segment cluster M85976_node_1 (SEQ ID NO:1393) according to the present invention is supported by 55 libraries. The number of libraries was determined as previously described. This segment can be found in the following transcript(s): M85976_T18 (SEQ ID NO:1372) and M85976_T36 (SEQ ID NO:1376). Table 1289 below describes the starting and ending position of this segment on each transcript.

TABLE 1289

| Segment location on transcripts | | |
|---|---|---|
| Transcript name | Segment starting position | Segment ending position |
| M85976_T18 (SEQ ID NO: 1372) | 144 | 219 |
| M85976_T36 (SEQ ID NO: 1376) | 144 | 219 |

This segment can be found in the following protein(s): M85976_P16 and M85976_P26.

Segment cluster M85976_node_4 (SEQ ID NO:1394) according to the present invention can be found in the following transcript(s): M85976_T18 (SEQ ID NO:1372) and M85976_T36 (SEQ ID NO:1376). Table 1290 below describes the starting and ending position of this segment on each transcript.

TABLE 1290

| Segment location on transcripts | | |
|---|---|---|
| Transcript name | Segment starting position | Segment ending position |
| M85976_T18 (SEQ ID NO: 1372) | 363 | 374 |
| M85976_T36 (SEQ ID NO: 1376) | 363 | 374 |

This segment can be found in the following protein(s): M85976_P16 and M85976_P26.

Segment cluster M85976_node_5 (SEQ ID NO:1395) according to the present invention is supported by 66 libraries. The number of libraries was determined as previously described. This segment can be found in the following transcript(s): M85976_T18 (SEQ ID NO:1372) and M85976_T36 (SEQ ID NO:1376). Table 1291 below describes the starting and ending position of this segment on each transcript.

TABLE 1291

| Segment location on transcripts | | |
|---|---|---|
| Transcript name | Segment starting position | Segment ending position |
| M85976_T18 (SEQ ID NO: 1372) | 375 | 432 |
| M85976_T36 (SEQ ID NO: 1376) | 375 | 432 |

This segment can be found in the following protein(s): M85976_P16 and M85976_P26.

Segment cluster M85976_node_10 (SEQ ID NO:1396) according to the present invention is supported by 63 libraries. The number of libraries was determined as previously described. This segment can be found in the following transcript(s): M85976_T18 (SEQ ID NO:1372). Table 1292 below describes the starting and ending position of this segment on each transcript.

TABLE 1292

| Segment location on transcripts | | |
|---|---|---|
| Transcript name | Segment starting position | Segment ending position |
| M85976_T18 (SEQ ID NO: 1372) | 433 | 461 |

This segment can be found in the following protein(s): M85976_P16.

Segment cluster M85976_node_11 (SEQ ID NO:1397) according to the present invention is supported by 64 libraries. The number of libraries was determined as previously described. This segment can be found in the following transcript(s): M85976_T18 (SEQ ID NO:1372). Table 1293 below describes the starting and ending position of this segment on each transcript.

TABLE 1293

| Segment location on transcripts | | |
|---|---|---|
| Transcript name | Segment starting position | Segment ending position |
| M85976_T18 (SEQ ID NO: 1372) | 462 | 496 |

This segment can be found in the following protein(s): M85976_P16.

Segment cluster M85976_node_12 (SEQ ID NO:1398) according to the present invention is supported by 67 libraries. The number of libraries was determined as previously described. This segment can be found in the following transcript(s): M85976_T18 (SEQ ID NO:1372). Table 1294 below describes the starting and ending position of this segment on each transcript.

TABLE 1294

| Segment location on transcripts | | |
|---|---|---|
| Transcript name | Segment starting position | Segment ending position |
| M85976_T18 (SEQ ID NO: 1372) | 497 | 541 |

This segment can be found in the following protein(s): M85976_P16.

Segment cluster M85976_node_13 (SEQ ID NO:1399) according to the present invention is supported by 68 libraries. The number of libraries was determined as previously described. This segment can be found in the following transcript(s): M85976_T18 (SEQ ID NO:1372). Table 1295 below describes the starting and ending position of this segment on each transcript.

TABLE 1295

Segment location on transcripts

| Transcript name | Segment starting position | Segment ending position |
|---|---|---|
| M85976_T18 (SEQ ID NO: 1372) | 542 | 581 |

This segment can be found in the following protein(s): M85976_P16.

Segment cluster M85976_node_16 (SEQ ID NO:1400) according to the present invention is supported by 74 libraries. The number of libraries was determined as previously described. This segment can be found in the following transcript(s): M85976_T18 (SEQ ID NO:1372). Table 1296 below describes the starting and ending position of this segment on each transcript.

TABLE 1296

Segment location on transcripts

| Transcript name | Segment starting position | Segment ending position |
|---|---|---|
| M85976_T18 (SEQ ID NO: 1372) | 582 | 652 |

This segment can be found in the following protein(s): M85976_P16.

Segment cluster M85976_node_17 (SEQ ID NO:1401) according to the present invention can be found in the following transcript(s): M85976_T18 (SEQ ID NO:1372). Table 1297 below describes the starting and ending position of this segment on each transcript.

TABLE 1297

Segment location on transcripts

| Transcript name | Segment starting position | Segment ending position |
|---|---|---|
| M85976_T18 (SEQ ID NO: 1372) | 653 | 677 |

This segment can be found in the following protein(s): M85976_P16.

Segment cluster M85976_node_19 (SEQ ID NO:1402) according to the present invention can be found in the following transcript(s): M85976_T18 (SEQ ID NO:1372). Table 1298 below describes the starting and ending position of this segment on each transcript.

TABLE 1298

Segment location on transcripts

| Transcript name | Segment starting position | Segment ending position |
|---|---|---|
| M85976_T18 (SEQ ID NO: 1372) | 678 | 689 |

This segment can be found in the following protein(s): M85976_P16.

Segment cluster M85976_node_21 (SEQ ID NO:1403) according to the present invention is supported by 72 libraries. The number of libraries was determined as previously described. This segment can be found in the following transcript(s): M85976_T18 (SEQ ID NO:1372). Table 1299 below describes the starting and ending position of this segment on each transcript.

TABLE 1299

Segment location on transcripts

| Transcript name | Segment starting position | Segment ending position |
|---|---|---|
| M85976_T18 (SEQ ID NO: 1372) | 690 | 792 |

This segment can be found in the following protein(s): M85976_P16.

Segment cluster M85976_node_33 (SEQ ID NO:1404) according to the present invention is supported by 59 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1300 below describes the starting and ending position of this segment on each transcript.

TABLE 1300

Segment location on transcripts

| Transcript name | Segment starting position | Segment ending position |
|---|---|---|
| M85976_T1 (SEQ ID NO: 1361) | 1049 | 1086 |
| M85976_T2 (SEQ ID NO: 1362) | 1049 | 1086 |
| M85976_T3 (SEQ ID NO: 1363) | 1049 | 1086 |
| M85976_T4 (SEQ ID NO: 1364) | 1049 | 1086 |
| M85976_T5 (SEQ ID NO: 1365) | 1049 | 1086 |
| M85976_T6 (SEQ ID NO: 1366) | 1049 | 1086 |
| M85976_T7 (SEQ ID NO: 1367) | 1049 | 1086 |
| M85976_T10 (SEQ ID NO: 1368) | 1049 | 1086 |
| M85976_T11 (SEQ ID NO: 1369) | 1049 | 1086 |
| M85976_T15 (SEQ ID NO: 1370) | 1049 | 1086 |
| M85976_T17 (SEQ ID NO: 1371) | 1049 | 1086 |
| M85976_T18 (SEQ ID NO: 1372) | 1090 | 1127 |
| M85976_T26 (SEQ ID NO: 1373) | 1049 | 1086 |

This segment can be found in both coding and non-coding regions of transcript(s) as follows. The segment can be found in a non-coding region of transcript(s) that are related to the following protein(s): M85976_P3 and M85976_P6. This segment can also be found in the following protein(s): M85976_P2, M85976_P4, M85976_P5, M85976_P7, M85976_P10, M85976_P11, M85976_P15 and M85976_P16, since it is in the coding region for the corresponding transcript.

Segment cluster M85976_node_35 (SEQ ID NO:1405) according to the present invention can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1301 below describes the starting and ending position of this segment on each transcript.

TABLE 1301

Segment location on transcripts

| Transcript name | Segment starting position | Segment ending position |
|---|---|---|
| M85976_T1 (SEQ ID NO: 1361) | 1381 | 1387 |
| M85976_T2 (SEQ ID NO: 1362) | 1381 | 1387 |
| M85976_T3 (SEQ ID NO: 1363) | 1381 | 1387 |
| M85976_T4 (SEQ ID NO: 1364) | 1381 | 1387 |
| M85976_T5 (SEQ ID NO: 1365) | 1381 | 1387 |
| M85976_T7 (SEQ ID NO: 1367) | 1381 | 1387 |
| M85976_T10 (SEQ ID NO: 1368) | 1381 | 1387 |
| M85976_T11 (SEQ ID NO: 1369) | 1381 | 1387 |
| M85976_T15 (SEQ ID NO: 1370) | 1381 | 1387 |
| M85976_T17 (SEQ ID NO: 1371) | 1381 | 1387 |
| M85976_T18 (SEQ ID NO: 1372) | 1422 | 1428 |
| M85976_T26 (SEQ ID NO: 1373) | 1381 | 1387 |

This segment can be found in both coding and non-coding regions of transcript(s) as follows. The segment can be found in a non-coding region of transcript(s) that are related to the following protein(s): M85976_P3. This segment can also be found in the following protein(s): M85976_P2, M85976_P4, M85976_P5, M85976_P7, M85976_P10, M85976_P11, M85976_P15 and M85976_P16, since it is in the coding region for the corresponding transcript.

Segment cluster M85976_node_36 (SEQ ID NO:1406) according to the present invention is supported by 51 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1302 below describes the starting and ending position of this segment on each transcript.

TABLE 1302

Segment location on transcripts

| Transcript name | Segment starting position | Segment ending position |
|---|---|---|
| M85976_T1 (SEQ ID NO: 1361) | 1388 | 1415 |
| M85976_T2 (SEQ ID NO: 1362) | 1388 | 1415 |
| M85976_T3 (SEQ ID NO: 1363) | 1388 | 1415 |
| M85976_T4 (SEQ ID NO: 1364) | 1388 | 1415 |
| M85976_T7 (SEQ ID NO: 1367) | 1388 | 1415 |
| M85976_T10 (SEQ ID NO: 1368) | 1388 | 1415 |
| M85976_T11 (SEQ ID NO: 1369) | 1388 | 1415 |
| M85976_T15 (SEQ ID NO: 1370) | 1388 | 1415 |
| M85976_T17 (SEQ ID NO: 1371) | 1388 | 1415 |
| M85976_T18 (SEQ ID NO: 1372) | 1429 | 1456 |
| M85976_T26 (SEQ ID NO: 1373) | 1388 | 1415 |

This segment can be found in both coding and non-coding regions of transcript(s) as follows. The segment can be found in a non-coding region of transcript(s) that are related to the following protein(s): M85976_P3. This segment can also be found in the following protein(s): M85976_P2, M85976_P4, M85976_P7, M85976_P10, M85976_P11, M85976_P15 and M85976_P16, since it is in the coding region for the corresponding transcript.

Segment cluster M85976_node_39 (SEQ ID NO:1407) according to the present invention can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1303 below describes the starting and ending position of this segment on each transcript.

TABLE 1303

Segment location on transcripts

| Transcript name | Segment starting position | Segment ending position |
|---|---|---|
| M85976_T1 (SEQ ID NO: 1361) | 1416 | 1434 |
| M85976_T2 (SEQ ID NO: 1362) | 1416 | 1434 |
| M85976_T3 (SEQ ID NO: 1363) | 1850 | 1868 |
| M85976_T4 (SEQ ID NO: 1364) | 1416 | 1434 |
| M85976_T5 (SEQ ID NO: 1365) | 1388 | 1406 |
| M85976_T6 (SEQ ID NO: 1366) | 1381 | 1399 |
| M85976_T7 (SEQ ID NO: 1367) | 1850 | 1868 |
| M85976_T10 (SEQ ID NO: 1368) | 1416 | 1434 |
| M85976_T11 (SEQ ID NO: 1369) | 1416 | 1434 |
| M85976_T15 (SEQ ID NO: 1370) | 1416 | 1434 |
| M85976_T17 (SEQ ID NO: 1371) | 1416 | 1434 |
| M85976_T18 (SEQ ID NO: 1372) | 1891 | 1909 |
| M85976_T26 (SEQ ID NO: 1373) | 1416 | 1434 |

This segment can be found in both coding and non-coding regions of transcript(s) as follows. The segment can be found in a non-coding region of transcript(s) that are related to the following protein(s): M85976_P3, M85976_P7 and M85976_P16. This segment can also be found in the following protein(s): M85976_P2, M85976_P4, M85976_P5, M85976_P6, M85976_P10, M85976_P11 and M85976_P15, since it is in the coding region for the corresponding transcript.

Segment cluster M85976_node_45 (SEQ ID NO:1408) according to the present invention can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371), M85976_T18 (SEQ ID NO:1372) and M85976_T26 (SEQ ID NO:1373). Table 1304 below describes the starting and ending position of this segment on each transcript.

TABLE 1304

Segment location on transcripts

| Transcript name | Segment starting position | Segment ending position |
|---|---|---|
| M85976_T1 (SEQ ID NO: 1361) | 1805 | 1827 |
| M85976_T2 (SEQ ID NO: 1362) | 1805 | 1827 |
| M85976_T3 (SEQ ID NO: 1363) | 2239 | 2261 |
| M85976_T4 (SEQ ID NO: 1364) | 3665 | 3687 |
| M85976_T5 (SEQ ID NO: 1365) | 1777 | 1799 |
| M85976_T6 (SEQ ID NO: 1366) | 1770 | 1792 |
| M85976_T7 (SEQ ID NO: 1367) | 4099 | 4121 |
| M85976_T10 (SEQ ID NO: 1368) | 1805 | 1827 |
| M85976_T11 (SEQ ID NO: 1369) | 1805 | 1827 |

TABLE 1304-continued

Segment location on transcripts

| Transcript name | Segment starting position | Segment ending position |
| --- | --- | --- |
| M85976_T15 (SEQ ID NO: 1370) | 3665 | 3687 |
| M85976_T17 (SEQ ID NO: 1371) | 1805 | 1827 |
| M85976_T18 (SEQ ID NO: 1372) | 2280 | 2302 |
| M85976_T26 (SEQ ID NO: 1373) | 3665 | 3687 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10, M85976_P11 and M85976_P15, since it is in the coding region for the corresponding transcript.

Segment cluster M85976_node_46 (SEQ ID NO:1409) according to the present invention can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T17 (SEQ ID NO:1371) and M85976_T18 (SEQ ID NO:1372). Table 1305 below describes the starting and ending position of this segment on each transcript.

TABLE 1305

Segment location on transcripts

| Transcript name | Segment starting position | Segment ending position |
| --- | --- | --- |
| M85976_T1 (SEQ ID NO: 1361) | 1828 | 1833 |
| M85976_T2 (SEQ ID NO: 1362) | 1828 | 1833 |
| M85976_T3 (SEQ ID NO: 1363) | 2262 | 2267 |
| M85976_T4 (SEQ ID NO: 1364) | 3688 | 3693 |
| M85976_T5 (SEQ ID NO: 1365) | 1800 | 1805 |
| M85976_T6 (SEQ ID NO: 1366) | 1793 | 1798 |
| M85976_T7 (SEQ ID NO: 1367) | 4122 | 4127 |
| M85976_T10 (SEQ ID NO: 1368) | 1828 | 1833 |
| M85976_T11 (SEQ ID NO: 1369) | 1828 | 1833 |
| M85976_T15 (SEQ ID NO: 1370) | 3688 | 3693 |
| M85976_T17 (SEQ ID NO: 1371) | 1828 | 1833 |
| M85976_T18 (SEQ ID NO: 1372) | 2303 | 2308 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10, M85976_P11 and M85976_P15, since it is in the coding region for the corresponding transcript.

Segment cluster M85976_node_47 (SEQ ID NO:1410) according to the present invention is supported by 73 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370) and M85976_T18 (SEQ ID NO:1372). Table 1306 below describes the starting and ending position of this segment on each transcript.

TABLE 1306

Segment location on transcripts

| Transcript name | Segment starting position | Segment ending position |
| --- | --- | --- |
| M85976_T1 (SEQ ID NO: 1361) | 1834 | 1933 |
| M85976_T2 (SEQ ID NO: 1362) | 1834 | 1933 |
| M85976_T3 (SEQ ID NO: 1363) | 2268 | 2367 |
| M85976_T4 (SEQ ID NO: 1364) | 3694 | 3793 |
| M85976_T5 (SEQ ID NO: 1365) | 1806 | 1905 |
| M85976_T6 (SEQ ID NO: 1366) | 1799 | 1898 |
| M85976_T7 (SEQ ID NO: 1367) | 4128 | 4227 |
| M85976_T10 (SEQ ID NO: 1368) | 1834 | 1933 |
| M85976_T11 (SEQ ID NO: 1369) | 1834 | 1933 |
| M85976_T15 (SEQ ID NO: 1370) | 3694 | 3793 |
| M85976_T18 (SEQ ID NO: 1372) | 2309 | 2408 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10 and M85976_P11, since it is in the coding region for the corresponding transcript.

Segment cluster M85976_node_50 (SEQ ID NO:1411) according to the present invention is supported by 69 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T15 (SEQ ID NO:1370) and M85976_T18 (SEQ ID NO:1372). Table 1307 below describes the starting and ending position of this segment on each transcript.

TABLE 1307

Segment location on transcripts

| Transcript name | Segment starting position | Segment ending position |
| --- | --- | --- |
| M85976_T1 (SEQ ID NO: 1361) | 1934 | 1969 |
| M85976_T2 (SEQ ID NO: 1362) | 1934 | 1969 |
| M85976_T3 (SEQ ID NO: 1363) | 2368 | 2403 |
| M85976_T4 (SEQ ID NO: 1364) | 3794 | 3829 |
| M85976_T5 (SEQ ID NO: 1365) | 1906 | 1941 |
| M85976_T6 (SEQ ID NO: 1366) | 1899 | 1934 |
| M85976_T7 (SEQ ID NO: 1367) | 4228 | 4263 |
| M85976_T10 (SEQ ID NO: 1368) | 1934 | 1969 |
| M85976_T15 (SEQ ID NO: 1370) | 3794 | 3829 |
| M85976_T18 (SEQ ID NO: 1372) | 2409 | 2444 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6 and M85976_P10, since it is in the coding region for the corresponding transcript.

Segment cluster M85976_node_51 (SEQ ID NO:1412) according to the present invention is supported by 88 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370) and M85976_T18 (SEQ ID NO:1372). Table 1308 below describes the starting and ending position of this segment on each transcript.

TABLE 1308

Segment location on transcripts

| Transcript name | Segment starting position | Segment ending position |
|---|---|---|
| M85976_T1 (SEQ ID NO: 1361) | 1970 | 2070 |
| M85976_T2 (SEQ ID NO: 1362) | 1970 | 2070 |
| M85976_T3 (SEQ ID NO: 1363) | 2404 | 2504 |
| M85976_T4 (SEQ ID NO: 1364) | 3830 | 3930 |
| M85976_T5 (SEQ ID NO: 1365) | 1942 | 2042 |
| M85976_T6 (SEQ ID NO: 1366) | 1935 | 2035 |
| M85976_T7 (SEQ ID NO: 1367) | 4264 | 4364 |
| M85976_T10 (SEQ ID NO: 1368) | 1970 | 2070 |
| M85976_T11 (SEQ ID NO: 1369) | 1934 | 2034 |
| M85976_T15 (SEQ ID NO: 1370) | 3830 | 3930 |
| M85976_T18 (SEQ ID NO: 1372) | 2445 | 2545 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10 and M85976_P11, since it is in the coding region for the corresponding transcript.

Segment cluster M85976_node_59 (SEQ ID NO:1413) according to the present invention is supported by 97 libraries. The number of libraries was determined as previously described. This segment can be found in the following transcript(s): M85976_T1 (SEQ ID NO:1361), M85976_T2 (SEQ ID NO:1362), M85976_T3 (SEQ ID NO:1363), M85976_T4 (SEQ ID NO:1364), M85976_T5 (SEQ ID NO:1365), M85976_T6 (SEQ ID NO:1366), M85976_T7 (SEQ ID NO:1367), M85976_T10 (SEQ ID NO:1368), M85976_T11 (SEQ ID NO:1369), M85976_T15 (SEQ ID NO:1370), M85976_T18 (SEQ ID NO:1372), M85976_T33 (SEQ ID NO:1374) and M85976_T34 (SEQ ID NO:1375). Table 1309 below describes the starting and ending position of this segment on each transcript.

TABLE 1309

Segment location on transcripts

| Transcript name | Segment starting position | Segment ending position |
|---|---|---|
| M85976_T1 (SEQ ID NO: 1361) | 2205 | 2261 |
| M85976_T2 (SEQ ID NO: 1362) | 2205 | 2261 |
| M85976_T3 (SEQ ID NO: 1363) | 2639 | 2695 |
| M85976_T4 (SEQ ID NO: 1364) | 4065 | 4121 |
| M85976_T5 (SEQ ID NO: 1365) | 2177 | 2233 |
| M85976_T6 (SEQ ID NO: 1366) | 2170 | 2226 |
| M85976_T7 (SEQ ID NO: 1367) | 4499 | 4555 |
| M85976_T10 (SEQ ID NO: 1368) | 2379 | 2435 |
| M85976_T11 (SEQ ID NO: 1369) | 2169 | 2225 |
| M85976_T15 (SEQ ID NO: 1370) | 4239 | 4295 |
| M85976_T18 (SEQ ID NO: 1372) | 2680 | 2736 |
| M85976_T33 (SEQ ID NO: 1374) | 713 | 769 |
| M85976_T34 (SEQ ID NO: 1375) | 713 | 769 |

This segment can be found in both coding and non-coding regions of transcript(s) as follows. The segment can be found in a non-coding region of transcript(s) that are related to the following protein(s): M85976_P4, M85976_P5, M85976_P7 and M85976_P16. This segment can also be found in the following protein(s): M85976_P2, M85976_P3, M85976_P6, M85976_P10, M85976_P11 and M85976_P25, since it is in the coding region for the corresponding transcript.

Description for Cluster N50847

Cluster N50847 features 1 transcript(s) and 20 segment(s) of interest, the names for which are given in Tables 1310 and 1311, respectively, the sequences themselves are given at the end of the application. The selected protein variants are given in Table 1312.

TABLE 1310

Transcripts of interest
Transcript Name

N50847_T5 (SEQ ID NO: 1414)

TABLE 1311

Segments of interest
Segment Name

N50847_node_6 (SEQ ID NO: 1415)
N50847_node_11 (SEQ ID NO: 1416)
N50847_node_12 (SEQ ID NO: 1417)
N50847_node_13 (SEQ ID NO: 1418)
N50847_node_15 (SEQ ID NO: 1419)
N50847_node_24 (SEQ ID NO: 1420)
N50847_node_25 (SEQ ID NO: 1421)
N50847_node_26 (SEQ ID NO: 1422)
N50847_node_7 (SEQ ID NO: 1423)
N50847_node_8 (SEQ ID NO: 1424)
N50847_node_14 (SEQ ID NO: 1425)
N50847_node_16 (SEQ ID NO: 1426)
N50847_node_17 (SEQ ID NO: 1427)
N50847_node_18 (SEQ ID NO: 1428)
N50847_node_19 (SEQ ID NO: 1429)
N50847_node_20 (SEQ ID NO: 1430)
N50847_node_21 (SEQ ID NO: 1431)
N50847_node_22 (SEQ ID NO: 1432)
N50847_node_23 (SEQ ID NO: 1433)
N50847_node_27 (SEQ ID NO: 1434)

TABLE 1312

Proteins of interest

| Protein Name | Corresponding Transcript(s) |
|---|---|
| N50847_P3 | N50847_T5 (SEQ ID NO: 1414) |

Cluster N50847 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 33 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 33 and Table 1313. This cluster is overexpressed (at least at a minimum level) in the following pathological conditions: epithelial malignant tumors, a mixture of malignant tumors from different tissues and pancreas carcinoma.

TABLE 1313

Normal tissue distribution

| Name of Tissue | Number |
|---|---|
| Bone | 32 |
| Brain | 66 |
| Colon | 0 |
| epithelial | 10 |
| general | 22 |
| Head and neck | 0 |
| kidney | 0 |
| Liver | 0 |
| Lung | 2 |
| lymph nodes | 37 |
| breast | 0 |
| muscle | 37 |
| ovary | 0 |
| pancreas | 0 |
| prostate | 30 |
| skin | 40 |
| stomach | 0 |
| uterus | 0 |

TABLE 1314

P values and ratios for expression in cancerous tissue

| Name of Tissue | P1 | P2 | SP1 | R3 | SP2 | R4 |
|---|---|---|---|---|---|---|
| bone | 9.2e−01 | 8.7e−01 | 1 | 0.5 | 9.1e−01 | 0.7 |
| brain | 5.8e−01 | 4.6e−01 | 7.3e−01 | 0.8 | 2.1e−02 | 1.2 |
| colon | 3.6e−02 | 1.8e−02 | 3.4e−01 | 2.3 | 1.6e−01 | 2.8 |
| epithelial | 4.1e−02 | 2.1e−04 | 4.8e−02 | 2.0 | 2.3e−11 | 5.1 |
| general | 1.3e−02 | 1.4e−05 | 1.9e−01 | 1.3 | 1.0e−14 | 2.9 |
| head and neck | 2.1e−01 | 3.3e−01 | 1 | 1.2 | 1 | 1.1 |
| kidney | 1 | 5.1e−01 | 1 | 1.0 | 2.4e−01 | 2.7 |
| liver | 1 | 4.5e−01 | 1 | 1.0 | 4.8e−01 | 1.9 |
| lung | 7.4e−01 | 3.9e−01 | 4.1e−01 | 2.0 | 5.5e−02 | 3.4 |
| lymph nodes | 8.5e−01 | 3.1e−01 | 1 | 0.3 | 3.4e−02 | 2.1 |
| breast | 3.4e−01 | 6.3e−02 | 4.7e−01 | 1.9 | 9.5e−02 | 2.9 |
| muscle | 9.2e−01 | 4.8e−01 | 1 | 0.3 | 7.7e−01 | 0.9 |
| ovary | 1 | 6.5e−01 | 1 | 1.0 | 2.6e−01 | 1.6 |
| pancreas | 9.5e−02 | 6.9e−02 | 7.6e−02 | 5.1 | 3.9e−07 | 5.5 |
| prostate | 9.0e−01 | 8.9e−01 | 7.5e−01 | 0.8 | 5.3e−01 | 1.0 |
| skin | 6.0e−01 | 1.7e−01 | 1.5e−01 | 3.3 | 2.1e−02 | 2.1 |
| stomach | 1 | 3.0e−01 | 1 | 1.0 | 3.4e−02 | 3.8 |
| uterus | 2.1e−01 | 1.6e−01 | 2.9e−01 | 2.5 | 4.1e−01 | 2.1 |

As noted above, cluster N50847 features 20 segment(s), which were listed in Table 1311 above and for which the sequence(s) are given at the end of the application. These segment(s) are portions of nucleic acid sequence(s) which are described herein separately because they are of particular interest. A description of each segment according to the present invention is now provided.

Segment cluster N50847_node_6 (SEQ ID NO:1415) according to the present invention is supported by 6 libraries. The number of libraries was determined as previously described. This segment can be found in the following transcript(s): N50847_T5 (SEQ ID NO:1414). Table 1315 below describes the starting and ending position of this segment on each transcript.

TABLE 1315

Segment location on transcripts

| Transcript name | Segment starting position | Segment ending position |
|---|---|---|
| N50847_T5 (SEQ ID NO: 1414) | 1 | 647 |

This segment can be found in a non-coding region of transcript(s) that are related to the following protein(s): N50847_P3.

Segment cluster N50847_node_11 (SEQ ID NO:1416) according to the present invention is supported by 39 libraries. The number of libraries was determined as previously described. This segment can be found in the following transcript(s): N50847_T5 (SEQ ID NO:1414). Table 1316 below describes the starting and ending position of this segment on each transcript.

TABLE 1316

Segment location on transcripts

| Transcript name | Segment starting position | Segment ending position |
|---|---|---|
| N50847_T5 (SEQ ID NO: 1414) | 870 | 1039 |

This segment can be found in the following protein(s): N50847_P3.

Segment cluster N50847_node_12 (SEQ ID NO:1417) according to the present invention is supported by 46 libraries. The number of libraries was determined as previously described. This segment can be found in the following transcript(s): N50847_T5 (SEQ ID NO:1414). Table 1317 below describes the starting and ending position of this segment on each transcript.

TABLE 1317

Segment location on transcripts

| Transcript name | Segment starting position | Segment ending position |
|---|---|---|
| N50847_T5 (SEQ ID NO: 1414) | 1040 | 1240 |

This segment can be found in the following protein(s): N50847_P3.

Segment cluster N50847_node_13 (SEQ ID NO:1418) according to the present invention is supported by 47 libraries. The number of libraries was determined as previously described. This segment can be found in the following transcript(s): N50847_T5 (SEQ ID NO:1414). Table 1318 below describes the starting and ending position of this segment on each transcript.

TABLE 1318

Segment location on transcripts

| Transcript name | Segment starting position | Segment ending position |
|---|---|---|
| N50847_T5 (SEQ ID NO: 1414) | 1241 | 1371 |

This segment can be found in the following protein(s): N50847_P3.

Segment cluster N50847_node_15 (SEQ ID NO:1419) according to the present invention is supported by 55 libraries. The number of libraries was determined as previously described. This segment can be found in the following transcript(s): N50847_T5 (SEQ ID NO:1414). Table 1319 below describes the starting and ending position of this segment on each transcript.

TABLE 1319

Segment location on transcripts

| Transcript name | Segment starting position | Segment ending position |
|---|---|---|
| N50847_T5 (SEQ ID NO: 1414) | 1459 | 1596 |

This segment can be found in a non-coding region of transcript(s) that are related to the following protein(s): N50847_P3.

Segment cluster N50847_node_24 (SEQ ID NO:1420) according to the present invention is supported by 104 libraries. The number of libraries was determined as previously described. This segment can be found in the following transcript(s): N50847_T5 (SEQ ID NO:1414). Table 1320 below describes the starting and ending position of this segment on each transcript.

TABLE 1320

Segment location on transcripts

| Transcript name | Segment starting position | Segment ending position |
|---|---|---|
| N50847_T5 (SEQ ID NO: 1414) | 1919 | 2323 |

This segment can be found in a non-coding region of transcript(s) that are related to the following protein(s): N50847_P3.

Segment cluster N50847_node_25 (SEQ ID NO:1421) according to the present invention is supported by 96 libraries. The number of libraries was determined as previously described. This segment can be found in the following transcript(s): N50847_T5 (SEQ ID NO:1414). Table 1321 below describes the starting and ending position of this segment on each transcript.

TABLE 1321

Segment location on transcripts

| Transcript name | Segment starting position | Segment ending position |
|---|---|---|
| N50847_T5 (SEQ ID NO: 1414) | 2324 | 2528 |

This segment can be found in a non-coding region of transcript(s) that are related to the following protein(s): N50847_P3.

Segment cluster N50847_node_26 (SEQ ID NO:1422) according to the present invention is supported by 90 libraries. The number of libraries was determined as previously described. This segment can be found in the following transcript(s): N50847_T5 (SEQ ID NO:1414). Table 1322 below describes the starting and ending position of this segment on each transcript.

TABLE 1322

Segment location on transcripts

| Transcript name | Segment starting position | Segment ending position |
|---|---|---|
| N50847_T5 (SEQ ID NO: 1414) | 2529 | 2772 |

This segment can be found in a non-coding region of transcript(s) that are related to the following protein(s): N50847_P3.

According to an optional embodiment of the present invention, short segments related to the above cluster are also provided. These segments are up to about 120 bp in length, and so are included in a separate description.

Segment cluster N50847_node_7 (SEQ ID NO:1423) according to the present invention is supported by 36 libraries. The number of libraries was determined as previously described. This segment can be found in the following transcript(s): N50847_T5 (SEQ ID NO:1414). Table 1323 below describes the starting and ending position of this segment on each transcript.

TABLE 1323

Segment location on transcripts

| Transcript name | Segment starting position | Segment ending position |
|---|---|---|
| N50847_T5 (SEQ ID NO: 1414) | 648 | 764 |

This segment can be found in the following protein(s): N50847_P3.

Segment cluster N50847_node_8 (SEQ ID NO:1424) according to the present invention is supported by 39 libraries. The number of libraries was determined as previously described. This segment can be found in the following transcript(s): N50847_T5 (SEQ ID NO:1414). Table 1324 below describes the starting and ending position of this segment on each transcript.

TABLE 1324

| | Segment location on transcripts | |
|---|---|---|
| Transcript name | Segment starting position | Segment ending position |
| N50847_T5 (SEQ ID NO: 1414) | 765 | 869 |

This segment can be found in the following protein(s): N50847_P3.

Segment cluster N50847_node_14 (SEQ ID NO:1425) according to the present invention is supported by 47 libraries. The number of libraries was determined as previously described. This segment can be found in the following transcript(s): N50847_T5 (SEQ ID NO:1414). Table 1325 below describes the starting and ending position of this segment on each transcript.

TABLE 1325

| | Segment location on transcripts | |
|---|---|---|
| Transcript name | Segment starting position | Segment ending position |
| N50847_T5 (SEQ ID NO: 1414) | 1372 | 1458 |

This segment can be found in a non-coding region of transcript(s) that are related to the following protein(s): N50847_P3.

Segment cluster N50847_node_16 (SEQ ID NO:1426) according to the present invention can be found in the following transcript(s): N50847_T5 (SEQ ID NO:1414). Table 1326 below describes the starting and ending position of this segment on each transcript.

TABLE 1326

| | Segment location on transcripts | |
|---|---|---|
| Transcript name | Segment starting position | Segment ending position |
| N50847_T5 (SEQ ID NO: 1414) | 1597 | 1600 |

This segment can be found in a non-coding region of transcript(s) that are related to the following protein(s): N50847_P3.

Segment cluster N50847_node_17 (SEQ ID NO:1427) according to the present invention is supported by 54 libraries. The number of libraries was determined as previously described. This segment can be found in the following transcript(s): N50847_T5 (SEQ ID NO:1414). Table 1327 below describes the starting and ending position of this segment on each transcript.

TABLE 1327

| | Segment location on transcripts | |
|---|---|---|
| Transcript name | Segment starting position | Segment ending position |
| N50847_T5 (SEQ ID NO: 1414) | 1601 | 1719 |

This segment can be found in a non-coding region of transcript(s) that are related to the following protein(s): N50847_P3.

Segment cluster N50847_node_18 (SEQ ID NO:1428) according to the present invention can be found in the following transcript(s): N50847_T5 (SEQ ID NO:1414). Table 1328 below describes the starting and ending position of this segment on each transcript.

TABLE 1328

| | Segment location on transcripts | |
|---|---|---|
| Transcript name | Segment starting position | Segment ending position |
| N50847_T5 (SEQ ID NO: 1414) | 1720 | 1728 |

This segment can be found in a non-coding region of transcript(s) that are related to the following protein(s): N50847_P3.

Segment cluster N50847_node_19 (SEQ ID NO:1429) according to the present invention is supported by 51 libraries. The number of libraries was determined as previously described. This segment can be found in the following transcript(s): N50847_T5 (SEQ ID NO:1414). Table 1329 below describes the starting and ending position of this segment on each transcript.

TABLE 1329

| | Segment location on transcripts | |
|---|---|---|
| Transcript name | Segment starting position | Segment ending position |
| N50847_T5 (SEQ ID NO: 1414) | 1729 | 1768 |

This segment can be found in a non-coding region of transcript(s) that are related to the following protein(s): N50847_P3.

Segment cluster N50847_node_20 (SEQ ID NO:1430) according to the present invention can be found in the following transcript(s): N50847_T5 (SEQ ID NO:1414). Table 1330 below describes the starting and ending position of this segment on each transcript.

TABLE 1330

| | Segment location on transcripts | |
|---|---|---|
| Transcript name | Segment starting position | Segment ending position |
| N50847_T5 (SEQ ID NO: 1414) | 1769 | 1788 |

This segment can be found in a non-coding region of transcript(s) that are related to the following protein(s): N50847_P3.

Segment cluster N50847_node_21 (SEQ ID NO:1431) according to the present invention is supported by 59 libraries. The number of libraries was determined as previously described. This segment can be found in the following transcript(s): N50847_T5 (SEQ ID NO:1414). Table 1331 below describes the starting and ending position of this segment on each transcript.

TABLE 1331

Segment location on transcripts

| Transcript name | Segment starting position | Segment ending position |
|---|---|---|
| N50847_T5 (SEQ ID NO: 1414) | 1789 | 1868 |

This segment can be found in a non-coding region of transcript(s) that are related to the following protein(s): N50847_P3.

Segment cluster N50847_node_22 (SEQ ID NO:1432) according to the present invention can be found in the following transcript(s): N50847_T5 (SEQ ID NO:1414). Table 1332 below describes the starting and ending position of this segment on each transcript.

TABLE 1332

Segment location on transcripts

| Transcript name | Segment starting position | Segment ending position |
|---|---|---|
| N50847_T5 (SEQ ID NO: 1414) | 1869 | 1880 |

This segment can be found in a non-coding region of transcript(s) that are related to the following protein(s): N50847_P3.

Segment cluster N50847_node_23 (SEQ ID NO:1433) according to the present invention is supported by 59 libraries. The number of libraries was determined as previously described. This segment can be found in the following transcript(s): N50847_T5 (SEQ ID NO:1414). Table 1333 below describes the starting and ending position of this segment on each transcript.

TABLE 1333

Segment location on transcripts

| Transcript name | Segment starting position | Segment ending position |
|---|---|---|
| N50847_T5 (SEQ ID NO: 1414) | 1881 | 1918 |

This segment can be found in a non-coding region of transcript(s) that are related to the following protein(s): N50847_P3.

Segment cluster N50847_node_27 (SEQ ID NO:1434) according to the present invention is supported by 67 libraries. The number of libraries was determined as previously described. This segment can be found in the following transcript(s): N50847_T5 (SEQ ID NO:1414). Table 1334 below describes the starting and ending position of this segment on each transcript.

TABLE 1334

Segment location on transcripts

| Transcript name | Segment starting position | Segment ending position |
|---|---|---|
| N50847_T5 (SEQ ID NO: 1414) | 2773 | 2839 |

This segment can be found in a non-coding region of transcript(s) that are related to the following protein(s): N50847_P3.

Description for Cluster N69694

Cluster N69694 features 5 transcript(s) and 11 segment(s) of interest, the names for which are given in Tables 1335 and 1336, respectively, the sequences themselves are given at the end of the application. The selected protein variants are given in Table 1337.

TABLE 1335

Transcripts of interest
Transcript Name

N69694_T1 (SEQ ID NO: 1435)
N69694_T2 (SEQ ID NO: 1436)
N69694_T8 (SEQ ID NO: 1437)
N69694_T10 (SEQ ID NO: 1438)
N69694_T11 (SEQ ID NO: 1439)

TABLE 1336

Segments of interest
Segment Name

N69694_node_4 (SEQ ID NO: 1440)
N69694_node_21 (SEQ ID NO: 1441)
N69694_node_0 (SEQ ID NO: 1442)
N69694_node_5 (SEQ ID NO: 1443)
N69694_node_7 (SEQ ID NO: 1444)
N69694_node_9 (SEQ ID NO: 1445)
N69694_node_10 (SEQ ID NO: 1446)
N69694_node_11 (SEQ ID NO: 1447)
N69694_node_15 (SEQ ID NO: 1448)
N69694_node_16 (SEQ ID NO: 1449)
N69694_node_18 (SEQ ID NO: 1450)

TABLE 1337

Proteins of interest

| Protein Name | Corresponding Transcript(s) |
|---|---|
| N69694_P2 | N69694_T1 (SEQ ID NO: 1435) |
| N69694_P3 | N69694_T2 (SEQ ID NO: 1436) |
| N69694_P8 | N69694_T8 (SEQ ID NO: 1437) |
| N69694_P9 | N69694_T10 (SEQ ID NO: 1438) |
| N69694_P10 | N69694_T11 (SEQ ID NO: 1439) |

Cluster N69694 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 34 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 34 and Table 1338. This cluster is overexpressed (at least at a minimum level) in the following pathological conditions: epithelial malignant tumors and a mixture of malignant tumors from different tissues.

TABLE 1338

Normal tissue distribution

| Name of Tissue | Number |
|---|---|
| Bladder | 0 |
| Bone | 0 |

TABLE 1338-continued

Normal tissue distribution

| Name of Tissue | Number |
|---|---|
| Brain | 2 |
| Colon | 31 |
| Epithelial | 5 |
| General | 7 |
| Kidney | 0 |
| Liver | 0 |
| Lung | 12 |
| lymph nodes | 82 |
| Breast | 0 |
| bone marrow | 0 |
| Muscle | 0 |
| Ovary | 0 |
| Pancreas | 0 |
| Prostate | 20 |
| Skin | 2 |
| Stomach | 0 |
| T cells | 0 |
| Uterus | 0 |

TABLE 1339

P values and ratios for expression in cancerous tissue

| Name of Tissue | P1 | P2 | SP1 | R3 | SP2 | R4 |
|---|---|---|---|---|---|---|
| Bladder | 1 | 6.0e−01 | 1 | 1.0 | 4.6e−01 | 1.9 |
| Bone | 3.3e−01 | 4.3e−01 | 4.0e−01 | 2.5 | 7.0e−01 | 1.7 |
| Brain | 2.1e−01 | 5.8e−02 | 1 | 1.6 | 2.5e−01 | 3.2 |
| Colon | 2.0e−01 | 5.9e−02 | 7.8e−01 | 1.1 | 4.2e−01 | 1.5 |
| Epithelial | 4.0e−02 | 5.5e−05 | 2.2e−01 | 1.8 | 6.8e−09 | 5.7 |
| General | 1.4e−03 | 2.0e−09 | 2.9e−02 | 2.0 | 1.9e−20 | 5.6 |
| Kidney | 4.1e−01 | 2.4e−01 | 3.4e−01 | 2.4 | 3.4e−01 | 2.4 |
| Liver | 1 | 3.0e−01 | 1 | 1.0 | 4.8e−01 | 1.9 |
| Lung | 5.1e−01 | 3.9e−01 | 3.7e−01 | 1.8 | 2.6e−02 | 2.1 |
| lymph nodes | 5.4e−01 | 6.4e−01 | 3.2e−01 | 1.6 | 2.9e−04 | 1.3 |
| Breast | 5.9e−01 | 2.8e−01 | 6.9e−01 | 1.5 | 3.1e−01 | 1.9 |
| bone marrow | 1 | 6.7e−01 | 1 | 1.0 | 2.8e−01 | 2.8 |
| Muscle | 1 | 2.9e−01 | 1 | 1.0 | 5.9e−02 | 4.1 |
| Ovary | 6.2e−01 | 4.2e−01 | 1 | 1.1 | 4.5e−01 | 1.7 |
| Pancreas | 1 | 4.4e−01 | 1 | 1.0 | 5.3e−01 | 1.9 |
| Prostate | 9.7e−01 | 9.3e−01 | 1 | 0.5 | 5.3e−01 | 0.8 |
| Skin | 9.2e−01 | 6.8e−01 | 1 | 0.8 | 1.4e−04 | 1.8 |
| Stomach | 3.6e−01 | 4.7e−01 | 1 | 1.0 | 6.4e−01 | 1.5 |
| T cells | 1 | 6.7e−01 | 1 | 1.0 | 7.2e−01 | 1.4 |
| Uterus | 1 | 1.4e−01 | 1 | 1.0 | 1.7e−01 | 2.5 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1340.

TABLE 1340

Oligonucleotides related to this cluster

| Oligonucleotide name | Overexpressed in cancers | Chip reference |
|---|---|---|
| N69694_0_0_28034 | lung malignant tumors | LUN |
| N69694_0_0_28038 | lung malignant tumors | LUN |

As noted above, cluster N69694 features 11 segment(s), which were listed in Table 1336 above and for which the sequence(s) are given at the end of the application. These segment(s) are portions of nucleic acid sequence(s) which are described herein separately because they are of particular interest. A description of each segment according to the present invention is now provided.

Segment cluster N69694_node_4 (SEQ ID NO:1440) according to the present invention is supported by 10 libraries. The number of libraries was determined as previously described. This segment can be found in the following transcript(s): N69694_T1 (SEQ ID NO:1435), N69694_T8 (SEQ ID NO:1437) and N69694_T10 (SEQ ID NO:1438). Table 1341 below describes the starting and ending position of this segment on each transcript.

TABLE 1341

Segment location on transcripts

| Transcript name | Segment starting position | Segment ending position |
|---|---|---|
| N69694_T1 (SEQ ID NO: 1435) | 1 | 298 |
| N69694_T8 (SEQ ID NO: 1437) | 1 | 298 |
| N69694_T10 (SEQ ID NO: 1438) | 1 | 298 |

This segment can be found in a non-coding region of transcript(s) that are related to the following protein(s): N69694_P2, N69694_P8 and N69694_P9.

Segment cluster N69694_node_21 (SEQ ID NO:1441) according to the present invention is supported by 92 libraries. The number of libraries was determined as previously described. This segment can be found in the following transcript(s): N69694_T1 (SEQ ID NO:1435), N69694_T2 (SEQ ID NO:1436), N69694_T8 (SEQ ID NO:1437), N69694_T10 (SEQ ID NO:1438) and N69694_T11 (SEQ ID NO:1439). Table 1342 below describes the starting and ending position of this segment on each transcript.

TABLE 1342

Segment location on transcripts

| Transcript name | Segment starting position | Segment ending position |
|---|---|---|
| N69694_T1 (SEQ ID NO: 1435) | 644 | 1351 |
| N69694_T2 (SEQ ID NO: 1436) | 450 | 1157 |
| N69694_T8 (SEQ ID NO: 1437) | 729 | 1436 |
| N69694_T10 (SEQ ID NO: 1438) | 552 | 1259 |
| N69694_T11 (SEQ ID NO: 1439) | 85 | 792 |

This segment can be found in both coding and non-coding regions of transcript(s) as follows. The segment can be found in a non-coding region of transcript(s) that are related to the following protein(s): N69694_P8. This segment can also be found in the following protein(s): N69694_P2, N69694_P3, N69694_P9 and N69694_P10, since it is in the coding region for the corresponding transcript.

According to an optional embodiment of the present invention, short segments related to the above cluster are also provided. These segments are up to about 120 bp in length, and so are included in a separate description.

Segment cluster N69694_node_0 (SEQ ID NO:1442) according to the present invention is supported by 1 libraries. The number of libraries was determined as previously described. This segment can be found in the following transcript(s): N69694_T2 (SEQ ID NO:1436). Table 1343 below describes the starting and ending position of this segment on each transcript.

TABLE 1343

| | Segment location on transcripts | |
|---|---|---|
| Transcript name | Segment starting position | Segment ending position |
| N69694_T2 (SEQ ID NO: 1436) | 1 | 104 |

This segment can be found in the following protein(s): N69694_P3.

Segment cluster N69694_node_5 (SEQ ID NO:1443) according to the present invention is supported by 78 libraries. The number of libraries was determined as previously described. This segment can be found in the following transcript(s): N69694_T1 (SEQ ID NO:1435), N69694_T2 (SEQ ID NO:1436), N69694_T8 (SEQ ID NO:1437) and N69694_T10 (SEQ ID NO:1438). Table 1344 below describes the starting and ending position of this segment on each transcript.

TABLE 1344

| | Segment location on transcripts | |
|---|---|---|
| Transcript name | Segment starting position | Segment ending position |
| N69694_T1 (SEQ ID NO: 1435) | 299 | 378 |
| N69694_T2 (SEQ ID NO: 1436) | 105 | 184 |
| N69694_T8 (SEQ ID NO: 1437) | 299 | 378 |
| N69694_T10 (SEQ ID NO: 1438) | 299 | 378 |

This segment can be found in the following protein(s): N69694_P2, N69694_P3, N69694_P8 and N69694_P9.

Segment cluster N69694_node_7 (SEQ ID NO:1444) according to the present invention is supported by 77 libraries. The number of libraries was determined as previously described. This segment can be found in the following transcript(s): N69694_T1 (SEQ ID NO:1435), N69694_T2 (SEQ ID NO:1436), N69694_T8 (SEQ ID NO:1437) and N69694_T10 (SEQ ID NO:1438). Table 1345 below describes the starting and ending position of this segment on each transcript.

TABLE 1345

| | Segment location on transcripts | |
|---|---|---|
| Transcript name | Segment starting position | Segment ending position |
| N69694_T1 (SEQ ID NO: 1435) | 379 | 471 |
| N69694_T2 (SEQ ID NO: 1436) | 185 | 277 |
| N69694_T8 (SEQ ID NO: 1437) | 379 | 471 |
| N69694_T10 (SEQ ID NO: 1438) | 379 | 471 |

This segment can be found in the following protein(s): N69694_P2, N69694_P3, N69694_P8 and N69694_P9.

Segment cluster N69694_node_9 (SEQ ID NO:1445) according to the present invention is supported by 1 libraries. The number of libraries was determined as previously described. This segment can be found in the following transcript(s): N69694_T8 (SEQ ID NO:1437). Table 1346 below describes the starting and ending position of this segment on each transcript.

TABLE 1346

| | Segment location on transcripts | |
|---|---|---|
| Transcript name | Segment starting position | Segment ending position |
| N69694_T8 (SEQ ID NO: 1437) | 472 | 548 |

This segment can be found in the following protein(s): N69694_P8.

Segment cluster N69694_node_10 (SEQ ID NO:1446) according to the present invention can be found in the following transcript(s): N69694_T8 (SEQ ID NO:1437). Table 1347 below describes the starting and ending position of this segment on each transcript.

TABLE 1347

| | Segment location on transcripts | |
|---|---|---|
| Transcript name | Segment starting position | Segment ending position |
| N69694_T8 (SEQ ID NO: 1437) | 549 | 556 |

This segment can be found in the following protein(s): N69694_P8.

Segment cluster N69694_node_11 (SEQ ID NO:1447) according to the present invention is supported by 64 libraries. The number of libraries was determined as previously described. This segment can be found in the following transcript(s): N69694_T1 (SEQ ID NO:1435), N69694_T2 (SEQ ID NO:1436), N69694_T8 (SEQ ID NO:1437) and N69694_T10 (SEQ ID NO:1438). Table 1348 below describes the starting and ending position of this segment on each transcript.

TABLE 1348

| | Segment location on transcripts | |
|---|---|---|
| Transcript name | Segment starting position | Segment ending position |
| N69694_T1 (SEQ ID NO: 1435) | 472 | 551 |
| N69694_T2 (SEQ ID NO: 1436) | 278 | 357 |
| N69694_T8 (SEQ ID NO: 1437) | 557 | 636 |
| N69694_T10 (SEQ ID NO: 1438) | 472 | 551 |

This segment can be found in the following protein(s): N69694_P2, N69694_P3, N69694_P8 and N69694_P9.

Segment cluster N69694_node_15 (SEQ ID NO:1448) according to the present invention can be found in the following transcript(s): N69694_T1 (SEQ ID NO:1435), N69694_T2 (SEQ ID NO:1436) and N69694_T8 (SEQ ID NO:1437). Table 1349 below describes the starting and ending position of this segment on each transcript.

TABLE 1349

| | Segment location on transcripts | |
|---|---|---|
| Transcript name | Segment starting position | Segment ending position |
| N69694_T1 (SEQ ID NO: 1435) | 552 | 568 |
| N69694_T2 (SEQ ID NO: 1436) | 358 | 374 |
| N69694_T8 (SEQ ID NO: 1437) | 637 | 653 |

This segment can be found in the following protein(s): N69694_P2, N69694_P3 and N69694_P8.

Segment cluster N69694_node_16 (SEQ ID NO:1449) according to the present invention is supported by 59 libraries. The number of libraries was determined as previously described. This segment can be found in the following transcript(s): N69694_T1 (SEQ ID NO:1435), N69694_T2 (SEQ ID NO:1436) and N69694_T8 (SEQ ID NO:1437). Table 1350 below describes the starting and ending position of this segment on each transcript.

TABLE 1350

| Transcript name | Segment location on transcripts | |
|---|---|---|
| | Segment starting position | Segment ending position |
| N69694_T1 (SEQ ID NO: 1435) | 569 | 643 |
| N69694_T2 (SEQ ID NO: 1436) | 375 | 449 |
| N69694_T8 (SEQ ID NO: 1437) | 654 | 728 |

This segment can be found in the following protein(s): N69694_P2, N69694_P3 and N69694_P8.

Segment cluster N69694_node_18 (SEQ ID NO:1450) according to the present invention is supported by 5 libraries. The number of libraries was determined as previously described. This segment can be found in the following transcript(s): N69694_T11 (SEQ ID NO:1439). Table 1351 below describes the starting and ending position of this segment on each transcript.

TABLE 1351

| Transcript name | Segment location on transcripts | |
|---|---|---|
| | Segment starting position | Segment ending position |
| N69694_T11 (SEQ ID NO: 1439) | 1 | 84 |

This segment can be found in the following protein(s): N69694_P10.

Description for Cluster R01445

Cluster R01445 features 14 transcript(s) and 28 segment(s) of interest, the names for which are given in Tables 1352 and 1353, respectively, the sequences themselves are given at the end of the application. The selected protein variants are given in Table 1354.

TABLE 1352

Transcripts of interest
Transcript Name

R01445_T1 (SEQ ID NO: 1451)
R01445_T2 (SEQ ID NO: 1452)
R01445_T3 (SEQ ID NO: 1453)
R01445_T4 (SEQ ID NO: 1454)
R01445_T5 (SEQ ID NO: 1455)
R01445_T6 (SEQ ID NO: 1456)
R01445_T7 (SEQ ID NO: 1457)
R01445_T8 (SEQ ID NO: 1458)
R01445_T10 (SEQ ID NO: 1459)
R01445_T11 (SEQ ID NO: 1460)
R01445_T12 (SEQ ID NO: 1461)
R01445_T14 (SEQ ID NO: 1462)
R01445_T15 (SEQ ID NO: 1463)
R01445_T17 (SEQ ID NO: 1464)

TABLE 1353

Segments of interest
Segment Name

R01445_node_0 (SEQ ID NO: 1465)
R01445_node_2 (SEQ ID NO: 1466)
R01445_node_8 (SEQ ID NO: 1467)
R01445_node_16 (SEQ ID NO: 1468)
R01445_node_19 (SEQ ID NO: 1469)
R01445_node_21 (SEQ ID NO: 1470)
R01445_node_24 (SEQ ID NO: 1471)
R01445_node_25 (SEQ ID NO: 1472)
R01445_node_26 (SEQ ID NO: 1473)
R01445_node_29 (SEQ ID NO: 1474)
R01445_node_33 (SEQ ID NO: 1475)
R01445_node_35 (SEQ ID NO: 1476)
R01445_node_36 (SEQ ID NO: 1477)
R01445_node_38 (SEQ ID NO: 1478)
R01445_node_39 (SEQ ID NO: 1479)
R01445_node_4 (SEQ ID NO: 1480)
R01445_node_5 (SEQ ID NO: 1481)
R01445_node_7 (SEQ ID NO: 1482)
R01445_node_10 (SEQ ID NO: 1483)
R01445_node_12 (SEQ ID NO: 1484)
R01445_node_13 (SEQ ID NO: 1485)
R01445_node_14 (SEQ ID NO: 1486)
R01445_node_18 (SEQ ID NO: 1487)
R01445_node_23 (SEQ ID NO: 1488)
R01445_node_28 (SEQ ID NO: 1489)
R01445_node_31 (SEQ ID NO: 1490)
R01445_node_32 (SEQ ID NO: 1491)
R01445_node_37 (SEQ ID NO: 1492)

TABLE 1354

| Proteins of interest | |
|---|---|
| Protein Name | Corresponding Transcript(s) |
| R01445_P2 | R01445_T2 (SEQ ID NO: 1452); R01445_T8 (SEQ ID NO: 1458); R01445_T10 (SEQ ID NO: 1459); R01445_T11 (SEQ ID NO: 1460) |
| R01445_P3 | R01445_T3 (SEQ ID NO: 1453) |
| R01445_P4 | R01445_T4 (SEQ ID NO: 1454); R01445_T5 (SEQ ID NO: 1455); R01445_T6 (SEQ ID NO: 1456); R01445_T7 (SEQ ID NO: 1457) |
| R01445_P5 | R01445_T12 (SEQ ID NO: 1461) |
| R01445_P7 | R01445_T14 (SEQ ID NO: 1462) |
| R01445_P8 | R01445_T1 (SEQ ID NO: 1451) |

Cluster R01445 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 35 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 35 and Table 1355. This cluster is overexpressed (at least at a minimum level) in the following pathological conditions: lung malignant tumors.

TABLE 1355

| Normal tissue distribution | |
|---|---|
| Name of Tissue | Number |
| Adrenal | 80 |
| Bladder | 0 |

TABLE 1355-continued

Normal tissue distribution

| Name of Tissue | Number |
|---|---|
| Bone | 0 |
| Brain | 26 |
| Colon | 0 |
| Epithelial | 15 |
| General | 19 |
| Lung | 0 |
| lymph nodes | 65 |
| Breast | 57 |
| Ovary | 0 |
| Prostate | 4 |
| Skin | 26 |
| Thyroid | 0 |
| Uterus | 22 |

TABLE 1356

P values and ratios for expression in cancerous tissue

| Name of Tissue | P1 | P2 | SP1 | R3 | SP2 | R4 |
|---|---|---|---|---|---|---|
| adrenal | 7.4e−01 | 7.8e−01 | 8.4e−01 | 0.7 | 9.0e−01 | 0.6 |
| bladder | 1 | 6.0e−01 | 1 | 1.0 | 6.8e−01 | 1.5 |
| Bone | 1 | 1.7e−01 | 1 | 1.0 | 4.9e−01 | 2.0 |
| Brain | 5.4e−01 | 4.3e−01 | 7.3e−01 | 0.9 | 5.1e−01 | 1.2 |
| Colon | 7.0e−01 | 6.2e−01 | 1 | 1.2 | 7.7e−01 | 1.4 |
| epithelial | 7.6e−01 | 5.3e−01 | 1.8e−01 | 1.1 | 3.5e−02 | 1.6 |
| general | 5.3e−01 | 1.5e−01 | 2.9e−01 | 1.0 | 2.7e−02 | 1.4 |
| Lung | 5.0e−03 | 1.2e−02 | 2.8e−02 | 7.6 | 5.5e−02 | 5.1 |
| Lymph nodes | 2.9e−01 | 5.2e−01 | 4.4e−01 | 1.7 | 2.4e−01 | 1.2 |
| Breast | 8.6e−01 | 8.9e−01 | 1 | 0.4 | 9.2e−01 | 0.6 |
| Ovary | 6.2e−01 | 4.2e−01 | 6.8e−01 | 1.5 | 5.9e−01 | 1.6 |
| prostate | 9.7e−01 | 8.6e−01 | 1 | 0.8 | 4.2e−01 | 1.7 |
| Skin | 8.5e−01 | 5.8e−01 | 1 | 0.3 | 4.1e−01 | 0.9 |
| Thyroid | 2.9e−01 | 2.9e−01 | 6.7e−01 | 1.5 | 6.7e−01 | 1.5 |
| Uterus | 4.4e−01 | 3.8e−01 | 7.4e−01 | 1.0 | 3.8e−01 | 1.4 |

As noted above, cluster R01445 features 28 segment(s), which were listed in Table 1353 above and for which the sequence(s) are given at the end of the application. These segment(s) are portions of nucleic acid sequence(s) which are described herein separately because they are of particular interest. A description of each segment according to the present invention is now provided.

Segment cluster R01445_node_0 (SEQ ID NO:1465) according to the present invention is supported by 55 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T6 (SEQ ID NO:1456), R01445_T7 (SEQ ID NO:1457), R01445_T8 (SEQ ID NO:1458), R01445_T10 (SEQ ID NO:1459), R01445_T11 (SEQ ID NO:1460) and R01445_T14 (SEQ ID NO:1462). Table 1357 below describes the starting and ending position of this segment on each transcript.

TABLE 1357

Segment location on transcripts

| Transcript name | Segment starting position | Segment ending position |
|---|---|---|
| R01445_T1 (SEQ ID NO: 1451) | 1 | 143 |
| R01445_T2 (SEQ ID NO: 1452) | 1 | 143 |
| R01445_T3 (SEQ ID NO: 1453) | 1 | 143 |
| R01445_T4 (SEQ ID NO: 1454) | 1 | 143 |
| R01445_T6 (SEQ ID NO: 1456) | 1 | 143 |
| R01445_T7 (SEQ ID NO: 1457) | 1 | 143 |
| R01445_T8 (SEQ ID NO: 1458) | 1 | 143 |
| R01445_T10 (SEQ ID NO: 1459) | 1 | 143 |
| R01445_T11 (SEQ ID NO: 1460) | 1 | 143 |
| R01445_T14 (SEQ ID NO: 1462) | 1 | 143 |

This segment can be found in both coding and non-coding regions of transcript(s) as follows. The segment can be found in a non-coding region of transcript(s) that are related to the following protein(s): R01445_P3 and R01445_P4. This segment can also be found in the following protein(s): R01445_P8, R01445_P2 and R01445_P7, since it is in the coding region for the corresponding transcript.

Segment cluster R01445_node_2 (SEQ ID NO:1466) according to the present invention is supported by 1 libraries. The number of libraries was determined as previously described. This segment can be found in the following transcript(s): R01445_T5 (SEQ ID NO:1455). Table 1358 below describes the starting and ending position of this segment on each transcript.

TABLE 1358

Segment location on transcripts

| Transcript name | Segment starting position | Segment ending position |
|---|---|---|
| R01445_T5 (SEQ ID NO: 1455) | 1 | 145 |

This segment can be found in a non-coding region of transcript(s) that are related to the following protein(s): R01445_P4.

Segment cluster R01445_node_8 (SEQ ID NO:1467) according to the present invention is supported by 56 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459), R01445_T11 (SEQ ID NO:1460) and R01445_T14 (SEQ ID NO:1462). Table 1359 below describes the starting and ending position of this segment on each transcript.

TABLE 1359

Segment location on transcripts

| Transcript name | Segment starting position | Segment ending position |
|---|---|---|
| R01445_T1 (SEQ ID NO: 1451) | 144 | 303 |
| R01445_T2 (SEQ ID NO: 1452) | 144 | 303 |
| R01445_T3 (SEQ ID NO: 1453) | 144 | 303 |
| R01445_T4 (SEQ ID NO: 1454) | 168 | 327 |
| R01445_T5 (SEQ ID NO: 1455) | 146 | 305 |
| R01445_T6 (SEQ ID NO: 1456) | 360 | 519 |
| R01445_T7 (SEQ ID NO: 1457) | 250 | 409 |
| R01445_T8 (SEQ ID NO: 1458) | 144 | 303 |

TABLE 1359-continued

Segment location on transcripts

| Transcript name | Segment starting position | Segment ending position |
|---|---|---|
| R01445_T10 (SEQ ID NO: 1459) | 144 | 303 |
| R01445_T11 (SEQ ID NO: 1460) | 144 | 303 |
| R01445_T14 (SEQ ID NO: 1462) | 144 | 303 |

This segment can be found in both coding and non-coding regions of transcript(s) as follows. The segment can be found in a non-coding region of transcript(s) that are related to the following protein(s): R01445_P3 and R01445_P4. This segment can also be found in the following protein(s): R01445_P8, R01445_P2 and R01445_P7, since it is in the coding region for the corresponding transcript.

Segment cluster R01445_node_16 (SEQ ID NO:1468) according to the present invention is supported by 4 libraries. The number of libraries was determined as previously described. This segment can be found in the following transcript(s): R01445_T3 (SEQ ID NO:1453). Table 1360 below describes the starting and ending position of this segment on each transcript.

TABLE 1360

Segment location on transcripts

| Transcript name | Segment starting position | Segment ending position |
|---|---|---|
| R01445_T3 (SEQ ID NO: 1453) | 500 | 638 |

This segment can be found in a non-coding region of transcript(s) that are related to the following protein(s): R01445_P3.

Segment cluster R01445_node_19 (SEQ ID NO:1469) according to the present invention is supported by 58 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T1 (SEQ ID NO:1459), R01445_T11 (SEQ ID NO:1460) and R01445_T12 (SEQ ID NO:1461). Table 1361 below describes the starting and ending position of this segment on each transcript.

TABLE 1361

Segment location on transcripts

| Transcript name | Segment starting position | Segment ending position |
|---|---|---|
| R01445_T1 (SEQ ID NO: 1451) | 500 | 676 |
| R01445_T2 (SEQ ID NO: 1452) | 500 | 676 |
| R01445_T3 (SEQ ID NO: 1453) | 639 | 815 |
| R01445_T4 (SEQ ID NO: 1454) | 524 | 700 |
| R01445_T5 (SEQ ID NO: 1455) | 502 | 678 |
| R01445_T6 (SEQ ID NO: 1456) | 716 | 892 |
| R01445_T7 (SEQ ID NO: 1457) | 606 | 782 |
| R01445_T8 (SEQ ID NO: 1458) | 500 | 676 |
| R01445_T10 (SEQ ID NO: 1459) | 500 | 676 |
| R01445_T11 (SEQ ID NO: 1460) | 500 | 676 |
| R01445_T12 (SEQ ID NO: 1461) | 117 | 293 |

This segment can be found in both coding and non-coding regions of transcript(s) as follows. The segment can be found in a non-coding region of transcript(s) that are related to the following protein(s): R01445_P3 and R01445_P5. This segment can also be found in the following protein(s): R01445_P8, R01445_P2 and R01445_P4, since it is in the coding region for the corresponding transcript.

Segment cluster R01445_node_21 (SEQ ID NO:1470) according to the present invention is supported by 51 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459) and R01445_T1 (SEQ ID NO:1460). Table 1362 below describes the starting and ending position of this segment on each transcript.

TABLE 1362

Segment location on transcripts

| Transcript name | Segment starting position | Segment ending position |
|---|---|---|
| R01445_T1 (SEQ ID NO: 1451) | 677 | 852 |
| R01445_T2 (SEQ ID NO: 1452) | 677 | 852 |
| R01445_T3 (SEQ ID NO: 1453) | 816 | 991 |
| R01445_T4 (SEQ ID NO: 1454) | 701 | 876 |
| R01445_T5 (SEQ ID NO: 1455) | 679 | 854 |
| R01445_T6 (SEQ ID NO: 1456) | 893 | 1068 |
| R01445_T7 (SEQ ID NO: 1457) | 783 | 958 |
| R01445_T8 (SEQ ID NO: 1458) | 677 | 852 |
| R01445_T10 (SEQ ID NO: 1459) | 677 | 852 |
| R01445_T11 (SEQ ID NO: 1460) | 677 | 852 |

This segment can be found in the following protein(s): R01445_P8, R01445_P2, R01445_P3 and R01445_P4.

Segment cluster R01445_node_24 (SEQ ID NO:1471) according to the present invention is supported by 19 libraries. The number of libraries was determined as previously described. This segment can be found in the following transcript(s): R01445_T2 (SEQ ID NO:1452), R01445_T8 (SEQ ID NO:1458), R01445_T10 (SEQ ID NO:1459) and R01445_T11 (SEQ ID NO:1460). Table 1363 below describes the starting and ending position of this segment on each transcript.

TABLE 1363

Segment location on transcripts

| Transcript name | Segment starting position | Segment ending position |
|---|---|---|
| R01445_T2 (SEQ ID NO: 1452) | 969 | 3114 |
| R01445_T8 (SEQ ID NO: 1458) | 969 | 3114 |
| R01445_T10 (SEQ ID NO: 1459) | 969 | 3114 |
| R01445_T11 (SEQ ID NO: 1460) | 969 | 3114 |

This segment can be found in the following protein(s): R01445_P2.

Segment cluster R01445_node_25 (SEQ ID NO:1472) according to the present invention is supported by 48 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459), R01445_T11 (SEQ ID NO:1460) and R01445_T12 (SEQ ID NO:1461). Table 1364 below describes the starting and ending position of this segment on each transcript.

TABLE 1364

Segment location on transcripts

| Transcript name | Segment starting position | Segment ending position |
|---|---|---|
| R01445_T1 (SEQ ID NO: 1451) | 969 | 1161 |
| R01445_T2 (SEQ ID NO: 1452) | 3115 | 3307 |
| R01445_T3 (SEQ ID NO: 1453) | 1108 | 1300 |
| R01445_T4 (SEQ ID NO: 1454) | 993 | 1185 |
| R01445_T5 (SEQ ID NO: 1455) | 971 | 1163 |
| R01445_T6 (SEQ ID NO: 1456) | 1185 | 1377 |
| R01445_T7 (SEQ ID NO: 1457) | 1075 | 1267 |
| R01445_T8 (SEQ ID NO: 1458) | 3115 | 3307 |
| R01445_T10 (SEQ ID NO: 1459) | 3115 | 3307 |
| R01445_T11 (SEQ ID NO: 1460) | 3115 | 3307 |
| R01445_T12 (SEQ ID NO: 1461) | 410 | 602 |

This segment can be found in both coding and non-coding regions of transcript(s) as follows. The segment can be found in a non-coding region of transcript(s) that are related to the following protein(s): R01445_P2. This segment can also be found in the following protein(s): R01445_P8, R01445_P3, R01445_P4 and R01445_P5, since it is in the coding region for the corresponding transcript.

Segment cluster R01445_node_26 (SEQ ID NO:1473) according to the present invention is supported by 5 libraries. The number of libraries was determined as previously described. This segment can be found in the following transcript(s): R01445_T10 (SEQ ID NO:1459). Table 1365 below describes the starting and ending position of this segment on each transcript.

TABLE 1365

Segment location on transcripts

| Transcript name | Segment starting position | Segment ending position |
|---|---|---|
| R01445_T10 (SEQ ID NO: 1459) | 3308 | 3900 |

This segment can be found in a non-coding region of transcript(s) that are related to the following protein(s): R01445_P2.

Segment cluster R01445_node_29 (SEQ ID NO:1474) according to the present invention is supported by 1 libraries. The number of libraries was determined as previously described. This segment can be found in the following transcript(s): R01445_T11 (SEQ ID NO:1460). Table 1366 below describes the starting and ending position of this segment on each transcript.

TABLE 1366

Segment location on transcripts

| Transcript name | Segment starting position | Segment ending position |
|---|---|---|
| R01445_T11 (SEQ ID NO: 1460) | 3426 | 3698 |

This segment can be found in a non-coding region of transcript(s) that are related to the following protein(s): R01445_P2.

Segment cluster R01445_node_33 (SEQ ID NO:1475) according to the present invention is supported by 2 libraries. The number of libraries was determined as previously described. This segment can be found in the following transcript(s): R01445_T8 (SEQ ID NO:1458). Table 1367 below describes the starting and ending position of this segment on each transcript.

TABLE 1367

Segment location on transcripts

| Transcript name | Segment starting position | Segment ending position |
|---|---|---|
| R01445_T8 (SEQ ID NO: 1458) | 3632 | 4157 |

This segment can be found in a non-coding region of transcript(s) that are related to the following protein(s): R01445_P2.

Segment cluster R01445_node_35 (SEQ ID NO:1476) according to the present invention is supported by 5 libraries. The number of libraries was determined as previously described. This segment can be found in the following transcript(s): R01445_T15 (SEQ ID NO:1463) and R01445_T17 (SEQ ID NO:1464). Table 1368 below describes the starting and ending position of this segment on each transcript.

TABLE 1368

Segment location on transcripts

| Transcript name | Segment starting position | Segment ending position |
|---|---|---|
| R01445_T15 (SEQ ID NO: 1463) | 1 | 1970 |
| R01445_T17 (SEQ ID NO: 1464) | 1 | 1970 |

The previously-described transcripts for these segment(s) do not code for protein.

Segment cluster R01445_node_36 (SEQ ID NO:1477) according to the present invention is supported by 36 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T12 (SEQ ID NO:1461), R01445_T15 (SEQ ID NO:1463) and R01445_T17 (SEQ ID NO:1464). Table 1369 below describes the starting and ending position of this segment on each transcript.

TABLE 1369

Segment location on transcripts

| Transcript name | Segment starting position | Segment ending position |
|---|---|---|
| R01445_T1 (SEQ ID NO: 1451) | 1486 | 1951 |
| R01445_T2 (SEQ ID NO: 1452) | 3632 | 4097 |
| R01445_T3 (SEQ ID NO: 1453) | 1625 | 2090 |
| R01445_T4 (SEQ ID NO: 1454) | 1510 | 1975 |
| R01445_T5 (SEQ ID NO: 1455) | 1488 | 1953 |
| R01445_T6 (SEQ ID NO: 1456) | 1702 | 2167 |
| R01445_T7 (SEQ ID NO: 1457) | 1592 | 2057 |
| R01445_T12 (SEQ ID NO: 1461) | 927 | 1392 |

TABLE 1369-continued

Segment location on transcripts

| Transcript name | Segment starting position | Segment ending position |
|---|---|---|
| R01445_T15 (SEQ ID NO: 1463) | 1971 | 2436 |
| R01445_T17 (SEQ ID NO: 1464) | 1971 | 2436 |

This segment can be found in both coding and non-coding regions of transcript(s) as follows. The segment can be found in a non-coding region of transcript(s) that are related to the following protein(s): R01445_P2. This segment can also be found in the following protein(s): R01445_P8, R01445_P3, R01445_P4 and R01445_P5, since it is in the coding region for the corresponding transcript.

Segment cluster R01445_node_38 (SEQ ID NO:1478) according to the present invention is supported by 71 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T12 (SEQ ID NO:1461), R01445_T14 (SEQ ID NO:1462), R01445_T15 (SEQ ID NO:1463) and R01445_T17 (SEQ ID NO:1464). Table 1370 below describes the starting and ending position of this segment on each transcript.

TABLE 1370

Segment location on transcripts

| Transcript name | Segment starting position | Segment ending position |
|---|---|---|
| R01445_T1 (SEQ ID NO: 1451) | 1956 | 3750 |
| R01445_T2 (SEQ ID NO: 1452) | 4102 | 5896 |
| R01445_T3 (SEQ ID NO: 1453) | 2095 | 3889 |
| R01445_T4 (SEQ ID NO: 1454) | 1980 | 3774 |
| R01445_T5 (SEQ ID NO: 1455) | 1958 | 3752 |
| R01445_T6 (SEQ ID NO: 1456) | 2172 | 3966 |
| R01445_T7 (SEQ ID NO: 1457) | 2062 | 3856 |
| R01445_T12 (SEQ ID NO: 1461) | 1397 | 3191 |
| R01445_T14 (SEQ ID NO: 1462) | 492 | 2286 |
| R01445_T15 (SEQ ID NO: 1463) | 2441 | 4235 |
| R01445_T17 (SEQ ID NO: 1464) | 2441 | 2552 |

This segment can be found in both coding and non-coding regions of transcript(s) as follows. The segment can be found in a non-coding region of transcript(s) that are related to the following protein(s): R01445_P8, R01445_P2, R01445_P3, R01445_P4 and R01445_P5. This segment can also be found in the following protein(s): R01445_P7, since it is in the coding region for the corresponding transcript.

Segment cluster R01445_node_39 (SEQ ID NO:1479) according to the present invention is supported by 15 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T12 (SEQ ID NO:1461), R01445_T14 (SEQ ID NO:1462) and R01445_T15 (SEQ ID NO:1463). Table 1371 below describes the starting and ending position of this segment on each transcript.

TABLE 1371

Segment location on transcripts

| Transcript name | Segment starting position | Segment ending position |
|---|---|---|
| R01445_T1 (SEQ ID NO: 1451) | 3751 | 4133 |
| R01445_T2 (SEQ ID NO: 1452) | 5897 | 6279 |
| R01445_T3 (SEQ ID NO: 1453) | 3890 | 4272 |
| R01445_T4 (SEQ ID NO: 1454) | 3775 | 4157 |
| R01445_T5 (SEQ ID NO: 1455) | 3753 | 4135 |
| R01445_T6 (SEQ ID NO: 1456) | 3967 | 4349 |
| R01445_T7 (SEQ ID NO: 1457) | 3857 | 4239 |
| R01445_T12 (SEQ ID NO: 1461) | 3192 | 3574 |
| R01445_T14 (SEQ ID NO: 1462) | 2287 | 2669 |
| R01445_T15 (SEQ ID NO: 1463) | 4236 | 4618 |

This segment can be found in a non-coding region of transcript(s) that are related to the following protein(s): R01445_P8, R01445_P2, R01445_P3, R01445_P4, R01445_P5 and R01445_P7.

According to an optional embodiment of the present invention, short segments related to the above cluster are also provided. These segments are up to about 120 bp in length, and so are included in a separate description.

Segment cluster R01445_node_4 (SEQ ID NO:1480) according to the present invention is supported by 1 libraries. The number of libraries was determined as previously described. This segment can be found in the following transcript(s): R01445_T6 (SEQ ID NO:1456). Table 1372 below describes the starting and ending position of this segment on each transcript.

TABLE 1372

Segment location on transcripts

| Transcript name | Segment starting position | Segment ending position |
|---|---|---|
| R01445_T6 (SEQ ID NO: 1456) | 144 | 253 |

This segment can be found in a non-coding region of transcript(s) that are related to the following protein(s): R01445_P4.

Segment cluster R01445_node_5 (SEQ ID NO:1481) according to the present invention is supported by 2 libraries. The number of libraries was determined as previously described. This segment can be found in the following transcript(s): R01445_T6 (SEQ ID NO:1456) and R01445_T7 (SEQ ID NO:1457). Table 1373 below describes the starting and ending position of this segment on each transcript.

TABLE 1373

Segment location on transcripts

| Transcript name | Segment starting position | Segment ending position |
|---|---|---|
| R01445_T6 (SEQ ID NO: 1456) | 254 | 359 |
| R01445_T7 (SEQ ID NO: 1457) | 144 | 249 |

This segment can be found in a non-coding region of transcript(s) that are related to the following protein(s): R01445_P4.

Segment cluster R01445_node_7 (SEQ ID NO:1482) according to the present invention can be found in the following transcript(s): R01445_T4 (SEQ ID NO:1454). Table 1374 below describes the starting and ending position of this segment on each transcript.

TABLE 1374

Segment location on transcripts

| Transcript name | Segment starting position | Segment ending position |
|---|---|---|
| R01445_T4 (SEQ ID NO: 1454) | 144 | 167 |

This segment can be found in a non-coding region of transcript(s) that are related to the following protein(s): R01445_P4.

Segment cluster R01445_node_10 (SEQ ID NO:1483) according to the present invention is supported by 51 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T1 (SEQ ID NO:1459), R01445_T11 (SEQ ID NO:1460) and R01445_T14 (SEQ ID NO:1462). Table 1375 below describes the starting and ending position of this segment on each transcript.

TABLE 1375

Segment location on transcripts

| Transcript name | Segment starting position | Segment ending position |
|---|---|---|
| R01445_T1 (SEQ ID NO: 1451) | 304 | 402 |
| R01445_T2 (SEQ ID NO: 1452) | 304 | 402 |
| R01445_T3 (SEQ ID NO: 1453) | 304 | 402 |
| R01445_T4 (SEQ ID NO: 1454) | 328 | 426 |
| R01445_T5 (SEQ ID NO: 1455) | 306 | 404 |
| R01445_T6 (SEQ ID NO: 1456) | 520 | 618 |
| R01445_T7 (SEQ ID NO: 1457) | 410 | 508 |
| R01445_T8 (SEQ ID NO: 1458) | 304 | 402 |
| R01445_T10 (SEQ ID NO: 1459) | 304 | 402 |
| R01445_T11 (SEQ ID NO: 1460) | 304 | 402 |
| R01445_T14 (SEQ ID NO: 1462) | 304 | 402 |

This segment can be found in both coding and non-coding regions of transcript(s) as follows. The segment can be found in a non-coding region of transcript(s) that are related to the following protein(s): R01445_P3. This segment can also be found in the following protein(s): R01445_P8, R01445_P2, R01445_P4 and R01445_P7, since it is in the coding region for the corresponding transcript.

Segment cluster R01445_node_12 (SEQ ID NO:1484) according to the present invention is supported by 56 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459), R01445_T11 (SEQ ID NO:1460) and R01445_T14 (SEQ ID NO:1462). Table 1376 below describes the starting and ending position of this segment on each transcript.

TABLE 1376

Segment location on transcripts

| Transcript name | Segment starting position | Segment ending position |
|---|---|---|
| R01445_T1 (SEQ ID NO: 1451) | 403 | 487 |
| R01445_T2 (SEQ ID NO: 1452) | 403 | 487 |
| R01445_T3 (SEQ ID NO: 1453) | 403 | 487 |
| R01445_T4 (SEQ ID NO: 1454) | 427 | 511 |
| R01445_T5 (SEQ ID NO: 1455) | 405 | 489 |
| R01445_T6 (SEQ ID NO: 1456) | 619 | 703 |
| R01445_T7 (SEQ ID NO: 1457) | 509 | 593 |
| R01445_T8 (SEQ ID NO: 1458) | 403 | 487 |
| R01445_T10 (SEQ ID NO: 1459) | 403 | 487 |
| R01445_T11 (SEQ ID NO: 1460) | 403 | 487 |
| R01445_T14 (SEQ ID NO: 1462) | 403 | 487 |

This segment can be found in both coding and non-coding regions of transcript(s) as follows. The segment can be found in a non-coding region of transcript(s) that are related to the following protein(s): R01445_P3. This segment can also be found in the following protein(s): R01445_P8, R01445_P2, R01445_P4 and R01445_P7, since it is in the coding region for the corresponding transcript.

Segment cluster R01445_node_13 (SEQ ID NO:1485) according to the present invention can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459) and R01445_T11 (SEQ ID NO:1460). Table 1377 below describes the starting and ending position of this segment on each transcript.

TABLE 1377

Segment location on transcripts

| Transcript name | Segment starting position | Segment ending position |
|---|---|---|
| R01445_T1 (SEQ ID NO: 1451) | 488 | 492 |
| R01445_T2 (SEQ ID NO: 1452) | 488 | 492 |
| R01445_T3 (SEQ ID NO: 1453) | 488 | 492 |
| R01445_T4 (SEQ ID NO: 1454) | 512 | 516 |
| R01445_T5 (SEQ ID NO: 1455) | 490 | 494 |
| R01445_T6 (SEQ ID NO: 1456) | 704 | 708 |
| R01445_T7 (SEQ ID NO: 1457) | 594 | 598 |
| R01445_T8 (SEQ ID NO: 1458) | 488 | 492 |
| R01445_T10 (SEQ ID NO: 1459) | 488 | 492 |
| R01445_T11 (SEQ ID NO: 1460) | 488 | 492 |

This segment can be found in both coding and non-coding regions of transcript(s) as follows. The segment can be found in a non-coding region of transcript(s) that are related to the following protein(s): R01445_P3. This segment can also be found in the following protein(s): R01445_P8, R01445_P2 and R01445_P4, since it is in the coding region for the corresponding transcript.

Segment cluster R01445_node_14 (SEQ ID NO:1486) according to the present invention can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459) and R01445_T11 (SEQ ID NO:1460). Table 1378 below describes the starting and ending position of this segment on each transcript.

TABLE 1378

Segment location on transcripts

| Transcript name | Segment starting position | Segment ending position |
|---|---|---|
| R01445_T1 (SEQ ID NO: 1451) | 493 | 499 |
| R01445_T2 (SEQ ID NO: 1452) | 493 | 499 |
| R01445_T3 (SEQ ID NO: 1453) | 493 | 499 |
| R01445_T4 (SEQ ID NO: 1454) | 517 | 523 |
| R01445_T5 (SEQ ID NO: 1455) | 495 | 501 |
| R01445_T6 (SEQ ID NO: 1456) | 709 | 715 |
| R01445_T7 (SEQ ID NO: 1457) | 599 | 605 |
| R01445_T8 (SEQ ID NO: 1458) | 493 | 499 |
| R01445_T10 (SEQ ID NO: 1459) | 493 | 499 |
| R01445_T11 (SEQ ID NO: 1460) | 493 | 499 |

This segment can be found in both coding and non-coding regions of transcript(s) as follows. The segment can be found in a non-coding region of transcript(s) that are related to the following protein(s): R01445_P3. This segment can also be found in the following protein(s): R01445_P8, R01445_P2 and R01445_P4, since it is in the coding region for the corresponding transcript.

Segment cluster R01445_node_18 (SEQ ID NO:1487) according to the present invention is supported by 1 libraries. The number of libraries was determined as previously described. This segment can be found in the following transcript(s): R01445_T12 (SEQ ID NO:1461). Table 1379 below describes the starting and ending position of this segment on each transcript.

TABLE 1379

Segment location on transcripts

| Transcript name | Segment starting position | Segment ending position |
|---|---|---|
| R01445_T12 (SEQ ID NO: 1461) | 1 | 116 |

This segment can be found in a non-coding region of transcript(s) that are related to the following protein(s): R01445_P5.

Segment cluster R01445_node_23 (SEQ ID NO:1488) according to the present invention is supported by 46 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T10 (SEQ ID NO:1459), R01445_T11 (SEQ ID NO:1460) and R01445_T12 (SEQ ID NO:1461). Table 1380 below describes the starting and ending position of this segment on each transcript.

TABLE 1380

Segment location on transcripts

| Transcript name | Segment starting position | Segment ending position |
|---|---|---|
| R01445_T1 (SEQ ID NO: 1451) | 853 | 968 |
| R01445_T2 (SEQ ID NO: 1452) | 853 | 968 |

TABLE 1380-continued

Segment location on transcripts

| Transcript name | Segment starting position | Segment ending position |
|---|---|---|
| R01445_T3 (SEQ ID NO: 1453) | 992 | 1107 |
| R01445_T4 (SEQ ID NO: 1454) | 877 | 992 |
| R01445_T5 (SEQ ID NO: 1455) | 855 | 970 |
| R01445_T6 (SEQ ID NO: 1456) | 1069 | 1184 |
| R01445_T7 (SEQ ID NO: 1457) | 959 | 1074 |
| R01445_T8 (SEQ ID NO: 1458) | 853 | 968 |
| R01445_T10 (SEQ ID NO: 1459) | 853 | 968 |
| R01445_T11 (SEQ ID NO: 1460) | 853 | 968 |
| R01445_T12 (SEQ ID NO: 1461) | 294 | 409 |

This segment can be found in the following protein(s): R01445_P8, R01445_P2, R01445_P3, R01445_P4 and R01445_P5.

Segment cluster R01445_node_28 (SEQ ID NO:1489) according to the present invention is supported by 44 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458), R01445_T11 (SEQ ID NO:1460) and R01445_T12 (SEQ ID NO:1461). Table 1381 below describes the starting and ending position of this segment on each transcript.

TABLE 1381

Segment location on transcripts

| Transcript name | Segment starting position | Segment ending position |
|---|---|---|
| R01445_T1 (SEQ ID NO: 1451) | 1162 | 1279 |
| R01445_T2 (SEQ ID NO: 1452) | 3308 | 3425 |
| R01445_T3 (SEQ ID NO: 1453) | 1301 | 1418 |
| R01445_T4 (SEQ ID NO: 1454) | 1186 | 1303 |
| R01445_T5 (SEQ ID NO: 1455) | 1164 | 1281 |
| R01445_T6 (SEQ ID NO: 1456) | 1378 | 1495 |
| R01445_T7 (SEQ ID NO: 1457) | 1268 | 1385 |
| R01445_T8 (SEQ ID NO: 1458) | 3308 | 3425 |
| R01445_T11 (SEQ ID NO: 1460) | 3308 | 3425 |
| R01445_T12 (SEQ ID NO: 1461) | 603 | 720 |

This segment can be found in both coding and non-coding regions of transcript(s) as follows. The segment can be found in a non-coding region of transcript(s) that are related to the following protein(s): R01445_P2. This segment can also be found in the following protein(s): R01445_P8, R01445_P3, R01445_P4 and R01445_P5, since it is in the coding region for the corresponding transcript.

Segment cluster R01445_node_31 (SEQ ID NO:1490) according to the present invention is supported by 36 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458) and R01445_T12 (SEQ ID NO:1461). Table 1382 below describes the starting and ending position of this segment on each transcript.

TABLE 1382

Segment location on transcripts

| Transcript name | Segment starting position | Segment ending position |
|---|---|---|
| R01445_T1 (SEQ ID NO: 1451) | 1280 | 1377 |
| R01445_T2 (SEQ ID NO: 1452) | 3426 | 3523 |
| R01445_T3 (SEQ ID NO: 1453) | 1419 | 1516 |
| R01445_T4 (SEQ ID NO: 1454) | 1304 | 1401 |
| R01445_T5 (SEQ ID NO: 1455) | 1282 | 1379 |
| R01445_T6 (SEQ ID NO: 1456) | 1496 | 1593 |
| R01445_T7 (SEQ ID NO: 1457) | 1386 | 1483 |
| R01445_T8 (SEQ ID NO: 1458) | 3426 | 3523 |
| R01445_T12 (SEQ ID NO: 1461) | 721 | 818 |

This segment can be found in both coding and non-coding regions of transcript(s) as follows. The segment can be found in a non-coding region of transcript(s) that are related to the following protein(s): R01445_P2. This segment can also be found in the following protein(s): R01445_P8, R01445_P3, R01445_P4 and R01445_P5, since it is in the coding region for the corresponding transcript.

Segment cluster R01445_node_32 (SEQ ID NO:1491) according to the present invention is supported by 31 libraries. The number of libraries was determined as previously described. This segment can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T8 (SEQ ID NO:1458) and R01445_T12 (SEQ ID NO:1461). Table 1383 below describes the starting and ending position of this segment on each transcript.

TABLE 1383

Segment location on transcripts

| Transcript name | Segment starting position | Segment ending position |
|---|---|---|
| R01445_T1 (SEQ ID NO: 1451) | 1378 | 1485 |
| R01445_T2 (SEQ ID NO: 1452) | 3524 | 3631 |
| R01445_T3 (SEQ ID NO: 1453) | 1517 | 1624 |
| R01445_T4 (SEQ ID NO: 1454) | 1402 | 1509 |
| R01445_T5 (SEQ ID NO: 1455) | 1380 | 1487 |
| R01445_T6 (SEQ ID NO: 1456) | 1594 | 1701 |
| R01445_T7 (SEQ ID NO: 1457) | 1484 | 1591 |
| R01445_T8 (SEQ ID NO: 1458) | 3524 | 3631 |
| R01445_T12 (SEQ ID NO: 1461) | 819 | 926 |

This segment can be found in both coding and non-coding regions of transcript(s) as follows. The segment can be found in a non-coding region of transcript(s) that are related to the following protein(s): R01445_P2. This segment can also be found in the following protein(s): R01445_P8, R01445_P3, R01445_P4 and R01445_P5, since it is in the coding region for the corresponding transcript.

Segment cluster R01445_node_37 (SEQ ID NO:1492) according to the present invention can be found in the following transcript(s): R01445_T1 (SEQ ID NO:1451), R01445_T2 (SEQ ID NO:1452), R01445_T3 (SEQ ID NO:1453), R01445_T4 (SEQ ID NO:1454), R01445_T5 (SEQ ID NO:1455), R01445_T6 (SEQ ID NO:1456), R01445_T7 (SEQ ID NO:1457), R01445_T12 (SEQ ID NO:1461), R01445_T14 (SEQ ID NO:1462), R01445_T15 (SEQ ID NO:1463) and R01445_T17 (SEQ ID NO:1464). Table 1384 below describes the starting and ending position of this segment on each transcript.

TABLE 1384

Segment location on transcripts

| Transcript name | Segment starting position | Segment ending position |
|---|---|---|
| R01445_T1 (SEQ ID NO: 1451) | 1952 | 1955 |
| R01445_T2 (SEQ ID NO: 1452) | 4098 | 4101 |
| R01445_T3 (SEQ ID NO: 1453) | 2091 | 2094 |
| R01445_T4 (SEQ ID NO: 1454) | 1976 | 1979 |
| R01445_T5 (SEQ ID NO: 1455) | 1954 | 1957 |
| R01445_T6 (SEQ ID NO: 1456) | 2168 | 2171 |
| R01445_T7 (SEQ ID NO: 1457) | 2058 | 2061 |
| R01445_T12 (SEQ ID NO: 1461) | 1393 | 1396 |
| R01445_T14 (SEQ ID NO: 1462) | 488 | 491 |
| R01445_T15 (SEQ ID NO: 1463) | 2437 | 2440 |
| R01445_T17 (SEQ ID NO: 1464) | 2437 | 2440 |

This segment can be found in both coding and non-coding regions of transcript(s) as follows. The segment can be found in a non-coding region of transcript(s) that are related to the following protein(s): R01445_P8, R01445_P2, R01445_P3, R01445_P4 and R01445_P5. This segment can also be found in the following protein(s): R01445_P7, since it is in the coding region for the corresponding transcript.

Description for Cluster R10078

Cluster R10078 features 8 transcript(s) and 33 segment(s) of interest, the names for which are given in Tables 1385 and 1386, respectively, the sequences themselves are given at the end of the application. The selected protein variants are given in Table 1387.

TABLE 1385

Transcripts of interest
Transcript Name

R10078_T7 (SEQ ID NO: 1493)
R10078_T8 (SEQ ID NO: 1494)
R10078_T16 (SEQ ID NO: 1495)
R10078_T28 (SEQ ID NO: 1496)
R10078_T31 (SEQ ID NO: 1497)
R10078_T32 (SEQ ID NO: 1498)
R10078_T34 (SEQ ID NO: 1499)
R10078_T35 (SEQ ID NO: 1500)

TABLE 1386

Segments of interest
Segment Name

R10078_node_1 (SEQ ID NO: 1501)
R10078_node_3 (SEQ ID NO: 1502)
R10078_node_5 (SEQ ID NO: 1503)
R10078_node_7 (SEQ ID NO: 1504)
R10078_node_26 (SEQ ID NO: 1505)
R10078_node_27 (SEQ ID NO: 1506)
R10078_node_34 (SEQ ID NO: 1507)
R10078_node_43 (SEQ ID NO: 1508)
R10078_node_44 (SEQ ID NO: 1509)
R10078_node_46 (SEQ ID NO: 1510)
R10078_node_48 (SEQ ID NO: 1511)
R10078_node_54 (SEQ ID NO: 1512)
R10078_node_8 (SEQ ID NO: 1513)
R10078_node_14 (SEQ ID NO: 1514)
R10078_node_15 (SEQ ID NO: 1515)
R10078_node_16 (SEQ ID NO: 1516)
R10078_node_17 (SEQ ID NO: 1517)
R10078_node_18 (SEQ ID NO: 1518)
R10078_node_19 (SEQ ID NO: 1519)

TABLE 1386-continued

Segments of interest
Segment Name

R10078_node_32 (SEQ ID NO: 1520)
R10078_node_33 (SEQ ID NO: 1521)
R10078_node_35 (SEQ ID NO: 1522)
R10078_node_36 (SEQ ID NO: 1523)
R10078_node_37 (SEQ ID NO: 1524)
R10078_node_38 (SEQ ID NO: 1525)
R10078_node_39 (SEQ ID NO: 1526)
R10078_node_40 (SEQ ID NO: 1527)
R10078_node_42 (SEQ ID NO: 1528)
R10078_node_49 (SEQ ID NO: 1529)
R10078_node_50 (SEQ ID NO: 1530)
R10078_node_51 (SEQ ID NO: 1531)
R10078_node_52 (SEQ ID NO: 1532)
R10078_node_53 (SEQ ID NO: 1533)

TABLE 1387

Proteins of interest

| Protein Name | Corresponding Transcript(s) |
|---|---|
| R10078_P1 | R10078_T8 (SEQ ID NO: 1494) |
| R10078_P5 | R10078_T7 (SEQ ID NO: 1493); R10078_T16 (SEQ ID NO: 1495) |

Cluster R10078 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 36 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 36 and Table 1388. This cluster is overexpressed (at least at a minimum level) in the following pathological conditions: brain malignant tumors, epithelial malignant tumors, a mixture of malignant tumors from different tissues and skin malignancies.

TABLE 1388

Normal tissue distribution

| Name of Tissue | Number |
|---|---|
| Adrenal | 0 |
| Bladder | 0 |
| Bone | 32 |
| Brain | 9 |
| Colon | 0 |
| Epithelial | 0 |
| General | 6 |
| Kidney | 0 |
| Liver | 0 |
| Lung | 0 |
| lymph nodes | 49 |
| Breast | 0 |
| bone marrow | 0 |
| Muscle | 0 |
| Ovary | 0 |
| Pancreas | 0 |
| Skin | 0 |
| Stomach | 0 |
| Uterus | 0 |

TABLE 1389

P values and ratios for expression in cancerous tissue

| Name of Tissue | P1 | P2 | SP1 | R3 | SP2 | R4 |
|---|---|---|---|---|---|---|
| Adrenal | 4.2e−01 | 1.9e−01 | 2.1e−01 | 3.4 | 1.5e−01 | 3.6 |
| Bladder | 5.4e−01 | 3.4e−01 | 5.6e−01 | 1.8 | 4.6e−01 | 1.9 |
| Bone | 5.5e−01 | 5.8e−01 | 3.6e−01 | 2.0 | 5.3e−01 | 1.4 |
| Brain | 8.0e−01 | 4.9e−01 | 6.3e−01 | 1.1 | 3.4e−03 | 3.2 |
| Colon | 5.4e−02 | 9.1e−02 | 4.9e−01 | 2.2 | 5.9e−01 | 1.8 |
| Epithelial | 1.9e−06 | 3.7e−11 | 7.1e−05 | 14.5 | 1.2e−10 | 27.2 |
| General | 1.3e−05 | 8.4e−14 | 5.1e−05 | 3.6 | 1.2e−16 | 6.5 |
| Kidney | 6.5e−01 | 2.4e−01 | 5.8e−01 | 1.7 | 8.2e−02 | 3.6 |
| Liver | 1 | 3.0e−01 | 1 | 1.0 | 6.9e−01 | 1.6 |
| Lung | 5.0e−01 | 1.5e−01 | 1 | 1.1 | 2.4e−01 | 2.9 |
| lymph nodes | 8.5e−01 | 3.1e−01 | 1 | 0.3 | 3.7e−01 | 1.4 |
| Breast | 3.4e−01 | 7.2e−02 | 6.9e−01 | 1.5 | 9.5e−02 | 2.8 |
| bone marrow | 1 | 6.7e−01 | 1 | 1.0 | 2.8e−01 | 2.8 |
| Muscle | 1 | 2.9e−01 | 1 | 1.0 | 3.9e−01 | 2.6 |
| Ovary | 3.8e−01 | 2.6e−01 | 4.7e−01 | 1.9 | 4.5e−01 | 1.9 |
| Pancreas | 1 | 4.4e−01 | 1 | 1.0 | 1.5e−01 | 2.8 |
| Skin | 1 | 2.3e−02 | 1 | 1.0 | 7.7e−03 | 5.5 |
| Stomach | 3.0e−01 | 2.7e−01 | 5.0e−01 | 2.0 | 3.2e−01 | 2.3 |
| Uterus | 8.2e−02 | 3.0e−02 | 2.9e−01 | 2.5 | 1.7e−01 | 2.8 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1390.

TABLE 1390

Oligonucleotides related to this cluster

| Oligonucleotide name | Overexpressed in cancers | Chip reference |
|---|---|---|
| R10175_0_0_29339 | lung malignant tumors | LUN |

As noted above, cluster R10078 features 33 segment(s), which were listed in Table 1386 above and for which the sequence(s) are given at the end of the application. These segment(s) are portions of nucleic acid sequence(s) which are described herein separately because they are of particular interest. A description of each segment according to the present invention is now provided.

Segment cluster R10078_node_1 (SEQ ID NO:1501) according to the present invention is supported by 3 libraries. The number of libraries was determined as previously described. This segment can be found in the following transcript(s): R10078_T8 (SEQ ID NO:1494), R10078_T34 (SEQ ID NO:1499) and R10078_T35 (SEQ ID NO:1500). Table 1391 below describes the starting and ending position of this segment on each transcript.

TABLE 1391

Segment location on transcripts

| Transcript name | Segment starting position | Segment ending position |
|---|---|---|
| R10078_T8 (SEQ ID NO: 1494) | 1 | 679 |
| R10078_T34 (SEQ ID NO: 1499) | 1 | 679 |
| R10078_T35 (SEQ ID NO: 1500) | 1 | 679 |

This segment can be found in a non-coding region of transcript(s) that are related to the following protein(s): R10078_P1.

Segment cluster R10078_node_3 (SEQ ID NO:1502) according to the present invention is supported by 1 libraries. The number of libraries was determined as previously described. This segment can be found in the following transcript(s): R10078_T34 (SEQ ID NO:1499). Table 1392 below describes the starting and ending position of this segment on each transcript.

TABLE 1392

| | Segment location on transcripts | |
|---|---|---|
| Transcript name | Segment starting position | Segment ending position |
| R10078_T34 (SEQ ID NO: 1499) | 680 | 869 |

The previously-described transcripts for these segment(s) do not code for protein.

Segment cluster R10078_node_5 (SEQ ID NO:1503) according to the present invention is supported by 3 libraries. The number of libraries was determined as previously described. This segment can be found in the following transcript(s): R10078_T34 (SEQ ID NO:1499) and R10078_T35 (SEQ ID NO:1500). Table 1393 below describes the starting and ending position of this segment on each transcript.

TABLE 1393

| | Segment location on transcripts | |
|---|---|---|
| Transcript name | Segment starting position | Segment ending position |
| R10078_T34 (SEQ ID NO: 1499) | 870 | 1454 |
| R10078_T35 (SEQ ID NO: 1500) | 680 | 1264 |

The previously-described transcripts for these segment(s) do not code for protein.

Segment cluster R10078_node_7 (SEQ ID NO:1504) according to the present invention is supported by 47 libraries. The number of libraries was determined as previously described. This segment can be found in the following transcript(s): R10078_T7 (SEQ ID NO:1493) and R10078_T16 (SEQ ID NO:1495). Table 1394 below describes the starting and ending position of this segment on each transcript.

TABLE 1394

| | Segment location on transcripts | |
|---|---|---|
| Transcript name | Segment starting position | Segment ending position |
| R10078_T7 (SEQ ID NO: 1493) | 1 | 144 |
| R10078_T16 (SEQ ID NO: 1495) | 1 | 144 |

This segment can be found in a non-coding region of transcript(s) that are related to the following protein(s): R10078_P5.

Segment cluster R10078_node_26 (SEQ ID NO:1505) according to the present invention is supported by 63 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1395 below describes the starting and ending position of this segment on each transcript.

TABLE 1395

| | Segment location on transcripts | |
|---|---|---|
| Transcript name | Segment starting position | Segment ending position |
| R10078_T7 (SEQ ID NO: 1493) | 484 | 690 |
| R10078_T8 (SEQ ID NO: 1494) | 945 | 1151 |
| R10078_T16 (SEQ ID NO: 1495) | 484 | 690 |

This segment can be found in the following protein(s): R10078_P5 and R10078_P1.

Segment cluster R10078_node_27 (SEQ ID NO:1506) according to the present invention is supported by 62 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1396 below describes the starting and ending position of this segment on each transcript.

TABLE 1396

| | Segment location on transcripts | |
|---|---|---|
| Transcript name | Segment starting position | Segment ending position |
| R10078_T7 (SEQ ID NO: 1493) | 691 | 851 |
| R10078_T8 (SEQ ID NO: 1494) | 1152 | 1312 |
| R10078_T16 (SEQ ID NO: 1495) | 691 | 851 |

This segment can be found in the following protein(s): R10078_P5 and R10078_P1.

Segment cluster R10078_node_34 (SEQ ID NO:1507) according to the present invention is supported by 54 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1397 below describes the starting and ending position of this segment on each transcript.

TABLE 1397

| | Segment location on transcripts | |
|---|---|---|
| Transcript name | Segment starting position | Segment ending position |
| R10078_T7 (SEQ ID NO: 1493) | 936 | 1085 |
| R10078_T8 (SEQ ID NO: 1494) | 1397 | 1546 |
| R10078_T16 (SEQ ID NO: 1495) | 936 | 1085 |

This segment can be found in the following protein(s): R10078_P5 and R10078_P1.

Segment cluster R10078_node_43 (SEQ ID NO:1508) according to the present invention is supported by 4 libraries. The number of libraries was determined as previously described. This segment can be found in the following transcript(s): R10078_T7 (SEQ ID NO:1493) and R10078_T16 (SEQ ID NO:1495). Table 1398 below describes the starting and ending position of this segment on each transcript.

TABLE 1398

Segment location on transcripts

| Transcript name | Segment starting position | Segment ending position |
|---|---|---|
| R10078_T7 (SEQ ID NO: 1493) | 1453 | 1584 |
| R10078_T16 (SEQ ID NO: 1495) | 1453 | 1584 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1399.

TABLE 1399

Oligonucleotides related to this segment

| Oligonucleotide name | Overexpressed in cancers | Chip reference |
|---|---|---|
| R10175_0_0_29331 | breast malignant tumors | BRS |
| R10175_0_0_29331 | colorectal cancer | Colon |
| R10175_0_0_29331 | lung malignant tumors | LUN |

This segment can be found in the following protein(s): R10078_P5.

Segment cluster R10078_node_44 (SEQ ID NO:1509) according to the present invention is supported by 44 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1400 below describes the starting and ending position of this segment on each transcript.

TABLE 1400

Segment location on transcripts

| Transcript name | Segment starting position | Segment ending position |
|---|---|---|
| R10078_T7 (SEQ ID NO: 1493) | 1585 | 1757 |
| R10078_T8 (SEQ ID NO: 1494) | 1914 | 2086 |
| R10078_T16 (SEQ ID NO: 1495) | 1585 | 1757 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1401.

TABLE 1401

Oligonucleotides related to this segment

| Oligonucleotide name | Overexpressed in cancers | Chip reference |
|---|---|---|
| R10175_0_0_29331 | breast malignant tumors | BRS |
| R10175_0_0_29331 | colorectal cancer | Colon |
| R10175_0_0_29331 | lung malignant tumors | LUN |

This segment can be found in both coding and non-coding regions of transcript(s) as follows. The segment can be found in a non-coding region of transcript(s) that are related to the following protein(s): R10078_P5. This segment can also be found in the following protein(s): R10078_P1, since it is in the coding region for the corresponding transcript.

Segment cluster R10078_node_46 (SEQ ID NO:1510) according to the present invention is supported by 48 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1402 below describes the starting and ending position of this segment on each transcript.

TABLE 1402

Segment location on transcripts

| Transcript name | Segment starting position | Segment ending position |
|---|---|---|
| R10078_T7 (SEQ ID NO: 1493) | 1758 | 1915 |
| R10078_T8 (SEQ ID NO: 1494) | 2087 | 2244 |
| R10078_T16 (SEQ ID NO: 1495) | 1758 | 1915 |

This segment can be found in both coding and non-coding regions of transcript(s) as follows. The segment can be found in a non-coding region of transcript(s) that are related to the following protein(s): R10078_P5. This segment can also be found in the following protein(s): R10078_P1, since it is in the coding region for the corresponding transcript.

Segment cluster R10078_node_48 (SEQ ID NO:1511) according to the present invention is supported by 12 libraries. The number of libraries was determined as previously described. This segment can be found in the following transcript(s): R10078_T28 (SEQ ID NO:1496), R10078_T31 (SEQ ID NO:1497) and R10078_T32 (SEQ ID NO:1498). Table 1403 below describes the starting and ending position of this segment on each transcript.

TABLE 1403

Segment location on transcripts

| Transcript name | Segment starting position | Segment ending position |
|---|---|---|
| R10078_T28 (SEQ ID NO: 1496) | 1 | 408 |
| R10078_T31 (SEQ ID NO: 1497) | 1 | 408 |
| R10078_T32 (SEQ ID NO: 1498) | 1 | 408 |

The previously-described transcripts for these segment(s) do not code for protein.

Segment cluster R10078_node_54 (SEQ ID NO:1512) according to the present invention is supported by 60 libraries. The number of libraries was determined as previously described. This segment can be found in the following transcript(s): R10078_T7 (SEQ ID NO:1493), R10078_T8 (SEQ ID NO:1494), R10078_T16 (SEQ ID NO:1495), R10078_T28 (SEQ ID NO:1496), R10078_T31 (SEQ ID NO:1497) and R10078_T32 (SEQ ID NO:1498). Table 1404 below describes the starting and ending position of this segment on each transcript.

TABLE 1404

Segment location on transcripts

| Transcript name | Segment starting position | Segment ending position |
|---|---|---|
| R10078_T7 (SEQ ID NO: 1493) | 2113 | 2239 |
| R10078_T8 (SEQ ID NO: 1494) | 2442 | 2568 |

TABLE 1404-continued

Segment location on transcripts

| Transcript name | Segment starting position | Segment ending position |
|---|---|---|
| R10078_T16 (SEQ ID NO: 1495) | 2186 | 2312 |
| R10078_T28 (SEQ ID NO: 1496) | 644 | 770 |
| R10078_T31 (SEQ ID NO: 1497) | 717 | 843 |
| R10078_T32 (SEQ ID NO: 1498) | 717 | 877 |

This segment can be found in a non-coding region of transcript(s) that are related to the following protein(s): R10078_P5 and R10078_P1.

According to an optional embodiment of the present invention, short segments related to the above cluster are also provided. These segments are up to about 120 bp in length, and so are included in a separate description.

Segment cluster R10078_node_8 (SEQ ID NO:1513) according to the present invention is supported by 46 libraries. The number of libraries was determined as previously described. This segment can be found in the following transcript(s): R10078_T7 (SEQ ID NO:1493) and R10078_T16 (SEQ ID NO:1495). Table 1405 below describes the starting and ending position of this segment on each transcript.

TABLE 1405

Segment location on transcripts

| Transcript name | Segment starting position | Segment ending position |
|---|---|---|
| R10078_T7 (SEQ ID NO: 1493) | 145 | 218 |
| R10078_T16 (SEQ ID NO: 1495) | 145 | 218 |

This segment can be found in a non-coding region of transcript(s) that are related to the following protein(s): R10078_P5.

Segment cluster R10078_node_14 (SEQ ID NO:1514) according to the present invention is supported by 49 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1406 below describes the starting and ending position of this segment on each transcript.

TABLE 1406

Segment location on transcripts

| Transcript name | Segment starting position | Segment ending position |
|---|---|---|
| R10078_T7 (SEQ ID NO: 1493) | 219 | 282 |
| R10078_T8 (SEQ ID NO: 1494) | 680 | 743 |
| R10078_T16 (SEQ ID NO: 1495) | 219 | 282 |

This segment can be found in a non-coding region of transcript(s) that are related to the following protein(s): R10078_P5 and R10078_P1.

Segment cluster R10078_node_15 (SEQ ID NO:1515) according to the present invention is supported by 49 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1407 below describes the starting and ending position of this segment on each transcript.

TABLE 1407

Segment location on transcripts

| Transcript name | Segment starting position | Segment ending position |
|---|---|---|
| R10078_T7 (SEQ ID NO: 1493) | 283 | 315 |
| R10078_T8 (SEQ ID NO: 1494) | 744 | 776 |
| R10078_T16 (SEQ ID NO: 1495) | 283 | 315 |

This segment can be found in a non-coding region of transcript(s) that are related to the following protein(s): R10078_P5 and R10078_P1.

Segment cluster R10078_node_16 (SEQ ID NO:1516) according to the present invention can be found in the following transcript(s): R10078_T7 (SEQ ID NO:1493), R10078_T8 (SEQ ID NO:1494) and R10078_T16 (SEQ ID NO:1495). Table 1408 below describes the starting and ending position of this segment on each transcript.

TABLE 1408

Segment location on transcripts

| Transcript name | Segment starting position | Segment ending position |
|---|---|---|
| R10078_T7 (SEQ ID NO: 1493) | 316 | 323 |
| R10078_T8 (SEQ ID NO: 1494) | 777 | 784 |
| R10078_T16 (SEQ ID NO: 1495) | 316 | 323 |

This segment can be found in a non-coding region of transcript(s) that are related to the following protein(s): R10078_P5 and R10078_P1.

Segment cluster R10078_node_17 (SEQ ID NO:1517) according to the present invention is supported by 48 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1409 below describes the starting and ending position of this segment on each transcript.

TABLE 1409

Segment location on transcripts

| Transcript name | Segment starting position | Segment ending position |
|---|---|---|
| R10078_T7 (SEQ ID NO: 1493) | 324 | 374 |
| R10078_T8 (SEQ ID NO: 1494) | 785 | 835 |
| R10078_T16 (SEQ ID NO: 1495) | 324 | 374 |

This segment can be found in a non-coding region of transcript(s) that are related to the following protein(s): R10078_P5 and R10078_P1.

Segment cluster R10078_node_18 (SEQ ID NO:1518) according to the present invention is supported by 55 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1410 below describes the starting and ending position of this segment on each transcript.

TABLE 1410

| Transcript name | Segment starting position | Segment ending position |
|---|---|---|
| R10078_T7 (SEQ ID NO: 1493) | 375 | 476 |
| R10078_T8 (SEQ ID NO: 1494) | 836 | 937 |
| R10078_T16 (SEQ ID NO: 1495) | 375 | 476 |

This segment can be found in the following protein(s): R10078_P5 and R10078_P1.

Segment cluster R10078_node__19 (SEQ ID NO:1519) according to the present invention can be found in the following transcript(s): R10078_T7 (SEQ ID NO:1493), R10078_T8 (SEQ ID NO:1494) and R10078_T16 (SEQ ID NO:1495). Table 1411 below describes the starting and ending position of this segment on each transcript.

TABLE 1411

| Transcript name | Segment starting position | Segment ending position |
|---|---|---|
| R10078_T7 (SEQ ID NO: 1493) | 477 | 483 |
| R10078_T8 (SEQ ID NO: 1494) | 938 | 944 |
| R10078_T16 (SEQ ID NO: 1495) | 477 | 483 |

This segment can be found in the following protein(s): R10078_P5 and R10078_P1.

Segment cluster R10078_node__32 (SEQ ID NO:1520) according to the present invention is supported by 57 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1412 below describes the starting and ending position of this segment on each transcript.

TABLE 1412

| Transcript name | Segment starting position | Segment ending position |
|---|---|---|
| R10078_T7 (SEQ ID NO: 1493) | 852 | 898 |
| R10078_T8 (SEQ ID NO: 1494) | 1313 | 1359 |
| R10078_T16 (SEQ ID NO: 1495) | 852 | 898 |

This segment can be found in the following protein(s): R10078_P5 and R10078_P1.

Segment cluster R10078_node__33 (SEQ ID NO:1521) according to the present invention is supported by 53 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1413 below describes the starting and ending position of this segment on each transcript.

TABLE 1413

| Transcript name | Segment starting position | Segment ending position |
|---|---|---|
| R10078_T7 (SEQ ID NO: 1493) | 899 | 935 |
| R10078_T8 (SEQ ID NO: 1494) | 1360 | 1396 |
| R10078_T16 (SEQ ID NO: 1495) | 899 | 935 |

This segment can be found in the following protein(s): R10078_P5 and R10078_P1.

Segment cluster R10078_node__35 (SEQ ID NO:1522) according to the present invention is supported by 45 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1414 below describes the starting and ending position of this segment on each transcript.

TABLE 1414

| Transcript name | Segment starting position | Segment ending position |
|---|---|---|
| R10078_T7 (SEQ ID NO: 1493) | 1086 | 1124 |
| R10078_T8 (SEQ ID NO: 1494) | 1547 | 1585 |
| R10078_T16 (SEQ ID NO: 1495) | 1086 | 1124 |

This segment can be found in the following protein(s): R10078_P5 and R10078_P1.

Segment cluster R10078_node__36 (SEQ ID NO:1523) according to the present invention can be found in the following transcript(s): R10078_T7 (SEQ ID NO:1493), R10078_T8 (SEQ ID NO:1494) and R10078_T16 (SEQ ID NO:1495). Table 1415 below describes the starting and ending position of this segment on each transcript.

TABLE 1415

| Transcript name | Segment starting position | Segment ending position |
|---|---|---|
| R10078_T7 (SEQ ID NO: 1493) | 1125 | 1128 |
| R10078_T8 (SEQ ID NO: 1494) | 1586 | 1589 |
| R10078_T16 (SEQ ID NO: 1495) | 1125 | 1128 |

This segment can be found in the following protein(s): R10078_P5 and R10078_P1.

Segment cluster R10078_node__37 (SEQ ID NO:1524) according to the present invention is supported by 46 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1416 below describes the starting and ending position of this segment on each transcript.

TABLE 1416

Segment location on transcripts

| Transcript name | Segment starting position | Segment ending position |
|---|---|---|
| R10078_T7 (SEQ ID NO: 1493) | 1129 | 1198 |
| R10078_T8 (SEQ ID NO: 1494) | 1590 | 1659 |
| R10078_T16 (SEQ ID NO: 1495) | 1129 | 1198 |

This segment can be found in the following protein(s): R10078_P5 and R10078_P1.

Segment cluster R10078_node_38 (SEQ ID NO:1525) according to the present invention is supported by 46 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1417 below describes the starting and ending position of this segment on each transcript.

TABLE 1417

Segment location on transcripts

| Transcript name | Segment starting position | Segment ending position |
|---|---|---|
| R10078_T7 (SEQ ID NO: 1493) | 1199 | 1235 |
| R10078_T8 (SEQ ID NO: 1494) | 1660 | 1696 |
| R10078_T16 (SEQ ID NO: 1495) | 1199 | 1235 |

This segment can be found in the following protein(s): R10078_P5 and R10078_P1.

Segment cluster R10078_node_39 (SEQ ID NO:1526) according to the present invention can be found in the following transcript(s): R10078_T7 (SEQ ID NO:1493), R10078_T8 (SEQ ID NO:1494) and R10078_T16 (SEQ ID NO:1495). Table 1418 below describes the starting and ending position of this segment on each transcript.

TABLE 1418

Segment location on transcripts

| Transcript name | Segment starting position | Segment ending position |
|---|---|---|
| R10078_T7 (SEQ ID NO: 1493) | 1236 | 1254 |
| R10078_T8 (SEQ ID NO: 1494) | 1697 | 1715 |
| R10078_T16 (SEQ ID NO: 1495) | 1236 | 1254 |

This segment can be found in the following protein(s): R10078_P5 and R10078_P1.

Segment cluster R10078_node_40 (SEQ ID NO:1527) according to the present invention is supported by 44 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1419 below describes the starting and ending position of this segment on each transcript.

TABLE 1419

Segment location on transcripts

| Transcript name | Segment starting position | Segment ending position |
|---|---|---|
| R10078_T7 (SEQ ID NO: 1493) | 1255 | 1345 |
| R10078_T8 (SEQ ID NO: 1494) | 1716 | 1806 |
| R10078_T16 (SEQ ID NO: 1495) | 1255 | 1345 |

This segment can be found in the following protein(s): R10078_P5 and R10078_P1.

Segment cluster R10078_node_42 (SEQ ID NO:1528) according to the present invention is supported by 39 libraries. The number of libraries was determined as previously described. This segment can be found in the following transcript(s): R10078_T7 (SEQ ID NO:1493), R10078_T8 (SEQ ID NO:1494) and R10078_T16 (SEQ ID NO:1495). Table 1420 below describes the starting and ending position of this segment on each transcript.

TABLE 1420

Segment location on transcripts

| Transcript name | Segment starting position | Segment ending position |
|---|---|---|
| R10078_T7 (SEQ ID NO: 1493) | 1346 | 1452 |
| R10078_T8 (SEQ ID NO: 1494) | 1807 | 1913 |
| R10078_T16 (SEQ ID NO: 1495) | 1346 | 1452 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1421.

TABLE 1421

Oligonucleotides related to this segment

| Oligonucleotide name | Overexpressed in cancers | Chip reference |
|---|---|---|
| R10175_0_0_29331 | breast malignant tumors | BRS |
| R10175_0_0_29331 | colorectal cancer | Colon |
| R10175_0_0_29331 | lung malignant tumors | LUN |

This segment can be found in the following protein(s): R10078_P5 and R10078_P1.

Segment cluster R10078_node_49 (SEQ ID NO:1529) according to the present invention is supported by 12 libraries. The number of libraries was determined as previously described. This segment can be found in the following transcript(s): R10078_T28 (SEQ ID NO:1496), R10078_T31 (SEQ ID NO:1497) and R10078_T32 (SEQ ID NO:1498). Table 1422 below describes the starting and ending position of this segment on each transcript.

TABLE 1422

Segment location on transcripts

| Transcript name | Segment starting position | Segment ending position |
|---|---|---|
| R10078_T28 (SEQ ID NO: 1496) | 409 | 446 |
| R10078_T31 (SEQ ID NO: 1497) | 409 | 446 |
| R10078_T32 (SEQ ID NO: 1498) | 409 | 446 |

The previously-described transcripts for these segment(s) do not code for protein.

Segment cluster R10078_node__50 (SEQ ID NO:1530) according to the present invention is supported by 58 libraries. The number of libraries was determined as previously described. This segment can be found in the following transcript(s): R10078_T7 (SEQ ID NO:1493), R10078_T8 (SEQ ID NO:1494), R10078_T16 (SEQ ID NO:1495), R10078_T28 (SEQ ID NO:1496), R10078_T31 (SEQ ID NO:1497) and R10078_T32 (SEQ ID NO:1498). Table 1423 below describes the starting and ending position of this segment on each transcript.

TABLE 1423

Segment location on transcripts

| Transcript name | Segment starting position | Segment ending position |
|---|---|---|
| R10078_T7 (SEQ ID NO: 1493) | 1916 | 1993 |
| R10078_T8 (SEQ ID NO: 1494) | 2245 | 2322 |
| R10078_T16 (SEQ ID NO: 1495) | 1916 | 1993 |
| R10078_T28 (SEQ ID NO: 1496) | 447 | 524 |
| R10078_T31 (SEQ ID NO: 1497) | 447 | 524 |
| R10078_T32 (SEQ ID NO: 1498) | 447 | 524 |

This segment can be found in both coding and non-coding regions of transcript(s) as follows. The segment can be found in a non-coding region of transcript(s) that are related to the following protein(s): R10078_P5. This segment can also be found in the following protein(s): R10078_P1, since it is in the coding region for the corresponding transcript.

Segment cluster R10078_node__51 (SEQ ID NO:1531) according to the present invention is supported by 9 libraries. The number of libraries was determined as previously described. This segment can be found in the following transcript(s): R10078_T16 (SEQ ID NO:1495), R10078_T31 (SEQ ID NO:1497) and R10078_T32 (SEQ ID NO:1498). Table 1424 below describes the starting and ending position of this segment on each transcript.

TABLE 1424

Segment location on transcripts

| Transcript name | Segment starting position | Segment ending position |
|---|---|---|
| R10078_T16 (SEQ ID NO: 1495) | 1994 | 2066 |
| R10078_T31 (SEQ ID NO: 1497) | 525 | 597 |
| R10078_T32 (SEQ ID NO: 1498) | 525 | 597 |

This segment can be found in a non-coding region of transcript(s) that are related to the following protein(s): R10078_P5.

Segment cluster R10078_node__52 (SEQ ID NO:1532) according to the present invention is supported by 60 libraries. The number of libraries was determined as previously described. This segment can be found in the following transcript(s): R10078_T7 (SEQ ID NO:1493), R10078_T8 (SEQ ID NO:1494), R10078_T16 (SEQ ID NO:1495), R10078_T28 (SEQ ID NO:1496), R10078_T31 (SEQ ID NO:1497) and R10078_T32 (SEQ ID NO:1498). Table 1425 below describes the starting and ending position of this segment on each transcript.

TABLE 1425

Segment location on transcripts

| Transcript name | Segment starting position | Segment ending position |
|---|---|---|
| R10078_T7 (SEQ ID NO: 1493) | 1994 | 2089 |
| R10078_T8 (SEQ ID NO: 1494) | 2323 | 2418 |
| R10078_T16 (SEQ ID NO: 1495) | 2067 | 2162 |
| R10078_T28 (SEQ ID NO: 1496) | 525 | 620 |
| R10078_T31 (SEQ ID NO: 1497) | 598 | 693 |
| R10078_T32 (SEQ ID NO: 1498) | 598 | 693 |

This segment can be found in both coding and non-coding regions of transcript(s) as follows. The segment can be found in a non-coding region of transcript(s) that are related to the following protein(s): R10078_P5. This segment can also be found in the following protein(s): R10078_P1, since it is in the coding region for the corresponding transcript.

Segment cluster R10078_node__53 (SEQ ID NO:1533) according to the present invention can be found in the following transcript(s): R10078_T7 (SEQ ID NO:1493), R10078_T8 (SEQ ID NO:1494), R10078_T16 (SEQ ID NO:1495), R10078_T28 (SEQ ID NO:1496), R10078_T31 (SEQ ID NO:1497) and R10078_T32 (SEQ ID NO:1498). Table 1426 below describes the starting and ending position of this segment on each transcript.

TABLE 1426

Segment location on transcripts

| Transcript name | Segment starting position | Segment ending position |
|---|---|---|
| R10078_T7 (SEQ ID NO: 1493) | 2090 | 2112 |
| R10078_T8 (SEQ ID NO: 1494) | 2419 | 2441 |
| R10078_T16 (SEQ ID NO: 1495) | 2163 | 2185 |
| R10078_T28 (SEQ ID NO: 1496) | 621 | 643 |
| R10078_T31 (SEQ ID NO: 1497) | 694 | 716 |
| R10078_T32 (SEQ ID NO: 1498) | 694 | 716 |

This segment can be found in both coding and non-coding regions of transcript(s) as follows. The segment can be found in a non-coding region of transcript(s) that are related to the following protein(s): R10078_P5. This segment can also be found in the following protein(s): R10078_P1, since it is in the coding region for the corresponding transcript.

Description for Cluster R20779

Cluster R20779 features 1 transcript(s) and 9 segment(s) of interest, the names for which are given in Tables 1427 and 1428, respectively, the sequences themselves are given at the end of the application. The selected protein variants are given in Table 1429.

TABLE 1427

Transcripts of interest
Transcript Name

R20779_T15 (SEQ ID NO: 1534)

TABLE 1428

Segments of interest
Segment Name

R20779_node__0 (SEQ ID NO: 1535)
R20779_node__2 (SEQ ID NO: 1536)

TABLE 1428-continued

Segments of interest

| Segment Name |
| --- |
| R20779_node_7 (SEQ ID NO: 1537) |
| R20779_node_9 (SEQ ID NO: 1538) |
| R20779_node_12 (SEQ ID NO: 1539) |
| R20779_node_1 (SEQ ID NO: 1540) |
| R20779_node_3 (SEQ ID NO: 1541) |
| R20779_node_10 (SEQ ID NO: 1542) |
| R20779_node_11 (SEQ ID NO: 1543) |

TABLE 1429

Proteins of interest

| Protein Name | Corresponding Transcript(s) |
| --- | --- |
| R20779_P10 | R20779_T15 (SEQ ID NO: 1534) |

These sequences are variants of the known protein Stanniocalcin 2 precursor (SwissProt accession identifier STC2_HUMAN; known also according to the synonyms STC-2; Stanniocalcin-related protein; STCRP; STC-related protein), referred to herein as the previously known protein.

Protein Stanniocalcin 2 precursor is known or believed to have the following function(s): Has an anti-hypocalcemic action on calcium and phosphate homeostasis. The sequence for protein Stanniocalcin 2 precursor is given at the end of the application, as "Stanniocalcin 2 precursor amino acid sequence". Protein Stanniocalcin 2 precursor localization is believed to be Secreted (Potential).

The following GO Annotation(s) apply to the previously known protein. The following annotation(s) were found: cell surface receptor linked signal transduction; cell-cell signaling; nutritional response pathway, which are annotation(s) related to Biological Process; hormone, which are annotation(s) related to Molecular Function; and extracellular, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R20779 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 37 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 37 and Table 1430. This cluster is overexpressed (at least at a minimum level) in the following pathological conditions: epithelial malignant tumors, a mixture of malignant tumors from different tissues and lung malignant tumors.

TABLE 1430

Normal tissue distribution

| Name of Tissue | Number |
| --- | --- |
| Bone | 825 |
| Brain | 0 |
| Colon | 0 |
| Epithelial | 32 |
| General | 38 |
| Kidney | 22 |
| Liver | 9 |
| Lung | 11 |
| lymph nodes | 0 |
| Breast | 215 |
| Muscle | 35 |
| Ovary | 36 |
| Pancreas | 4 |
| Prostate | 80 |
| Skin | 99 |
| Stomach | 0 |
| Uterus | 4 |

TABLE 1431

P values and ratios for expression in cancerous tissue

| Name of Tissue | P1 | P2 | SP1 | R3 | SP2 | R4 |
| --- | --- | --- | --- | --- | --- | --- |
| Bone | 5.9e−01 | 7.4e−01 | 1 | 0.2 | 1 | 0.1 |
| Brain | 2.5e−02 | 1.6e−02 | 2.2e−01 | 6.0 | 3.5e−02 | 8.0 |
| Colon | 1.7e−01 | 1.7e−01 | 1 | 1.3 | 7.7e−01 | 1.5 |
| Epithelial | 1.7e−01 | 1.5e−03 | 5.9e−01 | 1.0 | 2.0e−04 | 2.0 |
| General | 2.4e−02 | 6.2e−07 | 7.6e−01 | 0.8 | 4.6e−05 | 1.6 |
| Kidney | 4.3e−01 | 2.7e−01 | 6.2e−01 | 1.3 | 1.5e−01 | 2.0 |
| Liver | 8.3e−01 | 7.6e−01 | 1 | 0.8 | 3.3e−01 | 1.6 |
| Lung | 1.2e−01 | 1.4e−03 | 1.9e−01 | 2.9 | 1.6e−05 | 7.7 |
| lymph nodes | 1 | 3.1e−01 | 1 | 1.0 | 1 | 1.4 |
| Breast | 6.8e−01 | 6.8e−01 | 6.9e−01 | 0.8 | 3.6e−01 | 0.8 |
| Muscle | 9.2e−01 | 4.8e−01 | 1 | 0.3 | 1.4e−03 | 1.4 |
| Ovary | 8.4e−01 | 7.1e−01 | 9.0e−01 | 0.7 | 8.6e−01 | 0.8 |
| Pancreas | 9.3e−01 | 6.8e−01 | 1 | 0.7 | 1.5e−01 | 2.0 |
| Prostate | 9.1e−01 | 5.0e−01 | 9.8e−01 | 0.4 | 5.7e−01 | 0.7 |
| Skin | 6.3e−01 | 7.5e−01 | 7.1e−01 | 0.8 | 9.5e−01 | 0.3 |
| Stomach | 1 | 4.5e−01 | 1 | 1.0 | 5.1e−01 | 1.8 |
| Uterus | 7.1e−01 | 2.6e−01 | 4.4e−01 | 1.7 | 4.1e−01 | 1.8 |

As noted above, cluster R20779 features 9 segment(s), which were listed in Table 1428 above and for which the sequence(s) are given at the end of the application. These segment(s) are portions of nucleic acid sequence(s) which are described herein separately because they are of particular interest. A description of each segment according to the present invention is now provided.

Segment cluster R20779_node_0 (SEQ ID NO:1535) according to the present invention is supported by 31 libraries. The number of libraries was determined as previously described. This segment can be found in the following transcript(s): R20779_T15 (SEQ ID NO:1534). Table 1432 below describes the starting and ending position of this segment on each transcript.

TABLE 1432

Segment location on transcripts

| Transcript name | Segment starting position | Segment ending position |
| --- | --- | --- |
| R20779_T15 (SEQ ID NO: 1534) | 1 | 1298 |

This segment can be found in a non-coding region of transcript(s) that are related to the following protein(s): R20779_P10.

Segment cluster R20779_node_2 (SEQ ID NO:1536) according to the present invention is supported by 55 libraries. The number of libraries was determined as previously described. This segment can be found in the following transcript(s): R20779_T15 (SEQ ID NO:1534). Table 1433 below describes the starting and ending position of this segment on each transcript.

TABLE 1433

| | Segment location on transcripts | |
|---|---|---|
| Transcript name | Segment starting position | Segment ending position |
| R20779_T15 (SEQ ID NO: 1534) | 1337 | 1506 |

This segment can be found in the following protein(s): R20779_P10.

Segment cluster R20779_node_7 (SEQ ID NO:1537) according to the present invention is supported by 63 libraries. The number of libraries was determined as previously described. This segment can be found in the following transcript(s): R20779_T15 (SEQ ID NO:1534). Table 1434 below describes the starting and ending position of this segment on each transcript.

TABLE 1434

| | Segment location on transcripts | |
|---|---|---|
| Transcript name | Segment starting position | Segment ending position |
| R20779_T15 (SEQ ID NO: 1534) | 1548 | 1690 |

This segment can be found in the following protein(s): R20779_P10.

Segment cluster R20779_node_9 (SEQ ID NO:1538) according to the present invention is supported by 66 libraries. The number of libraries was determined as previously described. This segment can be found in the following transcript(s): R20779_T15 (SEQ ID NO:1534). Table 1435 below describes the starting and ending position of this segment on each transcript.

TABLE 1435

| | Segment location on transcripts | |
|---|---|---|
| Transcript name | Segment starting position | Segment ending position |
| R20779_T15 (SEQ ID NO: 1534) | 1691 | 1838 |

This segment can be found in the following protein(s): R20779_P10.

Segment cluster R20779_node_12 (SEQ ID NO:1539) according to the present invention is supported by 3 libraries. The number of libraries was determined as previously described. This segment can be found in the following transcript(s): R20779_T15 (SEQ ID NO:1534). Table 1436 below describes the starting and ending position of this segment on each transcript.

TABLE 1436

| | Segment location on transcripts | |
|---|---|---|
| Transcript name | Segment starting position | Segment ending position |
| R20779_T15 (SEQ ID NO: 1534) | 1903 | 2151 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1437.

TABLE 1437

| Oligonucleotides related to this segment | | |
|---|---|---|
| Oligonucleotide name | Overexpressed in cancers | Chip reference |
| R20779_0_0_30670 | breast malignant tumors | BRS |

This segment can be found in the following protein(s): R20779_P10.

According to an optional embodiment of the present invention, short segments related to the above cluster are also provided. These segments are up to about 120 bp in length, and so are included in a separate description.

Segment cluster R20779_node_1 (SEQ ID NO:1540) according to the present invention is supported by 27 libraries. The number of libraries was determined as previously described. This segment can be found in the following transcript(s): R20779_T15 (SEQ ID NO:1534). Table 1438 below describes the starting and ending position of this segment on each transcript.

TABLE 1438

| | Segment location on transcripts | |
|---|---|---|
| Transcript name | Segment starting position | Segment ending position |
| R20779_T15 (SEQ ID NO: 1534) | 1299 | 1336 |

This segment can be found in a non-coding region of transcript(s) that are related to the following protein(s): R20779_P10.

Segment cluster R20779_node_3 (SEQ ID NO:1541) according to the present invention is supported by 52 libraries. The number of libraries was determined as previously described. This segment can be found in the following transcript(s): R20779_T15 (SEQ ID NO:1534). Table 1439 below describes the starting and ending position of this segment on each transcript.

TABLE 1439

| | Segment location on transcripts | |
|---|---|---|
| Transcript name | Segment starting position | Segment ending position |
| R20779_T15 (SEQ ID NO: 1534) | 1507 | 1547 |

This segment can be found in the following protein(s): R20779_P10.

Segment cluster R20779_node_10 (SEQ ID NO:1542) according to the present invention can be found in the following transcript(s): R20779_T15 (SEQ ID NO:1534). Table 1440 below describes the starting and ending position of this segment on each transcript.

TABLE 1440

Segment location on transcripts

| Transcript name | Segment starting position | Segment ending position |
|---|---|---|
| R20779_T15 (SEQ ID NO: 1534) | 1839 | 1849 |

This segment can be found in the following protein(s): R20779_P10.

Segment cluster R20779_node_11 (SEQ ID NO:1543) according to the present invention is supported by 58 libraries. The number of libraries was determined as previously described. This segment can be found in the following transcript(s): R20779_T15 (SEQ ID NO:1534). Table 1441 below describes the starting and ending position of this segment on each transcript.

TABLE 1441

Segment location on transcripts

| Transcript name | Segment starting position | Segment ending position |
|---|---|---|
| R20779_T15 (SEQ ID NO: 1534) | 1850 | 1902 |

This segment can be found in the following protein(s): R20779_P10.

Description for Cluster R36629

Cluster R36629 features 5 transcript(s) and 14 segment(s) of interest, the names for which are given in Tables 1442 and 1443, respectively, the sequences themselves are given at the end of the application. The selected protein variants are given in Table 1444.

TABLE 1442

Transcripts of interest

| Transcript Name |
|---|
| R36629_T4 (SEQ ID NO: 1544) |
| R36629_T5 (SEQ ID NO: 1545) |
| R36629_T10 (SEQ ID NO: 1546) |
| R36629_T13 (SEQ ID NO: 1547) |
| R36629_T15 (SEQ ID NO: 1548) |

TABLE 1443

Segments of interest
Segment Name

| |
|---|
| R36629_node_0 (SEQ ID NO: 1549) |
| R36629_node_3 (SEQ ID NO: 1550) |
| R36629_node_5 (SEQ ID NO: 1551) |
| R36629_node_12 (SEQ ID NO: 1552) |
| R36629_node_15 (SEQ ID NO: 1553) |
| R36629_node_24 (SEQ ID NO: 1554) |
| R36629_node_7 (SEQ ID NO: 1555) |
| R36629_node_8 (SEQ ID NO: 1556) |
| R36629_node_18 (SEQ ID NO: 1557) |
| R36629_node_19 (SEQ ID NO: 1558) |
| R36629_node_20 (SEQ ID NO: 1559) |
| R36629_node_21 (SEQ ID NO: 1560) |

TABLE 1443-continued

Segments of interest
Segment Name

| |
|---|
| R36629_node_22 (SEQ ID NO: 1561) |
| R36629_node_23 (SEQ ID NO: 1562) |

TABLE 1444

Proteins of interest

| Protein Name | Corresponding Transcript(s) |
|---|---|
| R36629_P2 | R36629_T4 (SEQ ID NO: 1544); R36629_T15 (SEQ ID NO: 1548) |

These sequences are variants of the known protein Hypothetical protein KIAA0101 (SwissProt accession identifier Y101_HUMAN), referred to herein as the previously known protein.

The sequence for protein Hypothetical protein KIAA0101 is given at the end of the application, as "Hypothetical protein KIAA0101 amino acid sequence".

Cluster R36629 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 38 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 38 and Table 1445. This cluster is overexpressed (at least at a minimum level) in the following pathological conditions: transitional cell carcinoma, brain malignant tumors, epithelial malignant tumors, a mixture of malignant tumors from different tissues, malignant tumors involving the bone marrow and uterine malignancies.

TABLE 4

Normal tissue distribution

| Name of Tissue | Number |
|---|---|
| Adrenal | 0 |
| Bladder | 0 |
| Bone | 6 |
| Brain | 3 |
| Colon | 94 |
| Epithelial | 19 |
| General | 33 |
| head and neck | 131 |
| Kidney | 2 |
| Liver | 24 |
| Lung | 62 |
| lymph nodes | 248 |
| Breast | 0 |
| bone marrow | 62 |
| Muscle | 38 |
| Ovary | 0 |
| Pancreas | 10 |
| Prostate | 0 |
| Skin | 13 |
| Stomach | 0 |
| T cells | 585 |
| Uterus | 0 |

TABLE 1445

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 5.3e−01 | 1.9 |
| bladder | 5.4e−01 | 1.8e−01 | 5.6e−01 | 1.8 | 4.5e−05 | 3.3 |
| bone | 5.5e−01 | 3.1e−01 | 1 | 1.1 | 8.3e−02 | 2.7 |
| brain | 1.4e−01 | 2.1e−02 | 3.9e−01 | 2.7 | 7.4e−08 | 8.3 |
| colon | 6.3e−01 | 6.6e−01 | 9.7e−01 | 0.6 | 9.7e−01 | 0.5 |
| epithelial | 6.1e−02 | 2.3e−05 | 1.3e−01 | 1.3 | 2.6e−12 | 4.1 |
| general | 4.9e−02 | 3.7e−08 | 8.5e−01 | 0.7 | 1.4e−21 | 3.0 |
| head and neck | 6.5e−01 | 6.7e−01 | 1 | 0.5 | 8.0e−02 | 0.7 |
| kidney | 8.6e−01 | 8.0e−01 | 1 | 1.1 | 5.7e−02 | 1.8 |
| liver | 8.3e−01 | 3.0e−01 | 1 | 0.7 | 4.8e−01 | 1.5 |
| lung | 6.4e−01 | 3.6e−01 | 9.0e−01 | 0.5 | 8.1e−01 | 0.8 |
| lymph nodes | 4.0e−01 | 2.9e−01 | 9.5e−01 | 0.4 | 9.9e−01 | 0.4 |
| breast | 1.1e−01 | 7.2e−02 | 4.7e−01 | 2.0 | 4.6e−01 | 1.9 |
| bone marrow | 6.5e−01 | 6.2e−01 | 1 | 0.7 | 4.1e−09 | 5.9 |
| muscle | 8.5e−01 | 6.1e−01 | 1 | 0.3 | 7.7e−01 | 0.8 |
| ovary | 4.0e−01 | 2.8e−01 | 3.2e−01 | 1.9 | 2.6e−01 | 2.2 |
| pancreas | 2.1e−01 | 1.7e−01 | 3.9e−01 | 1.9 | 2.2e−01 | 2.3 |
| prostate | 1 | 7.8e−01 | 1 | 1.0 | 5.6e−03 | 1.7 |
| skin | 4.0e−01 | 8.7e−02 | 2.6e−01 | 3.5 | 1.1e−01 | 2.2 |
| stomach | 1 | 3.0e−02 | 1 | 1.0 | 2.2e−02 | 4.3 |
| T cells | 3.3e−01 | 5.0e−01 | 1 | 0.3 | 9.8e−01 | 0.4 |
| uterus | 2.1e−01 | 2.4e−02 | 8.5e−02 | 2.5 | 9.4e−03 | 5.3 |

As noted above, cluster R36629 features 14 segment(s), which were listed in Table 1443 above and for which the sequence(s) are given at the end of the application. These segment(s) are portions of nucleic acid sequence(s) which are described herein separately because they are of particular interest. A description of each segment according to the present invention is now provided.

Segment cluster R36629_node_0 (SEQ ID NO:1549) according to the present invention is supported by 5 libraries. The number of libraries was determined as previously described. This segment can be found in the following transcript(s): R36629_T4 (SEQ ID NO:1544) and R36629_T15 (SEQ ID NO:1548). Table 1447 below describes the starting and ending position of this segment on each transcript.

TABLE 1446

Segment location on transcripts

| Transcript name | Segment starting position | Segment ending position |
|---|---|---|
| R36629_T4 (SEQ ID NO: 1544) | 1 | 597 |
| R36629_T15 (SEQ ID NO: 1548) | 1 | 597 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1448.

TABLE 1447

Oligonucleotides related to this segment

| Oligonucleotide name | Overexpressed in cancers | Chip reference |
|---|---|---|
| T77560_0_0_55156 | breast malignant tumors | BRS |

This segment can be found in the following protein(s): R36629_P2.

Segment cluster R36629_node_3 (SEQ ID NO:1550) according to the present invention is supported by 1 libraries. The number of libraries was determined as previously described. This segment can be found in the following transcript(s): R36629_T15 (SEQ ID NO:1548). Table 1449 below describes the starting and ending position of this segment on each transcript.

TABLE 1448

Segment location on transcripts

| Transcript name | Segment starting position | Segment ending position |
|---|---|---|
| R36629_T15 (SEQ ID NO: 1548) | 598 | 1172 |

This segment can be found in a non-coding region of transcript(s) that are related to the following protein(s): R36629_P2.

Segment cluster R36629_node_5 (SEQ ID NO:1551) according to the present invention is supported by 151 libraries. The number of libraries was determined as previously described. This segment can be found in the following transcript(s): R36629_T10 (SEQ ID NO:1546) and R36629_T13 (SEQ ID NO:1547). Table 1450 below describes the starting and ending position of this segment on each transcript.

TABLE 1449

Segment location on transcripts

| Transcript name | Segment starting position | Segment ending position |
|---|---|---|
| R36629_T10 (SEQ ID NO: 1546) | 1 | 185 |
| R36629_T13 (SEQ ID NO: 1547) | 1 | 185 |

The previously-described transcripts for these segment(s) do not code for protein.

Segment cluster R36629_node_12 (SEQ ID NO:1552) according to the present invention is supported by 2 libraries. The number of libraries was determined as previously described. This segment can be found in the following transcript(s): R36629_T13 (SEQ ID NO:1547). Table 1451 below describes the starting and ending position of this segment on each transcript.

TABLE 1450

Segment location on transcripts

| Transcript name | Segment starting position | Segment ending position |
|---|---|---|
| R36629_T13 (SEQ ID NO: 1547) | 267 | 493 |

The previously-described transcripts for these segment(s) do not code for protein.

Segment cluster R36629_node_15 (SEQ ID NO:1553) according to the present invention is supported by 173 libraries. The number of libraries was determined as previously described. This segment can be found in the following transcript(s): R36629_T4 (SEQ ID NO:1544) and R36629_T5 (SEQ ID NO:1545). Table 1452 below describes the starting and ending position of this segment on each transcript.

TABLE 1451

Segment location on transcripts

| Transcript name | Segment starting position | Segment ending position |
|---|---|---|
| R36629_T4 (SEQ ID NO: 1544) | 679 | 841 |
| R36629_T5 (SEQ ID NO: 1545) | 200 | 362 |

This segment can be found in a non-coding region of transcript(s) that are related to the following protein(s): R36629_P2.

Segment cluster R36629_node_24 (SEQ ID NO:1554) according to the present invention is supported by 112 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1453 below describes the starting and ending position of this segment on each transcript.

TABLE 1452

Segment location on transcripts

| Transcript name | Segment starting position | Segment ending position |
|---|---|---|
| R36629_T4 (SEQ ID NO: 1544) | 1195 | 1333 |
| R36629_T5 (SEQ ID NO: 1545) | 716 | 854 |
| R36629_T10 (SEQ ID NO: 1546) | 620 | 1328 |

This segment can be found in a non-coding region of transcript(s) that are related to the following protein(s): R36629_P2.

According to an optional embodiment of the present invention, short segments related to the above cluster are also provided. These segments are up to about 120 bp in length, and so are included in a separate description.

Segment cluster R36629_node_7 (SEQ ID NO:1555) according to the present invention is supported by 1 libraries. The number of libraries was determined as previously described. This segment can be found in the following transcript(s): R36629_T5 (SEQ ID NO:1545). Table 1454 below describes the starting and ending position of this segment on each transcript.

TABLE 1453

Segment location on transcripts

| Transcript name | Segment starting position | Segment ending position |
|---|---|---|
| R36629_T5 (SEQ ID NO: 1545) | 1 | 118 |

The previously-described transcripts for these segment(s) do not code for protein.

Segment cluster R36629_node_8 (SEQ ID NO:1556) according to the present invention is supported by 173 libraries. The number of libraries was determined as previously described. This segment can be found in the following transcript(s): R36629_T4 (SEQ ID NO:1544), R36629_T5 (SEQ ID NO:1545), R36629_T10 (SEQ ID NO:1546) and R36629_T13 (SEQ ID NO:1547). Table 1455 below describes the starting and ending position of this segment on each transcript.

TABLE 1454

Segment location on transcripts

| Transcript name | Segment starting position | Segment ending position |
|---|---|---|
| R36629_T4 (SEQ ID NO: 1544) | 598 | 678 |
| R36629_T5 (SEQ ID NO: 1545) | 119 | 199 |
| R36629_T10 (SEQ ID NO: 1546) | 186 | 266 |
| R36629_T13 (SEQ ID NO: 1547) | 186 | 266 |

This segment can be found in a non-coding region of transcript(s) that are related to the following protein(s): R36629_P2.

Segment cluster R36629_node_18 (SEQ ID NO:1557) according to the present invention is supported by 160 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1456 below describes the starting and ending position of this segment on each transcript.

TABLE 1455

Segment location on transcripts

| Transcript name | Segment starting position | Segment ending position |
|---|---|---|
| R36629_T4 (SEQ ID NO: 1544) | 842 | 902 |
| R36629_T5 (SEQ ID NO: 1545) | 363 | 423 |
| R36629_T10 (SEQ ID NO: 1546) | 267 | 327 |

This segment can be found in a non-coding region of transcript(s) that are related to the following protein(s): R36629_P2.

Segment cluster R36629_node_19 (SEQ ID NO:1558) according to the present invention can be found in the following transcript(s): R36629_T4 (SEQ ID NO:1544), R36629_T5 (SEQ ID NO:1545) and R36629_T10 (SEQ ID NO:1546). Table 1457 below describes the starting and ending position of this segment on each transcript.

TABLE 1456

Segment location on transcripts

| Transcript name | Segment starting position | Segment ending position |
|---|---|---|
| R36629_T4 (SEQ ID NO: 1544) | 903 | 927 |
| R36629_T5 (SEQ ID NO: 1545) | 424 | 448 |
| R36629_T10 (SEQ ID NO: 1546) | 328 | 352 |

This segment can be found in a non-coding region of transcript(s) that are related to the following protein(s): R36629_P2.

Segment cluster R36629_node_20 (SEQ ID NO:1559) according to the present invention is supported by 162 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1458 below describes the starting and ending position of this segment on each transcript.

TABLE 1457

Segment location on transcripts

| Transcript name | Segment starting position | Segment ending position |
|---|---|---|
| R36629_T4 (SEQ ID NO: 1544) | 928 | 1024 |
| R36629_T5 (SEQ ID NO: 1545) | 449 | 545 |
| R36629_T10 (SEQ ID NO: 1546) | 353 | 449 |

This segment can be found in a non-coding region of transcript(s) that are related to the following protein(s): R36629_P2.

Segment cluster R36629_node_21 (SEQ ID NO:1560) according to the present invention is supported by 138 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1459 below describes the starting and ending position of this segment on each transcript.

TABLE 1458

Segment location on transcripts

| Transcript name | Segment starting position | Segment ending position |
|---|---|---|
| R36629_T4 (SEQ ID NO: 1544) | 1025 | 1079 |
| R36629_T5 (SEQ ID NO: 1545) | 546 | 600 |
| R36629_T10 (SEQ ID NO: 1546) | 450 | 504 |

This segment can be found in a non-coding region of transcript(s) that are related to the following protein(s): R36629_P2.

Segment cluster R36629_node_22 (SEQ ID NO:1561) according to the present invention is supported by 131 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1460 below describes the starting and ending position of this segment on each transcript.

TABLE 1459

Segment location on transcripts

| Transcript name | Segment starting position | Segment ending position |
|---|---|---|
| R36629_T4 (SEQ ID NO: 1544) | 1080 | 1140 |
| R36629_T5 (SEQ ID NO: 1545) | 601 | 661 |
| R36629_T10 (SEQ ID NO: 1546) | 505 | 565 |

This segment can be found in a non-coding region of transcript(s) that are related to the following protein(s): R36629_P2.

Segment cluster R36629_node_23 (SEQ ID NO:1562) according to the present invention is supported by 123 libraries. The number of libraries was determined as previously described. This segment can be found in the following transcript(s): R36629_T4 (SEQ ID NO:1544), R36629_T5 (SEQ ID NO:1545) and R36629_T10 (SEQ ID NO:1546). Table 1461 below describes the starting and ending position of this segment on each transcript.

TABLE 1460

Segment location on transcripts

| Transcript name | Segment starting position | Segment ending position |
|---|---|---|
| R36629_T4 (SEQ ID NO: 1544) | 1141 | 1194 |
| R36629_T5 (SEQ ID NO: 1545) | 662 | 715 |
| R36629_T10 (SEQ ID NO: 1546) | 566 | 619 |

This segment can be found in a non-coding region of transcript(s) that are related to the following protein(s): R36629_P2.

Description for Cluster R47363

Cluster R47363 features 10 transcript(s) and 45 segment(s) of interest, the names for which are given in Tables 1461 and 1462, respectively, the sequences themselves are given at the end of the application. The selected protein variants are given in Table 1463.

TABLE 1461

Transcripts of interest
Transcript Name

R47363_T3 (SEQ ID NO: 1563)
R47363_T22 (SEQ ID NO: 1564)
R47363_T23 (SEQ ID NO: 1565)
R47363_T25 (SEQ ID NO: 1566)
R47363_T28 (SEQ ID NO: 1567)
R47363_T29 (SEQ ID NO: 1568)
R47363_T30 (SEQ ID NO: 1569)
R47363_T35 (SEQ ID NO: 1570)
R47363_T38 (SEQ ID NO: 1571)
R47363_T40 (SEQ ID NO: 1572)

TABLE 1462

Segments of interest
Segment Name

R47363_node_5 (SEQ ID NO: 1573)
R47363_node_11 (SEQ ID NO: 1574)
R47363_node_12 (SEQ ID NO: 1575)
R47363_node_26 (SEQ ID NO: 1576)
R47363_node_33 (SEQ ID NO: 1577)
R47363_node_35 (SEQ ID NO: 1578)
R47363_node_40 (SEQ ID NO: 1579)
R47363_node_43 (SEQ ID NO: 1580)
R47363_node_45 (SEQ ID NO: 1581)
R47363_node_46 (SEQ ID NO: 1582)
R47363_node_47 (SEQ ID NO: 1583)
R47363_node_53 (SEQ ID NO: 1584)
R47363_node_55 (SEQ ID NO: 1585)
R47363_node_57 (SEQ ID NO: 1586)
R47363_node_64 (SEQ ID NO: 1587)
R47363_node_67 (SEQ ID NO: 1588)
R47363_node_68 (SEQ ID NO: 1589)
R47363_node_77 (SEQ ID NO: 1590)
R47363_node_78 (SEQ ID NO: 1591)
R47363_node_0 (SEQ ID NO: 1592)
R47363_node_2 (SEQ ID NO: 1593)
R47363_node_14 (SEQ ID NO: 1594)
R47363_node_15 (SEQ ID NO: 1595)
R47363_node_16 (SEQ ID NO: 1596)
R47363_node_18 (SEQ ID NO: 1597)
R47363_node_20 (SEQ ID NO: 1598)
R47363_node_21 (SEQ ID NO: 1599)
R47363_node_22 (SEQ ID NO: 1600)
R47363_node_24 (SEQ ID NO: 1601)
R47363_node_27 (SEQ ID NO: 1602)
R47363_node_28 (SEQ ID NO: 1603)
R47363_node_29 (SEQ ID NO: 1604)

TABLE 1462-continued

Segments of interest
Segment Name

R47363_node_32 (SEQ ID NO: 1605)
R47363_node_37 (SEQ ID NO: 1606)
R47363_node_41 (SEQ ID NO: 1607)
R47363_node_49 (SEQ ID NO: 1608)
R47363_node_51 (SEQ ID NO: 1609)
R47363_node_59 (SEQ ID NO: 1610)
R47363_node_60 (SEQ ID NO: 1611)
R47363_node_62 (SEQ ID NO: 1612)
R47363_node_66 (SEQ ID NO: 1613)
R47363_node_69 (SEQ ID NO: 1614)
R47363_node_72 (SEQ ID NO: 1615)
R47363_node_74 (SEQ ID NO: 1616)
R47363_node_76 (SEQ ID NO: 1617)

TABLE 1463

Proteins of interest

| Protein Name | Corresponding Transcript(s) |
| --- | --- |
| R47363_P4 | R47363_T3 (SEQ ID NO: 1563) |
| R47363_P8 | R47363_T22 (SEQ ID NO: 1564) |
| R47363_P13 | R47363_T23 (SEQ ID NO: 1565) |
| R47363_P15 | R47363_T25 (SEQ ID NO: 1566) |
| R47363_P17 | R47363_T30 (SEQ ID NO: 1569) |
| R47363_P18 | R47363_T28 (SEQ ID NO: 1567) |
| R47363_P19 | R47363_T29 (SEQ ID NO: 1568) |
| R47363_P22 | R47363_T35 (SEQ ID NO: 1570) |
| R47363_P25 | R47363_T38 (SEQ ID NO: 1571) |
| R47363_P27 | R47363_T40 (SEQ ID NO: 1572) |

Cluster R47363 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 39 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 39 and Table 1464. This cluster is overexpressed (at least at a minimum level) in the following pathological conditions: pancreas carcinoma and prostate cancer.

TABLE 1464

Normal tissue distribution

| Name of Tissue | Number |
| --- | --- |
| bladder | 0 |
| bone | 64 |
| brain | 10 |
| colon | 249 |
| epithelial | 36 |
| general | 21 |
| kidney | 26 |
| breast | 4 |
| ovary | 0 |
| pancreas | 2 |
| prostate | 20 |
| stomach | 109 |

TABLE 1465

P values and ratios for expression in cancerous tissue

| Name of Tissue | P1 | P2 | SP1 | R3 | SP2 | R4 |
| --- | --- | --- | --- | --- | --- | --- |
| bladder | 1.5e−01 | 2.1e−01 | 1.0e−01 | 4.2 | 2.1e−01 | 2.9 |
| bone | 2.3e−01 | 7.3e−01 | 5.3e−01 | 1.3 | 9.2e−01 | 0.6 |
| brain | 8.9e−01 | 8.2e−01 | 1 | 0.2 | 1.8e−02 | 1.5 |
| colon | 8.1e−01 | 8.4e−01 | 1 | 0.2 | 1 | 0.2 |
| epithelial | 1.5e−01 | 6.4e−01 | 8.1e−06 | 2.3 | 9.4e−02 | 1.2 |
| general | 4.6e−02 | 4.2e−01 | 3.0e−11 | 3.0 | 1.7e−04 | 1.7 |
| kidney | 6.6e−01 | 7.0e−01 | 6.2e−01 | 1.3 | 7.8e−01 | 1.0 |
| breast | 8.2e−01 | 7.3e−01 | 4.7e−01 | 1.7 | 5.6e−01 | 1.5 |
| ovary | 2.2e−01 | 2.6e−01 | 2.2e−01 | 2.9 | 3.4e−01 | 2.2 |
| pancreas | 3.5e−02 | 4.9e−02 | 5.7e−03 | 6.5 | 1.1e−02 | 5.3 |
| prostate | 1.5e−01 | 2.4e−01 | 1.2e−07 | 9.8 | 1.7e−05 | 6.9 |
| stomach | 7.1e−01 | 8.8e−01 | 1 | 0.3 | 1 | 0.3 |

As noted above, cluster R47363 features 45 segment(s), which were listed in Table 1462 above and for which the sequence(s) are given at the end of the application. These segment(s) are portions of nucleic acid sequence(s) which are described herein separately because they are of particular interest. A description of each segment according to the present invention is now provided.

Segment cluster R47363_node_5 (SEQ ID NO:1573) according to the present invention is supported by 12 libraries. The number of libraries was determined as previously described. This segment can be found in the following transcript(s): R47363_T22 (SEQ ID NO:1564) and R47363_T38 (SEQ ID NO:1571). Table 1466 below describes the starting and ending position of this segment on each transcript.

TABLE 1466

Segment location on transcripts

| Transcript name | Segment starting position | Segment ending position |
| --- | --- | --- |
| R47363_T22 (SEQ ID NO: 1564) | 188 | 362 |
| R47363_T38 (SEQ ID NO: 1571) | 188 | 362 |

This segment can be found in both coding and non-coding regions of transcript(s) as follows. The segment can be found in a non-coding region of transcript(s) that are related to the following protein(s): R47363_P8. This segment can also be found in the following protein(s): R47363_P25, since it is in the coding region for the corresponding transcript.

Segment cluster R47363_node_11 (SEQ ID NO:1574) according to the present invention is supported by 7 libraries. The number of libraries was determined as previously described. This segment can be found in the following transcript(s): R47363_T3 (SEQ ID NO:1563), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T35 (SEQ ID NO:1570). Table 1467 below describes the starting and ending position of this segment on each transcript.

TABLE 1467

Segment location on transcripts

| Transcript name | Segment starting position | Segment ending position |
| --- | --- | --- |
| R47363_T3 (SEQ ID NO: 1563) | 1 | 199 |
| R47363_T23 (SEQ ID NO: 1565) | 1 | 199 |

TABLE 1467-continued

Segment location on transcripts

| Transcript name | Segment starting position | Segment ending position |
|---|---|---|
| R47363_T25 (SEQ ID NO: 1566) | 1 | 199 |
| R47363_T28 (SEQ ID NO: 1567) | 1 | 199 |
| R47363_T29 (SEQ ID NO: 1568) | 1 | 199 |
| R47363_T30 (SEQ ID NO: 1569) | 1 | 199 |
| R47363_T35 (SEQ ID NO: 1570) | 1 | 199 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P13, R47363_P15, R47363_P19, R47363_P17 and R47363_P22, since it is in the coding region for the corresponding transcript.

Segment cluster R47363_node_12 (SEQ ID NO:1575) according to the present invention is supported by 16 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1468 below describes the starting and ending position of this segment on each transcript.

TABLE 1468

Segment location on transcripts

| Transcript name | Segment starting position | Segment ending position |
|---|---|---|
| R47363_T3 (SEQ ID NO: 1563) | 200 | 380 |
| R47363_T22 (SEQ ID NO: 1564) | 363 | 543 |
| R47363_T23 (SEQ ID NO: 1565) | 200 | 380 |
| R47363_T25 (SEQ ID NO: 1566) | 200 | 380 |
| R47363_T28 (SEQ ID NO: 1567) | 200 | 380 |
| R47363_T29 (SEQ ID NO: 1568) | 200 | 380 |
| R47363_T30 (SEQ ID NO: 1569) | 200 | 380 |
| R47363_T35 (SEQ ID NO: 1570) | 200 | 380 |
| R47363_T38 (SEQ ID NO: 1571) | 363 | 543 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_26 (SEQ ID NO:1576) according to the present invention is supported by 1 libraries. The number of libraries was determined as previously described. This segment can be found in the following transcript(s): R47363_T38 (SEQ ID NO:1571). Table 1469 below describes the starting and ending position of this segment on each transcript.

TABLE 1469

Segment location on transcripts

| Transcript name | Segment starting position | Segment ending position |
|---|---|---|
| R47363_T38 (SEQ ID NO: 1571) | 954 | 1112 |

This segment can be found in the following protein(s): R47363_P25.

Segment cluster R47363_node_33 (SEQ ID NO:1577) according to the present invention is supported by 5 libraries. The number of libraries was determined as previously described. This segment can be found in the following transcript(s): R47363_T35 (SEQ ID NO:1570) and R47363_T38 (SEQ ID NO:1571). Table 1470 below describes the starting and ending position of this segment on each transcript.

TABLE 1470

Segment location on transcripts

| Transcript name | Segment starting position | Segment ending position |
|---|---|---|
| R47363_T35 (SEQ ID NO: 1570) | 1083 | 1496 |
| R47363_T38 (SEQ ID NO: 1571) | 1405 | 1818 |

This segment can be found in both coding and non-coding regions of transcript(s) as follows. The segment can be found in a non-coding region of transcript(s) that are related to the following protein(s): R47363_P25. This segment can also be found in the following protein(s): R47363_P22, since it is in the coding region for the corresponding transcript.

Segment cluster R47363_node_35 (SEQ ID NO:1578) according to the present invention is supported by 3 libraries. The number of libraries was determined as previously described. This segment can be found in the following transcript(s): R47363_T22 (SEQ ID NO:1564) and R47363_T28 (SEQ ID NO:1567). Table 1471 below describes the starting and ending position of this segment on each transcript.

TABLE 1471

Segment location on transcripts

| Transcript name | Segment starting position | Segment ending position |
|---|---|---|
| R47363_T22 (SEQ ID NO: 1564) | 1236 | 1357 |
| R47363_T28 (SEQ ID NO: 1567) | 1083 | 1204 |

This segment can be found in a non-coding region of transcript(s) that are related to the following protein(s): R47363_P8 and R47363_P18.

Segment cluster R47363_node_40 (SEQ ID NO:1579) according to the present invention is supported by 52 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1472 below describes the starting and ending position of this segment on each transcript.

TABLE 1472

Segment location on transcripts

| Transcript name | Segment starting position | Segment ending position |
|---|---|---|
| R47363_T3 (SEQ ID NO: 1563) | 1196 | 1485 |
| R47363_T22 (SEQ ID NO: 1564) | 1358 | 1647 |
| R47363_T23 (SEQ ID NO: 1565) | 1196 | 1485 |
| R47363_T25 (SEQ ID NO: 1566) | 1196 | 1485 |
| R47363_T28 (SEQ ID NO: 1567) | 1205 | 1494 |
| R47363_T29 (SEQ ID NO: 1568) | 1196 | 1485 |
| R47363_T30 (SEQ ID NO: 1569) | 1196 | 1485 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P8, R47363_P13, R47363_P15, R47363_P19 and R47363_P17, since it is in the coding region for the corresponding transcript.

Segment cluster R47363_node__43 (SEQ ID NO:1580) according to the present invention is supported by 48 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1473 below describes the starting and ending position of this segment on each transcript.

TABLE 1473

Segment location on transcripts

| Transcript name | Segment starting position | Segment ending position |
|---|---|---|
| R47363_T3 (SEQ ID NO: 1563) | 1541 | 1675 |
| R47363_T22 (SEQ ID NO: 1564) | 1703 | 1837 |
| R47363_T23 (SEQ ID NO: 1565) | 1541 | 1675 |
| R47363_T25 (SEQ ID NO: 1566) | 1541 | 1675 |
| R47363_T28 (SEQ ID NO: 1567) | 1550 | 1684 |
| R47363_T29 (SEQ ID NO: 1568) | 1541 | 1675 |
| R47363_T30 (SEQ ID NO: 1569) | 1541 | 1675 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P8, R47363_P13, R47363_P15, R47363_P19 and R47363_P17, since it is in the coding region for the corresponding transcript.

Segment cluster R47363_node__45 (SEQ ID NO:1581) according to the present invention is supported by 47 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1474 below describes the starting and ending position of this segment on each transcript.

TABLE 1474

Segment location on transcripts

| Transcript name | Segment starting position | Segment ending position |
|---|---|---|
| R47363_T3 (SEQ ID NO: 1563) | 1676 | 1805 |
| R47363_T22 (SEQ ID NO: 1564) | 1838 | 1967 |
| R47363_T23 (SEQ ID NO: 1565) | 1676 | 1805 |
| R47363_T25 (SEQ ID NO: 1566) | 1676 | 1805 |
| R47363_T28 (SEQ ID NO: 1567) | 1685 | 1814 |
| R47363_T29 (SEQ ID NO: 1568) | 1676 | 1805 |
| R47363_T30 (SEQ ID NO: 1569) | 1676 | 1805 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P8, R47363_P13, R47363_P15, R47363_P19 and R47363_P17, since it is in the coding region for the corresponding transcript.

Segment cluster R47363_node__46 (SEQ ID NO:1582) according to the present invention is supported by 3 libraries. The number of libraries was determined as previously described. This segment can be found in the following transcript(s): R47363_T28 (SEQ ID NO:1567). Table 1475 below describes the starting and ending position of this segment on each transcript.

TABLE 1475

Segment location on transcripts

| Transcript name | Segment starting position | Segment ending position |
|---|---|---|
| R47363_T28 (SEQ ID NO: 1567) | 1815 | 1989 |

This segment can be found in a non-coding region of transcript(s) that are related to the following protein(s): R47363_P18.

Segment cluster R47363_node__47 (SEQ ID NO:1583) according to the present invention is supported by 45 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1476 below describes the starting and ending position of this segment on each transcript.

TABLE 1476

Segment location on transcripts

| Transcript name | Segment starting position | Segment ending position |
|---|---|---|
| R47363_T3 (SEQ ID NO: 1563) | 1806 | 1951 |
| R47363_T22 (SEQ ID NO: 1564) | 1968 | 2113 |
| R47363_T23 (SEQ ID NO: 1565) | 1806 | 1951 |
| R47363_T25 (SEQ ID NO: 1566) | 1806 | 1951 |
| R47363_T28 (SEQ ID NO: 1567) | 1990 | 2135 |
| R47363_T29 (SEQ ID NO: 1568) | 1806 | 1951 |
| R47363_T30 (SEQ ID NO: 1569) | 1806 | 1951 |

This segment can be found in the following protein(s): R47363_P4, R47363_P8, R47363_P13, R47363_P15, R47363_P18, R47363_P19 and R47363_P17.

Segment cluster R47363_node_53 (SEQ ID NO:1584) according to the present invention is supported by 57 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1477 below describes the starting and ending position of this segment on each transcript.

TABLE 1477

Segment location on transcripts

| Transcript name | Segment starting position | Segment ending position |
|---|---|---|
| R47363_T3 (SEQ ID NO: 1563) | 2143 | 2577 |
| R47363_T22 (SEQ ID NO: 1564) | 2305 | 2739 |
| R47363_T23 (SEQ ID NO: 1565) | 2143 | 2577 |
| R47363_T25 (SEQ ID NO: 1566) | 2143 | 2577 |
| R47363_T28 (SEQ ID NO: 1567) | 2327 | 2761 |
| R47363_T29 (SEQ ID NO: 1568) | 2143 | 2577 |
| R47363_T30 (SEQ ID NO: 1569) | 2143 | 2577 |

This segment can be found in the following protein(s): R47363_P4, R47363_P8, R47363_P13, R47363_P15, R47363_P18, R47363_P19 and R47363_P17.

Segment cluster R47363_node_55 (SEQ ID NO:1585) according to the present invention is supported by 55 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1478 below describes the starting and ending position of this segment on each transcript.

TABLE 1478

Segment location on transcripts

| Transcript name | Segment starting position | Segment ending position |
|---|---|---|
| R47363_T3 (SEQ ID NO: 1563) | 2578 | 2710 |
| R47363_T22 (SEQ ID NO: 1564) | 2740 | 2872 |
| R47363_T23 (SEQ ID NO: 1565) | 2578 | 2710 |
| R47363_T25 (SEQ ID NO: 1566) | 2578 | 2710 |
| R47363_T28 (SEQ ID NO: 1567) | 2762 | 2894 |
| R47363_T29 (SEQ ID NO: 1568) | 2578 | 2710 |
| R47363_T30 (SEQ ID NO: 1569) | 2578 | 2710 |

This segment can be found in the following protein(s): R47363_P4, R47363_P8, R47363_P13, R47363_P15, R47363_P18, R47363_P19 and R47363_P17.

Segment cluster R47363_node_57 (SEQ ID NO:1586) according to the present invention is supported by 91 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1479 below describes the starting and ending position of this segment on each transcript.

TABLE 1479

Segment location on transcripts

| Transcript name | Segment starting position | Segment ending position |
|---|---|---|
| R47363_T3 (SEQ ID NO: 1563) | 2711 | 2885 |
| R47363_T22 (SEQ ID NO: 1564) | 2873 | 3047 |
| R47363_T23 (SEQ ID NO: 1565) | 2711 | 2885 |
| R47363_T25 (SEQ ID NO: 1566) | 2711 | 2885 |
| R47363_T28 (SEQ ID NO: 1567) | 2895 | 3069 |
| R47363_T29 (SEQ ID NO: 1568) | 2711 | 2885 |
| R47363_T30 (SEQ ID NO: 1569) | 2711 | 2885 |

This segment can be found in the following protein(s): R47363_P4, R47363_P8, R47363_P13, R47363_P15, R47363_P18, R47363_P19 and R47363_P17.

Segment cluster R47363_node_64 (SEQ ID NO:1587) according to the present invention is supported by 86 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1480 below describes the starting and ending position of this segment on each transcript.

TABLE 1480

Segment location on transcripts

| Transcript name | Segment starting position | Segment ending position |
|---|---|---|
| R47363_T3 (SEQ ID NO: 1563) | 3064 | 3260 |
| R47363_T22 (SEQ ID NO: 1564) | 3226 | 3422 |
| R47363_T23 (SEQ ID NO: 1565) | 3064 | 3260 |
| R47363_T25 (SEQ ID NO: 1566) | 3064 | 3260 |
| R47363_T28 (SEQ ID NO: 1567) | 3248 | 3444 |
| R47363_T29 (SEQ ID NO: 1568) | 3177 | 3373 |
| R47363_T30 (SEQ ID NO: 1569) | 3064 | 3260 |

This segment can be found in both coding and non-coding regions of transcript(s) as follows. The segment can be found in a non-coding region of transcript(s) that are related to the following protein(s): R47363_P19. This segment can also be found in the following protein(s): R47363_P4, R47363_P8, R47363_P13, R47363_P15, R47363_P18 and R47363_P17, since it is in the coding region for the corresponding transcript.

Segment cluster R47363_node_67 (SEQ ID NO:1588) according to the present invention is supported by 92 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T40 (SEQ ID NO:1572). Table 1481 below describes the starting and ending position of this segment on each transcript.

TABLE 1481

Segment location on transcripts

| Transcript name | Segment starting position | Segment ending position |
|---|---|---|
| R47363_T3 (SEQ ID NO: 1563) | 3261 | 3393 |
| R47363_T22 (SEQ ID NO: 1564) | 3423 | 3555 |
| R47363_T23 (SEQ ID NO: 1565) | 3261 | 3393 |
| R47363_T25 (SEQ ID NO: 1566) | 3261 | 3393 |
| R47363_T28 (SEQ ID NO: 1567) | 3445 | 3577 |
| R47363_T29 (SEQ ID NO: 1568) | 3374 | 3506 |
| R47363_T30 (SEQ ID NO: 1569) | 3261 | 3393 |
| R47363_T40 (SEQ ID NO: 1572) | 110 | 242 |

This segment can be found in both coding and non-coding regions of transcript(s) as follows. The segment can be found in a non-coding region of transcript(s) that are related to the following protein(s): R47363_P19. This segment can also be found in the following protein(s): R47363_P4, R47363_P8, R47363_P13, R47363_P15, R47363_P18, R47363_P17 and R47363_P27, since it is in the coding region for the corresponding transcript.

Segment cluster R47363_node_68 (SEQ ID NO:1589) according to the present invention is supported by 2 libraries. The number of libraries was determined as previously described. This segment can be found in the following transcript(s): R47363_T25 (SEQ ID NO:1566). Table 1482 below describes the starting and ending position of this segment on each transcript.

TABLE 1482

Segment location on transcripts

| Transcript name | Segment starting position | Segment ending position |
|---|---|---|
| R47363_T25 (SEQ ID NO: 1566) | 3394 | 3565 |

This segment can be found in the following protein(s): R47363_P15.

Segment cluster R47363_node_77 (SEQ ID NO:1590) according to the present invention is supported by 3 libraries. The number of libraries was determined as previously described. This segment can be found in the following transcript(s): R47363_T23 (SEQ ID NO:1565), R47363_T30 (SEQ ID NO:1569) and R47363_T40 (SEQ ID NO:1572). Table 1483 below describes the starting and ending position of this segment on each transcript.

TABLE 1483

Segment location on transcripts

| Transcript name | Segment starting position | Segment ending position |
|---|---|---|
| R47363_T23 (SEQ ID NO: 1565) | 3573 | 3796 |
| R47363_T30 (SEQ ID NO: 1569) | 3500 | 3723 |
| R47363_T40 (SEQ ID NO: 1572) | 422 | 645 |

This segment can be found in both coding and non-coding regions of transcript(s) as follows. The segment can be found in a non-coding region of transcript(s) that are related to the following protein(s): R47363_P17. This segment can also be found in the following protein(s): R47363_P13 and R47363_P27, since it is in the coding region for the corresponding transcript.

Segment cluster R47363_node_78 (SEQ ID NO:1591) according to the present invention is supported by 94 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T40 (SEQ ID NO:1572). Table 1484 below describes the starting and ending position of this segment on each transcript.

TABLE 1484

Segment location on transcripts

| Transcript name | Segment starting position | Segment ending position |
|---|---|---|
| R47363_T3 (SEQ ID NO: 1563) | 3573 | 3915 |
| R47363_T22 (SEQ ID NO: 1564) | 3735 | 4077 |
| R47363_T23 (SEQ ID NO: 1565) | 3797 | 4139 |
| R47363_T25 (SEQ ID NO: 1566) | 3745 | 4087 |
| R47363_T28 (SEQ ID NO: 1567) | 3757 | 4099 |
| R47363_T29 (SEQ ID NO: 1568) | 3686 | 4028 |
| R47363_T30 (SEQ ID NO: 1569) | 3724 | 4066 |
| R47363_T40 (SEQ ID NO: 1572) | 646 | 988 |

This segment can be found in both coding and non-coding regions of transcript(s) as follows. The segment can be found in a non-coding region of transcript(s) that are related to the following protein(s): R47363_P15, R47363_P19 and R47363_P17. This segment can also be found in the following protein(s): R47363_P4, R47363_P8, R47363_P13, R47363_P18 and R47363_P27, since it is in the coding region for the corresponding transcript.

According to an optional embodiment of the present invention, short segments related to the above cluster are also provided. These segments are up to about 120 bp in length, and so are included in a separate description.

Segment cluster R47363_node_0 (SEQ ID NO:1592) according to the present invention is supported by 13 libraries. The number of libraries was determined as previously described. This segment can be found in the following transcript(s): R47363_T22 (SEQ ID NO:1564) and R47363_T38 (SEQ ID NO:1571). Table 1485 below describes the starting and ending position of this segment on each transcript.

TABLE 1485

Segment location on transcripts

| Transcript name | Segment starting position | Segment ending position |
|---|---|---|
| R47363_T22 (SEQ ID NO: 1564) | 1 | 119 |
| R47363_T38 (SEQ ID NO: 1571) | 1 | 119 |

This segment can be found in both coding and non-coding regions of transcript(s) as follows. The segment can be found in a non-coding region of transcript(s) that are related to the following protein(s): R47363_P8. This segment can also be found in the following protein(s): R47363_P25, since it is in the coding region for the corresponding transcript.

Segment cluster R47363_node_2 (SEQ ID NO:1593) according to the present invention is supported by 13 libraries. The number of libraries was determined as previously described. This segment can be found in the following transcript(s): R47363_T22 (SEQ ID NO:1564) and R47363_T38

(SEQ ID NO:1571). Table 1486 below describes the starting and ending position of this segment on each transcript.

TABLE 1486

Segment location on transcripts

| Transcript name | Segment starting position | Segment ending position |
| --- | --- | --- |
| R47363_T22 (SEQ ID NO: 1564) | 120 | 187 |
| R47363_T38 (SEQ ID NO: 1571) | 120 | 187 |

This segment can be found in both coding and non-coding regions of transcript(s) as follows. The segment can be found in a non-coding region of transcript(s) that are related to the following protein(s): R47363_P8. This segment can also be found in the following protein(s): R47363_P25, since it is in the coding region for the corresponding transcript.

Segment cluster R47363_node_14 (SEQ ID NO:1594) according to the present invention is supported by 31 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1487 below describes the starting and ending position of this segment on each transcript.

TABLE 1487

Segment location on transcripts

| Transcript name | Segment starting position | Segment ending position |
| --- | --- | --- |
| R47363_T3 (SEQ ID NO: 1563) | 381 | 431 |
| R47363_T22 (SEQ ID NO: 1564) | 544 | 594 |
| R47363_T23 (SEQ ID NO: 1565) | 381 | 431 |
| R47363_T25 (SEQ ID NO: 1566) | 381 | 431 |
| R47363_T28 (SEQ ID NO: 1567) | 381 | 431 |
| R47363_T29 (SEQ ID NO: 1568) | 381 | 431 |
| R47363_T30 (SEQ ID NO: 1569) | 381 | 431 |
| R47363_T35 (SEQ ID NO: 1570) | 381 | 431 |
| R47363_T38 (SEQ ID NO: 1571) | 544 | 594 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_15 (SEQ ID NO:1595) according to the present invention is supported by 35 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1488 below describes the starting and ending position of this segment on each transcript.

TABLE 1488

Segment location on transcripts

| Transcript name | Segment starting position | Segment ending position |
| --- | --- | --- |
| R47363_T3 (SEQ ID NO: 1563) | 432 | 506 |
| R47363_T22 (SEQ ID NO: 1564) | 595 | 669 |
| R47363_T23 (SEQ ID NO: 1565) | 432 | 506 |
| R47363_T25 (SEQ ID NO: 1566) | 432 | 506 |
| R47363_T28 (SEQ ID NO: 1567) | 432 | 506 |
| R47363_T29 (SEQ ID NO: 1568) | 432 | 506 |
| R47363_T30 (SEQ ID NO: 1569) | 432 | 506 |
| R47363_T35 (SEQ ID NO: 1570) | 432 | 506 |
| R47363_T38 (SEQ ID NO: 1571) | 595 | 669 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_16 (SEQ ID NO:1596) according to the present invention can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1489 below describes the starting and ending position of this segment on each transcript.

TABLE 1489

Segment location on transcripts

| Transcript name | Segment starting position | Segment ending position |
| --- | --- | --- |
| R47363_T3 (SEQ ID NO: 1563) | 507 | 529 |
| R47363_T22 (SEQ ID NO: 1564) | 670 | 692 |
| R47363_T23 (SEQ ID NO: 1565) | 507 | 529 |
| R47363_T25 (SEQ ID NO: 1566) | 507 | 529 |
| R47363_T28 (SEQ ID NO: 1567) | 507 | 529 |
| R47363_T29 (SEQ ID NO: 1568) | 507 | 529 |
| R47363_T30 (SEQ ID NO: 1569) | 507 | 529 |
| R47363_T35 (SEQ ID NO: 1570) | 507 | 529 |
| R47363_T38 (SEQ ID NO: 1571) | 670 | 692 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_18 (SEQ ID NO:1597) according to the present invention can be found in the following transcript(s): R47363_T3 (SEQ ID NO:1563), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1490 below describes the starting and ending position of this segment on each transcript.

TABLE 1490

| Transcript name | Segment starting position | Segment ending position |
|---|---|---|
| R47363_T3 (SEQ ID NO: 1563) | 530 | 544 |
| R47363_T23 (SEQ ID NO: 1565) | 530 | 544 |
| R47363_T25 (SEQ ID NO: 1566) | 530 | 544 |
| R47363_T28 (SEQ ID NO: 1567) | 530 | 544 |
| R47363_T29 (SEQ ID NO: 1568) | 530 | 544 |
| R47363_T30 (SEQ ID NO: 1569) | 530 | 544 |
| R47363_T35 (SEQ ID NO: 1570) | 530 | 544 |
| R47363_T38 (SEQ ID NO: 1571) | 693 | 707 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_20 (SEQ ID NO:1598) according to the present invention can be found in the following transcript(s): R47363_T22 (SEQ ID NO:1564). Table 1491 below describes the starting and ending position of this segment on each transcript.

TABLE 1491

| Transcript name | Segment starting position | Segment ending position |
|---|---|---|
| R47363_T22 (SEQ ID NO: 1564) | 693 | 697 |

This segment can be found in a non-coding region of transcript(s) that are related to the following protein(s): R47363_P8.

Segment cluster R47363_node_21 (SEQ ID NO:1599) according to the present invention is supported by 41 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1492 below describes the starting and ending position of this segment on each transcript.

TABLE 1492

| Transcript name | Segment starting position | Segment ending position |
|---|---|---|
| R47363_T3 (SEQ ID NO: 1563) | 545 | 658 |
| R47363_T22 (SEQ ID NO: 1564) | 698 | 811 |
| R47363_T23 (SEQ ID NO: 1565) | 545 | 658 |
| R47363_T25 (SEQ ID NO: 1566) | 545 | 658 |
| R47363_T28 (SEQ ID NO: 1567) | 545 | 658 |
| R47363_T29 (SEQ ID NO: 1568) | 545 | 658 |
| R47363_T30 (SEQ ID NO: 1569) | 545 | 658 |
| R47363_T35 (SEQ ID NO: 1570) | 545 | 658 |
| R47363_T38 (SEQ ID NO: 1571) | 708 | 821 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_22 (SEQ ID NO:1600) according to the present invention is supported by 42 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1493 below describes the starting and ending position of this segment on each transcript.

TABLE 1493

| Transcript name | Segment starting position | Segment ending position |
|---|---|---|
| R47363_T3 (SEQ ID NO: 1563) | 659 | 728 |
| R47363_T22 (SEQ ID NO: 1564) | 812 | 881 |
| R47363_T23 (SEQ ID NO: 1565) | 659 | 728 |
| R47363_T25 (SEQ ID NO: 1566) | 659 | 728 |
| R47363_T28 (SEQ ID NO: 1567) | 659 | 728 |
| R47363_T29 (SEQ ID NO: 1568) | 659 | 728 |
| R47363_T30 (SEQ ID NO: 1569) | 659 | 728 |
| R47363_T35 (SEQ ID NO: 1570) | 659 | 728 |
| R47363_T38 (SEQ ID NO: 1571) | 822 | 891 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_24 (SEQ ID NO:1601) according to the present invention is supported by 38 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1494 below describes the starting and ending position of this segment on each transcript.

TABLE 1494

| Transcript name | Segment starting position | Segment ending position |
|---|---|---|
| R47363_T3 (SEQ ID NO: 1563) | 729 | 790 |
| R47363_T22 (SEQ ID NO: 1564) | 882 | 943 |
| R47363_T23 (SEQ ID NO: 1565) | 729 | 790 |
| R47363_T25 (SEQ ID NO: 1566) | 729 | 790 |

TABLE 1494-continued

Segment location on transcripts

| Transcript name | Segment starting position | Segment ending position |
|---|---|---|
| R47363_T28 (SEQ ID NO: 1567) | 729 | 790 |
| R47363_T29 (SEQ ID NO: 1568) | 729 | 790 |
| R47363_T30 (SEQ ID NO: 1569) | 729 | 790 |
| R47363_T35 (SEQ ID NO: 1570) | 729 | 790 |
| R47363_T38 (SEQ ID NO: 1571) | 892 | 953 |

This segment can be found in both coding and non-coding regions of transcript(s) as follows. The segment can be found in a non-coding region of transcript(s) that are related to the following protein(s): R47363_P8 and R47363_P18. This segment can also be found in the following protein(s): R47363_P4, R47363_P13, R47363_P15, R47363_P19, R47363_P17, R47363_P22 and R47363_P25, since it is in the coding region for the corresponding transcript.

Segment cluster R47363_node_27 (SEQ ID NO:1602) according to the present invention is supported by 39 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1495 below describes the starting and ending position of this segment on each transcript.

TABLE 1495

Segment location on transcripts

| Transcript name | Segment starting position | Segment ending position |
|---|---|---|
| R47363_T3 (SEQ ID NO: 1563) | 791 | 884 |
| R47363_T22 (SEQ ID NO: 1564) | 944 | 1037 |
| R47363_T23 (SEQ ID NO: 1565) | 791 | 884 |
| R47363_T25 (SEQ ID NO: 1566) | 791 | 884 |
| R47363_T28 (SEQ ID NO: 1567) | 791 | 884 |
| R47363_T29 (SEQ ID NO: 1568) | 791 | 884 |
| R47363_T30 (SEQ ID NO: 1569) | 791 | 884 |
| R47363_T35 (SEQ ID NO: 1570) | 791 | 884 |
| R47363_T38 (SEQ ID NO: 1571) | 1113 | 1206 |

This segment can be found in both coding and non-coding regions of transcript(s) as follows. The segment can be found in a non-coding region of transcript(s) that are related to the following protein(s): R47363_P8, R47363_P18 and R47363_P25. This segment can also be found in the following protein(s): R47363_P4, R47363_P13, R47363_P15, R47363_P19, R47363_P17 and R47363_P22, since it is in the coding region for the corresponding transcript.

Segment cluster R47363_node_28 (SEQ ID NO:1603) according to the present invention is supported by 37 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1496 below describes the starting and ending position of this segment on each transcript.

TABLE 1496

Segment location on transcripts

| Transcript name | Segment starting position | Segment ending position |
|---|---|---|
| R47363_T3 (SEQ ID NO: 1563) | 885 | 956 |
| R47363_T22 (SEQ ID NO: 1564) | 1038 | 1109 |
| R47363_T23 (SEQ ID NO: 1565) | 885 | 956 |
| R47363_T25 (SEQ ID NO: 1566) | 885 | 956 |
| R47363_T28 (SEQ ID NO: 1567) | 885 | 956 |
| R47363_T29 (SEQ ID NO: 1568) | 885 | 956 |
| R47363_T30 (SEQ ID NO: 1569) | 885 | 956 |
| R47363_T35 (SEQ ID NO: 1570) | 885 | 956 |
| R47363_T38 (SEQ ID NO: 1571) | 1207 | 1278 |

This segment can be found in both coding and non-coding regions of transcript(s) as follows. The segment can be found in a non-coding region of transcript(s) that are related to the following protein(s): R47363_P8, R47363_P18 and R47363_P25. This segment can also be found in the following protein(s): R47363_P4, R47363_P13, R47363_P15, R47363_P19, R47363_P17 and R47363_P22, since it is in the coding region for the corresponding transcript.

Segment cluster R47363_node_29 (SEQ ID NO:1604) according to the present invention is supported by 36 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1497 below describes the starting and ending position of this segment on each transcript.

TABLE 1497

Segment location on transcripts

| Transcript name | Segment starting position | Segment ending position |
|---|---|---|
| R47363_T3 (SEQ ID NO: 1563) | 957 | 982 |
| R47363_T22 (SEQ ID NO: 1564) | 1110 | 1135 |
| R47363_T23 (SEQ ID NO: 1565) | 957 | 982 |
| R47363_T25 (SEQ ID NO: 1566) | 957 | 982 |
| R47363_T28 (SEQ ID NO: 1567) | 957 | 982 |
| R47363_T29 (SEQ ID NO: 1568) | 957 | 982 |
| R47363_T30 (SEQ ID NO: 1569) | 957 | 982 |
| R47363_T35 (SEQ ID NO: 1570) | 957 | 982 |
| R47363_T38 (SEQ ID NO: 1571) | 1279 | 1304 |

This segment can be found in both coding and non-coding regions of transcript(s) as follows. The segment can be found in a non-coding region of transcript(s) that are related to the following protein(s): R47363_P8, R47363_P18 and R47363_P25. This segment can also be found in the following protein(s): R47363_P4, R47363_P13, R47363_P15, R47363_P19, R47363_P17 and R47363_P22, since it is in the coding region for the corresponding transcript.

Segment cluster R47363_node_32 (SEQ ID NO:1605) according to the present invention is supported by 46 libraries. The number of libraries was determined as previously described. This segment can be found in the following transcript(s): R47363_T3 (SEQ ID NO:1563), R47363_T22

(SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569), R47363_T35 (SEQ ID NO:1570) and R47363_T38 (SEQ ID NO:1571). Table 1498 below describes the starting and ending position of this segment on each transcript.

TABLE 1498

Segment location on transcripts

| Transcript name | Segment starting position | Segment ending position |
|---|---|---|
| R47363_T3 (SEQ ID NO: 1563) | 983 | 1082 |
| R47363_T22 (SEQ ID NO: 1564) | 1136 | 1235 |
| R47363_T23 (SEQ ID NO: 1565) | 983 | 1082 |
| R47363_T25 (SEQ ID NO: 1566) | 983 | 1082 |
| R47363_T28 (SEQ ID NO: 1567) | 983 | 1082 |
| R47363_T29 (SEQ ID NO: 1568) | 983 | 1082 |
| R47363_T30 (SEQ ID NO: 1569) | 983 | 1082 |
| R47363_T35 (SEQ ID NO: 1570) | 983 | 1082 |
| R47363_T38 (SEQ ID NO: 1571) | 1305 | 1404 |

This segment can be found in both coding and non-coding regions of transcript(s) as follows. The segment can be found in a non-coding region of transcript(s) that are related to the following protein(s): R47363_P8, R47363_P18 and R47363_P25. This segment can also be found in the following protein(s): R47363_P4, R47363_P13, R47363_P15, R47363_P19, R47363_P17 and R47363_P22, since it is in the coding region for the corresponding transcript.

Segment cluster R47363_node_37 (SEQ ID NO:1606) according to the present invention is supported by 37 libraries. The number of libraries was determined as previously described. This segment can be found in the following transcript(s): R47363_T3 (SEQ ID NO:1563), R47363_T23 (SEQ ID NO:1565), R47363_T25 (SEQ ID NO:1566), R47363_T29 (SEQ ID NO:1568) and R47363_T30 (SEQ ID NO:1569). Table 39 below describes the starting and ending position of this segment on each transcript.

TABLE 1499

Segment location on transcripts

| Transcript name | Segment staring position | Segment ending position |
|---|---|---|
| R47363_T3 (SEQ ID NO: 1563) | 1083 | 1195 |
| R47363_T23 (SEQ ID NO: 1565) | 1083 | 1195 |
| R47363_T25 (SEQ ID NO: 1566) | 1083 | 1195 |
| R47363_T29 (SEQ ID NO: 1568) | 1083 | 1195 |
| R47363_T30 (SEQ ID NO: 1569) | 1083 | 1195 |

This segment can be found in the following protein(s): R47363_P4, R47363_P13, R47363_P15, R47363_P19 and R47363_P17.

Segment cluster R47363_node_41 (SEQ ID NO:1607) according to the present invention is supported by 35 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1500 below describes the starting and ending position of this segment on each transcript.

TABLE 1500

Segment location on transcripts

| Transcript name | Segment starting position | Segment ending position |
|---|---|---|
| R47363_T3 (SEQ ID NO: 1563) | 1486 | 1540 |
| R47363_T22 (SEQ ID NO: 1564) | 1648 | 1702 |
| R47363_T23 (SEQ ID NO: 1565) | 1486 | 1540 |
| R47363_T25 (SEQ ID NO: 1566) | 1486 | 1540 |
| R47363_T28 (SEQ ID NO: 1567) | 1495 | 1549 |
| R47363_T29 (SEQ ID NO: 1568) | 1486 | 1540 |
| R47363_T30 (SEQ ID NO: 1569) | 1486 | 1540 |

This segment can be found in both coding and non-coding regions of transcript(s) as follows. The segment can be found in a non-coding region of transcript(s) that are related to the following protein(s): R47363_P18. This segment can also be found in the following protein(s): R47363_P4, R47363_P8, R47363_P13, R47363_P15, R47363_P19 and R47363_P17, since it is in the coding region for the corresponding transcript.

Segment cluster R47363_node_49 (SEQ ID NO:1608) according to the present invention is supported by 45 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1501 below describes the starting and ending position of this segment on each transcript.

TABLE 1501

Segment location on transcripts

| Transcript name | Segment starting position | Segment ending position |
|---|---|---|
| R47363_T3 (SEQ ID NO: 1563) | 1952 | 2064 |
| R47363_T22 (SEQ ID NO: 1564) | 2114 | 2226 |
| R47363_T23 (SEQ ID NO: 1565) | 1952 | 2064 |
| R47363_T25 (SEQ ID NO: 1566) | 1952 | 2064 |
| R47363_T28 (SEQ ID NO: 1567) | 2136 | 2248 |
| R47363_T29 (SEQ ID NO: 1568) | 1952 | 2064 |
| R47363_T30 (SEQ ID NO: 1569) | 1952 | 2064 |

This segment can be found in the following protein(s): R47363_P4, R47363_P8, R47363_P13, R47363_P15, R47363_P18, R47363_P19 and R47363_P17.

Segment cluster R47363_node_51 (SEQ ID NO:1609) according to the present invention is supported by 39 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1502 below describes the starting and ending position of this segment on each transcript.

TABLE 1502

Segment location on transcripts

| Transcript name | Segment starting position | Segment ending position |
|---|---|---|
| R47363_T3 (SEQ ID NO: 1563) | 2065 | 2142 |
| R47363_T22 (SEQ ID NO: 1564) | 2227 | 2304 |
| R47363_T23 (SEQ ID NO: 1565) | 2065 | 2142 |
| R47363_T25 (SEQ ID NO: 1566) | 2065 | 2142 |
| R47363_T28 (SEQ ID NO: 1567) | 2249 | 2326 |
| R47363_T29 (SEQ ID NO: 1568) | 2065 | 2142 |
| R47363_T30 (SEQ ID NO: 1569) | 2065 | 2142 |

This segment can be found in the following protein(s): R47363_P4, R47363_P8, R47363_P13, R47363_P15, R47363_P18, R47363_P19 and R47363_P17.

Segment cluster R47363_node_59 (SEQ ID NO:1610) according to the present invention is supported by 83 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1503 below describes the starting and ending position of this segment on each transcript.

TABLE 1503

Segment location on transcripts

| Transcript name | Segment starting position | Segment ending position |
|---|---|---|
| R47363_T3 (SEQ ID NO: 1563) | 2886 | 2999 |
| R47363_T22 (SEQ ID NO: 1564) | 3048 | 3161 |
| R47363_T23 (SEQ ID NO: 1565) | 2886 | 2999 |
| R47363_T25 (SEQ ID NO: 1566) | 2886 | 2999 |
| R47363_T28 (SEQ ID NO: 1567) | 3070 | 3183 |
| R47363_T29 (SEQ ID NO: 1568) | 2886 | 2999 |
| R47363_T30 (SEQ ID NO: 1569) | 2886 | 2999 |

This segment can be found in the following protein(s): R47363_P4, R47363_P8, R47363_P13, R47363_P15, R47363_P18, R47363_P19 and R47363_P17.

Segment cluster R47363_node_60 (SEQ ID NO:1611) according to the present invention is supported by 72 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T30 (SEQ ID NO:1569). Table 1504 below describes the starting and ending position of this segment on each transcript.

TABLE 1504

Segment location on transcripts

| Transcript name | Segment starting position | Segment ending position |
|---|---|---|
| R47363_T3 (SEQ ID NO: 1563) | 3000 | 3063 |
| R47363_T22 (SEQ ID NO: 1564) | 3162 | 3225 |
| R47363_T23 (SEQ ID NO: 1565) | 3000 | 3063 |
| R47363_T25 (SEQ ID NO: 1566) | 3000 | 3063 |
| R47363_T28 (SEQ ID NO: 1567) | 3184 | 3247 |
| R47363_T29 (SEQ ID NO: 1568) | 3000 | 3063 |
| R47363_T30 (SEQ ID NO: 1569) | 3000 | 3063 |

This segment can be found in the following protein(s): R47363_P4, R47363_P8, R47363_P13, R47363_P15, R47363_P18, R47363_P19 and R47363_P17.

Segment cluster R47363_node_62 (SEQ ID NO:1612) according to the present invention is supported by 3 libraries. The number of libraries was determined as previously described. This segment can be found in the following transcript(s): R47363_T29 (SEQ ID NO:1568). Table 1505 below describes the starting and ending position of this segment on each transcript.

TABLE 1505

Segment location on transcripts

| Transcript name | Segment starting position | Segment ending position |
|---|---|---|
| R47363_T29 (SEQ ID NO: 1568) | 3064 | 3176 |

This segment can be found in the following protein(s): R47363_P19.

Segment cluster R47363_node_66 (SEQ ID NO:1613) according to the present invention is supported by 1 libraries. The number of libraries was determined as previously described. This segment can be found in the following transcript(s): R47363_T40 (SEQ ID NO:1572). Table 1506 below describes the starting and ending position of this segment on each transcript.

TABLE 1506

Segment location on transcripts

| Transcript name | Segment starting position | Segment ending position |
|---|---|---|
| R47363_T40 (SEQ ID NO: 1572) | 1 | 109 |

This segment can be found in the following protein(s): R47363_P27.

Segment cluster R47363_node_69 (SEQ ID NO:1614) according to the present invention is supported by 82 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568) and R47363_T40 (SEQ ID NO:1572). Table 1507 below describes the starting and ending position of this segment on each transcript.

TABLE 1507

Segment location on transcripts

| Transcript name | Segment starting position | Segment ending position |
|---|---|---|
| R47363_T3 (SEQ ID NO: 1563) | 3394 | 3466 |
| R47363_T22 (SEQ ID NO: 1564) | 3556 | 3628 |
| R47363_T23 (SEQ ID NO: 1565) | 3394 | 3466 |
| R47363_T25 (SEQ ID NO: 1566) | 3566 | 3638 |
| R47363_T28 (SEQ ID NO: 1567) | 3578 | 3650 |
| R47363_T29 (SEQ ID NO: 1568) | 3507 | 3579 |
| R47363_T40 (SEQ ID NO: 1572) | 243 | 315 |

This segment can be found in both coding and non-coding regions of transcript(s) as follows. The segment can be found in a non-coding region of transcript(s) that are related to the following protein(s): R47363_P15 and R47363_P19. This segment can also be found in the following protein(s): R47363_P4, R47363_P8, R47363_P13, R47363_P18 and R47363_P27, since it is in the coding region for the corresponding transcript.

Segment cluster R47363_node_72 (SEQ ID NO:1615) according to the present invention is supported by 80 libraries. The number of libraries was determined as previously described. This segment can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T40 (SEQ ID NO:1572). Table 1508 below describes the starting and ending position of this segment on each transcript.

TABLE 1508

Segment location on transcripts

| Transcript name | Segment starting position | Segment ending position |
|---|---|---|
| R47363_T3 (SEQ ID NO: 1563) | 3467 | 3536 |
| R47363_T22 (SEQ ID NO: 1564) | 3629 | 3698 |
| R47363_T23 (SEQ ID NO: 1565) | 3467 | 3536 |
| R47363_T25 (SEQ ID NO: 1566) | 3639 | 3708 |
| R47363_T28 (SEQ ID NO: 1567) | 3651 | 3720 |
| R47363_T29 (SEQ ID NO: 1568) | 3580 | 3649 |
| R47363_T30 (SEQ ID NO: 1569) | 3394 | 3463 |
| R47363_T40 (SEQ ID NO: 1572) | 316 | 385 |

This segment can be found in both coding and non-coding regions of transcript(s) as follows. The segment can be found in a non-coding region of transcript(s) that are related to the following protein(s): R47363_P15 and R47363_P19. This segment can also be found in the following protein(s): R47363_P4, R47363_P8, R47363_P13, R47363_P18, R47363_P17 and R47363_P27, since it is in the coding region for the corresponding transcript.

Segment cluster R47363_node_74 (SEQ ID NO:1616) according to the present invention can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T40 (SEQ ID NO:1572). Table 1509 below describes the starting and ending position of this segment on each transcript.

TABLE 1509

Segment location on transcripts

| Transcript name | Segment starting position | Segment ending position |
|---|---|---|
| R47363_T3 (SEQ ID NO: 1563) | 3537 | 3548 |
| R47363_T22 (SEQ ID NO: 1564) | 3699 | 3710 |
| R47363_T23 (SEQ ID NO: 1565) | 3537 | 3548 |
| R47363_T25 (SEQ ID NO: 1566) | 3709 | 3720 |
| R47363_T28 (SEQ ID NO: 1567) | 3721 | 3732 |
| R47363_T29 (SEQ ID NO: 1568) | 3650 | 3661 |
| R47363_T30 (SEQ ID NO: 1569) | 3464 | 3475 |
| R47363_T40 (SEQ ID NO: 1572) | 386 | 397 |

This segment can be found in both coding and non-coding regions of transcript(s) as follows. The segment can be found in a non-coding region of transcript(s) that are related to the following protein(s): R47363_P15, R47363_P19 and R47363_P17. This segment can also be found in the following protein(s): R47363_P4, R47363_P8, R47363_P13, R47363_P18 and R47363_P27, since it is in the coding region for the corresponding transcript.

Segment cluster R47363_node_76 (SEQ ID NO:1617) according to the present invention can be found in the following transcript(s): R47363_T3 (SEQ ID NO:1563), R47363_T22 (SEQ ID NO:1564), R47363_T23 (SEQ ID NO:1565), R47363_T25 (SEQ ID NO:1566), R47363_T28 (SEQ ID NO:1567), R47363_T29 (SEQ ID NO:1568), R47363_T30 (SEQ ID NO:1569) and R47363_T40 (SEQ ID NO:1572). Table 1510 below describes the starting and ending position of this segment on each transcript.

TABLE 1510

Segment location on transcripts

| Transcript name | Segment starting position | Segment ending position |
|---|---|---|
| R47363_T3 (SEQ ID NO: 1563) | 3549 | 3572 |
| R47363_T22 (SEQ ID NO: 1564) | 3711 | 3734 |
| R47363_T23 (SEQ ID NO: 1565) | 3549 | 3572 |
| R47363_T25 (SEQ ID NO: 1566) | 3721 | 3744 |
| R47363_T28 (SEQ ID NO: 1567) | 3733 | 3756 |
| R47363_T29 (SEQ ID NO: 1568) | 3662 | 3685 |
| R47363_T30 (SEQ ID NO: 1569) | 3476 | 3499 |
| R47363_T40 (SEQ ID NO: 1572) | 398 | 421 |

This segment can be found in both coding and non-coding regions of transcript(s) as follows. The segment can be found in a non-coding region of transcript(s) that are related to the following protein(s): R47363_P15, R47363_P19 and R47363_P17. This segment can also be found in the following protein(s): R47363_P4, R47363_P8, R47363_P13, R47363_P18 and R47363_P27, since it is in the coding region for the corresponding transcript.

Description for Cluster R49883

Cluster R49883 features 1 transcript(s) and 5 segment(s) of interest, the names for which are given in Tables 1511 and 1512, respectively, the sequences themselves are given at the end of the application. The selected protein variants are given in Table 1513.

TABLE 1511

Transcripts of interest
Transcript Name

R49883_T54 (SEQ ID NO: 1618)

TABLE 1512

Segments of interest
Segment Name

R49883_node_8 (SEQ ID NO: 1619)
R49883_node_1 (SEQ ID NO: 1620)
R49883_node_2 (SEQ ID NO: 1621)
R49883_node_5 (SEQ ID NO: 1622)
R49883_node_6 (SEQ ID NO: 1623)

TABLE 1513

Proteins of interest

| Protein Name | Corresponding Transcript(s) |
|---|---|
| R49883_P31 | R49883_T54 (SEQ ID NO: 1618) |

These sequences are variants of the known protein Tumor necrosis factor receptor superfamily member 5 precursor (SwissProt accession identifier TNR5_HUMAN; known also according to the synonyms CD40L receptor; B-cell surface antigen CD40; CDw40; Bp50), referred to herein as the previously known protein.

Protein Tumor necrosis factor receptor superfamily member 5 precursor is known or believed to have the following function(s): Receptor for TNFSF5/CD40L. The sequence for protein Tumor necrosis factor receptor superfamily member 5 precursor is given at the end of the application, as "Tumor necrosis factor receptor superfamily member 5 precursor amino acid sequence". Known polymorphisms for this sequence are as shown in Table 1514.

TABLE 1514

Amino acid mutations for Known Protein

| SNP position(s) on amino acid sequence | Comment |
|---|---|
| 83 | C -> R (in HIGM3). /FTId = VAR_013628. |

Protein Tumor necrosis factor receptor superfamily member 5 precursor localization is believed to be Type I membrane protein (isoform I); secreted (isoform II).

The following GO Annotation(s) apply to the previously known protein. The following annotation(s) were found: protein complex assembly; apoptosis; inflammatory response; immune response; signal transduction; developmental processes; antimicrobial humoral response (sensu Vertebrata); platelet activation, which are annotation(s) related to Biological Process; receptor; transmembrane receptor, which are annotation(s) related to Molecular Function; and integral plasma membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R49883 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 40 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 40 and Table 1515. This cluster is overexpressed (at least at a minimum level) in the following pathological conditions: brain malignant tumors.

TABLE 1515

Normal tissue distribution

| Name of Tissue | Number |
|---|---|
| Bladder | 0 |
| Bone | 0 |
| Brain | 2 |
| Colon | 6 |
| Epithelial | 16 |
| General | 25 |
| head and neck | 0 |
| Kidney | 0 |
| Liver | 0 |
| Lung | 13 |
| lymph nodes | 84 |
| bone marrow | 62 |
| Muscle | 1 |
| Ovary | 0 |
| Pancreas | 0 |
| Prostate | 4 |
| Skin | 26 |
| Stomach | 36 |
| Thyroid | 0 |

TABLE 1516

P values and ratios for expression in cancerous tissue

| Name of Tissue | P1 | P2 | SP1 | R3 | SP2 | R4 |
|---|---|---|---|---|---|---|
| Bladder | 5.4e−01 | 6.0e−01 | 5.6e−01 | 1.8 | 6.8e−01 | 1.5 |
| Bone | 1 | 4.3e−01 | 1 | 1.0 | 7.0e−01 | 1.6 |
| Brain | 1.5e−01 | 3.0e−01 | 2.3e−03 | 8.1 | 1.2e−02 | 4.8 |
| Colon | 3.4e−01 | 4.4e−01 | 3.4e−01 | 1.9 | 4.6e−01 | 1.6 |
| Epithelial | 3.9e−01 | 5.1e−01 | 5.2e−01 | 1.1 | 4.4e−01 | 1.1 |
| General | 6.5e−01 | 7.2e−01 | 7.4e−01 | 0.9 | 7.2e−01 | 0.8 |
| head and neck | 2.1e−01 | 3.3e−01 | 1 | 1.0 | 1 | 1.0 |
| Kidney | 4.1e−01 | 3.5e−01 | 3.4e−01 | 2.7 | 3.4e−01 | 2.4 |
| Liver | 1 | 6.8e−01 | 1 | 1.0 | 6.9e−01 | 1.4 |
| Lung | 7.9e−01 | 8.4e−01 | 1 | 0.6 | 6.7e−01 | 1.0 |
| lymph nodes | 6.9e−01 | 7.4e−01 | 5.5e−01 | 1.1 | 2.2e−01 | 0.9 |
| bone marrow | 8.6e−01 | 8.5e−01 | 1 | 0.3 | 9.0e−01 | 0.6 |
| Muscle | 4.0e−01 | 4.8e−01 | 1.5e−01 | 6.1 | 3.9e−01 | 2.3 |
| Ovary | 6.2e−01 | 4.2e−01 | 6.8e−01 | 1.5 | 4.5e−01 | 1.9 |
| Pancreas | 3.6e−02 | 3.3e−02 | 3.2e−02 | 6.5 | 1.1e−02 | 6.4 |
| Prostate | 8.2e−01 | 8.6e−01 | 6.7e−01 | 1.3 | 7.5e−01 | 1.1 |
| Skin | 9.2e−01 | 6.8e−01 | 1 | 0.3 | 9.5e−01 | 0.5 |
| Stomach | 9.0e−01 | 7.3e−01 | 1 | 0.5 | 7.3e−01 | 0.9 |
| Thyroid | 2.0e−01 | 2.0e−01 | 6.7e−01 | 1.6 | 6.7e−01 | 1.6 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1517.

TABLE 1517

Oligonucleotides related to this cluster

| Oligonucleotide name | Overexpressed in cancers | Chip reference |
|---|---|---|
| R49883_0_0_297 | breast malignant tumors | BRS |
| R49883_0_0_296 | colorectal cancer | Colon |

As noted above, cluster R49883 features 5 segment(s), which were listed in Table 1512 above and for which the sequence(s) are given at the end of the application. These segment(s) are portions of nucleic acid sequence(s) which are described herein separately because they are of particular interest. A description of each segment according to the present invention is now provided.

Segment cluster R49883_node_8 (SEQ ID NO:1619) according to the present invention is supported by 1 libraries. The number of libraries was determined as previously described. This segment can be found in the following transcript(s): R49883_T54 (SEQ ID NO:1618). Table 1518 below describes the starting and ending position of this segment on each transcript.

TABLE 1518

Segment location on transcripts

| Transcript name | Segment starting position | Segment ending position |
|---|---|---|
| R49883_T54 (SEQ ID NO: 1618) | 225 | 363 |

This segment can be found in a non-coding region of transcript(s) that are related to the following protein(s): R49883_P31.

According to an optional embodiment of the present invention, short segments related to the above cluster are also provided. These segments are up to about 120 bp in length, and so are included in a separate description.

Segment cluster R49883_node_1 (SEQ ID NO:1620) according to the present invention is supported by 64 libraries. The number of libraries was determined as previously described. This segment can be found in the following transcript(s): R49883_T54 (SEQ ID NO:1618). Table 1519 below describes the starting and ending position of this segment on each transcript.

TABLE 1519

Segment location on transcripts

| Transcript name | Segment starting position | Segment ending position |
|---|---|---|
| R49883_T54 (SEQ ID NO: 1618) | 1 | 97 |

This segment can be found in the following protein(s): R49883_P31.

Segment cluster R49883_node_2 (SEQ ID NO:1621) according to the present invention is supported by 69 libraries. The number of libraries was determined as previously described. This segment can be found in the following transcript(s): R49883_T54 (SEQ ID NO:1618). Table 1520 below describes the starting and ending position of this segment on each transcript.

TABLE 1520

Segment location on transcripts

| Transcript name | Segment starting position | Segment ending position |
|---|---|---|
| R49883_T54 (SEQ ID NO: 1618) | 98 | 145 |

This segment can be found in the following protein(s): R49883_P31.

Segment cluster R49883_node_5 (SEQ ID NO:1622) according to the present invention is supported by 72 libraries. The number of libraries was determined as previously described. This segment can be found in the following transcript(s): (SEQ ID NO:1618). Table 1521 below describes the starting and ending position of this segment on each transcript.

TABLE 1521

Segment location on transcripts

| Transcript name | Segment starting position | Segment ending position |
|---|---|---|
| R49883_T54 (SEQ ID NO: 1618) | 146 | 197 |

This segment can be found in a non-coding region of transcript(s) that are related to the following protein(s): R49883_P31.

Segment cluster R49883_node_6 (SEQ ID NO:1623) according to the present invention is supported by 71 libraries. The number of libraries was determined as previously described. This segment can be found in the following transcript(s): (SEQ ID NO:1618). Table 1522 below describes the starting and ending position of this segment on each transcript.

TABLE 1522

Segment location on transcripts

| Transcript name | Segment starting position | Segment ending position |
|---|---|---|
| R49883_T54 (SEQ ID NO: 1618) | 198 | 224 |

This segment can be found in a non-coding region of transcript(s) that are related to the following protein(s): R49883_P31.

Description for Cluster R60180

Cluster R60180 features 8 transcript(s) and 24 segment(s) of interest, the names for which are given in Tables 1523 and 1524, respectively, the sequences themselves are given at the end of the application. The selected protein variants are given in Table 1525.

TABLE 1523

Transcripts of interest
Transcript Name

R60180_T7 (SEQ ID NO: 1624)
R60180_T9 (SEQ ID NO: 1625)
R60180_T13 (SEQ ID NO: 1626)
R60180_T18 (SEQ ID NO: 1627)

TABLE 1523-continued

Transcripts of interest
Transcript Name

R60180_T19 (SEQ ID NO: 1628)
R60180_T22 (SEQ ID NO: 1629)
R60180_T24 (SEQ ID NO: 1630)
R60180_T28 (SEQ ID NO: 1631)

TABLE 1524

Segments of interest
Segment Name

R60180_node_4 (SEQ ID NO: 1632)
R60180_node_20 (SEQ ID NO: 1633)
R60180_node_21 (SEQ ID NO: 1634)
R60180_node_25 (SEQ ID NO: 1635)
R60180_node_29 (SEQ ID NO: 1636)
R60180_node_38 (SEQ ID NO: 1637)
R60180_node_41 (SEQ ID NO: 1638)
R60180_node_45 (SEQ ID NO: 1639)
R60180_node_46 (SEQ ID NO: 1640)
R60180_node_2 (SEQ ID NO: 1641)
R60180_node_8 (SEQ ID NO: 1642)
R60180_node_10 (SEQ ID NO: 1643)
R60180_node_11 (SEQ ID NO: 1644)
R60180_node_14 (SEQ ID NO: 1645)
R60180_node_15 (SEQ ID NO: 1646)
R60180_node_16 (SEQ ID NO: 1647)
R60180_node_18 (SEQ ID NO: 1648)
R60180_node_22 (SEQ ID NO: 1649)
R60180_node_27 (SEQ ID NO: 1650)
R60180_node_30 (SEQ ID NO: 1651)
R60180_node_33 (SEQ ID NO: 1652)
R60180_node_34 (SEQ ID NO: 1653)
R60180_node_43 (SEQ ID NO: 1654)
R60180_node_44 (SEQ ID NO: 1655)

TABLE 1525

Proteins of interest

| Protein Name | Corresponding Transcript(s) |
| --- | --- |
| R60180_P4 | R60180_T7 (SEQ ID NO: 1624) |
| R60180_P5 | R60180_T9 (SEQ ID NO: 1625); R60180_T13 (SEQ ID NO: 1626) |
| R60180_P8 | R60180_T18 (SEQ ID NO: 1627) |
| R60180_P9 | R60180_T19 (SEQ ID NO: 1628) |
| R60180_P12 | R60180_T22 (SEQ ID NO: 1629) |
| R60180_P14 | R60180_T24 (SEQ ID NO: 1630) |
| R60180_P16 | R60180_T28 (SEQ ID NO: 1631) |

These sequences are variants of the known protein Activator 1 40 kDa subunit (SwissProt accession identifier RFC2_HUMAN; known also according to the synonyms Replication factor C 40 kDa subunit; A1 40 kDa subunit; RF-C 40 kDa subunit; RFC40), referred to herein as the previously known protein.

Protein Activator 1 40 kDa subunit is known or believed to have the following function(s): THE ELONGATION OF PRIMED DNA TEMPLATES BY DNA POLYMERASE DELTA AND EPSILON REQUIRES THE ACTION OF THE ACCESSORY PROTEINS PROLIFERATING CELL NUCLEAR ANTIGEN (PCNA) AND ACTIVATOR 1. THE 40 kDa SUBUNIT BINDS ATP. The sequence for protein Activator 1 40 kDa subunit is given at the end of the application, as "Activator 1 40 kDa subunit amino acid sequence". Known polymorphisms for this sequence are as shown in Table 1526.

TABLE 1526

Amino acid mutations for Known Protein

| SNP position(s) on amino acid sequence | Comment |
| --- | --- |
| 244 | G -> L |

Protein Activator 1 40 kDa subunit localization is believed to be Nuclear (Probable).

The following GO Annotation(s) apply to the previously known protein. The following annotation(s) were found: DNA replication, which are annotation(s) related to Biological Process; nucleotide binding; DNA binding; ATP binding, which are annotation(s) related to Molecular Function; and nucleus; DNA replication factor C complex, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R60180 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 41 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 41 and Table 1527. This cluster is overexpressed (at least at a minimum level) in the following pathological conditions: brain malignant tumors, epithelial malignant tumors, a mixture of malignant tumors from different tissues, kidney malignant tumors, myosarcoma, pancreas carcinoma, skin malignancies and uterine malignancies.

TABLE 1527

Normal tissue distribution

| Name of Tissue | Number |
| --- | --- |
| Bone | 0 |
| Brain | 22 |
| Colon | 63 |
| Epithelial | 11 |
| General | 17 |
| Head and neck | 0 |
| Kidney | 0 |
| Liver | 0 |
| Lung | 21 |
| lymph nodes | 41 |
| Breast | 0 |
| Bone marrow | 31 |
| Muscle | 1 |
| Ovary | 36 |
| Pancreas | 0 |
| Prostate | 20 |
| Skin | 13 |
| Stomach | 0 |
| T cells | 0 |
| Uterus | 0 |

TABLE 1528

P values and ratios for expression in cancerous tissue

| Name of Tissue | P1 | P2 | SP1 | R3 | SP2 | R4 |
|---|---|---|---|---|---|---|
| Bone | 1 | 4.3e−01 | 1 | 1.0 | 4.9e−01 | 1.9 |
| Brain | 4.7e−01 | 7.8e−02 | 3.8e−01 | 1.5 | 4.0e−15 | 6.9 |
| Colon | 5.2e−01 | 3.7e−01 | 9.7e−01 | 0.6 | 4.0e−01 | 0.8 |
| Epithelial | 8.1e−02 | 6.2e−06 | 3.2e−01 | 1.4 | 3.2e−24 | 9.0 |
| General | 1.3e−01 | 5.0e−08 | 3.4e−01 | 1.2 | 4.4e−58 | 7.7 |
| Head and neck | 4.3e−01 | 2.8e−01 | 1 | 1.0 | 5.6e−02 | 1.7 |
| Kidney | 4.1e−01 | 1.6e−01 | 3.4e−01 | 2.4 | 5.5e−04 | 4.9 |
| Liver | 1 | 1.9e−01 | 1 | 1.0 | 1 | 1.4 |
| Lung | 6.4e−01 | 3.4e−01 | 5.4e−01 | 1.3 | 3.7e−02 | 2.3 |
| Lymph nodes | 4.5e−01 | 2.3e−01 | 3.2e−01 | 1.9 | 7.8e−04 | 2.7 |
| Breast | 1 | 1.2e−01 | 1 | 1.0 | 1.4e−01 | 2.5 |
| Bone marrow | 8.6e−01 | 7.2e−01 | 1 | 0.5 | 5.5e−01 | 1.4 |
| Muscle | 9.2e−01 | 4.8e−01 | 1 | 0.9 | 2.6e−09 | 3.7 |
| Ovary | 9.6e−01 | 7.1e−01 | 1 | 0.5 | 1.0e−01 | 1.1 |
| pancreas | 3.3e−01 | 6.9e−02 | 4.2e−01 | 2.4 | 2.4e−04 | 5.5 |
| prostate | 9.1e−01 | 6.8e−01 | 8.9e−01 | 0.7 | 8.0e−02 | 1.5 |
| Skin | 8.6e−01 | 3.2e−01 | 1 | 0.5 | 1.8e−11 | 6.4 |
| stomach | 1.5e−01 | 2.1e−01 | 1 | 1.5 | 6.4e−01 | 1.6 |
| T cells | 1 | 6.7e−01 | 1 | 1.0 | 7.2e−01 | 1.4 |
| Uterus | 1 | 8.2e−02 | 1 | 1.0 | 2.0e−03 | 6.2 |

As noted above, cluster R60180 features 24 segment(s), which were listed in Table 1524 above and for which the sequence(s) are given at the end of the application. These segment(s) are portions of nucleic acid sequence(s) which are described herein separately because they are of particular interest. A description of each segment according to the present invention is now provided.

Segment cluster R60180_node_4 (SEQ ID NO:1632) according to the present invention is supported by 105 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1529 below describes the starting and ending position of this segment on each transcript.

TABLE 1529

Segment location on transcripts

| Transcript name | Segment starting position | Segment ending position |
|---|---|---|
| R60180_T7 (SEQ ID NO: 1624) | 41 | 170 |
| R60180_T9 (SEQ ID NO: 1625) | 41 | 170 |
| R60180_T13 (SEQ ID NO: 1626) | 41 | 170 |
| R60180_T18 (SEQ ID NO: 1627) | 41 | 170 |

This segment can be found in both coding and non-coding regions of transcript(s) as follows. The segment can be found in a non-coding region of transcript(s) that are related to the following protein(s): R60180_P5 and R60180_P8. This segment can also be found in the following protein(s): R60180_P4, since it is in the coding region for the corresponding transcript.

Segment cluster R60180_node_20 (SEQ ID NO:1633) according to the present invention is supported by 3 libraries. The number of libraries was determined as previously described. This segment can be found in the following transcript(s): R60180_T19 (SEQ ID NO:1628) and R60180_T22 (SEQ ID NO:1629). Table 1530 below describes the starting and ending position of this segment on each transcript.

TABLE 1530

Segment location on transcripts

| Transcript name | Segment starting position | Segment ending position |
|---|---|---|
| R60180_T19 (SEQ ID NO: 1628) | 1 | 263 |
| R60180_T22 (SEQ ID NO: 1629) | 1 | 263 |

This segment can be found in both coding and non-coding regions of transcript(s) as follows. The segment can be found in a non-coding region of transcript(s) that are related to the following protein(s): R60180_P9. This segment can also be found in the following protein(s): R60180_P12, since it is in the coding region for the corresponding transcript.

Segment cluster R60180_node_21 (SEQ ID NO:1634) according to the present invention is supported by 1 libraries. The number of libraries was determined as previously described. This segment can be found in the following transcript(s): R60180_T19 (SEQ ID NO:1628). Table 1531 below describes the starting and ending position of this segment on each transcript.

TABLE 1531

Segment location on transcripts

| Transcript name | Segment starting position | Segment ending position |
|---|---|---|
| R60180_T19 (SEQ ID NO: 1628) | 264 | 493 |

This segment can be found in the following protein(s): R60180_P9.

Segment cluster R60180_node_25 (SEQ ID NO:1635) according to the present invention is supported by 101 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628) and R60180_T22 (SEQ ID NO:1629). Table 1532 below describes the starting and ending position of this segment on each transcript.

TABLE 1532

Segment location on transcripts

| Transcript name | Segment starting position | Segment ending position |
|---|---|---|
| R60180_T7 (SEQ ID NO: 1624) | 593 | 750 |
| R60180_T9 (SEQ ID NO: 1625) | 695 | 852 |
| R60180_T13 (SEQ ID NO: 1626) | 744 | 901 |
| R60180_T18 (SEQ ID NO: 1627) | 593 | 750 |
| R60180_T19 (SEQ ID NO: 1628) | 595 | 752 |
| R60180_T22 (SEQ ID NO: 1629) | 365 | 522 |

This segment can be found in the following protein(s): R60180_P4, R60180_P5, R60180_P8, R60180_P9 and R60180_P12.

Segment cluster R60180_node_29 (SEQ ID NO:1636) according to the present invention is supported by 4 libraries. The number of libraries was determined as previously described. This segment can be found in the following transcript(s): R60180_T24 (SEQ ID NO:1630) and R60180_T28 (SEQ ID NO:1631). Table 1533 below describes the starting and ending position of this segment on each transcript.

TABLE 1533

Segment location on transcripts

| Transcript name | Segment starting position | Segment ending position |
|---|---|---|
| R60180_T24 (SEQ ID NO: 1630) | 1 | 777 |
| R60180_T28 (SEQ ID NO: 1631) | 1 | 777 |

This segment can be found in the following protein(s): R60180_P14 and R60180_P16.

Segment cluster R60180_node_38 (SEQ ID NO:1637) according to the present invention is supported by 4 libraries. The number of libraries was determined as previously described. This segment can be found in the following transcript(s): R60180_T7 (SEQ ID NO:1624). Table 1534 below describes the starting and ending position of this segment on each transcript.

TABLE 1534

Segment location on transcripts

| Transcript name | Segment starting position | Segment ending position |
|---|---|---|
| R60180_T7 (SEQ ID NO: 1624) | 1012 | 1131 |

This segment can be found in the following protein(s): R60180_P4.

Segment cluster R60180_node_41 (SEQ ID NO:1638) according to the present invention is supported by 106 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629) and R60180_T24 (SEQ ID NO:1630). Table 1535 below describes the starting and ending position of this segment on each transcript.

TABLE 1535

Segment location on transcripts

| Transcript name | Segment starting position | Segment ending position |
|---|---|---|
| R60180_T7 (SEQ ID NO: 1624) | 1132 | 1324 |
| R60180_T9 (SEQ ID NO: 1625) | 1114 | 1306 |
| R60180_T13 (SEQ ID NO: 1626) | 1163 | 1355 |
| R60180_T18 (SEQ ID NO: 1627) | 1012 | 1204 |
| R60180_T19 (SEQ ID NO: 1628) | 1014 | 1206 |
| R60180_T22 (SEQ ID NO: 1629) | 784 | 976 |
| R60180_T24 (SEQ ID NO: 1630) | 973 | 1165 |

This segment can be found in both coding and non-coding regions of transcript(s) as follows. The segment can be found in a non-coding region of transcript(s) that are related to the following protein(s): R60180_P4. This segment can also be found in the following protein(s): R60180_P5, R60180_P8, R60180_P9, R60180_P12 and R60180_P14, since it is in the coding region for the corresponding transcript.

Segment cluster R60180_node_45 (SEQ ID NO:1639) according to the present invention is supported by 84 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629) and R60180_T24 (SEQ ID NO:1630). Table 1536 below describes the starting and ending position of this segment on each transcript.

TABLE 1536

Segment location on transcripts

| Transcript name | Segment starting position | Segment ending position |
|---|---|---|
| R60180_T7 (SEQ ID NO: 1624) | 1405 | 1622 |
| R60180_T9 (SEQ ID NO: 1625) | 1387 | 1604 |
| R60180_T13 (SEQ ID NO: 1626) | 1436 | 1653 |
| R60180_T18 (SEQ ID NO: 1627) | 1285 | 1502 |
| R60180_T19 (SEQ ID NO: 1628) | 1287 | 1504 |
| R60180_T22 (SEQ ID NO: 1629) | 1057 | 1274 |
| R60180_T24 (SEQ ID NO: 1630) | 1246 | 1463 |

This segment can be found in a non-coding region of transcript(s) that are related to the following protein(s): R60180_P4, R60180_P5, R60180_P8, R60180_P9, R60180_P12 and R60180_P14.

Segment cluster R60180_node_46 (SEQ ID NO:1640) according to the present invention is supported by 48 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629) and R60180_T24 (SEQ ID NO:1630). Table 1537 below describes the starting and ending position of this segment on each transcript.

TABLE 1537

Segment location on transcripts

| Transcript name | Segment starting position | Segment ending position |
|---|---|---|
| R60180_T7 (SEQ ID NO: 1624) | 1623 | 1684 |
| R60180_T9 (SEQ ID NO: 1625) | 1605 | 1666 |
| R60180_T13 (SEQ ID NO: 1626) | 1654 | 1715 |
| R60180_T18 (SEQ ID NO: 1627) | 1503 | 1564 |
| R60180_T19 (SEQ ID NO: 1628) | 1505 | 1566 |
| R60180_T22 (SEQ ID NO: 1629) | 1275 | 1336 |
| R60180_T24 (SEQ ID NO: 1630) | 1464 | 1525 |

This segment can be found in a non-coding region of transcript(s) that are related to the following protein(s): R60180_P4, R60180_P5, R60180_P8, R60180_P9, R60180_P12 and R60180_P14.

According to an optional embodiment of the present invention, short segments related to the above cluster are also provided. These segments are up to about 120 bp in length, and so are included in a separate description.

Segment cluster R60180_node_2 (SEQ ID NO:1641) according to the present invention is supported by 7 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1538 below describes the starting and ending position of this segment on each transcript.

TABLE 1538

Segment location on transcripts

| Transcript name | Segment starting position | Segment ending position |
|---|---|---|
| R60180_T7 (SEQ ID NO: 1624) | 1 | 40 |
| R60180_T9 (SEQ ID NO: 1625) | 1 | 40 |
| R60180_T13 (SEQ ID NO: 1626) | 1 | 40 |
| R60180_T18 (SEQ ID NO: 1627) | 1 | 40 |

This segment can be found in a non-coding region of transcript(s) that are related to the following protein(s): R60180_P4, R60180_P5 and R60180_P8.

Segment cluster R60180_node_8 (SEQ ID NO:1642) according to the present invention is supported by 108 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1539 below describes the starting and ending position of this segment on each transcript.

TABLE 1539

Segment location on transcripts

| Transcript name | Segment starting position | Segment ending position |
|---|---|---|
| R60180_T7 (SEQ ID NO: 1624) | 171 | 240 |
| R60180_T9 (SEQ ID NO: 1625) | 171 | 240 |
| R60180_T13 (SEQ ID NO: 1626) | 171 | 240 |
| R60180_T18 (SEQ ID NO: 1627) | 171 | 240 |

This segment can be found in both coding and non-coding regions of transcript(s) as follows. The segment can be found in a non-coding region of transcript(s) that are related to the following protein(s): R60180_P5 and R60180_P8. This segment can also be found in the following protein(s): R60180_P4, since it is in the coding region for the corresponding transcript.

Segment cluster R60180_node_10 (SEQ ID NO:1643) according to the present invention is supported by 4 libraries. The number of libraries was determined as previously described. This segment can be found in the following transcript(s): R60180_T13 (SEQ ID NO:1626). Table 1540 below describes the starting and ending position of this segment on each transcript.

TABLE 1540

Segment location on transcripts

| Transcript name | Segment starting position | Segment ending position |
|---|---|---|
| R60180_T13 (SEQ ID NO: 1626) | 241 | 289 |

This segment can be found in a non-coding region of transcript(s) that are related to the following protein(s): R60180_P5.

Segment cluster R60180_node_11 (SEQ ID NO:1644) according to the present invention is supported by 112 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1541 below describes the starting and ending position of this segment on each transcript.

TABLE 1541

Segment location on transcripts

| Transcript name | Segment starting position | Segment ending position |
|---|---|---|
| R60180_T7 (SEQ ID NO: 1624) | 241 | 282 |
| R60180_T9 (SEQ ID NO: 1625) | 241 | 282 |
| R60180_T13 (SEQ ID NO: 1626) | 290 | 331 |
| R60180_T18 (SEQ ID NO: 1627) | 241 | 282 |

This segment can be found in both coding and non-coding regions of transcript(s) as follows. The segment can be found in a non-coding region of transcript(s) that are related to the following protein(s): R60180_P5 and R60180_P8. This segment can also be found in the following protein(s): R60180_P4, since it is in the coding region for the corresponding transcript.

Segment cluster R60180_node_14 (SEQ ID NO:1645) according to the present invention is supported by 16 libraries. The number of libraries was determined as previously described. This segment can be found in the following transcript(s): R60180_T9 (SEQ ID NO:1625), R60180_T13 (SEQ ID NO:1626) and R60180_T18 (SEQ ID NO:1627). Table 1542 below describes the starting and ending position of this segment on each transcript.

TABLE 1542

Segment location on transcripts

| Transcript name | Segment starting position | Segment ending position |
|---|---|---|
| R60180_T9 (SEQ ID NO: 1625) | 283 | 384 |
| R60180_T13 (SEQ ID NO: 1626) | 332 | 433 |
| R60180_T18 (SEQ ID NO: 1627) | 283 | 384 |

This segment can be found in a non-coding region of transcript(s) that are related to the following protein(s): R60180_P5 and R60180_P8.

Segment cluster R60180_node_15 (SEQ ID NO:1646) according to the present invention is supported by 109 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1543 below describes the starting and ending position of this segment on each transcript.

TABLE 1543

Segment location on transcripts

| Transcript name | Segment starting position | Segment ending position |
|---|---|---|
| R60180_T7 (SEQ ID NO: 1624) | 283 | 355 |
| R60180_T9 (SEQ ID NO: 1625) | 385 | 457 |
| R60180_T13 (SEQ ID NO: 1626) | 434 | 506 |
| R60180_T18 (SEQ ID NO: 1627) | 385 | 457 |

This segment can be found in both coding and non-coding regions of transcript(s) as follows. The segment can be found in a non-coding region of transcript(s) that are related to the following protein(s): R60180_P5 and R60180_P8. This segment can also be found in the following protein(s): R60180_P4, since it is in the coding region for the corresponding transcript.

Segment cluster R60180_node__16 (SEQ ID NO:1647) according to the present invention is supported by 100 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626) and R60180_T18 (SEQ ID NO:1627). Table 1544 below describes the starting and ending position of this segment on each transcript.

TABLE 1544

Segment location on transcripts

| Transcript name | Segment starting position | Segment ending position |
| --- | --- | --- |
| R60180_T7 (SEQ ID NO: 1624) | 356 | 389 |
| R60180_T9 (SEQ ID NO: 1625) | 458 | 491 |
| R60180_T13 (SEQ ID NO: 1626) | 507 | 540 |
| R60180_T18 (SEQ ID NO: 1627) | 458 | 491 |

This segment can be found in the following protein(s): R60180_P4, R60180_P5 and R60180_P8.

Segment cluster R60180_node__18 (SEQ ID NO:1648) according to the present invention is supported by 97 libraries. The number of libraries was determined as previously described. This segment can be found in the following transcript(s): R60180_T7 (SEQ ID NO:1624), R60180_T9 (SEQ ID NO:1625) and R60180_T13 (SEQ ID NO:1626). Table 1545 below describes the starting and ending position of this segment on each transcript.

TABLE 1545

Segment location on transcripts

| Transcript name | Segment starting position | Segment ending position |
| --- | --- | --- |
| R60180_T7 (SEQ ID NO: 1624) | 390 | 491 |
| R60180_T9 (SEQ ID NO: 1625) | 492 | 593 |
| R60180_T13 (SEQ ID NO: 1626) | 541 | 642 |

This segment can be found in the following protein(s): R60180_P4 and R60180_P5.

Segment cluster R60180_node__22 (SEQ ID NO:1649) according to the present invention is supported by 105 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628) and R60180_T22 (SEQ ID NO:1629). Table 1546 below describes the starting and ending position of this segment on each transcript.

TABLE 1546

Segment location on transcripts

| Transcript name | Segment starting position | Segment ending position |
| --- | --- | --- |
| R60180_T7 (SEQ ID NO: 1624) | 492 | 592 |
| R60180_T9 (SEQ ID NO: 1625) | 594 | 694 |

TABLE 1546-continued

Segment location on transcripts

| Transcript name | Segment starting position | Segment ending position |
| --- | --- | --- |
| R60180_T13 (SEQ ID NO: 1626) | 643 | 743 |
| R60180_T18 (SEQ ID NO: 1627) | 492 | 592 |
| R60180_T19 (SEQ ID NO: 1628) | 494 | 594 |
| R60180_T22 (SEQ ID NO: 1629) | 264 | 364 |

This segment can be found in the following protein(s): R60180_P4, R60180_P5, R60180_P8, R60180_P9 and R60180_P12.

Segment cluster R60180_node__27 (SEQ ID NO:1650) according to the present invention is supported by 87 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628) and R60180_T22 (SEQ ID NO:1629). Table 1547 below describes the starting and ending position of this segment on each transcript.

TABLE 1547

Segment location on transcripts

| Transcript name | Segment starting position | Segment ending position |
| --- | --- | --- |
| R60180_T7 (SEQ ID NO: 1624) | 751 | 816 |
| R60180_T9 (SEQ ID NO: 1625) | 853 | 918 |
| R60180_T13 (SEQ ID NO: 1626) | 902 | 967 |
| R60180_T18 (SEQ ID NO: 1627) | 751 | 816 |
| R60180_T19 (SEQ ID NO: 1628) | 753 | 818 |
| R60180_T22 (SEQ ID NO: 1629) | 523 | 588 |

This segment can be found in the following protein(s): R60180_P4, R60180_P5, R60180_P8, R60180_P9 and R60180_P12.

Segment cluster R60180_node__30 (SEQ ID NO:1651) according to the present invention is supported by 95 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629), R60180_T24 (SEQ ID NO:1630) and R60180_T28 (SEQ ID NO:1631). Table 1548 below describes the starting and ending position of this segment on each transcript.

TABLE 1548

Segment location on transcripts

| Transcript name | Segment starting position | Segment ending position |
| --- | --- | --- |
| R60180_T7 (SEQ ID NO: 1624) | 817 | 897 |
| R60180_T9 (SEQ ID NO: 1625) | 919 | 999 |
| R60180_T13 (SEQ ID NO: 1626) | 968 | 1048 |
| R60180_T18 (SEQ ID NO: 1627) | 817 | 897 |
| R60180_T19 (SEQ ID NO: 1628) | 819 | 899 |
| R60180_T22 (SEQ ID NO: 1629) | 589 | 669 |
| R60180_T24 (SEQ ID NO: 1630) | 778 | 858 |
| R60180_T28 (SEQ ID NO: 1631) | 778 | 858 |

This segment can be found in the following protein(s): R60180_P4, R60180_P5, R60180_P8, R60180_P9, R60180_P12, R60180_P14 and R60180_P16.

Segment cluster R60180_node_33 (SEQ ID NO:1652) according to the present invention is supported by 101 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629), R60180_T24 (SEQ ID NO:1630) and R60180_T28 (SEQ ID NO:1631). Table 1549 below describes the starting and ending position of this segment on each transcript.

TABLE 1549

| | Segment location on transcripts | |
|---|---|---|
| Transcript name | Segment starting position | Segment ending position |
| R60180_T7 (SEQ ID NO: 1624) | 898 | 1011 |
| R60180_T9 (SEQ ID NO: 1625) | 1000 | 1113 |
| R60180_T13 (SEQ ID NO: 1626) | 1049 | 1162 |
| R60180_T18 (SEQ ID NO: 1627) | 898 | 1011 |
| R60180_T19 (SEQ ID NO: 1628) | 900 | 1013 |
| R60180_T22 (SEQ ID NO: 1629) | 670 | 783 |
| R60180_T24 (SEQ ID NO: 1630) | 859 | 972 |
| R60180_T28 (SEQ ID NO: 1631) | 859 | 972 |

This segment can be found in the following protein(s): R60180_P4, R60180_P5, R60180_P8, R60180_P9, R60180_P12, R60180_P14 and R60180_P16.

Segment cluster R60180_node_34 (SEQ ID NO:1653) according to the present invention is supported by 1 libraries. The number of libraries was determined as previously described. This segment can be found in the following transcript(s): R60180_T28 (SEQ ID NO:1631). Table 1550 below describes the starting and ending position of this segment on each transcript.

TABLE 1550

| | Segment location on transcripts | |
|---|---|---|
| Transcript name | Segment starting position | Segment ending position |
| R60180_T28 (SEQ ID NO: 1631) | 973 | 1061 |

This segment can be found in the following protein(s): R60180_P16.

Segment cluster R60180_node_43 (SEQ ID NO:1654) according to the present invention can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629) and R60180_T24 (SEQ ID NO:1630). Table 1551 below describes the starting and ending position of this segment on each transcript.

TABLE 1551

| | Segment location on transcripts | |
|---|---|---|
| Transcript name | Segment starting position | Segment ending position |
| R60180_T7 (SEQ ID NO: 1624) | 1325 | 1346 |
| R60180_T9 (SEQ ID NO: 1625) | 1307 | 1328 |
| R60180_T13 (SEQ ID NO: 1626) | 1356 | 1377 |
| R60180_T18 (SEQ ID NO: 1627) | 1205 | 1226 |
| R60180_T19 (SEQ ID NO: 1628) | 1207 | 1228 |
| R60180_T22 (SEQ ID NO: 1629) | 977 | 998 |
| R60180_T24 (SEQ ID NO: 1630) | 1166 | 1187 |

This segment can be found in a non-coding region of transcript(s) that are related to the following protein(s): R60180_P4, R60180_P5, R60180_P8, R60180_P9, R60180_P12 and R60180_P14.

Segment cluster R60180_node_44 (SEQ ID NO:1655) according to the present invention is supported by 87 libraries. The number of libraries was determined as previously described. This segment can be found in the following transcript(s): R60180_T7 (SEQ ID NO:1624), R60180_T9 (SEQ ID NO:1625), R60180_T13 (SEQ ID NO:1626), R60180_T18 (SEQ ID NO:1627), R60180_T19 (SEQ ID NO:1628), R60180_T22 (SEQ ID NO:1629) and R60180_T24 (SEQ ID NO:1630). Table 1552 below describes the starting and ending position of this segment on each transcript.

TABLE 1552

| | Segment location on transcripts | |
|---|---|---|
| Transcript name | Segment starting position | Segment ending position |
| R60180_T7 (SEQ ID NO: 1624) | 1347 | 1404 |
| R60180_T9 (SEQ ID NO: 1625) | 1329 | 1386 |
| R60180_T13 (SEQ ID NO: 1626) | 1378 | 1435 |
| R60180_T18 (SEQ ID NO: 1627) | 1227 | 1284 |
| R60180_T19 (SEQ ID NO: 1628) | 1229 | 1286 |
| R60180_T22 (SEQ ID NO: 1629) | 999 | 1056 |
| R60180_T24 (SEQ ID NO: 1630) | 1188 | 1245 |

This segment can be found in a non-coding region of transcript(s) that are related to the following protein(s): R60180_P4, R60180_P5, R60180_P8, R60180_P9, R60180_P12 and R60180_P14.

Description for Cluster T07144

Cluster T07144 features 4 transcript(s) and 32 segment(s) of interest, the names for which are given in Tables 1553 and 1554, respectively, the sequences themselves are given at the end of the application. The selected protein variants are given in Table 1555.

TABLE 1553

| Transcripts of interest Transcript Name |
|---|
| T07144_T14 (SEQ ID NO: 1656) |
| T07144_T20 (SEQ ID NO: 1657) |
| T07144_T22 (SEQ ID NO: 1658) |
| T07144_T27 (SEQ ID NO: 1659) |

TABLE 1554

Segments of interest
Segment Name

T07144_node_0 (SEQ ID NO: 1660)
T07144_node_2 (SEQ ID NO: 1661)
T07144_node_21 (SEQ ID NO: 1662)
T07144_node_23 (SEQ ID NO: 1663)
T07144_node_26 (SEQ ID NO: 1664)
T07144_node_28 (SEQ ID NO: 1665)
T07144_node_30 (SEQ ID NO: 1666)
T07144_node_31 (SEQ ID NO: 1667)
T07144_node_37 (SEQ ID NO: 1668)
T07144_node_39 (SEQ ID NO: 1669)
T07144_node_43 (SEQ ID NO: 1670)
T07144_node_45 (SEQ ID NO: 1671)
T07144_node_48 (SEQ ID NO: 1672)
T07144_node_52 (SEQ ID NO: 1673)
T07144_node_53 (SEQ ID NO: 1674)
T07144_node_54 (SEQ ID NO: 1675)
T07144_node_62 (SEQ ID NO: 1676)
T07144_node_64 (SEQ ID NO: 1677)
T07144_node_66 (SEQ ID NO: 1678)
T07144_node_15 (SEQ ID NO: 1679)
T07144_node_20 (SEQ ID NO: 1680)
T07144_node_24 (SEQ ID NO: 1681)
T07144_node_34 (SEQ ID NO: 1682)
T07144_node_35 (SEQ ID NO: 1683)
T07144_node_46 (SEQ ID NO: 1684)
T07144_node_50 (SEQ ID NO: 1685)
T07144_node_55 (SEQ ID NO: 1686)
T07144_node_56 (SEQ ID NO: 1687)
T07144_node_57 (SEQ ID NO: 1688)
T07144_node_58 (SEQ ID NO: 1689)
T07144_node_60 (SEQ ID NO: 1690)
T07144_node_61 (SEQ ID NO: 1691)

TABLE 1555

Proteins of interest

| Protein Name | Corresponding Transcript(s) |
|---|---|
| T07144_P1 | T07144_T22 (SEQ ID NO: 1658) |
| T07144_P12 | T07144_T27 (SEQ ID NO: 1659) |
| T07144_P13 | T07144_T14 (SEQ ID NO: 1656); T07144_T20 (SEQ ID NO: 1657) |

These sequences are variants of the known protein Beta-catenin (SwissProt accession identifier CTNB_HUMAN; known also according to the synonyms PRO2286), referred to herein as the previously known protein.

Protein Beta-catenin is known or believed to have the following function(s): Involved in the regulation of cell adhesion and in signal transduction through the Wnt pathway. The sequence for protein Beta-catenin is given at the end of the application, as "Beta-catenin amino acid sequence". Known polymorphisms for this sequence are as shown in Table 1556.

TABLE 1556

Amino acid mutations for Known Protein

| SNP position(s) on amino acid sequence | Comment |
|---|---|
| 23 | S -> R (in hepatocellular carcinoma). /FTId = VAR_017612. |
| 25-33 | Missing (in hepatocellular carcinoma). /FTId = VAR_017613. |
| 32 | D -> A (in hepatocellular carcinoma). /FTId = VAR_017614. |
| 32 | D -> G (in PTR and hepatocellular carcinoma). /FTId = VAR_017615. |
| 32 | D -> Y (in PTR, hepatoblastoma and hepatocellular carcinoma). /FTId = VAR_017616. |
| 33 | S -> F (in PTR, MDB and hepatocellular carcinoma). /FTId = VAR_017617. |
| 33 | S -> L (in hepatocellular carcinoma). /FTId = VAR_017618. |
| 33 | S -> Y (in PTR; enhances transactivation of target genes). /FTId = VAR_017619. |
| 34 | G -> E (in PTR). /FTId = VAR_017620. |
| 34 | G -> R (in hepatocellular carcinoma). /FTId = VAR_017621. |
| 34 | G -> V (in hepatoblastoma). /FTId = VAR_017622. |
| 35 | I -> S (in hepatocellular carcinoma). /FTId = VAR_017623. |
| 37 | S -> A (in MDB and hepatocellular carcinoma). /FTId = VAR_017624. |
| 37 | S -> C (in PTR and hepatoblastoma). /FTId = VAR_017625. |
| 37 | S -> F (in PTR). /FTId = VAR_017626. |
| 37 | S -> Y (in hepatocellular carcinoma). /FTId = VAR_017627. |
| 37-38 | SG -> W (in hepatocellular carcinoma). /FTId = VAR_017628. |
| 41 | T -> A (in hepatoblastoma and hepatocellular carcinoma; also in a desmoid tumor; abolishes phosphorylation on Ser-33 and Ser-37 and enhances transactivation of target genes). /FTId = VAR_017629. |
| 41 | T -> I (in PTR and hepatocellular carcinoma). /FTId = VAR_017630. |
| 45 | S -> F (in hepatocellular carcinoma). /FTId = VAR_017631. |
| 45 | S -> P (in hepatocellular carcinoma). /FTId = VAR_017632. |
| 37 | S->A: Enhances transactivation of target genes. |
| 253 | F->A: Abolishes or strongly reduces AXIN2 binding. |
| 260 | H->A: Abolishes or strongly reduces AXIN1 and AXIN2 binding. Strongly reduces phosphorylation and degradation; when associated with Ala-386 and Ala-383. |
| 292 | K->A: Abolishes or strongly reduces AXIN1 and AXIN2 binding. |
| 312 | K->E: Abolishes TCF7L2 binding. |
| 345 | K->A: Abolishes APC binding. |
| 383 | W->A: Abolishes APC binding. Strongly reduces phosphorylation and degradation; when associated with Ala-260 AND Ala-386. |
| 386 | R->A: Strongly reduces APC binding. Strongly reduces phosphorylation and degradation; when associated with Ala-260 and Ala-383. |
| 426 | N->A: Abolishes TCF7L2 and LEF1 binding. |
| 435 | K->A: Strongly reduces or abolishes LEF1 binding. |
| 435 | K->E: Abolishes TCF7L2 binding. |
| 469 | R->A: Abolishes TCF7L2 binding, and strongly reduces or abolishes LEF1 binding. |
| 470 | H->A: Abolishes TCF7L2 binding, and strongly reduces or abolishes LEF1 binding. |
| 508 | K->A: Abolishes TCF7L2 and LEF1 binding. |
| 654 | Y->E: Enhances TBP binding and transactivation of target genes. |
| 654 | Y->F: Abolishes increase of TBP binding after phosphorylation by CSK. |
| 660 | F->A: Abolishes CTNNBIP1 binding; when associated with Ala-661. |
| 661 | R->A: Abolishes CTNNBIP1 binding; when associated with Ala-660. |

Protein Beta-catenin localization is believed to be Cytoplasmic when it is unstabilized (high level of phosphorylation) or bound to CDH1. Translocates to the nucleus when it is stabilized (low level of phosphorylation).

The following GO Annotation(s) apply to the previously known protein. The following annotation(s) were found: transcription; transcription regulation, from Pol II promoter; cell adhesion; Wnt receptor signaling pathway, which are annotation(s) related to Biological Process; signal transducer; structural protein; protein binding, which are annotation(s)

related to Molecular Function; and nucleus; cytoskeleton; plasma membrane; intercellular junction, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster T07144 features 32 segment(s), which were listed in Table 1554 above and for which the sequence(s) are given at the end of the application. These segment(s) are portions of nucleic acid sequence(s) which are described herein separately because they are of particular interest. A description of each segment according to the present invention is now provided.

Segment cluster T07144_node_0 (SEQ ID NO:1660) according to the present invention is supported by 93 libraries. The number of libraries was determined as previously described. This segment can be found in the following transcript(s): T07144_T22 (SEQ ID NO:1658) and T07144_T27 (SEQ ID NO:1659). Table 1557 below describes the starting and ending position of this segment on each transcript.

TABLE 1557

Segment location on transcripts

| Transcript name | Segment starting position | Segment ending position |
|---|---|---|
| T07144_T22 (SEQ ID NO: 1658) | 1 | 233 |
| T07144_T27 (SEQ ID NO: 1659) | 1 | 233 |

This segment can be found in a non-coding region of transcript(s) that are related to the following protein(s): T07144_P1 and T07144_P12.

Segment cluster T07144_node_2 (SEQ ID NO:1661) according to the present invention is supported by 3 libraries. The number of libraries was determined as previously described. This segment can be found in the following transcript(s): T07144_T14 (SEQ ID NO:1656) and T07144_T20 (SEQ ID NO:1657). Table 1558 below describes the starting and ending position of this segment on each transcript.

TABLE 1558

Segment location on transcripts

| Transcript name | Segment starting position | Segment ending position |
|---|---|---|
| T07144_T14 (SEQ ID NO: 1656) | 1 | 226 |
| T07144_T20 (SEQ ID NO: 1657) | 1 | 226 |

This segment can be found in a non-coding region of transcript(s) that are related to the following protein(s): T07144_P13.

Segment cluster T07144_node_21 (SEQ ID NO:1662) according to the present invention is supported by 96 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1559 below describes the starting and ending position of this segment on each transcript.

TABLE 1559

Segment location on transcripts

| Transcript name | Segment starting position | Segment ending position |
|---|---|---|
| T07144_T14 (SEQ ID NO: 1656) | 336 | 515 |
| T07144_T20 (SEQ ID NO: 1657) | 336 | 515 |
| T07144_T22 (SEQ ID NO: 1658) | 343 | 522 |
| T07144_T27 (SEQ ID NO: 1659) | 343 | 522 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node_23 (SEQ ID NO:1663) according to the present invention is supported by 100 libraries. The number of libraries was determined as previously described. This segment can be found in the following transcript(s): T07144_T14 (SEQ ID NO:1656), T07144_T22 (SEQ ID NO:1658) and T07144_T27 (SEQ ID NO:1659). Table 1560 below describes the starting and ending position of this segment on each transcript.

TABLE 1560

Segment location on transcripts

| Transcript name | Segment starting position | Segment ending position |
|---|---|---|
| T07144_T14 (SEQ ID NO: 1656) | 516 | 664 |
| T07144_T22 (SEQ ID NO: 1658) | 523 | 671 |
| T07144_T27 (SEQ ID NO: 1659) | 523 | 671 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node_26 (SEQ ID NO:1664) according to the present invention is supported by 102 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1561 below describes the starting and ending position of this segment on each transcript.

TABLE 1561

Segment location on transcripts

| Transcript name | Segment starting position | Segment ending position |
|---|---|---|
| T07144_T14 (SEQ ID NO: 1656) | 770 | 1008 |
| T07144_T20 (SEQ ID NO: 1657) | 621 | 859 |
| T07144_T22 (SEQ ID NO: 1658) | 777 | 1015 |
| T07144_T27 (SEQ ID NO: 1659) | 777 | 1015 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node__28 (SEQ ID NO:1665) according to the present invention is supported by 94 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1562 below describes the starting and ending position of this segment on each transcript.

TABLE 1562

Segment location on transcripts

| Transcript name | Segment starting position | Segment ending position |
|---|---|---|
| T07144_T14 (SEQ ID NO: 1656) | 1009 | 1210 |
| T07144_T20 (SEQ ID NO: 1657) | 860 | 1061 |
| T07144_T22 (SEQ ID NO: 1658) | 1016 | 1217 |
| T07144_T27 (SEQ ID NO: 1659) | 1016 | 1217 |

This segment can be found in the following protein(s): T07144_P13, T07144_P1 and T07144_P12.

Segment cluster T07144_node__30 (SEQ ID NO:1666) according to the present invention is supported by 96 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1563 below describes the starting and ending position of this segment on each transcript.

TABLE 1563

Segment location on transcripts

| Transcript name | Segment starting position | Segment ending position |
|---|---|---|
| T07144_T14 (SEQ ID NO: 1656) | 1211 | 1355 |
| T07144_T20 (SEQ ID NO: 1657) | 1062 | 1206 |
| T07144_T22 (SEQ ID NO: 1658) | 1218 | 1362 |
| T07144_T27 (SEQ ID NO: 1659) | 1218 | 1362 |

This segment can be found in the following protein(s): T07144_P13, T07144_P1 and T07144_P12.

Segment cluster T07144_node__31 (SEQ ID NO:1667) according to the present invention is supported by 3 libraries. The number of libraries was determined as previously described. This segment can be found in the following transcript(s): T07144_T27 (SEQ ID NO:1659). Table 1564 below describes the starting and ending position of this segment on each transcript.

TABLE 1564

Segment location on transcripts

| Transcript name | Segment starting position | Segment ending position |
|---|---|---|
| T07144_T27 (SEQ ID NO: 1659) | 1363 | 1882 |

This segment can be found in the following protein(s): T07144_P12.

Segment cluster T07144_node__37 (SEQ ID NO:1668) according to the present invention is supported by 136 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1565 below describes the starting and ending position of this segment on each transcript.

TABLE 1565

Segment location on transcripts

| Transcript name | Segment starting position | Segment ending position |
|---|---|---|
| T07144_T14 (SEQ ID NO: 1656) | 1460 | 1798 |
| T07144_T20 (SEQ ID NO: 1657) | 1311 | 1649 |
| T07144_T22 (SEQ ID NO: 1658) | 1467 | 1805 |

This segment can be found in the following protein(s): T07144_P13 and T07144_P1.

Segment cluster T07144_node__39 (SEQ ID NO:1669) according to the present invention is supported by 121 libraries. The number of libraries was determined as previously described. This segment can be found in the following transcript(s): (SEQ ID NO:1656), T07144_T20 (SEQ ID NO:1657) and (SEQ ID NO:1658). Table 1566 below describes the starting and ending position of this segment on each transcript.

TABLE 1566

Segment location on transcripts

| Transcript name | Segment starting position | Segment ending position |
|---|---|---|
| T07144_T14 (SEQ ID NO: 1656) | 1799 | 1957 |
| T07144_T20 (SEQ ID NO: 1657) | 1650 | 1808 |
| T07144_T22 (SEQ ID NO: 1658) | 1806 | 1964 |

This segment can be found in the following protein(s): T07144_P13 and T07144_P1.

Segment cluster T07144_node__43 (SEQ ID NO:1670) according to the present invention is supported by 124 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1567 below describes the starting and ending position of this segment on each transcript.

TABLE 1567

Segment location on transcripts

| Transcript name | Segment starting position | Segment ending position |
|---|---|---|
| T07144_T14 (SEQ ID NO: 1656) | 1958 | 2077 |
| T07144_T20 (SEQ ID NO: 1657) | 1809 | 1928 |
| T07144_T22 (SEQ ID NO: 1658) | 1965 | 2084 |

This segment can be found in the following protein(s): T07144_P13 and T07144_P1.

Segment cluster T07144_node__45 (SEQ ID NO:1671) according to the present invention is supported by 148 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1568 below describes the starting and ending position of this segment on each transcript.

TABLE 1568

Segment location on transcripts

| Transcript name | Segment starting position | Segment ending position |
|---|---|---|
| T07144_T14 (SEQ ID NO: 1656) | 2078 | 2222 |
| T07144_T20 (SEQ ID NO: 1657) | 1929 | 2073 |
| T07144_T22 (SEQ ID NO: 1658) | 2085 | 2229 |

This segment can be found in the following protein(s): T07144_P13 and T07144_P1.

Segment cluster T07144_node_48 (SEQ ID NO:1672) according to the present invention is supported by 147 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1569 below describes the starting and ending position of this segment on each transcript.

TABLE 1569

Segment location on transcripts

| Transcript name | Segment starting position | Segment ending position |
|---|---|---|
| T07144_T14 (SEQ ID NO: 1656) | 2229 | 2350 |
| T07144_T20 (SEQ ID NO: 1657) | 2080 | 2201 |
| T07144_T22 (SEQ ID NO: 1658) | 2236 | 2357 |

This segment can be found in the following protein(s): T07144_P13 and T07144_P1.

Segment cluster T07144_node_52 (SEQ ID NO:1673) according to the present invention is supported by 171 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1570 below describes the starting and ending position of this segment on each transcript.

TABLE 1570

Segment location on transcripts

| Transcript name | Segment starting position | Segment ending position |
|---|---|---|
| T07144_T14 (SEQ ID NO: 1656) | 2412 | 2632 |
| T07144_T20 (SEQ ID NO: 1657) | 2263 | 2483 |
| T07144_T22 (SEQ ID NO: 1658) | 2419 | 2639 |

This segment can be found in the following protein(s): T07144_P13 and T07144_P1.

Segment cluster T07144_node_53 (SEQ ID NO:1674) according to the present invention is supported by 121 libraries. The number of libraries was determined as previously described. This segment can be found in the following transcript(s): T07144_T14 (SEQ ID NO:1656) and T07144_T20 (SEQ ID NO:1657). Table 1571 below describes the starting and ending position of this segment on each transcript.

TABLE 1571

Segment location on transcripts

| Transcript name | Segment starting position | Segment ending position |
|---|---|---|
| T07144_T14 (SEQ ID NO: 1656) | 2633 | 2937 |
| T07144_T20 (SEQ ID NO: 1657) | 2484 | 2788 |

This segment can be found in a non-coding region of transcript(s) that are related to the following protein(s): T07144_P13.

Segment cluster T07144_node_54 (SEQ ID NO:1675) according to the present invention is supported by 126 libraries. The number of libraries was determined as previously described. This segment can be found in the following transcript(s): T07144_T14 (SEQ ID NO:1656) and T07144_T20 (SEQ ID NO:1657). Table 1572 below describes the starting and ending position of this segment on each transcript.

TABLE 1572

Segment location on transcripts

| Transcript name | Segment starting position | Segment ending position |
|---|---|---|
| T07144_T14 (SEQ ID NO: 1656) | 2938 | 3090 |
| T07144_T20 (SEQ ID NO: 1657) | 2789 | 2941 |

This segment can be found in a non-coding region of transcript(s) that are related to the following protein(s): T07144_P13.

Segment cluster T07144_node_62 (SEQ ID NO:1676) according to the present invention is supported by 176 libraries. The number of libraries was determined as previously described. This segment can be found in the following transcript(s): T07144_T14 (SEQ ID NO:1656) and T07144_T20 (SEQ ID NO:1657). Table 1573 below describes the starting and ending position of this segment on each transcript.

TABLE 1573

Segment location on transcripts

| Transcript name | Segment starting position | Segment ending position |
|---|---|---|
| T07144_T14 (SEQ ID NO: 1656) | 3294 | 3728 |
| T07144_T20 (SEQ ID NO: 1657) | 3145 | 3579 |

This segment can be found in a non-coding region of transcript(s) that are related to the following protein(s): T07144_P13.

Segment cluster T07144_node_64 (SEQ ID NO:1677) according to the present invention is supported by 1 libraries. The number of libraries was determined as previously described. This segment can be found in the following transcript(s): T07144_T22 (SEQ ID NO:1658). Table 1574 below describes the starting and ending position of this segment on each transcript.

TABLE 1574

Segment location on transcripts

| Transcript name | Segment starting position | Segment ending position |
|---|---|---|
| T07144_T22 (SEQ ID NO: 1658) | 2640 | 2792 |

This segment can be found in a non-coding region of transcript(s) that are related to the following protein(s): T07144_P1.

Segment cluster T07144_node_66 (SEQ ID NO:1678) according to the present invention is supported by 1 libraries. The number of libraries was determined as previously described. This segment can be found in the following transcript(s): T07144_T22 (SEQ ID NO:1658). Table 1575 below describes the starting and ending position of this segment on each transcript.

TABLE 1575

Segment location on transcripts

| Transcript name | Segment starting position | Segment ending position |
|---|---|---|
| T07144_T22 (SEQ ID NO: 1658) | 2793 | 3031 |

This segment can be found in a non-coding region of transcript(s) that are related to the following protein(s): T07144_P1.

According to an optional embodiment of the present invention, short segments related to the above cluster are also provided. These segments are up to about 120 bp in length, and so are included in a separate description.

Segment cluster T07144_node_15 (SEQ ID NO:1679) according to the present invention is supported by 100 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1576 below describes the starting and ending position of this segment on each transcript.

TABLE 1576

Segment location on transcripts

| Transcript name | Segment starting position | Segment ending position |
|---|---|---|
| T07144_T14 (SEQ ID NO: 1656) | 227 | 287 |
| T07144_T20 (SEQ ID NO: 1657) | 227 | 287 |
| T07144_T22 (SEQ ID NO: 1658) | 234 | 294 |
| T07144_T27 (SEQ ID NO: 1659) | 234 | 294 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node_20 (SEQ ID NO:1680) according to the present invention is supported by 96 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1577 below describes the starting and ending position of this segment on each transcript.

TABLE 1577

Segment location on transcripts

| Transcript name | Segment starting position | Segment ending position |
|---|---|---|
| T07144_T14 (SEQ ID NO: 1656) | 288 | 335 |
| T07144_T20 (SEQ ID NO: 1657) | 288 | 335 |
| T07144_T22 (SEQ ID NO: 1658) | 295 | 342 |
| T07144_T27 (SEQ ID NO: 1659) | 295 | 342 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node_24 (SEQ ID NO:1681) according to the present invention is supported by 91 libraries. The number of libraries was determined as previously described. This segment can be found in the following transcript(s): T07144_T14 (SEQ ID NO:1656), T07144_T20 (SEQ ID NO:1657), T07144_T22 (SEQ ID NO:1658) and T07144_T27 (SEQ ID NO:1659). Table 1578 below describes the starting and ending position of this segment on each transcript.

TABLE 1578

Segment location on transcripts

| Transcript name | Segment starting position | Segment ending position |
|---|---|---|
| T07144_T14 (SEQ ID NO: 1656) | 665 | 769 |
| T07144_T20 (SEQ ID NO: 1657) | 516 | 620 |
| T07144_T22 (SEQ ID NO: 1658) | 672 | 776 |
| T07144_T27 (SEQ ID NO: 1659) | 672 | 776 |

This segment can be found in both coding and non-coding regions of transcript(s) as follows. The segment can be found in a non-coding region of transcript(s) that are related to the following protein(s): T07144_P13. This segment can also be found in the following protein(s): T07144_P1 and T07144_P12, since it is in the coding region for the corresponding transcript.

Segment cluster T07144_node_34 (SEQ ID NO:1682) according to the present invention is supported by 91 libraries. The number of libraries was determined as previously described. This segment can be found in the following transcript(s): T07144_T14 (SEQ ID NO:1656), T07144_T20 (SEQ ID NO:1657) and T07144_T22 (SEQ ID NO:1658). Table 1579 below describes the starting and ending position of this segment on each transcript.

TABLE 1579

Segment location on transcripts

| Transcript name | Segment starting position | Segment ending position |
|---|---|---|
| T07144_T14 (SEQ ID NO: 1656) | 1356 | 1451 |
| T07144_T20 (SEQ ID NO: 1657) | 1207 | 1302 |
| T07144_T22 (SEQ ID NO: 1658) | 1363 | 1458 |

This segment can be found in the following protein(s): T07144_P13 and T07144_P1.

Segment cluster T07144_node_35 (SEQ ID NO:1683) according to the present invention can be found in the following transcript(s): T07144_T14 (SEQ ID NO:1656), T07144_T20 (SEQ ID NO:1657) and T07144_T22 (SEQ ID NO:1658). Table 1580 below describes the starting and ending position of this segment on each transcript.

TABLE 1580

Segment location on transcripts

| Transcript name | Segment starting position | Segment ending position |
|---|---|---|
| T07144_T14 (SEQ ID NO: 1656) | 1452 | 1459 |
| T07144_T20 (SEQ ID NO: 1657) | 1303 | 1310 |
| T07144_T22 (SEQ ID NO: 1658) | 1459 | 1466 |

This segment can be found in the following protein(s): T07144_P13 and T07144_P1.

Segment cluster T07144_node_46 (SEQ ID NO:1684) according to the present invention can be found in the following transcript(s): T07144_T14 (SEQ ID NO:1656), T07144_T20 (SEQ ID NO:1657) and T07144_T22 (SEQ ID NO:1658). Table 1581 below describes the starting and ending position of this segment on each transcript.

TABLE 1581

Segment location on transcripts

| Transcript name | Segment starting position | Segment ending position |
|---|---|---|
| T07144_T14 (SEQ ID NO: 1656) | 2223 | 2228 |
| T07144_T20 (SEQ ID NO: 1657) | 2074 | 2079 |
| T07144_T22 (SEQ ID NO: 1658) | 2230 | 2235 |

This segment can be found in the following protein(s): T07144_P13 and T07144_P1.

Segment cluster T07144_node_50 (SEQ ID NO:1685) according to the present invention is supported by 115 libraries. The number of libraries was determined as previously described. This segment can be found in the following transcript(s): (SEQ ID NO:1656), T07144_T20 (SEQ ID NO:1657) and (SEQ ID NO:1658). Table 1582 below describes the starting and ending position of this segment on each transcript.

TABLE 1582

Segment location on transcripts

| Transcript name | Segment starting position | Segment ending position |
|---|---|---|
| T07144_T14 (SEQ ID NO: 1656) | 2351 | 2411 |
| T07144_T20 (SEQ ID NO: 1657) | 2202 | 2262 |
| T07144_T22 (SEQ ID NO: 1658) | 2358 | 2418 |

This segment can be found in the following protein(s): T07144_P13 and T07144_P1.

Segment cluster T07144_node_55 (SEQ ID NO:1686) according to the present invention can be found in the following transcript(s): T07144_T14 (SEQ ID NO:1656) and T07144_T20 (SEQ ID NO:1657). Table 1583 below describes the starting and ending position of this segment on each transcript.

TABLE 1583

Segment location on transcripts

| Transcript name | Segment starting position | Segment ending position |
|---|---|---|
| T07144_T14 (SEQ ID NO: 1656) | 3091 | 3096 |
| T07144_T20 (SEQ ID NO: 1657) | 2942 | 2947 |

This segment can be found in a non-coding region of transcript(s) that are related to the following protein(s): T07144_P13.

Segment cluster T07144_node_56 (SEQ ID NO:1687) according to the present invention is supported by 119 libraries. The number of libraries was determined as previously described. This segment can be found in the following transcript(s): T07144_T14 (SEQ ID NO:1656) and T07144_T20 (SEQ ID NO:1657). Table 1584 below describes the starting and ending position of this segment on each transcript.

TABLE 1584

Segment location on transcripts

| Transcript name | Segment starting position | Segment ending position |
|---|---|---|
| T07144_T14 (SEQ ID NO: 1656) | 3097 | 3130 |
| T07144_T20 (SEQ ID NO: 1657) | 2948 | 2981 |

This segment can be found in a non-coding region of transcript(s) that are related to the following protein(s): T07144_P13.

Segment cluster T07144_node_57 (SEQ ID NO:1688) according to the present invention is supported by 105 libraries. The number of libraries was determined as previously described. This segment can be found in the following transcript(s): T07144_T14 (SEQ ID NO:1656) and T07144_T20 (SEQ ID NO:1657). Table 1585 below describes the starting and ending position of this segment on each transcript.

TABLE 1585

Segment location on transcripts

| Transcript name | Segment starting position | Segment ending position |
|---|---|---|
| T07144_T14 (SEQ ID NO: 1656) | 3131 | 3216 |
| T07144_T20 (SEQ ID NO: 1657) | 2982 | 3067 |

This segment can be found in a non-coding region of transcript(s) that are related to the following protein(s): T07144_P13.

Segment cluster T07144_node__58 (SEQ ID NO:1689) according to the present invention is supported by 44 libraries. The number of libraries was determined as previously described. This segment can be found in the following transcript(s): T07144_T14 (SEQ ID NO:1656) and T07144_T20 (SEQ ID NO:1657). Table 1586 below describes the starting and ending position of this segment on each transcript.

TABLE 1586

| Segment location on transcripts | | |
|---|---|---|
| Transcript name | Segment starting position | Segment ending position |
| T07144_T14 (SEQ ID NO: 1656) | 3217 | 3261 |
| T07144_T20 (SEQ ID NO: 1657) | 3068 | 3112 |

This segment can be found in a non-coding region of transcript(s) that are related to the following protein(s): T07144_P13.

Segment cluster T07144_node__60 (SEQ ID NO:1690) according to the present invention can be found in the following transcript(s): T07144_T14 (SEQ ID NO:1656) and T07144_T20 (SEQ ID NO:1657). Table 1587 below describes the starting and ending position of this segment on each transcript.

TABLE 1587

| Segment location on transcripts | | |
|---|---|---|
| Transcript name | Segment starting position | Segment ending position |
| T07144_T14 (SEQ ID NO: 1656) | 3262 | 3280 |
| T07144_T20 (SEQ ID NO: 1657) | 3113 | 3131 |

This segment can be found in a non-coding region of transcript(s) that are related to the following protein(s): T07144_P13.

Segment cluster T07144_node__61 (SEQ ID NO:1691) according to the present invention can be found in the following transcript(s): T07144_T14 (SEQ ID NO:1656) and T07144_T20 (SEQ ID NO:1657). Table 1588 below describes the starting and ending position of this segment on each transcript.

TABLE 1588

| Segment location on transcripts | | |
|---|---|---|
| Transcript name | Segment starting position | Segment ending position |
| T07144_T14 (SEQ ID NO: 1656) | 3281 | 3293 |
| T07144_T20 (SEQ ID NO: 1657) | 3132 | 3144 |

This segment can be found in a non-coding region of transcript(s) that are related to the following protein(s): T07144_P13.

Description for Cluster T07259

Cluster T07259 features 7 transcript(s) and 33 segment(s) of interest, the names for which are given in Tables 1589 and 1590, respectively, the sequences themselves are given at the end of the application. The selected protein variants are given in Table 1591.

TABLE 1589

| Transcripts of interest |
|---|
| Transcript Name |
| T07259_T3 (SEQ ID NO: 1692) |
| T07259_T4 (SEQ ID NO: 1693) |
| T07259_T7 (SEQ ID NO: 1694) |
| T07259_T9 (SEQ ID NO: 1695) |
| T07259_T25 (SEQ ID NO: 1696) |
| T07259_T26 (SEQ ID NO: 1697) |
| T07259_T27 (SEQ ID NO: 1698) |

TABLE 1590

| Segments of interest |
|---|
| Segment Name |
| T07259_node__0 (SEQ ID NO: 1699) |
| T07259_node__2 (SEQ ID NO: 1700) |
| T07259_node__3 (SEQ ID NO: 1701) |
| T07259_node__6 (SEQ ID NO: 1702) |
| T07259_node__10 (SEQ ID NO: 1703) |
| T07259_node__12 (SEQ ID NO: 1704) |
| T07259_node__14 (SEQ ID NO: 1705) |
| T07259_node__17 (SEQ ID NO: 1706) |
| T07259_node__20 (SEQ ID NO: 1707) |
| T07259_node__29 (SEQ ID NO: 1708) |
| T07259_node__31 (SEQ ID NO: 1709) |
| T07259_node__33 (SEQ ID NO: 1710) |
| T07259_node__40 (SEQ ID NO: 1711) |
| T07259_node__42 (SEQ ID NO: 1712) |
| T07259_node__46 (SEQ ID NO: 1713) |
| T07259_node__50 (SEQ ID NO: 1714) |
| T07259_node__52 (SEQ ID NO: 1715) |
| T07259_node__59 (SEQ ID NO: 1716) |
| T07259_node__62 (SEQ ID NO: 1717) |
| T07259_node__64 (SEQ ID NO: 1718) |
| T07259_node__66 (SEQ ID NO: 1719) |
| T07259_node__68 (SEQ ID NO: 1720) |
| T07259_node__9 (SEQ ID NO: 1721) |
| T07259_node__13 (SEQ ID NO: 1722) |
| T07259_node__19 (SEQ ID NO: 1723) |
| T07259_node__22 (SEQ ID NO: 1724) |
| T07259_node__24 (SEQ ID NO: 1725) |
| T07259_node__26 (SEQ ID NO: 1726) |
| T07259_node__27 (SEQ ID NO: 1727) |
| T07259_node__36 (SEQ ID NO: 1728) |
| T07259_node__38 (SEQ ID NO: 1729) |
| T07259_node__57 (SEQ ID NO: 1730) |
| T07259_node__67 (SEQ ID NO: 1731) |

TABLE 1591

| Proteins of interest | |
|---|---|
| Protein Name | Corresponding Transcript(s) |
| T07259_P4 | T07259_T3 (SEQ ID NO: 1692); T07259_T4 (SEQ ID NO: 1693) |
| T07259_P5 | T07259_T7 (SEQ ID NO: 1694); T07259_T9 (SEQ ID NO: 1695) |
| T07259_P16 | T07259_T25 (SEQ ID NO: 1696) |
| T07259_P17 | T07259_T26 (SEQ ID NO: 1697) |

These sequences are variants of the known protein Hypothetical protein KIAA0250 (SwissProt accession identifier Y250_HUMAN), referred to herein as the previously known protein.

The sequence for protein Hypothetical protein KIAA0250 is given at the end of the application, as "Hypothetical protein KIAA0250 amino acid sequence".

Cluster T07259 can be used as a diagnostic marker according to overexpression of transcripts of this cluster in cancer.

Expression of such transcripts in normal tissues is also given according to the previously described methods. The term "number" in the left hand column of the table and the numbers on the y-axis of the FIG. 42 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 42 and Table 1592. This cluster is overexpressed (at least at a minimum level) in the following pathological conditions: prostate cancer.

TABLE 1592

Normal tissue distribution

| Name of Tissue | Number |
|---|---|
| Bladder | 41 |
| Bone | 0 |
| Brain | 95 |
| Colon | 63 |
| Epithelial | 53 |
| General | 63 |
| head and neck | 131 |
| Kidney | 69 |
| Liver | 107 |
| Lung | 53 |
| lymph nodes | 145 |
| Breast | 8 |
| bone marrow | 251 |
| Muscle | 24 |
| Ovary | 72 |
| Pancreas | 32 |
| Prostate | 2 |
| Skin | 94 |
| Stomach | 76 |
| T cells | 27 |
| Thyroid | 412 |
| Uterus | 50 |

TABLE 1593

P values and ratios for expression in cancerous tissue

| Name of Tissue | P1 | P2 | SP1 | R3 | SP2 | R4 |
|---|---|---|---|---|---|---|
| Bladder | 7.9e−01 | 6.7e−01 | 1 | 0.5 | 6.2e−01 | 1.0 |
| Bone | 1 | 1.7e−02 | 1 | 1.0 | 1.2e−01 | 3.8 |
| Brain | 6.0e−01 | 5.7e−01 | 8.7e−01 | 0.8 | 8.8e−01 | 0.7 |
| Colon | 4.4e−01 | 4.0e−01 | 3.8e−01 | 1.3 | 4.0e−01 | 1.2 |
| Epithelial | 3.9e−01 | 3.3e−01 | 2.6e−01 | 1.1 | 2.9e−02 | 1.3 |
| General | 2.6e−01 | 4.7e−02 | 7.0e−01 | 0.9 | 7.4e−02 | 1.1 |
| head and neck | 4.2e−01 | 4.7e−01 | 7.1e−01 | 1.0 | 8.4e−01 | 0.7 |
| Kidney | 8.3e−01 | 8.6e−01 | 9.7e−01 | 0.5 | 9.7e−01 | 0.5 |
| Liver | 4.4e−01 | 6.9e−01 | 1 | 0.5 | 3.6e−01 | 1.2 |
| Lung | 7.7e−01 | 8.6e−01 | 7.1e−01 | 0.9 | 8.6e−01 | 0.7 |
| lymph nodes | 2.9e−01 | 6.4e−01 | 7.8e−01 | 0.9 | 9.8e−01 | 0.4 |
| Breast | 2.0e−01 | 1.3e−01 | 1.1e−01 | 3.1 | 2.1e−01 | 2.3 |
| bone marrow | 5.1e−01 | 6.5e−01 | 4.5e−01 | 1.5 | 9.5e−01 | 0.5 |
| Muscle | 4.0e−01 | 2.6e−01 | 2.7e−01 | 3.2 | 3.4e−01 | 1.9 |
| Ovary | 4.8e−01 | 4.4e−01 | 5.1e−01 | 1.3 | 4.4e−01 | 1.1 |
| Pancreas | 6.5e−01 | 5.4e−01 | 8.9e−01 | 0.6 | 5.6e−01 | 0.9 |
| Prostate | 5.9e−01 | 3.3e−01 | 2.0e−01 | 2.7 | 7.4e−04 | 5.5 |
| Skin | 6.0e−01 | 5.2e−01 | 3.7e−01 | 1.6 | 8.7e−01 | 0.5 |
| Stomach | 7.3e−01 | 8.8e−01 | 1 | 0.3 | 9.9e−01 | 0.4 |
| T cells | 6.7e−01 | 6.7e−01 | 1 | 0.9 | 7.2e−01 | 1.3 |
| Thyroid | 6.4e−01 | 6.4e−01 | 1 | 0.2 | 1 | 0.2 |
| Uterus | 3.9e−01 | 2.4e−01 | 2.9e−01 | 1.3 | 1.8e−01 | 1.6 |

As noted above, cluster T07259 features 33 segment(s), which were listed in Table 1590 above and for which the sequence(s) are given at the end of the application. These segment(s) are portions of nucleic acid sequence(s) which are described herein separately because they are of particular interest. A description of each segment according to the present invention is now provided.

Segment cluster T07259_node_0 (SEQ ID NO:1699) according to the present invention is supported by 23 libraries. The number of libraries was determined as previously described. This segment can be found in the following transcript(s): T07259_T3 (SEQ ID NO:1692), T07259_T7 (SEQ ID NO:1694), T07259_T25 (SEQ ID NO:1696) and T07259_T26 (SEQ ID NO:1697). Table 1594 below describes the starting and ending position of this segment on each transcript.

TABLE 1594

Segment location on transcripts

| Transcript name | Segment starting position | Segment ending position |
|---|---|---|
| T07259_T3 (SEQ ID NO: 1692) | 1 | 139 |
| T07259_T7 (SEQ ID NO: 1694) | 1 | 139 |
| T07259_T25 (SEQ ID NO: 1696) | 1 | 139 |
| T07259_T26 (SEQ ID NO: 1697) | 1 | 139 |

This segment can be found in both coding and non-coding regions of transcript(s) as follows. The segment can be found in a non-coding region of transcript(s) that are related to the following protein(s): T07259_P4 and T07259_P5. This segment can also be found in the following protein(s): T07259_P16 and T07259_P17, since it is in the coding region for the corresponding transcript.

Segment cluster T07259_node_2 (SEQ ID NO:1700) according to the present invention is supported by 3 libraries. The number of libraries was determined as previously described. This segment can be found in the following transcript(s): T07259_T4 (SEQ ID NO:1693). Table 1595 below describes the starting and ending position of this segment on each transcript.

TABLE 1595

Segment location on transcripts

| Transcript name | Segment starting position | Segment ending position |
|---|---|---|
| T07259_T4 (SEQ ID NO: 1693) | 1 | 232 |

This segment can be found in a non-coding region of transcript(s) that are related to the following protein(s): T07259_P4.

Segment cluster T07259_node_3 (SEQ ID NO:1701) according to the present invention is supported by 8 libraries. The number of libraries was determined as previously described. This segment can be found in the following transcript(s): T07259_T3 (SEQ ID NO:1692), T07259_T4 (SEQ ID NO:1693) and T07259_T25 (SEQ ID NO:1696). Table 1596 below describes the starting and ending position of this segment on each transcript.

TABLE 1596

Segment location on transcripts

| Transcript name | Segment starting position | Segment ending position |
|---|---|---|
| T07259_T3 (SEQ ID NO: 1692) | 140 | 276 |
| T07259_T4 (SEQ ID NO: 1693) | 233 | 369 |
| T07259_T25 (SEQ ID NO: 1696) | 140 | 276 |

This segment can be found in both coding and non-coding regions of transcript(s) as follows. The segment can be found in a non-coding region of transcript(s) that are related to the following protein(s): T07259_P4. This segment can also be found in the following protein(s): T07259_P16, since it is in the coding region for the corresponding transcript.

Segment cluster T07259_node_6 (SEQ ID NO:1702) according to the present invention is supported by 7 libraries. The number of libraries was determined as previously described. This segment can be found in the following transcript(s): T07259_T3 (SEQ ID NO:1692), T07259_T4 (SEQ ID NO:1693) and T07259_T25 (SEQ ID NO:1696). Table 1597 below describes the starting and ending position of this segment on each transcript.

TABLE 1597

Segment location on transcripts

| Transcript name | Segment starting position | Segment ending position |
| --- | --- | --- |
| T07259_T3 (SEQ ID NO: 1692) | 277 | 415 |
| T07259_T4 (SEQ ID NO: 1693) | 370 | 508 |
| T07259_T25 (SEQ ID NO: 1696) | 277 | 415 |

This segment can be found in both coding and non-coding regions of transcript(s) as follows. The segment can be found in a non-coding region of transcript(s) that are related to the following protein(s): T07259_P16. This segment can also be found in the following protein(s): T07259_P4, since it is in the coding region for the corresponding transcript.

Segment cluster T07259_node_10 (SEQ ID NO:1703) according to the present invention is supported by 1 libraries. The number of libraries was determined as previously described. This segment can be found in the following transcript(s): T07259_T25 (SEQ ID NO:1696). Table 1598 below describes the starting and ending position of this segment on each transcript.

TABLE 1598

Segment location on transcripts

| Transcript name | Segment starting position | Segment ending position |
| --- | --- | --- |
| T07259_T25 (SEQ ID NO: 1696) | 448 | 935 |

This segment can be found in a non-coding region of transcript(s) that are related to the following protein(s): T07259_P16.

Segment cluster T07259_node_12 (SEQ ID NO:1704) according to the present invention is supported by 2 libraries. The number of libraries was determined as previously described. This segment can be found in the following transcript(s): T07259_T27 (SEQ ID NO:1698). Table 1599 below describes the starting and ending position of this segment on each transcript.

TABLE 1599

Segment location on transcripts

| Transcript name | Segment starting position | Segment ending position |
| --- | --- | --- |
| T07259_T27 (SEQ ID NO: 1698) | 1 | 385 |

The previously-described transcripts for these segment(s) do not code for protein.

Segment cluster T07259_node_14 (SEQ ID NO:1705) according to the present invention is supported by 3 libraries. The number of libraries was determined as previously described. This segment can be found in the following transcript(s): T07259_T26 (SEQ ID NO:1697) and T07259_T27 (SEQ ID NO:1698). Table 1600 below describes the starting and ending position of this segment on each transcript.

TABLE 1600

Segment location on transcripts

| Transcript name | Segment starting position | Segment ending position |
| --- | --- | --- |
| T07259_T26 (SEQ ID NO: 1697) | 290 | 477 |
| T07259_T27 (SEQ ID NO: 1698) | 504 | 691 |

This segment can be found in the following protein(s): T07259_P17.

Segment cluster T07259_node_17 (SEQ ID NO:1706) according to the present invention is supported by 28 libraries. The number of libraries was determined as previously described. This segment can be found in the following transcript(s): T07259_T3 (SEQ ID NO:1692), T07259_T4 (SEQ ID NO:1693) and T07259_T7 (SEQ ID NO:1694). Table 1601 below describes the starting and ending position of this segment on each transcript.

TABLE 1601

Segment location on transcripts

| Transcript name | Segment starting position | Segment ending position |
| --- | --- | --- |
| T07259_T3 (SEQ ID NO: 1692) | 566 | 698 |
| T07259_T4 (SEQ ID NO: 1693) | 659 | 791 |
| T07259_T7 (SEQ ID NO: 1694) | 290 | 422 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_20 (SEQ ID NO:1707) according to the present invention is supported by 29 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1602 below describes the starting and ending position of this segment on each transcript.

TABLE 1602

Segment location on transcripts

| Transcript name | Segment starting position | Segment ending position |
| --- | --- | --- |
| T07259_T3 (SEQ ID NO: 1692) | 699 | 870 |
| T07259_T4 (SEQ ID NO: 1693) | 792 | 963 |
| T07259_T7 (SEQ ID NO: 1694) | 423 | 594 |
| T07259_T9 (SEQ ID NO: 1695) | 83 | 254 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_29 (SEQ ID NO:1708) according to the present invention is supported by 28 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1603 below describes the starting and ending position of this segment on each transcript.

TABLE 1603

Segment location on transcripts

| Transcript name | Segment starting position | Segment ending position |
|---|---|---|
| T07259_T3 (SEQ ID NO: 1692) | 1094 | 1229 |
| T07259_T4 (SEQ ID NO: 1693) | 1187 | 1322 |
| T07259_T7 (SEQ ID NO: 1694) | 924 | 1059 |
| T07259_T9 (SEQ ID NO: 1695) | 508 | 643 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_31 (SEQ ID NO:1709) according to the present invention is supported by 28 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1604 below describes the starting and ending position of this segment on each transcript.

TABLE 1604

Segment location on transcripts

| Transcript name | Segment starting position | Segment ending position |
|---|---|---|
| T07259_T3 (SEQ ID NO: 1692) | 1230 | 1392 |
| T07259_T4 (SEQ ID NO: 1693) | 1323 | 1485 |
| T07259_T7 (SEQ ID NO: 1694) | 1060 | 1222 |
| T07259_T9 (SEQ ID NO: 1695) | 644 | 806 |

This segment can be found in the following protein(s): T07259_P4 and T07259_P5.

Segment cluster T07259_node_33 (SEQ ID NO:1710) according to the present invention is supported by 28 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1605 below describes the starting and ending position of this segment on each transcript.

TABLE 1605

Segment location on transcripts

| Transcript name | Segment starting position | Segment ending position |
|---|---|---|
| T07259_T3 (SEQ ID NO: 1692) | 1393 | 1549 |
| T07259_T4 (SEQ ID NO: 1693) | 1486 | 1642 |
| T07259_T7 (SEQ ID NO: 1694) | 1223 | 1379 |
| T07259_T9 (SEQ ID NO: 1695) | 807 | 963 |

This segment can be found in the following protein(s): T07259_P4 and T07259_P5.

Segment cluster T07259_node_40 (SEQ ID NO:1711) according to the present invention is supported by 34 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1606 below describes the starting and ending position of this segment on each transcript.

TABLE 1606

Segment location on transcripts

| Transcript name | Segment starting position | Segment ending position |
|---|---|---|
| T07259_T3 (SEQ ID NO: 1692) | 1682 | 1801 |
| T07259_T4 (SEQ ID NO: 1693) | 1775 | 1894 |
| T07259_T7 (SEQ ID NO: 1694) | 1512 | 1631 |
| T07259_T9 (SEQ ID NO: 1695) | 1096 | 1215 |

This segment can be found in the following protein(s): T07259_P4 and T07259_P5.

Segment cluster T07259_node_42 (SEQ ID NO:1712) according to the present invention is supported by 48 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1607 below describes the starting and ending position of this segment on each transcript.

TABLE 1607

Segment location on transcripts

| Transcript name | Segment starting position | Segment ending position |
|---|---|---|
| T07259_T3 (SEQ ID NO: 1692) | 1802 | 2090 |
| T07259_T4 (SEQ ID NO: 1693) | 1895 | 2183 |
| T07259_T7 (SEQ ID NO: 1694) | 1632 | 1920 |
| T07259_T9 (SEQ ID NO: 1695) | 1216 | 1504 |

This segment can be found in the following protein(s): T07259_P4 and T07259_P5.

Segment cluster T07259_node_46 (SEQ ID NO:1713) according to the present invention is supported by 50 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1608 below describes the starting and ending position of this segment on each transcript.

TABLE 1608

Segment location on transcripts

| Transcript name | Segment starting position | Segment ending position |
|---|---|---|
| T07259_T3 (SEQ ID NO: 1692) | 2091 | 2235 |
| T07259_T4 (SEQ ID NO: 1693) | 2184 | 2328 |
| T07259_T7 (SEQ ID NO: 1694) | 1921 | 2065 |
| T07259_T9 (SEQ ID NO: 1695) | 1505 | 1649 |

This segment can be found in the following protein(s): T07259_P4 and T07259_P5.

Segment cluster T07259_node_50 (SEQ ID NO:1714) according to the present invention is supported by 59 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1609 below describes the starting and ending position of this segment on each transcript.

TABLE 1609

Segment location on transcripts

| Transcript name | Segment starting position | Segment ending position |
|---|---|---|
| T07259_T3 (SEQ ID NO: 1692) | 2236 | 2618 |
| T07259_T4 (SEQ ID NO: 1693) | 2329 | 2711 |
| T07259_T7 (SEQ ID NO: 1694) | 2066 | 2448 |
| T07259_T9 (SEQ ID NO: 1695) | 1650 | 2032 |

This segment can be found in the following protein(s): T07259_P4 and T07259_P5.

Segment cluster T07259_node_52 (SEQ ID NO:1715) according to the present invention is supported by 67 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1610 below describes the starting and ending position of this segment on each transcript.

TABLE 1610

Segment location on transcripts

| Transcript name | Segment starting position | Segment ending position |
|---|---|---|
| T07259_T3 (SEQ ID NO: 1692) | 2619 | 2990 |
| T07259_T4 (SEQ ID NO: 1693) | 2712 | 3083 |
| T07259_T7 (SEQ ID NO: 1694) | 2449 | 2820 |
| T07259_T9 (SEQ ID NO: 1695) | 2033 | 2404 |

This segment can be found in the following protein(s): T07259_P4 and T07259_P5.

Segment cluster T07259_node_59 (SEQ ID NO:1716) according to the present invention is supported by 49 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1611 below describes the starting and ending position of this segment on each transcript.

TABLE 1611

Segment location on transcripts

| Transcript name | Segment starting position | Segment ending position |
|---|---|---|
| T07259_T3 (SEQ ID NO: 1692) | 3072 | 3231 |
| T07259_T4 (SEQ ID NO: 1693) | 3165 | 3324 |
| T07259_T7 (SEQ ID NO: 1694) | 2902 | 3061 |
| T07259_T9 (SEQ ID NO: 1695) | 2486 | 2645 |

This segment can be found in the following protein(s): T07259_P4 and T07259_P5.

Segment cluster T07259_node_62 (SEQ ID NO:1717) according to the present invention is supported by 47 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1612 below describes the starting and ending position of this segment on each transcript.

TABLE 1612

Segment location on transcripts

| Transcript name | Segment starting position | Segment ending position |
|---|---|---|
| T07259_T3 (SEQ ID NO: 1692) | 3232 | 3402 |
| T07259_T4 (SEQ ID NO: 1693) | 3325 | 3495 |
| T07259_T7 (SEQ ID NO: 1694) | 3062 | 3232 |
| T07259_T9 (SEQ ID NO: 1695) | 2646 | 2816 |

This segment can be found in the following protein(s): T07259_P4 and T07259_P5.

Segment cluster T07259_node_64 (SEQ ID NO:1718) according to the present invention is supported by 54 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1613 below describes the starting and ending position of this segment on each transcript.

TABLE 1613

Segment location on transcripts

| Transcript name | Segment starting position | Segment ending position |
|---|---|---|
| T07259_T3 (SEQ ID NO: 1692) | 3403 | 3548 |
| T07259_T4 (SEQ ID NO: 1693) | 3496 | 3641 |
| T07259_T7 (SEQ ID NO: 1694) | 3233 | 3378 |
| T07259_T9 (SEQ ID NO: 1695) | 2817 | 2962 |

This segment can be found in the following protein(s): T07259_P4 and T07259_P5.

Segment cluster T07259_node_66 (SEQ ID NO:1719) according to the present invention is supported by 272 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1614 below describes the starting and ending position of this segment on each transcript.

TABLE 1614

Segment location on transcripts

| Transcript name | Segment starting position | Segment ending position |
|---|---|---|
| T07259_T3 (SEQ ID NO:1692) | 3549 | 5443 |
| T07259_T4 (SEQ ID NO:1693) | 3642 | 5536 |
| T07259_T7 (SEQ ID NO:1694) | 3379 | 5273 |
| T07259_T9 (SEQ ID NO:1695) | 2963 | 4857 |

This segment can be found in the following protein(s): T07259_P4 and T07259_P5.

Segment cluster T07259_node__68 (SEQ ID NO:1720) according to the present invention is supported by 146 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1615 below describes the starting and ending position of this segment on each transcript.

TABLE 1615

Segment location on transcripts

| Transcript name | Segment starting position | Segment ending position |
|---|---|---|
| T07259_T3 (SEQ ID NO: 1692) | 5525 | 5947 |
| T07259_T4 (SEQ ID NO: 1693) | 5618 | 6040 |
| T07259_T7 (SEQ ID NO: 1694) | 5355 | 5777 |
| T07259_T9 (SEQ ID NO: 1695) | 4939 | 5361 |

This segment can be found in a non-coding region of transcript(s) that are related to the following protein(s): T07259_P4 and T07259_P5.

According to an optional embodiment of the present invention, short segments related to the above cluster are also provided. These segments are up to about 120 bp in length, and so are included in a separate description.

Segment cluster T07259_node__9 (SEQ ID NO:1721) according to the present invention is supported by 21 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694), T07259_T25 (SEQ ID NO:1696) and T07259_T26 (SEQ ID NO:1697). Table 1616 below describes the starting and ending position of this segment on each transcript.

TABLE 1616

Segment location on transcripts

| Transcript name | Segment starting position | Segment ending position |
|---|---|---|
| T07259_T3 (SEQ ID NO: 1692) | 416 | 447 |
| T07259_T4 (SEQ ID NO: 1693) | 509 | 540 |
| T07259_T7 (SEQ ID NO: 1694) | 140 | 171 |
| T07259_T25 (SEQ ID NO: 1696) | 416 | 447 |
| T07259_T26 (SEQ ID NO: 1697) | 140 | 171 |

This segment can be found in both coding and non-coding regions of transcript(s) as follows. The segment can be found in a non-coding region of transcript(s) that are related to the following protein(s): T07259_P5 and T07259_P16. This segment can also be found in. the following protein(s): T07259_P4 and T07259_P17, since it is in the coding region for the corresponding transcript.

Segment cluster T07259_node__13 (SEQ ID NO:1722) according to the present invention is supported by 28 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694), T07259_T26 (SEQ ID NO:1697) and T07259_T27 (SEQ ID NO:1698). Table 1617 below describes the starting and ending position of this segment on each transcript.

TABLE 1617

Segment location on transcripts

| Transcript name | Segment starting position | Segment ending position |
|---|---|---|
| T07259_T3 (SEQ ID NO: 1692) | 448 | 565 |
| T07259_T4 (SEQ ID NO: 1693) | 541 | 658 |
| T07259_T7 (SEQ ID NO: 1694) | 172 | 289 |
| T07259_T26 (SEQ ID NO: 1697) | 172 | 289 |
| T07259_T27 (SEQ ID NO: 1698) | 386 | 503 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4 and T07259_P17, since it is in the coding region for the corresponding transcript.

Segment cluster T07259_node__19 (SEQ ID NO:1723) according to the present invention is supported by 1 libraries. The number of libraries was determined as previously described. This segment can be found in the following transcript(s): T07259_T9 (SEQ ID NO:1695). Table 1618 below describes the starting and ending position of this segment on each transcript.

TABLE 1618

Segment location on transcripts

| Transcript name | Segment starting position | Segment ending position |
|---|---|---|
| T07259_T9 (SEQ ID NO: 1695) | 1 | 82 |

This segment can be found in a non-coding region of transcript(s) that are related to the following protein(s): T07259_P5.

Segment cluster T07259_node__22 (SEQ ID NO:1724) according to the present invention is supported by 2 libraries. The number of libraries was determined as previously described. This segment can be found in the following transcript(s): T07259_T7 (SEQ ID NO:1694) and T07259_T9 (SEQ ID NO:1695). Table 1619 below describes the starting and ending position of this segment on each transcript.

TABLE 1619

Segment location on transcripts

| Transcript name | Segment starting position | Segment ending position |
| --- | --- | --- |
| T07259_T7 (SEQ ID NO: 1694) | 595 | 700 |
| T07259_T9 (SEQ ID NO: 1695) | 255 | 360 |

This segment can be found in a non-coding region of transcript(s) that are related to the following protein(s): T07259_P5.

Segment cluster T07259_node_24 (SEQ ID NO:1725) according to the present invention is supported by 22 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1620 below describes the starting and ending position of this segment on each transcript.

TABLE 1620

Segment location on transcripts

| Transcript name | Segment starting position | Segment ending position |
| --- | --- | --- |
| T07259_T3 (SEQ ID NO: 1692) | 871 | 942 |
| T07259_T4 (SEQ ID NO: 1693) | 964 | 1035 |
| T07259_T7 (SEQ ID NO: 1694) | 701 | 772 |
| T07259_T9 (SEQ ID NO: 1695) | 361 | 432 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_26 (SEQ ID NO:1726) according to the present invention is supported by 25 libraries. The number of libraries was determined as previously described. This segment can be found in the following transcript(s): T07259_T3 (SEQ ID NO:1692), T07259_T4 (SEQ ID NO:1693) and T07259_T7 (SEQ ID NO:1694). Table 1621 below describes the starting and ending position of this segment on each transcript.

TABLE 1621

Segment location on transcripts

| Transcript name | Segment starting position | Segment ending position |
| --- | --- | --- |
| T07259_T3 (SEQ ID NO: 1692) | 943 | 1018 |
| T07259_T4 (SEQ ID NO: 1693) | 1036 | 1111 |
| T07259_T7 (SEQ ID NO: 1694) | 773 | 848 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_27 (SEQ ID NO:1727) according to the present invention is supported by 26 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1622 below describes the starting and ending position of this segment on each transcript.

TABLE 1622

Segment location on transcripts

| Transcript name | Segment starting position | Segment ending position |
| --- | --- | --- |
| T07259_T3 (SEQ ID NO: 1692) | 1019 | 1093 |
| T07259_T4 (SEQ ID NO: 1693) | 1112 | 1186 |
| T07259_T7 (SEQ ID NO: 1694) | 849 | 923 |
| T07259_T9 (SEQ ID NO: 1695) | 433 | 507 |

This segment can be found in both coding and non-coding regions of transcript(s) as follows. The segment can be found in a non-coding region of transcript(s) that are related to the following protein(s): T07259_P5. This segment can also be found in the following protein(s): T07259_P4, since it is in the coding region for the corresponding transcript.

Segment cluster T07259_node_36 (SEQ ID NO:1728) according to the present invention is supported by 29 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1623 below describes the starting and ending position of this segment on each transcript.

TABLE 1623

Segment location on transcripts

| Transcript name | Segment starting position | Segment ending position |
| --- | --- | --- |
| T07259_T3 (SEQ ID NO: 1692) | 1550 | 1620 |
| T07259_T4 (SEQ ID NO: 1693) | 1643 | 1713 |
| T07259_T7 (SEQ ID NO: 1694) | 1380 | 1450 |
| T07259_T9 (SEQ ID NO: 1695) | 964 | 1034 |

This segment can be found in the following protein(s): T07259_P4 and T07259_P5.

Segment cluster T07259_node_38 (SEQ ID NO:1729) according to the present invention is supported by 25 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1624 below describes the starting and ending position of this segment on each transcript.

TABLE 1624

Segment location on transcripts

| Transcript name | Segment starting position | Segment ending position |
| --- | --- | --- |
| T07259_T3 (SEQ ID NO: 1692) | 1621 | 1681 |
| T07259_T4 (SEQ ID NO: 1693) | 1714 | 1774 |

TABLE 1624-continued

Segment location on transcripts

| Transcript name | Segment starting position | Segment ending position |
|---|---|---|
| T07259_T7 (SEQ ID NO: 1694) | 1451 | 1511 |
| T07259_T9 (SEQ ID NO: 1695) | 1035 | 1095 |

This segment can be found in the following protein(s): T07259_P4 and T07259_P5.

Segment cluster T07259_node__57 (SEQ ID NO:1730) according to the present invention is supported by 39 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1625 below describes the starting and ending position of this segment on each transcript.

TABLE 1625

Segment location on transcripts

| Transcript name | Segment starting position | Segment ending position |
|---|---|---|
| T07259_T3 (SEQ ID NO: 1692) | 2991 | 3071 |
| T07259_T4 (SEQ ID NO: 1693) | 3084 | 3164 |
| T07259_T7 (SEQ ID NO: 1694) | 2821 | 2901 |
| T07259_T9 (SEQ ID NO: 1695) | 2405 | 2485 |

This segment can be found in the following protein(s): T07259_P4 and T07259_P5.

Segment cluster T07259_node__67 (SEQ ID NO:1731) according to the present invention is supported by 107 libraries. The number of libraries was determined as previously described. This segment can be found in the following transcript(s): T07259_T3 (SEQ ID NO:1692), T07259_T4 (SEQ ID NO:1693), T07259_T7 (SEQ ID NO:1694) and T07259_T9 (SEQ ID NO:1695). Table 1626 below describes the starting and ending position of this segment on each transcript.

TABLE 1626

Segment location on transcripts

| Transcript name | Segment starting position | Segment ending position |
|---|---|---|
| T07259_T3 (SEQ ID NO: 1692) | 5444 | 5524 |
| T07259_T4 (SEQ ID NO: 1693) | 5537 | 5617 |
| T07259_T7 (SEQ ID NO: 1694) | 5274 | 5354 |
| T07259_T9 (SEQ ID NO: 1695) | 4858 | 4938 |

This segment can be found in a non-coding region of transcript(s) that are related to the following protein(s): T07259_P4 and T07259_P5.

Description for Cluster T07775

Cluster T07775 features 4 transcript(s) and 49 segment(s) of interest, the names for which are given in Tables 1627 and 1628, respectively, the sequences themselves are given at the end of the application. The selected protein variants are given in Table 1629.

TABLE 1627

Transcripts of interest
Transcript Name

T07775_T16 (SEQ ID NO: 1732)
T07775_T17 (SEQ ID NO: 1733)
T07775_T18 (SEQ ID NO: 1734)
T07775_T21 (SEQ ID NO: 1735)

TABLE 1628

Segments of interest
Segment Name

T07775_node__4 (SEQ ID NO: 1736)
T07775_node__10 (SEQ ID NO: 1737)
T07775_node__16 (SEQ ID NO: 1738)
T07775_node__18 (SEQ ID NO: 1739)
T07775_node__21 (SEQ ID NO: 1740)
T07775_node__46 (SEQ ID NO: 1741)
T07775_node__48 (SEQ ID NO: 1742)
T07775_node__51 (SEQ ID NO: 1743)
T07775_node__53 (SEQ ID NO: 1744)
T07775_node__55 (SEQ ID NO: 1745)
T07775_node__68 (SEQ ID NO: 1746)
T07775_node__73 (SEQ ID NO: 1747)
T07775_node__74 (SEQ ID NO: 1748)
T07775_node__75 (SEQ ID NO: 1749)
T07775_node__81 (SEQ ID NO: 1750)
T07775_node__84 (SEQ ID NO: 1751)
T07775_node__86 (SEQ ID NO: 1752)
T07775_node__87 (SEQ ID NO: 1753)
T07775_node__88 (SEQ ID NO: 1754)
T07775_node__89 (SEQ ID NO: 1755)
T07775_node__94 (SEQ ID NO: 1756)
T07775_node__6 (SEQ ID NO: 1757)
T07775_node__8 (SEQ ID NO: 1758)
T07775_node__13 (SEQ ID NO: 1759)
T07775_node__14 (SEQ ID NO: 1760)
T07775_node__26 (SEQ ID NO: 1761)
T07775_node__29 (SEQ ID NO: 1762)
T07775_node__31 (SEQ ID NO: 1763)
T07775_node__33 (SEQ ID NO: 1764)
T07775_node__36 (SEQ ID NO: 1765)
T07775_node__38 (SEQ ID NO: 1766)
T07775_node__40 (SEQ ID NO: 1767)
T07775_node__45 (SEQ ID NO: 1768)
T07775_node__50 (SEQ ID NO: 1769)
T07775_node__57 (SEQ ID NO: 1770)
T07775_node__58 (SEQ ID NO: 1771)
T07775_node__67 (SEQ ID NO: 1772)
T07775_node__69 (SEQ ID NO: 1773)
T07775_node__70 (SEQ ID NO: 1774)
T07775_node__76 (SEQ ID NO: 1775)
T07775_node__77 (SEQ ID NO: 1776)
T07775_node__78 (SEQ ID NO: 1777)
T07775_node__79 (SEQ ID NO: 1778)
T07775_node__80 (SEQ ID NO: 1779)
T07775_node__82 (SEQ ID NO: 1780)
T07775_node__83 (SEQ ID NO: 1781)
T07775_node__90 (SEQ ID NO: 1782)
T07775_node__91 (SEQ ID NO: 1783)
T07775_node__93 (SEQ ID NO: 1784)

TABLE 1629

Proteins of interest

| Protein Name | Corresponding Transcript(s) |
|---|---|
| T07775_P26 | T07775_T21 (SEQ ID NO: 1735) |
| T07775_P29 | T07775_T16 (SEQ ID NO: 1732); T07775_T17 (SEQ ID NO: 1733); T07775_T18 (SEQ ID NO: 1734) |

These sequences are variants of the known protein Interleukin enhancer-binding factor 3 (SwissProt accession identifier ILF3_HUMAN; known also according to the synonyms Nuclear factor of activated T cells-90; NF-AT-90; Double-stranded RNA-binding protein 76; DRBP76; Translational control protein 80; TCP80; Nuclear factor associated with dsRNA; NFAR; M-phase phosphoprotein 4; MPP4), referred to herein as the previously known protein.

Protein Interleukin enhancer-binding factor 3 is known or believed to have the following function(s): May facilitate double-stranded RNA-regulated gene expression at the level of post-transcription. Can act as a translation inhibitory protein which binds to coding sequences of acid beta-glucocidase (GCase) and other mRNAs and functions at the initiation phase of GCase mRNA translation, probably by inhibiting its binding to polysomes. Can regulate protein arginine N-methyltransferase 1 activity. The sequence for protein Interleukin enhancer-binding factor 3 is given at the end of the application, as "Interleukin enhancer-binding factor 3 amino acid sequence". Known polymorphisms for this sequence are as shown in Table 1630.

TABLE 1630

Amino acid mutations for Known Protein

| SNP position(s) on amino acid sequence | Comment |
|---|---|
| 50 | D -> H |
| 101 | C -> G |
| 260 | G -> V |
| 647 | S -> T |
| 688-689 | QF -> N |
| 763 | P -> L |
| 797 | G -> R |
| 799 | S -> SGS |
| 813 | G -> E |

Protein Interleukin enhancer-binding factor 3 localization is believed to be Nuclear.

The following GO Annotation(s) apply to the previously known protein. The following annotation(s) were found: M phase; transcription regulation, which are annotation(s) related to Biological Process; DNA binding; RNA polymerase II transcription factor; double-stranded RNA binding, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T07775 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 43 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 43 and Table 1631. This cluster is overexpressed (at least at a minimum level) in the following pathological conditions: adrenal cortical carcinoma, epithelial malignant tumors, a mixture of malignant tumors from different tissues, hepatocellular carcinoma, myosarcoma and uterine malignancies.

TABLE 1631

Normal tissue distribution

| Name of Tissue | Number |
|---|---|
| Adrenal | 52 |
| Bladder | 328 |
| Bone | 207 |
| Brain | 197 |
| Colon | 141 |
| Epithelial | 156 |
| General | 178 |
| head and neck | 0 |
| Kidney | 213 |
| Liver | 4 |
| Lung | 140 |
| lymph nodes | 290 |
| Breast | 228 |
| bone marrow | 753 |
| Muscle | 3 |
| Ovary | 203 |
| Pancreas | 105 |
| Prostate | 144 |
| Skin | 252 |
| Stomach | 73 |
| T cells | 306 |
| Thyroid | 51 |
| Uterus | 113 |

TABLE 1632

P values and ratios for expression in cancerous tissue

| Name of Tissue | P1 | P2 | SP1 | R3 | SP2 | R4 |
|---|---|---|---|---|---|---|
| Adrenal | 6.3e−01 | 5.4e−01 | 1.0e−02 | 3.0 | 6.3e−03 | 3.5 |
| Bladder | 3.3e−01 | 4.3e−01 | 3.2e−01 | 1.1 | 6.0e−01 | 0.9 |
| Bone | 5.1e−01 | 6.5e−01 | 6.3e−01 | 1.0 | 6.7e−01 | 0.8 |
| Brain | 4.4e−01 | 4.1e−01 | 8.9e−03 | 1.4 | 8.7e−02 | 1.1 |
| Colon | 6.9e−02 | 8.5e−02 | 3.2e−01 | 1.3 | 2.6e−01 | 1.2 |
| Epithelial | 2.8e−02 | 7.4e−02 | 9.6e−03 | 1.3 | 1.5e−05 | 1.5 |
| General | 3.6e−03 | 1.6e−04 | 2.2e−07 | 1.4 | 3.7e−12 | 1.5 |
| head and neck | 7.1e−02 | 3.0e−02 | 1 | 1.8 | 4.2e−01 | 2.2 |
| Kidney | 8.2e−01 | 8.1e−01 | 9.9e−01 | 0.3 | 8.5e−01 | 0.5 |
| Liver | 3.3e−01 | 1.1e−01 | 1 | 1.2 | 4.1e−03 | 5.0 |
| Lung | 5.1e−01 | 4.4e−01 | 3.0e−01 | 1.0 | 2.4e−01 | 1.1 |
| lymph nodes | 5.9e−01 | 6.4e−01 | 7.2e−01 | 0.5 | 2.0e−01 | 0.9 |
| Breast | 3.0e−01 | 1.9e−01 | 5.6e−01 | 1.0 | 7.2e−01 | 0.8 |
| bone marrow | 6.2e−01 | 7.8e−01 | 1 | 0.0 | 1 | 0.2 |
| Muscle | 1.0e−01 | 4.0e−02 | 3.2e−03 | 12.3 | 1.3e−05 | 7.9 |
| Ovary | 5.2e−01 | 4.2e−01 | 5.3e−01 | 1.0 | 6.4e−01 | 0.9 |
| Pancreas | 3.3e−01 | 1.4e−01 | 1.2e−01 | 1.2 | 6.6e−03 | 1.6 |
| Prostate | 8.1e−01 | 8.3e−01 | 2.9e−01 | 1.1 | 2.0e−01 | 1.2 |
| Skin | 3.9e−01 | 5.9e−01 | 8.0e−01 | 0.7 | 2.7e−01 | 0.7 |
| Stomach | 2.9e−01 | 3.5e−01 | 9.2e−02 | 1.1 | 1.1e−01 | 1.8 |
| T cells | 3.3e−01 | 5.0e−01 | 1 | 0.5 | 6.9e−01 | 0.8 |
| Thyroid | 4.5e−01 | 4.5e−01 | 1 | 0.9 | 1 | 0.9 |
| Uterus | 6.1e−02 | 9.3e−03 | 4.1e−02 | 1.9 | 2.8e−03 | 2.0 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1633.

TABLE 1633

Oligonucleotides related to this cluster

| Oligonucleotide name | Overexpressed in cancers | Chip reference |
|---|---|---|
| T07775_0_0_39234 | lung malignant tumors | LUN |

As noted above, cluster T07775 features 49 segment(s), which were listed in Table 1628 above and for which the sequence(s) are given at the end of the application. These segment(s) are portions of nucleic acid sequence(s) which are described herein separately because they are of particular interest. A description of each segment according to the present invention is now provided.

Segment cluster T07775_node_4 (SEQ ID NO:1736) according to the present invention is supported by 86 libraries. The number of libraries was determined as previously described. This segment can be found in the following transcript(s): T07775_T16 (SEQ ID NO:1732) and T07775_T21 (SEQ ID NO:1735). Table 1634 below describes the starting and ending position of this segment on each transcript.

TABLE 1634

Segment location on transcripts

| Transcript name | Segment starting position | Segment ending position |
|---|---|---|
| T07775_T16 (SEQ ID NO: 1732) | 1 | 192 |
| T07775_T21 (SEQ ID NO: 1735) | 1 | 192 |

This segment can be found in a non-coding region of transcript(s) that are related to the following protein(s): T07775_P29 and T07775_P26.

Segment cluster T07775_node_10 (SEQ ID NO:1737) according to the present invention is supported by 6 libraries. The number of libraries was determined as previously described. This segment can be found in the following transcript(s): T07775_T16 (SEQ ID NO:1732). Table 1635 below describes the starting and ending position of this segment on each transcript.

TABLE 1635

Segment location on transcripts

| Transcript name | Segment starting position | Segment ending position |
|---|---|---|
| T07775_T16 (SEQ ID NO: 1732) | 193 | 350 |

This segment can be found in a non-coding region of transcript(s) that are related to the following protein(s): T07775_P29.

Segment cluster T07775_node_16 (SEQ ID NO:1738) according to the present invention is supported by 130 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1636 below describes the starting and ending position of this segment on each transcript.

TABLE 1636

Segment location on transcripts

| Transcript name | Segment starting position | Segment ending position |
|---|---|---|
| T07775_T16 (SEQ ID NO: 1732) | 444 | 673 |
| T07775_T17 (SEQ ID NO: 1733) | 145 | 374 |
| T07775_T18 (SEQ ID NO: 1734) | 184 | 413 |
| T07775_T21 (SEQ ID NO: 1735) | 286 | 515 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_18 (SEQ ID NO:1739) according to the present invention is supported by 139 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1637 below describes the starting and ending position of this segment on each transcript.

TABLE 1637

Segment location on transcripts

| Transcript name | Segment starting position | Segment ending position |
|---|---|---|
| T07775_T16 (SEQ ID NO: 1732) | 674 | 851 |
| T07775_T17 (SEQ ID NO: 1733) | 375 | 552 |
| T07775_T18 (SEQ ID NO: 1734) | 414 | 591 |
| T07775_T21 (SEQ ID NO: 1735) | 516 | 693 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_21 (SEQ ID NO:1740) according to the present invention is supported by 160 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1638 below describes the starting and ending position of this segment on each transcript.

TABLE 1638

Segment location on transcripts

| Transcript name | Segment starting position | Segment ending position |
|---|---|---|
| T07775_T16 (SEQ ID NO: 1732) | 852 | 999 |
| T07775_T17 (SEQ ID NO: 1733) | 553 | 700 |
| T07775_T18 (SEQ ID NO: 1734) | 592 | 739 |
| T07775_T21 (SEQ ID NO: 1735) | 694 | 841 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__46 (SEQ ID NO:1741) according to the present invention is supported by 138 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1639 below describes the starting and ending position of this segment on each transcript.

TABLE 1639

Segment location on transcripts

| Transcript name | Segment starting position | Segment ending position |
| --- | --- | --- |
| T07775_T16 (SEQ ID NO: 1732) | 1639 | 1820 |
| T07775_T17 (SEQ ID NO: 1733) | 1340 | 1521 |
| T07775_T18 (SEQ ID NO: 1734) | 1379 | 1560 |
| T07775_T21 (SEQ ID NO: 1735) | 1481 | 1662 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__48 (SEQ ID NO:1742) according to the present invention is supported by 136 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1640 below describes the starting and ending position of this segment on each transcript.

TABLE 1640

Segment location on transcripts

| Transcript name | Segment starting position | Segment ending position |
| --- | --- | --- |
| T07775_T16 (SEQ ID NO: 1732) | 1821 | 1988 |
| T07775_T17 (SEQ ID NO: 1733) | 1522 | 1689 |
| T07775_T18 (SEQ ID NO: 1734) | 1561 | 1728 |
| T07775_T21 (SEQ ID NO: 1735) | 1663 | 1830 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__51 (SEQ ID NO:1743) according to the present invention is supported by 123 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1641 below describes the starting and ending position of this segment on each transcript.

TABLE 1641

Segment location on transcripts

| Transcript name | Segment starting position | Segment ending position |
| --- | --- | --- |
| T07775_T16 (SEQ ID NO: 1732) | 1989 | 2114 |
| T07775_T17 (SEQ ID NO: 1733) | 1690 | 1815 |
| T07775_T18 (SEQ ID NO: 1734) | 1729 | 1854 |
| T07775_T21 (SEQ ID NO: 1735) | 1843 | 1968 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__53 (SEQ ID NO:1744) according to the present invention is supported by 145 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1642 below describes the starting and ending position of this segment on each transcript.

TABLE 1642

Segment location on transcripts

| Transcript name | Segment starting position | Segment ending position |
| --- | --- | --- |
| T07775_T16 (SEQ ID NO: 1732) | 2115 | 2291 |
| T07775_T17 (SEQ ID NO: 1733) | 1816 | 1992 |
| T07775_T18 (SEQ ID NO: 1734) | 1855 | 2031 |
| T07775_T21 (SEQ ID NO: 1735) | 1969 | 2145 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__55 (SEQ ID NO:1745) according to the present invention is supported by 144 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1643 below describes the starting and ending position of this segment on each transcript.

TABLE 1643

Segment location on transcripts

| Transcript name | Segment starting position | Segment ending position |
| --- | --- | --- |
| T07775_T16 (SEQ ID NO: 1732) | 2292 | 2445 |
| T07775_T17 (SEQ ID NO: 1733) | 1993 | 2146 |
| T07775_T18 (SEQ ID NO: 1734) | 2032 | 2185 |
| T07775_T21 (SEQ ID NO: 1735) | 2146 | 2299 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__68 (SEQ ID NO:1746) according to the present invention is supported by 130 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1644 below describes the starting and ending position of this segment on each transcript.

TABLE 1644

Segment location on transcripts

| Transcript name | Segment starting position | Segment ending position |
|---|---|---|
| T07775_T16 (SEQ ID NO: 1732) | 2576 | 2814 |
| T07775_T17 (SEQ ID NO: 1733) | 2277 | 2515 |
| T07775_T18 (SEQ ID NO: 1734) | 2316 | 2554 |
| T07775_T21 (SEQ ID NO: 1735) | 2430 | 2668 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__73 (SEQ ID NO:1747) according to the present invention is supported by 137 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1645 below describes the starting and ending position of this segment on each transcript.

TABLE 1645

Segment location on transcripts

| Transcript name | Segment starting position | Segment ending position |
|---|---|---|
| T07775_T16 (SEQ ID NO: 1732) | 2863 | 2991 |
| T07775_T17 (SEQ ID NO: 1733) | 2564 | 2692 |
| T07775_T18 (SEQ ID NO: 1734) | 2603 | 2731 |
| T07775_T21 (SEQ ID NO: 1735) | 2717 | 2845 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__74 (SEQ ID NO:1748) according to the present invention is supported by 7 libraries. The number of libraries was determined as previously described. This segment can be found in the following transcript(s): T07775_T21 (SEQ ID NO:1735). Table 1646 below describes the starting and ending position of this segment on each transcript.

TABLE 1646

Segment location on transcripts

| Transcript name | Segment starting position | Segment ending position |
|---|---|---|
| T07775_T21 (SEQ ID NO: 1735) | 2846 | 3345 |

This segment can be found in a non-coding region of transcript(s) that are related to the following protein(s): T07775_P26.

Segment cluster T07775_node__75 (SEQ ID NO:1749) according to the present invention is supported by 186 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1647 below describes the starting and ending position of this segment on each transcript.

TABLE 1647

Segment location on transcripts

| Transcript name | Segment starting position | Segment ending position |
|---|---|---|
| T07775_T16 (SEQ ID NO: 1732) | 2992 | 3170 |
| T07775_T17 (SEQ ID NO: 1733) | 2693 | 2871 |
| T07775_T18 (SEQ ID NO: 1734) | 2732 | 2910 |
| T07775_T21 (SEQ ID NO: 1735) | 3346 | 3524 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node__81 (SEQ ID NO:1750) according to the present invention is supported by 215 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1648 below describes the starting and ending position of this segment on each transcript.

TABLE 1648

Segment location on transcripts

| Transcript name | Segment starting position | Segment ending position |
|---|---|---|
| T07775_T16 (SEQ ID NO: 1732) | 3289 | 3674 |
| T07775_T17 (SEQ ID NO: 1733) | 2990 | 3375 |
| T07775_T18 (SEQ ID NO: 1734) | 3029 | 3414 |
| T07775_T21 (SEQ ID NO: 1735) | 3643 | 4028 |

This segment can be found in a non-coding region of transcript(s) that are related to the following protein(s): T07775_P29 and T07775_P26.

Segment cluster T07775_node__84 (SEQ ID NO:1751) according to the present invention is supported by 90 libraries. The number of libraries was determined as previously described. This segment can be found in the following transcript(s): T07775_T16 (SEQ ID NO:1732), T07775_T17

(SEQ ID NO:1733), T07775_T18 (SEQ ID NO:1734) and T07775_T21 (SEQ ID NO:1735). Table 1649 below describes the starting and ending position of this segment on each transcript.

TABLE 1649

Segment location on transcripts

| Transcript name | Segment starting position | Segment ending position |
|---|---|---|
| T07775_T16 (SEQ ID NO: 1732) | 3815 | 4172 |
| T07775_T17 (SEQ ID NO: 1733) | 3516 | 3873 |
| T07775_T18 (SEQ ID NO: 1734) | 3555 | 3912 |
| T07775_T21 (SEQ ID NO: 1735) | 4169 | 4526 |

This segment can be found in a non-coding region of transcript(s) that are related to the following protein(s): T07775_P29 and T07775_P26.

Segment cluster T07775_node_86 (SEQ ID NO:1752) according to the present invention is supported by 126 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1650 below describes the starting and ending position of this segment on each transcript.

TABLE 1650

Segment location on transcripts

| Transcript name | Segment starting position | Segment ending position |
|---|---|---|
| T07775_T16 (SEQ ID NO: 1732) | 4173 | 4712 |
| T07775_T17 (SEQ ID NO: 1733) | 3874 | 4413 |
| T07775_T18 (SEQ ID NO: 1734) | 3913 | 4452 |
| T07775_T21 (SEQ ID NO: 1735) | 4527 | 5066 |

This segment can be found in a non-coding region of transcript(s) that are related to the following protein(s): T07775_P29 and T07775_P26.

Segment cluster T07775_node_87 (SEQ ID NO:1753) according to the present invention is supported by 129 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1651 below describes the starting and ending position of this segment on each transcript.

TABLE 1651

Segment location on transcripts

| Transcript name | Segment starting position | Segment ending position |
|---|---|---|
| T07775_T16 (SEQ ID NO: 1732) | 4713 | 5105 |
| T07775_T17 (SEQ ID NO: 1733) | 4414 | 4806 |
| T07775_T18 (SEQ ID NO: 1734) | 4453 | 4845 |
| T07775_T21 (SEQ ID NO: 1735) | 5067 | 5459 |

This segment can be found in both coding and non-coding regions of transcript(s) as follows. The segment can be found in a non-coding region of transcript(s) that are related to the following protein(s): T07775_P29. This segment can also be found in the following protein(s): T07775_P26, since it is in the coding region for the corresponding transcript.

Segment cluster T07775_node_88 (SEQ ID NO:1754) according to the present invention is supported by 116 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1652 below describes the starting and ending position of this segment on each transcript.

TABLE 1652

Segment location on transcripts

| Transcript name | Segment starting position | Segment ending position |
|---|---|---|
| T07775_T16 (SEQ ID NO: 1732) | 5106 | 5372 |
| T07775_T17 (SEQ ID NO: 1733) | 4807 | 5073 |
| T07775_T18 (SEQ ID NO: 1734) | 4846 | 5112 |
| T07775_T21 (SEQ ID NO: 1735) | 5460 | 5726 |

This segment can be found in both coding and non-coding regions of transcript(s) as follows. The segment can be found in a non-coding region of transcript(s) that are related to the following protein(s): T07775_P29. This segment can also be found in the following protein(s): T07775_P26, since it is in the coding region for the corresponding transcript.

Segment cluster T07775_node_89 (SEQ ID NO:1755) according to the present invention is supported by 187 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1653 below describes the starting and ending position of this segment on each transcript.

TABLE 1653

Segment location on transcripts

| Transcript name | Segment starting position | Segment ending position |
|---|---|---|
| T07775_T16 (SEQ ID NO: 1732) | 5373 | 5827 |
| T07775_T17 (SEQ ID NO: 1733) | 5074 | 5528 |
| T07775_T18 (SEQ ID NO: 1734) | 5113 | 5567 |
| T07775_T21 (SEQ ID NO: 1735) | 5727 | 6181 |

This segment can be found in a non-coding region of transcript(s) that are related to the following protein(s): T07775_P29 and T07775_P26.

Segment cluster T07775_node_94 (SEQ ID NO:1756) according to the present invention is supported by 119 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1654 below describes the starting and ending position of this segment on each transcript.

TABLE 1654

Segment location on transcripts

| Transcript name | Segment starting position | Segment ending position |
|---|---|---|
| T07775_T16 (SEQ ID NO: 1732) | 6055 | 6237 |
| T07775_T17 (SEQ ID NO: 1733) | 5756 | 5938 |
| T07775_T18 (SEQ ID NO: 1734) | 5795 | 5977 |
| T07775_T21 (SEQ ID NO: 1735) | 6409 | 6591 |

This segment can be found in a non-coding region of transcript(s) that are related to the following protein(s): T07775_P29 and T07775_P26.

According to an optional embodiment of the present invention, short segments related to the above cluster are also provided. These segments are up to about 120 bp in length, and so are included in a separate description.

Segment cluster T07775_node_6 (SEQ ID NO:1757) according to the present invention is supported by 2 libraries. The number of libraries was determined as previously described. This segment can be found in the following transcript(s): T07775_T17 (SEQ ID NO:1733). Table 1655 below describes the starting and ending position of this segment on each transcript.

TABLE 1655

Segment location on transcripts

| Transcript name | Segment starting position | Segment ending position |
|---|---|---|
| T07775_T17 (SEQ ID NO: 1733) | 1 | 51 |

This segment can be found in a non-coding region of transcript(s) that are related to the following protein(s): T07775_P29.

Segment cluster T07775_node_8 (SEQ ID NO:1758) according to the present invention is supported by 1 libraries. The number of libraries was determined as previously described. This segment can be found in the following transcript(s): T07775_T18 (SEQ ID NO:1734). Table 1656 below describes the starting and ending position of this segment on each transcript.

TABLE 1656

Segment location on transcripts

| Transcript name | Segment starting position | Segment ending position |
|---|---|---|
| T07775_T18 (SEQ ID NO: 1734) | 1 | 90 |

This segment can be found in a non-coding region of transcript(s) that are related to the following protein(s): T07775_P29.

Segment cluster T07775_node_13 (SEQ ID NO:1759) according to the present invention is supported by 100 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1657 below describes the starting and ending position of this segment on each transcript.

TABLE 1657

Segment location on transcripts

| Transcript name | Segment staring position | Segment ending position |
|---|---|---|
| T07775_T16 (SEQ ID NO: 1732) | 351 | 420 |
| T07775_T17 (SEQ ID NO: 1733) | 52 | 121 |
| T07775_T18 (SEQ ID NO: 1734) | 91 | 160 |
| T07775_T21 (SEQ ID NO: 1735) | 193 | 262 |

This segment can be found in a non-coding region of transcript(s) that are related to the following protein(s): T07775_P29 and T07775_P26.

Segment cluster T07775_node_14 (SEQ ID NO:1760) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1658 below describes the starting and ending position of this segment on each transcript.

TABLE 1658

Segment location on transcripts

| Transcript name | Segment starting position | Segment ending position |
|---|---|---|
| T07775_T16 (SEQ ID NO: 1732) | 421 | 443 |
| T07775_T17 (SEQ ID NO: 1733) | 122 | 144 |
| T07775_T18 (SEQ ID NO: 1734) | 161 | 183 |
| T07775_T21 (SEQ ID NO: 1735) | 263 | 285 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_26 (SEQ ID NO:1761) according to the present invention is supported by 144 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1659 below describes the starting and ending position of this segment on each transcript.

TABLE 1659

Segment location on transcripts

| Transcript name | Segment starting position | Segment ending position |
|---|---|---|
| T07775_T16 (SEQ ID NO: 1732) | 1000 | 1091 |
| T07775_T17 (SEQ ID NO: 1733) | 701 | 792 |
| T07775_T18 (SEQ ID NO: 1734) | 740 | 831 |
| T07775_T21 (SEQ ID NO: 1735) | 842 | 933 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_29 (SEQ ID NO:1762) according to the present invention is supported by 157 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1660 below describes the starting and ending position of this segment on each transcript.

TABLE 1660

Segment location on transcripts

| Transcript name | Segment starting position | Segment ending position |
| --- | --- | --- |
| T07775_T16 (SEQ ID NO: 1732) | 1092 | 1187 |
| T07775_T17 (SEQ ID NO: 1733) | 793 | 888 |
| T07775_T18 (SEQ ID NO: 1734) | 832 | 927 |
| T07775_T21 (SEQ ID NO: 1735) | 934 | 1029 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_31 (SEQ ID NO:1763) according to the present invention is supported by 163 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1661 below describes the starting and ending position of this segment on each transcript.

TABLE 1661

Segment location on transcripts

| Transcript name | Segment starting position | Segment ending position |
| --- | --- | --- |
| T07775_T16 (SEQ ID NO: 1732) | 1188 | 1299 |
| T07775_T17 (SEQ ID NO: 1733) | 889 | 1000 |
| T07775_T18 (SEQ ID NO: 1734) | 928 | 1039 |
| T07775_T21 (SEQ ID NO: 1735) | 1030 | 1141 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_33 (SEQ ID NO:1764) according to the present invention is supported by 138 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1662 below describes the starting and ending position of this segment on each transcript.

TABLE 1662

Segment location on transcripts

| Transcript name | Segment starting position | Segment ending position |
| --- | --- | --- |
| T07775_T16 (SEQ ID NO: 1732) | 1300 | 1397 |
| T07775_T17 (SEQ ID NO: 1733) | 1001 | 1098 |
| T07775_T18 (SEQ ID NO: 1734) | 1040 | 1137 |
| T07775_T21 (SEQ ID NO: 1735) | 1142 | 1239 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_36 (SEQ ID NO:1765) according to the present invention is supported by 149 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1663 below describes the starting and ending position of this segment on each transcript.

TABLE 1663

Segment location on transcripts

| Transcript name | Segment starting position | Segment ending position |
| --- | --- | --- |
| T07775_T16 (SEQ ID NO: 1732) | 1398 | 1509 |
| T07775_T17 (SEQ ID NO: 1733) | 1099 | 1210 |
| T07775_T18 (SEQ ID NO: 1734) | 1138 | 1249 |
| T07775_T21 (SEQ ID NO: 1735) | 1240 | 1351 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_38 (SEQ ID NO:1766) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1664 below describes the starting and ending position of this segment on each transcript.

TABLE 1664

Segment location on transcripts

| Transcript name | Segment starting position | Segment ending position |
| --- | --- | --- |
| T07775_T16 (SEQ ID NO: 1732) | 1510 | 1531 |
| T07775_T17 (SEQ ID NO: 1733) | 1211 | 1232 |
| T07775_T18 (SEQ ID NO: 1734) | 1250 | 1271 |
| T07775_T21 (SEQ ID NO: 1735) | 1352 | 1373 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_40 (SEQ ID NO:1767) according to the present invention is supported by 141 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1665 below describes the starting and ending position of this segment on each transcript.

TABLE 1665

| | Segment location on transcripts | |
|---|---|---|
| Transcript name | Segment starting position | Segment ending position |
| T07775_T16 (SEQ ID NO: 1732) | 1532 | 1620 |
| T07775_T17 (SEQ ID NO: 1733) | 1233 | 1321 |
| T07775_T18 (SEQ ID NO: 1734) | 1272 | 1360 |
| T07775_T21 (SEQ ID NO: 1735) | 1374 | 1462 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_45 (SEQ ID NO:1768) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1666 below describes the starting and ending position of this segment on each transcript.

TABLE 1666

| | Segment location on transcripts | |
|---|---|---|
| Transcript name | Segment starting position | Segment ending position |
| T07775_T16 (SEQ ID NO: 1732) | 1621 | 1638 |
| T07775_T17 (SEQ ID NO: 1733) | 1322 | 1339 |
| T07775_T18 (SEQ ID NO: 1734) | 1361 | 1378 |
| T07775_T21 (SEQ ID NO: 1735) | 1463 | 1480 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_50 (SEQ ID NO:1769) according to the present invention can be found in the following transcript(s): T07775_T21 (SEQ ID NO:1735). Table 1667 below describes the starting and ending position of this segment on each transcript.

TABLE 1667

| | Segment location on transcripts | |
|---|---|---|
| Transcript name | Segment starting position | Segment ending position |
| T07775_T21 (SEQ ID NO: 1735) | 1831 | 1842 |

This segment can be found in a non-coding region of transcript(s) that are related to the following protein(s): T07775_P26.

Segment cluster T07775_node_57 (SEQ ID NO:1770) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1668 below describes the starting and ending position of this segment on each transcript.

TABLE 1668

| | Segment location on transcripts | |
|---|---|---|
| Transcript name | Segment starting position | Segment ending position |
| T07775_T16 (SEQ ID NO: 1732) | 2446 | 2461 |
| T07775_T17 (SEQ ID NO: 1733) | 2147 | 2162 |
| T07775_T18 (SEQ ID NO: 1734) | 2186 | 2201 |
| T07775_T21 (SEQ ID NO: 1735) | 2300 | 2315 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_58 (SEQ ID NO:1771) according to the present invention is supported by 122 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1669 below describes the starting and ending position of this segment on each transcript.

TABLE 1669

| | Segment location on transcripts | |
|---|---|---|
| Transcript name | Segment starting position | Segment ending position |
| T07775_T16 (SEQ ID NO: 1732) | 2462 | 2499 |
| T07775_T17 (SEQ ID NO: 1733) | 2163 | 2200 |
| T07775_T18 (SEQ ID NO: 1734) | 2202 | 2239 |
| T07775_T21 (SEQ ID NO: 1735) | 2316 | 2353 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_67 (SEQ ID NO:1772) according to the present invention is supported by 74 libraries. The number of libraries was determined as previously described. This segment can be found in the following transcript(s): T07775_T16 (SEQ ID NO:1732), T07775_T17

(SEQ ID NO:1733), T07775_T18 (SEQ ID NO:1734) and T07775_T21 (SEQ ID NO:1735). Table 1670 below describes the starting and ending position of this segment on each transcript.

TABLE 1670

Segment location on transcripts

| Transcript name | Segment starting position | Segment ending position |
|---|---|---|
| T07775_T16 (SEQ ID NO: 1732) | 2500 | 2575 |
| T07775_T17 (SEQ ID NO: 1733) | 2201 | 2276 |
| T07775_T18 (SEQ ID NO: 1734) | 2240 | 2315 |
| T07775_T21 (SEQ ID NO: 1735) | 2354 | 2429 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_69 (SEQ ID NO:1773) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1671 below describes the starting and ending position of this segment on each transcript.

TABLE 1671

Segment location on transcripts

| Transcript name | Segment starting position | Segment ending position |
|---|---|---|
| T07775_T16 (SEQ ID NO: 1732) | 2815 | 2818 |
| T07775_T17 (SEQ ID NO: 1733) | 2516 | 2519 |
| T07775_T18 (SEQ ID NO: 1734) | 2555 | 2558 |
| T07775_T21 (SEQ ID NO: 1735) | 2669 | 2672 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_70 (SEQ ID NO:1774) according to the present invention is supported by 101 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1672 below describes the starting and ending position of this segment on each transcript.

TABLE 1672

Segment location on transcripts

| Transcript name | Segment starting position | Segment ending position |
|---|---|---|
| T07775_T16 (SEQ ID NO: 1732) | 2819 | 2862 |
| T07775_T17 (SEQ ID NO: 1733) | 2520 | 2563 |
| T07775_T18 (SEQ ID NO: 1734) | 2559 | 2602 |
| T07775_T21 (SEQ ID NO: 1735) | 2673 | 2716 |

This segment can be found in both coding and non-coding regions of transcript(s) as follows. The segment can be found in a non-coding region of transcript(s) that are related to the following protein(s): T07775_P26. This segment can also be found in the following protein(s): T07775_P29, since it is in the coding region for the corresponding transcript.

Segment cluster T07775_node_76 (SEQ ID NO:1775) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1673 below describes the starting and ending position of this segment on each transcript.

TABLE 1673

Segment location on transcripts

| Transcript name | Segment starting position | Segment ending position |
|---|---|---|
| T07775_T16 (SEQ ID NO: 1732) | 3171 | 3189 |
| T07775_T17 (SEQ ID NO: 1733) | 2872 | 2890 |
| T07775_T18 (SEQ ID NO: 1734) | 2911 | 2929 |
| T07775_T21 (SEQ ID NO: 1735) | 3525 | 3543 |

This segment can be found in a non-coding region of transcript(s) that are related to the following protein(s): T07775_P29 and T07775_P26.

Segment cluster T07775_node_77 (SEQ ID NO:1776) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1674 below describes the starting and ending position of this segment on each transcript.

TABLE 1674

Segment location on transcripts

| Transcript name | Segment starting position | Segment ending position |
|---|---|---|
| T07775_T16 (SEQ ID NO: 1732) | 3190 | 3214 |
| T07775_T17 (SEQ ID NO: 1733) | 2891 | 2915 |
| T07775_T18 (SEQ ID NO: 1734) | 2930 | 2954 |
| T07775_T21 (SEQ ID NO: 1735) | 3544 | 3568 |

This segment can be found in a non-coding region of transcript(s) that are related to the following protein(s): T07775_P29 and T07775_P26.

Segment cluster T07775_node_78 (SEQ ID NO:1777) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1675 below describes the starting and ending position of this segment on each transcript.

TABLE 1675

Segment location on transcripts

| Transcript name | Segment starting position | Segment ending position |
|---|---|---|
| T07775_T16 (SEQ ID NO: 1732) | 3215 | 3229 |
| T07775_T17 (SEQ ID NO: 1733) | 2916 | 2930 |
| T07775_T18 (SEQ ID NO: 1734) | 2955 | 2969 |
| T07775_T21 (SEQ ID NO: 1735) | 3569 | 3583 |

This segment can be found in a non-coding region of transcript(s) that are related to the following protein(s): T07775_P29 and T07775_P26.

Segment cluster T07775_node_79 (SEQ ID NO:1778) according to the present invention is supported by 173 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1676 below describes the starting and ending position of this segment on each transcript.

TABLE 1676

Segment location on transcripts

| Transcript name | Segment starting position | Segment ending position |
|---|---|---|
| T07775_T16 (SEQ ID NO: 1732) | 3230 | 3260 |
| T07775_T17 (SEQ ID NO: 1733) | 2931 | 2961 |
| T07775_T18 (SEQ ID NO: 1734) | 2970 | 3000 |
| T07775_T21 (SEQ ID NO: 1735) | 3584 | 3614 |

This segment can be found in a non-coding region of transcript(s) that are related to the following protein(s): T07775_P29 and T07775_P26.

Segment cluster T07775_node_80 (SEQ ID NO:1779) according to the present invention is supported by 165 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1677 below describes the starting and ending position of this segment on each transcript.

TABLE 1677

Segment location on transcripts

| Transcript name | Segment starting position | Segment ending position |
|---|---|---|
| T07775_T16 (SEQ ID NO: 1732) | 3261 | 3288 |
| T07775_T17 (SEQ ID NO: 1733) | 2962 | 2989 |
| T07775_T18 (SEQ ID NO: 1734) | 3001 | 3028 |
| T07775_T21 (SEQ ID NO: 1735) | 3615 | 3642 |

This segment can be found in a non-coding region of transcript(s) that are related to the following protein(s): T07775_P29 and T07775_P26.

Segment cluster T07775_node_82 (SEQ ID NO:1780) according to the present invention is supported by 47 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1678 below describes the starting and ending position of this segment on each transcript.

TABLE 1678

Segment location on transcripts

| Transcript name | Segment starting position | Segment ending position |
|---|---|---|
| T07775_T16 (SEQ ID NO: 1732) | 3675 | 3726 |
| T07775_T17 (SEQ ID NO: 1733) | 3376 | 3427 |
| T07775_T18 (SEQ ID NO: 1734) | 3415 | 3466 |
| T07775_T21 (SEQ ID NO: 1735) | 4029 | 4080 |

This segment can be found in a non-coding region of transcript(s) that are related to the following protein(s): T07775_P29 and T07775_P26.

Segment cluster T07775_node_83 (SEQ ID NO:1781) according to the present invention is supported by 62 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1679 below describes the starting and ending position of this segment on each transcript.

TABLE 1679

Segment location on transcripts

| Transcript name | Segment starting position | Segment ending position |
|---|---|---|
| T07775_T16 (SEQ ID NO: 1732) | 3727 | 3814 |
| T07775_T17 (SEQ ID NO: 1733) | 3428 | 3515 |
| T07775_T18 (SEQ ID NO: 1734) | 3467 | 3554 |
| T07775_T21 (SEQ ID NO: 1735) | 4081 | 4168 |

This segment can be found in a non-coding region of transcript(s) that are related to the following protein(s): T07775_P29 and T07775_P26.

Segment cluster T07775_node_90 (SEQ ID NO:1782) according to the present invention is supported by 136 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1680 below describes the starting and ending position of this segment on each transcript.

TABLE 1680

Segment location on transcripts

| Transcript name | Segment starting position | Segment ending position |
|---|---|---|
| T07775_T16 (SEQ ID NO: 1732) | 5828 | 5942 |
| T07775_T17 (SEQ ID NO: 1733) | 5529 | 5643 |
| T07775_T18 (SEQ ID NO: 1734) | 5568 | 5682 |
| T07775_T21 (SEQ ID NO: 1735) | 6182 | 6296 |

This segment can be found in a non-coding region of transcript(s) that are related to the following protein(s): T07775_P29 and T07775_P26.

Segment cluster T07775_node_91 (SEQ ID NO:1783) according to the present invention can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1681 below describes the starting and ending position of this segment on each transcript.

TABLE 1681

Segment location on transcripts

| Transcript name | Segment starting position | Segment ending position |
|---|---|---|
| T07775_T16 (SEQ ID NO: 1732) | 5943 | 5961 |
| T07775_T17 (SEQ ID NO: 1733) | 5644 | 5662 |
| T07775_T18 (SEQ ID NO: 1734) | 5683 | 5701 |
| T07775_T21 (SEQ ID NO: 1735) | 6297 | 6315 |

This segment can be found in a non-coding region of transcript(s) that are related to the following protein(s): T07775_P29 and T07775_P26.

Segment cluster T07775_node_93 (SEQ ID NO:1784) according to the present invention is supported by 129 libraries. The number of libraries was determined as previously described. This segment can be found in the following transcript(s): T07775_T16 (SEQ ID NO:1732), T07775_T17 (SEQ ID NO:1733), T07775_T18 (SEQ ID NO:1734) and T07775_T21 (SEQ ID NO:1735). Table 1682 below describes the starting and ending position of this segment on each transcript.

TABLE 1682

Segment location on transcripts

| Transcript name | Segment starting position | Segment ending position |
|---|---|---|
| T07775_T16 (SEQ ID NO: 1732) | 5962 | 6054 |
| T07775_T17 (SEQ ID NO: 1733) | 5663 | 5755 |
| T07775_T18 (SEQ ID NO: 1734) | 5702 | 5794 |
| T07775_T21 (SEQ ID NO: 1735) | 6316 | 6408 |

This segment can be found in a non-coding region of transcript(s) that are related to the following protein(s): T07775_P29 and T07775_P26.

Description for Cluster T08538

Cluster T08538 features 3 transcript(s) and 24 segment(s) of interest, the names for which are given in Tables 1683 and 1684, respectively, the sequences themselves are given at the end of the application. The selected protein variants are given in Table 1685.

TABLE 1683

Transcripts of interest
Transcript Name

T08538_T45 (SEQ ID NO: 1785)
T08538_T56 (SEQ ID NO: 1786)
T08538_T59 (SEQ ID NO: 1787)

TABLE 1684

Segments of interest
Segment Name

T08538_node_0 (SEQ ID NO: 1788)
T08538_node_17 (SEQ ID NO: 1789)
T08538_node_24 (SEQ ID NO: 1790)
T08538_node_29 (SEQ ID NO: 1791)
T08538_node_30 (SEQ ID NO: 1792)

TABLE 1684-continued

Segments of interest
Segment Name

T08538_node_70 (SEQ ID NO: 1793)
T08538_node_75 (SEQ ID NO: 1794)
T08538_node_106 (SEQ ID NO: 1795)
T08538_node_7 (SEQ ID NO: 1796)
T08538_node_8 (SEQ ID NO: 1797)
T08538_node_9 (SEQ ID NO: 1798)
T08538_node_11 (SEQ ID NO: 1799)
T08538_node_15 (SEQ ID NO: 1800)
T08538_node_28 (SEQ ID NO: 1801)
T08538_node_62 (SEQ ID NO: 1802)
T08538_node_67 (SEQ ID NO: 1803)
T08538_node_68 (SEQ ID NO: 1804)
T08538_node_72 (SEQ ID NO: 1805)
T08538_node_76 (SEQ ID NO: 1806)
T08538_node_78 (SEQ ID NO: 1807)
T08538_node_79 (SEQ ID NO: 1808)
T08538_node_82 (SEQ ID NO: 1809)
T08538_node_85 (SEQ ID NO: 1810)
T08538_node_88 (SEQ ID NO: 1811)

TABLE 1685

Proteins of interest

| Protein Name | Corresponding Transcript(s) |
|---|---|
| T08538_P23 | T08538_T45 (SEQ ID NO: 1785) |
| T08538_P29 | T08538_T56 (SEQ ID NO: 1786) |
| T08538_P31 | T08538_T59 (SEQ ID NO: 1787) |

Cluster T08538 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 44 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 44 and Table 1686. This cluster is overexpressed (at least at a minimum level) in the following pathological conditions: lung malignant tumors.

TABLE 1686

Normal tissue distribution

| Name of Tissue | Number |
|---|---|
| Adrenal | 160 |
| Bladder | 82 |
| Brain | 84 |
| Colon | 31 |
| Epithelial | 32 |
| General | 40 |
| Kidney | 29 |
| Liver | 4 |
| Lung | 8 |
| lymph nodes | 49 |
| Breast | 0 |
| Muscle | 27 |
| Ovary | 14 |
| Pancreas | 43 |
| Prostate | 2 |
| Skin | 56 |
| Stomach | 36 |
| Thyroid | 0 |
| Uterus | 9 |

TABLE 1687

P values and ratios for expression in cancerous tissue

| Name of Tissue | P1 | P2 | SP1 | R3 | SP2 | R4 |
|---|---|---|---|---|---|---|
| Adrenal | 6.3e−01 | 6.9e−01 | 7.0e−01 | 0.9 | 8.3e−01 | 0.7 |
| Bladder | 8.2e−01 | 8.5e−01 | 9.2e−01 | 0.6 | 9.7e−01 | 0.5 |
| Brain | 7.7e−01 | 8.0e−01 | 1 | 0.2 | 1 | 0.2 |
| Colon | 2.5e−01 | 1.6e−01 | 6.5e−01 | 1.2 | 6.8e−01 | 1.2 |
| Epithelial | 3.4e−02 | 1.1e−01 | 3.5e−02 | 1.6 | 1.9e−01 | 1.2 |
| General | 2.6e−02 | 1.1e−01 | 5.0e−02 | 1.3 | 2.3e−01 | 1.1 |
| Kidney | 7.9e−01 | 8.0e−01 | 8.2e−01 | 0.8 | 9.1e−01 | 0.7 |
| Liver | 9.1e−01 | 8.8e−01 | 1 | 0.9 | 6.9e−01 | 1.3 |
| Lung | 2.2e−02 | 1.0e−01 | 3.3e−04 | 8.5 | 5.0e−03 | 4.7 |
| lymph nodes | 6.9e−01 | 8.3e−01 | 1 | 0.4 | 1 | 0.4 |
| Breast | 3.0e−02 | 2.4e−02 | 1.1e−01 | 3.7 | 1.7e−01 | 2.9 |
| Muscle | 5.2e−01 | 6.1e−01 | 1.2e−02 | 5.0 | 1.7e−01 | 1.6 |
| Ovary | 6.7e−01 | 5.6e−01 | 4.7e−01 | 1.4 | 4.5e−01 | 1.4 |
| Pancreas | 4.3e−01 | 6.5e−01 | 4.6e−01 | 1.2 | 6.9e−01 | 0.9 |
| Prostate | 8.3e−01 | 8.3e−01 | 4.5e−01 | 1.9 | 5.6e−01 | 1.7 |
| Skin | 6.3e−01 | 7.5e−01 | 5.4e−01 | 1.4 | 7.3e−01 | 0.5 |
| Stomach | 2.7e−01 | 4.7e−01 | 7.5e−01 | 1.0 | 6.5e−01 | 1.0 |
| Thyroid | 3.6e−01 | 3.6e−01 | 1 | 1.1 | 1 | 1.1 |
| Uterus | 2.8e−01 | 2.0e−01 | 2.9e−01 | 1.8 | 2.1e−01 | 1.8 |

As noted above, cluster T08538 features 24 segment(s), which were listed in Table 1684 above and for which the sequence(s) are given at the end of the application. These segment(s) are portions of nucleic acid sequence(s) which are described herein separately because they are of particular interest. A description of each segment according to the present invention is now provided.

Segment cluster T08538_node_0 (SEQ ID NO:1788) according to the present invention is supported by 37 libraries. The number of libraries was determined as previously described. This segment can be found in the following transcript(s): T08538_T56 (SEQ ID NO:1786) and T08538_T59 (SEQ ID NO:1787). Table 1688 below describes the starting and ending position of this segment on each transcript.

TABLE 1688

Segment location on transcripts

| Transcript name | Segment starting position | Segment ending position |
|---|---|---|
| T08538_T56 (SEQ ID NO: 1786) | 1 | 131 |
| T08538_T59 (SEQ ID NO: 1787) | 1 | 131 |

This segment can be found in the following protein(s): T08538_P29 and T08538_P31.

Segment cluster T08538_node_17 (SEQ ID NO:1789) according to the present invention is supported by 49 libraries. The number of libraries was determined as previously described. This segment can be found in the following transcript(s): T08538_T56 (SEQ ID NO:1786) and T08538_T59 (SEQ ID NO:1787). Table 1689 below describes the starting and ending position of this segment on each transcript.

TABLE 1689

Segment location on transcripts

| Transcript name | Segment starting position | Segment ending position |
|---|---|---|
| T08538_T56 (SEQ ID NO: 1786) | 460 | 623 |
| T08538_T59 (SEQ ID NO: 1787) | 460 | 623 |

This segment can be found in the following protein(s): T08538_P29 and T08538_P31.

Segment cluster T08538_node_24 (SEQ ID NO:1790) according to the present invention is supported by 6 libraries. The number of libraries was determined as previously described. This segment can be found in the following transcript(s): T08538_T59 (SEQ ID NO:1787). Table 1690 below describes the starting and ending position of this segment on each transcript.

TABLE 1690

Segment location on transcripts

| Transcript name | Segment starting position | Segment ending position |
|---|---|---|
| T08538_T59 (SEQ ID NO: 1787) | 624 | 1915 |

This segment can be found in the following protein(s): T08538_P31.

Segment cluster T08538_node_29 (SEQ ID NO:1791) according to the present invention is supported by 45 libraries. The number of libraries was determined as previously described. This segment can be found in the following transcript(s): T08538_T56 (SEQ ID NO:1786). Table 1691 below describes the starting and ending position of this segment on each transcript.

TABLE 1691

Segment location on transcripts

| Transcript name | Segment starting position | Segment ending position |
|---|---|---|
| T08538_T56 (SEQ ID NO: 1786) | 719 | 874 |

This segment can be found in the following protein(s): T08538_P29.

Segment cluster T08538_node_30 (SEQ ID NO:1792) according to the present invention is supported by 4 libraries. The number of libraries was determined as previously described. This segment can be found in the following transcript(s): T08538_T56 (SEQ ID NO:1786). Table 1692 below describes the starting and ending position of this segment on each transcript.

TABLE 1692

Segment location on transcripts

| Transcript name | Segment starting position | Segment ending position |
|---|---|---|
| T08538_T56 (SEQ ID NO: 1786) | 875 | 1524 |

This segment can be found in the following protein(s): T08538_P29.

Segment cluster T08538_node_70 (SEQ ID NO:1793) according to the present invention is supported by 51 libraries. The number of libraries was determined as previously described. This segment can be found in the following transcript(s): T08538_T45 (SEQ ID NO:1785). Table 1693 below describes the starting and ending position of this segment on each transcript.

TABLE 1693

Segment location on transcripts

| Transcript name | Segment starting position | Segment ending position |
|---|---|---|
| T08538_T45 (SEQ ID NO: 1785) | 191 | 334 |

This segment can be found in the following protein(s): T08538_P23.

Segment cluster T08538_node_75 (SEQ ID NO:1794) according to the present invention is supported by 54 libraries. The number of libraries was determined as previously described. This segment can be found in the following transcript(s): T08538_T45 (SEQ ID NO:1785). Table 1694 below describes the starting and ending position of this segment on each transcript.

TABLE 1694

Segment location on transcripts

| Transcript name | Segment starting position | Segment ending position |
|---|---|---|
| T08538_T45 (SEQ ID NO: 1785) | 395 | 573 |

This segment can be found in the following protein(s): T08538_P23.

Segment cluster T08538_node_106 (SEQ ID NO:1795) according to the present invention is supported by 152 libraries. The number of libraries was determined as previously described. This segment can be found in the following transcript(s): T08538_T45 (SEQ ID NO:1785). Table 1695 below describes the starting and ending position of this segment on each transcript.

TABLE 1695

Segment location on transcripts

| Transcript name | Segment starting position | Segment ending position |
|---|---|---|
| T08538_T45 (SEQ ID NO: 1785) | 1022 | 1630 |

This segment can be found in the following protein(s): T08538_P23.

According to an optional embodiment of the present invention, short segments related to the above cluster are also provided. These segments are up to about 120 bp in length, and so are included in a separate description.

Segment cluster T08538_node_7 (SEQ ID NO:1796) according to the present invention is supported by 52 libraries. The number of libraries was determined as previously described. This segment can be found in the following transcript(s): T08538_T56 (SEQ ID NO:1786) and T08538_T59 (SEQ ID NO:1787). Table 1696 below describes the starting and ending position of this segment on each transcript.

TABLE 1696

Segment location on transcripts

| Transcript name | Segment starting position | Segment ending position |
|---|---|---|
| T08538_T56 (SEQ ID NO: 1786) | 132 | 250 |
| T08538_T59 (SEQ ID NO: 1787) | 132 | 250 |

This segment can be found in the following protein(s): T08538_P29 and T08538_P31.

Segment cluster T08538_node_8 (SEQ ID NO:1797) according to the present invention can be found in the following transcript(s): T08538_T56 (SEQ ID NO:1786) and T08538_T59 (SEQ ID NO:1787). Table 1697 below describes the starting and ending position of this segment on each transcript.

TABLE 1697

Segment location on transcripts

| Transcript name | Segment starting position | Segment ending position |
|---|---|---|
| T08538_T56 (SEQ ID NO: 1786) | 251 | 269 |
| T08538_T59 (SEQ ID NO: 1787) | 251 | 269 |

This segment can be found in the following protein(s): T08538_P29 and T08538_P31.

Segment cluster T08538_node_9 (SEQ ID NO:1798) according to the present invention can be found in the following transcript(s): T08538_T56 (SEQ ID NO:1786) and T08538_T59 (SEQ ID NO:1787). Table 1698 below describes the starting and ending position of this segment on each transcript.

TABLE 1698

Segment location on transcripts

| Transcript name | Segment starting position | Segment ending position |
|---|---|---|
| T08538_T56 (SEQ ID NO: 1786) | 270 | 287 |
| T08538_T59 (SEQ ID NO: 1787) | 270 | 287 |

This segment can be found in the following protein(s): T08538_P29 and T08538_P31.

Segment cluster T08538_node_11 (SEQ ID NO:1799) according to the present invention is supported by 50 libraries. The number of libraries was determined as previously described. This segment can be found in the following transcript(s): T08538_T56 (SEQ ID NO:1786) and T08538_T59 (SEQ ID NO:1787). Table 1699 below describes the starting and ending position of this segment on each transcript.

TABLE 1699

Segment location on transcripts

| Transcript name | Segment starting position | Segment ending position |
|---|---|---|
| T08538_T56 (SEQ ID NO: 1786) | 288 | 354 |
| T08538_T59 (SEQ ID NO: 1787) | 288 | 354 |

This segment can be found in the following protein(s): T08538_P29 and T08538_P31.

Segment cluster T08538_node__15 (SEQ ID NO:1800) according to the present invention is supported by 51 libraries. The number of libraries was determined as previously described. This segment can be found in the following transcript(s): T08538_T56 (SEQ ID NO:1786) and T08538_T59 (SEQ ID NO:1787). Table 1700 below describes the starting and ending position of this segment on each transcript.

TABLE 1700

Segment location on transcripts

| Transcript name | Segment starting position | Segment ending position |
|---|---|---|
| T08538_T56 (SEQ ID NO: 1786) | 355 | 459 |
| T08538_T59 (SEQ ID NO: 1787) | 355 | 459 |

This segment can be found in the following protein(s): T08538_P29 and T08538_P31.

Segment cluster T08538_node__28 (SEQ ID NO:1801) according to the present invention is supported by 44 libraries. The number of libraries was determined as previously described. This segment can be found in the following transcript(s): T08538_T56 (SEQ ID NO:1786). Table 1701 below describes the starting and ending position of this segment on each transcript.

TABLE 1701

Segment location on transcripts

| Transcript name | Segment starting position | Segment ending position |
|---|---|---|
| T08538_T56 (SEQ ID NO: 1786) | 624 | 718 |

This segment can be found in the following protein(s): T08538_P29.

Segment cluster T08538_node__62 (SEQ ID NO:1802) according to the present invention is supported by 1 libraries. The number of-libraries was determined as previously described. This segment can be found in the following transcript(s): T08538_T45 (SEQ ID NO:1785). Table 1702 below describes the starting and ending position of this segment on each transcript.

TABLE 1702

Segment location on transcripts

| Transcript name | Segment starting position | Segment ending position |
|---|---|---|
| T08538_T45 (SEQ ID NO: 1785) | 1 | 102 |

This segment can be found in a non-coding region of transcript(s) that are related to the following protein(s): T08538_P23.

Segment cluster T08538_node__67 (SEQ ID NO:1803) according to the present invention can be found in the following transcript(s): T08538_T45 (SEQ ID NO:1785). Table 1703 below describes the starting and ending position of this segment on each transcript.

TABLE 1703

Segment location on transcripts

| Transcript name | Segment starting position | Segment ending position |
|---|---|---|
| T08538_T45 (SEQ ID NO: 1785) | 103 | 107 |

This segment can be found in a non-coding region of transcript(s) that are related to the following protein(s): T08538_P23.

Segment cluster T08538_node__68 (SEQ ID NO:1804) according to the present invention is supported by 47 libraries. The number of libraries was determined as previously described. This segment can be found in the following transcript(s): T08538_T45 (SEQ ID NO:1785). Table 1704 below describes the starting and ending position of this segment on each transcript.

TABLE 1704

Segment location on transcripts

| Transcript name | Segment starting position | Segment ending position |
|---|---|---|
| T08538_T45 (SEQ ID NO: 1785) | 108 | 190 |

This segment can be found in a non-coding region of transcript(s) that are related to the following protein(s): T08538_P23.

Segment cluster T08538_node__72 (SEQ ID NO:1805) according to the present invention is supported by 47 libraries. The number of libraries was determined as previously described. This segment can be found in the following transcript(s): T08538_T45 (SEQ ID NO:1785). Table 1705 below describes the starting and ending position of this segment on each transcript.

TABLE 1705

Segment location on transcripts

| Transcript name | Segment starting position | Segment ending position |
|---|---|---|
| T08538_T45 (SEQ ID NO: 1785) | 335 | 394 |

This segment can be found in the following protein(s): T08538_P23.

Segment cluster T08538_node__76 (SEQ ID NO:1806) according to the present invention is supported by 48 libraries. The number of libraries was determined as previously described. This segment can be found in the following transcript(s): T08538_T45 (SEQ ID NO:1785). Table 1706 below describes the starting and ending position of this segment on each transcript.

TABLE 1706

Segment location on transcripts

| Transcript name | Segment starting position | Segment ending position |
|---|---|---|
| T08538_T45 (SEQ ID NO: 1785) | 574 | 605 |

This segment can be found in the following protein(s): T08538_P23.

Segment cluster T08538_node_78 (SEQ ID NO:1807) according to the present invention is supported by 56 libraries. The number of libraries was determined as previously described. This segment can be found in the following transcript(s): T08538_T45 (SEQ ID NO:1785). Table 1707 below describes the starting and ending position of this segment on each transcript.

TABLE 1707

| Segment location on transcripts | | |
|---|---|---|
| Transcript name | Segment starting position | Segment ending position |
| T08538_T45 (SEQ ID NO: 1785) | 606 | 646 |

This segment can be found in the following protein(s): T08538_P23.

Segment cluster T08538_node_79 (SEQ ID NO:1808) according to the present invention is supported by 69 libraries. The number of libraries was determined as previously described. This segment can be found in the following transcript(s): T08538_T45 (SEQ ID NO:1785). Table 1708 below describes the starting and ending position of this segment on each transcript.

TABLE 1708

| Segment location on transcripts | | |
|---|---|---|
| Transcript name | Segment starting position | Segment ending position |
| T08538_T45 (SEQ ID NO: 1785) | 647 | 758 |

This segment can be found in the following protein(s): T08538_P23.

Segment cluster T08538_node_82 (SEQ ID NO:1809) according to the present invention is supported by 52 libraries. The number of libraries was determined as previously described. This segment can be found in the following transcript(s): T08538_T45 (SEQ ID NO:1785). Table 1709 below describes the starting and ending position of this segment on each transcript.

TABLE 1709

| Segment location on transcripts | | |
|---|---|---|
| Transcript name | Segment starting position | Segment ending position |
| T08538_T45 (SEQ ID NO: 1785) | 759 | 852 |

This segment can be found in the following protein(s): T08538_P23.

Segment cluster T08538_node_85 (SEQ ID NO:1810) according to the present invention is supported by 72 libraries. The number of libraries was determined as previously described. This segment can be found in the following transcript(s): T08538_T45 (SEQ ID NO:1785). Table 1710 below describes the starting and ending position of this segment on each transcript.

TABLE 1710

| Segment location on transcripts | | |
|---|---|---|
| Transcript name | Segment starting position | Segment ending position |
| T08538_T45 (SEQ ID NO: 1785) | 853 | 967 |

This segment can be found in the following protein(s): T08538_P23.

Segment cluster T08538_node_88 (SEQ ID NO:1811) according to the present invention is supported by 67 libraries. The number of libraries was determined as previously described. This segment can be found in the following transcript(s): T08538_T45 (SEQ ID NO:1785). Table 1711 below describes the starting and ending position of this segment on each transcript.

TABLE 1711

| Segment location on transcripts | | |
|---|---|---|
| Transcript name | Segment starting position | Segment ending position |
| T08538_T45 (SEQ ID NO: 1785) | 968 | 1021 |

This segment can be found in the following protein(s): T08538_P23.

Description for Cluster T10476

Cluster T10476 features 10 transcript(s) and 61 segment(s) of interest, the names for which are given in Tables 1712 and 1713, respectively, the sequences themselves are given at the end of the application. The selected protein variants are given in Table 1714.

TABLE 1712

| Transcripts of interest |
|---|
| Transcript Name |
| T10476_T3 (SEQ ID NO: 1812) |
| T10476_T4 (SEQ ID NO: 1813) |
| T10476_T6 (SEQ ID NO: 1814) |
| T10476_T7 (SEQ ID NO: 1815) |
| T10476_T8 (SEQ ID NO: 1816) |
| T10476_T13 (SEQ ID NO: 1817) |
| T10476_T26 (SEQ ID NO: 1818) |
| T10476_T27 (SEQ ID NO: 1819) |
| T10476_T29 (SEQ ID NO: 1820) |
| T10476_T31 (SEQ ID NO: 1821) |

TABLE 1713

| Segments of interest |
|---|
| Segment Name |
| T10476_node_0 (SEQ ID NO: 1822) |
| T10476_node_3 (SEQ ID NO: 1823) |
| T10476_node_13 (SEQ ID NO: 1824) |
| T10476_node_19 (SEQ ID NO: 1825) |
| T10476_node_23 (SEQ ID NO: 1826) |
| T10476_node_25 (SEQ ID NO: 1827) |
| T10476_node_31 (SEQ ID NO: 1828) |
| T10476_node_39 (SEQ ID NO: 1829) |
| T10476_node_41 (SEQ ID NO: 1830) |
| T10476_node_54 (SEQ ID NO: 1831) |
| T10476_node_60 (SEQ ID NO: 1832) |
| T10476_node_62 (SEQ ID NO: 1833) |
| T10476_node_64 (SEQ ID NO: 1834) |

TABLE 1713-continued

Segments of interest
Segment Name

T10476_node__68 (SEQ ID NO: 1835)
T10476_node__73 (SEQ ID NO: 1836)
T10476_node__74 (SEQ ID NO: 1837)
T10476_node__78 (SEQ ID NO: 1838)
T10476_node__80 (SEQ ID NO: 1839)
T10476_node__90 (SEQ ID NO: 1840)
T10476_node__91 (SEQ ID NO: 1841)
T10476_node__98 (SEQ ID NO: 1842)
T10476_node__103 (SEQ ID NO: 1843)
T10476_node__106 (SEQ ID NO: 1844)
T10476_node__107 (SEQ ID NO: 1845)
T10476_node__110 (SEQ ID NO: 1846)
T10476_node__111 (SEQ ID NO: 1847)
T10476_node__114 (SEQ ID NO: 1848)
T10476_node__115 (SEQ ID NO: 1849)
T10476_node__117 (SEQ ID NO: 1850)
T10476_node__118 (SEQ ID NO: 1851)
T10476_node__5 (SEQ ID NO: 1852)
T10476_node__11 (SEQ ID NO: 1853)
T10476_node__15 (SEQ ID NO: 1854)
T10476_node__17 (SEQ ID NO: 1855)
T10476_node__21 (SEQ ID NO: 1856)
T10476_node__27 (SEQ ID NO: 1857)
T10476_node__29 (SEQ ID NO: 1858)
T10476_node__33 (SEQ ID NO: 1859)
T10476_node__35 (SEQ ID NO: 1860)
T10476_node__37 (SEQ ID NO: 1861)
T10476_node__43 (SEQ ID NO: 1862)
T10476_node__47 (SEQ ID NO: 1863)
T10476_node__49 (SEQ ID NO: 1864)
T10476_node__51 (SEQ ID NO: 1865)
T10476_node__53 (SEQ ID NO: 1866)
T10476_node__56 (SEQ ID NO: 1867)
T10476_node__57 (SEQ ID NO: 1868)
T10476_node__58 (SEQ ID NO: 1869)
T10476_node__66 (SEQ ID NO: 1870)
T10476_node__71 (SEQ ID NO: 1871)
T10476_node__75 (SEQ ID NO: 1872)
T10476_node__83 (SEQ ID NO: 1873)
T10476_node__85 (SEQ ID NO: 1874)
T10476_node__88 (SEQ ID NO: 1875)
T10476_node__89 (SEQ ID NO: 1876)
T10476_node__94 (SEQ ID NO: 1877)
T10476_node__99 (SEQ ID NO: 1878)
T10476_node__101 (SEQ ID NO: 1879)
T10476_node__102 (SEQ ID NO: 1880)
T10476_node__108 (SEQ ID NO: 1881)
T10476_node__116 (SEQ ID NO: 1882)

TABLE 1714

Proteins of interest

| Protein Name | Corresponding Transcript(s) |
| --- | --- |
| T10476_P4 | T10476_T3 (SEQ ID NO: 1812) |
| T10476_P5 | T10476_T4 (SEQ ID NO: 1813) |
| T10476_P7 | T10476_T6 (SEQ ID NO: 1814) |
| T10476_P8 | T10476_T7 (SEQ ID NO: 1815) |
| T10476_P9 | T10476_T8 (SEQ ID NO: 1816); T10476_T13 (SEQ ID NO: 1817) |
| T10476_P17 | T10476_T29 (SEQ ID NO: 1820) |
| T10476_P18 | T10476_T31 (SEQ ID NO: 1821) |

Cluster T10476 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 45 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 45 and Table 1715. This cluster is overexpressed (at least at a minimum level) in the following pathological conditions: colorectal cancer.

TABLE 1715

Normal tissue distribution

| Name of Tissue | Number |
| --- | --- |
| Adrenal | 0 |
| Bladder | 0 |
| Bone | 161 |
| Brain | 53 |
| Colon | 0 |
| Epithelial | 47 |
| General | 53 |
| head and neck | 101 |
| Kidney | 2 |
| Liver | 156 |
| Lung | 99 |
| lymph nodes | 18 |
| Breast | 17 |
| bone marrow | 0 |
| Muscle | 83 |
| Ovary | 0 |
| Pancreas | 20 |
| Prostate | 38 |
| Skin | 29 |
| Stomach | 256 |
| Uterus | 4 |

TABLE 1716

P values and ratios for expression in cancerous tissue

| Name of Tissue | P1 | P2 | SP1 | R3 | SP2 | R4 |
| --- | --- | --- | --- | --- | --- | --- |
| Adrenal | 4.2e−01 | 1.9e−01 | 2.1e−01 | 3.4 | 1.5e−01 | 3.6 |
| Bladder | 5.4e−01 | 1.8e−01 | 5.6e−01 | 1.8 | 9.9e−02 | 2.9 |
| Bone | 7.0e−01 | 4.2e−01 | 8.5e−01 | 0.7 | 8.4e−01 | 0.8 |
| Brain | 6.2e−01 | 7.0e−01 | 8.7e−01 | 0.7 | 9.6e−01 | 0.5 |
| Colon | 7.0e−03 | 4.4e−03 | 8.0e−02 | 4.3 | 7.4e−02 | 4.2 |
| Epithelial | 4.9e−02 | 1.8e−02 | 4.9e−02 | 1.4 | 8.9e−02 | 1.3 |
| General | 7.1e−02 | 1.0e−02 | 1.0e−01 | 1.2 | 2.1e−01 | 1.1 |
| head and neck | 3.4e−01 | 5.0e−01 | 1 | 0.6 | 1 | 0.5 |
| Kidney | 7.1e−01 | 6.8e−01 | 3.4e−01 | 2.2 | 2.4e−01 | 2.5 |
| Liver | 5.5e−01 | 8.3e−01 | 1 | 0.3 | 9.2e−01 | 0.6 |
| Lung | 8.0e−01 | 8.5e−01 | 9.3e−01 | 0.5 | 9.9e−01 | 0.4 |
| lymph nodes | 5.1e−01 | 4.0e−01 | 2.0e−01 | 3.0 | 3.0e−01 | 2.0 |
| Breast | 2.3e−01 | 2.2e−01 | 3.5e−02 | 3.0 | 7.8e−02 | 2.4 |
| bone marrow | 1 | 6.7e−01 | 1 | 1.0 | 5.3e−01 | 1.9 |
| Muscle | 7.7e−01 | 6.7e−01 | 1 | 0.2 | 9.2e−01 | 0.5 |
| Ovary | 2.2e−01 | 1.6e−01 | 2.2e−01 | 2.9 | 2.6e−01 | 2.5 |
| Pancreas | 3.8e−01 | 3.6e−01 | 2.1e−01 | 1.7 | 1.8e−01 | 1.8 |
| Prostate | 8.9e−01 | 8.0e−01 | 6.0e−01 | 0.9 | 5.3e−01 | 1.0 |
| Skin | 5.8e−01 | 4.7e−01 | 3.7e−01 | 2.2 | 5.1e−01 | 1.0 |
| Stomach | 6.1e−01 | 7.9e−01 | 8.1e−01 | 0.4 | 1 | 0.3 |
| Uterus | 6.4e−02 | 4.4e−02 | 1.3e−01 | 3.0 | 6.9e−02 | 2.9 |

As noted above, cluster T10476 features 61 segment(s), which were listed in Table 1713 above and for which the sequence(s) are given at the end of the application. These segment(s) are portions of nucleic acid sequence(s) which are described herein separately because they are of particular interest. A description of each segment according to the present invention is now provided.

Segment cluster T10476_node__0 (SEQ ID NO:1822) according to the present invention is supported by 11 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and (SEQ ID NO:1821). Table 1717 below describes the starting and ending position of this segment on each transcript.

TABLE 1717

Segment location on transcripts

| Transcript name | Segment starting position | Segment ending position |
|---|---|---|
| T10476_T3 (SEQ ID NO: 1812) | 1 | 268 |
| T10476_T4 (SEQ ID NO: 1813) | 1 | 268 |
| T10476_T6 (SEQ ID NO: 1814) | 1 | 268 |
| T10476_T7 (SEQ ID NO: 1815) | 1 | 268 |
| T10476_T8 (SEQ ID NO: 1816) | 1 | 268 |
| T10476_T13 (SEQ ID NO: 1817) | 1 | 268 |
| T10476_T29 (SEQ ID NO: 1820) | 1 | 268 |
| T10476_T31 (SEQ ID NO: 1821) | 1 | 268 |

This segment can be found in the following protein(s): T10476_P4, T10476_P5, T10476_P7, T10476_P8, T10476_P9, T10476_P17 and T10476_P18.

Segment cluster T10476_node_3 (SEQ ID NO:1823) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1718 below describes the starting and ending position of this segment on each transcript.

TABLE 1718

Segment location on transcripts

| Transcript name | Segment starting position | Segment ending position |
|---|---|---|
| T10476_T3 (SEQ ID NO: 1812) | 269 | 409 |
| T10476_T4 (SEQ ID NO: 1813) | 269 | 409 |
| T10476_T6 (SEQ ID NO: 1814) | 269 | 409 |
| T10476_T7 (SEQ ID NO: 1815) | 269 | 409 |
| T10476_T8 (SEQ ID NO: 1816) | 269 | 409 |
| T10476_T13 (SEQ ID NO: 1817) | 269 | 409 |
| T10476_T29 (SEQ ID NO: 1820) | 269 | 409 |
| T10476_T31 (SEQ ID NO: 1821) | 269 | 409 |

This segment can be found in the following protein(s): T10476_P4, T10476_P5, T10476_P7, T10476_P8, T10476_P9, T10476_P17 and T10476_P18.

Segment cluster T10476_node_13 (SEQ ID NO:1824) according to the present invention is supported by 6 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1719 below describes the starting and ending position of this segment on each transcript.

TABLE 1719

Segment location on transcripts

| Transcript name | Segment starting position | Segment ending position |
|---|---|---|
| T10476_T3 (SEQ ID NO: 1812) | 572 | 721 |
| T10476_T4 (SEQ ID NO: 1813) | 572 | 721 |
| T10476_T6 (SEQ ID NO: 1814) | 572 | 721 |
| T10476_T7 (SEQ ID NO: 1815) | 572 | 721 |
| T10476_T8 (SEQ ID NO: 1816) | 572 | 721 |
| T10476_T13 (SEQ ID NO: 1817) | 572 | 721 |
| T10476_T29 (SEQ ID NO: 1820) | 572 | 721 |
| T10476_T31 (SEQ ID NO: 1821) | 572 | 721 |

This segment can be found in the following protein(s): T10476_P4, T10476_P5, T10476_P7, T10476_P8, T10476_P9, T10476_P17 and T10476_P18.

Segment cluster T10476_node_19 (SEQ ID NO:1825) according to the present invention is supported by 2 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T29 (SEQ ID NO:1820) and (SEQ ID NO:1821). Table 1720 below describes the starting and ending position of this segment on each transcript.

TABLE 1720

Segment location on transcripts

| Transcript name | Segment starting position | Segment ending position |
|---|---|---|
| T10476_T3 (SEQ ID NO: 1812) | 861 | 983 |
| T10476_T4 (SEQ ID NO: 1813) | 861 | 983 |
| T10476_T6 (SEQ ID NO: 1814) | 861 | 983 |
| T10476_T7 (SEQ ID NO: 1815) | 861 | 983 |
| T10476_T8 (SEQ ID NO: 1816) | 861 | 983 |
| T10476_T13 (SEQ ID NO: 1817) | 861 | 983 |
| T10476_T29 (SEQ ID NO: 1820) | 861 | 983 |
| T10476_T31 (SEQ ID NO: 1821) | 861 | 983 |

This segment can be found in the following protein(s): T10476_P4, T10476_P5, T10476_P7, T10476_P8, T10476_P9, T10476_P17 and T10476_P18.

Segment cluster T10476_node_23 (SEQ ID NO:1826) according to the present invention is supported by 3 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T29 (SEQ ID NO:1820) and (SEQ ID NO:1821). Table 1721 below describes the starting and ending position of this segment on each transcript.

TABLE 1721

Segment location on transcripts

| Transcript name | Segment starting position | Segment ending position |
|---|---|---|
| T10476_T3 (SEQ ID NO: 1812) | 1077 | 1342 |
| T10476_T4 (SEQ ID NO: 1813) | 1077 | 1342 |
| T10476_T6 (SEQ ID NO: 1814) | 1077 | 1342 |
| T10476_T7 (SEQ ID NO: 1815) | 1077 | 1342 |
| T10476_T8 (SEQ ID NO: 1816) | 1077 | 1342 |

TABLE 1721-continued

Segment location on transcripts

| Transcript name | Segment starting position | Segment ending position |
|---|---|---|
| T10476_T13 (SEQ ID NO: 1817) | 1077 | 1342 |
| T10476_T29 (SEQ ID NO: 1820) | 1077 | 1342 |
| T10476_T31 (SEQ ID NO: 1821) | 1077 | 1342 |

This segment can be found in the following protein(s): T10476_P4, T10476_P5, T10476_P7, T10476_P8, T10476_P9, T10476_P17 and T10476_P18.

Segment cluster T10476_node__25 (SEQ ID NO:1827) according to the present invention is supported by 5 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1722 below describes the starting and ending position of this segment on each transcript.

TABLE 1722

Segment location on transcripts

| Transcript name | Segment starting position | Segment ending position |
|---|---|---|
| T10476_T3 (SEQ ID NO: 1812) | 1343 | 1529 |
| T10476_T4 (SEQ ID NO: 1813) | 1343 | 1529 |
| T10476_T6 (SEQ ID NO: 1814) | 1343 | 1529 |
| T10476_T7 (SEQ ID NO: 1815) | 1343 | 1529 |
| T10476_T8 (SEQ ID NO: 1816) | 1343 | 1529 |
| T10476_T13 (SEQ ID NO: 1817) | 1343 | 1529 |
| T10476_T29 (SEQ ID NO: 1820) | 1343 | 1529 |
| T10476_T31 (SEQ ID NO: 1821) | 1343 | 1529 |

This segment can be found in the following protein(s): T10476_P4, T10476_P5, T10476_P7, T10476_P8, T10476_P9, T10476_P17 and T10476_P18.

Segment cluster T10476_node__31 (SEQ ID NO:1828) according to the present invention is supported by 12 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1723 below describes the starting and ending position of this segment on each transcript.

TABLE 1723

Segment location on transcripts

| Transcript name | Segment starting position | Segment ending position |
|---|---|---|
| T10476_T3 (SEQ ID NO: 1812) | 1685 | 1835 |
| T10476_T4 (SEQ ID NO: 1813) | 1685 | 1835 |
| T10476_T6 (SEQ ID NO: 1814) | 1685 | 1835 |
| T10476_T7 (SEQ ID NO: 1815) | 1685 | 1835 |
| T10476_T8 (SEQ ID NO: 1816) | 1685 | 1835 |
| T10476_T13 (SEQ ID NO: 1817) | 1685 | 1835 |

TABLE 1723-continued

Segment location on transcripts

| Transcript name | Segment starting position | Segment ending position |
|---|---|---|
| T10476_T29 (SEQ ID NO: 1820) | 1685 | 1835 |
| T10476_T31 (SEQ ID NO: 1821) | 1685 | 1835 |

This segment can be found in the following protein(s): T10476_P4, T10476_P5, T10476_P7, T10476_P8, T10476_P9, T10476_P17 and T10476_P18.

Segment cluster T10476_node__39 (SEQ ID NO:1829) according to the present invention is supported by 12 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1724 below describes the starting and ending position of this segment on each transcript.

TABLE 1724

Segment location on transcripts

| Transcript name | Segment starting position | Segment ending position |
|---|---|---|
| T10476_T3 (SEQ ID NO: 1812) | 2073 | 2288 |
| T10476_T4 (SEQ ID NO: 1813) | 2073 | 2288 |
| T10476_T6 (SEQ ID NO: 1814) | 2073 | 2288 |
| T10476_T7 (SEQ ID NO: 1815) | 2073 | 2288 |
| T10476_T8 (SEQ ID NO: 1816) | 2073 | 2288 |
| T10476_T13 (SEQ ID NO: 1817) | 2073 | 2288 |
| T10476_T29 (SEQ ID NO: 1820) | 2073 | 2288 |
| T10476_T31 (SEQ ID NO: 1821) | 2073 | 2288 |

This segment can be found in the following protein(s): T10476_P4, T10476_P5, T10476_P7, T10476_P8, T10476_P9, T10476_P17 and T10476_P18.

Segment cluster T10476_node__41 (SEQ ID NO:1830) according to the present invention is supported by 6 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1725 below describes the starting and ending position of this segment on each transcript.

TABLE 1725

Segment location on transcripts

| Transcript name | Segment starting position | Segment ending position |
|---|---|---|
| T10476_T3 (SEQ ID NO: 1812) | 2289 | 2446 |
| T10476_T4 (SEQ ID NO: 1813) | 2289 | 2446 |
| T10476_T6 (SEQ ID NO: 1814) | 2289 | 2446 |
| T10476_T7 (SEQ ID NO: 1815) | 2289 | 2446 |
| T10476_T8 (SEQ ID NO: 1816) | 2289 | 2446 |
| T10476_T13 (SEQ ID NO: 1817) | 2289 | 2446 |
| T10476_T29 (SEQ ID NO: 1820) | 2289 | 2446 |
| T10476_T31 (SEQ ID NO: 1821) | 2289 | 2446 |

This segment can be found in the following protein(s): T10476_P4, T10476_P5, T10476_P7, T10476_P8, T10476_P9, T10476_P17 and T10476_P18.

Segment cluster T10476_node_54 (SEQ ID NO:1831) according to the present invention is supported by 1 libraries. The number of libraries was determined as previously described. This segment can be found in the following transcript(s): T10476_T31 (SEQ ID NO:1821). Table 1726 below describes the starting and ending position of this segment on each transcript.

TABLE 1726

Segment location on transcripts

| Transcript name | Segment starting position | Segment ending position |
|---|---|---|
| T10476_T31 (SEQ ID NO: 1821) | 2811 | 3157 |

This segment can be found in the following protein(s): T10476_P18.

Segment cluster T10476_node_60 (SEQ ID NO:1832) according to the present invention is supported by 22 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1727 below describes the starting and ending position of this segment on each transcript.

TABLE 1727

Segment location on transcripts

| Transcript name | Segment starting position | Segment ending position |
|---|---|---|
| T10476_T3 (SEQ ID NO: 1812) | 3082 | 3213 |
| T10476_T4 (SEQ ID NO: 1813) | 2970 | 3101 |
| T10476_T6 (SEQ ID NO: 1814) | 2970 | 3101 |
| T10476_T7 (SEQ ID NO: 1815) | 2970 | 3101 |
| T10476_T8 (SEQ ID NO: 1816) | 2970 | 3101 |
| T10476_T13 (SEQ ID NO: 1817) | 2970 | 3101 |
| T10476_T29 (SEQ ID NO: 1820) | 2970 | 3101 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_62 (SEQ ID NO:1833) according to the present invention is supported by 27 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1728 below describes the starting and ending position of this segment on each transcript.

TABLE 1728

Segment location on transcripts

| Transcript name | Segment starting position | Segment ending position |
|---|---|---|
| T10476_T3 (SEQ ID NO: 1812) | 3214 | 3423 |
| T10476_T4 (SEQ ID NO: 1813) | 3102 | 3311 |
| T10476_T6 (SEQ ID NO: 1814) | 3102 | 3311 |
| T10476_T7 (SEQ ID NO: 1815) | 3102 | 3311 |
| T10476_T8 (SEQ ID NO: 1816) | 3102 | 3311 |
| T10476_T13 (SEQ ID NO: 1817) | 3102 | 3311 |
| T10476_T29 (SEQ ID NO: 1820) | 3102 | 3311 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_64 (SEQ ID NO:1834) according to the present invention is supported by 26 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1729 below describes the starting and ending position of this segment on each transcript.

TABLE 1729

Segment location on transcripts

| Transcript name | Segment starting position | Segment ending position |
|---|---|---|
| T10476_T3 (SEQ ID NO: 1812) | 3424 | 3560 |
| T10476_T4 (SEQ ID NO: 1813) | 3312 | 3448 |
| T10476_T6 (SEQ ID NO: 1814) | 3312 | 3448 |
| T10476_T7 (SEQ ID NO: 1815) | 3312 | 3448 |
| T10476_T8 (SEQ ID NO: 1816) | 3312 | 3448 |
| T10476_T13 (SEQ ID NO: 1817) | 3312 | 3448 |
| T10476_T29 (SEQ ID NO: 1820) | 3312 | 3448 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_68 (SEQ ID NO:1835) according to the present invention is supported by 16 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1730 below describes the starting and ending position of this segment on each transcript.

TABLE 1730

Segment location on transcripts

| Transcript name | Segment starting position | Segment ending position |
|---|---|---|
| T10476_T3 (SEQ ID NO: 1812) | 3615 | 3744 |
| T10476_T4 (SEQ ID NO: 1813) | 3503 | 3632 |
| T10476_T6 (SEQ ID NO: 1814) | 3503 | 3632 |
| T10476_T7 (SEQ ID NO: 1815) | 3503 | 3632 |
| T10476_T8 (SEQ ID NO: 1816) | 3503 | 3632 |
| T10476_T13 (SEQ ID NO: 1817) | 3503 | 3632 |
| T10476_T29 (SEQ ID NO: 1820) | 3503 | 3632 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node__73 (SEQ ID NO:1836) according to the present invention is supported by 23 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1731 below describes the starting and ending position of this segment on each transcript.

TABLE 1731

Segment location on transcripts

| Transcript name | Segment starting position | Segment ending position |
|---|---|---|
| T10476_T3 (SEQ ID NO: 1812) | 3827 | 3980 |
| T10476_T4 (SEQ ID NO: 1813) | 3715 | 3868 |
| T10476_T6 (SEQ ID NO: 1814) | 3715 | 3868 |
| T10476_T7 (SEQ ID NO: 1815) | 3715 | 3868 |
| T10476_T8 (SEQ ID NO: 1816) | 3715 | 3868 |
| T10476_T13 (SEQ ID NO: 1817) | 3715 | 3868 |
| T10476_T29 (SEQ ID NO: 1820) | 3715 | 3868 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node__74 (SEQ ID NO:1837) according to the present invention is supported by 7 libraries. The number of libraries was determined as previously described. This segment can be found in the following transcript(s): T10476_T4 (SEQ ID NO:1813). Table 1732 below describes the starting and ending position of this segment on each transcript.

TABLE 1732

Segment location on transcripts

| Transcript name | Segment starting position | Segment ending position |
|---|---|---|
| T10476_T4 (SEQ ID NO: 1813) | 3869 | 4374 |

This segment can be found in the following protein(s): T10476_P5.

Segment cluster T10476_node__78 (SEQ ID NO:1838) according to the present invention is supported by 30 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1733 below describes the starting and ending position of this segment on each transcript.

TABLE 1733

Segment location on transcripts

| Transcript name | Segment starting position | Segment ending position |
|---|---|---|
| T10476_T3 (SEQ ID NO: 1812) | 4051 | 4176 |
| T10476_T4 (SEQ ID NO: 1813) | 4445 | 4570 |
| T10476_T6 (SEQ ID NO: 1814) | 3939 | 4064 |
| T10476_T7 (SEQ ID NO: 1815) | 3939 | 4064 |
| T10476_T8 (SEQ ID NO: 1816) | 3939 | 4064 |
| T10476_T13 (SEQ ID NO: 1817) | 3939 | 4064 |
| T10476_T29 (SEQ ID NO: 1820) | 3939 | 4064 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node__80 (SEQ ID NO:1839) according to the present invention is supported by 34 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1734 below describes the starting and ending position of this segment on each transcript.

TABLE 1734

Segment location on transcripts

| Transcript name | Segment starting position | Segment ending position |
|---|---|---|
| T10476_T3 (SEQ ID NO: 1812) | 4177 | 4329 |
| T10476_T4 (SEQ ID NO: 1813) | 4571 | 4723 |
| T10476_T6 (SEQ ID NO: 1814) | 4065 | 4217 |
| T10476_T7 (SEQ ID NO: 1815) | 4065 | 4217 |
| T10476_T8 (SEQ ID NO: 1816) | 4065 | 4217 |
| T10476_T13 (SEQ ID NO: 1817) | 4065 | 4217 |
| T10476_T29 (SEQ ID NO: 1820) | 4065 | 4217 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node__90 (SEQ ID NO:1840) according to the present invention is supported by 2 libraries. The number of libraries was determined as previously described. This segment can be found in the following transcript(s): T10476_T7 (SEQ ID NO:1815). Table 1735 below describes the starting and ending position of this segment on each transcript.

TABLE 1735

Segment location on transcripts

| Transcript name | Segment starting position | Segment ending position |
|---|---|---|
| T10476_T7 (SEQ ID NO: 1815) | 4547 | 4936 |

This segment can be found in the following protein(s): T10476_P8.

Segment cluster T10476_node__91 (SEQ ID NO:1841) according to the present invention is supported by 60 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1736 below describes the starting and ending position of this segment on each transcript.

TABLE 1736

Segment location on transcripts

| Transcript name | Segment starting position | Segment ending position |
|---|---|---|
| T10476_T3 (SEQ ID NO: 1812) | 4659 | 4867 |
| T10476_T4 (SEQ ID NO: 1813) | 5053 | 5261 |
| T10476_T6 (SEQ ID NO: 1814) | 4527 | 4735 |
| T10476_T7 (SEQ ID NO: 1815) | 4937 | 5145 |
| T10476_T8 (SEQ ID NO: 1816) | 4547 | 4755 |
| T10476_T13 (SEQ ID NO: 1817) | 4547 | 4755 |
| T10476_T29 (SEQ ID NO: 1820) | 4547 | 4755 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node__98 (SEQ ID NO:1842) according to the present invention is supported by 61 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1737 below describes the starting and ending position of this segment on each transcript.

TABLE 1737

Segment location on transcripts

| Transcript name | Segment starting position | Segment ending position |
|---|---|---|
| T10476_T3 (SEQ ID NO: 1812) | 4954 | 5073 |
| T10476_T4 (SEQ ID NO: 1813) | 5348 | 5467 |
| T10476_T6 (SEQ ID NO: 1814) | 4822 | 4941 |
| T10476_T7 (SEQ ID NO: 1815) | 5232 | 5351 |
| T10476_T8 (SEQ ID NO: 1816) | 4842 | 4961 |
| T10476_T13 (SEQ ID NO: 1817) | 4842 | 4961 |
| T10476_T29 (SEQ ID NO: 1820) | 4842 | 4961 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node__103 (SEQ ID NO:1843) according to the present invention is supported by 3 libraries. The number of libraries was determined as previously described. This segment can be found in the following transcript(s): T10476_T29 (SEQ ID NO:1820). Table 1738 below describes the starting and ending position of this segment on each transcript.

TABLE 1738

Segment location on transcripts

| Transcript name | Segment starting position | Segment ending position |
|---|---|---|
| T10476_T29 (SEQ ID NO: 1820) | 5127 | 5975 |

This segment can be found in the following protein(s): T10476_P17.

Segment cluster T10476_node__106 (SEQ ID NO:1844) according to the present invention is supported by 32 libraries. The number of libraries was determined as previously described. This segment can be found in the following transcript(s): T10476_T8 (SEQ ID NO:1816) and T10476_T13 (SEQ ID NO:1817). Table 1739 below describes the starting and ending position of this segment on each transcript.

TABLE 1739

Segment location on transcripts

| Transcript name | Segment starting position | Segment ending position |
|---|---|---|
| T10476_T8 (SEQ ID NO: 1816) | 5127 | 6536 |
| T10476_T13 (SEQ ID NO: 1817) | 5127 | 6536 |

This segment can be found in the following protein(s): T10476_P9.

Segment cluster T10476_node__107 (SEQ ID NO:1845) according to the present invention is supported by 78 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816)and T10476_T13 (SEQ ID NO:1817). Table 1740 below describes the starting and ending position of this segment on each transcript.

TABLE 1740

Segment location on transcripts

| Transcript name | Segment starting position | Segment ending position |
|---|---|---|
| T10476_T3 (SEQ ID NO: 1812) | 5239 | 5401 |
| T10476_T4 (SEQ ID NO: 1813) | 5633 | 5795 |
| T10476_T6 (SEQ ID NO: 1814) | 5107 | 5269 |
| T10476_T7 (SEQ ID NO: 1815) | 5517 | 5679 |
| T10476_T8 (SEQ ID NO: 1816) | 6537 | 6699 |
| T10476_T13 (SEQ ID NO: 1817) | 6537 | 6699 |

This segment can be found in a non-coding region of transcript(s) that are related to the following protein(s): T10476_P4, T10476_P5, T10476_P7, T10476_P8 and T10476_P9.

Segment cluster T10476_node__110 (SEQ ID NO:1846) according to the present invention is supported by 6 libraries. The number of libraries was determined as previously described. This segment can be found in the following transcript(s): T10476_T26 (SEQ ID NO:1818) and T10476_T27 (SEQ ID NO:1819). Table 1741 below describes the starting and ending position of this segment on each transcript.

TABLE 1741

Segment location on transcripts

| Transcript name | Segment starting position | Segment ending position |
|---|---|---|
| T10476_T26 (SEQ ID NO: 1818) | 1 | 578 |
| T10476_T27 (SEQ ID NO: 1819) | 1 | 578 |

The previously-described transcripts for these segment(s) do not code for protein.

Segment cluster T10476_node__111 (SEQ ID NO:1847) according to the present invention is supported by 82 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T26 (SEQ ID NO:1818) and (SEQ ID NO:1819). Table 1742 below describes the starting and ending position of this segment on each transcript.

TABLE 1742

Segment location on transcripts

| Transcript name | Segment starting position | Segment ending position |
|---|---|---|
| T10476_T3 (SEQ ID NO: 1812) | 5402 | 5535 |
| T10476_T4 (SEQ ID NO: 1813) | 5796 | 5929 |
| T10476_T6 (SEQ ID NO: 1814) | 5270 | 5403 |
| T10476_T7 (SEQ ID NO: 1815) | 5680 | 5813 |
| T10476_T8 (SEQ ID NO: 1816) | 6700 | 6833 |
| T10476_T13 (SEQ ID NO: 1817) | 6712 | 6845 |
| T10476_T26 (SEQ ID NO: 1818) | 579 | 712 |
| T10476_T27 (SEQ ID NO: 1819) | 579 | 712 |

This segment can be found in a non-coding region of transcript(s) that are related to the following protein(s): T10476_P4, T10476_P5, T10476_P7, T10476_P8 and T10476_P9.

Segment cluster T10476_node__114 (SEQ ID NO:1848) according to the present invention is supported by 92 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T26 (SEQ ID NO:1818) and (SEQ ID NO:1819). Table 1743 below describes the starting and ending position of this segment on each transcript.

TABLE 1743

Segment location on transcripts

| Transcript name | Segment starting position | Segment ending position |
|---|---|---|
| T10476_T3 (SEQ ID NO: 1812) | 5536 | 5674 |
| T10476_T4 (SEQ ID NO: 1813) | 5930 | 6068 |
| T10476_T6 (SEQ ID NO: 1814) | 5404 | 5542 |
| T10476_T7 (SEQ ID NO: 1815) | 5814 | 5952 |
| T10476_T8 (SEQ ID NO: 1816) | 6834 | 6972 |
| T10476_T13 (SEQ ID NO: 1817) | 6846 | 6984 |
| T10476_T26 (SEQ ID NO: 1818) | 713 | 851 |
| T10476_T27 (SEQ ID NO: 1819) | 713 | 851 |

This segment can be found in a non-coding region of transcript(s) that are related to the following protein(s): T10476_P4, T10476_P5, T10476_P7, T10476_P8 and T10476_P9.

Segment cluster T10476_node__115 (SEQ ID NO:1849) according to the present invention is supported by 13 libraries. The number of libraries was determined as previously described. This segment can be found in the following transcript(s): T10476_T27 (SEQ ID NO:1819). Table 1744 below describes the starting and ending position of this segment on each transcript.

TABLE 1744

Segment location on transcripts

| Transcript name | Segment starting position | Segment ending position |
|---|---|---|
| T10476_T27 (SEQ ID NO: 1819) | 852 | 1362 |

The previously-described transcripts for these segment(s) do not code for protein.

Segment cluster T10476_node__117 (SEQ ID NO:1850) according to the present invention is supported by 162 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T26 (SEQ ID NO:1818) and T10476_T27 (SEQ ID NO:1819). Table 1745 below describes the starting and ending position of this segment on each transcript.

TABLE 1745

Segment location on transcripts

| Transcript name | Segment starting position | Segment ending position |
|---|---|---|
| T10476_T3 (SEQ ID NO: 1812) | 5726 | 6095 |
| T10476_T4 (SEQ ID NO: 1813) | 6120 | 6489 |
| T10476_T6 (SEQ ID NO: 1814) | 5594 | 5963 |
| T10476_T7 (SEQ ID NO: 1815) | 6004 | 6373 |
| T10476_T8 (SEQ ID NO: 1816) | 7024 | 7393 |
| T10476_T13 (SEQ ID NO: 1817) | 7036 | 7405 |
| T10476_T26 (SEQ ID NO: 1818) | 903 | 1272 |
| T10476_T27 (SEQ ID NO: 1819) | 1414 | 1783 |

This segment can be found in a non-coding region of transcript(s) that are related to the following protein(s): T10476_P4, T10476_P5, T10476_P7, T10476_P8 and T10476_P9.

Segment cluster T10476_node_118 (SEQ ID NO:1851) according to the present invention is supported by 145 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T26 (SEQ ID NO:1818) and T10476_T27 (SEQ ID NO:1819). Table 1746 below describes the starting and ending position of this segment on each transcript.

TABLE 1746

Segment location on transcripts

| Transcript name | Segment starting position | Segment ending position |
|---|---|---|
| T10476_T3 (SEQ ID NO: 1812) | 6096 | 6389 |
| T10476_T4 (SEQ ID NO: 1813) | 6490 | 6783 |
| T10476_T6 (SEQ ID NO: 1814) | 5964 | 6257 |
| T10476_T7 (SEQ ID NO: 1815) | 6374 | 6667 |
| T10476_T8 (SEQ ID NO: 1816) | 7394 | 7687 |
| T10476_T13 (SEQ ID NO: 1817) | 7406 | 7699 |
| T10476_T26 (SEQ ID NO: 1818) | 1273 | 1566 |
| T10476_T27 (SEQ ID NO: 1819) | 1784 | 2077 |

This segment can be found in a non-coding region of transcript(s) that are related to the following protein(s): T10476_P4, T10476_P5, T10476_P7, T10476_P8 and T10476_P9.

According to an optional embodiment of the present invention, short segments related to the above cluster are also provided. These segments are up to about 120 bp in length, and so are included in a separate description.

Segment cluster T10476_node_5 (SEQ ID NO:1852) according to the present invention is supported by 8 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1747 below describes the starting and ending position of this segment on each transcript.

TABLE 1747

Segment location on transcripts

| Transcript name | Segment starting position | Segment ending position |
|---|---|---|
| T10476_T3 (SEQ ID NO: 1812) | 410 | 526 |
| T10476_T4 (SEQ ID NO: 1813) | 410 | 526 |
| T10476_T6 (SEQ ID NO: 1814) | 410 | 526 |
| T10476_T7 (SEQ ID NO: 1815) | 410 | 526 |
| T10476_T8 (SEQ ID NO: 1816) | 410 | 526 |
| T10476_T13 (SEQ ID NO: 1817) | 410 | 526 |
| T10476_T29 (SEQ ID NO: 1820) | 410 | 526 |
| T10476_T31 (SEQ ID NO: 1821) | 410 | 526 |

This segment can be found in the following protein(s): T10476_P4, T10476_P5, T10476_P7, T10476_P8, T10476_P9, T10476_P17 and T10476_P18.

Segment cluster T10476_node_11 (SEQ ID NO:1853) according to the present invention is supported by 8 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1748 below describes the starting and ending position of this segment on each transcript.

TABLE 1748

Segment location on transcripts

| Transcript name | Segment starting position | Segment ending position |
|---|---|---|
| T10476_T3 (SEQ ID NO: 1812) | 527 | 571 |
| T10476_T4 (SEQ ID NO: 1813) | 527 | 571 |
| T10476_T6 (SEQ ID NO: 1814) | 527 | 571 |
| T10476_T7 (SEQ ID NO: 1815) | 527 | 571 |
| T10476_T8 (SEQ ID NO: 1816) | 527 | 571 |
| T10476_T13 (SEQ ID NO: 1817) | 527 | 571 |
| T10476_T29 (SEQ ID NO: 1820) | 527 | 571 |
| T10476_T31 (SEQ ID NO: 1821) | 527 | 571 |

This segment can be found in the following protein(s): T10476_P4, T10476_P5, T10476_P7, T10476_P8, T10476_P9, T10476_P17 and T10476_P18.

Segment cluster T10476_node_15 (SEQ ID NO:1854) according to the present invention is supported by 3 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1749 below describes the starting and ending position of this segment on each transcript.

TABLE 1749

Segment location on transcripts

| Transcript name | Segment starting position | Segment ending position |
|---|---|---|
| T10476_T3 (SEQ ID NO: 1812) | 722 | 785 |
| T10476_T4 (SEQ ID NO: 1813) | 722 | 785 |

TABLE 1749-continued

Segment location on transcripts

| Transcript name | Segment starting position | Segment ending position |
|---|---|---|
| T10476_T6 (SEQ ID NO: 1814) | 722 | 785 |
| T10476_T7 (SEQ ID NO: 1815) | 722 | 785 |
| T10476_T8 (SEQ ID NO: 1816) | 722 | 785 |
| T10476_T13 (SEQ ID NO: 1817) | 722 | 785 |
| T10476_T29 (SEQ ID NO: 1820) | 722 | 785 |
| T10476_T31 (SEQ ID NO: 1821) | 722 | 785 |

This segment can be found in the following protein(s): T10476_P4, T10476_P5, T10476_P7, T10476_P8, T10476_P9, T10476_P17 and T10476_P18.

Segment cluster T10476_node__17 (SEQ ID NO:1855) according to the present invention is supported by 3 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1750 below describes the starting and ending position of this segment on each transcript.

TABLE 1750

Segment location on transcripts

| Transcript name | Segment starting position | Segment ending position |
|---|---|---|
| T10476_T3 (SEQ ID NO: 1812) | 786 | 860 |
| T10476_T4 (SEQ ID NO: 1813) | 786 | 860 |
| T10476_T6 (SEQ ID NO: 1814) | 786 | 860 |
| T10476_T7 (SEQ ID NO: 1815) | 786 | 860 |
| T10476_T8 (SEQ ID NO: 1816) | 786 | 860 |
| T10476_T13 (SEQ ID NO: 1817) | 786 | 860 |
| T10476_T29 (SEQ ID NO: 1820) | 786 | 860 |
| T10476_T31 (SEQ ID NO: 1821) | 786 | 860 |

This segment can be found in the following protein(s): T10476_P4, T10476_P5, T10476_P7, T10476_P8, T10476_P9, T10476_P17 and T10476_P18.

Segment cluster T10476_node__21 (SEQ ID NO:1856) according to the present invention is supported by 1 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1751 below describes the starting and ending position of this segment on each transcript.

TABLE 1751

Segment location on transcripts

| Transcript name | Segment starting position | Segment ending position |
|---|---|---|
| T10476_T3 (SEQ ID NO: 1812) | 984 | 1076 |
| T10476_T4 (SEQ ID NO: 1813) | 984 | 1076 |
| T10476_T6 (SEQ ID NO: 1814) | 984 | 1076 |
| T10476_T7 (SEQ ID NO: 1815) | 984 | 1076 |

TABLE 1751-continued

Segment location on transcripts

| Transcript name | Segment starting position | Segment ending position |
|---|---|---|
| T10476_T8 (SEQ ID NO: 1816) | 984 | 1076 |
| T10476_T13 (SEQ ID NO: 1817) | 984 | 1076 |
| T10476_T29 (SEQ ID NO: 1820) | 984 | 1076 |
| T10476_T31 (SEQ ID NO: 1821) | 984 | 1076 |

This segment can be found in the following protein(s): T10476_P4, T10476_P5, T10476_P7, T10476_P8, T10476_P9, T10476_P17 and T10476_P18.

Segment cluster T10476_node__27 (SEQ ID NO:1857) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1752 below describes the starting and ending position of this segment on each transcript.

TABLE 1752

Segment location on transcripts

| Transcript name | Segment starting position | Segment ending position |
|---|---|---|
| T10476_T3 (SEQ ID NO: 1812) | 1530 | 1619 |
| T10476_T4 (SEQ ID NO: 1813) | 1530 | 1619 |
| T10476_T6 (SEQ ID NO: 1814) | 1530 | 1619 |
| T10476_T7 (SEQ ID NO: 1815) | 1530 | 1619 |
| T10476_T8 (SEQ ID NO: 1816) | 1530 | 1619 |
| T10476_T13 (SEQ ID NO: 1817) | 1530 | 1619 |
| T10476_T29 (SEQ ID NO: 1820) | 1530 | 1619 |
| T10476_T31 (SEQ ID NO: 1821) | 1530 | 1619 |

This segment can be found in the following protein(s): T10476_P4, T10476_P5, T10476_P7, T10476_P8, T10476_P9, T10476_P17 and T10476_P18.

Segment cluster T10476_node__29 (SEQ ID NO:1858) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1753 below describes the starting and ending position of this segment on each transcript.

TABLE 1753

Segment location on transcripts

| Transcript name | Segment starting position | Segment ending position |
|---|---|---|
| T10476_T3 (SEQ ID NO: 1812) | 1620 | 1684 |
| T10476_T4 (SEQ ID NO: 1813) | 1620 | 1684 |
| T10476_T6 (SEQ ID NO: 1814) | 1620 | 1684 |
| T10476_T7 (SEQ ID NO: 1815) | 1620 | 1684 |
| T10476_T8 (SEQ ID NO: 1816) | 1620 | 1684 |
| T10476_T13 (SEQ ID NO: 1817) | 1620 | 1684 |

TABLE 1753-continued

Segment location on transcripts

| Transcript name | Segment starting position | Segment ending position |
|---|---|---|
| T10476_T29 (SEQ ID NO: 1820) | 1620 | 1684 |
| T10476_T31 (SEQ ID NO: 1821) | 1620 | 1684 |

This segment can be found in the following protein(s): T10476_P4, T10476_P5, T10476_P7, T10476_P8, T10476_P9, T10476_P17 and T10476_P18.

Segment cluster T10476_node__33 (SEQ ID NO:1859) according to the present invention is supported by 8 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1754 below describes the starting and ending position of this segment on each transcript.

TABLE 1754

Segment location on transcripts

| Transcript name | Segment starting position | Segment ending position |
|---|---|---|
| T10476_T3 (SEQ ID NO: 1812) | 1836 | 1934 |
| T10476_T4 (SEQ ID NO: 1813) | 1836 | 1934 |
| T10476_T6 (SEQ ID NO: 1814) | 1836 | 1934 |
| T10476_T7 (SEQ ID NO: 1815) | 1836 | 1934 |
| T10476_T8 (SEQ ID NO: 1816) | 1836 | 1934 |
| T10476_T13 (SEQ ID NO: 1817) | 1836 | 1934 |
| T10476_T29 (SEQ ID NO: 1820) | 1836 | 1934 |
| T10476_T31 (SEQ ID NO: 1821) | 1836 | 1934 |

This segment can be found in the following protein(s): T10476_P4, T10476_P5, T10476_P7, T10476_P8, T10476_P9, T10476_P17 and T10476_P18.

Segment cluster T10476_node__35 (SEQ ID NO:1860) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1755 below describes the starting and ending position of this segment on each transcript.

TABLE 1755

Segment location on transcripts

| Transcript name | Segment starting position | Segment ending position |
|---|---|---|
| T10476_T3 (SEQ ID NO: 1812) | 1935 | 2004 |
| T10476_T4 (SEQ ID NO: 1813) | 1935 | 2004 |
| T10476_T6 (SEQ ID NO: 1814) | 1935 | 2004 |
| T10476_T7 (SEQ ID NO: 1815) | 1935 | 2004 |
| T10476_T8 (SEQ ID NO: 1816) | 1935 | 2004 |
| T10476_T13 (SEQ ID NO: 1817) | 1935 | 2004 |
| T10476_T29 (SEQ ID NO: 1820) | 1935 | 2004 |
| T10476_T31 (SEQ ID NO: 1821) | 1935 | 2004 |

This segment can be found in the following protein(s): T10476_P4, T10476_P5, T10476_P7, T10476_P8, T10476_P9, T10476_P17 and T10476_P18.

Segment cluster T10476_node__37 (SEQ ID NO:1861) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T29 (SEQ ID NO:1820) and (SEQ ID NO:1821). Table 1756 below describes the starting and ending position of this segment on each transcript.

TABLE 1756

Segment location on transcripts

| Transcript name | Segment starting position | Segment ending position |
|---|---|---|
| T10476_T3 (SEQ ID NO: 1812) | 2005 | 2072 |
| T10476_T4 (SEQ ID NO: 1813) | 2005 | 2072 |
| T10476_T6 (SEQ ID NO: 1814) | 2005 | 2072 |
| T10476_T7 (SEQ ID NO: 1815) | 2005 | 2072 |
| T10476_T8 (SEQ ID NO: 1816) | 2005 | 2072 |
| T10476_T13 (SEQ ID NO: 1817) | 2005 | 2072 |
| T10476_T29 (SEQ ID NO: 1820) | 2005 | 2072 |
| T10476_T31 (SEQ ID NO: 1821) | 2005 | 2072 |

This segment can be found in the following protein(s): T10476_P4, T10476_P5, T10476_P7, T10476_P8, T10476_P9, T10476_P17 and T10476_P18.

Segment cluster T10476_node__43 (SEQ ID NO:1862) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1757 below describes the starting and ending position of this segment on each transcript.

TABLE 1757

Segment location on transcripts

| Transcript name | Segment starting position | Segment ending position |
|---|---|---|
| T10476_T3 (SEQ ID NO: 1812) | 2447 | 2542 |
| T10476_T4 (SEQ ID NO: 1813) | 2447 | 2542 |
| T10476_T6 (SEQ ID NO: 1814) | 2447 | 2542 |
| T10476_T7 (SEQ ID NO: 1815) | 2447 | 2542 |
| T10476_T8 (SEQ ID NO: 1816) | 2447 | 2542 |
| T10476_T13 (SEQ ID NO: 1817) | 2447 | 2542 |
| T10476_T29 (SEQ ID NO: 1820) | 2447 | 2542 |
| T10476_T31 (SEQ ID NO: 1821) | 2447 | 2542 |

This segment can be found in the following protein(s): T10476_P4, T10476_P5, T10476_P7, T10476_P8, T10476_P9, T10476_P17 and T10476_P18.

Segment cluster T10476_node__47 (SEQ ID NO:1863) according to the present invention is supported by 9 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1758 below describes the starting and ending position of this segment on each transcript.

TABLE 1758

Segment location on transcripts

| Transcript name | Segment starting position | Segment ending position |
| --- | --- | --- |
| T10476_T3 (SEQ ID NO: 1812) | 2543 | 2598 |
| T10476_T4 (SEQ ID NO: 1813) | 2543 | 2598 |
| T10476_T6 (SEQ ID NO: 1814) | 2543 | 2598 |
| T10476_T7 (SEQ ID NO: 1815) | 2543 | 2598 |
| T10476_T8 (SEQ ID NO: 1816) | 2543 | 2598 |
| T10476_T13 (SEQ ID NO: 1817) | 2543 | 2598 |
| T10476_T29 (SEQ ID NO: 1820) | 2543 | 2598 |
| T10476_T31 (SEQ ID NO: 1821) | 2543 | 2598 |

This segment can be found in the following protein(s): T10476_P4, T10476_P5, T10476_P7, T10476_P8, T10476_P9, T10476_P17 and T10476_P18.

Segment cluster T10476_node__49 (SEQ ID NO:1864) according to the present invention is supported by 13 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), (SEQ ID NO:1817), T10476_T29 (SEQ ID NO:1820) and (SEQ ID NO:1821). Table 1759 below describes the starting and ending position of this segment on each transcript.

TABLE 1759

Segment location on transcripts

| Transcript name | Segment starting position | Segment ending position |
| --- | --- | --- |
| T10476_T3 (SEQ ID NO: 1812) | 2599 | 2655 |
| T10476_T4 (SEQ ID NO: 1813) | 2599 | 2655 |
| T10476_T6 (SEQ ID NO: 1814) | 2599 | 2655 |
| T10476_T7 (SEQ ID NO: 1815) | 2599 | 2655 |
| T10476_T8 (SEQ ID NO: 1816) | 2599 | 2655 |
| T10476_T13 (SEQ ID NO: 1817) | 2599 | 2655 |
| T10476_T29 (SEQ ID NO: 1820) | 2599 | 2655 |
| T10476_T31 (SEQ ID NO: 1821) | 2599 | 2655 |

This segment can be found in the following protein(s): T10476_P4, T10476_P5, T10476_P7, T10476_P8, T10476_P9, T10476_P17 and T10476_P18.

Segment cluster T10476_node__51 (SEQ ID NO:1865) according to the present invention is supported by 12 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1760 below describes the starting and ending position of this segment on each transcript.

TABLE 1760

Segment location on transcripts

| Transcript name | Segment starting position | Segment ending position |
| --- | --- | --- |
| T10476_T3 (SEQ ID NO: 1812) | 2656 | 2711 |
| T10476_T4 (SEQ ID NO: 1813) | 2656 | 2711 |
| T10476_T6 (SEQ ID NO: 1814) | 2656 | 2711 |
| T10476_T7 (SEQ ID NO: 1815) | 2656 | 2711 |
| T10476_T8 (SEQ ID NO: 1816) | 2656 | 2711 |
| T10476_T13 (SEQ ID NO: 1817) | 2656 | 2711 |
| T10476_T29 (SEQ ID NO: 1820) | 2656 | 2711 |
| T10476_T31 (SEQ ID NO: 1821) | 2656 | 2711 |

This segment can be found in the following protein(s): T10476_P4, T10476_P5, T10476_P7, T10476_P8, T10476_P9, T10476_P17 and T10476_P18.

Segment cluster T10476_node__53 (SEQ ID NO:1866) according to the present invention is supported by 18 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T29 (SEQ ID NO:1820) and T10476_T31 (SEQ ID NO:1821). Table 1761 below describes the starting and ending position of this segment on each transcript.

TABLE 1761

Segment location on transcripts

| Transcript name | Segment starting position | Segment ending position |
| --- | --- | --- |
| T10476_T3 (SEQ ID NO: 1812) | 2712 | 2810 |
| T10476_T4 (SEQ ID NO: 1813) | 2712 | 2810 |
| T10476_T6 (SEQ ID NO: 1814) | 2712 | 2810 |
| T10476_T7 (SEQ ID NO: 1815) | 2712 | 2810 |
| T10476_T8 (SEQ ID NO: 1816) | 2712 | 2810 |
| T10476_T13 (SEQ ID NO: 1817) | 2712 | 2810 |
| T10476_T29 (SEQ ID NO: 1820) | 2712 | 2810 |
| T10476_T31 (SEQ ID NO: 1821) | 2712 | 2810 |

This segment can be found in the following protein(s): T10476_P4, T10476_P5, T10476_P7, T10476_P8, T10476_P9, T10476_P17 and T10476_P18.

Segment cluster T10476_node__56 (SEQ ID NO:1867) according to the present invention is supported by 16 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1762 below describes the starting and ending position of this segment on each transcript.

TABLE 1762

Segment location on transcripts

| Transcript name | Segment starting position | Segment ending position |
|---|---|---|
| T10476_T3 (SEQ ID NO: 1812) | 2811 | 2873 |
| T10476_T4 (SEQ ID NO: 1813) | 2811 | 2873 |
| T10476_T6 (SEQ ID NO: 1814) | 2811 | 2873 |
| T10476_T7 (SEQ ID NO: 1815) | 2811 | 2873 |
| T10476_T8 (SEQ ID NO: 1816) | 2811 | 2873 |
| T10476_T13 (SEQ ID NO: 1817) | 2811 | 2873 |
| T10476_T29 (SEQ ID NO: 1820) | 2811 | 2873 |

This segment can be found in the following protein(s): T10476_P4, T10476_P5, T10476_P7, T10476_P8, T10476_P9 and T10476_P17.

Segment cluster T10476_node_57 (SEQ ID NO:1868) according to the present invention is supported by 1 libraries. The number of libraries was determined as previously described. This segment can be found in the following transcript(s): T10476_T3 (SEQ ID NO:1812). Table 1763 below describes the starting and ending position of this segment on each transcript.

TABLE 1763

Segment location on transcripts

| Transcript name | Segment starting position | Segment ending position |
|---|---|---|
| T10476_T3 (SEQ ID NO: 1812) | 2874 | 2985 |

This segment can be found in the following protein(s): T10476_P4.

Segment cluster T10476_node_58 (SEQ ID NO:1869) according to the present invention is supported by 18 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1764 below describes the starting and ending position of this segment on each transcript.

TABLE 1764

Segment location on transcripts

| Transcript name | Segment starting position | Segment ending position |
|---|---|---|
| T10476_T3 (SEQ ID NO: 1812) | 2986 | 3081 |
| T10476_T4 (SEQ ID NO: 1813) | 2874 | 2969 |
| T10476_T6 (SEQ ID NO: 1814) | 2874 | 2969 |
| T10476_T7 (SEQ ID NO: 1815) | 2874 | 2969 |
| T10476_T8 (SEQ ID NO: 1816) | 2874 | 2969 |
| T10476_T13 (SEQ ID NO: 1817) | 2874 | 2969 |
| T10476_T29 (SEQ ID NO: 1820) | 2874 | 2969 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_66 (SEQ ID NO:1870) according to the present invention is supported by 15 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1765 below describes the starting and ending position of this segment on each transcript.

TABLE 1765

Segment location on transcripts

| Transcript name | Segment starting position | Segment ending position |
|---|---|---|
| T10476_T3 (SEQ ID NO: 1812) | 3561 | 3614 |
| T10476_T4 (SEQ ID NO: 1813) | 3449 | 3502 |
| T10476_T6 (SEQ ID NO: 1814) | 3449 | 3502 |
| T10476_T7 (SEQ ID NO: 1815) | 3449 | 3502 |
| T10476_T8 (SEQ ID NO: 1816) | 3449 | 3502 |
| T10476_T13 (SEQ ID NO: 1817) | 3449 | 3502 |
| T10476_T29 (SEQ ID NO: 1820) | 3449 | 3502 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_71 (SEQ ID NO:1871) according to the present invention is supported by 17 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1766 below describes the starting and ending position of this segment on each transcript.

TABLE 1766

Segment location on transcripts

| Transcript name | Segment starting position | Segment ending position |
|---|---|---|
| T10476_T3 (SEQ ID NO: 1812) | 3745 | 3826 |
| T10476_T4 (SEQ ID NO: 1813) | 3633 | 3714 |
| T10476_T6 (SEQ ID NO: 1814) | 3633 | 3714 |
| T10476_T7 (SEQ ID NO: 1815) | 3633 | 3714 |
| T10476_T8 (SEQ ID NO: 1816) | 3633 | 3714 |
| T10476_T13 (SEQ ID NO: 1817) | 3633 | 3714 |
| T10476_T29 (SEQ ID NO: 1820) | 3633 | 3714 |

This segment can be found in both coding and non-coding regions of transcript(s) as follows. The segment can be found in a non-coding region of transcript(s) that are related to the following protein(s): T10476_P4. This segment can also be found in the following protein(s): T10476_P5, T10476_P7, T10476_P8, T10476_P9 and T10476_P17, since it is in the coding region for the corresponding transcript.

Segment cluster T10476_node_75 (SEQ ID NO:1872) according to the present invention is supported by 34 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1767 below describes the starting and ending position of this segment on each transcript.

TABLE 1767

Segment location on transcripts

| Transcript name | Segment starting position | Segment ending position |
|---|---|---|
| T10476_T3 (SEQ ID NO: 1812) | 3981 | 4050 |
| T10476_T4 (SEQ ID NO: 1813) | 4375 | 4444 |
| T10476_T6 (SEQ ID NO: 1814) | 3869 | 3938 |
| T10476_T7 (SEQ ID NO: 1815) | 3869 | 3938 |
| T10476_T8 (SEQ ID NO: 1816) | 3869 | 3938 |
| T10476_T13 (SEQ ID NO: 1817) | 3869 | 3938 |
| T10476_T29 (SEQ ID NO: 1820) | 3869 | 3938 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node__83 (SEQ ID NO:1873) according to the present invention is supported by 37 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1768 below describes the starting and ending position of this segment on each transcript.

TABLE 1768

Segment location on transcripts

| Transcript name | Segment starting position | Segment ending position |
|---|---|---|
| T10476_T3 (SEQ ID NO: 1812) | 4330 | 4434 |
| T10476_T4 (SEQ ID NO: 1813) | 4724 | 4828 |
| T10476_T6 (SEQ ID NO: 1814) | 4218 | 4322 |
| T10476_T7 (SEQ ID NO: 1815) | 4218 | 4322 |
| T10476_T8 (SEQ ID NO: 1816) | 4218 | 4322 |
| T10476_T13 (SEQ ID NO: 1817) | 4218 | 4322 |
| T10476_T29 (SEQ ID NO: 1820) | 4218 | 4322 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node__85 (SEQ ID NO:1874) according to the present invention is supported by 40 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1769 below describes the starting and ending position of this segment on each transcript.

TABLE 1769

Segment location on transcripts

| Transcript name | Segment starting position | Segment ending position |
|---|---|---|
| T10476_T3 (SEQ ID NO: 1812) | 4435 | 4526 |
| T10476_T4 (SEQ ID NO: 1813) | 4829 | 4920 |
| T10476_T6 (SEQ ID NO: 1814) | 4323 | 4414 |
| T10476_T7 (SEQ ID NO: 1815) | 4323 | 4414 |
| T10476_T8 (SEQ ID NO: 1816) | 4323 | 4414 |
| T10476_T13 (SEQ ID NO: 1817) | 4323 | 4414 |
| T10476_T29 (SEQ ID NO: 1820) | 4323 | 4414 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node__88 (SEQ ID NO:1875) according to the present invention can be found in the following transcript(s): T10476_T3 (SEQ ID NO:1812), T10476_T4 (SEQ ID NO:1813), T10476_T7 (SEQ ID NO:1815), T10476_T8 (SEQ ID NO:1816), T10476_T13 (SEQ ID NO:1817) and T10476_T29 (SEQ ID NO:1820). Table 1770 below describes the starting and ending position of this segment on each transcript.

TABLE 1770

Segment location on transcripts

| Transcript name | Segment starting position | Segment ending position |
|---|---|---|
| T10476_T3 (SEQ ID NO: 1812) | 4527 | 4546 |
| T10476_T4 (SEQ ID NO: 1813) | 4921 | 4940 |
| T10476_T7 (SEQ ID NO: 1815) | 4415 | 4434 |
| T10476_T8 (SEQ ID NO: 1816) | 4415 | 4434 |
| T10476_T13 (SEQ ID NO: 1817) | 4415 | 4434 |
| T10476_T29 (SEQ ID NO: 1820) | 4415 | 4434 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P8, T10476_P9 and T10476_P17, since it is in the coding region for the corresponding transcript.

Segment cluster T10476_node__89 (SEQ ID NO:1876) according to the present invention is supported by 45 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1771 below describes the starting and ending position of this segment on each transcript.

TABLE 1771

Segment location on transcripts

| Transcript name | Segment starting position | Segment ending position |
|---|---|---|
| T10476_T3 (SEQ ID NO: 1812) | 4547 | 4658 |
| T10476_T4 (SEQ ID NO: 1813) | 4941 | 5052 |
| T10476_T6 (SEQ ID NO: 1814) | 4415 | 4526 |
| T10476_T7 (SEQ ID NO: 1815) | 4435 | 4546 |
| T10476_T8 (SEQ ID NO: 1816) | 4435 | 4546 |
| T10476_T13 (SEQ ID NO: 1817) | 4435 | 4546 |
| T10476_T29 (SEQ ID NO: 1820) | 4435 | 4546 |

This segment can be found in both coding and non-coding regions of transcript(s) as follows. The segment can be found in a non-coding region of transcript(s) that are related to the following protein(s): T10476_P4 and T10476_P5. This segment can also be found in the following protein(s): T10476_P7, T10476_P8, T10476_P9 and T10476_P17, since it is in the coding region for the corresponding transcript.

Segment cluster T10476_node_94 (SEQ ID NO:1877) according to the present invention is supported by 56 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1772 below describes the starting and ending position of this segment on each transcript.

TABLE 1772

Segment location on transcripts

| Transcript name | Segment starting position | Segment ending position |
|---|---|---|
| T10476_T3 (SEQ ID NO: 1812) | 4868 | 4953 |
| T10476_T4 (SEQ ID NO: 1813) | 5262 | 5347 |
| T10476_T6 (SEQ ID NO: 1814) | 4736 | 4821 |
| T10476_T7 (SEQ ID NO: 1815) | 5146 | 5231 |
| T10476_T8 (SEQ ID NO: 1816) | 4756 | 4841 |
| T10476_T13 (SEQ ID NO: 1817) | 4756 | 4841 |
| T10476_T29 (SEQ ID NO: 1820) | 4756 | 4841 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node_99 (SEQ ID NO:1878) according to the present invention can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1773 below describes the starting and ending position of this segment on each transcript.

TABLE 1773

Segment location on transcripts

| Transcript name | Segment starting position | Segment ending position |
|---|---|---|
| T10476_T3 (SEQ ID NO: 1812) | 5074 | 5082 |
| T10476_T4 (SEQ ID NO: 1813) | 5468 | 5476 |
| T10476_T6 (SEQ ID NO: 1814) | 4942 | 4950 |
| T10476_T7 (SEQ ID NO: 1815) | 5352 | 5360 |
| T10476_T8 (SEQ ID NO: 1816) | 4962 | 4970 |
| T10476_T13 (SEQ ID NO: 1817) | 4962 | 4970 |
| T10476_T29 (SEQ ID NO: 1820) | 4962 | 4970 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node_101 (SEQ ID NO:1879) according to the present invention is supported by 54 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1774 below describes the starting and ending position of this segment on each transcript.

TABLE 1774

Segment location on transcripts

| Transcript name | Segment starting position | Segment ending position |
|---|---|---|
| T10476_T3 (SEQ ID NO: 1812) | 5083 | 5126 |
| T10476_T4 (SEQ ID NO: 1813) | 5477 | 5520 |
| T10476_T6 (SEQ ID NO: 1814) | 4951 | 4994 |
| T10476_T7 (SEQ ID NO: 1815) | 5361 | 5404 |
| T10476_T8 (SEQ ID NO: 1816) | 4971 | 5014 |
| T10476_T13 (SEQ ID NO: 1817) | 4971 | 5014 |
| T10476_T29 (SEQ ID NO: 1820) | 4971 | 5014 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node_102 (SEQ ID NO:1880) according to the present invention is supported by 60 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817) and T10476_T29 (SEQ ID NO:1820). Table 1775 below describes the starting and ending position of this segment on each transcript.

TABLE 1775

Segment location on transcripts

| Transcript name | Segment starting position | Segment ending position |
|---|---|---|
| T10476_T3 (SEQ ID NO: 1812) | 5127 | 5238 |
| T10476_T4 (SEQ ID NO: 1813) | 5521 | 5632 |
| T10476_T6 (SEQ ID NO: 1814) | 4995 | 5106 |
| T10476_T7 (SEQ ID NO: 1815) | 5405 | 5516 |
| T10476_T8 (SEQ ID NO: 1816) | 5015 | 5126 |
| T10476_T13 (SEQ ID NO: 1817) | 5015 | 5126 |
| T10476_T29 (SEQ ID NO: 1820) | 5015 | 5126 |

This segment can be found in both coding and non-coding regions of transcript(s) as follows. The segment can be found in a non-coding region of transcript(s) that are related to the following protein(s): T10476_P4, T10476_P5, T10476_P7 and T10476_P8. This segment can also be found in the following protein(s): T10476_P9 and T10476_P17, since it is in the coding region for the corresponding transcript.

Segment cluster T10476_node_108 (SEQ ID NO:1881) according to the present invention can be found in the following transcript(s): T10476_T13 (SEQ ID NO:1817). Table 1776 below describes the starting and ending position of this segment on each transcript.

TABLE 1776

Segment location on transcripts

| Transcript name | Segment starting position | Segment ending position |
|---|---|---|
| T10476_T13 (SEQ ID NO: 1817) | 6700 | 6711 |

This segment can be found in a non-coding region of transcript(s) that are related to the following protein(s): T10476_P9.

Segment cluster T10476_node_116 (SEQ ID NO:1882) according to the present invention is supported by 84 libraries. The number of libraries was determined as previously described. This segment can be found in the following transcript(s): T10476_T3 (SEQ ID NO:1812), T10476_T4 (SEQ ID NO:1813), T10476_T6 (SEQ ID NO:1814), T10476_T7 (SEQ ID NO:1815), T10476_T8 (SEQ ID NO:1816), T10476_T13 (SEQ ID NO:1817), T10476_T26 (SEQ ID NO:1818) and T10476_T27 (SEQ ID NO:1819). Table 1777 below describes the starting and ending position of this segment on each transcript.

TABLE 1777

Segment location on transcripts

| Transcript name | Segment starting position | Segment ending position |
|---|---|---|
| T10476_T3 (SEQ ID NO: 1812) | 5675 | 5725 |
| T10476_T4 (SEQ ID NO: 1813) | 6069 | 6119 |
| T10476_T6 (SEQ ID NO: 1814) | 5543 | 5593 |
| T10476_T7 (SEQ ID NO: 1815) | 5953 | 6003 |
| T10476_T8 (SEQ ID NO: 1816) | 6973 | 7023 |
| T10476_T13 (SEQ ID NO: 1817) | 6985 | 7035 |
| T10476_T26 (SEQ ID NO: 1818) | 852 | 902 |
| T10476_T27 (SEQ ID NO: 1819) | 1363 | 1413 |

This segment can be found in a non-coding region of transcript(s) that are related to the following protein(s): T10476_P4, T10476_P5, T10476_P7, T10476_P8 and T10476_P9.

Description for Cluster T49823

Cluster T49823 features 2 transcript(s) and 25 segment(s) of interest, the names for which are given in Tables 1778 and 1779, respectively, the sequences themselves are given at the end of the application. The selected protein variants are given in Table 1780

TABLE 1778

Transcripts of interest
Transcript Name

T49823_T41 (SEQ ID NO: 1883)
T49823_T62 (SEQ ID NO: 1884)

TABLE 1779

Segments of interest
Segment Name

T49823_node_11 (SEQ ID NO: 1885)
T49823_node_20 (SEQ ID NO: 1886)
T49823_node_26 (SEQ ID NO: 1887)
T49823_node_30 (SEQ ID NO: 1888)
T49823_node_35 (SEQ ID NO: 1889)
T49823_node_38 (SEQ ID NO: 1890)
T49823_node_56 (SEQ ID NO: 1891)
T49823_node_57 (SEQ ID NO: 1892)
T49823_node_4 (SEQ ID NO: 1893)
T49823_node_12 (SEQ ID NO: 1894)
T49823_node_13 (SEQ ID NO: 1895)
T49823_node_16 (SEQ ID NO: 1896)
T49823_node_17 (SEQ ID NO: 1897)
T49823_node_19 (SEQ ID NO: 1898)
T49823_node_21 (SEQ ID NO: 1899)
T49823_node_22 (SEQ ID NO: 1900)
T49823_node_28 (SEQ ID NO: 1901)
T49823_node_31 (SEQ ID NO: 1902)
T49823_node_37 (SEQ ID NO: 1903)
T49823_node_40 (SEQ ID NO: 1904)
T49823_node_41 (SEQ ID NO: 1905)
T49823_node_44 (SEQ ID NO: 1906)
T49823_node_45 (SEQ ID NO: 1907)
T49823_node_50 (SEQ ID NO: 1908)
T49823_node_58 (SEQ ID NO: 1909)

TABLE 1780

Proteins of interest

| Protein Name | Corresponding Transcript(s) |
|---|---|
| T49823_P6 | T49823_T41 (SEQ ID NO: 1883) |
| T49823_P34 | T49823_T62 (SEQ ID NO: 1884) |

Cluster T49823 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 46 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 46 and Table 1781. This cluster is overexpressed (at least at a minimum level) in the following pathological conditions: epithelial malignant tumors and skin malignancies.

TABLE 4

Normal tissue distribution

| Name of Tissue | Number |
|---|---|
| Bone | 0 |
| Brain | 18 |
| Colon | 0 |
| Epithelial | 3 |
| general | 12 |
| kidney | 47 |
| liver | 0 |
| lung | 0 |
| lymph nodes | 18 |
| breast | 0 |
| muscle | 0 |
| pancreas | 10 |
| prostate | 0 |
| skin | 0 |
| stomach | 0 |
| T cells | 0 |
| uterus | 0 |

TABLE 1781

P values and ratios for expression in cancerous tissue

| Name of Tissue | P1 | P2 | SP1 | R3 | SP2 | R4 |
|---|---|---|---|---|---|---|
| bone | 3.3e−01 | 4.3e−01 | 1 | 1.3 | 7.0e−01 | 1.5 |
| brain | 8.2e−01 | 8.5e−01 | 8.2e−01 | 0.8 | 9.4e−01 | 0.5 |
| colon | 5.4e−01 | 6.2e−01 | 1 | 1.1 | 1 | 1.1 |
| epithelial | 2.6e−03 | 3.1e−04 | 6.9e−03 | 3.8 | 1.2e−05 | 5.3 |
| general | 1.2e−01 | 4.9e−02 | 6.0e−02 | 1.6 | 1.9e−04 | 1.9 |
| kidney | 8.5e−01 | 8.9e−01 | 1 | 0.3 | 9.7e−01 | 0.5 |
| liver | 1.8e−01 | 1.9e−01 | 1 | 1.3 | 2.6e−02 | 2.4 |
| lung | 2.4e−01 | 1.5e−01 | 4.1e−01 | 3.0 | 2.4e−01 | 3.1 |
| lymph nodes | 5.1e−01 | 4.0e−01 | 1 | 0.8 | 1 | 0.7 |
| breast | 1.9e−01 | 2.8e−01 | 4.7e−01 | 2.0 | 6.8e−01 | 1.5 |
| muscle | 1 | 2.9e−01 | 1 | 1.0 | 2.3e−02 | 4.1 |
| pancreas | 2.6e−01 | 4.1e−01 | 3.9e−01 | 1.9 | 5.4e−01 | 1.4 |
| prostate | 5.3e−01 | 3.5e−01 | 6.7e−01 | 1.6 | 5.6e−01 | 1.8 |
| skin | 2.3e−01 | 6.9e−02 | 1.4e−01 | 7.0 | 2.0e−03 | 3.8 |
| stomach | 3.0e−01 | 4.3e−01 | 5.0e−01 | 2.0 | 5.1e−01 | 1.8 |
| T cells | 1 | 6.7e−01 | 1 | 1.0 | 7.2e−01 | 1.4 |
| uterus | 2.1e−01 | 8.2e−02 | 1.9e−01 | 2.5 | 2.6e−01 | 2.3 |

As noted above, cluster T49823 features 25 segment(s), which were listed in Table 1779 above and for which the sequence(s) are given at the end of the application. These segment(s) are portions of nucleic acid sequence(s) which are described herein separately because they are of particular interest. A description of each segment according to the present invention is now provided.

Segment cluster T49823_node_11 (SEQ ID NO:1885) according to the present invention is supported by 52 libraries. The number of libraries was determined as previously described. This segment can be found in the following transcript(s): T49823_T41 (SEQ ID NO:1883) and T49823_T62 (SEQ ID NO:1884). Table 1783 below describes the starting and ending position of this segment on each transcript.

TABLE 1782

Segment location on transcripts

| Transcript name | Segment starting position | Segment ending position |
|---|---|---|
| T49823_T41 (SEQ ID NO: 1883) | 85 | 223 |
| T49823_T62 (SEQ ID NO: 1884) | 85 | 223 |

This segment can be found in the following protein(s): T49823_P6 and T49823_P34.

Segment cluster T49823_node_20 (SEQ ID NO:1886) according to the present invention is supported by 58 libraries. The number of libraries was determined as previously described. This segment can be found in the following transcript(s): T49823_T41 (SEQ ID NO:1883) and T49823_T62 (SEQ ID NO:1884). Table 1784 below describes the starting and ending position of this segment on each transcript.

TABLE 1783

Segment location on transcripts

| Transcript name | Segment starting position | Segment ending position |
|---|---|---|
| T49823_T41 (SEQ ID NO: 1883) | 340 | 480 |
| T49823_T62 (SEQ ID NO: 1884) | 362 | 502 |

This segment can be found in both coding and non-coding regions of transcript(s) as follows. The segment can be found in a non-coding region of transcript(s) that are related to the following protein(s): T49823_P34. This segment can also be found in the following protein(s): T49823_P6, since it is in the coding region for the corresponding transcript.

Segment cluster T49823_node_26 (SEQ ID NO:1887) according to the present invention is supported by 1 libraries. The number of libraries was determined as previously described. This segment can be found in the following transcript(s): T49823_T62 (SEQ ID NO:1884). Table 1785 below describes the starting and ending position of this segment on each transcript.

TABLE 1784

Segment location on transcripts

| Transcript name | Segment starting position | Segment ending position |
|---|---|---|
| T49823_T62 (SEQ ID NO: 1884) | 538 | 658 |

This segment can be found in a non-coding region of transcript(s) that are related to the following protein(s): T49823_P34.

Segment cluster T49823_node_30 (SEQ ID NO:1888) according to the present invention is supported by 59 libraries. The number of libraries was determined as previously described. This segment can be found in the following transcript(s): T49823_T41 (SEQ ID NO:1883). Table 1786 below describes the starting and ending position of this segment on each transcript.

TABLE 1785

Segment location on transcripts

| Transcript name | Segment starting position | Segment ending position |
|---|---|---|
| T49823_T41 (SEQ ID NO: 1883) | 633 | 767 |

This segment can be found in the following protein(s): T49823_P6.

Segment cluster T49823_node_35 (SEQ ID NO:1889) according to the present invention is supported by 57 libraries. The number of libraries was determined as previously described. This segment can be found in the following transcript(s): T49823_T41 (SEQ ID NO:1883). Table 1787 below describes the starting and ending position of this segment on each transcript.

TABLE 1786

Segment location on transcripts

| Transcript name | Segment starting position | Segment ending position |
|---|---|---|
| T49823_T41 (SEQ ID NO: 1883) | 809 | 1048 |

This segment can be found in the following protein(s): T49823_P6.

Segment cluster T49823_node_38 (SEQ ID NO:1890) according to the present invention is supported by 50 libraries. The number of libraries was determined as previously described. This segment can be found in the following transcript(s): T49823_T41 (SEQ ID NO:1883). Table 1788 below describes the starting and ending position of this segment on each transcript.

TABLE 1787

Segment location on transcripts

| Transcript name | Segment starting position | Segment ending position |
|---|---|---|
| T49823_T41 (SEQ ID NO: 1883) | 1079 | 1216 |

This segment can be found in the following protein(s): T49823_P6.

Segment cluster T49823_node_56 (SEQ ID NO:1891) according to the present invention is supported by 48 libraries. The number of libraries was determined as previously described. This segment can be found in the following transcript(s): T49823_T41 (SEQ ID NO:1883). Table 1789 below describes the starting and ending position of this segment on each transcript.

TABLE 1788

Segment location on transcripts

| Transcript name | Segment starting position | Segment ending position |
|---|---|---|
| T49823_T41 (SEQ ID NO: 1883) | 1465 | 1608 |

This segment can be found in the following protein(s): T49823_P6.

Segment cluster T49823_node_57 (SEQ ID NO:1892) according to the present invention is supported by 3 libraries. The number of libraries was determined as previously described. This segment can be found in the following transcript(s): T49823_T41 (SEQ ID NO:1883). Table 1790 below describes the starting and ending position of this segment on each transcript.

TABLE 1789

Segment location on transcripts

| Transcript name | Segment starting position | Segment ending position |
|---|---|---|
| T49823_T41 (SEQ ID NO: 1883) | 1609 | 1783 |

This segment can be found in the following protein(s): T49823_P6.

According to an optional embodiment of the present invention, short segments related to the above cluster are also provided. These segments are up to about 120 bp in length, and so are included in a separate description.

Segment cluster T49823_node_4 (SEQ ID NO:1893) according to the present invention is supported by 40 libraries. The number of libraries was determined as previously described. This segment can be found in the following transcript(s): T49823_T41 (SEQ ID NO:1883) and T49823_T62 (SEQ ID NO:1884). Table 1791 below describes the starting and ending position of this segment on each transcript.

TABLE 1790

Segment location on transcripts

| Transcript name | Segment starting position | Segment ending position |
|---|---|---|
| T49823_T41 (SEQ ID NO: 1883) | 1 | 84 |
| T49823_T62 (SEQ ID NO: 1884) | 1 | 84 |

This segment can be found in the following protein(s): T49823_P6 and T49823_P34.

Segment cluster T49823_node_12 (SEQ ID NO:1894) according to the present invention can be found in the following transcript(s): T49823_T62 (SEQ ID NO:1884). Table 1792 below describes the starting and ending position of this segment on each transcript.

TABLE 1791

Segment location on transcripts

| Transcript name | Segment starting position | Segment ending position |
|---|---|---|
| T49823_T62 (SEQ ID NO: 1884) | 224 | 241 |

This segment can be found in the following protein(s): T49823_P34.

Segment cluster T49823_node_13 (SEQ ID NO:1895) according to the present invention can be found in the following transcript(s): T49823_T62 (SEQ ID NO:1884). Table 1793 below describes the starting and ending position of this segment on each transcript.

TABLE 1792

Segment location on transcripts

| Transcript name | Segment starting position | Segment ending position |
|---|---|---|
| T49823_T62 (SEQ ID NO: 1884) | 242 | 245 |

This segment can be found in the following protein(s): T49823_P34.

Segment cluster T49823_node_16 (SEQ ID NO:1896) according to the present invention is supported by 58 libraries. The number of libraries was determined as previously described. This segment can be found in the following transcript(s): T49823_T41 (SEQ ID NO:1883) and T49823_T62 (SEQ ID NO:1884). Table 1794 below describes the starting and ending position of this segment on each transcript.

TABLE 1793

Segment location on transcripts

| Transcript name | Segment starting position | Segment ending position |
|---|---|---|
| T49823_T41 (SEQ ID NO: 1883) | 224 | 262 |
| T49823_T62 (SEQ ID NO: 1884) | 246 | 284 |

This segment can be found in the following protein(s): T49823_P6 and T49823_P34.

Segment cluster T49823_node_17 (SEQ ID NO:1897) according to the present invention is supported by 57 libraries. The number of libraries was determined as previously described. This segment can be found in the following transcript(s): T49823_T41 (SEQ ID NO:1883) and T49823_T62 (SEQ ID NO:1884). Table 1795 below describes the starting and ending position of this segment on each transcript.

TABLE 1794

Segment location on transcripts

| Transcript name | Segment starting position | Segment ending position |
|---|---|---|
| T49823_T41 (SEQ ID NO: 1883) | 263 | 315 |
| T49823_T62 (SEQ ID NO: 1884) | 285 | 337 |

This segment can be found in both coding and non-coding regions of transcript(s) as follows. The segment can be found in a non-coding region of transcript(s) that are related to the following protein(s): T49823_P34. This segment can also be found in the following protein(s): T49823_P6, since it is in the coding region for the corresponding transcript.

Segment cluster T49823_node_19 (SEQ ID NO:1898) according to the present invention can be found in the following transcript(s): T49823_T41 (SEQ ID NO:1883) and T49823_T62 (SEQ ID NO:1884). Table 1796 below describes the starting and ending position of this segment on each transcript.

TABLE 1795

Segment location on transcripts

| Transcript name | Segment starting position | Segment ending position |
|---|---|---|
| T49823_T41 (SEQ ID NO: 1883) | 316 | 339 |
| T49823_T62 (SEQ ID NO: 1884) | 338 | 361 |

This segment can be found in both coding and non-coding regions of transcript(s) as follows. The segment can be found in a non-coding region of transcript(s) that are related to the following protein(s): T49823_P34. This segment can also be found in the following protein(s): T49823_P6, since it is in the coding region for the corresponding transcript.

Segment cluster T49823_node_21 (SEQ ID NO:1899) according to the present invention can be found in the following transcript(s): T49823_T41 (SEQ ID NO:1883) and T49823_T62 (SEQ ID NO:1884). Table 1797 below describes the starting and ending position of this segment on each transcript.

TABLE 1796

Segment location on transcripts

| Transcript name | Segment starting position | Segment ending position |
|---|---|---|
| T49823_T41 (SEQ ID NO: 1883) | 481 | 503 |
| T49823_T62 (SEQ ID NO: 1884) | 503 | 525 |

This segment can be found in both coding and non-coding regions of transcript(s) as follows. The segment can be found in a non-coding region of transcript(s) that are related to the following protein(s): T49823_P34. This segment can also be found in the following protein(s): T49823_P6, since it is in the coding region for the corresponding transcript.

Segment cluster T49823_node_22 (SEQ ID NO:1900) according to the present invention can be found in the following transcript(s): T49823_T41 (SEQ ID NO:1883) and T49823_T62 (SEQ ID NO:1884). Table 1798 below describes the starting and ending position of this segment on each transcript.

TABLE 1797

Segment location on transcripts

| Transcript name | Segment starting position | Segment ending position |
|---|---|---|
| T49823_T41 (SEQ ID NO: 1883) | 504 | 515 |
| T49823_T62 (SEQ ID NO: 1884) | 526 | 537 |

This segment can be found in both coding and non-coding regions of transcript(s) as follows. The segment can be found in a non-coding region of transcript(s) that are related to the following protein(s): T49823_P34. This segment can also be found in the following protein(s): T49823_P6, since it is in the coding region for the corresponding transcript.

Segment cluster T49823_node_28 (SEQ ID NO:1901) according to the present invention is supported by 37 libraries. The number of libraries was determined as previously described. This segment can be found in the following transcript(s): T49823_T41 (SEQ ID NO:1883). Table 1799 below describes the starting and ending position of this segment on each transcript.

TABLE 1798

Segment location on transcripts

| Transcript name | Segment starting position | Segment ending position |
|---|---|---|
| T49823_T41 (SEQ ID NO: 1883) | 516 | 632 |

This segment can be found in the following protein(s): T49823_P6.

Segment cluster T49823_node_31 (SEQ ID NO:1902) according to the present invention is supported by 51 libraries. The number of libraries was determined as previously described. This segment can be found in the following transcript(s): T49823_T41 (SEQ ID NO:1883). Table 1800 below describes the starting and ending position of this segment on each transcript.

TABLE 1799

Segment location on transcripts

| Transcript name | Segment starting position | Segment ending position |
|---|---|---|
| T49823_T41 (SEQ ID NO: 1883) | 768 | 808 |

This segment can be found in the following protein(s): T49823_P6.

Segment cluster T49823_node_37 (SEQ ID NO:1903) according to the present invention is supported by 43 libraries. The number of libraries was determined as previously described. This segment can be found in the following transcript(s): T49823_T41 (SEQ ID NO:1883). Table 1801 below describes the starting and ending position of this segment on each transcript.

TABLE 1800

Segment location on transcripts

| Transcript name | Segment starting position | Segment ending position |
|---|---|---|
| T49823_T41 (SEQ ID NO: 1883) | 1049 | 1078 |

This segment can be found in the following protein(s): T49823_P6.

Segment cluster T49823_node_40 (SEQ ID NO:1904) according to the present invention is supported by 54 libraries. The number of libraries was determined as previously described. This segment can be found in the following transcript(s): T49823_T41 (SEQ ID NO:1883). Table 1802 below describes the starting and ending position of this segment on each transcript.

TABLE 1801

Segment location on transcripts

| Transcript name | Segment starting position | Segment ending position |
|---|---|---|
| T49823_T41 (SEQ ID NO: 1883) | 1217 | 1326 |

This segment can be found in the following protein(s): T49823_P6.

Segment cluster T49823_node_41 (SEQ ID NO:1905) according to the present invention is supported by 46 libraries. The number of libraries was determined as previously described. This segment can be found in the following transcript(s): T49823_T41 (SEQ ID NO:1883). Table 1803 below describes the starting and ending position of this segment on each transcript.

TABLE 1802

Segment location on transcripts

| Transcript name | Segment starting position | Segment ending position |
|---|---|---|
| T49823_T41 (SEQ ID NO: 1883) | 1327 | 1353 |

This segment can be found in the following protein(s): T49823_P6.

Segment cluster T49823_node_44 (SEQ ID NO:1906) according to the present invention can be found in the following transcript(s): T49823_T41 (SEQ ID NO:1883). Table 1804 below describes the starting and ending position of this segment on each transcript.

TABLE 1803

Segment location on transcripts

| Transcript name | Segment starting postion | Segment ending position |
|---|---|---|
| T49823_T41 (SEQ ID NO: 1883) | 1354 | 1362 |

This segment can be found in the following protein(s): T49823_P6.

Segment cluster T49823_node_45 (SEQ ID NO:1907) according to the present invention is supported by 45 libraries. The number of libraries was determined as previously described. This segment can be found in the following transcript(s): T49823_T41 (SEQ ID NO:1883). Table 1805 below describes the starting and ending position of this segment on each transcript.

TABLE 1804

Segment location on transcripts

| Transcript name | Segment starting postion | Segment ending position |
|---|---|---|
| T49823_T41 (SEQ ID NO: 1883) | 1363 | 1425 |

This segment can be found in the following protein(s): T49823_P6.

Segment cluster T49823_node_50 (SEQ ID NO:1908) according to the present invention is supported by 39 libraries. The number of libraries was determined as previously described. This segment can be found in the following transcript(s): T49823_T41 (SEQ ID NO:1883). Table 1806 below describes the starting and ending position of this segment on each transcript.

TABLE 1805

Segment location on transcripts

| Transcript name | Segment starting position | Segment ending position |
|---|---|---|
| T49823_T41 (SEQ ID NO: 1883) | 1426 | 1464 |

This segment can be found in the following protein(s): T49823_P6.

Segment cluster T49823_node_58 (SEQ ID NO:1909) according to the present invention is supported by 1 libraries. The number of libraries was determined as previously described. This segment can be found in the following transcript(s): T49823_T41 (SEQ ID NO:1883). Table 1807 below describes the starting and ending position of this segment on each transcript.

TABLE 1806

Segment location on transcripts

| Transcript name | Segment starting position | Segment ending position |
|---|---|---|
| T49823_T41 (SEQ ID NO: 1883) | 1784 | 1892 |

This segment can be found in a non-coding region of transcript(s) that are related to the following protein(s): T49823_P6.

Description for Cluster T51634

Cluster T51634 features 3 transcript(s) and 30 segment(s) of interest, the names for which are given in Tables 1807 and 1808, respectively, the sequences themselves are given at the end of the application. The selected protein variants are given in Table 1809.

TABLE 1807

Transcripts of interest
Transcript Name

T51634_T4 (SEQ ID NO: 1910)
T51634_T11 (SEQ ID NO: 1911)
T51634_T18 (SEQ ID NO: 1912)

TABLE 1808

Segments of interest
Segment Name

T51634_node_1 (SEQ ID NO: 1913)
T51634_node_3 (SEQ ID NO: 1914)
T51634_node_7 (SEQ ID NO: 1915)
T51634_node_9 (SEQ ID NO: 1916)
T51634_node_11 (SEQ ID NO: 1917)
T51634_node_12 (SEQ ID NO: 1918)
T51634_node_18 (SEQ ID NO: 1919)
T51634_node_25 (SEQ ID NO: 1920)
T51634_node_27 (SEQ ID NO: 1921)
T51634_node_29 (SEQ ID NO: 1922)
T51634_node_33 (SEQ ID NO: 1923)
T51634_node_35 (SEQ ID NO: 1924)
T51634_node_40 (SEQ ID NO: 1925)
T51634_node_43 (SEQ ID NO: 1926)
T51634_node_45 (SEQ ID NO: 1927)
T51634_node_52 (SEQ ID NO: 1928)
T51634_node_54 (SEQ ID NO: 1929)
T51634_node_56 (SEQ ID NO: 1930)
T51634_node_59 (SEQ ID NO: 1931)
T51634_node_2 (SEQ ID NO: 1932)
T51634_node_5 (SEQ ID NO: 1933)
T51634_node_14 (SEQ ID NO: 1934)
T51634_node_15 (SEQ ID NO: 1935)
T51634_node_22 (SEQ ID NO: 1936)
T51634_node_23 (SEQ ID NO: 1937)
T51634_node_41 (SEQ ID NO: 1938)
T51634_node_46 (SEQ ID NO: 1939)
T51634_node_48 (SEQ ID NO: 1940)
T51634_node_51 (SEQ ID NO: 1941)
T51634_node_57 (SEQ ID NO: 1942)

TABLE 1809

Proteins of interest

| Protein Name | Correspoding Transcript(s) |
| --- | --- |
| T51634_P1 | T51634_T4 (SEQ ID NO: 1910) |
| T51634_P3 | T51634_T11 (SEQ ID NO: 1911) |
| T51634_P10 | T51634_T18 (SEQ ID NO: 1912) |

These sequences are variants of the known protein Restricted expression proliferation associated protein 100 (SwissProt accession identifier DIL2_HUMAN; known also according to the synonyms p100; Differentially expressed in lung cells 2; DIL-2; Targeting protein for Xklp2; Protein FLS353; Hepatocellular carcinoma-associated antigen 519), referred to herein as the previously known protein.

The sequence for protein Restricted expression proliferation associated protein 100 is given at the end of the application, as "Restricted expression proliferation associated protein 100 amino acid sequence". Known polymorphisms for this sequence are as shown in Table 1810.

TABLE 1810

Amino acid mutations for Known Protein

| SNP position(s) on amino acid sequence | Comment |
| --- | --- |
| 182 | K -> N |
| 273 | K -> E |
| 712 | V -> VTGSMSTDEHKHASVLFYLYLTLYQTGSKV |

Protein Restricted expression proliferation associated protein 100 localization is believed to be Nuclear. During mitosis it is strictly associated with the spindle pole and with the mitotic spindle, whereas during S and G2, it is diffusely distributed throughout the nucleus.

The following GO Annotation(s) apply to the previously known protein. The following annotation(s) were found: mitosis; cell proliferation, which are annotation(s) related to Biological Process; ATP binding; GTP binding, which are annotation(s) related to Molecular Function; and nucleus; spindle, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T51634 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 47 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 47 and Table 1811. This cluster is overexpressed (at least at a minimum level) in the following pathological conditions: brain malignant tumors, epithelial malignant tumors, a mixture of malignant tumors from different tissues, hepatocellular carcinoma, lung malignant tumors, myosarcoma, pancreas carcinoma, skin malignancies, gastric carcinoma and uterine malignancies.

47

TABLE 1811

Normal tissue distribution

| Name of Tissue | Number |
| --- | --- |
| Adrenal | 0 |
| Bladder | 0 |
| Bone | 38 |
| Brain | 3 |
| Colon | 37 |
| epithelial | 5 |
| general | 14 |
| head and neck | 10 |
| kidney | 22 |
| Liver | 0 |

TABLE 1811-continued

Normal tissue distribution

| Name of Tissue | Number |
|---|---|
| Lung | 2 |
| lymph nodes | 94 |
| breast | 0 |
| Bone marrow | 94 |
| muscle | 0 |
| Ovary | 0 |
| pancreas | 0 |
| prostate | 0 |
| Skin | 0 |
| stomach | 0 |
| T cells | 278 |
| uterus | 0 |

TABLE 1812

P values and ratios for expression in cancerous tissue

| Name of Tissue | P1 | P2 | SP1 | R3 | SP2 | R4 |
|---|---|---|---|---|---|---|
| adrenal | 1.9e−01 | 2.3e−01 | 2.1e−01 | 3.4 | 2.9e−01 | 2.7 |
| bladder | 1.5e−01 | 2.1e−01 | 3.2e−01 | 2.5 | 4.6e−01 | 1.9 |
| Bone | 3.7e−01 | 2.8e−02 | 1.8e−01 | 2.5 | 4.8e−02 | 3.1 |
| Brain | 2.6e−01 | 2.6e−02 | 3.5e−02 | 4.3 | 1.4e−05 | 10.7 |
| Colon | 5.7e−01 | 3.9e−01 | 5.2e−01 | 1.3 | 2.0e−01 | 1.8 |
| epithelial | 1.8e−06 | 8.7e−14 | 6.1e−07 | 6.6 | 5.3e−29 | 19.0 |
| general | 1.6e−07 | 2.9e−23 | 4.5e−07 | 3.1 | 1.2e−50 | 8.4 |
| head and neck | 3.4e−01 | 3.3e−01 | 1 | 1.2 | 7.5e−01 | 1.3 |
| kidney | 6.1e−01 | 3.9e−01 | 8.2e−01 | 1.0 | 5.3e−01 | 1.5 |
| Liver | 1 | 7.2e−02 | 1 | 1.0 | 2.8e−03 | 4.8 |
| Lung | 4.9e−01 | 3.2e−02 | 6.9e−02 | 3.5 | 6.5e−05 | 9.4 |
| lymph nodes | 2.0e−01 | 1.4e−01 | 6.4e−01 | 1.3 | 8.8e−02 | 1.4 |
| breast | 3.6e−01 | 8.2e−02 | 6.9e−01 | 1.5 | 1.6e−02 | 2.6 |
| Bone marrow | 7.5e−01 | 8.4e−01 | 1 | 0.3 | 8.5e−01 | 0.7 |
| muscle | 2.9e−01 | 9.5e−02 | 1 | 1.0 | 9.1e−03 | 4.1 |
| Ovary | 6.3e−02 | 2.9e−02 | 6.9e−02 | 3.8 | 2.4e−02 | 4.1 |
| pancreas | 3.3e−01 | 2.3e−02 | 4.2e−01 | 2.4 | 1.8e−05 | 11.8 |
| prostate | 5.3e−01 | 2.6e−01 | 3.0e−01 | 2.5 | 7.5e−02 | 3.4 |
| Skin | 3.8e−02 | 1.5e−03 | 2.0e−02 | 13.1 | 3.8e−05 | 5.0 |
| stomach | 3.0e−01 | 3.2e−03 | 5.0e−01 | 2.0 | 3.0e−04 | 8.1 |
| T cells | 5.0e−01 | 6.7e−01 | 1 | 0.5 | 9.2e−01 | 0.7 |
| uterus | 1.5e−02 | 3.7e−03 | 1.3e−01 | 3.6 | 2.5e−03 | 3.8 |

As noted above, cluster T51634 features 30 segment(s), which were listed in Table 1808 above and for which the sequence(s) are given at the end of the application. These segment(s) are portions of nucleic acid sequence(s) which are described herein separately because they are of particular interest. A description of each segment according to the present invention is now provided.

Segment cluster T51634_node_1 (SEQ ID NO:1913) according to the present invention is supported by 30 libraries. The number of libraries was determined as previously described. This segment can be found in the following transcript(s): T51634_T4 (SEQ ID NO:1910). Table 1813 below describes the starting and ending position of this segment on each transcript.

TABLE 1813

Segment location on transcripts

| Transcript name | Segment starting position | Segment ending position |
|---|---|---|
| T51634_T4 (SEQ ID NO: 1910) | 1 | 230 |

This segment can be found in a non-coding region of transcript(s) that are related to the following protein(s): T51634_P1.

Segment cluster T51634_node_3 (SEQ ID NO:1914) according to the present invention is supported by 70 libraries. The number of libraries was determined as previously described. This segment can be found in the following transcript(s): T51634_T4 (SEQ ID NO:1910). Table 1814 below describes the starting and ending position of this segment on each transcript.

TABLE 1814

Segment location on transcripts

| Transcript name | Segment starting position | Segment ending position |
|---|---|---|
| T51634_T4 (SEQ ID NO: 1910) | 248 | 521 |

This segment can be found in a non-coding region of transcript(s) that are related to the following protein(s): T51634_P1.

Segment cluster T51634_node_7 (SEQ ID NO:1915) according to the present invention is supported by 2 libraries. The number of libraries was determined as previously described. This segment can be found in the following transcript(s): T51634_T4 (SEQ ID NO:1910). Table 1815 below describes the starting and ending position of this segment on each transcript.

TABLE 1815

Segment location on transcripts

| Transcript name | Segment starting position | Segment ending position |
|---|---|---|
| T51634_T4 (SEQ ID NO: 1910) | 629 | 753 |

This segment can be found in a non-coding region of transcript(s) that are related to the following protein(s): T51634_P1.

Segment cluster T51634_node_9 (SEQ ID NO:1916) according to the present invention is supported by 81 libraries. The number of libraries was determined as previously described. This segment can be found in the following transcript(s): T51634_T4 (SEQ ID NO:1910). Table 1816 below describes the starting and ending position of this segment on each transcript.

TABLE 1816

Segment location on transcripts

| Transcript name | Segment starting position | Segment ending position |
|---|---|---|
| T51634_T4 (SEQ ID NO: 1910) | 754 | 929 |

This segment can be found in the following protein(s): T51634_P1.

Segment cluster T51634_node_11 (SEQ ID NO:1917) according to the present invention is supported by 2 libraries. The number of libraries was determined as previously described. This segment can be found in the following transcript(s): T51634_T11 (SEQ ID NO:1911). Table 1817 below describes the starting and ending position of this segment on each transcript.

TABLE 1817

Segment location on transcripts

| Transcript name | Segment starting position | Segment ending position |
|---|---|---|
| T51634_T11 (SEQ ID NO: 1911) | 1 | 137 |

This segment can be found in a non-coding region of transcript(s) that are related to the following protein(s): T51634_P3.

Segment cluster T51634_node__12 (SEQ ID NO:1918) according to the present invention is supported by 73 libraries. The number of libraries was determined as previously described. This segment can be found in the following transcript(s): T51634_T4 (SEQ ID NO:1910) and T51634_T11 (SEQ ID NO:1911). Table 1818 below describes the starting and ending position of this segment on each transcript.

TABLE 1818

Segment location on transcripts

| Transcript name | Segment starting position | Segment ending position |
|---|---|---|
| T51634_T4 (SEQ ID NO: 1910) | 930 | 1052 |
| T51634_T11 (SEQ ID NO: 1911) | 138 | 260 |

This segment can be found in both coding and non-coding regions of transcript(s) as follows. The segment can be found in a non-coding region of transcript(s) that are related to the following protein(s): T51634_P3. This segment can also be found in the following protein(s): T51634_P1, since it is in the coding region for the corresponding transcript.

Segment cluster T51634_node__18 (SEQ ID NO:1919) according to the present invention is supported by 52 libraries. The number of libraries was determined as previously described. This segment can be found in the following transcript(s): T51634_T4 (SEQ ID NO:1910) and T51634_T11 (SEQ ID NO:1911). Table 1819 below describes the starting and ending position of this segment on each transcript.

TABLE 1819

Segment location on transcripts

| Transcript name | Segment starting position | Segment ending position |
|---|---|---|
| T51634_T4 (SEQ ID NO: 1910) | 1180 | 1308 |
| T51634_T11 (SEQ ID NO: 1911) | 388 | 516 |

This segment can be found in the following protein(s): T51634_P1 and T51634_P3.

Segment cluster T51634_node__25 (SEQ ID NO:1920) according to the present invention is supported by 53 libraries. The number of libraries was determined as previously described. This segment can be found in the following transcript(s): T51634_T4 (SEQ ID NO:1910) and T51634_T11 (SEQ ID NO:1911). Table 1820 below describes the starting and ending position of this segment on each transcript.

TABLE 1820

Segment location on transcripts

| Transcript name | Segment starting position | Segment ending position |
|---|---|---|
| T51634_T4 (SEQ ID NO: 1910) | 1432 | 1553 |
| T51634_T11 (SEQ ID NO: 1911) | 640 | 761 |

This segment can be found in the following protein(s): T51634_P1 and T51634_P3.

Segment cluster T51634_node__27 (SEQ ID NO:1921) according to the present invention is supported by 58 libraries. The number of libraries was determined as previously described. This segment can be found in the following transcript(s): T51634_T4 (SEQ ID NO:1910) and T51634_T11 (SEQ ID NO:1911). Table 1821 below describes the starting and ending position of this segment on each transcript.

TABLE 1821

Segment location on transcripts

| Transcript name | Segment starting position | Segment ending position |
|---|---|---|
| T51634_T4 (SEQ ID NO: 1910) | 1554 | 1705 |
| T51634_T11 (SEQ ID NO: 1911) | 762 | 913 |

This segment can be found in the following protein(s): T51634_P1 and T51634_P3.

Segment cluster T51634_node__29 (SEQ ID NO:1922) according to the present invention is supported by 62 libraries. The number of libraries was determined as previously described. This segment can be found in the following transcript(s): T51634_T4 (SEQ ID NO:1910) and T51634_T11 (SEQ ID NO:1911). Table 1822 below describes the starting and ending position of this segment on each transcript.

TABLE 1822

Segment location on transcripts

| Transcript name | Segment starting position | Segment ending position |
|---|---|---|
| T51634_T4 (SEQ ID NO: 1910) | 1706 | 1877 |
| T51634_T11 (SEQ ID NO: 1911) | 914 | 1085 |

This segment can be found in the following protein(s):. T51634_P1 and T51634_P3.

Segment cluster T51634_node__33 (SEQ ID NO:1923) according to the present invention is supported by 57 libraries. The number of libraries was determined as previously described. This segment can be found in the following transcript(s): T51634_T4 (SEQ ID NO:1910) and T51634_T11 (SEQ ID NO:1911). Table 1823 below describes the starting and ending position of this segment on each transcript.

TABLE 1823

Segment location on transcripts

| Transcript name | Segment starting position | Segment ending position |
|---|---|---|
| T51634_T4 (SEQ ID NO: 1910) | 1878 | 2019 |
| T51634_T11 (SEQ ID NO: 1911) | 1086 | 1227 |

This segment can be found in the following protein(s): T51634_P1 and T51634_P3.

Segment cluster T51634_node_35 (SEQ ID NO:1924) according to the present invention is supported by 66 libraries. The number of libraries was determined as previously described. This segment can be found in the following transcript(s): T51634_T4 (SEQ ID NO:1910) and T51634_T11 (SEQ ID NO:1911). Table 1824 below describes the starting and ending position of this segment on each transcript.

TABLE 1824

Segment location on transcripts

| Transcript name | Segment starting position | Segment ending position |
|---|---|---|
| T51634_T4 (SEQ ID NO: 1910) | 2020 | 2236 |
| T51634_T11 (SEQ ID NO: 1911) | 1228 | 1444 |

This segment can be found in the following protein(s): T51634_P1 and T51634_P3.

Segment cluster T51634_node_40 (SEQ ID NO:1925) according to the present invention is supported by 2 libraries. The number of libraries was determined as previously described. This segment can be found in the following transcript(s): T51634_T18 (SEQ ID NO:1912). Table 1825 below describes the starting and ending position of this segment on each transcript.

TABLE 1825

Segment location on transcripts

| Transcript name | Segment starting position | Segment ending position |
|---|---|---|
| T51634_T18 (SEQ ID NO: 1912) | 1 | 172 |

This segment can be found in a non-coding region of transcript(s) that are related to the following protein(s): T51634_P10.

Segment cluster T51634_node_43 (SEQ ID NO:1926) according to the present invention is supported by 78 libraries. The number of libraries was determined as previously described. This segment can be found in the following transcript(s): T51634_T4 (SEQ ID NO:1910), T51634_T11 (SEQ ID NO:1911) and T51634_T18 (SEQ ID NO:1912). Table 1826 below describes the starting and ending position of this segment on each transcript.

TABLE 1826

Segment location on transcripts

| Transcript name | Segment starting position | Segment ending position |
|---|---|---|
| T51634_T4 (SEQ ID NO: 1910) | 2333 | 2509 |
| T51634_T11 (SEQ ID NO: 1911) | 1541 | 1717 |
| T51634_T18 (SEQ ID NO: 1912) | 269 | 445 |

This segment can be found in the following protein(s): T51634_P1, T51634_P3 and T51634_P10.

Segment cluster T51634_node_45 (SEQ ID NO:1927) according to the present invention is supported by 85 libraries. The number of libraries was determined as previously described. This segment can be found in the following transcript(s): T51634_T4 (SEQ ID NO:1910), T51634_T11 (SEQ ID NO:1911) and T51634_T18 (SEQ ID NO:1912). Table 1827 below describes the starting and ending position of this segment on each transcript.

TABLE 1827

Segment location on transcripts

| Transcript name | Segment starting position | Segment ending position |
|---|---|---|
| T51634_T4 (SEQ ID NO: 1910) | 2510 | 2656 |
| T51634_T11 (SEQ ID NO: 1911) | 1718 | 1864 |
| T51634_T18 (SEQ ID NO: 1912) | 446 | 592 |

This segment can be found in the following protein(s): T51634_P1, T51634_P3 and T51634_P10.

Segment cluster T51634_node_52 (SEQ ID NO:1928) according to the present invention is supported by 103 libraries. The number of libraries was determined as previously described. This segment can be found in the following transcript(s): T51634_T4 (SEQ ID NO:1910) and T51634_T11 (SEQ ID NO:1911). Table 1828 below describes the starting and ending position of this segment on each transcript.

TABLE 1828

Segment location on transcripts

| Transcript name | Segment starting position | Segment ending position |
|---|---|---|
| T51634_T4 (SEQ ID NO: 1910) | 2790 | 2956 |
| T51634_T11 (SEQ ID NO: 1911) | 1998 | 2164 |

This segment can be found in the following protein(s): T51634_P1 and T51634_P3.

Segment cluster T51634_node_54 (SEQ ID NO:1929) according to the present invention is supported by 135 libraries. The number of libraries was determined as previously described. This segment can be found in the following transcript(s): T51634_T4 (SEQ ID NO:1910) and T51634_T11 (SEQ ID NO:1911). Table 1829 below describes the starting and ending position of this segment on each transcript.

TABLE 1829

Segment location on transcripts

| Transcript name | Segment starting position | Segment ending position |
|---|---|---|
| T51634_T4 (SEQ ID NO: 1910) | 2957 | 3217 |
| T51634_T11 (SEQ ID NO: 1911) | 2165 | 2425 |

This segment can be found in the following protein(s): T51634_P1 and T51634_P3.

Segment cluster T51634_node_56 (SEQ ID NO:1930) according to the present invention is supported by 149 libraries. The number of libraries was determined as previously described. This segment can be found in the following transcript(s): T51634_T4 (SEQ ID NO:1910) and T51634_T11 (SEQ ID NO:1911). Table 1830 below describes the starting and ending position of this segment on each transcript.

TABLE 1830

| | Segment location on transcripts | |
|---|---|---|
| Transcript name | Segment starting position | Segment ending position |
| T51634_T4 (SEQ ID NO: 1910) | 3218 | 3587 |
| T51634_T11 (SEQ ID NO: 1911) | 2426 | 2795 |

This segment can be found in a non-coding region of transcript(s) that are related to the following protein(s): T51634_P1 and T51634_P3.

Segment cluster T51634_node__59 (SEQ ID NO:1931) according to the present invention is supported by 99 libraries. The number of libraries was determined as previously described. This segment can be found in the following transcript(s): T51634_T4 (SEQ ID NO:1910) and T51634_T11 (SEQ ID NO:1911). Table 1831 below describes the starting and ending position of this segment on each transcript.

TABLE 1831

| | Segment location on transcripts | |
|---|---|---|
| Transcript name | Segment starting position | Segment ending position |
| T51634_T4 (SEQ ID NO: 1910) | 3614 | 3800 |
| T51634_T11 (SEQ ID NO: 1911) | 2822 | 3008 |

This segment can be found in a non-coding region of transcript(s) that are related to the following protein(s): T51634_P1 and T51634_P3.

According to an optional embodiment of the present invention, short segments related to the above cluster are also provided. These segments are up to about 120 bp in length, and so are included in a separate description.

Segment cluster T51634_node__2 (SEQ ID NO:1932) according to the present invention can be found in the following transcript(s): T51634_T4 (SEQ ID NO:1910). Table 1832 below describes the starting and ending position of this segment on each transcript.

TABLE 1832

| | Segment location on transcripts | |
|---|---|---|
| Transcript name | Segment starting position | Segment ending position |
| T51634_T4 (SEQ ID NO: 1910) | 231 | 247 |

This segment can be found in a non-coding region of transcript(s) that are related to the following protein(s): T51634_P1.

Segment cluster T51634_node__5 (SEQ ID NO:1933) according to the present invention is supported by 66 libraries. The number of libraries was determined as previously described. This segment can be found in the following transcript(s): T51634_T4 (SEQ ID NO:1910). Table 1833 below describes the starting and ending position of this segment on each transcript.

TABLE 1833

| | Segment location on transcripts | |
|---|---|---|
| Transcript name | Segment starting position | Segment ending position |
| T51634_T4 (SEQ ID NO: 1910) | 522 | 628 |

This segment can be found in a non-coding region of transcript(s) that are related to the following protein(s): T51634_P1.

Segment cluster T51634_node__14 (SEQ ID NO:1934) according to the present invention is supported by 61 libraries. The number of libraries was determined as previously described. This segment can be found in the following transcript(s): T51634_T4 (SEQ ID NO:1910) and T51634_T11 (SEQ ID NO:1911). Table 1834 below describes the starting and ending position of this segment on each transcript.

TABLE 1834

| | Segment location on transcripts | |
|---|---|---|
| Transcript name | Segment starting position | Segment ending position |
| T51634_T4 (SEQ ID NO: 1910) | 1053 | 1143 |
| T51634_T11 (SEQ ID NO: 1911) | 261 | 351 |

This segment can be found in both coding and non-coding regions of transcript(s) as follows. The segment can be found in a non-coding region of transcript(s) that are related to the following protein(s): T51634_P3. This segment can also be found in the following protein(s): T51634_P1, since it is in the coding region for the corresponding transcript.

Segment cluster T51634_node__15 (SEQ ID NO:1935) according to the present invention is supported by 47 libraries. The number of libraries was determined as previously described. This segment can be found in the following transcript(s): T51634_T4 (SEQ ID NO:1910) and T51634_T11 (SEQ ID NO:1911). Table 1835 below describes the starting and ending position of this segment on each transcript.

TABLE 1835

| | Segment location on transcripts | |
|---|---|---|
| Transcript name | Segment starting position | Segment ending position |
| T51634_T4 (SEQ ID NO: 1910) | 1144 | 1179 |
| T51634_T11 (SEQ ID NO: 1911) | 352 | 387 |

This segment can be found in both coding and non-coding regions of transcript(s) as follows. The segment can be found in a non-coding region of transcript(s) that are related to the following protein(s): T51634_P3. This segment can also be found in the following protein(s): T51634_P1, since it is in the coding region for the corresponding transcript.

Segment cluster T51634_node__22 (SEQ ID NO:1936) according to the present invention is supported by 48 libraries. The number of libraries was determined as previously described. This segment can be found in the following transcript(s): T51634_T4 (SEQ ID NO:1910) and T51634_T11 (SEQ ID NO:1911). Table 1836 below describes the starting and ending position of this segment on each transcript.

TABLE 1836

Segment location on transcripts

| Transcript name | Segment starting position | Segment ending position |
|---|---|---|
| T51634_T4 (SEQ ID NO: 1910) | 1309 | 1385 |
| T51634_T11 (SEQ ID NO: 1911) | 517 | 593 |

This segment can be found in the following protein(s): T51634_P1 and T51634_P3.

Segment cluster T51634_node_23 (SEQ ID NO:1937) according to the present invention is supported by 47 libraries. The number of libraries was determined as previously described. This segment can be found in the following transcript(s): T51634_T4 (SEQ ID NO:1910) and T51634_T11 (SEQ ID NO:1911). Table 1837 below describes the starting and ending position of this segment on each transcript.

TABLE 1837

Segment location on transcripts

| Transcript name | Segment starting position | Segment ending position |
|---|---|---|
| T51634_T4 (SEQ ID NO: 1910) | 1386 | 1431 |
| T51634_T11 (SEQ ID NO: 1911) | 594 | 639 |

This segment can be found in the following protein(s): T51634_P1 and T51634_P3.

Segment cluster T51634_node_41 (SEQ ID NO:1938) according to the present invention is supported by 65 libraries. The number of libraries was determined as previously described. This segment can be found in the following transcript(s): T51634_T4 (SEQ ID NO:1910), T51634_T11 (SEQ ID NO:1911) and T51634_T18 (SEQ ID NO:1912). Table 1838 below describes the starting and ending position of this segment on each transcript.

TABLE 1838

Segment location on transcripts

| Transcript name | Segment starting position | Segment ending position |
|---|---|---|
| T51634_T4 (SEQ ID NO: 1910) | 2237 | 2332 |
| T51634_T11 (SEQ ID NO: 1911) | 1445 | 1540 |
| T51634_T18 (SEQ ID NO: 1912) | 173 | 268 |

This segment can be found in the following protein(s): T51634_P1, T51634_P3 and T51634_P10.

Segment cluster T51634_node_46 (SEQ ID NO:1939) according to the present invention is supported by 1 libraries. The number of libraries was determined as previously described. This segment can be found in the following transcript(s): T51634_T18 (SEQ ID NO:1912). Table 1839 below describes the starting and ending position of this segment on each transcript.

TABLE 1839

Segment location on transcripts

| Transcript name | Segment starting position | Segment ending position |
|---|---|---|
| T51634_T18 (SEQ ID NO: 1912) | 593 | 649 |

This segment can be found in the following protein(s): T51634_P10.

Segment cluster T51634_node_48 (SEQ ID NO:1940) according to the present invention is supported by 78 libraries. The number of libraries was determined as previously described. This segment can be found in the following transcript(s): T51634_T4 (SEQ ID NO:1910) and T51634_T11 (SEQ ID NO:1911). Table 1840 below describes the starting and ending position of this segment on each transcript.

TABLE 1840

Segment location on transcripts

| Transcript name | Segment starting position | Segment ending position |
|---|---|---|
| T51634_T4 (SEQ ID NO: 1910) | 2657 | 2768 |
| T51634_T11 (SEQ ID NO: 1911) | 1865 | 1976 |

This segment can be found in the following protein(s): T51634_P1 and T51634_P3.

Segment cluster T51634_node_51 (SEQ ID NO:1941) according to the present invention can be found in the following transcript(s): T51634_T4 (SEQ ID NO:1910) and T51634_T11 (SEQ ID NO:1911). Table 1841 below describes the starting and ending position of this segment on each transcript.

TABLE 1841

Segment location on transcripts

| Transcript name | Segment starting position | Segment ending position |
|---|---|---|
| T51634_T4 (SEQ ID NO: 1910) | 2769 | 2789 |
| T51634_T11 (SEQ ID NO: 1911) | 1977 | 1997 |

This segment can be found in the following protein(s): T51634_P1 and T51634_P3.

Segment cluster T51634_node_57 (SEQ ID NO:1942) according to the present invention is supported by 96 libraries. The number of libraries was determined as previously described. This segment can be found in the following transcript(s): T51634_T4 (SEQ ID NO:1910) and T51634_T11 (SEQ ID NO:1911). Table 1842 below describes the starting and ending position of this segment on each transcript.

TABLE 1842

Segment location on transcripts

| Transcript name | Segment starting position | Segment ending position |
|---|---|---|
| T51634_T4 (SEQ ID NO: 1910) | 3588 | 3613 |
| T51634_T11 (SEQ ID NO: 1911) | 2796 | 2821 |

This segment can be found in a non-coding region of transcript(s) that are related to the following protein(s): T51634_P1 and T51634_P3.

Description for Cluster T55968

Cluster T55968 features 5 transcript(s) and 14 segment(s) of interest, the names for which are given in Tables 1843 and 1844, respectively, the sequences themselves are given at the end of the application. The selected protein variants are given in Table 1845.

TABLE 1843

Transcripts of interest
Transcript Name

T55968_T3 (SEQ ID NO: 1943)
T55968_T6 (SEQ ID NO: 1944)
T55968_T7 (SEQ ID NO: 1945)
T55968_T11 (SEQ ID NO: 1946)
T55968_T12 (SEQ ID NO: 1947)

TABLE 1844

Segments of interest
Segment Name

T55968_node_0 (SEQ ID NO: 1948)
T55968_node_1 (SEQ ID NO: 1949)
T55968_node_4 (SEQ ID NO: 1950)
T55968_node_10 (SEQ ID NO: 1951)
T55968_node_14 (SEQ ID NO: 1952)
T55968_node_2 (SEQ ID NO: 1953)
T55968_node_3 (SEQ ID NO: 1954)
T55968_node_6 (SEQ ID NO: 1955)
T55968_node_7 (SEQ ID NO: 1956)
T55968_node_8 (SEQ ID NO: 1957)
T55968_node_9 (SEQ ID NO: 1958)
T55968_node_11 (SEQ ID NO: 1959)
T55968_node_12 (SEQ ID NO: 1960)
T55968_node_13 (SEQ ID NO: 1961)

TABLE 1845

Proteins of interest

| Protein Name | Corresponding Transcript(s) |
|---|---|
| T55968_P1 | T55968_T3 (SEQ ID NO: 1943); T55968_T6 (SEQ ID NO: 1944); T55968_T7 (SEQ ID NO: 1945) |

These sequences are variants of the known protein 28S ribosomal protein S12, mitochondrial precursor (SwissProt accession identifier RT12_HUMAN; known also according to the synonyms MPR-S12; MT-RPS12), referred to herein as the previously known protein.

The sequence for protein 28S ribosomal protein S12, mitochondrial precursor is given at the end of the application, as "28S ribosomal protein S12, mitochondrial precursor amino acid sequence". Protein 28S ribosomal protein S12, mitochondrial precursor localization is believed to be Mitochondrial.

The following GO Annotation(s) apply to the previously known protein. The following annotation(s) were found: protein biosynthesis, which are annotation(s) related to Biological Process; structural protein of ribosome, which are annotation(s) related to Molecular Function; and intracellular; mitochondrion; mitochondrial ribosome; small ribosomal subunit, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T55968 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 48 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 48 and Table 1846. This cluster is overexpressed (at least at a minimum level) in the following pathological conditions: brain malignant tumors, epithelial malignant tumors, a mixture of malignant tumors from different tissues, pancreas carcinoma and skin malignancies.

48

TABLE 1846

Normal tissue distribution

| Name of Tissue | Number |
|---|---|
| Bone | 38 |
| Brain | 1 |
| Colon | 31 |
| Epithelial | 14 |
| General | 10 |
| head and neck | 0 |
| Kidney | 8 |
| Liver | 0 |
| Lung | 12 |
| lymph nodes | 22 |
| Breast | 0 |
| Muscle | 18 |
| Ovary | 0 |
| Pancreas | 2 |
| Prostate | 98 |
| Skin | 16 |
| Stomach | 0 |
| Uterus | 9 |

TABLE 1847

P values and ratios for expression in cancerous tissue

| Name of Tissue | P1 | P2 | SP1 | R3 | SP2 | R4 |
|---|---|---|---|---|---|---|
| Bone | 6.6e−01 | 6.7e−01 | 6.4e−01 | 1.3 | 7.9e−01 | 1.0 |
| Brain | 6.6e−01 | 1.3e−01 | 2.2e−01 | 4.8 | 1.5e−05 | 11.8 |
| Colon | 4.1e−01 | 1.5e−01 | 7.8e−01 | 1.1 | 1.7e−01 | 1.7 |
| Epithelial | 1.1e−01 | 9.9e−05 | 3.6e−01 | 1.3 | 5.3e−14 | 5.5 |
| General | 1.1e−01 | 2.1e−06 | 8.1e−02 | 1.6 | 7.4e−30 | 6.7 |
| head and neck | 1.4e−01 | 4.0e−02 | 4.6e−01 | 2.2 | 4.2e−01 | 2.0 |
| Kidney | 7.1e−01 | 5.5e−01 | 5.8e−01 | 1.3 | 3.4e−01 | 1.8 |
| Liver | 1.8e−01 | 4.3e−02 | 1 | 1.3 | 1.6e−01 | 2.2 |
| Lung | 4.9e−01 | 3.7e−01 | 3.7e−01 | 2.2 | 1.3e−01 | 2.1 |
| lymph nodes | 8.5e−01 | 7.6e−01 | 1 | 0.5 | 6.1e−01 | 1.1 |
| Breast | 3.4e−01 | 2.8e−01 | 4.7e−01 | 2.0 | 1.1e−02 | 1.9 |
| Muscle | 9.3e−01 | 4.6e−01 | 1 | 0.5 | 6.3e−01 | 1.3 |
| Ovary | 6.2e−01 | 2.6e−01 | 1 | 1.3 | 1.6e−01 | 2.4 |
| Pancreas | 5.5e−01 | 8.7e−02 | 4.2e−01 | 2.0 | 5.7e−08 | 8.3 |
| Prostate | 9.3e−01 | 9.4e−01 | 1 | 0.2 | 9.5e−01 | 0.3 |
| Skin | 5.2e−01 | 8.5e−02 | 5.5e−02 | 5.9 | 1.2e−03 | 4.3 |
| Stomach | 1 | 4.5e−02 | 1 | 1.0 | 1.3e−01 | 2.0 |
| Uterus | 9.4e−01 | 5.3e−01 | 1 | 0.7 | 1.2e−02 | 1.6 |

As noted above, cluster T55968 features 14 segment(s), which were listed in Table 1844 above and for which the sequence(s) are given at the end of the application. These segment(s) are portions of nucleic acid sequence(s) which are described herein separately because they are of particular interest. A description of each segment according to the present invention is now provided.

Segment cluster T55968_node_0 (SEQ ID NO:1948) according to the present invention is supported by 59 libraries. The number of libraries was determined as previously described. This segment can be found in the following transcript(s): T55968_T3 (SEQ ID NO:1943), T55968_T6 (SEQ ID NO:1944), T55968_T7 (SEQ ID NO:1945), T55968_T11 (SEQ ID NO:1946) and T55968_T12 (SEQ ID NO:1947). Table 1848 below describes the starting and ending position of this segment on each transcript.

TABLE 1848

Segment location on transcripts

| Transcript name | Segment starting position | Segment ending position |
|---|---|---|
| T55968_T3 (SEQ ID NO: 1943) | 1 | 432 |
| T55968_T6 (SEQ ID NO: 1944) | 1 | 432 |
| T55968_T7 (SEQ ID NO: 1945) | 1 | 432 |
| T55968_T11 (SEQ ID NO: 1946) | 1 | 432 |
| T55968_T12 (SEQ ID NO: 1947) | 1 | 432 |

This segment can be found in a non-coding region of transcript(s) that are related to the following protein(s): T55968_P1.

Segment cluster T55968_node_1 (SEQ ID NO:1949) according to the present invention is supported by 52 libraries. The number of libraries was determined as previously described. This segment can be found in the following transcript(s): T55968_T3 (SEQ ID NO:1943), T55968_T7 (SEQ ID NO:1945) and T55968_T11 (SEQ ID NO:1946). Table 1849 below describes the starting and ending position of this segment on each transcript.

TABLE 1849

Segment location on transcripts

| Transcript name | Segment starting position | Segment ending position |
|---|---|---|
| T55968_T3 (SEQ ID NO: 1943) | 433 | 605 |
| T55968_T7 (SEQ ID NO: 1945) | 433 | 605 |
| T55968_T11 (SEQ ID NO: 1946) | 433 | 605 |

This segment can be found in a non-coding region of transcript(s) that are related to the following protein(s): T55968_P1.

Segment cluster T55968_node_4 (SEQ ID NO:1950) according to the present invention is supported by 4 libraries. The number of libraries was determined as previously described. This segment can be found in the following transcript(s): T55968_T11 (SEQ ID NO:1946) and T55968_T12 (SEQ ID NO:1947). Table 1850 below describes the starting and ending position of this segment on each transcript.

TABLE 1850

Segment location on transcripts

| Transcript name | Segment starting position | Segment ending position |
|---|---|---|
| T55968_T11 (SEQ ID NO: 1946) | 778 | 1396 |
| T55968_T12 (SEQ ID NO: 1947) | 501 | 1119 |

The previously-described transcripts for these segment(s) do not code for protein.

Segment cluster T55968_node_10 (SEQ ID NO:1951) according to the present invention is supported by 102 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1851 below describes the starting and ending position of this segment on each transcript.

TABLE 1851

Segment location on transcripts

| Transcript name | Segment starting position | Segment ending position |
|---|---|---|
| T55968_T3 (SEQ ID NO: 1943) | 885 | 1134 |
| T55968_T6 (SEQ ID NO: 1944) | 712 | 961 |
| T55968_T7 (SEQ ID NO: 1945) | 989 | 1238 |

This segment can be found in the following protein(s): T55968_P1.

Segment cluster T55968_node_14 (SEQ ID NO:1952) according to the present invention is supported by 11 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1852 below describes the starting and ending position of this segment on each transcript.

TABLE 1852

Segment location on transcripts

| Transcript name | Segment starting position | Segment ending position |
|---|---|---|
| T55968_T3 (SEQ ID NO: 1943) | 1366 | 1518 |
| T55968_T6 (SEQ ID NO: 1944) | 1193 | 1345 |
| T55968_T7 (SEQ ID NO: 1945) | 1470 | 1622 |

This segment can be found in a non-coding region of transcript(s) that are related to the following protein(s): T55968_P1.

According to an optional embodiment of the present invention, short segments related to the above cluster are also provided. These segments are up to about 120 bp in length, and so are included in a separate description.

Segment cluster T55968_node_2 (SEQ ID NO:1953) according to the present invention is supported by 17 libraries. The number of libraries was determined as previously described. This segment can be found in the following transcript(s): T55968_T7 (SEQ ID NO:1945) and T55968_T11 (SEQ ID NO:1946). Table 1853 below describes the starting and ending position of this segment on each transcript.

TABLE 1853

Segment location on transcripts

| Transcript name | Segment starting position | Segment ending position |
|---|---|---|
| T55968_T7 (SEQ ID NO: 1945) | 606 | 709 |
| T55968_T11 (SEQ ID NO: 1946) | 606 | 709 |

This segment can be found in a non-coding region of transcript(s) that are related to the following protein(s): T55968_P1.

Segment cluster T55968_node_3 (SEQ ID NO:1954) according to the present invention is supported by 95 libraries. The number of libraries was determined as previously described. This segment can be found in the following transcript(s): T55968_T3 (SEQ ID NO:1943), T55968_T6 (SEQ ID NO:1944), T55968_T7 (SEQ ID NO:1945), T55968_T11 (SEQ ID NO:1946) and T55968_T12 (SEQ ID NO:1947). Table 1854 below describes the starting and ending position of this segment on each transcript.

TABLE 1854

Segment location on transcripts

| Transcript name | Segment starting position | Segment ending position |
| --- | --- | --- |
| T55968_T3 (SEQ ID NO: 1943) | 606 | 673 |
| T55968_T6 (SEQ ID NO: 1944) | 433 | 500 |
| T55968_T7 (SEQ ID NO: 1945) | 710 | 777 |
| T55968_T11 (SEQ ID NO: 1946) | 710 | 777 |
| T55968_T12 (SEQ ID NO: 1947) | 433 | 500 |

This segment can be found in the following protein(s): T55968_P1.

Segment cluster T55968_node_6 (SEQ ID NO:1955) according to the present invention is supported by 91 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1855 below describes the starting and ending position of this segment on each transcript.

TABLE 1855

Segment location on transcripts

| Transcript name | Segment starting position | Segment ending position |
| --- | --- | --- |
| T55968_T3 (SEQ ID NO: 1943) | 674 | 748 |
| T55968_T6 (SEQ ID NO: 1944) | 501 | 575 |
| T55968_T7 (SEQ ID NO: 1945) | 778 | 852 |

This segment can be found in the following protein(s): T55968_P1.

Segment cluster T55968_node_7 (SEQ ID NO:1956) according to the present invention is supported by 82 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1856 below describes the starting and ending position of this segment on each transcript.

TABLE 1856

Segment location on transcripts

| Transcript name | Segment starting position | Segment ending position |
| --- | --- | --- |
| T55968_T3 (SEQ ID NO: 1943) | 749 | 793 |
| T55968_T6 (SEQ ID NO: 1944) | 576 | 620 |
| T55968_T7 (SEQ ID NO: 1945) | 853 | 897 |

This segment can be found in the following protein(s): T55968_P1.

Segment cluster T55968_node_8 (SEQ ID NO:1957) according to the present invention can be found in the following transcript(s): T55968_T3 (SEQ ID NO:1943), T55968_T6 (SEQ ID NO:1944) and T55968_T7 (SEQ ID NO:1945). Table 1857 below describes the starting and ending position of this segment on each transcript.

TABLE 1857

Segment location on transcripts

| Transcript name | Segment starting position | Segment ending position |
| --- | --- | --- |
| T55968_T3 (SEQ ID NO: 1943) | 794 | 818 |
| T55968_T6 (SEQ ID NO: 1944) | 621 | 645 |
| T55968_T7 (SEQ ID NO: 1945) | 898 | 922 |

This segment can be found in the following protein(s): T55968_P1.

Segment cluster T55968_node_9 (SEQ ID NO:1958) according to the present invention is supported by 69 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1858 below describes the starting and ending position of this segment on each transcript.

TABLE 1858

Segment location on transcripts

| Transcript name | Segment starting position | Segment ending position |
| --- | --- | --- |
| T55968_T3 (SEQ ID NO: 1943) | 819 | 884 |
| T55968_T6 (SEQ ID NO: 1944) | 646 | 711 |
| T55968_T7 (SEQ ID NO: 1945) | 923 | 988 |

This segment can be found in the following protein(s): T55968_P1.

Segment cluster T55968_node_11 (SEQ ID NO:1959) according to the present invention is supported by 102 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1859 below describes the starting and ending position of this segment on each transcript.

TABLE 1859

Segment location on transcripts

| Transcript name | Segment starting position | Segment ending position |
| --- | --- | --- |
| T55968_T3 (SEQ ID NO: 1943) | 1135 | 1242 |
| T55968_T6 (SEQ ID NO: 1944) | 962 | 1069 |
| T55968_T7 (SEQ ID NO: 1945) | 1239 | 1346 |

This segment can be found in a non-coding region of transcript(s) that are related to the following protein(s): T55968_P1.

Segment cluster T55968_node_12 (SEQ ID NO:1960) according to the present invention is supported by 96 libraries. The number of libraries was determined as previously described. This segment can be found in the following transcript(s): T55968_T3 (SEQ ID NO:1943), T55968_T6 (SEQ ID NO:1944) and T55968_T7 (SEQ ID NO:1945). Table 1860 below describes the starting and ending position of this segment on each transcript.

TABLE 1860

Segment location on transcripts

| Transcript name | Segment starting position | Segment ending position |
|---|---|---|
| T55968_T3 (SEQ ID NO: 1943) | 1243 | 1360 |
| T55968_T6 (SEQ ID NO: 1944) | 1070 | 1187 |
| T55968_T7 (SEQ ID NO: 1945) | 1347 | 1464 |

This segment can be found in a non-coding region of transcript(s) that are related to the following protein(s): T55968_P1.

Segment cluster T55968_node_13 (SEQ ID NO:1961) according to the present invention can be found in the following transcript(s): T55968_T3 (SEQ ID NO:1943), T55968_T6 (SEQ ID NO:1944) and T55968_T7 (SEQ ID NO:1945). Table 1861 below describes the starting and ending position of this segment on each transcript.

TABLE 1861

Segment location on transcripts

| Transcript name | Segment starting position | Segment ending position |
|---|---|---|
| T55968_T3 (SEQ ID NO: 1943) | 1361 | 1365 |
| T55968_T6 (SEQ ID NO: 1944) | 1188 | 1192 |
| T55968_T7 (SEQ ID NO: 1945) | 1465 | 1469 |

This segment can be found in a non-coding region of transcript(s) that are related to the following protein(s): T55968_P1.

Description for Cluster T86235

Cluster T86235 features 34 transcript(s) and 47 segment(s) of interest, the names for which are given in Tables 1862 and 1863, respectively, the sequences themselves are given at the end of the application. The selected protein variants are given in Table 1864.

TABLE 1862

Transcripts of interest
Transcript Name

T86235_T1 (SEQ ID NO: 1962)
T86235_T2 (SEQ ID NO: 1963)
T86235_T3 (SEQ ID NO: 1964)
T86235_T4 (SEQ ID NO: 1965)
T86235_T5 (SEQ ID NO: 1966)
T86235_T6 (SEQ ID NO: 1967)
T86235_T7 (SEQ ID NO: 1968)
T86235_T8 (SEQ ID NO: 1969)
T86235_T9 (SEQ ID NO: 1970)
T86235_T10 (SEQ ID NO: 1971)
T86235_T12 (SEQ ID NO: 1972)
T86235_T13 (SEQ ID NO: 1973)
T86235_T14 (SEQ ID NO: 1974)
T86235_T15 (SEQ ID NO: 1975)
T86235_T16 (SEQ ID NO: 1976)
T86235_T18 (SEQ ID NO: 1977)
T86235_T21 (SEQ ID NO: 1978)
T86235_T22 (SEQ ID NO: 1979)
T86235_T23 (SEQ ID NO: 1980)
T86235_T24 (SEQ ID NO: 1981)
T86235_T25 (SEQ ID NO: 1982)

TABLE 1862-continued

Transcripts of interest
Transcript Name

T86235_T26 (SEQ ID NO: 1983)
T86235_T28 (SEQ ID NO: 1984)
T86235_T29 (SEQ ID NO: 1985)
T86235_T31 (SEQ ID NO: 1986)
T86235_T32 (SEQ ID NO: 1987)
T86235_T33 (SEQ ID NO: 1988)
T86235_T34 (SEQ ID NO: 1989)
T86235_T35 (SEQ ID NO: 1990)
T86235_T36 (SEQ ID NO: 1991)
T86235_T37 (SEQ ID NO: 1992)
T86235_T38 (SEQ ID NO: 1993)
T86235_T39 (SEQ ID NO: 1994)
T86235_T40 (SEQ ID NO: 1995)

TABLE 1863

Segments of interest
Segment Name

T86235_node_3 (SEQ ID NO: 1996)
T86235_node_19 (SEQ ID NO: 1997)
T86235_node_21 (SEQ ID NO: 1998)
T86235_node_25 (SEQ ID NO: 1999)
T86235_node_35 (SEQ ID NO: 2000)
T86235_node_36 (SEQ ID NO: 2001)
T86235_node_41 (SEQ ID NO: 2002)
T86235_node_42 (SEQ ID NO: 2003)
T86235_node_43 (SEQ ID NO: 2004)
T86235_node_44 (SEQ ID NO: 2005)
T86235_node_51 (SEQ ID NO: 2006)
T86235_node_56 (SEQ ID NO: 2007)
T86235_node_57 (SEQ ID NO: 2008)
T86235_node_58 (SEQ ID NO: 2009)
T86235_node_59 (SEQ ID NO: 2010)
T86235_node_0 (SEQ ID NO: 2011)
T86235_node_4 (SEQ ID NO: 2012)
T86235_node_6 (SEQ ID NO: 2013)
T86235_node_7 (SEQ ID NO: 2014)
T86235_node_9 (SEQ ID NO: 2015)
T86235_node_10 (SEQ ID NO: 2016)
T86235_node_11 (SEQ ID NO: 2017)
T86235_node_12 (SEQ ID NO: 2018)
T86235_node_13 (SEQ ID NO: 2019)
T86235_node_14 (SEQ ID NO: 2020)
T86235_node_15 (SEQ ID NO: 2021)
T86235_node_16 (SEQ ID NO: 2022)
T86235_node_17 (SEQ ID NO: 2023)
T86235_node_18 (SEQ ID NO: 2024)
T86235_node_22 (SEQ ID NO: 2025)
T86235_node_23 (SEQ ID NO: 2026)
T86235_node_27 (SEQ ID NO: 2027)
T86235_node_29 (SEQ ID NO: 2028)
T86235_node_31 (SEQ ID NO: 2029)
T86235_node_32 (SEQ ID NO: 2030)
T86235_node_33 (SEQ ID NO: 2031)
T86235_node_38 (SEQ ID NO: 2032)
T86235_node_40 (SEQ ID NO: 2033)
T86235_node_45 (SEQ ID NO: 2034)
T86235_node_46 (SEQ ID NO: 2035)
T86235_node_47 (SEQ ID NO: 2036)
T86235_node_48 (SEQ ID NO: 2037)
T86235_node_49 (SEQ ID NO: 2038)
T86235_node_50 (SEQ ID NO: 2039)
T86235_node_52 (SEQ ID NO: 2040)
T86235_node_54 (SEQ ID NO: 2041)
T86235_node_55 (SEQ ID NO: 2042)

TABLE 1864

Proteins of interest

| Protein Name | Corresponding Transcript(s) |
| --- | --- |
| T86235_P1 | T86235_T14 (SEQ ID NO: 1974); |
|  | T86235_T15 (SEQ ID NO: 1975); |
|  | T86235_T18 (SEQ ID NO: 1977); |
|  | T86235_T21 (SEQ ID NO: 1978); |
|  | T86235_T25 (SEQ ID NO: 1982) |
| T86235_P2 | T86235_T2 (SEQ ID NO: 1963) |
| T86235_P3 | T86235_T3 (SEQ ID NO: 1964) |
| T86235_P4 | T86235_T4 (SEQ ID NO: 1965) |
| T86235_P5 | T86235_T5 (SEQ ID NO: 1966); |
|  | T86235_T23 (SEQ ID NO: 1980) |
| T86235_P6 | T86235_T6 (SEQ ID NO: 1967) |
| T86235_P7 | T86235_T7 (SEQ ID NO: 1968); |
|  | T86235_T8 (SEQ ID NO: 1969); |
|  | T86235_T9 (SEQ ID NO: 1970); |
|  | T86235_T26 (SEQ ID NO: 1983) |
| T86235_P8 | T86235_T10 (SEQ ID NO: 1971); |
|  | T86235_T24 (SEQ ID NO: 1981) |
| T86235_P10 | T86235_T12 (SEQ ID NO: 1972) |
| T86235_P11 | T86235_T13 (SEQ ID NO: 1973) |
| T86235_P12 | T86235_T16 (SEQ ID NO: 1976); |
|  | T86235_T22 (SEQ ID NO: 1979) |
| T86235_P14 | T86235_T28 (SEQ ID NO: 1984) |
| T86235_P15 | T86235_T29 (SEQ ID NO: 1985); |
|  | T86235_T31 (SEQ ID NO: 1986) |
| T86235_P17 | T86235_T32 (SEQ ID NO: 1987); |
|  | T86235_T35 (SEQ ID NO: 1990) |
| T86235_P18 | T86235_T33 (SEQ ID NO: 1988); |
|  | T86235_T37 (SEQ ID NO: 1992) |
| T86235_P19 | T86235_T34 (SEQ ID NO: 1989) |
| T86235_P20 | T86235_T36 (SEQ ID NO: 1991) |
| T86235_P21 | T86235_T39 (SEQ ID NO: 1994) |
| T86235_P22 | T86235_T40 (SEQ ID NO: 1995) |
| T86235_P28 | T86235_T1 (SEQ ID NO: 1962) |

These sequences are variants of the known protein Trophinin-associated protein (SwissProt accession identifier TAST_HUMAN; known also according to the synonyms Tastin; Trophinin-assisting protein), referred to herein as the previously known protein.

Protein Trophinin-associated protein is known or believed to have the following function(s): Could be involved with bystin and trophinin in a cell adhesion molecule complex that mediates an initial attachment of the blastocyst to uterine epithelial cells at the time of the embryo implantation. The sequence for protein Trophinin-associated protein is given at the end of the application, as "Trophinin-associated protein amino acid sequence". Protein Trophinin-associated protein localization is believed to be Cytoplasmic.

The following GO Annotation(s) apply to the previously known protein. The following annotation(s) were found: cell adhesion, which are annotation(s) related to Biological Process; protein binding, which are annotation(s) related to Molecular Function; and cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T86235 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 49 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 49 and Table 1865. This cluster is overexpressed (at least at a minimum level) in the following pathological conditions: brain malignant tumors, epithelial malignant tumors, a mixture of malignant tumors from different tissues and skin malignancies.

TABLE 1865

Normal tissue distribution

| Name of Tissue | Number |
| --- | --- |
| Adrenal | 0 |
| Bladder | 0 |
| Bone | 0 |
| Brain | 0 |
| Colon | 0 |
| Epithelial | 2 |
| General | 3 |
| Kidney | 0 |
| Liver | 0 |
| Lung | 0 |
| lymph nodes | 26 |
| Breast | 17 |
| bone marrow | 0 |
| Muscle | 1 |
| Ovary | 0 |
| Pancreas | 0 |
| Prostate | 0 |
| Skin | 0 |
| Stomach | 36 |
| Uterus | 4 |

TABLE 1866

P values and ratios for expression in cancerous tissue

| Name of Tissue | P1 | P2 | SP1 | R3 | SP2 | R4 |
| --- | --- | --- | --- | --- | --- | --- |
| Adrenal | 4.2e−01 | 4.6e−01 | 2.1e−01 | 3.4 | 2.9e−01 | 2.7 |
| Bladder | 1.2e−01 | 1.8e−01 | 1.0e−01 | 4.1 | 2.1e−01 | 2.9 |
| Bone | 1 | 4.3e−01 | 1 | 1.0 | 4.9e−01 | 1.9 |
| Brain | 2.6e−02 | 3.0e−03 | 2.4e−05 | 17.5 | 1.6e−06 | 18.9 |
| Colon | 1.7e−01 | 1.0e−01 | 4.9e−01 | 2.0 | 3.5e−01 | 2.3 |
| Epithelial | 1.7e−04 | 3.0e−06 | 1.7e−05 | 7.4 | 2.4e−09 | 9.4 |
| General | 8.2e−08 | 1.2e−12 | 2.9e−12 | 8.5 | 4.4e−24 | 11.1 |
| Kidney | 4.3e−01 | 3.7e−01 | 5.8e−01 | 1.7 | 4.9e−01 | 1.9 |
| Liver | 1 | 6.8e−01 | 1 | 1.0 | 6.9e−01 | 1.4 |
| Lung | 2.4e−01 | 2.5e−01 | 4.1e−01 | 2.6 | 2.4e−01 | 2.9 |
| lymph nodes | 6.3e−01 | 4.6e−01 | 1 | 0.8 | 1.3e−01 | 1.8 |
| Breast | 9.5e−01 | 7.3e−01 | 1 | 0.7 | 5.6e−01 | 1.2 |
| bone marrow | 1 | 4.2e−01 | 1 | 1.0 | 4.3e−02 | 4.5 |
| Muscle | 9.2e−01 | 4.8e−01 | 1 | 0.9 | 3.9e−01 | 2.3 |
| Ovary | 6.2e−01 | 4.2e−01 | 6.8e−01 | 1.5 | 4.5e−01 | 1.9 |
| Pancreas | 3.3e−01 | 4.4e−01 | 4.2e−01 | 2.4 | 5.3e−01 | 1.9 |
| Prostate | 5.3e−01 | 3.5e−01 | 4.5e−01 | 2.0 | 1.8e−01 | 2.7 |
| Skin | 1 | 6.9e−02 | 1 | 1.0 | 5.4e−04 | 4.9 |
| Stomach | 5.0e−01 | 6.1e−01 | 7.5e−01 | 1.0 | 8.2e−01 | 0.9 |
| Uterus | 2.4e−01 | 1.7e−01 | 8.5e−02 | 3.0 | 6.9e−02 | 3.2 |

As noted above, cluster T86235 features 47 segment(s), which were listed in Table 1863 above and for which the sequence(s) are given at the end of the application. These segment(s) are portions of nucleic acid sequence(s) which are described herein separately because they are of particular interest. A description of each segment according to the present invention is now provided.

Segment cluster T86235_node_3 (SEQ ID NO:1996) according to the present invention is supported by 18 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1867 below describes the starting and ending position of this segment on each transcript.

TABLE 1867

Segment location on transcripts

| Transcript name | Segment starting position | Segment ending position |
| --- | --- | --- |
| T86235_T1 (SEQ ID NO: 1962) | 85 | 227 |
| T86235_T2 (SEQ ID NO: 1963) | 85 | 227 |
| T86235_T3 (SEQ ID NO: 1964) | 85 | 227 |
| T86235_T4 (SEQ ID NO: 1965) | 85 | 227 |
| T86235_T5 (SEQ ID NO: 1966) | 85 | 227 |
| T86235_T6 (SEQ ID NO: 1967) | 85 | 227 |
| T86235_T7 (SEQ ID NO: 1968) | 85 | 227 |
| T86235_T8 (SEQ ID NO: 1969) | 85 | 227 |
| T86235_T9 (SEQ ID NO: 1970) | 85 | 227 |
| T86235_T10 (SEQ ID NO: 1971) | 85 | 227 |
| T86235_T12 (SEQ ID NO: 1972) | 85 | 227 |
| T86235_T13 (SEQ ID NO: 1973) | 85 | 227 |
| T86235_T14 (SEQ ID NO: 1974) | 85 | 227 |
| T86235_T15 (SEQ ID NO: 1975) | 85 | 227 |
| T86235_T16 (SEQ ID NO: 1976) | 85 | 227 |
| T86235_T18 (SEQ ID NO: 1977) | 85 | 227 |
| T86235_T21 (SEQ ID NO: 1978) | 85 | 227 |
| T86235_T22 (SEQ ID NO: 1979) | 85 | 227 |
| T86235_T23 (SEQ ID NO: 1980) | 85 | 227 |
| T86235_T24 (SEQ ID NO: 1981) | 85 | 227 |
| T86235_T25 (SEQ ID NO: 1982) | 85 | 227 |
| T86235_T28 (SEQ ID NO: 1984) | 85 | 227 |
| T86235_T29 (SEQ ID NO: 1985) | 85 | 227 |
| T86235_T31 (SEQ ID NO: 1986) | 85 | 227 |
| T86235_T32 (SEQ ID NO: 1987) | 85 | 227 |
| T86235_T33 (SEQ ID NO: 1988) | 85 | 227 |
| T86235_T34 (SEQ ID NO: 1989) | 85 | 227 |
| T86235_T35 (SEQ ID NO: 1990) | 85 | 227 |
| T86235_T36 (SEQ ID NO: 1991) | 85 | 227 |
| T86235_T37 (SEQ ID NO: 1992) | 85 | 227 |
| T86235_T39 (SEQ ID NO: 1994) | 85 | 227 |
| T86235_T40 (SEQ ID NO: 1995) | 85 | 227 |

This segment can be found in a non-coding region of transcript(s) that are related to the following protein(s): T86235_P28, T86235_P2, T86235_P3, T86235_P4, T86235_P5, T86235_P6, T86235_P7, T86235_P8, T86235_P10, T86235_P11, T86235_P1, T86235_P12, T86235_P14, T86235_P15, T86235_P17, T86235_P18, T86235_P19, T86235_P20, T86235_P21 and T86235_P22.

Segment cluster T86235_node__19 (SEQ ID NO:1997) according to the present invention is supported by 38 libraries. The number of libraries was determined as previously described. This segment can be found in the following transcript(s): T86235_T29 (SEQ ID NO:1985), T86235_T31 (SEQ ID NO:1986), T86235_T32 (SEQ ID NO:1987), T86235_T33 (SEQ ID NO:1988), T86235_T35 (SEQ ID NO:1990), T86235_T36 (SEQ ID NO:1991), T86235_T37 (SEQ ID NO:1992) and (SEQ ID NO:1994). Table 1868 below describes the starting and ending position of this segment on each transcript.

TABLE 1868

Segment location on transcripts

| Transcript name | Segment starting position | Segment ending position |
| --- | --- | --- |
| T86235_T29 (SEQ ID NO: 1985) | 645 | 1296 |
| T86235_T31 (SEQ ID NO: 1986) | 645 | 786 |
| T86235_T32 (SEQ ID NO: 1987) | 721 | 862 |
| T86235_T33 (SEQ ID NO: 1988) | 838 | 1489 |
| T86235_T35 (SEQ ID NO: 1990) | 721 | 1372 |
| T86235_T36 (SEQ ID NO: 1991) | 664 | 805 |
| T86235_T37 (SEQ ID NO: 1992) | 838 | 979 |
| T86235_T39 (SEQ ID NO: 1994) | 554 | 695 |

This segment can be found in both coding and non-coding regions of transcript(s) as follows. The segment can be found in a non-coding region of transcript(s) that are related to the following protein(s): T86235_P18. This segment can also be found in the following protein(s): T86235_P15, T86235_P17, T86235_P20 and T86235_P21, since it is in the coding region for the corresponding transcript.

Segment cluster T86235_node__21 (SEQ ID NO:1998) according to the present invention is supported by 1 libraries. The number of libraries was determined as previously described. This segment can be found in the following transcript(s): T86235_T38 (SEQ ID NO:1993). Table 1869 below describes the starting and ending position of this segment on each transcript.

TABLE 1869

Segment location on transcripts

| Transcript name | Segment starting position | Segment ending position |
| --- | --- | --- |
| T86235_T38 (SEQ ID NO: 1993) | 1 | 150 |

The previously-described transcripts for these segment(s) do not code for protein.

Segment cluster T86235_node__25 (SEQ ID NO:1999) according to the present invention is supported by 42 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980) and T86235_T24 (SEQ ID NO:1981). Table 1870 below describes the starting and ending position of this segment on each transcript.

TABLE 1870

Segment location on transcripts

| Transcript name | Segment starting position | Segment ending position |
|---|---|---|
| T86235_T1 (SEQ ID NO: 1962) | 799 | 936 |
| T86235_T2 (SEQ ID NO: 1963) | 799 | 936 |
| T86235_T3 (SEQ ID NO: 1964) | 799 | 936 |
| T86235_T4 (SEQ ID NO: 1965) | 799 | 936 |
| T86235_T5 (SEQ ID NO: 1966) | 799 | 936 |
| T86235_T6 (SEQ ID NO: 1967) | 799 | 936 |
| T86235_T7 (SEQ ID NO: 1968) | 799 | 936 |
| T86235_T8 (SEQ ID NO: 1969) | 799 | 936 |
| T86235_T9 (SEQ ID NO: 1970) | 799 | 936 |
| T86235_T10 (SEQ ID NO: 1971) | 799 | 936 |
| T86235_T12 (SEQ ID NO: 1972) | 799 | 936 |
| T86235_T13 (SEQ ID NO: 1973) | 799 | 936 |
| T86235_T14 (SEQ ID NO: 1974) | 799 | 936 |
| T86235_T15 (SEQ ID NO: 1975) | 708 | 845 |
| T86235_T16 (SEQ ID NO: 1976) | 799 | 936 |
| T86235_T18 (SEQ ID NO: 1977) | 701 | 838 |
| T86235_T21 (SEQ ID NO: 1978) | 448 | 585 |
| T86235_T22 (SEQ ID NO: 1979) | 799 | 936 |
| T86235_T23 (SEQ ID NO: 1980) | 708 | 845 |
| T86235_T24 (SEQ ID NO: 1981) | 708 | 845 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28 and T86235_P12, since it is in the coding region for the corresponding transcript.

Segment cluster T86235_node_35 (SEQ ID NO:2000) according to the present invention is supported by 1 libraries. The number of libraries was determined as previously described. This segment can be found in the following transcript(s): T86235_T26 (SEQ ID NO:1983). Table 1871 below describes the starting and ending position of this segment on each transcript.

TABLE 1871

Segment location on transcripts

| Transcript name | Segment starting position | Segment ending position |
|---|---|---|
| T86235_T26 (SEQ ID NO: 1983) | 1 | 294 |

This segment can be found in a non-coding region of transcript(s) that are related to the following protein(s): T86235_P7.

Segment cluster T86235_node_36 (SEQ ID NO:2001) according to the present invention is supported by 30 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982), T86235_T26 (SEQ ID NO:1983) and T86235_T34 (SEQ ID NO:1989). Table 1872 below describes the starting and ending position of this segment on each transcript.

TABLE 1872

Segment location on transcripts

| Transcript name | Segment starting position | Segment ending position |
|---|---|---|
| T86235_T1 (SEQ ID NO: 1962) | 1196 | 1324 |
| T86235_T2 (SEQ ID NO: 1963) | 1196 | 1324 |
| T86235_T3 (SEQ ID NO: 1964) | 1196 | 1324 |
| T86235_T4 (SEQ ID NO: 1965) | 1196 | 1324 |
| T86235_T5 (SEQ ID NO: 1966) | 1196 | 1324 |
| T86235_T6 (SEQ ID NO: 1967) | 1196 | 1324 |
| T86235_T7 (SEQ ID NO: 1968) | 1196 | 1324 |
| T86235_T8 (SEQ ID NO: 1969) | 1196 | 1324 |
| T86235_T9 (SEQ ID NO: 1970) | 1196 | 1324 |
| T86235_T10 (SEQ ID NO: 1971) | 1196 | 1324 |
| T86235_T12 (SEQ ID NO: 1972) | 1196 | 1324 |
| T86235_T13 (SEQ ID NO: 1973) | 1196 | 1324 |
| T86235_T14 (SEQ ID NO: 1974) | 1178 | 1306 |
| T86235_T15 (SEQ ID NO: 1975) | 1105 | 1233 |
| T86235_T16 (SEQ ID NO: 1976) | 1196 | 1324 |
| T86235_T18 (SEQ ID NO: 1977) | 1098 | 1226 |
| T86235_T21 (SEQ ID NO: 1978) | 845 | 973 |
| T86235_T23 (SEQ ID NO: 1980) | 1105 | 1233 |
| T86235_T24 (SEQ ID NO: 1981) | 1105 | 1233 |
| T86235_T25 (SEQ ID NO: 1982) | 654 | 782 |
| T86235_T26 (SEQ ID NO: 1983) | 295 | 423 |
| T86235_T34 (SEQ ID NO: 1989) | 654 | 782 |

This segment can be found in both coding and non-coding regions of transcript(s) as follows. The segment can be found in a non-coding region of transcript(s) that are related to the following protein(s): T86235_P7, T86235_P11 and T86235_P12. This segment can also be found in the following protein(s): T86235_P28, T86235_P2, T86235_P3, T86235_P4, T86235_P5, T86235_P6, T86235_P8, T86235_P10, T86235_P1 and T86235_P19, since it is in the coding region for the corresponding transcript.

Segment cluster T86235_node_41 (SEQ ID NO:2002) according to the present invention is supported by 9 libraries. The number of libraries was determined as previously described. This segment can be found in the following transcript(s): T86235_T7 (SEQ ID NO:1968), T86235_T9 (SEQ ID NO:1970), T86235_T13 (SEQ ID NO:1973) and T86235_T26 (SEQ ID NO:1983). Table 1873 below describes the starting and ending position of this segment on each transcript.

TABLE 1873

Segment location on transcripts

| Transcript name | Segment starting position | Segment ending position |
|---|---|---|
| T86235_T7 (SEQ ID NO: 1968) | 1469 | 1870 |
| T86235_T9 (SEQ ID NO: 1970) | 1469 | 1870 |
| T86235_T13 (SEQ ID NO: 1973) | 1469 | 1870 |
| T86235_T26 (SEQ ID NO: 1983) | 568 | 969 |

This segment can be found in a non-coding region of transcript(s) that are related to the following protein(s): T86235_P7 and T86235_P11.

Segment cluster T86235_node_42 (SEQ ID NO:2003) according to the present invention is supported by 30 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982), T86235_T26 (SEQ ID NO:1983) and T86235_T34 (SEQ ID NO:1989). Table 1874 below describes the starting and ending position of this segment on each transcript.

TABLE 1874

Segment location on transcripts

| Transcript name | Segment starting position | Segment ending position |
|---|---|---|
| T86235_T1 (SEQ ID NO: 1962) | 1469 | 1603 |
| T86235_T2 (SEQ ID NO: 1963) | 1469 | 1603 |
| T86235_T3 (SEQ ID NO: 1964) | 1469 | 1603 |
| T86235_T4 (SEQ ID NO: 1965) | 1469 | 1603 |
| T86235_T5 (SEQ ID NO: 1966) | 1469 | 1603 |
| T86235_T6 (SEQ ID NO: 1967) | 1469 | 1603 |
| T86235_T7 (SEQ ID NO: 1968) | 1871 | 2005 |
| T86235_T8 (SEQ ID NO: 1969) | 1469 | 1603 |
| T86235_T9 (SEQ ID NO: 1970) | 1871 | 2005 |
| T86235_T10 (SEQ ID NO: 1971) | 1469 | 1603 |
| T86235_T13 (SEQ ID NO: 1973) | 1871 | 2005 |
| T86235_T14 (SEQ ID NO: 1974) | 1451 | 1585 |
| T86235_T15 (SEQ ID NO: 1975) | 1378 | 1512 |
| T86235_T16 (SEQ ID NO: 1976) | 1469 | 1603 |
| T86235_T18 (SEQ ID NO: 1977) | 1371 | 1505 |
| T86235_T21 (SEQ ID NO: 1978) | 1118 | 1252 |
| T86235_T23 (SEQ ID NO: 1980) | 1378 | 1512 |
| T86235_T24 (SEQ ID NO: 1981) | 1378 | 1512 |
| T86235_T25 (SEQ ID NO: 1982) | 927 | 1061 |
| T86235_T26 (SEQ ID NO: 1983) | 970 | 1104 |
| T86235_T34 (SEQ ID NO: 1989) | 927 | 1061 |

This segment can be found in both coding and non-coding regions of transcript(s) as follows. The segment can be found in a non-coding region of transcript(s) that are related to the following protein(s): T86235_P7, T86235_P11 and T86235_P12. This segment can also be found in the following protein(s): T86235_P28, T86235_P2, T86235_P3, T86235_P4, T86235_P5, T86235_P6, T86235_P8, T86235_P1 and T86235_P19, since it is in the coding region for the corresponding transcript.

Segment cluster T86235_node_43 (SEQ ID NO:2004) according to the present invention is supported by 4 libraries. The number of libraries was determined as previously described. This segment can be found in the following transcript(s): T86235_T8 (SEQ ID NO:1969) and T86235_T9 (SEQ ID NO:1970). Table 1875 below describes the starting and ending position of this segment on each transcript.

TABLE 1875

Segment location on transcripts

| Transcript name | Segment starting position | Segment ending position |
|---|---|---|
| T86235_T8 (SEQ ID NO: 1969) | 1604 | 1756 |
| T86235_T9 (SEQ ID NO: 1970) | 2006 | 2158 |

This segment can be found in a non-coding region of transcript(s) that are related to the following protein(s): T86235_P7.

Segment cluster T86235_node_44 (SEQ ID NO:2005) according to the present invention is supported by 41 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982) and T86235_T26 (SEQ ID NO:1983). Table 1876 below describes the starting and ending position of this segment on each transcript.

TABLE 1876

Segment location on transcripts

| Transcript name | Segment starting position | Segment ending position |
|---|---|---|
| T86235_T1 (SEQ ID NO: 1962) | 1604 | 1887 |
| T86235_T2 (SEQ ID NO: 1963) | 1604 | 1887 |
| T86235_T3 (SEQ ID NO: 1964) | 1604 | 1887 |
| T86235_T4 (SEQ ID NO: 1965) | 1604 | 1887 |
| T86235_T5 (SEQ ID NO: 1966) | 1604 | 1887 |
| T86235_T6 (SEQ ID NO: 1967) | 1604 | 1887 |
| T86235_T7 (SEQ ID NO: 1968) | 2006 | 2289 |
| T86235_T8 (SEQ ID NO: 1969) | 1757 | 2040 |
| T86235_T9 (SEQ ID NO: 1970) | 2159 | 2442 |
| T86235_T10 (SEQ ID NO: 1971) | 1604 | 1887 |
| T86235_T12 (SEQ ID NO: 1972) | 1469 | 1752 |
| T86235_T13 (SEQ ID NO: 1973) | 2006 | 2289 |
| T86235_T14 (SEQ ID NO: 1974) | 1586 | 1869 |
| T86235_T15 (SEQ ID NO: 1975) | 1513 | 1796 |
| T86235_T18 (SEQ ID NO: 1977) | 1506 | 1789 |
| T86235_T21 (SEQ ID NO: 1978) | 1253 | 1536 |
| T86235_T23 (SEQ ID NO: 1980) | 1513 | 1796 |
| T86235_T24 (SEQ ID NO: 1981) | 1513 | 1796 |
| T86235_T25 (SEQ ID NO: 1982) | 1062 | 1345 |
| T86235_T26 (SEQ ID NO: 1983) | 1105 | 1388 |

This segment can be found in the following protein(s): T86235_P28, T86235_P2, T86235_P3, T86235_P4, T86235_P5, T86235_P6, T86235_P7, T86235_P8, T86235_P10, T86235_P11 and T86235_P1.

Segment cluster T86235_node_51 (SEQ ID NO:2006) according to the present invention is supported by 45 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T12

(SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T25 (SEQ ID NO:1982) and T86235_T26 (SEQ ID NO:1983). Table 1877 below describes the starting and ending position of this segment on each transcript.

TABLE 1877

Segment location on transcripts

| Transcript name | Segment starting position | Segment ending position |
|---|---|---|
| T86235_T1 (SEQ ID NO: 1962) | 2214 | 2352 |
| T86235_T2 (SEQ ID NO: 1963) | 2127 | 2265 |
| T86235_T3 (SEQ ID NO: 1964) | 2214 | 2352 |
| T86235_T4 (SEQ ID NO: 1965) | 2214 | 2352 |
| T86235_T6 (SEQ ID NO: 1967) | 2214 | 2352 |
| T86235_T7 (SEQ ID NO: 1968) | 2616 | 2754 |
| T86235_T8 (SEQ ID NO: 1969) | 2367 | 2505 |
| T86235_T9 (SEQ ID NO: 1970) | 2769 | 2907 |
| T86235_T12 (SEQ ID NO: 1972) | 2079 | 2217 |
| T86235_T13 (SEQ ID NO: 1973) | 2616 | 2754 |
| T86235_T14 (SEQ ID NO: 1974) | 2196 | 2334 |
| T86235_T15 (SEQ ID NO: 1975) | 2123 | 2261 |
| T86235_T18 (SEQ ID NO: 1977) | 2116 | 2254 |
| T86235_T21 (SEQ ID NO: 1978) | 1863 | 2001 |
| T86235_T25 (SEQ ID NO: 1982) | 1672 | 1810 |
| T86235_T26 (SEQ ID NO: 1983) | 1715 | 1853 |

This segment can be found in the following protein(s): T86235_P28, T86235_P2, T86235_P3, T86235_P4, T86235_P6, T86235_P7, T86235_P10, T86235_P11 and T86235_P1.

Segment cluster T86235_node__56 (SEQ ID NO:2007) according to the present invention is supported by 22 libraries. The number of libraries was determined as previously described. This segment can be found in the following transcript(s): (SEQ ID NO:1964), T86235_T4 (SEQ ID NO:1965), T86235_T13 (SEQ ID NO:1973), T86235_T28 (SEQ ID NO:1984) and T86235_T38 (SEQ ID NO:1993). Table 1878 below describes the starting and ending position of this segment on each transcript.

TABLE 1878

Segment location on transcripts

| Transcript name | Segment starting position | Segment ending position |
|---|---|---|
| T86235_T3 (SEQ ID NO: 1964) | 2403 | 2672 |
| T86235_T4 (SEQ ID NO: 1965) | 2403 | 2672 |
| T86235_T13 (SEQ ID NO: 1973) | 2805 | 3074 |
| T86235_T28 (SEQ ID NO: 1984) | 827 | 1096 |
| T86235_T38 (SEQ ID NO: 1993) | 337 | 606 |

This segment can be found in the following protein(s): T86235_P3, T86235_P4, T86235_P11 and T86235_P14.

Segment cluster T86235_node__57 (SEQ ID NO:2008) according to the present invention is supported by 53 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982), T86235_T26 (SEQ ID NO:1983), T86235_T28 (SEQ ID NO:1984), T86235_T34 (SEQ ID NO:1989), T86235_T38 (SEQ ID NO:1993) and T86235_T40 (SEQ ID NO:1995). Table 1879 below describes the starting and ending position of this segment on each transcript.

TABLE 1879

Segment location on transcripts

| Transcript name | Segment starting position | Segment ending position |
|---|---|---|
| T86235_T1 (SEQ ID NO: 1962) | 2403 | 2596 |
| T86235_T2 (SEQ ID NO: 1963) | 2316 | 2509 |
| T86235_T3 (SEQ ID NO: 1964) | 2673 | 2866 |
| T86235_T4 (SEQ ID NO: 1965) | 2673 | 2866 |
| T86235_T5 (SEQ ID NO: 1966) | 2033 | 2226 |
| T86235_T6 (SEQ ID NO: 1967) | 2399 | 2592 |
| T86235_T7 (SEQ ID NO: 1968) | 2805 | 2998 |
| T86235_T8 (SEQ ID NO: 1969) | 2556 | 2749 |
| T86235_T9 (SEQ ID NO: 1970) | 2958 | 3151 |
| T86235_T10 (SEQ ID NO: 1971) | 2083 | 2276 |
| T86235_T12 (SEQ ID NO: 1972) | 2268 | 2461 |
| T86235_T13 (SEQ ID NO: 1973) | 3075 | 3268 |
| T86235_T14 (SEQ ID NO: 1974) | 2385 | 2578 |
| T86235_T15 (SEQ ID NO: 1975) | 2312 | 2505 |
| T86235_T16 (SEQ ID NO: 1976) | 1604 | 1797 |
| T86235_T18 (SEQ ID NO: 1977) | 2305 | 2498 |
| T86235_T21 (SEQ ID NO: 1978) | 2052 | 2245 |
| T86235_T23 (SEQ ID NO: 1980) | 1942 | 2135 |
| T86235_T24 (SEQ ID NO: 1981) | 1992 | 2185 |
| T86235_T25 (SEQ ID NO: 1982) | 1861 | 2054 |
| T86235_T26 (SEQ ID NO: 1983) | 1904 | 2097 |
| T86235_T28 (SEQ ID NO: 1984) | 1097 | 1290 |
| T86235_T34 (SEQ ID NO: 1989) | 1062 | 1255 |
| T86235_T38 (SEQ ID NO: 1993) | 607 | 800 |
| T86235_T40 (SEQ ID NO: 1995) | 487 | 680 |

This segment can be found in both coding and non-coding regions of transcript(s) as follows. The segment can be found in a non-coding region of transcript(s) that are related to the following protein(s): T86235_P12. This segment can also be found in the following protein(s): T86235_P28, T86235_P2, T86235_P3, T86235_P4, T86235_P5, T86235_P6, T86235_P7, T86235_P8, T86235_P10, T86235_P11, T86235_P1, T86235_P14, T86235_P19 and T86235_P22, since it is in the coding region for the corresponding transcript.

Segment cluster T86235_node__58 (SEQ ID NO:2009) according to the present invention is supported by 5 libraries. The number of libraries was determined as previously described. This segment can be found in the following transcript(s): T86235_T4 (SEQ ID NO:1965). Table 1880 below describes the starting and ending position of this segment on each transcript.

TABLE 1880

Segment location on transcripts

| Transcript name | Segment starting position | Segment ending position |
|---|---|---|
| T86235_T4 (SEQ ID NO: 1965) | 2867 | 3031 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1881.

TABLE 1881

Oligonucleotides related to this segment

| Oligonucleotide name | Overexpressed in cancers | Chip reference |
|---|---|---|
| T86235_0_0_57380 | lung malignant tumors | LUN |

This segment can be found in the following protein(s): T86235_P4.

Segment cluster T86235_node_59 (SEQ ID NO:2010) according to the present invention is supported by 46 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982), T86235_T26 (SEQ ID NO:1983), T86235_T28 (SEQ ID NO:1984), T86235_T34 (SEQ ID NO:1989), T86235_T38 (SEQ ID NO:1993) and T86235_T40 (SEQ ID NO:1995). Table 1882 below describes the starting and ending position of this segment on each transcript.

TABLE 1882

Segment location on transcripts

| Transcript name | Segment starting position | Segment ending position |
|---|---|---|
| T86235_T1 (SEQ ID NO: 1962) | 2597 | 2761 |
| T86235_T2 (SEQ ID NO: 1963) | 2510 | 2674 |
| T86235_T3 (SEQ ID NO: 1964) | 2867 | 3031 |
| T86235_T4 (SEQ ID NO: 1965) | 3032 | 3196 |
| T86235_T5 (SEQ ID NO: 1966) | 2227 | 2391 |
| T86235_T6 (SEQ ID NO: 1967) | 2593 | 2757 |
| T86235_T7 (SEQ ID NO: 1968) | 2999 | 3163 |
| T86235_T8 (SEQ ID NO: 1969) | 2750 | 2914 |
| T86235_T9 (SEQ ID NO: 1970) | 3152 | 3316 |
| T86235_T10 (SEQ ID NO: 1971) | 2277 | 2441 |
| T86235_T12 (SEQ ID NO: 1972) | 2462 | 2626 |
| T86235_T13 (SEQ ID NO: 1973) | 3269 | 3433 |
| T86235_T14 (SEQ ID NO: 1974) | 2579 | 2743 |
| T86235_T15 (SEQ ID NO: 1975) | 2506 | 2670 |
| T86235_T16 (SEQ ID NO: 1976) | 1798 | 1962 |
| T86235_T18 (SEQ ID NO: 1977) | 2499 | 2663 |
| T86235_T21 (SEQ ID NO: 1978) | 2246 | 2410 |
| T86235_T23 (SEQ ID NO: 1980) | 2136 | 2300 |
| T86235_T24 (SEQ ID NO: 1981) | 2186 | 2350 |
| T86235_T25 (SEQ ID NO: 1982) | 2055 | 2219 |
| T86235_T26 (SEQ ID NO: 1983) | 2098 | 2262 |
| T86235_T28 (SEQ ID NO: 1984) | 1291 | 1455 |
| T86235_T34 (SEQ ID NO: 1989) | 1256 | 1420 |
| T86235_T38 (SEQ ID NO: 1993) | 801 | 965 |
| T86235_T40 (SEQ ID NO: 1995) | 681 | 845 |

This segment can be found in both coding and non-coding regions of transcript(s) as follows. The segment can be found in a non-coding region of transcript(s) that are related to the following protein(s): T86235_P4, T86235_P5, T86235_P6, T86235_P8, T86235_P12 and T86235_P19. This segment can also be found in the following protein(s): T86235_P28, T86235_P2, T86235_P3, T86235_P7, T86235_P10, T86235_P11, T86235_P1, T86235_P14 and T86235_P22, since it is in the coding region for the corresponding transcript.

According to an optional embodiment of the present invention, short segments related to the above cluster are also provided. These segments are up to about 120 bp in length, and so are included in a separate description.

Segment cluster T86235_node_0 (SEQ ID NO:2011) according to the present invention is supported by 1 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1883 below describes the starting and ending position of this segment on each transcript.

TABLE 1883

Segment location on transcripts

| Transcript name | Segment starting position | Segment ending position |
|---|---|---|
| T86235_T1 (SEQ ID NO: 1962) | 1 | 84 |
| T86235_T2 (SEQ ID NO: 1963) | 1 | 84 |
| T86235_T3 (SEQ ID NO: 1964) | 1 | 84 |
| T86235_T4 (SEQ ID NO: 1965) | 1 | 84 |
| T86235_T5 (SEQ ID NO: 1966) | 1 | 84 |
| T86235_T6 (SEQ ID NO: 1967) | 1 | 84 |
| T86235_T7 (SEQ ID NO: 1968) | 1 | 84 |
| T86235_T8 (SEQ ID NO: 1969) | 1 | 84 |
| T86235_T9 (SEQ ID NO: 1970) | 1 | 84 |
| T86235_T10 (SEQ ID NO: 1971) | 1 | 84 |
| T86235_T12 (SEQ ID NO: 1972) | 1 | 84 |
| T86235_T13 (SEQ ID NO: 1973) | 1 | 84 |
| T86235_T14 (SEQ ID NO: 1974) | 1 | 84 |
| T86235_T15 (SEQ ID NO: 1975) | 1 | 84 |
| T86235_T16 (SEQ ID NO: 1976) | 1 | 84 |
| T86235_T18 (SEQ ID NO: 1977) | 1 | 84 |
| T86235_T21 (SEQ ID NO: 1978) | 1 | 84 |
| T86235_T22 (SEQ ID NO: 1979) | 1 | 84 |
| T86235_T23 (SEQ ID NO: 1980) | 1 | 84 |
| T86235_T24 (SEQ ID NO: 1981) | 1 | 84 |
| T86235_T25 (SEQ ID NO: 1982) | 1 | 84 |
| T86235_T28 (SEQ ID NO: 1984) | 1 | 84 |
| T86235_T29 (SEQ ID NO: 1985) | 1 | 84 |
| T86235_T31 (SEQ ID NO: 1986) | 1 | 84 |
| T86235_T32 (SEQ ID NO: 1987) | 1 | 84 |
| T86235_T33 (SEQ ID NO: 1988) | 1 | 84 |
| T86235_T34 (SEQ ID NO: 1989) | 1 | 84 |
| T86235_T35 (SEQ ID NO: 1990) | 1 | 84 |
| T86235_T36 (SEQ ID NO: 1991) | 1 | 84 |

TABLE 1883-continued

Segment location on transcripts

| Transcript name | Segment starting position | Segment ending position |
|---|---|---|
| T86235_T37 (SEQ ID NO: 1992) | 1 | 84 |
| T86235_T39 (SEQ ID NO: 1994) | 1 | 84 |
| T86235_T40 (SEQ ID NO: 1995) | 1 | 84 |

This segment can be found in a non-coding region of transcript(s) that are related to the following protein(s): T86235_P28, T86235_P2, T86235_P3, T86235_P4, T86235_P5, T86235_P6, T86235_P7, T86235_P8, T86235_P10, T86235_P11, T86235_P1, T86235_P12, T86235_P14, T86235_P15, T86235_P17, T86235_P18, T86235_P19, T86235_P20, T86235_P21 and T86235_P22.

Segment cluster T86235_node_4 (SEQ ID NO:2012) according to the present invention is supported by 61 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1884 below describes the starting and ending position of this segment on each transcript.

TABLE 1884

Segment location on transcripts

| Transcript name | Segment starting position | Segment ending position |
|---|---|---|
| T86235_T1 (SEQ ID NO: 1962) | 228 | 298 |
| T86235_T2 (SEQ ID NO: 1963) | 228 | 298 |
| T86235_T3 (SEQ ID NO: 1964) | 228 | 298 |
| T86235_T4 (SEQ ID NO: 1965) | 228 | 298 |
| T86235_T5 (SEQ ID NO: 1966) | 228 | 298 |
| T86235_T6 (SEQ ID NO: 1967) | 228 | 298 |
| T86235_T7 (SEQ ID NO: 1968) | 228 | 298 |
| T86235_T8 (SEQ ID NO: 1969) | 228 | 298 |
| T86235_T9 (SEQ ID NO: 1970) | 228 | 298 |
| T86235_T10 (SEQ ID NO: 1971) | 228 | 298 |
| T86235_T12 (SEQ ID NO: 1972) | 228 | 298 |
| T86235_T13 (SEQ ID NO: 1973) | 228 | 298 |
| T86235_T14 (SEQ ID NO: 1974) | 228 | 298 |
| T86235_T15 (SEQ ID NO: 1975) | 228 | 298 |
| T86235_T16 (SEQ ID NO: 1976) | 228 | 298 |
| T86235_T18 (SEQ ID NO: 1977) | 228 | 298 |
| T86235_T21 (SEQ ID NO: 1978) | 228 | 298 |
| T86235_T22 (SEQ ID NO: 1979) | 228 | 298 |
| T86235_T23 (SEQ ID NO: 1980) | 228 | 298 |
| T86235_T24 (SEQ ID NO: 1981) | 228 | 298 |

TABLE 1884-continued

Segment location on transcripts

| Transcript name | Segment starting position | Segment ending position |
|---|---|---|
| T86235_T25 (SEQ ID NO: 1982) | 228 | 298 |
| T86235_T28 (SEQ ID NO: 1984) | 228 | 298 |
| T86235_T29 (SEQ ID NO: 1985) | 228 | 298 |
| T86235_T31 (SEQ ID NO: 1986) | 228 | 298 |
| T86235_T32 (SEQ ID NO: 1987) | 228 | 298 |
| T86235_T33 (SEQ ID NO: 1988) | 228 | 298 |
| T86235_T34 (SEQ ID NO: 1989) | 228 | 298 |
| T86235_T35 (SEQ ID NO: 1990) | 228 | 298 |
| T86235_T36 (SEQ ID NO: 1991) | 228 | 298 |
| T86235_T37 (SEQ ID NO: 1992) | 228 | 298 |
| T86235_T39 (SEQ ID NO: 1994) | 228 | 298 |
| T86235_T40 (SEQ ID NO: 1995) | 228 | 298 |

This segment can be found in a non-coding region of transcript(s) that are related to the following protein(s): T86235_P28, T86235_P2, T86235_P3, T86235_P4, T86235_P5, T86235_P6, T86235_P7, T86235_P8, T86235_P10, T86235_P11, T86235_P1, T86235_P12, T86235_P14, T86235_P15, T86235_P17, T86235_P18, T86235_P19, T86235_P20, T86235_P21 and T86235_P22.

Segment cluster T86235_node_6 (SEQ ID NO:2013) according to the present invention is supported by 74 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1885 below describes the starting and ending position of this segment on each transcript.

TABLE 1885

Segment location on transcripts

| Transcript name | Segment starting position | Segment ending position |
|---|---|---|
| T86235_T1 (SEQ ID NO: 1962) | 299 | 358 |
| T86235_T2 (SEQ ID NO: 1963) | 299 | 358 |
| T86235_T3 (SEQ ID NO: 1964) | 299 | 358 |
| T86235_T4 (SEQ ID NO: 1965) | 299 | 358 |
| T86235_T5 (SEQ ID NO: 1966) | 299 | 358 |
| T86235_T6 (SEQ ID NO: 1967) | 299 | 358 |
| T86235_T7 (SEQ ID NO: 1968) | 299 | 358 |
| T86235_T8 (SEQ ID NO: 1969) | 299 | 358 |
| T86235_T9 (SEQ ID NO: 1970) | 299 | 358 |
| T86235_T10 (SEQ ID NO: 1971) | 299 | 358 |
| T86235_T12 (SEQ ID NO: 1972) | 299 | 358 |

TABLE 1885-continued

Segment location on transcripts

| Transcript name | Segment starting position | Segment ending position |
|---|---|---|
| T86235_T13 (SEQ ID NO: 1973) | 299 | 358 |
| T86235_T14 (SEQ ID NO: 1974) | 299 | 358 |
| T86235_T15 (SEQ ID NO: 1975) | 299 | 358 |
| T86235_T16 (SEQ ID NO: 1976) | 299 | 358 |
| T86235_T18 (SEQ ID NO: 1977) | 299 | 358 |
| T86235_T21 (SEQ ID NO: 1978) | 299 | 358 |
| T86235_T22 (SEQ ID NO: 1979) | 299 | 358 |
| T86235_T23 (SEQ ID NO: 1980) | 299 | 358 |
| T86235_T24 (SEQ ID NO: 1981) | 299 | 358 |
| T86235_T25 (SEQ ID NO: 1982) | 299 | 358 |
| T86235_T28 (SEQ ID NO: 1984) | 299 | 358 |
| T86235_T29 (SEQ ID NO: 1985) | 299 | 358 |
| T86235_T31 (SEQ ID NO: 1986) | 299 | 358 |
| T86235_T32 (SEQ ID NO: 1987) | 299 | 358 |
| T86235_T33 (SEQ ID NO: 1988) | 299 | 358 |
| T86235_T34 (SEQ ID NO: 1989) | 299 | 358 |
| T86235_T35 (SEQ ID NO: 1990) | 299 | 358 |
| T86235_T36 (SEQ ID NO: 1991) | 299 | 358 |
| T86235_T37 (SEQ ID NO: 1992) | 299 | 358 |
| T86235_T39 (SEQ ID NO: 1994) | 299 | 358 |
| T86235_T40 (SEQ ID NO: 1995) | 299 | 358 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11, T86235_P1, T86235_P19 and T86235_P22. This segment can also be found in the following protein(s): T86235_P28, T86235_P12, T86235_P14, P17, T86235_P18, T86235_P20 and T86235_P21, since it is in the coding region for the corresponding transcript.

Segment cluster T86235_node_7 (SEQ ID NO:2014) according to the present invention is supported by 73 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1886 below describes the starting and ending position of this segment on each transcript.

TABLE 1886

Segment location on transcripts

| Transcript name | Segment starting position | Segment ending position |
|---|---|---|
| T86235_T1 (SEQ ID NO: 1962) | 359 | 447 |
| T86235_T2 (SEQ ID NO: 1963) | 359 | 447 |
| T86235_T3 (SEQ ID NO: 1964) | 359 | 447 |
| T86235_T4 (SEQ ID NO: 1965) | 359 | 447 |
| T86235_T5 (SEQ ID NO: 1966) | 359 | 447 |
| T86235_T6 (SEQ ID NO: 1967) | 359 | 447 |
| T86235_T7 (SEQ ID NO: 1968) | 359 | 447 |
| T86235_T8 (SEQ ID NO: 1969) | 359 | 447 |
| T86235_T9 (SEQ ID NO: 1970) | 359 | 447 |
| T86235_T10 (SEQ ID NO: 1971) | 359 | 447 |
| T86235_T12 (SEQ ID NO: 1972) | 359 | 447 |
| T86235_T13 (SEQ ID NO: 1973) | 359 | 447 |
| T86235_T14 (SEQ ID NO: 1974) | 359 | 447 |
| T86235_T15 (SEQ ID NO: 1975) | 359 | 447 |
| T86235_T16 (SEQ ID NO: 1976) | 359 | 447 |
| T86235_T18 (SEQ ID NO: 1977) | 359 | 447 |
| T86235_T21 (SEQ ID NO: 1978) | 359 | 447 |
| T86235_T22 (SEQ ID NO: 1979) | 359 | 447 |
| T86235_T23 (SEQ ID NO: 1980) | 359 | 447 |
| T86235_T24 (SEQ ID NO: 1981) | 359 | 447 |
| T86235_T25 (SEQ ID NO: 1982) | 359 | 447 |
| T86235_T28 (SEQ ID NO: 1984) | 359 | 447 |
| T86235_T29 (SEQ ID NO: 1985) | 359 | 447 |
| T86235_T31 (SEQ ID NO: 1986) | 359 | 447 |
| T86235_T32 (SEQ ID NO: 1987) | 359 | 447 |
| T86235_T33 (SEQ ID NO: 1988) | 359 | 447 |
| T86235_T34 (SEQ ID NO: 1989) | 359 | 447 |
| T86235_T35 (SEQ ID NO: 1990) | 359 | 447 |
| T86235_T36 (SEQ ID NO: 1991) | 359 | 447 |
| T86235_T37 (SEQ ID NO: 1992) | 359 | 447 |
| T86235_T39 (SEQ ID NO: 1994) | 359 | 447 |
| T86235_T40 (SEQ ID NO: 1995) | 359 | 447 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11, T86235_P1, T86235_P19 and T86235_P22. This segment can also be found in the following protein(s): T86235_P28, T86235_P12, T86235_P14, T86235_P15, T86235_P17, T86235_P18, T86235_P20 and T86235_P21, since it is in the coding region for the corresponding transcript.

Segment cluster T86235_node_9 (SEQ ID NO:2015) according to the present invention is supported by 69 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992), T86235_T39 (SEQ ID NO:1994) and T86235_T40 (SEQ ID NO:1995). Table 1887 below describes the starting and ending position of this segment on each transcript.

TABLE 1887

Segment location on transcripts

| Transcript name | Segment starting position | Segment ending position |
|---|---|---|
| T86235_T1 (SEQ ID NO: 1962) | 448 | 486 |
| T86235_T2 (SEQ ID NO: 1963) | 448 | 486 |
| T86235_T3 (SEQ ID NO: 1964) | 448 | 486 |
| T86235_T4 (SEQ ID NO: 1965) | 448 | 486 |
| T86235_T5 (SEQ ID NO: 1966) | 448 | 486 |
| T86235_T6 (SEQ ID NO: 1967) | 448 | 486 |
| T86235_T7 (SEQ ID NO: 1968) | 448 | 486 |
| T86235_T8 (SEQ ID NO: 1969) | 448 | 486 |
| T86235_T9 (SEQ ID NO: 1970) | 448 | 486 |
| T86235_T10 (SEQ ID NO: 1971) | 448 | 486 |
| T86235_T12 (SEQ ID NO: 1972) | 448 | 486 |
| T86235_T13 (SEQ ID NO: 1973) | 448 | 486 |
| T86235_T14 (SEQ ID NO: 1974) | 448 | 486 |
| T86235_T15 (SEQ ID NO: 1975) | 448 | 486 |
| T86235_T16 (SEQ ID NO: 1976) | 448 | 486 |
| T86235_T18 (SEQ ID NO: 1977) | 448 | 486 |
| T86235_T22 (SEQ ID NO: 1979) | 448 | 486 |
| T86235_T23 (SEQ ID NO: 1980) | 448 | 486 |
| T86235_T24 (SEQ ID NO: 1981) | 448 | 486 |
| T86235_T25 (SEQ ID NO: 1982) | 448 | 486 |
| T86235_T28 (SEQ ID NO: 1984) | 448 | 486 |
| T86235_T29 (SEQ ID NO: 1985) | 448 | 486 |
| T86235_T31 (SEQ ID NO: 1986) | 448 | 486 |
| T86235_T32 (SEQ ID NO: 1987) | 448 | 486 |
| T86235_T33 (SEQ ID NO: 1988) | 448 | 486 |
| T86235_T34 (SEQ ID NO: 1989) | 448 | 486 |
| T86235_T35 (SEQ ID NO: 1990) | 448 | 486 |
| T86235_T36 (SEQ ID NO: 1991) | 448 | 486 |
| T86235_T37 (SEQ ID NO: 1992) | 448 | 486 |
| T86235_T39 (SEQ ID NO: 1994) | 448 | 486 |
| T86235_T40 (SEQ ID NO: 1995) | 448 | 486 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11, T86235_P1 and T86235_P19. This segment can also be found in the following protein(s): T86235_P28, T86235_P12, T86235_P14, T86235_P15, T86235_P17, T86235_P18, T86235_P20, T86235_P21 and T86235_P22, since it is in the coding region for the corresponding transcript.

Segment cluster T86235_node_10 (SEQ ID NO:2016) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992) and T86235_T39 (SEQ ID NO:1994). Table 1888 below describes the starting and ending position of this segment on each transcript.

TABLE 1888

Segment location on transcripts

| Transcript name | Segment starting position | Segment ending position |
|---|---|---|
| T86235_T1 (SEQ ID NO: 1962) | 487 | 506 |
| T86235_T2 (SEQ ID NO: 1963) | 487 | 506 |
| T86235_T3 (SEQ ID NO: 1964) | 487 | 506 |
| T86235_T4 (SEQ ID NO: 1965) | 487 | 506 |
| T86235_T5 (SEQ ID NO: 1966) | 487 | 506 |
| T86235_T6 (SEQ ID NO: 1967) | 487 | 506 |
| T86235_T7 (SEQ ID NO: 1968) | 487 | 506 |
| T86235_T8 (SEQ ID NO: 1969) | 487 | 506 |
| T86235_T9 (SEQ ID NO: 1970) | 487 | 506 |
| T86235_T10 (SEQ ID NO: 1971) | 487 | 506 |
| T86235_T12 (SEQ ID NO: 1972) | 487 | 506 |
| T86235_T13 (SEQ ID NO: 1973) | 487 | 506 |
| T86235_T14 (SEQ ID NO: 1974) | 487 | 506 |
| T86235_T15 (SEQ ID NO: 1975) | 487 | 506 |
| T86235_T16 (SEQ ID NO: 1976) | 487 | 506 |
| T86235_T18 (SEQ ID NO: 1977) | 487 | 506 |
| T86235_T22 (SEQ ID NO: 1979) | 487 | 506 |
| T86235_T23 (SEQ ID NO: 1980) | 487 | 506 |
| T86235_T24 (SEQ ID NO: 1981) | 487 | 506 |
| T86235_T25 (SEQ ID NO: 1982) | 487 | 506 |
| T86235_T28 (SEQ ID NO: 1984) | 487 | 506 |
| T86235_T29 (SEQ ID NO: 1985) | 487 | 506 |
| T86235_T31 (SEQ ID NO: 1986) | 487 | 506 |
| T86235_T32 (SEQ ID NO: 1987) | 487 | 506 |
| T86235_T33 (SEQ ID NO: 1988) | 487 | 506 |
| T86235_T34 (SEQ ID NO: 1989) | 487 | 506 |
| T86235_T35 (SEQ ID NO: 1990) | 487 | 506 |
| T86235_T36 (SEQ ID NO: 1991) | 487 | 506 |
| T86235_T37 (SEQ ID NO: 1992) | 487 | 506 |
| T86235_T39 (SEQ ID NO: 1994) | 487 | 506 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11, T86235_P1 and T86235_P19. This segment can also be found in the following protein(s): T86235_P28, T86235_P12, T86235_P14, T86235_P15, T86235_P17, T86235_P18, T86235_P20 and T86235_P21, since it is in the coding region for the corresponding transcript.

Segment cluster T86235_node_11 (SEQ ID NO:2017) according to the present invention is supported by 69 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T22 (SEQ ID NO:1979), T86235_T23 (SEQ ID NO:1980), T86235_T24 (SEQ ID NO:1981), T86235_T25 (SEQ ID NO:1982), T86235_T28 (SEQ ID NO:1984), T86235_T29 (SEQ ID NO:1985), T86235_T31 (SEQ ID NO:1986), T86235_T32 (SEQ ID NO:1987), (SEQ ID NO:1988), T86235_T34 (SEQ ID NO:1989), T86235_T35 (SEQ ID NO:1990), T86235_T36 (SEQ ID NO:1991), T86235_T37 (SEQ ID NO:1992) and T86235_T39 (SEQ ID NO:1994). Table 1889 below describes the starting and ending position of this segment on each transcript.

TABLE 1889

Segment location on transcripts

| Transcript name | Segment starting position | Segment ending position |
|---|---|---|
| T86235_T1 (SEQ ID NO: 1962) | 507 | 549 |
| T86235_T2 (SEQ ID NO: 1963) | 507 | 549 |
| T86235_T3 (SEQ ID NO: 1964) | 507 | 549 |
| T86235_T4 (SEQ ID NO: 1965) | 507 | 549 |
| T86235_T5 (SEQ ID NO: 1966) | 507 | 549 |
| T86235_T6 (SEQ ID NO: 1967) | 507 | 549 |
| T86235_T7 (SEQ ID NO: 1968) | 507 | 549 |
| T86235_T8 (SEQ ID NO: 1969) | 507 | 549 |
| T86235_T9 (SEQ ID NO: 1970) | 507 | 549 |
| T86235_T10 (SEQ ID NO: 1971) | 507 | 549 |
| T86235_T12 (SEQ ID NO: 1972) | 507 | 549 |
| T86235_T13 (SEQ ID NO: 1973) | 507 | 549 |
| T86235_T14 (SEQ ID NO: 1974) | 507 | 549 |
| T86235_T15 (SEQ ID NO: 1975) | 507 | 549 |
| T86235_T16 (SEQ ID NO: 1976) | 507 | 549 |
| T86235_T18 (SEQ ID NO: 1977) | 507 | 549 |
| T86235_T22 (SEQ ID NO: 1979) | 507 | 549 |
| T86235_T23 (SEQ ID NO: 1980) | 507 | 549 |
| T86235_T24 (SEQ ID NO: 1981) | 507 | 549 |
| T86235_T25 (SEQ ID NO: 1982) | 507 | 549 |
| T86235_T28 (SEQ ID NO: 1984) | 507 | 549 |
| T86235_T29 (SEQ ID NO: 1985) | 507 | 549 |
| T86235_T31 (SEQ ID NO: 1986) | 507 | 549 |
| T86235_T32 (SEQ ID NO: 1987) | 507 | 549 |
| T86235_T33 (SEQ ID NO: 1988) | 507 | 549 |
| T86235_T34 (SEQ ID NO: 1989) | 507 | 549 |
| T86235_T35 (SEQ ID NO: 1990) | 507 | 549 |
| T86235_T36 (SEQ ID NO: 1991) | 507 | 549 |
| T86235_T37 (SEQ ID NO: 1992) | 507 | 549 |
| T86235_T39 (SEQ ID NO: 1994) | 507 | 549 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11, T86235_P1 and T86235_P19. This segment can also be found in the following protein(s): T86235_P28, T86235_P12, T86235_P14, T86235_P15, T86235_P17, T86235_P18, T86235_P20 and T86235_P21, since it is in the coding region for the corresponding transcript.

Segment cluster T86235_node_12 (SEQ ID NO:2018) according to the present invention is supported by 64 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T16 (SEQ ID NO:1976), T86235_T18 (SEQ ID NO:1977), T86235_T22 (SEQ ID NO:1979), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T35 (SEQ ID NO:1990), T86235_T36 (SEQ ID NO:1991) and T86235_T37 (SEQ ID NO:1992). Table 1890 below describes the starting and ending position of this segment on each transcript.

TABLE 1890

Segment location on transcripts

| Transcript name | Segment starting position | Segment ending position |
|---|---|---|
| T86235_T1 (SEQ ID NO: 1962) | 550 | 575 |
| T86235_T2 (SEQ ID NO: 1963) | 550 | 575 |
| T86235_T3 (SEQ ID NO: 1964) | 550 | 575 |
| T86235_T4 (SEQ ID NO: 1965) | 550 | 575 |
| T86235_T5 (SEQ ID NO: 1966) | 550 | 575 |
| T86235_T6 (SEQ ID NO: 1967) | 550 | 575 |
| T86235_T7 (SEQ ID NO: 1968) | 550 | 575 |
| T86235_T8 (SEQ ID NO: 1969) | 550 | 575 |
| T86235_T9 (SEQ ID NO: 1970) | 550 | 575 |
| T86235_T10 (SEQ ID NO: 1971) | 550 | 575 |
| T86235_T12 (SEQ ID NO: 1972) | 550 | 575 |
| T86235_T13 (SEQ ID NO: 1973) | 550 | 575 |
| T86235_T14 (SEQ ID NO: 1974) | 550 | 575 |
| T86235_T16 (SEQ ID NO: 1976) | 550 | 575 |
| T86235_T18 (SEQ ID NO: 1977) | 550 | 575 |
| T86235_T22 (SEQ ID NO: 1979) | 550 | 575 |
| T86235_T28 (SEQ ID NO: 1984) | 550 | 575 |
| T86235_T29 (SEQ ID NO: 1985) | 550 | 575 |
| T86235_T31 (SEQ ID NO: 1986) | 550 | 575 |
| T86235_T32 (SEQ ID NO: 1987) | 550 | 575 |
| T86235_T33 (SEQ ID NO: 1988) | 550 | 575 |
| T86235_T35 (SEQ ID NO: 1990) | 550 | 575 |
| T86235_T36 (SEQ ID NO: 1991) | 550 | 575 |
| T86235_T37 (SEQ ID NO: 1992) | 550 | 575 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28, T86235_P12, T86235_P14, T86235_P15, T86235_P17, T86235_P18 and T86235_P20, since it is in the coding region for the corresponding transcript.

Segment cluster T86235_node_13 (SEQ ID NO:2019) according to the present invention is supported by 66 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T16 (SEQ ID NO:1976), T86235_T18 (SEQ ID NO:1977), T86235_T22 (SEQ ID NO:1979), T86235_T28 (SEQ ID NO:1984), T86235_T29 (SEQ ID NO:1985), T86235_T31 (SEQ ID NO:1986), T86235_T32 (SEQ ID NO:1987), T86235_T33 (SEQ ID NO:1988), T86235_T35 (SEQ ID NO:1990), T86235_T36 (SEQ ID NO:1991) and T86235_T37 (SEQ ID NO:1992). Table 1891 below describes the starting and ending position of this segment on each transcript.

TABLE 1891

| Segment location on transcripts | | |
|---|---|---|
| Transcript name | Segment starting position | Segment ending position |
| T86235_T1 (SEQ ID NO: 1962) | 576 | 640 |
| T86235_T2 (SEQ ID NO: 1963) | 576 | 640 |
| T86235_T3 (SEQ ID NO: 1964) | 576 | 640 |
| T86235_T4 (SEQ ID NO: 1965) | 576 | 640 |
| T86235_T5 (SEQ ID NO: 1966) | 576 | 640 |
| T86235_T6 (SEQ ID NO: 1967) | 576 | 640 |
| T86235_T7 (SEQ ID NO: 1968) | 576 | 640 |
| T86235_T8 (SEQ ID NO: 1969) | 576 | 640 |
| T86235_T9 (SEQ ID NO: 1970) | 576 | 640 |
| T86235_T10 (SEQ ID NO: 1971) | 576 | 640 |
| T86235_T12 (SEQ ID NO: 1972) | 576 | 640 |
| T86235_T13 (SEQ ID NO: 1973) | 576 | 640 |
| T86235_T14 (SEQ ID NO: 1974) | 576 | 640 |
| T86235_T16 (SEQ ID NO: 1976) | 576 | 640 |
| T86235_T18 (SEQ ID NO: 1977) | 576 | 640 |
| T86235_T22 (SEQ ID NO: 1979) | 576 | 640 |
| T86235_T28 (SEQ ID NO: 1984) | 576 | 640 |
| T86235_T29 (SEQ ID NO: 1985) | 576 | 640 |
| T86235_T31 (SEQ ID NO: 1986) | 576 | 640 |
| T86235_T32 (SEQ ID NO: 1987) | 576 | 640 |
| T86235_T33 (SEQ ID NO: 1988) | 576 | 640 |
| T86235_T35 (SEQ ID NO: 1990) | 576 | 640 |
| T86235_T36 (SEQ ID NO: 1991) | 576 | 640 |
| T86235_T37 (SEQ ID NO: 1992) | 576 | 640 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28, T86235_P12, T86235_P14, T86235_P15, T86235_P17, T86235_P18 and T86235_P20, since it is in the coding region for the corresponding transcript.

Segment cluster T86235_node_14 (SEQ ID NO:2020) according to the present invention is supported by 9 libraries. The number of libraries was determined as previously described. This segment can be found in the following transcript(s): (SEQ ID NO:1988) and T86235_T37 (SEQ ID NO:1992). Table 1892 below describes the starting and ending position of this segment on each transcript.

TABLE 1892

| Segment location on transcripts | | |
|---|---|---|
| Transcript name | Segment starting position | Segment ending position |
| T86235_T33 (SEQ ID NO: 1988) | 641 | 745 |
| T86235_T37 (SEQ ID NO: 1992) | 641 | 745 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1893.

TABLE 1893

| Oligonucleotides related to this segment | | |
|---|---|---|
| Oligonucleotide name | Overexpressed in cancers | Chip reference |
| T86235_0_0_57365 | lung malignant tumors | LUN |

This segment can be found in the following protein(s): T86235_P18.

Segment cluster T86235_node_15 (SEQ ID NO:2021) according to the present invention can be found in the following transcript(s): T86235_T33 (SEQ ID NO:1988) and T86235_T37 (SEQ ID NO:1992). Table 1894 below describes the starting and ending position of this segment on each transcript.

TABLE 1894

| Segment location on transcripts | | |
|---|---|---|
| Transcript name | Segment starting position | Segment ending position |
| T86235_T33 (SEQ ID NO: 1988) | 746 | 757 |
| T86235_T37 (SEQ ID NO: 1992) | 746 | 757 |

This segment can be found in a non-coding region of transcript(s) that are related to the following protein(s): T86235_P18.

Segment cluster T86235_node_16 (SEQ ID NO:2022) according to the present invention is supported by 18 libraries. The number of libraries was determined as previously described. This segment can be found in the following transcript(s): T86235_T32 (SEQ ID NO:1987), T86235_T33 (SEQ ID NO:1988), T86235_T35 (SEQ ID NO:1990) and T86235_T37 (SEQ ID NO:1992). Table 1895 below describes the starting and ending position of this segment on each transcript.

TABLE 1895

| Segment location on transcripts | | |
|---|---|---|
| Transcript name | Segment starting position | Segment ending position |
| T86235_T32 (SEQ ID NO: 1987) | 641 | 697 |
| T86235_T33 (SEQ ID NO: 1988) | 758 | 814 |
| T86235_T35 (SEQ ID NO: 1990) | 641 | 697 |
| T86235_T37 (SEQ ID NO: 1992) | 758 | 814 |

This segment can be found in both coding and non-coding regions of transcript(s) as follows. The segment can be found in a non-coding region of transcript(s) that are related to the following protein(s): T86235_P18. This segment can also be found in the following protein(s): T86235_P17, since it is in the coding region for the corresponding transcript.

Segment cluster T86235_node_17 (SEQ ID NO:2023) according to the present invention can be found in the following transcript(s): T86235_T32 (SEQ ID NO:1987), T86235_T33 (SEQ ID NO:1988), T86235_T35 (SEQ ID NO:1990), T86235_T36 (SEQ ID NO:1991) and T86235_T37 (SEQ ID NO:1992). Table 1896 below describes the starting and ending position of this segment on each transcript.

TABLE 1896

Segment location on transcripts

| Transcript name | Segment starting position | Segment ending position |
|---|---|---|
| T86235_T32 (SEQ ID NO: 1987) | 698 | 716 |
| T86235_T33 (SEQ ID NO: 1988) | 815 | 833 |
| T86235_T35 (SEQ ID NO: 1990) | 698 | 716 |
| T86235_T36 (SEQ ID NO: 1991) | 641 | 659 |
| T86235_T37 (SEQ ID NO: 1992) | 815 | 833 |

This segment can be found in both coding and non-coding regions of transcript(s) as follows. The segment can be found in a non-coding region of transcript(s) that are related to the following protein(s): T86235_P18. This segment can also be found in the following protein(s): T86235_P17 and T86235_P20, since it is in the coding region for the corresponding transcript.

Segment cluster T86235_node_18 (SEQ ID NO:2024) according to the present invention can be found in the following transcript(s): T86235_T29 (SEQ ID NO:1985), T86235_T31 (SEQ ID NO:1986), T86235_T32 (SEQ ID NO:1987), T86235_T33 (SEQ ID NO:1988), T86235_T35 (SEQ ID NO:1990), T86235_T36 (SEQ ID NO:1991), T86235_T37 (SEQ ID NO:1992) and T86235_T39 (SEQ ID NO:1994). Table 1897 below describes the starting and ending position of this segment on each transcript.

TABLE 1897

Segment location on transcripts

| Transcript name | Segment starting position | Segment ending position |
|---|---|---|
| T86235_T29 (SEQ ID NO: 1985) | 641 | 644 |
| T86235_T31 (SEQ ID NO: 1986) | 641 | 644 |
| T86235_T32 (SEQ ID NO: 1987) | 717 | 720 |
| T86235_T33 (SEQ ID NO: 1988) | 834 | 837 |
| T86235_T35 (SEQ ID NO: 1990) | 717 | 720 |
| T86235_T36 (SEQ ID NO: 1991) | 660 | 663 |
| T86235_T37 (SEQ ID NO: 1992) | 834 | 837 |
| T86235_T39 (SEQ ID NO: 1994) | 550 | 553 |

This segment can be found in both coding and non-coding regions of transcript(s) as follows. The segment can be found in a non-coding region of transcript(s) that are related to the following protein(s): T86235_P18. This segment can also be found in the following protein(s): T86235_P15, T86235_P17, T86235_P20 and T86235_P21, since it is in the coding region for the corresponding transcript.

Segment cluster T86235_node_22 (SEQ ID NO:2025) according to the present invention is supported by 46 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T22 (SEQ ID NO:1979), T86235_T23 (SEQ ID NO:1980), T86235_T24 (SEQ ID NO:1981), T86235_T28 (SEQ ID NO:1984) and T86235_T38 (SEQ ID NO:1993). Table 1898 below describes the starting and ending position of this segment on each transcript.

TABLE 1898

Segment location on transcripts

| Transcript name | Segment starting position | Segment ending position |
|---|---|---|
| T86235_T1 (SEQ ID NO: 1962) | 641 | 700 |
| T86235_T2 (SEQ ID NO: 1963) | 641 | 700 |
| T86235_T3 (SEQ ID NO: 1964) | 641 | 700 |
| T86235_T4 (SEQ ID NO: 1965) | 641 | 700 |
| T86235_T5 (SEQ ID NO: 1966) | 641 | 700 |
| T86235_T6 (SEQ ID NO: 1967) | 641 | 700 |
| T86235_T7 (SEQ ID NO: 1968) | 641 | 700 |
| T86235_T8 (SEQ ID NO: 1969) | 641 | 700 |
| T86235_T9 (SEQ ID NO: 1970) | 641 | 700 |
| T86235_T10 (SEQ ID NO: 1971) | 641 | 700 |
| T86235_T12 (SEQ ID NO: 1972) | 641 | 700 |
| T86235_T13 (SEQ ID NO: 1973) | 641 | 700 |
| T86235_T14 (SEQ ID NO: 1974) | 641 | 700 |
| T86235_T15 (SEQ ID NO: 1975) | 550 | 609 |
| T86235_T16 (SEQ ID NO: 1976) | 641 | 700 |
| T86235_T18 (SEQ ID NO: 1977) | 641 | 700 |
| T86235_T22 (SEQ ID NO: 1979) | 641 | 700 |
| T86235_T23 (SEQ ID NO: 1980) | 550 | 609 |
| T86235_T24 (SEQ ID NO: 1981) | 550 | 609 |
| T86235_T28 (SEQ ID NO: 1984) | 641 | 700 |
| T86235_T38 (SEQ ID NO: 1993) | 151 | 210 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28, T86235_P12 and T86235_P14, since it is in the coding region for the corresponding transcript.

Segment cluster T86235_node_23 (SEQ ID NO:2026) according to the present invention is supported by 44 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T22 (SEQ ID NO:1979), T86235_T23 (SEQ ID NO:1980), T86235_T24 (SEQ ID NO:1981), T86235_T28 (SEQ ID NO:1984) and T86235_T38 (SEQ ID NO:1993). Table 1899 below describes the starting and ending position of this segment on each transcript.

TABLE 1899

Segment location on transcripts

| Transcript name | Segment starting position | Segment ending position |
|---|---|---|
| T86235_T1 (SEQ ID NO: 1962) | 701 | 798 |
| T86235_T2 (SEQ ID NO: 1963) | 701 | 798 |
| T86235_T3 (SEQ ID NO: 1964) | 701 | 798 |
| T86235_T4 (SEQ ID NO: 1965) | 701 | 798 |
| T86235_T5 (SEQ ID NO: 1966) | 701 | 798 |

TABLE 1899-continued

Segment location on transcripts

| Transcript name | Segment starting position | Segment ending position |
|---|---|---|
| T86235_T6 (SEQ ID NO: 1967) | 701 | 798 |
| T86235_T7 (SEQ ID NO: 1968) | 701 | 798 |
| T86235_T8 (SEQ ID NO: 1969) | 701 | 798 |
| T86235_T9 (SEQ ID NO: 1970) | 701 | 798 |
| T86235_T10 (SEQ ID NO: 1971) | 701 | 798 |
| T86235_T12 (SEQ ID NO: 1972) | 701 | 798 |
| T86235_T13 (SEQ ID NO: 1973) | 701 | 798 |
| T86235_T14 (SEQ ID NO: 1974) | 701 | 798 |
| T86235_T15 (SEQ ID NO: 1975) | 610 | 707 |
| T86235_T16 (SEQ ID NO: 1976) | 701 | 798 |
| T86235_T22 (SEQ ID NO: 1979) | 701 | 798 |
| T86235_T23 (SEQ ID NO: 1980) | 610 | 707 |
| T86235_T24 (SEQ ID NO: 1981) | 610 | 707 |
| T86235_T28 (SEQ ID NO: 1984) | 701 | 798 |
| T86235_T38 (SEQ ID NO: 1993) | 211 | 308 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28, T86235_P12 and T86235_P14, since it is in the coding region for the corresponding transcript.

Segment cluster T86235_node_27 (SEQ ID NO:2027) according to the present invention is supported by 38 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980) and T86235_T24 (SEQ ID NO:1981). Table 1900 below describes the starting and ending position of this segment on each transcript.

TABLE 1900

Segment location on transcripts

| Transcript name | Segment starting position | Segment ending position |
|---|---|---|
| T86235_T1 (SEQ ID NO: 1962) | 937 | 1019 |
| T86235_T2 (SEQ ID NO: 1963) | 937 | 1019 |
| T86235_T3 (SEQ ID NO: 1964) | 937 | 1019 |
| T86235_T4 (SEQ ID NO: 1965) | 937 | 1019 |
| T86235_T5 (SEQ ID NO: 1966) | 937 | 1019 |
| T86235_T6 (SEQ ID NO: 1967) | 937 | 1019 |
| T86235_T7 (SEQ ID NO: 1968) | 937 | 1019 |
| T86235_T8 (SEQ ID NO: 1969) | 937 | 1019 |
| T86235_T9 (SEQ ID NO: 1970) | 937 | 1019 |
| T86235_T10 (SEQ ID NO: 1971) | 937 | 1019 |
| T86235_T12 (SEQ ID NO: 1972) | 937 | 1019 |
| T86235_T13 (SEQ ID NO: 1973) | 937 | 1019 |
| T86235_T14 (SEQ ID NO: 1974) | 937 | 1019 |
| T86235_T15 (SEQ ID NO: 1975) | 846 | 928 |
| T86235_T16 (SEQ ID NO: 1976) | 937 | 1019 |
| T86235_T18 (SEQ ID NO: 1977) | 839 | 921 |
| T86235_T21 (SEQ ID NO: 1978) | 586 | 668 |
| T86235_T22 (SEQ ID NO: 1979) | 937 | 1019 |
| T86235_T23 (SEQ ID NO: 1980) | 846 | 928 |
| T86235_T24 (SEQ ID NO: 1981) | 846 | 928 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28 and T86235_P12, since it is in the coding region for the corresponding transcript.

Segment cluster T86235_node_29 (SEQ ID NO:2028) according to the present invention is supported by 35 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980) and T86235_T24 (SEQ ID NO:1981). Table 1901 below describes the starting and ending position of this segment on each transcript.

TABLE 1901

Segment location on transcripts

| Transcript name | Segment starting position | Segment ending position |
|---|---|---|
| T86235_T1 (SEQ ID NO: 1962) | 1020 | 1073 |
| T86235_T2 (SEQ ID NO: 1963) | 1020 | 1073 |
| T86235_T3 (SEQ ID NO: 1964) | 1020 | 1073 |
| T86235_T4 (SEQ ID NO: 1965) | 1020 | 1073 |
| T86235_T5 (SEQ ID NO: 1966) | 1020 | 1073 |
| T86235_T6 (SEQ ID NO: 1967) | 1020 | 1073 |
| T86235_T7 (SEQ ID NO: 1968) | 1020 | 1073 |
| T86235_T8 (SEQ ID NO: 1969) | 1020 | 1073 |
| T86235_T9 (SEQ ID NO: 1970) | 1020 | 1073 |
| T86235_T10 (SEQ ID NO: 1971) | 1020 | 1073 |
| T86235_T12 (SEQ ID NO: 1972) | 1020 | 1073 |
| T86235_T13 (SEQ ID NO: 1973) | 1020 | 1073 |
| T86235_T14 (SEQ ID NO: 1974) | 1020 | 1073 |
| T86235_T15 (SEQ ID NO: 1975) | 929 | 982 |
| T86235_T16 (SEQ ID NO: 1976) | 1020 | 1073 |
| T86235_T18 (SEQ ID NO: 1977) | 922 | 975 |
| T86235_T21 (SEQ ID NO: 1978) | 669 | 722 |
| T86235_T22 (SEQ ID NO: 1979) | 1020 | 1073 |
| T86235_T23 (SEQ ID NO: 1980) | 929 | 982 |
| T86235_T24 (SEQ ID NO: 1981) | 929 | 982 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28 and T86235_P12, since it is in the coding region for the corresponding transcript.

Segment cluster T86235_node_31 (SEQ ID NO:2029) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980) and T86235_T24 (SEQ ID NO:1981). Table 1902 below describes the starting and ending position of this segment on each transcript.

TABLE 1902

Segment location on transcripts

| Transcript name | Segment starting position | Segment ending position |
| --- | --- | --- |
| T86235_T1 (SEQ ID NO: 1962) | 1074 | 1091 |
| T86235_T2 (SEQ ID NO: 1963) | 1074 | 1091 |
| T86235_T3 (SEQ ID NO: 1964) | 1074 | 1091 |
| T86235_T4 (SEQ ID NO: 1965) | 1074 | 1091 |
| T86235_T5 (SEQ ID NO: 1966) | 1074 | 1091 |
| T86235_T6 (SEQ ID NO: 1967) | 1074 | 1091 |
| T86235_T7 (SEQ ID NO: 1968) | 1074 | 1091 |
| T86235_T8 (SEQ ID NO: 1969) | 1074 | 1091 |
| T86235_T9 (SEQ ID NO: 1970) | 1074 | 1091 |
| T86235_T10 (SEQ ID NO: 1971) | 1074 | 1091 |
| T86235_T12 (SEQ ID NO: 1972) | 1074 | 1091 |
| T86235_T13 (SEQ ID NO: 1973) | 1074 | 1091 |
| T86235_T15 (SEQ ID NO: 1975) | 983 | 1000 |
| T86235_T16 (SEQ ID NO: 1976) | 1074 | 1091 |
| T86235_T18 (SEQ ID NO: 1977) | 976 | 993 |
| T86235_T21 (SEQ ID NO: 1978) | 723 | 740 |
| T86235_T22 (SEQ ID NO: 1979) | 1074 | 1091 |
| T86235_T23 (SEQ ID NO: 1980) | 983 | 1000 |
| T86235_T24 (SEQ ID NO: 1981) | 983 | 1000 |

This segment can be found in both coding and non-coding regions of transcript(s) as follows. The segment can be found in a non-coding region of transcript(s) that are related to the following protein(s): T86235_P2, T86235_P3, T86235_P4, T86235_P5, T86235_P6, T86235_P7, T86235_P8, T86235_P10, T86235_P11 and T86235_P1. This segment can also be found in the following protein(s): T86235_P28 and T86235_P12, since it is in the coding region for the corresponding transcript.

Segment cluster T86235_node_32 (SEQ ID NO:2030) according to the present invention is supported by 38 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T22 (SEQ ID NO:1979), T86235_T23 (SEQ ID NO:1980), T86235_T24 (SEQ ID NO:1981), T86235_T25 (SEQ ID NO:1982) and T86235_T34 (SEQ ID NO:1989). Table 1903 below describes the starting and ending position of this segment on each transcript.

TABLE 1903

Segment location on transcripts

| Transcript name | Segment starting position | Segment ending position |
| --- | --- | --- |
| T86235_T1 (SEQ ID NO: 1962) | 1092 | 1195 |
| T86235_T2 (SEQ ID NO: 1963) | 1092 | 1195 |
| T86235_T3 (SEQ ID NO: 1964) | 1092 | 1195 |
| T86235_T4 (SEQ ID NO: 1965) | 1092 | 1195 |
| T86235_T5 (SEQ ID NO: 1966) | 1092 | 1195 |
| T86235_T6 (SEQ ID NO: 1967) | 1092 | 1195 |
| T86235_T7 (SEQ ID NO: 1968) | 1092 | 1195 |
| T86235_T8 (SEQ ID NO: 1969) | 1092 | 1195 |
| T86235_T9 (SEQ ID NO: 1970) | 1092 | 1195 |
| T86235_T10 (SEQ ID NO: 1971) | 1092 | 1195 |
| T86235_T12 (SEQ ID NO: 1972) | 1092 | 1195 |
| T86235_T13 (SEQ ID NO: 1973) | 1092 | 1195 |
| T86235_T14 (SEQ ID NO: 1974) | 1074 | 1177 |
| T86235_T15 (SEQ ID NO: 1975) | 1001 | 1104 |
| T86235_T16 (SEQ ID NO: 1976) | 1092 | 1195 |
| T86235_T18 (SEQ ID NO: 1977) | 994 | 1097 |
| T86235_T21 (SEQ ID NO: 1978) | 741 | 844 |
| T86235_T22 (SEQ ID NO: 1979) | 1092 | 1195 |
| T86235_T23 (SEQ ID NO: 1980) | 1001 | 1104 |
| T86235_T24 (SEQ ID NO: 1981) | 1001 | 1104 |
| T86235_T25 (SEQ ID NO: 1982) | 550 | 653 |
| T86235_T34 (SEQ ID NO: 1989) | 550 | 653 |

This segment can be found in both coding and non-coding regions of transcript(s) as follows. The segment can be found in a non-coding region of transcript(s) that are related to the following protein(s): T86235_P7, T86235_P11 and T86235_P12. This segment can also be found in the following protein(s): T86235_P28, T86235_P2, T86235_P3, T86235_P4, T86235_P5, T86235_P6, T86235_P8, T86235_P10, T86235_P1 and T86235_P19, since it is in the coding region for the corresponding transcript.

Segment cluster T86235_node_33 (SEQ ID NO:2031) according to the present invention can be found in the following transcript(s): T86235_T22 (SEQ ID NO:1979). Table 1904 below describes the starting and ending position of this segment on each transcript.

TABLE 1904

Segment location on transcripts

| Transcript name | Segment starting position | Segment ending position |
| --- | --- | --- |
| T86235_T22 (SEQ ID NO: 1979) | 1196 | 1220 |

This segment can be found in a non-coding region of transcript(s) that are related to the following protein(s): T86235_P12.

Segment cluster T86235_node_38 (SEQ ID NO:2032) according to the present invention is supported by 26 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981) T86235_T25 (SEQ ID NO:1982), T86235_T26 (SEQ ID NO:1983) and T86235_T34 (SEQ ID NO:1989). Table 1905 below describes the starting and ending position of this segment on each transcript.

TABLE 1905

| Segment location on transcripts | | |
|---|---|---|
| Transcript name | Segment starting position | Segment ending position |
| T86235_T1 (SEQ ID NO: 1962) | 1325 | 1408 |
| T86235_T2 (SEQ ID NO: 1963) | 1325 | 1408 |
| T86235_T3 (SEQ ID NO: 1964) | 1325 | 1408 |
| T86235_T4 (SEQ ID NO: 1965) | 1325 | 1408 |
| T86235_T5 (SEQ ID NO: 1966) | 1325 | 1408 |
| T86235_T6 (SEQ ID NO: 1967) | 1325 | 1408 |
| T86235_T7 (SEQ ID NO: 1968) | 1325 | 1408 |
| T86235_T8 (SEQ ID NO: 1969) | 1325 | 1408 |
| T86235_T9 (SEQ ID NO: 1970) | 1325 | 1408 |
| T86235_T10 (SEQ ID NO: 1971) | 1325 | 1408 |
| T86235_T12 (SEQ ID NO: 1972) | 1325 | 1408 |
| T86235_T13 (SEQ ID NO: 1973) | 1325 | 1408 |
| T86235_T14 (SEQ ID NO: 1974) | 1307 | 1390 |
| T86235_T15 (SEQ ID NO: 1975) | 1234 | 1317 |
| T86235_T16 (SEQ ID NO: 1976) | 1325 | 1408 |
| T86235_T18 (SEQ ID NO: 1977) | 1227 | 1310 |
| T86235_T21 (SEQ ID NO: 1978) | 974 | 1057 |
| T86235_T23 (SEQ ID NO: 1980) | 1234 | 1317 |
| T86235_T24 (SEQ ID NO: 1981) | 1234 | 1317 |
| T86235_T25 (SEQ ID NO: 1982) | 783 | 866 |
| T86235_T26 (SEQ ID NO: 1983) | 424 | 507 |
| T86235_T34 (SEQ ID NO: 1989) | 783 | 866 |

This segment can be found in both coding and non-coding regions of transcript(s) as follows. The segment can be found in a non-coding region of transcript(s) that are related to the following protein(s): T86235_P7, T86235_P11 and T86235_P12. This segment can also be found in the following protein(s): T86235_P28, T86235_P2, T86235_P3, T86235_P4, T86235_P5, T86235_P6, T86235_P8, T86235_P10, T86235_P1 and T86235_P19, since it is in the coding region for the corresponding transcript.

Segment cluster T86235_node_40 (SEQ ID NO:2033) according to the present invention is supported by 25 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T16 (SEQ ID NO:1976), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982), T86235_T26 (SEQ ID NO:1983) and T86235_T34 (SEQ ID NO:1989). Table 1906 below describes the starting and ending position of this segment on each transcript.

TABLE 1906

| Segment location on transcripts | | |
|---|---|---|
| Transcript name | Segment starting position | Segment ending position |
| T86235_T1 (SEQ ID NO: 1962) | 1409 | 1468 |
| T86235_T2 (SEQ ID NO: 1963) | 1409 | 1468 |
| T86235_T3 (SEQ ID NO: 1964) | 1409 | 1468 |
| T86235_T4 (SEQ ID NO: 1965) | 1409 | 1468 |
| T86235_T5 (SEQ ID NO: 1966) | 1409 | 1468 |
| T86235_T6 (SEQ ID NO: 1967) | 1409 | 1468 |
| T86235_T7 (SEQ ID NO: 1968) | 1409 | 1468 |
| T86235_T8 (SEQ ID NO: 1969) | 1409 | 1468 |
| T86235_T9 (SEQ ID NO: 1970) | 1409 | 1468 |
| T86235_T10 (SEQ ID NO: 1971) | 1409 | 1468 |
| T86235_T12 (SEQ ID NO: 1972) | 1409 | 1468 |
| T86235_T13 (SEQ ID NO: 1973) | 1409 | 1468 |
| T86235_T14 (SEQ ID NO: 1974) | 1391 | 1450 |
| T86235_T15 (SEQ ID NO: 1975) | 1318 | 1377 |
| T86235_T16 (SEQ ID NO: 1976) | 1409 | 1468 |
| T86235_T18 (SEQ ID NO: 1977) | 1311 | 1370 |
| T86235_T21 (SEQ ID NO: 1978) | 1058 | 1117 |
| T86235_T23 (SEQ ID NO: 1980) | 1318 | 1377 |
| T86235_T24 (SEQ ID NO: 1981) | 1318 | 1377 |
| T86235_T25 (SEQ ID NO: 1982) | 867 | 926 |
| T86235_T26 (SEQ ID NO: 1983) | 508 | 567 |
| T86235_T34 (SEQ ID NO: 1989) | 867 | 926 |

This segment can be found in both coding and non-coding regions of transcript(s) as follows. The segment can be found in a non-coding region of transcript(s) that are related to the following protein(s): T86235_P7, T86235_P11 and T86235_P12. This segment can also be found in the following protein(s): T86235_P28, T86235_P2, T86235_P3, T86235_P4, T86235_P5, T86235_P6, T86235_P8, T86235_P10, T86235_P1 and T86235_P19, since it is in the coding region for the corresponding transcript.

Segment cluster T86235_node_45 (SEQ ID NO:2034) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982) and T86235_T26 (SEQ ID NO:1983). Table 1907 below describes the starting and ending position of this segment on each transcript.

TABLE 1907

| Segment location on transcripts | | |
|---|---|---|
| Transcript name | Segment starting position | Segment ending position |
| T86235_T1 (SEQ ID NO: 1962) | 1888 | 1904 |
| T86235_T2 (SEQ ID NO: 1963) | 1888 | 1904 |
| T86235_T3 (SEQ ID NO: 1964) | 1888 | 1904 |
| T86235_T4 (SEQ ID NO: 1965) | 1888 | 1904 |
| T86235_T5 (SEQ ID NO: 1966) | 1888 | 1904 |
| T86235_T6 (SEQ ID NO: 1967) | 1888 | 1904 |
| T86235_T7 (SEQ ID NO: 1968) | 2290 | 2306 |
| T86235_T8 (SEQ ID NO: 1969) | 2041 | 2057 |
| T86235_T9 (SEQ ID NO: 1970) | 2443 | 2459 |

TABLE 1907-continued

Segment location on transcripts

| Transcript name | Segment starting position | Segment ending position |
|---|---|---|
| T86235_T10 (SEQ ID NO: 1971) | 1888 | 1904 |
| T86235_T12 (SEQ ID NO: 1972) | 1753 | 1769 |
| T86235_T13 (SEQ ID NO: 1973) | 2290 | 2306 |
| T86235_T14 (SEQ ID NO: 1974) | 1870 | 1886 |
| T86235_T15 (SEQ ID NO: 1975) | 1797 | 1813 |
| T86235_T18 (SEQ ID NO: 1977) | 1790 | 1806 |
| T86235_T21 (SEQ ID NO: 1978) | 1537 | 1553 |
| T86235_T23 (SEQ ID NO: 1980) | 1797 | 1813 |
| T86235_T24 (SEQ ID NO: 1981) | 1797 | 1813 |
| T86235_T25 (SEQ ID NO: 1982) | 1346 | 1362 |
| T86235_T26 (SEQ ID NO: 1983) | 1389 | 1405 |

This segment can be found in the following protein(s): T86235_P28, T86235_P2, T86235_P3, T86235_P4, T86235_P5, T86235_P6, T86235_P7, T86235_P8, T86235_P10, T86235_P11 and T86235_P1.

Segment cluster T86235_node__46 (SEQ ID NO:2035) according to the present invention is supported by 36 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982) and T86235_T26 (SEQ ID NO:1983). Table 1908 below describes the starting and ending position of this segment on each transcript.

TABLE 1908

Segment location on transcripts

| Transcript name | Segment starting position | Segment ending position |
|---|---|---|
| T86235_T1 (SEQ ID NO: 1962) | 1905 | 1986 |
| T86235_T2 (SEQ ID NO: 1963) | 1905 | 1986 |
| T86235_T3 (SEQ ID NO: 1964) | 1905 | 1986 |
| T86235_T4 (SEQ ID NO: 1965) | 1905 | 1986 |
| T86235_T5 (SEQ ID NO: 1966) | 1905 | 1986 |
| T86235_T6 (SEQ ID NO: 1967) | 1905 | 1986 |
| T86235_T7 (SEQ ID NO: 1968) | 2307 | 2388 |
| T86235_T8 (SEQ ID NO: 1969) | 2058 | 2139 |
| T86235_T9 (SEQ ID NO: 1970) | 2460 | 2541 |
| T86235_T10 (SEQ ID NO: 1971) | 1905 | 1986 |
| T86235_T12 (SEQ ID NO: 1972) | 1770 | 1851 |
| T86235_T13 (SEQ ID NO: 1973) | 2307 | 2388 |
| T86235_T14 (SEQ ID NO: 1974) | 1887 | 1968 |
| T86235_T15 (SEQ ID NO: 1975) | 1814 | 1895 |
| T86235_T18 (SEQ ID NO: 1977) | 1807 | 1888 |
| T86235_T21 (SEQ ID NO: 1978) | 1554 | 1635 |
| T86235_T23 (SEQ ID NO: 1980) | 1814 | 1895 |
| T86235_T24 (SEQ ID NO: 1981) | 1814 | 1895 |
| T86235_T25 (SEQ ID NO: 1982) | 1363 | 1444 |
| T86235_T26 (SEQ ID NO: 1983) | 1406 | 1487 |

This segment can be found in the following protein(s): T86235_P28, T86235_P2, T86235_P3, T86235_P4, T86235_P5, T86235_P6, T86235_P7, T86235_P8, T86235_P110, T86235_P11 and T86235_P1.

Segment cluster T86235_node__47 (SEQ ID NO:2036) according to the present invention is supported by 32 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T5 (SEQ ID NO:1966), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T23 (SEQ ID NO:1980), T86235_T24 (SEQ ID NO:1981), T86235_T25 (SEQ ID NO:1982) and T86235_T26 (SEQ ID NO:1983). Table 1909 below describes the starting and ending position of this segment on each transcript.

TABLE 1909

Segment location on transcripts

| Transcript name | Segment starting position | Segment ending position |
|---|---|---|
| T86235_T1 (SEQ ID NO: 1962) | 1987 | 2032 |
| T86235_T2 (SEQ ID NO: 1963) | 1987 | 2032 |
| T86235_T3 (SEQ ID NO: 1964) | 1987 | 2032 |
| T86235_T4 (SEQ ID NO: 1965) | 1987 | 2032 |
| T86235_T5 (SEQ ID NO: 1966) | 1987 | 2032 |
| T86235_T6 (SEQ ID NO: 1967) | 1987 | 2032 |
| T86235_T7 (SEQ ID NO: 1968) | 2389 | 2434 |
| T86235_T8 (SEQ ID NO: 1969) | 2140 | 2185 |
| T86235_T9 (SEQ ID NO: 1970) | 2542 | 2587 |
| T86235_T10 (SEQ ID NO: 1971) | 1987 | 2032 |
| T86235_T12 (SEQ ID NO: 1972) | 1852 | 1897 |
| T86235_T13 (SEQ ID NO: 1973) | 2389 | 2434 |
| T86235_T14 (SEQ ID NO: 1974) | 1969 | 2014 |
| T86235_T15 (SEQ ID NO: 1975) | 1896 | 1941 |
| T86235_T18 (SEQ ID NO: 1977) | 1889 | 1934 |
| T86235_T21 (SEQ ID NO: 1978) | 1636 | 1681 |
| T86235_T23 (SEQ ID NO: 1980) | 1896 | 1941 |
| T86235_T24 (SEQ ID NO: 1981) | 1896 | 1941 |
| T86235_T25 (SEQ ID NO: 1982) | 1445 | 1490 |
| T86235_T26 (SEQ ID NO: 1983) | 1488 | 1533 |

This segment can be found in the following protein(s): T86235_P28, T86235_P2, T86235_P3, T86235_P4, T86235_P5, T86235_P6, T86235_P7, T86235_P8, T86235_P10, T86235_P11 and T86235_P1.

Segment cluster T86235_node__48 (SEQ ID NO:2037) according to the present invention is supported by 29 libraries. The number of libraries was determined as previously described. This segment can be found in the following transcript(s): T86235_T1 (SEQ ID NO:1962), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), (SEQ ID NO:1978), T86235_T25 (SEQ ID NO:1982) and (SEQ ID NO:1983). Table 1910 below describes the starting and ending position of this segment on each transcript.

TABLE 1910

Segment location on transcripts

| Transcript name | Segment starting position | Segment ending position |
|---|---|---|
| T86235_T1 (SEQ ID NO: 1962) | 2033 | 2119 |
| T86235_T3 (SEQ ID NO: 1964) | 2033 | 2119 |
| T86235_T4 (SEQ ID NO: 1965) | 2033 | 2119 |
| T86235_T6 (SEQ ID NO: 1967) | 2033 | 2119 |
| T86235_T7 (SEQ ID NO: 1968) | 2435 | 2521 |
| T86235_T8 (SEQ ID NO: 1969) | 2186 | 2272 |
| T86235_T9 (SEQ ID NO: 1970) | 2588 | 2674 |
| T86235_T12 (SEQ ID NO: 1972) | 1898 | 1984 |
| T86235_T13 (SEQ ID NO: 1973) | 2435 | 2521 |
| T86235_T14 (SEQ ID NO: 1974) | 2015 | 2101 |
| T86235_T15 (SEQ ID NO: 1975) | 1942 | 2028 |
| T86235_T18 (SEQ ID NO: 1977) | 1935 | 2021 |
| T86235_T21 (SEQ ID NO: 1978) | 1682 | 1768 |
| T86235_T25 (SEQ ID NO: 1982) | 1491 | 1577 |
| T86235_T26 (SEQ ID NO: 1983) | 1534 | 1620 |

This segment can be found in the following protein(s): T86235_P28, T86235_P3, T86235_P4, T86235_P6, T86235_P7, T86235_P10, T86235_P11 and T86235_P1.

Segment cluster T86235_node_49 (SEQ ID NO:2038) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T25 (SEQ ID NO:1982) and (SEQ ID NO:1983). Table 1911 below describes the starting and ending position of this segment on each transcript.

TABLE 1911

Segment location on transcripts

| Transcript name | Segment starting position | Segment ending position |
|---|---|---|
| T86235_T1 (SEQ ID NO: 1962) | 2120 | 2131 |
| T86235_T2 (SEQ ID NO: 1963) | 2033 | 2044 |
| T86235_T3 (SEQ ID NO: 1964) | 2120 | 2131 |
| T86235_T4 (SEQ ID NO: 1965) | 2120 | 2131 |
| T86235_T6 (SEQ ID NO: 1967) | 2120 | 2131 |
| T86235_T7 (SEQ ID NO: 1968) | 2522 | 2533 |
| T86235_T8 (SEQ ID NO: 1969) | 2273 | 2284 |
| T86235_T9 (SEQ ID NO: 1970) | 2675 | 2686 |
| T86235_T12 (SEQ ID NO: 1972) | 1985 | 1996 |
| T86235_T13 (SEQ ID NO: 1973) | 2522 | 2533 |
| T86235_T14 (SEQ ID NO: 1974) | 2102 | 2113 |
| T86235_T15 (SEQ ID NO: 1975) | 2029 | 2040 |
| T86235_T18 (SEQ ID NO: 1977) | 2022 | 2033 |
| T86235_T21 (SEQ ID NO: 1978) | 1769 | 1780 |
| T86235_T25 (SEQ ID NO: 1982) | 1578 | 1589 |
| T86235_T26 (SEQ ID NO: 1983) | 1621 | 1632 |

This segment can be found in the following protein(s): T86235_P28, T86235_P2, T86235_P3, T86235_P4, T86235_P6, T86235_P7, T86235_P10, T86235_P1 I and T86235_P1.

Segment cluster T86235_node_50 (SEQ ID NO:2039) according to the present invention is supported by 33 libraries. The number of libraries was determined as previously described. This segment can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T25 (SEQ ID NO:1982) and T86235_T26 (SEQ ID NO:1983). Table 1912 below describes the starting and ending position of this segment on each transcript.

TABLE 1912

Segment location on transcripts

| Transcript name | Segment starting position | Segment ending position |
|---|---|---|
| T86235_T1 (SEQ ID NO: 1962) | 2132 | 2213 |
| T86235_T2 (SEQ ID NO: 1963) | 2045 | 2126 |
| T86235_T3 (SEQ ID NO: 1964) | 2132 | 2213 |
| T86235_T4 (SEQ ID NO: 1965) | 2132 | 2213 |
| T86235_T6 (SEQ ID NO: 1967) | 2132 | 2213 |
| T86235_T7 (SEQ ID NO: 1968) | 2534 | 2615 |
| T86235_T8 (SEQ ID NO: 1969) | 2285 | 2366 |
| T86235_T9 (SEQ ID NO: 1970) | 2687 | 2768 |
| T86235_T12 (SEQ ID NO: 1972) | 1997 | 2078 |
| T86235_T13 (SEQ ID NO: 1973) | 2534 | 2615 |
| T86235_T14 (SEQ ID NO: 1974) | 2114 | 2195 |
| T86235_T15 (SEQ ID NO: 1975) | 2041 | 2122 |
| T86235_T18 (SEQ ID NO: 1977) | 2034 | 2115 |
| T86235_T21 (SEQ ID NO: 1978) | 1781 | 1862 |
| T86235_T25 (SEQ ID NO: 1982) | 1590 | 1671 |
| T86235_T26 (SEQ ID NO: 1983) | 1633 | 1714 |

This segment can be found in the following protein(s): T86235_P28, T86235_P2, T86235_P3, T86235_P4, T86235_P6, T86235_P7, T86235_P10, T86235_P1 I and T86235_P1.

Segment cluster T86235_node_52 (SEQ ID NO:2040) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), (SEQ ID NO:1981), T86235_T25 (SEQ ID NO:1982) and (SEQ ID NO:1983). Table 1913 below describes the starting and ending position of this segment on each transcript.

TABLE 1913

Segment location on transcripts

| Transcript name | Segment starting position | Segment ending position |
|---|---|---|
| T86235_T1 (SEQ ID NO: 1962) | 2353 | 2374 |
| T86235_T2 (SEQ ID NO: 1963) | 2266 | 2287 |
| T86235_T3 (SEQ ID NO: 1964) | 2353 | 2374 |
| T86235_T4 (SEQ ID NO: 1965) | 2353 | 2374 |
| T86235_T6 (SEQ ID NO: 1967) | 2353 | 2374 |
| T86235_T7 (SEQ ID NO: 1968) | 2755 | 2776 |
| T86235_T8 (SEQ ID NO: 1969) | 2506 | 2527 |
| T86235_T9 (SEQ ID NO: 1970) | 2908 | 2929 |
| T86235_T10 (SEQ ID NO: 1971) | 2033 | 2054 |

TABLE 1913-continued

Segment location on transcripts

| Transcript name | Segment starting position | Segment ending position |
|---|---|---|
| T86235_T12 (SEQ ID NO: 1972) | 2218 | 2239 |
| T86235_T13 (SEQ ID NO: 1973) | 2755 | 2776 |
| T86235_T14 (SEQ ID NO: 1974) | 2335 | 2356 |
| T86235_T15 (SEQ ID NO: 1975) | 2262 | 2283 |
| T86235_T18 (SEQ ID NO: 1977) | 2255 | 2276 |
| T86235_T21 (SEQ ID NO: 1978) | 2002 | 2023 |
| T86235_T24 (SEQ ID NO: 1981) | 1942 | 1963 |
| T86235_T25 (SEQ ID NO: 1982) | 1811 | 1832 |
| T86235_T26 (SEQ ID NO: 1983) | 1854 | 1875 |

This segment can be found in the following protein(s): T86235_P28, T86235_P2, T86235_P3, T86235_P4, T86235_P6, T86235_P7, T86235_P8, T86235_P10, T86235_P11 and T86235_P1.

Segment cluster T86235_node_54 (SEQ ID NO:2041) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T6 (SEQ ID NO:1967), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T24 (SEQ ID NO:1981), T86235_T25 (SEQ ID NO:1982), T86235_T26 (SEQ ID NO:1983), T86235_T28 (SEQ ID NO:1984) and T86235_T38 (SEQ ID NO:1993). Table 1914 below describes the starting and ending position of this segment on each transcript.

TABLE 1914

Segment location on transcripts

| Transcript name | Segment starting position | Segment ending position |
|---|---|---|
| T86235_T1 (SEQ ID NO: 1962) | 2375 | 2398 |
| T86235_T2 (SEQ ID NO: 1963) | 2288 | 2311 |
| T86235_T3 (SEQ ID NO: 1964) | 2375 | 2398 |
| T86235_T4 (SEQ ID NO: 1965) | 2375 | 2398 |
| T86235_T6 (SEQ ID NO: 1967) | 2375 | 2398 |
| T86235_T7 (SEQ ID NO: 1968) | 2777 | 2800 |
| T86235_T8 (SEQ ID NO: 1969) | 2528 | 2551 |
| T86235_T9 (SEQ ID NO: 1970) | 2930 | 2953 |
| T86235_T10 (SEQ ID NO: 1971) | 2055 | 2078 |
| T86235_T12 (SEQ ID NO: 1972) | 2240 | 2263 |
| T86235_T13 (SEQ ID NO: 1973) | 2777 | 2800 |
| T86235_T14 (SEQ ID NO: 1974) | 2357 | 2380 |
| T86235_T15 (SEQ ID NO: 1975) | 2284 | 2307 |
| T86235_T18 (SEQ ID NO: 1977) | 2277 | 2300 |
| T86235_T21 (SEQ ID NO: 1978) | 2024 | 2047 |
| T86235_T24 (SEQ ID NO: 1981) | 1964 | 1987 |
| T86235_T25 (SEQ ID NO: 1982) | 1833 | 1856 |
| T86235_T26 (SEQ ID NO: 1983) | 1876 | 1899 |
| T86235_T28 (SEQ ID NO: 1984) | 799 | 822 |
| T86235_T38 (SEQ ID NO: 1993) | 309 | 332 |

This segment can be found in the following protein(s): T86235_P28, T86235_P2, T86235_P3, T86235_P4, T86235_P6, T86235_P7, T86235_P8, T86235_P10, T86235_P11, T86235_P1 and T86235_P14.

Segment cluster T86235_node_55 (SEQ ID NO:2042) according to the present invention can be found in the following transcript(s): T86235_T1 (SEQ ID NO:1962), T86235_T2 (SEQ ID NO:1963), T86235_T3 (SEQ ID NO:1964), T86235_T4 (SEQ ID NO:1965), T86235_T7 (SEQ ID NO:1968), T86235_T8 (SEQ ID NO:1969), T86235_T9 (SEQ ID NO:1970), T86235_T10 (SEQ ID NO:1971), T86235_T12 (SEQ ID NO:1972), T86235_T13 (SEQ ID NO:1973), T86235_T14 (SEQ ID NO:1974), T86235_T15 (SEQ ID NO:1975), T86235_T18 (SEQ ID NO:1977), T86235_T21 (SEQ ID NO:1978), T86235_T24 (SEQ ID NO:1981), T86235_T25 (SEQ ID NO:1982), T86235_T26 (SEQ ID NO:1983), T86235_T28 (SEQ ID NO:1984) and T86235_T38 (SEQ ID NO:1993). Table 1915 below describes the starting and ending position of this segment on each transcript.

TABLE 1915

Segment location on transcripts

| Transcript name | Segment starting position | Segment ending position |
|---|---|---|
| T86235_T1 (SEQ ID NO: 1962) | 2399 | 2402 |
| T86235_T2 (SEQ ID NO: 1963) | 2312 | 2315 |
| T86235_T3 (SEQ ID NO: 1964) | 2399 | 2402 |
| T86235_T4 (SEQ ID NO: 1965) | 2399 | 2402 |
| T86235_T7 (SEQ ID NO: 1968) | 2801 | 2804 |
| T86235_T8 (SEQ ID NO: 1969) | 2552 | 2555 |
| T86235_T9 (SEQ ID NO: 1970) | 2954 | 2957 |
| T86235_T10 (SEQ ID NO: 1971) | 2079 | 2082 |
| T86235_T12 (SEQ ID NO: 1972) | 2264 | 2267 |
| T86235_T13 (SEQ ID NO: 1973) | 2801 | 2804 |
| T86235_T14 (SEQ ID NO: 1974) | 2381 | 2384 |
| T86235_T15 (SEQ ID NO: 1975) | 2308 | 2311 |
| T86235_T18 (SEQ ID NO: 1977) | 2301 | 2304 |
| T86235_T21 (SEQ ID NO: 1978) | 2048 | 2051 |
| T86235_T24 (SEQ ID NO: 1981) | 1988 | 1991 |
| T86235_T25 (SEQ ID NO: 1982) | 1857 | 1860 |
| T86235_T26 (SEQ ID NO: 1983) | 1900 | 1903 |
| T86235_T28 (SEQ ID NO: 1984) | 823 | 826 |
| T86235_T38 (SEQ ID NO: 1993) | 333 | 336 |

This segment can be found in the following protein(s): T86235_P28, T86235_P2, T86235_P3, T86235_P4, T86235_P7, T86235_P8, T86235_P10, T86235_P11, T86235_P1 and T86235_P14.

Description for Cluster W01871

Cluster W01871 features 7 transcript(s) and 23 segment(s) of interest, the names for which are given in Tables 1916 and 1917, respectively, the sequences themselves are given at the end of the application. The selected protein variants are given in Table 1918.

TABLE 1916

Transcripts of interest

| Transcript Name |
|---|
| W01871_T2 (SEQ ID NO: 2043) |
| W01871_T4 (SEQ ID NO: 2044) |
| W01871_T5 (SEQ ID NO: 2045) |
| W01871_T10 (SEQ ID NO: 2046) |
| W01871_T15 (SEQ ID NO: 2047) |
| W01871_T34 (SEQ ID NO: 2048) |
| W01871_T43 (SEQ ID NO: 2049) |

TABLE 1917

Segments of interest
Segment Name

W01871_node_0 (SEQ ID NO: 2050)
W01871_node_1 (SEQ ID NO: 2051)
W01871_node_37 (SEQ ID NO: 2052)
W01871_node_40 (SEQ ID NO: 2053)
W01871_node_42 (SEQ ID NO: 2054)
W01871_node_47 (SEQ ID NO: 2055)
W01871_node_52 (SEQ ID NO: 2056)
W01871_node_3 (SEQ ID NO: 2057)
W01871_node_7 (SEQ ID NO: 2058)
W01871_node_9 (SEQ ID NO: 2059)
W01871_node_11 (SEQ ID NO: 2060)
W01871_node_13 (SEQ ID NO: 2061)
W01871_node_14 (SEQ ID NO: 2062)
W01871_node_18 (SEQ ID NO: 2063)
W01871_node_21 (SEQ ID NO: 2064)
W01871_node_24 (SEQ ID NO: 2065)
W01871_node_25 (SEQ ID NO: 2066)
W01871_node_27 (SEQ ID NO: 2067)
W01871_node_30 (SEQ ID NO: 2068)
W01871_node_32 (SEQ ID NO: 2069)
W01871_node_35 (SEQ ID NO: 2070)
W01871_node_44 (SEQ ID NO: 2071)
W01871_node_49 (SEQ ID NO: 2072)

TABLE 1918

Proteins of interest

| Protein Name | Corresponding Transcript(s) |
| --- | --- |
| W01871_P1 | W01871_T4 (SEQ ID NO: 2044); W01871_T5 (SEQ ID NO: 2045) |
| W01871_P2 | W01871_T2 (SEQ ID NO: 2043) |
| W01871_P5 | W01871_T10 (SEQ ID NO: 2046) |
| W01871_P7 | W01871_T15 (SEQ ID NO: 2047) |
| W01871_P25 | W01871_T34 (SEQ ID NO: 2048) |
| W01871_P34 | W01871_T43 (SEQ ID NO: 2049) |

Cluster W01871 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 50 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 50 and Table 1919. This cluster is overexpressed (at least at a minimum level) in the following pathological conditions: epithelial malignant tumors and a mixture of malignant tumors from different tissues.

TABLE 1919

Normal tissue distribution

| Name of Tissue | Number |
| --- | --- |
| Bladder | 0 |
| Bone | 0 |
| Brain | 0 |
| Colon | 0 |
| epithelial | 2 |
| general | 4 |
| kidney | 0 |
| Liver | 0 |

TABLE 1919-continued

Normal tissue distribution

| Name of Tissue | Number |
| --- | --- |
| Lung | 1 |
| lymph nodes | 18 |
| bone marrow | 62 |
| muscle | 1 |
| Ovary | 0 |
| prostate | 0 |
| Skin | 13 |
| stomach | 0 |
| uterus | 0 |

TABLE 1920

P values and ratios for expression in cancerous tissue

| Name of Tissue | P1 | P2 | SP1 | R3 | SP2 | R4 |
| --- | --- | --- | --- | --- | --- | --- |
| bladder | 5.4e−01 | 3.4e−01 | 5.6e−01 | 1.8 | 4.6e−01 | 1.9 |
| Bone | 1 | 4.3e−01 | 1 | 1.0 | 1 | 1.3 |
| Brain | 1 | 3.7e−01 | 1 | 1.0 | 1.1e−01 | 5.1 |
| Colon | 4.2e−01 | 2.2e−01 | 1 | 1.1 | 3.5e−01 | 2.2 |
| epithelial | 8.9e−02 | 6.7e−05 | 8.4e−02 | 2.7 | 6.6e−06 | 7.5 |
| general | 5.8e−02 | 4.6e−08 | 2.7e−01 | 1.5 | 7.4e−09 | 4.9 |
| kidney | 1 | 3.5e−01 | 1 | 1.0 | 4.9e−01 | 1.9 |
| Liver | 1 | 4.5e−01 | 1 | 1.0 | 1.6e−01 | 2.3 |
| Lung | 7.4e−01 | 6.9e−01 | 4.1e−01 | 2.2 | 2.4e−01 | 2.6 |
| lymph nodes | 9.2e−01 | 4.0e−01 | 1 | 0.5 | 4.4e−01 | 1.6 |
| bone marrow | 7.1e−01 | 8.4e−01 | 1 | 0.3 | 7.4e−01 | 0.9 |
| muscle | 1.0e−01 | 1.7e−01 | 1.5e−01 | 7.2 | 3.9e−01 | 2.6 |
| Ovary | 6.4e−01 | 4.4e−01 | 6.8e−01 | 1.5 | 5.9e−01 | 1.6 |
| prostate | 1 | 6.0e−01 | 1 | 1.0 | 7.5e−01 | 1.4 |
| Skin | 9.2e−01 | 4.0e−01 | 1 | 0.5 | 7.1e−01 | 1.1 |
| stomach | 3.0e−01 | 1.3e−01 | 5.0e−01 | 2.0 | 1.1e−01 | 3.0 |
| uterus | 4.7e−01 | 4.5e−02 | 6.6e−01 | 1.5 | 1.7e−01 | 3.0 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 1921.

TABLE 1921

Oligonucleotides related to this cluster

| Oligonucleotide name | Overexpressed in cancers | Chip reference |
| --- | --- | --- |
| W01871_0_0_59149 | lung malignant tumors | LUN |

As noted above, cluster W01871 features 23 segment(s), which were listed in Table 1917 above and for which the sequence(s) are given at the end of the application. These segment(s) are portions of nucleic acid sequence(s) which are described herein separately because they are of particular interest. A description of each segment according to the present invention is now provided.

Segment cluster W01871_node_0 (SEQ ID NO:2050) according to the present invention is supported by 24 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1922 below describes the starting and ending position of this segment on each transcript.

TABLE 1922

Segment location on transcripts

| Transcript name | Segment starting position | Segment ending position |
|---|---|---|
| W01871_T2 (SEQ ID NO: 2043) | 1 | 145 |
| W01871_T4 (SEQ ID NO: 2044) | 1 | 145 |
| W01871_T5 (SEQ ID NO: 2045) | 1 | 145 |
| W01871_T10 (SEQ ID NO: 2046) | 1 | 145 |
| W01871_T15 (SEQ ID NO: 2047) | 1 | 145 |
| W01871_T34 (SEQ ID NO: 2048) | 1 | 145 |
| W01871_T43 (SEQ ID NO: 2049) | 1 | 145 |

This segment can be found in a non-coding region of transcript(s) that are related to the following protein(s): W01871_P2, W01871_P1, W01871_P5, W01871_P7, W01871_P25 and W01871_P34.

Segment cluster W01871_node_1 (SEQ ID NO:2051) according to the present invention is supported by 6 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1923 below describes the starting and ending position of this segment on each transcript.

TABLE 1923

Segment location on transcripts

| Transcript name | Segment starting position | Segment ending position |
|---|---|---|
| W01871_T2 (SEQ ID NO: 2043) | 146 | 336 |
| W01871_T4 (SEQ ID NO: 2044) | 146 | 336 |
| W01871_T5 (SEQ ID NO: 2045) | 146 | 336 |
| W01871_T10 (SEQ ID NO: 2046) | 146 | 336 |
| W01871_T15 (SEQ ID NO: 2047) | 146 | 336 |
| W01871_T34 (SEQ ID NO: 2048) | 146 | 336 |
| W01871_T43 (SEQ ID NO: 2049) | 146 | 336 |

This segment can be found in a non-coding region of transcript(s) that are related to the following protein(s): W01871_P2, W01871_P1, W01871_P5, W01871_P7, W01871_P25 and W01871_P34.

Segment cluster W01871_node_37 (SEQ ID NO:2052) according to the present invention is supported by 60 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1924 below describes the starting and ending position of this segment on each transcript.

TABLE 1924

Segment location on transcripts

| Transcript name | Segment starting position | Segment ending position |
|---|---|---|
| W01871_T2 (SEQ ID NO: 2043) | 1210 | 1341 |
| W01871_T4 (SEQ ID NO: 2044) | 1296 | 1427 |
| W01871_T5 (SEQ ID NO: 2045) | 1379 | 1510 |
| W01871_T10 (SEQ ID NO: 2046) | 1235 | 1366 |
| W01871_T15 (SEQ ID NO: 2047) | 1358 | 1489 |
| W01871_T34 (SEQ ID NO: 2048) | 974 | 1105 |
| W01871_T43 (SEQ ID NO: 2049) | 974 | 1105 |

This segment can be found in the following protein(s): W01871_P2, W01871_P1, W01871_P5, W01871_P7, W01871_P25 and W01871_P34.

Segment cluster W01871_node_40 (SEQ ID NO:2053) according to the present invention is supported by 57 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046) and W01871_T15 (SEQ ID NO:2047). Table 1925 below describes the starting and ending position of this segment on each transcript.

TABLE 1925

Segment location on transcripts

| Transcript name | Segment starting position | Segment ending position |
|---|---|---|
| W01871_T2 (SEQ ID NO: 2043) | 1342 | 1464 |
| W01871_T4 (SEQ ID NO: 2044) | 1428 | 1550 |
| W01871_T5 (SEQ ID NO: 2045) | 1511 | 1633 |
| W01871_T10 (SEQ ID NO: 2046) | 1367 | 1489 |
| W01871_T15 (SEQ ID NO: 2047) | 1490 | 1612 |

This segment can be found in the following protein(s): W01871_P2, W01871_P1, W01871_P5 and W01871_P7.

Segment cluster W01871_node_42 (SEQ ID NO:2054) according to the present invention is supported by 68 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1926 below describes the starting and ending position of this segment on each transcript.

TABLE 1926

Segment location on transcripts

| Transcript name | Segment starting position | Segment ending position |
|---|---|---|
| W01871_T2 (SEQ ID NO: 2043) | 1465 | 1696 |
| W01871_T4 (SEQ ID NO: 2044) | 1551 | 1782 |
| W01871_T5 (SEQ ID NO: 2045) | 1634 | 1865 |
| W01871_T10 (SEQ ID NO: 2046) | 1490 | 1721 |
| W01871_T15 (SEQ ID NO: 2047) | 1613 | 1844 |
| W01871_T34 (SEQ ID NO: 2048) | 1106 | 1337 |
| W01871_T43 (SEQ ID NO: 2049) | 1106 | 1337 |

This segment can be found in the following protein(s): W01871_P2, W01871_P1, W01871_P5, W01871_P7, W01871_P25 and W01871_P34.

Segment cluster W01871_node_47 (SEQ ID NO:2055) according to the present invention is supported by 59 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1927 below describes the starting and ending position of this segment on each transcript.

TABLE 1927

Segment location on transcripts

| Transcript name | Segment starting position | Segment ending position |
| --- | --- | --- |
| W01871_T2 (SEQ ID NO: 2043) | 1794 | 1962 |
| W01871_T4 (SEQ ID NO: 2044) | 1880 | 2048 |
| W01871_T5 (SEQ ID NO: 2045) | 1963 | 2131 |
| W01871_T10 (SEQ ID NO: 2046) | 1819 | 1987 |
| W01871_T15 (SEQ ID NO: 2047) | 1942 | 2110 |
| W01871_T34 (SEQ ID NO: 2048) | 1435 | 1603 |
| W01871_T43 (SEQ ID NO: 2049) | 1435 | 1603 |

This segment can be found in the following protein(s): W01871_P2, W01871_P1, W01871_P5, W01871_P7, W01871_P25 and W01871_P34.

Segment cluster W01871_node_52 (SEQ ID NO:2056) according to the present invention is supported by 75 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1928 below describes the starting and ending position of this segment on each transcript.

TABLE 1928

Segment location on transcripts

| Transcript name | Segment starting position | Segment ending position |
| --- | --- | --- |
| W01871_T2 (SEQ ID NO: 2043) | 2067 | 2600 |
| W01871_T4 (SEQ ID NO: 2044) | 2153 | 2686 |
| W01871_T5 (SEQ ID NO: 2045) | 2236 | 2769 |
| W01871_T10 (SEQ ID NO: 2046) | 2092 | 2625 |
| W01871_T15 (SEQ ID NO: 2047) | 2215 | 2748 |
| W01871_T34 (SEQ ID NO: 2048) | 1708 | 2241 |
| W01871_T43 (SEQ ID NO: 2049) | 1604 | 2137 |

This segment can be found in the following protein(s): W01871_P2, W01871_P1, W01871_P5, W01871_P7, W01871_P25 and W01871_P34.

According to an optional embodiment of the present invention, short segments related to the above cluster are also provided. These segments are up to about 120 bp in length, and so are included in a separate description.

Segment cluster W01871_node_3 (SEQ ID NO:2057) according to the present invention is supported by 5 libraries. The number of libraries was determined as previously described. This segment can be found in the following transcript(s): W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 14 below describes the starting and ending position of this segment on each transcript.

TABLE 1929

Segment location on transcripts

| Transcript name | Segment starting position | Segment ending position |
| --- | --- | --- |
| W01871_T5 (SEQ ID NO: 2045) | 337 | 419 |
| W01871_T10 (SEQ ID NO: 2046) | 337 | 419 |
| W01871_T15 (SEQ ID NO: 2047) | 337 | 419 |
| W01871_T34 (SEQ ID NO: 2048) | 337 | 419 |
| W01871_T43 (SEQ ID NO: 2049) | 337 | 419 |

This segment can be found in a non-coding region of transcript(s) that are related to the following protein(s): W01871_P1, W01871_P5, W01871_P7, W01871_P25 and W01871_P34.

Segment cluster W01871_node_7 (SEQ ID NO:2058) according to the present invention is supported by 36 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1930 below describes the starting and ending position of this segment on each transcript.

TABLE 1930

Segment location on transcripts

| Transcript name | Segment starting position | Segment ending position |
| --- | --- | --- |
| W01871_T2 (SEQ ID NO: 2043) | 337 | 432 |
| W01871_T4 (SEQ ID NO: 2044) | 337 | 432 |
| W01871_T5 (SEQ ID NO: 2045) | 420 | 515 |
| W01871_T10 (SEQ ID NO: 2046) | 420 | 515 |
| W01871_T15 (SEQ ID NO: 2047) | 420 | 515 |
| W01871_T34 (SEQ ID NO: 2048) | 420 | 515 |
| W01871_T43 (SEQ ID NO: 2049) | 420 | 515 |

This segment can be found in both coding and non-coding regions of transcript(s) as follows. The segment can be found in a non-coding region of transcript(s) that are related to the following protein(s): W01871_P7. This segment can also be found in the following protein(s): W01871_P2, W01871_P1, W01871_P5, W01871_P25 and W01871_P34, since it is in the coding region for the corresponding transcript.

Segment cluster W01871_node_9 (SEQ ID NO:2059) according to the present invention is supported by 30 libraries. The number of libraries was determined as previously described. This segment can be found in the following transcript(s): W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1931 below describes the starting and ending position of this segment on each transcript.

TABLE 1931

Segment location on transcripts

| Transcript name | Segment starting position | Segment ending position |
|---|---|---|
| W01871_T4 (SEQ ID NO: 2044) | 433 | 518 |
| W01871_T5 (SEQ ID NO: 2045) | 516 | 601 |
| W01871_T10 (SEQ ID NO: 2046) | 516 | 601 |
| W01871_T15 (SEQ ID NO: 2047) | 516 | 601 |
| W01871_T34 (SEQ ID NO: 2048) | 516 | 601 |
| W01871_T43 (SEQ ID NO: 2049) | 516 | 601 |

This segment can be found in both coding and non-coding regions of transcript(s) as follows. The segment can be found in a non-coding region of transcript(s) that are related to the following protein(s): W01871_P7. This segment can also be found in the following protein(s): W01871_P1, W01871_P5, W01871_P25 and W01871_P34, since it is in the coding region for the corresponding transcript.

Segment cluster W01871_node_11 (SEQ ID NO:2060) according to the present invention is supported by 46 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1932 below describes the starting and ending position of this segment on each transcript.

TABLE 1932

Segment location on transcripts

| Transcript name | Segment starting position | Segment ending position |
|---|---|---|
| W01871_T2 (SEQ ID NO: 2043) | 433 | 549 |
| W01871_T4 (SEQ ID NO: 2044) | 519 | 635 |
| W01871_T5 (SEQ ID NO: 2045) | 602 | 718 |
| W01871_T10 (SEQ ID NO: 2046) | 602 | 718 |
| W01871_T15 (SEQ ID NO: 2047) | 602 | 718 |
| W01871_T34 (SEQ ID NO: 2048) | 602 | 718 |
| W01871_T43 (SEQ ID NO: 2049) | 602 | 718 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1933.

TABLE 1933

Oligonucleotides related to this segment

| Oligonucleotide name | Overexpressed in cancers | Chip reference |
|---|---|---|
| W01871_0_7_0 | breast malignant tumors | BRS |
| W01871_0_7_0 | lung malignant tumors | LUN |

This segment can be found in both coding and non-coding regions of transcript(s) as follows. The segment can be found in a non-coding region of transcript(s) that are related to the following protein(s): W01871_P7. This segment can also be found in the following protein(s): W01871_P2, W01871_P1, W01871_P5, W01871_P25 and W01871_P34, since it is in the coding region for the corresponding transcript.

Segment cluster W01871_node_13 (SEQ ID NO:2061) according to the present invention is supported by 37 libraries. The number of libraries was determined as previously described. This segment can be found in the following transcript(s): W01871_T2 (SEQ ID NO:2043), W01871_T4 (SEQ ID NO:2044) and W01871_T5 (SEQ ID NO:2045). Table 1934 below describes the starting and ending position of this segment on each transcript.

TABLE 1934

Segment location on transcripts

| Transcript name | Segment starting position | Segment ending position |
|---|---|---|
| W01871_T2 (SEQ ID NO: 2043) | 550 | 591 |
| W01871_T4 (SEQ ID NO: 2044) | 636 | 677 |
| W01871_T5 (SEQ ID NO: 2045) | 719 | 760 |

This segment can be found in the following protein(s): W01871_P2 and W01871_P1.

Segment cluster W01871_node_14 (SEQ ID NO:2062) according to the present invention is supported by 41 libraries. The number of libraries was determined as previously described. This segment can be found in the following transcript(s): W01871_T2 (SEQ ID NO:2043), W01871_T4 (SEQ ID NO:2044) and W01871_T5 (SEQ ID NO:2045). Table 1935 below describes the starting and ending position of this segment on each transcript.

TABLE 1935

Segment location on transcripts

| Transcript name | Segment starting position | Segment ending position |
|---|---|---|
| W01871_T2 (SEQ ID NO: 2043) | 592 | 693 |
| W01871_T4 (SEQ ID NO: 2044) | 678 | 779 |
| W01871_T5 (SEQ ID NO: 2045) | 761 | 862 |

This segment can be found in the following protein(s): W01871_P2 and W01871_P1.

Segment cluster W01871_node_18 (SEQ ID NO:2063) according to the present invention is supported by 48 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046) and W01871_T15 (SEQ ID NO:2047). Table 1936 below describes the starting and ending position of this segment on each transcript.

TABLE 1936

Segment location on transcripts

| Transcript name | Segment starting position | Segment ending position |
|---|---|---|
| W01871_T2 (SEQ ID NO: 2043) | 694 | 762 |
| W01871_T4 (SEQ ID NO: 2044) | 780 | 848 |
| W01871_T5 (SEQ ID NO: 2045) | 863 | 931 |
| W01871_T10 (SEQ ID NO: 2046) | 719 | 787 |
| W01871_T15 (SEQ ID NO: 2047) | 719 | 787 |

This segment can be found in both coding and non-coding regions of transcript(s) as follows. The segment can be found in a non-coding region of transcript(s) that are related to the following protein(s): W01871_P7. This segment can also be found in the following protein(s): W01871_P2, W01871_P1 and W01871_P5, since it is in the coding region for the corresponding transcript.

Segment cluster W01871_node_21 (SEQ ID NO:2064) according to the present invention is supported by 57 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046) and W01871_T15 (SEQ ID NO:2047). Table 1937 below describes the starting and ending position of this segment on each transcript.

TABLE 1937

Segment location on transcripts

| Transcript name | Segment starting position | Segment ending position |
|---|---|---|
| W01871_T2 (SEQ ID NO: 2043) | 763 | 855 |
| W01871_T4 (SEQ ID NO: 2044) | 849 | 941 |
| W01871_T5 (SEQ ID NO: 2045) | 932 | 1024 |
| W01871_T10 (SEQ ID NO: 2046) | 788 | 880 |
| W01871_T15 (SEQ ID NO: 2047) | 788 | 880 |

This segment can be found in both coding and non-coding regions of transcript(s) as follows. The segment can be found in a non-coding region of transcript(s) that are related to the following protein(s): W01871_P7. This segment can also be found in the following protein(s): W01871_P2, W01871_P1 and W01871_P5, since it is in the coding region for the corresponding transcript.

Segment cluster W01871_node_24 (SEQ ID NO:2065) according to the present invention can be found in the following transcript(s): W01871_T15 (SEQ ID NO:2047). Table 1938 below describes the starting and ending position of this segment on each transcript.

TABLE 1938

Segment location on transcripts

| Transcript name | Segment starting position | Segment ending position |
|---|---|---|
| W01871_T15 (SEQ ID NO: 2047) | 881 | 905 |

This segment can be found in a non-coding region of transcript(s) that are related to the following protein(s): W01871_P7.

Segment cluster W01871_node_25 (SEQ ID NO:2066) according to the present invention is supported by 14 libraries. The number of libraries was determined as previously described. This segment can be found in the following transcript(s): W01871_T15 (SEQ ID NO:2047). Table 1939 below describes the starting and ending position of this segment on each transcript.

TABLE 1939

Segment location on transcripts

| Transcript name | Segment starting position | Segment ending position |
|---|---|---|
| W01871_T15 (SEQ ID NO: 2047) | 906 | 1003 |

This segment can be found in a non-coding region of transcript(s) that are related to the following protein(s): W01871_P7.

Segment cluster W01871_node_27 (SEQ ID NO:2067) according to the present invention is supported by 57 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046) and W01871_T15 (SEQ ID NO:2047). Table 1940 below describes the starting and ending position of this segment on each transcript.

TABLE 1940

Segment location on transcripts

| Transcript name | Segment starting position | Segment ending position |
|---|---|---|
| W01871_T2 (SEQ ID NO: 2043) | 856 | 954 |
| W01871_T4 (SEQ ID NO: 2044) | 942 | 1040 |
| W01871_T5 (SEQ ID NO: 2045) | 1025 | 1123 |
| W01871_T10 (SEQ ID NO: 2046) | 881 | 979 |
| W01871_T15 (SEQ ID NO: 2047) | 1004 | 1102 |

This segment can be found in the following protein(s): W01871_P2, W01871_P1, W01871_P5 and W01871_P7.

Segment cluster W01871_node_30 (SEQ ID NO:2068) according to the present invention is supported by 53 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1941 below describes the starting and ending position of this segment on each transcript.

TABLE 1941

Segment location on transcripts

| Transcript name | Segment starting position | Segment ending position |
|---|---|---|
| W01871_T2 (SEQ ID NO: 2043) | 955 | 1023 |
| W01871_T4 (SEQ ID NO: 2044) | 1041 | 1109 |
| W01871_T5 (SEQ ID NO: 2045) | 1124 | 1192 |
| W01871_T10 (SEQ ID NO: 2046) | 980 | 1048 |
| W01871_T15 (SEQ ID NO: 2047) | 1103 | 1171 |
| W01871_T34 (SEQ ID NO: 2048) | 719 | 787 |
| W01871_T43 (SEQ ID NO: 2049) | 719 | 787 |

This segment can be found in the following protein(s): W01871_P2, W01871_P1, W01871_P5, W01871_P7, W01871_P25 and W01871_P34.

Segment cluster W01871_node_32 (SEQ ID NO:2069) according to the present invention is supported by 54 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1942 below describes the starting and ending position of this segment on each transcript.

TABLE 1942

Segment location on transcripts

| Transcript name | Segment starting position | Segment ending position |
|---|---|---|
| W01871_T2 (SEQ ID NO: 2043) | 1024 | 1122 |
| W01871_T4 (SEQ ID NO: 2044) | 1110 | 1208 |
| W01871_T5 (SEQ ID NO: 2045) | 1193 | 1291 |
| W01871_T10 (SEQ ID NO: 2046) | 1049 | 1147 |
| W01871_T15 (SEQ ID NO: 2047) | 1172 | 1270 |
| W01871_T34 (SEQ ID NO: 2048) | 788 | 886 |
| W01871_T43 (SEQ ID NO: 2049) | 788 | 886 |

This segment can be found in the following protein(s): W01871_P2, W01871_P1, W01871_P5, W01871_P7, W01871_P25 and W01871_P34.

Segment cluster W01871_node_35 (SEQ ID NO:2070) according to the present invention is supported by 52 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1943 below describes the starting and ending position of this segment on each transcript.

TABLE 1943

Segment location on transcripts

| Transcript name | Segment starting position | Segment ending position |
|---|---|---|
| W01871_T2 (SEQ ID NO: 2043) | 1123 | 1209 |
| W01871_T4 (SEQ ID NO: 2044) | 1209 | 1295 |
| W01871_T5 (SEQ ID NO: 2045) | 1292 | 1378 |
| W01871_T10 (SEQ ID NO: 2046) | 1148 | 1234 |
| W01871_T15 (SEQ ID NO: 2047) | 1271 | 1357 |
| W01871_T34 (SEQ ID NO: 2048) | 887 | 973 |
| W01871_T43 (SEQ ID NO: 2049) | 887 | 973 |

This segment can be found in the following protein(s): W01871_P2, W01871_P1, W01871_P5, W01871_P7, W01871_P25 and W01871_P34.

Segment cluster W01871_node_44 (SEQ ID NO:2071) according to the present invention is supported by 62 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047), W01871_T34 (SEQ ID NO:2048) and W01871_T43 (SEQ ID NO:2049). Table 1944 below describes the starting and ending position of this segment on each transcript.

TABLE 1944

Segment location on transcripts

| Transcript name | Segment starting position | Segment ending position |
|---|---|---|
| W01871_T2 (SEQ ID NO: 2043) | 1697 | 1793 |
| W01871_T4 (SEQ ID NO: 2044) | 1783 | 1879 |
| W01871_T5 (SEQ ID NO: 2045) | 1866 | 1962 |
| W01871_T10 (SEQ ID NO: 2046) | 1722 | 1818 |

TABLE 1944-continued

Segment location on transcripts

| Transcript name | Segment starting position | Segment ending position |
|---|---|---|
| W01871_T15 (SEQ ID NO: 2047) | 1845 | 1941 |
| W01871_T34 (SEQ ID NO: 2048) | 1338 | 1434 |
| W01871_T43 (SEQ ID NO: 2049) | 1338 | 1434 |

This segment can be found in the following protein(s): W01871_P2, W01871_P1, W01871_P5, W01871_P7, W01871_P25 and W01871_P34.

Segment cluster W01871_node_49 (SEQ ID NO:2072) according to the present invention is supported by 66 libraries. The number of libraries was determined as previously described. This segment can be found in the following transcript(s): W01871_T2 (SEQ ID NO:2043), W01871_T4 (SEQ ID NO:2044), W01871_T5 (SEQ ID NO:2045), W01871_T10 (SEQ ID NO:2046), W01871_T15 (SEQ ID NO:2047) and W01871_T34 (SEQ ID NO:2048). Table 1945 below describes the starting and ending position of this segment on each transcript.

TABLE 1945

Segment location on transcripts

| Transcript name | Segment starting position | Segment ending position |
|---|---|---|
| W01871_T2 (SEQ ID NO: 2043) | 1963 | 2066 |
| W01871_T4 (SEQ ID NO: 2044) | 2049 | 2152 |
| W01871_T5 (SEQ ID NO: 2045) | 2132 | 2235 |
| W01871_T10 (SEQ ID NO: 2046) | 1988 | 2091 |
| W01871_T15 (SEQ ID NO: 2047) | 2111 | 2214 |
| W01871_T34 (SEQ ID NO: 2048) | 1604 | 1707 |

This segment can be found in the following protein(s): W01871_P2, W01871_P1, W01871_P5, W01871_P7 and W01871_P25.

Description for Cluster Z19204

Cluster Z19204 features 6 transcript(s) and 49 segment(s) of interest, the names for which are given in Tables 1946 and 1947, respectively, the sequences themselves are given at the end of the application. The selected protein variants are given in Table 1948.

TABLE 1946

Transcripts of interest
Transcript Name

| |
|---|
| Z19204_T27 (SEQ ID NO: 2073) |
| Z19204_T29 (SEQ ID NO: 2074) |
| Z19204_T30 (SEQ ID NO: 2075) |
| Z19204_T31 (SEQ ID NO: 2076) |
| Z19204_T34 (SEQ ID NO: 2077) |
| Z19204_T42 (SEQ ID NO: 2078) |

TABLE 1947

Segments of interest
Segment Name

| |
|---|
| Z19204_node_0 (SEQ ID NO: 2079) |
| Z19204_node_1 (SEQ ID NO: 2080) |
| Z19204_node_2 (SEQ ID NO: 2081) |
| Z19204_node_4 (SEQ ID NO: 2082) |

TABLE 1947-continued

Segments of interest
Segment Name

Z19204_node_17 (SEQ ID NO: 2083)
Z19204_node_49 (SEQ ID NO: 2084)
Z19204_node_50 (SEQ ID NO: 2085)
Z19204_node_58 (SEQ ID NO: 2086)
Z19204_node_63 (SEQ ID NO: 2087)
Z19204_node_64 (SEQ ID NO: 2088)
Z19204_node_65 (SEQ ID NO: 2089)
Z19204_node_75 (SEQ ID NO: 2090)
Z19204_node_18 (SEQ ID NO: 2091)
Z19204_node_19 (SEQ ID NO: 2092)
Z19204_node_20 (SEQ ID NO: 2093)
Z19204_node_21 (SEQ ID NO: 2094)
Z19204_node_22 (SEQ ID NO: 2095)
Z19204_node_23 (SEQ ID NO: 2096)
Z19204_node_25 (SEQ ID NO: 2097)
Z19204_node_26 (SEQ ID NO: 2098)
Z19204_node_27 (SEQ ID NO: 2099)
Z19204_node_28 (SEQ ID NO: 2100)
Z19204_node_29 (SEQ ID NO: 2101)
Z19204_node_30 (SEQ ID NO: 2102)
Z19204_node_31 (SEQ ID NO: 2103)
Z19204_node_32 (SEQ ID NO: 2104)
Z19204_node_34 (SEQ ID NO: 2105)
Z19204_node_35 (SEQ ID NO: 2106)
Z19204_node_36 (SEQ ID NO: 2107)
Z19204_node_40 (SEQ ID NO: 2108)
Z19204_node_48 (SEQ ID NO: 2109)
Z19204_node_51 (SEQ ID NO: 2110)
Z19204_node_52 (SEQ ID NO: 2111)
Z19204_node_53 (SEQ ID NO: 2112)
Z19204_node_54 (SEQ ID NO: 2113)
Z19204_node_55 (SEQ ID NO: 2114)
Z19204_node_56 (SEQ ID NO: 2115)
Z19204_node_57 (SEQ ID NO: 2116)
Z19204_node_59 (SEQ ID NO: 2117)
Z19204_node_60 (SEQ ID NO: 2118)
Z19204_node_61 (SEQ ID NO: 2119)
Z19204_node_62 (SEQ ID NO: 2120)
Z19204_node_66 (SEQ ID NO: 2121)
Z19204_node_67 (SEQ ID NO: 2122)
Z19204_node_68 (SEQ ID NO: 2123)
Z19204_node_69 (SEQ ID NO: 2124)
Z19204_node_70 (SEQ ID NO: 2125)
Z19204_node_73 (SEQ ID NO: 2126)
Z19204_node_74 (SEQ ID NO: 2127)

TABLE 1948

Proteins of interest

| Protein Name | Corresponding Transcript(s) |
|---|---|
| Z19204_P1 | Z19204_T27 (SEQ ID NO: 2073); Z19204_T29 (SEQ ID NO: 2074); Z19204_T30 (SEQ ID NO: 2075); Z19204_T31 (SEQ ID NO: 2076) |
| Z19204_P13 | Z19204_T34 (SEQ ID NO: 2077) |
| Z19204_P15 | Z19204_T42 (SEQ ID NO: 2078) |

These sequences are variants of the known protein Cold-inducible RNA-binding protein (SwissProt accession identifier CIRP_HUMAN; known also according to the synonyms Glycine-rich RNA-binding protein CIRP; A18 hnRNP), referred to herein as the previously known protein.

Protein Cold-inducible RNA-binding protein is known or believed to have the following function(s): Seems to play an essential role in cold-induced suppression of cell proliferation. The sequence for protein Cold-inducible RNA-binding protein is given at the end of the application, as "Cold-inducible RNA-binding protein amino acid sequence". Protein Cold-inducible RNA-binding protein localization is believed to be Nuclear; nucleoplasm (By similarity).

The following GO Annotation(s) apply to the previously known protein. The following annotation(s) were found: response to cold, which are annotation(s) related to Biological Process; RNA binding, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z19204 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 51 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 51 and Table 1949. This cluster is overexpressed (at least at a minimum level) in the following pathological conditions: breast malignant tumors.

51

TABLE 1949

Normal tissue distribution

| Name of Tissue | Number |
|---|---|
| Adrenal | 689 |
| Bladder | 1067 |
| Bone | 472 |
| Brain | 580 |
| Colon | 466 |
| Epithelial | 458 |
| General | 448 |
| head and neck | 111 |
| Kidney | 338 |
| Liver | 253 |
| Lung | 417 |
| lymph nodes | 441 |
| Breast | 123 |
| bone marrow | 94 |
| Muscle | 174 |
| Ovary | 1398 |
| Pancreas | 515 |
| Prostate | 241 |
| Skin | 389 |
| Stomach | 146 |
| T cells | 0 |
| Thyroid | 0 |
| Uterus | 532 |

TABLE 1950

P values and ratios for expression in cancerous tissue

| Name of Tissue | P1 | P2 | SP1 | R3 | SP2 | R4 |
|---|---|---|---|---|---|---|
| Adrenal | 5.5e-01 | 6.4e-01 | 9.1e-01 | 0.5 | 9.8e-01 | 0.4 |
| Bladder | 6.3e-01 | 6.8e-01 | 1 | 0.3 | 1 | 0.3 |
| Bone | 5.8e-01 | 4.1e-01 | 8.8e-01 | 0.5 | 9.8e-01 | 0.5 |
| Brain | 6.6e-01 | 6.6e-01 | 7.4e-02 | 0.8 | 5.8e-01 | 0.7 |
| Colon | 6.0e-01 | 6.4e-01 | 9.6e-01 | 0.5 | 9.9e-01 | 0.5 |
| Epithelial | 2.9e-01 | 7.6e-01 | 9.9e-01 | 0.8 | 1 | 0.6 |
| General | 3.8e-01 | 8.8e-01 | 9.4e-01 | 0.9 | 1 | 0.6 |
| head and neck | 5.6e-01 | 6.4e-01 | 7.1e-01 | 1.0 | 6.3e-01 | 1.0 |
| Kidney | 6.1e-01 | 6.7e-01 | 2.6e-01 | 1.0 | 5.3e-01 | 0.9 |

TABLE 1950-continued

P values and ratios for expression in cancerous tissue

| Name of Tissue | P1 | P2 | SP1 | R3 | SP2 | R4 |
|---|---|---|---|---|---|---|
| Liver | 5.5e−01 | 8.1e−01 | 5.1e−01 | 1.2 | 9.5e−01 | 0.5 |
| Lung | 7.2e−01 | 8.0e−01 | 6.5e−01 | 0.6 | 6.8e−01 | 0.5 |
| lymph nodes | 5.0e−01 | 7.2e−01 | 7.0e−01 | 0.7 | 9.8e−01 | 0.4 |
| Breast | 4.8e−03 | 5.7e−03 | 1.6e−02 | 2.2 | 5.9e−02 | 1.8 |
| bone marrow | 5.1e−01 | 7.5e−01 | 4.8e−01 | 2.5 | 8.5e−01 | 0.8 |
| Muscle | 5.0e−01 | 4.8e−01 | 5.2e−03 | 2.3 | 1.1e−01 | 1.3 |
| Ovary | 7.2e−01 | 7.5e−01 | 1 | 0.1 | 1 | 0.2 |
| Pancreas | 3.6e−01 | 2.6e−01 | 1 | 0.4 | 1 | 0.4 |
| Prostate | 1.4e−01 | 3.2e−01 | 1.9e−06 | 2.8 | 5.4e−04 | 2.0 |
| Skin | 4.7e−01 | 6.2e−01 | 5.4e−01 | 0.6 | 1 | 0.3 |
| stomach | 3.0e−01 | 5.2e−01 | 6.4e−01 | 0.8 | 7.9e−01 | 0.8 |
| T cells | 1 | 6.7e−01 | 1 | 1.0 | 7.2e−01 | 1.4 |
| Thyroid | 4.8e−02 | 4.8e−02 | 3.0e−01 | 2.5 | 3.0e−01 | 2.5 |
| uterus | 6.5e−01 | 7.2e−01 | 1 | 0.4 | 1 | 0.3 |

As noted above, cluster Z19204 features 49 segment(s), which were listed in Table 1947 above and for which the sequence(s) are given at the end of the application. These segment(s) are portions of nucleic acid sequence(s) which are described herein separately because they are of particular interest. A description of each segment according to the present invention is now provided.

Segment cluster Z19204_node_0 (SEQ ID NO:2079) according to the present invention is supported by 8 libraries. The number of libraries was determined as previously described. This segment can be found in the following transcript(s): Z19204_T29 (SEQ ID NO:2074), Z19204_T30 (SEQ ID NO:2075), Z19204_T31 (SEQ ID NO:2076) and Z19204_T34 (SEQ ID NO:2077). Table 1951 below describes the starting and ending position of this segment on each transcript.

TABLE 1951

Segment location on transcripts

| Transcript name | Segment starting position | Segment ending position |
|---|---|---|
| Z19204_T29 (SEQ ID NO: 2074) | 1 | 467 |
| Z19204_T30 (SEQ ID NO: 2075) | 1 | 467 |
| Z19204_T31 (SEQ ID NO: 2076) | 1 | 467 |
| Z19204_T34 (SEQ ID NO: 2077) | 1 | 467 |

This segment can be found in both coding and non-coding regions of transcript(s) as follows. The segment can be found in a non-coding region of transcript(s) that are related to the following protein(s): Z19204_P1. This segment can also be found in the following protein(s): Z19204_P13, since it is in the coding region for the corresponding transcript.

Segment cluster Z19204_node_1 (SEQ ID NO:2080) according to the present invention is supported by 7 libraries. The number of libraries was determined as previously described. This segment can be found in the following transcript(s): Z19204_T29 (SEQ ID NO:2074) and Z19204_T30 (SEQ ID NO:2075). Table 1952 below describes the starting and ending position of this segment on each transcript.

TABLE 1952

Segment location on transcripts

| Transcript name | Segment starting position | Segment ending position |
|---|---|---|
| Z19204_T29 (SEQ ID NO: 2074) | 468 | 835 |
| Z19204_T30 (SEQ ID NO: 2075) | 468 | 835 |

This segment can be found in a non-coding region of transcript(s) that are related to the following protein(s): Z19204_P1.

Segment cluster Z19204_node_2 (SEQ ID NO:2081) according to the present invention is supported by 4 libraries. The number of libraries was determined as previously described. This segment can be found in the following transcript(s): Z19204_T29 (SEQ ID NO:2074). Table 1953 below describes the starting and ending position of this segment on each transcript.

TABLE 1953

Segment location on transcripts

| Transcript name | Segment starting position | Segment ending position |
|---|---|---|
| Z19204_T29 (SEQ ID NO: 2074) | 836 | 969 |

This segment can be found in a non-coding region of transcript(s) that are related to the following protein(s): Z19204_P1.

Segment cluster Z19204_node_4 (SEQ ID NO:2082) according to the present invention is supported by 5 libraries. The number of libraries was determined as previously described. This segment can be found in the following transcript(s): Z19204_T29 (SEQ ID NO:2074) and Z19204_T31 (SEQ ID NO:2076). Table 1954 below describes the starting and ending position of this segment on each transcript.

TABLE 1954

Segment location on transcripts

| Transcript name | Segment starting position | Segment ending position |
|---|---|---|
| Z19204_T29 (SEQ ID NO: 2074) | 970 | 1180 |
| Z19204_T31 (SEQ ID NO: 2076) | 468 | 678 |

This segment can be found in a non-coding region of transcript(s) that are related to the following protein(s): Z19204_P1.

Segment cluster Z19204_node_17 (SEQ ID NO:2083) according to the present invention is supported by 5 libraries. The number of libraries was determined as previously described. This segment can be found in the following transcript(s): Z19204_T27 (SEQ ID NO:2073) and Z19204_T42 (SEQ ID NO:2078). Table 1955 below describes the starting and ending position of this segment on each transcript.

TABLE 1955

Segment location on transcripts

| Transcript name | Segment starting position | Segment ending position |
|---|---|---|
| Z19204_T27 (SEQ ID NO: 2073) | 1 | 522 |
| Z19204_T42 (SEQ ID NO: 2078) | 1 | 522 |

This segment can be found in a non-coding region of transcript(s) that are related to the following protein(s): Z19204_P1 and Z19204_P15.

Segment cluster Z19204_node_49 (SEQ ID NO:2084) according to the present invention is supported by 446 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1956 below describes the starting and ending position of this segment on each transcript.

TABLE 1956

Segment location on transcripts

| Transcript name | Segment starting position | Segment ending position |
|---|---|---|
| Z19204_T27 (SEQ ID NO: 2073) | 1130 | 1253 |
| Z19204_T29 (SEQ ID NO: 2074) | 1727 | 1850 |
| Z19204_T30 (SEQ ID NO: 2075) | 1382 | 1505 |
| Z19204_T31 (SEQ ID NO: 2076) | 1225 | 1348 |
| Z19204_T34 (SEQ ID NO: 2077) | 1014 | 1137 |
| Z19204_T42 (SEQ ID NO: 2078) | 1233 | 1356 |

This segment can be found in a non-coding region of transcript(s) that are related to the following protein(s): Z19204_P1, Z19204_P13 and Z19204_P15.

Segment cluster Z19204_node_50 (SEQ ID NO:2085) according to the present invention is supported by 550 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1957 below describes the starting and ending position of this segment on each transcript.

TABLE 1957

Segment location on transcripts

| Transcript name | Segment starting position | Segment ending position |
|---|---|---|
| Z19204_T27 (SEQ ID NO: 2073) | 1254 | 1584 |
| Z19204_T29 (SEQ ID NO: 2074) | 1851 | 2181 |
| Z19204_T30 (SEQ ID NO: 2075) | 1506 | 1836 |
| Z19204_T31 (SEQ ID NO: 2076) | 1349 | 1679 |
| Z19204_T34 (SEQ ID NO: 2077) | 1138 | 1468 |
| Z19204_T42 (SEQ ID NO: 2078) | 1357 | 1687 |

This segment can be found in a non-coding region of transcript(s) that are related to the following protein(s): Z19204_P1, Z19204_P13 and Z19204_P15.

Segment cluster Z19204_node_58 (SEQ ID NO:2086) according to the present invention is supported by 389 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1958 below describes the starting and ending position of this segment on each transcript.

TABLE 1958

Segment location on transcripts

| Transcript name | Segment starting position | Segment ending position |
|---|---|---|
| Z19204_T27 (SEQ ID NO: 2073) | 1731 | 2139 |
| Z19204_T29 (SEQ ID NO: 2074) | 2328 | 2736 |
| Z19204_T30 (SEQ ID NO: 2075) | 1983 | 2391 |
| Z19204_T31 (SEQ ID NO: 2076) | 1826 | 2234 |
| Z19204_T34 (SEQ ID NO: 2077) | 1615 | 2023 |
| Z19204_T42 (SEQ ID NO: 2078) | 1834 | 2242 |

This segment can be found in both coding and non-coding regions of transcript(s) as follows. The segment can be found in a non-coding region of transcript(s) that are related to the following protein(s): Z19204_P1 and Z19204_P13. This segment can also be found in the following protein(s): Z19204_P15, since it is in the coding region for the corresponding transcript.

Segment cluster Z19204_node_63 (SEQ ID NO:2087) according to the present invention is supported by 179 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1959 below describes the starting and ending position of this segment on each transcript.

TABLE 1959

Segment location on transcripts

| Transcript name | Segment starting position | Segment ending position |
|---|---|---|
| Z19204_T27 (SEQ ID NO: 2073) | 2381 | 2566 |
| Z19204_T29 (SEQ ID NO: 2074) | 2978 | 3163 |
| Z19204_T30 (SEQ ID NO: 2075) | 2633 | 2818 |
| Z19204_T31 (SEQ ID NO: 2076) | 2476 | 2661 |
| Z19204_T34 (SEQ ID NO: 2077) | 2265 | 2450 |
| Z19204_T42 (SEQ ID NO: 2078) | 2484 | 2669 |

This segment can be found in a non-coding region of transcript(s) that are related to the following protein(s): Z19204_P1, Z19204_P13 and Z19204_P15.

Segment cluster Z19204_node_64 (SEQ ID NO:2088) according to the present invention is supported by 184 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1960 below describes the starting and ending position of this segment on each transcript.

TABLE 1960

Segment location on transcripts

| Transcript name | Segment starting position | Segment ending position |
|---|---|---|
| Z19204_T27 (SEQ ID NO: 2073) | 2567 | 2753 |
| Z19204_T29 (SEQ ID NO: 2074) | 3164 | 3350 |
| Z19204_T30 (SEQ ID NO: 2075) | 2819 | 3005 |
| Z19204_T31 (SEQ ID NO: 2076) | 2662 | 2848 |
| Z19204_T34 (SEQ ID NO: 2077) | 2451 | 2637 |
| Z19204_T42 (SEQ ID NO: 2078) | 2670 | 2856 |

This segment can be found in a non-coding region of transcript(s) that are related to the following protein(s): Z19204_P1, Z19204_P13 and Z19204_P15.

Segment cluster Z19204_node_65 (SEQ ID NO:2089) according to the present invention is supported by 151 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1961 below describes the starting and ending position of this segment on each transcript.

TABLE 1961

Segment location on transcripts

| Transcript name | Segment starting position | Segment ending position |
|---|---|---|
| Z19204_T27 (SEQ ID NO: 2073) | 2754 | 2876 |
| Z19204_T29 (SEQ ID NO: 2074) | 3351 | 3473 |
| Z19204_T30 (SEQ ID NO: 2075) | 3006 | 3128 |
| Z19204_T31 (SEQ ID NO: 2076) | 2849 | 2971 |
| Z19204_T34 (SEQ ID NO: 2077) | 2638 | 2760 |
| Z19204_T42 (SEQ ID NO: 2078) | 2857 | 2979 |

This segment can be found in a non-coding region of transcript(s) that are related to the following protein(s): Z19204_P1, Z19204_P13 and Z19204_P15.

Segment cluster Z19204_node_75 (SEQ ID NO:2090) according to the present invention is supported by 169 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1962 below describes the starting and ending position of this segment on each transcript.

TABLE 1962

Segment location on transcripts

| Transcript name | Segment starting position | Segment ending position |
|---|---|---|
| Z19204_T27 (SEQ ID NO: 2073) | 3181 | 3265 |
| Z19204_T29 (SEQ ID NO: 2074) | 3778 | 3862 |
| Z19204_T30 (SEQ ID NO: 2075) | 3433 | 3517 |
| Z19204_T31 (SEQ ID NO: 2076) | 3276 | 3360 |
| Z19204_T34 (SEQ ID NO: 2077) | 3065 | 3149 |
| Z19204_T42 (SEQ ID NO: 2078) | 3284 | 3368 |

This segment can be found in a non-coding region of transcript(s) that are related to the following protein(s): Z19204_P1, Z19204_P13 and Z19204_P15.

Segment cluster Z19204_node_18 (SEQ ID NO:2091) according to the present invention is supported by 54 libraries. The number of libraries was determined as previously described. This segment can be found in the following transcript(s): Z19204_T27 (SEQ ID NO:2073) and Z19204_T42 (SEQ ID NO:2078). Table 1963 below describes the starting and ending position of this segment on each transcript.

TABLE 1963

Segment location on transcripts

| Transcript name | Segment starting position | Segment ending position |
|---|---|---|
| Z19204_T27 (SEQ ID NO: 2073) | 523 | 583 |
| Z19204_T42 (SEQ ID NO: 2078) | 523 | 583 |

This segment can be found in a non-coding region of transcript(s) that are related to the following protein(s): Z19204_P1 and Z19204_P15.

Segment cluster Z19204_node_19 (SEQ ID NO:2092) according to the present invention is supported by 637 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1964 below describes the starting and ending position of this segment on each transcript.

TABLE 1964

Segment location on transcripts

| Transcript name | Segment starting position | Segment ending position |
|---|---|---|
| Z19204_T27 (SEQ ID NO: 2073) | 584 | 692 |
| Z19204_T29 (SEQ ID NO: 2074) | 1181 | 1289 |
| Z19204_T30 (SEQ ID NO: 2075) | 836 | 944 |
| Z19204_T31 (SEQ ID NO: 2076) | 679 | 787 |
| Z19204_T34 (SEQ ID NO: 2077) | 468 | 576 |
| Z19204_T42 (SEQ ID NO: 2078) | 584 | 692 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_20 (SEQ ID NO:2093) according to the present invention is supported by 9 libraries. The number of libraries was determined as previously described. This segment can be found in the following transcript(s): Z19204_T42 (SEQ ID NO:2078). Table 1965 below describes the starting and ending position of this segment on each transcript.

TABLE 1965

Segment location on transcripts

| Transcript name | Segment starting position | Segment ending position |
|---|---|---|
| Z19204_T42 (SEQ ID NO: 2078) | 693 | 759 |

This segment can be found in a non-coding region of transcript(s) that are related to the following protein(s): Z19204_P15.

Segment cluster Z19204_node_21 (SEQ ID NO:2094) according to the present invention can be found in the following transcript(s): Z19204_T42 (SEQ ID NO:2078). Table 1966 below describes the starting and ending position of this segment on each transcript.

TABLE 1966

Segment location on transcripts

| Transcript name | Segment starting position | Segment ending position |
|---|---|---|
| Z19204_T42 (SEQ ID NO: 2078) | 760 | 776 |

This segment can be found in a non-coding region of transcript(s) that are related to the following protein(s): Z19204_P15.

Segment cluster Z19204_node_22 (SEQ ID NO:2095) according to the present invention can be found in the following transcript(s): Z19204_T42 (SEQ ID NO:2078). Table 1967 below describes the starting and ending position of this segment on each transcript.

TABLE 1967

Segment location on transcripts

| Transcript name | Segment starting position | Segment ending position |
|---|---|---|
| Z19204_T42 (SEQ ID NO: 2078) | 777 | 795 |

This segment can be found in a non-coding region of transcript(s) that are related to the following protein(s): Z19204_P15.

Segment cluster Z19204_node_23 (SEQ ID NO:2096) according to the present invention is supported by 652 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1968 below describes the starting and ending position of this segment on each transcript.

TABLE 1968

Segment location on transcripts

| Transcript name | Segment starting position | Segment ending position |
|---|---|---|
| Z19204_T27 (SEQ ID NO: 2073) | 693 | 799 |
| Z19204_T29 (SEQ ID NO: 2074) | 1290 | 1396 |
| Z19204_T30 (SEQ ID NO: 2075) | 945 | 1051 |
| Z19204_T31 (SEQ ID NO: 2076) | 788 | 894 |

TABLE 1968-continued

Segment location on transcripts

| Transcript name | Segment starting position | Segment ending position |
|---|---|---|
| Z19204_T34 (SEQ ID NO: 2077) | 577 | 683 |
| Z19204_T42 (SEQ ID NO: 2078) | 796 | 902 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_25 (SEQ ID NO:2097) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1969 below describes the starting and ending position of this segment on each transcript.

TABLE 1969

Segment location on transcripts

| Transcript name | Segment starting position | Segment ending position |
|---|---|---|
| Z19204_T27 (SEQ ID NO: 2073) | 800 | 823 |
| Z19204_T29 (SEQ ID NO: 2074) | 1397 | 1420 |
| Z19204_T30 (SEQ ID NO: 2075) | 1052 | 1075 |
| Z19204_T31 (SEQ ID NO: 2076) | 895 | 918 |
| Z19204_T34 (SEQ ID NO: 2077) | 684 | 707 |
| Z19204_T42 (SEQ ID NO: 2078) | 903 | 926 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_26 (SEQ ID NO:2098) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1970 below describes the starting and ending position of this segment on each transcript.

TABLE 1970

Segment location on transcripts

| Transcript name | Segment starting position | Segment ending position |
|---|---|---|
| Z19204_T27 (SEQ ID NO: 2073) | 824 | 832 |
| Z19204_T29 (SEQ ID NO: 2074) | 1421 | 1429 |
| Z19204_T30 (SEQ ID NO: 2075) | 1076 | 1084 |
| Z19204_T31 (SEQ ID NO: 2076) | 919 | 927 |
| Z19204_T34 (SEQ ID NO: 2077) | 708 | 716 |
| Z19204_T42 (SEQ ID NO: 2078) | 927 | 935 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node__27 (SEQ ID NO:2099) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1971 below describes the starting and ending position of this segment on each transcript.

TABLE 1971

Segment location on transcripts

| Transcript name | Segment starting position | Segment ending position |
| --- | --- | --- |
| Z19204_T27 (SEQ ID NO: 2073) | 833 | 836 |
| Z19204_T29 (SEQ ID NO: 2074) | 1430 | 1433 |
| Z19204_T30 (SEQ ID NO: 2075) | 1085 | 1088 |
| Z19204_T31 (SEQ ID NO: 2076) | 928 | 931 |
| Z19204_T34 (SEQ ID NO: 2077) | 717 | 720 |
| Z19204_T42 (SEQ ID NO: 2078) | 936 | 939 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node__28 (SEQ ID NO:2100) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1972 below describes the starting and ending position of this segment on each transcript.

TABLE 1972

Segment location on transcripts

| Transcript name | Segment starting position | Segment ending position |
| --- | --- | --- |
| Z19204_T27 (SEQ ID NO: 2073) | 837 | 860 |
| Z19204_T29 (SEQ ID NO: 2074) | 1434 | 1457 |
| Z19204_T30 (SEQ ID NO: 2075) | 1089 | 1112 |
| Z19204_T31 (SEQ ID NO: 2076) | 932 | 955 |
| Z19204_T34 (SEQ ID NO: 2077) | 721 | 744 |
| Z19204_T42 (SEQ ID NO: 2078) | 940 | 963 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node__29 (SEQ ID NO:2101) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and Z19204_T42 (SEQ ID NO:2078). Table 1973 below describes the starting and ending position of this segment on each transcript.

TABLE 1973

Segment location on transcripts

| Transcript name | Segment starting position | Segment ending position |
| --- | --- | --- |
| Z19204_T27 (SEQ ID NO: 2073) | 861 | 872 |
| Z19204_T29 (SEQ ID NO: 2074) | 1458 | 1469 |
| Z19204_T30 (SEQ ID NO: 2075) | 1113 | 1124 |
| Z19204_T31 (SEQ ID NO: 2076) | 956 | 967 |
| Z19204_T34 (SEQ ID NO: 2077) | 745 | 756 |
| Z19204_T42 (SEQ ID NO: 2078) | 964 | 975 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node__30 (SEQ ID NO:2102) according to the present invention is supported by 406 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1974 below describes the starting and ending position of this segment on each transcript.

TABLE 1974

Segment location on transcripts

| Transcript name | Segment starting position | Segment ending position |
| --- | --- | --- |
| Z19204_T27 (SEQ ID NO: 2073) | 873 | 902 |
| Z19204_T29 (SEQ ID NO: 2074) | 1470 | 1499 |
| Z19204_T30 (SEQ ID NO: 2075) | 1125 | 1154 |
| Z19204_T31 (SEQ ID NO: 2076) | 968 | 997 |
| Z19204_T34 (SEQ ID NO: 2077) | 757 | 786 |
| Z19204_T42 (SEQ ID NO: 2078) | 976 | 1005 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node__31 (SEQ ID NO:2103) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1975 below describes the starting and ending position of this segment on each transcript.

TABLE 1975

Segment location on transcripts

| Transcript name | Segment starting position | Segment ending position |
|---|---|---|
| Z19204_T27 (SEQ ID NO: 2073) | 903 | 914 |
| Z19204_T29 (SEQ ID NO: 2074) | 1500 | 1511 |
| Z19204_T30 (SEQ ID NO: 2075) | 1155 | 1166 |
| Z19204_T31 (SEQ ID NO: 2076) | 998 | 1009 |
| Z19204_T34 (SEQ ID NO: 2077) | 787 | 798 |
| Z19204_T42 (SEQ ID NO: 2078) | 1006 | 1017 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_32 (SEQ ID NO:2104) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1976 below describes the starting and ending position of this segment on each transcript.

TABLE 1976

Segment location on transcripts

| Transcript name | Segment starting position | Segment ending position |
|---|---|---|
| Z19204_T27 (SEQ ID NO: 2073) | 915 | 938 |
| Z19204_T29 (SEQ ID NO: 2074) | 1512 | 1535 |
| Z19204_T30 (SEQ ID NO: 2075) | 1167 | 1190 |
| Z19204_T31 (SEQ ID NO: 2076) | 1010 | 1033 |
| Z19204_T34 (SEQ ID NO: 2077) | 799 | 822 |
| Z19204_T42 (SEQ ID NO: 2078) | 1018 | 1041 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_34 (SEQ ID NO:2105) according to the present invention is supported by 420 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1977 below describes the starting and ending position of this segment on each transcript.

TABLE 1977

Segment location on transcripts

| Transcript name | Segment starting position | Segment ending position |
|---|---|---|
| Z19204_T27 (SEQ ID NO: 2073) | 939 | 975 |
| Z19204_T29 (SEQ ID NO: 2074) | 1536 | 1572 |

TABLE 1977-continued

Segment location on transcripts

| Transcript name | Segment starting position | Segment ending position |
|---|---|---|
| Z19204_T30 (SEQ ID NO: 2075) | 1191 | 1227 |
| Z19204_T31 (SEQ ID NO: 2076) | 1034 | 1070 |
| Z19204_T34 (SEQ ID NO: 2077) | 823 | 859 |
| Z19204_T42 (SEQ ID NO: 2078) | 1042 | 1078 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_35 (SEQ ID NO:2106) according to the present invention is supported by 432 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1978 below describes the starting and ending position of this segment on each transcript.

TABLE 1978

Segment location on transcripts

| Transcript name | Segment starting position | Segment ending position |
|---|---|---|
| Z19204_T27 (SEQ ID NO: 2073) | 976 | 1016 |
| Z19204_T29 (SEQ ID NO: 2074) | 1573 | 1613 |
| Z19204_T30 (SEQ ID NO: 2075) | 1228 | 1268 |
| Z19204_T31 (SEQ ID NO: 2076) | 1071 | 1111 |
| Z19204_T34 (SEQ ID NO: 2077) | 860 | 900 |
| Z19204_T42 (SEQ ID NO: 2078) | 1079 | 1119 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_36 (SEQ ID NO:2107) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1979 below describes the starting and ending position of this segment on each transcript.

TABLE 1979

Segment location on transcripts

| Transcript name | Segment starting position | Segment ending position |
|---|---|---|
| Z19204_T27 (SEQ ID NO: 2073) | 1017 | 1020 |
| Z19204_T29 (SEQ ID NO: 2074) | 1614 | 1617 |

TABLE 1979-continued

Segment location on transcripts

| Transcript name | Segment starting position | Segment ending position |
|---|---|---|
| Z19204_T30 (SEQ ID NO: 2075) | 1269 | 1272 |
| Z19204_T31 (SEQ ID NO: 2076) | 1112 | 1115 |
| Z19204_T34 (SEQ ID NO: 2077) | 901 | 904 |
| Z19204_T42 (SEQ ID NO: 2078) | 1120 | 1123 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_40 (SEQ ID NO:2108) according to the present invention is supported by 477 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1980 below describes the starting and ending position of this segment on each transcript.

TABLE 1980

Segment location on transcripts

| Transcript name | Segment starting position | Segment ending position |
|---|---|---|
| Z19204_T27 (SEQ ID NO: 2073) | 1021 | 1091 |
| Z19204_T29 (SEQ ID NO: 2074) | 1618 | 1688 |
| Z19204_T30 (SEQ ID NO: 2075) | 1273 | 1343 |
| Z19204_T31 (SEQ ID NO: 2076) | 1116 | 1186 |
| Z19204_T34 (SEQ ID NO: 2077) | 905 | 975 |
| Z19204_T42 (SEQ ID NO: 2078) | 1124 | 1194 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_48 (SEQ ID NO:2109) according to the present invention is supported by 386 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1981 below describes the starting and ending position of this segment on each transcript.

TABLE 1981

Segment location on transcripts

| Transcript name | Segment starting position | Segment ending position |
|---|---|---|
| Z19204_T27 (SEQ ID NO: 2073) | 1092 | 1129 |
| Z19204_T29 (SEQ ID NO: 2074) | 1689 | 1726 |

TABLE 1981-continued

Segment location on transcripts

| Transcript name | Segment starting position | Segment ending position |
|---|---|---|
| Z19204_T30 (SEQ ID NO: 2075) | 1344 | 1381 |
| Z19204_T31 (SEQ ID NO: 2076) | 1187 | 1224 |
| Z19204_T34 (SEQ ID NO: 2077) | 976 | 1013 |
| Z19204_T42 (SEQ ID NO: 2078) | 1195 | 1232 |

This segment can be found in both coding and non-coding regions of transcript(s) as follows. The segment can be found in a non-coding region of transcript(s) that are related to the following protein(s): Z19204_P15. This segment can also be found in the following protein(s): Z19204_P1 and Z19204_P13, since it is in the coding region for the corresponding transcript.

Segment cluster Z19204_node_51 (SEQ ID NO:2110) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1982 below describes the starting and ending position of this segment on each transcript.

TABLE 1982

Segment location on transcripts

| Transcript name | Segment starting position | Segment ending position |
|---|---|---|
| Z19204_T27 (SEQ ID NO: 2073) | 1585 | 1604 |
| Z19204_T29 (SEQ ID NO: 2074) | 2182 | 2201 |
| Z19204_T30 (SEQ ID NO: 2075) | 1837 | 1856 |
| Z19204_T31 (SEQ ID NO: 2076) | 1680 | 1699 |
| Z19204_T34 (SEQ ID NO: 2077) | 1469 | 1488 |
| Z19204_T42 (SEQ ID NO: 2078) | 1688 | 1707 |

This segment can be found in a non-coding region of transcript(s) that are related to the following protein(s): Z19204_P1, Z19204_P13 and Z19204_P15.

Segment cluster Z19204_node_52 (SEQ ID NO:2111) according to the present invention is supported by 320 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1983 below describes the starting and ending position of this segment on each transcript.

TABLE 1983

Segment location on transcripts

| Transcript name | Segment starting position | Segment ending position |
|---|---|---|
| Z19204_T27 (SEQ ID NO: 2073) | 1605 | 1633 |
| Z19204_T29 (SEQ ID NO: 2074) | 2202 | 2230 |
| Z19204_T30 (SEQ ID NO: 2075) | 1857 | 1885 |
| Z19204_T31 (SEQ ID NO: 2076) | 1700 | 1728 |
| Z19204_T34 (SEQ ID NO: 2077) | 1489 | 1517 |
| Z19204_T42 (SEQ ID NO: 2078) | 1708 | 1736 |

This segment can be found in a non-coding region of transcript(s) that are related to the following protein(s): Z19204_P1, Z19204_P13 and Z19204_P15.

Segment cluster Z19204_node_53 (SEQ ID NO:2112) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1984 below describes the starting and ending position of this segment on each transcript.

TABLE 1984

Segment location on transcripts

| Transcript name | Segment starting position | Segment ending position |
| --- | --- | --- |
| Z19204_T27 (SEQ ID NO: 2073) | 1634 | 1640 |
| Z19204_T29 (SEQ ID NO: 2074) | 2231 | 2237 |
| Z19204_T30 (SEQ ID NO: 2075) | 1886 | 1892 |
| Z19204_T31 (SEQ ID NO: 2076) | 1729 | 1735 |
| Z19204_T34 (SEQ ID NO: 2077) | 1518 | 1524 |
| Z19204_T42 (SEQ ID NO: 2078) | 1737 | 1743 |

This segment can be found in a non-coding region of transcript(s) that are related to the following protein(s): Z19204_P1, Z19204_P13 and Z19204_P15.

Segment cluster Z19204_node_54 (SEQ ID NO:2113) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1985 below describes the starting and ending position of this segment on each transcript.

TABLE 1985

Segment location on transcripts

| Transcript name | Segment starting position | Segment ending position |
| --- | --- | --- |
| Z19204_T27 (SEQ ID NO: 2073) | 1641 | 1644 |
| Z19204_T29 (SEQ ID NO: 2074) | 2238 | 2241 |
| Z19204_T30 (SEQ ID NO: 2075) | 1893 | 1896 |
| Z19204_T31 (SEQ ID NO: 2076) | 1736 | 1739 |
| Z19204_T34 (SEQ ID NO: 2077) | 1525 | 1528 |
| Z19204_T42 (SEQ ID NO: 2078) | 1744 | 1747 |

This segment can be found in a non-coding region of transcript(s) that are related to the following protein(s): Z19204_P1, Z19204_P13 and Z19204_P15.

Segment cluster Z19204_node_55 (SEQ ID NO:2114) according to the present invention is supported by 314 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1986 below describes the starting and ending position of this segment on each transcript.

TABLE 1986

Segment location on transcripts

| Transcript name | Segment starting position | Segment ending position |
| --- | --- | --- |
| Z19204_T27 (SEQ ID NO: 2073) | 1645 | 1690 |
| Z19204_T29 (SEQ ID NO: 2074) | 2242 | 2287 |
| Z19204_T30 (SEQ ID NO: 2075) | 1897 | 1942 |
| Z19204_T31 (SEQ ID NO: 2076) | 1740 | 1785 |
| Z19204_T34 (SEQ ID NO: 2077) | 1529 | 1574 |
| Z19204_T42 (SEQ ID NO: 2078) | 1748 | 1793 |

This segment can be found in a non-coding region of transcript(s) that are related to the following protein(s): Z19204_P1, Z19204_P13 and Z19204_P15.

Segment cluster Z19204_node_56 (SEQ ID NO:2115) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1987 below describes the starting and ending position of this segment on each transcript.

TABLE 1987

Segment location on transcripts

| Transcript name | Segment starting position | Segment ending position |
| --- | --- | --- |
| Z19204_T27 (SEQ ID NO: 2073) | 1691 | 1706 |
| Z19204_T29 (SEQ ID NO: 2074) | 2288 | 2303 |
| Z19204_T30 (SEQ ID NO: 2075) | 1943 | 1958 |
| Z19204_T31 (SEQ ID NO: 2076) | 1786 | 1801 |
| Z19204_T34 (SEQ ID NO: 2077) | 1575 | 1590 |
| Z19204_T42 (SEQ ID NO: 2078) | 1794 | 1809 |

This segment can be found in both coding and non-coding regions of transcript(s) as follows. The segment can be found in a non-coding region of transcript(s) that are related to the following protein(s): Z19204_P1 and Z19204_P13. This segment can also be found in the following protein(s): Z19204_P15, since it is in the coding region for the corresponding transcript.

Segment cluster Z19204_node_57 (SEQ ID NO:2116) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1988 below describes the starting and ending position of this segment on each transcript.

TABLE 1988

Segment location on transcripts

| Transcript name | Segment starting position | Segment ending position |
| --- | --- | --- |
| Z19204_T27 (SEQ ID NO: 2073) | 1707 | 1730 |
| Z19204_T29 (SEQ ID NO: 2074) | 2304 | 2327 |
| Z19204_T30 (SEQ ID NO: 2075) | 1959 | 1982 |
| Z19204_T31 (SEQ ID NO: 2076) | 1802 | 1825 |
| Z19204_T34 (SEQ ID NO: 2077) | 1591 | 1614 |
| Z19204_T42 (SEQ ID NO: 2078) | 1810 | 1833 |

This segment can be found in both coding and non-coding regions of transcript(s) as follows. The segment can be found in a non-coding region of transcript(s) that are related to the following protein(s): Z19204_P1 and Z19204_P13. This segment can also be found in the following protein(s): Z19204_P15, since it is in the coding region for the corresponding transcript.

Segment cluster Z19204_node_59 (SEQ ID NO:2117) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1989 below describes the starting and ending position of this segment on each transcript.

TABLE 1989

Segment location on transcripts

| Transcript name | Segment starting position | Segment ending position |
|---|---|---|
| Z19204_T27 (SEQ ID NO: 2073) | 2140 | 2153 |
| Z19204_T29 (SEQ ID NO: 2074) | 2737 | 2750 |
| Z19204_T30 (SEQ ID NO: 2075) | 2392 | 2405 |
| Z19204_T31 (SEQ ID NO: 2076) | 2235 | 2248 |
| Z19204_T34 (SEQ ID NO: 2077) | 2024 | 2037 |
| Z19204_T42 (SEQ ID NO: 2078) | 2243 | 2256 |

This segment can be found in a non-coding region of transcript(s) that are related to the following protein(s): Z19204_P1, Z19204_P13 and Z19204_P15.

Segment cluster Z19204_node_60 (SEQ ID NO:2118) according to the present invention can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1990 below describes the starting and ending position of this segment on each transcript.

TABLE 1990

Segment location on transcripts

| Transcript name | Segment starting position | Segment ending position |
|---|---|---|
| Z19204_T27 (SEQ ID NO: 2073) | 2154 | 2158 |
| Z19204_T29 (SEQ ID NO: 2074) | 2751 | 2755 |
| Z19204_T30 (SEQ ID NO: 2075) | 2406 | 2410 |
| Z19204_T31 (SEQ ID NO: 2076) | 2249 | 2253 |
| Z19204_T34 (SEQ ID NO: 2077) | 2038 | 2042 |
| Z19204_T42 (SEQ ID NO: 2078) | 2257 | 2261 |

This segment can be found in a non-coding region of transcript(s) that are related to the following protein(s): Z19204_P1, Z19204_P13 and Z19204_P15.

Segment cluster Z19204_node_61 (SEQ ID NO:2119) according to the present invention is supported by 150 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1991 below describes the starting and ending position of this segment on each transcript.

TABLE 1991

Segment location on transcripts

| Transcript name | Segment starting position | Segment ending position |
|---|---|---|
| Z19204_T27 (SEQ ID NO: 2073) | 2159 | 2265 |
| Z19204_T29 (SEQ ID NO: 2074) | 2756 | 2862 |
| Z19204_T30 (SEQ ID NO: 2075) | 2411 | 2517 |
| Z19204_T31 (SEQ ID NO: 2076) | 2254 | 2360 |
| Z19204_T34 (SEQ ID NO: 2077) | 2043 | 2149 |
| Z19204_T42 (SEQ ID NO: 2078) | 2262 | 2368 |

This segment can be found in a non-coding region of transcript(s) that are related to the following protein(s): Z19204_P1, Z19204_P13 and Z19204_P15.

Segment cluster Z19204_node_62 (SEQ ID NO:2120) according to the present invention is supported by 171 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1992 below describes the starting and ending position of this segment on each transcript.

TABLE 1992

Segment location on transcripts

| Transcript name | Segment starting position | Segment ending position |
|---|---|---|
| Z19204_T27 (SEQ ID NO: 2073) | 2266 | 2380 |
| Z19204_T29 (SEQ ID NO: 2074) | 2863 | 2977 |
| Z19204_T30 (SEQ ID NO: 2075) | 2518 | 2632 |
| Z19204_T31 (SEQ ID NO: 2076) | 2361 | 2475 |
| Z19204_T34 (SEQ ID NO: 2077) | 2150 | 2264 |
| Z19204_T42 (SEQ ID NO: 2078) | 2369 | 2483 |

This segment can be found in a non-coding region of transcript(s) that are related to the following protein(s): Z19204_P1, Z19204_P13 and Z19204_P15.

Segment cluster Z19204_node_66 (SEQ ID NO:2121) according to the present invention is supported by 146 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1993 below describes the starting and ending position of this segment on each transcript.

TABLE 1993

Segment location on transcripts

| Transcript name | Segment starting position | Segment ending position |
|---|---|---|
| Z19204_T27 (SEQ ID NO: 2073) | 2877 | 2971 |
| Z19204_T29 (SEQ ID NO: 2074) | 3474 | 3568 |
| Z19204_T30 (SEQ ID NO: 2075) | 3129 | 3223 |
| Z19204_T31 (SEQ ID NO: 2076) | 2972 | 3066 |
| Z19204_T34 (SEQ ID NO: 2077) | 2761 | 2855 |
| Z19204_T42 (SEQ ID NO: 2078) | 2980 | 3074 |

This segment can be found in a non-coding region of transcript(s) that are related to the following protein(s): Z19204_P1, Z19204_P13 and Z19204_P15.

Segment cluster Z19204_node_67 (SEQ ID NO:2122) according to the present invention is supported by 238 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1994 below describes the starting and ending position of this segment on each transcript.

TABLE 1994

Segment location on transcripts

| Transcript name | Segment starting position | Segment ending position |
|---|---|---|
| Z19204_T27 (SEQ ID NO: 2073) | 2972 | 3015 |
| Z19204_T29 (SEQ ID NO: 2074) | 3569 | 3612 |
| Z19204_T30 (SEQ ID NO: 2075) | 3224 | 3267 |
| Z19204_T31 (SEQ ID NO: 2076) | 3067 | 3110 |
| Z19204_T34 (SEQ ID NO: 2077) | 2856 | 2899 |
| Z19204_T42 (SEQ ID NO: 2078) | 3075 | 3118 |

This segment can be found in a non-coding region of transcript(s) that are related to the following protein(s): Z19204_P1, Z19204_P13 and Z19204_P15.

Segment cluster Z19204_node_68 (SEQ ID NO:2123) according to the present invention can be found in the following transcript(s): Z19204_T27 (SEQ ID NO:2073), Z19204_T29 (SEQ ID NO:2074), Z19204_T30 (SEQ ID NO:2075), (SEQ ID NO:2076), Z19204_T34 (SEQ ID NO:2077) and (SEQ ID NO:2078). Table 1995 below describes the starting and ending position of this segment on each transcript.

TABLE 1995

Segment location on transcripts

| Transcript name | Segment starting position | Segment ending position |
|---|---|---|
| Z19204_T27 (SEQ ID NO: 2073) | 3016 | 3025 |
| Z19204_T29 (SEQ ID NO: 2074) | 3613 | 3622 |
| Z19204_T30 (SEQ ID NO: 2075) | 3268 | 3277 |
| Z19204_T31 (SEQ ID NO: 2076) | 3111 | 3120 |
| Z19204_T34 (SEQ ID NO: 2077) | 2900 | 2909 |
| Z19204_T42 (SEQ ID NO: 2078) | 3119 | 3128 |

This segment can be found in a non-coding region of transcript(s) that are related to the following protein(s): Z19204_P1, Z19204_P13 and Z19204_P15.

Segment cluster Z19204_node_69 (SEQ ID NO:2124) according to the present invention is supported by 228 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1996 below describes the starting and ending position of this segment on each transcript.

TABLE 1996

Segment location on transcripts

| Transcript name | Segment starting position | Segment ending position |
|---|---|---|
| Z19204_T27 (SEQ ID NO: 2073) | 3026 | 3057 |
| Z19204_T29 (SEQ ID NO: 2074) | 3623 | 3654 |
| Z19204_T30 (SEQ ID NO: 2075) | 3278 | 3309 |
| Z19204_T31 (SEQ ID NO: 2076) | 3121 | 3152 |
| Z19204_T34 (SEQ ID NO: 2077) | 2910 | 2941 |
| Z19204_T42 (SEQ ID NO: 2078) | 3129 | 3160 |

This segment can be found in a non-coding region of transcript(s) that are related to the following protein(s): Z19204_P1, Z19204_P13 and Z19204_P15.

Segment cluster Z19204_node_70 (SEQ ID NO:2125) according to the present invention is supported by 226 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1997 below describes the starting and ending position of this segment on each transcript.

TABLE 1997

Segment location on transcripts

| Transcript name | Segment starting position | Segment ending position |
|---|---|---|
| Z19204_T27 (SEQ ID NO: 2073) | 3058 | 3105 |
| Z19204_T29 (SEQ ID NO: 2074) | 3655 | 3702 |
| Z19204_T30 (SEQ ID NO: 2075) | 3310 | 3357 |
| Z19204_T31 (SEQ ID NO: 2076) | 3153 | 3200 |
| Z19204_T34 (SEQ ID NO: 2077) | 2942 | 2989 |
| Z19204_T42 (SEQ ID NO: 2078) | 3161 | 3208 |

This segment can be found in a non-coding region of transcript(s) that are related to the following protein(s): Z19204_P1, Z19204_P13 and Z19204_P15.

Segment cluster Z19204_node_73 (SEQ ID NO:2126) according to the present invention is supported by 206 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1998 below describes the starting and ending position of this segment on each transcript.

TABLE 1998

Segment location on transcripts

| Transcript name | Segment starting position | Segment ending position |
|---|---|---|
| Z19204_T27 (SEQ ID NO: 2073) | 3106 | 3139 |
| Z19204_T29 (SEQ ID NO: 2074) | 3703 | 3736 |
| Z19204_T30 (SEQ ID NO: 2075) | 3358 | 3391 |
| Z19204_T31 (SEQ ID NO: 2076) | 3201 | 3234 |
| Z19204_T34 (SEQ ID NO: 2077) | 2990 | 3023 |
| Z19204_T42 (SEQ ID NO: 2078) | 3209 | 3242 |

This segment can be found in a non-coding region of transcript(s) that are related to the following protein(s): Z19204_P1, Z19204_P13 and Z19204_P15.

Segment cluster Z19204_node__74 (SEQ ID NO:2127) according to the present invention is supported by 193 libraries. The number of libraries was determined as previously described. This segment can be found in the following transcript(s): Z19204_T27 (SEQ ID NO:2073), Z19204_T29 (SEQ ID NO:2074), Z19204_T30 (SEQ ID NO:2075), Z19204_T31 (SEQ ID NO:2076), Z19204_T34 (SEQ ID NO:2077) and Z19204_T42 (SEQ ID NO:2078). Table 1999 below describes the starting and ending position of this segment on each transcript.

TABLE 1999

Segment location on transcripts

| Transcript name | Segment starting position | Segment ending position |
| --- | --- | --- |
| Z19204_T27 (SEQ ID NO: 2073) | 3140 | 3180 |
| Z19204_T29 (SEQ ID NO: 2074) | 3737 | 3777 |
| Z19204_T30 (SEQ ID NO: 2075) | 3392 | 3432 |
| Z19204_T31 (SEQ ID NO: 2076) | 3235 | 3275 |
| Z19204_T34 (SEQ ID NO: 2077) | 3024 | 3064 |
| Z19204_T42 (SEQ ID NO: 2078) | 3243 | 3283 |

This segment can be found in a non-coding region of transcript(s) that are related to the following protein(s): Z19204_P1, Z19204_P13 and Z19204_P15.

Description for Cluster Z24775

Cluster Z24775 features 5 transcript(s) and 26 segment(s) of interest, the names for which are given in Tables 2000 and 2001, respectively, the sequences themselves are given at the end of the application. The selected protein variants are given in Table 2002.

TABLE 2000

Transcripts of interest
Transcript Name

Z24775_T23 (SEQ ID NO: 2128)
Z24775_T26 (SEQ ID NO: 2129)
Z24775_T27 (SEQ ID NO: 2130)
Z24775_T28 (SEQ ID NO: 2131)
Z24775_T29 (SEQ ID NO: 2132)

TABLE 2001

Segments of interest
Segment Name

Z24775_node__0 (SEQ ID NO: 2133)
Z24775_node__1 (SEQ ID NO: 2134)
Z24775_node__25 (SEQ ID NO: 2135)
Z24775_node__31 (SEQ ID NO: 2136)
Z24775_node__33 (SEQ ID NO: 2137)
Z24775_node__37 (SEQ ID NO: 2138)
Z24775_node__39 (SEQ ID NO: 2139)
Z24775_node__47 (SEQ ID NO: 2140)
Z24775_node__48 (SEQ ID NO: 2141)
Z24775_node__51 (SEQ ID NO: 2142)
Z24775_node__59 (SEQ ID NO: 2143)
Z24775_node__8 (SEQ ID NO: 2144)
Z24775_node__9 (SEQ ID NO: 2145)
Z24775_node__13 (SEQ ID NO: 2146)
Z24775_node__14 (SEQ ID NO: 2147)
Z24775_node__16 (SEQ ID NO: 2148)
Z24775_node__18 (SEQ ID NO: 2149)
Z24775_node__20 (SEQ ID NO: 2150)

TABLE 2001-continued

Segments of interest
Segment Name

Z24775_node__22 (SEQ ID NO: 2151)
Z24775_node__24 (SEQ ID NO: 2152)
Z24775_node__32 (SEQ ID NO: 2153)
Z24775_node__41 (SEQ ID NO: 2154)
Z24775_node__43 (SEQ ID NO: 2155)
Z24775_node__52 (SEQ ID NO: 2156)
Z24775_node__55 (SEQ ID NO: 2157)
Z24775_node__57 (SEQ ID NO: 2158)

TABLE 2002

Proteins of interest

| Protein Name | Corresponding Transcript(s) |
| --- | --- |
| Z24775_P7 | Z24775_T23 (SEQ ID NO: 2128) |
| Z24775_P15 | Z24775_T26 (SEQ ID NO: 2129) |
| Z24775_P16 | Z24775_T28 (SEQ ID NO: 2131) |
| Z24775_P17 | Z24775_T29 (SEQ ID NO: 2132) |

These sequences are variants of the known protein DNA mismatch repair protein Mlh1 (SwissProt accession identifier MLH1_HUMAN; known also according to the synonyms MutL protein homolog 1), referred to herein as the previously known protein.

Protein DNA mismatch repair protein Mlh1 is known or believed to have the following function(s): Involved in the repair of mismatches in DNA. The sequence for protein DNA mismatch repair protein Mlh1 is given at the end of the application, as "DNA mismatch repair protein Mlh1 amino acid sequence". Known polymorphisms for this sequence are as shown in Table 2003.

TABLE 2003

Amino acid mutations for Known Protein

| SNP position(s) on amino acid sequence | Comment |
| --- | --- |
| 28 | P -> L (in HNPCC2). /FTId = VAR__004433. |
| 32 | I -> V (in dbSNP:2020872). /FTId = VAR__014876. |
| 35 | M -> R (in HNPCC2). /FTId = VAR__004434. |
| 37 | E -> ELNH (in endometrial cancer; somatic). /FTId = VAR__004435. |
| 44 | S -> F (in HNPCC2; the equivalent substitution in yeast causes loss of function in a mismatch repair assay). /FTId = VAR__004436. |
| 54 | G -> E (in CRC; sporadic; somatic mutation). /FTId = VAR__012902. |
| 62 | Q -> K (in HNPCC2; reduced repair efficiency in a yeast mismatch repair assay). /FTId = VAR__004437. |
| 64 | N -> S (in HNPCC2). /FTId = VAR__004438. |
| 67 | G -> R (in HNPCC2; the equivalent substitution in yeast causes loss of function in a mismatch repair assay). /FTId = VAR__004439. |
| 67 | G -> W (in HNPCC2 and multiple cafe-au-lait spots with leukemia). /FTId = VAR__012903. |
| 68 | I -> N (in HNPCC2; the equivalent substitution in yeast causes loss of function in a mismatch repair assay). /FTId = VAR__004440. |
| 69 | R -> K (in HNPCC2; reduced repair efficiency in a mismatch repair assay). /FTId = VAR__004441. |
| 77 | C -> R (in HNPCC2 and sporadic CRC; normal interaction with PMS2; loss of function in a mismatch repair assay). /FTId = VAR__004442. |

TABLE 2003-continued

Amino acid mutations for Known Protein

| SNP position(s) on amino acid sequence | Comment |
|---|---|
| 77 | C -> Y (in sporadic CRC; early onset). /FTId = VAR_012904. |
| 80 | F -> V (in suspected HNPCC2). /FTId = VAR_012905. |
| 84 | K -> E (in suspected HNPCC2). /FTId = VAR_012906. |
| 93 | S -> G (in HNPCC; could be a polymorphism; normal interaction with PMS2; no functional alteration detected by an in vitro mismatch repair assay). /FTId = VAR_004443. |
| 107 | I -> R (in HNPCC2; normal interaction with PMS2; loss of function in a mismatch repair assay). /FTId = VAR_004444. |
| 111 | A -> V (in HNPCC2). /FTId = VAR_012907. |
| 117 | T -> M (in HNPCC2; fails to interact with PMS2 and EXO1; loss of function in a mismatch repair assay). /FTId = VAR_004445. |
| 117 | T -> R (in HNPCC2; equivalent substitution in yeast causes loss of function in mismatch repair assay). /FTId = VAR_004446. |
| 128 | A -> P (in HNPCC2). /FTId = VAR_012908. |
| 182 | R -> G (in incomplete HNPCC2). /FTId = VAR_012909. |
| 185 | V -> G (in HNPCC2; defective in a mismatch repair assay). /FTId = VAR_004447. |
| 193 | S -> P (in HNPCC2). /FTId = VAR_004448. |
| 213 | V -> M (in HNPCC2; dbSNP:2308317). /FTId = VAR_012910. |
| 217 | R -> C (in HNPCC2; proficient in a mismatch repair assay). /FTId = VAR_004449. |
| 219 | I -> V (common polymorphism; found in 37% of alleles; dbSNP:1799977). /FTId = VAR_004450. |
| 226 | R -> L (in HNPCC2). /FTId = VAR_004451. |
| 226-295 | Missing (in HNPCC2). /FTId = VAR_004452. |
| 244 | G -> D (in HNPCC2; defective in a mismatch repair assay). /FTId = VAR_012911. |
| 244 | G -> V (in sporadic CRC; somatic mutation; could be a polymorphism). /FTId = VAR_012912. |
| 262 | Missing (in HNPCC2). /FTId = VAR_012913. |
| 265 | R -> H (rare polymorphism; slightly lower mismatch repair efficiency). /FTId = VAR_012914. |
| 268 | E -> G (in CRC). /FTId = VAR_012915. |
| 295 | S -> T (in HNPCC2). /FTId = VAR_012916. |
| 325 | R -> Q (in sporadic CRC; somatic mutation; could be a polymorphism). /FTId = VAR_012917. |
| 326 | V -> A (in HNPCC2; proficient in a mismatch repair assay). /FTId = VAR_004453. |
| 329 | H -> P (in HNPCC2). /FTId = VAR_012918. |
| 384 | V -> D. /FTId = VAR_004454. |
| 406 | S -> N. /FTId = VAR_012919. |
| 441 | A -> T (in HNPCC2). /FTId = VAR_012920. |
| 492 | A -> T (in HNPCC2 and sporadic CRC). /FTId = VAR_004455. |
| 506 | V -> A (in HNPCC2). /FTId = VAR_004456. |
| 542 | Q -> L (in HNPCC2; type II; equivalent substitution in yeast causes loss of function in a mismatch repair assay). /FTId = VAR_004457. |
| 549 | L -> P (in HNPCC2). /FTId = VAR_012921. |
| 551 | N -> T (in HNPCC2). /FTId = VAR_012922. |
| 565 | I -> F (in HNPCC2). /FTId = VAR_012923. |
| 574 | L -> P (in HNPCC2; TY20-Oct-2003PE I). /FTId = VAR_004458. |
| 578 | E -> G (in HNPCC2 and CRC). /FTId = VAR_004459. |
| 582 | L -> V (in HNPCC2; type II). /FTId = VAR_004460. |
| 586 | A -> P (in HNPCC2). /FTId = VAR_015689. |
| 588 | L -> P (in HNPCC2). /FTId = VAR_012924. |
| 603 | P -> R (in suspected HNPCC; could be a polymorphism). /FTId = VAR_012925. |
| 607 | L -> H (in LCIS and HNPCC2). /FTId = VAR_012926. |
| 616 | Missing (in HNPCC2 and Turcot syndrome). /FTId = VAR_004461. |
| 618 | K -> A (in HNPCC2; requires 2 nucleotide substitutions). /FTId = VAR_004462. |
| 618 | K -> T (in HNPCC2; type II). /FTId = VAR_004463. |
| 622 | L -> H (in HNPCC2). /FTId = VAR_012927. |
| 626-627 | FS -> ST (in HNPCC2). /FTId = VAR_004464. |
| 648 | P -> L (in suspected HNPCC2). /FTId = VAR_012928. |
| 659 | R -> L (in HNPCC2). /FTId = VAR_012929. |
| 659 | R -> P (in HNPCC2; interacts only very weakly with PMS2; equivalent substitution in yeast causes almost complete loss of function in a mismatch repair assay). /FTId = VAR_004465. |
| 662 | T -> P (in HNPCC2; could be a rare polymorphism). /FTId = VAR_012930. |
| 681 | A -> T (in HNPCC2; equivalent substitution in yeast does not affect mismatch repair). /FTId = VAR_004466. |
| 687 | R -> W (in HNPCC2). /FTId = VAR_012931. |
| 689 | Q -> R (in suspected HNPCC; could be a polymorphism). /FTId = VAR_012932. |
| 716 | V -> M (in HNPCC2; could be a polymorphism). /FTId = VAR_012933. |
| 718 | H -> Y (in dbSNP:2020873). /FTId = VAR_004467. |
| 729 | L -> V (in dbSNP:1800149). /FTId = VAR_004468. |
| 751 | K -> R (in HNPCC2). /FTId = VAR_012934. |
| 755 | R -> W (in incomplete HNPCC). /FTId = VAR_012935. |
| 708-711 | Missing |

Protein DNA mismatch repair protein Mlh1 localization is believed to be Nuclear.

The following GO Annotation(s) apply to the previously known protein. The following annotation(s) were found: mismatch repair, which are annotation(s) related to Biological Process; ATP binding, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z24775 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 52 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 52 and Table 2004. This cluster is overexpressed (at least at a minimum level) in the following pathological conditions: malignant tumors involving the lymph nodes.

52

TABLE 2004

Normal tissue distribution

| Name of Tissue | Number |
|---|---|
| Adrenal | 40 |
| Bladder | 0 |
| Bone | 71 |
| Brain | 69 |
| Colon | 0 |
| Epithelial | 53 |

TABLE 2004-continued

Normal tissue distribution

| Name of Tissue | Number |
| --- | --- |
| General | 49 |
| head and neck | 10 |
| Kidney | 24 |
| Liver | 0 |
| Lung | 37 |
| lymph nodes | 20 |
| Breast | 0 |
| Muscle | 77 |
| Ovary | 109 |
| Pancreas | 20 |
| Prostate | 267 |
| Skin | 56 |
| Stomach | 0 |
| Uterus | 4 |

TABLE 2005

P values and ratios for expression in cancerous tissue

| Name of Tissue | P1 | P2 | SP1 | R3 | SP2 | R4 |
| --- | --- | --- | --- | --- | --- | --- |
| Adrenal | 9.2e−01 | 6.9e−01 | 1 | 0.5 | 7.8e−01 | 0.9 |
| Bladder | 1 | 6.0e−01 | 1 | 1.0 | 6.8e−01 | 1.5 |
| Bone | 8.3e−01 | 5.5e−01 | 1 | 0.3 | 7.5e−01 | 0.8 |
| Brain | 7.6e−01 | 8.1e−01 | 9.4e−01 | 0.5 | 9.8e−01 | 0.5 |
| Colon | 4.2e−01 | 1.5e−01 | 7.0e−01 | 1.5 | 2.7e−01 | 2.6 |
| Epithelial | 8.5e−01 | 6.5e−01 | 1 | 0.5 | 9.1e−01 | 0.7 |
| General | 9.2e−01 | 5.4e−01 | 1 | 0.6 | 3.7e−01 | 1.0 |
| head and neck | 4.6e−01 | 4.3e−01 | 1 | 1.0 | 7.5e−01 | 1.2 |
| Kidney | 7.4e−01 | 6.8e−01 | 4.4e−01 | 1.6 | 3.3e−01 | 1.8 |
| Liver | 1 | 4.5e−01 | 1 | 1.0 | 6.9e−01 | 1.5 |
| Lung | 8.1e−01 | 8.8e−01 | 4.8e−01 | 1.2 | 5.3e−01 | 1.0 |
| lymph nodes | 6.3e−01 | 3.1e−01 | 2.0e−01 | 2.9 | 3.1e−03 | 3.7 |
| Breast | 3.4e−01 | 2.8e−01 | 6.9e−01 | 1.5 | 5.6e−01 | 1.7 |
| Muscle | 6.9e−01 | 6.9e−01 | 1 | 0.2 | 5.6e−01 | 0.8 |
| Ovary | 8.1e−01 | 8.4e−01 | 9.1e−01 | 0.6 | 9.7e−01 | 0.5 |
| Pancreas | 7.0e−01 | 3.8e−01 | 8.1e−01 | 0.8 | 5.5e−01 | 1.2 |
| Prostate | 8.6e−01 | 8.8e−01 | 1 | 0.3 | 1 | 0.2 |
| Skin | 6.9e−01 | 7.5e−01 | 1 | 0.2 | 2.7e−01 | 0.7 |
| Stomach | 3.0e−01 | 3.0e−01 | 1 | 1.1 | 5.1e−01 | 1.8 |
| Uterus | 7.4e−01 | 5.6e−01 | 1 | 0.9 | 3.3e−01 | 1.7 |

As noted above, cluster Z24775 features 26 segment(s), which were listed in Table 2001 above and for which the sequence(s) are given at the end of the application. These segment(s) are portions of nucleic acid sequence(s) which are described herein separately because they are of particular interest. A description of each segment according to the present invention is now provided.

Segment cluster Z24775_node_0 (SEQ ID NO:2133) according to the present invention is supported by 2 libraries. The number of libraries was determined as previously described. This segment can be found in the following transcript(s): Z24775_T29 (SEQ ID NO:2132). Table 2006 below describes the starting and ending position of this segment on each transcript.

TABLE 2006

Segment location on transcripts

| Transcript name | Segment starting position | Segment ending position |
| --- | --- | --- |
| Z24775_T29 (SEQ ID NO: 2132) | 1 | 567 |

This segment can be found in a non-coding region of transcript(s) that are related to the following protein(s): Z24775_P17.

Segment cluster Z24775_node_1 (SEQ ID NO:2134) according to the present invention is supported by 65 libraries. The number of libraries was determined as previously described. This segment can be found in the following transcript(s): Z24775_T29 (SEQ ID NO:2132). Table 2007 below describes the starting and ending position of this segment on each transcript.

TABLE 2007

Segment location on transcripts

| Transcript name | Segment starting position | Segment ending position |
| --- | --- | --- |
| Z24775_T29 (SEQ ID NO: 2132) | 568 | 746 |

This segment can be found in the following protein(s): Z24775_P17.

Segment cluster Z24775_node_25 (SEQ ID NO:2135) according to the present invention is supported by 1 libraries. The number of libraries was determined as previously described. This segment can be found in the following transcript(s): Z24775_T29 (SEQ ID NO:2132). Table 2008 below describes the starting and ending position of this segment on each transcript.

TABLE 2008

Segment location on transcripts

| Transcript name | Segment starting position | Segment ending position |
| --- | --- | --- |
| Z24775_T29 (SEQ ID NO: 2132) | 1308 | 1874 |

This segment can be found in the following protein(s): Z24775_P17.

Segment cluster Z24775_node_31 (SEQ ID NO:2136) according to the present invention is supported by 4 libraries. The number of libraries was determined as previously described. This segment can be found in the following transcript(s): Z24775_T23 (SEQ ID NO:2128). Table 2009 below describes the starting and ending position of this segment on each transcript.

TABLE 2009

Segment location on transcripts

| Transcript name | Segment starting position | Segment ending position |
| --- | --- | --- |
| Z24775_T23 (SEQ ID NO: 2128) | 1 | 1087 |

This segment can be found in a non-coding region of transcript(s) that are related to the following protein(s): Z24775_P7.

Segment cluster Z24775_node_33 (SEQ ID NO:2137) according to the present invention is supported by 53 libraries. The number of libraries was determined as previously described. This segment can be found in the following transcript(s): Z24775_T23 (SEQ ID NO:2128). Table 2010 below describes the starting and ending position of this segment on each transcript.

TABLE 2010

Segment location on transcripts

| Transcript name | Segment starting position | Segment ending position |
|---|---|---|
| Z24775_T23 (SEQ ID NO: 2128) | 1093 | 1241 |

This segment can be found in the following protein(s): Z24775_P7.

Segment cluster Z24775_node_37 (SEQ ID NO:2138) according to the present invention is supported by 73 libraries. The number of libraries was determined as previously described. This segment can be found in the following transcript(s): Z24775_T23 (SEQ ID NO:2128). Table 2011 below describes the starting and ending position of this segment on each transcript.

TABLE 2011

Segment location on transcripts

| Transcript name | Segment starting position | Segment ending position |
|---|---|---|
| Z24775_T23 (SEQ ID NO: 2128) | 1242 | 1612 |

This segment can be found in the following protein(s): Z24775_P7.

Segment cluster Z24775_node_39 (SEQ ID NO:2139) according to the present invention is supported by 52 libraries. The number of libraries was determined as previously described. This segment can be found in the following transcript(s): Z24775_T23 (SEQ ID NO:2128). Table 2012 below describes the starting and ending position of this segment on each transcript.

TABLE 2012

Segment location on transcripts

| Transcript name | Segment starting position | Segment ending position |
|---|---|---|
| Z24775_T23 (SEQ ID NO: 2128) | 1613 | 1761 |

This segment can be found in the following protein(s): Z24775_P7.

Segment cluster Z24775_node_47 (SEQ ID NO:2140) according to the present invention is supported by 31 libraries. The number of libraries was determined as previously described. This segment can be found in the following transcript(s): Z24775_T26 (SEQ ID NO:2129) and Z24775_T28 (SEQ ID NO:2131). Table 2013 below describes the starting and ending position of this segment on each transcript.

TABLE 2013

Segment location on transcripts

| Transcript name | Segment starting position | Segment ending position |
|---|---|---|
| Z24775_T26 (SEQ ID NO: 2129) | 1 | 1691 |
| Z24775_T28 (SEQ ID NO: 2131) | 1 | 1691 |

This segment can be found in a non-coding region of transcript(s) that are related to the following protein(s): Z24775_P15 and Z24775_P16.

Segment cluster Z24775_node_48 (SEQ ID NO:2141) according to the present invention is supported by 107 libraries. The number of libraries was determined as previously described. This segment can be found in the following transcript(s): Z24775_T23 (SEQ ID NO:2128), Z24775_T26 (SEQ ID NO:2129) and Z24775_T28 (SEQ ID NO:2131). Table 2014 below describes the starting and ending position of this segment on each transcript.

TABLE 2014

Segment location on transcripts

| Transcript name | Segment starting position | Segment ending position |
|---|---|---|
| Z24775_T23 (SEQ ID NO: 2128) | 1935 | 2099 |
| Z24775_T26 (SEQ ID NO: 2129) | 1692 | 1856 |
| Z24775_T28 (SEQ ID NO: 2131) | 1692 | 1856 |

This segment can be found in the following protein(s): Z24775_P7, Z24775_P15 and Z24775_P16.

Segment cluster Z24775_node_51 (SEQ ID NO:2142) according to the present invention is supported by 6 libraries. The number of libraries was determined as previously described. This segment can be found in the following transcript(s): Z24775_T27 (SEQ ID NO:2130). Table 2015 below describes the starting and ending position of this segment on each transcript.

TABLE 2015

Segment location on transcripts

| Transcript name | Segment starting position | Segment ending position |
|---|---|---|
| Z24775_T27 (SEQ ID NO: 2130) | 1 | 574 |

The previously-described transcripts for these segment(s) do not code for protein.

Segment cluster Z24775_node_59 (SEQ ID NO:2143) according to the present invention is supported by 125 libraries. The number of libraries was determined as previously described. This segment can be found in the following transcript(s): Z24775_T23 (SEQ ID NO:2128), Z24775_T26 (SEQ ID NO:2129), Z24775_T27 (SEQ ID NO:2130) and Z24775_T28 (SEQ ID NO:2131). Table 2016 below describes the starting and ending position of this segment on each transcript.

TABLE 2016

Segment location on transcripts

| Transcript name | Segment starting position | Segment ending position |
|---|---|---|
| Z24775_T23 (SEQ ID NO: 2128) | 2406 | 2672 |
| Z24775_T26 (SEQ ID NO: 2129) | 2163 | 2429 |
| Z24775_T27 (SEQ ID NO: 2130) | 881 | 1147 |
| Z24775_T28 (SEQ ID NO: 2131) | 2070 | 2336 |

This segment can be found in the following protein(s): Z24775_P7, Z24775_P15 and Z24775_P16.

According to an optional embodiment of the present invention, short segments related to the above cluster are also provided. These segments are up to about 120 bp in length, and so are included in a separate description.

Segment cluster Z24775_node_8 (SEQ ID NO:2144) according to the present invention can be found in the following transcript(s): Z24775_T29 (SEQ ID NO:2132). Table 2017 below describes the starting and ending position of this segment on each transcript.

TABLE 2017

Segment location on transcripts

| Transcript name | Segment starting position | Segment ending position |
|---|---|---|
| Z24775_T29 (SEQ ID NO: 2132) | 747 | 751 |

This segment can be found in the following protein(s): Z24775_P17.

Segment cluster Z24775_node_9 (SEQ ID NO:2145) according to the present invention is supported by 84 libraries. The number of libraries was determined as previously described. This segment can be found in the following transcript(s): Z24775_T29 (SEQ ID NO:2132). Table 2018 below describes the starting and ending position of this segment on each transcript.

TABLE 2018

Segment location on transcripts

| Transcript name | Segment starting position | Segment ending position |
|---|---|---|
| Z24775_T29 (SEQ ID NO: 2132) | 752 | 837 |

This segment can be found in the following protein(s): Z24775_P17.

Segment cluster Z24775_node_13 (SEQ ID NO:2146) according to the present invention is supported by 91 libraries. The number of libraries was determined as previously described. This segment can be found in the following transcript(s): Z24775_T29 (SEQ ID NO:2132). Table 2019 below describes the starting and ending position of this segment on each transcript.

TABLE 2019

Segment location on transcripts

| Transcript name | Segment starting position | Segment ending position |
|---|---|---|
| Z24775_T29 (SEQ ID NO: 2132) | 838 | 931 |

This segment can be found in the following protein(s): Z24775_P17.

Segment cluster Z24775_node_14 (SEQ ID NO:2147) according to the present invention can be found in the following transcript(s): Z24775_T29 (SEQ ID NO:2132). Table 2020 below describes the starting and ending position of this segment on each transcript.

TABLE 2020

Segment location on transcripts

| Transcript name | Segment starting position | Segment ending position |
|---|---|---|
| Z24775_T29 (SEQ ID NO: 2132) | 932 | 936 |

This segment can be found in the following protein(s): Z24775_P17.

Segment cluster Z24775_node_16 (SEQ ID NO:2148) according to the present invention is supported by 83 libraries. The number of libraries was determined as previously described. This segment can be found in the following transcript(s): Z24775_T29 (SEQ ID NO:2132). Table 2021 below describes the starting and ending position of this segment on each transcript.

TABLE 2021

Segment location on transcripts

| Transcript name | Segment starting position | Segment ending position |
|---|---|---|
| Z24775_T29 (SEQ ID NO: 2132) | 937 | 1010 |

This segment can be found in the following protein(s): Z24775_P17.

Segment cluster Z24775_node_18 (SEQ ID NO:2149) according to the present invention is supported by 83 libraries. The number of libraries was determined as previously described. This segment can be found in the following transcript(s): Z24775_T29 (SEQ ID NO:2132). Table 2022 below describes the starting and ending position of this segment on each transcript.

TABLE 2022

Segment location on transcripts

| Transcript name | Segment starting position | Segment ending position |
|---|---|---|
| Z24775_T29 (SEQ ID NO: 2132) | 1011 | 1083 |

This segment can be found in the following protein(s): Z24775_P17.

Segment cluster Z24775_node_20 (SEQ ID NO:2150) according to the present invention is supported by 91 libraries. The number of libraries was determined as previously described. This segment can be found in the following transcript(s): Z24775_T29 (SEQ ID NO:2132). Table 2023 below describes the starting and ending position of this segment on each transcript.

TABLE 2023

Segment location on transcripts

| Transcript name | Segment starting position | Segment ending position |
|---|---|---|
| Z24775_T29 (SEQ ID NO: 2132) | 1084 | 1175 |

This segment can be found in the following protein(s): Z24775_P17.

Segment cluster Z24775_node_22 (SEQ ID NO:2151) according to the present invention is supported by 86 libraries. The number of libraries was determined as previously described. This segment can be found in the following transcript(s): Z24775_T29 (SEQ ID NO:2132). Table 2024 below describes the starting and ending position of this segment on each transcript.

TABLE 2024

Segment location on transcripts

| Transcript name | Segment starting position | Segment ending position |
|---|---|---|
| Z24775_T29 (SEQ ID NO: 2132) | 1176 | 1218 |

This segment can be found in the following protein(s): Z24775_P17.

Segment cluster Z24775_node_24 (SEQ ID NO:2152) according to the present invention is supported by 89 libraries. The number of libraries was determined as previously described. This segment can be found in the following transcript(s): Z24775_T29 (SEQ ID NO:2132). Table 2025 below describes the starting and ending position of this segment on each transcript.

TABLE 2025

Segment location on transcripts

| Transcript name | Segment starting position | Segment ending position |
|---|---|---|
| Z24775_T29 (SEQ ID NO: 2132) | 1219 | 1307 |

This segment can be found in the following protein(s): Z24775_P17.

Segment cluster Z24775_node_32 (SEQ ID NO:2153) according to the present invention can be found in the following transcript(s): Z24775_T23 (SEQ ID NO:2128). Table 2026 below describes the starting and ending position of this segment on each transcript.

TABLE 2026

Segment location on transcripts

| Transcript name | Segment starting position | Segment ending position |
|---|---|---|
| Z24775_T23 (SEQ ID NO: 2128) | 1088 | 1092 |

This segment can be found in a non-coding region of transcript(s) that are related to the following protein(s): Z24775_P7.

Segment cluster Z24775_node_41 (SEQ ID NO:2154) according to the present invention is supported by 51 libraries. The number of libraries was determined as previously described. This segment can be found in the following transcript(s): Z24775_T23 (SEQ ID NO:2128). Table 2027 below describes the starting and ending position of this segment on each transcript.

TABLE 2027

Segment location on transcripts

| Transcript name | Segment starting position | Segment ending position |
|---|---|---|
| Z24775_T23 (SEQ ID NO: 2128) | 1762 | 1870 |

This segment can be found in the following protein(s): Z24775_P7.

Segment cluster Z24775_node_43 (SEQ ID NO:2155) according to the present invention is supported by 51 libraries. The number of libraries was determined as previously described. This segment can be found in the following transcript(s): (SEQ ID NO:2128). Table 2028 below describes the starting and ending position of this segment on each transcript.

TABLE 2028

Segment location on transcripts

| Transcript name | Segment starting position | Segment ending position |
|---|---|---|
| Z24775_T23 (SEQ ID NO: 2128) | 1871 | 1934 |

This segment can be found in the following protein(s): Z24775_P7.

Segment cluster Z24775_node_52 (SEQ ID NO:2156) according to the present invention is supported by 110 libraries. The number of libraries was determined as previously described. This segment can be found in the following transcript(s): (SEQ ID NO:2128), Z24775_T26 (SEQ ID NO:2129) and (SEQ ID NO:2130). Table 2029 below describes the starting and ending position of this segment on each transcript.

TABLE 2029

Segment location on transcripts

| Transcript name | Segment starting position | Segment ending position |
|---|---|---|
| Z24775_T23 (SEQ ID NO: 2128) | 2100 | 2192 |
| Z24775_T26 (SEQ ID NO: 2129) | 1857 | 1949 |
| Z24775_T27 (SEQ ID NO: 2130) | 575 | 667 |

This segment can be found in the following protein(s): Z24775_P7 and Z24775_P15.

Segment cluster Z24775_node_55 (SEQ ID NO:2157) according to the present invention is supported by 135 libraries. The number of libraries was determined as previously described. This segment can be found in the following transcript(s): Z24775_T23 (SEQ ID NO:2128), Z24775_T26 (SEQ ID NO:2129), Z24775_T27 (SEQ ID NO:2130) and Z24775_T28 (SEQ ID NO:2131). Table 2030 below describes the starting and ending position of this segment on each transcript.

TABLE 2030

Segment location on transcripts

| Transcript name | Segment starting position | Segment ending position |
|---|---|---|
| Z24775_T23 (SEQ ID NO: 2128) | 2193 | 2306 |
| Z24775_T26 (SEQ ID NO: 2129) | 1950 | 2063 |
| Z24775_T27 (SEQ ID NO: 2130) | 668 | 781 |
| Z24775_T28 (SEQ ID NO: 2131) | 1857 | 1970 |

This segment can be found in the following protein(s): Z24775_P7, Z24775_P15 and Z24775_P16.

Segment cluster Z24775_node_57 (SEQ ID NO:2158) according to the present invention is supported by 125 libraries. The number of libraries was determined as previously described. This segment can be found in the following transcript(s): Z24775_T23 (SEQ ID NO:2128), Z24775_T26 (SEQ ID NO:2129), Z24775_T27 (SEQ ID NO:2130) and Z24775_T28 (SEQ ID NO:2131). Table 2031 below describes the starting and ending position of this segment on each transcript.

TABLE 2031

Segment location on transcripts

| Transcript name | Segment starting position | Segment ending position |
|---|---|---|
| Z24775_T23 (SEQ ID NO: 2128) | 2307 | 2405 |
| Z24775_T26 (SEQ ID NO: 2129) | 2064 | 2162 |
| Z24775_T27 (SEQ ID NO: 2130) | 782 | 880 |
| Z24775_T28 (SEQ ID NO: 2131) | 1971 | 2069 |

This segment can be found in the following protein(s): Z24775_P7, Z24775_P15 and Z24775_P16.

Description for Cluster Z24779

Cluster Z24779 features 5 transcript(s) and 44 segment(s) of interest, the names for which are given in Tables 2032 and 2033, respectively, the sequences themselves are given at the end of the application. The selected protein variants are given in Table 2034.

TABLE 2032

Transcripts of interest
Transcript Name

Z24779_T3 (SEQ ID NO: 2159)
Z24779_T9 (SEQ ID NO: 2160)
Z24779_T10 (SEQ ID NO: 2161)
Z24779_T13 (SEQ ID NO: 2162)
Z24779_T17 (SEQ ID NO: 2163)

TABLE 2033

Segments of interest
Segment Name

Z24779_node_0 (SEQ ID NO: 2164)
Z24779_node_2 (SEQ ID NO: 2165)
Z24779_node_4 (SEQ ID NO: 2166)
Z24779_node_7 (SEQ ID NO: 2167)
Z24779_node_9 (SEQ ID NO: 2168)
Z24779_node_10 (SEQ ID NO: 2169)
Z24779_node_18 (SEQ ID NO: 2170)
Z24779_node_20 (SEQ ID NO: 2171)
Z24779_node_22 (SEQ ID NO: 2172)
Z24779_node_27 (SEQ ID NO: 2173)
Z24779_node_32 (SEQ ID NO: 2174)
Z24779_node_34 (SEQ ID NO: 2175)
Z24779_node_37 (SEQ ID NO: 2176)
Z24779_node_39 (SEQ ID NO: 2177)
Z24779_node_42 (SEQ ID NO: 2178)
Z24779_node_46 (SEQ ID NO: 2179)
Z24779_node_48 (SEQ ID NO: 2180)
Z24779_node_49 (SEQ ID NO: 2181)
Z24779_node_53 (SEQ ID NO: 2182)
Z24779_node_59 (SEQ ID NO: 2183)
Z24779_node_61 (SEQ ID NO: 2184)
Z24779_node_75 (SEQ ID NO: 2185)
Z24779_node_76 (SEQ ID NO: 2186)
Z24779_node_78 (SEQ ID NO: 2187)
Z24779_node_80 (SEQ ID NO: 2188)
Z24779_node_86 (SEQ ID NO: 2189)
Z24779_node_12 (SEQ ID NO: 2190)
Z24779_node_14 (SEQ ID NO: 2191)
Z24779_node_16 (SEQ ID NO: 2192)
Z24779_node_25 (SEQ ID NO: 2193)
Z24779_node_26 (SEQ ID NO: 2194)
Z24779_node_30 (SEQ ID NO: 2195)
Z24779_node_51 (SEQ ID NO: 2196)
Z24779_node_55 (SEQ ID NO: 2197)
Z24779_node_57 (SEQ ID NO: 2198)
Z24779_node_63 (SEQ ID NO: 2199)
Z24779_node_65 (SEQ ID NO: 2200)

TABLE 2033-continued

Segments of interest
Segment Name

Z24779_node_67 (SEQ ID NO: 2201)
Z24779_node_69 (SEQ ID NO: 2202)
Z24779_node_71 (SEQ ID NO: 2203)
Z24779_node_73 (SEQ ID NO: 2204)
Z24779_node_79 (SEQ ID NO: 2205)
Z24779_node_81 (SEQ ID NO: 2206)
Z24779_node_84 (SEQ ID NO: 2207)

TABLE 2034

Proteins of interest

| Protein Name | Corresponding Transcript(s) |
|---|---|
| Z24779_P4 | Z24779_T3 (SEQ ID NO: 2159) |
| Z24779_P9 | Z24779_T9 (SEQ ID NO: 2160) |
| Z24779_P10 | Z24779_T10 (SEQ ID NO: 2161) |
| Z24779_P15 | Z24779_T17 (SEQ ID NO: 2163) |

These sequences are variants of the known protein Myomesin 1 (SwissProt accession identifier MYM1_HUMAN; known also according to the synonyms 190 kDa titin-associated protein; 190 kDa connectin-associated protein), referred to herein as the previously known protein.

Protein Myomesin 1 is known or believed to have the following function(s): Major component of the vertebrate myofibrillar M band. Binds myosin, titin, and light meromyosin. This binding is dose dependent. The sequence for protein Myomesin 1 is given at the end of the application, as "Myomesin 1 amino acid sequence".

The following GO Annotation(s) apply to the previously known protein. The following annotation(s) were found: striated muscle contraction; muscle development, which are annotation(s) related to Biological Process; structural protein of muscle, which are annotation(s) related to Molecular Function; and muscle thick filament, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster Z24779. Predictions were made for selective expression of transcripts of this contig in heart tissue, according to the previously described methods. The numbers on the y-axis of FIG. 53 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 53, concerning the number of heart-specific clones in libraries/sequences; as well as with regard to the histogram in FIG. 54, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 12.7; the ratio of expression of the cluster in heart specific ESTs to the overall expression of the cluster in muscle-specific ESTs which was found to be 2.9; and fisher exact test P-values were computed both for library and weighted clone counts to check that the counts are statistically significant, and were found to be 1.10E-17.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 12.7, which clearly supports specific expression in heart tissue.

As noted above, cluster Z24779 features 44 segment(s), which were listed in Table 2033 above and for which the sequence(s) are given at the end of the application. These segment(s) are portions of nucleic acid sequence(s) which are described herein separately because they are of particular interest. A description of each segment according to the present invention is now provided.

Segment cluster Z24779_node_0 (SEQ ID NO:2164) according to the present invention is supported by 4 libraries. The number of libraries was determined as previously described. This segment can be found in the following transcript(s): Z24779_T3 (SEQ ID NO:2159), Z24779_T10 (SEQ ID NO:2161) and Z24779_T17 (SEQ ID NO:2163). Table 2035 below describes the starting and ending position of this segment on each transcript.

TABLE 2035

Segment location on transcripts

| Transcript name | Segment starting position | Segment ending position |
|---|---|---|
| Z24779_T3 (SEQ ID NO: 2159) | 1 | 148 |
| Z24779_T10 (SEQ ID NO: 2161) | 1 | 148 |
| Z24779_T17 (SEQ ID NO: 2163) | 1 | 148 |

This segment can be found in a non-coding region of transcript(s) that are related to the following protein(s): Z24779_P4, Z24779_P10 and Z24779_P15.

Segment cluster Z24779_node_2 (SEQ ID NO:2165) according to the present invention is supported by 6 libraries. The number of libraries was determined as previously described. This segment can be found in the following transcript(s): Z24779_T3 (SEQ ID NO:2159), Z24779_T10 (SEQ ID NO:2161) and Z24779_T17 (SEQ ID NO:2163). Table 2036 below describes the starting and ending position of this segment on each transcript.

TABLE 2036

Segment location on transcripts

| Transcript name | Segment starting position | Segment ending position |
|---|---|---|
| Z24779_T3 (SEQ ID NO: 2159) | 149 | 466 |
| Z24779_T10 (SEQ ID NO: 2161) | 149 | 466 |
| Z24779_T17 (SEQ ID NO: 2163) | 149 | 466 |

This segment can be found in the following protein(s): Z24779_P4, Z24779_P10 and Z24779_P15.

Segment cluster Z24779_node_4 (SEQ ID NO:2166) according to the present invention is supported by 12 libraries. The number of libraries was determined as previously described. This segment can be found in the following transcript(s): Z24779_T3 (SEQ ID NO:2159), Z24779_T10 (SEQ ID NO:2161) and Z24779_T17 (SEQ ID NO:2163). Table 2037 below describes the starting and ending position of this segment on each transcript.

TABLE 2037

Segment location on transcripts

| Transcript name | Segment starting position | Segment ending position |
|---|---|---|
| Z24779_T3 (SEQ ID NO: 2159) | 467 | 607 |
| Z24779_T10 (SEQ ID NO: 2161) | 467 | 607 |
| Z24779_T17 (SEQ ID NO: 2163) | 467 | 607 |

This segment can be found in the following protein(s): Z24779_P4, Z24779_P10 and Z24779_P15.

Segment cluster Z24779_node_7 (SEQ ID NO:2167) according to the present invention is supported by 13 libraries. The number of libraries was determined as previously described. This segment can be found in the following transcript(s): Z24779_T3 (SEQ ID NO:2159), Z24779_T10 (SEQ ID NO:2161) and Z24779_T17 (SEQ ID NO:2163). Table 2038 below describes the starting and ending position of this segment on each transcript.

TABLE 2038

Segment location on transcripts

| Transcript name | Segment starting position | Segment ending position |
|---|---|---|
| Z24779_T3 (SEQ ID NO: 2159) | 608 | 947 |
| Z24779_T10 (SEQ ID NO: 2161) | 608 | 947 |
| Z24779_T17 (SEQ ID NO: 2163) | 608 | 947 |

This segment can be found in the following protein(s): Z24779_P4, Z24779_P10 and Z24779_P15.

Segment cluster Z24779_node_9 (SEQ ID NO:2168) according to the present invention is supported by 11 libraries. The number of libraries was determined as previously described. This segment can be found in the following transcript(s): Z24779_T3 (SEQ ID NO:2159), Z24779_T10 (SEQ ID NO:2161) and Z24779_T17 (SEQ ID NO:2163). Table 2039 below describes the starting and ending position of this segment on each transcript.

TABLE 2039

Segment location on transcripts

| Transcript name | Segment starting position | Segment ending position |
|---|---|---|
| Z24779_T3 (SEQ ID NO: 2159) | 948 | 1105 |
| Z24779_T10 (SEQ ID NO: 2161) | 948 | 1105 |
| Z24779_T17 (SEQ ID NO: 2163) | 948 | 1105 |

This segment can be found in the following protein(s): Z24779_P4, Z24779_P10 and Z24779_P15.

Segment cluster Z24779_node_10 (SEQ ID NO:2169) according to the present invention is supported by 5 libraries. The number of libraries was determined as previously described. This segment can be found in the following transcript(s): Z24779_T17 (SEQ ID NO:2163). Table 2040 below describes the starting and ending position of this segment on each transcript.

TABLE 2040

Segment location on transcripts

| Transcript name | Segment starting position | Segment ending position |
|---|---|---|
| Z24779_T17 (SEQ ID NO: 2163) | 1106 | 1722 |

This segment can be found in the following protein(s): Z24779_P15.

Segment cluster Z24779_node__18 (SEQ ID NO:2170) according to the present invention is supported by 12 libraries. The number of libraries was determined as previously described. This segment can be found in the following transcript(s): Z24779_T3 (SEQ ID NO:2159) and Z24779_T10 (SEQ ID NO:2161). Table 2041 below describes the starting and ending position of this segment on each transcript.

TABLE 2041

Segment location on transcripts

| Transcript name | Segment starting position | Segment ending position |
|---|---|---|
| Z24779_T3 (SEQ ID NO: 2159) | 1351 | 1515 |
| Z24779_T10 (SEQ ID NO: 2161) | 1351 | 1515 |

This segment can be found in the following protein(s): Z24779_P4 and Z24779_P10.

Segment cluster Z24779_node__20 (SEQ ID NO:2171) according to the present invention is supported by 11 libraries. The number of libraries was determined as previously described. This segment can be found in the following transcript(s): Z24779_T3 (SEQ ID NO:2159) and Z24779_T10 (SEQ ID NO:2161). Table 2042 below describes the starting and ending position of this segment on each transcript.

TABLE 2042

Segment location on transcripts

| Transcript name | Segment starting position | Segment ending position |
|---|---|---|
| Z24779_T3 (SEQ ID NO: 2159) | 1516 | 1677 |
| Z24779_T10 (SEQ ID NO: 2161) | 1516 | 1677 |

This segment can be found in the following protein(s): Z24779_P4 and Z24779_P10.

Segment cluster Z24779_node__22 (SEQ ID NO:2172) according to the present invention is supported by 7 libraries. The number of libraries was determined as previously described. This segment can be found in the following transcript(s): Z24779_T3 (SEQ ID NO:2159) and Z24779_T10 (SEQ ID NO:2161). Table 2043 below describes the starting and ending position of this segment on each transcript.

TABLE 2043

Segment location on transcripts

| Transcript name | Segment starting position | Segment ending position |
|---|---|---|
| Z24779_T3 (SEQ ID NO: 2159) | 1678 | 1819 |
| Z24779_T10 (SEQ ID NO: 2161) | 1678 | 1819 |

This segment can be found in the following protein(s): Z24779_P4 and Z24779_P10.

Segment cluster Z24779_node__27 (SEQ ID NO:2173) according to the present invention is supported by 8 libraries. The number of libraries was determined as previously described. This segment can be found in the following transcript(s): Z24779_T3 (SEQ ID NO:2159) and Z24779_T10 (SEQ ID NO:2161). Table 2044 below describes the starting and ending position of this segment on each transcript.

TABLE 2044

Segment location on transcripts

| Transcript name | Segment starting position | Segment ending position |
|---|---|---|
| Z24779_T3 (SEQ ID NO: 2159) | 1879 | 2019 |
| Z24779_T10 (SEQ ID NO: 2161) | 1879 | 2019 |

This segment can be found in the following protein(s): Z24779_P4 and Z24779_P10.

Segment cluster Z24779_node__32 (SEQ ID NO:2174) according to the present invention is supported by 7 libraries. The number of libraries was determined as previously described. This segment can be found in the following transcript(s): Z24779_T3 (SEQ ID NO:2159) and Z24779_T10 (SEQ ID NO:2161). Table 2045 below describes the starting and ending position of this segment on each transcript.

TABLE 2045

Segment location on transcripts

| Transcript name | Segment starting position | Segment ending position |
|---|---|---|
| Z24779_T3 (SEQ ID NO: 2159) | 2077 | 2201 |
| Z24779_T10 (SEQ ID NO: 2161) | 2077 | 2201 |

This segment can be found in the following protein(s): Z24779_P4 and Z24779_P10.

Segment cluster Z24779_node__34 (SEQ ID NO:2175) according to the present invention is supported by 8 libraries. The number of libraries was determined as previously described. This segment can be found in the following transcript(s): Z24779_T3 (SEQ ID NO:2159) and Z24779_T10 (SEQ ID NO:2161). Table 2046 below describes the starting and ending position of this segment on each transcript.

TABLE 2046

Segment location on transcripts

| Transcript name | Segment starting position | Segment ending position |
|---|---|---|
| Z24779_T3 (SEQ ID NO: 2159) | 2202 | 2385 |
| Z24779_T10 (SEQ ID NO: 2161) | 2202 | 2385 |

This segment can be found in the following protein(s): Z24779_P4 and Z24779_P10.

Segment cluster Z24779_node_37 (SEQ ID NO:2176) according to the present invention is supported by 9 libraries. The number of libraries was determined as previously described. This segment can be found in the following transcript(s): Z24779_T3 (SEQ ID NO:2159) and Z24779_T10 (SEQ ID NO:2161). Table 2047 below describes the starting and ending position of this segment on each transcript.

TABLE 2047

Segment location on transcripts

| Transcript name | Segment starting position | Segment ending position |
| --- | --- | --- |
| Z24779_T3 (SEQ ID NO: 2159) | 2386 | 2560 |
| Z24779_T10 (SEQ ID NO: 2161) | 2386 | 2560 |

This segment can be found in the following protein(s): Z24779_P4 and Z24779_P10.

Segment cluster Z24779_node_39 (SEQ ID NO:2177) according to the present invention is supported by 7 libraries. The number of libraries was determined as previously described. This segment can be found in the following transcript(s): Z24779_T3 (SEQ ID NO:2159) and Z24779_T10 (SEQ ID NO:2161). Table 2048 below describes the starting and ending position of this segment on each transcript.

TABLE 2048

Segment location on transcripts

| Transcript name | Segment starting position | Segment ending position |
| --- | --- | --- |
| Z24779_T3 (SEQ ID NO: 2159) | 2561 | 2682 |
| Z24779_T10 (SEQ ID NO: 2161) | 2561 | 2682 |

This segment can be found in the following protein(s): Z24779_P4 and Z24779_P10.

Segment cluster Z24779_node_42 (SEQ ID NO:2178) according to the present invention is supported by 10 libraries. The number of libraries was determined as previously described. This segment can be found in the following transcript(s): Z24779_T3 (SEQ ID NO:2159) and Z24779_T10 (SEQ ID NO:2161). Table 2049 below describes the starting and ending position of this segment on each transcript.

TABLE 2049

Segment location on transcripts

| Transcript name | Segment starting position | Segment ending position |
| --- | --- | --- |
| Z24779_T3 (SEQ ID NO: 2159) | 2683 | 2879 |
| Z24779_T10 (SEQ ID NO: 2161) | 2683 | 2879 |

This segment can be found in the following protein(s): Z24779_P4 and Z24779_P10.

Segment cluster Z24779_node_46 (SEQ ID NO:2179) according to the present invention is supported by 9 libraries. The number of libraries was determined as previously described. This segment can be found in the following transcript(s): Z24779_T3 (SEQ ID NO:2159) and Z24779_T10 (SEQ ID NO:2161). Table 2050 below describes the starting and ending position of this segment on each transcript.

TABLE 2050

Segment location on transcripts

| Transcript name | Segment starting position | Segment ending position |
| --- | --- | --- |
| Z24779_T3 (SEQ ID NO: 2159) | 2880 | 3006 |
| Z24779_T10 (SEQ ID NO: 2161) | 2880 | 3006 |

This segment can be found in the following protein(s): Z24779_P4 and Z24779_P10.

Segment cluster Z24779_node_48 (SEQ ID NO:2180) according to the present invention is supported by 1 libraries. The number of libraries was determined as previously described. This segment can be found in the following transcript(s): Z24779_T9 (SEQ ID NO:2160). Table 2051 below describes the starting and ending position of this segment on each transcript.

TABLE 2051

Segment location on transcripts

| Transcript name | Segment starting position | Segment ending position |
| --- | --- | --- |
| Z24779_T9 (SEQ ID NO: 2160) | 1 | 426 |

This segment can be found in the following protein(s): Z24779_P9.

Segment cluster Z24779_node_49 (SEQ ID NO:2181) according to the present invention is supported by 11 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2052 below describes the starting and ending position of this segment on each transcript.

TABLE 2052

Segment location on transcripts

| Transcript name | Segment starting position | Segment ending position |
| --- | --- | --- |
| Z24779_T3 (SEQ ID NO: 2159) | 3007 | 3191 |
| Z24779_T9 (SEQ ID NO: 2160) | 427 | 611 |
| Z24779_T10 (SEQ ID NO: 2161) | 3007 | 3191 |

This segment can be found in the following protein(s): Z24779_P4, Z24779_P9 and Z24779_P10.

Segment cluster Z24779_node_53 (SEQ ID NO:2182) according to the present invention is supported by 15 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2053 below describes the starting and ending position of this segment on each transcript.

TABLE 2053

Segment location on transcripts

| Transcript name | Segment starting position | Segment ending position |
|---|---|---|
| Z24779_T3 (SEQ ID NO: 2159) | 3307 | 3463 |
| Z24779_T9 (SEQ ID NO: 2160) | 727 | 883 |
| Z24779_T10 (SEQ ID NO: 2161) | 3307 | 3463 |

This segment can be found in the following protein(s): Z24779_P4, Z24779_P9 and Z24779_P10.

Segment cluster Z24779_node_59 (SEQ ID NO:2183) according to the present invention is supported by 21 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2054 below describes the starting and ending position of this segment on each transcript.

TABLE 2054

Segment location on transcripts

| Transcript name | Segment starting position | Segment ending position |
|---|---|---|
| Z24779_T3 (SEQ ID NO: 2159) | 3616 | 3752 |
| Z24779_T9 (SEQ ID NO: 2160) | 1036 | 1172 |
| Z24779_T10 (SEQ ID NO: 2161) | 3616 | 3752 |

This segment can be found in the following protein(s): Z24779_P4, Z24779_P9 and Z24779_P10.

Segment cluster Z24779_node_61 (SEQ ID NO:2184) according to the present invention is supported by 22 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2055 below describes the starting and ending position of this segment on each transcript.

TABLE 2055

Segment location on transcripts

| Transcript name | Segment starting position | Segment ending position |
|---|---|---|
| Z24779_T3 (SEQ ID NO: 2159) | 3753 | 3897 |
| Z24779_T9 (SEQ ID NO: 2160) | 1173 | 1317 |
| Z24779_T10 (SEQ ID NO: 2161) | 3753 | 3897 |

This segment can be found in the following protein(s): Z24779_P4, Z24779_P9 and Z24779_P10.

Segment cluster Z24779_node_75 (SEQ ID NO:2185) according to the present invention is supported by 33 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2056 below describes the starting and ending position of this segment on each transcript.

TABLE 2056

Segment location on transcripts

| Transcript name | Segment starting position | Segment ending position |
|---|---|---|
| Z24779_T3 (SEQ ID NO: 2159) | 4373 | 4536 |
| Z24779_T9 (SEQ ID NO: 2160) | 1793 | 1956 |
| Z24779_T10 (SEQ ID NO: 2161) | 4373 | 4536 |

This segment can be found in the following protein(s): Z24779_P4, Z24779_P9 and Z24779_P10.

Segment cluster Z24779_node_76 (SEQ ID NO:2186) according to the present invention is supported by 1 libraries. The number of libraries was determined as previously described. This segment can be found in the following transcript(s): Z24779_T10 (SEQ ID NO:2161). Table 2057 below describes the starting and ending position of this segment on each transcript.

TABLE 2057

Segment location on transcripts

| Transcript name | Segment starting position | Segment ending position |
|---|---|---|
| Z24779_T10 (SEQ ID NO: 2161) | 4537 | 4692 |

This segment can be found in the following protein(s): Z24779_P10.

Segment cluster Z24779_node_78 (SEQ ID NO:2187) according to the present invention is supported by 2 libraries. The number of libraries was determined as previously described. This segment can be found in the following transcript(s): Z24779_T13 (SEQ ID NO:2162). Table 2058 below describes the starting and ending position of this segment on each transcript.

TABLE 2058

Segment location on transcripts

| Transcript name | Segment starting position | Segment ending position |
|---|---|---|
| Z24779_T13 (SEQ ID NO: 2162) | 1 | 164 |

The previously-described transcripts for these segment(s) do not code for protein.

Segment cluster Z24779_node_80 (SEQ ID NO:2188) according to the present invention is supported by 5 libraries. The number of libraries was determined as previously described. This segment can be found in the following transcript(s): Z24779_T3 (SEQ ID NO:2159) and Z24779_T13 (SEQ ID NO:2162). Table 2059 below describes the starting and ending position of this segment on each transcript.

TABLE 2059

Segment location on transcripts

| Transcript name | Segment starting position | Segment ending position |
|---|---|---|
| Z24779_T3 (SEQ ID NO: 2159) | 4574 | 4824 |
| Z24779_T13 (SEQ ID NO: 2162) | 202 | 452 |

This segment can be found in the following protein(s): Z24779_P4.

Segment cluster Z24779_node__86 (SEQ ID NO:2189) according to the present invention is supported by 79 libraries. The number of libraries was determined as previously described. This segment can be found in the following transcript(s): Z24779_T3 (SEQ ID NO:2159), Z24779_T9 (SEQ ID NO:2160) and Z24779_T13 (SEQ ID NO:2162). Table 2060 below describes the starting and ending position of this segment on each transcript.

TABLE 2060

Segment location on transcripts

| Transcript name | Segment starting position | Segment ending position |
|---|---|---|
| Z24779_T3 (SEQ ID NO: 2159) | 4904 | 5652 |
| Z24779_T9 (SEQ ID NO: 2160) | 2073 | 2821 |
| Z24779_T13 (SEQ ID NO: 2162) | 532 | 1280 |

This segment can be found in both coding and non-coding regions of transcript(s) as follows. The segment can be found in a non-coding region of transcript(s) that are related to the following protein(s): Z24779_P4. This segment can also be found in the following protein(s): Z24779_P9, since it is in the coding region for the corresponding transcript.

According to an optional embodiment of the present invention, short segments related to the above cluster are also provided. These segments are up to about 120 bp in length, and so are included in a separate description.

Segment cluster Z24779_node__12 (SEQ ID NO:2190) according to the present invention is supported by 8 libraries. The number of libraries was determined as previously described. This segment can be found in the following transcript(s): Z24779_T3 (SEQ ID NO:2159) and Z24779_T10 (SEQ ID NO:2161). Table 2061 below describes the starting and ending position of this segment on each transcript.

TABLE 2061

Segment location on transcripts

| Transcript name | Segment starting position | Segment ending position |
|---|---|---|
| Z24779_T3 (SEQ ID NO: 2159) | 1106 | 1198 |
| Z24779_T10 (SEQ ID NO: 2161) | 1106 | 1198 |

This segment can be found in the following protein(s): Z24779_P4 and Z24779_P10.

Segment cluster Z24779_node__14 (SEQ ID NO:2191) according to the present invention is supported by 9 libraries. The number of libraries was determined as previously described. This segment can be found in the following transcript(s): Z24779_T3 (SEQ ID NO:2159) and Z24779_T10 (SEQ ID NO:2161). Table 2062 below describes the starting and ending position of this segment on each transcript.

TABLE 2062

Segment location on transcripts

| Transcript name | Segment starting position | Segment ending position |
|---|---|---|
| Z24779_T3 (SEQ ID NO: 2159) | 1199 | 1287 |
| Z24779_T10 (SEQ ID NO: 2161) | 1199 | 1287 |

This segment can be found in the following protein(s): Z24779_P4 and Z24779_P10.

Segment cluster Z24779_node__16 (SEQ ID NO:2192) according to the present invention is supported by 10 libraries. The number of libraries was determined as previously described. This segment can be found in the following transcript(s): Z24779_T3 (SEQ ID NO:2159) and Z24779_T10 (SEQ ID NO:2161). Table 2063 below describes the starting and ending position of this segment on each transcript.

TABLE 2063

Segment location on transcripts

| Transcript name | Segment starting position | Segment ending position |
|---|---|---|
| Z24779_T3 (SEQ ID NO: 2159) | 1288 | 1350 |
| Z24779_T10 (SEQ ID NO: 2161) | 1288 | 1350 |

This segment can be found in the following protein(s): Z24779_P4 and Z24779_P10.

Segment cluster Z24779_node__25 (SEQ ID NO:2193) according to the present invention is supported by 8 libraries. The number of libraries was determined as previously described. This segment can be found in the following transcript(s): Z24779_T3 (SEQ ID NO:2159) and Z24779_T10 (SEQ ID NO:2161). Table 2064 below describes the starting and ending position of this segment on each transcript.

TABLE 2064

Segment location on transcripts

| Transcript name | Segment starting position | Segment ending position |
|---|---|---|
| Z24779_T3 (SEQ ID NO: 2159) | 1820 | 1865 |
| Z24779_T10 (SEQ ID NO: 2161) | 1820 | 1865 |

This segment can be found in the following protein(s): Z24779_P4 and Z24779_P10.

Segment cluster Z24779_node__26 (SEQ ID NO:2194) according to the present invention can be found in the following transcript(s): Z24779_T3 (SEQ ID NO:2159) and Z24779_T10 (SEQ ID NO:2161). Table 2065 below describes the starting and ending position of this segment on each transcript.

TABLE 2065

Segment location on transcripts

| Transcript name | Segment starting position | Segment ending position |
|---|---|---|
| Z24779_T3 (SEQ ID NO: 2159) | 1866 | 1878 |
| Z24779_T10 (SEQ ID NO: 2161) | 1866 | 1878 |

This segment can be found in the following protein(s): Z24779_P4 and Z24779_P10.

Segment cluster Z24779_node__30 (SEQ ID NO:2195) according to the present invention is supported by 4 libraries. The number of libraries was determined as previously described. This segment can be found in the following transcript(s): Z24779_T3 (SEQ ID NO:2159) and Z24779_T10 (SEQ ID NO:2161). Table 2066 below describes the starting and ending position of this segment on each transcript.

TABLE 2066

Segment location on transcripts

| Transcript name | Segment starting position | Segment ending position |
|---|---|---|
| Z24779_T3 (SEQ ID NO: 2159) | 2020 | 2076 |
| Z24779_T10 (SEQ ID NO: 2161) | 2020 | 2076 |

This segment can be found in the following protein(s): Z24779_P4 and Z24779_P10.

Segment cluster Z24779_node_51 (SEQ ID NO:2196) according to the present invention is supported by 12 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2067 below describes the starting and ending position of this segment on each transcript.

TABLE 2067

Segment location on transcripts

| Transcript name | Segment starting position | Segment ending position |
|---|---|---|
| Z24779_T3 (SEQ ID NO: 2159) | 3192 | 3306 |
| Z24779_T9 (SEQ ID NO: 2160) | 612 | 726 |
| Z24779_T10 (SEQ ID NO: 2161) | 3192 | 3306 |

This segment can be found in the following protein(s): Z24779_P4, Z24779_P9 and Z24779_P10.

Segment cluster Z24779_node_55 (SEQ ID NO:2197) according to the present invention is supported by 22 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2068 below describes the starting and ending position of this segment on each transcript.

TABLE 2068

Segment location on transcripts

| Transcript name | Segment starting position | Segment ending position |
|---|---|---|
| Z24779_T3 (SEQ ID NO: 2159) | 3464 | 3570 |
| Z24779_T9 (SEQ ID NO: 2160) | 884 | 990 |
| Z24779_T10 (SEQ ID NO: 2161) | 3464 | 3570 |

This segment can be found in the following protein(s): Z24779_P4, Z24779_P9 and Z24779_P10.

Segment cluster Z24779_node_57 (SEQ ID NO:2198) according to the present invention is supported by 21 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2069 below describes the starting and ending position of this segment on each transcript.

TABLE 2069

Segment location on transcripts

| Transcript name | Segment starting position | Segment ending position |
|---|---|---|
| Z24779_T3 (SEQ ID NO: 2159) | 3571 | 3615 |
| Z24779_T9 (SEQ ID NO: 2160) | 991 | 1035 |
| Z24779_T10 (SEQ ID NO: 2161) | 3571 | 3615 |

This segment can be found in the following protein(s): Z24779_P4, Z24779_P9 and Z24779_P10.

Segment cluster Z24779_node_63 (SEQ ID NO:2199) according to the present invention is supported by 23 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2070 below describes the starting and ending position of this segment on each transcript.

TABLE 2070

Segment location on transcripts

| Transcript name | Segment starting position | Segment ending position |
|---|---|---|
| Z24779_T3 (SEQ ID NO: 2159) | 3898 | 3957 |
| Z24779_T9 (SEQ ID NO: 2160) | 1318 | 1377 |
| Z24779_T10 (SEQ ID NO: 2161) | 3898 | 3957 |

This segment can be found in the following protein(s): Z24779_P4, Z24779_P9 and Z24779_P10.

Segment cluster Z24779_node_65 (SEQ ID NO:2200) according to the present invention is supported by 21 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2071 below describes the starting and ending position of this segment on each transcript.

TABLE 2071

Segment location on transcripts

| Transcript name | Segment starting position | Segment ending position |
|---|---|---|
| Z24779_T3 (SEQ ID NO: 2159) | 3958 | 4025 |
| Z24779_T9 (SEQ ID NO: 2160) | 1378 | 1445 |
| Z24779_T10 (SEQ ID NO: 2161) | 3958 | 4025 |

This segment can be found in the following protein(s): Z24779_P4, Z24779_P9 and Z24779_P10.

Segment cluster Z24779_node_67 (SEQ ID NO:2201) according to the present invention is supported by 28 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2072 below describes the starting and ending position of this segment on each transcript.

TABLE 2072

Segment location on transcripts

| Transcript name | Segment starting position | Segment ending position |
|---|---|---|
| Z24779_T3 (SEQ ID NO: 2159) | 4026 | 4139 |
| Z24779_T9 (SEQ ID NO: 2160) | 1446 | 1559 |
| Z24779_T10 (SEQ ID NO: 2161) | 4026 | 4139 |

This segment can be found in the following protein(s): Z24779_P4, Z24779_P9 and Z24779_P10.

Segment cluster Z24779_node_69 (SEQ ID NO:2202) according to the present invention is supported by 29 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2073 below describes the starting and ending position of this segment on each transcript.

TABLE 2073

Segment location on transcripts

| Transcript name | Segment starting position | Segment ending position |
|---|---|---|
| Z24779_T3 (SEQ ID NO: 2159) | 4140 | 4227 |
| Z24779_T9 (SEQ ID NO: 2160) | 1560 | 1647 |
| Z24779_T10 (SEQ ID NO: 2161) | 4140 | 4227 |

This segment can be found in the following protein(s): Z24779_P4, Z24779_P9 and Z24779_P10.

Segment cluster Z24779_node_71 (SEQ ID NO:2203) according to the present invention is supported by 26 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2074 below describes the starting and ending position of this segment on each transcript.

TABLE 2074

Segment location on transcripts

| Transcript name | Segment starting position | Segment ending position |
|---|---|---|
| Z24779_T3 (SEQ ID NO: 2159) | 4228 | 4266 |
| Z24779_T9 (SEQ ID NO: 2160) | 1648 | 1686 |
| Z24779_T10 (SEQ ID NO: 2161) | 4228 | 4266 |

This segment can be found in the following protein(s): Z24779_P4, Z24779_P9 and Z24779_P10.

Segment cluster Z24779_node_73 (SEQ ID NO:2204) according to the present invention is supported by 29 libraries. The number of libraries was determined as previously described. This segment can be found in the following transcript(s): Z24779_T3 (SEQ ID NO:2159), Z24779_T9 (SEQ ID NO:2160) and Z24779_T10 (SEQ ID NO:2161). Table 2075 below describes the starting and ending position of this segment on each transcript.

TABLE 2075

Segment location on transcripts

| Transcript name | Segment starting position | Segment ending position |
|---|---|---|
| Z24779_T3 (SEQ ID NO: 2159) | 4267 | 4372 |
| Z24779_T9 (SEQ ID NO: 2160) | 1687 | 1792 |
| Z24779_T10 (SEQ ID NO: 2161) | 4267 | 4372 |

This segment can be found in the following protein(s): Z24779_P4, Z24779_P9 and Z24779_P10.

Segment cluster Z24779_node_79 (SEQ ID NO:2205) according to the present invention is supported by 28 libraries. The number of libraries was determined as previously described. This segment can be found in the following transcript(s): Z24779_T3 (SEQ ID NO:2159), Z24779_T9 (SEQ ID NO:2160) and Z24779_T13 (SEQ ID NO:2162). Table 2076 below describes the starting and ending position of this segment on each transcript.

TABLE 2076

Segment location on transcripts

| Transcript name | Segment starting position | Segment ending position |
|---|---|---|
| Z24779_T3 (SEQ ID NO: 2159) | 4537 | 4573 |
| Z24779_T9 (SEQ ID NO: 2160) | 1957 | 1993 |
| Z24779_T13 (SEQ ID NO: 2162) | 165 | 201 |

This segment can be found in the following protein(s): Z24779_P4 and Z24779_P9.

Segment cluster Z24779_node_81 (SEQ ID NO:2206) according to the present invention can be found in the following transcript(s): Z24779_T3 (SEQ ID NO:2159), Z24779_T9 (SEQ ID NO:2160) and Z24779_T13 (SEQ ID NO:2162). Table 2077 below describes the starting and ending position of this segment on each transcript.

TABLE 2077

Segment location on transcripts

| Transcript name | Segment starting position | Segment ending position |
|---|---|---|
| Z24779_T3 (SEQ ID NO: 2159) | 4825 | 4847 |
| Z24779_T9 (SEQ ID NO: 2160) | 1994 | 2016 |
| Z24779_T13 (SEQ ID NO: 2162) | 453 | 475 |

This segment can be found in both coding and non-coding regions of transcript(s) as follows. The segment can be found in a non-coding region of transcript(s) that are related to the following protein(s): Z24779_P4. This segment can also be found in the following protein(s): Z24779_P9, since it is in the coding region for the corresponding transcript.

Segment cluster Z24779_node_84 (SEQ ID NO:2207) according to the present invention is supported by 32 libraries. The number of libraries was determined as previously described. This segment can be found in the following transcript(s): Z24779_T3 (SEQ ID NO:2159), Z24779_T9 (SEQ ID NO:2160) and Z24779_T13 (SEQ ID NO:2162). Table 2078 below describes the starting and ending position of this segment on each transcript.

TABLE 2078

Segment location on transcripts

| Transcript name | Segment starting position | Segment ending position |
|---|---|---|
| Z24779_T3 (SEQ ID NO: 2159) | 4848 | 4903 |
| Z24779_T9 (SEQ ID NO: 2160) | 2017 | 2072 |
| Z24779_T13 (SEQ ID NO: 2162) | 476 | 531 |

This segment can be found in both coding and non-coding regions of transcript(s) as follows. The segment can be found in a non-coding region of transcript(s) that are related to the following protein(s): Z24779_P4. This segment can also be found in the following protein(s): Z24779_P9, since it is in the coding region for the corresponding transcript.

Description for Cluster Z38489

Cluster Z38489 features 7 transcript(s) and 35 segment(s) of interest, the names for which are given in Tables 2079 and 2080, respectively, the sequences themselves are given at the end of the application. The selected protein variants are given in Table 2081.

TABLE 2079

Transcripts of interest
Transcript Name

Z38489_T7 (SEQ ID NO: 2208)
Z38489_T9 (SEQ ID NO: 2209)
Z38489_T10 (SEQ ID NO: 2210)
Z38489_T11 (SEQ ID NO: 2211)
Z38489_T24 (SEQ ID NO: 2212)
Z38489_T30 (SEQ ID NO: 2213)
Z38489_T41 (SEQ ID NO: 2214)

TABLE 2080

Segments of interest
Segment Name

Z38489_node_5 (SEQ ID NO: 2215)
Z38489_node_7 (SEQ ID NO: 2216)
Z38489_node_11 (SEQ ID NO: 2217)
Z38489_node_26 (SEQ ID NO: 2218)
Z38489_node_27 (SEQ ID NO: 2219)
Z38489_node_54 (SEQ ID NO: 2220)
Z38489_node_57 (SEQ ID NO: 2221)
Z38489_node_60 (SEQ ID NO: 2222)
Z38489_node_71 (SEQ ID NO: 2223)
Z38489_node_74 (SEQ ID NO: 2224)
Z38489_node_0 (SEQ ID NO: 2225)
Z38489_node_1 (SEQ ID NO: 2226)
Z38489_node_2 (SEQ ID NO: 2227)
Z38489_node_3 (SEQ ID NO: 2228)
Z38489_node_9 (SEQ ID NO: 2229)
Z38489_node_16 (SEQ ID NO: 2230)
Z38489_node_17 (SEQ ID NO: 2231)
Z38489_node_18 (SEQ ID NO: 2232)
Z38489_node_23 (SEQ ID NO: 2233)
Z38489_node_28 (SEQ ID NO: 2234)
Z38489_node_29 (SEQ ID NO: 2235)
Z38489_node_37 (SEQ ID NO: 2236)
Z38489_node_41 (SEQ ID NO: 2237)
Z38489_node_44 (SEQ ID NO: 2238)
Z38489_node_46 (SEQ ID NO: 2239)
Z38489_node_49 (SEQ ID NO: 2240)
Z38489_node_50 (SEQ ID NO: 2241)
Z38489_node_59 (SEQ ID NO: 2242)
Z38489_node_62 (SEQ ID NO: 2243)
Z38489_node_63 (SEQ ID NO: 2244)
Z38489_node_66 (SEQ ID NO: 2245)

TABLE 2080-continued

Segments of interest
Segment Name

Z38489_node_69 (SEQ ID NO: 2246)
Z38489_node_70 (SEQ ID NO: 2247)
Z38489_node_72 (SEQ ID NO: 2248)
Z38489_node_73 (SEQ ID NO: 2249)

TABLE 2081

Proteins of interest

| Protein Name | Corresponding Transcript(s) |
|---|---|
| Z38489_P6 | Z38489_T7 (SEQ ID NO: 2208); Z38489_T9 (SEQ ID NO: 2209); Z38489_T11 (SEQ ID NO: 2211) |
| Z38489_P7 | Z38489_T10 (SEQ ID NO: 2210) |
| Z38489_P12 | Z38489_T24 (SEQ ID NO: 2212); Z38489_T30 (SEQ ID NO: 2213) |
| Z38489_P23 | Z38489_T41 (SEQ ID NO: 2214) |

These sequences are variants of the known protein Ubiquitin carboxyl-terminal hydrolase 10 (SwissProt accession identifier UB10_HUMAN; known also according to the synonyms EC 3.1.2.15; Ubiquitin thiolesterase 10; Ubiquitin-specific processing protease 10; Deubiquitinating enzyme 10), referred to herein as the previously known protein.

Protein Ubiquitin carboxyl-terminal hydrolase 10 is known or believed to have the following function(s): Ubiquitin specific protease are required to remove ubiquitin from specific proteins or peptides to which ubiquitin is attached. The sequence for protein Ubiquitin carboxyl-terminal hydrolase 10 is given at the end of the application, as "Ubiquitin carboxyl-terminal hydrolase 10 amino acid sequence". Known polymorphisms for this sequence are as shown in Table 2082.

TABLE 2082

Amino acid mutations for Known Protein

| SNP position(s) on amino acid sequence | Comment |
|---|---|
| 200 | M -> V (in dbSNP:1862792). /FTId = VAR_015859. |
| 203 | S -> P (in dbSNP:2326391). /FTId = VAR_015860. |
| 204 | V -> L (in dbSNP:1812061). /FTId = VAR_015861. |
| 424 | C -> A: ABOLISHES DE-UBIQUITINATING ACTIVITY. |
| 1 | M -> MCSKDTVLSVCALYWRKGIQSHTPLIGAWRRGKQRE QPEDRGVPMKRAA |

The following GO Annotation(s) apply to the previously known protein. The following annotation(s) were found: ubiquitin-dependent protein degradation, which are annotation(s) related to Biological Process; and cysteine-type endopeptidase; ubiquitin thiolesterase; hydrolase, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z38489 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 55 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 55 and Table 2083. This cluster is overexpressed (at least at a minimum level) in the following pathological conditions: colorectal cancer.

55

TABLE 2083

Normal tissue distribution

| Name of Tissue | Number |
|---|---|
| Bladder | 41 |
| Bone | 103 |
| Brain | 100 |
| Colon | 0 |
| Epithelial | 51 |
| General | 71 |
| head and neck | 0 |
| Kidney | 53 |
| Liver | 9 |
| Lung | 44 |
| lymph nodes | 54 |
| Breast | 17 |
| bone marrow | 376 |
| Ovary | 7 |
| Pancreas | 14 |
| Prostate | 110 |
| Skin | 104 |
| Stomach | 109 |
| Thyroid | 0 |
| Uterus | 36 |

TABLE 2084

P values and ratios for expression in cancerous tissue

| Name of Tissue | P1 | P2 | SP1 | R3 | SP2 | R4 |
|---|---|---|---|---|---|---|
| Bladder | 5.4e−01 | 6.3e−01 | 4.1e−01 | 1.7 | 6.2e−01 | 1.2 |
| Bone | 6.7e−01 | 8.5e−01 | 1 | 0.2 | 9.9e−01 | 0.4 |
| Brain | 7.8e−01 | 7.6e−01 | 9.7e−01 | 0.4 | 6.5e−01 | 0.6 |
| Colon | 1.1e−03 | 1.3e−03 | 1.9e−02 | 5.4 | 3.4e−02 | 4.6 |
| Epithelial | 2.7e−01 | 1.6e−01 | 4.6e−01 | 1.0 | 1.7e−01 | 1.2 |
| General | 7.5e−01 | 5.1e−01 | 9.9e−01 | 0.7 | 7.7e−01 | 0.9 |
| head and neck | 1.2e−01 | 2.1e−01 | 1 | 1.3 | 1 | 1.1 |
| Kidney | 5.5e−01 | 5.2e−01 | 5.1e−01 | 1.2 | 2.5e−01 | 1.3 |
| Liver | 3.3e−01 | 4.9e−01 | 1 | 2.2 | 4.8e−01 | 1.8 |
| Lung | 7.9e−01 | 8.9e−01 | 6.0e−01 | 1.0 | 9.2e−01 | 0.6 |
| lymph nodes | 6.9e−01 | 6.3e−01 | 6.3e−01 | 0.9 | 2.7e−01 | 1.0 |
| Breast | 6.2e−01 | 5.0e−01 | 3.3e−01 | 1.7 | 1.4e−01 | 1.7 |
| bone marrow | 6.4e−01 | 5.7e−01 | 1 | 0.2 | 9.9e−01 | 0.3 |
| Ovary | 5.3e−01 | 4.4e−01 | 4.7e−01 | 1.7 | 3.4e−01 | 1.9 |
| Pancreas | 3.8e−01 | 3.6e−01 | 3.9e−01 | 1.6 | 3.5e−01 | 1.5 |
| Prostate | 8.7e−01 | 9.0e−01 | 9.9e−01 | 0.3 | 9.7e−01 | 0.4 |
| Skin | 5.2e−01 | 6.7e−01 | 7.1e−01 | 0.8 | 7.7e−01 | 0.4 |
| Stomach | 9.0e−01 | 3.4e−01 | 1 | 0.2 | 7.9e−01 | 0.8 |
| Thyroid | 2.9e−01 | 2.9e−01 | 3.0e−01 | 2.1 | 3.0e−01 | 2.1 |
| Uterus | 6.3e−01 | 2.4e−01 | 7.4e−01 | 0.8 | 2.4e−01 | 1.3 |

As noted above, cluster Z38489 features 35 segment(s), which were listed in Table 2080 above and for which the sequence(s) are given at the end of the application. These segment(s) are portions of nucleic acid sequence(s) which are described herein separately because they are of particular interest. A description of each segment according to the present invention is now provided.

Segment cluster Z38489_node_5 (SEQ ID NO:2215) according to the present invention is supported by 1 libraries. The number of libraries was determined as previously described. This segment can be found in the following transcript(s): Z38489_T10 (SEQ ID NO:2210). Table 2085 below describes the starting and ending position of this segment on each transcript.

TABLE 2085

Segment location on transcripts

| Transcript name | Segment starting position | Segment ending position |
|---|---|---|
| Z38489_T10 (SEQ ID NO: 2210) | 139 | 259 |

This segment can be found in the following protein(s): Z38489_P7.

Segment cluster Z38489_node_7 (SEQ ID NO:2216) according to the present invention is supported by 2 libraries. The number of libraries was determined as previously described. This segment can be found in the following transcript(s): Z38489_T7 (SEQ ID NO:2208). Table 2086 below describes the starting and ending position of this segment on each transcript.

TABLE 2086

Segment location on transcripts

| Transcript name | Segment starting position | Segment ending position |
|---|---|---|
| Z38489_T7 (SEQ ID NO: 2208) | 139 | 268 |

This segment can be found in a non-coding region of transcript(s) that are related to the following protein(s): Z38489_P6.

Segment cluster Z38489_node_11 (SEQ ID NO:2217) according to the present invention is supported by 5 libraries. The number of libraries was determined as previously described. This segment can be found in the following transcript(s): Z38489_T9 (SEQ ID NO:2209), Z38489_T11 (SEQ ID NO:2211) and Z38489_T30 (SEQ ID NO:2213). Table 2087 below describes the starting and ending position of this segment on each transcript.

TABLE 2087

Segment location on transcripts

| Transcript name | Segment starting position | Segment ending position |
|---|---|---|
| Z38489_T9 (SEQ ID NO: 2209) | 139 | 330 |
| Z38489_T11 (SEQ ID NO: 2211) | 241 | 432 |
| Z38489_T30 (SEQ ID NO: 2213) | 139 | 330 |

This segment can be found in a non-coding region of transcript(s) that are related to the following protein(s): Z38489_P6 and Z38489_P12.

Segment cluster Z38489_node_26 (SEQ ID NO:2218) according to the present invention is supported by 146 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210) and Z38489_T11 (SEQ ID NO:2211). Table 2088 below describes the starting and ending position of this segment on each transcript.

TABLE 2088

Segment location on transcripts

| Transcript name | Segment starting position | Segment ending position |
|---|---|---|
| Z38489_T7 (SEQ ID NO: 2208) | 399 | 775 |
| Z38489_T9 (SEQ ID NO: 2209) | 461 | 837 |
| Z38489_T10 (SEQ ID NO: 2210) | 390 | 766 |
| Z38489_T11 (SEQ ID NO: 2211) | 563 | 939 |

This segment can be found in both coding and non-coding regions of transcript(s) as follows. The segment can be found in a non-coding region of transcript(s) that are related to the following protein(s): Z38489_P6. This segment can also be found in the following protein(s): Z38489_P7, since it is in the coding region for the corresponding transcript.

Segment cluster Z38489_node_27 (SEQ ID NO:2219) according to the present invention is supported by 123 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210) and Z38489_T11 (SEQ ID NO:2211). Table 2089 below describes the starting and ending position of this segment on each transcript.

TABLE 2089

Segment location on transcripts

| Transcript name | Segment starting position | Segment ending position |
|---|---|---|
| Z38489_T7 (SEQ ID NO: 2208) | 776 | 1278 |
| Z38489_T9 (SEQ ID NO: 2209) | 838 | 1340 |
| Z38489_T10 (SEQ ID NO: 2210) | 767 | 1269 |
| Z38489_T11 (SEQ ID NO: 2211) | 940 | 1442 |

This segment can be found in the following protein(s): Z38489_P6 and Z38489_P7.

Segment cluster Z38489_node_54 (SEQ ID NO:2220) according to the present invention is supported by 114 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2090 below describes the starting and ending position of this segment on each transcript.

TABLE 2090

Segment location on transcripts

| Transcript name | Segment starting position | Segment ending position |
|---|---|---|
| Z38489_T7 (SEQ ID NO: 2208) | 1902 | 2079 |
| Z38489_T9 (SEQ ID NO: 2209) | 1964 | 2141 |
| Z38489_T10 (SEQ ID NO: 2210) | 1893 | 2070 |
| Z38489_T11 (SEQ ID NO: 2211) | 2066 | 2243 |
| Z38489_T24 (SEQ ID NO: 2212) | 682 | 859 |
| Z38489_T30 (SEQ ID NO: 2213) | 862 | 1039 |

This segment can be found in the following protein(s): Z38489_P6, Z38489_P7 and Z38489_P12.

Segment cluster Z38489_node_57 (SEQ ID NO:2221) according to the present invention is supported by 3 libraries. The number of libraries was determined as previously described. This segment can be found in the following transcript(s): Z38489_T41 (SEQ ID NO:2214). Table 2091 below describes the starting and ending position of this segment on each transcript.

TABLE 2091

Segment location on transcripts

| Transcript name | Segment starting position | Segment ending position |
|---|---|---|
| Z38489_T41 (SEQ ID NO: 2214) | 1 | 239 |

This segment can be found in the following protein(s): Z38489_P23.

Segment cluster Z38489_node_60 (SEQ ID NO:2222) according to the present invention is supported by 112 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2092 below describes the starting and ending position of this segment on each transcript.

TABLE 2092

Segment location on transcripts

| Transcript name | Segment starting position | Segment ending position |
|---|---|---|
| Z38489_T7 (SEQ ID NO: 2208) | 2126 | 2245 |
| Z38489_T9 (SEQ ID NO: 2209) | 2188 | 2307 |
| Z38489_T10 (SEQ ID NO: 2210) | 2117 | 2236 |
| Z38489_T11 (SEQ ID NO: 2211) | 2290 | 2409 |
| Z38489_T24 (SEQ ID NO: 2212) | 906 | 1025 |
| Z38489_T30 (SEQ ID NO: 2213) | 1086 | 1205 |
| Z38489_T41 (SEQ ID NO: 2214) | 286 | 405 |

This segment can be found in the following protein(s): Z38489_P6, Z38489_P7, Z38489_P12 and Z38489_P23.

Segment cluster Z38489_node_71 (SEQ ID NO:2223) according to the present invention is supported by 220 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2093 below describes the starting and ending position of this segment on each transcript.

TABLE 2093

Segment location on transcripts

| Transcript name | Segment starting position | Segment ending position |
|---|---|---|
| Z38489_T7 (SEQ ID NO: 2208) | 2648 | 3242 |
| Z38489_T9 (SEQ ID NO: 2209) | 2710 | 3304 |

TABLE 2093-continued

Segment location on transcripts

| Transcript name | Segment starting position | Segment ending position |
|---|---|---|
| Z38489_T10 (SEQ ID NO: 2210) | 2639 | 3233 |
| Z38489_T11 (SEQ ID NO: 2211) | 2812 | 3406 |
| Z38489_T24 (SEQ ID NO: 2212) | 1428 | 2022 |
| Z38489_T30 (SEQ ID NO: 2213) | 1608 | 2202 |
| Z38489_T41 (SEQ ID NO: 2214) | 808 | 1402 |

This segment can be found in a non-coding region of transcript(s) that are related to the following protein(s): Z38489_P6, Z38489_P7, Z38489_P12 and Z38489_P23.

Segment cluster Z38489_node_74 (SEQ ID NO:2224) according to the present invention is supported by 116 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2094 below describes the starting and ending position of this segment on each transcript.

TABLE 2094

Segment location on transcripts

| Transcript name | Segment starting position | Segment ending position |
|---|---|---|
| Z38489_T7 (SEQ ID NO: 2208) | 3289 | 3484 |
| Z38489_T9 (SEQ ID NO: 2209) | 3351 | 3546 |
| Z38489_T10 (SEQ ID NO: 2210) | 3280 | 3475 |
| Z38489_T11 (SEQ ID NO: 2211) | 3453 | 3648 |
| Z38489_T24 (SEQ ID NO: 2212) | 2069 | 2264 |
| Z38489_T30 (SEQ ID NO: 2213) | 2249 | 2444 |
| Z38489_T41 (SEQ ID NO: 2214) | 1449 | 1644 |

This segment can be found in a non-coding region of transcript(s) that are related to the following protein(s): Z38489_P6, Z38489_P7, Z38489_P12 and Z38489_P23.

According to an optional embodiment of the present invention, short segments related to the above cluster are also provided. These segments are up to about 120 bp in length, and so are included in a separate description.

Segment cluster Z38489_node_0 (SEQ ID NO:2225) according to the present invention is supported by 101 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2095 below describes the starting and ending position of this segment on each transcript.

TABLE 2095

Segment location on transcripts

| Transcript name | Segment starting position | Segment ending position |
|---|---|---|
| Z38489_T7 (SEQ ID NO: 2208) | 1 | 81 |
| Z38489_T9 (SEQ ID NO: 2209) | 1 | 81 |

TABLE 2095-continued

Segment location on transcripts

| Transcript name | Segment starting position | Segment ending position |
|---|---|---|
| Z38489_T10 (SEQ ID NO: 2210) | 1 | 81 |
| Z38489_T11 (SEQ ID NO: 2211) | 1 | 81 |
| Z38489_T24 (SEQ ID NO: 2212) | 1 | 81 |
| Z38489_T30 (SEQ ID NO: 2213) | 1 | 81 |

This segment can be found in a non-coding region of transcript(s) that are related to the following protein(s): Z38489_P6, Z38489_P7 and Z38489_P12.

Segment cluster Z38489_node_1 (SEQ ID NO:2226) according to the present invention is supported by 114 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2096 below describes the starting and ending position of this segment on each transcript.

TABLE 2096

Segment location on transcripts

| Transcript name | Segment starting position | Segment ending position |
|---|---|---|
| Z38489_T7 (SEQ ID NO: 2208) | 82 | 115 |
| Z38489_T9 (SEQ ID NO: 2209) | 82 | 115 |
| Z38489_T10 (SEQ ID NO: 2210) | 82 | 115 |
| Z38489_T11 (SEQ ID NO: 2211) | 82 | 115 |
| Z38489_T24 (SEQ ID NO: 2212) | 82 | 115 |
| Z38489_T30 (SEQ ID NO: 2213) | 82 | 115 |

This segment can be found in a non-coding region of transcript(s) that are related to the following protein(s): Z38489_P6, Z38489_P7 and Z38489_P12.

Segment cluster Z38489_node_2 (SEQ ID NO:2227) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2097 below describes the starting and ending position of this segment on each transcript.

TABLE 2097

Segment location on transcripts

| Transcript name | Segment starting position | Segment ending position |
|---|---|---|
| Z38489_T7 (SEQ ID NO: 2208) | 116 | 123 |
| Z38489_T9 (SEQ ID NO: 2209) | 116 | 123 |
| Z38489_T10 (SEQ ID NO: 2210) | 116 | 123 |
| Z38489_T11 (SEQ ID NO: 2211) | 116 | 123 |
| Z38489_T24 (SEQ ID NO: 2212) | 116 | 123 |
| Z38489_T30 (SEQ ID NO: 2213) | 116 | 123 |

This segment can be found in a non-coding region of transcript(s) that are related to the following protein(s): Z38489_P6, Z38489_P7 and Z38489_P12.

Segment cluster Z38489_node_3 (SEQ ID NO:2228) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211) and Z38489_T30 (SEQ ID NO:2213). Table 2098 below describes the starting and ending position of this segment on each transcript.

TABLE 2098

Segment location on transcripts

| Transcript name | Segment starting position | Segment ending position |
|---|---|---|
| Z38489_T7 (SEQ ID NO: 2208) | 124 | 138 |
| Z38489_T9 (SEQ ID NO: 2209) | 124 | 138 |
| Z38489_T10 (SEQ ID NO: 2210) | 124 | 138 |
| Z38489_T11 (SEQ ID NO: 2211) | 124 | 138 |
| Z38489_T30 (SEQ ID NO: 2213) | 124 | 138 |

This segment can be found in a non-coding region of transcript(s) that are related to the following protein(s): Z38489_P6, Z38489_P7 and Z38489_P12.

Segment cluster Z38489_node_9 (SEQ ID NO:2229) according to the present invention is supported by 1 libraries. The number of libraries was determined as previously described. This segment can be found in the following transcript(s): Z38489_T11 (SEQ ID NO:2211). Table 2099 below describes the starting and ending position of this segment on each transcript.

TABLE 2099

Segment location on transcripts

| Transcript name | Segment starting position | Segment ending position |
|---|---|---|
| Z38489_T11 (SEQ ID NO: 2211) | 139 | 240 |

This segment can be found in a non-coding region of transcript(s) that are related to the following protein(s): Z38489_P6.

Segment cluster Z38489_node_16 (SEQ ID NO:2230) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211) and Z38489_T30 (SEQ ID NO:2213). Table 2100 below describes the starting and ending position of this segment on each transcript.

TABLE 2100

Segment location on transcripts

| Transcript name | Segment starting position | Segment ending position |
|---|---|---|
| Z38489_T7 (SEQ ID NO: 2208) | 269 | 290 |
| Z38489_T9 (SEQ ID NO: 2209) | 331 | 352 |
| Z38489_T10 (SEQ ID NO: 2210) | 260 | 281 |
| Z38489_T11 (SEQ ID NO: 2211) | 433 | 454 |
| Z38489_T30 (SEQ ID NO: 2213) | 331 | 352 |

This segment can be found in both coding and non-coding regions of transcript(s) as follows. The segment can be found in a non-coding region of transcript(s) that are related to the following protein(s): Z38489_P6 and Z38489_P12. This segment can also be found in the following protein(s): Z38489_P7, since it is in the coding region for the corresponding transcript.

Segment cluster Z38489_node_17 (SEQ ID NO:2231) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211) and Z38489_T30 (SEQ ID NO:2213). Table 2101 below describes the starting and ending position of this segment on each transcript.

TABLE 2101

Segment location on transcripts

| Transcript name | Segment starting position | Segment ending position |
|---|---|---|
| Z38489_T7 (SEQ ID NO: 2208) | 291 | 302 |
| Z38489_T9 (SEQ ID NO: 2209) | 353 | 364 |
| Z38489_T10 (SEQ ID NO: 2210) | 282 | 293 |
| Z38489_T11 (SEQ ID NO: 2211) | 455 | 466 |
| Z38489_T30 (SEQ ID NO: 2213) | 353 | 364 |

This segment can be found in both coding and non-coding regions of transcript(s) as follows. The segment can be found in a non-coding region of transcript(s) that are related to the following protein(s): Z38489_P6 and Z38489_P12. This segment can also be found in the following protein(s): Z38489_P7, since it is in the coding region for the corresponding transcript.

Segment cluster Z38489_node_18 (SEQ ID NO:2232) according to the present invention is supported by 121 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211) and Z38489_T30 (SEQ ID NO:2213). Table 2102 below describes the starting and ending position of this segment on each transcript.

TABLE 2102

Segment location on transcripts

| Transcript name | Segment starting position | Segment ending position |
|---|---|---|
| Z38489_T7 (SEQ ID NO: 2208) | 303 | 337 |
| Z38489_T9 (SEQ ID NO: 2209) | 365 | 399 |
| Z38489_T10 (SEQ ID NO: 2210) | 294 | 328 |
| Z38489_T11 (SEQ ID NO: 2211) | 467 | 501 |
| Z38489_T30 (SEQ ID NO: 2213) | 365 | 399 |

This segment can be found in both coding and non-coding regions of transcript(s) as follows. The segment can be found in a non-coding region of transcript(s) that are related to the following protein(s): Z38489_P6 and Z38489_P12. This segment can also be found in the following protein(s): Z38489_P7, since it is in the coding region for the corresponding transcript.

Segment cluster Z38489_node_23 (SEQ ID NO:2233) according to the present invention is supported by 123 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210) and Z38489_T11 (SEQ ID NO:2211). Table 2103 below describes the starting and ending position of this segment on each transcript.

TABLE 2103

Segment location on transcripts

| Transcript name | Segment starting position | Segment ending position |
|---|---|---|
| Z38489_T7 (SEQ ID NO: 2208) | 338 | 398 |
| Z38489_T9 (SEQ ID NO: 2209) | 400 | 460 |
| Z38489_T10 (SEQ ID NO: 2210) | 329 | 389 |
| Z38489_T11 (SEQ ID NO: 2211) | 502 | 562 |

This segment can be found in both coding and non-coding regions of transcript(s) as follows. The segment can be found in a non-coding region of transcript(s) that are related to the following protein(s): Z38489_P6. This segment can also be found in the following protein(s): Z38489_P7, since it is in the coding region for the corresponding transcript.

Segment cluster Z38489_node_28 (SEQ ID NO:2234) according to the present invention is supported by 69 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210) and Z38489_T11 (SEQ ID NO:2211). Table 2104 below describes the starting and ending position of this segment on each transcript.

TABLE 2104

Segment location on transcripts

| Transcript name | Segment starting position | Segment ending position |
|---|---|---|
| Z38489_T7 (SEQ ID NO: 2208) | 1279 | 1343 |
| Z38489_T9 (SEQ ID NO: 2209) | 1341 | 1405 |
| Z38489_T10 (SEQ ID NO: 2210) | 1270 | 1334 |
| Z38489_T11 (SEQ ID NO: 2211) | 1443 | 1507 |

This segment can be found in the following protein(s): Z38489_P6 and Z38489_P7.

Segment cluster Z38489_node_29 (SEQ ID NO:2235) according to the present invention is supported by 72 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211) and Z38489_T24 (SEQ ID NO:2212). Table 2105 below describes the starting and ending position of this segment on each transcript.

TABLE 2105

Segment location on transcripts

| Transcript name | Segment starting position | Segment ending position |
|---|---|---|
| Z38489_T7 (SEQ ID NO: 2208) | 1344 | 1439 |
| Z38489_T9 (SEQ ID NO: 2209) | 1406 | 1501 |
| Z38489_T10 (SEQ ID NO: 2210) | 1335 | 1430 |
| Z38489_T11 (SEQ ID NO: 2211) | 1508 | 1603 |
| Z38489_T24 (SEQ ID NO: 2212) | 124 | 219 |

This segment can be found in both coding and non-coding regions of transcript(s) as follows. The segment can be found in a non-coding region of transcript(s) that are related to the following protein(s): Z38489_P12. This segment can also be found in the following protein(s): Z38489_P6 and Z38489_P7, since it is in the coding region for the corresponding transcript.

Segment cluster Z38489_node_37 (SEQ ID NO:2236) according to the present invention is supported by 69 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2106 below describes the starting and ending position of this segment on each transcript.

TABLE 2106

Segment location on transcripts

| Transcript name | Segment starting position | Segment ending position |
|---|---|---|
| Z38489_T7 (SEQ ID NO: 2208) | 1440 | 1531 |
| Z38489_T9 (SEQ ID NO: 2209) | 1502 | 1593 |
| Z38489_T10 (SEQ ID NO: 2210) | 1431 | 1522 |
| Z38489_T11 (SEQ ID NO: 2211) | 1604 | 1695 |
| Z38489_T24 (SEQ ID NO: 2212) | 220 | 311 |
| Z38489_T30 (SEQ ID NO: 2213) | 400 | 491 |

This segment can be found in both coding and non-coding regions of transcript(s) as follows. The segment can be found in a non-coding region of transcript(s) that are related to the following protein(s): Z38489_P12. This segment can also be found in the following protein(s): Z38489_P6 and Z38489_P7, since it is in the coding region for the corresponding transcript.

Segment cluster Z38489_node_41 (SEQ ID NO:2237) according to the present invention is supported by 65 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2107 below describes the starting and ending position of this segment on each transcript.

TABLE 2107

Segment location on transcripts

| Transcript name | Segment starting position | Segment ending position |
|---|---|---|
| Z38489_T7 (SEQ ID NO: 2208) | 1532 | 1641 |
| Z38489_T9 (SEQ ID NO: 2209) | 1594 | 1703 |
| Z38489_T10 (SEQ ID NO: 2210) | 1523 | 1632 |
| Z38489_T11 (SEQ ID NO: 2211) | 1696 | 1805 |
| Z38489_T24 (SEQ ID NO: 2212) | 312 | 421 |
| Z38489_T30 (SEQ ID NO: 2213) | 492 | 601 |

This segment can be found in the following protein(s): Z38489_P6, Z38489_P7 and Z38489_P12.

Segment cluster Z38489_node_44 (SEQ ID NO:2238) according to the present invention is supported by 67 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2108 below describes the starting and ending position of this segment on each transcript.

TABLE 2108

Segment location on transcripts

| Transcript name | Segment starting position | Segment ending position |
| --- | --- | --- |
| Z38489_T7 (SEQ ID NO: 2208) | 1642 | 1697 |
| Z38489_T9 (SEQ ID NO: 2209) | 1704 | 1759 |
| Z38489_T10 (SEQ ID NO: 2210) | 1633 | 1688 |
| Z38489_T11 (SEQ ID NO: 2211) | 1806 | 1861 |
| Z38489_T24 (SEQ ID NO: 2212) | 422 | 477 |
| Z38489_T30 (SEQ ID NO: 2213) | 602 | 657 |

This segment can be found in the following protein(s): Z38489_P6, Z38489_P7 and Z38489_P12.

Segment cluster Z38489_node_46 (SEQ ID NO:2239) according to the present invention is supported by 86 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2109 below describes the starting and ending position of this segment on each transcript.

TABLE 2109

Segment location on transcripts

| Transcript name | Segment starting position | Segment ending position |
| --- | --- | --- |
| Z38489_T7 (SEQ ID NO: 2208) | 1698 | 1801 |
| Z38489_T9 (SEQ ID NO: 2209) | 1760 | 1863 |
| Z38489_T10 (SEQ ID NO: 2210) | 1689 | 1792 |
| Z38489_T11 (SEQ ID NO: 2211) | 1862 | 1965 |
| Z38489_T24 (SEQ ID NO: 2212) | 478 | 581 |
| Z38489_T30 (SEQ ID NO: 2213) | 658 | 761 |

This segment can be found in the following protein(s): Z38489_P6, Z38489_P7 and Z38489_P12.

Segment cluster Z38489_node_49 (SEQ ID NO:2240) according to the present invention is supported by 111 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2110 below describes the starting and ending position of this segment on each transcript.

TABLE 2110

Segment location on transcripts

| Transcript name | Segment starting position | Segment ending position |
| --- | --- | --- |
| Z38489_T7 (SEQ ID NO: 2208) | 1802 | 1892 |
| Z38489_T9 (SEQ ID NO: 2209) | 1864 | 1954 |
| Z38489_T10 (SEQ ID NO: 2210) | 1793 | 1883 |
| Z38489_T11 (SEQ ID NO: 2211) | 1966 | 2056 |
| Z38489_T24 (SEQ ID NO: 2212) | 582 | 672 |
| Z38489_T30 (SEQ ID NO: 2213) | 762 | 852 |

This segment can be found in the following protein(s): Z38489_P6, Z38489_P7 and Z38489_P12.

Segment cluster Z38489_node_50 (SEQ ID NO:2241) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212) and Z38489_T30 (SEQ ID NO:2213). Table 2111 below describes the starting and ending position of this segment on each transcript.

TABLE 2111

Segment location on transcripts

| Transcript name | Segment starting position | Segment ending position |
| --- | --- | --- |
| Z38489_T7 (SEQ ID NO: 2208) | 1893 | 1901 |
| Z38489_T9 (SEQ ID NO: 2209) | 1955 | 1963 |
| Z38489_T10 (SEQ ID NO: 2210) | 1884 | 1892 |
| Z38489_T11 (SEQ ID NO: 2211) | 2057 | 2065 |
| Z38489_T24 (SEQ ID NO: 2212) | 673 | 681 |
| Z38489_T30 (SEQ ID NO: 2213) | 853 | 861 |

This segment can be found in the following protein(s): Z38489_P6, Z38489_P7 and Z38489_P12.

Segment cluster Z38489_node_59 (SEQ ID NO:2242) according to the present invention is supported by 93 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2112 below describes the starting and ending position of this segment on each transcript.

TABLE 2112

Segment location on transcripts

| Transcript name | Segment starting position | Segment ending position |
| --- | --- | --- |
| Z38489_T7 (SEQ ID NO: 2208) | 2080 | 2125 |
| Z38489_T9 (SEQ ID NO: 2209) | 2142 | 2187 |
| Z38489_T10 (SEQ ID NO: 2210) | 2071 | 2116 |
| Z38489_T11 (SEQ ID NO: 2211) | 2244 | 2289 |
| Z38489_T24 (SEQ ID NO: 2212) | 860 | 905 |
| Z38489_T30 (SEQ ID NO: 2213) | 1040 | 1085 |
| Z38489_T41 (SEQ ID NO: 2214) | 240 | 285 |

This segment can be found in the following protein(s): Z38489_P6, Z38489_P7, Z38489_P12 and Z38489_P23.

Segment cluster Z38489_node_62 (SEQ ID NO:2243) according to the present invention is supported by 104 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2113 below describes the starting and ending position of this segment on each transcript.

TABLE 2113

| Segment location on transcripts | | |
|---|---|---|
| Transcript name | Segment starting position | Segment ending position |
| Z38489_T7 (SEQ ID NO: 2208) | 2246 | 2307 |
| Z38489_T9 (SEQ ID NO: 2209) | 2308 | 2369 |
| Z38489_T10 (SEQ ID NO: 2210) | 2237 | 2298 |
| Z38489_T11 (SEQ ID NO: 2211) | 2410 | 2471 |
| Z38489_T24 (SEQ ID NO: 2212) | 1026 | 1087 |
| Z38489_T30 (SEQ ID NO: 2213) | 1206 | 1267 |
| Z38489_T41 (SEQ ID NO: 2214) | 406 | 467 |

This segment can be found in the following protein(s): Z38489_P6, Z38489_P7, Z38489_P12 and Z38489_P23.

Segment cluster Z38489_node_63 (SEQ ID NO:2244) according to the present invention is supported by 107 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2114 below describes the starting and ending position of this segment on each transcript.

TABLE 2114

| Segment location on transcripts | | |
|---|---|---|
| Transcript name | Segment starting position | Segment ending position |
| Z38489_T7 (SEQ ID NO: 2208) | 2308 | 2390 |
| Z38489_T9 (SEQ ID NO: 2209) | 2370 | 2452 |
| Z38489_T10 (SEQ ID NO: 2210) | 2299 | 2381 |
| Z38489_T11 (SEQ ID NO: 2211) | 2472 | 2554 |
| Z38489_T24 (SEQ ID NO: 2212) | 1088 | 1170 |
| Z38489_T30 (SEQ ID NO: 2213) | 1268 | 1350 |
| Z38489_T41 (SEQ ID NO: 2214) | 468 | 550 |

This segment can be found in the following protein(s): Z38489_P6, Z38489_P7, Z38489_P12 and Z38489_P23.

Segment cluster Z38489_node_66 (SEQ ID NO:2245) according to the present invention is supported by 108 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2115 below describes the starting and ending position of this segment on each transcript.

TABLE 2115

| Segment location on transcripts | | |
|---|---|---|
| Transcript name | Segment starting position | Segment ending position |
| Z38489_T7 (SEQ ID NO: 2208) | 2391 | 2456 |
| Z38489_T9 (SEQ ID NO: 2209) | 2453 | 2518 |
| Z38489_T10 (SEQ ID NO: 2210) | 2382 | 2447 |
| Z38489_T11 (SEQ ID NO: 2211) | 2555 | 2620 |
| Z38489_T24 (SEQ ID NO: 2212) | 1171 | 1236 |
| Z38489_T30 (SEQ ID NO: 2213) | 1351 | 1416 |
| Z38489_T41 (SEQ ID NO: 2214) | 551 | 616 |

This segment can be found in the following protein(s): Z38489_P6, Z38489_P7, Z38489_P12 and Z38489_P23.

Segment cluster Z38489_node_69 (SEQ ID NO:2246) according to the present invention is supported by 124 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2116 below describes the starting and ending position of this segment on each transcript.

TABLE 2116

| Segment location on transcripts | | |
|---|---|---|
| Transcript name | Segment starting position | Segment ending position |
| Z38489_T7 (SEQ ID NO: 2208) | 2457 | 2532 |
| Z38489_T9 (SEQ ID NO: 2209) | 2519 | 2594 |
| Z38489_T10 (SEQ ID NO: 2210) | 2448 | 2523 |
| Z38489_T11 (SEQ ID NO: 2211) | 2621 | 2696 |
| Z38489_T24 (SEQ ID NO: 2212) | 1237 | 1312 |
| Z38489_T30 (SEQ ID NO: 2213) | 1417 | 1492 |
| Z38489_T41 (SEQ ID NO: 2214) | 617 | 692 |

This segment can be found in the following protein(s): Z38489_P6, Z38489_P7, Z38489_P12 and Z38489_P23.

Segment cluster Z38489_node_70 (SEQ ID NO:2247) according to the present invention is supported by 126 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2117 below describes the starting and ending position of this segment on each transcript.

TABLE 2117

| Segment location on transcripts | | |
|---|---|---|
| Transcript name | Segment starting position | Segment ending position |
| Z38489_T7 (SEQ ID NO: 2208) | 2533 | 2647 |
| Z38489_T9 (SEQ ID NO: 2209) | 2595 | 2709 |
| Z38489_T10 (SEQ ID NO: 2210) | 2524 | 2638 |
| Z38489_T11 (SEQ ID NO: 2211) | 2697 | 2811 |
| Z38489_T24 (SEQ ID NO: 2212) | 1313 | 1427 |
| Z38489_T30 (SEQ ID NO: 2213) | 1493 | 1607 |
| Z38489_T41 (SEQ ID NO: 2214) | 693 | 807 |

This segment can be found in the following protein(s): Z38489_P6, Z38489_P7, Z38489_P12 and Z38489_P23.

Segment cluster Z38489_node_72 (SEQ ID NO:2248) according to the present invention is supported by 114 libraries. The number of libraries was determined as previously described. This segment can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2118 below describes the starting and ending position of this segment on each transcript.

TABLE 2118

Segment location on transcripts

| Transcript name | Segment starting position | Segment ending position |
|---|---|---|
| Z38489_T7 (SEQ ID NO: 2208) | 3243 | 3271 |
| Z38489_T9 (SEQ ID NO: 2209) | 3305 | 3333 |
| Z38489_T10 (SEQ ID NO: 2210) | 3234 | 3262 |
| Z38489_T11 (SEQ ID NO: 2211) | 3407 | 3435 |
| Z38489_T24 (SEQ ID NO: 2212) | 2023 | 2051 |
| Z38489_T30 (SEQ ID NO: 2213) | 2203 | 2231 |
| Z38489_T41 (SEQ ID NO: 2214) | 1403 | 1431 |

This segment can be found in a non-coding region of transcript(s) that are related to the following protein(s): Z38489_P6, Z38489_P7, Z38489_P12 and Z38489_P23.

Segment cluster Z38489_node_73 (SEQ ID NO:2249) according to the present invention can be found in the following transcript(s): Z38489_T7 (SEQ ID NO:2208), Z38489_T9 (SEQ ID NO:2209), Z38489_T10 (SEQ ID NO:2210), Z38489_T11 (SEQ ID NO:2211), Z38489_T24 (SEQ ID NO:2212), Z38489_T30 (SEQ ID NO:2213) and Z38489_T41 (SEQ ID NO:2214). Table 2119 below describes the starting and ending position of this segment on each transcript.

TABLE 2119

Segment location on transcripts

| Transcript name | Segment starting position | Segment ending position |
|---|---|---|
| Z38489_T7 (SEQ ID NO: 2208) | 3272 | 3288 |
| Z38489_T9 (SEQ ID NO: 2209) | 3334 | 3350 |
| Z38489_T10 (SEQ ID NO: 2210) | 3263 | 3279 |
| Z38489_T11 (SEQ ID NO: 2211) | 3436 | 3452 |
| Z38489_T24 (SEQ ID NO: 2212) | 2052 | 2068 |
| Z38489_T30 (SEQ ID NO: 2213) | 2232 | 2248 |
| Z38489_T41 (SEQ ID NO: 2214) | 1432 | 1448 |

This segment can be found in a non-coding region of transcript(s) that are related to the following protein(s): Z38489_P6, Z38489_P7, Z38489_P12 and Z38489_P23.

Description for Cluster Z39788

Cluster Z39788 features 17 transcript(s) and 32 segment(s) of interest, the names for which are given in Tables 2120 and 2121, respectively, the sequences themselves are given at the end of the application. The selected protein variants are given in Table 2122.

TABLE 2120

Transcripts of interest
Transcript Name

Z39788_T0 (SEQ ID NO: 2250)
Z39788_T2 (SEQ ID NO: 2251)
Z39788_T3 (SEQ ID NO: 2252)
Z39788_T4 (SEQ ID NO: 2253)

TABLE 2120-continued

Transcripts of interest
Transcript Name

Z39788_T6 (SEQ ID NO: 2254)
Z39788_T7 (SEQ ID NO: 2255)
Z39788_T8 (SEQ ID NO: 2256)
Z39788_T9 (SEQ ID NO: 2257)
Z39788_T11 (SEQ ID NO: 2258)
Z39788_T13 (SEQ ID NO: 2259)
Z39788_T14 (SEQ ID NO: 2260)
Z39788_T17 (SEQ ID NO: 2261)
Z39788_T18 (SEQ ID NO: 2262)
Z39788_T19 (SEQ ID NO: 2263)
Z39788_T27 (SEQ ID NO: 2264)
Z39788_T29 (SEQ ID NO: 2265)
Z39788_T31 (SEQ ID NO: 2266)

TABLE 2121

Segments of interest
Segment Name

Z39788_node_0 (SEQ ID NO: 2267)
Z39788_node_2 (SEQ ID NO: 2268)
Z39788_node_4 (SEQ ID NO: 2269)
Z39788_node_9 (SEQ ID NO: 2270)
Z39788_node_11 (SEQ ID NO: 2271)
Z39788_node_13 (SEQ ID NO: 2272)
Z39788_node_25 (SEQ ID NO: 2273)
Z39788_node_27 (SEQ ID NO: 2274)
Z39788_node_28 (SEQ ID NO: 2275)
Z39788_node_42 (SEQ ID NO: 2276)
Z39788_node_43 (SEQ ID NO: 2277)
Z39788_node_46 (SEQ ID NO: 2278)
Z39788_node_48 (SEQ ID NO: 2279)
Z39788_node_49 (SEQ ID NO: 2280)
Z39788_node_54 (SEQ ID NO: 2281)
Z39788_node_56 (SEQ ID NO: 2282)
Z39788_node_1 (SEQ ID NO: 2283)
Z39788_node_7 (SEQ ID NO: 2284)
Z39788_node_8 (SEQ ID NO: 2285)
Z39788_node_22 (SEQ ID NO: 2286)
Z39788_node_30 (SEQ ID NO: 2287)
Z39788_node_31 (SEQ ID NO: 2288)
Z39788_node_32 (SEQ ID NO: 2289)
Z39788_node_34 (SEQ ID NO: 2290)
Z39788_node_35 (SEQ ID NO: 2291)
Z39788_node_38 (SEQ ID NO: 2292)
Z39788_node_39 (SEQ ID NO: 2293)
Z39788_node_44 (SEQ ID NO: 2294)
Z39788_node_50 (SEQ ID NO: 2295)
Z39788_node_51 (SEQ ID NO: 2296)
Z39788_node_52 (SEQ ID NO: 2297)
Z39788_node_53 (SEQ ID NO: 2298)

TABLE 2122

Proteins of interest

| Protein Name | Corresponding Transcript(s) |
|---|---|
| Z39788_P1 | Z39788_T0 (SEQ ID NO: 2250); Z39788_T4 (SEQ ID NO: 2253) |
| Z39788_P3 | Z39788_T2 (SEQ ID NO: 2251) |
| Z39788_P4 | Z39788_T3 (SEQ ID NO: 2252) |
| Z39788_P6 | Z39788_T6 (SEQ ID NO: 2254) |
| Z39788_P7 | Z39788_T7 (SEQ ID NO: 2255) |
| Z39788_P8 | Z39788_T8 (SEQ ID NO: 2256) |
| Z39788_P9 | Z39788_T9 (SEQ ID NO: 2257); Z39788_T11 (SEQ ID NO: 2258) |
| Z39788_P12 | Z39788_T13 (SEQ ID NO: 2259) |
| Z39788_P13 | Z39788_T14 (SEQ ID NO: 2260) |
| Z39788_P16 | Z39788_T17 (SEQ ID NO: 2261) |
| Z39788_P17 | Z39788_T18 (SEQ ID NO: 2262) |

TABLE 2122-continued

| Proteins of interest | |
|---|---|
| Protein Name | Corresponding Transcript(s) |
| Z39788_P18 | Z39788_T19 (SEQ ID NO: 2263) |
| Z39788_P24 | Z39788_T27 (SEQ ID NO: 2264) |
| Z39788_P26 | Z39788_T29 (SEQ ID NO: 2265) |
| Z39788_P27 | Z39788_T31 (SEQ ID NO: 2266) |

As noted above, cluster Z39788 features 32 segment(s), which were listed in Table 2121 above and for which the sequence(s) are given at the end of the application. These segment(s) are portions of nucleic acid sequence(s) which are described herein separately because they are of particular interest. A description of each segment according to the present invention is now provided.

Segment cluster Z39788_node_0 (SEQ ID NO:2267) according to the present invention is supported by 4 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T27 (SEQ ID NO:2264), Z39788_T29 (SEQ ID NO:2265) and Z39788_T31 (SEQ ID NO:2266). Table 2123 below describes the starting and ending position of this segment on each transcript.

TABLE 2123

| Segment location on transcripts | | |
|---|---|---|
| Transcript name | Segment starting position | Segment ending position |
| Z39788_T0 (SEQ ID NO: 2250) | 1 | 263 |
| Z39788_T2 (SEQ ID NO: 2251) | 1 | 263 |
| Z39788_T4 (SEQ ID NO: 2253) | 1 | 263 |
| Z39788_T6 (SEQ ID NO: 2254) | 1 | 263 |
| Z39788_T8 (SEQ ID NO: 2256) | 1 | 263 |
| Z39788_T9 (SEQ ID NO: 2257) | 1 | 263 |
| Z39788_T11 (SEQ ID NO: 2258) | 1 | 263 |
| Z39788_T13 (SEQ ID NO: 2259) | 1 | 263 |
| Z39788_T14 (SEQ ID NO: 2260) | 1 | 263 |
| Z39788_T17 (SEQ ID NO: 2261) | 1 | 263 |
| Z39788_T27 (SEQ ID NO: 2264) | 1 | 263 |
| Z39788_T29 (SEQ ID NO: 2265) | 1 | 263 |
| Z39788_T31 (SEQ ID NO: 2266) | 1 | 263 |

This segment can be found in both coding and non-coding regions of transcript(s) as follows. The segment can be found in a non-coding region of transcript(s) that are related to the following protein(s): Z39788_P3. This segment can also be found in the following protein(s): Z39788_P1, Z39788_P6, Z39788_P8, Z39788_P9, Z39788_P12, Z39788_P13, Z39788_P16, Z39788_P24, Z39788_P26 and Z39788_P27, since it is in the coding region for the corresponding transcript.

Segment cluster Z39788_node_2 (SEQ ID NO:2268) according to the present invention is supported by 11 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T27 (SEQ ID NO:2264), Z39788_T29 (SEQ ID NO:2265) and Z39788_T31 (SEQ ID NO:2266). Table 2124 below describes the starting and ending position of this segment on each transcript.

TABLE 2124

| Segment location on transcripts | | |
|---|---|---|
| Transcript name | Segment starting position | Segment ending position |
| Z39788_T0 (SEQ ID NO: 2250) | 320 | 454 |
| Z39788_T2 (SEQ ID NO: 2251) | 320 | 454 |
| Z39788_T4 (SEQ ID NO: 2253) | 320 | 454 |
| Z39788_T6 (SEQ ID NO: 2254) | 320 | 454 |
| Z39788_T8 (SEQ ID NO: 2256) | 320 | 454 |
| Z39788_T9 (SEQ ID NO: 2257) | 320 | 454 |
| Z39788_T11 (SEQ ID NO: 2258) | 320 | 454 |
| Z39788_T13 (SEQ ID NO: 2259) | 320 | 454 |
| Z39788_T14 (SEQ ID NO: 2260) | 320 | 454 |
| Z39788_T17 (SEQ ID NO: 2261) | 320 | 454 |
| Z39788_T27 (SEQ ID NO: 2264) | 320 | 454 |
| Z39788_T29 (SEQ ID NO: 2265) | 320 | 454 |
| Z39788_T31 (SEQ ID NO: 2266) | 320 | 454 |

This segment can be found in both coding and non-coding regions of transcript(s) as follows. The segment can be found in a non-coding region of transcript(s) that are related to the following protein(s): Z39788_P3. This segment can also be found in the following protein(s): Z39788_P1, Z39788_P6, Z39788_P8, Z39788_P9, Z39788_P12, Z39788_P13, Z39788_P16, Z39788_P24, Z39788_P26 and Z39788_P27, since it is in the coding region for the corresponding transcript.

Segment cluster Z39788_node_4 (SEQ ID NO:2269) according to the present invention is supported by 1 libraries. The number of libraries was determined as previously described. This segment can be found in the following transcript(s): Z39788_T31 (SEQ ID NO:2266). Table 2125 below describes the starting and ending position of this segment on each transcript.

TABLE 2125

| Segment location on transcripts | | |
|---|---|---|
| Transcript name | Segment starting position | Segment ending position |
| Z39788_T31 (SEQ ID NO: 2266) | 455 | 753 |

This segment can be found in the following protein(s): Z39788_P27.

Segment cluster Z39788_node_9 (SEQ ID NO:2270) according to the present invention is supported by 3 libraries. The number of libraries was determined as previously described. This segment can be found in the following transcript(s): Z39788_T27 (SEQ ID NO:2264). Table 2126 below describes the starting and ending position of this segment on each transcript.

TABLE 2126

Segment location on transcripts

| Transcript name | Segment starting position | Segment ending position |
|---|---|---|
| Z39788_T27 (SEQ ID NO: 2264) | 671 | 952 |

This segment can be found in the following protein(s): Z39788_P24.

Segment cluster Z39788_node_11 (SEQ ID NO:2271) according to the present invention is supported by 1 libraries. The number of libraries was determined as previously described. This segment can be found in the following transcript(s): Z39788_T29 (SEQ ID NO:2265). Table 2127 below describes the starting and ending position of this segment on each transcript.

TABLE 2127

Segment location on transcripts

| Transcript name | Segment starting position | Segment ending position |
|---|---|---|
| Z39788_T29 (SEQ ID NO: 2265) | 671 | 831 |

This segment can be found in the following protein(s): Z39788_P26.

Segment cluster Z39788_node_13 (SEQ ID NO:2272) according to the present invention is supported by 5 libraries. The number of libraries was determined as previously described. This segment can be found in the following transcript(s): Z39788_T2 (SEQ ID NO:2251). Table 2128 below describes the starting and ending position of this segment on each transcript.

TABLE 2128

Segment location on transcripts

| Transcript name | Segment starting position | Segment ending position |
|---|---|---|
| Z39788_T2 (SEQ ID NO: 2251) | 671 | 822 |

This segment can be found in the following protein(s): Z39788_P3.

Segment cluster Z39788_node_25 (SEQ ID NO:2273) according to the present invention is supported by 16 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260) and Z39788_T17 (SEQ ID NO:2261). Table 2129 below describes the starting and ending position of this segment on each transcript.

TABLE 2129

Segment location on transcripts

| Transcript name | Segment starting position | Segment ending position |
|---|---|---|
| Z39788_T0 (SEQ ID NO: 2250) | 788 | 934 |
| Z39788_T2 (SEQ ID NO: 2251) | 940 | 1086 |
| Z39788_T4 (SEQ ID NO: 2253) | 788 | 934 |
| Z39788_T6 (SEQ ID NO: 2254) | 788 | 934 |
| Z39788_T8 (SEQ ID NO: 2256) | 788 | 934 |
| Z39788_T9 (SEQ ID NO: 2257) | 788 | 934 |
| Z39788_T11 (SEQ ID NO: 2258) | 788 | 934 |
| Z39788_T13 (SEQ ID NO: 2259) | 788 | 934 |
| Z39788_T14 (SEQ ID NO: 2260) | 788 | 934 |
| Z39788_T17 (SEQ ID NO: 2261) | 788 | 934 |

This segment can be found in the following protein(s): Z39788_P1, Z39788_P3, Z39788_P6, Z39788_P8, Z39788_P9, Z39788_P12, Z39788_P13 and Z39788_P16.

Segment cluster Z39788_node_27 (SEQ ID NO:2274) according to the present invention is supported by 5 libraries. The number of libraries was determined as previously described. This segment can be found in the following transcript(s): Z39788_T3 (SEQ ID NO:2252), Z39788_T7 (SEQ ID NO:2255) and Z39788_T18 (SEQ ID NO:2262). Table 2130 below describes the starting and ending position of this segment on each transcript.

TABLE 2130

Segment location on transcripts

| Transcript name | Segment starting position | Segment ending position |
|---|---|---|
| Z39788_T3 (SEQ ID NO: 2252) | 1 | 462 |
| Z39788_T7 (SEQ ID NO: 2255) | 1 | 462 |
| Z39788_T18 (SEQ ID NO: 2262) | 1 | 462 |

This segment can be found in a non-coding region of transcript(s) that are related to the following protein(s): Z39788_P4, Z39788_P7 and Z39788_P17.

Segment cluster Z39788_node_28 (SEQ ID NO:2275) according to the present invention is supported by 26 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261) and Z39788_T18 (SEQ ID NO:2262). Table 2131 below describes the starting and ending position of this segment on each transcript.

TABLE 2131

Segment location on transcripts

| Transcript name | Segment starting position | Segment ending position |
|---|---|---|
| Z39788_T0 (SEQ ID NO: 2250) | 935 | 1114 |
| Z39788_T2 (SEQ ID NO: 2251) | 1087 | 1266 |
| Z39788_T3 (SEQ ID NO: 2252) | 463 | 642 |
| Z39788_T4 (SEQ ID NO: 2253) | 935 | 1114 |
| Z39788_T6 (SEQ ID NO: 2254) | 935 | 1114 |

TABLE 2131-continued

Segment location on transcripts

| Transcript name | Segment starting position | Segment ending position |
|---|---|---|
| Z39788_T7 (SEQ ID NO: 2255) | 463 | 642 |
| Z39788_T8 (SEQ ID NO: 2256) | 935 | 1114 |
| Z39788_T9 (SEQ ID NO: 2257) | 935 | 1114 |
| Z39788_T11 (SEQ ID NO: 2258) | 935 | 1114 |
| Z39788_T13 (SEQ ID NO: 2259) | 935 | 1114 |
| Z39788_T14 (SEQ ID NO: 2260) | 935 | 1114 |
| Z39788_T17 (SEQ ID NO: 2261) | 935 | 1114 |
| Z39788_T18 (SEQ ID NO: 2262) | 463 | 642 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_42 (SEQ ID NO:2276) according to the present invention is supported by 38 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), (SEQ ID NO:2260), Z39788_T17 (SEQ ID NO:2261) and (SEQ ID NO:2262). Table 2132 below describes the starting and ending position of this segment on each transcript.

TABLE 2132

Segment location on transcripts

| Transcript name | Segment starting position | Segment ending position |
|---|---|---|
| Z39788_T0 (SEQ ID NO: 2250) | 1609 | 1729 |
| Z39788_T2 (SEQ ID NO: 2251) | 1761 | 1881 |
| Z39788_T3 (SEQ ID NO: 2252) | 1137 | 1257 |
| Z39788_T4 (SEQ ID NO: 2253) | 1609 | 1729 |
| Z39788_T6 (SEQ ID NO: 2254) | 1465 | 1585 |
| Z39788_T7 (SEQ ID NO: 2255) | 993 | 1113 |
| Z39788_T8 (SEQ ID NO: 2256) | 1609 | 1729 |
| Z39788_T9 (SEQ ID NO: 2257) | 1609 | 1729 |
| Z39788_T11 (SEQ ID NO: 2258) | 1609 | 1729 |
| Z39788_T13 (SEQ ID NO: 2259) | 1465 | 1585 |
| Z39788_T14 (SEQ ID NO: 2260) | 1609 | 1729 |
| Z39788_T17 (SEQ ID NO: 2261) | 1465 | 1585 |
| Z39788_T18 (SEQ ID NO: 2262) | 993 | 1113 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_43 (SEQ ID NO:2277) according to the present invention is supported by 7 libraries. The number of libraries was determined as previously described. This segment can be found in the following transcript(s): Z39788_T9 (SEQ ID NO:2257), Z39788_T11 (SEQ ID NO:2258) and Z39788_T17 (SEQ ID NO:2261). Table 2133 below describes the starting and ending position of this segment on each transcript.

TABLE 2133

Segment location on transcripts

| Transcript name | Segment starting position | Segment ending position |
|---|---|---|
| Z39788_T9 (SEQ ID NO: 2257) | 1730 | 2568 |
| Z39788_T11 (SEQ ID NO: 2258) | 1730 | 2568 |
| Z39788_T17 (SEQ ID NO: 2261) | 1586 | 2424 |

This segment can be found in the following protein(s): Z39788_P9 and Z39788_P16.

Segment cluster Z39788_node_46 (SEQ ID NO:2278) according to the present invention is supported by 2 libraries. The number of libraries was determined as previously described. This segment can be found in the following transcript(s): Z39788_T11 (SEQ ID NO:2258) and Z39788_T14 (SEQ ID NO:2260). Table 2134 below describes the starting and ending position of this segment on each transcript.

TABLE 2134

Segment location on transcripts

| Transcript name | Segment starting position | Segment ending position |
|---|---|---|
| Z39788_T11 (SEQ ID NO: 2258) | 2678 | 2832 |
| Z39788_T14 (SEQ ID NO: 2260) | 1730 | 1884 |

This segment can be found in both coding and non-coding regions of transcript(s) as follows. The segment can be found in a non-coding region of transcript(s) that are related to the following protein(s): Z39788_P9. This segment can also be found in the following protein(s): Z39788_P13, since it is in the coding region for the corresponding transcript.

Segment cluster Z39788_node_48 (SEQ ID NO:2279) according to the present invention is supported by 9 libraries. The number of libraries was determined as previously described. This segment can be found in the following transcript(s): Z39788_T19 (SEQ ID NO:2263). Table 2135 below describes the starting and ending position of this segment on each transcript.

TABLE 2135

Segment location on transcripts

| Transcript name | Segment starting position | Segment ending position |
|---|---|---|
| Z39788_T19 (SEQ ID NO: 2263) | 1 | 1388 |

This segment can be found in the following protein(s): Z39788_P18.

Segment cluster Z39788_node_49 (SEQ ID NO:2280) according to the present invention is supported by 84 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2136 below describes the starting and ending position of this segment on each transcript.

TABLE 2136

Segment location on transcripts

| Transcript name | Segment starting position | Segment ending position |
|---|---|---|
| Z39788_T0 (SEQ ID NO: 2250) | 1730 | 2833 |
| Z39788_T2 (SEQ ID NO: 2251) | 1882 | 2985 |
| Z39788_T3 (SEQ ID NO: 2252) | 1258 | 2361 |
| Z39788_T4 (SEQ ID NO: 2253) | 1730 | 2833 |
| Z39788_T6 (SEQ ID NO: 2254) | 1586 | 2689 |
| Z39788_T7 (SEQ ID NO: 2255) | 1114 | 2217 |
| Z39788_T8 (SEQ ID NO: 2256) | 1839 | 2942 |
| Z39788_T9 (SEQ ID NO: 2257) | 2678 | 3781 |
| Z39788_T11 (SEQ ID NO: 2258) | 2833 | 3936 |
| Z39788_T13 (SEQ ID NO: 2259) | 1695 | 2798 |
| Z39788_T14 (SEQ ID NO: 2260) | 1885 | 2988 |
| Z39788_T17 (SEQ ID NO: 2261) | 2534 | 3637 |
| Z39788_T18 (SEQ ID NO: 2262) | 1223 | 2326 |
| Z39788_T19 (SEQ ID NO: 2263) | 1389 | 2492 |

This segment can be found in both coding and non-coding regions of transcript(s) as follows. The segment can be found in a non-coding region of transcript(s) that are related to the following protein(s): Z39788_P8, Z39788_P9, Z39788_P12, Z39788_P13, Z39788_P16, Z39788_P17 and Z39788_P18. This segment can also be found in the following protein(s): Z39788_P1, Z39788_P3, Z39788_P4, Z39788_P6 and Z39788_P7, since it is in the coding region for the corresponding transcript.

Segment cluster Z39788_node_54 (SEQ ID NO:2281) according to the present invention is supported by 63 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2137 below describes the starting and ending position of this segment on each transcript.

TABLE 2137

Segment location on transcripts

| Transcript name | Segment starting position | Segment ending position |
|---|---|---|
| Z39788_T0 (SEQ ID NO: 2250) | 2972 | 3224 |
| Z39788_T2 (SEQ ID NO: 2251) | 3124 | 3376 |
| Z39788_T3 (SEQ ID NO: 2252) | 2500 | 2752 |
| Z39788_T4 (SEQ ID NO: 2253) | 2972 | 3387 |
| Z39788_T6 (SEQ ID NO: 2254) | 2828 | 3080 |
| Z39788_T7 (SEQ ID NO: 2255) | 2356 | 2608 |
| Z39788_T8 (SEQ ID NO: 2256) | 3081 | 3333 |
| Z39788_T9 (SEQ ID NO: 2257) | 3920 | 4172 |
| Z39788_T11 (SEQ ID NO: 2258) | 4075 | 4327 |
| Z39788_T13 (SEQ ID NO: 2259) | 2937 | 3189 |
| Z39788_T14 (SEQ ID NO: 2260) | 3127 | 3379 |
| Z39788_T17 (SEQ ID NO: 2261) | 3776 | 4028 |
| Z39788_T18 (SEQ ID NO: 2262) | 2465 | 2717 |
| Z39788_T19 (SEQ ID NO: 2263) | 2631 | 2883 |

This segment can be found in a non-coding region of transcript(s) that are related to the following protein(s): Z39788_P1, Z39788_P3, Z39788_P4, Z39788_P6, Z39788_P7, Z39788_P8, Z39788_P9, Z39788_P12, Z39788_P13, Z39788_P16, Z39788_P17 and Z39788_P18.

Segment cluster Z39788_node_56 (SEQ ID NO:2282) according to the present invention is supported by 2 libraries. The number of libraries was determined as previously described. This segment can be found in the following transcript(s): Z39788_T4 (SEQ ID NO:2253). Table 2138 below describes the starting and ending position of this segment on each transcript.

TABLE 2138

Segment location on transcripts

| Transcript name | Segment starting position | Segment ending position |
|---|---|---|
| Z39788_T4 (SEQ ID NO: 2253) | 3388 | 3512 |

This segment can be found in a non-coding region of transcript(s) that are related to the following protein(s): Z39788_P1.

According to an optional embodiment of the present invention, short segments related to the above cluster are also provided. These segments are up to about 120 bp in length, and so are included in a separate description.

Segment cluster Z39788_node_1 (SEQ ID NO:2283) according to the present invention is supported by 3 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T27 (SEQ ID NO:2264), Z39788_T29 (SEQ ID NO:2265) and Z39788_T31 (SEQ ID NO:2266). Table 2139 below describes the starting and ending position of this segment on each transcript.

TABLE 2139

Segment location on transcripts

| Transcript name | Segment starting position | Segment ending position |
|---|---|---|
| Z39788_T0 (SEQ ID NO: 2250) | 264 | 319 |
| Z39788_T2 (SEQ ID NO: 2251) | 264 | 319 |
| Z39788_T4 (SEQ ID NO: 2253) | 264 | 319 |
| Z39788_T6 (SEQ ID NO: 2254) | 264 | 319 |
| Z39788_T8 (SEQ ID NO: 2256) | 264 | 319 |
| Z39788_T9 (SEQ ID NO: 2257) | 264 | 319 |
| Z39788_T11 (SEQ ID NO: 2258) | 264 | 319 |
| Z39788_T13 (SEQ ID NO: 2259) | 264 | 319 |
| Z39788_T14 (SEQ ID NO: 2260) | 264 | 319 |
| Z39788_T17 (SEQ ID NO: 2261) | 264 | 319 |
| Z39788_T27 (SEQ ID NO: 2264) | 264 | 319 |
| Z39788_T29 (SEQ ID NO: 2265) | 264 | 319 |
| Z39788_T31 (SEQ ID NO: 2266) | 264 | 319 |

This segment can be found in both coding and non-coding regions of transcript(s) as follows. The segment can be found in a non-coding region of transcript(s) that are related to the following protein(s): Z39788_P3. This segment can also be found in the following protein(s): Z39788_P1, Z39788_P6, Z39788_P8, Z39788_P9, Z39788_P12, Z39788_P13, Z39788_P16, Z39788_P24, Z39788_P26 and Z39788_P27, since it is in the coding region for the corresponding transcript.

Segment cluster Z39788_node_7 (SEQ ID NO:2284) according to the present invention is supported by 14 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T27 (SEQ ID NO:2264) and Z39788_T29 (SEQ ID NO:2265). Table 2140 below describes the starting and ending position of this segment on each transcript.

TABLE 2140

Segment location on transcripts

| Transcript name | Segment starting position | Segment ending position |
|---|---|---|
| Z39788_T0 (SEQ ID NO: 2250) | 455 | 553 |
| Z39788_T2 (SEQ ID NO: 2251) | 455 | 553 |
| Z39788_T4 (SEQ ID NO: 2253) | 455 | 553 |
| Z39788_T6 (SEQ ID NO: 2254) | 455 | 553 |
| Z39788_T8 (SEQ ID NO: 2256) | 455 | 553 |
| Z39788_T9 (SEQ ID NO: 2257) | 455 | 553 |
| Z39788_T11 (SEQ ID NO: 2258) | 455 | 553 |
| Z39788_T13 (SEQ ID NO: 2259) | 455 | 553 |
| Z39788_T14 (SEQ ID NO: 2260) | 455 | 553 |
| Z39788_T17 (SEQ ID NO: 2261) | 455 | 553 |
| Z39788_T27 (SEQ ID NO: 2264) | 455 | 553 |
| Z39788_T29 (SEQ ID NO: 2265) | 455 | 553 |

This segment can be found in both coding and non-coding regions of transcript(s) as follows. The segment can be found in a non-coding region of transcript(s) that are related to the following protein(s): Z39788_P3. This segment can also be found in the following protein(s): Z39788_P1, Z39788_P6, Z39788_P8, Z39788_P9, Z39788_P12, Z39788_P13, Z39788_P16, Z39788_P24 and Z39788_P26, since it is in the coding region for the corresponding transcript.

Segment cluster Z39788_node_8 (SEQ ID NO:2285) according to the present invention is supported by 18 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T27 (SEQ ID NO:2264) and Z39788_T29 (SEQ ID NO:2265). Table 2141 below describes the starting and ending position of this segment on each transcript.

TABLE 2141

Segment location on transcripts

| Transcript name | Segment starting position | Segment ending position |
|---|---|---|
| Z39788_T0 (SEQ ID NO: 2250) | 554 | 670 |
| Z39788_T2 (SEQ ID NO: 2251) | 554 | 670 |
| Z39788_T4 (SEQ ID NO: 2253) | 554 | 670 |
| Z39788_T6 (SEQ ID NO: 2254) | 554 | 670 |
| Z39788_T8 (SEQ ID NO: 2256) | 554 | 670 |
| Z39788_T9 (SEQ ID NO: 2257) | 554 | 670 |
| Z39788_T11 (SEQ ID NO: 2258) | 554 | 670 |
| Z39788_T13 (SEQ ID NO: 2259) | 554 | 670 |
| Z39788_T14 (SEQ ID NO: 2260) | 554 | 670 |

TABLE 2141-continued

Segment location on transcripts

| Transcript name | Segment starting position | Segment ending position |
|---|---|---|
| Z39788_T17 (SEQ ID NO: 2261) | 554 | 670 |
| Z39788_T27 (SEQ ID NO: 2264) | 554 | 670 |
| Z39788_T29 (SEQ ID NO: 2265) | 554 | 670 |

This segment can be found in both coding and non-coding regions of transcript(s) as follows. The segment can be found in a non-coding region of transcript(s) that are related to the following protein(s): Z39788_P3. This segment can also be found in the following protein(s): Z39788_P1, Z39788_P6, Z39788_P8, Z39788_P9, Z39788_P12, Z39788_P13, Z39788_P16, Z39788_P24 and Z39788_P26, since it is in the coding region for the corresponding transcript.

Segment cluster Z39788_node_22 (SEQ ID NO:2286) according to the present invention is supported by 15 libraries. The number of libraries was determined as previously described. This segment can be found in the following transcript(s): Z39788_T0 (SEQ ID NO:2250), Z39788_T2 (SEQ ID NO:2251), Z39788_T4 (SEQ ID NO:2253), Z39788_T6 (SEQ ID NO:2254), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260) and Z39788_T17 (SEQ ID NO:2261). Table 2142 below describes the starting and ending position of this segment on each transcript.

TABLE 2142

Segment location on transcripts

| Transcript name | Segment starting position | Segment ending position |
|---|---|---|
| Z39788_T0 (SEQ ID NO: 2250) | 671 | 787 |
| Z39788_T2 (SEQ ID NO: 2251) | 823 | 939 |
| Z39788_T4 (SEQ ID NO: 2253) | 671 | 787 |
| Z39788_T6 (SEQ ID NO: 2254) | 671 | 787 |
| Z39788_T8 (SEQ ID NO: 2256) | 671 | 787 |
| Z39788_T9 (SEQ ID NO: 2257) | 671 | 787 |
| Z39788_T11 (SEQ ID NO: 2258) | 671 | 787 |
| Z39788_T13 (SEQ ID NO: 2259) | 671 | 787 |
| Z39788_T14 (SEQ ID NO: 2260) | 671 | 787 |
| Z39788_T17 (SEQ ID NO: 2261) | 671 | 787 |

This segment can be found in the following protein(s): Z39788_P1, Z39788_P3, Z39788_P6, Z39788_P8, Z39788_P9, Z39788_P12, Z39788_P13 and Z39788_P16.

Segment cluster Z39788_node_30 (SEQ ID NO:2287) according to the present invention is supported by 23 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261) and Z39788_T18 (SEQ ID NO:2262). Table 2143 below describes the starting and ending position of this segment on each transcript.

TABLE 2143

Segment location on transcripts

| Transcript name | Segment starting position | Segment ending position |
|---|---|---|
| Z39788_T0 (SEQ ID NO: 2250) | 1115 | 1168 |
| Z39788_T2 (SEQ ID NO: 2251) | 1267 | 1320 |
| Z39788_T3 (SEQ ID NO: 2252) | 643 | 696 |
| Z39788_T4 (SEQ ID NO: 2253) | 1115 | 1168 |
| Z39788_T6 (SEQ ID NO: 2254) | 1115 | 1168 |
| Z39788_T7 (SEQ ID NO: 2255) | 643 | 696 |
| Z39788_T8 (SEQ ID NO: 2256) | 1115 | 1168 |
| Z39788_T9 (SEQ ID NO: 2257) | 1115 | 1168 |
| Z39788_T11 (SEQ ID NO: 2258) | 1115 | 1168 |
| Z39788_T13 (SEQ ID NO: 2259) | 1115 | 1168 |
| Z39788_T14 (SEQ ID NO: 2260) | 1115 | 1168 |
| Z39788_T17 (SEQ ID NO: 2261) | 1115 | 1168 |
| Z39788_T18 (SEQ ID NO: 2262) | 643 | 696 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_31 (SEQ ID NO:2288) according to the present invention is supported by 23 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261) and Z39788_T18 (SEQ ID NO:2262). Table 2144 below describes the starting and ending position of this segment on each transcript.

TABLE 2144

Segment location on transcripts

| Transcript name | Segment starting position | Segment ending position |
|---|---|---|
| Z39788_T0 (SEQ ID NO: 2250) | 1169 | 1274 |
| Z39788_T2 (SEQ ID NO: 2251) | 1321 | 1426 |
| Z39788_T3 (SEQ ID NO: 2252) | 697 | 802 |
| Z39788_T4 (SEQ ID NO: 2253) | 1169 | 1274 |
| Z39788_T6 (SEQ ID NO: 2254) | 1169 | 1274 |
| Z39788_T7 (SEQ ID NO: 2255) | 697 | 802 |
| Z39788_T8 (SEQ ID NO: 2256) | 1169 | 1274 |
| Z39788_T9 (SEQ ID NO: 2257) | 1169 | 1274 |
| Z39788_T11 (SEQ ID NO: 2258) | 1169 | 1274 |
| Z39788_T13 (SEQ ID NO: 2259) | 1169 | 1274 |
| Z39788_T14 (SEQ ID NO: 2260) | 1169 | 1274 |
| Z39788_T17 (SEQ ID NO: 2261) | 1169 | 1274 |
| Z39788_T18 (SEQ ID NO: 2262) | 697 | 802 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_32 (SEQ ID NO:2289) according to the present invention is supported by 20 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261) and Z39788_T18 (SEQ ID NO:2262). Table 2145 below describes the starting and ending position of this segment on each transcript.

TABLE 2145

Segment location on transcripts

| Transcript name | Segment starting position | Segment ending position |
|---|---|---|
| Z39788_T0 (SEQ ID NO: 2250) | 1275 | 1333 |
| Z39788_T2 (SEQ ID NO: 2251) | 1427 | 1485 |
| Z39788_T3 (SEQ ID NO: 2252) | 803 | 861 |
| Z39788_T4 (SEQ ID NO: 2253) | 1275 | 1333 |
| Z39788_T6 (SEQ ID NO: 2254) | 1275 | 1333 |
| Z39788_T7 (SEQ ID NO: 2255) | 803 | 861 |
| Z39788_T8 (SEQ ID NO: 2256) | 1275 | 1333 |
| Z39788_T9 (SEQ ID NO: 2257) | 1275 | 1333 |
| Z39788_T11 (SEQ ID NO: 2258) | 1275 | 1333 |
| Z39788_T13 (SEQ ID NO: 2259) | 1275 | 1333 |
| Z39788_T14 (SEQ ID NO: 2260) | 1275 | 1333 |
| Z39788_T17 (SEQ ID NO: 2261) | 1275 | 1333 |
| Z39788_T18 (SEQ ID NO: 2262) | 803 | 861 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2146.

TABLE 2146

Oligonucleotides related to this segment

| Oligonucleotide name | Overexpressed in cancers | Chip reference |
|---|---|---|
| Z39788_0_0_67419 | breast malignant tumors | BRS |
| Z39788_0_0_67419 | lung malignant tumors | LUN |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_34 (SEQ ID NO:2290) according to the present invention is supported by 18 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T8 (SEQ ID NO:2256), Z39788_T9 (SEQ ID NO:2257), Z39788_T11 (SEQ ID NO:2258) and Z39788_T14 (SEQ ID NO:2260). Table 2147 below describes the starting and ending position of this segment on each transcript.

TABLE 2147

Segment location on transcripts

| Transcript name | Segment starting position | Segment ending position |
|---|---|---|
| Z39788_T0 (SEQ ID NO: 2250) | 1334 | 1430 |
| Z39788_T2 (SEQ ID NO: 2251) | 1486 | 1582 |
| Z39788_T3 (SEQ ID NO: 2252) | 862 | 958 |

TABLE 2147-continued

Segment location on transcripts

| Transcript name | Segment starting position | Segment ending position |
|---|---|---|
| Z39788_T4 (SEQ ID NO: 2253) | 1334 | 1430 |
| Z39788_T8 (SEQ ID NO: 2256) | 1334 | 1430 |
| Z39788_T9 (SEQ ID NO: 2257) | 1334 | 1430 |
| Z39788_T11 (SEQ ID NO: 2258) | 1334 | 1430 |
| Z39788_T14 (SEQ ID NO: 2260) | 1334 | 1430 |

This segment can be found in the following protein(s): Z39788_P1, Z39788_P3, Z39788_P4, Z39788_P8, Z39788_P9 and Z39788_P13.

Segment cluster Z39788_node_35 (SEQ ID NO:2291) according to the present invention is supported by 16 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T8 (SEQ ID NO:2256), Z39788_T9 (SEQ ID NO:2257), Z39788_T11 (SEQ ID NO:2258) and Z39788_T14 (SEQ ID NO:2260). Table 2148 below describes the starting and ending position of this segment on each transcript.

TABLE 2148

Segment location on transcripts

| Transcript name | Segment starting position | Segment ending position |
|---|---|---|
| Z39788_T0 (SEQ ID NO: 2250) | 1431 | 1477 |
| Z39788_T2 (SEQ ID NO: 2251) | 1583 | 1629 |
| Z39788_T3 (SEQ ID NO: 2252) | 959 | 1005 |
| Z39788_T4 (SEQ ID NO: 2253) | 1431 | 1477 |
| Z39788_T8 (SEQ ID NO: 2256) | 1431 | 1477 |
| Z39788_T9 (SEQ ID NO: 2257) | 1431 | 1477 |
| Z39788_T11 (SEQ ID NO: 2258) | 1431 | 1477 |
| Z39788_T14 (SEQ ID NO: 2260) | 1431 | 1477 |

This segment can be found in the following protein(s): Z39788_P1, Z39788_P3, Z39788_P4, Z39788_P8, Z39788_P9 and Z39788_P13.

Segment cluster Z39788_node_38 (SEQ ID NO:2292) according to the present invention is supported by 30 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), (SEQ ID NO:2260), Z39788_T17 (SEQ ID NO:2261) and (SEQ ID NO:2262). Table 2149 below describes the starting and ending position of this segment on each transcript.

TABLE 2149

Segment location on transcripts

| Transcript name | Segment starting position | Segment ending position |
|---|---|---|
| Z39788_T0 (SEQ ID NO: 2250) | 1478 | 1516 |
| Z39788_T2 (SEQ ID NO: 2251) | 1630 | 1668 |
| Z39788_T3 (SEQ ID NO: 2252) | 1006 | 1044 |

TABLE 2149-continued

Segment location on transcripts

| Transcript name | Segment starting position | Segment ending position |
|---|---|---|
| Z39788_T4 (SEQ ID NO: 2253) | 1478 | 1516 |
| Z39788_T6 (SEQ ID NO: 2254) | 1334 | 1372 |
| Z39788_T7 (SEQ ID NO: 2255) | 862 | 900 |
| Z39788_T8 (SEQ ID NO: 2256) | 1478 | 1516 |
| Z39788_T9 (SEQ ID NO: 2257) | 1478 | 1516 |
| Z39788_T11 (SEQ ID NO: 2258) | 1478 | 1516 |
| Z39788_T13 (SEQ ID NO: 2259) | 1334 | 1372 |
| Z39788_T14 (SEQ ID NO: 2260) | 1478 | 1516 |
| Z39788_T17 (SEQ ID NO: 2261) | 1334 | 1372 |
| Z39788_T18 (SEQ ID NO: 2262) | 862 | 900 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_39 (SEQ ID NO:2293) according to the present invention is supported by 33 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), (SEQ ID NO:2260), Z39788_T17 (SEQ ID NO:2261) and (SEQ ID NO:2262). Table 2150 below describes the starting and ending position of this segment on each transcript.

TABLE 2150

Segment location on transcripts

| Transcript name | Segment starting position | Segment ending position |
|---|---|---|
| Z39788_T0 (SEQ ID NO: 2250) | 1517 | 1608 |
| Z39788_T2 (SEQ ID NO: 2251) | 1669 | 1760 |
| Z39788_T3 (SEQ ID NO: 2252) | 1045 | 1136 |
| Z39788_T4 (SEQ ID NO: 2253) | 1517 | 1608 |
| Z39788_T6 (SEQ ID NO: 2254) | 1373 | 1464 |
| Z39788_T7 (SEQ ID NO: 2255) | 901 | 992 |
| Z39788_T8 (SEQ ID NO: 2256) | 1517 | 1608 |
| Z39788_T9 (SEQ ID NO: 2257) | 1517 | 1608 |
| Z39788_T11 (SEQ ID NO: 2258) | 1517 | 1608 |
| Z39788_T13 (SEQ ID NO: 2259) | 1373 | 1464 |
| Z39788_T14 (SEQ ID NO: 2260) | 1517 | 1608 |
| Z39788_T17 (SEQ ID NO: 2261) | 1373 | 1464 |
| Z39788_T18 (SEQ ID NO: 2262) | 901 | 992 |

This segment can be found in the following protein(s): Z39788_P1, Z39788_P3, Z39788_P4, Z39788_P6, Z39788_P7, Z39788_P8, Z39788_P9, Z39788_P12, Z39788_P13, Z39788_P16 and Z39788_P17.

Segment cluster Z39788_node_44 (SEQ ID NO:2294) according to the present invention is supported by 9 libraries. The number of libraries was determined as previously described. This segment can be found in the following transcript(s): Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T17 (SEQ ID NO:2261) and Z39788_T18 (SEQ ID NO:2262). Table 2151 below describes the starting and ending position of this segment on each transcript.

TABLE 2151

Segment location on transcripts

| Transcript name | Segment starting position | Segment ending position |
|---|---|---|
| Z39788_T8 (SEQ ID NO: 2256) | 1730 | 1838 |
| Z39788_T9 (SEQ ID NO: 2257) | 2569 | 2677 |
| Z39788_T11 (SEQ ID NO: 2258) | 2569 | 2677 |
| Z39788_T13 (SEQ ID NO: 2259) | 1586 | 1694 |
| Z39788_T17 (SEQ ID NO: 2261) | 2425 | 2533 |
| Z39788_T18 (SEQ ID NO: 2262) | 1114 | 1222 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2152.

TABLE 2152

Oligonucleotides related to this segment

| Oligonucleotide name | Overexpressed in cancers | Chip reference |
|---|---|---|
| Z39788_0_0_67425 | lung malignant tumors | LUN |

This segment can be found in both coding and non-coding regions of transcript(s) as follows. The segment can be found in a non-coding region of transcript(s) that are related to the following protein(s): Z39788_P9 and Z39788_P16. This segment can also be found in the following protein(s): Z39788_P8, Z39788_P12 and Z39788_P17, since it is in the coding region for the corresponding transcript.

Segment cluster Z39788_node_50 (SEQ ID NO:2295) according to the present invention is supported by 35 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2153 below describes the starting and ending position of this segment on each transcript.

TABLE 2153

Segment location on transcripts

| Transcript name | Segment starting position | Segment ending position |
|---|---|---|
| Z39788_T0 (SEQ ID NO: 2250) | 2834 | 2870 |
| Z39788_T2 (SEQ ID NO: 2251) | 2986 | 3022 |
| Z39788_T3 (SEQ ID NO: 2252) | 2362 | 2398 |
| Z39788_T4 (SEQ ID NO: 2253) | 2834 | 2870 |
| Z39788_T6 (SEQ ID NO: 2254) | 2690 | 2726 |
| Z39788_T7 (SEQ ID NO: 2255) | 2218 | 2254 |
| Z39788_T8 (SEQ ID NO: 2256) | 2943 | 2979 |
| Z39788_T9 (SEQ ID NO: 2257) | 3782 | 3818 |
| Z39788_T11 (SEQ ID NO: 2258) | 3937 | 3973 |
| Z39788_T13 (SEQ ID NO: 2259) | 2799 | 2835 |
| Z39788_T14 (SEQ ID NO: 2260) | 2989 | 3025 |

TABLE 2153-continued

Segment location on transcripts

| Transcript name | Segment starting position | Segment ending position |
|---|---|---|
| Z39788_T17 (SEQ ID NO: 2261) | 3638 | 3674 |
| Z39788_T18 (SEQ ID NO: 2262) | 2327 | 2363 |
| Z39788_T19 (SEQ ID NO: 2263) | 2493 | 2529 |

This segment can be found in a non-coding region of transcript(s) that are related to the following protein(s): Z39788_P1, Z39788_P3, Z39788_P4, Z39788_P6, Z39788_P7, Z39788_P8, Z39788_P9, Z39788_P12, Z39788_P13, Z39788_P16, Z39788_P17 and Z39788_P18.

Segment cluster Z39788_node_51 (SEQ ID NO:2296) according to the present invention is supported by 36 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2154 below describes the starting and ending position of this segment on each transcript.

TABLE 2154

Segment location on transcripts

| Transcript name | Segment starting position | Segment ending position |
|---|---|---|
| Z39788_T0 (SEQ ID NO: 2250) | 2871 | 2910 |
| Z39788_T2 (SEQ ID NO: 2251) | 3023 | 3062 |
| Z39788_T3 (SEQ ID NO: 2252) | 2399 | 2438 |
| Z39788_T4 (SEQ ID NO: 2253) | 2871 | 2910 |
| Z39788_T6 (SEQ ID NO: 2254) | 2727 | 2766 |
| Z39788_T7 (SEQ ID NO: 2255) | 2255 | 2294 |
| Z39788_T8 (SEQ ID NO: 2256) | 2980 | 3019 |
| Z39788_T9 (SEQ ID NO: 2257) | 3819 | 3858 |
| Z39788_T11 (SEQ ID NO: 2258) | 3974 | 4013 |
| Z39788_T13 (SEQ ID NO: 2259) | 2836 | 2875 |
| Z39788_T14 (SEQ ID NO: 2260) | 3026 | 3065 |
| Z39788_T17 (SEQ ID NO: 2261) | 3675 | 3714 |
| Z39788_T18 (SEQ ID NO: 2262) | 2364 | 2403 |
| Z39788_T19 (SEQ ID NO: 2263) | 2530 | 2569 |

This segment can be found in a non-coding region of transcript(s) that are related to the following protein(s): Z39788_P1, Z39788_P3, Z39788_P4, Z39788_P6, Z39788_P7, Z39788_P8, Z39788_P9, Z39788_P12, Z39788_P13, Z39788_P16, Z39788_P17 and Z39788_P18.

Segment cluster Z39788_node_52 (SEQ ID NO:2297) according to the present invention is supported by 49 libraries. The number of libraries was determined as previously described. This segment can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2155 below describes the starting and ending position of this segment on each transcript.

TABLE 2155

Segment location on transcripts

| Transcript name | Segment starting position | Segment ending position |
|---|---|---|
| Z39788_T0 (SEQ ID NO: 2250) | 2911 | 2946 |
| Z39788_T2 (SEQ ID NO: 2251) | 3063 | 3098 |
| Z39788_T3 (SEQ ID NO: 2252) | 2439 | 2474 |
| Z39788_T4 (SEQ ID NO: 2253) | 2911 | 2946 |
| Z39788_T6 (SEQ ID NO: 2254) | 2767 | 2802 |
| Z39788_T7 (SEQ ID NO: 2255) | 2295 | 2330 |
| Z39788_T8 (SEQ ID NO: 2256) | 3020 | 3055 |
| Z39788_T9 (SEQ ID NO: 2257) | 3859 | 3894 |
| Z39788_T11 (SEQ ID NO: 2258) | 4014 | 4049 |
| Z39788_T13 (SEQ ID NO: 2259) | 2876 | 2911 |
| Z39788_T14 (SEQ ID NO: 2260) | 3066 | 3101 |
| Z39788_T17 (SEQ ID NO: 2261) | 3715 | 3750 |
| Z39788_T18 (SEQ ID NO: 2262) | 2404 | 2439 |
| Z39788_T19 (SEQ ID NO: 2263) | 2570 | 2605 |

This segment can be found in a non-coding region of transcript(s) that are related to the following protein(s): Z39788_P1, Z39788_P3, Z39788_P4, Z39788_P6, Z39788_P7, Z39788_P8, Z39788_P9, Z39788_P12, Z39788_P13, Z39788_P16, Z39788_P17 and Z39788_P18.

Segment cluster Z39788_node_53 (SEQ ID NO:2298) according to the present invention can be found in the following transcript(s): Z39788_T0 (SEQ ID NO:2250), Z39788_T2 (SEQ ID NO:2251), Z39788_T3 (SEQ ID NO:2252), Z39788_T4 (SEQ ID NO:2253), Z39788_T6 (SEQ ID NO:2254), Z39788_T7 (SEQ ID NO:2255), Z39788_T8 (SEQ ID NO:2256), Z39788_T9 (SEQ ID NO:2257), Z39788_T11 (SEQ ID NO:2258), Z39788_T13 (SEQ ID NO:2259), Z39788_T14 (SEQ ID NO:2260), Z39788_T17 (SEQ ID NO:2261), Z39788_T18 (SEQ ID NO:2262) and Z39788_T19 (SEQ ID NO:2263). Table 2156 below describes the starting and ending position of this segment on each transcript.

TABLE 2156

Segment location on transcripts

| Transcript name | Segment starting position | Segment ending position |
|---|---|---|
| Z39788_T0 (SEQ ID NO: 2250) | 2947 | 2971 |
| Z39788_T2 (SEQ ID NO: 2251) | 3099 | 3123 |
| Z39788_T3 (SEQ ID NO: 2252) | 2475 | 2499 |
| Z39788_T4 (SEQ ID NO: 2253) | 2947 | 2971 |
| Z39788_T6 (SEQ ID NO: 2254) | 2803 | 2827 |
| Z39788_T7 (SEQ ID NO: 2255) | 2331 | 2355 |
| Z39788_T8 (SEQ ID NO: 2256) | 3056 | 3080 |
| Z39788_T9 (SEQ ID NO: 2257) | 3895 | 3919 |
| Z39788_T11 (SEQ ID NO: 2258) | 4050 | 4074 |
| Z39788_T13 (SEQ ID NO: 2259) | 2912 | 2936 |
| Z39788_T14 (SEQ ID NO: 2260) | 3102 | 3126 |
| Z39788_T17 (SEQ ID NO: 2261) | 3751 | 3775 |
| Z39788_T18 (SEQ ID NO: 2262) | 2440 | 2464 |
| Z39788_T19 (SEQ ID NO: 2263) | 2606 | 2630 |

This segment can be found in a non-coding region of transcript(s) that are related to the following protein(s): Z39788_P1, Z39788_P3, Z39788_P4, Z39788_P6, Z39788_P7, Z39788_P8, Z39788_P9, Z39788_P12, Z39788_P13, Z39788_P16, Z39788_P17 and Z39788_P18.

Description for Cluster Z40569

Cluster Z40569 features 5 transcript(s) and 14 segment(s) of interest, the names for which are given in Tables 2157 and 2158, respectively, the sequences themselves are given at the end of the application. The selected protein variants are given in Table 2159.

TABLE 2157

Transcripts of interest
Transcript Name

Z40569_T1 (SEQ ID NO: 2299)
Z40569_T2 (SEQ ID NO: 2300)
Z40569_T5 (SEQ ID NO: 2301)
Z40569_T7 (SEQ ID NO: 2302)
Z40569_T8 (SEQ ID NO: 2303)

TABLE 2158

Segments of interest
Segment Name

Z40569_node_0 (SEQ ID NO: 2304)
Z40569_node_3 (SEQ ID NO: 2305)
Z40569_node_5 (SEQ ID NO: 2306)
Z40569_node_10 (SEQ ID NO: 2307)
Z40569_node_12 (SEQ ID NO: 2308)
Z40569_node_13 (SEQ ID NO: 2309)
Z40569_node_14 (SEQ ID NO: 2310)
Z40569_node_15 (SEQ ID NO: 2311)
Z40569_node_16 (SEQ ID NO: 2312)
Z40569_node_18 (SEQ ID NO: 2313)
Z40569_node_19 (SEQ ID NO: 2314)
Z40569_node_20 (SEQ ID NO: 2315)
Z40569_node_7 (SEQ ID NO: 2316)
Z40569_node_9 (SEQ ID NO: 2317)

TABLE 2159

Proteins of interest

| Protein Name | Corresponding Transcript(s) |
|---|---|
| Z40569_P1 | Z40569_T1 (SEQ ID NO: 2299); Z40569_T2 (SEQ ID NO: 2300) |
| Z40569_P2 | Z40569_T5 (SEQ ID NO: 2301) |
| Z40569_P3 | Z40569_T7 (SEQ ID NO: 2302); Z40569_T8 (SEQ ID NO: 2303) |

These sequences are variants of the known protein DNA replication complex GINS protein PSF2 (SwissProt accession identifier PSF2_HUMAN; known also according to the synonyms HSPC037; CGI-122; DC5), referred to herein as the previously known protein.

Protein DNA replication complex GINS protein PSF2 is known or believed to have the following function(s): The GINS complex seems to play an essential role in the initiation of DNA replication (By similarity). The sequence for protein DNA replication complex GINS protein PSF2 is given at the end of the application, as "DNA replication complex GINS protein PSF2 amino acid sequence". Protein DNA replication complex GINS protein PSF2 localization is believed to be Nuclear (By similarity).

The following GO Annotation(s) apply to the previously known protein. The following annotation(s) were found: DNA replication, which are annotation(s) related to Biological Process; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z40569 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 56 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 56 and Table 2160. This cluster is overexpressed (at least at a minimum level) in the following pathological conditions: brain malignant tumors, epithelial malignant tumors and a mixture of malignant tumors from different tissues.

56

TABLE 2160

Normal tissue distribution

| Name of Tissue | Number |
| --- | --- |
| bone | 0 |
| brain | 10 |
| colon | 63 |
| epithelial | 21 |
| general | 18 |
| head and neck | 50 |
| kidney | 8 |
| liver | 48 |
| lung | 30 |
| lymph nodes | 45 |
| breast | 8 |
| bone marrow | 31 |
| muscle | 0 |
| ovary | 7 |
| pancreas | 2 |
| prostate | 14 |
| skin | 0 |
| stomach | 146 |
| uterus | 4 |

TABLE 2161

P values and ratios for expression in cancerous tissue

| Name of Tissue | P1 | P2 | SP1 | R3 | SP2 | R4 |
| --- | --- | --- | --- | --- | --- | --- |
| bone | 1 | 1.9e−01 | 1 | 1.0 | 4.9e−01 | 1.9 |
| brain | 6.7e−01 | 3.9e−01 | 3.0e−01 | 2.4 | 2.2e−06 | 3.7 |
| colon | 4.0e−01 | 2.4e−01 | 9.1e−01 | 0.7 | 8.6e−01 | 0.8 |
| epithelial | 5.9e−01 | 7.5e−03 | 9.7e−01 | 0.5 | 1.8e−02 | 1.7 |
| general | 4.2e−01 | 1.2e−05 | 6.4e−01 | 0.9 | 4.2e−10 | 2.7 |
| head and neck | 6.7e−01 | 6.4e−01 | 1 | 0.7 | 7.5e−01 | 0.9 |
| kidney | 9.5e−01 | 8.0e−01 | 1 | 0.7 | 4.9e−01 | 1.3 |
| liver | 9.1e−01 | 3.4e−01 | 1 | 0.5 | 6.4e−01 | 1.2 |
| lung | 6.7e−01 | 2.9e−01 | 8.8e−01 | 0.8 | 8.5e−02 | 1.4 |
| lymph nodes | 2.9e−01 | 1.1e−01 | 1.4e−01 | 2.5 | 2.7e−02 | 1.8 |
| breast | 8.2e−01 | 3.4e−01 | 1 | 1.0 | 2.5e−01 | 1.8 |
| bone marrow | 8.8e−01 | 6.5e−01 | 1 | 0.5 | 3.6e−01 | 1.8 |
| muscle | 1 | 2.9e−01 | 1 | 1.0 | 2.3e−02 | 4.1 |
| ovary | 8.5e−01 | 5.8e−01 | 1 | 0.8 | 3.4e−01 | 1.8 |
| pancreas | 9.3e−01 | 6.8e−01 | 1 | 0.8 | 5.3e−01 | 1.6 |
| prostate | 9.0e−01 | 8.0e−01 | 6.7e−01 | 0.9 | 3.2e−01 | 1.4 |
| skin | 1 | 4.4e−01 | 1 | 1.0 | 1.7e−01 | 2.1 |
| stomach | 9.0e−01 | 6.1e−01 | 1 | 0.2 | 9.9e−01 | 0.4 |
| uterus | 7.4e−01 | 2.9e−01 | 1 | 1.0 | 2.1e−01 | 2.0 |

As noted above, cluster Z40569 features 14 segment(s), which were listed in Table 2158 above and for which the sequence(s) are given at the end of the application. These segment(s) are portions of nucleic acid sequence(s) which are described herein separately because they are of particular interest. A description of each segment according to the present invention is now provided.

Segment cluster Z40569_node_0 (SEQ ID NO:2304) according to the present invention is supported by 2 libraries. The number of libraries was determined as previously described. This segment can be found in the following transcript(s): Z40569_T8 (SEQ ID NO:2303). Table 2162 below describes the starting and ending position of this segment on each transcript.

TABLE 2162

Segment location on transcripts

| Transcript name | Segment starting position | Segment ending position |
| --- | --- | --- |
| Z40569_T8 (SEQ ID NO: 2303) | 1 | 437 |

This segment can be found in a non-coding region of transcript(s) that are related to the following protein(s): Z40569_P3.

Segment cluster Z40569_node_3 (SEQ ID NO:2305) according to the present invention is supported by 91 libraries. The number of libraries was determined as previously described. This segment can be found in the following transcript(s): Z40569_T1 (SEQ ID NO:2299), Z40569_T2 (SEQ ID NO:2300) and Z40569_T5 (SEQ ID NO:2301). Table 2163 below describes the starting and ending position of this segment on each transcript.

TABLE 2163

Segment location on transcripts

| Transcript name | Segment starting position | Segment ending position |
| --- | --- | --- |
| Z40569_T1 (SEQ ID NO: 2299) | 1 | 191 |
| Z40569_T2 (SEQ ID NO: 2300) | 1 | 191 |
| Z40569_T5 (SEQ ID NO: 2301) | 1 | 191 |

This segment can be found in the following protein(s): Z40569_P1 and Z40569_P2.

Segment cluster Z40569_node_5 (SEQ ID NO:2306) according to the present invention is supported by 1 libraries. The number of libraries was determined as previously described. This segment can be found in the following transcript(s): Z40569_T7 (SEQ ID NO:2302). Table 2164 below describes the starting and ending position of this segment on each transcript.

TABLE 2164

Segment location on transcripts

| Transcript name | Segment starting position | Segment ending position |
| --- | --- | --- |
| Z40569_T7 (SEQ ID NO: 2302) | 1 | 313 |

This segment can be found in a non-coding region of transcript(s) that are related to the following protein(s): Z40569_P3.

Segment cluster Z40569_node_10 (SEQ ID NO:2307) according to the present invention is supported by 2 libraries. The number of libraries was determined as previously described. This segment can be found in the following transcript(s): Z40569_T5 (SEQ ID NO:2301). Table 2165 below describes the starting and ending position of this segment on each transcript.

TABLE 2165

Segment location on transcripts

| Transcript name | Segment starting position | Segment ending position |
|---|---|---|
| Z40569_T5 (SEQ ID NO: 2301) | 407 | 864 |

This segment can be found in the following protein(s): Z40569_P2.

Segment cluster Z40569_node_12 (SEQ ID NO:2308) according to the present invention is supported by 3 libraries. The number of libraries was determined as previously described. This segment can be found in the following transcript(s): Z40569_T5 (SEQ ID NO:2301). Table 2166 below describes the starting and ending position of this segment on each transcript.

TABLE 2166

Segment location on transcripts

| Transcript name | Segment starting position | Segment ending position |
|---|---|---|
| Z40569_T5 (SEQ ID NO: 2301) | 865 | 2473 |

This segment can be found in a non-coding region of transcript(s) that are related to the following protein(s): Z40569_P2.

Segment cluster Z40569_node_13 (SEQ ID NO:2309) according to the present invention is supported by 92 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2167 below describes the starting and ending position of this segment on each transcript.

TABLE 2167

Segment location on transcripts

| Transcript name | Segment starting position | Segment ending position |
|---|---|---|
| Z40569_T1 (SEQ ID NO: 2299) | 407 | 533 |
| Z40569_T2 (SEQ ID NO: 2300) | 407 | 533 |
| Z40569_T5 (SEQ ID NO: 2301) | 2474 | 2600 |
| Z40569_T7 (SEQ ID NO: 2302) | 529 | 655 |
| Z40569_T8 (SEQ ID NO: 2303) | 653 | 779 |

This segment can be found in both coding and non-coding regions of transcript(s) as follows. The segment can be found in a non-coding region of transcript(s) that are related to the following protein(s): Z40569_P2. This segment can also be found in the following protein(s): Z40569_P1 and Z40569_P3, since it is in the coding region for the corresponding transcript.

Segment cluster Z40569_node_14 (SEQ ID NO:2310) according to the present invention is supported by 1 libraries. The number of libraries was determined as previously described. This segment can be found in the following transcript(s): Z40569_T5 (SEQ ID NO:2301). Table 2168 below describes the starting and ending position of this segment on each transcript.

TABLE 2168

Segment location on transcripts

| Transcript name | Segment starting position | Segment ending position |
|---|---|---|
| Z40569_T5 (SEQ ID NO: 2301) | 2601 | 2802 |

This segment can be found in a non-coding region of transcript(s) that are related to the following protein(s): Z40569_P2.

Segment cluster Z40569_node_15 (SEQ ID NO:2311) according to the present invention is supported by 112 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2169 below describes the starting and ending position of this segment on each transcript.

TABLE 2169

Segment location on transcripts

| Transcript name | Segment starting position | Segment ending position |
|---|---|---|
| Z40569_T1 (SEQ ID NO: 2299) | 534 | 793 |
| Z40569_T2 (SEQ ID NO: 2300) | 534 | 793 |
| Z40569_T5 (SEQ ID NO: 2301) | 2803 | 3062 |
| Z40569_T7 (SEQ ID NO: 2302) | 656 | 915 |
| Z40569_T8 (SEQ ID NO: 2303) | 780 | 1039 |

This segment can be found in both coding and non-coding regions of transcript(s) as follows. The segment can be found in a non-coding region of transcript(s) that are related to the following protein(s): Z40569_P2. This segment can also be found in the following protein(s): Z40569_P1 and Z40569_P3, since it is in the coding region for the corresponding transcript.

Segment cluster Z40569_node_16 (SEQ ID NO:2312) according to the present invention is supported by 91 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2170 below describes the starting and ending position of this segment on each transcript.

TABLE 2170

Segment location on transcripts

| Transcript name | Segment starting position | Segment ending position |
|---|---|---|
| Z40569_T1 (SEQ ID NO: 2299) | 794 | 930 |
| Z40569_T2 (SEQ ID NO: 2300) | 794 | 930 |
| Z40569_T5 (SEQ ID NO: 2301) | 3063 | 3199 |
| Z40569_T7 (SEQ ID NO: 2302) | 916 | 1052 |
| Z40569_T8 (SEQ ID NO: 2303) | 1040 | 1176 |

This segment can be found in a non-coding region of transcript(s) that are related to the following protein(s): Z40569_P1, Z40569_P2 and Z40569_P3.

Segment cluster Z40569_node_18 (SEQ ID NO:2313) according to the present invention is supported by 127 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2171 below describes the starting and ending position of this segment on each transcript.

TABLE 2171

Segment location on transcripts

| Transcript name | Segment starting position | Segment ending position |
| --- | --- | --- |
| Z40569_T1 (SEQ ID NO: 2299) | 931 | 3188 |
| Z40569_T2 (SEQ ID NO: 2300) | 931 | 3188 |
| Z40569_T5 (SEQ ID NO: 2301) | 3200 | 5457 |
| Z40569_T7 (SEQ ID NO: 2302) | 1053 | 3310 |
| Z40569_T8 (SEQ ID NO: 2303) | 1177 | 3434 |

This segment can be found in a non-coding region of transcript(s) that are related to the following protein(s): Z40569_P1, Z40569_P2 and Z40569_P3.

Segment cluster Z40569_node_19 (SEQ ID NO:2314) according to the present invention is supported by 9 libraries. The number of libraries was determined as previously described. This segment can be found in the following transcript(s): Z40569_T1 (SEQ ID NO:2299), Z40569_T5 (SEQ ID NO:2301), Z40569_T7 (SEQ ID NO:2302) and Z40569_T8 (SEQ ID NO:2303). Table 2172 below describes the starting and ending position of this segment on each transcript.

TABLE 2172

Segment location on transcripts

| Transcript name | Segment starting position | Segment ending position |
| --- | --- | --- |
| Z40569_T1 (SEQ ID NO: 2299) | 3189 | 3986 |
| Z40569_T5 (SEQ ID NO: 2301) | 5458 | 6255 |
| Z40569_T7 (SEQ ID NO: 2302) | 3311 | 4108 |
| Z40569_T8 (SEQ ID NO: 2303) | 3435 | 4232 |

This segment can be found in a non-coding region of transcript(s) that are related to the following protein(s): Z40569_P1, Z40569_P2 and Z40569_P3.

Segment cluster Z40569_node_20 (SEQ ID NO:2315) according to the present invention is supported by 16 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2173 below describes the starting and ending position of this segment on each transcript.

TABLE 2173

Segment location on transcripts

| Transcript name | Segment starting position | Segment ending position |
| --- | --- | --- |
| Z40569_T1 (SEQ ID NO: 2299) | 3987 | 5654 |
| Z40569_T2 (SEQ ID NO: 2300) | 3189 | 4856 |
| Z40569_T5 (SEQ ID NO: 2301) | 6256 | 7923 |
| Z40569_T7 (SEQ ID NO: 2302) | 4109 | 5776 |
| Z40569_T8 (SEQ ID NO: 2303) | 4233 | 5900 |

This segment can be found in a non-coding region of transcript(s) that are related to the following protein(s): Z40569_P1, Z40569_P2 and Z40569_P3.

According to an optional embodiment of the present invention, short segments related to the above cluster are also provided. These segments are up to about 120 bp in length, and so are included in a separate description.

Segment cluster Z40569_node_7 (SEQ ID NO:2316) according to the present invention is supported by 100 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2174 below describes the starting and ending position of this segment on each transcript.

TABLE 2174

Segment location on transcripts

| Transcript name | Segment starting position | Segment ending position |
| --- | --- | --- |
| Z40569_T1 (SEQ ID NO: 2299) | 192 | 306 |
| Z40569_T2 (SEQ ID NO: 2300) | 192 | 306 |
| Z40569_T5 (SEQ ID NO: 2301) | 192 | 306 |
| Z40569_T7 (SEQ ID NO: 2302) | 314 | 428 |
| Z40569_T8 (SEQ ID NO: 2303) | 438 | 552 |

This segment can be found in the following protein(s): Z40569_P1, Z40569_P2 and Z40569_P3.

Segment cluster Z40569_node_9 (SEQ ID NO:2317) according to the present invention is supported by 96 libraries. The number of libraries was determined as previously described. This segment can be found in the following transcript(s): Z40569_T1 (SEQ ID NO:2299), Z40569_T2 (SEQ ID NO:2300), Z40569_T5 (SEQ ID NO:2301), Z40569_T7 (SEQ ID NO:2302) and Z40569_T8 (SEQ ID NO:2303). Table 2175 below describes the starting and ending position of this segment on each transcript.

TABLE 2175

Segment location on transcripts

| Transcript name | Segment starting position | Segment ending position |
| --- | --- | --- |
| Z40569_T1 (SEQ ID NO: 2299) | 307 | 406 |
| Z40569_T2 (SEQ ID NO: 2300) | 307 | 406 |
| Z40569_T5 (SEQ ID NO: 2301) | 307 | 406 |
| Z40569_T7 (SEQ ID NO: 2302) | 429 | 528 |
| Z40569_T8 (SEQ ID NO: 2303) | 553 | 652 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2176.

TABLE 2176

Oligonucleotides related to this segment

| Oligonucleotide name | Overexpressed in cancers | Chip reference |
|---|---|---|
| R09987_0_7_0 | lung malignant tumors | LUN |

This segment can be found in the following protein(s): Z40569_P1, Z40569_P2 and Z40569_P3.

Description for Cluster Z44103

Cluster Z44103 features 8 transcript(s) and 31 segment(s) of interest, the names for which are given in Tables 2177 and 2178, respectively, the sequences themselves are given at the end of the application. The selected protein variants are given in Table 2179.

TABLE 2177

Transcripts of interest
Transcript Name

Z44103_T3 (SEQ ID NO: 2318)
Z44103_T7 (SEQ ID NO: 2319)
Z44103_T9 (SEQ ID NO: 2320)
Z44103_T10 (SEQ ID NO: 2321)
Z44103_T16 (SEQ ID NO: 2322)
Z44103_T20 (SEQ ID NO: 2323)
Z44103_T21 (SEQ ID NO: 2324)
Z44103_T29 (SEQ ID NO: 2325)

TABLE 2178

Segments of interest
Segment Name

Z44103_node_0 (SEQ ID NO: 2326)
Z44103_node_3 (SEQ ID NO: 2327)
Z44103_node_11 (SEQ ID NO: 2328)
Z44103_node_14 (SEQ ID NO: 2329)
Z44103_node_30 (SEQ ID NO: 2330)
Z44103_node_33 (SEQ ID NO: 2331)
Z44103_node_35 (SEQ ID NO: 2332)
Z44103_node_1 (SEQ ID NO: 2333)
Z44103_node_2 (SEQ ID NO: 2334)
Z44103_node_4 (SEQ ID NO: 2335)
Z44103_node_8 (SEQ ID NO: 2336)
Z44103_node_9 (SEQ ID NO: 2337)
Z44103_node_10 (SEQ ID NO: 2338)
Z44103_node_12 (SEQ ID NO: 2339)
Z44103_node_13 (SEQ ID NO: 2340)
Z44103_node_15 (SEQ ID NO: 2341)
Z44103_node_16 (SEQ ID NO: 2342)
Z44103_node_17 (SEQ ID NO: 2343)
Z44103_node_18 (SEQ ID NO: 2344)
Z44103_node_19 (SEQ ID NO: 2345)
Z44103_node_20 (SEQ ID NO: 2346)
Z44103_node_21 (SEQ ID NO: 2347)
Z44103_node_22 (SEQ ID NO: 2348)
Z44103_node_23 (SEQ ID NO: 2349)
Z44103_node_25 (SEQ ID NO: 2350)
Z44103_node_26 (SEQ ID NO: 2351)
Z44103_node_27 (SEQ ID NO: 2352)
Z44103_node_28 (SEQ ID NO: 2353)
Z44103_node_29 (SEQ ID NO: 2354)
Z44103_node_32 (SEQ ID NO: 2355)
Z44103_node_34 (SEQ ID NO: 2356)

TABLE 2179

Proteins of interest

| Protein Name | Corresponding Transcript(s) |
|---|---|
| Z44103_P1 | Z44103_T3 (SEQ ID NO: 2318); Z44103_T20 (SEQ ID NO: 2323) |
| Z44103_P4 | Z44103_T9 (SEQ ID NO: 2320) |
| Z44103_P5 | Z44103_T7 (SEQ ID NO: 2319); Z44103_T10 (SEQ ID NO: 2321) |
| Z44103_P6 | Z44103_T16 (SEQ ID NO: 2322) |
| Z44103_P9 | Z44103_T21 (SEQ ID NO: 2324) |
| Z44103_P16 | Z44103_T29 (SEQ ID NO: 2325) |

Cluster Z44103 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 57 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 57 and Table 2180. This cluster is overexpressed (at least at a minimum level) in the following pathological conditions: lung malignant tumors.

57

TABLE 2180

Normal tissue distribution

| Name of Tissue | Number |
|---|---|
| Adrenal | 40 |
| Bladder | 123 |
| Bone | 32 |
| Brain | 51 |
| Colon | 31 |
| Epithelial | 53 |
| General | 58 |
| head and neck | 0 |
| Kidney | 71 |
| Liver | 151 |
| Lung | 22 |
| lymph nodes | 99 |
| Breast | 17 |
| bone marrow | 0 |
| Muscle | 135 |
| Ovary | 7 |
| Pancreas | 43 |
| Prostate | 118 |
| Skin | 99 |
| Stomach | 36 |
| Uterus | 45 |

TABLE 2181

P values and ratios for expression in cancerous tissue

| Name of Tissue | P1 | P2 | SP1 | R3 | SP2 | R4 |
|---|---|---|---|---|---|---|
| Adrenal | 6.4e−01 | 6.9e−01 | 7.1e−01 | 1.1 | 7.8e−01 | 0.9 |
| Bladder | 7.0e−01 | 7.8e−01 | 8.8e−01 | 0.6 | 9.6e−01 | 0.5 |
| Bone | 5.5e−01 | 3.4e−01 | 1 | 0.6 | 5.3e−01 | 1.4 |
| Brain | 5.2e−01 | 4.2e−01 | 1.5e−03 | 2.0 | 2.1e−03 | 2.0 |
| Colon | 5.2e−02 | 2.3e−02 | 4.2e−01 | 1.6 | 2.4e−01 | 1.9 |
| Epithelial | 2.6e−01 | 2.3e−01 | 4.2e−01 | 1.0 | 5.0e−04 | 1.7 |
| General | 3.7e−01 | 1.1e−02 | 2.0e−01 | 1.1 | 2.9e−08 | 1.7 |
| head and neck | 1 | 5.0e−01 | 1 | 1.0 | 7.5e−01 | 1.3 |
| Kidney | 8.3e−01 | 8.6e−01 | 9.7e−01 | 0.4 | 2.5e−01 | 1.2 |
| Liver | 6.7e−01 | 8.5e−01 | 1 | 0.2 | 7.9e−01 | 0.7 |

TABLE 2181-continued

P values and ratios for expression in cancerous tissue

| Name of Tissue | P1 | P2 | SP1 | R3 | SP2 | R4 |
|---|---|---|---|---|---|---|
| Lung | 1.5e−01 | 1.1e−01 | 1.5e−02 | 3.5 | 8.2e−03 | 3.3 |
| lymph nodes | 5.9e−01 | 6.1e−01 | 2.4e−01 | 1.4 | 1.2e−02 | 1.2 |
| Breast | 6.0e−01 | 3.0e−01 | 4.7e−01 | 1.4 | 9.5e−02 | 2.0 |
| bone marrow | 4.3e−01 | 2.5e−01 | 1 | 2.1 | 1.5e−01 | 3.8 |
| Muscle | 6.9e−01 | 5.9e−01 | 1 | 0.1 | 5.3e−01 | 0.5 |
| Ovary | 4.1e−01 | 2.5e−01 | 3.2e−01 | 2.0 | 9.1e−02 | 2.6 |
| Pancreas | 5.9e−01 | 4.7e−01 | 8.0e−01 | 0.7 | 2.5e−01 | 1.1 |
| Prostate | 8.6e−01 | 8.8e−01 | 8.3e−01 | 0.4 | 5.7e−01 | 0.7 |
| Skin | 6.2e−01 | 5.8e−01 | 3.7e−01 | 1.6 | 2.3e−01 | 0.8 |
| Stomach | 5.8e−01 | 2.7e−01 | 1 | 0.5 | 1.6e−01 | 2.0 |
| Uterus | 1.6e−01 | 1.3e−01 | 5.6e−01 | 1.2 | 6.8e−01 | 1.0 |

As noted above, cluster Z44103 features 31 segment(s), which were listed in Table 2178 above and for which the sequence(s) are given at the end of the application. These segment(s) are portions of nucleic acid sequence(s) which are described herein separately because they are of particular interest. A description of each segment according to the present invention is now provided.

Segment cluster Z44103_node_0 (SEQ ID NO:2326) according to the present invention is supported by 109 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), (SEQ ID NO:2323), Z44103_T21 (SEQ ID NO:2324) and Z44103_T29 (SEQ ID NO:2325). Table 2182 below describes the starting and ending position of this segment on each transcript.

TABLE 2182

Segment location on transcripts

| Transcript name | Segment starting position | Segment ending position |
|---|---|---|
| Z44103_T3 (SEQ ID NO: 2318) | 1 | 722 |
| Z44103_T7 (SEQ ID NO: 2319) | 1 | 722 |
| Z44103_T9 (SEQ ID NO: 2320) | 1 | 722 |
| Z44103_T10 (SEQ ID NO: 2321) | 1 | 722 |
| Z44103_T16 (SEQ ID NO: 2322) | 1 | 722 |
| Z44103_T20 (SEQ ID NO: 2323) | 1 | 722 |
| Z44103_T21 (SEQ ID NO: 2324) | 1 | 722 |
| Z44103_T29 (SEQ ID NO: 2325) | 1 | 722 |

This segment can be found in a non-coding region of transcript(s) that are related to the following protein(s): Z44103_P1, Z44103_P5, Z44103_P4, Z44103_P6, Z44103_P9 and Z44103_P16.

Segment cluster Z44103_node_3 (SEQ ID NO:2327) according to the present invention is supported by 20 libraries. The number of libraries was determined as previously described. This segment can be found in the following transcript(s): Z44103_T3 (SEQ ID NO:2318), Z44103_T9 (SEQ ID NO:2320), Z44103_T10 (SEQ ID NO:2321), Z44103_T20 (SEQ ID NO:2323), Z44103_T21 (SEQ ID NO:2324) and Z44103_T29 (SEQ ID NO:2325). Table 2183 below describes the starting and ending position of this segment on each transcript.

TABLE 2183

Segment location on transcripts

| Transcript name | Segment starting position | Segment ending position |
|---|---|---|
| Z44103_T3 (SEQ ID NO: 2318) | 750 | 872 |
| Z44103_T9 (SEQ ID NO: 2320) | 750 | 872 |
| Z44103_T10 (SEQ ID NO: 2321) | 750 | 872 |
| Z44103_T20 (SEQ ID NO: 2323) | 750 | 872 |
| Z44103_T21 (SEQ ID NO: 2324) | 750 | 872 |
| Z44103_T29 (SEQ ID NO: 2325) | 750 | 872 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2184.

TABLE 2184

Oligonucleotides related to this segment

| Oligonucleotide name | Overexpressed in cancers | Chip reference |
|---|---|---|
| Z44103_0_0_71916 | breast malignant tumors | BRS |
| Z44103_0_0_71916 | lung malignant tumors | LUN |

This segment can be found in both coding and non-coding regions of transcript(s) as follows. The segment can be found in a non-coding region of transcript(s) that are related to the following protein(s): Z44103_P4, Z44103_P5, Z44103_P9 and Z44103_P16. This segment can also be found in the following protein(s): Z44103_P1, since it is in the coding region for the corresponding transcript.

Segment cluster Z44103_node_11 (SEQ ID NO:2328) according to the present invention is supported by 7 libraries. The number of libraries was determined as previously described. This segment can be found in the following transcript(s): Z44103_T7 (SEQ ID NO:2319), Z44103_T10 (SEQ ID NO:2321) and Z44103_T16 (SEQ ID NO:2322). Table 2185 below describes the starting and ending position of this segment on each transcript.

TABLE 2185

Segment location on transcripts

| Transcript name | Segment starting position | Segment ending position |
|---|---|---|
| Z44103_T7 (SEQ ID NO: 2319) | 929 | 1578 |
| Z44103_T10 (SEQ ID NO: 2321) | 1079 | 1728 |
| Z44103_T16 (SEQ ID NO: 2322) | 929 | 1578 |

This segment can be found in both coding and non-coding regions of transcript(s) as follows. The segment can be found in a non-coding region of transcript(s) that are related to the following protein(s): Z44103_P6. This segment can also be found in the following protein(s): Z44103_P5, since it is in the coding region for the corresponding transcript.

Segment cluster Z44103_node_14 (SEQ ID NO:2329) according to the present invention is supported by 183 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2186 below describes the starting and ending position of this segment on each transcript.

TABLE 2186

Segment location on transcripts

| Transcript name | Segment starting position | Segment ending position |
|---|---|---|
| Z44103_T3 (SEQ ID NO: 2318) | 1176 | 1295 |
| Z44103_T7 (SEQ ID NO: 2319) | 1689 | 1808 |
| Z44103_T9 (SEQ ID NO: 2320) | 1189 | 1308 |
| Z44103_T10 (SEQ ID NO: 2321) | 1839 | 1958 |
| Z44103_T16 (SEQ ID NO: 2322) | 1770 | 1889 |
| Z44103_T20 (SEQ ID NO: 2323) | 1176 | 1295 |
| Z44103_T21 (SEQ ID NO: 2324) | 1176 | 1295 |
| Z44103_T29 (SEQ ID NO: 2325) | 1176 | 1295 |

This segment can be found in the following protein(s): Z44103_P1, Z44103_P5, Z44103_P4, Z44103_P6, Z44103_P9 and Z44103_P16.

Segment cluster Z44103_node_30 (SEQ ID NO:2330) according to the present invention is supported by 184 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), (SEQ ID NO:2323), Z44103_T21 (SEQ ID NO:2324) and (SEQ ID NO:2325). Table 2187 below describes the starting and ending position of this segment on each transcript.

TABLE 2187

Segment location on transcripts

| Transcript name | Segment starting position | Segment ending position |
|---|---|---|
| Z44103_T3 (SEQ ID NO: 2318) | 1727 | 2182 |
| Z44103_T7 (SEQ ID NO: 2319) | 2240 | 2695 |
| Z44103_T9 (SEQ ID NO: 2320) | 1740 | 2195 |
| Z44103_T10 (SEQ ID NO: 2321) | 2390 | 2845 |
| Z44103_T16 (SEQ ID NO: 2322) | 2321 | 2776 |
| Z44103_T20 (SEQ ID NO: 2323) | 1727 | 1901 |
| Z44103_T21 (SEQ ID NO: 2324) | 1971 | 2426 |
| Z44103_T29 (SEQ ID NO: 2325) | 1572 | 2027 |

This segment can be found in the following protein(s): Z44103_P1, Z44103_P5, Z44103_P4, Z44103_P6, Z44103_P9 and Z44103_P16.

Segment cluster Z44103_node_33 (SEQ ID NO:2331) according to the present invention is supported by 59 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T21 (SEQ ID NO:2324) and Z44103_T29 (SEQ ID NO:2325). Table 2188 below describes the starting and ending position of this segment on each transcript.

TABLE 2188

Segment location on transcripts

| Transcript name | Segment starting position | Segment ending position |
|---|---|---|
| Z44103_T3 (SEQ ID NO: 2318) | 2196 | 2315 |
| Z44103_T7 (SEQ ID NO: 2319) | 2709 | 2828 |
| Z44103_T9 (SEQ ID NO: 2320) | 2209 | 2328 |
| Z44103_T10 (SEQ ID NO: 2321) | 2859 | 2978 |
| Z44103_T16 (SEQ ID NO: 2322) | 2790 | 2909 |
| Z44103_T21 (SEQ ID NO: 2324) | 2440 | 2559 |
| Z44103_T29 (SEQ ID NO: 2325) | 2041 | 2160 |

This segment can be found in a non-coding region of transcript(s) that are related to the following protein(s): Z44103_P1, Z44103_P5, Z44103_P4, Z44103_P6, Z44103_P9 and Z44103_P16.

Segment cluster Z44103_node_35 (SEQ ID NO:2332) according to the present invention is supported by 104 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T21 (SEQ ID NO:2324) and Z44103_T29 (SEQ ID NO:2325). Table 2189 below describes the starting and ending position of this segment on each transcript.

TABLE 2189

Segment location on transcripts

| Transcript name | Segment starting position | Segment ending position |
|---|---|---|
| Z44103_T3 (SEQ ID NO: 2318) | 2371 | 3087 |
| Z44103_T7 (SEQ ID NO: 2319) | 2884 | 3600 |
| Z44103_T9 (SEQ ID NO: 2320) | 2384 | 3100 |
| Z44103_T10 (SEQ ID NO: 2321) | 3034 | 3750 |
| Z44103_T16 (SEQ ID NO: 2322) | 2965 | 3681 |
| Z44103_T21 (SEQ ID NO: 2324) | 2615 | 3331 |
| Z44103_T29 (SEQ ID NO: 2325) | 2216 | 2932 |

This segment can be found in a non-coding region of transcript(s) that are related to the following protein(s): Z44103_P1, Z44103_P5, Z44103_P4, Z44103_P6, Z44103_P9 and Z44103_P16.

According to an optional embodiment of the present invention, short segments related to the above cluster are also provided. These segments are up to about 120 bp in length, and so are included in a separate description.

Segment cluster Z44103_node_1 (SEQ ID NO:2333) according to the present invention can be found in the following transcript(s): Z44103_T3 (SEQ ID NO:2318), Z44103_T9 (SEQ ID NO:2320), Z44103_T10 (SEQ ID NO:2321), Z44103_T20 (SEQ ID NO:2323), Z44103_T21 (SEQ ID NO:2324) and Z44103_T29 (SEQ ID NO:2325). Table 2190 below describes the starting and ending position of this segment on each transcript.

TABLE 2190

Segment location on transcripts

| Transcript name | Segment starting position | Segment ending position |
|---|---|---|
| Z44103_T3 (SEQ ID NO: 2318) | 723 | 744 |
| Z44103_T9 (SEQ ID NO: 2320) | 723 | 744 |

TABLE 2190-continued

Segment location on transcripts

| Transcript name | Segment starting position | Segment ending position |
|---|---|---|
| Z44103_T10 (SEQ ID NO: 2321) | 723 | 744 |
| Z44103_T20 (SEQ ID NO: 2323) | 723 | 744 |
| Z44103_T21 (SEQ ID NO: 2324) | 723 | 744 |
| Z44103_T29 (SEQ ID NO: 2325) | 723 | 744 |

This segment can be found in a non-coding region of transcript(s) that are related to the following protein(s): Z44103_P1, Z44103_P4, Z44103_P5, Z44103_P9 and Z44103_P16.

Segment cluster Z44103_node_2 (SEQ ID NO:2334) according to the present invention can be found in the following transcript(s): Z44103_T3 (SEQ ID NO:2318), Z44103_T9 (SEQ ID NO:2320), Z44103_T10 (SEQ ID NO:2321), Z44103_T20 (SEQ ID NO:2323), Z44103_T21 (SEQ ID NO:2324) and Z44103_T29 (SEQ ID NO:2325). Table 2191 below describes the starting and ending position of this segment on each transcript.

TABLE 2191

Segment location on transcripts

| Transcript name | Segment starting position | Segment ending position |
|---|---|---|
| Z44103_T3 (SEQ ID NO: 2318) | 745 | 749 |
| Z44103_T9 (SEQ ID NO: 2320) | 745 | 749 |
| Z44103_T10 (SEQ ID NO: 2321) | 745 | 749 |
| Z44103_T20 (SEQ ID NO: 2323) | 745 | 749 |
| Z44103_T21 (SEQ ID NO: 2324) | 745 | 749 |
| Z44103_T29 (SEQ ID NO: 2325) | 745 | 749 |

This segment can be found in a non-coding region of transcript(s) that are related to the following protein(s): Z44103_P1, Z44103_P4, Z44103_P5, Z44103_P9 and Z44103_P16.

Segment cluster Z44103_node_4 (SEQ ID NO:2335) according to the present invention is supported by 169 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2192 below describes the starting and ending position of this segment on each transcript.

TABLE 2192

Segment location on transcripts

| Transcript name | Segment starting position | Segment ending position |
|---|---|---|
| Z44103_T3 (SEQ ID NO: 2318) | 873 | 981 |
| Z44103_T7 (SEQ ID NO: 2319) | 723 | 831 |
| Z44103_T9 (SEQ ID NO: 2320) | 873 | 981 |
| Z44103_T10 (SEQ ID NO: 2321) | 873 | 981 |
| Z44103_T16 (SEQ ID NO: 2322) | 723 | 831 |
| Z44103_T20 (SEQ ID NO: 2323) | 873 | 981 |
| Z44103_T21 (SEQ ID NO: 2324) | 873 | 981 |
| Z44103_T29 (SEQ ID NO: 2325) | 873 | 981 |

This segment can be found in both coding and non-coding regions of transcript(s) as follows. The segment can be found in a non-coding region of transcript(s) that are related to the following protein(s): Z44103_P5, Z44103_P4, Z44103_P6, Z44103_P9 and Z44103_P16. This segment can also be found in the following protein(s): Z44103_P1, since it is in the coding region for the corresponding transcript.

Segment cluster Z44103_node_8 (SEQ ID NO:2336) according to the present invention is supported by 169 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2193 below describes the starting and ending position of this segment on each transcript.

TABLE 2193

Segment location on transcripts

| Transcript name | Segment starting position | Segment ending position |
|---|---|---|
| Z44103_T3 (SEQ ID NO: 2318) | 982 | 1059 |
| Z44103_T7 (SEQ ID NO: 2319) | 832 | 909 |
| Z44103_T9 (SEQ ID NO: 2320) | 982 | 1059 |
| Z44103_T10 (SEQ ID NO: 2321) | 982 | 1059 |
| Z44103_T16 (SEQ ID NO: 2322) | 832 | 909 |
| Z44103_T20 (SEQ ID NO: 2323) | 982 | 1059 |
| Z44103_T21 (SEQ ID NO: 2324) | 982 | 1059 |
| Z44103_T29 (SEQ ID NO: 2325) | 982 | 1059 |

This segment can be found in both coding and non-coding regions of transcript(s) as follows. The segment can be found in a non-coding region of transcript(s) that are related to the following protein(s): Z44103_P5, Z44103_P6, Z44103_P9 and Z44103_P16. This segment can also be found in the following protein(s): Z44103_P1 and Z44103_P4, since it is in the coding region for the corresponding transcript.

Segment cluster Z44103_node_9 (SEQ ID NO:2337) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2194 below describes the starting and ending position of this segment on each transcript.

TABLE 2194

Segment location on transcripts

| Transcript name | Segment starting position | Segment ending position |
|---|---|---|
| Z44103_T3 (SEQ ID NO: 2318) | 1060 | 1065 |
| Z44103_T7 (SEQ ID NO: 2319) | 910 | 915 |
| Z44103_T9 (SEQ ID NO: 2320) | 1060 | 1065 |
| Z44103_T10 (SEQ ID NO: 2321) | 1060 | 1065 |
| Z44103_T16 (SEQ ID NO: 2322) | 910 | 915 |
| Z44103_T20 (SEQ ID NO: 2323) | 1060 | 1065 |
| Z44103_T21 (SEQ ID NO: 2324) | 1060 | 1065 |
| Z44103_T29 (SEQ ID NO: 2325) | 1060 | 1065 |

This segment can be found in both coding and non-coding regions of transcript(s) as follows. The segment can be found in a non-coding region of transcript(s) that are related to the following protein(s): Z44103_P5, Z44103_P6, Z44103_P9 and Z44103_P16. This segment can also be found in the following protein(s): Z44103_P1 and Z44103_P4, since it is in the coding region for the corresponding transcript.

Segment cluster Z44103_node__10 (SEQ ID NO:2338) according to the present invention can be found in the following transcript(s): Z44103_T7 (SEQ ID NO:2319), Z44103_T9 (SEQ ID NO:2320), Z44103_T10 (SEQ ID NO:2321) and Z44103_T16 (SEQ ID NO:2322). Table 2195 below describes the starting and ending position of this segment on each transcript.

TABLE 2195

| Segment location on transcripts | | |
|---|---|---|
| Transcript name | Segment starting position | Segment ending position |
| Z44103_T7 (SEQ ID NO: 2319) | 916 | 928 |
| Z44103_T9 (SEQ ID NO: 2320) | 1066 | 1078 |
| Z44103_T10 (SEQ ID NO: 2321) | 1066 | 1078 |
| Z44103_T16 (SEQ ID NO: 2322) | 916 | 928 |

This segment can be found in both coding and non-coding regions of transcript(s) as follows. The segment can be found in a non-coding region of transcript(s) that are related to the following protein(s): Z44103_P5 and Z44103_P6. This segment can also be found in the following protein(s): Z44103_P4, since it is in the coding region for the corresponding transcript.

Segment cluster Z44103_node__12 (SEQ ID NO:2339) according to the present invention is supported by 167 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), (SEQ ID NO:2323), Z44103_T21 (SEQ ID NO:2324) and (SEQ ID NO:2325). Table 2196 below describes the starting and ending position of this segment on each transcript.

TABLE 2196

| Segment location on transcripts | | |
|---|---|---|
| Transcript name | Segment starting position | Segment ending position |
| Z44103_T3 (SEQ ID NO: 2318) | 1066 | 1175 |
| Z44103_T7 (SEQ ID NO: 2319) | 1579 | 1688 |
| Z44103_T9 (SEQ ID NO: 2320) | 1079 | 1188 |
| Z44103_T10 (SEQ ID NO: 2321) | 1729 | 1838 |
| Z44103_T16 (SEQ ID NO: 2322) | 1579 | 1688 |
| Z44103_T20 (SEQ ID NO: 2323) | 1066 | 1175 |
| Z44103_T21 (SEQ ID NO: 2324) | 1066 | 1175 |
| Z44103_T29 (SEQ ID NO: 2325) | 1066 | 1175 |

This segment can be found in both coding and non-coding regions of transcript(s) as follows. The segment can be found in a non-coding region of transcript(s) that are related to the following protein(s): Z44103_P6, Z44103_P9 and Z44103_P16. This segment can also be found in the following protein(s): Z44103_P1, Z44103_P5 and Z44103_P4, since it is in the coding region for the corresponding transcript.

Segment cluster Z44103_node__13 (SEQ ID NO:2340) according to the present invention is supported by 5 libraries. The number of libraries was determined as previously described. This segment can be found in the following transcript(s): Z44103_T16 (SEQ ID NO:2322). Table 2197 below describes the starting and ending position of this segment on each transcript.

TABLE 2197

| Segment location on transcripts | | |
|---|---|---|
| Transcript name | Segment starting position | Segment ending position |
| Z44103_T16 (SEQ ID NO: 2322) | 1689 | 1769 |

This segment can be found in a non-coding region of transcript(s) that are related to the following protein(s): Z44103_P6.

Segment cluster Z44103_node__15 (SEQ ID NO:2341) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2198 below describes the starting and ending position of this segment on each transcript.

TABLE 2198

| Segment location on transcripts | | |
|---|---|---|
| Transcript name | Segment starting position | Segment ending position |
| Z44103_T3 (SEQ ID NO: 2318) | 1296 | 1308 |
| Z44103_T7 (SEQ ID NO: 2319) | 1809 | 1821 |
| Z44103_T9 (SEQ ID NO: 2320) | 1309 | 1321 |
| Z44103_T10 (SEQ ID NO: 2321) | 1959 | 1971 |
| Z44103_T16 (SEQ ID NO: 2322) | 1890 | 1902 |
| Z44103_T20 (SEQ ID NO: 2323) | 1296 | 1308 |
| Z44103_T21 (SEQ ID NO: 2324) | 1296 | 1308 |
| Z44103_T29 (SEQ ID NO: 2325) | 1296 | 1308 |

This segment can be found in the following protein(s): Z44103_P1, Z44103_P5, Z44103_P4, Z44103_P6, Z44103_P9 and Z44103_P16.

Segment cluster Z44103_node__16 (SEQ ID NO:2342) according to the present invention is supported by 10 libraries. The number of libraries was determined as previously described. This segment can be found in the following transcript(s): Z44103_T21 (SEQ ID NO:2324). Table 2199 below describes the starting and ending position of this segment on each transcript.

TABLE 2199

| Segment location on transcripts | | |
|---|---|---|
| Transcript name | Segment starting position | Segment ending position |
| Z44103_T21 (SEQ ID NO: 2324) | 1309 | 1387 |

This segment can be found in the following protein(s): Z44103_P9.

Segment cluster Z44103_node__17 (SEQ ID NO:2343) according to the present invention is supported by 181 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323) and Z44103_T21 (SEQ ID NO:2324). Table 2200 below describes the starting and ending position of this segment on each transcript.

TABLE 2200

Segment location on transcripts

| Transcript name | Segment starting position | Segment ending position |
|---|---|---|
| Z44103_T3 (SEQ ID NO: 2318) | 1309 | 1385 |
| Z44103_T7 (SEQ ID NO: 2319) | 1822 | 1898 |
| Z44103_T9 (SEQ ID NO: 2320) | 1322 | 1398 |
| Z44103_T10 (SEQ ID NO: 2321) | 1972 | 2048 |
| Z44103_T16 (SEQ ID NO: 2322) | 1903 | 1979 |
| Z44103_T20 (SEQ ID NO: 2323) | 1309 | 1385 |
| Z44103_T21 (SEQ ID NO: 2324) | 1388 | 1464 |

This segment can be found in the following protein(s): Z44103_P1, Z44103_P5, Z44103_P4, Z44103_P6 and Z44103_P9.

Segment cluster Z44103_node_18 (SEQ ID NO:2344) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323) and Z44103_T21 (SEQ ID NO:2324). Table 2201 below describes the starting and ending position of this segment on each transcript.

TABLE 2201

Segment location on transcripts

| Transcript name | Segment starting position | Segment ending position |
|---|---|---|
| Z44103_T3 (SEQ ID NO: 2318) | 1386 | 1394 |
| Z44103_T7 (SEQ ID NO: 2319) | 1899 | 1907 |
| Z44103_T9 (SEQ ID NO: 2320) | 1399 | 1407 |
| Z44103_T10 (SEQ ID NO: 2321) | 2049 | 2057 |
| Z44103_T16 (SEQ ID NO: 2322) | 1980 | 1988 |
| Z44103_T20 (SEQ ID NO: 2323) | 1386 | 1394 |
| Z44103_T21 (SEQ ID NO: 2324) | 1465 | 1473 |

This segment can be found in the following protein(s): Z44103_P1, Z44103_P5, Z44103_P4, Z44103_P6 and Z44103_P9.

Segment cluster Z44103_node_19 (SEQ ID NO:2345) according to the present invention is supported by 178 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323) and Z44103_T21 (SEQ ID NO:2324). Table 2202 below describes the starting and ending position of this segment on each transcript.

TABLE 2202

Segment location on transcripts

| Transcript name | Segment starting position | Segment ending position |
|---|---|---|
| Z44103_T3 (SEQ ID NO: 2318) | 1395 | 1463 |
| Z44103_T7 (SEQ ID NO: 2319) | 1908 | 1976 |
| Z44103_T9 (SEQ ID NO: 2320) | 1408 | 1476 |
| Z44103_T10 (SEQ ID NO: 2321) | 2058 | 2126 |

TABLE 2202-continued

Segment location on transcripts

| Transcript name | Segment starting position | Segment ending position |
|---|---|---|
| Z44103_T16 (SEQ ID NO: 2322) | 1989 | 2057 |
| Z44103_T20 (SEQ ID NO: 2323) | 1395 | 1463 |
| Z44103_T21 (SEQ ID NO: 2324) | 1474 | 1542 |

This segment can be found in the following protein(s): Z44103_P1, Z44103_P5, Z44103_P4, Z44103_P6 and Z44103_P9.

Segment cluster Z44103_node_20 (SEQ ID NO:2346) according to the present invention is supported by 11 libraries. The number of libraries was determined as previously described. This segment can be found in the following transcript(s): Z44103_T21 (SEQ ID NO:2324). Table 2203 below describes the starting and ending position of this segment on each transcript.

TABLE 2203

Segment location on transcripts

| Transcript name | Segment starting position | Segment ending position |
|---|---|---|
| Z44103_T21 (SEQ ID NO: 2324) | 1543 | 1626 |

This segment can be found in the following protein(s): Z44103_P9.

Segment cluster Z44103_node_21 (SEQ ID NO:2347) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2204 below describes the starting and ending position of this segment on each transcript.

TABLE 2204

Segment location on transcripts

| Transcript name | Segment starting position | Segment ending position |
|---|---|---|
| Z44103_T3 (SEQ ID NO: 2318) | 1464 | 1472 |
| Z44103_T7 (SEQ ID NO: 2319) | 1977 | 1985 |
| Z44103_T9 (SEQ ID NO: 2320) | 1477 | 1485 |
| Z44103_T10 (SEQ ID NO: 2321) | 2127 | 2135 |
| Z44103_T16 (SEQ ID NO: 2322) | 2058 | 2066 |
| Z44103_T20 (SEQ ID NO: 2323) | 1464 | 1472 |
| Z44103_T21 (SEQ ID NO: 2324) | 1627 | 1635 |
| Z44103_T29 (SEQ ID NO: 2325) | 1309 | 1317 |

This segment can be found in the following protein(s): Z44103_P1, Z44103_P5, Z44103_P4, Z44103_P6, Z44103_P9 and Z44103_P16.

Segment cluster Z44103_node_22 (SEQ ID NO:2348) according to the present invention is supported by 174 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2205 below describes the starting and ending position of this segment on each transcript.

TABLE 2205

Segment location on transcripts

| Transcript name | Segment starting position | Segment ending position |
| --- | --- | --- |
| Z44103_T3 (SEQ ID NO: 2318) | 1473 | 1525 |
| Z44103_T7 (SEQ ID NO: 2319) | 1986 | 2038 |
| Z44103_T9 (SEQ ID NO: 2320) | 1486 | 1538 |
| Z44103_T10 (SEQ ID NO: 2321) | 2136 | 2188 |
| Z44103_T16 (SEQ ID NO: 2322) | 2067 | 2119 |
| Z44103_T20 (SEQ ID NO: 2323) | 1473 | 1525 |
| Z44103_T21 (SEQ ID NO: 2324) | 1636 | 1688 |
| Z44103_T29 (SEQ ID NO: 2325) | 1318 | 1370 |

This segment can be found in the following protein(s): Z44103_P1, Z44103_P5, Z44103_P4, Z44103_P6, Z44103_P9 and Z44103_P16.

Segment cluster Z44103_node__23 (SEQ ID NO:2349) according to the present invention is supported by 165 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2206 below describes the starting and ending position of this segment on each transcript.

TABLE 2206

Segment location on transcripts

| Transcript name | Segment starting position | Segment ending position |
| --- | --- | --- |
| Z44103_T3 (SEQ ID NO: 2318) | 1526 | 1558 |
| Z44103_T7 (SEQ ID NO: 2319) | 2039 | 2071 |
| Z44103_T9 (SEQ ID NO: 2320) | 1539 | 1571 |
| Z44103_T10 (SEQ ID NO: 2321) | 2189 | 2221 |
| Z44103_T16 (SEQ ID NO: 2322) | 2120 | 2152 |
| Z44103_T20 (SEQ ID NO: 2323) | 1526 | 1558 |
| Z44103_T21 (SEQ ID NO: 2324) | 1689 | 1721 |
| Z44103_T29 (SEQ ID NO: 2325) | 1371 | 1403 |

This segment can be found in the following protein(s): Z44103_P1, Z44103_P5, Z44103_P4, Z44103_P6, Z44103_P9 and Z44103_P16.

Segment cluster Z44103_node__25 (SEQ ID NO:2350) according to the present invention is supported by 167 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2207 below describes the starting and ending position of this segment on each transcript.

TABLE 2207

Segment location on transcripts

| Transcript name | Segment starting position | Segment ending position |
| --- | --- | --- |
| Z44103_T3 (SEQ ID NO: 2318) | 1559 | 1607 |
| Z44103_T7 (SEQ ID NO: 2319) | 2072 | 2120 |
| Z44103_T9 (SEQ ID NO: 2320) | 1572 | 1620 |
| Z44103_T10 (SEQ ID NO: 2321) | 2222 | 2270 |
| Z44103_T16 (SEQ ID NO: 2322) | 2153 | 2201 |
| Z44103_T20 (SEQ ID NO: 2323) | 1559 | 1607 |
| Z44103_T21 (SEQ ID NO: 2324) | 1722 | 1770 |
| Z44103_T29 (SEQ ID NO: 2325) | 1404 | 1452 |

This segment can be found in the following protein(s): Z44103_P1, Z44103_P5, Z44103_P4, Z44103_P6, Z44103_P9 and Z44103_P16.

Segment cluster Z44103_node__26 (SEQ ID NO:2351) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2208 below describes the starting and ending position of this segment on each transcript.

TABLE 2208

Segment location on transcripts

| Transcript name | Segment starting position | Segment ending position |
| --- | --- | --- |
| Z44103_T3 (SEQ ID NO: 2318) | 1608 | 1632 |
| Z44103_T7 (SEQ ID NO: 2319) | 2121 | 2145 |
| Z44103_T9 (SEQ ID NO: 2320) | 1621 | 1645 |
| Z44103_T10 (SEQ ID NO: 2321) | 2271 | 2295 |
| Z44103_T16 (SEQ ID NO: 2322) | 2202 | 2226 |
| Z44103_T20 (SEQ ID NO: 2323) | 1608 | 1632 |
| Z44103_T21 (SEQ ID NO: 2324) | 1771 | 1795 |
| Z44103_T29 (SEQ ID NO: 2325) | 1453 | 1477 |

This segment can be found in the following protein(s): Z44103_P1, Z44103_P5, Z44103_P4, Z44103_P6, Z44103_P9 and Z44103_P16.

Segment cluster Z44103_node__27 (SEQ ID NO:2352) according to the present invention is supported by 6 libraries. The number of libraries was determined as previously described. This segment can be found in the following transcript(s): Z44103_T21 (SEQ ID NO:2324). Table 2209 below describes the starting and ending position of this segment on each transcript.

TABLE 2209

Segment location on transcripts

| Transcript name | Segment starting position | Segment ending position |
| --- | --- | --- |
| Z44103_T21 (SEQ ID NO: 2324) | 1796 | 1876 |

This segment can be found in the following protein(s): Z44103_P9.

Segment cluster Z44103_node__28 (SEQ ID NO:2353) according to the present invention is supported by 167 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), (SEQ ID NO:2323), Z44103_T21 (SEQ ID NO:2324) and (SEQ ID NO:2325). Table 2210 below describes the starting and ending position of this segment on each transcript.

TABLE 2210

Segment location on transcripts

| Transcript name | Segment starting position | Segment ending position |
| --- | --- | --- |
| Z44103_T3 (SEQ ID NO: 2318) | 1633 | 1716 |
| Z44103_T7 (SEQ ID NO: 2319) | 2146 | 2229 |
| Z44103_T9 (SEQ ID NO: 2320) | 1646 | 1729 |
| Z44103_T10 (SEQ ID NO: 2321) | 2296 | 2379 |
| Z44103_T16 (SEQ ID NO: 2322) | 2227 | 2310 |
| Z44103_T20 (SEQ ID NO: 2323) | 1633 | 1716 |
| Z44103_T21 (SEQ ID NO: 2324) | 1877 | 1960 |
| Z44103_T29 (SEQ ID NO: 2325) | 1478 | 1561 |

This segment can be found in the following protein(s): Z44103_P1, Z44103_P5, Z44103_P4, Z44103_P6, Z44103_P9 and Z44103_P16.

Segment cluster Z44103_node_29 (SEQ ID NO:2354) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T20 (SEQ ID NO:2323), Z44103_T21 (SEQ ID NO:2324) and Z44103_T29 (SEQ ID NO:2325). Table 2211 below describes the starting and ending position of this segment on each transcript.

TABLE 2211

Segment location on transcripts

| Transcript name | Segment starting position | Segment ending position |
| --- | --- | --- |
| Z44103_T3 (SEQ ID NO: 2318) | 1717 | 1726 |
| Z44103_T7 (SEQ ID NO: 2319) | 2230 | 2239 |
| Z44103_T9 (SEQ ID NO: 2320) | 1730 | 1739 |
| Z44103_T10 (SEQ ID NO: 2321) | 2380 | 2389 |
| Z44103_T16 (SEQ ID NO: 2322) | 2311 | 2320 |
| Z44103_T20 (SEQ ID NO: 2323) | 1717 | 1726 |
| Z44103_T21 (SEQ ID NO: 2324) | 1961 | 1970 |
| Z44103_T29 (SEQ ID NO: 2325) | 1562 | 1571 |

This segment can be found in the following protein(s): Z44103_P1, Z44103_P5, Z44103_P4, Z44103_P6, Z44103_P9 and Z44103_P16.

Segment cluster Z44103_node_32 (SEQ ID NO:2355) according to the present invention can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T21 (SEQ ID NO:2324) and Z44103_T29 (SEQ ID NO:2325). Table 2212 below describes the starting and ending position of this segment on each transcript.

TABLE 2212

Segment location on transcripts

| Transcript name | Segment starting position | Segment ending position |
| --- | --- | --- |
| Z44103_T3 (SEQ ID NO: 2318) | 2183 | 2195 |
| Z44103_T7 (SEQ ID NO: 2319) | 2696 | 2708 |
| Z44103_T9 (SEQ ID NO: 2320) | 2196 | 2208 |
| Z44103_T10 (SEQ ID NO: 2321) | 2846 | 2858 |
| Z44103_T16 (SEQ ID NO: 2322) | 2777 | 2789 |
| Z44103_T21 (SEQ ID NO: 2324) | 2427 | 2439 |
| Z44103_T29 (SEQ ID NO: 2325) | 2028 | 2040 |

This segment can be found in a non-coding region of transcript(s) that are related to the following protein(s): Z44103_P1, Z44103_P5, Z44103_P4, Z44103_P6, Z44103_P9 and Z44103_P16.

Segment cluster Z44103_node_34 (SEQ ID NO:2356) according to the present invention is supported by 48 libraries. The number of libraries was determined as previously described. This segment can be found in the following transcript(s): Z44103_T3 (SEQ ID NO:2318), Z44103_T7 (SEQ ID NO:2319), Z44103_T9 (SEQ ID NO:2320), Z44103_T10 (SEQ ID NO:2321), Z44103_T16 (SEQ ID NO:2322), Z44103_T21 (SEQ ID NO:2324) and Z44103_T29 (SEQ ID NO:2325). Table 2213 below describes the starting and ending position of this segment on each transcript.

TABLE 2213

Segment location on transcripts

| Transcript name | Segment starting position | Segment ending position |
| --- | --- | --- |
| Z44103_T3 (SEQ ID NO: 2318) | 2316 | 2370 |
| Z44103_T7 (SEQ ID NO: 2319) | 2829 | 2883 |
| Z44103_T9 (SEQ ID NO: 2320) | 2329 | 2383 |
| Z44103_T10 (SEQ ID NO: 2321) | 2979 | 3033 |
| Z44103_T16 (SEQ ID NO: 2322) | 2910 | 2964 |
| Z44103_T21 (SEQ ID NO: 2324) | 2560 | 2614 |
| Z44103_T29 (SEQ ID NO: 2325) | 2161 | 2215 |

This segment can be found in a non-coding region of transcript(s) that are related to the following protein(s): Z44103_P1, Z44103_P5, Z44103_P4, Z44103_P6, Z44103_P9 and Z44103_P16.

Description for Cluster AA056634

Cluster AA056634 features 8 transcript(s) and 17 segment (s) of interest, the names for which are given in Tables 2214 and 2215, respectively, the sequences themselves are given at the end of the application. The selected protein variants are given in Table 2216.

TABLE 2214

| Transcripts of interest Transcript Name |
| --- |
| AA056634_T1 (SEQ ID NO: 2357) |
| AA056634_T2 (SEQ ID NO: 2358) |
| AA056634_T3 (SEQ ID NO: 2359) |
| AA056634_T4 (SEQ ID NO: 2360) |
| AA056634_T5 (SEQ ID NO: 2361) |
| AA056634_T9 (SEQ ID NO: 2362) |
| AA056634_T14 (SEQ ID NO: 2363) |
| AA056634_T15 (SEQ ID NO: 2364) |

TABLE 2215

Segments of interest

Segment Name

AA056634_node_0 (SEQ ID NO: 2365)
AA056634_node_3 (SEQ ID NO: 2366)
AA056634_node_5 (SEQ ID NO: 2367)
AA056634_node_12 (SEQ ID NO: 2368)
AA056634_node_14 (SEQ ID NO: 2369)
AA056634_node_16 (SEQ ID NO: 2370)
AA056634_node_20 (SEQ ID NO: 2371)
AA056634_node_21 (SEQ ID NO: 2372)
AA056634_node_22 (SEQ ID NO: 2373)
AA056634_node_23 (SEQ ID NO: 2374)
AA056634_node_24 (SEQ ID NO: 2375)
AA056634_node_1 (SEQ ID NO: 2376)
AA056634_node_6 (SEQ ID NO: 2377)
AA056634_node_7 (SEQ ID NO: 2378)
AA056634_node_11 (SEQ ID NO: 2379)
AA056634_node_18 (SEQ ID NO: 2380)
AA056634_node_19 (SEQ ID NO: 2381)

TABLE 2216

Proteins of interest

| Protein Name | Corresponding Transcript(s) |
|---|---|
| AA056634_P1 | AA056634_T4 (SEQ ID NO: 2360); AA056634_T5 (SEQ ID NO: 2361) |
| AA056634_P2 | AA056634_T9 (SEQ ID NO: 2362) |
| AA056634_P5 | AA056634_T14 (SEQ ID NO: 2363); AA056634_T15 (SEQ ID NO: 2364) |
| AA056634_P6 | AA056634_T1 (SEQ ID NO: 2357) |

These sequences are variants of the known protein Pituitary homeobox 1 (SwissProt accession identifier PIX1_HUMAN; known also according to the synonyms Hindlimb expressed homeobox protein backfoot), referred to herein as the previously known protein.

Protein Pituitary homeobox 1 is known or believed to have the following function(s): May play a role in the development of anterior structures, and in particular, the brain and facies and in specifying the identity or structure of hindlimb. The sequence for protein Pituitary homeobox 1 is given at the end of the application, as "Pituitary homeobox 1 amino acid sequence". Known polymorphisms for this sequence are as shown in Table 2217.

TABLE 2217

Amino acid mutations for Known Protein

| SNP position(s) on amino acid sequence | Comment |
|---|---|
| 17 | F -> L |
| 299 | G -> A |

Protein Pituitary homeobox 1 localization is believed to be Nuclear.

The following GO Annotation(s) apply to the previously known protein. The following annotation(s) were found: skeletal development; transcription regulation; morphogenesis, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster AA056634 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 58 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 58 and Table 2218. This cluster is overexpressed (at least at a minimum level) in the following pathological conditions: brain malignant tumors, epithelial malignant tumors, a mixture of malignant tumors from different tissues and pancreas carcinoma.

TABLE 2218

Normal tissue distribution

| Name of Tissue | Number |
|---|---|
| bone | 45 |
| brain | 0 |
| colon | 6 |
| epithelial | 9 |
| general | 11 |
| head and neck | 0 |
| kidney | 2 |
| lung | 20 |
| lymph nodes | 0 |
| breast | 0 |
| muscle | 20 |
| ovary | 0 |
| pancreas | 0 |
| prostate | 30 |
| skin | 2 |
| stomach | 36 |
| uterus | 0 |

TABLE 2219

P values and ratios for expression in cancerous tissue

| Name of Tissue | P1 | P2 | SP1 | R3 | SP2 | R4 |
|---|---|---|---|---|---|---|
| bone | 6.6e-01 | 8.5e-01 | 1 | 0.8 | 1 | 0.6 |
| brain | 2.8e-02 | 6.0e-03 | 4.8e-02 | 8.9 | 3.8e-03 | 9.6 |
| colon | 1.2e-01 | 4.2e-02 | 2.4e-01 | 2.3 | 1.6e-01 | 2.6 |
| epithelial | 8.9e-03 | 2.0e-04 | 7.0e-03 | 2.7 | 4.7e-07 | 4.4 |
| general | 9.7e-05 | 8.8e-08 | 3.9e-03 | 2.2 | 1.8e-10 | 3.4 |
| head and neck | 4.3e-01 | 2.8e-01 | 1 | 1.1 | 4.2e-01 | 1.7 |
| kidney | 8.6e-01 | 8.0e-01 | 5.8e-01 | 1.6 | 3.4e-01 | 2.1 |
| lung | 4.8e-01 | 5.6e-01 | 5.4e-01 | 1.7 | 2.5e-02 | 2.0 |
| lymph nodes | 3.1e-01 | 3.1e-01 | 2.9e-01 | 3.5 | 5.8e-01 | 1.9 |
| breast | 3.4e-01 | 1.2e-01 | 4.7e-01 | 1.9 | 2.5e-01 | 2.3 |
| muscle | 8.5e-01 | 6.1e-01 | 1 | 0.5 | 1.7e-01 | 2.0 |
| ovary | 6.2e-01 | 4.2e-01 | 6.8e-01 | 1.5 | 3.4e-01 | 1.9 |
| pancreas | 9.5e-02 | 2.3e-02 | 7.6e-02 | 5.1 | 3.1e-03 | 7.3 |
| prostate | 9.7e-01 | 7.8e-01 | 1 | 0.4 | 6.3e-01 | 0.9 |
| skin | 4.0e-01 | 6.8e-01 | 1.4e-01 | 5.9 | 6.4e-01 | 1.3 |
| stomach | 2.7e-01 | 5.0e-01 | 5.0e-01 | 1.5 | 5.0e-01 | 1.1 |
| uterus | 5.0e-01 | 5.4e-02 | 1 | 1.1 | 8.7e-02 | 3.0 |

As noted above, cluster AA056634 features 17 segment(s), which were listed in Table 2215 above and for which the sequence(s) are given at the end of the application. These segment(s) are portions of nucleic acid sequence(s) which are described herein separately because they are of particular interest. A description of each segment according to the present invention is now provided.

Segment cluster AA056634_node_0 (SEQ ID NO:2365) according to the present invention is supported by 7 libraries. The number of libraries was determined as previously described. This segment can be found in the following transcript(s): (SEQ ID NO:2360), AA056634_T5 (SEQ ID NO:2361), AA056634_T14 (SEQ ID NO:2363) and AA056634_T15 (SEQ ID NO:2364). Table 2220 below describes the starting and ending position of this segment on each transcript.

TABLE 2220

Segment location on transcripts

| Transcript name | Segment starting position | Segment ending position |
|---|---|---|
| AA056634_T4 (SEQ ID NO: 2360) | 1 | 200 |
| AA056634_T5 (SEQ ID NO: 2361) | 1 | 200 |
| AA056634_T14 (SEQ ID NO: 2363) | 1 | 200 |
| AA056634_T15 (SEQ ID NO: 2364) | 1 | 200 |

This segment can be found in a non-coding region of transcript(s) that are related to the following protein(s): AA056634_P1 and AA056634_P5.

Segment cluster AA056634_node_3 (SEQ ID NO:2366) according to the present invention is supported by 6 libraries. The number of libraries was determined as previously described. This segment can be found in the following transcript(s): AA056634_T14 (SEQ ID NO:2363) and AA056634_T15 (SEQ ID NO:2364). Table 2221 below describes the starting and ending position of this segment on each transcript.

TABLE 2221

Segment location on transcripts

| Transcript name | Segment starting position | Segment ending position |
|---|---|---|
| AA056634_T14 (SEQ ID NO: 2363) | 201 | 580 |
| AA056634_T15 (SEQ ID NO: 2364) | 206 | 585 |

This segment can be found in the following protein(s): AA056634_P5.

Segment cluster AA056634_node_5 (SEQ ID NO:2367) according to the present invention is supported by 4 libraries. The number of libraries was determined as previously described. This segment can be found in the following transcript(s): AA056634_T1 (SEQ ID NO:2357), AA056634_T2 (SEQ ID NO:2358) and AA056634_T3 (SEQ ID NO:2359). Table 2222 below describes the starting and ending position of this segment on each transcript.

TABLE 2222

Segment location on transcripts

| Transcript name | Segment starting position | Segment ending position |
|---|---|---|
| AA056634_T1 (SEQ ID NO: 2357) | 1 | 1207 |
| AA056634_T2 (SEQ ID NO: 2358) | 1 | 1207 |
| AA056634_T3 (SEQ ID NO: 2359) | 1 | 1207 |

This segment can be found in a non-coding region of transcript(s) that are related to the following protein(s): AA056634_P6.

Segment cluster AA056634_node_12 (SEQ ID NO:2368) according to the present invention is supported by 31 libraries. The number of libraries was determined as previously described. This segment can be found in the following transcript(s): (SEQ ID NO:2357), AA056634_T2 (SEQ ID NO:2358), (SEQ ID NO:2359), AA056634_T4 (SEQ ID NO:2360) and (SEQ ID NO:2361). Table 2223 below describes the starting and ending position of this segment on each transcript.

TABLE 2223

Segment location on transcripts

| Transcript name | Segment starting position | Segment ending position |
|---|---|---|
| AA056634_T1 (SEQ ID NO: 2357) | 1390 | 1562 |
| AA056634_T2 (SEQ ID NO: 2358) | 1457 | 1629 |
| AA056634_T3 (SEQ ID NO: 2359) | 1272 | 1444 |
| AA056634_T4 (SEQ ID NO: 2360) | 265 | 437 |
| AA056634_T5 (SEQ ID NO: 2361) | 270 | 442 |

This segment can be found in the following protein(s): AA056634_P6 and AA056634_P1.

Segment cluster AA056634_node_14 (SEQ ID NO:2369) according to the present invention is supported by 4 libraries. The number of libraries was determined as previously described. This segment can be found in the following transcript(s): AA056634_T9 (SEQ ID NO:2362). Table 2224 below describes the starting and ending position of this segment on each transcript.

TABLE 2224

Segment location on transcripts

| Transcript name | Segment starting position | Segment ending position |
|---|---|---|
| AA056634_T9 (SEQ ID NO: 2362) | 1 | 291 |

This segment can be found in a non-coding region of transcript(s) that are related to the following protein(s): AA056634_P2.

Segment cluster AA056634_node_16 (SEQ ID NO:2370) according to the present invention is supported by 43 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2225 below describes the starting and ending position of this segment on each transcript.

TABLE 2225

Segment location on transcripts

| Transcript name | Segment starting position | Segment ending position |
|---|---|---|
| AA056634_T1 (SEQ ID NO: 2357) | 1563 | 1795 |
| AA056634_T2 (SEQ ID NO: 2358) | 1630 | 1862 |
| AA056634_T3 (SEQ ID NO: 2359) | 1445 | 1677 |
| AA056634_T4 (SEQ ID NO: 2360) | 438 | 670 |
| AA056634_T5 (SEQ ID NO: 2361) | 443 | 675 |
| AA056634_T9 (SEQ ID NO: 2362) | 292 | 524 |

This segment can be found in the following protein(s): AA056634_P6, AA056634_P1 and AA056634_P2.

Segment cluster AA056634_node_20 (SEQ ID NO:2371) according to the present invention is supported by 67 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2226 below describes the starting and ending position of this segment on each transcript.

TABLE 2226

Segment location on transcripts

| Transcript name | Segment starting position | Segment ending position |
|---|---|---|
| AA056634_T1 (SEQ ID NO: 2357) | 1844 | 2412 |
| AA056634_T2 (SEQ ID NO: 2358) | 1911 | 2479 |
| AA056634_T3 (SEQ ID NO: 2359) | 1726 | 2294 |
| AA056634_T4 (SEQ ID NO: 2360) | 719 | 1287 |
| AA056634_T5 (SEQ ID NO: 2361) | 724 | 1292 |
| AA056634_T9 (SEQ ID NO: 2362) | 573 | 1141 |

This segment can be found in the following protein(s): AA056634_P6, AA056634_P1 and AA056634_P2.

Segment cluster AA056634_node_21 (SEQ ID NO:2372) according to the present invention is supported by 59 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2227 below describes the starting and ending position of this segment on each transcript.

TABLE 2227

Segment location on transcripts

| Transcript name | Segment starting position | Segment ending position |
|---|---|---|
| AA056634_T1 (SEQ ID NO: 2357) | 2413 | 2636 |
| AA056634_T2 (SEQ ID NO: 2358) | 2480 | 2703 |
| AA056634_T3 (SEQ ID NO: 2359) | 2295 | 2518 |
| AA056634_T4 (SEQ ID NO: 2360) | 1288 | 1511 |
| AA056634_T5 (SEQ ID NO: 2361) | 1293 | 1516 |
| AA056634_T9 (SEQ ID NO: 2362) | 1142 | 1365 |

This segment can be found in a non-coding region of transcript(s) that are related to the following protein(s): AA056634_P6, AA056634_P1 and AA056634_P2.

Segment cluster AA056634_node_22 (SEQ ID NO:2373) according to the present invention is supported by 47 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2228 below describes the starting and ending position of this segment on each transcript.

TABLE 2228

Segment location on transcripts

| Transcript name | Segment starting position | Segment ending position |
|---|---|---|
| AA056634_T1 (SEQ ID NO: 2357) | 2637 | 3071 |
| AA056634_T2 (SEQ ID NO: 2358) | 2704 | 3138 |
| AA056634_T3 (SEQ ID NO: 2359) | 2519 | 2953 |
| AA056634_T4 (SEQ ID NO: 2360) | 1512 | 1946 |
| AA056634_T5 (SEQ ID NO: 2361) | 1517 | 1951 |
| AA056634_T9 (SEQ ID NO: 2362) | 1366 | 1800 |

This segment can be found in a non-coding region of transcript(s) that are related to the following protein(s): AA056634_P6, AA056634_P1 and AA056634_P2.

Segment cluster AA056634_node_23 (SEQ ID NO:2374) according to the present invention is supported by 40 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2229 below describes the starting and ending position of this segment on each transcript.

TABLE 2229

Segment location on transcripts

| Transcript name | Segment starting position | Segment ending position |
|---|---|---|
| AA056634_T1 (SEQ ID NO: 2357) | 3072 | 3238 |
| AA056634_T2 (SEQ ID NO: 2358) | 3139 | 3305 |
| AA056634_T3 (SEQ ID NO: 2359) | 2954 | 3120 |
| AA056634_T4 (SEQ ID NO: 2360) | 1947 | 2113 |
| AA056634_T5 (SEQ ID NO: 2361) | 1952 | 2118 |
| AA056634_T9 (SEQ ID NO: 2362) | 1801 | 1967 |

This segment can be found in a non-coding region of transcript(s) that are related to the following protein(s): AA056634_P6, AA056634_P1 and AA056634_P2.

Segment cluster AA056634_node_24 (SEQ ID NO:2375) according to the present invention is supported by 36 libraries. The number of libraries was determined as previously described. This segment can be found in the following transcript(s): AA056634_T1 (SEQ ID NO:2357), AA056634_T2 (SEQ ID NO:2358), (SEQ ID NO:2359), AA056634_T4 (SEQ ID NO:2360), (SEQ ID NO:2361) and AA056634_T9 (SEQ ID NO:2362). Table 2230 below describes the starting and ending position of this segment on each transcript.

TABLE 2230

Segment location on transcripts

| Transcript name | Segment starting position | Segment ending position |
|---|---|---|
| AA056634_T1 (SEQ ID NO: 2357) | 3239 | 3340 |
| AA056634_T2 (SEQ ID NO: 2358) | 3306 | 3407 |
| AA056634_T3 (SEQ ID NO: 2359) | 3121 | 3222 |
| AA056634_T4 (SEQ ID NO: 2360) | 2114 | 2215 |
| AA056634_T5 (SEQ ID NO: 2361) | 2119 | 2220 |
| AA056634_T9 (SEQ ID NO: 2362) | 1968 | 2069 |

This segment can be found in a non-coding region of transcript(s) that are related to the following protein(s): AA056634_P6, AA056634_P1 and AA056634_P2.

According to an optional embodiment of the present invention, short segments related to the above cluster are also provided. These segments are up to about 120 bp in length, and so are included in a separate description.

Segment cluster AA056634_node_1 (SEQ ID NO:2376) according to the present invention can be found in the following transcript(s): AA056634_T5 (SEQ ID NO:2361) and AA056634_T15 (SEQ ID NO:2364). Table 2231 below describes the starting and ending position of this segment on each transcript.

TABLE 2231

Segment location on transcripts

| Transcript name | Segment starting position | Segment ending position |
|---|---|---|
| AA056634_T5 (SEQ ID NO: 2361) | 201 | 205 |
| AA056634_T15 (SEQ ID NO: 2364) | 201 | 205 |

This segment can be found in a non-coding region of transcript(s) that are related to the following protein(s): AA056634_P1 and AA056634_P5.

Segment cluster AA056634_node_6 (SEQ ID NO:2377) according to the present invention is supported by 3 libraries. The number of libraries was determined as previously described. This segment can be found in the following transcript(s): AA056634_T1 (SEQ ID NO:2357) and AA056634_T2 (SEQ ID NO:2358). Table 2232 below describes the starting and ending position of this segment on each transcript.

TABLE 2232

Segment location on transcripts

| Transcript name | Segment starting position | Segment ending position |
|---|---|---|
| AA056634_T1 (SEQ ID NO: 2357) | 1208 | 1325 |
| AA056634_T2 (SEQ ID NO: 2358) | 1208 | 1325 |

This segment can be found in a non-coding region of transcript(s) that are related to the following protein(s): AA056634_P6.

Segment cluster AA056634_node_7 (SEQ ID NO:2378) according to the present invention is supported by 2 libraries. The number of libraries was determined as previously described. This segment can be found in the following transcript(s): AA056634_T2 (SEQ ID NO:2358). Table 2233 below describes the starting and ending position of this segment on each transcript.

TABLE 2233

Segment location on transcripts

| Transcript name | Segment starting position | Segment ending position |
|---|---|---|
| AA056634_T2 (SEQ ID NO: 2358) | 1326 | 1392 |

The previously-described transcripts for these segment(s) do not code for protein.

Segment cluster AA056634_node_11 (SEQ ID NO:2379) according to the present invention is supported by 22 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360) and AA056634_T5 (SEQ ID NO:2361). Table 2234 below describes the starting and ending position of this segment on each transcript.

TABLE 2234

Segment location on transcripts

| Transcript name | Segment starting position | Segment ending position |
|---|---|---|
| AA056634_T1 (SEQ ID NO: 2357) | 1326 | 1389 |
| AA056634_T2 (SEQ ID NO: 2358) | 1393 | 1456 |
| AA056634_T3 (SEQ ID NO: 2359) | 1208 | 1271 |
| AA056634_T4 (SEQ ID NO: 2360) | 201 | 264 |
| AA056634_T5 (SEQ ID NO: 2361) | 206 | 269 |

This segment can be found in a non-coding region of transcript(s) that are related to the following protein(s): AA056634_P6 and AA056634_P1.

Segment cluster AA056634_node_18 (SEQ ID NO:2380) according to the present invention is supported by 37 libraries. The number of libraries was determined as previously described. This segment can be found in the following transcript(s): AA056634_T1 (SEQ ID NO:2357), AA056634_T2 (SEQ ID NO:2358), AA056634_T3 (SEQ ID NO:2359), AA056634_T4 (SEQ ID NO:2360), AA056634_T5 (SEQ ID NO:2361) and AA056634_T9 (SEQ ID NO:2362). Table 2235 below describes the starting and ending position of this segment on each transcript.

TABLE 2235

Segment location on transcripts

| Transcript name | Segment starting position | Segment ending position |
|---|---|---|
| AA056634_T1 (SEQ ID NO: 2357) | 1796 | 1830 |
| AA056634_T2 (SEQ ID NO: 2358) | 1863 | 1897 |
| AA056634_T3 (SEQ ID NO: 2359) | 1678 | 1712 |
| AA056634_T4 (SEQ ID NO: 2360) | 671 | 705 |
| AA056634_T5 (SEQ ID NO: 2361) | 676 | 710 |
| AA056634_T9 (SEQ ID NO: 2362) | 525 | 559 |

This segment can be found in the following protein(s): AA056634_P6, AA056634_P1 and AA056634_P2.

Segment cluster AA056634_node_19 (SEQ ID NO:2381) according to the present invention can be found in the following transcript(s): AA056634_T1 (SEQ ID NO:2357), AA056634_T2 (SEQ ID NO:2358), AA056634_T3 (SEQ ID NO:2359), (SEQ ID NO:2360), AA056634_T5 (SEQ ID NO:2361) and (SEQ ID NO:2362). Table 2236 below describes the starting and ending position of this segment on each transcript.

TABLE 2236

Segment location on transcripts

| Transcript name | Segment starting position | Segment ending position |
|---|---|---|
| AA056634_T1 (SEQ ID NO: 2357) | 1831 | 1843 |
| AA056634_T2 (SEQ ID NO: 2358) | 1898 | 1910 |
| AA056634_T3 (SEQ ID NO: 2359) | 1713 | 1725 |
| AA056634_T4 (SEQ ID NO: 2360) | 706 | 718 |
| AA056634_T5 (SEQ ID NO: 2361) | 711 | 723 |
| AA056634_T9 (SEQ ID NO: 2362) | 560 | 572 |

This segment can be found in the following protein(s): AA056634_P6, AA056634_P1 and AA056634_P2.

Description for Cluster AA318609

Cluster AA318609 features 3 transcript(s) and 37 segment(s) of interest, the names for which are given in Tables 2237 and 2238, respectively, the sequences themselves are given at the end of the application. The selected protein variants are given in Table 2239.

TABLE 2237

Transcripts of interest
Transcript Name

AA318609_T5 (SEQ ID NO: 2382)
AA318609_T9 (SEQ ID NO: 2383)
AA318609_T23 (SEQ ID NO: 2384)

TABLE 2238

Segments of interest
Segment Name

AA318609_node_7 (SEQ ID NO: 2385)
AA318609_node_10 (SEQ ID NO: 2386)
AA318609_node_17 (SEQ ID NO: 2387)
AA318609_node_37 (SEQ ID NO: 2388)
AA318609_node_49 (SEQ ID NO: 2389)
AA318609_node_60 (SEQ ID NO: 2390)
AA318609_node_62 (SEQ ID NO: 2391)
AA318609_node_65 (SEQ ID NO: 2392)
AA318609_node_73 (SEQ ID NO: 2393)
AA318609_node_0 (SEQ ID NO: 2394)
AA318609_node_5 (SEQ ID NO: 2395)
AA318609_node_6 (SEQ ID NO: 2396)
AA318609_node_8 (SEQ ID NO: 2397)
AA318609_node_9 (SEQ ID NO: 2398)
AA318609_node_11 (SEQ ID NO: 2399)
AA318609_node_13 (SEQ ID NO: 2400)
AA318609_node_15 (SEQ ID NO: 2401)
AA318609_node_19 (SEQ ID NO: 2402)
AA318609_node_20 (SEQ ID NO: 2403)
AA318609_node_22 (SEQ ID NO: 2404)
AA318609_node_24 (SEQ ID NO: 2405)
AA318609_node_26 (SEQ ID NO: 2406)
AA318609_node_28 (SEQ ID NO: 2407)
AA318609_node_31 (SEQ ID NO: 2408)
AA318609_node_33 (SEQ ID NO: 2409)
AA318609_node_35 (SEQ ID NO: 2410)
AA318609_node_38 (SEQ ID NO: 2411)
AA318609_node_39 (SEQ ID NO: 2412)
AA318609_node_40 (SEQ ID NO: 2413)
AA318609_node_42 (SEQ ID NO: 2414)
AA318609_node_47 (SEQ ID NO: 2415)
AA318609_node_53 (SEQ ID NO: 2416)
AA318609_node_56 (SEQ ID NO: 2417)
AA318609_node_58 (SEQ ID NO: 2418)
AA318609_node_67 (SEQ ID NO: 2419)
AA318609_node_69 (SEQ ID NO: 2420)
AA318609_node_70 (SEQ ID NO: 2421)

TABLE 2239

Proteins of interest

| Protein Name | Corresponding Transcript(s) |
|---|---|
| AA318609_P1 | AA318609_T5 (SEQ ID NO: 2382) |
| AA318609_P3 | AA318609_T9 (SEQ ID NO: 2383) |
| AA318609_P11 | AA318609_T23 (SEQ ID NO: 2384) |

Cluster AA318609 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 59 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 59 and Table 2240. This cluster is overexpressed (at least at a minimum level) in the following pathological conditions: epithelial malignant tumors.

59

TABLE 2240

Normal tissue distribution

| Name of Tissue | Number |
|---|---|
| adrenal | 0 |
| bone | 32 |
| brain | 54 |
| colon | 3 |
| epithelial | 0 |
| general | 20 |
| liver | 0 |
| lung | 0 |
| lymph nodes | 37 |
| breast | 0 |
| muscle | 0 |
| ovary | 0 |
| pancreas | 0 |
| skin | 0 |
| stomach | 0 |
| uterus | 0 |

TABLE 2241

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| bone | 9.2e−01 | 7.5e−01 | 1 | 0.5 | 9.1e−01 | 0.7 |
| brain | 8.3e−01 | 8.6e−01 | 1 | 0.1 | 1 | 0.2 |
| colon | 3.0e−01 | 3.9e−01 | 4.9e−01 | 1.9 | 5.9e−01 | 1.6 |
| epithelial | 3.9e−03 | 2.7e−04 | 1.7e−03 | 8.5 | 2.7e−05 | 11.7 |
| general | 6.0e−01 | 1.7e−01 | 8.7e−01 | 0.7 | 2.9e−01 | 1.1 |
| liver | 1 | 6.8e−01 | 1 | 1.0 | 6.9e−01 | 1.4 |
| lung | 5.0e−01 | 4.0e−01 | 4.1e−01 | 2.4 | 2.4e−01 | 2.9 |
| lymph nodes | 4.5e−01 | 2.3e−01 | 4.9e−01 | 2.0 | 5.4e−02 | 2.2 |
| breast | 5.9e−01 | 6.7e−01 | 6.9e−01 | 1.5 | 8.2e−01 | 1.2 |
| muscle | 1 | 2.9e−01 | 1 | 1.0 | 5.9e−02 | 4.1 |
| ovary | 6.2e−01 | 2.6e−01 | 3.2e−01 | 1.9 | 2.0e−01 | 2.5 |
| pancreas | 9.5e−02 | 6.9e−02 | 1.8e−01 | 3.7 | 7.7e−02 | 4.6 |
| skin | 1 | 4.4e−01 | 1 | 1.0 | 4.1e−01 | 2.1 |
| stomach | 1 | 4.7e−01 | 1 | 1.0 | 6.4e−01 | 1.5 |
| uterus | 1 | 2.4e−01 | 1 | 1.0 | 2.6e−01 | 2.1 |

As noted above, cluster AA318609 features 37 segment(s), which were listed in Table 2238 above and for which the sequence(s) are given at the end of the application. These segment(s) are portions of nucleic acid sequence(s) which are described herein separately because they are of particular interest. A description of each segment according to the present invention is now provided.

Segment cluster AA318609_node_7 (SEQ ID NO:2385) according to the present invention is supported by 2 libraries. The number of libraries was determined as previously described. This segment can be found in the following transcript(s): AA318609_T5 (SEQ ID NO:2382). Table 2242 below describes the starting and ending position of this segment on each transcript.

TABLE 2242

Segment location on transcripts

| Transcript name | Segment starting position | Segment ending position |
|---|---|---|
| AA318609_T5 (SEQ ID NO: 2382) | 248 | 372 |

This segment can be found in a non-coding region of transcript(s) that are related to the following protein(s): AA318609_P1.

Segment cluster AA318609_node_10 (SEQ ID NO:2386) according to the present invention is supported by 2 libraries. The number of libraries was determined as previously described. This segment can be found in the following transcript(s): AA318609_T5 (SEQ ID NO:2382). Table 2243 below describes the starting and ending position of this segment on each transcript.

TABLE 2243

Segment location on transcripts

| Transcript name | Segment starting position | Segment ending position |
|---|---|---|
| AA318609_T5 (SEQ ID NO: 2382) | 540 | 898 |

This segment can be found in a non-coding region of transcript(s) that are related to the following protein(s): AA318609_P1.

Segment cluster AA318609_node_17 (SEQ ID NO:2387) according to the present invention is supported by 28 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2244 below describes the starting and ending position of this segment on each transcript.

TABLE 2244

Segment location on transcripts

| Transcript name | Segment starting position | Segment ending position |
|---|---|---|
| AA318609_T5 (SEQ ID NO: 2382) | 1140 | 1281 |
| AA318609_T9 (SEQ ID NO: 2383) | 474 | 615 |
| AA318609_T23 (SEQ ID NO: 2384) | 474 | 615 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_37 (SEQ ID NO:2388) according to the present invention is supported by 13 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2245 below describes the starting and ending position of this segment on each transcript.

TABLE 2245

Segment location on transcripts

| Transcript name | Segment starting position | Segment ending position |
|---|---|---|
| AA318609_T5 (SEQ ID NO: 2382) | 1949 | 2127 |
| AA318609_T9 (SEQ ID NO: 2383) | 1283 | 1461 |
| AA318609_T23 (SEQ ID NO: 2384) | 1283 | 1461 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_49 (SEQ ID NO:2389) according to the present invention is supported by 33 libraries. The number of libraries was determined as previously described. This segment can be found in the following transcript(s): AA318609_T5 (SEQ ID NO:2382) and AA318609_T9 (SEQ ID NO:2383). Table 2246 below describes the starting and ending position of this segment on each transcript.

TABLE 2246

Segment location on transcripts

| Transcript name | Segment starting position | Segment ending position |
|---|---|---|
| AA318609_T5 (SEQ ID NO: 2382) | 2297 | 2572 |
| AA318609_T9 (SEQ ID NO: 2383) | 1716 | 1991 |

This segment can be found in the following protein(s): AA318609_P1 and AA318609_P3.

Segment cluster AA318609_node_60 (SEQ ID NO:2390) according to the present invention is supported by 42 libraries. The number of libraries was determined as previously described. This segment can be found in the following transcript(s): AA318609_T5 (SEQ ID NO:2382) and AA318609_T9 (SEQ ID NO:2383). Table 2247 below describes the starting and ending position of this segment on each transcript.

TABLE 2247

Segment location on transcripts

| Transcript name | Segment starting position | Segment ending position |
|---|---|---|
| AA318609_T5 (SEQ ID NO: 2382) | 2883 | 3038 |
| AA318609_T9 (SEQ ID NO: 2383) | 2302 | 2457 |

This segment can be found in the following protein(s): AA318609_P1 and AA318609_P3.

Segment cluster AA318609_node_62 (SEQ ID NO:2391) according to the present invention is supported by 35 libraries. The number of libraries was determined as previously described. This segment can be found in the following transcript(s): AA318609_T5 (SEQ ID NO:2382) and AA318609_T9 (SEQ ID NO:2383). Table 2248 below describes the starting and ending position of this segment on each transcript.

TABLE 2248

Segment location on transcripts

| Transcript name | Segment starting position | Segment ending position |
|---|---|---|
| AA318609_T5 (SEQ ID NO: 2382) | 3039 | 3171 |
| AA318609_T9 (SEQ ID NO: 2383) | 2458 | 2590 |

This segment can be found in the following protein(s): AA318609_P1 and AA318609_P3.

Segment cluster AA318609_node_65 (SEQ ID NO:2392) according to the present invention is supported by 40 libraries. The number of libraries was determined as previously described. This segment can be found in the following transcript(s): AA318609_T5 (SEQ ID NO:2382) and AA318609_T9 (SEQ ID NO:2383). Table 2249 below describes the starting and ending position of this segment on each transcript.

TABLE 2249

Segment location on transcripts

| Transcript name | Segment starting position | Segment ending position |
|---|---|---|
| AA318609_T5 (SEQ ID NO: 2382) | 3172 | 3371 |
| AA318609_T9 (SEQ ID NO: 2383) | 2591 | 2790 |

This segment can be found in the following protein(s): AA318609_P1 and AA318609_P3.

Segment cluster AA318609_node_73 (SEQ ID NO:2393) according to the present invention is supported by 39 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2250 below describes the starting and ending position of this segment on each transcript.

TABLE 2250

Segment location on transcripts

| Transcript name | Segment starting position | Segment ending position |
|---|---|---|
| AA318609_T5 (SEQ ID NO: 2382) | 3593 | 3877 |
| AA318609_T9 (SEQ ID NO: 2383) | 3012 | 3296 |
| AA318609_T23 (SEQ ID NO: 2384) | 1756 | 2040 |

This segment can be found in both coding and non-coding regions of transcript(s) as follows. The segment can be found in a non-coding region of transcript(s) that are related to the following protein(s): AA318609_P11. This segment can also be found in the following protein(s): AA318609_P1 and AA318609_P3, since it is in the coding region for the corresponding transcript.

According to an optional embodiment of the present invention, short segments related to the above cluster are also provided. These segments are up to about 120 bp in length, and so are included in a separate description.

Segment cluster AA318609_node_0 (SEQ ID NO:2394) according to the present invention is supported by 16 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2251 below describes the starting and ending position of this segment on each transcript.

TABLE 2251

Segment location on transcripts

| Transcript name | Segment starting position | Segment ending position |
|---|---|---|
| AA318609_T5 (SEQ ID NO: 2382) | 1 | 97 |
| AA318609_T9 (SEQ ID NO: 2383) | 1 | 97 |
| AA318609_T23 (SEQ ID NO: 2384) | 1 | 97 |

This segment can be found in a non-coding region of transcript(s) that are related to the following protein(s): AA318609_P1, AA318609_P3 and AA318609_P11.

Segment cluster AA318609_node_5 (SEQ ID NO:2395) according to the present invention is supported by 25 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2252 below describes the starting and ending position of this segment on each transcript.

TABLE 2252

Segment location on transcripts

| Transcript name | Segment starting position | Segment ending position |
|---|---|---|
| AA318609_T5 (SEQ ID NO: 2382) | 98 | 142 |
| AA318609_T9 (SEQ ID NO: 2383) | 98 | 142 |
| AA318609_T23 (SEQ ID NO: 2384) | 98 | 142 |

This segment can be found in a non-coding region of transcript(s) that are related to the following protein(s): AA318609_P1, AA318609_P3 and AA318609_P11.

Segment cluster AA318609_node_6 (SEQ ID NO:2396) according to the present invention is supported by 6 libraries. The number of libraries was determined as previously described. This segment can be found in the following transcript(s): AA318609_T5 (SEQ ID NO:2382). Table 2253 below describes the starting and ending position of this segment on each transcript.

TABLE 2253

Segment location on transcripts

| Transcript name | Segment starting position | Segment ending position |
|---|---|---|
| AA318609_T5 (SEQ ID NO: 2382) | 143 | 247 |

This segment can be found in a non-coding region of transcript(s) that are related to the following protein(s): AA318609_P1.

Segment cluster AA318609_node_8 (SEQ ID NO:2397) according to the present invention is supported by 26 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2254 below describes the starting and ending position of this segment on each transcript.

TABLE 2254

Segment location on transcripts

| Transcript name | Segment starting position | Segment ending position |
|---|---|---|
| AA318609_T5 (SEQ ID NO: 2382) | 373 | 462 |
| AA318609_T9 (SEQ ID NO: 2383) | 143 | 232 |
| AA318609_T23 (SEQ ID NO: 2384) | 143 | 232 |

This segment can be found in a non-coding region of transcript(s) that are related to the following protein(s): AA318609_P1, AA318609_P3 and AA318609_P11.

Segment cluster AA318609_node_9 (SEQ ID NO:2398) according to the present invention is supported by 5 libraries. The number of libraries was determined as previously described. This segment can be found in the following transcript(s): AA318609_T5 (SEQ ID NO:2382). Table 2255 below describes the starting and ending position of this segment on each transcript.

TABLE 2255

Segment location on transcripts

| Transcript name | Segment starting position | Segment ending position |
|---|---|---|
| AA318609_T5 (SEQ ID NO: 2382) | 463 | 539 |

This segment can be found in a non-coding region of transcript(s) that are related to the following protein(s): AA318609_P1.

Segment cluster AA318609_node_11 (SEQ ID NO:2399) according to the present invention is supported by 29 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2256 below describes the starting and ending position of this segment on each transcript.

TABLE 2256

Segment location on transcripts

| Transcript name | Segment starting position | Segment ending position |
|---|---|---|
| AA318609_T5 (SEQ ID NO: 2382) | 899 | 972 |
| AA318609_T9 (SEQ ID NO: 2383) | 233 | 306 |
| AA318609_T23 (SEQ ID NO: 2384) | 233 | 306 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_13 (SEQ ID NO:2400) according to the present invention is supported by 27 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2257 below describes the starting and ending position of this segment on each transcript.

TABLE 2257

Segment location on transcripts

| Transcript name | Segment starting position | Segment ending position |
|---|---|---|
| AA318609_T5 (SEQ ID NO: 2382) | 973 | 1064 |
| AA318609_T9 (SEQ ID NO: 2383) | 307 | 398 |
| AA318609_T23 (SEQ ID NO: 2384) | 307 | 398 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_15 (SEQ ID NO:2401) according to the present invention is supported by 25 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2258 below describes the starting and ending position of this segment on each transcript.

TABLE 2258

Segment location on transcripts

| Transcript name | Segment starting position | Segment ending position |
|---|---|---|
| AA318609_T5 (SEQ ID NO: 2382) | 1065 | 1139 |
| AA318609_T9 (SEQ ID NO: 2383) | 399 | 473 |
| AA318609_T23 (SEQ ID NO: 2384) | 399 | 473 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_19 (SEQ ID NO:2402) according to the present invention is supported by 22 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2259 below describes the starting and ending position of this segment on each transcript.

TABLE 2259

Segment location on transcripts

| Transcript name | Segment starting position | Segment ending position |
|---|---|---|
| AA318609_T5 (SEQ ID NO: 2382) | 1282 | 1320 |
| AA318609_T9 (SEQ ID NO: 2383) | 616 | 654 |
| AA318609_T23 (SEQ ID NO: 2384) | 616 | 654 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_20 (SEQ ID NO:2403) according to the present invention is supported by 23 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2260 below describes the starting and ending position of this segment on each transcript.

TABLE 2260

Segment location on transcripts

| Transcript name | Segment starting position | Segment ending position |
| --- | --- | --- |
| AA318609_T5 (SEQ ID NO: 2382) | 1321 | 1434 |
| AA318609_T9 (SEQ ID NO: 2383) | 655 | 768 |
| AA318609_T23 (SEQ ID NO: 2384) | 655 | 768 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P1, since it is in the coding region for the corresponding transcript.

Segment cluster AA318609_node_22 (SEQ ID NO:2404) according to the present invention is supported by 21 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2261 below describes the starting and ending position of this segment on each transcript.

TABLE 2261

Segment location on transcripts

| Transcript name | Segment starting position | Segment ending position |
| --- | --- | --- |
| AA318609_T5 (SEQ ID NO: 2382) | 1435 | 1539 |
| AA318609_T9 (SEQ ID NO: 2383) | 769 | 873 |
| AA318609_T23 (SEQ ID NO: 2384) | 769 | 873 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_24 (SEQ ID NO:2405) according to the present invention is supported by 20 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2262 below describes the starting and ending position of this segment on each transcript.

TABLE 2262

Segment location on transcripts

| Transcript name | Segment starting position | Segment ending position |
| --- | --- | --- |
| AA318609_T5 (SEQ ID NO: 2382) | 1540 | 1638 |
| AA318609_T9 (SEQ ID NO: 2383) | 874 | 972 |
| AA318609_T23 (SEQ ID NO: 2384) | 874 | 972 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_26 (SEQ ID NO:2406) according to the present invention is supported by 16 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2263 below describes the starting and ending position of this segment on each transcript.

TABLE 2263

Segment location on transcripts

| Transcript name | Segment starting position | Segment ending position |
| --- | --- | --- |
| AA318609_T5 (SEQ ID NO: 2382) | 1639 | 1735 |
| AA318609_T9 (SEQ ID NO: 2383) | 973 | 1069 |
| AA318609_T23 (SEQ ID NO: 2384) | 973 | 1069 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_28 (SEQ ID NO:2407) according to the present invention is supported by 14 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2264 below describes the starting and ending position of this segment on each transcript.

TABLE 2264

Segment location on transcripts

| Transcript name | Segment starting position | Segment ending position |
| --- | --- | --- |
| AA318609_T5 (SEQ ID NO: 2382) | 1736 | 1780 |
| AA318609_T9 (SEQ ID NO: 2383) | 1070 | 1114 |
| AA318609_T23 (SEQ ID NO: 2384) | 1070 | 1114 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_31 (SEQ ID NO:2408) according to the present invention is supported by 14 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2265 below describes the starting and ending position of this segment on each transcript.

TABLE 2265

Segment location on transcripts

| Transcript name | Segment starting position | Segment ending position |
|---|---|---|
| AA318609_T5 (SEQ ID NO: 2382) | 1781 | 1865 |
| AA318609_T9 (SEQ ID NO: 2383) | 1115 | 1199 |
| AA318609_T23 (SEQ ID NO: 2384) | 1115 | 1199 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_33 (SEQ ID NO:2409) according to the present invention can be found in the following transcript(s): AA318609_T5 (SEQ ID NO:2382), AA318609_T9 (SEQ ID NO:2383) and AA318609_T23 (SEQ ID NO:2384). Table 2266 below describes the starting and ending position of this segment on each transcript.

TABLE 2266

Segment location on transcripts

| Transcript name | Segment starting position | Segment ending position |
|---|---|---|
| AA318609_T5 (SEQ ID NO: 2382) | 1866 | 1890 |
| AA318609_T9 (SEQ ID NO: 2383) | 1200 | 1224 |
| AA318609_T23 (SEQ ID NO: 2384) | 1200 | 1224 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_35 (SEQ ID NO:2410) according to the present invention is supported by 12 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2267 below describes the starting and ending position of this segment on each transcript.

TABLE 2267

Segment location on transcripts

| Transcript name | Segment starting position | Segment ending position |
|---|---|---|
| AA318609_T5 (SEQ ID NO: 2382) | 1891 | 1948 |
| AA318609_T9 (SEQ ID NO: 2383) | 1225 | 1282 |
| AA318609_T23 (SEQ ID NO: 2384) | 1225 | 1282 |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P1 and AA318609_P11, since it is in the coding region for the corresponding transcript.

Segment cluster AA318609_node_38 (SEQ ID NO:2411) according to the present invention is supported by 5 libraries. The number of libraries was determined as previously described. This segment can be found in the following transcript(s): AA318609_T9 (SEQ ID NO:2383) and AA318609_T23 (SEQ ID NO:2384). Table 2268 below describes the starting and ending position of this segment on each transcript.

TABLE 2268

Segment location on transcripts

| Transcript name | Segment starting position | Segment ending position |
|---|---|---|
| AA318609_T9 (SEQ ID NO: 2383) | 1462 | 1546 |
| AA318609_T23 (SEQ ID NO: 2384) | 1462 | 1546 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2269.

TABLE 2269

Oligonucleotides related to this segment

| Oligonucleotide name | Overexpressed in cancers | Chip reference |
|---|---|---|
| AA318609_0_0_890 | lung malignant tumors | LUN |

This segment can be found in both coding and non-coding regions of transcript(s) as follows. The segment can be found in a non-coding region of transcript(s) that are related to the following protein(s): AA318609_P3. This segment can also be found in the following protein(s): AA318609_P11, since it is in the coding region for the corresponding transcript.

Segment cluster AA318609_node_39 (SEQ ID NO:2412) according to the present invention can be found in the following transcript(s): AA318609_T5 (SEQ ID NO:2382), AA318609_T9 (SEQ ID NO:2383) and AA318609_T23 (SEQ ID NO:2384). Table 2270 below describes the starting and ending position of this segment on each transcript.

TABLE 2270

Segment location on transcripts

| Transcript name | Segment starting position | Segment ending position |
|---|---|---|
| AA318609_T5 (SEQ ID NO: 2382) | 2128 | 2152 |
| AA318609_T9 (SEQ ID NO: 2383) | 1547 | 1571 |
| AA318609_T23 (SEQ ID NO: 2384) | 1547 | 1571 |

This segment can be found in the following protein(s): AA318609_P1, AA318609_P3 and AA318609_P11.

Segment cluster AA318609_node_40 (SEQ ID NO:2413) according to the present invention is supported by 4 libraries. The number of libraries was determined as previously described. This segment can be found in the following transcript(s): AA318609_T23 (SEQ ID NO:2384). Table 2271 below describes the starting and ending position of this segment on each transcript.

TABLE 2271

Segment location on transcripts

| Transcript name | Segment starting position | Segment ending position |
|---|---|---|
| AA318609_T23 (SEQ ID NO: 2384) | 1572 | 1681 |

This segment can be found in the following protein(s): AA318609_P11.

Segment cluster AA318609_node_42 (SEQ ID NO:2414) according to the present invention is supported by 13 libraries. The number of libraries was determined as previously described. This segment can be found in the following transcript(s): AA318609_T5 (SEQ ID NO:2382) and AA318609_T9 (SEQ ID NO:2383). Table 2272 below describes the starting and ending position of this segment on each transcript.

TABLE 2272

Segment location on transcripts

| Transcript name | Segment starting position | Segment ending position |
|---|---|---|
| AA318609_T5 (SEQ ID NO: 2382) | 2153 | 2204 |
| AA318609_T9 (SEQ ID NO: 2383) | 1572 | 1623 |

This segment can be found in the following protein(s): AA318609_P1 and AA318609_P3.

Segment cluster AA318609_node_47 (SEQ ID NO:2415) according to the present invention is supported by 18 libraries. The number of libraries was determined as previously described. This segment can be found in the following transcript(s): AA318609_T5 (SEQ ID NO:2382) and AA318609_T9 (SEQ ID NO:2383). Table 2273 below describes the starting and ending position of this segment on each transcript.

TABLE 2273

Segment location on transcripts

| Transcript name | Segment starting position | Segment ending position |
|---|---|---|
| AA318609_T5 (SEQ ID NO: 2382) | 2205 | 2296 |
| AA318609_T9 (SEQ ID NO: 2383) | 1624 | 1715 |

This segment can be found in the following protein(s): AA318609_P1 and AA318609_P3.

Segment cluster AA318609_node_53 (SEQ ID NO:2416) according to the present invention is supported by 28 libraries. The number of libraries was determined as previously described. This segment can be found in the following transcript(s): AA318609_T5 (SEQ ID NO:2382) and AA318609_T9 (SEQ ID NO:2383). Table 2274 below describes the starting and ending position of this segment on each transcript.

TABLE 2274

Segment location on transcripts

| Transcript name | Segment starting position | Segment ending position |
|---|---|---|
| AA318609_T5 (SEQ ID NO: 2382) | 2573 | 2685 |
| AA318609_T9 (SEQ ID NO: 2383) | 1992 | 2104 |

This segment can be found in the following protein(s): AA318609_P1 and AA318609_P3.

Segment cluster AA318609_node_56 (SEQ ID NO:2417) according to the present invention is supported by 34 libraries. The number of libraries was determined as previously described. This segment can be found in the following transcript(s): AA318609_T5 (SEQ ID NO:2382) and AA318609_T9 (SEQ ID NO:2383). Table 2275 below describes the starting and ending position of this segment on each transcript.

TABLE 2275

Segment location on transcripts

| Transcript name | Segment starting position | Segment ending position |
|---|---|---|
| AA318609_T5 (SEQ ID NO: 2382) | 2686 | 2773 |
| AA318609_T9 (SEQ ID NO: 2383) | 2105 | 2192 |

This segment can be found in the following protein(s): AA318609_P1 and AA318609_P3.

Segment cluster AA318609_node_58 (SEQ ID NO:2418) according to the present invention is supported by 40 libraries. The number of libraries was determined as previously described. This segment can be found in the following transcript(s): AA318609_T5 (SEQ ID NO:2382) and AA318609_T9 (SEQ ID NO:2383). Table 2276 below describes the starting and ending position of this segment on each transcript.

TABLE 2276

Segment location on transcripts

| Transcript name | Segment starting position | Segment ending position |
|---|---|---|
| AA318609_T5 (SEQ ID NO: 2382) | 2774 | 2882 |
| AA318609_T9 (SEQ ID NO: 2383) | 2193 | 2301 |

This segment can be found in the following protein(s): AA318609_P1 and AA318609_P3.

Segment cluster AA318609_node_67 (SEQ ID NO:2419) according to the present invention is supported by 29 libraries. The number of libraries was determined as previously described. This segment can be found in the following transcript(s): AA318609_T5 (SEQ ID NO:2382) and AA318609_T9 (SEQ ID NO:2383). Table 2277 below describes the starting and ending position of this segment on each transcript.

TABLE 2277

Segment location on transcripts

| Transcript name | Segment starting position | Segment ending position |
|---|---|---|
| AA318609_T5 (SEQ ID NO: 2382) | 3372 | 3427 |
| AA318609_T9 (SEQ ID NO: 2383) | 2791 | 2846 |

This segment can be found in the following protein(s): AA318609_P1 and AA318609_P3.

Segment cluster AA318609_node__69 (SEQ ID NO:2420) according to the present invention is supported by 34 libraries. The number of libraries was determined as previously described. This segment can be found in the following transcript(s): AA318609_T5 (SEQ ID NO:2382) and AA318609_T9 (SEQ ID NO:2383). Table 2278 below describes the starting and ending position of this segment on each transcript.

TABLE 2278

Segment location on transcripts

| Transcript name | Segment starting position | Segment ending position |
|---|---|---|
| AA318609_T5 (SEQ ID NO: 2382) | 3428 | 3518 |
| AA318609_T9 (SEQ ID NO: 2383) | 2847 | 2937 |

This segment can be found in the following protein(s): AA318609_P1 and AA318609_P3.

Segment cluster AA318609_node__70 (SEQ ID NO:2421) according to the present invention is supported by 40 libraries. The number of libraries was determined as previously described. This segment can be found in the following transcript(s): AA318609_T5 (SEQ ID NO:2382), AA318609_T9 (SEQ ID NO:2383) and AA318609_T23 (SEQ ID NO:2384). Table 2279 below describes the starting and ending position of this segment on each transcript.

TABLE 2279

Segment location on transcripts

| Transcript name | Segment starting position | Segment ending position |
|---|---|---|
| AA318609_T5 (SEQ ID NO: 2382) | 3519 | 3592 |
| AA318609_T9 (SEQ ID NO: 2383) | 2938 | 3011 |
| AA318609_T23 (SEQ ID NO: 2384) | 1682 | 1755 |

This segment can be found in both coding and non-coding regions of transcript(s) as follows. The segment can be found in a non-coding region of transcript(s) that are related to the following protein(s): AA318609_P11. This segment can also be found in the following protein(s): AA318609_P1 and AA318609_P3, since it is in the coding region for the corresponding transcript.

Description for Cluster AA367524

Cluster AA367524 features 7 transcript(s) and 21 segment(s) of interest, the names for which are given in Tables 2280 and 2281, respectively, the sequences themselves are given at the end of the application. The selected protein variants are given in Table 2282.

TABLE 2280

Transcripts of interest
Transcript Name

AA367524_T0 (SEQ ID NO: 2422)
AA367524_T2 (SEQ ID NO: 2423)
AA367524_T4 (SEQ ID NO: 2424)
AA367524_T6 (SEQ ID NO: 2425)
AA367524_T7 (SEQ ID NO: 2426)
AA367524_T9 (SEQ ID NO: 2427)
AA367524_T12 (SEQ ID NO: 2428)

TABLE 2281

Segments of interest
Segment Name

AA367524_node__0 (SEQ ID NO: 2429)
AA367524_node__1 (SEQ ID NO: 2430)
AA367524_node__10 (SEQ ID NO: 2431)
AA367524_node__11 (SEQ ID NO: 2432)
AA367524_node__23 (SEQ ID NO: 2433)
AA367524_node__25 (SEQ ID NO: 2434)
AA367524_node__28 (SEQ ID NO: 2435)
AA367524_node__31 (SEQ ID NO: 2436)
AA367524_node__37 (SEQ ID NO: 2437)
AA367524_node__39 (SEQ ID NO: 2438)
AA367524_node__3 (SEQ ID NO: 2439)
AA367524_node__5 (SEQ ID NO: 2440)
AA367524_node__6 (SEQ ID NO: 2441)
AA367524_node__7 (SEQ ID NO: 2442)
AA367524_node__12 (SEQ ID NO: 2443)
AA367524_node__16 (SEQ ID NO: 2444)
AA367524_node__17 (SEQ ID NO: 2445)
AA367524_node__20 (SEQ ID NO: 2446)
AA367524_node__21 (SEQ ID NO: 2447)
AA367524_node__33 (SEQ ID NO: 2448)
AA367524_node__35 (SEQ ID NO: 2449)

TABLE 2282

Proteins of interest

| Protein Name | Corresponding Transcript(s) |
|---|---|
| AA367524_P1 | AA367524_T0 (SEQ ID NO: 2422); AA367524_T2 (SEQ ID NO: 2423); AA367524_T4 (SEQ ID NO: 2424); AA367524_T6 (SEQ ID NO: 2425); AA367524_T7 (SEQ ID NO: 2426); AA367524_T9 (SEQ ID NO: 2427); AA367524_T12 (SEQ ID NO: 2428) |

As noted above, cluster AA367524 features 21 segment(s), which were listed in Table 2281 above and for which the sequence(s) are given at the end of the application. These segment(s) are portions of nucleic acid sequence(s) which are described herein separately because they are of particular interest. A description of each segment according to the present invention is now provided.

Segment cluster AA367524_node__0 (SEQ ID NO:2429) according to the present invention is supported by 1 libraries. The number of libraries was determined as previously described. This segment can be found in the following transcript(s): AA367524_T7 (SEQ ID NO:2426), AA367524_T9 (SEQ ID NO:2427) and AA367524_T12 (SEQ ID NO:2428). Table 2283 below describes the starting and ending position of this segment on each transcript.

TABLE 2283

| Transcript name | Segment location on transcripts | |
|---|---|---|
| | Segment starting position | Segment ending position |
| AA367524_T7 (SEQ ID NO: 2426) | 1 | 131 |
| AA367524_T9 (SEQ ID NO: 2427) | 1 | 131 |
| AA367524_T12 (SEQ ID NO: 2428) | 1 | 131 |

This segment can be found in a non-coding region of transcript(s) that are related to the following protein(s): AA367524_P1.

Segment cluster AA367524_node_1 (SEQ ID NO:2430) according to the present invention is supported by 1 libraries. The number of libraries was determined as previously described. This segment can be found in the following transcript(s): AA367524_T12 (SEQ ID NO:2428). Table 2284 below describes the starting and ending position of this segment on each transcript.

TABLE 2284

| Transcript name | Segment location on transcripts | |
|---|---|---|
| | Segment starting position | Segment ending position |
| AA367524_T12 (SEQ ID NO: 2428) | 132 | 330 |

This segment can be found in a non-coding region of transcript(s) that are related to the following protein(s): AA367524_P1.

Segment cluster AA367524_node_10 (SEQ ID NO:2431) according to the present invention is supported by 9 libraries. The number of libraries was determined as previously described. This segment can be found in the following transcript(s): AA367524_T0 (SEQ ID NO:2422) and AA367524_T6 (SEQ ID NO:2425). Table 2285 below describes the starting and ending position of this segment on each transcript.

TABLE 2285

| Transcript name | Segment location on transcripts | |
|---|---|---|
| | Segment starting position | Segment ending position |
| AA367524_T0 (SEQ ID NO: 2422) | 1 | 209 |
| AA367524_T6 (SEQ ID NO: 2425) | 1 | 209 |

This segment can be found in a non-coding region of transcript(s) that are related to the following protein(s): AA367524_P1.

Segment cluster AA367524_node_11 (SEQ ID NO:2432) according to the present invention is supported by 15 libraries. The number of libraries was determined as previously described. This segment can be found in the following transcript(s): AA367524_T0 (SEQ ID NO:2422). Table 2286 below describes the starting and ending position of this segment on each transcript.

TABLE 2286

| Transcript name | Segment location on transcripts | |
|---|---|---|
| | Segment starting position | Segment ending position |
| AA367524_T0 (SEQ ID NO: 2422) | 210 | 339 |

This segment can be found in a non-coding region of transcript(s) that are related to the following protein(s): AA367524_P1.

Segment cluster AA367524_node_23 (SEQ ID NO:2433) according to the present invention is supported by 31 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2287 below describes the starting and ending position of this segment on each transcript.

TABLE 2287

| Transcript name | Segment location on transcripts | |
|---|---|---|
| | Segment starting position | Segment ending position |
| AA367524_T0 (SEQ ID NO: 2422) | 813 | 1010 |
| AA367524_T2 (SEQ ID NO: 2423) | 528 | 725 |
| AA367524_T4 (SEQ ID NO: 2424) | 655 | 852 |
| AA367524_T6 (SEQ ID NO: 2425) | 571 | 768 |
| AA367524_T7 (SEQ ID NO: 2426) | 597 | 794 |
| AA367524_T9 (SEQ ID NO: 2427) | 655 | 852 |
| AA367524_T12 (SEQ ID NO: 2428) | 692 | 889 |

This segment can be found in the following protein(s): AA367524_P1.

Segment cluster AA367524_node_25 (SEQ ID NO:2434) according to the present invention is supported by 33 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2288 below describes the starting and ending position of this segment on each transcript.

TABLE 2288

| Transcript name | Segment location on transcripts | |
|---|---|---|
| | Segment starting position | Segment ending position |
| AA367524_T0 (SEQ ID NO: 2422) | 1011 | 1241 |
| AA367524_T2 (SEQ ID NO: 2423) | 726 | 956 |
| AA367524_T4 (SEQ ID NO: 2424) | 853 | 1083 |
| AA367524_T6 (SEQ ID NO: 2425) | 769 | 999 |
| AA367524_T7 (SEQ ID NO: 2426) | 795 | 1025 |
| AA367524_T9 (SEQ ID NO: 2427) | 853 | 1083 |
| AA367524_T12 (SEQ ID NO: 2428) | 890 | 1120 |

This segment can be found in the following protein(s): AA367524_P1.

Segment cluster AA367524_node__28 (SEQ ID NO:2435) according to the present invention is supported by 39 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2289 below describes the starting and ending position of this segment on each transcript.

TABLE 2289

Segment location on transcripts

| Transcript name | Segment starting position | Segment ending position |
| --- | --- | --- |
| AA367524_T0 (SEQ ID NO: 2422) | 1242 | 1375 |
| AA367524_T2 (SEQ ID NO: 2423) | 957 | 1090 |
| AA367524_T4 (SEQ ID NO: 2424) | 1084 | 1217 |
| AA367524_T6 (SEQ ID NO: 2425) | 1000 | 1133 |
| AA367524_T7 (SEQ ID NO: 2426) | 1026 | 1159 |
| AA367524_T9 (SEQ ID NO: 2427) | 1084 | 1217 |
| AA367524_T12 (SEQ ID NO: 2428) | 1121 | 1254 |

This segment can be found in the following protein(s): AA367524_P1.

Segment cluster AA367524_node__31 (SEQ ID NO:2436) according to the present invention is supported by 37 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2290 below describes the starting and ending position of this segment on each transcript.

TABLE 2290

Segment location on transcripts

| Transcript name | Segment starting position | Segment ending position |
| --- | --- | --- |
| AA367524_T0 (SEQ ID NO: 2422) | 1376 | 1498 |
| AA367524_T2 (SEQ ID NO: 2423) | 1091 | 1213 |
| AA367524_T4 (SEQ ID NO: 2424) | 1218 | 1340 |
| AA367524_T6 (SEQ ID NO: 2425) | 1134 | 1256 |
| AA367524_T7 (SEQ ID NO: 2426) | 1160 | 1282 |
| AA367524_T9 (SEQ ID NO: 2427) | 1218 | 1340 |
| AA367524_T12 (SEQ ID NO: 2428) | 1255 | 1377 |

This segment can be found in the following protein(s): AA367524_P1.

Segment cluster AA367524_node__37 (SEQ ID NO:2437) according to the present invention is supported by 44 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2291 below describes the starting and ending position of this segment on each transcript.

TABLE 2291

Segment location on transcripts

| Transcript name | Segment starting position | Segment ending position |
| --- | --- | --- |
| AA367524_T0 (SEQ ID NO: 2422) | 1718 | 1843 |
| AA367524_T2 (SEQ ID NO: 2423) | 1433 | 1558 |
| AA367524_T4 (SEQ ID NO: 2424) | 1560 | 1685 |
| AA367524_T6 (SEQ ID NO: 2425) | 1476 | 1601 |
| AA367524_T7 (SEQ ID NO: 2426) | 1502 | 1627 |
| AA367524_T9 (SEQ ID NO: 2427) | 1560 | 1685 |
| AA367524_T12 (SEQ ID NO: 2428) | 1597 | 1722 |

This segment can be found in the following protein(s): AA367524_P1.

Segment cluster AA367524_node__39 (SEQ ID NO:2438) according to the present invention is supported by 42 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2292 below describes the starting and ending position of this segment on each transcript.

TABLE 2292

Segment location on transcripts

| Transcript name | Segment starting position | Segment ending position |
| --- | --- | --- |
| AA367524_T0 (SEQ ID NO: 2422) | 1844 | 2075 |
| AA367524_T2 (SEQ ID NO: 2423) | 1559 | 1790 |
| AA367524_T4 (SEQ ID NO: 2424) | 1686 | 1917 |
| AA367524_T6 (SEQ ID NO: 2425) | 1602 | 1833 |
| AA367524_T7 (SEQ ID NO: 2426) | 1628 | 1859 |
| AA367524_T9 (SEQ ID NO: 2427) | 1686 | 1917 |
| AA367524_T12 (SEQ ID NO: 2428) | 1723 | 1954 |

This segment can be found in the following protein(s): AA367524_P1.

According to an optional embodiment of the present invention, short segments related to the above cluster are also provided. These segments are up to about 120 bp in length, and so are included in a separate description.

Segment cluster AA367524_node__3 (SEQ ID NO:2439) according to the present invention is supported by 2 libraries. The number of libraries was determined as previously described. This segment can be found in the following transcript(s): AA367524_T7 (SEQ ID NO:2426) and AA367524_T9 (SEQ ID NO:2427). Table 2293 below describes the starting and ending position of this segment on each transcript.

TABLE 2293

Segment location on transcripts

| Transcript name | Segment starting position | Segment ending position |
| --- | --- | --- |
| AA367524_T7 (SEQ ID NO: 2426) | 132 | 235 |
| AA367524_T9 (SEQ ID NO: 2427) | 132 | 235 |

This segment can be found in a non-coding region of transcript(s) that are related to the following protein(s): AA367524_P1.

Segment cluster AA367524_node_5 (SEQ ID NO:2440) according to the present invention is supported by 3 libraries. The number of libraries was determined as previously described. This segment can be found in the following transcript(s): AA367524_T2 (SEQ ID NO:2423) and AA367524_T4 (SEQ ID NO:2424). Table 2294 below describes the starting and ending position of this segment on each transcript.

TABLE 2294

Segment location on transcripts

| Transcript name | Segment starting position | Segment ending position |
|---|---|---|
| AA367524_T2 (SEQ ID NO: 2423) | 1 | 54 |
| AA367524_T4 (SEQ ID NO: 2424) | 1 | 54 |

This segment can be found in a non-coding region of transcript(s) that are related to the following protein(s): AA367524_P1.

Segment cluster AA367524_node_6 (SEQ ID NO:2441) according to the present invention is supported by 3 libraries. The number of libraries was determined as previously described. This segment can be found in the following transcript(s): AA367524_T4 (SEQ ID NO:2424). Table 2295 below describes the starting and ending position of this segment on each transcript.

TABLE 2295

Segment location on transcripts

| Transcript name | Segment starting position | Segment ending position |
|---|---|---|
| AA367524_T4 (SEQ ID NO: 2424) | 55 | 123 |

This segment can be found in a non-coding region of transcript(s) that are related to the following protein(s): AA367524_P1.

Segment cluster AA367524_node_7 (SEQ ID NO:2442) according to the present invention is supported by 3 libraries. The number of libraries was determined as previously described. This segment can be found in the following transcript(s): AA367524_T4 (SEQ ID NO:2424) and AA367524_T9 (SEQ ID NO:2427). Table 2296 below describes the starting and ending position of this segment on each transcript.

TABLE 2296

Segment location on transcripts

| Transcript name | Segment starting position | Segment ending position |
|---|---|---|
| AA367524_T4 (SEQ ID NO: 2424) | 124 | 181 |
| AA367524_T9 (SEQ ID NO: 2427) | 236 | 293 |

This segment can be found in a non-coding region of transcript(s) that are related to the following protein(s): AA367524_P1.

Segment cluster AA367524_node_12 (SEQ ID NO:2443) according to the present invention is supported by 17 libraries. The number of libraries was determined as previously described. This segment can be found in the following transcript(s): AA367524_T0 (SEQ ID NO:2422), AA367524_T2 (SEQ ID NO:2423) and AA367524_T4 (SEQ ID NO:2424). Table 2297 below describes the starting and ending position of this segment on each transcript.

TABLE 2297

Segment location on transcripts

| Transcript name | Segment starting position | Segment ending position |
|---|---|---|
| AA367524_T0 (SEQ ID NO: 2422) | 340 | 451 |
| AA367524_T2 (SEQ ID NO: 2423) | 55 | 166 |
| AA367524_T4 (SEQ ID NO: 2424) | 182 | 293 |

This segment can be found in a non-coding region of transcript(s) that are related to the following protein(s): AA367524_P1.

Segment cluster AA367524_node_16 (SEQ ID NO:2444) according to the present invention is supported by 25 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2298 below describes the starting and ending position of this segment on each transcript.

TABLE 2298

Segment location on transcripts

| Transcript name | Segment starting position | Segment ending position |
|---|---|---|
| AA367524_T0 (SEQ ID NO: 2422) | 452 | 560 |
| AA367524_T2 (SEQ ID NO: 2423) | 167 | 275 |
| AA367524_T4 (SEQ ID NO: 2424) | 294 | 402 |
| AA367524_T6 (SEQ ID NO: 2425) | 210 | 318 |
| AA367524_T7 (SEQ ID NO: 2426) | 236 | 344 |
| AA367524_T9 (SEQ ID NO: 2427) | 294 | 402 |
| AA367524_T12 (SEQ ID NO: 2428) | 331 | 439 |

This segment can be found in the following protein(s): AA367524_P1.

Segment cluster AA367524_node_17 (SEQ ID NO:2445) according to the present invention is supported by 27 libraries. The number of libraries was determined as previously described. This segment can be found in the following transcript(s): AA367524_T0 (SEQ ID NO:2422), AA367524_T2 (SEQ ID NO:2423), (SEQ ID NO:2424), AA367524_T6 (SEQ ID NO:2425), (SEQ ID NO:2426), AA367524_T9 (SEQ ID NO:2427) and AA367524_T12 (SEQ ID NO:2428). Table 2299 below describes the starting and ending position of this segment on each transcript.

TABLE 2299

Segment location on transcripts

| Transcript name | Segment starting position | Segment ending position |
|---|---|---|
| AA367524_T0 (SEQ ID NO: 2422) | 561 | 665 |
| AA367524_T2 (SEQ ID NO: 2423) | 276 | 380 |
| AA367524_T4 (SEQ ID NO: 2424) | 403 | 507 |
| AA367524_T6 (SEQ ID NO: 2425) | 319 | 423 |

TABLE 2299-continued

Segment location on transcripts

| Transcript name | Segment starting position | Segment ending position |
|---|---|---|
| AA367524_T7 (SEQ ID NO: 2426) | 345 | 449 |
| AA367524_T9 (SEQ ID NO: 2427) | 403 | 507 |
| AA367524_T12 (SEQ ID NO: 2428) | 440 | 544 |

This segment can be found in the following protein(s): AA367524_P1.

Segment cluster AA367524_node_20 (SEQ ID NO:2446) according to the present invention is supported by 30 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2300 below describes the starting and ending position of this segment on each transcript.

TABLE 2300

Segment location on transcripts

| Transcript name | Segment starting position | Segment ending position |
|---|---|---|
| AA367524_T0 (SEQ ID NO: 2422) | 666 | 698 |
| AA367524_T2 (SEQ ID NO: 2423) | 381 | 413 |
| AA367524_T4 (SEQ ID NO: 2424) | 508 | 540 |
| AA367524_T6 (SEQ ID NO: 2425) | 424 | 456 |
| AA367524_T7 (SEQ ID NO: 2426) | 450 | 482 |
| AA367524_T9 (SEQ ID NO: 2427) | 508 | 540 |
| AA367524_T12 (SEQ ID NO: 2428) | 545 | 577 |

This segment can be found in the following protein(s): AA367524_P1.

Segment cluster AA367524_node_21 (SEQ ID NO:2447) according to the present invention is supported by 28 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2301 below describes the starting and ending position of this segment on each transcript.

TABLE 2301

Segment location on transcripts

| Transcript name | Segment starting position | Segment ending position |
|---|---|---|
| AA367524_T0 (SEQ ID NO: 2422) | 699 | 812 |
| AA367524_T2 (SEQ ID NO: 2423) | 414 | 527 |
| AA367524_T4 (SEQ ID NO: 2424) | 541 | 654 |
| AA367524_T6 (SEQ ID NO: 2425) | 457 | 570 |
| AA367524_T7 (SEQ ID NO: 2426) | 483 | 596 |
| AA367524_T9 (SEQ ID NO: 2427) | 541 | 654 |
| AA367524_T12 (SEQ ID NO: 2428) | 578 | 691 |

This segment can be found in the following protein(s): AA367524_P1.

Segment cluster AA367524_node_33 (SEQ ID NO:2448) according to the present invention is supported by 36 libraries. The number of libraries was determined as previously described. This segment can be found in the following transcript(s): (SEQ ID NO:2422), AA367524_T2 (SEQ ID NO:2423), (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2302 below describes the starting and ending position of this segment on each transcript.

TABLE 2302

Segment location on transcripts

| Transcript name | Segment starting position | Segment ending position |
|---|---|---|
| AA367524_T0 (SEQ ID NO: 2422) | 1499 | 1598 |
| AA367524_T2 (SEQ ID NO: 2423) | 1214 | 1313 |
| AA367524_T4 (SEQ ID NO: 2424) | 1341 | 1440 |
| AA367524_T6 (SEQ ID NO: 2425) | 1257 | 1356 |
| AA367524_T7 (SEQ ID NO: 2426) | 1283 | 1382 |
| AA367524_T9 (SEQ ID NO: 2427) | 1341 | 1440 |
| AA367524_T12 (SEQ ID NO: 2428) | 1378 | 1477 |

This segment can be found in the following protein(s): AA367524_P1.

Segment cluster AA367524_node_35 (SEQ ID NO:2449) according to the present invention is supported by 44 libraries. The number of libraries was determined as previously described. This segment can be found in the following transcript(s): AA367524_T0 (SEQ ID NO:2422), AA367524_T2 (SEQ ID NO:2423), AA367524_T4 (SEQ ID NO:2424), AA367524_T6 (SEQ ID NO:2425), AA367524_T7 (SEQ ID NO:2426), AA367524_T9 (SEQ ID NO:2427) and AA367524_T12 (SEQ ID NO:2428). Table 2303 below describes the starting and ending position of this segment on each transcript.

TABLE 2303

Segment location on transcripts

| Transcript name | Segment starting position | Segment ending position |
|---|---|---|
| AA367524_T0 (SEQ ID NO:2422) | 1599 | 1717 |
| AA367524_T2 (SEQ ID NO:2423) | 1314 | 1432 |
| AA367524_T4 (SEQ ID NO:2424) | 1441 | 1559 |
| AA367524_T6 (SEQ ID NO:2425) | 1357 | 1475 |
| AA367524_T7 (SEQ ID NO:2426) | 1383 | 1501 |
| AA367524_T9 (SEQ ID NO:2427) | 1441 | 1559 |
| AA367524_T12 (SEQ ID NO:2428) | 1478 | 1596 |

This segment can be found in the following protein(s): AA367524_P1.

Description for Cluster AA563651

Cluster AA563651 features 5 transcript(s) and 7 segment(s) of interest, the names for which are given in Tables 2304 and 2305, respectively, the sequences themselves are given at the end of the application. The selected protein variants are given in Table 2306.

TABLE 2304

| Transcripts of interest Transcript Name |
|---|
| AA563651_T0 (SEQ ID NO: 2450) |
| AA563651_T1 (SEQ ID NO: 2451) |

TABLE 2304-continued

Transcripts of interest
Transcript Name

AA563651_T2 (SEQ ID NO: 2452)
AA563651_T3 (SEQ ID NO: 2453)
AA563651_T4 (SEQ ID NO: 2454)

TABLE 2305

Segments of interest
Segment Name

AA563651_node_0 (SEQ ID NO: 2455)
AA563651_node_2 (SEQ ID NO: 2456)
AA563651_node_4 (SEQ ID NO: 2457)
AA563651_node_6 (SEQ ID NO: 2458)
AA563651_node_7 (SEQ ID NO: 2459)
AA563651_node_3 (SEQ ID NO: 2460)
AA563651_node_5 (SEQ ID NO: 2461)

TABLE 2306

Proteins of interest

| Protein Name | Corresponding Transcript(s) |
|---|---|
| AA563651_P1 | AA563651_T0 (SEQ ID NO: 2450); AA563651_T1 (SEQ ID NO: 2451); AA563651_T2 (SEQ ID NO: 2452); AA563651_T3 (SEQ ID NO: 2453) |
| AA563651_P2 | AA563651_T4 (SEQ ID NO: 2454) |

Cluster AA563651 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 60 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 60 and Table 2307. This cluster is overexpressed (at least at a minimum level) in the following pathological conditions: epithelial malignant tumors, a mixture of malignant tumors from different tissues and lung malignant tumors.

TABLE 2307

Normal tissue distribution

| Name of Tissue | Number |
|---|---|
| Adrenal | 0 |
| Brain | 2 |
| Colon | 0 |
| Epithelial | 2 |
| General | 2 |
| Kidney | 0 |
| Liver | 0 |
| Lung | 2 |
| Breast | 0 |
| Bone marrow | 0 |
| prostate | 0 |
| Skin | 0 |
| stomach | 0 |
| uterus | 4 |

TABLE 2308

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 2.1e−01 | 3.4 | 2.9e−01 | 2.7 |
| Brain | 2.1e−01 | 3.1e−01 | 3.9e−01 | 2.6 | 5.5e−01 | 1.7 |
| colon | 4.3e−02 | 2.5e−02 | 1.7e−01 | 3.3 | 2.1e−01 | 2.9 |
| epithelial | 9.5e−03 | 4.1e−04 | 2.9e−02 | 3.6 | 6.0e−07 | 6.7 |
| general | 5.6e−04 | 6.5e−06 | 4.3e−03 | 3.8 | 4.7e−11 | 6.5 |
| kidney | 2.7e−01 | 3.7e−01 | 5.8e−01 | 1.9 | 7.0e−01 | 1.5 |
| Liver | 1 | 6.8e−01 | 1 | 1.0 | 2.3e−01 | 1.9 |
| Lung | 7.6e−01 | 5.4e−01 | 1 | 0.8 | 8.1e−03 | 3.4 |
| breast | 6.1e−01 | 3.0e−01 | 1 | 1.0 | 6.8e−01 | 1.4 |
| Bone marrow | 1 | 6.7e−01 | 1 | 1.0 | 5.3e−01 | 1.9 |
| prostate | 1 | 7.8e−01 | 1 | 1.0 | 7.5e−01 | 1.3 |
| Skin | 1 | 4.4e−01 | 1 | 1.0 | 1.3e−03 | 2.1 |
| stomach | 1 | 4.5e−01 | 1 | 1.0 | 5.1e−01 | 1.8 |
| uterus | 7.4e−01 | 4.1e−01 | 1 | 0.9 | 6.4e−01 | 1.4 |

As noted above, cluster AA563651 features 7 segment(s), which were listed in Table 2305 above and for which the sequence(s) are given at the end of the application. These segment(s) are portions of nucleic acid sequence(s) which are described herein separately because they are of particular interest. A description of each segment according to the present invention is now provided.

Segment cluster AA563651_node_0 (SEQ ID NO:2455) according to the present invention is supported by 12 libraries. The number of libraries was determined as previously described. This segment can be found in the following transcript(s): AA563651_T0 (SEQ ID NO:2450), AA563651_T1 (SEQ ID NO:2451), AA563651_T2 (SEQ ID NO:2452), AA563651_T3 (SEQ ID NO:2453) and AA563651_T4 (SEQ ID NO:2454). Table 2309 below describes the starting and ending position of this segment on each transcript.

TABLE 2309

Segment location on transcripts

| Transcript name | Segment starting position | Segment ending position |
|---|---|---|
| AA563651_T0 (SEQ ID NO: 2450) | 1 | 125 |
| AA563651_T1 (SEQ ID NO: 2451) | 1 | 125 |
| AA563651_T2 (SEQ ID NO: 2452) | 1 | 125 |
| AA563651_T3 (SEQ ID NO: 2453) | 1 | 125 |
| AA563651_T4 (SEQ ID NO: 2454) | 1 | 125 |

This segment can be found in both coding and non-coding regions of transcript(s) as follows. The segment can be found in a non-coding region of transcript(s) that are related to the following protein(s): AA563651_P1. This segment can also be found in the following protein(s): AA563651_P2, since it is in the coding region for the corresponding transcript.

Segment cluster AA563651_node_2 (SEQ ID NO:2456) according to the present invention is supported by 17 libraries. The number of libraries was determined as previously described. This segment can be found in the following transcript(s): AA563651_T0 (SEQ ID NO:2450), AA563651_T1 (SEQ ID NO:2451), AA563651_T2 (SEQ ID NO:2452) and AA563651_T3 (SEQ ID NO:2453). Table 2310 below describes the starting and ending position of this segment on each transcript.

TABLE 2310

Segment location on transcripts

| Transcript name | Segment starting position | Segment ending position |
|---|---|---|
| AA563651_T0 (SEQ ID NO: 2450) | 126 | 521 |
| AA563651_T1 (SEQ ID NO: 2451) | 126 | 521 |
| AA563651_T2 (SEQ ID NO: 2452) | 126 | 521 |
| AA563651_T3 (SEQ ID NO: 2453) | 126 | 521 |

This segment can be found in a non-coding region of transcript(s) that are related to the following protein(s): AA563651_P1.

Segment cluster AA563651_node_4 (SEQ ID NO:2457) according to the present invention is supported by 50 libraries. The number of libraries was determined as previously described. This segment can be found in the following transcript(s): (SEQ ID NO:2450), AA563651_T1 (SEQ ID NO:2451), (SEQ ID NO:2452) and AA563651_T3 (SEQ ID NO:2453). Table 2311 below describes the starting and ending position of this segment on each transcript.

TABLE 2311

Segment location on transcripts

| Transcript name | Segment starting position | Segment ending position |
|---|---|---|
| AA563651_T0 (SEQ ID NO: 2450) | 543 | 4478 |
| AA563651_T1 (SEQ ID NO: 2451) | 522 | 4457 |
| AA563651_T2 (SEQ ID NO: 2452) | 543 | 4478 |
| AA563651_T3 (SEQ ID NO: 2453) | 543 | 4478 |

This segment can be found in the following protein(s): AA563651_P1.

Segment cluster AA563651_node_6 (SEQ ID NO:2458) according to the present invention is supported by 14 libraries. The number of libraries was determined as previously described. This segment can be found in the following transcript(s): AA563651_T0 (SEQ ID NO:2450), AA563651_T1 (SEQ ID NO:2451), AA563651_T2 (SEQ ID NO:2452) and AA563651_T4 (SEQ ID NO:2454). Table 2312 below describes the starting and ending position of this segment on each transcript.

TABLE 2312

Segment location on transcripts

| Transcript name | Segment starting position | Segment ending position |
|---|---|---|
| AA563651_T0 (SEQ ID NO: 2450) | 4487 | 4639 |
| AA563651_T1 (SEQ ID NO: 2451) | 4466 | 4618 |
| AA563651_T2 (SEQ ID NO: 2452) | 4487 | 4639 |
| AA563651_T4 (SEQ ID NO: 2454) | 134 | 286 |

This segment can be found in both coding and non-coding regions of transcript(s) as follows. The segment can be found in a non-coding region of transcript(s) that are related to the following protein(s): AA563651_P1. This segment can also be found in the following protein(s): AA563651_P2, since it is in the coding region for the corresponding transcript.

Segment cluster AA563651_node_7 (SEQ ID NO:2459) according to the present invention is supported by 26 libraries. The number of libraries was determined as previously described. This segment can be found in the following transcript(s): AA563651_T0 (SEQ ID NO:2450), AA563651_T1 (SEQ ID NO:2451), AA563651_T2 (SEQ ID NO:2452), AA563651_T3 (SEQ ID NO:2453) and AA563651_T4 (SEQ ID NO:2454). Table 2313 below describes the starting and ending position of this segment on each transcript.

TABLE 2313

Segment location on transcripts

| Transcript name | Segment starting position | Segment ending position |
|---|---|---|
| AA563651_T0 (SEQ ID NO: 2450) | 4640 | 5614 |
| AA563651_T1 (SEQ ID NO: 2451) | 4619 | 5593 |
| AA563651_T2 (SEQ ID NO: 2452) | 4640 | 5924 |
| AA563651_T3 (SEQ ID NO: 2453) | 4487 | 5461 |
| AA563651_T4 (SEQ ID NO: 2454) | 287 | 1261 |

This segment can be found in a non-coding region of transcript(s) that are related to the following protein(s): AA563651_P1 and AA563651_P2.

According to an optional embodiment of the present invention, short segments related to the above cluster are also provided. These segments are up to about 120 bp in length, and so are included in a separate description.

Segment cluster AA563651_node_3 (SEQ ID NO:2460) according to the present invention can be found in the following transcript(s): AA563651_T0 (SEQ ID NO:2450), AA563651_T2 (SEQ ID NO:2452) and AA563651_T3 (SEQ ID NO:2453). Table 2314 below describes the starting and ending position of this segment on each transcript.

TABLE 2314

Segment location on transcripts

| Transcript name | Segment starting position | Segment ending position |
|---|---|---|
| AA563651_T0 (SEQ ID NO: 2450) | 522 | 542 |
| AA563651_T2 (SEQ ID NO: 2452) | 522 | 542 |
| AA563651_T3 (SEQ ID NO: 2453) | 522 | 542 |

This segment can be found in a non-coding region of transcript(s) that are related to the following protein(s): AA563651_P1.

Segment cluster AA563651_node_5 (SEQ ID NO:2461) according to the present invention can be found in the following transcript(s): AA563651_T0 (SEQ ID NO:2450), AA563651_T1 (SEQ ID NO:2451), AA563651_T2 (SEQ ID NO:2452), AA563651_T3 (SEQ ID NO:2453) and AA563651_T4 (SEQ ID NO:2454). Table 2315 below describes the starting and ending position of this segment on each transcript.

TABLE 2315

Segment location on transcripts

| Transcript name | Segment starting position | Segment ending position |
|---|---|---|
| AA563651_T0 (SEQ ID NO: 2450) | 4479 | 4486 |
| AA563651_T1 (SEQ ID NO: 2451) | 4458 | 4465 |
| AA563651_T2 (SEQ ID NO: 2452) | 4479 | 4486 |
| AA563651_T3 (SEQ ID NO: 2453) | 4479 | 4486 |
| AA563651_T4 (SEQ ID NO: 2454) | 126 | 133 |

This segment can be found in both coding and non-coding regions of transcript(s) as follows. The segment can be found in a non-coding region of transcript(s) that are related to the following protein(s): AA563651_P1. This segment can also be found in the following protein(s): AA563651_P2, since it is in the coding region for the corresponding transcript.

Description for Cluster D11717

Cluster D11717 features 7 transcript(s) and 31 segment(s) of interest, the names for which are given in Tables 2316 and 2317, respectively, the sequences themselves are given at the end of the application. The selected protein variants are given in Table 2318.

TABLE 2316

Transcripts of interest
Transcript Name

D11717_T0 (SEQ ID NO: 2462)
D11717_T1 (SEQ ID NO: 2463)
D11717_T4 (SEQ ID NO: 2464)
D11717_T8 (SEQ ID NO: 2465)
D11717_T9 (SEQ ID NO: 2466)
D11717_T11 (SEQ ID NO: 2467)
D11717_T14 (SEQ ID NO: 2468)

TABLE 2317

Segments of interest
Segment Name

D11717_node_12 (SEQ ID NO: 2469)
D11717_node_13 (SEQ ID NO: 2470)
D11717_node_14 (SEQ ID NO: 2471)
D11717_node_15 (SEQ ID NO: 2472)
D11717_node_16 (SEQ ID NO: 2473)
D11717_node_20 (SEQ ID NO: 2474)
D11717_node_21 (SEQ ID NO: 2475)
D11717_node_28 (SEQ ID NO: 2476)
D11717_node_37 (SEQ ID NO: 2477)
D11717_node_2 (SEQ ID NO: 2478)
D11717_node_3 (SEQ ID NO: 2479)
D11717_node_4 (SEQ ID NO: 2480)
D11717_node_5 (SEQ ID NO: 2481)
D11717_node_19 (SEQ ID NO: 2482)
D11717_node_22 (SEQ ID NO: 2483)
D11717_node_23 (SEQ ID NO: 2484)
D11717_node_24 (SEQ ID NO: 2485)
D11717_node_25 (SEQ ID NO: 2486)
D11717_node_26 (SEQ ID NO: 2487)
D11717_node_27 (SEQ ID NO: 2488)
D11717_node_29 (SEQ ID NO: 2489)
D11717_node_30 (SEQ ID NO: 2490)
D11717_node_31 (SEQ ID NO: 2491)
D11717_node_32 (SEQ ID NO: 2492)
D11717_node_33 (SEQ ID NO: 2493)
D11717_node_34 (SEQ ID NO: 2494)
D11717_node_35 (SEQ ID NO: 2495)
D11717_node_36 (SEQ ID NO: 2496)
D11717_node_38 (SEQ ID NO: 2497)
D11717_node_39 (SEQ ID NO: 2498)
D11717_node_40 (SEQ ID NO: 2499)

TABLE 2318

Proteins of interest

| Protein Name | Corresponding Transcript(s) |
|---|---|
| D11717_P2 | D11717_T4 (SEQ ID NO: 2464) |
| D11717_P6 | D11717_T8 (SEQ ID NO: 2465) |
| D11717_P7 | D11717_T9 (SEQ ID NO: 2466) |
| D11717_P8 | D11717_T11 (SEQ ID NO: 2467) |
| D11717_P11 | D11717_T14 (SEQ ID NO: 2468) |
| D11717_P16 | D11717_T0 (SEQ ID NO: 2462); D11717_T1 (SEQ ID NO: 2463) |

These sequences are variants of the known protein Growth/differentiation factor 15 precursor (SwissProt accession identifier GDFF_HUMAN; known also according to the synonyms GDF-15; Placental bone morphogenic protein; Placental TGF-beta; Macrophage inhibitory cytokine-1; MIC-1; Prostate differentiation factor; NSAID-regulated protein 1; NRG-1), referred to herein as the previously known protein.

The sequence for protein Growth/differentiation factor 15 precursor is given at the end of the application, as "Growth/differentiation factor 15 precursor amino acid sequence". Known polymorphisms for this sequence are as shown in Table 2319.

TABLE 2319

Amino acid mutations for Known Protein

| SNP position(s) on amino acid sequence | Comment |
|---|---|
| 48 | T -> S (in dbSNP: 1059369). /FTId = VAR_010386. |
| 9 | L -> V |
| 202 | H -> D |
| 269 | V -> E |
| 288 | T -> A |

Protein Growth/differentiation factor 15 precursor localization is believed to be Secreted (Probable).

A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: signal transduction; TGFbeta receptor signaling pathway; cell-cell signaling, which are annotation(s) related to Biological Process; cytokine; growth factor, which are annotation(s) related to Molecular Function; and extracellular, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster D11717 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 61 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 61 and Table 2320. This cluster is overexpressed (at least at a minimum level) in the following pathological conditions: brain malignant tumors, colorectal cancer, epithelial malignant tumors, a mixture of malignant tumors from different tissues, myosarcoma and gastric carcinoma.

TABLE 2320

Normal tissue distribution

| Name of Tissue | Number |
|---|---|
| bladder | 123 |
| Brain | 0 |
| Colon | 6 |
| epithelial | 79 |
| general | 52 |
| kidney | 116 |
| Liver | 48 |
| Lung | 78 |
| Lymph nodes | 0 |
| Breast | 17 |
| muscle | 0 |
| Ovary | 0 |
| pancreas | 84 |
| prostate | 251 |
| Skin | 127 |
| stomach | 0 |
| Uterus | 54 |

TABLE 2321

P values and ratios for expression in cancerous tissue

| Name of Tissue | P1 | P2 | SP1 | R3 | SP2 | R4 |
|---|---|---|---|---|---|---|
| bladder | 7.8e−01 | 8.1e−01 | 7.7e−01 | 0.6 | 9.1e−01 | 0.5 |
| Brain | 7.8e−02 | 1.4e−01 | 2.3e−03 | 12.7 | 1.2e−02 | 7.7 |
| Colon | 1.1e−02 | 1.1e−02 | 2.5e−04 | 7.7 | 9.0e−04 | 6.5 |
| epithelial | 2.0e−02 | 2.6e−03 | 6.4e−03 | 1.5 | 1.0e−16 | 2.0 |
| general | 6.2e−04 | 5.6e−06 | 3.0e−05 | 1.7 | 5.9e−40 | 2.7 |
| kidney | 2.7e−01 | 3.3e−01 | 6.2e−01 | 0.9 | 7.8e−01 | 0.7 |
| Liver | 9.1e−01 | 2.1e−01 | 1 | 0.5 | 1.1e−05 | 1.6 |
| Lung | 8.0e−01 | 8.4e−01 | 2.4e−01 | 1.2 | 1.3e−02 | 1.2 |
| Lymph nodes | 1 | 5.7e−01 | 1 | 1.0 | 5.8e−01 | 1.7 |
| Breast | 6.2e−01 | 4.4e−01 | 6.9e−01 | 1.2 | 5.6e−01 | 1.3 |
| muscle | 1 | 2.9e−01 | 1 | 1.0 | 9.3e−12 | 4.1 |
| Ovary | 3.8e−01 | 2.6e−01 | 6.8e−01 | 1.6 | 5.9e−01 | 1.7 |
| pancreas | 7.1e−01 | 4.7e−01 | 9.9e−01 | 0.3 | 2.4e−02 | 0.6 |
| prostate | 3.3e−01 | 3.1e−01 | 1.8e−01 | 1.2 | 3.5e−01 | 1.0 |
| Skin | 6.0e−01 | 1.7e−01 | 7.8e−01 | 0.7 | 9.3e−16 | 1.1 |
| stomach | 3.0e−01 | 3.8e−02 | 5.0e−01 | 2.0 | 1.2e−03 | 4.8 |
| Uterus | 4.4e−01 | 5.3e−01 | 7.8e−01 | 0.7 | 8.0e−01 | 0.7 |

As noted above, cluster D11717 features 31 segment(s), which were listed in Table 2317 above and for which the sequence(s) are given at the end of the application. These segment(s) are portions of nucleic acid sequence(s) which are described herein separately because they are of particular interest. A description of each segment according to the present invention is now provided.

Segment cluster D11717_node_12 (SEQ ID NO:2469) according to the present invention is supported by 159 libraries. The number of libraries was determined as previously described. This segment can be found in the following transcript(s): D11717_T0 (SEQ ID NO:2462), D11717_T1 (SEQ ID NO:2463), D11717_T8 (SEQ ID NO:2465), D11717_T9 (SEQ ID NO:2466), D11717_T11 (SEQ ID NO:2467) and D11717_T14 (SEQ ID NO:2468). Table 2322 below describes the starting and ending position of this segment on each transcript.

TABLE 2322

Segment location on transcripts

| Transcript name | Segment starting position | Segment ending position |
|---|---|---|
| D11717_T0 (SEQ ID NO: 2462) | 269 | 580 |
| D11717_T1 (SEQ ID NO: 2463) | 257 | 568 |
| D11717_T8 (SEQ ID NO: 2465) | 269 | 580 |
| D11717_T9 (SEQ ID NO: 2466) | 269 | 580 |
| D11717_T11 (SEQ ID NO: 2467) | 269 | 580 |
| D11717_T14 (SEQ ID NO: 2468) | 269 | 580 |

This segment can be found in both coding and non-coding regions of transcript(s) as follows. The segment can be found in a non-coding region of transcript(s) that are related to the following protein(s): D11717_P7 and D11717_P8. This segment can also be found in the following protein(s): D11717_P16, D11717_P6 and D11717_P11, since it is in the coding region for the corresponding transcript.

Segment cluster D11717_node_13 (SEQ ID NO:2470) according to the present invention is supported by 188 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2323 below describes the starting and ending position of this segment on each transcript.

TABLE 2323

Segment location on transcripts

| Transcript name | Segment starting position | Segment ending position |
|---|---|---|
| D11717_T0 (SEQ ID NO: 2462) | 581 | 818 |
| D11717_T1 (SEQ ID NO: 2463) | 569 | 806 |
| D11717_T4 (SEQ ID NO: 2464) | 257 | 494 |
| D11717_T8 (SEQ ID NO: 2465) | 581 | 818 |
| D11717_T9 (SEQ ID NO: 2466) | 581 | 818 |
| D11717_T11 (SEQ ID NO: 2467) | 581 | 818 |
| D11717_T14 (SEQ ID NO: 2468) | 581 | 818 |

This segment can be found in both coding and non-coding regions of transcript(s) as follows. The segment can be found in a non-coding region of transcript(s) that are related to the following protein(s): D11717_P7 and D11717_P8. This segment can also be found in the following protein(s): D11717_P16, D11717_P2, D11717_P6 and D11717_P11, since it is in the coding region for the corresponding transcript.

Segment cluster D11717_node_14 (SEQ ID NO:2471) according to the present invention is supported by 11 libraries. The number of libraries was determined as previously described. This segment can be found in the following transcript(s): D11717_T9 (SEQ ID NO:2466) and D11717_T11 (SEQ ID NO:2467). Table 2324 below describes the starting and ending position of this segment on each transcript.

TABLE 2324

| Segment location on transcripts | | |
|---|---|---|
| Transcript name | Segment starting position | Segment ending position |
| D11717_T9 (SEQ ID NO: 2466) | 819 | 1366 |
| D11717_T11 (SEQ ID NO: 2467) | 819 | 1366 |

This segment can be found in both coding and non-coding regions of transcript(s) as follows. The segment can be found in a non-coding region of transcript(s) that are related to the following protein(s): D11717_P7. This segment can also be found in the following protein(s): D11717_P8, since it is in the coding region for the corresponding transcript.

Segment cluster D11717_node_15 (SEQ ID NO:2472) according to the present invention is supported by 6 libraries. The number of libraries was determined as previously described. This segment can be found in the following transcript(s): D11717_T9 (SEQ ID NO:2466). Table 2325 below describes the starting and ending position of this segment on each transcript.

TABLE 2325

| Segment location on transcripts | | |
|---|---|---|
| Transcript name | Segment starting position | Segment ending position |
| D11717_T9 (SEQ ID NO: 2466) | 1367 | 1620 |

This segment can be found in a non-coding region of transcript(s) that are related to the following protein(s): D11717_P7.

Segment cluster D11717_node_16 (SEQ ID NO:2473) according to the present invention is supported by 6 libraries. The number of libraries was determined as previously described. This segment can be found in the following transcript(s): D11717_T9 (SEQ ID NO:2466). Table 2326 below describes the starting and ending position of this segment on each transcript.

TABLE 2326

| Segment location on transcripts | | |
|---|---|---|
| Transcript name | Segment starting position | Segment ending position |
| D11717_T9 (SEQ ID NO: 2466) | 1621 | 1832 |

This segment can be found in a non-coding region of transcript(s) that are related to the following protein(s): D11717_P7.

Segment cluster D11717_node_20 (SEQ ID NO:2474) according to the present invention is supported by 8 libraries. The number of libraries was determined as previously described. This segment can be found in the following transcript(s): D11717_T9 (SEQ ID NO:2466). Table 2327 below describes the starting and ending position of this segment on each transcript.

TABLE 2327

| Segment location on transcripts | | |
|---|---|---|
| Transcript name | Segment starting position | Segment ending position |
| D11717_T9 (SEQ ID NO: 2466) | 1915 | 2074 |

This segment can be found in a non-coding region of transcript(s) that are related to the following protein(s): D11717_P7.

Segment cluster D11717_node_21 (SEQ ID NO:2475) according to the present invention is supported by 9 libraries. The number of libraries was determined as previously described. This segment can be found in the following transcript(s): D11717_T9 (SEQ ID NO:2466). Table 2328 below describes the starting and ending position of this segment on each transcript.

TABLE 2328

| Segment location on transcripts | | |
|---|---|---|
| Transcript name | Segment starting position | Segment ending position |
| D11717_T9 (SEQ ID NO: 2466) | 2075 | 2247 |

This segment can be found in a non-coding region of transcript(s) that are related to the following protein(s): D11717_P7.

Segment cluster D11717_node_28 (SEQ ID NO:2476) according to the present invention is supported by 133 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2329 below describes the starting and ending position of this segment on each transcript.

TABLE 2329

| Segment location on transcripts | | |
|---|---|---|
| Transcript name | Segment starting position | Segment ending position |
| D11717_T0 (SEQ ID NO: 2462) | 1079 | 1198 |
| D11717_T1 (SEQ ID NO: 2463) | 1067 | 1186 |
| D11717_T4 (SEQ ID NO: 2464) | 755 | 874 |
| D11717_T8 (SEQ ID NO: 2465) | 1079 | 1198 |
| D11717_T9 (SEQ ID NO: 2466) | 2508 | 2627 |
| D11717_T11 (SEQ ID NO: 2467) | 1627 | 1746 |
| D11717_T14 (SEQ ID NO: 2468) | 917 | 1036 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_37 (SEQ ID NO:2477) according to the present invention is supported by 144 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2330 below describes the starting and ending position of this segment on each transcript.

TABLE 2330

Segment location on transcripts

| Transcript name | Segment starting position | Segment ending position |
|---|---|---|
| D11717_T0 (SEQ ID NO: 2462) | 1364 | 1522 |
| D11717_T1 (SEQ ID NO: 2463) | 1352 | 1510 |
| D11717_T4 (SEQ ID NO: 2464) | 1040 | 1198 |
| D11717_T8 (SEQ ID NO: 2465) | 1269 | 1427 |
| D11717_T9 (SEQ ID NO: 2466) | 2793 | 2951 |
| D11717_T11 (SEQ ID NO: 2467) | 1912 | 2070 |
| D11717_T14 (SEQ ID NO: 2468) | 1202 | 1360 |

This segment can be found in the following protein(s): D11717_P16, D11717_P2, D11717_P6, D11717_P7, D11717_P8 and D11717_P11.

According to an optional embodiment of the present invention, short segments related to the above cluster are also provided. These segments are up to about 120 bp in length, and so are included in a separate description.

Segment cluster D11717_node_2 (SEQ ID NO:2478) according to the present invention is supported by 5 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2331 below describes the starting and ending position of this segment on each transcript.

TABLE 2331

Segment location on transcripts

| Transcript name | Segment starting position | Segment ending position |
|---|---|---|
| D11717_T0 (SEQ ID NO: 2462) | 1 | 84 |
| D11717_T1 (SEQ ID NO: 2463) | 1 | 84 |
| D11717_T4 (SEQ ID NO: 2464) | 1 | 84 |
| D11717_T8 (SEQ ID NO: 2465) | 1 | 84 |
| D11717_T9 (SEQ ID NO: 2466) | 1 | 84 |
| D11717_T11 (SEQ ID NO: 2467) | 1 | 84 |
| D11717_T14 (SEQ ID NO: 2468) | 1 | 84 |

This segment can be found in a non-coding region of transcript(s) that are related to the following protein(s): D11717_P16, D11717_P2, D11717_P6, D11717_P7, D11717_P8 and D11717_P1.

Segment cluster D11717_node_3 (SEQ ID NO:2479) according to the present invention can be found in the following transcript(s): D11717_T0 (SEQ ID NO:2462), D11717_T8 (SEQ ID NO:2465), D11717_T9 (SEQ ID NO:2466), D11717_T11 (SEQ ID NO:2467) and D11717_T14 (SEQ ID NO:2468). Table 2332 below describes the starting and ending position of this segment on each transcript.

TABLE 2332

Segment location on transcripts

| Transcript name | Segment starting position | Segment ending position |
|---|---|---|
| D11717_T0 (SEQ ID NO: 2462) | 85 | 96 |
| D11717_T8 (SEQ ID NO: 2465) | 85 | 96 |
| D11717_T9 (SEQ ID NO: 2466) | 85 | 96 |
| D11717_T11 (SEQ ID NO: 2467) | 85 | 96 |
| D11717_T14 (SEQ ID NO: 2468) | 85 | 96 |

This segment can be found in a non-coding region of transcript(s) that are related to the following protein(s): D11717_P16, D11717_P6, D11717_P7, D11717_P8 and D11717_P11.

Segment cluster D11717_node_4 (SEQ ID NO:2480) according to the present invention is supported by 5 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2333 below describes the starting and ending position of this segment on each transcript.

TABLE 2333

Segment location on transcripts

| Transcript name | Segment starting position | Segment ending position |
|---|---|---|
| D11717_T0 (SEQ ID NO: 2462) | 97 | 170 |
| D11717_T1 (SEQ ID NO: 2463) | 85 | 158 |
| D11717_T4 (SEQ ID NO: 2464) | 85 | 158 |
| D11717_T8 (SEQ ID NO: 2465) | 97 | 170 |
| D11717_T9 (SEQ ID NO: 2466) | 97 | 170 |
| D11717_T11 (SEQ ID NO: 2467) | 97 | 170 |
| D11717_T14 (SEQ ID NO: 2468) | 97 | 170 |

This segment can be found in both coding and non-coding regions of transcript(s) as follows. The segment can be found in a non-coding region of transcript(s) that are related to the following protein(s): D11717_P16, D11717_P6, D11717_P7, D11717_P8 and D11717_P11. This segment can also be found in the following protein(s): D11717_P2, since it is in the coding region for the corresponding transcript.

Segment cluster D11717_node_5 (SEQ ID NO:2481) according to the present invention is supported by 6 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2334 below describes the starting and ending position of this segment on each transcript.

TABLE 2334

Segment location on transcripts

| Transcript name | Segment starting position | Segment ending position |
|---|---|---|
| D11717_T0 (SEQ ID NO: 2462) | 171 | 268 |
| D11717_T1 (SEQ ID NO: 2463) | 159 | 256 |

TABLE 2334-continued

Segment location on transcripts

| Transcript name | Segment starting position | Segment ending position |
|---|---|---|
| D11717_T4 (SEQ ID NO: 2464) | 159 | 256 |
| D11717_T8 (SEQ ID NO: 2465) | 171 | 268 |
| D11717_T9 (SEQ ID NO: 2466) | 171 | 268 |
| D11717_T11 (SEQ ID NO: 2467) | 171 | 268 |
| D11717_T14 (SEQ ID NO: 2468) | 171 | 268 |

This segment can be found in both coding and non-coding regions of transcript(s) as follows. The segment can be found in a non-coding region of transcript(s) that are related to the following protein(s): D11717_P16, D11717_P6, D11717_P7, D11717_P8 and D11717_P11. This segment can also be found in the following protein(s): D11717_P2, since it is in the coding region for the corresponding transcript.

Segment cluster D11717_node_19 (SEQ ID NO:2482) according to the present invention is supported by 3 libraries. The number of libraries was determined as previously described. This segment can be found in the following transcript(s): D11717_T9 (SEQ ID NO:2466). Table 2335 below describes the starting and ending position of this segment on each transcript.

TABLE 2335

Segment location on transcripts

| Transcript name | Segment starting position | Segment ending position |
|---|---|---|
| D11717_T9 (SEQ ID NO: 2466) | 1833 | 1914 |

This segment can be found in a non-coding region of transcript(s) that are related to the following protein(s): D11717_P7.

Segment cluster D11717_node_22 (SEQ ID NO:2483) according to the present invention is supported by 128 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2336 below describes the starting and ending position of this segment on each transcript.

TABLE 2336

Segment location on transcripts

| Transcript name | Segment starting position | Segment ending position |
|---|---|---|
| D11717_T0 (SEQ ID NO: 2462) | 819 | 847 |
| D11717_T1 (SEQ ID NO: 2463) | 807 | 835 |
| D11717_T4 (SEQ ID NO: 2464) | 495 | 523 |
| D11717_T8 (SEQ ID NO: 2465) | 819 | 847 |
| D11717_T9 (SEQ ID NO: 2466) | 2248 | 2276 |
| D11717_T11 (SEQ ID NO: 2467) | 1367 | 1395 |
| D11717_T14 (SEQ ID NO: 2468) | 819 | 847 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_23 (SEQ ID NO:2484) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466) and D11717_T11 (SEQ ID NO:2467). Table 2337 below describes the starting and ending position of this segment on each transcript.

TABLE 2337

Segment location on transcripts

| Transcript name | Segment starting position | Segment ending position |
|---|---|---|
| D11717_T0 (SEQ ID NO: 2462) | 848 | 868 |
| D11717_T1 (SEQ ID NO: 2463) | 836 | 856 |
| D11717_T4 (SEQ ID NO: 2464) | 524 | 544 |
| D11717_T8 (SEQ ID NO: 2465) | 848 | 868 |
| D11717_T9 (SEQ ID NO: 2466) | 2277 | 2297 |
| D11717_T11 (SEQ ID NO: 2467) | 1396 | 1416 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6 and D11717_P8, since it is in the coding region for the corresponding transcript.

Segment cluster D11717_node_24 (SEQ ID NO:2485) according to the present invention is supported by 124 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466) and D11717_T11 (SEQ ID NO:2467). Table 2338 below describes the starting and ending position of this segment on each transcript.

TABLE 2338

Segment location on transcripts

| Transcript name | Segment starting position | Segment ending position |
|---|---|---|
| D11717_T0 (SEQ ID NO: 2462) | 869 | 919 |
| D11717_T1 (SEQ ID NO: 2463) | 857 | 907 |
| D11717_T4 (SEQ ID NO: 2464) | 545 | 595 |
| D11717_T8 (SEQ ID NO: 2465) | 869 | 919 |
| D11717_T9 (SEQ ID NO: 2466) | 2298 | 2348 |
| D11717_T11 (SEQ ID NO: 2467) | 1417 | 1467 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6 and D11717_P8, since it is in the coding region for the corresponding transcript.

Segment cluster D11717_node_25 (SEQ ID NO:2486) according to the present invention is supported by 119 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8

(SEQ ID NO:2465), D11717_T9 (SEQ ID NO:2466) and D11717_T11 (SEQ ID NO:2467). Table 2339 below describes the starting and ending position of this segment on each transcript.

TABLE 2339

Segment location on transcripts

| Transcript name | Segment starting position | Segment ending position |
|---|---|---|
| D11717_T0 (SEQ ID NO: 2462) | 920 | 1009 |
| D11717_T1 (SEQ ID NO: 2463) | 908 | 997 |
| D11717_T4 (SEQ ID NO: 2464) | 596 | 685 |
| D11717_T8 (SEQ ID NO: 2465) | 920 | 1009 |
| D11717_T9 (SEQ ID NO: 2466) | 2349 | 2438 |
| D11717_T11 (SEQ ID NO: 2467) | 1468 | 1557 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6 and D11717_P8, since it is in the coding region for the corresponding transcript.

Segment cluster D11717_node_26 (SEQ ID NO:2487) according to the present invention is supported by 112 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2340 below describes the starting and ending position of this segment on each transcript.

TABLE 2340

Segment location on transcripts

| Transcript name | Segment starting position | Segment ending position |
|---|---|---|
| D11717_T0 (SEQ ID NO: 2462) | 1010 | 1046 |
| D11717_T1 (SEQ ID NO: 2463) | 998 | 1034 |
| D11717_T4 (SEQ ID NO: 2464) | 686 | 722 |
| D11717_T8 (SEQ ID NO: 2465) | 1010 | 1046 |
| D11717_T9 (SEQ ID NO: 2466) | 2439 | 2475 |
| D11717_T11 (SEQ ID NO: 2467) | 1558 | 1594 |
| D11717_T14 (SEQ ID NO: 2468) | 848 | 884 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_27 (SEQ ID NO:2488) according to the present invention is supported by 111 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2341 below describes the starting and ending position of this segment on each transcript.

TABLE 2341

Segment location on transcripts

| Transcript name | Segment starting position | Segment ending position |
|---|---|---|
| D11717_T0 (SEQ ID NO: 2462) | 1047 | 1078 |
| D11717_T1 (SEQ ID NO: 2463) | 1035 | 1066 |
| D11717_T4 (SEQ ID NO: 2464) | 723 | 754 |
| D11717_T8 (SEQ ID NO: 2465) | 1047 | 1078 |
| D11717_T9 (SEQ ID NO: 2466) | 2476 | 2507 |
| D11717_T11 (SEQ ID NO: 2467) | 1595 | 1626 |
| D11717_T14 (SEQ ID NO: 2468) | 885 | 916 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_29 (SEQ ID NO:2489) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2342 below describes the starting and ending position of this segment on each transcript.

TABLE 2342

Segment location on transcripts

| Transcript name | Segment starting position | Segment ending position |
|---|---|---|
| D11717_T0 (SEQ ID NO: 2462) | 1199 | 1215 |
| D11717_T1 (SEQ ID NO: 2463) | 1187 | 1203 |
| D11717_T4 (SEQ ID NO: 2464) | 875 | 891 |
| D11717_T8 (SEQ ID NO: 2465) | 1199 | 1215 |
| D11717_T9 (SEQ ID NO: 2466) | 2628 | 2644 |
| D11717_T11 (SEQ ID NO: 2467) | 1747 | 1763 |
| D11717_T14 (SEQ ID NO: 2468) | 1037 | 1053 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_30 (SEQ ID NO:2490) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2343 below describes the starting and ending position of this segment on each transcript.

TABLE 2343

Segment location on transcripts

| Transcript name | Segment starting position | Segment ending position |
|---|---|---|
| D11717_T0 (SEQ ID NO: 2462) | 1216 | 1232 |
| D11717_T1 (SEQ ID NO: 2463) | 1204 | 1220 |
| D11717_T4 (SEQ ID NO: 2464) | 892 | 908 |
| D11717_T8 (SEQ ID NO: 2465) | 1216 | 1232 |
| D11717_T9 (SEQ ID NO: 2466) | 2645 | 2661 |
| D11717_T11 (SEQ ID NO: 2467) | 1764 | 1780 |
| D11717_T14 (SEQ ID NO: 2468) | 1054 | 1070 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P6, D11717_P8 and D11717_P11, since it is in the coding region for the corresponding transcript.

Segment cluster D11717_node_31 (SEQ ID NO:2491) according to the present invention can be found in the following transcript(s): D11717_T0 (SEQ ID NO:2462), D11717_T1 (SEQ ID NO:2463), D11717_T4 (SEQ ID NO:2464), D11717_T9 (SEQ ID NO:2466), D11717_T11 (SEQ ID NO:2467) and D11717_T14 (SEQ ID NO:2468). Table 2344 below describes the starting and ending position of this segment on each transcript.

TABLE 2344

Segment location on transcripts

| Transcript name | Segment starting position | Segment ending position |
|---|---|---|
| D11717_T0 (SEQ ID NO: 2462) | 1233 | 1243 |
| D11717_T1 (SEQ ID NO: 2463) | 1221 | 1231 |
| D11717_T4 (SEQ ID NO: 2464) | 909 | 919 |
| D11717_T9 (SEQ ID NO: 2466) | 2662 | 2672 |
| D11717_T11 (SEQ ID NO: 2467) | 1781 | 1791 |
| D11717_T14 (SEQ ID NO: 2468) | 1071 | 1081 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P8 and D11717_P11, since it is in the coding region for the corresponding transcript.

Segment cluster D11717_node_32 (SEQ ID NO:2492) according to the present invention can be found in the following transcript(s): D11717_T0 (SEQ ID NO:2462), D11717_T1 (SEQ ID NO:2463), D11717_T4 (SEQ ID NO:2464), D11717_T9 (SEQ ID NO:2466), D11717_T11 (SEQ ID NO:2467) and D11717_T14 (SEQ ID NO:2468). Table 2345 below describes the starting and ending position of this segment on each transcript.

TABLE 2345

Segment location on transcripts

| Transcript name | Segment starting position | Segment ending position |
|---|---|---|
| D11717_T0 (SEQ ID NO: 2462) | 1244 | 1257 |
| D11717_T1 (SEQ ID NO: 2463) | 1232 | 1245 |
| D11717_T4 (SEQ ID NO: 2464) | 920 | 933 |
| D11717_T9 (SEQ ID NO: 2466) | 2673 | 2686 |
| D11717_T11 (SEQ ID NO: 2467) | 1792 | 1805 |
| D11717_T14 (SEQ ID NO: 2468) | 1082 | 1095 |

This segment can be found in both coding and non-coding regions of transcript(s) as follows. The segment can be found in a non-coding region of transcript(s) that are related to the following protein(s): D11717_P7. This segment can also be found in the following protein(s): D11717_P16, D11717_P2, D11717_P8 and D11717_P11, since it is in the coding region for the corresponding transcript.

Segment cluster D11717_node_33 (SEQ ID NO:2493) according to the present invention is supported by 119 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717-T9 (SEQ ID NO:2466), D11717_T11 (SEQ ID NO:2467) and D11717_T14 (SEQ ID NO:2468). Table 2346 below describes the starting and ending position of this segment on each transcript.

TABLE 2346

Segment location on transcripts

| Transcript name | Segment starting position | Segment ending position |
|---|---|---|
| D11717_T0 (SEQ ID NO: 2462) | 1258 | 1303 |
| D11717_T1 (SEQ ID NO: 2463) | 1246 | 1291 |
| D11717_T4 (SEQ ID NO: 2464) | 934 | 979 |
| D11717_T9 (SEQ ID NO: 2466) | 2687 | 2732 |
| D11717_T11 (SEQ ID NO: 2467) | 1806 | 1851 |
| D11717_T14 (SEQ ID NO: 2468) | 1096 | 1141 |

This segment can be found in the following protein(s): D11717_P16, D11717_P2, D11717_P7, D11717_P8 and D11717_P11.

Segment cluster D11717_node_34 (SEQ ID NO:2494) according to the present invention can be found in the following transcript(s): D11717_T0 (SEQ ID NO:2462), D11717_T1 (SEQ ID NO:2463), D11717_T4 (SEQ ID NO:2464), D11717_T9 (SEQ ID NO:2466), D11717_T11 (SEQ ID NO:2467) and D11717_T14 (SEQ ID NO:2468). Table 2347 below describes the starting and ending position of this segment on each transcript.

TABLE 2347

Segment location on transcripts

| Transcript name | Segment starting position | Segment ending position |
|---|---|---|
| D11717_T0 (SEQ ID NO: 2462) | 1304 | 1327 |
| D11717_T1 (SEQ ID NO: 2463) | 1292 | 1315 |
| D11717_T4 (SEQ ID NO: 2464) | 980 | 1003 |
| D11717_T9 (SEQ ID NO: 2466) | 2733 | 2756 |
| D11717_T11 (SEQ ID NO: 2467) | 1852 | 1875 |
| D11717_T14 (SEQ ID NO: 2468) | 1142 | 1165 |

This segment can be found in the following protein(s): D11717_P16, D11717_P2, D11717_P7, D11717_P8 and D11717_P11.

Segment cluster D11717_node_35 (SEQ ID NO:2495) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2348 below describes the starting and ending position of this segment on each transcript.

TABLE 2348

Segment location on transcripts

| Transcript name | Segment starting position | Segment ending position |
|---|---|---|
| D11717_T0 (SEQ ID NO: 2462) | 1328 | 1352 |
| D11717_T1 (SEQ ID NO: 2463) | 1316 | 1340 |
| D11717_T4 (SEQ ID NO: 2464) | 1004 | 1028 |
| D11717_T8 (SEQ ID NO: 2465) | 1233 | 1257 |
| D11717_T9 (SEQ ID NO: 2466) | 2757 | 2781 |
| D11717_T11 (SEQ ID NO: 2467) | 1876 | 1900 |
| D11717_T14 (SEQ ID NO: 2468) | 1166 | 1190 |

This segment can be found in the following protein(s): D11717_P16, D11717_P2, D11717_P6, D11717_P7, D11717_P8 and D11717_P11.

Segment cluster D11717_node_36 (SEQ ID NO:2496) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2349 below describes the starting and ending position of this segment on each transcript.

TABLE 2349

Segment location on transcripts

| Transcript name | Segment starting position | Segment ending position |
|---|---|---|
| D11717_T0 (SEQ ID NO: 2462) | 1353 | 1363 |
| D11717_T1 (SEQ ID NO: 2463) | 1341 | 1351 |
| D11717_T4 (SEQ ID NO: 2464) | 1029 | 1039 |
| D11717_T8 (SEQ ID NO: 2465) | 1258 | 1268 |
| D11717_T9 (SEQ ID NO: 2466) | 2782 | 2792 |
| D11717_T11 (SEQ ID NO: 2467) | 1901 | 1911 |
| D11717_T14 (SEQ ID NO: 2468) | 1191 | 1201 |

This segment can be found in the following protein(s): D11717_P16, D11717_P2, D11717_P6, D11717_P7, D11717_P8 and D11717_P11.

Segment cluster D11717_node_38 (SEQ ID NO:2497) according to the present invention is supported by 130 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2350 below describes the starting and ending position of this segment on each transcript.

TABLE 2350

Segment location on transcripts

| Transcript name | Segment starting position | Segment ending position |
|---|---|---|
| D11717_T0 (SEQ ID NO: 2462) | 1523 | 1591 |
| D11717_T1 (SEQ ID NO: 2463) | 1511 | 1579 |
| D11717_T4 (SEQ ID NO: 2464) | 1199 | 1267 |
| D11717_T8 (SEQ ID NO: 2465) | 1428 | 1496 |
| D11717_T9 (SEQ ID NO: 2466) | 2952 | 3020 |
| D11717_T11 (SEQ ID NO: 2467) | 2071 | 2139 |
| D11717_T14 (SEQ ID NO: 2468) | 1361 | 1429 |

This segment can be found in a non-coding region of transcript(s) that are related to the following protein(s): D11717_P16, D11717_P2, D11717_P6, D11717_P7, D11717_P8 and D11717_P11.

Segment cluster D11717_node_39 (SEQ ID NO:2498) according to the present invention can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2351 below describes the starting and ending position of this segment on each transcript.

TABLE 2351

Segment location on transcripts

| Transcript name | Segment starting position | Segment ending position |
|---|---|---|
| D11717_T0 (SEQ ID NO: 2462) | 1592 | 1611 |
| D11717_T1 (SEQ ID NO: 2463) | 1580 | 1599 |
| D11717_T4 (SEQ ID NO: 2464) | 1268 | 1287 |
| D11717_T8 (SEQ ID NO: 2465) | 1497 | 1516 |
| D11717_T9 (SEQ ID NO: 2466) | 3021 | 3040 |
| D11717_T11 (SEQ ID NO: 2467) | 2140 | 2159 |
| D11717_T14 (SEQ ID NO: 2468) | 1430 | 1449 |

This segment can be found in a non-coding region of transcript(s) that are related to the following protein(s): D11717_P16, D11717_P2, D11717_P6, D11717_P7, D11717_P8 and D11717_P11.

Segment cluster D11717_node_40 (SEQ ID NO:2499) according to the present invention is supported by 109 libraries. The number of libraries was determined as previously described. This segment can be found in the following transcript(s): D11717_T0 (SEQ ID NO:2462), D11717_T1 (SEQ ID NO:2463), D11717_T4 (SEQ ID NO:2464), D11717_T8 (SEQ ID NO:2465), D11717_T9 (SEQ ID NO:2466), D11717_T11 (SEQ ID NO:2467) and D11717_T14 (SEQ ID NO:2468). Table 2352 below describes the starting and ending position of this segment on each transcript.

TABLE 2352

Segment location on transcripts

| Transcript name | Segment starting position | Segment ending position |
|---|---|---|
| D11717_T0 (SEQ ID NO: 2462) | 1612 | 1709 |
| D11717_T1 (SEQ ID NO: 2463) | 1600 | 1697 |
| D11717_T4 (SEQ ID NO: 2464) | 1288 | 1385 |
| D11717_T8 (SEQ ID NO: 2465) | 1517 | 1614 |
| D11717_T9 (SEQ ID NO: 2466) | 3041 | 3138 |

TABLE 2352-continued

Segment location on transcripts

| Transcript name | Segment starting position | Segment ending position |
| --- | --- | --- |
| D11717_T11 (SEQ ID NO: 2467) | 2160 | 2257 |
| D11717_T14 (SEQ ID NO: 2468) | 1450 | 1547 |

This segment can be found in a non-coding region of transcript(s) that are related to the following protein(s): D11717_P16, D11717_P2, D11717_P6, D11717_P7, D11717_P8 and D11717_P11.

Description for Cluster D12392

Cluster D12392 features 6 transcript(s) and 23 segment(s) of interest, the names for which are given in Tables 2353 and 2354, respectively, the sequences themselves are given at the end of the application. The selected protein variants are given in Table 2355.

TABLE 2353

Transcripts of interest

| Transcript Name |
| --- |
| D12392_T12 (SEQ ID NO: 2500) |
| D12392_T13 (SEQ ID NO: 2501) |
| D12392_T14 (SEQ ID NO: 2502) |
| D12392_T15 (SEQ ID NO: 2503) |
| D12392_T16 (SEQ ID NO: 2504) |
| D12392_T17 (SEQ ID NO: 2505) |

TABLE 2354

Segments of interest

| Segment Name |
| --- |
| D12392_node_0 (SEQ ID NO: 2506) |
| D12392_node_7 (SEQ ID NO: 2507) |
| D12392_node_9 (SEQ ID NO: 2508) |
| D12392_node_13 (SEQ ID NO: 2509) |
| D12392_node_21 (SEQ ID NO: 2510) |
| D12392_node_22 (SEQ ID NO: 2511) |
| D12392_node_26 (SEQ ID NO: 2512) |
| D12392_node_30 (SEQ ID NO: 2513) |
| D12392_node_32 (SEQ ID NO: 2514) |
| D12392_node_35 (SEQ ID NO: 2515) |
| D12392_node_2 (SEQ ID NO: 2516) |
| D12392_node_3 (SEQ ID NO: 2517) |
| D12392_node_5 (SEQ ID NO: 2518) |
| D12392_node_14 (SEQ ID NO: 2519) |
| D12392_node_15 (SEQ ID NO: 2520) |
| D12392_node_17 (SEQ ID NO: 2521) |
| D12392_node_18 (SEQ ID NO: 2522) |
| D12392_node_19 (SEQ ID NO: 2523) |
| D12392_node_24 (SEQ ID NO: 2524) |
| D12392_node_29 (SEQ ID NO: 2525) |
| D12392_node_33 (SEQ ID NO: 2526) |
| D12392_node_36 (SEQ ID NO: 2527) |
| D12392_node_37 (SEQ ID NO: 2528) |

TABLE 2355

Proteins of interest

| Protein Name | Corresponding Transcript(s) |
| --- | --- |
| D12392_P9 | D12392_T12 (SEQ ID NO: 2500) |
| D12392_P11 | D12392_T13 (SEQ ID NO: 2501) |
| D12392_P12 | D12392_T15 (SEQ ID NO: 2503) |

Cluster D12392 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 62 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 62 and Table 2356. This cluster is overexpressed (at least at a minimum level) in the following pathological conditions: epithelial malignant tumors, a mixture of malignant tumors from different tissues and skin malignancies.

TABLE 2356

Normal tissue distribution

| Name of Tissue | Number |
| --- | --- |
| Bone | 0 |
| Colon | 31 |
| epithelial | 2 |
| general | 9 |
| kidney | 8 |
| Liver | 9 |
| Lung | 0 |
| Lymph nodes | 26 |
| Breast | 0 |
| bone marrow | 0 |
| muscle | 1 |
| pancreas | 0 |
| prostate | 2 |
| Skin | 0 |
| stomach | 0 |
| T cells | 0 |
| Uterus | 0 |

TABLE 2357

P values and ratios for expression in cancerous tissue

| Name of Tissue | P1 | P2 | SP1 | R3 | SP2 | R4 |
| --- | --- | --- | --- | --- | --- | --- |
| Bone | 1 | 1.0e−01 | 1 | 1.0 | 2.4e−01 | 2.8 |
| Colon | 5.8e−01 | 4.4e−01 | 1 | 0.6 | 9.5e−01 | 0.8 |
| epithelial | 1.0e−01 | 9.9e−04 | 1.7e−02 | 3.5 | 2.6e−11 | 10.2 |
| general | 2.8e−01 | 2.4e−04 | 1.5e−01 | 1.6 | 1.4e−14 | 4.3 |
| kidney | 8.6e−01 | 8.0e−01 | 5.8e−01 | 1.2 | 4.9e−01 | 1.3 |
| Liver | 9.1e−01 | 6.0e−01 | 1 | 0.8 | 2.8e−03 | 2.8 |
| Lung | 2.4e−01 | 5.4e−02 | 1.7e−01 | 4.5 | 2.1e−02 | 6.2 |
| Lymph nodes | 8.5e−01 | 6.1e−01 | 1 | 0.4 | 4.4e−01 | 1.2 |
| Breast | 9.6e−01 | 7.0e−01 | 1 | 1.0 | 3.1e−01 | 1.9 |
| bone marrow | 1 | 6.7e−01 | 1 | 1.0 | 1.5e−01 | 2.8 |
| muscle | 9.2e−01 | 4.8e−01 | 1 | 0.9 | 3.9e−01 | 2.3 |
| pancreas | 1.2e−01 | 2.1e−01 | 7.6e−02 | 5.1 | 1.5e−01 | 3.7 |
| prostate | 8.4e−01 | 8.4e−01 | 4.5e−01 | 1.8 | 4.2e−01 | 1.8 |
| Skin | 1 | 1.8e−01 | 1 | 1.0 | 5.9e−05 | 4.3 |
| stomach | 1.1e−01 | 2.1e−01 | 5.0e−01 | 2.5 | 3.2e−01 | 2.1 |
| T cells | 5.0e−01 | 6.7e−01 | 3.3e−01 | 3.1 | 7.2e−01 | 1.4 |
| uterus | 4.7e−01 | 5.4e−02 | 6.6e−01 | 1.5 | 8.7e−02 | 3.2 |

As noted above, cluster D12392 features 23 segment(s), which were listed in Table 2354 above and for which the sequence(s) are given at the end of the application. These segment(s) are portions of nucleic acid sequence(s) which are described herein separately because they are of particular interest. A description of each segment according to the present invention is now provided.

Segment cluster D12392_node_0 (SEQ ID NO:2506) according to the present invention is supported by 64 libraries. The number of libraries was determined as previously described. This segment can be found in the following transcript(s): D12392_T15 (SEQ ID NO:2503). Table 2358 below describes the starting and ending position of this segment on each transcript.

TABLE 2358

Segment location on transcripts

| Transcript name | Segment starting position | Segment ending position |
|---|---|---|
| D12392_T15 (SEQ ID NO: 2503) | 1 | 183 |

This segment can be found in the following protein(s): D12392_P12.

Segment cluster D12392_node_7 (SEQ ID NO:2507) according to the present invention is supported by 1 libraries. The number of libraries was determined as previously described. This segment can be found in the following transcript(s): D12392_T14 (SEQ ID NO:2502). Table 2359 below describes the starting and ending position of this segment on each transcript.

TABLE 2359

Segment location on transcripts

| Transcript name | Segment starting position | Segment ending position |
|---|---|---|
| D12392_T14 (SEQ ID NO: 2502) | 1 | 178 |

The previously-described transcripts for these segment(s) do not code for protein.

Segment cluster D12392_node_9 (SEQ ID NO:2508) according to the present invention is supported by 1 libraries. The number of libraries was determined as previously described. This segment can be found in the following transcript(s): D12392_T15 (SEQ ID NO:2503). Table 2360 below describes the starting and ending position of this segment on each transcript.

TABLE 2360

Segment location on transcripts

| Transcript name | Segment starting position | Segment ending position |
|---|---|---|
| D12392_T15 (SEQ ID NO: 2503) | 382 | 547 |

This segment can be found in the following protein(s): D12392_P12.

Segment cluster D12392_node_13 (SEQ ID NO:2509) according to the present invention is supported by 2 libraries. The number of libraries was determined as previously described. This segment can be found in the following transcript(s): D12392_T12 (SEQ ID NO:2500). Table 2361 below describes the starting and ending position of this segment on each transcript.

TABLE 2361

Segment location on transcripts

| Transcript name | Segment starting position | Segment ending position |
|---|---|---|
| D12392_T12 (SEQ ID NO: 2500) | 1 | 443 |

This segment can be found in a non-coding region of transcript(s) that are related to the following protein(s): D12392_P9.

Segment cluster D12392_node_21 (SEQ ID NO:2510) according to the present invention is supported by 2 libraries. The number of libraries was determined as previously described. This segment can be found in the following transcript(s): (SEQ ID NO:2501). Table 2362 below describes the starting and ending position of this segment on each transcript.

TABLE 2362

Segment location on transcripts

| Transcript name | Segment starting position | Segment ending position |
|---|---|---|
| D12392_T13 (SEQ ID NO: 2501) | 1 | 315 |

This segment can be found in a non-coding region of transcript(s) that are related to the following protein(s): D12392_P11.

Segment cluster D12392_node_22 (SEQ ID NO:2511) according to the present invention is supported by 63 libraries. The number of libraries was determined as previously described. This segment can be found in the following transcript(s): (SEQ ID NO:2500) and D12392_T13 (SEQ ID NO:2501). Table 2363 below describes the starting and ending position of this segment on each transcript.

TABLE 2363

Segment location on transcripts

| Transcript name | Segment starting position | Segment ending position |
|---|---|---|
| D12392_T12 (SEQ ID NO: 2500) | 646 | 826 |
| D12392_T13 (SEQ ID NO: 2501) | 316 | 496 |

This segment can be found in the following protein(s): D12392_P9 and D12392_P11.

Segment cluster D12392_node_26 (SEQ ID NO:2512) according to the present invention is supported by 60 libraries. The number of libraries was determined as previously described. This segment can be found in the following transcript(s): D12392_T12 (SEQ ID NO:2500) and D12392_T13 (SEQ ID NO:2501). Table 2364 below describes the starting and ending position of this segment on each transcript.

TABLE 2364

Segment location on transcripts

| Transcript name | Segment starting position | Segment ending position |
|---|---|---|
| D12392_T12 (SEQ ID NO: 2500) | 910 | 1098 |
| D12392_T13 (SEQ ID NO: 2501) | 580 | 768 |

This segment can be found in the following protein(s): D12392_P9 and D12392_P11.

Segment cluster D12392_node__30 (SEQ ID NO:2513) according to the present invention is supported by 54 libraries. The number of libraries was determined as previously described. This segment can be found in the following transcript(s): D12392_T12 (SEQ ID NO:2500) and D12392_T13 (SEQ ID NO:2501). Table 2365 below describes the starting and ending position of this segment on each transcript.

TABLE 2365

Segment location on transcripts

| Transcript name | Segment starting position | Segment ending position |
|---|---|---|
| D12392_T12 (SEQ ID NO: 2500) | 1121 | 1295 |
| D12392_T13 (SEQ ID NO: 2501) | 791 | 965 |

This segment can be found in the following protein(s): D12392_P9 and D12392_P11.

Segment cluster D12392_node__32 (SEQ ID NO:2514) according to the present invention is supported by 15 libraries. The number of libraries was determined as previously described. This segment can be found in the following transcript(s): D12392_T14 (SEQ ID NO:2502). Table 2366 below describes the starting and ending position of this segment on each transcript.

TABLE 2366

Segment location on transcripts

| Transcript name | Segment starting position | Segment ending position |
|---|---|---|
| D12392_T14 (SEQ ID NO: 2502) | 179 | 1381 |

The previously-described transcripts for these segment(s) do not code for protein.

Segment cluster D12392_node__35 (SEQ ID NO:2515) according to the present invention is supported by 4 libraries. The number of libraries was determined as previously described. This segment can be found in the following transcript(s): D12392_T16 (SEQ ID NO:2504) and D12392_T17 (SEQ ID NO:2505). Table 2367 below describes the starting and ending position of this segment on each transcript.

TABLE 2367

Segment location on transcripts

| Transcript name | Segment starting position | Segment ending position |
|---|---|---|
| D12392_T16 (SEQ ID NO: 2504) | 1 | 592 |
| D12392_T17 (SEQ ID NO: 2505) | 1 | 592 |

The previously-described transcripts for these segment(s) do not code for protein.

According to an optional embodiment of the present invention, short segments related to the above cluster are also provided. These segments are up to about 120 bp in length, and so are included in a separate description.

Segment cluster D12392_node__2 (SEQ ID NO:2516) according to the present invention is supported by 63 libraries. The number of libraries was determined as previously described. This segment can be found in the following transcript(s): D12392_T15 (SEQ ID NO:2503). Table 2368 below describes the starting and ending position of this segment on each transcript.

TABLE 2368

Segment location on transcripts

| Transcript name | Segment starting position | Segment ending position |
|---|---|---|
| D12392_T15 (SEQ ID NO: 2503) | 184 | 273 |

This segment can be found in the following protein(s): D12392_P12.

Segment cluster D12392_node__3 (SEQ ID NO:2517) according to the present invention can be found in the following transcript(s): D12392_T15 (SEQ ID NO:2503). Table 2369 below describes the starting and ending position of this segment on each transcript.

TABLE 2369

Segment location on transcripts

| Transcript name | Segment starting position | Segment ending position |
|---|---|---|
| D12392_T15 (SEQ ID NO: 2503) | 274 | 297 |

This segment can be found in the following protein(s): D12392_P12.

Segment cluster D12392_node__5 (SEQ ID NO:2518) according to the present invention is supported by 53 libraries. The number of libraries was determined as previously described. This segment can be found in the following transcript(s): D12392_T15 (SEQ ID NO:2503). Table 2370 below describes the starting and ending position of this segment on each transcript.

TABLE 2370

Segment location on transcripts

| Transcript name | Segment starting position | Segment ending position |
|---|---|---|
| D12392_T15 (SEQ ID NO: 2503) | 298 | 381 |

This segment can be found in the following protein(s): D12392_P12.

Segment cluster D12392_node__14 (SEQ ID NO:2519) according to the present invention can be found in the following transcript(s): D12392_T12 (SEQ ID NO:2500). Table 2371 below describes the starting and ending position of this segment on each transcript.

TABLE 2371

Segment location on transcripts

| Transcript name | Segment starting position | Segment ending position |
|---|---|---|
| D12392_T12 (SEQ ID NO: 2500) | 444 | 447 |

This segment can be found in a non-coding region of transcript(s) that are related to the following protein(s): D12392_P9.

Segment cluster D12392_node__15 (SEQ ID NO:2520) according to the present invention is supported by 48 libraries. The number of libraries was determined as previously described. This segment can be found in the following transcript(s): D12392_T12 (SEQ ID NO:2500). Table 2372 below describes the starting and ending position of this segment on each transcript.

TABLE 2372

| Segment location on transcripts | | |
|---|---|---|
| Transcript name | Segment starting position | Segment ending position |
| D12392_T12 (SEQ ID NO: 2500) | 448 | 503 |

This segment can be found in a non-coding region of transcript(s) that are related to the following protein(s): D12392_P9.

Segment cluster D12392_node_17 (SEQ ID NO:2521) according to the present invention is supported by 4 libraries. The number of libraries was determined as previously described. This segment can be found in the following transcript(s): D12392_T12 (SEQ ID NO:2500). Table 2373 below describes the starting and ending position of this segment on each transcript.

TABLE 2373

| Segment location on transcripts | | |
|---|---|---|
| Transcript name | Segment starting position | Segment ending position |
| D12392_T12 (SEQ ID NO: 2500) | 504 | 529 |

This segment can be found in a non-coding region of transcript(s) that are related to the following protein(s): D12392_P9.

Segment cluster D12392_node_18 (SEQ ID NO:2522) according to the present invention is supported by 44 libraries. The number of libraries was determined as previously described. This segment can be found in the following transcript(s): D12392_T12 (SEQ ID NO:2500). Table 2374 below describes the starting and ending position of this segment on each transcript.

TABLE 2374

| Segment location on transcripts | | |
|---|---|---|
| Transcript name | Segment starting position | Segment ending position |
| D12392_T12 (SEQ ID NO: 2500) | 530 | 558 |

This segment can be found in a non-coding region of transcript(s) that are related to the following protein(s): D12392_P9.

Segment cluster D12392_node_19 (SEQ ID NO:2523) according to the present invention is supported by 50 libraries. The number of libraries was determined as previously described. This segment can be found in the following transcript(s): D12392_T12 (SEQ ID NO:2500). Table 2375 below describes the starting and ending position of this segment on each transcript.

TABLE 2375

| Segment location on transcripts | | |
|---|---|---|
| Transcript name | Segment starting position | Segment ending position |
| D12392_T12 (SEQ ID NO: 2500) | 559 | 645 |

This segment can be found in the following protein(s): D12392_P9.

Segment cluster D12392_node_24 (SEQ ID NO:2524) according to the present invention is supported by 46 libraries. The number of libraries was determined as previously described. This segment can be found in the following transcript(s): D12392_T12 (SEQ ID NO:2500) and D12392_T13 (SEQ ID NO:2501). Table 2376 below describes the starting and ending position of this segment on each transcript.

TABLE 2376

| Segment location on transcripts | | |
|---|---|---|
| Transcript name | Segment starting position | Segment ending position |
| D12392_T12 (SEQ ID NO: 2500) | 827 | 909 |
| D12392_T13 (SEQ ID NO: 2501) | 497 | 579 |

This segment can be found in the following protein(s): D12392_P9 and D12392_P11.

Segment cluster D12392_node_29 (SEQ ID NO:2525) according to the present invention can be found in the following transcript(s): D12392_T12 (SEQ ID NO:2500) and D12392_T13 (SEQ ID NO:2501). Table 2377 below describes the starting and ending position of this segment on each transcript.

TABLE 2377

| Segment location on transcripts | | |
|---|---|---|
| Transcript name | Segment starting position | Segment ending position |
| D12392_T12 (SEQ ID NO: 2500) | 1099 | 1120 |
| D12392_T13 (SEQ ID NO: 2501) | 769 | 790 |

This segment can be found in the following protein(s): D12392_P9 and D12392_P11.

Segment cluster D12392_node_33 (SEQ ID NO:2526) according to the present invention is supported by 67 libraries. The number of libraries was determined as previously described. This segment can be found in the following transcript(s): D12392_T12 (SEQ ID NO:2500), D12392_T13 (SEQ ID NO:2501) and D12392_T14 (SEQ ID NO:2502). Table 2378 below describes the starting and ending position of this segment on each transcript.

TABLE 2378

| Segment location on transcripts | | |
|---|---|---|
| Transcript name | Segment starting position | Segment ending position |
| D12392_T12 (SEQ ID NO: 2500) | 1296 | 1388 |
| D12392_T13 (SEQ ID NO: 2501) | 966 | 1058 |
| D12392_T14 (SEQ ID NO: 2502) | 1382 | 1474 |

This segment can be found in the following protein(s): D12392_P9 and D12392_P11.

Segment cluster D12392_node__36 (SEQ ID NO:2527) according to the present invention is supported by 55 libraries. The number of libraries was determined as previously described. This segment can be found in the following transcript(s): D12392_T12 (SEQ ID NO:2500), D12392_T13 (SEQ ID NO:2501), D12392_T14 (SEQ ID NO:2502), D12392_T16 (SEQ ID NO:2504) and D12392_T17 (SEQ ID NO:2505). Table 2379 below describes the starting and ending position of this segment on each transcript.

TABLE 2379

Segment location on transcripts

| Transcript name | Segment starting position | Segment ending position |
|---|---|---|
| D12392_T12 (SEQ ID NO: 2500) | 1389 | 1469 |
| D12392_T13 (SEQ ID NO: 2501) | 1059 | 1139 |
| D12392_T14 (SEQ ID NO: 2502) | 1475 | 1555 |
| D12392_T16 (SEQ ID NO: 2504) | 593 | 673 |
| D12392_T17 (SEQ ID NO: 2505) | 593 | 673 |

This segment can be found in the following protein(s): D12392_P9 and D12392_P11.

Segment cluster D12392_node__37 (SEQ ID NO:2528) according to the present invention is supported by 45 libraries. The number of libraries was determined as previously described. This segment can be found in the following transcript(s): D12392_T12 (SEQ ID NO:2500), D12392_T13 (SEQ ID NO:2501), D12392_T14 (SEQ ID NO:2502), D12392_T16 (SEQ ID NO:2504) and D12392_T17 (SEQ ID NO:2505). Table 2380 below describes the starting and ending position of this segment on each transcript.

TABLE 2380

Segment location on transcripts

| Transcript name | Segment starting position | Segment ending position |
|---|---|---|
| D12392_T12 (SEQ ID NO: 2500) | 1470 | 1537 |
| D12392_T13 (SEQ ID NO: 2501) | 1140 | 1207 |
| D12392_T14 (SEQ ID NO: 2502) | 1556 | 1623 |
| D12392_T16 (SEQ ID NO: 2504) | 674 | 741 |
| D12392_T17 (SEQ ID NO: 2505) | 674 | 773 |

This segment can be found in the following protein(s): D12392_P9 and D12392_P11.

Description for Cluster D31004

Cluster D31004 features 4 transcript(s) and 17 segment(s) of interest, the names for which are given in Tables 2381 and 2382, respectively, the sequences themselves are given at the end of the application. The selected protein variants are given in Table 2383.

TABLE 2381

Transcripts of interest
Transcript Name

D31004_T6 (SEQ ID NO: 2529)
D31004_T16 (SEQ ID NO: 2530)
D31004_T19 (SEQ ID NO: 2531)
D31004_T26 (SEQ ID NO: 2532)

TABLE 2382

Segments of interest
Segment Name

D31004_node__12 (SEQ ID NO: 2533)
D31004_node__13 (SEQ ID NO: 2534)
D31004_node__15 (SEQ ID NO: 2535)
D31004_node__19 (SEQ ID NO: 2536)
D31004_node__20 (SEQ ID NO: 2537)
D31004_node__21 (SEQ ID NO: 2538)
D31004_node__23 (SEQ ID NO: 2539)
D31004_node__25 (SEQ ID NO: 2540)
D31004_node__27 (SEQ ID NO: 2541)
D31004_node__29 (SEQ ID NO: 2542)
D31004_node__30 (SEQ ID NO: 2543)
D31004_node__32 (SEQ ID NO: 2544)
D31004_node__14 (SEQ ID NO: 2545)
D31004_node__17 (SEQ ID NO: 2546)
D31004_node__22 (SEQ ID NO: 2547)
D31004_node__24 (SEQ ID NO: 2548)
D31004_node__26 (SEQ ID NO: 2549)

TABLE 2383

Proteins of interest

| Protein Name | Corresponding Transcript(s) |
|---|---|
| D31004_P5 | D31004_T16 (SEQ ID NO: 2530); D31004_T26 (SEQ ID NO: 2532) |

These sequences are variants of the known protein Thyroid transcription factor 1 (SwissProt accession identifier TTF1_HUMAN; known also according to the synonyms Thyroid nuclear factor 1; TTF-1; Homeobox protein Nkx-2.1; Homeobox protein NK-2 homolog A), referred to herein as the previously known protein.

Protein Thyroid transcription factor 1 is known or believed to have the following function(s): Transcription factor that binds and activates the promoter of thyroid specific genes such as thyroglobulin, thyroperoxidase, and thyrotropin receptor. Crucial in the maintenance of the thyroid differentiation phenotype. May play a role in lung development and surfactant homeostasis. The sequence for protein Thyroid transcription factor 1 is given at the end of the application, as "Thyroid transcription factor 1 amino acid sequence". Known polymorphisms for this sequence are as shown in Table 2384.

TABLE 2384

Amino acid mutations for Known Protein

| SNP position(s) on amino acid sequence | Comment |
|---|---|
| 208 | W -> L (in BHC). /FTId = VAR__015188. |
| 213 | R -> S (in BHC). /FTId = VAR__015189. |
| 49 | P -> H |
| 61 | H -> P |
| 158 | S -> T |
| 161 | R -> G |
| 226-227 | QQ -> HE |

Protein Thyroid transcription factor I localization is believed to be Nuclear.

The following GO Annotation(s) apply to the previously known protein. The following annotation(s) were found: transcription regulation, which are annotation(s) related to Biological Process; transcription factor; transcriptional activator, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster D31004 features 17 segment(s), which were listed in Table 2382 above and for which the sequence(s) are given at the end of the application. These segment(s) are portions of nucleic acid sequence(s) which are described herein separately because they are of particular interest. A description of each segment according to the present invention is now provided.

Segment cluster D31004_node__12 (SEQ ID NO:2533) according to the present invention is supported by 14 libraries. The number of libraries was determined as previously described. This segment can be found in the following transcript(s): D31004_T16 (SEQ ID NO:2530) and D31004_T26 (SEQ ID NO:2532). Table 2385 below describes the starting and ending position of this segment on each transcript.

TABLE 2385

Segment location on transcripts

| Transcript name | Segment starting position | Segment ending position |
|---|---|---|
| D31004_T16 (SEQ ID NO: 2530) | 1 | 192 |
| D31004_T26 (SEQ ID NO: 2532) | 1 | 192 |

This segment can be found in the following protein(s): D31004_P5.

Segment cluster D31004_node__13 (SEQ ID NO:2534) according to the present invention is supported by 17 libraries. The number of libraries was determined as previously described. This segment can be found in the following transcript(s): (SEQ ID NO:2530) and D31004_T26 (SEQ ID NO:2532). Table 2386 below describes the starting and ending position of this segment on each transcript.

TABLE 2386

Segment location on transcripts

| Transcript name | Segment starting position | Segment ending position |
|---|---|---|
| D31004_T16 (SEQ ID NO: 2530) | 193 | 513 |
| D31004_T26 (SEQ ID NO: 2532) | 193 | 513 |

This segment can be found in the following protein(s): D31004_P5.

Segment cluster D31004_node__15 (SEQ ID NO:2535) according to the present invention is supported by 19 libraries. The number of libraries was determined as previously described. This segment can be found in the following transcript(s): (SEQ ID NO:2530) and D31004_T26 (SEQ ID NO:2532). Table 2387 below describes the starting and ending position of this segment on each transcript.

TABLE 2387

Segment location on transcripts

| Transcript name | Segment starting position | Segment ending position |
|---|---|---|
| D31004_T16 (SEQ ID NO: 2530) | 578 | 757 |
| D31004_T26 (SEQ ID NO: 2532) | 578 | 757 |

This segment can be found in a non-coding region of transcript(s) that are related to the following protein(s): D31004_P5.

Segment cluster D31004_node__19 (SEQ ID NO:2536) according to the present invention is supported by 7 libraries. The number of libraries was determined as previously described. This segment can be found in the following transcript(s): D31004_T6 (SEQ ID NO:2529). Table 2388 below describes the starting and ending position of this segment on each transcript.

TABLE 2388

Segment location on transcripts

| Transcript name | Segment starting position | Segment ending position |
|---|---|---|
| D31004_T6 (SEQ ID NO: 2529) | 1 | 997 |

The previously-described transcripts for these segment(s) do not code for protein.

Segment cluster D31004_node__20 (SEQ ID NO:2537) according to the present invention is supported by 12 libraries. The number of libraries was determined as previously described. This segment can be found in the following transcript(s): D31004_T6 (SEQ ID NO:2529) and D31004_T16 (SEQ ID NO:2530). Table 2389 below describes the starting and ending position of this segment on each transcript.

TABLE 2389

Segment location on transcripts

| Transcript name | Segment starting position | Segment ending position |
|---|---|---|
| D31004_T6 (SEQ ID NO: 2529) | 998 | 1160 |
| D31004_T16 (SEQ ID NO: 2530) | 849 | 1011 |

This segment can be found in a non-coding region of transcript(s) that are related to the following protein(s): D31004_P5.

Segment cluster D31004_node__21 (SEQ ID NO:2538) according to the present invention is supported by 6 libraries. The number of libraries was determined as previously described. This segment can be found in the following transcript(s): D31004_T6 (SEQ ID NO:2529) and D31004_T16 (SEQ ID NO:2530). Table 2390 below describes the starting and ending position of this segment on each transcript.

TABLE 2390

Segment location on transcripts

| Transcript name | Segment starting position | Segment ending position |
|---|---|---|
| D31004_T6 (SEQ ID NO: 2529) | 1161 | 1337 |
| D31004_T16 (SEQ ID NO: 2530) | 1012 | 1188 |

This segment can be found in a non-coding region of transcript(s) that are related to the following protein(s): D31004_P5.

Segment cluster D31004_node_23 (SEQ ID NO:2539) according to the present invention is supported by 10 libraries. The number of libraries was determined as previously described. This segment can be found in the following transcript(s): D31004_T6 (SEQ ID NO:2529) and D31004_T16 (SEQ ID NO:2530). Table 2391 below describes the starting and ending position of this segment on each transcript.

TABLE 2391

| Segment location on transcripts | | |
|---|---|---|
| Transcript name | Segment starting position | Segment ending position |
| D31004_T6 (SEQ ID NO: 2529) | 1435 | 1772 |
| D31004_T16 (SEQ ID NO: 2530) | 1286 | 1623 |

This segment can be found in a non-coding region of transcript(s) that are related to the following protein(s): D31004_P5.

Segment cluster D31004_node_25 (SEQ ID NO:2540) according to the present invention is supported by 24 libraries. The number of libraries was determined as previously described. This segment can be found in the following transcript(s): D31004_T6 (SEQ ID NO:2529), D31004_T16 (SEQ ID NO:2530) and D31004_T26 (SEQ ID NO:2532). Table 2392 below describes the starting and ending position of this segment on each transcript.

TABLE 2392

| Segment location on transcripts | | |
|---|---|---|
| Transcript name | Segment starting position | Segment ending position |
| D31004_T6 (SEQ ID NO: 2529) | 1778 | 1905 |
| D31004_T16 (SEQ ID NO: 2530) | 1629 | 1756 |
| D31004_T26 (SEQ ID NO: 2532) | 854 | 981 |

This segment can be found in a non-coding region of transcript(s) that are related to the following protein(s): D31004_P5.

Segment cluster D31004_node_27 (SEQ ID NO:2541) according to the present invention is supported by 8 libraries. The number of libraries was determined as previously described. This segment can be found in the following transcript(s): D31004_T16 (SEQ ID NO:2530) and D31004_T26 (SEQ ID NO:2532). Table 2393 below describes the starting and ending position of this segment on each transcript.

TABLE 2393

| Segment location on transcripts | | |
|---|---|---|
| Transcript name | Segment starting position | Segment ending position |
| D31004_T16 (SEQ ID NO: 2530) | 1783 | 2337 |
| D31004_T26 (SEQ ID NO: 2532) | 1008 | 1562 |

This segment can be found in a non-coding region of transcript(s) that are related to the following protein(s): D31004_P5.

Segment cluster D31004_node_29 (SEQ ID NO:2542) according to the present invention is supported by 7 libraries. The number of libraries was determined as previously described. This segment can be found in the following transcript(s): D31004_T19 (SEQ ID NO:2531). Table 2394 below describes the starting and ending position of this segment on each transcript.

TABLE 2394

| Segment location on transcripts | | |
|---|---|---|
| Transcript name | Segment starting position | Segment ending position |
| D31004_T19 (SEQ ID NO: 2531) | 1 | 1092 |

The previously-described transcripts for these segment(s) do not code for protein.

Segment cluster D31004_node_30 (SEQ ID NO:2543) according to the present invention is supported by 26 libraries. The number of libraries was determined as previously described. This segment can be found in the following transcript(s): D31004_T6 (SEQ ID NO:2529) and D31004_T19 (SEQ ID NO:2531). Table 2395 below describes the starting and ending position of this segment on each transcript.

TABLE 2395

| Segment location on transcripts | | |
|---|---|---|
| Transcript name | Segment starting position | Segment ending position |
| D31004_T6 (SEQ ID NO: 2529) | 1906 | 2109 |
| D31004_T19 (SEQ ID NO: 2531) | 1093 | 1296 |

The previously-described transcripts for these segment(s) do not code for protein.

Segment cluster D31004_node_32 (SEQ ID NO:2544) according to the present invention is supported by 45 libraries. The number of libraries was determined as previously described. This segment can be found in the following transcript(s): D31004_T6 (SEQ ID NO:2529) and D31004_T19 (SEQ ID NO:2531). Table 2396 below describes the starting and ending position of this segment on each transcript.

TABLE 2396

| Segment location on transcripts | | |
|---|---|---|
| Transcript name | Segment starting position | Segment ending position |
| D31004_T6 (SEQ ID NO: 2529) | 2110 | 2701 |
| D31004_T19 (SEQ ID NO: 2531) | 1297 | 1888 |

The previously-described transcripts for these segment(s) do not code for protein.

According to an optional embodiment of the present invention, short segments related to the above cluster are also provided. These segments are up to about 120 bp in length, and so are included in a separate description.

Segment cluster D31004_node_14 (SEQ ID NO:2545) according to the present invention is supported by 13 libraries. The number of libraries was determined as previously described. This segment can be found in the following transcript(s): D31004_T16 (SEQ ID NO:2530) and D31004_T26 (SEQ ID NO:2532). Table 2397 below describes the starting and ending position of this segment on each transcript.

TABLE 2397

Segment location on transcripts

| Transcript name | Segment starting position | Segment ending position |
|---|---|---|
| D31004_T16 (SEQ ID NO: 2530) | 514 | 577 |
| D31004_T26 (SEQ ID NO: 2532) | 514 | 577 |

This segment can be found in a non-coding region of transcript(s) that are related to the following protein(s): D31004_P5.

Segment cluster D31004_node_17 (SEQ ID NO:2546) according to the present invention is supported by 21 libraries. The number of libraries was determined as previously described. This segment can be found in the following transcript(s): D31004_T16 (SEQ ID NO:2530) and D31004_T26 (SEQ ID NO:2532). Table 2398 below describes the starting and ending position of this segment on each transcript.

TABLE 2398

Segment location on transcripts

| Transcript name | Segment starting position | Segment ending position |
|---|---|---|
| D31004_T16 (SEQ ID NO: 2530) | 758 | 848 |
| D31004_T26 (SEQ ID NO: 2532) | 758 | 848 |

This segment can be found in a non-coding region of transcript(s) that are related to the following protein(s): D31004_P5.

Segment cluster D31004_node_22 (SEQ ID NO:2547) according to the present invention is supported by 6 libraries. The number of libraries was determined as previously described. This segment can be found in the following transcript(s): D31004_T6 (SEQ ID NO:2529) and D31004_T16 (SEQ ID NO:2530). Table 2399 below describes the starting and ending position of this segment on each transcript.

TABLE 2399

Segment location on transcripts

| Transcript name | Segment starting position | Segment ending position |
|---|---|---|
| D31004_T6 (SEQ ID NO: 2529) | 1338 | 1434 |
| D31004_T16 (SEQ ID NO: 2530) | 1189 | 1285 |

This segment can be found in a non-coding region of transcript(s) that are related to the following protein(s): D31004_P5.

Segment cluster D31004_node_24 (SEQ ID NO:2548) according to the present invention can be found in the following transcript(s): D31004_T6 (SEQ ID NO:2529), D31004_T16 (SEQ ID NO:2530) and D31004_T26 (SEQ ID NO:2532). Table 2400 below describes the starting and ending position of this segment on each transcript.

TABLE 2400

Segment location on transcripts

| Transcript name | Segment starting position | Segment ending position |
|---|---|---|
| D31004_T6 (SEQ ID NO: 2529) | 1773 | 1777 |
| D31004_T16 (SEQ ID NO: 2530) | 1624 | 1628 |
| D31004_T26 (SEQ ID NO: 2532) | 849 | 853 |

This segment can be found in a non-coding region of transcript(s) that are related to the following protein(s): D31004_P5.

Segment cluster D31004_node_26 (SEQ ID NO:2549) according to the present invention is supported by 7 libraries. The number of libraries was determined as previously described. This segment can be found in the following transcript(s): D31004_T16 (SEQ ID NO:2530) and D31004_T26 (SEQ ID NO:2532). Table 2401 below describes the starting and ending position of this segment on each transcript.

TABLE 2401

Segment location on transcripts

| Transcript name | Segment starting position | Segment ending position |
|---|---|---|
| D31004_T16 (SEQ ID NO: 2530) | 1757 | 1782 |
| D31004_T26 (SEQ ID NO: 2532) | 982 | 1007 |

This segment can be found in a non-coding region of transcript(s) that are related to the following protein(s): D31004_P5.

Description for Cluster D62617

Cluster D62617 features 1 transcript(s) and 2 segment(s) of interest, the names for which are given in Tables 2402 and 2403, respectively, the sequences themselves are given at the end of the application. The selected protein variants are given in Table 2404.

TABLE 2402

Transcripts of interest
Transcript Name

D62617_T0 (SEQ ID NO: 2550)

TABLE 2403

Segments of interest
Segment Name

D62617_node_0 (SEQ ID NO: 2551)
D62617_node_2 (SEQ ID NO: 2552)

TABLE 2404

Proteins of interest

| Protein Name | Corresponding Transcript(s) |
|---|---|
|  |  |

The heart-selective diagnostic marker prediction engine provided the following results with regard to cluster D62617.

Predictions were made for selective expression of transcripts of this contig in heart tissue, according to the previously described methods. The numbers on the y-axis of FIG. 63 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 63, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 11.4; the ratio of expression of the cluster in heart specific ESTs to the overall expression of the cluster in muscle-specific ESTs which was found to be 5.6; and fisher exact test P-values were computed both for library and weighted clone counts to check that the counts are statistically significant, and were found to be 3.60E-05.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 11.4, which clearly supports specific expression in heart tissue.

As noted above, cluster D62617 features 2 segment(s), which were listed in Table 2403 above and for which the sequence(s) are given at the end of the application. These segment(s) are portions of nucleic acid sequence(s) which are described herein separately because they are of particular interest. A description of each segment according to the present invention is now provided.

Segment cluster D62617_node_0 (SEQ ID NO:2551) according to the present invention is supported by 6 libraries. The number of libraries was determined as previously described. This segment can be found in the following transcript(s): D62617_T0 (SEQ ID NO:2550). Table 2405 below describes the starting and ending position of this segment on each transcript.

TABLE 2405

Segment location on transcripts

| Transcript name | Segment starting position | Segment ending position |
|---|---|---|
| D62617_T0 (SEQ ID NO: 2550) | 1 | 720 |

The previously-described transcripts for these segment(s) do not code for protein.

Segment cluster D62617_node_2 (SEQ ID NO:2552) according to the present invention is supported by 48 libraries. The number of libraries was determined as previously described. This segment can be found in the following transcript(s): D62617_T0 (SEQ ID NO:2550). Table 2406 below describes the starting and ending position of this segment on each transcript.

TABLE 2406

Segment location on transcripts

| Transcript name | Segment starting position | Segment ending position |
|---|---|---|
| D62617_T0 (SEQ ID NO: 2550) | 721 | 2973 |

The previously-described transcripts for these segment(s) do not code for protein.

Description for Cluster F13779

Cluster F13779 features 1 transcript(s) and 32 segment(s) of interest, the names for which are given in Tables 2407 and 2408, respectively, the sequences themselves are given at the end of the application. The selected protein variants are given in Table 2409.

TABLE 2407

Transcripts of interest
Transcript Name

F13779_T1 (SEQ ID NO: 2553)

TABLE 2408

Segments of interest
Segment Name

F13779_node_0 (SEQ ID NO: 2554)
F13779_node_9 (SEQ ID NO: 2555)
F13779_node_11 (SEQ ID NO: 2556)
F13779_node_13 (SEQ ID NO: 2557)
F13779_node_31 (SEQ ID NO: 2558)
F13779_node_32 (SEQ ID NO: 2559)
F13779_node_33 (SEQ ID NO: 2560)
F13779_node_34 (SEQ ID NO: 2561)
F13779_node_39 (SEQ ID NO: 2562)
F13779_node_41 (SEQ ID NO: 2563)
F13779_node_44 (SEQ ID NO: 2564)
F13779_node_45 (SEQ ID NO: 2565)
F13779_node_46 (SEQ ID NO: 2566)
F13779_node_6 (SEQ ID NO: 2567)
F13779_node_7 (SEQ ID NO: 2568)
F13779_node_15 (SEQ ID NO: 2569)
F13779_node_17 (SEQ ID NO: 2570)
F13779_node_20 (SEQ ID NO: 2571)
F13779_node_22 (SEQ ID NO: 2572)
F13779_node_25 (SEQ ID NO: 2573)
F13779_node_26 (SEQ ID NO: 2574)
F13779_node_27 (SEQ ID NO: 2575)
F13779_node_28 (SEQ ID NO: 2576)
F13779_node_29 (SEQ ID NO: 2577)
F13779_node_30 (SEQ ID NO: 2578)
F13779_node_35 (SEQ ID NO: 2579)
F13779_node_36 (SEQ ID NO: 2580)
F13779_node_37 (SEQ ID NO: 2581)
F13779_node_38 (SEQ ID NO: 2582)
F13779_node_40 (SEQ ID NO: 2583)
F13779_node_42 (SEQ ID NO: 2584)
F13779_node_43 (SEQ ID NO: 2585)

TABLE 2409

Proteins of interest

| Protein Name | Corresponding Transcript(s) |
|---|---|
| F13779_P1 | F13779_T1 (SEQ ID NO: 2553) |

Cluster F13779 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 64 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 64 and Table 2410. This cluster is overexpressed (at least at a minimum level) in the following pathological conditions: epithelial malignant tumors, a mixture of malignant tumors from different tissues and skin malignancies.

TABLE 2410

Normal tissue distribution

| Name of Tissue | Number |
|---|---|
| adrenal | 0 |
| Bone | 0 |
| Brain | 2 |
| Colon | 0 |
| epithelial | 0 |
| general | 7 |
| kidney | 0 |
| Liver | 0 |
| Lung | 2 |
| lymph nodes | 73 |
| Breast | 0 |
| bone marrow | 0 |
| muscle | 3 |
| Ovary | 0 |
| pancreas | 0 |
| prostate | 0 |
| Skin | 0 |
| stomach | 0 |
| T cells | 278 |
| Thyroid | 0 |
| uterus | 0 |

TABLE 2411

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 2.9e−01 | 2.7 |
| Bone | 1 | 2.8e−01 | 1 | 1.0 | 2.4e−01 | 2.8 |
| Brain | 5.8e−02 | 2.3e−02 | 1.2e−01 | 4.8 | 4.3e−02 | 5.0 |
| colon | 2.6e−01 | 3.3e−01 | 7.0e−01 | 1.7 | 7.7e−01 | 1.5 |
| epithelial | 4.5e−03 | 1.7e−06 | 3.2e−03 | 8.1 | 2.4e−10 | 19.9 |
| general | 1.2e−01 | 4.5e−09 | 5.4e−02 | 1.9 | 1.4e−15 | 5.5 |
| kidney | 1 | 5.1e−01 | 1 | 1.0 | 2.4e−01 | 2.3 |
| Liver | 1 | 1.9e−01 | 1 | 1.0 | 3.3e−01 | 2.5 |
| Lung | 4.9e−01 | 3.9e−01 | 1.7e−01 | 3.2 | 9.0e−02 | 3.4 |
| lymph nodes | 8.5e−01 | 6.1e−01 | 1 | 0.2 | 4.3e−01 | 0.7 |
| breast | 8.0e−01 | 5.4e−01 | 6.9e−01 | 1.5 | 2.5e−01 | 2.1 |
| Bone marrow | 1 | 4.2e−01 | 1 | 1.0 | 5.3e−01 | 2.1 |
| muscle | 9.2e−01 | 4.8e−01 | 1 | 0.8 | 1.5e−01 | 3.4 |
| ovary | 1 | 6.5e−01 | 1 | 1.0 | 7.7e−01 | 1.3 |
| pancreas | 3.3e−01 | 1.8e−01 | 4.2e−01 | 2.4 | 7.7e−02 | 3.7 |
| prostate | 7.3e−01 | 6.0e−01 | 1 | 1.0 | 5.6e−01 | 1.7 |
| Skin | 1 | 6.9e−02 | 1 | 1.0 | 2.0e−03 | 3.8 |
| stomach | 3.6e−01 | 1.3e−01 | 1 | 1.0 | 2.1e−01 | 2.5 |
| T cells | 5.0e−01 | 6.7e−01 | 1 | 0.5 | 8.1e−01 | 0.9 |
| Thyroid | 5.0e−01 | 5.0e−01 | 4.4e−01 | 2.0 | 4.4e−01 | 2.0 |
| uterus | 4.7e−01 | 1.4e−01 | 6.6e−01 | 1.5 | 2.1e−01 | 2.3 |

As noted above, cluster F13779 features 32 segment(s), which were listed in Table 2408 above and for which the sequence(s) are given at the end of the application. These segment(s) are portions of nucleic acid sequence(s) which are described herein separately because they are of particular interest. A description of each segment according to the present invention is now provided.

Segment cluster F13779_node_0 (SEQ ID NO:2554) according to the present invention is supported by 23 libraries. The number of libraries was determined as previously described. This segment can be found in the following transcript(s): F13779_T1 (SEQ ID NO:2553). Table 2412 below describes the starting and ending position of this segment on each transcript.

TABLE 2412

Segment location on transcripts

| Transcript name | Segment starting position | Segment ending position |
|---|---|---|
| F13779_T1 (SEQ ID NO: 2553) | 1 | 294 |

This segment can be found in a non-coding region of transcript(s) that are related to the following protein(s): F13779_P1.

Segment cluster F13779_node_9 (SEQ ID NO:2555) according to the present invention is supported by 27 libraries. The number of libraries was determined as previously described. This segment can be found in the following transcript(s): F13779_T1 (SEQ ID NO:2553). Table 2413 below describes the starting and ending position of this segment on each transcript.

TABLE 2413

Segment location on transcripts

| Transcript name | Segment starting position | Segment ending position |
|---|---|---|
| F13779_T1 (SEQ ID NO: 2553) | 428 | 578 |

This segment can be found in the following protein(s): F13779_P1.

Segment cluster F13779_node_11 (SEQ ID NO:2556) according to the present invention is supported by 28 libraries. The number of libraries was determined as previously described. This segment can be found in the following transcript(s): F13779_T1 (SEQ ID NO:2553). Table 2414 below describes the starting and ending position of this segment on each transcript.

TABLE 2414

Segment location on transcripts

| Transcript name | Segment starting position | Segment ending position |
|---|---|---|
| F13779_T1 (SEQ ID NO: 2553) | 579 | 701 |

This segment can be found in the following protein(s): F13779_P1.

Segment cluster F13779_node_13 (SEQ ID NO:2557) according to the present invention is supported by 32 libraries. The number of libraries was determined as previously described. This segment can be found in the following transcript(s): F13779_T1 (SEQ ID NO:2553). Table 2415 below describes the starting and ending position of this segment on each transcript.

TABLE 2415

Segment location on transcripts

| Transcript name | Segment starting position | Segment ending position |
|---|---|---|
| F13779_T1 (SEQ ID NO: 2553) | 702 | 944 |

This segment can be found in the following protein(s): F13779_P1.

Segment cluster F13779_node_31 (SEQ ID NO:2558) according to the present invention is supported by 22 libraries. The number of libraries was determined as previously described. This segment can be found in the following transcript(s): F13779_T1 (SEQ ID NO:2553). Table 2416 below describes the starting and ending position of this segment on each transcript.

TABLE 2416

Segment location on transcripts

| Transcript name | Segment starting position | Segment ending position |
|---|---|---|
| F13779_T1 (SEQ ID NO: 2553) | 1529 | 2286 |

This segment can be found in a non-coding region of transcript(s) that are related to the following protein(s): F13779_P1.

Segment cluster F13779_node_32 (SEQ ID NO:2559) according to the present invention is supported by 17 libraries. The number of libraries was determined as previously described. This segment can be found in the following transcript(s): F13779_T1 (SEQ ID NO:2553). Table 2417 below describes the starting and ending position of this segment on each transcript.

TABLE 2417

Segment location on transcripts

| Transcript name | Segment starting position | Segment ending position |
|---|---|---|
| F13779_T1 (SEQ ID NO: 2553) | 2287 | 2688 |

This segment can be found in a non-coding region of transcript(s) that are related to the following protein(s): F13779_P1.

Segment cluster F13779_node_33 (SEQ ID NO:2560) according to the present invention is supported by 16 libraries. The number of libraries was determined as previously described. This segment can be found in the following transcript(s): F13779_T1 (SEQ ID NO:2553). Table 2418 below describes the starting and ending position of this segment on each transcript.

TABLE 2418

Segment location on transcripts

| Transcript name | Segment starting position | Segment ending position |
|---|---|---|
| F13779_T1 (SEQ ID NO: 2553) | 2689 | 2892 |

This segment can be found in a non-coding region of transcript(s) that are related to the following protein(s): F13779_P1.

Segment cluster F13779_node_34 (SEQ ID NO:2561) according to the present invention is supported by 11 libraries. The number of libraries was determined as previously described. This segment can be found in the following transcript(s): F13779_T1 (SEQ ID NO:2553). Table 2419 below describes the starting and ending position of this segment on each transcript.

TABLE 2419

Segment location on transcripts

| Transcript name | Segment starting position | Segment ending position |
|---|---|---|
| F13779_T1 (SEQ ID NO: 2553) | 2893 | 3024 |

This segment can be found in a non-coding region of transcript(s) that are related to the following protein(s): F13779_P1.

Segment cluster F13779_node_39 (SEQ ID NO:2562) according to the present invention is supported by 22 libraries. The number of libraries was determined as previously described. This segment can be found in the following transcript(s): F13779_T1 (SEQ ID NO:2553). Table 2420 below describes the starting and ending position of this segment on each transcript.

TABLE 2420

Segment location on transcripts

| Transcript name | Segment starting position | Segment ending position |
|---|---|---|
| F13779_T1 (SEQ ID NO: 2553) | 3280 | 3416 |

This segment can be found in a non-coding region of transcript(s) that are related to the following protein(s): F13779_P1.

Segment cluster F13779_node_41 (SEQ ID NO:2563) according to the present invention is supported by 25 libraries. The number of libraries was determined as previously described. This segment can be found in the following transcript(s): F13779_T1 (SEQ ID NO:2553). Table 2421 below describes the starting and ending position of this segment on each transcript.

TABLE 2421

Segment location on transcripts

| Transcript name | Segment starting position | Segment ending position |
|---|---|---|
| F13779_T1 (SEQ ID NO: 2553) | 3429 | 3550 |

This segment can be found in a non-coding region of transcript(s) that are related to the following protein(s): F13779_P1.

Segment cluster F13779_node_44 (SEQ ID NO:2564) according to the present invention is supported by 24 libraries. The number of libraries was determined as previously described. This segment can be found in the following transcript(s): F13779_T1 (SEQ ID NO:2553). Table 2422 below describes the starting and ending position of this segment on each transcript.

TABLE 2422

| | Segment location on transcripts | |
|---|---|---|
| Transcript name | Segment starting position | Segment ending position |
| F13779_T1 (SEQ ID NO: 2553) | 3583 | 4192 |

This segment can be found in a non-coding region of transcript(s) that are related to the following protein(s): F13779_P1.

Segment cluster F13779_node_45 (SEQ ID NO:2565) according to the present invention is supported by 43 libraries. The number of libraries was determined as previously described. This segment can be found in the following transcript(s): F13779_T1 (SEQ ID NO:2553). Table 2423 below describes the starting and ending position of this segment on each transcript.

TABLE 2423

| | Segment location on transcripts | |
|---|---|---|
| Transcript name | Segment starting position | Segment ending position |
| F13779_T1 (SEQ ID NO: 2553) | 4193 | 5385 |

This segment can be found in a non-coding region of transcript(s) that are related to the following protein(s): F13779_P1.

Segment cluster F13779_node_46 (SEQ ID NO:2566) according to the present invention is supported by 5 libraries. The number of libraries was determined as previously described. This segment can be found in the following transcript(s): F13779_T1 (SEQ ID NO:2553). Table 2424 below describes the starting and ending position of this segment on each transcript.

TABLE 2424

| | Segment location on transcripts | |
|---|---|---|
| Transcript name | Segment starting position | Segment ending position |
| F13779_T1 (SEQ ID NO: 2553) | 5386 | 5802 |

This segment can be found in a non-coding region of transcript(s) that are related to the following protein(s): F13779_P1.

According to an optional embodiment of the present invention, short segments related to the above cluster are also provided. These segments are up to about 120 bp in length, and so are included in a separate description.

Segment cluster F13779_node_6 (SEQ ID NO:2567) according to the present invention is supported by 28 libraries. The number of libraries was determined as previously described. This segment can be found in the following transcript(s): F13779_T1 (SEQ ID NO:2553). Table 2425 below describes the starting and ending position of this segment on each transcript.

TABLE 2425

| | Segment location on transcripts | |
|---|---|---|
| Transcript name | Segment starting position | Segment ending position |
| F13779_T1 (SEQ ID NO: 2553) | 295 | 389 |

This segment can be found in the following protein(s): F13779_P1.

Segment cluster F13779_node_7 (SEQ ID NO:2568) according to the present invention is supported by 25 libraries. The number of libraries was determined as previously described. This segment can be found in the following transcript(s): F13779_T1 (SEQ ID NO:2553). Table 2426 below describes the starting and ending position of this segment on each transcript.

TABLE 2426

| | Segment location on transcripts | |
|---|---|---|
| Transcript name | Segment starting position | Segment ending position |
| F13779_T1 (SEQ ID NO: 2553) | 390 | 427 |

This segment can be found in the following protein(s): F13779_P1.

Segment cluster F13779_node_15 (SEQ ID NO:2569) according to the present invention is supported by 29 libraries. The number of libraries was determined as previously described. This segment can be found in the following transcript(s): F13779_T1 (SEQ ID NO:2553). Table 2427 below describes the starting and ending position of this segment on each transcript.

TABLE 2427

| | Segment location on transcripts | |
|---|---|---|
| Transcript name | Segment starting position | Segment ending position |
| F13779_T1 (SEQ ID NO: 2553) | 945 | 1043 |

This segment can be found in the following protein(s): F13779_P1.

Segment cluster F13779_node_17 (SEQ ID NO:2570) according to the present invention is supported by 30 libraries. The number of libraries was determined as previously described. This segment can be found in the following transcript(s): F13779_T1 (SEQ ID NO:2553). Table 2428 below describes the starting and ending position of this segment on each transcript.

TABLE 2428

| | Segment location on transcripts | |
|---|---|---|
| Transcript name | Segment starting position | Segment ending position |
| F13779_T1 (SEQ ID NO: 2553) | 1044 | 1156 |

This segment can be found in the following protein(s): F13779_P1.

Segment cluster F13779_node_20 (SEQ ID NO:2571) according to the present invention is supported by 21 libraries. The number of libraries was determined as previously described. This segment can be found in the following transcript(s): F13779_T1 (SEQ ID NO:2553). Table 2429 below describes the starting and ending position of this segment on each transcript.

TABLE 2429

Segment location on transcripts

| Transcript name | Segment starting position | Segment ending position |
|---|---|---|
| F13779_T1 (SEQ ID NO: 2553) | 1157 | 1216 |

This segment can be found in the following protein(s): F13779_P1.

Segment cluster F13779_node_22 (SEQ ID NO:2572) according to the present invention is supported by 20 libraries. The number of libraries was determined as previously described. This segment can be found in the following transcript(s): F13779_T1 (SEQ ID NO:2553). Table 2430 below describes the starting and ending position of this segment on each transcript.

TABLE 2430

Segment location on transcripts

| Transcript name | Segment starting position | Segment ending position |
|---|---|---|
| F13779_T1 (SEQ ID NO: 2553) | 1217 | 1313 |

This segment can be found in the following protein(s): F13779_P1.

Segment cluster F13779_node_25 (SEQ ID NO:2573) according to the present invention can be found in the following transcript(s): F13779_T1 (SEQ ID NO:2553). Table 2431 below describes the starting and ending position of this segment on each transcript.

TABLE 2431

Segment location on transcripts

| Transcript name | Segment starting position | Segment ending position |
|---|---|---|
| F13779_T1 (SEQ ID NO: 2553) | 1314 | 1332 |

This segment can be found in the following protein(s): F13779_P1.

Segment cluster F13779_node_26 (SEQ ID NO:2574) according to the present invention can be found in the following transcript(s): F13779_T1 (SEQ ID NO:2553). Table 2432 below describes the starting and ending position of this segment on each transcript.

TABLE 2432

Segment location on transcripts

| Transcript name | Segment starting position | Segment ending position |
|---|---|---|
| F13779_T1 (SEQ ID NO: 2553) | 1333 | 1350 |

This segment can be found in the following protein(s): F13779_P1.

Segment cluster F13779_node_27 (SEQ ID NO:2575) according to the present invention is supported by 18 libraries. The number of libraries was determined as previously described. This segment can be found in the following transcript(s): F13779_T1 (SEQ ID NO:2553). Table 2433 below describes the starting and ending position of this segment on each transcript.

TABLE 2433

Segment location on transcripts

| Transcript name | Segment starting position | Segment ending position |
|---|---|---|
| F13779_T1 (SEQ ID NO: 2553) | 1351 | 1407 |

This segment can be found in the following protein(s): F13779_P1.

Segment cluster F13779_node_28 (SEQ ID NO:2576) according to the present invention is supported by 14 libraries. The number of libraries was determined as previously described. This segment can be found in the following transcript(s): F13779_T1 (SEQ ID NO:2553). Table 2434 below describes the starting and ending position of this segment on each transcript.

TABLE 2434

Segment location on transcripts

| Transcript name | Segment starting position | Segment ending position |
|---|---|---|
| F13779_T1 (SEQ ID NO: 2553) | 1408 | 1461 |

This segment can be found in a non-coding region of transcript(s) that are related to the following protein(s): F13779_P1.

Segment cluster F13779_node_29 (SEQ ID NO:2577) according to the present invention is supported by 11 libraries. The number of libraries was determined as previously described. This segment can be found in the following transcript(s): F13779_T1 (SEQ ID NO:2553). Table 2435 below describes the starting and ending position of this segment on each transcript.

TABLE 2435

Segment location on transcripts

| Transcript name | Segment starting position | Segment ending position |
|---|---|---|
| F13779_T1 (SEQ ID NO: 2553) | 1462 | 1494 |

This segment can be found in a non-coding region of transcript(s) that are related to the following protein(s): F13779_P1.

Segment cluster F13779_node_30 (SEQ ID NO:2578) according to the present invention is supported by 10 libraries. The number of libraries was determined as previously described. This segment can be found in the following transcript(s): F13779_T1 (SEQ ID NO:2553). Table 2436 below describes the starting and ending position of this segment on each transcript.

TABLE 2436

| | Segment location on transcripts | |
|---|---|---|
| Transcript name | Segment starting position | Segment ending position |
| F13779_T1 (SEQ ID NO: 2553) | 1495 | 1528 |

This segment can be found in a non-coding region of transcript(s) that are related to the following protein(s): F13779_P1.

Segment cluster F13779 node_35 (SEQ ID NO:2579) according to the present invention is supported by 8 libraries. The number of libraries was determined as previously described. This segment can be found in the following transcript(s): F13779_T1 (SEQ ID NO:2553). Table 2437 below describes the starting and ending position of this segment on each transcript.

TABLE 2437

| | Segment location on transcripts | |
|---|---|---|
| Transcript name | Segment starting position | Segment ending position |
| F13779_T1 (SEQ ID NO: 2553) | 3025 | 3077 |

This segment can be found in a non-coding region of transcript(s) that are related to the following protein(s): F13779_P1.

Segment cluster F13779_node_36 (SEQ ID NO:2580) according to the present invention is supported by 10 libraries. The number of libraries was determined as previously described. This segment can be found in the following transcript(s): F13779_T1 (SEQ ID NO:2553). Table 2438 below describes the starting and ending position of this segment on each transcript.

TABLE 2438

| | Segment location on transcripts | |
|---|---|---|
| Transcript name | Segment starting position | Segment ending position |
| F13779_T1 (SEQ ID NO: 2553) | 3078 | 3186 |

This segment can be found in a non-coding region of transcript(s) that are related to the following protein(s): F13779_P1.

Segment cluster F13779_node_37 (SEQ ID NO:2581) according to the present invention can be found in the following transcript(s): F13779_T1 (SEQ ID NO:2553). Table 2439 below describes the starting and ending position of this segment on each transcript.

TABLE 2439

| | Segment location on transcripts | |
|---|---|---|
| Transcript name | Segment starting position | Segment ending position |
| F13779_T1 (SEQ ID NO: 2553) | 3187 | 3211 |

This segment can be found in a non-coding region of transcript(s) that are related to the following protein(s): F13779_P1.

Segment cluster F13779_node_38 (SEQ ID NO:2582) according to the present invention is supported by 23 libraries. The number of libraries was determined as previously described. This segment can be found in the following transcript(s): F13779_T1 (SEQ ID NO:2553). Table 2440 below describes the starting and ending position of this segment on each transcript.

TABLE 2440

| | Segment location on transcripts | |
|---|---|---|
| Transcript name | Segment starting position | Segment ending position |
| F13779_T1 (SEQ ID NO: 2553) | 3212 | 3279 |

This segment can be found in a non-coding region of transcript(s) that are related to the following protein(s): F13779_P1.

Segment cluster F13779_node_40 (SEQ ID NO:2583) according to the present invention can be found in the following transcript(s): F13779_T1 (SEQ ID NO:2553). Table 2441 below describes the starting and ending position of this segment on each transcript.

TABLE 2441

| | Segment location on transcripts | |
|---|---|---|
| Transcript name | Segment starting position | Segment ending position |
| F13779_T1 (SEQ ID NO: 2553) | 3417 | 3428 |

This segment can be found in a non-coding region of transcript(s) that are related to the following protein(s): F13779_P1.

Segment cluster F13779_node_42 (SEQ ID NO:2584) according to the present invention can be found in the following transcript(s): F13779_T1 (SEQ ID NO:2553). Table 2442 below describes the starting and ending position of this segment on each transcript.

TABLE 2442

| | Segment location on transcripts | |
|---|---|---|
| Transcript name | Segment starting position | Segment ending position |
| F13779_T1 (SEQ ID NO: 2553) | 3551 | 3555 |

This segment can be found in a non-coding region of transcript(s) that are related to the following protein(s): F13779_P1.

Segment cluster F13779_node_43 (SEQ ID NO:2585) according to the present invention is supported by 23 libraries. The number of libraries was determined as previously described. This segment can be found in the following transcript(s): F13779_T1 (SEQ ID NO:2553). Table 2443 below describes the starting and ending position of this segment on each transcript.

TABLE 2443

Segment location on transcripts

| Transcript name | Segment starting position | Segment ending position |
|---|---|---|
| F13779_T1 (SEQ ID NO: 2553) | 3556 | 3582 |

This segment can be found in a non-coding region of transcript(s) that are related to the following protein(s): F13779_P1.

Description for Cluster H79892

Cluster H79892 features 4 transcript(s) and 13 segment(s) of interest, the names for which are given in Tables 2444 and 2445, respectively, the sequences themselves are given at the end of the application. The selected protein variants are given in Table 2446.

TABLE 2444

Transcripts of interest
Transcript Name

H79892_T2 (SEQ ID NO: 2586)
H79892_T3 (SEQ ID NO: 2587)
H79892_T4 (SEQ ID NO: 2588)
H79892_T5 (SEQ ID NO: 2589)

TABLE 2445

Segments of interest
Segment Name

H79892_node_0 (SEQ ID NO: 2590)
H79892_node_4 (SEQ ID NO: 2591)
H79892_node_6 (SEQ ID NO: 2592)
H79892_node_8 (SEQ ID NO: 2593)
H79892_node_9 (SEQ ID NO: 2594)
H79892_node_11 (SEQ ID NO: 2595)
H79892_node_13 (SEQ ID NO: 2596)
H79892_node_14 (SEQ ID NO: 2597)
H79892_node_18 (SEQ ID NO: 2598)
H79892_node_19 (SEQ ID NO: 2599)
H79892_node_2 (SEQ ID NO: 2600)
H79892_node_16 (SEQ ID NO: 2601)
H79892_node_20 (SEQ ID NO: 2602)

TABLE 2446

Proteins of interest

| Protein Name | Corresponding Transcript(s) |
|---|---|
| H79892_P1 | H79892_T2 (SEQ ID NO: 2586) |
| H79892_P2 | H79892_T3 (SEQ ID NO: 2587) |
| H79892_P3 | H79892_T5 (SEQ ID NO: 2589) |

The heart-selective diagnostic marker prediction engine provided the following results with regard to cluster H79892. Predictions were made for selective expression of transcripts of this contig in heart tissue, according to the previously described methods. The numbers on the y-axis of FIG. 65 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 65, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 22.6; the ratio of expression of the cluster in heart specific ESTs to the overall expression of the cluster in muscle-specific ESTs which was found to be 55.5; and fisher exact test P-values were computed both for library and weighted clone counts to check that the counts are statistically significant, and were found to be 5.40E-04.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 22.6, which clearly supports specific expression in heart tissue.

As noted above, cluster H79892 features 13 segment(s), which were listed in Table 2445 above and for which the sequence(s) are given at the end of the application. These segment(s) are portions of nucleic acid sequence(s) which are described herein separately because they are of particular interest. A description of each segment according to the present invention is now provided.

Segment cluster H79892_node_0 (SEQ ID NO:2590) according to the present invention is supported by 5 libraries. The number of libraries was determined as previously described. This segment can be found in the following transcript(s): H79892_T2 (SEQ ID NO:2586), H79892_T3 (SEQ ID NO:2587) and H79892_T5 (SEQ ID NO:2589). Table 2447 below describes the starting and ending position of this segment on each transcript.

TABLE 2447

Segment location on transcripts

| Transcript name | Segment starting position | Segment ending position |
|---|---|---|
| H79892_T2 (SEQ ID NO: 2586) | 1 | 195 |
| H79892_T3 (SEQ ID NO: 2587) | 1 | 195 |
| H79892_T5 (SEQ ID NO: 2589) | 1 | 195 |

This segment can be found in both coding and non-coding regions of transcript(s) as follows. The segment can be found in a non-coding region of transcript(s) that are related to the following protein(s): H79892_P3. This segment can also be found in the following protein(s): H79892_P1 and H79892_P2, since it is in the coding region for the corresponding transcript.

Segment cluster H79892_node_4 (SEQ ID NO:2591) according to the present invention is supported by 7 libraries. The number of libraries was determined as previously described. This segment can be found in the following transcript(s): H79892_T2 (SEQ ID NO:2586) and H79892_T3 (SEQ ID NO:2587). Table 2448 below describes the starting and ending position of this segment on each transcript.

TABLE 2448

Segment location on transcripts

| Transcript name | Segment starting position | Segment ending position |
|---|---|---|
| H79892_T2 (SEQ ID NO: 2586) | 285 | 480 |
| H79892_T3 (SEQ ID NO: 2587) | 285 | 480 |

This segment can be found in the following protein(s): H79892_P1 and H79892_P2.

Segment cluster H79892_node_6 (SEQ ID NO:2592) according to the present invention is supported by 7 libraries. The number of libraries was determined as previously described. This segment can be found in the following transcript(s): H79892_T2 (SEQ ID NO:2586) and H79892_T3 (SEQ ID NO:2587). Table 2449 below describes the starting and ending position of this segment on each transcript.

TABLE 2449

Segment location on transcripts

| Transcript name | Segment starting position | Segment ending position |
|---|---|---|
| H79892_T2 (SEQ ID NO: 2586) | 481 | 620 |
| H79892_T3 (SEQ ID NO: 2587) | 481 | 620 |

This segment can be found in the following protein(s): H79892_P1 and H79892_P2.

Segment cluster H79892_node_8 (SEQ ID NO:2593) according to the present invention is supported by 9 libraries. The number of libraries was determined as previously described. This segment can be found in the following transcript(s): H79892_T2 (SEQ ID NO:2586) and H79892_T3 (SEQ ID NO:2587). Table 2450 below describes the starting and ending position of this segment on each transcript.

TABLE 2450

Segment location on transcripts

| Transcript name | Segment starting position | Segment ending position |
|---|---|---|
| H79892_T2 (SEQ ID NO: 2586) | 621 | 780 |
| H79892_T3 (SEQ ID NO: 2587) | 621 | 780 |

This segment can be found in the following protein(s): H79892_P1 and H79892_P2.

Segment cluster H79892_node_9 (SEQ ID NO:2594) according to the present invention is supported by 1 libraries. The number of libraries was determined as previously described. This segment can be found in the following transcript(s): H79892_T3 (SEQ ID NO:2587). Table 2451 below describes the starting and ending position of this segment on each transcript.

TABLE 2451

Segment location on transcripts

| Transcript name | Segment starting position | Segment ending position |
|---|---|---|
| H79892_T3 (SEQ ID NO: 2587) | 781 | 1107 |

This segment can be found in the following protein(s): H79892_P2.

Segment cluster H79892_node_11 (SEQ ID NO:2595) according to the present invention is supported by 11 libraries. The number of libraries was determined as previously described. This segment can be found in the following transcript(s): H79892_T2 (SEQ ID NO:2586). Table 2452 below describes the starting and ending position of this segment on each transcript.

TABLE 2452

Segment location on transcripts

| Transcript name | Segment starting position | Segment ending position |
|---|---|---|
| H79892_T2 (SEQ ID NO: 2586) | 781 | 917 |

This segment can be found in the following protein(s): H79892_P1.

Segment cluster H79892_node_13 (SEQ ID NO:2596) according to the present invention is supported by 2 libraries. The number of libraries was determined as previously described. This segment can be found in the following transcript(s): H79892_T4 (SEQ ID NO:2588). Table 2453 below describes the starting and ending position of this segment on each transcript.

TABLE 2453

Segment location on transcripts

| Transcript name | Segment starting position | Segment ending position |
|---|---|---|
| H79892_T4 (SEQ ID NO: 2588) | 1 | 547 |

The previously-described transcripts for these segment(s) do not code for protein.

Segment cluster H79892_node_14 (SEQ ID NO:2597) according to the present invention is supported by 13 libraries. The number of libraries was determined as previously described. This segment can be found in the following transcript(s): H79892_T2 (SEQ ID NO:2586), H79892_T4 (SEQ ID NO:2588) and H79892_T5 (SEQ ID NO:2589). Table 2454 below describes the starting and ending position of this segment on each transcript.

TABLE 2454

Segment location on transcripts

| Transcript name | Segment starting position | Segment ending position |
|---|---|---|
| H79892_T2 (SEQ ID NO: 2586) | 918 | 1104 |
| H79892_T4 (SEQ ID NO: 2588) | 548 | 734 |
| H79892_T5 (SEQ ID NO: 2589) | 196 | 382 |

This segment can be found in the following protein(s): H79892_P1 and H79892_P3.

Segment cluster H79892_node_18 (SEQ ID NO:2598) according to the present invention is supported by 3 libraries. The number of libraries was determined as previously described. This segment can be found in the following transcript(s): H79892_T2 (SEQ ID NO:2586) and H79892_T5 (SEQ ID NO:2589). Table 2455 below describes the starting and ending position of this segment on each transcript.

TABLE 2455

| Segment location on transcripts | | |
|---|---|---|
| Transcript name | Segment starting position | Segment ending position |
| H79892_T2 (SEQ ID NO: 2586) | 1149 | 1565 |
| H79892_T5 (SEQ ID NO: 2589) | 427 | 843 |

This segment can be found in a non-coding region of transcript(s) that are related to the following protein(s): H79892_P1 and H79892_P3.

Segment cluster H79892_node_19 (SEQ ID NO:2599) according to the present invention is supported by 3 libraries. The number of libraries was determined as previously described. This segment can be found in the following transcript(s): H79892_T2 (SEQ ID NO:2586) and H79892_T5 (SEQ ID NO:2589). Table 2456 below describes the starting and ending position of this segment on each transcript.

TABLE 2456

| Segment location on transcripts | | |
|---|---|---|
| Transcript name | Segment starting position | Segment ending position |
| H79892_T2 (SEQ ID NO: 2586) | 1566 | 1689 |
| H79892_T5 (SEQ ID NO: 2589) | 844 | 967 |

This segment can be found in a non-coding region of transcript(s) that are related to the following protein(s): H79892_P1 and H79892_P3.

According to an optional embodiment of the present invention, short segments related to the above cluster are also provided. These segments are up to about 120 bp in length, and so are included in a separate description.

Segment cluster H79892_node_2 (SEQ ID NO:2600) according to the present invention is supported by 6 libraries. The number of libraries was determined as previously described. This segment can be found in the following transcript(s): H79892_T2 (SEQ ID NO:2586) and H79892_T3 (SEQ ID NO:2587). Table 2457 below describes the starting and ending position of this segment on each transcript.

TABLE 2457

| Segment location on transcripts | | |
|---|---|---|
| Transcript name | Segment starting position | Segment ending position |
| H79892_T2 (SEQ ID NO: 2586) | 196 | 284 |
| H79892_T3 (SEQ ID NO: 2587) | 196 | 284 |

This segment can be found in the following protein(s): H79892_P1 and H79892_P2.

Segment cluster H79892_node_16 (SEQ ID NO:2601) according to the present invention is supported by 10 libraries. The number of libraries was determined as previously described. This segment can be found in the following transcript(s): H79892_T2 (SEQ ID NO:2586), H79892_T4 (SEQ ID NO:2588) and H79892_T5 (SEQ ID NO:2589). Table 2458 below describes the starting and ending position of this segment on each transcript.

TABLE 2458

| Segment location on transcripts | | |
|---|---|---|
| Transcript name | Segment starting position | Segment ending position |
| H79892_T2 (SEQ ID NO: 2586) | 1105 | 1148 |
| H79892_T4 (SEQ ID NO: 2588) | 735 | 778 |
| H79892_T5 (SEQ ID NO: 2589) | 383 | 426 |

This segment can be found in the following protein(s): H79892_P1 and H79892_P3.

Segment cluster H79892_node_20 (SEQ ID NO:2602) according to the present invention is supported by 9 libraries. The number of libraries was determined as previously described. This segment can be found in the following transcript(s): H79892_T2 (SEQ ID NO:2586), H79892_T4 (SEQ ID NO:2588) and H79892_T5 (SEQ ID NO:2589). Table 2459 below describes the starting and ending position of this segment on each transcript.

TABLE 2459

| Segment location on transcripts | | |
|---|---|---|
| Transcript name | Segment starting position | Segment ending position |
| H79892_T2 (SEQ ID NO: 2586) | 1690 | 1790 |
| H79892_T4 (SEQ ID NO: 2588) | 779 | 879 |
| H79892_T5 (SEQ ID NO: 2589) | 968 | 1068 |

This segment can be found in a non-coding region of transcript(s) that are related to the following protein(s): H79892_P1 and H79892_P3.

Description for Cluster HSAE2

Cluster HSAE2 features 13 transcript(s) and 58 segment(s) of interest, the names for which are given in Tables 2460 and 2461, respectively, the sequences themselves are given at the end of the application. The selected protein variants are given in Table 2462.

TABLE 2460

| Transcripts of interest Transcript Name |
|---|
| HSAE2_T1 (SEQ ID NO: 2603) |
| HSAE2_T4 (SEQ ID NO: 2604) |
| HSAE2_T7 (SEQ ID NO: 2605) |
| HSAE2_T8 (SEQ ID NO: 2606) |
| HSAE2_T10 (SEQ ID NO: 2607) |
| HSAE2_T11 (SEQ ID NO: 2608) |
| HSAE2_T18 (SEQ ID NO: 2609) |
| HSAE2_T23 (SEQ ID NO: 2610) |
| HSAE2_T29 (SEQ ID NO: 2611) |
| HSAE2_T32 (SEQ ID NO: 2612) |
| HSAE2_T34 (SEQ ID NO: 2613) |
| HSAE2_T47 (SEQ ID NO: 2614) |
| HSAE2_T48 (SEQ ID NO: 2615) |

TABLE 2461

| Segments of interest Segment Name |
|---|
| HSAE2_node_0 (SEQ ID NO: 2616) |
| HSAE2_node_2 (SEQ ID NO: 2617) |
| HSAE2_node_9 (SEQ ID NO: 2618) |

TABLE 2461-continued

Segments of interest
Segment Name

HSAE2_node_12 (SEQ ID NO: 2619)
HSAE2_node_13 (SEQ ID NO: 2620)
HSAE2_node_14 (SEQ ID NO: 2621)
HSAE2_node_17 (SEQ ID NO: 2622)
HSAE2_node_22 (SEQ ID NO: 2623)
HSAE2_node_23 (SEQ ID NO: 2624)
HSAE2_node_26 (SEQ ID NO: 2625)
HSAE2_node_28 (SEQ ID NO: 2626)
HSAE2_node_29 (SEQ ID NO: 2627)
HSAE2_node_34 (SEQ ID NO: 2628)
HSAE2_node_36 (SEQ ID NO: 2629)
HSAE2_node_42 (SEQ ID NO: 2630)
HSAE2_node_43 (SEQ ID NO: 2631)
HSAE2_node_54 (SEQ ID NO: 2632)
HSAE2_node_59 (SEQ ID NO: 2633)
HSAE2_node_64 (SEQ ID NO: 2634)
HSAE2_node_71 (SEQ ID NO: 2635)
HSAE2_node_72 (SEQ ID NO: 2636)
HSAE2_node_73 (SEQ ID NO: 2637)
HSAE2_node_74 (SEQ ID NO: 2638)
HSAE2_node_76 (SEQ ID NO: 2639)
HSAE2_node_77 (SEQ ID NO: 2640)
HSAE2_node_82 (SEQ ID NO: 2641)
HSAE2_node_6 (SEQ ID NO: 2642)
HSAE2_node_8 (SEQ ID NO: 2643)
HSAE2_node_11 (SEQ ID NO: 2644)
HSAE2_node_15 (SEQ ID NO: 2645)
HSAE2_node_16 (SEQ ID NO: 2646)
HSAE2_node_18 (SEQ ID NO: 2647)
HSAE2_node_19 (SEQ ID NO: 2648)
HSAE2_node_20 (SEQ ID NO: 2649)
HSAE2_node_24 (SEQ ID NO: 2650)
HSAE2_node_38 (SEQ ID NO: 2651)
HSAE2_node_40 (SEQ ID NO: 2652)
HSAE2_node_41 (SEQ ID NO: 2653)
HSAE2_node_44 (SEQ ID NO: 2654)
HSAE2_node_45 (SEQ ID NO: 2655)
HSAE2_node_46 (SEQ ID NO: 2656)
HSAE2_node_48 (SEQ ID NO: 2657)
HSAE2_node_49 (SEQ ID NO: 2658)
HSAE2_node_50 (SEQ ID NO: 2659)
HSAE2_node_51 (SEQ ID NO: 2660)
HSAE2_node_56 (SEQ ID NO: 2661)
HSAE2_node_57 (SEQ ID NO: 2662)
HSAE2_node_58 (SEQ ID NO: 2663)
HSAE2_node_65 (SEQ ID NO: 2664)
HSAE2_node_66 (SEQ ID NO: 2665)
HSAE2_node_67 (SEQ ID NO: 2666)
HSAE2_node_69 (SEQ ID NO: 2667)
HSAE2_node_70 (SEQ ID NO: 2668)
HSAE2_node_78 (SEQ ID NO: 2669)
HSAE2_node_79 (SEQ ID NO: 2670)
HSAE2_node_80 (SEQ ID NO: 2671)
HSAE2_node_81 (SEQ ID NO: 2672)
HSAE2_node_83 (SEQ ID NO: 2673)

TABLE 2462

Proteins of interest

| Protein Name | Corresponding Transcript(s) |
|---|---|
| HSAE2_P2 | HSAE2_T1 (SEQ ID NO: 2603) |
| HSAE2_P3 | HSAE2_T7 (SEQ ID NO: 2605); HSAE2_T10 (SEQ ID NO: 2607) |
| HSAE2_P5 | HSAE2_T8 (SEQ ID NO: 2606) |
| HSAE2_P7 | HSAE2_T11 (SEQ ID NO: 2608) |
| HSAE2_P13 | HSAE2_T18 (SEQ ID NO: 2609) |
| HSAE2_P15 | HSAE2_T32 (SEQ ID NO: 2612) |
| HSAE2_P18 | HSAE2_T23 (SEQ ID NO: 2610) |
| HSAE2_P23 | HSAE2_T29 (SEQ ID NO: 2611) |
| HSAE2_P26 | HSAE2_T34 (SEQ ID NO: 2613) |
| HSAE2_P37 | HSAE2_T47 (SEQ ID NO: 2614) |

TABLE 2462-continued

Proteins of interest

| Protein Name | Corresponding Transcript(s) |
|---|---|
| HSAE2_P38 | HSAE2_T48 (SEQ ID NO: 2615) |
| HSAE2_P41 | HSAE2_T4 (SEQ ID NO: 2604) |

These sequences are variants of the known protein Anion exchange protein 2 (SwissProt accession identifier B3A2_HUMAN; known also according to the synonyms Non-erythroid band 3-like protein; BND3L), referred to herein as the previously known protein.

Protein Anion exchange protein 2 is known or believed to have the following function(s): Plasma membrane anion exchange protein of wide distribution. The sequence for protein Anion exchange protein 2 is given at the end of the application, as "Anion exchange protein 2 amino acid sequence". Known polymorphisms for this sequence are as shown in Table 2463.

TABLE 2463

Amino acid mutations for Known Protein

| SNP position(s) on amino acid sequence | Comment |
|---|---|
| 68 | E -> M |
| 74 | H -> R |
| 92 | D -> G |
| 122 | E -> V |
| 157 | Q -> R |
| 248 | E -> R |
| 399 | Missing |
| 447 | L -> V |
| 450-475 | LLGHHHGQGAESDPHVTEPLMGGVPE -> CWGITMVRGLR VTPTSPSLSWEVFLR |
| 485-486 | EL -> DV |
| 666-681 | AAGAAEDDPLRRTGRP -> RQGQLKMIPSADGAA |
| 824 | Q -> R |
| 902 | L -> P |

Protein Anion exchange protein 2 localization is believed to be Integral membrane protein.

The following GO Annotation(s) apply to the previously known protein. The following annotation(s) were found: anion transport, which are annotation(s) related to Biological Process; inorganic anion exchanger; anion transporter; antiporter, which are annotation(s) related to Molecular Function; and membrane fraction; membrane; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSAE2 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 66 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 66 and Table 2464. This cluster is overexpressed (at least at a minimum level) in the following pathological conditions: brain malignant tumors, a mixture of malignant tumors from different tissues and prostate cancer.

TABLE 2464

Normal tissue distribution

| Name of Tissue | Number |
|---|---|
| adrenal | 40 |
| bladder | 41 |
| bone | 71 |
| brain | 30 |
| colon | 69 |
| epithelial | 57 |
| general | 45 |
| head and neck | 0 |
| kidney | 22 |
| liver | 0 |
| lung | 44 |
| lymph nodes | 47 |
| breast | 30 |
| bone marrow | 0 |
| muscle | 5 |
| Ovary | 189 |
| pancreas | 30 |
| prostate | 0 |
| Skin | 69 |
| stomach | 36 |
| Thyroid | 0 |
| Uterus | 95 |

TABLE 2465

P values and ratios for expression in cancerous tissue

| Name of Tissue | P1 | P2 | SP1 | R3 | SP2 | R4 |
|---|---|---|---|---|---|---|
| adrenal | 6.4e−01 | 6.9e−01 | 7.1e−01 | 1.1 | 7.8e−01 | 0.9 |
| bladder | 7.6e−01 | 8.1e−01 | 6.0e−01 | 1.3 | 7.6e−01 | 1.0 |
| Bone | 3.0e−02 | 4.3e−01 | 2.6e−02 | 2.7 | 3.2e−01 | 1.3 |
| Brain | 2.2e−02 | 1.6e−02 | 8.2e−04 | 3.3 | 1.7e−14 | 3.0 |
| Colon | 5.1e−01 | 4.6e−01 | 9.1e−01 | 0.7 | 3.0e−01 | 0.8 |
| epithelial | 4.8e−01 | 8.1e−01 | 3.6e−01 | 1.0 | 3.2e−05 | 1.9 |
| general | 5.0e−02 | 2.2e−03 | 1.4e−04 | 1.7 | 5.9e−20 | 2.5 |
| head and neck | 4.3e−01 | 2.8e−01 | 1 | 1.0 | 4.2e−01 | 1.7 |
| kidney | 5.5e−01 | 3.3e−01 | 2.1e−01 | 2.3 | 8.5e−02 | 2.6 |
| Liver | 1.8e−01 | 1.3e−01 | 2.3e−01 | 4.3 | 4.8e−01 | 2.0 |
| Lung | 5.6e−01 | 4.0e−01 | 6.0e−01 | 1.1 | 2.6e−01 | 1.4 |
| Lymph nodes | 6.9e−01 | 8.2e−01 | 6.3e−01 | 1.0 | 9.2e−01 | 0.5 |
| Breast | 7.1e−01 | 4.1e−01 | 3.3e−01 | 1.4 | 1.3e−02 | 2.0 |
| bone marrow | 1 | 6.7e−01 | 1 | 1.0 | 1.5e−01 | 2.8 |
| muscle | 9.2e−01 | 4.8e−01 | 1 | 0.8 | 3.9e−01 | 2.0 |
| Ovary | 8.1e−01 | 8.3e−01 | 9.8e−01 | 0.4 | 9.9e−01 | 0.4 |
| pancreas | 5.9e−01 | 4.7e−01 | 7.0e−01 | 0.9 | 4.4e−03 | 1.6 |
| prostate | 2.3e−01 | 1.6e−01 | 1.9e−02 | 4.5 | 1.3e−03 | 5.4 |
| Skin | 6.9e−01 | 2.9e−01 | 1 | 0.2 | 1.2e−01 | 1.3 |
| stomach | 5.0e−01 | 1.6e−01 | 7.5e−01 | 1.0 | 3.7e−01 | 1.6 |
| Thyroid | 2.9e−01 | 2.9e−01 | 1 | 1.1 | 1 | 1.1 |
| Uterus | 6.5e−01 | 6.0e−01 | 7.0e−01 | 0.7 | 5.9e−01 | 0.9 |

As noted above, cluster HSAE2 features 58 segment(s), which were listed in Table 2461 above and for which the sequence(s) are given at the end of the application. These segment(s) are portions of nucleic acid sequence(s) which are described herein separately because they are of particular interest. A description of each segment according to the present invention is now provided.

Segment cluster HSAE2_node_0 (SEQ ID NO:2616) according to the present invention is supported by 18 libraries. The number of libraries was determined as previously described. This segment can be found in the following transcript(s): HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2466 below describes the starting and ending position of this segment on each transcript.

TABLE 2466

Segment location on transcripts

| Transcript name | Segment starting position | Segment ending position |
|---|---|---|
| HSAE2_T8 (SEQ ID NO: 2606) | 1 | 164 |
| HSAE2_T11 (SEQ ID NO: 2608) | 1 | 164 |
| HSAE2_T18 (SEQ ID NO: 2609) | 1 | 164 |
| HSAE2_T23 (SEQ ID NO: 2610) | 1 | 164 |
| HSAE2_T29 (SEQ ID NO: 2611) | 1 | 164 |
| HSAE2_T32 (SEQ ID NO: 2612) | 1 | 164 |
| HSAE2_T34 (SEQ ID NO: 2613) | 1 | 164 |
| HSAE2_T47 (SEQ ID NO: 2614) | 1 | 164 |
| HSAE2_T48 (SEQ ID NO: 2615) | 1 | 164 |

This segment can be found in a non-coding region of transcript(s) that are related to the following protein(s): HSAE2_P5, HSAE2_P7, HSAE2_P13, HSAE2_P18, HSAE2_P23, HSAE2_P15, HSAE2_P26, HSAE2_P37 and HSAE2_P38.

Segment cluster HSAE2_node_2 (SEQ ID NO:2617) according to the present invention is supported by 3 libraries. The number of libraries was determined as previously described. This segment can be found in the following transcript(s): HSAE2_T4 (SEQ ID NO:2604). Table 2467 below describes the starting and ending position of this segment on each transcript.

TABLE 2467

Segment location on transcripts

| Transcript name | Segment starting position | Segment ending position |
|---|---|---|
| HSAE2_T4 (SEQ ID NO: 2604) | 1 | 271 |

This segment can be found in a non-coding region of transcript(s) that are related to the following protein(s): HSAE2_P41.

Segment cluster HSAE2_node_9 (SEQ ID NO:2618) according to the present invention is supported by 3 libraries. The number of libraries was determined as previously described. This segment can be found in the following transcript(s): HSAE2_T1 (SEQ ID NO:2603). Table 2468 below describes the starting and ending position of this segment on each transcript.

TABLE 2468

Segment location on transcripts

| Transcript name | Segment starting position | Segment ending position |
|---|---|---|
| HSAE2_T1 (SEQ ID NO: 2603) | 48 | 573 |

This segment can be found in the following protein(s): HSAE2_P2.

Segment cluster HSAE2_node__12 (SEQ ID NO:2619) according to the present invention is supported by 1 libraries. The number of libraries was determined as previously described. This segment can be found in the following transcript(s): HSAE2_T7 (SEQ ID NO:2605). Table 2469 below describes the starting and ending position of this segment on each transcript.

TABLE 2469

Segment location on transcripts

| Transcript name | Segment starting position | Segment ending position |
|---|---|---|
| HSAE2_T7 (SEQ ID NO: 2605) | 106 | 455 |

This segment can be found in a non-coding region of transcript(s) that are related to the following protein(s): HSAE2_P3.

Segment cluster HSAE2_node__13 (SEQ ID NO:2620) according to the present invention is supported by 32 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2470 below describes the starting and ending position of this segment on each transcript.

TABLE 2470

Segment location on transcripts

| Transcript name | Segment starting position | Segment ending position |
|---|---|---|
| HSAE2_T1 (SEQ ID NO: 2603) | 574 | 739 |
| HSAE2_T4 (SEQ ID NO: 2604) | 386 | 551 |
| HSAE2_T7 (SEQ ID NO: 2605) | 456 | 621 |
| HSAE2_T8 (SEQ ID NO: 2606) | 279 | 444 |
| HSAE2_T11 (SEQ ID NO: 2608) | 279 | 444 |
| HSAE2_T18 (SEQ ID NO: 2609) | 279 | 444 |
| HSAE2_T23 (SEQ ID NO: 2610) | 279 | 444 |
| HSAE2_T29 (SEQ ID NO: 2611) | 279 | 444 |
| HSAE2_T32 (SEQ ID NO: 2612) | 279 | 444 |
| HSAE2_T34 (SEQ ID NO: 2613) | 279 | 444 |
| HSAE2_T47 (SEQ ID NO: 2614) | 279 | 444 |
| HSAE2_T48 (SEQ ID NO: 2615) | 279 | 444 |

This segment can be found in both coding and non-coding regions of transcript(s) as follows. The segment can be found in a non-coding region of transcript(s) that are related to the following protein(s): HSAE2_P3, HSAE2_P5, HSAE2_P7 and HSAE2_P38. This segment can also be found in the following protein(s): HSAE2_P2, HSAE2_P41, HSAE2_P13, HSAE2_P18, HSAE2_P23, HSAE2_P15, HSAE2_P26 and HSAE2_P37, since it is in the coding region for the corresponding transcript.

Segment cluster HSAE2_node__14 (SEQ ID NO:2621) according to the present invention is supported by 1 libraries. The number of libraries was determined as previously described. This segment can be found in the following transcript(s): HSAE2_T8 (SEQ ID NO:2606). Table 2471 below describes the starting and ending position of this segment on each transcript.

TABLE 2471

Segment location on transcripts

| Transcript name | Segment starting position | Segment ending position |
|---|---|---|
| HSAE2_T8 (SEQ ID NO: 2606) | 445 | 602 |

This segment can be found in the following protein(s): HSAE2_P5.

Segment cluster HSAE2_node__17 (SEQ ID NO:2622) according to the present invention is supported by 35 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2472 below describes the starting and ending position of this segment on each transcript.

TABLE 2472

Segment location on transcripts

| Transcript name | Segment starting position | Segment ending position |
|---|---|---|
| HSAE2_T1 (SEQ ID NO: 2603) | 818 | 981 |
| HSAE2_T4 (SEQ ID NO: 2604) | 630 | 793 |
| HSAE2_T7 (SEQ ID NO: 2605) | 700 | 863 |
| HSAE2_T8 (SEQ ID NO: 2606) | 681 | 844 |
| HSAE2_T11 (SEQ ID NO: 2608) | 523 | 686 |
| HSAE2_T18 (SEQ ID NO: 2609) | 523 | 686 |
| HSAE2_T23 (SEQ ID NO: 2610) | 523 | 686 |
| HSAE2_T29 (SEQ ID NO: 2611) | 523 | 686 |
| HSAE2_T32 (SEQ ID NO: 2612) | 523 | 686 |
| HSAE2_T34 (SEQ ID NO: 2613) | 523 | 686 |
| HSAE2_T47 (SEQ ID NO: 2614) | 523 | 686 |
| HSAE2_T48 (SEQ ID NO: 2615) | 523 | 686 |

This segment can be found in both coding and non-coding regions of transcript(s) as follows. The segment can be found in a non-coding region of transcript(s) that are related to the following protein(s): HSAE2_P3, HSAE2_P7 and HSAE2_P38. This segment can also be found in the following protein(s): HSAE2_P2, HSAE2_P41, HSAE2_P5, HSAE2_P13, HSAE2_P18, HSAE2_P23, HSAE2_P15, HSAE2_P26 and HSAE2_P37, since it is in the coding region for the corresponding transcript.

Segment cluster HSAE2_node__22 (SEQ ID NO:2623) according to the present invention is supported by 2 libraries. The number of libraries was determined as previously described. This segment can be found in the following transcript(s): HSAE2_T10 (SEQ ID NO:2607). Table 2473 below describes the starting and ending position of this segment on each transcript.

TABLE 2473

Segment location on transcripts

| Transcript name | Segment starting position | Segment ending position |
|---|---|---|
| HSAE2_T10 (SEQ ID NO: 2607) | 1 | 601 |

This segment can be found in a non-coding region of transcript(s) that are related to the following protein(s): HSAE2_P3.

Segment cluster HSAE2_node_23 (SEQ ID NO:2624) according to the present invention is supported by 34 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2474 below describes the starting and ending position of this segment on each transcript.

TABLE 2474

| | Segment location on transcripts | |
|---|---|---|
| Transcript name | Segment starting position | Segment ending position |
| HSAE2_T1 (SEQ ID NO: 2603) | 1101 | 1308 |
| HSAE2_T4 (SEQ ID NO: 2604) | 913 | 1120 |
| HSAE2_T7 (SEQ ID NO: 2605) | 983 | 1190 |
| HSAE2_T8 (SEQ ID NO: 2606) | 964 | 1171 |
| HSAE2_T10 (SEQ ID NO: 2607) | 602 | 809 |
| HSAE2_T11 (SEQ ID NO: 2608) | 806 | 1013 |
| HSAE2_T18 (SEQ ID NO: 2609) | 806 | 1013 |
| HSAE2_T23 (SEQ ID NO: 2610) | 806 | 1013 |
| HSAE2_T29 (SEQ ID NO: 2611) | 806 | 1013 |
| HSAE2_T32 (SEQ ID NO: 2612) | 806 | 1013 |
| HSAE2_T34 (SEQ ID NO: 2613) | 806 | 1013 |
| HSAE2_T47 (SEQ ID NO: 2614) | 806 | 1013 |
| HSAE2_T48 (SEQ ID NO: 2615) | 886 | 1093 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_26 (SEQ ID NO:2625) according to the present invention is supported by 45 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2475 below describes the starting and ending position of this segment on each transcript.

TABLE 2475

| | Segment location on transcripts | |
|---|---|---|
| Transcript name | Segment starting position | Segment ending position |
| HSAE2_T1 (SEQ ID NO: 2603) | 1346 | 1488 |
| HSAE2_T4 (SEQ ID NO: 2604) | 1158 | 1300 |
| HSAE2_T7 (SEQ ID NO: 2605) | 1228 | 1370 |
| HSAE2_T8 (SEQ ID NO: 2606) | 1209 | 1351 |
| HSAE2_T10 (SEQ ID NO: 2607) | 847 | 989 |
| HSAE2_T11 (SEQ ID NO: 2608) | 1051 | 1193 |
| HSAE2_T18 (SEQ ID NO: 2609) | 1051 | 1193 |
| HSAE2_T23 (SEQ ID NO: 2610) | 1051 | 1193 |
| HSAE2_T29 (SEQ ID NO: 2611) | 1051 | 1193 |
| HSAE2_T32 (SEQ ID NO: 2612) | 1051 | 1193 |
| HSAE2_T34 (SEQ ID NO: 2613) | 1051 | 1193 |
| HSAE2_T47 (SEQ ID NO: 2614) | 1051 | 1193 |
| HSAE2_T48 (SEQ ID NO: 2615) | 1131 | 1273 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_28 (SEQ ID NO:2626) according to the present invention is supported by 41 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2476 below describes the starting and ending position of this segment on each transcript.

TABLE 2476

| | Segment location on transcripts | |
|---|---|---|
| Transcript name | Segment starting position | Segment ending position |
| HSAE2_T1 (SEQ ID NO: 2603) | 1489 | 1669 |
| HSAE2_T4 (SEQ ID NO: 2604) | 1301 | 1481 |
| HSAE2_T7 (SEQ ID NO: 2605) | 1371 | 1551 |
| HSAE2_T8 (SEQ ID NO: 2606) | 1352 | 1532 |
| HSAE2_T10 (SEQ ID NO: 2607) | 990 | 1170 |
| HSAE2_T11 (SEQ ID NO: 2608) | 1194 | 1374 |
| HSAE2_T18 (SEQ ID NO: 2609) | 1194 | 1374 |
| HSAE2_T23 (SEQ ID NO: 2610) | 1194 | 1374 |
| HSAE2_T29 (SEQ ID NO: 2611) | 1194 | 1374 |
| HSAE2_T32 (SEQ ID NO: 2612) | 1194 | 1374 |
| HSAE2_T34 (SEQ ID NO: 2613) | 1194 | 1374 |
| HSAE2_T47 (SEQ ID NO: 2614) | 1194 | 1374 |
| HSAE2_T48 (SEQ ID NO: 2615) | 1274 | 1454 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_29 (SEQ ID NO:2627) according to the present invention is supported by 4 libraries. The number of libraries was determined as previously described. This segment can be found in the following transcript(s): HSAE2_T47 (SEQ ID NO:2614) and HSAE2_T48 (SEQ ID NO:2615). Table 2477 below describes the starting and ending position of this segment on each transcript.

TABLE 2477

| Segment location on transcripts | | |
|---|---|---|
| Transcript name | Segment starting position | Segment ending position |
| HSAE2_T47 (SEQ ID NO: 2614) | 1375 | 2016 |
| HSAE2_T48 (SEQ ID NO: 2615) | 1455 | 2096 |

This segment can be found in the following protein(s): HSAE2_P37 and HSAE2_P38.

Segment cluster HSAE2_node_34 (SEQ ID NO:2628) according to the present invention is supported by 45 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2478 below describes the starting and ending position of this segment on each transcript.

TABLE 2478

| Segment location on transcripts | | |
|---|---|---|
| Transcript name | Segment starting position | Segment ending position |
| HSAE2_T1 (SEQ ID NO: 2603) | 1670 | 1805 |
| HSAE2_T4 (SEQ ID NO: 2604) | 1482 | 1617 |
| HSAE2_T7 (SEQ ID NO: 2605) | 1552 | 1687 |
| HSAE2_T8 (SEQ ID NO: 2606) | 1533 | 1668 |
| HSAE2_T10 (SEQ ID NO: 2607) | 1171 | 1306 |
| HSAE2_T11 (SEQ ID NO: 2608) | 1375 | 1510 |
| HSAE2_T18 (SEQ ID NO: 2609) | 1375 | 1510 |
| HSAE2_T23 (SEQ ID NO: 2610) | 1375 | 1510 |
| HSAE2_T29 (SEQ ID NO: 2611) | 1375 | 1510 |
| HSAE2_T32 (SEQ ID NO: 2612) | 1375 | 1510 |
| HSAE2_T34 (SEQ ID NO: 2613) | 1375 | 1510 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15 and HSAE2_P26, since it is in the coding region for the corresponding transcript.

Segment cluster HSAE2_node_36 (SEQ ID NO:2629) according to the present invention is supported by 51 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2479 below describes the starting and ending position of this segment on each transcript.

TABLE 2479

| Segment location on transcripts | | |
|---|---|---|
| Transcript name | Segment starting position | Segment ending position |
| HSAE2_T1 (SEQ ID NO: 2603) | 1806 | 1971 |
| HSAE2_T4 (SEQ ID NO: 2604) | 1618 | 1783 |
| HSAE2_T7 (SEQ ID NO: 2605) | 1688 | 1853 |
| HSAE2_T8 (SEQ ID NO: 2606) | 1669 | 1834 |
| HSAE2_T10 (SEQ ID NO: 2607) | 1307 | 1472 |
| HSAE2_T11 (SEQ ID NO: 2608) | 1511 | 1676 |
| HSAE2_T18 (SEQ ID NO: 2609) | 1511 | 1676 |
| HSAE2_T23 (SEQ ID NO: 2610) | 1511 | 1676 |
| HSAE2_T29 (SEQ ID NO: 2611) | 1511 | 1676 |
| HSAE2_T32 (SEQ ID NO: 2612) | 1511 | 1676 |
| HSAE2_T34 (SEQ ID NO: 2613) | 1511 | 1676 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15 and HSAE2_P26, since it is in the coding region for the corresponding transcript.

Segment cluster HSAE2_node_42 (SEQ ID NO:2630) according to the present invention is supported by 6 libraries. The number of libraries was determined as previously described. This segment can be found in the following transcript(s): HSAE2_T11 (SEQ ID NO:2608) and HSAE2_T18 (SEQ ID NO:2609). Table 2480 below describes the starting and ending position of this segment on each transcript.

TABLE 2480

| Segment location on transcripts | | |
|---|---|---|
| Transcript name | Segment starting position | Segment ending position |
| HSAE2_T11 (SEQ ID NO: 2608) | 1977 | 2136 |
| HSAE2_T18 (SEQ ID NO: 2609) | 1977 | 2136 |

This segment can be found in the following protein(s): HSAE2_P7 and HSAE2_P13.

Segment cluster HSAE2_node_43 (SEQ ID NO:2631) according to the present invention is supported by 64 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2481 below describes the starting and ending position of this segment on each transcript.

TABLE 2481

Segment location on transcripts

| Transcript name | Segment starting position | Segment ending position |
|---|---|---|
| HSAE2_T1 (SEQ ID NO: 2603) | 2272 | 2421 |
| HSAE2_T4 (SEQ ID NO: 2604) | 2084 | 2233 |
| HSAE2_T7 (SEQ ID NO: 2605) | 2154 | 2303 |
| HSAE2_T8 (SEQ ID NO: 2606) | 2135 | 2284 |
| HSAE2_T10 (SEQ ID NO: 2607) | 1773 | 1922 |
| HSAE2_T11 (SEQ ID NO: 2608) | 2137 | 2286 |
| HSAE2_T18 (SEQ ID NO: 2609) | 2137 | 2286 |
| HSAE2_T23 (SEQ ID NO: 2610) | 1977 | 2126 |
| HSAE2_T29 (SEQ ID NO: 2611) | 1977 | 2126 |
| HSAE2_T32 (SEQ ID NO: 2612) | 1977 | 2126 |
| HSAE2_T34 (SEQ ID NO: 2613) | 1977 | 2126 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_54 (SEQ ID NO:2632) according to the present invention is supported by 65 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2482 below describes the starting and ending position of this segment on each transcript.

TABLE 2482

Segment location on transcripts

| Transcript name | Segment starting position | Segment ending position |
|---|---|---|
| HSAE2_T1 (SEQ ID NO: 2603) | 2714 | 2862 |
| HSAE2_T4 (SEQ ID NO: 2604) | 2526 | 2674 |
| HSAE2_T7 (SEQ ID NO: 2605) | 2596 | 2744 |
| HSAE2_T8 (SEQ ID NO: 2606) | 2577 | 2725 |
| HSAE2_T10 (SEQ ID NO: 2607) | 2215 | 2363 |
| HSAE2_T11 (SEQ ID NO: 2608) | 2579 | 2727 |
| HSAE2_T18 (SEQ ID NO: 2609) | 2568 | 2716 |
| HSAE2_T23 (SEQ ID NO: 2610) | 2419 | 2567 |
| HSAE2_T29 (SEQ ID NO: 2611) | 2419 | 2567 |
| HSAE2_T32 (SEQ ID NO: 2612) | 2419 | 2567 |
| HSAE2_T34 (SEQ ID NO: 2613) | 2419 | 2567 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_59 (SEQ ID NO:2633) according to the present invention is supported by 80 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2483 below describes the starting and ending position of this segment on each transcript.

TABLE 2483

Segment location on transcripts

| Transcript name | Segment starting position | Segment ending position |
|---|---|---|
| HSAE2_T1 (SEQ ID NO: 2603) | 2938 | 3057 |
| HSAE2_T4 (SEQ ID NO: 2604) | 2750 | 2869 |
| HSAE2_T7 (SEQ ID NO: 2605) | 2820 | 2939 |
| HSAE2_T8 (SEQ ID NO: 2606) | 2801 | 2920 |
| HSAE2_T10 (SEQ ID NO: 2607) | 2439 | 2558 |
| HSAE2_T11 (SEQ ID NO: 2608) | 2803 | 2922 |
| HSAE2_T18 (SEQ ID NO: 2609) | 2792 | 2911 |
| HSAE2_T23 (SEQ ID NO: 2610) | 2643 | 2762 |
| HSAE2_T29 (SEQ ID NO: 2611) | 2643 | 2762 |
| HSAE2_T32 (SEQ ID NO: 2612) | 2643 | 2762 |
| HSAE2_T34 (SEQ ID NO: 2613) | 2643 | 2762 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_64 (SEQ ID NO:2634) according to the present invention is supported by 104 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2484 below describes the starting and ending position of this segment on each transcript.

TABLE 2484

Segment location on transcripts

| Transcript name | Segment starting position | Segment ending position |
|---|---|---|
| HSAE2_T1 (SEQ ID NO: 2603) | 3058 | 3225 |
| HSAE2_T4 (SEQ ID NO: 2604) | 2870 | 3037 |
| HSAE2_T7 (SEQ ID NO: 2605) | 2940 | 3107 |
| HSAE2_T8 (SEQ ID NO: 2606) | 2921 | 3088 |
| HSAE2_T10 (SEQ ID NO: 2607) | 2559 | 2726 |
| HSAE2_T11 (SEQ ID NO: 2608) | 2923 | 3090 |
| HSAE2_T18 (SEQ ID NO: 2609) | 2912 | 3079 |
| HSAE2_T23 (SEQ ID NO: 2610) | 2763 | 2930 |
| HSAE2_T29 (SEQ ID NO: 2611) | 2763 | 2930 |
| HSAE2_T32 (SEQ ID NO: 2612) | 2763 | 2930 |
| HSAE2_T34 (SEQ ID NO: 2613) | 2763 | 2930 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_71 (SEQ ID NO:2635) according to the present invention is supported by 4 libraries. The number of libraries was determined as previously described. This segment can be found in the following transcript(s): HSAE2_T23 (SEQ ID NO:2610) and HSAE2_T32 (SEQ ID NO:2612). Table 2485 below describes the starting and ending position of this segment on each transcript.

TABLE 2485

Segment location on transcripts

| Transcript name | Segment starting position | Segment ending position |
|---|---|---|
| HSAE2_T23 (SEQ ID NO: 2610) | 3275 | 3412 |
| HSAE2_T32 (SEQ ID NO: 2612) | 3380 | 3517 |

This segment can be found in both coding and non-coding regions of transcript(s) as follows. The segment can be found in a non-coding region of transcript(s) that are related to the following protein(s): HSAE2_P15. This segment can also be found in the following protein(s): HSAE2_P18, since it is in the coding region for the corresponding transcript.

Segment cluster HSAE2_node_72 (SEQ ID NO:2636) according to the present invention is supported by 6 libraries. The number of libraries was determined as previously described. This segment can be found in the following transcript(s): HSAE2_T23 (SEQ ID NO:2610) and HSAE2_T32 (SEQ ID NO:2612). Table 2486 below describes the starting and ending position of this segment on each transcript.

TABLE 2486

Segment location on transcripts

| Transcript name | Segment starting position | Segment ending position |
|---|---|---|
| HSAE2_T23 (SEQ ID NO: 2610) | 3413 | 3687 |
| HSAE2_T32 (SEQ ID NO: 2612) | 3518 | 3792 |

This segment can be found in a non-coding region of transcript(s) that are related to the following protein(s): HSAE2_P18 and HSAE2_P15.

Segment cluster HSAE2_node_73 (SEQ ID NO:2637) according to the present invention is supported by 120 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T1 8 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2487 below describes the starting and ending position of this segment on each transcript.

TABLE 2487

Segment location on transcripts

| Transcript name | Segment starting position | Segment ending position |
|---|---|---|
| HSAE2_T1 (SEQ ID NO: 2603) | 3570 | 3695 |
| HSAE2_T4 (SEQ ID NO: 2604) | 3382 | 3507 |
| HSAE2_T7 (SEQ ID NO: 2605) | 3452 | 3577 |
| HSAE2_T8 (SEQ ID NO: 2606) | 3433 | 3558 |
| HSAE2_T10 (SEQ ID NO: 2607) | 3071 | 3196 |
| HSAE2_T11 (SEQ ID NO: 2608) | 3435 | 3560 |
| HSAE2_T18 (SEQ ID NO: 2609) | 3424 | 3549 |
| HSAE2_T23 (SEQ ID NO: 2610) | 3688 | 3813 |
| HSAE2_T29 (SEQ ID NO: 2611) | 3275 | 3400 |
| HSAE2_T32 (SEQ ID NO: 2612) | 3793 | 3918 |
| HSAE2_T34 (SEQ ID NO: 2613) | 3275 | 3400 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_74 (SEQ ID NO:2638) according to the present invention is supported by 130 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2488 below describes the starting and ending position of this segment on each transcript.

TABLE 2488

Segment location on transcripts

| Transcript name | Segment starting position | Segment ending position |
|---|---|---|
| HSAE2_T1 (SEQ ID NO: 2603) | 3696 | 3823 |
| HSAE2_T4 (SEQ ID NO: 2604) | 3508 | 3635 |
| HSAE2_T7 (SEQ ID NO: 2605) | 3578 | 3705 |
| HSAE2_T8 (SEQ ID NO: 2606) | 3559 | 3686 |
| HSAE2_T10 (SEQ ID NO: 2607) | 3197 | 3324 |
| HSAE2_T11 (SEQ ID NO: 2608) | 3561 | 3688 |
| HSAE2_T18 (SEQ ID NO: 2609) | 3550 | 3677 |
| HSAE2_T23 (SEQ ID NO: 2610) | 3814 | 3941 |
| HSAE2_T29 (SEQ ID NO: 2611) | 3401 | 3528 |
| HSAE2_T32 (SEQ ID NO: 2612) | 3919 | 4046 |
| HSAE2_T34 (SEQ ID NO: 2613) | 3401 | 3528 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_76 (SEQ ID NO:2639) according to the present invention is supported by 149 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2489 below describes the starting and ending position of this segment on each transcript.

TABLE 2489

Segment location on transcripts

| Transcript name | Segment starting position | Segment ending position |
|---|---|---|
| HSAE2_T1 (SEQ ID NO: 2603) | 3824 | 3993 |
| HSAE2_T4 (SEQ ID NO: 2604) | 3636 | 3805 |
| HSAE2_T7 (SEQ ID NO: 2605) | 3706 | 3875 |
| HSAE2_T8 (SEQ ID NO: 2606) | 3687 | 3856 |
| HSAE2_T10 (SEQ ID NO: 2607) | 3325 | 3494 |
| HSAE2_T11 (SEQ ID NO: 2608) | 3689 | 3858 |
| HSAE2_T18 (SEQ ID NO: 2609) | 3678 | 3847 |
| HSAE2_T23 (SEQ ID NO: 2610) | 3942 | 4111 |
| HSAE2_T29 (SEQ ID NO: 2611) | 3529 | 3698 |
| HSAE2_T32 (SEQ ID NO: 2612) | 4047 | 4216 |
| HSAE2_T34 (SEQ ID NO: 2613) | 3529 | 3698 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_77 (SEQ ID NO:2640) according to the present invention is supported by 15 libraries. The number of libraries was determined as previously described. This segment can be found in the following transcript(s): HSAE2_T29 (SEQ ID NO:2611) and HSAE2_T34 (SEQ ID NO:2613). Table 2490 below describes the starting and ending position of this segment on each transcript.

TABLE 2490

Segment location on transcripts

| Transcript name | Segment starting position | Segment ending position |
|---|---|---|
| HSAE2_T29 (SEQ ID NO: 2611) | 3699 | 3935 |
| HSAE2_T34 (SEQ ID NO: 2613) | 3699 | 3935 |

This segment can be found in the following protein(s): HSAE2_P23 and HSAE2_P26.

Segment cluster HSAE2_node_82 (SEQ ID NO:2641) according to the present invention is supported by 134 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2491 below describes the starting and ending position of this segment on each transcript.

TABLE 2491

Segment location on transcripts

| Transcript name | Segment starting position | Segment ending position |
|---|---|---|
| HSAE2_T1 (SEQ ID NO: 2603) | 4168 | 4317 |
| HSAE2_T4 (SEQ ID NO: 2604) | 3980 | 4129 |
| HSAE2_T7 (SEQ ID NO: 2605) | 4050 | 4199 |
| HSAE2_T8 (SEQ ID NO: 2606) | 4031 | 4180 |
| HSAE2_T10 (SEQ ID NO: 2607) | 3669 | 3818 |
| HSAE2_T11 (SEQ ID NO: 2608) | 4033 | 4182 |
| HSAE2_T18 (SEQ ID NO: 2609) | 4022 | 4171 |
| HSAE2_T23 (SEQ ID NO: 2610) | 4286 | 4435 |
| HSAE2_T29 (SEQ ID NO: 2611) | 4110 | 4259 |
| HSAE2_T32 (SEQ ID NO: 2612) | 4391 | 4540 |
| HSAE2_T34 (SEQ ID NO: 2613) | 4210 | 4359 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

According to an optional embodiment of the present invention, short segments related to the above cluster are also provided. These segments are up to about 120 bp in length, and so are included in a separate description.

Segment cluster HSAE2_node_6 (SEQ ID NO:2642) according to the present invention is supported by 29 libraries. The number of libraries was determined as previously described. This segment can be found in the following transcript(s): HSAE2_T4 (SEQ ID NO:2604), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2492 below describes the starting and ending position of this segment on each transcript.

TABLE 2492

Segment location on transcripts

| Transcript name | Segment starting position | Segment ending position |
|---|---|---|
| HSAE2_T4 (SEQ ID NO: 2604) | 272 | 385 |
| HSAE2_T8 (SEQ ID NO: 2606) | 165 | 278 |
| HSAE2_T11 (SEQ ID NO: 2608) | 165 | 278 |
| HSAE2_T18 (SEQ ID NO: 2609) | 165 | 278 |
| HSAE2_T23 (SEQ ID NO: 2610) | 165 | 278 |
| HSAE2_T29 (SEQ ID NO: 2611) | 165 | 278 |
| HSAE2_T32 (SEQ ID NO: 2612) | 165 | 278 |
| HSAE2_T34 (SEQ ID NO: 2613) | 165 | 278 |
| HSAE2_T47 (SEQ ID NO: 2614) | 165 | 278 |
| HSAE2_T48 (SEQ ID NO: 2615) | 165 | 278 |

This segment can be found in both coding and non-coding regions of transcript(s) as follows. The segment can be found in a non-coding region of transcript(s) that are related to the following protein(s): HSAE2_P5, HSAE2_P7 and HSAE2_P38. This segment can also be found in the following protein(s): HSAE2_P41, HSAE2_P13, HSAE2_P18, HSAE2_P23, HSAE2_P15, HSAE2_P26 and HSAE2_P37, since it is in the coding region for the corresponding transcript.

Segment cluster HSAE2_node_8 (SEQ ID NO:2643) according to the present invention is supported by 3 libraries. The number of libraries was determined as previously described. This segment can be found in the following transcript(s): HSAE2_T1 (SEQ ID NO:2603). Table 2493 below describes the starting and ending position of this segment on each transcript.

TABLE 2493

| Transcript name | Segment location on transcripts | |
|---|---|---|
| | Segment starting position | Segment ending position |
| HSAE2_T1 (SEQ ID NO: 2603) | 1 | 47 |

This segment can be found in a non-coding region of transcript(s) that are related to the following protein(s): HSAE2_P2.

Segment cluster HSAE2_node_11 (SEQ ID NO:2644) according to the present invention is supported by 2 libraries. The number of libraries was determined as previously described. This segment can be found in the following transcript(s): HSAE2_T7 (SEQ ID NO:2605). Table 2494 below describes the starting and ending position of this segment on each transcript.

TABLE 2494

| Transcript name | Segment location on transcripts | |
|---|---|---|
| | Segment starting position | Segment ending position |
| HSAE2_T7 (SEQ ID NO: 2605) | 1 | 105 |

This segment can be found in a non-coding region of transcript(s) that are related to the following protein(s): HSAE2_P3.

Segment cluster HSAE2_node_15 (SEQ ID NO:2645) according to the present invention is supported by 30 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2495 below describes the starting and ending position of this segment on each transcript.

TABLE 2495

| Transcript name | Segment location on transcripts | |
|---|---|---|
| | Segment starting position | Segment ending position |
| HSAE2_T1 (SEQ ID NO: 2603) | 740 | 786 |
| HSAE2_T4 (SEQ ID NO: 2604) | 552 | 598 |
| HSAE2_T7 (SEQ ID NO: 2605) | 622 | 668 |
| HSAE2_T8 (SEQ ID NO: 2606) | 603 | 649 |
| HSAE2_T11 (SEQ ID NO: 2608) | 445 | 491 |

TABLE 2495-continued

| Transcript name | Segment location on transcripts | |
|---|---|---|
| | Segment starting position | Segment ending position |
| HSAE2_T18 (SEQ ID NO: 2609) | 445 | 491 |
| HSAE2_T23 (SEQ ID NO: 2610) | 445 | 491 |
| HSAE2_T29 (SEQ ID NO: 2611) | 445 | 491 |
| HSAE2_T32 (SEQ ID NO: 2612) | 445 | 491 |
| HSAE2_T34 (SEQ ID NO: 2613) | 445 | 491 |
| HSAE2_T47 (SEQ ID NO: 2614) | 445 | 491 |
| HSAE2_T48 (SEQ ID NO: 2615) | 445 | 491 |

This segment can be found in both coding and non-coding regions of transcript(s) as follows. The segment can be found in a non-coding region of transcript(s) that are related to the following protein(s): HSAE2_P3, HSAE2_P7 and HSAE2_P38. This segment can also be found in the following protein(s): HSAE2_P2, HSAE2_P41, HSAE2_P5, HSAE2_P13, HSAE2_P18, HSAE2_P23, HSAE2_P15, HSAE2_P26 and HSAE2_P37, since it is in the coding region for the corresponding transcript.

Segment cluster HSAE2_node_16 (SEQ ID NO:2646) according to the present invention is supported by 30 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2496 below describes the starting and ending position of this segment on each transcript.

TABLE 2496

| Transcript name | Segment location on transcripts | |
|---|---|---|
| | Segment starting position | Segment ending position |
| HSAE2_T1 (SEQ ID NO: 2603) | 787 | 817 |
| HSAE2_T4 (SEQ ID NO: 2604) | 599 | 629 |
| HSAE2_T7 (SEQ ID NO: 2605) | 669 | 699 |
| HSAE2_T8 (SEQ ID NO: 2606) | 650 | 680 |
| HSAE2_T11 (SEQ ID NO: 2608) | 492 | 522 |
| HSAE2_T18 (SEQ ID NO: 2609) | 492 | 522 |
| HSAE2_T23 (SEQ ID NO: 2610) | 492 | 522 |
| HSAE2_T29 (SEQ ID NO: 2611) | 492 | 522 |
| HSAE2_T32 (SEQ ID NO: 2612) | 492 | 522 |
| HSAE2_T34 (SEQ ID NO: 2613) | 492 | 522 |
| HSAE2_T47 (SEQ ID NO: 2614) | 492 | 522 |
| HSAE2_T48 (SEQ ID NO: 2615) | 492 | 522 |

This segment can be found in both coding and non-coding regions of transcript(s) as follows. The segment can be found in a non-coding region of transcript(s) that are related to the following protein(s): HSAE2_P3, HSAE2_P7 and HSAE2_P38. This segment can also be found in the following protein(s): HSAE2_P2, HSAE2_P41, HSAE2_P5, HSAE2_P13, HSAE2_P18, HSAE2_P23, HSAE2_P15, HSAE2_P26 and HSAE2_P37, since it is in the coding region for the corresponding transcript.

Segment cluster HSAE2_node_18 (SEQ ID NO:2647) according to the present invention is supported by 1 libraries. The number of libraries was determined as previously described. This segment can be found in the following transcript(s): HSAE2_T48 (SEQ ID NO:2615). Table 2497 below describes the starting and ending position of this segment on each transcript.

TABLE 2497

Segment location on transcripts

| Transcript name | Segment starting position | Segment ending position |
|---|---|---|
| HSAE2_T48 (SEQ ID NO: 2615) | 687 | 766 |

This segment can be found in the following protein(s): HSAE2_P38.

Segment cluster HSAE2_node_19 (SEQ ID NO:2648) according to the present invention is supported by 24 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2498 below describes the starting and ending position of this segment on each transcript.

TABLE 2498

Segment location on transcripts

| Transcript name | Segment starting position | Segment ending position |
|---|---|---|
| HSAE2_T1 (SEQ ID NO: 2603) | 982 | 1051 |
| HSAE2_T4 (SEQ ID NO: 2604) | 794 | 863 |
| HSAE2_T7 (SEQ ID NO: 2605) | 864 | 933 |
| HSAE2_T8 (SEQ ID NO: 2606) | 845 | 914 |
| HSAE2_T11 (SEQ ID NO: 2608) | 687 | 756 |
| HSAE2_T18 (SEQ ID NO: 2609) | 687 | 756 |
| HSAE2_T23 (SEQ ID NO: 2610) | 687 | 756 |
| HSAE2_T29 (SEQ ID NO: 2611) | 687 | 756 |
| HSAE2_T32 (SEQ ID NO: 2612) | 687 | 756 |
| HSAE2_T34 (SEQ ID NO: 2613) | 687 | 756 |
| HSAE2_T47 (SEQ ID NO: 2614) | 687 | 756 |
| HSAE2_T48 (SEQ ID NO: 2615) | 767 | 836 |

This segment can be found in both coding and non-coding regions of transcript(s) as follows. The segment can be found in a non-coding region of transcript(s) that are related to the following protein(s): HSAE2_P3 and HSAE2_P7. This segment can also be found in the following protein(s): HSAE2_P2, HSAE2_P41, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_20 (SEQ ID NO:2649) according to the present invention is supported by 22 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2499 below describes the starting and ending position of this segment on each transcript.

TABLE 2499

Segment location on transcripts

| Transcript name | Segment starting position | Segment ending position |
|---|---|---|
| HSAE2_T1 (SEQ ID NO: 2603) | 1052 | 1100 |
| HSAE2_T4 (SEQ ID NO: 2604) | 864 | 912 |
| HSAE2_T7 (SEQ ID NO: 2605) | 934 | 982 |
| HSAE2_T8 (SEQ ID NO: 2606) | 915 | 963 |
| HSAE2_T11 (SEQ ID NO: 2608) | 757 | 805 |
| HSAE2_T18 (SEQ ID NO: 2609) | 757 | 805 |
| HSAE2_T23 (SEQ ID NO: 2610) | 757 | 805 |
| HSAE2_T29 (SEQ ID NO: 2611) | 757 | 805 |
| HSAE2_T32 (SEQ ID NO: 2612) | 757 | 805 |
| HSAE2_T34 (SEQ ID NO: 2613) | 757 | 805 |
| HSAE2_T47 (SEQ ID NO: 2614) | 757 | 805 |
| HSAE2_T48 (SEQ ID NO: 2615) | 837 | 885 |

This segment can be found in both coding and non-coding regions of transcript(s) as follows. The segment can be found in a non-coding region of transcript(s) that are related to the following protein(s): HSAE2_P3 and HSAE2_P7. This segment can also be found in the following protein(s): HSAE2_P2, HSAE2_P41, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_24 (SEQ ID NO:2650) according to the present invention is supported by 32 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612), HSAE2_T34 (SEQ ID NO:2613), HSAE2_T47 (SEQ ID NO:2614) and HSAE2_T48 (SEQ ID NO:2615). Table 2500 below describes the starting and ending position of this segment on each transcript.

TABLE 2500

Segment location on transcripts

| Transcript name | Segment starting position | Segment ending position |
|---|---|---|
| HSAE2_T1 (SEQ ID NO: 2603) | 1309 | 1345 |
| HSAE2_T4 (SEQ ID NO: 2604) | 1121 | 1157 |
| HSAE2_T7 (SEQ ID NO: 2605) | 1191 | 1227 |
| HSAE2_T8 (SEQ ID NO: 2606) | 1172 | 1208 |
| HSAE2_T10 (SEQ ID NO: 2607) | 810 | 846 |
| HSAE2_T11 (SEQ ID NO: 2608) | 1014 | 1050 |
| HSAE2_T18 (SEQ ID NO: 2609) | 1014 | 1050 |
| HSAE2_T23 (SEQ ID NO: 2610) | 1014 | 1050 |
| HSAE2_T29 (SEQ ID NO: 2611) | 1014 | 1050 |
| HSAE2_T32 (SEQ ID NO: 2612) | 1014 | 1050 |
| HSAE2_T34 (SEQ ID NO: 2613) | 1014 | 1050 |
| HSAE2_T47 (SEQ ID NO: 2614) | 1014 | 1050 |
| HSAE2_T48 (SEQ ID NO: 2615) | 1094 | 1130 |

This segment can be found in both coding and non-coding regions of transcript(s) as follows. The segment can be found in a non-coding region of transcript(s) that are related to the following protein(s): HSAE2_P7. This segment can also be found in the following protein(s): HSAE2_P2, HSAE2_P41, HSAE2_P3, HSAE2_P5, HSAE2_P13, HSAE2_P18, HSAE2_P23, HSAE2_P15, HSAE2_P26, HSAE2_P37 and HSAE2_P38, since it is in the coding region for the corresponding transcript.

Segment cluster HSAE2_node_38 (SEQ ID NO:2651) according to the present invention is supported by 45 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2501 below describes the starting and ending position of this segment on each transcript.

TABLE 2501

Segment location on transcripts

| Transcript name | Segment starting position | Segment ending position |
| --- | --- | --- |
| HSAE2_T1 (SEQ ID NO: 2603) | 1972 | 2086 |
| HSAE2_T4 (SEQ ID NO: 2604) | 1784 | 1898 |
| HSAE2_T7 (SEQ ID NO: 2605) | 1854 | 1968 |
| HSAE2_T8 (SEQ ID NO: 2606) | 1835 | 1949 |
| HSAE2_T10 (SEQ ID NO: 2607) | 1473 | 1587 |
| HSAE2_T11 (SEQ ID NO: 2608) | 1677 | 1791 |
| HSAE2_T18 (SEQ ID NO: 2609) | 1677 | 1791 |
| HSAE2_T23 (SEQ ID NO: 2610) | 1677 | 1791 |
| HSAE2_T29 (SEQ ID NO: 2611) | 1677 | 1791 |
| HSAE2_T32 (SEQ ID NO: 2612) | 1677 | 1791 |
| HSAE2_T34 (SEQ ID NO: 2613) | 1677 | 1791 |

This segment can be found in the following protein(s): HSAE2_P2, HSAE2_P41, HSAE2_P3, HSAE2_P5, HSAE2_P7, HSAE2_P13, HSAE2_P18, HSAE2_P23, HSAE2_P15 and HSAE2_P26.

Segment cluster HSAE2_node_40 (SEQ ID NO:2652) according to the present invention is supported by 43 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2502 below describes the starting and ending position of this segment on each transcript.

TABLE 2502

Segment location on transcripts

| Transcript name | Segment starting position | Segment ending position |
| --- | --- | --- |
| HSAE2_T1 (SEQ ID NO: 2603) | 2087 | 2193 |
| HSAE2_T4 (SEQ ID NO: 2604) | 1899 | 2005 |
| HSAE2_T7 (SEQ ID NO: 2605) | 1969 | 2075 |
| HSAE2_T8 (SEQ ID NO: 2606) | 1950 | 2056 |
| HSAE2_T10 (SEQ ID NO: 2607) | 1588 | 1694 |
| HSAE2_T11 (SEQ ID NO: 2608) | 1792 | 1898 |
| HSAE2_T18 (SEQ ID NO: 2609) | 1792 | 1898 |
| HSAE2_T23 (SEQ ID NO: 2610) | 1792 | 1898 |
| HSAE2_T29 (SEQ ID NO: 2611) | 1792 | 1898 |
| HSAE2_T32 (SEQ ID NO: 2612) | 1792 | 1898 |
| HSAE2_T34 (SEQ ID NO: 2613) | 1792 | 1898 |

This segment can be found in the following protein(s): HSAE2_P2, HSAE2_P41, HSAE2_P3, HSAE2_P5, HSAE2_P7, HSAE2_P13, HSAE2_P18, HSAE2_P23, HSAE2_P15 and HSAE2_P26.

Segment cluster HSAE2_node_41 (SEQ ID NO:2653) according to the present invention is supported by 46 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2503 below describes the starting and ending position of this segment on each transcript.

TABLE 2503

Segment location on transcripts

| Transcript name | Segment starting position | Segment ending position |
| --- | --- | --- |
| HSAE2_T1 (SEQ ID NO: 2603) | 2194 | 2271 |
| HSAE2_T4 (SEQ ID NO: 2604) | 2006 | 2083 |
| HSAE2_T7 (SEQ ID NO: 2605) | 2076 | 2153 |
| HSAE2_T8 (SEQ ID NO: 2606) | 2057 | 2134 |
| HSAE2_T10 (SEQ ID NO: 2607) | 1695 | 1772 |
| HSAE2_T11 (SEQ ID NO: 2608) | 1899 | 1976 |
| HSAE2_T18 (SEQ ID NO: 2609) | 1899 | 1976 |
| HSAE2_T23 (SEQ ID NO: 2610) | 1899 | 1976 |
| HSAE2_T29 (SEQ ID NO: 2611) | 1899 | 1976 |
| HSAE2_T32 (SEQ ID NO: 2612) | 1899 | 1976 |
| HSAE2_T34 (SEQ ID NO: 2613) | 1899 | 1976 |

This segment can be found in the following protein(s): HSAE2_P2, HSAE2_P41, HSAE2_P3, HSAE2_P5, HSAE2_P7, HSAE2_P13, HSAE2_P18, HSAE2_P23, HSAE2_P15 and HSAE2_P26.

Segment cluster HSAE2_node_44 (SEQ ID NO:2654) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2504 below describes the starting and ending position of this segment on each transcript.

TABLE 2504

Segment location on transcripts

| Transcript name | Segment starting position | Segment ending position |
| --- | --- | --- |
| HSAE2_T1 (SEQ ID NO: 2603) | 2422 | 2436 |
| HSAE2_T4 (SEQ ID NO: 2604) | 2234 | 2248 |
| HSAE2_T7 (SEQ ID NO: 2605) | 2304 | 2318 |
| HSAE2_T8 (SEQ ID NO: 2606) | 2285 | 2299 |
| HSAE2_T10 (SEQ ID NO: 2607) | 1923 | 1937 |
| HSAE2_T11 (SEQ ID NO: 2608) | 2287 | 2301 |
| HSAE2_T18 (SEQ ID NO: 2609) | 2287 | 2301 |
| HSAE2_T23 (SEQ ID NO: 2610) | 2127 | 2141 |
| HSAE2_T29 (SEQ ID NO: 2611) | 2127 | 2141 |
| HSAE2_T32 (SEQ ID NO: 2612) | 2127 | 2141 |
| HSAE2_T34 (SEQ ID NO: 2613) | 2127 | 2141 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_45 (SEQ ID NO:2655) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2505 below describes the starting and ending position of this segment on each transcript.

TABLE 2505

Segment location on transcripts

| Transcript name | Segment starting position | Segment ending position |
| --- | --- | --- |
| HSAE2_T1 (SEQ ID NO: 2603) | 2437 | 2461 |
| HSAE2_T4 (SEQ ID NO: 2604) | 2249 | 2273 |
| HSAE2_T7 (SEQ ID NO: 2605) | 2319 | 2343 |
| HSAE2_T8 (SEQ ID NO: 2606) | 2300 | 2324 |
| HSAE2_T10 (SEQ ID NO: 2607) | 1938 | 1962 |
| HSAE2_T11 (SEQ ID NO: 2608) | 2302 | 2326 |
| HSAE2_T18 (SEQ ID NO: 2609) | 2302 | 2326 |
| HSAE2_T23 (SEQ ID NO: 2610) | 2142 | 2166 |
| HSAE2_T29 (SEQ ID NO: 2611) | 2142 | 2166 |
| HSAE2_T32 (SEQ ID NO: 2612) | 2142 | 2166 |
| HSAE2_T34 (SEQ ID NO: 2613) | 2142 | 2166 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_46 (SEQ ID NO:2656) according to the present invention is supported by 60 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2506 below describes the starting and ending position of this segment on each transcript.

TABLE 2506

Segment location on transcripts

| Transcript name | Segment starting position | Segment ending position |
| --- | --- | --- |
| HSAE2_T1 (SEQ ID NO: 2603) | 2462 | 2497 |
| HSAE2_T4 (SEQ ID NO: 2604) | 2274 | 2309 |

TABLE 2506-continued

Segment location on transcripts

| Transcript name | Segment starting position | Segment ending position |
| --- | --- | --- |
| HSAE2_T7 (SEQ ID NO: 2605) | 2344 | 2379 |
| HSAE2_T8 (SEQ ID NO: 2606) | 2325 | 2360 |
| HSAE2_T10 (SEQ ID NO: 2607) | 1963 | 1998 |
| HSAE2_T11 (SEQ ID NO: 2608) | 2327 | 2362 |
| HSAE2_T18 (SEQ ID NO: 2609) | 2327 | 2362 |
| HSAE2_T23 (SEQ ID NO: 2610) | 2167 | 2202 |
| HSAE2_T29 (SEQ ID NO: 2611) | 2167 | 2202 |
| HSAE2_T32 (SEQ ID NO: 2612) | 2167 | 2202 |
| HSAE2_T34 (SEQ ID NO: 2613) | 2167 | 2202 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_48 (SEQ ID NO:2657) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2507 below describes the starting and ending position of this segment on each transcript.

TABLE 2507

Segment location on transcripts

| Transcript name | Segment starting position | Segment ending position |
| --- | --- | --- |
| HSAE2_T1 (SEQ ID NO: 2603) | 2498 | 2508 |
| HSAE2_T4 (SEQ ID NO: 2604) | 2310 | 2320 |
| HSAE2_T7 (SEQ ID NO: 2605) | 2380 | 2390 |
| HSAE2_T8 (SEQ ID NO: 2606) | 2361 | 2371 |
| HSAE2_T10 (SEQ ID NO: 2607) | 1999 | 2009 |
| HSAE2_T11 (SEQ ID NO: 2608) | 2363 | 2373 |
| HSAE2_T23 (SEQ ID NO: 2610) | 2203 | 2213 |
| HSAE2_T29 (SEQ ID NO: 2611) | 2203 | 2213 |
| HSAE2_T32 (SEQ ID NO: 2612) | 2203 | 2213 |
| HSAE2_T34 (SEQ ID NO: 2613) | 2203 | 2213 |

This segment can be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26.

Segment cluster HSAE2_node_49 (SEQ ID NO:2658) according to the present invention is supported by 68 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2508 below describes the starting and ending position of this segment on each transcript.

TABLE 2508

Segment location on transcripts

| Transcript name | Segment starting position | Segment ending position |
|---|---|---|
| HSAE2_T1 (SEQ ID NO: 2603) | 2509 | 2564 |
| HSAE2_T4 (SEQ ID NO: 2604) | 2321 | 2376 |
| HSAE2_T7 (SEQ ID NO: 2605) | 2391 | 2446 |
| HSAE2_T8 (SEQ ID NO: 2606) | 2372 | 2427 |
| HSAE2_T10 (SEQ ID NO: 2607) | 2010 | 2065 |
| HSAE2_T11 (SEQ ID NO: 2608) | 2374 | 2429 |
| HSAE2_T18 (SEQ ID NO: 2609) | 2363 | 2418 |
| HSAE2_T23 (SEQ ID NO: 2610) | 2214 | 2269 |
| HSAE2_T29 (SEQ ID NO: 2611) | 2214 | 2269 |
| HSAE2_T32 (SEQ ID NO: 2612) | 2214 | 2269 |
| HSAE2_T34 (SEQ ID NO: 2613) | 2214 | 2269 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_50 (SEQ ID NO:2659) according to the present invention is supported by 62 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2509 below describes the starting and ending position of this segment on each transcript.

TABLE 2509

Segment location on transcripts

| Transcript name | Segment starting position | Segment ending position |
|---|---|---|
| HSAE2_T1 (SEQ ID NO: 2603) | 2565 | 2606 |
| HSAE2_T4 (SEQ ID NO: 2604) | 2377 | 2418 |
| HSAE2_T7 (SEQ ID NO: 2605) | 2447 | 2488 |
| HSAE2_T8 (SEQ ID NO: 2606) | 2428 | 2469 |
| HSAE2_T10 (SEQ ID NO: 2607) | 2066 | 2107 |
| HSAE2_T11 (SEQ ID NO: 2608) | 2430 | 2471 |
| HSAE2_T18 (SEQ ID NO: 2609) | 2419 | 2460 |
| HSAE2_T23 (SEQ ID NO: 2610) | 2270 | 2311 |
| HSAE2_T29 (SEQ ID NO: 2611) | 2270 | 2311 |
| HSAE2_T32 (SEQ ID NO: 2612) | 2270 | 2311 |
| HSAE2_T34 (SEQ ID NO: 2613) | 2270 | 2311 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_51 (SEQ ID NO:2660) according to the present invention is supported by 64 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2510 below describes the starting and ending position of this segment on each transcript.

TABLE 2510

Segment location on transcripts

| Transcript name | Segment starting position | Segment ending position |
|---|---|---|
| HSAE2_T1 (SEQ ID NO: 2603) | 2607 | 2713 |
| HSAE2_T4 (SEQ ID NO: 2604) | 2419 | 2525 |
| HSAE2_T7 (SEQ ID NO: 2605) | 2489 | 2595 |
| HSAE2_T8 (SEQ ID NO: 2606) | 2470 | 2576 |
| HSAE2_T10 (SEQ ID NO: 2607) | 2108 | 2214 |
| HSAE2_T11 (SEQ ID NO: 2608) | 2472 | 2578 |
| HSAE2_T18 (SEQ ID NO: 2609) | 2461 | 2567 |
| HSAE2_T23 (SEQ ID NO: 2610) | 2312 | 2418 |
| HSAE2_T29 (SEQ ID NO: 2611) | 2312 | 2418 |
| HSAE2_T32 (SEQ ID NO: 2612) | 2312 | 2418 |
| HSAE2_T34 (SEQ ID NO: 2613) | 2312 | 2418 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_56 (SEQ ID NO:2661) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2511 below describes the starting and ending position of this segment on each transcript.

TABLE 2511

Segment location on transcripts

| Transcript name | Segment starting position | Segment ending position |
|---|---|---|
| HSAE2_T1 (SEQ ID NO: 2603) | 2863 | 2870 |
| HSAE2_T4 (SEQ ID NO: 2604) | 2675 | 2682 |
| HSAE2_T7 (SEQ ID NO: 2605) | 2745 | 2752 |
| HSAE2_T8 (SEQ ID NO: 2606) | 2726 | 2733 |
| HSAE2_T10 (SEQ ID NO: 2607) | 2364 | 2371 |
| HSAE2_T11 (SEQ ID NO: 2608) | 2728 | 2735 |
| HSAE2_T18 (SEQ ID NO: 2609) | 2717 | 2724 |
| HSAE2_T23 (SEQ ID NO: 2610) | 2568 | 2575 |
| HSAE2_T29 (SEQ ID NO: 2611) | 2568 | 2575 |
| HSAE2_T32 (SEQ ID NO: 2612) | 2568 | 2575 |
| HSAE2_T34 (SEQ ID NO: 2613) | 2568 | 2575 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_57 (SEQ ID NO:2662) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2512 below describes the starting and ending position of this segment on each transcript.

TABLE 2512

Segment location on transcripts

| Transcript name | Segment starting position | Segment ending position |
| --- | --- | --- |
| HSAE2_T1 (SEQ ID NO: 2603) | 2871 | 2889 |
| HSAE2_T4 (SEQ ID NO: 2604) | 2683 | 2701 |
| HSAE2_T7 (SEQ ID NO: 2605) | 2753 | 2771 |
| HSAE2_T8 (SEQ ID NO: 2606) | 2734 | 2752 |
| HSAE2_T10 (SEQ ID NO: 2607) | 2372 | 2390 |
| HSAE2_T11 (SEQ ID NO: 2608) | 2736 | 2754 |
| HSAE2_T18 (SEQ ID NO: 2609) | 2725 | 2743 |
| HSAE2_T23 (SEQ ID NO: 2610) | 2576 | 2594 |
| HSAE2_T29 (SEQ ID NO: 2611) | 2576 | 2594 |
| HSAE2_T32 (SEQ ID NO: 2612) | 2576 | 2594 |
| HSAE2_T34 (SEQ ID NO: 2613) | 2576 | 2594 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_58 (SEQ ID NO:2663) according to the present invention is supported by 68 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2513 below describes the starting and ending position of this segment on each transcript.

TABLE 2513

Segment location on transcripts

| Transcript name | Segment starting position | Segment ending position |
| --- | --- | --- |
| HSAE2_T1 (SEQ ID NO: 2603) | 2890 | 2937 |
| HSAE2_T4 (SEQ ID NO: 2604) | 2702 | 2749 |

TABLE 2513-continued

Segment location on transcripts

| Transcript name | Segment starting position | Segment ending position |
| --- | --- | --- |
| HSAE2_T7 (SEQ ID NO: 2605) | 2772 | 2819 |
| HSAE2_T8 (SEQ ID NO: 2606) | 2753 | 2800 |
| HSAE2_T10 (SEQ ID NO: 2607) | 2391 | 2438 |
| HSAE2_T11 (SEQ ID NO: 2608) | 2755 | 2802 |
| HSAE2_T18 (SEQ ID NO: 2609) | 2744 | 2791 |
| HSAE2_T23 (SEQ ID NO: 2610) | 2595 | 2642 |
| HSAE2_T29 (SEQ ID NO: 2611) | 2595 | 2642 |
| HSAE2_T32 (SEQ ID NO: 2612) | 2595 | 2642 |
| HSAE2_T34 (SEQ ID NO: 2613) | 2595 | 2642 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_65 (SEQ ID NO:2664) according to the present invention is supported by 98 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2514 below describes the starting and ending position of this segment on each transcript.

TABLE 2514

Segment location on transcripts

| Transcript name | Segment starting position | Segment ending position |
| --- | --- | --- |
| HSAE2_T1 (SEQ ID NO: 2603) | 3226 | 3312 |
| HSAE2_T4 (SEQ ID NO: 2604) | 3038 | 3124 |
| HSAE2_T7 (SEQ ID NO: 2605) | 3108 | 3194 |
| HSAE2_T8 (SEQ ID NO: 2606) | 3089 | 3175 |
| HSAE2_T10 (SEQ ID NO: 2607) | 2727 | 2813 |
| HSAE2_T11 (SEQ ID NO: 2608) | 3091 | 3177 |
| HSAE2_T18 (SEQ ID NO: 2609) | 3080 | 3166 |
| HSAE2_T23 (SEQ ID NO: 2610) | 2931 | 3017 |
| HSAE2_T29 (SEQ ID NO: 2611) | 2931 | 3017 |
| HSAE2_T32 (SEQ ID NO: 2612) | 2931 | 3017 |
| HSAE2_T34 (SEQ ID NO: 2613) | 2931 | 3017 |

This segment can be found in both coding and non-coding regions of transcript(s) as follows. The segment can be found in a non-coding region of transcript(s) that are related to the following protein(s): HSAE2_P13. This segment can also be found in the following protein(s): HSAE2_P2, HSAE2_P41, HSAE2_P3, HSAE2_P5, HSAE2_P7, HSAE2_P18, HSAE2_P23, HSAE2_P15 and HSAE2_P26, since it is in the coding region for the corresponding transcript.

Segment cluster HSAE2_node_66 (SEQ ID NO:2665) according to the present invention is supported by 16 libraries. The number of libraries was determined as previously described. This segment can be found in the following transcript(s): HSAE2_T32 (SEQ ID NO:2612). Table 2515 below describes the starting and ending position of this segment on each transcript.

TABLE 2515

Segment location on transcripts

| Transcript name | Segment starting position | Segment ending position |
|---|---|---|
| HSAE2_T32 (SEQ ID NO: 2612) | 3018 | 3122 |

This segment can be found in the following protein(s): HSAE2_P15.

Segment cluster HSAE2_node__67 (SEQ ID NO:2666) according to the present invention is supported by 111 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2516 below describes the starting and ending position of this segment on each transcript.

TABLE 2516

Segment location on transcripts

| Transcript name | Segment starting position | Segment ending position |
|---|---|---|
| HSAE2_T1 (SEQ ID NO: 2603) | 3313 | 3402 |
| HSAE2_T4 (SEQ ID NO: 2604) | 3125 | 3214 |
| HSAE2_T7 (SEQ ID NO: 2605) | 3195 | 3284 |
| HSAE2_T8 (SEQ ID NO: 2606) | 3176 | 3265 |
| HSAE2_T10 (SEQ ID NO: 2607) | 2814 | 2903 |
| HSAE2_T11 (SEQ ID NO: 2608) | 3178 | 3267 |
| HSAE2_T18 (SEQ ID NO: 2609) | 3167 | 3256 |
| HSAE2_T23 (SEQ ID NO: 2610) | 3018 | 3107 |
| HSAE2_T29 (SEQ ID NO: 2611) | 3018 | 3107 |
| HSAE2_T32 (SEQ ID NO: 2612) | 3123 | 3212 |
| HSAE2_T34 (SEQ ID NO: 2613) | 3018 | 3107 |

This segment can be found in both coding and non-coding regions of transcript(s) as follows. The segment can be found in a non-coding region of transcript(s) that are related to the following protein(s): HSAE2_P13 and HSAE2_P15. This segment can also be found in the following protein(s): HSAE2_P2, HSAE2_P41, HSAE2_P3, HSAE2_P5, HSAE2_P7, HSAE2_P18, HSAE2_P23 and HSAE2_P26, since it is in the coding region for the corresponding transcript.

Segment cluster HSAE2_node__69 (SEQ ID NO:2667) according to the present invention is supported by 118 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2517 below describes the starting and ending position of this segment on each transcript.

TABLE 2517

Segment location on transcripts

| Transcript name | Segment starting position | Segment ending position |
|---|---|---|
| HSAE2_T1 (SEQ ID NO: 2603) | 3403 | 3490 |
| HSAE2_T4 (SEQ ID NO: 2604) | 3215 | 3302 |
| HSAE2_T7 (SEQ ID NO: 2605) | 3285 | 3372 |
| HSAE2_T8 (SEQ ID NO: 2606) | 3266 | 3353 |
| HSAE2_T10 (SEQ ID NO: 2607) | 2904 | 2991 |
| HSAE2_T11 (SEQ ID NO: 2608) | 3268 | 3355 |
| HSAE2_T18 (SEQ ID NO: 2609) | 3257 | 3344 |
| HSAE2_T23 (SEQ ID NO: 2610) | 3108 | 3195 |
| HSAE2_T29 (SEQ ID NO: 2611) | 3108 | 3195 |
| HSAE2_T32 (SEQ ID NO: 2612) | 3213 | 3300 |
| HSAE2_T34 (SEQ ID NO: 2613) | 3108 | 3195 |

This segment can be found in both coding and non-coding regions of transcript(s) as follows. The segment can be found in a non-coding region of transcript(s) that are related to the following protein(s): HSAE2_P13 and HSAE2_P15. This segment can also be found in the following protein(s): HSAE2_P2, HSAE2_P41, HSAE2_P3, HSAE2_P5, HSAE2_P7, HSAE2_P18, HSAE2_P23 and HSAE2_P26, since it is in the coding region for the corresponding transcript.

Segment cluster HSAE2_node__70 (SEQ ID NO:2668) according to the present invention is supported by 115 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2518 below describes the starting and ending position of this segment on each transcript.

TABLE 2518

Segment location on transcripts

| Transcript name | Segment starting position | Segment ending position |
|---|---|---|
| HSAE2_T1 (SEQ ID NO: 2603) | 3491 | 3569 |
| HSAE2_T4 (SEQ ID NO: 2604) | 3303 | 3381 |
| HSAE2_T7 (SEQ ID NO: 2605) | 3373 | 3451 |
| HSAE2_T8 (SEQ ID NO: 2606) | 3354 | 3432 |
| HSAE2_T10 (SEQ ID NO: 2607) | 2992 | 3070 |
| HSAE2_T11 (SEQ ID NO: 2608) | 3356 | 3434 |
| HSAE2_T18 (SEQ ID NO: 2609) | 3345 | 3423 |
| HSAE2_T23 (SEQ ID NO: 2610) | 3196 | 3274 |
| HSAE2_T29 (SEQ ID NO: 2611) | 3196 | 3274 |
| HSAE2_T32 (SEQ ID NO: 2612) | 3301 | 3379 |
| HSAE2_T34 (SEQ ID NO: 2613) | 3196 | 3274 |

This segment can be found in both coding and non-coding regions of transcript(s) as follows. The segment can be found in a non-coding region of transcript(s) that are related to the following protein(s): HSAE2_P13 and HSAE2_P15. This segment can also be found in the following protein(s): HSAE2_P2, HSAE2_P41, HSAE2_P3, HSAE2_P5, HSAE2_P7, HSAE2_P18, HSAE2_P23 and HSAE2_P26, since it is in the coding region for the corresponding transcript.

Segment cluster HSAE2_node__78 (SEQ ID NO:2669) according to the present invention is supported by 137 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2519 below describes the starting and ending position of this segment on each transcript.

TABLE 2519

Segment location on transcripts

| Transcript name | Segment starting position | Segment ending position |
|---|---|---|
| HSAE2_T1 (SEQ ID NO: 2603) | 3994 | 4090 |
| HSAE2_T4 (SEQ ID NO: 2604) | 3806 | 3902 |
| HSAE2_T7 (SEQ ID NO: 2605) | 3876 | 3972 |
| HSAE2_T8 (SEQ ID NO: 2606) | 3857 | 3953 |
| HSAE2_T10 (SEQ ID NO: 2607) | 3495 | 3591 |
| HSAE2_T11 (SEQ ID NO: 2608) | 3859 | 3955 |
| HSAE2_T18 (SEQ ID NO: 2609) | 3848 | 3944 |
| HSAE2_T23 (SEQ ID NO: 2610) | 4112 | 4208 |
| HSAE2_T29 (SEQ ID NO: 2611) | 3936 | 4032 |
| HSAE2_T32 (SEQ ID NO: 2612) | 4217 | 4313 |
| HSAE2_T34 (SEQ ID NO: 2613) | 3936 | 4032 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_79 (SEQ ID NO:2670) according to the present invention can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2520 below describes the starting and ending position of this segment on each transcript.

TABLE 2520

Segment location on transcripts

| Transcript name | Segment starting position | Segment ending position |
|---|---|---|
| HSAE2_T1 (SEQ ID NO: 2603) | 4091 | 4111 |
| HSAE2_T4 (SEQ ID NO: 2604) | 3903 | 3923 |
| HSAE2_T7 (SEQ ID NO: 2605) | 3973 | 3993 |
| HSAE2_T8 (SEQ ID NO: 2606) | 3954 | 3974 |
| HSAE2_T10 (SEQ ID NO: 2607) | 3592 | 3612 |
| HSAE2_T11 (SEQ ID NO: 2608) | 3956 | 3976 |
| HSAE2_T18 (SEQ ID NO: 2609) | 3945 | 3965 |
| HSAE2_T23 (SEQ ID NO: 2610) | 4209 | 4229 |
| HSAE2_T29 (SEQ ID NO: 2611) | 4033 | 4053 |
| HSAE2_T32 (SEQ ID NO: 2612) | 4314 | 4334 |
| HSAE2_T34 (SEQ ID NO: 2613) | 4033 | 4053 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_80 (SEQ ID NO:2671) according to the present invention is supported by 127 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2521 below describes the starting and ending position of this segment on each transcript.

TABLE 2521

Segment location on transcripts

| Transcript name | Segment starting position | Segment ending position |
|---|---|---|
| HSAE2_T1 (SEQ ID NO: 2603) | 4112 | 4167 |
| HSAE2_T4 (SEQ ID NO: 2604) | 3924 | 3979 |
| HSAE2_T7 (SEQ ID NO: 2605) | 3994 | 4049 |
| HSAE2_T8 (SEQ ID NO: 2606) | 3975 | 4030 |
| HSAE2_T10 (SEQ ID NO: 2607) | 3613 | 3668 |
| HSAE2_T11 (SEQ ID NO: 2608) | 3977 | 4032 |
| HSAE2_T18 (SEQ ID NO: 2609) | 3966 | 4021 |
| HSAE2_T23 (SEQ ID NO: 2610) | 4230 | 4285 |
| HSAE2_T29 (SEQ ID NO: 2611) | 4054 | 4109 |
| HSAE2_T32 (SEQ ID NO: 2612) | 4335 | 4390 |
| HSAE2_T34 (SEQ ID NO: 2613) | 4054 | 4109 |

This segment can be found in both coding and non-coding regions of transcript(s) as follows. The segment can be found in a non-coding region of transcript(s) that are related to the following protein(s): HSAE2_P13, HSAE2_P18 and HSAE2_P15. This segment can also be found in the following protein(s): HSAE2_P2, HSAE2_P41, HSAE2_P3, HSAE2_P5, HSAE2_P7, HSAE2_P23 and HSAE2_P26, since it is in the coding region for the corresponding transcript.

Segment cluster HSAE2_node_81 (SEQ ID NO:2672) according to the present invention is supported by 6 libraries. The number of libraries was determined as previously described. This segment can be found in the following transcript(s): HSAE2_T34 (SEQ ID NO:2613). Table 2522 below describes the starting and ending position of this segment on each transcript.

TABLE 2522

Segment location on transcripts

| Transcript name | Segment starting position | Segment ending position |
|---|---|---|
| HSAE2_T34 (SEQ ID NO: 2613) | 4110 | 4209 |

This segment can be found in the following protein(s): HSAE2_P26.

Segment cluster HSAE2_node_83 (SEQ ID NO:2673) according to the present invention is supported by 99 libraries. The number of libraries was determined as previously described. This segment can be found in the following transcript(s): HSAE2_T1 (SEQ ID NO:2603), HSAE2_T4 (SEQ ID NO:2604), HSAE2_T7 (SEQ ID NO:2605), HSAE2_T8 (SEQ ID NO:2606), HSAE2_T10 (SEQ ID NO:2607), HSAE2_T11 (SEQ ID NO:2608), HSAE2_T18 (SEQ ID NO:2609), HSAE2_T23 (SEQ ID NO:2610), HSAE2_T29 (SEQ ID NO:2611), HSAE2_T32 (SEQ ID NO:2612) and HSAE2_T34 (SEQ ID NO:2613). Table 2523 below describes the starting and ending position of this segment on each transcript.

TABLE 2523

Segment location on transcripts

| Transcript name | Segment starting position | Segment ending position |
|---|---|---|
| HSAE2_T1 (SEQ ID NO: 2603) | 4318 | 4414 |
| HSAE2_T4 (SEQ ID NO: 2604) | 4130 | 4226 |
| HSAE2_T7 (SEQ ID NO: 2605) | 4200 | 4296 |
| HSAE2_T8 (SEQ ID NO: 2606) | 4181 | 4277 |
| HSAE2_T10 (SEQ ID NO: 2607) | 3819 | 3915 |
| HSAE2_T11 (SEQ ID NO: 2608) | 4183 | 4279 |
| HSAE2_T18 (SEQ ID NO: 2609) | 4172 | 4268 |
| HSAE2_T23 (SEQ ID NO: 2610) | 4436 | 4532 |
| HSAE2_T29 (SEQ ID NO: 2611) | 4260 | 4356 |
| HSAE2_T32 (SEQ ID NO: 2612) | 4541 | 4637 |
| HSAE2_T34 (SEQ ID NO: 2613) | 4360 | 4456 |

This segment can be found in a non-coding region of transcript(s) that are related to the following protein(s): HSAE2_P2, HSAE2_P41, HSAE2_P3, HSAE2_P5, HSAE2_P7, HSAE2_P13, HSAE2_P18, HSAE2_P23, HSAE2_P15 and HSAE2_P26.

Description for Cluster HSAPHOL

Cluster HSAPHOL features 3 transcript(s) and 20 segment(s) of interest, the names for which are given in Tables 2524 and 2525, respectively, the sequences themselves are given at the end of the application. The selected protein variants are given in Table 2526.

TABLE 2524

Transcripts of interest
Transcript Name

HSAPHOL_T2 (SEQ ID NO: 2674)
HSAPHOL_T3 (SEQ ID NO: 2675)
HSAPHOL_T12 (SEQ ID NO: 2676)

TABLE 2525

Segments of interest
Segment Name

HSAPHOL_node_0 (SEQ ID NO: 2677)
HSAPHOL_node_2 (SEQ ID NO: 2678)
HSAPHOL_node_6 (SEQ ID NO: 2679)
HSAPHOL_node_11 (SEQ ID NO: 2680)
HSAPHOL_node_13 (SEQ ID NO: 2681)
HSAPHOL_node_19 (SEQ ID NO: 2682)
HSAPHOL_node_21 (SEQ ID NO: 2683)
HSAPHOL_node_23 (SEQ ID NO: 2684)
HSAPHOL_node_28 (SEQ ID NO: 2685)
HSAPHOL_node_32 (SEQ ID NO: 2686)
HSAPHOL_node_38 (SEQ ID NO: 2687)
HSAPHOL_node_40 (SEQ ID NO: 2688)
HSAPHOL_node_42 (SEQ ID NO: 2689)
HSAPHOL_node_16 (SEQ ID NO: 2690)
HSAPHOL_node_25 (SEQ ID NO: 2691)
HSAPHOL_node_33 (SEQ ID NO: 2692)

TABLE 2525-continued

Segments of interest
Segment Name

HSAPHOL_node_34 (SEQ ID NO: 2693)
HSAPHOL_node_35 (SEQ ID NO: 2694)
HSAPHOL_node_36 (SEQ ID NO: 2695)
HSAPHOL_node_41 (SEQ ID NO: 2696)

TABLE 2526

Proteins of interest

| Protein Name | Corresponding Transcript(s) |
|---|---|
| HSAPHOL_P1 | HSAPHOL_T2 (SEQ ID NO: 2674); HSAPHOL_T3 (SEQ ID NO: 2675) |
| HSAPHOL_P9 | HSAPHOL_T12 (SEQ ID NO: 2676) |

These sequences are variants of the known protein Alkaline phosphatase, tissue-nonspecific isozyme precursor (SwissProt accession identifier PPBT_HUMAN; known also according to the synonyms EC 3.1.3.1; AP-TNAP; Liver/bone/kidney isozyme; TNSALP), referred to herein as the previously known protein.

Protein Alkaline phosphatase, tissue-nonspecific isozyme precursor is known or believed to have the following function(s): THIS ISOZYME MAY PLAY A ROLE IN SKELETAL MINERALIZATION. The sequence for protein Alkaline phosphatase, tissue-nonspecific isozyme precursor is given at the end of the application, as "Alkaline phosphatase, tissue-nonspecific isozyme precursor amino acid sequence". Known polymorphisms for this sequence are as shown in Table 2527.

TABLE 2527

Amino acid mutations for Known Protein

| SNP position(s) on amino acid sequence | Comment |
|---|---|
| 28 | Y -> C (in hypophosphatasia; infantile; 7% of activity). / FTId=VAR_013972. |
| 33 | A -> V (in hypophosphatasia). /FTId=VAR_006147. |
| 40 | A -> V (in hypophosphatasia; 2% of activity). / FTId=VAR_011081. |
| 51 | A -> V (in hypophosphatasia). /FTId=VAR_013973. |
| 62 | M -> L (in hypophosphatasia; moderate; 27% of activity). / FTId=VAR_006148. |
| 63 | G -> V (in hypophosphatasia; loss of activity). / FTId=VAR_013974. |
| 71 | R -> C (in hypophosphatasia). /FTId=VAR_006149. |
| 71 | R -> H (in hypophosphatasia). /FTId=VAR_013975. |
| 71 | R -> P (in hypophosphatasia). /FTId=VAR_006150. |
| 75 | G -> S (in hypophosphatasia; severe; 3.5% of activity). / FTId=VAR_013976. |
| 111 | A -> T (in hypophosphatasia; odonto). / FTId=VAR_006151. |
| 116 | A -> T (in hypophosphatasia; loss of activity). / FTId=VAR_013977. |
| 120 | G -> R (in hypophosphatasia). /FTId=VAR_013978. |
| 129 | G -> R (in hypophosphatasia). /FTId=VAR_013979. |
| 132 | A -> V (in hypophosphatasia). /FTId=VAR_013146. |
| 134 | T -> N (in hypophosphatasia; 9% of activity). / FTId=VAR_011082. |
| 136 | R -> H (in hypophosphatasia; moderate; 33% of activity). / FTId=VAR_006152. |
| 152 | R -> H (in hypophosphatasia). /FTId=VAR_013980. |

TABLE 2527-continued

Amino acid mutations for Known Protein

| SNP position(s) on amino acid sequence | Comment |
|---|---|
| 162 | G -> V (in hypophosphatasia; severe; 1% of activity). / FTId=VAR_006153. |
| 170 | N -> D (in hypophosphatasia). /FTId=VAR_013981. |
| 171 | H -> Y (in hypophosphatasia; severe; 2% of activity). / FTId=VAR_006154. |
| 176 | A -> T (in hypophosphatasia). /FTId=VAR_011083. |
| 177 | A -> T (in hypophosphatasia; adult type). / FTId=VAR_006155. |
| 179 | A -> T (in hypophosphatasia). /FTId=VAR_006156. |
| 181 | S -> L (in hypophosphatasia; 1% OF activity). / FTId=VAR_013982. |
| 184 | R -> W (in hypophosphatasia; loss of activity). / FTId=VAR_013983. |
| 191 | E -> G (in hypophosphatasia; odonto). / FTId=VAR_006157. |
| 191 | E -> K (in hypophosphatasia; moderate; frequent mutation in European countries). /FTId=VAR_006158. |
| 201 | C -> Y (in hypophosphatasia). /FTId=VAR_006159. |
| 207 | Q -> P (in hypophosphatasia). /FTId=VAR_006160. |
| 211 | N -> D (in hypophosphatasia). /FTId=VAR_013984. |
| 220 | G -> V (in hypophosphatasia; odonto). / FTId=VAR_013985. |
| 223 | R -> W (in hypophosphatasia; 3% of activity). / FTId=VAR_013986. |
| 224 | K -> E (in hypophosphatasia; infantile; partial loss of activity). /FTId=VAR_011084. |
| 235 | E -> G (in hypophosphatasia). /FTId=VAR_013987. |
| 246 | R -> S (in hypophosphatasia; 4% of activity). / FTId=VAR_011085. |
| 249 | G -> V (in hypophosphatasia; partial loss of activity). / FTId=VAR_013988. |
| 263 | H -> Y (common polymorphism). /FTId=VAR_006161. |
| 289 | L -> F (in hypophosphatasia). /FTId=VAR_006162. |
| 291 | E -> K (in hypophosphatasia; moderate; 8% of activity). / FTId=VAR_013989. |
| 294 | D -> A (in hypophosphatasia). /FTId=VAR_006163. |
| 294 | D -> Y (in hypophosphatasia). /FTId=VAR_013990. |
| 306 | D -> V (in hypophosphatasia). /FTId=VAR_006164. |
| 326 | G -> R (in hypophosphatasia; in a patient carrying also lys-291). /FTId=VAR_013991. |
| 327 | F -> G (in hypophosphatasia; requires 2 nucleotides substitutions). /FTId=VAR_013992. |
| 327 | F -> L (in hypophosphatasia; childhood). / FTId=VAR_006165. |
| 334 | G -> D (in hypophosphatasia). /FTId=VAR_006166. |
| 348 | A -> T (in hypophosphatasia). /FTId=VAR_011086. |
| 378 | D -> V (in hypophosphatasia; loss of activity). / FTId=VAR_006167. |
| 381 | H -> R (in hypophosphatasia). /FTId=VAR_011087. |
| 382 | V -> I (in hypophosphatasia). /FTId=VAR_006168. |
| 391 | R -> C (in hypophosphatasia; moderate; 10% of activity). / FTId=VAR_013993. |
| 399 | A -> S (in hypophosphatasia). /FTId=VAR_013994. |
| 406 | D -> G (in hypophosphatasia; 15% of activity). / FTId=VAR_011088. |
| 423 | V -> A (in hypophosphatasia; 16% of activity). / FTId=VAR_013995. |
| 426 | G -> C (in hypophosphatasia; infantile; partial loss of activity). /FTId=VAR_011089. |
| 436 | Y -> H (in hypophosphatasia). /FTId=VAR_006169. |
| 445 | S -> P (in hypophosphatasia; severe; 2% of activity). / FTId=VAR_013996. |
| 450 | R -> C (in hypophosphatasia; severe; 4% of activity). / FTId=VAR_013997. |
| 450 | R -> H (in hypophosphatasia). /FTId=VAR_011090. |
| 456 | G -> R (in hypophosphatasia; loss of activity). / FTId=VAR_011091. |
| 459 | V -> M (in hypophosphatasia; infantile). / FTId=VAR_013998. |
| 473 | G -> S (in hypophosphatasia). /FTId=VAR_013999. |
| 476 | E -> K (in hypophosphatasia). /FTId=VAR_006170. |

TABLE 2527-continued

Amino acid mutations for Known Protein

| SNP position(s) on amino acid sequence | Comment |
|---|---|
| 478 | N -> I (in hypophosphatasia; 9% of activity). / FTId=VAR_011092. |
| 489 | C -> S (in hypophosphatasia; 9% of activity). / FTId=VAR_011093. |
| 490 | I -> F (in hypophosphatasia; odonto; partial loss of activity). /FTId=VAR_014000. |
| 491 | G -> R (in hypophosphatasia). /FTId=VAR_014001. |
| 522 | V -> A. /FTId=VAR_011094. |
| 29 | W -> A |
| 104 | N -> K |

Protein Alkaline phosphatase, tissue-nonspecific isozyme precursor localization is believed to be Attached to the membrane by a GPI-anchor.

The following GO Annotation(s) apply to the previously known protein. The following annotation(s) were found: skeletal development; ossification; metabolism, which are annotation(s) related to Biological Process; magnesium binding; alkaline phosphatase; hydrolase, which are annotation(s) related to Molecular Function; and integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 2528.

TABLE 2528

Oligonucleotides related to this cluster

| Oligonucleotide name | Overexpressed in cancers | Chip reference |
|---|---|---|
| HSAPHOL_0_11_0 | ovarian carcinoma | OVA |

As noted above, cluster HSAPHOL features 20 segment(s), which were listed in Table 2525 above and for which the sequence(s) are given at the end of the application. These segment(s) are portions of nucleic acid sequence(s) which are described herein separately because they are of particular interest. A description of each segment according to the present invention is now provided.

Segment cluster HSAPHOL_node_0 (SEQ ID NO:2677) according to the present invention is supported by 2 libraries. The number of libraries was determined as previously described. This segment can be found in the following transcript(s): HSAPHOL_T3 (SEQ ID NO:2675). Table 2529 below describes the starting and ending position of this segment on each transcript.

TABLE 2529

| Segment location on transcripts | | |
|---|---|---|
| Transcript name | Segment starting position | Segment ending position |
| HSAPHOL_T3 (SEQ ID NO: 2675) | 1 | 187 |

This segment can be found in a non-coding region of transcript(s) that are related to the following protein(s): HSAPHOL_P1.

Segment cluster HSAPHOL_node_2 (SEQ ID NO:2678) according to the present invention is supported by 33 libraries. The number of libraries was determined as previously described. This segment can be found in the following transcript(s): HSAPHOL_T2 (SEQ ID NO:2674). Table 2530 below describes the starting and ending position of this segment on each transcript.

TABLE 2530

| Segment location on transcripts | | |
|---|---|---|
| Transcript name | Segment starting position | Segment ending position |
| HSAPHOL_T2 (SEQ ID NO: 2674) | 1 | 148 |

This segment can be found in a non-coding region of transcript(s) that are related to the following protein(s): HSAPHOL_P1.

Segment cluster HSAPHOL_node_6 (SEQ ID NO:2679) according to the present invention is supported by 2 libraries. The number of libraries was determined as previously described. This segment can be found in the following transcript(s): HSAPHOL_T2 (SEQ ID NO:2674). Table 2531 below describes the starting and ending position of this segment on each transcript.

TABLE 2531

| Segment location on transcripts | | |
|---|---|---|
| Transcript name | Segment starting position | Segment ending position |
| HSAPHOL_T2 (SEQ ID NO: 2674) | 149 | 280 |

This segment can be found in a non-coding region of transcript(s) that are related to the following protein(s): HSAPHOL_P1.

Segment cluster HSAPHOL_node_11 (SEQ ID NO:2680) according to the present invention is supported by 48 libraries. The number of libraries was determined as previously described. This segment can be found in the following transcript(s): HSAPHOL_T2 (SEQ ID NO:2674) and HSAPHOL_T3 (SEQ ID NO:2675). Table 2532 below describes the starting and ending position of this segment on each transcript.

TABLE 2532

| Segment location on transcripts | | |
|---|---|---|
| Transcript name | Segment starting position | Segment ending position |
| HSAPHOL_T2 (SEQ ID NO: 2674) | 281 | 445 |
| HSAPHOL_T3 (SEQ ID NO: 2675) | 188 | 352 |

This segment can be found in the following protein(s): HSAPHOL_P1.

Segment cluster HSAPHOL_node_13 (SEQ ID NO:2681) according to the present invention is supported by 50 libraries. The number of libraries was determined as previously described. This segment can be found in the following transcript(s): HSAPHOL_T2 (SEQ ID NO:2674) and HSAPHOL_T3 (SEQ ID NO:2675). Table 2533 below describes the starting and ending position of this segment on each transcript.

TABLE 2533

| Segment location on transcripts | | |
|---|---|---|
| Transcript name | Segment starting position | Segment ending position |
| HSAPHOL_T2 (SEQ ID NO: 2674) | 446 | 565 |
| HSAPHOL_T3 (SEQ ID NO: 2675) | 353 | 472 |

This segment can be found in the following protein(s): HSAPHOL_P1.

Segment cluster HSAPHOL_node_19 (SEQ ID NO:2682) according to the present invention is supported by 46 libraries. The number of libraries was determined as previously described. This segment can be found in the following transcript(s): HSAPHOL_T2 (SEQ ID NO:2674) and HSAPHOL_T3 (SEQ ID NO:2675). Table 2534 below describes the starting and ending position of this segment on each transcript.

TABLE 2534

| Segment location on transcripts | | |
|---|---|---|
| Transcript name | Segment starting position | Segment ending position |
| HSAPHOL_T2 (SEQ ID NO: 2674) | 682 | 856 |
| HSAPHOL_T3 (SEQ ID NO: 2675) | 589 | 763 |

This segment can be found in the following protein(s): HSAPHOL_P1.

Segment cluster HSAPHOL_node_21 (SEQ ID NO:2683) according to the present invention is supported by 45 libraries. The number of libraries was determined as previously described. This segment can be found in the following transcript(s): HSAPHOL_T2 (SEQ ID NO:2674) and HSAPHOL_T3 (SEQ ID NO:2675). Table 2535 below describes the starting and ending position of this segment on each transcript.

TABLE 2535

| Segment location on transcripts | | |
|---|---|---|
| Transcript name | Segment starting position | Segment ending position |
| HSAPHOL_T2 (SEQ ID NO: 2674) | 857 | 1032 |
| HSAPHOL_T3 (SEQ ID NO: 2675) | 764 | 939 |

This segment can be found in the following protein(s): HSAPHOL_P1.

Segment cluster HSAPHOL_node_23 (SEQ ID NO:2684) according to the present invention is supported by 45 libraries. The number of libraries was determined as previously described. This segment can be found in the following transcript(s): HSAPHOL_T2 (SEQ ID NO:2674) and HSA- PHOL_T3 (SEQ ID NO:2675). Table 2536 below describes the starting and ending position of this segment on each transcript.

TABLE 2536

Segment location on transcripts

| Transcript name | Segment starting position | Segment ending position |
|---|---|---|
| HSAPHOL_T2 (SEQ ID NO: 2674) | 1033 | 1176 |
| HSAPHOL_T3 (SEQ ID NO: 2675) | 940 | 1083 |

This segment can be found in the following protein(s): HSAPHOL_P1.

Segment cluster HSAPHOL_node_28 (SEQ ID NO:2685) according to the present invention is supported by 44 libraries. The number of libraries was determined as previously described. This segment can be found in the following transcript(s): HSAPHOL_T2 (SEQ ID NO:2674) and HSAPHOL_T3 (SEQ ID NO:2675). Table 2537 below describes the starting and ending position of this segment on each transcript.

TABLE 2537

Segment location on transcripts

| Transcript name | Segment starting position | Segment ending position |
|---|---|---|
| HSAPHOL_T2 (SEQ ID NO: 2674) | 1247 | 1381 |
| HSAPHOL_T3 (SEQ ID NO: 2675) | 1154 | 1288 |

This segment can be found in the following protein(s): HSAPHOL_P1.

Segment cluster HSAPHOL_node_32 (SEQ ID NO:2686) according to the present invention is supported by 6 libraries. The number of libraries was determined as previously described. This segment can be found in the following transcript(s): HSAPHOL_T12 (SEQ ID NO:2676). Table 2538 below describes the starting and ending position of this segment on each transcript.

TABLE 2538

Segment location on transcripts

| Transcript name | Segment starting position | Segment ending position |
|---|---|---|
| HSAPHOL_T12 (SEQ ID NO: 2676) | 1 | 516 |

This segment can be found in a non-coding region of transcript(s) that are related to the following protein(s): HSAPHOL_P9.

Segment cluster HSAPHOL_node_38 (SEQ ID NO:2687) according to the present invention is supported by 45 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2539 below describes the starting and ending position of this segment on each transcript.

TABLE 2539

Segment location on transcripts

| Transcript name | Segment starting position | Segment ending position |
|---|---|---|
| HSAPHOL_T2 (SEQ ID NO: 2674) | 1574 | 1693 |
| HSAPHOL_T3 (SEQ ID NO: 2675) | 1481 | 1600 |
| HSAPHOL_T12 (SEQ ID NO: 2676) | 782 | 901 |

This segment can be found in the following protein(s): HSAPHOL_P1 and HSAPHOL_P9.

Segment cluster HSAPHOL_node_40 (SEQ ID NO:2688) according to the present invention is supported by 69 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2540 below describes the starting and ending position of this segment on each transcript.

TABLE 2540

Segment location on transcripts

| Transcript name | Segment starting position | Segment ending position |
|---|---|---|
| HSAPHOL_T2 (SEQ ID NO: 2674) | 1694 | 2056 |
| HSAPHOL_T3 (SEQ ID NO: 2675) | 1601 | 1963 |
| HSAPHOL_T12 (SEQ ID NO: 2676) | 902 | 1264 |

This segment can be found in the following protein(s): HSAPHOL_P1 and HSAPHOL_P9.

Segment cluster HSAPHOL_node_42 (SEQ ID NO:2689) according to the present invention is supported by 99 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2541 below describes the starting and ending position of this segment on each transcript.

TABLE 2541

Segment location on transcripts

| Transcript name | Segment starting position | Segment ending position |
|---|---|---|
| HSAPHOL_T2 (SEQ ID NO: 2674) | 2167 | 2723 |
| HSAPHOL_T3 (SEQ ID NO: 2675) | 2074 | 2630 |
| HSAPHOL_T12 (SEQ ID NO: 2676) | 1375 | 1931 |

This segment can be found in a non-coding region of transcript(s) that are related to the following protein(s): HSAPHOL_P1 and HSAPHOL_P9.

According to an optional embodiment of the present invention, short segments related to the above cluster are also provided. These segments are up to about 120 bp in length, and so are included in a separate description.

Segment cluster HSAPHOL_node_16 (SEQ ID NO:2690) according to the present invention is supported by 46 libraries. The number of libraries was determined as previously described. This segment can be found in the following transcript(s): HSAPHOL_T2 (SEQ ID NO:2674) and HSA- PHOL_T3 (SEQ ID NO:2675). Table 2542 below describes the starting and ending position of this segment on each transcript.

TABLE 2542

Segment location on transcripts

| Transcript name | Segment starting position | Segment ending position |
|---|---|---|
| HSAPHOL_T2 (SEQ ID NO: 2674) | 566 | 681 |
| HSAPHOL_T3 (SEQ ID NO: 2675) | 473 | 588 |

This segment can be found in the following protein(s): HSAPHOL_P1.

Segment cluster HSAPHOL_node_25 (SEQ ID NO:2691) according to the present invention is supported by 39 libraries. The number of libraries was determined as previously described. This segment can be found in the following transcript(s): HSAPHOL_T2 (SEQ ID NO:2674) and HSAPHOL_T3 (SEQ ID NO:2675). Table 2543 below describes the starting and ending position of this segment on each transcript.

TABLE 2543

Segment location on transcripts

| Transcript name | Segment starting position | Segment ending position |
|---|---|---|
| HSAPHOL_T2 (SEQ ID NO: 2674) | 1177 | 1246 |
| HSAPHOL_T3 (SEQ ID NO: 2675) | 1084 | 1153 |

This segment can be found in the following protein(s): HSAPHOL_P1.

Segment cluster HSAPHOL_node_33 (SEQ ID NO:2692) according to the present invention is supported by 5 libraries. The number of libraries was determined as previously described. This segment can be found in the following transcript(s): HSAPHOL_T12 (SEQ ID NO:2676). Table 2544 below describes the starting and ending position of this segment on each transcript.

TABLE 2544

Segment location on transcripts

| Transcript name | Segment starting position | Segment ending position |
|---|---|---|
| HSAPHOL_T12 (SEQ ID NO: 2676) | 517 | 589 |

This segment can be found in a non-coding region of transcript(s) that are related to the following protein(s): HSAPHOL_P9.

Segment cluster HSAPHOL_node_34 (SEQ ID NO:2693) according to the present invention is supported by 48 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2545 below describes the starting and ending position of this segment on each transcript.

TABLE 2545

Segment location on transcripts

| Transcript name | Segment starting position | Segment ending position |
|---|---|---|
| HSAPHOL_T2 (SEQ ID NO: 2674) | 1382 | 1452 |
| HSAPHOL_T3 (SEQ ID NO: 2675) | 1289 | 1359 |
| HSAPHOL_T12 (SEQ ID NO: 2676) | 590 | 660 |

This segment can be found in the following protein(s): HSAPHOL_P1 and HSAPHOL_P9.

Segment cluster HSAPHOL_node_35 (SEQ ID NO:2694) according to the present invention is supported by 51 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2546 below describes the starting and ending position of this segment on each transcript.

TABLE 2546

Segment location on transcripts

| Transcript name | Segment starting position | Segment ending position |
|---|---|---|
| HSAPHOL_T2 (SEQ ID NO: 2674) | 1453 | 1518 |
| HSAPHOL_T3 (SEQ ID NO: 2675) | 1360 | 1425 |
| HSAPHOL_T12 (SEQ ID NO: 2676) | 661 | 726 |

This segment can be found in the following protein(s): HSAPHOL_P1 and HSAPHOL_P9.

Segment cluster HSAPHOL_node_36 (SEQ ID NO:2695) according to the present invention is supported by 47 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2547 below describes the starting and ending position of this segment on each transcript.

TABLE 2547

Segment location on transcripts

| Transcript name | Segment starting position | Segment ending position |
|---|---|---|
| HSAPHOL_T2 (SEQ ID NO: 2674) | 1519 | 1573 |
| HSAPHOL_T3 (SEQ ID NO: 2675) | 1426 | 1480 |
| HSAPHOL_T12 (SEQ ID NO: 2676) | 727 | 781 |

This segment can be found in the following protein(s): HSAPHOL_P1 and HSAPHOL_P9.

Segment cluster HSAPHOL_node_41 (SEQ ID NO:2696) according to the present invention is supported by 60 libraries. The number of libraries was determined as previously described. This segment can be found in the following transcript(s): HSAPHOL_T2 (SEQ ID NO:2674), HSAPHOL_T3 (SEQ ID NO:2675) and HSAPHOL_T12 (SEQ ID NO:2676). Table 2548 below describes the starting and ending position of this segment on each transcript.

TABLE 2548

Segment location on transcripts

| Transcript name | Segment starting position | Segment ending position |
|---|---|---|
| HSAPHOL_T2 (SEQ ID NO: 2674) | 2057 | 2166 |
| HSAPHOL_T3 (SEQ ID NO: 2675) | 1964 | 2073 |
| HSAPHOL_T12 (SEQ ID NO: 2676) | 1265 | 1374 |

This segment can be found in a non-coding region of transcript(s) that are related to the following protein(s): HSAPHOL_P1 and HSAPHOL_P9.

Description for Cluster HSCDC2

Cluster HSCDC2 features 8 transcript(s) and 20 segment(s) of interest, the names for which are given in Tables 1 and 2, respectively, the sequences themselves are given at the end of the application. The selected protein variants are given in Table 2551.

TABLE 2549

Transcripts of interest
Transcript Name

HSCDC2_T0 (SEQ ID NO: 2697)
HSCDC2_T1 (SEQ ID NO: 2698)
HSCDC2_T4 (SEQ ID NO: 2699)
HSCDC2_T5 (SEQ ID NO: 2700)
HSCDC2_T9 (SEQ ID NO: 2701)
HSCDC2_T10 (SEQ ID NO: 2702)
HSCDC2_T11 (SEQ ID NO: 2703)
HSCDC2_T14 (SEQ ID NO: 2704)

TABLE 2550

Segments of interest
Segment Name

HSCDC2_node_6 (SEQ ID NO: 2705)
HSCDC2_node_8 (SEQ ID NO: 2706)
HSCDC2_node_16 (SEQ ID NO: 2707)
HSCDC2_node_18 (SEQ ID NO: 2708)
HSCDC2_node_20 (SEQ ID NO: 2709)
HSCDC2_node_23 (SEQ ID NO: 2710)
HSCDC2_node_25 (SEQ ID NO: 2711)
HSCDC2_node_27 (SEQ ID NO: 2712)
HSCDC2_node_0 (SEQ ID NO: 2713)
HSCDC2_node_1 (SEQ ID NO: 2714)
HSCDC2_node_2 (SEQ ID NO: 2715)
HSCDC2_node_4 (SEQ ID NO: 2716)
HSCDC2_node_10 (SEQ ID NO: 2717)
HSCDC2_node_12 (SEQ ID NO: 2718)
HSCDC2_node_13 (SEQ ID NO: 2719)
HSCDC2_node_14 (SEQ ID NO: 2720)
HSCDC2_node_21 (SEQ ID NO: 2721)
HSCDC2_node_22 (SEQ ID NO: 2722)
HSCDC2_node_24 (SEQ ID NO: 2723)
HSCDC2_node_26 (SEQ ID NO: 2724)

TABLE 2551

Proteins of interest

| Protein Name | Corresponding Transcript(s) |
|---|---|
| HSCDC2_P1 | HSCDC2_T0 (SEQ ID NO: 2697); HSCDC2_T1 (SEQ ID NO: 2698); HSCDC2_T4 (SEQ ID NO: 2699); HSCDC2_T5 (SEQ ID NO: 2700) |
| HSCDC2_P3 | HSCDC2_T9 (SEQ ID NO: 2701) |
| HSCDC2_P4 | HSCDC2_T10 (SEQ ID NO: 2702) |
| HSCDC2_P5 | HSCDC2_T11 (SEQ ID NO: 2703) |

These sequences are variants of the known protein Cell division control protein 2 homolog (SwissProt accession identifier CDC2_HUMAN; known also according to the synonyms EC 2.7.1.-; p34 protein kinase; Cyclin-dependent kinase 1; CDK1), referred to herein as the previously known protein.

Protein Cell division control protein 2 homolog is known or believed to have the following function(s): Plays a key role in the control of the eukaryotic cell cycle. It is required in higher cells for entry into S-phase and mitosis. p34 is a component of the kinase complex that phosphorylates the repetitive carboxyl-terminus of RNA polymerase II. The sequence for protein Cell division control protein 2 homolog is given at the end of the application, as "Cell division control protein 2 homolog amino acid sequence". Known polymorphisms for this sequence are as shown in Table 2552.

TABLE 2552

Amino acid mutations for Known Protein

| SNP position(s) on amino acid sequence | Comment |
|---|---|
| 107-163 | Missing (in CDC2deltaT). /FTId = VAR_011629. |

Protein Cell division control protein 2 homolog localization is believed to be Nuclear (By similarity).

The following GO Annotation(s) apply to the previously known protein. The following annotation(s) were found: protein amino acid phosphorylation; mitosis; start control point of mitotic cell cycle, which are annotation(s) related to Biological Process; cyclin-dependent protein kinase; ATP binding; transferase, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSCDC2 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 67 refer to weighted expression of ESTs in each category, as "parts per million" (ratio of the expression of ESTs for a particular cluster to the expression of all ESTs in that category, according to parts per million).

Overall, the following results were obtained as shown with regard. to the histograms in FIG. 67 and Table 2553. This cluster is overexpressed (at least at a minimum level) in the following pathological conditions: brain malignant tumors, epithelial malignant tumors, a mixture of malignant tumors from different tissues and breast malignant tumors.

TABLE 2553

Normal tissue distribution

| Name of Tissue | Number |
|---|---|
| adrenal | 4 |
| bladder | 0 |
| Bone | 0 |
| Brain | 3 |
| Colon | 69 |
| epithelial | 7 |
| general | 20 |
| head and neck | 0 |
| kidney | 24 |
| liver | 0 |
| lung | 4 |
| lymph nodes | 194 |
| breast | 0 |
| bone marrow | 0 |
| muscle | 25 |
| ovary | 0 |
| pancreas | 0 |
| prostate | 0 |
| skin | 1 |
| stomach | 0 |
| T cells | 0 |
| uterus | 0 |

TABLE 2554

P values and ratios for expression in cancerous tissue

| Name of Tissue | P1 | P2 | SP1 | R3 | SP2 | R4 |
|---|---|---|---|---|---|---|
| adrenal | 9.2e−01 | 6.9e−01 | 1 | 0.9 | 2.9e−01 | 2.5 |
| bladder | 1 | 6.0e−01 | 1 | 1.0 | 3.2e−01 | 1.9 |
| bone | 1 | 1.0e−01 | 1 | 1.0 | 2.4e−01 | 2.6 |
| brain | 9.6e−01 | 1.3e−01 | 1 | 0.5 | 6.3e−03 | 6.3 |
| colon | 7.3e−01 | 6.4e−01 | 9.1e−01 | 0.7 | 8.0e−01 | 0.9 |
| epithelial | 1.2e−02 | 3.3e−05 | 1.9e−03 | 3.2 | 2.2e−08 | 5.4 |
| general | 5.7e−04 | 2.8e−10 | 2.7e−03 | 1.7 | 8.7e−11 | 2.8 |
| head and neck | 1 | 5.0e−01 | 1 | 1.0 | 5.6e−01 | 1.7 |
| kidney | 8.9e−01 | 8.4e−01 | 6.2e−01 | 1.2 | 5.3e−01 | 1.4 |
| liver | 1 | 4.5e−01 | 1 | 1.0 | 4.8e−01 | 1.9 |
| lung | 3.5e−01 | 2.1e−01 | 1.7e−01 | 3.0 | 5.5e−02 | 3.5 |
| lymph nodes | 6.9e−01 | 7.8e−01 | 9.0e−01 | 0.5 | 9.7e−01 | 0.4 |
| breast | 1.9e−02 | 3.4e−03 | 3.3e−01 | 2.4 | 1.4e−01 | 3.0 |
| bone marrow | 1 | 2.5e−01 | 1 | 1.0 | 2.3e−02 | 5.4 |
| muscle | 2.9e−01 | 1.6e−01 | 1 | 1.4 | 6.3e−01 | 1.3 |
| ovary | 6.2e−01 | 2.6e−01 | 4.7e−01 | 1.9 | 2.0e−01 | 2.8 |
| pancreas | 3.3e−01 | 4.4e−01 | 1.8e−01 | 3.7 | 2.8e−01 | 2.8 |
| prostate | 7.3e−01 | 4.6e−01 | 6.7e−01 | 1.5 | 2.4e−01 | 2.7 |
| skin | 9.2e−01 | 4.0e−01 | 1 | 0.9 | 1.1e−01 | 2.4 |
| stomach | 3.0e−01 | 2.7e−01 | 5.0e−01 | 2.0 | 4.1e−01 | 2.0 |
| T cells | 1 | 6.7e−01 | 1 | 1.0 | 3.7e−01 | 1.8 |
| uterus | 8.2e−02 | 4.5e−02 | 2.9e−01 | 2.5 | 3.6e−02 | 3.8 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 2555.

TABLE 2555

Oligonucleotides related to this cluster

| Oligonucleotide name | Overexpressed in cancers | Chip reference |
|---|---|---|
| HSCDC2_0_0_9755 | breast malignant tumors | BRS |
| HSCDC2_0_0_9755 | Colorectal cancer | Colon |
| HSCDC2_0_0_9755 | lung malignant tumors | LUN |

TABLE 2555-continued

Oligonucleotides related to this cluster

| Oligonucleotide name | Overexpressed in cancers | Chip reference |
|---|---|---|
| HSCDC2_0_0_9756 | breast malignant tumors | BRS |
| HSCDC2_0_0_9756 | lung malignant tumors | LUN |
| HSCDC2_0_0_9758 | Colorectal cancer | Colon |
| HSCDC2_0_0_9758 | lung malignant tumors | LUN |
| HSCDC2_0_0_9744 | lung malignant tumors | LUN |
| HSCDC2_0_0_9757 | lung malignant tumors | LUN |
| HSCDC2_0_0_9757 | ovarian carcinoma | OVA |

As noted above, cluster HSCDC2 features 20 segment(s), which were listed in Table 2550 above and for which the sequence(s) are given at the end of the application. These segment(s) are portions of nucleic acid sequence(s) which are described herein separately because they are of particular interest. A description of each segment according to the present invention is now provided.

Segment cluster HSCDC2_node_6 (SEQ ID NO:2705) according to the present invention is supported by 82 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T10 (SEQ ID NO:2702) and HSCDC2_T11 (SEQ ID NO:2703). Table 2556 below describes the starting and ending position of this segment on each transcript.

TABLE 2556

Segment location on transcripts

| Transcript name | Segment starting position | Segment ending position |
|---|---|---|
| HSCDC2_T0 (SEQ ID NO: 2697) | 292 | 448 |
| HSCDC2_T1 (SEQ ID NO: 2698) | 292 | 448 |
| HSCDC2_T4 (SEQ ID NO: 2699) | 390 | 546 |
| HSCDC2_T5 (SEQ ID NO: 2700) | 181 | 337 |
| HSCDC2_T10 (SEQ ID NO: 2702) | 292 | 448 |
| HSCDC2_T11 (SEQ ID NO: 2703) | 292 | 448 |

This segment can be found in the following protein(s): HSCDC2_P1, HSCDC2_P4 and HSCDC2_P5.

Segment cluster HSCDC2_node_8 (SEQ ID NO:2706) according to the present invention is supported by 90 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702) and HSCDC2_T11 (SEQ ID NO:2703). Table 2557 below describes the starting and ending position of this segment on each transcript.

TABLE 2557

Segment location on transcripts

| Transcript name | Segment starting position | Segment ending position |
|---|---|---|
| HSCDC2_T0 (SEQ ID NO: 2697) | 449 | 572 |
| HSCDC2_T1 (SEQ ID NO: 2698) | 449 | 572 |

TABLE 2557-continued

Segment location on transcripts

| Transcript name | Segment starting position | Segment ending position |
|---|---|---|
| HSCDC2_T4 (SEQ ID NO: 2699) | 547 | 670 |
| HSCDC2_T5 (SEQ ID NO: 2700) | 338 | 461 |
| HSCDC2_T9 (SEQ ID NO: 2701) | 390 | 513 |
| HSCDC2_T10 (SEQ ID NO: 2702) | 449 | 572 |
| HSCDC2_T11 (SEQ ID NO: 2703) | 449 | 572 |

This segment can be found in the following protein(s): HSCDC2_P1, HSCDC2_P3, HSCDC2_P4 and HSCDC2_P5.

Segment cluster HSCDC2_node_16 (SEQ ID NO:2707) according to the present invention is supported by 100 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702) and HSCDC2_T11 (SEQ ID NO:2703). Table 2558 below describes the starting and ending position of this segment on each transcript.

TABLE 2558

Segment location on transcripts

| Transcript name | Segment starting position | Segment ending position |
|---|---|---|
| HSCDC2_T0 (SEQ ID NO: 2697) | 744 | 907 |
| HSCDC2_T1 (SEQ ID NO: 2698) | 744 | 907 |
| HSCDC2_T4 (SEQ ID NO: 2699) | 842 | 1005 |
| HSCDC2_T5 (SEQ ID NO: 2700) | 633 | 796 |
| HSCDC2_T9 (SEQ ID NO: 2701) | 685 | 848 |
| HSCDC2_T10 (SEQ ID NO: 2702) | 778 | 941 |
| HSCDC2_T11 (SEQ ID NO: 2703) | 573 | 736 |

This segment can be found in both coding and non-coding regions of transcript(s) as follows. The segment can be found in a non-coding region of transcript(s) that are related to the following protein(s): HSCDC2_P4. This segment can also be found in the following protein(s): HSCDC2_P1, HSCDC2_P3 and HSCDC2_P5, since it is in the coding region for the corresponding transcript.

Segment cluster HSCDC2_node_18 (SEQ ID NO:2708) according to the present invention is supported by 90 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702) and HSCDC2_T11 (SEQ ID NO:2703). Table 2559 below describes the starting and ending position of this segment on each transcript.

TABLE 2559

Segment location on transcripts

| Transcript name | Segment starting position | Segment ending position |
|---|---|---|
| HSCDC2_T0 (SEQ ID NO: 2697) | 908 | 1049 |
| HSCDC2_T1 (SEQ ID NO: 2698) | 908 | 1049 |

TABLE 2559-continued

Segment location on transcripts

| Transcript name | Segment starting position | Segment ending position |
|---|---|---|
| HSCDC2_T4 (SEQ ID NO: 2699) | 1006 | 1147 |
| HSCDC2_T5 (SEQ ID NO: 2700) | 797 | 938 |
| HSCDC2_T9 (SEQ ID NO: 2701) | 849 | 990 |
| HSCDC2_T10 (SEQ ID NO: 2702) | 942 | 1083 |
| HSCDC2_T11 (SEQ ID NO: 2703) | 737 | 878 |

This segment can be found in both coding and non-coding regions of transcript(s) as follows. The segment can be found in a non-coding region of transcript(s) that are related to the following protein(s): HSCDC2_P4. This segment can also be found in the following protein(s): HSCDC2_P1, HSCDC2_P3 and HSCDC2_P5, since it is in the coding region for the corresponding transcript.

Segment cluster HSCDC2_node_20 (SEQ ID NO:2709) according to the present invention is supported by 3 libraries. The number of libraries was determined as previously described. This segment can be found in the following transcript(s): HSCDC2_T14 (SEQ ID NO:2704). Table 2560 below describes the starting and ending position of this segment on each transcript.

TABLE 2560

Segment location on transcripts

| Transcript name | Segment starting position | Segment ending position |
|---|---|---|
| HSCDC2_T14 (SEQ ID NO: 2704) | 1 | 1402 |

The previously-described transcripts for these segment(s) do not code for protein.

Segment cluster HSCDC2_node_23 (SEQ ID NO:2710) according to the present invention is supported by 100 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2561 below describes the starting and ending position of this segment on each transcript.

TABLE 2561

Segment location on transcripts

| Transcript name | Segment starting position | Segment ending position |
|---|---|---|
| HSCDC2_T0 (SEQ ID NO: 2697) | 1208 | 1485 |
| HSCDC2_T1 (SEQ ID NO: 2698) | 1208 | 1485 |
| HSCDC2_T4 (SEQ ID NO: 2699) | 1306 | 1583 |
| HSCDC2_T5 (SEQ ID NO: 2700) | 1097 | 1374 |
| HSCDC2_T9 (SEQ ID NO: 2701) | 1149 | 1426 |
| HSCDC2_T10 (SEQ ID NO: 2702) | 1242 | 1519 |
| HSCDC2_T11 (SEQ ID NO: 2703) | 1037 | 1314 |
| HSCDC2_T14 (SEQ ID NO: 2704) | 1561 | 1838 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node__25 (SEQ ID NO:2711) according to the present invention is supported by 71 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T11 (SEQ ID NO:2702), HSCDC2_T11 (SEQ ID NO:2703) and HSCDC2_T14 (SEQ ID NO:2704). Table 2562 below describes the starting and ending position of this segment on each transcript.

TABLE 2562

Segment location on transcripts

| Transcript name | Segment starting position | Segment ending position |
|---|---|---|
| HSCDC2_T0 (SEQ ID NO: 2697) | 1540 | 1736 |
| HSCDC2_T1 (SEQ ID NO: 2698) | 1540 | 1736 |
| HSCDC2_T4 (SEQ ID NO: 2699) | 1638 | 1834 |
| HSCDC2_T5 (SEQ ID NO: 2700) | 1429 | 1625 |
| HSCDC2_T9 (SEQ ID NO: 2701) | 1481 | 1677 |
| HSCDC2_T10 (SEQ ID NO: 2702) | 1574 | 1770 |
| HSCDC2_T11 (SEQ ID NO: 2703) | 1369 | 1565 |
| HSCDC2_T14 (SEQ ID NO: 2704) | 1893 | 2089 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node__27 (SEQ ID NO:2712) according to the present invention is supported by 67 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2563 below describes the starting and ending position of this segment on each transcript.

TABLE 2563

Segment location on transcripts

| Transcript name | Segment starting position | Segment ending position |
|---|---|---|
| HSCDC2_T0 (SEQ ID NO: 2697) | 1791 | 2021 |
| HSCDC2_T1 (SEQ ID NO: 2698) | 1791 | 2632 |
| HSCDC2_T4 (SEQ ID NO: 2699) | 1889 | 2119 |
| HSCDC2_T5 (SEQ ID NO: 2700) | 1680 | 1910 |
| HSCDC2_T9 (SEQ ID NO: 2701) | 1732 | 1962 |
| HSCDC2_T10 (SEQ ID NO: 2702) | 1825 | 2055 |
| HSCDC2_T11 (SEQ ID NO: 2703) | 1620 | 1850 |
| HSCDC2_T14 (SEQ ID NO: 2704) | 2144 | 2374 |

This segment can be found in a non-coding region of transcript(s) that are related to the following protein(s): HSCDC2_P1, HSCDC2_P3, HSCDC2_P4 and HSCDC2_P5.

According to an optional embodiment of the present invention, short segments related to the above cluster are also provided. These segments are up to about 120 bp in length, and so are included in a separate description.

Segment cluster HSCDC2_node__0 (SEQ ID NO:2713) according to the present invention is supported by 2 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702) and HSCDC2_T11 (SEQ ID NO:2703). Table 2564 below describes the starting and ending position of this segment on each transcript.

TABLE 2564

Segment location on transcripts

| Transcript name | Segment starting position | Segment ending position |
|---|---|---|
| HSCDC2_T0 (SEQ ID NO: 2697) | 1 | 118 |
| HSCDC2_T1 (SEQ ID NO: 2698) | 1 | 118 |
| HSCDC2_T4 (SEQ ID NO: 2699) | 1 | 118 |
| HSCDC2_T5 (SEQ ID NO: 2700) | 1 | 118 |
| HSCDC2_T9 (SEQ ID NO: 2701) | 1 | 118 |
| HSCDC2_T10 (SEQ ID NO: 2702) | 1 | 118 |
| HSCDC2_T11 (SEQ ID NO: 2703) | 1 | 118 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node__1 (SEQ ID NO:2714) according to the present invention is supported by 55 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T9 (SEQ ID NO:2701), HSCDC2_T10 (SEQ ID NO:2702) and HSCDC2_T11 (SEQ ID NO:2703). Table 2565 below describes the starting and ending position of this segment on each transcript.

TABLE 2565

Segment location on transcripts

| Transcript name | Segment starting position | Segment ending position |
|---|---|---|
| HSCDC2_T0 (SEQ ID NO: 2697) | 119 | 229 |
| HSCDC2_T1 (SEQ ID NO: 2698) | 119 | 229 |
| HSCDC2_T4 (SEQ ID NO: 2699) | 119 | 229 |
| HSCDC2_T9 (SEQ ID NO: 2701) | 119 | 229 |
| HSCDC2_T10 (SEQ ID NO: 2702) | 119 | 229 |
| HSCDC2_T11 (SEQ ID NO: 2703) | 119 | 229 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node__2 (SEQ ID NO:2715) according to the present invention is supported by 5 libraries. The number of libraries was determined as previously described. This segment can be found in the following transcript(s): HSCDC2_T4 (SEQ ID NO:2699) and HSCDC2_T9 (SEQ ID NO:2701). Table 2566 below describes the starting and ending position of this segment on each transcript.

TABLE 2566

Segment location on transcripts

| Transcript name | Segment starting position | Segment ending position |
|---|---|---|
| HSCDC2_T4 (SEQ ID NO: 2699) | 230 | 327 |
| HSCDC2_T9 (SEQ ID NO: 2701) | 230 | 327 |

This segment can be found in a non-coding region of transcript(s) that are related to the following protein(s): HSCDC2_P1 and HSCDC2_P3.

Segment cluster HSCDC2_node_4 (SEQ ID NO:2716) according to the present invention is supported by 70 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702) and HSCDC2_T11 (SEQ ID NO:2703). Table 2567 below describes the starting and ending position of this segment on each transcript.

TABLE 2567

Segment location on transcripts

| Transcript name | Segment starting position | Segment ending position |
|---|---|---|
| HSCDC2_T0 (SEQ ID NO: 2697) | 230 | 291 |
| HSCDC2_T1 (SEQ ID NO: 2698) | 230 | 291 |
| HSCDC2_T4 (SEQ ID NO: 2699) | 328 | 389 |
| HSCDC2_T5 (SEQ ID NO: 2700) | 119 | 180 |
| HSCDC2_T9 (SEQ ID NO: 2701) | 328 | 389 |
| HSCDC2_T10 (SEQ ID NO: 2702) | 230 | 291 |
| HSCDC2_T11 (SEQ ID NO: 2703) | 230 | 291 |

This segment can be found in both coding and non-coding regions of transcript(s) as follows. The segment can be found in a non-coding region of transcript(s) that are related to the following protein(s): HSCDC2_P3. This segment can also be found in the following protein(s): HSCDC2_P1, HSCDC2_P4 and HSCDC2_P5, since it is in the coding region for the corresponding transcript.

Segment cluster HSCDC2_node_10 (SEQ ID NO:2717) according to the present invention is supported by 10 libraries. The number of libraries was determined as previously described. This segment can be found in the following transcript(s): HSCDC2_T10 (SEQ ID NO:2702). Table 2568 below describes the starting and ending position of this segment on each transcript.

TABLE 2568

Segment location on transcripts

| Transcript name | Segment starting position | Segment ending position |
|---|---|---|
| HSCDC2_T10 (SEQ ID NO: 2702) | 573 | 606 |

This segment can be found in the following protein(s): HSCDC2_P4.

Segment cluster HSCDC2_node_12 (SEQ ID NO:2718) according to the present invention is supported by 87 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701) and HSCDC2_T10 (SEQ ID NO:2702). Table 2569 below describes the starting and ending position of this segment on each transcript.

TABLE 2569

Segment location on transcripts

| Transcript name | Segment starting position | Segment ending position |
|---|---|---|
| HSCDC2_T0 (SEQ ID NO: 2697) | 573 | 653 |
| HSCDC2_T1 (SEQ ID NO: 2698) | 573 | 653 |
| HSCDC2_T4 (SEQ ID NO: 2699) | 671 | 751 |
| HSCDC2_T5 (SEQ ID NO: 2700) | 462 | 542 |
| HSCDC2_T9 (SEQ ID NO: 2701) | 514 | 594 |
| HSCDC2_T10 (SEQ ID NO: 2702) | 607 | 687 |

This segment can be found in the following protein(s): HSCDC2_P1, HSCDC2_P3 and HSCDC2_P4.

Segment cluster HSCDC2_node_13 (SEQ ID NO:2719) according to the present invention is supported by 87 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701) and HSCDC2_T10 (SEQ ID NO:2702). Table 2570 below describes the starting and ending position of this segment on each transcript.

TABLE 2570

Segment location on transcripts

| Transcript name | Segment starting position | Segment ending position |
|---|---|---|
| HSCDC2_T0 (SEQ ID NO: 2697) | 654 | 706 |
| HSCDC2_T1 (SEQ ID NO: 2698) | 654 | 706 |
| HSCDC2_T4 (SEQ ID NO: 2699) | 752 | 804 |
| HSCDC2_T5 (SEQ ID NO: 2700) | 543 | 595 |
| HSCDC2_T9 (SEQ ID NO: 2701) | 595 | 647 |
| HSCDC2_T10 (SEQ ID NO: 2702) | 688 | 740 |

This segment can be found in both coding and non-coding regions of transcript(s) as follows. The segment can be found in a non-coding region of transcript(s) that are related to the following protein(s): HSCDC2_P4. This segment can also be found in the following protein(s): HSCDC2_P1 and HSCDC2_P3, since it is in the coding region for the corresponding transcript.

Segment cluster HSCDC2_node_14 (SEQ ID NO:2720) according to the present invention is supported by 83 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701) and HSCDC2_T10 (SEQ ID NO:2702). Table 2571 below describes the starting and ending position of this segment on each transcript.

TABLE 2571

Segment location on transcripts

| Transcript name | Segment starting position | Segment ending position |
|---|---|---|
| HSCDC2_T0 (SEQ ID NO: 2697) | 707 | 743 |
| HSCDC2_T1 (SEQ ID NO: 2698) | 707 | 743 |
| HSCDC2_T4 (SEQ ID NO: 2699) | 805 | 841 |
| HSCDC2_T5 (SEQ ID NO: 2700) | 596 | 632 |
| HSCDC2_T9 (SEQ ID NO: 2701) | 648 | 684 |
| HSCDC2_T10 (SEQ ID NO: 2702) | 741 | 777 |

This segment can be found in both coding and non-coding regions of transcript(s) as follows. The segment can be found in a non-coding region of transcript(s) that are related to the following protein(s): HSCDC2_P4. This segment can also be found in the following protein(s): HSCDC2_P1 and HSCDC2_P3, since it is in the coding region for the corresponding transcript.

Segment cluster HSCDC2_node_21 (SEQ ID NO:2721) according to the present invention is supported by 80 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2572 below describes the starting and ending position of this segment on each transcript.

TABLE 2572

Segment location on transcripts

| Transcript name | Segment starting position | Segment ending position |
|---|---|---|
| HSCDC2_T0 (SEQ ID NO: 2697) | 1050 | 1152 |
| HSCDC2_T1 (SEQ ID NO: 2698) | 1050 | 1152 |
| HSCDC2_T4 (SEQ ID NO: 2699) | 1148 | 1250 |
| HSCDC2_T5 (SEQ ID NO: 2700) | 939 | 1041 |
| HSCDC2_T9 (SEQ ID NO: 2701) | 991 | 1093 |
| HSCDC2_T10 (SEQ ID NO: 2702) | 1084 | 1186 |
| HSCDC2_T11 (SEQ ID NO: 2703) | 879 | 981 |
| HSCDC2_T14 (SEQ ID NO: 2704) | 1403 | 1505 |

This segment can be found in both coding and non-coding regions of transcript(s) as follows. The segment can be found in a non-coding region of transcript(s) that are related to the following protein(s): HSCDC2_P4. This segment can also be found in the following protein(s): HSCDC2_P1, HSCDC2_P3 and HSCDC2_P5, since it is in the coding region for the corresponding transcript.

Segment cluster HSCDC2_node_22 (SEQ ID NO:2722) according to the present invention is supported by 72 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2573 below describes the starting and ending position of this segment on each transcript.

TABLE 2573

Segment location on transcripts

| Transcript name | Segment starting position | Segment ending position |
|---|---|---|
| HSCDC2_T0 (SEQ ID NO: 2697) | 1153 | 1207 |
| HSCDC2_T1 (SEQ ID NO: 2698) | 1153 | 1207 |
| HSCDC2_T4 (SEQ ID NO: 2699) | 1251 | 1305 |
| HSCDC2_T5 (SEQ ID NO: 2700) | 1042 | 1096 |
| HSCDC2_T9 (SEQ ID NO: 2701) | 1094 | 1148 |
| HSCDC2_T10 (SEQ ID NO: 2702) | 1187 | 1241 |
| HSCDC2_T11 (SEQ ID NO: 2703) | 982 | 1036 |
| HSCDC2_T14 (SEQ ID NO: 2704) | 1506 | 1560 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node_24 (SEQ ID NO:2723) according to the present invention is supported by 53 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2574 below describes the starting and ending position of this segment on each transcript.

TABLE 2574

Segment location on transcripts

| Transcript name | Segment starting position | Segment ending position |
|---|---|---|
| HSCDC2_T0 (SEQ ID NO: 2697) | 1486 | 1539 |
| HSCDC2_T1 (SEQ ID NO: 2698) | 1486 | 1539 |
| HSCDC2_T4 (SEQ ID NO: 2699) | 1584 | 1637 |
| HSCDC2_T5 (SEQ ID NO: 2700) | 1375 | 1428 |
| HSCDC2_T9 (SEQ ID NO: 2701) | 1427 | 1480 |
| HSCDC2_T10 (SEQ ID NO: 2702) | 1520 | 1573 |
| HSCDC2_T11 (SEQ ID NO: 2703) | 1315 | 1368 |
| HSCDC2_T14 (SEQ ID NO: 2704) | 1839 | 1892 |

This segment can be found in a non-coding region of transcript(s) that are related to the following protein(s): HSCDC2_P1, HSCDC2_P3, HSCDC2_P4 and HSCDC2_P5.

Segment cluster HSCDC2_node_26 (SEQ ID NO:2724) according to the present invention is supported by 63 libraries. The number of libraries was determined as previously described. This segment can be found in the following transcript(s): HSCDC2_T0 (SEQ ID NO:2697), HSCDC2_T1 (SEQ ID NO:2698), HSCDC2_T4 (SEQ ID NO:2699), HSCDC2_T5 (SEQ ID NO:2700), HSCDC2_T9 (SEQ ID NO:2701), HSCDC2_T10 (SEQ ID NO:2702), HSCDC2_T11 (SEQ ID NO:2703) and HSCDC2_T14 (SEQ ID NO:2704). Table 2575 below describes the starting and ending position of this segment on each transcript.

TABLE 2575

Segment location on transcripts

| Transcript name | Segment starting position | Segment ending position |
|---|---|---|
| HSCDC2_T0 (SEQ ID NO: 2697) | 1737 | 1790 |
| HSCDC2_T1 (SEQ ID NO: 2698) | 1737 | 1790 |

TABLE 2575-continued

Segment location on transcripts

| Transcript name | Segment starting position | Segment ending position |
|---|---|---|
| HSCDC2_T4 (SEQ ID NO: 2699) | 1835 | 1888 |
| HSCDC2_T5 (SEQ ID NO: 2700) | 1626 | 1679 |
| HSCDC2_T9 (SEQ ID NO: 2701) | 1678 | 1731 |
| HSCDC2_T10 (SEQ ID NO: 2702) | 1771 | 1824 |
| HSCDC2_T11 (SEQ ID NO: 2703) | 1566 | 1619 |
| HSCDC2_T14 (SEQ ID NO: 2704) | 2090 | 2143 |

This segment can be found in a non-coding region of transcript(s) that are related to the following protein(s): HSCDC2_P1, HSCDC2_P3, HSCDC2_P4 and HSCDC2_P5.

Description for Cluster HSCYTK

Cluster HSCYTK features 3 transcript(s) and 45 segment(s) of interest, the names for which are given in Tables 2576 and 2577, respectively, the sequences themselves are given at the end of the application. The selected protein variants are given in Table 2578.

TABLE 2576

Transcripts of interest
Transcript Name

HSCYTK_T2 (SEQ ID NO: 2725)
HSCYTK_T11 (SEQ ID NO: 2726)
HSCYTK_T30 (SEQ ID NO: 2727)

TABLE 2577

Segments of interest
Segment Name

HSCYTK_node_0 (SEQ ID NO: 2728)
HSCYTK_node_21 (SEQ ID NO: 2729)
HSCYTK_node_39 (SEQ ID NO: 2730)
HSCYTK_node_44 (SEQ ID NO: 2731)
HSCYTK_node_53 (SEQ ID NO: 2732)
HSCYTK_node_1 (SEQ ID NO: 2733)
HSCYTK_node_2 (SEQ ID NO: 2734)
HSCYTK_node_3 (SEQ ID NO: 2735)
HSCYTK_node_4 (SEQ ID NO: 2736)
HSCYTK_node_5 (SEQ ID NO: 2737)
HSCYTK_node_6 (SEQ ID NO: 2738)
HSCYTK_node_7 (SEQ ID NO: 2739)
HSCYTK_node_8 (SEQ ID NO: 2740)
HSCYTK_node_9 (SEQ ID NO: 2741)
HSCYTK_node_10 (SEQ ID NO: 2742)
HSCYTK_node_11 (SEQ ID NO: 2743)
HSCYTK_node_12 (SEQ ID NO: 2744)
HSCYTK_node_13 (SEQ ID NO: 2745)
HSCYTK_node_15 (SEQ ID NO: 2746)
HSCYTK_node_16 (SEQ ID NO: 2747)
HSCYTK_node_18 (SEQ ID NO: 2748)
HSCYTK_node_19 (SEQ ID NO: 2749)
HSCYTK_node_20 (SEQ ID NO: 2750)
HSCYTK_node_22 (SEQ ID NO: 2751)
HSCYTK_node_23 (SEQ ID NO: 2752)
HSCYTK_node_24 (SEQ ID NO: 2753)
HSCYTK_node_25 (SEQ ID NO: 2754)
HSCYTK_node_27 (SEQ ID NO: 2755)
HSCYTK_node_28 (SEQ ID NO: 2756)
HSCYTK_node_29 (SEQ ID NO: 2757)
HSCYTK_node_31 (SEQ ID NO: 2758)
HSCYTK_node_32 (SEQ ID NO: 2759)
HSCYTK_node_33 (SEQ ID NO: 2760)
HSCYTK_node_34 (SEQ ID NO: 2761)
HSCYTK_node_35 (SEQ ID NO: 2762)

TABLE 2577-continued

Segments of interest
Segment Name

HSCYTK_node_36 (SEQ ID NO: 2763)
HSCYTK_node_41 (SEQ ID NO: 2764)
HSCYTK_node_45 (SEQ ID NO: 2765)
HSCYTK_node_46 (SEQ ID NO: 2766)
HSCYTK_node_47 (SEQ ID NO: 2767)
HSCYTK_node_48 (SEQ ID NO: 2768)
HSCYTK_node_49 (SEQ ID NO: 2769)
HSCYTK_node_50 (SEQ ID NO: 2770)
HSCYTK_node_51 (SEQ ID NO: 2771)
HSCYTK_node_52 (SEQ ID NO: 2772)

TABLE 2578

Proteins of interest

| Protein Name | Corresponding Transcript(s) |
|---|---|
| HSCYTK_P2 | HSCYTK_T2 (SEQ ID NO: 2725) |
| HSCYTK_P10 | HSCYTK_T11 (SEQ ID NO: 2726) |

These sequences are variants of the known protein Keratin, type I cytoskeletal 13 (SwissProt accession identifier K1CM_HUMAN; known also according to the synonyms Cytokeratin 13; K13; CK 13), referred to herein as the previously known protein.

The sequence for protein Keratin, type I cytoskeletal 13 is given at the end of the application, as "Keratin, type I cytoskeletal 13 amino acid sequence". Known polymorphisms for this sequence are as shown in Table 2579.

TABLE 2579

Amino acid mutations for Known Protein

| SNP position(s) on amino acid sequence | Comment |
|---|---|
| 108 | M -> T (in WSN). /FTId=VAR_016035. |
| 112 | N -> S (in WSN). /FTId=VAR_016036. |
| 115 | L -> P (in WSN). /FTId=VAR_016037. |
| 119 | L -> P (in WSN). /FTId=VAR_003836. |
| 58 | G -> D |
| 416-457 | MIGFPSSAGSVSPRSTSVTTTSSASVTTTSNASGRRTSDVR R -> KRQP |

The following GO Annotation(s) apply to the previously known protein. The following annotation(s) were found: epidermal differentiation, which are annotation(s) related to Biological Process; structural protein of cytoskeleton, which are annotation(s) related to Molecular Function; and intermediate filament, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster HSCYTK can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 68 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 68 and Table 2580. This cluster is overexpressed (at least at a minimum level) in the following pathological conditions: a mixture of malignant tumors from different tissues.

TABLE 2580

Normal tissue distribution

| Name of Tissue | Number |
|---|---|
| bladder | 451 |
| Brain | 3 |
| Colon | 0 |
| epithelial | 228 |
| general | 85 |
| head and neck | 182 |
| Lung | 48 |
| breast | 0 |
| ovary | 0 |
| pancreas | 0 |
| prostate | 114 |
| skin | 241 |
| stomach | 0 |
| uterus | 2310 |

TABLE 2581

P values and ratios for expression in cancerous tissue

| Name of Tissue | P1 | P2 | SP1 | R3 | SP2 | R4 |
|---|---|---|---|---|---|---|
| bladder | 5.4e−01 | 5.9e−01 | 1.6e−02 | 0.9 | 2.3e−01 | 0.6 |
| brain | 6.7e−01 | 4.9e−01 | 1 | 0.5 | 4.2e−19 | 2.3 |
| colon | 3.0e−01 | 3.6e−01 | 1 | 1.1 | 1 | 1.1 |
| epithelial | 2.4e−01 | 6.9e−01 | 1 | 0.5 | 1 | 0.4 |
| general | 8.7e−03 | 1.6e−01 | 1.9e−02 | 1.1 | 2.7e−01 | 0.9 |
| head and neck | 4.7e−01 | 6.4e−01 | 1.1e−02 | 2.4 | 3.0e−01 | 0.9 |
| lung | 7.7e−01 | 9.0e−01 | 1.8e−01 | 0.9 | 6.8e−01 | 0.5 |
| breast | 5.9e−01 | 4.5e−01 | 1 | 1.0 | 1 | 1.0 |
| ovary | 6.2e−01 | 6.5e−01 | 1.5e−04 | 1.9 | 2.2e−03 | 1.6 |
| pancreas | 1 | 4.4e−01 | 1 | 1.0 | 8.2e−09 | 2.8 |
| prostate | 8.8e−01 | 9.0e−01 | 1 | 0.2 | 1 | 0.3 |
| skin | 5.2e−01 | 7.8e−01 | 9.5e−01 | 0.4 | 1 | 0.1 |
| stomach | 9.1e−01 | 8.5e−01 | 1 | 1.0 | 2.6e−01 | 1.5 |
| uterus | 5.8e−01 | 8.2e−01 | 1 | 0.0 | 1 | 0.0 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 2582.

TABLE 2582

Oligonucleotides related to this cluster

| Oligonucleotide name | Overexpressed in cancers | Chip reference |
|---|---|---|
| HSCYTK_0_0_434 | lung malignant tumors | LUN |

As noted above, cluster HSCYTK features 45 segment(s), which were listed in Table 2577 above and for which the sequence(s) are given at the end of the application. These segment(s) are portions of nucleic acid sequence(s) which are described herein separately because they are of particular interest. A description of each segment according to the present invention is now provided.

Segment cluster HSCYTK_node_0 (SEQ ID NO:2728) according to the present invention is supported by 3 libraries. The number of libraries was determined as previously described. This segment can be found in the following transcript(s): HSCYTK_T2 (SEQ ID NO:2725) and HSCYTK_T11 (SEQ ID NO:2726). Table 2583 below describes the starting and ending position of this segment on each transcript.

TABLE 2583

Segment location on transcripts

| Transcript name | Segment starting position | Segment ending position |
|---|---|---|
| HSCYTK_T2 (SEQ ID NO: 2725) | 1 | 198 |
| HSCYTK_T11 (SEQ ID NO: 2726) | 1 | 198 |

This segment can be found in a non-coding region of transcript(s) that are related to the following protein(s): HSCYTK_P2 and HSCYTK_P10.

Segment cluster HSCYTK_node_21 (SEQ ID NO:2729) according to the present invention is supported by 4 libraries. The number of libraries was determined as previously described. This segment can be found in the following transcript(s): HSCYTK_T11 (SEQ ID NO:2726). Table 2584 below describes the starting and ending position of this segment on each transcript.

TABLE 2584

Segment location on transcripts

| Transcript name | Segment starting position | Segment ending position |
|---|---|---|
| HSCYTK_T11 (SEQ ID NO: 2726) | 1018 | 1206 |

This segment can be found in the following protein(s): HSCYTK_P10.

Segment cluster HSCYTK_node_39 (SEQ ID NO:2730) according to the present invention is supported by 8 libraries. The number of libraries was determined as previously described. This segment can be found in the following transcript(s): HSCYTK_T30 (SEQ ID NO:2727). Table 2585 below describes the starting and ending position of this segment on each transcript.

TABLE 2585

Segment location on transcripts

| Transcript name | Segment starting position | Segment ending position |
|---|---|---|
| HSCYTK_T30 (SEQ ID NO: 2727) | 1 | 177 |

The previously-described transcripts for these segment(s) do not code for protein.

Segment cluster HSCYTK_node_44 (SEQ ID NO:2731) according to the present invention is supported by 25 libraries. The number of libraries was determined as previously described. This segment can be found in the following transcript(s): HSCYTK_T2 (SEQ ID NO:2725). Table 2586 below describes the starting and ending position of this segment on each transcript.

TABLE 2586

Segment location on transcripts

| Transcript name | Segment starting position | Segment ending position |
|---|---|---|
| HSCYTK_T2 (SEQ ID NO: 2725) | 1553 | 1908 |

This segment can be found in the following protein(s): HSCYTK_P2.

Segment cluster HSCYTK_node_53 (SEQ ID NO:2732) according to the present invention is supported by 89 libraries. The number of libraries was determined as previously described. This segment can be found in the following transcript(s): HSCYTK_T2 (SEQ ID NO:2725), HSCYTK_T11 (SEQ ID NO:2726) and HSCYTK_T30 (SEQ ID NO:2727). Table 2587 below describes the starting and ending position of this segment on each transcript.

TABLE 2587

Segment location on transcripts

| Transcript name | Segment starting position | Segment ending position |
|---|---|---|
| HSCYTK_T2 (SEQ ID NO: 2725) | 2157 | 2294 |
| HSCYTK_T11 (SEQ ID NO: 2726) | 1990 | 2127 |
| HSCYTK_T30 (SEQ ID NO: 2727) | 426 | 563 |

This segment can be found in a non-coding region of transcript(s) that are related to the following protein(s): HSCYTK_P2 and HSCYTK_P10.

According to an optional embodiment of the present invention, short segments related to the above cluster are also provided. These segments are up to about 120 bp in length, and so are included in a separate description.

Segment cluster HSCYTK_node_1 (SEQ ID NO:2733) according to the present invention is supported by 59 libraries. The number of libraries was determined as previously described. This segment can be found in the following transcript(s): HSCYTK_T2 (SEQ ID NO:2725) and HSCYTK_T11 (SEQ ID NO:2726). Table 2588 below describes the starting and ending position of this segment on each transcript.

TABLE 2588

Segment location on transcripts

| Transcript name | Segment starting position | Segment ending position |
|---|---|---|
| HSCYTK_T2 (SEQ ID NO: 2725) | 199 | 302 |
| HSCYTK_T11 (SEQ ID NO: 2726) | 199 | 302 |

This segment can be found in the following protein(s): HSCYTK_P2 and HSCYTK_P10.

Segment cluster HSCYTK_node_2 (SEQ ID NO:2734) according to the present invention is supported by 61 libraries. The number of libraries was determined as previously described. This segment can be found in the following transcript(s): HSCYTK_T2 (SEQ ID NO:2725) and HSCYTK_T11 (SEQ ID NO:2726). Table 2589 below describes the starting and ending position of this segment on each transcript.

TABLE 2589

Segment location on transcripts

| Transcript name | Segment starting position | Segment ending position |
|---|---|---|
| HSCYTK_T2 (SEQ ID NO: 2725) | 303 | 364 |
| HSCYTK_T11 (SEQ ID NO: 2726) | 303 | 364 |

This segment can be found in the following protein(s): HSCYTK_P2 and HSCYTK_P10.

Segment cluster HSCYTK_node_3 (SEQ ID NO:2735) according to the present invention can be found in the following transcript(s): HSCYTK_T2 (SEQ ID NO:2725) and HSCYTK_T11 (SEQ ID NO:2726). Table 2590 below describes the starting and ending position of this segment on each transcript.

TABLE 2590

Segment location on transcripts

| Transcript name | Segment starting position | Segment ending position |
|---|---|---|
| HSCYTK_T2 (SEQ ID NO: 2725) | 365 | 386 |
| HSCYTK_T11 (SEQ ID NO: 2726) | 365 | 386 |

This segment can be found in the following protein(s): HSCYTK_P2 and HSCYTK_P10.

Segment cluster HSCYTK_node_4 (SEQ ID NO:2736) according to the present invention is supported by 68 libraries. The number of libraries was determined as previously described. This segment can be found in the following transcript(s): HSCYTK_T2 (SEQ ID NO:2725) and HSCYTK_T11 (SEQ ID NO:2726). Table 2591 below describes the starting and ending position of this segment on each transcript.

TABLE 2591

Segment location on transcripts

| Transcript name | Segment starting position | Segment ending position |
|---|---|---|
| HSCYTK_T2 (SEQ ID NO: 2725) | 387 | 416 |
| HSCYTK_T11 (SEQ ID NO: 2726) | 387 | 416 |

This segment can be found in the following protein(s): HSCYTK_P2 and HSCYTK_P10.

Segment cluster HSCYTK_node_5 (SEQ ID NO:2737) according to the present invention is supported by 68 libraries. The number of libraries was determined as previously described. This segment can be found in the following transcript(s): HSCYTK_T2 (SEQ ID NO:2725) and HSCYTK_T11 (SEQ ID NO:2726). Table 2592 below describes the starting and ending position of this segment on each transcript.

TABLE 2592

| Transcript name | Segment starting position | Segment ending position |
|---|---|---|
| HSCYTK_T2 (SEQ ID NO: 2725) | 417 | 457 |
| HSCYTK_T11 (SEQ ID NO: 2726) | 417 | 457 |

This segment can be found in the following protein(s): HSCYTK_P2 and HSCYTK_P10.

Segment cluster HSCYTK_node_6 (SEQ ID NO:2738) according to the present invention can be found in the following transcript(s): HSCYTK_T2 (SEQ ID NO:2725) and HSCYTK_T11 (SEQ ID NO:2726). Table 2593 below describes the starting and ending position of this segment on each transcript.

TABLE 2593

| Transcript name | Segment starting position | Segment ending position |
|---|---|---|
| HSCYTK_T2 (SEQ ID NO: 2725) | 458 | 461 |
| HSCYTK_T11 (SEQ ID NO: 2726) | 458 | 461 |

This segment can be found in the following protein(s): HSCYTK_P2 and HSCYTK_P10.

Segment cluster HSCYTK_node_7 (SEQ ID NO:2739) according to the present invention can be found in the following transcript(s): HSCYTK_T2 (SEQ ID NO:2725) and HSCYTK_T11 (SEQ ID NO:2726). Table 2594 below describes the starting and ending position of this segment on each transcript.

TABLE 2594

| Transcript name | Segment starting position | Segment ending position |
|---|---|---|
| HSCYTK_T2 (SEQ ID NO: 2725) | 462 | 469 |
| HSCYTK_T11 (SEQ ID NO: 2726) | 462 | 469 |

This segment can be found in the following protein(s): HSCYTK_P2 and HSCYTK_P10.

Segment cluster HSCYTK_node_8 (SEQ ID NO:2740) according to the present invention is supported by 63 libraries. The number of libraries was determined as previously described. This segment can be found in the following transcript(s): HSCYTK_T2 (SEQ ID NO:2725) and HSCYTK_T11 (SEQ ID NO:2726). Table 2595 below describes the starting and ending position of this segment on each transcript.

TABLE 2595

| Transcript name | Segment starting position | Segment ending position |
|---|---|---|
| HSCYTK_T2 (SEQ ID NO: 2725) | 470 | 505 |
| HSCYTK_T11 (SEQ ID NO: 2726) | 470 | 505 |

This segment can be found in the following protein(s): HSCYTK_P2 and HSCYTK_P10.

Segment cluster HSCYTK_node_9 (SEQ ID NO:2741) according to the present invention can be found in the following transcript(s): HSCYTK_T2 (SEQ ID NO:2725) and HSCYTK_T11 (SEQ ID NO:2726). Table 2596 below describes the starting and ending position of this segment on each transcript.

TABLE 2596

| Transcript name | Segment starting position | Segment ending position |
|---|---|---|
| HSCYTK_T2 (SEQ ID NO: 2725) | 506 | 517 |
| HSCYTK_T11 (SEQ ID NO: 2726) | 506 | 517 |

This segment can be found in the following protein(s): HSCYTK_P2 and HSCYTK_P10.

Segment cluster HSCYTK_node_10 (SEQ ID NO:2742) according to the present invention is supported by 57 libraries. The number of libraries was determined as previously described. This segment can be found in the following transcript(s): HSCYTK_T2 (SEQ ID NO:2725) and HSCYTK_T11 (SEQ ID NO:2726). Table 2597 below describes the starting and ending position of this segment on each transcript.

TABLE 2597

| Transcript name | Segment starting position | Segment ending position |
|---|---|---|
| HSCYTK_T2 (SEQ ID NO: 2725) | 518 | 597 |
| HSCYTK_T11 (SEQ ID NO: 2726) | 518 | 597 |

This segment can be found in the following protein(s): HSCYTK_P2 and HSCYTK_P10.

Segment cluster HSCYTK_node_11 (SEQ ID NO:2743) according to the present invention is supported by 61 libraries. The number of libraries was determined as previously described. This segment can be found in the following transcript(s): HSCYTK_T2 (SEQ ID NO:2725) and HSCYTK_T11 (SEQ ID NO:2726). Table 2598 below describes the starting and ending position of this segment on each transcript.

TABLE 2598

| Transcript name | Segment starting position | Segment ending position |
|---|---|---|
| HSCYTK_T2 (SEQ ID NO: 2725) | 598 | 628 |
| HSCYTK_T11 (SEQ ID NO: 2726) | 598 | 628 |

This segment can be found in the following protein(s): HSCYTK_P2 and HSCYTK_P10.

Segment cluster HSCYTK_node_12 (SEQ ID NO:2744) according to the present invention is supported by 68 libraries. The number of libraries was determined as previously described. This segment can be found in the following transcript(s): HSCYTK_T2 (SEQ ID NO:2725) and HSCYTK_T11 (SEQ ID NO:2726). Table 2599 below describes the starting and ending position of this segment on each transcript.

TABLE 2599

Segment location on transcripts

| Transcript name | Segment starting position | Segment ending position |
|---|---|---|
| HSCYTK_T2 (SEQ ID NO: 2725) | 629 | 702 |
| HSCYTK_T11 (SEQ ID NO: 2726) | 629 | 702 |

This segment can be found in the following protein(s): HSCYTK_P2 and HSCYTK_P10.

Segment cluster HSCYTK_node_13 (SEQ ID NO:2745) according to the present invention is supported by 69 libraries. The number of libraries was determined as previously described. This segment can be found in the following transcript(s): HSCYTK_T2 (SEQ ID NO:2725) and HSCYTK_T11 (SEQ ID NO:2726). Table 2600 below describes the starting and ending position of this segment on each transcript.

TABLE 2600

Segment location on transcripts

| Transcript name | Segment starting position | Segment ending position |
|---|---|---|
| HSCYTK_T2 (SEQ ID NO: 2725) | 703 | 777 |
| HSCYTK_T11 (SEQ ID NO: 2726) | 703 | 777 |

This segment can be found in the following protein(s): HSCYTK_P2 and HSCYTK_P10.

Segment cluster HSCYTK_node_15 (SEQ ID NO:2746) according to the present invention is supported by 71 libraries. The number of libraries was determined as previously described. This segment can be found in the following transcript(s): HSCYTK_T2 (SEQ ID NO:2725) and HSCYTK_T11 (SEQ ID NO:2726). Table below describes the starting and ending position of this segment on each transcript.

TABLE 2601

Segment location on transcripts

| Transcript name | Segment starting position | Segment ending position |
|---|---|---|
| HSCYTK_T2 (SEQ ID NO: 2725) | 778 | 813 |
| HSCYTK_T11 (SEQ ID NO: 2726) | 778 | 813 |

This segment can be found in the following protein(s): HSCYTK_P2 and HSCYTK_P10.

Segment cluster HSCYTK_node_16 (SEQ ID NO:2747) according to the present invention is supported by 74 libraries. The number of libraries was determined as previously described. This segment can be found in the following transcript(s): HSCYTK_T2 (SEQ ID NO:2725) and HSCYTK_T11 (SEQ ID NO:2726). Table below describes the starting and ending position of this segment on each transcript.

TABLE 2602

Segment location on transcripts

| Transcript name | Segment starting position | Segment ending position |
|---|---|---|
| HSCYTK_T2 (SEQ ID NO: 2725) | 814 | 860 |
| HSCYTK_T11 (SEQ ID NO: 2726) | 814 | 860 |

This segment can be found in the following protein(s): HSCYTK_P2 and HSCYTK_P10.

Segment cluster HSCYTK_node_18 (SEQ ID NO:2748) according to the present invention is supported by 70 libraries. The number of libraries was determined as previously described. This segment can be found in the following transcript(s): HSCYTK_T2 (SEQ ID NO:2725) and HSCYTK_T11 (SEQ ID NO:2726). Table 2603 below describes the starting and ending position of this segment on each transcript.

TABLE 2603

Segment location on transcripts

| Transcript name | Segment starting position | Segment ending position |
|---|---|---|
| HSCYTK_T2 (SEQ ID NO: 2725) | 861 | 890 |
| HSCYTK_T11 (SEQ ID NO: 2726) | 861 | 890 |

This segment can be found in the following protein(s): HSCYTK_P2 and HSCYTK_P10.

Segment cluster HSCYTK_node_19 (SEQ ID NO:2749) according to the present invention is supported by 75 libraries. The number of libraries was determined as previously described. This segment can be found in the following transcript(s): HSCYTK_T2 (SEQ ID NO:2725) and HSCYTK_T11 (SEQ ID NO:2726). Table 2604 below describes the starting and ending position of this segment on each transcript.

TABLE 2604

Segment location on transcripts

| Transcript name | Segment starting position | Segment ending position |
|---|---|---|
| HSCYTK_T2 (SEQ ID NO: 2725) | 891 | 966 |
| HSCYTK_T11 (SEQ ID NO: 2726) | 891 | 966 |

This segment can be found in the following protein(s): HSCYTK_P2 and HSCYTK_P10.

Segment cluster HSCYTK_node_20 (SEQ ID NO:2750) according to the present invention is supported by 70 libraries. The number of libraries was determined as previously described. This segment can be found in the following transcript(s): HSCYTK_T2 (SEQ ID NO:2725) and HSCYTK_T11 (SEQ ID NO:2726). Table 2605 below describes the starting and ending position of this segment on each transcript.

TABLE 2605

Segment location on transcripts

| Transcript name | Segment starting position | Segment ending position |
|---|---|---|
| HSCYTK_T2 (SEQ ID NO: 2725) | 967 | 1017 |
| HSCYTK_T11 (SEQ ID NO: 2726) | 967 | 1017 |

This segment can be found in the following protein(s): HSCYTK_P2 and HSCYTK_P10.

Segment cluster HSCYTK_node__22 (SEQ ID NO:2751) according to the present invention is supported by 74 libraries. The number of libraries was determined as previously described. This segment can be found in the following transcript(s): HSCYTK_T2 (SEQ ID NO:2725) and HSCYTK_T11 (SEQ ID NO:2726). Table 2606 below describes the starting and ending position of this segment on each transcript.

TABLE 2606

| Transcript name | Segment location on transcripts | |
|---|---|---|
|  | Segment starting position | Segment ending position |
| HSCYTK_T2 (SEQ ID NO: 2725) | 1018 | 1110 |
| HSCYTK_T11 (SEQ ID NO: 2726) | 1207 | 1299 |

This segment can be found in the following protein(s): HSCYTK_P2 and HSCYTK_P10.

Segment cluster HSCYTK_node__23 (SEQ ID NO:2752) according to the present invention can be found in the following transcript(s): HSCYTK_T2 (SEQ ID NO:2725) and HSCYTK_T11 (SEQ ID NO:2726). Table 2607 below describes the starting and ending position of this segment on each transcript.

TABLE 2607

| Transcript name | Segment location on transcripts | |
|---|---|---|
|  | Segment starting position | Segment ending position |
| HSCYTK_T2 (SEQ ID NO: 2725) | 1111 | 1130 |
| HSCYTK_T11 (SEQ ID NO: 2726) | 1300 | 1319 |

This segment can be found in the following protein(s): HSCYTK_P2 and HSCYTK_P10.

Segment cluster HSCYTK_node__24 (SEQ ID NO:2753) according to the present invention can be found in the following transcript(s): HSCYTK_T2 (SEQ ID NO:2725) and HSCYTK_T11 (SEQ ID NO:2726). Table 2608 below describes the starting and ending position of this segment on each transcript.

TABLE 2608

| Transcript name | Segment location on transcripts | |
|---|---|---|
|  | Segment starting position | Segment ending position |
| HSCYTK_T2 (SEQ ID NO: 2725) | 1131 | 1138 |
| HSCYTK_T11 (SEQ ID NO: 2726) | 1320 | 1327 |

This segment can be found in the following protein(s): HSCYTK_P2 and HSCYTK_P10.

Segment cluster HSCYTK_node__25 (SEQ ID NO:2754) according to the present invention is supported by 65 libraries. The number of libraries was determined as previously described. This segment can be found in the following transcript(s): HSCYTK_T2 (SEQ ID NO:2725) and HSCYTK_T11 (SEQ ID NO:2726). Table 2609 below describes the starting and ending position of this segment on each transcript.

TABLE 2609

| Transcript name | Segment location on transcripts | |
|---|---|---|
|  | Segment starting position | Segment ending position |
| HSCYTK_T2 (SEQ ID NO: 2725) | 1139 | 1179 |
| HSCYTK_T11 (SEQ ID NO: 2726) | 1328 | 1368 |

This segment can be found in the following protein(s): HSCYTK_P2 and HSCYTK_P10.

Segment cluster HSCYTK_node__27 (SEQ ID NO:2755) according to the present invention is supported by 77 libraries. The number of libraries was determined as previously described. This segment can be found in the following transcript(s): HSCYTK_T2 (SEQ ID NO:2725) and HSCYTK_T11 (SEQ ID NO:2726). Table 2610 below describes the starting and ending position of this segment on each transcript.

TABLE 2610

| Transcript name | Segment location on transcripts | |
|---|---|---|
|  | Segment starting position | Segment ending position |
| HSCYTK_T2 (SEQ ID NO: 2725) | 1180 | 1251 |
| HSCYTK_T11 (SEQ ID NO: 2726) | 1369 | 1440 |

This segment can be found in the following protein(s): HSCYTK_P2 and HSCYTK_P10.

Segment cluster HSCYTK_node__28 (SEQ ID NO:2756) according to the present invention is supported by 73 libraries. The number of libraries was determined as previously described. This segment can be found in the following transcript(s): HSCYTK_T2 (SEQ ID NO:2725) and HSCYTK_T11 (SEQ ID NO:2726). Table 2611 below describes the starting and ending position of this segment on each transcript.

TABLE 2611

| Transcript name | Segment location on transcripts | |
|---|---|---|
|  | Segment starting position | Segment ending position |
| HSCYTK_T2 (SEQ ID NO: 2725) | 1252 | 1278 |
| HSCYTK_T11 (SEQ ID NO: 2726) | 1441 | 1467 |

This segment can be found in the following protein(s): HSCYTK_P2 and HSCYTK_P10.

Segment cluster HSCYTK_node__29 (SEQ ID NO:2757) according to the present invention is supported by 73 libraries. The number of libraries was determined as previously described. This segment can be found in the following transcript(s): HSCYTK_T2 (SEQ ID NO:2725) and HSCYTK_T11 (SEQ ID NO:2726). Table 2612 below describes the starting and ending position of this segment on each transcript.

TABLE 2612

Segment location on transcripts

| Transcript name | Segment starting position | Segment ending position |
|---|---|---|
| HSCYTK_T2 (SEQ ID NO: 2725) | 1279 | 1305 |
| HSCYTK_T11 (SEQ ID NO: 2726) | 1468 | 1494 |

This segment can be found in the following protein(s): HSCYTK_P2 and HSCYTK_P10.

Segment cluster HSCYTK_node_31 (SEQ ID NO:2758) according to the present invention can be found in the following transcript(s): HSCYTK_T2 (SEQ ID NO:2725) and HSCYTK_T11 (SEQ ID NO:2726). Table 2613 below describes the starting and ending position of this segment on each transcript.

TABLE 2613

Segment location on transcripts

| Transcript name | Segment starting position | Segment ending position |
|---|---|---|
| HSCYTK_T2 (SEQ ID NO: 2725) | 1306 | 1330 |
| HSCYTK_T11 (SEQ ID NO: 2726) | 1495 | 1519 |

This segment can be found in the following protein(s): HSCYTK_P2 and HSCYTK_P10.

Segment cluster HSCYTK_node_32 (SEQ ID NO:2759) according to the present invention is supported by 79 libraries. The number of libraries was determined as previously described. This segment can be found in the following transcript(s): HSCYTK_T2 (SEQ ID NO:2725) and HSCYTK_T11 (SEQ ID NO:2726). Table 2614 below describes the starting and ending position of this segment on each transcript.

TABLE 2614

Segment location on transcripts

| Transcript name | Segment starting position | Segment ending position |
|---|---|---|
| HSCYTK_T2 (SEQ ID NO: 2725) | 1331 | 1359 |
| HSCYTK_T11 (SEQ ID NO: 2726) | 1520 | 1548 |

This segment can be found in the following protein(s): HSCYTK_P2 and HSCYTK_P10.

Segment cluster HSCYTK_node_33 (SEQ ID NO:2760) according to the present invention can be found in the following transcript(s): HSCYTK_T2 (SEQ ID NO:2725) and HSCYTK_T11 (SEQ ID NO:2726). Table 2615 below describes the starting and ending position of this segment on each transcript.

TABLE 2615

Segment location on transcripts

| Transcript name | Segment starting position | Segment ending position |
|---|---|---|
| HSCYTK_T2 (SEQ ID NO: 2725) | 1360 | 1365 |
| HSCYTK_T11 (SEQ ID NO: 2726) | 1549 | 1554 |

This segment can be found in the following protein(s): HSCYTK_P2 and HSCYTK_P10.

Segment cluster HSCYTK_node_34 (SEQ ID NO:2761) according to the present invention is supported by 87 libraries. The number of libraries was determined as previously described. This segment can be found in the following transcript(s): HSCYTK_T2 (SEQ ID NO:2725) and HSCYTK_T11 (SEQ ID NO:2726). Table 2616 below describes the starting and ending position of this segment on each transcript.

TABLE 2616

Segment location on transcripts

| Transcript name | Segment starting position | Segment ending position |
|---|---|---|
| HSCYTK_T2 (SEQ ID NO: 2725) | 1366 | 1411 |
| HSCYTK_T11 (SEQ ID NO: 2726) | 1555 | 1600 |

This segment can be found in the following protein(s): HSCYTK_P2 and HSCYTK_P10.

Segment cluster HSCYTK_node_35 (SEQ ID NO:2762) according to the present invention is supported by 100 libraries. The number of libraries was determined as previously described. This segment can be found in the following transcript(s): HSCYTK_T2 (SEQ ID NO:2725) and HSCYTK_T11 (SEQ ID NO:2726). Table 2617 below describes the starting and ending position of this segment on each transcript.

TABLE 2617

Segment location on transcripts

| Transcript name | Segment starting position | Segment ending position |
|---|---|---|
| HSCYTK_T2 (SEQ ID NO: 2725) | 1412 | 1482 |
| HSCYTK_T11 (SEQ ID NO: 2726) | 1601 | 1671 |

This segment can be found in the following protein(s): HSCYTK_P2 and HSCYTK_P10.

Segment cluster HSCYTK_node_36 (SEQ ID NO:2763) according to the present invention is supported by 99 libraries. The number of libraries was determined as previously described. This segment can be found in the following transcript(s): HSCYTK_T2 (SEQ ID NO:2725) and HSCYTK_T11 (SEQ ID NO:2726). Table 2618 below describes the starting and ending position of this segment on each transcript.

TABLE 2618

Segment location on transcripts

| Transcript name | Segment starting position | Segment ending position |
|---|---|---|
| HSCYTK_T2 (SEQ ID NO: 2725) | 1483 | 1526 |
| HSCYTK_T11 (SEQ ID NO: 2726) | 1672 | 1715 |

This segment can be found in the following protein(s): HSCYTK_P2 and HSCYTK_P10.

Segment cluster HSCYTK_node_41 (SEQ ID NO:2764) according to the present invention is supported by 100 libraries. The number of libraries was determined as previously described. This segment can be found in the following transcript(s): HSCYTK_T2 (SEQ ID NO:2725) and HSCYTK_T11 (SEQ ID NO:2726). Table 2619 below describes the starting and ending position of this segment on each transcript.

TABLE 2619

Segment location on transcripts

| Transcript name | Segment starting position | Segment ending position |
|---|---|---|
| HSCYTK_T2 (SEQ ID NO: 2725) | 1527 | 1552 |
| HSCYTK_T11 (SEQ ID NO: 2726) | 1716 | 1741 |

This segment can be found in the following protein(s): HSCYTK_P2 and HSCYTK_P10.

Segment cluster HSCYTK_node_45 (SEQ ID NO:2765) according to the present invention can be found in the following transcript(s): HSCYTK_T2 (SEQ ID NO:2725), HSCYTK_T11 (SEQ ID NO:2726) and HSCYTK_T30 (SEQ ID NO:2727). Table 2620 below describes the starting and ending position of this segment on each transcript.

TABLE 2620

Segment location on transcripts

| Transcript name | Segment starting position | Segment ending position |
|---|---|---|
| HSCYTK_T2 (SEQ ID NO: 2725) | 1909 | 1922 |
| HSCYTK_T11 (SEQ ID NO: 2726) | 1742 | 1755 |
| HSCYTK_T30 (SEQ ID NO: 2727) | 178 | 191 |

This segment can be found in both coding and non-coding regions of transcript(s) as follows. The segment can be found in a non-coding region of transcript(s) that are related to the following protein(s): HSCYTK_P2. This segment can also be found in the following protein(s): HSCYTK_P10, since it is in the coding region for the corresponding transcript.

Segment cluster HSCYTK_node_46 (SEQ ID NO:2766) according to the present invention can be found in the following transcript(s): HSCYTK_T2 (SEQ ID NO:2725), HSCYTK_T11 (SEQ ID NO:2726) and HSCYTK_T30 (SEQ ID NO:2727). Table 2621 below describes the starting and ending position of this segment on each transcript.

TABLE 2621

Segment location on transcripts

| Transcript name | Segment starting position | Segment ending position |
|---|---|---|
| HSCYTK_T2 (SEQ ID NO: 2725) | 1923 | 1930 |
| HSCYTK_T11 (SEQ ID NO: 2726) | 1756 | 1763 |
| HSCYTK_T30 (SEQ ID NO: 2727) | 192 | 199 |

This segment can be found in both coding and non-coding regions of transcript(s) as follows. The segment can be found in a non-coding region of transcript(s) that are related to the following protein(s): HSCYTK_P2. This segment can also be found in the following protein(s): HSCYTK_P10, since it is in the coding region for the corresponding transcript.

Segment cluster HSCYTK_node_47 (SEQ ID NO:2767) according to the present invention can be found in the following transcript(s): HSCYTK_T2 (SEQ ID NO:2725), HSCYTK_T11 (SEQ ID NO:2726) and HSCYTK_T30 (SEQ ID NO:2727). Table 2622 below describes the starting and ending position of this segment on each transcript.

TABLE 2622

Segment location on transcripts

| Transcript name | Segment starting position | Segment ending position |
|---|---|---|
| HSCYTK_T2 (SEQ ID NO: 2725) | 1931 | 1939 |
| HSCYTK_T11 (SEQ ID NO: 2726) | 1764 | 1772 |
| HSCYTK_T30 (SEQ ID NO: 2727) | 200 | 208 |

This segment can be found in both coding and non-coding regions of transcript(s) as follows. The segment can be found in a non-coding region of transcript(s) that are related to the following protein(s): HSCYTK_P2. This segment can also be found in the following protein(s): HSCYTK_P10, since it is in the coding region for the corresponding transcript.

Segment cluster HSCYTK_node_48 (SEQ ID NO:2768) according to the present invention can be found in the following transcript(s): HSCYTK_T2 (SEQ ID NO:2725), HSCYTK_T11 (SEQ ID NO:2726) and HSCYTK_T30 (SEQ ID NO:2727). Table 2623 below describes the starting and ending position of this segment on each transcript.

TABLE 2623

Segment location on transcripts

| Transcript name | Segment starting position | Segment ending position |
|---|---|---|
| HSCYTK_T2 (SEQ ID NO: 2725) | 1940 | 1954 |
| HSCYTK_T11 (SEQ ID NO: 2726) | 1773 | 1787 |
| HSCYTK_T30 (SEQ ID NO: 2727) | 209 | 223 |

This segment can be found in both coding and non-coding regions of transcript(s) as follows. The segment can be found in a non-coding region of transcript(s) that are related to the following protein(s): HSCYTK_P2. This segment can also be found in the following protein(s): HSCYTK_P10, since it is in the coding region for the corresponding transcript.

Segment cluster HSCYTK_node_49 (SEQ ID NO:2769) according to the present invention is supported by 106 libraries. The number of libraries was determined as previously described. This segment can be found in the following transcript(s): HSCYTK_T2 (SEQ ID NO:2725), HSCYTK_T11 (SEQ ID NO:2726) and HSCYTK_T30 (SEQ ID NO:2727). Table 2624 below describes the starting and ending position of this segment on each transcript.

TABLE 2624

Segment location on transcripts

| Transcript name | Segment starting position | Segment ending position |
|---|---|---|
| HSCYTK_T2 (SEQ ID NO: 2725) | 1955 | 2056 |
| HSCYTK_T11 (SEQ ID NO: 2726) | 1788 | 1889 |
| HSCYTK_T30 (SEQ ID NO: 2727) | 224 | 325 |

This segment can be found in both coding and non-coding regions of transcript(s) as follows. The segment can be found in a non-coding region of transcript(s) that are related to the following protein(s): HSCYTK_P2. This segment can also be found in the following protein(s): HSCYTK_P10, since it is in the coding region for the corresponding transcript.

Segment cluster HSCYTK_node_50 (SEQ ID NO:2770) according to the present invention is supported by 93 libraries. The number of libraries was determined as previously described. This segment can be found in the following transcript(s): HSCYTK_T2 (SEQ ID NO:2725), HSCYTK_T11 (SEQ ID NO:2726) and HSCYTK_T30 (SEQ ID NO:2727). Table 2625 below describes the starting and ending position of this segment on each transcript.

TABLE 2625

Segment location on transcripts

| Transcript name | Segment starting position | Segment ending position |
|---|---|---|
| HSCYTK_T2 (SEQ ID NO: 2725) | 2057 | 2083 |
| HSCYTK_T11 (SEQ ID NO: 2726) | 1890 | 1916 |
| HSCYTK_T30 (SEQ ID NO: 2727) | 326 | 352 |

This segment can be found in a non-coding region of transcript(s) that are related to the following protein(s): HSCYTK_P2 and HSCYTK_P10.

Segment cluster HSCYTK_node_51 (SEQ ID NO:2771) according to the present invention is supported by 92 libraries. The number of libraries was determined as previously described. This segment can be found in the following transcript(s): HSCYTK_T2 (SEQ ID NO:2725), HSCYTK_T11 (SEQ ID NO:2726) and HSCYTK_T30 (SEQ ID NO:2727). Table 2626 below describes the starting and ending position of this segment on each transcript.

TABLE 2626

Segment location on transcripts

| Transcript name | Segment starting position | Segment ending position |
|---|---|---|
| HSCYTK_T2 (SEQ ID NO: 2725) | 2084 | 2121 |
| HSCYTK_T11 (SEQ ID NO: 2726) | 1917 | 1954 |
| HSCYTK_T30 (SEQ ID NO: 2727) | 353 | 390 |

This segment can be found in a non-coding region of transcript(s) that are related to the following protein(s): HSCYTK_P2 and HSCYTK_P10.

Segment cluster HSCYTK_node_52 (SEQ ID NO:2772) according to the present invention is supported by 89 libraries. The number of libraries was determined as previously described. This segment can be found in the following transcript(s): HSCYTK_T2 (SEQ ID NO:2725), HSCYTK_T11 (SEQ ID NO:2726) and HSCYTK_T30 (SEQ ID NO:2727). Table 2627 below describes the starting and ending position of this segment on each transcript.

TABLE 2627

Segment location on transcripts

| Transcript name | Segment starting position | Segment ending position |
|---|---|---|
| HSCYTK_T2 (SEQ ID NO: 2725) | 2122 | 2156 |
| HSCYTK_T11 (SEQ ID NO: 2726) | 1955 | 1989 |
| HSCYTK_T30 (SEQ ID NO: 2727) | 391 | 425 |

This segment can be found in a non-coding region of transcript(s) that are related to the following protein(s): HSCYTK_P2 and HSCYTK_P10.

Description for Cluster HSGONA

Cluster HSGONA features 1 transcript(s) and 13 segment(s) of interest, the names for which are given in Tables 2628 and 2629, respectively, the sequences themselves are given at the end of the application. The selected protein variants are given in Table 2630.

TABLE 2628

Transcripts of interest
Transcript Name

HSGONA_T8 (SEQ ID NO: 2773)

TABLE 2629

Segments of interest
Segment Name

HSGONA_node_0 (SEQ ID NO: 2774)
HSGONA_node_18 (SEQ ID NO: 2775)
HSGONA_node_21 (SEQ ID NO: 2776)
HSGONA_node_7 (SEQ ID NO: 2777)
HSGONA_node_9 (SEQ ID NO: 2778)
HSGONA_node_13 (SEQ ID NO: 2779)
HSGONA_node_15 (SEQ ID NO: 2780)
HSGONA_node_16 (SEQ ID NO: 2781)
HSGONA_node_17 (SEQ ID NO: 2782)
HSGONA_node_20 (SEQ ID NO: 2783)
HSGONA_node_22 (SEQ ID NO: 2784)
HSGONA_node_23 (SEQ ID NO: 2785)
HSGONA_node_26 (SEQ ID NO: 2786)

TABLE 2630

Proteins of interest

| Protein Name | Corresponding Transcript(s) |
|---|---|
| HSGONA_P3 | HSGONA_T8 (SEQ ID NO: 2773) |

These sequences are variants of the known protein Glycoprotein hormones alpha chain precursor (SwissProt accession identifier GLHA_HUMAN; known also according to the synonyms Follitropin alpha chain; Follicle-stimulating hormone alpha chain; FSH-alpha; Lutropin alpha chain; Luteinizing hormone alpha chain; LSH-alpha; Thyrotropin alpha chain; Thyroid-stimulating hormone alpha chain; TSH-alpha; Choriogonadotropin alpha chain; Chorionic gonadotrophin alpha subunit; CG-alpha), referred to herein as the previously known protein.

The sequence for protein Glycoprotein hormones alpha chain precursor is given at the end of the application, as "Glycoprotein hormones alpha chain precursor amino acid sequence". Known polymorphisms for this sequence are as shown in Table 2631.

TABLE 2631

Amino acid mutations for Known Protein

| SNP position(s) on amino acid sequence | Comment |
|---|---|
| 29 | Q -> E |
| 108-109 | CS -> SC |

Protein Glycoprotein hormones alpha chain precursor localization is believed to be Secreted.

The previously known protein also has the following indication(s) and/or potential therapeutic use(s): Benign prostatic hyperplasia; Myelodysplastic syndrome; Infection, prostate; Cancer, breast; Cancer, sarcoma, Kaposi's; Cancer, ovarian;

Cancer, prostate; Cancer, gastrointestinal, stomach; Infertility, female; Infertility, male; Polycystic ovarian syndrome. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Adenylate cyclase stimulant; Cyclic AMP agonist; Follicle-stimulating hormone agonist; LH agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Prostate disorders; Hormone; Anticancer; Fertility enhancer.

The following GO Annotation(s) apply to the previously known protein. The following annotation(s) were found: signal transduction; cell-cell signaling, which are annotation(s) related to Biological Process; hormone, which are annotation (s) related to Molecular Function; and extracellular; soluble fraction, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HSGONA features 13 segment(s), which were listed in Table 2629 above and for which the sequence(s) are given at the end of the application. These segment(s) are portions of nucleic acid sequence(s) which are described herein separately because they are of particular interest. A description of each segment according to the present invention is now provided.

Segment cluster HSGONA_node_0 (SEQ ID NO:2774) according to the present invention is supported by 54 libraries. The number of libraries was determined as previously described. This segment can be found in the following transcript(s): HSGONA_T8 (SEQ ID NO:2773). Table 2632 below describes the starting and ending position of this segment on each transcript.

TABLE 2632

Segment location on transcripts

| Transcript name | Segment starting position | Segment ending position |
|---|---|---|
| HSGONA_T8 (SEQ ID NO: 2773) | 1 | 394 |

This segment can be found in a non-coding region of transcript(s) that are related to the following protein(s): HSGONA_P3.

Segment cluster HSGONA_node_18 (SEQ ID NO:2775) according to the present invention is supported by 4 libraries. The number of libraries was determined as previously described. This segment can be found in the following transcript(s): HSGONA_T8 (SEQ ID NO:2773). Table 2633 below describes the starting and ending position of this segment on each transcript.

TABLE 2633

Segment location on transcripts

| Transcript name | Segment starting position | Segment ending position |
|---|---|---|
| HSGONA_T8 (SEQ ID NO: 2773) | 675 | 1090 |

This segment can be found in the following protein(s): HSGONA_P3.

Segment cluster HSGONA_node_21 (SEQ ID NO:2776) according to the present invention is supported by 63 libraries. The number of libraries was determined as previously described. This segment can be found in the following transcript(s): HSGONA_T8 (SEQ ID NO:2773). Table 2634 below describes the starting and ending position of this segment on each transcript.

TABLE 2634

Segment location on transcripts

| Transcript name | Segment starting position | Segment ending position |
|---|---|---|
| HSGONA_T8 (SEQ ID NO: 2773) | 1144 | 1298 |

This segment can be found in a non-coding region of transcript(s) that are related to the following protein(s): HSGONA_P3.

According to an optional embodiment of the present invention, short segments related to the above cluster are also provided. These segments are up to about 120 bp in length, and so are included in a separate description.

Segment cluster HSGONA_node_7 (SEQ ID NO:2777) according to the present invention is supported by 63 libraries. The number of libraries was determined as previously described. This segment can be found in the following transcript(s): HSGONA_T8 (SEQ ID NO:2773). Table 2635 below describes the starting and ending position of this segment on each transcript.

TABLE 2635

Segment location on transcripts

| Transcript name | Segment starting position | Segment ending position |
|---|---|---|
| HSGONA_T8 (SEQ ID NO: 2773) | 395 | 442 |

This segment can be found in the following protein(s): HSGONA_P3.

Segment cluster HSGONA_node_9 (SEQ ID NO:2778) according to the present invention is supported by 67 libraries. The number of libraries was determined as previously described. This segment can be found in the following transcript(s): HSGONA_T8 (SEQ ID NO:2773). Table 2636 below describes the starting and ending position of this segment on each transcript.

TABLE 2636

Segment location on transcripts

| Transcript name | Segment starting position | Segment ending position |
|---|---|---|
| HSGONA_T8 (SEQ ID NO: 2773) | 443 | 489 |

This segment can be found in the following protein(s): HSGONA_P3.

Segment cluster HSGONA_node_13 (SEQ ID NO:2779) according to the present invention can be found in the following transcript(s): HSGONA_T8 (SEQ ID NO:2773). Table 2637 below describes the starting and ending position of this segment on each transcript.

TABLE 2637

Segment location on transcripts

| Transcript name | Segment starting position | Segment ending position |
|---|---|---|
| HSGONA_T8 (SEQ ID NO: 2773) | 490 | 512 |

This segment can be found in the following protein(s): HSGONA_P3.

Segment cluster HSGONA_node_15 (SEQ ID NO:2780) according to the present invention can be found in the following transcript(s): HSGONA_T8 (SEQ ID NO:2773). Table 2638 below describes the starting and ending position of this segment on each transcript.

TABLE 2638

Segment location on transcripts

| Transcript name | Segment starting position | Segment ending position |
|---|---|---|
| HSGONA_T8 (SEQ ID NO: 2773) | 513 | 534 |

This segment can be found in the following protein(s): HSGONA_P3.

Segment cluster HSGONA_node_16 (SEQ ID NO:2781) according to the present invention is supported by 74 libraries. The number of libraries was determined as previously described. This segment can be found in the following transcript(s): HSGONA_T8 (SEQ ID NO:2773). Table 2639 below describes the starting and ending position of this segment on each transcript.

TABLE 2639

Segment location on transcripts

| Transcript name | Segment starting position | Segment ending position |
|---|---|---|
| HSGONA_T8 (SEQ ID NO: 2773) | 535 | 589 |

This segment can be found in the following protein(s): HSGONA_P3.

Segment cluster HSGONA_node_17 (SEQ ID NO:2782) according to the present invention is supported by 71 libraries. The number of libraries was determined as previously described. This segment can be found in the following transcript(s): HSGONA_T8 (SEQ ID NO:2773). Table 2640 below describes the starting and ending position of this segment on each transcript.

TABLE 2640

Segment location on transcripts

| Transcript name | Segment starting position | Segment ending position |
|---|---|---|
| HSGONA_T8 (SEQ ID NO: 2773) | 590 | 674 |

This segment can be found in the following protein(s): HSGONA_P3.

Segment cluster HSGONA_node_20 (SEQ ID NO:2783) according to the present invention is supported by 64 libraries. The number of libraries was determined as previously described. This segment can be found in the following transcript(s): HSGONA_T8 (SEQ ID NO:2773). Table 2641 below describes the starting and ending position of this segment on each transcript.

TABLE 2641

Segment location on transcripts

| Transcript name | Segment starting position | Segment ending position |
|---|---|---|
| HSGONA_T8 (SEQ ID NO: 2773) | 1091 | 1143 |

This segment can be found in a non-coding region of transcript(s) that are related to the following protein(s): HSGONA_P3.

Segment cluster HSGONA_node_22 (SEQ ID NO:2784) according to the present invention is supported by 54 libraries. The number of libraries was determined as previously described. This segment can be found in the following transcript(s): HSGONA_T8 (SEQ ID NO:2773). Table 2642 below describes the starting and ending position of this segment on each transcript.

TABLE 2642

Segment location on transcripts

| Transcript name | Segment starting position | Segment ending position |
|---|---|---|
| HSGONA_T8 (SEQ ID NO: 2773) | 1299 | 1336 |

This segment can be found in a non-coding region of transcript(s) that are related to the following protein(s): HSGONA_P3.

Segment cluster HSGONA_node_23 (SEQ ID NO:2785) according to the present invention can be found in the following transcript(s): HSGONA_T8 (SEQ ID NO:2773). Table 2643 below describes the starting and ending position of this segment on each transcript.

TABLE 2643

Segment location on transcripts

| Transcript name | Segment starting position | Segment ending position |
|---|---|---|
| HSGONA_T8 (SEQ ID NO: 2773) | 1337 | 1351 |

This segment can be found in a non-coding region of transcript(s) that are related to the following protein(s): HSGONA_P3.

Segment cluster HSGONA_node__26 (SEQ ID NO:2786) according to the present invention is supported by 47 libraries. The number of libraries was determined as previously described. This segment can be found in the following transcript(s): HSGONA_T8 (SEQ ID NO:2773). Table 2644 below describes the starting and ending position of this segment on each transcript.

TABLE 2644

| Segment location on transcripts | | |
|---|---|---|
| Transcript name | Segment starting position | Segment ending position |
| HSGONA_T8 (SEQ ID NO: 2773) | 1352 | 1446 |

This segment can be found in a non-coding region of transcript(s) that are related to the following protein(s): HSGONA_P3.

Description for Cluster HSKERELP

Cluster HSKERELP features 10 transcript(s) and 53 segment(s) of interest, the names for which are given in Tables 2645 and 2646, respectively, the sequences themselves are given at the end of the application. The selected protein variants are given in Table 2647.

TABLE 2645

| Transcripts of interest |
|---|
| Transcript Name |
| HSKERELP_T0 (SEQ ID NO: 2787) |
| HSKERELP_T2 (SEQ ID NO: 2788) |
| HSKERELP_T6 (SEQ ID NO: 2789) |
| HSKERELP_T7 (SEQ ID NO: 2790) |
| HSKERELP_T11 (SEQ ID NO: 2791) |
| HSKERELP_T13 (SEQ ID NO: 2792) |
| HSKERELP_T18 (SEQ ID NO: 2793) |
| HSKERELP_T23 (SEQ ID NO: 2794) |
| HSKERELP_T25 (SEQ ID NO: 2795) |
| HSKERELP_T32 (SEQ ID NO: 2796) |

TABLE 2646

| Segments of interest |
|---|
| Segment Name |
| HSKERELP_node__0 (SEQ ID NO: 2797) |
| HSKERELP_node__1 (SEQ ID NO: 2798) |
| HSKERELP_node__45 (SEQ ID NO: 2799) |
| HSKERELP_node__57 (SEQ ID NO: 2800) |
| HSKERELP_node__60 (SEQ ID NO: 2801) |
| HSKERELP_node__64 (SEQ ID NO: 2802) |
| HSKERELP_node__2 (SEQ ID NO: 2803) |
| HSKERELP_node__3 (SEQ ID NO: 2804) |
| HSKERELP_node__4 (SEQ ID NO: 2805) |
| HSKERELP_node__5 (SEQ ID NO: 2806) |
| HSKERELP_node__6 (SEQ ID NO: 2807) |
| HSKERELP_node__7 (SEQ ID NO: 2808) |
| HSKERELP_node__8 (SEQ ID NO: 2809) |
| HSKERELP_node__9 (SEQ ID NO: 2810) |
| HSKERELP_node__10 (SEQ ID NO: 2811) |
| HSKERELP_node__11 (SEQ ID NO: 2812) |
| HSKERELP_node__12 (SEQ ID NO: 2813) |
| HSKERELP_node__13 (SEQ ID NO: 2814) |
| HSKERELP_node__14 (SEQ ID NO: 2815) |
| HSKERELP_node__15 (SEQ ID NO: 2816) |
| HSKERELP_node__16 (SEQ ID NO: 2817) |
| HSKERELP_node__17 (SEQ ID NO: 2818) |

TABLE 2646-continued

| Segments of interest |
|---|
| Segment Name |
| HSKERELP_node__18 (SEQ ID NO: 2819) |
| HSKERELP_node__19 (SEQ ID NO: 2820) |
| HSKERELP_node__20 (SEQ ID NO: 2821) |
| HSKERELP_node__21 (SEQ ID NO: 2822) |
| HSKERELP_node__25 (SEQ ID NO: 2823) |
| HSKERELP_node__27 (SEQ ID NO: 2824) |
| HSKERELP_node__28 (SEQ ID NO: 2825) |
| HSKERELP_node__29 (SEQ ID NO: 2826) |
| HSKERELP_node__30 (SEQ ID NO: 2827) |
| HSKERELP_node__31 (SEQ ID NO: 2828) |
| HSKERELP_node__35 (SEQ ID NO: 2829) |
| HSKERELP_node__36 (SEQ ID NO: 2830) |
| HSKERELP_node__37 (SEQ ID NO: 2831) |
| HSKERELP_node__38 (SEQ ID NO: 2832) |
| HSKERELP_node__39 (SEQ ID NO: 2833) |
| HSKERELP_node__40 (SEQ ID NO: 2834) |
| HSKERELP_node__41 (SEQ ID NO: 2835) |
| HSKERELP_node__42 (SEQ ID NO: 2836) |
| HSKERELP_node__43 (SEQ ID NO: 2837) |
| HSKERELP_node__46 (SEQ ID NO: 2838) |
| HSKERELP_node__47 (SEQ ID NO: 2839) |
| HSKERELP_node__49 (SEQ ID NO: 2840) |
| HSKERELP_node__50 (SEQ ID NO: 2841) |
| HSKERELP_node__51 (SEQ ID NO: 2842) |
| HSKERELP_node__52 (SEQ ID NO: 2843) |
| HSKERELP_node__53 (SEQ ID NO: 2844) |
| HSKERELP_node__54 (SEQ ID NO: 2845) |
| HSKERELP_node__56 (SEQ ID NO: 2846) |
| HSKERELP_node__61 (SEQ ID NO: 2847) |
| HSKERELP_node__62 (SEQ ID NO: 2848) |
| HSKERELP_node__63 (SEQ ID NO: 2849) |

TABLE 2647

| Proteins of interest | |
|---|---|
| Protein Name | Corresponding Transcript(s) |
| HSKERELP_P1 | HSKERELP_T0 (SEQ ID NO: 2787) |
| HSKERELP_P3 | HSKERELP_T2 (SEQ ID NO: 2788) |
| HSKERELP_P7 | HSKERELP_T6 (SEQ ID NO: 2789) |
| HSKERELP_P8 | HSKERELP_T7 (SEQ ID NO: 2790) |
| HSKERELP_P9 | HSKERELP_T25 (SEQ ID NO: 2795) |
| HSKERELP_P12 | HSKERELP_T11 (SEQ ID NO: 2791) |
| HSKERELP_P14 | HSKERELP_T13 (SEQ ID NO: 2792) |
| HSKERELP_P19 | HSKERELP_T18 (SEQ ID NO: 2793) |
| HSKERELP_P23 | HSKERELP_T23 (SEQ ID NO: 2794) |
| HSKERELP_P30 | HSKERELP_T32 (SEQ ID NO: 2796) |

These sequences are variants of the known protein Keratin, type I cytoskeletal (SwissProt accession identifier K1CQ_HUMAN; known also according to the synonyms Cytokeratin 17; K17; CK 17; 39.1), referred to herein as the previously known protein.

Protein Keratin, type I cytoskeletal 17 is known or believed to have the following function(s): May be a marker of basal cell differentiation in complex epithelia and therefore indicative of a certain type of epithelial "stem cells". The sequence for protein Keratin, type I cytoskeletal 17 is given at the end of the application, as "Keratin, type I cytoskeletal 17 amino acid sequence". Known polymorphisms for this sequence are as shown in Table 2648.

TABLE 2648

Amino acid mutations for Known Protein

| SNP position(s) on amino acid sequence | Comment |
|---|---|
| 87 | M -> T (in PC2). /FTId = VAR_010512. |
| 91 | N -> D (in PC2). /FTId = VAR_003847. |
| 91 | N -> H (in SM). /FTId = VAR_003848. |
| 91 | N -> S (in PC2). /FTId = VAR_003849. |
| 93 | R -> C (in PC2 and SM). /FTId = VAR_010513. |
| 93 | R -> H (in SM). /FTId = VAR_003850. |
| 93 | R -> P (in PC2). /FTId = VAR_017068. |
| 93-97 | Missing (in PC2). /FTId = VAR_017069. |
| 94 | L -> Q (in PC2). /FTId = VAR_017070. |
| 94 | L -> P (in PC2). /FTId = VAR_017071. |
| 96 | Missing (in PC2). /FTId = VAR_017072. |
| 97 | Y -> D (in PC2). /FTId = VAR_003851. |
| 98 | L -> P (in PC2). /FTId = VAR_017073. |
| 101 | V -> M (in PC2). /FTId = VAR_017074. |

The following GO Annotation(s) apply to the previously known protein. The following annotation(s) were found: epidermal differentiation, which are annotation(s) related to Biological Process; structural protein of cytoskeleton, which are annotation(s) related to Molecular Function; and intermediate filament, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSKERELP can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 69 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 69 and Table 2649. This cluster is overexpressed (at least at a minimum level) in the following pathological conditions: transitional cell carcinoma, epithelial malignant tumors, a mixture of malignant tumors from different tissues, myosarcoma, pancreas carcinoma and uterine malignancies.

TABLE 2649

Normal tissue distribution

| Name of Tissue | Number |
|---|---|
| adrenal | 40 |
| bladder | 123 |
| bone | 0 |
| brain | 11 |
| colon | 0 |
| epithelial | 977 |
| general | 321 |
| head and neck | 628 |
| kidney | 22 |
| lung | 1001 |
| lymph nodes | 0 |
| breast | 1349 |
| bone marrow | 0 |
| muscle | 9 |
| ovary | 0 |
| pancreas | 0 |
| prostate | 1503 |
| skin | 5340 |
| stomach | 0 |
| Thyroid | 154 |
| uterus | 22 |

TABLE 2650

P values and ratios for expression in cancerous tissue

| Name of Tissue | P1 | P2 | SP1 | R3 | SP2 | R4 |
|---|---|---|---|---|---|---|
| adrenal | 6.9e-01 | 7.3e-01 | 3.9e-02 | 1.7 | 8.9e-02 | 1.4 |
| bladder | 2.8e-01 | 2.9e-01 | 1.0e-08 | 4.1 | 3.8e-06 | 3.2 |
| bone | 1 | 4.3e-01 | 1 | 1.0 | 7.0e-01 | 1.5 |
| brain | 5.0e-01 | 3.2e-01 | 1 | 0.4 | 9.6e-29 | 1.5 |
| colon | 1.9e-01 | 1.8e-01 | 7.0e-01 | 1.5 | 7.7e-01 | 1.3 |
| epithelial | 4.2e-03 | 4.4e-02 | 1 | 0.4 | 1 | 0.4 |
| general | 2.2e-07 | 4.3e-06 | 1.7e-04 | 0.9 | 1.6e-04 | 1.0 |
| head and neck | 2.1e-01 | 2.5e-01 | 1.1e-02 | 0.7 | 3.8e-02 | 1.1 |
| kidney | 7.1e-01 | 8.0e-01 | 3.1e-01 | 1.6 | 5.3e-01 | 1.1 |
| Lung | 5.6e-01 | 8.5e-01 | 9.7e-01 | 0.2 | 1 | 0.1 |
| lymph nodes | 1 | 5.7e-01 | 1 | 1.0 | 1.1e-01 | 2.5 |
| breast | 6.9e-01 | 6.4e-01 | 1 | 0.1 | 1 | 0.1 |
| bone marrow | 1 | 6.7e-01 | 1 | 1.0 | 1.5e-01 | 2.8 |
| muscle | 4.0e-01 | 1.7e-01 | 1.5e-01 | 4.5 | 4.1e-28 | 3.8 |
| ovary | 4.5e-02 | 3.6e-02 | 1.5e-02 | 4.8 | 1.8e-02 | 4.7 |
| pancreas | 9.5e-02 | 6.5e-03 | 8.2e-11 | 6.5 | 4.3e-38 | 44.2 |
| prostate | 7.3e-01 | 8.0e-01 | 1 | 0.1 | 1 | 0.1 |
| Skin | 3.9e-01 | 5.5e-01 | 4.9e-08 | 0.0 | 1 | 0.0 |
| stomach | 4.5e-02 | 2.1e-01 | 1.3e-01 | 4.3 | 2.6e-01 | 2.3 |
| Thyroid | 6.4e-01 | 6.4e-01 | 8.9e-01 | 0.7 | 8.9e-01 | 0.7 |
| uterus | 5.7e-02 | 1.3e-02 | 9.9e-02 | 2.3 | 2.0e-09 | 7.9 |

As noted above, cluster HSKERELP features 53 segment(s), which were listed in Table 2646 above and for which the sequence(s) are given at the end of the application. These segment(s) are portions of nucleic acid sequence(s) which are described herein separately because they are of particular interest. A description of each segment according to the present invention is now provided.

Segment cluster HSKERELP_node_0 (SEQ ID NO:2797) according to the present invention is supported by 3 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2651 below describes the starting and ending position of this segment on each transcript.

TABLE 2651

Segment location on transcripts

| Transcript name | Segment starting position | Segment ending position |
|---|---|---|
| HSKERELP_T0 (SEQ ID NO: 2787) | 1 | 307 |
| HSKERELP_T2 (SEQ ID NO: 2788) | 1 | 307 |

TABLE 2651-continued

Segment location on transcripts

| Transcript name | Segment starting position | Segment ending position |
|---|---|---|
| HSKERELP_T6 (SEQ ID NO: 2789) | 1 | 307 |
| HSKERELP_T7 (SEQ ID NO: 2790) | 1 | 307 |
| HSKERELP_T11 (SEQ ID NO: 2791) | 1 | 307 |
| HSKERELP_T13 (SEQ ID NO: 2792) | 1 | 307 |
| HSKERELP_T18 (SEQ ID NO: 2793) | 1 | 307 |
| HSKERELP_T23 (SEQ ID NO: 2794) | 1 | 307 |
| HSKERELP_T25 (SEQ ID NO: 2795) | 1 | 307 |
| HSKERELP_T32 (SEQ ID NO: 2796) | 1 | 307 |

This segment can be found in a non-coding region of transcript(s) that are related to the following protein(s): HSKERELP_P1, HSKERELP_P3, HSKERELP_P7, HSKERELP_P8, HSKERELP_P12, HSKERELP_P14, HSKERELP_P19, HSKERELP_P23, HSKERELP_P9 and HSKERELP_P30.

Segment cluster HSKERELP_node_1 (SEQ ID NO:2798) according to the present invention is supported by 115 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2652 below describes the starting and ending position of this segment on each transcript.

TABLE 2652

Segment location on transcripts

| Transcript name | Segment starting position | Segment ending position |
|---|---|---|
| HSKERELP_T0 (SEQ ID NO: 2787) | 308 | 526 |
| HSKERELP_T2 (SEQ ID NO: 2788) | 308 | 526 |
| HSKERELP_T6 (SEQ ID NO: 2789) | 308 | 526 |
| HSKERELP_T7 (SEQ ID NO: 2790) | 308 | 526 |
| HSKERELP_T11 (SEQ ID NO: 2791) | 308 | 526 |
| HSKERELP_T13 (SEQ ID NO: 2792) | 308 | 526 |
| HSKERELP_T18 (SEQ ID NO: 2793) | 308 | 526 |
| HSKERELP_T23 (SEQ ID NO: 2794) | 308 | 526 |
| HSKERELP_T32 (SEQ ID NO: 2796) | 308 | 526 |

This segment can be found in a non-coding region of transcript(s) that are related to the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_45 (SEQ ID NO:2799) according to the present invention is supported by 255 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2653 below describes the starting and ending position of this segment on each transcript.

TABLE 2653

Segment location on transcripts

| Transcript name | Segment starting position | Segment ending position |
|---|---|---|
| HSKERELP_T0 (SEQ ID NO: 2787) | 1375 | 1500 |
| HSKERELP_T2 (SEQ ID NO: 2788) | 1375 | 1500 |
| HSKERELP_T6 (SEQ ID NO: 2789) | 1375 | 1500 |
| HSKERELP_T7 (SEQ ID NO: 2790) | 1375 | 1500 |
| HSKERELP_T11 (SEQ ID NO: 2791) | 1357 | 1482 |
| HSKERELP_T13 (SEQ ID NO: 2792) | 1358 | 1483 |
| HSKERELP_T18 (SEQ ID NO: 2793) | 1330 | 1455 |
| HSKERELP_T23 (SEQ ID NO: 2794) | 1315 | 1440 |
| HSKERELP_T25 (SEQ ID NO: 2795) | 839 | 964 |
| HSKERELP_T32 (SEQ ID NO: 2796) | 1069 | 1194 |

This segment can be found in both coding and non-coding regions of transcript(s) as follows. The segment can be found in a non-coding region of transcript(s) that are related to the following protein(s): HSKERELP_P14. This segment can also be found in the following protein(s): HSKERELP_P1, HSKERELP_P3, HSKERELP_P7, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_57 (SEQ ID NO:2800) according to the present invention is supported by 41 libraries. The number of libraries was determined as previously described. This segment can be found in the following transcript(s): HSKERELP_T2 (SEQ ID NO:2788). Table 2654 below describes the starting and ending position of this segment on each transcript.

TABLE 2654

Segment location on transcripts

| Transcript name | Segment starting position | Segment ending position |
|---|---|---|
| HSKERELP_T2 (SEQ ID NO: 2788) | 1745 | 2449 |

This segment can be found in the following protein(s): HSKERELP_P3.

Segment cluster HSKERELP_node_60 (SEQ ID NO:2801) according to the present invention is supported by 24 libraries. The number of libraries was determined as previously described. This segment can be found in the following transcript(s): HSKERELP_T2 (SEQ ID NO:2788). Table 2655 below describes the starting and ending position of this segment on each transcript.

TABLE 2655

Segment location on transcripts

| Transcript name | Segment starting position | Segment ending position |
|---|---|---|
| HSKERELP_T2 (SEQ ID NO: 2788) | 2450 | 2591 |

This segment can be found in a non-coding region of transcript(s) that are related to the following protein(s): HSKERELP_P3.

Segment cluster HSKERELP_node_64 (SEQ ID NO:2802) according to the present invention is supported by 183 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2656 below describes the starting and ending position of this segment on each transcript.

TABLE 2656

Segment location on transcripts

| Transcript name | Segment starting position | Segment ending position |
| --- | --- | --- |
| HSKERELP_T0 (SEQ ID NO: 2787) | 1876 | 2002 |
| HSKERELP_T2 (SEQ ID NO: 2788) | 2723 | 2849 |
| HSKERELP_T6 (SEQ ID NO: 2789) | 1962 | 2088 |
| HSKERELP_T7 (SEQ ID NO: 2790) | 1757 | 1883 |
| HSKERELP_T11 (SEQ ID NO: 2791) | 1858 | 1984 |
| HSKERELP_T13 (SEQ ID NO: 2792) | 1859 | 1985 |
| HSKERELP_T18 (SEQ ID NO: 2793) | 1831 | 1957 |
| HSKERELP_T23 (SEQ ID NO: 2794) | 1816 | 1942 |
| HSKERELP_T25 (SEQ ID NO: 2795) | 1340 | 1466 |
| HSKERELP_T32 (SEQ ID NO: 2796) | 1570 | 1696 |

This segment can be found in both coding and non-coding regions of transcript(s) as follows. The segment can be found in a non-coding region of transcript(s) that are related to the following protein(s): HSKERELP_P1, HSKERELP_P3, HSKERELP_P7, HSKERELP_P12, HSKERELP_P14, HSKERELP_P19, HSKERELP_P23, HSKERELP_P9 and HSKERELP_P30. This segment can also be found in the following protein(s): HSKERELP_P8, since it is in the coding region for the corresponding transcript.

According to an optional embodiment of the present invention, short segments related to the above cluster are also provided. These segments are up to about 120 bp in length, and so are included in a separate description.

Segment cluster HSKERELP_node_2 (SEQ ID NO:2803) according to the present invention is supported by 127 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2657 below describes the starting and ending position of this segment on each transcript.

TABLE 2657

Segment location on transcripts

| Transcript name | Segment starting position | Segment ending position |
| --- | --- | --- |
| HSKERELP_T0 (SEQ ID NO: 2787) | 527 | 575 |
| HSKERELP_T2 (SEQ ID NO: 2788) | 527 | 575 |
| HSKERELP_T6 (SEQ ID NO: 2789) | 527 | 575 |
| HSKERELP_T7 (SEQ ID NO: 2790) | 527 | 575 |
| HSKERELP_T11 (SEQ ID NO: 2791) | 527 | 575 |
| HSKERELP_T13 (SEQ ID NO: 2792) | 527 | 575 |

TABLE 2657-continued

Segment location on transcripts

| Transcript name | Segment starting position | Segment ending position |
| --- | --- | --- |
| HSKERELP_T18 (SEQ ID NO: 2793) | 527 | 575 |
| HSKERELP_T23 (SEQ ID NO: 2794) | 527 | 575 |
| HSKERELP_T32 (SEQ ID NO: 2796) | 527 | 575 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_3 (SEQ ID NO:2804) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2658 below describes the starting and ending position of this segment on each transcript.

TABLE 2658

Segment location on transcripts

| Transcript name | Segment starting position | Segment ending position |
| --- | --- | --- |
| HSKERELP_T0 (SEQ ID NO: 2787) | 576 | 590 |
| HSKERELP_T2 (SEQ ID NO: 2788) | 576 | 590 |
| HSKERELP_T6 (SEQ ID NO: 2789) | 576 | 590 |
| HSKERELP_T7 (SEQ ID NO: 2790) | 576 | 590 |
| HSKERELP_T11 (SEQ ID NO: 2791) | 576 | 590 |
| HSKERELP_T13 (SEQ ID NO: 2792) | 576 | 590 |
| HSKERELP_T18 (SEQ ID NO: 2793) | 576 | 590 |
| HSKERELP_T23 (SEQ ID NO: 2794) | 576 | 590 |
| HSKERELP_T32 (SEQ ID NO: 2796) | 576 | 590 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_4 (SEQ ID NO:2805) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2659 below describes the starting and ending position of this segment on each transcript.

TABLE 2659

Segment location on transcripts

| Transcript name | Segment starting position | Segment ending position |
| --- | --- | --- |
| HSKERELP_T0 (SEQ ID NO: 2787) | 591 | 597 |
| HSKERELP_T2 (SEQ ID NO: 2788) | 591 | 597 |

TABLE 2659-continued

Segment location on transcripts

| Transcript name | Segment starting position | Segment ending position |
|---|---|---|
| HSKERELP_T6 (SEQ ID NO: 2789) | 591 | 597 |
| HSKERELP_T7 (SEQ ID NO: 2790) | 591 | 597 |
| HSKERELP_T11 (SEQ ID NO: 2791) | 591 | 597 |
| HSKERELP_T13 (SEQ ID NO: 2792) | 591 | 597 |
| HSKERELP_T18 (SEQ ID NO: 2793) | 591 | 597 |
| HSKERELP_T23 (SEQ ID NO: 2794) | 591 | 597 |
| HSKERELP_T32 (SEQ ID NO: 2796) | 591 | 597 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_5 (SEQ ID NO:2806) according to the present invention is supported by 135 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2660 below describes the starting and ending position of this segment on each transcript.

TABLE 2660

Segment location on transcripts

| Transcript name | Segment starting position | Segment ending position |
|---|---|---|
| HSKERELP_T0 (SEQ ID NO: 2787) | 598 | 641 |
| HSKERELP_T2 (SEQ ID NO: 2788) | 598 | 641 |
| HSKERELP_T6 (SEQ ID NO: 2789) | 598 | 641 |
| HSKERELP_T7 (SEQ ID NO: 2790) | 598 | 641 |
| HSKERELP_T11 (SEQ ID NO: 2791) | 598 | 641 |
| HSKERELP_T13 (SEQ ID NO: 2792) | 598 | 641 |
| HSKERELP_T18 (SEQ ID NO: 2793) | 598 | 641 |
| HSKERELP_T23 (SEQ ID NO: 2794) | 598 | 641 |
| HSKERELP_T32 (SEQ ID NO: 2796) | 598 | 641 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_6 (SEQ ID NO:2807) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2661 below describes the starting and ending position of this segment on each transcript.

TABLE 2661

Segment location on transcripts

| Transcript name | Segment starting position | Segment ending position |
|---|---|---|
| HSKERELP_T0 (SEQ ID NO: 2787) | 642 | 656 |
| HSKERELP_T2 (SEQ ID NO: 2788) | 642 | 656 |
| HSKERELP_T6 (SEQ ID NO: 2789) | 642 | 656 |
| HSKERELP_T7 (SEQ ID NO: 2790) | 642 | 656 |
| HSKERELP_T11 (SEQ ID NO: 2791) | 642 | 656 |
| HSKERELP_T13 (SEQ ID NO: 2792) | 642 | 656 |
| HSKERELP_T18 (SEQ ID NO: 2793) | 642 | 656 |
| HSKERELP_T23 (SEQ ID NO: 2794) | 642 | 656 |
| HSKERELP_T32 (SEQ ID NO: 2796) | 642 | 656 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_7 (SEQ ID NO:2808) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2662 below describes the starting and ending position of this segment on each transcript.

TABLE 2662

Segment location on transcripts

| Transcript name | Segment starting position | Segment ending position |
|---|---|---|
| HSKERELP_T0 (SEQ ID NO: 2787) | 657 | 663 |
| HSKERELP_T2 (SEQ ID NO: 2788) | 657 | 663 |
| HSKERELP_T6 (SEQ ID NO: 2789) | 657 | 663 |
| HSKERELP_T7 (SEQ ID NO: 2790) | 657 | 663 |
| HSKERELP_T11 (SEQ ID NO: 2791) | 657 | 663 |
| HSKERELP_T13 (SEQ ID NO: 2792) | 657 | 663 |
| HSKERELP_T18 (SEQ ID NO: 2793) | 657 | 663 |
| HSKERELP_T23 (SEQ ID NO: 2794) | 657 | 663 |
| HSKERELP_T32 (SEQ ID NO: 2796) | 657 | 663 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_8 (SEQ ID NO:2809) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2663 below describes the starting and ending position of this segment on each transcript.

TABLE 2663

Segment location on transcripts

| Transcript name | Segment starting position | Segment ending position |
|---|---|---|
| HSKERELP_T0 (SEQ ID NO: 2787) | 664 | 674 |
| HSKERELP_T2 (SEQ ID NO: 2788) | 664 | 674 |
| HSKERELP_T6 (SEQ ID NO: 2789) | 664 | 674 |
| HSKERELP_T7 (SEQ ID NO: 2790) | 664 | 674 |
| HSKERELP_T11 (SEQ ID NO: 2791) | 664 | 674 |
| HSKERELP_T13 (SEQ ID NO: 2792) | 664 | 674 |
| HSKERELP_T18 (SEQ ID NO: 2793) | 664 | 674 |
| HSKERELP_T23 (SEQ ID NO: 2794) | 664 | 674 |
| HSKERELP_T32 (SEQ ID NO: 2796) | 664 | 674 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_9 (SEQ ID NO:2810) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2664 below describes the starting and ending position of this segment on each transcript.

TABLE 2664

Segment location on transcripts

| Transcript name | Segment starting position | Segment ending position |
|---|---|---|
| HSKERELP_T0 (SEQ ID NO: 2787) | 675 | 689 |
| HSKERELP_T2 (SEQ ID NO: 2788) | 675 | 689 |
| HSKERELP_T6 (SEQ ID NO: 2789) | 675 | 689 |
| HSKERELP_T7 (SEQ ID NO: 2790) | 675 | 689 |
| HSKERELP_T11 (SEQ ID NO: 2791) | 675 | 689 |
| HSKERELP_T13 (SEQ ID NO: 2792) | 675 | 689 |
| HSKERELP_T18 (SEQ ID NO: 2793) | 675 | 689 |
| HSKERELP_T23 (SEQ ID NO: 2794) | 675 | 689 |
| HSKERELP_T32 (SEQ ID NO: 2796) | 675 | 689 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_10 (SEQ ID NO:2811) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2665 below describes the starting and ending position of this segment on each transcript.

TABLE 2665

Segment location on transcripts

| Transcript name | Segment starting position | Segment ending position |
|---|---|---|
| HSKERELP_T0 (SEQ ID NO: 2787) | 690 | 693 |
| HSKERELP_T2 (SEQ ID NO: 2788) | 690 | 693 |
| HSKERELP_T6 (SEQ ID NO: 2789) | 690 | 693 |
| HSKERELP_T7 (SEQ ID NO: 2790) | 690 | 693 |
| HSKERELP_T11 (SEQ ID NO: 2791) | 690 | 693 |
| HSKERELP_T13 (SEQ ID NO: 2792) | 690 | 693 |
| HSKERELP_T18 (SEQ ID NO: 2793) | 690 | 693 |
| HSKERELP_T23 (SEQ ID NO: 2794) | 690 | 693 |
| HSKERELP_T32 (SEQ ID NO: 2796) | 690 | 693 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_11 (SEQ ID NO:2812) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2666 below describes the starting and ending position of this segment on each transcript.

TABLE 2666

Segment location on transcripts

| Transcript name | Segment starting position | Segment ending position |
|---|---|---|
| HSKERELP_T0 (SEQ ID NO: 2787) | 694 | 711 |
| HSKERELP_T2 (SEQ ID NO: 2788) | 694 | 711 |
| HSKERELP_T6 (SEQ ID NO: 2789) | 694 | 711 |
| HSKERELP_T7 (SEQ ID NO: 2790) | 694 | 711 |
| HSKERELP_T13 (SEQ ID NO: 2792) | 694 | 711 |
| HSKERELP_T18 (SEQ ID NO: 2793) | 694 | 711 |
| HSKERELP_T23 (SEQ ID NO: 2794) | 694 | 711 |
| HSKERELP_T32 (SEQ ID NO: 2796) | 694 | 711 |

This segment can be found in the following protein(s): HSKERELP_P1, HSKERELP_P3, HSKERELP_P7, HSKERELP_P8, HSKERELP_P14, HSKERELP_P19, HSKERELP_P23 and HSKERELP_P30.

Segment cluster HSKERELP_node_12 (SEQ ID NO:2813) according to the present invention is supported by 146 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2667 below describes the starting and ending position of this segment on each transcript.

TABLE 2667

Segment location on transcripts

| Transcript name | Segment starting position | Segment ending position |
| --- | --- | --- |
| HSKERELP_T0 (SEQ ID NO: 2787) | 712 | 781 |
| HSKERELP_T2 (SEQ ID NO: 2788) | 712 | 781 |
| HSKERELP_T6 (SEQ ID NO: 2789) | 712 | 781 |
| HSKERELP_T7 (SEQ ID NO: 2790) | 712 | 781 |
| HSKERELP_T11 (SEQ ID NO: 2791) | 694 | 763 |
| HSKERELP_T13 (SEQ ID NO: 2792) | 712 | 781 |
| HSKERELP_T18 (SEQ ID NO: 2793) | 712 | 781 |
| HSKERELP_T23 (SEQ ID NO: 2794) | 712 | 781 |
| HSKERELP_T32 (SEQ ID NO: 2796) | 712 | 781 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_13 (SEQ ID NO:2814) according to the present invention is supported by 132 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T32 (SEQ ID NO:2796). Table 2668 below describes the starting and ending position of this segment on each transcript.

TABLE 2668

Segment location on transcripts

| Transcript name | Segment starting position | Segment ending position |
| --- | --- | --- |
| HSKERELP_T0 (SEQ ID NO: 2787) | 782 | 822 |
| HSKERELP_T2 (SEQ ID NO: 2788) | 782 | 822 |
| HSKERELP_T6 (SEQ ID NO: 2789) | 782 | 822 |
| HSKERELP_T7 (SEQ ID NO: 2790) | 782 | 822 |
| HSKERELP_T11 (SEQ ID NO: 2791) | 764 | 804 |
| HSKERELP_T13 (SEQ ID NO: 2792) | 782 | 822 |
| HSKERELP_T18 (SEQ ID NO: 2793) | 782 | 822 |
| HSKERELP_T23 (SEQ ID NO: 2794) | 782 | 822 |
| HSKERELP_T32 (SEQ ID NO: 2796) | 782 | 822 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30.

Segment cluster HSKERELP_node_14 (SEQ ID NO:2815) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T23 (SEQ ID NO:2794) and HSKERELP_T32 (SEQ ID NO:2796). Table 2669 below describes the starting and ending position of this segment on each transcript.

TABLE 2669

Segment location on transcripts

| Transcript name | Segment starting position | Segment ending position |
| --- | --- | --- |
| HSKERELP_T0 (SEQ ID NO: 2787) | 823 | 830 |
| HSKERELP_T2 (SEQ ID NO: 2788) | 823 | 830 |
| HSKERELP_T6 (SEQ ID NO: 2789) | 823 | 830 |
| HSKERELP_T7 (SEQ ID NO: 2790) | 823 | 830 |
| HSKERELP_T11 (SEQ ID NO: 2791) | 805 | 812 |
| HSKERELP_T13 (SEQ ID NO: 2792) | 823 | 830 |
| HSKERELP_T23 (SEQ ID NO: 2794) | 823 | 830 |
| HSKERELP_T32 (SEQ ID NO: 2796) | 823 | 830 |

This segment can be found in the following protein(s): HSKERELP_P1, HSKERELP_P3, HSKERELP_P7, HSKERELP_P8, HSKERELP_P12, HSKERELP_P14, HSKERELP_P23 and HSKERELP_P30.

Segment cluster HSKERELP_node_15 (SEQ ID NO:2816) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T23 (SEQ ID NO:2794) and HSKERELP_T32 (SEQ ID NO:2796). Table 2670 below describes the starting and ending position of this segment on each transcript.

TABLE 2670

Segment location on transcripts

| Transcript name | Segment starting position | Segment ending position |
| --- | --- | --- |
| HSKERELP_T0 (SEQ ID NO: 2787) | 831 | 843 |
| HSKERELP_T2 (SEQ ID NO: 2788) | 831 | 843 |
| HSKERELP_T6 (SEQ ID NO: 2789) | 831 | 843 |
| HSKERELP_T7 (SEQ ID NO: 2790) | 831 | 843 |
| HSKERELP_T11 (SEQ ID NO: 2791) | 813 | 825 |
| HSKERELP_T13 (SEQ ID NO: 2792) | 831 | 843 |
| HSKERELP_T23 (SEQ ID NO: 2794) | 831 | 843 |
| HSKERELP_T32 (SEQ ID NO: 2796) | 831 | 843 |

This segment can be found in the following protein(s): HSKERELP_P1, HSKERELP_P3, HSKERELP_P7, HSKERELP_P8, HSKERELP_P12, HSKERELP_P14, HSKERELP_P23 and HSKERELP_P30.

Segment cluster HSKERELP_node_16 (SEQ ID NO:2817) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T23 (SEQ ID NO:2794), HSKERELP_T25 (SEQ ID NO:2795) and HSKERELP_T32 (SEQ ID NO:2796). Table 2671 below describes the starting and ending position of this segment on each transcript.

TABLE 2671

Segment location on transcripts

| Transcript name | Segment starting position | Segment ending position |
|---|---|---|
| HSKERELP_T0 (SEQ ID NO: 2787) | 844 | 867 |
| HSKERELP_T2 (SEQ ID NO: 2788) | 844 | 867 |
| HSKERELP_T6 (SEQ ID NO: 2789) | 844 | 867 |
| HSKERELP_T7 (SEQ ID NO: 2790) | 844 | 867 |
| HSKERELP_T11 (SEQ ID NO: 2791) | 826 | 849 |
| HSKERELP_T13 (SEQ ID NO: 2792) | 844 | 867 |
| HSKERELP_T23 (SEQ ID NO: 2794) | 844 | 867 |
| HSKERELP_T25 (SEQ ID NO: 2795) | 308 | 331 |
| HSKERELP_T32 (SEQ ID NO: 2796) | 844 | 867 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P23 and HSKERELP_P30, since it is in the coding region for the corresponding transcript.

Segment cluster HSKERELP_node_17 (SEQ ID NO:2818) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2672 below describes the starting and ending position of this segment on each transcript.

TABLE 2672

Segment location on transcripts

| Transcript name | Segment starting position | Segment ending position |
|---|---|---|
| HSKERELP_T0 (SEQ ID NO: 2787) | 868 | 873 |
| HSKERELP_T2 (SEQ ID NO: 2788) | 868 | 873 |
| HSKERELP_T6 (SEQ ID NO: 2789) | 868 | 873 |
| HSKERELP_T7 (SEQ ID NO: 2790) | 868 | 873 |
| HSKERELP_T11 (SEQ ID NO: 2791) | 850 | 855 |
| HSKERELP_T13 (SEQ ID NO: 2792) | 868 | 873 |
| HSKERELP_T18 (SEQ ID NO: 2793) | 823 | 828 |
| HSKERELP_T23 (SEQ ID NO: 2794) | 868 | 873 |
| HSKERELP_T25 (SEQ ID NO: 2795) | 332 | 337 |
| HSKERELP_T32 (SEQ ID NO: 2796) | 868 | 873 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30, since it is in the coding region for the corresponding transcript.

Segment cluster HSKERELP_node_18 (SEQ ID NO:2819) according to the present invention is supported by 146 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2673 below describes the starting and ending position of this segment on each transcript.

TABLE 2673

Segment location on transcripts

| Transcript name | Segment starting position | Segment ending position |
|---|---|---|
| HSKERELP_T0 (SEQ ID NO: 2787) | 874 | 925 |
| HSKERELP_T2 (SEQ ID NO: 2788) | 874 | 925 |
| HSKERELP_T6 (SEQ ID NO: 2789) | 874 | 925 |
| HSKERELP_T7 (SEQ ID NO: 2790) | 874 | 925 |
| HSKERELP_T11 (SEQ ID NO: 2791) | 856 | 907 |
| HSKERELP_T13 (SEQ ID NO: 2792) | 874 | 925 |
| HSKERELP_T18 (SEQ ID NO: 2793) | 829 | 880 |
| HSKERELP_T23 (SEQ ID NO: 2794) | 874 | 925 |
| HSKERELP_T25 (SEQ ID NO: 2795) | 338 | 389 |
| HSKERELP_T32 (SEQ ID NO: 2796) | 874 | 925 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30, since it is in the coding region for the corresponding transcript.

Segment cluster HSKERELP_node_19 (SEQ ID NO:2820) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2674 below describes the starting and ending position of this segment on each transcript.

TABLE 2674

Segment location on transcripts

| Transcript name | Segment starting position | Segment ending position |
|---|---|---|
| HSKERELP_T0 (SEQ ID NO: 2787) | 926 | 941 |
| HSKERELP_T2 (SEQ ID NO: 2788) | 926 | 941 |
| HSKERELP_T6 (SEQ ID NO: 2789) | 926 | 941 |
| HSKERELP_T7 (SEQ ID NO: 2790) | 926 | 941 |
| HSKERELP_T11 (SEQ ID NO: 2791) | 908 | 923 |
| HSKERELP_T13 (SEQ ID NO: 2792) | 926 | 941 |
| HSKERELP_T18 (SEQ ID NO: 2793) | 881 | 896 |
| HSKERELP_T23 (SEQ ID NO: 2794) | 926 | 941 |
| HSKERELP_T25 (SEQ ID NO: 2795) | 390 | 405 |
| HSKERELP_T32 (SEQ ID NO: 2796) | 926 | 941 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30, since it is in the coding region for the corresponding transcript.

Segment cluster HSKERELP_node_20 (SEQ ID NO:2821) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2675 below describes the starting and ending position of this segment on each transcript.

TABLE 2675

Segment location on transcripts

| Transcript name | Segment starting position | Segment ending position |
|---|---|---|
| HSKERELP_T0 (SEQ ID NO: 2787) | 942 | 960 |
| HSKERELP_T2 (SEQ ID NO: 2788) | 942 | 960 |
| HSKERELP_T6 (SEQ ID NO: 2789) | 942 | 960 |
| HSKERELP_T7 (SEQ ID NO: 2790) | 942 | 960 |
| HSKERELP_T11 (SEQ ID NO: 2791) | 924 | 942 |
| HSKERELP_T13 (SEQ ID NO: 2792) | 942 | 960 |
| HSKERELP_T18 (SEQ ID NO: 2793) | 897 | 915 |
| HSKERELP_T23 (SEQ ID NO: 2794) | 942 | 960 |
| HSKERELP_T25 (SEQ ID NO: 2795) | 406 | 424 |
| HSKERELP_T32 (SEQ ID NO: 2796) | 942 | 960 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30, since it is in the coding region for the corresponding transcript.

Segment cluster HSKERELP_node_21 (SEQ ID NO:2822) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2676 below describes the starting and ending position of this segment on each transcript.

TABLE 2676

Segment location on transcripts

| Transcript name | Segment starting position | Segment ending position |
|---|---|---|
| HSKERELP_T0 (SEQ ID NO: 2787) | 961 | 972 |
| HSKERELP_T2 (SEQ ID NO: 2788) | 961 | 972 |
| HSKERELP_T6 (SEQ ID NO: 2789) | 961 | 972 |
| HSKERELP_T7 (SEQ ID NO: 2790) | 961 | 972 |
| HSKERELP_T11 (SEQ ID NO: 2791) | 943 | 954 |
| HSKERELP_T13 (SEQ ID NO: 2792) | 961 | 972 |

TABLE 2676-continued

Segment location on transcripts

| Transcript name | Segment starting position | Segment ending position |
|---|---|---|
| HSKERELP_T18 (SEQ ID NO: 2793) | 916 | 927 |
| HSKERELP_T23 (SEQ ID NO: 2794) | 961 | 972 |
| HSKERELP_T25 (SEQ ID NO: 2795) | 425 | 436 |
| HSKERELP_T32 (SEQ ID NO: 2796) | 961 | 972 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P30, since it is in the coding region for the corresponding transcript.

Segment cluster HSKERELP_node_25 (SEQ ID NO:2823) according to the present invention is supported by 172 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2677 below describes the starting and ending position of this segment on each transcript.

TABLE 2677

Segment location on transcripts

| Transcript name | Segment starting position | Segment ending position |
|---|---|---|
| HSKERELP_T0 (SEQ ID NO: 2787) | 973 | 1055 |
| HSKERELP_T2 (SEQ ID NO: 2788) | 973 | 1055 |
| HSKERELP_T6 (SEQ ID NO: 2789) | 973 | 1055 |
| HSKERELP_T7 (SEQ ID NO: 2790) | 973 | 1055 |
| HSKERELP_T11 (SEQ ID NO: 2791) | 955 | 1037 |
| HSKERELP_T13 (SEQ ID NO: 2792) | 973 | 1055 |
| HSKERELP_T18 (SEQ ID NO: 2793) | 928 | 1010 |
| HSKERELP_T23 (SEQ ID NO: 2794) | 973 | 1055 |
| HSKERELP_T25 (SEQ ID NO: 2795) | 437 | 519 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19 and HSKERELP_P23, since it is in the coding region for the corresponding transcript.

Segment cluster HSKERELP_node_27 (SEQ ID NO:2824) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793) and HSKERELP_T25 (SEQ ID NO:2795). Table 2678 below describes the starting and ending position of this segment on each transcript.

TABLE 2678

Segment location on transcripts

| Transcript name | Segment starting position | Segment ending position |
|---|---|---|
| HSKERELP_T0 (SEQ ID NO: 2787) | 1056 | 1080 |
| HSKERELP_T2 (SEQ ID NO: 2788) | 1056 | 1080 |
| HSKERELP_T6 (SEQ ID NO: 2789) | 1056 | 1080 |
| HSKERELP_T7 (SEQ ID NO: 2790) | 1056 | 1080 |
| HSKERELP_T11 (SEQ ID NO: 2791) | 1038 | 1062 |
| HSKERELP_T13 (SEQ ID NO: 2792) | 1056 | 1080 |
| HSKERELP_T18 (SEQ ID NO: 2793) | 1011 | 1035 |
| HSKERELP_T25 (SEQ ID NO: 2795) | 520 | 544 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14 and HSKERELP_P19, since it is in the coding region for the corresponding transcript.

Segment cluster HSKERELP_node_28 (SEQ ID NO:2825) according to the present invention is supported by 167 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793) and HSKERELP_T25 (SEQ ID NO:2795). Table 2679 below describes the starting and ending position of this segment on each transcript.

TABLE 2679

Segment location on transcripts

| Transcript name | Segment starting position | Segment ending position |
|---|---|---|
| HSKERELP_T0 (SEQ ID NO: 2787) | 1081 | 1115 |
| HSKERELP_T2 (SEQ ID NO: 2788) | 1081 | 1115 |
| HSKERELP_T6 (SEQ ID NO: 2789) | 1081 | 1115 |
| HSKERELP_T7 (SEQ ID NO: 2790) | 1081 | 1115 |
| HSKERELP_T11 (SEQ ID NO: 2791) | 1063 | 1097 |
| HSKERELP_T13 (SEQ ID NO: 2792) | 1081 | 1115 |
| HSKERELP_T18 (SEQ ID NO: 2793) | 1036 | 1070 |
| HSKERELP_T25 (SEQ ID NO: 2795) | 545 | 579 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14 and HSKERELP_P19, since it is in the coding region for the corresponding transcript.

Segment cluster HSKERELP_node_29 (SEQ ID NO:2826) according to the present invention is supported by 172 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2680 below describes the starting and ending position of this segment on each transcript.

TABLE 2680

Segment location on transcripts

| Transcript name | Segment starting position | Segment ending position |
|---|---|---|
| HSKERELP_T0 (SEQ ID NO: 2787) | 1116 | 1149 |
| HSKERELP_T2 (SEQ ID NO: 2788) | 1116 | 1149 |
| HSKERELP_T6 (SEQ ID NO: 2789) | 1116 | 1149 |
| HSKERELP_T7 (SEQ ID NO: 2790) | 1116 | 1149 |
| HSKERELP_T11 (SEQ ID NO: 2791) | 1098 | 1131 |
| HSKERELP_T13 (SEQ ID NO: 2792) | 1116 | 1149 |
| HSKERELP_T18 (SEQ ID NO: 2793) | 1071 | 1104 |
| HSKERELP_T23 (SEQ ID NO: 2794) | 1056 | 1089 |
| HSKERELP_T25 (SEQ ID NO: 2795) | 580 | 613 |

This segment can be found in both coding and non-coding regions of transcript(s) as follows. The segment can be found in a non-coding region of transcript(s) that are related to the following protein(s): HSKERELP_P9. This segment can also be found in the following protein(s): HSKERELP_P1, HSKERELP_P3, HSKERELP_P7, HSKERELP_P8, HSKERELP_P12, HSKERELP_P14, HSKERELP_P19 and HSKERELP_P23, since it is in the coding region for the corresponding transcript.

Segment cluster HSKERELP_node_30 (SEQ ID NO:2827) according to the present invention is supported by 183 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2681 below describes the starting and ending position of this segment on each transcript.

TABLE 2681

Segment location on transcripts

| Transcript name | Segment starting position | Segment ending position |
|---|---|---|
| HSKERELP_T0 (SEQ ID NO: 2787) | 1150 | 1191 |
| HSKERELP_T2 (SEQ ID NO: 2788) | 1150 | 1191 |
| HSKERELP_T6 (SEQ ID NO: 2789) | 1150 | 1191 |
| HSKERELP_T7 (SEQ ID NO: 2790) | 1150 | 1191 |
| HSKERELP_T11 (SEQ ID NO: 2791) | 1132 | 1173 |
| HSKERELP_T13 (SEQ ID NO: 2792) | 1150 | 1191 |
| HSKERELP_T18 (SEQ ID NO: 2793) | 1105 | 1146 |
| HSKERELP_T23 (SEQ ID NO: 2794) | 1090 | 1131 |
| HSKERELP_T25 (SEQ ID NO: 2795) | 614 | 655 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P9.

Segment cluster HSKERELP_node_31 (SEQ ID NO:2828) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2682 below describes the starting and ending position of this segment on each transcript.

TABLE 2682

Segment location on transcripts

| Transcript name | Segment starting position | Segment ending position |
|---|---|---|
| HSKERELP_T0 (SEQ ID NO: 2787) | 1192 | 1212 |
| HSKERELP_T2 (SEQ ID NO: 2788) | 1192 | 1212 |
| HSKERELP_T6 (SEQ ID NO: 2789) | 1192 | 1212 |
| HSKERELP_T7 (SEQ ID NO: 2790) | 1192 | 1212 |
| HSKERELP_T11 (SEQ ID NO: 2791) | 1174 | 1194 |
| HSKERELP_T13 (SEQ ID NO: 2792) | 1192 | 1212 |
| HSKERELP_T18 (SEQ ID NO: 2793) | 1147 | 1167 |
| HSKERELP_T23 (SEQ ID NO: 2794) | 1132 | 1152 |
| HSKERELP_T25 (SEQ ID NO: 2795) | 656 | 676 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P9.

Segment cluster HSKERELP_node_35 (SEQ ID NO:2829) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2683 below describes the starting and ending position of this segment on each transcript.

TABLE 2683

Segment location on transcripts

| Transcript name | Segment starting position | Segment ending position |
|---|---|---|
| HSKERELP_T0 (SEQ ID NO: 2787) | 1213 | 1236 |
| HSKERELP_T2 (SEQ ID NO: 2788) | 1213 | 1236 |
| HSKERELP_T6 (SEQ ID NO: 2789) | 1213 | 1236 |
| HSKERELP_T7 (SEQ ID NO: 2790) | 1213 | 1236 |
| HSKERELP_T11 (SEQ ID NO: 2791) | 1195 | 1218 |
| HSKERELP_T13 (SEQ ID NO: 2792) | 1213 | 1236 |
| HSKERELP_T18 (SEQ ID NO: 2793) | 1168 | 1191 |
| HSKERELP_T23 (SEQ ID NO: 2794) | 1153 | 1176 |
| HSKERELP_T25 (SEQ ID NO: 2795) | 677 | 700 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P9.

Segment cluster HSKERELP_node_36 (SEQ ID NO:2830) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2684 below describes the starting and ending position of this segment on each transcript.

TABLE 2684

Segment location on transcripts

| Transcript name | Segment starting position | Segment ending position |
|---|---|---|
| HSKERELP_T0 (SEQ ID NO: 2787) | 1237 | 1243 |
| HSKERELP_T2 (SEQ ID NO: 2788) | 1237 | 1243 |
| HSKERELP_T6 (SEQ ID NO: 2789) | 1237 | 1243 |
| HSKERELP_T7 (SEQ ID NO: 2790) | 1237 | 1243 |
| HSKERELP_T11 (SEQ ID NO: 2791) | 1219 | 1225 |
| HSKERELP_T13 (SEQ ID NO: 2792) | 1237 | 1243 |
| HSKERELP_T18 (SEQ ID NO: 2793) | 1192 | 1198 |
| HSKERELP_T23 (SEQ ID NO: 2794) | 1177 | 1183 |
| HSKERELP_T25 (SEQ ID NO: 2795) | 701 | 707 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P9.

Segment cluster HSKERELP_node_37 (SEQ ID NO:2831) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T18 (SEQ ID NO:2793), HSKERELP_T23 (SEQ ID NO:2794) and HSKERELP_T25 (SEQ ID NO:2795). Table 2685 below describes the starting and ending position of this segment on each transcript.

TABLE 2685

Segment location on transcripts

| Transcript name | Segment starting position | Segment ending position |
|---|---|---|
| HSKERELP_T0 (SEQ ID NO: 2787) | 1244 | 1260 |
| HSKERELP_T2 (SEQ ID NO: 2788) | 1244 | 1260 |
| HSKERELP_T6 (SEQ ID NO: 2789) | 1244 | 1260 |
| HSKERELP_T7 (SEQ ID NO: 2790) | 1244 | 1260 |
| HSKERELP_T11 (SEQ ID NO: 2791) | 1226 | 1242 |
| HSKERELP_T18 (SEQ ID NO: 2793) | 1199 | 1215 |
| HSKERELP_T23 (SEQ ID NO: 2794) | 1184 | 1200 |
| HSKERELP_T25 (SEQ ID NO: 2795) | 708 | 724 |

This segment can be found in the following protein(s): HSKERELP_P1, HSKERELP_P3, HSKERELP_P7, HSKERELP_P8, HSKERELP_P12, HSKERELP_P19, HSKERELP_P23 and HSKERELP_P9.

Segment cluster HSKERELP_node_38 (SEQ ID NO:2832) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794) and HSKERELP_T25 (SEQ ID NO:2795). Table 2686 below describes the starting and ending position of this segment on each transcript.

TABLE 2686

Segment location on transcripts

| Transcript name | Segment starting position | Segment ending position |
|---|---|---|
| HSKERELP_T0 (SEQ ID NO: 2787) | 1261 | 1278 |
| HSKERELP_T2 (SEQ ID NO: 2788) | 1261 | 1278 |
| HSKERELP_T6 (SEQ ID NO: 2789) | 1261 | 1278 |
| HSKERELP_T7 (SEQ ID NO: 2790) | 1261 | 1278 |
| HSKERELP_T11 (SEQ ID NO: 2791) | 1243 | 1260 |
| HSKERELP_T13 (SEQ ID NO: 2792) | 1244 | 1261 |
| HSKERELP_T18 (SEQ ID NO: 2793) | 1216 | 1233 |
| HSKERELP_T23 (SEQ ID NO: 2794) | 1201 | 1218 |
| HSKERELP_T25 (SEQ ID NO: 2795) | 725 | 742 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23 and HSKERELP_P9.

Segment cluster HSKERELP_node_39 (SEQ ID NO:2833) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2687 below describes the starting and ending position of this segment on each transcript.

TABLE 2687

Segment location on transcripts

| Transcript name | Segment starting position | Segment ending position |
|---|---|---|
| HSKERELP_T0 (SEQ ID NO: 2787) | 1279 | 1295 |
| HSKERELP_T2 (SEQ ID NO: 2788) | 1279 | 1295 |
| HSKERELP_T6 (SEQ ID NO: 2789) | 1279 | 1295 |
| HSKERELP_T7 (SEQ ID NO: 2790) | 1279 | 1295 |
| HSKERELP_T11 (SEQ ID NO: 2791) | 1261 | 1277 |
| HSKERELP_T13 (SEQ ID NO: 2792) | 1262 | 1278 |
| HSKERELP_T18 (SEQ ID NO: 2793) | 1234 | 1250 |
| HSKERELP_T23 (SEQ ID NO: 2794) | 1219 | 1235 |
| HSKERELP_T25 (SEQ ID NO: 2795) | 743 | 759 |
| HSKERELP_T32 (SEQ ID NO: 2796) | 973 | 989 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23, HSKERELP_P9 and HSKERELP_P30.

Segment cluster HSKERELP_node_40 (SEQ ID NO:2834) according to the present invention is supported by 193 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2688 below describes the starting and ending position of this segment on each transcript.

TABLE 2688

Segment location on transcripts

| Transcript name | Segment starting position | Segment ending position |
|---|---|---|
| HSKERELP_T0 (SEQ ID NO: 2787) | 1296 | 1322 |
| HSKERELP_T2 (SEQ ID NO: 2788) | 1296 | 1322 |
| HSKERELP_T6 (SEQ ID NO: 2789) | 1296 | 1322 |
| HSKERELP_T7 (SEQ ID NO: 2790) | 1296 | 1322 |
| HSKERELP_T11 (SEQ ID NO: 2791) | 1278 | 1304 |
| HSKERELP_T13 (SEQ ID NO: 2792) | 1279 | 1305 |
| HSKERELP_T18 (SEQ ID NO: 2793) | 1251 | 1277 |
| HSKERELP_T23 (SEQ ID NO: 2794) | 1236 | 1262 |
| HSKERELP_T25 (SEQ ID NO: 2795) | 760 | 786 |
| HSKERELP_T32 (SEQ ID NO: 2796) | 990 | 1016 |

This segment can be found in the following protein(s): HSKERELP_P1, HSKERELP_P3, HSKERELP_P7, HSKERELP_P8, HSKERELP_P12, HSKERELP_P14, HSKERELP_P19, HSKERELP_P23, HSKERELP_P9 and HSKERELP_P30.

Segment cluster HSKERELP_node_41 (SEQ ID NO:2835) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2689 below describes the starting and ending position of this segment on each transcript.

TABLE 2689

Segment location on transcripts

| Transcript name | Segment starting position | Segment ending position |
|---|---|---|
| HSKERELP_T0 (SEQ ID NO: 2787) | 1323 | 1330 |
| HSKERELP_T2 (SEQ ID NO: 2788) | 1323 | 1330 |
| HSKERELP_T6 (SEQ ID NO: 2789) | 1323 | 1330 |
| HSKERELP_T7 (SEQ ID NO: 2790) | 1323 | 1330 |
| HSKERELP_T11 (SEQ ID NO: 2791) | 1305 | 1312 |
| HSKERELP_T13 (SEQ ID NO: 2792) | 1306 | 1313 |
| HSKERELP_T18 (SEQ ID NO: 2793) | 1278 | 1285 |
| HSKERELP_T23 (SEQ ID NO: 2794) | 1263 | 1270 |
| HSKERELP_T25 (SEQ ID NO: 2795) | 787 | 794 |
| HSKERELP_T32 (SEQ ID NO: 2796) | 1017 | 1024 |

This segment can be found in both coding and non-coding regions of transcript(s) as follows. The segment can be found in a non-coding region of transcript(s) that are related to the following protein(s): HSKERELP_P14. This segment can also be found in the following protein(s): HSKERELP_P1, HSKERELP_P3, HSKERELP_P7, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_42 (SEQ ID NO:2836) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2690 below describes the starting and ending position of this segment on each transcript.

TABLE 2690

Segment location on transcripts

| Transcript name | Segment starting position | Segment ending position |
|---|---|---|
| HSKERELP_T0 (SEQ ID NO: 2787) | 1331 | 1335 |
| HSKERELP_T2 (SEQ ID NO: 2788) | 1331 | 1335 |
| HSKERELP_T6 (SEQ ID NO: 2789) | 1331 | 1335 |
| HSKERELP_T7 (SEQ ID NO: 2790) | 1331 | 1335 |
| HSKERELP_T11 (SEQ ID NO: 2791) | 1313 | 1317 |
| HSKERELP_T13 (SEQ ID NO: 2792) | 1314 | 1318 |
| HSKERELP_T18 (SEQ ID NO: 2793) | 1286 | 1290 |
| HSKERELP_T23 (SEQ ID NO: 2794) | 1271 | 1275 |
| HSKERELP_T25 (SEQ ID NO: 2795) | 795 | 799 |
| HSKERELP_T32 (SEQ ID NO: 2796) | 1025 | 1029 |

This segment can be found in both coding and non-coding regions of transcript(s) as follows. The segment can be found in a non-coding region of transcript(s) that are related to the following protein(s): HSKERELP_P14. This segment can also be found in the following protein(s): HSKERELP_P1, HSKERELP_P3, HSKERELP_P7, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_43 (SEQ ID NO:2837) according to the present invention is supported by 199 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2691 below describes the starting and ending position of this segment on each transcript.

TABLE 2691

Segment location on transcripts

| Transcript name | Segment starting position | Segment ending position |
|---|---|---|
| HSKERELP_T0 (SEQ ID NO: 2787) | 1336 | 1374 |
| HSKERELP_T2 (SEQ ID NO: 2788) | 1336 | 1374 |
| HSKERELP_T6 (SEQ ID NO: 2789) | 1336 | 1374 |
| HSKERELP_T7 (SEQ ID NO: 2790) | 1336 | 1374 |
| HSKERELP_T11 (SEQ ID NO: 2791) | 1318 | 1356 |
| HSKERELP_T13 (SEQ ID NO: 2792) | 1319 | 1357 |
| HSKERELP_T18 (SEQ ID NO: 2793) | 1291 | 1329 |
| HSKERELP_T23 (SEQ ID NO: 2794) | 1276 | 1314 |
| HSKERELP_T25 (SEQ ID NO: 2795) | 800 | 838 |
| HSKERELP_T32 (SEQ ID NO: 2796) | 1030 | 1068 |

This segment can be found in both coding and non-coding regions of transcript(s) as follows. The segment can be found in a non-coding region of transcript(s) that are related to the following protein(s): HSKERELP_P14. This segment can also be found in the following protein(s): HSKERELP_P1, HSKERELP_P3, HSKERELP_P7, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_46 (SEQ ID NO:2838) according to the present invention is supported by 5 libraries. The number of libraries was determined as previously described. This segment can be found in the following transcript(s): HSKERELP_T6 (SEQ ID NO:2789). Table 2692 below describes the starting and ending position of this segment on each transcript.

TABLE 2692

Segment location on transcripts

| Transcript name | Segment starting position | Segment ending position |
|---|---|---|
| HSKERELP_T6 (SEQ ID NO: 2789) | 1501 | 1586 |

This segment can be found in the following protein(s): HSKERELP_P7.

Segment cluster HSKERELP_node_47 (SEQ ID NO:2839) according to the present invention is supported by 232 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2693 below describes the starting and ending position of this segment on each transcript.

TABLE 2693

Segment location on transcripts

| Transcript name | Segment starting position | Segment ending position |
|---|---|---|
| HSKERELP_T0 (SEQ ID NO: 2787) | 1501 | 1534 |
| HSKERELP_T2 (SEQ ID NO: 2788) | 1501 | 1534 |
| HSKERELP_T6 (SEQ ID NO: 2789) | 1587 | 1620 |
| HSKERELP_T7 (SEQ ID NO: 2790) | 1501 | 1534 |
| HSKERELP_T11 (SEQ ID NO: 2791) | 1483 | 1516 |
| HSKERELP_T13 (SEQ ID NO: 2792) | 1484 | 1517 |
| HSKERELP_T18 (SEQ ID NO: 2793) | 1456 | 1489 |
| HSKERELP_T23 (SEQ ID NO: 2794) | 1441 | 1474 |
| HSKERELP_T25 (SEQ ID NO: 2795) | 965 | 998 |
| HSKERELP_T32 (SEQ ID NO: 2796) | 1195 | 1228 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_49 (SEQ ID NO:2840) according to the present invention is supported by 248 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2694 below describes the starting and ending position of this segment on each transcript.

TABLE 2694

Segment location on transcripts

| Transcript name | Segment starting position | Segment ending position |
|---|---|---|
| HSKERELP_T0 (SEQ ID NO: 2787) | 1535 | 1569 |
| HSKERELP_T2 (SEQ ID NO: 2788) | 1535 | 1569 |
| HSKERELP_T6 (SEQ ID NO: 2789) | 1621 | 1655 |
| HSKERELP_T7 (SEQ ID NO: 2790) | 1535 | 1569 |
| HSKERELP_T11 (SEQ ID NO: 2791) | 1517 | 1551 |
| HSKERELP_T13 (SEQ ID NO: 2792) | 1518 | 1552 |
| HSKERELP_T18 (SEQ ID NO: 2793) | 1490 | 1524 |
| HSKERELP_T23 (SEQ ID NO: 2794) | 1475 | 1509 |
| HSKERELP_T25 (SEQ ID NO: 2795) | 999 | 1033 |
| HSKERELP_T32 (SEQ ID NO: 2796) | 1229 | 1263 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_50 (SEQ ID NO:2841) according to the present invention is supported by 252 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2695 below describes the starting and ending position of this segment on each transcript.

TABLE 2695

Segment location on transcripts

| Transcript name | Segment starting position | Segment ending position |
|---|---|---|
| HSKERELP_T0 (SEQ ID NO: 2787) | 1570 | 1596 |
| HSKERELP_T2 (SEQ ID NO: 2788) | 1570 | 1596 |
| HSKERELP_T6 (SEQ ID NO: 2789) | 1656 | 1682 |
| HSKERELP_T7 (SEQ ID NO: 2790) | 1570 | 1596 |
| HSKERELP_T11 (SEQ ID NO: 2791) | 1552 | 1578 |
| HSKERELP_T13 (SEQ ID NO: 2792) | 1553 | 1579 |
| HSKERELP_T18 (SEQ ID NO: 2793) | 1525 | 1551 |
| HSKERELP_T23 (SEQ ID NO: 2794) | 1510 | 1536 |
| HSKERELP_T25 (SEQ ID NO: 2795) | 1034 | 1060 |
| HSKERELP_T32 (SEQ ID NO: 2796) | 1264 | 1290 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_51 (SEQ ID NO:2842) according to the present invention is supported by 255 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2696 below describes the starting and ending position of this segment on each transcript.

TABLE 2696

Segment location on transcripts

| Transcript name | Segment starting position | Segment ending position |
|---|---|---|
| HSKERELP_T0 (SEQ ID NO: 2787) | 1597 | 1647 |
| HSKERELP_T2 (SEQ ID NO: 2788) | 1597 | 1647 |
| HSKERELP_T6 (SEQ ID NO: 2789) | 1683 | 1733 |
| HSKERELP_T7 (SEQ ID NO: 2790) | 1597 | 1647 |
| HSKERELP_T11 (SEQ ID NO: 2791) | 1579 | 1629 |
| HSKERELP_T13 (SEQ ID NO: 2792) | 1580 | 1630 |
| HSKERELP_T18 (SEQ ID NO: 2793) | 1552 | 1602 |
| HSKERELP_T23 (SEQ ID NO: 2794) | 1537 | 1587 |
| HSKERELP_T25 (SEQ ID NO: 2795) | 1061 | 1111 |
| HSKERELP_T32 (SEQ ID NO: 2796) | 1291 | 1341 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_52 (SEQ ID NO:2843) according to the present invention is supported by 252 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2697 below describes the starting and ending position of this segment on each transcript.

TABLE 2697

Segment location on transcripts

| Transcript name | Segment starting position | Segment ending position |
|---|---|---|
| HSKERELP_T0 (SEQ ID NO: 2787) | 1648 | 1677 |
| HSKERELP_T2 (SEQ ID NO: 2788) | 1648 | 1677 |
| HSKERELP_T6 (SEQ ID NO: 2789) | 1734 | 1763 |

TABLE 2697-continued

Segment location on transcripts

| Transcript name | Segment starting position | Segment ending position |
|---|---|---|
| HSKERELP_T7 (SEQ ID NO: 2790) | 1648 | 1677 |
| HSKERELP_T11 (SEQ ID NO: 2791) | 1630 | 1659 |
| HSKERELP_T13 (SEQ ID NO: 2792) | 1631 | 1660 |
| HSKERELP_T18 (SEQ ID NO: 2793) | 1603 | 1632 |
| HSKERELP_T23 (SEQ ID NO: 2794) | 1588 | 1617 |
| HSKERELP_T25 (SEQ ID NO: 2795) | 1112 | 1141 |
| HSKERELP_T32 (SEQ ID NO: 2796) | 1342 | 1371 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_53 (SEQ ID NO:2844) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2698 below describes the starting and ending position of this segment on each transcript.

TABLE 2698

Segment location on transcripts

| Transcript name | Segment starting position | Segment ending position |
|---|---|---|
| HSKERELP_T0 (SEQ ID NO: 2787) | 1678 | 1698 |
| HSKERELP_T2 (SEQ ID NO: 2788) | 1678 | 1698 |
| HSKERELP_T6 (SEQ ID NO: 2789) | 1764 | 1784 |
| HSKERELP_T7 (SEQ ID NO: 2790) | 1678 | 1698 |
| HSKERELP_T11 (SEQ ID NO: 2791) | 1660 | 1680 |
| HSKERELP_T13 (SEQ ID NO: 2792) | 1661 | 1681 |
| HSKERELP_T18 (SEQ ID NO: 2793) | 1633 | 1653 |
| HSKERELP_T23 (SEQ ID NO: 2794) | 1618 | 1638 |
| HSKERELP_T25 (SEQ ID NO: 2795) | 1142 | 1162 |
| HSKERELP_T32 (SEQ ID NO: 2796) | 1372 | 1392 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_54 (SEQ ID NO:2845) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2699 below describes the starting and ending position of this segment on each transcript.

TABLE 2699

Segment location on transcripts

| Transcript name | Segment starting position | Segment ending position |
|---|---|---|
| HSKERELP_T0 (SEQ ID NO: 2787) | 1699 | 1721 |
| HSKERELP_T2 (SEQ ID NO: 2788) | 1699 | 1721 |
| HSKERELP_T6 (SEQ ID NO: 2789) | 1785 | 1807 |
| HSKERELP_T7 (SEQ ID NO: 2790) | 1699 | 1721 |
| HSKERELP_T11 (SEQ ID NO: 2791) | 1681 | 1703 |
| HSKERELP_T13 (SEQ ID NO: 2792) | 1682 | 1704 |
| HSKERELP_T18 (SEQ ID NO: 2793) | 1654 | 1676 |
| HSKERELP_T23 (SEQ ID NO: 2794) | 1639 | 1661 |
| HSKERELP_T25 (SEQ ID NO: 2795) | 1163 | 1185 |
| HSKERELP_T32 (SEQ ID NO: 2796) | 1393 | 1415 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P8, HSKERELP_P12, HSKERELP_P19, HSKERELP_P23, HSKERELP_P9 and HSKERELP_P30, since it is in the coding region for the corresponding transcript.

Segment cluster HSKERELP_node_56 (SEQ ID NO:2846) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2700 below describes the starting and ending position of this segment on each transcript.

TABLE 2700

Segment location on transcripts

| Transcript name | Segment starting position | Segment ending position |
|---|---|---|
| HSKERELP_T0 (SEQ ID NO: 2787) | 1722 | 1744 |
| HSKERELP_T2 (SEQ ID NO: 2788) | 1722 | 1744 |
| HSKERELP_T6 (SEQ ID NO: 2789) | 1808 | 1830 |
| HSKERELP_T11 (SEQ ID NO: 2791) | 1704 | 1726 |
| HSKERELP_T13 (SEQ ID NO: 2792) | 1705 | 1727 |
| HSKERELP_T18 (SEQ ID NO: 2793) | 1677 | 1699 |
| HSKERELP_T23 (SEQ ID NO: 2794) | 1662 | 1684 |
| HSKERELP_T25 (SEQ ID NO: 2795) | 1186 | 1208 |
| HSKERELP_T32 (SEQ ID NO: 2796) | 1416 | 1438 |

This segment can be found in both coding and non-coding regions of transcript(s) as follows. The segment can be found in a non-coding region of transcript(s) that are related to the following protein(s): HSKERELP_P7 and HSKERELP_P14. This segment can also be found in the following protein(s): HSKERELP_P1, HSKERELP_P3, HSKERELP_P12, HSKERELP_P19, HSKERELP_P23, HSKER- ELP_P9 and HSKERELP_P30, since it is in the coding region for the corresponding transcript.

Segment cluster HSKERELP_node_61 (SEQ ID NO:2847) according to the present invention is supported by 235 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2701 below describes the starting and ending position of this segment on each transcript.

TABLE 2701

Segment location on transcripts

| Transcript name | Segment starting position | Segment ending position |
|---|---|---|
| HSKERELP_T0 (SEQ ID NO: 2787) | 1745 | 1815 |
| HSKERELP_T2 (SEQ ID NO: 2788) | 2592 | 2662 |
| HSKERELP_T6 (SEQ ID NO: 2789) | 1831 | 1901 |
| HSKERELP_T11 (SEQ ID NO: 2791) | 1727 | 1797 |
| HSKERELP_T13 (SEQ ID NO: 2792) | 1728 | 1798 |
| HSKERELP_T18 (SEQ ID NO: 2793) | 1700 | 1770 |
| HSKERELP_T23 (SEQ ID NO: 2794) | 1685 | 1755 |
| HSKERELP_T25 (SEQ ID NO: 2795) | 1209 | 1279 |
| HSKERELP_T32 (SEQ ID NO: 2796) | 1439 | 1509 |

This segment can be found in both coding and non-coding regions of transcript(s) as follows. The segment can be found in a non-coding region of transcript(s) that are related to the following protein(s): HSKERELP_P3, HSKERELP_P7 and HSKERELP_P14. This segment can also be found in the following protein(s): HSKERELP_P1, HSKERELP_P12, HSKERELP_P19, HSKERELP_P23, HSKERELP_P9 and HSKERELP_P30, since it is in the coding region for the corresponding transcript.

Segment cluster HSKERELP_node_62 (SEQ ID NO:2848) according to the present invention can be found in the following transcript(s): HSKERELP_T0 (SEQ ID NO:2787), HSKERELP_T2 (SEQ ID NO:2788), HSKERELP_T6 (SEQ ID NO:2789), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2702 below describes the starting and ending position of this segment on each transcript.

TABLE 2702

Segment location on transcripts

| Transcript name | Segment starting position | Segment ending position |
|---|---|---|
| HSKERELP_T0 (SEQ ID NO: 2787) | 1816 | 1840 |
| HSKERELP_T2 (SEQ ID NO: 2788) | 2663 | 2687 |
| HSKERELP_T6 (SEQ ID NO: 2789) | 1902 | 1926 |
| HSKERELP_T11 (SEQ ID NO: 2791) | 1798 | 1822 |
| HSKERELP_T13 (SEQ ID NO: 2792) | 1799 | 1823 |
| HSKERELP_T18 (SEQ ID NO: 2793) | 1771 | 1795 |
| HSKERELP_T23 (SEQ ID NO: 2794) | 1756 | 1780 |
| HSKERELP_T25 (SEQ ID NO: 2795) | 1280 | 1304 |
| HSKERELP_T32 (SEQ ID NO: 2796) | 1510 | 1534 |

This segment can be found in both coding and non-coding regions of transcript(s) as follows. The segment can be found in a non-coding region of transcript(s) that are related to the following protein(s): HSKERELP_P3, HSKERELP_P7 and HSKERELP_P14. This segment can also be found in the following protein(s): HSKERELP_P1, HSKERELP_P12, HSKERELP_P19, HSKERELP_P23, HSKERELP_P9 and HSKERELP_P30, since it is in the coding region for the corresponding transcript.

Segment cluster HSKERELP_node_63 (SEQ ID NO:2849) according to the present invention is supported by 200 libraries. The number of libraries was determined as previously described. This segment can be found in the following transcript(s): HSKERELP_T0 (SEQ ID NO:2787), HSKERELP_T2 (SEQ ID NO:2788), HSKERELP_T6 (SEQ ID NO:2789), HSKERELP_T7 (SEQ ID NO:2790), HSKERELP_T11 (SEQ ID NO:2791), HSKERELP_T13 (SEQ ID NO:2792), HSKERELP_T18 (SEQ ID NO:2793), HSKERELP_T23 (SEQ ID NO:2794), HSKERELP_T25 (SEQ ID NO:2795) and HSKERELP_T32 (SEQ ID NO:2796). Table 2703 below describes the starting and ending position of this segment on each transcript.

TABLE 2703

Segment location on transcripts

| Transcript name | Segment starting position | Segment ending position |
|---|---|---|
| HSKERELP_T0 (SEQ ID NO: 2787) | 1841 | 1875 |
| HSKERELP_T2 (SEQ ID NO: 2788) | 2688 | 2722 |
| HSKERELP_T6 (SEQ ID NO: 2789) | 1927 | 1961 |
| HSKERELP_T7 (SEQ ID NO: 2790) | 1722 | 1756 |
| HSKERELP_T11 (SEQ ID NO: 2791) | 1823 | 1857 |
| HSKERELP_T13 (SEQ ID NO: 2792) | 1824 | 1858 |
| HSKERELP_T18 (SEQ ID NO: 2793) | 1796 | 1830 |
| HSKERELP_T23 (SEQ ID NO: 2794) | 1781 | 1815 |
| HSKERELP_T25 (SEQ ID NO: 2795) | 1305 | 1339 |
| HSKERELP_T32 (SEQ ID NO: 2796) | 1535 | 1569 |

This segment can be found in both coding and non-coding regions of transcript(s) as follows. The segment can be found in a non-coding region of transcript(s) that are related to the following protein(s): HSKERELP_P1, HSKERELP_P3, HSKERELP_P7, HSKERELP_P12, HSKERELP_P14, HSKERELP_P19, HSKERELP_P23, HSKERELP_P9 and HSKERELP_P30. This segment can also be found in the following protein(s): HSKERELP_P8, since it is in the coding region for the corresponding transcript.

Description for Cluster HUMASH1A

Cluster HUMASH1A features 1 transcript(s) and 14 segment(s) of interest, the names for which are given in Tables 2704 and 2705, respectively, the sequences themselves are given at the end of the application. The selected protein variants are given in Table 2706.

TABLE 2704

| Transcripts of interest Transcript Name |
|---|
| HUMASH1A_T1 (SEQ ID NO: 2850) |

TABLE 2705

Segments of interest
Segment Name

HUMASH1A_node_0 (SEQ ID NO: 2851)
HUMASH1A_node_1 (SEQ ID NO: 2852)
HUMASH1A_node_2 (SEQ ID NO: 2853)
HUMASH1A_node_7 (SEQ ID NO: 2854)
HUMASH1A_node_9 (SEQ ID NO: 2855)
HUMASH1A_node_11 (SEQ ID NO: 2856)
HUMASH1A_node_12 (SEQ ID NO: 2857)
HUMASH1A_node_3 (SEQ ID NO: 2858)
HUMASH1A_node_4 (SEQ ID NO: 2859)
HUMASH1A_node_5 (SEQ ID NO: 2860)
HUMASH1A_node_8 (SEQ ID NO: 2861)
HUMASH1A_node_10 (SEQ ID NO: 2862)
HUMASH1A_node_13 (SEQ ID NO: 2863)
HUMASH1A_node_14 (SEQ ID NO: 2864)

TABLE 2706

Proteins of interest

| Protein Name | Corresponding Transcript(s) |
|---|---|

These sequences are variants of the known protein Achaete-scute homolog I (SwissProt accession identifier ASC1_HUMAN; known also according to the synonyms HASH1), referred to herein as the previously known protein.

Protein Achaete-scute homolog 1 is known or believed to have the following function(s): May play a role at early stages of development of specific neural lineages in most regions of the CNS, and of several lineages in the PNS. Essential for the generation of olfactory and autonomic neurons. Activates transcription by binding to the E box (5'-CANNTG-3'). The sequence for protein Achaete-scute homolog 1 is given at the end of the application, as "Achaete-scute homolog 1 amino acid sequence". Known polymorphisms for this sequence are as shown in Table 2707.

TABLE 2707

Amino acid mutations for Known Protein

| SNP position(s) on amino acid sequence | Comment |
|---|---|
| 158 | E -> G (in dbSNP: 1803157). /FTId = VAR_013179. |
| 62 | Q -> QQQ |

Protein Achaete-scute homolog I localization is believed to be Nuclear (Probable).

The following GO Annotation(s) apply to the previously known protein. The following annotation(s) were found: transcription regulation, from Pol II promoter; neurogenesis; cell differentiation, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMASH1A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 70 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 70 and Table 2708. This cluster is overexpressed (at least at a minimum level) in the following pathological conditions: brain malignant tumors, epithelial malignant tumors, a mixture of malignant tumors from different tissues and lung malignant tumors.

TABLE 2708

Normal tissue distribution

| Name of Tissue | Number |
|---|---|
| brain | 9 |
| epithelial | 1 |
| general | 3 |
| lung | 0 |

TABLE 2709

P values and ratios for expression in cancerous tissue

| Name of Tissue | P1 | P2 | SP1 | R3 | SP2 | R4 |
|---|---|---|---|---|---|---|
| brain | 1.1e−02 | 9.5e−03 | 8.6e−10 | 12.5 | 5.4e−12 | 12.2 |
| epithelial | 2.1e−01 | 2.8e−01 | 3.1e−10 | 1.7 | 1.0e−10 | 8.3 |
| general | 6.1e−03 | 4.1e−02 | 4.4e−21 | 5.6 | 2.0e−22 | 7.6 |
| lung | 5.0e−01 | 4.0e−01 | 2.0e−15 | 3.9 | 1.3e−15 | 22.7 |

As noted above, cluster HUMASH1A features 14 segment(s), which were listed in Table 2705 above and for which the sequence(s) are given at the end of the application. These segment(s) are portions of nucleic acid sequence(s) which are described herein separately because they are of particular interest. A description of each segment according to the present invention is now provided.

Segment cluster HUMASH1A_node_0 (SEQ ID NO:2851) according to the present invention is supported by 49 libraries. The number of libraries was determined as previously described. This segment can be found in the following transcript(s): HUMASH1A_T1 (SEQ ID NO:2850). Table 2710 below describes the starting and ending position of this segment on each transcript.

TABLE 2710

Segment location on transcripts

| Transcript name | Segment starting position | Segment ending position |
|---|---|---|
| HUMASH1A_T1 (SEQ ID NO: 2850) | 1 | 1156 |

The previously-described transcripts for these segment(s) do not code for protein.

Segment cluster HUMASH1A_node_1 (SEQ ID NO:2852) according to the present invention is supported by 10 libraries. The number of libraries was determined as previously described. This segment can be found in the following transcript(s): HUMASH1A_T1 (SEQ ID NO:2850). Table 2711 below describes the starting and ending position of this segment on each transcript.

TABLE 2711

| Segment location on transcripts | | |
|---|---|---|
| Transcript name | Segment starting position | Segment ending position |
| HUMASH1A_T1 (SEQ ID NO: 2850) | 1157 | 1515 |

The previously-described transcripts for these segment(s) do not code for protein.

Segment cluster HUMASH1A_node_2 (SEQ ID NO:2853) according to the present invention is supported by 37 libraries. The number of libraries was determined as previously described. This segment can be found in the following transcript(s): HUMASH1A_T1 (SEQ ID NO:2850). Table 2712 below describes the starting and ending position of this segment on each transcript.

TABLE 2712

| Segment location on transcripts | | |
|---|---|---|
| Transcript name | Segment starting position | Segment ending position |
| HUMASH1A_T1 (SEQ ID NO: 2850) | 1516 | 1760 |

The previously-described transcripts for these segment(s) do not code for protein.

Segment cluster HUMASH1A_node_7 (SEQ ID NO:2854) according to the present invention is supported by 29 libraries. The number of libraries was determined as previously described. This segment can be found in the following transcript(s): HUMASH1A_T1 (SEQ ID NO:2850). Table 2713 below describes the starting and ending position of this segment on each transcript.

TABLE 2713

| Segment location on transcripts | | |
|---|---|---|
| Transcript name | Segment starting position | Segment ending position |
| HUMASH1A_T1 (SEQ ID NO: 2850) | 2008 | 2127 |

The previously-described transcripts for these segment(s) do not code for protein.

Segment cluster HUMASH1A_node_9 (SEQ ID NO:2855) according to the present invention is supported by 25 libraries. The number of libraries was determined as previously described. This segment can be found in the following transcript(s): HUMASH1A_T1 (SEQ ID NO:2850). Table 2714 below describes the starting and ending position of this segment on each transcript.

TABLE 2714

| Segment location on transcripts | | |
|---|---|---|
| Transcript name | Segment starting position | Segment ending position |
| HUMASH1A_T1 (SEQ ID NO: 2850) | 2141 | 2318 |

The previously-described transcripts for these segment(s) do not code for protein.

Segment cluster HUMASH1A_node_11 (SEQ ID NO:2856) according to the present invention is supported by 20 libraries. The number of libraries was determined as previously described. This segment can be found in the following transcript(s): HUMASH1A_T1 (SEQ ID NO:2850). Table 2715 below describes the starting and ending position of this segment on each transcript.

TABLE 2715

| Segment location on transcripts | | |
|---|---|---|
| Transcript name | Segment starting position | Segment ending position |
| HUMASH1A_T1 (SEQ ID NO: 2850) | 2357 | 2492 |

The previously-described transcripts for these segment(s) do not code for protein.

Segment cluster HUMASH1A_node_12 (SEQ ID NO:2857) according to the present invention is supported by 20 libraries. The number of libraries was determined as previously described. This segment can be found in the following transcript(s): HUMASH1A_T1 (SEQ ID NO:2850). Table 2716 below describes the starting and ending position of this segment on each transcript.

TABLE 2716

| Segment location on transcripts | | |
|---|---|---|
| Transcript name | Segment starting position | Segment ending position |
| HUMASH1A_T1 (SEQ ID NO: 2850) | 2493 | 2652 |

The previously-described transcripts for these segment(s) do not code for protein.

According to an optional embodiment of the present invention, short segments related to the above cluster are also provided. These segments are up to about 120 bp in length, and so are included in a separate description.

Segment cluster HUMASH1A_node_3 (SEQ ID NO:2858) according to the present invention is supported by 35 libraries. The number of libraries was determined as previously described. This segment can be found in the following transcript(s): HUMASH1A_T1 (SEQ ID NO:2850). Table 2717 below describes the starting and ending position of this segment on each transcript.

TABLE 2717

| Segment location on transcripts | | |
|---|---|---|
| Transcript name | Segment starting position | Segment ending position |
| HUMASH1A_T1 (SEQ ID NO: 2850) | 1761 | 1878 |

The previously-described transcripts for these segment(s) do not code for protein.

Segment cluster HUMASH1A_node_4 (SEQ ID NO:2859) according to the present invention is supported by 32 libraries. The number of libraries was determined as previously described. This segment can be found in the following transcript(s): HUMASH1A_T1 (SEQ ID NO:2850). Table 2718 below describes the starting and ending position of this segment on each transcript.

TABLE 2718

Segment location on transcripts

| Transcript name | Segment starting position | Segment ending position |
|---|---|---|
| HUMASH1A_T1 (SEQ ID NO: 2850) | 1879 | 1928 |

The previously-described transcripts for these segment(s) do not code for protein.

Segment cluster HUMASH1A_node_5 (SEQ ID NO:2860) according to the present invention is supported by 32 libraries. The number of libraries was determined as previously described. This segment can be found in the following transcript(s): HUMASH1A_T1 (SEQ ID NO:2850). Table 2719 below describes the starting and ending position of this segment on each transcript.

TABLE 2719

Segment location on transcripts

| Transcript name | Segment starting position | Segment ending position |
|---|---|---|
| HUMASH1A_T1 (SEQ ID NO: 2850) | 1929 | 2007 |

The previously-described transcripts for these segment(s) do not code for protein.

Segment cluster HUMASH1A_node_8 (SEQ ID NO:2861) according to the present invention can be found in the following transcript(s): HUMASH1A_T1 (SEQ ID NO:2850). Table 2720 below describes the starting and ending position of this segment on each transcript.

TABLE 2720

Segment location on transcripts

| Transcript name | Segment starting position | Segment ending position |
|---|---|---|
| HUMASH1A_T1 (SEQ ID NO: 2850) | 2128 | 2140 |

The previously-described transcripts for these segment(s) do not code for protein.

Segment cluster HUMASH1A_node_10 (SEQ ID NO:2862) according to the present invention is supported by 20 libraries. The number of libraries was determined as previously described. This segment can be found in the following transcript(s): HUMASH1A_T1 (SEQ ID NO:2850). Table 2721 below describes the starting and ending position of this segment on each transcript.

TABLE 2721

Segment location on transcripts

| Transcript name | Segment starting position | Segment ending position |
|---|---|---|
| HUMASH1A_T1 (SEQ ID NO: 2850) | 2319 | 2356 |

The previously-described transcripts for these segment(s) do not code for protein.

Segment cluster HUMASH1A_node_13 (SEQ ID NO:2863) according to the present invention is supported by 17 libraries. The number of libraries was determined as previously described. This segment can be found in the following transcript(s): HUMASH1A_T1 (SEQ ID NO:2850). Table 2722 below describes the starting and ending position of this segment on each transcript.

TABLE 2722

Segment location on transcripts

| Transcript name | Segment starting position | Segment ending position |
|---|---|---|
| HUMASH1A_T1 (SEQ ID NO: 2850) | 2653 | 2750 |

The previously-described transcripts for these segment(s) do not code for protein.

Segment cluster HUMASH1A_node_14 (SEQ ID NO:2864) according to the present invention is supported by 9 libraries. The number of libraries was determined as previously described. This segment can be found in the following transcript(s): HUMASH1A_T1 (SEQ ID NO:2850). Table 2723 below describes the starting and ending position of this segment on each transcript.

TABLE 2723

Segment location on transcripts

| Transcript name | Segment starting position | Segment ending position |
|---|---|---|
| HUMASH1A_T1 (SEQ ID NO: 2850) | 2751 | 2840 |

The previously-described transcripts for these segment(s) do not code for protein.

Description for Cluster HUMCYCB

Cluster HUMCYCB features 10 transcript(s) and 19 segment(s) of interest, the names for which are given in Tables 2724 and 2725, respectively, the sequences themselves are given at the end of the application. The selected protein variants are given in Table 2726.

TABLE 2724

Transcripts of interest
Transcript name

HUMCYCB_T4 (SEQ ID NO: 2865)
HUMCYCB_T5 (SEQ ID NO: 2866)
HUMCYCB_T6 (SEQ ID NO: 2867)
HUMCYCB_T9 (SEQ ID NO: 2868)
HUMCYCB_T12 (SEQ ID NO: 2869)
HUMCYCB_T16 (SEQ ID NO: 2870)
HUMCYCB_T17 (SEQ ID NO: 2871)

TABLE 2724-continued

Transcripts of interest
Transcript name

HUMCYCB_T18 (SEQ ID NO: 2872)
HUMCYCB_T19 (SEQ ID NO: 2873)
HUMCYCB_T20 (SEQ ID NO: 2874)

TABLE 2725

Segments of interest
Segment Name

HUMCYCB_node_0 (SEQ ID NO: 2875)
HUMCYCB_node_1 (SEQ ID NO: 2876)
HUMCYCB_node_3 (SEQ ID NO: 2877)
HUMCYCB_node_9 (SEQ ID NO: 2878)
HUMCYCB_node_11 (SEQ ID NO: 2879)
HUMCYCB_node_18 (SEQ ID NO: 2880)
HUMCYCB_node_20 (SEQ ID NO: 2881)
HUMCYCB_node_23 (SEQ ID NO: 2882)
HUMCYCB_node_26 (SEQ ID NO: 2883)
HUMCYCB_node_27 (SEQ ID NO: 2884)
HUMCYCB_node_2 (SEQ ID NO: 2885)
HUMCYCB_node_6 (SEQ ID NO: 2886)
HUMCYCB_node_7 (SEQ ID NO: 2887)
HUMCYCB_node_13 (SEQ ID NO: 2888)
HUMCYCB_node_14 (SEQ ID NO: 2889)
HUMCYCB_node_15 (SEQ ID NO: 2890)
HUMCYCB_node_17 (SEQ ID NO: 2891)
HUMCYCB_node_24 (SEQ ID NO: 2892)
HUMCYCB_node_25 (SEQ ID NO: 2893)

TABLE 2726

Proteins of interest

| Protein Name | Corresponding Transcript(s) |
|---|---|
| HUMCYCB_P2 | HUMCYCB_T4 (SEQ ID NO: 2865); HUMCYCB_T5 (SEQ ID NO: 2866); HUMCYCB_T6 (SEQ ID NO: 2867) |
| HUMCYCB_P5 | HUMCYCB_T9 (SEQ ID NO: 2868) |
| HUMCYCB_P8 | HUMCYCB_T12 (SEQ ID NO: 2869) |

These sequences are variants of the known protein G2/mitotic-specific cyclin B1 (SwissProt accession identifier CGB1_HUMAN), referred to herein as the previously known protein.

Protein G2/mitotic-specific cyclin B1 is known or believed to have the following function(s): Essential for the control of the cell cycle at the G2/M (mitosis) transition. The sequence for protein G2/mitotic-specific cyclin B1 is given at the end of the application, as "G2/mitotic-specific cyclin B1 amino acid sequence".

The following GO Annotation(s) apply to the previously known protein. The following annotation(s) were found: cell cycle control; G2/M transition of mitotic cell cycle; mitosis, which are annotation(s) related to Biological Process; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMCYCB can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 71 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 71 and Table 2727. This cluster is overexpressed (at least at a minimum level) in the following pathological conditions: brain malignant tumors, epithelial malignant tumors, a mixture of malignant tumors from different tissues, kidney malignant tumors, hepatocellular carcinoma, breast malignant tumors, myosarcoma, pancreas carcinoma, skin malignancies and uterine malignancies.

TABLE 2727

Normal tissue distribution

| Name of Tissue | Number |
|---|---|
| adrenal | 0 |
| bladder | 0 |
| bone | 32 |
| brain | 11 |
| colon | 63 |
| epithelial | 20 |
| general | 24 |
| head and neck | 152 |
| kidney | 0 |
| liver | 0 |
| lung | 39 |
| lymph nodes | 56 |
| breast | 4 |
| bone marrow | 31 |
| muscle | 3 |
| ovary | 80 |
| pancreas | 0 |
| prostate | 0 |
| skin | 16 |
| stomach | 0 |
| uterus | 22 |

TABLE 2728

P values and ratios for expression in cancerous tissue

| Name of Tissue | P1 | P2 | SP1 | R3 | SP2 | R4 |
|---|---|---|---|---|---|---|
| adrenal | 1.5e−01 | 7.0e−02 | 9.6e−02 | 4.5 | 4.4e−02 | 5.3 |
| bladder | 1 | 3.4e−01 | 1 | 1.0 | 1.5e−01 | 2.9 |
| bone | 9.2e−01 | 1.4e−01 | 1 | 0.5 | 4.8e−02 | 3.0 |
| brain | 8.6e−01 | 1.1e−01 | 6.3e−01 | 1.0 | 5.8e−22 | 9.2 |
| colon | 3.4e−01 | 2.2e−01 | 1 | 0.4 | 1.3e−01 | 0.7 |
| epithelial | 1.7e−02 | 2.8e−08 | 9.7e−04 | 2.2 | 8.2e−39 | 9.9 |
| general | 6.7e−03 | 9.5e−16 | 8.9e−04 | 1.8 | 2.2e−91 | 8.9 |
| head and neck | 5.6e−01 | 4.2e−01 | 1 | 0.6 | 5.3e−01 | 0.9 |
| kidney | 2.5e−01 | 6.6e−02 | 6.7e−02 | 4.6 | 1.9e−04 | 7.5 |
| liver | 1 | 2.4e−02 | 1 | 1.0 | 2.0e−03 | 4.1 |
| lung | 8.6e−01 | 7.4e−01 | 1 | 0.2 | 3.9e−03 | 2.5 |
| lymph nodes | 2.0e−01 | 6.8e−02 | 4.4e−01 | 1.8 | 5.1e−05 | 2.8 |
| breast | 5.9e−01 | 9.9e−02 | 6.9e−01 | 1.4 | 4.1e−03 | 4.1 |
| bone marrow | 8.6e−01 | 5.7e−01 | 1 | 0.5 | 8.7e−02 | 2.3 |
| muscle | 9.2e−01 | 4.8e−01 | 1 | 0.8 | 3.6e−12 | 3.4 |
| ovary | 7.6e−01 | 6.3e−01 | 6.1e−01 | 0.9 | 2.1e−02 | 1.6 |
| pancreas | 9.5e−02 | 2.3e−02 | 2.4e−03 | 5.1 | 5.7e−08 | 11.8 |
| prostate | 3.8e−01 | 1.9e−01 | 3.0e−01 | 2.5 | 7.4e−05 | 2.7 |
| skin | 5.2e−01 | 8.5e−02 | 2.6e−01 | 3.2 | 6.5e−11 | 9.6 |
| stomach | 3.6e−01 | 2.4e−02 | 1 | 1.1 | 3.4e−02 | 4.6 |
| uterus | 1.1e−01 | 5.5e−03 | 7.1e−02 | 2.3 | 2.0e−04 | 4.9 |

As noted above, cluster HUMCYCB features 19 segment(s), which were listed in Table 2725 above and for which the sequence(s) are given at the end of the application. These segment(s) are portions of nucleic acid sequence(s) which are described herein separately because they are of particular interest. A description of each segment according to the present invention is now provided.

Segment cluster HUMCYCB_node_0 (SEQ ID NO:2875) according to the present invention is supported by 21 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2729 below describes the starting and ending position of this segment on each transcript.

TABLE 2729

Segment location on transcripts

| Transcript name | Segment starting position | Segment ending position |
| --- | --- | --- |
| HUMCYCB_T4 (SEQ ID NO: 2865) | 1 | 135 |
| HUMCYCB_T5 (SEQ ID NO: 2866) | 1 | 135 |
| HUMCYCB_T6 (SEQ ID NO: 2867) | 1 | 135 |
| HUMCYCB_T9 (SEQ ID NO: 2868) | 1 | 135 |
| HUMCYCB_T12 (SEQ ID NO: 2869) | 1 | 135 |

This segment can be found in a non-coding region of transcript(s) that are related to the following protein(s): HUMCYCB_P2, HUMCYCB_P5 and HUMCYCB_P8.

Segment cluster HUMCYCB_node_1 (SEQ ID NO:2876) according to the present invention is supported by 167 libraries. The number of libraries was determined as previously described. This segment can be found in the following transcript(s): HUMCYCB_T4 (SEQ ID NO:2865), HUMCYCB T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2730 below describes the starting and ending position of this segment on each transcript.

TABLE 2730

Segment location on transcripts

| Transcript name | Segment starting position | Segment ending position |
| --- | --- | --- |
| HUMCYCB_T4 (SEQ ID NO: 2865) | 136 | 271 |
| HUMCYCB_T5 (SEQ ID NO: 2866) | 136 | 271 |
| HUMCYCB_T6 (SEQ ID NO: 2867) | 136 | 271 |
| HUMCYCB_T9 (SEQ ID NO: 2868) | 136 | 271 |
| HUMCYCB_T12 (SEQ ID NO: 2869) | 136 | 271 |

This segment can be found in both coding and non-coding regions of transcript(s) as follows. The segment can be found in a non-coding region of transcript(s) that are related to the following protein(s): HUMCYCB_P8. This segment can also be found in the following protein(s): HUMCYCB_P2 and HUMCYCB_P5, since it is in the coding region for the corresponding transcript.

Segment cluster HUMCYCB_node_3 (SEQ ID NO:2877) according to the present invention is supported by 2 libraries. The number of libraries was determined as previously described. This segment can be found in the following transcript(s): HUMCYCB_T12 (SEQ ID NO:2869). Table 2731 below describes the starting and ending position of this segment on each transcript.

TABLE 2731

Segment location on transcripts

| Transcript name | Segment starting position | Segment ending position |
| --- | --- | --- |
| HUMCYCB_T12 (SEQ ID NO: 2869) | 282 | 483 |

This segment can be found in the following protein(s): HUMCYCB_P8.

Segment cluster HUMCYCB_node_9 (SEQ ID NO:2878) according to the present invention is supported by 162 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2732 below describes the starting and ending position of this segment on each transcript.

TABLE 2732

Segment location on transcripts

| Transcript name | Segment starting position | Segment ending position |
| --- | --- | --- |
| HUMCYCB_T4 (SEQ ID NO: 2865) | 453 | 623 |
| HUMCYCB_T5 (SEQ ID NO: 2866) | 453 | 623 |
| HUMCYCB_T6 (SEQ ID NO: 2867) | 453 | 623 |
| HUMCYCB_T9 (SEQ ID NO: 2868) | 453 | 623 |
| HUMCYCB_T12 (SEQ ID NO: 2869) | 655 | 825 |

This segment can be found in the following protein(s): HUMCYCB_P2, HUMCYCB_P5 and HUMCYCB_P8.

Segment cluster HUMCYCB_node_11 (SEQ ID NO:2879) according to the present invention is supported by 149 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2733 below describes the starting and ending position of this segment on each transcript.

TABLE 2733

Segment location on transcripts

| Transcript name | Segment starting position | Segment ending position |
| --- | --- | --- |
| HUMCYCB_T4 (SEQ ID NO: 2865) | 624 | 806 |
| HUMCYCB_T5 (SEQ ID NO: 2866) | 624 | 806 |
| HUMCYCB_T6 (SEQ ID NO: 2867) | 624 | 806 |
| HUMCYCB_T9 (SEQ ID NO: 2868) | 624 | 806 |
| HUMCYCB_T12 (SEQ ID NO: 2869) | 826 | 1008 |

This segment can be found in the following protein(s): HUMCYCB_P2, HUMCYCB_P5 and HUMCYCB_P8.

Segment cluster HUMCYCB_node_18 (SEQ ID NO:2880) according to the present invention is supported by 129 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867) and HUMCYCB_T12 (SEQ ID NO:2869). Table 2734 below describes the starting and ending position of this segment on each transcript.

TABLE 2734

Segment location on transcripts

| Transcript name | Segment starting position | Segment ending position |
|---|---|---|
| HUMCYCB_T4 (SEQ ID NO: 2865) | 1060 | 1202 |
| HUMCYCB_T5 (SEQ ID NO: 2866) | 1060 | 1202 |
| HUMCYCB_T6 (SEQ ID NO: 2867) | 1060 | 1202 |
| HUMCYCB_T12 (SEQ ID NO: 2869) | 1262 | 1404 |

This segment can be found in the following protein(s): HUMCYCB_P2 and HUMCYCB_P8.

Segment cluster HUMCYCB_node_20 (SEQ ID NO:2881) according to the present invention is supported by 129 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2735 below describes the starting and ending position of this segment on each transcript.

TABLE 2735

Segment location on transcripts

| Transcript name | Segment starting position | Segment ending position |
|---|---|---|
| HUMCYCB_T4 (SEQ ID NO: 2865) | 1203 | 1343 |
| HUMCYCB_T5 (SEQ ID NO: 2866) | 1203 | 1343 |
| HUMCYCB_T6 (SEQ ID NO: 2867) | 1203 | 1343 |
| HUMCYCB_T9 (SEQ ID NO: 2868) | 1060 | 1200 |
| HUMCYCB_T12 (SEQ ID NO: 2869) | 1405 | 1545 |

This segment can be found in the following protein(s): HUMCYCB_P2, HUMCYCB_P5 and HUMCYCB_P8.

Segment cluster HUMCYCB_node_23 (SEQ ID NO:2882) according to the present invention is supported by 5 libraries. The number of libraries was determined as previously described. This segment can be found in the following transcript(s): HUMCYCB_T16 (SEQ ID NO:2870), HUMCYCB_T17 (SEQ ID NO:2871), HUMCYCB_T18 (SEQ ID NO:2872), HUMCYCB_T19 (SEQ ID NO:2873) and HUMCYCB_T20 (SEQ ID NO:2874). Table 2736 below describes the starting and ending position of this segment on each transcript.

TABLE 2736

Segment location on transcripts

| Transcript name | Segment starting position | Segment ending position |
|---|---|---|
| HUMCYCB_T16 (SEQ ID NO: 2870) | 1 | 241 |
| HUMCYCB_T17 (SEQ ID NO: 2871) | 1 | 241 |

TABLE 2736-continued

Segment location on transcripts

| Transcript name | Segment starting position | Segment ending position |
|---|---|---|
| HUMCYCB_T18 (SEQ ID NO: 2872) | 1 | 241 |
| HUMCYCB_T19 (SEQ ID NO: 2873) | 1 | 241 |
| HUMCYCB_T20 (SEQ ID NO: 2874) | 1 | 241 |

The previously-described transcripts for these segment(s) do not code for protein.

Segment cluster HUMCYCB_node_26 (SEQ ID NO:2883) according to the present invention is supported by 6 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T17 (SEQ ID NO:2871), HUMCYCB_T19 (SEQ ID NO:2873) and HUMCYCB_T20 (SEQ ID NO:2874). Table 2737 below describes the starting and ending position of this segment on each transcript.

TABLE 2737

Segment location on transcripts

| Transcript name | Segment starting position | Segment ending position |
|---|---|---|
| HUMCYCB_T4 (SEQ ID NO: 2865) | 1455 | 1628 |
| HUMCYCB_T5 (SEQ ID NO: 2866) | 1455 | 1628 |
| HUMCYCB_T6 (SEQ ID NO: 2867) | 1455 | 1628 |
| HUMCYCB_T17 (SEQ ID NO: 2871) | 353 | 526 |
| HUMCYCB_T19 (SEQ ID NO: 2873) | 353 | 526 |
| HUMCYCB_T20 (SEQ ID NO: 2874) | 353 | 526 |

This segment can be found in the following protein(s): HUMCYCB_P2.

Segment cluster HUMCYCB_node_27 (SEQ ID NO:2884) according to the present invention is supported by 146 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868), HUMCYCB_T12 (SEQ ID NO:2869), HUMCYCB_T16 (SEQ ID NO:2870), HUMCYCB_T17 (SEQ ID NO:2871), HUMCYCB_T18 (SEQ ID NO:2872), HUMCYCB_T19 (SEQ ID NO:2873) and HUMCYCB_T20 (SEQ ID NO:2874). Table 2738 below describes the starting and ending position of this segment on each transcript.

TABLE 2738

Segment location on transcripts

| Transcript name | Segment starting position | Segment ending position |
|---|---|---|
| HUMCYCB_T4 (SEQ ID NO: 2865) | 1629 | 2366 |
| HUMCYCB_T5 (SEQ ID NO: 2866) | 1629 | 1859 |
| HUMCYCB_T6 (SEQ ID NO: 2867) | 1629 | 1802 |
| HUMCYCB_T9 (SEQ ID NO: 2868) | 1312 | 2049 |
| HUMCYCB_T12 (SEQ ID NO: 2869) | 1657 | 1887 |
| HUMCYCB_T16 (SEQ ID NO: 2870) | 353 | 1090 |
| HUMCYCB_T17 (SEQ ID NO: 2871) | 527 | 1264 |

TABLE 2738-continued

Segment location on transcripts

| Transcript name | Segment starting position | Segment ending position |
|---|---|---|
| HUMCYCB_T18 (SEQ ID NO: 2872) | 353 | 526 |
| HUMCYCB_T19 (SEQ ID NO: 2873) | 527 | 757 |
| HUMCYCB_T20 (SEQ ID NO: 2874) | 527 | 700 |

This segment can be found in both coding and non-coding regions of transcript(s) as follows. The segment can be found in a non-coding region of transcript(s) that are related to the following protein(s): HUMCYCB_P2 and HUMCYCB_P5. This segment can also be found in the following protein(s): HUMCYCB_P8, since it is in the coding region for the corresponding transcript.

According to an optional embodiment of the present invention, short segments related to the above cluster are also provided. These segments are up to about 120 bp in length, and so are included in a separate description.

Segment cluster HUMCYCB_node_2 (SEQ ID NO:2885) according to the present invention can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2739 below describes the starting and ending position of this segment on each transcript.

TABLE 2739

Segment location on transcripts

| Transcript name | Segment starting position | Segment ending position |
|---|---|---|
| HUMCYCB_T4 (SEQ ID NO: 2865) | 272 | 281 |
| HUMCYCB_T5 (SEQ ID NO: 2866) | 272 | 281 |
| HUMCYCB_T6 (SEQ ID NO: 2867) | 272 | 281 |
| HUMCYCB_T9 (SEQ ID NO: 2868) | 272 | 281 |
| HUMCYCB_T12 (SEQ ID NO: 2869) | 272 | 281 |

This segment can be found in both coding and non-coding regions of transcript(s) as follows. The segment can be found in a non-coding region of transcript(s) that are related to the following protein(s): HUMCYCB_P8. This segment can also be found in the following protein(s): HUMCYCB_P2 and HUMCYCB_P5, since it is in the coding region for the corresponding transcript.

Segment cluster HUMCYCB_node_6 (SEQ ID NO:2886) according to the present invention is supported by 174 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 17 below describes the starting and ending position of this segment on each transcript.

TABLE 2740

Segment location on transcripts

| Transcript name | Segment starting position | Segment ending position |
|---|---|---|
| HUMCYCB_T4 (SEQ ID NO: 2865) | 282 | 361 |
| HUMCYCB_T5 (SEQ ID NO: 2866) | 282 | 361 |
| HUMCYCB_T6 (SEQ ID NO: 2867) | 282 | 361 |
| HUMCYCB_T9 (SEQ ID NO: 2868) | 282 | 361 |
| HUMCYCB_T12 (SEQ ID NO: 2869) | 484 | 563 |

This segment can be found in the following protein(s): HUMCYCB_P2, HUMCYCB_P5 and HUMCYCB_P8.

Segment cluster HUMCYCB_node_7 (SEQ ID NO:2887) according to the present invention is supported by 175 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2741 below describes the starting and ending position of this segment on each transcript.

TABLE 2741

Segment location on transcripts

| Transcript name | Segment starting position | Segment ending position |
|---|---|---|
| HUMCYCB_T4 (SEQ ID NO: 2865) | 362 | 452 |
| HUMCYCB_T5 (SEQ ID NO: 2866) | 362 | 452 |
| HUMCYCB_T6 (SEQ ID NO: 2867) | 362 | 452 |
| HUMCYCB_T9 (SEQ ID NO: 2868) | 362 | 452 |
| HUMCYCB_T12 (SEQ ID NO: 2869) | 564 | 654 |

This segment can be found in the following protein(s): HUMCYCB_P2, HUMCYCB_P5 and HUMCYCB_P8.

Segment cluster HUMCYCB_node_13 (SEQ ID NO:2888) according to the present invention is supported by 127 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2742 below describes the starting and ending position of this segment on each transcript.

TABLE 2742

Segment location on transcripts

| Transcript name | Segment starting position | Segment ending position |
|---|---|---|
| HUMCYCB_T4 (SEQ ID NO: 2865) | 807 | 872 |
| HUMCYCB_T5 (SEQ ID NO: 2866) | 807 | 872 |
| HUMCYCB_T6 (SEQ ID NO: 2867) | 807 | 872 |
| HUMCYCB_T9 (SEQ ID NO: 2868) | 807 | 872 |
| HUMCYCB_T12 (SEQ ID NO: 2869) | 1009 | 1074 |

This segment can be found in the following protein(s): HUMCYCB_P2, HUMCYCB_P5 and HUMCYCB_P8.

Segment cluster HUMCYCB_node_14 (SEQ ID NO:2889) according to the present invention can be found in the following transcript(s): HUMCYCB T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2743 below describes the starting and ending position of this segment on each transcript.

TABLE 2743

Segment location on transcripts

| Transcript name | Segment starting position | Segment ending position |
|---|---|---|
| HUMCYCB_T4 (SEQ ID NO: 2865) | 873 | 884 |
| HUMCYCB_T5 (SEQ ID NO: 2866) | 873 | 884 |
| HUMCYCB_T6 (SEQ ID NO: 2867) | 873 | 884 |
| HUMCYCB_T9 (SEQ ID NO: 2868) | 873 | 884 |
| HUMCYCB_T12 (SEQ ID NO: 2869) | 1075 | 1086 |

This segment can be found in the following protein(s): HUMCYCB_P2, HUMCYCB_P5 and HUMCYCB_P8.

Segment cluster HUMCYCB_node_15 (SEQ ID NO:2890) according to the present invention is supported by 126 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 2744 below describes the starting and ending position of this segment on each transcript.

TABLE 2744

Segment location on transcripts

| Transcript name | Segment starting position | Segment ending position |
|---|---|---|
| HUMCYCB_T4 (SEQ ID NO: 2865) | 885 | 965 |
| HUMCYCB_T5 (SEQ ID NO: 2866) | 885 | 965 |
| HUMCYCB_T6 (SEQ ID NO: 2867) | 885 | 965 |
| HUMCYCB_T9 (SEQ ID NO: 2868) | 885 | 965 |
| HUMCYCB_T12 (SEQ ID NO: 2869) | 1087 | 1167 |

This segment can be found in the following protein(s): HUMCYCB_P2, HUMCYCB_P5 and HUMCYCB_P8.

Segment cluster HUMCYCB_node_17 (SEQ ID NO:2891) according to the present invention is supported by 124 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868) and HUMCYCB_T12 (SEQ ID NO:2869). Table 22 below describes the starting and ending position of this segment on each transcript.

TABLE 2745

Segment location on transcripts

| Transcript name | Segment starting position | Segment ending position |
|---|---|---|
| HUMCYCB_T4 (SEQ ID NO: 2865) | 966 | 1059 |
| HUMCYCB_T5 (SEQ ID NO: 2866) | 966 | 1059 |
| HUMCYCB_T6 (SEQ ID NO: 2867) | 966 | 1059 |
| HUMCYCB_T9 (SEQ ID NO: 2868) | 966 | 1059 |

TABLE 2745-continued

Segment location on transcripts

| Transcript name | Segment starting position | Segment ending position |
|---|---|---|
| HUMCYCB_T12 (SEQ ID NO: 2869) | 1168 | 1261 |

This segment can be found in the following protein(s): HUMCYCB_P2, HUMCYCB_P5 and HUMCYCB_P8.

Segment cluster HUMCYCB_node_24 (SEQ ID NO:2892) according to the present invention is supported by 127 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868), HUMCYCB_T12 (SEQ ID NO:2869), HUMCYCB_T16 (SEQ ID NO:2870), HUMCYCB_T17 (SEQ ID NO:2871), HUMCYCB_T18 (SEQ ID NO:2872), HUMCYCB_T19 (SEQ ID NO:2873) and HUMCYCB_T20 (SEQ ID NO:2874). Table 2746 below describes the starting and ending position of this segment on each transcript.

TABLE 2746

Segment location on transcripts

| Transcript name | Segment starting position | Segment ending position |
|---|---|---|
| HUMCYCB_T4 (SEQ ID NO: 2865) | 1344 | 1395 |
| HUMCYCB_T5 (SEQ ID NO: 2866) | 1344 | 1395 |
| HUMCYCB_T6 (SEQ ID NO: 2867) | 1344 | 1395 |
| HUMCYCB_T9 (SEQ ID NO: 2868) | 1201 | 1252 |
| HUMCYCB_T12 (SEQ ID NO: 2869) | 1546 | 1597 |
| HUMCYCB_T16 (SEQ ID NO: 2870) | 242 | 293 |
| HUMCYCB_T17 (SEQ ID NO: 2871) | 242 | 293 |
| HUMCYCB_T18 (SEQ ID NO: 2872) | 242 | 293 |
| HUMCYCB_T19 (SEQ ID NO: 2873) | 242 | 293 |
| HUMCYCB_T20 (SEQ ID NO: 2874) | 242 | 293 |

This segment can be found in both coding and non-coding regions of transcript(s) as follows. The segment can be found in a non-coding region of transcript(s) that are related to the following protein(s): HUMCYCB_P5. This segment can also be found in the following protein(s): HUMCYCB_P2 and HUMCYCB_P8, since it is in the coding region for the corresponding transcript.

Segment cluster HUMCYCB_node_25 (SEQ ID NO:2893) according to the present invention is supported by 125 libraries. The number of libraries was determined as previously described. This segment can be found in the following transcript(s): HUMCYCB_T4 (SEQ ID NO:2865), HUMCYCB_T5 (SEQ ID NO:2866), HUMCYCB_T6 (SEQ ID NO:2867), HUMCYCB_T9 (SEQ ID NO:2868), HUMCYCB_T12 (SEQ ID NO:2869), HUMCYCB_T16 (SEQ ID NO:2870), HUMCYCB_T17 (SEQ ID NO:2871), HUMCYCB_T18 (SEQ ID NO:2872), HUMCYCB_T19 (SEQ ID NO:2873) and HUMCYCB_T20 (SEQ ID NO:2874). Table 2747 below describes the starting and ending position of this segment on each transcript.

TABLE 2747

Segment location on transcripts

| Transcript name | Segment starting position | Segment ending position |
|---|---|---|
| HUMCYCB_T4 (SEQ ID NO: 2865) | 1396 | 1454 |
| HUMCYCB_T5 (SEQ ID NO: 2866) | 1396 | 1454 |
| HUMCYCB_T6 (SEQ ID NO: 2867) | 1396 | 1454 |
| HUMCYCB_T9 (SEQ ID NO: 2868) | 1253 | 1311 |
| HUMCYCB_T12 (SEQ ID NO: 2869) | 1598 | 1656 |
| HUMCYCB_T16 (SEQ ID NO: 2870) | 294 | 352 |
| HUMCYCB_T17 (SEQ ID NO: 2871) | 294 | 352 |
| HUMCYCB_T18 (SEQ ID NO: 2872) | 294 | 352 |
| HUMCYCB_T19 (SEQ ID NO: 2873) | 294 | 352 |
| HUMCYCB_T20 (SEQ ID NO: 2874) | 294 | 352 |

This segment can be found in both coding and non-coding regions of transcript(s) as follows. The segment can be found in a non-coding region of transcript(s) that are related to the following protein(s): HUMCYCB_P5. This segment can also be found in the following protein(s): HUMCYCB_P2 and HUMCYCB_P8, since it is in the coding region for the corresponding transcript.

Description for Cluster HUMDNAPOLD

Cluster HUMDNAPOLD features 4 transcript(s) and 44 segment(s) of interest, the names for which are given in Tables 2748 and 2749, respectively, the sequences themselves are given at the end of the application. The selected protein variants are given in Table 2750.

TABLE 2748

Transcripts of interest
Transcript Name

HUMDNAPOLD_T1 (SEQ ID NO: 2894)
HUMDNAPOLD_T8 (SEQ ID NO: 2895)
HUMDNAPOLD_T15 (SEQ ID NO: 2896)
HUMDNAPOLD_T24 (SEQ ID NO: 2897)

TABLE 2749

Segments of interest
Segment Name

HUMDNAPOLD_node_2 (SEQ ID NO: 2898)
HUMDNAPOLD_node_6 (SEQ ID NO: 2899)
HUMDNAPOLD_node_8 (SEQ ID NO: 2900)
HUMDNAPOLD_node_14 (SEQ ID NO: 2901)
HUMDNAPOLD_node_16 (SEQ ID NO: 2902)
HUMDNAPOLD_node_18 (SEQ ID NO: 2903)
HUMDNAPOLD_node_22 (SEQ ID NO: 2904)
HUMDNAPOLD_node_26 (SEQ ID NO: 2905)
HUMDNAPOLD_node_36 (SEQ ID NO: 2906)
HUMDNAPOLD_node_54 (SEQ ID NO: 2907)
HUMDNAPOLD_node_62 (SEQ ID NO: 2908)
HUMDNAPOLD_node_68 (SEQ ID NO: 2909)
HUMDNAPOLD_node_74 (SEQ ID NO: 2910)
HUMDNAPOLD_node_0 (SEQ ID NO: 2911)
HUMDNAPOLD_node_4 (SEQ ID NO: 2912)

TABLE 2749-continued

Segments of interest
Segment Name

HUMDNAPOLD_node_9 (SEQ ID NO: 2913)
HUMDNAPOLD_node_10 (SEQ ID NO: 2914)
HUMDNAPOLD_node_12 (SEQ ID NO: 2915)
HUMDNAPOLD_node_20 (SEQ ID NO: 2916)
HUMDNAPOLD_node_24 (SEQ ID NO: 2917)
HUMDNAPOLD_node_25 (SEQ ID NO: 2918)
HUMDNAPOLD_node_29 (SEQ ID NO: 2919)
HUMDNAPOLD_node_31 (SEQ ID NO: 2920)
HUMDNAPOLD_node_32 (SEQ ID NO: 2921)
HUMDNAPOLD_node_34 (SEQ ID NO: 2922)
HUMDNAPOLD_node_38 (SEQ ID NO: 2923)
HUMDNAPOLD_node_41 (SEQ ID NO: 2924)
HUMDNAPOLD_node_43 (SEQ ID NO: 2925)
HUMDNAPOLD_node_46 (SEQ ID NO: 2926)
HUMDNAPOLD_node_47 (SEQ ID NO: 2927)
HUMDNAPOLD_node_49 (SEQ ID NO: 2928)
HUMDNAPOLD_node_51 (SEQ ID NO: 2929)
HUMDNAPOLD_node_52 (SEQ ID NO: 2930)
HUMDNAPOLD_node_56 (SEQ ID NO: 2931)
HUMDNAPOLD_node_57 (SEQ ID NO: 2932)
HUMDNAPOLD_node_61 (SEQ ID NO: 2933)
HUMDNAPOLD_node_63 (SEQ ID NO: 2934)
HUMDNAPOLD_node_64 (SEQ ID NO: 2935)
HUMDNAPOLD_node_65 (SEQ ID NO: 2936)
HUMDNAPOLD_node_66 (SEQ ID NO: 2937)
HUMDNAPOLD_node_69 (SEQ ID NO: 2938)
HUMDNAPOLD_node_70 (SEQ ID NO: 2939)
HUMDNAPOLD_node_72 (SEQ ID NO: 2940)
HUMDNAPOLD_node_75 (SEQ ID NO: 2941)

TABLE 2750

Proteins of interest

| Protein Name | Corresponding Transcript(s) |
|---|---|
| HUMDNAPOLD_P1 | HUMDNAPOLD_T1 (SEQ ID NO: 2894) |
| HUMDNAPOLD_P7 | HUMDNAPOLD_T8 (SEQ ID NO: 2895); HUMDNAPOLD_T15 (SEQ ID NO: 2896) |
| HUMDNAPOLD_P21 | HUMDNAPOLD_T24 (SEQ ID NO: 2897) |

These sequences are variants of the known protein DNA polymerase delta catalytic subunit (SwissProt accession identifier DPOD_HUMAN; known also according to the synonyms EC 2.7.7.7; DNA polymerase delta subunit p125), referred to herein as the previously known protein.

Protein DNA polymerase delta catalytic subunit is known or believed to have the following function(s): Possesses two enzymatic activities: DNA synthesis (polymerase) and an exonucleolytic activity that degrades single stranded DNA in the 3' to 5' direction. Required with its accessory proteins (proliferating cell nuclear antigen (PCNA) and replication factor C(RFC) or activator 1) for leading strand synthesis. Also involved in completing Okazaki fragments initiated by the DNA polymerase alpha/primase complex. The sequence for protein DNA polymerase delta catalytic subunit is given at the end of the application, as "DNA polymerase delta catalytic subunit amino acid sequence". Known polymorphisms for this sequence are as shown in Table 2751.

TABLE 2751

Amino acid mutations for Known Protein

| SNP position(s) on amino acid sequence | Comment |
|---|---|
| 30 | W -> R (in dbSNP:3218772). /FTId = VAR_016146. |
| 119 | R -> H |
| 173 | S -> N |
| 472 | H -> Y |
| 776 | R -> G |

Protein DNA polymerase delta catalytic subunit localization is believed to be Nuclear.

The following GO Annotation(s) apply to the previously known protein. The following annotation(s) were found: DNA replication; DNA repair; response to UV, which are annotation(s) related to Biological Process; nucleotide binding; DNA binding; delta DNA polymerase; 3'-5' exonuclease; transferase; hydrolase, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMDNAPOLD can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 72 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 72 and Table 2752. This cluster is overexpressed (at least at a minimum level) in the following pathological conditions: brain malignant tumors, epithelial malignant tumors, a mixture of malignant tumors from different tissues, myosarcoma and skin malignancies.

TABLE 2752

Normal tissue distribution

| Name of Tissue | Number |
|---|---|
| Adrenal | 0 |
| Bladder | 41 |
| Bone | 0 |
| Brain | 1 |
| Colon | 31 |
| Epithelial | 16 |
| general | 12 |
| kidney | 24 |
| liver | 0 |
| lung | 68 |
| lymph nodes | 45 |
| breast | 0 |
| bone marrow | 0 |
| muscle | 0 |
| ovary | 0 |
| pancreas | 0 |
| prostate | 6 |
| skin | 0 |
| stomach | 0 |
| uterus | 0 |

TABLE 2753

P values and ratios for expression in cancerous tissue

| Name of Tissue | P1 | P2 | SP1 | R3 | SP2 | R4 |
|---|---|---|---|---|---|---|
| adrenal | 4.2e-01 | 4.6e-01 | 4.6e-01 | 2.2 | 5.3e-01 | 1.9 |
| bladder | 7.6e-01 | 6.3e-01 | 6.0e-01 | 1.3 | 6.2e-01 | 1.2 |
| bone | 1 | 4.3e-01 | 1 | 1.0 | 7.0e-01 | 1.5 |
| brain | 1.3e-01 | 6.3e-02 | 5.0e-04 | 8.6 | 6.0e-09 | 15.5 |
| colon | 4.4e-01 | 5.3e-01 | 6.5e-01 | 1.2 | 7.7e-01 | 1.0 |
| epithelial | 5.2e-02 | 2.5e-04 | 9.1e-02 | 1.6 | 1.3e-06 | 3.3 |
| general | 4.1e-04 | 1.6e-09 | 1.2e-04 | 2.5 | 4.4e-22 | 5.2 |
| kidney | 9.0e-01 | 8.9e-01 | 1 | 0.5 | 4.2e-01 | 1.1 |
| liver | 1 | 6.8e-01 | 1 | 1.0 | 4.8e-01 | 1.9 |
| lung | 8.2e-01 | 6.5e-01 | 7.9e-01 | 0.7 | 1.6e-01 | 1.1 |
| lymph nodes | 3.3e-01 | 1.1e-01 | 6.3e-01 | 1.2 | 1.2e-03 | 2.6 |
| breast | 3.6e-01 | 1.2e-01 | 1 | 1.1 | 3.8e-01 | 2.1 |
| bone marrow | 1 | 6.7e-01 | 1 | 1.0 | 2.8e-01 | 2.8 |
| muscle | 2.3e-01 | 6.6e-02 | 2.2e-02 | 12.5 | 5.4e-04 | 7.2 |
| ovary | 1.6e-01 | 1.2e-01 | 4.7e-01 | 1.9 | 9.1e-02 | 2.2 |
| pancreas | 1 | 6.9e-02 | 1 | 1.0 | 4.0e-02 | 4.6 |
| prostate | 9.1e-01 | 6.8e-01 | 6.7e-01 | 1.1 | 1.0e-01 | 2.1 |
| skin | 1 | 6.9e-02 | 1 | 1.0 | 7.7e-03 | 3.3 |
| stomach | 3.0e-01 | 3.0e-01 | 5.0e-01 | 2.0 | 2.6e-01 | 2.0 |
| uterus | 1.0e-01 | 3.0e-02 | 1.3e-01 | 2.6 | 1.4e-01 | 2.8 |

As noted above, cluster HUMDNAPOLD features 44 segment(s), which were listed in Table 2749 above and for which the sequence(s) are given at the end of the application. These segment(s) are portions of nucleic acid sequence(s) which are described herein separately because they are of particular interest. A description of each segment according to the present invention is now provided.

Segment cluster HUMDNAPOLD_node_2 (SEQ ID NO:2898) according to the present invention is supported by 1 libraries. The number of libraries was determined as previously described. This segment can be found in the following transcript(s): HUMDNAPOLD_T1 (SEQ ID NO:2894). Table 2754 below describes the starting and ending position of this segment on each transcript.

TABLE 2754

Segment location on transcripts

| Transcript name | Segment starting position | Segment ending position |
|---|---|---|
| HUMDNAPOLD_T1 (SEQ ID NO: 2894) | 69 | 213 |

This segment can be found in a non-coding region of transcript(s) that are related to the following protein(s): HUMDNAPOLD_P1.

Segment cluster HUMDNAPOLD_node_6 (SEQ ID NO:2899) according to the present invention is supported by 1 libraries. The number of libraries was determined as previously described. This segment can be found in the following transcript(s): HUMDNAPOLD_T1 (SEQ ID NO:2894). Table 2755 below describes the starting and ending position of this segment on each transcript.

TABLE 2755

Segment location on transcripts

| Transcript name | Segment starting position | Segment ending position |
|---|---|---|
| HUMDNAPOLD_T1 (SEQ ID NO: 2894) | 303 | 428 |

This segment can be found in the following protein(s): HUMDNAPOLD_P1.

Segment cluster HUMDNAPOLD_node_8 (SEQ ID NO:2900) according to the present invention is supported by 33 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2756 below describes the starting and ending position of this segment on each transcript.

TABLE 2756

Segment location on transcripts

| Transcript name | Segment starting position | Segment ending position |
|---|---|---|
| HUMDNAPOLD_T1 (SEQ ID NO: 2894) | 429 | 585 |
| HUMDNAPOLD_T8 (SEQ ID NO: 2895) | 69 | 225 |
| HUMDNAPOLD_T15 (SEQ ID NO: 2896) | 69 | 225 |

This segment can be found in the following protein(s): HUMDNAPOLD_P1 and HUMDNAPOLD_P7.

Segment cluster HUMDNAPOLD_node_14 (SEQ ID NO:2901) according to the present invention is supported by 34 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2757 below describes the starting and ending position of this segment on each transcript.

TABLE 2757

Segment location on transcripts

| Transcript name | Segment starting position | Segment ending position |
|---|---|---|
| HUMDNAPOLD_T1 (SEQ ID NO: 2894) | 746 | 892 |
| HUMDNAPOLD_T8 (SEQ ID NO: 2895) | 386 | 532 |
| HUMDNAPOLD_T15 (SEQ ID NO: 2896) | 386 | 532 |

This segment can be found in the following protein(s): HUMDNAPOLD_P1 and HUMDNAPOLD_P7.

Segment cluster HUMDNAPOLD_node_16 (SEQ ID NO:2902) according to the present invention is supported by 34 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2758 below describes the starting and ending position of this segment on each transcript.

TABLE 2758

Segment location on transcripts

| Transcript name | Segment starting position | Segment ending position |
|---|---|---|
| HUMDNAPOLD_T1 (SEQ ID NO: 2894) | 893 | 1018 |
| HUMDNAPOLD_T8 (SEQ ID NO: 2895) | 533 | 658 |
| HUMDNAPOLD_T15 (SEQ ID NO: 2896) | 533 | 658 |

This segment can be found in the following protein(s): HUMDNAPOLD_P1 and HUMDNAPOLD_P7.

Segment cluster HUMDNAPOLD_node_18 (SEQ ID NO:2903) according to the present invention is supported by 36 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2759 below describes the starting and ending position of this segment on each transcript.

TABLE 2759

Segment location on transcripts

| Transcript name | Segment starting position | Segment ending position |
|---|---|---|
| HUMDNAPOLD_T1 (SEQ ID NO: 2894) | 1019 | 1187 |
| HUMDNAPOLD_T8 (SEQ ID NO: 2895) | 659 | 827 |
| HUMDNAPOLD_T15 (SEQ ID NO: 2896) | 659 | 827 |

This segment can be found in the following protein(s): HUMDNAPOLD_P1 and HUMDNAPOLD_P7.

Segment cluster HUMDNAPOLD_node_22 (SEQ ID NO:2904) according to the present invention is supported by 41 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2760 below describes the starting and ending position of this segment on each transcript.

TABLE 2760

Segment location on transcripts

| Transcript name | Segment starting position | Segment ending position |
|---|---|---|
| HUMDNAPOLD_T1 (SEQ ID NO: 2894) | 1270 | 1399 |
| HUMDNAPOLD_T8 (SEQ ID NO: 2895) | 910 | 1039 |
| HUMDNAPOLD_T15 (SEQ ID NO: 2896) | 910 | 1039 |

This segment can be found in the following protein(s): HUMDNAPOLD_P1 and HUMDNAPOLD_P7.

Segment cluster HUMDNAPOLD_node_26 (SEQ ID NO:2905) according to the present invention is supported by 38 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2761 below describes the starting and ending position of this segment on each transcript.

TABLE 2761

Segment location on transcripts

| Transcript name | Segment starting position | Segment ending position |
|---|---|---|
| HUMDNAPOLD_T1 (SEQ ID NO: 2894) | 1438 | 1566 |
| HUMDNAPOLD_T8 (SEQ ID NO: 2895) | 1078 | 1206 |
| HUMDNAPOLD_T15 (SEQ ID NO: 2896) | 1078 | 1206 |

This segment can be found in the following protein(s): HUMDNAPOLD_P1 and HUMDNAPOLD_P7.

Segment cluster HUMDNAPOLD_node_36 (SEQ ID NO:2906) according to the present invention is supported by 49 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2762 below describes the starting and ending position of this segment on each transcript.

TABLE 2762

Segment location on transcripts

| Transcript name | Segment starting position | Segment ending position |
|---|---|---|
| HUMDNAPOLD_T1 (SEQ ID NO: 2894) | 1924 | 2115 |
| HUMDNAPOLD_T8 (SEQ ID NO: 2895) | 1564 | 1755 |
| HUMDNAPOLD_T15 (SEQ ID NO: 2896) | 1564 | 1755 |

This segment can be found in the following protein(s): HUMDNAPOLD_P1 and HUMDNAPOLD_P7.

Segment cluster HUMDNAPOLD_node_54 (SEQ ID NO:2907) according to the present invention is supported by 49 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2763 below describes the starting and ending position of this segment on each transcript.

TABLE 2763

Segment location on transcripts

| Transcript name | Segment starting position | Segment ending position |
|---|---|---|
| HUMDNAPOLD_T1 (SEQ ID NO: 2894) | 2818 | 2993 |
| HUMDNAPOLD_T8 (SEQ ID NO: 2895) | 2458 | 2633 |
| HUMDNAPOLD_T15 (SEQ ID NO: 2896) | 2458 | 2633 |

This segment can be found in the following protein(s): HUMDNAPOLD_P1 and HUMDNAPOLD_P7.

Segment cluster HUMDNAPOLD_node_62 (SEQ ID NO:2908) according to the present invention is supported by 7 libraries. The number of libraries was determined as previously described. This segment can be found in the following transcript(s): HUMDNAPOLD_T8 (SEQ ID NO:2895) and HUMDNAPOLD_T15 (SEQ ID NO:2896). Table 2764 below describes the starting and ending position of this segment on each transcript.

TABLE 2764

Segment location on transcripts

| Transcript name | Segment starting position | Segment ending position |
|---|---|---|
| HUMDNAPOLD_T8 (SEQ ID NO: 2895) | 2890 | 3458 |
| HUMDNAPOLD_T15 (SEQ ID NO: 2896) | 2890 | 3458 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2765.

TABLE 2765

Oligonucleotides related to this segment

| Oligonucleotide name | Overexpressed in cancers | Chip reference |
|---|---|---|
| HUMDNAPOLD_0_0_15815 | lung malignant tumors | LUN |

This segment can be found in the following protein(s): HUMDNAPOLD_P7.

Segment cluster HUMDNAPOLD_node_68 (SEQ ID NO:2909) according to the present invention is supported by 2 libraries. The number of libraries was determined as previously described. This segment can be found in the following transcript(s): HUMDNAPOLD_T24 (SEQ ID NO:2897). Table 2766 below describes the starting and ending position of this segment on each transcript.

TABLE 2766

Segment location on transcripts

| Transcript name | Segment starting position | Segment ending position |
|---|---|---|
| HUMDNAPOLD_T24 (SEQ ID NO: 2897) | 1 | 289 |

This segment can be found in the following protein(s): HUMDNAPOLD_P21.

Segment cluster HUMDNAPOLD_node_74 (SEQ ID NO:2910) according to the present invention is supported by 78 libraries. The number of libraries was determined as previously described. This segment can be found in the following transcript(s): HUMDNAPOLD_T1 (SEQ ID NO:2894), HUMDNAPOLD_T8 (SEQ ID NO:2895), HUMDNAPOLD_T15 (SEQ ID NO:2896) and HUMDNAPOLD_T24 (SEQ ID NO:2897). Table 2767 below describes the starting and ending position of this segment on each transcript.

TABLE 2767

Segment location on transcripts

| Transcript name | Segment starting position | Segment ending position |
|---|---|---|
| HUMDNAPOLD_T1 (SEQ ID NO: 2894) | 3648 | 3786 |
| HUMDNAPOLD_T8 (SEQ ID NO: 2895) | 3857 | 3995 |
| HUMDNAPOLD_T15 (SEQ ID NO: 2896) | 3938 | 4076 |
| HUMDNAPOLD_T24 (SEQ ID NO: 2897) | 441 | 579 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1 and HUMDNAPOLD_P21, since it is in the coding region for the corresponding transcript.

According to an optional embodiment of the present invention, short segments related to the above cluster are also provided. These segments are up to about 120 bp in length, and so are included in a separate description.

Segment cluster HUMDNAPOLD_node_0 (SEQ ID NO:2911) according to the present invention is supported by 21 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2768 below describes the starting and ending position of this segment on each transcript.

TABLE 2768

Segment location on transcripts

| Transcript name | Segment starting position | Segment ending position |
|---|---|---|
| HUMDNAPOLD_T1 (SEQ ID NO: 2894) | 1 | 68 |
| HUMDNAPOLD_T8 (SEQ ID NO: 2895) | 1 | 68 |
| HUMDNAPOLD_T15 (SEQ ID NO: 2896) | 1 | 68 |

This segment can be found in both coding and non-coding regions of transcript(s) as follows. The segment can be found in a non-coding region of transcript(s) that are related to the following protein(s): HUMDNAPOLD_P1. This segment can also be found in the following protein(s): HUMDNAPOLD_P7, since it is in the coding region for the corresponding transcript.

Segment cluster HUMDNAPOLD_node_4 (SEQ ID NO:2912) according to the present invention is supported by 1 libraries. The number of libraries was determined as previously described. This segment can be found in the following transcript(s): HUMDNAPOLD_T1 (SEQ ID NO:2894). Table 2769 below describes the starting and ending position of this segment on each transcript.

TABLE 2769

Segment location on transcripts

| Transcript name | Segment starting position | Segment ending position |
|---|---|---|
| HUMDNAPOLD_T1 (SEQ ID NO: 2894) | 214 | 302 |

This segment can be found in a non-coding region of transcript(s) that are related to the following protein(s): HUMDNAPOLD_P1.

Segment cluster HUMDNAPOLD_node_9 (SEQ ID NO:2913) according to the present invention can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2770 below describes the starting and ending position of this segment on each transcript.

TABLE 2770

Segment location on transcripts

| Transcript name | Segment starting position | Segment ending position |
|---|---|---|
| HUMDNAPOLD_T1 (SEQ ID NO: 2894) | 586 | 597 |
| HUMDNAPOLD_T8 (SEQ ID NO: 2895) | 226 | 237 |
| HUMDNAPOLD_T15 (SEQ ID NO: 2896) | 226 | 237 |

This segment can be found in the following protein(s): HUMDNAPOLD_P1 and HUMDNAPOLD_P7.

Segment cluster HUMDNAPOLD_node_10 (SEQ ID NO:2914) according to the present invention is supported by 33 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2771 below describes the starting and ending position of this segment on each transcript.

TABLE 2771

Segment location on transcripts

| Transcript name | Segment starting position | Segment ending position |
|---|---|---|
| HUMDNAPOLD_T1 (SEQ ID NO: 2894) | 598 | 631 |
| HUMDNAPOLD_T8 (SEQ ID NO: 2895) | 238 | 271 |
| HUMDNAPOLD_T15 (SEQ ID NO: 2896) | 238 | 271 |

This segment can be found in the following protein(s): HUMDNAPOLD_P1 and HUMDNAPOLD_P7.

Segment cluster HUMDNAPOLD_node_12 (SEQ ID NO:2915) according to the present invention is supported by 32 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2772 below describes the starting and ending position of this segment on each transcript.

TABLE 2772

Segment location on transcripts

| Transcript name | Segment starting position | Segment ending position |
|---|---|---|
| HUMDNAPOLD_T1 (SEQ ID NO: 2894) | 632 | 745 |
| HUMDNAPOLD_T8 (SEQ ID NO: 2895) | 272 | 385 |
| HUMDNAPOLD_T15 (SEQ ID NO: 2896) | 272 | 385 |

This segment can be found in the following protein(s): HUMDNAPOLD_P1 and HUMDNAPOLD_P7.

Segment cluster HUMDNAPOLD_node_20 (SEQ ID NO:2916) according to the present invention is supported by 34 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2773 below describes the starting and ending position of this segment on each transcript.

TABLE 2773

Segment location on transcripts

| Transcript name | Segment starting position | Segment ending position |
|---|---|---|
| HUMDNAPOLD_T1 (SEQ ID NO: 2894) | 1188 | 1269 |
| HUMDNAPOLD_T8 (SEQ ID NO: 2895) | 828 | 909 |
| HUMDNAPOLD_T15 (SEQ ID NO: 2896) | 828 | 909 |

This segment can be found in the following protein(s): HUMDNAPOLD_P1 and HUMDNAPOLD_P7.

Segment cluster HUMDNAPOLD_node_24 (SEQ ID NO:2917) according to the present invention is supported by 35 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2774 below describes the starting and ending position of this segment on each transcript.

TABLE 2774

Segment location on transcripts

| Transcript name | Segment starting position | Segment ending position |
|---|---|---|
| HUMDNAPOLD_T1 (SEQ ID NO: 2894) | 1400 | 1426 |
| HUMDNAPOLD_T8 (SEQ ID NO: 2895) | 1040 | 1066 |
| HUMDNAPOLD_T15 (SEQ ID NO: 2896) | 1040 | 1066 |

This segment can be found in the following protein(s): HUMDNAPOLD_P1 and HUMDNAPOLD_P7.

Segment cluster HUMDNAPOLD_node_25 (SEQ ID NO:2918) according to the present invention can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2775 below describes the starting and ending position of this segment on each transcript.

TABLE 2775

Segment location on transcripts

| Transcript name | Segment starting position | Segment ending position |
|---|---|---|
| HUMDNAPOLD_T1 (SEQ ID NO: 2894) | 1427 | 1437 |
| HUMDNAPOLD_T8 (SEQ ID NO: 2895) | 1067 | 1077 |
| HUMDNAPOLD_T15 (SEQ ID NO: 2896) | 1067 | 1077 |

This segment can be found in the following protein(s): HUMDNAPOLD_P1 and HUMDNAPOLD_P7.

Segment cluster HUMDNAPOLD_node_29 (SEQ ID NO:2919) according to the present invention is supported by 37 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMD-NAPOLD_T15 (SEQ ID NO:2896). Table 2776 below describes the starting and ending position of this segment on each transcript.

TABLE 2776

Segment location on transcripts

| Transcript name | Segment starting position | Segment ending position |
|---|---|---|
| HUMDNAPOLD_T1 (SEQ ID NO: 2894) | 1567 | 1671 |
| HUMDNAPOLD_T8 (SEQ ID NO: 2895) | 1207 | 1311 |
| HUMDNAPOLD_T15 (SEQ ID NO: 2896) | 1207 | 1311 |

This segment can be found in the following protein(s): HUMDNAPOLD_P1 and HUMDNAPOLD_P7.

Segment cluster HUMDNAPOLD_node_31 (SEQ ID NO:2920) according to the present invention is supported by 36 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2777 below describes the starting and ending position of this segment on each transcript.

TABLE 2777

Segment location on transcripts

| Transcript name | Segment starting position | Segment ending position |
|---|---|---|
| HUMDNAPOLD_T1 (SEQ ID NO: 2894) | 1672 | 1739 |
| HUMDNAPOLD_T8 (SEQ ID NO: 2895) | 1312 | 1379 |
| HUMDNAPOLD_T15 (SEQ ID NO: 2896) | 1312 | 1379 |

This segment can be found in the following protein(s): HUMDNAPOLD_P1 and HUMDNAPOLD_P7.

Segment cluster HUMDNAPOLD_node_32 (SEQ ID NO:2921) according to the present invention is supported by 37 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2778 below describes the starting and ending position of this segment on each transcript.

TABLE 2778

Segment location on transcripts

| Transcript name | Segment starting position | Segment ending position |
|---|---|---|
| HUMDNAPOLD_T1 (SEQ ID NO: 2894) | 1740 | 1812 |
| HUMDNAPOLD_T8 (SEQ ID NO: 2895) | 1380 | 1452 |
| HUMDNAPOLD_T15 (SEQ ID NO: 2896) | 1380 | 1452 |

This segment can be found in the following protein(s): HUMDNAPOLD_P1 and HUMDNAPOLD_P7.

Segment cluster HUMDNAPOLD_node_34 (SEQ ID NO:2922) according to the present invention is supported by 38 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2779 below describes the starting and ending position of this segment on each transcript.

TABLE 2779

Segment location on transcripts

| Transcript name | Segment starting position | Segment ending position |
|---|---|---|
| HUMDNAPOLD_T1 (SEQ ID NO: 2894) | 1813 | 1923 |
| HUMDNAPOLD_T8 (SEQ ID NO: 2895) | 1453 | 1563 |
| HUMDNAPOLD_T15 (SEQ ID NO: 2896) | 1453 | 1563 |

This segment can be found in the following protein(s): HUMDNAPOLD_P1 and HUMDNAPOLD_P7.

Segment cluster HUMDNAPOLD_node_38 (SEQ ID NO:2923) according to the present invention is supported by 43 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2780 below describes the starting and ending position of this segment on each transcript.

TABLE 2780

Segment location on transcripts

| Transcript name | Segment starting position | Segment ending position |
|---|---|---|
| HUMDNAPOLD_T1 (SEQ ID NO: 2894) | 2116 | 2204 |
| HUMDNAPOLD_T8 (SEQ ID NO: 2895) | 1756 | 1844 |
| HUMDNAPOLD_T15 (SEQ ID NO: 2896) | 1756 | 1844 |

This segment can be found in the following protein(s): HUMDNAPOLD_P1 and HUMDNAPOLD_P7.

Segment cluster HUMDNAPOLD_node_41 (SEQ ID NO:2924) according to the present invention is supported by 48 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2781 below describes the starting and ending position of this segment on each transcript.

TABLE 2781

Segment location on transcripts

| Transcript name | Segment starting position | Segment ending position |
|---|---|---|
| HUMDNAPOLD_T1 (SEQ ID NO: 2894) | 2205 | 2321 |
| HUMDNAPOLD_T8 (SEQ ID NO: 2895) | 1845 | 1961 |
| HUMDNAPOLD_T15 (SEQ ID NO: 2896) | 1845 | 1961 |

This segment can be found in the following protein(s): HUMDNAPOLD_P1 and HUMDNAPOLD_P7.

Segment cluster HUMDNAPOLD_node_43 (SEQ ID NO:2925) according to the present invention is supported by 46 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2782 below describes the starting and ending position of this segment on each transcript.

TABLE 2782

Segment location on transcripts

| Transcript name | Segment starting position | Segment ending position |
|---|---|---|
| HUMDNAPOLD_T1 (SEQ ID NO: 2894) | 2322 | 2435 |
| HUMDNAPOLD_T8 (SEQ ID NO: 2895) | 1962 | 2075 |
| HUMDNAPOLD_T15 (SEQ ID NO: 2896) | 1962 | 2075 |

This segment can be found in the following protein(s): HUMDNAPOLD_P1 and HUMDNAPOLD_P7.

Segment cluster HUMDNAPOLD_node_46 (SEQ ID NO:2926) according to the present invention is supported by 42 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2783 below describes the starting and ending position of this segment on each transcript.

TABLE 2783

Segment location on transcripts

| Transcript name | Segment starting position | Segment ending position |
|---|---|---|
| HUMDNAPOLD_T1 (SEQ ID NO: 2894) | 2436 | 2511 |
| HUMDNAPOLD_T8 (SEQ ID NO: 2895) | 2076 | 2151 |
| HUMDNAPOLD_T15 (SEQ ID NO: 2896) | 2076 | 2151 |

This segment can be found in the following protein(s): HUMDNAPOLD_P1 and HUMDNAPOLD_P7.

Segment cluster HUMDNAPOLD_node_47 (SEQ ID NO:2927) according to the present invention is supported by 34 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2784 below describes the starting and ending position of this segment on each transcript.

TABLE 2784

Segment location on transcripts

| Transcript name | Segment starting position | Segment ending position |
|---|---|---|
| HUMDNAPOLD_T1 (SEQ ID NO: 2894) | 2512 | 2583 |
| HUMDNAPOLD_T8 (SEQ ID NO: 2895) | 2152 | 2223 |
| HUMDNAPOLD_T15 (SEQ ID NO: 2896) | 2152 | 2223 |

This segment can be found in the following protein(s): HUMDNAPOLD_P1 and HUMDNAPOLD_P7.

Segment cluster HUMDNAPOLD_node_49 (SEQ ID NO:2928) according to the present invention is supported by 45 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2785 below describes the starting and ending position of this segment on each transcript.

TABLE 2785

Segment location on transcripts

| Transcript name | Segment starting position | Segment ending position |
|---|---|---|
| HUMDNAPOLD_T1 (SEQ ID NO: 2894) | 2584 | 2679 |
| HUMDNAPOLD_T8 (SEQ ID NO: 2895) | 2224 | 2319 |
| HUMDNAPOLD_T15 (SEQ ID NO: 2896) | 2224 | 2319 |

This segment can be found in the following protein(s): HUMDNAPOLD_P1 and HUMDNAPOLD_P7.

Segment cluster HUMDNAPOLD_node_51 (SEQ ID NO:2929) according to the present invention is supported by 44 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2786 below describes the starting and ending position of this segment on each transcript.

TABLE 2786

Segment location on transcripts

| Transcript name | Segment starting position | Segment ending position |
|---|---|---|
| HUMDNAPOLD_T1 (SEQ ID NO: 2894) | 2680 | 2779 |
| HUMDNAPOLD_T8 (SEQ ID NO: 2895) | 2320 | 2419 |
| HUMDNAPOLD_T15 (SEQ ID NO: 2896) | 2320 | 2419 |

This segment can be found in the following protein(s): HUMDNAPOLD_P1 and HUMDNAPOLD_P7.

Segment cluster HUMDNAPOLD_node_52 (SEQ ID NO:2930) according to the present invention is supported by 40 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2787 below describes the starting and ending position of this segment on each transcript.

TABLE 2787

Segment location on transcripts

| Transcript name | Segment starting position | Segment ending position |
|---|---|---|
| HUMDNAPOLD_T1 (SEQ ID NO: 2894) | 2780 | 2817 |
| HUMDNAPOLD_T8 (SEQ ID NO: 2895) | 2420 | 2457 |
| HUMDNAPOLD_T15 (SEQ ID NO: 2896) | 2420 | 2457 |

This segment can be found in the following protein(s): HUMDNAPOLD_P1 and HUMDNAPOLD_P7.

Segment cluster HUMDNAPOLD_node_56 (SEQ ID NO:2931) according to the present invention is supported by 52 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2788 below describes the starting and ending position of this segment on each transcript.

TABLE 2788

Segment location on transcripts

| Transcript name | Segment starting position | Segment ending position |
|---|---|---|
| HUMDNAPOLD_T1 (SEQ ID NO: 2894) | 2994 | 3092 |
| HUMDNAPOLD_T8 (SEQ ID NO: 2895) | 2634 | 2732 |
| HUMDNAPOLD_T15 (SEQ ID NO: 2896) | 2634 | 2732 |

This segment can be found in the following protein(s): HUMDNAPOLD_P1 and HUMDNAPOLD_P7.

Segment cluster HUMDNAPOLD_node_57 (SEQ ID NO:2932) according to the present invention is supported by 50 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2789 below describes the starting and ending position of this segment on each transcript.

TABLE 2789

Segment location on transcripts

| Transcript name | Segment starting position | Segment ending position |
|---|---|---|
| HUMDNAPOLD_T1 (SEQ ID NO: 2894) | 3093 | 3146 |
| HUMDNAPOLD_T8 (SEQ ID NO: 2895) | 2733 | 2786 |
| HUMDNAPOLD_T15 (SEQ ID NO: 2896) | 2733 | 2786 |

This segment can be found in the following protein(s): HUMDNAPOLD_P1 and HUMDNAPOLD_P7.

Segment cluster HUMDNAPOLD_node_61 (SEQ ID NO:2933) according to the present invention is supported by 58 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2790 below describes the starting and ending position of this segment on each transcript.

TABLE 2790

Segment location on transcripts

| Transcript name | Segment starting position | Segment ending position |
|---|---|---|
| HUMDNAPOLD_T1 (SEQ ID NO: 2894) | 3147 | 3249 |
| HUMDNAPOLD_T8 (SEQ ID NO: 2895) | 2787 | 2889 |
| HUMDNAPOLD_T15 (SEQ ID NO: 2896) | 2787 | 2889 |

This segment can be found in the following protein(s): HUMDNAPOLD_P1 and HUMDNAPOLD_P7.

Segment cluster HUMDNAPOLD_node_63 (SEQ ID NO:2934) according to the present invention is supported by 59 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2791 below describes the starting and ending position of this segment on each transcript.

TABLE 2791

Segment location on transcripts

| Transcript name | Segment starting position | Segment ending position |
|---|---|---|
| HUMDNAPOLD_T1 (SEQ ID NO: 2894) | 3250 | 3294 |
| HUMDNAPOLD_T8 (SEQ ID NO: 2895) | 3459 | 3503 |
| HUMDNAPOLD_T15 (SEQ ID NO: 2896) | 3459 | 3503 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1, since it is in the coding region for the corresponding transcript.

Segment cluster HUMDNAPOLD_node_64 (SEQ ID NO:2935) according to the present invention is supported by 67 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2792 below describes the starting and ending position of this segment on each transcript.

TABLE 2792

Segment location on transcripts

| Transcript name | Segment starting position | Segment ending position |
|---|---|---|
| HUMDNAPOLD_T1 (SEQ ID NO: 2894) | 3295 | 3382 |

TABLE 2792-continued

Segment location on transcripts

| Transcript name | Segment starting position | Segment ending position |
|---|---|---|
| HUMDNAPOLD_T8 (SEQ ID NO: 2895) | 3504 | 3591 |
| HUMDNAPOLD_T15 (SEQ ID NO: 2896) | 3504 | 3591 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1, since it is in the coding region for the corresponding transcript.

Segment cluster HUMDNAPOLD_node_65 (SEQ ID NO:2936) according to the present invention is supported by 2 libraries. The number of libraries was determined as previously described. This segment can be found in the following transcript(s): HUMDNAPOLD_T15 (SEQ ID NO:2896). Table 2793 below describes the starting and ending position of this segment on each transcript.

TABLE 2793

Segment location on transcripts

| Transcript name | Segment starting position | Segment ending position |
|---|---|---|
| HUMDNAPOLD_T15 (SEQ ID NO: 2896) | 3592 | 3672 |

This segment can be found in a non-coding region of transcript(s) that are related to the following protein(s): HUMDNAPOLD_P7.

Segment cluster HUMDNAPOLD_node_66 (SEQ ID NO:2937) according to the present invention is supported by 77 libraries. The number of libraries was determined as previously described. This segment can be found in the following transcript(s): HUMDNAPOLD_T1 (SEQ ID NO:2894), HUMDNAPOLD_T8 (SEQ ID NO:2895) and HUMDNAPOLD_T15 (SEQ ID NO:2896). Table 2794 below describes the starting and ending position of this segment on each transcript.

TABLE 2794

Segment location on transcripts

| Transcript name | Segment starting position | Segment ending position |
|---|---|---|
| HUMDNAPOLD_T1 (SEQ ID NO: 2894) | 3383 | 3496 |
| HUMDNAPOLD_T8 (SEQ ID NO: 2895) | 3592 | 3705 |
| HUMDNAPOLD_T15 (SEQ ID NO: 2896) | 3673 | 3786 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1, since it is in the coding region for the corresponding transcript.

Segment cluster HUMDNAPOLD_node_69 (SEQ ID NO:2938) according to the present invention can be found in the following transcript(s): HUMDNAPOLD_T1 (SEQ ID NO:2894), HUMDNAPOLD_T8 (SEQ ID NO:2895), HUMDNAPOLD_T15 (SEQ ID NO:2896) and HUMDNAPOLD_T24 (SEQ ID NO:2897). Table 2795 below describes the starting and ending position of this segment on each transcript.

TABLE 2795

Segment location on transcripts

| Transcript name | Segment starting position | Segment ending position |
|---|---|---|
| HUMDNAPOLD_T1 (SEQ ID NO: 2894) | 3497 | 3519 |
| HUMDNAPOLD_T8 (SEQ ID NO: 2895) | 3706 | 3728 |
| HUMDNAPOLD_T15 (SEQ ID NO: 2896) | 3787 | 3809 |
| HUMDNAPOLD_T24 (SEQ ID NO: 2897) | 290 | 312 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1 and HUMDNAPOLD_P21, since it is in the coding region for the corresponding transcript.

Segment cluster HUMDNAPOLD_node_70 (SEQ ID NO:2939) according to the present invention is supported by 80 libraries. The number of libraries was determined as previously described. This segment can be found in the following transcript(s): HUMDNAPOLD_T1 (SEQ ID NO:2894), HUMDNAPOLD_T8 (SEQ ID NO:2895), HUMDNAPOLD_T15 (SEQ ID NO:2896) and HUMDNAPOLD_T24 (SEQ ID NO:2897). Table 2796 below describes the starting and ending position of this segment on each transcript.

TABLE 2796

Segment location on transcripts

| Transcript name | Segment starting position | Segment ending position |
|---|---|---|
| HUMDNAPOLD_T1 (SEQ ID NO: 2894) | 3520 | 3549 |
| HUMDNAPOLD_T8 (SEQ ID NO: 2895) | 3729 | 3758 |
| HUMDNAPOLD_T15 (SEQ ID NO: 2896) | 3810 | 3839 |
| HUMDNAPOLD_T24 (SEQ ID NO: 2897) | 313 | 342 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1 and HUMDNAPOLD_P21, since it is in the coding region for the corresponding transcript.

Segment cluster HUMDNAPOLD_node_72 (SEQ ID NO:2940) according to the present invention is supported by 87 libraries. The number of libraries was determined as previously described. This segment can be found in the following transcript(s): HUMDNAPOLD_T1 (SEQ ID NO:2894), HUMDNAPOLD_T8 (SEQ ID NO:2895), HUMDNAPOLD_T15 (SEQ ID NO:2896) and HUMDNAPOLD_T24 (SEQ ID NO:2897). Table 2797 below describes the starting and ending position of this segment on each transcript.

TABLE 2797

Segment location on transcripts

| Transcript name | Segment starting position | Segment ending position |
|---|---|---|
| HUMDNAPOLD_T1 (SEQ ID NO: 2894) | 3550 | 3647 |
| HUMDNAPOLD_T8 (SEQ ID NO: 2895) | 3759 | 3856 |
| HUMDNAPOLD_T15 (SEQ ID NO: 2896) | 3840 | 3937 |
| HUMDNAPOLD_T24 (SEQ ID NO: 2897) | 343 | 440 |

This segment can be found in both coding and non-coding regions of transcript(s) as follows. The segment can be found in a non-coding region of transcript(s) that are related to the following protein(s): HUMDNAPOLD_P7. This segment can also be found in the following protein(s): HUMDNAPOLD_P1 and HUMDNAPOLD_P21, since it is in the coding region for the corresponding transcript.

Segment cluster HUMDNAPOLD_node_75 (SEQ ID NO:2941) according to the present invention is supported by 56 libraries. The number of libraries was determined as previously described. This segment can be found in the following transcript(s): HUMDNAPOLD_T1 (SEQ ID NO:2894), HUMDNAPOLD_T8 (SEQ ID NO:2895), HUMDNAPOLD_T15 (SEQ ID NO:2896) and HUMDNAPOLD_T24 (SEQ ID NO:2897). Table 2798 below describes the starting and ending position of this segment on each transcript.

TABLE 2798

Segment location on transcripts

| Transcript name | Segment starting position | Segment ending position |
|---|---|---|
| HUMDNAPOLD_T1 (SEQ ID NO: 2894) | 3787 | 3824 |
| HUMDNAPOLD_T8 (SEQ ID NO: 2895) | 3996 | 4033 |
| HUMDNAPOLD_T15 (SEQ ID NO: 2896) | 4077 | 4114 |
| HUMDNAPOLD_T24 (SEQ ID NO: 2897) | 580 | 617 |

This segment can be found in a non-coding region of transcript(s) that are related to the following protein(s): HUMDNAPOLD_P1, HUMDNAPOLD_P7 and HUMDNAPOLD_P21.

Description for Cluster HUMETR103

Cluster HUMETR103 features 2 transcript(s) and 19 segment(s) of interest, the names for which are given in Tables 2799 and 2800, respectively, the sequences themselves are given at the end of the application. The selected protein variants are given in Table 2801.

TABLE 2799

Transcripts of interest
Transcript Name

HUMETR103_T3 (SEQ ID NO: 2942)
HUMETR103_T8 (SEQ ID NO: 2943)

TABLE 2800

Segments of interest
Segment Name

HUMETR103_node_1 (SEQ ID NO: 2944)
HUMETR103_node_5 (SEQ ID NO: 2945)
HUMETR103_node_7 (SEQ ID NO: 2946)
HUMETR103_node_9 (SEQ ID NO: 2947)
HUMETR103_node_12 (SEQ ID NO: 2948)
HUMETR103_node_15 (SEQ ID NO: 2949)
HUMETR103_node_20 (SEQ ID NO: 2950)
HUMETR103_node_0 (SEQ ID NO: 2951)
HUMETR103_node_2 (SEQ ID NO: 2952)
HUMETR103_node_3 (SEQ ID NO: 2953)
HUMETR103_node_4 (SEQ ID NO: 2954)
HUMETR103_node_6 (SEQ ID NO: 2955)
HUMETR103_node_8 (SEQ ID NO: 2956)
HUMETR103_node_10 (SEQ ID NO: 2957)
HUMETR103_node_11 (SEQ ID NO: 2958)
HUMETR103_node_13 (SEQ ID NO: 2959)
HUMETR103_node_16 (SEQ ID NO: 2960)
HUMETR103_node_18 (SEQ ID NO: 2961)
HUMETR103_node_19 (SEQ ID NO: 2962)

TABLE 2801

Proteins of interest

| Protein Name | Corresponding Transcript(s) |
|---|---|
| HUMETR103_P1 | HUMETR103_T8 (SEQ ID NO: 2943) |
| HUMETR103_P4 | HUMETR103_T3 (SEQ ID NO: 2942) |

These sequences are variants of the known protein Early growth response protein 1 (SwissProt accession identifier EGR1_HUMAN; known also according to the synonyms EGR-1; Krox-24 protein; ZIF268; Nerve growth factor-induced protein A; NGFI-A; Transcription factor ETR103; Zinc finger protein 225; AT225), referred to herein as the previously known protein.

Protein Early growth response protein 1 is known or believed to have the following function(s): Transcriptional regulator. Recognizes and binds to the DNA sequence 5'-CGCCCCCGC-3'(EGR-site). Activates the transcription of target genes whose products are required for mitogenesis and differentiation. The sequence for protein Early growth response protein 1 is given at the end of the application, as "Early growth response protein 1 amino acid sequence". Protein Early growth response protein 1 localization is believed to be Nuclear.

The following GO Annotation(s) apply to the previously known protein. The following annotation(s) were found: transcription regulation, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMETR103 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 73 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 73 and Table 2802. This cluster is overexpressed (at least at a minimum level) in the following pathological conditions: brain malignant tumors, a mixture of malignant tumors from different tissues and prostate cancer.

TABLE 2802

Normal tissue distribution

| Name of Tissue | Number |
| --- | --- |
| adrenal | 196 |
| bladder | 697 |
| bone | 265 |
| brain | 33 |
| colon | 286 |
| epithelial | 165 |
| general | 173 |
| head and neck | 101 |
| kidney | 78 |
| liver | 102 |
| lung | 234 |
| breast | 193 |
| ovary | 764 |
| pancreas | 63 |
| prostate | 24 |
| stomach | 3 |
| T cells | 0 |
| Thyroid | 206 |
| uterus | 90 |

TABLE 2803

P values and ratios for expression in cancerous tissue

| Name of Tissue | P1 | P2 | SP1 | R3 | SP2 | R4 |
| --- | --- | --- | --- | --- | --- | --- |
| adrenal | 2.2e−01 | 3.4e−01 | 2.8e−01 | 1.2 | 4.7e−01 | 0.9 |
| bladder | 6.2e−01 | 7.2e−01 | 7.8e−01 | 0.3 | 9.9e−01 | 0.2 |
| bone | 5.8e−01 | 8.4e−01 | 8.9e−01 | 0.6 | 9.9e−01 | 0.4 |
| brain | 2.2e−02 | 4.0e−02 | 7.8e−05 | 4.0 | 7.9e−03 | 2.4 |
| colon | 4.1e−01 | 5.1e−01 | 9.7e−01 | 0.4 | 9.9e−01 | 0.4 |
| epithelial | 1.2e−01 | 8.6e−01 | 4.0e−01 | 0.9 | 1 | 0.6 |
| general | 9.8e−03 | 7.3e−01 | 6.2e−01 | 0.9 | 1 | 0.5 |
| head and neck | 2.6e−01 | 4.4e−01 | 1 | 0.6 | 1 | 0.5 |
| kidney | 5.7e−01 | 7.5e−01 | 1.4e−01 | 1.5 | 4.2e−01 | 1.0 |
| liver | 1.8e−01 | 8.2e−01 | 5.5e−01 | 1.5 | 9.1e−01 | 0.6 |
| lung | 7.2e−01 | 8.5e−01 | 9.5e−01 | 0.6 | 4.0e−01 | 0.4 |
| breast | 6.7e−01 | 7.8e−01 | 6.2e−01 | 0.9 | 9.3e−01 | 0.5 |
| ovary | 8.0e−01 | 8.2e−01 | 1 | 0.2 | 1 | 0.1 |
| pancreas | 4.3e−01 | 4.9e−01 | 5.3e−01 | 0.9 | 6.8e−01 | 0.8 |
| prostate | 2.3e−01 | 4.5e−01 | 1.4e−04 | 6.1 | 2.5e−03 | 4.3 |
| stomach | 9.1e−01 | 7.1e−01 | 1 | 0.9 | 4.1e−01 | 1.6 |
| T cells | 1 | 6.7e−01 | 1 | 1.0 | 7.2e−01 | 1.4 |
| Thyroid | 4.9e−01 | 4.9e−01 | 7.4e−01 | 0.8 | 7.4e−01 | 0.8 |
| uterus | 5.4e−01 | 8.2e−01 | 9.1e−01 | 0.6 | 9.9e−01 | 0.4 |

As noted above, cluster HUMETR103 features 19 segment(s), which were listed in Table 2800 above and for which the sequence(s) are given at the end of the application. These segment(s) are portions of nucleic acid sequence(s) which are described herein separately because they are of particular interest. A description of each segment according to the present invention is now provided.

Segment cluster HUMETR103_node_1 (SEQ ID NO:2944) according to the present invention is supported by 33 libraries. The number of libraries was determined as previously described. This segment can be found in the following transcript(s): HUMETR103_T3 (SEQ ID NO:2942) and HUMETR103_T8 (SEQ ID NO:2943). Table 2804 below describes the starting and ending position of this segment on each transcript.

TABLE 2804

Segment location on transcripts

| Transcript name | Segment starting position | Segment ending position |
| --- | --- | --- |
| HUMETR103_T3 (SEQ ID NO: 2942) | 82 | 444 |
| HUMETR103_T8 (SEQ ID NO: 2943) | 82 | 444 |

This segment can be found in both coding and non-coding regions of transcript(s) as follows. The segment can be found in a non-coding region of transcript(s) that are related to the following protein(s): HUMETR103_P4. This segment can also be found in the following protein(s): HUMETR103_P1, since it is in the coding region for the corresponding transcript.

Segment cluster HUMETR103_node_5 (SEQ ID NO:2945) according to the present invention is supported by 13 libraries. The number of libraries was determined as previously described. This segment can be found in the following transcript(s): HUMETR103_T3 (SEQ ID NO:2942). Table 2805 below describes the starting and ending position of this segment on each transcript.

TABLE 2805

Segment location on transcripts

| Transcript name | Segment starting position | Segment ending position |
| --- | --- | --- |
| HUMETR103_T3 (SEQ ID NO: 2942) | 589 | 1276 |

This segment can be found in a non-coding region of transcript(s) that are related to the following protein(s): HUMETR103_P4.

Segment cluster HUMETR103_node_7 (SEQ ID NO:2946) according to the present invention is supported by 73 libraries. The number of libraries was determined as previously described. This segment can be found in the following transcript(s): HUMETR103_T3 (SEQ ID NO:2942) and HUMETR103_T8 (SEQ ID NO:2943). Table 2806 below describes the starting and ending position of this segment on each transcript.

TABLE 2806

Segment location on transcripts

| Transcript name | Segment starting position | Segment ending position |
| --- | --- | --- |
| HUMETR103_T3 (SEQ ID NO: 2942) | 1338 | 1513 |
| HUMETR103_T8 (SEQ ID NO: 2943) | 650 | 825 |

This segment can be found in the following protein(s): HUMETR103_P4 and HUMETR103_P1.

Segment cluster HUMETR103_node_9 (SEQ ID NO:2947) according to the present invention is supported by 85 libraries. The number of libraries was determined as previously described. This segment can be found in the following transcript(s): HUMETR103_T3 (SEQ ID NO:2942) and HUMETR103_T8 (SEQ ID NO:2943). Table 2807 below describes the starting and ending position of this segment on each transcript.

TABLE 2807

Segment location on transcripts

| Transcript name | Segment starting position | Segment ending position |
|---|---|---|
| HUMETR103_T3 (SEQ ID NO: 2942) | 1583 | 1787 |
| HUMETR103_T8 (SEQ ID NO: 2943) | 895 | 1099 |

This segment can be found in the following protein(s): HUMETR103_P4 and HUMETR103_P1.

Segment cluster HUMETR103_node_12 (SEQ ID NO:2948) according to the present invention is supported by 131 libraries. The number of libraries was determined as previously described. This segment can be found in the following transcript(s): HUMETR103_T3 (SEQ ID NO:2942) and HUMETR103_T8 (SEQ ID NO:2943). Table 2808 below describes the starting and ending position of this segment on each transcript.

TABLE 2808

Segment location on transcripts

| Transcript name | Segment starting position | Segment ending position |
|---|---|---|
| HUMETR103_T3 (SEQ ID NO: 2942) | 1864 | 2325 |
| HUMETR103_T8 (SEQ ID NO: 2943) | 1176 | 1637 |

This segment can be found in the following protein(s): HUMETR103_P4 and HUMETR103_P1.

Segment cluster HUMETR103_node_15 (SEQ ID NO:2949) according to the present invention is supported by 371 libraries. The number of libraries was determined as previously described. This segment can be found in the following transcript(s): HUMETR103_T3 (SEQ ID NO:2942) and HUMETR103_T8 (SEQ ID NO:2943). Table 2809 below describes the starting and ending position of this segment on each transcript.

TABLE 2809

Segment location on transcripts

| Transcript name | Segment starting position | Segment ending position |
|---|---|---|
| HUMETR103_T3 (SEQ ID NO: 2942) | 2433 | 3485 |
| HUMETR103_T8 (SEQ ID NO: 2943) | 1745 | 2797 |

This segment can be found in the following protein(s): HUMETR103_P4 and HUMETR103_P1.

Segment cluster HUMETR103_node_20 (SEQ ID NO:2950) according to the present invention is supported by 266 libraries. The number of libraries was determined as previously described. This segment can be found in the following transcript(s): HUMETR103_T3 (SEQ ID NO:2942) and HUMETR103_T8 (SEQ ID NO:2943). Table 2810 below describes the starting and ending position of this segment on each transcript.

TABLE 2810

Segment location on transcripts

| Transcript name | Segment starting position | Segment ending position |
|---|---|---|
| HUMETR103_T3 (SEQ ID NO: 2942) | 3639 | 3835 |
| HUMETR103_T8 (SEQ ID NO: 2943) | 2951 | 5038 |

This segment can be found in a non-coding region of transcript(s) that are related to the following protein(s): HUMETR103_P4 and HUMETR103_P1.

According to an optional embodiment of the present invention, short segments related to the above cluster are also provided. These segments are up to about 120 bp in length, and so are included in a separate description.

Segment cluster HUMETR103_node_0 (SEQ ID NO:2951) according to the present invention is supported by 17 libraries. The number of libraries was determined as previously described. This segment can be found in the following transcript(s): HUMETR103_T3 (SEQ ID NO:2942) and HUMETR103_T8 (SEQ ID NO:2943). Table 2811 below describes the starting and ending position of this segment on each transcript.

TABLE 2811

Segment location on transcripts

| Transcript name | Segment starting position | Segment ending position |
|---|---|---|
| HUMETR103_T3 (SEQ ID NO: 2942) | 1 | 81 |
| HUMETR103_T8 (SEQ ID NO: 2943) | 1 | 81 |

This segment can be found in a non-coding region of transcript(s) that are related to the following protein(s): HUMETR103_P4 and HUMETR103_P1.

Segment cluster HUMETR103_node_2 (SEQ ID NO:2952) according to the present invention can be found in the following transcript(s): HUMETR103_T3 (SEQ ID NO:2942) and HUMETR103_T8 (SEQ ID NO:2943). Table 2812 below describes the starting and ending position of this segment on each transcript.

TABLE 2812

Segment location on transcripts

| Transcript name | Segment starting position | Segment ending position |
|---|---|---|
| HUMETR103_T3 (SEQ ID NO: 2942) | 445 | 469 |
| HUMETR103_T8 (SEQ ID NO: 2943) | 445 | 469 |

This segment can be found in both coding and non-coding regions of transcript(s) as follows. The segment can be found in a non-coding region of transcript(s) that are related to the following protein(s): HUMETR103_P4. This segment can also be found in the following protein(s): HUMETR103_P1, since it is in the coding region for the corresponding transcript.

Segment cluster HUMETR103_node_3 (SEQ ID NO:2953) according to the present invention is supported by 32 libraries. The number of libraries was determined as previously described. This segment can be found in the following transcript(s): HUMETR103_T3 (SEQ ID NO:2942) and HUMETR103_T8 (SEQ ID NO:2943). Table 2813 below describes the starting and ending position of this segment on each transcript.

TABLE 2813

| Transcript name | Segment location on transcripts | |
|---|---|---|
| | Segment starting position | Segment ending position |
| HUMETR103_T3 (SEQ ID NO: 2942) | 470 | 517 |
| HUMETR103_T8 (SEQ ID NO: 2943) | 470 | 517 |

This segment can be found in both coding and non-coding regions of transcript(s) as follows. The segment can be found in a non-coding region of transcript(s) that are related to the following protein(s): HUMETR103_P4. This segment can also be found in the following protein(s): HUMETR103_P1, since it is in the coding region for the corresponding transcript.

Segment cluster HUMETR103_node_4 (SEQ ID NO:2954) according to the present invention is supported by 52 libraries. The number of libraries was determined as previously described. This segment can be found in the following transcript(s): HUMETR103_T3 (SEQ ID NO:2942) and HUMETR103_T8 (SEQ ID NO:2943). Table 2814 below describes the starting and ending position of this segment on each transcript.

TABLE 2814

| Transcript name | Segment location on transcripts | |
|---|---|---|
| | Segment starting position | Segment ending position |
| HUMETR103_T3 (SEQ ID NO: 2942) | 518 | 588 |
| HUMETR103_T8 (SEQ ID NO: 2943) | 518 | 588 |

This segment can be found in both coding and non-coding regions of transcript(s) as follows. The segment can be found in a non-coding region of transcript(s) that are related to the following protein(s): HUMETR103_P4. This segment can also be found in the following protein(s): HUMETR103_P1, since it is in the coding region for the corresponding transcript.

Segment cluster HUMETR103_node_6 (SEQ ID NO:2955) according to the present invention is supported by 63 libraries. The number of libraries was determined as previously described. This segment can be found in the following transcript(s): HUMETR103_T3 (SEQ ID NO:2942) and HUMETR103_T8 (SEQ ID NO:2943). Table 2815 below describes the starting and ending position of this segment on each transcript.

TABLE 2815

| Transcript name | Segment location on transcripts | |
|---|---|---|
| | Segment starting position | Segment ending position |
| HUMETR103_T3 (SEQ ID NO: 2942) | 1277 | 1337 |
| HUMETR103_T8 (SEQ ID NO: 2943) | 589 | 649 |

This segment can be found in both coding and non-coding regions of transcript(s) as follows. The segment can be found in a non-coding region of transcript(s) that are related to the following protein(s): HUMETR103_P4. This segment can also be found in the following protein(s): HUMETR103_P1, since it is in the coding region for the corresponding transcript.

Segment cluster HUMETR103_node_8 (SEQ ID NO:2956) according to the present invention is supported by 72 libraries. The number of libraries was determined as previously described. This segment can be found in the following transcript(s): HUMETR103_T3 (SEQ ID NO:2942) and HUMETR103_T8 (SEQ ID NO:2943). Table 2816 below describes the starting and ending position of this segment on each transcript.

TABLE 2816

| Transcript name | Segment location on transcripts | |
|---|---|---|
| | Segment starting position | Segment ending position |
| HUMETR103_T3 (SEQ ID NO: 2942) | 1514 | 1582 |
| HUMETR103_T8 (SEQ ID NO: 2943) | 826 | 894 |

This segment can be found in the following protein(s): HUMETR103_P4 and HUMETR103_P1.

Segment cluster HUMETR103_node_10 (SEQ ID NO:2957) according to the present invention is supported by 64 libraries. The number of libraries was determined as previously described. This segment can be found in the following transcript(s): HUMETR103_T3 (SEQ ID NO:2942) and HUMETR103_T8 (SEQ ID NO:2943). Table 2817 below describes the starting and ending position of this segment on each transcript.

TABLE 2817

| Transcript name | Segment location on transcripts | |
|---|---|---|
| | Segment starting position | Segment ending position |
| HUMETR103_T3 (SEQ ID NO: 2942) | 1788 | 1818 |
| HUMETR103_T8 (SEQ ID NO: 2943) | 1100 | 1130 |

This segment can be found in the following protein(s): HUMETR103_P4 and HUMETR103_P1.

Segment cluster HUMETR103_node_11 (SEQ ID NO:2958) according to the present invention is supported by 66 libraries. The number of libraries was determined as previously described. This segment can be found in the following transcript(s): HUMETR103_T3 (SEQ ID NO:2942) and HUMETR103_T8 (SEQ ID NO:2943). Table 2818 below describes the starting and ending position of this segment on each transcript.

TABLE 2818

Segment location on transcripts

| Transcript name | Segment starting position | Segment ending position |
|---|---|---|
| HUMETR103_T3 (SEQ ID NO: 2942) | 1819 | 1863 |
| HUMETR103_T8 (SEQ ID NO: 2943) | 1131 | 1175 |

This segment can be found in the following protein(s): HUMETR103_P4 and HUMETR103_P1.

Segment cluster HUMETR103_node_13 (SEQ ID NO:2959) according to the present invention is supported by 85 libraries. The number of libraries was determined as previously described. This segment can be found in the following transcript(s): HUMETR103_T3 (SEQ ID NO:2942) and HUMETR103_T8 (SEQ ID NO:2943). Table 2819 below describes the starting and ending position of this segment on each transcript.

TABLE 2819

Segment location on transcripts

| Transcript name | Segment starting position | Segment ending position |
|---|---|---|
| HUMETR103_T3 (SEQ ID NO: 2942) | 2326 | 2432 |
| HUMETR103_T8 (SEQ ID NO: 2943) | 1638 | 1744 |

This segment can be found in the following protein(s): HUMETR103_P4 and HUMETR103_P1.

Segment cluster HUMETR103_node_16 (SEQ ID NO:2960) according to the present invention can be found in the following transcript(s): HUMETR103_T3 (SEQ ID NO:2942) and HUMETR103_T8 (SEQ ID NO:2943). Table 2820 below describes the starting and ending position of this segment on each transcript.

TABLE 2820

Segment location on transcripts

| Transcript name | Segment starting position | Segment ending position |
|---|---|---|
| HUMETR103_T3 (SEQ ID NO: 2942) | 3486 | 3506 |
| HUMETR103_T8 (SEQ ID NO: 2943) | 2798 | 2818 |

This segment can be found in a non-coding region of transcript(s) that are related to the following protein(s): HUMETR103_P4 and HUMETR103_P1.

Segment cluster HUMETR103_node_18 (SEQ ID NO:2961) according to the present invention is supported by 248 libraries. The number of libraries was determined as previously described. This segment can be found in the following transcript(s): HUMETR103_T3 (SEQ ID NO:2942) and HUMETR103_T8 (SEQ ID NO:2943). Table 2821 below describes the starting and ending position of this segment on each transcript.

TABLE 2821

Segment location on transcripts

| Transcript name | Segment starting position | Segment ending position |
|---|---|---|
| HUMETR103_T3 (SEQ ID NO: 2942) | 3507 | 3583 |
| HUMETR103_T8 (SEQ ID NO: 2943) | 2819 | 2895 |

This segment can be found in a non-coding region of transcript(s) that are related to the following protein(s): HUMETR103_P4 and HUMETR103_P1.

Segment cluster HUMETR103_node_19 (SEQ ID NO:2962) according to the present invention is supported by 253 libraries. The number of libraries was determined as previously described. This segment can be found in the following transcript(s): HUMETR103_T3 (SEQ ID NO:2942) and HUMETR103_T8 (SEQ ID NO:2943). Table 2822 below describes the starting and ending position of this segment on each transcript.

TABLE 2822

Segment location on transcripts

| Transcript name | Segment starting position | Segment ending position |
|---|---|---|
| HUMETR103_T3 (SEQ ID NO: 2942) | 3584 | 3638 |
| HUMETR103_T8 (SEQ ID NO: 2943) | 2896 | 2950 |

This segment can be found in a non-coding region of transcript(s) that are related to the following protein(s): HUMETR103_P4 and HUMETR103_P1.

Description for Cluster HUMGRP5E

Cluster HUMGRP5E features 1 transcript(s) and 4 segment(s) of interest, the names for which are given in Tables 2823 and 2824, respectively, the sequences themselves are given at the end of the application. The selected protein variants are given in Table 2825.

TABLE 2823

Transcripts of interest
Transcript Name

HUMGRP5E_T3 (SEQ ID NO: 2963)

TABLE 2824

Segments of interest
Segment Name

HUMGRP5E_node_5 (SEQ ID NO: 2964)
HUMGRP5E_node_8 (SEQ ID NO: 2965)
HUMGRP5E_node_6 (SEQ ID NO: 2966)
HUMGRP5E_node_7 (SEQ ID NO: 2967)

TABLE 2825

Proteins of interest

| Protein Name | Corresponding Transcript(s) |
|---|---|

These sequences are variants of the known protein Gastrin-releasing peptide precursor (SwissProt accession identifier GRP_HUMAN; known also according to the synonyms GRP; GRP-10), referred to herein as the previously known protein.

Protein Gastrin-releasing peptide precursor is known or believed to have the following function(s): GRP stimulates gastrin release as well as other gastrointestinal hormones. The sequence for protein Gastrin-releasing peptide precursor is given at the end of the application, as "Gastrin-releasing peptide precursor amino acid sequence". Known polymorphisms for this sequence are as shown in Table 2826.

TABLE 2826

Amino acid mutations for Known Protein

| SNP position(s) on amino acid sequence | Comment |
|---|---|
| 4 | S -> R |

Protein Gastrin-releasing peptide precursor localization is believed to be Secreted.

The previously known protein also has the following indication(s) and/or potential therapeutic use(s): Diabetes, Type II. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bombesin antagonist; Insulinotropin agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anorectic/Antiobesity; Releasing hormone; Anticancer; Respiratory; Antidiabetic.

The following GO Annotation(s) apply to the previously known protein. The following annotation(s) were found: signal transduction; neuropeptide signaling pathway, which are annotation(s) related to Biological Process; growth factor, which are annotation(s) related to Molecular Function; and soluble fraction, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 2827.

TABLE 2827

Oligonucleotides related to this cluster

| Oligonucleotide name | Overexpressed in cancers | Chip reference |
|---|---|---|
| HUMGRP5E_0_0_16630 | lung malignant tumors | LUN |
| HUMGRP5E_0_2_0 | lung malignant tumors | LUN |

As noted above, cluster HUMGRP5E features 4 segment(s), which were listed in Table 2824 above and for which the sequence(s) are given at the end of the application. These segment(s) are portions of nucleic acid sequence(s) which are described herein separately because they are of particular interest. A description of each segment according to the present invention is now provided.

Segment cluster HUMGRP5E_node_5 (SEQ ID NO:2964) according to the present invention is supported by 5 libraries. The number of libraries was determined as previously described. This segment can be found in the following transcript(s): HUMGRP5E_T3 (SEQ ID NO:2963). Table 2828 below describes the starting and ending position of this segment on each transcript.

TABLE 2828

Segment location on transcripts

| Transcript name | Segment starting position | Segment ending position |
|---|---|---|
| HUMGRP5E_T3 (SEQ ID NO: 2963) | 1 | 1418 |

The previously-described transcripts for these segment(s) do not code for protein.

Segment cluster HUMGRP5E_node_8 (SEQ ID NO:2965) according to the present invention is supported by 26 libraries. The number of libraries was determined as previously described. This segment can be found in the following transcript(s): HUMGRP5E_T3 (SEQ ID NO:2963). Table 2829 below describes the starting and ending position of this segment on each transcript.

TABLE 2829

Segment location on transcripts

| Transcript name | Segment starting position | Segment ending position |
|---|---|---|
| HUMGRP5E_T3 (SEQ ID NO: 2963) | 1440 | 1798 |

The previously-described transcripts for these segment(s) do not code for protein.

According to an optional embodiment of the present invention, short segments related to the above cluster are also provided. These segments are up to about 120 bp in length, and so are included in a separate description.

Segment cluster HUMGRP5E_node_6 (SEQ ID NO:2966) according to the present invention can be found in the following transcript(s): HUMGRP5E_T3 (SEQ ID NO:2963). Table 2830 below describes the starting and ending position of this segment on each transcript.

TABLE 2830

| | Segment location on transcripts | |
|---|---|---|
| Transcript name | Segment starting position | Segment ending position |
| HUMGRP5E_T3 (SEQ ID NO: 2963) | 1419 | 1425 |

The previously-described transcripts for these segment(s) do not code for protein.

Segment cluster HUMGRP5E_node_7 (SEQ ID NO:2967) according to the present invention can be found in the following transcript(s): HUMGRP5E_T3 (SEQ ID NO:2963). Table 2831 below describes the starting and ending position of this segment on each transcript.

TABLE 2831

| | Segment location on transcripts | |
|---|---|---|
| Transcript name | Segment starting position | Segment ending position |
| HUMGRP5E_T3 (SEQ ID NO: 2963) | 1426 | 1439 |

The previously-described transcripts for these segment(s) do not code for protein.

Description for Cluster HUMIFN15K

Cluster HUMIFN15K features 6 transcript(s) and 10 segment(s) of interest, the names for which are given in Tables 2832 and 2833, respectively, the sequences themselves are given at the end of the application. The selected protein variants are given in Table 2834.

TABLE 2832

Transcripts of interest
Transcript Name

HUMIFN15K_T1 (SEQ ID NO: 2968)
HUMIFN15K_T2 (SEQ ID NO: 2969)
HUMIFN15K_T3 (SEQ ID NO: 2970)
HUMIFN15K_T4 (SEQ ID NO: 2971)
HUMIFN15K_T5 (SEQ ID NO: 2972)
HUMIFN15K_T6 (SEQ ID NO: 2973)

TABLE 2833

Segments of interest
Segment Name

HUMIFN15K_node_0 (SEQ ID NO: 2974)
HUMIFN15K_node_1 (SEQ ID NO: 2975)
HUMIFN15K_node_4 (SEQ ID NO: 2976)
HUMIFN15K_node_11 (SEQ ID NO: 2977)
HUMIFN15K_node_12 (SEQ ID NO: 2978)
HUMIFN15K_node_13 (SEQ ID NO: 2979)
HUMIFN15K_node_2 (SEQ ID NO: 2980)
HUMIFN15K_node_5 (SEQ ID NO: 2981)
HUMIFN15K_node_7 (SEQ ID NO: 2982)
HUMIFN15K_node_9 (SEQ ID NO: 2983)

TABLE 2834

| Proteins of interest | |
|---|---|
| Protein Name | Corresponding Transcript(s) |
| HUMIFN15K_P2 | HUMIFN15K_T1 (SEQ ID NO: 2968); HUMIFN15K_T6 (SEQ ID NO: 2973) |
| HUMIFN15K_P3 | HUMIFN15K_T2 (SEQ ID NO: 2969); HUMIFN15K_T3 (SEQ ID NO: 2970); HUMIFN15K_T5 (SEQ ID NO: 2972) |
| HUMIFN15K_P4 | HUMIFN15K_T4 (SEQ ID NO: 2971) |

These sequences are variants of the known protein Ubiquitin cross-reactive protein precursor (SwissProt accession identifier UCRP_HUMAN; known also according to the synonyms Interferon-induced 17 kDa protein; Interferon-induced 15 kDa protein), referred to herein as the previously known protein.

Protein Ubiquitin cross-reactive protein precursor is known or believed to have the following function(s): Acts as ubiquitin by conjugation to intracellular target proteins, through an enzyme pathway distinct from that of ubiquitin, differing in substrate specificity and interaction with ligating enzymes. Targets include SERPINA3G/SPI2A, JAK1, MAPK3/ERK1 and PLCG1. Shows specific chemotactic activity towards neutrophils and activates them to induce release of eosinophil chemotactic factors. May serve as a trans-acting binding factor directing the association of ligated target proteins to intermediate filaments. May also be involved in autocrine, paracrine and endocrine mechanisms, as in cell-to-cell signaling, possibly partly by inducing IFN-gamma secretion by monocytes and macrophages. The sequence for protein Ubiquitin cross-reactive protein precursor is given at the end of the application, as "Ubiquitin cross-reactive protein precursor amino acid sequence". Known polymorphisms for this sequence are as shown in Table 2835.

TABLE 2835

| Amino acid mutations for Known Protein | |
|---|---|
| SNP position(s) on amino acid sequence | Comment |
| 82 | S -> N (in dbSNP: 1921). /FTId = VAR_016181. |
| 34 | N -> K |

Protein Ubiquitin cross-reactive protein precursor localization is believed to be Cytoplasmic (UCRP conjugates seem to be noncovalently associated with the intermediate filaments and distributed in a punctate pattern) and secreted.

The following GO Annotation(s) apply to the previously known protein. The following annotation(s) were found: immune response; cell-cell signaling, which are annotation(s) related to Biological Process; protein binding, which are annotation(s) related to Molecular Function; and extracellular space; cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMIFN15K can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 74 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 74 and Table 2836. This cluster is overexpressed (at least at a minimum level) in the following pathological conditions: brain malignant tumors and breast malignant tumors.

TABLE 2836

Normal tissue distribution

| Name of Tissue | Number |
| --- | --- |
| adrenal | 0 |
| bladder | 0 |
| bone | 0 |
| brain | 8 |
| colon | 334 |
| epithelial | 51 |
| general | 56 |
| head and neck | 0 |
| liver | 0 |
| lung | 42 |
| lymph nodes | 3 |
| breast | 17 |
| bone marrow | 0 |
| ovary | 0 |
| pancreas | 12 |
| prostate | 10 |
| skin | 72 |
| stomach | 0 |
| uterus | 118 |

TABLE 2837

P values and ratios for expression in cancerous tissue

| Name of Tissue | P1 | P2 | SP1 | R3 | SP2 | R4 |
| --- | --- | --- | --- | --- | --- | --- |
| adrenal | 4.6e−01 | 5.0e−01 | 4.6e−01 | 2.2 | 5.3e−01 | 1.9 |
| bladder | 2.7e−01 | 3.4e−01 | 1.0e−01 | 3.3 | 2.1e−01 | 2.4 |
| bone | 9.1e−02 | 5.9e−02 | 1.6e−01 | 4.0 | 1.2e−01 | 3.0 |
| brain | 2.8e−02 | 4.1e−02 | 4.0e−05 | 5.7 | 4.7e−04 | 3.9 |
| colon | 6.3e−01 | 5.2e−01 | 1 | 0.3 | 1 | 0.3 |
| epithelial | 1.1e−01 | 7.0e−02 | 5.5e−03 | 1.3 | 3.9e−05 | 1.8 |
| general | 6.0e−02 | 3.6e−02 | 3.8e−05 | 1.5 | 1.4e−06 | 1.6 |
| head and neck | 2.1e−01 | 1.7e−01 | 1 | 1.2 | 5.6e−01 | 1.7 |
| liver | 1 | 4.5e−01 | 1 | 1.0 | 1 | 1.2 |
| lung | 8.5e−01 | 9.2e−01 | 9.3e−01 | 0.5 | 9.9e−01 | 0.3 |
| lymph nodes | 9.2e−01 | 8.0e−01 | 1 | 0.8 | 5.8e−01 | 1.4 |
| breast | 4.0e−01 | 2.7e−01 | 1.3e−04 | 3.3 | 8.2e−05 | 5.7 |
| bone marrow | 4.3e−01 | 6.7e−01 | 1.5e−01 | 6.7 | 5.3e−01 | 1.9 |
| ovary | 3.7e−02 | 3.0e−02 | 1.0e−02 | 5.8 | 2.4e−02 | 4.7 |
| pancreas | 6.7e−01 | 3.6e−01 | 6.7e−01 | 1.1 | 1.4e−01 | 2.5 |
| prostate | 7.0e−01 | 6.8e−01 | 3.0e−01 | 1.7 | 1.8e−01 | 1.8 |
| skin | 7.7e−01 | 6.9e−01 | 1 | 0.2 | 8.4e−01 | 0.5 |
| stomach | 1 | 6.8e−01 | 1 | 1.0 | 5.1e−01 | 1.5 |
| uterus | 3.0e−01 | 1.3e−01 | 7.5e−01 | 0.7 | 2.9e−02 | 1.4 |

As noted above, cluster HUMIFN15K features 10 segment(s), which were listed in Table 2833 above and for which the sequence(s) are given at the end of the application. These segment(s) are portions of nucleic acid sequence(s) which are described herein separately because they are of particular interest. A description of each segment according to the present invention is now provided.

Segment cluster HUMIFN15K_node_0 (SEQ ID NO:2974) according to the present invention is supported by 5 libraries. The number of libraries was determined as previously described. This segment can be found in the following transcript(s): HUMIFN15K_T1 (SEQ ID NO:2968), HUMIFN15K_T4 (SEQ ID NO:2971) and HUMIFN15K_T6 (SEQ ID NO:2973). Table 2838 below describes the starting and ending position of this segment on each transcript.

TABLE 2838

Segment location on transcripts

| Transcript name | Segment starting position | Segment ending position |
| --- | --- | --- |
| HUMIFN15K_T1 (SEQ ID NO:2968) | 1 | 478 |
| HUMIFN15K_T4 (SEQ ID NO:2971) | 1 | 478 |
| HUMIFN15K_T6 (SEQ ID NO:2973) | 1 | 478 |

This segment can be found in the following protein(s): HUMIFN15K_P2 and HUMIFN15K_P4.

Segment cluster HUMIFN15K_node_1 (SEQ ID NO:2975) according to the present invention is supported by 5 libraries. The number of libraries was determined as previously described. This segment can be found in the following transcript(s): HUMIFN15K_T1 (SEQ ID NO:2968) and HUMIFN15K_T6 (SEQ ID NO:2973). Table 2839 below describes the starting and ending position of this segment on each transcript.

TABLE 2839

Segment location on transcripts

| Transcript name | Segment starting position | Segment ending position |
| --- | --- | --- |
| HUMIFN15K_T1 (SEQ ID NO: 2968) | 479 | 703 |
| HUMIFN15K_T6 (SEQ ID NO: 2973) | 479 | 703 |

This segment can be found in the following protein(s): HUMIFN15K_P2.

Segment cluster HUMIFN15K_node_4 (SEQ ID NO:2976) according to the present invention is supported by 3 libraries. The number of libraries was determined as previously described. This segment can be found in the following transcript(s): HUMIFN15K_T2 (SEQ ID NO:2969) and HUMIFN15K_T3 (SEQ ID NO:2970). Table 2840 below describes the starting and ending position of this segment on each transcript.

TABLE 2840

Segment location on transcripts

| Transcript name | Segment starting position | Segment ending position |
| --- | --- | --- |
| HUMIFN15K_T2 (SEQ ID NO: 2969) | 1 | 126 |
| HUMIFN15K_T3 (SEQ ID NO: 2970) | 1 | 126 |

This segment can be found in a non-coding region of transcript(s) that are related to the following protein(s): HUMIFN15K_P3.

Segment cluster HUMIFN15K_node_11(SEQ ID NO:2977) according to the present invention is supported by 194 libraries. The number of libraries was determined as previously described. This segment can be found in the following transcript(s): HUMIFN15K_T5 (SEQ ID NO:2972). Table 2841 below describes the starting and ending position of this segment on each transcript.

TABLE 2841

Segment location on transcripts

| Transcript name | Segment starting position | Segment ending position |
|---|---|---|
| HUMIFN15K_T5 (SEQ ID NO: 2972) | 1 | 155 |

This segment can be found in a non-coding region of transcript(s) that are related to the following protein(s): HUMIFN15K_P3.

Segment cluster HUMIFN15K_node_12 (SEQ ID NO:2978) according to the present invention is supported by 10 libraries. The number of libraries was determined as previously described. This segment can be found in the following transcript(s): HUMIFN15K_T5 (SEQ ID NO:2972). Table 2842 below describes the starting and ending position of this segment on each transcript.

TABLE 2842

Segment location on transcripts

| Transcript name | Segment starting position | Segment ending position |
|---|---|---|
| HUMIFN15K_T5 (SEQ ID NO: 2972) | 156 | 562 |

This segment can be found in a non-coding region of transcript(s) that are related to the following protein(s): HUMIFN15K_P3.

Segment cluster HUMIFN15K_node_13 (SEQ ID NO:2979) according to the present invention is supported by 258 libraries. The number of libraries was determined as previously described. This segment can be found in the following transcript(s): HUMIFN15K_T1 (SEQ ID NO:2968), HUMIFN15K_T2 (SEQ ID NO:2969), HUMIFN15K_T3 (SEQ ID NO:2970), HUMIFN15K_T4 (SEQ ID NO:2971) and HUMIFN15K_T5 (SEQ ID NO:2972). Table 2843 below describes the starting and ending position of this segment on each transcript.

TABLE 2843

Segment location on transcripts

| Transcript name | Segment starting position | Segment ending position |
|---|---|---|
| HUMIFN15K_T1 (SEQ ID NO: 2968) | 886 | 1442 |
| HUMIFN15K_T2 (SEQ ID NO: 2969) | 231 | 787 |
| HUMIFN15K_T3 (SEQ ID NO: 2970) | 213 | 769 |
| HUMIFN15K_T4 (SEQ ID NO: 2971) | 565 | 1121 |
| HUMIFN15K_T5 (SEQ ID NO: 2972) | 563 | 1119 |

This segment can be found in both coding and non-coding regions of transcript(s) as follows. The segment can be found in a non-coding region of transcript(s) that are related to the following protein(s): HUMIFN15K_P2 and HUMIFN15K_P4. This segment can also be found in the following protein(s): HUMIFN15K_P3, since it is in the coding region for the corresponding transcript.

According to an optional embodiment of the present invention, short segments related to the above cluster are also provided. These segments are up to about 120 bp in length, and so are included in a separate description.

Segment cluster HUMIFN15K_node_2 (SEQ ID NO:2980) according to the present invention is supported by 3 libraries. The number of libraries was determined as previously described. This segment can be found in the following transcript(s): HUMIFN15K_T6 (SEQ ID NO:2973). Table 2844 below describes the starting and ending position of this segment on each transcript.

TABLE 2844

Segment location on transcripts

| Transcript name | Segment starting position | Segment ending position |
|---|---|---|
| HUMIFN15K_T6 (SEQ ID NO: 2973) | 704 | 794 |

This segment can be found in a non-coding region of transcript(s) that are related to the following protein(s): HUMIFN15K_P2.

Segment cluster HUMIFN15K_node_5 (SEQ ID NO:2981) according to the present invention can be found in the following transcript(s): HUMIFN15K_T2 (SEQ ID NO:2969). Table 2845 below describes the starting and ending position of this segment on each transcript.

TABLE 2845

Segment location on transcripts

| Transcript name | Segment starting position | Segment ending position |
|---|---|---|
| HUMIFN15K_T2 (SEQ ID NO: 2969) | 127 | 144 |

This segment can be found in a non-coding region of transcript(s) that are related to the following protein(s): HUMIFN15K_P3.

Segment cluster HUMIFN15K_node_7 (SEQ ID NO:2982) according to the present invention is supported by 1 libraries. The number of libraries was determined as previously described. This segment can be found in the following transcript(s): HUMIFN15K_T1 (SEQ ID NO:2968). Table 2846 below describes the starting and ending position of this segment on each transcript.

TABLE 2846

Segment location on transcripts

| Transcript name | Segment starting position | Segment ending position |
|---|---|---|
| HUMIFN15K_T1 (SEQ ID NO: 2968) | 704 | 799 |

This segment can be found in a non-coding region of transcript(s) that are related to the following protein(s): HUMIFN15K_P2.

Segment cluster HUMIFN15K_node_9 (SEQ ID NO:2983) according to the present invention is supported by 4 libraries. The number of libraries was determined as previously described. This segment can be found in the following transcript(s): HUMIFN15K_T1 (SEQ ID NO:2968), HUMIFN15K_T2 (SEQ ID NO:2969), HUMIFN15K_T3 (SEQ ID NO:2970) and HUMIFN15K_T4 (SEQ ID NO:2971). Table 2847 below describes the starting and ending position of this segment on each transcript.

TABLE 2847

Segment location on transcripts

| Transcript name | Segment starting position | Segment ending position |
|---|---|---|
| HUMIFN15K_T1 (SEQ ID NO: 2968) | 800 | 885 |
| HUMIFN15K_T2 (SEQ ID NO: 2969) | 145 | 230 |
| HUMIFN15K_T3 (SEQ ID NO: 2970) | 127 | 212 |
| HUMIFN15K_T4 (SEQ ID NO: 2971) | 479 | 564 |

This segment can be found in both coding and non-coding regions of transcript(s) as follows. The segment can be found in a non-coding region of transcript(s) that are related to the following protein(s): HUMIFN15K_P2 and HUMIFN15K_P3. This segment can also be found in the following protein(s): HUMIFN15K_P4, since it is in the coding region for the corresponding transcript.

Description for Cluster HUMPKM2L

Cluster HUMPKM2L features 5 transcript(s) and 120 segment(s) of interest, the names for which are given in Tables 2848 and 2849, respectively, the sequences themselves are given at the end of the application. The selected protein variants are given in Table 2850.

TABLE 2848

Transcripts of interest
Transcript Name

HUMPKM2L_T6 (SEQ ID NO: 2984)
HUMPKM2L_T9 (SEQ ID NO: 2985)
HUMPKM2L_T27 (SEQ ID NO: 2986)
HUMPKM2L_T41 (SEQ ID NO: 2987)
HUMPKM2L_T65 (SEQ ID NO: 2988)

TABLE 2849

Segments of interest
Segment Name

HUMPKM2L_node_2 (SEQ ID NO: 2989)
HUMPKM2L_node_3 (SEQ ID NO: 2990)
HUMPKM2L_node_11 (SEQ ID NO: 2991)
HUMPKM2L_node_12 (SEQ ID NO: 2992)
HUMPKM2L_node_38 (SEQ ID NO: 2993)
HUMPKM2L_node_56 (SEQ ID NO: 2994)
HUMPKM2L_node_155 (SEQ ID NO: 2995)
HUMPKM2L_node_4 (SEQ ID NO: 2996)
HUMPKM2L_node_10 (SEQ ID NO: 2997)
HUMPKM2L_node_14 (SEQ ID NO: 2998)
HUMPKM2L_node_16 (SEQ ID NO: 2999)
HUMPKM2L_node_19 (SEQ ID NO: 3000)
HUMPKM2L_node_20 (SEQ ID NO: 3001)
HUMPKM2L_node_21 (SEQ ID NO: 3002)
HUMPKM2L_node_22 (SEQ ID NO: 3003)
HUMPKM2L_node_23 (SEQ ID NO: 3004)
HUMPKM2L_node_24 (SEQ ID NO: 3005)
HUMPKM2L_node_25 (SEQ ID NO: 3006)
HUMPKM2L_node_29 (SEQ ID NO: 3007)
HUMPKM2L_node_30 (SEQ ID NO: 3008)
HUMPKM2L_node_31 (SEQ ID NO: 3009)
HUMPKM2L_node_34 (SEQ ID NO: 3010)
HUMPKM2L_node_35 (SEQ ID NO: 3011)
HUMPKM2L_node_36 (SEQ ID NO: 3012)
HUMPKM2L_node_37 (SEQ ID NO: 3013)
HUMPKM2L_node_39 (SEQ ID NO: 3014)
HUMPKM2L_node_40 (SEQ ID NO: 3015)
HUMPKM2L_node_41 (SEQ ID NO: 3016)
HUMPKM2L_node_42 (SEQ ID NO: 3017)
HUMPKM2L_node_43 (SEQ ID NO: 3018)

TABLE 2849-continued

Segments of interest
Segment Name

HUMPKM2L_node_44 (SEQ ID NO: 3019)
HUMPKM2L_node_45 (SEQ ID NO: 3020)
HUMPKM2L_node_46 (SEQ ID NO: 3021)
HUMPKM2L_node_48 (SEQ ID NO: 3022)
HUMPKM2L_node_49 (SEQ ID NO: 3023)
HUMPKM2L_node_50 (SEQ ID NO: 3024)
HUMPKM2L_node_51 (SEQ ID NO: 3025)
HUMPKM2L_node_52 (SEQ ID NO: 3026)
HUMPKM2L_node_53 (SEQ ID NO: 3027)
HUMPKM2L_node_57 (SEQ ID NO: 3028)
HUMPKM2L_node_58 (SEQ ID NO: 3029)
HUMPKM2L_node_59 (SEQ ID NO: 3030)
HUMPKM2L_node_60 (SEQ ID NO: 3031)
HUMPKM2L_node_61 (SEQ ID NO: 3032)
HUMPKM2L_node_62 (SEQ ID NO: 3033)
HUMPKM2L_node_63 (SEQ ID NO: 3034)
HUMPKM2L_node_64 (SEQ ID NO: 3035)
HUMPKM2L_node_65 (SEQ ID NO: 3036)
HUMPKM2L_node_66 (SEQ ID NO: 3037)
HUMPKM2L_node_67 (SEQ ID NO: 3038)
HUMPKM2L_node_68 (SEQ ID NO: 3039)
HUMPKM2L_node_69 (SEQ ID NO: 3040)
HUMPKM2L_node_70 (SEQ ID NO: 3041)
HUMPKM2L_node_71 (SEQ ID NO: 3042)
HUMPKM2L_node_72 (SEQ ID NO: 3043)
HUMPKM2L_node_75 (SEQ ID NO: 3044)
HUMPKM2L_node_76 (SEQ ID NO: 3045)
HUMPKM2L_node_77 (SEQ ID NO: 3046)
HUMPKM2L_node_80 (SEQ ID NO: 3047)
HUMPKM2L_node_81 (SEQ ID NO: 3048)
HUMPKM2L_node_82 (SEQ ID NO: 3049)
HUMPKM2L_node_83 (SEQ ID NO: 3050)
HUMPKM2L_node_84 (SEQ ID NO: 3051)
HUMPKM2L_node_85 (SEQ ID NO: 3052)
HUMPKM2L_node_93 (SEQ ID NO: 3053)
HUMPKM2L_node_94 (SEQ ID NO: 3054)
HUMPKM2L_node_95 (SEQ ID NO: 3055)
HUMPKM2L_node_96 (SEQ ID NO: 3056)
HUMPKM2L_node_97 (SEQ ID NO: 3057)
HUMPKM2L_node_98 (SEQ ID NO: 3058)
HUMPKM2L_node_99 (SEQ ID NO: 3059)
HUMPKM2L_node_100 (SEQ ID NO: 3060)
HUMPKM2L_node_101 (SEQ ID NO: 3061)
HUMPKM2L_node_102 (SEQ ID NO: 3062)
HUMPKM2L_node_103 (SEQ ID NO: 3063)
HUMPKM2L_node_106 (SEQ ID NO: 3064)
HUMPKM2L_node_107 (SEQ ID NO: 3065)
HUMPKM2L_node_108 (SEQ ID NO: 3066)
HUMPKM2L_node_109 (SEQ ID NO: 3067)
HUMPKM2L_node_110 (SEQ ID NO: 3068)
HUMPKM2L_node_112 (SEQ ID NO: 3069)
HUMPKM2L_node_113 (SEQ ID NO: 3070)
HUMPKM2L_node_114 (SEQ ID NO: 3071)
HUMPKM2L_node_115 (SEQ ID NO: 3072)
HUMPKM2L_node_116 (SEQ ID NO: 3073)
HUMPKM2L_node_117 (SEQ ID NO: 3074)
HUMPKM2L_node_118 (SEQ ID NO: 3075)
HUMPKM2L_node_119 (SEQ ID NO: 3076)
HUMPKM2L_node_120 (SEQ ID NO: 3077)
HUMPKM2L_node_121 (SEQ ID NO: 3078)
HUMPKM2L_node_122 (SEQ ID NO: 3079)
HUMPKM2L_node_123 (SEQ ID NO: 3080)
HUMPKM2L_node_124 (SEQ ID NO: 3081)
HUMPKM2L_node_125 (SEQ ID NO: 3082)
HUMPKM2L_node_126 (SEQ ID NO: 3083)
HUMPKM2L_node_127 (SEQ ID NO: 3084)
HUMPKM2L_node_128 (SEQ ID NO: 3085)
HUMPKM2L_node_129 (SEQ ID NO: 3086)
HUMPKM2L_node_130 (SEQ ID NO: 3087)
HUMPKM2L_node_131 (SEQ ID NO: 3088)
HUMPKM2L_node_132 (SEQ ID NO: 3089)
HUMPKM2L_node_133 (SEQ ID NO: 3090)
HUMPKM2L_node_134 (SEQ ID NO: 3091)
HUMPKM2L_node_135 (SEQ ID NO: 3092)
HUMPKM2L_node_136 (SEQ ID NO: 3093)
HUMPKM2L_node_137 (SEQ ID NO: 3094)

TABLE 2849-continued

Segments of interest
Segment Name

HUMPKM2L_node_138 (SEQ ID NO: 3095)
HUMPKM2L_node_139 (SEQ ID NO: 3096)
HUMPKM2L_node_140 (SEQ ID NO: 3097)
HUMPKM2L_node_141 (SEQ ID NO: 3098)
HUMPKM2L_node_142 (SEQ ID NO: 3099)
HUMPKM2L_node_143 (SEQ ID NO: 3100)
HUMPKM2L_node_144 (SEQ ID NO: 3101)
HUMPKM2L_node_145 (SEQ ID NO: 3102)
HUMPKM2L_node_146 (SEQ ID NO: 3103)
HUMPKM2L_node_147 (SEQ ID NO: 3104)
HUMPKM2L_node_148 (SEQ ID NO: 3105)
HUMPKM2L_node_149 (SEQ ID NO: 3106)
HUMPKM2L_node_150 (SEQ ID NO: 3107)
HUMPKM2L_node_151 (SEQ ID NO: 3108)

TABLE 2850

Proteins of interest

| Protein Name | Corresponding Transcript(s) |
| --- | --- |
| HUMPKM2L_P4 | HUMPKM2L_T6 (SEQ ID NO: 2984) |
| HUMPKM2L_P6 | HUMPKM2L_T9 (SEQ ID NO: 2985) |
| HUMPKM2L_P10 | HUMPKM2L_T27 (SEQ ID NO: 2986) |
| HUMPKM2L_P16 | HUMPKM2L_T41 (SEQ ID NO: 2987) |
| HUMPKM2L_P37 | HUMPKM2L_T65 (SEQ ID NO: 2988) |

These sequences are variants of the known protein Pyruvate kinase, M1 isozyme (SwissProt accession identifier KPY1_HUMAN; known also according to the synonyms EC 2.7.1.40; Pyruvate kinase muscle isozyme; Cytosolic thyroid hormone-binding protein; CTHBP; THBP1), referred to herein as the previously known protein.

The sequence for protein Pyruvate kinase, M1 isozyme is given at the end of the application, as "Pyruvate kinase, M1 isozyme amino acid sequence". Known polymorphisms for this sequence are as shown in Table 2851.

TABLE 2851

Amino acid mutations for Known Protein

| SNP position(s) on amino acid sequence | Comment |
| --- | --- |
| 6 | E -> Q |
| 102 | I -> Y |
| 131 | V -> L |
| 203 | G -> V |
| 338 | R -> P |
| 506 | D -> H |

The following GO Annotation(s) apply to the previously known protein. The following annotation(s) were found: glycolysis, which are annotation(s) related to Biological Process; magnesium binding; pyruvate kinase; transferase, which are annotation(s) related to Molecular Function; and cytosol, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMPKM2L can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 75 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 75 and Table 2852. This cluster is overexpressed (at least at a minimum level) in the following pathological conditions: epithelial malignant tumors, a mixture of malignant tumors from different tissues, hepatocellular carcinoma, malignant tumors involving the lymph nodes, ovarian carcinoma, pancreas carcinoma, gastric carcinoma and uterine malignancies.

TABLE 2852

Normal tissue distribution

| Name of Tissue | Number |
| --- | --- |
| Adrenal | 420 |
| Bladder | 738 |
| Bone | 4080 |
| Brain | 902 |
| Colon | 365 |
| epithelial | 452 |
| general | 719 |
| head and neck | 324 |
| kidney | 525 |
| liver | 4 |
| lung | 610 |
| lymph nodes | 235 |
| breast | 558 |
| bone marrow | 627 |
| muscle | 1112 |
| ovary | 167 |
| pancreas | 119 |
| prostate | 289 |
| skin | 1099 |
| stomach | 219 |
| T cells | 2787 |
| Thyroid | 270 |
| uterus | 268 |

TABLE 2853

P values and ratios for expression in cancerous tissue

| Name of Tissue | P1 | P2 | SP1 | R3 | SP2 | R4 |
| --- | --- | --- | --- | --- | --- | --- |
| adrenal | 5.3e-01 | 5.4e-01 | 1.5e-01 | 0.9 | 6.2e-03 | 1.3 |
| bladder | 3.3e-01 | 2.7e-01 | 4.8e-01 | 0.8 | 4.7e-01 | 0.7 |
| bone | 3.5e-01 | 4.1e-01 | 1 | 0.1 | 1 | 0.2 |
| brain | 5.9e-01 | 5.0e-01 | 3.4e-04 | 1.0 | 3.4e-36 | 1.8 |
| colon | 1.5e-01 | 7.9e-02 | 1.6e-02 | 1.6 | 4.2e-10 | 2.3 |
| epithelial | 1.9e-02 | 8.8e-05 | 1.1e-12 | 1.6 | 2.2e-259 | 4.9 |
| general | 9.4e-02 | 1.4e-03 | 9.9e-04 | 1.1 | 0.0e+00 | 3.0 |
| head and neck | 3.3e-01 | 2.2e-01 | 4.2e-01 | 1.3 | 1.2e-09 | 1.2 |
| kidney | 5.8e-01 | 5.4e-01 | 1.1e-02 | 1.3 | 5.8e-21 | 1.9 |
| liver | 3.3e-01 | 3.6e-04 | 2.3e-01 | 3.9 | 1.8e-28 | 38.0 |
| lung | 6.3e-01 | 5.5e-01 | 7.1e-02 | 1.1 | 1.7e-25 | 2.8 |
| lymph nodes | 4.8e-01 | 4.9e-01 | 6.6e-05 | 2.2 | 6.7e-42 | 6.3 |
| breast | 4.4e-01 | 2.9e-01 | 5.1e-01 | 0.8 | 6.1e-18 | 2.4 |
| bone marrow | 6.0e-01 | 7.0e-01 | 9.7e-01 | 0.3 | 9.4e-01 | 0.5 |
| muscle | 4.2e-01 | 4.6e-01 | 1 | 0.2 | 6.9e-08 | 0.1 |
| ovary | 4.4e-01 | 3.6e-01 | 7.4e-06 | 2.8 | 5.8e-30 | 7.0 |
| pancreas | 3.7e-02 | 8.5e-03 | 2.6e-17 | 4.9 | 4.8e-46 | 10.3 |
| prostate | 6.5e-01 | 5.4e-01 | 3.8e-02 | 1.2 | 4.1e-12 | 2.1 |
| skin | 4.9e-01 | 3.9e-01 | 3.6e-06 | 0.6 | 1.4e-53 | 2.7 |
| stomach | 5.7e-01 | 1.9e-01 | 6.0e-02 | 0.4 | 1.1e-15 | 6.2 |
| T cells | 1 | 1 | 9.9e-01 | 0.3 | 7.3e-01 | 0.2 |
| Thyroid | 3.6e-01 | 3.6e-01 | 3.0e-01 | 1.1 | 3.0e-01 | 1.1 |
| uterus | 8.7e-02 | 2.3e-02 | 7.5e-05 | 1.9 | 1.4e-22 | 5.2 |

As noted above, cluster HUMPKM2L features 120 segment(s), which were listed in Table 2849 above and for which the sequence(s) are given at the end of the application. These segment(s) are portions of nucleic acid sequence(s) which are described herein separately because they are of particular interest. A description of each segment according to the present invention is now provided.

Segment cluster HUMPKM2L_node_2 (SEQ ID NO:2989) according to the present invention is supported by 21 libraries. The number of libraries was determined as previously described. This segment can be found in the following transcript(s): HUMPKM2L_T27 (SEQ ID NO:2986) and HUMPKM2L_T65 (SEQ ID NO:2988). Table 2854 below describes the starting and ending position of this segment on each transcript.

TABLE 2854

Segment location on transcripts

| Transcript name | Segment starting position | Segment ending position |
|---|---|---|
| HUMPKM2L_T27 (SEQ ID NO: 2986) | 1 | 257 |
| HUMPKM2L_T65 (SEQ ID NO: 2988) | 1 | 257 |

This segment can be found in a non-coding region of transcript(s) that are related to the following protein(s): HUMPKM2L_P10 and HUMPKM2L_P37.

Segment cluster HUMPKM2L_node_3 (SEQ ID NO:2990) according to the present invention is supported by 103 libraries. The number of libraries was determined as previously described. This segment can be found in the following transcript(s): HUMPKM2L_T27 (SEQ ID NO:2986) and HUMPKM2L_T65 (SEQ ID NO:2988). Table 2855 below describes the starting and ending position of this segment on each transcript.

TABLE 2855

Segment location on transcripts

| Transcript name | Segment starting position | Segment ending position |
|---|---|---|
| HUMPKM2L_T27 (SEQ ID NO: 2986) | 258 | 396 |
| HUMPKM2L_T65 (SEQ ID NO: 2988) | 258 | 396 |

This segment can be found in a non-coding region of transcript(s) that are related to the following protein(s): HUMPKM2L_P10 and HUMPKM2L_P37.

Segment cluster HUMPKM2L_node_11 (SEQ ID NO:2991) according to the present invention is supported by 4 libraries. The number of libraries was determined as previously described. This segment can be found in the following transcript(s): HUMPKM2L_T6 (SEQ ID NO:2984). Table 2856 below describes the starting and ending position of this segment on each transcript.

TABLE 2856

Segment location on transcripts

| Transcript name | Segment starting position | Segment ending position |
|---|---|---|
| HUMPKM2L_T6 (SEQ ID NO: 2984) | 104 | 381 |

This segment can be found in a non-coding region of transcript(s) that are related to the following protein(s): HUMPKM2L_P4.

Segment cluster HUMPKM2L_node_12 (SEQ ID NO:2992) according to the present invention is supported by 6 libraries. The number of libraries was determined as previously described. This segment can be found in the following transcript(s): HUMPKM2L_T6 (SEQ ID NO:2984). Table 2857 below describes the starting and ending position of this segment on each transcript.

TABLE 2857

Segment location on transcripts

| Transcript name | Segment starting position | Segment ending position |
|---|---|---|
| HUMPKM2L_T6 (SEQ ID NO: 2984) | 382 | 1073 |

This segment can be found in the following protein(s): HUMPKM2L_P4.

Segment cluster HUMPKM2L_node_38 (SEQ ID NO:2993) according to the present invention is supported by 6 libraries. The number of libraries was determined as previously described. This segment can be found in the following transcript(s): HUMPKM2L_T27 (SEQ ID NO:2986). Table 2858 below describes the starting and ending position of this segment on each transcript.

TABLE 2858

Segment location on transcripts

| Transcript name | Segment starting position | Segment ending position |
|---|---|---|
| HUMPKM2L_T27 (SEQ ID NO: 2986) | 866 | 1343 |

This segment can be found in a non-coding region of transcript(s) that are related to the following protein(s): HUMPKM2L_P10.

Segment cluster HUMPKM2L_node_56 (SEQ ID NO:2994) according to the present invention is supported by 3 libraries. The number of libraries was determined as previously described. This segment can be found in the following transcript(s): HUMPKM2L_T41 (SEQ ID NO:2987). Table 2859 below describes the starting and ending position of this segment on each transcript.

TABLE 2859

Segment location on transcripts

| Transcript name | Segment starting position | Segment ending position |
|---|---|---|
| HUMPKM2L_T41 (SEQ ID NO: 2987) | 1 | 196 |

This segment can be found in a non-coding region of transcript(s) that are related to the following protein(s): HUMPKM2L_P16.

Segment cluster HUMPKM2L_node_155 (SEQ ID NO:2995) according to the present invention is supported by 2 libraries. The number of libraries was determined as previously described. This segment can be found in the following transcript(s): HUMPKM2L_T65 (SEQ ID NO:2988). Table 2860 below describes the starting and ending position of this segment on each transcript.

TABLE 2860

| Transcript name | Segment location on transcripts | |
|---|---|---|
| | Segment starting position | Segment ending position |
| HUMPKM2L_T65 (SEQ ID NO: 2988) | 1619 | 1869 |

This segment can be found in the following protein(s): HUMPKM2L_P37.

According to an optional embodiment of the present invention, short segments related to the above cluster are also provided. These segments are up to about 120 bp in length, and so are included in a separate description.

Segment cluster HUMPKM2L_node_4 (SEQ ID NO:2996) according to the present invention is supported by 177 libraries. The number of libraries was determined as previously described. This segment can be found in the following transcript(s): HUMPKM2L_T27 (SEQ ID NO:2986) and HUMPKM2L_T65 (SEQ ID NO:2988). Table 2861 below describes the starting and ending position of this segment on each transcript.

TABLE 2861

| Transcript name | Segment location on transcripts | |
|---|---|---|
| | Segment starting position | Segment ending position |
| HUMPKM2L_T27 (SEQ ID NO: 2986) | 397 | 465 |
| HUMPKM2L_T65 (SEQ ID NO: 2988) | 397 | 465 |

This segment can be found in a non-coding region of transcript(s) that are related to the following protein(s): HUMPKM2L_P10 and HUMPKM2L_P37.

Segment cluster HUMPKM2L_node_10 (SEQ ID NO:2997) according to the present invention is supported by 5 libraries. The number of libraries was determined as previously described. This segment can be found in the following transcript(s): HUMPKM2L_T6 (SEQ ID NO:2984). Table 2862 below describes the starting and ending position of this segment on each transcript.

TABLE 2862

| Transcript name | Segment location on transcripts | |
|---|---|---|
| | Segment starting position | Segment ending position |
| HUMPKM2L_T6 (SEQ ID NO: 2984) | 1 | 103 |

This segment can be found in a non-coding region of transcript(s) that are related to the following protein(s): HUMPKM2L_P4.

Segment cluster HUMPKM2L_node_14 (SEQ ID NO:2998) according to the present invention is supported by 2 libraries. The number of libraries was determined as previously described. This segment can be found in the following transcript(s): HUMPKM2L_T9 (SEQ ID NO:2985). Table 2863 below describes the starting and ending position of this segment on each transcript.

TABLE 2863

| Transcript name | Segment location on transcripts | |
|---|---|---|
| | Segment starting position | Segment ending position |
| HUMPKM2L_T9 (SEQ ID NO: 2985) | 1 | 108 |

This segment can be found in the following protein(s): HUMPKM2L_P6.

Segment cluster HUMPKM2L_node_16 (SEQ ID NO:2999) according to the present invention is supported by 5 libraries. The number of libraries was determined as previously described. This segment can be found in the following transcript(s): HUMPKM2L_T6 (SEQ ID NO:2984). Table 2864 below describes the starting and ending position of this segment on each transcript.

TABLE 2864

| Transcript name | Segment location on transcripts | |
|---|---|---|
| | Segment starting position | Segment ending position |
| HUMPKM2L_T6 (SEQ ID NO: 2984) | 1074 | 1190 |

This segment can be found in the following protein(s): HUMPKM2L_P4.

Segment cluster HUMPKM2L_node_19 (SEQ ID NO:3000) according to the present invention is supported by 215 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2865 below describes the starting and ending position of this segment on each transcript.

TABLE 2865

| Transcript name | Segment location on transcripts | |
|---|---|---|
| | Segment starting position | Segment ending position |
| HUMPKM2L_T6 (SEQ ID NO: 2984) | 1191 | 1235 |
| HUMPKM2L_T9 (SEQ ID NO: 2985) | 109 | 153 |
| HUMPKM2L_T27 (SEQ ID NO: 2986) | 466 | 510 |
| HUMPKM2L_T65 (SEQ ID NO: 2988) | 466 | 510 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_20 (SEQ ID NO:3001) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2866 below describes the starting and ending position of this segment on each transcript.

TABLE 2866

Segment location on transcripts

| Transcript name | Segment starting position | Segment ending position |
|---|---|---|
| HUMPKM2L_T6 (SEQ ID NO: 2984) | 1236 | 1251 |
| HUMPKM2L_T9 (SEQ ID NO: 2985) | 154 | 169 |
| HUMPKM2L_T27 (SEQ ID NO: 2986) | 511 | 526 |
| HUMPKM2L_T65 (SEQ ID NO: 2988) | 511 | 526 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_21 (SEQ ID NO:3002) according to the present invention is supported by 227 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2867 below describes the starting and ending position of this segment on each transcript.

TABLE 2867

Segment location on transcripts

| Transcript name | Segment starting position | Segment ending position |
|---|---|---|
| HUMPKM2L_T6 (SEQ ID NO: 2984) | 1252 | 1290 |
| HUMPKM2L_T9 (SEQ ID NO: 2985) | 170 | 208 |
| HUMPKM2L_T27 (SEQ ID NO: 2986) | 527 | 565 |
| HUMPKM2L_T65 (SEQ ID NO: 2988) | 527 | 565 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_22 (SEQ ID NO:3003) according to the present invention is supported by 232 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2868 below describes the starting and ending position of this segment on each transcript.

TABLE 2868

Segment location on transcripts

| Transcript name | Segment starting position | Segment ending position |
|---|---|---|
| HUMPKM2L_T6 (SEQ ID NO: 2984) | 1291 | 1318 |
| HUMPKM2L_T9 (SEQ ID NO: 2985) | 209 | 236 |
| HUMPKM2L_T27 (SEQ ID NO: 2986) | 566 | 593 |
| HUMPKM2L_T65 (SEQ ID NO: 2988) | 566 | 593 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_23 (SEQ ID NO:3004) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2869 below describes the starting and ending position of this segment on each transcript.

TABLE 2869

Segment location on transcripts

| Transcript name | Segment starting position | Segment ending position |
|---|---|---|
| HUMPKM2L_T6 (SEQ ID NO: 2984) | 1319 | 1322 |
| HUMPKM2L_T9 (SEQ ID NO: 2985) | 237 | 240 |
| HUMPKM2L_T27 (SEQ ID NO: 2986) | 594 | 597 |
| HUMPKM2L_T65 (SEQ ID NO: 2988) | 594 | 597 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_24 (SEQ ID NO:3005) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2870 below describes the starting and ending position of this segment on each transcript.

TABLE 2870

Segment location on transcripts

| Transcript name | Segment starting position | Segment ending position |
|---|---|---|
| HUMPKM2L_T6 (SEQ ID NO: 2984) | 1323 | 1337 |
| HUMPKM2L_T9 (SEQ ID NO: 2985) | 241 | 255 |
| HUMPKM2L_T27 (SEQ ID NO: 2986) | 598 | 612 |
| HUMPKM2L_T65 (SEQ ID NO: 2988) | 598 | 612 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_25 (SEQ ID NO:3006) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2871 below describes the starting and ending position of this segment on each transcript.

TABLE 2871

Segment location on transcripts

| Transcript name | Segment starting position | Segment ending position |
|---|---|---|
| HUMPKM2L_T6 (SEQ ID NO: 2984) | 1338 | 1357 |
| HUMPKM2L_T9 (SEQ ID NO: 2985) | 256 | 275 |
| HUMPKM2L_T27 (SEQ ID NO: 2986) | 613 | 632 |
| HUMPKM2L_T65 (SEQ ID NO: 2988) | 613 | 632 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_29 (SEQ ID NO:3007) according to the present invention is supported by 215 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2872 below describes the starting and ending position of this segment on each transcript.

TABLE 2872

Segment location on transcripts

| Transcript name | Segment starting position | Segment ending position |
|---|---|---|
| HUMPKM2L_T6 (SEQ ID NO: 2984) | 1358 | 1383 |
| HUMPKM2L_T9 (SEQ ID NO: 2985) | 276 | 301 |
| HUMPKM2L_T27 (SEQ ID NO: 2986) | 633 | 658 |
| HUMPKM2L_T65 (SEQ ID NO: 2988) | 633 | 658 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_30 (SEQ ID NO:3008) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2873 below describes the starting and ending position of this segment on each transcript.

TABLE 2873

Segment location on transcripts

| Transcript name | Segment starting position | Segment ending position |
|---|---|---|
| HUMPKM2L_T6 (SEQ ID NO: 2984) | 1384 | 1404 |
| HUMPKM2L_T9 (SEQ ID NO: 2985) | 302 | 322 |
| HUMPKM2L_T27 (SEQ ID NO: 2986) | 659 | 679 |
| HUMPKM2L_T65 (SEQ ID NO: 2988) | 659 | 679 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_31 (SEQ ID NO:3009) according to the present invention is supported by 248 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2874 below describes the starting and ending position of this segment on each transcript.

TABLE 2874

Segment location on transcripts

| Transcript name | Segment starting position | Segment ending position |
|---|---|---|
| HUMPKM2L_T6 (SEQ ID NO: 2984) | 1405 | 1449 |
| HUMPKM2L_T9 (SEQ ID NO: 2985) | 323 | 367 |
| HUMPKM2L_T27 (SEQ ID NO: 2986) | 680 | 724 |
| HUMPKM2L_T65 (SEQ ID NO: 2988) | 680 | 724 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_34 (SEQ ID NO:3010) according to the present invention is supported by 273 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2875 below describes the starting and ending position of this segment on each transcript.

TABLE 2875

Segment location on transcripts

| Transcript name | Segment starting position | Segment ending position |
|---|---|---|
| HUMPKM2L_T6 (SEQ ID NO: 2984) | 1450 | 1512 |
| HUMPKM2L_T9 (SEQ ID NO: 2985) | 368 | 430 |
| HUMPKM2L_T27 (SEQ ID NO: 2986) | 725 | 787 |
| HUMPKM2L_T65 (SEQ ID NO: 2988) | 725 | 787 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_35 (SEQ ID NO:3011) according to the present invention is supported by 280 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2876 below describes the starting and ending position of this segment on each transcript.

TABLE 2876

Segment location on transcripts

| Transcript name | Segment starting position | Segment ending position |
|---|---|---|
| HUMPKM2L_T6 (SEQ ID NO: 2984) | 1513 | 1552 |
| HUMPKM2L_T9 (SEQ ID NO: 2985) | 431 | 470 |
| HUMPKM2L_T27 (SEQ ID NO: 2986) | 788 | 827 |
| HUMPKM2L_T65 (SEQ ID NO: 2988) | 788 | 827 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_36 (SEQ ID NO:3012) according to the present invention is supported by 281 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2877 below describes the starting and ending position of this segment on each transcript.

TABLE 2877

Segment location on transcripts

| Transcript name | Segment starting position | Segment ending position |
|---|---|---|
| HUMPKM2L_T6 (SEQ ID NO: 2984) | 1553 | 1581 |
| HUMPKM2L_T9 (SEQ ID NO: 2985) | 471 | 499 |
| HUMPKM2L_T27 (SEQ ID NO: 2986) | 828 | 856 |
| HUMPKM2L_T65 (SEQ ID NO: 2988) | 828 | 856 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_37 (SEQ ID NO:3013) according to the present invention can be found in the following transcript(s): HUMPKM2L_T27 (SEQ ID NO:2986). Table 2878 below describes the starting and ending position of this segment on each transcript.

TABLE 2878

Segment location on transcripts

| Transcript name | Segment starting position | Segment ending position |
|---|---|---|
| HUMPKM2L_T27 (SEQ ID NO: 2986) | 857 | 865 |

This segment can be found in a non-coding region of transcript(s) that are related to the following protein(s): HUMPKM2L_P10.

Segment cluster HUMPKM2L_node_39 (SEQ ID NO:3014) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2879 below describes the starting and ending position of this segment on each transcript.

TABLE 2879

| Segment location on transcripts | | |
|---|---|---|
| Transcript name | Segment starting position | Segment ending position |
| HUMPKM2L_T6 (SEQ ID NO: 2984) | 1582 | 1596 |
| HUMPKM2L_T9 (SEQ ID NO: 2985) | 500 | 514 |
| HUMPKM2L_T27 (SEQ ID NO: 2986) | 1344 | 1358 |
| HUMPKM2L_T65 (SEQ ID NO: 2988) | 857 | 871 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_40 (SEQ ID NO:3015) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2880 below describes the starting and ending position of this segment on each transcript.

TABLE 2880

| Segment location on transcripts | | |
|---|---|---|
| Transcript name | Segment starting position | Segment ending position |
| HUMPKM2L_T6 (SEQ ID NO: 2984) | 1597 | 1602 |
| HUMPKM2L_T9 (SEQ ID NO: 2985) | 515 | 520 |
| HUMPKM2L_T27 (SEQ ID NO: 2986) | 1359 | 1364 |
| HUMPKM2L_T65 (SEQ ID NO: 2988) | 872 | 877 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_41 (SEQ ID NO:3016) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2881 below describes the starting and ending position of this segment on each transcript.

TABLE 2881

| Segment location on transcripts | | |
|---|---|---|
| Transcript name | Segment starting position | Segment ending position |
| HUMPKM2L_T6 (SEQ ID NO: 2984) | 1603 | 1611 |
| HUMPKM2L_T9 (SEQ ID NO: 2985) | 521 | 529 |
| HUMPKM2L_T27 (SEQ ID NO: 2986) | 1365 | 1373 |
| HUMPKM2L_T65 (SEQ ID NO: 2988) | 878 | 886 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_42 (SEQ ID NO:3017) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2882 below describes the starting and ending position of this segment on each transcript.

TABLE 2882

| Segment location on transcripts | | |
|---|---|---|
| Transcript name | Segment starting position | Segment ending position |
| HUMPKM2L_T6 (SEQ ID NO: 2984) | 1612 | 1632 |
| HUMPKM2L_T9 (SEQ ID NO: 2985) | 530 | 550 |
| HUMPKM2L_T27 (SEQ ID NO: 2986) | 1374 | 1394 |
| HUMPKM2L_T65 (SEQ ID NO: 2988) | 887 | 907 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_43 (SEQ ID NO:3018) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2883 below describes the starting and ending position of this segment on each transcript.

TABLE 2883

Segment location on transcripts

| Transcript name | Segment starting position | Segment ending position |
|---|---|---|
| HUMPKM2L_T6 (SEQ ID NO: 2984) | 1633 | 1643 |
| HUMPKM2L_T9 (SEQ ID NO: 2985) | 551 | 561 |
| HUMPKM2L_T27 (SEQ ID NO: 2986) | 1395 | 1405 |
| HUMPKM2L_T65 (SEQ ID NO: 2988) | 908 | 918 |

This segment can be found in both coding and non-coding regions of transcript(s) as follows. The segment can be found in a non-coding region of transcript(s) that are related to the following protein(s): HUMPKM2L_P10. This segment can also be found in the following protein(s): HUMPKM2L_P4, HUMPKM2L_P6 and HUMPKM2L_P37, since it is in the coding region for the corresponding transcript.

Segment cluster HUMPKM2L_node_44 (SEQ ID NO:3019) according to the present invention is supported by 305 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2884 below describes the starting and ending position of this segment on each transcript.

TABLE 2884

Segment location on transcripts

| Transcript name | Segment starting position | Segment ending position |
|---|---|---|
| HUMPKM2L_T6 (SEQ ID NO: 2984) | 1644 | 1671 |
| HUMPKM2L_T9 (SEQ ID NO: 2985) | 562 | 589 |
| HUMPKM2L_T27 (SEQ ID NO: 2986) | 1406 | 1433 |
| HUMPKM2L_T65 (SEQ ID NO: 2988) | 919 | 946 |

This segment can be found in the following protein(s): HUMPKM2L_P4, HUMPKM2L_P6, HUMPKM2L_P10 and HUMPKM2L_P37.

Segment cluster HUMPKM2L_node_45 (SEQ ID NO:3020) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2885 below describes the starting and ending position of this segment on each transcript.

TABLE 2885

Segment location on transcripts

| Transcript name | Segment starting position | Segment ending position |
|---|---|---|
| HUMPKM2L_T6 (SEQ ID NO: 2984) | 1672 | 1682 |
| HUMPKM2L_T9 (SEQ ID NO: 2985) | 590 | 600 |
| HUMPKM2L_T27 (SEQ ID NO: 2986) | 1434 | 1444 |
| HUMPKM2L_T65 (SEQ ID NO: 2988) | 947 | 957 |

This segment can be found in the following protein(s): HUMPKM2L_P4, HUMPKM2L_P6, HUMPKM2L_P10 and HUMPKM2L_P37.

Segment cluster HUMPKM2L_node_46 (SEQ ID NO:3021) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2886 below describes the starting and ending position of this segment on each transcript.

TABLE 2886

Segment location on transcripts

| Transcript name | Segment starting position | Segment ending position |
|---|---|---|
| HUMPKM2L_T6 (SEQ ID NO: 2984) | 1683 | 1694 |
| HUMPKM2L_T9 (SEQ ID NO: 2985) | 601 | 612 |
| HUMPKM2L_T27 (SEQ ID NO: 2986) | 1445 | 1456 |
| HUMPKM2L_T65 (SEQ ID NO: 2988) | 958 | 969 |

This segment can be found in the following protein(s): HUMPKM2L_P4, HUMPKM2L_P6, HUMPKM2L_P10 and HUMPKM2L_P37.

Segment cluster HUMPKM2L_node_48 (SEQ ID NO:3022) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2887 below describes the starting and ending position of this segment on each transcript.

TABLE 2887

Segment location on transcripts

| Transcript name | Segment starting position | Segment ending position |
|---|---|---|
| HUMPKM2L_T6 (SEQ ID NO: 2984) | 1695 | 1701 |
| HUMPKM2L_T9 (SEQ ID NO: 2985) | 613 | 619 |
| HUMPKM2L_T27 (SEQ ID NO: 2986) | 1457 | 1463 |
| HUMPKM2L_T65 (SEQ ID NO: 2988) | 970 | 976 |

This segment can be found in the following protein(s): HUMPKM2L_P4, HUMPKM2L_P6, HUMPKM2L_P10 and HUMPKM2L_P37.

Segment cluster HUMPKM2L_node_49 (SEQ ID NO:3023) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2888 below describes the starting and ending position of this segment on each transcript.

TABLE 2888

Segment location on transcripts

| Transcript name | Segment starting position | Segment ending position |
| --- | --- | --- |
| HUMPKM2L_T6 (SEQ ID NO: 2984) | 1702 | 1710 |
| HUMPKM2L_T9 (SEQ ID NO: 2985) | 620 | 628 |
| HUMPKM2L_T27 (SEQ ID NO: 2986) | 1464 | 1472 |
| HUMPKM2L_T65 (SEQ ID NO: 2988) | 977 | 985 |

This segment can be found in the following protein(s): HUMPKM2L_P4, HUMPKM2L_P6, HUMPKM2L_P10 and HUMPKM2L_P37.

Segment cluster HUMPKM2L_node_50 (SEQ ID NO:3024) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2889 below describes the starting and ending position of this segment on each transcript.

TABLE 2889

Segment location on transcripts

| Transcript name | Segment starting position | Segment ending position |
| --- | --- | --- |
| HUMPKM2L_T6 (SEQ ID NO: 2984) | 1711 | 1724 |
| HUMPKM2L_T9 (SEQ ID NO: 2985) | 629 | 642 |
| HUMPKM2L_T27 (SEQ ID NO: 2986) | 1473 | 1486 |
| HUMPKM2L_T65 (SEQ ID NO: 2988) | 986 | 999 |

This segment can be found in the following protein(s): HUMPKM2L_P4, HUMPKM2L_P6, HUMPKM2L_P10 and HUMPKM2L_P37.

Segment cluster HUMPKM2L_node_51 (SEQ ID NO:3025) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2890 below describes the starting and ending position of this segment on each transcript.

TABLE 2890

Segment location on transcripts

| Transcript name | Segment starting position | Segment ending position |
| --- | --- | --- |
| HUMPKM2L_T6 (SEQ ID NO: 2984) | 1725 | 1728 |
| HUMPKM2L_T9 (SEQ ID NO: 2985) | 643 | 646 |
| HUMPKM2L_T27 (SEQ ID NO: 2986) | 1487 | 1490 |
| HUMPKM2L_T65 (SEQ ID NO: 2988) | 1000 | 1003 |

This segment can be found in the following protein(s): HUMPKM2L_P4, HUMPKM2L_P6, HUMPKM2L_P10 and HUMPKM2L_P37.

Segment cluster HUMPKM2L_node_52 (SEQ ID NO:3026) according to the present invention is supported by 295 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2891 below describes the starting and ending position of this segment on each transcript.

TABLE 2891

Segment location on transcripts

| Transcript name | Segment starting position | Segment ending position |
| --- | --- | --- |
| HUMPKM2L_T6 (SEQ ID NO: 2984) | 1729 | 1755 |
| HUMPKM2L_T9 (SEQ ID NO: 2985) | 647 | 673 |
| HUMPKM2L_T27 (SEQ ID NO: 2986) | 1491 | 1517 |
| HUMPKM2L_T65 (SEQ ID NO: 2988) | 1004 | 1030 |

This segment can be found in the following protein(s): HUMPKM2L_P4, HUMPKM2L_P6, HUMPKM2L_P10 and HUMPKM2L_P37.

Segment cluster HUMPKM2L_node_53 (SEQ ID NO:3027) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T65 (SEQ ID NO:2988). Table 2892 below describes the starting and ending position of this segment on each transcript.

TABLE 2892

Segment location on transcripts

| Transcript name | Segment starting position | Segment ending position |
| --- | --- | --- |
| HUMPKM2L_T6 (SEQ ID NO: 2984) | 1756 | 1768 |
| HUMPKM2L_T9 (SEQ ID NO: 2985) | 674 | 686 |
| HUMPKM2L_T27 (SEQ ID NO: 2986) | 1518 | 1530 |
| HUMPKM2L_T65 (SEQ ID NO: 2988) | 1031 | 1043 |

This segment can be found in the following protein(s): HUMPKM2L_P4, HUMPKM2L_P6, HUMPKM2L_P10 and HUMPKM2L_P37.

Segment cluster HUMPKM2L_node_57 (SEQ ID NO:3028) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2893 below describes the starting and ending position of this segment on each transcript.

TABLE 2893

Segment location on transcripts

| Transcript name | Segment starting position | Segment ending position |
|---|---|---|
| HUMPKM2L_T6 (SEQ ID NO: 2984) | 1769 | 1779 |
| HUMPKM2L_T9 (SEQ ID NO: 2985) | 687 | 697 |
| HUMPKM2L_T27 (SEQ ID NO: 2986) | 1531 | 1541 |
| HUMPKM2L_T41 (SEQ ID NO: 2987) | 197 | 207 |
| HUMPKM2L_T65 (SEQ ID NO: 2988) | 1044 | 1054 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_58 (SEQ ID NO:3029) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2894 below describes the starting and ending position of this segment on each transcript.

TABLE 2894

Segment location on transcripts

| Transcript name | Segment starting position | Segment ending position |
|---|---|---|
| HUMPKM2L_T6 (SEQ ID NO: 2984) | 1780 | 1794 |
| HUMPKM2L_T9 (SEQ ID NO: 2985) | 698 | 712 |
| HUMPKM2L_T27 (SEQ ID NO: 2986) | 1542 | 1556 |
| HUMPKM2L_T41 (SEQ ID NO: 2987) | 208 | 222 |
| HUMPKM2L_T65 (SEQ ID NO: 2988) | 1055 | 1069 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_59 (SEQ ID NO:3030) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2895 below describes the starting and ending position of this segment on each transcript.

TABLE 2895

Segment location on transcripts

| Transcript name | Segment starting position | Segment ending position |
|---|---|---|
| HUMPKM2L_T6 (SEQ ID NO: 2984) | 1795 | 1808 |
| HUMPKM2L_T9 (SEQ ID NO: 2985) | 713 | 726 |
| HUMPKM2L_T27 (SEQ ID NO: 2986) | 1557 | 1570 |
| HUMPKM2L_T41 (SEQ ID NO: 2987) | 223 | 236 |
| HUMPKM2L_T65 (SEQ ID NO: 2988) | 1070 | 1083 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_60 (SEQ ID NO:3031) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2896 below describes the starting and ending position of this segment on each transcript.

TABLE 2896

Segment location on transcripts

| Transcript name | Segment starting position | Segment ending position |
|---|---|---|
| HUMPKM2L_T6 (SEQ ID NO: 2984) | 1809 | 1817 |
| HUMPKM2L_T9 (SEQ ID NO: 2985) | 727 | 735 |
| HUMPKM2L_T27 (SEQ ID NO: 2986) | 1571 | 1579 |
| HUMPKM2L_T41 (SEQ ID NO: 2987) | 237 | 245 |
| HUMPKM2L_T65 (SEQ ID NO: 2988) | 1084 | 1092 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_61 (SEQ ID NO:3032) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2897 below describes the starting and ending position of this segment on each transcript.

TABLE 2897

Segment location on transcripts

| Transcript name | Segment starting position | Segment ending position |
|---|---|---|
| HUMPKM2L_T6 (SEQ ID NO: 2984) | 1818 | 1825 |
| HUMPKM2L_T9 (SEQ ID NO: 2985) | 736 | 743 |
| HUMPKM2L_T27 (SEQ ID NO: 2986) | 1580 | 1587 |
| HUMPKM2L_T41 (SEQ ID NO: 2987) | 246 | 253 |
| HUMPKM2L_T65 (SEQ ID NO: 2988) | 1093 | 1100 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_62 (SEQ ID NO:3033) according to the present invention is supported by 291 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2898 below describes the starting and ending position of this segment on each transcript.

TABLE 2898

Segment location on transcripts

| Transcript name | Segment starting position | Segment ending position |
|---|---|---|
| HUMPKM2L_T6 (SEQ ID NO: 2984) | 1826 | 1854 |
| HUMPKM2L_T9 (SEQ ID NO: 2985) | 744 | 772 |
| HUMPKM2L_T27 (SEQ ID NO: 2986) | 1588 | 1616 |
| HUMPKM2L_T41 (SEQ ID NO: 2987) | 254 | 282 |
| HUMPKM2L_T65 (SEQ ID NO: 2988) | 1101 | 1129 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_63 (SEQ ID NO:3034) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2899 below describes the starting and ending position of this segment on each transcript.

TABLE 2899

Segment location on transcripts

| Transcript name | Segment starting position | Segment ending position |
|---|---|---|
| HUMPKM2L_T6 (SEQ ID NO: 2984) | 1855 | 1858 |
| HUMPKM2L_T9 (SEQ ID NO: 2985) | 773 | 776 |
| HUMPKM2L_T27 (SEQ ID NO: 2986) | 1617 | 1620 |
| HUMPKM2L_T41 (SEQ ID NO: 2987) | 283 | 286 |
| HUMPKM2L_T65 (SEQ ID NO: 2988) | 1130 | 1133 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_64 (SEQ ID NO:3035) according to the present invention is supported by 297 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2900 below describes the starting and ending position of this segment on each transcript.

TABLE 2900

Segment location on transcripts

| Transcript name | Segment starting position | Segment ending position |
|---|---|---|
| HUMPKM2L_T6 (SEQ ID NO: 2984) | 1859 | 1908 |
| HUMPKM2L_T9 (SEQ ID NO: 2985) | 777 | 826 |
| HUMPKM2L_T27 (SEQ ID NO: 2986) | 1621 | 1670 |
| HUMPKM2L_T41 (SEQ ID NO: 2987) | 287 | 336 |
| HUMPKM2L_T65 (SEQ ID NO: 2988) | 1134 | 1183 |

This segment can be found in both coding and non-coding regions of transcript(s) as follows. The segment can be found in a non-coding region of transcript(s) that are related to the following protein(s): HUMPKM2L_P16. This segment can also be found in the following protein(s): HUMPKM2L_P4, HUMPKM2L_P6, HUMPKM2L_P10 and HUMPKM2L_P37, since it is in the coding region for the corresponding transcript.

Segment cluster HUMPKM2L_node_65 (SEQ ID NO:3036) according to the present invention is supported by 287 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2901 below describes the starting and ending position of this segment on each transcript.

TABLE 2901

Segment location on transcripts

| Transcript name | Segment starting position | Segment ending position |
|---|---|---|
| HUMPKM2L_T6 (SEQ ID NO: 2984) | 1909 | 1948 |
| HUMPKM2L_T9 (SEQ ID NO: 2985) | 827 | 866 |
| HUMPKM2L_T27 (SEQ ID NO: 2986) | 1671 | 1710 |
| HUMPKM2L_T41 (SEQ ID NO: 2987) | 337 | 376 |
| HUMPKM2L_T65 (SEQ ID NO: 2988) | 1184 | 1223 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_66 (SEQ ID NO:3037) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2902 below describes the starting and ending position of this segment on each transcript.

TABLE 2902

Segment location on transcripts

| Transcript name | Segment starting position | Segment ending position |
|---|---|---|
| HUMPKM2L_T6 (SEQ ID NO: 2984) | 1949 | 1962 |
| HUMPKM2L_T9 (SEQ ID NO: 2985) | 867 | 880 |
| HUMPKM2L_T27 (SEQ ID NO: 2986) | 1711 | 1724 |
| HUMPKM2L_T41 (SEQ ID NO: 2987) | 377 | 390 |
| HUMPKM2L_T65 (SEQ ID NO: 2988) | 1224 | 1237 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_67 (SEQ ID NO:3038) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2903 below describes the starting and ending position of this segment on each transcript.

TABLE 2903

Segment location on transcripts

| Transcript name | Segment starting position | Segment ending position |
|---|---|---|
| HUMPKM2L_T6 (SEQ ID NO: 2984) | 1963 | 1974 |
| HUMPKM2L_T9 (SEQ ID NO: 2985) | 881 | 892 |
| HUMPKM2L_T27 (SEQ ID NO: 2986) | 1725 | 1736 |
| HUMPKM2L_T41 (SEQ ID NO: 2987) | 391 | 402 |
| HUMPKM2L_T65 (SEQ ID NO: 2988) | 1238 | 1249 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_68 (SEQ ID NO:3039) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2904 below describes the starting and ending position of this segment on each transcript.

TABLE 2904

Segment location on transcripts

| Transcript name | Segment starting position | Segment ending position |
|---|---|---|
| HUMPKM2L_T6 (SEQ ID NO: 2984) | 1975 | 1986 |
| HUMPKM2L_T9 (SEQ ID NO: 2985) | 893 | 904 |
| HUMPKM2L_T27 (SEQ ID NO: 2986) | 1737 | 1748 |
| HUMPKM2L_T41 (SEQ ID NO: 2987) | 403 | 414 |
| HUMPKM2L_T65 (SEQ ID NO: 2988) | 1250 | 1261 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_69 (SEQ ID NO:3040) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2905 below describes the starting and ending position of this segment on each transcript.

TABLE 2905

Segment location on transcripts

| Transcript name | Segment starting position | Segment ending position |
|---|---|---|
| HUMPKM2L_T6 (SEQ ID NO: 2984) | 1987 | 1997 |
| HUMPKM2L_T9 (SEQ ID NO: 2985) | 905 | 915 |

TABLE 2905-continued

Segment location on transcripts

| Transcript name | Segment starting position | Segment ending position |
|---|---|---|
| HUMPKM2L_T27 (SEQ ID NO: 2986) | 1749 | 1759 |
| HUMPKM2L_T41 (SEQ ID NO: 2987) | 415 | 425 |
| HUMPKM2L_T65 (SEQ ID NO: 2988) | 1262 | 1272 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_70 (SEQ ID NO:3041) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2906 below describes the starting and ending position of this segment on each transcript.

TABLE 2906

Segment location on transcripts

| Transcript name | Segment starting position | Segment ending position |
|---|---|---|
| HUMPKM2L_T6 (SEQ ID NO: 2984) | 1998 | 2009 |
| HUMPKM2L_T9 (SEQ ID NO: 2985) | 916 | 927 |
| HUMPKM2L_T27 (SEQ ID NO: 2986) | 1760 | 1771 |
| HUMPKM2L_T41 (SEQ ID NO: 2987) | 426 | 437 |
| HUMPKM2L_T65 (SEQ ID NO: 2988) | 1273 | 1284 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_71 (SEQ ID NO:3042) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2907 below describes the starting and ending position of this segment on each transcript.

TABLE 2907

Segment location on transcripts

| Transcript name | Segment starting position | Segment ending position |
|---|---|---|
| HUMPKM2L_T6 (SEQ ID NO: 2984) | 2010 | 2018 |
| HUMPKM2L_T9 (SEQ ID NO: 2985) | 928 | 936 |
| HUMPKM2L_T27 (SEQ ID NO: 2986) | 1772 | 1780 |

TABLE 2907-continued

Segment location on transcripts

| Transcript name | Segment starting position | Segment ending position |
|---|---|---|
| HUMPKM2L_T41 (SEQ ID NO: 2987) | 438 | 446 |
| HUMPKM2L_T65 (SEQ ID NO: 2988) | 1285 | 1293 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_72 (SEQ ID NO:3043) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2908 below describes the starting and ending position of this segment on each transcript.

TABLE 2908

Segment location on transcripts

| Transcript name | Segment starting position | Segment ending position |
|---|---|---|
| HUMPKM2L_T6 (SEQ ID NO: 2984) | 2019 | 2039 |
| HUMPKM2L_T9 (SEQ ID NO: 2985) | 937 | 957 |
| HUMPKM2L_T27 (SEQ ID NO: 2986) | 1781 | 1801 |
| HUMPKM2L_T41 (SEQ ID NO: 2987) | 447 | 467 |
| HUMPKM2L_T65 (SEQ ID NO: 2988) | 1294 | 1314 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_75 (SEQ ID NO:3044) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2909 below describes the starting and ending position of this segment on each transcript.

TABLE 2909

Segment location on transcripts

| Transcript name | Segment starting position | Segment ending position |
|---|---|---|
| HUMPKM2L_T6 (SEQ ID NO: 2984) | 2040 | 2060 |
| HUMPKM2L_T9 (SEQ ID NO: 2985) | 958 | 978 |
| HUMPKM2L_T27 (SEQ ID NO: 2986) | 1802 | 1822 |
| HUMPKM2L_T41 (SEQ ID NO: 2987) | 468 | 488 |
| HUMPKM2L_T65 (SEQ ID NO: 2988) | 1315 | 1335 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_76 (SEQ ID NO:3045) according to the present invention is supported by 268 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2910 below describes the starting and ending position of this segment on each transcript.

TABLE 2910

Segment location on transcripts

| Transcript name | Segment starting position | Segment ending position |
|---|---|---|
| HUMPKM2L_T6 (SEQ ID NO: 2984) | 2061 | 2086 |
| HUMPKM2L_T9 (SEQ ID NO: 2985) | 979 | 1004 |
| HUMPKM2L_T27 (SEQ ID NO: 2986) | 1823 | 1848 |
| HUMPKM2L_T41 (SEQ ID NO: 2987) | 489 | 514 |
| HUMPKM2L_T65 (SEQ ID NO: 2988) | 1336 | 1361 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_77 (SEQ ID NO:3046) according to the present invention is supported by 306 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2911 below describes the starting and ending position of this segment on each transcript.

TABLE 2911

Segment location on transcripts

| Transcript name | Segment starting position | Segment ending position |
|---|---|---|
| HUMPKM2L_T6 (SEQ ID NO: 2984) | 2087 | 2190 |
| HUMPKM2L_T9 (SEQ ID NO: 2985) | 1005 | 1108 |
| HUMPKM2L_T27 (SEQ ID NO: 2986) | 1849 | 1952 |
| HUMPKM2L_T41 (SEQ ID NO: 2987) | 515 | 618 |
| HUMPKM2L_T65 (SEQ ID NO: 2988) | 1362 | 1465 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_80 (SEQ ID NO:3047) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2912 below describes the starting and ending position of this segment on each transcript.

TABLE 2912

Segment location on transcripts

| Transcript name | Segment starting position | Segment ending position |
|---|---|---|
| HUMPKM2L_T6 (SEQ ID NO: 2984) | 2191 | 2205 |
| HUMPKM2L_T9 (SEQ ID NO: 2985) | 1109 | 1123 |
| HUMPKM2L_T27 (SEQ ID NO: 2986) | 1953 | 1967 |
| HUMPKM2L_T41 (SEQ ID NO: 2987) | 619 | 633 |
| HUMPKM2L_T65 (SEQ ID NO: 2988) | 1466 | 1480 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_81 (SEQ ID NO:3048) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2913 below describes the starting and ending position of this segment on each transcript.

TABLE 2913

Segment location on transcripts

| Transcript name | Segment starting position | Segment ending position |
|---|---|---|
| HUMPKM2L_T6 (SEQ ID NO: 2984) | 2206 | 2211 |
| HUMPKM2L_T9 (SEQ ID NO: 2985) | 1124 | 1129 |
| HUMPKM2L_T27 (SEQ ID NO: 2986) | 1968 | 1973 |
| HUMPKM2L_T41 (SEQ ID NO: 2987) | 634 | 639 |
| HUMPKM2L_T65 (SEQ ID NO: 2988) | 1481 | 1486 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_82 (SEQ ID NO:3049) according to the present invention is supported by 308 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2914 below describes the starting and ending position of this segment on each transcript.

TABLE 2914

Segment location on transcripts

| Transcript name | Segment starting position | Segment ending position |
|---|---|---|
| HUMPKM2L_T6 (SEQ ID NO: 2984) | 2212 | 2259 |
| HUMPKM2L_T9 (SEQ ID NO: 2985) | 1130 | 1177 |

TABLE 2914-continued

Segment location on transcripts

| Transcript name | Segment starting position | Segment ending position |
|---|---|---|
| HUMPKM2L_T27 (SEQ ID NO: 2986) | 1974 | 2021 |
| HUMPKM2L_T41 (SEQ ID NO: 2987) | 640 | 687 |
| HUMPKM2L_T65 (SEQ ID NO: 2988) | 1487 | 1534 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_83 (SEQ ID NO:3050) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2915 below describes the starting and ending position of this segment on each transcript.

TABLE 2915

Segment location on transcripts

| Transcript name | Segment starting position | Segment ending position |
|---|---|---|
| HUMPKM2L_T6 (SEQ ID NO: 2984) | 2260 | 2266 |
| HUMPKM2L_T9 (SEQ ID NO: 2985) | 1178 | 1184 |
| HUMPKM2L_T27 (SEQ ID NO: 2986) | 2022 | 2028 |
| HUMPKM2L_T41 (SEQ ID NO: 2987) | 688 | 694 |
| HUMPKM2L_T65 (SEQ ID NO: 2988) | 1535 | 1541 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_84 (SEQ ID NO:3051) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2916 below describes the starting and ending position of this segment on each transcript.

TABLE 2916

Segment location on transcripts

| Transcript name | Segment starting position | Segment ending position |
|---|---|---|
| HUMPKM2L_T6 (SEQ ID NO: 2984) | 2267 | 2283 |
| HUMPKM2L_T9 (SEQ ID NO: 2985) | 1185 | 1201 |
| HUMPKM2L_T27 (SEQ ID NO: 2986) | 2029 | 2045 |
| HUMPKM2L_T41 (SEQ ID NO: 2987) | 695 | 711 |
| HUMPKM2L_T65 (SEQ ID NO: 2988) | 1542 | 1558 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_85 (SEQ ID NO:3052) according to the present invention is supported by 329 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986), HUMPKM2L_T41 (SEQ ID NO:2987) and HUMPKM2L_T65 (SEQ ID NO:2988). Table 2917 below describes the starting and ending position of this segment on each transcript.

TABLE 2917

Segment location on transcripts

| Transcript name | Segment starting position | Segment ending position |
|---|---|---|
| HUMPKM2L_T6 (SEQ ID NO: 2984) | 2284 | 2343 |
| HUMPKM2L_T9 (SEQ ID NO: 2985) | 1202 | 1261 |
| HUMPKM2L_T27 (SEQ ID NO: 2986) | 2046 | 2105 |
| HUMPKM2L_T41 (SEQ ID NO: 2987) | 712 | 771 |
| HUMPKM2L_T65 (SEQ ID NO: 2988) | 1559 | 1618 |

This segment can be found in the following protein(s): HUMPKM2L_P4, HUMPKM2L_P6, HUMPKM2L_P10, HUMPKM2L_P16 and HUMPKM2L_P37.

Segment cluster HUMPKM2L_node_93 (SEQ ID NO:3053) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2918 below describes the starting and ending position of this segment on each transcript.

TABLE 2918

Segment location on transcripts

| Transcript name | Segment starting position | Segment ending position |
|---|---|---|
| HUMPKM2L_T6 (SEQ ID NO: 2984) | 2344 | 2359 |
| HUMPKM2L_T9 (SEQ ID NO: 2985) | 1262 | 1277 |
| HUMPKM2L_T27 (SEQ ID NO: 2986) | 2106 | 2121 |
| HUMPKM2L_T41 (SEQ ID NO: 2987) | 772 | 787 |

This segment can be found in the following protein(s): HUMPKM2L_P4, HUMPKM2L_P6, HUMPKM2L_P10 and HUMPKM2L_P16.

Segment cluster HUMPKM2L_node_94 (SEQ ID NO:3054) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2919 below describes the starting and ending position of this segment on each transcript.

TABLE 2919

Segment location on transcripts

| Transcript name | Segment starting position | Segment ending position |
|---|---|---|
| HUMPKM2L_T6 (SEQ ID NO: 2984) | 2360 | 2369 |
| HUMPKM2L_T9 (SEQ ID NO: 2985) | 1278 | 1287 |
| HUMPKM2L_T27 (SEQ ID NO: 2986) | 2122 | 2131 |
| HUMPKM2L_T41 (SEQ ID NO: 2987) | 788 | 797 |

This segment can be found in the following protein(s): HUMPKM2L_P4, HUMPKM2L_P6, HUMPKM2L_P10 and HUMPKM2L_P16.

Segment cluster HUMPKM2L_node_95 (SEQ ID NO:3055) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2920 below describes the starting and ending position of this segment on each transcript.

TABLE 2920

Segment location on transcripts

| Transcript name | Segment starting position | Segment ending position |
|---|---|---|
| HUMPKM2L_T6 (SEQ ID NO: 2984) | 2370 | 2376 |
| HUMPKM2L_T9 (SEQ ID NO: 2985) | 1288 | 1294 |
| HUMPKM2L_T27 (SEQ ID NO: 2986) | 2132 | 2138 |
| HUMPKM2L_T41 (SEQ ID NO: 2987) | 798 | 804 |

This segment can be found in the following protein(s): HUMPKM2L_P4, HUMPKM2L_P6, HUMPKM2L_P10 and HUMPKM2L_P16.

Segment cluster HUMPKM2L_node_96 (SEQ ID NO:3056) according to the present invention is supported by 322 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2921 below describes the starting and ending position of this segment on each transcript.

TABLE 2921

Segment location on transcripts

| Transcript name | Segment starting position | Segment ending position |
|---|---|---|
| HUMPKM2L_T6 (SEQ ID NO: 2984) | 2377 | 2438 |
| HUMPKM2L_T9 (SEQ ID NO: 2985) | 1295 | 1356 |
| HUMPKM2L_T27 (SEQ ID NO: 2986) | 2139 | 2200 |
| HUMPKM2L_T41 (SEQ ID NO: 2987) | 805 | 866 |

This segment can be found in the following protein(s): HUMPKM2L_P4, HUMPKM2L_P6, HUMPKM2L_P10 and HUMPKM2L_P16.

Segment cluster HUMPKM2L_node_97 (SEQ ID NO:3057) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2922 below describes the starting and ending position of this segment on each transcript.

TABLE 2922

Segment location on transcripts

| Transcript name | Segment starting position | Segment ending position |
|---|---|---|
| HUMPKM2L_T6 (SEQ ID NO: 2984) | 2439 | 2446 |
| HUMPKM2L_T9 (SEQ ID NO: 2985) | 1357 | 1364 |
| HUMPKM2L_T27 (SEQ ID NO: 2986) | 2201 | 2208 |
| HUMPKM2L_T41 (SEQ ID NO: 2987) | 867 | 874 |

This segment can be found in the following protein(s): HUMPKM2L_P4, HUMPKM2L_P6, HUMPKM2L_P10 and HUMPKM2L_P16.

Segment cluster HUMPKM2L_node_98 (SEQ ID NO:3058) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2923 below describes the starting and ending position of this segment on each transcript.

TABLE 2923

Segment location on transcripts

| Transcript name | Segment starting position | Segment ending position |
|---|---|---|
| HUMPKM2L_T6 (SEQ ID NO: 2984) | 2447 | 2457 |
| HUMPKM2L_T9 (SEQ ID NO: 2985) | 1365 | 1375 |
| HUMPKM2L_T27 (SEQ ID NO: 2986) | 2209 | 2219 |
| HUMPKM2L_T41 (SEQ ID NO: 2987) | 875 | 885 |

This segment can be found in the following protein(s): HUMPKM2L_P4, HUMPKM2L_P6, HUMPKM2L_P10 and HUMPKM2L_P16.

Segment cluster HUMPKM2L_node_99 (SEQ ID NO:3059) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2924 below describes the starting and ending position of this segment on each transcript.

TABLE 2924

Segment location on transcripts

| Transcript name | Segment starting position | Segment ending position |
|---|---|---|
| HUMPKM2L_T6 (SEQ ID NO: 2984) | 2458 | 2471 |
| HUMPKM2L_T9 (SEQ ID NO: 2985) | 1376 | 1389 |
| HUMPKM2L_T27 (SEQ ID NO: 2986) | 2220 | 2233 |
| HUMPKM2L_T41 (SEQ ID NO: 2987) | 886 | 899 |

This segment can be found in the following protein(s): HUMPKM2L_P4, HUMPKM2L_P6, HUMPKM2L_P10 and HUMPKM2L_P16.

Segment cluster HUMPKM2L_node_100 (SEQ ID NO:3060) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2925 below describes the starting and ending position of this segment on each transcript.

TABLE 2925

Segment location on transcripts

| Transcript name | Segment starting position | Segment ending position |
|---|---|---|
| HUMPKM2L_T6 (SEQ ID NO: 2984) | 2472 | 2476 |
| HUMPKM2L_T9 (SEQ ID NO: 2985) | 1390 | 1394 |
| HUMPKM2L_T27 (SEQ ID NO: 2986) | 2234 | 2238 |
| HUMPKM2L_T41 (SEQ ID NO: 2987) | 900 | 904 |

This segment can be found in the following protein(s): HUMPKM2L_P4, HUMPKM2L_P6, HUMPKM2L_P10 and HUMPKM2L_P16.

Segment cluster HUMPKM2L_node_101 (SEQ ID NO:3061) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2926 below describes the starting and ending position of this segment on each transcript.

TABLE 2926

Segment location on transcripts

| Transcript name | Segment starting position | Segment ending position |
|---|---|---|
| HUMPKM2L_T6 (SEQ ID NO: 2984) | 2477 | 2488 |
| HUMPKM2L_T9 (SEQ ID NO: 2985) | 1395 | 1406 |
| HUMPKM2L_T27 (SEQ ID NO: 2986) | 2239 | 2250 |
| HUMPKM2L_T41 (SEQ ID NO: 2987) | 905 | 916 |

This segment can be found in the following protein(s): HUMPKM2L_P4, HUMPKM2L_P6, HUMPKM2L_P10 and HUMPKM2L_P16.

Segment cluster HUMPKM2L_node_102 (SEQ ID NO:3062) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2927 below describes the starting and ending position of this segment on each transcript.

TABLE 2927

Segment location on transcripts

| Transcript name | Segment starting position | Segment ending position |
|---|---|---|
| HUMPKM2L_T6 (SEQ ID NO: 2984) | 2489 | 2503 |
| HUMPKM2L_T9 (SEQ ID NO: 2985) | 1407 | 1421 |
| HUMPKM2L_T27 (SEQ ID NO: 2986) | 2251 | 2265 |
| HUMPKM2L_T41 (SEQ ID NO: 2987) | 917 | 931 |

This segment can be found in the following protein(s): HUMPKM2L_P4, HUMPKM2L_P6, HUMPKM2L_P10 and HUMPKM2L_P16.

Segment cluster HUMPKM2L_node_103 (SEQ ID NO:3063) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2928 below describes the starting and ending position of this segment on each transcript.

TABLE 2928

Segment location on transcripts

| Transcript name | Segment starting position | Segment ending position |
|---|---|---|
| HUMPKM2L_T6 (SEQ ID NO: 2984) | 2504 | 2510 |
| HUMPKM2L_T9 (SEQ ID NO: 2985) | 1422 | 1428 |
| HUMPKM2L_T27 (SEQ ID NO: 2986) | 2266 | 2272 |
| HUMPKM2L_T41 (SEQ ID NO: 2987) | 932 | 938 |

This segment can be found in the following protein(s): HUMPKM2L_P4, HUMPKM2L_P6, HUMPKM2L_P10 and HUMPKM2L_P16.

Segment cluster HUMPKM2L_node_106 (SEQ ID NO:3064) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2929 below describes the starting and ending position of this segment on each transcript.

TABLE 2929

Segment location on transcripts

| Transcript name | Segment starting position | Segment ending position |
|---|---|---|
| HUMPKM2L_T6 (SEQ ID NO: 2984) | 2511 | 2523 |
| HUMPKM2L_T9 (SEQ ID NO: 2985) | 1429 | 1441 |

TABLE 2929-continued

Segment location on transcripts

| Transcript name | Segment starting position | Segment ending position |
|---|---|---|
| HUMPKM2L_T27 (SEQ ID NO: 2986) | 2273 | 2285 |
| HUMPKM2L_T41 (SEQ ID NO: 2987) | 939 | 951 |

This segment can be found in the following protein(s): HUMPKM2L_P4, HUMPKM2L_P6, HUMPKM2L_P0 and HUMPKM2L_P16.

Segment cluster HUMPKM2L_node__107 (SEQ ID NO:3065) according to the present invention is supported by 384 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2930 below describes the starting and ending position of this segment on each transcript.

TABLE 2930

Segment location on transcripts

| Transcript name | Segment starting position | Segment ending position |
|---|---|---|
| HUMPKM2L_T6 (SEQ ID NO: 2984) | 2524 | 2553 |
| HUMPKM2L_T9 (SEQ ID NO: 2985) | 1442 | 1471 |
| HUMPKM2L_T27 (SEQ ID NO: 2986) | 2286 | 2315 |
| HUMPKM2L_T41 (SEQ ID NO: 2987) | 952 | 981 |

This segment can be found in the following protein(s): HUMPKM2L_P4, HUMPKM2L_P6, HUMPKM2L_P10 and HUMPKM2L_P16.

Segment cluster HUMPKM2L_node__108 (SEQ ID NO:3066) according to the present invention is supported by 384 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2931 below describes the starting and ending position of this segment on each transcript.

TABLE 2931

Segment location on transcripts

| Transcript name | Segment starting position | Segment ending position |
|---|---|---|
| HUMPKM2L_T6 (SEQ ID NO: 2984) | 2554 | 2595 |
| HUMPKM2L_T9 (SEQ ID NO: 2985) | 1472 | 1513 |
| HUMPKM2L_T27 (SEQ ID NO: 2986) | 2316 | 2357 |
| HUMPKM2L_T41 (SEQ ID NO: 2987) | 982 | 1023 |

This segment can be found in the following protein(s): HUMPKM2L_P4, HUMPKM2L_P6, HUMPKM2L_P10 and HUMPKM2L_P16.

Segment cluster HUMPKM2L_node__109 (SEQ ID NO:3067) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2932 below describes the starting and ending position of this segment on each transcript.

TABLE 2932

Segment location on transcripts

| Transcript name | Segment starting position | Segment ending position |
|---|---|---|
| HUMPKM2L_T6 (SEQ ID NO: 2984) | 2596 | 2606 |
| HUMPKM2L_T9 (SEQ ID NO: 2985) | 1514 | 1524 |
| HUMPKM2L_T27 (SEQ ID NO: 2986) | 2358 | 2368 |
| HUMPKM2L_T41 (SEQ ID NO: 2987) | 1024 | 1034 |

This segment can be found in the following protein(s): HUMPKM2L_P4, HUMPKM2L_P6, HUMPKM2L_P10 and HUMPKM2L_P16.

Segment cluster HUMPKM2L_node__110 (SEQ ID NO:3068) according to the present invention is supported by 382 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2933 below describes the starting and ending position of this segment on each transcript.

TABLE 2933

Segment location on transcripts

| Transcript name | Segment starting position | Segment ending position |
|---|---|---|
| HUMPKM2L_T6 (SEQ ID NO: 2984) | 2607 | 2692 |
| HUMPKM2L_T9 (SEQ ID NO: 2985) | 1525 | 1610 |
| HUMPKM2L_T27 (SEQ ID NO: 2986) | 2369 | 2454 |
| HUMPKM2L_T41 (SEQ ID NO: 2987) | 1035 | 1120 |

This segment can be found in the following protein(s): HUMPKM2L_P4, HUMPKM2L_P6, HUMPKM2L_P10 and HUMPKM2L_P16.

Segment cluster HUMPKM2L_node__112 (SEQ ID NO:3069) according to the present invention is supported by 311 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2934 below describes the starting and ending position of this segment on each transcript.

TABLE 2934

Segment location on transcripts

| Transcript name | Segment starting position | Segment ending position |
|---|---|---|
| HUMPKM2L_T6 (SEQ ID NO: 2984) | 2693 | 2752 |
| HUMPKM2L_T9 (SEQ ID NO: 2985) | 1611 | 1670 |
| HUMPKM2L_T27 (SEQ ID NO: 2986) | 2455 | 2514 |
| HUMPKM2L_T41 (SEQ ID NO: 2987) | 1121 | 1180 |

This segment can be found in the following protein(s): HUMPKM2L_P4, HUMPKM2L_P6, HUMPKM2L_P10 and HUMPKM2L_P16.

Segment cluster HUMPKM2L_node_113 (SEQ ID NO:3070) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2935 below describes the starting and ending position of this segment on each transcript.

TABLE 2935

Segment location on transcripts

| Transcript name | Segment starting position | Segment ending position |
|---|---|---|
| HUMPKM2L_T6 (SEQ ID NO: 2984) | 2753 | 2759 |
| HUMPKM2L_T9 (SEQ ID NO: 2985) | 1671 | 1677 |
| HUMPKM2L_T27 (SEQ ID NO: 2986) | 2515 | 2521 |
| HUMPKM2L_T41 (SEQ ID NO: 2987) | 1181 | 1187 |

This segment can be found in the following protein(s): HUMPKM2L_P4, HUMPKM2L_P6, HUMPKM2L_P10 and HUMPKM2L_P16.

Segment cluster HUMPKM2L_node_114 (SEQ ID NO:3071) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2936 below describes the starting and ending position of this segment on each transcript.

TABLE 2936

Segment location on transcripts

| Transcript name | Segment starting position | Segment ending position |
|---|---|---|
| HUMPKM2L_T6 (SEQ ID NO: 2984) | 2760 | 2772 |
| HUMPKM2L_T9 (SEQ ID NO: 2985) | 1678 | 1690 |
| HUMPKM2L_T27 (SEQ ID NO: 2986) | 2522 | 2534 |
| HUMPKM2L_T41 (SEQ ID NO: 2987) | 1188 | 1200 |

This segment can be found in the following protein(s): HUMPKM2L_P4, HUMPKM2L_P6, HUMPKM2L_P10 and HUMPKM2L_P16.

Segment cluster HUMPKM2L_node_115 (SEQ ID NO:3072) according to the present invention is supported by 306 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2937 below describes the starting and ending position of this segment on each transcript.

TABLE 2937

Segment location on transcripts

| Transcript name | Segment starting position | Segment ending position |
|---|---|---|
| HUMPKM2L_T6 (SEQ ID NO: 2984) | 2773 | 2838 |
| HUMPKM2L_T9 (SEQ ID NO: 2985) | 1691 | 1756 |
| HUMPKM2L_T27 (SEQ ID NO: 2986) | 2535 | 2600 |
| HUMPKM2L_T41 (SEQ ID NO: 2987) | 1201 | 1266 |

This segment can be found in the following protein(s): HUMPKM2L_P4, HUMPKM2L_P6, HUMPKM2L_P10 and HUMPKM2L_P16.

Segment cluster HUMPKM2L_node_116 (SEQ ID NO:3073) according to the present invention is supported by 281 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2938 below describes the starting and ending position of this segment on each transcript.

TABLE 2938

Segment location on transcripts

| Transcript name | Segment starting position | Segment ending position |
|---|---|---|
| HUMPKM2L_T6 (SEQ ID NO: 2984) | 2839 | 2865 |
| HUMPKM2L_T9 (SEQ ID NO: 2985) | 1757 | 1783 |
| HUMPKM2L_T27 (SEQ ID NO: 2986) | 2601 | 2627 |
| HUMPKM2L_T41 (SEQ ID NO: 2987) | 1267 | 1293 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_117 (SEQ ID NO:3074) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2939 below describes the starting and ending position of this segment on each transcript.

TABLE 2939

Segment location on transcripts

| Transcript name | Segment starting position | Segment ending position |
|---|---|---|
| HUMPKM2L_T6 (SEQ ID NO: 2984) | 2866 | 2870 |
| HUMPKM2L_T9 (SEQ ID NO: 2985) | 1784 | 1788 |
| HUMPKM2L_T27 (SEQ ID NO: 2986) | 2628 | 2632 |
| HUMPKM2L_T41 (SEQ ID NO: 2987) | 1294 | 1298 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_118 (SEQ ID NO:3075) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2940 below describes the starting and ending position of this segment on each transcript.

TABLE 2940

Segment location on transcripts

| Transcript name | Segment starting position | Segment ending position |
|---|---|---|
| HUMPKM2L_T6 (SEQ ID NO: 2984) | 2871 | 2885 |
| HUMPKM2L_T9 (SEQ ID NO: 2985) | 1789 | 1803 |
| HUMPKM2L_T27 (SEQ ID NO: 2986) | 2633 | 2647 |
| HUMPKM2L_T41 (SEQ ID NO: 2987) | 1299 | 1313 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_119 (SEQ ID NO:3076) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2941 below describes the starting and ending position of this segment on each transcript.

TABLE 2941

Segment location on transcripts

| Transcript name | Segment starting position | Segment ending position |
|---|---|---|
| HUMPKM2L_T6 (SEQ ID NO: 2984) | 2886 | 2910 |
| HUMPKM2L_T9 (SEQ ID NO: 2985) | 1804 | 1828 |
| HUMPKM2L_T27 (SEQ ID NO: 2986) | 2648 | 2672 |
| HUMPKM2L_T41 (SEQ ID NO: 2987) | 1314 | 1338 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_120 (SEQ ID NO:3077) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2942 below describes the starting and ending position of this segment on each transcript.

TABLE 2942

Segment location on transcripts

| Transcript name | Segment starting position | Segment ending position |
|---|---|---|
| HUMPKM2L_T6 (SEQ ID NO: 2984) | 2911 | 2923 |
| HUMPKM2L_T9 (SEQ ID NO: 2985) | 1829 | 1841 |
| HUMPKM2L_T27 (SEQ ID NO: 2986) | 2673 | 2685 |
| HUMPKM2L_T41 (SEQ ID NO: 2987) | 1339 | 1351 |

This segment can be found in a non-coding region of transcript(s) that are related to the following protein(s): HUMPKM2L_P4, HUMPKM2L_P6, HUMPKM2L_P0 and HUMPKM2L_P16.

Segment cluster HUMPKM2L_node_121 (SEQ ID NO:3078) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2943 below describes the starting and ending position of this segment on each transcript.

TABLE 2943

Segment location on transcripts

| Transcript name | Segment starting position | Segment ending position |
|---|---|---|
| HUMPKM2L_T6 (SEQ ID NO: 2984) | 2924 | 2931 |
| HUMPKM2L_T9 (SEQ ID NO: 2985) | 1842 | 1849 |
| HUMPKM2L_T27 (SEQ ID NO: 2986) | 2686 | 2693 |
| HUMPKM2L_T41 (SEQ ID NO: 2987) | 1352 | 1359 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_122 (SEQ ID NO:3079) according to the present invention is supported by 303 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2944 below describes the starting and ending position of this segment on each transcript.

TABLE 2944

Segment location on transcripts

| Transcript name | Segment starting position | Segment ending position |
|---|---|---|
| HUMPKM2L_T6 (SEQ ID NO: 2984) | 2932 | 2972 |
| HUMPKM2L_T9 (SEQ ID NO: 2985) | 1850 | 1890 |
| HUMPKM2L_T27 (SEQ ID NO: 2986) | 2694 | 2734 |
| HUMPKM2L_T41 (SEQ ID NO: 2987) | 1360 | 1400 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_123 (SEQ ID NO:3080) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2945 below describes the starting and ending position of this segment on each transcript.

TABLE 2945

Segment location on transcripts

| Transcript name | Segment starting position | Segment ending position |
|---|---|---|
| HUMPKM2L_T6 (SEQ ID NO: 2984) | 2973 | 2976 |
| HUMPKM2L_T9 (SEQ ID NO: 2985) | 1891 | 1894 |
| HUMPKM2L_T27 (SEQ ID NO: 2986) | 2735 | 2738 |
| HUMPKM2L_T41 (SEQ ID NO: 2987) | 1401 | 1404 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_124 (SEQ ID NO:3081) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2946 below describes the starting and ending position of this segment on each transcript.

TABLE 2946

Segment location on transcripts

| Transcript name | Segment starting position | Segment ending position |
|---|---|---|
| HUMPKM2L_T6 (SEQ ID NO: 2984) | 2977 | 2984 |
| HUMPKM2L_T9 (SEQ ID NO: 2985) | 1895 | 1902 |
| HUMPKM2L_T27 (SEQ ID NO: 2986) | 2739 | 2746 |
| HUMPKM2L_T41 (SEQ ID NO: 2987) | 1405 | 1412 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_125 (SEQ ID NO:3082) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2947 below describes the starting and ending position of this segment on each transcript.

TABLE 2947

Segment location on transcripts

| Transcript name | Segment starting position | Segment ending position |
|---|---|---|
| HUMPKM2L_T6 (SEQ ID NO: 2984) | 2985 | 3004 |
| HUMPKM2L_T9 (SEQ ID NO: 2985) | 1903 | 1922 |
| HUMPKM2L_T27 (SEQ ID NO: 2986) | 2747 | 2766 |
| HUMPKM2L_T41 (SEQ ID NO: 2987) | 1413 | 1432 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_126 (SEQ ID NO:3083) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2948 below describes the starting and ending position of this segment on each transcript.

TABLE 2948

Segment location on transcripts

| Transcript name | Segment starting position | Segment ending position |
|---|---|---|
| HUMPKM2L_T6 (SEQ ID NO: 2984) | 3005 | 3017 |
| HUMPKM2L_T9 (SEQ ID NO: 2985) | 1923 | 1935 |
| HUMPKM2L_T27 (SEQ ID NO: 2986) | 2767 | 2779 |
| HUMPKM2L_T41 (SEQ ID NO: 2987) | 1433 | 1445 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_127 (SEQ ID NO:3084) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2949 below describes the starting and ending position of this segment on each transcript.

TABLE 2949

Segment location on transcripts

| Transcript name | Segment starting position | Segment ending position |
|---|---|---|
| HUMPKM2L_T6 (SEQ ID NO: 2984) | 3018 | 3026 |
| HUMPKM2L_T9 (SEQ ID NO: 2985) | 1936 | 1944 |
| HUMPKM2L_T27 (SEQ ID NO: 2986) | 2780 | 2788 |
| HUMPKM2L_T41 (SEQ ID NO: 2987) | 1446 | 1454 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_128 (SEQ ID NO:3085) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2950 below describes the starting and ending position of this segment on each transcript.

TABLE 2950

Segment location on transcripts

| Transcript name | Segment starting position | Segment ending position |
|---|---|---|
| HUMPKM2L_T6 (SEQ ID NO: 2984) | 3027 | 3042 |
| HUMPKM2L_T9 (SEQ ID NO: 2985) | 1945 | 1960 |
| HUMPKM2L_T27 (SEQ ID NO: 2986) | 2789 | 2804 |
| HUMPKM2L_T41 (SEQ ID NO: 2987) | 1455 | 1470 |

This segment can be found in a non-coding region of transcript(s) that are related to the following protein(s): HUMPKM2L_P4, HUMPKM2L_P6, HUMPKM2L_P0 and HUMPKM2L_P16.

Segment cluster HUMPKM2L_node_129 (SEQ ID NO:3086) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2951 below describes the starting and ending position of this segment on each transcript.

TABLE 2951

Segment location on transcripts

| Transcript name | Segment starting position | Segment ending position |
|---|---|---|
| HUMPKM2L_T6 (SEQ ID NO: 2984) | 3043 | 3067 |
| HUMPKM2L_T9 (SEQ ID NO: 2985) | 1961 | 1985 |
| HUMPKM2L_T27 (SEQ ID NO: 2986) | 2805 | 2829 |
| HUMPKM2L_T41 (SEQ ID NO: 2987) | 1471 | 1495 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_130 (SEQ ID NO:3087) according to the present invention is supported by 296 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2952 below describes the starting and ending position of this segment on each transcript.

TABLE 2952

Segment location on transcripts

| Transcript name | Segment starting position | Segment ending position |
|---|---|---|
| HUMPKM2L_T6 (SEQ ID NO: 2984) | 3068 | 3099 |
| HUMPKM2L_T9 (SEQ ID NO: 2985) | 1986 | 2017 |
| HUMPKM2L_T27 (SEQ ID NO: 2986) | 2830 | 2861 |
| HUMPKM2L_T41 (SEQ ID NO: 2987) | 1496 | 1527 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_131 (SEQ ID NO:3088) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2953 below describes the starting and ending position of this segment on each transcript.

TABLE 2953

Segment location on transcripts

| Transcript name | Segment starting position | Segment ending position |
|---|---|---|
| HUMPKM2L_T6 (SEQ ID NO: 2984) | 3100 | 3105 |
| HUMPKM2L_T9 (SEQ ID NO: 2985) | 2018 | 2023 |
| HUMPKM2L_T27 (SEQ ID NO: 2986) | 2862 | 2867 |
| HUMPKM2L_T41 (SEQ ID NO: 2987) | 1528 | 1533 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_132 (SEQ ID NO:3089) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2954 below describes the starting and ending position of this segment on each transcript.

TABLE 2954

Segment location on transcripts

| Transcript name | Segment starting position | Segment ending position |
|---|---|---|
| HUMPKM2L_T6 (SEQ ID NO: 2984) | 3106 | 3116 |
| HUMPKM2L_T9 (SEQ ID NO: 2985) | 2024 | 2034 |
| HUMPKM2L_T27 (SEQ ID NO: 2986) | 2868 | 2878 |
| HUMPKM2L_T41 (SEQ ID NO: 2987) | 1534 | 1544 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_133 (SEQ ID NO:3090) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2955 below describes the starting and ending position of this segment on each transcript.

TABLE 2955

Segment location on transcripts

| Transcript name | Segment starting position | Segment ending position |
|---|---|---|
| HUMPKM2L_T6 (SEQ ID NO: 2984) | 3117 | 3122 |
| HUMPKM2L_T9 (SEQ ID NO: 2985) | 2035 | 2040 |
| HUMPKM2L_T27 (SEQ ID NO: 2986) | 2879 | 2884 |
| HUMPKM2L_T41 (SEQ ID NO: 2987) | 1545 | 1550 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_134 (SEQ ID NO:3091) according to the present invention is supported by 274 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2956 below describes the starting and ending position of this segment on each transcript.

TABLE 2956

Segment location on transcripts

| Transcript name | Segment starting position | Segment ending position |
|---|---|---|
| HUMPKM2L_T6 (SEQ ID NO: 2984) | 3123 | 3151 |
| HUMPKM2L_T9 (SEQ ID NO: 2985) | 2041 | 2069 |
| HUMPKM2L_T27 (SEQ ID NO: 2986) | 2885 | 2913 |
| HUMPKM2L_T41 (SEQ ID NO: 2987) | 1551 | 1579 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_135 (SEQ ID NO:3092) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2957 below describes the starting and ending position of this segment on each transcript.

TABLE 2957

Segment location on transcripts

| Transcript name | Segment starting position | Segment ending position |
|---|---|---|
| HUMPKM2L_T6 (SEQ ID NO: 2984) | 3152 | 3168 |
| HUMPKM2L_T9 (SEQ ID NO: 2985) | 2070 | 2086 |
| HUMPKM2L_T27 (SEQ ID NO: 2986) | 2914 | 2930 |
| HUMPKM2L_T41 (SEQ ID NO: 2987) | 1580 | 1596 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_136 (SEQ ID NO:3093) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2958 below describes the starting and ending position of this segment on each transcript.

TABLE 2958

Segment location on transcripts

| Transcript name | Segment starting position | Segment ending position |
|---|---|---|
| HUMPKM2L_T6 (SEQ ID NO: 2984) | 3169 | 3178 |
| HUMPKM2L_T9 (SEQ ID NO: 2985) | 2087 | 2096 |
| HUMPKM2L_T27 (SEQ ID NO: 2986) | 2931 | 2940 |
| HUMPKM2L_T41 (SEQ ID NO: 2987) | 1597 | 1606 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__137 (SEQ ID NO:3094) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2959 below describes the starting and ending position of this segment on each transcript.

TABLE 2959

Segment location on transcripts

| Transcript name | Segment starting position | Segment ending position |
|---|---|---|
| HUMPKM2L_T6 (SEQ ID NO: 2984) | 3179 | 3182 |
| HUMPKM2L_T9 (SEQ ID NO: 2985) | 2097 | 2100 |
| HUMPKM2L_T27 (SEQ ID NO: 2986) | 2941 | 2944 |
| HUMPKM2L_T41 (SEQ ID NO: 2987) | 1607 | 1610 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__138 (SEQ ID NO:3095) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2960 below describes the starting and ending position of this segment on each transcript.

TABLE 2960

Segment location on transcripts

| Transcript name | Segment starting position | Segment ending position |
|---|---|---|
| HUMPKM2L_T6 (SEQ ID NO: 2984) | 3183 | 3192 |
| HUMPKM2L_T9 (SEQ ID NO: 2985) | 2101 | 2110 |
| HUMPKM2L_T27 (SEQ ID NO: 2986) | 2945 | 2954 |
| HUMPKM2L_T41 (SEQ ID NO: 2987) | 1611 | 1620 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__139 (SEQ ID NO:3096) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2961 below describes the starting and ending position of this segment on each transcript.

TABLE 2961

Segment location on transcripts

| Transcript name | Segment starting position | Segment ending position |
|---|---|---|
| HUMPKM2L_T6 (SEQ ID NO: 2984) | 3193 | 3215 |
| HUMPKM2L_T9 (SEQ ID NO: 2985) | 2111 | 2133 |
| HUMPKM2L_T27 (SEQ ID NO: 2986) | 2955 | 2977 |
| HUMPKM2L_T41 (SEQ ID NO: 2987) | 1621 | 1643 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__140 (SEQ ID NO:3097) according to the present invention is supported by 230 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2962 below describes the starting and ending position of this segment on each transcript.

TABLE 2962

Segment location on transcripts

| Transcript name | Segment starting position | Segment ending position |
|---|---|---|
| HUMPKM2L_T6 (SEQ ID NO: 2984) | 3216 | 3258 |
| HUMPKM2L_T9 (SEQ ID NO: 2985) | 2134 | 2176 |
| HUMPKM2L_T27 (SEQ ID NO: 2986) | 2978 | 3020 |
| HUMPKM2L_T41 (SEQ ID NO: 2987) | 1644 | 1686 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__141 (SEQ ID NO:3098) according to the present invention is supported by 192 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2963 below describes the starting and ending position of this segment on each transcript.

TABLE 2963

Segment location on transcripts

| Transcript name | Segment starting position | Segment ending position |
|---|---|---|
| HUMPKM2L_T6 (SEQ ID NO: 2984) | 3259 | 3304 |
| HUMPKM2L_T9 (SEQ ID NO: 2985) | 2177 | 2222 |
| HUMPKM2L_T27 (SEQ ID NO: 2986) | 3021 | 3066 |

TABLE 2963-continued

Segment location on transcripts

| Transcript name | Segment starting position | Segment ending position |
|---|---|---|
| HUMPKM2L_T41 (SEQ ID NO: 2987) | 1687 | 1732 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_142 (SEQ ID NO:3099) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2964 below describes the starting and ending position of this segment on each transcript.

TABLE 2964

Segment location on transcripts

| Transcript name | Segment starting position | Segment ending position |
|---|---|---|
| HUMPKM2L_T6 (SEQ ID NO: 2984) | 3305 | 3309 |
| HUMPKM2L_T9 (SEQ ID NO: 2985) | 2223 | 2227 |
| HUMPKM2L_T27 (SEQ ID NO: 2986) | 3067 | 3071 |
| HUMPKM2L_T41 (SEQ ID NO: 2987) | 1733 | 1737 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_143 (SEQ ID NO:3100) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2965 below describes the starting and ending position of this segment on each transcript.

TABLE 2965

Segment location on transcripts

| Transcript name | Segment starting position | Segment ending position |
|---|---|---|
| HUMPKM2L_T6 (SEQ ID NO: 2984) | 3310 | 3315 |
| HUMPKM2L_T9 (SEQ ID NO: 2985) | 2228 | 2233 |
| HUMPKM2L_T27 (SEQ ID NO: 2986) | 3072 | 3077 |
| HUMPKM2L_T41 (SEQ ID NO: 2987) | 1738 | 1743 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_144 (SEQ ID NO:3101) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2966 below describes the starting and ending position of this segment on each transcript.

TABLE 2966

Segment location on transcripts

| Transcript name | Segment starting position | Segment ending position |
|---|---|---|
| HUMPKM2L_T6 (SEQ ID NO: 2984) | 3316 | 3320 |
| HUMPKM2L_T9 (SEQ ID NO: 2985) | 2234 | 2238 |
| HUMPKM2L_T27 (SEQ ID NO: 2986) | 3078 | 3082 |
| HUMPKM2L_T41 (SEQ ID NO: 2987) | 1744 | 1748 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_145 (SEQ ID NO:3102) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2967 below describes the starting and ending position of this segment on each transcript.

TABLE 2967

Segment location on transcripts

| Transcript name | Segment starting position | Segment ending position |
|---|---|---|
| HUMPKM2L_T6 (SEQ ID NO: 2984) | 3321 | 3327 |
| HUMPKM2L_T9 (SEQ ID NO: 2985) | 2239 | 2245 |
| HUMPKM2L_T27 (SEQ ID NO: 2986) | 3083 | 3089 |
| HUMPKM2L_T41 (SEQ ID NO: 2987) | 1749 | 1755 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node_146 (SEQ ID NO:3103) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2968 below describes the starting and ending position of this segment on each transcript.

TABLE 2968

Segment location on transcripts

| Transcript name | Segment starting position | Segment ending position |
|---|---|---|
| HUMPKM2L_T6 (SEQ ID NO: 2984) | 3328 | 3334 |
| HUMPKM2L_T9 (SEQ ID NO: 2985) | 2246 | 2252 |
| HUMPKM2L_T27 (SEQ ID NO: 2986) | 3090 | 3096 |
| HUMPKM2L_T41 (SEQ ID NO: 2987) | 1756 | 1762 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__147 (SEQ ID NO:3104) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2969 below describes the starting and ending position of this segment on each transcript.

TABLE 2969

Segment location on transcripts

| Transcript name | Segment starting position | Segment ending position |
|---|---|---|
| HUMPKM2L_T6 (SEQ ID NO: 2984) | 3335 | 3346 |
| HUMPKM2L_T9 (SEQ ID NO: 2985) | 2253 | 2264 |
| HUMPKM2L_T27 (SEQ ID NO: 2986) | 3097 | 3108 |
| HUMPKM2L_T41 (SEQ ID NO: 2987) | 1763 | 1774 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__148 (SEQ ID NO:3105) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2970 below describes the starting and ending position of this segment on each transcript.

TABLE 2970

Segment location on transcripts

| Transcript name | Segment starting position | Segment ending position |
|---|---|---|
| HUMPKM2L_T6 (SEQ ID NO: 2984) | 3347 | 3351 |
| HUMPKM2L_T9 (SEQ ID NO: 2985) | 2265 | 2269 |
| HUMPKM2L_T27 (SEQ ID NO: 2986) | 3109 | 3113 |
| HUMPKM2L_T41 (SEQ ID NO: 2987) | 1775 | 1779 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__149 (SEQ ID NO:3106) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2971 below describes the starting and ending position of this segment on each transcript.

TABLE 2971

Segment location on transcripts

| Transcript name | Segment starting position | Segment ending position |
|---|---|---|
| HUMPKM2L_T6 (SEQ ID NO: 2984) | 3352 | 3370 |
| HUMPKM2L_T9 (SEQ ID NO: 2985) | 2270 | 2288 |
| HUMPKM2L_T27 (SEQ ID NO: 2986) | 3114 | 3132 |
| HUMPKM2L_T41 (SEQ ID NO: 2987) | 1780 | 1798 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__150 (SEQ ID NO:3107) according to the present invention can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2972 below describes the starting and ending position of this segment on each transcript.

TABLE 2972

Segment location on transcripts

| Transcript name | Segment starting position | Segment ending position |
|---|---|---|
| HUMPKM2L_T6 (SEQ ID NO: 2984) | 3371 | 3377 |
| HUMPKM2L_T9 (SEQ ID NO: 2985) | 2289 | 2295 |
| HUMPKM2L_T27 (SEQ ID NO: 2986) | 3133 | 3139 |
| HUMPKM2L_T41 (SEQ ID NO: 2987) | 1799 | 1805 |

This segment can be found in a non-coding region of transcript(s) that are related to the following protein(s): HUMPKM2L_P4, HUMPKM2L_P6, HUMPKM2L_P10 and HUMPKM2L_P16.

Segment cluster HUMPKM2L_node__151 (SEQ ID NO:3108) according to the present invention is supported by 127 libraries. The number of libraries was determined as previously described. This segment can be found in the following transcript(s): HUMPKM2L_T6 (SEQ ID NO:2984), HUMPKM2L_T9 (SEQ ID NO:2985), HUMPKM2L_T27 (SEQ ID NO:2986) and HUMPKM2L_T41 (SEQ ID NO:2987). Table 2973 below describes the starting and ending position of this segment on each transcript.

TABLE 2973

Segment location on transcripts

| Transcript name | Segment starting position | Segment ending position |
| --- | --- | --- |
| HUMPKM2L_T6 (SEQ ID NO: 2984) | 3378 | 3421 |
| HUMPKM2L_T9 (SEQ ID NO: 2985) | 2296 | 2339 |
| HUMPKM2L_T27 (SEQ ID NO: 2986) | 3140 | 3183 |
| HUMPKM2L_T41 (SEQ ID NO: 2987) | 1806 | 1849 |

This segment can be found in a non-coding region of transcript(s) that are related to the following protein(s): HUMPKM2L_P4, HUMPKM2L_P6, HUMPKM2L_P0 and HUMPKM2L_P16.

Description for Cluster HUMPROTP

Cluster HUMPROTP features 20 transcript(s) and 33 segment(s) of interest, the names for which are given in Tables 2974 and 2975, respectively, the sequences themselves are given at the end of the application. The selected protein variants are given in Table 2976.

TABLE 2974

Transcripts of interest
Transcript Name

HUMPROTP_T0 (SEQ ID NO: 3109)
HUMPROTP_T1 (SEQ ID NO: 3110)
HUMPROTP_T2 (SEQ ID NO: 3111)
HUMPROTP_T3 (SEQ ID NO: 3112)
HUMPROTP_T4 (SEQ ID NO: 3113)
HUMPROTP_T5 (SEQ ID NO: 3114)
HUMPROTP_T6 (SEQ ID NO: 3115)
HUMPROTP_T7 (SEQ ID NO: 3116)
HUMPROTP_T8 (SEQ ID NO: 3117)
HUMPROTP_T9 (SEQ ID NO: 3118)
HUMPROTP_T10 (SEQ ID NO: 3119)
HUMPROTP_T11 (SEQ ID NO: 3120)
HUMPROTP_T12 (SEQ ID NO: 3121)
HUMPROTP_T14 (SEQ ID NO: 3122)
HUMPROTP_T15 (SEQ ID NO: 3123)
HUMPROTP_T16 (SEQ ID NO: 3124)
HUMPROTP_T17 (SEQ ID NO: 3125)
HUMPROTP_T18 (SEQ ID NO: 3126)
HUMPROTP_T19 (SEQ ID NO: 3127)
HUMPROTP_T20 (SEQ ID NO: 3128)

TABLE 2975

Segments of interest
Segment Name

HUMPROTP_node_0 (SEQ ID NO: 3129)
HUMPROTP_node_2 (SEQ ID NO: 3130)
HUMPROTP_node_5 (SEQ ID NO: 3131)
HUMPROTP_node_7 (SEQ ID NO: 3132)
HUMPROTP_node_9 (SEQ ID NO: 3133)
HUMPROTP_node_11 (SEQ ID NO: 3134)
HUMPROTP_node_14 (SEQ ID NO: 3135)
HUMPROTP_node_16 (SEQ ID NO: 3136)
HUMPROTP_node_23 (SEQ ID NO: 3137)
HUMPROTP_node_29 (SEQ ID NO: 3138)
HUMPROTP_node_31 (SEQ ID NO: 3139)
HUMPROTP_node_32 (SEQ ID NO: 3140)
HUMPROTP_node_33 (SEQ ID NO: 3141)
HUMPROTP_node_38 (SEQ ID NO: 3142)
HUMPROTP_node_46 (SEQ ID NO: 3143)
HUMPROTP_node_48 (SEQ ID NO: 3144)
HUMPROTP_node_50 (SEQ ID NO: 3145)

TABLE 2975-continued

Segments of interest
Segment Name

HUMPROTP_node_51 (SEQ ID NO: 3146)
HUMPROTP_node_12 (SEQ ID NO: 3147)
HUMPROTP_node_17 (SEQ ID NO: 3148)
HUMPROTP_node_19 (SEQ ID NO: 3149)
HUMPROTP_node_21 (SEQ ID NO: 3150)
HUMPROTP_node_25 (SEQ ID NO: 3151)
HUMPROTP_node_26 (SEQ ID NO: 3152)
HUMPROTP_node_28 (SEQ ID NO: 3153)
HUMPROTP_node_30 (SEQ ID NO: 3154)
HUMPROTP_node_34 (SEQ ID NO: 3155)
HUMPROTP_node_36 (SEQ ID NO: 3156)
HUMPROTP_node_37 (SEQ ID NO: 3157)
HUMPROTP_node_39 (SEQ ID NO: 3158)
HUMPROTP_node_41 (SEQ ID NO: 3159)
HUMPROTP_node_43 (SEQ ID NO: 3160)
HUMPROTP_node_44 (SEQ ID NO: 3161)

TABLE 2976

Proteins of interest

| Protein Name | Corresponding Transcript(s) |
| --- | --- |
| HUMPROTP_P2 | HUMPROTP_T1 (SEQ ID NO: 3110); |
| | HUMPROTP_T2 (SEQ ID NO: 3111); |
| | HUMPROTP_T3 (SEQ ID NO: 3112); |
| | HUMPROTP_T10 (SEQ ID NO: 3119); |
| | HUMPROTP_T11 (SEQ ID NO: 3120); |
| | HUMPROTP_T14 (SEQ ID NO: 3122); |
| | HUMPROTP_T16 (SEQ ID NO: 3124) |
| HUMPROTP_P3 | HUMPROTP_T4 (SEQ ID NO: 3113); |
| | HUMPROTP_T6 (SEQ ID NO: 3115); |
| | HUMPROTP_T7 (SEQ ID NO: 3116) |
| HUMPROTP_P4 | HUMPROTP_T5 (SEQ ID NO: 3114) |
| HUMPROTP_P5 | HUMPROTP_T8 (SEQ ID NO: 3117) |
| HUMPROTP_P6 | HUMPROTP_T9 (SEQ ID NO: 3118) |
| HUMPROTP_P7 | HUMPROTP_T12 (SEQ ID NO: 3121) |
| HUMPROTP_P8 | HUMPROTP_T15 (SEQ ID NO: 3123) |
| HUMPROTP_P9 | HUMPROTP_T17 (SEQ ID NO: 3125); |
| | HUMPROTP_T19 (SEQ ID NO: 3127) |
| HUMPROTP_P10 | HUMPROTP_T18 (SEQ ID NO: 3126); |
| | HUMPROTP_T20 (SEQ ID NO: 3128) |
| HUMPROTP_P11 | HUMPROTP_T0 (SEQ ID NO: 3109) |

These sequences are variants of the known protein Vacuolar ATP synthase subunit B, kidney isoform (SwissProt accession identifier VAB1_HUMAN; known also according to the synonyms EC 3.6.3.14; V-ATPase B1 subunit; Vacuolar proton pump B isoform 1; Endomembrane proton pump 58 kDa subunit), referred to herein as the previously known protein.

Protein Vacuolar ATP synthase subunit B, kidney isoform is known or believed to have the following function(s): Non-catalytic subunit of the peripheral V1 complex of vacuolar ATPase. V-ATPase is responsible for acidifying a variety of intracellular compartments in eukaryotic cells. The sequence for protein Vacuolar ATP synthase subunit B, kidney isoform is given at the end of the application, as "Vacuolar ATP synthase subunit B, kidney isoform amino acid sequence". Known polymorphisms for this sequence are as shown in Table 2977.

TABLE 2977

Amino acid mutations for Known Protein

| SNP position(s) on amino acid sequence | Comment |
|---|---|
| 81 | L -> P (in dRTA). /FTId = VAR__007866. |
| 124 | R -> W (in dRTA). /FTId = VAR__007867. |
| 174 | M -> R (in dRTA). /FTId = VAR__007868. |
| 275 | T -> P (in dRTA). /FTId = VAR__007869. |
| 316 | G -> E (in dRTA). /FTId = VAR__007870. |
| 346 | P -> R (in dRTA). /FTId = VAR__007871. |
| 364 | G -> S (in dRTA). /FTId = VAR__007872. |

Protein Vacuolar ATP synthase subunit B, kidney isoform localization is believed to be Endomembrane.

The following GO Annotation(s) apply to the previously known protein. The following annotation(s) were found: ATP biosynthesis; excretion; hearing; energy coupled proton transport, against the electrochemical gradient; proton transport, which are annotation(s) related to Biological Process; ATP-binding and phosphorylation-dependent chloride channel; ATP binding; hydrogen-exporting ATPase; hydrolase, which are annotation(s) related to Molecular Function; and cytoplasm; plasma membrane; hydrogen-transporting two-sector ATPase, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMPROTP features 33 segment(s), which were listed in Table 2975 above and for which the sequence(s) are given at the end of the application. These segment(s) are portions of nucleic acid sequence(s) which are described herein separately because they are of particular interest. A description of each segment according to the present invention is now provided.

Segment cluster HUMPROTP_node_0 (SEQ ID NO:3129) according to the present invention is supported by 22 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 2978 below describes the starting and ending position of this segment on each transcript.

TABLE 2978

| Segment location on transcripts | | |
|---|---|---|
| Transcript name | Segment starting position | Segment ending position |
| HUMPROTP_T0 (SEQ ID NO: 3109) | 1 | 214 |
| HUMPROTP_T1 (SEQ ID NO: 3110) | 1 | 214 |
| HUMPROTP_T2 (SEQ ID NO: 3111) | 1 | 214 |
| HUMPROTP_T3 (SEQ ID NO: 3112) | 1 | 214 |
| HUMPROTP_T9 (SEQ ID NO: 3118) | 1 | 214 |
| HUMPROTP_T10 (SEQ ID NO: 3119) | 1 | 214 |
| HUMPROTP_T11 (SEQ ID NO: 3120) | 1 | 214 |
| HUMPROTP_T12 (SEQ ID NO: 3121) | 1 | 214 |
| HUMPROTP_T14 (SEQ ID NO: 3122) | 1 | 214 |
| HUMPROTP_T15 (SEQ ID NO: 3123) | 1 | 214 |
| HUMPROTP_T16 (SEQ ID NO: 3124) | 1 | 214 |

This segment can be found in the following protein(s): HUMPROTP_P11, HUMPROTP_P2, HUMPROTP_P6, HUMPROTP_P7 and HUMPROTP_P8.

Segment cluster HUMPROTP_node_2 (SEQ ID NO:3130) according to the present invention is supported by 2 libraries. The number of libraries was determined as previously described. This segment can be found in the following transcript(s): HUMPROTP_T6 (SEQ ID NO:3115) and HUMPROTP_T8 (SEQ ID NO:3117). Table 2979 below describes the starting and ending position of this segment on each transcript.

TABLE 2979

| Segment location on transcripts | | |
|---|---|---|
| Transcript name | Segment starting position | Segment ending position |
| HUMPROTP_T6 (SEQ ID NO: 3115) | 1 | 267 |
| HUMPROTP_T8 (SEQ ID NO: 3117) | 1 | 267 |

This segment can be found in a non-coding region of transcript(s) that are related to the following protein(s): HUMPROTP_P3 and HUMPROTP_P5.

Segment cluster HUMPROTP_node_5 (SEQ ID NO:3131) according to the present invention is supported by 1 libraries. The number of libraries was determined as previously described. This segment can be found in the following transcript(s): HUMPROTP_T7 (SEQ ID NO:3116). Table 2980 below describes the starting and ending position of this segment on each transcript.

TABLE 2980

| Segment location on transcripts | | |
|---|---|---|
| Transcript name | Segment starting position | Segment ending position |
| HUMPROTP_T7 (SEQ ID NO: 3116) | 1 | 174 |

This segment can be found in a non-coding region of transcript(s) that are related to the following protein(s): HUMPROTP_P3.

Segment cluster HUMPROTP_node_7 (SEQ ID NO:3132) according to the present invention is supported by 1 libraries. The number of libraries was determined as previously described. This segment can be found in the following transcript(s): HUMPROTP_T6 (SEQ ID NO:3115) and HUMPROTP_T8 (SEQ ID NO:3117). Table 2981 below describes the starting and ending position of this segment on each transcript.

TABLE 2981

Segment location on transcripts

| Transcript name | Segment starting position | Segment ending position |
|---|---|---|
| HUMPROTP_T6 (SEQ ID NO: 3115) | 268 | 749 |
| HUMPROTP_T8 (SEQ ID NO: 3117) | 268 | 749 |

This segment can be found in a non-coding region of transcript(s) that are related to the following protein(s): HUMPROTP_P3 and HUMPROTP_P5.

Segment cluster HUMPROTP_node_9 (SEQ ID NO:3133) according to the present invention is supported by 2 libraries. The number of libraries was determined as previously described. This segment can be found in the following transcript(s): HUMPROTP_T6 (SEQ ID NO:3115) and HUMPROTP_T8 (SEQ ID NO:3117). Table 2982 below describes the starting and ending position of this segment on each transcript.

TABLE 2982

Segment location on transcripts

| Transcript name | Segment starting position | Segment ending position |
|---|---|---|
| HUMPROTP_T6 (SEQ ID NO: 3115) | 750 | 1784 |
| HUMPROTP_T8 (SEQ ID NO: 3117) | 750 | 1784 |

This segment can be found in a non-coding region of transcript(s) that are related to the following protein(s): HUMPROTP_P3 and HUMPROTP_P5.

Segment cluster HUMPROTP_node_11 (SEQ ID NO:3134) according to the present invention is supported by 2 libraries. The number of libraries was determined as previously described. This segment can be found in the following transcript(s): HUMPROTP_T5 (SEQ ID NO:3114). Table 2983 below describes the starting and ending position of this segment on each transcript.

TABLE 2983

Segment location on transcripts

| Transcript name | Segment starting position | Segment ending position |
|---|---|---|
| HUMPROTP_T5 (SEQ ID NO: 3114) | 1 | 287 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 2984.

TABLE 2984

Oligonucleotides related to this segment

| Oligonucleotide name | Overexpressed in cancers | Chip reference |
|---|---|---|
| HUMPROTP_0_0_18616 | lung malignant tumors | LUN |

This segment can be found in the following protein(s): HUMPROTP_P4.

Segment cluster HUMPROTP_node_14 (SEQ ID NO:3135) according to the present invention is supported by 1 libraries. The number of libraries was determined as previously described. This segment can be found in the following transcript(s): HUMPROTP_T8 (SEQ ID NO:3117). Table 2985 below describes the starting and ending position of this segment on each transcript.

TABLE 2985

Segment location on transcripts

| Transcript name | Segment starting position | Segment ending position |
|---|---|---|
| HUMPROTP_T8 (SEQ ID NO: 3117) | 1841 | 2058 |

This segment can be found in the following protein(s): HUMPROTP_P5.

Segment cluster HUMPROTP_node_16 (SEQ ID NO:3136) according to the present invention is supported by 4 libraries. The number of libraries was determined as previously described. This segment can be found in the following transcript(s): HUMPROTP_T4 (SEQ ID NO:3113). Table 2986 below describes the starting and ending position of this segment on each transcript.

TABLE 2986

Segment location on transcripts

| Transcript name | Segment starting position | Segment ending position |
|---|---|---|
| HUMPROTP_T4 (SEQ ID NO: 3113) | 1 | 920 |

This segment can be found in a non-coding region of transcript(s) that are related to the following protein(s): HUMPROTP_P3.

Segment cluster HUMPROTP_node_23 (SEQ ID NO:3137) according to the present invention is supported by 25 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 2987 below describes the starting and ending position of this segment on each transcript.

TABLE 2987

Segment location on transcripts

| Transcript name | Segment starting position | Segment ending position |
|---|---|---|
| HUMPROTP_T0 (SEQ ID NO: 3109) | 542 | 681 |
| HUMPROTP_T1 (SEQ ID NO: 3110) | 542 | 681 |

TABLE 2987-continued

Segment location on transcripts

| Transcript name | Segment starting position | Segment ending position |
|---|---|---|
| HUMPROTP_T2 (SEQ ID NO: 3111) | 542 | 681 |
| HUMPROTP_T3 (SEQ ID NO: 3112) | 542 | 681 |
| HUMPROTP_T4 (SEQ ID NO: 3113) | 1192 | 1331 |
| HUMPROTP_T5 (SEQ ID NO: 3114) | 615 | 754 |
| HUMPROTP_T6 (SEQ ID NO: 3115) | 2112 | 2251 |
| HUMPROTP_T7 (SEQ ID NO: 3116) | 502 | 641 |
| HUMPROTP_T8 (SEQ ID NO: 3117) | 2330 | 2469 |
| HUMPROTP_T9 (SEQ ID NO: 3118) | 542 | 681 |
| HUMPROTP_T10 (SEQ ID NO: 3119) | 542 | 681 |
| HUMPROTP_T11 (SEQ ID NO: 3120) | 542 | 681 |
| HUMPROTP_T12 (SEQ ID NO: 3121) | 542 | 681 |
| HUMPROTP_T14 (SEQ ID NO: 3122) | 542 | 681 |
| HUMPROTP_T15 (SEQ ID NO: 3123) | 542 | 681 |
| HUMPROTP_T16 (SEQ ID NO: 3124) | 542 | 681 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_29 (SEQ ID NO:3138) according to the present invention is supported by 9 libraries. The number of libraries was determined as previously described. This segment can be found in the following transcript(s): HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T10 (SEQ ID NO:3119), HUMPROTP_T11 (SEQ ID NO:3120), HUMPROTP_T14 (SEQ ID NO:3122) and HUMPROTP_T16 (SEQ ID NO:3124). Table 2988 below describes the starting and ending position of this segment on each transcript.

TABLE 2988

Segment location on transcripts

| Transcript name | Segment starting position | Segment ending position |
|---|---|---|
| HUMPROTP_T1 (SEQ ID NO: 3110) | 882 | 1194 |
| HUMPROTP_T2 (SEQ ID NO: 3111) | 882 | 1194 |
| HUMPROTP_T3 (SEQ ID NO: 3112) | 882 | 1194 |
| HUMPROTP_T4 (SEQ ID NO: 3113) | 1532 | 1844 |
| HUMPROTP_T5 (SEQ ID NO: 3114) | 955 | 1267 |
| HUMPROTP_T6 (SEQ ID NO: 3115) | 2452 | 2764 |
| HUMPROTP_T7 (SEQ ID NO: 3116) | 842 | 1154 |
| HUMPROTP_T10 (SEQ ID NO: 3119) | 882 | 1194 |
| HUMPROTP_T11 (SEQ ID NO: 3120) | 882 | 1194 |
| HUMPROTP_T14 (SEQ ID NO: 3122) | 882 | 1194 |
| HUMPROTP_T16 (SEQ ID NO: 3124) | 882 | 1194 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P2 and HUMPROTP_P4, since it is in the coding region for the corresponding transcript.

Segment cluster HUMPROTP_node_31 (SEQ ID NO:3139) according to the present invention is supported by 10 libraries. The number of libraries was determined as previously described. This segment can be found in the following transcript(s): HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T10 (SEQ ID NO:3119), HUMPROTP_T11 (SEQ ID NO:3120), HUMPROTP_T14 (SEQ ID NO:3122) and HUMPROTP_T16 (SEQ ID NO:3124). Table 2989 below describes the starting and ending position of this segment on each transcript.

TABLE 2989

Segment location on transcripts

| Transcript name | Segment starting position | Segment ending position |
|---|---|---|
| HUMPROTP_T1 (SEQ ID NO: 3110) | 1219 | 1664 |
| HUMPROTP_T2 (SEQ ID NO: 3111) | 1195 | 1640 |
| HUMPROTP_T3 (SEQ ID NO: 3112) | 1219 | 1664 |
| HUMPROTP_T4 (SEQ ID NO: 3113) | 1869 | 2314 |
| HUMPROTP_T5 (SEQ ID NO: 3114) | 1292 | 1737 |
| HUMPROTP_T6 (SEQ ID NO: 3115) | 2789 | 3234 |
| HUMPROTP_T7 (SEQ ID NO: 3116) | 1179 | 1624 |
| HUMPROTP_T10 (SEQ ID NO: 3119) | 1219 | 1664 |
| HUMPROTP_T11 (SEQ ID NO: 3120) | 1219 | 1664 |
| HUMPROTP_T14 (SEQ ID NO: 3122) | 1219 | 1664 |
| HUMPROTP_T16 (SEQ ID NO: 3124) | 1195 | 1640 |

This segment can be found in a non-coding region of transcript(s) that are related to the following protein(s): HUMPROTP_P2, HUMPROTP_P3 and HUMPROTP_P4.

Segment cluster HUMPROTP_node_32 (SEQ ID NO:3140) according to the present invention is supported by 10 libraries. The number of libraries was determined as previously described. This segment can be found in the following transcript(s): HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T10 (SEQ ID NO:3119), HUMPROTP_T11 (SEQ ID NO:3120) and HUMPROTP_T14 (SEQ ID NO:3122). Table 2990 below describes the starting and ending position of this segment on each transcript.

TABLE 2990

Segment location on transcripts

| Transcript name | Segment starting position | Segment ending position |
|---|---|---|
| HUMPROTP_T1 (SEQ ID NO: 3110) | 1665 | 1988 |
| HUMPROTP_T2 (SEQ ID NO: 3111) | 1641 | 1964 |
| HUMPROTP_T3 (SEQ ID NO: 3112) | 1665 | 1988 |
| HUMPROTP_T4 (SEQ ID NO: 3113) | 2315 | 2638 |
| HUMPROTP_T5 (SEQ ID NO: 3114) | 1738 | 2061 |
| HUMPROTP_T6 (SEQ ID NO: 3115) | 3235 | 3558 |
| HUMPROTP_T7 (SEQ ID NO: 3116) | 1625 | 1948 |
| HUMPROTP_T10 (SEQ ID NO: 3119) | 1665 | 1988 |

TABLE 2990-continued

Segment location on transcripts

| Transcript name | Segment starting position | Segment ending position |
|---|---|---|
| HUMPROTP_T11 (SEQ ID NO: 3120) | 1665 | 1988 |
| HUMPROTP_T14 (SEQ ID NO: 3122) | 1665 | 1988 |

This segment can be found in a non-coding region of transcript(s) that are related to the following protein(s): HUMPROTP_P2, HUMPROTP_P3 and HUMPROTP_P4.

Segment cluster HUMPROTP_node_33 (SEQ ID NO:3141) according to the present invention is supported by 25 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122) and HUMPROTP_T15 (SEQ ID NO:3123). Table 2991 below describes the starting and ending position of this segment on each transcript.

TABLE 2991

Segment location on transcripts

| Transcript name | Segment starting position | Segment ending position |
|---|---|---|
| HUMPROTP_T0 (SEQ ID NO: 3109) | 882 | 1005 |
| HUMPROTP_T1 (SEQ ID NO: 3110) | 1989 | 2112 |
| HUMPROTP_T2 (SEQ ID NO: 3111) | 1965 | 2088 |
| HUMPROTP_T3 (SEQ ID NO: 3112) | 1989 | 2112 |
| HUMPROTP_T4 (SEQ ID NO: 3113) | 2639 | 2762 |
| HUMPROTP_T5 (SEQ ID NO: 3114) | 2062 | 2185 |
| HUMPROTP_T6 (SEQ ID NO: 3115) | 3559 | 3682 |
| HUMPROTP_T7 (SEQ ID NO: 3116) | 1949 | 2072 |
| HUMPROTP_T8 (SEQ ID NO: 3117) | 2670 | 2793 |
| HUMPROTP_T9 (SEQ ID NO: 3118) | 903 | 1026 |
| HUMPROTP_T10 (SEQ ID NO: 3119) | 1989 | 2112 |
| HUMPROTP_T11 (SEQ ID NO: 3120) | 1989 | 2112 |
| HUMPROTP_T12 (SEQ ID NO: 3121) | 882 | 1005 |
| HUMPROTP_T14 (SEQ ID NO: 3122) | 1989 | 2112 |
| HUMPROTP_T15 (SEQ ID NO: 3123) | 882 | 1005 |

This segment can be found in both coding and non-coding regions of transcript(s) as follows. The segment can be found in a non-coding region of transcript(s) that are related to the following protein(s): HUMPROTP_P2, HUMPROTP_P3 and HUMPROTP_P4. This segment can also be found in the following protein(s): HUMPROTP_P11, HUMPROTP_P5, HUMPROTP_P6, HUMPROTP_P7 and HUMPROTP_P8, since it is in the coding region for the corresponding transcript.

Segment cluster HUMPROTP_node_38 (SEQ ID NO:3142) according to the present invention is supported by 2 libraries. The number of libraries was determined as previously described. This segment can be found in the following transcript(s): HUMPROTP_T10 (SEQ ID NO:3119). Table 2992 below describes the starting and ending position of this segment on each transcript.

TABLE 2992

Segment location on transcripts

| Transcript name | Segment starting position | Segment ending position |
|---|---|---|
| HUMPROTP_T10 (SEQ ID NO: 3119) | 2263 | 2521 |

This segment can be found in a non-coding region of transcript(s) that are related to the following protein(s): HUMPROTP_P2.

Segment cluster HUMPROTP_node_46 (SEQ ID NO:3143) according to the present invention is supported by 1 libraries. The number of libraries was determined as previously described. This segment can be found in the following transcript(s): HUMPROTP_T18 (SEQ ID NO:3126) and HUMPROTP_T20 (SEQ ID NO:3128). Table 2993 below describes the starting and ending position of this segment on each transcript.

TABLE 2993

Segment location on transcripts

| Transcript name | Segment starting position | Segment ending position |
|---|---|---|
| HUMPROTP_T18 (SEQ ID NO: 3126) | 1 | 179 |
| HUMPROTP_T20 (SEQ ID NO: 3128) | 1 | 179 |

This segment can be found in a non-coding region of transcript(s) that are related to the following protein(s): HUMPROTP_P10.

Segment cluster HUMPROTP_node_48 (SEQ ID NO:3144) according to the present invention is supported by 41 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T17 (SEQ ID NO:3125), HUMPROTP_T18 (SEQ ID NO:3126), HUMPROTP_T19 (SEQ ID NO:3127) and HUMPROTP_T20 (SEQ ID NO:3128). Table 2994 below describes the starting and ending position of this segment on each transcript.

TABLE 2994

Segment location on transcripts

| Transcript name | Segment starting position | Segment ending position |
|---|---|---|
| HUMPROTP_T0 (SEQ ID NO: 3109) | 1344 | 1473 |
| HUMPROTP_T1 (SEQ ID NO: 3110) | 2451 | 2580 |
| HUMPROTP_T2 (SEQ ID NO: 3111) | 2427 | 2556 |
| HUMPROTP_T3 (SEQ ID NO: 3112) | 2451 | 2580 |
| HUMPROTP_T4 (SEQ ID NO: 3113) | 3101 | 3230 |
| HUMPROTP_T5 (SEQ ID NO: 3114) | 2524 | 2653 |
| HUMPROTP_T6 (SEQ ID NO: 3115) | 4021 | 4150 |

TABLE 2994-continued

Segment location on transcripts

| Transcript name | Segment starting position | Segment ending position |
|---|---|---|
| HUMPROTP_T7 (SEQ ID NO: 3116) | 2411 | 2540 |
| HUMPROTP_T8 (SEQ ID NO: 3117) | 3132 | 3261 |
| HUMPROTP_T9 (SEQ ID NO: 3118) | 1365 | 1494 |
| HUMPROTP_T10 (SEQ ID NO: 3119) | 2710 | 2839 |
| HUMPROTP_T11 (SEQ ID NO: 3120) | 2493 | 2622 |
| HUMPROTP_T12 (SEQ ID NO: 3121) | 1194 | 1323 |
| HUMPROTP_T17 (SEQ ID NO: 3125) | 145 | 274 |
| HUMPROTP_T18 (SEQ ID NO: 3126) | 180 | 309 |
| HUMPROTP_T19 (SEQ ID NO: 3127) | 145 | 274 |
| HUMPROTP_T20 (SEQ ID NO: 3128) | 180 | 309 |

This segment can be found in both coding and non-coding regions of transcript(s) as follows. The segment can be found in a non-coding region of transcript(s) that are related to the following protein(s): HUMPROTP_P2, HUMPROTP_P4, HUMPROTP_P5, HUMPROTP_P6 and HUMPROTP_P7. This segment can also be found in the following protein(s): HUMPROTP_P11, HUMPROTP_P3, HUMPROTP_P9 and HUMPROTP_P10, since it is in the coding region for the corresponding transcript.

Segment cluster HUMPROTP_node_50 (SEQ ID NO:3145) according to the present invention is supported by 48 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T17 (SEQ ID NO:3125), HUMPROTP_T18 (SEQ ID NO:3126), HUMPROTP_T19 (SEQ ID NO:3127) and HUMPROTP_T20 (SEQ ID NO:3128). Table 2995 below describes the starting and ending position of this segment on each transcript.

TABLE 2995

Segment location on transcripts

| Transcript name | Segment starting position | Segment ending position |
|---|---|---|
| HUMPROTP_T0 (SEQ ID NO: 3109) | 1474 | 1804 |
| HUMPROTP_T1 (SEQ ID NO: 3110) | 2581 | 2911 |
| HUMPROTP_T2 (SEQ ID NO: 3111) | 2557 | 2887 |
| HUMPROTP_T3 (SEQ ID NO: 3112) | 2581 | 2911 |
| HUMPROTP_T4 (SEQ ID NO: 3113) | 3231 | 3561 |
| HUMPROTP_T5 (SEQ ID NO: 3114) | 2654 | 2984 |
| HUMPROTP_T6 (SEQ ID NO: 3115) | 4151 | 4481 |
| HUMPROTP_T7 (SEQ ID NO: 3116) | 2541 | 2871 |
| HUMPROTP_T8 (SEQ ID NO: 3117) | 3262 | 3592 |
| HUMPROTP_T9 (SEQ ID NO: 3118) | 1495 | 1825 |
| HUMPROTP_T10 (SEQ ID NO: 3119) | 2840 | 3170 |
| HUMPROTP_T11 (SEQ ID NO: 3120) | 2623 | 2953 |
| HUMPROTP_T12 (SEQ ID NO: 3121) | 1324 | 1654 |
| HUMPROTP_T17 (SEQ ID NO: 3125) | 275 | 605 |
| HUMPROTP_T18 (SEQ ID NO: 3126) | 310 | 640 |
| HUMPROTP_T19 (SEQ ID NO: 3127) | 275 | 605 |
| HUMPROTP_T20 (SEQ ID NO: 3128) | 310 | 640 |

This segment can be found in both coding and non-coding regions of transcript(s) as follows. The segment can be found in a non-coding region of transcript(s) that are related to the following protein(s): HUMPROTP_P2, HUMPROTP_P4, HUMPROTP_P5, HUMPROTP_P6 and HUMPROTP_P7. This segment can also be found in the following protein(s): HUMPROTP_P11, HUMPROTP_P3, HUMPROTP_P9 and HUMPROTP_P10, since it is in the coding region for the corresponding transcript.

Segment cluster HUMPROTP_node_51 (SEQ ID NO:3146) according to the present invention is supported by 39 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T16 (SEQ ID NO:3124), HUMPROTP_T17 (SEQ ID NO:3125), HUMPROTP_T18 (SEQ ID NO:3126), HUMPROTP_T19 (SEQ ID NO:3127) and HUMPROTP_T20 (SEQ ID NO:3128). Table 2996 below describes the starting and ending position of this segment on each transcript.

TABLE 2996

Segment location on transcripts

| Transcript name | Segment starting position | Segment ending position |
|---|---|---|
| HUMPROTP_T0 (SEQ ID NO: 3109) | 1805 | 1940 |
| HUMPROTP_T1 (SEQ ID NO: 3110) | 2912 | 3047 |
| HUMPROTP_T2 (SEQ ID NO: 3111) | 2888 | 3023 |
| HUMPROTP_T3 (SEQ ID NO: 3112) | 2912 | 3691 |
| HUMPROTP_T4 (SEQ ID NO: 3113) | 3562 | 3697 |
| HUMPROTP_T5 (SEQ ID NO: 3114) | 2985 | 3120 |
| HUMPROTP_T6 (SEQ ID NO: 3115) | 4482 | 4617 |
| HUMPROTP_T7 (SEQ ID NO: 3116) | 2872 | 3007 |
| HUMPROTP_T8 (SEQ ID NO: 3117) | 3593 | 3728 |
| HUMPROTP_T9 (SEQ ID NO: 3118) | 1826 | 1961 |
| HUMPROTP_T10 (SEQ ID NO: 3119) | 3171 | 3306 |
| HUMPROTP_T11 (SEQ ID NO: 3120) | 2954 | 3089 |
| HUMPROTP_T12 (SEQ ID NO: 3121) | 1655 | 1790 |
| HUMPROTP_T16 (SEQ ID NO: 3124) | 1641 | 1776 |
| HUMPROTP_T17 (SEQ ID NO: 3125) | 606 | 741 |
| HUMPROTP_T18 (SEQ ID NO: 3126) | 641 | 776 |
| HUMPROTP_T19 (SEQ ID NO: 3127) | 606 | 1385 |
| HUMPROTP_T20 (SEQ ID NO: 3128) | 641 | 1420 |

This segment can be found in a non-coding region of transcript(s) that are related to the following protein(s): HUMPROTP_P11, HUMPROTP_P2, HUMPROTP_P3, HUMPROTP_P4, HUMPROTP_P5, HUMPROTP_P6, HUMPROTP_P7, HUMPROTP_P9 and HUMPROTP_P10.

According to an optional embodiment of the present invention, short segments related to the above cluster are also provided. These segments are up to about 120 bp in length, and so are included in a separate description.

Segment cluster HUMPROTP_node_12 (SEQ ID NO:3147) according to the present invention is supported by 24 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUM- PROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 2997 below describes the starting and ending position of this segment on each transcript.

TABLE 2997

Segment location on transcripts

| Transcript name | Segment starting position | Segment ending position |
|---|---|---|
| HUMPROTP_T0 (SEQ ID NO: 3109) | 215 | 270 |
| HUMPROTP_T1 (SEQ ID NO: 3110) | 215 | 270 |
| HUMPROTP_T2 (SEQ ID NO: 3111) | 215 | 270 |
| HUMPROTP_T3 (SEQ ID NO: 3112) | 215 | 270 |
| HUMPROTP_T5 (SEQ ID NO: 3114) | 288 | 343 |
| HUMPROTP_T6 (SEQ ID NO: 3115) | 1785 | 1840 |
| HUMPROTP_T7 (SEQ ID NO: 3116) | 175 | 230 |
| HUMPROTP_T8 (SEQ ID NO: 3117) | 1785 | 1840 |
| HUMPROTP_T9 (SEQ ID NO: 3118) | 215 | 270 |
| HUMPROTP_T10 (SEQ ID NO: 3119) | 215 | 270 |
| HUMPROTP_T11 (SEQ ID NO: 3120) | 215 | 270 |
| HUMPROTP_T12 (SEQ ID NO: 3121) | 215 | 270 |
| HUMPROTP_T14 (SEQ ID NO: 3122) | 215 | 270 |
| HUMPROTP_T15 (SEQ ID NO: 3123) | 215 | 270 |
| HUMPROTP_T16 (SEQ ID NO: 3124) | 215 | 270 |

This segment can be found in both coding and non-coding regions of transcript(s) as follows. The segment can be found in a non-coding region of transcript(s) that are related to the following protein(s): HUMPROTP_P3 and HUMPROTP_P5. This segment can also be found in the following protein(s): HUMPROTP_P11, HUMPROTP_P2, HUMPROTP_P4, HUMPROTP_P6, HUMPROTP_P7 and HUMPROTP_P8, since it is in the coding region for the corresponding transcript.

Segment cluster HUMPROTP_node_17 (SEQ ID NO:3148) according to the present invention is supported by 27 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 2998 below describes the starting and ending position of this segment on each transcript.

TABLE 2998

Segment location on transcripts

| Transcript name | Segment starting position | Segment ending position |
|---|---|---|
| HUMPROTP_T0 (SEQ ID NO: 3109) | 271 | 369 |
| HUMPROTP_T1 (SEQ ID NO: 3110) | 271 | 369 |
| HUMPROTP_T2 (SEQ ID NO: 3111) | 271 | 369 |
| HUMPROTP_T3 (SEQ ID NO: 3112) | 271 | 369 |
| HUMPROTP_T4 (SEQ ID NO: 3113) | 921 | 1019 |
| HUMPROTP_T5 (SEQ ID NO: 3114) | 344 | 442 |
| HUMPROTP_T6 (SEQ ID NO: 3115) | 1841 | 1939 |
| HUMPROTP_T7 (SEQ ID NO: 3116) | 231 | 329 |
| HUMPROTP_T8 (SEQ ID NO: 3117) | 2059 | 2157 |
| HUMPROTP_T9 (SEQ ID NO: 3118) | 271 | 369 |
| HUMPROTP_T10 (SEQ ID NO: 3119) | 271 | 369 |
| HUMPROTP_T11 (SEQ ID NO: 3120) | 271 | 369 |
| HUMPROTP_T12 (SEQ ID NO: 3121) | 271 | 369 |
| HUMPROTP_T14 (SEQ ID NO: 3122) | 271 | 369 |
| HUMPROTP_T15 (SEQ ID NO: 3123) | 271 | 369 |
| HUMPROTP_T16 (SEQ ID NO: 3124) | 271 | 369 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_19 (SEQ ID NO:3149) according to the present invention is supported by 26 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 2999 below describes the starting and ending position of this segment on each transcript.

TABLE 2999

Segment location on transcripts

| Transcript name | Segment starting position | Segment ending position |
|---|---|---|
| HUMPROTP_T0 (SEQ ID NO: 3109) | 370 | 463 |
| HUMPROTP_T1 (SEQ ID NO: 3110) | 370 | 463 |
| HUMPROTP_T2 (SEQ ID NO: 3111) | 370 | 463 |
| HUMPROTP_T3 (SEQ ID NO: 3112) | 370 | 463 |
| HUMPROTP_T4 (SEQ ID NO: 3113) | 1020 | 1113 |
| HUMPROTP_T5 (SEQ ID NO: 3114) | 443 | 536 |
| HUMPROTP_T6 (SEQ ID NO: 3115) | 1940 | 2033 |
| HUMPROTP_T7 (SEQ ID NO: 3116) | 330 | 423 |
| HUMPROTP_T8 (SEQ ID NO: 3117) | 2158 | 2251 |
| HUMPROTP_T9 (SEQ ID NO: 3118) | 370 | 463 |
| HUMPROTP_T10 (SEQ ID NO: 3119) | 370 | 463 |
| HUMPROTP_T11 (SEQ ID NO: 3120) | 370 | 463 |
| HUMPROTP_T12 (SEQ ID NO: 3121) | 370 | 463 |
| HUMPROTP_T14 (SEQ ID NO: 3122) | 370 | 463 |
| HUMPROTP_T15 (SEQ ID NO: 3123) | 370 | 463 |
| HUMPROTP_T16 (SEQ ID NO: 3124) | 370 | 463 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_21 (SEQ ID NO:3150) according to the present invention is supported by 23 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 3000 below describes the starting and ending position of this segment on each transcript.

TABLE 3000

Segment location on transcripts

| Transcript name | Segment starting position | Segment ending position |
|---|---|---|
| HUMPROTP_T0 (SEQ ID NO: 3109) | 464 | 541 |
| HUMPROTP_T1 (SEQ ID NO: 3110) | 464 | 541 |
| HUMPROTP_T2 (SEQ ID NO: 3111) | 464 | 541 |
| HUMPROTP_T3 (SEQ ID NO: 3112) | 464 | 541 |
| HUMPROTP_T4 (SEQ ID NO: 3113) | 1114 | 1191 |
| HUMPROTP_T5 (SEQ ID NO: 3114) | 537 | 614 |
| HUMPROTP_T6 (SEQ ID NO: 3115) | 2034 | 2111 |
| HUMPROTP_T7 (SEQ ID NO: 3116) | 424 | 501 |
| HUMPROTP_T8 (SEQ ID NO: 3117) | 2252 | 2329 |
| HUMPROTP_T9 (SEQ ID NO: 3118) | 464 | 541 |
| HUMPROTP_T10 (SEQ ID NO: 3119) | 464 | 541 |
| HUMPROTP_T11 (SEQ ID NO: 3120) | 464 | 541 |
| HUMPROTP_T12 (SEQ ID NO: 3121) | 464 | 541 |
| HUMPROTP_T14 (SEQ ID NO: 3122) | 464 | 541 |
| HUMPROTP_T15 (SEQ ID NO: 3123) | 464 | 541 |
| HUMPROTP_T16 (SEQ ID NO: 3124) | 464 | 541 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_25 (SEQ ID NO:3151) according to the present invention is supported by 22 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 3001 below describes the starting and ending position of this segment on each transcript.

TABLE 3001

Segment location on transcripts

| Transcript name | Segment starting position | Segment ending position |
|---|---|---|
| HUMPROTP_T0 (SEQ ID NO: 3109) | 682 | 783 |
| HUMPROTP_T1 (SEQ ID NO: 3110) | 682 | 783 |
| HUMPROTP_T2 (SEQ ID NO: 3111) | 682 | 783 |
| HUMPROTP_T3 (SEQ ID NO: 3112) | 682 | 783 |
| HUMPROTP_T4 (SEQ ID NO: 3113) | 1332 | 1433 |
| HUMPROTP_T5 (SEQ ID NO: 3114) | 755 | 856 |
| HUMPROTP_T6 (SEQ ID NO: 3115) | 2252 | 2353 |
| HUMPROTP_T7 (SEQ ID NO: 3116) | 642 | 743 |
| HUMPROTP_T8 (SEQ ID NO: 3117) | 2470 | 2571 |
| HUMPROTP_T9 (SEQ ID NO: 3118) | 682 | 783 |
| HUMPROTP_T10 (SEQ ID NO: 3119) | 682 | 783 |
| HUMPROTP_T11 (SEQ ID NO: 3120) | 682 | 783 |
| HUMPROTP_T12 (SEQ ID NO: 3121) | 682 | 783 |
| HUMPROTP_T14 (SEQ ID NO: 3122) | 682 | 783 |
| HUMPROTP_T15 (SEQ ID NO: 3123) | 682 | 783 |
| HUMPROTP_T16 (SEQ ID NO: 3124) | 682 | 783 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 3002.

TABLE 3002

Oligonucleotides related to this segment

| Oligonucleotide name | Overexpressed in cancers | Chip reference |
|---|---|---|
| HUMPROTP_0_4_0 | ovarian carcinoma | OVA |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_26 (SEQ ID NO:3152) according to the present invention can be found in the following transcript(s): HUMPROTP_T9 (SEQ ID NO:3118). Table 3003 below describes the starting and ending position of this segment on each transcript.

TABLE 3003

Segment location on transcripts

| Transcript name | Segment starting position | Segment ending position |
|---|---|---|
| HUMPROTP_T9 (SEQ ID NO: 3118) | 784 | 804 |

This segment can be found in the following protein(s): HUMPROTP_P6.

Segment cluster HUMPROTP_node_28 (SEQ ID NO:3153) according to the present invention is supported by 23 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T14 (SEQ ID NO:3122), HUMPROTP_T15 (SEQ ID NO:3123) and HUMPROTP_T16 (SEQ ID NO:3124). Table 3004 below describes the starting and ending position of this segment on each transcript.

TABLE 3004

Segment location on transcripts

| Transcript name | Segment starting position | Segment ending position |
|---|---|---|
| HUMPROTP_T0 (SEQ ID NO: 3109) | 784 | 881 |
| HUMPROTP_T1 (SEQ ID NO: 3110) | 784 | 881 |
| HUMPROTP_T2 (SEQ ID NO: 3111) | 784 | 881 |
| HUMPROTP_T3 (SEQ ID NO: 3112) | 784 | 881 |
| HUMPROTP_T4 (SEQ ID NO: 3113) | 1434 | 1531 |
| HUMPROTP_T5 (SEQ ID NO: 3114) | 857 | 954 |
| HUMPROTP_T6 (SEQ ID NO: 3115) | 2354 | 2451 |
| HUMPROTP_T7 (SEQ ID NO: 3116) | 744 | 841 |
| HUMPROTP_T8 (SEQ ID NO: 3117) | 2572 | 2669 |
| HUMPROTP_T9 (SEQ ID NO: 3118) | 805 | 902 |
| HUMPROTP_T10 (SEQ ID NO: 3119) | 784 | 881 |
| HUMPROTP_T11 (SEQ ID NO: 3120) | 784 | 881 |
| HUMPROTP_T12 (SEQ ID NO: 3121) | 784 | 881 |
| HUMPROTP_T14 (SEQ ID NO: 3122) | 784 | 881 |
| HUMPROTP_T15 (SEQ ID NO: 3123) | 784 | 881 |
| HUMPROTP_T16 (SEQ ID NO: 3124) | 784 | 881 |

This segment can be found in both coding and non-coding regions of transcript(s) as follows. The segment can be found in a non-coding region of transcript(s) that are related to the following protein(s): HUMPROTP_P3. This segment can also be found in the following protein(s): HUMPROTP_P11, HUMPROTP_P2, HUMPROTP_P4, HUMPROTP_P5, HUMPROTP_P6, HUMPROTP_P7 and HUMPROTP_P8, since it is in the coding region for the corresponding transcript.

Segment cluster HUMPROTP_node_30 (SEQ ID NO:3154) according to the present invention can be found in the following transcript(s): HUMPROTP_T1 (SEQ ID NO:3110), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T10 (SEQ ID NO:3119), HUMPROTP_T11 (SEQ ID NO:3120) and HUMPROTP_T14 (SEQ ID NO:3122). Table 3005 below describes the starting and ending position of this segment on each transcript.

TABLE 3005

Segment location on transcripts

| Transcript name | Segment starting position | Segment ending position |
|---|---|---|
| HUMPROTP_T1 (SEQ ID NO: 3110) | 1195 | 1218 |
| HUMPROTP_T3 (SEQ ID NO: 3112) | 1195 | 1218 |
| HUMPROTP_T4 (SEQ ID NO: 3113) | 1845 | 1868 |
| HUMPROTP_T5 (SEQ ID NO: 3114) | 1268 | 1291 |
| HUMPROTP_T6 (SEQ ID NO: 3115) | 2765 | 2788 |
| HUMPROTP_T7 (SEQ ID NO: 3116) | 1155 | 1178 |
| HUMPROTP_T10 (SEQ ID NO: 3119) | 1195 | 1218 |
| HUMPROTP_T11 (SEQ ID NO: 3120) | 1195 | 1218 |
| HUMPROTP_T14 (SEQ ID NO: 3122) | 1195 | 1218 |

This segment can be found in a non-coding region of transcript(s) that are related to the following protein(s): HUMPROTP_P2, HUMPROTP_P3 and HUMPROTP_P4.

Segment cluster HUMPROTP_node_34 (SEQ ID NO:3155) according to the present invention can be found in the following transcript(s): HUMPROTP_T14 (SEQ ID NO:3122) and HUMPROTP_T15 (SEQ ID NO:3123). Table 3006 below describes the starting and ending position of this segment on each transcript.

TABLE 3006

Segment location on transcripts

| Transcript name | Segment starting position | Segment ending position |
|---|---|---|
| HUMPROTP_T14 (SEQ ID NO: 3122) | 2113 | 2136 |
| HUMPROTP_T15 (SEQ ID NO: 3123) | 1006 | 1029 |

This segment can be found in both coding and non-coding regions of transcript(s) as follows. The segment can be found in a non-coding region of transcript(s) that are related to the following protein(s): HUMPROTP_P2. This segment can also be found in the following protein(s): HUMPROTP_P8, since it is in the coding region for the corresponding transcript.

Segment cluster HUMPROTP_node_36 (SEQ ID NO:3156) according to the present invention is supported by 23 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119) and HUMPROTP_T11 (SEQ ID NO:3120). Table 3007 below describes the starting and ending position of this segment on each transcript.

TABLE 3007

Segment location on transcripts

| Transcript name | Segment starting position | Segment ending position |
|---|---|---|
| HUMPROTP_T0 (SEQ ID NO: 3109) | 1006 | 1101 |
| HUMPROTP_T1 (SEQ ID NO: 3110) | 2113 | 2208 |

TABLE 3007-continued

Segment location on transcripts

| Transcript name | Segment starting position | Segment ending position |
|---|---|---|
| HUMPROTP_T2 (SEQ ID NO: 3111) | 2089 | 2184 |
| HUMPROTP_T3 (SEQ ID NO: 3112) | 2113 | 2208 |
| HUMPROTP_T4 (SEQ ID NO: 3113) | 2763 | 2858 |
| HUMPROTP_T5 (SEQ ID NO: 3114) | 2186 | 2281 |
| HUMPROTP_T6 (SEQ ID NO: 3115) | 3683 | 3778 |
| HUMPROTP_T7 (SEQ ID NO: 3116) | 2073 | 2168 |
| HUMPROTP_T8 (SEQ ID NO: 3117) | 2794 | 2889 |
| HUMPROTP_T9 (SEQ ID NO: 3118) | 1027 | 1122 |
| HUMPROTP_T10 (SEQ ID NO: 3119) | 2113 | 2208 |
| HUMPROTP_T11 (SEQ ID NO: 3120) | 2113 | 2208 |

This segment can be found in both coding and non-coding regions of transcript(s) as follows. The segment can be found in a non-coding region of transcript(s) that are related to the following protein(s): HUMPROTP_P2, HUMPROTP_P3 and HUMPROTP_P4. This segment can also be found in the following protein(s): HUMPROTP_P11, HUMPROTP_P5 and HUMPROTP_P6, since it is in the coding region for the corresponding transcript.

Segment cluster HUMPROTP_node_37 (SEQ ID NO:3157) according to the present invention is supported by 24 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119) and HUMPROTP_T11 (SEQ ID NO:3120). Table 3008 below describes the starting and ending position of this segment on each transcript.

TABLE 3008

Segment location on transcripts

| Transcript name | Segment starting position | Segment ending position |
|---|---|---|
| HUMPROTP_T0 (SEQ ID NO: 3109) | 1102 | 1155 |
| HUMPROTP_T1 (SEQ ID NO: 3110) | 2209 | 2262 |
| HUMPROTP_T2 (SEQ ID NO: 3111) | 2185 | 2238 |
| HUMPROTP_T3 (SEQ ID NO: 3112) | 2209 | 2262 |
| HUMPROTP_T4 (SEQ ID NO: 3113) | 2859 | 2912 |
| HUMPROTP_T5 (SEQ ID NO: 3114) | 2282 | 2335 |
| HUMPROTP_T6 (SEQ ID NO: 3115) | 3779 | 3832 |
| HUMPROTP_T7 (SEQ ID NO: 3116) | 2169 | 2222 |
| HUMPROTP_T8 (SEQ ID NO: 3117) | 2890 | 2943 |
| HUMPROTP_T9 (SEQ ID NO: 3118) | 1123 | 1176 |
| HUMPROTP_T10 (SEQ ID NO: 3119) | 2209 | 2262 |
| HUMPROTP_T11 (SEQ ID NO: 3120) | 2209 | 2262 |

This segment can be found in both coding and non-coding regions of transcript(s) as follows. The segment can be found in a non-coding region of transcript(s) that are related to the following protein(s): HUMPROTP_P2 and HUMPROTP_P4. This segment can also be found in the following protein(s): HUMPROTP_P11, HUMPROTP_P3, HUMPROTP_P5 and HUMPROTP_P6, since it is in the coding region for the corresponding transcript.

Segment cluster HUMPROTP_node_39 (SEQ ID NO:3158) according to the present invention is supported by 30 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120) and HUMPROTP_T12 (SEQ ID NO:3121). Table 3009 below describes the starting and ending position of this segment on each transcript.

TABLE 3009

Segment location on transcripts

| Transcript name | Segment starting position | Segment ending position |
|---|---|---|
| HUMPROTP_T0 (SEQ ID NO: 3109) | 1156 | 1238 |
| HUMPROTP_T1 (SEQ ID NO: 3110) | 2263 | 2345 |
| HUMPROTP_T2 (SEQ ID NO: 3111) | 2239 | 2321 |
| HUMPROTP_T3 (SEQ ID NO: 3112) | 2263 | 2345 |
| HUMPROTP_T4 (SEQ ID NO: 3113) | 2913 | 2995 |
| HUMPROTP_T5 (SEQ ID NO: 3114) | 2336 | 2418 |
| HUMPROTP_T6 (SEQ ID NO: 3115) | 3833 | 3915 |
| HUMPROTP_T7 (SEQ ID NO: 3116) | 2223 | 2305 |
| HUMPROTP_T8 (SEQ ID NO: 3117) | 2944 | 3026 |
| HUMPROTP_T9 (SEQ ID NO: 3118) | 1177 | 1259 |
| HUMPROTP_T10 (SEQ ID NO: 3119) | 2522 | 2604 |
| HUMPROTP_T11 (SEQ ID NO: 3120) | 2263 | 2345 |
| HUMPROTP_T12 (SEQ ID NO: 3121) | 1006 | 1088 |

This segment can be found in both coding and non-coding regions of transcript(s) as follows. The segment can be found in a non-coding region of transcript(s) that are related to the following protein(s): HUMPROTP_P2 and HUMPROTP_P4. This segment can also be found in the following protein(s): HUMPROTP_P11, HUMPROTP_P3, HUMPROTP_P5, HUMPROTP_P6 and HUMPROTP_P7, since it is in the coding region for the corresponding transcript.

Segment cluster HUMPROTP_node_41 (SEQ ID NO:3159) according to the present invention is supported by 1 libraries. The number of libraries was determined as previously described. This segment can be found in the following transcript(s): HUMPROTP_T11 (SEQ ID NO:3120). Table 3010 below describes the starting and ending position of this segment on each transcript.

TABLE 3010

Segment location on transcripts

| Transcript name | Segment starting position | Segment ending position |
|---|---|---|
| HUMPROTP_T11 (SEQ ID NO: 3120) | 2346 | 2387 |

This segment can be found in a non-coding region of transcript(s) that are related to the following protein(s): HUMPROTP_P2.

Segment cluster HUMPROTP_node_43 (SEQ ID NO:3160) according to the present invention is supported by 1 libraries. The number of libraries was determined as previously described. This segment can be found in the following transcript(s): HUMPROTP_T17 (SEQ ID NO:3125) and HUMPROTP_T19 (SEQ ID NO:3127). Table 3011 below describes the starting and ending position of this segment on each transcript.

TABLE 3011

Segment location on transcripts

| Transcript name | Segment starting position | Segment ending position |
|---|---|---|
| HUMPROTP_T17 (SEQ ID NO: 3125) | 1 | 39 |
| HUMPROTP_T19 (SEQ ID NO: 3127) | 1 | 39 |

This segment can be found in the following protein(s): HUMPROTP_P9.

Segment cluster HUMPROTP_node_44 (SEQ ID NO:3161) according to the present invention is supported by 34 libraries. The number of libraries was determined as previously described. This segment can be found in the following transcript(s): HUMPROTP_T0 (SEQ ID NO:3109), HUMPROTP_T1 (SEQ ID NO:3110), HUMPROTP_T2 (SEQ ID NO:3111), HUMPROTP_T3 (SEQ ID NO:3112), HUMPROTP_T4 (SEQ ID NO:3113), HUMPROTP_T5 (SEQ ID NO:3114), HUMPROTP_T6 (SEQ ID NO:3115), HUMPROTP_T7 (SEQ ID NO:3116), HUMPROTP_T8 (SEQ ID NO:3117), HUMPROTP_T9 (SEQ ID NO:3118), HUMPROTP_T10 (SEQ ID NO:3119), HUMPROTP_T11 (SEQ ID NO:3120), HUMPROTP_T12 (SEQ ID NO:3121), HUMPROTP_T17 (SEQ ID NO:3125) and HUMPROTP_T19 (SEQ ID NO:3127). Table 3012 below describes the starting and ending position of this segment on each transcript.

TABLE 3012

Segment location on transcripts

| Transcript name | Segment starting position | Segment ending position |
|---|---|---|
| HUMPROTP_T0 (SEQ ID NO: 3109) | 1239 | 1343 |
| HUMPROTP_T1 (SEQ ID NO: 3110) | 2346 | 2450 |
| HUMPROTP_T2 (SEQ ID NO: 3111) | 2322 | 2426 |
| HUMPROTP_T3 (SEQ ID NO: 3112) | 2346 | 2450 |
| HUMPROTP_T4 (SEQ ID NO: 3113) | 2996 | 3100 |
| HUMPROTP_T5 (SEQ ID NO: 3114) | 2419 | 2523 |
| HUMPROTP_T6 (SEQ ID NO: 3115) | 3916 | 4020 |
| HUMPROTP_T7 (SEQ ID NO: 3116) | 2306 | 2410 |
| HUMPROTP_T8 (SEQ ID NO: 3117) | 3027 | 3131 |
| HUMPROTP_T9 (SEQ ID NO: 3118) | 1260 | 1364 |
| HUMPROTP_T10 (SEQ ID NO: 3119) | 2605 | 2709 |
| HUMPROTP_T11 (SEQ ID NO: 3120) | 2388 | 2492 |
| HUMPROTP_T12 (SEQ ID NO: 3121) | 1089 | 1193 |
| HUMPROTP_T17 (SEQ ID NO: 3125) | 40 | 144 |
| HUMPROTP_T19 (SEQ ID NO: 3127) | 40 | 144 |

This segment can be found in both coding and non-coding regions of transcript(s) as follows. The segment can be found in a non-coding region of transcript(s) that are related to the following protein(s): HUMPROTP_P2, HUMPROTP_P4, HUMPROTP_P5, HUMPROTP_P6 and HUMPROTP_P7. This segment can also be found in the following protein(s): HUMPROTP_P11, HUMPROTP_P3 and HUMPROTP_P9, since it is in the coding region for the corresponding transcript.

Description for Cluster HUMSTPK13

Cluster HUMSTPK13 features 7 transcript(s) and 27 segment(s) of interest, the names for which are given in Tables 3013 and 3014, respectively, the sequences themselves are given at the end of the application. The selected protein variants are given in Table 3015.

TABLE 3013

Transcripts of interest
Transcript Name

HUMSTPK13_T2 (SEQ ID NO: 3162)
HUMSTPK13_T4 (SEQ ID NO: 3163)
HUMSTPK13_T7 (SEQ ID NO: 3164)
HUMSTPK13_T8 (SEQ ID NO: 3165)
HUMSTPK13_T12 (SEQ ID NO: 3166)
HUMSTPK13_T15 (SEQ ID NO: 3167)
HUMSTPK13_T16 (SEQ ID NO: 3168)

TABLE 3014

Segments of interest
Segment Name

HUMSTPK13_node_6 (SEQ ID NO: 3169)
HUMSTPK13_node_7 (SEQ ID NO: 3170)
HUMSTPK13_node_11 (SEQ ID NO: 3171)
HUMSTPK13_node_12 (SEQ ID NO: 3172)
HUMSTPK13_node_14 (SEQ ID NO: 3173)
HUMSTPK13_node_22 (SEQ ID NO: 3174)
HUMSTPK13_node_27 (SEQ ID NO: 3175)
HUMSTPK13_node_32 (SEQ ID NO: 3176)
HUMSTPK13_node_33 (SEQ ID NO: 3177)
HUMSTPK13_node_35 (SEQ ID NO: 3178)
HUMSTPK13_node_39 (SEQ ID NO: 3179)
HUMSTPK13_node_42 (SEQ ID NO: 3180)
HUMSTPK13_node_1 (SEQ ID NO: 3181)
HUMSTPK13_node_2 (SEQ ID NO: 3182)
HUMSTPK13_node_3 (SEQ ID NO: 3183)
HUMSTPK13_node_5 (SEQ ID NO: 3184)
HUMSTPK13_node_9 (SEQ ID NO: 3185)
HUMSTPK13_node_18 (SEQ ID NO: 3186)
HUMSTPK13_node_23 (SEQ ID NO: 3187)
HUMSTPK13_node_30 (SEQ ID NO: 3188)
HUMSTPK13_node_31 (SEQ ID NO: 3189)
HUMSTPK13_node_34 (SEQ ID NO: 3190)
HUMSTPK13_node_36 (SEQ ID NO: 3191)
HUMSTPK13_node_37 (SEQ ID NO: 3192)
HUMSTPK13_node_38 (SEQ ID NO: 3193)
HUMSTPK13_node_40 (SEQ ID NO: 3194)
HUMSTPK13_node_43 (SEQ ID NO: 3195)

TABLE 3015

Proteins of interest

| Protein Name | Corresponding Transcript(s) |
|---|---|
| HUMSTPK13_P2 | HUMSTPK13_T2 (SEQ ID NO: 3162) |
| HUMSTPK13_P4 | HUMSTPK13_T4 (SEQ ID NO: 3163) |
| HUMSTPK13_P5 | HUMSTPK13_T8 (SEQ ID NO: 3165) |
| HUMSTPK13_P6 | HUMSTPK13_T7 (SEQ ID NO: 3164) |
| HUMSTPK13_P9 | HUMSTPK13_T12 (SEQ ID NO: 3166); HUMSTPK13_T15 (SEQ ID NO: 3167); HUMSTPK13_T16 (SEQ ID NO: 3168) |

These sequences are variants of the known protein Serine/threonine-protein kinase PLK (SwissProt accession identifier PLK1_HUMAN; known also according to the synonyms EC 2.7.1.-; PLK-1; Serine-threonine protein kinase 13; STPK13), referred to herein as the previously known protein.

Protein Serine/threonine-protein kinase PLK is known or believed to have the following function(s): May be required for cell division and may have a role during G1 or S phase. The sequence for protein Serine/threonine-protein kinase PLK is given at the end of the application, as "Serine/threonine-protein kinase PLK amino acid sequence". Known polymorphisms for this sequence are as shown in Table 3016.

TABLE 3016

Amino acid mutations for Known Protein

| SNP position(s) on amino acid sequence | Comment |
|---|---|
| 2 | S -> T |
| 11 | A -> P |
| 58 | F -> L |
| 60 | G -> S |
| 73 | A -> V |
| 141 | L -> P |
| 227 | G -> E |
| 301 | N -> G |
| 495 | A -> G |
| 501 | E -> Q |

Protein Serine/threonine-protein kinase PLK localization is believed to be Nuclear.

The following GO Annotation(s) apply to the previously known protein. The following annotation(s) were found: cell cycle control; protein amino acid phosphorylation; mitosis; cell proliferation, which are annotation(s) related to Biological Process; protein serine/threonine kinase; ATP binding; transferase, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMSTPK13 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 76 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 76 and Table 3017. This cluster is overexpressed (at least at a minimum level) in the following pathological conditions: epithelial malignant tumors, a mixture of malignant tumors from different tissues, hepatocellular carcinoma, lung malignant tumors, myosarcoma, pancreas carcinoma, skin malignancies and uterine malignancies.

TABLE 3017

Normal tissue distribution

| Name of Tissue | Number |
|---|---|
| bladder | 0 |
| bone | 32 |
| brain | 95 |
| colon | 31 |
| epithelial | 6 |
| general | 31 |
| head and neck | 0 |
| kidney | 0 |
| liver | 0 |
| lung | 0 |
| lymph nodes | 101 |
| breast | 0 |

TABLE 3017-continued

Normal tissue distribution

| Name of Tissue | Number |
|---|---|
| bone marrow | 0 |
| muscle | 3 |
| ovary | 0 |
| pancreas | 0 |
| prostate | 20 |
| skin | 0 |
| stomach | 73 |
| T cells | 557 |
| uterus | 0 |

TABLE 3018

P values and ratios for expression in cancerous tissue

| Name of Tissue | P1 | P2 | SP1 | R3 | SP2 | R4 |
|---|---|---|---|---|---|---|
| bladder | 5.7e−01 | 3.8e−01 | 1 | 1.0 | 4.6e−01 | 1.9 |
| bone | 9.2e−01 | 4.4e−01 | 1 | 0.5 | 5.3e−01 | 1.4 |
| brain | 6.3e−01 | 3.3e−01 | 1 | 0.2 | 1.8e−01 | 1.0 |
| colon | 1.8e−01 | 7.7e−02 | 7.8e−01 | 1.1 | 9.0e−02 | 1.5 |
| epithelial | 1.4e−04 | 4.5e−12 | 4.2e−02 | 2.6 | 7.8e−32 | 18.4 |
| general | 1.8e−03 | 3.2e−16 | 6.7e−01 | 0.9 | 3.8e−46 | 4.9 |
| head and neck | 2.1e−01 | 1.7e−01 | 1 | 1.0 | 5.6e−01 | 1.7 |
| kidney | 6.7e−01 | 2.6e−01 | 1 | 1.1 | 6.7e−03 | 2.4 |
| liver | 1 | 5.0e−02 | 1 | 1.0 | 9.4e−04 | 4.2 |
| lung | 5.9e−02 | 3.5e−02 | 4.1e−01 | 3.2 | 2.5e−05 | 4.4 |
| lymph nodes | 6.9e−01 | 3.9e−01 | 8.7e−01 | 0.5 | 1.2e−02 | 1.6 |
| breast | 6.1e−01 | 1.4e−01 | 1 | 1.0 | 1.2e−01 | 2.3 |
| bone marrow | 1 | 4.2e−01 | 1 | 1.0 | 1.5e−01 | 3.6 |
| muscle | 9.2e−01 | 4.8e−01 | 1 | 0.8 | 3.5e−03 | 3.4 |
| ovary | 2.4e−01 | 1.1e−01 | 2.2e−01 | 2.9 | 7.0e−02 | 3.4 |
| pancreas | 3.3e−01 | 6.9e−02 | 4.2e−01 | 2.4 | 8.6e−04 | 5.5 |
| prostate | 9.7e−01 | 6.8e−01 | 1 | 0.5 | 2.0e−01 | 1.4 |
| skin | 1 | 2.3e−02 | 1 | 1.0 | 3.1e−08 | 10.5 |
| stomach | 5.0e−01 | 5.8e−02 | 6.9e−01 | 1.0 | 9.7e−04 | 2.4 |
| T cells | 5.0e−01 | 6.7e−01 | 1 | 0.3 | 9.8e−01 | 0.5 |
| uterus | 5.0e−01 | 5.4e−02 | 1 | 1.0 | 9.4e−03 | 3.9 |

As noted above, cluster HUMSTPK13 features 27 segment(s), which were listed in Table 3014 above and for which the sequence(s) are given at the end of the application. These segment(s) are portions of nucleic acid sequence(s) which are described herein separately because they are of particular interest. A description of each segment according to the present invention is now provided.

Segment cluster HUMSTPK13_node_6 (SEQ ID NO:3169) according to the present invention is supported by 101 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165) and HUMSTPK13_12 (SEQ ID NO:3166). Table 3019 below describes the starting and ending position of this segment on each transcript.

TABLE 3019

Segment location on transcripts

| Transcript name | Segment starting position | Segment ending position |
|---|---|---|
| HUMSTPK13_T2 (SEQ ID NO: 3162) | 295 | 519 |
| HUMSTPK13_T4 (SEQ ID NO: 3163) | 295 | 519 |
| HUMSTPK13_T7 (SEQ ID NO: 3164) | 295 | 519 |

TABLE 3019-continued

Segment location on transcripts

| Transcript name | Segment starting position | Segment ending position |
|---|---|---|
| HUMSTPK13_T8 (SEQ ID NO: 3165) | 295 | 519 |
| HUMSTPK13_T12 (SEQ ID NO: 3166) | 295 | 519 |

This segment can be found in both coding and non-coding regions of transcript(s) as follows. The segment can be found in a non-coding region of transcript(s) that are related to the following protein(s): HUMSTPK13_P9. This segment can also be found in the following protein(s): HUMSTPK13_P2, HUMSTPK13_P4, HUMSTPK13_P6 and HUMSTPK13_P5, since it is in the coding region for the corresponding transcript.

Segment cluster HUMSTPK13_node_7 (SEQ ID NO:3170) according to the present invention is supported by 2 libraries. The number of libraries was determined as previously described. This segment can be found in the following transcript(s): HUMSTPK13_T12 (SEQ ID NO:3166). Table 3020 below describes the starting and ending position of this segment on each transcript.

TABLE 3020

Segment location on transcripts

| Transcript name | Segment starting position | Segment ending position |
|---|---|---|
| HUMSTPK13_T12 (SEQ ID NO: 3166) | 520 | 679 |

This segment can be found in a non-coding region of transcript(s) that are related to the following protein(s): HUMSTPK13_P9.

Segment cluster HUMSTPK13_node_11 (SEQ ID NO:3171) according to the present invention is supported by 3 libraries. The number of libraries was determined as previously described. This segment can be found in the following transcript(s): HUMSTPK13_T15 (SEQ ID NO:3167). Table 3021 below describes the starting and ending position of this segment on each transcript.

TABLE 3021

Segment location on transcripts

| Transcript name | Segment starting position | Segment ending position |
|---|---|---|
| HUMSTPK13_T15 (SEQ ID NO: 3167) | 1 | 359 |

This segment can be found in a non-coding region of transcript(s) that are related to the following protein(s): HUMSTPK13_P9.

Segment cluster HUMSTPK13_node_12 (SEQ ID NO:3172) according to the present invention is supported by 103 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3022 below describes the starting and ending position of this segment on each transcript.

TABLE 3022

Segment location on transcripts

| Transcript name | Segment starting position | Segment ending position |
|---|---|---|
| HUMSTPK13_T2 (SEQ ID NO: 3162) | 520 | 688 |
| HUMSTPK13_T4 (SEQ ID NO: 3163) | 520 | 688 |
| HUMSTPK13_T7 (SEQ ID NO: 3164) | 520 | 688 |
| HUMSTPK13_T8 (SEQ ID NO: 3165) | 520 | 688 |
| HUMSTPK13_T12 (SEQ ID NO: 3166) | 680 | 848 |
| HUMSTPK13_T15 (SEQ ID NO: 3167) | 360 | 528 |
| HUMSTPK13_T16 (SEQ ID NO: 3168) | 84 | 252 |

This segment can be found in both coding and non-coding regions of transcript(s) as follows. The segment can be found in a non-coding region of transcript(s) that are related to the following protein(s): HUMSTPK13_P9. This segment can also be found in the following protein(s): HUMSTPK13_P2, HUMSTPK13_P4, HUMSTPK13_P6 and HUMSTPK13_P5, since it is in the coding region for the corresponding transcript.

Segment cluster HUMSTPK13_node_14 (SEQ ID NO:3173) according to the present invention is supported by 97 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3023 below describes the starting and ending position of this segment on each transcript.

TABLE 3023

Segment location on transcripts

| Transcript name | Segment starting position | Segment ending position |
|---|---|---|
| HUMSTPK13_T2 (SEQ ID NO: 3162) | 689 | 833 |
| HUMSTPK13_T4 (SEQ ID NO: 3163) | 689 | 833 |
| HUMSTPK13_T7 (SEQ ID NO: 3164) | 689 | 833 |
| HUMSTPK13_T8 (SEQ ID NO: 3165) | 689 | 833 |
| HUMSTPK13_T12 (SEQ ID NO: 3166) | 849 | 993 |
| HUMSTPK13_T15 (SEQ ID NO: 3167) | 529 | 673 |
| HUMSTPK13_T16 (SEQ ID NO: 3168) | 253 | 397 |

This segment can be found in the following protein(s): HUMSTPK13_P2, HUMSTPK13_P4, HUMSTPK13_P6, HUMSTPK13_P5 and HUMSTPK13_P9.

Segment cluster HUMSTPK13_node_22 (SEQ ID NO:3174) according to the present invention is supported by 90 libraries. The number of libraries was determined as previously described. This segment can be found in the following transcript(s): HUMSTPK13_T2 (SEQ ID NO:3162), HUMSTPK13_T7 (SEQ ID NO:3164), HUMSTPK13_T8 (SEQ ID NO:3165), HUMSTPK13_T12 (SEQ ID NO:3166) HUMSTPK13_T15 (SEQ ID NO:3167) and HUMSTPK13_T16 (SEQ ID NO:3168). Table 3024 below describes the starting and ending position of this segment on each transcript.

TABLE 3024

Segment location on transcripts

| Transcript name | Segment starting position | Segment ending position |
|---|---|---|
| HUMSTPK13_T2 (SEQ ID NO: 3162) | 928 | 1112 |
| HUMSTPK13_T7 (SEQ ID NO: 3164) | 928 | 1112 |
| HUMSTPK13_T8 (SEQ ID NO: 3165) | 928 | 1112 |
| HUMSTPK13_T12 (SEQ ID NO: 3166) | 1088 | 1272 |
| HUMSTPK13_T15 (SEQ ID NO: 3167) | 768 | 952 |
| HUMSTPK13_T16 (SEQ ID NO: 3168) | 492 | 676 |

This segment can be found in the following protein(s): HUMSTPK13_P2, HUMSTPK13_P6, HUMSTPK13_P5 and HUMSTPK13_P9.

Segment cluster HUMSTPK13_node_27 (SEQ ID NO:3175) according to the present invention is supported by 93 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3025 below describes the starting and ending position of this segment on each transcript.

TABLE 3025

Segment location on transcripts

| Transcript name | Segment starting position | Segment ending position |
|---|---|---|
| HUMSTPK13_T2 (SEQ ID NO: 3162) | 1148 | 1303 |
| HUMSTPK13_T4 (SEQ ID NO: 3163) | 928 | 1083 |
| HUMSTPK13_T7 (SEQ ID NO: 3164) | 1148 | 1303 |
| HUMSTPK13_T8 (SEQ ID NO: 3165) | 1148 | 1303 |
| HUMSTPK13_T12 (SEQ ID NO: 3166) | 1308 | 1463 |
| HUMSTPK13_T15 (SEQ ID NO: 3167) | 988 | 1143 |
| HUMSTPK13_T16 (SEQ ID NO: 3168) | 712 | 867 |

This segment can be found in the following protein(s): HUMSTPK13_P2, HUMSTPK13_P4, HUMSTPK13_P6, HUMSTPK13_P5 and HUMSTPK13_P9.

Segment cluster HUMSTPK13_node_32 (SEQ ID NO:3176) according to the present invention is supported by 15 libraries. The number of libraries was determined as previously described. This segment can be found in the following transcript(s): HUMSTPK13_T2 (SEQ ID NO:3162). Table 3026 below describes the starting and ending position of this segment on each transcript.

TABLE 3026

Segment location on transcripts

| Transcript name | Segment starting position | Segment ending position |
|---|---|---|
| HUMSTPK13_T2 (SEQ ID NO: 3162) | 1382 | 1873 |

This segment can be found in the following protein(s): HUMSTPK13_P2.

Segment cluster HUMSTPK13_node_33 (SEQ ID NO:3177) according to the present invention is supported by 111 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3027 below describes the starting and ending position of this segment on each transcript.

TABLE 3027

Segment location on transcripts

| Transcript name | Segment starting position | Segment ending position |
|---|---|---|
| HUMSTPK13_T2 (SEQ ID NO: 3162) | 1874 | 2028 |
| HUMSTPK13_T4 (SEQ ID NO: 3163) | 1162 | 1316 |
| HUMSTPK13_T7 (SEQ ID NO: 3164) | 1382 | 1536 |
| HUMSTPK13_T8 (SEQ ID NO: 3165) | 1382 | 1536 |
| HUMSTPK13_T12 (SEQ ID NO: 3166) | 1542 | 1696 |
| HUMSTPK13_T15 (SEQ ID NO: 3167) | 1222 | 1376 |
| HUMSTPK13_T16 (SEQ ID NO: 3168) | 946 | 1100 |

This segment can be found in both coding and non-coding regions of transcript(s) as follows. The segment can be found in a non-coding region of transcript(s) that are related to the following protein(s): HUMSTPK13_P2. This segment can also be found in the following protein(s): HUMSTPK13_P4, HUMSTPK13_P6, HUMSTPK13_P5 and HUMSTPK13_P9, since it is in the coding region for the corresponding transcript.

Segment cluster HUMSTPK13_node_35 (SEQ ID NO:3178) according to the present invention is supported by 118 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3028 below describes the starting and ending position of this segment on each transcript.

TABLE 3028

Segment location on transcripts

| Transcript name | Segment starting position | Segment ending position |
|---|---|---|
| HUMSTPK13_T2 (SEQ ID NO: 3162) | 2029 | 2169 |
| HUMSTPK13_T4 (SEQ ID NO: 3163) | 1317 | 1457 |
| HUMSTPK13_T7 (SEQ ID NO: 3164) | 1638 | 1778 |
| HUMSTPK13_T8 (SEQ ID NO: 3165) | 1537 | 1677 |
| HUMSTPK13_T12 (SEQ ID NO: 3166) | 1697 | 1837 |
| HUMSTPK13_T15 (SEQ ID NO: 3167) | 1377 | 1517 |
| HUMSTPK13_T16 (SEQ ID NO: 3168) | 1101 | 1241 |

This segment can be found in both coding and non-coding regions of transcript(s) as follows. The segment can be found in a non-coding region of transcript(s) that are related to the following protein(s): HUMSTPK13_P2 and HUMSTPK13_P4. This segment can also be found in the following protein(s): HUMSTPK13_P6, HUMSTPK13_P5 and HUMSTPK13_P9, since it is in the coding region for the corresponding transcript.

Segment cluster HUMSTPK13_node_39 (SEQ ID NO:3179) according to the present invention is supported by 123 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3029 below describes the starting and ending position of this segment on each transcript.

TABLE 3029

Segment location on transcripts

| Transcript name | Segment starting position | Segment ending position |
|---|---|---|
| HUMSTPK13_T2 (SEQ ID NO: 3162) | 2212 | 2387 |
| HUMSTPK13_T4 (SEQ ID NO: 3163) | 1500 | 1675 |
| HUMSTPK13_T7 (SEQ ID NO: 3164) | 1821 | 1996 |
| HUMSTPK13_T8 (SEQ ID NO: 3165) | 1903 | 2078 |
| HUMSTPK13_T12 (SEQ ID NO: 3166) | 1880 | 2055 |
| HUMSTPK13_T15 (SEQ ID NO: 3167) | 1560 | 1735 |
| HUMSTPK13_T16 (SEQ ID NO: 3168) | 1284 | 1459 |

This segment can be found in both coding and non-coding regions of transcript(s) as follows. The segment can be found in a non-coding region of transcript(s) that are related to the following protein(s): HUMSTPK13_P2, HUMSTPK13_P4, HUMSTPK13_P6 and HUMSTPK13_P5. This segment can also be found in the following protein(s): HUMSTPK13_P9, since it is in the coding region for the corresponding transcript.

Segment cluster HUMSTPK13_node_42 (SEQ ID NO:3180) according to the present invention is supported by 121 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3030 below describes the starting and ending position of this segment on each transcript.

TABLE 3030

Segment location on transcripts

| Transcript name | Segment starting position | Segment ending position |
|---|---|---|
| HUMSTPK13_T2 (SEQ ID NO: 3162) | 2419 | 2618 |
| HUMSTPK13_T4 (SEQ ID NO: 3163) | 1707 | 1906 |
| HUMSTPK13_T7 (SEQ ID NO: 3164) | 2028 | 2227 |
| HUMSTPK13_T8 (SEQ ID NO: 3165) | 2110 | 2309 |
| HUMSTPK13_T12 (SEQ ID NO: 3166) | 2087 | 2286 |
| HUMSTPK13_T15 (SEQ ID NO: 3167) | 1767 | 1966 |
| HUMSTPK13_T16 (SEQ ID NO: 3168) | 1491 | 1690 |

This segment can be found in a non-coding region of transcript(s) that are related to the following protein(s): HUMSTPK13_P2, HUMSTPK13_P4, HUMSTPK13_P6, HUMSTPK13_P5 and HUMSTPK13_P9.

According to an optional embodiment of the present invention, short segments related to the above cluster are also provided. These segments are up to about 120 bp in length, and so are included in a separate description.

Segment cluster HUMSTPK13_node_1 (SEQ ID NO:3181) according to the present invention is supported by 51 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165) and HUMSTPK13_T12 (SEQ ID NO:3166). Table 3031 below describes the starting and ending position of this segment on each transcript.

TABLE 3031

Segment location on transcripts

| Transcript name | Segment starting position | Segment ending position |
|---|---|---|
| HUMSTPK13_T2 (SEQ ID NO: 3162) | 1 | 78 |
| HUMSTPK13_T4 (SEQ ID NO: 3163) | 1 | 78 |
| HUMSTPK13_T7 (SEQ ID NO: 3164) | 1 | 78 |
| HUMSTPK13_T8 (SEQ ID NO: 3165) | 1 | 78 |
| HUMSTPK13_T12 (SEQ ID NO: 3166) | 1 | 78 |

This segment can be found in both coding and non-coding regions of transcript(s) as follows. The segment can be found in a non-coding region of transcript(s) that are related to the following protein(s): HUMSTPK13_P2, HUMSTPK13_P6, HUMSTPK13_P5 and HUMSTPK13_P9. This segment can also be found in the following protein(s): HUMSTPK13_P4, since it is in the coding region for the corresponding transcript.

Segment cluster HUMSTPK13_node_2 (SEQ ID NO:3182) according to the present invention is supported by 94 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165) and HUMSTPK13_T12 (SEQ ID NO:3166). Table 3032 below describes the starting and ending position of this segment on each transcript.

TABLE 3032

Segment location on transcripts

| Transcript name | Segment starting position | Segment ending position |
| --- | --- | --- |
| HUMSTPK13_T2 (SEQ ID NO: 3162) | 79 | 173 |
| HUMSTPK13_T4 (SEQ ID NO: 3163) | 79 | 173 |
| HUMSTPK13_T7 (SEQ ID NO: 3164) | 79 | 173 |
| HUMSTPK13_T8 (SEQ ID NO: 3165) | 79 | 173 |
| HUMSTPK13_T12 (SEQ ID NO: 3166) | 79 | 173 |

This segment can be found in both coding and non-coding regions of transcript(s) as follows. The segment can be found in a non-coding region of transcript(s) that are related to the following protein(s): HUMSTPK13_P9. This segment can also be found in the following protein(s): HUMSTPK13_P2, HUMSTPK13_P4, HUMSTPK13_P6 and HUMSTPK13_P5, since it is in the coding region for the corresponding transcript.

Segment cluster HUMSTPK13_node_3 (SEQ ID NO:3183) according to the present invention is supported by 94 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165) and HUMSTPK13_T12 (SEQ ID NO:3166). Table 3033 below describes the starting and ending position of this segment on each transcript.

TABLE 3033

Segment location on transcripts

| Transcript name | Segment starting position | Segment ending position |
| --- | --- | --- |
| HUMSTPK13_T2 (SEQ ID NO: 3162) | 174 | 199 |
| HUMSTPK13_T4 (SEQ ID NO: 3163) | 174 | 199 |
| HUMSTPK13_T7 (SEQ ID NO: 3164) | 174 | 199 |
| HUMSTPK13_T8 (SEQ ID NO: 3165) | 174 | 199 |
| HUMSTPK13_T12 (SEQ ID NO: 3166) | 174 | 199 |

This segment can be found in both coding and non-coding regions of transcript(s) as follows. The segment can be found in a non-coding region of transcript(s) that are related to the following protein(s): HUMSTPK13_P9. This segment can also be found in the following protein(s): HUMSTPK13_P2, HUMSTPK13_P4, HUMSTPK13_P6 and HUMSTPK13_P5, since it is in the coding region for the corresponding transcript.

Segment cluster HUMSTPK13_node_5 (SEQ ID NO:3184) according to the present invention is supported by 95 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165) and HUMSTPK13_T12 (SEQ ID NO:3166). Table 3034 below describes the starting and ending position of this segment on each transcript.

TABLE 3034

Segment location on transcripts

| Transcript name | Segment starting position | Segment ending position |
| --- | --- | --- |
| HUMSTPK13_T2 (SEQ ID NO: 3162) | 200 | 294 |
| HUMSTPK13_T4 (SEQ ID NO: 3163) | 200 | 294 |
| HUMSTPK13_T7 (SEQ ID NO: 3164) | 200 | 294 |
| HUMSTPK13_T8 (SEQ ID NO: 3165) | 200 | 294 |
| HUMSTPK13_T12 (SEQ ID NO: 3166) | 200 | 294 |

This segment can be found in both coding and non-coding regions of transcript(s) as follows. The segment can be found in a non-coding region of transcript(s) that are related to the following protein(s): HUMSTPK13_P9. This segment can also be found in the following protein(s): HUMSTPK13_P2, HUMSTPK13_P4, HUMSTPK13_P6 and HUMSTPK13_P5, since it is in the coding region for the corresponding transcript.

Segment cluster HUMSTPK13_node_9 (SEQ ID NO:3185) according to the present invention is supported by 3 libraries. The number of libraries was determined as previously described. This segment can be found in the following transcript(s): HUMSTPK13_T16 (SEQ ID NO:3168). Table 3035 below describes the starting and ending position of this segment on each transcript.

TABLE 3035

Segment location on transcripts

| Transcript name | Segment starting position | Segment ending position |
| --- | --- | --- |
| HUMSTPK13_T16 (SEQ ID NO: 3168) | 1 | 83 |

This segment can be found in a non-coding region of transcript(s) that are related to the following protein(s): HUMSTPK13_P9.

Segment cluster HUMSTPK13_node_18 (SEQ ID NO:3186) according to the present invention is supported by 80 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3036 below describes the starting and ending position of this segment on each transcript.

TABLE 3036

Segment location on transcripts

| Transcript name | Segment starting position | Segment ending position |
| --- | --- | --- |
| HUMSTPK13_T2 (SEQ ID NO: 3162) | 834 | 927 |
| HUMSTPK13_T4 (SEQ ID NO: 3163) | 834 | 927 |
| HUMSTPK13_T7 (SEQ ID NO: 3164) | 834 | 927 |

TABLE 3036-continued

Segment location on transcripts

| Transcript name | Segment starting position | Segment ending position |
|---|---|---|
| HUMSTPK13_T8 (SEQ ID NO: 3165) | 834 | 927 |
| HUMSTPK13_T12 (SEQ ID NO: 3166) | 994 | 1087 |
| HUMSTPK13_T15 (SEQ ID NO: 3167) | 674 | 767 |
| HUMSTPK13_T16 (SEQ ID NO: 3168) | 398 | 491 |

This segment can be found in the following protein(s): HUMSTPK13_P2, HUMSTPK13_P4, HUMSTPK13_P6, HUMSTPK13_P5 and HUMSTPK13_P9.

Segment cluster HUMSTPK13_node_23 (SEQ ID NO:3187) according to the present invention is supported by 78 libraries. The number of libraries was determined as previously described. This segment can be found in the following transcript(s): HUMSTPK13_T2 (SEQ ID NO:3162), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3037 below describes the starting and ending position of this segment on each transcript.

TABLE 3037

Segment location on transcripts

| Transcript name | Segment starting position | Segment ending position |
|---|---|---|
| HUMSTPK13_T2 (SEQ ID NO: 3162) | 1113 | 1147 |
| HUMSTPK13_T7 (SEQ ID NO: 3164) | 1113 | 1147 |
| HUMSTPK13_T8 (SEQ ID NO: 3165) | 1113 | 1147 |
| HUMSTPK13_T12 (SEQ ID NO: 3166) | 1273 | 1307 |
| HUMSTPK13_T15 (SEQ ID NO: 3167) | 953 | 987 |
| HUMSTPK13_T16 (SEQ ID NO: 3168) | 677 | 711 |

This segment can be found in the following protein(s): HUMSTPK13_P2, HUMSTPK13_P6, HUMSTPK13_P5 and HUMSTPK13_P9.

Segment cluster HUMSTPK13_node_30 (SEQ ID NO:3188) according to the present invention is supported by 90 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3038 below describes the starting and ending position of this segment on each transcript.

TABLE 3038

Segment location on transcripts

| Transcript name | Segment starting position | Segment ending position |
|---|---|---|
| HUMSTPK13_T2 (SEQ ID NO: 3162) | 1304 | 1331 |
| HUMSTPK13_T4 (SEQ ID NO: 3163) | 1084 | 1111 |
| HUMSTPK13_T7 (SEQ ID NO: 3164) | 1304 | 1331 |
| HUMSTPK13_T8 (SEQ ID NO: 3165) | 1304 | 1331 |
| HUMSTPK13_T12 (SEQ ID NO: 3166) | 1464 | 1491 |
| HUMSTPK13_T15 (SEQ ID NO: 3167) | 1144 | 1171 |
| HUMSTPK13_T16 (SEQ ID NO: 3168) | 868 | 895 |

This segment can be found in the following protein(s): HUMSTPK13_P2, HUMSTPK13_P4, HUMSTPK13_P6, HUMSTPK13_P5 and HUMSTPK13_P9.

Segment cluster HUMSTPK13_node_31 (SEQ ID NO:3189) according to the present invention is supported by 94 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3039 below describes the starting and ending position of this segment on each transcript.

TABLE 3039

Segment location on transcripts

| Transcript name | Segment starting position | Segment ending position |
|---|---|---|
| HUMSTPK13_T2 (SEQ ID NO: 3162) | 1332 | 1381 |
| HUMSTPK13_T4 (SEQ ID NO: 3163) | 1112 | 1161 |
| HUMSTPK13_T7 (SEQ ID NO: 3164) | 1332 | 1381 |
| HUMSTPK13_T8 (SEQ ID NO: 3165) | 1332 | 1381 |
| HUMSTPK13_T12 (SEQ ID NO: 3166) | 1492 | 1541 |
| HUMSTPK13_T15 (SEQ ID NO: 3167) | 1172 | 1221 |
| HUMSTPK13_T16 (SEQ ID NO: 3168) | 896 | 945 |

This segment can be found in the following protein(s): HUMSTPK13_P2, HUMSTPK13_P4, HUMSTPK13_P6, HUMSTPK13_P5 and HUMSTPK13_P9.

Segment cluster HUMSTPK13_node_34 (SEQ ID NO:3190) according to the present invention is supported by 2 libraries. The number of libraries was determined as previously described. This segment can be found in the following transcript(s): HUMSTPK13_T7 (SEQ ID NO:3164). Table 3040 below describes the starting and ending position of this segment on each transcript.

TABLE 3040

Segment location on transcripts

| Transcript name | Segment starting position | Segment ending position |
|---|---|---|
| HUMSTPK13_T7 (SEQ ID NO: 3164) | 1537 | 1637 |

This segment can be found in the following protein(s): HUMSTPK13_P6.

Segment cluster HUMSTPK13_node_36 (SEQ ID NO:3191) according to the present invention is supported by 104 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3041 below describes the starting and ending position of this segment on each transcript.

TABLE 3041

Segment location on transcripts

| Transcript name | Segment starting position | Segment ending position |
|---|---|---|
| HUMSTPK13_T2 (SEQ ID NO: 3162) | 2170 | 2211 |
| HUMSTPK13_T4 (SEQ ID NO: 3163) | 1458 | 1499 |
| HUMSTPK13_T7 (SEQ ID NO: 3164) | 1779 | 1820 |
| HUMSTPK13_T8 (SEQ ID NO: 3165) | 1678 | 1719 |
| HUMSTPK13_T12 (SEQ ID NO: 3166) | 1838 | 1879 |
| HUMSTPK13_T15 (SEQ ID NO: 3167) | 1518 | 1559 |
| HUMSTPK13_T16 (SEQ ID NO: 3168) | 1242 | 1283 |

This segment can be found in both coding and non-coding regions of transcript(s) as follows. The segment can be found in a non-coding region of transcript(s) that are related to the following protein(s): HUMSTPK13_P2, HUMSTPK13_P4 and HUMSTPK13_P6. This segment can also be found in the following protein(s): HUMSTPK13_P5 and HUMSTPK13_P9, since it is in the coding region for the corresponding transcript.

Segment cluster HUMSTPK13_node_37 (SEQ ID NO:3192) according to the present invention is supported by 5 libraries. The number of libraries was determined as previously described. This segment can be found in the following transcript(s): HUMSTPK13_T8 (SEQ ID NO:3165). Table 3042 below describes the starting and ending position of this segment on each transcript.

TABLE 3042

Segment location on transcripts

| Transcript name | Segment starting position | Segment ending position |
|---|---|---|
| HUMSTPK13_T8 (SEQ ID NO: 3165) | 1720 | 1815 |

This segment can be found in the following protein(s): HUMSTPK13_P5.

Segment cluster HUMSTPK13_node_38 (SEQ ID NO:3193) according to the present invention is supported by 2 libraries. The number of libraries was determined as previously described. This segment can be found in the following transcript(s): HUMSTPK13_T8 (SEQ ID NO:3165). Table 3043 below describes the starting and ending position of this segment on each transcript.

TABLE 3043

Segment location on transcripts

| Transcript name | Segment starting position | Segment ending position |
|---|---|---|
| HUMSTPK13_T8 (SEQ ID NO: 3165) | 1816 | 1902 |

This segment can be found in a non-coding region of transcript(s) that are related to the following protein(s): HUMSTPK13_P5.

Segment cluster HUMSTPK13_node_40 (SEQ ID NO:3194) according to the present invention is supported by 110 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3044 below describes the starting and ending position of this segment on each transcript.

TABLE 3044

Segment location on transcripts

| Transcript name | Segment starting position | Segment ending position |
|---|---|---|
| HUMSTPK13_T2 (SEQ ID NO: 3162) | 2388 | 2418 |
| HUMSTPK13_T4 (SEQ ID NO: 3163) | 1676 | 1706 |
| HUMSTPK13_T7 (SEQ ID NO: 3164) | 1997 | 2027 |
| HUMSTPK13_T8 (SEQ ID NO: 3165) | 2079 | 2109 |
| HUMSTPK13_T12 (SEQ ID NO: 3166) | 2056 | 2086 |
| HUMSTPK13_T15 (SEQ ID NO: 3167) | 1736 | 1766 |
| HUMSTPK13_T16 (SEQ ID NO: 3168) | 1460 | 1490 |

This segment can be found in both coding and non-coding regions of transcript(s) as follows. The segment can be found in a non-coding region of transcript(s) that are related to the following protein(s): HUMSTPK13_P2, HUMSTPK13_P4, HUMSTPK13_P6 and HUMSTPK13_P5. This segment can also be found in the following protein(s): HUMSTPK13_P9, since it is in the coding region for the corresponding transcript.

Segment cluster HUMSTPK13_node_43 (SEQ ID NO:3195) according to the present invention is supported by 103 libraries. The number of libraries was determined as previously described. This segment can be found in the following transcript(s): HUMSTPK13_T2 (SEQ ID NO:3162), HUMSTPK13_T4 (SEQ ID NO:3163), HUMSTPK13_T7 (SEQ ID NO:3164), HUMSTPK13_T8 (SEQ ID NO:3165), HUMSTPK13_T12 (SEQ ID NO:3166), HUMSTPK13_T15 (SEQ ID NO:3167) and HUMSTPK13_T16 (SEQ ID NO:3168). Table 3045 below describes the starting and ending position of this segment on each transcript.

TABLE 3045

Segment location on transcripts

| Transcript name | Segment starting position | Segment ending position |
|---|---|---|
| HUMSTPK13_T2 (SEQ ID NO: 3162) | 2619 | 2719 |
| HUMSTPK13_T4 (SEQ ID NO: 3163) | 1907 | 2007 |
| HUMSTPK13_T7 (SEQ ID NO: 3164) | 2228 | 2328 |
| HUMSTPK13_T8 (SEQ ID NO: 3165) | 2310 | 2410 |
| HUMSTPK13_T12 (SEQ ID NO: 3166) | 2287 | 2387 |
| HUMSTPK13_T15 (SEQ ID NO: 3167) | 1967 | 2067 |
| HUMSTPK13_T16 (SEQ ID NO: 3168) | 1691 | 1791 |

This segment can be found in a non-coding region of transcript(s) that are related to the following protein(s): HUMSTPK13_P2, HUMSTPK13_P4, HUMSTPK13_P6, HUMSTPK13_P5 and HUMSTPK13_P9.

Description for Cluster HUMTLEII

Cluster HUMTLEII features 10 transcript(s) and 49 segment(s) of interest, the names for which are given in Tables 3046 and 3047, respectively, the sequences themselves are given at the end of the application. The selected protein variants are given in Table 3048.

TABLE 3046

Transcripts of interest

Transcript Name

HUMTLEII_T1 (SEQ ID NO: 3196)
HUMTLEII_T2 (SEQ ID NO: 3197)
HUMTLEII_T3 (SEQ ID NO: 3198)
HUMTLEII_T4 (SEQ ID NO: 3199)
HUMTLEII_T10 (SEQ ID NO: 3200)
HUMTLEII_T14 (SEQ ID NO: 3201)
HUMTLEII_T28 (SEQ ID NO: 3202)
HUMTLEII_T34 (SEQ ID NO: 3203)
HUMTLEII_T37 (SEQ ID NO: 3204)
HUMTLEII_T39 (SEQ ID NO: 3205)

TABLE 3047

Segments of interest

Segment Name

HUMTLEII_node_4 (SEQ ID NO: 3206)
HUMTLEII_node_16 (SEQ ID NO: 3207)
HUMTLEII_node_19 (SEQ ID NO: 3208)
HUMTLEII_node_21 (SEQ ID NO: 3209)
HUMTLEII_node_49 (SEQ ID NO: 3210)
HUMTLEII_node_60 (SEQ ID NO: 3211)
HUMTLEII_node_64 (SEQ ID NO: 3212)
HUMTLEII_node_75 (SEQ ID NO: 3213)
HUMTLEII_node_77 (SEQ ID NO: 3214)
HUMTLEII_node_79 (SEQ ID NO: 3215)
HUMTLEII_node_81 (SEQ ID NO: 3216)
HUMTLEII_node_88 (SEQ ID NO: 3217)
HUMTLEII_node_0 (SEQ ID NO: 3218)
HUMTLEII_node_5 (SEQ ID NO: 3219)
HUMTLEII_node_7 (SEQ ID NO: 3220)
HUMTLEII_node_9 (SEQ ID NO: 3221)
HUMTLEII_node_11 (SEQ ID NO: 3222)
HUMTLEII_node_13 (SEQ ID NO: 3223)
HUMTLEII_node_15 (SEQ ID NO: 3224)
HUMTLEII_node_17 (SEQ ID NO: 3225)
HUMTLEII_node_20 (SEQ ID NO: 3226)
HUMTLEII_node_23 (SEQ ID NO: 3227)
HUMTLEII_node_24 (SEQ ID NO: 3228)

TABLE 3047-continued

Segments of interest

Segment Name

HUMTLEII_node_29 (SEQ ID NO: 3229)
HUMTLEII_node_30 (SEQ ID NO: 3230)
HUMTLEII_node_32 (SEQ ID NO: 3231)
HUMTLEII_node_35 (SEQ ID NO: 3232)
HUMTLEII_node_36 (SEQ ID NO: 3233)
HUMTLEII_node_38 (SEQ ID NO: 3234)
HUMTLEII_node_39 (SEQ ID NO: 3235)
HUMTLEII_node_40 (SEQ ID NO: 3236)
HUMTLEII_node_46 (SEQ ID NO: 3237)
HUMTLEII_node_50 (SEQ ID NO: 3238)
HUMTLEII_node_53 (SEQ ID NO: 3239)
HUMTLEII_node_59 (SEQ ID NO: 3240)
HUMTLEII_node_61 (SEQ ID NO: 3241)
HUMTLEII_node_62 (SEQ ID NO: 3242)
HUMTLEII_node_65 (SEQ ID NO: 3243)
HUMTLEII_node_66 (SEQ ID NO: 3244)
HUMTLEII_node_67 (SEQ ID NO: 3245)
HUMTLEII_node_68 (SEQ ID NO: 3246)
HUMTLEII_node_71 (SEQ ID NO: 3247)
HUMTLEII_node_72 (SEQ ID NO: 3248)
HUMTLEII_node_73 (SEQ ID NO: 3249)
HUMTLEII_node_74 (SEQ ID NO: 3250)
HUMTLEII_node_80 (SEQ ID NO: 3251)
HUMTLEII_node_85 (SEQ ID NO: 3252)
HUMTLEII_node_90 (SEQ ID NO: 3253)
HUMTLEII_node_91 (SEQ ID NO: 3254)

TABLE 3048

Proteins of interest

| Protein Name | Corresponding Transcript(s) |
|---|---|
| HUMTLEII_P1 | HUMTLEII_T1 (SEQ ID NO: 3196) |
| HUMTLEII_P2 | HUMTLEII_T2 (SEQ ID NO: 3197); HUMTLEII_T3 (SEQ ID NO: 3198); HUMTLEII_T4 (SEQ ID NO: 3199) |
| HUMTLEII_P6 | HUMTLEII_T10 (SEQ ID NO: 3200) |
| HUMTLEII_P10 | HUMTLEII_T14 (SEQ ID NO: 3201) |
| HUMTLEII_P22 | HUMTLEII_T28 (SEQ ID NO: 3202) |
| HUMTLEII_P28 | HUMTLEII_T34 (SEQ ID NO: 3203) |
| HUMTLEII_P30 | HUMTLEII_T37 (SEQ ID NO: 3204) |
| HUMTLEII_P31 | HUMTLEII_T39 (SEQ ID NO: 3205) |

These sequences are variants of the known protein Transducin-like enhancer protein 2 (SwissProt accession identifier TLE2_HUMAN; known also according to the synonyms ESG2), referred to herein as the previously known protein.

Protein Transducin-like enhancer protein 2 is known or believed to have the following function(s): Transcriptional corepressor that binds to a number of transcription factors. Inhibits the transcriptional activation mediated by CTNNB1 and TCF family members in Wnt signaling. The effects of full-length TLE family members may be modulated by association with dominant-negative AES (By similarity). The sequence for protein Transducin-like enhancer protein 2 is given at the end of the application, as "Transducin-like enhancer protein 2 amino acid sequence". Known polymorphisms for this sequence are as shown in Table 3049.

TABLE 3049

Amino acid mutations for Known Protein

| SNP position(s) on amino acid sequence | Comment |
|---|---|
| 280 | G -> R |
| 328 | A -> L |

TABLE 3049-continued

Amino acid mutations for Known Protein

| SNP position(s) on amino acid sequence | Comment |
|---|---|
| 441 | G -> D |
| 495 | A -> R |
| 636-637 | LG -> PC |
| 660 | R -> G |
| 681 | S -> P |

Protein Transducin-like enhancer protein 2 localization is believed to be Nuclear.

The following GO Annotation(s) apply to the previously known protein. The following annotation(s) were found: transcription regulation; signal transduction; frizzled receptor signaling pathway, which are annotation(s) related to Biological Process; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMTLEII features 49 segment(s), which were listed in Table 3047 above and for which the sequence(s) are given at the end of the application. These segment(s) are portions of nucleic acid sequence(s) which are described herein separately because they are of particular interest. A description of each segment according to the present invention is now provided.

Segment cluster HUMTLEII_node_4 (SEQ ID NO:3206) according to the present invention is supported by 13 libraries. The number of libraries was determined as previously described. This segment can be found in the following transcript(s): HUMTLEII_T2 (SEQ ID NO:3197), HUMTLEII_T4 (SEQ ID NO:3199) and HUMTLEII_T10 (SEQ ID NO:3200). Table 3050 below describes the starting and ending position of this segment on each transcript.

TABLE 3050

Segment location on transcripts

| Transcript name | Segment starting position | Segment ending position |
|---|---|---|
| HUMTLEII_T2 (SEQ ID NO: 3197) | 1 | 272 |
| HUMTLEII_T4 (SEQ ID NO: 3199) | 1 | 272 |
| HUMTLEII_T10 (SEQ ID NO: 3200) | 1 | 272 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P6, since it is in the coding region for the corresponding transcript.

Segment cluster HUMTLEII_node_16 (SEQ ID NO:3207) according to the present invention is supported by 5 libraries. The number of libraries was determined as previously described. This segment can be found in the following transcript(s): HUMTLEII_T3 (SEQ ID NO:3198). Table 3051 below describes the starting and ending position of this segment on each transcript.

TABLE 3051

Segment location on transcripts

| Transcript name | Segment starting position | Segment ending position |
|---|---|---|
| HUMTLEII_T3 (SEQ ID NO: 3198) | 78 | 817 |

This segment can be found in a non-coding region of transcript(s) that are related to the following protein(s): HUMTLEII_P2.

Segment cluster HUMTLEII_node_19 (SEQ ID NO:3208) according to the present invention is supported by 13 libraries. The number of libraries was determined as previously described. This segment can be found in the following transcript(s): HUMTLEII_T2 (SEQ ID NO:3197), HUMTLEII_T3 (SEQ ID NO:3198) and HUMTLEII_T4 (SEQ ID NO:3199). Table 3052 below describes the starting and ending position of this segment on each transcript.

TABLE 3052

Segment location on transcripts

| Transcript name | Segment starting position | Segment ending position |
|---|---|---|
| HUMTLEII_T2 (SEQ ID NO: 3197) | 643 | 874 |
| HUMTLEII_T3 (SEQ ID NO: 3198) | 893 | 1124 |
| HUMTLEII_T4 (SEQ ID NO: 3199) | 643 | 874 |

This segment can be found in a non-coding region of transcript(s) that are related to the following protein(s): HUMTLEII_P2.

Segment cluster HUMTLEII_node_21 (SEQ ID NO:3209) according to the present invention is supported by 28 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199) and HUMTLEII_T10 (SEQ ID NO:3200). Table 3053 below describes the starting and ending position of this segment on each transcript.

TABLE 3053

Segment location on transcripts

| Transcript name | Segment starting position | Segment ending position |
|---|---|---|
| HUMTLEII_T1 (SEQ ID NO: 3196) | 491 | 618 |
| HUMTLEII_T2 (SEQ ID NO: 3197) | 931 | 1058 |
| HUMTLEII_T3 (SEQ ID NO: 3198) | 1181 | 1308 |
| HUMTLEII_T4 (SEQ ID NO: 3199) | 931 | 1058 |
| HUMTLEII_T10 (SEQ ID NO: 3200) | 699 | 826 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_49 (SEQ ID NO:3210) according to the present invention is supported by 43 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199) HUMTLEII_T10 (SEQ ID NO:3200) and HUMTLEII_T14 (SEQ ID NO:3201). Table 3054 below describes the starting and ending position of this segment on each transcript.

TABLE 3054

Segment location on transcripts

| Transcript name | Segment starting position | Segment ending position |
|---|---|---|
| HUMTLEII_T1 (SEQ ID NO: 3196) | 1081 | 1205 |
| HUMTLEII_T2 (SEQ ID NO: 3197) | 1521 | 1645 |
| HUMTLEII_T3 (SEQ ID NO: 3198) | 1771 | 1895 |
| HUMTLEII_T4 (SEQ ID NO: 3199) | 1501 | 1625 |
| HUMTLEII_T10 (SEQ ID NO: 3200) | 1339 | 1463 |
| HUMTLEII_T14 (SEQ ID NO: 3201) | 561 | 685 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_60 (SEQ ID NO:3211) according to the present invention is supported by 55 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3055 below describes the starting and ending position of this segment on each transcript.

TABLE 3055

Segment location on transcripts

| Transcript name | Segment starting position | Segment ending position |
|---|---|---|
| HUMTLEII_T1 (SEQ ID NO: 3196) | 1373 | 1511 |
| HUMTLEII_T2 (SEQ ID NO: 3197) | 1813 | 1951 |
| HUMTLEII_T3 (SEQ ID NO: 3198) | 2063 | 2201 |
| HUMTLEII_T4 (SEQ ID NO: 3199) | 1793 | 1931 |
| HUMTLEII_T10 (SEQ ID NO: 3200) | 1631 | 1769 |
| HUMTLEII_T14 (SEQ ID NO: 3201) | 853 | 991 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_64 (SEQ ID NO:3212) according to the present invention is supported by 2 libraries. The number of libraries was determined as previously described. This segment can be found in the following transcript(s): HUMTLEII_T28 (SEQ ID NO:3202) and HUMTLEII_T39 (SEQ ID NO:3205). Table 3056 below describes the starting and ending position of this segment on each transcript.

TABLE 3056

Segment location on transcripts

| Transcript name | Segment starting position | Segment ending position |
|---|---|---|
| HUMTLEII_T28 (SEQ ID NO: 3202) | 1 | 250 |
| HUMTLEII_T39 (SEQ ID NO: 3205) | 1 | 250 |

This segment can be found in a non-coding region of transcript(s) that are related to the following protein(s): HUMTLEII_P22 and HUMTLEII_P31.

Segment cluster HUMTLEII_node_75 (SEQ ID NO:3213) according to the present invention is supported by 1 libraries. The number of libraries was determined as previously described. This segment can be found in the following transcript(s): HUMTLEII_T39 (SEQ ID NO:3205). Table 3057 below describes the starting and ending position of this segment on each transcript.

TABLE 3057

Segment location on transcripts

| Transcript name | Segment starting position | Segment ending position |
|---|---|---|
| HUMTLEII_T39 (SEQ ID NO: 3205) | 647 | 1338 |

This segment can be found in the following protein(s): HUMTLEII_P31.

Segment cluster HUMTLEII_node_77 (SEQ ID NO:3214) according to the present invention is supported by 2 libraries. The number of libraries was determined as previously described. This segment can be found in the following transcript(s): HUMTLEII_T37 (SEQ ID NO:3204). Table 3058 below describes the starting and ending position of this segment on each transcript.

TABLE 3058

Segment location on transcripts

| Transcript name | Segment starting position | Segment ending position |
|---|---|---|
| HUMTLEII_T37 (SEQ ID NO: 3204) | 1 | 728 |

This segment can be found in the following protein(s): HUMTLEII_P30.

Segment cluster HUMTLEII_node_79 (SEQ ID NO:3215) according to the present invention is supported by 13 libraries. The number of libraries was determined as previously described. This segment can be found in the following transcript(s): HUMTLEII_T34 (SEQ ID NO:3203). Table 3059 below describes the starting and ending position of this segment on each transcript.

TABLE 3059

Segment location on transcripts

| Transcript name | Segment starting position | Segment ending position |
|---|---|---|
| HUMTLEII_T34 (SEQ ID NO: 3203) | 1 | 1045 |

This segment can be found in a non-coding region of transcript(s) that are related to the following protein(s): HUMTLEII_P28.

Segment cluster HUMTLEII_node_81 (SEQ ID NO:3216) according to the present invention is supported by 108 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3060 below describes the starting and ending position of this segment on each transcript.

TABLE 3060

Segment location on transcripts

| Transcript name | Segment starting position | Segment ending position |
|---|---|---|
| HUMTLEII_T1 (SEQ ID NO: 3196) | 1995 | 2115 |
| HUMTLEII_T2 (SEQ ID NO: 3197) | 2435 | 2555 |
| HUMTLEII_T3 (SEQ ID NO: 3198) | 2685 | 2805 |
| HUMTLEII_T4 (SEQ ID NO: 3199) | 2415 | 2535 |
| HUMTLEII_T10 (SEQ ID NO: 3200) | 2253 | 2373 |
| HUMTLEII_T14 (SEQ ID NO: 3201) | 1475 | 1595 |
| HUMTLEII_T28 (SEQ ID NO: 3202) | 677 | 797 |
| HUMTLEII_T34 (SEQ ID NO: 3203) | 1076 | 1196 |
| HUMTLEII_T37 (SEQ ID NO: 3204) | 759 | 879 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22, HUMTLEII_P28 and HUMTLEII_P30, since it is in the coding region for the corresponding transcript.

Segment cluster HUMTLEII_node_88 (SEQ ID NO:3217) according to the present invention is supported by 94 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3061 below describes the starting and ending position of this segment on each transcript.

TABLE 3061

Segment location on transcripts

| Transcript name | Segment starting position | Segment ending position |
|---|---|---|
| HUMTLEII_T1 (SEQ ID NO: 3196) | 2193 | 2385 |
| HUMTLEII_T2 (SEQ ID NO: 3197) | 2633 | 2825 |
| HUMTLEII_T3 (SEQ ID NO: 3198) | 2883 | 3075 |
| HUMTLEII_T4 (SEQ ID NO: 3199) | 2613 | 2805 |
| HUMTLEII_T10 (SEQ ID NO: 3200) | 2451 | 2643 |
| HUMTLEII_T14 (SEQ ID NO: 3201) | 1673 | 1865 |
| HUMTLEII_T28 (SEQ ID NO: 3202) | 875 | 1067 |
| HUMTLEII_T34 (SEQ ID NO: 3203) | 1274 | 1466 |
| HUMTLEII_T37 (SEQ ID NO: 3204) | 957 | 1149 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22, HUMTLEII_P28 and HUMTLEII_P30, since it is in the coding region for the corresponding transcript.

According to an optional embodiment of the present invention, short segments related to the above cluster are also provided. These segments are up to about 120 bp in length, and so are included in a separate description.

Segment cluster HUMTLEII_node_0 (SEQ ID NO:3218) according to the present invention is supported by 1 libraries. The number of libraries was determined as previously described. This segment can be found in the following transcript(s): HUMTLEII_T1 (SEQ ID NO:3196). Table 3062 below describes the starting and ending position of this segment on each transcript.

TABLE 3062

Segment location on transcripts

| Transcript name | Segment starting position | Segment ending position |
|---|---|---|
| HUMTLEII_T1 (SEQ ID NO: 3196) | 1 | 64 |

This segment can be found in the following protein(s): HUMTLEII_P1.

Segment cluster HUMTLEII_node_5 (SEQ ID NO:3219) according to the present invention can be found in the following transcript(s): HUMTLEII_T1 (SEQ ID NO:3196), HUMTLEII_T2 (SEQ ID NO:3197), HUMTLEII_T4 (SEQ ID NO:3199) and HUMTLEII_T10 (SEQ ID NO:3200). Table 3063 below describes the starting and ending position of this segment on each transcript.

TABLE 3063

Segment location on transcripts

| Transcript name | Segment starting position | Segment ending position |
|---|---|---|
| HUMTLEII_T1 (SEQ ID NO: 3196) | 65 | 89 |
| HUMTLEII_T2 (SEQ ID NO: 3197) | 273 | 297 |
| HUMTLEII_T4 (SEQ ID NO: 3199) | 273 | 297 |
| HUMTLEII_T10 (SEQ ID NO: 3200) | 273 | 297 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_7 (SEQ ID NO:3220) according to the present invention is supported by 19 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T4 (SEQ ID NO:3199) and HUMTLEII_T10 (SEQ ID NO:3200). Table 3064 below describes the starting and ending position of this segment on each transcript.

TABLE 3064

Segment location on transcripts

| Transcript name | Segment starting position | Segment ending position |
|---|---|---|
| HUMTLEII_T1 (SEQ ID NO: 3196) | 90 | 187 |
| HUMTLEII_T2 (SEQ ID NO: 3197) | 298 | 395 |
| HUMTLEII_T4 (SEQ ID NO: 3199) | 298 | 395 |
| HUMTLEII_T10 (SEQ ID NO: 3200) | 298 | 395 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_9 (SEQ ID NO:3221) according to the present invention is supported by 23 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T4 (SEQ ID NO:3199) and HUMTLEII_T10 (SEQ ID NO:3200). Table 3065 below describes the starting and ending position of this segment on each transcript.

TABLE 3065

Segment location on transcripts

| Transcript name | Segment starting position | Segment ending position |
|---|---|---|
| HUMTLEII_T1 (SEQ ID NO: 3196) | 188 | 251 |
| HUMTLEII_T2 (SEQ ID NO: 3197) | 396 | 459 |
| HUMTLEII_T4 (SEQ ID NO: 3199) | 396 | 459 |
| HUMTLEII_T10 (SEQ ID NO: 3200) | 396 | 459 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_11 (SEQ ID NO:3222) according to the present invention is supported by 26 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T4 (SEQ ID NO:3199) and HUMTLEII_T10 (SEQ ID NO:3200). Table 3066 below describes the starting and ending position of this segment on each transcript.

TABLE 3066

Segment location on transcripts

| Transcript name | Segment starting position | Segment ending position |
|---|---|---|
| HUMTLEII_T1 (SEQ ID NO: 3196) | 252 | 296 |
| HUMTLEII_T2 (SEQ ID NO: 3197) | 460 | 504 |
| HUMTLEII_T4 (SEQ ID NO: 3199) | 460 | 504 |
| HUMTLEII_T10 (SEQ ID NO: 3200) | 460 | 504 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_13 (SEQ ID NO:3223) according to the present invention is supported by 26 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T4 (SEQ ID NO:3199) and HUMTLEII_T10 (SEQ ID NO:3200). Table 3067 below describes the starting and ending position of this segment on each transcript.

TABLE 3067

Segment location on transcripts

| Transcript name | Segment starting position | Segment ending position |
|---|---|---|
| HUMTLEII_T1 (SEQ ID NO: 3196) | 297 | 359 |
| HUMTLEII_T2 (SEQ ID NO: 3197) | 505 | 567 |
| HUMTLEII_T4 (SEQ ID NO: 3199) | 505 | 567 |
| HUMTLEII_T10 (SEQ ID NO: 3200) | 505 | 567 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_15 (SEQ ID NO:3224) according to the present invention is supported by 2 libraries. The number of libraries was determined as previously described. This segment can be found in the following transcript(s): HUMTLEII_T3 (SEQ ID NO:3198). Table 3068 below describes the starting and ending position of this segment on each transcript.

TABLE 3068

Segment location on transcripts

| Transcript name | Segment starting position | Segment ending position |
|---|---|---|
| HUMTLEII_T3 (SEQ ID NO: 3198) | 1 | 77 |

This segment can be found in a non-coding region of transcript(s) that are related to the following protein(s): HUMTLEII_P2.

Segment cluster HUMTLEII_node_17 (SEQ ID NO:3225) according to the present invention is supported by 33 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199) and HUMTLEII_T10 (SEQ ID NO:3200). Table 3069 below describes the starting and ending position of this segment on each transcript.

TABLE 3069

Segment location on transcripts

| Transcript name | Segment starting position | Segment ending position |
|---|---|---|
| HUMTLEII_T1 (SEQ ID NO: 3196) | 360 | 434 |
| HUMTLEII_T2 (SEQ ID NO: 3197) | 568 | 642 |
| HUMTLEII_T3 (SEQ ID NO: 3198) | 818 | 892 |
| HUMTLEII_T4 (SEQ ID NO: 3199) | 568 | 642 |
| HUMTLEII_T10 (SEQ ID NO: 3200) | 568 | 642 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_20 (SEQ ID NO:3226) according to the present invention is supported by 27 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199) and HUMTLEII_T10 (SEQ ID NO:3200). Table 3070 below describes the starting and ending position of this segment on each transcript.

TABLE 3070

Segment location on transcripts

| Transcript name | Segment starting position | Segment ending position |
|---|---|---|
| HUMTLEII_T1 (SEQ ID NO: 3196) | 435 | 490 |
| HUMTLEII_T2 (SEQ ID NO: 3197) | 875 | 930 |
| HUMTLEII_T3 (SEQ ID NO: 3198) | 1125 | 1180 |
| HUMTLEII_T4 (SEQ ID NO: 3199) | 875 | 930 |
| HUMTLEII_T10 (SEQ ID NO: 3200) | 643 | 698 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1 and HUMTLEII_P6, since it is in the coding region for the corresponding transcript.

Segment cluster HUMTLEII_node_23 (SEQ ID NO:3227) according to the present invention is supported by 3 libraries. The number of libraries was determined as previously described. This segment can be found in the following transcript(s): HUMTLEII_T14 (SEQ ID NO:3201). Table 3071 below describes the starting and ending position of this segment on each transcript.

TABLE 3071

Segment location on transcripts

| Transcript name | Segment starting position | Segment ending position |
|---|---|---|
| HUMTLEII_T14 (SEQ ID NO: 3201) | 1 | 98 |

This segment can be found in the following protein(s): HUMTLEII_P10.

Segment cluster HUMTLEII_node_24 (SEQ ID NO:3228) according to the present invention can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T10 (SEQ ID NO:3200) and HUMTLEII_T14 (SEQ ID NO:3201). Table 3072 below describes the starting and ending position of this segment on each transcript.

TABLE 3072

Segment location on transcripts

| Transcript name | Segment starting position | Segment ending position |
|---|---|---|
| HUMTLEII_T1 (SEQ ID NO: 3196) | 619 | 638 |
| HUMTLEII_T2 (SEQ ID NO: 3197) | 1059 | 1078 |
| HUMTLEII_T3 (SEQ ID NO: 3198) | 1309 | 1328 |
| HUMTLEII_T10 (SEQ ID NO: 3200) | 827 | 846 |
| HUMTLEII_T14 (SEQ ID NO: 3201) | 99 | 118 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_29 (SEQ ID NO:3229) according to the present invention is supported by 40 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3073 below describes the starting and ending position of this segment on each transcript.

TABLE 3073

Segment location on transcripts

| Transcript name | Segment starting position | Segment ending position |
|---|---|---|
| HUMTLEII_T1 (SEQ ID NO: 3196) | 639 | 741 |
| HUMTLEII_T2 (SEQ ID NO: 3197) | 1079 | 1181 |
| HUMTLEII_T3 (SEQ ID NO: 3198) | 1329 | 1431 |
| HUMTLEII_T4 (SEQ ID NO: 3199) | 1059 | 1161 |
| HUMTLEII_T10 (SEQ ID NO: 3200) | 847 | 949 |
| HUMTLEII_T14 (SEQ ID NO: 3201) | 119 | 221 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_30 (SEQ ID NO:3230) according to the present invention can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3074 below describes the starting and ending position of this segment on each transcript.

TABLE 3074

Segment location on transcripts

| Transcript name | Segment starting position | Segment ending position |
|---|---|---|
| HUMTLEII_T1 (SEQ ID NO: 3196) | 742 | 746 |
| HUMTLEII_T2 (SEQ ID NO: 3197) | 1182 | 1186 |
| HUMTLEII_T3 (SEQ ID NO: 3198) | 1432 | 1436 |
| HUMTLEII_T4 (SEQ ID NO: 3199) | 1162 | 1166 |
| HUMTLEII_T10 (SEQ ID NO: 3200) | 950 | 954 |
| HUMTLEII_T14 (SEQ ID NO: 3201) | 222 | 226 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_32 (SEQ ID NO:3231) according to the present invention is supported by 36 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3075 below describes the starting and ending position of this segment on each transcript.

TABLE 3075

Segment location on transcripts

| Transcript name | Segment starting position | Segment ending position |
|---|---|---|
| HUMTLEII_T1 (SEQ ID NO: 3196) | 747 | 791 |
| HUMTLEII_T2 (SEQ ID NO: 3197) | 1187 | 1231 |
| HUMTLEII_T3 (SEQ ID NO: 3198) | 1437 | 1481 |
| HUMTLEII_T4 (SEQ ID NO: 3199) | 1167 | 1211 |
| HUMTLEII_T10 (SEQ ID NO: 3200) | 955 | 999 |
| HUMTLEII_T14 (SEQ ID NO: 3201) | 227 | 271 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_35 (SEQ ID NO:3232) according to the present invention is supported by 41 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3076 below describes the starting and ending position of this segment on each transcript.

TABLE 3076

Segment location on transcripts

| Transcript name | Segment starting position | Segment ending position |
|---|---|---|
| HUMTLEII_T1 (SEQ ID NO: 3196) | 792 | 839 |
| HUMTLEII_T2 (SEQ ID NO: 3197) | 1232 | 1279 |
| HUMTLEII_T3 (SEQ ID NO: 3198) | 1482 | 1529 |
| HUMTLEII_T4 (SEQ ID NO: 3199) | 1212 | 1259 |
| HUMTLEII_T10 (SEQ ID NO: 3200) | 1000 | 1047 |
| HUMTLEII_T14 (SEQ ID NO: 3201) | 272 | 319 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_36 (SEQ ID NO:3233) according to the present invention is supported by 35 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3077 below describes the starting and ending position of this segment on each transcript.

TABLE 3077

Segment location on transcripts

| Transcript name | Segment starting position | Segment ending position |
|---|---|---|
| HUMTLEII_T1 (SEQ ID NO: 3196) | 840 | 941 |
| HUMTLEII_T2 (SEQ ID NO: 3197) | 1280 | 1381 |
| HUMTLEII_T3 (SEQ ID NO: 3198) | 1530 | 1631 |
| HUMTLEII_T4 (SEQ ID NO: 3199) | 1260 | 1361 |
| HUMTLEII_T10 (SEQ ID NO: 3200) | 1048 | 1149 |
| HUMTLEII_T14 (SEQ ID NO: 3201) | 320 | 421 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_38 (SEQ ID NO:3234) according to the present invention can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3078 below describes the starting and ending position of this segment on each transcript.

TABLE 3078

Segment location on transcripts

| Transcript name | Segment starting position | Segment ending position |
|---|---|---|
| HUMTLEII_T1 (SEQ ID NO: 3196) | 942 | 958 |
| HUMTLEII_T2 (SEQ ID NO: 3197) | 1382 | 1398 |
| HUMTLEII_T3 (SEQ ID NO: 3198) | 1632 | 1648 |
| HUMTLEII_T4 (SEQ ID NO: 3199) | 1362 | 1378 |
| HUMTLEII_T10 (SEQ ID NO: 3200) | 1150 | 1166 |
| HUMTLEII_T14 (SEQ ID NO: 3201) | 422 | 438 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_39 (SEQ ID NO:3235) according to the present invention is supported by 39 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3079 below describes the starting and ending position of this segment on each transcript.

TABLE 3079

Segment location on transcripts

| Transcript name | Segment starting position | Segment ending position |
|---|---|---|
| HUMTLEII_T1 (SEQ ID NO: 3196) | 959 | 1021 |
| HUMTLEII_T2 (SEQ ID NO: 3197) | 1399 | 1461 |
| HUMTLEII_T3 (SEQ ID NO: 3198) | 1649 | 1711 |
| HUMTLEII_T4 (SEQ ID NO: 3199) | 1379 | 1441 |
| HUMTLEII_T10 (SEQ ID NO: 3200) | 1167 | 1229 |
| HUMTLEII_T14 (SEQ ID NO: 3201) | 439 | 501 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_40 (SEQ ID NO:3236) according to the present invention is supported by 37 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3080 below describes the starting and ending position of this segment on each transcript.

TABLE 3080

Segment location on transcripts

| Transcript name | Segment starting position | Segment ending position |
|---|---|---|
| HUMTLEII_T1 (SEQ ID NO: 3196) | 1022 | 1080 |
| HUMTLEII_T2 (SEQ ID NO: 3197) | 1462 | 1520 |
| HUMTLEII_T3 (SEQ ID NO: 3198) | 1712 | 1770 |
| HUMTLEII_T4 (SEQ ID NO: 3199) | 1442 | 1500 |
| HUMTLEII_T10 (SEQ ID NO: 3200) | 1230 | 1288 |
| HUMTLEII_T14 (SEQ ID NO: 3201) | 502 | 560 |

This segment can be found in both coding and non-coding regions of transcript(s) as follows. The segment can be found in a non-coding region of transcript(s) that are related to the following protein(s): HUMTLEII_P2. This segment can also be found in the following protein(s): HUMTLEII_P1, HUMTLEII_P6 and HUMTLEII_P10, since it is in the coding region for the corresponding transcript.

Segment cluster HUMTLEII_node_46 (SEQ ID NO:3237) according to the present invention is supported by 1 libraries. The number of libraries was determined as previously described. This segment can be found in the following transcript(s): HUMTLEII_T10 (SEQ ID NO:3200). Table 3081 below describes the starting and ending position of this segment on each transcript.

TABLE 3081

Segment location on transcripts

| Transcript name | Segment starting position | Segment ending position |
|---|---|---|
| HUMTLEII_T10 (SEQ ID NO: 3200) | 1289 | 1338 |

This segment can be found in the following protein(s): HUMTLEII_P6.

Segment cluster HUMTLEII_node_50 (SEQ ID NO:3238) according to the present invention is supported by 31 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3082 below describes the starting and ending position of this segment on each transcript.

TABLE 3082

Segment location on transcripts

| Transcript name | Segment starting position | Segment ending position |
|---|---|---|
| HUMTLEII_T1 (SEQ ID NO: 3196) | 1206 | 1241 |
| HUMTLEII_T2 (SEQ ID NO: 3197) | 1646 | 1681 |
| HUMTLEII_T3 (SEQ ID NO: 3198) | 1896 | 1931 |
| HUMTLEII_T4 (SEQ ID NO: 3199) | 1626 | 1661 |
| HUMTLEII_T10 (SEQ ID NO: 3200) | 1464 | 1499 |
| HUMTLEII_T14 (SEQ ID NO: 3201) | 686 | 721 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_53 (SEQ ID NO:3239) according to the present invention is supported by 42 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3083 below describes the starting and ending position of this segment on each transcript.

TABLE 3083

Segment location on transcripts

| Transcript name | Segment starting position | Segment ending position |
|---|---|---|
| HUMTLEII_T1 (SEQ ID NO: 3196) | 1242 | 1318 |
| HUMTLEII_T2 (SEQ ID NO: 3197) | 1682 | 1758 |
| HUMTLEII_T3 (SEQ ID NO: 3198) | 1932 | 2008 |
| HUMTLEII_T4 (SEQ ID NO: 3199) | 1662 | 1738 |
| HUMTLEII_T10 (SEQ ID NO: 3200) | 1500 | 1576 |
| HUMTLEII_T14 (SEQ ID NO: 3201) | 722 | 798 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 3084.

TABLE 3084

Oligonucleotides related to this segment

| Oligonucleotide name | Overexpressed in cancers | Chip reference |
|---|---|---|
| HUMTLEII_0_15_0 | lung malignant tumors | LUN |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_59 (SEQ ID NO:3240) according to the present invention is supported by 49 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3085 below describes the starting and ending position of this segment on each transcript.

TABLE 3085

Segment location on transcripts

| Transcript name | Segment starting position | Segment ending position |
|---|---|---|
| HUMTLEII_T1 (SEQ ID NO: 3196) | 1319 | 1372 |
| HUMTLEII_T2 (SEQ ID NO: 3197) | 1759 | 1812 |
| HUMTLEII_T3 (SEQ ID NO: 3198) | 2009 | 2062 |
| HUMTLEII_T4 (SEQ ID NO: 3199) | 1739 | 1792 |
| HUMTLEII_T10 (SEQ ID NO: 3200) | 1577 | 1630 |
| HUMTLEII_T14 (SEQ ID NO: 3201) | 799 | 852 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_61 (SEQ ID NO:3241) according to the present invention is supported by 50 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3086 below describes the starting and ending position of this segment on each transcript.

TABLE 3086

Segment location on transcripts

| Transcript name | Segment starting position | Segment ending position |
| --- | --- | --- |
| HUMTLEII_T1 (SEQ ID NO: 3196) | 1512 | 1537 |
| HUMTLEII_T2 (SEQ ID NO: 3197) | 1952 | 1977 |
| HUMTLEII_T3 (SEQ ID NO: 3198) | 2202 | 2227 |
| HUMTLEII_T4 (SEQ ID NO: 3199) | 1932 | 1957 |
| HUMTLEII_T10 (SEQ ID NO: 3200) | 1770 | 1795 |
| HUMTLEII_T14 (SEQ ID NO: 3201) | 992 | 1017 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_62 (SEQ ID NO:3242) according to the present invention is supported by 49 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200) and HUMTLEII_T14 (SEQ ID NO:3201). Table 3087 below describes the starting and ending position of this segment on each transcript.

TABLE 3087

Segment location on transcripts

| Transcript name | Segment starting position | Segment ending position |
| --- | --- | --- |
| HUMTLEII_T1 (SEQ ID NO: 3196) | 1538 | 1568 |
| HUMTLEII_T2 (SEQ ID NO: 3197) | 1978 | 2008 |
| HUMTLEII_T3 (SEQ ID NO: 3198) | 2228 | 2258 |
| HUMTLEII_T4 (SEQ ID NO: 3199) | 1958 | 1988 |
| HUMTLEII_T10 (SEQ ID NO: 3200) | 1796 | 1826 |
| HUMTLEII_T14 (SEQ ID NO: 3201) | 1018 | 1048 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2 and HUMTLEII_P10, since it is in the coding region for the corresponding transcript.

Segment cluster HUMTLEII_node_65 (SEQ ID NO:3243) according to the present invention is supported by 66 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3088 below describes the starting and ending position of this segment on each transcript.

TABLE 3088

Segment location on transcripts

| Transcript name | Segment starting position | Segment ending position |
| --- | --- | --- |
| HUMTLEII_T1 (SEQ ID NO: 3196) | 1569 | 1675 |
| HUMTLEII_T2 (SEQ ID NO: 3197) | 2009 | 2115 |
| HUMTLEII_T3 (SEQ ID NO: 3198) | 2259 | 2365 |
| HUMTLEII_T4 (SEQ ID NO: 3199) | 1989 | 2095 |
| HUMTLEII_T10 (SEQ ID NO: 3200) | 1827 | 1933 |
| HUMTLEII_T14 (SEQ ID NO: 3201) | 1049 | 1155 |
| HUMTLEII_T28 (SEQ ID NO: 3202) | 251 | 357 |
| HUMTLEII_T39 (SEQ ID NO: 3205) | 251 | 357 |

This segment can be found in both coding and non-coding regions of transcript(s) as follows. The segment can be found in a non-coding region of transcript(s) that are related to the following protein(s): HUMTLEII_P6, HUMTLEII_P22 and HUMTLEII_P31. This segment can also be found in the following protein(s): HUMTLEII_P1, HUMTLEII_P2 and HUMTLEII_P10, since it is in the coding region for the corresponding transcript.

Segment cluster HUMTLEII_node_66 (SEQ ID NO:3244) according to the present invention is supported by 65 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3089 below describes the starting and ending position of this segment on each transcript.

TABLE 3089

Segment location on transcripts

| Transcript name | Segment starting position | Segment ending position |
| --- | --- | --- |
| HUMTLEII_T1 (SEQ ID NO: 3196) | 1676 | 1714 |
| HUMTLEII_T2 (SEQ ID NO: 3197) | 2116 | 2154 |
| HUMTLEII_T3 (SEQ ID NO: 3198) | 2366 | 2404 |
| HUMTLEII_T4 (SEQ ID NO: 3199) | 2096 | 2134 |
| HUMTLEII_T10 (SEQ ID NO: 3200) | 1934 | 1972 |
| HUMTLEII_T14 (SEQ ID NO: 3201) | 1156 | 1194 |
| HUMTLEII_T28 (SEQ ID NO: 3202) | 358 | 396 |
| HUMTLEII_T39 (SEQ ID NO: 3205) | 358 | 396 |

This segment can be found in both coding and non-coding regions of transcript(s) as follows. The segment can be found in a non-coding region of transcript(s) that are related to the following protein(s): HUMTLEII_P6, HUMTLEII_P22 and HUMTLEII_P31. This segment can also be found in the following protein(s): HUMTLEII_P1, HUMTLEII_P2 and HUMTLEII_P10, since it is in the coding region for the corresponding transcript.

Segment cluster HUMTLEII_node_67 (SEQ ID NO:3245) according to the present invention is supported by 61 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14

(SEQ ID NO:3201), HUMTLEII_T28 (SEQ ID NO:3202) and HUMTLEII_T39 (SEQ ID NO:3205). Table 3090 below describes the starting and ending position of this segment on each transcript.

TABLE 3090

Segment location on transcripts

| Transcript name | Segment starting position | Segment ending position |
|---|---|---|
| HUMTLEII_T1 (SEQ ID NO: 3196) | 1715 | 1748 |
| HUMTLEII_T2 (SEQ ID NO: 3197) | 2155 | 2188 |
| HUMTLEII_T3 (SEQ ID NO: 3198) | 2405 | 2438 |
| HUMTLEII_T4 (SEQ ID NO: 3199) | 2135 | 2168 |
| HUMTLEII_T10 (SEQ ID NO: 3200) | 1973 | 2006 |
| HUMTLEII_T14 (SEQ ID NO: 3201) | 1195 | 1228 |
| HUMTLEII_T28 (SEQ ID NO: 3202) | 397 | 430 |
| HUMTLEII_T39 (SEQ ID NO: 3205) | 397 | 430 |

This segment can be found in both coding and non-coding regions of transcript(s) as follows. The segment can be found in a non-coding region of transcript(s) that are related to the following protein(s): HUMTLEII_P6, HUMTLEII_P22 and HUMTLEII_P31. This segment can also be found in the following protein(s): HUMTLEII_P1, HUMTLEII_P2 and HUMTLEII_P10, since it is in the coding region for the corresponding transcript.

Segment cluster HUMTLEII_node_68 (SEQ ID NO:3246) according to the present invention is supported by 71 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3091 below describes the starting and ending position of this segment on each transcript.

TABLE 3091

Segment location on transcripts

| Transcript name | Segment starting position | Segment ending position |
|---|---|---|
| HUMTLEII_T1 (SEQ ID NO: 3196) | 1749 | 1816 |
| HUMTLEII_T2 (SEQ ID NO: 3197) | 2189 | 2256 |
| HUMTLEII_T3 (SEQ ID NO: 3198) | 2439 | 2506 |
| HUMTLEII_T4 (SEQ ID NO: 3199) | 2169 | 2236 |
| HUMTLEII_T10 (SEQ ID NO: 3200) | 2007 | 2074 |
| HUMTLEII_T14 (SEQ ID NO: 3201) | 1229 | 1296 |
| HUMTLEII_T28 (SEQ ID NO: 3202) | 431 | 498 |
| HUMTLEII_T39 (SEQ ID NO: 3205) | 431 | 498 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22 and HUMTLEII_P31, since it is in the coding region for the corresponding transcript.

Segment cluster HUMTLEII_node_71 (SEQ ID NO:3247) according to the present invention is supported by 78 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3092 below describes the starting and ending position of this segment on each transcript.

TABLE 3092

Segment location on transcripts

| Transcript name | Segment starting position | Segment ending position |
|---|---|---|
| HUMTLEII_T1 (SEQ ID NO: 3196) | 1817 | 1846 |
| HUMTLEII_T2 (SEQ ID NO: 3197) | 2257 | 2286 |
| HUMTLEII_T3 (SEQ ID NO: 3198) | 2507 | 2536 |
| HUMTLEII_T4 (SEQ ID NO: 3199) | 2237 | 2266 |
| HUMTLEII_T10 (SEQ ID NO: 3200) | 2075 | 2104 |
| HUMTLEII_T14 (SEQ ID NO: 3201) | 1297 | 1326 |
| HUMTLEII_T28 (SEQ ID NO: 3202) | 499 | 528 |
| HUMTLEII_T39 (SEQ ID NO: 3205) | 499 | 528 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22 and HUMTLEII_P31, since it is in the coding region for the corresponding transcript.

Segment cluster HUMTLEII_node_72 (SEQ ID NO:3248) according to the present invention is supported by 79 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3093 below describes the starting and ending position of this segment on each transcript.

TABLE 3093

Segment location on transcripts

| Transcript name | Segment starting position | Segment ending position |
|---|---|---|
| HUMTLEII_T1 (SEQ ID NO: 3196) | 1847 | 1873 |
| HUMTLEII_T2 (SEQ ID NO: 3197) | 2287 | 2313 |
| HUMTLEII_T3 (SEQ ID NO: 3198) | 2537 | 2563 |
| HUMTLEII_T4 (SEQ ID NO: 3199) | 2267 | 2293 |
| HUMTLEII_T10 (SEQ ID NO: 3200) | 2105 | 2131 |
| HUMTLEII_T14 (SEQ ID NO: 3201) | 1327 | 1353 |
| HUMTLEII_T28 (SEQ ID NO: 3202) | 529 | 555 |
| HUMTLEII_T39 (SEQ ID NO: 3205) | 529 | 555 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22 and HUMTLEII_P31, since it is in the coding region for the corresponding transcript.

Segment cluster HUMTLEII_node_73 (SEQ ID NO:3249) according to the present invention is supported by 83 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3094 below describes the starting and ending position of this segment on each transcript.

TABLE 3094

Segment location on transcripts

| Transcript name | Segment starting position | Segment ending position |
|---|---|---|
| HUMTLEII_T1 (SEQ ID NO: 3196) | 1874 | 1937 |
| HUMTLEII_T2 (SEQ ID NO: 3197) | 2314 | 2377 |
| HUMTLEII_T3 (SEQ ID NO: 3198) | 2564 | 2627 |
| HUMTLEII_T4 (SEQ ID NO: 3199) | 2294 | 2357 |
| HUMTLEII_T10 (SEQ ID NO: 3200) | 2132 | 2195 |
| HUMTLEII_T14 (SEQ ID NO: 3201) | 1354 | 1417 |
| HUMTLEII_T28 (SEQ ID NO: 3202) | 556 | 619 |
| HUMTLEII_T39 (SEQ ID NO: 3205) | 556 | 619 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22 and HUMTLEII_P31, since it is in the coding region for the corresponding transcript.

Segment cluster HUMTLEII_node_74 (SEQ ID NO:3250) according to the present invention is supported by 78 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202) and HUMTLEII_T39 (SEQ ID NO:3205). Table 3095 below describes the starting and ending position of this segment on each transcript.

TABLE 3095

Segment location on transcripts

| Transcript name | Segment starting position | Segment ending position |
|---|---|---|
| HUMTLEII_T1 (SEQ ID NO: 3196) | 1938 | 1964 |
| HUMTLEII_T2 (SEQ ID NO: 3197) | 2378 | 2404 |
| HUMTLEII_T3 (SEQ ID NO: 3198) | 2628 | 2654 |
| HUMTLEII_T4 (SEQ ID NO: 3199) | 2358 | 2384 |
| HUMTLEII_T10 (SEQ ID NO: 3200) | 2196 | 2222 |
| HUMTLEII_T14 (SEQ ID NO: 3201) | 1418 | 1444 |
| HUMTLEII_T28 (SEQ ID NO: 3202) | 620 | 646 |
| HUMTLEII_T39 (SEQ ID NO: 3205) | 620 | 646 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1, HUMTLEII_P2, HUMTLEII_P10, HUMTLEII_P22 and HUMTLEII_P31, since it is in the coding region for the corresponding transcript.

Segment cluster HUMTLEII_node_80 (SEQ ID NO:3251) according to the present invention is supported by 86 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3096 below describes the starting and ending position of this segment on each transcript.

TABLE 3096

Segment location on transcripts

| Transcript name | Segment starting position | Segment ending position |
|---|---|---|
| HUMTLEII_T1 (SEQ ID NO: 3196) | 1965 | 1994 |
| HUMTLEII_T2 (SEQ ID NO: 3197) | 2405 | 2434 |
| HUMTLEII_T3 (SEQ ID NO: 3198) | 2655 | 2684 |
| HUMTLEII_T4 (SEQ ID NO: 3199) | 2385 | 2414 |
| HUMTLEII_T10 (SEQ ID NO: 3200) | 2223 | 2252 |
| HUMTLEII_T14 (SEQ ID NO: 3201) | 1445 | 1474 |
| HUMTLEII_T28 (SEQ ID NO: 3202) | 647 | 676 |
| HUMTLEII_T34 (SEQ ID NO: 3203) | 1046 | 1075 |
| HUMTLEII_T37 (SEQ ID NO: 3204) | 729 | 758 |

This segment can be found in both coding and non-coding regions of transcript(s) as follows. The segment can be found in a non-coding region of transcript(s) that are related to the following protein(s): HUMTLEII_P6 and HUMTLEII_P28. This segment can also be found in the following protein(s): HUMTLEII_P1, HUMTLEII_P2, HUMTLEII_P10, HUMTLEII_P22 and HUMTLEII_P30, since it is in the coding region for the corresponding transcript.

Segment cluster HUMTLEII_node_85 (SEQ ID NO:3252) according to the present invention is supported by 83 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3097 below describes the starting and ending position of this segment on each transcript.

TABLE 3097

Segment location on transcripts

| Transcript name | Segment starting position | Segment ending position |
|---|---|---|
| HUMTLEII_T1 (SEQ ID NO: 3196) | 2116 | 2192 |
| HUMTLEII_T2 (SEQ ID NO: 3197) | 2556 | 2632 |
| HUMTLEII_T3 (SEQ ID NO: 3198) | 2806 | 2882 |
| HUMTLEII_T4 (SEQ ID NO: 3199) | 2536 | 2612 |
| HUMTLEII_T10 (SEQ ID NO: 3200) | 2374 | 2450 |
| HUMTLEII_T14 (SEQ ID NO: 3201) | 1596 | 1672 |
| HUMTLEII_T28 (SEQ ID NO: 3202) | 798 | 874 |

TABLE 3097-continued

Segment location on transcripts

| Transcript name | Segment starting position | Segment ending position |
|---|---|---|
| HUMTLEII_T34 (SEQ ID NO: 3203) | 1197 | 1273 |
| HUMTLEII_T37 (SEQ ID NO: 3204) | 880 | 956 |

This segment can be found in both coding and non-coding regions of transcript(s) as follows. The segment can be found in a non-coding region of transcript(s) that are related to the following protein(s): HUMTLEII_P6. This segment can also be found in the following protein(s): HUMTLEII_P1 HUMTLEII_P2, HUMTLEII_P10, HUMTLEII_P22, HUMTLEII_P28 and HUMTLEII_P30, since it is in the coding region for the corresponding transcript.

Segment cluster HUMTLEII_node_90 (SEQ ID NO:3253) according to the present invention is supported by 70 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3098 below describes the starting and ending position of this segment on each transcript.

TABLE 3098

Segment location on transcripts

| Transcript name | Segment starting position | Segment ending position |
|---|---|---|
| HUMTLEII_T1 (SEQ ID NO: 3196) | 2386 | 2421 |
| HUMTLEII_T2 (SEQ ID NO: 3197) | 2826 | 2861 |
| HUMTLEII_T3 (SEQ ID NO: 3198) | 3076 | 3111 |
| HUMTLEII_T4 (SEQ ID NO: 3199) | 2806 | 2841 |
| HUMTLEII_T10 (SEQ ID NO: 3200) | 2644 | 2679 |
| HUMTLEII_T14 (SEQ ID NO: 3201) | 1866 | 1901 |
| HUMTLEII_T28 (SEQ ID NO: 3202) | 1068 | 1103 |
| HUMTLEII_T34 (SEQ ID NO: 3203) | 1467 | 1502 |
| HUMTLEII_T37 (SEQ ID NO: 3204) | 1150 | 1185 |

This segment can be found in a non-coding region of transcript(s) that are related to the following protein(s): HUMTLEII_P1, HUMTLEII_P2, HUMTLEII_P6, HUMTLEII_P10, HUMTLEII_P22, HUMTLEII_P28 and HUMTLEII_P30.

Segment cluster HUMTLEII_node_91 (SEQ ID NO:3254) according to the present invention is supported by 61 libraries. The number of libraries was determined as previously described. This segment can be found in the following transcript(s): HUMTLEII_T1 (SEQ ID NO:3196), HUMTLEII_T2 (SEQ ID NO:3197), HUMTLEII_T3 (SEQ ID NO:3198), HUMTLEII_T4 (SEQ ID NO:3199), HUMTLEII_T10 (SEQ ID NO:3200), HUMTLEII_T14 (SEQ ID NO:3201), HUMTLEII_T28 (SEQ ID NO:3202), HUMTLEII_T34 (SEQ ID NO:3203) and HUMTLEII_T37 (SEQ ID NO:3204). Table 3099 below describes the starting and ending position of this segment on each transcript.

TABLE 3099

Segment location on transcripts

| Transcript name | Segment starting position | Segment ending position |
|---|---|---|
| HUMTLEII_T1 (SEQ ID NO: 3196) | 2422 | 2516 |
| HUMTLEII_T2 (SEQ ID NO: 3197) | 2862 | 2956 |
| HUMTLEII_T3 (SEQ ID NO: 3198) | 3112 | 3206 |
| HUMTLEII_T4 (SEQ ID NO: 3199) | 2842 | 2936 |
| HUMTLEII_T10 (SEQ ID NO: 3200) | 2680 | 2774 |
| HUMTLEII_T14 (SEQ ID NO: 3201) | 1902 | 1996 |
| HUMTLEII_T28 (SEQ ID NO: 3202) | 1104 | 1198 |
| HUMTLEII_T34 (SEQ ID NO: 3203) | 1503 | 1597 |
| HUMTLEII_T37 (SEQ ID NO: 3204) | 1186 | 1280 |

This segment can be found in a non-coding region of transcript(s) that are related to the following protein(s): HUMTLEII_P1, HUMTLEII_P2, HUMTLEII_P6, HUMTLEII_P10, HUMTLEII_P22, HUMTLEII_P28 and HUMTLEII_P30.

Description for Cluster HUMTYRKIN

Cluster HUMTYRKIN features 5 transcript(s) and 33 segment(s) of interest, the names for which are given in Tables 3100 and 3101, respectively, the sequences themselves are given at the end of the application. The selected protein variants are given in Table 3102.

TABLE 3100

Transcripts of interest
Transcript Name

HUMTYRKIN_T1 (SEQ ID NO: 3255)
HUMTYRKIN_T5 (SEQ ID NO: 3256)
HUMTYRKIN_T6 (SEQ ID NO: 3257)
HUMTYRKIN_T21 (SEQ ID NO: 3258)
HUMTYRKIN_T25 (SEQ ID NO: 3259)

TABLE 3101

Segments of interest
Segment Name

HUMTYRKIN_node_0 (SEQ ID NO: 3260)
HUMTYRKIN_node_6 (SEQ ID NO: 3261)
HUMTYRKIN_node_12 (SEQ ID NO: 3262)
HUMTYRKIN_node_17 (SEQ ID NO: 3263)
HUMTYRKIN_node_18 (SEQ ID NO: 3264)
HUMTYRKIN_node_23 (SEQ ID NO: 3265)
HUMTYRKIN_node_26 (SEQ ID NO: 3266)
HUMTYRKIN_node_28 (SEQ ID NO: 3267)
HUMTYRKIN_node_30 (SEQ ID NO: 3268)
HUMTYRKIN_node_34 (SEQ ID NO: 3269)
HUMTYRKIN_node_42 (SEQ ID NO: 3270)
HUMTYRKIN_node_46 (SEQ ID NO: 3271)
HUMTYRKIN_node_47 (SEQ ID NO: 3272)
HUMTYRKIN_node_48 (SEQ ID NO: 3273)
HUMTYRKIN_node_49 (SEQ ID NO: 3274)
HUMTYRKIN_node_50 (SEQ ID NO: 3275)
HUMTYRKIN_node_2 (SEQ ID NO: 3276)
HUMTYRKIN_node_4 (SEQ ID NO: 3277)
HUMTYRKIN_node_13 (SEQ ID NO: 3278)
HUMTYRKIN_node_15 (SEQ ID NO: 3279)
HUMTYRKIN_node_20 (SEQ ID NO: 3280)
HUMTYRKIN_node_22 (SEQ ID NO: 3281)
HUMTYRKIN_node_24 (SEQ ID NO: 3282)
HUMTYRKIN_node_25 (SEQ ID NO: 3283)
HUMTYRKIN_node_27 (SEQ ID NO: 3284)
HUMTYRKIN_node_29 (SEQ ID NO: 3285)
HUMTYRKIN_node_31 (SEQ ID NO: 3286)
HUMTYRKIN_node_32 (SEQ ID NO: 3287)

TABLE 3101-continued

Segments of interest
Segment Name

HUMTYRKIN_node_33 (SEQ ID NO: 3288)
HUMTYRKIN_node_38 (SEQ ID NO: 3289)
HUMTYRKIN_node_39 (SEQ ID NO: 3290)
HUMTYRKIN_node_44 (SEQ ID NO: 3291)
HUMTYRKIN_node_45 (SEQ ID NO: 3292)

TABLE 3102

Proteins of interest

| Protein Name | Corresponding Transcript(s) |
| --- | --- |
| HUMTYRKIN_P1 | HUMTYRKIN_T5 (SEQ ID NO: 3256); HUMTYRKIN_T6 (SEQ ID NO: 3257); HUMTYRKIN_T21 (SEQ ID NO: 3258) |
| HUMTYRKIN_P2 | HUMTYRKIN_T1 (SEQ ID NO: 3255); HUMTYRKIN_T25 (SEQ ID NO: 3259) |

These sequences are variants of the known protein Tyrosine-protein kinase ZAP-70 (SwissProt accession identifier ZA70_HUMAN; known also according to the synonyms EC 2.7.1.112; 70 kDa zeta-associated protein; Syk-related tyrosine kinase), referred to herein as the previously known protein.

Protein Tyrosine-protein kinase ZAP-70 is known or believed to have the following function(s): Associates with the T-cell antigen receptor zeta chain (CD3Z). Plays a role in lymphocyte activation. The sequence for protein Tyrosine-protein kinase ZAP-70 is given at the end of the application, as "Tyrosine-protein kinase ZAP-70 amino acid sequence". Known polymorphisms for this sequence are as shown in Table 3103.

TABLE 3103

Amino acid mutations for Known Protein

| SNP position(s) on amino acid sequence | Comment |
| --- | --- |
| 465 | R -> H (in STD). /FTId = VAR_015538. |
| 518 | S -> R (in STD). /FTId = VAR_006351. |
| 319 | Y->F: Inhibition of activation. |

The following GO Annotation(s) apply to the previously known protein. The following annotation(s) were found: protein amino acid phosphorylation; immune response; protein kinase cascade, which are annotation(s) related to Biological Process; and protein tyrosine kinase; protein binding; ATP binding; transferase, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMTYRKIN features 33 segment(s), which were listed in Table 3101 above and for which the sequence(s) are given at the end of the application. These segment(s) are portions of nucleic acid sequence(s) which are described herein separately because they are of particular interest. A description of each segment according to the present invention is now provided.

Segment cluster HUMTYRKIN_node_0 (SEQ ID NO:3260) according to the present invention is supported by 22 libraries. The number of libraries was determined as previously described. This segment can be found in the following transcript(s): HUMTYRKIN_T5 (SEQ ID NO:3256), HUMTYRKIN_T6 (SEQ ID NO:3257) and HUMTYRKIN_T21 (SEQ ID NO:3258). Table 3104 below describes the starting and ending position of this segment on each transcript.

TABLE 3104

Segment location on transcripts

| Transcript name | Segment starting position | Segment ending position |
| --- | --- | --- |
| HUMTYRKIN_T5 (SEQ ID NO: 3256) | 1 | 310 |
| HUMTYRKIN_T6 (SEQ ID NO: 3257) | 1 | 310 |
| HUMTYRKIN_T21 (SEQ ID NO: 3258) | 1 | 310 |

This segment can be found in a non-coding region of transcript(s) that are related to the following protein(s): HUMTYRKIN_P1.

Segment cluster HUMTYRKIN_node_6 (SEQ ID NO:3261) according to the present invention is supported by 30 libraries. The number of libraries was determined as previously described. This segment can be found in the following transcript(s): HUMTYRKIN_T5 (SEQ ID NO:3256), HUMTYRKIN_T6 (SEQ ID NO:3257) and HUMTYRKIN_T21 (SEQ ID NO:3258). Table 3105 below describes the starting and ending position of this segment on each transcript.

TABLE 3105

Segment location on transcripts

| Transcript name | Segment starting position | Segment ending position |
| --- | --- | --- |
| HUMTYRKIN_T5 (SEQ ID NO: 3256) | 495 | 917 |
| HUMTYRKIN_T6 (SEQ ID NO: 3257) | 390 | 812 |
| HUMTYRKIN_T21 (SEQ ID NO: 3258) | 390 | 812 |

This segment can be found in the following protein(s): HUMTYRKIN_P1.

Segment cluster HUMTYRKIN_node_12 (SEQ ID NO:3262) according to the present invention is supported by 21 libraries. The number of libraries was determined as previously described. This segment can be found in the following transcript(s): HUMTYRKIN_T5 (SEQ ID NO:3256), HUMTYRKIN_T6 (SEQ ID NO:3257) and HUMTYRKIN_T21 (SEQ ID NO:3258). Table 3106 below describes the starting and ending position of this segment on each transcript.

TABLE 3106

Segment location on transcripts

| Transcript name | Segment starting position | Segment ending position |
| --- | --- | --- |
| HUMTYRKIN_T5 (SEQ ID NO: 3256) | 918 | 1068 |
| HUMTYRKIN_T6 (SEQ ID NO: 3257) | 813 | 963 |
| HUMTYRKIN_T21 (SEQ ID NO: 3258) | 813 | 963 |

This segment can be found in the following protein(s): HUMTYRKIN_P1.

Segment cluster HUMTYRKIN_node__17 (SEQ ID NO:3263) according to the present invention is supported by 7 libraries. The number of libraries was determined as previously described. This segment can be found in the following transcript(s): HUMTYRKIN_T1 (SEQ ID NO:3255). Table 3107 below describes the starting and ending position of this segment on each transcript.

TABLE 3107

Segment location on transcripts

| Transcript name | Segment starting position | Segment ending position |
|---|---|---|
| HUMTYRKIN_T1 (SEQ ID NO: 3255) | 1 | 1675 |

This segment can be found in a non-coding region of transcript(s) that are related to the following protein(s): HUMTYRKIN_P2.

Segment cluster HUMTYRKIN_node__18 (SEQ ID NO:3264) according to the present invention is supported by 29 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3108 below describes the starting and ending position of this segment on each transcript.

TABLE 3108

Segment location on transcripts

| Transcript name | Segment starting position | Segment ending position |
|---|---|---|
| HUMTYRKIN_T1 (SEQ ID NO: 3255) | 1676 | 1814 |
| HUMTYRKIN_T5 (SEQ ID NO: 3256) | 1079 | 1217 |
| HUMTYRKIN_T6 (SEQ ID NO: 3257) | 974 | 1112 |
| HUMTYRKIN_T21 (SEQ ID NO: 3258) | 974 | 1112 |
| HUMTYRKIN_T25 (SEQ ID NO: 3259) | 99 | 237 |

This segment can be found in both coding and non-coding regions of transcript(s) as follows. The segment can be found in a non-coding region of transcript(s) that are related to the following protein(s): HUMTYRKIN_P2. This segment can also be found in the following protein(s): HUMTYRKIN_P1, since it is in the coding region for the corresponding transcript.

Segment cluster HUMTYRKIN_node__23 (SEQ ID NO:3265) according to the present invention is supported by 15 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T21 (SEQ ID NO:3258). Table 3109 below describes the starting and ending position of this segment on each transcript.

TABLE 3109

Segment location on transcripts

| Transcript name | Segment starting position | Segment ending position |
|---|---|---|
| HUMTYRKIN_T1 (SEQ ID NO: 3255) | 1950 | 2149 |
| HUMTYRKIN_T5 (SEQ ID NO: 3256) | 1353 | 1552 |
| HUMTYRKIN_T6 (SEQ ID NO: 3257) | 1248 | 1447 |
| HUMTYRKIN_T21 (SEQ ID NO: 3258) | 1248 | 1447 |

This segment can be found in both coding and non-coding regions of transcript(s) as follows. The segment can be found in a non-coding region of transcript(s) that are related to the following protein(s): HUMTYRKIN_P2. This segment can also be found in the following protein(s): HUMTYRKIN_P1, since it is in the coding region for the corresponding transcript.

Segment cluster HUMTYRKIN_node__26 (SEQ ID NO:3266) according to the present invention is supported by 16 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T21 (SEQ ID NO:3258). Table 3110 below describes the starting and ending position of this segment on each transcript.

TABLE 3110

Segment location on transcripts

| Transcript name | Segment starting position | Segment ending position |
|---|---|---|
| HUMTYRKIN_T1 (SEQ ID NO: 3255) | 2202 | 3125 |
| HUMTYRKIN_T5 (SEQ ID NO: 3256) | 1605 | 2528 |
| HUMTYRKIN_T6 (SEQ ID NO: 3257) | 1500 | 2423 |
| HUMTYRKIN_T21 (SEQ ID NO: 3258) | 1500 | 2423 |

This segment can be found in a non-coding region of transcript(s) that are related to the following protein(s): HUMTYRKIN_P2 and HUMTYRKIN_P1.

Segment cluster HUMTYRKIN_node__28 (SEQ ID NO:3267) according to the present invention is supported by 40 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3111 below describes the starting and ending position of this segment on each transcript.

TABLE 3111

Segment location on transcripts

| Transcript name | Segment starting position | Segment ending position |
|---|---|---|
| HUMTYRKIN_T1 (SEQ ID NO: 3255) | 3144 | 3308 |
| HUMTYRKIN_T5 (SEQ ID NO: 3256) | 2547 | 2711 |
| HUMTYRKIN_T6 (SEQ ID NO: 3257) | 2442 | 2606 |
| HUMTYRKIN_T21 (SEQ ID NO: 3258) | 2442 | 2606 |
| HUMTYRKIN_T25 (SEQ ID NO: 3259) | 412 | 576 |

This segment can be found in a non-coding region of transcript(s) that are related to the following protein(s): HUMTYRKIN_P2 and HUMTYRKIN_P1.

Segment cluster HUMTYRKIN_node_30 (SEQ ID NO:3268) according to the present invention is supported by 21 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3112 below describes the starting and ending position of this segment on each transcript.

TABLE 3112

Segment location on transcripts

| Transcript name | Segment starting position | Segment ending position |
|---|---|---|
| HUMTYRKIN_T1 (SEQ ID NO: 3255) | 3319 | 3855 |
| HUMTYRKIN_T5 (SEQ ID NO: 3256) | 2722 | 3258 |
| HUMTYRKIN_T6 (SEQ ID NO: 3257) | 2617 | 3153 |
| HUMTYRKIN_T21 (SEQ ID NO: 3258) | 2617 | 3153 |
| HUMTYRKIN_T25 (SEQ ID NO: 3259) | 587 | 1123 |

This segment can be found in a non-coding region of transcript(s) that are related to the following protein(s): HUMTYRKIN_P2 and HUMTYRKIN_P1.

Segment cluster HUMTYRKIN_node_34 (SEQ ID NO:3269) according to the present invention is supported by 2 libraries. The number of libraries was determined as previously described. This segment can be found in the following transcript(s): HUMTYRKIN_T21 (SEQ ID NO:3258). Table 3113 below describes the starting and ending position of this segment on each transcript.

TABLE 3113

Segment location on transcripts

| Transcript name | Segment starting position | Segment ending position |
|---|---|---|
| HUMTYRKIN_T21 (SEQ ID NO: 3258) | 3361 | 3891 |

This segment can be found in a non-coding region of transcript(s) that are related to the following protein(s): HUMTYRKIN_P1.

Segment cluster HUMTYRKIN_node_42 (SEQ ID NO:3270) according to the present invention is supported by 58 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3114 below describes the starting and ending position of this segment on each transcript.

TABLE 3114

Segment location on transcripts

| Transcript name | Segment starting position | Segment ending position |
|---|---|---|
| HUMTYRKIN_T1 (SEQ ID NO: 3255) | 4256 | 4396 |
| HUMTYRKIN_T5 (SEQ ID NO: 3256) | 3659 | 3799 |
| HUMTYRKIN_T6 (SEQ ID NO: 3257) | 3554 | 3694 |
| HUMTYRKIN_T25 (SEQ ID NO: 3259) | 1524 | 1664 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_46 (SEQ ID NO:3271) according to the present invention is supported by 11 libraries. The number of libraries was determined as previously described. This segment can be found in the following transcript(s): HUMTYRKIN_T6 (SEQ ID NO:3257). Table 3115 below describes the starting and ending position of this segment on each transcript.

TABLE 3115

Segment location on transcripts

| Transcript name | Segment starting position | Segment ending position |
|---|---|---|
| HUMTYRKIN_T6 (SEQ ID NO: 3257) | 3914 | 4209 |

This segment can be found in a non-coding region of transcript(s) that are related to the following protein(s): HUMTYRKIN_P1.

Segment cluster HUMTYRKIN_node_47 (SEQ ID NO:3272) according to the present invention is supported by 7 libraries. The number of libraries was determined as previously described. This segment can be found in the following transcript(s): HUMTYRKIN_T6 (SEQ ID NO:3257). Table 3116 below describes the starting and ending position of this segment on each transcript.

TABLE 3116

| Segment location on transcripts | | |
|---|---|---|
| Transcript name | Segment starting position | Segment ending position |
| HUMTYRKIN_T6 (SEQ ID NO: 3257) | 4210 | 5074 |

This segment can be found in a non-coding region of transcript(s) that are related to the following protein(s): HUMTYRKIN_P1.

Segment cluster HUMTYRKIN_node_48 (SEQ ID NO:3273) according to the present invention is supported by 46 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3117 below describes the starting and ending position of this segment on each transcript.

TABLE 3117

| Segment location on transcripts | | |
|---|---|---|
| Transcript name | Segment starting position | Segment ending position |
| HUMTYRKIN_T1 (SEQ ID NO: 3255) | 4510 | 4637 |
| HUMTYRKIN_T5 (SEQ ID NO: 3256) | 3913 | 4040 |
| HUMTYRKIN_T6 (SEQ ID NO: 3257) | 5075 | 5202 |
| HUMTYRKIN_T25 (SEQ ID NO: 3259) | 1778 | 1905 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_49 (SEQ ID NO:3274) according to the present invention is supported by 53 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3118 below describes the starting and ending position of this segment on each transcript.

TABLE 3118

| Segment location on transcripts | | |
|---|---|---|
| Transcript name | Segment starting position | Segment ending position |
| HUMTYRKIN_T1 (SEQ ID NO: 3255) | 4638 | 4916 |
| HUMTYRKIN_T5 (SEQ ID NO: 3256) | 4041 | 4319 |
| HUMTYRKIN_T6 (SEQ ID NO: 3257) | 5203 | 5481 |
| HUMTYRKIN_T25 (SEQ ID NO: 3259) | 1906 | 2184 |

This segment can be found in a non-coding region of transcript(s) that are related to the following protein(s): HUMTYRKIN_P2 and HUMTYRKIN_P1.

Segment cluster HUMTYRKIN_node_50 (SEQ ID NO:3275) according to the present invention is supported by 41 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3119 below describes the starting and ending position of this segment on each transcript.

TABLE 3119

| Segment location on transcripts | | |
|---|---|---|
| Transcript name | Segment starting position | Segment ending position |
| HUMTYRKIN_T1 (SEQ ID NO: 3255) | 4917 | 4997 |
| HUMTYRKIN_T5 (SEQ ID NO: 3256) | 4320 | 4400 |
| HUMTYRKIN_T6 (SEQ ID NO: 3257) | 5482 | 6226 |
| HUMTYRKIN_T25 (SEQ ID NO: 3259) | 2185 | 2929 |

This segment can be found in a non-coding region of transcript(s) that are related to the following protein(s): HUMTYRKIN_P2 and HUMTYRKIN_P1.

According to an optional embodiment of the present invention, short segments related to the above cluster are also provided. These segments are up to about 120 bp in length, and so are included in a separate description.

Segment cluster HUMTYRKIN_node_2 (SEQ ID NO:3276) according to the present invention is supported by 24 libraries. The number of libraries was determined as previously described. This segment can be found in the following transcript(s): HUMTYRKIN_T5 (SEQ ID NO:3256), HUMTYRKIN_T6 (SEQ ID NO:3257) and HUMTYRKIN_T21 (SEQ ID NO:3258). Table 3120 below describes the starting and ending position of this segment on each transcript.

TABLE 3120

| Segment location on transcripts | | |
|---|---|---|
| Transcript name | Segment starting position | Segment ending position |
| HUMTYRKIN_T5 (SEQ ID NO: 3256) | 311 | 389 |
| HUMTYRKIN_T6 (SEQ ID NO: 3257) | 311 | 389 |
| HUMTYRKIN_T21 (SEQ ID NO: 3258) | 311 | 389 |

This segment can be found in a non-coding region of transcript(s) that are related to the following protein(s): HUMTYRKIN_P1.

Segment cluster HUMTYRKIN_node_4 (SEQ ID NO:3277) according to the present invention is supported by 1 libraries. The number of libraries was determined as previously described. This segment can be found in the following transcript(s): HUMTYRKIN_T5 (SEQ ID NO:3256). Table 3121 below describes the starting and ending position of this segment on each transcript.

TABLE 3121

Segment location on transcripts

| Transcript name | Segment starting position | Segment ending position |
|---|---|---|
| HUMTYRKIN_T5 (SEQ ID NO: 3256) | 390 | 494 |

This segment can be found in a non-coding region of transcript(s) that are related to the following protein(s): HUMTYRKIN_P1.

Segment cluster HUMTYRKIN_node_13 (SEQ ID NO:3278) according to the present invention can be found in the following transcript(s): HUMTYRKIN_T5 (SEQ ID NO:3256), HUMTYRKIN_T6 (SEQ ID NO:3257) and HUMTYRKIN_T21 (SEQ ID NO:3258). Table 3122 below describes the starting and ending position of this segment on each transcript.

TABLE 3122

Segment location on transcripts

| Transcript name | Segment starting position | Segment ending position |
|---|---|---|
| HUMTYRKIN_T5 (SEQ ID NO: 3256) | 1069 | 1078 |
| HUMTYRKIN_T6 (SEQ ID NO: 3257) | 964 | 973 |
| HUMTYRKIN_T21 (SEQ ID NO: 3258) | 964 | 973 |

This segment can be found in the following protein(s): HUMTYRKIN_P1.

Segment cluster HUMTYRKIN_node_15 (SEQ ID NO:3279) according to the present invention is supported by 2 libraries. The number of libraries was determined as previously described. This segment can be found in the following transcript(s): HUMTYRKIN_T25 (SEQ ID NO:3259). Table 3123 below describes the starting and ending position of this segment on each transcript.

TABLE 3123

Segment location on transcripts

| Transcript name | Segment starting position | Segment ending position |
|---|---|---|
| HUMTYRKIN_T25 (SEQ ID NO: 3259) | 1 | 98 |

This segment can be found in a non-coding region of transcript(s) that are related to the following protein(s): HUMTYRKIN_P2.

Segment cluster HUMTYRKIN_node_20 (SEQ ID NO:3280) according to the present invention is supported by 33 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3124 below describes the starting and ending position of this segment on each transcript.

TABLE 3124

Segment location on transcripts

| Transcript name | Segment starting position | Segment ending position |
|---|---|---|
| HUMTYRKIN_T1 (SEQ ID NO: 3255) | 1815 | 1902 |
| HUMTYRKIN_T5 (SEQ ID NO: 3256) | 1218 | 1305 |
| HUMTYRKIN_T6 (SEQ ID NO: 3257) | 1113 | 1200 |
| HUMTYRKIN_T21 (SEQ ID NO: 3258) | 1113 | 1200 |
| HUMTYRKIN_T25 (SEQ ID NO: 3259) | 238 | 325 |

This segment can be found in both coding and non-coding regions of transcript(s) as follows. The segment can be found in a non-coding region of transcript(s) that are related to the following protein(s): HUMTYRKIN_P2. This segment can also be found in the following protein(s): HUMTYRKIN_P1, since it is in the coding region for the corresponding transcript.

Segment cluster HUMTYRKIN_node_22 (SEQ ID NO:3281) according to the present invention is supported by 30 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3125 below describes the starting and ending position of this segment on each transcript.

TABLE 3125

Segment location on transcripts

| Transcript name | Segment starting position | Segment ending position |
|---|---|---|
| HUMTYRKIN_T1 (SEQ ID NO: 3255) | 1903 | 1949 |
| HUMTYRKIN_T5 (SEQ ID NO: 3256) | 1306 | 1352 |
| HUMTYRKIN_T6 (SEQ ID NO: 3257) | 1201 | 1247 |
| HUMTYRKIN_T21 (SEQ ID NO: 3258) | 1201 | 1247 |
| HUMTYRKIN_T25 (SEQ ID NO: 3259) | 326 | 372 |

This segment can be found in both coding and non-coding regions of transcript(s) as follows. The segment can be found in a non-coding region of transcript(s) that are related to the following protein(s): HUMTYRKIN_P2. This segment can also be found in the following protein(s): HUMTYRKIN_P1, since it is in the coding region for the corresponding transcript.

Segment cluster HUMTYRKIN_node_24 (SEQ ID NO:3282) according to the present invention is supported by 30 libraries. The number of libraries was determined as previously described. This segment can be found in the following transcript(s): HUMTYRKIN_T1 (SEQ ID NO:3255), HUM- TYRKIN_T5 (SEQ ID NO:3256), HUMTYRKIN_T6 (SEQ ID NO:3257) and HUMTYRKIN_T21 (SEQ ID NO:3258). Table 3126 below describes the starting and ending position of this segment on each transcript.

TABLE 3126

Segment location on transcripts

| Transcript name | Segment starting position | Segment ending position |
| --- | --- | --- |
| HUMTYRKIN_T1 (SEQ ID NO: 3255) | 2150 | 2180 |
| HUMTYRKIN_T5 (SEQ ID NO: 3256) | 1553 | 1583 |
| HUMTYRKIN_T6 (SEQ ID NO: 3257) | 1448 | 1478 |
| HUMTYRKIN_T21 (SEQ ID NO: 3258) | 1448 | 1478 |

This segment can be found in a non-coding region of transcript(s) that are related to the following protein(s): HUMTYRKIN_P2 and HUMTYRKIN_P1.

Segment cluster HUMTYRKIN_node_25 (SEQ ID NO:3283) according to the present invention can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3127 below describes the starting and ending position of this segment on each transcript.

TABLE 3127

Segment location on transcripts

| Transcript name | Segment starting position | Segment ending position |
| --- | --- | --- |
| HUMTYRKIN_T1 (SEQ ID NO: 3255) | 2181 | 2201 |
| HUMTYRKIN_T5 (SEQ ID NO: 3256) | 1584 | 1604 |
| HUMTYRKIN_T6 (SEQ ID NO: 3257) | 1479 | 1499 |
| HUMTYRKIN_T21 (SEQ ID NO: 3258) | 1479 | 1499 |
| HUMTYRKIN_T25 (SEQ ID NO: 3259) | 373 | 393 |

This segment can be found in a non-coding region of transcript(s) that are related to the following protein(s): HUMTYRKIN_P2 and HUMTYRKIN_P1.

Segment cluster HUMTYRKIN_node_27 (SEQ ID NO:3284) according to the present invention can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3128 below describes the starting and ending position of this segment on each transcript.

TABLE 3128

Segment location on transcripts

| Transcript name | Segment starting position | Segment ending position |
| --- | --- | --- |
| HUMTYRKIN_T1 (SEQ ID NO: 3255) | 3126 | 3143 |
| HUMTYRKIN_T5 (SEQ ID NO: 3256) | 2529 | 2546 |
| HUMTYRKIN_T6 (SEQ ID NO: 3257) | 2424 | 2441 |
| HUMTYRKIN_T21 (SEQ ID NO: 3258) | 2424 | 2441 |
| HUMTYRKIN_T25 (SEQ ID NO: 3259) | 394 | 411 |

This segment can be found in a non-coding region of transcript(s) that are related to the following protein(s): HUMTYRKIN_P2 and HUMTYRKIN_P1.

Segment cluster HUMTYRKIN_node_29 (SEQ ID NO:3285) according to the present invention can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3129 below describes the starting and ending position of this segment on each transcript.

TABLE 3129

Segment location on transcripts

| Transcript name | Segment starting position | Segment ending position |
| --- | --- | --- |
| HUMTYRKIN_T1 (SEQ ID NO: 3255) | 3309 | 3318 |
| HUMTYRKIN_T5 (SEQ ID NO: 3256) | 2712 | 2721 |
| HUMTYRKIN_T6 (SEQ ID NO: 3257) | 2607 | 2616 |
| HUMTYRKIN_T21 (SEQ ID NO: 3258) | 2607 | 2616 |
| HUMTYRKIN_T25 (SEQ ID NO: 3259) | 577 | 586 |

This segment can be found in a non-coding region of transcript(s) that are related to the following protein(s): HUMTYRKIN_P2 and HUMTYRKIN_P1.

Segment cluster HUMTYRKIN_node_31 (SEQ ID NO:3286) according to the present invention is supported by 41 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3130 below describes the starting and ending position of this segment on each transcript.

TABLE 3130

Segment location on transcripts

| Transcript name | Segment starting position | Segment ending position |
| --- | --- | --- |
| HUMTYRKIN_T1 (SEQ ID NO: 3255) | 3856 | 3964 |
| HUMTYRKIN_T5 (SEQ ID NO: 3256) | 3259 | 3367 |
| HUMTYRKIN_T6 (SEQ ID NO: 3257) | 3154 | 3262 |

TABLE 3130-continued

Segment location on transcripts

| Transcript name | Segment starting position | Segment ending position |
|---|---|---|
| HUMTYRKIN_T21 (SEQ ID NO: 3258) | 3154 | 3262 |
| HUMTYRKIN_T25 (SEQ ID NO: 3259) | 1124 | 1232 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_32 (SEQ ID NO:3287) according to the present invention is supported by 43 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3131 below describes the starting and ending position of this segment on each transcript.

TABLE 3131

Segment location on transcripts

| Transcript name | Segment starting position | Segment ending position |
|---|---|---|
| HUMTYRKIN_T1 (SEQ ID NO: 3255) | 3965 | 4022 |
| HUMTYRKIN_T5 (SEQ ID NO: 3256) | 3368 | 3425 |
| HUMTYRKIN_T6 (SEQ ID NO: 3257) | 3263 | 3320 |
| HUMTYRKIN_T21 (SEQ ID NO: 3258) | 3263 | 3320 |
| HUMTYRKIN_T25 (SEQ ID NO: 3259) | 1233 | 1290 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_33 (SEQ ID NO:3288) according to the present invention is supported by 42 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257), HUMTYRKIN_T21 (SEQ ID NO:3258) and HUMTYRKIN_T25 (SEQ ID NO:3259). Table 3132 below describes the starting and ending position of this segment on each transcript.

TABLE 3132

Segment location on transcripts

| Transcript name | Segment starting position | Segment ending position |
|---|---|---|
| HUMTYRKIN_T1 (SEQ ID NO: 3255) | 4023 | 4062 |
| HUMTYRKIN_T5 (SEQ ID NO: 3256) | 3426 | 3465 |
| HUMTYRKIN_T6 (SEQ ID NO: 3257) | 3321 | 3360 |
| HUMTYRKIN_T21 (SEQ ID NO: 3258) | 3321 | 3360 |
| HUMTYRKIN_T25 (SEQ ID NO: 3259) | 1291 | 1330 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_38 (SEQ ID NO:3289) according to the present invention is supported by 42 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3133 below describes the starting and ending position of this segment on each transcript.

TABLE 3133

Segment location on transcripts

| Transcript name | Segment starting position | Segment ending position |
|---|---|---|
| HUMTYRKIN_T1 (SEQ ID NO: 3255) | 4063 | 4177 |
| HUMTYRKIN_T5 (SEQ ID NO: 3256) | 3466 | 3580 |
| HUMTYRKIN_T6 (SEQ ID NO: 3257) | 3361 | 3475 |
| HUMTYRKIN_T25 (SEQ ID NO: 3259) | 1331 | 1445 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_39 (SEQ ID NO:3290) according to the present invention is supported by 45 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3134 below describes the starting and ending position of this segment on each transcript.

TABLE 3134

Segment location on transcripts

| Transcript name | Segment starting position | Segment ending position |
|---|---|---|
| HUMTYRKIN_T1 (SEQ ID NO: 3255) | 4178 | 4255 |
| HUMTYRKIN_T5 (SEQ ID NO: 3256) | 3581 | 3658 |
| HUMTYRKIN_T6 (SEQ ID NO: 3257) | 3476 | 3553 |
| HUMTYRKIN_T25 (SEQ ID NO: 3259) | 1446 | 1523 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_44 (SEQ ID NO:3291) according to the present invention is supported by 59 libraries. The number of libraries was determined as previously described. This segment can be found in the following transcript(s): HUMTYRKIN_T1 (SEQ ID NO:3255), HUMTYRKIN_T5 (SEQ ID NO:3256), HUMTYRKIN_T6 (SEQ ID NO:3257) and HUMTYRKIN_T25 (SEQ ID NO:3259). Table 3135 below describes the starting and ending position of this segment on each transcript.

TABLE 3135

Segment location on transcripts

| Transcript name | Segment starting position | Segment ending position |
|---|---|---|
| HUMTYRKIN_T1 (SEQ ID NO: 3255) | 4397 | 4509 |
| HUMTYRKIN_T5 (SEQ ID NO: 3256) | 3800 | 3912 |
| HUMTYRKIN_T6 (SEQ ID NO: 3257) | 3695 | 3807 |
| HUMTYRKIN_T25 (SEQ ID NO: 3259) | 1665 | 1777 |

This segment can be found in both coding and non-coding regions of transcript(s) as follows. The segment can be found in a non-coding region of transcript(s) that are related to the following protein(s): HUMTYRKIN_P1. This segment can also be found in the following protein(s): HUMTYRKIN_P2, since it is in the coding region for the corresponding transcript.

Segment cluster HUMTYRKIN_node_45 (SEQ ID NO:3292) according to the present invention is supported by 9 libraries. The number of libraries was determined as previously described. This segment can be found in the following transcript(s): HUMTYRKIN_T6 (SEQ ID NO:3257). Table 3136 below describes the starting and ending position of this segment on each transcript.

TABLE 3136

Segment location on transcripts

| Transcript name | Segment starting position | Segment ending position |
|---|---|---|
| HUMTYRKIN_T6 (SEQ ID NO: 3257) | 3808 | 3913 |

This segment can be found in a non-coding region of transcript(s) that are related to the following protein(s): HUMTYRKIN_P1.

Description for Cluster M77903

Cluster M77903 features 7 transcript(s) and 35 segment(s) of interest, the names for which are given in Tables 3137 and 3138, respectively, the sequences themselves are given at the end of the application. The selected protein variants are given in Table 3139.

TABLE 3137

Transcripts of interest
Transcript Name

M77903_T8 (SEQ ID NO: 3293)
M77903_T19 (SEQ ID NO: 3294)
M77903_T26 (SEQ ID NO: 3295)
M77903_T28 (SEQ ID NO: 3296)
M77903_T29 (SEQ ID NO: 3297)
M77903_T30 (SEQ ID NO: 3298)
M77903_T32 (SEQ ID NO: 3299)

TABLE 3138

Segments of interest
Segment Name

M77903_node_2 (SEQ ID NO: 3300)
M77903_node_16 (SEQ ID NO: 3301)
M77903_node_25 (SEQ ID NO: 3302)
M77903_node_26 (SEQ ID NO: 3303)
M77903_node_30 (SEQ ID NO: 3304)
M77903_node_35 (SEQ ID NO: 3305)
M77903_node_36 (SEQ ID NO: 3306)
M77903_node_37 (SEQ ID NO: 3307)
M77903_node_38 (SEQ ID NO: 3308)
M77903_node_40 (SEQ ID NO: 3309)
M77903_node_44 (SEQ ID NO: 3310)
M77903_node_46 (SEQ ID NO: 3311)
M77903_node_47 (SEQ ID NO: 3312)
M77903_node_48 (SEQ ID NO: 3313)
M77903_node_49 (SEQ ID NO: 3314)
M77903_node_51 (SEQ ID NO: 3315)
M77903_node_52 (SEQ ID NO: 3316)
M77903_node_56 (SEQ ID NO: 3317)
M77903_node_1 (SEQ ID NO: 3318)
M77903_node_5 (SEQ ID NO: 3319)
M77903_node_9 (SEQ ID NO: 3320)
M77903_node_10 (SEQ ID NO: 3321)
M77903_node_11 (SEQ ID NO: 3322)
M77903_node_12 (SEQ ID NO: 3323)
M77903_node_15 (SEQ ID NO: 3324)
M77903_node_17 (SEQ ID NO: 3325)
M77903_node_20 (SEQ ID NO: 3326)
M77903_node_22 (SEQ ID NO: 3327)
M77903_node_28 (SEQ ID NO: 3328)
M77903_node_29 (SEQ ID NO: 3329)
M77903_node_31 (SEQ ID NO: 3330)
M77903_node_32 (SEQ ID NO: 3331)
M77903_node_34 (SEQ ID NO: 3332)
M77903_node_41 (SEQ ID NO: 3333)
M77903_node_42 (SEQ ID NO: 3334)

TABLE 3139

Proteins of interest

| Protein Name | Corresponding Transcript(s) |
|---|---|
| M77903_P1 | M77903_T19 (SEQ ID NO: 3294) |
| M77903_P2 | M77903_T30 (SEQ ID NO: 3298) |
| M77903_P3 | M77903_T8 (SEQ ID NO: 3293); |
|  | M77903_T32 (SEQ ID NO: 3299) |
| M77903_P11 | M77903_T28 (SEQ ID NO: 3296) |
| M77903_P12 | M77903_T29 (SEQ ID NO: 3297) |
| M77903_P18 | M77903_T26 (SEQ ID NO: 3295) |

These sequences are variants of the known protein Translocon-associated protein, alpha subunit precursor (SwissProt accession identifier SSRA_HUMAN; known also according to the synonyms TRAP-alpha; Signal sequence receptor alpha subunit; SSR-alpha), referred to herein as the previously known protein.

Protein Translocon-associated protein, alpha subunit precursor is known or believed to have the following function(s): TRAP proteins are part of a complex whose function is to bind calcium to the ER membrane and thereby regulate the retention of ER resident proteins. May be involved in the recycling of the translocation apparatus after completion of the translocation process or may function as a membrane-bound chaperone facilitating folding of translocated proteins. The sequence for protein Translocon-associated protein, alpha subunit precursor is given at the end of the application, as "Translocon-associated protein, alpha subunit precursor amino acid sequence". Known polymorphisms for this sequence are as shown in Table 3140.

TABLE 3140

Amino acid mutations for Known Protein

| SNP position(s) on amino acid sequence | Comment |
|---|---|
| 28 | L -> S |
| 130 | Y -> H |

Protein Translocon-associated protein, alpha subunit precursor localization is believed to be Type I membrane protein. Endoplasmic reticulum.

The following GO Annotation(s) apply to the previously known protein. The following annotation(s) were found: co-translational membrane targeting; positive control of cell proliferation, which are annotation(s) related to Biological Process; signal sequence receptor; calcium binding, which are annotation(s) related to Molecular Function; and endoplasmic reticulum; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M77903 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 77 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 77 and Table 3141. This cluster is overexpressed (at least at a minimum level) in the following pathological conditions: ovarian carcinoma and uterine malignancies.

TABLE 3141

Normal tissue distribution

| Name of Tissue | Number |
|---|---|
| adrenal | 120 |
| bladder | 123 |
| bone | 129 |
| brain | 79 |
| colon | 31 |
| epithelial | 124 |
| general | 129 |
| head and neck | 263 |
| kidney | 118 |
| liver | 107 |
| lung | 147 |
| lymph nodes | 126 |
| breast | 211 |
| bone marrow | 251 |
| muscle | 109 |
| ovary | 3 |
| pancreas | 144 |
| prostate | 142 |
| skin | 163 |
| stomach | 183 |
| T cells | 278 |
| Thyroid | 128 |
| uterus | 81 |

TABLE 3142

P values and ratios for expression in cancerous tissue

| Name of Tissue | P1 | P2 | SP1 | R3 | SP2 | R4 |
|---|---|---|---|---|---|---|
| adrenal | 3.8e−01 | 2.8e−01 | 4.1e−01 | 1.4 | 2.4e−01 | 1.6 |
| bladder | 3.7e−01 | 4.1e−01 | 1.6e−01 | 1.8 | 3.0e−01 | 1.4 |
| bone | 2.0e−01 | 2.4e−01 | 7.7e−01 | 1.0 | 6.6e−01 | 0.9 |
| brain | 5.9e−01 | 5.5e−01 | 8.4e−01 | 0.7 | 7.9e−01 | 0.8 |
| colon | 7.0e−02 | 1.1e−02 | 6.1e−02 | 2.9 | 2.5e−02 | 3.2 |
| epithelial | 4.2e−02 | 5.8e−02 | 1.3e−01 | 1.2 | 4.7e−01 | 1.0 |
| general | 4.0e−02 | 2.0e−02 | 6.1e−01 | 1.0 | 8.9e−01 | 0.9 |
| head and neck | 4.5e−01 | 4.6e−01 | 1 | 0.4 | 9.0e−01 | 0.5 |
| kidney | 6.5e−01 | 7.6e−01 | 2.8e−01 | 1.2 | 5.3e−01 | 0.9 |
| liver | 5.3e−01 | 5.8e−01 | 1 | 0.4 | 9.1e−01 | 0.6 |
| lung | 6.1e−01 | 7.3e−01 | 3.7e−01 | 1.2 | 7.0e−01 | 0.9 |
| lymph nodes | 2.4e−01 | 5.8e−01 | 7.1e−01 | 0.9 | 8.7e−01 | 0.6 |
| breast | 8.0e−01 | 8.3e−01 | 9.9e−01 | 0.4 | 9.1e−01 | 0.5 |
| bone marrow | 7.5e−01 | 6.8e−01 | 1 | 0.1 | 9.5e−01 | 0.5 |
| muscle | 4.0e−01 | 2.6e−01 | 6.2e−01 | 1.5 | 8.3e−01 | 0.7 |
| ovary | 7.8e−03 | 8.7e−03 | 1.0e−02 | 5.8 | 3.1e−02 | 4.4 |
| pancreas | 5.6e−01 | 6.6e−01 | 7.8e−01 | 0.6 | 8.6e−01 | 0.6 |
| prostate | 4.5e−01 | 4.3e−01 | 6.2e−01 | 0.9 | 4.3e−01 | 0.8 |
| skin | 4.9e−01 | 5.3e−01 | 3.6e−01 | 1.4 | 9.3e−01 | 0.4 |
| stomach | 2.9e−01 | 5.5e−01 | 7.5e−01 | 0.6 | 9.4e−01 | 0.5 |
| T cells | 6.7e−01 | 5.0e−01 | 5.5e−01 | 1.5 | 5.7e−01 | 1.1 |
| Thyroid | 5.7e−01 | 5.7e−01 | 7.4e−01 | 1.1 | 7.4e−01 | 1.1 |
| uterus | 7.4e−03 | 2.5e−02 | 4.6e−01 | 1.1 | 6.0e−01 | 0.9 |

As noted above, cluster M77903 features 35 segment(s), which were listed in Table 3138 above and for which the sequence(s) are given at the end of the application. These segment(s) are portions of nucleic acid sequence(s) which are described herein separately because they are of particular interest. A description of each segment according to the present invention is now provided.

Segment cluster M77903_node_2 (SEQ ID NO:3300) according to the present invention is supported by 150 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3143 below describes the starting and ending position of this segment on each transcript.

TABLE 3143

Segment location on transcripts

| Transcript name | Segment starting position | Segment ending position |
|---|---|---|
| M77903_T8 (SEQ ID NO: 3293) | 118 | 278 |
| M77903_T19 (SEQ ID NO: 3294) | 118 | 278 |
| M77903_T26 (SEQ ID NO: 3295) | 118 | 278 |
| M77903_T28 (SEQ ID NO: 3296) | 118 | 278 |
| M77903_T29 (SEQ ID NO: 3297) | 118 | 278 |
| M77903_T30 (SEQ ID NO: 3298) | 118 | 278 |
| M77903_T32 (SEQ ID NO: 3299) | 118 | 278 |

This segment can be found in the following protein(s): M77903_P3, M77903_P1, M77903_P18, M77903_P11, M77903_P12 and M77903_P2.

Segment cluster M77903_node__16 (SEQ ID NO:3301) according to the present invention is supported by 149 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3144 below describes the starting and ending position of this segment on each transcript.

TABLE 3144

Segment location on transcripts

| Transcript name | Segment starting position | Segment ending position |
|---|---|---|
| M77903_T8 (SEQ ID NO: 3293) | 523 | 683 |
| M77903_T19 (SEQ ID NO: 3294) | 523 | 683 |
| M77903_T26 (SEQ ID NO: 3295) | 523 | 683 |
| M77903_T28 (SEQ ID NO: 3296) | 523 | 683 |
| M77903_T29 (SEQ ID NO: 3297) | 523 | 683 |
| M77903_T30 (SEQ ID NO: 3298) | 523 | 683 |
| M77903_T32 (SEQ ID NO: 3299) | 523 | 683 |

This segment can be found in the following protein(s): M77903_P3, M77903_P1, M77903_P18, M77903_P11, M77903_P12 and M77903_P2.

Segment cluster M77903_node__25 (SEQ ID NO:3302) according to the present invention is supported by 5 libraries. The number of libraries was determined as previously described. This segment can be found in the following transcript(s): M77903_T8 (SEQ ID NO:3293) and M77903_T32 (SEQ ID NO:3299). Table 3145 below describes the starting and ending position of this segment on each transcript.

TABLE 3145

Segment location on transcripts

| Transcript name | Segment starting position | Segment ending position |
|---|---|---|
| M77903_T8 (SEQ ID NO: 3293) | 899 | 1041 |
| M77903_T32 (SEQ ID NO: 3299) | 899 | 1041 |

This segment can be found in the following protein(s): M77903_P3.

Segment cluster M77903_node__26 (SEQ ID NO:3303) according to the present invention is supported by 3 libraries. The number of libraries was determined as previously described. This segment can be found in the following transcript(s): M77903_T32 (SEQ ID NO:3299). Table 3146 below describes the starting and ending position of this segment on each transcript.

TABLE 3146

Segment location on transcripts

| Transcript name | Segment starting position | Segment ending position |
|---|---|---|
| M77903_T32 (SEQ ID NO: 3299) | 1042 | 1391 |

This segment can be found in a non-coding region of transcript(s) that are related to the following protein(s): M77903_P3.

Segment cluster M77903_node__30 (SEQ ID NO:3304) according to the present invention is supported by 1 libraries. The number of libraries was determined as previously described. This segment can be found in the following transcript(s): M77903_T30 (SEQ ID NO:3298). Table 3147 below describes the starting and ending position of this segment on each transcript.

TABLE 3147

Segment location on transcripts

| Transcript name | Segment starting position | Segment ending position |
|---|---|---|
| M77903_T30 (SEQ ID NO: 3298) | 1010 | 1281 |

This segment can be found in a non-coding region of transcript(s) that are related to the following protein(s): M77903_P2.

Segment cluster M77903_node__35 (SEQ ID NO:3305) according to the present invention is supported by 145 libraries. The number of libraries was determined as previously described. This segment can be found in the following transcript(s): M77903_T8 (SEQ ID NO:3293), M77903_T19 (SEQ ID NO:3294) and M77903_T26 (SEQ ID NO:3295). Table 3148 below describes the starting and ending position of this segment on each transcript.

TABLE 3148

Segment location on transcripts

| Transcript name | Segment starting position | Segment ending position |
|---|---|---|
| M77903_T8 (SEQ ID NO: 3293) | 1200 | 1384 |
| M77903_T19 (SEQ ID NO: 3294) | 1057 | 1241 |
| M77903_T26 (SEQ ID NO: 3295) | 1057 | 1241 |

This segment can be found in both coding and non-coding regions of transcript(s) as follows. The segment can be found in a non-coding region of transcript(s) that are related to the following protein(s): M77903_P3. This segment can also be found in the following protein(s): M77903_P1 and M77903_P18, since it is in the coding region for the corresponding transcript.

Segment cluster M77903_node_36 (SEQ ID NO:3306) according to the present invention is supported by 173 libraries. The number of libraries was determined as previously described. This segment can be found in the following transcript(s): M77903_T8 (SEQ ID NO:3293) and M77903_T19 (SEQ ID NO:3294). Table 3149 below describes the starting and ending position of this segment on each transcript.

TABLE 3149

Segment location on transcripts

| Transcript name | Segment starting position | Segment ending position |
|---|---|---|
| M77903_T8 (SEQ ID NO: 3293) | 1385 | 1793 |
| M77903_T19 (SEQ ID NO: 3294) | 1242 | 1650 |

This segment can be found in a non-coding region of transcript(s) that are related to the following protein(s): M77903_P3 and M77903_P1.

Segment cluster M77903_node_37 (SEQ ID NO:3307) according to the present invention is supported by 128 libraries. The number of libraries was determined as previously described. This segment can be found in the following transcript(s): M77903_T8 (SEQ ID NO:3293) and M77903_T19 (SEQ ID NO:3294). Table 3150 below describes the starting and ending position of this segment on each transcript.

TABLE 3150

Segment location on transcripts

| Transcript name | Segment starting position | Segment ending position |
|---|---|---|
| M77903_T8 (SEQ ID NO: 3293) | 1794 | 2135 |
| M77903_T19 (SEQ ID NO: 3294) | 1651 | 1992 |

This segment can be found in a non-coding region of transcript(s) that are related to the following protein(s): M77903_P3 and M77903_P1.

Segment cluster M77903_node_38 (SEQ ID NO:3308) according to the present invention is supported by 152 libraries. The number of libraries was determined as previously described. This segment can be found in the following transcript(s): M77903_T8 (SEQ ID NO:3293) and M77903_T19 (SEQ ID NO:3294). Table 3151 below describes the starting and ending position of this segment on each transcript.

TABLE 3151

Segment location on transcripts

| Transcript name | Segment starting position | Segment ending position |
|---|---|---|
| M77903_T8 (SEQ ID NO: 3293) | 2136 | 2633 |
| M77903_T19 (SEQ ID NO: 3294) | 1993 | 2490 |

This segment can be found in a non-coding region of transcript(s) that are related to the following protein(s): M77903_P3 and M77903_P1.

Segment cluster M77903_node_40 (SEQ ID NO:3309) according to the present invention is supported by 186 libraries. The number of libraries was determined as previously described. This segment can be found in the following transcript(s): M77903_T8 (SEQ ID NO:3293) and M77903_T19 (SEQ ID NO:3294). Table 3152 below describes the starting and ending position of this segment on each transcript.

TABLE 3152

Segment location on transcripts

| Transcript name | Segment starting position | Segment ending position |
|---|---|---|
| M77903_T8 (SEQ ID NO: 3293) | 2634 | 3145 |
| M77903_T19 (SEQ ID NO: 3294) | 2491 | 3002 |

This segment can be found in a non-coding region of transcript(s) that are related to the following protein(s): M77903_P3 and M77903_P1.

Segment cluster M77903_node_44 (SEQ ID NO:3310) according to the present invention is supported by 122 libraries. The number of libraries was determined as previously described. This segment can be found in the following transcript(s): M77903_T8 (SEQ ID NO:3293). Table 3153 below describes the starting and ending position of this segment on each transcript.

TABLE 3153

Segment location on transcripts

| Transcript name | Segment starting position | Segment ending position |
|---|---|---|
| M77903_T8 (SEQ ID NO: 3293) | 3301 | 4048 |

This segment can be found in a non-coding region of transcript(s) that are related to the following protein(s): M77903_P3.

Segment cluster M77903_node_46 (SEQ ID NO:3311) according to the present invention is supported by 10 libraries. The number of libraries was determined as previously described. This segment can be found in the following transcript(s): M77903_T8 (SEQ ID NO:3293). Table 3154 below describes the starting and ending position of this segment on each transcript.

TABLE 3154

| | Segment location on transcripts | |
|---|---|---|
| Transcript name | Segment starting position | Segment ending position |
| M77903_T8 (SEQ ID NO: 3293) | 4049 | 4418 |

This segment can be found in a non-coding region of transcript(s) that are related to the following protein(s): M77903_P3.

Segment cluster M77903_node_47 (SEQ ID NO:3312) according to the present invention is supported by 40 libraries. The number of libraries was determined as previously described. This segment can be found in the following transcript(s): M77903_T8 (SEQ ID NO:3293). Table 3155 below describes the starting and ending position of this segment on each transcript.

TABLE 3155

| | Segment location on transcripts | |
|---|---|---|
| Transcript name | Segment starting position | Segment ending position |
| M77903_T8 (SEQ ID NO: 3293) | 4419 | 5404 |

This segment can be found in a non-coding region of transcript(s) that are related to the following protein(s): M77903_P3.

Segment cluster M77903_node_48 (SEQ ID NO:3313) according to the present invention is supported by 63 libraries. The number of libraries was determined as previously described. This segment can be found in the following transcript(s): M77903_T8 (SEQ ID NO:3293). Table 3156 below describes the starting and ending position of this segment on each transcript.

TABLE 3156

| | Segment location on transcripts | |
|---|---|---|
| Transcript name | Segment starting position | Segment ending position |
| M77903_T8 (SEQ ID NO: 3293) | 5405 | 6355 |

This segment can be found in a non-coding region of transcript(s) that are related to the following protein(s): M77903_P3.

Segment cluster M77903_node_49 (SEQ ID NO:3314) according to the present invention is supported by 7 libraries. The number of libraries was determined as previously described. This segment can be found in the following transcript(s): M77903_T8 (SEQ ID NO:3293). Table 3157 below describes the starting and ending position of this segment on each transcript.

TABLE 3157

| | Segment location on transcripts | |
|---|---|---|
| Transcript name | Segment starting position | Segment ending position |
| M77903_T8 (SEQ ID NO: 3293) | 6356 | 6541 |

This segment can be found in a non-coding region of transcript(s) that are related to the following protein(s): M77903_P3.

Segment cluster M77903_node_51 (SEQ ID NO:3315) according to the present invention is supported by 14 libraries. The number of libraries was determined as previously described. This segment can be found in the following transcript(s): M77903_T8 (SEQ ID NO:3293). Table 3158 below describes the starting and ending position of this segment on each transcript.

TABLE 3158

| | Segment location on transcripts | |
|---|---|---|
| Transcript name | Segment starting position | Segment ending position |
| M77903_T8 (SEQ ID NO: 3293) | 6542 | 7764 |

This segment can be found in a non-coding region of transcript(s) that are related to the following protein(s): M77903_P3.

Segment cluster M77903_node_52 (SEQ ID NO:3316) according to the present invention is supported by 160 libraries. The number of libraries was determined as previously described. This segment can be found in the following transcript(s): M77903_T8 (SEQ ID NO:3293). Table 3159 below describes the starting and ending position of this segment on each transcript.

TABLE 3159

| | Segment location on transcripts | |
|---|---|---|
| Transcript name | Segment starting position | Segment ending position |
| M77903_T8 (SEQ ID NO: 3293) | 7765 | 9924 |

This segment can be found in a non-coding region of transcript(s) that are related to the following protein(s): M77903_P3.

Segment cluster M77903_node_56 (SEQ ID NO:3317) according to the present invention is supported by 22 libraries. The number of libraries was determined as previously described. This segment can be found in the following transcript(s): M77903_T19 (SEQ ID NO:3294), M77903_T26 (SEQ ID NO:3295), M77903_T28 (SEQ ID NO:3296) and M77903_T29 (SEQ ID NO:3297). Table 3160 below describes the starting and ending position of this segment on each transcript.

TABLE 3160

| | Segment location on transcripts | |
|---|---|---|
| Transcript name | Segment starting position | Segment ending position |
| M77903_T19 (SEQ ID NO: 3294) | 3064 | 3918 |
| M77903_T26 (SEQ ID NO: 3295) | 1303 | 2157 |
| M77903_T28 (SEQ ID NO: 3296) | 1057 | 1911 |
| M77903_T29 (SEQ ID NO: 3297) | 1072 | 1926 |

This segment can be found in both coding and non-coding regions of transcript(s) as follows. The segment can be found in a non-coding region of transcript(s) that are related to the following protein(s): M77903_P1 and M77903_P18. This segment can also be found in the following protein(s):

M77903_P11 and M77903_P12, since it is in the coding region for the corresponding transcript.

According to an optional embodiment of the present invention, short segments related to the above cluster are also provided. These segments are up to about 120 bp in length, and so are included in a separate description.

Segment cluster M77903_node_1 (SEQ ID NO:3318) according to the present invention is supported by 4 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3161 below describes the starting and ending position of this segment on each transcript.

TABLE 3161

Segment location on transcripts

| Transcript name | Segment starting position | Segment ending position |
| --- | --- | --- |
| M77903_T8 (SEQ ID NO: 3293) | 1 | 117 |
| M77903_T19 (SEQ ID NO: 3294) | 1 | 117 |
| M77903_T26 (SEQ ID NO: 3295) | 1 | 117 |
| M77903_T28 (SEQ ID NO: 3296) | 1 | 117 |
| M77903_T29 (SEQ ID NO: 3297) | 1 | 117 |
| M77903_T30 (SEQ ID NO: 3298) | 1 | 117 |
| M77903_T32 (SEQ ID NO: 3299) | 1 | 117 |

This segment can be found in a non-coding region of transcript(s) that are related to the following protein(s): M77903_P3, M77903_P1, M77903_P18, M77903_P1, M77903_P12 and M77903_P2.

Segment cluster M77903_node_5 (SEQ ID NO:3319) according to the present invention is supported by 154 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3162 below describes the starting and ending position of this segment on each transcript.

TABLE 3162

Segment location on transcripts

| Transcript name | Segment starting position | Segment ending position |
| --- | --- | --- |
| M77903_T8 (SEQ ID NO: 3293) | 279 | 391 |
| M77903_T19 (SEQ ID NO: 3294) | 279 | 391 |
| M77903_T26 (SEQ ID NO: 3295) | 279 | 391 |
| M77903_T28 (SEQ ID NO: 3296) | 279 | 391 |
| M77903_T29 (SEQ ID NO: 3297) | 279 | 391 |
| M77903_T30 (SEQ ID NO: 3298) | 279 | 391 |
| M77903_T32 (SEQ ID NO: 3299) | 279 | 391 |

This segment can be found in the following protein(s): M77903_P3, M77903_P1, M77903_P18, M77903_P11, M77903_P12 and M77903_P2.

Segment cluster M77903_node_9 (SEQ ID NO:3320) according to the present invention can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3163 below describes the starting and ending position of this segment on each transcript.

TABLE 3163

Segment location on transcripts

| Transcript name | Segment starting position | Segment ending position |
| --- | --- | --- |
| M77903_T8 (SEQ ID NO: 3293) | 392 | 395 |
| M77903_T19 (SEQ ID NO: 3294) | 392 | 395 |
| M77903_T26 (SEQ ID NO: 3295) | 392 | 395 |
| M77903_T28 (SEQ ID NO: 3296) | 392 | 395 |
| M77903_T29 (SEQ ID NO: 3297) | 392 | 395 |
| M77903_T30 (SEQ ID NO: 3298) | 392 | 395 |
| M77903_T32 (SEQ ID NO: 3299) | 392 | 395 |

This segment can be found in the following protein(s): M77903_P3, M77903_P1, M77903_P18, M77903_P11, M77903_P12 and M77903_P2.

Segment cluster M77903_node_10 (SEQ ID NO:3321) according to the present invention is supported by 148 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3164 below describes the starting and ending position of this segment on each transcript.

TABLE 3164

Segment location on transcripts

| Transcript name | Segment starting position | Segment ending position |
| --- | --- | --- |
| M77903_T8 (SEQ ID NO: 3293) | 396 | 468 |
| M77903_T19 (SEQ ID NO: 3294) | 396 | 468 |
| M77903_T26 (SEQ ID NO: 3295) | 396 | 468 |
| M77903_T28 (SEQ ID NO: 3296) | 396 | 468 |
| M77903_T29 (SEQ ID NO: 3297) | 396 | 468 |
| M77903_T30 (SEQ ID NO: 3298) | 396 | 468 |
| M77903_T32 (SEQ ID NO: 3299) | 396 | 468 |

This segment can be found in the following protein(s): M77903_P3, M77903_P1, M77903_P18, M77903_P11, M77903_P12 and M77903_P2.

Segment cluster M77903_node_11 (SEQ ID NO:3322) according to the present invention can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3165 below describes the starting and ending position of this segment on each transcript.

TABLE 3165

| Segment location on transcripts | | |
|---|---|---|
| Transcript name | Segment starting position | Segment ending position |
| M77903_T8 (SEQ ID NO: 3293) | 469 | 473 |
| M77903_T19 (SEQ ID NO: 3294) | 469 | 473 |
| M77903_T26 (SEQ ID NO: 3295) | 469 | 473 |
| M77903_T28 (SEQ ID NO: 3296) | 469 | 473 |
| M77903_T29 (SEQ ID NO: 3297) | 469 | 473 |
| M77903_T30 (SEQ ID NO: 3298) | 469 | 473 |
| M77903_T32 (SEQ ID NO: 3299) | 469 | 473 |

This segment can be found in the following protein(s): M77903_P3, M77903_P1, M77903_P18, M77903_P11, M77903_P12 and M77903_P2.

Segment cluster M77903_node__12 (SEQ ID NO:3323) according to the present invention can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3166 below describes the starting and ending position of this segment on each transcript.

TABLE 3166

| Segment location on transcripts | | |
|---|---|---|
| Transcript name | Segment starting position | Segment ending position |
| M77903_T8 (SEQ ID NO: 3293) | 474 | 479 |
| M77903_T19 (SEQ ID NO: 3294) | 474 | 479 |
| M77903_T26 (SEQ ID NO: 3295) | 474 | 479 |
| M77903_T28 (SEQ ID NO: 3296) | 474 | 479 |
| M77903_T29 (SEQ ID NO: 3297) | 474 | 479 |
| M77903_T30 (SEQ ID NO: 3298) | 474 | 479 |
| M77903_T32 (SEQ ID NO: 3299) | 474 | 479 |

This segment can be found in the following protein(s): M77903_P3, M77903_P1, M77903_P18, M77903_P11, M77903_P12 and M77903_P2.

Segment cluster M77903_node__15 (SEQ ID NO:3324) according to the present invention is supported by 129 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3167 below describes the starting and ending position of this segment on each transcript.

TABLE 3167

| Segment location on transcripts | | |
|---|---|---|
| Transcript name | Segment starting position | Segment ending position |
| M77903_T8 (SEQ ID NO: 3293) | 480 | 522 |
| M77903_T19 (SEQ ID NO: 3294) | 480 | 522 |
| M77903_T26 (SEQ ID NO: 3295) | 480 | 522 |
| M77903_T28 (SEQ ID NO: 3296) | 480 | 522 |
| M77903_T29 (SEQ ID NO: 3297) | 480 | 522 |
| M77903_T30 (SEQ ID NO: 3298) | 480 | 522 |
| M77903_T32 (SEQ ID NO: 3299) | 480 | 522 |

This segment can be found in the following protein(s): M77903_P3, M77903_P1, M77903_P18, M77903_P11, M77903_P12 and M77903_P2.

Segment cluster M77903_node__17 (SEQ ID NO:3325) according to the present invention is supported by 141 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3168 below describes the starting and ending position of this segment on each transcript.

TABLE 3168

| Segment location on transcripts | | |
|---|---|---|
| Transcript name | Segment starting position | Segment ending position |
| M77903_T8 (SEQ ID NO: 3293) | 684 | 742 |
| M77903_T19 (SEQ ID NO: 3294) | 684 | 742 |
| M77903_T26 (SEQ ID NO: 3295) | 684 | 742 |
| M77903_T28 (SEQ ID NO: 3296) | 684 | 742 |
| M77903_T29 (SEQ ID NO: 3297) | 684 | 742 |
| M77903_T30 (SEQ ID NO: 3298) | 684 | 742 |
| M77903_T32 (SEQ ID NO: 3299) | 684 | 742 |

This segment can be found in the following protein(s): M77903_P3, M77903_P1, M77903_P18, M77903_P11, M77903_P12 and M77903_P2.

Segment cluster M77903_node__20 (SEQ ID NO:3326) according to the present invention is supported by 134 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3169 below describes the starting and ending position of this segment on each transcript.

TABLE 3169

| Segment location on transcripts | | |
|---|---|---|
| Transcript name | Segment starting position | Segment ending position |
| M77903_T8 (SEQ ID NO: 3293) | 743 | 819 |
| M77903_T19 (SEQ ID NO: 3294) | 743 | 819 |
| M77903_T26 (SEQ ID NO: 3295) | 743 | 819 |
| M77903_T28 (SEQ ID NO: 3296) | 743 | 819 |
| M77903_T29 (SEQ ID NO: 3297) | 743 | 819 |
| M77903_T30 (SEQ ID NO: 3298) | 743 | 819 |
| M77903_T32 (SEQ ID NO: 3299) | 743 | 819 |

This segment can be found in the following protein(s): M77903_P3, M77903_P1, M77903_P1 8, M77903_P11, M77903_P12 and M77903_P2.

Segment cluster M77903_node_22 (SEQ ID NO:3327) according to the present invention is supported by 129 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297), M77903_T30 (SEQ ID NO:3298) and M77903_T32 (SEQ ID NO:3299). Table 3170 below describes the starting and ending position of this segment on each transcript.

TABLE 3170

Segment location on transcripts

| Transcript name | Segment starting position | Segment ending position |
| --- | --- | --- |
| M77903_T8 (SEQ ID NO: 3293) | 820 | 898 |
| M77903_T19 (SEQ ID NO: 3294) | 820 | 898 |
| M77903_T26 (SEQ ID NO: 3295) | 820 | 898 |
| M77903_T28 (SEQ ID NO: 3296) | 820 | 898 |
| M77903_T29 (SEQ ID NO: 3297) | 820 | 898 |
| M77903_T30 (SEQ ID NO: 3298) | 820 | 898 |
| M77903_T32 (SEQ ID NO: 3299) | 820 | 898 |

This segment can be found in the following protein(s): M77903_P3, M77903_P1, M77903_P18, M77903_P11, M77903_P12 and M77903_P2.

Segment cluster M77903_node_28 (SEQ ID NO:3328) according to the present invention is supported by 134 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296), M77903_T29 (SEQ ID NO:3297) and M77903_T30 (SEQ ID NO:3298). Table 3171 below describes the starting and ending position of this segment on each transcript.

TABLE 3171

Segment location on transcripts

| Transcript name | Segment starting position | Segment ending position |
| --- | --- | --- |
| M77903_T8 (SEQ ID NO: 3293) | 1042 | 1135 |
| M77903_T19 (SEQ ID NO: 3294) | 899 | 992 |
| M77903_T26 (SEQ ID NO: 3295) | 899 | 992 |
| M77903_T28 (SEQ ID NO: 3296) | 899 | 992 |
| M77903_T29 (SEQ ID NO: 3297) | 899 | 992 |
| M77903_T30 (SEQ ID NO: 3298) | 899 | 992 |

This segment can be found in both coding and non-coding regions of transcript(s) as follows. The segment can be found in a non-coding region of transcript(s) that are related to the following protein(s): M77903_P3. This segment can also be found in the following protein(s): M77903_P1, M77903_P18, M77903_P11, M77903_P12 and M77903_P2, since it is in the coding region for the corresponding transcript.

Segment cluster M77903_node_29 (SEQ ID NO:3329) according to the present invention can be found in the following transcript(s): M77903_T30 (SEQ ID NO:3298). Table 3172 below describes the starting and ending position of this segment on each transcript.

TABLE 3172

Segment location on transcripts

| Transcript name | Segment starting position | Segment ending position |
| --- | --- | --- |
| M77903_T30 (SEQ ID NO: 3298) | 993 | 1009 |

This segment can be found in the following protein(s): M77903_P2.

Segment cluster M77903_node_31 (SEQ ID NO:3330) according to the present invention can be found in the following transcript(s): M77903_T29 (SEQ ID NO:3297) and M77903_T30 (SEQ ID NO:3298). Table 3173 below describes the starting and ending position of this segment on each transcript.

TABLE 3173

Segment location on transcripts

| Transcript name | Segment starting position | Segment ending position |
| --- | --- | --- |
| M77903_T29 (SEQ ID NO: 3297) | 993 | 1007 |
| M77903_T30 (SEQ ID NO: 3298) | 1282 | 1296 |

This segment can be found in both coding and non-coding regions of transcript(s) as follows. The segment can be found in a non-coding region of transcript(s) that are related to the following protein(s): M77903_P2. This segment can also be found in the following protein(s): M77903_P12, since it is in the coding region for the corresponding transcript.

Segment cluster M77903_node_32 (SEQ ID NO:3331) according to the present invention is supported by 1 libraries. The number of libraries was determined as previously described. This segment can be found in the following transcript(s): M77903_T30 (SEQ ID NO:3298). Table 3174 below describes the starting and ending position of this segment on each transcript.

TABLE 3174

Segment location on transcripts

| Transcript name | Segment starting position | Segment ending position |
| --- | --- | --- |
| M77903_T30 (SEQ ID NO: 3298) | 1297 | 1328 |

This segment can be found in a non-coding region of transcript(s) that are related to the following protein(s): M77903_P2.

Segment cluster M77903_node_34 (SEQ ID NO:3332) according to the present invention is supported by 134 libraries. The number of libraries was determined as previously described. This segment can be found in the following transcript(s): M77903_T8 (SEQ ID NO:3293), M77903_T19 (SEQ ID NO:3294), M77903_T26 (SEQ ID NO:3295), M77903_T28 (SEQ ID NO:3296) and M77903_T29 (SEQ ID NO:3297). Table 39 below describes the starting and ending position of this segment on each transcript.

TABLE 3175

Segment location on transcripts

| Transcript name | Segment starting position | Segment ending position |
|---|---|---|
| M77903_T8 (SEQ ID NO: 3293) | 1136 | 1199 |
| M77903_T19 (SEQ ID NO: 3294) | 993 | 1056 |
| M77903_T26 (SEQ ID NO: 3295) | 993 | 1056 |
| M77903_T28 (SEQ ID NO: 3296) | 993 | 1056 |
| M77903_T29 (SEQ ID NO: 3297) | 1008 | 1071 |

This segment can be found in both coding and non-coding regions of transcript(s) as follows. The segment can be found in a non-coding region of transcript(s) that are related to the following protein(s): M77903_P3. This segment can also be found in the following protein(s): M77903_P1, M77903_P18, M77903_P11 and M77903_P12, since it is in the coding region for the corresponding transcript.

Segment cluster M77903_node_41 (SEQ ID NO:3333) according to the present invention is supported by 119 libraries. The number of libraries was determined as previously described. This segment can be found in the following transcript(s): M77903_T8 (SEQ ID NO:3293), M77903_T19 (SEQ ID NO:3294) and M77903_T26 (SEQ ID NO:3295). Table 3176 below describes the starting and ending position of this segment on each transcript.

TABLE 3176

Segment location on transcripts

| Transcript name | Segment starting position | Segment ending position |
|---|---|---|
| M77903_T8 (SEQ ID NO: 3293) | 3146 | 3206 |
| M77903_T19 (SEQ ID NO: 3294) | 3003 | 3063 |
| M77903_T26 (SEQ ID NO: 3295) | 1242 | 1302 |

This segment can be found in a non-coding region of transcript(s) that are related to the following protein(s): M77903_P3, M77903_P1 and M77903_P18.

Segment cluster M77903_node_42 (SEQ ID NO:3334) according to the present invention is supported by 123 libraries. The number of libraries was determined as previously described. This segment can be found in the following transcript(s): M77903_T8 (SEQ ID NO:3293). Table 3177 below describes the starting and ending position of this segment on each transcript.

TABLE 3177

Segment location on transcripts

| Transcript name | Segment starting position | Segment ending position |
|---|---|---|
| M77903_T8 (SEQ ID NO: 3293) | 3207 | 3300 |

This segment can be found in a non-coding region of transcript(s) that are related to the following protein(s): M77903_P3.

Description for Cluster M78445

Cluster M78445 features 4 transcript(s) and 42 segment(s) of interest, the names for which are given in Tables 3178 and 3179, respectively, the sequences themselves are given at the end of the application. The selected protein variants are given in Table 3180.

TABLE 3178

Transcripts of interest

Transcript Name

M78445_T0 (SEQ ID NO: 3335)
M78445_T1 (SEQ ID NO: 3336)
M78445_T24 (SEQ ID NO: 3337)
M78445_T44 (SEQ ID NO: 3338)

TABLE 3179

Segments of interest

Segment Name

M78445_node_0 (SEQ ID NO: 3339)
M78445_node_4 (SEQ ID NO: 3340)
M78445_node_35 (SEQ ID NO: 3341)
M78445_node_36 (SEQ ID NO: 3342)
M78445_node_42 (SEQ ID NO: 3343)
M78445_node_47 (SEQ ID NO: 3344)
M78445_node_48 (SEQ ID NO: 3345)
M78445_node_60 (SEQ ID NO: 3346)
M78445_node_64 (SEQ ID NO: 3347)
M78445_node_67 (SEQ ID NO: 3348)
M78445_node_73 (SEQ ID NO: 3349)
M78445_node_74 (SEQ ID NO: 3350)
M78445_node_75 (SEQ ID NO: 3351)
M78445_node_76 (SEQ ID NO: 3352)
M78445_node_78 (SEQ ID NO: 3353)
M78445_node_80 (SEQ ID NO: 3354)
M78445_node_81 (SEQ ID NO: 3355)
M78445_node_82 (SEQ ID NO: 3356)
M78445_node_84 (SEQ ID NO: 3357)
M78445_node_87 (SEQ ID NO: 3358)
M78445_node_90 (SEQ ID NO: 3359)
M78445_node_91 (SEQ ID NO: 3360)
M78445_node_5 (SEQ ID NO: 3361)
M78445_node_6 (SEQ ID NO: 3362)
M78445_node_7 (SEQ ID NO: 3363)
M78445_node_38 (SEQ ID NO: 3364)
M78445_node_40 (SEQ ID NO: 3365)
M78445_node_44 (SEQ ID NO: 3366)
M78445_node_45 (SEQ ID NO: 3367)
M78445_node_55 (SEQ ID NO: 3368)
M78445_node_56 (SEQ ID NO: 3369)
M78445_node_62 (SEQ ID NO: 3370)
M78445_node_69 (SEQ ID NO: 3371)
M78445_node_70 (SEQ ID NO: 3372)
M78445_node_71 (SEQ ID NO: 3373)
M78445_node_72 (SEQ ID NO: 3374)
M78445_node_77 (SEQ ID NO: 3375)
M78445_node_79 (SEQ ID NO: 3376)
M78445_node_83 (SEQ ID NO: 3377)
M78445_node_85 (SEQ ID NO: 3378)
M78445_node_86 (SEQ ID NO: 3379)
M78445_node_88 (SEQ ID NO: 3380)

TABLE 3180

Proteins of interest

| Protein Name | Corresponding Transcript(s) |
|---|---|
| M78445_P1 | M78445_T0 (SEQ ID NO: 3335); M78445_T1 (SEQ ID NO: 3336) |
| M78445_P6 | M78445_T24 (SEQ ID NO: 3337) |
| M78445_P11 | M78445_T44 (SEQ ID NO: 3338) |

These sequences are variants of the known protein CUG triplet repeat RNA-binding protein 1 (SwissProt accession identifier CUG1_HUMAN; known also according to the synonyms CUG-BP1; RNA-binding protein BRUNOL-2; Deadenylation factor CUG-BP; 50 kDa Nuclear polyadenylated RNA-binding protein; EDEN-BP), referred to herein as the previously known protein.

Protein CUG triplet repeat RNA-binding protein 1 is known or believed to have the following function(s): Regulates splicing and translation of various RNAs. Binds to (CUG)n triplet repeats and to Bruno response elements. The sequence for protein CUG triplet repeat RNA-binding protein 1 is given at the end of the application, as "CUG triplet repeat RNA-binding protein 1 amino acid sequence". Protein CUG triplet repeat RNA-binding protein 1 localization is believed to be Nuclear.

The following GO Annotation(s) apply to the previously known protein. The following annotation(s) were found: mRNA splice site selection; mRNA processing; germ-cell development; RNA interference, which are annotation(s) related to Biological Process; RNA binding; pre-mRNA splicing factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M78445 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 78 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 78 and Table 3181. This cluster is overexpressed (at least at a minimum level) in the following pathological conditions: ovarian carcinoma.

TABLE 3181

Normal tissue distribution

| Name of Tissue | Number |
| --- | --- |
| adrenal | 128 |
| bladder | 82 |
| bone | 71 |
| brain | 131 |
| colon | 94 |
| epithelial | 88 |
| general | 109 |
| head and neck | 0 |
| kidney | 96 |
| liver | 9 |
| lung | 99 |
| lymph nodes | 197 |
| breast | 52 |
| bone marrow | 0 |
| muscle | 42 |
| ovary | 0 |
| pancreas | 43 |
| prostate | 96 |
| skin | 69 |
| stomach | 109 |
| T cells | 0 |
| Thyroid | 38 |
| uterus | 168 |

TABLE 3182

P values and ratios for expression in cancerous tissue

| Name of Tissue | P1 | P2 | SP1 | R3 | SP2 | R4 |
| --- | --- | --- | --- | --- | --- | --- |
| adrenal | 6.7e−01 | 7.2e−01 | 1 | 0.2 | 8.5e−01 | 0.7 |
| bladder | 7.0e−01 | 6.6e−01 | 3.5e−01 | 1.1 | 4.1e−01 | 1.1 |
| bone | 7.0e−01 | 5.3e−01 | 7.9e−01 | 0.8 | 3.2e−01 | 1.3 |
| brain | 5.6e−01 | 5.9e−01 | 3.9e−01 | 1.0 | 4.4e−01 | 0.9 |
| colon | 1.3e−01 | 8.6e−02 | 6.4e−01 | 1.1 | 5.4e−01 | 1.1 |
| epithelial | 8.2e−01 | 1.4e−01 | 1.6e−01 | 1.2 | 4.1e−01 | 1.2 |
| general | 5.6e−02 | 8.0e−02 | 5.8e−01 | 1.0 | 2.7e−01 | 1.0 |
| head and neck | 1.2e−01 | 1.4e−01 | 2.1e−01 | 3.9 | 4.2e−01 | 2.2 |
| kidney | 7.8e−01 | 7.6e−01 | 6.9e−01 | 0.9 | 4.5e−01 | 1.1 |
| liver | 4.6e−01 | 6.6e−01 | 1 | 1.7 | 3.3e−01 | 2.2 |
| lung | 5.7e−01 | 8.0e−01 | 5.1e−01 | 1.1 | 4.3e−01 | 0.9 |
| lymph nodes | 5.9e−01 | 7.5e−01 | 9.0e−01 | 0.7 | 8.2e−01 | 0.6 |
| breast | 6.6e−01 | 4.7e−01 | 4.0e−01 | 1.5 | 4.5e−01 | 1.4 |
| bone marrow | 1 | 6.7e−01 | 1 | 1.0 | 5.3e−01 | 2.1 |
| muscle | 6.1e−01 | 3.8e−01 | 1 | 0.3 | 7.7e−01 | 0.8 |
| ovary | 5.6e−03 | 2.4e−03 | 1.5e−02 | 5.8 | 8.3e−03 | 5.9 |
| pancreas | 4.3e−01 | 3.2e−01 | 4.6e−01 | 1.2 | 2.5e−01 | 1.4 |
| prostate | 3.1e−01 | 4.7e−01 | 3.5e−01 | 1.2 | 6.3e−01 | 0.9 |
| skin | 6.0e−01 | 3.3e−01 | 2.6e−01 | 2.1 | 3.3e−01 | 0.8 |
| stomach | 4.9e−01 | 6.7e−01 | 8.1e−01 | 0.8 | 1.8e−01 | 1.1 |
| T cells | 6.7e−01 | 6.7e−01 | 1 | 1.0 | 7.2e−01 | 1.4 |
| Thyroid | 3.4e−01 | 3.4e−01 | 6.7e−01 | 1.3 | 6.7e−01 | 1.3 |
| uterus | 7.1e−01 | 7.4e−01 | 9.6e−01 | 0.4 | 8.9e−01 | 0.6 |

As noted above, cluster M78445 features 42 segment(s), which were listed in Table 3179 above and for which the sequence(s) are given at the end of the application. These segment(s) are portions of nucleic acid sequence(s) which are described herein separately because they are of particular interest. A description of each segment according to the present invention is now provided.

Segment cluster M78445_node_0 (SEQ ID NO:3339) according to the present invention is supported by 3 libraries. The number of libraries was determined as previously described. This segment can be found in the following transcript(s): M78445_T1 (SEQ ID NO:3336). Table 3183 below describes the starting and ending position of this segment on each transcript.

TABLE 3183

Segment location on transcripts

| Transcript name | Segment starting position | Segment ending position |
| --- | --- | --- |
| M78445_T1 (SEQ ID NO: 3336) | 1 | 232 |

This segment can be found in a non-coding region of transcript(s) that are related to the following protein(s): M78445_P1.

Segment cluster M78445_node_4 (SEQ ID NO:3340) according to the present invention is supported by 8 libraries. The number of libraries was determined as previously described. This segment can be found in the following transcript(s): M78445_T0 (SEQ ID NO:3335) and M78445_T44 (SEQ ID NO:3338). Table 3184 below describes the starting and ending position of this segment on each transcript.

TABLE 3184

Segment location on transcripts

| Transcript name | Segment starting position | Segment ending position |
|---|---|---|
| M78445_T0 (SEQ ID NO: 3335) | 1 | 364 |
| M78445_T44 (SEQ ID NO: 3338) | 1 | 364 |

This segment can be found in a non-coding region of transcript(s) that are related to the following protein(s): M78445_P1 and M78445_P11.

Segment cluster M78445_node_35 (SEQ ID NO:3341) according to the present invention is supported by 3 libraries. The number of libraries was determined as previously described. This segment can be found in the following transcript(s): M78445_T24 (SEQ ID NO:3337). Table 3185 below describes the starting and ending position of this segment on each transcript.

TABLE 3185

Segment location on transcripts

| Transcript name | Segment starting position | Segment ending position |
|---|---|---|
| M78445_T24 (SEQ ID NO: 3337) | 1 | 638 |

This segment can be found in a non-coding region of transcript(s) that are related to the following protein(s): M78445_P6.

Segment cluster M78445_node_36 (SEQ ID NO:3342) according to the present invention is supported by 60 libraries. The number of libraries was determined as previously described. This segment can be found in the following transcript(s): M78445_T0 (SEQ ID NO:3335), M78445_T1 (SEQ ID NO:3336), M78445_T24 (SEQ ID NO:3337) and M78445_T44 (SEQ ID NO:3338). Table 3186 below describes the starting and ending position of this segment on each transcript.

TABLE 3186

Segment location on transcripts

| Transcript name | Segment starting position | Segment ending position |
|---|---|---|
| M78445_T0 (SEQ ID NO: 3335) | 486 | 673 |
| M78445_T1 (SEQ ID NO: 3336) | 354 | 541 |
| M78445_T24 (SEQ ID NO: 3337) | 639 | 826 |
| M78445_T44 (SEQ ID NO: 3338) | 486 | 673 |

This segment can be found in both coding and non-coding regions of transcript(s) as follows. The segment can be found in a non-coding region of transcript(s) that are related to the following protein(s): M78445_P6. This segment can also be found in the following protein(s): M78445_P1 and M78445_P11, since it is in the coding region for the corresponding transcript.

Segment cluster M78445_node_42 (SEQ ID NO:3343) according to the present invention is supported by 62 libraries. The number of libraries was determined as previously described. This segment can be found in the following transcript(s): M78445_T0 (SEQ ID NO:3335), M78445_T1 (SEQ ID NO:3336), M78445_T24 (SEQ ID NO:3337) and M78445_T44 (SEQ ID NO:3338). Table 3187 below describes the starting and ending position of this segment on each transcript.

TABLE 3187

Segment location on transcripts

| Transcript name | Segment starting position | Segment ending position |
|---|---|---|
| M78445_T0 (SEQ ID NO: 3335) | 806 | 940 |
| M78445_T1 (SEQ ID NO: 3336) | 674 | 808 |
| M78445_T24 (SEQ ID NO: 3337) | 959 | 1093 |
| M78445_T44 (SEQ ID NO: 3338) | 806 | 940 |

This segment can be found in both coding and non-coding regions of transcript(s) as follows. The segment can be found in a non-coding region of transcript(s) that are related to the following protein(s): M78445_P6. This segment can also be found in the following protein(s): M78445_P1 and M78445_P11, since it is in the coding region for the corresponding transcript.

Segment cluster M78445_node_47 (SEQ ID NO:3344) according to the present invention is supported by 60 libraries. The number of libraries was determined as previously described. This segment can be found in the following transcript(s): M78445_T0 (SEQ ID NO:3335), M78445_T1 (SEQ ID NO:3336), M78445_T24 (SEQ ID NO:3337) and M78445_T44 (SEQ ID NO:3338). Table 3188 below describes the starting and ending position of this segment on each transcript.

TABLE 3188

Segment location on transcripts

| Transcript name | Segment starting position | Segment ending position |
|---|---|---|
| M78445_T0 (SEQ ID NO: 3335) | 1021 | 1182 |
| M78445_T1 (SEQ ID NO: 3336) | 889 | 1050 |
| M78445_T24 (SEQ ID NO: 3337) | 1094 | 1255 |
| M78445_T44 (SEQ ID NO: 3338) | 1021 | 1182 |

This segment can be found in the following protein(s): M78445_P1, M78445_P6 and M78445_P11.

Segment cluster M78445_node_48 (SEQ ID NO:3345) according to the present invention is supported by 24 libraries. The number of libraries was determined as previously described. This segment can be found in the following transcript(s): M78445_T44 (SEQ ID NO:3338). Table 3189 below describes the starting and ending position of this segment on each transcript.

TABLE 3189

Segment location on transcripts

| Transcript name | Segment starting position | Segment ending position |
|---|---|---|
| M78445_T44 (SEQ ID NO: 3338) | 1183 | 2749 |

This segment can be found in the following protein(s): M78445_P11.

Segment cluster M78445_node_60 (SEQ ID NO:3346) according to the present invention is supported by 52 libraries. The number of libraries was determined as previously described. This segment can be found in the following transcript(s): M78445_T0 (SEQ ID NO:3335), M78445_T1

(SEQ ID NO:3336) and M78445_T24 (SEQ ID NO:3337). Table 3190 below describes the starting and ending position of this segment on each transcript.

TABLE 3190

Segment location on transcripts

| Transcript name | Segment starting position | Segment ending position |
|---|---|---|
| M78445_T0 (SEQ ID NO: 3335) | 1259 | 1387 |
| M78445_T1 (SEQ ID NO: 3336) | 1127 | 1255 |
| M78445_T24 (SEQ ID NO: 3337) | 1332 | 1460 |

This segment can be found in the following protein(s): M78445_P1 and M78445_P6.

Segment cluster M78445_node__64 (SEQ ID NO:3347) according to the present invention is supported by 61 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3191 below describes the starting and ending position of this segment on each transcript.

TABLE 3191

Segment location on transcripts

| Transcript name | Segment starting position | Segment ending position |
|---|---|---|
| M78445_T0 (SEQ ID NO: 3335) | 1502 | 1687 |
| M78445_T1 (SEQ ID NO: 3336) | 1370 | 1555 |
| M78445_T24 (SEQ ID NO: 3337) | 1575 | 1760 |

This segment can be found in the following protein(s): M78445_P1 and M78445_P6.

Segment cluster M78445_node__67 (SEQ ID NO:3348) according to the present invention is supported by 69 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3192 below describes the starting and ending position of this segment on each transcript.

TABLE 3192

Segment location on transcripts

| Transcript name | Segment starting position | Segment ending position |
|---|---|---|
| M78445_T0 (SEQ ID NO: 3335) | 1688 | 1831 |
| M78445_T1 (SEQ ID NO: 3336) | 1556 | 1699 |
| M78445_T24 (SEQ ID NO: 3337) | 1761 | 1904 |

This segment can be found in the following protein(s): M78445_P1 and M78445_P6.

Segment cluster M78445_node__73 (SEQ ID NO:3349) according to the present invention is supported by 114 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3193 below describes the starting and ending position of this segment on each transcript.

TABLE 3193

Segment location on transcripts

| Transcript name | Segment starting position | Segment ending position |
|---|---|---|
| M78445_T0 (SEQ ID NO: 3335) | 2192 | 3050 |
| M78445_T1 (SEQ ID NO: 3336) | 2060 | 2918 |
| M78445_T24 (SEQ ID NO: 3337) | 2265 | 3123 |

This segment can be found in a non-coding region of transcript(s) that are related to the following protein(s): M78445_P1 and M78445_P6.

Segment cluster M78445_node__74 (SEQ ID NO:3350) according to the present invention is supported by 97 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3194 below describes the starting and ending position of this segment on each transcript.

TABLE 3194

Segment location on transcripts

| Transcript name | Segment starting position | Segment ending position |
|---|---|---|
| M78445_T0 (SEQ ID NO: 3335) | 3051 | 3283 |
| M78445_T1 (SEQ ID NO: 3336) | 2919 | 3151 |
| M78445_T24 (SEQ ID NO: 3337) | 3124 | 3356 |

This segment can be found in a non-coding region of transcript(s) that are related to the following protein(s): M78445_P1 and M78445_P6.

Segment cluster M78445_node__75 (SEQ ID NO:3351) according to the present invention is supported by 87 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3195 below describes the starting and ending position of this segment on each transcript.

TABLE 3195

Segment location on transcripts

| Transcript name | Segment starting position | Segment ending position |
|---|---|---|
| M78445_T0 (SEQ ID NO: 3335) | 3284 | 3431 |
| M78445_T1 (SEQ ID NO: 3336) | 3152 | 3299 |
| M78445_T24 (SEQ ID NO: 3337) | 3357 | 3504 |

This segment can be found in a non-coding region of transcript(s) that are related to the following protein(s): M78445_P1 and M78445_P6.

Segment cluster M78445_node__76 (SEQ ID NO:3352) according to the present invention is supported by 106 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3196 below describes the starting and ending position of this segment on each transcript.

TABLE 3196

Segment location on transcripts

| Transcript name | Segment starting position | Segment ending position |
|---|---|---|
| M78445_T0 (SEQ ID NO: 3335) | 3432 | 3633 |
| M78445_T1 (SEQ ID NO: 3336) | 3300 | 3501 |
| M78445_T24 (SEQ ID NO: 3337) | 3505 | 3706 |

This segment can be found in a non-coding region of transcript(s) that are related to the following protein(s): M78445_P1 and M78445_P6.

Segment cluster M78445_node_78 (SEQ ID NO:3353) according to the present invention is supported by 168 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3197 below describes the starting and ending position of this segment on each transcript.

TABLE 3197

Segment location on transcripts

| Transcript name | Segment starting position | Segment ending position |
|---|---|---|
| M78445_T0 (SEQ ID NO: 3335) | 3638 | 5204 |
| M78445_T1 (SEQ ID NO: 3336) | 3506 | 5072 |
| M78445_T24 (SEQ ID NO: 3337) | 3711 | 5277 |

This segment can be found in a non-coding region of transcript(s) that are related to the following protein(s): M78445_P1 and M78445_P6.

Segment cluster M78445_node_80 (SEQ ID NO:3354) according to the present invention is supported by 59 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3198 below describes the starting and ending position of this segment on each transcript.

TABLE 3198

Segment location on transcripts

| Transcript name | Segment starting position | Segment ending position |
|---|---|---|
| M78445_T0 (SEQ ID NO: 3335) | 5297 | 5652 |
| M78445_T1 (SEQ ID NO: 3336) | 5165 | 5520 |
| M78445_T24 (SEQ ID NO: 3337) | 5370 | 5725 |

This segment can be found in a non-coding region of transcript(s) that are related to the following protein(s): M78445_P1 and M78445_P6.

Segment cluster M78445_node_81 (SEQ ID NO:3355) according to the present invention is supported by 48 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3199 below describes the starting and ending position of this segment on each transcript.

TABLE 3199

Segment location on transcripts

| Transcript name | Segment starting position | Segment ending position |
|---|---|---|
| M78445_T0 (SEQ ID NO:3335) | 5653 | 5928 |
| M78445_T1 (SEQ ID NO:3336) | 5521 | 5796 |
| M78445_T24 (SEQ ID NO:3337) | 5726 | 6001 |

This segment can be found in a non-coding region of transcript(s) that are related to the following protein(s): M78445_P1 and M78445_P6.

Segment cluster M78445_node_82 (SEQ ID NO:3356) according to the present invention is supported by 119 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3200 below describes the starting and ending position of this segment on each transcript.

TABLE 3200

Segment location on transcripts

| Transcript name | Segment starting position | Segment ending position |
|---|---|---|
| M78445_T0 (SEQ ID NO: 3335) | 5929 | 6832 |
| M78445_T1 (SEQ ID NO: 3336) | 5797 | 6700 |
| M78445_T24 (SEQ ID NO: 3337) | 6002 | 6905 |

This segment can be found in a non-coding region of transcript(s) that are related to the following protein(s): M78445_P1 and M78445_P6.

Segment cluster M78445_node_84 (SEQ ID NO:3357) according to the present invention is supported by 159 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3201 below describes the starting and ending position of this segment on each transcript.

TABLE 3201

Segment location on transcripts

| Transcript name | Segment starting position | Segment ending position |
|---|---|---|
| M78445_T0 (SEQ ID NO: 3335) | 6949 | 7179 |
| M78445_T1 (SEQ ID NO: 3336) | 6817 | 7047 |
| M78445_T24 (SEQ ID NO: 3337) | 7022 | 7252 |

This segment can be found in a non-coding region of transcript(s) that are related to the following protein(s): M78445_P1 and M78445_P6.

Segment cluster M78445_node_87 (SEQ ID NO:3358) according to the present invention is supported by 246 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3202 below describes the starting and ending position of this segment on each transcript.

TABLE 3202

Segment location on transcripts

| Transcript name | Segment starting position | Segment ending position |
|---|---|---|
| M78445_T0 (SEQ ID NO: 3335) | 7244 | 7676 |
| M78445_T1 (SEQ ID NO: 3336) | 7112 | 7544 |
| M78445_T24 (SEQ ID NO: 3337) | 7317 | 7749 |

This segment can be found in a non-coding region of transcript(s) that are related to the following protein(s): M78445_P1 and M78445_P6.

Segment cluster M78445_node_90 (SEQ ID NO:3359) according to the present invention is supported by 152 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3203 below describes the starting and ending position of this segment on each transcript.

TABLE 3203

Segment location on transcripts

| Transcript name | Segment starting position | Segment ending position |
|---|---|---|
| M78445_T0 (SEQ ID NO: 3335) | 7692 | 8000 |
| M78445_T1 (SEQ ID NO: 3336) | 7560 | 7868 |
| M78445_T24 (SEQ ID NO: 3337) | 7765 | 8073 |

This segment can be found in a non-coding region of transcript(s) that are related to the following protein(s): M78445_P1 and M78445_P6.

Segment cluster M78445_node_91 (SEQ ID NO:3360) according to the present invention is supported by 106 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3204 below describes the starting and ending position of this segment on each transcript.

TABLE 3204

Segment location on transcripts

| Transcript name | Segment starting position | Segment ending position |
|---|---|---|
| M78445_T0 (SEQ ID NO: 3335) | 8001 | 8265 |
| M78445_T1 (SEQ ID NO: 3336) | 7869 | 8133 |
| M78445_T24 (SEQ ID NO: 3337) | 8074 | 8338 |

This segment can be found in a non-coding region of transcript(s) that are related to the following protein(s): M78445_P1 and M78445_P6.

According to an optional embodiment of the present invention, short segments related to the above cluster are also provided. These segments are up to about 120 bp in length, and so are included in a separate description.

Segment cluster M78445_node_5 (SEQ ID NO:3361) according to the present invention is supported by 37 libraries. The number of libraries was determined as previously described. This segment can be found in the following transcript(s): M78445_T0 (SEQ ID NO:3335), M78445_T1 (SEQ ID NO:3336) and M78445_T44 (SEQ ID NO:3338).

Table 3205 below describes the starting and ending position of this segment on each transcript.

TABLE 3205

Segment location on transcripts

| Transcript name | Segment starting position | Segment ending position |
|---|---|---|
| M78445_T0 (SEQ ID NO: 3335) | 365 | 424 |
| M78445_T1 (SEQ ID NO: 3336) | 233 | 292 |
| M78445_T44 (SEQ ID NO: 3338) | 365 | 424 |

This segment can be found in a non-coding region of transcript(s) that are related to the following protein(s): M78445_P1 and M78445_P11.

Segment cluster M78445_node_6 (SEQ ID NO:3362) according to the present invention can be found in the following transcript(s): M78445_T0 (SEQ ID NO:3335), M78445_T1 (SEQ ID NO:3336) and M78445_T44 (SEQ ID NO:3338). Table 3206 below describes the starting and ending position of this segment on each transcript.

TABLE 3206

Segment location on transcripts

| Transcript name | Segment starting position | Segment ending position |
|---|---|---|
| M78445_T0 (SEQ ID NO: 3335) | 425 | 445 |
| M78445_T1 (SEQ ID NO: 3336) | 293 | 313 |
| M78445_T44 (SEQ ID NO: 3338) | 425 | 445 |

This segment can be found in a non-coding region of transcript(s) that are related to the following protein(s): M78445_P1 and M78445_P11.

Segment cluster M78445_node_7 (SEQ ID NO:3363) according to the present invention is supported by 40 libraries. The number of libraries was determined as previously described. This segment can be found in the following transcript(s): M78445_T0 (SEQ ID NO:3335), M78445_T1 (SEQ ID NO:3336) and M78445_T44 (SEQ ID NO:3338). Table 3207 below describes the starting and ending position of this segment on each transcript.

TABLE 3207

Segment location on transcripts

| Transcript name | Segment starting position | Segment ending position |
|---|---|---|
| M78445_T0 (SEQ ID NO: 3335) | 446 | 485 |
| M78445_T1 (SEQ ID NO: 3336) | 314 | 353 |
| M78445_T44 (SEQ ID NO: 3338) | 446 | 485 |

This segment can be found in a non-coding region of transcript(s) that are related to the following protein(s): M78445_P1 and M78445_P11.

Segment cluster M78445_node_38 (SEQ ID NO:3364) according to the present invention is supported by 57 libraries. The number of libraries was determined as previously described. This segment can be found in the following transcript(s): M78445_T0 (SEQ ID NO:3335), M78445_T1 (SEQ ID NO:3336), M78445_T24 (SEQ ID NO:3337) and M78445_T44 (SEQ ID NO:3338). Table 3208 below describes the starting and ending position of this segment on each transcript.

TABLE 3208

Segment location on transcripts

| Transcript name | Segment starting position | Segment ending position |
|---|---|---|
| M78445_T0 (SEQ ID NO: 3335) | 674 | 756 |
| M78445_T1 (SEQ ID NO: 3336) | 542 | 624 |
| M78445_T24 (SEQ ID NO: 3337) | 827 | 909 |
| M78445_T44 (SEQ ID NO: 3338) | 674 | 756 |

This segment can be found in both coding and non-coding regions of transcript(s) as follows. The segment can be found in a non-coding region of transcript(s) that are related to the following protein(s): M78445_P6. This segment can also be found in the following protein(s): M78445_P1 and M78445_P11, since it is in the coding region for the corresponding transcript.

Segment cluster M78445_node_40 (SEQ ID NO:3365) according to the present invention is supported by 55 libraries. The number of libraries was determined as previously described. This segment can be found in the following transcript(s): M78445_T0 (SEQ ID NO:3335), M78445_T1 (SEQ ID NO:3336), M78445_T24 (SEQ ID NO:3337) and M78445_T44 (SEQ ID NO:3338). Table 3209 below describes the starting and ending position of this segment on each transcript.

TABLE 3209

Segment location on transcripts

| Transcript name | Segment starting position | Segment ending position |
|---|---|---|
| M78445_T0 (SEQ ID NO: 3335) | 757 | 805 |
| M78445_T1 (SEQ ID NO: 3336) | 625 | 673 |
| M78445_T24 (SEQ ID NO: 3337) | 910 | 958 |
| M78445_T44 (SEQ ID NO: 3338) | 757 | 805 |

This segment can be found in both coding and non-coding regions of transcript(s) as follows. The segment can be found in a non-coding region of transcript(s) that are related to the following protein(s): M78445_P6. This segment can also be found in the following protein(s): M78445_P1 and M78445_P11, since it is in the coding region for the corresponding transcript.

Segment cluster M78445_node_44 (SEQ ID NO:3366) according to the present invention is supported by 54 libraries. The number of libraries was determined as previously described. This segment can be found in the following transcript(s): M78445_T0 (SEQ ID NO:3335), M78445_T1 (SEQ ID NO:3336) and M78445_T44 (SEQ ID NO:3338). Table 3210 below describes the starting and ending position of this segment on each transcript.

TABLE 3210

Segment location on transcripts

| Transcript name | Segment starting position | Segment ending position |
|---|---|---|
| M78445_T0 (SEQ ID NO: 3335) | 941 | 1012 |
| M78445_T1 (SEQ ID NO: 3336) | 809 | 880 |
| M78445_T44 (SEQ ID NO: 3338) | 941 | 1012 |

This segment can be found in the following protein(s): M78445_P1 and M78445_P11.

Segment cluster M78445_node_45 (SEQ ID NO:3367) according to the present invention can be found in the following transcript(s): M78445_T0 (SEQ ID NO:3335), M78445_T1 (SEQ ID NO:3336) and M78445_T44 (SEQ ID NO:3338). Table 3211 below describes the starting and ending position of this segment on each transcript.

TABLE 3211

Segment location on transcripts

| Transcript name | Segment starting position | Segment ending position |
|---|---|---|
| M78445_T0 (SEQ ID NO: 3335) | 1013 | 1020 |
| M78445_T1 (SEQ ID NO: 3336) | 881 | 888 |
| M78445_T44 (SEQ ID NO: 3338) | 1013 | 1020 |

This segment can be found in the following protein(s): M78445_P1 and M78445_P11.

Segment cluster M78445_node_55 (SEQ ID NO:3368) according to the present invention can be found in the following transcript(s): M78445_T0 (SEQ ID NO:3335), M78445_T1 (SEQ ID NO:3336) and M78445_T24 (SEQ ID NO:3337). Table 3212 below describes the starting and ending position of this segment on each transcript.

TABLE 3212

Segment location on transcripts

| Transcript name | Segment starting position | Segment ending position |
|---|---|---|
| M78445_T0 (SEQ ID NO: 3335) | 1183 | 1194 |
| M78445_T1 (SEQ ID NO: 3336) | 1051 | 1062 |
| M78445_T24 (SEQ ID NO: 3337) | 1256 | 1267 |

This segment can be found in the following protein(s): M78445_P1 and M78445_P6.

Segment cluster M78445_node_56 (SEQ ID NO:3369) according to the present invention is supported by 47 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3213 below describes the starting and ending position of this segment on each transcript.

TABLE 3213

Segment location on transcripts

| Transcript name | Segment starting position | Segment ending position |
|---|---|---|
| M78445_T0 (SEQ ID NO: 3335) | 1195 | 1258 |
| M78445_T1 (SEQ ID NO: 3336) | 1063 | 1126 |
| M78445_T24 (SEQ ID NO: 3337) | 1268 | 1331 |

This segment can be found in the following protein(s): M78445_P1 and M78445_P6.

Segment cluster M78445_node_62 (SEQ ID NO:3370) according to the present invention is supported by 53 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3214 below describes the starting and ending position of this segment on each transcript.

TABLE 3214

Segment location on transcripts

| Transcript name | Segment starting position | Segment ending position |
|---|---|---|
| M78445_T0 (SEQ ID NO: 3335) | 1388 | 1501 |
| M78445_T1 (SEQ ID NO: 3336) | 1256 | 1369 |
| M78445_T24 (SEQ ID NO: 3337) | 1461 | 1574 |

This segment can be found in the following protein(s): M78445_P1 and M78445_P6.

Segment cluster M78445_node__69 (SEQ ID NO:3371) according to the present invention is supported by 66 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3215 below describes the starting and ending position of this segment on each transcript.

TABLE 3215

Segment location on transcripts

| Transcript name | Segment starting position | Segment ending position |
|---|---|---|
| M78445_T0 (SEQ ID NO: 3335) | 1832 | 1889 |
| M78445_T1 (SEQ ID NO: 3336) | 1700 | 1757 |
| M78445_T24 (SEQ ID NO: 3337) | 1905 | 1962 |

This segment can be found in the following protein(s): M78445_P1 and M78445_P6.

Segment cluster M78445_node__70 (SEQ ID NO:3372) according to the present invention is supported by 73 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3216 below describes the starting and ending position of this segment on each transcript.

TABLE 3216

Segment location on transcripts

| Transcript name | Segment starting position | Segment ending position |
|---|---|---|
| M78445_T0 (SEQ ID NO: 3335) | 1890 | 1998 |
| M78445_T1 (SEQ ID NO: 3336) | 1758 | 1866 |
| M78445_T24 (SEQ ID NO: 3337) | 1963 | 2071 |

This segment can be found in the following protein(s): M78445_P1 and M78445_P6.

Segment cluster M78445_node__71 (SEQ ID NO:3373) according to the present invention is supported by 18 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3217 below describes the starting and ending position of this segment on each transcript.

TABLE 3217

Segment location on transcripts

| Transcript name | Segment starting position | Segment ending position |
|---|---|---|
| M78445_T0 (SEQ ID NO: 3335) | 1999 | 2086 |
| M78445_T1 (SEQ ID NO: 3336) | 1867 | 1954 |
| M78445_T24 (SEQ ID NO: 3337) | 2072 | 2159 |

This segment can be found in a non-coding region of transcript(s) that are related to the following protein(s): M78445_P1 and M78445_P6.

Segment cluster M78445_node__72 (SEQ ID NO:3374) according to the present invention is supported by 29 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3218 below describes the starting and ending position of this segment on each transcript.

TABLE 3218

Segment location on transcripts

| Transcript name | Segment starting position | Segment ending position |
|---|---|---|
| M78445_T0 (SEQ ID NO: 3335) | 2087 | 2191 |
| M78445_T1 (SEQ ID NO: 3336) | 1955 | 2059 |
| M78445_T24 (SEQ ID NO: 3337) | 2160 | 2264 |

This segment can be found in a non-coding region of transcript(s) that are related to the following protein(s): M78445_P1 and M78445_P6.

Segment cluster M78445_node__77 (SEQ ID NO:3375) according to the present invention can be found in the following transcript(s): M78445_T0 (SEQ ID NO:3335), M78445_T1 (SEQ ID NO:3336) and M78445_T24 (SEQ ID NO:3337). Table 3219 below describes the starting and ending position of this segment on each transcript.

TABLE 3219

Segment location on transcripts

| Transcript name | Segment starting position | Segment ending position |
|---|---|---|
| M78445_T0 (SEQ ID NO: 3335) | 3634 | 3637 |
| M78445_T1 (SEQ ID NO: 3336) | 3502 | 3505 |
| M78445_T24 (SEQ ID NO: 3337) | 3707 | 3710 |

This segment can be found in a non-coding region of transcript(s) that are related to the following protein(s): M78445_P1 and M78445_P6.

Segment cluster M78445_node__79 (SEQ ID NO:3376) according to the present invention is supported by 22 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3220 below describes the starting and ending position of this segment on each transcript.

TABLE 3220

Segment location on transcripts

| Transcript name | Segment starting position | Segment ending position |
|---|---|---|
| M78445_T0 (SEQ ID NO: 3335) | 5205 | 5296 |
| M78445_T1 (SEQ ID NO: 3336) | 5073 | 5164 |
| M78445_T24 (SEQ ID NO: 3337) | 5278 | 5369 |

This segment can be found in a non-coding region of transcript(s) that are related to the following protein(s): M78445_P1 and M78445_P6.

Segment cluster M78445_node_83 (SEQ ID NO:3377) according to the present invention is supported by 84 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3221 below describes the starting and ending position of this segment on each transcript.

TABLE 3221

Segment location on transcripts

| Transcript name | Segment starting position | Segment ending position |
|---|---|---|
| M78445_T0 (SEQ ID NO: 3335) | 6833 | 6948 |
| M78445_T1 (SEQ ID NO: 3336) | 6701 | 6816 |
| M78445_T24 (SEQ ID NO: 3337) | 6906 | 7021 |

This segment can be found in a non-coding region of transcript(s) that are related to the following protein(s): M78445_P1 and M78445_P6.

Segment cluster M78445_node_85 (SEQ ID NO:3378) according to the present invention is supported by 136 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3222 below describes the starting and ending position of this segment on each transcript.

TABLE 3222

Segment location on transcripts

| Transcript name | Segment starting position | Segment ending position |
|---|---|---|
| M78445_T0 (SEQ ID NO: 3335) | 7180 | 7205 |
| M78445_T1 (SEQ ID NO: 3336) | 7048 | 7073 |
| M78445_T24 (SEQ ID NO: 3337) | 7253 | 7278 |

This segment can be found in a non-coding region of transcript(s) that are related to the following protein(s): M78445_P1 and M78445_P6.

Segment cluster M78445_node_86 (SEQ ID NO:3379) according to the present invention is supported by 147 libraries. The number of libraries was determined as previously described. This segment can be found in the following transcript(s): M78445_T0 (SEQ ID NO:3335), M78445_T1 (SEQ ID NO:3336) and M78445_T24 (SEQ ID NO:3337). Table 3223 below describes the starting and ending position of this segment on each transcript.

TABLE 3223

Segment location on transcripts

| Transcript name | Segment starting position | Segment ending position |
|---|---|---|
| M78445_T0 (SEQ ID NO: 3335) | 7206 | 7243 |
| M78445_T1 (SEQ ID NO: 3336) | 7074 | 7111 |
| M78445_T24 (SEQ ID NO: 3337) | 7279 | 7316 |

This segment can be found in a non-coding region of transcript(s) that are related to the following protein(s): M78445_P1 and M78445_P6.

Segment cluster M78445_node_88 (SEQ ID NO:3380) according to the present invention can be found in the following transcript(s): M78445_T0 (SEQ ID NO:3335), M78445_T1 (SEQ ID NO:3336) and M78445_T24 (SEQ ID NO:3337). Table 3224 below describes the starting and ending position of this segment on each transcript.

TABLE 3224

Segment location on transcripts

| Transcript name | Segment starting position | Segment ending position |
|---|---|---|
| M78445_T0 (SEQ ID NO: 3335) | 7677 | 7691 |
| M78445_T1 (SEQ ID NO: 3336) | 7545 | 7559 |
| M78445_T24 (SEQ ID NO: 3337) | 7750 | 7764 |

This segment can be found in a non-coding region of transcript(s) that are related to the following protein(s): M78445_P1 and M78445_P6.

Description for Cluster M79251

Cluster M79251 features 2 transcript(s) and 26 segment(s) of interest, the names for which are given in Tables 3225 and 3226, respectively, the sequences themselves are given at the end of the application. The selected protein variants are given in Table 3227.

TABLE 3225

Transcripts of interest
Transcript Name

M79251_T7 (SEQ ID NO: 3381)
M79251_T27 (SEQ ID NO: 3382)

TABLE 3226

Segments of interest
Segment Name

M79251_node_2 (SEQ ID NO: 3383)
M79251_node_14 (SEQ ID NO: 3384)
M79251_node_19 (SEQ ID NO: 3385)
M79251_node_27 (SEQ ID NO: 3386)
M79251_node_29 (SEQ ID NO: 3387)
M79251_node_31 (SEQ ID NO: 3388)
M79251_node_35 (SEQ ID NO: 3389)
M79251_node_49 (SEQ ID NO: 3390)
M79251_node_52 (SEQ ID NO: 3391)
M79251_node_53 (SEQ ID NO: 3392)
M79251_node_57 (SEQ ID NO: 3393)
M79251_node_1 (SEQ ID NO: 3394)
M79251_node_10 (SEQ ID NO: 3395)
M79251_node_11 (SEQ ID NO: 3396)
M79251_node_18 (SEQ ID NO: 3397)
M79251_node_24 (SEQ ID NO: 3398)

TABLE 3226-continued

Segments of interest
Segment Name

M79251_node_25 (SEQ ID NO: 3399)
M79251_node_33 (SEQ ID NO: 3400)
M79251_node_39 (SEQ ID NO: 3401)
M79251_node_42 (SEQ ID NO: 3402)
M79251_node_48 (SEQ ID NO: 3403)
M79251_node_50 (SEQ ID NO: 3404)
M79251_node_51 (SEQ ID NO: 3405)
M79251_node_54 (SEQ ID NO: 3406)
M79251_node_55 (SEQ ID NO: 3407)
M79251_node_56 (SEQ ID NO: 3408)

TABLE 3227

Proteins of interest

| Protein Name | Corresponding Transcript(s) |
|---|---|
| M79251_P6 | M79251_T7 (SEQ ID NO: 3381) |
| M79251_P15 | M79251_T27 (SEQ ID NO: 3382) |

These sequences are variants of the known protein DnaJ homolog subfamily A member 3, mitochondrial precursor (SwissProt accession identifier DJA3_HUMAN; known also according to the synonyms Tumorous imaginal discs protein Tid56 homolog; DnaJ protein Tid-1; hTid-1), referred to herein as the previously known protein.

Protein DnaJ homolog subfamily A member 3, mitochondrial precursor is known or believed to have the following function(s): Modulates apoptotic signal transduction or effector structures within the mitochondrial matrix. Affect cytochrome C release from the mitochondria and caspase 3 activation, but not caspase 8 activation. Isoform I increases apoptosis triggered by both TNF and the DNA-damaging agent mytomycin C; in sharp contrast, isoform 2 suppresses apoptosis. Can modulate IFN-gamma-mediated transcriptional activity. The sequence for protein DnaJ homolog subfamily A member 3, mitochondrial precursor is given at the end of the application, as "DnaJ homolog subfamily A member 3, mitochondrial precursor amino acid sequence". Known polymorphisms for this sequence are as shown in Table 3228.

TABLE 3228

Amino acid mutations for Known Protein

| SNP position(s) on amino acid sequence | Comment |
|---|---|
| 121 | H->Q: Loss of modulation of apoptosis. |
| 75 | Y -> N |
| 320 | M -> W |

Protein DnaJ homolog subfamily A member 3, mitochondrial precursor localization is believed to be Mitochondrial matrix.

The following GO Annotation(s) apply to the previously known protein. The following annotation(s) were found: protein folding; apoptosis, which are annotation(s) related to Biological Process; chaperone, which are annotation(s) related to Molecular Function; and mitochondrion, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M79251 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 79 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 79 and Table 3229. This cluster is overexpressed (at least at a minimum level) in the following pathological conditions: bone malignant tumors, epithelial malignant tumors and a mixture of malignant tumors from different tissues.

TABLE 3229

Normal tissue distribution

| Name of Tissue | Number |
|---|---|
| bladder | 41 |
| Bone | 0 |
| Brain | 60 |
| Colon | 31 |
| epithelial | 32 |
| general | 43 |
| head and neck | 0 |
| kidney | 4 |
| liver | 4 |
| lung | 23 |
| lymph nodes | 67 |
| breast | 8 |
| muscle | 72 |
| ovary | 14 |
| pancreas | 24 |
| prostate | 102 |
| skin | 43 |
| stomach | 36 |
| Thyroid | 0 |
| uterus | 45 |

TABLE 3230

P values and ratios for expression in cancerous tissue

| Name of Tissue | P1 | P2 | SP1 | R3 | SP2 | R4 |
|---|---|---|---|---|---|---|
| bladder | 7.6e−01 | 8.1e−01 | 8.1e−01 | 0.9 | 9.0e−01 | 0.7 |
| bone | 1.8e−02 | 8.7e−03 | 1.6e−01 | 4.3 | 8.3e−02 | 4.2 |
| brain | 5.9e−01 | 3.6e−01 | 9.1e−01 | 0.7 | 1.1e−02 | 1.6 |
| colon | 3.7e−01 | 2.1e−01 | 2.5e−01 | 1.9 | 3.8e−02 | 2.0 |
| epithelial | 5.5e−02 | 6.4e−03 | 5.4e−03 | 1.9 | 1.0e−06 | 2.5 |
| general | 7.3e−02 | 6.8e−04 | 4.5e−02 | 1.3 | 2.6e−08 | 1.9 |
| head and neck | 1.4e−01 | 1.2e−01 | 4.6e−01 | 2.4 | 4.2e−01 | 2.1 |
| kidney | 5.5e−01 | 5.5e−01 | 1.1e−01 | 3.2 | 1.7e−01 | 2.6 |
| liver | 3.3e−01 | 6.0e−01 | 1 | 1.2 | 1.6e−01 | 1.8 |
| lung | 7.7e−01 | 5.4e−01 | 1.9e−01 | 1.6 | 5.2e−02 | 2.2 |
| lymph nodes | 6.9e−01 | 4.9e−01 | 1 | 0.3 | 7.9e−01 | 0.8 |
| breast | 4.4e−01 | 2.2e−01 | 4.7e−01 | 1.7 | 6.4e−02 | 2.9 |
| muscle | 8.5e−01 | 6.1e−01 | 1 | 0.2 | 6.5e−01 | 0.8 |
| ovary | 1.7e−01 | 9.3e−02 | 6.9e−02 | 2.8 | 3.1e−01 | 3.2 |
| pancreas | 5.1e−01 | 5.2e−01 | 5.6e−01 | 1.1 | 3.9e−01 | 1.4 |
| prostate | 8.1e−01 | 7.7e−01 | 8.3e−01 | 0.7 | 6.2e−01 | 0.7 |
| skin | 6.3e−01 | 6.3e−01 | 4.6e−01 | 1.7 | 1.6e−01 | 1.2 |
| stomach | 8.2e−01 | 4.3e−01 | 1 | 0.5 | 3.7e−01 | 1.5 |
| Thyroid | 5.0e−01 | 5.0e−01 | 6.7e−01 | 1.5 | 6.7e−01 | 1.5 |
| uterus | 3.0e−01 | 3.3e−01 | 5.6e−01 | 1.2 | 5.6e−01 | 1.1 |

As noted above, cluster M79251 features 26 segment(s), which were listed in Table 3226 above and for which the sequence(s) are given at the end of the application. These segment(s) are portions of nucleic acid sequence(s) which are described herein separately because they are of particular interest. A description of each segment according to the present invention is now provided.

Segment cluster M79251_node_2 (SEQ ID NO:3383) according to the present invention is supported by 98 libraries. The number of libraries was determined as previously described. This segment can be found in the following transcript(s): M79251_T7 (SEQ ID NO:3381) and M79251_T27 (SEQ ID NO:3382). Table 3231 below describes the starting and ending position of this segment on each transcript.

TABLE 3231

Segment location on transcripts

| Transcript name | Segment starting position | Segment ending position |
|---|---|---|
| M79251_T7 (SEQ ID NO: 3381) | 57 | 288 |
| M79251_T27 (SEQ ID NO: 3382) | 57 | 288 |

This segment can be found in both coding and non-coding regions of transcript(s) as follows. The segment can be found in a non-coding region of transcript(s) that are related to the following protein(s): M79251_P6. This segment can also be found in the following protein(s): M79251_P15, since it is in the coding region for the corresponding transcript.

Segment cluster M79251_node_14 (SEQ ID NO:3384) according to the present invention is supported by 2 libraries. The number of libraries was determined as previously described. This segment can be found in the following transcript(s): M79251_T7 (SEQ ID NO:3381). Table 3232 below describes the starting and ending position of this segment on each transcript.

TABLE 3232

Segment location on transcripts

| Transcript name | Segment starting position | Segment ending position |
|---|---|---|
| M79251_T7 (SEQ ID NO: 3381) | 423 | 578 |

This segment can be found in the following protein(s): M79251_P6.

Segment cluster M79251_node_19 (SEQ ID NO:3385) according to the present invention is supported by 12 libraries. The number of libraries was determined as previously described. This segment can be found in the following transcript(s): M79251_T27 (SEQ ID NO:3382). Table 3233 below describes the starting and ending position of this segment on each transcript.

TABLE 3233

Segment location on transcripts

| Transcript name | Segment starting position | Segment ending position |
|---|---|---|
| M79251_T27 (SEQ ID NO: 3382) | 507 | 983 |

This segment can be found in the following protein(s): M79251_P15.

Segment cluster M79251_node_27 (SEQ ID NO:3386) according to the present invention is supported by 97 libraries. The number of libraries was determined as previously described. This segment can be found in the following transcript(s): M79251_T7 (SEQ ID NO:3381). Table 3234 below describes the starting and ending position of this segment on each transcript.

TABLE 3234

Segment location on transcripts

| Transcript name | Segment starting position | Segment ending position |
|---|---|---|
| M79251_T7 (SEQ ID NO: 3381) | 734 | 863 |

This segment can be found in the following protein(s): M79251_P6.

Segment cluster M79251_node_29 (SEQ ID NO:3387) according to the present invention is supported by 104 libraries. The number of libraries was determined as previously described. This segment can be found in the following transcript(s): M79251_T7 (SEQ ID NO:3381). Table 3235 below describes the starting and ending position of this segment on each transcript.

TABLE 3235

Segment location on transcripts

| Transcript name | Segment starting position | Segment ending position |
|---|---|---|
| M79251_T7 (SEQ ID NO: 3381) | 864 | 1016 |

This segment can be found in the following protein(s): M79251_P6.

Segment cluster M79251_node_31 (SEQ ID NO:3388) according to the present invention is supported by 93 libraries. The number of libraries was determined as previously described. This segment can be found in the following transcript(s): M79251_T7 (SEQ ID NO:3381). Table 3236 below describes the starting and ending position of this segment on each transcript.

TABLE 3236

Segment location on transcripts

| Transcript name | Segment starting position | Segment ending position |
|---|---|---|
| M79251_T7 (SEQ ID NO: 3381) | 1017 | 1164 |

This segment can be found in the following protein(s): M79251_P6.

Segment cluster M79251_node_35 (SEQ ID NO:3389) according to the present invention is supported by 74 libraries. The number of libraries was determined as previously described. This segment can be found in the following transcript(s): M79251_T7 (SEQ ID NO:3381). Table 3237 below describes the starting and ending position of this segment on each transcript.

TABLE 3237

Segment location on transcripts

| Transcript name | Segment starting position | Segment ending position |
|---|---|---|
| M79251_T7 (SEQ ID NO: 3381) | 1230 | 1358 |

This segment can be found in the following protein(s): M79251_P6.

Segment cluster M79251_node_49 (SEQ ID NO:3390) according to the present invention is supported by 102 libraries. The number of libraries was determined as previously described. This segment can be found in the following transcript(s): M79251_T7 (SEQ ID NO:3381). Table 3238 below describes the starting and ending position of this segment on each transcript.

TABLE 3238

Segment location on transcripts

| Transcript name | Segment starting position | Segment ending position |
|---|---|---|
| M79251_T7 (SEQ ID NO: 3381) | 1651 | 1807 |

This segment can be found in a non-coding region of transcript(s) that are related to the following protein(s): M79251_P6.

Segment cluster M79251_node_52 (SEQ ID NO:3391) according to the present invention is supported by 135 libraries. The number of libraries was determined as previously described. This segment can be found in the following transcript(s): M79251_T7 (SEQ ID NO:3381). Table 3239 below describes the starting and ending position of this segment on each transcript.

TABLE 3239

Segment location on transcripts

| Transcript name | Segment starting position | Segment ending position |
|---|---|---|
| M79251_T7 (SEQ ID NO: 3381) | 1921 | 2181 |

This segment can be found in a non-coding region of transcript(s) that are related to the following protein(s): M79251_P6.

Segment cluster M79251_node_53 (SEQ ID NO:3392) according to the present invention is supported by 142 libraries. The number of libraries was determined as previously described. This segment can be found in the following transcript(s): M79251_T7 (SEQ ID NO:3381). Table 3240 below describes the starting and ending position of this segment on each transcript.

TABLE 3240

Segment location on transcripts

| Transcript name | Segment starting position | Segment ending position |
|---|---|---|
| M79251_T7 (SEQ ID NO: 3381) | 2182 | 2514 |

This segment can be found in a non-coding region of transcript(s) that are related to the following protein(s): M79251_P6.

Segment cluster M79251_node_57 (SEQ ID NO:3393) according to the present invention is supported by 102 libraries. The number of libraries was determined as previously described. This segment can be found in the following transcript(s): M79251_T7 (SEQ ID NO:3381). Table 3241 below describes the starting and ending position of this segment on each transcript.

TABLE 3241

Segment location on transcripts

| Transcript name | Segment starting position | Segment ending position |
|---|---|---|
| M79251_T7 (SEQ ID NO: 3381) | 2674 | 2811 |

This segment can be found in a non-coding region of transcript(s) that are related to the following protein(s): M79251_P6.

According to an optional embodiment of the present invention, short segments related to the above cluster are also provided. These segments are up to about 120 bp in length, and so are included in a separate description.

Segment cluster M79251_node_1 (SEQ ID NO:3394) according to the present invention is supported by 7 libraries. The number of libraries was determined as previously described. This segment can be found in the following transcript(s): M79251_T7 (SEQ ID NO:3381) and M79251_T27 (SEQ ID NO:3382). Table 3242 below describes the starting and ending position of this segment on each transcript.

TABLE 3242

Segment location on transcripts

| Transcript name | Segment starting position | Segment ending position |
|---|---|---|
| M79251_T7 (SEQ ID NO: 3381) | 1 | 56 |
| M79251_T27 (SEQ ID NO: 3382) | 1 | 56 |

This segment can be found in a non-coding region of transcript(s) that are related to the following protein(s): M79251_P6 and M79251_P15.

Segment cluster M79251_node_10 (SEQ ID NO:3395) according to the present invention is supported by 98 libraries. The number of libraries was determined as previously described. This segment can be found in the following transcript(s): M79251_T7 (SEQ ID NO:3381) and M79251_T27 (SEQ ID NO:3382). Table 3243 below describes the starting and ending position of this segment on each transcript.

TABLE 3243

Segment location on transcripts

| Transcript name | Segment starting position | Segment ending position |
|---|---|---|
| M79251_T7 (SEQ ID NO: 3381) | 289 | 344 |
| M79251_T27 (SEQ ID NO: 3382) | 289 | 344 |

This segment can be found in both coding and non-coding regions of transcript(s) as follows. The segment can be found in a non-coding region of transcript(s) that are related to the following protein(s): M79251_P6. This segment can also be found in the following protein(s): M79251_P15, since it is in the coding region for the corresponding transcript.

Segment cluster M79251_node_11 (SEQ ID NO:3396) according to the present invention is supported by 93 libraries. The number of libraries was determined as previously described. This segment can be found in the following transcript(s): M79251_T7 (SEQ ID NO:3381) and M79251_T27 (SEQ ID NO:3382). Table 3244 below describes the starting and ending position of this segment on each transcript.

TABLE 3244

Segment location on transcripts

| Transcript name | Segment starting position | Segment ending position |
|---|---|---|
| M79251_T7 (SEQ ID NO: 3381) | 345 | 422 |
| M79251_T27 (SEQ ID NO: 3382) | 345 | 422 |

This segment can be found in both coding and non-coding regions of transcript(s) as follows. The segment can be found in a non-coding region of transcript(s) that are related to the following protein(s): M79251_P6. This segment can also be found in the following protein(s): M79251_P15, since it is in the coding region for the corresponding transcript.

Segment cluster M79251_node_18 (SEQ ID NO:3397) according to the present invention is supported by 105 libraries. The number of libraries was determined as previously described. This segment can be found in the following transcript(s): M79251_T7 (SEQ ID NO:3381) and M79251_T27 (SEQ ID NO:3382). Table 3245 below describes the starting and ending position of this segment on each transcript.

TABLE 3245

Segment location on transcripts

| Transcript name | Segment starting position | Segment ending position |
|---|---|---|
| M79251_T7 (SEQ ID NO: 3381) | 579 | 662 |
| M79251_T27 (SEQ ID NO: 3382) | 423 | 506 |

This segment can be found in the following protein(s): M79251_P6 and M79251_P15.

Segment cluster M79251_node_24 (SEQ ID NO:3398) according to the present invention is supported by 96 libraries. The number of libraries was determined as previously described. This segment can be found in the following transcript(s): M79251_T7 (SEQ ID NO:3381). Table 3246 below describes the starting and ending position of this segment on each transcript.

TABLE 3246

Segment location on transcripts

| Transcript name | Segment starting position | Segment ending position |
|---|---|---|
| M79251_T7 (SEQ ID NO: 3381) | 663 | 707 |

This segment can be found in the following protein(s): M79251_P6.

Segment cluster M79251_node_25 (SEQ ID NO:3399) according to the present invention is supported by 92 libraries. The number of libraries was determined as previously described. This segment can be found in the following transcript(s): M79251_T7 (SEQ ID NO:3381). Table 3247 below describes the starting and ending position of this segment on each transcript.

TABLE 3247

Segment location on transcripts

| Transcript name | Segment starting position | Segment ending position |
|---|---|---|
| M79251_T7 (SEQ ID NO: 3381) | 708 | 733 |

This segment can be found in the following protein(s): M79251_P6.

Segment cluster M79251_node_33 (SEQ ID NO:3400) according to the present invention is supported by 74 libraries. The number of libraries was determined as previously described. This segment can be found in the following transcript(s): M79251_T7 (SEQ ID NO:3381). Table 3248 below describes the starting and ending position of this segment on each transcript.

TABLE 3248

Segment location on transcripts

| Transcript name | Segment starting position | Segment ending position |
|---|---|---|
| M79251_T7 (SEQ ID NO: 3381) | 1165 | 1229 |

This segment can be found in the following protein(s): M79251_P6.

Segment cluster M79251_node_39 (SEQ ID NO:3401) according to the present invention is supported by 79 libraries. The number of libraries was determined as previously described. This segment can be found in the following transcript(s): M79251_T7 (SEQ ID NO:3381). Table 3249 below describes the starting and ending position of this segment on each transcript.

TABLE 3249

Segment location on transcripts

| Transcript name | Segment starting position | Segment ending position |
|---|---|---|
| M79251_T7 (SEQ ID NO: 3381) | 1359 | 1474 |

This segment can be found in the following protein(s): M79251_P6.

Segment cluster M79251_node_42 (SEQ ID NO:3402) according to the present invention is supported by 88 libraries. The number of libraries was determined as previously described. This segment can be found in the following transcript(s): M79251_T7 (SEQ ID NO:3381). Table 3250 below describes the starting and ending position of this segment on each transcript.

TABLE 3250

Segment location on transcripts

| Transcript name | Segment starting position | Segment ending position |
|---|---|---|
| M79251_T7 (SEQ ID NO: 3381) | 1475 | 1572 |

This segment can be found in the following protein(s): M79251_P6.

Segment cluster M79251_node_48 (SEQ ID NO:3403) according to the present invention is supported by 83 libraries. The number of libraries was determined as previously described. This segment can be found in the following transcript(s): M79251_T7 (SEQ ID NO:3381). Table 3251 below describes the starting and ending position of this segment on each transcript.

TABLE 3251

Segment location on transcripts

| Transcript name | Segment starting position | Segment ending position |
|---|---|---|
| M79251_T7 (SEQ ID NO: 3381) | 1573 | 1650 |

This segment can be found in the following protein(s): M79251_P6.

Segment cluster M79251_node__50 (SEQ ID NO:3404) according to the present invention is supported by 90 libraries. The number of libraries was determined as previously described. This segment can be found in the following transcript(s): M79251_T7 (SEQ ID NO:3381). Table 3252 below describes the starting and ending position of this segment on each transcript.

TABLE 3252

Segment location on transcripts

| Transcript name | Segment starting position | Segment ending position |
|---|---|---|
| M79251_T7 (SEQ ID NO: 3381) | 1808 | 1866 |

This segment can be found in a non-coding region of transcript(s) that are related to the following protein(s): M79251_P6.

Segment cluster M79251_node__51 (SEQ ID NO:3405) according to the present invention is supported by 95 libraries. The number of libraries was determined as previously described. This segment can be found in the following transcript(s): M79251_T7 (SEQ ID NO:3381). Table 3253 below describes the starting and ending position of this segment on each transcript.

TABLE 3253

Segment location on transcripts

| Transcript name | Segment starting position | Segment ending position |
|---|---|---|
| M79251_T7 (SEQ ID NO: 3381) | 1867 | 1920 |

This segment can be found in a non-coding region of transcript(s) that are related to the following protein(s): M79251_P6.

Segment cluster M79251_node__54 (SEQ ID NO:3406) according to the present invention is supported by 106 libraries. The number of libraries was determined as previously described. This segment can be found in the following transcript(s): M79251_T7 (SEQ ID NO:3381). Table 3254 below describes the starting and ending position of this segment on each transcript.

TABLE 3254

Segment location on transcripts

| Transcript name | Segment starting position | Segment ending position |
|---|---|---|
| M79251_T7 (SEQ ID NO: 3381) | 2515 | 2569 |

This segment can be found in a non-coding region of transcript(s) that are related to the following protein(s): M79251_P6.

Segment cluster M79251_node__55 (SEQ ID NO:3407) according to the present invention is supported by 108 libraries. The number of libraries was determined as previously described. This segment can be found in the following transcript(s): M79251_T7 (SEQ ID NO:3381). Table 3255 below describes the starting and ending position of this segment on each transcript.

TABLE 3255

Segment location on transcripts

| Transcript name | Segment starting position | Segment ending position |
|---|---|---|
| M79251_T7 (SEQ ID NO: 3381) | 2570 | 2624 |

This segment can be found in a non-coding region of transcript(s) that are related to the following protein(s): M79251_P6.

Segment cluster M79251_node__56 (SEQ ID NO:3408) according to the present invention is supported by 108 libraries. The number of libraries was determined as previously described. This segment can be found in the following transcript(s): M79251_T7 (SEQ ID NO:3381). Table 3256 below describes the starting and ending position of this segment on each transcript.

TABLE 3256

Segment location on transcripts

| Transcript name | Segment starting position | Segment ending position |
|---|---|---|
| M79251_T7 (SEQ ID NO: 3381) | 2625 | 2673 |

This segment can be found in a non-coding region of transcript(s) that are related to the following protein(s): M79251_P6.

Description for Cluster M85927

Cluster M85927 features 3 transcript(s) and 15 segment(s) of interest, the names for which are given in Tables 3257 and 3258, respectively, the sequences themselves are given at the end of the application. The selected protein variants are given in Table 3259.

TABLE 3257

Transcripts of interest
Transcript Name

M85927_T0 (SEQ ID NO: 3409)
M85927_T3 (SEQ ID NO: 3410)
M85927_T5 (SEQ ID NO: 3411)

TABLE 3258

Segments of interest
Segment Name

M85927_node_0 (SEQ ID NO: 3412)
M85927_node_3 (SEQ ID NO: 3413)
M85927_node_4 (SEQ ID NO: 3414)
M85927_node_5 (SEQ ID NO: 3415)
M85927_node_9 (SEQ ID NO: 3416)
M85927_node_10 (SEQ ID NO: 3417)
M85927_node_13 (SEQ ID NO: 3418)
M85927_node_14 (SEQ ID NO: 3419)
M85927_node_15 (SEQ ID NO: 3420)
M85927_node_1 (SEQ ID NO: 3421)
M85927_node_6 (SEQ ID NO: 3422)
M85927_node_7 (SEQ ID NO: 3423)
M85927_node_8 (SEQ ID NO: 3424)
M85927_node_11 (SEQ ID NO: 3425)
M85927_node_12 (SEQ ID NO: 3426)

TABLE 3259

Proteins of interest

| Protein Name | Corresponding Transcript(s) |
|---|---|
| M85927_P1 | M85927_T3 (SEQ ID NO: 3410) |
| M85927_P2 | M85927_T5 (SEQ ID NO: 3411) |
| M85927_P6 | M85927_T0 (SEQ ID NO: 3409) |

Cluster M85927 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 80 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 80 and Table 3260. This cluster is overexpressed (at least at a minimum level) in the following pathological conditions: brain malignant tumors and prostate cancer.

TABLE 3260

Normal tissue distribution

| Name of Tissue | Number |
|---|---|
| adrenal | 80 |
| bladder | 41 |
| bone | 71 |
| brain | 14 |
| colon | 69 |
| epithelial | 86 |
| general | 81 |
| head and neck | 0 |
| kidney | 67 |
| liver | 102 |
| lung | 56 |
| lymph nodes | 120 |
| breast | 43 |
| muscle | 37 |
| ovary | 415 |
| pancreas | 35 |
| prostate | 8 |
| skin | 86 |
| stomach | 293 |
| T cells | 0 |
| Thyroid | 0 |
| uterus | 113 |

TABLE 3261

P values and ratios for expression in cancerous tissue

| Name of Tissue | P1 | P2 | SP1 | R3 | SP2 | R4 |
|---|---|---|---|---|---|---|
| Adrenal | 7.4e−01 | 7.8e−01 | 6.2e−01 | 1.1 | 7.4e−01 | 0.9 |
| Bladder | 1.7e−01 | 1.6e−01 | 4.6e−02 | 2.8 | 8.9e−02 | 2.4 |
| Bone | 8.3e−01 | 7.7e−01 | 1 | 0.3 | 5.6e−01 | 1.0 |
| Brain | 8.1e−02 | 1.6e−01 | 6.6e−03 | 4.6 | 1.6e−02 | 3.4 |
| Colon | 2.9e−01 | 2.8e−01 | 4.6e−01 | 1.2 | 5.9e−01 | 1.0 |
| Epithelial | 1.1e−01 | 9.8e−02 | 1.0e−01 | 1.2 | 3.4e−01 | 1.1 |
| General | 4.5e−02 | 7.6e−02 | 2.2e−02 | 1.3 | 1.3e−01 | 1.1 |
| head and neck | 4.3e−01 | 2.8e−01 | 1 | 1.1 | 7.5e−01 | 1.4 |
| Kidney | 2.7e−01 | 2.4e−01 | 1.9e−01 | 1.3 | 4.2e−01 | 1.0 |
| Liver | 4.1e−01 | 7.6e−01 | 5.5e−01 | 1.4 | 7.3e−01 | 0.9 |
| Lung | 8.2e−01 | 8.6e−01 | 7.1e−01 | 0.9 | 5.4e−01 | 1.0 |
| lymph nodes | 6.5e−01 | 7.8e−01 | 1 | 0.3 | 6.3e−01 | 0.6 |
| Breast | 3.4e−01 | 4.1e−01 | 3.1e−01 | 1.9 | 5.1e−01 | 1.4 |
| Muscle | 8.5e−01 | 6.1e−01 | 1 | 0.3 | 8.7e−02 | 1.4 |
| Ovary | 7.9e−01 | 8.0e−01 | 1 | 0.3 | 1 | 0.3 |
| pancreas | 3.2e−01 | 4.1e−01 | 5.0e−01 | 1.2 | 5.6e−01 | 1.0 |
| prostate | 1.4e−01 | 1.5e−01 | 7.6e−04 | 6.5 | 3.1e−03 | 5.1 |
| Skin | 5.9e−01 | 5.3e−01 | 6.6e−01 | 1.0 | 7.3e−01 | 0.8 |
| stomach | 6.1e−01 | 4.7e−01 | 1 | 0.2 | 1 | 0.3 |
| T cells | 1 | 6.7e−01 | 1 | 1.0 | 7.2e−01 | 1.4 |
| Thyroid | 6.4e−01 | 6.4e−01 | 3.0e−01 | 2.0 | 3.0e−01 | 2.0 |
| Uterus | 6.2e−01 | 2.6e−01 | 9.2e−01 | 0.5 | 7.0e−01 | 0.8 |

As noted above, cluster M85927 features 15 segment(s), which were listed in Table 3258 above and for which the sequence(s) are given at the end of the application. These segment(s) are portions of nucleic acid sequence(s) which are described herein separately because they are of particular interest. A description of each segment according to the present invention is now provided.

Segment cluster M85927_node_0 (SEQ ID NO:3412) according to the present invention is supported by 6 libraries. The number of libraries was determined as previously described. This segment can be found in the following transcript(s): M85927_T3 (SEQ ID NO:3410). Table 3262 below describes the starting and ending position of this segment on each transcript.

TABLE 3262

Segment location on transcripts

| Transcript name | Segment starting position | Segment ending position |
|---|---|---|
| M85927_T3 (SEQ ID NO: 3410) | 1 | 127 |

This segment can be found in a non-coding region of transcript(s) that are related to the following protein(s): M85927_P1.

Segment cluster M85927_node_3 (SEQ ID NO:3413) according to the present invention is supported by 32 libraries. The number of libraries was determined as previously described. This segment can be found in the following transcript(s): M85927_T0 (SEQ ID NO:3409) and M85927_T5 (SEQ ID NO:3411). Table 3263 below describes the starting and ending position of this segment on each transcript.

TABLE 3263

Segment location on transcripts

| Transcript name | Segment starting position | Segment ending position |
|---|---|---|
| M85927_T0 (SEQ ID NO: 3409) | 1 | 1140 |
| M85927_T5 (SEQ ID NO: 3411) | 1 | 1140 |

This segment can be found in a non-coding region of transcript(s) that are related to the following protein(s): M85927_P6 and M85927_P2.

Segment cluster M85927_node_4 (SEQ ID NO:3414) according to the present invention is supported by 160 libraries. The number of libraries was determined as previously described. This segment can be found in the following transcript(s): M85927_T0 (SEQ ID NO:3409) and M85927_T5 (SEQ ID NO:3411). Table 3264 below describes the starting and ending position of this segment on each transcript.

TABLE 3264

Segment location on transcripts

| Transcript name | Segment starting position | Segment ending position |
|---|---|---|
| M85927_T0 (SEQ ID NO: 3409) | 1141 | 1293 |
| M85927_T5 (SEQ ID NO: 3411) | 1141 | 1293 |

This segment can be found in a non-coding region of transcript(s) that are related to the following protein(s): M85927_P6 and M85927_P2.

Segment cluster M85927_node_5 (SEQ ID NO:3415) according to the present invention is supported by 184 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3265 below describes the starting and ending position of this segment on each transcript.

TABLE 3265

Segment location on transcripts

| Transcript name | Segment starting position | Segment ending position |
|---|---|---|
| M85927_T0 (SEQ ID NO: 3409) | 1294 | 1415 |
| M85927_T3 (SEQ ID NO: 3410) | 139 | 260 |
| M85927_T5 (SEQ ID NO: 3411) | 1294 | 1415 |

This segment can be found in both coding and non-coding regions of transcript(s) as follows. The segment can be found in a non-coding region of transcript(s) that are related to the following protein(s): M85927_P2. This segment can also be found in the following protein(s): M85927_P6 and M85927_P1, since it is in the coding region for the corresponding transcript.

Segment cluster M85927_node_9 (SEQ ID NO:3416) according to the present invention is supported by 132 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3266 below describes the starting and ending position of this segment on each transcript.

TABLE 3266

Segment location on transcripts

| Transcript name | Segment starting position | Segment ending position |
|---|---|---|
| M85927_T0 (SEQ ID NO: 3409) | 1613 | 1892 |
| M85927_T3 (SEQ ID NO: 3410) | 458 | 737 |
| M85927_T5 (SEQ ID NO: 3411) | 1564 | 1843 |

This segment can be found in the following protein(s): M85927_P6, M85927_P1 and M85927_P2.

Segment cluster M85927_node_10 (SEQ ID NO:3417) according to the present invention is supported by 135 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3267 below describes the starting and ending position of this segment on each transcript.

TABLE 3267

Segment location on transcripts

| Transcript name | Segment starting position | Segment ending position |
|---|---|---|
| M85927_T0 (SEQ ID NO: 3409) | 1893 | 2235 |
| M85927_T3 (SEQ ID NO: 3410) | 738 | 1080 |
| M85927_T5 (SEQ ID NO: 3411) | 1844 | 2186 |

This segment can be found in the following protein(s): M85927_P6, M85927_P1 and M85927_P2.

Segment cluster M85927_node_13 (SEQ ID NO:3418) according to the present invention is supported by 223 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3268 below describes the starting and ending position of this segment on each transcript.

TABLE 3268

Segment location on transcripts

| Transcript name | Segment starting position | Segment ending position |
|---|---|---|
| M85927_T0 (SEQ ID NO: 3409) | 2355 | 2532 |
| M85927_T3 (SEQ ID NO: 3410) | 1200 | 1377 |
| M85927_T5 (SEQ ID NO: 3411) | 2306 | 2483 |

This segment can be found in a non-coding region of transcript(s) that are related to the following protein(s): M85927_P6, M85927_P1 and M85927_P2.

Segment cluster M85927_node_14 (SEQ ID NO:3419) according to the present invention is supported by 289 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3269 below describes the starting and ending position of this segment on each transcript.

TABLE 3269

Segment location on transcripts

| Transcript name | Segment starting position | Segment ending position |
|---|---|---|
| M85927_T0 (SEQ ID NO: 3409) | 2533 | 2917 |
| M85927_T3 (SEQ ID NO: 3410) | 1378 | 1762 |
| M85927_T5 (SEQ ID NO: 3411) | 2484 | 2868 |

This segment can be found in a non-coding region of transcript(s) that are related to the following protein(s): M85927_P6, M85927_P1 and M85927_P2.

Segment cluster M85927_node_15 (SEQ ID NO:3420) according to the present invention is supported by 143 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3270 below describes the starting and ending position of this segment on each transcript.

TABLE 3270

Segment location on transcripts

| Transcript name | Segment starting position | Segment ending position |
|---|---|---|
| M85927_T0 (SEQ ID NO: 3409) | 2918 | 3108 |
| M85927_T3 (SEQ ID NO: 3410) | 1763 | 1953 |
| M85927_T5 (SEQ ID NO: 3411) | 2869 | 3059 |

This segment can be found in a non-coding region of transcript(s) that are related to the following protein(s): M85927_P6, M85927_P1 and M85927_P2.

According to an optional embodiment of the present invention, short segments related to the above cluster are also provided. These segments are up to about 120 bp in length, and so are included in a separate description.

Segment cluster M85927_node_1 (SEQ ID NO:3421) according to the present invention can be found in the following transcript(s): M85927_T3 (SEQ ID NO:3410). Table 3271 below describes the starting and ending position of this segment on each transcript.

TABLE 3271

Segment location on transcripts

| Transcript name | Segment starting position | Segment ending position |
|---|---|---|
| M85927_T3 (SEQ ID NO: 3410) | 128 | 138 |

This segment can be found in a non-coding region of transcript(s) that are related to the following protein(s): M85927_P1.

Segment cluster M85927_node_6 (SEQ ID NO:3422) according to the present invention is supported by 183 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3272 below describes the starting and ending position of this segment on each transcript.

TABLE 3272

Segment location on transcripts

| Transcript name | Segment starting position | Segment ending position |
|---|---|---|
| M85927_T0 (SEQ ID NO: 3409) | 1416 | 1459 |
| M85927_T3 (SEQ ID NO: 3410) | 261 | 304 |
| M85927_T5 (SEQ ID NO: 3411) | 1416 | 1459 |

This segment can be found in both coding and non-coding regions of transcript(s) as follows. The segment can be found in a non-coding region of transcript(s) that are related to the following protein(s): M85927_P2. This segment can also be found in the following protein(s): M85927_P6 and M85927_P1, since it is in the coding region for the corresponding transcript.

Segment cluster M85927_node_7 (SEQ ID NO:3423) according to the present invention is supported by 170 libraries. The number of libraries was determined as previously described. This segment can be found in the following transcript(s): M85927_T0 (SEQ ID NO:3409) and M85927_T3 (SEQ ID NO:3410). Table 3273 below describes the starting and ending position of this segment on each transcript.

TABLE 3273

Segment location on transcripts

| Transcript name | Segment starting position | Segment ending position |
|---|---|---|
| M85927_T0 (SEQ ID NO: 3409) | 1460 | 1508 |
| M85927_T3 (SEQ ID NO: 3410) | 305 | 353 |

This segment can be found in the following protein(s): M85927_P6 and M85927_P1.

Segment cluster M85927_node_8 (SEQ ID NO:3424) according to the present invention is supported by 153 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3274 below describes the starting and ending position of this segment on each transcript.

TABLE 3274

Segment location on transcripts

| Transcript name | Segment starting position | Segment ending position |
|---|---|---|
| M85927_T0 (SEQ ID NO: 3409) | 1509 | 1612 |
| M85927_T3 (SEQ ID NO: 3410) | 354 | 457 |
| M85927_T5 (SEQ ID NO: 3411) | 1460 | 1563 |

This segment can be found in both coding and non-coding regions of transcript(s) as follows. The segment can be found in a non-coding region of transcript(s) that are related to the following protein(s): M85927_P2. This segment can also be found in the following protein(s): M85927_P6 and M85927_P1, since it is in the coding region for the corresponding transcript.

Segment cluster M85927_node_11 (SEQ ID NO:3425) according to the present invention is supported by 96 libraries. The number of libraries was determined as previously described. This segment can be found in the following transcript(s): M85927_T0 (SEQ ID NO:3409), M85927_T3

(SEQ ID NO:3410) and M85927_T5 (SEQ ID NO:3411). Table 3275 below describes the starting and ending position of this segment on each transcript.

TABLE 3275

Segment location on transcripts

| Transcript name | Segment starting position | Segment ending position |
|---|---|---|
| M85927_T0 (SEQ ID NO: 3409) | 2236 | 2289 |
| M85927_T3 (SEQ ID NO: 3410) | 1081 | 1134 |
| M85927_T5 (SEQ ID NO: 3411) | 2187 | 2240 |

This segment can be found in a non-coding region of transcript(s) that are related to the following protein(s): M85927_P6, M85927_P1 and M85927_P2.

Segment cluster M85927_node_12 (SEQ ID NO:3426) according to the present invention is supported by 110 libraries. The number of libraries was determined as previously described. This segment can be found in the following transcript(s): M85927_T0 (SEQ ID NO:3409), M85927_T3 (SEQ ID NO:3410) and M85927_T5 (SEQ ID NO:3411). Table 3276 below describes the starting and ending position of this segment on each transcript.

TABLE 3276

Segment location on transcripts

| Transcript name | Segment starting position | Segment ending position |
|---|---|---|
| M85927_T0 (SEQ ID NO: 3409) | 2290 | 2354 |
| M85927_T3 (SEQ ID NO: 3410) | 1135 | 1199 |
| M85927_T5 (SEQ ID NO: 3411) | 2241 | 2305 |

This segment can be found in a non-coding region of transcript(s) that are related to the following protein(s): M85927_P6, M85927_P1 and M85927_P2.

Description for Cluster R14741

Cluster R14741 features 8 transcript(s) and 10 segment(s) of interest, the names for which are given in Tables 3277 and 3278, respectively, the sequences themselves are given at the end of the application. The selected protein variants are given in Table 3279.

TABLE 3277

Transcripts of interest
Transcript Name

R14741_T0 (SEQ ID NO: 3427)
R14741_T1 (SEQ ID NO: 3428)
R14741_T2 (SEQ ID NO: 3429)
R14741_T3 (SEQ ID NO: 3430)
R14741_T4 (SEQ ID NO: 3431)
R14741_T5 (SEQ ID NO: 3432)
R14741_T6 (SEQ ID NO: 3433)
R14741_T7 (SEQ ID NO: 3434)

TABLE 3278

Segments of interest
Segment Name

R14741_node_0 (SEQ ID NO: 3435)
R14741_node_2 (SEQ ID NO: 3436)
R14741_node_3 (SEQ ID NO: 3437)

TABLE 3278-continued

Segments of interest
Segment Name

R14741_node_4 (SEQ ID NO: 3438)
R14741_node_5 (SEQ ID NO: 3439)
R14741_node_6 (SEQ ID NO: 3440)
R14741_node_8 (SEQ ID NO: 3441)
R14741_node_9 (SEQ ID NO: 3442)
R14741_node_10 (SEQ ID NO: 3443)
R14741_node_7 (SEQ ID NO: 3444)

TABLE 3279

Proteins of interest

| Protein Name | Corresponding Transcript(s) |
|---|---|
| R14741_P1 | R14741_T0 (SEQ ID NO: 3427) |
| R14741_P2 | R14741_T1 (SEQ ID NO: 3428) |
| R14741_P3 | R14741_T2 (SEQ ID NO: 3429); R14741_T6 (SEQ ID NO: 3433) |
| R14741_P4 | R14741_T3 (SEQ ID NO: 3430) |
| R14741_P5 | R14741_T4 (SEQ ID NO: 3431) |
| R14741_P6 | R14741_T5 (SEQ ID NO: 3432) |
| R14741_P7 | R14741_T7 (SEQ ID NO: 3434) |

These sequences are variants of the known protein Zinc finger protein ZIC 2 (SwissProt accession identifier ZIC2_HUMAN; known also according to the synonyms Zinc finger protein of the cerebellum 2), referred to herein as the previously known protein.

Protein Zinc finger protein ZIC 2 is known or believed to have the following function(s): Involved in cerebellar development (By similarity). The sequence for protein Zinc finger protein ZIC 2 is given at the end of the application, as "Zinc finger protein ZIC 2 amino acid sequence". Known polymorphisms for this sequence are as shown in Table 3280.

TABLE 3280

Amino acid mutations for Known Protein

| SNP position(s) on amino acid sequence | Comment |
|---|---|
| 470 | A -> AAAAAAAAAAA (in HPE5)./ FTId=VAR_008856. |
| 124-128 | RGFGD -> ARLPGT |

Protein Zinc finger protein ZIC 2 localization is believed to be Nuclear.

The following GO Annotation(s) apply to the previously known protein. The following annotation(s) were found: developmental processes; neurogenesis; brain development, which are annotation(s) related to Biological Process; DNA binding, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster R14741 features 10 segment(s), which were listed in Table 3278 above and for which the sequence(s) are given at the end of the application. These segment(s) are portions of nucleic acid sequence(s) which are described herein separately because they are of particular interest. A description of each segment according to the present invention is now provided.

Segment cluster R14741_node_0 (SEQ ID NO:3435) according to the present invention is supported by 8 libraries. The number of libraries was determined as previously described. This segment can be found in the following transcript(s): R14741_T0 (SEQ ID NO:3427), R14741_T5 (SEQ ID NO:3432) and R14741_T7 (SEQ ID NO:3434). Table 3281 below describes the starting and ending position of this segment on each transcript.

TABLE 3281

Segment location on transcripts

| Transcript name | Segment starting position | Segment ending position |
|---|---|---|
| R14741_T0 (SEQ ID NO: 3427) | 1 | 1305 |
| R14741_T5 (SEQ ID NO: 3432) | 1 | 1305 |
| R14741_T7 (SEQ ID NO: 3434) | 1 | 1305 |

This segment can be found in the following protein(s): R14741_P1, R14741_P6 and R14741_P7.

Segment cluster R14741_node_2 (SEQ ID NO:3436) according to the present invention is supported by 3 libraries. The number of libraries was determined as previously described. This segment can be found in the following transcript(s): R14741_T1 (SEQ ID NO:3428), R14741_T2 (SEQ ID NO:3429), R14741_T3 (SEQ ID NO:3430), R14741_T4 (SEQ ID NO:3431) and R14741_T6 (SEQ ID NO:3433). Table 3282 below describes the starting and ending position of this segment on each transcript.

TABLE 3282

Segment location on transcripts

| Transcript name | Segment starting position | Segment ending position |
|---|---|---|
| R14741_T1 (SEQ ID NO: 3428) | 1 | 549 |
| R14741_T2 (SEQ ID NO: 3429) | 1 | 549 |
| R14741_T3 (SEQ ID NO: 3430) | 1 | 549 |
| R14741_T4 (SEQ ID NO: 3431) | 1 | 549 |
| R14741_T6 (SEQ ID NO: 3433) | 1 | 549 |

This segment can be found in a non-coding region of transcript(s) that are related to the following protein(s): R14741_P2, R14741_P3, R14741_P4 and R14741_P5.

Segment cluster R14741_node_3 (SEQ ID NO:3437) according to the present invention is supported by 5 libraries. The number of libraries was determined as previously described. This segment can be found in the following transcript(s): R14741_T1 (SEQ ID NO:3428), R14741_T2 (SEQ ID NO:3429), R14741_T3 (SEQ ID NO:3430) and R14741_T4 (SEQ ID NO:3431). Table 3283 below describes the starting and ending position of this segment on each transcript.

TABLE 3283

Segment location on transcripts

| Transcript name | Segment starting position | Segment ending position |
|---|---|---|
| R14741_T1 (SEQ ID NO: 3428) | 550 | 876 |
| R14741_T2 (SEQ ID NO: 3429) | 550 | 876 |

TABLE 3283-continued

Segment location on transcripts

| Transcript name | Segment starting position | Segment ending position |
|---|---|---|
| R14741_T3 (SEQ ID NO: 3430) | 550 | 876 |
| R14741_T4 (SEQ ID NO: 3431) | 550 | 876 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 3284.

TABLE 3284

Oligonucleotides related to this segment

| Oligonucleotide name | Overexpressed in cancers | Chip reference |
|---|---|---|
| R14741_0_0_30104 | breast malignant tumors | BRS |
| R14741_0_0_30104 | lung malignant tumors | LUN |

This segment can be found in both coding and non-coding regions of transcript(s) as follows. The segment can be found in a non-coding region of transcript(s) that are related to the following protein(s): R14741_P3, R14741_P4 and R14741_P5. This segment can also be found in the following protein(s): R14741_P2, since it is in the coding region for the corresponding transcript.

Segment cluster R14741_node_4 (SEQ ID NO:3438) according to the present invention is supported by 3 libraries. The number of libraries was determined as previously described. This segment can be found in the following transcript(s): R14741_T2 (SEQ ID NO:3429), R14741_T3 (SEQ ID NO:3430) and R14741_T4 (SEQ ID NO:3431). Table 3285 below describes the starting and ending position of this segment on each transcript.

TABLE 3285

Segment location on transcripts

| Transcript name | Segment starting position | Segment ending position |
|---|---|---|
| R14741_T2 (SEQ ID NO: 3429) | 877 | 1084 |
| R14741_T3 (SEQ ID NO: 3430) | 877 | 1084 |
| R14741_T4 (SEQ ID NO: 3431) | 877 | 1084 |

This segment can be found in a non-coding region of transcript(s) that are related to the following protein(s): R14741_P3, R14741_P4 and R14741_P5.

Segment cluster R14741_node_5 (SEQ ID NO:3439) according to the present invention is supported by 9 libraries. The number of libraries was determined as previously described. This segment can be found in the following transcript(s): R14741_T0 (SEQ ID NO:3427), R14741_T1 (SEQ ID NO:3428), R14741_T2 (SEQ ID NO:3429), R14741_T3 (SEQ ID NO:3430), R14741_T4 (SEQ ID NO:3431), R14741_T5 (SEQ ID NO:3432), R14741_T6 (SEQ ID NO:3433) and R14741_T7 (SEQ ID NO:3434). Table 3286 below describes the starting and ending position of this segment on each transcript.

TABLE 3286

Segment location on transcripts

| Transcript name | Segment starting position | Segment ending position |
|---|---|---|
| R14741_T0 (SEQ ID NO: 3427) | 1306 | 1469 |
| R14741_T1 (SEQ ID NO: 3428) | 877 | 1040 |
| R14741_T2 (SEQ ID NO: 3429) | 1085 | 1248 |
| R14741_T3 (SEQ ID NO: 3430) | 1085 | 1248 |
| R14741_T4 (SEQ ID NO: 3431) | 1085 | 1248 |
| R14741_T5 (SEQ ID NO: 3432) | 1306 | 1469 |
| R14741_T6 (SEQ ID NO: 3433) | 550 | 713 |
| R14741_T7 (SEQ ID NO: 3434) | 1306 | 1469 |

This segment can be found in both coding and non-coding regions of transcript(s) as follows. The segment can be found in a non-coding region of transcript(s) that are related to the following protein(s): R14741_P5. This segment can also be found in the following protein(s): R14741_P1, R14741_P2, R14741_P3, R14741_P4, R14741_P6 and R14741_P7, since it is in the coding region for the corresponding transcript.

Segment cluster R14741_node_6 (SEQ ID NO:3440) according to the present invention is supported by 2 libraries. The number of libraries was determined as previously described. This segment can be found in the following transcript(s): R14741_T3 (SEQ ID NO:3430) and R14741_T5 (SEQ ID NO:3432). Table 3287 below describes the starting and ending position of this segment on each transcript.

TABLE 3287

Segment location on transcripts

| Transcript name | Segment starting position | Segment ending position |
|---|---|---|
| R14741_T3 (SEQ ID NO: 3430) | 1249 | 1424 |
| R14741_T5 (SEQ ID NO: 3432) | 1470 | 1645 |

This segment can be found in the following protein(s): R14741_P4 and R14741_P6.

Segment cluster R14741_node_8 (SEQ ID NO:3441) according to the present invention is supported by 17 libraries. The number of libraries was determined as previously described. This segment can be found in the following transcript(s): R14741_T0 (SEQ ID NO:3427), R14741_T1 (SEQ ID NO:3428), R14741_T2 (SEQ ID NO:3429), R14741_T3 (SEQ ID NO:3430), R14741_T4 (SEQ ID NO:3431), R14741_T5 (SEQ ID NO:3432), R14741_T6 (SEQ ID NO:3433) and R14741_T7 (SEQ ID NO:3434). Table 3288 below describes the starting and ending position of this segment on each transcript.

TABLE 3288

Segment location on transcripts

| Transcript name | Segment starting position | Segment ending position |
|---|---|---|
| R14741_T0 (SEQ ID NO: 3427) | 1470 | 1819 |
| R14741_T1 (SEQ ID NO: 3428) | 1041 | 1390 |
| R14741_T2 (SEQ ID NO: 3429) | 1249 | 1598 |
| R14741_T3 (SEQ ID NO: 3430) | 1462 | 1811 |
| R14741_T4 (SEQ ID NO: 3431) | 1286 | 1635 |
| R14741_T5 (SEQ ID NO: 3432) | 1683 | 2032 |
| R14741_T6 (SEQ ID NO: 3433) | 714 | 1063 |
| R14741_T7 (SEQ ID NO: 3434) | 1470 | 1819 |

This segment can be found in the following protein(s): R14741_P1, R14741_P2, R14741_P3, R14741_P4, R14741_P5, R14741_P6 and R14741_P7.

Segment cluster R14741_node_9 (SEQ ID NO:3442) according to the present invention is supported by 17 libraries. The number of libraries was determined as previously described. This segment can be found in the following transcript(s): R14741_T0 (SEQ ID NO:3427), R14741_T1 (SEQ ID NO:3428), R14741_T2 (SEQ ID NO:3429), R14741_T3 (SEQ ID NO:3430), R14741_T4 (SEQ ID NO:3431), R14741_T5 (SEQ ID NO:3432) and R14741_T6 (SEQ ID NO:3433). Table 3289 below describes the starting and ending position of this segment on each transcript.

TABLE 3289

Segment location on transcripts

| Transcript name | Segment starting position | Segment ending position |
|---|---|---|
| R14741_T0 (SEQ ID NO: 3427) | 1820 | 2012 |
| R14741_T1 (SEQ ID NO: 3428) | 1391 | 1583 |
| R14741_T2 (SEQ ID NO: 3429) | 1599 | 1791 |
| R14741_T3 (SEQ ID NO: 3430) | 1812 | 2004 |
| R14741_T4 (SEQ ID NO: 3431) | 1636 | 1828 |
| R14741_T5 (SEQ ID NO: 3432) | 2033 | 2225 |
| R14741_T6 (SEQ ID NO: 3433) | 1064 | 1256 |

This segment can be found in the following protein(s): R14741_P1, R14741_P2, R14741_P3, R14741_P4, R14741_P5 and R14741_P6.

Segment cluster R14741_node_10 (SEQ ID NO:3443) according to the present invention is supported by 40 libraries. The number of libraries was determined as previously described. This segment can be found in the following transcript(s): R14741_T0 (SEQ ID NO:3427), R14741_T1 (SEQ ID NO:3428), R14741_T2 (SEQ ID NO:3429), R14741_T3 (SEQ ID NO:3430), R14741_T4 (SEQ ID NO:3431), R14741_T5 (SEQ ID NO:3432), R14741_T6 (SEQ ID NO:3433) and R14741_T7 (SEQ ID NO:3434). Table 3290 below describes the starting and ending position of this segment on each transcript.

TABLE 3290

Segment location on transcripts

| Transcript name | Segment starting position | Segment ending position |
|---|---|---|
| R14741_T0 (SEQ ID NO: 3427) | 2013 | 2920 |
| R14741_T1 (SEQ ID NO: 3428) | 1584 | 2491 |
| R14741_T2 (SEQ ID NO: 3429) | 1792 | 2699 |
| R14741_T3 (SEQ ID NO: 3430) | 2005 | 2912 |
| R14741_T4 (SEQ ID NO: 3431) | 1829 | 2736 |
| R14741_T5 (SEQ ID NO: 3432) | 2226 | 3133 |
| R14741_T6 (SEQ ID NO: 3433) | 1257 | 2164 |
| R14741_T7 (SEQ ID NO: 3434) | 1820 | 2727 |

This segment can be found in both coding and non-coding regions of transcript(s) as follows. The segment can be found in a non-coding region of transcript(s) that are related to the following protein(s): R14741_P1, R14741_P2, R14741_P3, R14741_P4, R14741_P5 and R14741_P6. This segment can also be found in the following protein(s): R14741_P7, since it is in the coding region for the corresponding transcript.

According to an optional embodiment of the present invention, short segments related to the above cluster are also provided. These segments are up to about 120 bp in length, and so are included in a separate description.

Segment cluster R14741_node_7 (SEQ ID NO:3444) according to the present invention is supported by 3 libraries. The number of libraries was determined as previously described. This segment can be found in the following transcript(s): R14741_T3 (SEQ ID NO:3430), R14741_T4 (SEQ ID NO:3431) and R14741_T5 (SEQ ID NO:3432). Table 3291 below describes the starting and ending position of this segment on each transcript.

TABLE 3291

Segment location on transcripts

| Transcript name | Segment starting position | Segment ending position |
|---|---|---|
| R14741_T3 (SEQ ID NO: 3430) | 1425 | 1461 |
| R14741_T4 (SEQ ID NO: 3431) | 1249 | 1285 |
| R14741_T5 (SEQ ID NO: 3432) | 1646 | 1682 |

This segment can be found in both coding and non-coding regions of transcript(s) as follows. The segment can be found in a non-coding region of transcript(s) that are related to the following protein(s): R14741_P5. This segment can also be found in the following protein(s): R14741_P4 and R14741_P6, since it is in the coding region for the corresponding transcript.

Description for Cluster R17570

Cluster R17570 features 5 transcript(s) and 38 segment(s) of interest, the names for which are given in Tables 3292 and 3293, respectively, the sequences themselves are given at the end of the application. The selected protein variants are given in Table 3294.

TABLE 3292

Transcripts of interest
Transcript Name

R17570_T3 (SEQ ID NO: 3445)
R17570_T5 (SEQ ID NO: 3446)
R17570_T10 (SEQ ID NO: 3447)
R17570_T24 (SEQ ID NO: 3448)
R17570_T25 (SEQ ID NO: 3449)

TABLE 3293

Segments of interest
Segment Name

R17570_node_5 (SEQ ID NO: 3450)
R17570_node_7 (SEQ ID NO: 3451)
R17570_node_10 (SEQ ID NO: 3452)
R17570_node_15 (SEQ ID NO: 3453)
R17570_node_17 (SEQ ID NO: 3454)
R17570_node_24 (SEQ ID NO: 3455)
R17570_node_26 (SEQ ID NO: 3456)
R17570_node_27 (SEQ ID NO: 3457)
R17570_node_34 (SEQ ID NO: 3458)
R17570_node_46 (SEQ ID NO: 3459)
R17570_node_48 (SEQ ID NO: 3460)
R17570_node_53 (SEQ ID NO: 3461)
R17570_node_57 (SEQ ID NO: 3462)
R17570_node_2 (SEQ ID NO: 3463)
R17570_node_3 (SEQ ID NO: 3464)
R17570_node_6 (SEQ ID NO: 3465)
R17570_node_16 (SEQ ID NO: 3466)
R17570_node_20 (SEQ ID NO: 3467)
R17570_node_21 (SEQ ID NO: 3468)
R17570_node_29 (SEQ ID NO: 3469)
R17570_node_30 (SEQ ID NO: 3470)
R17570_node_32 (SEQ ID NO: 3471)

TABLE 3293-continued

Segments of interest
Segment Name

R17570_node_36 (SEQ ID NO: 3472)
R17570_node_38 (SEQ ID NO: 3473)
R17570_node_40 (SEQ ID NO: 3474)
R17570_node_41 (SEQ ID NO: 3475)
R17570_node_42 (SEQ ID NO: 3476)
R17570_node_44 (SEQ ID NO: 3477)
R17570_node_50 (SEQ ID NO: 3478)
R17570_node_54 (SEQ ID NO: 3479)
R17570_node_55 (SEQ ID NO: 3480)
R17570_node_56 (SEQ ID NO: 3481)
R17570_node_58 (SEQ ID NO: 3482)
R17570_node_60 (SEQ ID NO: 3483)
R17570_node_62 (SEQ ID NO: 3484)
R17570_node_63 (SEQ ID NO: 3485)
R17570_node_65 (SEQ ID NO: 3486)
R17570_node_66 (SEQ ID NO: 3487)

TABLE 3294

Proteins of interest

| Protein Name | Corresponding Transcript(s) |
|---|---|
| R17570_P1 | R17570_T3 (SEQ ID NO: 3445) |
| R17570_P2 | R17570_T5 (SEQ ID NO: 3446) |
| R17570_P4 | R17570_T10 (SEQ ID NO: 3447) |
| R17570_P14 | R17570_T24 (SEQ ID NO: 3448) |
| R17570_P15 | R17570_T25 (SEQ ID NO: 3449) |

These sequences are variants of the known protein Kinesin light chain 2 (SwissProt accession identifier KLC2_HUMAN; known also according to the synonyms KLC 2), referred to herein as the previously known protein.

Protein Kinesin light chain 2 is known or believed to have the following function(s): Kinesin is a microtubule-associated force-producing protein that may play a role in organelle transport. The light chain may function in coupling of cargo to the heavy chain or in the modulation of its ATPase activity (By similarity). The sequence for protein Kinesin light chain 2 is given at the end of the application, as "Kinesin light chain 2 amino acid sequence". Known polymorphisms for this sequence are as shown in Table 3295.

TABLE 3295

Amino acid mutations for Known Protein

| SNP position(s) on amino acid sequence | Comment |
|---|---|
| 6 | F -> Y |
| 306 | K -> R |

The following GO Annotation(s) apply to the previously known protein. The following annotation(s) were found: microtubule motor, which are annotation(s) related to Molecular Function; and kinesin, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R17570 can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 81 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 81 and Table 3296. This cluster is overexpressed (at least at a minimum level) in the following pathological conditions: epithelial malignant tumors.

TABLE 3296

Normal tissue distribution

| Name of Tissue | Number |
|---|---|
| Adrenal | 8 |
| Bladder | 41 |
| Bone | 0 |
| Brain | 104 |
| Colon | 0 |
| Epithelial | 7 |
| General | 30 |
| Kidney | 0 |
| liver | 0 |
| lung | 1 |
| lymph nodes | 7 |
| muscle | 0 |
| ovary | 0 |
| pancreas | 4 |
| prostate | 0 |
| skin | 13 |
| stomach | 0 |
| uterus | 0 |

TABLE 3297

P values and ratios for expression in cancerous tissue

| Name of Tissue | P1 | P2 | SP1 | R3 | SP2 | R4 |
|---|---|---|---|---|---|---|
| adrenal | 6.4e−01 | 6.9e−01 | 4.6e−01 | 1.8 | 5.3e−01 | 1.6 |
| bladder | 7.6e−01 | 6.3e−01 | 8.1e−01 | 0.9 | 7.6e−01 | 1.0 |
| bone | 1 | 6.7e−01 | 1 | 1.0 | 7.0e−01 | 1.4 |
| brain | 7.8e−01 | 8.1e−01 | 9.1e−01 | 0.4 | 9.9e−01 | 0.3 |
| colon | 6.5e−01 | 3.4e−01 | 1 | 1.0 | 7.7e−01 | 1.3 |
| epithelial | 8.2e−02 | 8.8e−04 | 6.2e−02 | 2.1 | 1.8e−05 | 4.2 |
| general | 6.9e−01 | 8.8e−02 | 9.7e−01 | 0.6 | 1.3e−01 | 1.2 |
| kidney | 1.7e−01 | 1.8e−01 | 2.0e−01 | 3.2 | 1.7e−01 | 3.1 |
| liver | 1 | 3.0e−01 | 1 | 1.0 | 3.3e−01 | 2.3 |
| lung | 4.7e−01 | 2.5e−01 | 1 | 1.4 | 2.1e−02 | 4.0 |
| lymph nodes | 8.5e−01 | 6.1e−01 | 1 | 0.7 | 3.7e−02 | 3.4 |
| muscle | 1 | 2.9e−01 | 1 | 1.0 | 1.5e−01 | 4.1 |
| ovary | 6.2e−01 | 4.2e−01 | 6.8e−01 | 1.5 | 5.9e−01 | 1.6 |
| pancreas | 9.3e−01 | 6.8e−01 | 1 | 0.7 | 1.5e−01 | 2.0 |
| prostate | 3.8e−01 | 2.6e−01 | 1.4e−01 | 3.0 | 1.3e−01 | 3.1 |
| skin | 9.2e−01 | 4.0e−01 | 1 | 0.5 | 3.0e−01 | 1.6 |
| stomach | 1 | 4.3e−01 | 1 | 1.0 | 2.6e−01 | 1.8 |
| uterus | 4.7e−01 | 8.2e−02 | 6.6e−01 | 1.5 | 1.4e−01 | 2.8 |

As noted above, cluster R17570 features 38 segment(s), which were listed in Table 3293 above and for which the sequence(s) are given at the end of the application. These segment(s) are portions of nucleic acid sequence(s) which are described herein separately because they are of particular interest. A description of each segment according to the present invention is now provided.

Segment cluster R17570_node_5 (SEQ ID NO:3450) according to the present invention is supported by 8 libraries. The number of libraries was determined as previously described. This segment can be found in the following transcript(s): R17570_T3 (SEQ ID NO:3445) and R17570_T10 (SEQ ID NO:3447). Table 3298 below describes the starting and ending position of this segment on each transcript.

TABLE 3298

Segment location on transcripts

| Transcript name | Segment starting position | Segment ending position |
|---|---|---|
| R17570_T3 (SEQ ID NO: 3445) | 1 | 577 |
| R17570_T10 (SEQ ID NO: 3447) | 1 | 577 |

This segment can be found in a non-coding region of transcript(s) that are related to the following protein(s): R17570_P1 and R17570_P4.

Segment cluster R17570_node_7 (SEQ ID NO:3451) according to the present invention is supported by 54 libraries. The number of libraries was determined as previously described. This segment can be found in the following transcript(s): R17570_T3 (SEQ ID NO:3445), R17570_T10 (SEQ ID NO:3447) and R17570_T25 (SEQ ID NO:3449). Table 3299 below describes the starting and ending position of this segment on each transcript.

TABLE 3299

Segment location on transcripts

| Transcript name | Segment starting position | Segment ending position |
|---|---|---|
| R17570_T3 (SEQ ID NO: 3445) | 615 | 853 |
| R17570_T10 (SEQ ID NO: 3447) | 615 | 853 |
| R17570_T25 (SEQ ID NO: 3449) | 123 | 361 |

This segment can be found in the following protein(s): R17570_P1, R17570_P4 and R17570_P15.

Segment cluster R17570_node_10 (SEQ ID NO:3452) according to the present invention is supported by 5 libraries. The number of libraries was determined as previously described. This segment can be found in the following transcript(s): R17570_T5 (SEQ ID NO:3446). Table 3300 below describes the starting and ending position of this segment on each transcript.

TABLE 3300

Segment location on transcripts

| Transcript name | Segment starting position | Segment ending position |
|---|---|---|
| R17570_T5 (SEQ ID NO: 3446) | 1 | 575 |

This segment can be found in a non-coding region of transcript(s) that are related to the following protein(s): R17570_P2.

Segment cluster R17570_node_15 (SEQ ID NO:3453) according to the present invention is supported by 7 libraries. The number of libraries was determined as previously described. This segment can be found in the following transcript(s): R17570_T5 (SEQ ID NO:3446). Table 3301 below describes the starting and ending position of this segment on each transcript.

TABLE 3301

| Segment location on transcripts | | |
|---|---|---|
| Transcript name | Segment starting position | Segment ending position |
| R17570_T5 (SEQ ID NO: 3446) | 576 | 1321 |

This segment can be found in a non-coding region of transcript(s) that are related to the following protein(s): R17570_P2.

Segment cluster R17570_node__17 (SEQ ID NO:3454) according to the present invention is supported by 56 libraries. The number of libraries was determined as previously described. This segment can be found in the following transcript(s): R17570_T3 (SEQ ID NO:3445), R17570_T5 (SEQ ID NO:3446) and R17570_T25 (SEQ ID NO:3449). Table 3302 below describes the starting and ending position of this segment on each transcript.

TABLE 3302

| Segment location on transcripts | | |
|---|---|---|
| Transcript name | Segment starting position | Segment ending position |
| R17570_T3 (SEQ ID NO: 3445) | 890 | 1084 |
| R17570_T5 (SEQ ID NO: 3446) | 1358 | 1552 |
| R17570_T25 (SEQ ID NO: 3449) | 398 | 592 |

This segment can be found in the following protein(s): R17570_P1, R17570_P2 and R17570_P15.

Segment cluster R17570_node__24 (SEQ ID NO:3455) according to the present invention is supported by 54 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T25 (SEQ ID NO:3449). Table 3303 below describes the starting and ending position of this segment on each transcript.

TABLE 3303

| Segment location on transcripts | | |
|---|---|---|
| Transcript name | Segment starting position | Segment ending position |
| R17570_T3 (SEQ ID NO: 3445) | 1155 | 1377 |
| R17570_T5 (SEQ ID NO: 3446) | 1623 | 1845 |
| R17570_T10 (SEQ ID NO: 3447) | 924 | 1146 |
| R17570_T25 (SEQ ID NO: 3449) | 663 | 885 |

This segment can be found in the following protein(s): R17570_P1, R17570_P2, R17570_P4 and R17570_P15.

Segment cluster R17570_node__26 (SEQ ID NO:3456) according to the present invention is supported by 2 libraries. The number of libraries was determined as previously described. This segment can be found in the following transcript(s): R17570_T24 (SEQ ID NO:3448). Table 3304 below describes the starting and ending position of this segment on each transcript.

TABLE 3304

| Segment location on transcripts | | |
|---|---|---|
| Transcript name | Segment starting position | Segment ending position |
| R17570_T24 (SEQ ID NO: 3448) | 1 | 225 |

This segment can be found in a non-coding region of transcript(s) that are related to the following protein(s): R17570_P14.

Segment cluster R17570_node__27 (SEQ ID NO:3457) according to the present invention is supported by 4 libraries. The number of libraries was determined as previously described. This segment can be found in the following transcript(s): R17570_T24 (SEQ ID NO:3448). Table 3305 below describes the starting and ending position of this segment on each transcript.

TABLE 3305

| Segment location on transcripts | | |
|---|---|---|
| Transcript name | Segment starting position | Segment ending position |
| R17570_T24 (SEQ ID NO: 3448) | 226 | 526 |

This segment can be found in the following protein(s): R17570_P14.

Segment cluster R17570_node__34 (SEQ ID NO:3458) according to the present invention is supported by 51 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3306 below describes the starting and ending position of this segment on each transcript.

TABLE 3306

| Segment location on transcripts | | |
|---|---|---|
| Transcript name | Segment starting position | Segment ending position |
| R17570_T3 (SEQ ID NO: 3445) | 1568 | 1741 |
| R17570_T5 (SEQ ID NO: 3446) | 2036 | 2209 |
| R17570_T10 (SEQ ID NO: 3447) | 1337 | 1510 |
| R17570_T24 (SEQ ID NO: 3448) | 717 | 890 |
| R17570_T25 (SEQ ID NO: 3449) | 1076 | 1249 |

This segment can be found in the following protein(s): R17570_P1, R17570_P2, R17570_P4, R17570_P14 and R17570_P15.

Segment cluster R17570_node__46 (SEQ ID NO:3459) according to the present invention is supported by 61 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3307 below describes the starting and ending position of this segment on each transcript.

TABLE 3307

Segment location on transcripts

| Transcript name | Segment starting position | Segment ending position |
|---|---|---|
| R17570_T3 (SEQ ID NO: 3445) | 2069 | 2227 |
| R17570_T5 (SEQ ID NO: 3446) | 2537 | 2695 |
| R17570_T10 (SEQ ID NO: 3447) | 1838 | 1996 |
| R17570_T24 (SEQ ID NO: 3448) | 1218 | 1376 |

This segment can be found in the following protein(s): R17570_P1, R17570_P2, R17570_P4 and R17570_P14.

Segment cluster R17570_node_48 (SEQ ID NO:3460) according to the present invention is supported by 52 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3308 below describes the starting and ending position of this segment on each transcript.

TABLE 3308

Segment location on transcripts

| Transcript name | Segment starting position | Segment ending position |
|---|---|---|
| R17570_T3 (SEQ ID NO: 3445) | 2228 | 2352 |
| R17570_T5 (SEQ ID NO: 3446) | 2696 | 2820 |
| R17570_T10 (SEQ ID NO: 3447) | 1997 | 2121 |
| R17570_T24 (SEQ ID NO: 3448) | 1377 | 1501 |

This segment can be found in the following protein(s): R17570_P1, R17570_P2, R17570_P4 and R17570_P14.

Segment cluster R17570_node_53 (SEQ ID NO:3461) according to the present invention is supported by 66 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3309 below describes the starting and ending position of this segment on each transcript.

TABLE 3309

Segment location on transcripts

| Transcript name | Segment starting position | Segment ending position |
|---|---|---|
| R17570_T3 (SEQ ID NO: 3445) | 2411 | 2711 |
| R17570_T5 (SEQ ID NO: 3446) | 2879 | 3179 |
| R17570_T10 (SEQ ID NO: 3447) | 2180 | 2480 |
| R17570_T24 (SEQ ID NO: 3448) | 1560 | 1860 |

This segment can be found in the following protein(s): R17570_P1, R17570_P2, R17570_P4 and R17570_P14.

Segment cluster R17570_node_57 (SEQ ID NO:3462) according to the present invention is supported by 70 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3310 below describes the starting and ending position of this segment on each transcript.

TABLE 3310

Segment location on transcripts

| Transcript name | Segment starting position | Segment ending position |
|---|---|---|
| R17570_T3 (SEQ ID NO: 3445) | 2910 | 3043 |
| R17570_T5 (SEQ ID NO: 3446) | 3378 | 3511 |
| R17570_T10 (SEQ ID NO: 3447) | 2679 | 2812 |
| R17570_T24 (SEQ ID NO: 3448) | 2059 | 2192 |

This segment can be found in a non-coding region of transcript(s) that are related to the following protein(s): R17570_P1, R17570_P2, R17570_P4 and R17570_P14.

According to an optional embodiment of the present invention, short segments related to the above cluster are also provided. These segments are up to about 120 bp in length, and so are included in a separate description.

Segment cluster R17570_node_2 (SEQ ID NO:3463) according to the present invention is supported by 29 libraries. The number of libraries was determined as previously described. This segment can be found in the following transcript(s): R17570_T25 (SEQ ID NO:3449). Table 3311 below describes the starting and ending position of this segment on each transcript.

TABLE 3311

Segment location on transcripts

| Transcript name | Segment starting position | Segment ending position |
|---|---|---|
| R17570_T25 (SEQ ID NO: 3449) | 1 | 59 |

This segment can be found in a non-coding region of transcript(s) that are related to the following protein(s): R17570_P15.

Segment cluster R17570_node_3 (SEQ ID NO:3464) according to the present invention is supported by 36 libraries. The number of libraries was determined as previously described. This segment can be found in the following transcript(s): R17570_T25 (SEQ ID NO:3449). Table 3312 below describes the starting and ending position of this segment on each transcript.

TABLE 3312

Segment location on transcripts

| Transcript name | Segment starting position | Segment ending position |
|---|---|---|
| R17570_T25 (SEQ ID NO: 3449) | 60 | 122 |

This segment can be found in a non-coding region of transcript(s) that are related to the following protein(s): R17570_P15.

Segment cluster R17570_node_6 (SEQ ID NO:3465) according to the present invention is supported by 21 libraries. The number of libraries was determined as previously described. This segment can be found in the following transcript(s): R17570_T3 (SEQ ID NO:3445) and R17570_T10 (SEQ ID NO:3447). Table 3313 below describes the starting and ending position of this segment on each transcript.

TABLE 3313

Segment location on transcripts

| Transcript name | Segment starting position | Segment ending position |
|---|---|---|
| R17570_T3 (SEQ ID NO: 3445) | 578 | 614 |
| R17570_T10 (SEQ ID NO: 3447) | 578 | 614 |

This segment can be found in a non-coding region of transcript(s) that are related to the following protein(s): R17570_P1 and R17570_P4.

Segment cluster R17570_node_16 (SEQ ID NO:3466) according to the present invention is supported by 48 libraries. The number of libraries was determined as previously described. This segment can be found in the following transcript(s): R17570_T3 (SEQ ID NO:3445), R17570_T5 (SEQ ID NO:3446) and R17570_T25 (SEQ ID NO:3449). Table 3314 below describes the starting and ending position of this segment on each transcript.

TABLE 3314

Segment location on transcripts

| Transcript name | Segment starting position | Segment ending position |
|---|---|---|
| R17570_T3 (SEQ ID NO: 3445) | 854 | 889 |
| R17570_T5 (SEQ ID NO: 3446) | 1322 | 1357 |
| R17570_T25 (SEQ ID NO: 3449) | 362 | 397 |

This segment can be found in both coding and non-coding regions of transcript(s) as follows. The segment can be found in a non-coding region of transcript(s) that are related to the following protein(s): R17570_P2. This segment can also be found in the following protein(s): R17570_P1 and R17570_P15, since it is in the coding region for the corresponding transcript.

Segment cluster R17570_node_20 (SEQ ID NO:3467) according to the present invention is supported by 48 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T25 (SEQ ID NO:3449). Table 3315 below describes the starting and ending position of this segment on each transcript.

TABLE 3315

Segment location on transcripts

| Transcript name | Segment starting position | Segment ending position |
|---|---|---|
| R17570_T3 (SEQ ID NO: 3445) | 1085 | 1131 |
| R17570_T5 (SEQ ID NO: 3446) | 1553 | 1599 |
| R17570_T10 (SEQ ID NO: 3447) | 854 | 900 |
| R17570_T25 (SEQ ID NO: 3449) | 593 | 639 |

This segment can be found in the following protein(s): R17570_P1, R17570_P2, R17570_P4 and R17570_P15.

Segment cluster R17570_node_21 (SEQ ID NO:3468) according to the present invention can be found in the following transcript(s): R17570_T3 (SEQ ID NO:3445), R17570_T5 (SEQ ID NO:3446), R17570_T10 (SEQ ID NO:3447) and R17570_T25 (SEQ ID NO:3449). Table 3316 below describes the starting and ending position of this segment on each transcript.

TABLE 3316

Segment location on transcripts

| Transcript name | Segment starting position | Segment ending position |
|---|---|---|
| R17570_T3 (SEQ ID NO: 3445) | 1132 | 1154 |
| R17570_T5 (SEQ ID NO: 3446) | 1600 | 1622 |
| R17570_T10 (SEQ ID NO: 3447) | 901 | 923 |
| R17570_T25 (SEQ ID NO: 3449) | 640 | 662 |

This segment can be found in the following protein(s): R17570_P1, R17570_P2, R17570_P4 and R17570_P15.

Segment cluster R17570_node_29 (SEQ ID NO:3469) according to the present invention can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3317 below describes the starting and ending position of this segment on each transcript.

TABLE 3317

Segment location on transcripts

| Transcript name | Segment starting position | Segment ending position |
|---|---|---|
| R17570_T3 (SEQ ID NO: 3445) | 1378 | 1396 |
| R17570_T5 (SEQ ID NO: 3446) | 1846 | 1864 |
| R17570_T10 (SEQ ID NO: 3447) | 1147 | 1165 |
| R17570_T24 (SEQ ID NO: 3448) | 527 | 545 |
| R17570_T25 (SEQ ID NO: 3449) | 886 | 904 |

This segment can be found in the following protein(s): R17570_P1, R17570_P2, R17570_P4, R17570_P14 and R17570_P15.

Segment cluster R17570_node_30 (SEQ ID NO:3470) according to the present invention is supported by 49 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3318 below describes the starting and ending position of this segment on each transcript.

TABLE 3318

Segment location on transcripts

| Transcript name | Segment starting position | Segment ending position |
|---|---|---|
| R17570_T3 (SEQ ID NO: 3445) | 1397 | 1465 |
| R17570_T5 (SEQ ID NO: 3446) | 1865 | 1933 |
| R17570_T10 (SEQ ID NO: 3447) | 1166 | 1234 |
| R17570_T24 (SEQ ID NO: 3448) | 546 | 614 |
| R17570_T25 (SEQ ID NO: 3449) | 905 | 973 |

This segment can be found in the following protein(s): R17570_P1, R17570_P2, R17570_P4, R17570_P14 and R17570_P15.

Segment cluster R17570_node_32 (SEQ ID NO:3471) according to the present invention is supported by 46 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3319 below describes the starting and ending position of this segment on each transcript.

TABLE 3319

Segment location on transcripts

| Transcript name | Segment starting position | Segment ending position |
| --- | --- | --- |
| R17570_T3 (SEQ ID NO: 3445) | 1466 | 1567 |
| R17570_T5 (SEQ ID NO: 3446) | 1934 | 2035 |
| R17570_T10 (SEQ ID NO: 3447) | 1235 | 1336 |
| R17570_T24 (SEQ ID NO: 3448) | 615 | 716 |
| R17570_T25 (SEQ ID NO: 3449) | 974 | 1075 |

This segment can be found in the following protein(s): R17570_P1, R17570_P2, R17570_P4, R17570_P14 and R17570_P15.

Segment cluster R17570_node_36 (SEQ ID NO:3472) according to the present invention is supported by 49 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3320 below describes the starting and ending position of this segment on each transcript.

TABLE 3320

Segment location on transcripts

| Transcript name | Segment starting position | Segment ending position |
| --- | --- | --- |
| R17570_T3 (SEQ ID NO: 3445) | 1742 | 1841 |
| R17570_T5 (SEQ ID NO: 3446) | 2210 | 2309 |
| R17570_T10 (SEQ ID NO: 3447) | 1511 | 1610 |
| R17570_T24 (SEQ ID NO: 3448) | 891 | 990 |
| R17570_T25 (SEQ ID NO: 3449) | 1250 | 1349 |

This segment can be found in the following protein(s): R17570_P1, R17570_P2, R17570_P4, R17570_P14 and R17570_P15.

Segment cluster R17570_node_38 (SEQ ID NO:3473) according to the present invention is supported by 48 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3321 below describes the starting and ending position of this segment on each transcript.

TABLE 3321

Segment location on transcripts

| Transcript name | Segment starting position | Segment ending position |
| --- | --- | --- |
| R17570_T3 (SEQ ID NO: 3445) | 1842 | 1891 |
| R17570_T5 (SEQ ID NO: 3446) | 2310 | 2359 |
| R17570_T10 (SEQ ID NO: 3447) | 1611 | 1660 |
| R17570_T24 (SEQ ID NO: 3448) | 991 | 1040 |
| R17570_T25 (SEQ ID NO: 3449) | 1350 | 1399 |

This segment can be found in the following protein(s): R17570_P1, R17570_P2, R17570_P4, R17570_P14 and R17570_P15.

Segment cluster R17570_node_40 (SEQ ID NO:3474) according to the present invention is supported by 56 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3322 below describes the starting and ending position of this segment on each transcript.

TABLE 3322

Segment location on transcripts

| Transcript name | Segment starting position | Segment ending position |
| --- | --- | --- |
| R17570_T3 (SEQ ID NO: 3445) | 1892 | 1920 |
| R17570_T5 (SEQ ID NO: 3446) | 2360 | 2388 |
| R17570_T10 (SEQ ID NO: 3447) | 1661 | 1689 |
| R17570_T24 (SEQ ID NO: 3448) | 1041 | 1069 |
| R17570_T25 (SEQ ID NO: 3449) | 1400 | 1428 |

This segment can be found in the following protein(s): R17570_P1, R17570_P2, R17570_P4, R17570_P14 and R17570_P15.

Segment cluster R17570_node_41 (SEQ ID NO:3475) according to the present invention is supported by 56 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447), R17570_T24 (SEQ ID NO:3448) and R17570_T25 (SEQ ID NO:3449). Table 3323 below describes the starting and ending position of this segment on each transcript.

TABLE 3323

Segment location on transcripts

| Transcript name | Segment starting position | Segment ending position |
| --- | --- | --- |
| R17570_T3 (SEQ ID NO: 3445) | 1921 | 1959 |
| R17570_T5 (SEQ ID NO: 3446) | 2389 | 2427 |
| R17570_T10 (SEQ ID NO: 3447) | 1690 | 1728 |
| R17570_T24 (SEQ ID NO: 3448) | 1070 | 1108 |
| R17570_T25 (SEQ ID NO: 3449) | 1429 | 1467 |

This segment can be found in the following protein(s): R17570_P1, R17570_P2, R17570_P4, R17570_P14 and R17570_P15.

Segment cluster R17570_node_42 (SEQ ID NO:3476) according to the present invention is supported by 1 libraries. The number of libraries was determined as previously described. This segment can be found in the following transcript(s): R17570_T25 (SEQ ID NO:3449). Table 3324 below describes the starting and ending position of this segment on each transcript.

TABLE 3324

Segment location on transcripts

| Transcript name | Segment starting position | Segment ending position |
| --- | --- | --- |
| R17570_T25 (SEQ ID NO: 3449) | 1468 | 1528 |

This segment can be found in the following protein(s): R17570_P15.

Segment cluster R17570_node_44 (SEQ ID NO:3477) according to the present invention is supported by 54 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3325 below describes the starting and ending position of this segment on each transcript.

TABLE 3325

Segment location on transcripts

| Transcript name | Segment starting position | Segment ending position |
|---|---|---|
| R17570_T3 (SEQ ID NO: 3445) | 1960 | 2068 |
| R17570_T5 (SEQ ID NO: 3446) | 2428 | 2536 |
| R17570_T10 (SEQ ID NO: 3447) | 1729 | 1837 |
| R17570_T24 (SEQ ID NO: 3448) | 1109 | 1217 |

This segment can be found in the following protein(s): R17570_P1, R17570_P2, R17570_P4 and R17570_P14.

Segment cluster R17570_node_50 (SEQ ID NO:3478) according to the present invention is supported by 49 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3326 below describes the starting and ending position of this segment on each transcript.

TABLE 3326

Segment location on transcripts

| Transcript name | Segment starting position | Segment ending position |
|---|---|---|
| R17570_T3 (SEQ ID NO: 3445) | 2353 | 2410 |
| R17570_T5 (SEQ ID NO: 3446) | 2821 | 2878 |
| R17570_T10 (SEQ ID NO: 3447) | 2122 | 2179 |
| R17570_T24 (SEQ ID NO: 3448) | 1502 | 1559 |

This segment can be found in the following protein(s): R17570_P1, R17570_P2, R17570_P4 and R17570_P14.

Segment cluster R17570_node_54 (SEQ ID NO:3479) according to the present invention is supported by 58 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3327 below describes the starting and ending position of this segment on each transcript.

TABLE 3327

Segment location on transcripts

| Transcript name | Segment starting position | Segment ending position |
|---|---|---|
| R17570_T3 (SEQ ID NO: 3445) | 2712 | 2740 |
| R17570_T5 (SEQ ID NO: 3446) | 3180 | 3208 |
| R17570_T10 (SEQ ID NO: 3447) | 2481 | 2509 |
| R17570_T24 (SEQ ID NO: 3448) | 1861 | 1889 |

This segment can be found in a non-coding region of transcript(s) that are related to the following protein(s): R17570_P1, R17570_P2, R17570_P4 and R17570_P14.

Segment cluster R17570_node_55 (SEQ ID NO:3480) according to the present invention is supported by 64 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3328 below describes the starting and ending position of this segment on each transcript.

TABLE 3328

Segment location on transcripts

| Transcript name | Segment starting position | Segment ending position |
|---|---|---|
| R17570_T3 (SEQ ID NO: 3445) | 2741 | 2844 |
| R17570_T5 (SEQ ID NO: 3446) | 3209 | 3312 |
| R17570_T10 (SEQ ID NO: 3447) | 2510 | 2613 |
| R17570_T24 (SEQ ID NO: 3448) | 1890 | 1993 |

This segment can be found in a non-coding region of transcript(s) that are related to the following protein(s): R17570_P1, R17570_P2, R17570_P4 and R17570_P14.

Segment cluster R17570_node_56 (SEQ ID NO:3481) according to the present invention is supported by 59 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3329 below describes the starting and ending position of this segment on each transcript.

TABLE 3329

Segment location on transcripts

| Transcript name | Segment starting position | Segment ending position |
|---|---|---|
| R17570_T3 (SEQ ID NO: 3445) | 2845 | 2909 |
| R17570_T5 (SEQ ID NO: 3446) | 3313 | 3377 |
| R17570_T10 (SEQ ID NO: 3447) | 2614 | 2678 |
| R17570_T24 (SEQ ID NO: 3448) | 1994 | 2058 |

This segment can be found in a non-coding region of transcript(s) that are related to the following protein(s): R17570_P1, R17570_P2, R17570_P4 and R17570_P14.

Segment cluster R17570_node_58 (SEQ ID NO:3482) according to the present invention is supported by 57 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3330 below describes the starting and ending position of this segment on each transcript.

TABLE 3330

Segment location on transcripts

| Transcript name | Segment starting position | Segment ending position |
|---|---|---|
| R17570_T3 (SEQ ID NO: 3445) | 3044 | 3149 |
| R17570_T5 (SEQ ID NO: 3446) | 3512 | 3617 |
| R17570_T10 (SEQ ID NO: 3447) | 2813 | 2918 |
| R17570_T24 (SEQ ID NO: 3448) | 2193 | 2298 |

This segment can be found in a non-coding region of transcript(s) that are related to the following protein(s): R17570_P1, R17570_P2, R17570_P4 and R17570_P14.

Segment cluster R17570_node_60 (SEQ ID NO:3483) according to the present invention is supported by 47 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3331 below describes the starting and ending position of this segment on each transcript.

TABLE 3331

Segment location on transcripts

| Transcript name | Segment starting position | Segment ending position |
|---|---|---|
| R17570_T3 (SEQ ID NO: 3445) | 3150 | 3209 |
| R17570_T5 (SEQ ID NO: 3446) | 3618 | 3677 |
| R17570_T10 (SEQ ID NO: 3447) | 2919 | 2978 |
| R17570_T24 (SEQ ID NO: 3448) | 2299 | 2358 |

This segment can be found in a non-coding region of transcript(s) that are related to the following protein(s): R17570_P1, R17570_P2, R17570_P4 and R17570_P14.

Segment cluster R17570_node_62 (SEQ ID NO:3484) according to the present invention is supported by 41 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3332 below describes the starting and ending position of this segment on each transcript.

TABLE 3332

Segment location on transcripts

| Transcript name | Segment starting position | Segment ending position |
|---|---|---|
| R17570_T3 (SEQ ID NO: 3445) | 3210 | 3278 |
| R17570_T5 (SEQ ID NO: 3446) | 3678 | 3746 |
| R17570_T10 (SEQ ID NO: 3447) | 2979 | 3047 |
| R17570_T24 (SEQ ID NO: 3448) | 2359 | 2427 |

This segment can be found in a non-coding region of transcript(s) that are related to the following protein(s): R17570_P1, R17570_P2, R17570_P4 and R17570_P14.

Segment cluster R17570_node_63 (SEQ ID NO:3485) according to the present invention can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3333 below describes the starting and ending position of this segment on each transcript.

TABLE 3333

Segment location on transcripts

| Transcript name | Segment starting position | Segment ending position |
|---|---|---|
| R17570_T3 (SEQ ID NO: 3445) | 3279 | 3300 |
| R17570_T5 (SEQ ID NO: 3446) | 3747 | 3768 |
| R17570_T10 (SEQ ID NO: 3447) | 3048 | 3069 |
| R17570_T24 (SEQ ID NO: 3448) | 2428 | 2449 |

This segment can be found in a non-coding region of transcript(s) that are related to the following protein(s): R17570_P1, R17570_P2, R17570_P4 and R17570_P14.

Segment cluster R17570_node_65 (SEQ ID NO:3486) according to the present invention is supported by 34 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3334 below describes the starting and ending position of this segment on each transcript.

TABLE 3334

Segment location on transcripts

| Transcript name | Segment starting position | Segment ending position |
|---|---|---|
| R17570_T3 (SEQ ID NO: 3445) | 3301 | 3326 |
| R17570_T5 (SEQ ID NO: 3446) | 3769 | 3794 |
| R17570_T10 (SEQ ID NO: 3447) | 3070 | 3095 |
| R17570_T24 (SEQ ID NO: 3448) | 2450 | 2475 |

This segment can be found in a non-coding region of transcript(s) that are related to the following protein(s): R17570_P1, R17570_P2, R17570_P4 and R17570_P14.

Segment cluster R17570_node_66 (SEQ ID NO:3487) according to the present invention is supported by 33 libraries. The number of libraries was determined as previously described. This segment can be found in the following transcript(s): R17570_T3 (SEQ ID NO:3445), R17570_T5 (SEQ ID NO:3446), R17570_T10 (SEQ ID NO:3447) and R17570_T24 (SEQ ID NO:3448). Table 3335 below describes the starting and ending position of this segment on each transcript.

TABLE 3335

Segment location on transcripts

| Transcript name | Segment starting position | Segment ending position |
|---|---|---|
| R17570_T3 (SEQ ID NO: 3445) | 3327 | 3403 |
| R17570_T5 (SEQ ID NO: 3446) | 3795 | 3871 |
| R17570_T10 (SEQ ID NO: 3447) | 3096 | 3172 |
| R17570_T24 (SEQ ID NO: 3448) | 2476 | 2552 |

This segment can be found in a non-coding region of transcript(s) that are related to the following protein(s): R17570_P1, R17570_P2, R17570_P4 and R17570_P14.

Description for Cluster R20420

Cluster R20420 features 1 transcript(s) and 18 segment(s) of interest, the names for which are given in Tables 3336 and 3337, respectively, the sequences themselves are given at the end of the application. The selected protein variants are given in Table 3338.

TABLE 3336

Transcripts of interest
Transcript Name

R20420_T2 (SEQ ID NO: 3488)

TABLE 3337

Segments of interest
Segment Name

R20420_node_0 (SEQ ID NO: 3489)
R20420_node_5 (SEQ ID NO: 3490)
R20420_node_6 (SEQ ID NO: 3491)
R20420_node_8 (SEQ ID NO: 3492)
R20420_node_11 (SEQ ID NO: 3493)
R20420_node_13 (SEQ ID NO: 3494)
R20420_node_14 (SEQ ID NO: 3495)
R20420_node_20 (SEQ ID NO: 3496)
R20420_node_24 (SEQ ID NO: 3497)
R20420_node_26 (SEQ ID NO: 3498)
R20420_node_27 (SEQ ID NO: 3499)
R20420_node_4 (SEQ ID NO: 3500)
R20420_node_9 (SEQ ID NO: 3501)
R20420_node_10 (SEQ ID NO: 3502)
R20420_node_15 (SEQ ID NO: 3503)
R20420_node_17 (SEQ ID NO: 3504)
R20420_node_18 (SEQ ID NO: 3505)
R20420_node_25 (SEQ ID NO: 3506)

TABLE 3338

Proteins of interest

| Protein Name | Corresponding Transcript(s) |
|---|---|
| R20420_P2 | R20420_T2 (SEQ ID NO: 3488) |

These sequences are variants of the known protein NGFI-A binding protein 2 (SwissProt accession identifier NAB2_HUMAN; known also according to the synonyms EGR-1 binding protein 2; Melanoma-associated delayed early response protein; MADER protein), referred to herein as the previously known protein.

Protein NGFI-A binding protein 2 is known or believed to have the following function(s): Acts as a transcriptional repressor for zinc finger transcription factors EGR1 and EGR2. Isoform 2 lacks repression ability (By similarity). The sequence for protein NGFI-A binding protein 2 is given at the end of the application, as "NGFI-A binding protein 2 amino acid sequence". Known polymorphisms for this sequence are as shown in Table 3339.

TABLE 3339

Amino acid mutations for Known Protein

| SNP position(s) on amino acid sequence | Comment |
|---|---|
| 257-258 | PR -> Q |

Protein NGFI-A binding protein 2 localization is believed to be Nuclear. Isoform 2 is not localized to the nucleus (By similarity).

The following GO Annotation(s) apply to the previously known protein. The following annotation(s) were found: transcription regulation; neurogenesis; cell proliferation, which are annotation(s) related to Biological Process; and transcription co-repressor, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R20420 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 82 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 82 and Table 3340. This cluster is overexpressed (at least at a minimum level) in the following pathological conditions: skin malignancies.

TABLE 3340

Normal tissue distribution

| Name of Tissue | Number |
|---|---|
| adrenal | 0 |
| bone | 136 |
| brain | 23 |
| colon | 0 |
| epithelial | 25 |
| general | 27 |
| kidney | 44 |
| liver | 14 |
| lymph nodes | 73 |
| breast | 17 |
| bone marrow | 0 |
| muscle | 20 |
| ovary | 80 |
| prostate | 34 |
| skin | 26 |
| stomach | 36 |
| Thyroid | 0 |
| uterus | 4 |

TABLE 3341

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| bone | 7.0e−01 | 8.0e−01 | 9.2e−01 | 0.5 | 9.9e−01 | 0.4 |
| brain | 5.0e−01 | 2.7e−01 | 4.5e−02 | 1.5 | 1.3e−02 | 2.1 |
| colon | 2.8e−01 | 3.4e−01 | 7.0e−01 | 1.6 | 7.7e−01 | 1.4 |
| epithelial | 6.9e−02 | 7.4e−02 | 2.2e−01 | 1.3 | 5.4e−02 | 1.4 |
| general | 2.2e−02 | 1.0e−02 | 4.7e−02 | 1.3 | 3.2e−03 | 1.5 |
| kidney | 8.3e−01 | 8.4e−01 | 9.3e−01 | 0.6 | 8.4e−01 | 0.8 |
| liver | 9.1e−01 | 8.8e−01 | 1 | 0.8 | 6.9e−01 | 1.1 |
| lymph nodes | 6.9e−01 | 8.2e−01 | 1 | 0.2 | 7.9e−01 | 0.7 |
| breast | 5.8e−01 | 6.1e−01 | 3.3e−01 | 1.7 | 5.6e−01 | 1.2 |
| bone marrow | 1 | 6.7e−01 | 1 | 1.0 | 5.3e−01 | 2.1 |
| muscle | 5.2e−01 | 2.9e−01 | 2.7e−01 | 3.2 | 7.3e−03 | 2.7 |
| ovary | 6.0e−01 | 5.7e−01 | 6.1e−01 | 1.1 | 7.2e−01 | 0.9 |
| prostate | 9.0e−01 | 8.6e−01 | 7.5e−01 | 0.7 | 6.3e−01 | 0.9 |

TABLE 3341-continued

P values and ratios for expression in cancerous tissue

| Name of Tissue | P1 | P2 | SP1 | R3 | SP2 | R4 |
|---|---|---|---|---|---|---|
| skin | 5.2e−01 | 8.5e−02 | 3.7e−01 | 2.3 | 3.5e−03 | 3.1 |
| stomach | 9.0e−01 | 8.7e−01 | 1 | 0.5 | 9.6e−01 | 0.6 |
| Thyroid | 2.9e−02 | 2.9e−02 | 3.0e−01 | 2.8 | 3.0e−01 | 2.8 |
| uterus | 4.2e−02 | 6.2e−02 | 1.3e−01 | 3.0 | 1.1e−01 | 2.7 |

As noted above, cluster R20420 features 18 segment(s), which were listed in Table 3337 above and for which the sequence(s) are given at the end of the application. These segment(s) are portions of nucleic acid sequence(s) which are described herein separately because they are of particular interest. A description of each segment according to the present invention is now provided.

Segment cluster R20420_node_0 (SEQ ID NO:3489) according to the present invention is supported by 47 libraries. The number of libraries was determined as previously described. This segment can be found in the following transcript(s): R20420_T2 (SEQ ID NO:3488). Table 3342 below describes the starting and ending position of this segment on each transcript.

TABLE 3342

Segment location on transcripts

| Transcript name | Segment starting position | Segment ending position |
|---|---|---|
| R20420_T2 (SEQ ID NO: 3488) | 1 | 454 |

This segment can be found in the following protein(s): R20420_P2.

Segment cluster R20420_node_5 (SEQ ID NO:3490) according to the present invention is supported by 56 libraries. The number of libraries was determined as previously described. This segment can be found in the following transcript(s): R20420_T2 (SEQ ID NO:3488). Table 3343 below describes the starting and ending position of this segment on each transcript.

TABLE 3343

Segment location on transcripts

| Transcript name | Segment starting position | Segment ending position |
|---|---|---|
| R20420_T2 (SEQ ID NO: 3488) | 461 | 591 |

This segment can be found in the following protein(s): R20420_P2.

Segment cluster R20420_node_6 (SEQ ID NO:3491) according to the present invention is supported by 63 libraries. The number of libraries was determined as previously described. This segment can be found in the following transcript(s): R20420_T2 (SEQ ID NO:3488). Table 3344 below describes the starting and ending position of this segment on each transcript.

TABLE 3344

Segment location on transcripts

| Transcript name | Segment starting position | Segment ending position |
|---|---|---|
| R20420_T2 (SEQ ID NO: 3488) | 592 | 816 |

This segment can be found in the following protein(s): R20420_P2.

Segment cluster R20420_node_8 (SEQ ID NO:3492) according to the present invention is supported by 63 libraries. The number of libraries was determined as previously described. This segment can be found in the following transcript(s): R20420_T2 (SEQ ID NO:3488). Table 3345 below describes the starting and ending position of this segment on each transcript.

TABLE 3345

Segment location on transcripts

| Transcript name | Segment starting position | Segment ending position |
|---|---|---|
| R20420_T2 (SEQ ID NO: 3488) | 817 | 978 |

This segment can be found in the following protein(s): R20420_P2.

Segment cluster R20420_node_11 (SEQ ID NO:3493) according to the present invention is supported by 56 libraries. The number of libraries was determined as previously described. This segment can be found in the following transcript(s): R20420_T2 (SEQ ID NO:3488). Table 3346 below describes the starting and ending position of this segment on each transcript.

TABLE 3346

Segment location on transcripts

| Transcript name | Segment starting position | Segment ending position |
|---|---|---|
| R20420_T2 (SEQ ID NO: 3488) | 1101 | 1328 |

This segment can be found in the following protein(s): R20420_P2.

Segment cluster R20420_node_13 (SEQ ID NO:3494) according to the present invention is supported by 58 libraries. The number of libraries was determined as previously described. This segment can be found in the following transcript(s): R20420_T2 (SEQ ID NO:3488). Table 3347 below describes the starting and ending position of this segment on each transcript.

TABLE 3347

Segment location on transcripts

| Transcript name | Segment starting position | Segment ending position |
|---|---|---|
| R20420_T2 (SEQ ID NO: 3488) | 1329 | 1462 |

This segment can be found in the following protein(s): R20420_P2.

Segment cluster R20420_node_14 (SEQ ID NO:3495) according to the present invention is supported by 11 libraries. The number of libraries was determined as previously described. This segment can be found in the following transcript(s): R20420_T2 (SEQ ID NO:3488). Table 3348 below describes the starting and ending position of this segment on each transcript.

TABLE 3348

Segment location on transcripts

| Transcript name | Segment starting position | Segment ending position |
|---|---|---|
| R20420_T2 (SEQ ID NO: 3488) | 1463 | 1797 |

This segment can be found in the following protein(s): R20420_P2.

Segment cluster R20420_node_20 (SEQ ID NO:3496) according to the present invention is supported by 56 libraries. The number of libraries was determined as previously described. This segment can be found in the following transcript(s): R20420_T2 (SEQ ID NO:3488). Table 3349 below describes the starting and ending position of this segment on each transcript.

TABLE 3349

Segment location on transcripts

| Transcript name | Segment starting position | Segment ending position |
|---|---|---|
| R20420_T2 (SEQ ID NO: 3488) | 1983 | 2174 |

This segment can be found in a non-coding region of transcript(s) that are related to the following protein(s): R20420_P2.

Segment cluster R20420_node_24 (SEQ ID NO:3497) according to the present invention is supported by 99 libraries. The number of libraries was determined as previously described. This segment can be found in the following transcript(s): R20420_T2 (SEQ ID NO:3488). Table 3350 below describes the starting and ending position of this segment on each transcript.

TABLE 3350

Segment location on transcripts

| Transcript name | Segment starting position | Segment ending position |
|---|---|---|
| R20420_T2 (SEQ ID NO: 3488) | 2175 | 2483 |

This segment can be found in a non-coding region of transcript(s) that are related to the following protein(s): R20420_P2.

Segment cluster R20420_node_26 (SEQ ID NO:3498) according to the present invention is supported by 129 libraries. The number of libraries was determined as previously described. This segment can be found in the following transcript(s): R20420_T2 (SEQ ID NO:3488). Table 3351 below describes the starting and ending position of this segment on each transcript.

TABLE 3351

Segment location on transcripts

| Transcript name | Segment starting position | Segment ending position |
|---|---|---|
| R20420_T2 (SEQ ID NO: 3488) | 2590 | 2799 |

This segment can be found in a non-coding region of transcript(s) that are related to the following protein(s): R20420_P2.

Segment cluster R20420_node_27 (SEQ ID NO:3499) according to the present invention is supported by 114 libraries. The number of libraries was determined as previously described. This segment can be found in the following transcript(s): R20420_T2 (SEQ ID NO:3488). Table 3352 below describes the starting and ending position of this segment on each transcript.

TABLE 3352

Segment location on transcripts

| Transcript name | Segment starting position | Segment ending position |
|---|---|---|
| R20420_T2 (SEQ ID NO: 3488) | 2800 | 3039 |

This segment can be found in a non-coding region of transcript(s) that are related to the following protein(s): R20420_P2.

According to an optional embodiment of the present invention, short segments related to the above cluster are also provided. These segments are up to about 120 bp in length, and so are included in a separate description.

Segment cluster R20420_node_4 (SEQ ID NO:3500) according to the present invention can be found in the following transcript(s): R20420_T2 (SEQ ID NO:3488). Table 3353 below describes the starting and ending position of this segment on each transcript.

TABLE 3353

Segment location on transcripts

| Transcript name | Segment starting position | Segment ending position |
|---|---|---|
| R20420_T2 (SEQ ID NO: 3488) | 455 | 460 |

This segment can be found in the following protein(s): R20420_P2.

Segment cluster R20420_node_9 (SEQ ID NO:3501) according to the present invention is supported by 44 libraries. The number of libraries was determined as previously described. This segment can be found in the following transcript(s): R20420_T2 (SEQ ID NO:3488). Table 3354 below describes the starting and ending position of this segment on each transcript.

TABLE 3354

| Segment location on transcripts | | |
|---|---|---|
| Transcript name | Segment starting position | Segment ending position |
| R20420_T2 (SEQ ID NO: 3488) | 979 | 1043 |

This segment can be found in the following protein(s): R20420_P2.

Segment cluster R20420_node_10 (SEQ ID NO:3502) according to the present invention is supported by 39 libraries. The number of libraries was determined as previously described. This segment can be found in the following transcript(s): R20420_T2 (SEQ ID NO:3488). Table 3355 below describes the starting and ending position of this segment on each transcript.

TABLE 3355

| Segment location on transcripts | | |
|---|---|---|
| Transcript name | Segment starting position | Segment ending position |
| R20420_T2 (SEQ ID NO: 3488) | 1044 | 1100 |

This segment can be found in the following protein(s): R20420_P2.

Segment cluster R20420_node_15 (SEQ ID NO:3503) according to the present invention is supported by 45 libraries. The number of libraries was determined as previously described. This segment can be found in the following transcript(s): R20420_T2 (SEQ ID NO:3488). Table 3356 below describes the starting and ending position of this segment on each transcript.

TABLE 3356

| Segment location on transcripts | | |
|---|---|---|
| Transcript name | Segment starting position | Segment ending position |
| R20420_T2 (SEQ ID NO: 3488) | 1798 | 1849 |

This segment can be found in a non-coding region of transcript(s) that are related to the following protein(s): R20420_P2.

Segment cluster R20420_node_17 (SEQ ID NO:3504) according to the present invention is supported by 47 libraries. The number of libraries was determined as previously described. This segment can be found in the following transcript(s): R20420_T2 (SEQ ID NO:3488). Table 3357 below describes the starting and ending position of this segment on each transcript.

TABLE 3357

| Segment location on transcripts | | |
|---|---|---|
| Transcript name | Segment starting position | Segment ending position |
| R20420_T2 (SEQ ID NO: 3488) | 1850 | 1944 |

This segment can be found in a non-coding region of transcript(s) that are related to the following protein(s): R20420_P2.

Segment cluster R20420_node_18 (SEQ ID NO:3505) according to the present invention is supported by 37 libraries. The number of libraries was determined as previously described. This segment can be found in the following transcript(s): R20420_T2 (SEQ ID NO:3488). Table 3358 below describes the starting and ending position of this segment on each transcript.

TABLE 3358

| Segment location on transcripts | | |
|---|---|---|
| Transcript name | Segment starting position | Segment ending position |
| R20420_T2 (SEQ ID NO: 3488) | 1945 | 1982 |

This segment can be found in a non-coding region of transcript(s) that are related to the following protein(s): R20420_P2.

Segment cluster R20420_node_25 (SEQ ID NO:3506) according to the present invention is supported by 112 libraries. The number of libraries was determined as previously described. This segment can be found in the following transcript(s): R20420_T2 (SEQ ID NO:3488). Table 3359 below describes the starting and ending position of this segment on each transcript.

TABLE 3359

| Segment location on transcripts | | |
|---|---|---|
| Transcript name | Segment starting position | Segment ending position |
| R20420_T2 (SEQ ID NO: 3488) | 2484 | 2589 |

This segment can be found in a non-coding region of transcript(s) that are related to the following protein(s): R20420_P2.

Description for Cluster R34204

Cluster R34204 features 1 transcript(s) and 6 segment(s) of interest, the names for which are given in Tables 3360 and 3361, respectively, the sequences themselves are given at the end of the application. The selected protein variants are given in Table 3362.

TABLE 3360

| Transcripts of interest Transcript Name |
|---|
| R34204_T20 (SEQ ID NO: 3507) |

TABLE 3361

| Segments of interest Segment Name |
|---|
| R34204_node_33 (SEQ ID NO: 3508) |
| R34204_node_34 (SEQ ID NO: 3509) |
| R34204_node_38 (SEQ ID NO: 3510) |
| R34204_node_45 (SEQ ID NO: 3511) |
| R34204_node_46 (SEQ ID NO: 3512) |
| R34204_node_40 (SEQ ID NO: 3513) |

TABLE 3362

Proteins of interest

| Protein Name | Corresponding Transcript(s) |
|---|---|
| R34204_P16 | R34204_T20 (SEQ ID NO: 3507) |

Cluster R34204 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 83 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 83 and Table 3363. This cluster is overexpressed (at least at a minimum level) in the following pathological conditions: epithelial malignant tumors, a mixture of malignant tumors from different tissues, gastric carcinoma and uterine malignancies.

TABLE 3363

Normal tissue distribution

| Name of Tissue | Number |
|---|---|
| bladder | 0 |
| colon | 31 |
| epithelial | 30 |
| general | 11 |
| head and neck | 10 |
| kidney | 11 |
| liver | 0 |
| lung | 27 |
| breast | 96 |
| ovary | 0 |
| pancreas | 14 |
| prostate | 98 |
| skin | 94 |
| stomach | 0 |
| Thyroid | 0 |
| uterus | 0 |

TABLE 3364

P values and ratios for expression in cancerous tissue

| Name of Tissue | P1 | P2 | SP1 | R3 | SP2 | R4 |
|---|---|---|---|---|---|---|
| bladder | 1.5e−01 | 5.8e−02 | 3.2e−01 | 2.5 | 1.4e−02 | 3.3 |
| colon | 1.1e−01 | 7.0e−02 | 4.2e−01 | 1.6 | 4.2e−01 | 1.6 |
| epithelial | 7.0e−06 | 9.7e−05 | 9.8e−06 | 2.6 | 8.2e−05 | 2.1 |
| general | 1.3e−11 | 1.7e−10 | 2.5e−15 | 5.1 | 4.9e−15 | 4.2 |
| head and neck | 1.6e−01 | 3.3e−01 | 4.6e−01 | 2.6 | 7.5e−01 | 1.4 |
| kidney | 5.8e−01 | 7.0e−01 | 2.0e−01 | 2.1 | 3.4e−01 | 1.5 |
| liver | 1.8e−01 | 1.9e−01 | 1 | 2.6 | 6.9e−01 | 1.8 |
| lung | 1.5e−01 | 5.1e−01 | 1.5e−02 | 3.5 | 2.0e−01 | 1.7 |
| breast | 4.0e−01 | 3.0e−01 | 7.2e−01 | 1.0 | 5.3e−01 | 0.9 |
| ovary | 8.2e−02 | 6.3e−02 | 1.5e−01 | 3.3 | 1.6e−01 | 3.1 |
| pancreas | 3.8e−01 | 5.8e−01 | 1.1e−01 | 2.1 | 2.2e−01 | 1.5 |
| prostate | 7.9e−01 | 8.3e−01 | 6.4e−01 | 0.8 | 7.9e−01 | 0.6 |
| skin | 6.9e−01 | 7.7e−01 | 1 | 0.1 | 9.9e−01 | 0.3 |
| stomach | 1.1e−01 | 1.1e−01 | 6.3e−02 | 3.2 | 8.8e−03 | 4.3 |
| Thyroid | 2.9e−01 | 2.9e−01 | 1 | 1.2 | 1 | 1.2 |
| uterus | 8.2e−02 | 2.4e−01 | 7.1e−03 | 4.6 | 6.9e−01 | 2.7 |

As noted above, cluster R34204 features 6 segment(s), which were listed in Table 3361 above and for which the sequence(s) are given at the end of the application. These segment(s) are portions of nucleic acid sequence(s) which are described herein separately because they are of particular interest. A description of each segment according to the present invention is now provided.

Segment cluster R34204_node__33 (SEQ ID NO:3508) according to the present invention is supported by 7 libraries. The number of libraries was determined as previously described. This segment can be found in the following transcript(s): R34204_T20 (SEQ ID NO:3507). Table 3365 below describes the starting and ending position of this segment on each transcript.

TABLE 3365

Segment location on transcripts

| Transcript name | Segment starting position | Segment ending position |
|---|---|---|
| R34204_T20 (SEQ ID NO: 3507) | 1 | 1163 |

This segment can be found in the following protein(s): R34204_P16.

Segment cluster R34204_node__34 (SEQ ID NO:3509) according to the present invention is supported by 52 libraries. The number of libraries was determined as previously described. This segment can be found in the following transcript(s): R34204_T20 (SEQ ID NO:3507). Table 3366 below describes the starting and ending position of this segment on each transcript.

TABLE 3366

Segment location on transcripts

| Transcript name | Segment starting position | Segment ending position |
|---|---|---|
| R34204_T20 (SEQ ID NO: 3507) | 1164 | 1332 |

This segment can be found in the following protein(s): R34204_P16.

Segment cluster R34204_node__38 (SEQ ID NO:3510) according to the present invention is supported by 30 libraries. The number of libraries was determined as previously described. This segment can be found in the following transcript(s): R34204_T20 (SEQ ID NO:3507). Table 3367 below describes the starting and ending position of this segment on each transcript.

TABLE 3367

Segment location on transcripts

| Transcript name | Segment starting position | Segment ending position |
|---|---|---|
| R34204_T20 (SEQ ID NO: 3507) | 1333 | 1483 |

This segment can be found in the following protein(s): R34204_P16.

Segment cluster R34204_node__45 (SEQ ID NO:3511) according to the present invention is supported by 107 libraries. The number of libraries was determined as previously described. This segment can be found in the following transcript(s): R34204_T20 (SEQ ID NO:3507). Table 3368 below describes the starting and ending position of this segment on each transcript.

TABLE 3368

| Segment location on transcripts | | |
|---|---|---|
| Transcript name | Segment starting position | Segment ending position |
| R34204_T20 (SEQ ID NO: 3507) | 1594 | 2335 |

This segment can be found in a non-coding region of transcript(s) that are related to the following protein(s): R34204_P16.

Segment cluster R34204_node_46 (SEQ ID NO:3512) according to the present invention is supported by 98 libraries. The number of libraries was determined as previously described. This segment can be found in the following transcript(s): R34204_T20 (SEQ ID NO:3507). Table 3369 below describes the starting and ending position of this segment on each transcript.

TABLE 3369

| Segment location on transcripts | | |
|---|---|---|
| Transcript name | Segment starting position | Segment ending position |
| R34204_T20 (SEQ ID NO: 3507) | 2336 | 3135 |

This segment can be found in a non-coding region of transcript(s) that are related to the following protein(s): R34204_P16.

According to an optional embodiment of the present invention, short segments related to the above cluster are also provided. These segments are up to about 120 bp in length, and so are included in a separate description.

Segment cluster R34204_node_40 (SEQ ID NO:3513) according to the present invention is supported by 24 libraries. The number of libraries was determined as previously described. This segment can be found in the following transcript(s): R34204_T20 (SEQ ID NO:3507). Table 3370 below describes the starting and ending position of this segment on each transcript.

TABLE 3370

| Segment location on transcripts | | |
|---|---|---|
| Transcript name | Segment starting position | Segment ending position |
| R34204_T20 (SEQ ID NO: 3507) | 1484 | 1593 |

This segment can be found in the following protein(s): R34204_P16.

Description for Cluster R52151

Cluster R52151 features 2 transcript(s) and 24 segment(s) of interest, the names for which are given in Tables 3371 and 3372, respectively, the sequences themselves are given at the end of the application. The selected protein variants are given in Table 3373.

TABLE 3371

| Transcripts of interest Transcript Name |
|---|
| R52151_T24 (SEQ ID NO: 3514) |
| R52151_T35 (SEQ ID NO: 3515) |

TABLE 3372

| Segments of interest Segment Name |
|---|
| R52151_node_0 (SEQ ID NO: 3516) |
| R52151_node_7 (SEQ ID NO: 3517) |
| R52151_node_8 (SEQ ID NO: 3518) |
| R52151_node_12 (SEQ ID NO: 3519) |
| R52151_node_13 (SEQ ID NO: 3520) |
| R52151_node_18 (SEQ ID NO: 3521) |
| R52151_node_29 (SEQ ID NO: 3522) |
| R52151_node_34 (SEQ ID NO: 3523) |
| R52151_node_44 (SEQ ID NO: 3524) |
| R52151_node_46 (SEQ ID NO: 3525) |
| R52151_node_9 (SEQ ID NO: 3526) |
| R52151_node_14 (SEQ ID NO: 3527) |
| R52151_node_16 (SEQ ID NO: 3528) |
| R52151_node_17 (SEQ ID NO: 3529) |
| R52151_node_22 (SEQ ID NO: 3530) |
| R52151_node_23 (SEQ ID NO: 3531) |
| R52151_node_25 (SEQ ID NO: 3532) |
| R52151_node_27 (SEQ ID NO: 3533) |
| R52151_node_31 (SEQ ID NO: 3534) |
| R52151_node_33 (SEQ ID NO: 3535) |
| R52151_node_36 (SEQ ID NO: 3536) |
| R52151_node_39 (SEQ ID NO: 3537) |
| R52151_node_40 (SEQ ID NO: 3538) |
| R52151_node_47 (SEQ ID NO: 3539) |

TABLE 3373

| Proteins of interest | |
|---|---|
| Protein Name | Corresponding Transcript(s) |
| R52151_P19 | R52151_T24 (SEQ ID NO: 3514) |
| R52151_P27 | R52151_T35 (SEQ ID NO: 3515) |

These sequences are variants of the known protein Synaptotagmin-like protein 1 (SwissProt accession identifier STL1_HUMAN; known also according to the synonyms Exophilin 7; JFC1 protein; SB146), referred to herein as the previously known protein.

Protein Synaptotagmin-like protein 1 is known or believed to have the following function(s): May act as Rab effector protein and play a role in vesicle trafficking (By similarity). Binds phosphatidylinositol 3,4,5-triphosphate. The sequence for protein Synaptotagmin-like protein 1 is given at the end of the application, as "Synaptotagmin-like protein 1 amino acid sequence". Known polymorphisms for this sequence are as shown in Table 3374.

TABLE 3374

| Amino acid mutations for Known Protein | |
|---|---|
| SNP position(s) on amino acid sequence | Comment |
| 111 | S -> N |
| 162 | V -> A |
| 456 | Q -> R |

Protein Synaptotagmin-like protein 1 localization is believed to be Peripheral membrane protein tightly bound to the cytoplasmic side of cellular membranes.

The following GO Annotation(s) apply to the previously known protein. The following annotation(s) were found: transport, which are annotation(s) related to Biological Process; transporter, which are annotation(s) related to Molecular Function; and synaptic vesicle; membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R52151 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 84 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 84 and Table 3375. This cluster is overexpressed (at least at a minimum level) in the following pathological conditions: prostate cancer.

TABLE 3375

Normal tissue distribution

| Name of Tissue | Number |
|---|---|
| bladder | 0 |
| Bone | 0 |
| Brain | 6 |
| Colon | 0 |
| epithelial | 33 |
| general | 32 |
| kidney | 0 |
| liver | 0 |
| lung | 17 |
| lymph nodes | 128 |
| breast | 35 |
| ovary | 21 |
| pancreas | 51 |
| prostate | 8 |
| skin | 107 |
| stomach | 120 |
| uterus | 0 |

TABLE 3376

P values and ratios for expression in cancerous tissue

| Name of Tissue | P1 | P2 | SP1 | R3 | SP2 | R4 |
|---|---|---|---|---|---|---|
| bladder | 3.1e−01 | 3.8e−01 | 3.2e−01 | 2.6 | 4.6e−01 | 2.0 |
| bone | 1 | 6.7e−01 | 1 | 1.0 | 7.0e−01 | 1.4 |
| brain | 9.5e−01 | 8.2e−01 | 1 | 0.3 | 9.5e−02 | 1.6 |
| colon | 1.8e−01 | 2.7e−01 | 1 | 1.4 | 1 | 1.3 |
| epithelial | 5.1e−02 | 1.8e−01 | 1.4e−02 | 1.6 | 1.7e−01 | 1.2 |
| general | 2.4e−02 | 1.7e−01 | 5.7e−03 | 1.5 | 1.8e−01 | 1.1 |
| kidney | 4.1e−01 | 3.5e−01 | 3.4e−01 | 2.4 | 2.4e−01 | 2.7 |
| liver | 1 | 4.5e−01 | 1 | 1.0 | 6.9e−01 | 1.5 |
| lung | 7.7e−01 | 7.9e−01 | 6.5e−01 | 0.9 | 2.6e−01 | 1.5 |
| lymph nodes | 3.9e−01 | 7.3e−01 | 7.1e−01 | 0.8 | 9.7e−01 | 0.4 |
| breast | 8.0e−01 | 7.9e−01 | 1 | 0.6 | 1 | 0.6 |
| ovary | 8.4e−01 | 8.6e−01 | 6.8e−01 | 0.9 | 7.7e−01 | 0.8 |
| pancreas | 6.0e−01 | 7.3e−01 | 2.0e−01 | 1.5 | 4.6e−01 | 1.1 |
| prostate | 1.5e−01 | 2.4e−01 | 1.7e−03 | 6.1 | 7.5e−03 | 4.6 |
| skin | 6.2e−01 | 7.5e−01 | 2.0e−01 | 1.5 | 1 | 0.2 |

TABLE 3376-continued

P values and ratios for expression in cancerous tissue

| Name of Tissue | P1 | P2 | SP1 | R3 | SP2 | R4 |
|---|---|---|---|---|---|---|
| stomach | 8.2e−01 | 6.4e−01 | 1 | 0.2 | 6.9e−01 | 0.6 |
| uterus | 2.2e−02 | 6.3e−02 | 3.7e−02 | 3.2 | 1.4e−01 | 2.3 |

As noted above, cluster R52151 features 24 segment(s), which were listed in Table 3372 above and for which the sequence(s) are given at the end of the application. These segment(s) are portions of nucleic acid sequence(s) which are described herein separately because they are of particular interest. A description of each segment according to the present invention is now provided.

Segment cluster R52151_node_0 (SEQ ID NO:3516) according to the present invention is supported by 51 libraries. The number of libraries was determined as previously described. This segment can be found in the following transcript(s): R52151_T35 (SEQ ID NO:3515). Table 3377 below describes the starting and ending position of this segment on each transcript.

TABLE 3377

Segment location on transcripts

| Transcript name | Segment starting position | Segment ending position |
|---|---|---|
| R52151_T35 (SEQ ID NO: 3515) | 1 | 374 |

This segment can be found in a non-coding region of transcript(s) that are related to the following protein(s): R52151_P27.

Segment cluster R52151_node_7 (SEQ ID NO:3517) according to the present invention is supported by 8 libraries. The number of libraries was determined as previously described. This segment can be found in the following transcript(s): R52151_T24 (SEQ ID NO:3514). Table 3378 below describes the starting and ending position of this segment on each transcript.

TABLE 3378

Segment location on transcripts

| Transcript name | Segment starting position | Segment ending position |
|---|---|---|
| R52151_T24 (SEQ ID NO: 3514) | 1 | 610 |

This segment can be found in a non-coding region of transcript(s) that are related to the following protein(s): R52151_P19.

Segment cluster R52151_node_8 (SEQ ID NO:3518) according to the present invention is supported by 69 libraries. The number of libraries was determined as previously described. This segment can be found in the following transcript(s): R52151_T24 (SEQ ID NO:3514) and R52151_T35 (SEQ ID NO:3515). Table 3379 below describes the starting and ending position of this segment on each transcript.

TABLE 3379

Segment location on transcripts

| Transcript name | Segment starting position | Segment ending position |
|---|---|---|
| R52151_T24 (SEQ ID NO: 3514) | 611 | 819 |
| R52151_T35 (SEQ ID NO: 3515) | 375 | 583 |

This segment can be found in both coding and non-coding regions of transcript(s) as follows. The segment can be found in a non-coding region of transcript(s) that are related to the following protein(s): R52151_P19. This segment can also be found in the following protein(s): R52151_P27, since it is in the coding region for the corresponding transcript.

Segment cluster R52151_node_12 (SEQ ID NO:3519) according to the present invention is supported by 60 libraries. The number of libraries was determined as previously described. This segment can be found in the following transcript(s): R52151_T24 (SEQ ID NO:3514) and R52151_T35 (SEQ ID NO:3515). Table 3380 below describes the starting and ending position of this segment on each transcript.

TABLE 3380

Segment location on transcripts

| Transcript name | Segment starting position | Segment ending position |
|---|---|---|
| R52151_T24 (SEQ ID NO: 3514) | 840 | 988 |
| R52151_T35 (SEQ ID NO: 3515) | 604 | 752 |

This segment can be found in the following protein(s): R52151_P19 and R52151_P27.

Segment cluster R52151_node_13 (SEQ ID NO:3520) according to the present invention is supported by 1 libraries. The number of libraries was determined as previously described. This segment can be found in the following transcript(s): R52151_T24 (SEQ ID NO:3514). Table 3381 below describes the starting and ending position of this segment on each transcript.

TABLE 3381

Segment location on transcripts

| Transcript name | Segment starting position | Segment ending position |
|---|---|---|
| R52151_T24 (SEQ ID NO: 3514) | 989 | 1226 |

This segment can be found in the following protein(s): R52151_P19.

Segment cluster R52151_node_18 (SEQ ID NO:3521) according to the present invention is supported by 5 libraries. The number of libraries was determined as previously described. This segment can be found in the following transcript(s): R52151_T35 (SEQ ID NO:3515). Table 3382 below describes the starting and ending position of this segment on each transcript.

TABLE 3382

Segment location on transcripts

| Transcript name | Segment starting position | Segment ending position |
|---|---|---|
| R52151_T35 (SEQ ID NO: 3515) | 872 | 1477 |

This segment can be found in the following protein(s): R52151_P27.

Segment cluster R52151_node_29 (SEQ ID NO:3522) according to the present invention is supported by 39 libraries. The number of libraries was determined as previously described. This segment can be found in the following transcript(s): R52151_T24 (SEQ ID NO:3514). Table 3383 below describes the starting and ending position of this segment on each transcript.

TABLE 3383

Segment location on transcripts

| Transcript name | Segment starting position | Segment ending position |
|---|---|---|
| R52151_T24 (SEQ ID NO: 3514) | 1634 | 1794 |

This segment can be found in the following protein(s): R52151_P19.

Segment cluster R52151_node_34 (SEQ ID NO:3523) according to the present invention is supported by 61 libraries. The number of libraries was determined as previously described. This segment can be found in the following transcript(s): R52151_T24 (SEQ ID NO:3514). Table 3384 below describes the starting and ending position of this segment on each transcript.

TABLE 3384

Segment location on transcripts

| Transcript name | Segment starting position | Segment ending position |
|---|---|---|
| R52151_T24 (SEQ ID NO: 3514) | 1907 | 2050 |

This segment can be found in the following protein(s): R52151_P19.

Segment cluster R52151_node_44 (SEQ ID NO:3524) according to the present invention is supported by 98 libraries. The number of libraries was determined as previously described. This segment can be found in the following transcript(s): R52151_T24 (SEQ ID NO:3514). Table 3385 below describes the starting and ending position of this segment on each transcript.

TABLE 3385

Segment location on transcripts

| Transcript name | Segment starting position | Segment ending position |
|---|---|---|
| R52151_T24 (SEQ ID NO: 3514) | 2230 | 2435 |

This segment can be found in the following protein(s): R52151_P19.

Segment cluster R52151_node_46 (SEQ ID NO:3525) according to the present invention is supported by 84 libraries. The number of libraries was determined as previously described. This segment can be found in the following transcript(s): R52151_T24 (SEQ ID NO:3514). Table 3386 below describes the starting and ending position of this segment on each transcript.

TABLE 3386

Segment location on transcripts

| Transcript name | Segment starting position | Segment ending position |
|---|---|---|
| R52151_T24 (SEQ ID NO: 3514) | 2436 | 2591 |

This segment can be found in the following protein(s): R52151_P19.

According to an optional embodiment of the present invention, short segments related to the above cluster are also provided. These segments are up to about 120 bp in length, and so are included in a separate description.

Segment cluster R52151_node_9 (SEQ ID NO:3526) according to the present invention can be found in the following transcript(s): R52151_T24 (SEQ ID NO:3514) and R52151_T35 (SEQ ID NO:3515). Table 3387 below describes the starting and ending position of this segment on each transcript.

TABLE 3387

Segment location on transcripts

| Transcript name | Segment starting position | Segment ending position |
|---|---|---|
| R52151_T24 (SEQ ID NO: 3514) | 820 | 839 |
| R52151_T35 (SEQ ID NO: 3515) | 584 | 603 |

This segment can be found in both coding and non-coding regions of transcript(s) as follows. The segment can be found in a non-coding region of transcript(s) that are related to the following protein(s): R52151_P19. This segment can also be found in the following protein(s): R52151_P27, since it is in the coding region for the corresponding transcript.

Segment cluster R52151_node_14 (SEQ ID NO:3527) according to the present invention is supported by 52 libraries. The number of libraries was determined as previously described. This segment can be found in the following transcript(s): R52151_T24 (SEQ ID NO:3514) and R52151_T35 (SEQ ID NO:3515). Table 3388 below describes the starting and ending position of this segment on each transcript.

TABLE 3388

Segment location on transcripts

| Transcript name | Segment starting position | Segment ending position |
|---|---|---|
| R52151_T24 (SEQ ID NO: 3514) | 1227 | 1299 |
| R52151_T35 (SEQ ID NO: 3515) | 753 | 825 |

This segment can be found in the following protein(s): R52151_P19 and R52151_P27.

Segment cluster R52151_node_16 (SEQ ID NO:3528) according to the present invention can be found in the following transcript(s): R52151_T24 (SEQ ID NO:3514) and R52151_T35 (SEQ ID NO:3515). Table 3389 below describes the starting and ending position of this segment on each transcript.

TABLE 3389

Segment location on transcripts

| Transcript name | Segment starting position | Segment ending position |
|---|---|---|
| R52151_T24 (SEQ ID NO: 3514) | 1300 | 1319 |
| R52151_T35 (SEQ ID NO: 3515) | 826 | 845 |

This segment can be found in the following protein(s): R52151_P19 and R52151_P27.

Segment cluster R52151_node_17 (SEQ ID NO:3529) according to the present invention is supported by 46 libraries. The number of libraries was determined as previously described. This segment can be found in the following transcript(s): R52151_T24 (SEQ ID NO:3514) and R52151_T35 (SEQ ID NO:3515). Table 3390 below describes the starting and ending position of this segment on each transcript.

TABLE 3390

Segment location on transcripts

| Transcript name | Segment starting position | Segment ending position |
|---|---|---|
| R52151_T24 (SEQ ID NO: 3514) | 1320 | 1345 |
| R52151_T35 (SEQ ID NO: 3515) | 846 | 871 |

This segment can be found in the following protein(s): R52151_P19 and R52151_P27.

Segment cluster R52151_node_22 (SEQ ID NO:3530) according to the present invention is supported by 38 libraries. The number of libraries was determined as previously described. This segment can be found in the following transcript(s): R52151_T24 (SEQ ID NO:3514). Table 3391 below describes the starting and ending position of this segment on each transcript.

TABLE 3391

Segment location on transcripts

| Transcript name | Segment starting position | Segment ending position |
|---|---|---|
| R52151_T24 (SEQ ID NO: 3514) | 1346 | 1381 |

This segment can be found in the following protein(s): R52151_P19.

Segment cluster R52151_node_23 (SEQ ID NO:3531) according to the present invention is supported by 42 libraries. The number of libraries was determined as previously described. This segment can be found in the following transcript(s): R52151_T24 (SEQ ID NO:3514). Table 3392 below describes the starting and ending position of this segment on each transcript.

TABLE 3392

Segment location on transcripts

| Transcript name | Segment starting position | Segment ending position |
|---|---|---|
| R52151_T24 (SEQ ID NO: 3514) | 1382 | 1418 |

This segment can be found in the following protein(s): R52151_P19.

Segment cluster R52151_node_25 (SEQ ID NO:3532) according to the present invention is supported by 45 libraries. The number of libraries was determined as previously described. This segment can be found in the following transcript(s): R52151_T24 (SEQ ID NO:3514). Table 3393 below describes the starting and ending position of this segment on each transcript.

TABLE 3393

Segment location on transcripts

| Transcript name | Segment starting position | Segment ending position |
|---|---|---|
| R52151_T24 (SEQ ID NO: 3514) | 1419 | 1519 |

This segment can be found in the following protein(s): R52151_P19.

Segment cluster R52151_node_27 (SEQ ID NO:3533) according to the present invention is supported by 40 libraries. The number of libraries was determined as previously described. This segment can be found in the following transcript(s): R52151_T24 (SEQ ID NO:3514). Table 3394 below describes the starting and ending position of this segment on each transcript.

TABLE 3394

Segment location on transcripts

| Transcript name | Segment starting position | Segment ending position |
|---|---|---|
| R52151_T24 (SEQ ID NO: 3514) | 1520 | 1633 |

This segment can be found in the following protein(s): R52151_P19.

Segment cluster R52151_node_31 (SEQ ID NO:3534) according to the present invention is supported by 60 libraries. The number of libraries was determined as previously described. This segment can be found in the following transcript(s): R52151_T24 (SEQ ID NO:3514). Table 3395 below describes the starting and ending position of this segment on each transcript.

TABLE 3395

Segment location on transcripts

| Transcript name | Segment starting position | Segment ending position |
|---|---|---|
| R52151_T24 (SEQ ID NO: 3514) | 1795 | 1891 |

This segment can be found in the following protein(s): R52151_P19.

Segment cluster R52151_node_33 (SEQ ID NO:3535) according to the present invention can be found in the following transcript(s): R52151_T24 (SEQ ID NO:3514). Table 3396 below describes the starting and ending position of this segment on each transcript.

TABLE 3396

Segment location on transcripts

| Transcript name | Segment starting position | Segment ending position |
|---|---|---|
| R52151_T24 (SEQ ID NO: 3514) | 1892 | 1906 |

This segment can be found in the following protein(s): R52151_P19.

Segment cluster R52151_node_36 (SEQ ID NO:3536) according to the present invention is supported by 68 libraries. The number of libraries was determined as previously described. This segment can be found in the following transcript(s): R52151_T24 (SEQ ID NO:3514). Table 3397 below describes the starting and ending position of this segment on each transcript.

TABLE 3397

Segment location on transcripts

| Transcript name | Segment starting position | Segment ending position |
|---|---|---|
| R52151_T24 (SEQ ID NO: 3514) | 2051 | 2129 |

This segment can be found in the following protein(s): R52151_P19.

Segment cluster R52151_node_39 (SEQ ID NO:3537) according to the present invention is supported by 87 libraries. The number of libraries was determined as previously described. This segment can be found in the following transcript(s): R52151_T24 (SEQ ID NO:3514). Table 3398 below describes the starting and ending position of this segment on each transcript.

TABLE 3398

Segment location on transcripts

| Transcript name | Segment starting position | Segment ending position |
|---|---|---|
| R52151_T24 (SEQ ID NO: 3514) | 2130 | 2204 |

This segment can be found in the following protein(s): R52151_P19.

Segment cluster R52151_node_40 (SEQ ID NO:3538) according to the present invention can be found in the following transcript(s): R52151_T24 (SEQ ID NO:3514). Table 3399 below describes the starting and ending position of this segment on each transcript.

TABLE 3399

Segment location on transcripts

| Transcript name | Segment starting position | Segment ending position |
|---|---|---|
| R52151_T24 (SEQ ID NO: 3514) | 2205 | 2229 |

This segment can be found in the following protein(s): R52151_P19.

Segment cluster R52151_node_47 (SEQ ID NO:3539) according to the present invention is supported by 63 libraries. The number of libraries was determined as previously described. This segment can be found in the following transcript(s): R52151_T24 (SEQ ID NO:3514). Table 3400 below describes the starting and ending position of this segment on each transcript.

TABLE 3400

Segment location on transcripts

| Transcript name | Segment starting position | Segment ending position |
|---|---|---|
| R52151_T24 (SEQ ID NO: 3514) | 2592 | 2675 |

This segment can be found in a non-coding region of transcript(s) that are related to the following protein(s): R52151_P19.

Description for Cluster R82331

Cluster R82331 features 52 transcript(s) and 74 segment(s) of interest, the names for which are given in Tables 3401 and 3402, respectively, the sequences themselves are given at the end of the application. The selected protein variants are given in Table 3403.

TABLE 3401

Transcripts of interest
Transcript Name

R82331_T0 (SEQ ID NO: 3540)
R82331_T1 (SEQ ID NO: 3541)
R82331_T2 (SEQ ID NO: 3542)
R82331_T3 (SEQ ID NO: 3543)
R82331_T5 (SEQ ID NO: 3544)
R82331_T7 (SEQ ID NO: 3545)
R82331_T9 (SEQ ID NO: 3546)
R82331_T10 (SEQ ID NO: 3547)
R82331_T11 (SEQ ID NO: 3548)
R82331_T13 (SEQ ID NO: 3549)
R82331_T15 (SEQ ID NO: 3550)
R82331_T16 (SEQ ID NO: 3551)
R82331_T17 (SEQ ID NO: 3552)
R82331_T18 (SEQ ID NO: 3553)
R82331_T19 (SEQ ID NO: 3554)
R82331_T20 (SEQ ID NO: 3555)
R82331_T21 (SEQ ID NO: 3556)
R82331_T22 (SEQ ID NO: 3557)
R82331_T23 (SEQ ID NO: 3558)
R82331_T24 (SEQ ID NO: 3559)
R82331_T25 (SEQ ID NO: 3560)
R82331_T26 (SEQ ID NO: 3561)
R82331_T27 (SEQ ID NO: 3562)
R82331_T28 (SEQ ID NO: 3563)
R82331_T29 (SEQ ID NO: 3564)
R82331_T30 (SEQ ID NO: 3565)
R82331_T31 (SEQ ID NO: 3566)
R82331_T32 (SEQ ID NO: 3567)
R82331_T34 (SEQ ID NO: 3568)
R82331_T35 (SEQ ID NO: 3569)
R82331_T36 (SEQ ID NO: 3570)
R82331_T37 (SEQ ID NO: 3571)
R82331_T38 (SEQ ID NO: 3572)
R82331_T39 (SEQ ID NO: 3573)
R82331_T51 (SEQ ID NO: 3574)
R82331_T53 (SEQ ID NO: 3575)
R82331_T55 (SEQ ID NO: 3576)
R82331_T56 (SEQ ID NO: 3577)
R82331_T59 (SEQ ID NO: 3578)
R82331_T60 (SEQ ID NO: 3579)
R82331_T66 (SEQ ID NO: 3580)
R82331_T69 (SEQ ID NO: 3581)
R82331_T72 (SEQ ID NO: 3582)
R82331_T74 (SEQ ID NO: 3583)
R82331_T76 (SEQ ID NO: 3584)
R82331_T79 (SEQ ID NO: 3585)
R82331_T80 (SEQ ID NO: 3586)
R82331_T84 (SEQ ID NO: 3587)
R82331_T86 (SEQ ID NO: 3588)

TABLE 3401-continued

Transcripts of interest
Transcript Name

R82331_T89 (SEQ ID NO: 3589)
R82331_T90 (SEQ ID NO: 3590)
R82331_T92 (SEQ ID NO: 3591)

TABLE 3402

Segments of interest
Segment Name

R82331_node_0 (SEQ ID NO: 3592)
R82331_node_4 (SEQ ID NO: 3593)
R82331_node_12 (SEQ ID NO: 3594)
R82331_node_19 (SEQ ID NO: 3595)
R82331_node_20 (SEQ ID NO: 3596)
R82331_node_21 (SEQ ID NO: 3597)
R82331_node_23 (SEQ ID NO: 3598)
R82331_node_26 (SEQ ID NO: 3599)
R82331_node_27 (SEQ ID NO: 3600)
R82331_node_28 (SEQ ID NO: 3601)
R82331_node_30 (SEQ ID NO: 3602)
R82331_node_32 (SEQ ID NO: 3603)
R82331_node_33 (SEQ ID NO: 3604)
R82331_node_35 (SEQ ID NO: 3605)
R82331_node_38 (SEQ ID NO: 3606)
R82331_node_41 (SEQ ID NO: 3607)
R82331_node_43 (SEQ ID NO: 3608)
R82331_node_44 (SEQ ID NO: 3609)
R82331_node_47 (SEQ ID NO: 3610)
R82331_node_49 (SEQ ID NO: 3611)
R82331_node_59 (SEQ ID NO: 3612)
R82331_node_61 (SEQ ID NO: 3613)
R82331_node_63 (SEQ ID NO: 3614)
R82331_node_71 (SEQ ID NO: 3615)
R82331_node_78 (SEQ ID NO: 3616)
R82331_node_83 (SEQ ID NO: 3617)
R82331_node_85 (SEQ ID NO: 3618)
R82331_node_89 (SEQ ID NO: 3619)
R82331_node_90 (SEQ ID NO: 3620)
R82331_node_91 (SEQ ID NO: 3621)
R82331_node_93 (SEQ ID NO: 3622)
R82331_node_95 (SEQ ID NO: 3623)
R82331_node_96 (SEQ ID NO: 3624)
R82331_node_97 (SEQ ID NO: 3625)
R82331_node_98 (SEQ ID NO: 3626)
R82331_node_99 (SEQ ID NO: 3627)
R82331_node_101 (SEQ ID NO: 3628)
R82331_node_102 (SEQ ID NO: 3629)
R82331_node_103 (SEQ ID NO: 3630)
R82331_node_104 (SEQ ID NO: 3631)
R82331_node_105 (SEQ ID NO: 3632)
R82331_node_108 (SEQ ID NO: 3633)
R82331_node_110 (SEQ ID NO: 3634)
R82331_node_2 (SEQ ID NO: 3635)
R82331_node_6 (SEQ ID NO: 3636)
R82331_node_8 (SEQ ID NO: 3637)
R82331_node_10 (SEQ ID NO: 3638)
R82331_node_14 (SEQ ID NO: 3639)
R82331_node_16 (SEQ ID NO: 3640)
R82331_node_17 (SEQ ID NO: 3641)
R82331_node_22 (SEQ ID NO: 3642)
R82331_node_24 (SEQ ID NO: 3643)
R82331_node_25 (SEQ ID NO: 3644)
R82331_node_31 (SEQ ID NO: 3645)
R82331_node_39 (SEQ ID NO: 3646)
R82331_node_53 (SEQ ID NO: 3647)
R82331_node_54 (SEQ ID NO: 3648)
R82331_node_55 (SEQ ID NO: 3649)
R82331_node_57 (SEQ ID NO: 3650)
R82331_node_64 (SEQ ID NO: 3651)
R82331_node_65 (SEQ ID NO: 3652)
R82331_node_72 (SEQ ID NO: 3653)
R82331_node_73 (SEQ ID NO: 3654)
R82331_node_74 (SEQ ID NO: 3655)

TABLE 3402-continued

Segments of interest
Segment Name

R82331_node_76 (SEQ ID NO: 3656)
R82331_node_80 (SEQ ID NO: 3657)
R82331_node_81 (SEQ ID NO: 3658)
R82331_node_82 (SEQ ID NO: 3659)
R82331_node_84 (SEQ ID NO: 3660)
R82331_node_94 (SEQ ID NO: 3661)
R82331_node_100 (SEQ ID NO: 3662)
R82331_node_106 (SEQ ID NO: 3663)
R82331_node_107 (SEQ ID NO: 3664)
R82331_node_109 (SEQ ID NO: 3665)

TABLE 3403

Proteins of interest

| Protein Name | Corresponding Transcript(s) |
|---|---|
| R82331_P1 | R82331_T0 (SEQ ID NO: 3540); R82331_T1 (SEQ ID NO: 3541); R82331_T2 (SEQ ID NO: 3542); R82331_T3 (SEQ ID NO: 3543); R82331_T5 (SEQ ID NO: 3544); R82331_T7 (SEQ ID NO: 3545); R82331_T15 (SEQ ID NO: 3550); R82331_T16 (SEQ ID NO: 3551); R82331_T17 (SEQ ID NO: 3552); R82331_T18 (SEQ ID NO: 3553); R82331_T19 (SEQ ID NO: 3554); R82331_T20 (SEQ ID NO: 3555); R82331_T23 (SEQ ID NO: 3558); R82331_T24 (SEQ ID NO: 3559); R82331_T28 (SEQ ID NO: 3563) |
| R82331_P2 | R82331_T9 (SEQ ID NO: 3546); R82331_T10 (SEQ ID NO: 3547); R82331_T11 (SEQ ID NO: 3548); R82331_T13 (SEQ ID NO: 3549); R82331_T55 (SEQ ID NO: 3576); R82331_T90 (SEQ ID NO: 3590) |
| R82331_P4 | R82331_T21 (SEQ ID NO: 3556); R82331_T25 (SEQ ID NO: 3560); R82331_T26 (SEQ ID NO: 3561); R82331_T27 (SEQ ID NO: 3562); R82331_T29 (SEQ ID NO: 3564); R82331_T30 (SEQ ID NO: 3565); R82331_T31 (SEQ ID NO: 3566); R82331_T32 (SEQ ID NO: 3567); R82331_T34 (SEQ ID NO: 3568); R82331_T35 (SEQ ID NO: 3569); R82331_T36 (SEQ ID NO: 3570); R82331_T37 (SEQ ID NO: 3571); R82331_T38 (SEQ ID NO: 3572); R82331_T39 (SEQ ID NO: 3573) |
| R82331_P5 | R82331_T60 (SEQ ID NO: 3579); R82331_T66 (SEQ ID NO: 3580) |
| R82331_P6 | R82331_T74 (SEQ ID NO: 3583); R82331_T80 (SEQ ID NO: 3586) |
| R82331_P7 | R82331_T53 (SEQ ID NO: 3575) |

Cluster R82331 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 85 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 85 and Table 3404. This cluster is overexpressed (at least at a minimum level) in the following pathological conditions: brain malignant tumors, epithelial malignant tumors, a mixture of malignant tumors from different tissues, ovarian carcinoma, skin malignancies and uterine malignancies.

TABLE 3404

Normal tissue distribution

| Name of Tissue | Number |
|---|---|
| adrenal | 80 |
| bladder | 0 |
| bone | 38 |
| brain | 18 |
| colon | 31 |
| epithelial | 54 |
| general | 25 |
| head and neck | 10 |
| kidney | 24 |
| liver | 0 |
| lung | 1 |
| breast | 48 |
| bone marrow | 0 |
| ovary | 0 |
| pancreas | 0 |
| prostate | 550 |
| skin | 0 |
| stomach | 0 |
| T cells | 0 |
| uterus | 4 |

TABLE 3405

P values and ratios for expression in cancerous tissue

| Name of Tissue | P1 | P2 | SP1 | R3 | SP2 | R4 |
|---|---|---|---|---|---|---|
| adrenal | 7.4e-01 | 6.0e-01 | 2.7e-01 | 1.1 | 2.0e-01 | 1.5 |
| bladder | 2.7e-01 | 9.2e-02 | 5.7e-02 | 4.1 | 4.6e-02 | 4.3 |
| bone | 3.7e-01 | 2.3e-01 | 6.4e-01 | 1.4 | 3.3e-01 | 1.7 |
| brain | 3.1e-01 | 2.9e-02 | 1.2e-02 | 3.6 | 9.0e-07 | 5.0 |
| colon | 1.9e-01 | 1.3e-01 | 6.5e-01 | 1.3 | 5.9e-01 | 1.3 |
| epithelial | 2.3e-08 | 3.2e-10 | 3.0e-14 | 3.3 | 1.9e-11 | 2.7 |
| general | 3.1e-15 | 1.0e-21 | 1.1e-39 | 6.1 | 2.7e-40 | 5.2 |
| head and neck | 4.6e-01 | 2.5e-01 | 1 | 0.9 | 4.2e-01 | 1.8 |
| kidney | 6.3e-01 | 4.8e-01 | 3.1e-01 | 1.8 | 6.3e-02 | 2.2 |
| liver | 1.8e-01 | 4.3e-02 | 1 | 2.0 | 3.7e-02 | 4.1 |
| lung | 3.0e-01 | 1.8e-01 | 4.1e-01 | 3.3 | 9.0e-02 | 3.7 |
| breast | 2.8e-01 | 2.2e-01 | 3.1e-01 | 1.6 | 4.5e-01 | 1.4 |
| bone marrow | 4.3e-01 | 4.2e-01 | 1.5e-01 | 6.7 | 2.8e-01 | 2.8 |
| ovary | 1.2e-02 | 1.0e-02 | 6.9e-03 | 6.6 | 2.4e-02 | 5.0 |
| pancreas | 9.5e-02 | 1.8e-01 | 3.2e-02 | 6.5 | 7.7e-02 | 4.6 |
| prostate | 6.2e-01 | 6.8e-01 | 4.9e-01 | 0.8 | 8.9e-01 | 0.6 |
| skin | 6.6e-02 | 7.1e-04 | 2.0e-02 | 13.1 | 1.0e-05 | 9.4 |
| stomach | 1.1e-01 | 3.2e-01 | 6.3e-02 | 3.2 | 2.6e-01 | 2.1 |
| T cells | 1 | 6.7e-01 | 1 | 1.0 | 5.2e-01 | 1.8 |
| uterus | 2.5e-02 | 5.5e-03 | 1.8e-04 | 7.6 | 4.2e-04 | 6.7 |

As noted above, cluster R82331 features 74 segment(s), which were listed in Table 3402 above and for which the sequence(s) are given at the end of the application. These segment(s) are portions of nucleic acid sequence(s) which are described herein separately because they are of particular interest. A description of each segment according to the present invention is now provided.

Segment cluster R82331_node_0 (SEQ ID NO:3592) according to the present invention is supported by 1 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3406 below describes the starting and ending position of this segment on each transcript.

TABLE 3406

Segment location on transcripts

| Transcript name | Segment starting position | Segment ending position |
| --- | --- | --- |
| R82331_T9 (SEQ ID NO: 3546) | 1 | 473 |
| R82331_T10 (SEQ ID NO: 3547) | 1 | 473 |
| R82331_T11 (SEQ ID NO: 3548) | 1 | 473 |
| R82331_T13 (SEQ ID NO: 3549) | 1 | 473 |
| R82331_T53 (SEQ ID NO: 3575) | 1 | 473 |
| R82331_T55 (SEQ ID NO: 3576) | 1 | 473 |
| R82331_T90 (SEQ ID NO: 3590) | 1 | 473 |

This segment can be found in a non-coding region of transcript(s) that are related to the following protein(s): R82331_P2 and R82331_P7.

Segment cluster R82331_node_4 (SEQ ID NO:3593) according to the present invention is supported by 1 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3407 below describes the starting and ending position of this segment on each transcript.

TABLE 3407

Segment location on transcripts

| Transcript name | Segment starting position | Segment ending position |
| --- | --- | --- |
| R82331_T9 (SEQ ID NO: 3546) | 581 | 718 |
| R82331_T10 (SEQ ID NO: 3547) | 581 | 718 |
| R82331_T11 (SEQ ID NO: 3548) | 581 | 718 |
| R82331_T13 (SEQ ID NO: 3549) | 581 | 718 |
| R82331_T53 (SEQ ID NO: 3575) | 581 | 718 |
| R82331_T55 (SEQ ID NO: 3576) | 581 | 718 |
| R82331_T90 (SEQ ID NO: 3590) | 581 | 718 |

This segment can be found in a non-coding region of transcript(s) that are related to the following protein(s): R82331_P2 and R82331_P7.

Segment cluster R82331_node_12 (SEQ ID NO:3594) according to the present invention is supported by 5 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3408 below describes the starting and ending position of this segment on each transcript.

TABLE 3408

Segment location on transcripts

| Transcript name | Segment starting position | Segment ending position |
| --- | --- | --- |
| R82331_T9 (SEQ ID NO: 3546) | 906 | 1072 |
| R82331_T10 (SEQ ID NO: 3547) | 906 | 1072 |
| R82331_T11 (SEQ ID NO: 3548) | 906 | 1072 |
| R82331_T13 (SEQ ID NO: 3549) | 906 | 1072 |
| R82331_T53 (SEQ ID NO: 3575) | 906 | 1072 |
| R82331_T55 (SEQ ID NO: 3576) | 906 | 1072 |
| R82331_T90 (SEQ ID NO: 3590) | 906 | 1072 |

This segment can be found in a non-coding region of transcript(s) that are related to the following protein(s): R82331_P2 and R82331_P7.

Segment cluster R82331_node_19 (SEQ ID NO:3595) according to the present invention is supported by 12 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3409 below describes the starting and ending position of this segment on each transcript.

TABLE 3409

Segment location on transcripts

| Transcript name | Segment starting position | Segment ending position |
| --- | --- | --- |
| R82331_T9 (SEQ ID NO: 3546) | 1241 | 4156 |
| R82331_T10 (SEQ ID NO: 3547) | 1241 | 4156 |
| R82331_T11 (SEQ ID NO: 3548) | 1241 | 4156 |
| R82331_T13 (SEQ ID NO: 3549) | 1192 | 4107 |
| R82331_T53 (SEQ ID NO: 3575) | 1192 | 4107 |
| R82331_T55 (SEQ ID NO: 3576) | 1241 | 4156 |
| R82331_T90 (SEQ ID NO: 3590) | 1241 | 4156 |

This segment can be found in the following protein(s): R82331_P2 and R82331_P7.

Segment cluster R82331_node_20 (SEQ ID NO:3596) according to the present invention is supported by 6 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3410 below describes the starting and ending position of this segment on each transcript.

TABLE 3410

Segment location on transcripts

| Transcript name | Segment starting position | Segment ending position |
| --- | --- | --- |
| R82331_T9 (SEQ ID NO: 3546) | 4157 | 4700 |
| R82331_T10 (SEQ ID NO: 3547) | 4157 | 4700 |
| R82331_T11 (SEQ ID NO: 3548) | 4157 | 4700 |
| R82331_T13 (SEQ ID NO: 3549) | 4108 | 4651 |
| R82331_T53 (SEQ ID NO: 3575) | 4108 | 4651 |

TABLE 3410-continued

Segment location on transcripts

| Transcript name | Segment starting position | Segment ending position |
|---|---|---|
| R82331_T55 (SEQ ID NO: 3576) | 4157 | 4700 |
| R82331_T90 (SEQ ID NO: 3590) | 4157 | 4700 |

This segment can be found in a non-coding region of transcript(s) that are related to the following protein(s): R82331_P2 and R82331_P7.

Segment cluster R82331_node__21 (SEQ ID NO:3597) according to the present invention is supported by 3 libraries. The number of libraries was determined as previously described. This segment can be found in the following transcript(s): R82331_T9 (SEQ ID NO:3546), R82331_T10 (SEQ ID NO:3547), R82331_T13 (SEQ ID NO:3549), R82331_T53 (SEQ ID NO:3575), R82331_T55 (SEQ ID NO:3576) and R82331_T90 (SEQ ID NO:3590). Table 3411 below describes the starting and ending position of this segment on each transcript.

TABLE 3411

Segment location on transcripts

| Transcript name | Segment starting position | Segment ending position |
|---|---|---|
| R82331_T9 (SEQ ID NO: 3546) | 4701 | 4927 |
| R82331_T10 (SEQ ID NO: 3547) | 4701 | 4927 |
| R82331_T13 (SEQ ID NO: 3549) | 4652 | 4878 |
| R82331_T53 (SEQ ID NO: 3575) | 4652 | 4878 |
| R82331_T55 (SEQ ID NO: 3576) | 4701 | 4927 |
| R82331_T90 (SEQ ID NO: 3590) | 4701 | 4927 |

This segment can be found in a non-coding region of transcript(s) that are related to the following protein(s): R82331_P2 and R82331_P7.

Segment cluster R82331_node__23 (SEQ ID NO:3598) according to the present invention is supported by 4 libraries. The number of libraries was determined as previously described. This segment can be found in the following transcript(s): R82331_T10 (SEQ ID NO:3547) and R82331_T55 (SEQ ID NO:3576). Table 3412 below describes the starting and ending position of this segment on each transcript.

TABLE 3412

Segment location on transcripts

| Transcript name | Segment starting position | Segment ending position |
|---|---|---|
| R82331_T10 (SEQ ID NO: 3547) | 4941 | 5074 |
| R82331_T55 (SEQ ID NO: 3576) | 4941 | 5074 |

This segment can be found in a non-coding region of transcript(s) that are related to the following protein(s): R82331_P2.

Segment cluster R82331_node__26 (SEQ ID NO:3599) according to the present invention is supported by 7 libraries. The number of libraries was determined as previously described. This segment can be found in the following transcript(s): R82331_T9 (SEQ ID NO:3546), R82331_T10 (SEQ ID NO:3547), R82331_T13 (SEQ ID NO:3549), R82331_T53 (SEQ ID NO:3575), R82331_T55 (SEQ ID NO:3576) and R82331_T90 (SEQ ID NO:3590). Table 3413 below describes the starting and ending position of this segment on each transcript.

TABLE 3413

Segment location on transcripts

| Transcript name | Segment starting position | Segment ending position |
|---|---|---|
| R82331_T9 (SEQ ID NO: 3546) | 4943 | 5170 |
| R82331_T10 (SEQ ID NO: 3547) | 5181 | 5408 |
| R82331_T13 (SEQ ID NO: 3549) | 4894 | 5121 |
| R82331_T53 (SEQ ID NO: 3575) | 4892 | 5119 |
| R82331_T55 (SEQ ID NO: 3576) | 5181 | 5408 |
| R82331_T90 (SEQ ID NO: 3590) | 4943 | 5170 |

This segment can be found in a non-coding region of transcript(s) that are related to the following protein(s): R82331_P2 and R82331_P7.

Segment cluster R82331_node__27 (SEQ ID NO:3600) according to the present invention is supported by 26 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3414 below describes the starting and ending position of this segment on each transcript.

TABLE 3414

Segment location on transcripts

| Transcript name | Segment starting position | Segment ending position |
|---|---|---|
| R82331_T9 (SEQ ID NO: 3546) | 5171 | 6089 |
| R82331_T10 (SEQ ID NO: 3547) | 5409 | 6327 |
| R82331_T11 (SEQ ID NO: 3548) | 4701 | 5619 |
| R82331_T13 (SEQ ID NO: 3549) | 5122 | 6040 |
| R82331_T53 (SEQ ID NO: 3575) | 5120 | 6038 |
| R82331_T55 (SEQ ID NO: 3576) | 5409 | 6327 |
| R82331_T90 (SEQ ID NO: 3590) | 5171 | 6089 |

This segment can be found in a non-coding region of transcript(s) that are related to the following protein(s): R82331_P2 and R82331_P7.

Segment cluster R82331_node__28 (SEQ ID NO:3601) according to the present invention is supported by 24 libraries. The number of libraries was determined as previously described. This segment can be found in the following transcript(s): R82331_T53 (SEQ ID NO:3575) and R82331_T55 (SEQ ID NO:3576). Table 3415 below describes the starting and ending position of this segment on each transcript.

TABLE 3415

Segment location on transcripts

| Transcript name | Segment starting position | Segment ending position |
|---|---|---|
| R82331_T53 (SEQ ID NO: 3575) | 6039 | 6536 |
| R82331_T55 (SEQ ID NO: 3576) | 6328 | 6825 |

This segment can be found in a non-coding region of transcript(s) that are related to the following protein(s): R82331_P7 and R82331_P2.

Segment cluster R82331_node_30 (SEQ ID NO:3602) according to the present invention is supported by 4 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586), R82331_T84 (SEQ ID NO:3587), R82331_T86 (SEQ ID NO:3588), R82331_T89 (SEQ ID NO:3589) and R82331_T92 (SEQ ID NO:3591). Table 3416 below describes the starting and ending position of this segment on each transcript.

TABLE 3416

Segment location on transcripts

| Transcript name | Segment starting position | Segment ending position |
|---|---|---|
| R82331_T0 (SEQ ID NO: 3540) | 1 | 636 |
| R82331_T1 (SEQ ID NO: 3541) | 1 | 636 |
| R82331_T2 (SEQ ID NO: 3542) | 1 | 636 |
| R82331_T3 (SEQ ID NO: 3543) | 1 | 636 |
| R82331_T5 (SEQ ID NO: 3544) | 1 | 636 |
| R82331_T7 (SEQ ID NO: 3545) | 1 | 636 |
| R82331_T15 (SEQ ID NO: 3550) | 1 | 636 |
| R82331_T16 (SEQ ID NO: 3551) | 1 | 636 |
| R82331_T17 (SEQ ID NO: 3552) | 1 | 636 |
| R82331_T18 (SEQ ID NO: 3553) | 1 | 636 |
| R82331_T19 (SEQ ID NO: 3554) | 1 | 636 |
| R82331_T51 (SEQ ID NO: 3574) | 1 | 636 |
| R82331_T56 (SEQ ID NO: 3577) | 1 | 636 |
| R82331_T59 (SEQ ID NO: 3578) | 1 | 636 |
| R82331_T69 (SEQ ID NO: 3581) | 1 | 636 |
| R82331_T72 (SEQ ID NO: 3582) | 1 | 636 |
| R82331_T74 (SEQ ID NO: 3583) | 1 | 636 |
| R82331_T76 (SEQ ID NO: 3584) | 1 | 636 |
| R82331_T79 (SEQ ID NO: 3585) | 1 | 636 |
| R82331_T80 (SEQ ID NO: 3586) | 1 | 636 |
| R82331_T84 (SEQ ID NO: 3587) | 1 | 636 |
| R82331_T86 (SEQ ID NO: 3588) | 1 | 636 |
| R82331_T89 (SEQ ID NO: 3589) | 1 | 636 |
| R82331_T92 (SEQ ID NO: 3591) | 1 | 636 |

This segment can be found in a non-coding region of transcript(s) that are related to the following protein(s): R82331_P1 and R82331_P6.

Segment cluster R82331_node_32 (SEQ ID NO:3603) according to the present invention is supported by 21 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586), R82331_T84 (SEQ ID NO:3587), R82331_T86 (SEQ ID NO:3588), R82331_T89 (SEQ ID NO:3589) and R82331_T92 (SEQ ID NO:3591). Table 3417 below describes the starting and ending position of this segment on each transcript.

TABLE 3417

Segment location on transcripts

| Transcript name | Segment starting position | Segment ending position |
|---|---|---|
| R82331_T0 (SEQ ID NO: 3540) | 643 | 1703 |
| R82331_T1 (SEQ ID NO: 3541) | 643 | 1703 |
| R82331_T2 (SEQ ID NO: 3542) | 643 | 1703 |
| R82331_T3 (SEQ ID NO: 3543) | 643 | 1703 |
| R82331_T5 (SEQ ID NO: 3544) | 643 | 1703 |
| R82331_T7 (SEQ ID NO: 3545) | 643 | 1703 |
| R82331_T15 (SEQ ID NO: 3550) | 643 | 1703 |
| R82331_T16 (SEQ ID NO: 3551) | 643 | 1703 |
| R82331_T17 (SEQ ID NO: 3552) | 643 | 1703 |
| R82331_T18 (SEQ ID NO: 3553) | 643 | 1703 |
| R82331_T19 (SEQ ID NO: 3554) | 643 | 1703 |
| R82331_T51 (SEQ ID NO: 3574) | 643 | 1703 |
| R82331_T56 (SEQ ID NO: 3577) | 643 | 1703 |
| R82331_T59 (SEQ ID NO: 3578) | 643 | 1703 |
| R82331_T69 (SEQ ID NO: 3581) | 643 | 1703 |
| R82331_T72 (SEQ ID NO: 3582) | 643 | 1703 |
| R82331_T74 (SEQ ID NO: 3583) | 643 | 1703 |
| R82331_T76 (SEQ ID NO: 3584) | 643 | 1703 |
| R82331_T79 (SEQ ID NO: 3585) | 643 | 1703 |
| R82331_T80 (SEQ ID NO: 3586) | 643 | 1703 |
| R82331_T84 (SEQ ID NO: 3587) | 643 | 1703 |
| R82331_T86 (SEQ ID NO: 3588) | 643 | 1703 |
| R82331_T89 (SEQ ID NO: 3589) | 643 | 1703 |
| R82331_T92 (SEQ ID NO: 3591) | 643 | 1703 |

This segment can be found in a non-coding region of transcript(s) that are related to the following protein(s): R82331_P1 and R82331_P6.

Segment cluster R82331_node_33 (SEQ ID NO:3604) according to the present invention is supported by 24 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586), R82331_T84 (SEQ ID NO:3587), R82331_T86 (SEQ ID NO:3588), R82331_T89 (SEQ ID NO:3589), R82331_T90 (SEQ ID NO:3590) and R82331_T92 (SEQ ID NO:3591). Table 3418 below describes the starting and ending position of this segment on each transcript.

TABLE 3418

Segment location on transcripts

| Transcript name | Segment starting position | Segment ending position |
|---|---|---|
| R82331_T0 (SEQ ID NO: 3540) | 1704 | 1839 |
| R82331_T1 (SEQ ID NO: 3541) | 1704 | 1839 |
| R82331_T2 (SEQ ID NO: 3542) | 1704 | 1839 |
| R82331_T3 (SEQ ID NO: 3543) | 1704 | 1839 |
| R82331_T5 (SEQ ID NO: 3544) | 1704 | 1839 |
| R82331_T7 (SEQ ID NO: 3545) | 1704 | 1839 |
| R82331_T9 (SEQ ID NO: 3546) | 6090 | 6225 |
| R82331_T10 (SEQ ID NO: 3547) | 6328 | 6463 |
| R82331_T11 (SEQ ID NO: 3548) | 5620 | 5755 |
| R82331_T13 (SEQ ID NO: 3549) | 6041 | 6176 |
| R82331_T15 (SEQ ID NO: 3550) | 1704 | 1839 |
| R82331_T16 (SEQ ID NO: 3551) | 1704 | 1839 |
| R82331_T17 (SEQ ID NO: 3552) | 1704 | 1839 |
| R82331_T18 (SEQ ID NO: 3553) | 1704 | 1839 |
| R82331_T19 (SEQ ID NO: 3554) | 1704 | 1839 |
| R82331_T51 (SEQ ID NO: 3574) | 1704 | 1839 |
| R82331_T56 (SEQ ID NO: 3577) | 1704 | 1839 |
| R82331_T59 (SEQ ID NO: 3578) | 1704 | 1839 |
| R82331_T69 (SEQ ID NO: 3581) | 1704 | 1839 |
| R82331_T72 (SEQ ID NO: 3582) | 1704 | 1839 |
| R82331_T74 (SEQ ID NO: 3583) | 1704 | 1839 |
| R82331_T76 (SEQ ID NO: 3584) | 1704 | 1839 |
| R82331_T79 (SEQ ID NO: 3585) | 1704 | 1839 |
| R82331_T80 (SEQ ID NO: 3586) | 1704 | 1839 |
| R82331_T84 (SEQ ID NO: 3587) | 1704 | 1839 |
| R82331_T86 (SEQ ID NO: 3588) | 1704 | 1839 |
| R82331_T89 (SEQ ID NO: 3589) | 1704 | 1839 |
| R82331_T90 (SEQ ID NO: 3590) | 6090 | 6225 |
| R82331_T92 (SEQ ID NO: 3591) | 1704 | 1839 |

This segment can be found in a non-coding region of transcript(s) that are related to the following protein(s): R82331_P1, R82331_P2 and R82331_P6.

Segment cluster R82331_node_35 (SEQ ID NO:3605) according to the present invention is supported by 24 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T16 (SEQ ID NO:3551), R82331_T17 (SEQ ID NO:3552), R82331_T18 (SEQ ID NO:3553), R82331_T19 (SEQ ID NO:3554), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586) and R82331_T84 (SEQ ID NO:3587). Table 3419 below describes the starting and ending position of this segment on each transcript.

TABLE 3419

Segment location on transcripts

| Transcript name | Segment starting position | Segment ending position |
|---|---|---|
| R82331_T0 (SEQ ID NO: 3540) | 1840 | 2109 |
| R82331_T1 (SEQ ID NO: 3541) | 1840 | 2109 |
| R82331_T2 (SEQ ID NO: 3542) | 1840 | 2109 |
| R82331_T3 (SEQ ID NO: 3543) | 1840 | 2109 |

TABLE 3419-continued

Segment location on transcripts

| Transcript name | Segment starting position | Segment ending position |
|---|---|---|
| R82331_T5 (SEQ ID NO: 3544) | 1840 | 2109 |
| R82331_T7 (SEQ ID NO: 3545) | 1840 | 2109 |
| R82331_T9 (SEQ ID NO: 3546) | 6226 | 6495 |
| R82331_T10 (SEQ ID NO: 3547) | 6464 | 6733 |
| R82331_T11 (SEQ ID NO: 3548) | 5756 | 6025 |
| R82331_T13 (SEQ ID NO: 3549) | 6177 | 6446 |
| R82331_T16 (SEQ ID NO: 3551) | 1840 | 2109 |
| R82331_T17 (SEQ ID NO: 3552) | 1840 | 2109 |
| R82331_T18 (SEQ ID NO: 3553) | 1840 | 2109 |
| R82331_T19 (SEQ ID NO: 3554) | 1840 | 2109 |
| R82331_T51 (SEQ ID NO: 3574) | 1840 | 2109 |
| R82331_T56 (SEQ ID NO: 3577) | 1840 | 2109 |
| R82331_T59 (SEQ ID NO: 3578) | 1840 | 2109 |
| R82331_T69 (SEQ ID NO: 3581) | 1840 | 2109 |
| R82331_T72 (SEQ ID NO: 3582) | 1840 | 2109 |
| R82331_T74 (SEQ ID NO: 3583) | 1840 | 2109 |
| R82331_T76 (SEQ ID NO: 3584) | 1840 | 2109 |
| R82331_T79 (SEQ ID NO: 3585) | 1840 | 2109 |
| R82331_T80 (SEQ ID NO: 3586) | 1840 | 2109 |
| R82331_T84 (SEQ ID NO: 3587) | 1840 | 2109 |

This segment can be found in a non-coding region of transcript(s) that are related to the following protein(s): R82331_P1, R82331_P2 and R82331_P6.

Segment cluster R82331_node_38 (SEQ ID NO:3606) according to the present invention is supported by 2 libraries. The number of libraries was determined as previously described. This segment can be found in the following transcript(s): R82331_T28 (SEQ ID NO:3563). Table 3420 below describes the starting and ending position of this segment on each transcript.

TABLE 3420

Segment location on transcripts

| Transcript name | Segment starting position | Segment ending position |
|---|---|---|
| R82331_T28 (SEQ ID NO: 3563) | 1 | 556 |

This segment can be found in a non-coding region of transcript(s) that are related to the following protein(s): R82331_P1.

Segment cluster R82331_node_41 (SEQ ID NO:3607) according to the present invention is supported by 3 libraries. The number of libraries was determined as previously described. This segment can be found in the following transcript(s): R82331_T84 (SEQ ID NO:3587). Table 3421 below describes the starting and ending position of this segment on each transcript.

TABLE 3421

Segment location on transcripts

| Transcript name | Segment starting position | Segment ending position |
|---|---|---|
| R82331_T84 (SEQ ID NO: 3587) | 2176 | 2484 |

The previously-described transcripts for these segment(s) do not code for protein.

Segment cluster R82331_node_43 (SEQ ID NO:3608) according to the present invention is supported by 7 libraries.

The number of libraries was determined as previously described. This segment can be found in the following transcript(s): R82331_T51 (SEQ ID NO:3574), R82331_T59 (SEQ ID NO:3578), R82331_T79 (SEQ ID NO:3585) and R82331_T92 (SEQ ID NO:3591). Table 3422 below describes the starting and ending position of this segment on each transcript.

TABLE 3422

Segment location on transcripts

| Transcript name | Segment starting position | Segment ending position |
|---|---|---|
| R82331_T51 (SEQ ID NO: 3574) | 2176 | 2437 |
| R82331_T59 (SEQ ID NO: 3578) | 2176 | 2437 |
| R82331_T79 (SEQ ID NO: 3585) | 2176 | 2437 |
| R82331_T92 (SEQ ID NO: 3591) | 1906 | 2167 |

The previously-described transcripts for these segment(s) do not code for protein.

Segment cluster R82331_node__44 (SEQ ID NO:3609) according to the present invention is supported by 18 libraries. The number of libraries was determined as previously described. This segment can be found in the following transcript(s): R82331_T51 (SEQ ID NO:3574) and R82331_T59 (SEQ ID NO:3578). Table 3423 below describes the starting and ending position of this segment on each transcript.

TABLE 3423

Segment location on transcripts

| Transcript name | Segment starting position | Segment ending position |
|---|---|---|
| R82331_T51 (SEQ ID NO: 3574) | 2438 | 4524 |
| R82331_T59 (SEQ ID NO: 3578) | 2438 | 3093 |

The previously-described transcripts for these segment(s) do not code for protein.

Segment cluster R82331_node__47 (SEQ ID NO:3610) according to the present invention is supported by 21 libraries. The number of libraries was determined as previously described. This segment can be found in the following transcript(s): R82331_T69 (SEQ ID NO:3581) and R82331_T86 (SEQ ID NO:3588). Table 3424 below describes the starting and ending position of this segment on each transcript.

TABLE 3424

Segment location on transcripts

| Transcript name | Segment starting position | Segment ending position |
|---|---|---|
| R82331_T69 (SEQ ID NO: 3581) | 2176 | 2912 |
| R82331_T86 (SEQ ID NO: 3588) | 1906 | 2642 |

The previously-described transcripts for these segment(s) do not code for protein.

Segment cluster R82331_node__49 (SEQ ID NO:3611) according to the present invention is supported by 1 libraries. The number of libraries was determined as previously described. This segment can be found in the following transcript(s): R82331_T79 (SEQ ID NO:3585). Table 3425 below describes the starting and ending position of this segment on each transcript.

TABLE 3425

Segment location on transcripts

| Transcript name | Segment starting position | Segment ending position |
|---|---|---|
| R82331_T79 (SEQ ID NO: 3585) | 2438 | 2574 |

The previously-described transcripts for these segment(s) do not code for protein.

Segment cluster R82331_node__59 (SEQ ID NO:3612) according to the present invention is supported by 20 libraries. The number of libraries was determined as previously described. This segment can be found in the following transcript(s): R82331_T72 (SEQ ID NO:3582), R82331_T76 (SEQ ID NO:3584), R82331_T79 (SEQ ID NO:3585), R82331_T89 (SEQ ID NO:3589), R82331_T90 (SEQ ID NO:3590) and R82331_T92 (SEQ ID NO:3591). Table 3426 below describes the starting and ending position of this segment on each transcript.

TABLE 3426

Segment location on transcripts

| Transcript name | Segment starting position | Segment ending position |
|---|---|---|
| R82331_T72 (SEQ ID NO: 3582) | 2328 | 2450 |
| R82331_T76 (SEQ ID NO: 3584) | 2328 | 2629 |
| R82331_T79 (SEQ ID NO: 3585) | 2727 | 2849 |
| R82331_T89 (SEQ ID NO: 3589) | 2058 | 2180 |
| R82331_T90 (SEQ ID NO: 3590) | 6444 | 6566 |
| R82331_T92 (SEQ ID NO: 3591) | 2320 | 2442 |

This segment can be found in a non-coding region of transcript(s) that are related to the following protein(s): R82331_P2.

Segment cluster R82331_node__61 (SEQ ID NO:3613) according to the present invention is supported by 47 libraries. The number of libraries was determined as previously described. This segment can be found in the following transcript(s): R82331_T21 (SEQ ID NO:3556), R82331_T25 (SEQ ID NO:3560), R82331_T26 (SEQ ID NO:3561), R82331_T27 (SEQ ID NO:3562), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3427 below describes the starting and ending position of this segment on each transcript.

TABLE 3427

Segment location on transcripts

| Transcript name | Segment starting position | Segment ending position |
|---|---|---|
| R82331_T21 (SEQ ID NO: 3556) | 1 | 152 |
| R82331_T25 (SEQ ID NO: 3560) | 1 | 152 |
| R82331_T26 (SEQ ID NO: 3561) | 1 | 152 |
| R82331_T27 (SEQ ID NO: 3562) | 1 | 152 |
| R82331_T29 (SEQ ID NO: 3564) | 1 | 152 |
| R82331_T30 (SEQ ID NO: 3565) | 1 | 152 |
| R82331_T31 (SEQ ID NO: 3566) | 1 | 152 |
| R82331_T32 (SEQ ID NO: 3567) | 1 | 152 |
| R82331_T34 (SEQ ID NO: 3568) | 1 | 152 |

TABLE 3427-continued

Segment location on transcripts

| Transcript name | Segment starting position | Segment ending position |
|---|---|---|
| R82331_T35 (SEQ ID NO: 3569) | 1 | 152 |
| R82331_T36 (SEQ ID NO: 3570) | 1 | 152 |
| R82331_T37 (SEQ ID NO: 3571) | 1 | 152 |
| R82331_T38 (SEQ ID NO: 3572) | 1 | 152 |
| R82331_T39 (SEQ ID NO: 3573) | 1 | 152 |

This segment can be found in the following protein(s): R82331_P4.

Segment cluster R82331_node_63 (SEQ ID NO:3614) according to the present invention is supported by 10 libraries. The number of libraries was determined as previously described. This segment can be found in the following transcript(s): R82331_T20 (SEQ ID NO:3555). Table 3428 below describes the starting and ending position of this segment on each transcript.

TABLE 3428

Segment location on transcripts

| Transcript name | Segment starting position | Segment ending position |
|---|---|---|
| R82331_T20 (SEQ ID NO: 3555) | 1 | 987 |

This segment can be found in a non-coding region of transcript(s) that are related to the following protein(s): R82331_P1.

Segment cluster R82331_node_71 (SEQ ID NO:3615) according to the present invention is supported by 4 libraries. The number of libraries was determined as previously described. This segment can be found in the following transcript(s): R82331_T23 (SEQ ID NO:3558). Table 3429 below describes the starting and ending position of this segment on each transcript.

TABLE 3429

Segment location on transcripts

| Transcript name | Segment starting position | Segment ending position |
|---|---|---|
| R82331_T23 (SEQ ID NO: 3558) | 1 | 215 |

This segment can be found in a non-coding region of transcript(s) that are related to the following protein(s): R82331_P1.

Segment cluster R82331_node_78 (SEQ ID NO:3616) according to the present invention is supported by 5 libraries. The number of libraries was determined as previously described. This segment can be found in the following transcript(s): R82331_T24 (SEQ ID NO:3559). Table 3430 below describes the starting and ending position of this segment on each transcript.

TABLE 3430

Segment location on transcripts

| Transcript name | Segment starting position | Segment ending position |
|---|---|---|
| R82331_T24 (SEQ ID NO: 3559) | 1 | 1184 |

This segment can be found in a non-coding region of transcript(s) that are related to the following protein(s): R82331_P1.

Segment cluster R82331_node_83 (SEQ ID NO:3617) according to the present invention is supported by 3 libraries. The number of libraries was determined as previously described. This segment can be found in the following transcript(s): R82331_T2 (SEQ ID NO:3542), R82331_T21 (SEQ ID NO:3556) and R82331_T24 (SEQ ID NO:3559). Table 3431 below describes the starting and ending position of this segment on each transcript.

TABLE 3431

Segment location on transcripts

| Transcript name | Segment starting position | Segment ending position |
|---|---|---|
| R82331_T2 (SEQ ID NO: 3542) | 2685 | 2896 |
| R82331_T21 (SEQ ID NO: 3556) | 662 | 873 |
| R82331_T24 (SEQ ID NO: 3559) | 1323 | 1534 |

This segment can be found in a non-coding region of transcript(s) that are related to the following protein(s): R82331_P1 and R82331_P4.

Segment cluster R82331_node_85 (SEQ ID NO:3618) according to the present invention is supported by 31 libraries. The number of libraries was determined as previously described. This segment can be found in the following transcript(s): R82331_T1 (SEQ ID NO:3541), R82331_T2 (SEQ ID NO:3542), R82331_T3 (SEQ ID NO:3543), R82331_T16 (SEQ ID NO:3551), R82331_T18 (SEQ ID NO:3553), R82331_T19 (SEQ ID NO:3554), R82331_T21 (SEQ ID NO:3556), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T29 (SEQ ID NO:3564), R82331_T30 (SEQ ID NO:3565), R82331_T34 (SEQ ID NO:3568), R82331_T35 (SEQ ID NO:3569), R82331_T37 (SEQ ID NO:3571), R82331_T38 (SEQ ID NO:3572), R82331_T39 (SEQ ID NO:3573), R82331_T74 (SEQ ID NO:3583) and R82331_T80 (SEQ ID NO:3586). Table 3432 below describes the starting and ending position of this segment on each transcript.

TABLE 3432

Segment location on transcripts

| Transcript name | Segment starting position | Segment ending position |
|---|---|---|
| R82331_T1 (SEQ ID NO: 3541) | 2652 | 2787 |
| R82331_T2 (SEQ ID NO: 3542) | 2903 | 3038 |
| R82331_T3 (SEQ ID NO: 3543) | 2667 | 2802 |
| R82331_T16 (SEQ ID NO: 3551) | 2652 | 2787 |
| R82331_T18 (SEQ ID NO: 3553) | 2652 | 2787 |
| R82331_T19 (SEQ ID NO: 3554) | 2652 | 2787 |
| R82331_T21 (SEQ ID NO: 3556) | 880 | 1015 |
| R82331_T23 (SEQ ID NO: 3558) | 614 | 749 |

TABLE 3432-continued

Segment location on transcripts

| Transcript name | Segment starting position | Segment ending position |
| --- | --- | --- |
| R82331_T24 (SEQ ID NO: 3559) | 1541 | 1676 |
| R82331_T25 (SEQ ID NO: 3560) | 629 | 764 |
| R82331_T26 (SEQ ID NO: 3561) | 551 | 686 |
| R82331_T27 (SEQ ID NO: 3562) | 638 | 773 |
| R82331_T29 (SEQ ID NO: 3564) | 403 | 538 |
| R82331_T30 (SEQ ID NO: 3565) | 527 | 662 |
| R82331_T34 (SEQ ID NO: 3568) | 518 | 653 |
| R82331_T35 (SEQ ID NO: 3569) | 616 | 751 |
| R82331_T37 (SEQ ID NO: 3571) | 291 | 426 |
| R82331_T38 (SEQ ID NO: 3572) | 297 | 432 |
| R82331_T39 (SEQ ID NO: 3573) | 638 | 773 |
| R82331_T74 (SEQ ID NO: 3583) | 2652 | 2787 |
| R82331_T80 (SEQ ID NO: 3586) | 2652 | 2787 |

This segment can be found in a non-coding region of transcript(s) that are related to the following protein(s): R82331_P1, R82331_P4 and R82331_P6.

Segment cluster R82331_node_89 (SEQ ID NO:3619) according to the present invention is supported by 8 libraries. The number of libraries was determined as previously described. This segment can be found in the following transcript(s): R82331_T60 (SEQ ID NO:3579) and R82331_T66 (SEQ ID NO:3580). Table 3433 below describes the starting and ending position of this segment on each transcript.

TABLE 3433

Segment location on transcripts

| Transcript name | Segment starting position | Segment ending position |
| --- | --- | --- |
| R82331_T60 (SEQ ID NO: 3579) | 1 | 2136 |
| R82331_T66 (SEQ ID NO: 3580) | 1 | 2136 |

This segment can be found in the following protein(s): R82331_P5.

Segment cluster R82331_node_90 (SEQ ID NO:3620) according to the present invention is supported by 16 libraries. The number of libraries was determined as previously described. This segment can be found in the following transcript(s): R82331_T60 (SEQ ID NO:3579) and R82331_T66 (SEQ ID NO:3580). Table 3434 below describes the starting and ending position of this segment on each transcript.

TABLE 3434

Segment location on transcripts

| Transcript name | Segment starting position | Segment ending position |
| --- | --- | --- |
| R82331_T60 (SEQ ID NO: 3579) | 2137 | 2387 |
| R82331_T66 (SEQ ID NO: 3580) | 2137 | 2387 |

This segment can be found in a non-coding region of transcript(s) that are related to the following protein(s): R82331_P5.

Segment cluster R82331_node_91 (SEQ ID NO:3621) according to the present invention is supported by 29 libraries. The number of libraries was determined as previously described. This segment can be found in the following transcript(s): R82331_T60 (SEQ ID NO:3579) and R82331_T66 (SEQ ID NO:3580). Table 3435 below describes the starting and ending position of this segment on each transcript.

TABLE 3435

Segment location on transcripts

| Transcript name | Segment starting position | Segment ending position |
| --- | --- | --- |
| R82331_T60 (SEQ ID NO: 3579) | 2388 | 3554 |
| R82331_T66 (SEQ ID NO: 3580) | 2388 | 3647 |

This segment can be found in a non-coding region of transcript(s) that are related to the following protein(s): R82331_P5.

Segment cluster R82331_node_93 (SEQ ID NO:3622) according to the present invention is supported by 6 libraries. The number of libraries was determined as previously described. This segment can be found in the following transcript(s): R82331_T22 (SEQ ID NO:3557). Table 3436 below describes the starting and ending position of this segment on each transcript.

TABLE 3436

Segment location on transcripts

| Transcript name | Segment starting position | Segment ending position |
| --- | --- | --- |
| R82331_T22 (SEQ ID NO: 3557) | 1 | 941 |

The previously-described transcripts for these segment(s) do not code for protein.

Segment cluster R82331_node_95 (SEQ ID NO:3623) according to the present invention is supported by 8 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T56 (SEQ ID NO:3577), R82331_T74 (SEQ ID NO:3583) and R82331_T80 (SEQ ID NO:3586). Table 3437 below describes the starting and ending position of this segment on each transcript.

TABLE 3437

Segment location on transcripts

| Transcript name | Segment starting position | Segment ending position |
| --- | --- | --- |
| R82331_T0 (SEQ ID NO: 3540) | 2638 | 3025 |
| R82331_T1 (SEQ ID NO: 3541) | 2879 | 3266 |
| R82331_T2 (SEQ ID NO: 3542) | 3130 | 3517 |

TABLE 3437-continued

Segment location on transcripts

| Transcript name | Segment starting position | Segment ending position |
|---|---|---|
| R82331_T3 (SEQ ID NO: 3543) | 2894 | 3281 |
| R82331_T5 (SEQ ID NO: 3544) | 2638 | 3025 |
| R82331_T7 (SEQ ID NO: 3545) | 2638 | 3025 |
| R82331_T9 (SEQ ID NO: 3546) | 7024 | 7411 |
| R82331_T10 (SEQ ID NO: 3547) | 7262 | 7649 |
| R82331_T11 (SEQ ID NO: 3548) | 6554 | 6941 |
| R82331_T13 (SEQ ID NO: 3549) | 6975 | 7362 |
| R82331_T15 (SEQ ID NO: 3550) | 2368 | 2755 |
| R82331_T20 (SEQ ID NO: 3555) | 1450 | 1837 |
| R82331_T21 (SEQ ID NO: 3556) | 1107 | 1494 |
| R82331_T22 (SEQ ID NO: 3557) | 1033 | 1420 |
| R82331_T23 (SEQ ID NO: 3558) | 841 | 1228 |
| R82331_T24 (SEQ ID NO: 3559) | 1768 | 2155 |
| R82331_T25 (SEQ ID NO: 3560) | 856 | 1243 |
| R82331_T26 (SEQ ID NO: 3561) | 778 | 1165 |
| R82331_T27 (SEQ ID NO: 3562) | 865 | 1252 |
| R82331_T28 (SEQ ID NO: 3563) | 1085 | 1472 |
| R82331_T29 (SEQ ID NO: 3564) | 630 | 1017 |
| R82331_T30 (SEQ ID NO: 3565) | 754 | 1141 |
| R82331_T31 (SEQ ID NO: 3566) | 577 | 964 |
| R82331_T32 (SEQ ID NO: 3567) | 471 | 858 |
| R82331_T34 (SEQ ID NO: 3568) | 745 | 1132 |
| R82331_T35 (SEQ ID NO: 3569) | 843 | 1230 |
| R82331_T36 (SEQ ID NO: 3570) | 244 | 631 |
| R82331_T37 (SEQ ID NO: 3571) | 518 | 905 |
| R82331_T38 (SEQ ID NO: 3572) | 524 | 911 |
| R82331_T56 (SEQ ID NO: 3577) | 2638 | 3025 |
| R82331_T74 (SEQ ID NO: 3583) | 2879 | 3266 |
| R82331_T80 (SEQ ID NO: 3586) | 2879 | 3266 |

This segment can be found in both coding and non-coding regions of transcript(s) as follows. The segment can be found in a non-coding region of transcript(s) that are related to the following protein(s): R82331_P1, R82331_P2 and R82331_P4. This segment can also be found in the following protein(s): R82331_P6, since it is in the coding region for the corresponding transcript.

Segment cluster R82331_node_96 (SEQ ID NO:3624) according to the present invention is supported by 17 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T56 (SEQ ID NO:3577). Table 3438 below describes the starting and ending position of this segment on each transcript.

TABLE 3438

Segment location on transcripts

| Transcript name | Segment starting position | Segment ending position |
|---|---|---|
| R82331_T0 (SEQ ID NO: 3540) | 3026 | 4978 |
| R82331_T1 (SEQ ID NO: 3541) | 3267 | 5219 |
| R82331_T2 (SEQ ID NO: 3542) | 3518 | 5470 |
| R82331_T3 (SEQ ID NO: 3543) | 3282 | 5234 |
| R82331_T5 (SEQ ID NO: 3544) | 3026 | 4978 |
| R82331_T7 (SEQ ID NO: 3545) | 3026 | 4978 |
| R82331_T9 (SEQ ID NO: 3546) | 7412 | 9364 |
| R82331_T10 (SEQ ID NO: 3547) | 7650 | 9602 |
| R82331_T11 (SEQ ID NO: 3548) | 6942 | 8894 |
| R82331_T13 (SEQ ID NO: 3549) | 7363 | 9315 |
| R82331_T15 (SEQ ID NO: 3550) | 2756 | 4708 |
| R82331_T20 (SEQ ID NO: 3555) | 1838 | 3790 |
| R82331_T21 (SEQ ID NO: 3556) | 1495 | 3447 |
| R82331_T22 (SEQ ID NO: 3557) | 1421 | 3373 |
| R82331_T23 (SEQ ID NO: 3558) | 1229 | 3181 |
| R82331_T24 (SEQ ID NO: 3559) | 2156 | 4108 |
| R82331_T25 (SEQ ID NO: 3560) | 1244 | 3196 |
| R82331_T26 (SEQ ID NO: 3561) | 1166 | 3118 |
| R82331_T27 (SEQ ID NO: 3562) | 1253 | 3205 |
| R82331_T28 (SEQ ID NO: 3563) | 1473 | 3425 |
| R82331_T29 (SEQ ID NO: 3564) | 1018 | 2970 |
| R82331_T30 (SEQ ID NO: 3565) | 1142 | 3094 |
| R82331_T31 (SEQ ID NO: 3566) | 965 | 2917 |
| R82331_T32 (SEQ ID NO: 3567) | 859 | 2811 |
| R82331_T34 (SEQ ID NO: 3568) | 1133 | 3085 |
| R82331_T35 (SEQ ID NO: 3569) | 1231 | 3183 |
| R82331_T36 (SEQ ID NO: 3570) | 632 | 2584 |
| R82331_T37 (SEQ ID NO: 3571) | 906 | 2858 |
| R82331_T38 (SEQ ID NO: 3572) | 912 | 2864 |
| R82331_T56 (SEQ ID NO: 3577) | 3026 | 4978 |

This segment can be found in a non-coding region of transcript(s) that are related to the following protein(s): R82331_P1, R82331_P2 and R82331_P4.

Segment cluster R82331_node_97 (SEQ ID NO:3625) according to the present invention is supported by 11 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T56 (SEQ ID NO:3577). Table 3439 below describes the starting and ending position of this segment on each transcript.

TABLE 3439

Segment location on transcripts

| Transcript name | Segment starting position | Segment ending position |
|---|---|---|
| R82331_T0 (SEQ ID NO: 3540) | 4979 | 5287 |
| R82331_T1 (SEQ ID NO: 3541) | 5220 | 5528 |
| R82331_T2 (SEQ ID NO: 3542) | 5471 | 5779 |
| R82331_T3 (SEQ ID NO: 3543) | 5235 | 5543 |
| R82331_T5 (SEQ ID NO: 3544) | 4979 | 5287 |
| R82331_T7 (SEQ ID NO: 3545) | 4979 | 5287 |
| R82331_T9 (SEQ ID NO: 3546) | 9365 | 9673 |
| R82331_T10 (SEQ ID NO: 3547) | 9603 | 9911 |
| R82331_T11 (SEQ ID NO: 3548) | 8895 | 9203 |
| R82331_T13 (SEQ ID NO: 3549) | 9316 | 9624 |
| R82331_T15 (SEQ ID NO: 3550) | 4709 | 5017 |
| R82331_T16 (SEQ ID NO: 3551) | 2879 | 3187 |
| R82331_T17 (SEQ ID NO: 3552) | 2638 | 2946 |
| R82331_T20 (SEQ ID NO: 3555) | 3791 | 4099 |
| R82331_T21 (SEQ ID NO: 3556) | 3448 | 3756 |
| R82331_T22 (SEQ ID NO: 3557) | 3374 | 3682 |
| R82331_T23 (SEQ ID NO: 3558) | 3182 | 3490 |
| R82331_T24 (SEQ ID NO: 3559) | 4109 | 4417 |
| R82331_T25 (SEQ ID NO: 3560) | 3197 | 3505 |
| R82331_T26 (SEQ ID NO: 3561) | 3119 | 3427 |
| R82331_T27 (SEQ ID NO: 3562) | 3206 | 3514 |
| R82331_T28 (SEQ ID NO: 3563) | 3426 | 3734 |
| R82331_T29 (SEQ ID NO: 3564) | 2971 | 3279 |
| R82331_T30 (SEQ ID NO: 3565) | 3095 | 3403 |
| R82331_T31 (SEQ ID NO: 3566) | 2918 | 3226 |
| R82331_T32 (SEQ ID NO: 3567) | 2812 | 3120 |
| R82331_T34 (SEQ ID NO: 3568) | 3086 | 3394 |
| R82331_T35 (SEQ ID NO: 3569) | 3184 | 3492 |
| R82331_T36 (SEQ ID NO: 3570) | 2585 | 2893 |
| R82331_T37 (SEQ ID NO: 3571) | 2859 | 3167 |
| R82331_T38 (SEQ ID NO: 3572) | 2865 | 3173 |
| R82331_T56 (SEQ ID NO: 3577) | 4979 | 5287 |

This segment can be found in a non-coding region of transcript(s) that are related to the following protein(s): R82331_P1, R82331_P2 and R82331_P4.

Segment cluster R82331_node_98 (SEQ ID NO:3626) according to the present invention is supported by 12 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T56 (SEQ ID NO:3577). Table 3440 below describes the starting and ending position of this segment on each transcript.

TABLE 3440

Segment location on transcripts

| Transcript name | Segment starting position | Segment ending position |
|---|---|---|
| R82331_T0 (SEQ ID NO: 3540) | 5288 | 5463 |
| R82331_T1 (SEQ ID NO: 3541) | 5529 | 5704 |
| R82331_T2 (SEQ ID NO: 3542) | 5780 | 5955 |
| R82331_T3 (SEQ ID NO: 3543) | 5544 | 5719 |
| R82331_T5 (SEQ ID NO: 3544) | 5288 | 5463 |
| R82331_T7 (SEQ ID NO: 3545) | 5288 | 5463 |
| R82331_T9 (SEQ ID NO: 3546) | 9674 | 9849 |
| R82331_T10 (SEQ ID NO: 3547) | 9912 | 10087 |
| R82331_T11 (SEQ ID NO: 3548) | 9204 | 9379 |
| R82331_T13 (SEQ ID NO: 3549) | 9625 | 9800 |
| R82331_T15 (SEQ ID NO: 3550) | 5018 | 5193 |
| R82331_T16 (SEQ ID NO: 3551) | 3188 | 3363 |
| R82331_T17 (SEQ ID NO: 3552) | 2947 | 3122 |
| R82331_T18 (SEQ ID NO: 3553) | 2879 | 3054 |
| R82331_T20 (SEQ ID NO: 3555) | 4100 | 4275 |
| R82331_T21 (SEQ ID NO: 3556) | 3757 | 3932 |
| R82331_T22 (SEQ ID NO: 3557) | 3683 | 3858 |
| R82331_T23 (SEQ ID NO: 3558) | 3491 | 3666 |
| R82331_T24 (SEQ ID NO: 3559) | 4418 | 4593 |
| R82331_T25 (SEQ ID NO: 3560) | 3506 | 3681 |
| R82331_T26 (SEQ ID NO: 3561) | 3428 | 3603 |
| R82331_T27 (SEQ ID NO: 3562) | 3515 | 3690 |
| R82331_T28 (SEQ ID NO: 3563) | 3735 | 3910 |
| R82331_T29 (SEQ ID NO: 3564) | 3280 | 3455 |
| R82331_T30 (SEQ ID NO: 3565) | 3404 | 3579 |
| R82331_T31 (SEQ ID NO: 3566) | 3227 | 3402 |
| R82331_T32 (SEQ ID NO: 3567) | 3121 | 3296 |
| R82331_T34 (SEQ ID NO: 3568) | 3395 | 3570 |
| R82331_T35 (SEQ ID NO: 3569) | 3493 | 3668 |
| R82331_T36 (SEQ ID NO: 3570) | 2894 | 3069 |
| R82331_T37 (SEQ ID NO: 3571) | 3168 | 3343 |
| R82331_T38 (SEQ ID NO: 3572) | 3174 | 3349 |
| R82331_T56 (SEQ ID NO: 3577) | 5288 | 5463 |

This segment can be found in a non-coding region of transcript(s) that are related to the following protein(s): R82331_P1, R82331_P2 and R82331_P4.

Segment cluster R82331_node_99 (SEQ ID NO:3627) according to the present invention is supported by 11 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T56 (SEQ ID NO:3577). Table 3441 below describes the starting and ending position of this segment on each transcript.

TABLE 3441

Segment location on transcripts

| Transcript name | Segment starting position | Segment ending position |
|---|---|---|
| R82331_T0 (SEQ ID NO: 3540) | 5464 | 5644 |
| R82331_T1 (SEQ ID NO: 3541) | 5705 | 5885 |
| R82331_T2 (SEQ ID NO: 3542) | 5956 | 6136 |
| R82331_T3 (SEQ ID NO: 3543) | 5720 | 5900 |
| R82331_T5 (SEQ ID NO: 3544) | 5464 | 5644 |
| R82331_T9 (SEQ ID NO: 3546) | 9850 | 10030 |
| R82331_T10 (SEQ ID NO: 3547) | 10088 | 10268 |
| R82331_T11 (SEQ ID NO: 3548) | 9380 | 9560 |
| R82331_T13 (SEQ ID NO: 3549) | 9801 | 9981 |
| R82331_T15 (SEQ ID NO: 3550) | 5194 | 5374 |
| R82331_T16 (SEQ ID NO: 3551) | 3364 | 3544 |
| R82331_T17 (SEQ ID NO: 3552) | 3123 | 3303 |
| R82331_T18 (SEQ ID NO: 3553) | 3055 | 3235 |
| R82331_T20 (SEQ ID NO: 3555) | 4276 | 4456 |
| R82331_T21 (SEQ ID NO: 3556) | 3933 | 4113 |
| R82331_T22 (SEQ ID NO: 3557) | 3859 | 4039 |
| R82331_T23 (SEQ ID NO: 3558) | 3667 | 3847 |
| R82331_T24 (SEQ ID NO: 3559) | 4594 | 4774 |
| R82331_T25 (SEQ ID NO: 3560) | 3682 | 3862 |
| R82331_T26 (SEQ ID NO: 3561) | 3604 | 3784 |
| R82331_T27 (SEQ ID NO: 3562) | 3691 | 3871 |
| R82331_T28 (SEQ ID NO: 3563) | 3911 | 4091 |
| R82331_T29 (SEQ ID NO: 3564) | 3456 | 3636 |
| R82331_T30 (SEQ ID NO: 3565) | 3580 | 3760 |
| R82331_T31 (SEQ ID NO: 3566) | 3403 | 3583 |
| R82331_T32 (SEQ ID NO: 3567) | 3297 | 3477 |
| R82331_T34 (SEQ ID NO: 3568) | 3571 | 3751 |
| R82331_T35 (SEQ ID NO: 3569) | 3669 | 3849 |
| R82331_T36 (SEQ ID NO: 3570) | 3070 | 3250 |
| R82331_T37 (SEQ ID NO: 3571) | 3344 | 3524 |
| R82331_T38 (SEQ ID NO: 3572) | 3350 | 3530 |
| R82331_T56 (SEQ ID NO: 3577) | 5464 | 5644 |

This segment can be found in a non-coding region of transcript(s) that are related to the following protein(s): R82331_P1, R82331_P2 and R82331_P4.

Segment cluster R82331_node_101 (SEQ ID NO:3628) according to the present invention is supported by 22 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T39 (SEQ ID NO:3573) and R82331_T56 (SEQ ID NO:3577). Table 3442 below describes the starting and ending position of this segment on each transcript.

TABLE 3442

Segment location on transcripts

| Transcript name | Segment starting position | Segment ending position |
|---|---|---|
| R82331_T0 (SEQ ID NO: 3540) | 5764 | 6068 |
| R82331_T1 (SEQ ID NO: 3541) | 6005 | 6309 |
| R82331_T2 (SEQ ID NO: 3542) | 6256 | 6560 |
| R82331_T3 (SEQ ID NO: 3543) | 6020 | 6324 |
| R82331_T5 (SEQ ID NO: 3544) | 5764 | 6068 |
| R82331_T7 (SEQ ID NO: 3545) | 5583 | 5887 |
| R82331_T9 (SEQ ID NO: 3546) | 10150 | 10454 |
| R82331_T10 (SEQ ID NO: 3547) | 10388 | 10692 |
| R82331_T11 (SEQ ID NO: 3548) | 9680 | 9984 |
| R82331_T13 (SEQ ID NO: 3549) | 10101 | 10405 |
| R82331_T15 (SEQ ID NO: 3550) | 5494 | 5798 |
| R82331_T16 (SEQ ID NO: 3551) | 3664 | 3968 |
| R82331_T17 (SEQ ID NO: 3552) | 3423 | 3727 |
| R82331_T18 (SEQ ID NO: 3553) | 3355 | 3659 |
| R82331_T19 (SEQ ID NO: 3554) | 2998 | 3302 |
| R82331_T20 (SEQ ID NO: 3555) | 4576 | 4880 |
| R82331_T21 (SEQ ID NO: 3556) | 4233 | 4537 |
| R82331_T22 (SEQ ID NO: 3557) | 4159 | 4463 |
| R82331_T23 (SEQ ID NO: 3558) | 3967 | 4271 |
| R82331_T24 (SEQ ID NO: 3559) | 4894 | 5198 |
| R82331_T25 (SEQ ID NO: 3560) | 3982 | 4286 |
| R82331_T26 (SEQ ID NO: 3561) | 3904 | 4208 |
| R82331_T27 (SEQ ID NO: 3562) | 3991 | 4295 |
| R82331_T28 (SEQ ID NO: 3563) | 4211 | 4515 |
| R82331_T29 (SEQ ID NO: 3564) | 3756 | 4060 |
| R82331_T30 (SEQ ID NO: 3565) | 3880 | 4184 |
| R82331_T31 (SEQ ID NO: 3566) | 3703 | 4007 |
| R82331_T32 (SEQ ID NO: 3567) | 3597 | 3901 |
| R82331_T34 (SEQ ID NO: 3568) | 3871 | 4175 |
| R82331_T35 (SEQ ID NO: 3569) | 3969 | 4273 |
| R82331_T36 (SEQ ID NO: 3570) | 3370 | 3674 |
| R82331_T37 (SEQ ID NO: 3571) | 3644 | 3948 |
| R82331_T38 (SEQ ID NO: 3572) | 3650 | 3954 |
| R82331_T39 (SEQ ID NO: 3573) | 984 | 1288 |
| R82331_T56 (SEQ ID NO: 3577) | 5764 | 6068 |

This segment can be found in a non-coding region of transcript(s) that are related to the following protein(s): R82331_P1, R82331_P2 and R82331_P4.

Segment cluster R82331_node_102 (SEQ ID NO:3629) according to the present invention is supported by 26 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3443 below describes the starting and ending position of this segment on each transcript.

TABLE 3443

Segment location on transcripts

| Transcript name | Segment starting position | Segment ending position |
|---|---|---|
| R82331_T0 (SEQ ID NO: 3540) | 6069 | 6392 |
| R82331_T1 (SEQ ID NO: 3541) | 6310 | 6633 |
| R82331_T2 (SEQ ID NO: 3542) | 6561 | 6884 |
| R82331_T3 (SEQ ID NO: 3543) | 6325 | 6648 |
| R82331_T5 (SEQ ID NO: 3544) | 6069 | 6392 |
| R82331_T7 (SEQ ID NO: 3545) | 5888 | 6211 |
| R82331_T9 (SEQ ID NO: 3546) | 10455 | 10778 |
| R82331_T10 (SEQ ID NO: 3547) | 10693 | 11016 |
| R82331_T11 (SEQ ID NO: 3548) | 9985 | 10308 |
| R82331_T13 (SEQ ID NO: 3549) | 10406 | 10729 |
| R82331_T15 (SEQ ID NO: 3550) | 5799 | 6122 |
| R82331_T16 (SEQ ID NO: 3551) | 3969 | 4292 |
| R82331_T17 (SEQ ID NO: 3552) | 3728 | 4051 |
| R82331_T18 (SEQ ID NO: 3553) | 3660 | 3983 |
| R82331_T19 (SEQ ID NO: 3554) | 3303 | 3626 |
| R82331_T20 (SEQ ID NO: 3555) | 4881 | 5204 |
| R82331_T21 (SEQ ID NO: 3556) | 4538 | 4861 |
| R82331_T22 (SEQ ID NO: 3557) | 4464 | 4787 |
| R82331_T23 (SEQ ID NO: 3558) | 4272 | 4595 |
| R82331_T24 (SEQ ID NO: 3559) | 5199 | 5522 |
| R82331_T25 (SEQ ID NO: 3560) | 4287 | 4610 |
| R82331_T26 (SEQ ID NO: 3561) | 4209 | 4532 |
| R82331_T27 (SEQ ID NO: 3562) | 4296 | 4619 |
| R82331_T28 (SEQ ID NO: 3563) | 4516 | 4839 |
| R82331_T29 (SEQ ID NO: 3564) | 4061 | 4384 |
| R82331_T30 (SEQ ID NO: 3565) | 4185 | 4508 |
| R82331_T31 (SEQ ID NO: 3566) | 4008 | 4331 |
| R82331_T32 (SEQ ID NO: 3567) | 3902 | 4225 |
| R82331_T34 (SEQ ID NO: 3568) | 4176 | 4499 |
| R82331_T35 (SEQ ID NO: 3569) | 4274 | 4597 |
| R82331_T36 (SEQ ID NO: 3570) | 3675 | 3998 |
| R82331_T37 (SEQ ID NO: 3571) | 3949 | 4272 |
| R82331_T38 (SEQ ID NO: 3572) | 3955 | 4278 |
| R82331_T39 (SEQ ID NO: 3573) | 1289 | 1612 |

This segment can be found in a non-coding region of transcript(s) that are related to the following protein(s): R82331_P1, R82331_P2 and R82331_P4.

Segment cluster R82331_node_103 (SEQ ID NO:3630) according to the present invention is supported by 24 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3444 below describes the starting and ending position of this segment on each transcript.

TABLE 3444

Segment location on transcripts

| Transcript name | Segment starting position | Segment ending position |
|---|---|---|
| R82331_T0 (SEQ ID NO: 3540) | 6393 | 6753 |
| R82331_T1 (SEQ ID NO: 3541) | 6634 | 6994 |
| R82331_T2 (SEQ ID NO: 3542) | 6885 | 7245 |
| R82331_T3 (SEQ ID NO: 3543) | 6649 | 7009 |
| R82331_T5 (SEQ ID NO: 3544) | 6393 | 6753 |
| R82331_T7 (SEQ ID NO: 3545) | 6212 | 6572 |
| R82331_T9 (SEQ ID NO: 3546) | 10779 | 11139 |
| R82331_T10 (SEQ ID NO: 3547) | 11017 | 11377 |
| R82331_T11 (SEQ ID NO: 3548) | 10309 | 10669 |
| R82331_T13 (SEQ ID NO: 3549) | 10730 | 11090 |
| R82331_T15 (SEQ ID NO: 3550) | 6123 | 6483 |
| R82331_T16 (SEQ ID NO: 3551) | 4293 | 4653 |
| R82331_T17 (SEQ ID NO: 3552) | 4052 | 4412 |
| R82331_T18 (SEQ ID NO: 3553) | 3984 | 4344 |
| R82331_T19 (SEQ ID NO: 3554) | 3627 | 3987 |
| R82331_T20 (SEQ ID NO: 3555) | 5205 | 5565 |
| R82331_T21 (SEQ ID NO: 3556) | 4862 | 5222 |
| R82331_T22 (SEQ ID NO: 3557) | 4788 | 5148 |
| R82331_T23 (SEQ ID NO: 3558) | 4596 | 4956 |
| R82331_T24 (SEQ ID NO: 3559) | 5523 | 5883 |
| R82331_T25 (SEQ ID NO: 3560) | 4611 | 4971 |
| R82331_T26 (SEQ ID NO: 3561) | 4533 | 4893 |
| R82331_T27 (SEQ ID NO: 3562) | 4620 | 4980 |
| R82331_T28 (SEQ ID NO: 3563) | 4840 | 5200 |
| R82331_T29 (SEQ ID NO: 3564) | 4385 | 4745 |
| R82331_T30 (SEQ ID NO: 3565) | 4509 | 4869 |
| R82331_T31 (SEQ ID NO: 3566) | 4332 | 4692 |
| R82331_T32 (SEQ ID NO: 3567) | 4226 | 4586 |
| R82331_T34 (SEQ ID NO: 3568) | 4500 | 4860 |
| R82331_T35 (SEQ ID NO: 3569) | 4598 | 4958 |
| R82331_T36 (SEQ ID NO: 3570) | 3999 | 4359 |
| R82331_T37 (SEQ ID NO: 3571) | 4273 | 4633 |
| R82331_T38 (SEQ ID NO: 3572) | 4279 | 4639 |
| R82331_T39 (SEQ ID NO: 3573) | 1613 | 1973 |

This segment can be found in a non-coding region of transcript(s) that are related to the following protein(s): R82331_P1, R82331_P2 and R82331_P4.

Segment cluster R82331_node_104 (SEQ ID NO:3631) according to the present invention is supported by 67 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3445 below describes the starting and ending position of this segment on each transcript.

TABLE 3445

Segment location on transcripts

| Transcript name | Segment starting position | Segment ending position |
|---|---|---|
| R82331_T0 (SEQ ID NO: 3540) | 6754 | 9568 |
| R82331_T1 (SEQ ID NO: 3541) | 6995 | 9809 |
| R82331_T2 (SEQ ID NO: 3542) | 7246 | 10060 |
| R82331_T3 (SEQ ID NO: 3543) | 7010 | 9824 |
| R82331_T5 (SEQ ID NO: 3544) | 6754 | 9568 |
| R82331_T7 (SEQ ID NO: 3545) | 6573 | 9387 |
| R82331_T9 (SEQ ID NO: 3546) | 11140 | 13954 |
| R82331_T10 (SEQ ID NO: 3547) | 11378 | 14192 |
| R82331_T11 (SEQ ID NO: 3548) | 10670 | 13484 |
| R82331_T13 (SEQ ID NO: 3549) | 11091 | 13905 |
| R82331_T15 (SEQ ID NO: 3550) | 6484 | 9298 |
| R82331_T16 (SEQ ID NO: 3551) | 4654 | 7468 |
| R82331_T17 (SEQ ID NO: 3552) | 4413 | 7227 |
| R82331_T18 (SEQ ID NO: 3553) | 4345 | 7159 |
| R82331_T19 (SEQ ID NO: 3554) | 3988 | 6802 |
| R82331_T20 (SEQ ID NO: 3555) | 5566 | 8380 |
| R82331_T21 (SEQ ID NO: 3556) | 5223 | 8037 |
| R82331_T22 (SEQ ID NO: 3557) | 5149 | 7963 |
| R82331_T23 (SEQ ID NO: 3558) | 4957 | 7771 |
| R82331_T24 (SEQ ID NO: 3559) | 5884 | 8698 |
| R82331_T25 (SEQ ID NO: 3560) | 4972 | 7786 |
| R82331_T26 (SEQ ID NO: 3561) | 4894 | 7708 |
| R82331_T27 (SEQ ID NO: 3562) | 4981 | 7795 |
| R82331_T28 (SEQ ID NO: 3563) | 5201 | 8015 |
| R82331_T29 (SEQ ID NO: 3564) | 4746 | 7560 |
| R82331_T30 (SEQ ID NO: 3565) | 4870 | 7684 |
| R82331_T31 (SEQ ID NO: 3566) | 4693 | 7507 |
| R82331_T32 (SEQ ID NO: 3567) | 4587 | 7401 |
| R82331_T34 (SEQ ID NO: 3568) | 4861 | 7675 |
| R82331_T35 (SEQ ID NO: 3569) | 4959 | 7773 |
| R82331_T36 (SEQ ID NO: 3570) | 4360 | 7174 |
| R82331_T37 (SEQ ID NO: 3571) | 4634 | 7448 |
| R82331_T38 (SEQ ID NO: 3572) | 4640 | 7454 |
| R82331_T39 (SEQ ID NO: 3573) | 1974 | 4788 |

This segment can be found in both coding and non-coding regions of transcript(s) as follows. The segment can be found in a non-coding region of transcript(s) that are related to the following protein(s): R82331_P2 and R82331_P4. This segment can also be found in the following protein(s): R82331_P1, since it is in the coding region for the corresponding transcript.

Segment cluster R82331_node_105 (SEQ ID NO:3632) according to the present invention is supported by 18 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3446 below describes the starting and ending position of this segment on each transcript.

TABLE 3446

Segment location on transcripts

| Transcript name | Segment starting position | Segment ending position |
|---|---|---|
| R82331_T0 (SEQ ID NO: 3540) | 9569 | 10118 |
| R82331_T1 (SEQ ID NO: 3541) | 9810 | 10359 |
| R82331_T2 (SEQ ID NO: 3542) | 10061 | 10610 |
| R82331_T3 (SEQ ID NO: 3543) | 9825 | 10374 |
| R82331_T5 (SEQ ID NO: 3544) | 9569 | 10118 |
| R82331_T7 (SEQ ID NO: 3545) | 9388 | 9937 |
| R82331_T9 (SEQ ID NO: 3546) | 13955 | 14504 |
| R82331_T10 (SEQ ID NO: 3547) | 14193 | 14742 |
| R82331_T11 (SEQ ID NO: 3548) | 13485 | 14034 |
| R82331_T13 (SEQ ID NO: 3549) | 13906 | 14455 |
| R82331_T15 (SEQ ID NO: 3550) | 9299 | 9848 |
| R82331_T16 (SEQ ID NO: 3551) | 7469 | 8018 |
| R82331_T17 (SEQ ID NO: 3552) | 7228 | 7777 |
| R82331_T18 (SEQ ID NO: 3553) | 7160 | 7709 |
| R82331_T19 (SEQ ID NO: 3554) | 6803 | 7352 |
| R82331_T20 (SEQ ID NO: 3555) | 8381 | 8930 |
| R82331_T21 (SEQ ID NO: 3556) | 8038 | 8587 |
| R82331_T22 (SEQ ID NO: 3557) | 7964 | 8513 |
| R82331_T23 (SEQ ID NO: 3558) | 7772 | 8321 |
| R82331_T24 (SEQ ID NO: 3559) | 8699 | 9248 |
| R82331_T25 (SEQ ID NO: 3560) | 7787 | 8336 |
| R82331_T26 (SEQ ID NO: 3561) | 7709 | 8258 |
| R82331_T27 (SEQ ID NO: 3562) | 7796 | 8345 |
| R82331_T28 (SEQ ID NO: 3563) | 8016 | 8565 |
| R82331_T29 (SEQ ID NO: 3564) | 7561 | 8110 |
| R82331_T30 (SEQ ID NO: 3565) | 7685 | 8234 |
| R82331_T31 (SEQ ID NO: 3566) | 7508 | 8057 |
| R82331_T32 (SEQ ID NO: 3567) | 7402 | 7951 |
| R82331_T34 (SEQ ID NO: 3568) | 7676 | 8225 |
| R82331_T35 (SEQ ID NO: 3569) | 7774 | 8323 |
| R82331_T36 (SEQ ID NO: 3570) | 7175 | 7724 |
| R82331_T37 (SEQ ID NO: 3571) | 7449 | 7998 |
| R82331_T38 (SEQ ID NO: 3572) | 7455 | 8004 |
| R82331_T39 (SEQ ID NO: 3573) | 4789 | 5338 |

This segment can be found in a non-coding region of transcript(s) that are related to the following protein(s): R82331_P1, R82331_P2 and R82331_P4.

Segment cluster R82331_node_108 (SEQ ID NO:3633) according to the present invention is supported by 56 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3447 below describes the starting and ending position of this segment on each transcript.

TABLE 3447

Segment location on transcripts

| Transcript name | Segment starting position | Segment ending position |
|---|---|---|
| R82331_T0 (SEQ ID NO: 3540) | 10134 | 10778 |
| R82331_T1 (SEQ ID NO: 3541) | 10375 | 11019 |
| R82331_T2 (SEQ ID NO: 3542) | 10626 | 11270 |
| R82331_T3 (SEQ ID NO: 3543) | 10390 | 11034 |
| R82331_T5 (SEQ ID NO: 3544) | 10134 | 10778 |
| R82331_T7 (SEQ ID NO: 3545) | 9953 | 10597 |
| R82331_T9 (SEQ ID NO: 3546) | 14520 | 15164 |
| R82331_T10 (SEQ ID NO: 3547) | 14758 | 15402 |
| R82331_T11 (SEQ ID NO: 3548) | 14050 | 14694 |
| R82331_T13 (SEQ ID NO: 3549) | 14471 | 15115 |
| R82331_T15 (SEQ ID NO: 3550) | 9864 | 10508 |
| R82331_T16 (SEQ ID NO: 3551) | 8034 | 8678 |
| R82331_T17 (SEQ ID NO: 3552) | 7793 | 8437 |
| R82331_T18 (SEQ ID NO: 3553) | 7725 | 8369 |
| R82331_T19 (SEQ ID NO: 3554) | 7368 | 8012 |
| R82331_T20 (SEQ ID NO: 3555) | 8946 | 9590 |
| R82331_T21 (SEQ ID NO: 3556) | 8603 | 9247 |
| R82331_T22 (SEQ ID NO: 3557) | 8529 | 9173 |
| R82331_T23 (SEQ ID NO: 3558) | 8337 | 8981 |
| R82331_T24 (SEQ ID NO: 3559) | 9264 | 9908 |
| R82331_T25 (SEQ ID NO: 3560) | 8352 | 8996 |
| R82331_T26 (SEQ ID NO: 3561) | 8274 | 8918 |
| R82331_T27 (SEQ ID NO: 3562) | 8361 | 9005 |
| R82331_T28 (SEQ ID NO: 3563) | 8581 | 9225 |
| R82331_T29 (SEQ ID NO: 3564) | 8126 | 8770 |
| R82331_T30 (SEQ ID NO: 3565) | 8250 | 8894 |
| R82331_T31 (SEQ ID NO: 3566) | 8073 | 8717 |
| R82331_T32 (SEQ ID NO: 3567) | 7967 | 8611 |
| R82331_T34 (SEQ ID NO: 3568) | 8241 | 8885 |
| R82331_T35 (SEQ ID NO: 3569) | 8339 | 8983 |
| R82331_T36 (SEQ ID NO: 3570) | 7740 | 8384 |
| R82331_T37 (SEQ ID NO: 3571) | 8014 | 8658 |
| R82331_T38 (SEQ ID NO: 3572) | 8020 | 8664 |
| R82331_T39 (SEQ ID NO: 3573) | 5354 | 5998 |

This segment can be found in a non-coding region of transcript(s) that are related to the following protein(s): R82331_P1, R82331_P2 and R82331_P4.

Segment cluster R82331_node_110 (SEQ ID NO:3634) according to the present invention is supported by 41 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T39 (SEQ ID NO:3573), R82331_T56 (SEQ ID NO:3577), R82331_T74 (SEQ ID NO:3583) and R82331_T80 (SEQ ID NO:3586). Table 3448 below describes the starting and ending position of this segment on each transcript.

TABLE 3448

Segment location on transcripts

| Transcript name | Segment starting position | Segment ending position |
|---|---|---|
| R82331_T0 (SEQ ID NO: 3540) | 10798 | 10963 |
| R82331_T1 (SEQ ID NO: 3541) | 11039 | 11204 |
| R82331_T2 (SEQ ID NO: 3542) | 11290 | 11455 |
| R82331_T3 (SEQ ID NO: 3543) | 11054 | 11219 |
| R82331_T5 (SEQ ID NO: 3544) | 10798 | 11205 |
| R82331_T7 (SEQ ID NO: 3545) | 10617 | 10782 |
| R82331_T9 (SEQ ID NO: 3546) | 15184 | 15349 |
| R82331_T10 (SEQ ID NO: 3547) | 15422 | 15587 |
| R82331_T11 (SEQ ID NO: 3548) | 14714 | 14879 |
| R82331_T13 (SEQ ID NO: 3549) | 15135 | 15300 |
| R82331_T15 (SEQ ID NO: 3550) | 10528 | 10693 |
| R82331_T16 (SEQ ID NO: 3551) | 8698 | 8863 |
| R82331_T17 (SEQ ID NO: 3552) | 8457 | 8622 |
| R82331_T18 (SEQ ID NO: 3553) | 8389 | 8554 |
| R82331_T19 (SEQ ID NO: 3554) | 8032 | 8197 |
| R82331_T20 (SEQ ID NO: 3555) | 9610 | 9775 |
| R82331_T21 (SEQ ID NO: 3556) | 9267 | 9432 |
| R82331_T22 (SEQ ID NO: 3557) | 9193 | 9358 |
| R82331_T23 (SEQ ID NO: 3558) | 9001 | 9166 |
| R82331_T24 (SEQ ID NO: 3559) | 9928 | 10093 |
| R82331_T25 (SEQ ID NO: 3560) | 9016 | 9181 |
| R82331_T26 (SEQ ID NO: 3561) | 8938 | 9103 |
| R82331_T27 (SEQ ID NO: 3562) | 9025 | 9190 |
| R82331_T28 (SEQ ID NO: 3563) | 9245 | 9410 |
| R82331_T29 (SEQ ID NO: 3564) | 8790 | 8955 |
| R82331_T30 (SEQ ID NO: 3565) | 8914 | 9079 |
| R82331_T31 (SEQ ID NO: 3566) | 8737 | 8902 |
| R82331_T32 (SEQ ID NO: 3567) | 8631 | 8796 |
| R82331_T34 (SEQ ID NO: 3568) | 8905 | 9070 |
| R82331_T35 (SEQ ID NO: 3569) | 9003 | 9168 |
| R82331_T36 (SEQ ID NO: 3570) | 8404 | 8569 |
| R82331_T37 (SEQ ID NO: 3571) | 8678 | 8843 |
| R82331_T38 (SEQ ID NO: 3572) | 8684 | 8849 |
| R82331_T39 (SEQ ID NO: 3573) | 6018 | 6183 |
| R82331_T56 (SEQ ID NO: 3577) | 6069 | 6234 |
| R82331_T74 (SEQ ID NO: 3583) | 3286 | 3693 |
| R82331_T80 (SEQ ID NO: 3586) | 3286 | 3451 |

This segment can be found in both coding and non-coding regions of transcript(s) as follows. The segment can be found in a non-coding region of transcript(s) that are related to the following protein(s): R82331_P1, R82331_P2 and R82331_P4. This segment can also be found in the following protein(s): R82331_P6, since it is in the coding region for the corresponding transcript.

According to an optional embodiment of the present invention, short segments related to the above cluster are also provided. These segments are up to about 120 bp in length, and so are included in a separate description.

Segment cluster R82331_node_2 (SEQ ID NO:3635) according to the present invention is supported by 1 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3449 below describes the starting and ending position of this segment on each transcript.

TABLE 3449

Segment location on transcripts

| Transcript name | Segment starting position | Segment ending position |
| --- | --- | --- |
| R82331_T9 (SEQ ID NO: 3546) | 474 | 580 |
| R82331_T10 (SEQ ID NO: 3547) | 474 | 580 |
| R82331_T11 (SEQ ID NO: 3548) | 474 | 580 |
| R82331_T13 (SEQ ID NO: 3549) | 474 | 580 |
| R82331_T53 (SEQ ID NO: 3575) | 474 | 580 |
| R82331_T55 (SEQ ID NO: 3576) | 474 | 580 |
| R82331_T90 (SEQ ID NO: 3590) | 474 | 580 |

This segment can be found in a non-coding region of transcript(s) that are related to the following protein(s): R82331_P2 and R82331_P7.

Segment cluster R82331_node_6 (SEQ ID NO:3636) according to the present invention is supported by 3 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3450 below describes the starting and ending position of this segment on each transcript.

TABLE 3450

Segment location on transcripts

| Transcript name | Segment starting position | Segment ending position |
| --- | --- | --- |
| R82331_T9 (SEQ ID NO: 3546) | 719 | 789 |
| R82331_T10 (SEQ ID NO: 3547) | 719 | 789 |
| R82331_T11 (SEQ ID NO: 3548) | 719 | 789 |
| R82331_T13 (SEQ ID NO: 3549) | 719 | 789 |
| R82331_T53 (SEQ ID NO: 3575) | 719 | 789 |
| R82331_T55 (SEQ ID NO: 3576) | 719 | 789 |
| R82331_T90 (SEQ ID NO: 3590) | 719 | 789 |

This segment can be found in a non-coding region of transcript(s) that are related to the following protein(s): R82331_P2 and R82331_P7.

Segment cluster R82331_node_8 (SEQ ID NO:3637) according to the present invention is supported by 3 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3451 below describes the starting and ending position of this segment on each transcript.

TABLE 3451

Segment location on transcripts

| Transcript name | Segment starting position | Segment ending position |
| --- | --- | --- |
| R82331_T9 (SEQ ID NO: 3546) | 790 | 860 |
| R82331_T10 (SEQ ID NO: 3547) | 790 | 860 |
| R82331_T11 (SEQ ID NO: 3548) | 790 | 860 |
| R82331_T13 (SEQ ID NO: 3549) | 790 | 860 |
| R82331_T53 (SEQ ID NO: 3575) | 790 | 860 |
| R82331_T55 (SEQ ID NO: 3576) | 790 | 860 |
| R82331_T90 (SEQ ID NO: 3590) | 790 | 860 |

This segment can be found in a non-coding region of transcript(s) that are related to the following protein(s): R82331_P2 and R82331_P7.

Segment cluster R82331_node_10 (SEQ ID NO:3638) according to the present invention is supported by 4 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3452 below describes the starting and ending position of this segment on each transcript.

TABLE 3452

Segment location on transcripts

| Transcript name | Segment starting position | Segment ending position |
| --- | --- | --- |
| R82331_T9 (SEQ ID NO: 3546) | 861 | 905 |
| R82331_T10 (SEQ ID NO: 3547) | 861 | 905 |
| R82331_T11 (SEQ ID NO: 3548) | 861 | 905 |
| R82331_T13 (SEQ ID NO: 3549) | 861 | 905 |
| R82331_T53 (SEQ ID NO: 3575) | 861 | 905 |
| R82331_T55 (SEQ ID NO: 3576) | 861 | 905 |
| R82331_T90 (SEQ ID NO: 3590) | 861 | 905 |

This segment can be found in a non-coding region of transcript(s) that are related to the following protein(s): R82331_P2 and R82331_P7.

Segment cluster R82331_node_14 (SEQ ID NO:3639) according to the present invention is supported by 5 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T55 (SEQ ID NO:3576) and R82331_T90 (SEQ ID NO:3590). Table 53 below describes the starting and ending position of this segment on each transcript.

TABLE 3453

Segment location on transcripts

| Transcript name | Segment starting position | Segment ending position |
| --- | --- | --- |
| R82331_T9 (SEQ ID NO: 3546) | 1073 | 1121 |
| R82331_T10 (SEQ ID NO: 3547) | 1073 | 1121 |
| R82331_T11 (SEQ ID NO: 3548) | 1073 | 1121 |
| R82331_T55 (SEQ ID NO: 3576) | 1073 | 1121 |
| R82331_T90 (SEQ ID NO: 3590) | 1073 | 1121 |

This segment can be found in a non-coding region of transcript(s) that are related to the following protein(s): R82331_P2.

Segment cluster R82331_node__16 (SEQ ID NO:3640) according to the present invention is supported by 4 libraries. The number of libraries was determined as previously described. This segment can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3454 below describes the starting and ending position of this segment on each transcript.

TABLE 3454

Segment location on transcripts

| Transcript name | Segment starting position | Segment ending position |
|---|---|---|
| R82331_T9 (SEQ ID NO: 3546) | 1122 | 1230 |
| R82331_T10 (SEQ ID NO: 3547) | 1122 | 1230 |
| R82331_T11 (SEQ ID NO: 3548) | 1122 | 1230 |
| R82331_T13 (SEQ ID NO: 3549) | 1073 | 1181 |
| R82331_T53 (SEQ ID NO: 3575) | 1073 | 1181 |
| R82331_T55 (SEQ ID NO: 3576) | 1122 | 1230 |
| R82331_T90 (SEQ ID NO: 3590) | 1122 | 1230 |

This segment can be found in both coding and non-coding regions of transcript(s) as follows. The segment can be found in a non-coding region of transcript(s) that are related to the following protein(s): R82331_P7. This segment can also be found in the following protein(s): R82331_P2, since it is in the coding region for the corresponding transcript.

Segment cluster R82331_node__17 (SEQ ID NO:3641) according to the present invention can be found in the following transcript(s): R82331_T9 (SEQ ID NO:3546), R82331_T10 (SEQ ID NO:3547), R82331_T11 (SEQ ID NO:3548), R82331_T13 (SEQ ID NO:3549), R82331_T53 (SEQ ID NO:3575), R82331_T55 (SEQ ID NO:3576) and R82331_T90 (SEQ ID NO:3590). Table 3455 below describes the starting and ending position of this segment on each transcript.

TABLE 3455

Segment location on transcripts

| Transcript name | Segment starting position | Segment ending position |
|---|---|---|
| R82331_T9 (SEQ ID NO: 3546) | 1231 | 1240 |
| R82331_T10 (SEQ ID NO: 3547) | 1231 | 1240 |
| R82331_T11 (SEQ ID NO: 3548) | 1231 | 1240 |
| R82331_T13 (SEQ ID NO: 3549) | 1182 | 1191 |
| R82331_T53 (SEQ ID NO: 3575) | 1182 | 1191 |
| R82331_T55 (SEQ ID NO: 3576) | 1231 | 1240 |
| R82331_T90 (SEQ ID NO: 3590) | 1231 | 1240 |

This segment can be found in both coding and non-coding regions of transcript(s) as follows. The segment can be found in a non-coding region of transcript(s) that are related to the following protein(s): R82331_P7. This segment can also be found in the following protein(s): R82331_P2, since it is in the coding region for the corresponding transcript.

Segment cluster R82331_node__22 (SEQ ID NO:3642) according to the present invention can be found in the following transcript(s): R82331_T10 (SEQ ID NO:3547), R82331_T53 (SEQ ID NO:3575) and R82331_T55 (SEQ ID NO:3576). Table 3456 below describes the starting and ending position of this segment on each transcript.

TABLE 3456

Segment location on transcripts

| Transcript name | Segment starting position | Segment ending position |
|---|---|---|
| R82331_T10 (SEQ ID NO: 3547) | 4928 | 4940 |
| R82331_T53 (SEQ ID NO: 3575) | 4879 | 4891 |
| R82331_T55 (SEQ ID NO: 3576) | 4928 | 4940 |

This segment can be found in a non-coding region of transcript(s) that are related to the following protein(s): R82331_P2 and R82331_P7.

Segment cluster R82331_node__24 (SEQ ID NO:3643) according to the present invention is supported by 5 libraries. The number of libraries was determined as previously described. This segment can be found in the following transcript(s): R82331_T10 (SEQ ID NO:3547) and R82331_T55 (SEQ ID NO:3576). Table 3457 below describes the starting and ending position of this segment on each transcript.

TABLE 3457

Segment location on transcripts

| Transcript name | Segment starting position | Segment ending position |
|---|---|---|
| R82331_T10 (SEQ ID NO: 3547) | 5075 | 5165 |
| R82331_T55 (SEQ ID NO: 3576) | 5075 | 5165 |

This segment can be found in a non-coding region of transcript(s) that are related to the following protein(s): R82331_P2.

Segment cluster R82331_node__25 (SEQ ID NO:3644) according to the present invention can be found in the following transcript(s): R82331_T9 (SEQ ID NO:3546), R82331_T10 (SEQ ID NO:3547), R82331_T13 (SEQ ID NO:3549), R82331_T55 (SEQ ID NO:3576) and R82331_T90 (SEQ ID NO:3590). Table 58 below describes the starting and ending position of this segment on each transcript.

TABLE 3458

Segment location on transcripts

| Transcript name | Segment starting position | Segment ending position |
|---|---|---|
| R82331_T9 (SEQ ID NO: 3546) | 4928 | 4942 |
| R82331_T10 (SEQ ID NO: 3547) | 5166 | 5180 |
| R82331_T13 (SEQ ID NO: 3549) | 4879 | 4893 |
| R82331_T55 (SEQ ID NO: 3576) | 5166 | 5180 |
| R82331_T90 (SEQ ID NO: 3590) | 4928 | 4942 |

This segment can be found in a non-coding region of transcript(s) that are related to the following protein(s): R82331_P2.

Segment cluster R82331_node__31 (SEQ ID NO:3645) according to the present invention can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586), R82331_T84 (SEQ ID NO:3587), R82331_T86 (SEQ ID NO:3588), R82331_T89 (SEQ ID NO:3589) and R82331_T92 (SEQ ID NO:3591). Table 3459 below describes the starting and ending position of this segment on each transcript.

TABLE 3459

Segment location on transcripts

| Transcript name | Segment starting position | Segment ending position |
|---|---|---|
| R82331_T0 (SEQ ID NO: 3540) | 637 | 642 |
| R82331_T1 (SEQ ID NO: 3541) | 637 | 642 |
| R82331_T2 (SEQ ID NO: 3542) | 637 | 642 |
| R82331_T3 (SEQ ID NO: 3543) | 637 | 642 |
| R82331_T5 (SEQ ID NO: 3544) | 637 | 642 |
| R82331_T7 (SEQ ID NO: 3545) | 637 | 642 |
| R82331_T15 (SEQ ID NO: 3550) | 637 | 642 |
| R82331_T16 (SEQ ID NO: 3551) | 637 | 642 |
| R82331_T17 (SEQ ID NO: 3552) | 637 | 642 |
| R82331_T18 (SEQ ID NO: 3553) | 637 | 642 |
| R82331_T19 (SEQ ID NO: 3554) | 637 | 642 |
| R82331_T51 (SEQ ID NO: 3574) | 637 | 642 |
| R82331_T56 (SEQ ID NO: 3577) | 637 | 642 |
| R82331_T59 (SEQ ID NO: 3578) | 637 | 642 |
| R82331_T69 (SEQ ID NO: 3581) | 637 | 642 |
| R82331_T72 (SEQ ID NO: 3582) | 637 | 642 |
| R82331_T74 (SEQ ID NO: 3583) | 637 | 642 |
| R82331_T76 (SEQ ID NO: 3584) | 637 | 642 |
| R82331_T79 (SEQ ID NO: 3585) | 637 | 642 |
| R82331_T80 (SEQ ID NO: 3586) | 637 | 642 |
| R82331_T84 (SEQ ID NO: 3587) | 637 | 642 |
| R82331_T86 (SEQ ID NO: 3588) | 637 | 642 |
| R82331_T89 (SEQ ID NO: 3589) | 637 | 642 |
| R82331_T92 (SEQ ID NO: 3591) | 637 | 642 |

This segment can be found in a non-coding region of transcript(s) that are related to the following protein(s): R82331_P1 and R82331_P6.

Segment cluster R82331_node_39 (SEQ ID NO:3646) according to the present invention is supported by 26 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T28 (SEQ ID NO:3563), R82331_T51 (SEQ ID NO:3574), R82331_T56 (SEQ ID NO:3577), R82331_T59 (SEQ ID NO:3578), R82331_T69 (SEQ ID NO:3581), R82331_T72 (SEQ ID NO:3582), R82331_T74 (SEQ ID NO:3583), R82331_T76 (SEQ ID NO:3584), R82331_T79 (SEQ ID NO:3585), R82331_T80 (SEQ ID NO:3586), R82331_T84 (SEQ ID NO:3587), R82331_T86 (SEQ ID NO:3588), R82331_T89 (SEQ ID NO:3589), R82331_T90 (SEQ ID NO:3590) and R82331_T92 (SEQ ID NO:3591). Table 3460 below describes the starting and ending position of this segment on each transcript.

TABLE 3460

Segment location on transcripts

| Transcript name | Segment starting position | Segment ending position |
|---|---|---|
| R82331_T0 (SEQ ID NO: 3540) | 2110 | 2175 |
| R82331_T1 (SEQ ID NO: 3541) | 2110 | 2175 |
| R82331_T2 (SEQ ID NO: 3542) | 2110 | 2175 |
| R82331_T3 (SEQ ID NO: 3543) | 2110 | 2175 |
| R82331_T5 (SEQ ID NO: 3544) | 2110 | 2175 |
| R82331_T7 (SEQ ID NO: 3545) | 2110 | 2175 |
| R82331_T9 (SEQ ID NO: 3546) | 6496 | 6561 |
| R82331_T10 (SEQ ID NO: 3547) | 6734 | 6799 |
| R82331_T11 (SEQ ID NO: 3548) | 6026 | 6091 |
| R82331_T13 (SEQ ID NO: 3549) | 6447 | 6512 |
| R82331_T15 (SEQ ID NO: 3550) | 1840 | 1905 |
| R82331_T16 (SEQ ID NO: 3551) | 2110 | 2175 |
| R82331_T17 (SEQ ID NO: 3552) | 2110 | 2175 |
| R82331_T18 (SEQ ID NO: 3553) | 2110 | 2175 |
| R82331_T19 (SEQ ID NO: 3554) | 2110 | 2175 |
| R82331_T28 (SEQ ID NO: 3563) | 557 | 622 |
| R82331_T51 (SEQ ID NO: 3574) | 2110 | 2175 |
| R82331_T56 (SEQ ID NO: 3577) | 2110 | 2175 |
| R82331_T59 (SEQ ID NO: 3578) | 2110 | 2175 |
| R82331_T69 (SEQ ID NO: 3581) | 2110 | 2175 |
| R82331_T72 (SEQ ID NO: 3582) | 2110 | 2175 |
| R82331_T74 (SEQ ID NO: 3583) | 2110 | 2175 |
| R82331_T76 (SEQ ID NO: 3584) | 2110 | 2175 |
| R82331_T79 (SEQ ID NO: 3585) | 2110 | 2175 |
| R82331_T80 (SEQ ID NO: 3586) | 2110 | 2175 |
| R82331_T84 (SEQ ID NO: 3587) | 2110 | 2175 |
| R82331_T86 (SEQ ID NO: 3588) | 1840 | 1905 |
| R82331_T89 (SEQ ID NO: 3589) | 1840 | 1905 |
| R82331_T90 (SEQ ID NO: 3590) | 6226 | 6291 |
| R82331_T92 (SEQ ID NO: 3591) | 1840 | 1905 |

This segment can be found in a non-coding region of transcript(s) that are related to the following protein(s): R82331_P1, R82331_P2 and R82331_P6.

Segment cluster R82331_node_53 (SEQ ID NO:3647) according to the present invention is supported by 28 libraries. The number of libraries was determined as previously described. This segment can be found in the following transcript(s): R82331_T72 (SEQ ID NO:3582), R82331_T76 (SEQ ID NO:3584), R82331_T79 (SEQ ID NO:3585), R82331_T89 (SEQ ID NO:3589), R82331_T90 (SEQ ID NO:3590) and R82331_T92 (SEQ ID NO:3591). Table 3461 below describes the starting and ending position of this segment on each transcript.

TABLE 3461

Segment location on transcripts

| Transcript name | Segment starting position | Segment ending position |
|---|---|---|
| R82331_T72 (SEQ ID NO: 3582) | 2176 | 2270 |
| R82331_T76 (SEQ ID NO: 3584) | 2176 | 2270 |
| R82331_T79 (SEQ ID NO: 3585) | 2575 | 2669 |
| R82331_T89 (SEQ ID NO: 3589) | 1906 | 2000 |
| R82331_T90 (SEQ ID NO: 3590) | 6292 | 6386 |
| R82331_T92 (SEQ ID NO: 3591) | 2168 | 2262 |

This segment can be found in a non-coding region of transcript(s) that are related to the following protein(s): R82331_P2.

Segment cluster R82331_node_54 (SEQ ID NO:3648) according to the present invention is supported by 26 libraries. The number of libraries was determined as previously described. This segment can be found in the following transcript(s): R82331_T72 (SEQ ID NO:3582), R82331_T76

(SEQ ID NO:3584), R82331_T79 (SEQ ID NO:3585), R82331_T89 (SEQ ID NO:3589), R82331_T90 (SEQ ID NO:3590) and R82331_T92 (SEQ ID NO:3591). Table 3462 below describes the starting and ending position of this segment on each transcript.

TABLE 3462

Segment location on transcripts

| Transcript name | Segment starting position | Segment ending position |
|---|---|---|
| R82331_T72 (SEQ ID NO: 3582) | 2271 | 2299 |
| R82331_T76 (SEQ ID NO: 3584) | 2271 | 2299 |
| R82331_T79 (SEQ ID NO: 3585) | 2670 | 2698 |
| R82331_T89 (SEQ ID NO: 3589) | 2001 | 2029 |
| R82331_T90 (SEQ ID NO: 3590) | 6387 | 6415 |
| R82331_T92 (SEQ ID NO: 3591) | 2263 | 2291 |

This segment can be found in a non-coding region of transcript(s) that are related to the following protein(s): R82331_P2.

Segment cluster R82331_node_55 (SEQ ID NO:3649) according to the present invention can be found in the following transcript(s): R82331_T72 (SEQ ID NO:3582), R82331_T76 (SEQ ID NO:3584), R82331_T79 (SEQ ID NO:3585), R82331_T89 (SEQ ID NO:3589), R82331_T90 (SEQ ID NO:3590) and R82331_T92 (SEQ ID NO:3591). Table 3463 below describes the starting and ending position of this segment on each transcript.

TABLE 3463

Segment location on transcripts

| Transcript name | Segment starting position | Segment ending position |
|---|---|---|
| R82331_T72 (SEQ ID NO: 3582) | 2300 | 2308 |
| R82331_T76 (SEQ ID NO: 3584) | 2300 | 2308 |
| R82331_T79 (SEQ ID NO: 3585) | 2699 | 2707 |
| R82331_T89 (SEQ ID NO: 3589) | 2030 | 2038 |
| R82331_T90 (SEQ ID NO: 3590) | 6416 | 6424 |
| R82331_T92 (SEQ ID NO: 3591) | 2292 | 2300 |

This segment can be found in a non-coding region of transcript(s) that are related to the following protein(s): R82331_P2.

Segment cluster R82331_node_57 (SEQ ID NO:3650) according to the present invention can be found in the following transcript(s): R82331_T72 (SEQ ID NO:3582), R82331_T76 (SEQ ID NO:3584), R82331_T79 (SEQ ID NO:3585), R82331_T89 (SEQ ID NO:3589), R82331_T90 (SEQ ID NO:3590) and R82331_T92 (SEQ ID NO:3591). Table 3464 below describes the starting and ending position of this segment on each transcript.

TABLE 3464

Segment location on transcripts

| Transcript name | Segment starting position | Segment ending position |
|---|---|---|
| R82331_T72 (SEQ ID NO: 3582) | 2309 | 2327 |
| R82331_T76 (SEQ ID NO: 3584) | 2309 | 2327 |
| R82331_T79 (SEQ ID NO: 3585) | 2708 | 2726 |
| R82331_T89 (SEQ ID NO: 3589) | 2039 | 2057 |
| R82331_T90 (SEQ ID NO: 3590) | 6425 | 6443 |
| R82331_T92 (SEQ ID NO: 3591) | 2301 | 2319 |

This segment can be found in a non-coding region of transcript(s) that are related to the following protein(s): R82331_P2.

Segment cluster R82331_node_64 (SEQ ID NO:3651) according to the present invention is supported by 30 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T25 (SEQ ID NO:3560), R82331_T27 (SEQ ID NO:3562), R82331_T28 (SEQ ID NO:3563), R82331_T31 (SEQ ID NO:3566), R82331_T35 (SEQ ID NO:3569), R82331_T39 (SEQ ID NO:3573), R82331_T56 (SEQ ID NO:3577), R82331_T74 (SEQ ID NO:3583) and R82331_T80 (SEQ ID NO:3586). Table 3465 below describes the starting and ending position of this segment on each transcript.

TABLE 3465

Segment location on transcripts

| Transcript name | Segment starting position | Segment ending position |
|---|---|---|
| R82331_T0 (SEQ ID NO: 3540) | 2176 | 2240 |
| R82331_T1 (SEQ ID NO: 3541) | 2176 | 2240 |
| R82331_T2 (SEQ ID NO: 3542) | 2176 | 2240 |
| R82331_T3 (SEQ ID NO: 3543) | 2176 | 2240 |
| R82331_T5 (SEQ ID NO: 3544) | 2176 | 2240 |
| R82331_T7 (SEQ ID NO: 3545) | 2176 | 2240 |
| R82331_T9 (SEQ ID NO: 3546) | 6562 | 6626 |
| R82331_T10 (SEQ ID NO: 3547) | 6800 | 6864 |
| R82331_T11 (SEQ ID NO: 3548) | 6092 | 6156 |
| R82331_T13 (SEQ ID NO: 3549) | 6513 | 6577 |
| R82331_T15 (SEQ ID NO: 3550) | 1906 | 1970 |
| R82331_T16 (SEQ ID NO: 3551) | 2176 | 2240 |
| R82331_T17 (SEQ ID NO: 3552) | 2176 | 2240 |
| R82331_T18 (SEQ ID NO: 3553) | 2176 | 2240 |
| R82331_T19 (SEQ ID NO: 3554) | 2176 | 2240 |
| R82331_T20 (SEQ ID NO: 3555) | 988 | 1052 |
| R82331_T21 (SEQ ID NO: 3556) | 153 | 217 |
| R82331_T25 (SEQ ID NO: 3560) | 153 | 217 |
| R82331_T27 (SEQ ID NO: 3562) | 153 | 217 |
| R82331_T28 (SEQ ID NO: 3563) | 623 | 687 |
| R82331_T31 (SEQ ID NO: 3566) | 153 | 217 |
| R82331_T35 (SEQ ID NO: 3569) | 153 | 217 |
| R82331_T39 (SEQ ID NO: 3573) | 153 | 217 |
| R82331_T56 (SEQ ID NO: 3577) | 2176 | 2240 |
| R82331_T74 (SEQ ID NO: 3583) | 2176 | 2240 |
| R82331_T80 (SEQ ID NO: 3586) | 2176 | 2240 |

This segment can be found in a non-coding region of transcript(s) that are related to the following protein(s): R82331_P1, R82331_P2, R82331_P4 and R82331_P6.

Segment cluster R82331_node_65 (SEQ ID NO:3652) according to the present invention is supported by 30 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T25 (SEQ ID NO:3560), R82331_T27 (SEQ ID NO:3562), R82331_T28 (SEQ ID NO:3563), R82331_T31 (SEQ ID NO:3566), R82331_T39 (SEQ ID NO:3573), R82331_T56 (SEQ ID NO:3577), R82331_T74 (SEQ ID NO:3583) and R82331_T80 (SEQ ID NO:3586). Table 3466 below describes the starting and ending position of this segment on each transcript.

TABLE 3466

Segment location on transcripts

| Transcript name | Segment starting position | Segment ending position |
|---|---|---|
| R82331_T0 (SEQ ID NO: 3540) | 2241 | 2286 |
| R82331_T1 (SEQ ID NO: 3541) | 2241 | 2286 |
| R82331_T2 (SEQ ID NO: 3542) | 2241 | 2286 |
| R82331_T3 (SEQ ID NO: 3543) | 2241 | 2286 |
| R82331_T5 (SEQ ID NO: 3544) | 2241 | 2286 |
| R82331_T7 (SEQ ID NO: 3545) | 2241 | 2286 |
| R82331_T9 (SEQ ID NO: 3546) | 6627 | 6672 |
| R82331_T10 (SEQ ID NO: 3547) | 6865 | 6910 |
| R82331_T11 (SEQ ID NO: 3548) | 6157 | 6202 |
| R82331_T13 (SEQ ID NO: 3549) | 6578 | 6623 |
| R82331_T15 (SEQ ID NO: 3550) | 1971 | 2016 |
| R82331_T16 (SEQ ID NO: 3551) | 2241 | 2286 |
| R82331_T17 (SEQ ID NO: 3552) | 2241 | 2286 |
| R82331_T18 (SEQ ID NO: 3553) | 2241 | 2286 |
| R82331_T19 (SEQ ID NO: 3554) | 2241 | 2286 |
| R82331_T20 (SEQ ID NO: 3555) | 1053 | 1098 |
| R82331_T21 (SEQ ID NO: 3556) | 218 | 263 |
| R82331_T25 (SEQ ID NO: 3560) | 218 | 263 |
| R82331_T27 (SEQ ID NO: 3562) | 218 | 263 |
| R82331_T28 (SEQ ID NO: 3563) | 688 | 733 |
| R82331_T31 (SEQ ID NO: 3566) | 218 | 263 |
| R82331_T39 (SEQ ID NO: 3573) | 218 | 263 |
| R82331_T56 (SEQ ID NO: 3577) | 2241 | 2286 |
| R82331_T74 (SEQ ID NO: 3583) | 2241 | 2286 |
| R82331_T80 (SEQ ID NO: 3586) | 2241 | 2286 |

This segment can be found in a non-coding region of transcript(s) that are related to the following protein(s): R82331_P1, R82331_P2, R82331_P4 and R82331_P6.

Segment cluster R82331_node_72 (SEQ ID NO:3653) according to the present invention is supported by 27 libraries. The number of libraries was determined as previously described. This segment can be found in the following transcript(s): R82331_T0 (SEQ ID NO:3540), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T17 (SEQ ID NO:3552), R82331_T20 (SEQ ID NO:3555), R82331_T21 (SEQ ID NO:3556), R82331_T23 (SEQ ID NO:3558), R82331_T26 (SEQ ID NO:3561), R82331_T27 (SEQ ID NO:3562), R82331_T28 (SEQ ID NO:3563), R82331_T30 (SEQ ID NO:3565), R82331_T35 (SEQ ID NO:3569), R82331_T39 (SEQ ID NO:3573) and R82331_T56 (SEQ ID NO:3577). Table 3467 below describes the starting and ending position of this segment on each transcript.

TABLE 3467

Segment location on transcripts

| Transcript name | Segment starting position | Segment ending position |
|---|---|---|
| R82331_T0 (SEQ ID NO: 3540) | 2287 | 2319 |
| R82331_T2 (SEQ ID NO: 3542) | 2287 | 2319 |
| R82331_T3 (SEQ ID NO: 3543) | 2287 | 2319 |
| R82331_T5 (SEQ ID NO: 3544) | 2287 | 2319 |
| R82331_T7 (SEQ ID NO: 3545) | 2287 | 2319 |
| R82331_T9 (SEQ ID NO: 3546) | 6673 | 6705 |
| R82331_T10 (SEQ ID NO: 3547) | 6911 | 6943 |
| R82331_T11 (SEQ ID NO: 3548) | 6203 | 6235 |
| R82331_T13 (SEQ ID NO: 3549) | 6624 | 6656 |
| R82331_T15 (SEQ ID NO: 3550) | 2017 | 2049 |
| R82331_T17 (SEQ ID NO: 3552) | 2287 | 2319 |
| R82331_T20 (SEQ ID NO: 3555) | 1099 | 1131 |
| R82331_T21 (SEQ ID NO: 3556) | 264 | 296 |
| R82331_T23 (SEQ ID NO: 3558) | 216 | 248 |
| R82331_T26 (SEQ ID NO: 3561) | 153 | 185 |
| R82331_T27 (SEQ ID NO: 3562) | 264 | 296 |
| R82331_T28 (SEQ ID NO: 3563) | 734 | 766 |
| R82331_T30 (SEQ ID NO: 3565) | 153 | 185 |
| R82331_T35 (SEQ ID NO: 3569) | 218 | 250 |
| R82331_T39 (SEQ ID NO: 3573) | 264 | 296 |
| R82331_T56 (SEQ ID NO: 3577) | 2287 | 2319 |

This segment can be found in a non-coding region of transcript(s) that are related to the following protein(s): R82331_P1, R82331_P2 and R82331_P4.

Segment cluster R82331_node_73 (SEQ ID NO:3654) according to the present invention can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T23 (SEQ ID NO:3558), R82331_T25 (SEQ ID NO:3560), R82331_T26 (SEQ ID NO:3561), R82331_T27 (SEQ ID NO:3562), R82331_T28 (SEQ ID NO:3563), R82331_T30 (SEQ ID NO:3565), R82331_T32 (SEQ ID NO:3567), R82331_T34 (SEQ ID NO:3568), R82331_T35 (SEQ ID NO:3569), R82331_T39 (SEQ ID NO:3573), R82331_T56 (SEQ ID NO:3577), R82331_T74 (SEQ ID NO:3583) and R82331_T80 (SEQ ID NO:3586). Table 3468 below describes the starting and ending position of this segment on each transcript.

TABLE 3468

Segment location on transcripts

| Transcript name | Segment starting position | Segment ending position |
|---|---|---|
| R82331_T0 (SEQ ID NO: 3540) | 2320 | 2324 |
| R82331_T1 (SEQ ID NO: 3541) | 2287 | 2291 |
| R82331_T2 (SEQ ID NO: 3542) | 2320 | 2324 |
| R82331_T3 (SEQ ID NO: 3543) | 2320 | 2324 |
| R82331_T5 (SEQ ID NO: 3544) | 2320 | 2324 |
| R82331_T7 (SEQ ID NO: 3545) | 2320 | 2324 |
| R82331_T9 (SEQ ID NO: 3546) | 6706 | 6710 |
| R82331_T10 (SEQ ID NO: 3547) | 6944 | 6948 |
| R82331_T11 (SEQ ID NO: 3548) | 6236 | 6240 |
| R82331_T13 (SEQ ID NO: 3549) | 6657 | 6661 |

TABLE 3468-continued

Segment location on transcripts

| Transcript name | Segment starting position | Segment ending position |
|---|---|---|
| R82331_T15 (SEQ ID NO: 3550) | 2050 | 2054 |
| R82331_T16 (SEQ ID NO: 3551) | 2287 | 2291 |
| R82331_T17 (SEQ ID NO: 3552) | 2320 | 2324 |
| R82331_T18 (SEQ ID NO: 3553) | 2287 | 2291 |
| R82331_T19 (SEQ ID NO: 3554) | 2287 | 2291 |
| R82331_T20 (SEQ ID NO: 3555) | 1132 | 1136 |
| R82331_T21 (SEQ ID NO: 3556) | 297 | 301 |
| R82331_T23 (SEQ ID NO: 3558) | 249 | 253 |
| R82331_T25 (SEQ ID NO: 3560) | 264 | 268 |
| R82331_T26 (SEQ ID NO: 3561) | 186 | 190 |
| R82331_T27 (SEQ ID NO: 3562) | 297 | 301 |
| R82331_T28 (SEQ ID NO: 3563) | 767 | 771 |
| R82331_T30 (SEQ ID NO: 3565) | 186 | 190 |
| R82331_T32 (SEQ ID NO: 3567) | 153 | 157 |
| R82331_T34 (SEQ ID NO: 3568) | 153 | 157 |
| R82331_T35 (SEQ ID NO: 3569) | 251 | 255 |
| R82331_T39 (SEQ ID NO: 3573) | 297 | 301 |
| R82331_T56 (SEQ ID NO: 3577) | 2320 | 2324 |
| R82331_T74 (SEQ ID NO: 3583) | 2287 | 2291 |
| R82331_T80 (SEQ ID NO: 3586) | 2287 | 2291 |

This segment can be found in a non-coding region of transcript(s) that are related to the following protein(s): R82331_P1, R82331_P2, R82331_P4 and R82331_P6.

Segment cluster R82331_node_74 (SEQ ID NO:3655) according to the present invention is supported by 37 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T23 (SEQ ID NO:3558), R82331_T25 (SEQ ID NO:3560), R82331_T26 (SEQ ID NO:3561), R82331_T27 (SEQ ID NO:3562), R82331_T28 (SEQ ID NO:3563), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T39 (SEQ ID NO:3573), R82331_T56 (SEQ ID NO:3577), R82331_T74 (SEQ ID NO:3583) and R82331_T80 (SEQ ID NO:3586). Table 3469 below describes the starting and ending position of this segment on each transcript.

TABLE 3469

Segment location on transcripts

| Transcript name | Segment starting position | Segment ending position |
|---|---|---|
| R82331_T0 (SEQ ID NO: 3540) | 2325 | 2434 |
| R82331_T1 (SEQ ID NO: 3541) | 2292 | 2401 |
| R82331_T2 (SEQ ID NO: 3542) | 2325 | 2434 |
| R82331_T3 (SEQ ID NO: 3543) | 2325 | 2434 |
| R82331_T5 (SEQ ID NO: 3544) | 2325 | 2434 |
| R82331_T7 (SEQ ID NO: 3545) | 2325 | 2434 |
| R82331_T9 (SEQ ID NO: 3546) | 6711 | 6820 |
| R82331_T10 (SEQ ID NO: 3547) | 6949 | 7058 |

TABLE 3469-continued

Segment location on transcripts

| Transcript name | Segment starting position | Segment ending position |
|---|---|---|
| R82331_T11 (SEQ ID NO: 3548) | 6241 | 6350 |
| R82331_T13 (SEQ ID NO: 3549) | 6662 | 6771 |
| R82331_T15 (SEQ ID NO: 3550) | 2055 | 2164 |
| R82331_T16 (SEQ ID NO: 3551) | 2292 | 2401 |
| R82331_T17 (SEQ ID NO: 3552) | 2325 | 2434 |
| R82331_T18 (SEQ ID NO: 3553) | 2292 | 2401 |
| R82331_T19 (SEQ ID NO: 3554) | 2292 | 2401 |
| R82331_T20 (SEQ ID NO: 3555) | 1137 | 1246 |
| R82331_T21 (SEQ ID NO: 3556) | 302 | 411 |
| R82331_T23 (SEQ ID NO: 3558) | 254 | 363 |
| R82331_T25 (SEQ ID NO: 3560) | 269 | 378 |
| R82331_T26 (SEQ ID NO: 3561) | 191 | 300 |
| R82331_T27 (SEQ ID NO: 3562) | 302 | 411 |
| R82331_T28 (SEQ ID NO: 3563) | 772 | 881 |
| R82331_T30 (SEQ ID NO: 3565) | 191 | 300 |
| R82331_T31 (SEQ ID NO: 3566) | 264 | 373 |
| R82331_T32 (SEQ ID NO: 3567) | 158 | 267 |
| R82331_T34 (SEQ ID NO: 3568) | 158 | 267 |
| R82331_T35 (SEQ ID NO: 3569) | 256 | 365 |
| R82331_T39 (SEQ ID NO: 3573) | 302 | 411 |
| R82331_T56 (SEQ ID NO: 3577) | 2325 | 2434 |
| R82331_T74 (SEQ ID NO: 3583) | 2292 | 2401 |
| R82331_T80 (SEQ ID NO: 3586) | 2292 | 2401 |

This segment can be found in a non-coding region of transcript(s) that are related to the following protein(s): R82331_P1, R82331_P2, R82331_P4 and R82331_P6.

Segment cluster R82331_node_76 (SEQ ID NO:3656) according to the present invention is supported by 47 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T23 (SEQ ID NO:3558), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T39 (SEQ ID NO:3573), R82331_T56 (SEQ ID NO:3577), R82331_T74 (SEQ ID NO:3583) and R82331_T80 (SEQ ID NO:3586). Table 3470 below describes the starting and ending position of this segment on each transcript.

TABLE 3470

Segment location on transcripts

| Transcript name | Segment starting position | Segment ending position |
|---|---|---|
| R82331_T0 (SEQ ID NO: 3540) | 2435 | 2546 |
| R82331_T1 (SEQ ID NO: 3541) | 2402 | 2513 |
| R82331_T2 (SEQ ID NO: 3542) | 2435 | 2546 |
| R82331_T3 (SEQ ID NO: 3543) | 2435 | 2546 |
| R82331_T5 (SEQ ID NO: 3544) | 2435 | 2546 |

TABLE 3470-continued

Segment location on transcripts

| Transcript name | Segment starting position | Segment ending position |
|---|---|---|
| R82331_T7 (SEQ ID NO: 3545) | 2435 | 2546 |
| R82331_T9 (SEQ ID NO: 3546) | 6821 | 6932 |
| R82331_T10 (SEQ ID NO: 3547) | 7059 | 7170 |
| R82331_T11 (SEQ ID NO: 3548) | 6351 | 6462 |
| R82331_T13 (SEQ ID NO: 3549) | 6772 | 6883 |
| R82331_T15 (SEQ ID NO: 3550) | 2165 | 2276 |
| R82331_T16 (SEQ ID NO: 3551) | 2402 | 2513 |
| R82331_T17 (SEQ ID NO: 3552) | 2435 | 2546 |
| R82331_T18 (SEQ ID NO: 3553) | 2402 | 2513 |
| R82331_T19 (SEQ ID NO: 3554) | 2402 | 2513 |
| R82331_T20 (SEQ ID NO: 3555) | 1247 | 1358 |
| R82331_T21 (SEQ ID NO: 3556) | 412 | 523 |
| R82331_T23 (SEQ ID NO: 3558) | 364 | 475 |
| R82331_T25 (SEQ ID NO: 3560) | 379 | 490 |
| R82331_T26 (SEQ ID NO: 3561) | 301 | 412 |
| R82331_T27 (SEQ ID NO: 3562) | 412 | 523 |
| R82331_T28 (SEQ ID NO: 3563) | 882 | 993 |
| R82331_T29 (SEQ ID NO: 3564) | 153 | 264 |
| R82331_T30 (SEQ ID NO: 3565) | 301 | 412 |
| R82331_T31 (SEQ ID NO: 3566) | 374 | 485 |
| R82331_T32 (SEQ ID NO: 3567) | 268 | 379 |
| R82331_T34 (SEQ ID NO: 3568) | 268 | 379 |
| R82331_T35 (SEQ ID NO: 3569) | 366 | 477 |
| R82331_T39 (SEQ ID NO: 3573) | 412 | 523 |
| R82331_T56 (SEQ ID NO: 3577) | 2435 | 2546 |
| R82331_T74 (SEQ ID NO: 3583) | 2402 | 2513 |
| R82331_T80 (SEQ ID NO: 3586) | 2402 | 2513 |

This segment can be found in a non-coding region of transcript(s) that are related to the following protein(s): R82331_P1, R82331_P2, R82331_P4 and R82331_P6.

Segment cluster R82331_node_80 (SEQ ID NO:3657) according to the present invention can be found in the following transcript(s): R82331_T1 (SEQ ID NO:3541), R82331_T2 (SEQ ID NO:3542), R82331_T16 (SEQ ID NO:3551), R82331_T18 (SEQ ID NO:3553), R82331_T19 (SEQ ID NO:3554), R82331_T21 (SEQ ID NO:3556), R82331_T23 (SEQ ID NO:3558), R82331_T24 (SEQ ID NO:3559), R82331_T25 (SEQ ID NO:3560), R82331_T26 (SEQ ID NO:3561), R82331_T29 (SEQ ID NO:3564), R82331_T34 (SEQ ID NO:3568), R82331_T35 (SEQ ID NO:3569), R82331_T37 (SEQ ID NO:3571), R82331_T38 (SEQ ID NO:3572), R82331_T74 (SEQ ID NO:3583) and R82331_T80 (SEQ ID NO:3586). Table 3471 below describes the starting and ending position of this segment on each transcript.

TABLE 3471

Segment location on transcripts

| Transcript name | Segment starting position | Segment ending position |
|---|---|---|
| R82331_T1 (SEQ ID NO: 3541) | 2514 | 2537 |
| R82331_T2 (SEQ ID NO: 3542) | 2547 | 2570 |
| R82331_T16 (SEQ ID NO: 3551) | 2514 | 2537 |
| R82331_T18 (SEQ ID NO: 3553) | 2514 | 2537 |
| R82331_T19 (SEQ ID NO: 3554) | 2514 | 2537 |
| R82331_T21 (SEQ ID NO: 3556) | 524 | 547 |
| R82331_T23 (SEQ ID NO: 3558) | 476 | 499 |
| R82331_T24 (SEQ ID NO: 3559) | 1185 | 1208 |
| R82331_T25 (SEQ ID NO: 3560) | 491 | 514 |
| R82331_T26 (SEQ ID NO: 3561) | 413 | 436 |
| R82331_T29 (SEQ ID NO: 3564) | 265 | 288 |
| R82331_T34 (SEQ ID NO: 3568) | 380 | 403 |
| R82331_T35 (SEQ ID NO: 3569) | 478 | 501 |
| R82331_T37 (SEQ ID NO: 3571) | 153 | 176 |

TABLE 3471-continued

Segment location on transcripts

| Transcript name | Segment starting position | Segment ending position |
|---|---|---|
| R82331_T38 (SEQ ID NO: 3572) | 153 | 176 |
| R82331_T74 (SEQ ID NO: 3583) | 2514 | 2537 |
| R82331_T80 (SEQ ID NO: 3586) | 2514 | 2537 |

This segment can be found in a non-coding region of transcript(s) that are related to the following protein(s): R82331_P1, R82331_P4 and R82331_P6.

Segment cluster R82331_node_81 (SEQ ID NO:3658) according to the present invention is supported by 47 libraries. The number of libraries was determined as previously described. This segment can be found in the following transcript(s): R82331_T1 (SEQ ID NO:3541), R82331_T2 (SEQ ID NO:3542), R82331_T3 (SEQ ID NO:3543), R82331_T16 (SEQ ID NO:3551), R82331_T18 (SEQ ID NO:3553), R82331_T19 (SEQ ID NO:3554), R82331_T21 (SEQ ID NO:3556), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T29 (SEQ ID NO:3564), R82331_T30 (SEQ ID NO:3565), R82331_T34 (SEQ ID NO:3568), R82331_T35 (SEQ ID NO:3569), R82331_T37 (SEQ ID NO:3571), R82331_T38 (SEQ ID NO:3572), R82331_T39 (SEQ ID NO:3573), R82331_T74 (SEQ ID NO:3583) and R82331_T80 (SEQ ID NO:3586). Table 3472 below describes the starting and ending position of this segment on each transcript.

TABLE 3472

Segment location on transcripts

| Transcript name | Segment starting position | Segment ending position |
|---|---|---|
| R82331_T1 (SEQ ID NO: 3541) | 2538 | 2585 |
| R82331_T2 (SEQ ID NO: 3542) | 2571 | 2618 |
| R82331_T3 (SEQ ID NO: 3543) | 2547 | 2594 |
| R82331_T16 (SEQ ID NO: 3551) | 2538 | 2585 |
| R82331_T18 (SEQ ID NO: 3553) | 2538 | 2585 |
| R82331_T19 (SEQ ID NO: 3554) | 2538 | 2585 |
| R82331_T21 (SEQ ID NO: 3556) | 548 | 595 |
| R82331_T23 (SEQ ID NO: 3558) | 500 | 547 |
| R82331_T24 (SEQ ID NO: 3559) | 1209 | 1256 |
| R82331_T25 (SEQ ID NO: 3560) | 515 | 562 |
| R82331_T26 (SEQ ID NO: 3561) | 437 | 484 |
| R82331_T27 (SEQ ID NO: 3562) | 524 | 571 |
| R82331_T29 (SEQ ID NO: 3564) | 289 | 336 |
| R82331_T30 (SEQ ID NO: 3565) | 413 | 460 |
| R82331_T34 (SEQ ID NO: 3568) | 404 | 451 |
| R82331_T35 (SEQ ID NO: 3569) | 502 | 549 |
| R82331_T37 (SEQ ID NO: 3571) | 177 | 224 |
| R82331_T38 (SEQ ID NO: 3572) | 177 | 224 |
| R82331_T39 (SEQ ID NO: 3573) | 524 | 571 |
| R82331_T74 (SEQ ID NO: 3583) | 2538 | 2585 |
| R82331_T80 (SEQ ID NO: 3586) | 2538 | 2585 |

This segment can be found in a non-coding region of transcript(s) that are related to the following protein(s): R82331_P1, R82331_P4 and R82331_P6.

Segment cluster R82331_node_82 (SEQ ID NO:3659) according to the present invention is supported by 46 libraries. The number of libraries was determined as previously described. This segment can be found in the following transcript(s): R82331_T1 (SEQ ID NO:3541), R82331_T2 (SEQ ID NO:3542), R82331_T3 (SEQ ID NO:3543), R82331_T16

(SEQ ID NO:3551), R82331_T18 (SEQ ID NO:3553), R82331_T19 (SEQ ID NO:3554), R82331_T21 (SEQ ID NO:3556), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T29 (SEQ ID NO:3564), R82331_T30 (SEQ ID NO:3565), R82331_T34 (SEQ ID NO:3568), R82331_T35 (SEQ ID NO:3569), R82331_T37 (SEQ ID NO:3571), R82331_T38 (SEQ ID NO:3572), R82331_T39 (SEQ ID NO:3573), R82331_T74 (SEQ ID NO:3583) and R82331_T80 (SEQ ID NO:3586). Table 3473 below describes the starting and ending position of this segment on each transcript.

TABLE 3473

Segment location on transcripts

| Transcript name | Segment starting position | Segment ending position |
|---|---|---|
| R82331_T1 (SEQ ID NO: 3541) | 2586 | 2651 |
| R82331_T2 (SEQ ID NO: 3542) | 2619 | 2684 |
| R82331_T3 (SEQ ID NO: 3543) | 2595 | 2660 |
| R82331_T16 (SEQ ID NO: 3551) | 2586 | 2651 |
| R82331_T18 (SEQ ID NO: 3553) | 2586 | 2651 |
| R82331_T19 (SEQ ID NO: 3554) | 2586 | 2651 |
| R82331_T21 (SEQ ID NO: 3556) | 596 | 661 |
| R82331_T23 (SEQ ID NO: 3558) | 548 | 613 |
| R82331_T24 (SEQ ID NO: 3559) | 1257 | 1322 |
| R82331_T25 (SEQ ID NO: 3560) | 563 | 628 |
| R82331_T26 (SEQ ID NO: 3561) | 485 | 550 |
| R82331_T27 (SEQ ID NO: 3562) | 572 | 637 |
| R82331_T29 (SEQ ID NO: 3564) | 337 | 402 |
| R82331_T30 (SEQ ID NO: 3565) | 461 | 526 |
| R82331_T34 (SEQ ID NO: 3568) | 452 | 517 |
| R82331_T35 (SEQ ID NO: 3569) | 550 | 615 |
| R82331_T37 (SEQ ID NO: 3571) | 225 | 290 |
| R82331_T38 (SEQ ID NO: 3572) | 225 | 290 |
| R82331_T39 (SEQ ID NO: 3573) | 572 | 637 |
| R82331_T74 (SEQ ID NO: 3583) | 2586 | 2651 |
| R82331_T80 (SEQ ID NO: 3586) | 2586 | 2651 |

This segment can be found in a non-coding region of transcript(s) that are related to the following protein(s): R82331_P1, R82331_P4 and R82331_P6.

Segment cluster R82331_node_84 (SEQ ID NO:3660) according to the present invention can be found in the following transcript(s): R82331_T2 (SEQ ID NO:3542), R82331_T3 (SEQ ID NO:3543), R82331_T21 (SEQ ID NO:3556), R82331_T24 (SEQ ID NO:3559) and R82331_T38 (SEQ ID NO:3572). Table 3474 below describes the starting and ending position of this segment on each transcript.

TABLE 3474

Segment location on transcripts

| Transcript name | Segment starting position | Segment ending position |
|---|---|---|
| R82331_T2 (SEQ ID NO: 3542) | 2897 | 2902 |
| R82331_T3 (SEQ ID NO: 3543) | 2661 | 2666 |
| R82331_T21 (SEQ ID NO: 3556) | 874 | 879 |
| R82331_T24 (SEQ ID NO: 3559) | 1535 | 1540 |
| R82331_T38 (SEQ ID NO: 3572) | 291 | 296 |

This segment can be found in a non-coding region of transcript(s) that are related to the following protein(s): R82331_P1 and R82331_P4.

Segment cluster R82331_node_94 (SEQ ID NO:3661) according to the present invention is supported by 32 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T39 (SEQ ID NO:3573), R82331_T56 (SEQ ID NO:3577), R82331_T74 (SEQ ID NO:3583) and R82331_T80 (SEQ ID NO:3586). Table 3475 below describes the starting and ending position of this segment on each transcript.

TABLE 3475

Segment location on transcripts

| Transcript name | Segment starting position | Segment ending position |
|---|---|---|
| R82331_T0 (SEQ ID NO: 3540) | 2547 | 2637 |
| R82331_T1 (SEQ ID NO: 3541) | 2788 | 2878 |
| R82331_T2 (SEQ ID NO: 3542) | 3039 | 3129 |
| R82331_T3 (SEQ ID NO: 3543) | 2803 | 2893 |
| R82331_T5 (SEQ ID NO: 3544) | 2547 | 2637 |
| R82331_T7 (SEQ ID NO: 3545) | 2547 | 2637 |
| R82331_T9 (SEQ ID NO: 3546) | 6933 | 7023 |
| R82331_T10 (SEQ ID NO: 3547) | 7171 | 7261 |
| R82331_T11 (SEQ ID NO: 3548) | 6463 | 6553 |
| R82331_T13 (SEQ ID NO: 3549) | 6884 | 6974 |
| R82331_T15 (SEQ ID NO: 3550) | 2277 | 2367 |
| R82331_T16 (SEQ ID NO: 3551) | 2788 | 2878 |
| R82331_T17 (SEQ ID NO: 3552) | 2547 | 2637 |
| R82331_T18 (SEQ ID NO: 3553) | 2788 | 2878 |
| R82331_T19 (SEQ ID NO: 3554) | 2788 | 2878 |
| R82331_T20 (SEQ ID NO: 3555) | 1359 | 1449 |
| R82331_T21 (SEQ ID NO: 3556) | 1016 | 1106 |
| R82331_T22 (SEQ ID NO: 3557) | 942 | 1032 |
| R82331_T23 (SEQ ID NO: 3558) | 750 | 840 |
| R82331_T24 (SEQ ID NO: 3559) | 1677 | 1767 |
| R82331_T25 (SEQ ID NO: 3560) | 765 | 855 |
| R82331_T26 (SEQ ID NO: 3561) | 687 | 777 |
| R82331_T27 (SEQ ID NO: 3562) | 774 | 864 |
| R82331_T28 (SEQ ID NO: 3563) | 994 | 1084 |
| R82331_T29 (SEQ ID NO: 3564) | 539 | 629 |
| R82331_T30 (SEQ ID NO: 3565) | 663 | 753 |
| R82331_T31 (SEQ ID NO: 3566) | 486 | 576 |
| R82331_T32 (SEQ ID NO: 3567) | 380 | 470 |
| R82331_T34 (SEQ ID NO: 3568) | 654 | 744 |
| R82331_T35 (SEQ ID NO: 3569) | 752 | 842 |
| R82331_T36 (SEQ ID NO: 3570) | 153 | 243 |
| R82331_T37 (SEQ ID NO: 3571) | 427 | 517 |
| R82331_T38 (SEQ ID NO: 3572) | 433 | 523 |
| R82331_T39 (SEQ ID NO: 3573) | 774 | 864 |
| R82331_T56 (SEQ ID NO: 3577) | 2547 | 2637 |
| R82331_T74 (SEQ ID NO: 3583) | 2788 | 2878 |
| R82331_T80 (SEQ ID NO: 3586) | 2788 | 2878 |

This segment can be found in a non-coding region of transcript(s) that are related to the following protein(s): R82331_P1, R82331_P2, R82331_P4 and R82331_P6.

Segment cluster R82331_node__100 (SEQ ID NO:3662) according to the present invention is supported by 14 libraries. The number of libraries was determined as previously described. This segment can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T39 (SEQ ID NO:3573) and R82331_T56 (SEQ ID NO:3577). Table 3476 below describes the starting and ending position of this segment on each transcript.

TABLE 3476

Segment location on transcripts

| Transcript name | Segment starting position | Segment ending position |
|---|---|---|
| R82331_T0 (SEQ ID NO: 3540) | 5645 | 5763 |
| R82331_T1 (SEQ ID NO: 3541) | 5886 | 6004 |
| R82331_T2 (SEQ ID NO: 3542) | 6137 | 6255 |
| R82331_T3 (SEQ ID NO: 3543) | 5901 | 6019 |
| R82331_T5 (SEQ ID NO: 3544) | 5645 | 5763 |
| R82331_T7 (SEQ ID NO: 3545) | 5464 | 5582 |
| R82331_T9 (SEQ ID NO: 3546) | 10031 | 10149 |
| R82331_T10 (SEQ ID NO: 3547) | 10269 | 10387 |
| R82331_T11 (SEQ ID NO: 3548) | 9561 | 9679 |
| R82331_T13 (SEQ ID NO: 3549) | 9982 | 10100 |
| R82331_T15 (SEQ ID NO: 3550) | 5375 | 5493 |
| R82331_T16 (SEQ ID NO: 3551) | 3545 | 3663 |
| R82331_T17 (SEQ ID NO: 3552) | 3304 | 3422 |
| R82331_T18 (SEQ ID NO: 3553) | 3236 | 3354 |
| R82331_T19 (SEQ ID NO: 3554) | 2879 | 2997 |
| R82331_T20 (SEQ ID NO: 3555) | 4457 | 4575 |
| R82331_T21 (SEQ ID NO: 3556) | 4114 | 4232 |
| R82331_T22 (SEQ ID NO: 3557) | 4040 | 4158 |
| R82331_T23 (SEQ ID NO: 3558) | 3848 | 3966 |
| R82331_T24 (SEQ ID NO: 3559) | 4775 | 4893 |
| R82331_T25 (SEQ ID NO: 3560) | 3863 | 3981 |
| R82331_T26 (SEQ ID NO: 3561) | 3785 | 3903 |
| R82331_T27 (SEQ ID NO: 3562) | 3872 | 3990 |
| R82331_T28 (SEQ ID NO: 3563) | 4092 | 4210 |
| R82331_T29 (SEQ ID NO: 3564) | 3637 | 3755 |
| R82331_T30 (SEQ ID NO: 3565) | 3761 | 3879 |
| R82331_T31 (SEQ ID NO: 3566) | 3584 | 3702 |
| R82331_T32 (SEQ ID NO: 3567) | 3478 | 3596 |
| R82331_T34 (SEQ ID NO: 3568) | 3752 | 3870 |
| R82331_T35 (SEQ ID NO: 3569) | 3850 | 3968 |
| R82331_T36 (SEQ ID NO: 3570) | 3251 | 3369 |
| R82331_T37 (SEQ ID NO: 3571) | 3525 | 3643 |
| R82331_T38 (SEQ ID NO: 3572) | 3531 | 3649 |
| R82331_T39 (SEQ ID NO: 3573) | 865 | 983 |
| R82331_T56 (SEQ ID NO: 3577) | 5645 | 5763 |

This segment can be found in a non-coding region of transcript(s) that are related to the following protein(s): R82331_P1, R82331_P2 and R82331_P4.

Segment cluster R82331_node__106 (SEQ ID NO:3663) according to the present invention can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572) and R82331_T39 (SEQ ID NO:3573). Table 3477 below describes the starting and ending position of this segment on each transcript.

TABLE 3477

Segment location on transcripts

| Transcript name | Segment starting position | Segment ending position |
|---|---|---|
| R82331_T0 (SEQ ID NO: 3540) | 10119 | 10128 |
| R82331_T1 (SEQ ID NO: 3541) | 10360 | 10369 |
| R82331_T2 (SEQ ID NO: 3542) | 10611 | 10620 |
| R82331_T3 (SEQ ID NO: 3543) | 10375 | 10384 |
| R82331_T5 (SEQ ID NO: 3544) | 10119 | 10128 |
| R82331_T7 (SEQ ID NO: 3545) | 9938 | 9947 |
| R82331_T9 (SEQ ID NO: 3546) | 14505 | 14514 |
| R82331_T10 (SEQ ID NO: 3547) | 14743 | 14752 |
| R82331_T11 (SEQ ID NO: 3548) | 14035 | 14044 |
| R82331_T13 (SEQ ID NO: 3549) | 14456 | 14465 |
| R82331_T15 (SEQ ID NO: 3550) | 9849 | 9858 |
| R82331_T16 (SEQ ID NO: 3551) | 8019 | 8028 |
| R82331_T17 (SEQ ID NO: 3552) | 7778 | 7787 |
| R82331_T18 (SEQ ID NO: 3553) | 7710 | 7719 |
| R82331_T19 (SEQ ID NO: 3554) | 7353 | 7362 |
| R82331_T20 (SEQ ID NO: 3555) | 8931 | 8940 |
| R82331_T21 (SEQ ID NO: 3556) | 8588 | 8597 |
| R82331_T22 (SEQ ID NO: 3557) | 8514 | 8523 |
| R82331_T23 (SEQ ID NO: 3558) | 8322 | 8331 |
| R82331_T24 (SEQ ID NO: 3559) | 9249 | 9258 |
| R82331_T25 (SEQ ID NO: 3560) | 8337 | 8346 |
| R82331_T26 (SEQ ID NO: 3561) | 8259 | 8268 |
| R82331_T27 (SEQ ID NO: 3562) | 8346 | 8355 |
| R82331_T28 (SEQ ID NO: 3563) | 8566 | 8575 |
| R82331_T29 (SEQ ID NO: 3564) | 8111 | 8120 |
| R82331_T30 (SEQ ID NO: 3565) | 8235 | 8244 |
| R82331_T31 (SEQ ID NO: 3566) | 8058 | 8067 |
| R82331_T32 (SEQ ID NO: 3567) | 7952 | 7961 |
| R82331_T34 (SEQ ID NO: 3568) | 8226 | 8235 |
| R82331_T35 (SEQ ID NO: 3569) | 8324 | 8333 |
| R82331_T36 (SEQ ID NO: 3570) | 7725 | 7734 |
| R82331_T37 (SEQ ID NO: 3571) | 7999 | 8008 |
| R82331_T38 (SEQ ID NO: 3572) | 8005 | 8014 |
| R82331_T39 (SEQ ID NO: 3573) | 5339 | 5348 |

This segment can be found in a non-coding region of transcript(s) that are related to the following protein(s): R82331_P1, R82331_P2 and R82331_P4.

Segment cluster R82331_node__107 (SEQ ID NO:3664) according to the present invention can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570) R82331_T37 (SEQ ID NO:3571), R82331_T38 (SEQ ID NO:3572) and R82331_T39 (SEQ ID NO:3573). Table 3478 below describes the starting and ending position of this segment on each transcript.

TABLE 3478

Segment location on transcripts

| Transcript name | Segment starting position | Segment ending position |
|---|---|---|
| R82331_T0 (SEQ ID NO: 3540) | 10129 | 10133 |
| R82331_T1 (SEQ ID NO: 3541) | 10370 | 10374 |
| R82331_T2 (SEQ ID NO: 3542) | 10621 | 10625 |
| R82331_T3 (SEQ ID NO: 3543) | 10385 | 10389 |
| R82331_T5 (SEQ ID NO: 3544) | 10129 | 10133 |
| R82331_T7 (SEQ ID NO: 3545) | 9948 | 9952 |
| R82331_T9 (SEQ ID NO: 3546) | 14515 | 14519 |
| R82331_T10 (SEQ ID NO: 3547) | 14753 | 14757 |
| R82331_T11 (SEQ ID NO: 3548) | 14045 | 14049 |
| R82331_T13 (SEQ ID NO: 3549) | 14466 | 14470 |
| R82331_T15 (SEQ ID NO: 3550) | 9859 | 9863 |
| R82331_T16 (SEQ ID NO: 3551) | 8029 | 8033 |
| R82331_T17 (SEQ ID NO: 3552) | 7788 | 7792 |
| R82331_T18 (SEQ ID NO: 3553) | 7720 | 7724 |
| R82331_T19 (SEQ ID NO: 3554) | 7363 | 7367 |
| R82331_T20 (SEQ ID NO: 3555) | 8941 | 8945 |
| R82331_T21 (SEQ ID NO: 3556) | 8598 | 8602 |
| R82331_T22 (SEQ ID NO: 3557) | 8524 | 8528 |
| R82331_T23 (SEQ ID NO: 3558) | 8332 | 8336 |
| R82331_T24 (SEQ ID NO: 3559) | 9259 | 9263 |
| R82331_T25 (SEQ ID NO: 3560) | 8347 | 8351 |
| R82331_T26 (SEQ ID NO: 3561) | 8269 | 8273 |
| R82331_T27 (SEQ ID NO: 3562) | 8356 | 8360 |
| R82331_T28 (SEQ ID NO: 3563) | 8576 | 8580 |
| R82331_T29 (SEQ ID NO: 3564) | 8121 | 8125 |
| R82331_T30 (SEQ ID NO: 3565) | 8245 | 8249 |
| R82331_T31 (SEQ ID NO: 3566) | 8068 | 8072 |
| R82331_T32 (SEQ ID NO: 3567) | 7962 | 7966 |
| R82331_T34 (SEQ ID NO: 3568) | 8236 | 8240 |
| R82331_T35 (SEQ ID NO: 3569) | 8334 | 8338 |
| R82331_T36 (SEQ ID NO: 3570) | 7735 | 7739 |
| R82331_T37 (SEQ ID NO: 3571) | 8009 | 8013 |
| R82331_T38 (SEQ ID NO: 3572) | 8015 | 8019 |
| R82331_T39 (SEQ ID NO: 3573) | 5349 | 5353 |

This segment can be found in a non-coding region of transcript(s) that are related to the following protein(s): R82331_P1, R82331_P2 and R82331_P4.

Segment cluster R82331_node_109 (SEQ ID NO:3665) according to the present invention can be found in the following transcript(s): R82331_T0 (SEQ ID NO:3540), R82331_T1 (SEQ ID NO:3541), R82331_T2 (SEQ ID NO:3542), R82331_T3 (SEQ ID NO:3543), R82331_T5 (SEQ ID NO:3544), R82331_T7 (SEQ ID NO:3545), R82331_T9 (SEQ ID NO:3546), R82331_T10 (SEQ ID NO:3547), R82331_T11 (SEQ ID NO:3548), R82331_T13 (SEQ ID NO:3549), R82331_T15 (SEQ ID NO:3550), R82331_T16 (SEQ ID NO:3551), R82331_T17 (SEQ ID NO:3552), R82331_T18 (SEQ ID NO:3553), R82331_T19 (SEQ ID NO:3554), R82331_T20 (SEQ ID NO:3555), R82331_T21 (SEQ ID NO:3556), R82331_T22 (SEQ ID NO:3557), R82331_T23 (SEQ ID NO:3558), R82331_T24 (SEQ ID NO:3559), R82331_T25 (SEQ ID NO:3560), R82331_T26 (SEQ ID NO:3561), R82331_T27 (SEQ ID NO:3562), R82331_T28 (SEQ ID NO:3563), R82331_T29 (SEQ ID NO:3564), R82331_T30 (SEQ ID NO:3565), R82331_T31 (SEQ ID NO:3566), R82331_T32 (SEQ ID NO:3567), R82331_T34 (SEQ ID NO:3568), R82331_T35 (SEQ ID NO:3569), R82331_T36 (SEQ ID NO:3570), R82331_T37 (SEQ ID NO:3571), R82331_T38 (SEQ ID NO:3572), R82331_T39 (SEQ ID NO:3573), R82331_T74 (SEQ ID NO:3583) and R82331_T80 (SEQ ID NO:3586). Table 3479 below describes the starting and ending position of this segment on each transcript.

TABLE 3479

Segment location on transcripts

| Transcript name | Segment starting position | Segment ending position |
|---|---|---|
| R82331_T0 (SEQ ID NO: 3540) | 10779 | 10797 |
| R82331_T1 (SEQ ID NO: 3541) | 11020 | 11038 |
| R82331_T2 (SEQ ID NO: 3542) | 11271 | 11289 |
| R82331_T3 (SEQ ID NO: 3543) | 11035 | 11053 |
| R82331_T5 (SEQ ID NO: 3544) | 10779 | 10797 |
| R82331_T7 (SEQ ID NO: 3545) | 10598 | 10616 |
| R82331_T9 (SEQ ID NO: 3546) | 15165 | 15183 |
| R82331_T10 (SEQ ID NO: 3547) | 15403 | 15421 |
| R82331_T11 (SEQ ID NO: 3548) | 14695 | 14713 |
| R82331_T13 (SEQ ID NO: 3549) | 15116 | 15134 |
| R82331_T15 (SEQ ID NO: 3550) | 10509 | 10527 |
| R82331_T16 (SEQ ID NO: 3551) | 8679 | 8697 |
| R82331_T17 (SEQ ID NO: 3552) | 8438 | 8456 |
| R82331_T18 (SEQ ID NO: 3553) | 8370 | 8388 |
| R82331_T19 (SEQ ID NO: 3554) | 8013 | 8031 |
| R82331_T20 (SEQ ID NO: 3555) | 9591 | 9609 |
| R82331_T21 (SEQ ID NO: 3556) | 9248 | 9266 |
| R82331_T22 (SEQ ID NO: 3557) | 9174 | 9192 |
| R82331_T23 (SEQ ID NO: 3558) | 8982 | 9000 |
| R82331_T24 (SEQ ID NO: 3559) | 9909 | 9927 |
| R82331_T25 (SEQ ID NO: 3560) | 8997 | 9015 |
| R82331_T26 (SEQ ID NO: 3561) | 8919 | 8937 |
| R82331_T27 (SEQ ID NO: 3562) | 9006 | 9024 |
| R82331_T28 (SEQ ID NO: 3563) | 9226 | 9244 |
| R82331_T29 (SEQ ID NO: 3564) | 8771 | 8789 |
| R82331_T30 (SEQ ID NO: 3565) | 8895 | 8913 |
| R82331_T31 (SEQ ID NO: 3566) | 8718 | 8736 |
| R82331_T32 (SEQ ID NO: 3567) | 8612 | 8630 |
| R82331_T34 (SEQ ID NO: 3568) | 8886 | 8904 |
| R82331_T35 (SEQ ID NO: 3569) | 8984 | 9002 |
| R82331_T36 (SEQ ID NO: 3570) | 8385 | 8403 |
| R82331_T37 (SEQ ID NO: 3571) | 8659 | 8677 |
| R82331_T38 (SEQ ID NO: 3572) | 8665 | 8683 |
| R82331_T39 (SEQ ID NO: 3573) | 5999 | 6017 |
| R82331_T74 (SEQ ID NO: 3583) | 3267 | 3285 |
| R82331_T80 (SEQ ID NO: 3586) | 3267 | 3285 |

This segment can be found in both coding and non-coding regions of transcript(s) as follows. The segment can be found in a non-coding region of transcript(s) that are related to the following protein(s): R82331_P1, R82331_P2 and R82331_P4. This segment can also be found in the following protein(s): R82331_P6, since it is in the coding region for the corresponding transcript.

Description for Cluster T06117

Cluster T06117 features 6 transcript(s) and 39 segment(s) of interest, the names for which are given in Tables 3480 and 3481, respectively, the sequences themselves are given at the end of the application. The selected protein variants are given in Table 3482.

TABLE 3480

Transcripts of interest
Transcript Name

T06117_T7 (SEQ ID NO: 3666)
T06117_T16 (SEQ ID NO: 3667)
T06117_T30 (SEQ ID NO: 3668)
T06117_T31 (SEQ ID NO: 3669)
T06117_T42 (SEQ ID NO: 3670)
T06117_T45 (SEQ ID NO: 3671)

TABLE 3481

Segments of interest
Segment Name

T06117_node_0 (SEQ ID NO: 3672)
T06117_node_14 (SEQ ID NO: 3673)
T06117_node_18 (SEQ ID NO: 3674)
T06117_node_22 (SEQ ID NO: 3675)
T06117_node_25 (SEQ ID NO: 3676)
T06117_node_27 (SEQ ID NO: 3677)
T06117_node_28 (SEQ ID NO: 3678)
T06117_node_30 (SEQ ID NO: 3679)
T06117_node_31 (SEQ ID NO: 3680)
T06117_node_36 (SEQ ID NO: 3681)
T06117_node_53 (SEQ ID NO: 3682)
T06117_node_60 (SEQ ID NO: 3683)
T06117_node_69 (SEQ ID NO: 3684)
T06117_node_71 (SEQ ID NO: 3685)
T06117_node_74 (SEQ ID NO: 3686)
T06117_node_2 (SEQ ID NO: 3687)
T06117_node_8 (SEQ ID NO: 3688)
T06117_node_11 (SEQ ID NO: 3689)
T06117_node_16 (SEQ ID NO: 3690)
T06117_node_17 (SEQ ID NO: 3691)
T06117_node_19 (SEQ ID NO: 3692)
T06117_node_20 (SEQ ID NO: 3693)
T06117_node_32 (SEQ ID NO: 3694)
T06117_node_33 (SEQ ID NO: 3695)
T06117_node_39 (SEQ ID NO: 3696)
T06117_node_40 (SEQ ID NO: 3697)
T06117_node_41 (SEQ ID NO: 3698)
T06117_node_42 (SEQ ID NO: 3699)
T06117_node_43 (SEQ ID NO: 3700)
T06117_node_44 (SEQ ID NO: 3701)
T06117_node_45 (SEQ ID NO: 3702)
T06117_node_47 (SEQ ID NO: 3703)
T06117_node_49 (SEQ ID NO: 3704)
T06117_node_55 (SEQ ID NO: 3705)
T06117_node_57 (SEQ ID NO: 3706)
T06117_node_62 (SEQ ID NO: 3707)
T06117_node_65 (SEQ ID NO: 3708)
T06117_node_68 (SEQ ID NO: 3709)
T06117_node_72 (SEQ ID NO: 3710)

TABLE 3482

Proteins of interest

| Protein Name | Corresponding Transcript(s) |
|---|---|
| T06117_P8 | T06117_T7 (SEQ ID NO: 3666) |
| T06117_P16 | T06117_T16 (SEQ ID NO: 3667) |
| T06117_P27 | T06117_T30 (SEQ ID NO: 3668) |
| T06117_P28 | T06117_T31 (SEQ ID NO: 3669) |
| T06117_P39 | T06117_T42 (SEQ ID NO: 3670) |
| T06117_P42 | T06117_T45 (SEQ ID NO: 3671) |

Cluster T06117 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 86 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 86 and Table 3483. This cluster is overexpressed (at least at a minimum level) in the following pathological conditions: a mixture of malignant tumors from different tissues.

TABLE 3483

Normal tissue distribution

| Name of Tissue | Number |
|---|---|
| adrenal | 84 |
| bladder | 0 |
| bone | 97 |
| brain | 64 |
| colon | 69 |
| epithelial | 45 |
| general | 40 |
| head and neck | 10 |
| kidney | 121 |
| liver | 9 |
| lung | 45 |
| lymph nodes | 47 |
| breast | 43 |
| bone marrow | 0 |
| muscle | 44 |
| ovary | 43 |
| pancreas | 20 |
| prostate | 60 |
| skin | 26 |
| stomach | 73 |
| Thyroid | 0 |
| uterus | 4 |

TABLE 3484

P values and ratios for expression in cancerous tissue

| Name of Tissue | P1 | P2 | SP1 | R3 | SP2 | R4 |
|---|---|---|---|---|---|---|
| adrenal | 7.4e−01 | 7.7e−01 | 6.2e−01 | 1.1 | 7.4e−01 | 0.9 |
| bladder | 5.4e−01 | 3.4e−01 | 5.6e−01 | 1.8 | 4.6e−01 | 1.9 |
| bone | 4.9e−01 | 6.3e−01 | 6.7e−01 | 1.0 | 8.1e−01 | 0.8 |
| brain | 7.2e−01 | 7.8e−01 | 9.7e−01 | 0.4 | 9.9e−01 | 0.4 |
| colon | 1.3e−02 | 2.8e−02 | 2.0e−01 | 1.9 | 1.6e−01 | 1.6 |
| epithelial | 1.0e−02 | 1.1e−02 | 5.6e−03 | 1.6 | 1.8e−02 | 1.5 |
| general | 1.3e−03 | 5.4e−04 | 2.4e−04 | 1.7 | 8.6e−04 | 1.5 |
| head and neck | 4.6e−01 | 2.5e−01 | 1 | 1.0 | 4.2e−01 | 1.8 |
| kidney | 7.9e−01 | 8.3e−01 | 9.4e−01 | 0.5 | 9.5e−01 | 0.5 |
| liver | 9.1e−01 | 7.5e−01 | 1 | 0.8 | 1 | 0.9 |
| lung | 2.8e−01 | 4.5e−01 | 1.8e−01 | 1.9 | 4.9e−01 | 1.1 |
| lymph nodes | 6.9e−01 | 8.2e−01 | 6.3e−01 | 1.0 | 9.2e−01 | 0.5 |
| breast | 2.9e−01 | 1.1e−01 | 5.0e−01 | 1.5 | 4.5e−01 | 1.5 |
| bone marrow | 1 | 4.2e−01 | 1 | 1.0 | 5.3e−01 | 2.1 |
| muscle | 6.0e−01 | 4.0e−01 | 3.8e−01 | 2.0 | 4.4e−02 | 1.7 |
| ovary | 4.8e−01 | 4.4e−01 | 2.9e−01 | 1.7 | 4.1e−01 | 1.4 |
| pancreas | 4.6e−01 | 4.2e−01 | 3.6e−01 | 1.7 | 1.8e−01 | 1.8 |

TABLE 3484-continued

P values and ratios for expression in cancerous tissue

| Name of Tissue | P1 | P2 | SP1 | R3 | SP2 | R4 |
|---|---|---|---|---|---|---|
| prostate | 8.1e−01 | 6.9e−01 | 6.6e−01 | 0.9 | 6.5e−01 | 0.9 |
| skin | 4.0e−01 | 2.0e−01 | 3.7e−01 | 2.3 | 2.5e−01 | 1.1 |
| stomach | 4.9e−01 | 7.8e−01 | 1.5e−01 | 1.0 | 3.9e−01 | 1.1 |
| Thyroid | 4.3e−01 | 4.3e−01 | 1 | 1.1 | 1 | 1.1 |
| uterus | 1.8e−01 | 1.5e−01 | 1.3e−01 | 2.2 | 1.4e−01 | 2.3 |

As noted above, cluster T06117 features 39 segment(s), which were listed in Table 3481 above and for which the sequence(s) are given at the end of the application. These segment(s) are portions of nucleic acid sequence(s) which are described herein separately because they are of particular interest. A description of each segment according to the present invention is now provided.

Segment cluster T06117_node_0 (SEQ ID NO:3672) according to the present invention is supported by 56 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 6 below describes the starting and ending position of this segment on each transcript.

TABLE 3485

Segment location on transcripts

| Transcript name | Segment starting position | Segment ending position |
|---|---|---|
| T06117_T7 (SEQ ID NO: 3666) | 1 | 331 |
| T06117_T30 (SEQ ID NO: 3668) | 1 | 331 |
| T06117_T31 (SEQ ID NO: 3669) | 1 | 331 |
| T06117_T42 (SEQ ID NO: 3670) | 1 | 331 |
| T06117_T45 (SEQ ID NO: 3671) | 1 | 331 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_14 (SEQ ID NO:3673) according to the present invention is supported by 78 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 7 below describes the starting and ending position of this segment on each transcript.

TABLE 3486

Segment location on transcripts

| Transcript name | Segment starting position | Segment ending position |
|---|---|---|
| T06117_T7 (SEQ ID NO: 3666) | 549 | 671 |
| T06117_T30 (SEQ ID NO: 3668) | 549 | 671 |
| T06117_T31 (SEQ ID NO: 3669) | 549 | 671 |
| T06117_T42 (SEQ ID NO: 3670) | 549 | 671 |
| T06117_T45 (SEQ ID NO: 3671) | 549 | 671 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_18 (SEQ ID NO:3674) according to the present invention is supported by 5 libraries. The number of libraries was determined as previously described. This segment can be found in the following transcript(s): T06117_T7 (SEQ ID NO:3666). Table 3487 below describes the starting and ending position of this segment on each transcript.

TABLE 3487

Segment location on transcripts

| Transcript name | Segment starting position | Segment ending position |
|---|---|---|
| T06117_T7 (SEQ ID NO: 3666) | 753 | 1174 |

This segment can be found in a non-coding region of transcript(s) that are related to the following protein(s): T06117_P8.

Segment cluster T06117_node_22 (SEQ ID NO:3675) according to the present invention is supported by 53 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 9 below describes the starting and ending position of this segment on each transcript.

TABLE 3488

Segment location on transcripts

| Transcript name | Segment starting position | Segment ending position |
|---|---|---|
| T06117_T7 (SEQ ID NO: 3666) | 1240 | 1376 |
| T06117_T30 (SEQ ID NO: 3668) | 818 | 954 |
| T06117_T31 (SEQ ID NO: 3669) | 818 | 954 |
| T06117_T42 (SEQ ID NO: 3670) | 818 | 954 |
| T06117_T45 (SEQ ID NO: 3671) | 818 | 954 |

This segment can be found in the following protein(s): T06117_P8, T06117_P27, T06117_P28, T06117_P39 and T06117_P42.

Segment cluster T06117_node_25 (SEQ ID NO:3676) according to the present invention is supported by 42 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669) and T06117_T42 (SEQ ID NO:3670). Table 3489 below describes the starting and ending position of this segment on each transcript.

TABLE 3489

Segment location on transcripts

| Transcript name | Segment starting position | Segment ending position |
|---|---|---|
| T06117_T7 (SEQ ID NO: 3666) | 1377 | 1595 |
| T06117_T30 (SEQ ID NO: 3668) | 955 | 1173 |
| T06117_T31 (SEQ ID NO: 3669) | 955 | 1173 |
| T06117_T42 (SEQ ID NO: 3670) | 955 | 1173 |

This segment can be found in the following protein(s): T06117_P8, T06117_P27, T06117_P28 and T06117_P39.

Segment cluster T06117_node_27 (SEQ ID NO:3677) according to the present invention is supported by 38 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 11 below describes the starting and ending position of this segment on each transcript.

TABLE 3490

Segment location on transcripts

| Transcript name | Segment starting position | Segment ending position |
|---|---|---|
| T06117_T7 (SEQ ID NO: 3666) | 1596 | 1740 |
| T06117_T30 (SEQ ID NO: 3668) | 1174 | 1318 |
| T06117_T31 (SEQ ID NO: 3669) | 1174 | 1318 |
| T06117_T42 (SEQ ID NO: 3670) | 1174 | 1318 |
| T06117_T45 (SEQ ID NO: 3671) | 955 | 1099 |

This segment can be found in the following protein(s): T06117_P8, T06117_P27, T06117_P28, T06117_P39 and T06117_P42.

Segment cluster T06117_node_28 (SEQ ID NO:3678) according to the present invention is supported by 11 libraries. The number of libraries was determined as previously described. This segment can be found in the following transcript(s): T06117_T42 (SEQ ID NO:3670) and T06117_T45 (SEQ ID NO:3671). Table 3491 below describes the starting and ending position of this segment on each transcript.

TABLE 3491

Segment location on transcripts

| Transcript name | Segment starting position | Segment ending position |
|---|---|---|
| T06117_T42 (SEQ ID NO: 3670) | 1319 | 2133 |
| T06117_T45 (SEQ ID NO: 3671) | 1100 | 1914 |

This segment can be found in the following protein(s): T06117_P39 and T06117_P42.

Segment cluster T06117_node_30 (SEQ ID NO:3679) according to the present invention is supported by 16 libraries. The number of libraries was determined as previously described. This segment can be found in the following transcript(s): T06117_T16 (SEQ ID NO:3667). Table 3492 below describes the starting and ending position of this segment on each transcript.

TABLE 3492

Segment location on transcripts

| Transcript name | Segment starting position | Segment ending position |
|---|---|---|
| T06117_T16 (SEQ ID NO: 3667) | 1 | 246 |

This segment can be found in the following protein(s): T06117_P16.

Segment cluster T06117_node_31 (SEQ ID NO:3680) according to the present invention is supported by 17 libraries. The number of libraries was determined as previously described. This segment can be found in the following transcript(s): T06117_T16 (SEQ ID NO:3667). Table 3493 below describes the starting and ending position of this segment on each transcript.

TABLE 3493

Segment location on transcripts

| Transcript name | Segment starting position | Segment ending position |
|---|---|---|
| T06117_T16 (SEQ ID NO: 3667) | 247 | 368 |

This segment can be found in the following protein(s): T06117_P16.

Segment cluster T06117_node_36 (SEQ ID NO:3681) according to the present invention is supported by 66 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3494 below describes the starting and ending position of this segment on each transcript.

TABLE 3494

Segment location on transcripts

| Transcript name | Segment starting position | Segment ending position |
|---|---|---|
| T06117_T7 (SEQ ID NO: 3666) | 1951 | 2231 |
| T06117_T16 (SEQ ID NO: 3667) | 579 | 859 |
| T06117_T30 (SEQ ID NO: 3668) | 1529 | 1809 |
| T06117_T31 (SEQ ID NO: 3669) | 1529 | 1809 |

This segment can be found in the following protein(s): T06117_P8, T06117_P16, T06117_P27 and T06117_P28.

Segment cluster T06117_node_53 (SEQ ID NO:3682) according to the present invention is supported by 95 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3495 below describes the starting and ending position of this segment on each transcript.

TABLE 3495

Segment location on transcripts

| Transcript name | Segment starting position | Segment ending position |
|---|---|---|
| T06117_T7 (SEQ ID NO: 3666) | 2826 | 3040 |
| T06117_T16 (SEQ ID NO: 3667) | 1454 | 1668 |
| T06117_T30 (SEQ ID NO: 3668) | 2404 | 2618 |
| T06117_T31 (SEQ ID NO: 3669) | 2404 | 2618 |

This segment can be found in the following protein(s): T06117_P8, T06117_P16, T06117_P27 and T06117_P28.

Segment cluster T06117_node_60 (SEQ ID NO:3683) according to the present invention is supported by 109 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3496 below describes the starting and ending position of this segment on each transcript.

TABLE 3496

Segment location on transcripts

| Transcript name | Segment starting position | Segment ending position |
|---|---|---|
| T06117_T7 (SEQ ID NO: 3666) | 3203 | 3380 |
| T06117_T16 (SEQ ID NO: 3667) | 1831 | 2008 |
| T06117_T30 (SEQ ID NO: 3668) | 2781 | 2958 |
| T06117_T31 (SEQ ID NO: 3669) | 2781 | 2958 |

This segment can be found in the following protein(s): T06117_P8, T06117_P16, T06117_P27 and T06117_P28.

Segment cluster T06117_node_69 (SEQ ID NO:3684) according to the present invention is supported by 17 libraries. The number of libraries was determined as previously described. This segment can be found in the following transcript(s): T06117_T30 (SEQ ID NO:3668) and T06117_T31 (SEQ ID NO:3669). Table 3497 below describes the starting and ending position of this segment on each transcript.

TABLE 3497

Segment location on transcripts

| Transcript name | Segment starting position | Segment ending position |
|---|---|---|
| T06117_T30 (SEQ ID NO: 3668) | 3109 | 3285 |
| T06117_T31 (SEQ ID NO: 3669) | 3185 | 3361 |

This segment can be found in both coding and non-coding regions of transcript(s) as follows. The segment can be found in a non-coding region of transcript(s) that are related to the following protein(s): T06117_P28. This segment can also be found in the following protein(s): T06117_P27, since it is in the coding region for the corresponding transcript.

Segment cluster T06117_node_71 (SEQ ID NO:3685) according to the present invention is supported by 138 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3498 below describes the starting and ending position of this segment on each transcript.

TABLE 3498

Segment location on transcripts

| Transcript name | Segment starting position | Segment ending position |
|---|---|---|
| T06117_T7 (SEQ ID NO: 3666) | 3531 | 3703 |
| T06117_T16 (SEQ ID NO: 3667) | 2159 | 2331 |
| T06117_T30 (SEQ ID NO: 3668) | 3286 | 3458 |
| T06117_T31 (SEQ ID NO: 3669) | 3362 | 3534 |

This segment can be found in both coding and non-coding regions of transcript(s) as follows. The segment can be found in a non-coding region of transcript(s) that are related to the following protein(s): T06117_P27 and T06117_P28. This segment can also be found in the following protein(s): T06117_P8 and T06117_P16, since it is in the coding region for the corresponding transcript.

Segment cluster T06117_node_74 (SEQ ID NO:3686) according to the present invention is supported by 122 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3499 below describes the starting and ending position of this segment on each transcript.

TABLE 3499

Segment location on transcripts

| Transcript name | Segment starting position | Segment ending position |
|---|---|---|
| T06117_T7 (SEQ ID NO: 3666) | 3740 | 3919 |
| T06117_T16 (SEQ ID NO: 3667) | 2368 | 2547 |
| T06117_T30 (SEQ ID NO: 3668) | 3495 | 3674 |
| T06117_T31 (SEQ ID NO: 3669) | 3571 | 3750 |

This segment can be found in a non-coding region of transcript(s) that are related to the following protein(s): T06117_P8, T06117_P16, T06117_P27 and T06117_P28.

According to an optional embodiment of the present invention, short segments related to the above cluster are also provided. These segments are up to about 120 bp in length, and so are included in a separate description.

Segment cluster T06117_node_2 (SEQ ID NO:3687) according to the present invention is supported by 65 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 21 below describes the starting and ending position of this segment on each transcript.

TABLE 3500

Segment location on transcripts

| Transcript name | Segment starting position | Segment ending position |
|---|---|---|
| T06117_T7 (SEQ ID NO: 3666) | 332 | 428 |
| T06117_T30 (SEQ ID NO: 3668) | 332 | 428 |

TABLE 3500-continued

Segment location on transcripts

| Transcript name | Segment starting position | Segment ending position |
|---|---|---|
| T06117_T31 (SEQ ID NO: 3669) | 332 | 428 |
| T06117_T42 (SEQ ID NO: 3670) | 332 | 428 |
| T06117_T45 (SEQ ID NO: 3671) | 332 | 428 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_8 (SEQ ID NO:3688) according to the present invention is supported by 71 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 22 below describes the starting and ending position of this segment on each transcript.

TABLE 3501

Segment location on transcripts

| Transcript name | Segment starting position | Segment ending position |
|---|---|---|
| T06117_T7 (SEQ ID NO: 3666) | 429 | 498 |
| T06117_T30 (SEQ ID NO: 3668) | 429 | 498 |
| T06117_T31 (SEQ ID NO: 3669) | 429 | 498 |
| T06117_T42 (SEQ ID NO: 3670) | 429 | 498 |
| T06117_T45 (SEQ ID NO: 3671) | 429 | 498 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_11 (SEQ ID NO:3689) according to the present invention is supported by 75 libraries. The number of libraries was determined as previously described. This segment can be found in the following transcript(s): T06117_T7 (SEQ ID NO:3666), T06117_T30 (SEQ ID NO:3668) T06117_T31 (SEQ ID NO:3669), T06117_T42 (SEQ ID NO:3670) and T06117_T45 (SEQ ID NO:3671). Table 23 below describes the starting and ending position of this segment on each transcript.

TABLE 3502

Segment location on transcripts

| Transcript name | Segment starting position | Segment ending position |
|---|---|---|
| T06117_T7 (SEQ ID NO: 3666) | 499 | 548 |
| T06117_T30 (SEQ ID NO: 3668) | 499 | 548 |
| T06117_T31 (SEQ ID NO: 3669) | 499 | 548 |
| T06117_T42 (SEQ ID NO: 3670) | 499 | 548 |
| T06117_T45 (SEQ ID NO: 3671) | 499 | 548 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_16 (SEQ ID NO:3690) according to the present invention is supported by 73 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 24 below describes the starting and ending position of this segment on each transcript.

TABLE 3503

Segment location on transcripts

| Transcript name | Segment starting position | Segment ending position |
|---|---|---|
| T06117_T7 (SEQ ID NO: 3666) | 672 | 747 |
| T06117_T30 (SEQ ID NO: 3668) | 672 | 747 |
| T06117_T31 (SEQ ID NO: 3669) | 672 | 747 |
| T06117_T42 (SEQ ID NO: 3670) | 672 | 747 |
| T06117_T45 (SEQ ID NO: 3671) | 672 | 747 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_17 (SEQ ID NO:3691) according to the present invention can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 25 below describes the starting and ending position of this segment on each transcript.

TABLE 3504

Segment location on transcripts

| Transcript name | Segment starting position | Segment ending position |
|---|---|---|
| T06117_T7 (SEQ ID NO: 3666) | 748 | 752 |
| T06117_T30 (SEQ ID NO: 3668) | 748 | 752 |
| T06117_T31 (SEQ ID NO: 3669) | 748 | 752 |
| T06117_T42 (SEQ ID NO: 3670) | 748 | 752 |
| T06117_T45 (SEQ ID NO: 3671) | 748 | 752 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_19 (SEQ ID NO:3692) according to the present invention is supported by 59 libraries. The number of libraries was determined as previously described. This segment can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 26 below describes the starting and ending position of this segment on each transcript.

TABLE 3505

Segment location on transcripts

| Transcript name | Segment starting position | Segment ending position |
| --- | --- | --- |
| T06117_T7 (SEQ ID NO: 3666) | 1175 | 1231 |
| T06117_T30 (SEQ ID NO: 3668) | 753 | 809 |
| T06117_T31 (SEQ ID NO: 3669) | 753 | 809 |
| T06117_T42 (SEQ ID NO: 3670) | 753 | 809 |
| T06117_T45 (SEQ ID NO: 3671) | 753 | 809 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_20 (SEQ ID NO:3693) according to the present invention can be found in the following transcript(s): T06117_T7 (SEQ ID NO:3666), T06117_T30 (SEQ ID NO:3668), T06117_T31 (SEQ ID NO:3669), T06117_T42 (SEQ ID NO:3670) and T06117_T45 (SEQ ID NO:3671). Table 27 below describes the starting and ending position of this segment on each transcript.

TABLE 3506

Segment location on transcripts

| Transcript name | Segment starting position | Segment ending position |
| --- | --- | --- |
| T06117_T7 (SEQ ID NO: 3666) | 1232 | 1239 |
| T06117_T30 (SEQ ID NO: 3668) | 810 | 817 |
| T06117_T31 (SEQ ID NO: 3669) | 810 | 817 |
| T06117_T42 (SEQ ID NO: 3670) | 810 | 817 |
| T06117_T45 (SEQ ID NO: 3671) | 810 | 817 |

This segment can be found in both coding and non-coding regions of transcript(s) as follows. The segment can be found in a non-coding region of transcript(s) that are related to the following protein(s): T06117_P8. This segment can also be found in the following protein(s): T06117_P27, T06117_P28, T06117_P39 and T06117_P42, since it is in the coding region for the corresponding transcript.

Segment cluster T06117_node_32 (SEQ ID NO:3694) according to the present invention is supported by 44 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3507 below describes the starting and ending position of this segment on each transcript.

TABLE 3507

Segment location on transcripts

| Transcript name | Segment starting position | Segment ending position |
| --- | --- | --- |
| T06117_T7 (SEQ ID NO: 3666) | 1741 | 1857 |
| T06117_T16 (SEQ ID NO: 3667) | 369 | 485 |
| T06117_T30 (SEQ ID NO: 3668) | 1319 | 1435 |
| T06117_T31 (SEQ ID NO: 3669) | 1319 | 1435 |

This segment can be found in the following protein(s): T06117_P8, T06117_P16, T06117_P27 and T06117_P28.

Segment cluster T06117_node_33 (SEQ ID NO:3695) according to the present invention is supported by 39 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3508 below describes the starting and ending position of this segment on each transcript.

TABLE 3508

Segment location on transcripts

| Transcript name | Segment starting position | Segment ending position |
| --- | --- | --- |
| T06117_T7 (SEQ ID NO: 3666) | 1858 | 1950 |
| T06117_T16 (SEQ ID NO: 3667) | 486 | 578 |
| T06117_T30 (SEQ ID NO: 3668) | 1436 | 1528 |
| T06117_T31 (SEQ ID NO: 3669) | 1436 | 1528 |

This segment can be found in the following protein(s): T06117_P8, T06117_P16, T06117_P27 and T06117_P28.

Segment cluster T06117_node_39 (SEQ ID NO:3696) according to the present invention is supported by 71 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3509 below describes the starting and ending position of this segment on each transcript.

TABLE 3509

Segment location on transcripts

| Transcript name | Segment starting position | Segment ending position |
| --- | --- | --- |
| T06117_T7 (SEQ ID NO: 3666) | 2232 | 2345 |
| T06117_T16 (SEQ ID NO: 3667) | 860 | 973 |
| T06117_T30 (SEQ ID NO: 3668) | 1810 | 1923 |
| T06117_T31 (SEQ ID NO: 3669) | 1810 | 1923 |

This segment can be found in the following protein(s): T06117_P8, T06117_P16, T06117_P27 and T06117_P28.

Segment cluster T06117_node_40 (SEQ ID NO:3697) according to the present invention is supported by 69 libraries. The number of libraries was determined as previously described. This segment can be found in the following transcript(s): T06117_T7 (SEQ ID NO:3666), T06117_T16

(SEQ ID NO:3667), T06117_T30 (SEQ ID NO:3668) and T06117_T31 (SEQ ID NO:3669). Table 3510 below describes the starting and ending position of this segment on each transcript.

TABLE 3510

Segment location on transcripts

| Transcript name | Segment starting position | Segment ending position |
|---|---|---|
| T06117_T7 (SEQ ID NO: 3666) | 2346 | 2382 |
| T06117_T16 (SEQ ID NO: 3667) | 974 | 1010 |
| T06117_T30 (SEQ ID NO: 3668) | 1924 | 1960 |
| T06117_T31 (SEQ ID NO: 3669) | 1924 | 1960 |

This segment can be found in the following protein(s): T06117_P8, T06117_P16, T06117_P27 and T06117_P28.

Segment cluster T06117_node_41 (SEQ ID NO:3698) according to the present invention can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3511 below describes the starting and ending position of this segment on each transcript.

TABLE 3511

Segment location on transcripts

| Transcript name | Segment starting position | Segment ending position |
|---|---|---|
| T06117_T7 (SEQ ID NO: 3666) | 2383 | 2390 |
| T06117_T16 (SEQ ID NO: 3667) | 1011 | 1018 |
| T06117_T30 (SEQ ID NO: 3668) | 1961 | 1968 |
| T06117_T31 (SEQ ID NO: 3669) | 1961 | 1968 |

This segment can be found in the following protein(s): T06117_P8, T06117_P16, T06117_P27 and T06117_P28.

Segment cluster T06117_node_42 (SEQ ID NO:3699) according to the present invention is supported by 70 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3512 below describes the starting and ending position of this segment on each transcript.

TABLE 3512

Segment location on transcripts

| Transcript name | Segment starting position | Segment ending position |
|---|---|---|
| T06117_T7 (SEQ ID NO: 3666) | 2391 | 2432 |
| T06117_T16 (SEQ ID NO: 3667) | 1019 | 1060 |
| T06117_T30 (SEQ ID NO: 3668) | 1969 | 2010 |
| T06117_T31 (SEQ ID NO: 3669) | 1969 | 2010 |

This segment can be found in the following protein(s): T06117_P8, T06117_P16, T06117_P27 and T06117_P28.

Segment cluster T06117_node_43 (SEQ ID NO:3700) according to the present invention is supported by 74 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3513 below describes the starting and ending position of this segment on each transcript.

TABLE 3513

Segment location on transcripts

| Transcript name | Segment starting position | Segment ending position |
|---|---|---|
| T06117_T7 (SEQ ID NO: 3666) | 2433 | 2505 |
| T06117_T16 (SEQ ID NO: 3667) | 1061 | 1133 |
| T06117_T30 (SEQ ID NO: 3668) | 2011 | 2083 |
| T06117_T31 (SEQ ID NO: 3669) | 2011 | 2083 |

This segment can be found in the following protein(s): T06117_P8, T06117_P16, T06117_P27 and T06117_P28.

Segment cluster T06117_node_44 (SEQ ID NO:3701) according to the present invention is supported by 82 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3514 below describes the starting and ending position of this segment on each transcript.

TABLE 3514

Segment location on transcripts

| Transcript name | Segment starting position | Segment ending position |
|---|---|---|
| T06117_T7 (SEQ ID NO: 3666) | 2506 | 2616 |
| T06117_T16 (SEQ ID NO: 3667) | 1134 | 1244 |
| T06117_T30 (SEQ ID NO: 3668) | 2084 | 2194 |
| T06117_T31 (SEQ ID NO: 3669) | 2084 | 2194 |

This segment can be found in the following protein(s): T06117_P8, T06117_P16, T06117_P27 and T06117_P28.

Segment cluster T06117_node_45 (SEQ ID NO:3702) according to the present invention is supported by 78 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3515 below describes the starting and ending position of this segment on each transcript.

TABLE 3515

Segment location on transcripts

| Transcript name | Segment starting position | Segment ending position |
|---|---|---|
| T06117_T7 (SEQ ID NO: 3666) | 2617 | 2684 |
| T06117_T16 (SEQ ID NO: 3667) | 1245 | 1312 |
| T06117_T30 (SEQ ID NO: 3668) | 2195 | 2262 |
| T06117_T31 (SEQ ID NO: 3669) | 2195 | 2262 |

This segment can be found in the following protein(s): T06117_P8, T06117_P16, T06117_P27 and T06117_P28.

Segment cluster T06117_node_47 (SEQ ID NO:3703) according to the present invention is supported by 82 libraries. The number of libraries was determined as previously described. This segment can be found in the following transcript(s): T06117_T7 (SEQ ID NO:3666), T06117_T16

(SEQ ID NO:3667), T06117_T30 (SEQ ID NO:3668) and T06117_T31 (SEQ ID NO:3669). Table 3516 below describes the starting and ending position of this segment on each transcript.

TABLE 3516

Segment location on transcripts

| Transcript name | Segment starting position | Segment ending position |
|---|---|---|
| T06117_T7 (SEQ ID NO: 3666) | 2685 | 2778 |
| T06117_T16 (SEQ ID NO: 3667) | 1313 | 1406 |
| T06117_T30 (SEQ ID NO: 3668) | 2263 | 2356 |
| T06117_T31 (SEQ ID NO: 3669) | 2263 | 2356 |

This segment can be found in the following protein(s): T06117_P8, T06117_P16, T06117_P27 and T06117_P28.

Segment cluster T06117_node_49 (SEQ ID NO:3704) according to the present invention is supported by 66 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3517 below describes the starting and ending position of this segment on each transcript.

TABLE 3517

Segment location on transcripts

| Transcript name | Segment starting position | Segment ending position |
|---|---|---|
| T06117_T7 (SEQ ID NO: 3666) | 2779 | 2825 |
| T06117_T16 (SEQ ID NO: 3667) | 1407 | 1453 |
| T06117_T30 (SEQ ID NO: 3668) | 2357 | 2403 |
| T06117_T31 (SEQ ID NO: 3669) | 2357 | 2403 |

This segment can be found in the following protein(s): T06117_P8, T06117_P16, T06117_P27 and T06117_P28.

Segment cluster T06117_node_55 (SEQ ID NO:3705) according to the present invention is supported by 73 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3518 below describes the starting and ending position of this segment on each transcript.

TABLE 3518

Segment location on transcripts

| Transcript name | Segment starting position | Segment ending position |
|---|---|---|
| T06117_T7 (SEQ ID NO: 3666) | 3041 | 3133 |
| T06117_T16 (SEQ ID NO: 3667) | 1669 | 1761 |
| T06117_T30 (SEQ ID NO: 3668) | 2619 | 2711 |
| T06117_T31 (SEQ ID NO: 3669) | 2619 | 2711 |

This segment can be found in the following protein(s): T06117_P8, T06117_P16, T06117_P27 and T06117_P28.

Segment cluster T06117_node_57 (SEQ ID NO:3706) according to the present invention is supported by 63 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3519 below describes the starting and ending position of this segment on each transcript.

TABLE 3519

Segment location on transcripts

| Transcript name | Segment starting position | Segment ending position |
|---|---|---|
| T06117_T7 (SEQ ID NO: 3666) | 3134 | 3202 |
| T06117_T16 (SEQ ID NO: 3667) | 1762 | 1830 |
| T06117_T30 (SEQ ID NO: 3668) | 2712 | 2780 |
| T06117_T31 (SEQ ID NO: 3669) | 2712 | 2780 |

This segment can be found in the following protein(s): T06117_P8, T06117_P16, T06117_P27 and T06117_P28.

Segment cluster T06117_node_62 (SEQ ID NO:3707) according to the present invention is supported by 114 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3520 below describes the starting and ending position of this segment on each transcript.

TABLE 3520

Segment location on transcripts

| Transcript name | Segment starting position | Segment ending position |
|---|---|---|
| T06117_T7 (SEQ ID NO: 3666) | 3381 | 3485 |
| T06117_T16 (SEQ ID NO: 3667) | 2009 | 2113 |
| T06117_T30 (SEQ ID NO: 3668) | 2959 | 3063 |
| T06117_T31 (SEQ ID NO: 3669) | 2959 | 3063 |

This segment can be found in the following protein(s): T06117_P8, T06117_P16, T06117_P27 and T06117_P28.

Segment cluster T06117_node_65 (SEQ ID NO:3708) according to the present invention is supported by 84 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3521 below describes the starting and ending position of this segment on each transcript.

TABLE 3521

Segment location on transcripts

| Transcript name | Segment starting position | Segment ending position |
|---|---|---|
| T06117_T7 (SEQ ID NO: 3666) | 3486 | 3530 |
| T06117_T16 (SEQ ID NO: 3667) | 2114 | 2158 |
| T06117_T30 (SEQ ID NO: 3668) | 3064 | 3108 |
| T06117_T31 (SEQ ID NO: 3669) | 3064 | 3108 |

This segment can be found in the following protein(s): T06117_P8, T06117_P16, T06117_P27 and T06117_P28.

Segment cluster T06117_node_68 (SEQ ID NO:3709) according to the present invention is supported by 9 libraries. The number of libraries was determined as previously described. This segment can be found in the following transcript(s): T06117_T31 (SEQ ID NO:3669). Table 3522 below describes the starting and ending position of this segment on each transcript.

TABLE 3522

Segment location on transcripts

| Transcript name | Segment starting position | Segment ending position |
|---|---|---|
| T06117_T31 (SEQ ID NO: 3669) | 3109 | 3184 |

This segment can be found in the following protein(s): T06117_P28.

Segment cluster T06117_node__72 (SEQ ID NO:3710) according to the present invention is supported by 119 libraries. The number of libraries was determined as previously described. This segment can be found in the following transcript(s): T06117_T7 (SEQ ID NO:3666), T06117_T16 (SEQ ID NO:3667), T06117_T30 (SEQ ID NO:3668) and T06117_T31 (SEQ ID NO:3669). Table 3523 below describes the starting and ending position of this segment on each transcript.

TABLE 3523

Segment location on transcripts

| Transcript name | Segment starting position | Segment ending position |
|---|---|---|
| T06117_T7 (SEQ ID NO: 3666) | 3704 | 3739 |
| T06117_T16 (SEQ ID NO: 3667) | 2332 | 2367 |
| T06117_T30 (SEQ ID NO: 3668) | 3459 | 3494 |
| T06117_T31 (SEQ ID NO: 3669) | 3535 | 3570 |

This segment can be found in a non-coding region of transcript(s) that are related to the following protein(s): T06117_P8, T06117_P16, T06117_P27 and T06117_P28.

Description for Cluster T10374

Cluster T10374 features 3 transcript(s) and 26 segment(s) of interest, the names for which are given in Tables 3524 and 3525, respectively, the sequences themselves are given at the end of the application. The selected protein variants are given in Table 3526.

TABLE 3524

Transcripts of interest
Transcript Name

T10374_T16 (SEQ ID NO: 3711)
T10374_T24 (SEQ ID NO: 3712)
T10374_T27 (SEQ ID NO: 3713)

TABLE 3525

Segments of interest
Segment Name

T10374_node__2 (SEQ ID NO: 3714)
T10374_node__3 (SEQ ID NO: 3715)
T10374_node__19 (SEQ ID NO: 3716)
T10374_node__27 (SEQ ID NO: 3717)
T10374_node__51 (SEQ ID NO: 3718)
T10374_node__57 (SEQ ID NO: 3719)
T10374_node__60 (SEQ ID NO: 3720)
T10374_node__63 (SEQ ID NO: 3721)

TABLE 3525-continued

Segments of interest
Segment Name

T10374_node__65 (SEQ ID NO: 3722)
T10374_node__67 (SEQ ID NO: 3723)
T10374_node__16 (SEQ ID NO: 3724)
T10374_node__23 (SEQ ID NO: 3725)
T10374_node__25 (SEQ ID NO: 3726)
T10374_node__29 (SEQ ID NO: 3727)
T10374_node__31 (SEQ ID NO: 3728)
T10374_node__33 (SEQ ID NO: 3729)
T10374_node__35 (SEQ ID NO: 3730)
T10374_node__38 (SEQ ID NO: 3731)
T10374_node__40 (SEQ ID NO: 3732)
T10374_node__42 (SEQ ID NO: 3733)
T10374_node__46 (SEQ ID NO: 3734)
T10374_node__49 (SEQ ID NO: 3735)
T10374_node__53 (SEQ ID NO: 3736)
T10374_node__61 (SEQ ID NO: 3737)
T10374_node__64 (SEQ ID NO: 3738)
T10374_node__66 (SEQ ID NO: 3739)

TABLE 3526

Proteins of interest

| Protein Name | Corresponding Transcript(s) |
|---|---|
| T10374_P2 | T10374_T16 (SEQ ID NO: 3711) |
| T10374_P6 | T10374_T24 (SEQ ID NO: 3712) |
| T10374_P9 | T10374_T27 (SEQ ID NO: 3713) |

Cluster T10374 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 87 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 87 and Table 3527. This cluster is overexpressed (at least at a minimum level) in the following pathological conditions: ovarian carcinoma.

TABLE 3527

Normal tissue distribution

| Name of Tissue | Number |
|---|---|
| Adrenal | 40 |
| Bladder | 41 |
| Bone | 64 |
| Brain | 122 |
| Colon | 157 |
| epithelial | 74 |
| general | 104 |
| head and neck | 20 |
| kidney | 85 |
| liver | 4 |
| lung | 101 |
| lymph nodes | 280 |
| breast | 61 |
| bone marrow | 0 |
| muscle | 62 |
| ovary | 7 |
| pancreas | 74 |
| prostate | 116 |
| skin | 96 |
| stomach | 0 |

TABLE 3527-continued

Normal tissue distribution

| Name of Tissue | Number |
|---|---|
| T cells | 557 |
| Thyroid | 386 |
| uterus | 50 |

TABLE 3528

P values and ratios for expression in cancerous tissue

| Name of Tissue | P1 | P2 | SP1 | R3 | SP2 | R4 |
|---|---|---|---|---|---|---|
| adrenal | 6.4e−01 | 4.2e−01 | 7.1e−01 | 1.1 | 5.5e−01 | 1.4 |
| bladder | 5.4e−01 | 2.9e−01 | 4.1e−01 | 1.7 | 1.6e−01 | 2.1 |
| bone | 8.3e−01 | 8.5e−01 | 1 | 0.3 | 4.7e−01 | 1.0 |
| brain | 7.9e−01 | 8.1e−01 | 1 | 0.1 | 1 | 0.2 |
| colon | 3.8e−02 | 1.6e−02 | 1.3e−01 | 1.5 | 1.0e−01 | 1.6 |
| epithelial | 1.1e−02 | 1.1e−02 | 1.3e−05 | 1.9 | 9.2e−06 | 1.8 |
| general | 4.8e−02 | 2.1e−02 | 4.7e−02 | 1.2 | 7.2e−03 | 1.2 |
| head and neck | 4.6e−01 | 4.3e−01 | 1 | 1.0 | 7.5e−01 | 1.2 |
| kidney | 3.5e−01 | 4.3e−01 | 2.3e−02 | 2.3 | 1.2e−02 | 1.8 |
| Liver | 8.3e−01 | 7.6e−01 | 1 | 0.9 | 2.3e−01 | 2.6 |
| lung | 7.7e−01 | 8.2e−01 | 1.5e−01 | 1.4 | 6.2e−01 | 0.8 |
| lymph nodes | 3.4e−01 | 5.3e−01 | 9.0e−01 | 0.6 | 9.4e−01 | 0.5 |
| breast | 3.1e−01 | 2.4e−01 | 3.1e−01 | 1.4 | 2.2e−01 | 1.3 |
| bone marrow | 4.3e−01 | 1.4e−01 | 1 | 3.3 | 8.1e−02 | 5.0 |
| muscle | 9.0e−02 | 1.6e−02 | 4.7e−01 | 1.8 | 8.6e−01 | 0.7 |
| ovary | 1.1e−01 | 9.3e−02 | 2.2e−03 | 6.3 | 1.1e−02 | 4.6 |
| pancreas | 6.4e−01 | 7.5e−01 | 6.3e−01 | 0.8 | 8.5e−01 | 0.6 |
| prostate | 7.7e−01 | 7.0e−01 | 4.3e−01 | 0.9 | 1.8e−01 | 1.2 |
| skin | 6.9e−01 | 7.9e−01 | 1 | 0.1 | 1 | 0.2 |
| stomach | 1.1e−01 | 1.5e−01 | 3.2e−02 | 3.1 | 3.4e−02 | 3.8 |
| T cells | 1 | 6.7e−01 | 6.9e−01 | 1.0 | 9.8e−01 | 0.5 |
| Thyroid | 5.7e−01 | 5.7e−01 | 9.0e−01 | 0.5 | 9.0e−01 | 0.5 |
| uterus | 4.6e−01 | 3.8e−01 | 7.8e−01 | 0.8 | 5.3e−02 | 1.8 |

As noted above, cluster T10374 features 26 segment(s), which were listed in Table 3525 above and for which the sequence(s) are given at the end of the application. These segment(s) are portions of nucleic acid sequence(s) which are described herein separately because they are of particular interest. A description of each segment according to the present invention is now provided.

Segment cluster T10374_node_2 (SEQ ID NO:3714) according to the present invention is supported by 3 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3529 below describes the starting and ending position of this segment on each transcript.

TABLE 3529

Segment location on transcripts

| Transcript name | Segment starting position | Segment ending position |
|---|---|---|
| T10374_T16 (SEQ ID NO: 3711) | 1 | 296 |
| T10374_T24 (SEQ ID NO: 3712) | 1 | 296 |
| T10374_T27 (SEQ ID NO: 3713) | 1 | 296 |

This segment can be found in a non-coding region of transcript(s) that are related to the following protein(s): T10374_P2, T10374_P6 and T10374_P9.

Segment cluster T10374_node_3 (SEQ ID NO:3715) according to the present invention is supported by 47 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3530 below describes the starting and ending position of this segment on each transcript.

TABLE 3530

Segment location on transcripts

| Transcript name | Segment starting position | Segment ending position |
|---|---|---|
| T10374_T16 (SEQ ID NO: 3711) | 297 | 562 |
| T10374_T24 (SEQ ID NO: 3712) | 297 | 562 |
| T10374_T27 (SEQ ID NO: 3713) | 297 | 562 |

This segment can be found in a non-coding region of transcript(s) that are related to the following protein(s): T10374_P2, T10374_P6 and T10374_P9.

Segment cluster T10374_node_19 (SEQ ID NO:3716) according to the present invention is supported by 82 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3531 below describes the starting and ending position of this segment on each transcript.

TABLE 3531

Segment location on transcripts

| Transcript name | Segment starting position | Segment ending position |
|---|---|---|
| T10374_T16 (SEQ ID NO: 3711) | 678 | 892 |
| T10374_T24 (SEQ ID NO: 3712) | 678 | 892 |
| T10374_T27 (SEQ ID NO: 3713) | 678 | 892 |

This segment can be found in both coding and non-coding regions of transcript(s) as follows. The segment can be found in a non-coding region of transcript(s) that are related to the following protein(s): T10374_P2 and T10374_P9. This segment can also be found in the following protein(s): T10374_P6, since it is in the coding region for the corresponding transcript.

Segment cluster T10374_node_27 (SEQ ID NO:3717) according to the present invention is supported by 2 libraries. The number of libraries was determined as previously described. This segment can be found in the following transcript(s): T10374_T16 (SEQ ID NO:3711) and T10374_T27 (SEQ ID NO:3713). Table 3532 below describes the starting and ending position of this segment on each transcript.

TABLE 3532

Segment location on transcripts

| Transcript name | Segment starting position | Segment ending position |
|---|---|---|
| T10374_T16 (SEQ ID NO: 3711) | 1085 | 1260 |
| T10374_T27 (SEQ ID NO: 3713) | 1085 | 1260 |

This segment can be found in a non-coding region of transcript(s) that are related to the following protein(s): T10374_P2 and T10374_P9.

Segment cluster T10374_node_51 (SEQ ID NO:3718) according to the present invention is supported by 56 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3533 below describes the starting and ending position of this segment on each transcript.

TABLE 3533

| Segment location on transcripts | | |
|---|---|---|
| Transcript name | Segment starting position | Segment ending position |
| T10374_T16 (SEQ ID NO: 3711) | 2069 | 2210 |
| T10374_T24 (SEQ ID NO: 3712) | 1893 | 2034 |
| T10374_T27 (SEQ ID NO: 3713) | 2069 | 2210 |

This segment can be found in the following protein(s): T10374_P2, T10374_P6 and T10374_P9.

Segment cluster T10374_node_57 (SEQ ID NO:3719) according to the present invention is supported by 6 libraries. The number of libraries was determined as previously described. This segment can be found in the following transcript(s): T10374_T24 (SEQ ID NO:3712) and T10374_T27 (SEQ ID NO:3713). Table 3534 below describes the starting and ending position of this segment on each transcript.

TABLE 3534

| Segment location on transcripts | | |
|---|---|---|
| Transcript name | Segment starting position | Segment ending position |
| T10374_T24 (SEQ ID NO: 3712) | 2133 | 3868 |
| T10374_T27 (SEQ ID NO: 3713) | 2309 | 4044 |

This segment can be found in the following protein(s): T10374_P6 and T10374_P9.

Segment cluster T10374_node_60 (SEQ ID NO:3720) according to the present invention is supported by 276 libraries. The number of libraries was determined as previously described. This segment can be found in the following transcript(s): T10374_T16 (SEQ ID NO:3711). Table 3535 below describes the starting and ending position of this segment on each transcript.

TABLE 3535

| Segment location on transcripts | | |
|---|---|---|
| Transcript name | Segment starting position | Segment ending position |
| T10374_T16 (SEQ ID NO: 3711) | 2309 | 6036 |

This segment can be found in the following protein(s): T10374_P2.

Segment cluster T10374_node_63 (SEQ ID NO:3721) according to the present invention is supported by 70 libraries. The number of libraries was determined as previously described. This segment can be found in the following transcript(s): T10374_T16 (SEQ ID NO:3711). Table 3536 below describes the starting and ending position of this segment on each transcript.

TABLE 3536

| Segment location on transcripts | | |
|---|---|---|
| Transcript name | Segment starting position | Segment ending position |
| T10374_T16 (SEQ ID NO: 3711) | 6122 | 6297 |

This segment can be found in a non-coding region of transcript(s) that are related to the following protein(s): T10374_P2.

Segment cluster T10374_node_65 (SEQ ID NO:3722) according to the present invention is supported by 330 libraries. The number of libraries was determined as previously described. This segment can be found in the following transcript(s): T10374_T16 (SEQ ID NO:3711). Table 3537 below describes the starting and ending position of this segment on each transcript.

TABLE 3537

| Segment location on transcripts | | |
|---|---|---|
| Transcript name | Segment starting position | Segment ending position |
| T10374_T16 (SEQ ID NO: 3711) | 6384 | 7909 |

This segment can be found in a non-coding region of transcript(s) that are related to the following protein(s): T10374_P2.

Segment cluster T10374_node_67 (SEQ ID NO:3723) according to the present invention is supported by 157 libraries. The number of libraries was determined as previously described. This segment can be found in the following transcript(s): T10374_T16 (SEQ ID NO:3711). Table 3538 below describes the starting and ending position of this segment on each transcript.

TABLE 3538

| Segment location on transcripts | | |
|---|---|---|
| Transcript name | Segment starting position | Segment ending position |
| T10374_T16 (SEQ ID NO: 3711) | 7965 | 8315 |

This segment can be found in a non-coding region of transcript(s) that are related to the following protein(s): T10374_P2.

According to an optional embodiment of the present invention, short segments related to the above cluster are also provided. These segments are up to about 120 bp in length, and so are included in a separate description.

Segment cluster T10374_node_16 (SEQ ID NO:3724) according to the present invention is supported by 60 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3539 below describes the starting and ending position of this segment on each transcript.

TABLE 3539

Segment location on transcripts

| Transcript name | Segment starting position | Segment ending position |
|---|---|---|
| T10374_T16 (SEQ ID NO: 3711) | 563 | 677 |
| T10374_T24 (SEQ ID NO: 3712) | 563 | 677 |
| T10374_T27 (SEQ ID NO: 3713) | 563 | 677 |

This segment can be found in a non-coding region of transcript(s) that are related to the following protein(s): T10374_P2, T10374_P6 and T10374_P9.

Segment cluster T10374_node_23 (SEQ ID NO:3725) according to the present invention is supported by 64 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3540 below describes the starting and ending position of this segment on each transcript.

TABLE 3540

Segment location on transcripts

| Transcript name | Segment starting position | Segment ending position |
|---|---|---|
| T10374_T16 (SEQ ID NO: 3711) | 893 | 968 |
| T10374_T24 (SEQ ID NO: 3712) | 893 | 968 |
| T10374_T27 (SEQ ID NO: 3713) | 893 | 968 |

This segment can be found in both coding and non-coding regions of transcript(s) as follows. The segment can be found in a non-coding region of transcript(s) that are related to the following protein(s): T10374_P2 and T10374_P9. This segment can also be found in the following protein(s): T10374_P6, since it is in the coding region for the corresponding transcript.

Segment cluster T10374_node_25 (SEQ ID NO:3726) according to the present invention is supported by 60 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3541 below describes the starting and ending position of this segment on each transcript.

TABLE 3541

Segment location on transcripts

| Transcript name | Segment starting position | Segment ending position |
|---|---|---|
| T10374_T16 (SEQ ID NO: 3711) | 969 | 1084 |
| T10374_T24 (SEQ ID NO: 3712) | 969 | 1084 |
| T10374_T27 (SEQ ID NO: 3713) | 969 | 1084 |

This segment can be found in both coding and non-coding regions of transcript(s) as follows. The segment can be found in a non-coding region of transcript(s) that are related to the following protein(s): T10374_P2 and T10374_P9. This segment can also be found in the following protein(s): T10374_P6, since it is in the coding region for the corresponding transcript.

Segment cluster T10374_node_29 (SEQ ID NO:3727) according to the present invention is supported by 48 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3542 below describes the starting and ending position of this segment on each transcript.

TABLE 3542

Segment location on transcripts

| Transcript name | Segment starting position | Segment ending position |
|---|---|---|
| T10374_T16 (SEQ ID NO: 3711) | 1261 | 1334 |
| T10374_T24 (SEQ ID NO: 3712) | 1085 | 1158 |
| T10374_T27 (SEQ ID NO: 3713) | 1261 | 1334 |

This segment can be found in both coding and non-coding regions of transcript(s) as follows. The segment can be found in a non-coding region of transcript(s) that are related to the following protein(s): T10374_P2 and T10374_P9. This segment can also be found in the following protein(s): T10374_P6, since it is in the coding region for the corresponding transcript.

Segment cluster T10374_node_31 (SEQ ID NO:3728) according to the present invention is supported by 46 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3543 below describes the starting and ending position of this segment on each transcript.

TABLE 3543

Segment location on transcripts

| Transcript name | Segment starting position | Segment ending position |
|---|---|---|
| T10374_T16 (SEQ ID NO: 3711) | 1335 | 1427 |
| T10374_T24 (SEQ ID NO: 3712) | 1159 | 1251 |
| T10374_T27 (SEQ ID NO: 3713) | 1335 | 1427 |

This segment can be found in the following protein(s): T10374_P2, T10374_P6 and T10374_P9.

Segment cluster T10374_node_33 (SEQ ID NO:3729) according to the present invention is supported by 49 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3544 below describes the starting and ending position of this segment on each transcript.

TABLE 3544

Segment location on transcripts

| Transcript name | Segment starting position | Segment ending position |
|---|---|---|
| T10374_T16 (SEQ ID NO: 3711) | 1428 | 1509 |
| T10374_T24 (SEQ ID NO: 3712) | 1252 | 1333 |
| T10374_T27 (SEQ ID NO: 3713) | 1428 | 1509 |

This segment can be found in the following protein(s): T10374_P2, T10374_P6 and T10374_P9.

Segment cluster T10374_node_35 (SEQ ID NO:3730) according to the present invention is supported by 48 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3545 below describes the starting and ending position of this segment on each transcript.

TABLE 3545

| | Segment location on transcripts | |
|---|---|---|
| Transcript name | Segment starting position | Segment ending position |
| T10374_T16 (SEQ ID NO: 3711) | 1510 | 1592 |
| T10374_T24 (SEQ ID NO: 3712) | 1334 | 1416 |
| T10374_T27 (SEQ ID NO: 3713) | 1510 | 1592 |

This segment can be found in the following protein(s): T10374_P2, T10374_P6 and T10374_P9.

Segment cluster T10374_node_38 (SEQ ID NO:3731) according to the present invention is supported by 45 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3546 below describes the starting and ending position of this segment on each transcript.

TABLE 3546

| | Segment location on transcripts | |
|---|---|---|
| Transcript name | Segment starting position | Segment ending position |
| T10374_T16 (SEQ ID NO: 3711) | 1593 | 1651 |
| T10374_T24 (SEQ ID NO: 3712) | 1417 | 1475 |
| T10374_T27 (SEQ ID NO: 3713) | 1593 | 1651 |

This segment can be found in the following protein(s): T10374_P2, T10374_P6 and T10374_P9.

Segment cluster T10374_node_40 (SEQ ID NO:3732) according to the present invention is supported by 47 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3547 below describes the starting and ending position of this segment on each transcript.

TABLE 3547

| | Segment location on transcripts | |
|---|---|---|
| Transcript name | Segment starting position | Segment ending position |
| T10374_T16 (SEQ ID NO: 3711) | 1652 | 1768 |
| T10374_T24 (SEQ ID NO: 3712) | 1476 | 1592 |
| T10374_T27 (SEQ ID NO: 3713) | 1652 | 1768 |

This segment can be found in the following protein(s): T10374_P2, T10374_P6 and T10374_P9.

Segment cluster T10374_node_42 (SEQ ID NO:3733) according to the present invention is supported by 46 libraries. The number of libraries was determined as previously described. This segment can be found in the following transcript(s): T10374_T16 (SEQ ID NO:3711), T10374_T24 (SEQ ID. NO:3712) and T10374_T27 (SEQ ID NO:3713). Table 3548 below describes the starting and ending position of this segment on each transcript.

TABLE 3548

| | Segment location on transcripts | |
|---|---|---|
| Transcript name | Segment starting position | Segment ending position |
| T10374_T16 (SEQ ID NO: 3711) | 1769 | 1848 |
| T10374_T24 (SEQ ID NO: 3712) | 1593 | 1672 |
| T10374_T27 (SEQ ID NO: 3713) | 1769 | 1848 |

This segment can be found in the following protein(s): T10374_P2, T10374_P6 and T10374_P9.

Segment cluster T10374_node_46 (SEQ ID NO:3734) according to the present invention is supported by 52 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3549 below describes the starting and ending position of this segment on each transcript.

TABLE 3549

| | Segment location on transcripts | |
|---|---|---|
| Transcript name | Segment starting position | Segment ending position |
| T10374_T16 (SEQ ID NO: 3711) | 1849 | 1949 |
| T10374_T24 (SEQ ID NO: 3712) | 1673 | 1773 |
| T10374_T27 (SEQ ID NO: 3713) | 1849 | 1949 |

This segment can be found in the following protein(s): T10374_P2, T10374_P6 and T10374_P9.

Segment cluster T10374_node_49 (SEQ ID NO:3735) according to the present invention is supported by 52 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3550 below describes the starting and ending position of this segment on each transcript.

TABLE 3550

| | Segment location on transcripts | |
|---|---|---|
| Transcript name | Segment starting position | Segment ending position |
| T10374_T16 (SEQ ID NO: 3711) | 1950 | 2068 |
| T10374_T24 (SEQ ID NO: 3712) | 1774 | 1892 |
| T10374_T27 (SEQ ID NO: 3713) | 1950 | 2068 |

This segment can be found in the following protein(s): T10374_P2, T10374_P6 and T10374_P9.

Segment cluster T10374_node_53 (SEQ ID NO:3736) according to the present invention is supported by 53 libraries. The number of libraries was determined as previously described. This segment can be found in the following transcript(s): T10374_T16 (SEQ ID NO:3711), T10374_T24 (SEQ ID NO:3712) and T10374_T27 (SEQ ID NO:3713). Table 3551 below describes the starting and ending position of this segment on each transcript.

TABLE 3551

Segment location on transcripts

| Transcript name | Segment starting position | Segment ending position |
|---|---|---|
| T10374_T16 (SEQ ID NO: 3711) | 2211 | 2308 |
| T10374_T24 (SEQ ID NO: 3712) | 2035 | 2132 |
| T10374_T27 (SEQ ID NO: 3713) | 2211 | 2308 |

This segment can be found in the following protein(s): T10374_P2, T10374_P6 and T10374_P9.

Segment cluster T10374_node_61 (SEQ ID NO:3737) according to the present invention is supported by 64 libraries. The number of libraries was determined as previously described. This segment can be found in the following transcript(s): T10374_T16 (SEQ ID NO:3711). Table 3552 below describes the starting and ending position of this segment on each transcript.

TABLE 3552

Segment location on transcripts

| Transcript name | Segment starting position | Segment ending position |
|---|---|---|
| T10374_T16 (SEQ ID NO: 3711) | 6037 | 6121 |

This segment can be found in a non-coding region of transcript(s) that are related to the following protein(s): T10374_P2.

Segment cluster T10374_node_64 (SEQ ID NO:3738) according to the present invention is supported by 70 libraries. The number of libraries was determined as previously described. This segment can be found in the following transcript(s): T10374_T16 (SEQ ID NO:3711). Table 3553 below describes the starting and ending position of this segment on each transcript.

TABLE 3553

Segment location on transcripts

| Transcript name | Segment starting position | Segment ending position |
|---|---|---|
| T10374_T16 (SEQ ID NO: 3711) | 6298 | 6383 |

This segment can be found in a non-coding region of transcript(s) that are related to the following protein(s): T10374_P2.

Segment cluster T10374_node_66 (SEQ ID NO:3739) according to the present invention is supported by 131 libraries. The number of libraries was determined as previously described. This segment can be found in the following transcript(s): T10374_T16 (SEQ ID NO:3711). Table 3554 below describes the starting and ending position of this segment on each transcript.

TABLE 3554

Segment location on transcripts

| Transcript name | Segment starting position | Segment ending position |
|---|---|---|
| T10374_T16 (SEQ ID NO: 3711) | 7910 | 7964 |

This segment can be found in a non-coding region of transcript(s) that are related to the following protein(s): T10374_P2.

Description for Cluster T11832

Cluster T11832 features 8 transcript(s) and 37 segment(s) of interest, the names for which are given in Tables 3555 and 3556, respectively, the sequences themselves are given at the end of the application. The selected protein variants are given in Table 3557.

TABLE 3555

Transcripts of interest
Transcript Name

T11832_T2 (SEQ ID NO: 3740)
T11832_T5 (SEQ ID NO: 3741)
T11832_T6 (SEQ ID NO: 3742)
T11832_T7 (SEQ ID NO: 3743)
T11832_T9 (SEQ ID NO: 3744)
T11832_T10 (SEQ ID NO: 3745)
T11832_T12 (SEQ ID NO: 3746)
T11832_T14 (SEQ ID NO: 3747)

TABLE 3556

Segments of interest
Segment Name

T11832_node_0 (SEQ ID NO: 3748)
T11832_node_3 (SEQ ID NO: 3749)
T11832_node_5 (SEQ ID NO: 3750)
T11832_node_13 (SEQ ID NO: 3751)
T11832_node_14 (SEQ ID NO: 3752)
T11832_node_17 (SEQ ID NO: 3753)
T11832_node_20 (SEQ ID NO: 3754)
T11832_node_22 (SEQ ID NO: 3755)
T11832_node_27 (SEQ ID NO: 3756)
T11832_node_31 (SEQ ID NO: 3757)
T11832_node_33 (SEQ ID NO: 3758)
T11832_node_34 (SEQ ID NO: 3759)
T11832_node_36 (SEQ ID NO: 3760)
T11832_node_48 (SEQ ID NO: 3761)
T11832_node_57 (SEQ ID NO: 3762)
T11832_node_59 (SEQ ID NO: 3763)
T11832_node_62 (SEQ ID NO: 3764)
T11832_node_64 (SEQ ID NO: 3765)
T11832_node_65 (SEQ ID NO: 3766)
T11832_node_66 (SEQ ID NO: 3767)
T11832_node_67 (SEQ ID NO: 3768)
T11832_node_1 (SEQ ID NO: 3769)
T11832_node_7 (SEQ ID NO: 3770)
T11832_node_9 (SEQ ID NO: 3771)
T11832_node_11 (SEQ ID NO: 3772)
T11832_node_15 (SEQ ID NO: 3773)
T11832_node_29 (SEQ ID NO: 3774)
T11832_node_38 (SEQ ID NO: 3775)
T11832_node_39 (SEQ ID NO: 3776)
T11832_node_40 (SEQ ID NO: 3777)
T11832_node_41 (SEQ ID NO: 3778)
T11832_node_43 (SEQ ID NO: 3779)
T11832_node_50 (SEQ ID NO: 3780)
T11832_node_52 (SEQ ID NO: 3781)
T11832_node_54 (SEQ ID NO: 3782)
T11832_node_56 (SEQ ID NO: 3783)
T11832_node_60 (SEQ ID NO: 3784)

TABLE 3557

Proteins of interest

| Protein Name | Corresponding Transcript(s) |
|---|---|
| T11832_P2 | T11832_T2 (SEQ ID NO: 3740) |
| T11832_P4 | T11832_T6 (SEQ ID NO: 3742) |
| T11832_P5 | T11832_T7 (SEQ ID NO: 3743) |
| T11832_P6 | T11832_T14 (SEQ ID NO: 3747) |
| T11832_P7 | T11832_T10 (SEQ ID NO: 3745) |

Cluster T11832 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 88 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 88 and Table 3558. This cluster is overexpressed (at least at a minimum level) in the following pathological conditions: epithelial malignant tumors and a mixture of malignant tumors from different tissues.

TABLE 3558

Normal tissue distribution

| Name of Tissue | Number |
|---|---|
| adrenal | 0 |
| bladder | 0 |
| bone | 0 |
| brain | 7 |
| colon | 0 |
| epithelial | 16 |
| general | 21 |
| head and neck | 0 |
| kidney | 0 |
| liver | 9 |
| lung | 12 |
| lymph nodes | 99 |
| breast | 43 |
| bone marrow | 125 |
| ovary | 36 |
| prostate | 4 |
| skin | 40 |
| stomach | 36 |
| uterus | 0 |

TABLE 3559

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 5.3e−01 | 1.9 |
| bladder | 5.4e−01 | 1.8e−01 | 3.2e−01 | 2.5 | 1.5e−01 | 3.3 |
| bone | 1 | 1.7e−01 | 1 | 1.0 | 1.7e−01 | 2.9 |
| brain | 7.6e−01 | 6.2e−01 | 1 | 0.4 | 7.0e−01 | 1.0 |
| colon | 1.7e−01 | 1.1e−01 | 4.9e−01 | 2.2 | 3.5e−01 | 2.2 |
| epithelial | 9.9e−03 | 1.3e−03 | 6.9e−02 | 1.7 | 1.7e−02 | 1.8 |
| general | 3.0e−02 | 9.3e−05 | 2.8e−01 | 1.2 | 8.5e−06 | 1.6 |
| head and neck | 1.2e−01 | 1.1e−01 | 1 | 1.2 | 7.5e−01 | 1.4 |
| kidney | 4.1e−01 | 3.5e−01 | 3.4e−01 | 2.5 | 2.4e−01 | 2.8 |
| liver | 9.1e−01 | 6.0e−01 | 1 | 0.8 | 1 | 0.9 |
| lung | 3.2e−01 | 4.8e−01 | 3.7e−01 | 2.2 | 5.1e−01 | 1.5 |
| lymph nodes | 5.4e−01 | 7.4e−01 | 6.4e−01 | 1.0 | 7.9e−01 | 0.6 |
| breast | 9.5e−01 | 7.5e−01 | 1 | 0.5 | 9.7e−01 | 0.7 |

TABLE 3559-continued

P values and ratios for expression in cancerous tissue

| Name of Tissue | P1 | P2 | SP1 | R3 | SP2 | R4 |
|---|---|---|---|---|---|---|
| bone marrow | 8.6e−01 | 7.2e−01 | 1 | 0.2 | 7.4e−05 | 0.7 |
| ovary | 3.5e−01 | 4.1e−01 | 3.8e−01 | 1.7 | 5.7e−01 | 1.3 |
| prostate | 9.7e−01 | 9.3e−01 | 1 | 0.8 | 7.5e−01 | 1.1 |
| skin | 9.2e−01 | 6.8e−01 | 1 | 0.2 | 7.9e−01 | 0.5 |
| stomach | 3.5e−01 | 4.1e−01 | 1 | 0.6 | 8.2e−01 | 0.9 |
| uterus | 4.1e−02 | 5.4e−02 | 1.3e−01 | 3.6 | 5.6e−02 | 3.3 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 3560.

TABLE 3560

Oligonucleotides related to this cluster

| Oligonucleotide name | Overexpressed in cancers | Chip reference |
|---|---|---|
| T11832_0_0_45266 | lung malignant tumors | LUN |

As noted above, cluster T11832 features 37 segment(s), which were listed in Table 3556 above and for which the sequence(s) are given at the end of the application. These segment(s) are portions of nucleic acid sequence(s) which are described herein separately because they are of particular interest. A description of each segment according to the present invention is now provided.

Segment cluster T11832_node_0 (SEQ ID NO:3748) according to the present invention is supported by 16 libraries. The number of libraries was determined as previously described. This segment can be found in the following transcript(s): T11832_T7 (SEQ ID NO:3743) and T11832_T14 (SEQ ID NO:3747). Table 3561 below describes the starting and ending position of this segment on each transcript.

TABLE 3561

Segment location on transcripts

| Transcript name | Segment starting position | Segment ending position |
|---|---|---|
| T11832_T7 (SEQ ID NO: 3743) | 1 | 129 |
| T11832_T14 (SEQ ID NO: 3747) | 1 | 129 |

This segment can be found in a non-coding region of transcript(s) that are related to the following protein(s): T11832_P5 and T11832_P6.

Segment cluster T11832_node_3 (SEQ ID NO:3749) according to the present invention is supported by 17 libraries. The number of libraries was determined as previously described. This segment can be found in the following transcript(s): T11832_T7 (SEQ ID NO:3743) and T11832_T14 (SEQ ID NO:3747). Table 3562 below describes the starting and ending position of this segment on each transcript.

TABLE 3562

| Transcript name | Segment location on transcripts | |
|---|---|---|
| | Segment starting position | Segment ending position |
| T11832_T7 (SEQ ID NO: 3743) | 175 | 296 |
| T11832_T14 (SEQ ID NO: 3747) | 175 | 296 |

This segment can be found in the following protein(s): T11832_P5 and T11832_P6.

Segment cluster T11832_node_5 (SEQ ID NO:3750) according to the present invention is supported by 19 libraries. The number of libraries was determined as previously described. This segment can be found in the following transcript(s): T11832_T7 (SEQ ID NO:3743) and T11832_T14 (SEQ ID NO:3747). Table 3563 below describes the starting and ending position of this segment on each transcript.

TABLE 3563

| Transcript name | Segment location on transcripts | |
|---|---|---|
| | Segment starting position | Segment ending position |
| T11832_T7 (SEQ ID NO: 3743) | 297 | 419 |
| T11832_T14 (SEQ ID NO: 3747) | 297 | 419 |

This segment can be found in the following protein(s): T11832_P5 and T11832_P6.

Segment cluster T11832_node_13 (SEQ ID NO:3751) according to the present invention is supported by 7 libraries. The number of libraries was determined as previously described. This segment can be found in the following transcript(s): T11832_T2 (SEQ ID NO:3740). Table 3564 below describes the starting and ending position of this segment on each transcript.

TABLE 3564

| Transcript name | Segment location on transcripts | |
|---|---|---|
| | Segment starting position | Segment ending position |
| T11832_T2 (SEQ ID NO: 3740) | 1 | 2516 |

This segment can be found in a non-coding region of transcript(s) that are related to the following protein(s): T11832_P2.

Segment cluster T11832_node_14 (SEQ ID NO:3752) according to the present invention is supported by 7 libraries. The number of libraries was determined as previously described. This segment can be found in the following transcript(s): T11832_T2 (SEQ ID NO:3740). Table 3565 below describes the starting and ending position of this segment on each transcript.

TABLE 3565

| Transcript name | Segment location on transcripts | |
|---|---|---|
| | Segment starting position | Segment ending position |
| T11832_T2 (SEQ ID NO: 3740) | 2517 | 3117 |

This segment can be found in a non-coding region of transcript(s) that are related to the following protein(s): T11832_P2.

Segment cluster T11832_node_17 (SEQ ID NO:3753) according to the present invention is supported by 18 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3566 below describes the starting and ending position of this segment on each transcript.

TABLE 3566

| Transcript name | Segment location on transcripts | |
|---|---|---|
| | Segment starting position | Segment ending position |
| T11832_T2 (SEQ ID NO: 3740) | 3160 | 3387 |
| T11832_T7 (SEQ ID NO: 3743) | 621 | 848 |
| T11832_T14 (SEQ ID NO: 3747) | 621 | 848 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 3567.

TABLE 3567

| Oligonucleotides related to this segment | | |
|---|---|---|
| Oligonucleotide name | Overexpressed in cancers | Chip reference |
| T11832_0_19_0 | lung malignant tumors | LUN |

This segment can be found in the following protein(s): T11832_P2, T11832_P5 and T11832_P6.

Segment cluster T11832_node_20 (SEQ ID NO:3754) according to the present invention is supported by 10 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3568 below describes the starting and ending position of this segment on each transcript.

TABLE 3568

| Transcript name | Segment location on transcripts | |
|---|---|---|
| | Segment starting position | Segment ending position |
| T11832_T2 (SEQ ID NO: 3740) | 3388 | 3570 |
| T11832_T7 (SEQ ID NO: 3743) | 849 | 1031 |
| T11832_T14 (SEQ ID NO: 3747) | 849 | 1031 |

This segment can be found in the following protein(s): T11832_P2, T11832_P5 and T11832_P6.

Segment cluster T11832_node_22 (SEQ ID NO:3755) according to the present invention is supported by 10 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3569 below describes the starting and ending position of this segment on each transcript.

TABLE 3569

Segment location on transcripts

| Transcript name | Segment starting position | Segment ending position |
|---|---|---|
| T11832_T2 (SEQ ID NO: 3740) | 3571 | 3714 |
| T11832_T7 (SEQ ID NO: 3743) | 1032 | 1175 |
| T11832_T14 (SEQ ID NO: 3747) | 1032 | 1175 |

This segment can be found in the following protein(s): T11832_P2, T11832_P5 and T11832_P6.

Segment cluster T11832_node_27 (SEQ ID NO:3756) according to the present invention is supported by 11 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3570 below describes the starting and ending position of this segment on each transcript.

TABLE 3570

Segment location on transcripts

| Transcript name | Segment starting position | Segment ending position |
|---|---|---|
| T11832_T2 (SEQ ID NO: 3740) | 3715 | 3911 |
| T11832_T7 (SEQ ID NO: 3743) | 1176 | 1372 |
| T11832_T14 (SEQ ID NO: 3747) | 1176 | 1372 |

This segment can be found in the following protein(s): T11832_P2, T11832_P5 and T11832_P6.

Segment cluster T11832_node_31 (SEQ ID NO:3757) according to the present invention is supported by 11 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3571 below describes the starting and ending position of this segment on each transcript.

TABLE 3571

Segment location on transcripts

| Transcript name | Segment starting position | Segment ending position |
|---|---|---|
| T11832_T2 (SEQ ID NO: 3740) | 4009 | 4170 |
| T11832_T7 (SEQ ID NO: 3743) | 1470 | 1631 |
| T11832_T14 (SEQ ID NO: 3747) | 1470 | 1631 |

This segment can be found in the following protein(s): T11832_P2, T11832_P5 and T11832_P6.

Segment cluster T11832_node_33 (SEQ ID NO:3758) according to the present invention is supported by 2 libraries. The number of libraries was determined as previously described. This segment can be found in the following transcript(s): T11832_T6 (SEQ ID NO:3742) and T11832_T10 (SEQ ID NO:3745). Table 3572 below describes the starting and ending position of this segment on each transcript.

TABLE 3572

Segment location on transcripts

| Transcript name | Segment starting position | Segment ending position |
|---|---|---|
| T11832_T6 (SEQ ID NO: 3742) | 1 | 630 |
| T11832_T10 (SEQ ID NO: 3745) | 1 | 630 |

This segment can be found in a non-coding region of transcript(s) that are related to the following protein(s): T11832_P4 and T11832_P7.

Segment cluster T11832_node_34 (SEQ ID NO:3759) according to the present invention is supported by 20 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3573 below describes the starting and ending position of this segment on each transcript.

TABLE 3573

Segment location on transcripts

| Transcript name | Segment starting position | Segment ending position |
|---|---|---|
| T11832_T2 (SEQ ID NO: 3740) | 4171 | 4310 |
| T11832_T6 (SEQ ID NO: 3742) | 631 | 770 |
| T11832_T7 (SEQ ID NO: 3743) | 1632 | 1771 |
| T11832_T10 (SEQ ID NO: 3745) | 631 | 770 |
| T11832_T14 (SEQ ID NO: 3747) | 1632 | 1771 |

This segment can be found in both coding and non-coding regions of transcript(s) as follows. The segment can be found in a non-coding region of transcript(s) that are related to the following protein(s): T11832_P4 and T11832_P7. This segment can also be found in the following protein(s): T11832_P2, T11832_P5 and T11832_P6, since it is in the coding region for the corresponding transcript.

Segment cluster T11832_node_36 (SEQ ID NO:3760) according to the present invention is supported by 21 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3574 below describes the starting and ending position of this segment on each transcript.

TABLE 3574

Segment location on transcripts

| Transcript name | Segment starting position | Segment ending position |
|---|---|---|
| T11832_T2 (SEQ ID NO: 3740) | 4311 | 4449 |
| T11832_T6 (SEQ ID NO: 3742) | 771 | 909 |
| T11832_T7 (SEQ ID NO: 3743) | 1772 | 1910 |
| T11832_T10 (SEQ ID NO: 3745) | 771 | 909 |
| T11832_T14 (SEQ ID NO: 3747) | 1772 | 1910 |

This segment can be found in both coding and non-coding regions of transcript(s) as follows. The segment can be found in a non-coding region of transcript(s) that are related to the following protein(s): T11832_P7. This segment can also be found in the following protein(s): T11832_P2, T11832_P4, T11832_P5 and T11832_P6, since it is in the coding region for the corresponding transcript.

Segment cluster T11832_node_48 (SEQ ID NO:3761) according to the present invention is supported by 27 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3575 below describes the starting and ending position of this segment on each transcript.

TABLE 3575

Segment location on transcripts

| Transcript name | Segment starting position | Segment ending position |
|---|---|---|
| T11832_T2 (SEQ ID NO: 3740) | 4771 | 4930 |
| T11832_T6 (SEQ ID NO: 3742) | 1231 | 1390 |
| T11832_T7 (SEQ ID NO: 3743) | 2314 | 2473 |
| T11832_T10 (SEQ ID NO: 3745) | 1313 | 1472 |
| T11832_T14 (SEQ ID NO: 3747) | 2232 | 2391 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node_57 (SEQ ID NO:3762) according to the present invention is supported by 44 libraries. The number of libraries was determined as previously described. This segment can be found in the following transcript(s): T11832_T14 (SEQ ID NO:3747). Table 3576 below describes the starting and ending position of this segment on each transcript.

TABLE 3576

Segment location on transcripts

| Transcript name | Segment starting position | Segment ending position |
|---|---|---|
| T11832_T14 (SEQ ID NO: 3747) | 2650 | 3443 |

This segment can be found in the following protein(s): T11832_P6.

Segment cluster T11832_node_59 (SEQ ID NO:3763) according to the present invention is supported by 42 libraries. The number of libraries was determined as previously described. This segment can be found in the following transcript(s): T11832_T5 (SEQ ID NO:3741). Table 3577 below describes the starting and ending position of this segment on each transcript.

TABLE 3577

Segment location on transcripts

| Transcript name | Segment starting position | Segment ending position |
|---|---|---|
| T11832_T5 (SEQ ID NO: 3741) | 1 | 4402 |

The previously-described transcripts for these segment(s) do not code for protein.

Segment cluster T11832_node_62 (SEQ ID NO:3764) according to the present invention is supported by 7 libraries. The number of libraries was determined as previously described. This segment can be found in the following transcript(s): T11832_T12 (SEQ ID NO:3746). Table 3578 below describes the starting and ending position of this segment on each transcript.

TABLE 3578

Segment location on transcripts

| Transcript name | Segment starting position | Segment ending position |
|---|---|---|
| T11832_T12 (SEQ ID NO: 3746) | 1 | 850 |

The previously-described transcripts for these segment(s) do not code for protein.

Segment cluster T11832_node_64 (SEQ ID NO:3765) according to the present invention is supported by 23 libraries. The number of libraries was determined as previously described. This segment can be found in the following transcript(s): T11832_T9 (SEQ ID NO:3744). Table 3579 below describes the starting and ending position of this segment on each transcript.

TABLE 3579

Segment location on transcripts

| Transcript name | Segment starting position | Segment ending position |
|---|---|---|
| T11832_T9 (SEQ ID NO: 3744) | 1 | 818 |

The previously-described transcripts for these segment(s) do not code for protein.

Segment cluster T11832_node_65 (SEQ ID NO:3766) according to the present invention is supported by 32 libraries. The number of libraries was determined as previously described. This segment can be found in the following transcript(s): T11832_T2 (SEQ ID NO:3740), T11832_T5 (SEQ ID NO:3741), T11832_T6 (SEQ ID NO:3742), T11832_T7 (SEQ ID NO:3743), T11832_T9 (SEQ ID NO:3744) and T11832_T10 (SEQ ID NO:3745). Table 3580 below describes the starting and ending position of this segment on each transcript.

TABLE 3580

Segment location on transcripts

| Transcript name | Segment starting position | Segment ending position |
|---|---|---|
| T11832_T2 (SEQ ID NO: 3740) | 5306 | 5781 |
| T11832_T5 (SEQ ID NO: 3741) | 4520 | 4995 |
| T11832_T6 (SEQ ID NO: 3742) | 1766 | 2241 |
| T11832_T7 (SEQ ID NO: 3743) | 2849 | 3324 |
| T11832_T9 (SEQ ID NO: 3744) | 819 | 1294 |
| T11832_T10 (SEQ ID NO: 3745) | 1848 | 2323 |

This segment can be found in a non-coding region of transcript(s) that are related to the following protein(s): T11832_P2, T11832_P4, T11832_P5 and T11832_P7.

Segment cluster T11832_node_66 (SEQ ID NO:3767) according to the present invention is supported by 20 libraries. The number of libraries was determined as previously described. This segment can be found in the following transcript(s): T11832_T2 (SEQ ID NO:3740), T11832_T5 (SEQ ID NO:3741), T11832_T6 (SEQ ID NO:3742), T11832_T7 (SEQ ID NO:3743), T11832_T9 (SEQ ID NO:3744), T11832_T10 (SEQ ID NO:3745) and T11832_T12 (SEQ ID NO:3746). Table 3581 below describes the starting and ending position of this segment on each transcript.

TABLE 3581

Segment location on transcripts

| Transcript name | Segment starting position | Segment ending position |
|---|---|---|
| T11832_T2 (SEQ ID NO: 3740) | 5782 | 6251 |
| T11832_T5 (SEQ ID NO: 3741) | 4996 | 5465 |
| T11832_T6 (SEQ ID NO: 3742) | 2242 | 2711 |
| T11832_T7 (SEQ ID NO: 3743) | 3325 | 3794 |
| T11832_T9 (SEQ ID NO: 3744) | 1295 | 1764 |
| T11832_T10 (SEQ ID NO: 3745) | 2324 | 2793 |
| T11832_T12 (SEQ ID NO: 3746) | 851 | 1320 |

This segment can be found in a non-coding region of transcript(s) that are related to the following protein(s): T11832_P2, T11832_P4, T11832_P5 and T11832_P7.

Segment cluster T11832_node_67 (SEQ ID NO:3768) according to the present invention is supported by 96 libraries. The number of libraries was determined as previously described. This segment can be found in the following transcript(s): T11832_T2 (SEQ ID NO:3740), T11832_T5 (SEQ ID NO:3741), T11832_T6 (SEQ ID NO:3742), T11832_T7 (SEQ ID NO:3743), T11832_T9 (SEQ ID NO:3744), T11832_T10 (SEQ ID NO:3745) and T11832_T12 (SEQ ID NO:3746). Table 3582 below describes the starting and ending position of this segment on each transcript.

TABLE 3582

Segment location on transcripts

| Transcript name | Segment starting position | Segment ending position |
|---|---|---|
| T11832_T2 (SEQ ID NO: 3740) | 6252 | 9356 |
| T11832_T5 (SEQ ID NO: 3741) | 5466 | 8570 |
| T11832_T6 (SEQ ID NO: 3742) | 2712 | 5816 |
| T11832_T7 (SEQ ID NO: 3743) | 3795 | 6899 |
| T11832_T9 (SEQ ID NO: 3744) | 1765 | 4869 |
| T11832_T10 (SEQ ID NO: 3745) | 2794 | 5898 |
| T11832_T12 (SEQ ID NO: 3746) | 1321 | 4425 |

This segment can be found in a non-coding region of transcript(s) that are related to the following protein(s): T11832_P2, T11832_P4, T11832_P5 and T11832_P7.

According to an optional embodiment of the present invention, short segments related to the above cluster are also provided. These segments are up to about 120 bp in length, and so are included in a separate description.

Segment cluster T11832_node_1 (SEQ ID NO:3769) according to the present invention is supported by 11 libraries. The number of libraries was determined as previously described. This segment can be found in the following transcript(s): T11832_T7 (SEQ ID NO:3743) and T11832_T14 (SEQ ID NO:3747). Table 3583 below describes the starting and ending position of this segment on each transcript.

TABLE 3583

Segment location on transcripts

| Transcript name | Segment starting position | Segment ending position |
|---|---|---|
| T11832_T7 (SEQ ID NO: 3743) | 130 | 174 |
| T11832_T14 (SEQ ID NO: 3747) | 130 | 174 |

This segment can be found in the following protein(s): T11832_P5 and T11832_P6.

Segment cluster T11832_node_7 (SEQ ID NO:3770) according to the present invention is supported by 19 libraries. The number of libraries was determined as previously described. This segment can be found in the following transcript(s): T11832_T7 (SEQ ID NO:3743) and T11832_T14 (SEQ ID NO:3747). Table 3584 below describes the starting and ending position of this segment on each transcript.

TABLE 3584

Segment location on transcripts

| Transcript name | Segment starting position | Segment ending position |
|---|---|---|
| T11832_T7 (SEQ ID NO: 3743) | 420 | 476 |
| T11832_T14 (SEQ ID NO: 3747) | 420 | 476 |

This segment can be found in the following protein(s): T11832_P5 and T11832_P6.

Segment cluster T11832_node_9 (SEQ ID NO:3771) according to the present invention is supported by 18 libraries. The number of libraries was determined as previously described. This segment can be found in the following transcript(s): T11832_T7 (SEQ ID NO:3743) and T11832_T14 (SEQ ID NO:3747). Table 3585 below describes the starting and ending position of this segment on each transcript.

TABLE 3585

Segment location on transcripts

| Transcript name | Segment starting position | Segment ending position |
|---|---|---|
| T11832_T7 (SEQ ID NO: 3743) | 477 | 513 |
| T11832_T14 (SEQ ID NO: 3747) | 477 | 513 |

This segment can be found in the following protein(s): T11832_P5 and T11832_P6.

Segment cluster T11832_node_11 (SEQ ID NO:3772) according to the present invention is supported by 16 libraries. The number of libraries was determined as previously described. This segment can be found in the following transcript(s): T11832_T7 (SEQ ID NO:3743) and T11832_T14 (SEQ ID NO:3747). Table 3586 below describes the starting and ending position of this segment on each transcript.

TABLE 3586

Segment location on transcripts

| Transcript name | Segment starting position | Segment ending position |
|---|---|---|
| T11832_T7 (SEQ ID NO: 3743) | 514 | 578 |
| T11832_T14 (SEQ ID NO: 3747) | 514 | 578 |

This segment can be found in the following protein(s): T11832_P5 and T11832_P6.

Segment cluster T11832_node__15 (SEQ ID NO:3773) according to the present invention is supported by 16 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3587 below describes the starting and ending position of this segment on each transcript.

TABLE 3587

| Segment location on transcripts | | |
|---|---|---|
| Transcript name | Segment starting position | Segment ending position |
| T11832_T2 (SEQ ID NO: 3740) | 3118 | 3159 |
| T11832_T7 (SEQ ID NO: 3743) | 579 | 620 |
| T11832_T14 (SEQ ID NO: 3747) | 579 | 620 |

This segment can be found in both coding and non-coding regions of transcript(s) as follows. The segment can be found in a non-coding region of transcript(s) that are related to the following protein(s): T11832_P2. This segment can also be found in the following protein(s): T11832_P5 and T11832_P6, since it is in the coding region for the corresponding transcript.

Segment cluster T11832_node__29 (SEQ ID NO:3774) according to the present invention is supported by 10 libraries. The number of libraries was determined as previously described. This segment can be found in the following transcript(s): T11832_T2 (SEQ ID NO:3740), T11832_T7 (SEQ ID NO:3743) and T11832_T14 (SEQ ID NO:3747). Table 3588 below describes the starting and ending position of this segment on each transcript.

TABLE 3588

| Segment location on transcripts | | |
|---|---|---|
| Transcript name | Segment starting position | Segment ending position |
| T11832_T2 (SEQ ID NO: 3740) | 3912 | 4008 |
| T11832_T7 (SEQ ID NO: 3743) | 1373 | 1469 |
| T11832_T14 (SEQ ID NO: 3747) | 1373 | 1469 |

This segment can be found in the following protein(s): T11832_P2, T11832_P5 and T11832_P6.

Segment cluster T11832_node__38 (SEQ ID NO:3775) according to the present invention is supported by 23 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3589 below describes the starting and ending position of this segment on each transcript.

TABLE 3589

| Segment location on transcripts | | |
|---|---|---|
| Transcript name | Segment starting position | Segment ending position |
| T11832_T2 (SEQ ID NO: 3740) | 4450 | 4533 |
| T11832_T6 (SEQ ID NO: 3742) | 910 | 993 |

TABLE 3589-continued

| Segment location on transcripts | | |
|---|---|---|
| Transcript name | Segment starting position | Segment ending position |
| T11832_T7 (SEQ ID NO: 3743) | 1911 | 1994 |
| T11832_T10 (SEQ ID NO: 3745) | 910 | 993 |
| T11832_T14 (SEQ ID NO: 3747) | 1911 | 1994 |

This segment can be found in both coding and non-coding regions of transcript(s) as follows. The segment can be found in a non-coding region of transcript(s) that are related to the following protein(s): T11832_P7. This segment can also be found in the following protein(s): T11832_P2, T11832_P4, T11832_P5 and T11832_P6, since it is in the coding region for the corresponding transcript.

Segment cluster T11832_node__39 (SEQ ID NO:3776) according to the present invention is supported by 2 libraries. The number of libraries was determined as previously described. This segment can be found in the following transcript(s): T11832_T7 (SEQ ID NO:3743) and T11832_T10 (SEQ ID NO:3745). Table 3590 below describes the starting and ending position of this segment on each transcript.

TABLE 3590

| Segment location on transcripts | | |
|---|---|---|
| Transcript name | Segment starting position | Segment ending position |
| T11832_T7 (SEQ ID NO: 3743) | 1995 | 2076 |
| T11832_T10 (SEQ ID NO: 3745) | 994 | 1075 |

This segment can be found in both coding and non-coding regions of transcript(s) as follows. The segment can be found in a non-coding region of transcript(s) that are related to the following protein(s): T11832_P7. This segment can also be found in the following protein(s): T11832_P5, since it is in the coding region for the corresponding transcript.

Segment cluster T11832_node__40 (SEQ ID NO:3777) according to the present invention is supported by 22 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3591 below describes the starting and ending position of this segment on each transcript.

TABLE 3591

| Segment location on transcripts | | |
|---|---|---|
| Transcript name | Segment starting position | Segment ending position |
| T11832_T2 (SEQ ID NO: 3740) | 4534 | 4559 |
| T11832_T6 (SEQ ID NO: 3742) | 994 | 1019 |
| T11832_T7 (SEQ ID NO: 3743) | 2077 | 2102 |
| T11832_T10 (SEQ ID NO: 3745) | 1076 | 1101 |
| T11832_T14 (SEQ ID NO: 3747) | 1995 | 2020 |

This segment can be found in the following protein(s): T11832_P2, T11832_P4, T11832_P5, T11832_P7 and T11832_P6.

Segment cluster T11832_node__41 (SEQ ID NO:3778) according to the present invention is supported by 28 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3592 below describes the starting and ending position of this segment on each transcript.

TABLE 3592

Segment location on transcripts

| Transcript name | Segment starting position | Segment ending position |
|---|---|---|
| T11832_T2 (SEQ ID NO: 3740) | 4560 | 4653 |
| T11832_T6 (SEQ ID NO: 3742) | 1020 | 1113 |
| T11832_T7 (SEQ ID NO: 3743) | 2103 | 2196 |
| T11832_T10 (SEQ ID NO: 3745) | 1102 | 1195 |
| T11832_T14 (SEQ ID NO: 3747) | 2021 | 2114 |

This segment can be found in the following protein(s): T11832_P2, T11832_P4, T11832_P5, T11832_P7 and T11832_P6.

Segment cluster T11832_node__43 (SEQ ID NO:3779) according to the present invention is supported by 27 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3593 below describes the starting and ending position of this segment on each transcript.

TABLE 3593

Segment location on transcripts

| Transcript name | Segment starting position | Segment ending position |
|---|---|---|
| T11832_T2 (SEQ ID NO: 3740) | 4654 | 4770 |
| T11832_T6 (SEQ ID NO: 3742) | 1114 | 1230 |
| T11832_T7 (SEQ ID NO: 3743) | 2197 | 2313 |
| T11832_T10 (SEQ ID NO: 3745) | 1196 | 1312 |
| T11832_T14 (SEQ ID NO: 3747) | 2115 | 2231 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node__50 (SEQ ID NO:3780) according to the present invention is supported by 27 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3594 below describes the starting and ending position of this segment on each transcript.

TABLE 3594

Segment location on transcripts

| Transcript name | Segment starting position | Segment ending position |
|---|---|---|
| T11832_T2 (SEQ ID NO: 3740) | 4931 | 5027 |
| T11832_T6 (SEQ ID NO: 3742) | 1391 | 1487 |
| T11832_T7 (SEQ ID NO: 3743) | 2474 | 2570 |
| T11832_T10 (SEQ ID NO: 3745) | 1473 | 1569 |
| T11832_T14 (SEQ ID NO: 3747) | 2392 | 2488 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node__52 (SEQ ID NO:3781) according to the present invention is supported by 27 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3595 below describes the starting and ending position of this segment on each transcript.

TABLE 3595

Segment location on transcripts

| Transcript name | Segment starting position | Segment ending position |
|---|---|---|
| T11832_T2 (SEQ ID NO: 3740) | 5028 | 5104 |
| T11832_T6 (SEQ ID NO: 3742) | 1488 | 1564 |
| T11832_T7 (SEQ ID NO: 3743) | 2571 | 2647 |
| T11832_T10 (SEQ ID NO: 3745) | 1570 | 1646 |
| T11832_T14 (SEQ ID NO: 3747) | 2489 | 2565 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node__54 (SEQ ID NO:3782) according to the present invention is supported by 35 libraries. The number of libraries was determined as previously described. This segment can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3596 below describes the starting and ending position of this segment on each transcript.

TABLE 3596

Segment location on transcripts

| Transcript name | Segment starting position | Segment ending position |
|---|---|---|
| T11832_T2 (SEQ ID NO: 3740) | 5105 | 5184 |
| T11832_T6 (SEQ ID NO: 3742) | 1565 | 1644 |
| T11832_T7 (SEQ ID NO: 3743) | 2648 | 2727 |

TABLE 3596-continued

Segment location on transcripts

| Transcript name | Segment starting position | Segment ending position |
|---|---|---|
| T11832_T10 (SEQ ID NO: 3745) | 1647 | 1726 |
| T11832_T14 (SEQ ID NO: 3747) | 2566 | 2645 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node__56 (SEQ ID NO:3783) according to the present invention can be found in the following transcript(s): T11832_T2 (SEQ ID NO:3740), T11832_T6 (SEQ ID NO:3742), T11832_T7 (SEQ ID NO:3743), T11832_T10 (SEQ ID NO:3745) and T11832_T14 (SEQ ID NO:3747). Table 3597 below describes the starting and ending position of this segment on each transcript.

TABLE 3597

Segment location on transcripts

| Transcript name | Segment starting position | Segment ending position |
|---|---|---|
| T11832_T2 (SEQ ID NO: 3740) | 5185 | 5188 |
| T11832_T6 (SEQ ID NO: 3742) | 1645 | 1648 |
| T11832_T7 (SEQ ID NO: 3743) | 2728 | 2731 |
| T11832_T10 (SEQ ID NO: 3745) | 1727 | 1730 |
| T11832_T14 (SEQ ID NO: 3747) | 2646 | 2649 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4, T11832_P7 and T11832_P6, since it is in the coding region for the corresponding transcript.

Segment cluster T11832_node__60 (SEQ ID NO:3784) according to the present invention is supported by 4 libraries. The number of libraries was determined as previously described. This segment can be found in the following transcript(s): T11832_T2 (SEQ ID NO:3740), T11832_T5 (SEQ ID NO:3741), T11832_T6 (SEQ ID NO:3742), T11832_T7 (SEQ ID NO:3743) and T11832_T10 (SEQ ID NO:3745). Table 3598 below describes the starting and ending position of this segment on each transcript.

TABLE 3598

Segment location on transcripts

| Transcript name | Segment starting position | Segment ending position |
|---|---|---|
| T11832_T2 (SEQ ID NO: 3740) | 5189 | 5305 |
| T11832_T5 (SEQ ID NO: 3741) | 4403 | 4519 |
| T11832_T6 (SEQ ID NO: 3742) | 1649 | 1765 |
| T11832_T7 (SEQ ID NO: 3743) | 2732 | 2848 |
| T11832_T10 (SEQ ID NO: 3745) | 1731 | 1847 |

This segment can be found in both coding and non-coding regions of transcript(s) as follows. The segment can be found in a non-coding region of transcript(s) that are related to the following protein(s): T11832_P5. This segment can also be found in the following protein(s): T11832_P2, T11832_P4 and T11832_P7, since it is in the coding region for the corresponding transcript.

Description for Cluster T41334

Cluster T41334 features 7 transcript(s) and 30 segment(s) of interest, the names for which are given in Tables 3599 and 3600, respectively, the sequences themselves are given at the end of the application. The selected protein variants are given in Table 3601.

TABLE 3599

Transcripts of interest
Transcript Name

T41334_T0 (SEQ ID NO: 3785)
T41334_T9 (SEQ ID NO: 3786)
T41334_T10 (SEQ ID NO: 3787)
T41334_T11 (SEQ ID NO: 3788)
T41334_T12 (SEQ ID NO: 3789)
T41334_T14 (SEQ ID NO: 3790)
T41334_T16 (SEQ ID NO: 3791)

TABLE 3600

Segments of interest
Segment Name

T41334_node__0 (SEQ ID NO: 3792)
T41334_node__2 (SEQ ID NO: 3793)
T41334_node__3 (SEQ ID NO: 3794)
T41334_node__14 (SEQ ID NO: 3795)
T41334_node__16 (SEQ ID NO: 3796)
T41334_node__18 (SEQ ID NO: 3797)
T41334_node__22 (SEQ ID NO: 3798)
T41334_node__25 (SEQ ID NO: 3799)
T41334_node__41 (SEQ ID NO: 3800)
T41334_node__42 (SEQ ID NO: 3801)
T41334_node__49 (SEQ ID NO: 3802)
T41334_node__20 (SEQ ID NO: 3803)
T41334_node__24 (SEQ ID NO: 3804)
T41334_node__29 (SEQ ID NO: 3805)
T41334_node__30 (SEQ ID NO: 3806)
T41334_node__31 (SEQ ID NO: 3807)
T41334_node__32 (SEQ ID NO: 3808)
T41334_node__33 (SEQ ID NO: 3809)
T41334_node__34 (SEQ ID NO: 3810)
T41334_node__35 (SEQ ID NO: 3811)
T41334_node__36 (SEQ ID NO: 3812)
T41334_node__37 (SEQ ID NO: 3813)
T41334_node__38 (SEQ ID NO: 3814)
T41334_node__39 (SEQ ID NO: 3815)
T41334_node__40 (SEQ ID NO: 3816)
T41334_node__43 (SEQ ID NO: 3817)
T41334_node__44 (SEQ ID NO: 3818)
T41334_node__45 (SEQ ID NO: 3819)
T41334_node__46 (SEQ ID NO: 3820)
T41334_node__47 (SEQ ID NO: 3821)

TABLE 3601

Proteins of interest

| Protein Name | Corresponding Transcript(s) |
|---|---|
| T41334_P1 | T41334_T0 (SEQ ID NO: 3785) |
| T41334_P7 | T41334_T9 (SEQ ID NO: 3786) |

These sequences are variants of the known protein 40S ribosomal protein SA (SwissProt accession identifier RSP4_HUMAN; known also according to the synonyms P40; 34/67 kDa laminin receptor; Colon carcinoma laminin-binding protein; NEM/1CHD4; Multidrug resistance-associated protein MGr1-Ag), referred to herein as the previously known protein.

The sequence for protein 40S ribosomal protein SA is given at the end of the application, as "40S ribosomal protein SA amino acid sequence". Known polymorphisms for this sequence are as shown in Table 3602.

TABLE 3602

Amino acid mutations for Known Protein

| SNP position(s) on amino acid sequence | Comment |
| --- | --- |
| 60 | L -> V |
| 84 | Q -> QVCGTV |
| 211 | E -> G |
| 228 | Q -> L |

Protein 40S ribosomal protein SA localization is believed to be Cytoplasmic.

The following GO Annotation(s) apply to the previously known protein. The following annotation(s) were found: protein biosynthesis; translational regulation; cell adhesion; cell surface receptor linked signal transduction, which are annotation(s) related to Biological Process; structural protein of ribosome; laminin receptor, which are annotation(s) related to Molecular Function; and intracellular; cytosolic small ribosomal (40S) subunit; integrin, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T41334 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 89 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 89 and Table 3603. This cluster is overexpressed (at least at a minimum level) in the following pathological conditions: a mixture of malignant tumors from different tissues, kidney malignant tumors and uterine malignancies.

TABLE 3603

Normal tissue distribution

| Name of Tissue | Number |
| --- | --- |
| adrenal | 160 |
| bladder | 41 |
| bone | 446 |
| brain | 75 |
| colon | 277 |
| epithelial | 192 |
| general | 154 |
| head and neck | 162 |

TABLE 3603-continued

Normal tissue distribution

| Name of Tissue | Number |
| --- | --- |
| kidney | 33 |
| liver | 195 |
| lung | 349 |
| lymph nodes | 282 |
| breast | 131 |
| bone marrow | 62 |
| muscle | 75 |
| ovary | 218 |
| pancreas | 226 |
| prostate | 321 |
| skin | 204 |
| stomach | 293 |
| Thyroid | 128 |
| uterus | 100 |

TABLE 3604

P values and ratios for expression in cancerous tissue

| Name of Tissue | P1 | P2 | SP1 | R3 | SP2 | R4 |
| --- | --- | --- | --- | --- | --- | --- |
| adrenal | 2.8e-01 | 2.0e-01 | 7.0e-01 | 0.9 | 2.0e-01 | 1.1 |
| bladder | 3.9e-01 | 2.1e-01 | 4.1e-01 | 1.7 | 1.8e-02 | 2.1 |
| bone | 5.7e-01 | 7.6e-01 | 5.2e-02 | 0.5 | 2.0e-06 | 2.2 |
| brain | 7.1e-01 | 3.3e-01 | 2.2e-01 | 1.1 | 7.0e-06 | 2.2 |
| colon | 7.9e-01 | 6.4e-01 | 9.6e-01 | 0.4 | 1.4e-01 | 0.9 |
| epithelial | 3.8e-01 | 2.4e-02 | 1.4e-01 | 1.1 | 6.1e-13 | 1.9 |
| general | 2.5e-01 | 3.3e-04 | 8.6e-06 | 1.4 | 6.3e-60 | 2.6 |
| head and neck | 4.8e-01 | 2.8e-01 | 2.6e-01 | 1.7 | 1.6e-01 | 1.4 |
| kidney | 6.3e-01 | 3.9e-01 | 8.1e-04 | 2.2 | 1.6e-04 | 4.0 |
| liver | 2.2e-01 | 2.2e-01 | 1 | 0.5 | 1.5e-01 | 1.2 |
| lung | 5.6e-01 | 3.7e-01 | 5.9e-01 | 0.7 | 3.5e-05 | 1.8 |
| lymph nodes | 4.7e-01 | 3.1e-01 | 1.9e-02 | 0.8 | 1.4e-05 | 2.1 |
| breast | 3.4e-01 | 9.7e-02 | 7.8e-01 | 0.8 | 2.4e-01 | 1.3 |
| bone marrow | 7.5e-01 | 3.8e-01 | 1 | 0.3 | 2.0e-02 | 3.3 |
| muscle | 6.0e-01 | 4.0e-01 | 5.5e-01 | 1.3 | 4.9e-07 | 1.1 |
| ovary | 7.0e-01 | 6.1e-01 | 5.4e-01 | 0.7 | 4.1e-02 | 1.4 |
| pancreas | 5.3e-01 | 2.7e-01 | 5.0e-01 | 0.7 | 2.4e-01 | 1.0 |
| prostate | 8.1e-01 | 8.4e-01 | 9.6e-01 | 0.5 | 7.8e-01 | 0.6 |
| skin | 5.2e-01 | 6.1e-01 | 4.8e-01 | 0.8 | 5.1e-02 | 0.9 |
| stomach | 3.0e-01 | 4.7e-01 | 7.0e-01 | 0.6 | 8.9e-01 | 0.6 |
| Thyroid | 4.6e-01 | 4.6e-01 | 7.4e-01 | 1.2 | 7.4e-01 | 1.2 |
| uterus | 3.6e-01 | 1.1e-01 | 1.9e-03 | 2.4 | 4.9e-05 | 3.3 |

As noted above, cluster T41334 features 30 segment(s), which were listed in Table 3600 above and for which the sequence(s) are given at the end of the application. These segment(s) are portions of nucleic acid sequence(s) which are described herein separately because they are of particular interest. A description of each segment according to the present invention is now provided.

Segment cluster T41334_node_0 (SEQ ID NO:3792) according to the present invention is supported by 11 libraries. The number of libraries was determined as previously described. This segment can be found in the following transcript(s): T41334_T0 (SEQ ID NO:3785), T41334_T9 (SEQ ID NO:3786), T41334_T10 (SEQ ID NO:3787), T41334_T11 (SEQ ID NO:3788) and T41334_T16 (SEQ ID NO:3791). Table 3605 below describes the starting and ending position of this segment on each transcript.

TABLE 3605

| | Segment location on transcripts | |
|---|---|---|
| Transcript name | Segment starting position | Segment ending position |
| T41334_T0 (SEQ ID NO: 3785) | 1 | 153 |
| T41334_T9 (SEQ ID NO: 3786) | 1 | 153 |
| T41334_T10 (SEQ ID NO: 3787) | 1 | 153 |
| T41334_T11 (SEQ ID NO: 3788) | 1 | 153 |
| T41334_T16 (SEQ ID NO: 3791) | 1 | 153 |

This segment can be found in a non-coding, region of transcript(s) that are related to the following protein(s): T41334_P1 and T41334_P7.

Segment cluster T41334_node_2 (SEQ ID NO:3793) according to the present invention is supported by 2 libraries. The number of libraries was determined as previously described. This segment can be found in the following transcript(s): T41334_T16 (SEQ ID NO:3791). Table 3606 below describes the starting and ending position of this segment on each transcript.

TABLE 3606

| | Segment location on transcripts | |
|---|---|---|
| Transcript name | Segment starting position | Segment ending position |
| T41334_T16 (SEQ ID NO: 3791) | 154 | 527 |

The previously-described transcripts for these segment(s) do not code for protein.

Segment cluster T41334_node_3 (SEQ ID NO:3794) according to the present invention is supported by 6 libraries. The number of libraries was determined as previously described. This segment can be found in the following transcript(s): T41334_T16 (SEQ ID NO:3791). Table 3607 below describes the starting and ending position of this segment on each transcript.

TABLE 3607

| | Segment location on transcripts | |
|---|---|---|
| Transcript name | Segment starting position | Segment ending position |
| T41334_T16 (SEQ ID NO: 3791) | 528 | 1509 |

The previously-described transcripts for these segment(s) do not code for protein.

Segment cluster T41334_node_14 (SEQ ID NO:3795) according to the present invention is supported by 3 libraries. The number of libraries was determined as previously described. This segment can be found in the following transcript(s): T41334_T12 (SEQ ID NO:3789). Table 3608 below describes the starting and ending position of this segment on each transcript.

TABLE 3608

| | Segment location on transcripts | |
|---|---|---|
| Transcript name | Segment starting position | Segment ending position |
| T41334_T12 (SEQ ID NO: 3789) | 1 | 962 |

The previously-described transcripts for these segment(s) do not code for protein.

Segment cluster T41334_node_16 (SEQ ID NO:3796) according to the present invention is supported by 4 libraries. The number of libraries was determined as previously described. This segment can be found in the following transcript(s): T41334_T12 (SEQ ID NO:3789). Table 3609 below describes the starting and ending position of this segment on each transcript.

TABLE 3609

| | Segment location on transcripts | |
|---|---|---|
| Transcript name | Segment starting position | Segment ending position |
| T41334_T12 (SEQ ID NO: 3789) | 963 | 1237 |

The previously-described transcripts for these segment(s) do not code for protein.

Segment cluster T41334_node_18 (SEQ ID NO:3797) according to the present invention is supported by 7 libraries. The number of libraries was determined as previously described. This segment can be found in the following transcript(s): T41334_T12 (SEQ ID NO:3789). Table 3610 below describes the starting and ending position of this segment on each transcript.

TABLE 3610

| | Segment location on transcripts | |
|---|---|---|
| Transcript name | Segment starting position | Segment ending position |
| T41334_T12 (SEQ ID NO: 3789) | 1238 | 2530 |

The previously-described transcripts for these segment(s) do not code for protein.

Segment cluster T41334_node_22 (SEQ ID NO:3798) according to the present invention is supported by 1 libraries. The number of libraries was determined as previously described. This segment can be found in the following transcript(s): T41334_T14 (SEQ ID NO:3790). Table 3611 below describes the starting and ending position of this segment on each transcript.

TABLE 3611

| | Segment location on transcripts | |
|---|---|---|
| Transcript name | Segment starting position | Segment ending position |
| T41334_T14 (SEQ ID NO: 3790) | 1 | 125 |

The previously-described transcripts for these segment(s) do not code for protein.

Segment cluster T41334_node_25 (SEQ ID NO:3799) according to the present invention is supported by 16 libraries. The number of libraries was determined as previously described. This segment can be found in the following transcript(s): T41334_T10 (SEQ ID NO:3787), T41334_T11 (SEQ ID NO:3788) and T41334_T14 (SEQ ID NO:3790). Table 3612 below describes the starting and ending position of this segment on each transcript.

TABLE 3612

| | Segment location on transcripts | |
|---|---|---|
| Transcript name | Segment starting position | Segment ending position |
| T41334_T10 (SEQ ID NO: 3787) | 364 | 1698 |
| T41334_T11 (SEQ ID NO: 3788) | 364 | 1064 |
| T41334_T14 (SEQ ID NO: 3790) | 222 | 1556 |

The previously-described transcripts for these segment(s) do not code for protein.

Segment cluster T41334_node_41 (SEQ ID NO:3800) according to the present invention is supported by 123 libraries. The number of libraries was determined as previously described. This segment can be found in the following transcript(s): T41334_T0 (SEQ ID NO:3785). Table 3613 below describes the starting and ending position of this segment on each transcript.

TABLE 3613

| | Segment location on transcripts | |
|---|---|---|
| Transcript name | Segment starting position | Segment ending position |
| T41334_T0 (SEQ ID NO: 3785) | 938 | 1074 |

This segment can be found in the following protein(s): T41334_P1. Segment cluster T41334_node_42 (SEQ ID NO:3801) according to the present invention is supported by 117 libraries. The number of libraries was determined as previously described. This segment can be found in the following transcript(s): T41334_T0 (SEQ ID NO:3785). Table 3614 below describes the starting and ending position of this segment on each transcript.

TABLE 3614

| | Segment location on transcripts | |
|---|---|---|
| Transcript name | Segment starting position | Segment ending position |
| T41334_T0 (SEQ ID NO: 3785) | 1075 | 1200 |

This segment can be found in the following protein(s): T41334_P1.

Segment cluster T41334_node_49 (SEQ ID NO:3802) according to the present invention is supported by 15 libraries. The number of libraries was determined as previously described. This segment can be found in the following transcript(s): T41334_T9 (SEQ ID NO:3786). Table 3615 below describes the starting and ending position of this segment on each transcript.

TABLE 3615

| | Segment location on transcripts | |
|---|---|---|
| Transcript name | Segment starting position | Segment ending position |
| T41334_T9 (SEQ ID NO: 3786) | 364 | 3985 |

This segment can be found in the following protein(s): T41334_P7.

According to an optional embodiment of the present invention, short segments related to the above cluster are also provided. These segments are up to about 120 bp in length, and so are included in a separate description.

Segment cluster T41334_node_20 (SEQ ID NO:3803) according to the present invention is supported by 10 libraries. The number of libraries was determined as previously described. This segment can be found in the following transcript(s): T41334_T0 (SEQ ID NO:3785), T41334_T9 (SEQ ID NO:3786), T41334_T10 (SEQ ID NO:3787) and T41334_T11 (SEQ ID NO:3788). Table 3616 below describes the starting and ending position of this segment on each transcript.

TABLE 3616

| | Segment location on transcripts | |
|---|---|---|
| Transcript name | Segment starting position | Segment ending position |
| T41334_T0 (SEQ ID NO: 3785) | 154 | 267 |
| T41334_T9 (SEQ ID NO: 3786) | 154 | 267 |
| T41334_T10 (SEQ ID NO: 3787) | 154 | 267 |
| T41334_T11 (SEQ ID NO: 3788) | 154 | 267 |

This segment can be found in a non-coding region of transcript(s) that are related to the following protein(s): T41334_P1 and T41334_P7.

Segment cluster T41334_node_24 (SEQ ID NO:3804) according to the present invention is supported by 12 libraries. The number of libraries was determined as previously described. This segment can be found in the following transcript(s): T41334_T0 (SEQ ID NO:3785), T41334_T9 (SEQ ID NO:3786), T41334_T10 (SEQ ID NO:3787), T41334_T11 (SEQ ID NO:3788) and T41334_T14 (SEQ ID NO:3790). Table 3617 below describes the starting and ending position of this segment on each transcript.

TABLE 3617

| | Segment location on transcripts | |
|---|---|---|
| Transcript name | Segment starting position | Segment ending position |
| T41334_T0 (SEQ ID NO: 3785) | 268 | 363 |
| T41334_T9 (SEQ ID NO: 3786) | 268 | 363 |
| T41334_T10 (SEQ ID NO: 3787) | 268 | 363 |
| T41334_T11 (SEQ ID NO: 3788) | 268 | 363 |
| T41334_T14 (SEQ ID NO: 3790) | 126 | 221 |

This segment can be found in a non-coding region of transcript(s) that are related to the following protein(s): T41334_P1 and T41334_P7.

Segment cluster T41334_node_29 (SEQ ID NO:3805) according to the present invention is supported by 104 libraries. The number of libraries was determined as previously described. This segment can be found in the following transcript(s): T41334_T0 (SEQ ID NO:3785). Table 3618 below describes the starting and ending position of this segment on each transcript.

TABLE 3618

Segment location on transcripts

| Transcript name | Segment starting position | Segment ending position |
|---|---|---|
| T41334_T0 (SEQ ID NO: 3785) | 364 | 438 |

This segment can be found in a non-coding region of transcript(s) that are related to the following protein(s): T41334_P1.

Segment cluster T41334_node_30 (SEQ ID NO:3806) according to the present invention is supported by 108 libraries. The number of libraries was determined as previously described. This segment can be found in the following transcript(s): T41334_T0 (SEQ ID NO:3785). Table 3619 below describes the starting and ending position of this segment on each transcript.

TABLE 3619

Segment location on transcripts

| Transcript name | Segment starting position | Segment ending position |
|---|---|---|
| T41334_T0 (SEQ ID NO: 3785) | 439 | 531 |

This segment can be found in the following protein(s): T41334_P1.

Segment cluster T41334_node_31 (SEQ ID NO:3807) according to the present invention is supported by 104 libraries. The number of libraries was determined as previously described. This segment can be found in the following transcript(s): T41334_T0 (SEQ ID NO:3785). Table 3620 below describes the starting and ending position of this segment on each transcript.

TABLE 3620

Segment location on transcripts

| Transcript name | Segment starting position | Segment ending position |
|---|---|---|
| T41334_T0 (SEQ ID NO: 3785) | 532 | 568 |

This segment can be found in the following protein(s): T41334_P1.

Segment cluster T41334_node_32 (SEQ ID NO:3808) according to the present invention can be found in the following transcript(s): T41334_T0 (SEQ ID NO:3785). Table 3621 below describes the starting and ending position of this segment on each transcript.

TABLE 3621

Segment location on transcripts

| Transcript name | Segment starting position | Segment ending position |
|---|---|---|
| T41334_T0 (SEQ ID NO: 3785) | 569 | 588 |

This segment can be found in the following protein(s): T41334_P1.

Segment cluster T41334_node_33 (SEQ ID NO:3809) according to the present invention can be found in the following transcript(s): T41334_T0 (SEQ ID NO:3785). Table 3622 below describes the starting and ending position of this segment on each transcript.

TABLE 3622

Segment location on transcripts

| Transcript name | Segment starting position | Segment ending position |
|---|---|---|
| T41334_T0 (SEQ ID NO: 3785) | 589 | 592 |

This segment can be found in the following protein(s): T41334_P1.

Segment cluster T41334_node_34 (SEQ ID NO:3810) according to the present invention is supported by 109 libraries. The number of libraries was determined as previously described. This segment can be found in the following transcript(s): T41334_T0 (SEQ ID NO:3785). Table 3623 below describes the starting and ending position of this segment on each transcript.

TABLE 3623

Segment location on transcripts

| Transcript name | Segment starting position | Segment ending position |
|---|---|---|
| T41334_T0 (SEQ ID NO: 3785) | 593 | 657 |

This segment can be found in the following protein(s): T41334_P1.

Segment cluster T41334_node_35 (SEQ ID NO:3811) according to the present invention is supported by 102 libraries. The number of libraries was determined as previously described. This segment can be found in the following transcript(s): T41334_T0 (SEQ ID NO:3785). Table 3624 below describes the starting and ending position of this segment on each transcript.

TABLE 3624

Segment location on transcripts

| Transcript name | Segment starting position | Segment ending position |
|---|---|---|
| T41334_T0 (SEQ ID NO: 3785) | 658 | 694 |

This segment can be found in the following protein(s): T41334_P1.

Segment cluster T41334_node_36 (SEQ ID NO:3812) according to the present invention is supported by 102 libraries. The number of libraries was determined as previously described. This segment can be found in the following transcript(s): T41334_T0 (SEQ ID NO:3785). Table 3625 below describes the starting and ending position of this segment on each transcript.

TABLE 3625

Segment location on transcripts

| Transcript name | Segment starting position | Segment ending position |
|---|---|---|
| T41334_T0 (SEQ ID NO: 3785) | 695 | 722 |

This segment can be found in the following protein(s): T41334_P1.

Segment cluster T41334_node_37 (SEQ ID NO:3813) according to the present invention is supported by 102 libraries. The number of libraries was determined as previously described. This segment can be found in the following transcript(s): T41334_T0 (SEQ ID NO:3785). Table 3626 below describes the starting and ending position of this segment on each transcript.

TABLE 3626

Segment location on transcripts

| Transcript name | Segment starting position | Segment ending position |
|---|---|---|
| T41334_T0 (SEQ ID NO: 3785) | 723 | 775 |

This segment can be found in the following protein(s): T41334_P1.

Segment cluster T41334_node_38 (SEQ ID NO:3814) according to the present invention is supported by 108 libraries. The number of libraries was determined as previously described. This segment can be found in the following transcript(s): T41334_T0 (SEQ ID NO:3785). Table 3627 below describes the starting and ending position of this segment on each transcript.

TABLE 3627

Segment location on transcripts

| Transcript name | Segment starting position | Segment ending position |
|---|---|---|
| T41334_T0 (SEQ ID NO: 3785) | 776 | 867 |

This segment can be found in the following protein(s): T41334_P1.

Segment cluster T41334_node_39 (SEQ ID NO:3815) according to the present invention is supported by 115 libraries. The number of libraries was determined as previously described. This segment can be found in the following transcript(s): T41334_T0 (SEQ ID NO:3785). Table 3628 below describes the starting and ending position of this segment on each transcript.

TABLE 3628

Segment location on transcripts

| Transcript name | Segment starting position | Segment ending position |
|---|---|---|
| T41334_T0 (SEQ ID NO: 3785) | 868 | 919 |

This segment can be found in the following protein(s): T41334_P1.

Segment cluster T41334_node_40 (SEQ ID NO:3816) according to the present invention can be found in the following transcript(s): T41334_T0 (SEQ ID NO:3785). Table 3629 below describes the starting and ending position of this segment on each transcript.

TABLE 3629

Segment location on transcripts

| Transcript name | Segment starting position | Segment ending position |
|---|---|---|
| T41334_T0 (SEQ ID NO: 3785) | 920 | 937 |

This segment can be found in the following protein(s): T41334_P1.

Segment cluster T41334_node_43 (SEQ ID NO:3817) according to the present invention is supported by 103 libraries. The number of libraries was determined as previously described. This segment can be found in the following transcript(s): T41334_T0 (SEQ ID NO:3785). Table 3630 below describes the starting and ending position of this segment on each transcript.

TABLE 3630

Segment location on transcripts

| Transcript name | Segment starting position | Segment ending position |
|---|---|---|
| T41334_T0 (SEQ ID NO: 3785) | 1201 | 1252 |

This segment can be found in the following protein(s): T41334_P1.

Segment cluster T41334_node_44 (SEQ ID NO:3818) according to the present invention is supported by 93 libraries. The number of libraries was determined as previously described. This segment can be found in the following transcript(s): T41334_T0 (SEQ ID NO:3785). Table 3631 below describes the starting and ending position of this segment on each transcript.

TABLE 3631

Segment location on transcripts

| Transcript name | Segment starting position | Segment ending position |
|---|---|---|
| T41334_T0 (SEQ ID NO: 3785) | 1253 | 1284 |

This segment can be found in the following protein(s): T41334_P1.

Segment cluster T41334_node_45 (SEQ ID NO:3819) according to the present invention can be found in the following transcript(s): T41334_T0 (SEQ ID NO:3785). Table 3632 below describes the starting and ending position of this segment on each transcript.

TABLE 3632

Segment location on transcripts

| Transcript name | Segment starting position | Segment ending position |
|---|---|---|
| T41334_T0 (SEQ ID NO: 3785) | 1285 | 1290 |

This segment can be found in the following protein(s): T41334_P1.

Segment cluster T41334_node_46 (SEQ ID NO:3820) according to the present invention is supported by 80 libraries. The number of libraries was determined as previously described. This segment can be found in the following transcript(s): T41334_T0 (SEQ ID NO:3785). Table 3633 below describes the starting and ending position of this segment on each transcript.

TABLE 3633

Segment location on transcripts

| Transcript name | Segment starting position | Segment ending position |
|---|---|---|
| T41334_T0 (SEQ ID NO: 3785) | 1291 | 1334 |

This segment can be found in the following protein(s): T41334_P1.

Segment cluster T41334_node_47 (SEQ ID NO:3821) according to the present invention is supported by 59 libraries. The number of libraries was determined as previously described. This segment can be found in the following transcript(s): T41334_T0 (SEQ ID NO:3785). Table 3634 below describes the starting and ending position of this segment on each transcript.

TABLE 3634

Segment location on transcripts

| Transcript name | Segment starting position | Segment ending position |
|---|---|---|
| T41334_T0 (SEQ ID NO: 3785) | 1335 | 1429 |

This segment can be found in the following protein(s): T41334_P1.

Description for Cluster T59832

Cluster T59832 features 3 transcript(s) and 19 segment(s) of interest, the names for which are given in Tables 3635 and 3636, respectively, the sequences themselves are given at the end of the application. The selected protein variants are given in Table 3637.

TABLE 3635

Transcripts of interest
Transcript Name

T59832_T18 (SEQ ID NO: 3822)
T59832_T23 (SEQ ID NO: 3823)
T59832_T24 (SEQ ID NO: 3824)

TABLE 3636

Segments of interest
Segment Name

T59832_node_18 (SEQ ID NO: 3825)
T59832_node_22 (SEQ ID NO: 3826)
T59832_node_23 (SEQ ID NO: 3827)
T59832_node_24 (SEQ ID NO: 3828)
T59832_node_39 (SEQ ID NO: 3829)
T59832_node_19 (SEQ ID NO: 3830)
T59832_node_20 (SEQ ID NO: 3831)
T59832_node_25 (SEQ ID NO: 3832)
T59832_node_26 (SEQ ID NO: 3833)
T59832_node_27 (SEQ ID NO: 3834)
T59832_node_28 (SEQ ID NO: 3835)
T59832_node_30 (SEQ ID NO: 3836)
T59832_node_31 (SEQ ID NO: 3837)
T59832_node_32 (SEQ ID NO: 3838)
T59832_node_34 (SEQ ID NO: 3839)
T59832_node_35 (SEQ ID NO: 3840)
T59832_node_36 (SEQ ID NO: 3841)
T59832_node_37 (SEQ ID NO: 3842)
T59832_node_38 (SEQ ID NO: 3843)

TABLE 3637

Proteins of interest

| Protein Name | Corresponding Transcript(s) |
|---|---|
| T59832_P15 | T59832_T18 (SEQ ID NO: 3822) |
| T59832_P19 | T59832_T23 (SEQ ID NO: 3823); T59832_T24 (SEQ ID NO: 3824) |

These sequences are variants of the known protein Gamma-interferon inducible lysosomal thiol reductase precursor (SwissProt accession identifier GILT_HUMAN; known also according to the synonyms Gamma-interferon-inducible protein IP-30), referred to herein as the previously known protein.

Protein Gamma-interferon inducible lysosomal thiol reductase precursor is known or believed to have the following function(s): Cleaves disulfide bonds in proteins by reduction. May facilitate the complete unfolding of proteins destined for lysosomal degradation. May be involved in MHC class II-restricted antigen processing. The sequence for protein Gamma-interferon inducible lysosomal thiol reductase precursor is given at the end of the application, as "Gamma-interferon inducible lysosomal thiol reductase precursor amino acid sequence". Known polymorphisms for this sequence are as shown in Table 3638.

TABLE 3638

Amino acid mutations for Known Protein

| SNP position(s) on amino acid sequence | Comment |
|---|---|
| 109 | L -> S |
| 130 | H -> L |
| 157-261 | IVCMEEFEDMERSLPLCLQLYAPGLSPDTIMECAMGDRGMQ LMHANAQRTDALQPPHEYVPWVTVNGKPLEDQTQLLTLVCQ LYQGKKPDVCPSSTSSLRSVCFK -> MSGMAWKSLRTWRE VCHYACSSTPQGCRQNYHGVCNGGPRHAAHARQRPADRCSP ATARVCALGHRQWETLGRSDPAPYPCLPVVPGQEAGCLPFL NQLPPECLLRVLAGGLRRAHGRRVGTRLPAFFSDPDPRHLL LTNWKILCIP |

Protein Gamma-interferon inducible lysosomal thiol reductase precursor localization is believed to be Lysosomal.

The following GO Annotation(s) apply to the previously known protein. The following annotation(s) were found: extracellular; lysosome, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T59832 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 90 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 90 and Table 3639. This cluster is overexpressed (at least at a minimum level) in the following pathological conditions: brain malignant tumors, breast malignant tumors, ovarian carcinoma and pancreas carcinoma.

TABLE 3639

Normal tissue distribution

| Name of Tissue | Number |
| --- | --- |
| adrenal | 208 |
| bladder | 205 |
| bone | 200 |
| brain | 18 |
| colon | 236 |
| epithelial | 143 |
| general | 280 |
| head and neck | 192 |
| kidney | 71 |
| liver | 53 |
| lung | 459 |
| lymph nodes | 248 |
| breast | 0 |
| bone marrow | 94 |
| ovary | 0 |
| pancreas | 20 |
| prostate | 86 |
| skin | 29 |
| stomach | 109 |
| T cells | 557 |
| Thyroid | 0 |
| uterus | 63 |

TABLE 3640

P values and ratios for expression in cancerous tissue

| Name of Tissue | P1 | P2 | SP1 | R3 | SP2 | R4 |
| --- | --- | --- | --- | --- | --- | --- |
| adrenal | 4.9e−01 | 5.9e−01 | 4.7e−03 | 1.1 | 2.9e−02 | 0.8 |
| bladder | 3.7e−01 | 5.6e−01 | 3.7e−02 | 1.3 | 2.5e−01 | 0.9 |
| bone | 6.6e−01 | 6.7e−01 | 3.4e−01 | 0.6 | 9.1e−01 | 0.4 |
| brain | 1.8e−01 | 2.9e−01 | 4.3e−03 | 3.8 | 2.8e−02 | 2.5 |
| colon | 4.4e−01 | 5.2e−01 | 6.1e−01 | 0.9 | 8.1e−01 | 0.7 |
| epithelial | 2.5e−02 | 1.6e−01 | 1.2e−05 | 1.6 | 9.8e−02 | 1.1 |
| general | 1.3e−02 | 1.6e−01 | 1 | 0.8 | 1 | 0.6 |
| head and neck | 3.4e−01 | 3.3e−01 | 1 | 0.4 | 9.4e−01 | 0.5 |
| kidney | 7.7e−01 | 8.5e−01 | 1.4e−01 | 1.3 | 4.2e−01 | 0.9 |
| liver | 8.3e−01 | 7.6e−01 | 1 | 0.5 | 1 | 0.6 |
| lung | 5.7e−01 | 8.3e−01 | 3.5e−01 | 0.8 | 9.8e−01 | 0.5 |

TABLE 3640-continued

P values and ratios for expression in cancerous tissue

| Name of Tissue | P1 | P2 | SP1 | R3 | SP2 | R4 |
| --- | --- | --- | --- | --- | --- | --- |
| lymph nodes | 5.7e−01 | 6.6e−01 | 7.6e−01 | 0.8 | 3.6e−02 | 1.1 |
| breast | 5.0e−02 | 1.3e−01 | 2.5e−03 | 6.5 | 4.4e−02 | 3.6 |
| bone marrow | 6.2e−01 | 7.8e−01 | 1 | 0.3 | 9.5e−01 | 0.5 |
| ovary | 2.2e−01 | 9.4e−02 | 3.2e−03 | 6.1 | 8.3e−03 | 5.3 |
| pancreas | 9.0e−02 | 1.6e−02 | 1.1e−03 | 4.0 | 7.9e−04 | 4.2 |
| prostate | 8.1e−01 | 8.0e−01 | 5.7e−01 | 0.9 | 4.1e−01 | 0.9 |
| skin | 1.6e−01 | 1.2e−01 | 2.3e−02 | 6.0 | 1.0e−02 | 2.2 |
| stomach | 5.5e−01 | 7.4e−01 | 9.4e−01 | 0.6 | 4.9e−01 | 1.0 |
| T cells | 1 | 6.7e−01 | 6.9e−01 | 1.0 | 9.8e−01 | 0.5 |
| Thyroid | 2.3e−01 | 2.3e−01 | 5.9e−02 | 2.5 | 5.9e−02 | 2.5 |
| uterus | 7.4e−02 | 4.7e−02 | 2.2e−02 | 2.0 | 6.2e−02 | 1.7 |

As noted above, cluster T59832 features 19 segment(s), which were listed in Table 3636 above and for which the sequence(s) are given at the end of the application. These segment(s) are portions of nucleic acid sequence(s) which are described herein separately because they are of particular interest. A description of each segment according to the present invention is now provided.

Segment cluster T59832_node_18 (SEQ ID NO:3825) according to the present invention is supported by 1 libraries. The number of libraries was determined as previously described. This segment can be found in the following transcript(s): T59832_T18 (SEQ ID NO:3822). Table 3641 below describes the starting and ending position of this segment on each transcript.

TABLE 3641

Segment location on transcripts

| Transcript name | Segment starting position | Segment ending position |
| --- | --- | --- |
| T59832_T18 (SEQ ID NO: 3822) | 1 | 163 |

This segment can be found in a non-coding region of transcript(s) that are related to the following protein(s): T59832_P15.

Segment cluster T59832_node_22 (SEQ ID NO:3826) according to the present invention is supported by 4 libraries. The number of libraries was determined as previously described. This segment can be found in the following transcript(s): T59832_T23 (SEQ ID NO:3823) and T59832_T24 (SEQ ID NO:3824). Table 3642 below describes the starting and ending position of this segment on each transcript.

TABLE 3642

Segment location on transcripts

| Transcript name | Segment starting position | Segment ending position |
| --- | --- | --- |
| T59832_T23 (SEQ ID NO: 3823) | 1 | 523 |
| T59832_T24 (SEQ ID NO: 3824) | 1 | 523 |

This segment can be found in a non-coding region of transcript(s) that are related to the following protein(s): T59832_P19.

Segment cluster T59832_node_23 (SEQ ID NO:3827) according to the present invention is supported by 1 libraries. The number of libraries was determined as previously described. This segment can be found in the following transcript(s): T59832_T23 (SEQ ID NO:3823). Table 3643 below describes the starting and ending position of this segment on each transcript.

TABLE 3643

Segment location on transcripts

| Transcript name | Segment starting position | Segment ending position |
|---|---|---|
| T59832_T23 (SEQ ID NO: 3823) | 524 | 652 |

This segment can be found in a non-coding region of transcript(s) that are related to the following protein(s): T59832_P19.

Segment cluster T59832_node_24 (SEQ ID NO:3828) according to the present invention is supported by 4 libraries. The number of libraries was determined as previously described. This segment can be found in the following transcript(s): T59832_T23 (SEQ ID NO:3823) and T59832_T24 (SEQ ID NO:3824). Table 3644 below describes the starting and ending position of this segment on each transcript.

TABLE 3644

Segment location on transcripts

| Transcript name | Segment starting position | Segment ending position |
|---|---|---|
| T59832_T23 (SEQ ID NO: 3823) | 653 | 901 |
| T59832_T24 (SEQ ID NO: 3824) | 524 | 772 |

This segment can be found in a non-coding region of transcript(s) that are related to the following protein(s): T59832_P19.

Segment cluster T59832_node_39 (SEQ ID NO:3829) according to the present invention is supported by 195 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3645 below describes the starting and ending position of this segment on each transcript.

TABLE 3645

Segment location on transcripts

| Transcript name | Segment starting position | Segment ending position |
|---|---|---|
| T59832_T18 (SEQ ID NO: 3822) | 684 | 737 |
| T59832_T23 (SEQ ID NO: 3823) | 1329 | 1382 |
| T59832_T24 (SEQ ID NO: 3824) | 1200 | 1253 |

This segment can be found in a non-coding region of transcript(s) that are related to the following protein(s): T59832_P15 and T59832_P19.

According to an optional embodiment of the present invention, short segments related to the above cluster are also provided. These segments are up to about 120 bp in length, and so are included in a separate description.

Segment cluster T59832_node_19 (SEQ ID NO:3830) according to the present invention is supported by 300 libraries. The number of libraries was determined as previously described. This segment can be found in the following transcript(s): T59832_T18 (SEQ ID NO:3822). Table 3646 below describes the starting and ending position of this segment on each transcript.

TABLE 3646

Segment location on transcripts

| Transcript name | Segment starting position | Segment ending position |
|---|---|---|
| T59832_T18 (SEQ ID NO: 3822) | 164 | 202 |

This segment can be found in a non-coding region of transcript(s) that are related to the following protein(s): T59832_P15.

Segment cluster T59832_node_20 (SEQ ID NO:3831) according to the present invention is supported by 318 libraries. The number of libraries was determined as previously described. This segment can be found in the following transcript(s): T59832_T18 (SEQ ID NO:3822). Table 3647 below describes the starting and ending position of this segment on each transcript.

TABLE 3647

Segment location on transcripts

| Transcript name | Segment starting position | Segment ending position |
|---|---|---|
| T59832_T18 (SEQ ID NO: 3822) | 203 | 256 |

This segment can be found in the following protein(s): T59832_P15.

Segment cluster T59832_node_25 (SEQ ID NO:3832) according to the present invention can be found in the following transcript(s): T59832_T18 (SEQ ID NO:3822), T59832_T23 (SEQ ID NO:3823) and T59832_T24 (SEQ ID NO:3824). Table 3648 below describes the starting and ending position of this segment on each transcript.

TABLE 3648

Segment location on transcripts

| Transcript name | Segment starting position | Segment ending position |
|---|---|---|
| T59832_T18 (SEQ ID NO: 3822) | 257 | 278 |
| T59832_T23 (SEQ ID NO: 3823) | 902 | 923 |
| T59832_T24 (SEQ ID NO: 3824) | 773 | 794 |

This segment can be found in both coding and non-coding regions of transcript(s) as follows. The segment can be found in a non-coding region of transcript(s) that are related to the following protein(s): T59832_P19. This segment can also be found in the following protein(s): T59832_P15, since it is in the coding region for the corresponding transcript.

Segment cluster T59832_node_26 (SEQ ID NO:3833) according to the present invention is supported by 342 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3649 below describes the starting and ending position of this segment on each transcript.

TABLE 3649

Segment location on transcripts

| Transcript name | Segment starting position | Segment ending position |
|---|---|---|
| T59832_T18 (SEQ ID NO: 3822) | 279 | 342 |
| T59832_T23 (SEQ ID NO: 3823) | 924 | 987 |
| T59832_T24 (SEQ ID NO: 3824) | 795 | 858 |

This segment can be found in the following protein(s): T59832_P15 and T59832_P19.

Segment cluster T59832_node__27 (SEQ ID NO:3834) according to the present invention is supported by 314 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3650 below describes the starting and ending position of this segment on each transcript.

TABLE 3650

Segment location on transcripts

| Transcript name | Segment starting position | Segment ending position |
|---|---|---|
| T59832_T18 (SEQ ID NO: 3822) | 343 | 381 |
| T59832_T23 (SEQ ID NO: 3823) | 988 | 1026 |
| T59832_T24 (SEQ ID NO: 3824) | 859 | 897 |

This segment can be found in the following protein(s): T59832_P15 and T59832_P19.

Segment cluster T59832_node__28 (SEQ ID NO:3835) according to the present invention is supported by 284 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3651 below describes the starting and ending position of this segment on each transcript.

TABLE 3651

Segment location on transcripts

| Transcript name | Segment starting position | Segment ending position |
|---|---|---|
| T59832_T18 (SEQ ID NO: 3822) | 382 | 409 |
| T59832_T23 (SEQ ID NO: 3823) | 1027 | 1054 |
| T59832_T24 (SEQ ID NO: 3824) | 898 | 925 |

This segment can be found in the following protein(s): T59832_P15 and T59832_P19.

Segment cluster T59832_node__30 (SEQ ID NO:3836) according to the present invention can be found in the following transcript(s): T59832_T18 (SEQ ID NO:3822), T59832_T23 (SEQ ID NO:3823) and T59832_T24 (SEQ ID NO:3824). Table 3652 below describes the starting and ending position of this segment on each transcript.

TABLE 3652

Segment location on transcripts

| Transcript name | Segment starting position | Segment ending position |
|---|---|---|
| T59832_T18 (SEQ ID NO: 3822) | 410 | 413 |
| T59832_T23 (SEQ ID NO: 3823) | 1055 | 1058 |
| T59832_T24 (SEQ ID NO: 3824) | 926 | 929 |

This segment can be found in the following protein(s): T59832_P15 and T59832_P19.

Segment cluster T59832_node__31 (SEQ ID NO:3837) according to the present invention can be found in the following transcript(s): T59832_T18 (SEQ ID NO:3822), T59832_T23 (SEQ ID NO:3823) and T59832_T24 (SEQ ID NO:3824). Table 3653 below describes the starting and ending position of this segment on each transcript.

TABLE 3653

Segment location on transcripts

| Transcript name | Segment starting position | Segment ending position |
|---|---|---|
| T59832_T18 (SEQ ID NO: 3822) | 414 | 433 |
| T59832_T23 (SEQ ID NO: 3823) | 1059 | 1078 |
| T59832_T24 (SEQ ID NO: 3824) | 930 | 949 |

This segment can be found in the following protein(s): T59832_P15 and T59832_P19.

Segment cluster T59832_node__32 (SEQ ID NO:3838) according to the present invention is supported by 287 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3654 below describes the starting and ending position of this segment on each transcript.

TABLE 3654

Segment location on transcripts

| Transcript name | Segment starting position | Segment ending position |
|---|---|---|
| T59832_T18 (SEQ ID NO: 3822) | 434 | 463 |
| T59832_T23 (SEQ ID NO: 3823) | 1079 | 1108 |
| T59832_T24 (SEQ ID NO: 3824) | 950 | 979 |

This segment can be found in the following protein(s): T59832_P15 and T59832_P19.

Segment cluster T59832_node__34 (SEQ ID NO:3839) according to the present invention can be found in the following transcript(s): T59832_T18 (SEQ ID NO:3822), T59832_T23 (SEQ ID NO:3823) and T59832_T24 (SEQ ID NO:3824). Table 3655 below describes the starting and ending position of this segment on each transcript.

TABLE 3655

Segment location on transcripts

| Transcript name | Segment starting position | Segment ending position |
|---|---|---|
| T59832_T18 (SEQ ID NO: 3822) | 464 | 485 |
| T59832_T23 (SEQ ID NO: 3823) | 1109 | 1130 |
| T59832_T24 (SEQ ID NO: 3824) | 980 | 1001 |

This segment can be found in the following protein(s): T59832_P15 and T59832_P19.

Segment cluster T59832_node_35 (SEQ ID NO:3840) according to the present invention can be found in the following transcript(s): T59832_T18 (SEQ ID NO:3822), T59832_T23 (SEQ ID NO:3823) and T59832_T24 (SEQ ID NO:3824). Table 3656 below describes the starting and ending position of this segment on each transcript.

TABLE 3656

Segment location on transcripts

| Transcript name | Segment starting position | Segment ending position |
|---|---|---|
| T59832_T18 (SEQ ID NO: 3822) | 486 | 489 |
| T59832_T23 (SEQ ID NO: 3823) | 1131 | 1134 |
| T59832_T24 (SEQ ID NO: 3824) | 1002 | 1005 |

This segment can be found in the following protein(s): T59832_P15 and T59832_P19.

Segment cluster T59832_node_36 (SEQ ID NO:3841) according to the present invention can be found in the following transcript(s): T59832_T18 (SEQ ID NO:3822), T59832_T23 (SEQ ID NO:3823) and T59832_T24 (SEQ ID NO:3824). Table 3657 below describes the starting and ending position of this segment on each transcript.

TABLE 3657

Segment location on transcripts

| Transcript name | Segment starting position | Segment ending position |
|---|---|---|
| T59832_T18 (SEQ ID NO: 3822) | 490 | 498 |
| T59832_T23 (SEQ ID NO: 3823) | 1135 | 1143 |
| T59832_T24 (SEQ ID NO: 3824) | 1006 | 1014 |

This segment can be found in the following protein(s): T59832_P15 and T59832_P19.

Segment cluster T59832_node_37 (SEQ ID NO:3842) according to the present invention is supported by 300 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3658 below describes the starting and ending position of this segment on each transcript.

TABLE 3658

Segment location on transcripts

| Transcript name | Segment starting position | Segment ending position |
|---|---|---|
| T59832_T18 (SEQ ID NO: 3822) | 499 | 598 |
| T59832_T23 (SEQ ID NO: 3823) | 1144 | 1243 |
| T59832_T24 (SEQ ID NO: 3824) | 1015 | 1114 |

This segment can be found in the following protein(s): T59832_P15 and T59832_P19.

Segment cluster T59832_node_38 (SEQ ID NO:3843) according to the present invention is supported by 247 libraries. The number of libraries was determined as previously described. This segment can be found in the following transcript(s): T59832_T18 (SEQ ID NO:3822), T59832_T23 (SEQ ID NO:3823) and T59832_T24 (SEQ ID NO:3824). Table 3659 below describes the starting and ending position of this segment on each transcript.

TABLE 3659

Segment location on transcripts

| Transcript name | Segment starting position | Segment ending position |
|---|---|---|
| T59832_T18 (SEQ ID NO: 3822) | 599 | 683 |
| T59832_T23 (SEQ ID NO: 3823) | 1244 | 1328 |
| T59832_T24 (SEQ ID NO: 3824) | 1115 | 1199 |

This segment can be found in both coding and non-coding regions of transcript(s) as follows. The segment can be found in a non-coding region of transcript(s) that are related to the following protein(s): T59832_P19. This segment can also be found in the following protein(s): T59832_P15, since it is in the coding region for the corresponding transcript.

Description for Cluster T66935

Cluster T66935 features 3 transcript(s) and 15 segment(s) of interest, the names for which are given in Tables 3660 and 3661, respectively, the sequences themselves are given at the end of the application. The selected protein variants are given in Table 3662.

TABLE 3660

Transcripts of interest
Transcript Name

T66935_T4 (SEQ ID NO: 3844)
T66935_T5 (SEQ ID NO: 3845)
T66935_T9 (SEQ ID NO: 3846)

TABLE 3661

Segments of interest
Segment Name

T66935_node_0 (SEQ ID NO: 3847)
T66935_node_5 (SEQ ID NO: 3848)
T66935_node_7 (SEQ ID NO: 3849)
T66935_node_10 (SEQ ID NO: 3850)
T66935_node_12 (SEQ ID NO: 3851)
T66935_node_18 (SEQ ID NO: 3852)
T66935_node_19 (SEQ ID NO: 3853)
T66935_node_21 (SEQ ID NO: 3854)
T66935_node_2 (SEQ ID NO: 3855)
T66935_node_4 (SEQ ID NO: 3856)

TABLE 3661-continued

Segments of interest
Segment Name

T66935_node_8 (SEQ ID NO: 3857)
T66935_node_11 (SEQ ID NO: 3858)
T66935_node_13 (SEQ ID NO: 3859)
T66935_node_15 (SEQ ID NO: 3860)
T66935_node_17 (SEQ ID NO: 3861)

TABLE 3662

Proteins of interest

| Protein Name | Corresponding Transcript(s) |
|---|---|
| T66935_P6 | T66935_T9 (SEQ ID NO: 3846) |
| T66935_P7 | T66935_T4 (SEQ ID NO: 3844); T66935_T5 (SEQ ID NO: 3845) |

Cluster T66935 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 91 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 91 and Table 3663. This cluster is overexpressed (at least at a minimum level) in the following pathological conditions: epithelial malignant tumors and a mixture of malignant tumors from different tissues.

TABLE 3663

Normal tissue distribution

| Name of Tissue | Number |
|---|---|
| adrenal | 0 |
| bone | 0 |
| brain | 0 |
| colon | 6 |
| epithelial | 3 |
| general | 7 |
| kidney | 0 |
| liver | 4 |
| lung | 10 |
| lymph nodes | 75 |
| breast | 0 |
| bone marrow | 0 |
| muscle | 1 |
| ovary | 0 |
| pancreas | 0 |
| prostate | 0 |
| skin | 0 |
| stomach | 36 |
| T cells | 0 |
| uterus | 0 |

TABLE 3664

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 2.1e−01 | 3.4 | 1.5e−01 | 3.6 |
| bone | 1 | 4.3e−01 | 1 | 1.0 | 3.4e−01 | 2.3 |

TABLE 3664-continued

P values and ratios for expression in cancerous tissue

| Name of Tissue | P1 | P2 | SP1 | R3 | SP2 | R4 |
|---|---|---|---|---|---|---|
| brain | 1 | 4.7e−02 | 1 | 1.0 | 3.5e−02 | 7.1 |
| colon | 4.1e−01 | 3.2e−01 | 1 | 1.1 | 5.9e−01 | 1.5 |
| epithelial | 4.8e−03 | 3.8e−06 | 1.9e−02 | 3.3 | 9.2e−08 | 7.5 |
| general | 2.4e−04 | 1.6e−11 | 2.0e−02 | 2.2 | 8.2e−13 | 4.9 |
| kidney | 1 | 3.5e−01 | 1 | 1.0 | 8.2e−01 | 3.1 |
| liver | 9.1e−01 | 6.0e−01 | 1 | 0.9 | 6.9e−01 | 1.4 |
| lung | 1.9e−01 | 8.9e−02 | 1.9e−01 | 2.8 | 5.8e−02 | 3.4 |
| lymph nodes | 6.3e−01 | 4.6e−01 | 1 | 0.4 | 9.9e−01 | 0.4 |
| breast | 2.1e−01 | 1.2e−01 | 6.9e−01 | 1.5 | 3.1e−01 | 2.1 |
| bone marrow | 4.3e−01 | 4.2e−01 | 1 | 4.4 | 1 | 1.7 |
| muscle | 9.2e−01 | 4.8e−01 | 1 | 0.9 | 1.5e−01 | 3.7 |
| ovary | 6.2e−01 | 4.2e−01 | 6.8e−01 | 1.5 | 2.6e−01 | 1.9 |
| pancreas | 1 | 1.8e−01 | 1 | 1.0 | 2.8e−01 | 2.8 |
| prostate | 1 | 7.8e−01 | 1 | 1.0 | 7.5e−01 | 1.3 |
| skin | 1 | 1.8e−01 | 1 | 1.0 | 2.9e−02 | 2.7 |
| stomach | 5.8e−01 | 6.1e−01 | 1 | 0.5 | 5.0e−01 | 1.1 |
| T cells | 1 | 6.7e−01 | 1 | 1.0 | 7.2e−01 | 1.4 |
| uterus | 2.1e−01 | 1.4e−01 | 4.4e−01 | 2.0 | 4.1e−01 | 2.0 |

As noted above, cluster T66935 features 15 segment(s), which were listed in Table 3661 above and for which the sequence(s) are given at the end of the application. These segment(s) are portions of nucleic acid sequence(s) which are described herein separately because they are of particular interest. A description of each segment according to the present invention is now provided.

Segment cluster T66935_node_0 (SEQ ID NO:3847) according to the present invention is supported by 36 libraries. The number of libraries was determined as previously described. This segment can be found in the following transcript(s): T66935_T9 (SEQ ID NO:3846). Table 3665 below describes the starting and ending position of this segment on each transcript.

TABLE 3665

Segment location on transcripts

| Transcript name | Segment starting position | Segment ending position |
|---|---|---|
| T66935_T9 (SEQ ID NO: 3846) | 1 | 184 |

This segment can be found in the following protein(s): T66935_P6.

Segment cluster T66935_node_5 (SEQ ID NO:3848) according to the present invention is supported by 3 libraries. The number of libraries was determined as previously described. This segment can be found in the following transcript(s): T66935_T9 (SEQ ID NO:3846). Table 3666 below describes the starting and ending position of this segment on each transcript.

TABLE 3666

Segment location on transcripts

| Transcript name | Segment starting position | Segment ending position |
|---|---|---|
| T66935_T9 (SEQ ID NO: 3846) | 308 | 955 |

This segment can be found in the following protein(s): T66935_P6.

Segment cluster T66935_node_7 (SEQ ID NO:3849) according to the present invention is supported by 2 libraries. The number of libraries was determined as previously described. This segment can be found in the following transcript(s): T66935_T5 (SEQ ID NO:3845). Table 3667 below describes the starting and ending position of this segment on each transcript.

TABLE 3667

Segment location on transcripts

| Transcript name | Segment starting position | Segment ending position |
|---|---|---|
| T66935_T5 (SEQ ID NO: 3845) | 1 | 583 |

This segment can be found in a non-coding region of transcript(s) that are related to the following protein(s): T66935_P7.

Segment cluster T66935_node_10 (SEQ ID NO:3850) according to the present invention is supported by 3 libraries. The number of libraries was determined as previously described. This segment can be found in the following transcript(s): T66935_T4 (SEQ ID NO:3844). Table 3668 below describes the starting and ending position of this segment on each transcript.

TABLE 3668

Segment location on transcripts

| Transcript name | Segment starting position | Segment ending position |
|---|---|---|
| T66935_T4 (SEQ ID NO: 3844) | 1 | 1385 |

This segment can be found in a non-coding region of transcript(s) that are related to the following protein(s): T66935_P7.

Segment cluster T66935_node_12 (SEQ ID NO:3851) according to the present invention is supported by 6 libraries. The number of libraries was determined as previously described. This segment can be found in the following transcript(s): T66935_T4 (SEQ ID NO:3844). Table 3669 below describes the starting and ending position of this segment on each transcript.

TABLE 3669

Segment location on transcripts

| Transcript name | Segment starting position | Segment ending position |
|---|---|---|
| T66935_T4 (SEQ ID NO: 3844) | 1451 | 3026 |

This segment can be found in a non-coding region of transcript(s) that are related to the following protein(s): T66935_P7.

Segment cluster T66935_node_18 (SEQ ID NO:3852) according to the present invention is supported by 79 libraries. The number of libraries was determined as previously described. This segment can be found in the following transcript(s): T66935_T4 (SEQ ID NO:3844) and T66935_T5 (SEQ ID NO:3845). Table 3670 below describes the starting and ending position of this segment on each transcript.

TABLE 3670

Segment location on transcripts

| Transcript name | Segment starting position | Segment ending position |
|---|---|---|
| T66935_T4 (SEQ ID NO: 3844) | 3313 | 4259 |
| T66935_T5 (SEQ ID NO: 3845) | 1032 | 1978 |

This segment can be found in the following protein(s): T66935_P7.

Segment cluster T66935_node_19 (SEQ ID NO:3853) according to the present invention is supported by 75 libraries. The number of libraries was determined as previously described. This segment can be found in the following transcript(s): T66935_T4 (SEQ ID NO:3844) and T66935_T5 (SEQ ID NO:3845). Table 3671 below describes the starting and ending position of this segment on each transcript.

TABLE 3671

Segment location on transcripts

| Transcript name | Segment starting position | Segment ending position |
|---|---|---|
| T66935_T4 (SEQ ID NO: 3844) | 4260 | 4795 |
| T66935_T5 (SEQ ID NO: 3845) | 1979 | 2514 |

This segment can be found in the following protein(s): T66935_P7.

Segment cluster T66935_node_21 (SEQ ID NO:3854) according to the present invention is supported by 52 libraries. The number of libraries was determined as previously described. This segment can be found in the following transcript(s): T66935_T4 (SEQ ID NO:3844) and T66935_T5 (SEQ ID NO:3845). Table 3672 below describes the starting and ending position of this segment on each transcript.

TABLE 3672

Segment location on transcripts

| Transcript name | Segment starting position | Segment ending position |
|---|---|---|
| T66935_T4 (SEQ ID NO: 3844) | 4796 | 5066 |
| T66935_T5 (SEQ ID NO: 3845) | 2515 | 2785 |

This segment can be found in the following protein(s): T66935_P7.

According to an optional embodiment of the present invention, short segments related to the above cluster are also provided. These segments are up to about 120 bp in length, and so are included in a separate description.

Segment cluster T66935_node_2 (SEQ ID NO:3855) according to the present invention is supported by 37 libraries. The number of libraries was determined as previously described. This segment can be found in the following transcript(s): T66935_T9 (SEQ ID NO:3846). Table 3673 below describes the starting and ending position of this segment on each transcript.

TABLE 3673

Segment location on transcripts

| Transcript name | Segment starting position | Segment ending position |
|---|---|---|
| T66935_T9 (SEQ ID NO: 3846) | 185 | 251 |

This segment can be found in the following protein(s): T66935_P6.

Segment cluster T66935_node_4 (SEQ ID NO:3856) according to the present invention is supported by 40 libraries. The number of libraries was determined as previously described. This segment can be found in the following transcript(s): T66935_T9 (SEQ ID NO:3846). Table 3674 below describes the starting and ending position of this segment on each transcript.

TABLE 3674

Segment location on transcripts

| Transcript name | Segment starting position | Segment ending position |
|---|---|---|
| T66935_T9 (SEQ ID NO: 3846) | 252 | 307 |

This segment can be found in the following protein(s): T66935_P6.

Segment cluster T66935_node_8 (SEQ ID NO:3857) according to the present invention is supported by 38 libraries. The number of libraries was determined as previously described. This segment can be found in the following transcript(s): T66935_T5 (SEQ ID NO:3845). Table 3675 below describes the starting and ending position of this segment on each transcript.

TABLE 3675

Segment location on transcripts

| Transcript name | Segment starting position | Segment ending position |
|---|---|---|
| T66935_T5 (SEQ ID NO: 3845) | 584 | 680 |

This segment can be found in a non-coding region of transcript(s) that are related to the following protein(s): T66935_P7.

Segment cluster T66935_node_11 (SEQ ID NO:3858) according to the present invention is supported by 39 libraries. The number of libraries was determined as previously described. This segment can be found in the following transcript(s): T66935_T4 (SEQ ID NO:3844) and T66935_T5 (SEQ ID NO:3845). Table 3676 below describes the starting and ending position of this segment on each transcript.

TABLE 3676

Segment location on transcripts

| Transcript name | Segment starting position | Segment ending position |
|---|---|---|
| T66935_T4 (SEQ ID NO: 3844) | 1386 | 1450 |
| T66935_T5 (SEQ ID NO: 3845) | 681 | 745 |

This segment can be found in a non-coding region of transcript(s) that are related to the following protein(s): T66935_P7.

Segment cluster T66935_node_13 (SEQ ID NO:3859) according to the present invention is supported by 42 libraries. The number of libraries was determined as previously described. This segment can be found in the following transcript(s): T66935_T4 (SEQ ID NO:3844) and T66935_T5 (SEQ ID NO:3845). Table 3677 below describes the starting and ending position of this segment on each transcript.

TABLE 3677

Segment location on transcripts

| Transcript name | Segment starting position | Segment ending position |
|---|---|---|
| T66935_T4 (SEQ ID NO: 3844) | 3027 | 3119 |
| T66935_T5 (SEQ ID NO: 3845) | 746 | 838 |

This segment can be found in a non-coding region of transcript(s) that are related to the following protein(s): T66935_P7.

Segment cluster T66935_node_15 (SEQ ID NO:3860) according to the present invention is supported by 38 libraries. The number of libraries was determined as previously described. This segment can be found in the following transcript(s): T66935_T4 (SEQ ID NO:3844) and T66935_T5 (SEQ ID NO:3845). Table 3678 below describes the starting and ending position of this segment on each transcript.

TABLE 3678

Segment location on transcripts

| Transcript name | Segment starting position | Segment ending position |
|---|---|---|
| T66935_T4 (SEQ ID NO: 3844) | 3120 | 3198 |
| T66935_T5 (SEQ ID NO: 3845) | 839 | 917 |

This segment can be found in a non-coding region of transcript(s) that are related to the following protein(s): T66935_P7.

Segment cluster T66935_node_17 (SEQ ID NO:3861) according to the present invention is supported by 42 libraries. The number of libraries was determined as previously described. This segment can be found in the following transcript(s): T66935_T4 (SEQ ID NO:3844) and T66935_T5 (SEQ ID NO:3845). Table 3679 below describes the starting and ending position of this segment on each transcript.

TABLE 3679

Segment location on transcripts

| Transcript name | Segment starting position | Segment ending position |
|---|---|---|
| T66935_T4 (SEQ ID NO: 3844) | 3199 | 3312 |
| T66935_T5 (SEQ ID NO: 3845) | 918 | 1031 |

This segment can be found in a non-coding region of transcript(s) that are related to the following protein(s): T66935_P7.

Description for Cluster T78346

Cluster T78346 features 10 transcript(s) and 50 segment(s) of interest, the names for which are given in Tables 3680 and 3681, respectively, the sequences themselves are given at the end of the application. The selected protein variants are given in Table 3682.

TABLE 3680

Transcripts of interest
Transcript Name

T78346_T5 (SEQ ID NO: 3862)
T78346_T11 (SEQ ID NO: 3863)
T78346_T21 (SEQ ID NO: 3864)
T78346_T22 (SEQ ID NO: 3865)
T78346_T24 (SEQ ID NO: 3866)
T78346_T29 (SEQ ID NO: 3867)
T78346_T30 (SEQ ID NO: 3868)
T78346_T31 (SEQ ID NO: 3869)
T78346_T32 (SEQ ID NO: 3870)
T78346_T35 (SEQ ID NO: 3871)

TABLE 3681

Segments of interest
Segment Name

T78346_node_0 (SEQ ID NO: 3872)
T78346_node_4 (SEQ ID NO: 3873)
T78346_node_6 (SEQ ID NO: 3874)
T78346_node_7 (SEQ ID NO: 3875)
T78346_node_8 (SEQ ID NO: 3876)
T78346_node_12 (SEQ ID NO: 3877)
T78346_node_19 (SEQ ID NO: 3878)
T78346_node_21 (SEQ ID NO: 3879)
T78346_node_25 (SEQ ID NO: 3880)
T78346_node_29 (SEQ ID NO: 3881)
T78346_node_31 (SEQ ID NO: 3882)
T78346_node_34 (SEQ ID NO: 3883)
T78346_node_35 (SEQ ID NO: 3884)
T78346_node_37 (SEQ ID NO: 3885)
T78346_node_38 (SEQ ID NO: 3886)
T78346_node_40 (SEQ ID NO: 3887)
T78346_node_41 (SEQ ID NO: 3888)
T78346_node_44 (SEQ ID NO: 3889)
T78346_node_46 (SEQ ID NO: 3890)
T78346_node_50 (SEQ ID NO: 3891)
T78346_node_52 (SEQ ID NO: 3892)
T78346_node_53 (SEQ ID NO: 3893)
T78346_node_55 (SEQ ID NO: 3894)
T78346_node_57 (SEQ ID NO: 3895)
T78346_node_58 (SEQ ID NO: 3896)
T78346_node_59 (SEQ ID NO: 3897)
T78346_node_62 (SEQ ID NO: 3898)
T78346_node_66 (SEQ ID NO: 3899)
T78346_node_68 (SEQ ID NO: 3900)
T78346_node_71 (SEQ ID NO: 3901)
T78346_node_73 (SEQ ID NO: 3902)
T78346_node_75 (SEQ ID NO: 3903)
T78346_node_1 (SEQ ID NO: 3904)
T78346_node_2 (SEQ ID NO: 3905)
T78346_node_3 (SEQ ID NO: 3906)
T78346_node_5 (SEQ ID NO: 3907)
T78346_node_9 (SEQ ID NO: 3908)
T78346_node_10 (SEQ ID NO: 3909)
T78346_node_13 (SEQ ID NO: 3910)
T78346_node_15 (SEQ ID NO: 3911)
T78346_node_17 (SEQ ID NO: 3912)
T78346_node_18 (SEQ ID NO: 3913)
T78346_node_22 (SEQ ID NO: 3914)
T78346_node_23 (SEQ ID NO: 3915)
T78346_node_48 (SEQ ID NO: 3916)
T78346_node_60 (SEQ ID NO: 3917)
T78346_node_63 (SEQ ID NO: 3918)
T78346_node_64 (SEQ ID NO: 3919)
T78346_node_72 (SEQ ID NO: 3920)
T78346_node_74 (SEQ ID NO: 3921)

TABLE 3682

Proteins of interest

| Protein Name | Corresponding Transcript(s) |
| --- | --- |
| T78346_P3 | T78346_T5 (SEQ ID NO: 3862) |
| T78346_P4 | T78346_T11 (SEQ ID NO: 3863) |
| T78346_P11 | T78346_T21 (SEQ ID NO: 3864); T78346_T22 (SEQ ID NO: 3865) |
| T78346_P12 | T78346_T24 (SEQ ID NO: 3866) |
| T78346_P14 | T78346_T29 (SEQ ID NO: 3867) |
| T78346_P15 | T78346_T30 (SEQ ID NO: 3868) |
| T78346_P16 | T78346_T31 (SEQ ID NO: 3869); T78346_T32 (SEQ ID NO: 3870) |
| T78346_P18 | T78346_T35 (SEQ ID NO: 3871) |

These sequences are variants of the known protein Structural maintenance of chromosomes 4-like 1 protein (SwissProt accession identifier SMC4_HUMAN; known also according to the synonyms Chromosome-associated polypeptide C; hCAP-C; XCAP-C homolog), referred to herein as the previously known protein.

Protein Structural maintenance of chromosomes 4-like 1 protein is known or believed to have the following function(s): Central component of the condensin complex, a complex required for conversion of interphase chromatin into mitotic-like condense chromosomes. The condensin complex probably introduces positive supercoils into relaxed DNA in the presence of type I topoisomerases and converts nicked DNA into positive knotted forms in the presence of type II topoisomerases. The sequence for protein Structural maintenance of chromosomes 4-like 1 protein is given at the end of the application, as "Structural maintenance of chromosomes 4-like 1 protein amino acid sequence". Known polymorphisms for this sequence are as shown in Table 3683.

TABLE 3683

Amino acid mutations for Known Protein

| SNP position(s) on amino acid sequence | Comment |
| --- | --- |
| 272 | R -> Q |
| 283 | E -> D |
| 392-393 | QL -> HV |
| 594 | R -> S |
| 645 | V -> G |

Protein Structural maintenance of chromosomes 4-like 1 protein localization is believed to be Nuclear and cytoplasmic. In interphase cells, the majority of the condensin complex is found in the cytoplasm, while a minority of the complex is associated with chromatin. A subpopulation of the complex however remains associated with chromosome foci in interphase cells. During mitosis, most of the condensin complex is associated with the chromatin. At the onset of prophase, the regulatory subunits of the complex are phosphorylated by CDC2, leading to condensin's association with chromosome arms and to chromosome condensation. Dissoc.

The following GO Annotation(s) apply to the previously known protein. The following annotation(s) were found: mitotic chromosome segregation; transport; chromosome organization and biogenesis; cell cycle; mitosis; mitotic chromosome condensation, which are annotation(s) related to Biological Process; ATP-binding cassette (ABC) transporter; ATP binding; DNA supercoiling, which are annotation(s)

related to Molecular Function; and nucleus; cytoplasm; membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T78346 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 92 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 92 and Table 3684. This cluster is overexpressed (at least at a minimum level) in the following pathological conditions: brain malignant tumors, epithelial malignant tumors, a mixture of malignant tumors from different tissues, breast malignant tumors, ovarian carcinoma and uterine malignancies.

TABLE 3684

Normal tissue distribution

| Name of Tissue | Number |
|---|---|
| adrenal | 0 |
| bladder | 41 |
| bone | 6 |
| brain | 10 |
| colon | 31 |
| epithelial | 28 |
| general | 41 |
| head and neck | 20 |
| kidney | 29 |
| liver | 14 |
| lung | 68 |
| lymph nodes | 226 |
| breast | 26 |
| bone marrow | 31 |
| muscle | 20 |
| ovary | 0 |
| pancreas | 10 |
| prostate | 2 |
| skin | 40 |
| stomach | 0 |
| T cells | 0 |
| Thyroid | 128 |
| uterus | 9 |

TABLE 3685

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 4.6e−01 | 2.2 | 1.5e−01 | 3.6 |
| bladder | 5.4e−01 | 2.9e−01 | 6.0e−01 | 1.3 | 1.3e−02 | 2.8 |
| bone | 2.3e−01 | 8.6e−02 | 1.6e−01 | 3.8 | 2.9e−02 | 4.3 |
| brain | 2.7e−01 | 9.2e−02 | 3.0e−01 | 1.9 | 1.4e−03 | 4.3 |
| colon | 5.6e−02 | 7.6e−02 | 1.9e−01 | 2.4 | 3.0e−01 | 1.9 |
| epithelial | 4.8e−04 | 1.0e−05 | 1.2e−07 | 3.2 | 2.4e−14 | 4.2 |
| general | 8.5e−05 | 7.7e−09 | 4.2e−09 | 2.3 | 1.4e−22 | 3.0 |
| head and neck | 1.7e−01 | 1.7e−01 | 1 | 0.9 | 1.8e−01 | 1.4 |
| kidney | 8.3e−01 | 7.7e−01 | 6.2e−01 | 1.1 | 1.5e−01 | 1.7 |
| liver | 4.8e−01 | 5.0e−01 | 1 | 3.3 | 3.3e−01 | 2.1 |
| lung | 7.5e−01 | 8.1e−01 | 5.0e−01 | 1.1 | 7.4e−01 | 0.8 |
| lymph nodes | 4.2e−01 | 4.8e−01 | 5.0e−01 | 1.0 | 7.7e−01 | 0.7 |

TABLE 3685-continued

P values and ratios for expression in cancerous tissue

| Name of Tissue | P1 | P2 | SP1 | R3 | SP2 | R4 |
|---|---|---|---|---|---|---|
| breast | 3.6e−01 | 2.7e−01 | 2.4e−02 | 2.6 | 2.3e−03 | 3.6 |
| bone marrow | 8.8e−01 | 3.0e−01 | 1 | 0.5 | 1.0e−02 | 4.4 |
| muscle | 5.2e−01 | 6.1e−01 | 2.7e−01 | 3.2 | 6.3e−01 | 1.2 |
| ovary | 5.6e−03 | 5.2e−03 | 1.0e−02 | 6.1 | 1.8e−02 | 5.3 |
| pancreas | 9.7e−02 | 9.6e−02 | 1.1e−01 | 3.2 | 8.2e−02 | 3.2 |
| prostate | 8.2e−01 | 5.9e−01 | 4.5e−01 | 1.8 | 3.1e−02 | 2.5 |
| skin | 1.9e−01 | 8.5e−02 | 1.5e−01 | 3.3 | 9.2e−02 | 1.5 |
| stomach | 6.7e−02 | 3.8e−02 | 6.3e−02 | 4.0 | 3.4e−02 | 4.5 |
| T cells | 1 | 6.7e−01 | 1 | 1.0 | 7.2e−01 | 1.4 |
| Thyroid | 7.0e−01 | 7.0e−01 | 8.9e−01 | 0.7 | 8.9e−01 | 0.7 |
| uterus | 2.5e−02 | 5.5e−03 | 1.4e−03 | 4.9 | 4.2e−04 | 5.7 |

As noted above, cluster T78346 features 50 segment(s), which were listed in Table 3681 above and for which the sequence(s) are given at the end of the application. These segment(s) are portions of nucleic acid sequence(s) which are described herein separately because they are of particular interest. A description of each segment according to the present invention is now provided.

Segment cluster T78346_node_0 (SEQ ID NO:3872) according to the present invention is supported by 41 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3686 below describes the starting and ending position of this segment on each transcript.

TABLE 3686

Segment location on transcripts

| Transcript name | Segment starting position | Segment ending position |
|---|---|---|
| T78346_T5 (SEQ ID NO: 3862) | 1 | 129 |
| T78346_T11 (SEQ ID NO: 3863) | 1 | 129 |
| T78346_T21 (SEQ ID NO: 3864) | 1 | 129 |
| T78346_T35 (SEQ ID NO: 3871) | 1 | 129 |

This segment can be found in a non-coding region of transcript(s) that are related to the following protein(s): T78346_P3, T78346_P4, T78346_P11 and T78346_P18.

Segment cluster T78346_node_4 (SEQ ID NO:3873) according to the present invention is supported by 13 libraries. The number of libraries was determined as previously described. This segment can be found in the following transcript(s): T78346_T5 (SEQ ID NO:3862) and T78346_T21 (SEQ ID NO:3864). Table 3687 below describes the starting and ending position of this segment on each transcript.

TABLE 3687

Segment location on transcripts

| Transcript name | Segment starting position | Segment ending position |
|---|---|---|
| T78346_T5 (SEQ ID NO: 3862) | 196 | 1045 |
| T78346_T21 (SEQ ID NO: 3864) | 196 | 1045 |

This segment can be found in a non-coding region of transcript(s) that are related to the following protein(s): T78346_P3 and T78346_P11.

Segment cluster T78346_node_6 (SEQ ID NO:3874) according to the present invention is supported by 10 libraries. The number of libraries was determined as previously described. This segment can be found in the following transcript(s): T78346_T5 (SEQ ID NO:3862) and T78346_T21 (SEQ ID NO:3864). Table 3688 below describes the starting and ending position of this segment on each transcript.

TABLE 3688

Segment location on transcripts

| Transcript name | Segment starting position | Segment ending position |
| --- | --- | --- |
| T78346_T5 (SEQ ID NO: 3862) | 1074 | 1267 |
| T78346_T21 (SEQ ID NO: 3864) | 1074 | 1267 |

This segment can be found in a non-coding region of transcript(s) that are related to the following protein(s): T78346_P3 and T78346_P11.

Segment cluster T78346_node_7 (SEQ ID NO:3875) according to the present invention is supported by 53 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3689 below describes the starting and ending position of this segment on each transcript.

TABLE 3689

Segment location on transcripts

| Transcript name | Segment starting position | Segment ending position |
| --- | --- | --- |
| T78346_T5 (SEQ ID NO: 3862) | 1268 | 1411 |
| T78346_T11 (SEQ ID NO: 3863) | 196 | 339 |
| T78346_T21 (SEQ ID NO: 3864) | 1268 | 1411 |
| T78346_T35 (SEQ ID NO: 3871) | 196 | 339 |

This segment can be found in both coding and non-coding regions of transcript(s) as follows. The segment can be found in a non-coding region of transcript(s) that are related to the following protein(s): T78346_P3 and T78346_P11. This segment can also be found in the following protein(s): T78346_P4 and T78346_P18, since it is in the coding region for the corresponding transcript.

Segment cluster T78346_node_8 (SEQ ID NO:3876) according to the present invention is supported by 7 libraries. The number of libraries was determined as previously described. This segment can be found in the following transcript(s): T78346_T5 (SEQ ID NO:3862) and T78346_T21 (SEQ ID NO:3864). Table 3690 below describes the starting and ending position of this segment on each transcript.

TABLE 3690

Segment location on transcripts

| Transcript name | Segment starting position | Segment ending position |
| --- | --- | --- |
| T78346_T5 (SEQ ID NO: 3862) | 1412 | 2360 |
| T78346_T21 (SEQ ID NO: 3864) | 1412 | 2360 |

This segment can be found in a non-coding region of transcript(s) that are related to the following protein(s): T78346_P3 and T78346_P11.

Segment cluster T78346_node_12 (SEQ ID NO:3877) according to the present invention is supported by 72 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3691 below describes the starting and ending position of this segment on each transcript.

TABLE 3691

Segment location on transcripts

| Transcript name | Segment starting position | Segment ending position |
| --- | --- | --- |
| T78346_T5 (SEQ ID NO: 3862) | 2540 | 2710 |
| T78346_T11 (SEQ ID NO: 3863) | 519 | 689 |
| T78346_T21 (SEQ ID NO: 3864) | 2540 | 2710 |
| T78346_T35 (SEQ ID NO: 3871) | 519 | 689 |

This segment can be found in both coding and non-coding regions of transcript(s) as follows. The segment can be found in a non-coding region of transcript(s) that are related to the following protein(s): T78346_P11. This segment can also be found in the following protein(s): T78346_P3, T78346_P4 and T78346_P18, since it is in the coding region for the corresponding transcript.

Segment cluster T78346_node_19 (SEQ ID NO:3878) according to the present invention is supported by 66 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865) and T78346_T35 (SEQ ID NO:3871). Table 13 below describes the starting and ending position of this segment on each transcript.

TABLE 3692

Segment location on transcripts

| Transcript name | Segment starting position | Segment ending position |
| --- | --- | --- |
| T78346_T5 (SEQ ID NO: 3862) | 2782 | 2908 |
| T78346_T11 (SEQ ID NO: 3863) | 761 | 887 |
| T78346_T21 (SEQ ID NO: 3864) | 2729 | 2855 |
| T78346_T22 (SEQ ID NO: 3865) | 170 | 296 |
| T78346_T35 (SEQ ID NO: 3871) | 761 | 887 |

This segment can be found in both coding and non-coding regions of transcript(s) as follows. The segment can be found in a non-coding region of transcript(s) that are related to the following protein(s): T78346_P11. This segment can also be found in the following protein(s): T78346_P3, T78346_P4 and T78346_P18, since it is in the coding region for the corresponding transcript.

Segment cluster T78346_node_21 (SEQ ID NO:3879) according to the present invention is supported by 2 libraries. The number of libraries was determined as previously described. This segment can be found in the following transcript(s): T78346_T24 (SEQ ID NO:3866). Table 3693 below describes the starting and ending position of this segment on each transcript.

TABLE 3693

Segment location on transcripts

| Transcript name | Segment starting position | Segment ending position |
|---|---|---|
| T78346_T24 (SEQ ID NO: 3866) | 1 | 838 |

This segment can be found in the following protein(s): T78346_P12.

Segment cluster T78346_node_25 (SEQ ID NO:3880) according to the present invention is supported by 71 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3694 below describes the starting and ending position of this segment on each transcript.

TABLE 3694

Segment location on transcripts

| Transcript name | Segment starting position | Segment ending position |
|---|---|---|
| T78346_T5 (SEQ ID NO: 3862) | 3074 | 3201 |
| T78346_T11 (SEQ ID NO: 3863) | 1053 | 1180 |
| T78346_T21 (SEQ ID NO: 3864) | 3021 | 3148 |
| T78346_T22 (SEQ ID NO: 3865) | 462 | 589 |
| T78346_T24 (SEQ ID NO: 3866) | 1004 | 1131 |
| T78346_T35 (SEQ ID NO: 3871) | 1053 | 1180 |

This segment can be found in the following protein(s): T78346_P3, T78346_P4, T78346_P11, T78346_P12 and T78346_P18.

Segment cluster T78346_node_29 (SEQ ID NO:3881) according to the present invention is supported by 75 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3695 below describes the starting and ending position of this segment on each transcript.

TABLE 3695

Segment location on transcripts

| Transcript name | Segment starting position | Segment ending position |
|---|---|---|
| T78346_T5 (SEQ ID NO: 3862) | 3202 | 3342 |
| T78346_T11 (SEQ ID NO: 3863) | 1181 | 1321 |
| T78346_T21 (SEQ ID NO: 3864) | 3149 | 3289 |
| T78346_T22 (SEQ ID NO: 3865) | 590 | 730 |
| T78346_T24 (SEQ ID NO: 3866) | 1132 | 1272 |
| T78346_T35 (SEQ ID NO: 3871) | 1181 | 1321 |

This segment can be found in the following protein(s): T78346_P3, T78346_P4, T78346_P11, T78346_P12 and T78346_P18.

Segment cluster T78346_node_31 (SEQ ID NO:3882) according to the present invention is supported by 71 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3696 below describes the starting and ending position of this segment on each transcript.

TABLE 3696

Segment location on transcripts

| Transcript name | Segment starting position | Segment ending position |
|---|---|---|
| T78346_T5 (SEQ ID NO: 3862) | 3343 | 3493 |
| T78346_T11 (SEQ ID NO: 3863) | 1322 | 1472 |
| T78346_T21 (SEQ ID NO: 3864) | 3290 | 3440 |
| T78346_T22 (SEQ ID NO: 3865) | 731 | 881 |
| T78346_T24 (SEQ ID NO: 3866) | 1273 | 1423 |
| T78346_T35 (SEQ ID NO: 3871) | 1322 | 1472 |

This segment can be found in the following protein(s): T78346_P3, T78346_P4, T78346_P11, T78346_P12 and T78346_P18.

Segment cluster T78346_node_34 (SEQ ID NO:3883) according to the present invention is supported by 59 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3697 below describes the starting and ending position of this segment on each transcript.

TABLE 3697

Segment location on transcripts

| Transcript name | Segment starting position | Segment ending position |
|---|---|---|
| T78346_T5 (SEQ ID NO: 3862) | 3494 | 3658 |
| T78346_T11 (SEQ ID NO: 3863) | 1473 | 1637 |
| T78346_T21 (SEQ ID NO: 3864) | 3441 | 3605 |
| T78346_T22 (SEQ ID NO: 3865) | 882 | 1046 |
| T78346_T24 (SEQ ID NO: 3866) | 1424 | 1588 |
| T78346_T35 (SEQ ID NO: 3871) | 1473 | 1637 |

This segment can be found in the following protein(s): T78346_P3, T78346_P4, T78346_P11, T78346_P12 and T78346_P18.

Segment cluster T78346_node_35 (SEQ ID NO:3884) according to the present invention is supported by 3 libraries. The number of libraries was determined as previously described. This segment can be found in the following transcript(s): T78346_T35 (SEQ ID NO:3871). Table 3698 below describes the starting and ending position of this segment on each transcript.

TABLE 3698

Segment location on transcripts

| Transcript name | Segment starting position | Segment ending position |
|---|---|---|
| T78346_T35 (SEQ ID NO: 3871) | 1638 | 1849 |

This segment can be found in the following protein(s): T78346_P18.

Segment cluster T78346_node__37 (SEQ ID NO:3885) according to the present invention is supported by 3 libraries. The number of libraries was determined as previously described. This segment can be found in the following transcript(s): T78346_T29 (SEQ ID NO:3867). Table 3699 below describes the starting and ending position of this segment on each transcript.

TABLE 3699

Segment location on transcripts

| Transcript name | Segment starting position | Segment ending position |
| --- | --- | --- |
| T78346_T29 (SEQ ID NO: 3867) | 1 | 531 |

This segment can be found in a non-coding region of transcript(s) that are related to the following protein(s): T78346_P14.

Segment cluster T78346_node__38 (SEQ ID NO:3886) according to the present invention is supported by 43 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T29 (SEQ ID NO:3867). Table 3700 below describes the starting and ending position of this segment on each transcript.

TABLE 3700

Segment location on transcripts

| Transcript name | Segment starting position | Segment ending position |
| --- | --- | --- |
| T78346_T5 (SEQ ID NO: 3862) | 3659 | 3892 |
| T78346_T11 (SEQ ID NO: 3863) | 1638 | 1871 |
| T78346_T21 (SEQ ID NO: 3864) | 3606 | 3839 |
| T78346_T22 (SEQ ID NO: 3865) | 1047 | 1280 |
| T78346_T24 (SEQ ID NO: 3866) | 1589 | 1822 |
| T78346_T29 (SEQ ID NO: 3867) | 532 | 765 |

This segment can be found in the following protein(s): T78346_P3, T78346_P4, T78346_P11, T78346_P12 and T78346_P14.

Segment cluster T78346_node__40 (SEQ ID NO:3887) according to the present invention is supported by 1 libraries. The number of libraries was determined as previously described. This segment can be found in the following transcript(s): T78346_T30 (SEQ ID NO:3868). Table 3701 below describes the starting and ending position of this segment on each transcript.

TABLE 3701

Segment location on transcripts

| Transcript name | Segment starting position | Segment ending position |
| --- | --- | --- |
| T78346_T30 (SEQ ID NO: 3868) | 1 | 357 |

This segment can be found in a non-coding region of transcript(s) that are related to the following protein(s): T78346_P15.

Segment cluster T78346_node__41 (SEQ ID NO:3888) according to the present invention is supported by 38 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867) and T78346_T30 (SEQ ID NO:3868). Table 3702 below describes the starting and ending position of this segment on each transcript.

TABLE 3702

Segment location on transcripts

| Transcript name | Segment starting position | Segment ending position |
| --- | --- | --- |
| T78346_T5 (SEQ ID NO: 3862) | 3893 | 4078 |
| T78346_T11 (SEQ ID NO: 3863) | 1872 | 2057 |
| T78346_T21 (SEQ ID NO: 3864) | 3840 | 4025 |
| T78346_T22 (SEQ ID NO: 3865) | 1281 | 1466 |
| T78346_T24 (SEQ ID NO: 3866) | 1823 | 2008 |
| T78346_T29 (SEQ ID NO: 3867) | 766 | 951 |
| T78346_T30 (SEQ ID NO: 3868) | 358 | 543 |

This segment can be found in the following protein(s): T78346_P3, T78346_P4, T78346_P11, T78346_P12, T78346_P14 and T78346_P15.

Segment cluster T78346_node__44 (SEQ ID NO:3889) according to the present invention is supported by 35 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867) and T78346_T30 (SEQ ID NO:3868). Table 3703 below describes the starting and ending position of this segment on each transcript.

TABLE 3703

Segment location on transcripts

| Transcript name | Segment starting position | Segment ending position |
| --- | --- | --- |
| T78346_T5 (SEQ ID NO: 3862) | 4079 | 4240 |
| T78346_T11 (SEQ ID NO: 3863) | 2058 | 2219 |
| T78346_T21 (SEQ ID NO: 3864) | 4026 | 4187 |
| T78346_T22 (SEQ ID NO: 3865) | 1467 | 1628 |
| T78346_T24 (SEQ ID NO: 3866) | 2009 | 2170 |
| T78346_T29 (SEQ ID NO: 3867) | 952 | 1113 |
| T78346_T30 (SEQ ID NO: 3868) | 544 | 705 |

This segment can be found in the following protein(s): T78346_P3, T78346_P4, T78346_P11, T78346_P12, T78346_P14 and T78346_P15.

Segment cluster T78346_node__46 (SEQ ID NO:3890) according to the present invention is supported by 43 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867) and T78346_T30 (SEQ ID NO:3868). Table 3704 below describes the starting and ending position of this segment on each transcript.

TABLE 3704

Segment location on transcripts

| Transcript name | Segment starting position | Segment ending position |
| --- | --- | --- |
| T78346_T5 (SEQ ID NO: 3862) | 4241 | 4466 |
| T78346_T11 (SEQ ID NO: 3863) | 2220 | 2445 |
| T78346_T21 (SEQ ID NO: 3864) | 4188 | 4413 |
| T78346_T22 (SEQ ID NO: 3865) | 1629 | 1854 |
| T78346_T24 (SEQ ID NO: 3866) | 2171 | 2396 |
| T78346_T29 (SEQ ID NO: 3867) | 1114 | 1339 |
| T78346_T30 (SEQ ID NO: 3868) | 706 | 931 |

This segment can be found in the following protein(s): T78346_P3, T78346_P4, T78346_P11, T78346_P12, T78346_P14 and T78346_P15.

Segment cluster T78346_node_50 (SEQ ID NO:3891) according to the present invention is supported by 44 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867) and T78346_T30 (SEQ ID NO:3868). Table 3705 below describes the starting and ending position of this segment on each transcript.

TABLE 3705

Segment location on transcripts

| Transcript name | Segment starting position | Segment ending position |
| --- | --- | --- |
| T78346_T5 (SEQ ID NO: 3862) | 4547 | 4699 |
| T78346_T11 (SEQ ID NO: 3863) | 2526 | 2678 |
| T78346_T21 (SEQ ID NO: 3864) | 4494 | 4646 |
| T78346_T22 (SEQ ID NO: 3865) | 1935 | 2087 |
| T78346_T24 (SEQ ID NO: 3866) | 2477 | 2629 |
| T78346_T29 (SEQ ID NO: 3867) | 1420 | 1572 |
| T78346_T30 (SEQ ID NO: 3868) | 1012 | 1164 |

This segment can be found in the following protein(s): T78346_P3, T78346_P4, T78346_P11, T78346_P12, T78346_P14 and T78346_P15.

Segment cluster T78346_node_52 (SEQ ID NO:3892) according to the present invention is supported by 1 libraries. The number of libraries was determined as previously described. This segment can be found in the following transcript(s): T78346_T31 (SEQ ID NO:3869). Table 3706 below describes the starting and ending position of this segment on each transcript.

TABLE 3706

Segment location on transcripts

| Transcript name | Segment starting position | Segment ending position |
| --- | --- | --- |
| T78346_T31 (SEQ ID NO: 3869) | 1 | 258 |

This segment can be found in a non-coding region of transcript(s) that are related to the following protein(s): T78346_P16.

Segment cluster T78346_node_53 (SEQ ID NO:3893) according to the present invention is supported by 46 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868) and T78346_T31 (SEQ ID NO:3869). Table 3707 below describes the starting and ending position of this segment on each transcript.

TABLE 3707

Segment location on transcripts

| Transcript name | Segment starting position | Segment ending position |
| --- | --- | --- |
| T78346_T5 (SEQ ID NO: 3862) | 4700 | 4826 |
| T78346_T11 (SEQ ID NO: 3863) | 2679 | 2805 |
| T78346_T21 (SEQ ID NO: 3864) | 4647 | 4773 |
| T78346_T22 (SEQ ID NO: 3865) | 2088 | 2214 |
| T78346_T24 (SEQ ID NO: 3866) | 2630 | 2756 |
| T78346_T29 (SEQ ID NO: 3867) | 1573 | 1699 |
| T78346_T30 (SEQ ID NO: 3868) | 1165 | 1291 |
| T78346_T31 (SEQ ID NO: 3869) | 259 | 385 |

This segment can be found in both coding and non-coding regions of transcript(s) as follows. The segment can be found in a non-coding region of transcript(s) that are related to the following protein(s): T78346_P16. This segment can also be found in the following protein(s): T78346_P3, T78346_P4, T78346_P11, T78346_P12, T78346_P14 and T78346_P15, since it is in the coding region for the corresponding transcript.

Segment cluster T78346_node_55 (SEQ ID NO:3894) according to the present invention is supported by 56 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868) and T78346_T31 (SEQ ID NO:3869). Table 3708 below describes the starting and ending position of this segment on each transcript.

TABLE 3708

Segment location on transcripts

| Transcript name | Segment starting position | Segment ending position |
| --- | --- | --- |
| T78346_T5 (SEQ ID NO: 3862) | 4827 | 5016 |
| T78346_T11 (SEQ ID NO: 3863) | 2806 | 2995 |
| T78346_T21 (SEQ ID NO: 3864) | 4774 | 4963 |
| T78346_T22 (SEQ ID NO: 3865) | 2215 | 2404 |
| T78346_T24 (SEQ ID NO: 3866) | 2757 | 2946 |
| T78346_T29 (SEQ ID NO: 3867) | 1700 | 1889 |
| T78346_T30 (SEQ ID NO: 3868) | 1292 | 1481 |
| T78346_T31 (SEQ ID NO: 3869) | 386 | 575 |

This segment can be found in both coding and non-coding regions of transcript(s) as follows. The segment can be found in a non-coding region of transcript(s) that are related to the following protein(s): T78346_P16. This segment can also be found in the following protein(s): T78346_P3, T78346_P4, T78346_P11, T78346_P12, T78346_P14 and T78346_P15, since it is in the coding region for the corresponding transcript.

Segment cluster T78346_node_57 (SEQ ID NO:3895) according to the present invention is supported by 53 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868) and T78346_T31 (SEQ ID NO:3869). Table 3709 below describes the starting and ending position of this segment on each transcript.

TABLE 3709

Segment location on transcripts

| Transcript name | Segment starting position | Segment ending position |
|---|---|---|
| T78346_T5 (SEQ ID NO: 3862) | 5017 | 5161 |
| T78346_T11 (SEQ ID NO: 3863) | 2996 | 3140 |
| T78346_T21 (SEQ ID NO: 3864) | 4964 | 5108 |
| T78346_T22 (SEQ ID NO: 3865) | 2405 | 2549 |
| T78346_T24 (SEQ ID NO: 3866) | 2947 | 3091 |
| T78346_T29 (SEQ ID NO: 3867) | 1890 | 2034 |
| T78346_T30 (SEQ ID NO: 3868) | 1482 | 1626 |
| T78346_T31 (SEQ ID NO: 3869) | 576 | 720 |

This segment can be found in both coding and non-coding regions of transcript(s) as follows. The segment can be found in a non-coding region of transcript(s) that are related to the following protein(s): T78346_P16. This segment can also be found in the following protein(s): T78346_P3, T78346_P4, T78346_P11, T78346_P12, T78346_P14 and T78346_P15, since it is in the coding region for the corresponding transcript.

Segment cluster T78346_node_58 (SEQ ID NO:3896) according to the present invention is supported by 5 libraries. The number of libraries was determined as previously described. This segment can be found in the following transcript(s): T78346_T11 (SEQ ID NO:3863). Table 3710 below describes the starting and ending position of this segment on each transcript.

TABLE 3710

Segment location on transcripts

| Transcript name | Segment starting position | Segment ending position |
|---|---|---|
| T78346_T11 (SEQ ID NO: 3863) | 3141 | 3428 |

This segment can be found in the following protein(s): T78346_P4.

Segment cluster T78346_node_59 (SEQ ID NO:3897) according to the present invention is supported by 57 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868) and T78346_T31 (SEQ ID NO:3869). Table 3711 below describes the starting and ending position of this segment on each transcript.

TABLE 3711

Segment location on transcripts

| Transcript name | Segment starting position | Segment ending position |
|---|---|---|
| T78346_T5 (SEQ ID NO: 3862) | 5162 | 5288 |
| T78346_T11 (SEQ ID NO: 3863) | 3429 | 3555 |
| T78346_T21 (SEQ ID NO: 3864) | 5109 | 5235 |
| T78346_T22 (SEQ ID NO: 3865) | 2550 | 2676 |
| T78346_T24 (SEQ ID NO: 3866) | 3092 | 3218 |
| T78346_T29 (SEQ ID NO: 3867) | 2035 | 2161 |
| T78346_T30 (SEQ ID NO: 3868) | 1627 | 1753 |
| T78346_T31 (SEQ ID NO: 3869) | 721 | 847 |

This segment can be found in both coding and non-coding regions of transcript(s) as follows. The segment can be found in a non-coding region of transcript(s) that are related to the following protein(s): T78346_P4 and T78346_P16. This segment can also be found in the following protein(s): T78346_P3, T78346_P11, T78346_P12, T78346_P14 and T78346_P15, since it is in the coding region for the corresponding transcript.

Segment cluster T78346_node_62 (SEQ ID NO:3898) according to the present invention is supported by 1 libraries. The number of libraries was determined as previously described. This segment can be found in the following transcript(s): T78346_T32 (SEQ ID NO:3870). Table 3712 below describes the starting and ending position of this segment on each transcript.

TABLE 3712

Segment location on transcripts

| Transcript name | Segment starting position | Segment ending position |
|---|---|---|
| T78346_T32 (SEQ ID NO: 3870) | 1 | 428 |

This segment can be found in a non-coding region of transcript(s) that are related to the following protein(s): T78346_P16.

Segment cluster T78346_node_66 (SEQ ID NO:3899) according to the present invention is supported by 71 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3713 below describes the starting and ending position of this segment on each transcript.

TABLE 3713

Segment location on transcripts

| Transcript name | Segment starting position | Segment ending position |
|---|---|---|
| T78346_T5 (SEQ ID NO: 3862) | 5519 | 5751 |
| T78346_T11 (SEQ ID NO: 3863) | 3786 | 4018 |
| T78346_T21 (SEQ ID NO: 3864) | 5466 | 5698 |
| T78346_T22 (SEQ ID NO: 3865) | 2907 | 3139 |
| T78346_T24 (SEQ ID NO: 3866) | 3449 | 3681 |
| T78346_T29 (SEQ ID NO: 3867) | 2392 | 2624 |
| T78346_T30 (SEQ ID NO: 3868) | 1984 | 2216 |

TABLE 3713-continued

Segment location on transcripts

| Transcript name | Segment starting position | Segment ending position |
|---|---|---|
| T78346_T31 (SEQ ID NO: 3869) | 1078 | 1310 |
| T78346_T32 (SEQ ID NO: 3870) | 612 | 844 |

This segment can be found in both coding and non-coding regions of transcript(s) as follows. The segment can be found in a non-coding region of transcript(s) that are related to the following protein(s): T78346_P4. This segment can also be found in the following protein(s): T78346_P3, T78346_P11, T78346_P12, T78346_P14, T78346_P15 and T78346_P16, since it is in the coding region for the corresponding transcript.

Segment cluster T78346_node__68 (SEQ ID NO:3900) according to the present invention is supported by 89 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3714 below describes the starting and ending position of this segment on each transcript.

TABLE 3714

Segment location on transcripts

| Transcript name | Segment starting position | Segment ending position |
|---|---|---|
| T78346_T5 (SEQ ID NO: 3862) | 5752 | 5935 |
| T78346_T11 (SEQ ID NO: 3863) | 4019 | 4202 |
| T78346_T21 (SEQ ID NO: 3864) | 5699 | 5882 |
| T78346_T22 (SEQ ID NO: 3865) | 3140 | 3323 |
| T78346_T24 (SEQ ID NO: 3866) | 3682 | 3865 |
| T78346_T29 (SEQ ID NO: 3867) | 2625 | 2808 |
| T78346_T30 (SEQ ID NO: 3868) | 2217 | 2400 |
| T78346_T31 (SEQ ID NO: 3869) | 1311 | 1494 |
| T78346_T32 (SEQ ID NO: 3870) | 845 | 1028 |

This segment can be found in both coding and non-coding regions of transcript(s) as follows. The segment can be found in a non-coding region of transcript(s) that are related to the following protein(s): T78346_P4. This segment can also be found in the following protein(s): T78346_P3, T78346_P11, T78346_P12, T78346_P14, T78346_P15 and T78346_P16, since it is in the coding region for the corresponding transcript.

Segment cluster T78346_node__71 (SEQ ID NO:3901) according to the present invention is supported by 121 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3715 below describes the starting and ending position of this segment on each transcript.

TABLE 3715

Segment location on transcripts

| Transcript name | Segment starting position | Segment ending position |
|---|---|---|
| T78346_T5 (SEQ ID NO: 3862) | 5936 | 6345 |
| T78346_T11 (SEQ ID NO: 3863) | 4203 | 4612 |
| T78346_T21 (SEQ ID NO: 3864) | 5883 | 6292 |
| T78346_T22 (SEQ ID NO: 3865) | 3324 | 3733 |
| T78346_T24 (SEQ ID NO: 3866) | 3866 | 4275 |
| T78346_T29 (SEQ ID NO: 3867) | 2809 | 3218 |
| T78346_T30 (SEQ ID NO: 3868) | 2401 | 2810 |
| T78346_T31 (SEQ ID NO: 3869) | 1495 | 1904 |
| T78346_T32 (SEQ ID NO: 3870) | 1029 | 1438 |

This segment can be found in both coding and non-coding regions of transcript(s) as follows. The segment can be found in a non-coding region of transcript(s) that are related to the following protein(s): T78346_P4. This segment can also be found in the following protein(s): T78346_P3, T78346_P1, T78346_P12, T78346_P14, T78346_P15 and T78346_P16, since it is in the coding region for the corresponding, transcript.

Segment cluster T78346_node__73 (SEQ ID NO:3902) according to the present invention is supported by 92 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3716 below describes the starting and ending position of this segment on each transcript.

TABLE 3716

Segment location on transcripts

| Transcript name | Segment starting position | Segment ending position |
|---|---|---|
| T78346_T5 (SEQ ID NO: 3862) | 6398 | 6568 |
| T78346_T11 (SEQ ID NO: 3863) | 4665 | 4835 |
| T78346_T21 (SEQ ID NO: 3864) | 6345 | 6515 |
| T78346_T22 (SEQ ID NO: 3865) | 3786 | 3956 |
| T78346_T24 (SEQ ID NO: 3866) | 4328 | 4498 |
| T78346_T29 (SEQ ID NO: 3867) | 3271 | 3441 |
| T78346_T30 (SEQ ID NO: 3868) | 2863 | 3033 |
| T78346_T31 (SEQ ID NO: 3869) | 1957 | 2127 |
| T78346_T32 (SEQ ID NO: 3870) | 1491 | 1661 |

This segment can be found in a non-coding region of transcript(s) that are related to the following protein(s): T78346_P3, T78346_P4, T78346_P11, T78346_P12, T78346_P14, T78346_P15 and T78346_P16.

Segment cluster T78346_node__75 (SEQ ID NO:3903) according to the present invention is supported by 146 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3717 below describes the starting and ending position of this segment on each transcript.

TABLE 3717

Segment location on transcripts

| Transcript name | Segment starting position | Segment ending position |
|---|---|---|
| T78346_T5 (SEQ ID NO: 3862) | 6588 | 7232 |
| T78346_T11 (SEQ ID NO: 3863) | 4855 | 5499 |
| T78346_T21 (SEQ ID NO: 3864) | 6535 | 7179 |
| T78346_T22 (SEQ ID NO: 3865) | 3976 | 4620 |
| T78346_T24 (SEQ ID NO: 3866) | 4518 | 5162 |
| T78346_T29 (SEQ ID NO: 3867) | 3461 | 4105 |
| T78346_T30 (SEQ ID NO: 3868) | 3053 | 3697 |
| T78346_T31 (SEQ ID NO: 3869) | 2147 | 2791 |
| T78346_T32 (SEQ ID NO: 3870) | 1681 | 2325 |

This segment can be found in a non-coding region of transcript(s) that are related to the following protein(s): T78346_P3, T78346_P4, T78346_P11, T78346_P12, T78346_P14, T78346_P15 and T78346_P16.

According to an optional embodiment of the present invention, short segments related to the above cluster are also provided. These segments are up to about 120 bp in length, and so are included in a separate description.

Segment cluster T78346_node_1 (SEQ ID NO:3904) according to the present invention can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3718 below describes the starting and ending position of this segment on each transcript.

TABLE 3718

Segment location on transcripts

| Transcript name | Segment starting position | Segment ending position |
|---|---|---|
| T78346_T5 (SEQ ID NO: 3862) | 130 | 143 |
| T78346_T11 (SEQ ID NO: 3863) | 130 | 143 |
| T78346_T21 (SEQ ID NO: 3864) | 130 | 143 |
| T78346_T35 (SEQ ID NO: 3871) | 130 | 143 |

This segment can be found in a non-coding region of transcript(s) that are related to the following protein(s): T78346_P3, T78346_P4, T78346_P11 and T78346_P18.

Segment cluster T78346_node_2 (SEQ ID NO:3905) according to the present invention is supported by 59 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3719 below describes the starting and ending position of this segment on each transcript.

TABLE 3719

Segment location on transcripts

| Transcript name | Segment starting position | Segment ending position |
|---|---|---|
| T78346_T5 (SEQ ID NO: 3862) | 144 | 169 |
| T78346_T11 (SEQ ID NO: 3863) | 144 | 169 |
| T78346_T21 (SEQ ID NO: 3864) | 144 | 169 |
| T78346_T35 (SEQ ID NO: 3871) | 144 | 169 |

This segment can be found in a non-coding region of transcript(s) that are related to the following protein(s): T78346_P3, T78346_P4, T78346_P11 and T78346_P18.

Segment cluster T78346_node_3 (SEQ ID NO:3906) according to the present invention is supported by 58 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3720 below describes the starting and ending position of this segment on each transcript.

TABLE 3720

Segment location on transcripts

| Transcript name | Segment starting position | Segment ending position |
|---|---|---|
| T78346_T5 (SEQ ID NO: 3862) | 170 | 195 |
| T78346_T11 (SEQ ID NO: 3863) | 170 | 195 |
| T78346_T21 (SEQ ID NO: 3864) | 170 | 195 |
| T78346_T35 (SEQ ID NO: 3871) | 170 | 195 |

This segment can be found in a non-coding region of transcript(s) that are related to the following protein(s): T78346_P3, T78346_P4, T78346_P11 and T78346_P18.

Segment cluster T78346_node_5 (SEQ ID NO:3907) according to the present invention is supported by 8 libraries. The number of libraries was determined as previously described. This segment can be found in the following transcript(s): T78346_T5 (SEQ ID NO:3862) and T78346_T21 (SEQ ID NO:3864). Table 3721 below describes the starting and ending position of this segment on each transcript.

TABLE 3721

Segment location on transcripts

| Transcript name | Segment starting position | Segment ending position |
|---|---|---|
| T78346_T5 (SEQ ID NO: 3862) | 1046 | 1073 |
| T78346_T21 (SEQ ID NO: 3864) | 1046 | 1073 |

This segment can be found in a non-coding region of transcript(s) that are related to the following protein(s): T78346_P3 and T78346_P11.

Segment cluster T78346_node_9 (SEQ ID NO:3908) according to the present invention is supported by 56 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3722 below describes the starting and ending position of this segment on each transcript.

TABLE 3722

Segment location on transcripts

| Transcript name | Segment starting position | Segment ending position |
|---|---|---|
| T78346_T5 (SEQ ID NO: 3862) | 2361 | 2435 |
| T78346_T11 (SEQ ID NO: 3863) | 340 | 414 |
| T78346_T21 (SEQ ID NO: 3864) | 2361 | 2435 |
| T78346_T35 (SEQ ID NO: 3871) | 340 | 414 |

This segment can be found in both coding and non-coding regions of transcript(s) as follows. The segment can be found in a non-coding region of transcript(s) that are related to the following protein(s): T78346_P3 and T78346_P11. This segment can also be found in the following protein(s): T78346_P4 and T78346_P18, since it is in the coding region for the corresponding transcript.

Segment cluster T78346_node__10 (SEQ ID NO:3909) according to the present invention is supported by 60 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864) and T78346_T35 (SEQ ID NO:3871). Table 3723 below describes the starting and ending position of this segment on each transcript.

TABLE 3723

Segment location on transcripts

| Transcript name | Segment starting position | Segment ending position |
|---|---|---|
| T78346_T5 (SEQ ID NO: 3862) | 2436 | 2539 |
| T78346_T11 (SEQ ID NO: 3863) | 415 | 518 |
| T78346_T21 (SEQ ID NO: 3864) | 2436 | 2539 |
| T78346_T35 (SEQ ID NO: 3871) | 415 | 518 |

This segment can be found in both coding and non-coding regions of transcript(s) as follows. The segment can be found in a non-coding region of transcript(s) that are related to the following protein(s): T78346_P11. This segment can also be found in the following protein(s): T78346_P3, T78346_P4 and T78346_P18, since it is in the coding region for the corresponding transcript.

Segment cluster T78346_node__13 (SEQ ID NO:3910) according to the present invention can be found in the following transcript(s): T78346_T5 (SEQ ID NO:3862), T78346_T11 (SEQ ID NO:3863) and T78346_T35 (SEQ ID NO:3871). Table 3724 below describes the starting and ending position of this segment on each transcript.

TABLE 3724

Segment location on transcripts

| Transcript name | Segment starting position | Segment ending position |
|---|---|---|
| T78346_T5 (SEQ ID NO: 3862) | 2711 | 2731 |
| T78346_T11 (SEQ ID NO: 3863) | 690 | 710 |
| T78346_T35 (SEQ ID NO: 3871) | 690 | 710 |

This segment can be found in the following protein(s): T78346_P3, T78346_P4 and T78346_P18.

Segment cluster T78346_node__15 (SEQ ID NO:3911) according to the present invention is supported by 1 libraries. The number of libraries was determined as previously described. This segment can be found in the following transcript(s): T78346_T22 (SEQ ID NO:3865). Table 3725 below describes the starting and ending position of this segment on each transcript.

TABLE 3725

Segment location on transcripts

| Transcript name | Segment starting position | Segment ending position |
|---|---|---|
| 78346_T22 (SEQ ID NO: 3865) | 1 | 119 |

This segment can be found in a non-coding region of transcript(s) that are related to the following protein(s): T78346_P11.

Segment cluster T78346_node__17 (SEQ ID NO:3912) according to the present invention is supported by 59 libraries. The number of libraries was determined as previously described. This segment can be found in the following transcript(s): T78346_T5 (SEQ ID NO:3862), T78346_T11 (SEQ ID NO:3863), T78346_T22 (SEQ ID NO:3865) and T78346_T35 (SEQ ID NO:3871). Table 3726 below describes the starting and ending position of this segment on each transcript.

TABLE 3726

Segment location on transcripts

| Transcript name | Segment starting position | Segment ending position |
|---|---|---|
| T78346_T5 (SEQ ID NO: 3862) | 2732 | 2763 |
| T78346_T11 (SEQ ID NO: 3863) | 711 | 742 |
| T78346_T22 (SEQ ID NO: 3865) | 120 | 151 |
| T78346_T35 (SEQ ID NO: 3871) | 711 | 742 |

This segment can be found in both coding and non-coding regions of transcript(s) as follows. The segment can be found in a non-coding region of transcript(s) that are related to the following protein(s): T78346_P11. This segment can also be found in the following protein(s): T78346_P3, T78346_P4 and T78346_P18, since it is in the coding region for the corresponding transcript.

Segment cluster T78346_node__18 (SEQ ID NO:3913) according to the present invention can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865) and T78346_T35 (SEQ ID NO:3871). Table 48 below describes the starting and ending position of this segment on each transcript.

TABLE 3727

Segment location on transcripts

| Transcript name | Segment starting position | Segment ending position |
|---|---|---|
| T78346_T5 (SEQ ID NO: 3862) | 2764 | 2781 |
| T78346_T11 (SEQ ID NO: 3863) | 743 | 760 |
| T78346_T21 (SEQ ID NO: 3864) | 2711 | 2728 |
| T78346_T22 (SEQ ID NO: 3865) | 152 | 169 |
| T78346_T35 (SEQ ID NO: 3871) | 743 | 760 |

This segment can be found in both coding and non-coding regions of transcript(s) as follows. The segment can be found in a non-coding region of transcript(s) that are related to the following protein(s): T78346_P11. This segment can also be found in the following protein(s): T78346_P3, T78346_P4 and T78346_P18, since it is in the coding region for the corresponding transcript.

Segment cluster T78346_node__22 (SEQ ID NO:3914) according to the present invention is supported by 64 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3728 below describes the starting and ending position of this segment on each transcript.

TABLE 3728

Segment location on transcripts

| Transcript name | Segment starting position | Segment ending position |
|---|---|---|
| T78346_T5 (SEQ ID NO: 3862) | 2909 | 2966 |
| T78346_T11 (SEQ ID NO: 3863) | 888 | 945 |
| T78346_T21 (SEQ ID NO: 3864) | 2856 | 2913 |
| T78346_T22 (SEQ ID NO: 3865) | 297 | 354 |
| T78346_T24 (SEQ ID NO: 3866) | 839 | 896 |
| T78346_T35 (SEQ ID NO: 3871) | 888 | 945 |

This segment can be found in the following protein(s): T78346_P3, T78346_P4, T78346_P11, T78346_P12 and T78346_P18.

Segment cluster T78346_node__23 (SEQ ID NO:3915) according to the present invention is supported by 63 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866) and T78346_T35 (SEQ ID NO:3871). Table 3729 below describes the starting and ending position of this segment on each transcript.

TABLE 3729

Segment location on transcripts

| Transcript name | Segment starting position | Segment ending position |
|---|---|---|
| T78346_T5 (SEQ ID NO: 3862) | 2967 | 3073 |
| T78346_T11 (SEQ ID NO: 3863) | 946 | 1052 |
| T78346_T21 (SEQ ID NO: 3864) | 2914 | 3020 |
| T78346_T22 (SEQ ID NO: 3865) | 355 | 461 |
| T78346_T24 (SEQ ID NO: 3866) | 897 | 1003 |
| T78346_T35 (SEQ ID NO: 3871) | 946 | 1052 |

This segment can be found in the following protein(s): T78346_P3, T78346_P4, T78346_P11, T78346_P12 and T78346_P18.

Segment cluster T78346_node__48 (SEQ ID NO:3916) according to the present invention is supported by 38 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867) and T78346_T30 (SEQ ID NO:3868). Table 3730 below describes the starting and ending position of this segment on each transcript.

TABLE 3730

Segment location on transcripts

| Transcript name | Segment starting position | Segment ending position |
|---|---|---|
| T78346_T5 (SEQ ID NO: 3862) | 4467 | 4546 |
| T78346_T11 (SEQ ID NO: 3863) | 2446 | 2525 |
| T78346_T21 (SEQ ID NO: 3864) | 4414 | 4493 |
| T78346_T22 (SEQ ID NO: 3865) | 1855 | 1934 |
| T78346_T24 (SEQ ID NO: 3866) | 2397 | 2476 |
| T78346_T29 (SEQ ID NO: 3867) | 1340 | 1419 |
| T78346_T30 (SEQ ID NO: 3868) | 932 | 1011 |

This segment can be found in the following protein(s): T78346_P3, T78346_P4, T78346_P11, T78346_P12, T78346_P14 and T78346_P15.

Segment cluster T78346_node__60 (SEQ ID NO:3917) according to the present invention is supported by 53 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868) and T78346_T31 (SEQ ID NO:3869). Table 3731 below describes the starting and ending position of this segment on each transcript.

TABLE 3731

Segment location on transcripts

| Transcript name | Segment starting position | Segment ending position |
|---|---|---|
| T78346_T5 (SEQ ID NO: 3862) | 5289 | 5335 |
| T78346_T11 (SEQ ID NO: 3863) | 3556 | 3602 |
| T78346_T21 (SEQ ID NO: 3864) | 5236 | 5282 |
| T78346_T22 (SEQ ID NO: 3865) | 2677 | 2723 |
| T78346_T24 (SEQ ID NO: 3866) | 3219 | 3265 |
| T78346_T29 (SEQ ID NO: 3867) | 2162 | 2208 |
| T78346_T30 (SEQ ID NO: 3868) | 1754 | 1800 |
| T78346_T31 (SEQ ID NO: 3869) | 848 | 894 |

This segment can be found in both coding and non-coding regions of transcript(s) as follows. The segment can be found in a non-coding region of transcript(s) that are related to the following protein(s): T78346_P4 and T78346_P16. This segment can also be found in the following protein(s): T78346_P3, T78346_P11, T78346_P12, T78346_P14 and T78346_P15, since it is in the coding region for the corresponding transcript.

Segment cluster T78346_node__63 (SEQ ID NO:3918) according to the present invention is supported by 66 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3732 below describes the starting and ending position of this segment on each transcript.

TABLE 3732

Segment location on transcripts

| Transcript name | Segment starting position | Segment ending position |
|---|---|---|
| T78346_T5 (SEQ ID NO: 3862) | 5336 | 5453 |
| T78346_T11 (SEQ ID NO: 3863) | 3603 | 3720 |
| T78346_T21 (SEQ ID NO: 3864) | 5283 | 5400 |
| T78346_T22 (SEQ ID NO: 3865) | 2724 | 2841 |
| T78346_T24 (SEQ ID NO: 3866) | 3266 | 3383 |
| T78346_T29 (SEQ ID NO: 3867) | 2209 | 2326 |
| T78346_T30 (SEQ ID NO: 3868) | 1801 | 1918 |
| T78346_T31 (SEQ ID NO: 3869) | 895 | 1012 |
| T78346_T32 (SEQ ID NO: 3870) | 429 | 546 |

This segment can be found in both coding and non-coding regions of transcript(s) as follows. The segment can be found in a non-coding region of transcript(s) that are related to the following protein(s): T78346_P4 and T78346_P16. This segment can also be found in the following protein(s): T78346_P3, T78346_P11, T78346_P12, T78346_P14 and T78346_P15, since it is in the coding region for the corresponding transcript.

Segment cluster T78346_node__64 (SEQ ID NO:3919) according to the present invention is supported by 64 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3733 below describes the starting and ending position of this segment on each transcript.

TABLE 3733

Segment location on transcripts

| Transcript name | Segment starting position | Segment ending position |
|---|---|---|
| T78346_T5 (SEQ ID NO: 3862) | 5454 | 5518 |
| T78346_T11 (SEQ ID NO: 3863) | 3721 | 3785 |
| T78346_T21 (SEQ ID NO: 3864) | 5401 | 5465 |
| T78346_T22 (SEQ ID NO: 3865) | 2842 | 2906 |
| T78346_T24 (SEQ ID NO: 3866) | 3384 | 3448 |
| T78346_T29 (SEQ ID NO: 3867) | 2327 | 2391 |
| T78346_T30 (SEQ ID NO: 3868) | 1919 | 1983 |
| T78346_T31 (SEQ ID NO: 3869) | 1013 | 1077 |
| T78346_T32 (SEQ ID NO: 3870) | 547 | 611 |

This segment can be found in both coding and non-coding regions of transcript(s) as follows. The segment can be found in a non-coding region of transcript(s) that are related to the following protein(s): T78346_P4. This segment can also be found in the following protein(s): T78346_P3, T78346_P11, T78346_P12, T78346_P14, T78346_P15 and T78346_P16, since it is in the coding region for the corresponding transcript.

Segment cluster T78346_node__72 (SEQ ID NO:3920) according to the present invention is supported by 66 libraries. The number of libraries was determined as previously described. This segment can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3734 below describes the starting and ending position of this segment on each transcript.

TABLE 3734

Segment location on transcripts

| Transcript name | Segment starting position | Segment ending position |
|---|---|---|
| T78346_T5 (SEQ ID NO: 3862) | 6346 | 6397 |
| T78346_T11 (SEQ ID NO: 3863) | 4613 | 4664 |
| T78346_T21 (SEQ ID NO: 3864) | 6293 | 6344 |
| T78346_T22 (SEQ ID NO: 3865) | 3734 | 3785 |
| T78346_T24 (SEQ ID NO: 3866) | 4276 | 4327 |
| T78346_T29 (SEQ ID NO: 3867) | 3219 | 3270 |
| T78346_T30 (SEQ ID NO: 3868) | 2811 | 2862 |
| T78346_T31 (SEQ ID NO: 3869) | 1905 | 1956 |
| T78346_T32 (SEQ ID NO: 3870) | 1439 | 1490 |

This segment can be found in a non-coding region of transcript(s) that are related to the following protein(s): T78346_P3, T78346_P4, T78346_P11, T78346_P12, T78346_P14, T78346_P15 and T78346_P16.

Segment cluster T78346_node__74 (SEQ ID NO:3921) according to the present invention can be found in the following transcript(s): T78346_T5 (SEQ ID NO:3862), T78346_T11 (SEQ ID NO:3863), T78346_T21 (SEQ ID NO:3864), T78346_T22 (SEQ ID NO:3865), T78346_T24 (SEQ ID NO:3866), T78346_T29 (SEQ ID NO:3867), T78346_T30 (SEQ ID NO:3868), T78346_T31 (SEQ ID NO:3869) and T78346_T32 (SEQ ID NO:3870). Table 3735 below describes the starting and ending position of this segment on each transcript.

TABLE 3735

Segment location on transcripts

| Transcript name | Segment starting position | Segment ending position |
|---|---|---|
| T78346_T5 (SEQ ID NO: 3862) | 6569 | 6587 |
| T78346_T11 (SEQ ID NO: 3863) | 4836 | 4854 |
| T78346_T21 (SEQ ID NO: 3864) | 6516 | 6534 |
| T78346_T22 (SEQ ID NO: 3865) | 3957 | 3975 |
| T78346_T24 (SEQ ID NO: 3866) | 4499 | 4517 |
| T78346_T29 (SEQ ID NO: 3867) | 3442 | 3460 |
| T78346_T30 (SEQ ID NO: 3868) | 3034 | 3052 |
| T78346_T31 (SEQ ID NO: 3869) | 2128 | 2146 |
| T78346_T32 (SEQ ID NO: 3870) | 1662 | 1680 |

This segment can be found in a non-coding region of transcript(s) that are related to the following protein(s): T78346_P3, T78346_P4, T78346_P11, T78346_P12, T78346_P14, T78346_P15 and T78346_P16.

Description for Cluster T78438

Cluster T78438 features 7 transcript(s) and 29 segment(s) of interest, the names for which are given in Tables 3736 and 3737, respectively, the sequences themselves are given at the end of the application. The selected protein variants are given in Table 3738.

TABLE 3736

Transcripts of interest
Transcript Name

T78438_T4 (SEQ ID NO: 3922)
T78438_T20 (SEQ ID NO: 3923)
T78438_T24 (SEQ ID NO: 3924)
T78438_T27 (SEQ ID NO: 3925)
T78438_T28 (SEQ ID NO: 3926)
T78438_T29 (SEQ ID NO: 3927)
T78438_T37 (SEQ ID NO: 3928)

TABLE 3737

Segments of interest
Segment Name

T78438_node_0 (SEQ ID NO: 3929)
T78438_node_1 (SEQ ID NO: 3930)
T78438_node_3 (SEQ ID NO: 3931)
T78438_node_6 (SEQ ID NO: 3932)
T78438_node_7 (SEQ ID NO: 3933)
T78438_node_9 (SEQ ID NO: 3934)
T78438_node_11 (SEQ ID NO: 3935)
T78438_node_12 (SEQ ID NO: 3936)
T78438_node_14 (SEQ ID NO: 3937)
T78438_node_27 (SEQ ID NO: 3938)
T78438_node_32 (SEQ ID NO: 3939)
T78438_node_34 (SEQ ID NO: 3940)
T78438_node_38 (SEQ ID NO: 3941)
T78438_node_39 (SEQ ID NO: 3942)
T78438_node_4 (SEQ ID NO: 3943)
T78438_node_5 (SEQ ID NO: 3944)
T78438_node_8 (SEQ ID NO: 3945)
T78438_node_13 (SEQ ID NO: 3946)
T78438_node_15 (SEQ ID NO: 3947)
T78438_node_16 (SEQ ID NO: 3948)
T78438_node_17 (SEQ ID NO: 3949)
T78438_node_21 (SEQ ID NO: 3950)
T78438_node_22 (SEQ ID NO: 3951)
T78438_node_24 (SEQ ID NO: 3952)
T78438_node_28 (SEQ ID NO: 3953)
T78438_node_33 (SEQ ID NO: 3954)
T78438_node_35 (SEQ ID NO: 3955)
T78438_node_36 (SEQ ID NO: 3956)
T78438_node_37 (SEQ ID NO: 3957)

TABLE 3738

Proteins of interest

| Protein Name | Corresponding Transcript(s) |
|---|---|
| T78438_P10 | T78438_T20 (SEQ ID NO: 3923); T78438_T27 (SEQ ID NO: 3925); T78438_T29 (SEQ ID NO: 3927) |
| T78438_P12 | T78438_T24 (SEQ ID NO: 3924) |
| T78438_P14 | T78438_T28 (SEQ ID NO: 3926) |
| T78438_P18 | T78438_T37 (SEQ ID NO: 3928) |
| T78438_P21 | T78438_T4 (SEQ ID NO: 3922) |

Cluster T78438 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 93 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 93 and Table 3739. This cluster is overexpressed (at least at a minimum level) in the following pathological conditions: epithelial malignant tumors, a mixture of malignant tumors from different tissues, breast malignant tumors and ovarian carcinoma.

TABLE 3739

Normal tissue distribution

| Name of Tissue | Number |
|---|---|
| adrenal | 0 |
| bladder | 246 |
| colon | 384 |
| epithelial | 150 |
| general | 57 |
| head and neck | 0 |
| kidney | 83 |
| liver | 53 |
| lung | 186 |
| lymph nodes | 0 |
| breast | 43 |
| bone marrow | 0 |
| ovary | 0 |
| pancreas | 127 |
| prostate | 50 |
| stomach | 219 |
| uterus | 90 |

TABLE 3740

P values and ratios for expression in cancerous tissue

| Name of Tissue | P1 | P2 | SP1 | R3 | SP2 | R4 |
|---|---|---|---|---|---|---|
| adrenal | 4.6e−01 | 5.0e−01 | 4.6e−01 | 2.2 | 5.3e−01 | 1.9 |
| bladder | 8.2e−02 | 1.1e−01 | 4.9e−02 | 1.2 | 2.7e−01 | 0.9 |
| colon | 9.1e−02 | 7.5e−02 | 3.3e−01 | 1.1 | 4.4e−01 | 1.0 |
| epithelial | 4.4e−05 | 5.5e−03 | 7.1e−11 | 2.0 | 6.8e−04 | 1.4 |
| general | 1.7e−12 | 6.9e−09 | 4.8e−38 | 3.8 | 1.1e−22 | 2.6 |
| head and neck | 1.2e−01 | 1.1e−01 | 1 | 1.3 | 1.0e−01 | 1.8 |
| kidney | 6.7e−01 | 7.5e−01 | 4.4e−01 | 1.1 | 4.9e−01 | 1.0 |
| liver | 4.4e−01 | 5.8e−01 | 4.1e−01 | 2.0 | 6.4e−01 | 1.2 |
| lung | 1.9e−01 | 5.1e−01 | 3.6e−01 | 1.0 | 7.4e−01 | 0.7 |
| lymph nodes | 3.1e−01 | 5.7e−01 | 2.9e−01 | 3.5 | 5.8e−01 | 1.7 |
| breast | 8.2e−02 | 1.8e−01 | 8.0e−03 | 3.7 | 1.2e−01 | 2.0 |
| bone marrow | 1 | 6.7e−01 | 1 | 1.0 | 5.3e−01 | 1.9 |
| ovary | 7.8e−03 | 7.0e−02 | 3.3e−07 | 14.7 | 2.4e−05 | 10.3 |
| pancreas | 4.4e−01 | 3.1e−01 | 3.7e−04 | 1.7 | 3.7e−03 | 1.5 |
| prostate | 5.2e−01 | 7.1e−01 | 3.9e−04 | 2.6 | 6.6e−03 | 1.9 |
| stomach | 4.4e−01 | 4.3e−01 | 7.3e−01 | 0.4 | 6.9e−02 | 1.4 |
| uterus | 3.8e−02 | 1.9e−01 | 5.5e−02 | 1.8 | 3.5e−01 | 1.1 |

As noted above, cluster T78438 features 29 segment(s), which were listed in Table 3737 above and for which the sequence(s) are given at the end of the application. These segment(s) are portions of nucleic acid sequence(s) which are described herein separately because they are of particular interest. A description of each segment according to the present invention is now provided.

Segment cluster T78438_node_0 (SEQ ID NO:3929) according to the present invention is supported by 5 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3741 below describes the starting and ending position of this segment on each transcript.

TABLE 3741

Segment location on transcripts

| Transcript name | Segment starting position | Segment ending position |
| --- | --- | --- |
| T78438_T4 (SEQ ID NO: 3922) | 1 | 1098 |
| T78438_T20 (SEQ ID NO: 3923) | 1 | 1098 |
| T78438_T24 (SEQ ID NO: 3924) | 1 | 1098 |
| T78438_T27 (SEQ ID NO: 3925) | 1 | 1098 |
| T78438_T28 (SEQ ID NO: 3926) | 1 | 1098 |
| T78438_T29 (SEQ ID NO: 3927) | 1 | 1098 |
| T78438_T37 (SEQ ID NO: 3928) | 1 | 1098 |

This segment can be found in both coding and non-coding regions of transcript(s) as follows. The segment can be found in a non-coding region of transcript(s) that are related to the following protein(s): T78438_P21, T78438_P10, T78438_P12 and T78438_P14. This segment can also be found in the following protein(s): T78438_P18, since it is in the coding region for the corresponding transcript.

Segment cluster T78438_node_1 (SEQ ID NO:3930) according to the present invention is supported by 2 libraries. The number of libraries was determined as previously described. This segment can be found in the following transcript(s): T78438_T4 (SEQ ID NO:3922). Table 3742 below describes the starting and ending position of this segment on each transcript.

TABLE 3742

Segment location on transcripts

| Transcript name | Segment starting position | Segment ending position |
| --- | --- | --- |
| T78438_T4 (SEQ ID NO: 3922) | 1099 | 2263 |

This segment can be found in a non-coding region of transcript(s) that are related to the following protein(s): T78438_P21.

Segment cluster T78438_node_3 (SEQ ID NO:3931) according to the present invention is supported by 16 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3743 below describes the starting and ending position of this segment on each transcript.

TABLE 3743

Segment location on transcripts

| Transcript name | Segment starting position | Segment ending position |
| --- | --- | --- |
| T78438_T4 (SEQ ID NO: 3922) | 2264 | 3154 |
| T78438_T20 (SEQ ID NO: 3923) | 1099 | 1989 |
| T78438_T24 (SEQ ID NO: 3924) | 1099 | 1989 |
| T78438_T27 (SEQ ID NO: 3925) | 1099 | 1989 |
| T78438_T28 (SEQ ID NO: 3926) | 1099 | 1989 |
| T78438_T29 (SEQ ID NO: 3927) | 1099 | 1989 |
| T78438_T37 (SEQ ID NO: 3928) | 1099 | 1989 |

This segment can be found in a non-coding region of transcript(s) that are related to the following protein(s): T78438_P21, T78438_P10, T78438_P12, T78438_P14 and T78438_P18.

Segment cluster T78438_node_6 (SEQ ID NO:3932) according to the present invention is supported by 19 libraries. The number of libraries was determined as previously described. This segment can be found in the following transcript(s): T78438_T4 (SEQ ID NO:3922) and T78438_T27 (SEQ ID NO:3925). Table 3744 below describes the starting and ending position of this segment on each transcript.

TABLE 3744

Segment location on transcripts

| Transcript name | Segment starting position | Segment ending position |
| --- | --- | --- |
| T78438_T4 (SEQ ID NO: 3922) | 3387 | 3694 |
| T78438_T27 (SEQ ID NO: 3925) | 2222 | 2529 |

This segment can be found in a non-coding region of transcript(s) that are related to the following protein(s): T78438_P21 and T78438_P10.

Segment cluster T78438_node_7 (SEQ ID NO:3933) according to the present invention is supported by 149 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T37 (SEQ ID NO:3928). Table 3745 below describes the starting and ending position of this segment on each transcript.

TABLE 3745

Segment location on transcripts

| Transcript name | Segment starting position | Segment ending position |
| --- | --- | --- |
| T78438_T4 (SEQ ID NO: 3922) | 3695 | 3859 |
| T78438_T20 (SEQ ID NO: 3923) | 2108 | 2272 |
| T78438_T24 (SEQ ID NO: 3924) | 2108 | 2272 |
| T78438_T27 (SEQ ID NO: 3925) | 2530 | 2694 |
| T78438_T28 (SEQ ID NO: 3926) | 2108 | 2272 |
| T78438_T37 (SEQ ID NO: 3928) | 2108 | 2272 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 3746.

TABLE 3746

Oligonucleotides related to this segment

| Oligonucleotide name | Overexpressed in cancers | Chip reference |
| --- | --- | --- |
| T78438_0_20_0 | lung malignant tumors | LUN |
| T78438_0_20_0 | ovarian carcinoma | OVA |

This segment can be found in both coding and non-coding regions of transcript(s) as follows. The segment can be found in a non-coding region of transcript(s) that are related to the following protein(s): T78438_P10 and T78438_P18. This segment can also be found in the following protein(s):

T78438_P21, T78438_P12 and T78438_P14, since it is in the coding region for the corresponding transcript.

Segment cluster T78438_node_9 (SEQ ID NO:3934) according to the present invention is supported by 20 libraries. The number of libraries was determined as previously described. This segment can be found in the following transcript(s): T78438_T37 (SEQ ID NO:3928). Table 3747 below describes the starting and ending position of this segment on each transcript.

TABLE 3747

| | Segment location on transcripts | |
|---|---|---|
| Transcript name | Segment starting position | Segment ending position |
| T78438_T37 (SEQ ID NO: 3928) | 2279 | 2563 |

This segment can be found in a non-coding region of transcript(s) that are related to the following protein(s): T78438_P18.

Segment cluster T78438_node_11 (SEQ ID NO:3935) according to the present invention is supported by 148 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3748 below describes the starting and ending position of this segment on each transcript.

TABLE 3748

| | Segment location on transcripts | |
|---|---|---|
| Transcript name | Segment starting position | Segment ending position |
| T78438_T4 (SEQ ID NO: 3922) | 3866 | 4087 |
| T78438_T20 (SEQ ID NO: 3923) | 2279 | 2500 |
| T78438_T24 (SEQ ID NO: 3924) | 2279 | 2500 |
| T78438_T27 (SEQ ID NO: 3925) | 2701 | 2922 |
| T78438_T28 (SEQ ID NO: 3926) | 2279 | 2500 |
| T78438_T29 (SEQ ID NO: 3927) | 2108 | 2329 |

This segment can be found in both coding and non-coding regions of transcript(s) as follows. The segment can be found in a non-coding region of transcript(s) that are related to the following protein(s): T78438_P10. This segment can also be found in the following protein(s): T78438_P21, T78438_P12 and T78438_P14, since it is in the coding region for the corresponding transcript.

Segment cluster T78438_node_12 (SEQ ID NO:3936) according to the present invention is supported by 21 libraries. The number of libraries was determined as previously described. This segment can be found in the following transcript(s): T78438_T20 (SEQ ID NO:3923), T78438_T27 (SEQ ID NO:3925), T78438_T28 (SEQ ID NO:3926) and T78438_T29 (SEQ ID NO:3927). Table 3749 below describes the starting and ending position of this segment on each transcript.

TABLE 3749

| | Segment location on transcripts | |
|---|---|---|
| Transcript name | Segment starting position | Segment ending position |
| T78438_T20 (SEQ ID NO: 3923) | 2501 | 2665 |
| T78438_T27 (SEQ ID NO: 3925) | 2923 | 3087 |
| T78438_T28 (SEQ ID NO: 3926) | 2501 | 2665 |
| T78438_T29 (SEQ ID NO: 3927) | 2330 | 2494 |

This segment can be found in both coding and non-coding regions of transcript(s) as follows. The segment can be found in a non-coding region of transcript(s) that are related to the following protein(s): T78438_P10. This segment can also be found in the following protein(s): T78438_P14, since it is in the coding region for the corresponding transcript.

Segment cluster T78438_node_14 (SEQ ID NO:3937) according to the present invention is supported by 20 libraries. The number of libraries was determined as previously described. This segment can be found in the following transcript(s): T78438_T24 (SEQ ID NO:3924) and T78438_T28 (SEQ ID NO:3926). Table 3750 below describes the starting and ending position of this segment on each transcript.

TABLE 3750

| | Segment location on transcripts | |
|---|---|---|
| Transcript name | Segment starting position | Segment ending position |
| T78438_T24 (SEQ ID NO: 3924) | 2594 | 2796 |
| T78438_T28 (SEQ ID NO: 3926) | 2759 | 2961 |

This segment can be found in both coding and non-coding regions of transcript(s) as follows. The segment can be found in a non-coding region of transcript(s) that are related to the following protein(s): T78438_P14. This segment can also be found in the following protein(s): T78438_P12, since it is in the coding region for the corresponding transcript.

Segment cluster T78438_node_27 (SEQ ID NO:3938) according to the present invention is supported by 154 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3751 below describes the starting and ending position of this segment on each transcript.

TABLE 3751

| | Segment location on transcripts | |
|---|---|---|
| Transcript name | Segment starting position | Segment ending position |
| T78438_T4 (SEQ ID NO: 3922) | 4508 | 4671 |
| T78438_T20 (SEQ ID NO: 3923) | 3086 | 3249 |
| T78438_T24 (SEQ ID NO: 3924) | 3124 | 3287 |
| T78438_T27 (SEQ ID NO: 3925) | 3508 | 3671 |
| T78438_T28 (SEQ ID NO: 3926) | 3289 | 3452 |
| T78438_T29 (SEQ ID NO: 3927) | 2915 | 3078 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node_32 (SEQ ID NO:3939) according to the present invention is supported by 15 libraries. The number of libraries was determined as previously described. This segment can be found in the following transcript(s): T78438_T37 (SEQ ID NO:3928). Table 3752 below describes the starting and ending position of this segment on each transcript.

TABLE 3752

Segment location on transcripts

| Transcript name | Segment starting position | Segment ending position |
|---|---|---|
| T78438_T37 (SEQ ID NO: 3928) | 2564 | 2886 |

This segment can be found in a non-coding region of transcript(s) that are related to the following protein(s): T78438_P18.

Segment cluster T78438_node_34 (SEQ ID NO:3940) according to the present invention is supported by 181 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3753 below describes the starting and ending position of this segment on each transcript.

TABLE 3753

Segment location on transcripts

| Transcript name | Segment starting position | Segment ending position |
|---|---|---|
| T78438_T4 (SEQ ID NO: 3922) | 4782 | 4903 |
| T78438_T20 (SEQ ID NO: 3923) | 3360 | 3481 |
| T78438_T24 (SEQ ID NO: 3924) | 3398 | 3519 |
| T78438_T27 (SEQ ID NO: 3925) | 3782 | 3903 |
| T78438_T28 (SEQ ID NO: 3926) | 3563 | 3684 |
| T78438_T29 (SEQ ID NO: 3927) | 3189 | 3310 |
| T78438_T37 (SEQ ID NO: 3928) | 2965 | 3086 |

This segment can be found in both coding and non-coding regions of transcript(s) as follows. The segment can be found in a non-coding region of transcript(s) that are related to the following protein(s): T78438_P12, T78438_P14 and T78438_P18. This segment can also be found in the following protein(s): T78438_P21 and T78438_P10, since it is in the coding region for the corresponding transcript.

Segment cluster T78438_node_38 (SEQ ID NO:3941) according to the present invention is supported by 219 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3754 below describes the starting and ending position of this segment on each transcript.

TABLE 3754

Segment location on transcripts

| Transcript name | Segment starting position | Segment ending position |
|---|---|---|
| T78438_T4 (SEQ ID NO: 3922) | 5015 | 5218 |
| T78438_T20 (SEQ ID NO: 3923) | 3593 | 3796 |
| T78438_T24 (SEQ ID NO: 3924) | 3631 | 3834 |
| T78438_T27 (SEQ ID NO: 3925) | 4015 | 4218 |
| T78438_T28 (SEQ ID NO: 3926) | 3796 | 3999 |
| T78438_T29 (SEQ ID NO: 3927) | 3422 | 3625 |
| T78438_T37 (SEQ ID NO: 3928) | 3198 | 3401 |

This segment can be found in a non-coding region of transcript(s) that are related to the following protein(s): T78438_P21, T78438_P10, T78438_P12, T78438_P14 and T78438_P18.

Segment cluster T78438_node_39 (SEQ ID NO:3942) according to the present invention is supported by 229 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3755 below describes the starting and ending position of this segment on each transcript.

TABLE 3755

Segment location on transcripts

| Transcript name | Segment starting position | Segment ending position |
|---|---|---|
| T78438_T4 (SEQ ID NO: 3922) | 5219 | 5504 |
| T78438_T20 (SEQ ID NO: 3923) | 3797 | 4082 |
| T78438_T24 (SEQ ID NO: 3924) | 3835 | 4120 |
| T78438_T27 (SEQ ID NO: 3925) | 4219 | 4504 |
| T78438_T28 (SEQ ID NO: 3926) | 4000 | 4285 |
| T78438_T29 (SEQ ID NO: 3927) | 3626 | 3911 |
| T78438_T37 (SEQ ID NO: 3928) | 3402 | 3687 |

This segment can be found in a non-coding region of transcript(s) that are related to the following protein(s): T78438_P21, T78438_P10, T78438_P12, T78438_P14 and T78438_P18.

According to an optional embodiment of the present invention, short segments related to the above cluster are also provided. These segments are up to about 120 bp in length, and so are included in a separate description.

Segment cluster T78438_node_4 (SEQ ID NO:3943) according to the present invention is supported by 131 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3756 below describes the starting and ending position of this segment on each transcript.

TABLE 3756

Segment location on transcripts

| Transcript name | Segment starting position | Segment ending position |
|---|---|---|
| T78438_T4 (SEQ ID NO: 3922) | 3155 | 3272 |
| T78438_T20 (SEQ ID NO: 3923) | 1990 | 2107 |
| T78438_T24 (SEQ ID NO: 3924) | 1990 | 2107 |
| T78438_T27 (SEQ ID NO: 3925) | 1990 | 2107 |
| T78438_T28 (SEQ ID NO: 3926) | 1990 | 2107 |
| T78438_T29 (SEQ ID NO: 3927) | 1990 | 2107 |
| T78438_T37 (SEQ ID NO: 3928) | 1990 | 2107 |

This segment can be found in a non-coding region of transcript(s) that are related to the following protein(s): T78438_P21, T78438_P10, T78438_P12, T78438_P14 and T78438_P18.

Segment cluster T78438_node_5 (SEQ ID NO:3944) according to the present invention is supported by 20 libraries. The number of libraries was determined as previously described. This segment can be found in the following transcript(s): T78438_T4 (SEQ ID NO:3922) and T78438_T27 (SEQ ID NO:3925). Table 3757 below describes the starting and ending position of this segment on each transcript.

TABLE 3757

Segment location on transcripts

| Transcript name | Segment starting position | Segment ending position |
|---|---|---|
| T78438_T4 (SEQ ID NO: 3922) | 3273 | 3386 |
| T78438_T27 (SEQ ID NO: 3925) | 2108 | 2221 |

This segment can be found in a non-coding region of transcript(s) that are related to the following protein(s): T78438_P21 and T78438_P10.

Segment cluster T78438_node_8 (SEQ ID NO:3945) according to the present invention can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T37 (SEQ ID NO:3928). Table 3758 below describes the starting and ending position of this segment on each transcript.

TABLE 3758

Segment location on transcripts

| Transcript name | Segment starting position | Segment ending position |
|---|---|---|
| T78438_T4 (SEQ ID NO: 3922) | 3860 | 3865 |
| T78438_T20 (SEQ ID NO: 3923) | 2273 | 2278 |
| T78438_T24 (SEQ ID NO: 3924) | 2273 | 2278 |
| T78438_T27 (SEQ ID NO: 3925) | 2695 | 2700 |
| T78438_T28 (SEQ ID NO: 3926) | 2273 | 2278 |
| T78438_T37 (SEQ ID NO: 3928) | 2273 | 2278 |

This segment can be found in both coding and non-coding regions of transcript(s) as follows. The segment can be found in a non-coding region of transcript(s) that are related to the following protein(s): T78438_P10 and T78438_P18. This segment can also be found in the following protein(s): T78438_P21, T78438_P12 and T78438_P14, since it is in the coding region for the corresponding transcript.

Segment cluster T78438_node_13 (SEQ ID NO:3946) according to the present invention is supported by 111 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3759 below describes the starting and ending position of this segment on each transcript.

TABLE 3759

Segment location on transcripts

| Transcript name | Segment starting position | Segment ending position |
|---|---|---|
| T78438_T4 (SEQ ID NO: 3922) | 4088 | 4180 |
| T78438_T20 (SEQ ID NO: 3923) | 2666 | 2758 |
| T78438_T24 (SEQ ID NO: 3924) | 2501 | 2593 |
| T78438_T27 (SEQ ID NO: 3925) | 3088 | 3180 |
| T78438_T28 (SEQ ID NO: 3926) | 2666 | 2758 |
| T78438_T29 (SEQ ID NO: 3927) | 2495 | 2587 |

This segment can be found in both coding and non-coding regions of transcript(s) as follows. The segment can be found in a non-coding region of transcript(s) that are related to the following protein(s): T78438_P14. This segment can also be found in the following protein(s): T78438_P21, T78438_P10 and T78438_P12, since it is in the coding region for the corresponding transcript.

Segment cluster T78438_node_15 (SEQ ID NO:3947) according to the present invention is supported by 97 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3760 below describes the starting and ending position of this segment on each transcript.

TABLE 3760

Segment location on transcripts

| Transcript name | Segment starting position | Segment ending position |
|---|---|---|
| T78438_T4 (SEQ ID NO: 3922) | 4181 | 4219 |
| T78438_T20 (SEQ ID NO: 3923) | 2759 | 2797 |
| T78438_T24 (SEQ ID NO: 3924) | 2797 | 2835 |
| T78438_T27 (SEQ ID NO: 3925) | 3181 | 3219 |
| T78438_T28 (SEQ ID NO: 3926) | 2962 | 3000 |
| T78438_T29 (SEQ ID NO: 3927) | 2588 | 2626 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node_16 (SEQ ID NO:3948) according to the present invention is supported by 98 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3761 below describes the starting and ending position of this segment on each transcript.

TABLE 3761

Segment location on transcripts

| Transcript name | Segment starting position | Segment ending position |
|---|---|---|
| T78438_T4 (SEQ ID NO: 3922) | 4220 | 4261 |
| T78438_T20 (SEQ ID NO: 3923) | 2798 | 2839 |
| T78438_T24 (SEQ ID NO: 3924) | 2836 | 2877 |
| T78438_T27 (SEQ ID NO: 3925) | 3220 | 3261 |
| T78438_T28 (SEQ ID NO: 3926) | 3001 | 3042 |
| T78438_T29 (SEQ ID NO: 3927) | 2627 | 2668 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node__17 (SEQ ID NO:3949) according to the present invention is supported by 93 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3762 below describes the starting and ending position of this segment on each transcript.

TABLE 3762

Segment location on transcripts

| Transcript name | Segment starting position | Segment ending position |
|---|---|---|
| T78438_T4 (SEQ ID NO: 3922) | 4262 | 4300 |
| T78438_T20 (SEQ ID NO: 3923) | 2840 | 2878 |
| T78438_T24 (SEQ ID NO: 3924) | 2878 | 2916 |
| T78438_T27 (SEQ ID NO: 3925) | 3262 | 3300 |
| T78438_T28 (SEQ ID NO: 3926) | 3043 | 3081 |
| T78438_T29 (SEQ ID NO: 3927) | 2669 | 2707 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node__21 (SEQ ID NO:3950) according to the present invention is supported by 106 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3763 below describes the starting and ending position of this segment on each transcript.

TABLE 3763

Segment location on transcripts

| Transcript name | Segment starting position | Segment ending position |
|---|---|---|
| T78438_T4 (SEQ ID NO: 3922) | 4301 | 4372 |
| T78438_T20 (SEQ ID NO: 3923) | 2879 | 2950 |
| T78438_T24 (SEQ ID NO: 3924) | 2917 | 2988 |
| T78438_T27 (SEQ ID NO: 3925) | 3301 | 3372 |
| T78438_T28 (SEQ ID NO: 3926) | 3082 | 3153 |
| T78438_T29 (SEQ ID NO: 3927) | 2708 | 2779 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node__22 (SEQ ID NO:3951) according to the present invention can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3764 below describes the starting and ending position of this segment on each transcript.

TABLE 3764

Segment location on transcripts

| Transcript name | Segment starting position | Segment ending position |
|---|---|---|
| T78438_T4 (SEQ ID NO: 3922) | 4373 | 4390 |
| T78438_T20 (SEQ ID NO: 3923) | 2951 | 2968 |
| T78438_T24 (SEQ ID NO: 3924) | 2989 | 3006 |
| T78438_T27 (SEQ ID NO: 3925) | 3373 | 3390 |
| T78438_T28 (SEQ ID NO: 3926) | 3154 | 3171 |
| T78438_T29 (SEQ ID NO: 3927) | 2780 | 2797 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node__24 (SEQ ID NO:3952) according to the present invention is supported by 119 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3765 below describes the starting and ending position of this segment on each transcript.

TABLE 3765

Segment location on transcripts

| Transcript name | Segment starting position | Segment ending position |
|---|---|---|
| T78438_T4 (SEQ ID NO: 3922) | 4391 | 4507 |
| T78438_T20 (SEQ ID NO: 3923) | 2969 | 3085 |

TABLE 3765-continued

Segment location on transcripts

| Transcript name | Segment starting position | Segment ending position |
|---|---|---|
| T78438_T24 (SEQ ID NO: 3924) | 3007 | 3123 |
| T78438_T27 (SEQ ID NO: 3925) | 3391 | 3507 |
| T78438_T28 (SEQ ID NO: 3926) | 3172 | 3288 |
| T78438_T29 (SEQ ID NO: 3927) | 2798 | 2914 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node_28 (SEQ ID NO:3953) according to the present invention is supported by 131 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926) and T78438_T29 (SEQ ID NO:3927). Table 3766 below describes the starting and ending position of this segment on each transcript.

TABLE 3766

Segment location on transcripts

| Transcript name | Segment starting position | Segment ending position |
|---|---|---|
| T78438_T4 (SEQ ID NO: 3922) | 4672 | 4703 |
| T78438_T20 (SEQ ID NO: 3923) | 3250 | 3281 |
| T78438_T24 (SEQ ID NO: 3924) | 3288 | 3319 |
| T78438_T27 (SEQ ID NO: 3925) | 3672 | 3703 |
| T78438_T28 (SEQ ID NO: 3926) | 3453 | 3484 |
| T78438_T29 (SEQ ID NO: 3927) | 3079 | 3110 |

This segment can be found in both coding and non-coding regions of transcript(s) as follows. The segment can be found in a non-coding region of transcript(s) that are related to the following protein(s): T78438_P12 and T78438_P14. This segment can also be found in the following protein(s): T78438_P21 and T78438_P10, since it is in the coding region for the corresponding transcript.

Segment cluster T78438_node_33 (SEQ ID NO:3954) according to the present invention is supported by 140 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3767 below describes the starting and ending position of this segment on each transcript.

TABLE 3767

Segment location on transcripts

| Transcript name | Segment starting position | Segment ending position |
|---|---|---|
| T78438_T4 (SEQ ID NO: 3922) | 4704 | 4781 |
| T78438_T20 (SEQ ID NO: 3923) | 3282 | 3359 |
| T78438_T24 (SEQ ID NO: 3924) | 3320 | 3397 |
| T78438_T27 (SEQ ID NO: 3925) | 3704 | 3781 |
| T78438_T28 (SEQ ID NO: 3926) | 3485 | 3562 |
| T78438_T29 (SEQ ID NO: 3927) | 3111 | 3188 |
| T78438_T37 (SEQ ID NO: 3928) | 2887 | 2964 |

This segment can be found in both coding and non-coding regions of transcript(s) as follows. The segment can be found in a non-coding region of transcript(s) that are related to the following protein(s): T78438_P12, T78438_P14 and T78438_P18. This segment can also be found in the following protein(s): T78438_P21 and T78438_P10, since it is in the coding region for the corresponding transcript.

Segment cluster T78438_node_35 (SEQ ID NO:3955) according to the present invention can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3768 below describes the starting and ending position of this segment on each transcript.

TABLE 3768

Segment location on transcripts

| Transcript name | Segment starting position | Segment ending position |
|---|---|---|
| T78438_T4 (SEQ ID NO: 3922) | 4904 | 4908 |
| T78438_T20 (SEQ ID NO: 3923) | 3482 | 3486 |
| T78438_T24 (SEQ ID NO: 3924) | 3520 | 3524 |
| T78438_T27 (SEQ ID NO: 3925) | 3904 | 3908 |
| T78438_T28 (SEQ ID NO: 3926) | 3685 | 3689 |
| T78438_T29 (SEQ ID NO: 3927) | 3311 | 3315 |
| T78438_T37 (SEQ ID NO: 3928) | 3087 | 3091 |

This segment can be found in a non-coding region of transcript(s) that are related to the following protein(s): T78438_P21, T78438_P10, T78438_P12, T78438_P14 and T78438_P18.

Segment cluster T78438_node_36 (SEQ ID NO:3956) according to the present invention is supported by 178 libraries. The number of libraries was determined as previously described. This segment can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3769 below describes the starting and ending position of this segment on each transcript.

TABLE 3769

Segment location on transcripts

| Transcript name | Segment starting position | Segment ending position |
|---|---|---|
| T78438_T4 (SEQ ID NO: 3922) | 4909 | 5008 |
| T78438_T20 (SEQ ID NO: 3923) | 3487 | 3586 |
| T78438_T24 (SEQ ID NO: 3924) | 3525 | 3624 |
| T78438_T27 (SEQ ID NO: 3925) | 3909 | 4008 |
| T78438_T28 (SEQ ID NO: 3926) | 3690 | 3789 |
| T78438_T29 (SEQ ID NO: 3927) | 3316 | 3415 |
| T78438_T37 (SEQ ID NO: 3928) | 3092 | 3191 |

This segment can be found in a non-coding region of transcript(s) that are related to the following protein(s): T78438_P21, T78438_P10, T78438_P12, T78438_P14 and T78438_P18.

Segment cluster T78438_node_37 (SEQ ID NO:3957) according to the present invention can be found in the following transcript(s): T78438_T4 (SEQ ID NO:3922), T78438_T20 (SEQ ID NO:3923), T78438_T24 (SEQ ID NO:3924), T78438_T27 (SEQ ID NO:3925), T78438_T28 (SEQ ID NO:3926), T78438_T29 (SEQ ID NO:3927) and T78438_T37 (SEQ ID NO:3928). Table 3770 below describes the starting and ending position of this segment on each transcript.

TABLE 3770

Segment location on transcripts

| Transcript name | Segment starting position | Segment ending position |
|---|---|---|
| T78438_T4 (SEQ ID NO: 3922) | 5009 | 5014 |
| T78438_T20 (SEQ ID NO: 3923) | 3587 | 3592 |
| T78438_T24 (SEQ ID NO: 3924) | 3625 | 3630 |
| T78438_T27 (SEQ ID NO: 3925) | 4009 | 4014 |
| T78438_T28 (SEQ ID NO: 3926) | 3790 | 3795 |
| T78438_T29 (SEQ ID NO: 3927) | 3416 | 3421 |
| T78438_T37 (SEQ ID NO: 3928) | 3192 | 3197 |

This segment can be found in a non-coding region of transcript(s) that are related to the following protein(s): T78438_P21, T78438_P10, T78438_P12, T78438_P14 and T78438_P18.

Description for Cluster T86345

Cluster T86345 features 21 transcript(s) and 45 segment(s) of interest, the names for which are given in Tables 3771 and 3772, respectively, the sequences themselves are given at the end of the application. The selected protein variants are given in Table 3773.

TABLE 3771

Transcripts of interest
Transcript Name

T86345_T0 (SEQ ID NO: 3958)
T86345_T2 (SEQ ID NO: 3959)
T86345_T3 (SEQ ID NO: 3960)
T86345_T4 (SEQ ID NO: 3961)
T86345_T5 (SEQ ID NO: 3962)
T86345_T6 (SEQ ID NO: 3963)
T86345_T7 (SEQ ID NO: 3964)
T86345_T8 (SEQ ID NO: 3965)
T86345_T10 (SEQ ID NO: 3966)
T86345_T11 (SEQ ID NO: 3967)
T86345_T12 (SEQ ID NO: 3968)
T86345_T13 (SEQ ID NO: 3969)

TABLE 3771-continued

Transcripts of interest
Transcript Name

T86345_T14 (SEQ ID NO: 3970)
T86345_T16 (SEQ ID NO: 3971)
T86345_T17 (SEQ ID NO: 3972)
T86345_T18 (SEQ ID NO: 3973)
T86345_T19 (SEQ ID NO: 3974)
T86345_T23 (SEQ ID NO: 3975)
T86345_T24 (SEQ ID NO: 3976)
T86345_T32 (SEQ ID NO: 3977)
T86345_T33 (SEQ ID NO: 3978)

TABLE 3772

Segments of interest
Segment Name

T86345_node_1 (SEQ ID NO: 3979)
T86345_node_6 (SEQ ID NO: 3980)
T86345_node_12 (SEQ ID NO: 3981)
T86345_node_16 (SEQ ID NO: 3982)
T86345_node_20 (SEQ ID NO: 3983)
T86345_node_25 (SEQ ID NO: 3984)
T86345_node_28 (SEQ ID NO: 3985)
T86345_node_39 (SEQ ID NO: 3986)
T86345_node_41 (SEQ ID NO: 3987)
T86345_node_42 (SEQ ID NO: 3988)
T86345_node_46 (SEQ ID NO: 3989)
T86345_node_51 (SEQ ID NO: 3990)
T86345_node_53 (SEQ ID NO: 3991)
T86345_node_58 (SEQ ID NO: 3992)
T86345_node_65 (SEQ ID NO: 3993)
T86345_node_78 (SEQ ID NO: 3994)
T86345_node_80 (SEQ ID NO: 3995)
T86345_node_0 (SEQ ID NO: 3996)
T86345_node_3 (SEQ ID NO: 3997)
T86345_node_4 (SEQ ID NO: 3998)
T86345_node_8 (SEQ ID NO: 3999)
T86345_node_10 (SEQ ID NO: 4000)
T86345_node_14 (SEQ ID NO: 4001)
T86345_node_18 (SEQ ID NO: 4002)
T86345_node_22 (SEQ ID NO: 4003)
T86345_node_36 (SEQ ID NO: 4004)
T86345_node_47 (SEQ ID NO: 4005)
T86345_node_50 (SEQ ID NO: 4006)
T86345_node_52 (SEQ ID NO: 4007)
T86345_node_54 (SEQ ID NO: 4008)
T86345_node_55 (SEQ ID NO: 4009)
T86345_node_56 (SEQ ID NO: 4010)
T86345_node_60 (SEQ ID NO: 4011)
T86345_node_61 (SEQ ID NO: 4012)
T86345_node_63 (SEQ ID NO: 4013)
T86345_node_64 (SEQ ID NO: 4014)
T86345_node_67 (SEQ ID NO: 4015)
T86345_node_70 (SEQ ID NO: 4016)
T86345_node_71 (SEQ ID NO: 4017)
T86345_node_72 (SEQ ID NO: 4018)
T86345_node_73 (SEQ ID NO: 4019)
T86345_node_75 (SEQ ID NO: 4020)
T86345_node_76 (SEQ ID NO: 4021)
T86345_node_79 (SEQ ID NO: 4022)
T86345_node_82 (SEQ ID NO: 4023)

TABLE 3773

Proteins of interest

| Protein Name | Corresponding Transcript(s) |
|---|---|
| T86345_P3 | T86345_T2 (SEQ ID NO: 3959); T86345_T4 (SEQ ID NO: 3961); T86345_T23 (SEQ ID NO: 3975) |

TABLE 3773-continued

Proteins of interest

| Protein Name | Corresponding Transcript(s) |
|---|---|
| T86345_P4 | T86345_T3 (SEQ ID NO: 3960) |
| T86345_P5 | T86345_T5 (SEQ ID NO: 3962) |
| T86345_P6 | T86345_T6 (SEQ ID NO: 3963) |
| T86345_P7 | T86345_T8 (SEQ ID NO: 3965) |
| T86345_P9 | T86345_T10 (SEQ ID NO: 3966) |
| T86345_P10 | T86345_T11 (SEQ ID NO: 3967) |
| T86345_P11 | T86345_T12 (SEQ ID NO: 3968) |
| T86345_P12 | T86345_T13 (SEQ ID NO: 3969); T86345_T16 (SEQ ID NO: 3971); T86345_T18 (SEQ ID NO: 3973) |
| T86345_P13 | T86345_T14 (SEQ ID NO: 3970) |
| T86345_P15 | T86345_T17 (SEQ ID NO: 3972) |
| T86345_P16 | T86345_T19 (SEQ ID NO: 3974) |
| T86345_P18 | T86345_T24 (SEQ ID NO: 3976) |
| T86345_P24 | T86345_T0 (SEQ ID NO: 3958); T86345_T7 (SEQ ID NO: 3964) |

Cluster T86345 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 94 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 94 and Table 3774. This cluster is overexpressed (at least at a minimum level) in the following pathological conditions: adrenal cortical carcinoma, epithelial malignant tumors and gastric carcinoma.

TABLE 3774

Normal tissue distribution

| Name of Tissue | Number |
|---|---|
| adrenal | 0 |
| bone | 0 |
| brain | 25 |
| colon | 63 |
| epithelial | 8 |
| general | 18 |
| kidney | 2 |
| liver | 4 |
| lung | 4 |
| lymph nodes | 18 |
| breast | 0 |
| bone marrow | 0 |
| muscle | 1 |
| ovary | 0 |
| pancreas | 22 |
| prostate | 4 |
| skin | 0 |
| stomach | 0 |
| uterus | 27 |

TABLE 3775

P values and ratios for expression in cancerous tissue

| Name of Tissue | P1 | P2 | SP1 | R3 | SP2 | R4 |
|---|---|---|---|---|---|---|
| adrenal | 1.5e-01 | 1.9e-01 | 1.9e-03 | 5.7 | 6.7e-03 | 4.5 |
| bone | 1 | 4.3e-01 | 1 | 1.0 | 4.9e-01 | 1.9 |
| brain | 8.1e-01 | 8.7e-01 | 1 | 0.2 | 1 | 0.2 |
| colon | 5.7e-01 | 6.9e-01 | 6.4e-01 | 1.1 | 8.0e-01 | 0.8 |

TABLE 3775-continued

P values and ratios for expression in cancerous tissue

| Name of Tissue | P1 | P2 | SP1 | R3 | SP2 | R4 |
|---|---|---|---|---|---|---|
| epithelial | 3.2e-04 | 7.6e-04 | 1.7e-05 | 4.2 | 2.6e-04 | 3.3 |
| general | 1.3e-02 | 2.2e-02 | 4.0e-03 | 1.7 | 2.0e-02 | 1.4 |
| kidney | 8.6e-01 | 9.0e-01 | 5.8e-01 | 1.6 | 7.0e-01 | 1.3 |
| liver | 9.1e-01 | 6.0e-01 | 1 | 0.9 | 3.3e-01 | 2.2 |
| lung | 8.9e-02 | 1.9e-01 | 6.9e-02 | 4.3 | 2.4e-01 | 2.4 |
| lymph nodes | 5.1e-01 | 6.0e-01 | 4.9e-01 | 1.8 | 6.1e-01 | 1.2 |
| breast | 5.9e-01 | 4.4e-01 | 6.9e-01 | 1.5 | 6.8e-01 | 1.4 |
| bone marrow | 1 | 6.7e-01 | 1 | 1.0 | 5.3e-01 | 1.9 |
| muscle | 4.0e-01 | 4.8e-01 | 1.5e-01 | 6.1 | 3.9e-01 | 2.3 |
| ovary | 2.4e-01 | 2.8e-01 | 4.7e-01 | 1.9 | 5.9e-01 | 1.6 |
| pancreas | 8.8e-01 | 7.7e-01 | 1 | 0.3 | 8.9e-01 | 0.6 |
| prostate | 3.7e-01 | 3.3e-01 | 1 | 1.4e-01 | 2.9 | 1.3e-01 | 2.8 |
| skin | 2.3e-01 | 1.8e-01 | 1.4e-01 | 7.0 | 4.1e-01 | 2.1 |
| stomach | 3.0e-03 | 3.8e-02 | 2.5e-01 | 3.1 | 2.1e-01 | 2.8 |
| uterus | 6.2e-01 | 7.3e-01 | 7.4e-01 | 0.9 | 7.4e-01 | 0.9 |

As noted above, cluster T86345 features 45 segment(s), which were listed in Table 3772 above and for which the sequence(s) are given at the end of the application. These segment(s) are portions of nucleic acid sequence(s) which are described herein separately because they are of particular interest. A description of each segment according to the present invention is now provided.

Segment cluster T86345_node_1 (SEQ ID NO:3979) according to the present invention is supported by 25 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3776 below describes the starting and ending position of this segment on each transcript.

TABLE 3776

Segment location on transcripts

| Transcript name | Segment starting position | Segment ending position |
|---|---|---|
| T86345_T0 (SEQ ID NO: 3958) | 29 | 288 |
| T86345_T2 (SEQ ID NO: 3959) | 29 | 288 |
| T86345_T3 (SEQ ID NO: 3960) | 29 | 288 |
| T86345_T4 (SEQ ID NO: 3961) | 29 | 288 |
| T86345_T5 (SEQ ID NO: 3962) | 29 | 288 |
| T86345_T6 (SEQ ID NO: 3963) | 29 | 288 |
| T86345_T7 (SEQ ID NO: 3964) | 29 | 288 |
| T86345_T8 (SEQ ID NO: 3965) | 29 | 288 |
| T86345_T10 (SEQ ID NO: 3966) | 29 | 288 |
| T86345_T11 (SEQ ID NO: 3967) | 29 | 288 |
| T86345_T12 (SEQ ID NO: 3968) | 29 | 288 |
| T86345_T13 (SEQ ID NO: 3969) | 29 | 288 |
| T86345_T14 (SEQ ID NO: 3970) | 29 | 288 |
| T86345_T16 (SEQ ID NO: 3971) | 29 | 288 |
| T86345_T17 (SEQ ID NO: 3972) | 29 | 288 |
| T86345_T18 (SEQ ID NO: 3973) | 29 | 288 |
| T86345_T19 (SEQ ID NO: 3974) | 29 | 288 |

TABLE 3776-continued

Segment location on transcripts

| Transcript name | Segment starting position | Segment ending position |
|---|---|---|
| T86345_T23 (SEQ ID NO: 3975) | 29 | 288 |
| T86345_T24 (SEQ ID NO: 3976) | 29 | 288 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_6 (SEQ ID NO:3980) according to the present invention is supported by 27 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3777 below describes the starting and ending position of this segment on each transcript.

TABLE 3777

Segment location on transcripts

| Transcript name | Segment starting position | Segment ending position |
|---|---|---|
| T86345_T0 (SEQ ID NO: 3958) | 464 | 604 |
| T86345_T2 (SEQ ID NO: 3959) | 464 | 604 |
| T86345_T3 (SEQ ID NO: 3960) | 464 | 604 |
| T86345_T4 (SEQ ID NO: 3961) | 464 | 604 |
| T86345_T5 (SEQ ID NO: 3962) | 464 | 604 |
| T86345_T6 (SEQ ID NO: 3963) | 464 | 604 |
| T86345_T7 (SEQ ID NO: 3964) | 464 | 604 |
| T86345_T8 (SEQ ID NO: 3965) | 464 | 604 |
| T86345_T10 (SEQ ID NO: 3966) | 464 | 604 |
| T86345_T11 (SEQ ID NO: 3967) | 464 | 604 |
| T86345_T12 (SEQ ID NO: 3968) | 464 | 604 |
| T86345_T13 (SEQ ID NO: 3969) | 464 | 604 |
| T86345_T14 (SEQ ID NO: 3970) | 464 | 604 |
| T86345_T16 (SEQ ID NO: 3971) | 464 | 604 |
| T86345_T17 (SEQ ID NO: 3972) | 464 | 604 |
| T86345_T18 (SEQ ID NO: 3973) | 464 | 604 |
| T86345_T19 (SEQ ID NO: 3974) | 464 | 604 |
| T86345_T23 (SEQ ID NO: 3975) | 464 | 604 |
| T86345_T24 (SEQ ID NO: 3976) | 464 | 604 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_12 (SEQ ID NO:3981) according to the present invention is supported by 23 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3778 below describes the starting and ending position of this segment on each transcript.

TABLE 3778

Segment location on transcripts

| Transcript name | Segment starting position | Segment ending position |
|---|---|---|
| T86345_T0 (SEQ ID NO: 3958) | 729 | 911 |
| T86345_T2 (SEQ ID NO: 3959) | 729 | 911 |
| T86345_T3 (SEQ ID NO: 3960) | 729 | 911 |
| T86345_T4 (SEQ ID NO: 3961) | 729 | 911 |
| T86345_T5 (SEQ ID NO: 3962) | 729 | 911 |
| T86345_T6 (SEQ ID NO: 3963) | 729 | 911 |
| T86345_T7 (SEQ ID NO: 3964) | 729 | 911 |
| T86345_T8 (SEQ ID NO: 3965) | 729 | 911 |
| T86345_T10 (SEQ ID NO: 3966) | 729 | 911 |
| T86345_T11 (SEQ ID NO: 3967) | 729 | 911 |
| T86345_T12 (SEQ ID NO: 3968) | 729 | 911 |
| T86345_T13 (SEQ ID NO: 3969) | 729 | 911 |
| T86345_T14 (SEQ ID NO: 3970) | 729 | 911 |
| T86345_T16 (SEQ ID NO: 3971) | 729 | 911 |
| T86345_T17 (SEQ ID NO: 3972) | 729 | 911 |
| T86345_T18 (SEQ ID NO: 3973) | 729 | 911 |
| T86345_T19 (SEQ ID NO: 3974) | 729 | 911 |
| T86345_T23 (SEQ ID NO: 3975) | 729 | 911 |
| T86345_T24 (SEQ ID NO: 3976) | 729 | 911 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_16 (SEQ ID NO:3982) according to the present invention is supported by 15 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3779 below describes the starting and ending position of this segment on each transcript.

TABLE 3779

Segment location on transcripts

| Transcript name | Segment starting position | Segment ending position |
|---|---|---|
| T86345_T0 (SEQ ID NO: 3958) | 1020 | 1175 |
| T86345_T2 (SEQ ID NO: 3959) | 1020 | 1175 |
| T86345_T3 (SEQ ID NO: 3960) | 1020 | 1175 |
| T86345_T4 (SEQ ID NO: 3961) | 1020 | 1175 |
| T86345_T5 (SEQ ID NO: 3962) | 1020 | 1175 |
| T86345_T6 (SEQ ID NO: 3963) | 1020 | 1175 |
| T86345_T7 (SEQ ID NO: 3964) | 1020 | 1175 |
| T86345_T8 (SEQ ID NO: 3965) | 1020 | 1175 |
| T86345_T10 (SEQ ID NO: 3966) | 1020 | 1175 |
| T86345_T11 (SEQ ID NO: 3967) | 1020 | 1175 |
| T86345_T12 (SEQ ID NO: 3968) | 1020 | 1175 |
| T86345_T13 (SEQ ID NO: 3969) | 1020 | 1175 |
| T86345_T14 (SEQ ID NO: 3970) | 1020 | 1175 |
| T86345_T16 (SEQ ID NO: 3971) | 1020 | 1175 |
| T86345_T17 (SEQ ID NO: 3972) | 1020 | 1175 |
| T86345_T18 (SEQ ID NO: 3973) | 1020 | 1175 |
| T86345_T19 (SEQ ID NO: 3974) | 1020 | 1175 |
| T86345_T23 (SEQ ID NO: 3975) | 1020 | 1175 |
| T86345_T24 (SEQ ID NO: 3976) | 1020 | 1175 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_20 (SEQ ID NO:3983) according to the present invention is supported by 16 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3780 below describes the starting and ending position of this segment on each transcript.

TABLE 3780

Segment location on transcripts

| Transcript name | Segment starting position | Segment ending position |
|---|---|---|
| T86345_T0 (SEQ ID NO: 3958) | 1277 | 1418 |
| T86345_T2 (SEQ ID NO: 3959) | 1277 | 1418 |
| T86345_T3 (SEQ ID NO: 3960) | 1277 | 1418 |
| T86345_T4 (SEQ ID NO: 3961) | 1277 | 1418 |
| T86345_T5 (SEQ ID NO: 3962) | 1277 | 1418 |
| T86345_T6 (SEQ ID NO: 3963) | 1277 | 1418 |
| T86345_T7 (SEQ ID NO: 3964) | 1277 | 1418 |
| T86345_T8 (SEQ ID NO: 3965) | 1277 | 1418 |
| T86345_T11 (SEQ ID NO: 3967) | 1277 | 1418 |
| T86345_T12 (SEQ ID NO: 3968) | 1277 | 1418 |
| T86345_T13 (SEQ ID NO: 3969) | 1277 | 1418 |
| T86345_T14 (SEQ ID NO: 3970) | 1277 | 1418 |
| T86345_T16 (SEQ ID NO: 3971) | 1277 | 1418 |
| T86345_T17 (SEQ ID NO: 3972) | 1277 | 1418 |
| T86345_T18 (SEQ ID NO: 3973) | 1277 | 1418 |
| T86345_T19 (SEQ ID NO: 3974) | 1277 | 1418 |
| T86345_T23 (SEQ ID NO: 3975) | 1277 | 1418 |
| T86345_T24 (SEQ ID NO: 3976) | 1277 | 1418 |

This segment can be found in both coding and non-coding regions of transcript(s) as follows. The segment can be found in a non-coding region of transcript(s) that are related to the following protein(s): T86345_P24. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_25 (SEQ ID NO:3984) according to the present invention is supported by 30 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3781 below describes the starting and ending position of this segment on each transcript.

TABLE 3781

Segment location on transcripts

| Transcript name | Segment starting position | Segment ending position |
|---|---|---|
| T86345_T0 (SEQ ID NO: 3958) | 1490 | 1665 |
| T86345_T2 (SEQ ID NO: 3959) | 1490 | 1665 |
| T86345_T3 (SEQ ID NO: 3960) | 1490 | 1665 |
| T86345_T4 (SEQ ID NO: 3961) | 1490 | 1665 |
| T86345_T5 (SEQ ID NO: 3962) | 1490 | 1665 |
| T86345_T6 (SEQ ID NO: 3963) | 1490 | 1665 |
| T86345_T7 (SEQ ID NO: 3964) | 1490 | 1665 |
| T86345_T11 (SEQ ID NO: 3967) | 1490 | 1665 |
| T86345_T12 (SEQ ID NO: 3968) | 1490 | 1665 |
| T86345_T13 (SEQ ID NO: 3969) | 1490 | 1665 |
| T86345_T14 (SEQ ID NO: 3970) | 1490 | 1665 |
| T86345_T16 (SEQ ID NO: 3971) | 1490 | 1665 |
| T86345_T17 (SEQ ID NO: 3972) | 1490 | 1665 |
| T86345_T18 (SEQ ID NO: 3973) | 1490 | 1665 |
| T86345_T19 (SEQ ID NO: 3974) | 1490 | 1665 |

TABLE 3781-continued

Segment location on transcripts

| Transcript name | Segment starting position | Segment ending position |
| --- | --- | --- |
| T86345_T23 (SEQ ID NO: 3975) | 1490 | 1665 |
| T86345_T24 (SEQ ID NO: 3976) | 1490 | 1665 |

This segment can be found in the following protein(s): T86345_P24, T86345_P3, T86345_P4, T86345_P5, T86345_P6, T86345_P10, T86345_P11, T86345_P12, T86345_P13, T86345_P15, T86345_P16 and T86345_P18.

Segment cluster T86345_node_28 (SEQ ID NO:3985) according to the present invention is supported by 31 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3782 below describes the starting and ending position of this segment on each transcript.

TABLE 3782

Segment location on transcripts

| Transcript name | Segment starting position | Segment ending position |
| --- | --- | --- |
| T86345_T0 (SEQ ID NO: 3958) | 1666 | 1799 |
| T86345_T2 (SEQ ID NO: 3959) | 1666 | 1799 |
| T86345_T3 (SEQ ID NO: 3960) | 1666 | 1799 |
| T86345_T4 (SEQ ID NO: 3961) | 1666 | 1799 |
| T86345_T5 (SEQ ID NO: 3962) | 1666 | 1799 |
| T86345_T6 (SEQ ID NO: 3963) | 1666 | 1799 |
| T86345_T7 (SEQ ID NO: 3964) | 1666 | 1799 |
| T86345_T8 (SEQ ID NO: 3965) | 1490 | 1623 |
| T86345_T10 (SEQ ID NO: 3966) | 1348 | 1481 |
| T86345_T11 (SEQ ID NO: 3967) | 1666 | 1799 |
| T86345_T12 (SEQ ID NO: 3968) | 1666 | 1799 |
| T86345_T13 (SEQ ID NO: 3969) | 1666 | 1799 |
| T86345_T14 (SEQ ID NO: 3970) | 1666 | 1799 |
| T86345_T16 (SEQ ID NO: 3971) | 1666 | 1799 |
| T86345_T17 (SEQ ID NO: 3972) | 1666 | 1799 |
| T86345_T18 (SEQ ID NO: 3973) | 1666 | 1799 |
| T86345_T19 (SEQ ID NO: 3974) | 1666 | 1799 |
| T86345_T23 (SEQ ID NO: 3975) | 1666 | 1799 |
| T86345_T24 (SEQ ID NO: 3976) | 1666 | 1799 |

This segment can be found in the following protein(s): T86345_P24, T86345_P3, T86345_P4, T86345_P5, T86345_P6, T86345_P7, T86345_P9, T86345_P10, T86345_P11, T86345_P12, T86345_P13, T86345_P15, T86345_P16 and T86345_P18.

Segment cluster T86345_node_39 (SEQ ID NO:3986) according to the present invention is supported by 46 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3783 below describes the starting and ending position of this segment on each transcript.

TABLE 3783

Segment location on transcripts

| Transcript name | Segment starting position | Segment ending position |
| --- | --- | --- |
| T86345_T0 (SEQ ID NO: 3958) | 1911 | 2112 |
| T86345_T2 (SEQ ID NO: 3959) | 1911 | 2112 |
| T86345_T3 (SEQ ID NO: 3960) | 1911 | 2112 |
| T86345_T4 (SEQ ID NO: 3961) | 1911 | 2112 |
| T86345_T5 (SEQ ID NO: 3962) | 1911 | 2112 |
| T86345_T6 (SEQ ID NO: 3963) | 1911 | 2112 |
| T86345_T7 (SEQ ID NO: 3964) | 1911 | 2112 |
| T86345_T8 (SEQ ID NO: 3965) | 1735 | 1936 |
| T86345_T10 (SEQ ID NO: 3966) | 1593 | 1794 |
| T86345_T11 (SEQ ID NO: 3967) | 1911 | 2112 |
| T86345_T12 (SEQ ID NO: 3968) | 1911 | 2112 |
| T86345_T13 (SEQ ID NO: 3969) | 1911 | 2112 |
| T86345_T14 (SEQ ID NO: 3970) | 1911 | 2112 |
| T86345_T16 (SEQ ID NO: 3971) | 1911 | 2112 |
| T86345_T17 (SEQ ID NO: 3972) | 1911 | 2112 |
| T86345_T18 (SEQ ID NO: 3973) | 1911 | 2112 |
| T86345_T19 (SEQ ID NO: 3974) | 1911 | 2112 |
| T86345_T23 (SEQ ID NO: 3975) | 1911 | 2112 |
| T86345_T24 (SEQ ID NO: 3976) | 1911 | 2112 |

This segment can be found in both coding and non-coding regions of transcript(s) as follows. The segment can be found in a non-coding region of transcript(s) that are related to the following protein(s): T86345_P7. This segment can also be found in the following protein(s): T86345_P24, T86345_P3, T86345_P4, T86345_P5, T86345_P6, T86345_P9, T86345_P1, T86345_P11, T86345_P12, T86345_P13, T86345_P15, T86345_P16 and T86345_P18, since it is in the coding region for the corresponding transcript.

Segment cluster T86345_node_41 (SEQ ID NO:3987) according to the present invention is supported by 42 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3784 below describes the starting and ending position of this segment on each transcript.

TABLE 3784

Segment location on transcripts

| Transcript name | Segment starting position | Segment ending position |
|---|---|---|
| T86345_T0 (SEQ ID NO: 3958) | 2113 | 2234 |
| T86345_T2 (SEQ ID NO: 3959) | 2113 | 2234 |
| T86345_T3 (SEQ ID NO: 3960) | 2113 | 2234 |
| T86345_T4 (SEQ ID NO: 3961) | 2113 | 2234 |
| T86345_T5 (SEQ ID NO: 3962) | 2113 | 2234 |
| T86345_T6 (SEQ ID NO: 3963) | 2113 | 2234 |
| T86345_T7 (SEQ ID NO: 3964) | 2113 | 2234 |
| T86345_T8 (SEQ ID NO: 3965) | 1937 | 2058 |
| T86345_T10 (SEQ ID NO: 3966) | 1795 | 1916 |
| T86345_T11 (SEQ ID NO: 3967) | 2113 | 2234 |
| T86345_T12 (SEQ ID NO: 3968) | 2113 | 2234 |
| T86345_T13 (SEQ ID NO: 3969) | 2113 | 2234 |
| T86345_T14 (SEQ ID NO: 3970) | 2113 | 2234 |
| T86345_T16 (SEQ ID NO: 3971) | 2113 | 2234 |
| T86345_T17 (SEQ ID NO: 3972) | 2113 | 2234 |
| T86345_T18 (SEQ ID NO: 3973) | 2113 | 2234 |
| T86345_T19 (SEQ ID NO: 3974) | 2113 | 2234 |
| T86345_T23 (SEQ ID NO: 3975) | 2113 | 2234 |
| T86345_T24 (SEQ ID NO: 3976) | 2113 | 2234 |

This segment can be found in both coding and non-coding regions of transcript(s) as follows. The segment can be found in a non-coding region of transcript(s) that are related to the following protein(s): T86345_P7. This segment can also be found in the following protein(s): T86345_P24, T86345_P3, T86345_P4, T86345_P5, T86345_P6, T86345_P9, T86345_P10, T86345_P11, T86345_P12, T86345_P13, T86345_P15, T86345_P16 and T86345_P18, since it is in the coding region for the corresponding transcript.

Segment cluster T86345_node_42 (SEQ ID NO:3988) according to the present invention is supported by 11 libraries. The number of libraries was determined as previously described. This segment can be found in the following transcript(s): T86345_T24 (SEQ ID NO:3976). Table 3785 below describes the starting and ending position of this segment on each transcript.

TABLE 3785

Segment location on transcripts

| Transcript name | Segment starting position | Segment ending position |
|---|---|---|
| T86345_T24 (SEQ ID NO: 3976) | 2235 | 2894 |

This segment can be found in the following protein(s): T86345_P18. Segment cluster T86345_node_46 (SEQ ID NO:3989) according to the present invention is supported by 41 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3786 below describes the starting and ending position of this segment on each transcript.

TABLE 3786

Segment location on transcripts

| Transcript name | Segment starting position | Segment ending position |
|---|---|---|
| T86345_T0 (SEQ ID NO: 3958) | 2235 | 2419 |
| T86345_T2 (SEQ ID NO: 3959) | 2235 | 2419 |
| T86345_T3 (SEQ ID NO: 3960) | 2235 | 2419 |
| T86345_T4 (SEQ ID NO: 3961) | 2235 | 2419 |
| T86345_T5 (SEQ ID NO: 3962) | 2235 | 2419 |
| T86345_T6 (SEQ ID NO: 3963) | 2235 | 2419 |
| T86345_T7 (SEQ ID NO: 3964) | 2235 | 2419 |
| T86345_T8 (SEQ ID NO: 3965) | 2059 | 2243 |
| T86345_T10 (SEQ ID NO: 3966) | 1917 | 2101 |
| T86345_T11 (SEQ ID NO: 3967) | 2235 | 2419 |
| T86345_T13 (SEQ ID NO: 3969) | 2235 | 2419 |
| T86345_T14 (SEQ ID NO: 3970) | 2235 | 2419 |
| T86345_T16 (SEQ ID NO: 3971) | 2235 | 2419 |
| T86345_T17 (SEQ ID NO: 3972) | 2235 | 2419 |
| T86345_T18 (SEQ ID NO: 3973) | 2235 | 2419 |
| T86345_T19 (SEQ ID NO: 3974) | 2235 | 2419 |
| T86345_T23 (SEQ ID NO: 3975) | 2235 | 2419 |

This segment can be found in both coding and non-coding regions of transcript(s) as follows. The segment can be found in a non-coding region of transcript(s) that are related to the following protein(s): T86345_P7. This segment can also be found in the following protein(s): T86345_P24, T86345_P3, T86345_P4, T86345_P5, T86345_P6, T86345_P9, T86345_P10, T86345_P12, T86345_P13, T86345_P15 and T86345_P16, since it is in the coding region for the corresponding transcript.

Segment cluster T86345_node_51 (SEQ ID NO:3990) according to the present invention is supported by 5 libraries. The number of libraries was determined as previously described. This segment can be found in the following transcript(s): T86345_T2 (SEQ ID NO:3959), T86345_T3 (SEQ ID NO:3960), T86345_T4 (SEQ ID NO:3961) and T86345_T23 (SEQ ID NO:3975). Table 3787 below describes the starting and ending position of this segment on each transcript.

TABLE 3787

Segment location on transcripts

| Transcript name | Segment starting position | Segment ending position |
|---|---|---|
| T86345_T2 (SEQ ID NO: 3959) | 2454 | 2573 |
| T86345_T3 (SEQ ID NO: 3960) | 2464 | 2583 |
| T86345_T4 (SEQ ID NO: 3961) | 2454 | 2573 |
| T86345_T23 (SEQ ID NO: 3975) | 2454 | 2573 |

This segment can be found in both coding and non-coding regions of transcript(s) as follows. The segment can be found in a non-coding region of transcript(s) that are related to the following protein(s): T86345_P4. This segment can also be found in the following protein(s): T86345_P3, since it is in the coding region for the corresponding transcript.

Segment cluster T86345_node_53 (SEQ ID NO:3991) according to the present invention is supported by 15 libraries. The number of libraries was determined as previously described. This segment can be found in the following transcript(s): T86345_T2 (SEQ ID NO:3959), T86345_T3 (SEQ ID NO:3960), T86345_T4 (SEQ ID NO:3961) and T86345_T23 (SEQ ID NO:3975). Table 3788 below describes the starting and ending position of this segment on each transcript.

TABLE 3788

Segment location on transcripts

| Transcript name | Segment starting position | Segment ending position |
|---|---|---|
| T86345_T2 (SEQ ID NO: 3959) | 2614 | 3401 |
| T86345_T3 (SEQ ID NO: 3960) | 2624 | 3411 |
| T86345_T4 (SEQ ID NO: 3961) | 2614 | 3401 |
| T86345_T23 (SEQ ID NO: 3975) | 2614 | 3401 |

This segment can be found in a non-coding region of transcript(s) that are related to the following protein(s): T86345_P3 and T86345_P4.

Segment cluster T86345_node_58 (SEQ ID NO:3992) according to the present invention is supported by 3 libraries. The number of libraries was determined as previously described. This segment can be found in the following transcript(s): T86345_T4 (SEQ ID NO:3961) and T86345_T6 (SEQ ID NO:3963). Table 3789 below describes the starting and ending position of this segment on each transcript.

TABLE 3789

Segment location on transcripts

| Transcript name | Segment starting position | Segment ending position |
|---|---|---|
| T86345_T4 (SEQ ID NO: 3961) | 3521 | 3642 |
| T86345_T6 (SEQ ID NO: 3963) | 2573 | 2694 |

This segment can be found in both coding and non-coding regions of transcript(s) as follows. The segment can be found in a non-coding region of transcript(s) that are related to the following protein(s): T86345_P3. This segment can also be found in the following protein(s): T86345_P6, since it is in the coding region for the corresponding transcript.

Segment cluster T86345_node_65 (SEQ ID NO:3993) according to the present invention is supported by 6 libraries. The number of libraries was determined as previously described. This segment can be found in the following transcript(s): T86345_T19 (SEQ ID NO:3974) and T86345_T23 (SEQ ID NO:3975). Table 3790 below describes the starting and ending position of this segment on each transcript.

TABLE 3790

Segment location on transcripts

| Transcript name | Segment starting position | Segment ending position |
|---|---|---|
| T86345_T19 (SEQ ID NO: 3974) | 2796 | 3469 |
| T86345_T23 (SEQ ID NO: 3975) | 3823 | 4496 |

This segment can be found in both coding and non-coding regions of transcript(s) as follows. The segment can be found in a non-coding region of transcript(s) that are related to the following protein(s): T86345_P3. This segment can also be found in the following protein(s): T86345_P16, since it is in the coding region for the corresponding transcript.

Segment cluster T86345_node_78 (SEQ ID NO:3994) according to the present invention is supported by 7 libraries. The number of libraries was determined as previously described. This segment can be found in the following transcript(s): T86345_T32 (SEQ ID NO:3977) and T86345_T33 (SEQ ID NO:3978). Table 3791 below describes the starting and ending position of this segment on each transcript.

TABLE 3791

Segment location on transcripts

| Transcript name | Segment starting position | Segment ending position |
|---|---|---|
| T86345_T32 (SEQ ID NO: 3977) | 1 | 590 |
| T86345_T33 (SEQ ID NO: 3978) | 1 | 590 |

The previously-described transcripts for these segment(s) do not code for protein.

Segment cluster T86345_node_80 (SEQ ID NO:3995) according to the present invention is supported by 68 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T32 (SEQ ID NO:3977) and T86345_T33 (SEQ ID NO:3978). Table 3792 below describes the starting and ending position of this segment on each transcript.

TABLE 3792

Segment location on transcripts

| Transcript name | Segment starting position | Segment ending position |
|---|---|---|
| T86345_T0 (SEQ ID NO: 3958) | 3131 | 3237 |
| T86345_T2 (SEQ ID NO: 3959) | 4079 | 4185 |
| T86345_T3 (SEQ ID NO: 3960) | 4089 | 4195 |
| T86345_T4 (SEQ ID NO: 3961) | 4201 | 4307 |
| T86345_T5 (SEQ ID NO: 3962) | 3171 | 3277 |
| T86345_T6 (SEQ ID NO: 3963) | 3253 | 3359 |
| T86345_T7 (SEQ ID NO: 3964) | 3131 | 3676 |
| T86345_T8 (SEQ ID NO: 3965) | 2955 | 3061 |
| T86345_T10 (SEQ ID NO: 3966) | 2813 | 2919 |
| T86345_T11 (SEQ ID NO: 3967) | 3080 | 3186 |
| T86345_T12 (SEQ ID NO: 3968) | 2912 | 3018 |
| T86345_T13 (SEQ ID NO: 3969) | 3204 | 3310 |
| T86345_T14 (SEQ ID NO: 3970) | 3057 | 3163 |
| T86345_T16 (SEQ ID NO: 3971) | 3204 | 3749 |
| T86345_T32 (SEQ ID NO: 3977) | 692 | 1237 |
| T86345_T33 (SEQ ID NO: 3978) | 692 | 798 |

This segment can be found in both coding and non-coding regions of transcript(s) as follows. The segment can be found in a non-coding region of transcript(s) that are related to the following protein(s): T86345_P3, T86345_P4, T86345_P5, T86345_P6, T86345_P7, T86345_P12 and T86345_P13. This segment can also be found in the following protein(s): T86345_P24, T86345_P9, T86345_P10 and T86345_P11, since it is in the coding region for the corresponding transcript.

According to an optional embodiment of the present invention, short segments related to the above cluster are also provided. These segments are up to about 120 bp in length, and so are included in a separate description.

Segment cluster T86345_node_0 (SEQ ID NO:3996) according to the present invention is supported by 2 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3793 below describes the starting and ending position of this segment on each transcript.

TABLE 3793

Segment location on transcripts

| Transcript name | Segment starting position | Segment ending position |
|---|---|---|
| T86345_T0 (SEQ ID NO: 3958) | 1 | 28 |
| T86345_T2 (SEQ ID NO: 3959) | 1 | 28 |
| T86345_T3 (SEQ ID NO: 3960) | 1 | 28 |
| T86345_T4 (SEQ ID NO: 3961) | 1 | 28 |
| T86345_T5 (SEQ ID NO: 3962) | 1 | 28 |
| T86345_T6 (SEQ ID NO: 3963) | 1 | 28 |
| T86345_T7 (SEQ ID NO: 3964) | 1 | 28 |
| T86345_T8 (SEQ ID NO: 3965) | 1 | 28 |
| T86345_T10 (SEQ ID NO: 3966) | 1 | 28 |
| T86345_T11 (SEQ ID NO: 3967) | 1 | 28 |
| T86345_T12 (SEQ ID NO: 3968) | 1 | 28 |
| T86345_T13 (SEQ ID NO: 3969) | 1 | 28 |
| T86345_T14 (SEQ ID NO: 3970) | 1 | 28 |
| T86345_T16 (SEQ ID NO: 3971) | 1 | 28 |
| T86345_T17 (SEQ ID NO: 3972) | 1 | 28 |
| T86345_T18 (SEQ ID NO: 3973) | 1 | 28 |
| T86345_T19 (SEQ ID NO: 3974) | 1 | 28 |
| T86345_T23 (SEQ ID NO: 3975) | 1 | 28 |
| T86345_T24 (SEQ ID NO: 3976) | 1 | 28 |

This segment can be found in a non-coding region of transcript(s) that are related to the following protein(s): T86345_P24, T86345_P3, T86345_P4, T86345_P5, T86345_P6, T86345_P7, T86345_P9, T86345_P10, T86345_P11, T86345_P12, T86345_P13, T86345_P15, T86345_P16 and T86345_P18.

Segment cluster T86345_node_3 (SEQ ID NO:3997) according to the present invention is supported by 28 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3794 below describes the starting and ending position of this segment on each transcript.

TABLE 3794

Segment location on transcripts

| Transcript name | Segment starting position | Segment ending position |
|---|---|---|
| T86345_T0 (SEQ ID NO: 3958) | 289 | 386 |
| T86345_T2 (SEQ ID NO: 3959) | 289 | 386 |
| T86345_T3 (SEQ ID NO: 3960) | 289 | 386 |
| T86345_T4 (SEQ ID NO: 3961) | 289 | 386 |
| T86345_T5 (SEQ ID NO: 3962) | 289 | 386 |
| T86345_T6 (SEQ ID NO: 3963) | 289 | 386 |
| T86345_T7 (SEQ ID NO: 3964) | 289 | 386 |
| T86345_T8 (SEQ ID NO: 3965) | 289 | 386 |
| T86345_T10 (SEQ ID NO: 3966) | 289 | 386 |
| T86345_T11 (SEQ ID NO: 3967) | 289 | 386 |
| T86345_T12 (SEQ ID NO: 3968) | 289 | 386 |
| T86345_T13 (SEQ ID NO: 3969) | 289 | 386 |
| T86345_T14 (SEQ ID NO: 3970) | 289 | 386 |
| T86345_T16 (SEQ ID NO: 3971) | 289 | 386 |
| T86345_T17 (SEQ ID NO: 3972) | 289 | 386 |
| T86345_T18 (SEQ ID NO: 3973) | 289 | 386 |
| T86345_T19 (SEQ ID NO: 3974) | 289 | 386 |
| T86345_T23 (SEQ ID NO: 3975) | 289 | 386 |
| T86345_T24 (SEQ ID NO: 3976) | 289 | 386 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_4 (SEQ ID NO:3998) according to the present invention is supported by 26 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3795 below describes the starting and ending position of this segment on each transcript.

TABLE 3795

Segment location on transcripts

| Transcript name | Segment starting position | Segment ending position |
|---|---|---|
| T86345_T0 (SEQ ID NO: 3958) | 387 | 463 |
| T86345_T2 (SEQ ID NO: 3959) | 387 | 463 |
| T86345_T3 (SEQ ID NO: 3960) | 387 | 463 |
| T86345_T4 (SEQ ID NO: 3961) | 387 | 463 |
| T86345_T5 (SEQ ID NO: 3962) | 387 | 463 |
| T86345_T6 (SEQ ID NO: 3963) | 387 | 463 |
| T86345_T7 (SEQ ID NO: 3964) | 387 | 463 |
| T86345_T8 (SEQ ID NO: 3965) | 387 | 463 |
| T86345_T10 (SEQ ID NO: 3966) | 387 | 463 |

TABLE 3795-continued

Segment location on transcripts

| Transcript name | Segment starting position | Segment ending position |
| --- | --- | --- |
| T86345_T11 (SEQ ID NO: 3967) | 387 | 463 |
| T86345_T12 (SEQ ID NO: 3968) | 387 | 463 |
| T86345_T13 (SEQ ID NO: 3969) | 387 | 463 |
| T86345_T14 (SEQ ID NO: 3970) | 387 | 463 |
| T86345_T16 (SEQ ID NO: 3971) | 387 | 463 |
| T86345_T17 (SEQ ID NO: 3972) | 387 | 463 |
| T86345_T18 (SEQ ID NO: 3973) | 387 | 463 |
| T86345_T19 (SEQ ID NO: 3974) | 387 | 463 |
| T86345_T23 (SEQ ID NO: 3975) | 387 | 463 |
| T86345_T24 (SEQ ID NO: 3976) | 387 | 463 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_8 (SEQ ID NO:3999) according to the present invention is supported by 23 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3796 below describes the starting and ending position of this segment on each transcript.

TABLE 3796

Segment location on transcripts

| Transcript name | Segment starting position | Segment ending position |
| --- | --- | --- |
| T86345_T0 (SEQ ID NO: 3958) | 605 | 676 |
| T86345_T2 (SEQ ID NO: 3959) | 605 | 676 |
| T86345_T3 (SEQ ID NO: 3960) | 605 | 676 |
| T86345_T4 (SEQ ID NO: 3961) | 605 | 676 |
| T86345_T5 (SEQ ID NO: 3962) | 605 | 676 |
| T86345_T6 (SEQ ID NO: 3963) | 605 | 676 |
| T86345_T7 (SEQ ID NO: 3964) | 605 | 676 |
| T86345_T8 (SEQ ID NO: 3965) | 605 | 676 |
| T86345_T10 (SEQ ID NO: 3966) | 605 | 676 |
| T86345_T11 (SEQ ID NO: 3967) | 605 | 676 |
| T86345_T12 (SEQ ID NO: 3968) | 605 | 676 |
| T86345_T13 (SEQ ID NO: 3969) | 605 | 676 |
| T86345_T14 (SEQ ID NO: 3970) | 605 | 676 |
| T86345_T16 (SEQ ID NO: 3971) | 605 | 676 |
| T86345_T17 (SEQ ID NO: 3972) | 605 | 676 |
| T86345_T18 (SEQ ID NO: 3973) | 605 | 676 |
| T86345_T19 (SEQ ID NO: 3974) | 605 | 676 |
| T86345_T23 (SEQ ID NO: 3975) | 605 | 676 |
| T86345_T24 (SEQ ID NO: 3976) | 605 | 676 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_10 (SEQ ID NO:4000) according to the present invention is supported by 22 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3797 below describes the starting and ending position of this segment on each transcript.

TABLE 3797

Segment location on transcripts

| Transcript name | Segment starting position | Segment ending position |
| --- | --- | --- |
| T86345_T0 (SEQ ID NO: 3958) | 677 | 728 |
| T86345_T2 (SEQ ID NO: 3959) | 677 | 728 |
| T86345_T3 (SEQ ID NO: 3960) | 677 | 728 |
| T86345_T4 (SEQ ID NO: 3961) | 677 | 728 |
| T86345_T5 (SEQ ID NO: 3962) | 677 | 728 |
| T86345_T6 (SEQ ID NO: 3963) | 677 | 728 |
| T86345_T7 (SEQ ID NO: 3964) | 677 | 728 |
| T86345_T8 (SEQ ID NO: 3965) | 677 | 728 |
| T86345_T10 (SEQ ID NO: 3966) | 677 | 728 |
| T86345_T11 (SEQ ID NO: 3967) | 677 | 728 |
| T86345_T12 (SEQ ID NO: 3968) | 677 | 728 |
| T86345_T13 (SEQ ID NO: 3969) | 677 | 728 |
| T86345_T14 (SEQ ID NO: 3970) | 677 | 728 |
| T86345_T16 (SEQ ID NO: 3971) | 677 | 728 |
| T86345_T17 (SEQ ID NO: 3972) | 677 | 728 |
| T86345_T18 (SEQ ID NO: 3973) | 677 | 728 |
| T86345_T19 (SEQ ID NO: 3974) | 677 | 728 |
| T86345_T23 (SEQ ID NO: 3975) | 677 | 728 |
| T86345_T24 (SEQ ID NO: 3976) | 677 | 728 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s):

T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node__14 (SEQ ID NO:4001) according to the present invention is supported by 13 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3798 below describes the starting and ending position of this segment on each transcript.

TABLE 3798

Segment location on transcripts

| Transcript name | Segment starting position | Segment ending position |
|---|---|---|
| T86345_T0 (SEQ ID NO: 3958) | 912 | 1019 |
| T86345_T2 (SEQ ID NO: 3959) | 912 | 1019 |
| T86345_T3 (SEQ ID NO: 3960) | 912 | 1019 |
| T86345_T4 (SEQ ID NO: 3961) | 912 | 1019 |
| T86345_T5 (SEQ ID NO: 3962) | 912 | 1019 |
| T86345_T6 (SEQ ID NO: 3963) | 912 | 1019 |
| T86345_T7 (SEQ ID NO: 3964) | 912 | 1019 |
| T86345_T8 (SEQ ID NO: 3965) | 912 | 1019 |
| T86345_T10 (SEQ ID NO: 3966) | 912 | 1019 |
| T86345_T11 (SEQ ID NO: 3967) | 912 | 1019 |
| T86345_T12 (SEQ ID NO: 3968) | 912 | 1019 |
| T86345_T13 (SEQ ID NO: 3969) | 912 | 1019 |
| T86345_T14 (SEQ ID NO: 3970) | 912 | 1019 |
| T86345_T16 (SEQ ID NO: 3971) | 912 | 1019 |
| T86345_T17 (SEQ ID NO: 3972) | 912 | 1019 |
| T86345_T18 (SEQ ID NO: 3973) | 912 | 1019 |
| T86345_T19 (SEQ ID NO: 3974) | 912 | 1019 |
| T86345_T23 (SEQ ID NO: 3975) | 912 | 1019 |
| T86345_T24 (SEQ ID NO: 3976) | 912 | 1019 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node__18 (SEQ ID NO:4002) according to the present invention is supported by 15 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3799 below describes the starting and ending position of this segment on each transcript.

TABLE 3799

Segment location on transcripts

| Transcript name | Segment starting position | Segment ending position |
|---|---|---|
| T86345_T0 (SEQ ID NO: 3958) | 1176 | 1276 |
| T86345_T2 (SEQ ID NO: 3959) | 1176 | 1276 |
| T86345_T3 (SEQ ID NO: 3960) | 1176 | 1276 |
| T86345_T4 (SEQ ID NO: 3961) | 1176 | 1276 |
| T86345_T5 (SEQ ID NO: 3962) | 1176 | 1276 |
| T86345_T6 (SEQ ID NO: 3963) | 1176 | 1276 |
| T86345_T7 (SEQ ID NO: 3964) | 1176 | 1276 |
| T86345_T8 (SEQ ID NO: 3965) | 1176 | 1276 |
| T86345_T10 (SEQ ID NO: 3966) | 1176 | 1276 |
| T86345_T11 (SEQ ID NO: 3967) | 1176 | 1276 |
| T86345_T12 (SEQ ID NO: 3968) | 1176 | 1276 |
| T86345_T13 (SEQ ID NO: 3969) | 1176 | 1276 |
| T86345_T14 (SEQ ID NO: 3970) | 1176 | 1276 |
| T86345_T16 (SEQ ID NO: 3971) | 1176 | 1276 |
| T86345_T17 (SEQ ID NO: 3972) | 1176 | 1276 |
| T86345_T18 (SEQ ID NO: 3973) | 1176 | 1276 |
| T86345_T19 (SEQ ID NO: 3974) | 1176 | 1276 |
| T86345_T23 (SEQ ID NO: 3975) | 1176 | 1276 |
| T86345_T24 (SEQ ID NO: 3976) | 1176 | 1276 |

This segment can be found in both coding and non-coding regions of transcript(s) as follows. The segment can be found in a non-coding region of transcript(s) that are related to the following protein(s): T86345_P24 and T86345_P9. This segment can also be found in the following protein(s): T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node__22 (SEQ ID NO:4003) according to the present invention is supported by 18 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3800 below describes the starting and ending position of this segment on each transcript.

TABLE 3800

Segment location on transcripts

| Transcript name | Segment starting position | Segment ending position |
|---|---|---|
| T86345_T0 (SEQ ID NO: 3958) | 1419 | 1489 |
| T86345_T2 (SEQ ID NO: 3959) | 1419 | 1489 |
| T86345_T3 (SEQ ID NO: 3960) | 1419 | 1489 |
| T86345_T4 (SEQ ID NO: 3961) | 1419 | 1489 |
| T86345_T5 (SEQ ID NO: 3962) | 1419 | 1489 |
| T86345_T6 (SEQ ID NO: 3963) | 1419 | 1489 |
| T86345_T7 (SEQ ID NO: 3964) | 1419 | 1489 |
| T86345_T8 (SEQ ID NO: 3965) | 1419 | 1489 |
| T86345_T10 (SEQ ID NO: 3966) | 1277 | 1347 |
| T86345_T11 (SEQ ID NO: 3967) | 1419 | 1489 |
| T86345_T12 (SEQ ID NO: 3968) | 1419 | 1489 |
| T86345_T13 (SEQ ID NO: 3969) | 1419 | 1489 |
| T86345_T14 (SEQ ID NO: 3970) | 1419 | 1489 |
| T86345_T16 (SEQ ID NO: 3971) | 1419 | 1489 |
| T86345_T17 (SEQ ID NO: 3972) | 1419 | 1489 |
| T86345_T18 (SEQ ID NO: 3973) | 1419 | 1489 |
| T86345_T19 (SEQ ID NO: 3974) | 1419 | 1489 |
| T86345_T23 (SEQ ID NO: 3975) | 1419 | 1489 |
| T86345_T24 (SEQ ID NO: 3976) | 1419 | 1489 |

This segment can be found in both coding and non-coding regions of transcript(s) as follows. The segment can be found in a non-coding region of transcript(s) that are related to the following protein(s): T86345_P9. This segment can also be found in the following protein(s): T86345_P24, T86345_P3, T86345_P4, T86345_P5, T86345_P6, T86345_P7, T86345_P10, T86345_P11, T86345_P12, T86345_P13, T86345_P15, T86345_P16 and T86345_P18, since it is in the coding region for the corresponding transcript.

Segment cluster T86345_node_36 (SEQ ID NO:4004) according to the present invention is supported by 39 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974), T86345_T23 (SEQ ID NO:3975) and T86345_T24 (SEQ ID NO:3976). Table 3801 below describes the starting and ending position of this segment on each transcript.

TABLE 3801

Segment location on transcripts

| Transcript name | Segment starting position | Segment ending position |
|---|---|---|
| T86345_T0 (SEQ ID NO: 3958) | 1800 | 1910 |
| T86345_T2 (SEQ ID NO: 3959) | 1800 | 1910 |
| T86345_T3 (SEQ ID NO: 3960) | 1800 | 1910 |
| T86345_T4 (SEQ ID NO: 3961) | 1800 | 1910 |
| T86345_T5 (SEQ ID NO: 3962) | 1800 | 1910 |
| T86345_T6 (SEQ ID NO: 3963) | 1800 | 1910 |
| T86345_T7 (SEQ ID NO: 3964) | 1800 | 1910 |
| T86345_T8 (SEQ ID NO: 3965) | 1624 | 1734 |
| T86345_T10 (SEQ ID NO: 3966) | 1482 | 1592 |
| T86345_T11 (SEQ ID NO: 3967) | 1800 | 1910 |
| T86345_T12 (SEQ ID NO: 3968) | 1800 | 1910 |
| T86345_T13 (SEQ ID NO: 3969) | 1800 | 1910 |
| T86345_T14 (SEQ ID NO: 3970) | 1800 | 1910 |
| T86345_T16 (SEQ ID NO: 3971) | 1800 | 1910 |
| T86345_T17 (SEQ ID NO: 3972) | 1800 | 1910 |
| T86345_T18 (SEQ ID NO: 3973) | 1800 | 1910 |
| T86345_T19 (SEQ ID NO: 3974) | 1800 | 1910 |
| T86345_T23 (SEQ ID NO: 3975) | 1800 | 1910 |
| T86345_T24 (SEQ ID NO: 3976) | 1800 | 1910 |

This segment can be found in both coding and non-coding regions of transcript(s) as follows. The segment can be found in a non-coding region of transcript(s) that are related to the following protein(s): T86345_P7. This segment can also be found in the following protein(s): T86345_P24, T86345_P3, T86345_P4, T86345_P5, T86345_P6, T86345_P9, T86345_P10, T86345_P11, T86345_P12, T86345_P13, T86345_P15, T86345_P16 and T86345_P18, since it is in the coding region for the corresponding transcript.

Segment cluster T86345_node_47 (SEQ ID NO:4005) according to the present invention can be found in the following transcript(s): T86345_T3 (SEQ ID NO:3960). Table 3802 below describes the starting and ending position of this segment on each transcript.

TABLE 3802

Segment location on transcripts

| Transcript name | Segment starting position | Segment ending position |
|---|---|---|
| T86345_T3 (SEQ ID NO: 3960) | 2420 | 2429 |

This segment can be found in the following protein(s): T86345_P4.

Segment cluster T86345_node_50 (SEQ ID NO:4006) according to the present invention is supported by 37 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3803 below describes the starting and ending position of this segment on each transcript.

TABLE 3803

Segment location on transcripts

| Transcript name | Segment starting position | Segment ending position |
|---|---|---|
| T86345_T0 (SEQ ID NO: 3958) | 2420 | 2453 |
| T86345_T2 (SEQ ID NO: 3959) | 2420 | 2453 |
| T86345_T3 (SEQ ID NO: 3960) | 2430 | 2463 |
| T86345_T4 (SEQ ID NO: 3961) | 2420 | 2453 |

TABLE 3803-continued

Segment location on transcripts

| Transcript name | Segment starting position | Segment ending position |
|---|---|---|
| T86345_T5 (SEQ ID NO: 3962) | 2420 | 2453 |
| T86345_T6 (SEQ ID NO: 3963) | 2420 | 2453 |
| T86345_T7 (SEQ ID NO: 3964) | 2420 | 2453 |
| T86345_T8 (SEQ ID NO: 3965) | 2244 | 2277 |
| T86345_T10 (SEQ ID NO: 3966) | 2102 | 2135 |
| T86345_T11 (SEQ ID NO: 3967) | 2420 | 2453 |
| T86345_T13 (SEQ ID NO: 3969) | 2420 | 2453 |
| T86345_T14 (SEQ ID NO: 3970) | 2420 | 2453 |
| T86345_T16 (SEQ ID NO: 3971) | 2420 | 2453 |
| T86345_T17 (SEQ ID NO: 3972) | 2420 | 2453 |
| T86345_T18 (SEQ ID NO: 3973) | 2420 | 2453 |
| T86345_T19 (SEQ ID NO: 3974) | 2420 | 2453 |
| T86345_T23 (SEQ ID NO: 3975) | 2420 | 2453 |

This segment can be found in both coding and non-coding regions of transcript(s) as follows. The segment can be found in a non-coding region of transcript(s) that are related to the following protein(s): T86345_P7. This segment can also be found in the following protein(s): T86345_P24, T86345_P3, T86345_P4, T86345_P5, T86345_P6, T86345_P9, T86345_P10, T86345_P12, T86345_P13, T86345_P15 and T86345_P16, since it is in the coding region for the corresponding transcript.

Segment cluster T86345_node__52 (SEQ ID NO:4007) according to the present invention is supported by 9 libraries. The number of libraries was determined as previously described. This segment can be found in the following transcript(s): T86345_T2 (SEQ ID NO:3959), T86345_T3 (SEQ ID NO:3960), T86345_T4 (SEQ ID NO:3961), T86345_T5 (SEQ ID NO:3962) and T86345_T23 (SEQ ID NO:3975). Table 3804 below describes the starting and ending position of this segment on each transcript.

TABLE 3804

Segment location on transcripts

| Transcript name | Segment starting position | Segment ending position |
|---|---|---|
| T86345_T2 (SEQ ID NO: 3959) | 2574 | 2613 |
| T86345_T3 (SEQ ID NO: 3960) | 2584 | 2623 |
| T86345_T4 (SEQ ID NO: 3961) | 2574 | 2613 |
| T86345_T5 (SEQ ID NO: 3962) | 2454 | 2493 |
| T86345_T23 (SEQ ID NO: 3975) | 2574 | 2613 |

This segment can be found in both coding and non-coding regions of transcript(s) as follows. The segment can be found in a non-coding region of transcript(s) that are related to the following protein(s): T86345_P3 and T86345_P4. This segment can also be found in the following protein(s): T86345_P5, since it is in the coding region for the corresponding transcript.

Segment cluster T86345_node__54 (SEQ ID NO:4008) according to the present invention is supported by 44 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3805 below describes the starting and ending position of this segment on each transcript.

TABLE 3805

Segment location on transcripts

| Transcript name | Segment starting position | Segment ending position |
|---|---|---|
| T86345_T0 (SEQ ID NO: 3958) | 2454 | 2510 |
| T86345_T2 (SEQ ID NO: 3959) | 3402 | 3458 |
| T86345_T3 (SEQ ID NO: 3960) | 3412 | 3468 |
| T86345_T4 (SEQ ID NO: 3961) | 3402 | 3458 |
| T86345_T5 (SEQ ID NO: 3962) | 2494 | 2550 |
| T86345_T6 (SEQ ID NO: 3963) | 2454 | 2510 |
| T86345_T7 (SEQ ID NO: 3964) | 2454 | 2510 |
| T86345_T8 (SEQ ID NO: 3965) | 2278 | 2334 |
| T86345_T10 (SEQ ID NO: 3966) | 2136 | 2192 |
| T86345_T11 (SEQ ID NO: 3967) | 2454 | 2510 |
| T86345_T12 (SEQ ID NO: 3968) | 2235 | 2291 |
| T86345_T13 (SEQ ID NO: 3969) | 2454 | 2510 |
| T86345_T14 (SEQ ID NO: 3970) | 2454 | 2510 |
| T86345_T16 (SEQ ID NO: 3971) | 2454 | 2510 |
| T86345_T17 (SEQ ID NO: 3972) | 2454 | 2510 |
| T86345_T18 (SEQ ID NO: 3973) | 2454 | 2510 |
| T86345_T19 (SEQ ID NO: 3974) | 2454 | 2510 |
| T86345_T23 (SEQ ID NO: 3975) | 3402 | 3458 |

This segment can be found in both coding and non-coding regions of transcript(s) as follows. The segment can be found in a non-coding region of transcript(s) that are related to the following protein(s): T86345_P3, T86345_P4, T86345_P5 and T86345_P7. This segment can also be found in the following protein(s): T86345_P24, T86345_P6, T86345_P9, T86345_P10, T86345_P11, T86345_P12, T86345_P13, T86345_P15 and T86345_P16, since it is in the coding region for the corresponding transcript.

Segment cluster T86345_node__55 (SEQ ID NO:4009) according to the present invention is supported by 1 libraries. The number of libraries was determined as previously described. This segment can be found in the following transcript(s): T86345_T23 (SEQ ID NO:3975). Table 3806 below describes the starting and ending position of this segment on each transcript.

TABLE 3806

Segment location on transcripts

| Transcript name | Segment starting position | Segment ending position |
|---|---|---|
| T86345_T23 (SEQ ID NO: 3975) | 3459 | 3537 |

This segment can be found in a non-coding region of transcript(s) that are related to the following protein(s): T86345_P3.

Segment cluster T86345_node__56 (SEQ ID NO:4010) according to the present invention is supported by 46 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3807 below describes the starting and ending position of this segment on each transcript.

TABLE 3807

Segment location on transcripts

| Transcript name | Segment starting position | Segment ending position |
|---|---|---|
| T86345_T0 (SEQ ID NO: 3958) | 2511 | 2572 |
| T86345_T2 (SEQ ID NO: 3959) | 3459 | 3520 |
| T86345_T3 (SEQ ID NO: 3960) | 3469 | 3530 |
| T86345_T4 (SEQ ID NO: 3961) | 3459 | 3520 |
| T86345_T5 (SEQ ID NO: 3962) | 2551 | 2612 |
| T86345_T6 (SEQ ID NO: 3963) | 2511 | 2572 |
| T86345_T7 (SEQ ID NO: 3964) | 2511 | 2572 |
| T86345_T8 (SEQ ID NO: 3965) | 2335 | 2396 |
| T86345_T10 (SEQ ID NO: 3966) | 2193 | 2254 |
| T86345_T11 (SEQ ID NO: 3967) | 2511 | 2572 |
| T86345_T12 (SEQ ID NO: 3968) | 2292 | 2353 |
| T86345_T13 (SEQ ID NO: 3969) | 2511 | 2572 |
| T86345_T14 (SEQ ID NO: 3970) | 2511 | 2572 |
| T86345_T16 (SEQ ID NO: 3971) | 2511 | 2572 |
| T86345_T17 (SEQ ID NO: 3972) | 2511 | 2572 |
| T86345_T18 (SEQ ID NO: 3973) | 2511 | 2572 |
| T86345_T19 (SEQ ID NO: 3974) | 2511 | 2572 |
| T86345_T23 (SEQ ID NO: 3975) | 3538 | 3599 |

This segment can be found in both coding and non-coding regions of transcript(s) as follows. The segment can be found in a non-coding region of transcript(s) that are related to the following protein(s): T86345_P3, T86345_P4, T86345_P5 and T86345_P7. This segment can also be found in the following protein(s): T86345_P24, T86345_P6, T86345_P9, T86345_P10, T86345_P11, T86345_P12, T86345_P13, T86345_P15 and T86345_P16, since it is in the coding region for the corresponding transcript.

Segment cluster T86345_node__60 (SEQ ID NO:4011) according to the present invention is supported by 56 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3808 below describes the starting and ending position of this segment on each transcript.

TABLE 3808

Segment location on transcripts

| Transcript name | Segment starting position | Segment ending position |
|---|---|---|
| T86345_T0 (SEQ ID NO: 3958) | 2573 | 2649 |
| T86345_T2 (SEQ ID NO: 3959) | 3521 | 3597 |
| T86345_T3 (SEQ ID NO: 3960) | 3531 | 3607 |
| T86345_T4 (SEQ ID NO: 3961) | 3643 | 3719 |

TABLE 3808-continued

Segment location on transcripts

| Transcript name | Segment starting position | Segment ending position |
|---|---|---|
| T86345_T5 (SEQ ID NO: 3962) | 2613 | 2689 |
| T86345_T6 (SEQ ID NO: 3963) | 2695 | 2771 |
| T86345_T7 (SEQ ID NO: 3964) | 2573 | 2649 |
| T86345_T8 (SEQ ID NO: 3965) | 2397 | 2473 |
| T86345_T10 (SEQ ID NO: 3966) | 2255 | 2331 |
| T86345_T11 (SEQ ID NO: 3967) | 2573 | 2649 |
| T86345_T12 (SEQ ID NO: 3968) | 2354 | 2430 |
| T86345_T13 (SEQ ID NO: 3969) | 2573 | 2649 |
| T86345_T14 (SEQ ID NO: 3970) | 2573 | 2649 |
| T86345_T16 (SEQ ID NO: 3971) | 2573 | 2649 |
| T86345_T17 (SEQ ID NO: 3972) | 2573 | 2649 |
| T86345_T18 (SEQ ID NO: 3973) | 2573 | 2649 |
| T86345_T19 (SEQ ID NO: 3974) | 2573 | 2649 |
| T86345_T23 (SEQ ID NO: 3975) | 3600 | 3676 |

This segment can be found in both coding and non-coding regions of transcript(s) as follows. The segment can be found in a non-coding region of transcript(s) that are related to the following protein(s): T86345_P3, T86345_P4, T86345_P5 and T86345_P7. This segment can also be found in the following protein(s): T86345_P24, T86345_P6, T86345_P9, T86345_P10, T86345_P11, T86345_P12, T86345_P13, T86345_P15 and T86345_P16, since it is in the coding region for the corresponding transcript.

Segment cluster T86345_node__61 (SEQ ID NO:4012) according to the present invention is supported by 54 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3809 below describes the starting and ending position of this segment on each transcript.

TABLE 3809

Segment location on transcripts

| Transcript name | Segment starting position | Segment ending position |
|---|---|---|
| T86345_T0 (SEQ ID NO: 3958) | 2650 | 2691 |
| T86345_T2 (SEQ ID NO: 3959) | 3598 | 3639 |
| T86345_T3 (SEQ ID NO: 3960) | 3608 | 3649 |
| T86345_T4 (SEQ ID NO: 3961) | 3720 | 3761 |
| T86345_T5 (SEQ ID NO: 3962) | 2690 | 2731 |
| T86345_T6 (SEQ ID NO: 3963) | 2772 | 2813 |
| T86345_T7 (SEQ ID NO: 3964) | 2650 | 2691 |
| T86345_T8 (SEQ ID NO: 3965) | 2474 | 2515 |
| T86345_T10 (SEQ ID NO: 3966) | 2332 | 2373 |
| T86345_T11 (SEQ ID NO: 3967) | 2650 | 2691 |
| T86345_T12 (SEQ ID NO: 3968) | 2431 | 2472 |
| T86345_T13 (SEQ ID NO: 3969) | 2650 | 2691 |
| T86345_T14 (SEQ ID NO: 3970) | 2650 | 2691 |
| T86345_T16 (SEQ ID NO: 3971) | 2650 | 2691 |
| T86345_T17 (SEQ ID NO: 3972) | 2650 | 2691 |
| T86345_T18 (SEQ ID NO: 3973) | 2650 | 2691 |

TABLE 3809-continued

Segment location on transcripts

| Transcript name | Segment starting position | Segment ending position |
|---|---|---|
| T86345_T19 (SEQ ID NO: 3974) | 2650 | 2691 |
| T86345_T23 (SEQ ID NO: 3975) | 3677 | 3718 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P10, T86345_P11, T86345_P12, T86345_P13, T86345_P15 and T86345_P16, since it is in the coding region for the corresponding transcript.

Segment cluster T86345_node_63 (SEQ ID NO:4013) according to the present invention is supported by 65 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3810 below describes the starting and ending position of this segment on each transcript.

TABLE 3810

Segment location on transcripts

| Transcript name | Segment starting position | Segment ending position |
|---|---|---|
| T86345_T0 (SEQ ID NO: 3958) | 2692 | 2765 |
| T86345_T2 (SEQ ID NO: 3959) | 3640 | 3713 |
| T86345_T3 (SEQ ID NO: 3960) | 3650 | 3723 |
| T86345_T4 (SEQ ID NO: 3961) | 3762 | 3835 |
| T86345_T5 (SEQ ID NO: 3962) | 2732 | 2805 |
| T86345_T6 (SEQ ID NO: 3963) | 2814 | 2887 |
| T86345_T7 (SEQ ID NO: 3964) | 2692 | 2765 |
| T86345_T8 (SEQ ID NO: 3965) | 2516 | 2589 |
| T86345_T10 (SEQ ID NO: 3966) | 2374 | 2447 |
| T86345_T11 (SEQ ID NO: 3967) | 2692 | 2765 |
| T86345_T12 (SEQ ID NO: 3968) | 2473 | 2546 |
| T86345_T13 (SEQ ID NO: 3969) | 2692 | 2765 |
| T86345_T14 (SEQ ID NO: 3970) | 2692 | 2765 |
| T86345_T16 (SEQ ID NO: 3971) | 2692 | 2765 |
| T86345_T17 (SEQ ID NO: 3972) | 2692 | 2765 |
| T86345_T18 (SEQ ID NO: 3973) | 2692 | 2765 |
| T86345_T19 (SEQ ID NO: 3974) | 2692 | 2765 |
| T86345_T23 (SEQ ID NO: 3975) | 3719 | 3792 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P10, T86345_P11, T86345_P12, T86345_P13, T86345_P15 and T86345_P16, since it is in the coding region for the corresponding transcript.

Segment cluster T86345_node_64 (SEQ ID NO:4014) according to the present invention is supported by 63 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972), T86345_T18 (SEQ ID NO:3973), T86345_T19 (SEQ ID NO:3974) and T86345_T23 (SEQ ID NO:3975). Table 3811 below describes the starting and ending position of this segment on each transcript.

TABLE 3811

Segment location on transcripts

| Transcript name | Segment starting position | Segment ending position |
|---|---|---|
| T86345_T0 (SEQ ID NO: 3958) | 2766 | 2795 |
| T86345_T2 (SEQ ID NO: 3959) | 3714 | 3743 |
| T86345_T3 (SEQ ID NO: 3960) | 3724 | 3753 |
| T86345_T4 (SEQ ID NO: 3961) | 3836 | 3865 |
| T86345_T5 (SEQ ID NO: 3962) | 2806 | 2835 |
| T86345_T6 (SEQ ID NO: 3963) | 2888 | 2917 |
| T86345_T7 (SEQ ID NO: 3964) | 2766 | 2795 |
| T86345_T8 (SEQ ID NO: 3965) | 2590 | 2619 |
| T86345_T10 (SEQ ID NO: 3966) | 2448 | 2477 |
| T86345_T11 (SEQ ID NO: 3967) | 2766 | 2795 |
| T86345_T12 (SEQ ID NO: 3968) | 2547 | 2576 |
| T86345_T13 (SEQ ID NO: 3969) | 2766 | 2795 |
| T86345_T14 (SEQ ID NO: 3970) | 2766 | 2795 |
| T86345_T16 (SEQ ID NO: 3971) | 2766 | 2795 |
| T86345_T17 (SEQ ID NO: 3972) | 2766 | 2795 |
| T86345_T18 (SEQ ID NO: 3973) | 2766 | 2795 |
| T86345_T19 (SEQ ID NO: 3974) | 2766 | 2795 |
| T86345_T23 (SEQ ID NO: 3975) | 3793 | 3822 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P10, T86345_P11, T86345_P12, T86345_P13, T86345_P15 and T86345_P16, since it is in the coding region for the corresponding transcript.

Segment cluster T86345_node_67 (SEQ ID NO:4015) according to the present invention is supported by 63 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972) and T86345_T18 (SEQ ID NO:3973). Table 3812 below describes the starting and ending position of this segment on each transcript.

TABLE 3812

Segment location on transcripts

| Transcript name | Segment starting position | Segment ending position |
|---|---|---|
| T86345_T0 (SEQ ID NO: 3958) | 2796 | 2846 |
| T86345_T2 (SEQ ID NO: 3959) | 3744 | 3794 |
| T86345_T3 (SEQ ID NO: 3960) | 3754 | 3804 |
| T86345_T4 (SEQ ID NO: 3961) | 3866 | 3916 |
| T86345_T5 (SEQ ID NO: 3962) | 2836 | 2886 |
| T86345_T6 (SEQ ID NO: 3963) | 2918 | 2968 |
| T86345_T7 (SEQ ID NO: 3964) | 2796 | 2846 |
| T86345_T8 (SEQ ID NO: 3965) | 2620 | 2670 |
| T86345_T10 (SEQ ID NO: 3966) | 2478 | 2528 |
| T86345_T12 (SEQ ID NO: 3968) | 2577 | 2627 |
| T86345_T13 (SEQ ID NO: 3969) | 2796 | 2846 |
| T86345_T14 (SEQ ID NO: 3970) | 2796 | 2846 |
| T86345_T16 (SEQ ID NO: 3971) | 2796 | 2846 |
| T86345_T17 (SEQ ID NO: 3972) | 2796 | 2846 |
| T86345_T18 (SEQ ID NO: 3973) | 2796 | 2846 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P11, T86345_P12, T86345_P13 and T86345_P15, since it is in the coding region for the corresponding transcript.

Segment cluster T86345_node__70 (SEQ ID NO:4016) according to the present invention is supported by 60 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T16 (SEQ ID NO:3971), T86345_T17 (SEQ ID NO:3972) and T86345_T18 (SEQ ID NO:3973). Table 3813 below describes the starting and ending position of this segment on each transcript.

TABLE 3813

Segment location on transcripts

| Transcript name | Segment starting position | Segment ending position |
|---|---|---|
| T86345_T0 (SEQ ID NO: 3958) | 2847 | 2872 |
| T86345_T2 (SEQ ID NO: 3959) | 3795 | 3820 |
| T86345_T3 (SEQ ID NO: 3960) | 3805 | 3830 |
| T86345_T4 (SEQ ID NO: 3961) | 3917 | 3942 |
| T86345_T5 (SEQ ID NO: 3962) | 2887 | 2912 |
| T86345_T6 (SEQ ID NO: 3963) | 2969 | 2994 |
| T86345_T7 (SEQ ID NO: 3964) | 2847 | 2872 |
| T86345_T8 (SEQ ID NO: 3965) | 2671 | 2696 |
| T86345_T10 (SEQ ID NO: 3966) | 2529 | 2554 |
| T86345_T11 (SEQ ID NO: 3967) | 2796 | 2821 |
| T86345_T12 (SEQ ID NO: 3968) | 2628 | 2653 |
| T86345_T13 (SEQ ID NO: 3969) | 2847 | 2872 |
| T86345_T16 (SEQ ID NO: 3971) | 2847 | 2872 |
| T86345_T17 (SEQ ID NO: 3972) | 2847 | 2872 |
| T86345_T18 (SEQ ID NO: 3973) | 2847 | 2872 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P10, T86345_P11, T86345_P12 and T86345_P15, since it is in the coding region for the corresponding transcript.

Segment cluster T86345_node__71 (SEQ ID NO:4017) according to the present invention is supported by 67 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T16 (SEQ ID NO:3971), T86345_T17 (SEQ ID NO:3972) and T86345_T18 (SEQ ID NO:3973). Table 3814 below describes the starting and ending position of this segment on each transcript.

TABLE 3814

Segment location on transcripts

| Transcript name | Segment starting position | Segment ending position |
|---|---|---|
| T86345_T0 (SEQ ID NO: 3958) | 2873 | 2920 |
| T86345_T2 (SEQ ID NO: 3959) | 3821 | 3868 |
| T86345_T3 (SEQ ID NO: 3960) | 3831 | 3878 |
| T86345_T4 (SEQ ID NO: 3961) | 3943 | 3990 |
| T86345_T5 (SEQ ID NO: 3962) | 2913 | 2960 |
| T86345_T6 (SEQ ID NO: 3963) | 2995 | 3042 |
| T86345_T7 (SEQ ID NO: 3964) | 2873 | 2920 |
| T86345_T8 (SEQ ID NO: 3965) | 2697 | 2744 |
| T86345_T10 (SEQ ID NO: 3966) | 2555 | 2602 |
| T86345_T11 (SEQ ID NO: 3967) | 2822 | 2869 |
| T86345_T12 (SEQ ID NO: 3968) | 2654 | 2701 |
| T86345_T13 (SEQ ID NO: 3969) | 2873 | 2920 |
| T86345_T16 (SEQ ID NO: 3971) | 2873 | 2920 |
| T86345_T17 (SEQ ID NO: 3972) | 2873 | 2920 |
| T86345_T18 (SEQ ID NO: 3973) | 2873 | 2920 |

This segment can be found in both coding and non-coding regions of transcript(s) as follows. The segment can be found in a non-coding region of transcript(s) that are related to the following protein(s): T86345_P3, T86345_P4, T86345_P5, T86345_P6 and T86345_P7. This segment can also be found in the following protein(s): T86345_P24, T86345_P9, T86345_P10, T86345_P11, T86345_P12 and T86345_P15, since it is in the coding region for the corresponding transcript.

Segment cluster T86345_node__72 (SEQ ID NO:4018) according to the present invention is supported by 8 libraries. The number of libraries was determined as previously described. This segment can be found in the following transcript(s): T86345_T13 (SEQ ID NO:3969), T86345_T16 (SEQ ID NO:3971) and T86345_T18 (SEQ ID NO:3973). Table 3815 below describes the starting and ending position of this segment on each transcript.

TABLE 3815

Segment location on transcripts

| Transcript name | Segment starting position | Segment ending position |
|---|---|---|
| T86345_T13 (SEQ ID NO: 3969) | 2921 | 2993 |
| T86345_T16 (SEQ ID NO: 3971) | 2921 | 2993 |
| T86345_T18 (SEQ ID NO: 3973) | 2921 | 2993 |

This segment can be found in the following protein(s): T86345_P12.

Segment cluster T86345_node__73 (SEQ ID NO:4019) according to the present invention is supported by 76 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972) and T86345_T18 (SEQ ID NO:3973). Table 3816 below describes the starting and ending position of this segment on each transcript.

TABLE 3816

Segment location on transcripts

| Transcript name | Segment starting position | Segment ending position |
|---|---|---|
| T86345_T0 (SEQ ID NO: 3958) | 2921 | 2985 |
| T86345_T2 (SEQ ID NO: 3959) | 3869 | 3933 |
| T86345_T3 (SEQ ID NO: 3960) | 3879 | 3943 |
| T86345_T4 (SEQ ID NO: 3961) | 3991 | 4055 |
| T86345_T5 (SEQ ID NO: 3962) | 2961 | 3025 |
| T86345_T6 (SEQ ID NO: 3963) | 3043 | 3107 |
| T86345_T7 (SEQ ID NO: 3964) | 2921 | 2985 |
| T86345_T8 (SEQ ID NO: 3965) | 2745 | 2809 |
| T86345_T10 (SEQ ID NO: 3966) | 2603 | 2667 |
| T86345_T11 (SEQ ID NO: 3967) | 2870 | 2934 |
| T86345_T12 (SEQ ID NO: 3968) | 2702 | 2766 |
| T86345_T13 (SEQ ID NO: 3969) | 2994 | 3058 |
| T86345_T14 (SEQ ID NO: 3970) | 2847 | 2911 |
| T86345_T16 (SEQ ID NO: 3971) | 2994 | 3058 |
| T86345_T17 (SEQ ID NO: 3972) | 2921 | 2985 |
| T86345_T18 (SEQ ID NO: 3973) | 2994 | 3058 |

This segment can be found in both coding and non-coding regions of transcript(s) as follows. The segment can be found in a non-coding region of transcript(s) that are related to the following protein(s): T86345_P3, T86345_P4, T86345_P5, T86345_P6, T86345_P7 and T86345_P12. This segment can also be found in the following protein(s): T86345_P24, T86345_P9, T86345_P10, T86345_P11, T86345_P13 and T86345_P15, since it is in the coding region for the corresponding transcript.

Segment cluster T86345_node__75 (SEQ ID NO:4020) according to the present invention is supported by 72 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T17 (SEQ ID NO:3972) and T86345_T18 (SEQ ID NO:3973). Table 3817 below describes the starting and ending position of this segment on each transcript.

TABLE 3817

Segment location on transcripts

| Transcript name | Segment starting position | Segment ending position |
|---|---|---|
| T86345_T0 (SEQ ID NO: 3958) | 2986 | 3029 |
| T86345_T2 (SEQ ID NO: 3959) | 3934 | 3977 |
| T86345_T3 (SEQ ID NO: 3960) | 3944 | 3987 |
| T86345_T4 (SEQ ID NO: 3961) | 4056 | 4099 |
| T86345_T5 (SEQ ID NO: 3962) | 3026 | 3069 |
| T86345_T6 (SEQ ID NO: 3963) | 3108 | 3151 |
| T86345_T7 (SEQ ID NO: 3964) | 2986 | 3029 |
| T86345_T8 (SEQ ID NO: 3965) | 2810 | 2853 |
| T86345_T10 (SEQ ID NO: 3966) | 2668 | 2711 |
| T86345_T11 (SEQ ID NO: 3967) | 2935 | 2978 |
| T86345_T12 (SEQ ID NO: 3968) | 2767 | 2810 |
| T86345_T13 (SEQ ID NO: 3969) | 3059 | 3102 |
| T86345_T14 (SEQ ID NO: 3970) | 2912 | 2955 |
| T86345_T16 (SEQ ID NO: 3971) | 3059 | 3102 |
| T86345_T17 (SEQ ID NO: 3972) | 2986 | 3029 |
| T86345_T18 (SEQ ID NO: 3973) | 3059 | 3102 |

This segment can be found in both coding and non-coding regions of transcript(s) as follows. The segment can be found in a non-coding region of transcript(s) that are related to the following protein(s): T86345_P3, T86345_P4, T86345_P5, T86345_P6, T86345_P7, T86345_P12 and T86345_P13. This segment can also be found in the following protein(s): T86345_P24, T86345_P9, T86345_P10, T86345_P11 and T86345_P15, since it is in the coding region for the corresponding transcript.

Segment cluster T86345_node__76 (SEQ ID NO:4021) according to the present invention is supported by 1 libraries. The number of libraries was determined as previously described. This segment can be found in the following transcript(s): T86345_T18 (SEQ ID NO:3973). Table 3818 below describes the starting and ending position of this segment on each transcript.

TABLE 3818

Segment location on transcripts

| Transcript name | Segment starting position | Segment ending position |
|---|---|---|
| T86345_T18 (SEQ ID NO: 3973) | 3103 | 3209 |

This segment can be found in a non-coding region of transcript(s) that are related to the following protein(s): T86345_P12.

Segment cluster T86345_node__79 (SEQ ID NO:4022) according to the present invention is supported by 77 libraries. The number of libraries was determined as previously described. This segment can be found in the following transcript(s): T86345_T0 (SEQ ID NO:3958), T86345_T2 (SEQ ID NO:3959), T86345_T3 (SEQ ID NO:3960), T86345_T4 (SEQ ID NO:3961), T86345_T5 (SEQ ID NO:3962), T86345_T6 (SEQ ID NO:3963), T86345_T7 (SEQ ID NO:3964), T86345_T8 (SEQ ID NO:3965), T86345_T10 (SEQ ID NO:3966), T86345_T11 (SEQ ID NO:3967), T86345_T12 (SEQ ID NO:3968), T86345_T13 (SEQ ID NO:3969), T86345_T14 (SEQ ID NO:3970), T86345_T16 (SEQ ID NO:3971), T86345_T32 (SEQ ID NO:3977) and T86345_T33 (SEQ ID NO:3978). Table 3819 below describes the starting and ending position of this segment on each transcript.

TABLE 3819

Segment location on transcripts

| Transcript name | Segment starting position | Segment ending position |
|---|---|---|
| T86345_T0 (SEQ ID NO: 3958) | 3030 | 3130 |
| T86345_T2 (SEQ ID NO: 3959) | 3978 | 4078 |
| T86345_T3 (SEQ ID NO: 3960) | 3988 | 4088 |
| T86345_T4 (SEQ ID NO: 3961) | 4100 | 4200 |
| T86345_T5 (SEQ ID NO: 3962) | 3070 | 3170 |
| T86345_T6 (SEQ ID NO: 3963) | 3152 | 3252 |
| T86345_T7 (SEQ ID NO: 3964) | 3030 | 3130 |
| T86345_T8 (SEQ ID NO: 3965) | 2854 | 2954 |
| T86345_T10 (SEQ ID NO: 3966) | 2712 | 2812 |
| T86345_T11 (SEQ ID NO: 3967) | 2979 | 3079 |
| T86345_T12 (SEQ ID NO: 3968) | 2811 | 2911 |
| T86345_T13 (SEQ ID NO: 3969) | 3103 | 3203 |
| T86345_T14 (SEQ ID NO: 3970) | 2956 | 3056 |
| T86345_T16 (SEQ ID NO: 3971) | 3103 | 3203 |
| T86345_T32 (SEQ ID NO: 3977) | 591 | 691 |
| T86345_T33 (SEQ ID NO: 3978) | 591 | 691 |

This segment can be found in both coding and non-coding regions of transcript(s) as follows. The segment can be found in a non-coding region of transcript(s) that are related to the following protein(s): T86345_P3, T86345_P4, T86345_P5, T86345_P6, T86345_P7, T86345_P12 and T86345_P13. This segment can also be found in the following protein(s): T86345_P24, T86345_P9, T86345_P10 and T86345_P11, since it is in the coding region for the corresponding transcript.

Segment cluster T86345_node_82 (SEQ ID NO:4023) according to the present invention is supported by 1 libraries. The number of libraries was determined as previously described. This segment can be found in the following transcript(s): T86345_T17 (SEQ ID NO:3972). Table 3820 below describes the starting and ending position of this segment on each transcript.

TABLE 3820

Segment location on transcripts

| Transcript name | Segment starting position | Segment ending position |
|---|---|---|
| T86345_T17 (SEQ ID NO: 3972) | 3030 | 3069 |

This segment can be found in the following protein(s): T86345_P15.

Description for Cluster T93947

Cluster T93947 features 3 transcript(s) and 22 segment(s) of interest, the names for which are given in Tables 3821 and 3822, respectively, the sequences themselves are given at the end of the application. The selected protein variants are given in Table 3823.

TABLE 3821

Transcripts of interest
Transcript Name

T93947_T21 (SEQ ID NO: 4024)
T93947_T23 (SEQ ID NO: 4025)
T93947_T24 (SEQ ID NO: 4026)

TABLE 3822

Segments of interest
Segment Name

T93947_node_15 (SEQ ID NO: 4432)
T93947_node_17 (SEQ ID NO: 4433)
T93947_node_29 (SEQ ID NO: 4434)
T93947_node_31 (SEQ ID NO: 4435)
T93947_node_37 (SEQ ID NO: 4436)
T93947_node_44 (SEQ ID NO: 4437)
T93947_node_46 (SEQ ID NO: 4438)
T93947_node_57 (SEQ ID NO: 4439)
T93947_node_0 (SEQ ID NO: 4440)
T93947_node_1 (SEQ ID NO: 4441)
T93947_node_11 (SEQ ID NO: 4442)
T93947_node_12 (SEQ ID NO: 4443)
T93947_node_19 (SEQ ID NO: 4444)
T93947_node_21 (SEQ ID NO: 4445)
T93947_node_25 (SEQ ID NO: 4446)
T93947_node_27 (SEQ ID NO: 4447)
T93947_node_33 (SEQ ID NO: 4448)
T93947_node_36 (SEQ ID NO: 4449)
T93947_node_38 (SEQ ID NO: 4450)
T93947_node_41 (SEQ ID NO: 4451)
T93947_node_53 (SEQ ID NO: 4452)
T93947_node_55 (SEQ ID NO: 4453)

TABLE 3823

Proteins of interest

| Protein Name | Corresponding Transcript(s) |
|---|---|
| T93947_P11 | T93947_T21 (SEQ ID NO: 4024) |

Cluster T93947 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 95 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 95 and Table 3824. This cluster is overexpressed (at least at a minimum level) in the following pathological conditions: brain malignant tumors, epithelial malignant tumors and a mixture of malignant tumors from different tissues.

TABLE 3824

Normal tissue distribution

| Name of Tissue | Number |
|---|---|
| adrenal | 0 |
| bladder | 0 |
| bone | 0 |
| brain | 12 |

TABLE 3824-continued

Normal tissue distribution

| Name of Tissue | Number |
| --- | --- |
| colon | 0 |
| epithelial | 5 |
| general | 9 |
| head and neck | 10 |
| kidney | 0 |
| lung | 11 |
| lymph nodes | 7 |
| breast | 8 |
| muscle | 0 |
| ovary | 0 |
| pancreas | 0 |
| prostate | 0 |
| skin | 28 |
| Thyroid | 0 |
| uterus | 4 |

TABLE 3825

P values and ratios for expression in cancerous tissue

| Name of Tissue | P1 | P2 | SP1 | R3 | SP2 | R4 |
| --- | --- | --- | --- | --- | --- | --- |
| adrenal | 1 | 4.6e−01 | 1 | 1.0 | 5.3e−01 | 1.9 |
| bladder | 5.4e−01 | 1.8e−01 | 5.6e−01 | 1.8 | 2.1e−01 | 2.9 |
| bone | 3.3e−01 | 1.0e−01 | 4.0e−01 | 2.5 | 2.4e−01 | 2.9 |
| brain | 2.6e−01 | 4.2e−02 | 1.8e−01 | 2.4 | 1.2e−04 | 4.7 |
| colon | 9.4e−02 | 4.1e−02 | 7.0e−01 | 1.9 | 2.7e−01 | 2.5 |
| epithelial | 1.2e−02 | 2.4e−04 | 1.9e−02 | 2.8 | 2.3e−07 | 5.2 |
| general | 6.5e−04 | 3.5e−09 | 3.9e−03 | 2.3 | 4.4e−14 | 4.3 |
| head and neck | 6.4e−01 | 5.6e−01 | 1 | 1.1 | 4.2e−01 | 1.6 |
| kidney | 6.5e−01 | 3.5e−01 | 1 | 1.3 | 1.2e−01 | 2.9 |
| lung | 4.9e−01 | 4.8e−01 | 3.7e−01 | 2.0 | 3.7e−01 | 1.7 |
| lymph nodes | 9.2e−01 | 1.5e−01 | 1 | 0.7 | 6.4e−02 | 3.2 |
| breast | 8.2e−01 | 4.9e−01 | 6.9e−01 | 1.2 | 2.1e−01 | 1.4 |
| muscle | 1 | 2.9e−01 | 1 | 1.0 | 3.9e−01 | 2.6 |
| ovary | 2.4e−01 | 1.7e−01 | 4.7e−01 | 1.9 | 4.5e−01 | 1.9 |
| pancreas | 1 | 4.4e−01 | 1 | 1.0 | 5.3e−01 | 1.9 |
| prostate | 7.3e−01 | 6.0e−01 | 6.7e−01 | 1.5 | 5.6e−01 | 1.7 |
| skin | 5.2e−01 | 5.8e−01 | 3.7e−01 | 2.3 | 3.2e−01 | 0.9 |
| Thyroid | 2.0e−01 | 2.0e−01 | 6.7e−01 | 1.8 | 6.7e−01 | 1.8 |
| uterus | 4.4e−01 | 1.7e−01 | 4.4e−01 | 1.7 | 2.9e−02 | 2.5 |

As noted above, cluster T93947 features 22 segment(s), which were listed in Table 3822 above and for which the sequence(s) are given at the end of the application. These segment(s) are portions of nucleic acid sequence(s) which are described herein separately because they are of particular interest. A description of each segment according to the present invention is now provided.

Segment cluster T93947_node_15 (SEQ ID NO:4432) according to the present invention is supported by 48 libraries. The number of libraries was determined as previously described. This segment can be found in the following transcript(s): T93947_T21 (SEQ ID NO:4024). Table 3826 below describes the starting and ending position of this segment on each transcript.

TABLE 3826

Segment location on transcripts

| Transcript name | Segment starting position | Segment ending position |
| --- | --- | --- |
| T93947_T21 (SEQ ID NO: 4024) | 208 | 410 |

This segment can be found in the following protein(s): T93947_P11.

Segment cluster T93947_node_17 (SEQ ID NO:4433) according to the present invention is supported by 48 libraries. The number of libraries was determined as previously described. This segment can be found in the following transcript(s): T93947_T21 (SEQ ID NO:4024). Table 3827 below describes the starting and ending position of this segment on each transcript.

TABLE 3827

Segment location on transcripts

| Transcript name | Segment starting position | Segment ending position |
| --- | --- | --- |
| T93947_T21 (SEQ ID NO: 4024) | 411 | 547 |

This segment can be found in the following protein(s): T93947_P11.

Segment cluster T93947_node_29 (SEQ ID NO:4434) according to the present invention is supported by 40 libraries. The number of libraries was determined as previously described. This segment can be found in the following transcript(s): T93947_T21 (SEQ ID NO:4024). Table 3828 below describes the starting and ending position of this segment on each transcript.

TABLE 3828

Segment location on transcripts

| Transcript name | Segment starting position | Segment ending position |
| --- | --- | --- |
| T93947_T21 (SEQ ID NO: 4024) | 871 | 1001 |

This segment can be found in the following protein(s): T93947_P11.

Segment cluster T93947_node_31 (SEQ ID NO:4435) according to the present invention is supported by 37 libraries. The number of libraries was determined as previously described. This segment can be found in the following transcript(s): T93947_T21 (SEQ ID NO:4024). Table 3829 below describes the starting and ending position of this segment on each transcript.

TABLE 3829

Segment location on transcripts

| Transcript name | Segment starting position | Segment ending position |
| --- | --- | --- |
| T93947_T21 (SEQ ID NO: 4024) | 1002 | 1166 |

This segment can be found in the following protein(s): T93947_P11.

Segment cluster T93947_node_37 (SEQ ID NO:4436) according to the present invention is supported by 38 libraries. The number of libraries was determined as previously described. This segment can be found in the following transcript(s): T93947_T21 (SEQ ID NO:4024). Table 3830 below describes the starting and ending position of this segment on each transcript.

TABLE 3830

Segment location on transcripts

| Transcript name | Segment starting position | Segment ending position |
|---|---|---|
| T93947_T21 (SEQ ID NO: 4024) | 1317 | 1441 |

This segment can be found in the following protein(s): T93947_P11.

Segment cluster T93947_node__44 (SEQ ID NO:4437) according to the present invention is supported by 41 libraries. The number of libraries was determined as previously described. This segment can be found in the following transcript(s): T93947_T21 (SEQ ID NO:4024). Table 3831 below describes the starting and ending position of this segment on each transcript.

TABLE 3831

Segment location on transcripts

| Transcript name | Segment starting position | Segment ending position |
|---|---|---|
| T93947_T21 (SEQ ID NO: 4024) | 1568 | 1700 |

This segment can be found in the following protein(s): T93947_P11.

Segment cluster T93947_node__46 (SEQ ID NO:4438) according to the present invention is supported by 36 libraries. The number of libraries was determined as previously described. This segment can be found in the following transcript(s): T93947_T21 (SEQ ID NO:4024). Table 3832 below describes the starting and ending position of this segment on each transcript.

TABLE 3832

Segment location on transcripts

| Transcript name | Segment starting position | Segment ending position |
|---|---|---|
| T93947_T21 (SEQ ID NO: 4024) | 1701 | 1836 |

This segment can be found in the following protein(s): T93947_P11.

Segment cluster T93947_node__57 (SEQ ID NO:4439) according to the present invention is supported by 3 libraries. The number of libraries was determined as previously described. This segment can be found in the following transcript(s): T93947_T21 (SEQ ID NO:4024), T93947_T23 (SEQ ID NO:4025) and T93947_T24 (SEQ ID NO:4026). Table 3833 below describes the starting and ending position of this segment on each transcript.

TABLE 3833

Segment location on transcripts

| Transcript name | Segment starting position | Segment ending position |
|---|---|---|
| T93947_T21 (SEQ ID NO: 4024) | 1837 | 1974 |
| T93947_T23 (SEQ ID NO: 4025) | 59 | 196 |
| T93947_T24 (SEQ ID NO: 4026) | 30 | 167 |

This segment can be found in the following protein(s): T93947_P11.

According to an optional embodiment of the present invention, short segments related to the above cluster are also provided. These segments are up to about 120 bp in length, and so are included in a separate description.

Segment cluster T93947_node__0 (SEQ ID NO:4440) according to the present invention is supported by 7 libraries. The number of libraries was determined as previously described. This segment can be found in the following transcript(s): T93947_T21 (SEQ ID NO:4024). Table 3834 below describes the starting and ending position of this segment on each transcript.

TABLE 3834

Segment location on transcripts

| Transcript name | Segment starting position | Segment ending position |
|---|---|---|
| T93947_T21 (SEQ ID NO: 4024) | 1 | 65 |

This segment can be found in a non-coding region of transcript(s) that are related to the following protein(s): T93947_P11.

Segment cluster T93947_node__1 (SEQ ID NO:4441) according to the present invention is supported by 33 libraries. The number of libraries was determined as previously described. This segment can be found in the following transcript(s): T93947_T21 (SEQ ID NO:4024). Table 3835 below describes the starting and ending position of this segment on each transcript.

TABLE 3835

Segment location on transcripts

| Transcript name | Segment starting position | Segment ending position |
|---|---|---|
| T93947_T21 (SEQ ID NO: 4024) | 66 | 118 |

This segment can be found in a non-coding region of transcript(s) that are related to the following protein(s): T93947_P11.

Segment cluster T93947_node__11 (SEQ ID NO:4442) according to the present invention can be found in the following transcript(s): T93947_T21 (SEQ ID NO:4024). Table 3836 below describes the starting and ending position of this segment on each transcript.

TABLE 3836

Segment location on transcripts

| Transcript name | Segment starting position | Segment ending position |
|---|---|---|
| T93947_T21 (SEQ ID NO: 4024) | 119 | 122 |

This segment can be found in the following protein(s): T93947_P11.

Segment cluster T93947_node__12 (SEQ ID NO:4443) according to the present invention is supported by 43 libraries. The number of libraries was determined as previously described. This segment can be found in the following transcript(s): T93947_T21 (SEQ ID NO:4024). Table 3837 below describes the starting and ending position of this segment on each transcript.

TABLE 3837

Segment location on transcripts

| Transcript name | Segment starting position | Segment ending position |
|---|---|---|
| T93947_T21 (SEQ ID NO: 4024) | 123 | 207 |

This segment can be found in the following protein(s): T93947_P11.

Segment cluster T93947_node_19 (SEQ ID NO:4444) according to the present invention is supported by 47 libraries. The number of libraries was determined as previously described. This segment can be found in the following transcript(s): T93947_T21 (SEQ ID NO:4024). Table 3838 below describes the starting and ending position of this segment on each transcript.

TABLE 3838

Segment location on transcripts

| Transcript name | Segment starting position | Segment ending position |
|---|---|---|
| T93947_T21 (SEQ ID NO: 4024) | 548 | 617 |

This segment can be found in the following protein(s): T93947_P11.

Segment cluster T93947_node_21 (SEQ ID NO:4445) according to the present invention is supported by 44 libraries. The number of libraries was determined as previously described. This segment can be found in the following transcript(s): T93947_T21 (SEQ ID NO:4024). Table 3839 below describes the starting and ending position of this segment on each transcript.

TABLE 3839

Segment location on transcripts

| Transcript name | Segment starting position | Segment ending position |
|---|---|---|
| T93947_T21 (SEQ ID NO: 4024) | 618 | 671 |

This segment can be found in the following protein(s): T93947_P11.

Segment cluster T93947_node_25 (SEQ ID NO:4446) according to the present invention is supported by 43 libraries. The number of libraries was determined as previously described. This segment can be found in the following transcript(s): T93947_T21 (SEQ ID NO:4024). Table 3840 below describes the starting and ending position of this segment on each transcript.

TABLE 3840

Segment location on transcripts

| Transcript name | Segment starting position | Segment ending position |
|---|---|---|
| T93947_T21 (SEQ ID NO: 4024) | 672 | 752 |

This segment can be found in the following protein(s): T93947_P11.

Segment cluster T93947_node_27 (SEQ ID NO:4447) according to the present invention is supported by 44 libraries. The number of libraries was determined as previously described. This segment can be found in the following transcript(s): T93947_T21 (SEQ ID NO:4024). Table 3841 below describes the starting and ending position of this segment on each transcript.

TABLE 3841

Segment location on transcripts

| Transcript name | Segment starting position | Segment ending position |
|---|---|---|
| T93947_T21 (SEQ ID NO: 4024) | 753 | 870 |

This segment can be found in the following protein(s): T93947_P11.

Segment cluster T93947_node_33 (SEQ ID NO:4448) according to the present invention is supported by 37 libraries. The number of libraries was determined as previously described. This segment can be found in the following transcript(s): T93947_T21 (SEQ ID NO:4024). Table 3842 below describes the starting and ending position of this segment on each transcript.

TABLE 3842

Segment location on transcripts

| Transcript name | Segment starting position | Segment ending position |
|---|---|---|
| T93947_T21 (SEQ ID NO: 4024) | 1167 | 1262 |

This segment can be found in the following protein(s): T93947_P11.

Segment cluster T93947_node_36 (SEQ ID NO:4449) according to the present invention is supported by 35 libraries. The number of libraries was determined as previously described. This segment can be found in the following transcript(s): T93947_T21 (SEQ ID NO:4024). Table 3843 below describes the starting and ending position of this segment on each transcript.

TABLE 3843

Segment location on transcripts

| Transcript name | Segment starting position | Segment ending position |
|---|---|---|
| T93947_T21 (SEQ ID NO: 4024) | 1263 | 1316 |

This segment can be found in the following protein(s): T93947_P11.

Segment cluster T93947_node_38 (SEQ ID NO:4450) according to the present invention can be found in the following transcript(s): T93947_T21 (SEQ ID NO:4024). Table 3844 below describes the starting and ending position of this segment on each transcript.

TABLE 3844

Segment location on transcripts

| Transcript name | Segment starting position | Segment ending position |
|---|---|---|
| T93947_T21 (SEQ ID NO: 4024) | 1442 | 1461 |

This segment can be found in the following protein(s): T93947_P11.

Segment cluster T93947_node_41 (SEQ ID NO:4451) according to the present invention is supported by 37 libraries. The number of libraries was determined as previously described. This segment can be found in the following transcript(s): T93947_T21 (SEQ ID NO:4024). Table 3845 below describes the starting and ending position of this segment on each transcript.

TABLE 3845

Segment location on transcripts

| Transcript name | Segment starting position | Segment ending position |
|---|---|---|
| T93947_T21 (SEQ ID NO: 4024) | 1462 | 1567 |

This segment can be found in the following protein(s): T93947_P11.

Segment cluster T93947_node_53 (SEQ ID NO:4452) according to the present invention is supported by 1 libraries. The number of libraries was determined as previously described. This segment can be found in the following transcript(s): T93947_T23 (SEQ ID NO:4025). Table 3846 below describes the starting and ending position of this segment on each transcript.

TABLE 3846

Segment location on transcripts

| Transcript name | Segment starting position | Segment ending position |
|---|---|---|
| T93947_T23 (SEQ ID NO: 4025) | 1 | 58 |

The previously-described transcripts for these segment(s) do not code for protein.

Segment cluster T93947_node_55 (SEQ ID NO:4453) according to the present invention is supported by 1 libraries. The number of libraries was determined as previously described. This segment can be found in the following transcript(s): T93947_T24 (SEQ ID NO:4026). Table 3847 below describes the starting and ending position of this segment on each transcript.

TABLE 3847

Segment location on transcripts

| Transcript name | Segment starting position | Segment ending position |
|---|---|---|
| T93947_T24 (SEQ ID NO: 4026) | 1 | 29 |

The previously-described transcripts for these segment(s) do not code for protein.

Description for Cluster W25389

Cluster W25389 features 2 transcript(s) and 6 segment(s) of interest, the names for which are given in Tables 3848 and 3849, respectively, the sequences themselves are given at the end of the application. The selected protein variants are given in Table 3850.

TABLE 3848

Transcripts of interest
Transcript Name

W25389_T6 (SEQ ID NO: 4454)
W25389_T7 (SEQ ID NO: 4455)

TABLE 3849

Segments of interest
Segment Name

W25389_node_9 (SEQ ID NO: 4456)
W25389_node_10 (SEQ ID NO: 4457)
W25389_node_12 (SEQ ID NO: 4458)
W25389_node_14 (SEQ ID NO: 4459)
W25389_node_17 (SEQ ID NO: 4460)
W25389_node_19 (SEQ ID NO: 4461)

TABLE 3850

Proteins of interest

| Protein Name | Corresponding Transcript(s) |
|---|---|
| W25389_P4 | W25389_T6 (SEQ ID NO: 4454); W25389_T7 (SEQ ID NO: 4455) |

Cluster W25389 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 96 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 96 and Table 3851. This cluster is overexpressed (at least at a minimum level) in the following pathological conditions: brain malignant tumors, epithelial malignant tumors and a mixture of malignant tumors from different tissues.

TABLE 3851

Normal tissue distribution

| Name of Tissue | Number |
|---|---|
| bone | 0 |
| brain | 2 |
| colon | 0 |
| epithelial | 1 |
| general | 6 |
| head and neck | 0 |
| liver | 0 |
| lung | 10 |
| lymph nodes | 37 |
| breast | 8 |
| bone marrow | 0 |
| ovary | 0 |
| prostate | 0 |
| skin | 0 |
| stomach | 0 |
| uterus | 0 |

TABLE 3852

P values and ratios for expression in cancerous tissue

| Name of Tissue | P1 | P2 | SP1 | R3 | SP2 | R4 |
|---|---|---|---|---|---|---|
| bone | 1 | 1.0e−01 | 1 | 1.0 | 1.7e−01 | 3.1 |
| brain | 5.1e−01 | 1.4e−01 | 1 | 0.9 | 1.1e−04 | 4.8 |
| colon | 2.6e−01 | 3.3e−01 | 1 | 1.2 | 1 | 1.1 |
| epithelial | 1.4e−02 | 2.5e−04 | 1.7e−02 | 3.9 | 5.0e−05 | 6.7 |
| general | 1.6e−02 | 4.2e−07 | 1.1e−01 | 1.6 | 1.7e−08 | 3.9 |
| head and neck | 1 | 5.0e−01 | 1 | 1.0 | 7.5e−01 | 1.3 |
| liver | 1 | 3.0e−01 | 1 | 1.0 | 6.9e−01 | 1.6 |
| lung | 7.4e−01 | 6.9e−01 | 6.5e−01 | 1.2 | 8.5e−01 | 0.9 |
| lymph nodes | 6.3e−01 | 4.6e−01 | 1 | 0.5 | 6.4e−01 | 0.9 |
| breast | 6.2e−01 | 5.8e−01 | 4.7e−01 | 1.6 | 3.1e−01 | 1.6 |
| bone marrow | 1 | 4.2e−01 | 1 | 1.0 | 2.8e−01 | 2.8 |
| ovary | 6.2e−01 | 6.5e−01 | 6.8e−01 | 1.5 | 7.7e−01 | 1.3 |
| prostate | 7.3e−01 | 6.0e−01 | 6.7e−01 | 1.5 | 7.5e−01 | 1.4 |
| skin | 2.3e−01 | 3.3e−02 | 1.4e−01 | 7.0 | 2.9e−02 | 3.8 |
| stomach | 3.6e−01 | 1.9e−01 | 1 | 1.1 | 2.1e−01 | 2.5 |
| uterus | 4.7e−01 | 2.4e−01 | 2.9e−01 | 2.0 | 2.1e−01 | 2.5 |

As noted above, cluster W25389 features 6 segment(s), which were listed in Table 3849 above and for which the sequence(s) are given at the end of the application. These segment(s) are portions of nucleic acid sequence(s) which are described herein separately because they are of particular interest. A description of each segment according to the present invention is now provided.

Segment cluster W25389_node_9 (SEQ ID NO:4456) according to the present invention is supported by 5 libraries. The number of libraries was determined as previously described. This segment can be found in the following transcript(s): W25389_T6 (SEQ ID NO:4454) and W25389_T7 (SEQ ID NO:4455). Table 3853 below describes the starting and ending position of this segment on each transcript.

TABLE 3853

Segment location on transcripts

| Transcript name | Segment starting position | Segment ending position |
|---|---|---|
| W25389_T6 (SEQ ID NO: 4454) | 1 | 516 |
| W25389_T7 (SEQ ID NO: 4455) | 1 | 516 |

This segment can be found in the following protein(s): W25389_P4.

Segment cluster W25389_node_10 (SEQ ID NO:4457) according to the present invention is supported by 58 libraries. The number of libraries was determined as previously described. This segment can be found in the following transcript(s): W25389_T6 (SEQ ID NO:4454) and W25389_T7 (SEQ ID NO:4455). Table 3854 below describes the starting and ending position of this segment on each transcript.

TABLE 3854

Segment location on transcripts

| Transcript name | Segment starting position | Segment ending position |
|---|---|---|
| W25389_T6 (SEQ ID NO: 4454) | 517 | 659 |
| W25389_T7 (SEQ ID NO: 4455) | 517 | 659 |

This segment can be found in the following protein(s): W25389_P4.

Segment cluster W25389_node_12 (SEQ ID NO:4458) according to the present invention is supported by 51 libraries. The number of libraries was determined as previously described. This segment can be found in the following transcript(s): W25389_T6 (SEQ ID NO:4454) and W25389_T7 (SEQ ID NO:4455). Table 3855 below describes the starting and ending position of this segment on each transcript.

TABLE 3855

Segment location on transcripts

| Transcript name | Segment starting position | Segment ending position |
|---|---|---|
| W25389_T6 (SEQ ID NO: 4454) | 660 | 829 |
| W25389_T7 (SEQ ID NO: 4455) | 660 | 829 |

This segment can be found in the following protein(s): W25389_P4.

Segment cluster W25389_node_14 (SEQ ID NO:4459) according to the present invention is supported by 45 libraries. The number of libraries was determined as previously described. This segment can be found in the following transcript(s): W25389_T6 (SEQ ID NO:4454) and W25389_T7 (SEQ ID NO:4455). Table 3856 below describes the starting and ending position of this segment on each transcript.

TABLE 3856

Segment location on transcripts

| Transcript name | Segment starting position | Segment ending position |
|---|---|---|
| W25389_T6 (SEQ ID NO: 4454) | 830 | 959 |
| W25389_T7 (SEQ ID NO: 4455) | 830 | 959 |

This segment can be found in the following protein(s): W25389_P4.

Segment cluster W25389_node_17 (SEQ ID NO:4460) according to the present invention is supported by 42 libraries. The number of libraries was determined as previously described. This segment can be found in the following transcript(s): W25389_T6 (SEQ ID NO:4454) and W25389_T7 (SEQ ID NO:4455). Table 3857 below describes the starting and ending position of this segment on each transcript.

TABLE 3857

Segment location on transcripts

| Transcript name | Segment starting position | Segment ending position |
|---|---|---|
| W25389_T6 (SEQ ID NO: 4454) | 960 | 1136 |
| W25389_T7 (SEQ ID NO: 4455) | 960 | 1136 |

This segment can be found in the following protein(s): W25389_P4.

Segment cluster W25389_node_19 (SEQ ID NO:4461) according to the present invention is supported by 75 libraries. The number of libraries was determined as previously described. This segment can be found in the following transcript(s): W25389_T6 (SEQ ID NO:4454) and W25389_T7 (SEQ ID NO:4455). Table 3858 below describes the starting and ending position of this segment on each transcript.

TABLE 3858

Segment location on transcripts

| Transcript name | Segment starting position | Segment ending position |
|---|---|---|
| W25389_T6 (SEQ ID NO: 4454) | 1137 | 2019 |
| W25389_T7 (SEQ ID NO: 4455) | 1137 | 1743 |

This segment can be found in the following protein(s): W25389_P4.

Description for Cluster Z19129

Cluster Z19129 features 10 transcript(s) and 71 segment(s) of interest, the names for which are given in Tables 3859 and 3860, respectively, the sequences themselves are given at the end of the application. The selected protein variants are given in Table 3861.

TABLE 3859

Transcripts of interest
Transcript Name

Z19129_T4 (SEQ ID NO: 4462)
Z19129_T7 (SEQ ID NO: 4463)
Z19129_T19 (SEQ ID NO: 4464)
Z19129_T22 (SEQ ID NO: 4465)
Z19129_T26 (SEQ ID NO: 4466)
Z19129_T28 (SEQ ID NO: 4467)
Z19129_T29 (SEQ ID NO: 4468)
Z19129_T30 (SEQ ID NO: 4469)
Z19129_T31 (SEQ ID NO: 4470)
Z19129_T33 (SEQ ID NO: 4471)

TABLE 3860

Segments of interest
Segment Name

Z19129_node_8 (SEQ ID NO: 4472)
Z19129_node_10 (SEQ ID NO: 4473)
Z19129_node_12 (SEQ ID NO: 4474)
Z19129_node_14 (SEQ ID NO: 4475)
Z19129_node_25 (SEQ ID NO: 4476)
Z19129_node_27 (SEQ ID NO: 4477)
Z19129_node_29 (SEQ ID NO: 4478)
Z19129_node_37 (SEQ ID NO: 4479)
Z19129_node_42 (SEQ ID NO: 4480)
Z19129_node_45 (SEQ ID NO: 4481)
Z19129_node_57 (SEQ ID NO: 4482)
Z19129_node_59 (SEQ ID NO: 4483)
Z19129_node_65 (SEQ ID NO: 4484)
Z19129_node_69 (SEQ ID NO: 4485)
Z19129_node_71 (SEQ ID NO: 4486)
Z19129_node_72 (SEQ ID NO: 4487)
Z19129_node_73 (SEQ ID NO: 4488)
Z19129_node_75 (SEQ ID NO: 4489)
Z19129_node_77 (SEQ ID NO: 4490)
Z19129_node_79 (SEQ ID NO: 4491)
Z19129_node_81 (SEQ ID NO: 4492)
Z19129_node_85 (SEQ ID NO: 4493)
Z19129_node_90 (SEQ ID NO: 4494)
Z19129_node_93 (SEQ ID NO: 4495)
Z19129_node_94 (SEQ ID NO: 4496)
Z19129_node_96 (SEQ ID NO: 4497)
Z19129_node_100 (SEQ ID NO: 4498)
Z19129_node_101 (SEQ ID NO: 4499)
Z19129_node_104 (SEQ ID NO: 4500)
Z19129_node_115 (SEQ ID NO: 4501)
Z19129_node_116 (SEQ ID NO: 4502)
Z19129_node_117 (SEQ ID NO: 4503)
Z19129_node_123 (SEQ ID NO: 4504)
Z19129_node_126 (SEQ ID NO: 4505)

TABLE 3860-continued

Segments of interest
Segment Name

Z19129_node_0 (SEQ ID NO: 4506)
Z19129_node_4 (SEQ ID NO: 4507)
Z19129_node_5 (SEQ ID NO: 4508)
Z19129_node_16 (SEQ ID NO: 4509)
Z19129_node_18 (SEQ ID NO: 4510)
Z19129_node_19 (SEQ ID NO: 4511)
Z19129_node_21 (SEQ ID NO: 4512)
Z19129_node_23 (SEQ ID NO: 4513)
Z19129_node_31 (SEQ ID NO: 4514)
Z19129_node_33 (SEQ ID NO: 4515)
Z19129_node_35 (SEQ ID NO: 4516)
Z19129_node_39 (SEQ ID NO: 4517)
Z19129_node_43 (SEQ ID NO: 4518)
Z19129_node_50 (SEQ ID NO: 4519)
Z19129_node_51 (SEQ ID NO: 4520)
Z19129_node_53 (SEQ ID NO: 4521)
Z19129_node_54 (SEQ ID NO: 4522)
Z19129_node_56 (SEQ ID NO: 4523)
Z19129_node_61 (SEQ ID NO: 4524)
Z19129_node_62 (SEQ ID NO: 4525)
Z19129_node_67 (SEQ ID NO: 4526)
Z19129_node_86 (SEQ ID NO: 4527)
Z19129_node_87 (SEQ ID NO: 4528)
Z19129_node_88 (SEQ ID NO: 4529)
Z19129_node_98 (SEQ ID NO: 4530)
Z19129_node_102 (SEQ ID NO: 4531)
Z19129_node_106 (SEQ ID NO: 4532)
Z19129_node_108 (SEQ ID NO: 4533)
Z19129_node_109 (SEQ ID NO: 4534)
Z19129_node_110 (SEQ ID NO: 4535)
Z19129_node_118 (SEQ ID NO: 4536)
Z19129_node_119 (SEQ ID NO: 4537)
Z19129_node_120 (SEQ ID NO: 4538)
Z19129_node_121 (SEQ ID NO: 4539)
Z19129_node_122 (SEQ ID NO: 4540)
Z19129_node_124 (SEQ ID NO: 4541)
Z19129_node_125 (SEQ ID NO: 4542)

TABLE 3861

Proteins of interest

| Protein Name | Corresponding Transcript(s) |
|---|---|
| Z19129_P3 | Z19129_T4 (SEQ ID NO: 4462) |
| Z19129_P6 | Z19129_T7 (SEQ ID NO: 4463) |
| Z19129_P16 | Z19129_T19 (SEQ ID NO: 4464) |
| Z19129_P18 | Z19129_T22 (SEQ ID NO: 4465) |
| Z19129_P22 | Z19129_T26 (SEQ ID NO: 4466) |
| Z19129_P24 | Z19129_T28 (SEQ ID NO: 4467) |
| Z19129_P25 | Z19129_T30 (SEQ ID NO: 4469); Z19129_T31 (SEQ ID NO: 4470) |
| Z19129_P27 | Z19129_T33 (SEQ ID NO: 4471) |

These sequences are variants of the known protein CH-TOG protein (SwissProt accession identifier CTOG_HUMAN; known also according to the synonyms Colonic and hepatic tumor over-expressed protein), referred to herein as the previously known protein.

The sequence for protein CH-TOG protein is given at the end of the application, as "CH-TOG protein amino acid sequence". Known polymorphisms for this sequence are as shown in Table 3862.

TABLE 3862

Amino acid mutations for Known Protein

| SNP position(s) on amino acid sequence | Comment |
|---|---|
| 1564-1623 | Missing |
| 1814 | E -> A |
| 1822 | E -> A |

Cluster Z19129 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 97 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 97 and Table 3863. This cluster is overexpressed (at least at a minimum level) in the following pathological conditions: colorectal cancer, a mixture of malignant tumors from different tissues and myosarcoma.

TABLE 3863

Normal tissue distribution

| Name of Tissue | Number |
|---|---|
| adrenal | 400 |
| bladder | 41 |
| bone | 64 |
| brain | 125 |
| colon | 0 |
| epithelial | 74 |
| general | 155 |
| kidney | 35 |
| liver | 4 |
| lung | 53 |
| lymph nodes | 98 |
| breast | 65 |
| bone marrow | 0 |
| muscle | 12 |
| ovary | 116 |
| pancreas | 20 |
| prostate | 48 |
| skin | 67 |
| stomach | 219 |
| T cells | 0 |
| Thyroid | 141 |
| uterus | 90 |

TABLE 3864

P values and ratios for expression in cancerous tissue

| Name of Tissue | P1 | P2 | SP1 | R3 | SP2 | R4 |
|---|---|---|---|---|---|---|
| adrenal | 7.0e-01 | 7.1e-01 | 1 | 0.1 | 1 | 0.2 |
| bladder | 7.6e-01 | 6.3e-01 | 8.1e-01 | 0.9 | 2.9e-01 | 1.2 |
| bone | 8.3e-01 | 6.7e-01 | 1 | 0.3 | 3.2e-01 | 1.2 |
| brain | 7.6e-01 | 6.0e-01 | 1 | 0.2 | 1 | 0.3 |
| colon | 4.9e-03 | 3.2e-03 | 8.0e-02 | 4.4 | 5.7e-02 | 4.3 |
| epithelial | 4.0e-01 | 1.1e-01 | 4.6e-02 | 0.9 | 9.7e-03 | 1.2 |
| general | 3.8e-02 | 9.4e-05 | 1 | 0.5 | 1 | 0.6 |
| kidney | 7.7e-01 | 7.0e-01 | 6.2e-01 | 1.0 | 4.2e-01 | 1.3 |
| liver | 3.3e-01 | 3.4e-01 | 1 | 1.2 | 1.1e-01 | 3.0 |
| lung | 7.7e-01 | 6.0e-01 | 7.1e-01 | 1.0 | 2.0e-01 | 1.5 |
| lymph nodes | 5.0e-01 | 5.8e-01 | 6.4e-01 | 1.0 | 7.9e-01 | 0.8 |

TABLE 3864-continued

P values and ratios for expression in cancerous tissue

| Name of Tissue | P1 | P2 | SP1 | R3 | SP2 | R4 |
|---|---|---|---|---|---|---|
| breast | 8.3e-01 | 7.3e-01 | 9.0e-01 | 0.6 | 5.7e-01 | 1.0 |
| bone marrow | 1 | 4.2e-01 | 1 | 1.0 | 2.3e-02 | 5.4 |
| muscle | 1.0e-01 | 4.0e-02 | 4.8e-04 | 8.0 | 2.1e-04 | 6.3 |
| ovary | 8.5e-01 | 8.5e-01 | 9.1e-01 | 0.6 | 8.6e-01 | 0.6 |
| pancreas | 2.3e-01 | 5.3e-02 | 3.6e-01 | 1.7 | 1.8e-01 | 2.1 |
| prostate | 8.7e-01 | 8.6e-01 | 8.0e-01 | 0.9 | 3.9e-01 | 1.2 |
| skin | 6.0e-01 | 3.3e-01 | 6.0e-01 | 1.2 | 3.3e-01 | 0.6 |
| stomach | 5.8e-01 | 4.7e-01 | 8.3e-01 | 0.4 | 9.8e-01 | 0.4 |
| T cells | 1 | 6.7e-01 | 1 | 1.0 | 7.2e-01 | 1.4 |
| Thyroid | 5.6e-01 | 5.6e-01 | 1 | 0.6 | 1 | 0.6 |
| uterus | 2.4e-02 | 2.0e-01 | 2.7e-01 | 1.2 | 2.1e-01 | 1.2 |

As noted above, cluster Z19129 features 71 segment(s), which were listed in Table 3860 above and for which the sequence(s) are given at the end of the application. These segment(s) are portions of nucleic acid sequence(s) which are described herein separately because they are of particular interest. A description of each segment according to the present invention is now provided.

Segment cluster Z19129_node_8 (SEQ ID NO:4472) according to the present invention is supported by 21 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3865 below describes the starting and ending position of this segment on each transcript.

TABLE 3865

Segment location on transcripts

| Transcript name | Segment starting position | Segment ending position |
|---|---|---|
| Z19129_T4 (SEQ ID NO: 4462) | 174 | 367 |
| Z19129_T30 (SEQ ID NO: 4469) | 174 | 367 |
| Z19129_T31 (SEQ ID NO: 4470) | 174 | 367 |
| Z19129_T33 (SEQ ID NO: 4471) | 174 | 367 |

This segment can be found in the following protein(s): Z19129_P3, Z19129_P25 and Z19129_P27.

Segment cluster Z19129_node_10 (SEQ ID NO:4473) according to the present invention is supported by 20 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3866 below describes the starting and ending position of this segment on each transcript.

TABLE 3866

Segment location on transcripts

| Transcript name | Segment starting position | Segment ending position |
|---|---|---|
| Z19129_T4 (SEQ ID NO: 4462) | 368 | 574 |
| Z19129_T30 (SEQ ID NO: 4469) | 368 | 574 |
| Z19129_T31 (SEQ ID NO: 4470) | 368 | 574 |
| Z19129_T33 (SEQ ID NO: 4471) | 368 | 574 |

This segment can be found in the following protein(s): Z19129_P3, Z19129_P25 and Z19129_P27.

Segment cluster Z19129_node_12 (SEQ ID NO:4474) according to the present invention is supported by 23 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3867 below describes the starting and ending position of this segment on each transcript.

TABLE 3867

| | Segment location on transcripts | |
|---|---|---|
| Transcript name | Segment starting position | Segment ending position |
| Z19129_T4 (SEQ ID NO: 4462) | 575 | 746 |
| Z19129_T30 (SEQ ID NO: 4469) | 575 | 746 |
| Z19129_T31 (SEQ ID NO: 4470) | 575 | 746 |
| Z19129_T33 (SEQ ID NO: 4471) | 575 | 746 |

This segment can be found in the following protein(s): Z19129_P3, Z19129_P25 and Z19129_P27.

Segment cluster Z19129_node_14 (SEQ ID NO:4475) according to the present invention is supported by 19 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3868 below describes the starting and ending position of this segment on each transcript.

TABLE 3868

| | Segment location on transcripts | |
|---|---|---|
| Transcript name | Segment starting position | Segment ending position |
| Z19129_T4 (SEQ ID NO: 4462) | 747 | 879 |
| Z19129_T30 (SEQ ID NO: 4469) | 747 | 879 |
| Z19129_T31 (SEQ ID NO: 4470) | 747 | 879 |
| Z19129_T33 (SEQ ID NO: 4471) | 747 | 879 |

This segment can be found in the following protein(s): Z19129_P3, Z19129_P25 and Z19129_P27.

Segment cluster Z19129_node_25 (SEQ ID NO:4476) according to the present invention is supported by 7 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3869 below describes the starting and ending position of this segment on each transcript.

TABLE 3869

| | Segment location on transcripts | |
|---|---|---|
| Transcript name | Segment starting position | Segment ending position |
| Z19129_T4 (SEQ ID NO: 4462) | 1290 | 1454 |
| Z19129_T30 (SEQ ID NO: 4469) | 1290 | 1454 |

TABLE 3869-continued

| | Segment location on transcripts | |
|---|---|---|
| Transcript name | Segment starting position | Segment ending position |
| Z19129_T31 (SEQ ID NO: 4470) | 1290 | 1454 |
| Z19129_T33 (SEQ ID NO: 4471) | 1290 | 1454 |

This segment can be found in the following protein(s): Z19129_P3, Z19129_P25 and Z19129_P27.

Segment cluster Z19129_node_27 (SEQ ID NO:4477) according to the present invention is supported by 10 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3870 below describes the starting and ending position of this segment on each transcript.

TABLE 3870

| | Segment location on transcripts | |
|---|---|---|
| Transcript name | Segment starting position | Segment ending position |
| Z19129_T4 (SEQ ID NO: 4462) | 1455 | 1583 |
| Z19129_T30 (SEQ ID NO: 4469) | 1455 | 1583 |
| Z19129_T31 (SEQ ID NO: 4470) | 1455 | 1583 |
| Z19129_T33 (SEQ ID NO: 4471) | 1455 | 1583 |

This segment can be found in the following protein(s): Z19129_P3, Z19129_P25 and Z19129_P27.

Segment cluster Z19129_node_29 (SEQ ID NO:4478) according to the present invention is supported by 11 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3871 below describes the starting and ending position of this segment on each transcript.

TABLE 3871

| | Segment location on transcripts | |
|---|---|---|
| Transcript name | Segment starting position | Segment ending position |
| Z19129_T4 (SEQ ID NO: 4462) | 1584 | 1766 |
| Z19129_T30 (SEQ ID NO: 4469) | 1584 | 1766 |
| Z19129_T31 (SEQ ID NO: 4470) | 1584 | 1766 |
| Z19129_T33 (SEQ ID NO: 4471) | 1584 | 1766 |

This segment can be found in the following protein(s): Z19129_P3, Z19129_P25 and Z19129_P27.

Segment cluster Z19129_node_37 (SEQ ID NO:4479) according to the present invention is supported by 21 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3872 below describes the starting and ending position of this segment on each transcript.

TABLE 3872

Segment location on transcripts

| Transcript name | Segment starting position | Segment ending position |
|---|---|---|
| Z19129_T4 (SEQ ID NO: 4462) | 2085 | 2270 |
| Z19129_T30 (SEQ ID NO: 4469) | 2085 | 2270 |
| Z19129_T31 (SEQ ID NO: 4470) | 2085 | 2270 |
| Z19129_T33 (SEQ ID NO: 4471) | 2085 | 2270 |

This segment can be found in the following protein(s): Z19129_P3, Z19129_P25 and Z19129_P27.

Segment cluster Z19129_node_42 (SEQ ID NO:4480) according to the present invention is supported by 1 libraries. The number of libraries was determined as previously described. This segment can be found in the following transcript(s): Z19129_T7 (SEQ ID NO:4463). Table 3873 below describes the starting and ending position of this segment on each transcript.

TABLE 3873

Segment location on transcripts

| Transcript name | Segment starting position | Segment ending position |
|---|---|---|
| Z19129_T7 (SEQ ID NO: 4463) | 1 | 183 |

This segment can be found in a non-coding region of transcript(s) that are related to the following protein(s): Z19129_P6.

Segment cluster Z19129_node_45 (SEQ ID NO:4481) according to the present invention is supported by 24 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3874 below describes the starting and ending position of this segment on each transcript.

TABLE 3874

Segment location on transcripts

| Transcript name | Segment starting position | Segment ending position |
|---|---|---|
| Z19129_T4 (SEQ ID NO: 4462) | 2424 | 2549 |
| Z19129_T7 (SEQ ID NO: 4463) | 242 | 367 |
| Z19129_T30 (SEQ ID NO: 4469) | 2424 | 2549 |
| Z19129_T31 (SEQ ID NO: 4470) | 2424 | 2549 |
| Z19129_T33 (SEQ ID NO: 4471) | 2424 | 2549 |

This segment can be found in the following protein(s): Z19129_P3, Z19129_P6, Z19129_P25 and Z19129_P27.

Segment cluster Z19129_node_57 (SEQ ID NO:4482) according to the present invention is supported by 2 libraries. The number of libraries was determined as previously described. This segment can be found in the following transcript(s): Z19129_T33 (SEQ ID NO:4471). Table 3875 below describes the starting and ending position of this segment on each transcript.

TABLE 3875

Segment location on transcripts

| Transcript name | Segment starting position | Segment ending position |
|---|---|---|
| Z19129_T33 (SEQ ID NO: 4471) | 2979 | 3138 |

This segment can be found in the following protein(s): Z19129_P27.

Segment cluster Z19129_node_59 (SEQ ID NO:4483) according to the present invention is supported by 28 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3876 below describes the starting and ending position of this segment on each transcript.

TABLE 3876

Segment location on transcripts

| Transcript name | Segment starting position | Segment ending position |
|---|---|---|
| Z19129_T4 (SEQ ID NO: 4462) | 2979 | 3107 |
| Z19129_T7 (SEQ ID NO: 4463) | 797 | 925 |
| Z19129_T30 (SEQ ID NO: 4469) | 2979 | 3107 |
| Z19129_T31 (SEQ ID NO: 4470) | 2979 | 3107 |

This segment can be found in the following protein(s): Z19129_P3, Z19129_P6 and Z19129_P25.

Segment cluster Z19129_node_65 (SEQ ID NO:4484) according to the present invention is supported by 36 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3877 below describes the starting and ending position of this segment on each transcript.

TABLE 3877

Segment location on transcripts

| Transcript name | Segment starting position | Segment ending position |
|---|---|---|
| Z19129_T4 (SEQ ID NO: 4462) | 3303 | 3438 |
| Z19129_T7 (SEQ ID NO: 4463) | 1121 | 1256 |
| Z19129_T30 (SEQ ID NO: 4469) | 3303 | 3438 |
| Z19129_T31 (SEQ ID NO: 4470) | 3303 | 3438 |

This segment can be found in the following protein(s): Z19129_P3, Z19129_P6 and Z19129_P25.

Segment cluster Z19129_node_69 (SEQ ID NO:4485) according to the present invention is supported by 31 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3878 below describes the starting and ending position of this segment on each transcript.

TABLE 3878

Segment location on transcripts

| Transcript name | Segment starting position | Segment ending position |
|---|---|---|
| Z19129_T4 (SEQ ID NO: 4462) | 3528 | 3653 |
| Z19129_T7 (SEQ ID NO: 4463) | 1346 | 1471 |
| Z19129_T30 (SEQ ID NO: 4469) | 3528 | 3653 |
| Z19129_T31 (SEQ ID NO: 4470) | 3528 | 3653 |

This segment can be found in the following protein(s): Z19129_P3, Z19129_P6 and Z19129_P25.

Segment cluster Z19129_node_71 (SEQ ID NO:4486) according to the present invention is supported by 38 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3879 below describes the starting and ending position of this segment on each transcript.

TABLE 3879

Segment location on transcripts

| Transcript name | Segment starting position | Segment ending position |
|---|---|---|
| Z19129_T4 (SEQ ID NO: 4462) | 3654 | 3803 |
| Z19129_T7 (SEQ ID NO: 4463) | 1472 | 1621 |
| Z19129_T30 (SEQ ID NO: 4469) | 3654 | 3803 |
| Z19129_T31 (SEQ ID NO: 4470) | 3654 | 3803 |

This segment can be found in the following protein(s): Z19129_P3, Z19129_P6 and Z19129_P25.

Segment cluster Z19129_node_72 (SEQ ID NO:4487) according to the present invention is supported by 3 libraries. The number of libraries was determined as previously described. This segment can be found in the following transcript(s): Z19129_T4 (SEQ ID NO:4462). Table 3880 below describes the starting and ending position of this segment on each transcript.

TABLE 3880

Segment location on transcripts

| Transcript name | Segment starting position | Segment ending position |
|---|---|---|
| Z19129_T4 (SEQ ID NO: 4462) | 3804 | 4104 |

This segment can be found in the following protein(s): Z19129_P3.

Segment cluster Z19129_node_73 (SEQ ID NO:4488) according to the present invention is supported by 44 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3881 below describes the starting and ending position of this segment on each transcript.

TABLE 3881

Segment location on transcripts

| Transcript name | Segment starting position | Segment ending position |
|---|---|---|
| Z19129_T4 (SEQ ID NO: 4462) | 4105 | 4308 |
| Z19129_T7 (SEQ ID NO: 4463) | 1622 | 1825 |
| Z19129_T30 (SEQ ID NO: 4469) | 3804 | 4007 |
| Z19129_T31 (SEQ ID NO: 4470) | 3804 | 4007 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6 and Z19129_P25, since it is in the coding region for the corresponding transcript.

Segment cluster Z19129_node_75 (SEQ ID NO:4489) according to the present invention is supported by 43 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3882 below describes the starting and ending position of this segment on each transcript.

TABLE 3882

Segment location on transcripts

| Transcript name | Segment starting position | Segment ending position |
|---|---|---|
| Z19129_T4 (SEQ ID NO: 4462) | 4309 | 4444 |
| Z19129_T7 (SEQ ID NO: 4463) | 1826 | 1961 |
| Z19129_T30 (SEQ ID NO: 4469) | 4008 | 4143 |
| Z19129_T31 (SEQ ID NO: 4470) | 4008 | 4143 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6 and Z19129_P25, since it is in the coding region for the corresponding transcript.

Segment cluster Z19129_node_77 (SEQ ID NO:4490) according to the present invention is supported by 1 libraries. The number of libraries was determined as previously described. This segment can be found in the following transcript(s): Z19129_T19 (SEQ ID NO:4464). Table 3883 below describes the starting and ending position of this segment on each transcript.

TABLE 3883

Segment location on transcripts

| Transcript name | Segment starting position | Segment ending position |
|---|---|---|
| Z19129_T19 (SEQ ID NO: 4464) | 1 | 174 |

This segment can be found in a non-coding region of transcript(s) that are related to the following protein(s): Z19129_P16.

Segment cluster Z19129_node_79 (SEQ ID NO:4491) according to the present invention is supported by 49 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T30 (SEQ ID NO:4469) and Z19129_T31 (SEQ ID NO:4470). Table 3884 below describes the starting and ending position of this segment on each transcript.

TABLE 3884

Segment location on transcripts

| Transcript name | Segment starting position | Segment ending position |
|---|---|---|
| Z19129_T4 (SEQ ID NO: 4462) | 4445 | 4638 |
| Z19129_T7 (SEQ ID NO: 4463) | 1962 | 2155 |
| Z19129_T19 (SEQ ID NO: 4464) | 175 | 368 |
| Z19129_T30 (SEQ ID NO: 4469) | 4144 | 4337 |
| Z19129_T31 (SEQ ID NO: 4470) | 4144 | 4337 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16 and Z19129_P25, since it is in the coding region for the corresponding transcript.

Segment cluster Z19129_node_81 (SEQ ID NO:4492) according to the present invention is supported by 50 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T30 (SEQ ID NO:4469) and Z19129_T31 (SEQ ID NO:4470). Table 3885 below describes the starting and ending position of this segment on each transcript.

TABLE 3885

Segment location on transcripts

| Transcript name | Segment starting position | Segment ending position |
|---|---|---|
| Z19129_T4 (SEQ ID NO: 4462) | 4639 | 4811 |
| Z19129_T7 (SEQ ID NO: 4463) | 2156 | 2328 |
| Z19129_T19 (SEQ ID NO: 4464) | 369 | 541 |
| Z19129_T30 (SEQ ID NO: 4469) | 4338 | 4510 |
| Z19129_T31 (SEQ ID NO: 4470) | 4338 | 4510 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16 and Z19129_P25, since it is in the coding region for the corresponding transcript.

Segment cluster Z19129_node_85 (SEQ ID NO:4493) according to the present invention is supported by 1 libraries. The number of libraries was determined as previously described. This segment can be found in the following transcript(s): Z19129_T22 (SEQ ID NO:4465). Table 3886 below describes the starting and ending position of this segment on each transcript.

TABLE 3886

Segment location on transcripts

| Transcript name | Segment starting position | Segment ending position |
|---|---|---|
| Z19129_T22 (SEQ ID NO: 4465) | 1 | 283 |

This segment can be found in a non-coding region of transcript(s) that are related to the following protein(s): Z19129_P18.

Segment cluster Z19129_node_90 (SEQ ID NO:4494) according to the present invention is supported by 51 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T30 (SEQ ID NO:4469) and Z19129_T31 (SEQ ID NO:4470). Table 3887 below describes the starting and ending position of this segment on each transcript.

TABLE 3887

Segment location on transcripts

| Transcript name | Segment starting position | Segment ending position |
|---|---|---|
| Z19129_T4 (SEQ ID NO: 4462) | 4986 | 5106 |
| Z19129_T7 (SEQ ID NO: 4463) | 2503 | 2623 |
| Z19129_T19 (SEQ ID NO: 4464) | 716 | 836 |
| Z19129_T22 (SEQ ID NO: 4465) | 458 | 578 |
| Z19129_T30 (SEQ ID NO: 4469) | 4685 | 4805 |
| Z19129_T31 (SEQ ID NO: 4470) | 4685 | 4805 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P25, since it is in the coding region for the corresponding transcript.

Segment cluster Z19129_node_93 (SEQ ID NO:4495) according to the present invention is supported by 61 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T30 (SEQ ID NO:4469) and Z19129_T31 (SEQ ID NO:4470). Table 3888 below describes the starting and ending position of this segment on each transcript.

TABLE 3888

Segment location on transcripts

| Transcript name | Segment starting position | Segment ending position |
|---|---|---|
| Z19129_T4 (SEQ ID NO: 4462) | 5107 | 5286 |
| Z19129_T7 (SEQ ID NO: 4463) | 2624 | 2803 |
| Z19129_T19 (SEQ ID NO: 4464) | 837 | 1016 |
| Z19129_T22 (SEQ ID NO: 4465) | 579 | 758 |
| Z19129_T30 (SEQ ID NO: 4469) | 4806 | 4985 |
| Z19129_T31 (SEQ ID NO: 4470) | 4806 | 4985 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P25, since it is in the coding region for the corresponding transcript.

Segment cluster Z19129_node__94 (SEQ ID NO:4496) according to the present invention is supported by 8 libraries. The number of libraries was determined as previously described. This segment can be found in the following transcript(s): Z19129_T30 (SEQ ID NO:4469) and Z19129_T31 (SEQ ID NO:4470). Table 3889 below describes the starting and ending position of this segment on each transcript.

TABLE 3889

Segment location on transcripts

| Transcript name | Segment starting position | Segment ending position |
|---|---|---|
| Z19129_T30 (SEQ ID NO: 4469) | 4986 | 5460 |
| Z19129_T31 (SEQ ID NO: 4470) | 4986 | 5853 |

This segment can be found in the following protein(s): Z19129_P25.

Segment cluster Z19129_node__96 (SEQ ID NO:4497) according to the present invention is supported by 74 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464) and Z19129_T22 (SEQ ID NO:4465). Table 3890 below describes the starting and ending position of this segment on each transcript.

TABLE 3890

Segment location on transcripts

| Transcript name | Segment starting position | Segment ending position |
|---|---|---|
| Z19129_T4 (SEQ ID NO: 4462) | 5287 | 5474 |
| Z19129_T7 (SEQ ID NO: 4463) | 2804 | 2991 |
| Z19129_T19 (SEQ ID NO: 4464) | 1017 | 1204 |
| Z19129_T22 (SEQ ID NO: 4465) | 759 | 946 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16 and Z19129_P18, since it is in the coding region for the corresponding transcript.

Segment cluster Z19129_node__100 (SEQ ID NO:4498) according to the present invention is supported by 2 libraries. The number of libraries was determined as previously described. This segment can be found in the following transcript(s): Z19129_T26 (SEQ ID NO:4466). Table 3891 below describes the starting and ending position of this segment on each transcript.

TABLE 3891

Segment location on transcripts

| Transcript name | Segment starting position | Segment ending position |
|---|---|---|
| Z19129_T26 (SEQ ID NO: 4466) | 1 | 334 |

This segment can be found in a non-coding region of transcript(s) that are related to the following protein(s): Z19129_P22.

Segment cluster Z19129_node__101 (SEQ ID NO:4499) according to the present invention is supported by 95 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3892 below describes the starting and ending position of this segment on each transcript.

TABLE 3892

Segment location on transcripts

| Transcript name | Segment starting position | Segment ending position |
|---|---|---|
| Z19129_T4 (SEQ ID NO: 4462) | 5551 | 5690 |
| Z19129_T7 (SEQ ID NO: 4463) | 3068 | 3207 |
| Z19129_T19 (SEQ ID NO: 4464) | 1281 | 1420 |
| Z19129_T22 (SEQ ID NO: 4465) | 1023 | 1162 |
| Z19129_T26 (SEQ ID NO: 4466) | 335 | 474 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__104 (SEQ ID NO:4500) according to the present invention is supported by 98 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3893 below describes the starting and ending position of this segment on each transcript.

TABLE 3893

Segment location on transcripts

| Transcript name | Segment starting position | Segment ending position |
|---|---|---|
| Z19129_T4 (SEQ ID NO: 4462) | 5740 | 5877 |
| Z19129_T7 (SEQ ID NO: 4463) | 3257 | 3394 |
| Z19129_T19 (SEQ ID NO: 4464) | 1470 | 1607 |
| Z19129_T22 (SEQ ID NO: 4465) | 1212 | 1349 |
| Z19129_T26 (SEQ ID NO: 4466) | 524 | 661 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node_115 (SEQ ID NO:4501) according to the present invention is supported by 7 libraries. The number of libraries was determined as previously described. This segment can be found in the following transcript(s): Z19129_T28 (SEQ ID NO:4467) and Z19129_T29 (SEQ ID NO:4468). Table 3894 below describes the starting and ending position of this segment on each transcript.

TABLE 3894

Segment location on transcripts

| Transcript name | Segment starting position | Segment ending position |
|---|---|---|
| Z19129_T28 (SEQ ID NO: 4467) | 1 | 1521 |
| Z19129_T29 (SEQ ID NO: 4468) | 1 | 1521 |

This segment can be found in a non-coding region of transcript(s) that are related to the following protein(s): Z19129_P24.

Segment cluster Z19129_node_116 (SEQ ID NO:4502) according to the present invention is supported by 134 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3895 below describes the starting and ending position of this segment on each transcript.

TABLE 3895

Segment location on transcripts

| Transcript name | Segment starting position | Segment ending position |
|---|---|---|
| Z19129_T4 (SEQ ID NO: 4462) | 6122 | 6273 |
| Z19129_T7 (SEQ ID NO: 4463) | 3639 | 3790 |
| Z19129_T19 (SEQ ID NO: 4464) | 1852 | 2003 |
| Z19129_T22 (SEQ ID NO: 4465) | 1594 | 1745 |
| Z19129_T26 (SEQ ID NO: 4466) | 906 | 1057 |
| Z19129_T28 (SEQ ID NO: 4467) | 1522 | 1673 |
| Z19129_T29 (SEQ ID NO: 4468) | 1522 | 1673 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node_117 (SEQ ID NO:4503) according to the present invention is supported by 2 libraries. The number of libraries was determined as previously described. This segment can be found in the following transcript(s): Z19129_T29 (SEQ ID NO:4468). Table 3896 below describes the starting and ending position of this segment on each transcript.

TABLE 3896

Segment location on transcripts

| Transcript name | Segment starting position | Segment ending position |
|---|---|---|
| Z19129_T29 (SEQ ID NO: 4468) | 1674 | 1833 |

The previously-described transcripts for these segment(s) do not code for protein.

Segment cluster Z19129_node_123 (SEQ ID NO:4504) according to the present invention is supported by 175 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3897 below describes the starting and ending position of this segment on each transcript.

TABLE 3897

Segment location on transcripts

| Transcript name | Segment starting position | Segment ending position |
|---|---|---|
| Z19129_T4 (SEQ ID NO: 4462) | 6511 | 6708 |
| Z19129_T7 (SEQ ID NO: 4463) | 4028 | 4225 |
| Z19129_T19 (SEQ ID NO: 4464) | 2241 | 2438 |
| Z19129_T22 (SEQ ID NO: 4465) | 1983 | 2180 |
| Z19129_T26 (SEQ ID NO: 4466) | 1295 | 1492 |
| Z19129_T28 (SEQ ID NO: 4467) | 1911 | 2108 |
| Z19129_T29 (SEQ ID NO: 4468) | 2071 | 2268 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node_126 (SEQ ID NO:4505) according to the present invention is supported by 125 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3898 below describes the starting and ending position of this segment on each transcript.

TABLE 3898

Segment location on transcripts

| Transcript name | Segment starting position | Segment ending position |
|---|---|---|
| Z19129_T4 (SEQ ID NO: 4462) | 6878 | 7004 |
| Z19129_T7 (SEQ ID NO: 4463) | 4395 | 4521 |
| Z19129_T19 (SEQ ID NO: 4464) | 2608 | 2734 |
| Z19129_T22 (SEQ ID NO: 4465) | 2350 | 2476 |
| Z19129_T26 (SEQ ID NO: 4466) | 1662 | 1788 |
| Z19129_T28 (SEQ ID NO: 4467) | 2278 | 2404 |

TABLE 3898-continued

Segment location on transcripts

| Transcript name | Segment starting position | Segment ending position |
|---|---|---|
| Z19129_T29 (SEQ ID NO: 4468) | 2438 | 2564 |

This segment can be found in a non-coding region of transcript(s) that are related to the following protein(s): Z19129_P3, Z19129_P6, Z19129_P16, Z19129_P18, Z19129_P22 and Z19129_P24.

According to an optional embodiment of the present invention, short segments related to the above cluster are also provided. These segments are up to about 120 bp in length, and so are included in a separate description.

Segment cluster Z19129_node_0 (SEQ ID NO:4506) according to the present invention is supported by 12 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3899 below describes the starting and ending position of this segment on each transcript.

TABLE 3899

Segment location on transcripts

| Transcript name | Segment starting position | Segment ending position |
|---|---|---|
| Z19129_T4 (SEQ ID NO: 4462) | 1 | 79 |
| Z19129_T30 (SEQ ID NO: 4469) | 1 | 79 |
| Z19129_T31 (SEQ ID NO: 4470) | 1 | 79 |
| Z19129_T33 (SEQ ID NO: 4471) | 1 | 79 |

This segment can be found in a non-coding region of transcript(s) that are related to the following protein(s): Z19129_P3, Z19129_P25 and Z19129_P27.

Segment cluster Z19129_node_4 (SEQ ID NO:4507) according to the present invention can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3900 below describes the starting and ending position of this segment on each transcript.

TABLE 3900

Segment location on transcripts

| Transcript name | Segment starting position | Segment ending position |
|---|---|---|
| Z19129_T4 (SEQ ID NO: 4462) | 80 | 99 |
| Z19129_T30 (SEQ ID NO: 4469) | 80 | 99 |
| Z19129_T31 (SEQ ID NO: 4470) | 80 | 99 |
| Z19129_T33 (SEQ ID NO: 4471) | 80 | 99 |

This segment can be found in a non-coding region of transcript(s) that are related to the following protein(s): Z19129_P3, Z19129_P25 and Z19129_P27.

Segment cluster Z19129_node_5 (SEQ ID NO:4508) according to the present invention is supported by 18 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3901 below describes the starting and ending position of this segment on each transcript.

TABLE 3901

Segment location on transcripts

| Transcript name | Segment starting position | Segment ending position |
|---|---|---|
| Z19129_T4 (SEQ ID NO: 4462) | 100 | 173 |
| Z19129_T30 (SEQ ID NO: 4469) | 100 | 173 |
| Z19129_T31 (SEQ ID NO: 4470) | 100 | 173 |
| Z19129_T33 (SEQ ID NO: 4471) | 100 | 173 |

This segment can be found in the following protein(s): Z19129_P3, Z19129_P25 and Z19129_P27.

Segment cluster Z19129_node_16 (SEQ ID NO:4509) according to the present invention is supported by 18 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3902 below describes the starting and ending position of this segment on each transcript.

TABLE 3902

Segment location on transcripts

| Transcript name | Segment starting position | Segment ending position |
|---|---|---|
| Z19129_T4 (SEQ ID NO: 4462) | 880 | 980 |
| Z19129_T30 (SEQ ID NO: 4469) | 880 | 980 |
| Z19129_T31 (SEQ ID NO: 4470) | 880 | 980 |
| Z19129_T33 (SEQ ID NO: 4471) | 880 | 980 |

This segment can be found in the following protein(s): Z19129_P3, Z19129_P25 and Z19129_P27.

Segment cluster Z19129_node_18 (SEQ ID NO:4510) according to the present invention is supported by 13 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3903 below describes the starting and ending position of this segment on each transcript.

TABLE 3903

Segment location on transcripts

| Transcript name | Segment starting position | Segment ending position |
|---|---|---|
| Z19129_T4 (SEQ ID NO: 4462) | 981 | 1050 |
| Z19129_T30 (SEQ ID NO: 4469) | 981 | 1050 |
| Z19129_T31 (SEQ ID NO: 4470) | 981 | 1050 |
| Z19129_T33 (SEQ ID NO: 4471) | 981 | 1050 |

This segment can be found in the following protein(s): Z19129_P3, Z19129_P25 and Z19129_P27.

Segment cluster Z19129_node_19 (SEQ ID NO:4511) according to the present invention is supported by 10 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3904 below describes the starting and ending position of this segment on each transcript.

TABLE 3904

Segment location on transcripts

| Transcript name | Segment starting position | Segment ending position |
|---|---|---|
| Z19129_T4 (SEQ ID NO: 4462) | 1051 | 1094 |
| Z19129_T30 (SEQ ID NO: 4469) | 1051 | 1094 |
| Z19129_T31 (SEQ ID NO: 4470) | 1051 | 1094 |
| Z19129_T33 (SEQ ID NO: 4471) | 1051 | 1094 |

This segment can be found in the following protein(s): Z19129_P3, Z19129_P25 and Z19129_P27.

Segment cluster Z19129_node_21 (SEQ ID NO:4512) according to the present invention is supported by 7 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3905 below describes the starting and ending position of this segment on each transcript.

TABLE 3905

Segment location on transcripts

| Transcript name | Segment starting position | Segment ending position |
|---|---|---|
| Z19129_T4 (SEQ ID NO: 4462) | 1095 | 1199 |
| Z19129_T30 (SEQ ID NO: 4469) | 1095 | 1199 |
| Z19129_T31 (SEQ ID NO: 4470) | 1095 | 1199 |
| Z19129_T33 (SEQ ID NO: 4471) | 1095 | 1199 |

This segment can be found in the following protein(s): Z19129_P3, Z19129_P25 and Z19129_P27.

Segment cluster Z19129_node_23 (SEQ ID NO:4513) according to the present invention is supported by 9 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3906 below describes the starting and ending position of this segment on each transcript.

TABLE 3906

Segment location on transcripts

| Transcript name | Segment starting position | Segment ending position |
|---|---|---|
| Z19129_T4 (SEQ ID NO: 4462) | 1200 | 1289 |
| Z19129_T30 (SEQ ID NO: 4469) | 1200 | 1289 |
| Z19129_T31 (SEQ ID NO: 4470) | 1200 | 1289 |
| Z19129_T33 (SEQ ID NO: 4471) | 1200 | 1289 |

This segment can be found in the following protein(s): Z19129_P3, Z19129_P25 and Z19129_P27.

Segment cluster Z19129_node_31 (SEQ ID NO:4514) according to the present invention is supported by 15 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3907 below describes the starting and ending position of this segment on each transcript.

TABLE 3907

Segment location on transcripts

| Transcript name | Segment starting position | Segment ending position |
|---|---|---|
| Z19129_T4 (SEQ ID NO: 4462) | 1767 | 1880 |
| Z19129_T30 (SEQ ID NO: 4469) | 1767 | 1880 |
| Z19129_T31 (SEQ ID NO: 4470) | 1767 | 1880 |
| Z19129_T33 (SEQ ID NO: 4471) | 1767 | 1880 |

This segment can be found in the following protein(s): Z19129_P3, Z19129_P25 and Z19129_P27.

Segment cluster Z19129_node_33 (SEQ ID NO:4515) according to the present invention is supported by 15 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3908 below describes the starting and ending position of this segment on each transcript.

TABLE 3908

Segment location on transcripts

| Transcript name | Segment starting position | Segment ending position |
|---|---|---|
| Z19129_T4 (SEQ ID NO: 4462) | 1881 | 1991 |
| Z19129_T30 (SEQ ID NO: 4469) | 1881 | 1991 |
| Z19129_T31 (SEQ ID NO: 4470) | 1881 | 1991 |
| Z19129_T33 (SEQ ID NO: 4471) | 1881 | 1991 |

This segment can be found in the following protein(s): Z19129_P3, Z19129_P25 and Z19129_P27.

Segment cluster Z19129_node_35 (SEQ ID NO:4516) according to the present invention is supported by 14 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3909 below describes the starting and ending position of this segment on each transcript.

TABLE 3909

Segment location on transcripts

| Transcript name | Segment starting position | Segment ending position |
|---|---|---|
| Z19129_T4 (SEQ ID NO: 4462) | 1992 | 2084 |
| Z19129_T30 (SEQ ID NO: 4469) | 1992 | 2084 |
| Z19129_T31 (SEQ ID NO: 4470) | 1992 | 2084 |
| Z19129_T33 (SEQ ID NO: 4471) | 1992 | 2084 |

This segment can be found in the following protein(s): Z19129_P3, Z19129_P25 and Z19129_P27.

Segment cluster Z19129_node_39 (SEQ ID NO:4517) according to the present invention is supported by 19 libraries. The number of libraries was determined as previously described. This segment can be found in the following transcript(s): Z19129_T4 (SEQ ID NO:4462), Z19129_T30 (SEQ ID NO:4469), Z19129_T31 (SEQ ID NO:4470) and Z19129_T33 (SEQ ID NO:4471). Table 3910 below describes the starting and ending position of this segment on each transcript.

TABLE 3910

Segment location on transcripts

| Transcript name | Segment starting position | Segment ending position |
|---|---|---|
| Z19129_T4 (SEQ ID NO: 4462) | 2271 | 2365 |
| Z19129_T30 (SEQ ID NO: 4469) | 2271 | 2365 |
| Z19129_T31 (SEQ ID NO: 4470) | 2271 | 2365 |
| Z19129_T33 (SEQ ID NO: 4471) | 2271 | 2365 |

This segment can be found in the following protein(s): Z19129_P3, Z19129_P25 and Z19129_P27.

Segment cluster Z19129_node_43 (SEQ ID NO:4518) according to the present invention is supported by 21 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3911 below describes the starting and ending position of this segment on each transcript.

TABLE 3911

Segment location on transcripts

| Transcript name | Segment starting position | Segment ending position |
|---|---|---|
| Z19129_T4 (SEQ ID NO: 4462) | 2366 | 2423 |
| Z19129_T7 (SEQ ID NO: 4463) | 184 | 241 |
| Z19129_T30 (SEQ ID NO: 4469) | 2366 | 2423 |
| Z19129_T31 (SEQ ID NO: 4470) | 2366 | 2423 |
| Z19129_T33 (SEQ ID NO: 4471) | 2366 | 2423 |

This segment can be found in both coding and non-coding regions of transcript(s) as follows. The segment can be found in a non-coding region of transcript(s) that are related to the following protein(s): Z19129_P6. This segment can also be found in the following protein(s): Z19129_P3, Z19129_P25 and Z19129_P27, since it is in the coding region for the corresponding transcript.

Segment cluster Z19129_node_50 (SEQ ID NO:4519) according to the present invention is supported by 24 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3912 below describes the starting and ending position of this segment on each transcript.

TABLE 3912

Segment location on transcripts

| Transcript name | Segment starting position | Segment ending position |
|---|---|---|
| Z19129_T4 (SEQ ID NO: 4462) | 2550 | 2625 |
| Z19129_T7 (SEQ ID NO: 4463) | 368 | 443 |

TABLE 3912-continued

Segment location on transcripts

| Transcript name | Segment starting position | Segment ending position |
|---|---|---|
| Z19129_T30 (SEQ ID NO: 4469) | 2550 | 2625 |
| Z19129_T31 (SEQ ID NO: 4470) | 2550 | 2625 |
| Z19129_T33 (SEQ ID NO: 4471) | 2550 | 2625 |

This segment can be found in the following protein(s): Z19129_P3, Z19129_P6, Z19129_P25 and Z19129_P27.

Segment cluster Z19129_node_51 (SEQ ID NO:4520) according to the present invention is supported by 22 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3913 below describes the starting and ending position of this segment on each transcript.

TABLE 3913

Segment location on transcripts

| Transcript name | Segment starting position | Segment ending position |
|---|---|---|
| Z19129_T4 (SEQ ID NO: 4462) | 2626 | 2689 |
| Z19129_T7 (SEQ ID NO: 4463) | 444 | 507 |
| Z19129_T30 (SEQ ID NO: 4469) | 2626 | 2689 |
| Z19129_T31 (SEQ ID NO: 4470) | 2626 | 2689 |
| Z19129_T33 (SEQ ID NO: 4471) | 2626 | 2689 |

This segment can be found in the following protein(s): Z19129_P3, Z19129_P6, Z19129_P25 and Z19129_P27.

Segment cluster Z19129_node_53 (SEQ ID NO:4521) according to the present invention is supported by 26 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3914 below describes the starting and ending position of this segment on each transcript.

TABLE 3914

Segment location on transcripts

| Transcript name | Segment starting position | Segment ending position |
|---|---|---|
| Z19129_T4 (SEQ ID NO: 4462) | 2690 | 2786 |
| Z19129_T7 (SEQ ID NO: 4463) | 508 | 604 |
| Z19129_T30 (SEQ ID NO: 4469) | 2690 | 2786 |
| Z19129_T31 (SEQ ID NO: 4470) | 2690 | 2786 |
| Z19129_T33 (SEQ ID NO: 4471) | 2690 | 2786 |

This segment can be found in the following protein(s): Z19129_P3, Z19129_P6, Z19129_P25 and Z19129_P27.

Segment cluster Z19129_node_54 (SEQ ID NO:4522) according to the present invention is supported by 29 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3915 below describes the starting and ending position of this segment on each transcript.

TABLE 3915

Segment location on transcripts

| Transcript name | Segment starting position | Segment ending position |
|---|---|---|
| Z19129_T4 (SEQ ID NO: 4462) | 2787 | 2864 |
| Z19129_T7 (SEQ ID NO: 4463) | 605 | 682 |
| Z19129_T30 (SEQ ID NO: 4469) | 2787 | 2864 |
| Z19129_T31 (SEQ ID NO: 4470) | 2787 | 2864 |
| Z19129_T33 (SEQ ID NO: 4471) | 2787 | 2864 |

This segment can be found in the following protein(s): Z19129_P3, Z19129_P6, Z19129_P25 and Z19129_P27.

Segment cluster Z19129_node_56 (SEQ ID NO:4523) according to the present invention is supported by 31 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469), Z19129_T31 (SEQ ID NO:4470) and Z19129_T33 (SEQ ID NO:4471). Table 3916 below describes the starting and ending position of this segment on each transcript.

TABLE 3916

Segment location on transcripts

| Transcript name | Segment starting position | Segment ending position |
|---|---|---|
| Z19129_T4 (SEQ ID NO: 4462) | 2865 | 2978 |
| Z19129_T7 (SEQ ID NO: 4463) | 683 | 796 |
| Z19129_T30 (SEQ ID NO: 4469) | 2865 | 2978 |
| Z19129_T31 (SEQ ID NO: 4470) | 2865 | 2978 |
| Z19129_T33 (SEQ ID NO: 4471) | 2865 | 2978 |

This segment can be found in the following protein(s): Z19129_P3, Z19129_P6, Z19129_P25 and Z19129_P27.

Segment cluster Z19129_node_61 (SEQ ID NO:4524) according to the present invention is supported by 35 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3917 below describes the starting and ending position of this segment on each transcript.

TABLE 3917

Segment location on transcripts

| Transcript name | Segment starting position | Segment ending position |
|---|---|---|
| Z19129_T4 (SEQ ID NO: 4462) | 3108 | 3194 |
| Z19129_T7 (SEQ ID NO: 4463) | 926 | 1012 |
| Z19129_T30 (SEQ ID NO: 4469) | 3108 | 3194 |
| Z19129_T31 (SEQ ID NO: 4470) | 3108 | 3194 |

This segment can be found in the following protein(s): Z19129_P3, Z19129_P6 and Z19129_P25.

Segment cluster Z19129_node_62 (SEQ ID NO:4525) according to the present invention is supported by 31 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3918 below describes the starting and ending position of this segment on each transcript.

TABLE 3918

Segment location on transcripts

| Transcript name | Segment starting position | Segment ending position |
|---|---|---|
| Z19129_T4 (SEQ ID NO: 4462) | 3195 | 3302 |
| Z19129_T7 (SEQ ID NO: 4463) | 1013 | 1120 |
| Z19129_T30 (SEQ ID NO: 4469) | 3195 | 3302 |
| Z19129_T31 (SEQ ID NO: 4470) | 3195 | 3302 |

This segment can be found in the following protein(s): Z19129_P3, Z19129_P6 and Z19129_P25.

Segment cluster Z19129_node_67 (SEQ ID NO:4526) according to the present invention is supported by 31 libraries. The number of libraries was determined as previously described. This segment can be found in the following transcript(s): Z19129_T4 (SEQ ID NO:4462), Z19129_T7 (SEQ ID NO:4463), Z19129_T30 (SEQ ID NO:4469) and Z19129_T31 (SEQ ID NO:4470). Table 3919 below describes the starting and ending position of this segment on each transcript.

TABLE 3919

Segment location on transcripts

| Transcript name | Segment starting position | Segment ending position |
|---|---|---|
| Z19129_T4 (SEQ ID NO: 4462) | 3439 | 3527 |
| Z19129_T7 (SEQ ID NO: 4463) | 1257 | 1345 |
| Z19129_T30 (SEQ ID NO: 4469) | 3439 | 3527 |
| Z19129_T31 (SEQ ID NO: 4470) | 3439 | 3527 |

This segment can be found in the following protein(s): Z19129_P3, Z19129_P6 and Z19129_P25.

Segment cluster Z19129_node_86 (SEQ ID NO:4527) according to the present invention is supported by 50 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T30 (SEQ ID NO:4469) and Z19129_T31 (SEQ ID NO:4470). Table 3920 below describes the starting and ending position of this segment on each transcript.

TABLE 3920

Segment location on transcripts

| Transcript name | Segment starting position | Segment ending position |
|---|---|---|
| Z19129_T4 (SEQ ID NO: 4462) | 4812 | 4908 |
| Z19129_T7 (SEQ ID NO: 4463) | 2329 | 2425 |
| Z19129_T19 (SEQ ID NO: 4464) | 542 | 638 |
| Z19129_T22 (SEQ ID NO: 4465) | 284 | 380 |
| Z19129_T30 (SEQ ID NO: 4469) | 4511 | 4607 |
| Z19129_T31 (SEQ ID NO: 4470) | 4511 | 4607 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P25, since it is in the coding region for the corresponding transcript.

Segment cluster Z19129_node__87 (SEQ ID NO:4528) according to the present invention is supported by 39 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T30 (SEQ ID NO:4469) and Z19129_T31 (SEQ ID NO:4470). Table 3921 below describes the starting and ending position of this segment on each transcript.

TABLE 3921

Segment location on transcripts

| Transcript name | Segment starting position | Segment ending position |
|---|---|---|
| Z19129_T4 (SEQ ID NO: 4462) | 4909 | 4966 |
| Z19129_T7 (SEQ ID NO: 4463) | 2426 | 2483 |
| Z19129_T19 (SEQ ID NO: 4464) | 639 | 696 |
| Z19129_T22 (SEQ ID NO: 4465) | 381 | 438 |
| Z19129_T30 (SEQ ID NO: 4469) | 4608 | 4665 |
| Z19129_T31 (SEQ ID NO: 4470) | 4608 | 4665 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P25, since it is in the coding region for the corresponding transcript.

Segment cluster Z19129_node__88 (SEQ ID NO:4529) according to the present invention can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T30 (SEQ ID NO:4469) and Z19129_T31 (SEQ ID NO:4470). Table 3922 below describes the starting and ending position of this segment on each transcript.

TABLE 3922

Segment location on transcripts

| Transcript name | Segment starting position | Segment ending position |
|---|---|---|
| Z19129_T4 (SEQ ID NO: 4462) | 4967 | 4985 |
| Z19129_T7 (SEQ ID NO: 4463) | 2484 | 2502 |
| Z19129_T19 (SEQ ID NO: 4464) | 697 | 715 |
| Z19129_T22 (SEQ ID NO: 4465) | 439 | 457 |
| Z19129_T30 (SEQ ID NO: 4469) | 4666 | 4684 |
| Z19129_T31 (SEQ ID NO: 4470) | 4666 | 4684 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P25, since it is in the coding region for the corresponding transcript.

Segment cluster Z19129_node__98 (SEQ ID NO:4530) according to the present invention is supported by 65 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464) and Z19129_T22 (SEQ ID NO:4465). Table 3923 below describes the starting and ending position of this segment on each transcript.

TABLE 3923

Segment location on transcripts

| Transcript name | Segment starting position | Segment ending position |
|---|---|---|
| Z19129_T4 (SEQ ID NO: 4462) | 5475 | 5550 |
| Z19129_T7 (SEQ ID NO: 4463) | 2992 | 3067 |
| Z19129_T19 (SEQ ID NO: 4464) | 1205 | 1280 |
| Z19129_T22 (SEQ ID NO: 4465) | 947 | 1022 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16 and Z19129_P18, since it is in the coding region for the corresponding transcript.

Segment cluster Z19129_node__102 (SEQ ID NO:4531) according to the present invention is supported by 88 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3924 below describes the starting and ending position of this segment on each transcript.

TABLE 3924

Segment location on transcripts

| Transcript name | Segment starting position | Segment ending position |
|---|---|---|
| Z19129_T4 (SEQ ID NO: 4462) | 5691 | 5739 |
| Z19129_T7 (SEQ ID NO: 4463) | 3208 | 3256 |
| Z19129_T19 (SEQ ID NO: 4464) | 1421 | 1469 |
| Z19129_T22 (SEQ ID NO: 4465) | 1163 | 1211 |
| Z19129_T26 (SEQ ID NO: 4466) | 475 | 523 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__106 (SEQ ID NO:4532) according to the present invention is supported by 81 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3925 below describes the starting and ending position of this segment on each transcript.

TABLE 3925

Segment location on transcripts

| Transcript name | Segment starting position | Segment ending position |
| --- | --- | --- |
| Z19129_T4 (SEQ ID NO: 4462) | 5878 | 5961 |
| Z19129_T7 (SEQ ID NO: 4463) | 3395 | 3478 |
| Z19129_T19 (SEQ ID NO: 4464) | 1608 | 1691 |
| Z19129_T22 (SEQ ID NO: 4465) | 1350 | 1433 |
| Z19129_T26 (SEQ ID NO: 4466) | 662 | 745 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__108 (SEQ ID NO:4533) according to the present invention is supported by 91 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3926 below describes the starting and ending position of this segment on each transcript.

TABLE 3926

Segment location on transcripts

| Transcript name | Segment starting position | Segment ending position |
| --- | --- | --- |
| Z19129_T4 (SEQ ID NO: 4462) | 5962 | 6027 |
| Z19129_T7 (SEQ ID NO: 4463) | 3479 | 3544 |
| Z19129_T19 (SEQ ID NO: 4464) | 1692 | 1757 |
| Z19129_T22 (SEQ ID NO: 4465) | 1434 | 1499 |
| Z19129_T26 (SEQ ID NO: 4466) | 746 | 811 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__109 (SEQ ID NO:4534) according to the present invention is supported by 91 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3927 below describes the starting and ending position of this segment on each transcript.

TABLE 3927

Segment location on transcripts

| Transcript name | Segment starting position | Segment ending position |
| --- | --- | --- |
| Z19129_T4 (SEQ ID NO: 4462) | 6028 | 6081 |
| Z19129_T7 (SEQ ID NO: 4463) | 3545 | 3598 |
| Z19129_T19 (SEQ ID NO: 4464) | 1758 | 1811 |

TABLE 3927-continued

Segment location on transcripts

| Transcript name | Segment starting position | Segment ending position |
| --- | --- | --- |
| Z19129_T22 (SEQ ID NO: 4465) | 1500 | 1553 |
| Z19129_T26 (SEQ ID NO: 4466) | 812 | 865 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__110 (SEQ ID NO:4535) according to the present invention is supported by 93 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465) and Z19129_T26 (SEQ ID NO:4466). Table 3928 below describes the starting and ending position of this segment on each transcript.

TABLE 3928

Segment location on transcripts

| Transcript name | Segment starting position | Segment ending position |
| --- | --- | --- |
| Z19129_T4 (SEQ ID NO: 4462) | 6082 | 6121 |
| Z19129_T7 (SEQ ID NO: 4463) | 3599 | 3638 |
| Z19129_T19 (SEQ ID NO: 4464) | 1812 | 1851 |
| Z19129_T22 (SEQ ID NO: 4465) | 1554 | 1593 |
| Z19129_T26 (SEQ ID NO: 4466) | 866 | 905 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18 and Z19129_P22, since it is in the coding region for the corresponding transcript.

Segment cluster Z19129_node__118 (SEQ ID NO:4536) according to the present invention is supported by 107 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3929 below describes the starting and ending position of this segment on each transcript.

TABLE 3929

Segment location on transcripts

| Transcript name | Segment starting position | Segment ending position |
| --- | --- | --- |
| Z19129_T4 (SEQ ID NO: 4462) | 6274 | 6345 |
| Z19129_T7 (SEQ ID NO: 4463) | 3791 | 3862 |
| Z19129_T19 (SEQ ID NO: 4464) | 2004 | 2075 |
| Z19129_T22 (SEQ ID NO: 4465) | 1746 | 1817 |

TABLE 3929-continued

Segment location on transcripts

| Transcript name | Segment starting position | Segment ending position |
|---|---|---|
| Z19129_T26 (SEQ ID NO: 4466) | 1058 | 1129 |
| Z19129_T28 (SEQ ID NO: 4467) | 1674 | 1745 |
| Z19129_T29 (SEQ ID NO: 4468) | 1834 | 1905 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node__119 (SEQ ID NO:4537) according to the present invention can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3930 below describes the starting and ending position of this segment on each transcript.

TABLE 3930

Segment location on transcripts

| Transcript name | Segment starting position | Segment ending position |
|---|---|---|
| Z19129_T4 (SEQ ID NO: 4462) | 6346 | 6356 |
| Z19129_T7 (SEQ ID NO: 4463) | 3863 | 3873 |
| Z19129_T19 (SEQ ID NO: 4464) | 2076 | 2086 |
| Z19129_T22 (SEQ ID NO: 4465) | 1818 | 1828 |
| Z19129_T26 (SEQ ID NO: 4466) | 1130 | 1140 |
| Z19129_T28 (SEQ ID NO: 4467) | 1746 | 1756 |
| Z19129_T29 (SEQ ID NO: 4468) | 1906 | 1916 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node__120 (SEQ ID NO:4538) according to the present invention is supported by 111 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3931 below describes the starting and ending position of this segment on each transcript.

TABLE 3931

Segment location on transcripts

| Transcript name | Segment starting position | Segment ending position |
|---|---|---|
| Z19129_T4 (SEQ ID NO: 4462) | 6357 | 6393 |
| Z19129_T7 (SEQ ID NO: 4463) | 3874 | 3910 |
| Z19129_T19 (SEQ ID NO: 4464) | 2087 | 2123 |
| Z19129_T22 (SEQ ID NO: 4465) | 1829 | 1865 |
| Z19129_T26 (SEQ ID NO: 4466) | 1141 | 1177 |
| Z19129_T28 (SEQ ID NO: 4467) | 1757 | 1793 |
| Z19129_T29 (SEQ ID NO: 4468) | 1917 | 1953 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node__121 (SEQ ID NO:4539) according to the present invention is supported by 124 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3932 below describes the starting and ending position of this segment on each transcript.

TABLE 3932

Segment location on transcripts

| Transcript name | Segment starting position | Segment ending position |
|---|---|---|
| Z19129_T4 (SEQ ID NO: 4462) | 6394 | 6460 |
| Z19129_T7 (SEQ ID NO: 4463) | 3911 | 3977 |
| Z19129_T19 (SEQ ID NO: 4464) | 2124 | 2190 |
| Z19129_T22 (SEQ ID NO: 4465) | 1866 | 1932 |
| Z19129_T26 (SEQ ID NO: 4466) | 1178 | 1244 |
| Z19129_T28 (SEQ ID NO: 4467) | 1794 | 1860 |
| Z19129_T29 (SEQ ID NO: 4468) | 1954 | 2020 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node__122 (SEQ ID NO:4540) according to the present invention is supported by 139 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3933 below describes the starting and ending position of this segment on each transcript.

TABLE 3933

| Segment location on transcripts | | |
|---|---|---|
| Transcript name | Segment starting position | Segment ending position |
| Z19129_T4 (SEQ ID NO: 4462) | 6461 | 6510 |
| Z19129_T7 (SEQ ID NO: 4463) | 3978 | 4027 |
| Z19129_T19 (SEQ ID NO: 4464) | 2191 | 2240 |
| Z19129_T22 (SEQ ID NO: 4465) | 1933 | 1982 |
| Z19129_T26 (SEQ ID NO: 4466) | 1245 | 1294 |
| Z19129_T28 (SEQ ID NO: 4467) | 1861 | 1910 |
| Z19129_T29 (SEQ ID NO: 4468) | 2021 | 2070 |

This segment can be found in both coding and non-coding regions of transcript(s) as follows. The segment can be found in a non-coding region of transcript(s) that are related to the following protein(s): Z19129_P3. This segment can also be found in the following protein(s): Z19129_P6, Z19129_P16, Z19129_P18, Z19129_P22 and Z19129_P24, since it is in the coding region for the corresponding transcript.

Segment cluster Z19129_node_124 (SEQ ID NO:4541) according to the present invention is supported by 161 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3934 below describes the starting and ending position of this segment on each transcript.

TABLE 3934

| Segment location on transcripts | | |
|---|---|---|
| Transcript name | Segment starting position | Segment ending position |
| Z19129_T4 (SEQ ID NO: 4462) | 6709 | 6823 |
| Z19129_T7 (SEQ ID NO: 4463) | 4226 | 4340 |
| Z19129_T19 (SEQ ID NO: 4464) | 2439 | 2553 |
| Z19129_T22 (SEQ ID NO: 4465) | 2181 | 2295 |
| Z19129_T26 (SEQ ID NO: 4466) | 1493 | 1607 |
| Z19129_T28 (SEQ ID NO: 4467) | 2109 | 2223 |
| Z19129_T29 (SEQ ID NO: 4468) | 2269 | 2383 |

This segment can be found in a non-coding region of transcript(s) that are related to the following protein(s): Z19129_P3, Z19129_P6, Z19129_P16, Z19129_P18, Z19129_P22 and Z19129_P24.

Segment cluster Z19129_node_125 (SEQ ID NO:4542) according to the present invention is supported by 132 libraries. The number of libraries was determined as previously described. This segment can be found in the following transcript(s): Z19129_T4 (SEQ ID NO:4462), Z19129_T7 (SEQ ID NO:4463), Z19129_T19 (SEQ ID NO:4464), Z19129_T22 (SEQ ID NO:4465), Z19129_T26 (SEQ ID NO:4466), Z19129_T28 (SEQ ID NO:4467) and Z19129_T29 (SEQ ID NO:4468). Table 3935 below describes the starting and ending position of this segment on each transcript.

TABLE 3935

| Segment location on transcripts | | |
|---|---|---|
| Transcript name | Segment starting position | Segment ending position |
| Z19129_T4 (SEQ ID NO: 4462) | 6824 | 6877 |
| Z19129_T7 (SEQ ID NO: 4463) | 4341 | 4394 |
| Z19129_T19 (SEQ ID NO: 4464) | 2554 | 2607 |
| Z19129_T22 (SEQ ID NO: 4465) | 2296 | 2349 |
| Z19129_T26 (SEQ ID NO: 4466) | 1608 | 1661 |
| Z19129_T28 (SEQ ID NO: 4467) | 2224 | 2277 |
| Z19129_T29 (SEQ ID NO: 4468) | 2384 | 2437 |

This segment can be found in a non-coding region of transcript(s) that are related to the following protein(s): Z19129_P3, Z19129_P6, Z19129_P16, Z19129_P18, Z19129_P22 and Z19129_P24.

Description for Cluster Z19214

Cluster Z19214 features 19 transcript(s) and 53 segment(s) of interest, the names for which are given in Tables 3936 and 3937, respectively, the sequences themselves are given at the end of the application. The selected protein variants are given in Table 3938.

TABLE 3936

| Transcripts of interest<br>Transcript Name |
|---|
| Z19214_T35 (SEQ ID NO: 4543) |
| Z19214_T43 (SEQ ID NO: 4544) |
| Z19214_T44 (SEQ ID NO: 4545) |
| Z19214_T46 (SEQ ID NO: 4546) |
| Z19214_T49 (SEQ ID NO: 4547) |
| Z19214_T50 (SEQ ID NO: 4548) |
| Z19214_T51 (SEQ ID NO: 4549) |
| Z19214_T52 (SEQ ID NO: 4550) |
| Z19214_T53 (SEQ ID NO: 4551) |
| Z19214_T54 (SEQ ID NO: 4552) |
| Z19214_T55 (SEQ ID NO: 4553) |
| Z19214_T56 (SEQ ID NO: 4554) |
| Z19214_T57 (SEQ ID NO: 4555) |
| Z19214_T58 (SEQ ID NO: 4556) |
| Z19214_T59 (SEQ ID NO: 4557) |
| Z19214_T60 (SEQ ID NO: 4558) |
| Z19214_T63 (SEQ ID NO: 4559) |
| Z19214_T66 (SEQ ID NO: 4560) |
| Z19214_T68 (SEQ ID NO: 4561) |

TABLE 3937

| Segments of interest<br>Segment Name |
|---|
| Z19214_node_1 (SEQ ID NO: 4562) |
| Z19214_node_4 (SEQ ID NO: 4563) |
| Z19214_node_6 (SEQ ID NO: 4564) |
| Z19214_node_8 (SEQ ID NO: 4565) |
| Z19214_node_13 (SEQ ID NO: 4566) |
| Z19214_node_15 (SEQ ID NO: 4567) |
| Z19214_node_17 (SEQ ID NO: 4568) |
| Z19214_node_19 (SEQ ID NO: 4569) |
| Z19214_node_21 (SEQ ID NO: 4570) |
| Z19214_node_23 (SEQ ID NO: 4571) |
| Z19214_node_25 (SEQ ID NO: 4572) |
| Z19214_node_28 (SEQ ID NO: 4573) |
| Z19214_node_34 (SEQ ID NO: 4574) |
| Z19214_node_55 (SEQ ID NO: 4575) |
| Z19214_node_59 (SEQ ID NO: 4576) |
| Z19214_node_61 (SEQ ID NO: 4577) |
| Z19214_node_66 (SEQ ID NO: 4578) |
| Z19214_node_70 (SEQ ID NO: 4579) |

TABLE 3937-continued

Segments of interest

Segment Name

Z19214_node_75 (SEQ ID NO: 4580)
Z19214_node_77 (SEQ ID NO: 4581)
Z19214_node_84 (SEQ ID NO: 4582)
Z19214_node_86 (SEQ ID NO: 4583)
Z19214_node_92 (SEQ ID NO: 4584)
Z19214_node_93 (SEQ ID NO: 4585)
Z19214_node_0 (SEQ ID NO: 4586)
Z19214_node_2 (SEQ ID NO: 4587)
Z19214_node_10 (SEQ ID NO: 4588)
Z19214_node_14 (SEQ ID NO: 4589)
Z19214_node_20 (SEQ ID NO: 4590)
Z19214_node_24 (SEQ ID NO: 4591)
Z19214_node_30 (SEQ ID NO: 4592)
Z19214_node_32 (SEQ ID NO: 4593)
Z19214_node_37 (SEQ ID NO: 4594)
Z19214_node_39 (SEQ ID NO: 4595)
Z19214_node_41 (SEQ ID NO: 4596)
Z19214_node_43 (SEQ ID NO: 4597)
Z19214_node_45 (SEQ ID NO: 4598)
Z19214_node_49 (SEQ ID NO: 4599)
Z19214_node_50 (SEQ ID NO: 4600)
Z19214_node_52 (SEQ ID NO: 4601)
Z19214_node_56 (SEQ ID NO: 4602)
Z19214_node_57 (SEQ ID NO: 4603)
Z19214_node_58 (SEQ ID NO: 4604)
Z19214_node_60 (SEQ ID NO: 4605)
Z19214_node_63 (SEQ ID NO: 4606)
Z19214_node_68 (SEQ ID NO: 4607)
Z19214_node_72 (SEQ ID NO: 4608)
719214_node_79 (SEQ ID NO: 4609)
Z19214_node_80 (SEQ ID NO: 4610)
719214_node_82 (SEQ ID NO: 4611)
Z19214_node_88 (SEQ ID NO: 4612)
Z19214_node_89 (SEQ ID NO: 4613)
Z19214_node_90 (SEQ ID NO: 4614)

TABLE 3938

Proteins of interest

| Protein Name | Corresponding Transcript(s) |
|---|---|
| Z19214_P31 | Z19214_T35 (SEQ ID NO: 4543) |
| Z19214_P36 | Z19214_T43 (SEQ ID NO: 4544) |
| Z19214_P37 | Z19214_T44 (SEQ ID NO: 4545) |
| Z19214_P39 | Z19214_T46 (SEQ ID NO: 4546) |
| Z19214_P42 | Z19214_T49 (SEQ ID NO: 4547); |
|  | Z19214_T50 (SEQ ID NO: 4548); |
|  | Z19214_T51 (SEQ ID NO: 4549); |
|  | Z19214_T52 (SEQ ID NO: 4550) |
| Z19214_P43 | Z19214_T53 (SEQ ID NO: 4551) |
| Z19214_P44 | Z19214_T54 (SEQ ID NO: 4552) |
| Z19214_P45 | Z19214_T55 (SEQ ID NO: 4553) |
| Z19214_P46 | Z19214_T56 (SEQ ID NO: 4554) |
| Z19214_P47 | Z19214_T57 (SEQ ID NO: 4555) |
| Z19214_P48 | Z19214_T59 (SEQ ID NO: 4557) |
| Z19214_P49 | Z19214_T60 (SEQ ID NO: 4558) |
| Z19214_P51 | Z19214_T63 (SEQ ID NO: 4559) |

These sequences are variants of the known protein Aspartyl/asparaginyl beta-hydroxylase (SwissProt accession identifier ASPH_HUMAN; known also according to the synonyms EC 1.14.11.16; Aspartate beta-hydroxylase; ASP beta-hydroxylase; Peptide-aspartate beta-dioxygenase), referred to herein as the previously known protein.

Protein Aspartyl/asparaginyl beta-hydroxylase is known or believed to have the following function(s): Specifically hydroxylates an Asp or Asn residue in certain epidermal growth factor-like (EGF) domains of a number of proteins. The sequence for protein Aspartyl/asparaginyl beta-hydroxylase is given at the end of the application, as "Aspartyl/aspar- aginyl beta-hydroxylase amino acid sequence". Protein Aspartyl/asparaginyl beta-hydroxylase localization is believed to be Type II membrane protein. Endoplasmic reticulum.

The following GO Annotation(s) apply to the previously known protein. The following annotation(s) were found: muscle contraction, which are annotation(s) related to Biological Process; peptide-aspartate beta-dioxygenase; electron transporter; calcium binding; structural protein of muscle, which are annotation(s) related to Molecular Function; and endoplasmic reticulum membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z19214 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 98 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 98 and Table 3939. This cluster is overexpressed (at least at a minimum level) in the following pathological conditions: colorectal cancer, kidney malignant tumors, prostate cancer and uterine malignancies.

TABLE 3939

Normal tissue distribution

| Name of Tissue | Number |
|---|---|
| adrenal | 448 |
| bladder | 123 |
| bone | 297 |
| brain | 165 |
| colon | 31 |
| epithelial | 114 |
| general | 129 |
| head and neck | 0 |
| kidney | 29 |
| liver | 43 |
| lung | 151 |
| lymph nodes | 32 |
| breast | 237 |
| bone marrow | 125 |
| muscle | 251 |
| ovary | 0 |
| pancreas | 156 |
| prostate | 2 |
| skin | 251 |
| stomach | 109 |
| Thyroid | 0 |
| uterus | 13 |

TABLE 3940

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 9.6e−01 | 0.4 | 9.3e−01 | 0.5 |
| bladder | 7.2e−01 | 6.2e−01 | 8.8e−01 | 0.6 | 3.0e−01 | 1.2 |
| bone | 3.9e−01 | 9.1e−02 | 9.2e−01 | 0.5 | 4.6e−01 | 0.9 |
| brain | 7.3e−01 | 7.6e−01 | 9.9e−01 | 0.4 | 9.9e−01 | 0.4 |
| colon | 1.3e−02 | 2.4e−02 | 3.8e−03 | 4.4 | 1.6e−02 | 3.5 |

TABLE 3940-continued

P values and ratios for expression in cancerous tissue

| Name of Tissue | P1 | P2 | SP1 | R3 | SP2 | R4 |
|---|---|---|---|---|---|---|
| epithelial | 1.8e−01 | 5.4e−02 | 8.5e−02 | 1.2 | 9.7e−04 | 1.4 |
| general | 4.3e−01 | 9.0e−02 | 7.8e−01 | 0.9 | 4.1e−02 | 1.1 |
| head and neck | 4.3e−01 | 2.8e−01 | 1 | 1.0 | 7.5e−01 | 1.3 |
| kidney | 2.1e−01 | 2.0e−01 | 9.0e−03 | 3.1 | 3.1e−04 | 3.3 |
| liver | 7.5e−01 | 5.0e−01 | 1 | 0.5 | 3.3e−01 | 1.2 |
| lung | 7.1e−01 | 7.6e−01 | 8.9e−01 | 0.7 | 3.6e−01 | 0.7 |
| lymph nodes | 4.5e−01 | 8.3e−01 | 4.9e−01 | 1.5 | 8.2e−01 | 0.7 |
| breast | 6.9e−01 | 7.2e−01 | 6.9e−01 | 0.9 | 9.3e−01 | 0.6 |
| bone marrow | 8.6e−01 | 7.2e−01 | 1 | 0.2 | 8.2e−01 | 0.7 |
| muscle | 5.0e−01 | 5.7e−01 | 8.9e−01 | 0.5 | 1 | 0.2 |
| ovary | 1.3e−01 | 1.6e−01 | 2.2e−01 | 2.9 | 3.4e−01 | 2.2 |
| pancreas | 6.0e−01 | 5.0e−01 | 8.3e−01 | 0.5 | 7.4e−01 | 0.7 |
| prostate | 7.5e−01 | 6.1e−01 | 6.1e−01 | 4.0 | 4.2e−04 | 7.0 |
| skin | 5.6e−01 | 6.3e−01 | 8.0e−01 | 0.7 | 9.9e−01 | 0.3 |
| stomach | 5.8e−01 | 5.2e−01 | 3.7e−01 | 0.7 | 6.2e−03 | 2.3 |
| Thyroid | 2.9e−01 | 2.9e−01 | 1 | 1.3 | 1 | 1.3 |
| uterus | 1.5e−02 | 8.7e−03 | 7.1e−03 | 3.9 | 1.5e−02 | 3.2 |

As noted above, cluster Z19214 features 53 segment(s), which were listed in Table 3937 above and for which the sequence(s) are given at the end of the application. These segment(s) are portions of nucleic acid sequence(s) which are described herein separately because they are of particular interest. A description of each segment according to the present invention is now provided.

Segment cluster Z19214_node_1 (SEQ ID NO:4562) according to the present invention is supported by 76 libraries. The number of libraries was determined as previously described. This segment can be found in the following transcript(s): Z19214_T43 (SEQ ID NO:4544), Z19214_T44 (SEQ ID NO:4545), Z19214_T46 (SEQ ID NO:4546), Z19214_T53 (SEQ ID NO:4551), Z19214_T55 (SEQ ID NO:4553), Z19214_T56 (SEQ ID NO:4554), Z19214_T57 (SEQ ID NO:4555), Z19214_T60 (SEQ ID NO:4558) and Z19214_T63 (SEQ ID NO:4559). Table 3941 below describes the starting and ending position of this segment on each transcript.

TABLE 3941

Segment location on transcripts

| Transcript name | Segment starting position | Segment ending position |
|---|---|---|
| Z19214_T43 (SEQ ID NO: 4544) | 61 | 334 |
| Z19214_T44 (SEQ ID NO: 4545) | 61 | 334 |
| Z19214_T46 (SEQ ID NO: 4546) | 61 | 334 |
| Z19214_T53 (SEQ ID NO: 4551) | 61 | 334 |
| Z19214_T55 (SEQ ID NO: 4553) | 61 | 334 |
| Z19214_T56 (SEQ ID NO: 4554) | 61 | 334 |
| Z19214_T57 (SEQ ID NO: 4555) | 61 | 334 |
| Z19214_T60 (SEQ ID NO: 4558) | 61 | 334 |
| Z19214_T63 (SEQ ID NO: 4559) | 61 | 334 |

This segment can be found in the following protein(s): Z19214_P36, Z19214_P37, Z19214_P39, Z19214_P43, Z19214_P45, Z19214_P46, Z19214_P47, Z19214_P49 and Z19214_P51.

Segment cluster Z19214_node_4 (SEQ ID NO:4563) according to the present invention is supported by 25 libraries. The number of libraries was determined as previously described. This segment can be found in the following transcript(s): Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T54 (SEQ ID NO:4552) and Z19214_T68 (SEQ ID NO:4561). Table 3942 below describes the starting and ending position of this segment on each transcript.

TABLE 3942

Segment location on transcripts

| Transcript name | Segment starting position | Segment ending position |
|---|---|---|
| Z19214_T49 (SEQ ID NO: 4547) | 1 | 143 |
| Z19214_T50 (SEQ ID NO: 4548) | 1 | 143 |
| Z19214_T51 (SEQ ID NO: 4549) | 1 | 143 |
| Z19214_T52 (SEQ ID NO: 4550) | 1 | 143 |
| Z19214_T54 (SEQ ID NO: 4552) | 1 | 143 |
| Z19214_T68 (SEQ ID NO: 4561) | 1 | 143 |

This segment can be found in the following protein(s): Z19214_P42 and Z19214_P44.

Segment cluster Z19214_node_6 (SEQ ID NO:4564) according to the present invention is supported by 1 libraries. The number of libraries was determined as previously described. This segment can be found in the following transcript(s): Z19214_T68 (SEQ ID NO:4561). Table 3943 below describes the starting and ending position of this segment on each transcript.

TABLE 3943

Segment location on transcripts

| Transcript name | Segment starting position | Segment ending position |
|---|---|---|
| Z19214_T68 (SEQ ID NO: 4561) | 144 | 429 |

The previously-described transcripts for these segment(s) do not code for protein.

Segment cluster Z19214_node_8 (SEQ ID NO:4565) according to the present invention is supported by 110 libraries. The number of libraries was determined as previously described. This segment can be found in the following transcript(s): Z19214_T43 (SEQ ID NO:4544), Z19214_T44 (SEQ ID NO:4545), Z19214_T46 (SEQ ID NO:4546), Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T53 (SEQ ID NO:4551), Z19214_T54 (SEQ ID NO:4552) Z19214_T55 (SEQ ID NO:4553), Z19214_T56 (SEQ ID NO:4554), Z19214_T57 (SEQ ID NO:4555), Z19214_T60 (SEQ ID NO:4558) and Z19214_T63 (SEQ ID NO:4559). Table 3944 below describes the starting and ending position of this segment on each transcript.

TABLE 3944

Segment location on transcripts

| Transcript name | Segment starting position | Segment ending position |
|---|---|---|
| Z19214_T43 (SEQ ID NO: 4544) | 377 | 526 |
| Z19214_T44 (SEQ ID NO: 4545) | 377 | 526 |
| Z19214_T46 (SEQ ID NO: 4546) | 377 | 526 |
| Z19214_T49 (SEQ ID NO: 4547) | 144 | 293 |
| Z19214_T50 (SEQ ID NO: 4548) | 144 | 293 |
| Z19214_T51 (SEQ ID NO: 4549) | 144 | 293 |
| Z19214_T52 (SEQ ID NO: 4550) | 144 | 293 |
| Z19214_T53 (SEQ ID NO: 4551) | 377 | 526 |
| Z19214_T54 (SEQ ID NO: 4552) | 144 | 293 |
| Z19214_T55 (SEQ ID NO: 4553) | 377 | 526 |

TABLE 3944-continued

| Transcript name | Segment starting position | Segment ending position |
|---|---|---|
| Z19214_T56 (SEQ ID NO: 4554) | 377 | 526 |
| Z19214_T57 (SEQ ID NO: 4555) | 377 | 526 |
| Z19214_T60 (SEQ ID NO: 4558) | 377 | 526 |
| Z19214_T63 (SEQ ID NO: 4559) | 377 | 526 |

This segment can be found in the following protein(s): Z19214_P36, Z19214_P37, Z19214_P39, Z19214_P42, Z19214_P43, Z19214_P44, Z19214_P45, Z19214_P46, Z19214_P47, Z19214_P49 and Z19214_P51.

Segment cluster Z19214_node_13 (SEQ ID NO:4566) according to the present invention is supported by 1 libraries. The number of libraries was determined as previously described. This segment can be found in the following transcript(s): Z19214_T35 (SEQ ID NO:4543). Table 3945 below describes the starting and ending position of this segment on each transcript.

TABLE 3945

| Transcript name | Segment starting position | Segment ending position |
|---|---|---|
| Z19214_T35 (SEQ ID NO: 4543) | 1 | 271 |

This segment can be found in a non-coding region of transcript(s) that are related to the following protein(s): Z19214_P31.

Segment cluster Z19214_node_15 (SEQ ID NO:4567) according to the present invention is supported by 7 libraries. The number of libraries was determined as previously described. This segment can be found in the following transcript(s): Z19214_T60 (SEQ ID NO:4558). Table 3946 below describes the starting and ending position of this segment on each transcript.

TABLE 3946

| Transcript name | Segment starting position | Segment ending position |
|---|---|---|
| Z19214_T60 (SEQ ID NO: 4558) | 596 | 1583 |

This segment can be found in the following protein(s): Z19214_P49.

Segment cluster Z19214_node_17 (SEQ ID NO:4568) according to the present invention is supported by 30 libraries. The number of libraries was determined as previously described. This segment can be found in the following transcript(s): Z19214_T53 (SEQ ID NO:4551). Table 3947 below describes the starting and ending position of this segment on each transcript.

TABLE 3947

| Transcript name | Segment starting position | Segment ending position |
|---|---|---|
| Z19214_T53 (SEQ ID NO: 4551) | 641 | 1700 |

This segment can be found in the following protein(s): Z19214_P43.

Segment cluster Z19214_node_19 (SEQ ID NO:4569) according to the present invention is supported by 5 libraries. The number of libraries was determined as previously described. This segment can be found in the following transcript(s): Z19214_T59 (SEQ ID NO:4557) and Z19214_T66 (SEQ ID NO:4560). Table 3948 below describes the starting and ending position of this segment on each transcript.

TABLE 3948

| Transcript name | Segment starting position | Segment ending position |
|---|---|---|
| Z19214_T59 (SEQ ID NO: 4557) | 1 | 743 |
| Z19214_T66 (SEQ ID NO: 4560) | 1 | 743 |

This segment can be found in the following protein(s): Z19214_P48.

Segment cluster Z19214_node_21 (SEQ ID NO:4570) according to the present invention is supported by 4 libraries. The number of libraries was determined as previously described. This segment can be found in the following transcript(s): Z19214_T63 (SEQ ID NO:4559) and Z19214_T66 (SEQ ID NO:4560). Table 3949 below describes the starting and ending position of this segment on each transcript.

TABLE 3949

| Transcript name | Segment starting position | Segment ending position |
|---|---|---|
| Z19214_T63 (SEQ ID NO: 4559) | 638 | 1347 |
| Z19214_T66 (SEQ ID NO: 4560) | 786 | 1495 |

This segment can be found in the following protein(s): Z19214_P51.

Segment cluster Z19214_node_23 (SEQ ID NO:4571) according to the present invention is supported by 3 libraries. The number of libraries was determined as previously described. This segment can be found in the following transcript(s): Z19214_T58 (SEQ ID NO:4556). Table 3950 below describes the starting and ending position of this segment on each transcript.

TABLE 3950

| Transcript name | Segment starting position | Segment ending position |
|---|---|---|
| Z19214_T58 (SEQ ID NO: 4556) | 1 | 1030 |

The previously-described transcripts for these segment(s) do not code for protein.

Segment cluster Z19214_node__25 (SEQ ID NO:4572) according to the present invention is supported by 36 libraries. The number of libraries was determined as previously described. This segment can be found in the following transcript(s): Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T54 (SEQ ID NO:4552), Z19214_T55 (SEQ ID NO:4553), Z19214_T58 (SEQ ID NO:4556) and Z19214_T59 (SEQ ID NO:4557). Table 3951 below describes the starting and ending position of this segment on each transcript.

TABLE 3951

Segment location on transcripts

| Transcript name | Segment starting position | Segment ending position |
|---|---|---|
| Z19214_T49 (SEQ ID NO: 4547) | 411 | 3191 |
| Z19214_T50 (SEQ ID NO: 4548) | 411 | 3451 |
| Z19214_T51 (SEQ ID NO: 4549) | 411 | 916 |
| Z19214_T52 (SEQ ID NO: 4550) | 411 | 2090 |
| Z19214_T54 (SEQ ID NO: 4552) | 456 | 3236 |
| Z19214_T55 (SEQ ID NO: 4553) | 683 | 3463 |
| Z19214_T58 (SEQ ID NO: 4556) | 1037 | 3817 |
| Z19214_T59 (SEQ ID NO: 4557) | 792 | 3572 |

This segment can be found in the following protein(s): Z19214_P42, Z19214_P44, Z19214_P45 and Z19214_P48.

Segment cluster Z19214_node__28 (SEQ ID NO:4573) according to the present invention is supported by 32 libraries. The number of libraries was determined as previously described. This segment can be found in the following transcript(s): Z19214_T56 (SEQ ID NO:4554) and Z19214_T57 (SEQ ID NO:4555). Table 3952 below describes the starting and ending position of this segment on each transcript.

TABLE 3952

Segment location on transcripts

| Transcript name | Segment starting position | Segment ending position |
|---|---|---|
| Z19214_T56 (SEQ ID NO: 4554) | 596 | 3799 |
| Z19214_T57 (SEQ ID NO: 4555) | 641 | 3844 |

This segment can be found in the following protein(s): Z19214_P46 and Z19214_P47.

Segment cluster Z19214_node__34 (SEQ ID NO:4574) according to the present invention is supported by 77 libraries. The number of libraries was determined as previously described. This segment can be found in the following transcript(s): Z19214_T43 (SEQ ID NO:4544), Z19214_T44 (SEQ ID NO:4545) and Z19214_T46 (SEQ ID NO:4546). Table 3953 below describes the starting and ending position of this segment on each transcript.

TABLE 3953

Segment location on transcripts

| Transcript name | Segment starting position | Segment ending position |
|---|---|---|
| Z19214_T43 (SEQ ID NO: 4544) | 764 | 892 |
| Z19214_T44 (SEQ ID NO: 4545) | 764 | 892 |
| Z19214_T46 (SEQ ID NO: 4546) | 764 | 892 |

This segment can be found in the following protein(s): Z19214_P36, Z19214_P37 and Z19214_P39.

Segment cluster Z19214_node__55 (SEQ ID NO:4575) according to the present invention is supported by 118 libraries. The number of libraries was determined as previously described. This segment can be found in the following transcript(s): Z19214_T35 (SEQ ID NO:4543). Table 3954 below describes the starting and ending position of this segment on each transcript.

TABLE 3954

Segment location on transcripts

| Transcript name | Segment starting position | Segment ending position |
|---|---|---|
| Z19214_T35 (SEQ ID NO: 4543) | 824 | 1391 |

This segment can be found in the following protein(s): Z19214_P31.

Segment cluster Z19214_node__59 (SEQ ID NO:4576) according to the present invention is supported by 105 libraries. The number of libraries was determined as previously described. This segment can be found in the following transcript(s): Z19214_T35 (SEQ ID NO:4543). Table 3955 below describes the starting and ending position of this segment on each transcript.

TABLE 3955

Segment location on transcripts

| Transcript name | Segment starting position | Segment ending position |
|---|---|---|
| Z19214_T35 (SEQ ID NO: 4543) | 1465 | 1798 |

This segment can be found in a non-coding region of transcript(s) that are related to the following protein(s): Z19214_P31.

Segment cluster Z19214_node__61 (SEQ ID NO:4577) according to the present invention is supported by 199 libraries. The number of libraries was determined as previously described. This segment can be found in the following transcript(s): Z19214_T35 (SEQ ID NO:4543). Table 3956 below describes the starting and ending position of this segment on each transcript.

TABLE 3956

Segment location on transcripts

| Transcript name | Segment starting position | Segment ending position |
|---|---|---|
| Z19214_T35 (SEQ ID NO: 4543) | 1879 | 2566 |

This segment can be found in a non-coding region of transcript(s) that are related to the following protein(s): Z19214_P31.

Segment cluster Z19214_node__66 (SEQ ID NO:4578) according to the present invention is supported by 18 libraries. The number of libraries was determined as previously described. This segment can be found in the following transcript(s): Z19214_T44 (SEQ ID NO:4545). Table 3957 below describes the starting and ending position of this segment on each transcript.

TABLE 3957

Segment location on transcripts

| Transcript name | Segment starting position | Segment ending position |
|---|---|---|
| Z19214_T44 (SEQ ID NO: 4545) | 1250 | 2121 |

This segment can be found in the following protein(s): Z19214_P37.

Segment cluster Z19214_node_70 (SEQ ID NO:4579) according to the present invention is supported by 1 libraries. The number of libraries was determined as previously described. This segment can be found in the following transcript(s): Z19214_T46 (SEQ ID NO:4546). Table 3958 below describes the starting and ending position of this segment on each transcript.

TABLE 3958

Segment location on transcripts

| Transcript name | Segment starting position | Segment ending position |
|---|---|---|
| Z19214_T46 (SEQ ID NO: 4546) | 1336 | 1872 |

This segment can be found in the following protein(s): Z19214_P39.

Segment cluster Z19214_node_75 (SEQ ID NO:4580) according to the present invention is supported by 26 libraries. The number of libraries was determined as previously described. This segment can be found in the following transcript(s): Z19214_T43 (SEQ ID NO:4544). Table 3959 below describes the starting and ending position of this segment on each transcript.

TABLE 3959

Segment location on transcripts

| Transcript name | Segment starting position | Segment ending position |
|---|---|---|
| Z19214_T43 (SEQ ID NO: 4544) | 1423 | 1573 |

This segment can be found in the following protein(s): Z19214_P36.

Segment cluster Z19214_node_77 (SEQ ID NO:4581) according to the present invention is supported by 28 libraries. The number of libraries was determined as previously described. This segment can be found in the following transcript(s): Z19214_T43 (SEQ ID NO:4544). Table 3960 below describes the starting and ending position of this segment on each transcript.

TABLE 3960

Segment location on transcripts

| Transcript name | Segment starting position | Segment ending position |
|---|---|---|
| Z19214_T43 (SEQ ID NO: 4544) | 1574 | 1710 |

This segment can be found in the following protein(s): Z19214_P36.

Segment cluster Z19214_node_84 (SEQ ID NO:4582) according to the present invention is supported by 36 libraries. The number of libraries was determined as previously described. This segment can be found in the following transcript(s): Z19214_T43 (SEQ ID NO:4544). Table 3961 below describes the starting and ending position of this segment on each transcript.

TABLE 3961

Segment location on transcripts

| Transcript name | Segment starting position | Segment ending position |
|---|---|---|
| Z19214_T43 (SEQ ID NO: 4544) | 1900 | 2037 |

This segment can be found in the following protein(s): Z19214_P36.

Segment cluster Z19214_node_86 (SEQ ID NO:4583) according to the present invention is supported by 36 libraries. The number of libraries was determined as previously described. This segment can be found in the following transcript(s): Z19214_T43 (SEQ ID NO:4544). Table 3962 below describes the starting and ending position of this segment on each transcript.

TABLE 3962

Segment location on transcripts

| Transcript name | Segment starting position | Segment ending position |
|---|---|---|
| Z19214_T43 (SEQ ID NO: 4544) | 2038 | 2173 |

This segment can be found in the following protein(s): Z19214_P36.

Segment cluster Z19214_node_92 (SEQ ID NO:4584) according to the present invention is supported by 29 libraries. The number of libraries was determined as previously described. This segment can be found in the following transcript(s): Z19214_T43 (SEQ ID NO:4544). Table 3963 below describes the starting and ending position of this segment on each transcript.

TABLE 3963

Segment location on transcripts

| Transcript name | Segment starting position | Segment ending position |
|---|---|---|
| Z19214_T43 (SEQ ID NO: 4544) | 2266 | 2399 |

This segment can be found in the following protein(s): Z19214_P36.

Segment cluster Z19214_node_93 (SEQ ID NO:4585) according to the present invention is supported by 1 libraries. The number of libraries was determined as previously described. This segment can be found in the following transcript(s): Z19214_T43 (SEQ ID NO:4544). Table 3964 below describes the starting and ending position of this segment on each transcript.

TABLE 3964

Segment location on transcripts

| Transcript name | Segment starting position | Segment ending position |
|---|---|---|
| Z19214_T43 (SEQ ID NO: 4544) | 2400 | 2914 |

This segment can be found in the following protein(s): Z19214_P36.

According to an optional embodiment of the present invention, short segments related to the above cluster are also provided. These segments are up to about 120 bp in length, and so are included in a separate description.

Segment cluster Z19214_node_0 (SEQ ID NO:4586) according to the present invention is supported by 6 libraries. The number of libraries was determined as previously described. This segment can be found in the following transcript(s): Z19214_T43 (SEQ ID NO:4544), Z19214_T44 (SEQ ID NO:4545), Z19214_T46 (SEQ ID NO:4546), Z19214_T53 (SEQ ID NO:4551), Z19214_T55 (SEQ ID NO:4553), Z19214_T56 (SEQ ID NO:4554), Z19214_T57 (SEQ ID NO:4555), Z19214_T60 (SEQ ID NO:4558) and Z19214_T63 (SEQ ID NO:4559). Table 3965 below describes the starting and ending position of this segment on each transcript.

TABLE 3965

Segment location on transcripts

| Transcript name | Segment starting position | Segment ending position |
|---|---|---|
| Z19214_T43 (SEQ ID NO: 4544) | 1 | 60 |
| Z19214_T44 (SEQ ID NO: 4545) | 1 | 60 |
| Z19214_T46 (SEQ ID NO: 4546) | 1 | 60 |
| Z19214_T53 (SEQ ID NO: 4551) | 1 | 60 |
| Z19214_T55 (SEQ ID NO: 4553) | 1 | 60 |
| Z19214_T56 (SEQ ID NO: 4554) | 1 | 60 |
| Z19214_T57 (SEQ ID NO: 4555) | 1 | 60 |
| Z19214_T60 (SEQ ID NO: 4558) | 1 | 60 |
| Z19214_T63 (SEQ ID NO: 4559) | 1 | 60 |

This segment can be found in a non-coding region of transcript(s) that are related to the following protein(s): Z19214_P36, Z19214_P37, Z19214_P39, Z19214_P43, Z19214_P45, Z19214_P46, Z19214_P47, Z19214_P49 and Z19214_P51.

Segment cluster Z19214_node_2 (SEQ ID NO:4587) according to the present invention is supported by 66 libraries. The number of libraries was determined as previously described. This segment can be found in the following transcript(s): Z19214_T43 (SEQ ID NO:4544), Z19214_T44 (SEQ ID NO:4545), Z19214_T46 (SEQ ID NO:4546), Z19214_T53 (SEQ ID NO:4551), Z19214_T55 (SEQ ID NO:4553), Z19214_T56 (SEQ ID NO:4554), Z19214_T57 (SEQ ID NO:4555), Z19214_T60 (SEQ ID NO:4558) and Z19214_T63 (SEQ ID NO:4559). Table 3966 below describes the starting and ending position of this segment on each transcript.

TABLE 3966

Segment location on transcripts

| Transcript name | Segment starting position | Segment ending position |
|---|---|---|
| Z19214_T43 (SEQ ID NO: 4544) | 335 | 376 |
| Z19214_T44 (SEQ ID NO: 4545) | 335 | 376 |
| Z19214_T46 (SEQ ID NO: 4546) | 335 | 376 |
| Z19214_T53 (SEQ ID NO: 4551) | 335 | 376 |
| Z19214_T55 (SEQ ID NO: 4553) | 335 | 376 |
| Z19214_T56 (SEQ ID NO: 4554) | 335 | 376 |
| Z19214_T57 (SEQ ID NO: 4555) | 335 | 376 |
| Z19214_T60 (SEQ ID NO: 4558) | 335 | 376 |
| Z19214_T63 (SEQ ID NO: 4559) | 335 | 376 |

This segment can be found in the following protein(s): Z19214_P36, Z19214_P37, Z19214_P39, Z19214_P43, Z19214_P45, Z19214_P46, Z19214_P47, Z19214_P49 and Z19214_P51.

Segment cluster Z19214_node_10 (SEQ ID NO:4588) according to the present invention is supported by 23 libraries. The number of libraries was determined as previously described. This segment can be found in the following transcript(s): Z19214_T53 (SEQ ID NO:4551), Z19214_T54 (SEQ ID NO:4552), Z19214_T55 (SEQ ID NO:4553) and Z19214_T57 (SEQ ID NO:4555). Table 3967 below describes the starting and ending position of this segment on each transcript.

TABLE 3967

Segment location on transcripts

| Transcript name | Segment starting position | Segment ending position |
|---|---|---|
| Z19214_T53 (SEQ ID NO: 4551) | 527 | 571 |
| Z19214_T54 (SEQ ID NO: 4552) | 294 | 338 |
| Z19214_T55 (SEQ ID NO: 4553) | 527 | 571 |
| Z19214_T57 (SEQ ID NO: 4555) | 527 | 571 |

This segment can be found in the following protein(s): Z19214_P43, Z19214_P44, Z19214_P45 and Z19214_P47.

Segment cluster Z19214_node_14 (SEQ ID NO:4589) according to the present invention is supported by 105 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545), Z19214_T46 (SEQ ID NO:4546), Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T53 (SEQ ID NO:4551), Z19214_T54 (SEQ ID NO:4552), Z19214_T55 (SEQ ID NO:4553), Z19214_T56 (SEQ ID NO:4554), Z19214_T57 (SEQ ID NO:4555), Z19214_T60 (SEQ ID NO:4558) and Z19214_T63 (SEQ ID NO:4559). Table 3968 below describes the starting and ending position of this segment on each transcript.

TABLE 3968

Segment location on transcripts

| Transcript name | Segment starting position | Segment ending position |
|---|---|---|
| Z19214_T35 (SEQ ID NO: 4543) | 272 | 340 |
| Z19214_T43 (SEQ ID NO: 4544) | 527 | 595 |
| Z19214_T44 (SEQ ID NO: 4545) | 527 | 595 |

TABLE 3968-continued

Segment location on transcripts

| Transcript name | Segment starting position | Segment ending position |
|---|---|---|
| Z19214_T46 (SEQ ID NO: 4546) | 527 | 595 |
| Z19214_T49 (SEQ ID NO: 4547) | 294 | 362 |
| Z19214_T50 (SEQ ID NO: 4548) | 294 | 362 |
| Z19214_T51 (SEQ ID NO: 4549) | 294 | 362 |
| Z19214_T52 (SEQ ID NO: 4550) | 294 | 362 |
| Z19214_T53 (SEQ ID NO: 4551) | 572 | 640 |
| Z19214_T54 (SEQ ID NO: 4552) | 339 | 407 |
| Z19214_T55 (SEQ ID NO: 4553) | 572 | 640 |
| Z19214_T56 (SEQ ID NO: 4554) | 527 | 595 |
| Z19214_T57 (SEQ ID NO: 4555) | 572 | 640 |
| Z19214_T60 (SEQ ID NO: 4558) | 527 | 595 |
| Z19214_T63 (SEQ ID NO: 4559) | 527 | 595 |

This segment can be found in both coding and non-coding regions of transcript(s) as follows. The segment can be found in a non-coding region of transcript(s) that are related to the following protein(s): Z19214_P31. This segment can also be found in the following protein(s): Z19214_P36, Z19214_P37, Z19214_P39, Z19214_P42, Z19214_P43, Z19214_P44, Z19214_P45, Z19214_P46, Z19214_P47, Z19214_P49 and Z19214_P51, since it is in the coding region for the corresponding transcript.

Segment cluster Z19214_node_20 (SEQ ID NO:4590) according to the present invention is supported by 7 libraries. The number of libraries was determined as previously described. This segment can be found in the following transcript(s): Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T54 (SEQ ID NO:4552), Z19214_T55 (SEQ ID NO:4553), Z19214_T59 (SEQ ID NO:4557), Z19214_T63 (SEQ ID NO:4559) and Z19214_T66 (SEQ ID NO:4560). Table 3969 below describes the starting and ending position of this segment on each transcript.

TABLE 3969

Segment location on transcripts

| Transcript name | Segment starting position | Segment ending position |
|---|---|---|
| Z19214_T49 (SEQ ID NO: 4547) | 363 | 404 |
| Z19214_T50 (SEQ ID NO: 4548) | 363 | 404 |
| Z19214_T51 (SEQ ID NO: 4549) | 363 | 404 |
| Z19214_T52 (SEQ ID NO: 4550) | 363 | 404 |
| Z19214_T54 (SEQ ID NO: 4552) | 408 | 449 |
| Z19214_T55 (SEQ ID NO: 4553) | 641 | 682 |
| Z19214_T59 (SEQ ID NO: 4557) | 744 | 785 |
| Z19214_T63 (SEQ ID NO: 4559) | 596 | 637 |
| Z19214_T66 (SEQ ID NO: 4560) | 744 | 785 |

This segment can be found in the following protein(s): Z19214_P42, Z19214_P44, Z19214_P45, Z19214_P48 and Z19214_P51.

Segment cluster Z19214_node_24 (SEQ ID NO:4591) according to the present invention can be found in the following transcript(s): Z19214_T49 (SEQ ID NO:4547), Z19214_T50 (SEQ ID NO:4548), Z19214_T51 (SEQ ID NO:4549), Z19214_T52 (SEQ ID NO:4550), Z19214_T54 (SEQ ID NO:4552), Z19214_T58 (SEQ ID NO:4556) and Z19214_T59 (SEQ ID NO:4557). Table 3970 below describes the starting and ending position of this segment on each transcript.

TABLE 3970

Segment location on transcripts

| Transcript name | Segment starting position | Segment ending position |
|---|---|---|
| Z19214_T49 (SEQ ID NO: 4547) | 405 | 410 |
| Z19214_T50 (SEQ ID NO: 4548) | 405 | 410 |
| Z19214_T51 (SEQ ID NO: 4549) | 405 | 410 |
| Z19214_T52 (SEQ ID NO: 4550) | 405 | 410 |
| Z19214_T54 (SEQ ID NO: 4552) | 450 | 455 |
| Z19214_T58 (SEQ ID NO: 4556) | 1031 | 1036 |
| Z19214_T59 (SEQ ID NO: 4557) | 786 | 791 |

This segment can be found in the following protein(s): Z19214_P42, Z19214_P44 and Z19214_P48.

Segment cluster Z19214_node_30 (SEQ ID NO:4592) according to the present invention is supported by 86 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3971 below describes the starting and ending position of this segment on each transcript.

TABLE 3971

Segment location on transcripts

| Transcript name | Segment starting position | Segment ending position |
|---|---|---|
| Z19214_T35 (SEQ ID NO: 4543) | 341 | 433 |
| Z19214_T43 (SEQ ID NO: 4544) | 596 | 688 |
| Z19214_T44 (SEQ ID NO: 4545) | 596 | 688 |
| Z19214_T46 (SEQ ID NO: 4546) | 596 | 688 |

This segment can be found in both coding and non-coding regions of transcript(s) as follows. The segment can be found in a non-coding region of transcript(s) that are related to the following protein(s): Z19214_P31. This segment can also be found in the following protein(s): Z19214_P36, Z19214_P37 and Z19214_P39, since it is in the coding region for the corresponding transcript.

Segment cluster Z19214_node_32 (SEQ ID NO:4593) according to the present invention is supported by 93 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3972 below describes the starting and ending position of this segment on each transcript.

TABLE 3972

Segment location on transcripts

| Transcript name | Segment starting position | Segment ending position |
|---|---|---|
| Z19214_T35 (SEQ ID NO: 4543) | 434 | 508 |
| Z19214_T43 (SEQ ID NO: 4544) | 689 | 763 |
| Z19214_T44 (SEQ ID NO: 4545) | 689 | 763 |
| Z19214_T46 (SEQ ID NO: 4546) | 689 | 763 |

This segment can be found in the following protein(s): Z19214_P31, Z19214_P36, Z19214_P37 and Z19214_P39.

Segment cluster Z19214_node_37 (SEQ ID NO:4594) according to the present invention is supported by 82 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3973 below describes the starting and ending position of this segment on each transcript.

TABLE 3973

Segment location on transcripts

| Transcript name | Segment starting position | Segment ending position |
|---|---|---|
| Z19214_T35 (SEQ ID NO: 4543) | 509 | 541 |
| Z19214_T43 (SEQ ID NO: 4544) | 893 | 925 |
| Z19214_T44 (SEQ ID NO: 4545) | 893 | 925 |
| Z19214_T46 (SEQ ID NO: 4546) | 893 | 925 |

This segment can be found in the following protein(s): Z19214_P31, Z19214_P36, Z19214_P37 and Z19214_P39.

Segment cluster Z19214_node_39 (SEQ ID NO:4595) according to the present invention is supported by 69 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3974 below describes the starting and ending position of this segment on each transcript.

TABLE 3974

Segment location on transcripts

| Transcript name | Segment starting position | Segment ending position |
|---|---|---|
| Z19214_T35 (SEQ ID NO: 4543) | 542 | 598 |
| Z19214_T43 (SEQ ID NO: 4544) | 926 | 982 |
| Z19214_T44 (SEQ ID NO: 4545) | 926 | 982 |
| Z19214_T46 (SEQ ID NO: 4546) | 926 | 982 |

This segment can be found in the following protein(s): Z19214_P31, Z19214_P36, Z19214_P37 and Z19214_P39.

Segment cluster Z19214_node_41 (SEQ ID NO:4596) according to the present invention is supported by 76 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3975 below describes the starting and ending position of this segment on each transcript.

TABLE 3975

Segment location on transcripts

| Transcript name | Segment starting position | Segment ending position |
|---|---|---|
| Z19214_T35 (SEQ ID NO: 4543) | 599 | 646 |
| Z19214_T43 (SEQ ID NO: 4544) | 983 | 1030 |
| Z19214_T44 (SEQ ID NO: 4545) | 983 | 1030 |
| Z19214_T46 (SEQ ID NO: 4546) | 983 | 1030 |

This segment can be found in the following protein(s): Z19214_P31, Z19214_P36, Z19214_P37 and Z19214_P39.

Segment cluster Z19214_node_43 (SEQ ID NO:4597) according to the present invention is supported by 79 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3976 below describes the starting and ending position of this segment on each transcript.

TABLE 3976

Segment location on transcripts

| Transcript name | Segment starting position | Segment ending position |
|---|---|---|
| Z19214_T35 (SEQ ID NO: 4543) | 647 | 679 |
| Z19214_T43 (SEQ ID NO: 4544) | 1031 | 1063 |
| Z19214_T44 (SEQ ID NO: 4545) | 1031 | 1063 |
| Z19214_T46 (SEQ ID NO: 4546) | 1031 | 1063 |

This segment can be found in the following protein(s): Z19214_P31, Z19214_P36, Z19214_P37 and Z19214_P39.

Segment cluster Z19214_node_45 (SEQ ID NO:4598) according to the present invention is supported by 83 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3977 below describes the starting and ending position of this segment on each transcript.

TABLE 3977

Segment location on transcripts

| Transcript name | Segment starting position | Segment ending position |
|---|---|---|
| Z19214_T35 (SEQ ID NO: 4543) | 680 | 721 |
| Z19214_T43 (SEQ ID NO: 4544) | 1064 | 1105 |
| Z19214_T44 (SEQ ID NO: 4545) | 1064 | 1105 |
| Z19214_T46 (SEQ ID NO: 4546) | 1064 | 1105 |

This segment can be found in the following protein(s): Z19214_P31, Z19214_P36, Z19214_P37 and Z19214_P39.

Segment cluster Z19214_node_49 (SEQ ID NO:4599) according to the present invention is supported by 81 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3978 below describes the starting and ending position of this segment on each transcript.

TABLE 3978

Segment location on transcripts

| Transcript name | Segment starting position | Segment ending position |
|---|---|---|
| Z19214_T35 (SEQ ID NO: 4543) | 722 | 765 |
| Z19214_T43 (SEQ ID NO: 4544) | 1106 | 1149 |
| Z19214_T44 (SEQ ID NO: 4545) | 1106 | 1149 |
| Z19214_T46 (SEQ ID NO: 4546) | 1106 | 1149 |

This segment can be found in the following protein(s): Z19214_P31, Z19214_P36, Z19214_P37 and Z19214_P39.

Segment cluster Z19214_node_50 (SEQ ID NO:4600) according to the present invention can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3979 below describes the starting and ending position of this segment on each transcript.

TABLE 3979

Segment location on transcripts

| Transcript name | Segment starting position | Segment ending position |
|---|---|---|
| Z19214_T35 (SEQ ID NO: 4543) | 766 | 778 |
| Z19214_T43 (SEQ ID NO: 4544) | 1150 | 1162 |
| Z19214_T44 (SEQ ID NO: 4545) | 1150 | 1162 |
| Z19214_T46 (SEQ ID NO: 4546) | 1150 | 1162 |

This segment can be found in the following protein(s): Z19214_P31, Z19214_P36, Z19214_P37 and Z19214_P39.

Segment cluster Z19214_node_52 (SEQ ID NO:4601) according to the present invention is supported by 81 libraries. The number of libraries was determined as previously described. This segment can be found in the following transcript(s): Z19214_T35 (SEQ ID NO:4543), Z19214_T43 (SEQ ID NO:4544), Z19214_T44 (SEQ ID NO:4545) and Z19214_T46 (SEQ ID NO:4546). Table 3980 below describes the starting and ending position of this segment on each transcript.

TABLE 3980

Segment location on transcripts

| Transcript name | Segment starting position | Segment ending position |
|---|---|---|
| Z19214_T35 (SEQ ID NO: 4543) | 779 | 823 |
| Z19214_T43 (SEQ ID NO: 4544) | 1163 | 1207 |
| Z19214_T44 (SEQ ID NO: 4545) | 1163 | 1207 |
| Z19214_T46 (SEQ ID NO: 4546) | 1163 | 1207 |

This segment can be found in the following protein(s): Z19214_P31, Z19214_P36, Z19214_P37 and Z19214_P39.

Segment cluster Z19214_node_56 (SEQ ID NO:4602) according to the present invention can be found in the following transcript(s): Z19214_T35 (SEQ ID NO:4543). Table 3981 below describes the starting and ending position of this segment on each transcript.

TABLE 3981

Segment location on transcripts

| Transcript name | Segment starting position | Segment ending position |
|---|---|---|
| Z19214_T35 (SEQ ID NO: 4543) | 1392 | 1416 |

This segment can be found in a non-coding region of transcript(s) that are related to the following protein(s): Z19214_P31.

Segment cluster Z19214_node_57 (SEQ ID NO:4603) according to the present invention is supported by 67 libraries. The number of libraries was determined as previously described. This segment can be found in the following transcript(s): Z19214_T35 (SEQ ID NO:4543). Table 3982 below describes the starting and ending position of this segment on each transcript.

TABLE 3982

Segment location on transcripts

| Transcript name | Segment starting position | Segment ending position |
|---|---|---|
| Z19214_T35 (SEQ ID NO: 4543) | 1417 | 1448 |

This segment can be found in a non-coding region of transcript(s) that are related to the following protein(s): Z19214_P31.

Segment cluster Z19214_node_58 (SEQ ID NO:4604) according to the present invention can be found in the following transcript(s): Z19214_T35 (SEQ ID NO:4543). Table 3983 below describes the starting and ending position of this segment on each transcript.

TABLE 3983

Segment location on transcripts

| Transcript name | Segment starting position | Segment ending position |
|---|---|---|
| Z19214_T35 (SEQ ID NO: 4543) | 1449 | 1464 |

This segment can be found in a non-coding region of transcript(s) that are related to the following protein(s): Z19214_P31.

Segment cluster Z19214_node_60 (SEQ ID NO:4605) according to the present invention is supported by 88 libraries. The number of libraries was determined as previously described. This segment can be found in the following transcript(s): Z19214_T35 (SEQ ID NO:4543). Table 3984 below describes the starting and ending position of this segment on each transcript.

TABLE 3984

Segment location on transcripts

| Transcript name | Segment starting position | Segment ending position |
|---|---|---|
| Z19214_T35 (SEQ ID NO: 4543) | 1799 | 1878 |

This segment can be found in a non-coding region of transcript(s) that are related to the following protein(s): Z19214_P31.

Segment cluster Z19214_node_63 (SEQ ID NO:4606) according to the present invention is supported by 29 libraries. The number of libraries was determined as previously described. This segment can be found in the following transcript(s): Z19214_T43 (SEQ ID NO:4544), Z19214_T44 (SEQ ID NO:4545) and Z19214_T46 (SEQ ID NO:4546). Table 3985 below describes the starting and ending position of this segment on each transcript.

TABLE 3985

Segment location on transcripts

| Transcript name | Segment starting position | Segment ending position |
|---|---|---|
| Z19214_T43 (SEQ ID NO: 4544) | 1208 | 1249 |
| Z19214_T44 (SEQ ID NO: 4545) | 1208 | 1249 |
| Z19214_T46 (SEQ ID NO: 4546) | 1208 | 1249 |

This segment can be found in the following protein(s): Z19214_P36, Z19214_P37 and Z19214_P39.

Segment cluster Z19214_node_68 (SEQ ID NO:4607) according to the present invention is supported by 28 libraries. The number of libraries was determined as previously described. This segment can be found in the following transcript(s): Z19214_T43 (SEQ ID NO:4544) and Z19214_T46 (SEQ ID NO:4546). Table 3986 below describes the starting and ending position of this segment on each transcript.

TABLE 3986

Segment location on transcripts

| Transcript name | Segment starting position | Segment ending position |
|---|---|---|
| Z19214_T43 (SEQ ID NO: 4544) | 1250 | 1335 |
| Z19214_T46 (SEQ ID NO: 4546) | 1250 | 1335 |

This segment can be found in the following protein(s): Z19214_P36 and Z19214_P39.

Segment cluster Z19214_node_72 (SEQ ID NO:4608) according to the present invention is supported by 23 libraries. The number of libraries was determined as previously described. This segment can be found in the following transcript(s): Z19214_T43 (SEQ ID NO:4544). Table 3987 below describes the starting and ending position of this segment on each transcript.

TABLE 3987

Segment location on transcripts

| Transcript name | Segment starting position | Segment ending position |
|---|---|---|
| Z19214_T43 (SEQ ID NO: 4544) | 1336 | 1422 |

This segment can be found in the following protein(s): Z19214_P36.

Segment cluster Z19214_node_79 (SEQ ID NO:4609) according to the present invention is supported by 27 libraries. The number of libraries was determined as previously described. This segment can be found in the following transcript(s): Z19214_T43 (SEQ ID NO:4544). Table 3988 below describes the starting and ending position of this segment on each transcript.

TABLE 3988

Segment location on transcripts

| Transcript name | Segment starting position | Segment ending position |
|---|---|---|
| Z19214_T43 (SEQ ID NO: 4544) | 1711 | 1786 |

This segment can be found in the following protein(s): Z19214_P36.

Segment cluster Z19214_node_80 (SEQ ID NO:4610) according to the present invention can be found in the following transcript(s): Z19214_T43 (SEQ ID NO:4544). Table 3989 below describes the starting and ending position of this segment on each transcript.

TABLE 3989

Segment location on transcripts

| Transcript name | Segment starting position | Segment ending position |
|---|---|---|
| Z19214_T43 (SEQ ID NO: 4544) | 1787 | 1809 |

This segment can be found in the following protein(s): Z19214_P36.

Segment cluster Z19214_node_82 (SEQ ID NO:4611) according to the present invention is supported by 29 libraries. The number of libraries was determined as previously described. This segment can be found in the following transcript(s): Z19214_T43 (SEQ ID NO:4544). Table 3990 below describes the starting and ending position of this segment on each transcript.

TABLE 3990

Segment location on transcripts

| Transcript name | Segment starting position | Segment ending position |
|---|---|---|
| Z19214_T43 (SEQ ID NO: 4544) | 1810 | 1899 |

This segment can be found in the following protein(s): Z19214_P36.

Segment cluster Z19214_node_88 (SEQ ID NO:4612) according to the present invention is supported by 30 libraries. The number of libraries was determined as previously described. This segment can be found in the following transcript(s): Z19214_T43 (SEQ ID NO:4544). Table 3991 below describes the starting and ending position of this segment on each transcript.

TABLE 3991

Segment location on transcripts

| Transcript name | Segment starting position | Segment ending position |
|---|---|---|
| Z19214_T43 (SEQ ID NO: 4544) | 2174 | 2236 |

This segment can be found in the following protein(s): Z19214_P36.

Segment cluster Z19214_node_89 (SEQ ID NO:4613) according to the present invention can be found in the following transcript(s): Z19214_T43 (SEQ ID NO:4544). Table 3992 below describes the starting and ending position of this segment on each transcript.

TABLE 3992

| Segment location on transcripts | | |
|---|---|---|
| Transcript name | Segment starting position | Segment ending position |
| Z19214_T43 (SEQ ID NO: 4544) | 2237 | 2255 |

This segment can be found in the following protein(s): Z19214_P36.

Segment cluster Z19214_node_90 (SEQ ID NO:4614) according to the present invention can be found in the following transcript(s): Z19214_T43 (SEQ ID NO:4544). Table 3993 below describes the starting and ending position of this segment on each transcript.

TABLE 3993

| Segment location on transcripts | | |
|---|---|---|
| Transcript name | Segment starting position | Segment ending position |
| Z19214_T43 (SEQ ID NO: 4544) | 2256 | 2265 |

This segment can be found in the following protein(s): Z19214_P36.

Description for Cluster Z21997

Cluster Z21997 features 11 transcript(s) and 44 segment(s) of interest, the names for which are given in Tables 3994 and 3995, respectively, the sequences themselves are given at the end of the application. The selected protein variants are given in Table 3996.

TABLE 3994

Transcripts of interest
Transcript Name

Z21997_T3 (SEQ ID NO: 4615)
Z21997_T21 (SEQ ID NO: 4616)
Z21997_T23 (SEQ ID NO: 4617)
Z21997_T24 (SEQ ID NO: 4618)
Z21997_T26 (SEQ ID NO: 4619)
Z21997_T28 (SEQ ID NO: 4620)
Z21997_T32 (SEQ ID NO: 4621)
Z21997_T33 (SEQ ID NO: 4622)
Z21997_T34 (SEQ ID NO: 4623)
Z21997_T35 (SEQ ID NO: 4624)
Z21997_T38 (SEQ ID NO: 4625)

TABLE 3995

Segments of interest
Segment Name

Z21997_node_1 (SEQ ID NO: 4626)
Z21997_node_5 (SEQ ID NO: 4627)
Z21997_node_11 (SEQ ID NO: 4628)
Z21997_node_12 (SEQ ID NO: 4629)
Z21997_node_13 (SEQ ID NO: 4630)
Z21997_node_31 (SEQ ID NO: 4631)
Z21997_node_35 (SEQ ID NO: 4632)
Z21997_node_36 (SEQ ID NO: 4633)
Z21997_node_37 (SEQ ID NO: 4634)
Z21997_node_43 (SEQ ID NO: 4635)
Z21997_node_44 (SEQ ID NO: 4636)
Z21997_node_53 (SEQ ID NO: 4637)
Z21997_node_56 (SEQ ID NO: 4638)
Z21997_node_0 (SEQ ID NO: 4639)

TABLE 3995-continued

Segments of interest
Segment Name

Z21997_node_2 (SEQ ID NO: 4640)
Z21997_node_3 (SEQ ID NO: 4641)
Z21997_node_4 (SEQ ID NO: 4642)
Z21997_node_6 (SEQ ID NO: 4643)
Z21997_node_16 (SEQ ID NO: 4644)
Z21997_node_17 (SEQ ID NO: 4645)
Z21997_node_18 (SEQ ID NO: 4646)
Z21997_node_19 (SEQ ID NO: 4647)
Z21997_node_21 (SEQ ID NO: 4648)
Z21997_node_22 (SEQ ID NO: 4649)
Z21997_node_23 (SEQ ID NO: 4650)
Z21997_node_24 (SEQ ID NO: 4651)
Z21997_node_27 (SEQ ID NO: 4652)
Z21997_node_30 (SEQ ID NO: 4653)
Z21997_node_32 (SEQ ID NO: 4654)
Z21997_node_33 (SEQ ID NO: 4655)
Z21997_node_34 (SEQ ID NO: 4656)
Z21997_node_38 (SEQ ID NO: 4657)
Z21997_node_39 (SEQ ID NO: 4658)
Z21997_node_40 (SEQ ID NO: 4659)
Z21997_node_41 (SEQ ID NO: 4660)
Z21997_node_42 (SEQ ID NO: 4661)
Z21997_node_45 (SEQ ID NO: 4662)
Z21997_node_46 (SEQ ID NO: 4663)
Z21997_node_47 (SEQ ID NO: 4664)
Z21997_node_48 (SEQ ID NO: 4665)
Z21997_node_49 (SEQ ID NO: 4666)
Z21997_node_51 (SEQ ID NO: 4667)
Z21997_node_54 (SEQ ID NO: 4668)
Z21997_node_55 (SEQ ID NO: 4669)

TABLE 3996

| Proteins of interest | |
|---|---|
| Protein Name | Corresponding Transcript(s) |
| Z21997_P2 | Z21997_T3 (SEQ ID NO: 4615) |
| Z21997_P5 | Z21997_T21 (SEQ ID NO: 4616) |
| Z21997_P11 | Z21997_T23 (SEQ ID NO: 4617); Z21997_T28 (SEQ ID NO: 4620) |
| Z21997_P12 | Z21997_T24 (SEQ ID NO: 4618); Z21997_T32 (SEQ ID NO: 4621) |
| Z21997_P13 | Z21997_T35 (SEQ ID NO: 4624) |
| Z21997_P14 | Z21997_T26 (SEQ ID NO: 4619) |
| Z21997_P19 | Z21997_T33 (SEQ ID NO: 4622); Z21997_T34 (SEQ ID NO: 4623) |
| Z21997_P21 | Z21997_T38 (SEQ ID NO: 4625) |

Cluster Z21997 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 99 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 99 and Table 3997. This cluster is overexpressed (at least at a minimum level) in the following pathological conditions: brain malignant tumors, epithelial malignant tumors, a mixture of malignant tumors from different tissues, lung malignant tumors, breast malignant tumors, myosarcoma, pancreas carcinoma, skin malignancies and uterine malignancies.

TABLE 3997

Normal tissue distribution

| Name of Tissue | Number |
|---|---|
| adrenal | 40 |
| bladder | 41 |
| bone | 226 |
| brain | 32 |
| colon | 104 |
| epithelial | 89 |
| general | 57 |
| head and neck | 0 |
| kidney | 107 |
| liver | 0 |
| lung | 57 |
| lymph nodes | 54 |
| breast | 8 |
| bone marrow | 0 |
| muscle | 0 |
| ovary | 182 |
| pancreas | 24 |
| prostate | 64 |
| skin | 112 |
| stomach | 73 |
| Thyroid | 0 |
| uterus | 40 |

TABLE 3998

P values and ratios for expression in cancerous tissue

| Name of Tissue | P1 | P2 | SP1 | R3 | SP2 | R4 |
|---|---|---|---|---|---|---|
| adrenal | 1.5e−01 | 2.1e−01 | 5.2e−03 | 2.9 | 1.9e−02 | 2.2 |
| bladder | 5.4e−01 | 4.5e−01 | 6.0e−01 | 1.3 | 2.2e−01 | 1.4 |
| bone | 2.3e−01 | 8.6e−02 | 9.8e−01 | 0.3 | 9.7e−01 | 0.5 |
| brain | 2.3e−01 | 1.9e−01 | 5.8e−02 | 2.3 | 8.7e−23 | 6.8 |
| colon | 3.2e−01 | 3.6e−01 | 2.9e−01 | 1.3 | 7.9e−04 | 1.4 |
| epithelial | 1.2e−02 | 1.1e−04 | 4.3e−01 | 1.0 | 1.8e−60 | 5.1 |
| general | 1.3e−05 | 1.2e−09 | 3.1e−04 | 1.5 | 2.9e−138 | 6.5 |
| head and neck | 4.3e−01 | 2.8e−01 | 1 | 1.0 | 3.2e−07 | 1.7 |
| kidney | 6.6e−01 | 5.2e−01 | 5.9e−01 | 1.0 | 1.3e−04 | 1.3 |
| liver | 1.8e−01 | 1.2e−01 | 2.3e−01 | 4.3 | 2.6e−02 | 3.7 |
| lung | 5.8e−02 | 2.3e−02 | 2.7e−01 | 1.6 | 8.0e−18 | 6.3 |
| lymph nodes | 7.2e−01 | 8.3e−01 | 6.3e−01 | 0.9 | 9.2e−01 | 0.5 |
| breast | 3.5e−01 | 6.4e−02 | 6.9e−01 | 1.4 | 2.7e−04 | 3.9 |
| bone marrow | 1 | 4.2e−01 | 1 | 1.0 | 2.8e−01 | 2.9 |
| muscle | 2.3e−01 | 6.6e−02 | 1.5e−01 | 6.8 | 3.2e−05 | 5.7 |
| ovary | 7.8e−01 | 7.0e−01 | 9.8e−01 | 0.4 | 1.1e−01 | 0.8 |
| pancreas | 3.4e−02 | 4.8e−03 | 3.5e−02 | 2.7 | 1.8e−17 | 5.9 |
| prostate | 8.7e−01 | 8.2e−01 | 9.0e−01 | 0.6 | 2.0e−08 | 0.9 |
| skin | 4.4e−01 | 2.5e−01 | 4.3e−01 | 1.4 | 2.1e−12 | 4.1 |
| stomach | 6.1e−01 | 2.2e−01 | 8.8e−01 | 0.7 | 2.5e−02 | 2.5 |
| Thyroid | 7.1e−02 | 7.1e−02 | 6.7e−01 | 1.7 | 6.7e−01 | 1.7 |
| uterus | 2.4e−01 | 1.1e−01 | 9.9e−02 | 1.6 | 3.8e−08 | 3.4 |

As noted above, cluster Z21997 features 44 segment(s), which were listed in Table 3995 above and for which the sequence(s) are given at the end of the application. These segment(s) are portions of nucleic acid sequence(s) which are described herein separately because they are of particular interest. A description of each segment according to the present invention is now provided.

Segment cluster Z21997_node_1 (SEQ ID NO:4626) according to the present invention is supported by 20 libraries. The number of libraries was determined as previously described. This segment can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 3999 below describes the starting and ending position of this segment on each transcript.

TABLE 3999

Segment location on transcripts

| Transcript name | Segment starting position | Segment ending position |
|---|---|---|
| Z21997_T21 (SEQ ID NO: 4616) | 63 | 249 |
| Z21997_T23 (SEQ ID NO: 4617) | 63 | 249 |
| Z21997_T24 (SEQ ID NO: 4618) | 63 | 249 |
| Z21997_T26 (SEQ ID NO: 4619) | 63 | 249 |
| Z21997_T28 (SEQ ID NO: 4620) | 63 | 249 |
| Z21997_T32 (SEQ ID NO: 4621) | 63 | 249 |
| Z21997_T33 (SEQ ID NO: 4622) | 63 | 249 |
| Z21997_T34 (SEQ ID NO: 4623) | 63 | 249 |
| Z21997_T35 (SEQ ID NO: 4624) | 63 | 249 |
| Z21997_T38 (SEQ ID NO: 4625) | 63 | 249 |

This segment can be found in a non-coding region of transcript(s) that are related to the following protein(s): Z21997_P5, Z21997_P11, Z21997_P12, Z21997_P14, Z21997_P19, Z21997_P13 and Z21997_P21.

Segment cluster Z21997_node_5 (SEQ ID NO:4627) according to the present invention is supported by 32 libraries. The number of libraries was determined as previously described. This segment can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4000 below describes the starting and ending position of this segment on each transcript.

TABLE 4000

Segment location on transcripts

| Transcript name | Segment starting position | Segment ending position |
|---|---|---|
| Z21997_T21 (SEQ ID NO: 4616) | 322 | 465 |
| Z21997_T23 (SEQ ID NO: 4617) | 322 | 465 |
| Z21997_T24 (SEQ ID NO: 4618) | 322 | 465 |
| Z21997_T26 (SEQ ID NO: 4619) | 322 | 465 |
| Z21997_T28 (SEQ ID NO: 4620) | 322 | 465 |
| Z21997_T32 (SEQ ID NO: 4621) | 322 | 465 |
| Z21997_T33 (SEQ ID NO: 4622) | 322 | 465 |
| Z21997_T34 (SEQ ID NO: 4623) | 322 | 465 |
| Z21997_T35 (SEQ ID NO: 4624) | 322 | 465 |
| Z21997_T38 (SEQ ID NO: 4625) | 322 | 465 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P11, Z21997_P12, Z21997_P14, Z21997_P13 and Z21997_P21, since it is in the coding region for the corresponding transcript.

Segment cluster Z21997_node_11 (SEQ ID NO:4628) according to the present invention is supported by 8 libraries. The number of libraries was determined as previously described. This segment can be found in the following transcript(s): Z21997_T3 (SEQ ID NO:4615). Table 4001 below describes the starting and ending position of this segment on each transcript.

TABLE 4001

Segment location on transcripts

| Transcript name | Segment starting position | Segment ending position |
|---|---|---|
| Z21997_T3 (SEQ ID NO: 4615) | 1 | 765 |

This segment can be found in a non-coding region of transcript(s) that are related to the following protein(s): Z21997_P2.

Segment cluster Z21997_node_12 (SEQ ID NO:4629) according to the present invention is supported by 18 libraries. The number of libraries was determined as previously described. This segment can be found in the following transcript(s): Z21997_T3 (SEQ ID NO:4615). Table 4002 below describes the starting and ending position of this segment on each transcript.

TABLE 4002

Segment location on transcripts

| Transcript name | Segment starting position | Segment ending position |
|---|---|---|
| Z21997_T3 (SEQ ID NO: 4615) | 766 | 1599 |

This segment can be found in the following protein(s): Z21997_P2.

Segment cluster Z21997_node_13 (SEQ ID NO:4630) according to the present invention is supported by 64 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4003 below describes the starting and ending position of this segment on each transcript.

TABLE 4003

Segment location on transcripts

| Transcript name | Segment starting position | Segment ending position |
|---|---|---|
| Z21997_T3 (SEQ ID NO: 4615) | 1600 | 1785 |
| Z21997_T21 (SEQ ID NO: 4616) | 500 | 685 |
| Z21997_T23 (SEQ ID NO: 4617) | 500 | 685 |
| Z21997_T24 (SEQ ID NO: 4618) | 500 | 685 |
| Z21997_T26 (SEQ ID NO: 4619) | 500 | 685 |
| Z21997_T28 (SEQ ID NO: 4620) | 500 | 685 |
| Z21997_T32 (SEQ ID NO: 4621) | 500 | 685 |
| Z21997_T33 (SEQ ID NO: 4622) | 500 | 685 |
| Z21997_T34 (SEQ ID NO: 4623) | 500 | 685 |
| Z21997_T35 (SEQ ID NO: 4624) | 500 | 685 |
| Z21997_T38 (SEQ ID NO: 4625) | 500 | 685 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_31 (SEQ ID NO:4631) according to the present invention is supported by 8 libraries. The number of libraries was determined as previously described. This segment can be found in the following transcript(s): Z21997_T21 (SEQ ID NO:4616), Z21997_T33 (SEQ ID NO:4622) and Z21997_T34 (SEQ ID NO:4623). Table 4004 below describes the starting and ending position of this segment on each transcript.

TABLE 4004

Segment location on transcripts

| Transcript name | Segment starting position | Segment ending position |
|---|---|---|
| Z21997_T21 (SEQ ID NO: 4616) | 1122 | 1345 |
| Z21997_T33 (SEQ ID NO: 4622) | 1122 | 1345 |
| Z21997_T34 (SEQ ID NO: 4623) | 1122 | 1345 |

This segment can be found in a non-coding region of transcript(s) that are related to the following protein(s): Z21997_P5 and Z21997_P19.

Segment cluster Z21997_node_35 (SEQ ID NO:4632) according to the present invention is supported by 12 libraries. The number of libraries was determined as previously described. This segment can be found in the following transcript(s): Z21997_T26 (SEQ ID NO:4619), Z21997_T33 (SEQ ID NO:4622), Z21997_T34 (SEQ ID NO:4623) and Z21997_T38 (SEQ ID NO:4625). Table 4005 below describes the starting and ending position of this segment on each transcript.

TABLE 4005

Segment location on transcripts

| Transcript name | Segment starting position | Segment ending position |
|---|---|---|
| Z21997_T26 (SEQ ID NO: 4619) | 1313 | 1629 |
| Z21997_T33 (SEQ ID NO: 4622) | 1537 | 1853 |
| Z21997_T34 (SEQ ID NO: 4623) | 1651 | 1967 |
| Z21997_T38 (SEQ ID NO: 4625) | 1187 | 1503 |

This segment can be found in both coding and non-coding regions of transcript(s) as follows. The segment can be found in a non-coding region of transcript(s) that are related to the following protein(s): Z21997_P19. This segment can also be found in the following protein(s): Z21997_P14 and Z21997_P21, since it is in the coding region for the corresponding transcript.

Segment cluster Z21997_node_36 (SEQ ID NO:4633) according to the present invention is supported by 125 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4006 below describes the starting and ending position of this segment on each transcript.

TABLE 4006

Segment location on transcripts

| Transcript name | Segment starting position | Segment ending position |
|---|---|---|
| Z21997_T3 (SEQ ID NO: 4615) | 2413 | 2543 |
| Z21997_T21 (SEQ ID NO: 4616) | 1537 | 1667 |
| Z21997_T23 (SEQ ID NO: 4617) | 1313 | 1443 |
| Z21997_T24 (SEQ ID NO: 4618) | 1313 | 1443 |
| Z21997_T26 (SEQ ID NO: 4619) | 1630 | 1760 |
| Z21997_T28 (SEQ ID NO: 4620) | 1313 | 1443 |
| Z21997_T32 (SEQ ID NO: 4621) | 1313 | 1443 |
| Z21997_T33 (SEQ ID NO: 4622) | 1854 | 1984 |
| Z21997_T34 (SEQ ID NO: 4623) | 1968 | 2098 |
| Z21997_T35 (SEQ ID NO: 4624) | 1313 | 1443 |
| Z21997_T38 (SEQ ID NO: 4625) | 1504 | 1634 |

This segment can be found in both coding and non-coding regions of transcript(s) as follows. The segment can be found in a non-coding region of transcript(s) that are related to the following protein(s): Z21997_P14 and Z21997_P21. This segment can also be found in the following protein(s): Z21997_P2, Z21997_P5, Z21997_P11, Z21997_P12, Z21997_P19 and Z21997_P13, since it is in the coding region for the corresponding transcript.

Segment cluster Z21997_node_37 (SEQ ID NO:4634) according to the present invention is supported by 4 libraries. The number of libraries was determined as previously described. This segment can be found in the following transcript(s): Z21997_T24 (SEQ ID NO:4618) and Z21997_T32 (SEQ ID NO:4621). Table 4007 below describes the starting and ending position of this segment on each transcript.

TABLE 4007

Segment location on transcripts

| Transcript name | Segment starting position | Segment ending position |
|---|---|---|
| Z21997_T24 (SEQ ID NO: 4618) | 1444 | 1638 |
| Z21997_T32 (SEQ ID NO: 4621) | 1444 | 1638 |

This segment can be found in the following protein(s): Z21997_P12.

Segment cluster Z21997_node_43 (SEQ ID NO:4635) according to the present invention is supported by 108 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4008 below describes the starting and ending position of this segment on each transcript.

TABLE 4008

Segment location on transcripts

| Transcript name | Segment starting position | Segment ending position |
|---|---|---|
| Z21997_T3 (SEQ ID NO: 4615) | 2709 | 2845 |
| Z21997_T21 (SEQ ID NO: 4616) | 1833 | 1969 |
| Z21997_T23 (SEQ ID NO: 4617) | 1609 | 1745 |
| Z21997_T24 (SEQ ID NO: 4618) | 1804 | 1940 |
| Z21997_T26 (SEQ ID NO: 4619) | 1926 | 2062 |
| Z21997_T28 (SEQ ID NO: 4620) | 1609 | 1745 |
| Z21997_T32 (SEQ ID NO: 4621) | 1885 | 2021 |
| Z21997_T33 (SEQ ID NO: 4622) | 2150 | 2286 |
| Z21997_T34 (SEQ ID NO: 4623) | 2264 | 2400 |
| Z21997_T35 (SEQ ID NO: 4624) | 1690 | 1826 |
| Z21997_T38 (SEQ ID NO: 4625) | 1800 | 1936 |

This segment can be found in both coding and non-coding regions of transcript(s) as follows. The segment can be found in a non-coding region of transcript(s) that are related to the following protein(s): Z21997_P12, Z21997_P14, Z21997_P13 and Z21997_P21. This segment can also be found in the following protein(s): Z21997_P2, Z21997_P5, Z21997_P11 and Z21997_P19, since it is in the coding region for the corresponding transcript.

Segment cluster Z21997_node_44 (SEQ ID NO:4636) according to the present invention is supported by 4 libraries. The number of libraries was determined as previously described. This segment can be found in the following transcript(s): Z21997_T23 (SEQ ID NO:4617), Z21997_T28 (SEQ ID NO:4620) and Z21997_T35 (SEQ ID NO:4624). Table 4009 below describes the starting and ending position of this segment on each transcript.

TABLE 4009

Segment location on transcripts

| Transcript name | Segment starting position | Segment ending position |
|---|---|---|
| Z21997_T23 (SEQ ID NO: 4617) | 1746 | 2081 |
| Z21997_T28 (SEQ ID NO: 4620) | 1746 | 2081 |
| Z21997_T35 (SEQ ID NO: 4624) | 1827 | 2162 |

This segment can be found in both coding and non-coding regions of transcript(s) as follows. The segment can be found in a non-coding region of transcript(s) that are related to the following protein(s): Z21997_P13. This segment can also be found in the following protein(s): Z21997_P11, since it is in the coding region for the corresponding transcript.

Segment cluster Z21997_node_53 (SEQ ID NO:4637) according to the present invention is supported by 109 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4010 below describes the starting and ending position of this segment on each transcript.

TABLE 4010

Segment location on transcripts

| Transcript name | Segment starting position | Segment ending position |
| --- | --- | --- |
| Z21997_T3 (SEQ ID NO: 4615) | 3126 | 3295 |
| Z21997_T21 (SEQ ID NO: 4616) | 2250 | 2419 |
| Z21997_T23 (SEQ ID NO: 4617) | 2362 | 2531 |
| Z21997_T24 (SEQ ID NO: 4618) | 2221 | 2390 |
| Z21997_T26 (SEQ ID NO: 4619) | 2343 | 2512 |
| Z21997_T28 (SEQ ID NO: 4620) | 2440 | 2609 |
| Z21997_T32 (SEQ ID NO: 4621) | 2302 | 2471 |
| Z21997_T33 (SEQ ID NO: 4622) | 2567 | 2736 |
| Z21997_T34 (SEQ ID NO: 4623) | 2681 | 2850 |
| Z21997_T35 (SEQ ID NO: 4624) | 2521 | 2690 |
| Z21997_T38 (SEQ ID NO: 4625) | 2217 | 2386 |

This segment can be found in both coding and non-coding regions of transcript(s) as follows. The segment can be found in a non-coding region of transcript(s) that are related to the following protein(s): Z21997_P11, Z21997_P12, Z21997_P14, Z21997_P13 and Z21997_P21. This segment can also be found in the following protein(s): Z21997_P2, Z21997_P5 and Z21997_P19, since it is in the coding region for the corresponding transcript.

Segment cluster Z21997_node_56 (SEQ ID NO:4638) according to the present invention is supported by 90 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4011 below describes the starting and ending position of this segment on each transcript.

TABLE 4011

Segment location on transcripts

| Transcript name | Segment starting position | Segment ending position |
| --- | --- | --- |
| Z21997_T3 (SEQ ID NO: 4615) | 3397 | 3595 |
| Z21997_T21 (SEQ ID NO: 4616) | 2521 | 2719 |
| Z21997_T23 (SEQ ID NO: 4617) | 2633 | 2831 |
| Z21997_T24 (SEQ ID NO: 4618) | 2492 | 2690 |
| Z21997_T26 (SEQ ID NO: 4619) | 2614 | 2812 |
| Z21997_T28 (SEQ ID NO: 4620) | 2711 | 2909 |
| Z21997_T32 (SEQ ID NO: 4621) | 2573 | 2771 |
| Z21997_T33 (SEQ ID NO: 4622) | 2838 | 3036 |
| Z21997_T34 (SEQ ID NO: 4623) | 2952 | 3150 |
| Z21997_T35 (SEQ ID NO: 4624) | 2792 | 2990 |
| Z21997_T38 (SEQ ID NO: 4625) | 2488 | 2686 |

This segment can be found in a non-coding region of transcript(s) that are related to the following protein(s): Z21997_P2, Z21997_P5, Z21997_P11, Z21997_P12, Z21997_P14, Z21997_P19, Z21997_P13 and Z21997_P21.

According to an optional embodiment of the present invention, short segments related to the above cluster are also provided. These segments are up to about 120 bp in length, and so are included in a separate description.

Segment cluster Z21997_node_0 (SEQ ID NO:4639) according to the present invention is supported by 2 libraries. The number of libraries was determined as previously described. This segment can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4012 below describes the starting and ending position of this segment on each transcript.

TABLE 4012

Segment location on transcripts

| Transcript name | Segment starting position | Segment ending position |
| --- | --- | --- |
| Z21997_T21 (SEQ ID NO: 4616) | 1 | 62 |
| Z21997_T23 (SEQ ID NO: 4617) | 1 | 62 |
| Z21997_T24 (SEQ ID NO: 4618) | 1 | 62 |
| Z21997_T26 (SEQ ID NO: 4619) | 1 | 62 |
| Z21997_T28 (SEQ ID NO: 4620) | 1 | 62 |
| Z21997_T32 (SEQ ID NO: 4621) | 1 | 62 |
| Z21997_T33 (SEQ ID NO: 4622) | 1 | 62 |
| Z21997_T34 (SEQ ID NO: 4623) | 1 | 62 |
| Z21997_T35 (SEQ ID NO: 4624) | 1 | 62 |
| Z21997_T38 (SEQ ID NO: 4625) | 1 | 62 |

This segment can be found in a non-coding region of transcript(s) that are related to the following protein(s): Z21997_P5, Z21997_P11, Z21997_P12, Z21997_P14, Z21997_P19, Z21997_P13 and Z21997_P21. Segment cluster Z21997_node_2 (SEQ ID NO:4640) according to the present invention is supported by 19 libraries. The number of libraries was determined as previously described. This segment can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4013 below describes the starting and ending position of this segment on each transcript.

TABLE 4013

Segment location on transcripts

| Transcript name | Segment starting position | Segment ending position |
| --- | --- | --- |
| Z21997_T21 (SEQ ID NO: 4616) | 250 | 296 |
| Z21997_T23 (SEQ ID NO: 4617) | 250 | 296 |
| Z21997_T24 (SEQ ID NO: 4618) | 250 | 296 |
| Z21997_T26 (SEQ ID NO: 4619) | 250 | 296 |
| Z21997_T28 (SEQ ID NO: 4620) | 250 | 296 |
| Z21997_T32 (SEQ ID NO: 4621) | 250 | 296 |
| Z21997_T33 (SEQ ID NO: 4622) | 250 | 296 |
| Z21997_T34 (SEQ ID NO: 4623) | 250 | 296 |
| Z21997_T35 (SEQ ID NO: 4624) | 250 | 296 |
| Z21997_T38 (SEQ ID NO: 4625) | 250 | 296 |

This segment can be found in a non-coding region of transcript(s) that are related to the following protein(s): Z21997_P5, Z21997_P11, Z21997_P12, Z21997_P14, Z21997_P19, Z21997_P13 and Z21997_P21.

Segment cluster Z21997_node_3 (SEQ ID NO:4641) according to the present invention can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4014 below describes the starting and ending position of this segment on each transcript.

TABLE 4014

Segment location on transcripts

| Transcript name | Segment starting position | Segment ending position |
| --- | --- | --- |
| Z21997_T21 (SEQ ID NO: 4616) | 297 | 314 |
| Z21997_T23 (SEQ ID NO: 4617) | 297 | 314 |
| Z21997_T24 (SEQ ID NO: 4618) | 297 | 314 |
| Z21997_T26 (SEQ ID NO: 4619) | 297 | 314 |
| Z21997_T28 (SEQ ID NO: 4620) | 297 | 314 |
| Z21997_T32 (SEQ ID NO: 4621) | 297 | 314 |
| Z21997_T33 (SEQ ID NO: 4622) | 297 | 314 |
| Z21997_T34 (SEQ ID NO: 4623) | 297 | 314 |
| Z21997_T35 (SEQ ID NO: 4624) | 297 | 314 |
| Z21997_T38 (SEQ ID NO: 4625) | 297 | 314 |

This segment can be found in a non-coding region of transcript(s) that are related to the following protein(s): Z21997_P5, Z21997_P11, Z21997_P12, Z21997_P14, Z21997_P19, Z21997_P13 and Z21997_P21.

Segment cluster Z21997_node_4 (SEQ ID NO:4642) according to the present invention can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4015 below describes the starting and ending position of this segment on each transcript.

TABLE 4015

Segment location on transcripts

| Transcript name | Segment starting position | Segment ending position |
| --- | --- | --- |
| Z21997_T21 (SEQ ID NO: 4616) | 315 | 321 |
| Z21997_T23 (SEQ ID NO: 4617) | 315 | 321 |
| Z21997_T24 (SEQ ID NO: 4618) | 315 | 321 |
| Z21997_T26 (SEQ ID NO: 4619) | 315 | 321 |
| Z21997_T28 (SEQ ID NO: 4620) | 315 | 321 |
| Z21997_T32 (SEQ ID NO: 4621) | 315 | 321 |
| Z21997_T33 (SEQ ID NO: 4622) | 315 | 321 |
| Z21997_T34 (SEQ ID NO: 4623) | 315 | 321 |
| Z21997_T35 (SEQ ID NO: 4624) | 315 | 321 |
| Z21997_T38 (SEQ ID NO: 4625) | 315 | 321 |

This segment can be found in a non-coding region of transcript(s) that are related to the following protein(s): Z21997_P5, Z21997_P11, Z21997_P12, Z21997_P14, Z21997_P19, Z21997_P13 and Z21997_P21.

Segment cluster Z21997_node_6 (SEQ ID NO:4643) according to the present invention is supported by 34 libraries. The number of libraries was determined as previously described. This segment can be found in the following transcript(s): Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4016 below describes the starting and ending position of this segment on each transcript.

TABLE 4016

Segment location on transcripts

| Transcript name | Segment starting position | Segment ending position |
| --- | --- | --- |
| Z21997_T21 (SEQ ID NO: 4616) | 466 | 499 |
| Z21997_T23 (SEQ ID NO: 4617) | 466 | 499 |
| Z21997_T24 (SEQ ID NO: 4618) | 466 | 499 |
| Z21997_T26 (SEQ ID NO: 4619) | 466 | 499 |
| Z21997_T28 (SEQ ID NO: 4620) | 466 | 499 |
| Z21997_T32 (SEQ ID NO: 4621) | 466 | 499 |
| Z21997_T33 (SEQ ID NO: 4622) | 466 | 499 |
| Z21997_T34 (SEQ ID NO: 4623) | 466 | 499 |
| Z21997_T35 (SEQ ID NO: 4624) | 466 | 499 |
| Z21997_T38 (SEQ ID NO: 4625) | 466 | 499 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P11, Z21997_P12, Z21997_P14, Z21997_P13 and Z21997_P21, since it is in the coding region for the corresponding transcript.

Segment cluster Z21997_node_16 (SEQ ID NO:4644) according to the present invention is supported by 64 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4017 below describes the starting and ending position of this segment on each transcript.

TABLE 4017

Segment location on transcripts

| Transcript name | Segment starting position | Segment ending position |
| --- | --- | --- |
| Z21997_T3 (SEQ ID NO: 4615) | 1786 | 1826 |
| Z21997_T21 (SEQ ID NO: 4616) | 686 | 726 |
| Z21997_T23 (SEQ ID NO: 4617) | 686 | 726 |
| Z21997_T24 (SEQ ID NO: 4618) | 686 | 726 |
| Z21997_T26 (SEQ ID NO: 4619) | 686 | 726 |
| Z21997_T28 (SEQ ID NO: 4620) | 686 | 726 |
| Z21997_T32 (SEQ ID NO: 4621) | 686 | 726 |
| Z21997_T33 (SEQ ID NO: 4622) | 686 | 726 |
| Z21997_T34 (SEQ ID NO: 4623) | 686 | 726 |
| Z21997_T35 (SEQ ID NO: 4624) | 686 | 726 |
| Z21997_T38 (SEQ ID NO: 4625) | 686 | 726 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_17 (SEQ ID NO:4645) according to the present invention can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623) and Z21997_T35 (SEQ ID NO:4624). Table 4018 below describes the starting and ending position of this segment on each transcript.

TABLE 4018

Segment location on transcripts

| Transcript name | Segment starting position | Segment ending position |
|---|---|---|
| Z21997_T3 (SEQ ID NO: 4615) | 1827 | 1835 |
| Z21997_T21 (SEQ ID NO: 4616) | 727 | 735 |
| Z21997_T23 (SEQ ID NO: 4617) | 727 | 735 |
| Z21997_T24 (SEQ ID NO: 4618) | 727 | 735 |
| Z21997_T26 (SEQ ID NO: 4619) | 727 | 735 |
| Z21997_T28 (SEQ ID NO: 4620) | 727 | 735 |
| Z21997_T32 (SEQ ID NO: 4621) | 727 | 735 |
| Z21997_T33 (SEQ ID NO: 4622) | 727 | 735 |
| Z21997_T34 (SEQ ID NO: 4623) | 727 | 735 |
| Z21997_T35 (SEQ ID NO: 4624) | 727 | 735 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14 and Z21997_P13, since it is in the coding region for the corresponding transcript.

Segment cluster Z21997_node_18 (SEQ ID NO:4646) according to the present invention can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623) and Z21997_T35 (SEQ ID NO:4624). Table 4019 below describes the starting and ending position of this segment on each transcript.

TABLE 4019

Segment location on transcripts

| Transcript name | Segment starting position | Segment ending position |
|---|---|---|
| Z21997_T3 (SEQ ID NO: 4615) | 1836 | 1856 |
| Z21997_T21 (SEQ ID NO: 4616) | 736 | 756 |
| Z21997_T23 (SEQ ID NO: 4617) | 736 | 756 |
| Z21997_T24 (SEQ ID NO: 4618) | 736 | 756 |
| Z21997_T26 (SEQ ID NO: 4619) | 736 | 756 |
| Z21997_T28 (SEQ ID NO: 4620) | 736 | 756 |
| Z21997_T32 (SEQ ID NO: 4621) | 736 | 756 |
| Z21997_T33 (SEQ ID NO: 4622) | 736 | 756 |
| Z21997_T34 (SEQ ID NO: 4623) | 736 | 756 |
| Z21997_T35 (SEQ ID NO: 4624) | 736 | 756 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14 and Z21997_P13, since it is in the coding region for the corresponding transcript.

Segment cluster Z21997_node_19 (SEQ ID NO:4647) according to the present invention is supported by 70 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623) and Z21997_T35 (SEQ ID NO:4624). Table 4020 below describes the starting and ending position of this segment on each transcript.

TABLE 4020

Segment location on transcripts

| Transcript name | Segment starting position | Segment ending position |
|---|---|---|
| Z21997_T3 (SEQ ID NO: 4615) | 1857 | 1926 |
| Z21997_T21 (SEQ ID NO: 4616) | 757 | 826 |
| Z21997_T23 (SEQ ID NO: 4617) | 757 | 826 |
| Z21997_T24 (SEQ ID NO: 4618) | 757 | 826 |
| Z21997_T26 (SEQ ID NO: 4619) | 757 | 826 |
| Z21997_T28 (SEQ ID NO: 4620) | 757 | 826 |
| Z21997_T32 (SEQ ID NO: 4621) | 757 | 826 |
| Z21997_T33 (SEQ ID NO: 4622) | 757 | 826 |
| Z21997_T34 (SEQ ID NO: 4623) | 757 | 826 |
| Z21997_T35 (SEQ ID NO: 4624) | 757 | 826 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14 and Z21997_P13, since it is in the coding region for the corresponding transcript.

Segment cluster Z21997_node_21 (SEQ ID NO:4648) according to the present invention is supported by 72 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623) and Z21997_T35 (SEQ ID NO:4624). Table 4021 below describes the starting and ending position of this segment on each transcript.

TABLE 4021

Segment location on transcripts

| Transcript name | Segment starting position | Segment ending position |
|---|---|---|
| Z21997_T3 (SEQ ID NO: 4615) | 1927 | 1952 |
| Z21997_T21 (SEQ ID NO: 4616) | 827 | 852 |
| Z21997_T23 (SEQ ID NO: 4617) | 827 | 852 |
| Z21997_T24 (SEQ ID NO: 4618) | 827 | 852 |
| Z21997_T26 (SEQ ID NO: 4619) | 827 | 852 |
| Z21997_T28 (SEQ ID NO: 4620) | 827 | 852 |
| Z21997_T32 (SEQ ID NO: 4621) | 827 | 852 |
| Z21997_T33 (SEQ ID NO: 4622) | 827 | 852 |
| Z21997_T34 (SEQ ID NO: 4623) | 827 | 852 |
| Z21997_T35 (SEQ ID NO: 4624) | 827 | 852 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14 and Z21997_P13, since it is in the coding region for the corresponding transcript.

Segment cluster Z21997_node_22 (SEQ ID NO:4649) according to the present invention is supported by 83 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4022 below describes the starting and ending position of this segment on each transcript.

TABLE 4022

Segment location on transcripts

| Transcript name | Segment starting position | Segment ending position |
|---|---|---|
| Z21997_T3 (SEQ ID NO: 4615) | 1953 | 2009 |
| Z21997_T21 (SEQ ID NO: 4616) | 853 | 909 |
| Z21997_T23 (SEQ ID NO: 4617) | 853 | 909 |
| Z21997_T24 (SEQ ID NO: 4618) | 853 | 909 |
| Z21997_T26 (SEQ ID NO: 4619) | 853 | 909 |
| Z21997_T28 (SEQ ID NO: 4620) | 853 | 909 |
| Z21997_T32 (SEQ ID NO: 4621) | 853 | 909 |
| Z21997_T33 (SEQ ID NO: 4622) | 853 | 909 |
| Z21997_T34 (SEQ ID NO: 4623) | 853 | 909 |
| Z21997_T35 (SEQ ID NO: 4624) | 853 | 909 |
| Z21997_T38 (SEQ ID NO: 4625) | 727 | 783 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_23 (SEQ ID NO:4650) according to the present invention can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4023 below describes the starting and ending position of this segment on each transcript.

TABLE 4023

Segment location on transcripts

| Transcript name | Segment starting position | Segment ending position |
|---|---|---|
| Z21997_T3 (SEQ ID NO: 4615) | 2010 | 2021 |
| Z21997_T21 (SEQ ID NO: 4616) | 910 | 921 |

TABLE 4023-continued

Segment location on transcripts

| Transcript name | Segment starting position | Segment ending position |
|---|---|---|
| Z21997_T23 (SEQ ID NO: 4617) | 910 | 921 |
| Z21997_T24 (SEQ ID NO: 4618) | 910 | 921 |
| Z21997_T26 (SEQ ID NO: 4619) | 910 | 921 |
| Z21997_T28 (SEQ ID NO: 4620) | 910 | 921 |
| Z21997_T32 (SEQ ID NO: 4621) | 910 | 921 |
| Z21997_T33 (SEQ ID NO: 4622) | 910 | 921 |
| Z21997_T34 (SEQ ID NO: 4623) | 910 | 921 |
| Z21997_T35 (SEQ ID NO: 4624) | 910 | 921 |
| Z21997_T38 (SEQ ID NO: 4625) | 784 | 795 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_24 (SEQ ID NO:4651) according to the present invention is supported by 93 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4024 below describes the starting and ending position of this segment on each transcript.

TABLE 4024

Segment location on transcripts

| Transcript name | Segment starting position | Segment ending position |
|---|---|---|
| Z21997_T3 (SEQ ID NO: 4615) | 2022 | 2060 |
| Z21997_T21 (SEQ ID NO: 4616) | 922 | 960 |
| Z21997_T23 (SEQ ID NO: 4617) | 922 | 960 |
| Z21997_T24 (SEQ ID NO: 4618) | 922 | 960 |
| Z21997_T26 (SEQ ID NO: 4619) | 922 | 960 |
| Z21997_T28 (SEQ ID NO: 4620) | 922 | 960 |
| Z21997_T32 (SEQ ID NO: 4621) | 922 | 960 |
| Z21997_T33 (SEQ ID NO: 4622) | 922 | 960 |
| Z21997_T34 (SEQ ID NO: 4623) | 922 | 960 |
| Z21997_T35 (SEQ ID NO: 4624) | 922 | 960 |
| Z21997_T38 (SEQ ID NO: 4625) | 796 | 834 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_27 (SEQ ID NO:4652) according to the present invention is supported by 95 libraries. The number of libraries was determined as previously described. This segment can be found in the following transcript(s): Z21997_T3 (SEQ ID NO:4615), Z21997_T21

(SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4025 below describes the starting and ending position of this segment on each transcript.

TABLE 4025

Segment location on transcripts

| Transcript name | Segment starting position | Segment ending position |
|---|---|---|
| Z21997_T3 (SEQ ID NO: 4615) | 2061 | 2107 |
| Z21997_T21 (SEQ ID NO: 4616) | 961 | 1007 |
| Z21997_T23 (SEQ ID NO: 4617) | 961 | 1007 |
| Z21997_T24 (SEQ ID NO: 4618) | 961 | 1007 |
| Z21997_T26 (SEQ ID NO: 4619) | 961 | 1007 |
| Z21997_T28 (SEQ ID NO: 4620) | 961 | 1007 |
| Z21997_T32 (SEQ ID NO: 4621) | 961 | 1007 |
| Z21997_T33 (SEQ ID NO: 4622) | 961 | 1007 |
| Z21997_T34 (SEQ ID NO: 4623) | 961 | 1007 |
| Z21997_T35 (SEQ ID NO: 4624) | 961 | 1007 |
| Z21997_T38 (SEQ ID NO: 4625) | 835 | 881 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_30 (SEQ ID NO:4653) according to the present invention is supported by 114 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4026 below describes the starting and ending position of this segment on each transcript.

TABLE 4026

Segment location on transcripts

| Transcript name | Segment starting position | Segment ending position |
|---|---|---|
| Z21997_T3 (SEQ ID NO: 4615) | 2108 | 2221 |
| Z21997_T21 (SEQ ID NO: 4616) | 1008 | 1121 |
| Z21997_T23 (SEQ ID NO: 4617) | 1008 | 1121 |
| Z21997_T24 (SEQ ID NO: 4618) | 1008 | 1121 |
| Z21997_T26 (SEQ ID NO: 4619) | 1008 | 1121 |
| Z21997_T28 (SEQ ID NO: 4620) | 1008 | 1121 |
| Z21997_T32 (SEQ ID NO: 4621) | 1008 | 1121 |
| Z21997_T33 (SEQ ID NO: 4622) | 1008 | 1121 |
| Z21997_T34 (SEQ ID NO: 4623) | 1008 | 1121 |
| Z21997_T35 (SEQ ID NO: 4624) | 1008 | 1121 |
| Z21997_T38 (SEQ ID NO: 4625) | 882 | 995 |

This segment can be found in both coding and non-coding regions of transcript(s) as follows. The segment can be found in a non-coding region of transcript(s) that are related to the following protein(s): Z21997_P5 and Z21997_P19. This segment can also be found in the following protein(s): Z21997_P2, Z21997_P11, Z21997_P12, Z21997_P14, Z21997_P13 and Z21997_P21, since it is in the coding region for the corresponding transcript.

Segment cluster Z21997_node_32 (SEQ ID NO:4654) according to the present invention is supported by 114 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4027 below describes the starting and ending position of this segment on each transcript.

TABLE 4027

Segment location on transcripts

| Transcript name | Segment starting position | Segment ending position |
|---|---|---|
| Z21997_T3 (SEQ ID NO: 4615) | 2222 | 2297 |
| Z21997_T21 (SEQ ID NO: 4616) | 1346 | 1421 |
| Z21997_T23 (SEQ ID NO: 4617) | 1122 | 1197 |
| Z21997_T24 (SEQ ID NO: 4618) | 1122 | 1197 |
| Z21997_T26 (SEQ ID NO: 4619) | 1122 | 1197 |
| Z21997_T28 (SEQ ID NO: 4620) | 1122 | 1197 |
| Z21997_T32 (SEQ ID NO: 4621) | 1122 | 1197 |
| Z21997_T33 (SEQ ID NO: 4622) | 1346 | 1421 |
| Z21997_T34 (SEQ ID NO: 4623) | 1346 | 1421 |
| Z21997_T35 (SEQ ID NO: 4624) | 1122 | 1197 |
| Z21997_T38 (SEQ ID NO: 4625) | 996 | 1071 |

This segment can be found in both coding and non-coding regions of transcript(s) as follows. The segment can be found in a non-coding region of transcript(s) that are related to the following protein(s): Z21997_P19. This segment can also be found in the following protein(s): Z21997_P2, Z21997_P5, Z21997_P11, Z21997_P12, Z21997_P14, Z21997_P13 and Z21997_P21, since it is in the coding region for the corresponding transcript.

Segment cluster Z21997_node_33 (SEQ ID NO:4655) according to the present invention is supported by 2 libraries. The number of libraries was determined as previously described. This segment can be found in the following transcript(s): Z21997_T34 (SEQ ID NO:4623). Table 4028 below describes the starting and ending position of this segment on each transcript.

TABLE 4028

Segment location on transcripts

| Transcript name | Segment starting position | Segment ending position |
|---|---|---|
| Z21997_T34 (SEQ ID NO: 4623) | 1422 | 1535 |

This segment can be found in a non-coding region of transcript(s) that are related to the following protein(s): Z21997_P19.

Segment cluster Z21997_node_34 (SEQ ID NO:4656) according to the present invention is supported by 124 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4029 below describes the starting and ending position of this segment on each transcript.

TABLE 4029

Segment location on transcripts

| Transcript name | Segment starting position | Segment ending position |
|---|---|---|
| Z21997_T3 (SEQ ID NO: 4615) | 2298 | 2412 |
| Z21997_T21 (SEQ ID NO: 4616) | 1422 | 1536 |
| Z21997_T23 (SEQ ID NO: 4617) | 1198 | 1312 |
| Z21997_T24 (SEQ ID NO: 4618) | 1198 | 1312 |
| Z21997_T26 (SEQ ID NO: 4619) | 1198 | 1312 |
| Z21997_T28 (SEQ ID NO: 4620) | 1198 | 1312 |
| Z21997_T32 (SEQ ID NO: 4621) | 1198 | 1312 |
| Z21997_T33 (SEQ ID NO: 4622) | 1422 | 1536 |
| Z21997_T34 (SEQ ID NO: 4623) | 1536 | 1650 |
| Z21997_T35 (SEQ ID NO: 4624) | 1198 | 1312 |
| Z21997_T38 (SEQ ID NO: 4625) | 1072 | 1186 |

This segment can be found in both coding and non-coding regions of transcript(s) as follows. The segment can be found in a non-coding region of transcript(s) that are related to the following protein(s): Z21997_P19. This segment can also be found in the following protein(s): Z21997_P2, Z21997_P5, Z21997_P11, Z21997_P12, Z21997_P14, Z21997_P13 and Z21997_P21, since it is in the coding region for the corresponding transcript.

Segment cluster Z21997_node_38 (SEQ ID NO:4657) according to the present invention is supported by 114 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4030 below describes the starting and ending position of this segment on each transcript.

TABLE 4030

Segment location on transcripts

| Transcript name | Segment starting position | Segment ending position |
|---|---|---|
| Z21997_T3 (SEQ ID NO: 4615) | 2544 | 2603 |
| Z21997_T21 (SEQ ID NO: 4616) | 1668 | 1727 |
| Z21997_T23 (SEQ ID NO: 4617) | 1444 | 1503 |
| Z21997_T24 (SEQ ID NO: 4618) | 1639 | 1698 |
| Z21997_T26 (SEQ ID NO: 4619) | 1761 | 1820 |
| Z21997_T28 (SEQ ID NO: 4620) | 1444 | 1503 |
| Z21997_T32 (SEQ ID NO: 4621) | 1639 | 1698 |
| Z21997_T33 (SEQ ID NO: 4622) | 1985 | 2044 |
| Z21997_T34 (SEQ ID NO: 4623) | 2099 | 2158 |
| Z21997_T35 (SEQ ID NO: 4624) | 1444 | 1503 |
| Z21997_T38 (SEQ ID NO: 4625) | 1635 | 1694 |

This segment can be found in both coding and non-coding regions of transcript(s) as follows. The segment can be found in a non-coding region of transcript(s) that are related to the following protein(s): Z21997_P12, Z21997_P14 and Z21997_P21. This segment can also be found in the following protein(s): Z21997_P2, Z21997_P5, Z21997_P11, Z21997_P19 and Z21997_P13, since it is in the coding region for the corresponding transcript.

Segment cluster Z21997_node_39 (SEQ ID NO:4658) according to the present invention is supported by 109 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4031 below describes the starting and ending-position of this segment on each transcript.

TABLE 4031

Segment location on transcripts

| Transcript name | Segment starting position | Segment ending position |
|---|---|---|
| Z21997_T3 (SEQ ID NO: 4615) | 2604 | 2651 |
| Z21997_T21 (SEQ ID NO: 4616) | 1728 | 1775 |
| Z21997_T23 (SEQ ID NO: 4617) | 1504 | 1551 |
| Z21997_T24 (SEQ ID NO: 4618) | 1699 | 1746 |
| Z21997_T26 (SEQ ID NO: 4619) | 1821 | 1868 |
| Z21997_T28 (SEQ ID NO: 4620) | 1504 | 1551 |
| Z21997_T32 (SEQ ID NO: 4621) | 1699 | 1746 |
| Z21997_T33 (SEQ ID NO: 4622) | 2045 | 2092 |
| Z21997_T34 (SEQ ID NO: 4623) | 2159 | 2206 |
| Z21997_T35 (SEQ ID NO: 4624) | 1504 | 1551 |
| Z21997_T38 (SEQ ID NO: 4625) | 1695 | 1742 |

This segment can be found in both coding and non-coding regions of transcript(s) as follows. The segment can be found in a non-coding region of transcript(s) that are related to the following protein(s): Z21997_P12, Z21997_P14 and Z21997_P21. This segment can also be found in the following protein(s): Z21997_P2, Z21997_P5, Z21997_P11, Z21997_P19 and Z21997_P13, since it is in the coding region for the corresponding transcript.

Segment cluster Z21997_node_40 (SEQ ID NO:4659) according to the present invention is supported by 5 libraries. The number of libraries was determined as previously described. This segment can be found in the following transcript(s): Z21997_T32 (SEQ ID NO:4621) and Z21997_T35 (SEQ ID NO:4624). Table 4032 below describes the starting and ending position of this segment on each transcript.

TABLE 4032

Segment location on transcripts

| Transcript name | Segment starting position | Segment ending position |
|---|---|---|
| Z21997_T32 (SEQ ID NO: 4621) | 1747 | 1773 |
| Z21997_T35 (SEQ ID NO: 4624) | 1552 | 1578 |

This segment can be found in both coding and non-coding regions of transcript(s) as follows. The segment can be found in a non-coding region of transcript(s) that are related to the following protein(s): Z21997_P12. This segment can also be found in the following protein(s): Z21997_P13, since it is in the coding region for the corresponding transcript.

Segment cluster Z21997_node_41 (SEQ ID NO:4660) according to the present invention is supported by 7 libraries. The number of libraries was determined as previously described. This segment can be found in the following transcript(s): Z21997_T32 (SEQ ID NO:4621) and Z21997_T35 (SEQ ID NO:4624). Table 4033 below describes the starting and ending position of this segment on each transcript.

TABLE 4033

Segment location on transcripts

| Transcript name | Segment starting position | Segment ending position |
| --- | --- | --- |
| Z21997_T32 (SEQ ID NO: 4621) | 1774 | 1827 |
| Z21997_T35 (SEQ ID NO: 4624) | 1579 | 1632 |

This segment can be found in a non-coding region of transcript(s) that are related to the following protein(s): Z21997_P12 and Z21997_P13.

Segment cluster Z21997_node_42 (SEQ ID NO:4661) according to the present invention is supported by 111 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4034 below describes the starting and ending position of this segment on each transcript.

TABLE 4034

Segment location on transcripts

| Transcript name | Segment starting position | Segment ending position |
| --- | --- | --- |
| Z21997_T3 (SEQ ID NO: 4615) | 2652 | 2708 |
| Z21997_T21 (SEQ ID NO: 4616) | 1776 | 1832 |
| Z21997_T23 (SEQ ID NO: 4617) | 1552 | 1608 |
| Z21997_T24 (SEQ ID NO: 4618) | 1747 | 1803 |
| Z21997_T26 (SEQ ID NO: 4619) | 1869 | 1925 |
| Z21997_T28 (SEQ ID NO: 4620) | 1552 | 1608 |
| Z21997_T32 (SEQ ID NO: 4621) | 1828 | 1884 |
| Z21997_T33 (SEQ ID NO: 4622) | 2093 | 2149 |
| Z21997_T34 (SEQ ID NO: 4623) | 2207 | 2263 |
| Z21997_T35 (SEQ ID NO: 4624) | 1633 | 1689 |
| Z21997_T38 (SEQ ID NO: 4625) | 1743 | 1799 |

This segment can be found in both coding and non-coding regions of transcript(s) as follows. The segment can be found in a non-coding region of transcript(s) that are related to the following protein(s): Z21997_P12, Z21997_P14, Z21997_P13 and Z21997_P21. This segment can also be found in the following protein(s): Z21997_P2, Z21997_P5, Z21997_P11 and Z21997_P19, since it is in the coding region for the corresponding transcript.

Segment cluster Z21997_node_45 (SEQ ID NO:4662) according to the present invention can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4035 below describes the starting and ending position of this segment on each transcript.

TABLE 4035

Segment location on transcripts

| Transcript name | Segment starting position | Segment ending position |
| --- | --- | --- |
| Z21997_T3 (SEQ ID NO: 4615) | 2846 | 2860 |
| Z21997_T21 (SEQ ID NO: 4616) | 1970 | 1984 |
| Z21997_T23 (SEQ ID NO: 4617) | 2082 | 2096 |
| Z21997_T24 (SEQ ID NO: 4618) | 1941 | 1955 |
| Z21997_T26 (SEQ ID NO: 4619) | 2063 | 2077 |
| Z21997_T28 (SEQ ID NO: 4620) | 2082 | 2096 |
| Z21997_T32 (SEQ ID NO: 4621) | 2022 | 2036 |
| Z21997_T33 (SEQ ID NO: 4622) | 2287 | 2301 |
| Z21997_T34 (SEQ ID NO: 4623) | 2401 | 2415 |
| Z21997_T35 (SEQ ID NO: 4624) | 2163 | 2177 |
| Z21997_T38 (SEQ ID NO: 4625) | 1937 | 1951 |

This segment can be found in both coding and non-coding regions of transcript(s) as follows. The segment can be found in a non-coding region of transcript(s) that are related to the following protein(s): Z21997_P11, Z21997_P12, Z21997_P14, Z21997_P13 and Z21997_P21. This segment can also be found in the following protein(s): Z21997_P2, Z21997_P5 and Z21997_P19, since it is in the coding region for the corresponding transcript.

Segment cluster Z21997_node_46 (SEQ ID NO:4663) according to the present invention is supported by 91 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4036 below describes the starting and ending position of this segment on each transcript.

TABLE 4036

Segment location on transcripts

| Transcript name | Segment starting position | Segment ending position |
| --- | --- | --- |
| Z21997_T3 (SEQ ID NO: 4615) | 2861 | 2924 |
| Z21997_T21 (SEQ ID NO: 4616) | 1985 | 2048 |
| Z21997_T23 (SEQ ID NO: 4617) | 2097 | 2160 |
| Z21997_T24 (SEQ ID NO: 4618) | 1956 | 2019 |
| Z21997_T26 (SEQ ID NO: 4619) | 2078 | 2141 |
| Z21997_T28 (SEQ ID NO: 4620) | 2097 | 2160 |
| Z21997_T32 (SEQ ID NO: 4621) | 2037 | 2100 |
| Z21997_T33 (SEQ ID NO: 4622) | 2302 | 2365 |
| Z21997_T34 (SEQ ID NO: 4623) | 2416 | 2479 |
| Z21997_T35 (SEQ ID NO: 4624) | 2178 | 2241 |
| Z21997_T38 (SEQ ID NO: 4625) | 1952 | 2015 |

This segment can be found in both coding and non-coding regions of transcript(s) as follows. The segment can be found in a non-coding region of transcript(s) that are related to the following protein(s): Z21997_P11, Z21997_P12, Z21997_P14, Z21997_P13 and Z21997_P21. This segment can also be found in the following protein(s): Z21997_P2, Z21997_P5 and Z21997_P19, since it is in the coding region for the corresponding transcript.

Segment cluster Z21997_node_47 (SEQ ID NO:4664) according to the present invention can be found in the following transcript(s): Z21997_T28 (SEQ ID NO:4620) and Z21997_T35 (SEQ ID NO:4624). Table 4037 below describes the starting and ending position of this segment on each transcript.

TABLE 4037

Segment location on transcripts

| Transcript name | Segment starting position | Segment ending position |
| --- | --- | --- |
| Z21997_T28 (SEQ ID NO: 4620) | 2161 | 2169 |
| Z21997_T35 (SEQ ID NO: 4624) | 2242 | 2250 |

This segment can be found in a non-coding region of transcript(s) that are related to the following protein(s): Z21997_P11 and Z21997_P13.

Segment cluster Z21997_node_48 (SEQ ID NO:4665) according to the present invention is supported by 3 libraries. The number of libraries was determined as previously described. This segment can be found in the following transcript(s): Z21997_T28 (SEQ ID NO:4620) and Z21997_T35 (SEQ ID NO:4624). Table 4038 below describes the starting and ending position of this segment on each transcript.

TABLE 4038

Segment location on transcripts

| Transcript name | Segment starting position | Segment ending position |
| --- | --- | --- |
| Z21997_T28 (SEQ ID NO: 4620) | 2170 | 2238 |
| Z21997_T35 (SEQ ID NO: 4624) | 2251 | 2319 |

This segment can be found in a non-coding region of transcript(s) that are related to the following protein(s): Z21997_P11 and Z21997_P13.

Segment cluster Z21997_node_49 (SEQ ID NO:4666) according to the present invention is supported by 87 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4039 below describes the starting and ending position of this segment on each transcript.

TABLE 4039

Segment location on transcripts

| Transcript name | Segment starting position | Segment ending position |
| --- | --- | --- |
| Z21997_T3 (SEQ ID NO: 4615) | 2925 | 3012 |
| Z21997_T21 (SEQ ID NO: 4616) | 2049 | 2136 |
| Z21997_T23 (SEQ ID NO: 4617) | 2161 | 2248 |
| Z21997_T24 (SEQ ID NO: 4618) | 2020 | 2107 |
| Z21997_T26 (SEQ ID NO: 4619) | 2142 | 2229 |
| Z21997_T28 (SEQ ID NO: 4620) | 2239 | 2326 |
| Z21997_T32 (SEQ ID NO: 4621) | 2101 | 2188 |
| Z21997_T33 (SEQ ID NO: 4622) | 2366 | 2453 |
| Z21997_T34 (SEQ ID NO: 4623) | 2480 | 2567 |
| Z21997_T35 (SEQ ID NO: 4624) | 2320 | 2407 |
| Z21997_T38 (SEQ ID NO: 4625) | 2016 | 2103 |

This segment can be found in both coding and non-coding regions of transcript(s) as follows. The segment can be found in a non-coding region of transcript(s) that are related to the following protein(s): Z21997_P1, Z21997_P12, Z21997_P14, Z21997_P13 and Z21997_P21. This segment can also be found in the following protein(s): Z21997_P2, Z21997_P5 and Z21997_P19, since it is in the coding region for the corresponding transcript.

Segment cluster Z21997_node_51 (SEQ ID NO:4667) according to the present invention is supported by 106 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4040 below describes the starting and ending position of this segment on each transcript.

TABLE 4040

Segment location on transcripts

| Transcript name | Segment starting position | Segment ending position |
| --- | --- | --- |
| Z21997_T3 (SEQ ID NO: 4615) | 3013 | 3125 |
| Z21997_T21 (SEQ ID NO: 4616) | 2137 | 2249 |
| Z21997_T23 (SEQ ID NO: 4617) | 2249 | 2361 |
| Z21997_T24 (SEQ ID NO: 4618) | 2108 | 2220 |
| Z21997_T26 (SEQ ID NO: 4619) | 2230 | 2342 |
| Z21997_T28 (SEQ ID NO: 4620) | 2327 | 2439 |
| Z21997_T32 (SEQ ID NO: 4621) | 2189 | 2301 |
| Z21997_T33 (SEQ ID NO: 4622) | 2454 | 2566 |
| Z21997_T34 (SEQ ID NO: 4623) | 2568 | 2680 |
| Z21997_T35 (SEQ ID NO: 4624) | 2408 | 2520 |
| Z21997_T38 (SEQ ID NO: 4625) | 2104 | 2216 |

This segment can be found in both coding and non-coding regions of transcript(s) as follows. The segment can be found in a non-coding region of transcript(s) that are related to the following protein(s): Z21997_P11, Z21997_P12, Z21997_P14, Z21997_P13 and Z21997_P21. This segment can also be found in the following protein(s): Z21997_P2, Z21997_P5 and Z21997_P19, since it is in the coding region for the corresponding transcript.

Segment cluster Z21997_node_54 (SEQ ID NO:4668) according to the present invention is supported by 92 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4041 below describes the starting and ending position of this segment on each transcript.

TABLE 4041

Segment location on transcripts

| Transcript name | Segment starting position | Segment ending position |
|---|---|---|
| Z21997_T3 (SEQ ID NO: 4615) | 3296 | 3343 |
| Z21997_T21 (SEQ ID NO: 4616) | 2420 | 2467 |
| Z21997_T23 (SEQ ID NO: 4617) | 2532 | 2579 |
| Z21997_T24 (SEQ ID NO: 4618) | 2391 | 2438 |
| Z21997_T26 (SEQ ID NO: 4619) | 2513 | 2560 |
| Z21997_T28 (SEQ ID NO: 4620) | 2610 | 2657 |
| Z21997_T32 (SEQ ID NO: 4621) | 2472 | 2519 |
| Z21997_T33 (SEQ ID NO: 4622) | 2737 | 2784 |
| Z21997_T34 (SEQ ID NO: 4623) | 2851 | 2898 |
| Z21997_T35 (SEQ ID NO: 4624) | 2691 | 2738 |
| Z21997_T38 (SEQ ID NO: 4625) | 2387 | 2434 |

This segment can be found in a non-coding region of transcript(s) that are related to the following protein(s): Z21997_P2, Z21997_P5, Z21997_P11, Z21997_P12, Z21997_P14, Z21997_P19, Z21997_P13 and Z21997_P21.

Segment cluster Z21997_node_55 (SEQ ID NO:4669) according to the present invention is supported by 89 libraries. The number of libraries was determined as previously described. This segment can be found in the following transcript(s): Z21997_T3 (SEQ ID NO:4615), Z21997_T21 (SEQ ID NO:4616), Z21997_T23 (SEQ ID NO:4617), Z21997_T24 (SEQ ID NO:4618), Z21997_T26 (SEQ ID NO:4619), Z21997_T28 (SEQ ID NO:4620), Z21997_T32 (SEQ ID NO:4621), Z21997_T33 (SEQ ID NO:4622), Z21997_T34 (SEQ ID NO:4623), Z21997_T35 (SEQ ID NO:4624) and Z21997_T38 (SEQ ID NO:4625). Table 4042 below describes the starting and ending position of this segment on each transcript.

TABLE 4042

Segment location on transcripts

| Transcript name | Segment starting position | Segment ending position |
|---|---|---|
| Z21997_T3 (SEQ ID NO: 4615) | 3344 | 3396 |
| Z21997_T21 (SEQ ID NO: 4616) | 2468 | 2520 |
| Z21997_T23 (SEQ ID NO: 4617) | 2580 | 2632 |
| Z21997_T24 (SEQ ID NO: 4618) | 2439 | 2491 |
| Z21997_T26 (SEQ ID NO: 4619) | 2561 | 2613 |
| Z21997_T28 (SEQ ID NO: 4620) | 2658 | 2710 |
| Z21997_T32 (SEQ ID NO: 4621) | 2520 | 2572 |
| Z21997_T33 (SEQ ID NO: 4622) | 2785 | 2837 |
| Z21997_T34 (SEQ ID NO: 4623) | 2899 | 2951 |
| Z21997_T35 (SEQ ID NO: 4624) | 2739 | 2791 |
| Z21997_T38 (SEQ ID NO: 4625) | 2435 | 2487 |

This segment can be found in a non-coding region of transcript(s) that are related to the following protein(s): Z21997_P2, Z21997_P5, Z21997_P11, Z21997_P12, Z21997_P14, Z21997_P19, Z21997_P13 and Z21997_P21.

Description for Cluster Z25166

Cluster Z25166 features 3 transcript(s) and 34 segment(s) of interest, the names for which are given in Tables 1 and 2, respectively, the sequences themselves are given at the end of the application. The selected protein variants are given in Table 4045.

TABLE 4043

Transcripts of interest
Transcript Name

Z25166_T2 (SEQ ID NO: 4670)
Z25166_T9 (SEQ ID NO: 4671)
Z25166_T10 (SEQ ID NO: 4672)

TABLE 4044

Segments of interest
Segment Name

Z25166_node_0 (SEQ ID NO: 4673)
Z25166_node_14 (SEQ ID NO: 4674)
Z25166_node_15 (SEQ ID NO: 4675)
Z25166_node_16 (SEQ ID NO: 4676)
Z25166_node_21 (SEQ ID NO: 4677)
Z25166_node_23 (SEQ ID NO: 4678)
Z25166_node_24 (SEQ ID NO: 4679)
Z25166_node_25 (SEQ ID NO: 4680)
Z25166_node_26 (SEQ ID NO: 4681)
Z25166_node_28 (SEQ ID NO: 4682)
Z25166_node_29 (SEQ ID NO: 4683)
Z25166_node_30 (SEQ ID NO: 4684)
Z25166_node_35 (SEQ ID NO: 4685)
Z25166_node_44 (SEQ ID NO: 4686)
Z25166_node_1 (SEQ ID NO: 4687)
Z25166_node_2 (SEQ ID NO: 4688)
Z25166_node_3 (SEQ ID NO: 4689)
Z25166_node_5 (SEQ ID NO: 4690)
Z25166_node_7 (SEQ ID NO: 4691)
Z25166_node_9 (SEQ ID NO: 4692)
Z25166_node_12 (SEQ ID NO: 4693)
Z25166_node_17 (SEQ ID NO: 4694)
Z25166_node_18 (SEQ ID NO: 4695)
Z25166_node_19 (SEQ ID NO: 4696)
Z25166_node_31 (SEQ ID NO: 4697)
Z25166_node_33 (SEQ ID NO: 4698)
Z25166_node_34 (SEQ ID NO: 4699)
Z25166_node_36 (SEQ ID NO: 4700)
Z25166_node_37 (SEQ ID NO: 4701)
Z25166_node_38 (SEQ ID NO: 4702)
Z25166_node_40 (SEQ ID NO: 4703)
Z25166_node_41 (SEQ ID NO: 4704)
Z25166_node_42 (SEQ ID NO: 4705)
Z25166_node_43 (SEQ ID NO: 4706)

TABLE 4045

Proteins of interest

| Protein Name | Corresponding Transcript(s) |
|---|---|
| Z25166_P2 | Z25166_T2 (SEQ ID NO: 4670) |
| Z25166_P3 | Z25166_T9 (SEQ ID NO: 4671) |
| Z25166_P4 | Z25166_T10 (SEQ ID NO: 4672) |

These sequences are variants of the known protein Nuclear ubiquitous casein and cyclin-dependent kinases substrate (SwissProt accession identifier NUKS_HUMAN), referred to herein as the previously known protein.

The sequence for protein Nuclear ubiquitous casein and cyclin-dependent kinases substrate is given at the end of the application, as "Nuclear ubiquitous casein and cyclin-dependent kinases substrate amino acid sequence". Protein Nuclear ubiquitous casein and cyclin-dependent kinases substrate localization is believed to be Nuclear.

The following GO Annotation(s) apply to the previously known protein. The following annotation(s) were found: nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z25166 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 100 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 100 and Table 4046. This cluster is overexpressed (at least at a minimum level) in the following pathological conditions: bone malignant tumors, epithelial malignant tumors, a mixture of malignant tumors from different tissues, ovarian carcinoma and gastric carcinoma.

TABLE 4046

Normal tissue distribution

| Name of Tissue | Number |
|---|---|
| adrenal | 292 |
| bladder | 369 |
| Bone | 71 |
| Brain | 262 |
| Colon | 157 |
| epithelial | 194 |
| general | 213 |
| head and neck | 314 |
| kidney | 177 |
| liver | 102 |
| lung | 114 |
| lymph nodes | 179 |
| breast | 202 |
| bone marrow | 376 |
| muscle | 259 |
| ovary | 182 |
| pancreas | 185 |
| prostate | 361 |
| skin | 244 |
| stomach | 36 |
| T cells | 306 |
| Thyroid | 257 |
| uterus | 286 |

TABLE 4047

P values and ratios for expression in cancerous tissue

| Name of Tissue | P1 | P2 | SP1 | R3 | SP2 | R4 |
|---|---|---|---|---|---|---|
| adrenal | 5.7e−01 | 6.1e−01 | 9.1e−01 | 0.5 | 8.7e−01 | 0.6 |
| bladder | 3.7e−01 | 3.0e−01 | 5.7e−01 | 0.9 | 3.6e−01 | 1.0 |
| bone | 7.1e−02 | 1.5e−01 | 1.3e−02 | 3.6 | 2.2e−03 | 3.6 |
| brain | 6.2e−01 | 6.6e−01 | 6.5e−01 | 0.8 | 7.7e−01 | 0.8 |
| colon | 1.1e−01 | 7.1e−02 | 4.6e−01 | 1.0 | 5.2e−01 | 1.0 |
| epithelial | 1.6e−04 | 1.8e−03 | 8.7e−05 | 1.4 | 1.8e−04 | 1.4 |
| general | 4.4e−03 | 1.4e−02 | 2.4e−04 | 1.3 | 4.7e−06 | 1.3 |
| head and neck | 5.1e−01 | 6.0e−01 | 4.1e−04 | 1.5 | 1.2e−01 | 0.9 |
| kidney | 4.9e−01 | 5.7e−01 | 1.1e−01 | 1.4 | 3.8e−02 | 1.5 |
| liver | 4.4e−01 | 3.6e−01 | 1 | 1.3 | 5.3e−01 | 0.9 |
| lung | 1.3e−01 | 9.2e−02 | 6.4e−02 | 1.6 | 4.6e−02 | 1.6 |
| lymph nodes | 3.5e−01 | 4.3e−01 | 4.4e−02 | 1.6 | 4.0e−01 | 1.0 |
| breast | 2.3e−01 | 2.4e−01 | 2.0e−01 | 1.3 | 1.5e−01 | 1.2 |
| bone marrow | 5.4e−01 | 5.1e−01 | 8.8e−01 | 0.6 | 4.8e−01 | 0.9 |
| muscle | 4.2e−01 | 3.5e−01 | 9.1e−01 | 0.6 | 6.8e−01 | 0.4 |
| ovary | 2.2e−03 | 4.7e−03 | 1.5e−01 | 1.6 | 2.4e−01 | 1.3 |

TABLE 4047-continued

P values and ratios for expression in cancerous tissue

| Name of Tissue | P1 | P2 | SP1 | R3 | SP2 | R4 |
|---|---|---|---|---|---|---|
| pancreas | 2.2e−01 | 1.7e−01 | 1.3e−01 | 1.0 | 3.9e−01 | 0.8 |
| prostate | 6.6e−01 | 6.6e−01 | 8.4e−01 | 0.7 | 8.2e−01 | 0.6 |
| skin | 5.8e−01 | 6.3e−01 | 3.8e−01 | 0.7 | 6.2e−01 | 0.4 |
| stomach | 1.5e−01 | 2.4e−01 | 2.7e−04 | 3.1 | 1.2e−02 | 2.8 |
| T cells | 3.3e−01 | 5.0e−01 | 1 | 0.5 | 8.1e−01 | 0.8 |
| Thyroid | 4.3e−01 | 4.3e−01 | 7.9e−01 | 0.9 | 7.9e−01 | 0.9 |
| uterus | 6.2e−01 | 6.6e−01 | 8.6e−01 | 0.5 | 4.1e−01 | 0.7 |

As noted above, cluster Z25166 features 34 segment(s), which were listed in Table 4044 above and for which the sequence(s) are given at the end of the application. These segment(s) are portions of nucleic acid sequence(s) which are described herein separately because they are of particular interest. A description of each segment according to the present invention is now provided.

Segment cluster Z25166_node_0 (SEQ ID NO:4673) according to the present invention is supported by 124 libraries. The number of libraries was determined as previously described. This segment can be found in the following transcript(s): Z25166_T2 (SEQ ID NO:4670). Table 4048 below describes the starting and ending position of this segment on each transcript.

TABLE 4048

Segment location on transcripts

| Transcript name | Segment starting position | Segment ending position |
|---|---|---|
| Z25166_T2 (SEQ ID NO: 4670) | 1 | 183 |

This segment can be found in a non-coding region of transcript(s) that are related to the following protein(s): Z25166_P2.

Segment cluster Z25166_node_14 (SEQ ID NO:4674) according to the present invention is supported by 2 libraries. The number of libraries was determined as previously described. This segment can be found in the following transcript(s): Z25166_T9 (SEQ ID NO:4671) and Z25166_T10 (SEQ ID NO:4672). Table 4049 below describes the starting and ending position of this segment on each transcript.

TABLE 4049

Segment location on transcripts

| Transcript name | Segment starting position | Segment ending position |
|---|---|---|
| Z25166_T9 (SEQ ID NO: 4671) | 1 | 410 |
| Z25166_T10 (SEQ ID NO: 4672) | 1 | 410 |

This segment can be found in a non-coding region of transcript(s) that are related to the following protein(s): Z25166_P3 and Z25166_P4.

Segment cluster Z25166_node_15 (SEQ ID NO:4675) according to the present invention is supported by 203 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4050 below describes the starting and ending position of this segment on each transcript.

TABLE 4050

Segment location on transcripts

| Transcript name | Segment starting position | Segment ending position |
|---|---|---|
| Z25166_T2 (SEQ ID NO: 4670) | 533 | 685 |
| Z25166_T9 (SEQ ID NO: 4671) | 411 | 563 |
| Z25166_T10 (SEQ ID NO: 4672) | 411 | 563 |

This segment can be found in both coding and non-coding regions of transcript(s) as follows. The segment can be found in a non-coding region of transcript(s) that are related to the following protein(s): Z25166_P4. This segment can also be found in the following protein(s): Z25166_P2 and Z25166_P3, since it is in the coding region for the corresponding transcript.

Segment cluster Z25166_node__16 (SEQ ID NO:4676) according to the present invention is supported by 5 libraries. The number of libraries was determined as previously described. This segment can be found in the following transcript(s): Z25166_T2 (SEQ ID NO:4670) and Z25166_T10 (SEQ ID NO:4672). Table 4051 below describes the starting and ending position of this segment on each transcript.

TABLE 4051

Segment location on transcripts

| Transcript name | Segment starting position | Segment ending position |
|---|---|---|
| Z25166_T2 (SEQ ID NO: 4670) | 686 | 1509 |
| Z25166_T10 (SEQ ID NO: 4672) | 564 | 1387 |

This segment can be found in both coding and non-coding regions of transcript(s) as follows. The segment can be found in a non-coding region of transcript(s) that are related to the following protein(s): Z25166_P4. This segment can also be found in the following protein(s): Z25166_P2, since it is in the coding region for the corresponding transcript.

Segment cluster Z25166_node__21 (SEQ ID NO:4677) according to the present invention is supported by 146 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4052 below describes the starting and ending position of this segment on each transcript.

TABLE 4052

Segment location on transcripts

| Transcript name | Segment starting position | Segment ending position |
|---|---|---|
| Z25166_T2 (SEQ ID NO: 4670) | 1660 | 2037 |
| Z25166_T9 (SEQ ID NO: 4671) | 714 | 1091 |
| Z25166_T10 (SEQ ID NO: 4672) | 1538 | 1915 |

This segment can be found in both coding and non-coding regions of transcript(s) as follows. The segment can be found in a non-coding region of transcript(s) that are related to the following protein(s): Z25166_P2. This segment can also be found in the following protein(s): Z25166_P3 and Z25166_P4, since it is in the coding region for the corresponding transcript.

Segment cluster Z25166_node__23 (SEQ ID NO:4678) according to the present invention is supported by 198 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4053 below describes the starting and ending position of this segment on each transcript.

TABLE 4053

Segment location on transcripts

| Transcript name | Segment starting position | Segment ending position |
|---|---|---|
| Z25166_T2 (SEQ ID NO: 4670) | 2038 | 2920 |
| Z25166_T9 (SEQ ID NO: 4671) | 1092 | 1974 |
| Z25166_T10 (SEQ ID NO: 4672) | 1916 | 2798 |

This segment can be found in a non-coding region of transcript(s) that are related to the following protein(s): Z25166_P2, Z25166_P3 and Z25166_P4.

Segment cluster Z25166_node__24 (SEQ ID NO:4679) according to the present invention is supported by 41 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4054 below describes the starting and ending position of this segment on each transcript.

TABLE 4054

Segment location on transcripts

| Transcript name | Segment starting position | Segment ending position |
|---|---|---|
| Z25166_T2 (SEQ ID NO: 4670) | 2921 | 3163 |
| Z25166_T9 (SEQ ID NO: 4671) | 1975 | 2217 |
| Z25166_T10 (SEQ ID NO: 4672) | 2799 | 3041 |

This segment can be found in a non-coding region of transcript(s) that are related to the following protein(s): Z25166_P2, Z25166_P3 and Z25166_P4.

Segment cluster Z25166_node__25 (SEQ ID NO:4680) according to the present invention is supported by 56 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4055 below describes the starting and ending position of this segment on each transcript.

TABLE 4055

Segment location on transcripts

| Transcript name | Segment starting position | Segment ending position |
|---|---|---|
| Z25166_T2 (SEQ ID NO: 4670) | 3164 | 3475 |
| Z25166_T9 (SEQ ID NO: 4671) | 2218 | 2529 |
| Z25166_T10 (SEQ ID NO: 4672) | 3042 | 3353 |

This segment can be found in a non-coding region of transcript(s) that are related to the following protein(s): Z25166_P2, Z25166_P3 and Z25166_P4.

Segment cluster Z25166_node__26 (SEQ ID NO:4681) according to the present invention is supported by 116 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4056 below describes the starting and ending position of this segment on each transcript.

TABLE 4056

Segment location on transcripts

| Transcript name | Segment starting position | Segment ending position |
|---|---|---|
| Z25166_T2 (SEQ ID NO: 4670) | 3476 | 4198 |
| Z25166_T9 (SEQ ID NO: 4671) | 2530 | 3252 |
| Z25166_T10 (SEQ ID NO: 4672) | 3354 | 4076 |

This segment can be found in a non-coding region of transcript(s) that are related to the following protein(s): Z25166_P2, Z25166_P3 and Z25166_P4.

Segment cluster Z25166_node_28 (SEQ ID NO:4682) according to the present invention is supported by 316 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4057 below describes the starting and ending position of this segment on each transcript.

TABLE 4057

Segment location on transcripts

| Transcript name | Segment starting position | Segment ending position |
|---|---|---|
| Z25166_T2 (SEQ ID NO: 4670) | 4199 | 5614 |
| Z25166_T9 (SEQ ID NO: 4671) | 3253 | 4668 |
| Z25166_T10 (SEQ ID NO: 4672) | 4077 | 5492 |

This segment can be found in a non-coding region of transcript(s) that are related to the following protein(s): Z25166_P2, Z25166_P3 and Z25166_P4.

Segment cluster Z25166_node_29 (SEQ ID NO:4683) according to the present invention is supported by 203 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4058 below describes the starting and ending position of this segment on each transcript.

TABLE 4058

Segment location on transcripts

| Transcript name | Segment starting position | Segment ending position |
|---|---|---|
| Z25166_T2 (SEQ ID NO: 4670) | 5615 | 5882 |
| Z25166_T9 (SEQ ID NO: 4671) | 4669 | 4936 |
| Z25166_T10 (SEQ ID NO: 4672) | 5493 | 5760 |

This segment can be found in a non-coding region of transcript(s) that are related to the following protein(s): Z25166_P2, Z25166_P3 and Z25166_P4.

Segment cluster Z25166_node_30 (SEQ ID NO:4684) according to the present invention is supported by 223 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4059 below describes the starting and ending position of this segment on each transcript.

TABLE 4059

Segment location on transcripts

| Transcript name | Segment starting position | Segment ending position |
|---|---|---|
| Z25166_T2 (SEQ ID NO: 4670) | 5883 | 6041 |
| Z25166_T9 (SEQ ID NO: 4671) | 4937 | 5095 |
| Z25166_T10 (SEQ ID NO: 4672) | 5761 | 5919 |

This segment can be found in a non-coding region of transcript(s) that are related to the following protein(s): Z25166_P2, Z25166_P3 and Z25166_P4.

Segment cluster Z25166_node_35 (SEQ ID NO:4685) according to the present invention is supported by 298 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4060 below describes the starting and ending position of this segment on each transcript.

TABLE 4060

Segment location on transcripts

| Transcript name | Segment starting position | Segment ending position |
|---|---|---|
| Z25166_T2 (SEQ ID NO: 4670) | 6222 | 6495 |
| Z25166_T9 (SEQ ID NO: 4671) | 5276 | 5549 |
| Z25166_T10 (SEQ ID NO: 4672) | 6100 | 6373 |

This segment can be found in a non-coding region of transcript(s) that are related to the following protein(s): Z25166_P2, Z25166_P3 and Z25166_P4.

Segment cluster Z25166_node_44 (SEQ ID NO:4686) according to the present invention is supported by 198 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4061 below describes the starting and ending position of this segment on each transcript.

TABLE 4061

Segment location on transcripts

| Transcript name | Segment starting position | Segment ending position |
|---|---|---|
| Z25166_T2 (SEQ ID NO: 4670) | 6791 | 6946 |
| Z25166_T9 (SEQ ID NO: 4671) | 5845 | 6000 |
| Z25166_T10 (SEQ ID NO: 4672) | 6669 | 6824 |

This segment can be found in a non-coding region of transcript(s) that are related to the following protein(s): Z25166_P2, Z25166_P3 and Z25166_P4.

According to an optional embodiment of the present invention, short segments related to the above cluster are also provided. These segments are up to about 120 bp in length, and so are included in a separate description.

Segment cluster Z25166_node_1 (SEQ ID NO:4687) according to the present invention can be found in the following transcript(s): Z25166_T2 (SEQ ID NO:4670). Table 4062 below describes the starting and ending position of this segment on each transcript.

TABLE 4062

Segment location on transcripts

| Transcript name | Segment starting position | Segment ending position |
|---|---|---|
| Z25166_T2 (SEQ ID NO: 4670) | 184 | 196 |

This segment can be found in a non-coding region of transcript(s) that are related to the following protein(s): Z25166_P2.

Segment cluster Z25166_node_2 (SEQ ID NO:4688) according to the present invention can be found in the following transcript(s): Z25166_T2 (SEQ ID NO:4670). Table 4063 below describes the starting and ending position of this segment on each transcript.

TABLE 4063

Segment location on transcripts

| Transcript name | Segment starting position | Segment ending position |
|---|---|---|
| Z25166_T2 (SEQ ID NO: 4670) | 197 | 217 |

This segment can be found in a non-coding region of transcript(s) that are related to the following protein(s): Z25166_P2.

Segment cluster Z25166_node_3 (SEQ ID NO:4689) according to the present invention is supported by 199 libraries. The number of libraries was determined as previously described. This segment can be found in the following transcript(s): Z25166_T2 (SEQ ID NO:4670). Table 4064 below describes the starting and ending position of this segment on each transcript.

TABLE 4064

Segment location on transcripts

| Transcript name | Segment starting position | Segment ending position |
|---|---|---|
| Z25166_T2 (SEQ ID NO: 4670) | 218 | 320 |

This segment can be found in the following protein(s): Z25166_P2.

Segment cluster Z25166_node_5 (SEQ ID NO:4690) according to the present invention can be found in the following transcript(s): Z25166_T2 (SEQ ID NO:4670). Table 4065 below describes the starting and ending position of this segment on each transcript.

TABLE 4065

Segment location on transcripts

| Transcript name | Segment starting position | Segment ending position |
|---|---|---|
| Z25166_T2 (SEQ ID NO: 4670) | 321 | 342 |

This segment can be found in the following protein(s): Z25166_P2.

Segment cluster Z25166_node_7 (SEQ ID NO:4691) according to the present invention is supported by 189 libraries. The number of libraries was determined as previously described. This segment can be found in the following transcript(s): Z25166_T2 (SEQ ID NO:4670). Table 4066 below describes the starting and ending position of this segment on each transcript.

TABLE 4066

Segment location on transcripts

| Transcript name | Segment starting position | Segment ending position |
|---|---|---|
| Z25166_T2 (SEQ ID NO: 4670) | 343 | 370 |

This segment can be found in the following protein(s): Z25166_P2.

Segment cluster Z25166_node_9 (SEQ ID NO:4692) according to the present invention is supported by 192 libraries. The number of libraries was determined as previously described. This segment can be found in the following transcript(s): Z25166_T2 (SEQ ID NO:4670). Table 4067 below describes the starting and ending position of this segment on each transcript.

TABLE 4067

Segment location on transcripts

| Transcript name | Segment starting position | Segment ending position |
|---|---|---|
| Z25166_T2 (SEQ ID NO: 4670) | 371 | 476 |

This segment can be found in the following protein(s): Z25166_P2.

Segment cluster Z25166_node_12 (SEQ ID NO:4693) according to the present invention is supported by 187 libraries. The number of libraries was determined as previously described. This segment can be found in the following transcript(s): Z25166_T2 (SEQ ID NO:4670). Table 4068 below describes the starting and ending position of this segment on each transcript.

TABLE 4068

Segment location on transcripts

| Transcript name | Segment starting position | Segment ending position |
|---|---|---|
| Z25166_T2 (SEQ ID NO: 4670) | 477 | 532 |

This segment can be found in the following protein(s): Z25166_P2.

Segment cluster Z25166_node_17 (SEQ ID NO:4694) according to the present invention is supported by 168 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4069 below describes the starting and ending position of this segment on each transcript.

TABLE 4069

Segment location on transcripts

| Transcript name | Segment starting position | Segment ending position |
|---|---|---|
| Z25166_T2 (SEQ ID NO: 4670) | 1510 | 1548 |
| Z25166_T9 (SEQ ID NO: 4671) | 564 | 602 |
| Z25166_T10 (SEQ ID NO: 4672) | 1388 | 1426 |

This segment can be found in both coding and non-coding regions of transcript(s) as follows. The segment can be found in a non-coding region of transcript(s) that are related to the following protein(s): Z25166_P2. This segment can also be found in the following protein(s): Z25166_P3 and Z25166_P4, since it is in the coding region for the corresponding transcript.

Segment cluster Z25166_node_18 (SEQ ID NO:4695) according to the present invention can be found in the following transcript(s): Z25166_T2 (SEQ ID NO:4670), Z25166_T9 (SEQ ID NO:4671) and Z25166_T10 (SEQ ID NO:4672). Table 4070 below describes the starting and ending position of this segment on each transcript.

TABLE 4070

Segment location on transcripts

| Transcript name | Segment starting position | Segment ending position |
|---|---|---|
| Z25166_T2 (SEQ ID NO: 4670) | 1549 | 1561 |
| Z25166_T9 (SEQ ID NO: 4671) | 603 | 615 |
| Z25166_T10 (SEQ ID NO: 4672) | 1427 | 1439 |

This segment can be found in both coding and non-coding regions of transcript(s) as follows. The segment can be found in a non-coding region of transcript(s) that are related to the following protein(s): Z25166_P2. This segment can also be found in the following protein(s): Z25166_P3 and Z25166_P4, since it is in the coding region for the corresponding transcript.

Segment cluster Z25166_node_19 (SEQ ID NO:4696) according to the present invention is supported by 179 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4071 below describes the starting and ending position of this segment on each transcript.

TABLE 4071

Segment location on transcripts

| Transcript name | Segment starting position | Segment ending position |
|---|---|---|
| Z25166_T2 (SEQ ID NO: 4670) | 1562 | 1659 |
| Z25166_T9 (SEQ ID NO: 4671) | 616 | 713 |
| Z25166_T10 (SEQ ID NO: 4672) | 1440 | 1537 |

This segment can be found in both coding and non-coding regions of transcript(s) as follows. The segment can be found in a non-coding region of transcript(s) that are related to the following protein(s): Z25166_P2. This segment can also be found in the following protein(s): Z25166_P3 and Z25166_P4, since it is in the coding region for the corresponding transcript.

Segment cluster Z25166_node_31 (SEQ ID NO:4697) according to the present invention is supported by 197 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4072 below describes the starting and ending position of this segment on each transcript.

TABLE 4072

Segment location on transcripts

| Transcript name | Segment starting position | Segment ending position |
|---|---|---|
| Z25166_T2 (SEQ ID NO: 4670) | 6042 | 6092 |
| Z25166_T9 (SEQ ID NO: 4671) | 5096 | 5146 |
| Z25166_T10 (SEQ ID NO: 4672) | 5920 | 5970 |

This segment can be found in a non-coding region of transcript(s) that are related to the following protein(s): Z25166_P2, Z25166_P3 and Z25166_P4.

Segment cluster Z25166_node_33 (SEQ ID NO:4698) according to the present invention is supported by 205 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4073 below describes the starting and ending position of this segment on each transcript.

TABLE 4073

Segment location on transcripts

| Transcript name | Segment starting position | Segment ending position |
|---|---|---|
| Z25166_T2 (SEQ ID NO: 4670) | 6093 | 6127 |
| Z25166_T9 (SEQ ID NO: 4671) | 5147 | 5181 |
| Z25166_T10 (SEQ ID NO: 4672) | 5971 | 6005 |

This segment can be found in a non-coding region of transcript(s) that are related to the following protein(s): Z25166_P2, Z25166_P3 and Z25166_P4.

Segment cluster Z25166_node_34 (SEQ ID NO:4699) according to the present invention is supported by 227 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4074 below describes the starting and ending position of this segment on each transcript.

TABLE 4074

Segment location on transcripts

| Transcript name | Segment starting position | Segment ending position |
|---|---|---|
| Z25166_T2 (SEQ ID NO: 4670) | 6128 | 6221 |
| Z25166_T9 (SEQ ID NO: 4671) | 5182 | 5275 |
| Z25166_T10 (SEQ ID NO: 4672) | 6006 | 6099 |

This segment can be found in a non-coding region of transcript(s) that are related to the following protein(s): Z25166_P2, Z25166_P3 and Z25166_P4.

Segment cluster Z25166_node_36 (SEQ ID NO:4700) according to the present invention is supported by 246 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4075 below describes the starting and ending position of this segment on each transcript.

TABLE 4075

Segment location on transcripts

| Transcript name | Segment starting position | Segment ending position |
|---|---|---|
| Z25166_T2 (SEQ ID NO: 4670) | 6496 | 6563 |
| Z25166_T9 (SEQ ID NO: 4671) | 5550 | 5617 |
| Z25166_T10 (SEQ ID NO: 4672) | 6374 | 6441 |

This segment can be found in a non-coding region of transcript(s) that are related to the following protein(s): Z25166_P2, Z25166_P3 and Z25166_P4.

Segment cluster Z25166_node_37 (SEQ ID NO:4701) according to the present invention is supported by 258 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4076 below describes the starting and ending position of this segment on each transcript.

TABLE 4076

Segment location on transcripts

| Transcript name | Segment starting position | Segment ending position |
|---|---|---|
| Z25166_T2 (SEQ ID NO: 4670) | 6564 | 6643 |
| Z25166_T9 (SEQ ID NO: 4671) | 5618 | 5697 |
| Z25166_T10 (SEQ ID NO: 4672) | 6442 | 6521 |

This segment can be found in a non-coding region of transcript(s) that are related to the following protein(s): Z25166_P2, Z25166_P3 and Z25166_P4.

Segment cluster Z25166_node_38 (SEQ ID NO:4702) according to the present invention can be found in the following transcript(s): Z25166_T2 (SEQ ID NO:4670), Z25166_T9 (SEQ ID NO:4671) and Z25166_T10 (SEQ ID NO:4672). Table 4077 below describes the starting and ending position of this segment on each transcript.

TABLE 4077

Segment location on transcripts

| Transcript name | Segment starting position | Segment ending position |
|---|---|---|
| Z25166_T2 (SEQ ID NO: 4670) | 6644 | 6661 |
| Z25166_T9 (SEQ ID NO: 4671) | 5698 | 5715 |
| Z25166_T10 (SEQ ID NO: 4672) | 6522 | 6539 |

This segment can be found in a non-coding region of transcript(s) that are related to the following protein(s): Z25166_P2, Z25166_P3 and Z25166_P4.

Segment cluster Z25166_node_40 (SEQ ID NO:4703) according to the present invention can be found in the following transcript(s): Z25166_T2 (SEQ ID NO:4670), Z25166_T9 (SEQ ID NO:4671) and Z25166_T10 (SEQ ID NO:4672). Table 4078 below describes the starting and ending position of this segment on each transcript.

TABLE 4078

Segment location on transcripts

| Transcript name | Segment starting position | Segment ending position |
|---|---|---|
| Z25166_T2 (SEQ ID NO: 4670) | 6662 | 6686 |
| Z25166_T9 (SEQ ID NO: 4671) | 5716 | 5740 |
| Z25166_T10 (SEQ ID NO: 4672) | 6540 | 6564 |

This segment can be found in a non-coding region of transcript(s) that are related to the following protein(s): Z25166_P2, Z25166_P3 and Z25166_P4.

Segment cluster Z25166_node_41 (SEQ ID NO:4704) according to the present invention is supported by 225 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4079 below describes the starting and ending position of this segment on each transcript.

TABLE 4079

Segment location on transcripts

| Transcript name | Segment starting position | Segment ending position |
|---|---|---|
| Z25166_T2 (SEQ ID NO: 4670) | 6687 | 6717 |
| Z25166_T9 (SEQ ID NO: 4671) | 5741 | 5771 |
| Z25166_T10 (SEQ ID NO: 4672) | 6565 | 6595 |

This segment can be found in a non-coding region of transcript(s) that are related to the following protein(s): Z25166_P2, Z25166_P3 and Z25166_P4.

Segment cluster Z25166_node_42 (SEQ ID NO:4705) according to the present invention is supported by 216 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4080 below describes the starting and ending position of this segment on each transcript.

TABLE 4080

Segment location on transcripts

| Transcript name | Segment starting position | Segment ending position |
|---|---|---|
| Z25166_T2 (SEQ ID NO: 4670) | 6718 | 6750 |
| Z25166_T9 (SEQ ID NO: 4671) | 5772 | 5804 |
| Z25166_T10 (SEQ ID NO: 4672) | 6596 | 6628 |

This segment can be found in a non-coding region of transcript(s) that are related to the following protein(s): Z25166_P2, Z25166_P3 and Z25166_P4.

Segment cluster Z25166_node_43 (SEQ ID NO:4706) according to the present invention is supported by 207 libraries. The number of libraries was determined as previously described. This segment can be found in the following transcript(s): Z25166_T2 (SEQ ID NO:4670), Z25166_T9 (SEQ ID NO:4671) and Z25166_T10 (SEQ ID NO:4672). Table 4081 below describes the starting and ending position of this segment on each transcript.

TABLE 4081

Segment location on transcripts

| Transcript name | Segment starting position | Segment ending position |
|---|---|---|
| Z25166_T2 (SEQ ID NO: 4670) | 6751 | 6790 |
| Z25166_T9 (SEQ ID NO: 4671) | 5805 | 5844 |
| Z25166_T10 (SEQ ID NO: 4672) | 6629 | 6668 |

This segment can be found in a non-coding region of transcript(s) that are related to the following protein(s): Z25166_P2, Z25166_P3 and Z25166_P4.

Description for Cluster Z40494

Cluster Z40494 features 2 transcript(s) and 22 segment(s) of interest, the names for which are given in Tables 4082 and 4083, respectively, the sequences themselves are given at the end of the application. The selected protein variants are given in Table 4084.

TABLE 4082

Transcripts of interest

Transcript Name

Z40494_T1 (SEQ ID NO: 4707)
Z40494_T11 (SEQ ID NO: 4708)

TABLE 4083

Segments of interest

Segment Name

Z40494_node_0 (SEQ ID NO: 4709)
Z40494_node_2 (SEQ ID NO: 4710)
Z40494_node_11 (SEQ ID NO: 4711)
Z40494_node_12 (SEQ ID NO: 4712)
Z40494_node_16 (SEQ ID NO: 4713)
Z40494_node_19 (SEQ ID NO: 4714)
Z40494_node_20 (SEQ ID NO: 4715)
Z40494_node_21 (SEQ ID NO: 4716)
Z40494_node_22 (SEQ ID NO: 4717)
Z40494_node_24 (SEQ ID NO: 4718)
Z40494_node_1 (SEQ ID NO: 4719)
Z40494_node_3 (SEQ ID NO: 4720)
Z40494_node_4 (SEQ ID NO: 4721)
Z40494_node_6 (SEQ ID NO: 4722)
Z40494_node_8 (SEQ ID NO: 4723)
Z40494_node_13 (SEQ ID NO: 4724)
Z40494_node_14 (SEQ ID NO: 4725)
Z40494_node_17 (SEQ ID NO: 4726)
Z40494_node_18 (SEQ ID NO: 4727)
Z40494_node_23 (SEQ ID NO: 4728)
Z40494_node_26 (SEQ ID NO: 4729)
Z40494_node_28 (SEQ ID NO: 4730)

TABLE 4084

Proteins of interest

| Protein Name | Corresponding Transcript(s) |
|---|---|
| Z40494_P2 | Z40494_T1 (SEQ ID NO: 4707); Z40494_T11 (SEQ ID NO: 4708) |

Cluster Z40494 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 101 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 101 and Table 4085. This cluster is overexpressed (at least at a minimum level) in the following pathological conditions: brain malignant tumors, epithelial malignant tumors, a mixture of malignant tumors from different tissues, malignant tumors involving the lymph nodes, myosarcoma, pancreas carcinoma and skin malignancies.

TABLE 4085

Normal tissue distribution

| Name of Tissue | Number |
|---|---|
| bladder | 0 |
| bone | 0 |
| brain | 10 |
| colon | 0 |
| epithelial | 9 |
| general | 11 |
| head and neck | 0 |
| kidney | 0 |
| liver | 0 |
| lung | 32 |
| lymph nodes | 11 |
| breast | 0 |
| bone marrow | 0 |
| muscle | 1 |
| ovary | 0 |
| pancreas | 0 |
| prostate | 40 |
| skin | 0 |
| stomach | 0 |
| uterus | 0 |

TABLE 4086

P values and ratios for expression in cancerous tissue

| Name of Tissue | P1 | P2 | SP1 | R3 | SP2 | R4 |
|---|---|---|---|---|---|---|
| bladder | 5.4e-01 | 6.0e-01 | 1.8e-01 | 2.5 | 3.2e-01 | 1.9 |
| bone | 1 | 2.8e-01 | 1 | 1.0 | 1.7e-01 | 2.8 |
| brain | 3.9e-01 | 9.4e-02 | 6.3e-01 | 1.3 | 1.7e-08 | 5.2 |
| colon | 9.7e-02 | 7.4e-02 | 1.2e-01 | 3.2 | 3.4e-02 | 3.7 |
| epithelial | 3.1e-02 | 2.0e-05 | 1.6e-02 | 2.4 | 1.0e-12 | 6.4 |
| general | 1.6e-03 | 3.1e-11 | 6.3e-03 | 2.0 | 1.6e-32 | 6.8 |
| head and neck | 2.1e-01 | 3.3e-01 | 0.0e+00 | 0.0 | 0.0e+00 | 0.0 |
| kidney | 1 | 3.5e-01 | 1 | 1.0 | 4.9e-01 | 1.9 |
| liver | 1 | 6.8e-01 | 1 | 1.0 | 2.3e-01 | 1.9 |
| lung | 9.0e-01 | 8.4e-01 | 1 | 0.2 | 3.4e-01 | 1.1 |
| lymph nodes | 2.0e-01 | 1.6e-02 | 2.9e-01 | 2.8 | 2.9e-05 | 4.1 |
| breast | 8.0e-01 | 3.0e-01 | 6.9e-01 | 1.7 | 1.4e-01 | 2.2 |
| bone marrow | 1 | 6.7e-01 | 1 | 1.0 | 5.3e-01 | 2.4 |
| muscle | 9.2e-01 | 4.8e-01 | 1 | 0.9 | 1.4e-03 | 3.7 |
| ovary | 2.2e-01 | 9.4e-02 | 2.2e-01 | 2.9 | 9.1e-02 | 3.4 |
| pancreas | 1 | 1.8e-01 | 1 | 1.0 | 6.6e-05 | 4.6 |
| prostate | 9.7e-01 | 9.3e-01 | 1 | 0.3 | 9.5e-01 | 0.6 |
| skin | 2.3e-01 | 2.3e-01 | 1.4e-01 | 7.0 | 2.4e-05 | 6.0 |
| stomach | 3.6e-01 | 1.6e-01 | 1 | 1.0 | 4.1e-01 | 2.0 |
| uterus | 2.1e-01 | 2.4e-02 | 2.9e-01 | 2.5 | 2.3e-02 | 4.3 |

As noted above, cluster Z40494 features 22 segment(s), which were listed in Table 4083 above and for which the sequence(s) are given at the end of the application. These segment(s) are portions of nucleic acid sequence(s) which are described herein separately because they are of particular interest. A description of each segment according to the present invention is now provided.

Segment cluster Z40494_node_0 (SEQ ID NO:4709) according to the present invention is supported by 53 libraries. The number of libraries was determined as previously described. This segment can be found in the following transcript(s): Z40494_T1 (SEQ ID NO:4707) and Z40494_T11 (SEQ ID NO:4708). Table 4087 below describes the starting and ending position of this segment on each transcript.

TABLE 4087

| | Segment location on transcripts | |
|---|---|---|
| Transcript name | Segment starting position | Segment ending position |
| Z40494_T1 (SEQ ID NO: 4707) | 1 | 218 |
| Z40494_T11 (SEQ ID NO: 4708) | 1 | 218 |

This segment can be found in the following protein(s): Z40494_P2.

Segment cluster Z40494_node_2 (SEQ ID NO:4710) according to the present invention is supported by 10 libraries. The number of libraries was determined as previously described. This segment can be found in the following transcript(s): Z40494_T1 (SEQ ID NO:4707) and Z40494_T11 (SEQ ID NO:4708). Table 4088 below describes the starting and ending position of this segment on each transcript.

TABLE 4088

| | Segment location on transcripts | |
|---|---|---|
| Transcript name | Segment starting position | Segment ending position |
| Z40494_T1 (SEQ ID NO: 4707) | 248 | 427 |
| Z40494_T11 (SEQ ID NO: 4708) | 248 | 427 |

This segment can be found in the following protein(s): Z40494_P2.

Segment cluster Z40494_node_11 (SEQ ID NO:4711) according to the present invention is supported by 67 libraries. The number of libraries was determined as previously described. This segment can be found in the following transcript(s): Z40494_T1 (SEQ ID NO:4707). Table 4089 below describes the starting and ending position of this segment on each transcript.

TABLE 4089

| | Segment location on transcripts | |
|---|---|---|
| Transcript name | Segment starting position | Segment ending position |
| Z40494_T1 (SEQ ID NO: 4707) | 625 | 862 |

This segment can be found in a non-coding region of transcript(s) that are related to the following protein(s): Z40494_P2.

Segment cluster Z40494_node_12 (SEQ ID NO:4712) according to the present invention is supported by 63 libraries. The number of libraries was determined as previously described. This segment can be found in the following transcript(s): Z40494_T1 (SEQ ID NO:4707). Table 4090 below describes the starting and ending position of this segment on each transcript.

TABLE 4090

| | Segment location on transcripts | |
|---|---|---|
| Transcript name | Segment starting position | Segment ending position |
| Z40494_T1 (SEQ ID NO: 4707) | 863 | 997 |

This segment can be found in a non-coding region of transcript(s) that are related to the following protein(s): Z40494_P2.

Segment cluster Z40494_node_16 (SEQ ID NO:4713) according to the present invention is supported by 59 libraries. The number of libraries was determined as previously described. This segment can be found in the following transcript(s): Z40494_T1 (SEQ ID NO:4707). Table 4091 below describes the starting and ending position of this segment on each transcript.

TABLE 4091

| | Segment location on transcripts | |
|---|---|---|
| Transcript name | Segment starting position | Segment ending position |
| Z40494_T1 (SEQ ID NO: 4707) | 1060 | 1200 |

This segment can be found in a non-coding region of transcript(s) that are related to the following protein(s): Z40494_P2.

Segment cluster Z40494_node_19 (SEQ ID NO:4714) according to the present invention is supported by 58 libraries. The number of libraries was determined as previously described. This segment can be found in the following transcript(s): Z40494_T1 (SEQ ID NO:4707). Table 4092 below describes the starting and ending position of this segment on each transcript.

TABLE 4092

| | Segment location on transcripts | |
|---|---|---|
| Transcript name | Segment starting position | Segment ending position |
| Z40494_T1 (SEQ ID NO: 4707) | 1291 | 1561 |

This segment can be found in a non-coding region of transcript(s) that are related to the following protein(s): Z40494_P2.

Segment cluster Z40494_node_20 (SEQ ID NO:4715) according to the present invention is supported by 51 libraries. The number of libraries was determined as previously described. This segment can be found in the following transcript(s): Z40494_T1 (SEQ ID NO:4707). Table 4093 below describes the starting and ending position of this segment on each transcript.

TABLE 4093

| | Segment location on transcripts | |
|---|---|---|
| Transcript name | Segment starting position | Segment ending position |
| Z40494_T1 (SEQ ID NO: 4707) | 1562 | 1735 |

This segment can be found in a non-coding region of transcript(s) that are related to the following protein(s): Z40494_P2.

Segment cluster Z40494_node_21 (SEQ ID NO:4716) according to the present invention is supported by 94 libraries. The number of libraries was determined as previously described. This segment can be found in the following transcript(s): Z40494_T1 (SEQ ID NO:4707). Table 4094 below describes the starting and ending position of this segment on each transcript.

TABLE 4094

| Segment location on transcripts | | |
|---|---|---|
| Transcript name | Segment starting position | Segment ending position |
| Z40494_T1 (SEQ ID NO: 4707) | 1736 | 2292 |

This segment can be found in a non-coding region of transcript(s) that are related to the following protein(s): Z40494_P2.

Segment cluster Z40494_node_22 (SEQ ID NO:4717) according to the present invention is supported by 104 libraries. The number of libraries was determined as previously described. This segment can be found in the following transcript(s): Z40494_T1 (SEQ ID NO:4707). Table 4095 below describes the starting and ending position of this segment on each transcript.

TABLE 4095

| Segment location on transcripts | | |
|---|---|---|
| Transcript name | Segment starting position | Segment ending position |
| Z40494_T1 (SEQ ID NO: 4707) | 2293 | 2467 |

This segment can be found in a non-coding region of transcript(s) that are related to the following protein(s): Z40494_P2.

Segment cluster Z40494_node_24 (SEQ ID NO:4718) according to the present invention is supported by 104 libraries. The number of libraries was determined as previously described. This segment can be found in the following transcript(s): Z40494_T1 (SEQ ID NO:4707). Table 4096 below describes the starting and ending position of this segment on each transcript.

TABLE 4096

| Segment location on transcripts | | |
|---|---|---|
| Transcript name | Segment starting position | Segment ending position |
| Z40494_T1 (SEQ ID NO: 4707) | 2527 | 2799 |

This segment can be found in a non-coding region of transcript(s) that are related to the following protein(s): Z40494_P2.

According to an optional embodiment of the present invention, short segments related to the above cluster are also provided. These segments are up to about 120 bp in length, and so are included in a separate description.

Segment cluster Z40494_node_1 (SEQ ID NO:4719) according to the present invention is supported by 8 libraries. The number of libraries was determined as previously described. This segment can be found in the following transcript(s): Z40494_T1 (SEQ ID NO:4707) and Z40494_T11 (SEQ ID NO:4708). Table 4097 below describes the starting and ending position of this segment on each transcript.

TABLE 4097

| Segment location on transcripts | | |
|---|---|---|
| Transcript name | Segment starting position | Segment ending position |
| Z40494_T1 (SEQ ID NO: 4707) | 219 | 247 |
| Z40494_T11 (SEQ ID NO: 4708) | 219 | 247 |

This segment can be found in the following protein(s): Z40494_P2.

Segment cluster Z40494_node_3 (SEQ ID NO:4720) according to the present invention can be found in the following transcript(s): Z40494_T1 (SEQ ID NO:4707) and Z40494_T11 (SEQ ID NO:4708). Table 4098 below describes the starting and ending position of this segment on each transcript.

TABLE 4098

| Segment location on transcripts | | |
|---|---|---|
| Transcript name | Segment starting position | Segment ending position |
| Z40494_T1 (SEQ ID NO: 4707) | 428 | 434 |
| Z40494_T11 (SEQ ID NO: 4708) | 428 | 434 |

This segment can be found in the following protein(s): Z40494_P2.

Segment cluster Z40494_node_4 (SEQ ID NO:4721) according to the present invention is supported by 59 libraries. The number of libraries was determined as previously described. This segment can be found in the following transcript(s): Z40494_T1 (SEQ ID NO:4707) and Z40494_T11 (SEQ ID NO:4708). Table 4099 below describes the starting and ending position of this segment on each transcript.

TABLE 4099

| Segment location on transcripts | | |
|---|---|---|
| Transcript name | Segment starting position | Segment ending position |
| Z40494_T1 (SEQ ID NO: 4707) | 435 | 522 |
| Z40494_T11 (SEQ ID NO: 4708) | 435 | 522 |

This segment can be found in the following protein(s): Z40494_P2.

Segment cluster Z40494_node_6 (SEQ ID NO:4722) according to the present invention is supported by 61 libraries. The number of libraries was determined as previously described. This segment can be found in the following transcript(s): Z40494_T1 (SEQ ID NO:4707) and Z40494_T11 (SEQ ID NO:4708). Table 4100 below describes the starting and ending position of this segment on each transcript.

TABLE 4100

Segment location on transcripts

| Transcript name | Segment starting position | Segment ending position |
|---|---|---|
| Z40494_T1 (SEQ ID NO: 4707) | 523 | 588 |
| Z40494_T11 (SEQ ID NO: 4708) | 523 | 588 |

This segment can be found in the following protein(s): Z40494_P2.

Segment cluster Z40494_node_8 (SEQ ID NO:4723) according to the present invention is supported by 61 libraries. The number of libraries was determined as previously described. This segment can be found in the following transcript(s): Z40494_T1 (SEQ ID NO:4707) and Z40494_T11 (SEQ ID NO:4708). Table 4101 below describes the starting and ending position of this segment on each transcript.

TABLE 4101

Segment location on transcripts

| Transcript name | Segment starting position | Segment ending position |
|---|---|---|
| Z40494_T1 (SEQ ID NO: 4707) | 589 | 624 |
| Z40494_T11 (SEQ ID NO: 4708) | 589 | 624 |

This segment can be found in a non-coding region of transcript(s) that are related to the following protein(s): Z40494_P2.

Segment cluster Z40494_node_13 (SEQ ID NO:4724) according to the present invention can be found in the following transcript(s): Z40494_T1 (SEQ ID NO:4707). Table 4102 below describes the starting and ending position of this segment on each transcript.

TABLE 4102

Segment location on transcripts

| Transcript name | Segment starting position | Segment ending position |
|---|---|---|
| Z40494_T1 (SEQ ID NO: 4707) | 998 | 1008 |

This segment can be found in a non-coding region of transcript(s) that are related to the following protein(s): Z40494_P2.

Segment cluster Z40494_node_14 (SEQ ID NO:4725) according to the present invention is supported by 54 libraries. The number of libraries was determined as previously described. This segment can be found in the following transcript(s): Z40494_T1 (SEQ ID NO:4707). Table 4103 below describes the starting and ending position of this segment on each transcript.

TABLE 4103

Segment location on transcripts

| Transcript name | Segment starting position | Segment ending position |
|---|---|---|
| Z40494_T1 (SEQ ID NO: 4707) | 1009 | 1059 |

This segment can be found in a non-coding region of transcript(s) that are related to the following protein(s): Z40494_P2.

Segment cluster Z40494_node_17 (SEQ ID NO:4726) according to the present invention is supported by 41 libraries. The number of libraries was determined as previously described. This segment can be found in the following transcript(s): Z40494_T1 (SEQ ID NO:4707). Table 4104 below describes the starting and ending position of this segment on each transcript.

TABLE 4104

Segment location on transcripts

| aTranscript name | Segment starting position | Segment ending position |
|---|---|---|
| Z40494_T1 (SEQ ID NO: 4707) | 1201 | 1229 |

This segment can be found in a non-coding region of transcript(s) that are related to the following protein(s): Z40494_P2.

Segment cluster Z40494_node_18 (SEQ ID NO:4727) according to the present invention is supported by 43 libraries. The number of libraries was determined as previously described. This segment can be found in the following transcript(s): Z40494_T1 (SEQ ID NO:4707). Table 4105 below describes the starting and ending position of this segment on each transcript.

TABLE 4105

Segment location on transcripts

| Transcript name | Segment starting position | Segment ending position |
|---|---|---|
| Z40494_T1 (SEQ ID NO: 4707) | 1230 | 1290 |

This segment can be found in a non-coding region of transcript(s) that are related to the following protein(s): Z40494_P2.

Segment cluster Z40494_node_23 (SEQ ID NO:4728) according to the present invention is supported by 99 libraries. The number of libraries was determined as previously described. This segment can be found in the following transcript(s): Z40494_T1 (SEQ ID NO:4707). Table 4106 below describes the starting and ending position of this segment on each transcript.

TABLE 4106

Segment location on transcripts

| Transcript name | Segment starting position | Segment ending position |
|---|---|---|
| Z40494_T1 (SEQ ID NO: 4707) | 2468 | 2526 |

This segment can be found in a non-coding region of transcript(s) that are related to the following protein(s): Z40494_P2.

Segment cluster Z40494_node_26 (SEQ ID NO:4729) according to the present invention is supported by 1 libraries. The number of libraries was determined as previously described. This segment can be found in the following transcript(s): Z40494_T11 (SEQ ID NO:4708). Table 4107 below describes the starting and ending position of this segment on each transcript.

TABLE 4107

Segment location on transcripts

| Transcript name | Segment starting position | Segment ending position |
|---|---|---|
| Z40494_T11 (SEQ ID NO: 4708) | 625 | 738 |

This segment can be found in a non-coding region of transcript(s) that are related to the following protein(s): Z40494_P2.

Segment cluster Z40494_node_28 (SEQ ID NO:4730) according to the present invention is supported by 1 libraries. The number of libraries was determined as previously described. This segment can be found in the following transcript(s): Z40494_T11 (SEQ ID NO:4708). Table 4108 below describes the starting and ending position of this segment on each transcript.

TABLE 4108

Segment location on transcripts

| Transcript name | Segment starting position | Segment ending position |
|---|---|---|
| Z40494_T11 (SEQ ID NO: 4708) | 739 | 813 |

This segment can be found in a non-coding region of transcript(s) that are related to the following protein(s): Z40494_P2.

Description for Cluster Z44716

Cluster Z44716 features 9 transcript(s) and 34 segment(s) of interest, the names for which are given in Tables 4109 and 4110, respectively, the sequences themselves are given at the end of the application. The selected protein variants are given in Table 4111.

TABLE 4109

Transcripts of interest

Transcript Name

Z44716_T4 (SEQ ID NO: 4731)
Z44716_T7 (SEQ ID NO: 4732)
Z44716_T9 (SEQ ID NO: 4733)
Z44716_T25 (SEQ ID NO: 4734)
Z44716_T32 (SEQ ID NO: 4735)
Z44716_T34 (SEQ ID NO: 4736)
Z44716_T35 (SEQ ID NO: 4737)
Z44716_T40 (SEQ ID NO: 4738)
Z44716_T42 (SEQ ID NO: 4739)

TABLE 4110

Segments of interest

Segment Name

Z44716_node_0 (SEQ ID NO: 4740)
Z44716_node_4 (SEQ ID NO: 4741)
Z44716_node_10 (SEQ ID NO: 4742)
Z44716_node_14 (SEQ ID NO: 4743)
Z44716_node_16 (SEQ ID NO: 4744)
Z44716_node_20 (SEQ ID NO: 4745)
Z44716_node_23 (SEQ ID NO: 4746)
Z44716_node_27 (SEQ ID NO: 4747)
Z44716_node_30 (SEQ ID NO: 4748)
Z44716_node_38 (SEQ ID NO: 4749)
Z44716_node_49 (SEQ ID NO: 4750)

TABLE 4110-continued

Segments of interest

Segment Name

Z44716_node_51 (SEQ ID NO: 4751)
Z44716_node_57 (SEQ ID NO: 4752)
Z44716_node_59 (SEQ ID NO: 4753)
Z44716_node_61 (SEQ ID NO: 4754)
Z44716_node_66 (SEQ ID NO: 4755)
Z44716_node_68 (SEQ ID NO: 4756)
Z44716_node_1 (SEQ ID NO: 4757)
Z44716_node_2 (SEQ ID NO: 4758)
Z44716_node_12 (SEQ ID NO: 4759)
Z44716_node_13 (SEQ ID NO: 4760)
Z44716_node_18 (SEQ ID NO: 4761)
Z44716_node_25 (SEQ ID NO: 4762)
Z44716_node_31 (SEQ ID NO: 4763)
Z44716_node_41 (SEQ ID NO: 4764)
Z44716_node_42 (SEQ ID NO: 4765)
Z44716_node_44 (SEQ ID NO: 4766)
Z44716_node_46 (SEQ ID NO: 4767)
Z44716_node_53 (SEQ ID NO: 4768)
Z44716_node_54 (SEQ ID NO: 4769)
Z44716_node_56 (SEQ ID NO: 4770)
Z44716_node_60 (SEQ ID NO: 4771)
Z44716_node_62 (SEQ ID NO: 4772)
Z44716_node_67 (SEQ ID NO: 4773)

TABLE 4111

Proteins of interest

| Protein Name | Corresponding Transcript(s) |
|---|---|
| Z44716_P1 | Z44716_T4 (SEQ ID NO: 4731) |
| Z44716_P5 | Z44716_T7 (SEQ ID NO: 4732) |
| Z44716_P7 | Z44716_T9 (SEQ ID NO: 4733) |
| Z44716_P17 | Z44716_T25 (SEQ ID NO: 4734) |
| Z44716_P22 | Z44716_T40 (SEQ ID NO: 4738) |

These sequences are variants of the known protein Enhancer of zeste homolog 2 (SwissProt accession identifier EZH2_HUMAN; known also according to the synonyms ENX-1), referred to herein as the previously known protein.

Protein Enhancer of zeste homolog 2 is known or believed to have the following function(s): May be involved in the regulation of gene transcription and chromatin structure. The sequence for protein Enhancer of zeste homolog 2 is given at the end of the application, as "Enhancer of zeste homolog 2 amino acid sequence". Known polymorphisms for this sequence are as shown in Table 4112.

TABLE 4112

Amino acid mutations for Known Protein

| SNP position(s) on amino acid sequence | Comment |
|---|---|
| 224 | F -> L |
| 724 | F -> V |

Protein Enhancer of zeste homolog 2 localization is believed to be Nuclear (Probable).

The following GO Annotation(s) apply to the previously known protein. The following annotation(s) were found: establishment and/or maintenance of chromatin architecture; transcription regulation, which are annotation(s) related to Biological Process; DNA binding, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z44716 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 102 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 102 and Table 4113. This cluster is overexpressed (at least at a minimum level) in the following pathological conditions: epithelial malignant tumors, a mixture of malignant tumors from different tissues and myosarcoma.

TABLE 4113

Normal tissue distribution

| Name of Tissue | Number |
| --- | --- |
| bladder | 0 |
| bone | 0 |
| brain | 10 |
| colon | 0 |
| epithelial | 13 |
| general | 21 |
| kidney | 4 |
| liver | 0 |
| lung | 10 |
| lymph nodes | 88 |
| breast | 0 |
| bone marrow | 31 |
| muscle | 1 |
| ovary | 0 |
| pancreas | 0 |
| prostate | 0 |
| skin | 13 |
| stomach | 73 |
| T cells | 0 |
| uterus | 0 |

TABLE 4114

P values and ratios for expression in cancerous tissue

| Name of Tissue | P1 | P2 | SP1 | R3 | SP2 | R4 |
| --- | --- | --- | --- | --- | --- | --- |
| bladder | 5.4e−01 | 6.0e−01 | 5.6e−01 | 1.8 | 6.8e−01 | 1.5 |
| bone | 1 | 3.3e−02 | 1 | 1.0 | 1.2e−01 | 3.6 |
| brain | 6.8e−01 | 6.2e−01 | 1 | 0.5 | 8.3e−02 | 1.3 |
| colon | 3.0e−02 | 3.5e−02 | 1.2e−01 | 3.6 | 1.6e−01 | 3.1 |
| epithelial | 1.3e−05 | 7.1e−02 | 1.9e−03 | 2.8 | 2.1e−05 | 3.4 |
| general | 9.4e−05 | 2.6e−09 | 4.2e−03 | 1.8 | 4.3e−09 | 2.6 |
| kidney | 8.6e−01 | 6.8e−01 | 5.8e−01 | 1.4 | 1.2e−01 | 2.6 |
| liver | 1 | 1.9e−01 | 1 | 1.0 | 1.6e−01 | 2.4 |
| lung | 4.5e−02 | 8.2e−02 | 1.9e−01 | 3.2 | 1.8e−01 | 2.6 |
| lymph nodes | 5.4e−01 | 5.2e−01 | 8.1e−01 | 0.7 | 7.9e−01 | 0.7 |
| breast | 2.2e−01 | 2.0e−01 | 4.7e−01 | 1.9 | 4.6e−01 | 1.9 |
| bone marrow | 6.4e−01 | 5.7e−01 | 1 | 1.1 | 5.5e−01 | 1.5 |
| muscle | 4.0e−01 | 1.7e−01 | 2.2e−02 | 11.4 | 3.5e−03 | 6.6 |
| ovary | 2.4e−01 | 1.1e−01 | 4.7e−01 | 1.9 | 3.4e−01 | 2.2 |
| pancreas | 9.5e−02 | 6.9e−02 | 1.8e−01 | 3.7 | 7.7e−02 | 4.6 |
| prostate | 3.8e−01 | 3.5e−01 | 3.0e−01 | 2.5 | 4.2e−01 | 2.1 |
| skin | 4.0e−01 | 4.0e−01 | 5.5e−02 | 6.5 | 2.2e−01 | 1.6 |
| stomach | 8.5e−02 | 9.5e−02 | 6.9e−01 | 1.1 | 3.9e−01 | 1.4 |
| T cells | 1 | 6.7e−01 | 1 | 1.0 | 7.2e−01 | 1.4 |
| uterus | 5.4e−02 | 6.3e−02 | 4.4e−01 | 2.1 | 2.1e−01 | 2.3 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4115.

TABLE 4115

Oligonucleotides related to this cluster

| Oligonucleotide name | Overexpressed in cancers | Chip reference |
| --- | --- | --- |
| Z44716_0_0_72298 | colorectal cancer | Colon |
| Z44716_0_0_72298 | lung malignant tumors | LUN |
| Z44716_0_0_72300 | lung malignant tumors | LUN |
| Z44716_0_0_72309 | lung malignant tumors | LUN |
| Z44716_0_0_72312 | lung malignant tumors | LUN |

As noted above, cluster Z44716 features 34 segment(s), which were listed in Table 4110 above and for which the sequence(s) are given at the end of the application. These segment(s) are portions of nucleic acid sequence(s) which are described herein separately because they are of particular interest. A description of each segment according to the present invention is now provided.

Segment cluster Z44716_node_0 (SEQ ID NO:4740) according to the present invention is supported by 31 libraries. The number of libraries was determined as previously described. This segment can be found in the following transcript(s): Z44716_T7 (SEQ ID NO:4732), Z44716_T9 (SEQ ID NO:4733) and Z44716_T40 (SEQ ID NO:4738). Table 4116 below describes the starting and ending position of this segment on each transcript.

TABLE 4116

Segment location on transcripts

| Transcript name | Segment starting position | Segment ending position |
| --- | --- | --- |
| Z44716_T7 (SEQ ID NO: 4732) | 1 | 416 |
| Z44716_T9 (SEQ ID NO: 4733) | 1 | 416 |
| Z44716_T40 (SEQ ID NO: 4738) | 1 | 416 |

This segment can be found in a non-coding region of transcript(s) that are related to the following protein(s): Z44716_P5, Z44716_P7 and Z44716_P22.

Segment cluster Z44716_node_4 (SEQ ID NO:4741) according to the present invention is supported by 2 libraries. The number of libraries was determined as previously described. This segment can be found in the following transcript(s): Z44716_T4 (SEQ ID NO:4731). Table 4117 below describes the starting and ending position of this segment on each transcript.

TABLE 4117

Segment location on transcripts

| Transcript name | Segment starting position | Segment ending position |
|---|---|---|
| Z44716_T4 (SEQ ID NO: 4731) | 1 | 289 |

This segment can be found in a non-coding region of transcript(s) that are related to the following protein(s): Z44716_P1.

Segment cluster Z44716_node__10 (SEQ ID NO:4742) according to the present invention is supported by 42 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T40 (SEQ ID NO:4738). Table 4118 below describes the starting and ending position of this segment on each transcript.

TABLE 4118

Segment location on transcripts

| Transcript name | Segment starting position | Segment ending position |
|---|---|---|
| Z44716_T4 (SEQ ID NO: 4731) | 290 | 413 |
| Z44716_T7 (SEQ ID NO: 4732) | 480 | 603 |
| Z44716_T9 (SEQ ID NO: 4733) | 480 | 603 |
| Z44716_T40 (SEQ ID NO: 4738) | 480 | 603 |

This segment can be found in both coding and non-coding regions of transcript(s) as follows. The segment can be found in a non-coding region of transcript(s) that are related to the following protein(s): Z44716_P5 and Z44716_P7. This segment can also be found in the following protein(s): Z44716_P1 and Z44716_P22, since it is in the coding region for the corresponding transcript.

Segment cluster Z44716_node__14 (SEQ ID NO:4743) according to the present invention is supported by 1 libraries. The number of libraries was determined as previously described. This segment can be found in the following transcript(s): Z44716_T40 (SEQ ID NO:4738). Table 4119 below describes the starting and ending position of this segment on each transcript.

TABLE 4119

Segment location on transcripts

| Transcript name | Segment starting position | Segment ending position |
|---|---|---|
| Z44716_T40 (SEQ ID NO: 4738) | 733 | 895 |

This segment can be found in the following protein(s): Z44716_P22.

Segment cluster Z44716_node__16 (SEQ ID NO:4744) according to the present invention is supported by 3 libraries. The number of libraries was determined as previously described. This segment can be found in the following transcript(s): Z44716_T7 (SEQ ID NO:4732) and Z44716_T9 (SEQ ID NO:4733). Table 4120 below describes the starting and ending position of this segment on each transcript.

TABLE 4120

Segment location on transcripts

| Transcript name | Segment starting position | Segment ending position |
|---|---|---|
| Z44716_T7 (SEQ ID NO: 4732) | 733 | 911 |
| Z44716_T9 (SEQ ID NO: 4733) | 706 | 884 |

This segment can be found in both coding and non-coding regions of transcript(s) as follows. The segment can be found in a non-coding region of transcript(s) that are related to the following protein(s): Z44716_P5. This segment can also be found in the following protein(s): Z44716_P7, since it is in the coding region for the corresponding transcript.

Segment cluster Z44716_node__20 (SEQ ID NO:4745) according to the present invention is supported by 38 libraries. The number of libraries was determined as previously described. This segment can be found in the following transcript(s): Z44716_T4 (SEQ ID NO:4731), Z44716_T7 (SEQ ID NO:4732) and Z44716_T9 (SEQ ID NO:4733). Table 4121 below describes the starting and ending position of this segment on each transcript.

TABLE 4121

Segment location on transcripts

| Transcript name | Segment starting position | Segment ending position |
|---|---|---|
| Z44716_T4 (SEQ ID NO: 4731) | 660 | 780 |
| Z44716_T7 (SEQ ID NO: 4732) | 1029 | 1149 |
| Z44716_T9 (SEQ ID NO: 4733) | 1002 | 1122 |

This segment can be found in the following protein(s): Z44716_P1, Z44716_P5 and Z44716_P7.

Segment cluster Z44716_node__23 (SEQ ID NO:4746) according to the present invention is supported by 34 libraries. The number of libraries was determined as previously described. This segment can be found in the following transcript(s): Z44716_T4 (SEQ ID NO:4731), Z44716_T7 (SEQ ID NO:4732) and Z44716_T9 (SEQ ID NO:4733). Table 4122 below describes the starting and ending position of this segment on each transcript.

TABLE 4122

Segment location on transcripts

| Transcript name | Segment starting position | Segment ending position |
|---|---|---|
| Z44716_T4 (SEQ ID NO: 4731) | 781 | 921 |
| Z44716_T7 (SEQ ID NO: 4732) | 1150 | 1290 |
| Z44716_T9 (SEQ ID NO: 4733) | 1123 | 1263 |

This segment can be found in the following protein(s): Z44716_P1, Z44716_P5 and Z44716_P7.

Segment cluster Z44716_node__27 (SEQ ID NO:4747) according to the present invention is supported by 42 libraries. The number of libraries was determined as previously described. This segment can be found in the following transcript(s): Z44716_T4 (SEQ ID NO:4731), Z44716_T7 (SEQ ID NO:4732) and Z44716_T9 (SEQ ID NO:4733). Table 4123 below describes the starting and ending position of this segment on each transcript.

TABLE 4123

Segment location on transcripts

| Transcript name | Segment starting position | Segment ending position |
|---|---|---|
| Z44716_T4 (SEQ ID NO: 4731) | 1025 | 1188 |
| Z44716_T7 (SEQ ID NO: 4732) | 1394 | 1557 |
| Z44716_T9 (SEQ ID NO: 4733) | 1367 | 1530 |

This segment can be found in the following protein(s): Z44716_P1, Z44716_P5 and Z44716_P7.

Segment cluster Z44716_node_30 (SEQ ID NO:4748) according to the present invention is supported by 7 libraries. The number of libraries was determined as previously described. This segment can be found in the following transcript(s): Z44716_T25 (SEQ ID NO:4734). Table 4124 below describes the starting and ending position of this segment on each transcript.

TABLE 4124

Segment location on transcripts

| Transcript name | Segment starting position | Segment ending position |
|---|---|---|
| Z44716_T25 (SEQ ID NO: 4734) | 1 | 1044 |

This segment can be found in a non-coding region of transcript(s) that are related to the following protein(s): Z44716_P17.

Segment cluster Z44716_node_38 (SEQ ID NO:4749) according to the present invention is supported by 59 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4125 below describes the starting and ending position of this segment on each transcript.

TABLE 4125

Segment location on transcripts

| Transcript name | Segment starting position | Segment ending position |
|---|---|---|
| Z44716_T4 (SEQ ID NO: 4731) | 1281 | 1521 |
| Z44716_T7 (SEQ ID NO: 4732) | 1650 | 1890 |
| Z44716_T9 (SEQ ID NO: 4733) | 1623 | 1863 |
| Z44716_T25 (SEQ ID NO: 4734) | 1137 | 1377 |

This segment can be found in both coding and non-coding regions of transcript(s) as follows. The segment can be found in a non-coding region of transcript(s) that are related to the following protein(s): Z44716_P17. This segment can also be found in the following protein(s): Z44716_P1, Z44716_P5 and Z44716_P7, since it is in the coding region for the corresponding transcript.

Segment cluster Z44716_node_49 (SEQ ID NO:4750) according to the present invention is supported by 50 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4126 below describes the starting and ending position of this segment on each transcript.

TABLE 4126

Segment location on transcripts

| Transcript name | Segment starting position | Segment ending position |
|---|---|---|
| Z44716_T4 (SEQ ID NO: 4731) | 1828 | 1953 |
| Z44716_T7 (SEQ ID NO: 4732) | 2197 | 2322 |
| Z44716_T9 (SEQ ID NO: 4733) | 2170 | 2295 |
| Z44716_T25 (SEQ ID NO: 4734) | 1684 | 1809 |

This segment can be found in the following protein(s): Z44716_P1, Z44716_P5, Z44716_P7 and Z44716_P17.

Segment cluster Z44716_node_51 (SEQ ID NO:4751) according to the present invention is supported by 57 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4127 below describes the starting and ending position of this segment on each transcript.

TABLE 4127

Segment location on transcripts

| Transcript name | Segment starting position | Segment ending position |
|---|---|---|
| Z44716_T4 (SEQ ID NO: 4731) | 1954 | 2132 |
| Z44716_T7 (SEQ ID NO: 4732) | 2323 | 2501 |
| Z44716_T9 (SEQ ID NO: 4733) | 2296 | 2474 |
| Z44716_T25 (SEQ ID NO: 4734) | 1810 | 1988 |

This segment can be found in the following protein(s): Z44716_P1, Z44716_P5, Z44716_P7 and Z44716_P17.

Segment cluster Z44716_node_57 (SEQ ID NO:4752) according to the present invention is supported by 4 libraries. The number of libraries was determined as previously described. This segment can be found in the following transcript(s): Z44716_T42 (SEQ ID NO:4739). Table 4128 below describes the starting and ending position of this segment on each transcript.

TABLE 4128

Segment location on transcripts

| Transcript name | Segment starting position | Segment ending position |
|---|---|---|
| Z44716_T42 (SEQ ID NO: 4739) | 287 | 470 |

The previously-described transcripts for these segment(s) do not code for protein.

Segment cluster Z44716_node_59 (SEQ ID NO:4753) according to the present invention is supported by 6 libraries. The number of libraries was determined as previously described. This segment can be found in the following transcript(s): Z44716_T32 (SEQ ID NO:4735), Z44716_T34 (SEQ ID NO:4736) and Z44716_T35 (SEQ ID NO:4737). Table 4129 below describes the starting and ending position of this segment on each transcript.

TABLE 4129

| | Segment location on transcripts | |
|---|---|---|
| Transcript name | Segment starting position | Segment ending position |
| Z44716_T32 (SEQ ID NO: 4735) | 1 | 272 |
| Z44716_T34 (SEQ ID NO: 4736) | 1 | 272 |
| Z44716_T35 (SEQ ID NO: 4737) | 1 | 272 |

The previously-described transcripts for these segment(s) do not code for protein.

Segment cluster Z44716_node_61 (SEQ ID NO:4754) according to the present invention is supported by 6 libraries. The number of libraries was determined as previously described. This segment can be found in the following transcript(s): Z44716_T34 (SEQ ID NO:4736). Table 4130 below describes the starting and ending position of this segment on each transcript.

TABLE 4130

| | Segment location on transcripts | |
|---|---|---|
| Transcript name | Segment starting position | Segment ending position |
| Z44716_T34 (SEQ ID NO: 4736) | 354 | 507 |

The previously-described transcripts for these segment(s) do not code for protein.

Segment cluster Z44716_node_66 (SEQ ID NO:4755) according to the present invention is supported by 86 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734), Z44716_T32 (SEQ ID NO:4735), Z44716_T34 (SEQ ID NO:4736) and Z44716_T35 (SEQ ID NO:4737). Table 4131 below describes the starting and ending position of this segment on each transcript.

TABLE 4131

| | Segment location on transcripts | |
|---|---|---|
| Transcript name | Segment starting position | Segment ending position |
| Z44716_T4 (SEQ ID NO: 4731) | 2477 | 2609 |
| Z44716_T7 (SEQ ID NO: 4732) | 2846 | 2978 |
| Z44716_T9 (SEQ ID NO: 4733) | 2819 | 2951 |
| Z44716_T25 (SEQ ID NO: 4734) | 2333 | 2465 |
| Z44716_T32 (SEQ ID NO: 4735) | 439 | 571 |
| Z44716_T34 (SEQ ID NO: 4736) | 593 | 725 |
| Z44716_T35 (SEQ ID NO: 4737) | 439 | 571 |

This segment can be found in the following protein(s): Z44716_P1, Z44716_P5, Z44716_P7 and Z44716_P17.

Segment cluster Z44716_node_68 (SEQ ID NO:4756) according to the present invention is supported by 78 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734), Z44716_T32 (SEQ ID NO:4735), Z44716_T34 (SEQ ID NO:4736) and Z44716_T35 (SEQ ID NO:4737). Table 4132 below describes the starting and ending position of this segment on each transcript.

TABLE 4132

| | Segment location on transcripts | |
|---|---|---|
| Transcript name | Segment starting position | Segment ending position |
| Z44716_T4 (SEQ ID NO: 4731) | 2639 | 2800 |
| Z44716_T7 (SEQ ID NO: 4732) | 3008 | 3169 |
| Z44716_T9 (SEQ ID NO: 4733) | 2981 | 3142 |
| Z44716_T25 (SEQ ID NO: 4734) | 2495 | 2656 |
| Z44716_T32 (SEQ ID NO: 4735) | 601 | 762 |
| Z44716_T34 (SEQ ID NO: 4736) | 755 | 916 |
| Z44716_T35 (SEQ ID NO: 4737) | 601 | 982 |

This segment can be found in a non-coding region of transcript(s) that are related to the following protein(s): Z44716_P1, Z44716_P5, Z44716_P7 and Z44716_P17.

According to an optional embodiment of the present invention, short segments related to the above cluster are also provided. These segments are up to about 120 bp in length, and so are included in a separate description.

Segment cluster Z44716_node_1 (SEQ ID NO:4757) according to the present invention is supported by 35 libraries. The number of libraries was determined as previously described. This segment can be found in the following transcript(s): Z44716_T7 (SEQ ID NO:4732), Z44716_T9 (SEQ ID NO:4733) and Z44716_T40 (SEQ ID NO:4738). Table 4133 below describes the starting and ending position of this segment on each transcript.

TABLE 4133

| | Segment location on transcripts | |
|---|---|---|
| Transcript name | Segment starting position | Segment ending position |
| Z44716_T7 (SEQ ID NO: 4732) | 417 | 443 |
| Z44716_T9 (SEQ ID NO: 4733) | 417 | 443 |
| Z44716_T40 (SEQ ID NO: 4738) | 417 | 443 |

This segment can be found in a non-coding region of transcript(s) that are related to the following protein(s): Z44716_P5, Z44716_P7 and Z44716_P22.

Segment cluster Z44716_node_2 (SEQ ID NO:4758) according to the present invention is supported by 36 libraries. The number of libraries was determined as previously described. This segment can be found in the following transcript(s): Z44716_T7 (SEQ ID NO:4732), Z44716_T9 (SEQ ID NO:4733) and Z44716_T40 (SEQ ID NO:4738). Table 4134 below describes the starting and ending position of this segment on each transcript.

TABLE 4134

| | Segment location on transcripts | |
|---|---|---|
| Transcript name | Segment starting position | Segment ending position |
| Z44716_T7 (SEQ ID NO: 4732) | 444 | 479 |
| Z44716_T9 (SEQ ID NO: 4733) | 444 | 479 |
| Z44716_T40 (SEQ ID NO: 4738) | 444 | 479 |

This segment can be found in a non-coding region of transcript(s) that are related to the following protein(s): Z44716_P5, Z44716_P7 and Z44716_P22.

Segment cluster Z44716_node_12 (SEQ ID NO:4759) according to the present invention is supported by 43 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T40 (SEQ ID NO:4738). Table 4135 below describes the starting and ending position of this segment on each transcript.

TABLE 4135

Segment location on transcripts

| Transcript name | Segment starting position | Segment ending position |
|---|---|---|
| Z44716_T4 (SEQ ID NO: 4731) | 414 | 515 |
| Z44716_T7 (SEQ ID NO: 4732) | 604 | 705 |
| Z44716_T9 (SEQ ID NO: 4733) | 604 | 705 |
| Z44716_T40 (SEQ ID NO: 4738) | 604 | 705 |

This segment can be found in both coding and non-coding regions of transcript(s) as follows. The segment can be found in a non-coding region of transcript(s) that are related to the following protein(s): Z44716_P5. This segment can also be found in the following protein(s): Z44716_P1, Z44716_P7 and Z44716_P22, since it is in the coding region for the corresponding transcript.

Segment cluster Z44716_node__13 (SEQ ID NO:4760) according to the present invention is supported by 30 libraries. The number of libraries was determined as previously described. This segment can be found in the following transcript(s): Z44716_T4 (SEQ ID NO:4731), Z44716_T7 (SEQ ID NO:4732) and Z44716_T40 (SEQ ID NO:4738). Table 4136 below describes the starting and ending position of this segment on each transcript.

TABLE 4136

Segment location on transcripts

| Transcript name | Segment starting position | Segment ending position |
|---|---|---|
| Z44716_T4 (SEQ ID NO: 4731) | 516 | 542 |
| Z44716_T7 (SEQ ID NO: 4732) | 706 | 732 |
| Z44716_T40 (SEQ ID NO: 4738) | 706 | 732 |

This segment can be found in both coding and non-coding regions of transcript(s) as follows. The segment can be found in a non-coding region of transcript(s) that are related to the following protein(s): Z44716_P5. This segment can also be found in the following protein(s): Z44716_P1 and Z44716_P22, since it is in the coding region for the corresponding transcript.

Segment cluster Z44716_node__18 (SEQ ID NO:4761) according to the present invention is supported by 32 libraries. The number of libraries was determined as previously described. This segment can be found in the following transcript(s): Z44716_T4 (SEQ ID NO:4731), Z44716_T7 (SEQ ID NO:4732) and Z44716_T9 (SEQ ID NO:4733). Table 4137 below describes the starting and ending position of this segment on each transcript.

TABLE 4137

Segment location on transcripts

| Transcript name | Segment starting position | Segment ending position |
|---|---|---|
| Z44716_T4 (SEQ ID NO: 4731) | 543 | 659 |
| Z44716_T7 (SEQ ID NO: 4732) | 912 | 1028 |
| Z44716_T9 (SEQ ID NO: 4733) | 885 | 1001 |

This segment can be found in the following protein(s): Z44716_P1, Z44716_P5 and Z44716_P7.

Segment cluster Z44716_node__25 (SEQ ID NO:4762) according to the present invention is supported by 32 libraries. The number of libraries was determined as previously described. This segment can be found in the following transcript(s): Z44716_T4 (SEQ ID NO:4731), Z44716_T7 (SEQ ID NO:4732) and Z44716_T9 (SEQ ID NO:4733). Table 4138 below describes the starting and ending position of this segment on each transcript.

TABLE 4138

Segment location on transcripts

| Transcript name | Segment starting position | Segment ending position |
|---|---|---|
| Z44716_T4 (SEQ ID NO: 4731) | 922 | 1024 |
| Z44716_T7 (SEQ ID NO: 4732) | 1291 | 1393 |
| Z44716_T9 (SEQ ID NO: 4733) | 1264 | 1366 |

This segment can be found in the following protein(s): Z44716_P1, Z44716_P5 and Z44716_P7.

Segment cluster Z44716_node__31 (SEQ ID NO:4763) according to the present invention is supported by 50 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4139 below describes the starting and ending position of this segment on each transcript.

TABLE 4139

Segment location on transcripts

| Transcript name | Segment starting position | Segment ending position |
|---|---|---|
| Z44716_T4 (SEQ ID NO: 4731) | 1189 | 1280 |
| Z44716_T7 (SEQ ID NO: 4732) | 1558 | 1649 |
| Z44716_T9 (SEQ ID NO: 4733) | 1531 | 1622 |
| Z44716_T25 (SEQ ID NO: 4734) | 1045 | 1136 |

This segment can be found in both coding and non-coding regions of transcript(s) as follows. The segment can be found in a non-coding region of transcript(s) that are related to the following protein(s): Z44716_P17. This segment can also be found in the following protein(s): Z44716_P1, Z44716_P5 and Z44716_P7, since it is in the coding region for the corresponding transcript.

Segment cluster Z44716_node__41 (SEQ ID NO:4764) according to the present invention is supported by 53 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4140 below describes the starting and ending position of this segment on each transcript.

TABLE 4140

Segment location on transcripts

| Transcript name | Segment starting position | Segment ending position |
|---|---|---|
| Z44716_T4 (SEQ ID NO: 4731) | 1522 | 1580 |
| Z44716_T7 (SEQ ID NO: 4732) | 1891 | 1949 |
| Z44716_T9 (SEQ ID NO: 4733) | 1864 | 1922 |
| Z44716_T25 (SEQ ID NO: 4734) | 1378 | 1436 |

This segment can be found in the following protein(s): Z44716_P1, Z44716_P5, Z44716_P7 and Z44716_P17.

Segment cluster Z44716_node_42 (SEQ ID NO:4765) according to the present invention is supported by 54 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4141 below describes the starting and ending position of this segment on each transcript.

TABLE 4141

Segment location on transcripts

| Transcript name | Segment starting position | Segment ending position |
|---|---|---|
| Z44716_T4 (SEQ ID NO: 4731) | 1581 | 1691 |
| Z44716_T7 (SEQ ID NO: 4732) | 1950 | 2060 |
| Z44716_T9 (SEQ ID NO: 4733) | 1923 | 2033 |
| Z44716_T25 (SEQ ID NO: 4734) | 1437 | 1547 |

This segment can be found in the following protein(s): Z44716_P1, Z44716_P5, Z44716_P7 and Z44716_P17.

Segment cluster Z44716_node_44 (SEQ ID NO:4766) according to the present invention is supported by 54 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4142 below describes the starting and ending position of this segment on each transcript.

TABLE 4142

Segment location on transcripts

| Transcript name | Segment starting position | Segment ending position |
|---|---|---|
| Z44716_T4 (SEQ ID NO: 4731) | 1692 | 1786 |
| Z44716_T7 (SEQ ID NO: 4732) | 2061 | 2155 |
| Z44716_T9 (SEQ ID NO: 4733) | 2034 | 2128 |
| Z44716_T25 (SEQ ID NO: 4734) | 1548 | 1642 |

This segment can be found in the following protein(s): Z44716_P1, Z44716_P5, Z44716_P7 and Z44716_P17.

Segment cluster Z44716_node_46 (SEQ ID NO:4767) according to the present invention is supported by 42 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733) and Z44716_T25 (SEQ ID NO:4734). Table 4143 below describes the starting and ending position of this segment on each transcript.

TABLE 4143

Segment location on transcripts

| Transcript name | Segment starting position | Segment ending position |
|---|---|---|
| Z44716_T4 (SEQ ID NO: 4731) | 1787 | 1827 |
| Z44716_T7 (SEQ ID NO: 4732) | 2156 | 2196 |
| Z44716_T9 (SEQ ID NO: 4733) | 2129 | 2169 |
| Z44716_T25 (SEQ ID NO: 4734) | 1643 | 1683 |

This segment can be found in the following protein(s): Z44716_P1, Z44716_P5, Z44716_P7 and Z44716_P17.

Segment cluster Z44716_node_53 (SEQ ID NO:4768) according to the present invention is supported by 3 libraries. The number of libraries was determined as previously described. This segment can be found in the following transcript(s): Z44716_T42 (SEQ ID NO:4739). Table 4144 below describes the starting and ending position of this segment on each transcript.

TABLE 4144

Segment location on transcripts

| Transcript name | Segment starting position | Segment ending position |
|---|---|---|
| Z44716_T42 (SEQ ID NO: 4739) | 1 | 108 |

The previously-described transcripts for these segment(s) do not code for protein.

Segment cluster Z44716_node_54 (SEQ ID NO:4769) according to the present invention is supported by 67 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734) and Z44716_T42 (SEQ ID NO:4739). Table 4145 below describes the starting and ending position of this segment on each transcript.

TABLE 4145

Segment location on transcripts

| Transcript name | Segment starting position | Segment ending position |
|---|---|---|
| Z44716_T4 (SEQ ID NO: 4731) | 2133 | 2228 |
| Z44716_T7 (SEQ ID NO: 4732) | 2502 | 2597 |
| Z44716_T9 (SEQ ID NO: 4733) | 2475 | 2570 |
| Z44716_T25 (SEQ ID NO: 4734) | 1989 | 2084 |
| Z44716_T42 (SEQ ID NO: 4739) | 109 | 204 |

This segment can be found in the following protein(s): Z44716_P1, Z44716_P5, Z44716_P7 and Z44716_P17.

Segment cluster Z44716_node_56 (SEQ ID NO:4770) according to the present invention is supported by 64 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734) and Z44716_T42 (SEQ ID NO:4739).

Table 4146 below describes the starting and ending position of this segment on each transcript.

TABLE 4146

Segment location on transcripts

| Transcript name | Segment starting position | Segment ending position |
| --- | --- | --- |
| Z44716_T4 (SEQ ID NO: 4731) | 2229 | 2310 |
| Z44716_T7 (SEQ ID NO: 4732) | 2598 | 2679 |
| Z44716_T9 (SEQ ID NO: 4733) | 2571 | 2652 |
| Z44716_T25 (SEQ ID NO: 4734) | 2085 | 2166 |
| Z44716_T42 (SEQ ID NO: 4739) | 205 | 286 |

This segment can be found in the following protein(s): Z44716_P1, Z44716_P5, Z44716_P7 and Z44716_P17.

Segment cluster Z44716_node_60 (SEQ ID NO:4771) according to the present invention is supported by 74 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734), Z44716_T32 (SEQ ID NO:4735), Z44716_T34 (SEQ ID NO:4736) and Z44716_T35 (SEQ ID NO:4737). Table 4147 below describes the starting and ending position of this segment on each transcript.

TABLE 4147

Segment location on transcripts

| Transcript name | Segment starting position | Segment ending position |
| --- | --- | --- |
| Z44716_T4 (SEQ ID NO: 4731) | 2311 | 2391 |
| Z44716_T7 (SEQ ID NO: 4732) | 2680 | 2760 |
| Z44716_T9 (SEQ ID NO: 4733) | 2653 | 2733 |
| Z44716_T25 (SEQ ID NO: 4734) | 2167 | 2247 |
| Z44716_T32 (SEQ ID NO: 4735) | 273 | 353 |
| Z44716_T34 (SEQ ID NO: 4736) | 273 | 353 |
| Z44716_T35 (SEQ ID NO: 4737) | 273 | 353 |

This segment can be found in the following protein(s): Z44716_P1, Z44716_P5, Z44716_P7 and Z44716_P17.

Segment cluster Z44716_node_62 (SEQ ID NO:4772) according to the present invention is supported by 76 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734), Z44716_T32 (SEQ ID NO:4735), Z44716_T34 (SEQ ID NO:4736) and Z44716_T35 (SEQ ID NO:4737). Table 4148 below describes the starting and ending position of this segment on each transcript.

TABLE 4148

Segment location on transcripts

| Transcript name | Segment starting position | Segment ending position |
| --- | --- | --- |
| Z44716_T4 (SEQ ID NO: 4731) | 2392 | 2476 |
| Z44716_T7 (SEQ ID NO: 4732) | 2761 | 2845 |
| Z44716_T9 (SEQ ID NO: 4733) | 2734 | 2818 |
| Z44716_T25 (SEQ ID NO: 4734) | 2248 | 2332 |
| Z44716_T32 (SEQ ID NO: 4735) | 354 | 438 |
| Z44716_T34 (SEQ ID NO: 4736) | 508 | 592 |
| Z44716_T35 (SEQ ID NO: 4737) | 354 | 438 |

This segment can be found in the following protein(s): Z44716_P1, Z44716_P5, Z44716_P7 and Z44716_P17.

Segment cluster Z44716_node_67 (SEQ ID NO:4773) according to the present invention is supported by 74 libraries. The number of libraries was determined as previously described. This segment can be found in the following transcript(s): Z44716_T4 (SEQ ID NO:4731), Z44716_T7 (SEQ ID NO:4732), Z44716_T9 (SEQ ID NO:4733), Z44716_T25 (SEQ ID NO:4734), Z44716_T32 (SEQ ID NO:4735), Z44716_T34 (SEQ ID NO:4736) and Z44716_T35 (SEQ ID NO:4737). Table 4149 below describes the starting and ending position of this segment on each transcript.

TABLE 4149

Segment location on transcripts

| Transcript name | Segment starting position | Segment ending position |
| --- | --- | --- |
| Z44716_T4 (SEQ ID NO: 4731) | 2610 | 2638 |
| Z44716_T7 (SEQ ID NO: 4732) | 2979 | 3007 |
| Z44716_T9 (SEQ ID NO: 4733) | 2952 | 2980 |
| Z44716_T25 (SEQ ID NO: 4734) | 2466 | 2494 |
| Z44716_T32 (SEQ ID NO: 4735) | 572 | 600 |
| Z44716_T34 (SEQ ID NO: 4736) | 726 | 754 |
| Z44716_T35 (SEQ ID NO: 4737) | 572 | 600 |

This segment can be found in a non-coding region of transcript(s) that are related to the following protein(s): Z44716_P1, Z44716_P5, Z44716_P7 and Z44716_P17.

Expression of Homo sapiens enhancer of zeste homolog 2 (Drosophila) (EZH2) Z44716 transcripts which are detectable by amplicon as depicted in sequence name Z44716 seg16 in normal and cancerous lung tissues Expression of Homo sapiens enhancer of zeste homolog 2 (Drosophila) (EZH2) transcripts detectable by or according to Z44716 seg16, Z44716 seg16 amplicon(s) (SEQ ID NO: 6903) and Z44716 seg16F (SEQ ID NO: 6904) and Z44716 seg16R (SEQ ID NO: 6905) primers was measured by real time PCR. In parallel the expression of four housekeeping genes—PBGD (GenBank Accession No. BC019323 (SEQ ID NO: 6892); amplicon—PBGD-amplicon (SEQ ID NO: 6893)), HPRT1 (GenBank Accession No. NM_000194 (SEQ ID NO: 6894); amplicon—HPRT1-amplicon (SEQ ID NO: 6895)), Ubiquitin (GenBank Accession No. BC000449; amplicon—Ubiquitin-amplicon) and SDHA (GenBank Accession No. NM_004168 (SEQ ID NO: 6896); amplicon—SDHA-amplicon (SEQ ID NO: 6897)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 1 above), to obtain a value of fold up-regulation for each sample relative to median of the normal PM samples.

FIG. 103 is a histogram showing over expression of the above-indicated EZH2 transcripts in cancerous lung samples relative to the normal samples. Values represent the average of duplicate experiments. Error bars indicate the minimal and maximal values obtained.

As is evident from FIG. 103, the expression of EZH2 transcripts detectable by the above amplicon(s) in cancer samples was higher than in the non-cancerous samples (Sample Nos. 47-50, 90-93, 96-99 Table 1). Notably an overexpression of at least 5 fold was found in 1 out of 15 adenocarcinoma samples, 2 out of 16 squamous cell carcinoma samples, 2 out of 4 large cell carcinoma samples and in 7 out of 8 small cell carcinoma samples.

Primer pairs are also optionally and preferably encompassed within the present invention; for example, for the above experiment, the following primer pair was used as a non-limiting illustrative example only of a suitable primer pair: Z44716 seg16F forward primer (SEQ ID NO: 6904); and Z44716 seg16R reverse primer (SEQ ID NO: 6905).

The present invention also preferably encompasses any amplicon obtained through the use of any suitable primer pair; for example, for the above experiment, the following amplicon was obtained as a non-limiting illustrative example only of a suitable amplicon: Z44716 seg16 (SEQ ID NO: 6903).

```
Forward primer-Z44716 seg16F (SEQ ID NO: 6904):
ACAGTTTTTACTTGGAACCAGCCT

Reverse primer-Z44716 seg16R (SEQ ID NO: 6905):
AGTGGGAGCTGGAGAGGGA

Amplicon (SEQ ID NO: 6903):
ACAGTTTTTACTTGGAACCAGCCTTCTGCCAAGAGTCTCAGTTTGGTTGT

GTACTCCTACAACTACTATTTTTGGCTTGACTTCCCTCTCCAGCTCCCAG

T
```

Description for Cluster R13007

Cluster R13007 features 4 transcript(s) and 28 segment(s) of interest, the names for which are given in Tables 4150 and 4151, respectively, the sequences themselves are given at the end of the application. The selected protein variants are given in Table 4152.

TABLE 4150

| Transcripts of interest |
|---|
| Transcript Name |
| R13007_T7 (SEQ ID NO: 4027) |
| R13007_T9 (SEQ ID NO: 4028) |
| R13007_T10 (SEQ ID NO: 4029) |
| R13007_T18 (SEQ ID NO: 4030) |

TABLE 4151

| Segments of interest |
|---|
| Segment Name |
| R13007_node_0 (SEQ ID NO: 4774) |
| R13007_node_3 (SEQ ID NO: 4775) |
| R13007_node_5 (SEQ ID NO: 4776) |
| R13007_node_6 (SEQ ID NO: 4777) |
| R13007_node_27 (SEQ ID NO: 4778) |
| R13007_node_33 (SEQ ID NO: 4779) |
| R13007_node_43 (SEQ ID NO: 4780) |
| R13007_node_11 (SEQ ID NO: 4781) |
| R13007_node_12 (SEQ ID NO: 4782) |
| R13007_node_13 (SEQ ID NO: 4783) |
| R13007_node_22 (SEQ ID NO: 4784) |
| R13007_node_24 (SEQ ID NO: 4785) |
| R13007_node_25 (SEQ ID NO: 4786) |
| R13007_node_28 (SEQ ID NO: 4787) |
| R13007_node_29 (SEQ ID NO: 4788) |
| R13007_node_34 (SEQ ID NO: 4789) |
| R13007_node_36 (SEQ ID NO: 4790) |
| R13007_node_37 (SEQ ID NO: 4791) |
| R13007_node_38 (SEQ ID NO: 4792) |
| R13007_node_39 (SEQ ID NO: 4793) |
| R13007_node_40 (SEQ ID NO: 4794) |

TABLE 4151-continued

| Segments of interest |
|---|
| Segment Name |
| R13007_node_41 (SEQ ID NO: 4795) |
| R13007_node_42 (SEQ ID NO: 4796) |
| R13007_node_44 (SEQ ID NO: 4797) |
| R13007_node_45 (SEQ ID NO: 4798) |
| R13007_node_46 (SEQ ID NO: 4799) |
| R13007_node_47 (SEQ ID NO: 4800) |
| R13007_node_49 (SEQ ID NO: 4801) |

TABLE 4152

| Proteins of interest | |
|---|---|
| Protein Name | Corresponding Transcript(s) |
| R13007_P8 | R13007_T7 (SEQ ID NO: 4027); R13007_T9 (SEQ ID NO: 4028) |
| R13007_P10 | R13007_T10 (SEQ ID NO: 4029) |
| R13007_P14 | R13007_T18 (SEQ ID NO: 4030) |

These sequences are variants of the known protein Calponin H1, smooth muscle (SwissProt accession identifier CLP1_HUMAN; known also according to the synonyms Basic calponin; Calponin 1), referred to herein as the previously known protein.

Protein Calponin H1, smooth muscle is known or believed to have the following function(s): Thin filament-associated protein that is implicated in the regulation and modulation of smooth muscle contraction. It is capable of binding to actin, calmodulin, troponin C and tropomyosin. The interaction of calponin with actin inhibits the actomyosin Mg-ATPase activity (By similarity). The sequence for protein Calponin H1, smooth muscle is given at the end of the application, as "Calponin H1, smooth muscle amino acid sequence". Known polymorphisms for this sequence are as shown in Table 4153.

TABLE 4153

| Amino acid mutations for Known Protein | |
|---|---|
| SNP position(s) on amino acid sequence | Comment |
| 57 | G -> S |
| 149 | E -> G |
| 170 | T -> S |
| 266 | Q -> P |

The following GO Annotation(s) apply to the previously known protein. The following annotation(s) were found: smooth muscle contraction, which are annotation(s) related to Biological Process; actin binding; calmodulin binding, which are annotation(s) related to Molecular Function; and cytoskeleton, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster R13007 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 104 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 104 and Table 4154. This cluster is overexpressed (at least at a minimum level) in the following pathological conditions: myosarcoma and pancreas carcinoma.

TABLE 4154

Normal tissue distribution

| Name of Tissue | Number |
|---|---|
| Adrenal | 0 |
| Bladder | 2914 |
| Colon | 189 |
| Epithelial | 378 |
| General | 237 |
| Kidney | 0 |
| Lung | 40 |
| Breast | 74 |
| Muscle | 24 |
| Ovary | 14 |
| Pancreas | 10 |
| Prostate | 201 |
| Stomach | 806 |
| Uterus | 1537 |

TABLE 4155

P values and ratios for expression in cancerous tissue

| Name of Tissue | P1 | P2 | SP1 | R3 | SP2 | R4 |
|---|---|---|---|---|---|---|
| Adrenal | 4.2e−01 | 4.6e−01 | 4.6e−01 | 2.2 | 5.3e−01 | 1.9 |
| Bladder | 6.5e−01 | 6.9e−01 | 1 | 0.1 | 1 | 0.0 |
| Colon | 6.3e−01 | 7.5e−01 | 9.9e−01 | 0.4 | 1 | 0.3 |
| Epithelial | 8.2e−01 | 9.3e−01 | 1 | 0.4 | 1 | 0.2 |
| General | 9.0e−01 | 9.2e−01 | 1 | 0.5 | 1 | 0.3 |
| Kidney | 4.3e−01 | 5.3e−01 | 3.4e−01 | 2.4 | 4.9e−01 | 1.9 |
| Lung | 6.4e−01 | 7.6e−01 | 9.3e−01 | 0.6 | 9.2e−01 | 0.6 |
| Breast | 8.3e−01 | 8.6e−01 | 6.3e−01 | 0.7 | 8.5e−01 | 0.5 |
| Muscle | 6.0e−01 | 6.7e−01 | 3.0e−07 | 5.4 | 1.4e−03 | 1.8 |
| Ovary | 8.9e−01 | 9.1e−01 | 6.8e−01 | 1.0 | 7.7e−01 | 0.9 |
| Pancreas | 6.2e−02 | 1.7e−01 | 2.7e−03 | 3.9 | 1.6e−02 | 2.7 |
| Prostate | 5.2e−01 | 7.2e−01 | 6.9e−04 | 2.2 | 2.9e−02 | 1.5 |
| Stomach | 3.0e−01 | 8.5e−01 | 9.4e−01 | 0.2 | 1 | 0.1 |
| Uterus | 5.6e−01 | 6.8e−01 | 1 | 0.1 | 1 | 0.0 |

As noted above, cluster R13007 features 28 segment(s), which were listed in Table 4151 above and for which the sequence(s) are given at the end of the application. These segment(s) are portions of nucleic acid sequence(s) which are described herein separately because they are of particular interest. A description of each segment according to the present invention is now provided.

Segment cluster R13007_node_0 (SEQ ID NO:4774) according to the present invention is supported by 227 libraries. The number of libraries was determined as previously described. This segment can be found in the following transcript(s): R13007_T9 (SEQ ID NO:4028). Table 4156 below describes the starting and ending position of this segment on each transcript.

TABLE 4156

| | Segment location on transcripts | |
|---|---|---|
| Transcript name | Segment starting position | Segment ending position |
| R13007_T9 (SEQ ID NO: 4028) | 1 | 276 |

This segment can be found in a non-coding region of transcript(s) that are related to the following protein(s): R13007_P8.

Segment cluster R13007_node_3 (SEQ ID NO:4775) according to the present invention is supported by 2 libraries. The number of libraries was determined as previously described. This segment can be found in the following transcript(s): R13007_T9 (SEQ ID NO:4028). Table 4157 below describes the starting and ending position of this segment on each transcript.

TABLE 4157

| | Segment location on transcripts | |
|---|---|---|
| Transcript name | Segment starting position | Segment ending position |
| R13007_T9 (SEQ ID NO: 4028) | 277 | 542 |

This segment can be found in a non-coding region of transcript(s) that are related to the following protein(s): R13007_P8.

Segment cluster R13007_node_5 (SEQ ID NO:4776) according to the present invention is supported by 13 libraries. The number of libraries was determined as previously described. This segment can be found in the following transcript(s): R13007_T7 (SEQ ID NO:4027) and R13007_T10 (SEQ ID NO:4029). Table 4158 below describes the starting and ending position of this segment on each transcript.

TABLE 4158

| | Segment location on transcripts | |
|---|---|---|
| Transcript name | Segment starting position | Segment ending position |
| R13007_T7 (SEQ ID NO: 4027) | 1 | 301 |
| R13007_T10 (SEQ ID NO: 4029) | 1 | 301 |

This segment can be found in a non-coding region of transcript(s) that are related to the following protein(s): R13007_P8 and R13007_P10.

Segment cluster R13007_node_6 (SEQ ID NO:4777) according to the present invention is supported by 7 libraries. The number of libraries was determined as previously described. This segment can be found in the following transcript(s): R13007_T10 (SEQ ID NO:4029). Table 4159 below describes the starting and ending position of this segment on each transcript.

TABLE 4159

| | Segment location on transcripts | |
|---|---|---|
| Transcript name | Segment starting position | Segment ending position |
| R13007_T10 (SEQ ID NO: 4029) | 302 | 966 |

This segment can be found in the following protein(s): R13007_P10.

Segment cluster R13007_node__27 (SEQ ID NO:4778) according to the present invention is supported by 5 libraries. The number of libraries was determined as previously described. This segment can be found in the following transcript(s): R13007_T18 (SEQ ID NO:4030). Table 4160 below describes the starting and ending position of this segment on each transcript.

TABLE 4160

Segment location on transcripts

| Transcript name | Segment starting position | Segment ending position |
|---|---|---|
| R13007_T18 (SEQ ID NO: 4030) | 1 | 238 |

This segment can be found in a non-coding region of transcript(s) that are related to the following protein(s): R13007_P14.

Segment cluster R13007_node__33 (SEQ ID NO:4779) according to the present invention is supported by 209 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4161 below describes the starting and ending position of this segment on each transcript.

TABLE 4161

Segment location on transcripts

| Transcript name | Segment starting position | Segment ending position |
|---|---|---|
| R13007_T7 (SEQ ID NO: 4027) | 740 | 867 |
| R13007_T9 (SEQ ID NO: 4028) | 981 | 1108 |
| R13007_T10 (SEQ ID NO: 4029) | 1405 | 1532 |
| R13007_T18 (SEQ ID NO: 4030) | 350 | 477 |

This segment can be found in the following protein(s): R13007_P8, R13007_P10 and R13007_P14.

Segment cluster R13007_node__43 (SEQ ID NO:4780) according to the present invention is supported by 197 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4162 below describes the starting and ending position of this segment on each transcript.

TABLE 4162

Segment location on transcripts

| Transcript name | Segment starting position | Segment ending position |
|---|---|---|
| R13007_T7 (SEQ ID NO: 4027) | 1200 | 1369 |
| R13007_T9 (SEQ ID NO: 4028) | 1441 | 1610 |
| R13007_T10 (SEQ ID NO: 4029) | 1865 | 2034 |
| R13007_T18 (SEQ ID NO: 4030) | 810 | 979 |

This segment can be found in a non-coding region of transcript(s) that are related to the following protein(s): R13007_P8, R13007_P10 and R13007_P14.

According to an optional embodiment of the present invention, short segments related to the above cluster are also provided. These segments are up to about 120 bp in length, and so are included in a separate description.

Segment cluster R13007_node__11 (SEQ ID NO:4781) according to the present invention is supported by 235 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4163 below describes the starting and ending position of this segment on each transcript.

TABLE 4163

Segment location on transcripts

| Transcript name | Segment starting position | Segment ending position |
|---|---|---|
| R13007_T7 (SEQ ID NO: 4027) | 302 | 345 |
| R13007_T9 (SEQ ID NO: 4028) | 543 | 586 |
| R13007_T10 (SEQ ID NO: 4029) | 967 | 1010 |

This segment can be found in both coding and non-coding regions of transcript(s) as follows. The segment can be found in a non-coding region of transcript(s) that are related to the following protein(s): R13007_P8. This segment can also be found in the following protein(s): R13007_P10, since it is in the coding region for the corresponding transcript.

Segment cluster R13007_node__12 (SEQ ID NO:4782) according to the present invention is supported by 240 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4164 below describes the starting and ending position of this segment on each transcript.

TABLE 4164

Segment location on transcripts

| Transcript name | Segment starting position | Segment ending position |
|---|---|---|
| R13007_T7 (SEQ ID NO: 4027) | 346 | 373 |
| R13007_T9 (SEQ ID NO: 4028) | 587 | 614 |
| R13007_T10 (SEQ ID NO: 4029) | 1011 | 1038 |

This segment can be found in both coding and non-coding regions of transcript(s) as follows. The segment can be found in a non-coding region of transcript(s) that are related to the following protein(s): R13007_P8. This segment can also be found in the following protein(s): R13007_P10, since it is in the coding region for the corresponding transcript.

Segment cluster R13007_node__13 (SEQ ID NO:4783) according to the present invention is supported by 241 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4165 below describes the starting and ending position of this segment on each transcript.

TABLE 4165

Segment location on transcripts

| Transcript name | Segment starting position | Segment ending position |
|---|---|---|
| R13007_T7 (SEQ ID NO: 4027) | 374 | 423 |
| R13007_T9 (SEQ ID NO: 4028) | 615 | 664 |
| R13007_T10 (SEQ ID NO: 4029) | 1039 | 1088 |

This segment can be found in the following protein(s): R13007_P8 and R13007_P10.

Segment cluster R13007_node__22 (SEQ ID NO:4784) according to the present invention is supported by 222 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4166 below describes the starting and ending position of this segment on each transcript.

TABLE 4166

Segment location on transcripts

| Transcript name | Segment starting position | Segment ending position |
|---|---|---|
| R13007_T7 (SEQ ID NO: 4027) | 424 | 490 |
| R13007_T9 (SEQ ID NO: 4028) | 665 | 731 |
| R13007_T10 (SEQ ID NO: 4029) | 1089 | 1155 |

This segment can be found in the following protein(s): R13007_P8 and R13007_P10.

Segment cluster R13007_node__24 (SEQ ID NO:4785) according to the present invention is supported by 187 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4167 below describes the starting and ending position of this segment on each transcript.

TABLE 4167

Segment location on transcripts

| Transcript name | Segment starting position | Segment ending position |
|---|---|---|
| R13007_T7 (SEQ ID NO: 4027) | 491 | 595 |
| R13007_T9 (SEQ ID NO: 4028) | 732 | 836 |
| R13007_T10 (SEQ ID NO: 4029) | 1156 | 1260 |

This segment can be found in the following protein(s): R13007_P8 and R13007_P10.

Segment cluster R13007_node__25 (SEQ ID NO:4786) according to the present invention is supported by 165 libraries. The number of libraries was determined as previously described. This segment can be found in the following transcript(s): R13007_T7 (SEQ ID NO:4027), R13007_T9 (SEQ ID NO:4028) and R13007_T10 (SEQ ID NO:4029). Table 4168 below describes the starting and ending position of this segment on each transcript.

TABLE 4168

Segment location on transcripts

| Transcript name | Segment starting position | Segment ending position |
|---|---|---|
| R13007_T7 (SEQ ID NO: 4027) | 596 | 628 |
| R13007_T9 (SEQ ID NO: 4028) | 837 | 869 |
| R13007_T10 (SEQ ID NO: 4029) | 1261 | 1293 |

This segment can be found in the following protein(s): R13007_P8 and R13007_P10.

Segment cluster R13007_node__28 (SEQ ID NO:4787) according to the present invention is supported by 199 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4169 below describes the starting and ending position of this segment on each transcript.

TABLE 4169

Segment location on transcripts

| Transcript name | Segment starting position | Segment ending position |
|---|---|---|
| R13007_T7 (SEQ ID NO: 4027) | 629 | 716 |
| R13007_T9 (SEQ ID NO: 4028) | 870 | 957 |
| R13007_T10 (SEQ ID NO: 4029) | 1294 | 1381 |
| R13007_T18 (SEQ ID NO: 4030) | 239 | 326 |

This segment can be found in both coding and non-coding regions of transcript(s) as follows. The segment can be found in a non-coding region of transcript(s) that are related to the following protein(s): R13007_P14. This segment can also be found in the following protein(s): R13007_P8 and R13007_P10, since it is in the coding region for the corresponding transcript.

Segment cluster R13007_node__29 (SEQ ID NO:4788) according to the present invention can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4170 below describes the starting and ending position of this segment on each transcript.

TABLE 4170

Segment location on transcripts

| Transcript name | Segment starting position | Segment ending position |
|---|---|---|
| R13007_T7 (SEQ ID NO: 4027) | 717 | 739 |
| R13007_T9 (SEQ ID NO: 4028) | 958 | 980 |
| R13007_T10 (SEQ ID NO: 4029) | 1382 | 1404 |
| R13007_T18 (SEQ ID NO: 4030) | 327 | 349 |

This segment can be found in the following protein(s): R13007_P8, R13007_P10 and R13007_P14.

Segment cluster R13007_node__34 (SEQ ID NO:4789) according to the present invention can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4171 below describes the starting and ending position of this segment on each transcript.

TABLE 4171

Segment location on transcripts

| Transcript name | Segment starting position | Segment ending position |
|---|---|---|
| R13007_T7 (SEQ ID NO: 4027) | 868 | 886 |
| R13007_T9 (SEQ ID NO: 4028) | 1109 | 1127 |
| R13007_T10 (SEQ ID NO: 4029) | 1533 | 1551 |
| R13007_T18 (SEQ ID NO: 4030) | 478 | 496 |

This segment can be found in the following protein(s): R13007_P8, R13007_P10 and R13007_P14.

Segment cluster R13007_node_36 (SEQ ID NO:4790) according to the present invention is supported by 174 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4172 below describes the starting and ending position of this segment on each transcript.

TABLE 4172

Segment location on transcripts

| Transcript name | Segment starting position | Segment ending position |
|---|---|---|
| R13007_T7 (SEQ ID NO: 4027) | 887 | 942 |
| R13007_T9 (SEQ ID NO: 4028) | 1128 | 1183 |
| R13007_T10 (SEQ ID NO: 4029) | 1552 | 1607 |
| R13007_T18 (SEQ ID NO: 4030) | 497 | 552 |

This segment can be found in the following protein(s): R13007_P8, R13007_P11 and R13007_P14.

Segment cluster R13007_node_37 (SEQ ID NO:4791) according to the present invention is supported by 169 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4173 below describes the starting and ending position of this segment on each transcript.

TABLE 4173

Segment location on transcripts

| Transcript name | Segment starting position | Segment ending position |
|---|---|---|
| R13007_T7 (SEQ ID NO: 4027) | 943 | 976 |
| R13007_T9 (SEQ ID NO: 4028) | 1184 | 1217 |
| R13007_T10 (SEQ ID NO: 4029) | 1608 | 1641 |
| R13007_T18 (SEQ ID NO: 4030) | 553 | 586 |

This segment can be found in the following protein(s): R13007_P8, R13007_P10 and R13007_P14.

Segment cluster R13007_node_38 (SEQ ID NO:4792) according to the present invention can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4174 below describes the starting and ending position of this segment on each transcript.

TABLE 4174

Segment location on transcripts

| Transcript name | Segment starting position | Segment ending position |
|---|---|---|
| R13007_T7 (SEQ ID NO: 4027) | 977 | 984 |
| R13007_T9 (SEQ ID NO: 4028) | 1218 | 1225 |
| R13007_T10 (SEQ ID NO: 4029) | 1642 | 1649 |
| R13007_T18 (SEQ ID NO: 4030) | 587 | 594 |

This segment can be found in the following protein(s): R13007_P8, R13007_P1 and R13007_P14.

Segment cluster R13007_node_39 (SEQ ID NO:4793) according to the present invention is supported by 204 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4175 below describes the starting and ending position of this segment on each transcript.

TABLE 4175

Segment location on transcripts

| Transcript name | Segment starting position | Segment ending position |
|---|---|---|
| R13007_T7 (SEQ ID NO: 4027) | 985 | 1082 |
| R13007_T9 (SEQ ID NO: 4028) | 1226 | 1323 |
| R13007_T10 (SEQ ID NO: 4029) | 1650 | 1747 |
| R13007_T18 (SEQ ID NO: 4030) | 595 | 692 |

This segment can be found in the following protein(s): R13007_P8, R13007_P10 and R13007_P14.

Segment cluster R13007_node_40 (SEQ ID NO:4794) according to the present invention is supported by 189 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4176 below describes the starting and ending position of this segment on each transcript.

TABLE 4176

Segment location on transcripts

| Transcript name | Segment starting position | Segment ending position |
|---|---|---|
| R13007_T7 (SEQ ID NO: 4027) | 1083 | 1156 |
| R13007_T9 (SEQ ID NO: 4028) | 1324 | 1397 |
| R13007_T10 (SEQ ID NO: 4029) | 1748 | 1821 |
| R13007_T18 (SEQ ID NO: 4030) | 693 | 766 |

This segment can be found in the following protein(s): R13007_P8, R13007_P11 and R13007_P14.

Segment cluster R13007_node_41 (SEQ ID NO:4795) according to the present invention can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4177 below describes the starting and ending position of this segment on each transcript.

TABLE 4177

Segment location on transcripts

| Transcript name | Segment starting position | Segment ending position |
|---|---|---|
| R13007_T7 (SEQ ID NO: 4027) | 1157 | 1168 |
| R13007_T9 (SEQ ID NO: 4028) | 1398 | 1409 |
| R13007_T10 (SEQ ID NO: 4029) | 1822 | 1833 |
| R13007_T18 (SEQ ID NO: 4030) | 767 | 778 |

This segment can be found in a non-coding region of transcript(s) that are related to the following protein(s): R13007_P8, R13007_P10 and R13007_P14.

Segment cluster R13007_node_42 (SEQ ID NO:4796) according to the present invention is supported by 166 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4178 below describes the starting and ending position of this segment on each transcript.

TABLE 4178

Segment location on transcripts

| Transcript name | Segment starting position | Segment ending position |
|---|---|---|
| R13007_T7 (SEQ ID NO: 4027) | 1169 | 1199 |
| R13007_T9 (SEQ ID NO: 4028) | 1410 | 1440 |
| R13007_T10 (SEQ ID NO: 4029) | 1834 | 1864 |
| R13007_T18 (SEQ ID NO: 4030) | 779 | 809 |

This segment can be found in a non-coding region of transcript(s) that are related to the following protein(s): R13007_P8, R13007_P10 and R13007_P14.

Segment cluster R13007_node_44 (SEQ ID NO:4797) according to the present invention is supported by 167 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4179 below describes the starting and ending position of this segment on each transcript.

TABLE 4179

Segment location on transcripts

| Transcript name | Segment starting position | Segment ending position |
|---|---|---|
| R13007_T7 (SEQ ID NO: 4027) | 1370 | 1403 |
| R13007_T9 (SEQ ID NO: 4028) | 1611 | 1644 |
| R13007_T10 (SEQ ID NO: 4029) | 2035 | 2068 |
| R13007_T18 (SEQ ID NO: 4030) | 980 | 1013 |

This segment can be found in a non-coding region of transcript(s) that are related to the following protein(s): R13007_P8, R13007_P10 and R13007_P14.

Segment cluster R13007_node_45 (SEQ ID NO:4798) according to the present invention is supported by 178 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4180 below describes the starting and ending position of this segment on each transcript.

TABLE 4180

Segment location on transcripts

| Transcript name | Segment starting position | Segment ending position |
|---|---|---|
| R13007_T7 (SEQ ID NO: 4027) | 1404 | 1462 |
| R13007_T9 (SEQ ID NO: 4028) | 1645 | 1703 |
| R13007_T10 (SEQ ID NO: 4029) | 2069 | 2127 |
| R13007_T18 (SEQ ID NO: 4030) | 1014 | 1072 |

This segment can be found in a non-coding region of transcript(s) that are related to the following protein(s): R13007_P8, R13007_P10 and R13007_P14.

Segment cluster R13007_node_46 (SEQ ID NO:4799) according to the present invention is supported by 174 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4181 below describes the starting and ending position of this segment on each transcript.

TABLE 4181

Segment location on transcripts

| Transcript name | Segment starting position | Segment ending position |
|---|---|---|
| R13007_T7 (SEQ ID NO: 4027) | 1463 | 1561 |
| R13007_T9 (SEQ ID NO: 4028) | 1704 | 1802 |
| R13007_T10 (SEQ ID NO: 4029) | 2128 | 2226 |
| R13007_T18 (SEQ ID NO: 4030) | 1073 | 1171 |

This segment can be found in a non-coding region of transcript(s) that are related to the following protein(s): R13007_P8, R13007_P10 and R13007_P14.

Segment cluster R13007_node_47 (SEQ ID NO:4800) according to the present invention is supported by 136 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4182 below describes the starting and ending position of this segment on each transcript.

TABLE 4182

Segment location on transcripts

| Transcript name | Segment starting position | Segment ending position |
|---|---|---|
| R13007_T7 (SEQ ID NO: 4027) | 1562 | 1587 |
| R13007_T9 (SEQ ID NO: 4028) | 1803 | 1828 |
| R13007_T10 (SEQ ID NO: 4029) | 2227 | 2252 |
| R13007_T18 (SEQ ID NO: 4030) | 1172 | 1197 |

This segment can be found in a non-coding region of transcript(s) that are related to the following protein(s): R13007_P8, R13007_P10 and R13007_P14.

Segment cluster R13007_node_49 (SEQ ID NO:4801) according to the present invention is supported by 111 libraries. The number of libraries was determined as previously described. This segment can be found in the following transcript(s): R13007_T7 (SEQ ID NO:4027), R13007_T9 (SEQ ID NO:4028), R13007_T10 (SEQ ID NO:4029) and R13007_T18 (SEQ ID NO:4030). Table 4183 below describes the starting and ending position of this segment on each transcript.

TABLE 4183

Segment location on transcripts

| Transcript name | Segment starting position | Segment ending position |
| --- | --- | --- |
| R13007_T7 (SEQ ID NO: 4027) | 1588 | 1667 |
| R13007_T9 (SEQ ID NO: 4028) | 1829 | 1908 |
| R13007_T10 (SEQ ID NO: 4029) | 2253 | 2332 |
| R13007_T18 (SEQ ID NO: 4030) | 1198 | 1277 |

This segment can be found in a non-coding region of transcript(s) that are related to the following protein(s): R13007_P8, R13007_P10 and R13007_P14.

Description for Cluster AA091457

Cluster AA091457 features 13 transcript(s) and 26 segment(s) of interest, the names for which are given in Tables 4184 and 4185, respectively, the sequences themselves are given at the end of the application. The selected protein variants are given in Table 4186.

TABLE 4184

Transcripts of interest
Transcript Name

AA091457_T0 (SEQ ID NO: 4031)
AA091457_T1 (SEQ ID NO: 4032)
AA091457_T2 (SEQ ID NO: 4033)
AA091457_T4 (SEQ ID NO: 4034)
AA091457_T5 (SEQ ID NO: 4035)
AA091457_T6 (SEQ ID NO: 4036)
AA091457_T7 (SEQ ID NO: 4037)
AA091457_T8 (SEQ ID NO: 4038)
AA091457_T9 (SEQ ID NO: 4039)
AA091457_T12 (SEQ ID NO: 4040)
AA091457_T14 (SEQ ID NO: 4041)
AA091457_T15 (SEQ ID NO: 4042)
AA091457_T16 (SEQ ID NO: 4043)

TABLE 4185

Segments of interest
Segment Name

AA091457_node_0 (SEQ ID NO: 4802)
AA091457_node_3 (SEQ ID NO: 4803)
AA091457_node_5 (SEQ ID NO: 4804)
AA091457_node_6 (SEQ ID NO: 4805)
AA091457_node_7 (SEQ ID NO: 4806)
AA091457_node_8 (SEQ ID NO: 4807)
AA091457_node_9 (SEQ ID NO: 4808)
AA091457_node_15 (SEQ ID NO: 4809)
AA091457_node_17 (SEQ ID NO: 4810)
AA091457_node_19 (SEQ ID NO: 4811)
AA091457_node_33 (SEQ ID NO: 4812)

TABLE 4185-continued

Segments of interest
Segment Name

AA091457_node_34 (SEQ ID NO: 4813)
AA091457_node_35 (SEQ ID NO: 4814)
AA091457_node_39 (SEQ ID NO: 4815)
AA091457_node_2 (SEQ ID NO: 4816)
AA091457_node_11 (SEQ ID NO: 4817)
AA091457_node_13 (SEQ ID NO: 4818)
AA091457_node_20 (SEQ ID NO: 4819)
AA091457_node_22 (SEQ ID NO: 4820)
AA091457_node_24 (SEQ ID NO: 4821)
AA091457_node_25 (SEQ ID NO: 4822)
AA091457_node_27 (SEQ ID NO: 4823)
AA091457_node_28 (SEQ ID NO: 4824)
AA091457_node_30 (SEQ ID NO: 4825)
AA091457_node_36 (SEQ ID NO: 4826)
AA091457_node_37 (SEQ ID NO: 4827)

TABLE 4186

Proteins of interest

| Protein Name | Corresponding Transcript(s) |
| --- | --- |
| AA091457_P1 | AA091457_T0 (SEQ ID NO: 4031); AA091457_T1 (SEQ ID NO: 4032); AA091457_T2 (SEQ ID NO: 4033); AA091457_T4 (SEQ ID NO: 4034); AA091457_T5 (SEQ ID NO: 4035) |
| AA091457_P2 | AA091457_T6 (SEQ ID NO: 4036); AA091457_T14 (SEQ ID NO: 4041) |
| AA091457_P3 | AA091457_T7 (SEQ ID NO: 4037) |
| AA091457_P4 | AA091457_T8 (SEQ ID NO: 4038) |
| AA091457_P5 | AA091457_T9 (SEQ ID NO: 4039) |
| AA091457_P6 | AA091457_T15 (SEQ ID NO: 4042) |
| AA091457_P8 | AA091457_T12 (SEQ ID NO: 4040) |

Cluster AA091457 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 105 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 105 and Table 4187. This cluster is overexpressed (at least at a minimum level) in the following pathological conditions: epithelial malignant tumors and a mixture of malignant tumors from different tissues.

TABLE 4187

Normal tissue distribution

| Name of Tissue | Number |
| --- | --- |
| adrenal | 0 |
| bladder | 0 |
| bone | 0 |
| brain | 0 |
| colon | 31 |
| epithelial | 1 |
| general | 5 |
| head and neck | 0 |
| kidney | 2 |
| liver | 4 |

TABLE 4187-continued

Normal tissue distribution

| Name of Tissue | Number |
| --- | --- |
| lung | 0 |
| lymph nodes | 56 |
| breast | 0 |
| bone marrow | 31 |
| ovary | 0 |
| 0pancreas | 0 |
| skin | 0 |
| stomach | 0 |
| T cells | 0 |
| uterus | 0 |

TABLE 4188

P values and ratios for expression in cancerous tissue

| Name of Tissue | P1 | P2 | SP1 | R3 | SP2 | R4 |
| --- | --- | --- | --- | --- | --- | --- |
| adrenal | 1 | 4.6e−01 | 1 | 1.0 | 5.3e−01 | 1.9 |
| bladder | 1 | 3.4e−01 | 1 | 1.0 | 2.1e−01 | 2.4 |
| bone | 1 | 2.8e−01 | 1 | 1.0 | 2.4e−01 | 2.4 |
| brain | 5.1e−01 | 5.9e−01 | 4.8e−02 | 6.8 | 1.1e−01 | 4.2 |
| colon | 3.4e−01 | 4.4e−01 | 7.8e−01 | 1.0 | 8.7e−01 | 0.8 |
| epithelial | 6.6e−04 | 5.3e−06 | 9.8e−03 | 4.9 | 1.2e−06 | 8.0 |
| general | 6.0e−04 | 4.7e−09 | 1.1e−02 | 2.5 | 2.6e−11 | 5.0 |
| head and neck | 2.1e−01 | 3.3e−01 | 1 | 1.1 | 1 | 1.0 |
| kidney | 7.3e−01 | 5.8e−01 | 1 | 1.0 | 4.9e−01 | 2.0 |
| liver | 9.1e−01 | 6.0e−01 | 1 | 0.9 | 4.8e−01 | 1.8 |
| lung | 2.4e−01 | 9.1e−02 | 1.7e−01 | 3.9 | 5.5e−02 | 4.7 |
| lymph nodes | 3.3e−01 | 4.6e−01 | 7.4e−01 | 1.0 | 8.9e−01 | 0.7 |
| breast | 1 | 6.7e−01 | 1 | 1.0 | 1.4e−01 | 1.4 |
| bone marrow | 8.6e−01 | 7.2e−01 | 1 | 0.5 | 3.6e−01 | 1.8 |
| ovary | 6.2e−01 | 6.5e−01 | 6.8e−01 | 1.5 | 7.7e−01 | 1.3 |
| pancreas | 1 | 4.4e−01 | 1 | 1.0 | 5.3e−01 | 1.9 |
| skin | 2.3e−01 | 6.9e−02 | 1.4e−01 | 7.0 | 4.1e−01 | 2.2 |
| stomach | 1 | 4.3e−01 | 1 | 1.0 | 5.1e−01 | 1.8 |
| T cells | 1 | 6.7e−01 | 1 | 1.0 | 7.2e−01 | 1.4 |
| uterus | 4.1e−02 | 5.4e−02 | 2.9e−01 | 2.5 | 1.7e−01 | 2.5 |

As noted above, cluster AA091457 features 26 segment(s), which were listed in Table 4185 above and for which the sequence(s) are given at the end of the application. These segment(s) are portions of nucleic acid sequence(s) which are described herein separately because they are of particular interest. A description of each segment according to the present invention is now provided.

Segment cluster AA091457_node_0 (SEQ ID NO:4802) according to the present invention is supported by 3 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041), AA091457_T15 (SEQ ID NO:4042) and AA091457_T16 (SEQ ID NO:4043). Table 4189 below describes the starting and ending position of this segment on each transcript.

TABLE 4189

Segment location on transcripts

| Transcript name | Segment starting position | Segment ending position |
| --- | --- | --- |
| AA091457_T0 (SEQ ID NO: 4031) | 1 | 205 |
| AA091457_T1 (SEQ ID NO: 4032) | 1 | 205 |
| AA091457_T2 (SEQ ID NO: 4033) | 1 | 205 |
| AA091457_T4 (SEQ ID NO: 4034) | 1 | 205 |
| AA091457_T5 (SEQ ID NO: 4035) | 1 | 205 |
| AA091457_T6 (SEQ ID NO: 4036) | 1 | 205 |
| AA091457_T7 (SEQ ID NO: 4037) | 1 | 205 |
| AA091457_T8 (SEQ ID NO: 4038) | 1 | 205 |
| AA091457_T9 (SEQ ID NO: 4039) | 1 | 205 |
| AA091457_T12 (SEQ ID NO: 4040) | 1 | 205 |
| AA091457_T14 (SEQ ID NO: 4041) | 1 | 205 |
| AA091457_T15 (SEQ ID NO: 4042) | 1 | 205 |
| AA091457_T16 (SEQ ID NO: 4043) | 1 | 205 |

This segment can be found in a non-coding region of transcript(s) that are related to the following protein(s): AA091457_P1, AA091457_P2, AA091457_P3, AA091457_P4, AA091457_P5, AA091457_P8 and AA091457_P6.

Segment cluster AA091457_node_3 (SEQ ID NO:4803) according to the present invention is supported by 2 libraries. The number of libraries was determined as previously described. This segment can be found in the following transcript(s): AA091457_T16 (SEQ ID NO:4043). Table 4190 below describes the starting and ending position of this segment on each transcript.

TABLE 4190

Segment location on transcripts

| Transcript name | Segment starting position | Segment ending position |
| --- | --- | --- |
| AA091457_T16 (SEQ ID NO: 4043) | 300 | 522 |

The previously-described transcripts for these segment(s) do not code for protein.

Segment cluster AA091457_node_5 (SEQ ID NO:4804) according to the present invention is supported by 7 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4191 below describes the starting and ending position of this segment on each transcript.

TABLE 4191

Segment location on transcripts

| Transcript name | Segment starting position | Segment ending position |
| --- | --- | --- |
| AA091457_T0 (SEQ ID NO: 4031) | 300 | 813 |
| AA091457_T1 (SEQ ID NO: 4032) | 300 | 813 |
| AA091457_T2 (SEQ ID NO: 4033) | 300 | 813 |
| AA091457_T4 (SEQ ID NO: 4034) | 300 | 813 |

TABLE 4191-continued

Segment location on transcripts

| Transcript name | Segment starting position | Segment ending position |
|---|---|---|
| AA091457_T5 (SEQ ID NO: 4035) | 300 | 813 |
| AA091457_T6 (SEQ ID NO: 4036) | 300 | 813 |
| AA091457_T7 (SEQ ID NO: 4037) | 300 | 813 |
| AA091457_T8 (SEQ ID NO: 4038) | 300 | 813 |
| AA091457_T9 (SEQ ID NO: 4039) | 300 | 813 |
| AA091457_T12 (SEQ ID NO: 4040) | 300 | 813 |
| AA091457_T14 (SEQ ID NO: 4041) | 300 | 813 |
| AA091457_T15 (SEQ ID NO: 4042) | 300 | 813 |

This segment can be found in a non-coding region of transcript(s) that are related to the following protein(s): AA091457_P1, AA091457_P2, AA091457_P3, AA091457_P4, AA091457_P5, AA091457_P8 and AA091457_P6.

Segment cluster AA091457_node__6 (SEQ ID NO:4805) according to the present invention is supported by 14 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T12 (SEQ ID NO:4040), AA091457_T14 (SEQ ID NO:4041) and AA091457_T15 (SEQ ID NO:4042). Table 4192 below describes the starting and ending position of this segment on each transcript.

TABLE 4192

Segment location on transcripts

| Transcript name | Segment starting position | Segment ending position |
|---|---|---|
| AA091457_T0 (SEQ ID NO: 4031) | 814 | 1167 |
| AA091457_T1 (SEQ ID NO: 4032) | 814 | 1167 |
| AA091457_T2 (SEQ ID NO: 4033) | 814 | 1167 |
| AA091457_T4 (SEQ ID NO: 4034) | 814 | 1167 |
| AA091457_T5 (SEQ ID NO: 4035) | 814 | 1167 |
| AA091457_T6 (SEQ ID NO: 4036) | 814 | 1167 |
| AA091457_T7 (SEQ ID NO: 4037) | 814 | 1167 |
| AA091457_T8 (SEQ ID NO: 4038) | 814 | 1167 |
| AA091457_T12 (SEQ ID NO: 4040) | 814 | 1167 |
| AA091457_T14 (SEQ ID NO: 4041) | 814 | 1167 |
| AA091457_T15 (SEQ ID NO: 4042) | 814 | 1167 |

This segment can be found in a non-coding region of transcript(s) that are related to the following protein(s): AA091457_P1, AA091457_P2, AA091457_P3, AA091457_P4, AA091457_P8 and AA091457_P6.

Segment cluster AA091457_node__7 (SEQ ID NO:4806) according to the present invention is supported by 15 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T12 (SEQ ID NO:4040), AA091457_T14 (SEQ ID NO:4041) and AA091457_T15 (SEQ ID NO:4042). Table 4193 below describes the starting and ending position of this segment on each transcript.

TABLE 4193

Segment location on transcripts

| Transcript name | Segment starting position | Segment ending position |
|---|---|---|
| AA091457_T0 (SEQ ID NO: 4031) | 1168 | 1364 |
| AA091457_T1 (SEQ ID NO: 4032) | 1168 | 1364 |
| AA091457_T2 (SEQ ID NO: 4033) | 1168 | 1364 |
| AA091457_T5 (SEQ ID NO: 4035) | 1168 | 1364 |
| AA091457_T6 (SEQ ID NO: 4036) | 1168 | 1364 |
| AA091457_T7 (SEQ ID NO: 4037) | 1168 | 1364 |
| AA091457_T8 (SEQ ID NO: 4038) | 1168 | 1364 |
| AA091457_T12 (SEQ ID NO: 4040) | 1168 | 1364 |
| AA091457_T14 (SEQ ID NO: 4041) | 1168 | 1364 |
| AA091457_T15 (SEQ ID NO: 4042) | 1168 | 1364 |

This segment can be found in a non-coding region of transcript(s) that are related to the following protein(s): AA091457_P1, AA091457_P2, AA091457_P3, AA091457_P4, AA091457_P8 and AA091457_P6.

Segment cluster AA091457_node__8 (SEQ ID NO:4807) according to the present invention is supported by 19 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T12 (SEQ ID NO:4040), AA091457_T14 (SEQ ID NO:4041) and AA091457_T15 (SEQ ID NO:4042). Table 4194 below describes the starting and ending position of this segment on each transcript.

TABLE 4194

Segment location on transcripts

| Transcript name | Segment starting position | Segment ending position |
|---|---|---|
| AA091457_T0 (SEQ ID NO: 4031) | 1365 | 1559 |
| AA091457_T1 (SEQ ID NO: 4032) | 1365 | 1559 |
| AA091457_T2 (SEQ ID NO: 4033) | 1365 | 1559 |
| AA091457_T4 (SEQ ID NO: 4034) | 1168 | 1362 |
| AA091457_T5 (SEQ ID NO: 4035) | 1365 | 1559 |
| AA091457_T6 (SEQ ID NO: 4036) | 1365 | 1559 |
| AA091457_T7 (SEQ ID NO: 4037) | 1365 | 1559 |
| AA091457_T8 (SEQ ID NO: 4038) | 1365 | 1559 |
| AA091457_T12 (SEQ ID NO: 4040) | 1365 | 1559 |
| AA091457_T14 (SEQ ID NO: 4041) | 1365 | 1559 |
| AA091457_T15 (SEQ ID NO: 4042) | 1365 | 1559 |

This segment can be found in a non-coding region of transcript(s) that are related to the following protein(s): AA091457_P1, AA091457_P2, AA091457_P3, AA091457_P4, AA091457_P8 and AA091457_P6.

Segment cluster AA091457_node__9 (SEQ ID NO:4808) according to the present invention is supported by 23 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T12 (SEQ ID NO:4040), AA091457_T14 (SEQ ID NO:4041) and AA091457_T15

(SEQ ID NO:4042). Table 4195 below describes the starting and ending position of this segment on each transcript.

TABLE 4195

Segment location on transcripts

| Transcript name | Segment starting position | Segment ending position |
| --- | --- | --- |
| AA091457_T0 (SEQ ID NO: 4031) | 1560 | 1900 |
| AA091457_T1 (SEQ ID NO: 4032) | 1560 | 1900 |
| AA091457_T2 (SEQ ID NO: 4033) | 1560 | 1900 |
| AA091457_T4 (SEQ ID NO: 4034) | 1363 | 1703 |
| AA091457_T5 (SEQ ID NO: 4035) | 1560 | 1900 |
| AA091457_T6 (SEQ ID NO: 4036) | 1560 | 1900 |
| AA091457_T7 (SEQ ID NO: 4037) | 1560 | 1900 |
| AA091457_T8 (SEQ ID NO: 4038) | 1560 | 1900 |
| AA091457_T12 (SEQ ID NO: 4040) | 1560 | 1900 |
| AA091457_T14 (SEQ ID NO: 4041) | 1560 | 1900 |
| AA091457_T15 (SEQ ID NO: 4042) | 1560 | 1900 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4 and AA091457_P6, since it is in the coding region for the corresponding transcript.

Segment cluster AA091457_node__15 (SEQ ID NO:4809) according to the present invention is supported by 21 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4196 below describes the starting and ending position of this segment on each transcript.

TABLE 4196

Segment location on transcripts

| Transcript name | Segment starting position | Segment ending position |
| --- | --- | --- |
| AA091457_T0 (SEQ ID NO: 4031) | 2069 | 2322 |
| AA091457_T1 (SEQ ID NO: 4032) | 2069 | 2322 |
| AA091457_T2 (SEQ ID NO: 4033) | 2069 | 2322 |
| AA091457_T4 (SEQ ID NO: 4034) | 1872 | 2125 |
| AA091457_T5 (SEQ ID NO: 4035) | 2069 | 2322 |
| AA091457_T6 (SEQ ID NO: 4036) | 2069 | 2322 |
| AA091457_T7 (SEQ ID NO: 4037) | 2069 | 2322 |
| AA091457_T8 (SEQ ID NO: 4038) | 2069 | 2322 |
| AA091457_T9 (SEQ ID NO: 4039) | 982 | 1235 |
| AA091457_T12 (SEQ ID NO: 4040) | 2069 | 2322 |
| AA091457_T14 (SEQ ID NO: 4041) | 2069 | 2322 |
| AA091457_T15 (SEQ ID NO: 4042) | 2069 | 2322 |

This segment can be found in both coding and non-coding regions of transcript(s) as follows. The segment can be found in a non-coding region of transcript(s) that are related to the following protein(s): AA091457_P5 and AA091457_P8. This segment can also be found in the following protein(s): AA091457_P1, AA091457_P2, AA091457_P3, AA091457_P4 and AA091457_P6, since it is in the coding region for the corresponding transcript.

Segment cluster AA091457_node__17 (SEQ ID NO:4810) according to the present invention is supported by 27 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4197 below describes the starting and ending position of this segment on each transcript.

TABLE 4197

Segment location on transcripts

| Transcript name | Segment starting position | Segment ending position |
| --- | --- | --- |
| AA091457_T0 (SEQ ID NO: 4031) | 2323 | 2486 |
| AA091457_T1 (SEQ ID NO: 4032) | 2323 | 2486 |
| AA091457_T2 (SEQ ID NO: 4033) | 2323 | 2486 |
| AA091457_T4 (SEQ ID NO: 4034) | 2126 | 2289 |
| AA091457_T5 (SEQ ID NO: 4035) | 2323 | 2486 |
| AA091457_T6 (SEQ ID NO: 4036) | 2323 | 2486 |
| AA091457_T7 (SEQ ID NO: 4037) | 2323 | 2486 |
| AA091457_T8 (SEQ ID NO: 4038) | 2323 | 2486 |
| AA091457_T9 (SEQ ID NO: 4039) | 1236 | 1399 |
| AA091457_T12 (SEQ ID NO: 4040) | 2323 | 2486 |
| AA091457_T14 (SEQ ID NO: 4041) | 2323 | 2486 |
| AA091457_T15 (SEQ ID NO: 4042) | 2323 | 2486 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node__19 (SEQ ID NO:4811) according to the present invention is supported by 25 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4198 below describes the starting and ending position of this segment on each transcript.

TABLE 4198

Segment location on transcripts

| Transcript name | Segment starting position | Segment ending position |
| --- | --- | --- |
| AA091457_T0 (SEQ ID NO: 4031) | 2487 | 2610 |
| AA091457_T1 (SEQ ID NO: 4032) | 2487 | 2610 |
| AA091457_T2 (SEQ ID NO: 4033) | 2487 | 2610 |
| AA091457_T4 (SEQ ID NO: 4034) | 2290 | 2413 |
| AA091457_T5 (SEQ ID NO: 4035) | 2487 | 2610 |
| AA091457_T6 (SEQ ID NO: 4036) | 2487 | 2610 |

TABLE 4198-continued

Segment location on transcripts

| Transcript name | Segment starting position | Segment ending position |
|---|---|---|
| AA091457_T7 (SEQ ID NO: 4037) | 2487 | 2610 |
| AA091457_T8 (SEQ ID NO: 4038) | 2487 | 2610 |
| AA091457_T9 (SEQ ID NO: 4039) | 1400 | 1523 |
| AA091457_T12 (SEQ ID NO: 4040) | 2487 | 2610 |
| AA091457_T14 (SEQ ID NO: 4041) | 2487 | 2610 |
| AA091457_T15 (SEQ ID NO: 4042) | 2487 | 2610 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_33 (SEQ ID NO:4812) according to the present invention is supported by 28 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4199 below describes the starting and ending position of this segment on each transcript.

TABLE 4199

Segment location on transcripts

| Transcript name | Segment starting position | Segment ending position |
|---|---|---|
| AA091457_T0 (SEQ ID NO: 4031) | 3116 | 3254 |
| AA091457_T1 (SEQ ID NO: 4032) | 3116 | 3254 |
| AA091457_T2 (SEQ ID NO: 4033) | 3116 | 3254 |
| AA091457_T4 (SEQ ID NO: 4034) | 2919 | 3057 |
| AA091457_T5 (SEQ ID NO: 4035) | 3116 | 3254 |
| AA091457_T6 (SEQ ID NO: 4036) | 3116 | 3254 |
| AA091457_T7 (SEQ ID NO: 4037) | 3029 | 3167 |
| AA091457_T8 (SEQ ID NO: 4038) | 3032 | 3170 |
| AA091457_T9 (SEQ ID NO: 4039) | 2029 | 2167 |
| AA091457_T12 (SEQ ID NO: 4040) | 3116 | 3254 |
| AA091457_T14 (SEQ ID NO: 4041) | 3116 | 3254 |
| AA091457_T15 (SEQ ID NO: 4042) | 3032 | 3170 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_34 (SEQ ID NO:4813) according to the present invention is supported by 7 libraries. The number of libraries was determined as previously described. This segment can be found in the following transcript(s): AA091457_T6 (SEQ ID NO:4036), AA091457_T14 (SEQ ID NO:4041) and AA091457_T15 (SEQ ID NO:4042). Table 4200 below describes the starting and ending position of this segment on each transcript.

TABLE 4200

Segment location on transcripts

| Transcript name | Segment starting position | Segment ending position |
|---|---|---|
| AA091457_T6 (SEQ ID NO: 4036) | 3255 | 3595 |
| AA091457_T14 (SEQ ID NO: 4041) | 3255 | 3519 |
| AA091457_T15 (SEQ ID NO: 4042) | 3171 | 3435 |

This segment can be found in the following protein(s): AA091457_P2 and AA091457_P6.

Segment cluster AA091457_node_35 (SEQ ID NO:4814) according to the present invention is supported by 98 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039) and AA091457_T12 (SEQ ID NO:4040). Table 4201 below describes the starting and ending position of this segment on each transcript.

TABLE 4201

Segment location on transcripts

| Transcript name | Segment starting position | Segment ending position |
|---|---|---|
| AA091457_T0 (SEQ ID NO: 4031) | 3255 | 5665 |
| AA091457_T1 (SEQ ID NO: 4032) | 3255 | 5665 |
| AA091457_T2 (SEQ ID NO: 4033) | 3255 | 5665 |
| AA091457_T4 (SEQ ID NO: 4034) | 3058 | 5468 |
| AA091457_T5 (SEQ ID NO: 4035) | 3255 | 4895 |
| AA091457_T6 (SEQ ID NO: 4036) | 3596 | 6006 |
| AA091457_T7 (SEQ ID NO: 4037) | 3168 | 5578 |
| AA091457_T8 (SEQ ID NO: 4038) | 3171 | 5581 |
| AA091457_T9 (SEQ ID NO: 4039) | 2168 | 4578 |
| AA091457_T12 (SEQ ID NO: 4040) | 3255 | 3981 |

This segment can be found in both coding and non-coding regions of transcript(s) as follows. The segment can be found in a non-coding region of transcript(s) that are related to the following protein(s): AA091457_P2 and AA091457_P8. This segment can also be found in the following protein(s): AA091457_P1, AA091457_P3, AA091457_P4 and AA091457_P5, since it is in the coding region for the corresponding transcript.

Segment cluster AA091457_node_39 (SEQ ID NO:4815) according to the present invention is supported by 33 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T6 (SEQ ID NO:4036), AA091457_T7 (SEQ ID NO:4037), AA091457_T8 (SEQ ID NO:4038) and AA091457_T9 (SEQ ID NO:4039). Table 4202 below describes the starting and ending position of this segment on each transcript.

TABLE 4202

Segment location on transcripts

| Transcript name | Segment starting position | Segment ending position |
|---|---|---|
| AA091457_T0 (SEQ ID NO: 4031) | 5900 | 6950 |
| AA091457_T1 (SEQ ID NO: 4032) | 5900 | 5983 |
| AA091457_T2 (SEQ ID NO: 4033) | 5900 | 6037 |
| AA091457_T4 (SEQ ID NO: 4034) | 5703 | 6753 |
| AA091457_T6 (SEQ ID NO: 4036) | 6241 | 7291 |
| AA091457_T7 (SEQ ID NO: 4037) | 5813 | 6863 |
| AA091457_T8 (SEQ ID NO: 4038) | 5816 | 6866 |
| AA091457_T9 (SEQ ID NO: 4039) | 4813 | 5863 |

This segment can be found in a non-coding region of transcript(s) that are related to the following protein(s): AA091457_P1, AA091457_P2, AA091457_P3, AA091457_P4 and AA091457_P5.

According to an optional embodiment of the present invention, short segments related to the above cluster are also provided. These segments are up to about 120 bp in length, and so are included in a separate description.

Segment cluster AA091457_node__2 (SEQ ID NO:4816) according to the present invention is supported by 4 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041), AA091457_T15 (SEQ ID NO:4042) and AA091457_T16 (SEQ ID NO:4043). Table 4203 below describes the starting and ending position of this segment on each transcript.

TABLE 4203

Segment location on transcripts

| Transcript name | Segment starting position | Segment ending position |
|---|---|---|
| AA091457_T0 (SEQ ID NO: 4031) | 206 | 299 |
| AA091457_T1 (SEQ ID NO: 4032) | 206 | 299 |
| AA091457_T2 (SEQ ID NO: 4033) | 206 | 299 |
| AA091457_T4 (SEQ ID NO: 4034) | 206 | 299 |
| AA091457_T5 (SEQ ID NO: 4035) | 206 | 299 |
| AA091457_T6 (SEQ ID NO: 4036) | 206 | 299 |
| AA091457_T7 (SEQ ID NO: 4037) | 206 | 299 |
| AA091457_T8 (SEQ ID NO: 4038) | 206 | 299 |
| AA091457_T9 (SEQ ID NO: 4039) | 206 | 299 |
| AA091457_T12 (SEQ ID NO: 4040) | 206 | 299 |
| AA091457_T14 (SEQ ID NO: 4041) | 206 | 299 |
| AA091457_T15 (SEQ ID NO: 4042) | 206 | 299 |
| AA091457_T16 (SEQ ID NO: 4043) | 206 | 299 |

This segment can be found in a non-coding region of transcript(s) that are related to the following protein(s): AA091457_P1, AA091457_P2, AA091457_P3, AA091457_P4, AA091457_P5, AA091457_P8 and AA091457_P6.

Segment cluster AA091457_node__11 (SEQ ID NO:4817) according to the present invention is supported by 18 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4204 below describes the starting and ending position of this segment on each transcript.

TABLE 4204

Segment location on transcripts

| Transcript name | Segment starting position | Segment ending position |
|---|---|---|
| AA091457_T0 (SEQ ID NO: 4031) | 1901 | 1971 |
| AA091457_T1 (SEQ ID NO: 4032) | 1901 | 1971 |
| AA091457_T2 (SEQ ID NO: 4033) | 1901 | 1971 |
| AA091457_T4 (SEQ ID NO: 4034) | 1704 | 1774 |
| AA091457_T5 (SEQ ID NO: 4035) | 1901 | 1971 |
| AA091457_T6 (SEQ ID NO: 4036) | 1901 | 1971 |
| AA091457_T7 (SEQ ID NO: 4037) | 1901 | 1971 |
| AA091457_T8 (SEQ ID NO: 4038) | 1901 | 1971 |
| AA091457_T9 (SEQ ID NO: 4039) | 814 | 884 |
| AA091457_T12 (SEQ ID NO: 4040) | 1901 | 1971 |
| AA091457_T14 (SEQ ID NO: 4041) | 1901 | 1971 |
| AA091457_T15 (SEQ ID NO: 4042) | 1901 | 1971 |

This segment can be found in both coding and non-coding regions of transcript(s) as follows. The segment can be found in a non-coding region of transcript(s) that are related to the following protein(s): AA091457_P5 and AA091457_P8. This segment can also be found in the following protein(s): AA091457_P1, AA091457_P2, AA091457_P3, AA091457_P4 and AA091457_P6, since it is in the coding region for the corresponding transcript.

Segment cluster AA091457_node__13 (SEQ ID NO:4818) according to the present invention is supported by 20 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4205 below describes the starting and ending position of this segment on each transcript.

TABLE 4205

Segment location on transcripts

| Transcript name | Segment starting position | Segment ending position |
|---|---|---|
| AA091457_T0 (SEQ ID NO: 4031) | 1972 | 2068 |
| AA091457_T1 (SEQ ID NO: 4032) | 1972 | 2068 |
| AA091457_T2 (SEQ ID NO: 4033) | 1972 | 2068 |
| AA091457_T4 (SEQ ID NO: 4034) | 1775 | 1871 |
| AA091457_T5 (SEQ ID NO: 4035) | 1972 | 2068 |
| AA091457_T6 (SEQ ID NO: 4036) | 1972 | 2068 |
| AA091457_T7 (SEQ ID NO: 4037) | 1972 | 2068 |
| AA091457_T8 (SEQ ID NO: 4038) | 1972 | 2068 |
| AA091457_T9 (SEQ ID NO: 4039) | 885 | 981 |
| AA091457_T12 (SEQ ID NO: 4040) | 1972 | 2068 |
| AA091457_T14 (SEQ ID NO: 4041) | 1972 | 2068 |
| AA091457_T15 (SEQ ID NO: 4042) | 1972 | 2068 |

This segment can be found in both coding and non-coding regions of transcript(s) as follows. The segment can be found in a non-coding region of transcript(s) that are related to the following protein(s): AA091457_P5 and AA091457_P8. This segment can also be found in the following protein(s): AA091457_P1, AA091457_P2, AA091457_P3, AA091457_P4 and AA091457_P6, since it is in the coding region for the corresponding transcript.

Segment cluster AA091457_node_20 (SEQ ID NO:4819) according to the present invention can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4206 below describes the starting and ending position of this segment on each transcript.

TABLE 4206

Segment location on transcripts

| Transcript name | Segment starting position | Segment ending position |
| --- | --- | --- |
| AA091457_T0 (SEQ ID NO: 4031) | 2611 | 2633 |
| AA091457_T1 (SEQ ID NO: 4032) | 2611 | 2633 |
| AA091457_T2 (SEQ ID NO: 4033) | 2611 | 2633 |
| AA091457_T4 (SEQ ID NO: 4034) | 2414 | 2436 |
| AA091457_T5 (SEQ ID NO: 4035) | 2611 | 2633 |
| AA091457_T6 (SEQ ID NO: 4036) | 2611 | 2633 |
| AA091457_T7 (SEQ ID NO: 4037) | 2611 | 2633 |
| AA091457_T8 (SEQ ID NO: 4038) | 2611 | 2633 |
| AA091457_T9 (SEQ ID NO: 4039) | 1524 | 1546 |
| AA091457_T12 (SEQ ID NO: 4040) | 2611 | 2633 |
| AA091457_T14 (SEQ ID NO: 4041) | 2611 | 2633 |
| AA091457_T15 (SEQ ID NO: 4042) | 2611 | 2633 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_22 (SEQ ID NO:4820) according to the present invention is supported by 26 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4207 below describes the starting and ending position of this segment on each transcript.

TABLE 4207

Segment location on transcripts

| Transcript name | Segment starting position | Segment ending position |
| --- | --- | --- |
| AA091457_T0 (SEQ ID NO: 4031) | 2634 | 2708 |
| AA091457_T1 (SEQ ID NO: 4032) | 2634 | 2708 |
| AA091457_T2 (SEQ ID NO: 4033) | 2634 | 2708 |
| AA091457_T4 (SEQ ID NO: 4034) | 2437 | 2511 |
| AA091457_T5 (SEQ ID NO: 4035) | 2634 | 2708 |
| AA091457_T6 (SEQ ID NO: 4036) | 2634 | 2708 |
| AA091457_T7 (SEQ ID NO: 4037) | 2634 | 2708 |
| AA091457_T8 (SEQ ID NO: 4038) | 2634 | 2708 |
| AA091457_T9 (SEQ ID NO: 4039) | 1547 | 1621 |
| AA091457_T12 (SEQ ID NO: 4040) | 2634 | 2708 |
| AA091457_T14 (SEQ ID NO: 4041) | 2634 | 2708 |
| AA091457_T15 (SEQ ID NO: 4042) | 2634 | 2708 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_24 (SEQ ID NO:4821) according to the present invention is supported by 25 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4208 below describes the starting and ending position of this segment on each transcript.

TABLE 4208

Segment location on transcripts

| Transcript name | Segment starting position | Segment ending position |
| --- | --- | --- |
| AA091457_T0 (SEQ ID NO: 4031) | 2709 | 2789 |
| AA091457_T1 (SEQ ID NO: 4032) | 2709 | 2789 |
| AA091457_T2 (SEQ ID NO: 4033) | 2709 | 2789 |
| AA091457_T4 (SEQ ID NO: 4034) | 2512 | 2592 |
| AA091457_T5 (SEQ ID NO: 4035) | 2709 | 2789 |
| AA091457_T6 (SEQ ID NO: 4036) | 2709 | 2789 |
| AA091457_T7 (SEQ ID NO: 4037) | 2709 | 2789 |
| AA091457_T8 (SEQ ID NO: 4038) | 2709 | 2789 |
| AA091457_T9 (SEQ ID NO: 4039) | 1622 | 1702 |
| AA091457_T12 (SEQ ID NO: 4040) | 2709 | 2789 |
| AA091457_T14 (SEQ ID NO: 4041) | 2709 | 2789 |
| AA091457_T15 (SEQ ID NO: 4042) | 2709 | 2789 |

This segment can be found in the following protein(s): AA091457_P1, AA091457_P2, AA091457_P3, AA091457_P4, AA091457_P5, AA091457_P8 and AA091457_P6.

Segment cluster AA091457_node_25 (SEQ ID NO:4822) according to the present invention is supported by 28 libraries. The number of libraries was determined as previously described. This segment can be found in the following transcript(s): AA091457_T0 (SEQ ID NO:4031), AA091457_T1

(SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4209 below describes the starting and ending position of this segment on each transcript.

TABLE 4209

Segment location on transcripts

| Transcript name | Segment starting position | Segment ending position |
|---|---|---|
| AA091457_T0 (SEQ ID NO: 4031) | 2790 | 2876 |
| AA091457_T1 (SEQ ID NO: 4032) | 2790 | 2876 |
| AA091457_T2 (SEQ ID NO: 4033) | 2790 | 2876 |
| AA091457_T4 (SEQ ID NO: 4034) | 2593 | 2679 |
| AA091457_T5 (SEQ ID NO: 4035) | 2790 | 2876 |
| AA091457_T6 (SEQ ID NO: 4036) | 2790 | 2876 |
| AA091457_T8 (SEQ ID NO: 4038) | 2790 | 2876 |
| AA091457_T9 (SEQ ID NO: 4039) | 1703 | 1789 |
| AA091457_T12 (SEQ ID NO: 4040) | 2790 | 2876 |
| AA091457_T14 (SEQ ID NO: 4041) | 2790 | 2876 |
| AA091457_T15 (SEQ ID NO: 4042) | 2790 | 2876 |

This segment can be found in the following protein(s): AA091457_P1, AA091457_P2, AA091457_P4, AA091457_P5, AA091457_P8 and AA091457_P6.

Segment cluster AA091457_node_27 (SEQ ID NO:4823) according to the present invention is supported by 29 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T9 (SEQ ID NO:4039), AA091457_T12 (SEQ ID NO:4040) and AA091457_T14 (SEQ ID NO:4041). Table 4210 below describes the starting and ending position of this segment on each transcript.

TABLE 4210

Segment location on transcripts

| Transcript name | Segment starting position | Segment ending position |
|---|---|---|
| AA091457_T0 (SEQ ID NO: 4031) | 2877 | 2960 |
| AA091457_T1 (SEQ ID NO: 4032) | 2877 | 2960 |
| AA091457_T2 (SEQ ID NO: 4033) | 2877 | 2960 |
| AA091457_T4 (SEQ ID NO: 4034) | 2680 | 2763 |
| AA091457_T5 (SEQ ID NO: 4035) | 2877 | 2960 |
| AA091457_T6 (SEQ ID NO: 4036) | 2877 | 2960 |
| AA091457_T7 (SEQ ID NO: 4037) | 2790 | 2873 |
| AA091457_T9 (SEQ ID NO: 4039) | 1790 | 1873 |
| AA091457_T12 (SEQ ID NO: 4040) | 2877 | 2960 |
| AA091457_T14 (SEQ ID NO: 4041) | 2877 | 2960 |

This segment can be found in the following protein(s): AA091457_P1, AA091457_P2, AA091457_P3, AA091457_P5 and AA091457_P8.

Segment cluster AA091457_node_28 (SEQ ID NO:4824) according to the present invention is supported by 29 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4211 below describes the starting and ending position of this segment on each transcript.

TABLE 4211

Segment location on transcripts

| Transcript name | Segment starting position | Segment ending position |
|---|---|---|
| AA091457_T0 (SEQ ID NO: 4031) | 2961 | 3006 |
| AA091457_T1 (SEQ ID NO: 4032) | 2961 | 3006 |
| AA091457_T2 (SEQ ID NO: 4033) | 2961 | 3006 |
| AA091457_T4 (SEQ ID NO: 4034) | 2764 | 2809 |
| AA091457_T5 (SEQ ID NO: 4035) | 2961 | 3006 |
| AA091457_T6 (SEQ ID NO: 4036) | 2961 | 3006 |
| AA091457_T7 (SEQ ID NO: 4037) | 2874 | 2919 |
| AA091457_T8 (SEQ ID NO: 4038) | 2877 | 2922 |
| AA091457_T9 (SEQ ID NO: 4039) | 1874 | 1919 |
| AA091457_T12 (SEQ ID NO: 4040) | 2961 | 3006 |
| AA091457_T14 (SEQ ID NO: 4041) | 2961 | 3006 |
| AA091457_T15 (SEQ ID NO: 4042) | 2877 | 2922 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_30 (SEQ ID NO:4825) according to the present invention is supported by 33 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T5 (SEQ ID NO:4035), AA091457_T6 (SEQ ID NO:4036), AA091457_T7 (SEQ ID NO:4037), AA091457_T8 (SEQ ID NO:4038), AA091457_T9 (SEQ ID NO:4039), AA091457_T12 (SEQ ID NO:4040), AA091457_T14 (SEQ ID NO:4041) and AA091457_T15 (SEQ ID NO:4042). Table 4212 below describes the starting and ending position of this segment on each transcript.

TABLE 4212

Segment location on transcripts

| Transcript name | Segment starting position | Segment ending position |
|---|---|---|
| AA091457_T0 (SEQ ID NO: 4031) | 3007 | 3115 |
| AA091457_T1 (SEQ ID NO: 4032) | 3007 | 3115 |
| AA091457_T2 (SEQ ID NO: 4033) | 3007 | 3115 |
| AA091457_T4 (SEQ ID NO: 4034) | 2810 | 2918 |
| AA091457_T5 (SEQ ID NO: 4035) | 3007 | 3115 |
| AA091457_T6 (SEQ ID NO: 4036) | 3007 | 3115 |
| AA091457_T7 (SEQ ID NO: 4037) | 2920 | 3028 |
| AA091457_T8 (SEQ ID NO: 4038) | 2923 | 3031 |
| AA091457_T9 (SEQ ID NO: 4039) | 1920 | 2028 |
| AA091457_T12 (SEQ ID NO: 4040) | 3007 | 3115 |
| AA091457_T14 (SEQ ID NO: 4041) | 3007 | 3115 |
| AA091457_T15 (SEQ ID NO: 4042) | 2923 | 3031 |

This segment can be found in both coding and non-coding regions of transcript(s) as follows. The segment can be found in a non-coding region of transcript(s) that are related to the following protein(s): AA091457_P8. This segment can also be found in the following protein(s): AA091457_P1, AA091457_P2, AA091457_P3, AA091457_P4, AA091457_P5 and AA091457_P6, since it is in the coding region for the corresponding transcript.

Segment cluster AA091457_node_36 (SEQ ID NO:4826) according to the present invention is supported by 30 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T6 (SEQ ID NO:4036), AA091457_T7 (SEQ ID NO:4037), AA091457_T8 (SEQ ID NO:4038) and AA091457_T9 (SEQ ID NO:4039). Table 4213 below describes the starting and ending position of this segment on each transcript.

TABLE 4213

Segment location on transcripts

| Transcript name | Segment starting position | Segment ending position |
|---|---|---|
| AA091457_T0 (SEQ ID NO: 4031) | 5666 | 5780 |
| AA091457_T1 (SEQ ID NO: 4032) | 5666 | 5780 |
| AA091457_T2 (SEQ ID NO: 4033) | 5666 | 5780 |
| AA091457_T4 (SEQ ID NO: 4034) | 5469 | 5583 |
| AA091457_T6 (SEQ ID NO: 4036) | 6007 | 6121 |
| AA091457_T7 (SEQ ID NO: 4037) | 5579 | 5693 |
| AA091457_T8 (SEQ ID NO: 4038) | 5582 | 5696 |
| AA091457_T9 (SEQ ID NO: 4039) | 4579 | 4693 |

This segment can be found in a non-coding region of transcript(s) that are related to the following protein(s): AA091457_P1, AA091457_P2, AA091457_P3, AA091457_P4 and AA091457_P5.

Segment cluster AA091457_node_37 (SEQ ID NO:4827) according to the present invention is supported by 28 libraries. The number of libraries was determined as previously described. This segment can be found in the following transcript(s): AA091457_T0 (SEQ ID NO:4031), AA091457_T1 (SEQ ID NO:4032), AA091457_T2 (SEQ ID NO:4033), AA091457_T4 (SEQ ID NO:4034), AA091457_T6 (SEQ ID NO:4036), AA091457_T7 (SEQ ID NO:4037), AA091457_T8 (SEQ ID NO:4038) and AA091457_T9 (SEQ ID NO:4039). Table 4214 below describes the starting and ending position of this segment on each transcript.

TABLE 4214

Segment location on transcripts

| Transcript name | Segment starting position | Segment ending position |
|---|---|---|
| AA091457_T0 (SEQ ID NO: 4031) | 5781 | 5899 |
| AA091457_T1 (SEQ ID NO: 4032) | 5781 | 5899 |
| AA091457_T2 (SEQ ID NO: 4033) | 5781 | 5899 |
| AA091457_T4 (SEQ ID NO: 4034) | 5584 | 5702 |
| AA091457_T6 (SEQ ID NO: 4036) | 6122 | 6240 |
| AA091457_T7 (SEQ ID NO: 4037) | 5694 | 5812 |
| AA091457_T8 (SEQ ID NO: 4038) | 5697 | 5815 |
| AA091457_T9 (SEQ ID NO: 4039) | 4694 | 4812 |

This segment can be found in a non-coding region of transcript(s) that are related to the following protein(s): AA091457_P1, AA091457_P2, AA091457_P3, AA091457_P4 and AA091457_P5.

Description for Cluster AA722065

Cluster AA722065 features 4 transcript(s) and 4 segment(s) of interest, the names for which are given in Tables 4215 and 4216, respectively, the sequences themselves are given at the end of the application. The selected protein variants are given in Table 4217.

TABLE 4215

Transcripts of interest
Transcript Name

AA722065_T0 (SEQ ID NO: 4044)
AA722065_T1 (SEQ ID NO: 4045)
AA722065_T2 (SEQ ID NO: 4046)
AA722065_T3 (SEQ ID NO: 4047)

TABLE 4216

Segments of interest
Segment Name

AA722065_node_0 (SEQ ID NO: 4828)
AA722065_node_5 (SEQ ID NO: 4829)
AA722065_node_7 (SEQ ID NO: 4830)
AA722065_node_8 (SEQ ID NO: 4831)

TABLE 4217

Proteins of interest

| Protein Name | Corresponding Transcript(s) |
|---|---|
|  |  |

The heart-selective diagnostic marker prediction engine provided the following results with regard to cluster AA722065. Predictions were made for selective expression of transcripts of this contig in heart tissue, according to the previously described methods. The numbers on the y-axis of FIG. 106 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 106, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 41.7; the ratio of expression of the cluster in heart specific ESTs to the overall expression of the cluster in muscle-specific ESTs which was found to be 2.2; and fisher exact test P-values were computed both for library and weighted clone counts to check that the counts are statistically significant, and were found to be 4.70E-03.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 41.7, which clearly supports specific expression in heart tissue.

As noted above, cluster AA722065 features 4 segment(s), which were listed in Table 4216 above and for which the sequence(s) are given at the end of the application. These segment(s) are portions of nucleic acid sequence(s) which are described herein separately because they are of particular interest. A description of each segment according to the present invention is now provided.

Segment cluster AA722065_node_0 (SEQ ID NO:4828) according to the present invention is supported by 7 libraries. The number of libraries was determined as previously described. This segment can be found in the following transcript(s): AA722065_T2 (SEQ ID NO:4046) and AA722065_T3 (SEQ ID NO:4047). Table 4218 below describes the starting and ending position of this segment on each transcript.

TABLE 4218

| | Segment location on transcripts | |
|---|---|---|
| Transcript name | Segment starting position | Segment ending position |
| AA722065_T2 (SEQ ID NO: 4046) | 1 | 214 |
| AA722065_T3 (SEQ ID NO: 4047) | 1 | 214 |

The previously-described transcripts for these segment(s) do not code for protein.

Segment cluster AA722065_node_5 (SEQ ID NO:4829) according to the present invention is supported by 1 libraries. The number of libraries was determined as previously described. This segment can be found in the following transcript(s): AA722065_T3 (SEQ ID NO:4047). Table 4219 below describes the starting and ending position of this segment on each transcript.

TABLE 4219

| | Segment location on transcripts | |
|---|---|---|
| Transcript name | Segment starting position | Segment ending position |
| AA722065_T3 (SEQ ID NO: 4047) | 215 | 366 |

The previously-described transcripts for these segment(s) do not code for protein.

Segment cluster AA722065_node_7 (SEQ ID NO:4830) according to the present invention is supported by 2 libraries. The number of libraries was determined as previously described. This segment can be found in the following transcript(s): AA722065_T0 (SEQ ID NO:4044) and AA722065_T1 (SEQ ID NO:4045). Table 4220 below describes the starting and ending position of this segment on each transcript.

TABLE 4220

| | Segment location on transcripts | |
|---|---|---|
| Transcript name | Segment starting position | Segment ending position |
| AA722065_T0 (SEQ ID NO: 4044) | 1 | 957 |
| AA722065_T1 (SEQ ID NO: 4045) | 1 | 957 |

The previously-described transcripts for these segment(s) do not code for protein.

Segment cluster AA722065_node_8 (SEQ ID NO:4831) according to the present invention is supported by 7 libraries. The number of libraries was determined as previously described. This segment can be found in the following transcript(s): AA722065_T0 (SEQ ID NO:4044), AA722065_T1 (SEQ ID NO:4045), AA722065_T2 (SEQ ID NO:4046) and AA722065_T3 (SEQ ID NO:4047). Table 4221 below describes the starting and ending position of this segment on each transcript.

TABLE 4221

| | Segment location on transcripts | |
|---|---|---|
| Transcript name | Segment starting position | Segment ending position |
| AA722065_T0 (SEQ ID NO: 4044) | 958 | 1241 |
| AA722065_T1 (SEQ ID NO: 4045) | 958 | 1732 |
| AA722065_T2 (SEQ ID NO: 4046) | 215 | 498 |
| AA722065_T3 (SEQ ID NO: 4047) | 367 | 650 |

The previously-described transcripts for these segment(s) do not code for protein.

Description for Cluster AL600896

Cluster AL600896 features 1 transcript(s) and 1 segment(s) of interest, the names for which are given in Tables 4222 and 4223, respectively, the sequences themselves are given at the end of the application. The selected protein variants are given in Table 4224.

TABLE 4222

Transcripts of interest
Transcript Name

AL600896_T0 (SEQ ID NO: 4048)

TABLE 4223

Segments of interest
Segment Name

AL600896_node_0 (SEQ ID NO: 4832)

TABLE 4224

Proteins of interest

| Protein Name | Corresponding Transcript(s) |
|---|---|

The heart-selective diagnostic marker prediction engine provided the following results with regard to cluster AL600896. Predictions were made for selective expression of transcripts of this contig in heart tissue, according to the previously described methods. The numbers on the y-axis of FIG. 107 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 107, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 85.3; the ratio of expression of the cluster in heart specific ESTs to the overall expression of the cluster in muscle-specific ESTs which was found to be 55.5; and fisher exact test P-values were computed both for library and weighted clone counts to check that the counts are statistically significant, and were found to be 3.50E-05.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 85.3, which clearly supports specific expression in heart tissue.

As noted above, cluster AL600896 features 1 segment(s), which were listed in Table 4223 above and for which the sequence(s) are given at the end of the application. These segment(s) are portions of nucleic acid sequence(s) which are described herein separately because they are of particular interest. A description of each segment according to the present invention is now provided.

Segment cluster AL600896_node_0 (SEQ ID NO:4832) according to the present invention is supported by 8 libraries. The number of libraries was determined as previously described. This segment can be found in the following transcript(s): AL600896_T0 (SEQ ID NO:4048). Table 4225 below describes the starting and ending position of this segment on each transcript.

TABLE 4225

Segment location on transcripts

| Transcript name | Segment starting position | Segment ending position |
|---|---|---|
| AL600896_T0 (SEQ ID NO: 4048) | 1 | 1138 |

The previously-described transcripts for these segment(s) do not code for protein.

Description for Cluster F09066

Cluster F09066 features 23 transcript(s) and 72 segment(s) of interest, the names for which are given in Tables 4226 and 4227, respectively, the sequences themselves are given at the end of the application. The selected protein variants are given in Table 4228.

TABLE 4226

Transcripts of interest
Transcript Name

F09066_T1 (SEQ ID NO: 4049)
F09066_T2 (SEQ ID NO: 4050)
F09066_T5 (SEQ ID NO: 4051)
F09066_T8 (SEQ ID NO: 4052)
F09066_T9 (SEQ ID NO: 4053)
F09066_T10 (SEQ ID NO: 4054)
F09066_T11 (SEQ ID NO: 4055)
F09066_T12 (SEQ ID NO: 4056)
F09066_T13 (SEQ ID NO: 4057)
F09066_T14 (SEQ ID NO: 4058)
F09066_T15 (SEQ ID NO: 4059)
F09066_T17 (SEQ ID NO: 4060)
F09066_T18 (SEQ ID NO: 4061)
F09066_T20 (SEQ ID NO: 4062)
F09066_T24 (SEQ ID NO: 4063)
F09066_T26 (SEQ ID NO: 4064)
F09066_T27 (SEQ ID NO: 4065)
F09066_T29 (SEQ ID NO: 4066)
F09066_T36 (SEQ ID NO: 4067)
F09066_T39 (SEQ ID NO: 4068)
F09066_T41 (SEQ ID NO: 4069)
F09066_T42 (SEQ ID NO: 4070)
F09066_T43 (SEQ ID NO: 4071)

TABLE 4227

Segments of interest
Segment Name

F09066_node_0 (SEQ ID NO: 4833)
F09066_node_6 (SEQ ID NO: 4834)
F09066_node_21 (SEQ ID NO: 4835)
F09066_node_31 (SEQ ID NO: 4836)
F09066_node_32 (SEQ ID NO: 4837)
F09066_node_38 (SEQ ID NO: 4838)
F09066_node_41 (SEQ ID NO: 4839)
F09066_node_46 (SEQ ID NO: 4840)
F09066_node_47 (SEQ ID NO: 4841)
F09066_node_51 (SEQ ID NO: 4842)
F09066_node_57 (SEQ ID NO: 4843)
F09066_node_58 (SEQ ID NO: 4844)
F09066_node_60 (SEQ ID NO: 4845)
F09066_node_63 (SEQ ID NO: 4846)
F09066_node_69 (SEQ ID NO: 4847)
F09066_node_70 (SEQ ID NO: 4848)
F09066_node_74 (SEQ ID NO: 4849)
F09066_node_75 (SEQ ID NO: 4850)
F09066_node_78 (SEQ ID NO: 4851)
F09066_node_84 (SEQ ID NO: 4852)
F09066_node_86 (SEQ ID NO: 4853)
F09066_node_95 (SEQ ID NO: 4854)
F09066_node_98 (SEQ ID NO: 4855)
F09066_node_100 (SEQ ID NO: 4856)
F09066_node_102 (SEQ ID NO: 4857)
F09066_node_103 (SEQ ID NO: 4858)
F09066_node_105 (SEQ ID NO: 4859)
F09066_node_106 (SEQ ID NO: 4860)
F09066_node_117 (SEQ ID NO: 4861)
F09066_node_8 (SEQ ID NO: 4862)
F09066_node_9 (SEQ ID NO: 4863)
F09066_node_13 (SEQ ID NO: 4864)
F09066_node_23 (SEQ ID NO: 4865)
F09066_node_26 (SEQ ID NO: 4866)
F09066_node_30 (SEQ ID NO: 4867)
F09066_node_33 (SEQ ID NO: 4868)
F09066_node_35 (SEQ ID NO: 4869)
F09066_node_36 (SEQ ID NO: 4870)
F09066_node_37 (SEQ ID NO: 4871)
F09066_node_40 (SEQ ID NO: 4872)
F09066_node_49 (SEQ ID NO: 4873)
F09066_node_53 (SEQ ID NO: 4874)
F09066_node_55 (SEQ ID NO: 4875)
F09066_node_56 (SEQ ID NO: 4876)

TABLE 4227-continued

Segments of interest

Segment Name

F09066_node_59 (SEQ ID NO: 4877)
F09066_node_66 (SEQ ID NO: 4878)
F09066_node_67 (SEQ ID NO: 4879)
F09066_node_71 (SEQ ID NO: 4880)
F09066_node_72 (SEQ ID NO: 4881)
F09066_node_76 (SEQ ID NO: 4882)
F09066_node_77 (SEQ ID NO: 4883)
F09066_node_79 (SEQ ID NO: 4884)
F09066_node_80 (SEQ ID NO: 4885)
F09066_node_81 (SEQ ID NO: 4886)
F09066_node_83 (SEQ ID NO: 4887)
F09066_node_88 (SEQ ID NO: 4888)
F09066_node_89 (SEQ ID NO: 4889)
F09066_node_90 (SEQ ID NO: 4890)
F09066_node_91 (SEQ ID NO: 4891)
F09066_node_92 (SEQ ID NO: 4892)
F09066_node_93 (SEQ ID NO: 4893)
F09066_node_104 (SEQ ID NO: 4894)
F09066_node_107 (SEQ ID NO: 4895)
F09066_node_108 (SEQ ID NO: 4896)
F09066_node_109 (SEQ ID NO: 4897)
F09066_node_110 (SEQ ID NO: 4898)
F09066_node_111 (SEQ ID NO: 4899)
F09066_node_112 (SEQ ID NO: 4900)
F09066_node_113 (SEQ ID NO: 4901)
F09066_node_114 (SEQ ID NO: 4902)
F09066_node_115 (SEQ ID NO: 4903)
F09066_node_116 (SEQ ID NO: 4904)

TABLE 4228

Proteins of interest

| Protein Name | Corresponding Transcript(s) |
|---|---|
| F09066_P2 | F09066_T1 (SEQ ID NO: 4049); F09066_T11 (SEQ ID NO: 4055); F09066_T24 (SEQ ID NO: 4063) |
| F09066_P3 | F09066_T2 (SEQ ID NO: 4050); F09066_T20 (SEQ ID NO: 4062) |
| F09066_P5 | F09066_T5 (SEQ ID NO: 4051); F09066_T9 (SEQ ID NO: 4053) |
| F09066_P6 | F09066_T8 (SEQ ID NO: 4052); F09066_T15 (SEQ ID NO: 4059) |
| F09066_P7 | F09066_T10 (SEQ ID NO: 4054) |
| F09066_P8 | F09066_T12 (SEQ ID NO: 4056) |
| F09066_P9 | F09066_T13 (SEQ ID NO: 4057) |
| F09066_P10 | F09066_T14 (SEQ ID NO: 4058) |
| F09066_P12 | F09066_T17 (SEQ ID NO: 4060) |
| F09066_P13 | F09066_T18 (SEQ ID NO: 4061) |
| F09066_P18 | F09066_T26 (SEQ ID NO: 4064) |
| F09066_P19 | F09066_T27 (SEQ ID NO: 4065) |
| F09066_P27 | F09066_T36 (SEQ ID NO: 4067) |
| F09066_P30 | F09066_T39 (SEQ ID NO: 4068); F09066_T41 (SEQ ID NO: 4069); F09066_T42 (SEQ ID NO: 4070); F09066_T43 (SEQ ID NO: 4071) |
| F09066_P35 | F09066_T29 (SEQ ID NO: 4066) |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4229.

TABLE 4229

Oligonucleotides related to this cluster

| Oligonucleotide name | Overexpressed in cancers | Chip reference |
|---|---|---|
| F09066_0_46_0 | lung malignant tumors | LUN |

As noted above, cluster F09066 features 72 segment(s), which were listed in Table 4227 above and for which the sequence(s) are given at the end of the application. These segment(s) are portions of nucleic acid sequence(s) which are described herein separately because they are of particular interest. A description of each segment according to the present invention is now provided.

Segment cluster F09066_node_0 (SEQ ID NO:4833) according to the present invention is supported by 1 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4230 below describes the starting and ending position of this segment on each transcript.

TABLE 4230

Segment location on transcripts

| Transcript name | Segment starting position | Segment ending position |
|---|---|---|
| F09066_T1 (SEQ ID NO: 4049) | 1 | 146 |
| F09066_T2 (SEQ ID NO: 4050) | 1 | 146 |
| F09066_T5 (SEQ ID NO: 4051) | 1 | 146 |
| F09066_T8 (SEQ ID NO: 4052) | 1 | 146 |
| F09066_T9 (SEQ ID NO: 4053) | 1 | 146 |
| F09066_T10 (SEQ ID NO: 4054) | 1 | 146 |
| F09066_T11 (SEQ ID NO: 4055) | 1 | 146 |
| F09066_T12 (SEQ ID NO: 4056) | 1 | 146 |
| F09066_T13 (SEQ ID NO: 4057) | 1 | 146 |
| F09066_T14 (SEQ ID NO: 4058) | 1 | 146 |
| F09066_T15 (SEQ ID NO: 4059) | 1 | 146 |
| F09066_T17 (SEQ ID NO: 4060) | 1 | 146 |
| F09066_T18 (SEQ ID NO: 4061) | 1 | 146 |
| F09066_T20 (SEQ ID NO: 4062) | 1 | 146 |
| F09066_T24 (SEQ ID NO: 4063) | 1 | 146 |
| F09066_T26 (SEQ ID NO: 4064) | 1 | 146 |
| F09066_T27 (SEQ ID NO: 4065) | 1 | 146 |
| F09066_T29 (SEQ ID NO: 4066) | 1 | 146 |
| F09066_T36 (SEQ ID NO: 4067) | 1 | 146 |
| F09066_T39 (SEQ ID NO: 4068) | 1 | 146 |
| F09066_T41 (SEQ ID NO: 4069) | 1 | 146 |
| F09066_T42 (SEQ ID NO: 4070) | 1 | 146 |
| F09066_T43 (SEQ ID NO: 4071) | 1 | 146 |

This segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35, F09066_P27 and F09066_P30.

Segment cluster F09066_node_6 (SEQ ID NO:4834) according to the present invention is supported by 11 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4231 below describes the starting and ending position of this segment on each transcript.

TABLE 4231

Segment location on transcripts

| Transcript name | Segment starting position | Segment ending position |
|---|---|---|
| F09066_T1 (SEQ ID NO: 4049) | 147 | 294 |
| F09066_T2 (SEQ ID NO: 4050) | 147 | 294 |
| F09066_T5 (SEQ ID NO: 4051) | 147 | 294 |
| F09066_T8 (SEQ ID NO: 4052) | 147 | 294 |
| F09066_T9 (SEQ ID NO: 4053) | 147 | 294 |
| F09066_T10 (SEQ ID NO: 4054) | 147 | 294 |
| F09066_T11 (SEQ ID NO: 4055) | 147 | 294 |
| F09066_T12 (SEQ ID NO: 4056) | 147 | 294 |
| F09066_T13 (SEQ ID NO: 4057) | 147 | 294 |
| F09066_T14 (SEQ ID NO: 4058) | 147 | 294 |
| F09066_T15 (SEQ ID NO: 4059) | 147 | 294 |
| F09066_T17 (SEQ ID NO: 4060) | 147 | 294 |
| F09066_T18 (SEQ ID NO: 4061) | 147 | 294 |
| F09066_T20 (SEQ ID NO: 4062) | 147 | 294 |
| F09066_T24 (SEQ ID NO: 4063) | 147 | 294 |
| F09066_T26 (SEQ ID NO: 4064) | 147 | 294 |
| F09066_T27 (SEQ ID NO: 4065) | 147 | 294 |
| F09066_T29 (SEQ ID NO: 4066) | 147 | 294 |
| F09066_T36 (SEQ ID NO: 4067) | 147 | 294 |
| F09066_T39 (SEQ ID NO: 4068) | 147 | 294 |
| F09066_T41 (SEQ ID NO: 4069) | 147 | 294 |
| F09066_T42 (SEQ ID NO: 4070) | 147 | 294 |
| F09066_T43 (SEQ ID NO: 4071) | 147 | 294 |

This segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35, F09066_P27 and F09066_P30.

Segment cluster F09066_node_21 (SEQ ID NO:4835) according to the present invention is supported by 15 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4232 below describes the starting and ending position of this segment on each transcript.

TABLE 4232

Segment location on transcripts

| Transcript name | Segment starting position | Segment ending position |
|---|---|---|
| F09066_T1 (SEQ ID NO: 4049) | 470 | 664 |
| F09066_T2 (SEQ ID NO: 4050) | 470 | 664 |
| F09066_T5 (SEQ ID NO: 4051) | 470 | 664 |
| F09066_T8 (SEQ ID NO: 4052) | 470 | 664 |
| F09066_T9 (SEQ ID NO: 4053) | 470 | 664 |
| F09066_T10 (SEQ ID NO: 4054) | 470 | 664 |
| F09066_T11 (SEQ ID NO: 4055) | 470 | 664 |
| F09066_T12 (SEQ ID NO: 4056) | 470 | 664 |
| F09066_T13 (SEQ ID NO: 4057) | 470 | 664 |
| F09066_T14 (SEQ ID NO: 4058) | 470 | 664 |
| F09066_T15 (SEQ ID NO: 4059) | 470 | 664 |
| F09066_T17 (SEQ ID NO: 4060) | 470 | 664 |
| F09066_T18 (SEQ ID NO: 4061) | 470 | 664 |
| F09066_T20 (SEQ ID NO: 4062) | 470 | 664 |
| F09066_T24 (SEQ ID NO: 4063) | 470 | 664 |
| F09066_T26 (SEQ ID NO: 4064) | 470 | 664 |
| F09066_T27 (SEQ ID NO: 4065) | 470 | 664 |
| F09066_T29 (SEQ ID NO: 4066) | 470 | 664 |
| F09066_T36 (SEQ ID NO: 4067) | 470 | 664 |
| F09066_T39 (SEQ ID NO: 4068) | 470 | 664 |
| F09066_T41 (SEQ ID NO: 4069) | 470 | 664 |
| F09066_T42 (SEQ ID NO: 4070) | 470 | 664 |
| F09066_T43 (SEQ ID NO: 4071) | 470 | 664 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node_31 (SEQ ID NO:4836) according to the present invention is supported by 39 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4233 below describes the starting and ending position of this segment on each transcript.

TABLE 4233

Segment location on transcripts

| Transcript name | Segment starting position | Segment ending position |
|---|---|---|
| F09066_T1 (SEQ ID NO: 4049) | 854 | 2343 |
| F09066_T2 (SEQ ID NO: 4050) | 854 | 2343 |
| F09066_T5 (SEQ ID NO: 4051) | 854 | 2343 |
| F09066_T8 (SEQ ID NO: 4052) | 854 | 2343 |
| F09066_T9 (SEQ ID NO: 4053) | 854 | 2343 |
| F09066_T10 (SEQ ID NO: 4054) | 854 | 2343 |
| F09066_T11 (SEQ ID NO: 4055) | 854 | 2343 |
| F09066_T12 (SEQ ID NO: 4056) | 854 | 2343 |
| F09066_T13 (SEQ ID NO: 4057) | 854 | 2343 |
| F09066_T14 (SEQ ID NO: 4058) | 854 | 2343 |
| F09066_T15 (SEQ ID NO: 4059) | 854 | 2343 |
| F09066_T17 (SEQ ID NO: 4060) | 854 | 2343 |
| F09066_T18 (SEQ ID NO: 4061) | 854 | 2343 |
| F09066_T20 (SEQ ID NO: 4062) | 854 | 2343 |
| F09066_T24 (SEQ ID NO: 4063) | 854 | 2343 |
| F09066_T26 (SEQ ID NO: 4064) | 854 | 2343 |
| F09066_T27 (SEQ ID NO: 4065) | 854 | 2343 |
| F09066_T29 (SEQ ID NO: 4066) | 854 | 2343 |
| F09066_T36 (SEQ ID NO: 4067) | 854 | 2343 |
| F09066_T39 (SEQ ID NO: 4068) | 854 | 2343 |
| F09066_T41 (SEQ ID NO: 4069) | 854 | 2343 |
| F09066_T42 (SEQ ID NO: 4070) | 854 | 2343 |
| F09066_T43 (SEQ ID NO: 4071) | 854 | 2343 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node_32 (SEQ ID NO:4837) according to the present invention is supported by 19 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4234 below describes the starting and ending position of this segment on each transcript.

TABLE 4234

Segment location on transcripts

| Transcript name | Segment starting position | Segment ending position |
|---|---|---|
| F09066_T1 (SEQ ID NO: 4049) | 2344 | 2678 |
| F09066_T2 (SEQ ID NO: 4050) | 2344 | 2678 |
| F09066_T5 (SEQ ID NO: 4051) | 2344 | 2678 |
| F09066_T8 (SEQ ID NO: 4052) | 2344 | 2678 |
| F09066_T9 (SEQ ID NO: 4053) | 2344 | 2678 |
| F09066_T10 (SEQ ID NO: 4054) | 2344 | 2678 |
| F09066_T11 (SEQ ID NO: 4055) | 2344 | 2678 |
| F09066_T12 (SEQ ID NO: 4056) | 2344 | 2678 |
| F09066_T13 (SEQ ID NO: 4057) | 2344 | 2678 |
| F09066_T14 (SEQ ID NO: 4058) | 2344 | 2678 |
| F09066_T15 (SEQ ID NO: 4059) | 2344 | 2678 |
| F09066_T17 (SEQ ID NO: 4060) | 2344 | 2678 |
| F09066_T18 (SEQ ID NO: 4061) | 2344 | 2678 |
| F09066_T20 (SEQ ID NO: 4062) | 2344 | 2678 |
| F09066_T24 (SEQ ID NO: 4063) | 2344 | 2678 |
| F09066_T26 (SEQ ID NO: 4064) | 2344 | 2678 |
| F09066_T27 (SEQ ID NO: 4065) | 2344 | 2678 |
| F09066_T29 (SEQ ID NO: 4066) | 2344 | 2678 |
| F09066_T36 (SEQ ID NO: 4067) | 2344 | 2678 |
| F09066_T39 (SEQ ID NO: 4068) | 2344 | 2678 |
| F09066_T41 (SEQ ID NO: 4069) | 2344 | 2678 |
| F09066_T42 (SEQ ID NO: 4070) | 2344 | 2678 |
| F09066_T43 (SEQ ID NO: 4071) | 2344 | 2678 |

This segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35, F09066_P27 and F09066_P30.

Segment cluster F09066_node_38 (SEQ ID NO:4838) according to the present invention is supported by 1 libraries. The number of libraries was determined as previously described. This segment can be found in the following transcript(s): F09066_T43 (SEQ ID NO:4071). Table 4235 below describes the starting and ending position of this segment on each transcript.

TABLE 4235

Segment location on transcripts

| Transcript name | Segment starting position | Segment ending position |
|---|---|---|
| F09066_T43 (SEQ ID NO: 4071) | 2913 | 3112 |

This segment can be found in a non-coding region of transcript(s) that are related to the following protein(s): F09066_P30.

Segment cluster F09066_node_41 (SEQ ID NO:4839) according to the present invention is supported by 2 libraries. The number of libraries was determined as previously described. This segment can be found in the following transcript(s): F09066_T42 (SEQ ID NO:4070). Table 4236 below describes the starting and ending position of this segment on each transcript.

TABLE 4236

Segment location on transcripts

| Transcript name | Segment starting position | Segment ending position |
|---|---|---|
| F09066_T42 (SEQ ID NO: 4070) | 2989 | 3301 |

This segment can be found in a non-coding region of transcript(s) that are related to the following protein(s): F09066_P30.

Segment cluster F09066_node_46 (SEQ ID NO:4840) according to the present invention is supported by 50 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T36 (SEQ ID NO:4067), F09066_T39 (SEQ ID NO:4068) and F09066_T41 (SEQ ID NO:4069). Table 4237 below describes the starting and ending position of this segment on each transcript.

TABLE 4237

Segment location on transcripts

| Transcript name | Segment starting position | Segment ending position |
| --- | --- | --- |
| F09066_T1 (SEQ ID NO: 4049) | 2989 | 3198 |
| F09066_T2 (SEQ ID NO: 4050) | 2989 | 3198 |
| F09066_T5 (SEQ ID NO: 4051) | 2989 | 3198 |
| F09066_T8 (SEQ ID NO: 4052) | 2989 | 3198 |
| F09066_T9 (SEQ ID NO: 4053) | 2989 | 3198 |
| F09066_T10 (SEQ ID NO: 4054) | 2989 | 3198 |
| F09066_T12 (SEQ ID NO: 4056) | 2989 | 3198 |
| F09066_T13 (SEQ ID NO: 4057) | 2989 | 3198 |
| F09066_T14 (SEQ ID NO: 4058) | 2989 | 3198 |
| F09066_T15 (SEQ ID NO: 4059) | 2989 | 3198 |
| F09066_T17 (SEQ ID NO: 4060) | 2989 | 3198 |
| F09066_T18 (SEQ ID NO: 4061) | 2989 | 3198 |
| F09066_T20 (SEQ ID NO: 4062) | 2989 | 3198 |
| F09066_T24 (SEQ ID NO: 4063) | 2989 | 3198 |
| F09066_T26 (SEQ ID NO: 4064) | 2989 | 3198 |
| F09066_T27 (SEQ ID NO: 4065) | 2989 | 3198 |
| F09066_T36 (SEQ ID NO: 4067) | 2989 | 3198 |
| F09066_T39 (SEQ ID NO: 4068) | 2989 | 3198 |
| F09066_T41 (SEQ ID NO: 4069) | 2989 | 3198 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P9, F09066_P10, F09066_P12, F09066_P13, F09066_P18, F09066_P19, F09066_P27 and F09066_P30. This segment can also be found in the following protein(s): F09066_P8, since it is in the coding region for the corresponding transcript.

Segment cluster F09066_node_47 (SEQ ID NO:4841) according to the present invention is supported by 1 libraries. The number of libraries was determined as previously described. This segment can be found in the following transcript(s): F09066_T41 (SEQ ID NO:4069). Table 4238 below describes the starting and ending position of this segment on each transcript.

TABLE 4238

Segment location on transcripts

| Transcript name | Segment starting position | Segment ending position |
| --- | --- | --- |
| F09066_T41 (SEQ ID NO: 4069) | 3199 | 3368 |

This segment can be found in a non-coding region of transcript(s) that are related to the following protein(s): F09066_P30.

Segment cluster F09066_node_51 (SEQ ID NO:4842) according to the present invention is supported by 56 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4239 below describes the starting and ending position of this segment on each transcript.

TABLE 4239

Segment location on transcripts

| Transcript name | Segment starting position | Segment ending position |
| --- | --- | --- |
| F09066_T1 (SEQ ID NO: 4049) | 3300 | 3432 |
| F09066_T2 (SEQ ID NO: 4050) | 3300 | 3432 |
| F09066_T5 (SEQ ID NO: 4051) | 3300 | 3432 |
| F09066_T8 (SEQ ID NO: 4052) | 3300 | 3432 |
| F09066_T9 (SEQ ID NO: 4053) | 3300 | 3432 |
| F09066_T10 (SEQ ID NO: 4054) | 3300 | 3432 |
| F09066_T11 (SEQ ID NO: 4055) | 3090 | 3222 |
| F09066_T12 (SEQ ID NO: 4056) | 3199 | 3331 |
| F09066_T13 (SEQ ID NO: 4057) | 3300 | 3432 |
| F09066_T14 (SEQ ID NO: 4058) | 3300 | 3432 |
| F09066_T15 (SEQ ID NO: 4059) | 3300 | 3432 |
| F09066_T17 (SEQ ID NO: 4060) | 3300 | 3432 |
| F09066_T18 (SEQ ID NO: 4061) | 3300 | 3432 |
| F09066_T20 (SEQ ID NO: 4062) | 3300 | 3432 |
| F09066_T24 (SEQ ID NO: 4063) | 3300 | 3432 |
| F09066_T26 (SEQ ID NO: 4064) | 3300 | 3432 |
| F09066_T27 (SEQ ID NO: 4065) | 3300 | 3432 |
| F09066_T29 (SEQ ID NO: 4066) | 3090 | 3222 |
| F09066_T36 (SEQ ID NO: 4067) | 3300 | 3432 |
| F09066_T39 (SEQ ID NO: 4068) | 3300 | 3432 |

This segment can be found in both coding and non-coding regions of transcript(s) as follows. The segment can be found in a non-coding region of transcript(s) that are related to the following protein(s): F09066_P3, F09066_P5, F09066_P6, F09066_P7, F09066_P9, F09066_P10 and F09066_P30. This segment can also be found in the following protein(s): F09066_P2, F09066_P8, F09066_P12, F09066_P13, F09066_P18, F09066_P19, F09066_P35 and F09066_P27, since it is in the coding region for the corresponding transcript.

Segment cluster F09066_node_57 (SEQ ID NO:4843) according to the present invention is supported by 16 libraries. The number of libraries was determined as previously described. This segment can be found in the following transcript(s): F09066_T10 (SEQ ID NO:4054), F09066_T20 (SEQ ID NO:4062) and F09066_T39 (SEQ ID NO:4068). Table 4240 below describes the starting and ending position of this segment on each transcript.

TABLE 4240

Segment location on transcripts

| Transcript name | Segment starting position | Segment ending position |
|---|---|---|
| F09066_T10 (SEQ ID NO: 4054) | 3581 | 4033 |
| F09066_T20 (SEQ ID NO: 4062) | 3581 | 4033 |
| F09066_T39 (SEQ ID NO: 4068) | 3581 | 4033 |

This segment can be found in both coding and non-coding regions of transcript(s) as follows. The segment can be found in a non-coding region of transcript(s) that are related to the following protein(s): F09066_P3 and F09066_P30. This segment can also be found in the following protein(s): F09066_P7, since it is in the coding region for the corresponding transcript.

Segment cluster F09066_node_58 (SEQ ID NO:4844) according to the present invention is supported by 70 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4241 below describes the starting and ending position of this segment on each transcript.

TABLE 4241

Segment location on transcripts

| Transcript name | Segment starting position | Segment ending position |
|---|---|---|
| F09066_T1 (SEQ ID NO: 4049) | 3581 | 3760 |
| F09066_T2 (SEQ ID NO: 4050) | 3581 | 3760 |
| F09066_T5 (SEQ ID NO: 4051) | 3581 | 3760 |
| F09066_T8 (SEQ ID NO: 4052) | 3581 | 3760 |
| F09066_T9 (SEQ ID NO: 4053) | 3581 | 3760 |
| F09066_T10 (SEQ ID NO: 4054) | 4034 | 4213 |
| F09066_T11 (SEQ ID NO: 4055) | 3371 | 3550 |
| F09066_T12 (SEQ ID NO: 4056) | 3480 | 3659 |
| F09066_T13 (SEQ ID NO: 4057) | 3581 | 3760 |
| F09066_T14 (SEQ ID NO: 4058) | 3581 | 3760 |
| F09066_T15 (SEQ ID NO: 4059) | 3581 | 3760 |
| F09066_T17 (SEQ ID NO: 4060) | 3581 | 3760 |
| F09066_T18 (SEQ ID NO: 4061) | 3581 | 3760 |
| F09066_T20 (SEQ ID NO: 4062) | 4034 | 4213 |
| F09066_T24 (SEQ ID NO: 4063) | 3581 | 3760 |
| F09066_T26 (SEQ ID NO: 4064) | 3581 | 3760 |
| F09066_T27 (SEQ ID NO: 4065) | 3581 | 3760 |
| F09066_T29 (SEQ ID NO: 4066) | 3371 | 3550 |
| F09066_T36 (SEQ ID NO: 4067) | 3581 | 3760 |
| F09066_T39 (SEQ ID NO: 4068) | 4034 | 4213 |

This segment can be found in both coding and non-coding regions of transcript(s) as follows. The segment can be found in a non-coding region of transcript(s) that are related to the following protein(s): F09066_P3, F09066_P5, F09066_P6, F09066_P9, F09066_P10 and F09066_P30. This segment can also be found in the following protein(s): F09066_P2, F09066_P7, F09066_P8, F09066_P12, F09066_P13, F09066_P18, F09066_P19, F09066_P35 and F09066_P27, since it is in the coding region for the corresponding transcript.

Segment cluster F09066_node_60 (SEQ ID NO:4845) according to the present invention is supported by 12 libraries. The number of libraries was determined as previously described. This segment can be found in the following transcript(s): F09066_T36 (SEQ ID NO:4067) and F09066_T39 (SEQ ID NO:4068). Table 4242 below describes the starting and ending position of this segment on each transcript.

TABLE 4242

Segment location on transcripts

| Transcript name | Segment starting position | Segment ending position |
|---|---|---|
| F09066_T36 (SEQ ID NO: 4067) | 3790 | 4705 |
| F09066_T39 (SEQ ID NO: 4068) | 4243 | 5158 |

This segment can be found in both coding and non-coding regions of transcript(s) as follows. The segment can be found in a non-coding region of transcript(s) that are related to the following protein(s): F09066_P30. This segment can also be found in the following protein(s): F09066_P27, since it is in the coding region for the corresponding transcript.

Segment cluster F09066_node_63 (SEQ ID NO:4846) according to the present invention is supported by 59 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4243 below describes the starting and ending position of this segment on each transcript.

TABLE 4243

Segment location on transcripts

| Transcript name | Segment starting position | Segment ending position |
|---|---|---|
| F09066_T1 (SEQ ID NO: 4049) | 3790 | 3928 |
| F09066_T2 (SEQ ID NO: 4050) | 3790 | 3928 |
| F09066_T5 (SEQ ID NO: 4051) | 3790 | 3928 |
| F09066_T8 (SEQ ID NO: 4052) | 3790 | 3928 |
| F09066_T9 (SEQ ID NO: 4053) | 3790 | 3928 |
| F09066_T10 (SEQ ID NO: 4054) | 4243 | 4381 |
| F09066_T11 (SEQ ID NO: 4055) | 3580 | 3718 |
| F09066_T12 (SEQ ID NO: 4056) | 3689 | 3827 |
| F09066_T13 (SEQ ID NO: 4057) | 3790 | 3928 |
| F09066_T14 (SEQ ID NO: 4058) | 3790 | 3928 |
| F09066_T15 (SEQ ID NO: 4059) | 3790 | 3928 |

TABLE 4243-continued

Segment location on transcripts

| Transcript name | Segment starting position | Segment ending position |
|---|---|---|
| F09066_T17 (SEQ ID NO: 4060) | 3790 | 3928 |
| F09066_T18 (SEQ ID NO: 4061) | 3790 | 3928 |
| F09066_T20 (SEQ ID NO: 4062) | 4243 | 4381 |
| F09066_T24 (SEQ ID NO: 4063) | 3790 | 3928 |
| F09066_T26 (SEQ ID NO: 4064) | 3790 | 3928 |
| F09066_T27 (SEQ ID NO: 4065) | 3790 | 3928 |
| F09066_T29 (SEQ ID NO: 4066) | 3580 | 3718 |

This segment can be found in both coding and non-coding regions of transcript(s) as follows. The segment can be found in a non-coding region of transcript(s) that are related to the following protein(s): F09066_P3, F09066_P5, F09066_P6, F09066_P9 and F09066_P10. This segment can also be found in the following protein(s): F09066_P2, F09066_P7, F09066_P8, F09066_P12, F09066_P13, F09066_P18, F09066_P19 and F09066_P35, since it is in the coding region for the corresponding transcript.

Segment cluster F09066_node__69 (SEQ ID NO:4847) according to the present invention is supported by 51 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4244 below describes the starting and ending position of this segment on each transcript.

TABLE 4244

Segment location on transcripts

| Transcript name | Segment starting position | Segment ending position |
|---|---|---|
| F09066_T1 (SEQ ID NO: 4049) | 4062 | 4227 |
| F09066_T2 (SEQ ID NO: 4050) | 4062 | 4227 |
| F09066_T5 (SEQ ID NO: 4051) | 4062 | 4227 |
| F09066_T8 (SEQ ID NO: 4052) | 4062 | 4227 |
| F09066_T9 (SEQ ID NO: 4053) | 4062 | 4227 |
| F09066_T10 (SEQ ID NO: 4054) | 4515 | 4680 |
| F09066_T11 (SEQ ID NO: 4055) | 3852 | 4017 |
| F09066_T12 (SEQ ID NO: 4056) | 3961 | 4126 |
| F09066_T15 (SEQ ID NO: 4059) | 4062 | 4227 |
| F09066_T17 (SEQ ID NO: 4060) | 4062 | 4227 |
| F09066_T18 (SEQ ID NO: 4061) | 4062 | 4227 |
| F09066_T20 (SEQ ID NO: 4062) | 4515 | 4680 |
| F09066_T24 (SEQ ID NO: 4063) | 4062 | 4227 |
| F09066_T26 (SEQ ID NO: 4064) | 4062 | 4227 |
| F09066_T27 (SEQ ID NO: 4065) | 4062 | 4227 |
| F09066_T29 (SEQ ID NO: 4066) | 3852 | 4017 |

This segment can be found in both coding and non-coding regions of transcript(s) as follows. The segment can be found in a non-coding region of transcript(s) that are related to the following protein(s): F09066_P3, F09066_P5 and F09066_P6. This segment can also be found in the following protein(s): F09066_P2, F09066_P7, F09066_P8, F09066_P12, F09066_P13, F09066_P18, F09066_P19 and F09066_P35, since it is in the coding region for the corresponding transcript.

Segment cluster F09066_node__70 (SEQ ID NO:4848) according to the present invention is supported by 8 libraries. The number of libraries was determined as previously described. This segment can be found in the following transcript(s): F09066_T2 (SEQ ID NO:4050), F09066_T9 (SEQ ID NO:4053), F09066_T15 (SEQ ID NO:4059) and F09066_T20 (SEQ ID NO:4062). Table 4245 below describes the starting and ending position of this segment on each transcript.

TABLE 4245

Segment location on transcripts

| Transcript name | Segment starting position | Segment ending position |
|---|---|---|
| F09066_T2 (SEQ ID NO: 4050) | 4228 | 4759 |
| F09066_T9 (SEQ ID NO: 4053) | 4228 | 4759 |
| F09066_T15 (SEQ ID NO: 4059) | 4228 | 4759 |
| F09066_T20 (SEQ ID NO: 4062) | 4681 | 5212 |

This segment can be found in both coding and non-coding regions of transcript(s) as follows. The segment can be found in a non-coding region of transcript(s) that are related to the following protein(s): F09066_P5 and F09066_P6. This segment can also be found in the following protein(s): F09066_P3, since it is in the coding region for the corresponding transcript.

Segment cluster F09066_node__74 (SEQ ID NO:4849) according to the present invention is supported by 49 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4246 below describes the starting and ending position of this segment on each transcript.

TABLE 4246

Segment location on transcripts

| Transcript name | Segment starting position | Segment ending position |
|---|---|---|
| F09066_T1 (SEQ ID NO: 4049) | 4330 | 4452 |
| F09066_T2 (SEQ ID NO: 4050) | 4862 | 4984 |
| F09066_T5 (SEQ ID NO: 4051) | 4330 | 4452 |
| F09066_T8 (SEQ ID NO: 4052) | 4330 | 4452 |
| F09066_T9 (SEQ ID NO: 4053) | 4862 | 4984 |
| F09066_T10 (SEQ ID NO: 4054) | 4783 | 4905 |
| F09066_T11 (SEQ ID NO: 4055) | 4120 | 4242 |
| F09066_T12 (SEQ ID NO: 4056) | 4229 | 4351 |
| F09066_T13 (SEQ ID NO: 4057) | 4164 | 4286 |
| F09066_T14 (SEQ ID NO: 4058) | 4073 | 4195 |
| F09066_T15 (SEQ ID NO: 4059) | 4862 | 4984 |
| F09066_T17 (SEQ ID NO: 4060) | 4330 | 4452 |
| F09066_T18 (SEQ ID NO: 4061) | 4330 | 4452 |
| F09066_T20 (SEQ ID NO: 4062) | 5315 | 5437 |

TABLE 4246-continued

Segment location on transcripts

| Transcript name | Segment starting position | Segment ending position |
|---|---|---|
| F09066_T24 (SEQ ID NO: 4063) | 4330 | 4452 |
| F09066_T26 (SEQ ID NO: 4064) | 4330 | 4452 |
| F09066_T27 (SEQ ID NO: 4065) | 4330 | 4452 |
| F09066_T29 (SEQ ID NO: 4066) | 4120 | 4242 |

This segment can be found in both coding and non-coding regions of transcript(s) as follows. The segment can be found in a non-coding region of transcript(s) that are related to the following protein(s): F09066_P5, F09066_P6 and F09066_P9. This segment can also be found in the following protein(s): F09066_P2, F09066_P3, F09066_P7, F09066_P8, F09066_P10, F09066_P12, F09066_P13, F09066_P18, F09066_P19 and F09066_P35, since it is in the coding region for the corresponding transcript.

Segment cluster F09066_node_75 (SEQ ID NO:4850) according to the present invention is supported by 4 libraries. The number of libraries was determined as previously described. This segment can be found in the following transcript(s): F09066_T5 (SEQ ID NO:4051) and F09066_T9 (SEQ ID NO:4053). Table 4247 below describes the starting and ending position of this segment on each transcript.

TABLE 4247

Segment location on transcripts

| Transcript name | Segment starting position | Segment ending position |
|---|---|---|
| F09066_T5 (SEQ ID NO: 4051) | 4453 | 4621 |
| F09066_T9 (SEQ ID NO: 4053) | 4985 | 5153 |

This segment can be found in the following protein(s): F09066_P5.

Segment cluster F09066_node_78 (SEQ ID NO:4851) according to the present invention is supported by 6 libraries. The number of libraries was determined as previously described. This segment can be found in the following transcript(s): F09066_T8 (SEQ ID NO:4052) and F09066_T15 (SEQ ID NO:4059). Table 4248 below describes the starting and ending position of this segment on each transcript.

TABLE 4248

Segment location on transcripts

| Transcript name | Segment starting position | Segment ending position |
|---|---|---|
| F09066_T8 (SEQ ID NO: 4052) | 4563 | 4930 |
| F09066_T15 (SEQ ID NO: 4059) | 5095 | 5462 |

This segment can be found in the following protein(s): F09066_P6.

Segment cluster F09066_node_84 (SEQ ID NO:4852) according to the present invention is supported by 72 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4249 below describes the starting and ending position of this segment on each transcript.

TABLE 4249

Segment location on transcripts

| Transcript name | Segment starting position | Segment ending position |
|---|---|---|
| F09066_T1 (SEQ ID NO: 4049) | 4751 | 5001 |
| F09066_T2 (SEQ ID NO: 4050) | 5283 | 5533 |
| F09066_T5 (SEQ ID NO: 4051) | 4926 | 5176 |
| F09066_T8 (SEQ ID NO: 4052) | 5119 | 5369 |
| F09066_T9 (SEQ ID NO: 4053) | 5458 | 5708 |
| F09066_T10 (SEQ ID NO: 4054) | 5204 | 5454 |
| F09066_T11 (SEQ ID NO: 4055) | 4541 | 4791 |
| F09066_T12 (SEQ ID NO: 4056) | 4650 | 4900 |
| F09066_T13 (SEQ ID NO: 4057) | 4585 | 4835 |
| F09066_T14 (SEQ ID NO: 4058) | 4494 | 4744 |
| F09066_T15 (SEQ ID NO: 4059) | 5651 | 5901 |
| F09066_T17 (SEQ ID NO: 4060) | 4751 | 5001 |
| F09066_T18 (SEQ ID NO: 4061) | 4751 | 5001 |
| F09066_T20 (SEQ ID NO: 4062) | 5736 | 5986 |
| F09066_T24 (SEQ ID NO: 4063) | 4751 | 5001 |
| F09066_T26 (SEQ ID NO: 4064) | 4751 | 5001 |
| F09066_T27 (SEQ ID NO: 4065) | 4751 | 5001 |
| F09066_T29 (SEQ ID NO: 4066) | 4541 | 4791 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_86 (SEQ ID NO:4853) according to the present invention is supported by 76 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4250 below describes the starting and ending position of this segment on each transcript.

TABLE 4250

Segment location on transcripts

| Transcript name | Segment starting position | Segment ending position |
|---|---|---|
| F09066_T1 (SEQ ID NO: 4049) | 5002 | 5196 |
| F09066_T2 (SEQ ID NO: 4050) | 5534 | 5728 |
| F09066_T5 (SEQ ID NO: 4051) | 5177 | 5371 |
| F09066_T8 (SEQ ID NO: 4052) | 5370 | 5564 |
| F09066_T9 (SEQ ID NO: 4053) | 5709 | 5903 |
| F09066_T10 (SEQ ID NO: 4054) | 5455 | 5649 |
| F09066_T11 (SEQ ID NO: 4055) | 4792 | 4986 |
| F09066_T12 (SEQ ID NO: 4056) | 4901 | 5095 |

TABLE 4250-continued

Segment location on transcripts

| Transcript name | Segment starting position | Segment ending position |
|---|---|---|
| F09066_T13 (SEQ ID NO: 4057) | 4836 | 5030 |
| F09066_T14 (SEQ ID NO: 4058) | 4745 | 4939 |
| F09066_T15 (SEQ ID NO: 4059) | 5902 | 6096 |
| F09066_T17 (SEQ ID NO: 4060) | 5002 | 5196 |
| F09066_T18 (SEQ ID NO: 4061) | 5002 | 5196 |
| F09066_T20 (SEQ ID NO: 4062) | 5987 | 6181 |
| F09066_T24 (SEQ ID NO: 4063) | 5002 | 5196 |
| F09066_T26 (SEQ ID NO: 4064) | 5002 | 5196 |
| F09066_T27 (SEQ ID NO: 4065) | 5002 | 5196 |
| F09066_T29 (SEQ ID NO: 4066) | 4792 | 4986 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_95 (SEQ ID NO:4854) according to the present invention is supported by 76 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4251 below describes the starting and ending position of this segment on each transcript.

TABLE 4251

Segment location on transcripts

| Transcript name | Segment starting position | Segment ending position |
|---|---|---|
| F09066_T1 (SEQ ID NO: 4049) | 5424 | 5546 |
| F09066_T2 (SEQ ID NO: 4050) | 5956 | 6078 |
| F09066_T5 (SEQ ID NO: 4051) | 5599 | 5721 |
| F09066_T8 (SEQ ID NO: 4052) | 5792 | 5914 |
| F09066_T9 (SEQ ID NO: 4053) | 6131 | 6253 |
| F09066_T10 (SEQ ID NO: 4054) | 5877 | 5999 |
| F09066_T11 (SEQ ID NO: 4055) | 5214 | 5336 |
| F09066_T12 (SEQ ID NO: 4056) | 5323 | 5445 |
| F09066_T13 (SEQ ID NO: 4057) | 5258 | 5380 |
| F09066_T14 (SEQ ID NO: 4058) | 5167 | 5289 |
| F09066_T15 (SEQ ID NO: 4059) | 6324 | 6446 |
| F09066_T17 (SEQ ID NO: 4060) | 5360 | 5482 |
| F09066_T18 (SEQ ID NO: 4061) | 5361 | 5483 |
| F09066_T20 (SEQ ID NO: 4062) | 6409 | 6531 |
| F09066_T24 (SEQ ID NO: 4063) | 5424 | 5546 |
| F09066_T26 (SEQ ID NO: 4064) | 5424 | 5546 |
| F09066_T27 (SEQ ID NO: 4065) | 5361 | 5483 |
| F09066_T29 (SEQ ID NO: 4066) | 5150 | 5272 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_98 (SEQ ID NO:4855) according to the present invention is supported by 84 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4252 below describes the starting and ending position of this segment on each transcript.

TABLE 4252

Segment location on transcripts

| Transcript name | Segment starting position | Segment ending position |
|---|---|---|
| F09066_T1 (SEQ ID NO: 4049) | 5547 | 5683 |
| F09066_T2 (SEQ ID NO: 4050) | 6079 | 6215 |
| F09066_T5 (SEQ ID NO: 4051) | 5722 | 5858 |
| F09066_T8 (SEQ ID NO: 4052) | 5915 | 6051 |
| F09066_T9 (SEQ ID NO: 4053) | 6254 | 6390 |
| F09066_T10 (SEQ ID NO: 4054) | 6000 | 6136 |
| F09066_T11 (SEQ ID NO: 4055) | 5337 | 5473 |
| F09066_T12 (SEQ ID NO: 4056) | 5446 | 5582 |
| F09066_T13 (SEQ ID NO: 4057) | 5381 | 5517 |
| F09066_T14 (SEQ ID NO: 4058) | 5290 | 5426 |
| F09066_T15 (SEQ ID NO: 4059) | 6447 | 6583 |
| F09066_T17 (SEQ ID NO: 4060) | 5483 | 5619 |
| F09066_T18 (SEQ ID NO: 4061) | 5484 | 5620 |
| F09066_T20 (SEQ ID NO: 4062) | 6532 | 6668 |
| F09066_T24 (SEQ ID NO: 4063) | 5547 | 5683 |
| F09066_T26 (SEQ ID NO: 4064) | 5547 | 5683 |
| F09066_T27 (SEQ ID NO: 4065) | 5484 | 5620 |
| F09066_T29 (SEQ ID NO: 4066) | 5273 | 5409 |

This segment can be found in both coding and non-coding regions of transcript(s) as follows. The segment can be found in a non-coding region of transcript(s) that are related to the following protein(s): F09066_P12 and F09066_P35. This segment can also be found in the following protein(s): F09066_P2, F09066_P3, F09066_P5, F09066_P6, F09066_P7, F09066_P8, F09066_P9, F09066_P10, F09066_P13, F09066_P18 and F09066_P19, since it is in the coding region for the corresponding transcript.

Segment cluster F09066_node_100 (SEQ ID NO:4856) according to the present invention is supported by 96 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4253 below describes the starting and ending position of this segment on each transcript.

TABLE 4253

Segment location on transcripts

| Transcript name | Segment starting position | Segment ending position |
|---|---|---|
| F09066_T1 (SEQ ID NO: 4049) | 5684 | 5877 |
| F09066_T2 (SEQ ID NO: 4050) | 6216 | 6409 |
| F09066_T5 (SEQ ID NO: 4051) | 5859 | 6052 |
| F09066_T8 (SEQ ID NO: 4052) | 6052 | 6245 |
| F09066_T9 (SEQ ID NO: 4053) | 6391 | 6584 |
| F09066_T10 (SEQ ID NO: 4054) | 6137 | 6330 |
| F09066_T11 (SEQ ID NO: 4055) | 5474 | 5667 |
| F09066_T12 (SEQ ID NO: 4056) | 5583 | 5776 |
| F09066_T13 (SEQ ID NO: 4057) | 5518 | 5711 |
| F09066_T14 (SEQ ID NO: 4058) | 5427 | 5620 |
| F09066_T15 (SEQ ID NO: 4059) | 6584 | 6777 |
| F09066_T17 (SEQ ID NO: 4060) | 5620 | 5813 |
| F09066_T18 (SEQ ID NO: 4061) | 5621 | 5814 |
| F09066_T20 (SEQ ID NO: 4062) | 6669 | 6862 |
| F09066_T24 (SEQ ID NO: 4063) | 5684 | 5877 |
| F09066_T26 (SEQ ID NO: 4064) | 5684 | 5877 |
| F09066_T27 (SEQ ID NO: 4065) | 5621 | 5814 |
| F09066_T29 (SEQ ID NO: 4066) | 5410 | 5603 |

This segment can be found in both coding and non-coding regions of transcript(s) as follows. The segment can be found in a non-coding region of transcript(s) that are related to the following protein(s): F09066_P12 and F09066_P35. This segment can also be found in the following protein(s): F09066_P2, F09066_P3, F09066_P5, F09066_P6, F09066_P7, F09066_P8, F09066_P9, F09066_P10, F09066_P13, F09066_P18 and F09066_P19, since it is in the coding region for the corresponding transcript.

Segment cluster F09066_node__102 (SEQ ID NO:4857) according to the present invention is supported by 101 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062) and F09066_T24 (SEQ ID NO:4063). Table 4254 below describes the starting and ending position of this segment on each transcript.

TABLE 4254

Segment location on transcripts

| Transcript name | Segment starting position | Segment ending position |
|---|---|---|
| F09066_T1 (SEQ ID NO: 4049) | 5878 | 6166 |
| F09066_T2 (SEQ ID NO: 4050) | 6410 | 6698 |
| F09066_T5 (SEQ ID NO: 4051) | 6053 | 6341 |
| F09066_T8 (SEQ ID NO: 4052) | 6246 | 6534 |
| F09066_T9 (SEQ ID NO: 4053) | 6585 | 6873 |
| F09066_T10 (SEQ ID NO: 4054) | 6331 | 6619 |
| F09066_T11 (SEQ ID NO: 4055) | 5668 | 5956 |
| F09066_T12 (SEQ ID NO: 4056) | 5777 | 6065 |
| F09066_T13 (SEQ ID NO: 4057) | 5712 | 6000 |
| F09066_T14 (SEQ ID NO: 4058) | 5621 | 5909 |
| F09066_T15 (SEQ ID NO: 4059) | 6778 | 7066 |
| F09066_T17 (SEQ ID NO: 4060) | 5814 | 6102 |
| F09066_T18 (SEQ ID NO: 4061) | 5815 | 6103 |
| F09066_T20 (SEQ ID NO: 4062) | 6863 | 7151 |
| F09066_T24 (SEQ ID NO: 4063) | 5878 | 6166 |

This segment can be found in both coding and non-coding regions of transcript(s) as follows. The segment can be found in a non-coding region of transcript(s) that are related to the following protein(s): F09066_P12. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__103 (SEQ ID NO:4858) according to the present invention is supported by 110 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4255 below describes the starting and ending position of this segment on each transcript.

TABLE 4255

Segment location on transcripts

| Transcript name | Segment starting position | Segment ending position |
|---|---|---|
| F09066_T1 (SEQ ID NO: 4049) | 6167 | 6422 |
| F09066_T2 (SEQ ID NO: 4050) | 6699 | 6954 |
| F09066_T5 (SEQ ID NO: 4051) | 6342 | 6597 |
| F09066_T8 (SEQ ID NO: 4052) | 6535 | 6790 |
| F09066_T9 (SEQ ID NO: 4053) | 6874 | 7129 |
| F09066_T10 (SEQ ID NO: 4054) | 6620 | 6875 |
| F09066_T11 (SEQ ID NO: 4055) | 5957 | 6212 |
| F09066_T12 (SEQ ID NO: 4056) | 6066 | 6321 |
| F09066_T13 (SEQ ID NO: 4057) | 6001 | 6256 |
| F09066_T14 (SEQ ID NO:4058) | 5910 | 6165 |
| F09066_T15 (SEQ ID NO: 4059) | 7067 | 7322 |
| F09066_T17 (SEQ ID NO: 4060) | 6103 | 6358 |
| F09066_T18 (SEQ ID NO: 4061) | 6104 | 6359 |
| F09066_T20 (SEQ ID NO: 4062) | 7152 | 7407 |
| F09066_T24 (SEQ ID NO: 4063) | 6167 | 6422 |
| F09066_T26 (SEQ ID NO: 4064) | 5878 | 6133 |
| F09066_T27 (SEQ ID NO: 4065) | 5815 | 6070 |
| F09066_T29 (SEQ ID NO: 4066) | 5604 | 5859 |

This segment can be found in both coding and non-coding regions of transcript(s) as follows. The segment can be found in a non-coding region of transcript(s) that are related to the following protein(s): F09066_P12 and F09066_P35. This segment can also be found in the following protein(s): F09066_P2, F09066_P3, F09066_P5, F09066_P6, F09066_P7, F09066_P8, F09066_P9, F09066_P10, F09066_P13, F09066_P18 and F09066_P19, since it is in the coding region for the corresponding transcript.

Segment cluster F09066_node__105 (SEQ ID NO:4859) according to the present invention is supported by 99 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4256 below describes the starting and ending position of this segment on each transcript.

TABLE 4256

Segment location on transcripts

| Transcript name | Segment starting position | Segment ending position |
|---|---|---|
| F09066_T1 (SEQ ID NO: 4049) | 6462 | 6612 |
| F09066_T2 (SEQ ID NO: 4050) | 6994 | 7144 |
| F09066_T5 (SEQ ID NO: 4051) | 6637 | 6787 |
| F09066_T8 (SEQ ID NO: 4052) | 6830 | 6980 |
| F09066_T9 (SEQ ID NO: 4053) | 7169 | 7319 |
| F09066_T10 (SEQ ID NO: 4054) | 6915 | 7065 |
| F09066_T11 (SEQ ID NO: 4055) | 6252 | 6402 |
| F09066_T12 (SEQ ID NO: 4056) | 6361 | 6511 |
| F09066_T13 (SEQ ID NO: 4057) | 6296 | 6446 |
| F09066_T14 (SEQ ID NO: 4058) | 6205 | 6355 |
| F09066_T15 (SEQ ID NO: 4059) | 7362 | 7512 |
| F09066_T17 (SEQ ID NO: 4060) | 6398 | 6548 |
| F09066_T18 (SEQ ID NO: 4061) | 6399 | 6549 |
| F09066_T20 (SEQ ID NO: 4062) | 7447 | 7597 |
| F09066_T24 (SEQ ID NO: 4063) | 6462 | 6612 |
| F09066_T26 (SEQ ID NO: 4064) | 6173 | 6323 |
| F09066_T27 (SEQ ID NO: 4065) | 6110 | 6260 |
| F09066_T29 (SEQ ID NO: 4066) | 5899 | 6049 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__106 (SEQ ID NO:4860) according to the present invention is supported by 139 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4257 below describes the starting and ending position of this segment on each transcript.

TABLE 4257

Segment location on transcripts

| Transcript name | Segment starting position | Segment ending position |
|---|---|---|
| F09066_T1 (SEQ ID NO: 4049) | 6613 | 6834 |
| F09066_T2 (SEQ ID NO: 4050) | 7145 | 7366 |
| F09066_T5 (SEQ ID NO: 4051) | 6788 | 7009 |
| F09066_T8 (SEQ ID NO: 4052) | 6981 | 7202 |
| F09066_T9 (SEQ ID NO: 4053) | 7320 | 7541 |
| F09066_T10 (SEQ ID NO: 4054) | 7066 | 7287 |
| F09066_T11 (SEQ ID NO: 4055) | 6403 | 6624 |
| F09066_T12 (SEQ ID NO: 4056) | 6512 | 6733 |
| F09066_T13 (SEQ ID NO: 4057) | 6447 | 6668 |
| F09066_T14 (SEQ ID NO: 4058) | 6356 | 6577 |
| F09066_T15 (SEQ ID NO: 4059) | 7513 | 7734 |
| F09066_T17 (SEQ ID NO: 4060) | 6549 | 6770 |
| F09066_T18 (SEQ ID NO: 4061) | 6550 | 6771 |
| F09066_T20 (SEQ ID NO: 4062) | 7598 | 7819 |
| F09066_T24 (SEQ ID NO: 4063) | 6613 | 6834 |
| F09066_T26 (SEQ ID NO: 4064) | 6324 | 6545 |
| F09066_T27 (SEQ ID NO: 4065) | 6261 | 6482 |
| F09066_T29 (SEQ ID NO: 4066) | 6050 | 6271 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__117 (SEQ ID NO:4861) according to the present invention is supported by 149 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4258 below describes the starting and ending position of this segment on each transcript.

TABLE 4258

Segment location on transcripts

| Transcript name | Segment starting position | Segment ending position |
|---|---|---|
| F09066_T1 (SEQ ID NO: 4049) | 7282 | 7463 |
| F09066_T2 (SEQ ID NO: 4050) | 7814 | 7995 |
| F09066_T5 (SEQ ID NO: 4051) | 7457 | 7638 |
| F09066_T8 (SEQ ID NO: 4052) | 7650 | 7831 |
| F09066_T9 (SEQ ID NO: 4053) | 7989 | 8170 |
| F09066_T10 (SEQ ID NO: 4054) | 7735 | 7916 |
| F09066_T11 (SEQ ID NO: 4055) | 7072 | 7253 |
| F09066_T12 (SEQ ID NO: 4056) | 7181 | 7362 |
| F09066_T13 (SEQ ID NO: 4057) | 7116 | 7297 |
| F09066_T14 (SEQ ID NO: 4058) | 7025 | 7206 |
| F09066_T15 (SEQ ID NO: 4059) | 8182 | 8363 |
| F09066_T17 (SEQ ID NO: 4060) | 7218 | 7399 |
| F09066_T18 (SEQ ID NO: 4061) | 7219 | 7400 |

TABLE 4258-continued

Segment location on transcripts

| Transcript name | Segment starting position | Segment ending position |
|---|---|---|
| F09066_T20 (SEQ ID NO: 4062) | 8267 | 8448 |
| F09066_T24 (SEQ ID NO: 4063) | 7282 | 7571 |
| F09066_T26 (SEQ ID NO: 4064) | 6993 | 7174 |
| F09066_T27 (SEQ ID NO: 4065) | 6930 | 7111 |
| F09066_T29 (SEQ ID NO: 4066) | 6719 | 6900 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

According to an optional embodiment of the present invention, short segments related to the above cluster are also provided. These segments are up to about 120 bp in length, and so are included in a separate description.

Segment cluster F09066_node_8 (SEQ ID NO:4862) according to the present invention is supported by 9 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4259 below describes the starting and ending position of this segment on each transcript.

TABLE 4259

Segment location on transcripts

| Transcript name | Segment starting position | Segment ending position |
|---|---|---|
| F09066_T1 (SEQ ID NO: 4049) | 295 | 322 |
| F09066_T2 (SEQ ID NO: 4050) | 295 | 322 |
| F09066_T5 (SEQ ID NO: 4051) | 295 | 322 |
| F09066_T8 (SEQ ID NO: 4052) | 295 | 322 |
| F09066_T9 (SEQ ID NO: 4053) | 295 | 322 |
| F09066_T10 (SEQ ID NO: 4054) | 295 | 322 |
| F09066_T11 (SEQ ID NO: 4055) | 295 | 322 |
| F09066_T12 (SEQ ID NO: 4056) | 295 | 322 |
| F09066_T13 (SEQ ID NO: 4057) | 295 | 322 |
| F09066_T14 (SEQ ID NO: 4058) | 295 | 322 |
| F09066_T15 (SEQ ID NO: 4059) | 295 | 322 |
| F09066_T17 (SEQ ID NO: 4060) | 295 | 322 |
| F09066_T18 (SEQ ID NO: 4061) | 295 | 322 |
| F09066_T20 (SEQ ID NO: 4062) | 295 | 322 |
| F09066_T24 (SEQ ID NO: 4063) | 295 | 322 |
| F09066_T26 (SEQ ID NO: 4064) | 295 | 322 |
| F09066_T27 (SEQ ID NO: 4065) | 295 | 322 |
| F09066_T29 (SEQ ID NO: 4066) | 295 | 322 |
| F09066_T36 (SEQ ID NO: 4067) | 295 | 322 |
| F09066_T39 (SEQ ID NO: 4068) | 295 | 322 |
| F09066_T41 (SEQ ID NO: 4069) | 295 | 322 |
| F09066_T42 (SEQ ID NO: 4070) | 295 | 322 |
| F09066_T43 (SEQ ID NO: 4071) | 295 | 322 |

This segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35, F09066_P27 and F09066_P30.

Segment cluster F09066_node_9 (SEQ ID NO:4863) according to the present invention is supported by 15 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4260 below describes the starting and ending position of this segment on each transcript.

TABLE 4260

Segment location on transcripts

| Transcript name | Segment starting position | Segment ending position |
|---|---|---|
| F09066_T1 (SEQ ID NO: 4049) | 323 | 437 |
| F09066_T2 (SEQ ID NO: 4050) | 323 | 437 |
| F09066_T5 (SEQ ID NO: 4051) | 323 | 437 |
| F09066_T8 (SEQ ID NO: 4052) | 323 | 437 |
| F09066_T9 (SEQ ID NO: 4053) | 323 | 437 |
| F09066_T10 (SEQ ID NO: 4054) | 323 | 437 |
| F09066_T11 (SEQ ID NO: 4055) | 323 | 437 |
| F09066_T12 (SEQ ID NO: 4056) | 323 | 437 |
| F09066_T13 (SEQ ID NO: 4057) | 323 | 437 |
| F09066_T14 (SEQ ID NO: 4058) | 323 | 437 |
| F09066_T15 (SEQ ID NO: 4059) | 323 | 437 |
| F09066_T17 (SEQ ID NO: 4060) | 323 | 437 |
| F09066_T18 (SEQ ID NO: 4061) | 323 | 437 |
| F09066_T20 (SEQ ID NO: 4062) | 323 | 437 |
| F09066_T24 (SEQ ID NO: 4063) | 323 | 437 |
| F09066_T26 (SEQ ID NO: 4064) | 323 | 437 |
| F09066_T27 (SEQ ID NO: 4065) | 323 | 437 |
| F09066_T29 (SEQ ID NO: 4066) | 323 | 437 |
| F09066_T36 (SEQ ID NO: 4067) | 323 | 437 |
| F09066_T39 (SEQ ID NO: 4068) | 323 | 437 |
| F09066_T41 (SEQ ID NO: 4069) | 323 | 437 |
| F09066_T42 (SEQ ID NO: 4070) | 323 | 437 |
| F09066_T43 (SEQ ID NO: 4071) | 323 | 437 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node__13 (SEQ ID NO:4864) according to the present invention is supported by 16 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4261 below describes the starting and ending position of this segment on each transcript.

TABLE 4261

Segment location on transcripts

| Transcript name | Segment starting position | Segment ending position |
|---|---|---|
| F09066_T1 (SEQ ID NO: 4049) | 438 | 469 |
| F09066_T2 (SEQ ID NO: 4050) | 438 | 469 |
| F09066_T5 (SEQ ID NO: 4051) | 438 | 469 |
| F09066_T8 (SEQ ID NO: 4052) | 438 | 469 |
| F09066_T9 (SEQ ID NO: 4053) | 438 | 469 |
| F09066_T10 (SEQ ID NO: 4054) | 438 | 469 |
| F09066_T11 (SEQ ID NO: 4055) | 438 | 469 |
| F09066_T12 (SEQ ID NO: 4056) | 438 | 469 |
| F09066_T13 (SEQ ID NO: 4057) | 438 | 469 |
| F09066_T14 (SEQ ID NO: 4058) | 438 | 469 |
| F09066_T15 (SEQ ID NO: 4059) | 438 | 469 |
| F09066_T17 (SEQ ID NO: 4060) | 438 | 469 |
| F09066_T18 (SEQ ID NO: 4061) | 438 | 469 |
| F09066_T20 (SEQ ID NO: 4062) | 438 | 469 |
| F09066_T24 (SEQ ID NO: 4063) | 438 | 469 |
| F09066_T26 (SEQ ID NO: 4064) | 438 | 469 |
| F09066_T27 (SEQ ID NO: 4065) | 438 | 469 |
| F09066_T29 (SEQ ID NO: 4066) | 438 | 469 |
| F09066_T36 (SEQ ID NO: 4067) | 438 | 469 |
| F09066_T39 (SEQ ID NO: 4068) | 438 | 469 |
| F09066_T41 (SEQ ID NO: 4069) | 438 | 469 |
| F09066_T42 (SEQ ID NO: 4070) | 438 | 469 |
| F09066_T43 (SEQ ID NO: 4071) | 438 | 469 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node__23 (SEQ ID NO:4865) according to the present invention is supported by 30 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4262 below describes the starting and ending position of this segment on each transcript.

TABLE 4262

Segment location on transcripts

| Transcript name | Segment starting position | Segment ending position |
|---|---|---|
| F09066_T1 (SEQ ID NO: 4049) | 665 | 756 |
| F09066_T2 (SEQ ID NO: 4050) | 665 | 756 |
| F09066_T5 (SEQ ID NO: 4051) | 665 | 756 |
| F09066_T8 (SEQ ID NO: 4052) | 665 | 756 |
| F09066_T9 (SEQ ID NO: 4053) | 665 | 756 |
| F09066_T10 (SEQ ID NO: 4054) | 665 | 756 |
| F09066_T11 (SEQ ID NO: 4055) | 665 | 756 |
| F09066_T12 (SEQ ID NO: 4056) | 665 | 756 |
| F09066_T13 (SEQ ID NO: 4057) | 665 | 756 |
| F09066_T14 (SEQ ID NO: 4058) | 665 | 756 |
| F09066_T15 (SEQ ID NO: 4059) | 665 | 756 |
| F09066_T17 (SEQ ID NO: 4060) | 665 | 756 |
| F09066_T18 (SEQ ID NO: 4061) | 665 | 756 |
| F09066_T20 (SEQ ID NO: 4062) | 665 | 756 |
| F09066_T24 (SEQ ID NO: 4063) | 665 | 756 |
| F09066_T26 (SEQ ID NO: 4064) | 665 | 756 |
| F09066_T27 (SEQ ID NO: 4065) | 665 | 756 |
| F09066_T29 (SEQ ID NO: 4066) | 665 | 756 |
| F09066_T36 (SEQ ID NO: 4067) | 665 | 756 |
| F09066_T39 (SEQ ID NO: 4068) | 665 | 756 |
| F09066_T41 (SEQ ID NO: 4069) | 665 | 756 |
| F09066_T42 (SEQ ID NO: 4070) | 665 | 756 |
| F09066_T43 (SEQ ID NO: 4071) | 665 | 756 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node__26 (SEQ ID NO:4866) according to the present invention is supported by 30 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4263 below describes the starting and ending position of this segment on each transcript.

TABLE 4263

Segment location on transcripts

| Transcript name | Segment starting position | Segment ending position |
| --- | --- | --- |
| F09066_T1 (SEQ ID NO: 4049) | 757 | 832 |
| F09066_T2 (SEQ ID NO: 4050) | 757 | 832 |
| F09066_T5 (SEQ ID NO: 4051) | 757 | 832 |
| F09066_T8 (SEQ ID NO: 4052) | 757 | 832 |
| F09066_T9 (SEQ ID NO: 4053) | 757 | 832 |
| F09066_T10 (SEQ ID NO: 4054) | 757 | 832 |
| F09066_T11 (SEQ ID NO: 4055) | 757 | 832 |
| F09066_T12 (SEQ ID NO: 4056) | 757 | 832 |
| F09066_T13 (SEQ ID NO: 4057) | 757 | 832 |
| F09066_T14 (SEQ ID NO: 4058) | 757 | 832 |
| F09066_T15 (SEQ ID NO: 4059) | 757 | 832 |
| F09066_T17 (SEQ ID NO: 4060) | 757 | 832 |
| F09066_T18 (SEQ ID NO: 4061) | 757 | 832 |
| F09066_T20 (SEQ ID NO: 4062) | 757 | 832 |
| F09066_T24 (SEQ ID NO: 4063) | 757 | 832 |
| F09066_T26 (SEQ ID NO: 4064) | 757 | 832 |
| F09066_T27 (SEQ ID NO: 4065) | 757 | 832 |
| F09066_T29 (SEQ ID NO: 4066) | 757 | 832 |
| F09066_T36 (SEQ ID NO: 4067) | 757 | 832 |
| F09066_T39 (SEQ ID NO: 4068) | 757 | 832 |
| F09066_T41 (SEQ ID NO: 4069) | 757 | 832 |
| F09066_T42 (SEQ ID NO: 4070) | 757 | 832 |
| F09066_T43 (SEQ ID NO: 4071) | 757 | 832 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node_30 (SEQ ID NO:4867) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4264 below describes the starting and ending position of this segment on each transcript.

TABLE 4264

Segment location on transcripts

| Transcript name | Segment starting position | Segment ending position |
| --- | --- | --- |
| F09066_T1 (SEQ ID NO: 4049) | 833 | 853 |
| F09066_T2 (SEQ ID NO: 4050) | 833 | 853 |
| F09066_T5 (SEQ ID NO: 4051) | 833 | 853 |
| F09066_T8 (SEQ ID NO: 4052) | 833 | 853 |
| F09066_T9 (SEQ ID NO: 4053) | 833 | 853 |
| F09066_T10 (SEQ ID NO: 4054) | 833 | 853 |
| F09066_T11 (SEQ ID NO: 4055) | 833 | 853 |
| F09066_T12 (SEQ ID NO: 4056) | 833 | 853 |
| F09066_T13 (SEQ ID NO: 4057) | 833 | 853 |
| F09066_T14 (SEQ ID NO: 4058) | 833 | 853 |
| F09066_T15 (SEQ ID NO: 4059) | 833 | 853 |
| F09066_T17 (SEQ ID NO: 4060) | 833 | 853 |
| F09066_T18 (SEQ ID NO: 4061) | 833 | 853 |
| F09066_T20 (SEQ ID NO: 4062) | 833 | 853 |
| F09066_T24 (SEQ ID NO: 4063) | 833 | 853 |
| F09066_T26 (SEQ ID NO: 4064) | 833 | 853 |
| F09066_T27 (SEQ ID NO: 4065) | 833 | 853 |
| F09066_T29 (SEQ ID NO: 4066) | 833 | 853 |
| F09066_T36 (SEQ ID NO: 4067) | 833 | 853 |
| F09066_T39 (SEQ ID NO: 4068) | 833 | 853 |
| F09066_T41 (SEQ ID NO: 4069) | 833 | 853 |
| F09066_T42 (SEQ ID NO: 4070) | 833 | 853 |
| F09066_T43 (SEQ ID NO: 4071) | 833 | 853 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P8, F09066_P9, F09066_P11, F09066_P12, F09066_P13, F09066_P18, F09066_P19, F09066_P35 and F09066_P27. This segment can also be found in the following protein(s): F09066_P30, since it is in the coding region for the corresponding transcript.

Segment cluster F09066_node_33 (SEQ ID NO:4868) according to the present invention is supported by 40 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4265 below describes the starting and ending position of this segment on each transcript.

TABLE 4265

Segment location on transcripts

| Transcript name | Segment starting position | Segment ending position |
| --- | --- | --- |
| F09066_T1 (SEQ ID NO: 4049) | 2679 | 2757 |
| F09066_T2 (SEQ ID NO: 4050) | 2679 | 2757 |
| F09066_T5 (SEQ ID NO: 4051) | 2679 | 2757 |

TABLE 4265-continued

Segment location on transcripts

| Transcript name | Segment starting position | Segment ending position |
|---|---|---|
| F09066_T8 (SEQ ID NO: 4052) | 2679 | 2757 |
| F09066_T9 (SEQ ID NO: 4053) | 2679 | 2757 |
| F09066_T10 (SEQ ID NO: 4054) | 2679 | 2757 |
| F09066_T11 (SEQ ID NO: 4055) | 2679 | 2757 |
| F09066_T12 (SEQ ID NO: 4056) | 2679 | 2757 |
| F09066_T13 (SEQ ID NO: 4057) | 2679 | 2757 |
| F09066_T14 (SEQ ID NO: 4058) | 2679 | 2757 |
| F09066_T15 (SEQ ID NO: 4059) | 2679 | 2757 |
| F09066_T17 (SEQ ID NO: 4060) | 2679 | 2757 |
| F09066_T18 (SEQ ID NO: 4061) | 2679 | 2757 |
| F09066_T20 (SEQ ID NO: 4062) | 2679 | 2757 |
| F09066_T24 (SEQ ID NO: 4063) | 2679 | 2757 |
| F09066_T26 (SEQ ID NO: 4064) | 2679 | 2757 |
| F09066_T27 (SEQ ID NO: 4065) | 2679 | 2757 |
| F09066_T29 (SEQ ID NO: 4066) | 2679 | 2757 |
| F09066_T36 (SEQ ID NO: 4067) | 2679 | 2757 |
| F09066_T39 (SEQ ID NO: 4068) | 2679 | 2757 |
| F09066_T41 (SEQ ID NO: 4069) | 2679 | 2757 |
| F09066_T42 (SEQ ID NO: 4070) | 2679 | 2757 |
| F09066_T43 (SEQ ID NO: 4071) | 2679 | 2757 |

This segment can be found in a non-coding region of transcript(s) that are related to the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19, F09066_P35, F09066_P27 and F09066_P30.

Segment cluster F09066_node_35 (SEQ ID NO:4869) according to the present invention is supported by 45 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4266 below describes the starting and ending position of this segment on each transcript.

TABLE 4266

Segment location on transcripts

| Transcript name | Segment starting position | Segment ending position |
|---|---|---|
| F09066_T1 (SEQ ID NO: 4049) | 2758 | 2849 |
| F09066_T2 (SEQ ID NO: 4050) | 2758 | 2849 |
| F09066_T5 (SEQ ID NO: 4051) | 2758 | 2849 |
| F09066_T8 (SEQ ID NO: 4052) | 2758 | 2849 |
| F09066_T9 (SEQ ID NO: 4053) | 2758 | 2849 |
| F09066_T10 (SEQ ID NO: 4054) | 2758 | 2849 |
| F09066_T11 (SEQ ID NO: 4055) | 2758 | 2849 |
| F09066_T12 (SEQ ID NO: 4056) | 2758 | 2849 |
| F09066_T13 (SEQ ID NO: 4057) | 2758 | 2849 |
| F09066_T14 (SEQ ID NO: 4058) | 2758 | 2849 |
| F09066_T15 (SEQ ID NO: 4059) | 2758 | 2849 |
| F09066_T17 (SEQ ID NO: 4060) | 2758 | 2849 |
| F09066_T18 (SEQ ID NO: 4061) | 2758 | 2849 |
| F09066_T20 (SEQ ID NO: 4062) | 2758 | 2849 |
| F09066_T24 (SEQ ID NO: 4063) | 2758 | 2849 |
| F09066_T26 (SEQ ID NO: 4064) | 2758 | 2849 |
| F09066_T27 (SEQ ID NO: 4065) | 2758 | 2849 |
| F09066_T29 (SEQ ID NO: 4066) | 2758 | 2849 |
| F09066_T36 (SEQ ID NO: 4067) | 2758 | 2849 |
| F09066_T39 (SEQ ID NO: 4068) | 2758 | 2849 |
| F09066_T41 (SEQ ID NO: 4069) | 2758 | 2849 |
| F09066_T42 (SEQ ID NO: 4070) | 2758 | 2849 |
| F09066_T43 (SEQ ID NO: 4071) | 2758 | 2849 |

This segment can be found in a non-coding region of transcript(s) that are related to the following protein(s): F09066_P2, F09066_P3, F09066_P5, F09066_P6, F09066_P7, F09066_P8, F09066_P9, F09066_P1, F09066_P12, F09066_P13, F09066_P18, F09066_P19, F09066_P35, F09066_P27 and F09066_P30.

Segment cluster F09066_node_36 (SEQ ID NO:4870) according to the present invention is supported by 45 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4267 below describes the starting and ending position of this segment on each transcript.

TABLE 4267

Segment location on transcripts

| Transcript name | Segment starting position | Segment ending position |
|---|---|---|
| F09066_T1 (SEQ ID NO: 4049) | 2850 | 2893 |
| F09066_T2 (SEQ ID NO: 4050) | 2850 | 2893 |
| F09066_T5 (SEQ ID NO: 4051) | 2850 | 2893 |
| F09066_T8 (SEQ ID NO: 4052) | 2850 | 2893 |
| F09066_T9 (SEQ ID NO: 4053) | 2850 | 2893 |
| F09066_T10 (SEQ ID NO: 4054) | 2850 | 2893 |
| F09066_T11 (SEQ ID NO: 4055) | 2850 | 2893 |
| F09066_T12 (SEQ ID NO: 4056) | 2850 | 2893 |
| F09066_T13 (SEQ ID NO: 4057) | 2850 | 2893 |
| F09066_T14 (SEQ ID NO: 4058) | 2850 | 2893 |
| F09066_T15 (SEQ ID NO: 4059) | 2850 | 2893 |
| F09066_T17 (SEQ ID NO: 4060) | 2850 | 2893 |
| F09066_T18 (SEQ ID NO: 4061) | 2850 | 2893 |
| F09066_T20 (SEQ ID NO: 4062) | 2850 | 2893 |
| F09066_T24 (SEQ ID NO: 4063) | 2850 | 2893 |
| F09066_T26 (SEQ ID NO: 4064) | 2850 | 2893 |
| F09066_T27 (SEQ ID NO: 4065) | 2850 | 2893 |
| F09066_T29 (SEQ ID NO: 4066) | 2850 | 2893 |
| F09066_T36 (SEQ ID NO: 4067) | 2850 | 2893 |

TABLE 4267-continued

Segment location on transcripts

| Transcript name | Segment starting position | Segment ending position |
| --- | --- | --- |
| F09066_T39 (SEQ ID NO: 4068) | 2850 | 2893 |
| F09066_T41 (SEQ ID NO: 4069) | 2850 | 2893 |
| F09066_T42 (SEQ ID NO: 4070) | 2850 | 2893 |
| F09066_T43 (SEQ ID NO: 4071) | 2850 | 2893 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P9, F09066_P10, F09066_P12, F09066_P13, F09066_P18, F09066_P19, F09066_P27 and F09066_P30. This segment can also be found in the following protein(s): F09066_P8 and F09066_P35, since it is in the coding region for the corresponding transcript.

Segment cluster F09066_node_37 (SEQ ID NO:4871) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069), F09066_T42 (SEQ ID NO:4070) and F09066_T43 (SEQ ID NO:4071). Table 4268 below describes the starting and ending position of this segment on each transcript.

TABLE 4268

Segment location on transcripts

| Transcript name | Segment starting position | Segment ending position |
| --- | --- | --- |
| F09066_T1 (SEQ ID NO: 4049) | 2894 | 2912 |
| F09066_T2 (SEQ ID NO: 4050) | 2894 | 2912 |
| F09066_T5 (SEQ ID NO: 4051) | 2894 | 2912 |
| F09066_T8 (SEQ ID NO: 4052) | 2894 | 2912 |
| F09066_T9 (SEQ ID NO: 4053) | 2894 | 2912 |
| F09066_T10 (SEQ ID NO: 4054) | 2894 | 2912 |
| F09066_T11 (SEQ ID NO: 4055) | 2894 | 2912 |
| F09066_T12 (SEQ ID NO: 4056) | 2894 | 2912 |
| F09066_T13 (SEQ ID NO: 4057) | 2894 | 2912 |
| F09066_T14 (SEQ ID NO: 4058) | 2894 | 2912 |
| F09066_T15 (SEQ ID NO: 4059) | 2894 | 2912 |
| F09066_T17 (SEQ ID NO: 4060) | 2894 | 2912 |
| F09066_T18 (SEQ ID NO: 4061) | 2894 | 2912 |
| F09066_T20 (SEQ ID NO: 4062) | 2894 | 2912 |
| F09066_T24 (SEQ ID NO: 4063) | 2894 | 2912 |
| F09066_T26 (SEQ ID NO: 4064) | 2894 | 2912 |
| F09066_T27 (SEQ ID NO: 4065) | 2894 | 2912 |
| F09066_T29 (SEQ ID NO: 4066) | 2894 | 2912 |
| F09066_T36 (SEQ ID NO: 4067) | 2894 | 2912 |
| F09066_T39 (SEQ ID NO: 4068) | 2894 | 2912 |
| F09066_T41 (SEQ ID NO: 4069) | 2894 | 2912 |
| F09066_T42 (SEQ ID NO: 4070) | 2894 | 2912 |
| F09066_T43 (SEQ ID NO: 4071) | 2894 | 2912 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P9, F09066_P10, F09066_P12, F09066_P13, F09066_P18, F09066_P19, F09066_P27 and F09066_P30. This segment can also be found in the following protein(s): F09066_P8 and F09066_P35, since it is in the coding region for the corresponding transcript.

Segment cluster F09066_node_40 (SEQ ID NO:4872) according to the present invention is supported by 43 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067), F09066_T39 (SEQ ID NO:4068), F09066_T41 (SEQ ID NO:4069) and F09066_T42 (SEQ ID NO:4070). Table 4269 below describes the starting and ending position of this segment on each transcript.

TABLE 4269

Segment location on transcripts

| Transcript name | Segment starting position | Segment ending position |
| --- | --- | --- |
| F09066_T1 (SEQ ID NO: 4049) | 2913 | 2988 |
| F09066_T2 (SEQ ID NO: 4050) | 2913 | 2988 |
| F09066_T5 (SEQ ID NO: 4051) | 2913 | 2988 |
| F09066_T8 (SEQ ID NO: 4052) | 2913 | 2988 |
| F09066_T9 (SEQ ID NO: 4053) | 2913 | 2988 |
| F09066_T10 (SEQ ID NO: 4054) | 2913 | 2988 |
| F09066_T11 (SEQ ID NO: 4055) | 2913 | 2988 |
| F09066_T12 (SEQ ID NO: 4056) | 2913 | 2988 |
| F09066_T13 (SEQ ID NO: 4057) | 2913 | 2988 |
| F09066_T14 (SEQ ID NO: 4058) | 2913 | 2988 |
| F09066_T15 (SEQ ID NO: 4059) | 2913 | 2988 |
| F09066_T17 (SEQ ID NO: 4060) | 2913 | 2988 |
| F09066_T18 (SEQ ID NO: 4061) | 2913 | 2988 |
| F09066_T20 (SEQ ID NO: 4062) | 2913 | 2988 |
| F09066_T24 (SEQ ID NO: 4063) | 2913 | 2988 |
| F09066_T26 (SEQ ID NO: 4064) | 2913 | 2988 |
| F09066_T27 (SEQ ID NO: 4065) | 2913 | 2988 |
| F09066_T29 (SEQ ID NO: 4066) | 2913 | 2988 |
| F09066_T36 (SEQ ID NO: 4067) | 2913 | 2988 |
| F09066_T39 (SEQ ID NO: 4068) | 2913 | 2988 |
| F09066_T41 (SEQ ID NO: 4069) | 2913 | 2988 |
| F09066_T42 (SEQ ID NO: 4070) | 2913 | 2988 |

This segment can be found in both coding and non-coding regions of transcript(s) as follows. The segment can be found in a non-coding region of transcript(s) that are related to the following protein(s): F09066_P2, F09066_P3, F09066_P5, F09066_P6, F09066_P7, F09066_P9, F09066_P10, F09066_P12, F09066_P13, F09066_P18, F09066_P19, F09066_P27 and F09066_P30. This segment can also be found in the following protein(s): F09066_P8 and F09066_P35, since it is in the coding region for the corresponding transcript.

Segment cluster F09066_node_49 (SEQ ID NO:4873) according to the present invention is supported by 44 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4270 below describes the starting and ending position of this segment on each transcript.

TABLE 4270

Segment location on transcripts

| Transcript name | Segment starting position | Segment ending position |
|---|---|---|
| F09066_T1 (SEQ ID NO: 4049) | 3199 | 3299 |
| F09066_T2 (SEQ ID NO: 4050) | 3199 | 3299 |
| F09066_T5 (SEQ ID NO: 4051) | 3199 | 3299 |
| F09066_T8 (SEQ ID NO: 4052) | 3199 | 3299 |
| F09066_T9 (SEQ ID NO: 4053) | 3199 | 3299 |
| F09066_T10 (SEQ ID NO: 4054) | 3199 | 3299 |
| F09066_T11 (SEQ ID NO: 4055) | 2989 | 3089 |
| F09066_T13 (SEQ ID NO: 4057) | 3199 | 3299 |
| F09066_T14 (SEQ ID NO: 4058) | 3199 | 3299 |
| F09066_T15 (SEQ ID NO: 4059) | 3199 | 3299 |
| F09066_T17 (SEQ ID NO: 4060) | 3199 | 3299 |
| F09066_T18 (SEQ ID NO: 4061) | 3199 | 3299 |
| F09066_T20 (SEQ ID NO: 4062) | 3199 | 3299 |
| F09066_T24 (SEQ ID NO: 4063) | 3199 | 3299 |
| F09066_T26 (SEQ ID NO: 4064) | 3199 | 3299 |
| F09066_T27 (SEQ ID NO: 4065) | 3199 | 3299 |
| F09066_T29 (SEQ ID NO: 4066) | 2989 | 3089 |
| F09066_T36 (SEQ ID NO: 4067) | 3199 | 3299 |
| F09066_T39 (SEQ ID NO: 4068) | 3199 | 3299 |

This segment can be found in both coding and non-coding regions of transcript(s) as follows. The segment can be found in a non-coding region of transcript(s) that are related to the following protein(s): F09066_P3, F09066_P5, F09066_P6, F09066_P7, F09066_P9, F09066_P10 and F09066_P30. This segment can also be found in the following protein(s): F09066_P2, F09066_P12, F09066_P13, F09066_P18, F09066_P19, F09066_P35 and F09066_P27, since it is in the coding region for the corresponding transcript.

Segment cluster F09066_node__53 (SEQ ID NO:4874) according to the present invention is supported by 58 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4271 below describes the starting and ending position of this segment on each transcript.

TABLE 4271

Segment location on transcripts

| Transcript name | Segment starting position | Segment ending position |
|---|---|---|
| F09066_T1 (SEQ ID NO: 4049) | 3433 | 3494 |
| F09066_T2 (SEQ ID NO: 4050) | 3433 | 3494 |
| F09066_T5 (SEQ ID NO: 4051) | 3433 | 3494 |
| F09066_T8 (SEQ ID NO: 4052) | 3433 | 3494 |
| F09066_T9 (SEQ ID NO: 4053) | 3433 | 3494 |
| F09066_T10 (SEQ ID NO: 4054) | 3433 | 3494 |
| F09066_T11 (SEQ ID NO: 4055) | 3223 | 3284 |
| F09066_T12 (SEQ ID NO: 4056) | 3332 | 3393 |
| F09066_T13 (SEQ ID NO: 4057) | 3433 | 3494 |
| F09066_T14 (SEQ ID NO: 4058) | 3433 | 3494 |
| F09066_T15 (SEQ ID NO: 4059) | 3433 | 3494 |
| F09066_T17 (SEQ ID NO: 4060) | 3433 | 3494 |
| F09066_T18 (SEQ ID NO: 4061) | 3433 | 3494 |
| F09066_T20 (SEQ ID NO: 4062) | 3433 | 3494 |
| F09066_T24 (SEQ ID NO: 4063) | 3433 | 3494 |
| F09066_T26 (SEQ ID NO: 4064) | 3433 | 3494 |
| F09066_T27 (SEQ ID NO: 4065) | 3433 | 3494 |
| F09066_T29 (SEQ ID NO: 4066) | 3223 | 3284 |
| F09066_T36 (SEQ ID NO: 4067) | 3433 | 3494 |
| F09066_T39 (SEQ ID NO: 4068) | 3433 | 3494 |

This segment can be found in both coding and non-coding regions of transcript(s) as follows. The segment can be found in a non-coding region of transcript(s) that are related to the following protein(s): F09066_P3, F09066_P5, F09066_P6, F09066_P7, F09066_P9, F09066_P10 and F09066_P30. This segment can also be found in the following protein(s): F09066_P2, F09066_P8, F09066_P12, F09066_P13, F09066_P18, F09066_P19, F09066_P35 and F09066_P27, since it is in the coding region for the corresponding transcript.

Segment cluster F09066_node__55 (SEQ ID NO:4875) according to the present invention is supported by 62 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4272 below describes the starting and ending position of this segment on each transcript.

TABLE 4272

Segment location on transcripts

| Transcript name | Segment starting position | Segment ending position |
|---|---|---|
| F09066_T1 (SEQ ID NO: 4049) | 3495 | 3541 |
| F09066_T2 (SEQ ID NO: 4050) | 3495 | 3541 |
| F09066_T5 (SEQ ID NO: 4051) | 3495 | 3541 |
| F09066_T8 (SEQ ID NO: 4052) | 3495 | 3541 |
| F09066_T9 (SEQ ID NO: 4053) | 3495 | 3541 |
| F09066_T10 (SEQ ID NO: 4054) | 3495 | 3541 |
| F09066_T11 (SEQ ID NO: 4055) | 3285 | 3331 |
| F09066_T12 (SEQ ID NO: 4056) | 3394 | 3440 |

TABLE 4272-continued

Segment location on transcripts

| Transcript name | Segment starting position | Segment ending position |
|---|---|---|
| F09066_T13 (SEQ ID NO: 4057) | 3495 | 3541 |
| F09066_T14 (SEQ ID NO: 4058) | 3495 | 3541 |
| F09066_T15 (SEQ ID NO: 4059) | 3495 | 3541 |
| F09066_T17 (SEQ ID NO: 4060) | 3495 | 3541 |
| F09066_T18 (SEQ ID NO: 4061) | 3495 | 3541 |
| F09066_T20 (SEQ ID NO: 4062) | 3495 | 3541 |
| F09066_T24 (SEQ ID NO: 4063) | 3495 | 3541 |
| F09066_T26 (SEQ ID NO: 4064) | 3495 | 3541 |
| F09066_T27 (SEQ ID NO: 4065) | 3495 | 3541 |
| F09066_T29 (SEQ ID NO: 4066) | 3285 | 3331 |
| F09066_T36 (SEQ ID NO: 4067) | 3495 | 3541 |
| F09066_T39 (SEQ ID NO: 4068) | 3495 | 3541 |

This segment can be found in both coding and non-coding regions of transcript(s) as follows. The segment can be found in a non-coding region of transcript(s) that are related to the following protein(s): F09066_P3, F09066_P5, F09066_P6, F09066_P7, F09066_P9, F09066_P10 and F09066_P30. This segment can also be found in the following protein(s): F09066_P2, F09066_P8, F09066_P12, F09066_P13, F09066_P18, F09066_P19, F09066_P35 and F09066_P27, since it is in the coding region for the corresponding transcript.

Segment cluster F09066_node_56 (SEQ ID NO:4876) according to the present invention is supported by 62 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4273 below describes the starting and ending position of this segment on each transcript.

TABLE 4273

Segment location on transcripts

| Transcript name | Segment starting position | Segment ending position |
|---|---|---|
| F09066_T1 (SEQ ID NO: 4049) | 3542 | 3580 |
| F09066_T2 (SEQ ID NO: 4050) | 3542 | 3580 |
| F09066_T5 (SEQ ID NO: 4051) | 3542 | 3580 |
| F09066_T8 (SEQ ID NO: 4052) | 3542 | 3580 |
| F09066_T9 (SEQ ID NO: 4053) | 3542 | 3580 |
| F09066_T10 (SEQ ID NO: 4054) | 3542 | 3580 |
| F09066_T11 (SEQ ID NO: 4055) | 3332 | 3370 |
| F09066_T12 (SEQ ID NO: 4056) | 3441 | 3479 |
| F09066_T13 (SEQ ID NO: 4057) | 3542 | 3580 |
| F09066_T14 (SEQ ID NO: 4058) | 3542 | 3580 |
| F09066_T15 (SEQ ID NO: 4059) | 3542 | 3580 |
| F09066_T17 (SEQ ID NO: 4060) | 3542 | 3580 |
| F09066_T18 (SEQ ID NO: 4061) | 3542 | 3580 |
| F09066_T20 (SEQ ID NO: 4062) | 3542 | 3580 |
| F09066_T24 (SEQ ID NO: 4063) | 3542 | 3580 |
| F09066_T26 (SEQ ID NO: 4064) | 3542 | 3580 |

TABLE 4273-continued

Segment location on transcripts

| Transcript name | Segment starting position | Segment ending position |
|---|---|---|
| F09066_T27 (SEQ ID NO: 4065) | 3542 | 3580 |
| F09066_T29 (SEQ ID NO: 4066) | 3332 | 3370 |
| F09066_T36 (SEQ ID NO: 4067) | 3542 | 3580 |
| F09066_T39 (SEQ ID NO: 4068) | 3542 | 3580 |

This segment can be found in both coding and non-coding regions of transcript(s) as follows. The segment can be found in a non-coding region of transcript(s) that are related to the following protein(s): F09066_P3, F09066_P5, F09066_P6, F09066_P7, F09066_P9, F09066_P10 and F09066_P30. This segment can also be found in the following protein(s): F09066_P2, F09066_P8, F09066_P12, F09066_P13, F09066_P18, F09066_P19, F09066_P35 and F09066_P27, since it is in the coding region for the corresponding transcript.

Segment cluster F09066_node_59 (SEQ ID NO:4877) according to the present invention is supported by 58 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065), F09066_T29 (SEQ ID NO:4066), F09066_T36 (SEQ ID NO:4067) and F09066_T39 (SEQ ID NO:4068). Table 4274 below describes the starting and ending position of this segment on each transcript.

TABLE 4274

Segment location on transcripts

| Transcript name | Segment starting position | Segment ending position |
|---|---|---|
| F09066_T1 (SEQ ID NO: 4049) | 3761 | 3789 |
| F09066_T2 (SEQ ID NO: 4050) | 3761 | 3789 |
| F09066_T5 (SEQ ID NO: 4051) | 3761 | 3789 |
| F09066_T8 (SEQ ID NO: 4052) | 3761 | 3789 |
| F09066_T9 (SEQ ID NO: 4053) | 3761 | 3789 |
| F09066_T10 (SEQ ID NO: 4054) | 4214 | 4242 |
| F09066_T11 (SEQ ID NO: 4055) | 3551 | 3579 |
| F09066_T12 (SEQ ID NO: 4056) | 3660 | 3688 |
| F09066_T13 (SEQ ID NO: 4057) | 3761 | 3789 |
| F09066_T14 (SEQ ID NO: 4058) | 3761 | 3789 |
| F09066_T15 (SEQ ID NO: 4059) | 3761 | 3789 |
| F09066_T17 (SEQ ID NO: 4060) | 3761 | 3789 |
| F09066_T18 (SEQ ID NO: 4061) | 3761 | 3789 |
| F09066_T20 (SEQ ID NO: 4062) | 4214 | 4242 |
| F09066_T24 (SEQ ID NO: 4063) | 3761 | 3789 |
| F09066_T26 (SEQ ID NO: 4064) | 3761 | 3789 |
| F09066_T27 (SEQ ID NO: 4065) | 3761 | 3789 |
| F09066_T29 (SEQ ID NO: 4066) | 3551 | 3579 |
| F09066_T36 (SEQ ID NO: 4067) | 3761 | 3789 |
| F09066_T39 (SEQ ID NO: 4068) | 4214 | 4242 |

This segment can be found in both coding and non-coding regions of transcript(s) as follows. The segment can be found in a non-coding region of transcript(s) that are related to the following protein(s): F09066_P3, F09066_P5, F09066_P6, F09066_P9, F09066_P10 and F09066_P30. This segment can also be found in the following protein(s): F09066_P2, F09066_P7, F09066_P8, F09066_P12, F09066_P13, F09066_P18, F09066_P19, F09066_P35 and F09066_P27, since it is in the coding region for the corresponding transcript.

Segment cluster F09066_node__66 (SEQ ID NO:4878) according to the present invention is supported by 58 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:40.66). Table 4275 below describes the starting and ending position of this segment on each transcript.

TABLE 4275

Segment location on transcripts

| Transcript name | Segment starting position | Segment ending position |
|---|---|---|
| F09066_T1 (SEQ ID NO: 4049) | 3929 | 4020 |
| F09066_T2 (SEQ ID NO: 4050) | 3929 | 4020 |
| F09066_T5 (SEQ ID NO: 4051) | 3929 | 4020 |
| F09066_T8 (SEQ ID NO: 4052) | 3929 | 4020 |
| F09066_T9 (SEQ ID NO: 4053) | 3929 | 4020 |
| F09066_T10 (SEQ ID NO: 4054) | 4382 | 4473 |
| F09066_T11 (SEQ ID NO: 4055) | 3719 | 3810 |
| F09066_T12 (SEQ ID NO: 4056) | 3828 | 3919 |
| F09066_T13 (SEQ ID NO: 4057) | 3929 | 4020 |
| F09066_T14 (SEQ ID NO: 4058) | 3929 | 4020 |
| F09066_T15 (SEQ ID NO: 4059) | 3929 | 4020 |
| F09066_T17 (SEQ ID NO: 4060) | 3929 | 4020 |
| F09066_T18 (SEQ ID NO: 4061) | 3929 | 4020 |
| F09066_T20 (SEQ ID NO: 4062) | 4382 | 4473 |
| F09066_T24 (SEQ ID NO: 4063) | 3929 | 4020 |
| F09066_T26 (SEQ ID NO: 4064) | 3929 | 4020 |
| F09066_T27 (SEQ ID NO: 4065) | 3929 | 4020 |
| F09066_T29 (SEQ ID NO: 4066) | 3719 | 3810 |

This segment can be found in both coding and non-coding regions of transcript(s) as follows. The segment can be found in a non-coding region of transcript(s) that are related to the following protein(s): F09066_P3, F09066_P5, F09066_P6 and F09066_P9. This segment can also be found in the following protein(s): F09066_P2, F09066_P7, F09066_P8, F09066_P10, F09066_P12, F09066_P13, F09066_P18, F09066_P19 and F09066_P35, since it is in the coding region for the corresponding transcript.

Segment cluster F09066_node__67 (SEQ ID NO:4879) according to the present invention is supported by 46 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4276 below describes the starting and ending position of this segment on each transcript.

TABLE 4276

Segment location on transcripts

| Transcript name | Segment starting position | Segment ending position |
|---|---|---|
| F09066_T1 (SEQ ID NO: 4049) | 4021 | 4061 |
| F09066_T2 (SEQ ID NO: 4050) | 4021 | 4061 |
| F09066_T5 (SEQ ID NO: 4051) | 4021 | 4061 |
| F09066_T8 (SEQ ID NO: 4052) | 4021 | 4061 |
| F09066_T9 (SEQ ID NO: 4053) | 4021 | 4061 |
| F09066_T10 (SEQ ID NO: 4054) | 4474 | 4514 |
| F09066_T11 (SEQ ID NO: 4055) | 3811 | 3851 |
| F09066_T12 (SEQ ID NO: 4056) | 3920 | 3960 |
| F09066_T13 (SEQ ID NO: 4057) | 4021 | 4061 |
| F09066_T15 (SEQ ID NO: 4059) | 4021 | 4061 |
| F09066_T17 (SEQ ID NO: 4060) | 4021 | 4061 |
| F09066_T18 (SEQ ID NO: 4061) | 4021 | 4061 |
| F09066_T20 (SEQ ID NO: 4062) | 4474 | 4514 |
| F09066_T24 (SEQ ID NO: 4063) | 4021 | 4061 |
| F09066_T26 (SEQ ID NO: 4064) | 4021 | 4061 |
| F09066_T27 (SEQ ID NO: 4065) | 4021 | 4061 |
| F09066_T29 (SEQ ID NO: 4066) | 3811 | 3851 |

This segment can be found in both coding and non-coding regions of transcript(s) as follows. The segment can be found in a non-coding region of transcript(s) that are related to the following protein(s): F09066_P3, F09066_P5, F09066_P6 and F09066_P9. This segment can also be found in the following protein(s): F09066_P2, F09066_P7, F09066_P8, F09066_P12, F09066_P13, F09066_P18, F09066_P19 and F09066_P35, since it is in the coding region for the corresponding transcript.

Segment cluster F09066_node__71 (SEQ ID NO:4880) according to the present invention is supported by 47 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4277 below describes the starting and ending position of this segment on each transcript.

TABLE 4277

Segment location on transcripts

| Transcript name | Segment starting position | Segment ending position |
|---|---|---|
| F09066_T1 (SEQ ID NO: 4049) | 4228 | 4277 |
| F09066_T2 (SEQ ID NO: 4050) | 4760 | 4809 |
| F09066_T5 (SEQ ID NO: 4051) | 4228 | 4277 |
| F09066_T8 (SEQ ID NO: 4052) | 4228 | 4277 |
| F09066_T9 (SEQ ID NO: 4053) | 4760 | 4809 |
| F09066_T10 (SEQ ID NO: 4054) | 4681 | 4730 |
| F09066_T11 (SEQ ID NO: 4055) | 4018 | 4067 |
| F09066_T12 (SEQ ID NO: 4056) | 4127 | 4176 |
| F09066_T13 (SEQ ID NO: 4057) | 4062 | 4111 |

TABLE 4277-continued

Segment location on transcripts

| Transcript name | Segment starting position | Segment ending position |
|---|---|---|
| F09066_T15 (SEQ ID NO: 4059) | 4760 | 4809 |
| F09066_T17 (SEQ ID NO: 4060) | 4228 | 4277 |
| F09066_T18 (SEQ ID NO: 4061) | 4228 | 4277 |
| F09066_T20 (SEQ ID NO: 4062) | 5213 | 5262 |
| F09066_T24 (SEQ ID NO: 4063) | 4228 | 4277 |
| F09066_T26 (SEQ ID NO: 4064) | 4228 | 4277 |
| F09066_T27 (SEQ ID NO: 4065) | 4228 | 4277 |
| F09066_T29 (SEQ ID NO: 4066) | 4018 | 4067 |

This segment can be found in both coding and non-coding regions of transcript(s) as follows. The segment can be found in a non-coding region of transcript(s) that are related to the following protein(s): F09066_P5, F09066_P6 and F09066_P9. This segment can also be found in the following protein(s): F09066_P2, F09066_P3, F09066_P7, F09066_P8, F09066_P12, F09066_P13, F09066_P18, F09066_P19 and F09066_P35, since it is in the coding region for the corresponding transcript.

Segment cluster F09066_node_72 (SEQ ID NO:4881) according to the present invention is supported by 47 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4278 below describes the starting and ending position of this segment on each transcript.

TABLE 4278

Segment location on transcripts

| Transcript name | Segment starting position | Segment ending position |
|---|---|---|
| F09066_T1 (SEQ ID NO: 4049) | 4278 | 4329 |
| F09066_T2 (SEQ ID NO: 4050) | 4810 | 4861 |
| F09066_T5 (SEQ ID NO: 4051) | 4278 | 4329 |
| F09066_T8 (SEQ ID NO: 4052) | 4278 | 4329 |
| F09066_T9 (SEQ ID NO: 4053) | 4810 | 4861 |
| F09066_T10 (SEQ ID NO: 4054) | 4731 | 4782 |
| F09066_T11 (SEQ ID NO: 4055) | 4068 | 4119 |
| F09066_T12 (SEQ ID NO: 4056) | 4177 | 4228 |
| F09066_T13 (SEQ ID NO: 4057) | 4112 | 4163 |
| F09066_T14 (SEQ ID NO: 4058) | 4021 | 4072 |
| F09066_T15 (SEQ ID NO: 4059) | 4810 | 4861 |
| F09066_T17 (SEQ ID NO: 4060) | 4278 | 4329 |
| F09066_T18 (SEQ ID NO: 4061) | 4278 | 4329 |
| F09066_T20 (SEQ ID NO: 4062) | 5263 | 5314 |
| F09066_T24 (SEQ ID NO: 4063) | 4278 | 4329 |
| F09066_T26 (SEQ ID NO: 4064) | 4278 | 4329 |
| F09066_T27 (SEQ ID NO: 4065) | 4278 | 4329 |
| F09066_T29 (SEQ ID NO: 4066) | 4068 | 4119 |

This segment can be found in both coding and non-coding regions of transcript(s) as follows. The segment can be found in a non-coding region of transcript(s) that are related to the following protein(s): F09066_P5, F09066_P6 and F09066_P9. This segment can also be found in the following protein(s): F09066_P2, F09066_P3, F09066_P7, F09066_P8, F09066_P10, F09066_P12, F09066_P13, F09066_P18, F09066_P19 and F09066_P35, since it is in the coding region for the corresponding transcript.

Segment cluster F09066_node_76 (SEQ ID NO:4882) according to the present invention can be found in the following transcript(s): F09066_T5 (SEQ ID NO:4051) and F09066_T9 (SEQ ID NO:4053). Table 4279 below describes the starting and ending position of this segment on each transcript.

TABLE 4279

Segment location on transcripts

| Transcript name | Segment starting position | Segment ending position |
|---|---|---|
| F09066_T5 (SEQ ID NO: 4051) | 4622 | 4627 |
| F09066_T9 (SEQ ID NO: 4053) | 5154 | 5159 |

This segment can be found in the following protein(s): F09066_P5.

Segment cluster F09066_node_77 (SEQ ID NO:4883) according to the present invention is supported by 50 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4280 below describes the starting and ending position of this segment on each transcript.

TABLE 4280

Segment location on transcripts

| Transcript name | Segment starting position | Segment ending position |
|---|---|---|
| F09066_T1 (SEQ ID NO: 4049) | 4453 | 4562 |
| F09066_T2 (SEQ ID NO: 4050) | 4985 | 5094 |
| F09066_T5 (SEQ ID NO: 4051) | 4628 | 4737 |
| F09066_T8 (SEQ ID NO: 4052) | 4453 | 4562 |
| F09066_T9 (SEQ ID NO: 4053) | 5160 | 5269 |
| F09066_T10 (SEQ ID NO: 4054) | 4906 | 5015 |
| F09066_T11 (SEQ ID NO: 4055) | 4243 | 4352 |
| F09066_T12 (SEQ ID NO: 4056) | 4352 | 4461 |
| F09066_T13 (SEQ ID NO: 4057) | 4287 | 4396 |
| F09066_T14 (SEQ ID NO: 4058) | 4196 | 4305 |
| F09066_T15 (SEQ ID NO: 4059) | 4985 | 5094 |
| F09066_T17 (SEQ ID NO: 4060) | 4453 | 4562 |
| F09066_T18 (SEQ ID NO: 4061) | 4453 | 4562 |
| F09066_T20 (SEQ ID NO: 4062) | 5438 | 5547 |
| F09066_T24 (SEQ ID NO: 4063) | 4453 | 4562 |
| F09066_T26 (SEQ ID NO: 4064) | 4453 | 4562 |
| F09066_T27 (SEQ ID NO: 4065) | 4453 | 4562 |
| F09066_T29 (SEQ ID NO: 4066) | 4243 | 4352 |

This segment can be found in both coding and non-coding regions of transcript(s) as follows. The segment can be found in a non-coding region of transcript(s) that are related to the following protein(s): F09066_P6. This segment can also be found in the following protein(s): F09066_P2, F09066_P3, F09066_P5, F09066_P7, F09066_P8, F09066_P9, F09066_P10, F09066_P12, F09066_P13, F09066_P18, F09066_P19 and F09066_P35, since it is in the coding region for the corresponding transcript.

Segment cluster F09066_node__79 (SEQ ID NO:4884) according to the present invention is supported by 63 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4281 below describes the starting and ending position of this segment on each transcript.

TABLE 4281

Segment location on transcripts

| Transcript name | Segment starting position | Segment ending position |
|---|---|---|
| F09066_T1 (SEQ ID NO: 4049) | 4563 | 4649 |
| F09066_T2 (SEQ ID NO: 4050) | 5095 | 5181 |
| F09066_T5 (SEQ ID NO: 4051) | 4738 | 4824 |
| F09066_T8 (SEQ ID NO: 4052) | 4931 | 5017 |
| F09066_T9 (SEQ ID NO: 4053) | 5270 | 5356 |
| F09066_T10 (SEQ ID NO: 4054) | 5016 | 5102 |
| F09066_T11 (SEQ ID NO: 4055) | 4353 | 4439 |
| F09066_T12 (SEQ ID NO: 4056) | 4462 | 4548 |
| F09066_T13 (SEQ ID NO: 4057) | 4397 | 4483 |
| F09066_T14 (SEQ ID NO: 4058) | 4306 | 4392 |
| F09066_T15 (SEQ ID NO: 4059) | 5463 | 5549 |
| F09066_T17 (SEQ ID NO: 4060) | 4563 | 4649 |
| F09066_T18 (SEQ ID NO: 4061) | 4563 | 4649 |
| F09066_T20 (SEQ ID NO: 4062) | 5548 | 5634 |
| F09066_T24 (SEQ ID NO: 4063) | 4563 | 4649 |
| F09066_T26 (SEQ ID NO: 4064) | 4563 | 4649 |
| F09066_T27 (SEQ ID NO: 4065) | 4563 | 4649 |
| F09066_T29 (SEQ ID NO: 4066) | 4353 | 4439 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node__80 (SEQ ID NO:4885) according to the present invention is supported by 63 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4282 below describes the starting and ending position of this segment on each transcript.

TABLE 4282

Segment location on transcripts

| Transcript name | Segment starting position | Segment ending position |
|---|---|---|
| F09066_T1 (SEQ ID NO: 4049) | 4650 | 4710 |
| F09066_T2 (SEQ ID NO: 4050) | 5182 | 5242 |
| F09066_T5 (SEQ ID NO: 4051) | 4825 | 4885 |
| F09066_T8 (SEQ ID NO: 4052) | 5018 | 5078 |
| F09066_T9 (SEQ ID NO: 4053) | 5357 | 5417 |
| F09066_T10 (SEQ ID NO: 4054) | 5103 | 5163 |
| F09066_T11 (SEQ ID NO: 4055) | 4440 | 4500 |
| F09066_T12 (SEQ ID NO: 4056) | 4549 | 4609 |
| F09066_T13 (SEQ ID NO: 4057) | 4484 | 4544 |
| F09066_T14 (SEQ ID NO: 4058) | 4393 | 4453 |
| F09066_T15 (SEQ ID NO: 4059) | 5550 | 5610 |
| F09066_T17 (SEQ ID NO: 4060) | 4650 | 4710 |
| F09066_T18 (SEQ ID NO: 4061) | 4650 | 4710 |
| F09066_T20 (SEQ ID NO: 4062) | 5635 | 5695 |
| F09066_T24 (SEQ ID NO: 4063) | 4650 | 4710 |
| F09066_T26 (SEQ ID NO: 4064) | 4650 | 4710 |
| F09066_T27 (SEQ ID NO: 4065) | 4650 | 4710 |
| F09066_T29 (SEQ ID NO: 4066) | 4440 | 4500 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node__81 (SEQ ID NO:4886) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4283 below describes the starting and ending position of this segment on each transcript.

TABLE 4283

Segment location on transcripts

| Transcript name | Segment starting position | Segment ending position |
|---|---|---|
| F09066_T1 (SEQ ID NO: 4049) | 4711 | 4717 |
| F09066_T2 (SEQ ID NO: 4050) | 5243 | 5249 |
| F09066_T5 (SEQ ID NO: 4051) | 4886 | 4892 |
| F09066_T8 (SEQ ID NO: 4052) | 5079 | 5085 |
| F09066_T9 (SEQ ID NO: 4053) | 5418 | 5424 |
| F09066_T10 (SEQ ID NO: 4054) | 5164 | 5170 |
| F09066_T11 (SEQ ID NO: 4055) | 4501 | 4507 |
| F09066_T12 (SEQ ID NO: 4056) | 4610 | 4616 |
| F09066_T13 (SEQ ID NO: 4057) | 4545 | 4551 |
| F09066_T14 (SEQ ID NO: 4058) | 4454 | 4460 |
| F09066_T15 (SEQ ID NO: 4059) | 5611 | 5617 |
| F09066_T17 (SEQ ID NO: 4060) | 4711 | 4717 |
| F09066_T18 (SEQ ID NO: 4061) | 4711 | 4717 |
| F09066_T20 (SEQ ID NO: 4062) | 5696 | 5702 |
| F09066_T24 (SEQ ID NO: 4063) | 4711 | 4717 |
| F09066_T26 (SEQ ID NO: 4064) | 4711 | 4717 |

TABLE 4283-continued

Segment location on transcripts

| Transcript name | Segment starting position | Segment ending position |
|---|---|---|
| F09066_T27 (SEQ ID NO: 4065) | 4711 | 4717 |
| F09066_T29 (SEQ ID NO: 4066) | 4501 | 4507 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_83 (SEQ ID NO:4887) according to the present invention is supported by 63 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4284 below describes the starting and ending position of this segment on each transcript.

TABLE 4284

Segment location on transcripts

| Transcript name | Segment starting position | Segment ending position |
|---|---|---|
| F09066_T1 (SEQ ID NO: 4049) | 4718 | 4750 |
| F09066_T2 (SEQ ID NO: 4050) | 5250 | 5282 |
| F09066_T5 (SEQ ID NO: 4051) | 4893 | 4925 |
| F09066_T8 (SEQ ID NO: 4052) | 5086 | 5118 |
| F09066_T9 (SEQ ID NO: 4053) | 5425 | 5457 |
| F09066_T10 (SEQ ID NO: 4054) | 5171 | 5203 |
| F09066_T11 (SEQ ID NO: 4055) | 4508 | 4540 |
| F09066_T12 (SEQ ID NO: 4056) | 4617 | 4649 |
| F09066_T13 (SEQ ID NO: 4057) | 4552 | 4584 |
| F09066_T14 (SEQ ID NO: 4058) | 4461 | 4493 |
| F09066_T15 (SEQ ID NO: 4059) | 5618 | 5650 |
| F09066_T17 (SEQ ID NO: 4060) | 4718 | 4750 |
| F09066_T18 (SEQ ID NO: 4061) | 4718 | 4750 |
| F09066_T20 (SEQ ID NO: 4062) | 5703 | 5735 |
| F09066_T24 (SEQ ID NO: 4063) | 4718 | 4750 |
| F09066_T26 (SEQ ID NO: 4064) | 4718 | 4750 |
| F09066_T27 (SEQ ID NO: 4065) | 4718 | 4750 |
| F09066_T29 (SEQ ID NO: 4066) | 4508 | 4540 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_88 (SEQ ID NO:4888) according to the present invention is supported by 62 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4285 below describes the starting and ending position of this segment on each transcript.

TABLE 4285

Segment location on transcripts

| Transcript name | Segment starting position | Segment ending position |
|---|---|---|
| F09066_T1 (SEQ ID NO: 4049) | 5197 | 5274 |
| F09066_T2 (SEQ ID NO: 4050) | 5729 | 5806 |
| F09066_T5 (SEQ ID NO: 4051) | 5372 | 5449 |
| F09066_T8 (SEQ ID NO: 4052) | 5565 | 5642 |
| F09066_T9 (SEQ ID NO: 4053) | 5904 | 5981 |
| F09066_T10 (SEQ ID NO: 4054) | 5650 | 5727 |
| F09066_T11 (SEQ ID NO: 4055) | 4987 | 5064 |
| F09066_T12 (SEQ ID NO: 4056) | 5096 | 5173 |
| F09066_T13 (SEQ ID NO: 4057) | 5031 | 5108 |
| F09066_T14 (SEQ ID NO: 4058) | 4940 | 5017 |
| F09066_T15 (SEQ ID NO: 4059) | 6097 | 6174 |
| F09066_T17 (SEQ ID NO: 4060) | 5197 | 5274 |
| F09066_T18 (SEQ ID NO: 4061) | 5197 | 5274 |
| F09066_T20 (SEQ ID NO: 4062) | 6182 | 6259 |
| F09066_T24 (SEQ ID NO: 4063) | 5197 | 5274 |
| F09066_T26 (SEQ ID NO: 4064) | 5197 | 5274 |
| F09066_T27 (SEQ ID NO: 4065) | 5197 | 5274 |
| F09066_T29 (SEQ ID NO: 4066) | 4987 | 5064 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_89 (SEQ ID NO:4889) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T20 (SEQ ID NO:4062), F09066_T24 (SEQ ID NO:4063), F09066_T26 (SEQ ID NO:4064) and F09066_T29 (SEQ ID NO:4066). Table 4286 below describes the starting and ending position of this segment on each transcript.

TABLE 4286

Segment location on transcripts

| Transcript name | Segment starting position | Segment ending position |
|---|---|---|
| F09066_T1 (SEQ ID NO: 4049) | 5275 | 5280 |
| F09066_T2 (SEQ ID NO: 4050) | 5807 | 5812 |
| F09066_T5 (SEQ ID NO: 4051) | 5450 | 5455 |
| F09066_T8 (SEQ ID NO: 4052) | 5643 | 5648 |
| F09066_T9 (SEQ ID NO: 4053) | 5982 | 5987 |
| F09066_T10 (SEQ ID NO: 4054) | 5728 | 5733 |
| F09066_T11 (SEQ ID NO: 4055) | 5065 | 5070 |
| F09066_T12 (SEQ ID NO: 4056) | 5174 | 5179 |
| F09066_T13 (SEQ ID NO: 4057) | 5109 | 5114 |

TABLE 4286-continued

Segment location on transcripts

| Transcript name | Segment starting position | Segment ending position |
|---|---|---|
| F09066_T14 (SEQ ID NO: 4058) | 5018 | 5023 |
| F09066_T15 (SEQ ID NO: 4059) | 6175 | 6180 |
| F09066_T17 (SEQ ID NO: 4060) | 5275 | 5280 |
| F09066_T20 (SEQ ID NO: 4062) | 6260 | 6265 |
| F09066_T24 (SEQ ID NO: 4063) | 5275 | 5280 |
| F09066_T26 (SEQ ID NO: 4064) | 5275 | 5280 |
| F09066_T29 (SEQ ID NO: 4066) | 5065 | 5070 |

This segment can be found in the following protein(s): F09066_P2, F09066_P3, F09066_P5, F09066_P6, F09066_P7, F09066_P8, F09066_P9, F09066_P140, F09066_P12, F09066_P18 and F09066_P35.

Segment cluster F09066_node_90 (SEQ ID NO:4890) according to the present invention is supported by 48 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T20 (SEQ ID NO:4062), F09066_T24 (SEQ ID NO:4063) and F09066_T26 (SEQ ID NO:4064). Table 4287 below describes the starting and ending position of this segment on each transcript.

TABLE 4287

Segment location on transcripts

| Transcript name | Segment starting position | Segment ending position |
|---|---|---|
| F09066_T1 (SEQ ID NO: 4049) | 5281 | 5337 |
| F09066_T2 (SEQ ID NO: 4050) | 5813 | 5869 |
| F09066_T5 (SEQ ID NO: 4051) | 5456 | 5512 |
| F09066_T8 (SEQ ID NO: 4052) | 5649 | 5705 |
| F09066_T9 (SEQ ID NO: 4053) | 5988 | 6044 |
| F09066_T10 (SEQ ID NO: 4054) | 5734 | 5790 |
| F09066_T11 (SEQ ID NO: 4055) | 5071 | 5127 |
| F09066_T12 (SEQ ID NO: 4056) | 5180 | 5236 |
| F09066_T13 (SEQ ID NO: 4057) | 5115 | 5171 |
| F09066_T14 (SEQ ID NO: 4058) | 5024 | 5080 |
| F09066_T15 (SEQ ID NO: 4059) | 6181 | 6237 |
| F09066_T20 (SEQ ID NO: 4062) | 6266 | 6322 |
| F09066_T24 (SEQ ID NO: 4063) | 5281 | 5337 |
| F09066_T26 (SEQ ID NO: 4064) | 5281 | 5337 |

This segment can be found in the following protein(s): F09066_P2, F09066_P3, F09066_P5, F09066_P6, F09066_P7, F09066_P8, F09066_P9, F09066_P10 and F09066_P18.

Segment cluster F09066_node_91 (SEQ ID NO:4891) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T18 (SEQ ID NO:4061), F09066_T20 (SEQ ID NO:4062), F09066_T24 (SEQ ID NO:4063), F09066_T26 (SEQ ID NO:4064) and F09066_T27 (SEQ ID NO:4065). Table 4288 below describes the starting and ending position of this segment on each transcript.

TABLE 4288

Segment location on transcripts

| Transcript name | Segment starting position | Segment ending position |
|---|---|---|
| F09066_T1 (SEQ ID NO: 4049) | 5338 | 5344 |
| F09066_T2 (SEQ ID NO: 4050) | 5870 | 5876 |
| F09066_T5 (SEQ ID NO: 4051) | 5513 | 5519 |
| F09066_T8 (SEQ ID NO: 4052) | 5706 | 5712 |
| F09066_T9 (SEQ ID NO: 4053) | 6045 | 6051 |
| F09066_T10 (SEQ ID NO: 4054) | 5791 | 5797 |
| F09066_T11 (SEQ ID NO: 4055) | 5128 | 5134 |
| F09066_T12 (SEQ ID NO: 4056) | 5237 | 5243 |
| F09066_T13 (SEQ ID NO: 4057) | 5172 | 5178 |
| F09066_T14 (SEQ ID NO: 4058) | 5081 | 5087 |
| F09066_T15 (SEQ ID NO: 4059) | 6238 | 6244 |
| F09066_T18 (SEQ ID NO: 4061) | 5275 | 5281 |
| F09066_T20 (SEQ ID NO: 4062) | 6323 | 6329 |
| F09066_T24 (SEQ ID NO: 4063) | 5338 | 5344 |
| F09066_T26 (SEQ ID NO: 4064) | 5338 | 5344 |
| F09066_T27 (SEQ ID NO: 4065) | 5275 | 5281 |

This segment can be found in the following protein(s): F09066_P2, F09066_P3, F09066_P5, F09066_P6, F09066_P7, F09066_P8, F09066_P9, F09066_P10, F09066_P13, F09066_P18 and F09066_P19.

Segment cluster F09066_node_92 (SEQ ID NO:4892) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4289 below describes the starting and ending position of this segment on each transcript.

TABLE 4289

Segment location on transcripts

| Transcript name | Segment starting position | Segment ending position |
|---|---|---|
| F09066_T1 (SEQ ID NO: 4049) | 5345 | 5366 |
| F09066_T2 (SEQ ID NO: 4050) | 5877 | 5898 |
| F09066_T5 (SEQ ID NO: 4051) | 5520 | 5541 |
| F09066_T8 (SEQ ID NO: 4052) | 5713 | 5734 |
| F09066_T9 (SEQ ID NO: 4053) | 6052 | 6073 |
| F09066_T10 (SEQ ID NO: 4054) | 5798 | 5819 |
| F09066_T11 (SEQ ID NO: 4055) | 5135 | 5156 |
| F09066_T12 (SEQ ID NO: 4056) | 5244 | 5265 |
| F09066_T13 (SEQ ID NO: 4057) | 5179 | 5200 |
| F09066_T14 (SEQ ID NO: 4058) | 5088 | 5109 |
| F09066_T15 (SEQ ID NO: 4059) | 6245 | 6266 |
| F09066_T17 (SEQ ID NO: 4060) | 5281 | 5302 |
| F09066_T18 (SEQ ID NO: 4061) | 5282 | 5303 |
| F09066_T20 (SEQ ID NO: 4062) | 6330 | 6351 |
| F09066_T24 (SEQ ID NO: 4063) | 5345 | 5366 |
| F09066_T26 (SEQ ID NO: 4064) | 5345 | 5366 |
| F09066_T27 (SEQ ID NO: 4065) | 5282 | 5303 |
| F09066_T29 (SEQ ID NO: 4066) | 5071 | 5092 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_93 (SEQ ID NO:4893) according to the present invention is supported by 57 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4290 below describes the starting and ending position of this segment on each transcript.

TABLE 4290

Segment location on transcripts

| Transcript name | Segment starting position | Segment ending position |
|---|---|---|
| F09066_T1 (SEQ ID NO: 4049) | 5367 | 5423 |
| F09066_T2 (SEQ ID NO: 4050) | 5899 | 5955 |
| F09066_T5 (SEQ ID NO: 4051) | 5542 | 5598 |
| F09066_T8 (SEQ ID NO: 4052) | 5735 | 5791 |
| F09066_T9 (SEQ ID NO: 4053) | 6074 | 6130 |
| F09066_T10 (SEQ ID NO: 4054) | 5820 | 5876 |
| F09066_T11 (SEQ ID NO: 4055) | 5157 | 5213 |
| F09066_T12 (SEQ ID NO: 4056) | 5266 | 5322 |
| F09066_T13 (SEQ ID NO: 4057) | 5201 | 5257 |
| F09066_T14 (SEQ ID NO: 4058) | 5110 | 5166 |
| F09066_T15 (SEQ ID NO: 4059) | 6267 | 6323 |
| F09066_T17 (SEQ ID NO: 4060) | 5303 | 5359 |
| F09066_T18 (SEQ ID NO: 4061) | 5304 | 5360 |
| F09066_T20 (SEQ ID NO: 4062) | 6352 | 6408 |
| F09066_T24 (SEQ ID NO: 4063) | 5367 | 5423 |
| F09066_T26 (SEQ ID NO: 4064) | 5367 | 5423 |
| F09066_T27 (SEQ ID NO: 4065) | 5304 | 5360 |
| F09066_T29 (SEQ ID NO: 4066) | 5093 | 5149 |

This segment can be found in the following protein(s): F09066_P2, F09066_P3, F09066_P5, F09066_P6, F09066_P7, F09066_P8, F09066_P9, F09066_P10, F09066_P12, F09066_P13, F09066_P18, F09066_P19 and F09066_P35.

Segment cluster F09066_node_104 (SEQ ID NO:4894) according to the present invention is supported by 88 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4291 below describes the starting and ending position of this segment on each transcript.

TABLE 4291

Segment location on transcripts

| Transcript name | Segment starting position | Segment ending position |
|---|---|---|
| F09066_T1 (SEQ ID NO: 4049) | 6423 | 6461 |
| F09066_T2 (SEQ ID NO: 4050) | 6955 | 6993 |
| F09066_T5 (SEQ ID NO: 4051) | 6598 | 6636 |
| F09066_T8 (SEQ ID NO: 4052) | 6791 | 6829 |
| F09066_T9 (SEQ ID NO: 4053) | 7130 | 7168 |
| F09066_T10 (SEQ ID NO: 4054) | 6876 | 6914 |
| F09066_T11 (SEQ ID NO: 4055) | 6213 | 6251 |
| F09066_T12 (SEQ ID NO: 4056) | 6322 | 6360 |
| F09066_T13 (SEQ ID NO: 4057) | 6257 | 6295 |
| F09066_T14 (SEQ ID NO: 4058) | 6166 | 6204 |
| F09066_T15 (SEQ ID NO: 4059) | 7323 | 7361 |
| F09066_T17 (SEQ ID NO: 4060) | 6359 | 6397 |
| F09066_T18 (SEQ ID NO: 4061) | 6360 | 6398 |
| F09066_T20 (SEQ ID NO: 4062) | 7408 | 7446 |
| F09066_T24 (SEQ ID NO: 4063) | 6423 | 6461 |
| F09066_T26 (SEQ ID NO: 4064) | 6134 | 6172 |
| F09066_T27 (SEQ ID NO: 4065) | 6071 | 6109 |
| F09066_T29 (SEQ ID NO: 4066) | 5860 | 5898 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_107 (SEQ ID NO:4895) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4292 below describes the starting and ending position of this segment on each transcript.

TABLE 4292

Segment location on transcripts

| Transcript name | Segment starting position | Segment ending position |
|---|---|---|
| F09066_T1 (SEQ ID NO: 4049) | 6835 | 6842 |
| F09066_T2 (SEQ ID NO: 4050) | 7367 | 7374 |
| F09066_T5 (SEQ ID NO: 4051) | 7010 | 7017 |
| F09066_T8 (SEQ ID NO: 4052) | 7203 | 7210 |
| F09066_T9 (SEQ ID NO: 4053) | 7542 | 7549 |
| F09066_T10 (SEQ ID NO: 4054) | 7288 | 7295 |
| F09066_T11 (SEQ ID NO: 4055) | 6625 | 6632 |
| F09066_T12 (SEQ ID NO: 4056) | 6734 | 6741 |
| F09066_T13 (SEQ ID NO: 4057) | 6669 | 6676 |
| F09066_T14 (SEQ ID NO: 4058) | 6578 | 6585 |
| F09066_T15 (SEQ ID NO: 4059) | 7735 | 7742 |
| F09066_T17 (SEQ ID NO: 4060) | 6771 | 6778 |
| F09066_T18 (SEQ ID NO: 4061) | 6772 | 6779 |
| F09066_T20 (SEQ ID NO: 4062) | 7820 | 7827 |
| F09066_T24 (SEQ ID NO: 4063) | 6835 | 6842 |

TABLE 4292-continued

Segment location on transcripts

| Transcript name | Segment starting position | Segment ending position |
|---|---|---|
| F09066_T26 (SEQ ID NO: 4064) | 6546 | 6553 |
| F09066_T27 (SEQ ID NO: 4065) | 6483 | 6490 |
| F09066_T29 (SEQ ID NO: 4066) | 6272 | 6279 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_108 (SEQ ID NO:4896) according to the present invention is supported by 120 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4293 below describes the starting and ending position of this segment on each transcript.

TABLE 4293

Segment location on transcripts

| Transcript name | Segment starting position | Segment ending position |
|---|---|---|
| F09066_T1 (SEQ ID NO: 4049) | 6843 | 6872 |
| F09066_T2 (SEQ ID NO: 4050) | 7375 | 7404 |
| F09066_T5 (SEQ ID NO: 4051) | 7018 | 7047 |
| F09066_T8 (SEQ ID NO: 4052) | 7211 | 7240 |
| F09066_T9 (SEQ ID NO: 4053) | 7550 | 7579 |
| F09066_T10 (SEQ ID NO: 4054) | 7296 | 7325 |
| F09066_T11 (SEQ ID NO: 4055) | 6633 | 6662 |
| F09066_T12 (SEQ ID NO: 4056) | 6742 | 6771 |
| F09066_T13 (SEQ ID NO: 4057) | 6677 | 6706 |
| F09066_T14 (SEQ ID NO: 4058) | 6586 | 6615 |
| F09066_T15 (SEQ ID NO: 4059) | 7743 | 7772 |
| F09066_T17 (SEQ ID NO: 4060) | 6779 | 6808 |
| F09066_T18 (SEQ ID NO: 4061) | 6780 | 6809 |
| F09066_T20 (SEQ ID NO: 4062) | 7828 | 7857 |
| F09066_T24 (SEQ ID NO: 4063) | 6843 | 6872 |
| F09066_T26 (SEQ ID NO: 4064) | 6554 | 6583 |
| F09066_T27 (SEQ ID NO: 4065) | 6491 | 6520 |
| F09066_T29 (SEQ ID NO: 4066) | 6280 | 6309 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_109 (SEQ ID NO:4897) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4294 below describes the starting and ending position of this segment on each transcript.

TABLE 4294

Segment location on transcripts

| Transcript name | Segment starting position | Segment ending position |
|---|---|---|
| F09066_T1 (SEQ ID NO: 4049) | 6873 | 6897 |
| F09066_T2 (SEQ ID NO: 4050) | 7405 | 7429 |
| F09066_T5 (SEQ ID NO: 4051) | 7048 | 7072 |
| F09066_T8 (SEQ ID NO: 4052) | 7241 | 7265 |
| F09066_T9 (SEQ ID NO: 4053) | 7580 | 7604 |
| F09066_T10 (SEQ ID NO: 4054) | 7326 | 7350 |
| F09066_T11 (SEQ ID NO: 4055) | 6663 | 6687 |
| F09066_T12 (SEQ ID NO: 4056) | 6772 | 6796 |
| F09066_T13 (SEQ ID NO: 4057) | 6707 | 6731 |
| F09066_T14 (SEQ ID NO: 4058) | 6616 | 6640 |
| F09066_T15 (SEQ ID NO: 4059) | 7773 | 7797 |
| F09066_T17 (SEQ ID NO: 4060) | 6809 | 6833 |
| F09066_T18 (SEQ ID NO: 4061) | 6810 | 6834 |
| F09066_T20 (SEQ ID NO: 4062) | 7858 | 7882 |
| F09066_T24 (SEQ ID NO: 4063) | 6873 | 6897 |
| F09066_T26 (SEQ ID NO: 4064) | 6584 | 6608 |
| F09066_T27 (SEQ ID NO: 4065) | 6521 | 6545 |
| F09066_T29 (SEQ ID NO: 4066) | 6310 | 6334 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_110 (SEQ ID NO:4898) according to the present invention is supported by 124 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4295 below describes the starting and ending position of this segment on each transcript.

TABLE 4295

Segment location on transcripts

| Transcript name | Segment starting position | Segment ending position |
|---|---|---|
| F09066_T1 (SEQ ID NO: 4049) | 6898 | 6924 |
| F09066_T2 (SEQ ID NO: 4050) | 7430 | 7456 |
| F09066_T5 (SEQ ID NO: 4051) | 7073 | 7099 |
| F09066_T8 (SEQ ID NO: 4052) | 7266 | 7292 |
| F09066_T9 (SEQ ID NO: 4053) | 7605 | 7631 |
| F09066_T10 (SEQ ID NO: 4054) | 7351 | 7377 |
| F09066_T11 (SEQ ID NO: 4055) | 6688 | 6714 |
| F09066_T12 (SEQ ID NO: 4056) | 6797 | 6823 |
| F09066_T13 (SEQ ID NO: 4057) | 6732 | 6758 |
| F09066_T14 (SEQ ID NO: 4058) | 6641 | 6667 |
| F09066_T15 (SEQ ID NO: 4059) | 7798 | 7824 |
| F09066_T17 (SEQ ID NO: 4060) | 6834 | 6860 |
| F09066_T18 (SEQ ID NO: 4061) | 6835 | 6861 |
| F09066_T20 (SEQ ID NO: 4062) | 7883 | 7909 |
| F09066_T24 (SEQ ID NO: 4063) | 6898 | 6924 |
| F09066_T26 (SEQ ID NO: 4064) | 6609 | 6635 |
| F09066_T27 (SEQ ID NO: 4065) | 6546 | 6572 |
| F09066_T29 (SEQ ID NO: 4066) | 6335 | 6361 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_111 (SEQ ID NO:4899) according to the present invention is supported by 143 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4296 below describes the starting and ending position of this segment on each transcript.

TABLE 4296

Segment location on transcripts

| Transcript name | Segment starting position | Segment ending position |
|---|---|---|
| F09066_T1 (SEQ ID NO: 4049) | 6925 | 7041 |
| F09066_T2 (SEQ ID NO: 4050) | 7457 | 7573 |
| F09066_T5 (SEQ ID NO: 4051) | 7100 | 7216 |
| F09066_T8 (SEQ ID NO: 4052) | 7293 | 7409 |
| F09066_T9 (SEQ ID NO: 4053) | 7632 | 7748 |
| F09066_T10 (SEQ ID NO: 4054) | 7378 | 7494 |
| F09066_T11 (SEQ ID NO: 4055) | 6715 | 6831 |
| F09066_T12 (SEQ ID NO: 4056) | 6824 | 6940 |
| F09066_T13 (SEQ ID NO: 4057) | 6759 | 6875 |
| F09066_T14 (SEQ ID NO: 4058) | 6668 | 6784 |
| F09066_T15 (SEQ ID NO: 4059) | 7825 | 7941 |
| F09066_T17 (SEQ ID NO: 4060) | 6861 | 6977 |
| F09066_T18 (SEQ ID NO: 4061) | 6862 | 6978 |
| F09066_T20 (SEQ ID NO: 4062) | 7910 | 8026 |
| F09066_T24 (SEQ ID NO: 4063) | 6925 | 7041 |
| F09066_T26 (SEQ ID NO: 4064) | 6636 | 6752 |
| F09066_T27 (SEQ ID NO: 4065) | 6573 | 6689 |
| F09066_T29 (SEQ ID NO: 4066) | 6362 | 6478 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_112 (SEQ ID NO:4900) according to the present invention is supported by 151 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4297 below describes the starting and ending position of this segment on each transcript.

TABLE 4297

Segment location on transcripts

| Transcript name | Segment starting position | Segment ending position |
|---|---|---|
| F09066_T1 (SEQ ID NO: 4049) | 7042 | 7126 |
| F09066_T2 (SEQ ID NO: 4050) | 7574 | 7658 |
| F09066_T5 (SEQ ID NO: 4051) | 7217 | 7301 |
| F09066_T8 (SEQ ID NO: 4052) | 7410 | 7494 |
| F09066_T9 (SEQ ID NO: 4053) | 7749 | 7833 |
| F09066_T10 (SEQ ID NO: 4054) | 7495 | 7579 |
| F09066_T11 (SEQ ID NO: 4055) | 6832 | 6916 |
| F09066_T12 (SEQ ID NO: 4056) | 6941 | 7025 |
| F09066_T13 (SEQ ID NO: 4057) | 6876 | 6960 |
| F09066_T14 (SEQ ID NO: 4058) | 6785 | 6869 |
| F09066_T15 (SEQ ID NO: 4059) | 7942 | 8026 |
| F09066_T17 (SEQ ID NO: 4060) | 6978 | 7062 |
| F09066_T18 (SEQ ID NO: 4061) | 6979 | 7063 |
| F09066_T20 (SEQ ID NO: 4062) | 8027 | 8111 |
| F09066_T24 (SEQ ID NO: 4063) | 7042 | 7126 |
| F09066_T26 (SEQ ID NO: 4064) | 6753 | 6837 |
| F09066_T27 (SEQ ID NO: 4065) | 6690 | 6774 |
| F09066_T29 (SEQ ID NO: 4066) | 6479 | 6563 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__113 (SEQ ID NO:4901) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4298 below describes the starting and ending position of this segment on each transcript.

TABLE 4298

Segment location on transcripts

| Transcript name | Segment starting position | Segment ending position |
|---|---|---|
| F09066_T1 (SEQ ID NO: 4049) | 7127 | 7150 |
| F09066_T2 (SEQ ID NO: 4050) | 7659 | 7682 |
| F09066_T5 (SEQ ID NO: 4051) | 7302 | 7325 |
| F09066_T8 (SEQ ID NO: 4052) | 7495 | 7518 |
| F09066_T9 (SEQ ID NO: 4053) | 7834 | 7857 |
| F09066_T10 (SEQ ID NO: 4054) | 7580 | 7603 |
| F09066_T11 (SEQ ID NO: 4055) | 6917 | 6940 |
| F09066_T12 (SEQ ID NO: 4056) | 7026 | 7049 |
| F09066_T13 (SEQ ID NO: 4057) | 6961 | 6984 |
| F09066_T14 (SEQ ID NO: 4058) | 6870 | 6893 |
| F09066_T15 (SEQ ID NO: 4059) | 8027 | 8050 |
| F09066_T17 (SEQ ID NO: 4060) | 7063 | 7086 |
| F09066_T18 (SEQ ID NO: 4061) | 7064 | 7087 |
| F09066_T20 (SEQ ID NO: 4062) | 8112 | 8135 |
| F09066_T24 (SEQ ID NO: 4063) | 7127 | 7150 |
| F09066_T26 (SEQ ID NO: 4064) | 6838 | 6861 |
| F09066_T27 (SEQ ID NO: 4065) | 6775 | 6798 |
| F09066_T29 (SEQ ID NO: 4066) | 6564 | 6587 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__114 (SEQ ID NO:4902) according to the present invention is supported by 156 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4299 below describes the starting and ending position of this segment on each transcript.

TABLE 4299

Segment location on transcripts

| Transcript name | Segment starting position | Segment ending position |
|---|---|---|
| F09066_T1 (SEQ ID NO: 4049) | 7151 | 7229 |
| F09066_T2 (SEQ ID NO: 4050) | 7683 | 7761 |
| F09066_T5 (SEQ ID NO: 4051) | 7326 | 7404 |
| F09066_T8 (SEQ ID NO: 4052) | 7519 | 7597 |
| F09066_T9 (SEQ ID NO: 4053) | 7858 | 7936 |
| F09066_T10 (SEQ ID NO: 4054) | 7604 | 7682 |
| F09066_T11 (SEQ ID NO: 4055) | 6941 | 7019 |
| F09066_T12 (SEQ ID NO: 4056) | 7050 | 7128 |
| F09066_T13 (SEQ ID NO: 4057) | 6985 | 7063 |
| F09066_T14 (SEQ ID NO: 4058) | 6894 | 6972 |
| F09066_T15 (SEQ ID NO: 4059) | 8051 | 8129 |
| F09066_T17 (SEQ ID NO: 4060) | 7087 | 7165 |
| F09066_T18 (SEQ ID NO: 4061) | 7088 | 7166 |
| F09066_T20 (SEQ ID NO: 4062) | 8136 | 8214 |
| F09066_T24 (SEQ ID NO: 4063) | 7151 | 7229 |
| F09066_T26 (SEQ ID NO: 4064) | 6862 | 6940 |
| F09066_T27 (SEQ ID NO: 4065) | 6799 | 6877 |
| F09066_T29 (SEQ ID NO: 4066) | 6588 | 6666 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node__115 (SEQ ID NO:4903) according to the present invention can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4300 below describes the starting and ending position of this segment on each transcript.

TABLE 4300

Segment location on transcripts

| Transcript name | Segment starting position | Segment ending position |
|---|---|---|
| F09066_T1 (SEQ ID NO: 4049) | 7230 | 7240 |
| F09066_T2 (SEQ ID NO: 4050) | 7762 | 7772 |
| F09066_T5 (SEQ ID NO: 4051) | 7405 | 7415 |
| F09066_T8 (SEQ ID NO: 4052) | 7598 | 7608 |
| F09066_T9 (SEQ ID NO: 4053) | 7937 | 7947 |
| F09066_T10 (SEQ ID NO: 4054) | 7683 | 7693 |
| F09066_T11 (SEQ ID NO: 4055) | 7020 | 7030 |
| F09066_T12 (SEQ ID NO: 4056) | 7129 | 7139 |
| F09066_T13 (SEQ ID NO: 4057) | 7064 | 7074 |
| F09066_T14 (SEQ ID NO: 4058) | 6973 | 6983 |
| F09066_T15 (SEQ ID NO: 4059) | 8130 | 8140 |
| F09066_T17 (SEQ ID NO: 4060) | 7166 | 7176 |
| F09066_T18 (SEQ ID NO: 4061) | 7167 | 7177 |
| F09066_T20 (SEQ ID NO: 4062) | 8215 | 8225 |
| F09066_T24 (SEQ ID NO: 4063) | 7230 | 7240 |

TABLE 4300-continued

Segment location on transcripts

| Transcript name | Segment starting position | Segment ending position |
|---|---|---|
| F09066_T26 (SEQ ID NO: 4064) | 6941 | 6951 |
| F09066_T27 (SEQ ID NO: 4065) | 6878 | 6888 |
| F09066_T29 (SEQ ID NO: 4066) | 6667 | 6677 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Segment cluster F09066_node_116 (SEQ ID NO:4904) according to the present invention is supported by 146 libraries. The number of libraries was determined as previously described. This segment can be found in the following transcript(s): F09066_T1 (SEQ ID NO:4049), F09066_T2 (SEQ ID NO:4050), F09066_T5 (SEQ ID NO:4051), F09066_T8 (SEQ ID NO:4052), F09066_T9 (SEQ ID NO:4053), F09066_T10 (SEQ ID NO:4054), F09066_T11 (SEQ ID NO:4055), F09066_T12 (SEQ ID NO:4056), F09066_T13 (SEQ ID NO:4057), F09066_T14 (SEQ ID NO:4058), F09066_T15 (SEQ ID NO:4059), F09066_T17 (SEQ ID NO:4060), F09066_T18 (SEQ ID NO:4061), F09066_T20 (SEQ ID NO:4062), F09066_T24 (SEQ ID NO:4063), F09066_T26 (SEQ ID NO:4064), F09066_T27 (SEQ ID NO:4065) and F09066_T29 (SEQ ID NO:4066). Table 4301 below describes the starting and ending position of this segment on each transcript.

TABLE 4301

Segment location on transcripts

| Transcript name | Segment starting position | Segment ending position |
|---|---|---|
| F09066_T1 (SEQ ID NO: 4049) | 7241 | 7281 |
| F09066_T2 (SEQ ID NO: 4050) | 7773 | 7813 |
| F09066_T5 (SEQ ID NO: 4051) | 7416 | 7456 |
| F09066_T8 (SEQ ID NO: 4052) | 7609 | 7649 |
| F09066_T9 (SEQ ID NO: 4053) | 7948 | 7988 |
| F09066_T10 (SEQ ID NO: 4054) | 7694 | 7734 |
| F09066_T11 (SEQ ID NO: 4055) | 7031 | 7071 |
| F09066_T12 (SEQ ID NO: 4056) | 7140 | 7180 |
| F09066_T13 (SEQ ID NO: 4057) | 7075 | 7115 |
| F09066_T14 (SEQ ID NO: 4058) | 6984 | 7024 |
| F09066_T15 (SEQ ID NO: 4059) | 8141 | 8181 |
| F09066_T17 (SEQ ID NO: 4060) | 7177 | 7217 |
| F09066_T18 (SEQ ID NO: 4061) | 7178 | 7218 |
| F09066_T20 (SEQ ID NO: 4062) | 8226 | 8266 |
| F09066_T24 (SEQ ID NO: 4063) | 7241 | 7281 |
| F09066_T26 (SEQ ID NO: 4064) | 6952 | 6992 |
| F09066_T27 (SEQ ID NO: 4065) | 6889 | 6929 |
| F09066_T29 (SEQ ID NO: 4066) | 6678 | 6718 |

This segment can be found in both coding and non-coding regions of transcript(s) as follows. The segment can be found in a non-coding region of transcript(s) that are related to the following protein(s): F09066_P12, F09066_P18, F09066_P19 and F09066_P35. This segment can also be found in the following protein(s): F09066_P2, F09066_P3, F09066_P5, F09066_P6, F09066_P7, F09066_P8, F09066_P9, F09066_P10 and F09066_P13, since it is in the coding region for the corresponding transcript.

Description for Cluster H88495

Cluster H88495 features 4 transcript(s) and 22 segment(s) of interest, the names for which are given in Tables 4302 and 4303, respectively, the sequences themselves are given at the end of the application. The selected protein variants are given in Table 4304.

TABLE 4302

Transcripts of interest
Transcript Name

H88495_PEA_3_T4 (SEQ ID NO: 4072)
H88495_PEA_3_T5 (SEQ ID NO: 4073)
H88495_PEA_3_T6 (SEQ ID NO: 4074)
H88495_PEA_3_T7 (SEQ ID NO: 4075)

TABLE 4303

Segments of interest
Segment Name

H88495_PEA_3_node_0 (SEQ ID NO: 4905)
H88495_PEA_3_node_1 (SEQ ID NO: 4906)
H88495_PEA_3_node_4 (SEQ ID NO: 4907)
H88495_PEA_3_node_9 (SEQ ID NO: 4908)
H88495_PEA_3_node_13 (SEQ ID NO: 4909)
H88495_PEA_3_node_19 (SEQ ID NO: 4910)
H88495_PEA_3_node_21 (SEQ ID NO: 4911)
H88495_PEA_3_node_26 (SEQ ID NO: 4912)
H88495_PEA_3_node_2 (SEQ ID NO: 4913)
H88495_PEA_3_node_5 (SEQ ID NO: 4914)
H88495_PEA_3_node_6 (SEQ ID NO: 4915)
H88495_PEA_3_node_7 (SEQ ID NO: 4916)
H88495_PEA_3_node_8 (SEQ ID NO: 4917)
H88495_PEA_3_node_10 (SEQ ID NO: 4918)
H88495_PEA_3_node_11 (SEQ ID NO: 4919)
H88495_PEA_3_node_12 (SEQ ID NO: 4920)
H88495_PEA_3_node_14 (SEQ ID NO: 4921)
H88495_PEA_3_node_16 (SEQ ID NO: 4922)
H88495_PEA_3_node_18 (SEQ ID NO: 4923)
H88495_PEA_3_node_20 (SEQ ID NO: 4924)
H88495_PEA_3_node_23 (SEQ ID NO: 4925)
H88495_PEA_3_node_24 (SEQ ID NO: 4926)

TABLE 4304

Proteins of interest

| Protein Name | Corresponding Transcript(s) |
|---|---|
| H88495_PEA_3_P15 | H88495_PEA_3_T4 (SEQ ID NO: 4072); H88495_PEA_3_T7 (SEQ ID NO: 4075) |
| H88495_PEA_3_P16 | H88495_PEA_3_T5 (SEQ ID NO: 4073); H88495_PEA_3_T6 (SEQ ID NO: 4074) |

These sequences are variants of the known protein Sarcoplasmic reticulum histidine-rich calcium-binding protein precursor (SwissProt accession identifier SRCH_HUMAN), referred to herein as the previously known protein.

Protein Sarcoplasmic reticulum histidine-rich calcium-binding protein precursor is known or believed to have the following function(s): May play a role in the regulation of calcium sequestration or release in the SR of skeletal and cardiac muscle. The sequence for protein Sarcoplasmic reticulum histidine-rich calcium-binding protein precursor is given at the end of the application, as "Sarcoplasmic reticulum histidine-rich calcium-binding protein precursor amino acid sequence". Known polymorphisms for this sequence are as shown in Table 4305.

TABLE 4305

Amino acid mutations for Known Protein

| SNP position(s) on amino acid sequence | Comment |
|---|---|
| 96 | S -> A. /FTId = VAR_005623. |
| 204 | Missing. /FTId = VAR_011622. |

Protein Sarcoplasmic reticulum histidine-rich calcium-binding protein precursor localization is believed to be Sarcoplasmic reticulum lumen.

The following GO Annotation(s) apply to the previously known protein. The following annotation(s) were found: muscle contraction, which are annotation(s) related to Biological Process; and calcium binding, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster H88495. Predictions were made for selective expression of transcripts of this contig in heart tissue, according to the previously described methods. The numbers on the y-axis of FIG. 108 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 108, concerning the number of heart-specific clones in libraries/sequences; as well as with regard to the histogram in FIG. 109, concerning the actual expression of oligonucleotides in various tissues, including heart.

This cluster was found to, be selectively expressed in heart for the following reasons: in a comparison of the ratio of expression of the cluster in heart specific ESTs to the overall expression of the cluster in non-heart ESTs, which was found to be 13.7; the ratio of expression of the cluster in heart specific ESTs to the overall expression of the cluster in muscle-specific ESTs which was found to be 2.3; and fisher exact test P-values were computed both for library and weighted clone counts to check that the counts are statistically significant, and were found to be 1.90E-06.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 13.7, which clearly supports specific expression in heart tissue.

As noted above, cluster H88495 features 22 segment(s), which were listed in Table 4303 above and for which the sequence(s) are given at the end of the application. These segment(s) are portions of nucleic acid sequence(s) which are described herein separately because they are of particular interest. A description of each segment according to the present invention is now provided.

Segment cluster H88495_PEA_3_node_0 (SEQ ID NO:4905) according to the present invention is supported by 12 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4306 below describes the starting and ending position of this segment on each transcript.

TABLE 4306

Segment location on transcripts

| Transcript name | Segment starting position | Segment ending position |
|---|---|---|
| H88495_PEA_3_T4 (SEQ ID NO: 4072) | 1 | 665 |
| H88495_PEA_3_T5 (SEQ ID NO: 4073) | 1 | 665 |
| H88495_PEA_3_T6 (SEQ ID NO: 4074) | 1 | 665 |
| H88495_PEA_3_T7 (SEQ ID NO: 4075) | 1 | 665 |

This segment can be found in a non-coding region of transcript(s) that are related to the following protein(s): H88495_PEA_3_P15 and H88495_PEA_3_P16.

Segment cluster H88495_PEA_3_node_1 (SEQ ID NO:4906) according to the present invention is supported by 18 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4307 below describes the starting and ending position of this segment on each transcript.

TABLE 4307

Segment location on transcripts

| Transcript name | Segment starting position | Segment ending position |
|---|---|---|
| H88495_PEA_3_T4 (SEQ ID NO: 4072) | 666 | 1178 |
| H88495_PEA_3_T5 (SEQ ID NO: 4073) | 666 | 1178 |
| H88495_PEA_3_T6 (SEQ ID NO: 4074) | 666 | 1178 |
| H88495_PEA_3_T7 (SEQ ID NO: 4075) | 666 | 1178 |

This segment can be found in the following protein(s): H88495_PEA_3_P15 and H88495_PEA_3_P16.

Segment cluster H88495_PEA_3_node_4 (SEQ ID NO:4907) according to the present invention is supported by 22 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4308 below describes the starting and ending position of this segment on each transcript.

TABLE 4308

Segment location on transcripts

| Transcript name | Segment starting position | Segment ending position |
|---|---|---|
| H88495_PEA_3_T4 (SEQ ID NO: 4072) | 1210 | 1646 |
| H88495_PEA_3_T5 (SEQ ID NO: 4073) | 1210 | 1646 |
| H88495_PEA_3_T6 (SEQ ID NO: 4074) | 1210 | 1646 |
| H88495_PEA_3_T7 (SEQ ID NO: 4075) | 1210 | 1646 |

This segment can be found in the following protein(s): H88495_PEA_3_P15 and H88495_PEA_3_P16.

Segment cluster H88495_PEA_3_node_9 (SEQ ID NO:4908) according to the present invention is supported by 31 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4309 below describes the starting and ending position of this segment on each transcript.

TABLE 4309

Segment location on transcripts

| Transcript name | Segment starting position | Segment ending position |
|---|---|---|
| H88495_PEA_3_T4 (SEQ ID NO: 4072) | 1819 | 2335 |
| H88495_PEA_3_T5 (SEQ ID NO: 4073) | 1819 | 2335 |
| H88495_PEA_3_T6 (SEQ ID NO: 4074) | 1819 | 2335 |
| H88495_PEA_3_T7 (SEQ ID NO: 4075) | 1819 | 2335 |

This segment can be found in the following protein(s): H88495_PEA_3_P15 and H88495_PEA_3_P16.

Segment cluster H88495_PEA_3_node_13 (SEQ ID NO:4909) according to the present invention is supported by 34 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4310 below describes the starting and ending position of this segment on each transcript.

TABLE 4310

Segment location on transcripts

| Transcript name | Segment starting position | Segment ending position |
|---|---|---|
| H88495_PEA_3_T4 (SEQ ID NO: 4072) | 2378 | 2509 |
| H88495_PEA_3_T5 (SEQ ID NO: 4073) | 2378 | 2509 |
| H88495_PEA_3_T6 (SEQ ID NO: 4074) | 2378 | 2509 |
| H88495_PEA_3_T7 (SEQ ID NO: 4075) | 2378 | 2509 |

This segment can be found in the following protein(s): H88495_PEA_3_P15 and H88495_PEA_3_P16.

Segment cluster H88495_PEA_3_node_19 (SEQ ID NO:4910) according to the present invention is supported by 4 libraries. The number of libraries was determined as previously described. This segment can be found in the following transcript(s): H88495_PEA_3_T4 (SEQ ID NO:4072) and H88495_PEA_3_T7 (SEQ ID NO:4075). Table 4311 below describes the starting and ending position of this segment on each transcript.

TABLE 4311

Segment location on transcripts

| Transcript name | Segment starting position | Segment ending position |
|---|---|---|
| H88495_PEA_3_T4 (SEQ ID NO: 4072) | 2714 | 2964 |
| H88495_PEA_3_T7 (SEQ ID NO: 4075) | 2714 | 2964 |

This segment can be found in the following protein(s): H88495_PEA_3_P15.

Segment cluster H88495_PEA_3_node_21 (SEQ ID NO:4911) according to the present invention is supported by 1 libraries. The number of libraries was determined as previously described. This segment can be found in the following transcript(s): H88495_PEA_3_T5 (SEQ ID NO:4073), H88495_PEA_3_T6 (SEQ ID NO:4074) and H88495_PEA_3_T7 (SEQ ID NO:4075). Table 4312 below describes the starting and ending position of this segment on each transcript.

TABLE 4312

Segment location on transcripts

| Transcript name | Segment starting position | Segment ending position |
|---|---|---|
| H88495_PEA_3_T5 (SEQ ID NO: 4073) | 2769 | 3095 |
| H88495_PEA_3_T6 (SEQ ID NO: 4074) | 2769 | 3095 |
| H88495_PEA_3_T7 (SEQ ID NO: 4075) | 3020 | 3346 |

This segment can be found in both coding and non-coding regions of transcript(s) as follows. The segment can be found in a non-coding region of transcript(s) that are related to the following protein(s): H88495_PEA_3_P15. This segment can also be found in the following protein(s): H88495_PEA_3_P16, since it is in the coding region for the corresponding transcript.

Segment cluster H88495_PEA_3_node_26 (SEQ ID NO:4912) according to the present invention is supported by 26 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4313 below describes the starting and ending position of this segment on each transcript.

TABLE 4313

Segment location on transcripts

| Transcript name | Segment starting position | Segment ending position |
|---|---|---|
| H88495_PEA_3_T4 (SEQ ID NO: 4072) | 3057 | 3298 |
| H88495_PEA_3_T5 (SEQ ID NO: 4073) | 3125 | 3257 |
| H88495_PEA_3_T6 (SEQ ID NO: 4074) | 3125 | 3366 |
| H88495_PEA_3_T7 (SEQ ID NO: 4075) | 3376 | 3508 |

This segment can be found in a non-coding region of transcript(s) that are related to the following protein(s): H88495_PEA_3_P15 and H88495_PEA_3_P16.

According to an optional embodiment of the present invention, short segments related to the above cluster are also provided. These segments are up to about 120 bp in length, and so are included in a separate description.

Segment cluster H88495_PEA_3_node_2 (SEQ ID NO:4913) according to the present invention is supported by 14 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4314 below describes the starting and ending position of this segment on each transcript.

TABLE 4314

Segment location on transcripts

| Transcript name | Segment starting position | Segment ending position |
|---|---|---|
| H88495_PEA_3_T4 (SEQ ID NO: 4072) | 1179 | 1209 |
| H88495_PEA_3_T5 (SEQ ID NO: 4073) | 1179 | 1209 |
| H88495_PEA_3_T6 (SEQ ID NO: 4074) | 1179 | 1209 |
| H88495_PEA_3_T7 (SEQ ID NO: 4075) | 1179 | 1209 |

This segment can be found in the following protein(s): H88495_PEA_3_P15 and H88495_PEA_3_P16.

Segment cluster H88495_PEA_3_node_5 (SEQ ID NO:4914) according to the present invention is supported by 16 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4315 below describes the starting and ending position of this segment on each transcript.

TABLE 4315

Segment location on transcripts

| Transcript name | Segment starting position | Segment ending position |
|---|---|---|
| H88495_PEA_3_T4 (SEQ ID NO: 4072) | 1647 | 1676 |
| H88495_PEA_3_T5 (SEQ ID NO: 4073) | 1647 | 1676 |
| H88495_PEA_3_T6 (SEQ ID NO: 4074) | 1647 | 1676 |
| H88495_PEA_3_T7 (SEQ ID NO: 4075) | 1647 | 1676 |

This segment can be found in the following protein(s): H88495_PEA_3_P15 and H88495_PEA_3_P16.

Segment cluster H88495_PEA_3_node_6 (SEQ ID NO:4915) according to the present invention is supported by 14 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4316 below describes the starting and ending position of this segment on each transcript.

TABLE 4316

Segment location on transcripts

| Transcript name | Segment starting position | Segment ending position |
|---|---|---|
| H88495_PEA_3_T4 (SEQ ID NO: 4072) | 1677 | 1763 |
| H88495_PEA_3_T5 (SEQ ID NO: 4073) | 1677 | 1763 |
| H88495_PEA_3_T6 (SEQ ID NO: 4074) | 1677 | 1763 |
| H88495_PEA_3_T7 (SEQ ID NO: 4075) | 1677 | 1763 |

This segment can be found in the following protein(s): H88495_PEA_3_P15 and H88495_PEA_3_P16.

Segment cluster H88495_PEA_3_node_7 (SEQ ID NO:4916) according to the present invention can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4317 below describes the starting and ending position of this segment on each transcript.

TABLE 4317

Segment location on transcripts

| Transcript name | Segment starting position | Segment ending position |
|---|---|---|
| H88495_PEA_3_T4 (SEQ ID NO: 4072) | 1764 | 1773 |
| H88495_PEA_3_T5 (SEQ ID NO: 4073) | 1764 | 1773 |
| H88495_PEA_3_T6 (SEQ ID NO: 4074) | 1764 | 1773 |
| H88495_PEA_3_T7 (SEQ ID NO: 4075) | 1764 | 1773 |

This segment can be found in the following protein(s): H88495_PEA_3_P15 and H88495_PEA_3_P16.

Segment cluster H88495_PEA_3_node_8 (SEQ ID NO:4917) according to the present invention is supported by 19 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4318 below describes the starting and ending position of this segment on each transcript.

TABLE 4318

Segment location on transcripts

| Transcript name | Segment starting position | Segment ending position |
|---|---|---|
| H88495_PEA_3_T4 (SEQ ID NO: 4072) | 1774 | 1818 |
| H88495_PEA_3_T5 (SEQ ID NO: 4073) | 1774 | 1818 |
| H88495_PEA_3_T6 (SEQ ID NO: 4074) | 1774 | 1818 |
| H88495_PEA_3_T7 (SEQ ID NO: 4075) | 1774 | 1818 |

This segment can be found in the following protein(s): H88495_PEA_3_P15 and H88495_PEA_3_P16.

Segment cluster H88495_PEA_3_node_10 (SEQ ID NO:4918) according to the present invention can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4319 below describes the starting and ending position of this segment on each transcript.

TABLE 4319

Segment location on transcripts

| Transcript name | Segment starting position | Segment ending position |
|---|---|---|
| H88495_PEA_3_T4 (SEQ ID NO: 4072) | 2336 | 2353 |
| H88495_PEA_3_T5 (SEQ ID NO: 4073) | 2336 | 2353 |
| H88495_PEA_3_T6 (SEQ ID NO: 4074) | 2336 | 2353 |
| H88495_PEA_3_T7 (SEQ ID NO: 4075) | 2336 | 2353 |

This segment can be found in the following protein(s): H88495_PEA_3_P15 and H88495_PEA_3_P16.

Segment cluster H88495_PEA_3_node_11 (SEQ ID NO:4919) according to the present invention can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4320 below describes the starting and ending position of this segment on each transcript.

TABLE 4320

Segment location on transcripts

| Transcript name | Segment starting position | Segment ending position |
|---|---|---|
| H88495_PEA_3_T4 (SEQ ID NO: 4072) | 2354 | 2362 |
| H88495_PEA_3_T5 (SEQ ID NO: 4073) | 2354 | 2362 |
| H88495_PEA_3_T6 (SEQ ID NO: 4074) | 2354 | 2362 |
| H88495_PEA_3_T7 (SEQ ID NO: 4075) | 2354 | 2362 |

This segment can be found in the following protein(s): H88495_PEA_3_P15 and H88495_PEA_3_P16.

Segment cluster H88495_PEA_3_node_12 (SEQ ID NO:4920) according to the present invention can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4321 below describes the starting and ending position of this segment on each transcript.

TABLE 4321

Segment location on transcripts

| Transcript name | Segment starting position | Segment ending position |
|---|---|---|
| H88495_PEA_3_T4 (SEQ ID NO: 4072) | 2363 | 2377 |
| H88495_PEA_3_T5 (SEQ ID NO: 4073) | 2363 | 2377 |
| H88495_PEA_3_T6 (SEQ ID NO: 4074) | 2363 | 2377 |
| H88495_PEA_3_T7 (SEQ ID NO: 4075) | 2363 | 2377 |

This segment can be found in the following protein(s): H88495_PEA_3_P15 and H88495_PEA_3_P16.

Segment cluster H88495_PEA_3_node_14 (SEQ ID NO:4921) according to the present invention is supported by 33 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4322 below describes the starting and ending position of this segment on each transcript.

TABLE 4322

Segment location on transcripts

| Transcript name | Segment starting position | Segment ending position |
|---|---|---|
| H88495_PEA_3_T4 (SEQ ID NO: 4072) | 2510 | 2573 |
| H88495_PEA_3_T5 (SEQ ID NO: 4073) | 2510 | 2573 |
| H88495_PEA_3_T6 (SEQ ID NO: 4074) | 2510 | 2573 |
| H88495_PEA_3_T7 (SEQ ID NO: 4075) | 2510 | 2573 |

This segment can be found in the following protein(s): H88495_PEA_3_P15 and H88495_PEA_3_P16.

Segment cluster H88495_PEA_3_node_16 (SEQ ID NO:4922) according to the present invention is supported by 33 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4323 below describes the starting and ending position of this segment on each transcript.

TABLE 4323

Segment location on transcripts

| Transcript name | Segment starting position | Segment ending position |
|---|---|---|
| H88495_PEA_3_T4 (SEQ ID NO: 4072) | 2574 | 2644 |
| H88495_PEA_3_T5 (SEQ ID NO: 4073) | 2574 | 2644 |
| H88495_PEA_3_T6 (SEQ ID NO: 4074) | 2574 | 2644 |
| H88495_PEA_3_T7 (SEQ ID NO: 4075) | 2574 | 2644 |

This segment can be found in the following protein(s): H88495_PEA_3_P15 and H88495_PEA_3_P16.

Segment cluster H88495_PEA_3_node_18 (SEQ ID NO:4923) according to the present invention is supported by 31 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4324 below describes the starting and ending position of this segment on each transcript.

TABLE 4324

Segment location on transcripts

| Transcript name | Segment starting position | Segment ending position |
|---|---|---|
| H88495_PEA_3_T4 (SEQ ID NO: 4072) | 2645 | 2713 |
| H88495_PEA_3_T5 (SEQ ID NO: 4073) | 2645 | 2713 |
| H88495_PEA_3_T6 (SEQ ID NO: 4074) | 2645 | 2713 |
| H88495_PEA_3_T7 (SEQ ID NO: 4075) | 2645 | 2713 |

This segment can be found in the following protein(s): H88495_PEA_3_P15 and H88495_PEA_3_P16.

Segment cluster H88495_PEA_3_node_20 (SEQ ID NO:4924) according to the present invention is supported by 27 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4325 below describes the starting and ending position of this segment on each transcript.

TABLE 4325

Segment location on transcripts

| Transcript name | Segment starting position | Segment ending position |
|---|---|---|
| H88495_PEA_3_T4 (SEQ ID NO: 4072) | 2965 | 3019 |

TABLE 4325-continued

Segment location on transcripts

| Transcript name | Segment starting position | Segment ending position |
|---|---|---|
| H88495_PEA_3_T5 (SEQ ID NO: 4073) | 2714 | 2768 |
| H88495_PEA_3_T6 (SEQ ID NO: 4074) | 2714 | 2768 |
| H88495_PEA_3_T7 (SEQ ID NO: 4075) | 2965 | 3019 |

This segment can be found in both coding and non-coding regions of transcript(s) as follows. The segment can be found in a non-coding region of transcript(s) that are related to the following protein(s): H88495_PEA_3_P15. This segment can also be found in the following protein(s): H88495_PEA_3_P16, since it is in the coding region for the corresponding transcript.

Segment cluster H88495_PEA_3_node_23 (SEQ ID NO:4925) according to the present invention can be found in the following transcript(s): H88495_PEA_3_T4 (SEQ ID NO:4072). Table 4326 below describes the starting and ending position of this segment on each transcript.

TABLE 4326

Segment location on transcripts

| Transcript name | Segment starting position | Segment ending position |
|---|---|---|
| H88495_PEA_3_T4 (SEQ ID NO: 4072) | 3020 | 3027 |

This segment can be found in a non-coding region of transcript(s) that are related to the following protein(s): H88495_PEA_3_P15.

Segment cluster H88495_PEA_3_node_24 (SEQ ID NO:4926) according to the present invention is supported by 23 libraries. The number of libraries was determined as previously described. This segment can be found in the following transcript(s): H88495_PEA_3_T4 (SEQ ID NO:4072), H88495_PEA_3_T5 (SEQ ID NO:4073), H88495_PEA_3_T6 (SEQ ID NO:4074) and H88495_PEA_3_T7 (SEQ ID NO:4075). Table 4327 below describes the starting and ending position of this segment on each transcript.

TABLE 4327

Segment location on transcripts

| Transcript name | Segment starting position | Segment ending position |
|---|---|---|
| H88495_PEA_3_T4 (SEQ ID NO: 4072) | 3028 | 3056 |
| H88495_PEA_3_T5 (SEQ ID NO: 4073) | 3096 | 3124 |
| H88495_PEA_3_T6 (SEQ ID NO: 4074) | 3096 | 3124 |
| H88495_PEA_3_T7 (SEQ ID NO: 4075) | 3347 | 3375 |

This segment can be found in a non-coding region of transcript(s) that are related to the following protein(s): H88495_PEA_3_P15 and H88495_PEA_3_P16.

Description for Cluster HSACMHCP

Cluster HSACMHCP features 1 transcript(s) and 55 segment(s) of interest, the names for which are given in Tables 4328 and 4329, respectively, the sequences themselves are given at the end of the application. The selected protein variants are given in Table 4330.

TABLE 4328

Transcripts of interest
Transcript Name

HSACMHCP_PEA_1_T6 (SEQ ID NO: 4076)

TABLE 4329

Segments of interest
Segment Name

HSACMHCP_PEA_1_node_20 (SEQ ID NO: 4927)
HSACMHCP_PEA_1_node_22 (SEQ ID NO: 4928)
HSACMHCP_PEA_1_node_25 (SEQ ID NO: 4929)
HSACMHCP_PEA_1_node_43 (SEQ ID NO: 4930)
HSACMHCP_PEA_1_node_45 (SEQ ID NO: 4931)
HSACMHCP_PEA_1_node_49 (SEQ ID NO: 4932)
HSACMHCP_PEA_1_node_57 (SEQ ID NO: 4933)
HSACMHCP_PEA_1_node_59 (SEQ ID NO: 4934)
HSACMHCP_PEA_1_node_61 (SEQ ID NO: 4935)
HSACMHCP_PEA_1_node_63 (SEQ ID NO: 4936)
HSACMHCP_PEA_1_node_65 (SEQ ID NO: 4937)
HSACMHCP_PEA_1_node_67 (SEQ ID NO: 4938)
HSACMHCP_PEA_1_node_71 (SEQ ID NO: 4939)
HSACMHCP_PEA_1_node_87 (SEQ ID NO: 4940)
HSACMHCP_PEA_1_node_89 (SEQ ID NO: 4941)
HSACMHCP_PEA_1_node_96 (SEQ ID NO: 4942)
HSACMHCP_PEA_1_node_97 (SEQ ID NO: 4943)
HSACMHCP_PEA_1_node_100 (SEQ ID NO: 4944)
HSACMHCP_PEA_1_node_106 (SEQ ID NO: 4945)
HSACMHCP_PEA_1_node_107 (SEQ ID NO: 4946)
HSACMHCP_PEA_1_node_111 (SEQ ID NO: 4947)
HSACMHCP_PEA_1_node_113 (SEQ ID NO: 4948)
HSACMHCP_PEA_1_node_16 (SEQ ID NO: 4949)
HSACMHCP_PEA_1_node_18 (SEQ ID NO: 4950)
HSACMHCP_PEA_1_node_23 (SEQ ID NO: 4951)
HSACMHCP_PEA_1_node_27 (SEQ ID NO: 4952)

TABLE 4329-continued

Segments of interest
Segment Name

HSACMHCP_PEA_1_node_29 (SEQ ID NO: 4953)
HSACMHCP_PEA_1_node_31 (SEQ ID NO: 4954)
HSACMHCP_PEA_1_node_33 (SEQ ID NO: 4955)
HSACMHCP_PEA_1_node_35 (SEQ ID NO: 4956)
HSACMHCP_PEA_1_node_37 (SEQ ID NO: 4957)
HSACMHCP_PEA_1_node_39 (SEQ ID NO: 4958)
HSACMHCP_PEA_1_node_40 (SEQ ID NO: 4959)
HSACMHCP_PEA_1_node_51 (SEQ ID NO: 4960)
HSACMHCP_PEA_1_node_53 (SEQ ID NO: 4961)
HSACMHCP_PEA_1_node_55 (SEQ ID NO: 4962)
HSACMHCP_PEA_1_node_69 (SEQ ID NO: 4963)
HSACMHCP_PEA_1_node_72 (SEQ ID NO: 4964)
HSACMHCP_PEA_1_node_73 (SEQ ID NO: 4965)
HSACMHCP_PEA_1_node_74 (SEQ ID NO: 4966)
HSACMHCP_PEA_1_node_77 (SEQ ID NO: 4967)
HSACMHCP_PEA_1_node_78 (SEQ ID NO: 4968)
HSACMHCP_PEA_1_node_80 (SEQ ID NO: 4969)
HSACMHCP_PEA_1_node_82 (SEQ ID NO: 4970)
HSACMHCP_PEA_1_node_83 (SEQ ID NO: 4971)
HSACMHCP_PEA_1_node_84 (SEQ ID NO: 4972)
HSACMHCP_PEA_1_node_85 (SEQ ID NO: 4973)
HSACMHCP_PEA_1_node_91 (SEQ ID NO: 4974)
HSACMHCP_PEA_1_node_92 (SEQ ID NO: 4975)
HSACMHCP_PEA_1_node_93 (SEQ ID NO: 4976)
HSACMHCP_PEA_1_node_95 (SEQ ID NO: 4977)
HSACMHCP_PEA_1_node_98 (SEQ ID NO: 4978)
HSACMHCP_PEA_1_node_103 (SEQ ID NO: 4979)
HSACMHCP_PEA_1_node_104 (SEQ ID NO: 4980)
HSACMHCP_PEA_1_node_109 (SEQ ID NO: 4981)

TABLE 4330

Proteins of interest

| Protein Name | Corresponding Transcript(s) |
| --- | --- |
| HSACMHCP_PEA_1_P2 | HSACMHCP_PEA_1_T6 (SEQ ID NO: 4076) |

These sequences are variants of the known protein Myosin heavy chain, cardiac muscle alpha isoform (SwissProt accession identifier MYH6_HUMAN; known also according to the synonyms MyHC-alpha), referred to herein as the previously known protein.

Protein Myosin heavy chain, cardiac muscle alpha isoform is known or believed to have the following function(s): Muscle contraction. The sequence for protein Myosin heavy chain, cardiac muscle alpha isoform is given at the end of the application, as "Myosin heavy chain, cardiac muscle alpha isoform amino acid sequence". Known polymorphisms for this sequence are as shown in Table 4331.

TABLE 4331

Amino acid mutations for Known Protein

| SNP position(s) on amino acid sequence | Comment |
|---|---|
| 88 | Q -> E |
| 574 | Q -> P |
| 608 | A -> G |
| 744 | T -> A |
| 790 | M -> I |
| 1014 | V -> A |
| 1021 | S -> T |
| 1101 | A -> V |
| 1290 | A -> S |
| 1373 | W -> C |
| 1533 | K -> N |
| 1540 | L -> M |
| 1577-1578 | KL -> NV |
| 1705-1706 | EQ -> DR |
| 1733 | E -> D |
| 1734 | A -> S |
| 1737 | T -> S |
| 1763 | D -> H |
| 1788 | M -> I |
| 1871 | D -> N |
| 1882 | R -> G |
| 1890 | Q -> R |
| 1933 | Missing |

Protein Myosin heavy chain, cardiac muscle alpha isoform localization is believed to be Thick filaments of the myofibrils.

The following GO Annotation(s) apply to the previously known protein. The following annotation(s) were found: muscle contraction; striated muscle contraction; muscle development, which are annotation(s) related to Biological Process; microfilament motor; actin binding; calmodulin binding; ATP binding, which are annotation(s) related to Molecular Function; and muscle myosin; muscle thick filament; myosin, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster HSACMHCP. Predictions were made for selective expression of transcripts of this contig in heart tissue, according to the previously described methods. The numbers on the y-axis of FIG. 110 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 110, concerning the number of heart-specific clones in libraries/sequences; as well as with regard to the histogram in FIGS. 111-112 concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 24; the ratio of expression of the cluster in heart specific ESTs to the overall expression of the cluster in muscle-specific ESTs which was found to be 92.5; and fisher exact test P-values were computed both for library and weighted clone counts to check that the counts are statistically significant, and were found to be 3.20E-47.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 24, which clearly supports specific expression in heart tissue.

As noted above, cluster HSACMHCP features 55 segment(s), which were listed in Table 4329 above and for which the sequence(s) are given at the end of the application. These segment(s) are portions of nucleic acid sequence(s) which are described herein separately because they are of particular interest. A description of each segment according to the present invention is now provided.

Segment cluster HSACMHCP_PEA_1_node_20 (SEQ ID NO:4927) according to the present invention is supported by 6 libraries. The number of libraries was determined as previously described. This segment can be found in the following transcript(s): HSACMHCP_PEA_1_T6 (SEQ ID NO:4076). Table 4332 below describes the starting and ending position of this segment on each transcript.

TABLE 4332

Segment location on transcripts

| Transcript name | Segment starting position | Segment ending position |
|---|---|---|
| HSACMHCP_PEA_1_T6 (SEQ ID NO: 4076) | 65 | 278 |

This segment can be found in the following protein(s): HSACMHCP_PEA_1_P2.

Segment cluster HSACMHCP_PEA_1_node_22 (SEQ ID NO:4928) according to the present invention is supported by 7 libraries. The number of libraries was determined as previously described. This segment can be found in the following transcript(s): HSACMHCP_PEA_1_T6 (SEQ ID NO:4076). Table 4333 below describes the starting and ending position of this segment on each transcript.

TABLE 4333

Segment location on transcripts

| Transcript name | Segment starting position | Segment ending position |
|---|---|---|
| HSACMHCP_PEA_1_T6 (SEQ ID NO: 4076) | 279 | 400 |

This segment can be found in the following protein(s): HSACMHCP_PEA_1_P2.

Segment cluster HSACMHCP_PEA_1_node_25 (SEQ ID NO:4929) according to the present invention is supported by 6 libraries. The number of libraries was determined as previously described. This segment can be found in the following transcript(s): HSACMHCP_PEA_1_T6 (SEQ ID NO:4076). Table 4334 below describes the starting and ending position of this segment on each transcript.

TABLE 4334

Segment location on transcripts

| Transcript name | Segment starting position | Segment ending position |
|---|---|---|
| HSACMHCP_PEA_1_T6 (SEQ ID NO: 4076) | 423 | 579 |

This segment can be found in the following protein(s): HSACMHCP_PEA_1_P2.

Segment cluster HSACMHCP_PEA_1_node_43 (SEQ ID NO:4930) according to the present invention is supported by 8 libraries. The number of libraries was determined as previously described. This segment can be found in the following transcript(s): HSACMHCP_PEA_1_T6 (SEQ ID NO:4076). Table 4335 below describes the starting and ending position of this segment on each transcript.

TABLE 4335

Segment location on transcripts

| Transcript name | Segment starting position | Segment ending position |
|---|---|---|
| HSACMHCP_PEA_1_T6 (SEQ ID NO: 4076) | 1219 | 1487 |

This segment can be found in the following protein(s): HSACMHCP_PEA_1_P2.

Segment cluster HSACMHCP_PEA_1_node_45 (SEQ ID NO:4931) according to the present invention is supported by 8 libraries. The number of libraries was determined as previously described. This segment can be found in the following transcript(s): HSACMHCP_PEA_1_T6 (SEQ ID NO:4076). Table 4336 below describes the starting and ending position of this segment on each transcript.

TABLE 4336

Segment location on transcripts

| Transcript name | Segment starting position | Segment ending position |
|---|---|---|
| HSACMHCP_PEA_1_T6 (SEQ ID NO: 4076) | 1488 | 1658 |

This segment can be found in the following protein(s): HSACMHCP_PEA_1_P2.

Segment cluster HSACMHCP_PEA_1_node_49 (SEQ ID NO:4932) according to the present invention is supported by 9 libraries. The number of libraries was determined as previously described. This segment can be found in the following transcript(s): HSACMHCP_PEA_1_T6 (SEQ ID NO:4076). Table 4337 below describes the starting and ending position of this segment on each transcript.

TABLE 4337

Segment location on transcripts

| Transcript name | Segment starting position | Segment ending position |
|---|---|---|
| HSACMHCP_PEA_1_T6 (SEQ ID NO: 4076) | 1659 | 1968 |

This segment can be found in the following protein(s): HSACMHCP_PEA_1_P2.

Segment cluster HSACMHCP_PEA_1_node_57 (SEQ ID NO:4933) according to the present invention is supported by 4 libraries. The number of libraries was determined as previously described. This segment can be found in the following transcript(s): HSACMHCP_PEA_1_T6 (SEQ ID NO:4076). Table 4338 below describes the starting and ending position of this segment on each transcript.

TABLE 4338

Segment location on transcripts

| Transcript name | Segment starting position | Segment ending position |
|---|---|---|
| HSACMHCP_PEA_1_T6 (SEQ ID NO: 4076) | 2246 | 2369 |

This segment can be found in the following protein(s): HSACMHCP_PEA_1_P2.

Segment cluster HSACMHCP_PEA_1_node_59 (SEQ ID NO:4934) according to the present invention is supported by 4 libraries. The number of libraries was determined as previously described. This segment can be found in the following transcript(s): HSACMHCP_PEA_1_T6 (SEQ ID NO:4076). Table 4339 below describes the starting and ending position of this segment on each transcript.

TABLE 4339

Segment location on transcripts

| Transcript name | Segment starting position | Segment ending position |
|---|---|---|
| HSACMHCP_PEA_1_T6 (SEQ ID NO: 4076) | 2370 | 2506 |

This segment can be found in the following protein(s): HSACMHCP_PEA_1_P2.

Segment cluster HSACMHCP_PEA_1_node_61 (SEQ ID NO:4935) according to the present invention is supported by 5 libraries. The number of libraries was determined as previously described. This segment can be found in the following transcript(s): HSACMHCP_PEA_1_T6 (SEQ ID NO:4076). Table 4340 below describes the starting and ending position of this segment on each transcript.

TABLE 4340

Segment location on transcripts

| Transcript name | Segment starting position | Segment ending position |
|---|---|---|
| HSACMHCP_PEA_1_T6 (SEQ ID NO: 4076) | 2507 | 2762 |

This segment can be found in the following protein(s): HSACMHCP_PEA_1_P2.

Segment cluster HSACMHCP_PEA_1_node_63 (SEQ ID NO:4936) according to the present invention is supported by 6 libraries. The number of libraries was determined as previously described. This segment can be found in the following transcript(s): HSACMHCP_PEA_1_T6 (SEQ ID NO:4076). Table 4341 below describes the starting and ending position of this segment on each transcript.

TABLE 4341

Segment location on transcripts

| Transcript name | Segment starting position | Segment ending position |
|---|---|---|
| HSACMHCP_PEA_1_T6 (SEQ ID NO: 4076) | 2763 | 3005 |

This segment can be found in the following protein(s): HSACMHCP_PEA_1_P2.

Segment cluster HSACMHCP_PEA_1_node_65 (SEQ ID NO:4937) according to the present invention is supported by 7 libraries. The number of libraries was determined as previously described. This segment can be found in the following transcript(s): HSACMHCP_PEA_1_T6 (SEQ ID NO:4076). Table 4342 below describes the starting and ending position of this segment on each transcript.

TABLE 4342

Segment location on transcripts

| Transcript name | Segment starting position | Segment ending position |
|---|---|---|
| HSACMHCP_PEA_1_T6 (SEQ ID NO: 4076) | 3006 | 3182 |

This segment can be found in the following protein(s): HSACMHCP_PEA_1_P2.

Segment cluster HSACMHCP_PEA_1_node_67 (SEQ ID NO:4938) according to the present invention is supported by 8 libraries. The number of libraries was determined as previously described. This segment can be found in the following transcript(s): HSACMHCP_PEA_1_T6 (SEQ ID NO:4076). Table 4343 below describes the starting and ending position of this segment on each transcript.

TABLE 4343

Segment location on transcripts

| Transcript name | Segment starting position | Segment ending position |
|---|---|---|
| HSACMHCP_PEA_1_T6 (SEQ ID NO: 4076) | 3183 | 3328 |

This segment can be found in the following protein(s): HSACMHCP_PEA_1_P2.

Segment cluster HSACMHCP_PEA_1_node_71 (SEQ ID NO:4939) according to the present invention is supported by 10 libraries. The number of libraries was determined as previously described. This segment can be found in the following transcript(s): HSACMHCP_PEA_1_T6 (SEQ ID NO:4076). Table 4344 below describes the starting and ending position of this segment on each transcript.

TABLE 4344

Segment location on transcripts

| Transcript name | Segment starting position | Segment ending position |
|---|---|---|
| HSACMHCP_PEA_1_T6 (SEQ ID NO: 4076) | 3420 | 3689 |

This segment can be found in the following protein(s): HSACMHCP_PEA_1_P2.

Segment cluster HSACMHCP_PEA_1_node_87 (SEQ ID NO:4940) according to the present invention is supported by 12 libraries. The number of libraries was determined as previously described. This segment can be found in the following transcript(s): HSACMHCP_PEA_1_T6 (SEQ ID NO:4076). Table 4345 below describes the starting and ending position of this segment on each transcript.

TABLE 4345

Segment location on transcripts

| Transcript name | Segment starting position | Segment ending position |
|---|---|---|
| HSACMHCP_PEA_1_T6 (SEQ ID NO: 4076) | 4253 | 4436 |

This segment can be found in the following protein(s): HSACMHCP_PEA_1_P2.

Segment cluster HSACMHCP_PEA_1_node_89 (SEQ ID NO:4941) according to the present invention is supported by 15 libraries. The number of libraries was determined as previously described. This segment can be found in the following transcript(s): HSACMHCP_PEA_1_T6 (SEQ ID NO:4076). Table 4346 below describes the starting and ending position of this segment on each transcript.

TABLE 4346

Segment location on transcripts

| Transcript name | Segment starting position | Segment ending position |
|---|---|---|
| HSACMHCP_PEA_1_T6 (SEQ ID NO: 4076) | 4437 | 4602 |

This segment can be found in the following protein(s): HSACMHCP_PEA_1_P2.

Segment cluster HSACMHCP_PEA_1_node_96 (SEQ ID NO:4942) according to the present invention is supported by 16 libraries. The number of libraries was determined as previously described. This segment can be found in the following transcript(s): HSACMHCP_PEA_1_T6 (SEQ ID NO:4076). Table 4347 below describes the starting and ending position of this segment on each transcript.

TABLE 4347

Segment location on transcripts

| Transcript name | Segment starting position | Segment ending position |
|---|---|---|
| HSACMHCP_PEA_1_T6 (SEQ ID NO: 4076) | 4743 | 4877 |

This segment can be found in the following protein(s): HSACMHCP_PEA_1_P2.

Segment cluster HSACMHCP_PEA_1_node_97 (SEQ ID NO:4943) according to the present invention is supported by 16 libraries. The number of libraries was determined as previously described. This segment can be found in the following transcript(s): HSACMHCP_PEA_1_T6 (SEQ ID NO:4076). Table 4348 below describes the starting and ending position of this segment on each transcript.

TABLE 4348

Segment location on transcripts

| Transcript name | Segment starting position | Segment ending position |
|---|---|---|
| HSACMHCP_PEA_1_T6 (SEQ ID NO: 4076) | 4878 | 5006 |

This segment can be found in the following protein(s): HSACMHCP_PEA_1_P2.

Segment cluster HSACMHCP_PEA_1_node_100 (SEQ ID NO:4944) according to the present invention is supported by 19 libraries. The number of libraries was determined as previously described. This segment can be found in the following transcript(s): HSACMHCP_PEA_1_T6 (SEQ ID NO:4076). Table 4349 below describes the starting and ending position of this segment on each transcript.

TABLE 4349

Segment location on transcripts

| Transcript name | Segment starting position | Segment ending position |
|---|---|---|
| HSACMHCP_PEA_1_T6 (SEQ ID NO: 4076) | 5037 | 5240 |

This segment can be found in the following protein(s): HSACMHCP_PEA_1_P2.

Segment cluster HSACMHCP_PEA_1_node_106 (SEQ ID NO:4945) according to the present invention is supported by 18 libraries. The number of libraries was determined as previously described. This segment can be found in the following transcript(s): HSACMHCP_PEA_1_T6 (SEQ ID NO:4076). Table 4350 below describes the starting and ending position of this segment on each transcript.

TABLE 4350

Segment location on transcripts

| Transcript name | Segment starting position | Segment ending position |
|---|---|---|
| HSACMHCP_PEA_1_T6 (SEQ ID NO: 4076) | 5367 | 5642 |

This segment can be found in the following protein(s): HSACMHCP_PEA_1_P2.

Segment cluster HSACMHCP_PEA_1_node_107 (SEQ ID NO:4946) according to the present invention is supported by 5 libraries. The number of libraries was determined as previously described. This segment can be found in the following transcript(s): HSACMHCP_PEA_1_T6 (SEQ ID NO:4076). Table 4351 below describes the starting and ending position of this segment on each transcript.

TABLE 4351

Segment location on transcripts

| Transcript name | Segment starting position | Segment ending position |
|---|---|---|
| HSACMHCP_PEA_1_T6 (SEQ ID NO: 4076) | 5643 | 5866 |

This segment can be found in the following protein(s): HSACMHCP_PEA_1_P2.

Segment cluster HSACMHCP_PEA_1_node_111 (SEQ ID NO:4947) according to the present invention is supported by 20 libraries. The number of libraries was determined as previously described. This segment can be found in the following transcript(s): HSACMHCP_PEA_1_T6 (SEQ ID NO:4076). Table 4352 below describes the starting and ending position of this segment on each transcript.

TABLE 4352

Segment location on transcripts

| Transcript name | Segment starting position | Segment ending position |
|---|---|---|
| HSACMHCP_PEA_1_T6 (SEQ ID NO: 4076) | 5963 | 6097 |

This segment can be found in a non-coding region of transcript(s) that are related to the following protein(s): HSACMHCP_PEA_1_P2.

Segment cluster HSACMHCP_PEA_1_node_113 (SEQ ID NO:4948) according to the present invention is supported by 20 libraries. The number of libraries was determined as previously described. This segment can be found in the following transcript(s): HSACMHCP_PEA_1_T6 (SEQ ID NO:4076). Table 4353 below describes the starting and ending position of this segment on each transcript.

TABLE 4353

Segment location on transcripts

| Transcript name | Segment starting position | Segment ending position |
|---|---|---|
| HSACMHCP_PEA_1_T6 (SEQ ID NO: 4076) | 6098 | 6177 |

This segment can be found in a non-coding region of transcript(s) that are related to the following protein(s): HSACMHCP_PEA_1_P2.

According to an optional embodiment of the present invention, short segments related to the above cluster are also provided. These segments are up to about 120 bp in length, and so are included in a separate description.

Segment cluster HSACMHCP_PEA_1_node_16 (SEQ ID NO:4949) according to the present invention is supported by 1 libraries. The number of libraries was determined as previously described. This segment can be found in the following transcript(s): HSACMHCP_PEA_1_T6 (SEQ ID NO:4076). Table 4354 below describes the starting and ending position of this segment on each transcript.

TABLE 4354

| | Segment location on transcripts | |
|---|---|---|
| Transcript name | Segment starting position | Segment ending position |
| HSACMHCP_PEA_1_T6 (SEQ ID NO: 4076) | 1 | 31 |

This segment can be found in a non-coding region of transcript(s) that are related to the following protein(s): HSACMHCP_PEA_1_P2.

Segment cluster HSACMHCP_PEA_1_node_18 (SEQ ID NO:4950) according to the present invention is supported by 3 libraries. The number of libraries was determined as previously described. This segment can be found in the following transcript(s): HSACMHCP_PEA_1_T6 (SEQ ID NO:4076). Table 4355 below describes the starting and ending position of this segment on each transcript.

TABLE 4355

| | Segment location on transcripts | |
|---|---|---|
| Transcript name | Segment starting position | Segment ending position |
| HSACMHCP_PEA_1_T6 (SEQ ID NO: 4076) | 32 | 64 |

This segment can be found in a non-coding region of transcript(s) that are related to the following protein(s): HSACMHCP_PEA_1_P2.

Segment cluster HSACMHCP_PEA_1_node_23 (SEQ ID NO:4951) according to the present invention can be found in the following transcript(s): HSACMHCP_PEA_1_T6 (SEQ ID NO:4076). Table 4356 below describes the starting and ending position of this segment on each transcript.

TABLE 4356

| | Segment location on transcripts | |
|---|---|---|
| Transcript name | Segment starting position | Segment ending position |
| HSACMHCP_PEA_1_T6 (SEQ ID NO: 4076) | 401 | 422 |

This segment can be found in the following protein(s): HSACMHCP_PEA_1_P2.

Segment cluster HSACMHCP_PEA_1_node_27 (SEQ ID NO:4952) according to the present invention is supported by 5 libraries. The number of libraries was determined as previously described. This segment can be found in the following transcript(s): HSACMHCP_PEA_1_T6 (SEQ ID NO:4076). Table 4357 below describes the starting and ending position of this segment on each transcript.

TABLE 4357

| | Segment location on transcripts | |
|---|---|---|
| Transcript name | Segment starting position | Segment ending position |
| HSACMHCP_PEA_1_T6 (SEQ ID NO: 4076) | 580 | 607 |

This segment can be found in the following protein(s): HSACMHCP_PEA_1_P2.

Segment cluster HSACMHCP_PEA_1_node_29 (SEQ ID NO:4953) according to the present invention is supported by 6 libraries. The number of libraries was determined as previously described. This segment can be found in the following transcript(s): HSACMHCP_PEA_1_T6 (SEQ ID NO:4076). Table 4358 below describes the starting and ending position of this segment on each transcript.

TABLE 4358

| | Segment location on transcripts | |
|---|---|---|
| Transcript name | Segment starting position | Segment ending position |
| HSACMHCP_PEA_1_T6 (SEQ ID NO: 4076) | 608 | 719 |

This segment can be found in the following protein(s): HSACMHCP_PEA_1_P2.

Segment cluster HSACMHCP_PEA_1_node_31 (SEQ ID NO:4954) according to the present invention is supported by 7 libraries. The number of libraries was determined as previously described. This segment can be found in the following transcript(s): HSACMHCP_PEA_1_T6 (SEQ ID NO:4076). Table 4359 below describes the starting and ending position of this segment on each transcript.

TABLE 4359

| | Segment location on transcripts | |
|---|---|---|
| Transcript name | Segment starting position | Segment ending position |
| HSACMHCP_PEA_1_T6 (SEQ ID NO: 4076) | 720 | 812 |

This segment can be found in the following protein(s): HSACMHCP_PEA_1_P2.

Segment cluster HSACMHCP_PEA_1_node_33 (SEQ ID NO:4955) according to the present invention is supported by 7 libraries. The number of libraries was determined as previously described. This segment can be found in the following transcript(s): HSACMHCP_PEA_1_T6 (SEQ ID NO:4076). Table 4360 below describes the starting and ending position of this segment on each transcript.

TABLE 4360

| | Segment location on transcripts | |
|---|---|---|
| Transcript name | Segment starting position | Segment ending position |
| HSACMHCP_PEA_1_T6 (SEQ ID NO: 4076) | 813 | 876 |

This segment can be found in the following protein(s): HSACMHCP_PEA_1_P2.

Segment cluster HSACMHCP_PEA_1_node_35 (SEQ ID NO:4956) according to the present invention is supported by 6 libraries. The number of libraries was determined as previously described. This segment can be found in the following transcript(s): HSACMHCP_PEA_1_T6 (SEQ ID NO:4076). Table 4361 below describes the starting and ending position of this segment on each transcript.

TABLE 4361

Segment location on transcripts

| Transcript name | Segment starting position | Segment ending position |
|---|---|---|
| HSACMHCP_PEA_1_T6 (SEQ ID NO: 4076) | 877 | 975 |

This segment can be found in the following protein(s): HSACMHCP_PEA_1_P2.

Segment cluster HSACMHCP_PEA_1_node_37 (SEQ ID NO:4957) according to the present invention is supported by 7 libraries. The number of libraries was determined as previously described. This segment can be found in the following transcript(s): HSACMHCP_PEA_1_T6 (SEQ ID NO:4076). Table 4362 below describes the starting and ending position of this segment on each transcript.

TABLE 4362

Segment location on transcripts

| Transcript name | Segment starting position | Segment ending position |
|---|---|---|
| HSACMHCP_PEA_1_T6 (SEQ ID NO: 4076) | 976 | 1079 |

This segment can be found in the following protein(s): HSACMHCP_PEA_1_P2.

Segment cluster HSACMHCP_PEA_1_node_39 (SEQ ID NO:4958) according to the present invention is supported by 8 libraries. The number of libraries was determined as previously described. This segment can be found in the following transcript(s): HSACMHCP_PEA_1_T6 (SEQ ID NO:4076). Table 4363 below describes the starting and ending position of this segment on each transcript.

TABLE 4363

Segment location on transcripts

| Transcript name | Segment starting position | Segment ending position |
|---|---|---|
| HSACMHCP_PEA_1_T6 (SEQ ID NO: 4076) | 1080 | 1196 |

This segment can be found in the following protein(s): HSACMHCP_PEA_1_P2.

Segment cluster HSACMHCP_PEA_1_node_40 (SEQ ID NO:4959) according to the present invention can be found in the following transcript(s): HSACMHCP_PEA_1_T6 (SEQ ID NO:4076). Table 4364 below describes the starting and ending position of this segment on each transcript.

TABLE 4364

Segment location on transcripts

| Transcript name | Segment starting position | Segment ending position |
|---|---|---|
| HSACMHCP_PEA_1_T6 (SEQ ID NO: 4076) | 1197 | 1218 |

This segment can be found in the following protein(s): HSACMHCP_PEA_1_P2.

Segment cluster HSACMHCP_PEA_1_node_51 (SEQ ID NO:4960) according to the present invention is supported by 6 libraries. The number of libraries was determined as previously described. This segment can be found in the following transcript(s): HSACMHCP_PEA_1_T6 (SEQ ID NO:4076). Table 4365 below describes the starting and ending position of this segment on each transcript.

TABLE 4365

Segment location on transcripts

| Transcript name | Segment starting position | Segment ending position |
|---|---|---|
| HSACMHCP_PEA_1_T6 (SEQ ID NO: 4076) | 1969 | 2039 |

This segment can be found in the following protein(s): HSACMHCP_PEA_1_P2.

Segment cluster HSACMHCP_PEA_1_node_53 (SEQ ID NO:4961) according to the present invention is supported by 3 libraries. The number of libraries was determined as previously described. This segment can be found in the following transcript(s): HSACMHCP_PEA_1_T6 (SEQ ID NO:4076). Table 4366 below describes the starting and ending position of this segment on each transcript.

TABLE 4366

Segment location on transcripts

| Transcript name | Segment starting position | Segment ending position |
|---|---|---|
| HSACMHCP_PEA_1_T6 (SEQ ID NO: 4076) | 2040 | 2127 |

This segment can be found in the following protein(s): HSACMHCP_PEA_1_P2.

Segment cluster HSACMHCP_PEA_1_node_55 (SEQ ID NO:4962) according to the present invention is supported by 2 libraries. The number of libraries was determined as previously described. This segment can be found in the following transcript(s): HSACMHCP_PEA_1_T6 (SEQ ID NO:4076). Table 4367 below describes the starting and ending position of this segment on each transcript.

TABLE 4367

Segment location on transcripts

| Transcript name | Segment starting position | Segment ending position |
|---|---|---|
| HSACMHCP_PEA_1_T6 (SEQ ID NO: 4076) | 2128 | 2245 |

This segment can be found in the following protein(s): HSACMHCP_PEA_1_P2.

Segment cluster HSACMHCP_PEA_1_node_69 (SEQ ID NO:4963) according to the present invention is supported by 8 libraries. The number of libraries was determined as previously described. This segment can be found in the following transcript(s): HSACMHCP_PEA_1_T6 (SEQ ID NO:4076). Table 4368 below describes the starting and ending position of this segment on each transcript.

TABLE 4368

| Segment location on transcripts | | |
|---|---|---|
| Transcript name | Segment starting position | Segment ending position |
| HSACMHCP_PEA_1_T6 (SEQ ID NO: 4076) | 3329 | 3419 |

This segment can be found in the following protein(s): HSACMHCP_PEA_1_P2.

Segment cluster HSACMHCP_PEA_1_node_72 (SEQ ID NO:4964) according to the present invention can be found in the following transcript(s): HSACMHCP_PEA_1_T6 (SEQ ID NO:4076). Table 4369 below describes the starting and ending position of this segment on each transcript.

TABLE 4369

| Segment location on transcripts | | |
|---|---|---|
| Transcript name | Segment starting position | Segment ending position |
| HSACMHCP_PEA_1_T6 (SEQ ID NO: 4076) | 3690 | 3701 |

This segment can be found in the following protein(s): HSACMHCP_PEA_1_P2.

Segment cluster HSACMHCP_PEA_1_node_73 (SEQ ID NO:4965) according to the present invention is supported by 10 libraries. The number of libraries was determined as previously described. This segment can be found in the following transcript(s): HSACMHCP_PEA_1_T6 (SEQ ID NO:4076). Table 4370 below describes the starting and ending position of this segment on each transcript.

TABLE 4370

| Segment location on transcripts | | |
|---|---|---|
| Transcript name | Segment starting position | Segment ending position |
| HSACMHCP_PEA_1_T6 (SEQ ID NO: 4076) | 3702 | 3731 |

This segment can be found in the following protein(s): HSACMHCP_PEA_1_P2.

Segment cluster HSACMHCP_PEA_1_node_74 (SEQ ID NO:4966) according to the present invention is supported by 8 libraries. The number of libraries was determined as previously described. This segment can be found in the following transcript(s): HSACMHCP_PEA_1_T6 (SEQ ID NO:4076). Table 4371 below describes the starting and ending position of this segment on each transcript.

TABLE 4371

| Segment location on transcripts | | |
|---|---|---|
| Transcript name | Segment starting position | Segment ending position |
| HSACMHCP_PEA_1_T6 (SEQ ID NO: 4076) | 3732 | 3809 |

This segment can be found in the following protein(s): HSACMHCP_PEA_1_P2.

Segment cluster HSACMHCP_PEA_1_node_77 (SEQ ID NO:4967) according to the present invention is supported by 12 libraries. The number of libraries was determined as previously described. This segment can be found in the following transcript(s): HSACMHCP_PEA_1_T6 (SEQ ID NO:4076). Table 4372 below describes the starting and ending position of this segment on each transcript.

TABLE 4372

| Segment location on transcripts | | |
|---|---|---|
| Transcript name | Segment starting position | Segment ending position |
| HSACMHCP_PEA_1_T6 (SEQ ID NO: 4076) | 3810 | 3911 |

This segment can be found in the following protein(s): HSACMHCP_PEA_1_P2.

Segment cluster HSACMHCP_PEA_1_node_78 (SEQ ID NO:4968) according to the present invention can be found in the following transcript(s): HSACMHCP_PEA_1_T6 (SEQ ID NO:4076). Table 4373 below describes the starting and ending position of this segment on each transcript.

TABLE 4373

| Segment location on transcripts | | |
|---|---|---|
| Transcript name | Segment starting position | Segment ending position |
| HSACMHCP_PEA_1_T6 (SEQ ID NO: 4076) | 3912 | 3936 |

This segment can be found in the following protein(s): HSACMHCP_PEA_1_P2.

Segment cluster HSACMHCP_PEA_1_node_80 (SEQ ID NO:4969) according to the present invention is supported by 14 libraries. The number of libraries was determined as previously described. This segment can be found in the following transcript(s): HSACMHCP_PEA_1_T6 (SEQ ID NO:4076). Table 4374 below describes the starting and ending position of this segment on each transcript.

TABLE 4374

| Segment location on transcripts | | |
|---|---|---|
| Transcript name | Segment starting position | Segment ending position |
| HSACMHCP_PEA_1_T6 (SEQ ID NO: 4076) | 3937 | 4055 |

This segment can be found in the following protein(s): HSACMHCP_PEA_1_P2.

Segment cluster HSACMHCP_PEA_1_node_82 (SEQ ID NO:4970) according to the present invention can be found in the following transcript(s): HSACMHCP_PEA_1_T6 (SEQ ID NO:4076). Table 4375 below describes the starting and ending position of this segment on each transcript.

TABLE 4375

| Transcript name | Segment starting position | Segment ending position |
|---|---|---|
| Segment location on transcripts | | |
| HSACMHCP_PEA_1_T6 (SEQ ID NO: 4076) | 4056 | 4079 |

This segment can be found in the following protein(s): HSACMHCP_PEA_1_P2.

Segment cluster HSACMHCP_PEA_1_node_83 (SEQ ID NO:4971) according to the present invention is supported by 12 libraries. The number of libraries was determined as previously described. This segment can be found in the following transcript(s): HSACMHCP_PEA_1_T6 (SEQ ID NO:4076). Table 4376 below describes the starting and ending position of this segment on each transcript.

TABLE 4376

| Transcript name | Segment starting position | Segment ending position |
|---|---|---|
| Segment location on transcripts | | |
| HSACMHCP_PEA_1_T6 (SEQ ID NO: 4076) | 4080 | 4145 |

This segment can be found in the following protein(s): HSACMHCP_PEA_1_P2.

Segment cluster HSACMHCP_PEA_1_node_84 (SEQ ID NO:4972) according to the present invention is supported by 9 libraries. The number of libraries was determined as previously described. This segment can be found in the following transcript(s): HSACMHCP_PEA_1_T6 (SEQ ID NO:4076). Table 4377 below describes the starting and ending position of this segment on each transcript.

TABLE 4377

| Transcript name | Segment starting position | Segment ending position |
|---|---|---|
| Segment location on transcripts | | |
| HSACMHCP_PEA_1_T6 (SEQ ID NO: 4076) | 4146 | 4217 |

This segment can be found in the following protein(s): HSACMHCP_PEA_1_P2.

Segment cluster HSACMHCP_PEA_1_node_85 (SEQ ID NO:4973) according to the present invention is supported by 10 libraries. The number of libraries was determined as previously described. This segment can be found in the following transcript(s): HSACMHCP_PEA_1_T6 (SEQ ID NO:4076). Table 4378 below describes the starting and ending position of this segment on each transcript.

TABLE 4378

| Transcript name | Segment starting position | Segment ending position |
|---|---|---|
| Segment location on transcripts | | |
| HSACMHCP_PEA_1_T6 (SEQ ID NO: 4076) | 4218 | 4252 |

This segment can be found in the following protein(s): HSACMHCP_PEA_1_P2.

Segment cluster HSACMHCP_PEA_1_node_91 (SEQ ID NO:4974) according to the present invention is supported by 12 libraries. The number of libraries was determined as previously described. This segment can be found in the following transcript(s): HSACMHCP_PEA_1_T6 (SEQ ID NO:4076). Table 4379 below describes the starting and ending position of this segment on each transcript.

TABLE 4379

| Transcript name | Segment starting position | Segment ending position |
|---|---|---|
| Segment location on transcripts | | |
| HSACMHCP_PEA_1_T6 (SEQ ID NO: 4076) | 4603 | 4679 |

This segment can be found in the following protein(s): HSACMHCP_PEA_1_P2.

Segment cluster HSACMHCP_PEA_1_node_92 (SEQ ID NO:4975) according to the present invention can be found in the following transcript(s): HSACMHCP_PEA_1_T6 (SEQ ID NO:4076). Table 4380 below describes the starting and ending position of this segment on each transcript.

TABLE 4380

| Transcript name | Segment starting position | Segment ending position |
|---|---|---|
| Segment location on transcripts | | |
| HSACMHCP_PEA_1_T6 (SEQ ID NO: 4076) | 4680 | 4700 |

This segment can be found in the following protein(s): HSACMHCP_PEA_1_P2.

Segment cluster HSACMHCP_PEA_1_node_93 (SEQ ID NO:4976) according to the present invention is supported by 14 libraries. The number of libraries was determined as previously described. This segment can be found in the following transcript(s): HSACMHCP_PEA_1_T6 (SEQ ID NO:4076). Table 4381 below describes the starting and ending position of this segment on each transcript.

TABLE 4381

| Transcript name | Segment starting position | Segment ending position |
|---|---|---|
| Segment location on transcripts | | |
| HSACMHCP_PEA_1_T6 (SEQ ID NO: 4076) | 4701 | 4727 |

This segment can be found in the following protein(s): HSACMHCP_PEA_1_P2.

Segment cluster HSACMHCP_PEA_1_node_95 (SEQ ID NO:4977) according to the present invention can be found in the following transcript(s): HSACMHCP_PEA_1_T6 (SEQ ID NO:4076). Table 4382 below describes the starting and ending position of this segment on each transcript.

TABLE 4382

Segment location on transcripts

| Transcript name | Segment starting position | Segment ending position |
|---|---|---|
| HSACMHCP_PEA_1_T6 (SEQ ID NO: 4076) | 4728 | 4742 |

This segment can be found in the following protein(s): HSACMHCP_PEA_1_P2.

Segment cluster HSACMHCP_PEA_1_node_98 (SEQ ID NO:4978) according to the present invention is supported by 15 libraries. The number of libraries was determined as previously described. This segment can be found in the following transcript(s): HSACMHCP_PEA_1_T6 (SEQ ID NO:4076). Table 4383 below describes the starting and ending position of this segment on each transcript.

TABLE 4383

Segment location on transcripts

| Transcript name | Segment starting position | Segment ending position |
|---|---|---|
| HSACMHCP_PEA_1_T6 (SEQ ID NO: 4076) | 5007 | 5036 |

This segment can be found in the following protein(s): HSACMHCP_PEA_1_P2.

Segment cluster HSACMHCP_PEA_1_node_103 (SEQ ID NO:4979) according to the present invention is supported by 18 libraries. The number of libraries was determined as previously described. This segment can be found in the following transcript(s): HSACMHCP_PEA_1_T6 (SEQ ID NO:4076). Table 4384 below describes the starting and ending position of this segment on each transcript.

TABLE 4384

Segment location on transcripts

| Transcript name | Segment starting position | Segment ending position |
|---|---|---|
| HSACMHCP_PEA_1_T6 (SEQ ID NO: 4076) | 5241 | 5297 |

This segment can be found in the following protein(s): HSACMHCP_PEA_1_P2.

Segment cluster HSACMHCP_PEA_1_node_104 (SEQ ID NO:4980) according to the present invention is supported by 18 libraries. The number of libraries was determined as previously described. This segment can be found in the following transcript(s): HSACMHCP_PEA_1_T6 (SEQ ID NO:4076). Table 4385 below describes the starting and ending position of this segment on each transcript.

TABLE 4385

Segment location on transcripts

| Transcript name | Segment starting position | Segment ending position |
|---|---|---|
| HSACMHCP_PEA_1_T6 (SEQ ID NO: 4076) | 5298 | 5366 |

This segment can be found in the following protein(s): HSACMHCP_PEA_1_P2.

Segment cluster HSACMHCP_PEA_1_node_109 (SEQ ID NO:4981) according to the present invention is supported by 18 libraries. The number of libraries was determined as previously described. This segment can be found in the following transcript(s): HSACMHCP_PEA_1_T6 (SEQ ID NO:4076). Table 4386 below describes the starting and ending position of this segment on each transcript.

TABLE 4386

Segment location on transcripts

| Transcript name | Segment starting position | Segment ending position |
|---|---|---|
| HSACMHCP_PEA_1_T6 (SEQ ID NO: 4076) | 5867 | 5962 |

This segment can be found in a non-coding region of transcript(s) that are related to the following protein(s): HSACMHCP_PEA_1_P2.

Description for Cluster HSHE4MR

Cluster HSHE4MR features 5 transcript(s) and 10 segment(s) of interest, the names for which are given in Tables 4387 and 4388, respectively, the sequences themselves are given at the end of the application. The selected protein variants are given in Table 4389.

TABLE 4387

Transcripts of interest
Transcript Name

HSHE4MR_PEA_1_T4 (SEQ ID NO: 4077)
HSHE4MR_PEA_1_T6 (SEQ ID NO: 4078)
HSHE4MR_PEA_1_T8 (SEQ ID NO: 4079)
HSHE4MR_PEA_1_T9 (SEQ ID NO: 4080)
HSHE4MR_PEA_1_T13 (SEQ ID NO: 4081)

TABLE 4388

Segments of interest
Segment Name

HSHE4MR_PEA_1_node_0 (SEQ ID NO: 4982)
HSHE4MR_PEA_1_node_3 (SEQ ID NO: 4983)
HSHE4MR_PEA_1_node_5 (SEQ ID NO: 4984)
HSHE4MR_PEA_1_node_6 (SEQ ID NO: 4985)
HSHE4MR_PEA_1_node_7 (SEQ ID NO: 4986)
HSHE4MR_PEA_1_node_10 (SEQ ID NO: 4987)
HSHE4MR_PEA_1_node_11 (SEQ ID NO: 4988)
HSHE4MR_PEA_1_node_12 (SEQ ID NO: 4989)
HSHE4MR_PEA_1_node_13 (SEQ ID NO: 4990)
HSHE4MR_PEA_1_node_16 (SEQ ID NO: 4991)

TABLE 4389

Proteins of interest

| Protein Name | Corresponding Transcript(s) |
| --- | --- |
| HSHE4MR_PEA_1_P3 | HSHE4MR_PEA_1_T6 (SEQ ID NO: 4078); HSHE4MR_PEA_1_T13 (SEQ ID NO: 4081) |
| HSHE4MR_PEA_1_P5 | HSHE4MR_PEA_1_T8 (SEQ ID NO: 4079) |
| HSHE4MR_PEA_1_P8 | HSHE4MR_PEA_1_T4 (SEQ ID NO: 4077) |

These sequences are variants of the known protein WAP four-disulfide core domain protein 2 precursor (SwissProt accession identifier WFD2_HUMAN; known also according to the synonyms Major epididymis-specific protein E4; Epididymal secretory protein E4; Putative protease inhibitor WAP5), referred to herein as the previously known protein.

The sequence for protein WAP four-disulfide core domain protein 2 precursor is given at the end of the application, as "WAP four-disulfide core domain protein 2 precursor amino acid sequence". Known polymorphisms for this sequence are as shown in Table 4390.

TABLE 4390

Amino acid mutations for Known Protein

| SNP position(s) on amino acid sequence | Comment |
| --- | --- |
| 71-72 | SL -> LLC |
| 101 | S -> T |

Protein WAP four-disulfide core domain protein 2 precursor localization is believed to be Secreted (Potential).

The following GO Annotation(s) apply to the previously known protein. The following annotation(s) were found: proteolysis and peptidolysis; spermatogenesis, which are annotation(s) related to Biological Process; proteinase inhibitor, which are annotation(s) related to Molecular Function; and extracellular space, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSHE4MR can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 113 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 113 and Table 4391. This cluster is overexpressed (at least at a minimum level) in the following pathological conditions: ovarian carcinoma and uterine malignancies.

TABLE 4391

Normal tissue distribution

| Name of Tissue | Number |
| --- | --- |
| bladder | 82 |
| brain | 12 |
| colon | 31 |
| epithelial | 61 |
| general | 29 |
| kidney | 103 |
| lung | 162 |
| breast | 8 |
| bone marrow | 0 |
| ovary | 7 |
| prostate | 130 |
| skin | 0 |
| Thyroid | 386 |
| uterus | 27 |

TABLE 4392

P values and ratios for expression in cancerous tissue

| Name of Tissue | P1 | P2 | SP1 | R3 | SP2 | R4 |
| --- | --- | --- | --- | --- | --- | --- |
| bladder | 7.6e−01 | 8.1e−01 | 9.2e−01 | 0.6 | 9.7e−01 | 0.5 |
| brain | 9.3e−01 | 8.7e−01 | 1 | 0.2 | 8.6e−01 | 0.6 |
| colon | 5.6e−01 | 6.4e−01 | 1 | 0.6 | 1 | 0.6 |
| epithelial | 4.9e−01 | 9.1e−01 | 8.1e−03 | 1.2 | 7.2e−01 | 0.7 |
| general | 1.2e−01 | 6.4e−01 | 4.0e−09 | 2.1 | 6.9e−03 | 1.2 |
| kidney | 7.7e−01 | 8.5e−01 | 9.9e−01 | 0.3 | 1 | 0.3 |
| lung | 8.2e−01 | 8.6e−01 | 9.6e−01 | 0.4 | 1 | 0.2 |
| breast | 7.8e−01 | 7.8e−01 | 3.3e−01 | 1.6 | 5.6e−01 | 1.2 |
| bone marrow | 1 | 6.7e−01 | 1 | 1.0 | 5.3e−01 | 1.9 |
| ovary | 6.2e−02 | 5.6e−02 | 4.8e−06 | 6.3 | 5.3e−05 | 5.7 |
| prostate | 8.8e−01 | 9.0e−01 | 9.9e−01 | 0.4 | 1 | 0.3 |
| skin | 1 | 4.4e−01 | 1 | 1.0 | 6.4e−01 | 1.6 |
| Thyroid | 6.0e−01 | 6.0e−01 | 9.9e−01 | 0.4 | 9.9e−01 | 0.4 |
| uterus | 2.4e−01 | 5.3e−01 | 6.7e−04 | 3.5 | 1.9e−02 | 2.3 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4393.

TABLE 4393

Oligonucleotides related to this cluster

| Oligonucleotide name | Overexpressed in cancers | Chip reference |
| --- | --- | --- |
| HSHE4MR_0_0_10628 | ovarian carcinoma | OVA |
| HSHE4MR_0_0_10635 | ovarian carcinoma | OVA |

As noted above, cluster HSHE4MR features 10 segment(s), which were listed in Table 4388 above and for which the sequence(s) are given at the end of the application. These segment(s) are portions of nucleic acid sequence(s) which are described herein separately because they are of particular interest. A description of each segment according to the present invention is now provided.

Segment cluster HSHE4MR_PEA_1_node_0 (SEQ ID NO:4982) according to the present invention is supported by 83 libraries. The number of libraries was determined as previously described. This segment can be found in the following transcript(s): HSHE4MR_PEA_1_T6 (SEQ ID NO:4078)

and HSHE4MR_PEA_1_T13 (SEQ ID NO:4081). Table 4394 below describes the starting and ending position of this segment on each transcript.

TABLE 4394

Segment location on transcripts

| Transcript name | Segment starting position | Segment ending position |
|---|---|---|
| HSHE4MR_PEA_1_T6 (SEQ ID NO: 4078) | 1 | 359 |
| HSHE4MR_PEA_1_T13 (SEQ ID NO: 4081) | 1 | 359 |

This segment can be found in the following protein(s): HSHE4MR_PEA_1_P3.

Segment cluster HSHE4MR_PEA_1_node_3 (SEQ ID NO:4983) according to the present invention is supported by 115 libraries. The number of libraries was determined as previously described. This segment can be found in the following transcript(s): HSHE4MR_PEA_1_T6 (SEQ ID NO:4078) and HSHE4MR_PEA_1_T13 (SEQ ID NO:4081). Table 4395 below describes the starting and ending position of this segment on each transcript.

TABLE 4395

Segment location on transcripts

| Transcript name | Segment starting position | Segment ending position |
|---|---|---|
| HSHE4MR_PEA_1_T6 (SEQ ID NO: 4078) | 360 | 503 |
| HSHE4MR_PEA_1_T13 (SEQ ID NO: 4081) | 360 | 503 |

This segment can be found in the following protein(s): HSHE4MR_PEA_1_P3.

Segment cluster HSHE4MR_PEA_1_node_5 (SEQ ID NO:4984) according to the present invention is supported by 6 libraries. The number of libraries was determined as previously described. This segment can be found in the following transcript(s): HSHE4MR_PEA_1_T8 (SEQ ID NO:4079). Table 4396 below describes the starting and ending position of this segment on each transcript.

TABLE 4396

Segment location on transcripts

| Transcript name | Segment starting position | Segment ending position |
|---|---|---|
| HSHE4MR_PEA_1_T8 (SEQ ID NO: 4079) | 1 | 388 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 4397.

TABLE 4397

Oligonucleotides related to this segment

| Oligonucleotide name | Overexpressed in cancers | Chip reference |
|---|---|---|
| HSHE4MR_0_0_10633 | ovarian carcinoma | OVA |

This segment can be found in the following protein(s): HSHE4MR_PEA_1_P5.

Segment cluster HSHE4MR_PEA_1_node_6 (SEQ ID NO:4985) according to the present invention is supported by 8 libraries. The number of libraries was determined as previously described. This segment can be found in the following transcript(s): HSHE4MR_PEA_1_T6 (SEQ ID NO:4078), HSHE4MR_PEA_1_T8 (SEQ ID NO:4079) and HSHE4MR_PEA_1_T13 (SEQ ID NO:4081). Table 4398 below describes the starting and ending position of this segment on each transcript.

TABLE 4398

Segment location on transcripts

| Transcript name | Segment starting position | Segment ending position |
|---|---|---|
| HSHE4MR_PEA_1_T6 (SEQ ID NO: 4078) | 504 | 632 |
| HSHE4MR_PEA_1_T8 (SEQ ID NO: 4079) | 389 | 517 |
| HSHE4MR_PEA_1_T13 (SEQ ID NO: 4081) | 504 | 632 |

This segment can be found in the following protein(s): HSHE4MR_PEA_1_P3 and HSHE4MR_PEA_1_P5.

Segment cluster HSHE4MR_PEA_1_node_7 (SEQ ID NO:4986) according to the present invention is supported by 6 libraries. The number of libraries was determined as previously described. This segment can be found in the following transcript(s): HSHE4MR_PEA_1_T6 (SEQ ID NO:4078), HSHE4MR_PEA_1_T8 (SEQ ID NO:4079) and HSHE4MR_PEA_1_T13 (SEQ ID NO:4081). Table 4399 below describes the starting and ending position of this segment on each transcript.

TABLE 4399

Segment location on transcripts

| Transcript name | Segment starting position | Segment ending position |
|---|---|---|
| HSHE4MR_PEA_1_T6 (SEQ ID NO: 4078) | 633 | 768 |
| HSHE4MR_PEA_1_T8 (SEQ ID NO: 4079) | 518 | 653 |
| HSHE4MR_PEA_1_T13 (SEQ ID NO: 4081) | 633 | 768 |

This segment can be found in a non-coding region of transcript(s) that are related to the following protein(s): HSHE4MR_PEA_1_P3 and HSHE4MR_PEA_1_P5.

Segment cluster HSHE4MR_PEA_1_node_10 (SEQ ID NO:4987) according to the present invention is supported by 13 libraries. The number of libraries was determined as previously described. This segment can be found in the following transcript(s): HSHE4MR_PEA_1_T4 (SEQ ID NO:4077)

and HSHE4MR_PEA_1_T9 (SEQ ID NO:4080). Table 4400 below describes the starting and ending position of this segment on each transcript.

TABLE 4400

Segment location on transcripts

| Transcript name | Segment starting position | Segment ending position |
|---|---|---|
| HSHE4MR_PEA_1_T4 (SEQ ID NO: 4077) | 1 | 928 |
| HSHE4MR_PEA_1_T9 (SEQ ID NO: 4080) | 1 | 928 |

This segment can be found in a non-coding region of transcript(s) that are related to the following protein(s): HSHE4MR_PEA_1_P8.

Segment cluster HSHE4MR_PEA_1_node_1 (SEQ ID NO:4988) according to the present invention is supported by 8 libraries. The number of libraries was determined as previously described. This segment can be found in the following transcript(s): HSHE4MR_PEA_1_T4 (SEQ ID NO:4077) and HSHE4MR_PEA_1_T9 (SEQ ID NO:4080). Table 4401 below describes the starting and ending position of this segment on each transcript.

TABLE 4401

Segment location on transcripts

| Transcript name | Segment starting position | Segment ending position |
|---|---|---|
| HSHE4MR_PEA_1_T4 (SEQ ID NO: 4077) | 929 | 1056 |
| HSHE4MR_PEA_1_T9 (SEQ ID NO: 4080) | 929 | 1056 |

This segment can be found in a non-coding region of transcript(s) that are related to the following protein(s): HSHE4MR_PEA_1_P8.

Segment cluster HSHE4MR_PEA_1_node_12 (SEQ ID NO:4989) according to the present invention is supported by 14 libraries. The number of libraries was determined as previously described. This segment can be found in the following transcript(s): HSHE4MR_PEA_1_T4 (SEQ ID NO:4077). Table 4402 below describes the starting and ending position of this segment on each transcript.

TABLE 4402

Segment location on transcripts

| Transcript name | Segment starting position | Segment ending position |
|---|---|---|
| HSHE4MR_PEA_1_T4 (SEQ ID NO: 4077) | 1057 | 1228 |

This segment can be found in the following protein(s): HSHE4MR_PEA_1_P8.

Segment cluster HSHE4MR_PEA_1_node_13 (SEQ ID NO:4990) according to the present invention is supported by 145 libraries. The number of libraries was determined as previously described. This segment can be found in the following transcript(s): HSHE4MR_PEA_1_T4 (SEQ ID NO:4077), HSHE4MR_PEA_1_T6 (SEQ ID NO:4078), HSHE4MR_PEA_1_T8 (SEQ ID NO:4079), HSHE4MR_PEA_1_T9 (SEQ ID NO:4080) and HSHE4MR_PEA_1_T13 (SEQ ID NO:4081). Table 4403 below describes the starting and ending position of this segment on each transcript.

TABLE 4403

Segment location on transcripts

| Transcript name | Segment starting position | Segment ending position |
|---|---|---|
| HSHE4MR_PEA_1_T4 (SEQ ID NO: 4077) | 1229 | 1381 |
| HSHE4MR_PEA_1_T6 (SEQ ID NO: 4078) | 769 | 921 |
| HSHE4MR_PEA_1_T8 (SEQ ID NO: 4079) | 654 | 806 |
| HSHE4MR_PEA_1_T9 (SEQ ID NO: 4080) | 1057 | 1209 |
| HSHE4MR_PEA_1_T13 (SEQ ID NO: 4081) | 769 | 921 |

This segment can be found in both coding and non-coding regions of transcript(s) as follows. The segment can be found in a non-coding region of transcript(s) that are related to the following protein(s): HSHE4MR_PEA_1_P3 and HSHE4MR_PEA_1_P5. This segment can also be found in the following protein(s): HSHE4MR_PEA_1_P8, since it is in the coding region for the corresponding transcript.

Segment cluster HSHE4MR_PEA_1_node_16 (SEQ ID NO:4991) according to the present invention is supported by 116 libraries. The number of libraries was determined as previously described. This segment can be found in the following transcript(s): HSHE4MR_PEA_1_T4 (SEQ ID NO:4077), HSHE4MR_PEA_1_T6 (SEQ ID NO:4078), HSHE4MR_PEA_1_T8 (SEQ ID NO:4079), HSHE4MR_PEA_1_T9 (SEQ ID NO:4080) and HSHE4MR_PEA_1_T13 (SEQ ID NO:4081). Table 4404 below describes the starting and ending position of this segment on each transcript.

TABLE 4404

Segment location on transcripts

| Transcript name | Segment starting position | Segment ending position |
|---|---|---|
| HSHE4MR_PEA_1_T4 (SEQ ID NO: 4077) | 1382 | 1543 |
| HSHE4MR_PEA_1_T6 (SEQ ID NO: 4078) | 922 | 1083 |
| HSHE4MR_PEA_1_T8 (SEQ ID NO: 4079) | 807 | 968 |
| HSHE4MR_PEA_1_T9 (SEQ ID NO: 4080) | 1210 | 1371 |
| HSHE4MR_PEA_1_T13 (SEQ ID NO: 4081) | 922 | 1785 |

This segment can be found in a non-coding region of transcript(s) that are related to the following protein(s): HSHE4MR_PEA_1_P8, HSHE4MR_PEA_1_P3 and HSHE4MR_PEA_1_P5.

Description for Cluster HSMRP1

Cluster HSMRP1 features 1 transcript(s) and 20 segment(s) of interest, the names for which are given in Tables 4405 and 4406, respectively, the sequences themselves are given at the end of the application. The selected protein variants are given in Table 4407.

TABLE 4405

Transcripts of interest
Transcript Name

HSMRP1_T5 (SEQ ID NO: 4082)

TABLE 4406

Segments of interest
Segment Name

HSMRP1_node_40 (SEQ ID NO: 4992)
HSMRP1_node_41 (SEQ ID NO: 4993)
HSMRP1_node_42 (SEQ ID NO: 4994)
HSMRP1_node_48 (SEQ ID NO: 4995)
HSMRP1_node_5 (SEQ ID NO: 4996)
HSMRP1_node_6 (SEQ ID NO: 4997)
HSMRP1_node_7 (SEQ ID NO: 4998)
HSMRP1_node_8 (SEQ ID NO: 4999)
HSMRP1_node_18 (SEQ ID NO: 5000)
HSMRP1_node_24 (SEQ ID NO: 5001)
HSMRP1_node_28 (SEQ ID NO: 5002)
HSMRP1_node_31 (SEQ ID NO: 5003)
HSMRP1_node_33 (SEQ ID NO: 5004)
HSMRP1_node_34 (SEQ ID NO: 5005)
HSMRP1_node_38 (SEQ ID NO: 5006)
HSMRP1_node_39 (SEQ ID NO: 5007)
HSMRP1_node_43 (SEQ ID NO: 5008)
HSMRP1_node_44 (SEQ ID NO: 5009)
HSMRP1_node_46 (SEQ ID NO: 5010)
HSMRP1_node_47 (SEQ ID NO: 5011)

TABLE 4407

Proteins of interest

| Protein Name | Corresponding Transcript(s) |
|---|---|
| HSMRP1_P3 | HSMRP1_T5 (SEQ ID NO: 4082) |

These sequences are variants of the known protein CD9 antigen (SwissProt accession identifier CD9_HUMAN; known also according to the synonyms P24; Leukocyte antigen MIC3; Motility-related protein; MRP-1), referred to herein as the previously known protein.

Protein CD9 antigen is known or believed to have the following function(s): Involved in platelet activation and aggregation. Regulates paranodal junction formation. Required for gamete fusion. Involved in cell adhesion, cell motility and tumor metastasis. The sequence for protein CD9 antigen is given at the end of the application, as "CD9 antigen amino acid sequence". Known polymorphisms for this sequence are as shown in Table 4408.

TABLE 4408

Amino acid mutations for Known Protein

| SNP position(s) on amino acid sequence | Comment |
|---|---|
| 8 | C->A: Loss of palmitoylation; when associated with A-77, A-78, A-86, A-217 and A-218. |
| 77 | C->A: Loss of palmitoylation; when associated with A-8, A-78, A-86, A-217 and A-218. |
| 78 | C->A: Loss of palmitoylation; when associated with A-8, A-77, A-86, A-217 and A-218. |
| 86 | C->A: Loss of palmitoylation; when associated with A-8, A-77, A-78, A-217 and A-218. |

TABLE 4408-continued

Amino acid mutations for Known Protein

| SNP position(s) on amino acid sequence | Comment |
|---|---|
| 217 | C->A: Loss of palmitoylation; when associated with A-8, A-77, A-78, A-86 and A-218. |
| 218 | C->A: Loss of palmitoylation; when associated with A-8, A-77, A-78, A-86 and A-217. |
| 8 | C -> S |
| 66 | G -> A |
| 193 | Missing |
| 214 | M -> T |

Protein CD9 antigen localization is believed to be Integral membrane protein.

The following GO Annotation(s) apply to the previously known protein. The following annotation(s) were found: cell motility; cell adhesion; binding/fusion of sperm to egg plasma membrane; platelet activation, which are annotation(s) related to Biological Process; protein binding, which are annotation(s) related to Molecular Function; and integral plasma membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSMRP1 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 114 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 114 and Table 4409. This cluster is overexpressed (at least at a minimum level) in the following pathological conditions: ovarian carcinoma.

TABLE 4409

Normal tissue distribution

| Name of Tissue | Number |
|---|---|
| bladder | 410 |
| bone | 129 |
| brain | 89 |
| colon | 441 |
| epithelial | 360 |
| general | 269 |
| head and neck | 496 |
| kidney | 390 |
| liver | 9 |
| lung | 548 |
| lymph nodes | 41 |
| breast | 96 |
| bone marrow | 31 |
| ovary | 0 |
| pancreas | 126 |
| prostate | 635 |
| skin | 361 |
| stomach | 553 |

TABLE 4409-continued

Normal tissue distribution

| Name of Tissue | Number |
|---|---|
| Thyroid | 257 |
| uterus | 395 |

TABLE 4410

P values and ratios for expression in cancerous tissue

| Name of Tissue | P1 | P2 | SP1 | R3 | SP2 | R4 |
|---|---|---|---|---|---|---|
| bladder | 6.3e−01 | 6.2e−01 | 4.4e−01 | 0.9 | 6.0e−01 | 0.9 |
| bone | 6.5e−02 | 1.4e−01 | 6.0e−02 | 2.1 | 2.9e−01 | 1.3 |
| brain | 3.1e−01 | 3.1e−01 | 5.1e−02 | 1.6 | 2.9e−01 | 1.1 |
| colon | 7.5e−02 | 6.7e−02 | 7.7e−01 | 0.8 | 9.3e−01 | 0.6 |
| epithelial | 3.9e−01 | 8.1e−01 | 8.5e−01 | 0.9 | 1 | 0.6 |
| general | 3.8e−02 | 4.8e−01 | 1.8e−01 | 1.0 | 1 | 0.7 |
| head and neck | 4.5e−01 | 6.2e−01 | 1 | 0.3 | 1 | 0.2 |
| kidney | 7.3e−01 | 8.2e−01 | 9.5e−01 | 0.5 | 1 | 0.3 |
| liver | 8.3e−01 | 3.0e−01 | 1 | 0.8 | 3.3e−01 | 2.1 |
| lung | 7.0e−01 | 7.6e−01 | 9.4e−01 | 0.6 | 1 | 0.4 |
| lymph nodes | 6.9e−01 | 8.6e−01 | 6.3e−01 | 1.1 | 9.2e−01 | 0.5 |
| breast | 9.5e−02 | 1.5e−01 | 2.8e−02 | 2.3 | 2.0e−01 | 1.4 |
| bone marrow | 8.6e−01 | 7.2e−01 | 1 | 0.5 | 2.3e−01 | 1.8 |
| ovary | 6.4e−04 | 7.2e−04 | 1.5e−04 | 9.6 | 2.0e−04 | 8.8 |
| pancreas | 4.6e−01 | 5.9e−01 | 3.7e−01 | 1.0 | 6.8e−01 | 0.8 |
| prostate | 7.0e−01 | 7.6e−01 | 7.5e−01 | 0.7 | 9.9e−01 | 0.5 |
| skin | 4.4e−01 | 6.1e−01 | 6.3e−01 | 0.5 | 1 | 0.1 |
| stomach | 4.7e−01 | 7.4e−01 | 1 | 0.2 | 7.7e−01 | 0.7 |
| Thyroid | 5.4e−01 | 5.4e−01 | 5.7e−01 | 1.1 | 5.7e−01 | 1.1 |
| uterus | 4.5e−01 | 6.1e−01 | 7.7e−01 | 0.6 | 9.9e−01 | 0.4 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4411.

TABLE 4411

Oligonucleotides related to this cluster

| Oligonucleotide name | Overexpressed in cancers | Chip reference |
|---|---|---|
| HSMRP1_0_0_11326 | ovarian carcinoma | OVA |

As noted above, cluster HSMRP1 features 20 segment(s), which were listed in Table 4406 above and for which the sequence(s) are given at the end of the application. These segment(s) are portions of nucleic acid sequence(s) which are described herein separately because they are of particular interest. A description of each segment according to the present invention is now provided.

Segment cluster HSMRP1_node__40 (SEQ ID NO:4992) according to the present invention is supported by 6 libraries. The number of libraries was determined as previously described. This segment can be found in the following transcript(s): HSMRP1_T5 (SEQ ID NO:4082). Table 4412 below describes the starting and ending position of this segment on each transcript.

TABLE 4412

Segment location on transcripts

| Transcript name | Segment starting position | Segment ending position |
|---|---|---|
| HSMRP1_T5 (SEQ ID NO: 4082) | 817 | 1380 |

This segment can be found in the following protein(s): HSMRP1_P3.

Segment cluster HSMRP1_node__41 (SEQ ID NO:4993) according to the present invention is supported by 2 libraries. The number of libraries was determined as previously described. This segment can be found in the following transcript(s): HSMRP1_T5 (SEQ ID NO:4082). Table 4413 below describes the starting and ending position of this segment on each transcript.

TABLE 4413

Segment location on transcripts

| Transcript name | Segment starting position | Segment ending position |
|---|---|---|
| HSMRP1_T5 (SEQ ID NO: 4082) | 1381 | 1799 |

This segment can be found in a non-coding region of transcript(s) that are related to the following protein(s): HSMRP1_P3.

Segment cluster HSMRP1_node__42 (SEQ ID NO:4994) according to the present invention is supported by 12 libraries. The number of libraries was determined as previously described. This segment can be found in the following transcript(s): HSMRP1_T5 (SEQ ID NO:4082). Table 4414 below describes the starting and ending position of this segment on each transcript.

TABLE 4414

Segment location on transcripts

| Transcript name | Segment starting position | Segment ending position |
|---|---|---|
| HSMRP1_T5 (SEQ ID NO: 4082) | 1800 | 2292 |

This segment can be found in a non-coding region of transcript(s) that are related to the following protein(s): HSMRP1_P3.

Segment cluster HSMRP1_node__48 (SEQ ID NO:4995) according to the present invention is supported by 350 libraries. The number of libraries was determined as previously described. This segment can be found in the following transcript(s): HSMRP1_T5 (SEQ ID NO:4082). Table 4415 below describes the starting and ending position of this segment on each transcript.

TABLE 4415

Segment location on transcripts

| Transcript name | Segment starting position | Segment ending position |
|---|---|---|
| HSMRP1_T5 (SEQ ID NO: 4082) | 2435 | 2800 |

This segment can be found in a non-coding region of transcript(s) that are related to the following protein(s): HSMRP1_P3.

According to an optional embodiment of the present invention, short segments related to the above cluster are also provided. These segments are up to about 120 bp in length, and so are included in a separate description.

Segment cluster HSMRP1_node_5 (SEQ ID NO:4996) according to the present invention is supported by 71 libraries. The number of libraries was determined as previously described. This segment can be found in the following transcript(s): HSMRP1_T5 (SEQ ID NO:4082). Table 4416 below describes the starting and ending position of this segment on each transcript.

TABLE 4416

Segment location on transcripts

| Transcript name | Segment starting position | Segment ending position |
|---|---|---|
| HSMRP1_T5 (SEQ ID NO: 4082) | 1 | 68 |

This segment can be found in a non-coding region of transcript(s) that are related to the following protein(s): HSMRP1_P3.

Segment cluster HSMRP1_node_6 (SEQ ID NO:4997) according to the present invention is supported by 319 libraries. The number of libraries was determined as previously described. This segment can be found in the following transcript(s): HSMRP1_T5 (SEQ ID NO:4082). Table 4417 below describes the starting and ending position of this segment on each transcript.

TABLE 4417

Segment location on transcripts

| Transcript name | Segment starting position | Segment ending position |
|---|---|---|
| HSMRP1_T5 (SEQ ID NO: 4082) | 69 | 106 |

This segment can be found in a non-coding region of transcript(s) that are related to the following protein(s): HSMRP1_P3.

Segment cluster HSMRP1_node_7 (SEQ ID NO:4998) according to the present invention is supported by 422 libraries. The number of libraries was determined as previously described. This segment can be found in the following transcript(s): HSMRP1_T5 (SEQ ID NO:4082). Table 4418 below describes the starting and ending position of this segment on each transcript.

TABLE 4418

Segment location on transcripts

| Transcript name | Segment starting position | Segment ending position |
|---|---|---|
| HSMRP1_T5 (SEQ ID NO: 4082) | 107 | 220 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 4419.

TABLE 4419

Oligonucleotides related to this segment

| Oligonucleotide name | Overexpressed in cancers | Chip reference |
|---|---|---|
| HSMRP1_0_1_0 | ovarian carcinoma | OVA |

This segment can be found in the following protein(s): HSMRP1_P3.

Segment cluster HSMRP1_node_8 (SEQ ID NO:4999) according to the present invention is supported by 420 libraries. The number of libraries was determined as previously described. This segment can be found in the following transcript(s): HSMRP1_T5 (SEQ ID NO:4082). Table 4420 below describes the starting and ending position of this segment on each transcript.

TABLE 4420

Segment location on transcripts

| Transcript name | Segment starting position | Segment ending position |
|---|---|---|
| HSMRP1_T5 (SEQ ID NO: 4082) | 221 | 250 |

This segment can be found in the following protein(s): HSMRP1_P3.

Segment cluster HSMRP1_node_18 (SEQ ID NO:5000) according to the present invention is supported by 466 libraries. The number of libraries was determined as previously described. This segment can be found in the following transcript(s): HSMRP1_T5 (SEQ ID NO:4082). Table 4421 below describes the starting and ending position of this segment on each transcript.

TABLE 4421

Segment location on transcripts

| Transcript name | Segment starting position | Segment ending position |
|---|---|---|
| HSMRP1_T5 (SEQ ID NO: 4082) | 251 | 359 |

This segment can be found in the following protein(s): HSMRP1_P3.

Segment cluster HSMRP1_node_24 (SEQ ID NO:5001) according to the present invention is supported by 376 libraries. The number of libraries was determined as previously described. This segment can be found in the following transcript(s): HSMRP1_T5 (SEQ ID NO:4082). Table 4422 below describes the starting and ending position of this segment on each transcript.

TABLE 4422

Segment location on transcripts

| Transcript name | Segment starting position | Segment ending position |
|---|---|---|
| HSMRP1_T5 (SEQ ID NO: 4082) | 360 | 457 |

This segment can be found in the following protein(s): HSMRP1_P3.

Segment cluster HSMRP1_node_28 (SEQ ID NO:5002) according to the present invention is supported by 360 libraries. The number of libraries was determined as previously described. This segment can be found in the following transcript(s): HSMRP1_T5 (SEQ ID NO:4082). Table 4423 below describes the starting and ending position of this segment on each transcript.

TABLE 4423

Segment location on transcripts

| Transcript name | Segment starting position | Segment ending position |
|---|---|---|
| HSMRP1_T5 (SEQ ID NO: 4082) | 458 | 532 |

This segment can be found in the following protein(s): HSMRP1_P3.

Segment cluster HSMRP1_node_31 (SEQ ID NO:5003) according to the present invention is supported by 398 libraries. The number of libraries was determined as previously described. This segment can be found in the following transcript(s): HSMRP1_T5 (SEQ ID NO:4082). Table 4424 below describes the starting and ending position of this segment on each transcript.

TABLE 4424

Segment location on transcripts

| Transcript name | Segment starting position | Segment ending position |
|---|---|---|
| HSMRP1_T5 (SEQ ID NO: 4082) | 533 | 631 |

This segment can be found in the following protein(s): HSMRP1_P3.

Segment cluster HSMRP1_node_33 (SEQ ID NO:5004) according to the present invention can be found in the following transcript(s): HSMRP1_T5 (SEQ ID NO:4082). Table 4425 below describes the starting and ending position of this segment on each transcript.

TABLE 4425

Segment location on transcripts

| Transcript name | Segment starting position | Segment ending position |
|---|---|---|
| HSMRP1_T5 (SEQ ID NO: 4082) | 632 | 636 |

This segment can be found in the following protein(s): HSMRP1_P3.

Segment cluster HSMRP1_node_34 (SEQ ID NO:5005) according to the present invention is supported by 392 libraries. The number of libraries was determined as previously described. This segment can be found in the following transcript(s): HSMRP1_T5 (SEQ ID NO:4082). Table 4426 below describes the starting and ending position of this segment on each transcript.

TABLE 4426

Segment location on transcripts

| Transcript name | Segment starting position | Segment ending position |
|---|---|---|
| HSMRP1_T5 (SEQ ID NO: 4082) | 637 | 721 |

This segment can be found in the following protein(s): HSMRP1_P3.

Segment cluster HSMRP1_node_38 (SEQ ID NO:5006) according to the present invention is supported by 392 libraries. The number of libraries was determined as previously described. This segment can be found in the following transcript(s): HSMRP1_T5 (SEQ ID NO:4082). Table 4427 below describes the starting and ending position of this segment on each transcript.

TABLE 4427

Segment location on transcripts

| Transcript name | Segment starting position | Segment ending position |
|---|---|---|
| HSMRP1_T5 (SEQ ID NO: 4082) | 722 | 805 |

This segment can be found in the following protein(s): HSMRP1_P3.

Segment cluster HSMRP1_node_39 (SEQ ID NO:5007) according to the present invention can be found in the following transcript(s): HSMRP1_T5 (SEQ ID NO:4082). Table 4428 below describes the starting and ending position of this segment on each transcript.

TABLE 4428

Segment location on transcripts

| Transcript name | Segment starting position | Segment ending position |
|---|---|---|
| HSMRP1_T5 (SEQ ID NO: 4082) | 806 | 816 |

This segment can be found in the following protein(s): HSMRP1_P3.

Segment cluster HSMRP1_node_43 (SEQ ID NO:5008) according to the present invention is supported by 361 libraries. The number of libraries was determined as previously described. This segment can be found in the following transcript(s): HSMRP1_T5 (SEQ ID NO:4082). Table 4429 below describes the starting and ending position of this segment on each transcript.

TABLE 4429

Segment location on transcripts

| Transcript name | Segment starting position | Segment ending position |
|---|---|---|
| HSMRP1_T5 (SEQ ID NO: 4082) | 2293 | 2339 |

This segment can be found in a non-coding region of transcript(s) that are related to the following protein(s): HSMRP1_P3.

Segment cluster HSMRP1_node_44 (SEQ ID NO:5009) according to the present invention is supported by 353 libraries. The number of libraries was determined as previously described. This segment can be found in the following transcript(s): HSMRP1_T5 (SEQ ID NO:4082). Table 4430 below describes the starting and ending position of this segment on each transcript.

TABLE 4430

Segment location on transcripts

| Transcript name | Segment starting position | Segment ending position |
|---|---|---|
| HSMRP1_T5 (SEQ ID NO: 4082) | 2340 | 2375 |

This segment can be found in a non-coding region of transcript(s) that are related to the following protein(s): HSMRP1_P3.

Segment cluster HSMRP1_node_46 (SEQ ID NO:5010) according to the present invention is supported by 341 libraries. The number of libraries was determined as previously described. This segment can be found in the following transcript(s): HSMRP1_T5 (SEQ ID NO:4082). Table 4431 below describes the starting and ending position of this segment on each transcript.

TABLE 4431

Segment location on transcripts

| Transcript name | Segment starting position | Segment ending position |
|---|---|---|
| HSMRP1_T5 (SEQ ID NO: 4082) | 2376 | 2419 |

This segment can be found in a non-coding region of transcript(s) that are related to the following protein(s): HSMRP1_P3.

Segment cluster HSMRP1_node_47 (SEQ ID NO:5011) according to the present invention can be found in the following transcript(s): HSMRP1_T5 (SEQ ID NO:4082). Table 4432 below describes the starting and ending position of this segment on each transcript.

TABLE 4432

Segment location on transcripts

| Transcript name | Segment starting position | Segment ending position |
|---|---|---|
| HSMRP1_T5 (SEQ ID NO: 4082) | 2420 | 2434 |

This segment can be found in a non-coding region of transcript(s) that are related to the following protein(s): HSMRP1_P3.

Description for Cluster HSPPI

Cluster HSPPI features 1 transcript(s) and 11 segment(s) of interest, the names for which are given in Tables 4433 and 4434, respectively, the sequences themselves are given at the end of the application. The selected protein variants are given in Table 4435.

TABLE 4433

Transcripts of interest
Transcript Name

HSPPI_PEA_1_T3 (SEQ ID NO: 4083)

TABLE 4434

Segments of interest
Segment Name

HSPPI_PEA_1_node_2 (SEQ ID NO: 5012)
HSPPI_PEA_1_node_13 (SEQ ID NO: 5013)
HSPPI_PEA_1_node_0 (SEQ ID NO: 5014)
HSPPI_PEA_1_node_1 (SEQ ID NO: 5015)
HSPPI_PEA_1_node_3 (SEQ ID NO: 5016)
HSPPI_PEA_1_node_4 (SEQ ID NO: 5017)
HSPPI_PEA_1_node_5 (SEQ ID NO: 5018)
HSPPI_PEA_1_node_6 (SEQ ID NO: 5019)
HSPPI_PEA_1_node_10 (SEQ ID NO: 5020)
HSPPI_PEA_1_node_11 (SEQ ID NO: 5021)
HSPPI_PEA_1_node_12 (SEQ ID NO: 5022)

TABLE 4435

Proteins of interest

| Protein Name | Corresponding Transcript(s) |
|---|---|
| HSPPI_PEA_1_P8 | HSPPI_PEA_1_T3 (SEQ ID NO: 4083) |

These sequences are variants of the known protein Insulin precursor (SwissProt accession identifier INS_HUMAN), referred to herein as the previously known protein.

Protein Insulin precursor is known or believed to have the following function(s): Insulin decreases blood glucose concentration. It increases cell permeability to monosaccharides, amino acids and fatty acids. It accelerates glycolysis, the pentose phosphate cycle, and glycogen synthesis in liver. The sequence for protein Insulin precursor is given at the end of the application, as "Insulin precursor amino acid sequence". Known polymorphisms for this sequence are as shown in Table 4436.

TABLE 4436

Amino acid mutations for Known Protein

| SNP position(s) on amino acid sequence | Comment |
|---|---|
| 34 | H -> D (in familial hyperproinsulinemia; Providence). /FTId = VAR_003971. |
| 48 | F -> S (associated with diabetes mellitus type-II; Los-Angeles). /FTId = VAR_003972. |
| 49 | F -> L (in Chicago). /FTId = VAR_003973. |
| 89 | R -> H (in familial hyperproinsulinemia; impairs posttranslational cleavage). /FTId = VAR_003974. |
| 89 | R -> L (in familial hyperproinsulinemia; Kyoto). /FTId = VAR_003975. |
| 92 | V -> L (in Wakayama). /FTId = VAR_003976. |

Protein Insulin precursor localization is believed to be Secreted.

The previously known protein also has the following indication(s) and/or potential therapeutic use(s): Diabetes, Type I; Diabetes, Type II; Cardiomyopathy, diabetic; Diabetes; Wound healing. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Insulin agonist; Interleukin 10 agonist; Interleukin 4 agonist; Immunomodulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antidiabetic; Insulin; Symptomatic antidiabetic; Cardiovascular; Growth hormone; Vulnerary.

The following GO Annotation(s) apply to the previously known protein. The following annotation(s) were found: glucose metabolism; energy pathways; lipid metabolism; cell surface receptor linked signal transduction; cell-cell signaling; physiological processes, which are annotation(s) related to Biological Process; insulin receptor ligand; hormone, which are annotation(s) related to Molecular Function; and extracellular, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HSPPI features 11 segment(s), which were listed in Table 4434 above and for which the sequence(s) are given at the end of the application. These segment(s) are portions of nucleic acid sequence(s) which are described herein separately because they are of particular interest. A description of each segment according to the present invention is now provided.

Segment cluster HSPPI_PEA_1_node_2 (SEQ ID NO:5012) according to the present invention is supported by 8 libraries. The number of libraries was determined as previously described. This segment can be found in the following transcript(s): HSPPI_PEA_1_T3 (SEQ ID NO:4083). Table 4437 below describes the starting and ending position of this segment on each transcript.

TABLE 4437

| Segment location on transcripts | | |
|---|---|---|
| Transcript name | Segment starting position | Segment ending position |
| HSPPI_PEA_1_T3 (SEQ ID NO: 4083) | 141 | 293 |

This segment can be found in a non-coding region of transcript(s) that are related to the following protein(s): HSPPI_PEA_1_P8.

Segment cluster HSPPI_PEA_1_node_13 (SEQ ID NO:5013) according to the present invention is supported by 24 libraries. The number of libraries was determined as previously described. This segment can be found in the following transcript(s): HSPPI_PEA_1_T3 (SEQ ID NO:4083). Table 4438 below describes the starting and ending position of this segment on each transcript.

TABLE 4438

| Segment location on transcripts | | |
|---|---|---|
| Transcript name | Segment starting position | Segment ending position |
| HSPPI_PEA_1_T3 (SEQ ID NO: 4083) | 623 | 1147 |

This segment can be found in the following protein(s): HSPPI_PEA_1_P8.

According to an optional embodiment of the present invention, short segments related to the above cluster are also provided. These segments are up to about 120 bp in length, and so are included in a separate description.

Segment cluster HSPPI_PEA_1_node_0 (SEQ ID NO:5014) according to the present invention is supported by 18 libraries. The number of libraries was determined as previously described. This segment can be found in the following transcript(s): HSPPI_PEA_1_T3 (SEQ ID NO:4083). Table 4439 below describes the starting and ending position of this segment on each transcript.

TABLE 4439

| Segment location on transcripts | | |
|---|---|---|
| Transcript name | Segment starting position | Segment ending position |
| HSPPI_PEA_1_T3 (SEQ ID NO: 4083) | 1 | 110 |

This segment can be found in a non-coding region of transcript(s) that are related to the following protein(s): HSPPI_PEA_1_P8.

Segment cluster HSPPI_PEA_1_node_1 (SEQ ID NO:5015) according to the present invention is supported by 7 libraries. The number of libraries was determined as previously described. This segment can be found in the following transcript(s): HSPPI_PEA_1_T3 (SEQ ID NO:4083). Table 4440 below describes the starting and ending position of this segment on each transcript.

TABLE 4440

| Segment location on transcripts | | |
|---|---|---|
| Transcript name | Segment starting position | Segment ending position |
| HSPPI_PEA_1_T3 (SEQ ID NO: 4083) | 111 | 140 |

This segment can be found in a non-coding region of transcript(s) that are related to the following protein(s): HSPPI_PEA_1_P8.

Segment cluster HSPPI_PEA_1_node_3 (SEQ ID NO:5016) according to the present invention is supported by 25 libraries. The number of libraries was determined as previously described. This segment can be found in the following transcript(s): HSPPI_PEA_1_T3 (SEQ ID NO:4083). Table 4441 below describes the starting and ending position of this segment on each transcript.

TABLE 4441

| Segment location on transcripts | | |
|---|---|---|
| Transcript name | Segment starting position | Segment ending position |
| HSPPI_PEA_1_T3 (SEQ ID NO: 4083) | 294 | 399 |

This segment can be found in the following protein(s): HSPPI_PEA_1_P8.

Segment cluster HSPPI_PEA_1_node_4 (SEQ ID NO:5017) according to the present invention can be found in the following transcript(s): HSPPI_PEA_1_T3 (SEQ ID NO:4083). Table 4442 below describes the starting and ending position of this segment on each transcript.

TABLE 4442

Segment location on transcripts

| Transcript name | Segment starting position | Segment ending position |
|---|---|---|
| HSPPI_PEA_1_T3 (SEQ ID NO: 4083) | 400 | 410 |

This segment can be found in the following protein(s): HSPPI_PEA_1_P8.

Segment cluster HSPPI_PEA_1_node_5 (SEQ ID NO:5018) according to the present invention is supported by 24 libraries. The number of libraries was determined as previously described. This segment can be found in the following transcript(s): HSPPI_PEA_1_T3 (SEQ ID NO:4083). Table 4443 below describes the starting and ending position of this segment on each transcript.

TABLE 4443

Segment location on transcripts

| Transcript name | Segment starting position | Segment ending position |
|---|---|---|
| HSPPI_PEA_1_T3 (SEQ ID NO: 4083) | 411 | 474 |

This segment can be found in the following protein(s): HSPPI_PEA_1_P8.

Segment cluster HSPPI_PEA_1_node_6 (SEQ ID NO:5019) according to the present invention can be found in the following transcript(s): HSPPI_PEA_1_T3 (SEQ ID NO:4083). Table 4444 below describes the starting and ending position of this segment on each transcript.

TABLE 4444

Segment location on transcripts

| Transcript name | Segment starting position | Segment ending position |
|---|---|---|
| HSPPI_PEA_1_T3 (SEQ ID NO: 4083) | 475 | 497 |

This segment can be found in the following protein(s): HSPPI_PEA_1_P8.

Segment cluster HSPPI_PEA_1_node_10 (SEQ ID NO:5020) according to the present invention can be found in the following transcript(s): HSPPI_PEA_1_T3 (SEQ ID NO:4083). Table 4445 below describes the starting and ending position of this segment on each transcript.

TABLE 4445

Segment location on transcripts

| Transcript name | Segment starting position | Segment ending position |
|---|---|---|
| HSPPI_PEA_1_T3 (SEQ ID NO: 4083) | 498 | 505 |

This segment can be found in the following protein(s): HSPPI_PEA_1_P8.

Segment cluster HSPPI_PEA_1_node_11 (SEQ ID NO:5021) according to the present invention is supported by 22 libraries. The number of libraries was determined as previously described. This segment can be found in the following transcript(s): HSPPI_PEA_1_T3 (SEQ ID NO:4083). Table 4446 below describes the starting and ending position of this segment on each transcript.

TABLE 4446

Segment location on transcripts

| Transcript name | Segment starting position | Segment ending position |
|---|---|---|
| HSPPI_PEA_1_T3 (SEQ ID NO: 4083) | 506 | 533 |

This segment can be found in the following protein(s): HSPPI_PEA_1_P8.

Segment cluster HSPPI_PEA_1_node_12 (SEQ ID NO:5022) according to the present invention is supported by 25 libraries. The number of libraries was determined as previously described. This segment can be found in the following transcript(s): HSPPI_PEA_1_T3 (SEQ ID NO:4083). Table 4447 below describes the starting and ending position of this segment on each transcript.

TABLE 4447

Segment location on transcripts

| Transcript name | Segment starting position | Segment ending position |
|---|---|---|
| HSPPI_PEA_1_T3 (SEQ ID NO: 4083) | 534 | 622 |

This segment can be found in the following protein(s): HSPPI_PEA_1_P8.

Description for Cluster HSRR2SS

Cluster HSRR2SS features 1 transcript(s) and 21 segment(s) of interest, the names for which are given in Tables 4448 and 4449, respectively, the sequences themselves are given at the end of the application. The selected protein variants are given in Table 4450.

TABLE 4448

Transcripts of interest
Transcript Name

HSRR2SS_PEA_1_T9 (SEQ ID NO: 4084)

TABLE 4449

Segments of interest
Segment Name

HSRR2SS_PEA_1_node_0 (SEQ ID NO: 5023)
HSRR2SS_PEA_1_node_29 (SEQ ID NO: 5024)
HSRR2SS_PEA_1_node_44 (SEQ ID NO: 5025)
HSRR2SS_PEA_1_node_46 (SEQ ID NO: 5026)
HSRR2SS_PEA_1_node_49 (SEQ ID NO: 5027)
HSRR2SS_PEA_1_node_2 (SEQ ID NO: 5028)

TABLE 4449-continued

| Segments of interest Segment Name |
|---|
| HSRR2SS_PEA_1_node_3 (SEQ ID NO: 5029) |
| HSRR2SS_PEA_1_node_5 (SEQ ID NO: 5030) |
| HSRR2SS_PEA_1_node_8 (SEQ ID NO: 5031) |
| HSRR2SS_PEA_1_node_9 (SEQ ID NO: 5032) |
| HSRR2SS_PEA_1_node_10 (SEQ ID NO: 5033) |
| HSRR2SS_PEA_1_node_11 (SEQ ID NO: 5034) |
| HSRR2SS_PEA_1_node_12 (SEQ ID NO: 5035) |
| HSRR2SS_PEA_1_node_15 (SEQ ID NO: 5036) |
| HSRR2SS_PEA_1_node_19 (SEQ ID NO: 5037) |
| HSRR2SS_PEA_1_node_20 (SEQ ID NO: 5038) |
| HSRR2SS_PEA_1_node_21 (SEQ ID NO: 5039) |
| HSRR2SS_PEA_1_node_27 (SEQ ID NO: 5040) |
| HSRR2SS_PEA_1_node_32 (SEQ ID NO: 5041) |
| HSRR2SS_PEA_1_node_34 (SEQ ID NO: 5042) |
| HSRR2SS_PEA_1_node_42 (SEQ ID NO: 5043) |

TABLE 4450

Proteins of interest

| Protein Name | Corresponding Transcript(s) |
|---|---|
| HSRR2SS_PEA_1_P20 | HSRR2SS_PEA_1_T9 (SEQ ID NO: 4084) |

These sequences are variants of the known protein Ribonucleoside-diphosphate reductase M2 chain (SwissProt accession identifier RIR2_HUMAN; known also according to the synonyms EC 1.17.4.1; Ribonucleotide reductase small chain), referred to herein as the previously known protein.

Protein Ribonucleoside-diphosphate reductase M2 chain is known or believed to have the following function(s): Provides the precursors necessary for DNA synthesis. The sequence for protein Ribonucleoside-diphosphate reductase M2 chain is given at the end of the application, as "Ribonucleoside-diphosphate reductase M2 chain amino acid sequence". Protein Ribonucleoside-diphosphate reductase M2 chain localization is believed to be Cytoplasmic.

The following GO Annotation(s) apply to the previously known protein. The following annotation(s) were found: DNA replication; deoxyribonucleoside diphosphate metabolism, which are annotation(s) related to Biological Process; ribonucleoside-diphosphate reductase; oxidoreductase, which are annotation(s) related to Molecular Function; and cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSRR2SS can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 115 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 115 and Table 4451. This cluster is overexpressed (at least at a minimum level) in the following pathological conditions: brain malignant tumors, colorectal cancer, epithelial malignant tumors, a mixture of malignant tumors from different tissues, hepatocellular carcinoma, lung malignant tumors, myosarcoma, pancreas carcinoma, skin malignancies and gastric carcinoma.

TABLE 4451

Normal tissue distribution

| Name of Tissue | Number |
|---|---|
| adrenal | 0 |
| bladder | 0 |
| bone | 0 |
| brain | 3 |
| colon | 0 |
| epithelial | 6 |
| general | 24 |
| head and neck | 0 |
| kidney | 0 |
| liver | 4 |
| lung | 2 |
| lymph nodes | 65 |
| breast | 0 |
| bone marrow | 62 |
| muscle | 5 |
| ovary | 7 |
| pancreas | 4 |
| prostate | 4 |
| skin | 0 |
| stomach | 0 |
| T cells | 557 |
| uterus | 50 |

TABLE 4452

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 2.1e−01 | 3.4 | 1.5e−01 | 3.6 |
| bladder | 1 | 3.4e−01 | 1 | 1.0 | 2.1e−01 | 2.4 |
| bone | 1 | 1.7e−01 | 1 | 1.0 | 2.9e−02 | 3.6 |
| brain | 7.4e−01 | 5.1e−02 | 3.9e−01 | 2.0 | 1.2e−10 | 16.4 |
| colon | 2.1e−02 | 7.0e−03 | 5.6e−02 | 3.6 | 5.5e−03 | 4.8 |
| epithelial | 2.3e−04 | 1.9e−11 | 1.1e−06 | 5.5 | 9.3e−30 | 18.2 |
| general | 8.6e−03 | 7.9e−15 | 1.3e−03 | 1.8 | 6.8e−55 | 6.2 |
| head and neck | 2.1e−01 | 1.7e−01 | 1 | 1.2 | 5.6e−01 | 1.7 |
| kidney | 4.1e−01 | 2.4e−01 | 3.4e−01 | 2.4 | 1.7e−01 | 3.1 |
| liver | 3.3e−01 | 1.7e−01 | 1 | 1.2 | 1.4e−03 | 4.6 |
| lung | 1.9e−01 | 1.3e−02 | 4.1e−01 | 2.6 | 1.2e−03 | 8.0 |
| lymph nodes | 4.0e−01 | 9.5e−02 | 2.3e−01 | 1.4 | 8.0e−05 | 2.7 |
| breast | 6.1e−01 | 1.5e−01 | 6.9e−01 | 1.5 | 2.5e−01 | 2.1 |
| bone marrow | 6.4e−01 | 5.7e−01 | 3.8e−01 | 2.2 | 2.8e−01 | 1.8 |
| muscle | 9.2e−01 | 4.8e−01 | 1 | 0.8 | 3.6e−12 | 3.2 |
| ovary | 6.7e−01 | 5.6e−01 | 2.2e−01 | 2.4 | 7.0e−02 | 2.4 |
| pancreas | 5.5e−01 | 4.0e−01 | 1.8e−01 | 2.7 | 8.6e−04 | 3.3 |
| prostate | 8.2e−01 | 5.9e−01 | 4.5e−01 | 1.6 | 1.0e−01 | 2.3 |
| skin | 2.9e−01 | 3.1e−03 | 1.4e−01 | 7.0 | 2.0e−08 | 16.1 |

TABLE 4452-continued

P values and ratios for expression in cancerous tissue

| Name of Tissue | P1 | P2 | SP1 | R3 | SP2 | R4 |
|---|---|---|---|---|---|---|
| stomach | 9.1e−01 | 6.8e−02 | 1 | 1.0 | 4.7e−04 | 7.1 |
| T cells | 5.0e−01 | 6.7e−01 | 1 | 0.3 | 9.3e−01 | 0.6 |
| uterus | 2.1e−01 | 6.5e−02 | 7.8e−01 | 0.9 | 7.3e−02 | 1.4 |

As noted above, cluster HSRR2SS features 21 segment(s), which were listed in Table 4449 above and for which the sequence(s) are given at the end of the application. These segment(s) are portions of nucleic acid sequence(s) which are described herein separately because they are of particular interest. A description of each segment according to the present invention is now provided.

Segment cluster HSRR2SS_PEA_1_node_0 (SEQ ID NO:5023) according to the present invention is supported by 92 libraries. The number of libraries was determined as previously described. This segment can be found in the following transcript(s): HSRR2SS_PEA_1_T9 (SEQ ID NO:4084). Table 4453 below describes the starting and ending position of this segment on each transcript.

TABLE 4453

Segment location on transcripts

| Transcript name | Segment starting position | Segment ending position |
|---|---|---|
| HSRR2SS_PEA_1_T9 (SEQ ID NO: 4084) | 1 | 573 |

This segment can be found in the following protein(s): HSRR2SS_PEA_1_P20.

Segment cluster HSRR2SS_PEA_1_node_29 (SEQ ID NO:5024) according to the present invention is supported by 109 libraries. The number of libraries was determined as previously described. This segment can be found in the following transcript(s): HSRR2SS_PEA_1_T9 (SEQ ID NO:4084). Table 4454 below describes the starting and ending position of this segment on each transcript.

TABLE 4454

Segment location on transcripts

| Transcript name | Segment starting position | Segment ending position |
|---|---|---|
| HSRR2SS_PEA_1_T9 (SEQ ID NO: 4084) | 1139 | 1272 |

This segment can be found in the following protein(s): HSRR2SS_PEA_1_P20.

Segment cluster HSRR2SS_PEA_1_node_44 (SEQ ID NO:5025) according to the present invention is supported by 3 libraries. The number of libraries was determined as previously described. This segment can be found in the following transcript(s): HSRR2SS_PEA_1_T9 (SEQ ID NO:4084). Table 4455 below describes the starting and ending position of this segment on each transcript.

TABLE 4455

Segment location on transcripts

| Transcript name | Segment starting position | Segment ending position |
|---|---|---|
| HSRR2SS_PEA_1_T9 (SEQ ID NO: 4084) | 1593 | 1713 |

This segment can be found in the following protein(s): HSRR2SS_PEA_1_P20.

Segment cluster HSRR2SS_PEA_1_node_46 (SEQ ID NO:5026) according to the present invention is supported by 5 libraries. The number of libraries was determined as previously described. This segment can be found in the following transcript(s): HSRR2SS_PEA_1_T9 (SEQ ID NO:4084). Table 4456 below describes the starting and ending position of this segment on each transcript.

TABLE 4456

Segment location on transcripts

| Transcript name | Segment starting position | Segment ending position |
|---|---|---|
| HSRR2SS_PEA_1_T9 (SEQ ID NO: 4084) | 1714 | 2991 |

This segment can be found in a non-coding region of transcript(s) that are related to the following protein(s): HSRR2SS_PEA_1_P20.

Segment cluster HSRR2SS_PEA_1_node_49 (SEQ ID NO:5027) according to the present invention is supported by 1 libraries. The number of libraries was determined as previously described. This segment can be found in the following transcript(s): HSRR2SS_PEA_1_T9 (SEQ ID NO:4084). Table 4457 below describes the starting and ending position of this segment on each transcript.

TABLE 4457

Segment location on transcripts

| Transcript name | Segment starting position | Segment ending position |
|---|---|---|
| HSRR2SS_PEA_1_T9 (SEQ ID NO: 4084) | 2992 | 3366 |

This segment can be found in a non-coding region of transcript(s) that are related to the following protein(s): HSRR2SS_PEA_1_P20.

According to an optional embodiment of the present invention, short segments related to the above cluster are also provided. These segments are up to about 120 bp in length, and so are included in a separate description.

Segment cluster HSRR2SS_PEA_1_node_2 (SEQ ID NO:5028) according to the present invention is supported by 91 libraries. The number of libraries was determined as previously described. This segment can be found in the following transcript(s): HSRR2SS_PEA_1_T9 (SEQ ID NO:4084). Table 4458 below describes the starting and ending position of this segment on each transcript.

TABLE 4458

Segment location on transcripts

| Transcript name | Segment starting position | Segment ending position |
|---|---|---|
| HSRR2SS_PEA_1_T9 (SEQ ID NO: 4084) | 574 | 601 |

This segment can be found in the following protein(s): HSRR2SS_PEA_1_P20.

Segment cluster HSRR2SS_PEA_1_node_3 (SEQ ID NO:5029) according to the present invention is supported by 93 libraries. The number of libraries was determined as previously described. This segment can be found in the following transcript(s): HSRR2SS_PEA_1_T9 (SEQ ID NO:4084). Table 4459 below describes the starting and ending position of this segment on each transcript.

TABLE 4459

Segment location on transcripts

| Transcript name | Segment starting position | Segment ending position |
|---|---|---|
| HSRR2SS_PEA_1_T9 (SEQ ID NO: 4084) | 602 | 637 |

This segment can be found in the following protein(s): HSRR2SS_PEA_1_P20.

Segment cluster HSRR2SS_PEA_1_node_5 (SEQ ID NO:5030) according to the present invention can be found in the following transcript(s): HSRR2SS_PEA_1_T9 (SEQ ID NO:4084). Table 4460 below describes the starting and ending position of this segment on each transcript.

TABLE 4460

Segment location on transcripts

| Transcript name | Segment starting position | Segment ending position |
|---|---|---|
| HSRR2SS_PEA_1_T9 (SEQ ID NO: 4084) | 638 | 648 |

This segment can be found in the following protein(s): HSRR2SS_PEA_1_P20.

Segment cluster HSRR2SS_PEA_1_node_8 (SEQ ID NO:5031) according to the present invention can be found in the following transcript(s): HSRR2SS_PEA_1_T9 (SEQ ID NO:4084). Table 4461 below describes the starting and ending position of this segment on each transcript.

TABLE 4461

Segment location on transcripts

| Transcript name | Segment starting position | Segment ending position |
|---|---|---|
| HSRR2SS_PEA_1_T9 (SEQ ID NO: 4084) | 649 | 667 |

This segment can be found in the following protein(s): HSRR2SS_PEA_1_P20.

Segment cluster HSRR2SS_PEA_1_node_9 (SEQ ID NO:5032) according to the present invention is supported by 93 libraries. The number of libraries was determined as previously described. This segment can be found in the following transcript(s): HSRR2SS_PEA_1_T9 (SEQ ID NO:4084). Table 4462 below describes the starting and ending position of this segment on each transcript.

TABLE 4462

Segment location on transcripts

| Transcript name | Segment starting position | Segment ending position |
|---|---|---|
| HSRR2SS_PEA_1_T9 (SEQ ID NO: 4084) | 668 | 697 |

This segment can be found in the following protein(s): HSRR2SS_PEA_1_P20.

Segment cluster HSRR2SS_PEA_1_node_10 (SEQ ID NO:5033) according to the present invention can be found in the following transcript(s): HSRR2SS_PEA_1_T9 (SEQ ID NO:4084). Table 4463 below describes the starting and ending position of this segment on each transcript.

TABLE 4463

Segment location on transcripts

| Transcript name | Segment starting position | Segment ending position |
|---|---|---|
| HSRR2SS_PEA_1_T9 (SEQ ID NO: 4084) | 698 | 702 |

This segment can be found in the following protein(s): HSRR2SS_PEA_1_P20.

Segment cluster HSRR2SS_PEA_1_node_11 (SEQ ID NO:5034) according to the present invention can be found in the following transcript(s): HSRR2SS_PEA_1_T9 (SEQ ID NO:4084). Table 4464 below describes the starting and ending position of this segment on each transcript.

TABLE 4464

Segment location on transcripts

| Transcript name | Segment starting position | Segment ending position |
|---|---|---|
| HSRR2SS_PEA_1_T9 (SEQ ID NO: 4084) | 703 | 724 |

This segment can be found in the following protein(s): HSRR2SS_PEA_1_P20.

Segment cluster HSRR2SS_PEA_1_node_12 (SEQ ID NO:5035) according to the present invention is supported by 102 libraries. The number of libraries was determined as previously described. This segment can be found in the following transcript(s): HSRR2SS_PEA_1_1_T9 (SEQ ID NO:4084). Table 4465 below describes the starting and ending position of this segment on each transcript.

TABLE 4465

Segment location on transcripts

| Transcript name | Segment starting position | Segment ending position |
|---|---|---|
| HSRR2SS_PEA_1_T9 (SEQ ID NO: 4084) | 725 | 792 |

This segment can be found in the following protein(s): HSRR2SS_PEA_1_P20.

Segment cluster HSRR2SS_PEA_1_node_15 (SEQ ID NO:5036) according to the present invention is supported by 114 libraries. The number of libraries was determined as previously described. This segment can be found in the following transcript(s): HSRR2SS_PEA_1_T9 (SEQ ID NO:4084). Table 4466 below describes the starting and ending position of this segment on each transcript.

TABLE 4466

Segment location on transcripts

| Transcript name | Segment starting position | Segment ending position |
|---|---|---|
| HSRR2SS_PEA_1_T9 (SEQ ID NO: 4084) | 793 | 909 |

This segment can be found in the following protein(s): HSRR2SS_PEA_1_P20.

Segment cluster HSRR2SS_PEA_1_node_19 (SEQ ID NO:5037) according to the present invention is supported by 107 libraries. The number of libraries was determined as previously described. This segment can be found in the following transcript(s): HSRR2SS_PEA_1_T9 (SEQ ID NO:4084). Table 4467 below describes the starting and ending position of this segment on each transcript.

TABLE 4467

Segment location on transcripts

| Transcript name | Segment starting position | Segment ending position |
|---|---|---|
| HSRR2SS_PEA_1_T9 (SEQ ID NO: 4084) | 910 | 962 |

This segment can be found in the following protein(s): HSRR2SS_PEA_1_P20.

Segment cluster HSRR2SS_PEA_1_node_20 (SEQ ID NO:5038) according to the present invention is supported by 108 libraries. The number of libraries was determined as previously described. This segment can be found in the following transcript(s): HSRR2SS_PEA_1_T9 (SEQ ID NO:4084). Table 4468 below describes the starting and ending position of this segment on each transcript.

TABLE 4468

Segment location on transcripts

| Transcript name | Segment starting position | Segment ending position |
|---|---|---|
| HSRR2SS_PEA_1_T9 (SEQ ID NO: 4084) | 963 | 988 |

This segment can be found in the following protein(s): HSRR2SS_PEA_1_P20.

Segment cluster HSRR2SS_PEA_1_node_21 (SEQ ID NO:5039) according to the present invention is supported by 110 libraries. The number of libraries was determined as previously described. This segment can be found in the following transcript(s): HSRR2SS_PEA_1_T9 (SEQ ID NO:4084). Table 4469 below describes the starting and ending position of this segment on each transcript.

TABLE 4469

Segment location on transcripts

| Transcript name | Segment starting position | Segment ending position |
|---|---|---|
| HSRR2SS_PEA_1_T9 (SEQ ID NO: 4084) | 989 | 1043 |

This segment can be found in the following protein(s): HSRR2SS_PEA_1_P20.

Segment cluster HSRR2SS_PEA_1_node_27 (SEQ ID NO:5040) according to the present invention is supported by 112 libraries. The number of libraries was determined as previously described. This segment can be found in the following transcript(s): HSRR2SS_PEA_1_T9 (SEQ ID NO:4084). Table 4470 below describes the starting and ending position of this segment on each transcript.

TABLE 4470

Segment location on transcripts

| Transcript name | Segment starting position | Segment ending position |
|---|---|---|
| HSRR2SS_PEA_1_T9 (SEQ ID NO: 4084) | 1044 | 1138 |

This segment can be found in the following protein(s): HSRR2SS_PEA_1_P20.

Segment cluster HSRR2SS_PEA_1_node_32 (SEQ ID NO:5041) according to the present invention is supported by 106 libraries. The number of libraries was determined as previously described. This segment can be found in the following transcript(s): HSRR2SS_PEA_1_T9 (SEQ ID NO:4084). Table 4471 below describes the starting and ending position of this segment on each transcript.

TABLE 4471

Segment location on transcripts

| Transcript name | Segment starting position | Segment ending position |
|---|---|---|
| HSRR2SS_PEA_1_T9 (SEQ ID NO: 4084) | 1273 | 1377 |

This segment can be found in the following protein(s): HSRR2SS_PEA_1_P20.

Segment cluster HSRR2SS_PEA_1_node_34 (SEQ ID NO:5042) according to the present invention is supported by 104 libraries. The number of libraries was determined as previously described. This segment can be found in the following transcript(s): HSRR2SS_PEA_1_T9 (SEQ ID NO:4084). Table 4472 below describes the starting and ending position of this segment on each transcript.

TABLE 4472

Segment location on transcripts

| Transcript name | Segment starting position | Segment ending position |
|---|---|---|
| HSRR2SS_PEA_1_T9 (SEQ ID NO: 4084) | 1378 | 1491 |

This segment can be found in the following protein(s): HSRR2SS_PEA_1_P20.

Segment cluster HSRR2SS_PEA_1_node_42 (SEQ ID NO:5043) according to the present invention is supported by 3 libraries. The number of libraries was determined as previously described. This segment can be found in the following transcript(s): HSRR2SS_PEA_1_T9 (SEQ ID NO:4084). Table 4473 below describes the starting and ending position of this segment on each transcript.

TABLE 4473

Segment location on transcripts

| Transcript name | Segment starting position | Segment ending position |
|---|---|---|
| HSRR2SS_PEA_1_T9 (SEQ ID NO: 4084) | 1492 | 1592 |

This segment can be found in the following protein(s): HSRR2SS_PEA_1_P20.

Description for Cluster HSTCRT3E

Cluster HSTCRT3E features 6 transcript(s) and 12 segment(s) of interest, the names for which are given in Tables 4474 and 4475, respectively, the sequences themselves are given at the end of the application. The selected protein variants are given in Table 4476.

TABLE 4474

Transcripts of interest
Transcript Name

HSTCRT3E_T0 (SEQ ID NO: 4085)
HSTCRT3E_T1 (SEQ ID NO: 4086)
HSTCRT3E_T2 (SEQ ID NO: 4087)
HSTCRT3E_T3 (SEQ ID NO: 4088)
HSTCRT3E_T5 (SEQ ID NO: 4089)
HSTCRT3E_T13 (SEQ ID NO: 4090)

TABLE 4475

Segments of interest
Segment Name

HSTCRT3E_node_0 (SEQ ID NO: 5044)
HSTCRT3E_node_13 (SEQ ID NO: 5045)
HSTCRT3E_node_14 (SEQ ID NO: 5046)
HSTCRT3E_node_18 (SEQ ID NO: 5047)
HSTCRT3E_node_24 (SEQ ID NO: 5048)
HSTCRT3E_node_2 (SEQ ID NO: 5049)
HSTCRT3E_node_3 (SEQ ID NO: 5050)
HSTCRT3E_node_5 (SEQ ID NO: 5051)
HSTCRT3E_node_8 (SEQ ID NO: 5052)
HSTCRT3E_node_11 (SEQ ID NO: 5053)
HSTCRT3E_node_20 (SEQ ID NO: 5054)
HSTCRT3E_node_23 (SEQ ID NO: 5055)

TABLE 4476

Proteins of interest

| Protein Name | Corresponding Transcript(s) |
|---|---|
| HSTCRT3E_P2 | HSTCRT3E_T0 (SEQ ID NO: 4085); HSTCRT3E_T1 (SEQ ID NO: 4086) |
| HSTCRT3E_P3 | HSTCRT3E_T2 (SEQ ID NO: 4087); HSTCRT3E_T3 (SEQ ID NO: 4088) |

These sequences are variants of the known protein T-cell surface glycoprotein CD3 epsilon chain precursor (SwissProt accession identifier CD3E_HUMAN; known also according to the synonyms T-cell surface antigen T3/Leu-4 epsilon chain), referred to herein as the previously known protein.

Protein T-cell surface glycoprotein CD3 epsilon chain precursor is known or believed to have the following function(s): The CD3 complex mediates signal transduction. The sequence for protein T-cell surface glycoprotein CD3 epsilon chain precursor is given at the end of the application, as "T-cell surface glycoprotein CD3 epsilon chain precursor amino acid sequence". Protein T-cell surface glycoprotein CD3 epsilon chain precursor localization is believed to be Type I membrane protein.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD19 antagonist; CD3 antagonist; T cell inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antidiabetic; Immunosuppressant; Antiarthritic, immunological; Monoclonal antibody, humanized; Monoclonal antibody, murine; Anticancer; Monoclonal antibody, human.

The following GO Annotation(s) apply to the previously known protein. The following annotation(s) were found: protein complex assembly; signal complex formation; G-protein coupled receptor protein signaling pathway, which are annotation(s) related to Biological Process; transmembrane receptor; SH3-domain binding; receptor signaling complex scaffold protein, which are annotation(s) related to Molecular Function; and integral plasma membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSTCRT3E can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 116 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 116 and Table 4477. This cluster is overexpressed (at least at a minimum level) in the following pathological conditions: pancreas carcinoma.

TABLE 4477

Normal tissue distribution

| Name of Tissue | Number |
|---|---|
| epithelial | 13 |
| general | 40 |
| kidney | 0 |

TABLE 4477-continued

Normal tissue distribution

| Name of Tissue | Number |
|---|---|
| lung | 12 |
| lymph nodes | 207 |
| pancreas | 0 |
| prostate | 0 |
| T cells | 278 |

TABLE 4478

P values and ratios for expression in cancerous tissue

| Name of Tissue | P1 | P2 | SP1 | R3 | SP2 | R4 |
|---|---|---|---|---|---|---|
| epithelial | 4.0e−01 | 7.9e−01 | 9.1e−01 | 0.6 | 1 | 0.4 |
| general | 9.4e−01 | 9.6e−01 | 1 | 0.2 | 1 | 0.2 |
| kidney | 4.3e−01 | 5.3e−01 | 1 | 1.3 | 1 | 1.2 |
| lung | 3.7e−01 | 6.3e−01 | 6.5e−01 | 1.2 | 8.5e−01 | 0.8 |
| lymph nodes | 5.9e−01 | 7.5e−01 | 9.8e−01 | 0.3 | 1 | 0.2 |
| pancreas | 3.6e−02 | 8.7e−02 | 1.0e−03 | 6.5 | 5.9e−03 | 4.6 |
| prostate | 3.8e−01 | 4.6e−01 | 4.5e−01 | 2.0 | 5.6e−01 | 1.7 |
| T cells | 6.7e−01 | 6.7e−01 | 1 | 0.5 | 3.7e−01 | 0.9 |

As noted above, cluster HSTCRT3E features 12 segment(s), which were listed in Table 4475 above and for which the sequence(s) are given at the end of the application. These segment(s) are portions of nucleic acid sequence(s) which are described herein separately because they are of particular interest. A description of each segment according to the present invention is now provided.

Segment cluster HSTCRT3E_node_0 (SEQ ID NO:5044) according to the present invention is supported by 23 libraries. The number of libraries was determined as previously described. This segment can be found in the following transcript(s): HSTCRT3E_T0 (SEQ ID NO:4085), HSTCRT3E_T2 (SEQ ID NO:4087), HSTCRT3E_T5 (SEQ ID NO:4089) and HSTCRT3E_T13 (SEQ ID NO:4090). Table 4479 below describes the starting and ending position of this segment on each transcript.

TABLE 4479

Segment location on transcripts

| Transcript name | Segment starting position | Segment ending position |
|---|---|---|
| HSTCRT3E_T0 (SEQ ID NO: 4085) | 1 | 232 |
| HSTCRT3E_T2 (SEQ ID NO: 4087) | 1 | 232 |
| HSTCRT3E_T5 (SEQ ID NO: 4089) | 1 | 232 |
| HSTCRT3E_T13 (SEQ ID NO: 4090) | 1 | 232 |

This segment can be found in a non-coding region of transcript(s) that are related to the following protein(s): HSTCRT3E_P2 and HSTCRT3E_P3.

Segment cluster HSTCRT3E_node_13 (SEQ ID NO:5045) according to the present invention is supported by 4 libraries. The number of libraries was determined as previously described. This segment can be found in the following transcript(s): HSTCRT3E_T5 (SEQ ID NO:4089). Table 4480 below describes the starting and ending position of this segment on each transcript.

TABLE 4480

Segment location on transcripts

| Transcript name | Segment starting position | Segment ending position |
|---|---|---|
| HSTCRT3E_T5 (SEQ ID NO: 4089) | 381 | 827 |

The previously-described transcripts for these segment(s) do not code for protein.

Segment cluster HSTCRT3E_node_14 (SEQ ID NO:5046) according to the present invention is supported by 63 libraries. The number of libraries was determined as previously described. This segment can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088) and HSTCRT3E_T5 (SEQ ID NO:4089). Table 4481 below describes the starting and ending position of this segment on each transcript.

TABLE 4481

Segment location on transcripts

| Transcript name | Segment starting position | Segment ending position |
|---|---|---|
| HSTCRT3E_T0 (SEQ ID NO: 4085) | 381 | 629 |
| HSTCRT3E_T1 (SEQ ID NO: 4086) | 218 | 466 |
| HSTCRT3E_T2 (SEQ ID NO: 4087) | 396 | 644 |
| HSTCRT3E_T3 (SEQ ID NO: 4088) | 233 | 481 |
| HSTCRT3E_T5 (SEQ ID NO: 4089) | 828 | 1076 |

This segment can be found in the following protein(s): HSTCRT3E_P2 and HSTCRT3E_P3.

Segment cluster HSTCRT3E_node_18 (SEQ ID NO:5047) according to the present invention is supported by 48 libraries. The number of libraries was determined as previously described. This segment can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088) and HSTCRT3E_T5 (SEQ ID NO:4089). Table 4482 below describes the starting and ending position of this segment on each transcript.

TABLE 4482

Segment location on transcripts

| Transcript name | Segment starting position | Segment ending position |
|---|---|---|
| HSTCRT3E_T0 (SEQ ID NO: 4085) | 630 | 797 |
| HSTCRT3E_T1 (SEQ ID NO: 4086) | 467 | 634 |
| HSTCRT3E_T2 (SEQ ID NO: 4087) | 645 | 812 |
| HSTCRT3E_T3 (SEQ ID NO: 4088) | 482 | 649 |
| HSTCRT3E_T5 (SEQ ID NO: 4089) | 1077 | 1244 |

This segment can be found in the following protein(s): HSTCRT3E_P2 and HSTCRT3E_P3.

Segment cluster HSTCRT3E_node_24 (SEQ ID NO:5048) according to the present invention is supported by 75 libraries. The number of libraries was determined as previously described. This segment can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4483 below describes the starting and ending position of this segment on each transcript.

TABLE 4483

Segment location on transcripts

| Transcript name | Segment starting position | Segment ending position |
|---|---|---|
| HSTCRT3E_T0 (SEQ ID NO: 4085) | 866 | 1538 |
| HSTCRT3E_T1 (SEQ ID NO: 4086) | 703 | 1375 |
| HSTCRT3E_T2 (SEQ ID NO: 4087) | 881 | 1553 |
| HSTCRT3E_T3 (SEQ ID NO: 4088) | 718 | 1390 |
| HSTCRT3E_T5 (SEQ ID NO: 4089) | 1313 | 1985 |
| HSTCRT3E_T13 (SEQ ID NO: 4090) | 449 | 1121 |

This segment can be found in the following protein(s): HSTCRT3E_P2 and HSTCRT3E_P3.

According to an optional embodiment of the present invention, short segments related to the above cluster are also provided. These segments are up to about 120 bp in length, and so are included in a separate description.

Segment cluster HSTCRT3E_node_2 (SEQ ID NO:5049) according to the present invention is supported by 4 libraries. The number of libraries was determined as previously described. This segment can be found in the following transcript(s): HSTCRT3E_T1 (SEQ ID NO:4086) and HSTCRT3E_T3 (SEQ ID NO:4088). Table 4484 below describes the starting and ending position of this segment on each transcript.

TABLE 4484

Segment location on transcripts

| Transcript name | Segment starting position | Segment ending position |
|---|---|---|
| HSTCRT3E_T1 (SEQ ID NO: 4086) | 1 | 69 |
| HSTCRT3E_T3 (SEQ ID NO: 4088) | 1 | 69 |

This segment can be found in a non-coding region of transcript(s) that are related to the following protein(s): HSTCRT3E_P2 and HSTCRT3E_P3.

Segment cluster HSTCRT3E_node_3 (SEQ ID NO:5050) according to the present invention is supported by 54 libraries. The number of libraries was determined as previously described. This segment can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4485 below describes the starting and ending position of this segment on each transcript.

TABLE 4485

Segment location on transcripts

| Transcript name | Segment starting position | Segment ending position |
|---|---|---|
| HSTCRT3E_T0 (SEQ ID NO: 4085) | 233 | 340 |
| HSTCRT3E_T1 (SEQ ID NO: 4086) | 70 | 177 |
| HSTCRT3E_T2 (SEQ ID NO: 4087) | 233 | 340 |
| HSTCRT3E_T3 (SEQ ID NO: 4088) | 70 | 177 |
| HSTCRT3E_T5 (SEQ ID NO: 4089) | 233 | 340 |
| HSTCRT3E_T13 (SEQ ID NO: 4090) | 233 | 340 |

This segment can be found in the following protein(s): HSTCRT3E_P2 and HSTCRT3E_P3.

Segment cluster HSTCRT3E_node_5 (SEQ ID NO:5051) according to the present invention can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4486 below describes the starting and ending position of this segment on each transcript.

TABLE 4486

Segment location on transcripts

| Transcript name | Segment starting position | Segment ending position |
|---|---|---|
| HSTCRT3E_T0 (SEQ ID NO: 4085) | 341 | 362 |
| HSTCRT3E_T1 (SEQ ID NO: 4086) | 178 | 199 |
| HSTCRT3E_T2 (SEQ ID NO: 4087) | 341 | 362 |
| HSTCRT3E_T3 (SEQ ID NO: 4088) | 178 | 199 |
| HSTCRT3E_T5 (SEQ ID NO: 4089) | 341 | 362 |
| HSTCRT3E_T13 (SEQ ID NO: 4090) | 341 | 362 |

This segment can be found in the following protein(s): HSTCRT3E_P2 and HSTCRT3E_P3.

Segment cluster HSTCRT3E_node_8 (SEQ ID NO:5052) according to the present invention can be found in the following transcript(s): HSTCRT3E_T2 (SEQ ID NO:4087) and HSTCRT3E_T3 (SEQ ID NO:4088). Table 4487 below describes the starting and ending position of this segment on each transcript.

TABLE 4487

Segment location on transcripts

| Transcript name | Segment starting position | Segment ending position |
|---|---|---|
| HSTCRT3E_T2 (SEQ ID NO: 4087) | 363 | 377 |
| HSTCRT3E_T3 (SEQ ID NO: 4088) | 200 | 214 |

This segment can be found in the following protein(s): HSTCRT3E_P3.

Segment cluster HSTCRT3E_node_11 (SEQ ID NO:5053) according to the present invention can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4488 below describes the starting and ending position of this segment on each transcript.

TABLE 4488

Segment location on transcripts

| Transcript name | Segment starting position | Segment ending position |
|---|---|---|
| HSTCRT3E_T0 (SEQ ID NO: 4085) | 363 | 380 |
| HSTCRT3E_T1 (SEQ ID NO: 4086) | 200 | 217 |
| HSTCRT3E_T2 (SEQ ID NO: 4087) | 378 | 395 |
| HSTCRT3E_T3 (SEQ ID NO: 4088) | 215 | 232 |
| HSTCRT3E_T5 (SEQ ID NO: 4089) | 363 | 380 |
| HSTCRT3E_T13 (SEQ ID NO: 4090) | 363 | 380 |

This segment can be found in the following protein(s): HSTCRT3E_P2 and HSTCRT3E_P3.

Segment cluster HSTCRT3E_node_20 (SEQ ID NO:5054) according to the present invention is supported by 44 libraries. The number of libraries was determined as previously described. This segment can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4489 below describes the starting and ending position of this segment on each transcript.

TABLE 4489

Segment location on transcripts

| Transcript name | Segment starting position | Segment ending position |
|---|---|---|
| HSTCRT3E_T0 (SEQ ID NO: 4085) | 798 | 844 |
| HSTCRT3E_T1 (SEQ ID NO: 4086) | 635 | 681 |
| HSTCRT3E_T2 (SEQ ID NO: 4087) | 813 | 859 |
| HSTCRT3E_T3 (SEQ ID NO: 4088) | 650 | 696 |
| HSTCRT3E_T5 (SEQ ID NO: 4089) | 1245 | 1291 |
| HSTCRT3E_T13 (SEQ ID NO: 4090) | 381 | 427 |

This segment can be found in the following protein(s): HSTCRT3E_P2 and HSTCRT3E_P3.

Segment cluster HSTCRT3E_node_23 (SEQ ID NO:5055) according to the present invention can be found in the following transcript(s): HSTCRT3E_T0 (SEQ ID NO:4085), HSTCRT3E_T1 (SEQ ID NO:4086), HSTCRT3E_T2 (SEQ ID NO:4087), HSTCRT3E_T3 (SEQ ID NO:4088), HSTCRT3E_T5 (SEQ ID NO:4089) and HSTCRT3E_T13 (SEQ ID NO:4090). Table 4490 below describes the starting and ending position of this segment on each transcript.

TABLE 4490

Segment location on transcripts

| Transcript name | Segment starting position | Segment ending position |
|---|---|---|
| HSTCRT3E_T0 (SEQ ID NO: 4085) | 845 | 865 |
| HSTCRT3E_T1 (SEQ ID NO: 4086) | 682 | 702 |
| HSTCRT3E_T2 (SEQ ID NO: 4087) | 860 | 880 |
| HSTCRT3E_T3 (SEQ ID NO: 4088) | 697 | 717 |
| HSTCRT3E_T5 (SEQ ID NO: 4089) | 1292 | 1312 |
| HSTCRT3E_T13 (SEQ ID NO: 4090) | 428 | 448 |

This segment can be found in the following protein(s): HSTCRT3E_P2 and HSTCRT3E_P3.

Description for Cluster HSTFE3

Cluster HSTFE3 features 2 transcript(s) and 36 segment(s) of interest, the names for which are given in Tables 4491 and 4492, respectively, the sequences themselves are given at the end of the application. The selected protein variants are given in Table 4493.

TABLE 4491

Transcripts of interest
Transcript Name

HSTFE3_PEA_1_T16 (SEQ ID NO: 4091)
HSTFE3_PEA_1_T22 (SEQ ID NO: 4092)

TABLE 4492

Segments of interest
Segment Name

HSTFE3_PEA_1_node_5 (SEQ ID NO: 5056)
HSTFE3_PEA_1_node_14 (SEQ ID NO: 5057)
HSTFE3_PEA_1_node_17 (SEQ ID NO: 5058)
HSTFE3_PEA_1_node_31 (SEQ ID NO: 5059)
HSTFE3_PEA_1_node_35 (SEQ ID NO: 5060)
HSTFE3_PEA_1_node_36 (SEQ ID NO: 5061)
HSTFE3_PEA_1_node_38 (SEQ ID NO: 5062)
HSTFE3_PEA_1_node_39 (SEQ ID NO: 5063)
HSTFE3_PEA_1_node_41 (SEQ ID NO: 5064)
HSTFE3_PEA_1_node_47 (SEQ ID NO: 5065)
HSTFE3_PEA_1_node_49 (SEQ ID NO: 5066)
HSTFE3_PEA_1_node_51 (SEQ ID NO: 5067)
HSTFE3_PEA_1_node_55 (SEQ ID NO: 5068)
HSTFE3_PEA_1_node_59 (SEQ ID NO: 5069)
HSTFE3_PEA_1_node_60 (SEQ ID NO: 5070)
HSTFE3_PEA_1_node_7 (SEQ ID NO: 5071)
HSTFE3_PEA_1_node_11 (SEQ ID NO: 5072)
HSTFE3_PEA_1_node_12 (SEQ ID NO: 5073)
HSTFE3_PEA_1_node_13 (SEQ ID NO: 5074)
HSTFE3_PEA_1_node_19 (SEQ ID NO: 5075)
HSTFE3_PEA_1_node_28 (SEQ ID NO: 5076)
HSTFE3_PEA_1_node_30 (SEQ ID NO: 5077)
HSTFE3_PEA_1_node_32 (SEQ ID NO: 5078)
HSTFE3_PEA_1_node_33 (SEQ ID NO: 5079)
HSTFE3_PEA_1_node_34 (SEQ ID NO: 5080)
HSTFE3_PEA_1_node_42 (SEQ ID NO: 5081)
HSTFE3_PEA_1_node_43 (SEQ ID NO: 5082)
HSTFE3_PEA_1_node_45 (SEQ ID NO: 5083)
HSTFE3_PEA_1_node_48 (SEQ ID NO: 5084)
HSTFE3_PEA_1_node_50 (SEQ ID NO: 5085)
HSTFE3_PEA_1_node_52 (SEQ ID NO: 5086)
HSTFE3_PEA_1_node_53 (SEQ ID NO: 5087)
HSTFE3_PEA_1_node_54 (SEQ ID NO: 5088)
HSTFE3_PEA_1_node_56 (SEQ ID NO: 5089)
HSTFE3_PEA_1_node_57 (SEQ ID NO: 5090)
HSTFE3_PEA_1_node_58 (SEQ ID NO: 5091)

TABLE 4493

Proteins of interest

| Protein Name | Corresponding Transcript(s) |
|---|---|
| HSTFE3_PEA_1_P10 | HSTFE3_PEA_1_T16 (SEQ ID NO: 4091) |
| HSTFE3_PEA_1_P5 | HSTFE3_PEA_1_T22 (SEQ ID NO: 4092) |

These sequences are variants of the known protein Transcription factor E3 (SwissProt accession identifier TFE3_HUMAN), referred to herein as the previously known protein.

Protein Transcription factor E3 is known or believed to have the following function(s): Positive-acting transcription factor that binds to the immunoglobulin enchancer MUE3 motif. It binds also very well to a USF/MLTF site. Binding of TFE3 to DNA induces DNA binding. The sequence for protein Transcription factor E3 is given at the end of the application, as "Transcription factor E3 amino acid sequence". Known polymorphisms for this sequence are as shown in Table 4494.

TABLE 4494

Amino acid mutations for Known Protein

| SNP position(s) on amino acid sequence | Comment |
|---|---|
| 208-211 | GPKL -> EFGR |
| 219 | P -> S |
| 222 | P -> K |
| 443 | P -> G |
| 455 | T -> A |
| 475 | A -> R |
| 557-725 | Missing |
| 593 | V -> C |
| 726-743 | ESSNGGPSPGGLSSAPSP -> PAVSKASSRRSSFSMEES |

Protein Transcription factor E3 localization is believed to be Nuclear.

The following GO Annotation(s) apply to the previously known protein. The following annotation(s) were found: transcription regulation; transcription, from Pol II promoter; cell growth and/or maintenance, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HSTFE3 features 36 segment(s), which were listed in Table 4492 above and for which the sequence(s) are given at the end of the application. These segment(s) are portions of nucleic acid sequence(s) which are described herein separately because they are of particular interest. A description of each segment according to the present invention is now provided.

Segment cluster HSTFE3_PEA_1_node_5 (SEQ ID NO:5056) according to the present invention is supported by 33 libraries. The number of libraries was determined as previously described. This segment can be found in the following transcript(s): HSTFE3_PEA_1_T22 (SEQ ID NO:4092). Table 4495 below describes the starting and ending position of this segment on each transcript.

TABLE 4495

Segment location on transcripts

| Transcript name | Segment starting position | Segment ending position |
|---|---|---|
| HSTFE3_PEA_1_T22 (SEQ ID NO: 4092) | 1 | 376 |

This segment can be found in the following protein(s): HSTFE3_PEA_1_P5.

Segment cluster HSTFE3_PEA_1_node_14 (SEQ ID NO:5057) according to the present invention is supported by 42 libraries. The number of libraries was determined as previously described. This segment can be found in the following transcript(s): HSTFE3_PEA_1_T22 (SEQ ID NO:4092). Table 4496 below describes the starting and ending position of this segment on each transcript.

TABLE 4496

Segment location on transcripts

| Transcript name | Segment starting position | Segment ending position |
|---|---|---|
| HSTFE3_PEA_1_T22 (SEQ ID NO: 4092) | 556 | 794 |

This segment can be found in the following protein(s): HSTFE3_PEA_1_P5.

Segment cluster HSTFE3_PEA_1_node_17 (SEQ ID NO:5058) according to the present invention is supported by 44 libraries. The number of libraries was determined as previously described. This segment can be found in the following transcript(s): HSTFE3_PEA_1_T22 (SEQ ID NO:4092). Table 4497 below describes the starting and ending position of this segment on each transcript.

TABLE 4497

Segment location on transcripts

| Transcript name | Segment starting position | Segment ending position |
|---|---|---|
| HSTFE3_PEA_1_T22 (SEQ ID NO: 4092) | 795 | 1040 |

This segment can be found in the following protein(s): HSTFE3_PEA_1_P5.

Segment cluster HSTFE3_PEA_1_node_31 (SEQ ID NO:5059) according to the present invention is supported by 4 libraries. The number of libraries was determined as previously described. This segment can be found in the following transcript(s): HSTFE3_PEA_1_T22 (SEQ ID NO:4092). Table 4498 below describes the starting and ending position of this segment on each transcript.

TABLE 4498

Segment location on transcripts

| Transcript name | Segment starting position | Segment ending position |
|---|---|---|
| HSTFE3_PEA_1_T22 (SEQ ID NO: 4092) | 1321 | 1479 |

This segment can be found in the following protein(s): HSTFE3_PEA_1_P5.

Segment cluster HSTFE3_PEA_1_node_35 (SEQ ID NO:5060) according to the present invention is supported by 3 libraries. The number of libraries was determined as previously described. This segment can be found in the following transcript(s): HSTFE3_PEA_1_T22 (SEQ ID NO:4092). Table 4499 below describes the starting and ending position of this segment on each transcript.

TABLE 4499

Segment location on transcripts

| Transcript name | Segment starting position | Segment ending position |
|---|---|---|
| HSTFE3_PEA_1_T22 (SEQ ID NO: 4092) | 1582 | 1869 |

This segment can be found in a non-coding region of transcript(s) that are related to the following protein(s): HSTFE3_PEA_1_P5.

Segment cluster HSTFE3_PEA_1_node_36 (SEQ ID NO:5061) according to the present invention is supported by 1 libraries. The number of libraries was determined as previously described. This segment can be found in the following transcript(s): HSTFE3_PEA_1_T22 (SEQ ID NO:4092). Table 4500 below describes the starting and ending position of this segment on each transcript.

TABLE 4500

Segment location on transcripts

| Transcript name | Segment starting position | Segment ending position |
|---|---|---|
| HSTFE3_PEA_1_T22 (SEQ ID NO: 4092) | 1870 | 2144 |

This segment can be found in a non-coding region of transcript(s) that are related to the following protein(s): HSTFE3_PEA_1_P5.

Segment cluster HSTFE3_PEA_1_node_38 (SEQ ID NO:5062) according to the present invention is supported by 2 libraries. The number of libraries was determined as previously described. This segment can be found in the following transcript(s): HSTFE3_PEA_1_T22 (SEQ ID NO:4092). Table 4501 below describes the starting and ending position of this segment on each transcript.

TABLE 4501

Segment location on transcripts

| Transcript name | Segment starting position | Segment ending position |
|---|---|---|
| HSTFE3_PEA_1_T22 (SEQ ID NO: 4092) | 2145 | 2337 |

This segment can be found in a non-coding region of transcript(s) that are related to the following protein(s): HSTFE3_PEA_1_P5.

Segment cluster HSTFE3_PEA_1_node_39 (SEQ ID NO:5063) according to the present invention is supported by 2 libraries. The number of libraries was determined as previously described. This segment can be found in the following transcript(s): HSTFE3_PEA_1_T22 (SEQ ID NO:4092). Table 4502 below describes the starting and ending position of this segment on each transcript.

TABLE 4502

Segment location on transcripts

| Transcript name | Segment starting position | Segment ending position |
|---|---|---|
| HSTFE3_PEA_1_T22 (SEQ ID NO: 4092) | 2338 | 2480 |

This segment can be found in a non-coding region of transcript(s) that are related to the following protein(s): HSTFE3_PEA_1_P5.

Segment cluster HSTFE3_PEA_1_node_41 (SEQ ID NO:5064) according to the present invention is supported by 5 libraries. The number of libraries was determined as previously described. This segment can be found in the following transcript(s): HSTFE3_PEA_1_T16 (SEQ ID NO:4091). Table 4503 below describes the starting and ending position of this segment on each transcript.

TABLE 4503

Segment location on transcripts

| Transcript name | Segment starting position | Segment ending position |
|---|---|---|
| HSTFE3_PEA_1_T16 (SEQ ID NO: 4091) | 1 | 523 |

This segment can be found in a non-coding region of transcript(s) that are related to the following protein(s): HSTFE3_PEA_1_P10.

Segment cluster HSTFE3_PEA_1_node_47 (SEQ ID NO:5065) according to the present invention is supported by 72 libraries. The number of libraries was determined as previously described. This segment can be found in the following transcript(s): HSTFE3_PEA_1_T16 (SEQ ID NO:4091). Table 4504 below describes the starting and ending position of this segment on each transcript.

TABLE 4504

Segment location on transcripts

| Transcript name | Segment starting position | Segment ending position |
|---|---|---|
| HSTFE3_PEA_1_T16 (SEQ ID NO: 4091) | 778 | 997 |

This segment can be found in the following protein(s): HSTFE3_PEA_1_P10.

Segment cluster HSTFE3_PEA_1_node_49 (SEQ ID NO:5066) according to the present invention is supported by 65 libraries. The number of libraries was determined as previously described. This segment can be found in the following transcript(s): HSTFE3_PEA_1_T16 (SEQ ID NO:4091). Table 4505 below describes the starting and ending position of this segment on each transcript.

TABLE 4505

Segment location on transcripts

| Transcript name | Segment starting position | Segment ending position |
|---|---|---|
| HSTFE3_PEA_1_T16 (SEQ ID NO: 4091) | 1107 | 1237 |

This segment can be found in the following protein(s): HSTFE3_PEA_1_P10.

Segment cluster HSTFE3_PEA_1_node_51 (SEQ ID NO:5067) according to the present invention is supported by 90 libraries. The number of libraries was determined as previously described. This segment can be found in the following transcript(s): HSTFE3_PEA_1_T16 (SEQ ID NO:4091). Table 4506 below describes the starting and ending position of this segment on each transcript.

TABLE 4506

Segment location on transcripts

| Transcript name | Segment starting position | Segment ending position |
|---|---|---|
| HSTFE3_PEA_1_T16 (SEQ ID NO: 4091) | 1329 | 1513 |

This segment can be found in a non-coding region of transcript(s) that are related to the following protein(s): HSTFE3_PEA_1_P10.

Segment cluster HSTFE3_PEA_1_node_55 (SEQ ID NO:5068) according to the present invention is supported by 163 libraries. The number of libraries was determined as previously described. This segment can be found in the following transcript(s): HSTFE3_PEA_1_T16 (SEQ ID NO:4091). Table 4507 below describes the starting and ending position of this segment on each transcript.

TABLE 4507

Segment location on transcripts

| Transcript name | Segment starting position | Segment ending position |
|---|---|---|
| HSTFE3_PEA_1_T16 (SEQ ID NO: 4091) | 1643 | 2046 |

This segment can be found in a non-coding region of transcript(s) that are related to the following protein(s): HSTFE3_PEA_1_P10.

Segment cluster HSTFE3_PEA_1_node_59 (SEQ ID NO:5069) according to the present invention is supported by 136 libraries. The number of libraries was determined as previously described. This segment can be found in the following transcript(s): HSTFE3_PEA_1_T16 (SEQ ID NO:4091). Table 4508 below describes the starting and ending position of this segment on each transcript.

TABLE 4508

Segment location on transcripts

| Transcript name | Segment starting position | Segment ending position |
|---|---|---|
| HSTFE3_PEA_1_T16 (SEQ ID NO: 4091) | 2173 | 2344 |

This segment can be found in a non-coding region of transcript(s) that are related to the following protein(s): HSTFE3_PEA_1_P10.

Segment cluster HSTFE3_PEA_1_node_60 (SEQ ID NO:5070) according to the present invention is supported by 124 libraries. The number of libraries was determined as previously described. This segment can be found in the following transcript(s): HSTFE3_PEA_1_T16 (SEQ ID NO:4091). Table 4509 below describes the starting and ending position of this segment on each transcript.

TABLE 4509

Segment location on transcripts

| Transcript name | Segment starting position | Segment ending position |
|---|---|---|
| HSTFE3_PEA_1_T16 (SEQ ID NO: 4091) | 2345 | 2553 |

This segment can be found in a non-coding region of transcript(s) that are related to the following protein(s): HSTFE3_PEA_1_P10.

According to an optional embodiment of the present invention, short segments related to the above cluster are also provided. These segments are up to about 120 bp in length, and so are included in a separate description.

Segment cluster HSTFE3_PEA_1_node_7 (SEQ ID NO:5071) according to the present invention is supported by 36 libraries. The number of libraries was determined as previously described. This segment can be found in the following transcript(s): HSTFE3_PEA_1_T22 (SEQ ID NO:4092). Table 4510 below describes the starting and ending position of this segment on each transcript.

TABLE 4510

Segment location on transcripts

| Transcript name | Segment starting position | Segment ending position |
|---|---|---|
| HSTFE3_PEA_1_T22 (SEQ ID NO: 4092) | 377 | 490 |

This segment can be found in the following protein(s): HSTFE3_PEA_1_P5.

Segment cluster HSTFE3_PEA_1_node_1 (SEQ ID NO:5072) according to the present invention can be found in the following transcript(s): HSTFE3_PEA_1_T22 (SEQ ID NO:4092). Table 4511 below describes the starting and ending position of this segment on each transcript.

TABLE 4511

Segment location on transcripts

| Transcript name | Segment starting position | Segment ending position |
|---|---|---|
| HSTFE3_PEA_1_T22 (SEQ ID NO: 4092) | 491 | 509 |

This segment can be found in the following protein(s): HSTFE3_PEA_1_P5.

Segment cluster HSTFE3_PEA_1_node_12 (SEQ ID NO:5073) according to the present invention can be found in the following transcript(s): HSTFE3_PEA_1_T22 (SEQ ID NO:4092). Table 4512 below describes the starting and ending position of this segment on each transcript.

TABLE 4512

Segment location on transcripts

| Transcript name | Segment starting position | Segment ending position |
|---|---|---|
| HSTFE3_PEA_1_T22 (SEQ ID NO: 4092) | 510 | 528 |

This segment can be found in the following protein(s): HSTFE3_PEA_1_P5.

Segment cluster HSTFE3_PEA_1_node_13 (SEQ ID NO:5074) according to the present invention is supported by 28 libraries. The number of libraries was determined as previously described. This segment can be found in the following transcript(s): HSTFE3_PEA_1_T22 (SEQ ID NO:4092). Table 4513 below describes the starting and ending position of this segment on each transcript.

TABLE 4513

Segment location on transcripts

| Transcript name | Segment starting position | Segment ending position |
|---|---|---|
| HSTFE3_PEA_1_T22 (SEQ ID NO: 4092) | 529 | 555 |

This segment can be found in the following protein(s): HSTFE3_PEA_1_P5.

Segment cluster HSTFE3_PEA_1_node_19 (SEQ ID NO:5075) according to the present invention is supported by 39 libraries. The number of libraries was determined as previously described. This segment can be found in the following transcript(s): HSTFE3_PEA_1_T22 (SEQ ID NO:4092). Table 4514 below describes the starting and ending position of this segment on each transcript.

TABLE 4514

Segment location on transcripts

| Transcript name | Segment starting position | Segment ending position |
|---|---|---|
| HSTFE3_PEA_1_T22 (SEQ ID NO: 4092) | 1041 | 1145 |

This segment can be found in the following protein(s): HSTFE3_PEA_1_P5.

Segment cluster HSTFE3_PEA_1_node_28 (SEQ ID NO:5076) according to the present invention is supported by 45 libraries. The number of libraries was determined as previously described. This segment can be found in the following transcript(s): HSTFE3_PEA_1_T22 (SEQ ID NO:4092). Table 4515 below describes the starting and ending position of this segment on each transcript.

TABLE 4515

Segment location on transcripts

| Transcript name | Segment starting position | Segment ending position |
|---|---|---|
| HSTFE3_PEA_1_T22 (SEQ ID NO: 4092) | 1146 | 1263 |

This segment can be found in the following protein(s): HSTFE3_PEA_1_P5.

Segment cluster HSTFE3_PEA_1_node_30 (SEQ ID NO:5077) according to the present invention is supported by 50 libraries. The number of libraries was determined as previously described. This segment can be found in the following transcript(s): HSTFE3_PEA_1_T22 (SEQ ID NO:4092). Table 4516 below describes the starting and ending position of this segment on each transcript.

TABLE 4516

Segment location on transcripts

| Transcript name | Segment starting position | Segment ending position |
|---|---|---|
| HSTFE3_PEA_1_T22 (SEQ ID NO: 4092) | 1264 | 1320 |

This segment can be found in the following protein(s): HSTFE3_PEA_1_P5.

Segment cluster HSTFE3_PEA_1_node_32 (SEQ ID NO:5078) according to the present invention is supported by 3 libraries. The number of libraries was determined as previously described. This segment can be found in the following transcript(s): HSTFE3_PEA_1_T22 (SEQ ID NO:4092). Table 4517 below describes the starting and ending position of this segment on each transcript.

TABLE 4517

Segment location on transcripts

| Transcript name | Segment starting position | Segment ending position |
|---|---|---|
| HSTFE3_PEA_1_T22 (SEQ ID NO: 4092) | 1480 | 1505 |

This segment can be found in a non-coding region of transcript(s) that are related to the following protein(s): HSTFE3_PEA_1_P5.

Segment cluster HSTFE3_PEA_1_node_33 (SEQ ID NO:5079) according to the present invention is supported by 44 libraries. The number of libraries was determined as previously described. This segment can be found in the following transcript(s): HSTFE3_PEA_1_T22 (SEQ ID NO:4092). Table 4518 below describes the starting and ending position of this segment on each transcript.

TABLE 4518

Segment location on transcripts

| Transcript name | Segment starting position | Segment ending position |
|---|---|---|
| HSTFE3_PEA_1_T22 (SEQ ID NO: 4092) | 1506 | 1539 |

This segment can be found in a non-coding region of transcript(s) that are related to the following protein(s): HSTFE3_PEA_1_P5.

Segment cluster HSTFE3_PEA_1_node_34 (SEQ ID NO:5080) according to the present invention is supported by 45 libraries. The number of libraries was determined as previously described. This segment can be found in the following transcript(s): HSTFE3_PEA_1_T22 (SEQ ID NO:4092). Table 4519 below describes the starting and ending position of this segment on each transcript.

TABLE 4519

| | Segment location on transcripts | |
|---|---|---|
| Transcript name | Segment starting position | Segment ending position |
| HSTFE3_PEA_1_T22 (SEQ ID NO: 4092) | 1540 | 1581 |

This segment can be found in a non-coding region of transcript(s) that are related to the following protein(s): HSTFE3_PEA_1_P5.

Segment cluster HSTFE3_PEA_1_node_42 (SEQ ID NO:5081) according to the present invention is supported by 49 libraries. The number of libraries was determined as previously described. This segment can be found in the following transcript(s): HSTFE3_PEA_1_T16 (SEQ ID NO:4091). Table 4520 below describes the starting and ending position of this segment on each transcript.

TABLE 4520

| | Segment location on transcripts | |
|---|---|---|
| Transcript name | Segment starting position | Segment ending position |
| HSTFE3_PEA_1_T16 (SEQ ID NO: 4091) | 524 | 587 |

This segment can be found in the following protein(s): HSTFE3_PEA_1_P10.

Segment cluster HSTFE3_PEA_1_node_43 (SEQ ID NO:5082) according to the present invention is supported by 54 libraries. The number of libraries was determined as previously described. This segment can be found in the following transcript(s): HSTFE3_PEA_1_T16 (SEQ ID NO:4091). Table 4521 below describes the starting and ending position of this segment on each transcript.

TABLE 4521

| | Segment location on transcripts | |
|---|---|---|
| Transcript name | Segment starting position | Segment ending position |
| HSTFE3_PEA_1_T16 (SEQ ID NO: 4091) | 588 | 671 |

This segment can be found in the following protein(s): HSTFE3_PEA_1_P10.

Segment cluster HSTFE3_PEA_1_node_45 (SEQ ID NO:5083) according to the present invention is supported by 55 libraries. The number of libraries was determined as previously described. This segment can be found in the following transcript(s): HSTFE3_PEA_1_T16 (SEQ ID NO:4091). Table 4522 below describes the starting and ending position of this segment on each transcript.

TABLE 4522

| | Segment location on transcripts | |
|---|---|---|
| Transcript name | Segment starting position | Segment ending position |
| HSTFE3_PEA_1_T16 (SEQ ID NO: 4091) | 672 | 777 |

This segment can be found in the following protein(s): HSTFE3_PEA_1_P10.

Segment cluster HSTFE3_PEA_1_node_48 (SEQ ID NO:5084) according to the present invention is supported by 57 libraries. The number of libraries was determined as previously described. This segment can be found in the following transcript(s): HSTFE3_PEA_1_T16 (SEQ ID NO:4091). Table 4523 below describes the starting and ending position of this segment on each transcript.

TABLE 4523

| | Segment location on transcripts | |
|---|---|---|
| Transcript name | Segment starting position | Segment ending position |
| HSTFE3_PEA_1_T16 (SEQ ID NO: 4091) | 998 | 1106 |

This segment can be found in the following protein(s): HSTFE3_PEA_1_P10.

Segment cluster HSTFE3_PEA_1_node_50 (SEQ ID NO:5085) according to the present invention is supported by 71 libraries. The number of libraries was determined as previously described. This segment can be found in the following transcript(s): HSTFE3_PEA_1_T16 (SEQ ID NO:4091). Table 4524 below describes the starting and ending position of this segment on each transcript.

TABLE 4524

| | Segment location on transcripts | |
|---|---|---|
| Transcript name | Segment starting position | Segment ending position |
| HSTFE3_PEA_1_T16 (SEQ ID NO: 4091) | 1238 | 1328 |

This segment can be found in a non-coding region of transcript(s) that are related to the following protein(s): HSTFE3_PEA_1_P10.

Segment cluster HSTFE3_PEA_1_node_52 (SEQ ID NO:5086) according to the present invention is supported by 87 libraries. The number of libraries was determined as previously described. This segment can be found in the following transcript(s): HSTFE3_PEA_1_T16 (SEQ ID NO:4091). Table 4525 below describes the starting and ending position of this segment on each transcript.

TABLE 4525

| | Segment location on transcripts | |
|---|---|---|
| Transcript name | Segment starting position | Segment ending position |
| HSTFE3_PEA_1_T16 (SEQ ID NO: 4091) | 1514 | 1597 |

This segment can be found in a non-coding region of transcript(s) that are related to the following protein(s): HSTFE3_PEA_1_P10.

Segment cluster HSTFE3_PEA_1_node_53 (SEQ ID NO:5087) according to the present invention is supported by 83 libraries. The number of libraries was determined as previously described. This segment can be found in the following transcript(s): HSTFE3_PEA_1_T16 (SEQ ID NO:4091).

Table 4526 below describes the starting and ending position of this segment on each transcript.

TABLE 4526

Segment location on transcripts

| Transcript name | Segment starting position | Segment ending position |
|---|---|---|
| HSTFE3_PEA_1_T16 (SEQ ID NO: 4091) | 1598 | 1637 |

This segment can be found in a non-coding region of transcript(s) that are related to the following protein(s): HSTFE3_PEA_1_P10.

Segment cluster HSTFE3_PEA_1_node_54 (SEQ ID NO:5088) according to the present invention can be found in the following transcript(s): HSTFE3_PEA_1_T16 (SEQ ID NO:4091). Table 4527 below describes the starting and ending position of this segment on each transcript.

TABLE 4527

Segment location on transcripts

| Transcript name | Segment starting position | Segment ending position |
|---|---|---|
| HSTFE3_PEA_1_T16 (SEQ ID NO: 4091) | 1638 | 1642 |

This segment can be found in a non-coding region of transcript(s) that are related to the following protein(s): HSTFE3_PEA_1_P10.

Segment cluster HSTFE3_PEA_1_node_56 (SEQ ID NO:5089) according to the present invention is supported by 107 libraries. The number of libraries was determined as previously described. This segment can be found in the following transcript(s): HSTFE3_PEA_1_T16 (SEQ ID NO:4091). Table 4528 below describes the starting and ending position of this segment on each transcript.

TABLE 4528

Segment location on transcripts

| Transcript name | Segment starting position | Segment ending position |
|---|---|---|
| HSTFE3_PEA_1_T16 (SEQ ID NO: 4091) | 2047 | 2085 |

This segment can be found in a non-coding region of transcript(s) that are related to the following protein(s): HSTFE3_PEA_1_P10.

Segment cluster HSTFE3_PEA_1_node_57 (SEQ ID NO:5090) according to the present invention is supported by 107 libraries. The number of libraries was determined as previously described. This segment can be found in the following transcript(s): HSTFE3_PEA_1_T16 (SEQ ID NO:4091). Table 4529 below describes the starting and ending position of this segment on each transcript.

TABLE 4529

Segment location on transcripts

| Transcript name | Segment starting position | Segment ending position |
|---|---|---|
| HSTFE3_PEA_1_T16 (SEQ ID NO: 4091) | 2086 | 2151 |

This segment can be found in a non-coding region of transcript(s) that are related to the following protein(s): HSTFE3_PEA_1_P10.

Segment cluster HSTFE3_PEA_1_node_58 (SEQ ID NO:5091) according to the present invention can be found in the following transcript(s): HSTFE3_PEA_1_T16 (SEQ ID NO:4091). Table 4530 below describes the starting and ending position of this segment on each transcript.

TABLE 4530

Segment location on transcripts

| Transcript name | Segment starting position | Segment ending position |
|---|---|---|
| HSTFE3_PEA_1_T16 (SEQ ID NO: 4091) | 2152 | 2172 |

This segment can be found in a non-coding region of transcript(s) that are related to the following protein(s): HSTFE3_PEA_1_P10.

Description for Cluster HUMANFB

Cluster HUMANFB features 7 transcript(s) and 44 segment(s) of interest, the names for which are given in Tables 4531 and 4532, respectively, the sequences themselves are given at the end of the application. The selected protein variants are given in Table 4533.

TABLE 4531

Transcripts of interest
Transcript Name

HUMANFB_PEA_1_T24 (SEQ ID NO: 4093)
HUMANFB_PEA_1_T26 (SEQ ID NO: 4094)
HUMANFB_PEA_1_T29 (SEQ ID NO: 4095)
HUMANFB_PEA_1_T34 (SEQ ID NO: 4096)
HUMANFB_PEA_1_T35 (SEQ ID NO: 4097)
HUMANFB_PEA_1_T40 (SEQ ID NO: 4098)
HUMANFB_PEA_1_T45 (SEQ ID NO: 4099)

TABLE 4532

Segments of interest
Segment Name

HUMANFB_PEA_1_node_0 (SEQ ID NO: 5092)
HUMANFB_PEA_1_node_24 (SEQ ID NO: 5093)
HUMANFB_PEA_1_node_39 (SEQ ID NO: 5094)
HUMANFB_PEA_1_node_47 (SEQ ID NO: 5095)
HUMANFB_PEA_1_node_49 (SEQ ID NO: 5096)
HUMANFB_PEA_1_node_51 (SEQ ID NO: 5097)
HUMANFB_PEA_1_node_55 (SEQ ID NO: 5098)
HUMANFB_PEA_1_node_57 (SEQ ID NO: 5099)
HUMANFB_PEA_1_node_60 (SEQ ID NO: 5100)
HUMANFB_PEA_1_node_64 (SEQ ID NO: 5101)
HUMANFB_PEA_1_node_65 (SEQ ID NO: 5102)
HUMANFB_PEA_1_node_71 (SEQ ID NO: 5103)

TABLE 4532-continued

Segments of interest
Segment Name

HUMANFB_PEA_1_node_72 (SEQ ID NO: 5104)
HUMANFB_PEA_1_node_73 (SEQ ID NO: 5105)
HUMANFB_PEA_1_node_80 (SEQ ID NO: 5106)
HUMANFB_PEA_1_node_83 (SEQ ID NO: 5107)
HUMANFB_PEA_1_node_93 (SEQ ID NO: 5108)
HUMANFB_PEA_1_node_95 (SEQ ID NO: 5109)
HUMANFB_PEA_1_node_4 (SEQ ID NO: 5110)
HUMANFB_PEA_1_node_6 (SEQ ID NO: 5111)
HUMANFB_PEA_1_node_8 (SEQ ID NO: 5112)
HUMANFB_PEA_1_node_9 (SEQ ID NO: 5113)
HUMANFB_PEA_1_node_11 (SEQ ID NO: 5114)
HUMANFB_PEA_1_node_12 (SEQ ID NO: 5115)
HUMANFB_PEA_1_node_17 (SEQ ID NO: 5116)
HUMANFB_PEA_1_node_18 (SEQ ID NO: 5117)
HUMANFB_PEA_1_node_26 (SEQ ID NO: 5118)
HUMANFB_PEA_1_node_28 (SEQ ID NO: 5119)
HUMANFB_PEA_1_node_31 (SEQ ID NO: 5120)
HUMANFB_PEA_1_node_32 (SEQ ID NO: 5121)
HUMANFB_PEA_1_node_35 (SEQ ID NO: 5122)
HUMANFB_PEA_1_node_38 (SEQ ID NO: 5123)
HUMANFB_PEA_1_node_41 (SEQ ID NO: 5124)
HUMANFB_PEA_1_node_42 (SEQ ID NO: 5125)
HUMANFB_PEA_1_node_53 (SEQ ID NO: 5126)
HUMANFB_PEA_1_node_59 (SEQ ID NO: 5127)
HUMANFB_PEA_1_node_62 (SEQ ID NO: 5128)
HUMANFB_PEA_1_node_68 (SEQ ID NO: 5129)
HUMANFB_PEA_1_node_69 (SEQ ID NO: 5130)
HUMANFB_PEA_1_node_70 (SEQ ID NO: 5131)
HUMANFB_PEA_1_node_77 (SEQ ID NO: 5132)
HUMANFB_PEA_1_node_78 (SEQ ID NO: 5133)
HUMANFB_PEA_1_node_92 (SEQ ID NO: 5134)
HUMANFB_PEA_1_node_94 (SEQ ID NO: 5135)

TABLE 4533

Proteins of interest

| Protein Name | Corresponding Transcript(s) |
|---|---|
| HUMANFB_PEA_1_P1 | HUMANFB_PEA_1_T24 (SEQ ID NO: 4093); HUMANFB_PEA_1_T26 (SEQ ID NO: 4094); HUMANFB_PEA_1_T29 (SEQ ID NO: 4095); HUMANFB_PEA_1_T34 (SEQ ID NO: 4096); HUMANFB_PEA_1_T35 (SEQ ID NO: 4097) |
| HUMANFB_PEA_1_P17 | HUMANFB_PEA_1_T40 (SEQ ID NO: 4098) |
| HUMANFB_PEA_1_P12 | HUMANFB_PEA_1_T45 (SEQ ID NO: 4099) |

These sequences are variants of the known protein Chloride channel protein 6 (SwissProt accession identifier CLC6_HUMAN; known also according to the synonyms ClC-6), referred to herein as the previously known protein.

Protein Chloride channel protein 6 is known or believed to have the following function(s): Voltage-gated chloride channel. Chloride channels have several functions including the regulation of cell volume; membrane potential stabilization, signal transduction and transepithelial transport. The sequence for protein Chloride channel protein 6 is given at the end of the application, as "Chloride channel protein 6 amino acid sequence". Known polymorphisms for this sequence are as shown in Table 4534.

TABLE 4534

Amino acid mutations for Known Protein

| SNP position(s) on amino acid sequence | Comment |
|---|---|
| 198 | G -> E |

Protein Chloride channel protein 6 localization is believed to be Integral membrane protein.

The following GO Annotation(s) apply to the previously known protein. The following annotation(s) were found: transport; ion transport; chloride transport; cell volume regulation; signal transduction, which are annotation(s) related to Biological Process; voltage-gated chloride channel, which are annotation(s) related to Molecular Function; and membrane fraction; integral plasma membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster HUMANFB. Predictions were made for selective expression of transcripts of this contig in heart tissue, according to the previously described methods. The numbers on the y-axis of FIG. 117 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 117, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 19.3; the ratio of expression of the cluster in heart specific ESTs to the overall expression of the cluster in muscle-specific ESTs which was found to be 370.1; and fisher exact test P-values were computed both for library and weighted clone counts to check that the counts are statistically significant, and were found to be 6.40E-102.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 19.3, which clearly supports specific expression in heart tissue.

As noted above, cluster HUMANFB features 44 segment(s), which were listed in Table 4532 above and for which the sequence(s) are given at the end of the application. These segment(s) are portions of nucleic acid sequence(s) which are described herein separately because they are of particular interest. A description of each segment according to the present invention is now provided.

Segment cluster HUMANFB_PEA_1_node_0 (SEQ ID NO:5092) according to the present invention is supported by 23 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4535 below describes the starting and ending position of this segment on each transcript.

TABLE 4535

Segment location on transcripts

| Transcript name | Segment starting position | Segment ending position |
| --- | --- | --- |
| HUMANFB_PEA_1_T24 (SEQ ID NO: 4093) | 1 | 159 |
| HUMANFB_PEA_1_T26 (SEQ ID NO: 4094) | 1 | 159 |
| HUMANFB_PEA_1_T29 (SEQ ID NO: 4095) | 1 | 159 |
| HUMANFB_PEA_1_T34 (SEQ ID NO: 4096) | 1 | 159 |
| HUMANFB_PEA_1_T35 (SEQ ID NO: 4097) | 1 | 159 |
| HUMANFB_PEA_1_T40 (SEQ ID NO: 4098) | 1 | 159 |
| HUMANFB_PEA_1_T45 (SEQ ID NO: 4099) | 1 | 159 |

This segment can be found in the following protein(s): HUMANFB_PEA_1_P1, HUMANFB_PEA_1_P17 and HUMANFB_PEA_1_P12.

Segment cluster HUMANFB_PEA_1_node_24 (SEQ ID NO:5093) according to the present invention is supported by 29 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4536 below describes the starting and ending position of this segment on each transcript.

TABLE 4536

Segment location on transcripts

| Transcript name | Segment starting position | Segment ending position |
| --- | --- | --- |
| HUMANFB_PEA_1_T24 (SEQ ID NO: 4093) | 526 | 652 |
| HUMANFB_PEA_1_T26 (SEQ ID NO: 4094) | 526 | 652 |
| HUMANFB_PEA_1_T29 (SEQ ID NO: 4095) | 526 | 652 |
| HUMANFB_PEA_1_T34 (SEQ ID NO: 4096) | 526 | 652 |
| HUMANFB_PEA_1_T35 (SEQ ID NO: 4097) | 526 | 652 |
| HUMANFB_PEA_1_T40 (SEQ ID NO: 4098) | 526 | 652 |
| HUMANFB_PEA_1_T45 (SEQ ID NO: 4099) | 526 | 652 |

This segment can be found in the following protein(s): HUMANFB_PEA_1_P1, HUMANFB_PEA_1_P17 and HUMANFB_PEA_1_P12.

Segment cluster HUMANFB_PEA_1_node_39 (SEQ ID NO:5094) according to the present invention is supported by 28 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4537 below describes the starting and ending position of this segment on each transcript.

TABLE 4537

Segment location on transcripts

| Transcript name | Segment starting position | Segment ending position |
| --- | --- | --- |
| HUMANFB_PEA_1_T24 (SEQ ID NO: 4093) | 1064 | 1193 |
| HUMANFB_PEA_1_T26 (SEQ ID NO: 4094) | 1064 | 1193 |
| HUMANFB_PEA_1_T29 (SEQ ID NO: 4095) | 1064 | 1193 |
| HUMANFB_PEA_1_T34 (SEQ ID NO: 4096) | 1064 | 1193 |
| HUMANFB_PEA_1_T35 (SEQ ID NO: 4097) | 1064 | 1193 |
| HUMANFB_PEA_1_T40 (SEQ ID NO: 4098) | 1064 | 1193 |
| HUMANFB_PEA_1_T45 (SEQ ID NO: 4099) | 1064 | 1193 |

This segment can be found in the following protein(s): HUMANFB_PEA_1_P1, HUMANFB_PEA_1_P17 and HUMANFB_PEA_1_P12.

Segment cluster HUMANFB_PEA_1_node_47 (SEQ ID NO:5095) according to the present invention is supported by 37 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4538 below describes the starting and ending position of this segment on each transcript.

TABLE 4538

Segment location on transcripts

| Transcript name | Segment starting position | Segment ending position |
| --- | --- | --- |
| HUMANFB_PEA_1_T24 (SEQ ID NO: 4093) | 1321 | 1444 |
| HUMANFB_PEA_1_T26 (SEQ ID NO: 4094) | 1321 | 1444 |
| HUMANFB_PEA_1_T29 (SEQ ID NO: 4095) | 1321 | 1444 |
| HUMANFB_PEA_1_T34 (SEQ ID NO: 4096) | 1321 | 1444 |
| HUMANFB_PEA_1_T35 (SEQ ID NO: 4097) | 1321 | 1444 |
| HUMANFB_PEA_1_T40 (SEQ ID NO: 4098) | 1321 | 1444 |
| HUMANFB_PEA_1_T45 (SEQ ID NO: 4099) | 1321 | 1444 |

This segment can be found in the following protein(s): HUMANFB_PEA_1_P1, HUMANFB_PEA_1_P17 and HUMANFB_PEA_1_P12.

Segment cluster HUMANFB_PEA_1_node_49 (SEQ ID NO:5096) according to the present invention is supported by 37 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4539 below describes the starting and ending position of this segment on each transcript.

TABLE 4539

Segment location on transcripts

| Transcript name | Segment starting position | Segment ending position |
|---|---|---|
| HUMANFB_PEA_1_T24 (SEQ ID NO: 4093) | 1445 | 1598 |
| HUMANFB_PEA_1_T26 (SEQ ID NO: 4094) | 1445 | 1598 |
| HUMANFB_PEA_1_T29 (SEQ ID NO: 4095) | 1445 | 1598 |
| HUMANFB_PEA_1_T34 (SEQ ID NO: 4096) | 1445 | 1598 |
| HUMANFB_PEA_1_T35 (SEQ ID NO: 4097) | 1445 | 1598 |
| HUMANFB_PEA_1_T40 (SEQ ID NO: 4098) | 1445 | 1598 |
| HUMANFB_PEA_1_T45 (SEQ ID NO: 4099) | 1445 | 1598 |

This segment can be found in the following protein(s): HUMANFB_PEA_1_P1, HUMANFB_PEA_1_P17 and HUMANFB_PEA_1_P12.

Segment cluster HUMANFB_PEA_1_node_51 (SEQ ID NO:5097) according to the present invention is supported by 35 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4540 below describes the starting and ending position of this segment on each transcript.

TABLE 4540

Segment location on transcripts

| Transcript name | Segment starting position | Segment ending position |
|---|---|---|
| HUMANFB_PEA_1_T24 (SEQ ID NO: 4093) | 1599 | 1758 |
| HUMANFB_PEA_1_T26 (SEQ ID NO: 4094) | 1599 | 1758 |
| HUMANFB_PEA_1_T29 (SEQ ID NO: 4095) | 1599 | 1758 |
| HUMANFB_PEA_1_T34 (SEQ ID NO: 4096) | 1599 | 1758 |
| HUMANFB_PEA_1_T35 (SEQ ID NO: 4097) | 1599 | 1758 |
| HUMANFB_PEA_1_T40 (SEQ ID NO: 4098) | 1599 | 1758 |
| HUMANFB_PEA_1_T45 (SEQ ID NO: 4099) | 1599 | 1758 |

This segment can be found in the following protein(s): HUMANFB_PEA_1_P1, HUMANFB_PEA_1_P17 and HUMANFB_PEA_1_P12.

Segment cluster HUMANFB_PEA_1_node_55 (SEQ ID NO:5098) according to the present invention is supported by 36 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4541 below describes the starting and ending position of this segment on each transcript.

TABLE 4541

Segment location on transcripts

| Transcript name | Segment starting position | Segment ending position |
|---|---|---|
| HUMANFB_PEA_1_T24 (SEQ ID NO: 4093) | 1866 | 2052 |
| HUMANFB_PEA_1_T26 (SEQ ID NO: 4094) | 1866 | 2052 |
| HUMANFB_PEA_1_T29 (SEQ ID NO: 4095) | 1866 | 2052 |
| HUMANFB_PEA_1_T34 (SEQ ID NO: 4096) | 1866 | 2052 |
| HUMANFB_PEA_1_T35 (SEQ ID NO: 4097) | 1866 | 2052 |
| HUMANFB_PEA_1_T40 (SEQ ID NO: 4098) | 1866 | 2052 |
| HUMANFB_PEA_1_T45 (SEQ ID NO: 4099) | 1866 | 2052 |

This segment can be found in the following protein(s): HUMANFB_PEA_1_P1, HUMANFB_PEA_1_P17 and HUMANFB_PEA_1_P12.

Segment cluster HUMANFB_PEA_1_node_57 (SEQ ID NO:5099) according to the present invention is supported by 39 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4542 below describes the starting and ending position of this segment on each transcript.

TABLE 4542

Segment location on transcripts

| Transcript name | Segment starting position | Segment ending position |
|---|---|---|
| HUMANFB_PEA_1_T24 (SEQ ID NO: 4093) | 2053 | 2210 |
| HUMANFB_PEA_1_T26 (SEQ ID NO: 4094) | 2053 | 2210 |
| HUMANFB_PEA_1_T29 (SEQ ID NO: 4095) | 2053 | 2210 |
| HUMANFB_PEA_1_T34 (SEQ ID NO: 4096) | 2053 | 2210 |
| HUMANFB_PEA_1_T35 (SEQ ID NO: 4097) | 2053 | 2210 |
| HUMANFB_PEA_1_T40 (SEQ ID NO: 4098) | 2053 | 2210 |
| HUMANFB_PEA_1_T45 (SEQ ID NO: 4099) | 2053 | 2210 |

This segment can be found in the following protein(s): HUMANFB_PEA_1_P1, HUMANFB_PEA_1_P17 and HUMANFB_PEA_1_P12.

Segment cluster HUMANFB_PEA_1_node_60 (SEQ ID NO:5100) according to the present invention is supported by 34 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4543 below describes the starting and ending position of this segment on each transcript.

TABLE 4543

Segment location on transcripts

| Transcript name | Segment starting position | Segment ending position |
|---|---|---|
| HUMANFB_PEA_1_T24 (SEQ ID NO: 4093) | 2245 | 2367 |
| HUMANFB_PEA_1_T26 (SEQ ID NO: 4094) | 2245 | 2367 |
| HUMANFB_PEA_1_T29 (SEQ ID NO: 4095) | 2245 | 2367 |
| HUMANFB_PEA_1_T34 (SEQ ID NO: 4096) | 2245 | 2367 |
| HUMANFB_PEA_1_T35 (SEQ ID NO: 4097) | 2245 | 2367 |
| HUMANFB_PEA_1_T40 (SEQ ID NO: 4098) | 2245 | 2367 |
| HUMANFB_PEA_1_T45 (SEQ ID NO: 4099) | 2211 | 2333 |

This segment can be found in the following protein(s): HUMANFB_PEA_1_P1, HUMANFB_PEA_1_P17 and HUMANFB_PEA_1_P12.

Segment cluster HUMANFB_PEA_1_node_64 (SEQ ID NO:5101) according to the present invention is supported by 30 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4544 below describes the starting and ending position of this segment on each transcript.

TABLE 4544

Segment location on transcripts

| Transcript name | Segment starting position | Segment ending position |
|---|---|---|
| HUMANFB_PEA_1_T24 (SEQ ID NO: 4093) | 2476 | 2601 |
| HUMANFB_PEA_1_T26 (SEQ ID NO: 4094) | 2476 | 2601 |
| HUMANFB_PEA_1_T29 (SEQ ID NO: 4095) | 2476 | 2601 |
| HUMANFB_PEA_1_T34 (SEQ ID NO: 4096) | 2476 | 2601 |
| HUMANFB_PEA_1_T35 (SEQ ID NO: 4097) | 2476 | 2601 |
| HUMANFB_PEA_1_T40 (SEQ ID NO: 4098) | 2476 | 2601 |
| HUMANFB_PEA_1_T45 (SEQ ID NO: 4099) | 2442 | 2567 |

This segment can be found in both coding and non-coding regions of transcript(s) as follows. The segment can be found in a non-coding region of transcript(s) that are related to the following protein(s): HUMANFB_PEA_1_P12. This segment can also be found in the following protein(s): HUMANFB_PEA_1_P1 and HUMANFB_PEA_1_P17, since it is in the coding region for the corresponding transcript.

Segment cluster HUMANFB_PEA_1_node_65 (SEQ ID NO:5102) according to the present invention is supported by 3 libraries. The number of libraries was determined as previously described. This segment can be found in the following transcript(s): HUMANFB_PEA_1_T40 (SEQ ID NO:4098) and HUMANFB_PEA_1_T45 (SEQ ID NO:4099). Table 4545 below describes the starting and ending position of this segment on each transcript.

TABLE 4545

Segment location on transcripts

| Transcript name | Segment starting position | Segment ending position |
|---|---|---|
| HUMANFB_PEA_1_T40 (SEQ ID NO: 4098) | 2602 | 2992 |
| HUMANFB_PEA_1_T45 (SEQ ID NO: 4099) | 2568 | 2958 |

This segment can be found in both coding and non-coding regions of transcript(s) as follows. The segment can be found in a non-coding region of transcript(s) that are related to the following protein(s): HUMANFB_PEA_1_P12. This segment can also be found in the following protein(s): HUMANFB_PEA_1_P17, since it is in the coding region for the corresponding transcript.

Segment cluster HUMANFB_PEA_1_node_71 (SEQ ID NO:5103) according to the present invention is supported by 31 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4546 below describes the starting and ending position of this segment on each transcript.

TABLE 4546

Segment location on transcripts

| Transcript name | Segment starting position | Segment ending position |
|---|---|---|
| HUMANFB_PEA_1_T24 (SEQ ID NO: 4093) | 2684 | 2945 |
| HUMANFB_PEA_1_T26 (SEQ ID NO: 4094) | 2684 | 2945 |
| HUMANFB_PEA_1_T29 (SEQ ID NO: 4095) | 2684 | 2945 |
| HUMANFB_PEA_1_T34 (SEQ ID NO: 4096) | 2684 | 2945 |
| HUMANFB_PEA_1_T35 (SEQ ID NO: 4097) | 2684 | 2945 |

This segment can be found in a non-coding region of transcript(s) that are related to the following protein(s): HUMANFB_PEA_1_P1.

Segment cluster HUMANFB_PEA_1_node_72 (SEQ ID NO:5104) according to the present invention is supported by 46 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4547 below describes the starting and ending position of this segment on each transcript.

TABLE 4547

Segment location on transcripts

| Transcript name | Segment starting position | Segment ending position |
|---|---|---|
| HUMANFB_PEA_1_T24 (SEQ ID NO: 4093) | 2946 | 3666 |
| HUMANFB_PEA_1_T26 (SEQ ID NO: 4094) | 2946 | 3666 |
| HUMANFB_PEA_1_T29 (SEQ ID NO: 4095) | 2946 | 3666 |
| HUMANFB_PEA_1_T34 (SEQ ID NO: 4096) | 2946 | 3666 |
| HUMANFB_PEA_1_T35 (SEQ ID NO: 4097) | 2946 | 3666 |

This segment can be found in a non-coding region of transcript(s) that are related to the following protein(s): HUMANFB_PEA_1_P1.

Segment cluster HUMANFB_PEA_1_node_73 (SEQ ID NO:5105) according to the present invention is supported by 114 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094) and HUMANFB_PEA_1_T29 (SEQ ID NO:4095). Table 4548 below describes the starting and ending position of this segment on each transcript.

TABLE 4548

Segment location on transcripts

| Transcript name | Segment starting position | Segment ending position |
|---|---|---|
| HUMANFB_PEA_1_T24 (SEQ ID NO: 4093) | 3667 | 5076 |
| HUMANFB_PEA_1_T26 (SEQ ID NO: 4094) | 3667 | 5076 |
| HUMANFB_PEA_1_T29 (SEQ ID NO: 4095) | 3667 | 5076 |

This segment can be found in a non-coding region of transcript(s) that are related to the following protein(s): HUMANFB_PEA_1_P1.

Segment cluster HUMANFB_PEA_1_node_80 (SEQ ID NO:5106) according to the present invention is supported by 8 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095) and HUMANFB_PEA_1_T34 (SEQ ID NO:4096). Table 4549 below describes the starting and ending position of this segment on each transcript.

TABLE 4549

Segment location on transcripts

| Transcript name | Segment starting position | Segment ending position |
|---|---|---|
| HUMANFB_PEA_1_T24 (SEQ ID NO: 4093) | 5111 | 5416 |
| HUMANFB_PEA_1_T26 (SEQ ID NO: 4094) | 5111 | 5416 |
| HUMANFB_PEA_1_T29 (SEQ ID NO: 4095) | 5111 | 5416 |
| HUMANFB_PEA_1_T34 (SEQ ID NO: 4096) | 3731 | 4036 |

This segment can be found in a non-coding region of transcript(s) that are related to the following protein(s): HUMANFB_PEA_1_P1.

Segment cluster HUMANFB_PEA_1_node_83 (SEQ ID NO:5107) according to the present invention is supported by 16 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4550 below describes the starting and ending position of this segment on each transcript.

TABLE 4550

Segment location on transcripts

| Transcript name | Segment starting position | Segment ending position |
|---|---|---|
| HUMANFB_PEA_1_T24 (SEQ ID NO: 4093) | 5417 | 5636 |
| HUMANFB_PEA_1_T26 (SEQ ID NO: 4094) | 5417 | 5636 |
| HUMANFB_PEA_1_T29 (SEQ ID NO: 4095) | 5417 | 5636 |

TABLE 4550-continued

Segment location on transcripts

| Transcript name | Segment starting position | Segment ending position |
|---|---|---|
| HUMANFB_PEA_1_T34 (SEQ ID NO: 4096) | 4037 | 4256 |
| HUMANFB_PEA_1_T35 (SEQ ID NO: 4097) | 3667 | 3886 |

This segment can be found in a non-coding region of transcript(s) that are related to the following protein(s): HUMANFB_PEA_1_P1.

Segment cluster HUMANFB_PEA_1_node_93 (SEQ ID NO:5108) according to the present invention is supported by 12 libraries. The number of libraries was determined as previously described. This segment can be found in the following transcript(s): HUMANFB_PEA_1_T24 (SEQ ID NO:4093) and HUMANFB_PEA_1_T34 (SEQ ID NO:4096). Table 4551 below describes the starting and ending position of this segment on each transcript.

TABLE 4551

Segment location on transcripts

| Transcript name | Segment starting position | Segment ending position |
|---|---|---|
| HUMANFB_PEA_1_T24 (SEQ ID NO: 4093) | 5643 | 5764 |
| HUMANFB_PEA_1_T34 (SEQ ID NO: 4096) | 4263 | 4384 |

This segment can be found in a non-coding region of transcript(s) that are related to the following protein(s): HUMANFB_PEA_1_P1.

Segment cluster HUMANFB_PEA_1_node_95 (SEQ ID NO:5109) according to the present invention is supported by 41 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4552 below describes the starting and ending position of this segment on each transcript.

TABLE 4552

Segment location on transcripts

| Transcript name | Segment starting position | Segment ending position |
|---|---|---|
| HUMANFB_PEA_1_T24 (SEQ ID NO: 4093) | 5780 | 6282 |
| HUMANFB_PEA_1_T26 (SEQ ID NO: 4094) | 5637 | 6139 |
| HUMANFB_PEA_1_T29 (SEQ ID NO: 4095) | 5637 | 6191 |
| HUMANFB_PEA_1_T34 (SEQ ID NO: 4096) | 4400 | 4902 |
| HUMANFB_PEA_1_T35 (SEQ ID NO: 4097) | 3887 | 4389 |

This segment can be found in a non-coding region of transcript(s) that are related to the following protein(s): HUMANFB_PEA_1_P1.

According to an optional embodiment of the present invention, short segments related to the above cluster are also provided. These segments are up to about 120 bp in length, and so are included in a separate description.

Segment cluster HUMANFB_PEA_1_node_4 (SEQ ID NO:5110) according to the present invention is supported by 27 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4553 below describes the starting and ending position of this segment on each transcript.

TABLE 4553

Segment location on transcripts

| Transcript name | Segment starting position | Segment ending position |
|---|---|---|
| HUMANFB_PEA_1_T24 (SEQ ID NO: 4093) | 160 | 219 |
| HUMANFB_PEA_1_T26 (SEQ ID NO: 4094) | 160 | 219 |
| HUMANFB_PEA_1_T29 (SEQ ID NO: 4095) | 160 | 219 |
| HUMANFB_PEA_1_T34 (SEQ ID NO: 4096) | 160 | 219 |
| HUMANFB_PEA_1_T35 (SEQ ID NO: 4097) | 160 | 219 |
| HUMANFB_PEA_1_T40 (SEQ ID NO: 4098) | 160 | 219 |
| HUMANFB_PEA_1_T45 (SEQ ID NO: 4099) | 160 | 219 |

This segment can be found in the following protein(s): HUMANFB_PEA_1_P1, HUMANFB_PEA_1_P17 and HUMANFB_PEA_1_P12.

Segment cluster HUMANFB_PEA_1_node_6 (SEQ ID NO:5111) according to the present invention is supported by 27 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4554 below describes the starting and ending position of this segment on each transcript.

TABLE 4554

Segment location on transcripts

| Transcript name | Segment starting position | Segment ending position |
|---|---|---|
| HUMANFB_PEA_1_T24 (SEQ ID NO: 4093) | 220 | 285 |
| HUMANFB_PEA_1_T26 (SEQ ID NO: 4094) | 220 | 285 |
| HUMANFB_PEA_1_T29 (SEQ ID NO: 4095) | 220 | 285 |
| HUMANFB_PEA_1_T34 (SEQ ID NO: 4096) | 220 | 285 |
| HUMANFB_PEA_1_T35 (SEQ ID NO: 4097) | 220 | 285 |

TABLE 4554-continued

Segment location on transcripts

| Transcript name | Segment starting position | Segment ending position |
|---|---|---|
| HUMANFB_PEA_1_T40 (SEQ ID NO: 4098) | 220 | 285 |
| HUMANFB_PEA_1_T45 (SEQ ID NO: 4099) | 220 | 285 |

This segment can be found in the following protein(s): HUMANFB_PEA_1_P1, HUMANFB_PEA_1_P17 and HUMANFB_PEA_1_P12.

Segment cluster HUMANFB_PEA_1_node_8 (SEQ ID NO:5112) according to the present invention can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4555 below describes the starting and ending position of this segment on each transcript.

TABLE 4555

Segment location on transcripts

| Transcript name | Segment starting position | Segment ending position |
|---|---|---|
| HUMANFB_PEA_1_T24 (SEQ ID NO: 4093) | 286 | 289 |
| HUMANFB_PEA_1_T26 (SEQ ID NO: 4094) | 286 | 289 |
| HUMANFB_PEA_1_T29 (SEQ ID NO: 4095) | 286 | 289 |
| HUMANFB_PEA_1_T34 (SEQ ID NO: 4096) | 286 | 289 |
| HUMANFB_PEA_1_T35 (SEQ ID NO: 4097) | 286 | 289 |
| HUMANFB_PEA_1_T40 (SEQ ID NO: 4098) | 286 | 289 |
| HUMANFB_PEA_1_T45 (SEQ ID NO: 4099) | 286 | 289 |

This segment can be found in the following protein(s): HUMANFB_PEA_1_P1, HUMANFB_PEA_1_P17 and HUMANFB_PEA_1_P12.

Segment cluster HUMANFB_PEA_1_node_9 (SEQ ID NO:5113) according to the present invention is supported by 26 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4556 below describes the starting and ending position of this segment on each transcript.

TABLE 4556

Segment location on transcripts

| Transcript name | Segment starting position | Segment ending position |
|---|---|---|
| HUMANFB_PEA_1_T24 (SEQ ID NO: 4093) | 290 | 351 |
| HUMANFB_PEA_1_T26 (SEQ ID NO: 4094) | 290 | 351 |
| HUMANFB_PEA_1_T29 (SEQ ID NO: 4095) | 290 | 351 |
| HUMANFB_PEA_1_T34 (SEQ ID NO: 4096) | 290 | 351 |
| HUMANFB_PEA_1_T35 (SEQ ID NO: 4097) | 290 | 351 |
| HUMANFB_PEA_1_T40 (SEQ ID NO: 4098) | 290 | 351 |
| HUMANFB_PEA_1_T45 (SEQ ID NO: 4099) | 290 | 351 |

This segment can be found in the following protein(s): HUMANFB_PEA_1_P1, HUMANFB_PEA_1_P17 and HUMANFB_PEA_1_P12.

Segment cluster HUMANFB_PEA_1_node_11 (SEQ ID NO:5114) according to the present invention is supported by 29 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4557 below describes the starting and ending position of this segment on each transcript.

TABLE 4557

Segment location on transcripts

| Transcript name | Segment starting position | Segment ending position |
|---|---|---|
| HUMANFB_PEA_1_T24 (SEQ ID NO: 4093) | 352 | 414 |
| HUMANFB_PEA_1_T26 (SEQ ID NO: 4094) | 352 | 414 |
| HUMANFB_PEA_1_T29 (SEQ ID NO: 4095) | 352 | 414 |
| HUMANFB_PEA_1_T34 (SEQ ID NO: 4096) | 352 | 414 |
| HUMANFB_PEA_1_T35 (SEQ ID NO: 4097) | 352 | 414 |
| HUMANFB_PEA_1_T40 (SEQ ID NO: 4098) | 352 | 414 |
| HUMANFB_PEA_1_T45 (SEQ ID NO: 4099) | 352 | 414 |

This segment can be found in the following protein(s): HUMANFB_PEA_1_P1, HUMANFB_PEA_1_P17 and HUMANFB_PEA_1_P12.

Segment cluster HUMANFB_PEA_1_node_12 (SEQ ID NO:5115) according to the present invention can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4558 below describes the starting and ending position of this segment on each transcript.

TABLE 4558

Segment location on transcripts

| Transcript name | Segment starting position | Segment ending position |
|---|---|---|
| HUMANFB_PEA_1_T24 (SEQ ID NO: 4093) | 415 | 418 |
| HUMANFB_PEA_1_T26 (SEQ ID NO: 4094) | 415 | 418 |
| HUMANFB_PEA_1_T29 (SEQ ID NO: 4095) | 415 | 418 |
| HUMANFB_PEA_1_T34 (SEQ ID NO: 4096) | 415 | 418 |
| HUMANFB_PEA_1_T35 (SEQ ID NO: 4097) | 415 | 418 |
| HUMANFB_PEA_1_T40 (SEQ ID NO: 4098) | 415 | 418 |
| HUMANFB_PEA_1_T45 (SEQ ID NO: 4099) | 415 | 418 |

This segment can be found in the following protein(s): HUMANFB_PEA_1_P1, HUMANFB_PEA_1_P17 and HUMANFB_PEA_1_P12.

Segment cluster HUMANFB_PEA_1_node_17 (SEQ ID NO:5116) according to the present invention is supported by 26 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4559 below describes the starting and ending position of this segment on each transcript.

TABLE 4559

Segment location on transcripts

| Transcript name | Segment starting position | Segment ending position |
|---|---|---|
| HUMANFB_PEA_1_T24 (SEQ ID NO: 4093) | 419 | 488 |
| HUMANFB_PEA_1_T26 (SEQ ID NO: 4094) | 419 | 488 |
| HUMANFB_PEA_1_T29 (SEQ ID NO: 4095) | 419 | 488 |
| HUMANFB_PEA_1_T34 (SEQ ID NO: 4096) | 419 | 488 |
| HUMANFB_PEA_1_T35 (SEQ ID NO: 4097) | 419 | 488 |
| HUMANFB_PEA_1_T40 (SEQ ID NO: 4098) | 419 | 488 |
| HUMANFB_PEA_1_T45 (SEQ ID NO: 4099) | 419 | 488 |

This segment can be found in the following protein(s): HUMANFB_PEA_1_P1, HUMANFB_PEA_1_P17 and HUMANFB_PEA_1_P12.

Segment cluster HUMANFB_PEA_1_node_18 (SEQ ID NO:5117) according to the present invention is supported by 26 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4560 below describes the starting and ending position of this segment on each transcript.

TABLE 4560

Segment location on transcripts

| Transcript name | Segment starting position | Segment ending position |
|---|---|---|
| HUMANFB_PEA_1_T24 (SEQ ID NO: 4093) | 489 | 525 |
| HUMANFB_PEA_1_T26 (SEQ ID NO: 4094) | 489 | 525 |
| HUMANFB_PEA_1_T29 (SEQ ID NO: 4095) | 489 | 525 |
| HUMANFB_PEA_1_T34 (SEQ ID NO: 4096) | 489 | 525 |
| HUMANFB_PEA_1_T35 (SEQ ID NO: 4097) | 489 | 525 |
| HUMANFB_PEA_1_T40 (SEQ ID NO: 4098) | 489 | 525 |
| HUMANFB_PEA_1_T45 (SEQ ID NO: 4099) | 489 | 525 |

This segment can be found in the following protein(s): HUMANFB_PEA_1_P1, HUMANFB_PEA_1_P17 and HUMANFB_PEA_1_P12.

Segment cluster HUMANFB_PEA_1_node_26 (SEQ ID NO:5118) according to the present invention is supported by 30 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4561 below describes the starting and ending position of this segment on each transcript.

TABLE 4561

Segment location on transcripts

| Transcript name | Segment starting position | Segment ending position |
|---|---|---|
| HUMANFB_PEA_1_T24 (SEQ ID NO: 4093) | 653 | 720 |
| HUMANFB_PEA_1_T26 (SEQ ID NO: 4094) | 653 | 720 |
| HUMANFB_PEA_1_T29 (SEQ ID NO: 4095) | 653 | 720 |
| HUMANFB_PEA_1_T34 (SEQ ID NO: 4096) | 653 | 720 |
| HUMANFB_PEA_1_T35 (SEQ ID NO: 4097) | 653 | 720 |
| HUMANFB_PEA_1_T40 (SEQ ID NO: 4098) | 653 | 720 |
| HUMANFB_PEA_1_T45 (SEQ ID NO: 4099) | 653 | 720 |

This segment can be found in the following protein(s): HUMANFB_PEA_1_P1, HUMANFB_PEA_1_P17 and HUMANFB_PEA_1_P12.

Segment cluster HUMANFB_PEA_1_node_28 (SEQ ID NO:5119) according to the present invention is supported by 34 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_

1_T35 (SEQ ID NO:4097), HUMANFB_PEA_1_T40 (SEQ ID NO:4098) and HUMANFB_PEA_1_T45 (SEQ ID NO:4099). Table 4562 below describes the starting and ending position of this segment on each transcript.

TABLE 4562

Segment location on transcripts

| Transcript name | Segment starting position | Segment ending position |
|---|---|---|
| HUMANFB_PEA_1_T24 (SEQ ID NO: 4093) | 721 | 779 |
| HUMANFB_PEA_1_T26 (SEQ ID NO: 4094) | 721 | 779 |
| HUMANFB_PEA_1_T29 (SEQ ID NO: 4095) | 721 | 779 |
| HUMANFB_PEA_1_T34 (SEQ ID NO: 4096) | 721 | 779 |
| HUMANFB_PEA_1_T35 (SEQ ID NO: 4097) | 721 | 779 |
| HUMANFB_PEA_1_T40 (SEQ ID NO: 4098) | 721 | 779 |
| HUMANFB_PEA_1_T45 (SEQ ID NO: 4099) | 721 | 779 |

This segment can be found in the following protein(s): HUMANFB_PEA_1_P1, HUMANFB_PEA_1_P17 and HUMANFB_PEA_1_P12.

Segment cluster HUMANFB_PEA_1_node_31 (SEQ ID NO:5120) according to the present invention is supported by 35 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4563 below describes the starting and ending position of this segment on each transcript.

TABLE 4563

Segment location on transcripts

| Transcript name | Segment starting position | Segment ending position |
|---|---|---|
| HUMANFB_PEA_1_T24 (SEQ ID NO: 4093) | 780 | 805 |
| HUMANFB_PEA_1_T26 (SEQ ID NO: 4094) | 780 | 805 |
| HUMANFB_PEA_1_T29 (SEQ ID NO: 4095) | 780 | 805 |
| HUMANFB_PEA_1_T34 (SEQ ID NO: 4096) | 780 | 805 |
| HUMANFB_PEA_1_T35 (SEQ ID NO: 4097) | 780 | 805 |
| HUMANFB_PEA_1_T40 (SEQ ID NO: 4098) | 780 | 805 |
| HUMANFB_PEA_1_T45 (SEQ ID NO: 4099) | 780 | 805 |

This segment can be found in the following protein(s): HUMANFB_PEA_1_P1, HUMANFB_PEA_1_P17 and HUMANFB_PEA_1_P12.

Segment cluster HUMANFB_PEA_1_node_32 (SEQ ID NO:5121) according to the present invention is supported by 36 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4564 below describes the starting and ending position of this segment on each transcript.

TABLE 4564

Segment location on transcripts

| Transcript name | Segment starting position | Segment ending position |
|---|---|---|
| HUMANFB_PEA_1_T24 (SEQ ID NO: 4093) | 806 | 912 |
| HUMANFB_PEA_1_T26 (SEQ ID NO: 4094) | 806 | 912 |
| HUMANFB_PEA_1_T29 (SEQ ID NO: 4095) | 806 | 912 |
| HUMANFB_PEA_1_T34 (SEQ ID NO: 4096) | 806 | 912 |
| HUMANFB_PEA_1_T35 (SEQ ID NO: 4097) | 806 | 912 |
| HUMANFB_PEA_1_T40 (SEQ ID NO: 4098) | 806 | 912 |
| HUMANFB_PEA_1_T45 (SEQ ID NO: 4099) | 806 | 912 |

This segment can be found in the following protein(s): HUMANFB_PEA_1_P1, HUMANFB_PEA_1_P17 and HUMANFB_PEA_1_P12.

Segment cluster HUMANFB_PEA_1_node_35 (SEQ ID NO:5122) according to the present invention is supported by 34 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4565 below describes the starting and ending position of this segment on each transcript.

TABLE 4565

Segment location on transcripts

| Transcript name | Segment starting position | Segment ending position |
|---|---|---|
| HUMANFB_PEA_1_T24 (SEQ ID NO: 4093) | 913 | 1026 |
| HUMANFB_PEA_1_T26 (SEQ ID NO: 4094) | 913 | 1026 |
| HUMANFB_PEA_1_T29 (SEQ ID NO: 4095) | 913 | 1026 |
| HUMANFB_PEA_1_T34 (SEQ ID NO: 4096) | 913 | 1026 |
| HUMANFB_PEA_1_T35 (SEQ ID NO: 4097) | 913 | 1026 |
| HUMANFB_PEA_1_T40 (SEQ ID NO: 4098) | 913 | 1026 |
| HUMANFB_PEA_1_T45 (SEQ ID NO: 4099) | 913 | 1026 |

This segment can be found in the following protein(s): HUMANFB_PEA_1_P1, HUMANFB_PEA_1_P17 and HUMANFB_PEA_1_P12.

Segment cluster HUMANFB_PEA_1_node_38 (SEQ ID NO:5123) according to the present invention is supported by 22 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4566 below describes the starting and ending position of this segment on each transcript.

TABLE 4566

Segment location on transcripts

| Transcript name | Segment starting position | Segment ending position |
|---|---|---|
| HUMANFB_PEA_1_T24 (SEQ ID NO: 4093) | 1027 | 1063 |
| HUMANFB_PEA_1_T26 (SEQ ID NO: 4094) | 1027 | 1063 |
| HUMANFB_PEA_1_T29 (SEQ ID NO: 4095) | 1027 | 1063 |
| HUMANFB_PEA_1_T34 (SEQ ID NO: 4096) | 1027 | 1063 |
| HUMANFB_PEA_1_T35 (SEQ ID NO: 4097) | 1027 | 1063 |
| HUMANFB_PEA_1_T40 (SEQ ID NO: 4098) | 1027 | 1063 |
| HUMANFB_PEA_1_T45 (SEQ ID NO: 4099) | 1027 | 1063 |

This segment can be found in the following protein(s): HUMANFB_PEA_1_P1, HUMANFB_PEA_1_P17 and HUMANFB_PEA_1_P12.

Segment cluster HUMANFB_PEA_1_node_41 (SEQ ID NO:5124) according to the present invention is supported by 43 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4567 below describes the starting and ending position of this segment on each transcript.

TABLE 4567

Segment location on transcripts

| Transcript name | Segment starting position | Segment ending position |
|---|---|---|
| HUMANFB_PEA_1_T24 (SEQ ID NO: 4093) | 1194 | 1297 |
| HUMANFB_PEA_1_T26 (SEQ ID NO: 4094) | 1194 | 1297 |
| HUMANFB_PEA_1_T29 (SEQ ID NO: 4095) | 1194 | 1297 |
| HUMANFB_PEA_1_T34 (SEQ ID NO: 4096) | 1194 | 1297 |
| HUMANFB_PEA_1_T35 (SEQ ID NO: 4097) | 1194 | 1297 |
| HUMANFB_PEA_1_T40 (SEQ ID NO: 4098) | 1194 | 1297 |
| HUMANFB_PEA_1_T45 (SEQ ID NO: 4099) | 1194 | 1297 |

This segment can be found in the following protein(s): HUMANFB_PEA_1_P1, HUMANFB_PEA_1_P17 and HUMANFB_PEA_1_P12.

Segment cluster HUMANFB_PEA_1_node_42 (SEQ ID NO:5125) according to the present invention can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4568 below describes the starting and ending position of this segment on each transcript.

TABLE 4568

Segment location on transcripts

| Transcript name | Segment starting position | Segment ending position |
|---|---|---|
| HUMANFB_PEA_1_T24 (SEQ ID NO: 4093) | 1298 | 1320 |
| HUMANFB_PEA_1_T26 (SEQ ID NO: 4094) | 1298 | 1320 |
| HUMANFB_PEA_1_T29 (SEQ ID NO: 4095) | 1298 | 1320 |
| HUMANFB_PEA_1_T34 (SEQ ID NO: 4096) | 1298 | 1320 |
| HUMANFB_PEA_1_T35 (SEQ ID NO: 4097) | 1298 | 1320 |
| HUMANFB_PEA_1_T40 (SEQ ID NO: 4098) | 1298 | 1320 |
| HUMANFB_PEA_1_T45 (SEQ ID NO: 4099) | 1298 | 1320 |

This segment can be found in the following protein(s): HUMANFB_PEA_1_P1, HUMANFB_PEA_1_P17 and HUMANFB_PEA_1_P12.

Segment cluster HUMANFB_PEA_1_node_53 (SEQ ID NO:5126) according to the present invention is supported by 31 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4569 below describes the starting and ending position of this segment on each transcript.

TABLE 4569

Segment location on transcripts

| Transcript name | Segment starting position | Segment ending position |
|---|---|---|
| HUMANFB_PEA_1_T24 (SEQ ID NO: 4093) | 1759 | 1865 |
| HUMANFB_PEA_1_T26 (SEQ ID NO: 4094) | 1759 | 1865 |
| HUMANFB_PEA_1_T29 (SEQ ID NO: 4095) | 1759 | 1865 |
| HUMANFB_PEA_1_T34 (SEQ ID NO: 4096) | 1759 | 1865 |
| HUMANFB_PEA_1_T35 (SEQ ID NO: 4097) | 1759 | 1865 |
| HUMANFB_PEA_1_T40 (SEQ ID NO: 4098) | 1759 | 1865 |
| HUMANFB_PEA_1_T45 (SEQ ID NO: 4099) | 1759 | 1865 |

This segment can be found in the following protein(s): HUMANFB_PEA_1_P1, HUMANFB_PEA_1_P17 and HUMANFB_PEA_1_P12.

Segment cluster HUMANFB_PEA_1_node_59 (SEQ ID NO:5127) according to the present invention is supported by 35 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097) and HUMANFB_PEA_1_T40 (SEQ ID NO:4098). Table 4570 below describes the starting and ending position of this segment on each transcript.

TABLE 4570

Segment location on transcripts

| Transcript name | Segment starting position | Segment ending position |
|---|---|---|
| HUMANFB_PEA_1_T24 (SEQ ID NO: 4093) | 2211 | 2244 |
| HUMANFB_PEA_1_T26 (SEQ ID NO: 4094) | 2211 | 2244 |
| HUMANFB_PEA_1_T29 (SEQ ID NO: 4095) | 2211 | 2244 |
| HUMANFB_PEA_1_T34 (SEQ ID NO: 4096) | 2211 | 2244 |
| HUMANFB_PEA_1_T35 (SEQ ID NO: 4097) | 2211 | 2244 |
| HUMANFB_PEA_1_T40 (SEQ ID NO: 4098) | 2211 | 2244 |

This segment can be found in the following protein(s): HUMANFB_PEA_1_P1 and HUMANFB_PEA_1_P17.

Segment cluster HUMANFB_PEA_1_node_62 (SEQ ID NO:5128) according to the present invention is supported by 29 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096), HUMANFB_PEA_1_T35 (SEQ ID NO:4097), HUMANFB_PEA_1_T40 (SEQ ID NO:4098) and HUMANFB_PEA_1_T45 (SEQ ID NO:4099). Table 4571 below describes the starting and ending position of this segment on each transcript.

TABLE 4571

Segment location on transcripts

| Transcript name | Segment starting position | Segment ending position |
|---|---|---|
| HUMANFB_PEA_1_T24 (SEQ ID NO: 4093) | 2368 | 2475 |
| HUMANFB_PEA_1_T26 (SEQ ID NO: 4094) | 2368 | 2475 |
| HUMANFB_PEA_1_T29 (SEQ ID NO: 4095) | 2368 | 2475 |
| HUMANFB_PEA_1_T34 (SEQ ID NO: 4096) | 2368 | 2475 |
| HUMANFB_PEA_1_T35 (SEQ ID NO: 4097) | 2368 | 2475 |
| HUMANFB_PEA_1_T40 (SEQ ID NO: 4098) | 2368 | 2475 |
| HUMANFB_PEA_1_T45 (SEQ ID NO: 4099) | 2334 | 2441 |

This segment can be found in both coding and non-coding regions of transcript(s) as follows. The segment can be found in a non-coding region of transcript(s) that are related to the following protein(s): HUMANFB_PEA_1_P12. This segment can also be found in the following protein(s): HUMANFB_PEA_1_P1 and HUMANFB_PEA_1_P17, since it is in the coding region for the corresponding transcript.

Segment cluster HUMANFB_PEA_1_node_68 (SEQ ID NO:5129) according to the present invention is supported by 26 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4572 below describes the starting and ending position of this segment on each transcript.

TABLE 4572

Segment location on transcripts

| Transcript name | Segment starting position | Segment ending position |
|---|---|---|
| HUMANFB_PEA_1_T24 (SEQ ID NO: 4093) | 2602 | 2633 |
| HUMANFB_PEA_1_T26 (SEQ ID NO: 4094) | 2602 | 2633 |
| HUMANFB_PEA_1_T29 (SEQ ID NO: 4095) | 2602 | 2633 |
| HUMANFB_PEA_1_T34 (SEQ ID NO: 4096) | 2602 | 2633 |
| HUMANFB_PEA_1_T35 (SEQ ID NO: 4097) | 2602 | 2633 |

This segment can be found in the following protein(s): HUMANFB_PEA_1_P1.

Segment cluster HUMANFB_PEA_1_node_69 (SEQ ID NO:5130) according to the present invention is supported by 27 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4573 below describes the starting and ending position of this segment on each transcript.

TABLE 4573

Segment location on transcripts

| Transcript name | Segment starting position | Segment ending position |
|---|---|---|
| HUMANFB_PEA_1_T24 (SEQ ID NO: 4093) | 2634 | 2678 |
| HUMANFB_PEA_1_T26 (SEQ ID NO: 4094) | 2634 | 2678 |
| HUMANFB_PEA_1_T29 (SEQ ID NO: 4095) | 2634 | 2678 |
| HUMANFB_PEA_1_T34 (SEQ ID NO: 4096) | 2634 | 2678 |
| HUMANFB_PEA_1_T35 (SEQ ID NO: 4097) | 2634 | 2678 |

This segment can be found in the following protein(s): HUMANFB_PEA_1_P1.

Segment cluster HUMANFB_PEA_1_node_70 (SEQ ID NO:5131) according to the present invention can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095), HUMANFB_PEA_1_T34 (SEQ ID NO:4096) and HUMANFB_PEA_1_T35 (SEQ ID NO:4097). Table 4574 below describes the starting and ending position of this segment on each transcript.

TABLE 4574

Segment location on transcripts

| Transcript name | Segment starting position | Segment ending position |
|---|---|---|
| HUMANFB_PEA_1_T24 (SEQ ID NO: 4093) | 2679 | 2683 |
| HUMANFB_PEA_1_T26 (SEQ ID NO: 4094) | 2679 | 2683 |
| HUMANFB_PEA_1_T29 (SEQ ID NO: 4095) | 2679 | 2683 |
| HUMANFB_PEA_1_T34 (SEQ ID NO: 4096) | 2679 | 2683 |
| HUMANFB_PEA_1_T35 (SEQ ID NO: 4097) | 2679 | 2683 |

This segment can be found in the following protein(s): HUMANFB_PEA_1_P1.

Segment cluster HUMANFB_PEA_1_node_77 (SEQ ID NO:5132) according to the present invention is supported by 2 libraries. The number of libraries was determined as previously described. This segment can be found in the following transcript(s): HUMANFB_PEA_1_T34 (SEQ ID NO:4096). Table 4575 below describes the starting and ending position of this segment on each transcript.

TABLE 4575

Segment location on transcripts

| Transcript name | Segment starting position | Segment ending position |
|---|---|---|
| HUMANFB_PEA_1_T34 (SEQ ID NO: 4096) | 3667 | 3696 |

This segment can be found in a non-coding region of transcript(s) that are related to the following protein(s): HUMANFB_PEA_1_P1.

Segment cluster HUMANFB_PEA_1_node_78 (SEQ ID NO:5133) according to the present invention is supported by 3 libraries. The number of libraries was determined as previously described. This segment can be found in the following transcript(s): HUMANFB_PEA_1_T24 (SEQ ID NO:4093), HUMANFB_PEA_1_T26 (SEQ ID NO:4094), HUMANFB_PEA_1_T29 (SEQ ID NO:4095) and HUMANFB_PEA_1_T34 (SEQ ID NO:4096). Table 4576 below describes the starting and ending position of this segment on each transcript.

TABLE 4576

Segment location on transcripts

| Transcript name | Segment starting position | Segment ending position |
|---|---|---|
| HUMANFB_PEA_1_T24 (SEQ ID NO: 4093) | 5077 | 5110 |
| HUMANFB_PEA_1_T26 (SEQ ID NO: 4094) | 5077 | 5110 |
| HUMANFB_PEA_1_T29 (SEQ ID NO: 4095) | 5077 | 5110 |
| HUMANFB_PEA_1_T34 (SEQ ID NO: 4096) | 3697 | 3730 |

This segment can be found in a non-coding region of transcript(s) that are related to the following protein(s): HUMANFB_PEA_1_P1.

Segment cluster HUMANFB_PEA_1_node_92 (SEQ ID NO:5134) according to the present invention can be found in the following transcript(s): HUMANFB_PEA_1_T24 (SEQ ID NO:4093) and HUMANFB_PEA_1_T34 (SEQ ID NO:4096). Table 4577 below describes the starting and ending position of this segment on each transcript.

TABLE 4577

Segment location on transcripts

| Transcript name | Segment starting position | Segment ending position |
|---|---|---|
| HUMANFB_PEA_1_T24 (SEQ ID NO: 4093) | 5637 | 5642 |
| HUMANFB_PEA_1_T34 (SEQ ID NO: 4096) | 4257 | 4262 |

This segment can be found in a non-coding region of transcript(s) that are related to the following protein(s): HUMANFB_PEA_1_P1.

Segment cluster HUMANFB_PEA_1_node_94 (SEQ ID NO:5135) according to the present invention can be found in the following transcript(s): HUMANFB_PEA_1_T24 (SEQ ID NO:4093) and HUMANFB_PEA_1_T34 (SEQ ID NO:4096). Table 4578 below describes the starting and ending position of this segment on each transcript.

TABLE 4578

Segment location on transcripts

| Transcript name | Segment starting position | Segment ending position |
|---|---|---|
| HUMANFB_PEA_1_T24 (SEQ ID NO: 4093) | 5765 | 5779 |
| HUMANFB_PEA_1_T34 (SEQ ID NO: 4096) | 4385 | 4399 |

This segment can be found in a non-coding region of transcript(s) that are related to the following protein(s): HUMANFB_PEA_1_P1.

Description for Cluster HUMCEA

Cluster HUMCEA features 1 transcript(s) and 23 segment(s) of interest, the names for which are given in Tables 4579 and 4580, respectively, the sequences themselves are given at the end of the application. The selected protein variants are given in Table 4581.

TABLE 4579

Transcripts of interest
Transcript Name

HUMCEA_PEA_1_T20 (SEQ ID NO: 4100)

TABLE 4580

Segments of interest
Segment Name

HUMCEA_PEA_1_node_0 (SEQ ID NO: 5136)

TABLE 4580-continued

Segments of interest

| Segment Name |
| --- |
| HUMCEA_PEA_1_node_2 (SEQ ID NO: 5137) |
| HUMCEA_PEA_1_node_12 (SEQ ID NO: 5138) |
| HUMCEA_PEA_1_node_31 (SEQ ID NO: 5139) |
| HUMCEA_PEA_1_node_67 (SEQ ID NO: 5140) |
| HUMCEA_PEA_1_node_3 (SEQ ID NO: 5141) |
| HUMCEA_PEA_1_node_7 (SEQ ID NO: 5142) |
| HUMCEA_PEA_1_node_8 (SEQ ID NO: 5143) |
| HUMCEA_PEA_1_node_9 (SEQ ID NO: 5144) |
| HUMCEA_PEA_1_node_10 (SEQ ID NO: 5145) |
| HUMCEA_PEA_1_node_15 (SEQ ID NO: 5146) |
| HUMCEA_PEA_1_node_16 (SEQ ID NO: 5147) |
| HUMCEA_PEA_1_node_17 (SEQ ID NO: 5148) |
| HUMCEA_PEA_1_node_18 (SEQ ID NO: 5149) |
| HUMCEA_PEA_1_node_19 (SEQ ID NO: 5150) |
| HUMCEA_PEA_1_node_20 (SEQ ID NO: 5151) |
| HUMCEA_PEA_1_node_21 (SEQ ID NO: 5152) |
| HUMCEA_PEA_1_node_22 (SEQ ID NO: 5153) |
| HUMCEA_PEA_1_node_23 (SEQ ID NO: 5154) |
| HUMCEA_PEA_1_node_24 (SEQ ID NO: 5155) |
| HUMCEA_PEA_1_node_27 (SEQ ID NO: 5156) |
| HUMCEA_PEA_1_node_29 (SEQ ID NO: 5157) |
| HUMCEA_PEA_1_node_30 (SEQ ID NO: 5158) |

TABLE 4581

Proteins of interest

| Protein Name | Corresponding Transcript(s) |
| --- | --- |
| HUMCEA_PEA_1_P14 | HUMCEA_PEA_1_T20 (SEQ ID NO: 4100) |

These sequences are variants of the known protein Carcinoembryonic antigen-related cell adhesion molecule 5 precursor (SwissProt accession identifier CEA5_HUMAN; known also according to the synonyms Carcinoembryonic antigen; CEA; Meconium antigen 100; CD66e antigen), referred to herein as the previously known protein.

The sequence for protein Carcinoembryonic antigen-related cell adhesion molecule 5 precursor is given at the end of the application, as "Carcinoembryonic antigen-related cell adhesion molecule 5 precursor amino acid sequence". Known polymorphisms for this sequence are as shown in Table 4582.

TABLE 4582

Amino acid mutations for Known Protein

| SNP position(s) on amino acid sequence | Comment |
| --- | --- |
| 320 | Missing |

Protein Carcinoembryonic antigen-related cell adhesion molecule 5 precursor localization is believed to be Attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: integral plasma membrane protein; membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMCEA can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 118 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 118 and Table 4583. This cluster is overexpressed (at least at a minimum level) in the following pathological conditions: epithelial malignant tumors, a mixture of malignant tumors from different tissues and pancreas carcinoma.

TABLE 4583

Normal tissue distribution

| Name of Tissue | Number |
| --- | --- |
| Colon | 1175 |
| epithelial | 92 |
| general | 29 |
| head and neck | 81 |
| kidney | 0 |
| Lung | 0 |
| Lymph nodes | 0 |
| Breast | 0 |

TABLE 4583-continued

Normal tissue distribution

| Name of Tissue | Number |
|---|---|
| pancreas | 0 |
| prostate | 0 |
| stomach | 256 |

TABLE 4584

P values and ratios for expression in cancerous tissue

| Name of Tissue | P1 | P2 | SP1 | R3 | SP2 | R4 |
|---|---|---|---|---|---|---|
| Colon | 2.0e−01 | 2.7e−01 | 9.8e−01 | 0.5 | 1 | 0.5 |
| epithelial | 2.1e−03 | 2.7e−02 | 6.4e−04 | 1.4 | 2.1e−01 | 1.0 |
| general | 3.9e−08 | 8.2e−06 | 9.2e−18 | 3.2 | 1.3e−10 | 2.2 |
| head and neck | 3.4e−01 | 5.0e−01 | 2.1e−01 | 1.8 | 5.6e−01 | 0.9 |
| kidney | 4.3e−01 | 5.3e−01 | 5.8e−01 | 2.1 | 7.0e−01 | 1.6 |
| Lung | 1.3e−01 | 2.6e−01 | 1 | 1.1 | 1 | 1.1 |
| Lymph nodes | 3.1e−01 | 5.7e−01 | 8.1e−02 | 6.0 | 3.3e−01 | 2.5 |
| Breast | 3.8e−01 | 1.5e−01 | 1 | 1.0 | 6.8e−01 | 1.5 |
| pancreas | 2.2e−02 | 2.3e−02 | 1.4e−08 | 7.8 | 7.4e−07 | 6.4 |
| prostate | 5.3e−01 | 6.0e−01 | 3.0e−01 | 2.5 | 4.2e−01 | 2.0 |
| stomach | 1.5e−01 | 4.7e−01 | 8.9e−01 | 0.6 | 7.2e−01 | 0.4 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4585.

TABLE 4585

Oligonucleotides related to this cluster

| Oligonucleotide name | Overexpressed in cancers | Chip reference |
|---|---|---|
| HUMCEA_0_0_96 | colorectal cancer | Colon |
| HUMCEA_0_0_96 | lung malignant tumors | LUN |
| HUMCEA_0_0_15168 | lung malignant tumors | LUN |

As noted above, cluster HUMCEA features 23 segment(s), which were listed in Table 4580 above and for which the sequence(s) are given at the end of the application. These segment(s) are portions of nucleic acid sequence(s) which are described herein separately because they are of particular interest. A description of each segment according to the present invention is now provided.

Segment cluster HUMCEA_PEA_1_node_0 (SEQ ID NO:5136) according to the present invention is supported by 56 libraries. The number of libraries was determined as previously described. This segment can be found in the following transcript(s): HUMCEA_PEA_1_T20 (SEQ ID NO:4100). Table 4586 below describes the starting and ending position of this segment on each transcript.

TABLE 4586

Segment location on transcripts

| Transcript name | Segment starting position | Segment ending position |
|---|---|---|
| HUMCEA_PEA_1_T20 (SEQ ID NO: 4100) | 1 | 178 |

This segment can be found in the following protein(s): HUMCEA_PEA_1_P14.

Segment cluster HUMCEA_PEA_1_node_2 (SEQ ID NO:5137) according to the present invention is supported by 83 libraries. The number of libraries was determined as previously described. This segment can be found in the following transcript(s): HUMCEA_PEA_1_T20 (SEQ ID NO:4100). Table 4587 below describes the starting and ending position of this segment on each transcript.

TABLE 4587

Segment location on transcripts

| Transcript name | Segment starting position | Segment ending position |
|---|---|---|
| HUMCEA_PEA_1_T20 (SEQ ID NO: 4100) | 179 | 456 |

This segment can be found in the following protein(s): HUMCEA_PEA_1_P14.

Segment cluster HUMCEA_PEA_1_node_12 (SEQ ID NO:5138) according to the present invention is supported by 83 libraries. The number of libraries was determined as previously described. This segment can be found in the following transcript(s): HUMCEA_PEA_1_T20 (SEQ ID NO:4100). Table 4588 below describes the starting and ending position of this segment on each transcript.

TABLE 4588

Segment location on transcripts

| Transcript name | Segment starting position | Segment ending position |
|---|---|---|
| HUMCEA_PEA_1_T20 (SEQ ID NO: 4100) | 818 | 1072 |

This segment can be found in the following protein(s): HUMCEA_PEA_1_P14.

Segment cluster HUMCEA_PEA_1_node_31 (SEQ ID NO:5139) according to the present invention is supported by 87 libraries. The number of libraries was determined as previously described. This segment can be found in the following transcript(s): HUMCEA_PEA_1_T20 (SEQ ID NO:4100). Table 4589 below describes the starting and ending position of this segment on each transcript.

TABLE 4589

Segment location on transcripts

| Transcript name | Segment starting position | Segment ending position |
|---|---|---|
| HUMCEA_PEA_1_T20 (SEQ ID NO: 4100) | 1417 | 1606 |

This segment can be found in the following protein(s): HUMCEA_PEA_1_P14.

Segment cluster HUMCEA_PEA_1_node_67 (SEQ ID NO:5140) according to the present invention is supported by 2 libraries. The number of libraries was determined as previously described. This segment can be found in the following transcript(s): HUMCEA_PEA_1_T20 (SEQ ID NO:4100). Table 4590 below describes the starting and ending position of this segment on each transcript.

TABLE 4590

Segment location on transcripts

| Transcript name | Segment starting position | Segment ending position |
|---|---|---|
| HUMCEA_PEA_1_T20 (SEQ ID NO: 4100) | 1607 | 1886 |

This segment can be found in the following protein(s): HUMCEA_PEA_1_P14.

According to an optional embodiment of the present invention, short segments related to the above cluster are also provided. These segments are up to about 120 bp in length, and so are included in a separate description.

Segment cluster HUMCEA_PEA_1_node_3 (SEQ ID NO:5141) according to the present invention is supported by 67 libraries. The number of libraries was determined as previously described. This segment can be found in the following transcript(s): HUMCEA_PEA_1_T20 (SEQ ID NO:4100). Table 4591 below describes the starting and ending position of this segment on each transcript.

TABLE 4591

Segment location on transcripts

| Transcript name | Segment starting position | Segment ending position |
|---|---|---|
| HUMCEA_PEA_1_T20 (SEQ ID NO: 4100) | 457 | 538 |

This segment can be found in the following protein(s): HUMCEA_PEA_1_P14.

Segment cluster HUMCEA_PEA_1_node_7 (SEQ ID NO:5142) according to the present invention is supported by 73 libraries. The number of libraries was determined as previously described. This segment can be found in the following transcript(s): HUMCEA_PEA_1_T20 (SEQ ID NO:4100). Table 4592 below describes the starting and ending position of this segment on each transcript.

TABLE 4592

Segment location on transcripts

| Transcript name | Segment starting position | Segment ending position |
|---|---|---|
| HUMCEA_PEA_1_T20 (SEQ ID NO: 4100) | 539 | 642 |

This segment can be found in the following protein(s): HUMCEA_PEA_1_P14.

Segment cluster HUMCEA_PEA_1_node_8 (SEQ ID NO:5143) according to the present invention is supported by 67 libraries. The number of libraries was determined as previously described. This segment can be found in the following transcript(s): HUMCEA_PEA_1_T20 (SEQ ID NO:4100). Table 4593 below describes the starting and ending position of this segment on each transcript.

TABLE 4593

Segment location on transcripts

| Transcript name | Segment starting position | Segment ending position |
|---|---|---|
| HUMCEA_PEA_1_T20 (SEQ ID NO: 4100) | 643 | 690 |

This segment can be found in the following protein(s): HUMCEA_PEA_1_P14.

Segment cluster HUMCEA_PEA_1_node_9 (SEQ ID NO:5144) according to the present invention is supported by 71 libraries. The number of libraries was determined as previously described. This segment can be found in the following transcript(s): HUMCEA_PEA_1_T20 (SEQ ID NO:4100). Table 4594 below describes the starting and ending position of this segment on each transcript.

TABLE 4594

Segment location on transcripts

| Transcript name | Segment starting position | Segment ending position |
|---|---|---|
| HUMCEA_PEA_1_T20 (SEQ ID NO: 4100) | 691 | 738 |

This segment can be found in the following protein(s): HUMCEA_PEA_1_P14.

Segment cluster HUMCEA_PEA_1_node_10 (SEQ ID NO:5145) according to the present invention is supported by 67 libraries. The number of libraries was determined as previously described. This segment can be found in the following transcript(s): HUMCEA_PEA_1_T20 (SEQ ID NO:4100). Table 4595 below describes the starting and ending position of this segment on each transcript.

TABLE 4595

Segment location on transcripts

| Transcript name | Segment starting position | Segment ending position |
|---|---|---|
| HUMCEA_PEA_1_T20 (SEQ ID NO: 4100) | 739 | 817 |

This segment can be found in the following protein(s): HUMCEA_PEA_1_P14.

Segment cluster HUMCEA_PEA_1_node_15 (SEQ ID NO:5146) according to the present invention can be found in the following transcript(s): HUMCEA_PEA_1_T20 (SEQ ID NO:4100). Table 4596 below describes the starting and ending position of this segment on each transcript.

TABLE 4596

Segment location on transcripts

| Transcript name | Segment starting position | Segment ending position |
|---|---|---|
| HUMCEA_PEA_1_T20 (SEQ ID NO: 4100) | 1073 | 1075 |

This segment can be found in the following protein(s): HUMCEA_PEA_1_P14.

Segment cluster HUMCEA_PEA_1_node_16 (SEQ ID NO:5147) according to the present invention can be found in the following transcript(s): HUMCEA_PEA_1_T20 (SEQ ID NO:4100). Table 4597 below describes the starting and ending position of this segment on each transcript.

TABLE 4597

Segment location on transcripts

| Transcript name | Segment starting position | Segment ending position |
|---|---|---|
| HUMCEA_PEA_1_T20 (SEQ ID NO: 4100) | 1076 | 1081 |

This segment can be found in the following protein(s): HUMCEA_PEA_1_P14.

Segment cluster HUMCEA_PEA_1_node_17 (SEQ ID NO:5148) according to the present invention can be found in the following transcript(s): HUMCEA_PEA_1_T20 (SEQ ID NO:4100). Table 4598 below describes the starting and ending position of this segment on each transcript.

TABLE 4598

Segment location on transcripts

| Transcript name | Segment starting position | Segment ending position |
|---|---|---|
| HUMCEA_PEA_1_T20 (SEQ ID NO: 4100) | 1082 | 1088 |

This segment can be found in the following protein(s): HUMCEA_PEA_1_P14.

Segment cluster HUMCEA_PEA_1_node_18 (SEQ ID NO:5149) according to the present invention can be found in the following transcript(s): HUMCEA_PEA_1_T20 (SEQ ID NO:4100). Table 4599 below describes the starting and ending position of this segment on each transcript.

TABLE 4599

Segment location on transcripts

| Transcript name | Segment starting position | Segment ending position |
|---|---|---|
| HUMCEA_PEA_1_T20 (SEQ ID NO: 4100) | 1089 | 1106 |

This segment can be found in the following protein(s): HUMCEA_PEA_1_P14.

Segment cluster HUMCEA_PEA_1_node_19 (SEQ ID NO:5150) according to the present invention is supported by 69 libraries. The number of libraries was determined as previously described. This segment can be found in the following transcript(s): HUMCEA_PEA_1_T20 (SEQ ID NO:4100). Table 4600 below describes the starting and ending position of this segment on each transcript.

TABLE 4600

Segment location on transcripts

| Transcript name | Segment starting position | Segment ending position |
|---|---|---|
| HUMCEA_PEA_1_T20 (SEQ ID NO: 4100) | 1107 | 1176 |

This segment can be found in the following protein(s): HUMCEA_PEA_1_P14.

Segment cluster HUMCEA_PEA_1_node_20 (SEQ ID NO:5151) according to the present invention can be found in the following transcript(s): HUMCEA_PEA_1_T20 (SEQ ID NO:4100). Table 4601 below describes the starting and ending position of this segment on each transcript.

TABLE 4601

Segment location on transcripts

| Transcript name | Segment starting position | Segment ending position |
|---|---|---|
| HUMCEA_PEA_1_T20 (SEQ ID NO: 4100) | 1177 | 1200 |

This segment can be found in the following protein(s): HUMCEA_PEA_1_P14.

Segment cluster HUMCEA_PEA_1_node_21 (SEQ ID NO:5152) according to the present invention can be found in the following transcript(s): HUMCEA_PEA_1_T20 (SEQ ID NO:4100). Table 4602 below describes the starting and ending position of this segment on each transcript.

TABLE 4602

Segment location on transcripts

| Transcript name | Segment starting position | Segment ending position |
|---|---|---|
| HUMCEA_PEA_1_T20 (SEQ ID NO: 4100) | 1201 | 1224 |

This segment can be found in the following protein(s): HUMCEA_PEA_1_P14.

Segment cluster HUMCEA_PEA_1_node_22 (SEQ ID NO:5153) according to the present invention is supported by 77 libraries. The number of libraries was determined as previously described. This segment can be found in the following transcript(s): HUMCEA_PEA_1_T20 (SEQ ID NO:4100). Table 4603 below describes the starting and ending position of this segment on each transcript.

TABLE 4603

Segment location on transcripts

| Transcript name | Segment starting position | Segment ending position |
|---|---|---|
| HUMCEA_PEA_1_T20 (SEQ ID NO: 4100) | 1225 | 1302 |

This segment can be found in the following protein(s): HUMCEA_PEA_1_P14.

Segment cluster HUMCEA_PEA_1_node_23 (SEQ ID NO:5154) according to the present invention is supported by 72 libraries. The number of libraries was determined as previously described. This segment can be found in the following transcript(s): HUMCEA_PEA_1_T20 (SEQ ID NO:4100). Table 4604 below describes the starting and ending position of this segment on each transcript.

TABLE 4604

| Segment location on transcripts | | |
|---|---|---|
| Transcript name | Segment starting position | Segment ending position |
| HUMCEA_PEA_1_T20 (SEQ ID NO: 4100) | 1303 | 1332 |

This segment can be found in the following protein(s): HUMCEA_PEA_1_P14.

Segment cluster HUMCEA_PEA_1_node_24 (SEQ ID NO:5155) according to the present invention can be found in the following transcript(s): HUMCEA_PEA_1_T20 (SEQ ID NO:4100). Table 4605 below describes the starting and ending position of this segment on each transcript.

TABLE 4605

| Segment location on transcripts | | |
|---|---|---|
| Transcript name | Segment starting position | Segment ending position |
| HUMCEA_PEA_1_T20 (SEQ ID NO: 4100) | 1333 | 1351 |

This segment can be found in the following protein(s): HUMCEA_PEA_1_P14.

Segment cluster HUMCEA_PEA_1_node_27 (SEQ ID NO:5156) according to the present invention can be found in the following transcript(s): HUMCEA_PEA_1_T20 (SEQ ID NO:4100). Table 4606 below describes the starting and ending position of this segment on each transcript.

TABLE 4606

| Segment location on transcripts | | |
|---|---|---|
| Transcript name | Segment starting position | Segment ending position |
| HUMCEA_PEA_1_T20 (SEQ ID NO: 4100) | 1352 | 1370 |

This segment can be found in the following protein(s): HUMCEA_PEA_1_P14.

Segment cluster HUMCEA_PEA_1_node_29 (SEQ ID NO:5157) according to the present invention can be found in the following transcript(s): HUMCEA_PEA_1_T20 (SEQ ID NO:4100). Table 4607 below describes the starting and ending position of this segment on each transcript.

TABLE 4607

| Segment location on transcripts | | |
|---|---|---|
| Transcript name | Segment starting position | Segment ending position |
| HUMCEA_PEA_1_T20 (SEQ ID NO: 4100) | 1371 | 1388 |

This segment can be found in the following protein(s): HUMCEA_PEA_1_P14.

Segment cluster HUMCEA_PEA_1_node_30 (SEQ ID NO:5158) according to the present invention is supported by 67 libraries. The number of libraries was determined as previously described. This segment can be found in the following transcript(s): HUMCEA_PEA_1_T20 (SEQ ID NO:4100). Table 4608 below describes the starting and ending position of this segment on each transcript.

TABLE 4608

| Segment location on transcripts | | |
|---|---|---|
| Transcript name | Segment starting position | Segment ending position |
| HUMCEA_PEA_1_T20 (SEQ ID NO: 4100) | 1389 | 1416 |

This segment can be found in the following protein(s): HUMCEA_PEA_1_P14.

Description for Cluster HUMCFX

Cluster HUMCFX features 2 transcript(s) and 48 segment(s) of interest, the names for which are given in Tables 4609 and 4610, respectively, the sequences themselves are given at the end of the application. The selected protein variants are given in Table 4611.

TABLE 4609

| Transcripts of interest Transcript Name |
|---|
| HUMCFX_PEA_1_T1 (SEQ ID NO: 4101) |
| HUMCFX_PEA_1_T27 (SEQ ID NO: 4102) |

TABLE 4610

| Segments of interest Segment Name |
|---|
| HUMCFX_PEA_1_node_0 (SEQ ID NO: 5159) |
| HUMCFX_PEA_1_node_2 (SEQ ID NO: 5160) |
| HUMCFX_PEA_1_node_4 (SEQ ID NO: 5161) |
| HUMCFX_PEA_1_node_7 (SEQ ID NO: 5162) |
| HUMCFX_PEA_1_node_9 (SEQ ID NO: 5163) |
| HUMCFX_PEA_1_node_11 (SEQ ID NO: 5164) |
| HUMCFX_PEA_1_node_13 (SEQ ID NO: 5165) |
| HUMCFX_PEA_1_node_14 (SEQ ID NO: 5166) |
| HUMCFX_PEA_1_node_18 (SEQ ID NO: 5167) |
| HUMCFX_PEA_1_node_19 (SEQ ID NO: 5168) |
| HUMCFX_PEA_1_node_21 (SEQ ID NO: 5169) |
| HUMCFX_PEA_1_node_22 (SEQ ID NO: 5170) |
| HUMCFX_PEA_1_node_23 (SEQ ID NO: 5171) |
| HUMCFX_PEA_1_node_24 (SEQ ID NO: 5172) |

TABLE 4610-continued

Segments of interest
Segment Name

HUMCFX_PEA_1_node_25 (SEQ ID NO: 5173)
HUMCFX_PEA_1_node_26 (SEQ ID NO: 5174)
HUMCFX_PEA_1_node_27 (SEQ ID NO: 5175)
HUMCFX_PEA_1_node_28 (SEQ ID NO: 5176)
HUMCFX_PEA_1_node_31 (SEQ ID NO: 5177)
HUMCFX_PEA_1_node_32 (SEQ ID NO: 5178)
HUMCFX_PEA_1_node_33 (SEQ ID NO: 5179)
HUMCFX_PEA_1_node_34 (SEQ ID NO: 5180)
HUMCFX_PEA_1_node_35 (SEQ ID NO: 5181)
HUMCFX_PEA_1_node_36 (SEQ ID NO: 5182)
HUMCFX_PEA_1_node_38 (SEQ ID NO: 5183)
HUMCFX_PEA_1_node_40 (SEQ ID NO: 5184)
HUMCFX_PEA_1_node_41 (SEQ ID NO: 5185)
HUMCFX_PEA_1_node_42 (SEQ ID NO: 5186)
HUMCFX_PEA_1_node_45 (SEQ ID NO: 5187)
HUMCFX_PEA_1_node_46 (SEQ ID NO: 5188)
HUMCFX_PEA_1_node_47 (SEQ ID NO: 5189)
HUMCFX_PEA_1_node_48 (SEQ ID NO: 5190)
HUMCFX_PEA_1_node_49 (SEQ ID NO: 5191)
HUMCFX_PEA_1_node_50 (SEQ ID NO: 5192)
HUMCFX_PEA_1_node_51 (SEQ ID NO: 5193)
HUMCFX_PEA_1_node_52 (SEQ ID NO: 5194)
HUMCFX_PEA_1_node_53 (SEQ ID NO: 5195)
HUMCFX_PEA_1_node_54 (SEQ ID NO: 5196)
HUMCFX_PEA_1_node_55 (SEQ ID NO: 5197)
HUMCFX_PEA_1_node_56 (SEQ ID NO: 5198)
HUMCFX_PEA_1_node_57 (SEQ ID NO: 5199)
HUMCFX_PEA_1_node_58 (SEQ ID NO: 5200)
HUMCFX_PEA_1_node_59 (SEQ ID NO: 5201)
HUMCFX_PEA_1_node_60 (SEQ ID NO: 5202)
HUMCFX_PEA_1_node_61 (SEQ ID NO: 5203)
HUMCFX_PEA_1_node_62 (SEQ ID NO: 5204)
HUMCFX_PEA_1_node_63 (SEQ ID NO: 5205)
HUMCFX_PEA_1_node_64 (SEQ ID NO: 5206)

TABLE 4611

Proteins of interest

| Protein Name | Corresponding Transcript(s) |
| --- | --- |
| HUMCFX_PEA_1_P16 | HUMCFX_PEA_1_T27 (SEQ ID NO: 4102) |
| HUMCFX_PEA_1_P39 | HUMCFX_PEA_1_T1 (SEQ ID NO: 4101) |

These sequences are variants of the known protein Coagulation factor X precursor (SwissProt accession identifier FA10_HUMAN; known also according to the synonyms EC 3.4.21.6; Stuart factor; Stuart-Prower factor), referred to herein as the previously known protein.

Protein Coagulation factor X precursor is known or believed to have the following function(s): Factor Xa is a vitamin K-dependent glycoprotein that converts prothrombin to thrombin in the presence of factor Va, calcium and phospholipid during blood clotting. The sequence for protein Coagulation factor X precursor is given at the end of the application, as "Coagulation factor X precursor amino acid sequence". Known polymorphisms for this sequence are as shown in Table 4612.

TABLE 4612

Amino acid mutations for Known Protein

| SNP position(s) on amino acid sequence | Comment |
| --- | --- |
| 7 | L -> I (in dbSNP: 5963). /FTId = VAR_014162. |
| 30 | Q -> H (in dbSNP: 5961). /FTId = VAR_014163. |
| 285-288 | KVRV -> E |
| 442 | G -> S |

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Factor VIIa inhibitor; Factor Xa inhibitor; Thrombin inhibitor; Trypsin inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticoagulant; Antiinflammatory; Antithrombotic.

The following GO Annotation(s) apply to the previously known protein. The following annotation(s) were found: proteolysis and peptidolysis; blood coagulation, which are annotation(s) related to Biological Process; blood coagulation factor X; chymotrypsin; trypsin; calcium binding; hydrolase, which are annotation(s) related to Molecular Function; and extracellular, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMCFX features 48 segment(s), which were listed in Table 4610 above and for which the sequence(s) are given at the end of the application. These segment(s) are portions of nucleic acid sequence(s) which are described herein separately because they are of particular interest. A description of each segment according to the present invention is now provided.

Segment cluster HUMCFX_PEA_1_node_0 (SEQ ID NO:5159) according to the present invention is supported by 53 libraries. The number of libraries was determined as previously described. This segment can be found in the following transcript(s): HUMCFX_PEA_1_T27 (SEQ ID NO:4102). Table 4613 below describes the starting and ending position of this segment on each transcript.

TABLE 4613

Segment location on transcripts

| Transcript name | Segment starting position | Segment ending position |
|---|---|---|
| HUMCFX_PEA_1_T27 (SEQ ID NO: 4102) | 1 | 127 |

This segment can be found in a non-coding region of transcript(s) that are related to the following protein(s): HUMCFX_PEA_1_P16.

Segment cluster HUMCFX_PEA_1_node_2 (SEQ ID NO:5160) according to the present invention is supported by 1 libraries. The number of libraries was determined as previously described. This segment can be found in the following transcript(s): HUMCFX_PEA_1_T1 (SEQ ID NO:4101). Table 4614 below describes the starting and ending position of this segment on each transcript.

TABLE 4614

Segment location on transcripts

| Transcript name | Segment starting position | Segment ending position |
|---|---|---|
| HUMCFX_PEA_1_T1 (SEQ ID NO: 4101) | 1 | 359 |

This segment can be found in the following protein(s): HUMCFX_PEA_1_P39.

Segment cluster HUMCFX_PEA_1_node_4 (SEQ ID NO:5161) according to the present invention is supported by 64 libraries. The number of libraries was determined as previously described. This segment can be found in the following transcript(s): HUMCFX_PEA_1_T1 (SEQ ID NO:4101) and HUMCFX_PEA_1_T27 (SEQ ID NO:4102). Table 4615 below describes the starting and ending position of this segment on each transcript.

TABLE 4615

Segment location on transcripts

| Transcript name | Segment starting position | Segment ending position |
|---|---|---|
| HUMCFX_PEA_1_T1 (SEQ ID NO: 4101) | 360 | 520 |
| HUMCFX_PEA_1_T27 (SEQ ID NO: 4102) | 128 | 288 |

This segment can be found in both coding and non-coding regions of transcript(s) as follows. The segment can be found in a non-coding region of transcript(s) that are related to the following protein(s): HUMCFX_PEA_1_P16. This segment can also be found in the following protein(s): HUMCFX_PEA_1_P39, since it is in the coding region for the corresponding transcript.

Segment cluster HUMCFX_PEA_1_node_7 (SEQ ID NO:5162) according to the present invention is supported by 23 libraries. The number of libraries was determined as previously described. This segment can be found in the following transcript(s): HUMCFX_PEA_1_T27 (SEQ ID NO:4102). Table 4616 below describes the starting and ending position of this segment on each transcript.

TABLE 4616

Segment location on transcripts

| Transcript name | Segment starting position | Segment ending position |
|---|---|---|
| HUMCFX_PEA_1_T27 (SEQ ID NO: 4102) | 289 | 2490 |

This segment can be found in the following protein(s): HUMCFX_PEA_1_P16.

Segment cluster HUMCFX_PEA_1_node_9 (SEQ ID NO:5163) according to the present invention is supported by 5 libraries. The number of libraries was determined as previously described. This segment can be found in the following transcript(s): HUMCFX_PEA_1_T27 (SEQ ID NO:4102). Table 4617 below describes the starting and ending position of this segment on each transcript.

TABLE 4617

Segment location on transcripts

| Transcript name | Segment starting position | Segment ending position |
|---|---|---|
| HUMCFX_PEA_1_T27 (SEQ ID NO: 4102) | 2491 | 3479 |

This segment can be found in a non-coding region of transcript(s) that are related to the following protein(s): HUMCFX_PEA_1_P16.

According to an optional embodiment of the present invention, short segments related to the above cluster are also provided. These segments are up to about 120 bp in length, and so are included in a separate description.

Segment cluster HUMCFX_PEA_1_node_11 (SEQ ID NO:5164) according to the present invention can be found in the following transcript(s): HUMCFX_PEA_1_T1 (SEQ ID NO:4101). Table 4618 below describes the starting and ending position of this segment on each transcript.

TABLE 4618

Segment location on transcripts

| Transcript name | Segment starting position | Segment ending position |
|---|---|---|
| HUMCFX_PEA_1_T1 (SEQ ID NO: 4101) | 521 | 545 |

This segment can be found in the following protein(s): HUMCFX_PEA_1_P39.

Segment cluster HUMCFX_PEA_1_node_13 (SEQ ID NO:5165) according to the present invention is supported by 54 libraries. The number of libraries was determined as previously described. This segment can be found in the following transcript(s): HUMCFX_PEA_1_T1 (SEQ ID NO:4101). Table 4619 below describes the starting and ending position of this segment on each transcript.

TABLE 4619

Segment location on transcripts

| Transcript name | Segment starting position | Segment ending position |
|---|---|---|
| HUMCFX_PEA_1_T1 (SEQ ID NO: 4101) | 546 | 590 |

This segment can be found in the following protein(s): HUMCFX_PEA_1_P39.

Segment cluster HUMCFX_PEA_1_node_14 (SEQ ID NO:5166) according to the present invention is supported by 54 libraries. The number of libraries was determined as previously described. This segment can be found in the following transcript(s): HUMCFX_PEA_1_T1 (SEQ ID NO:4101). Table 4620 below describes the starting and ending position of this segment on each transcript.

TABLE 4620

Segment location on transcripts

| Transcript name | Segment starting position | Segment ending position |
|---|---|---|
| HUMCFX_PEA_1_T1 (SEQ ID NO: 4101) | 591 | 659 |

This segment can be found in the following protein(s): HUMCFX_PEA_1_P39.

Segment cluster HUMCFX_PEA_1_node_18 (SEQ ID NO:5167) according to the present invention is supported by 50 libraries. The number of libraries was determined as previously described. This segment can be found in the following transcript(s): HUMCFX_PEA_1_T1 (SEQ ID NO:4101). Table 4621 below describes the starting and ending position of this segment on each transcript.

TABLE 4621

Segment location on transcripts

| Transcript name | Segment starting position | Segment ending position |
|---|---|---|
| HUMCFX_PEA_1_T1 (SEQ ID NO: 4101) | 660 | 764 |

This segment can be found in the following protein(s): HUMCFX_PEA_1_P39.

Segment cluster HUMCFX_PEA_1_node_19 (SEQ ID NO:5168) according to the present invention is supported by 50 libraries. The number of libraries was determined as previously described. This segment can be found in the following transcript(s): HUMCFX_PEA_1_T1 (SEQ ID NO:4101). Table 4622 below describes the starting and ending position of this segment on each transcript.

TABLE 4622

Segment location on transcripts

| Transcript name | Segment starting position | Segment ending position |
|---|---|---|
| HUMCFX_PEA_1_T1 (SEQ ID NO: 4101) | 765 | 791 |

This segment can be found in the following protein(s): HUMCFX_PEA_1_P39.

Segment cluster HUMCFX_PEA_1_node_21 (SEQ ID NO:5169) according to the present invention is supported by 51 libraries. The number of libraries was determined as previously described. This segment can be found in the following transcript(s): HUMCFX_PEA_1_T1 (SEQ ID NO:4101). Table 4623 below describes the starting and ending position of this segment on each transcript.

TABLE 4623

Segment location on transcripts

| Transcript name | Segment starting position | Segment ending position |
|---|---|---|
| HUMCFX_PEA_1_T1 (SEQ ID NO: 4101) | 792 | 864 |

This segment can be found in the following protein(s): HUMCFX_PEA_1_P39.

Segment cluster HUMCFX_PEA_1_node_22 (SEQ ID NO:5170) according to the present invention can be found in the following transcript(s): HUMCFX_PEA_1_T1 (SEQ ID NO:4101). Table 4624 below describes the starting and ending position of this segment on each transcript.

TABLE 4624

Segment location on transcripts

| Transcript name | Segment starting position | Segment ending position |
|---|---|---|
| HUMCFX_PEA_1_T1 (SEQ ID NO: 4101) | 865 | 872 |

This segment can be found in the following protein(s): HUMCFX_PEA_1_P39.

Segment cluster HUMCFX_PEA_1_node_23 (SEQ ID NO:5171) according to the present invention can be found in the following transcript(s): HUMCFX_PEA_1_T1 (SEQ ID NO:4101). Table 4625 below describes the starting and ending position of this segment on each transcript.

TABLE 4625

Segment location on transcripts

| Transcript name | Segment starting position | Segment ending position |
|---|---|---|
| HUMCFX_PEA_1_T1 (SEQ ID NO: 4101) | 873 | 879 |

This segment can be found in the following protein(s): HUMCFX_PEA_1_P39.

Segment cluster HUMCFX_PEA_1_node_24 (SEQ ID NO:5172) according to the present invention can be found in the following transcript(s): HUMCFX_PEA_1_T1 (SEQ ID NO:4101). Table 4626 below describes the starting and ending position of this segment on each transcript.

TABLE 4626

Segment location on transcripts

| Transcript name | Segment starting position | Segment ending position |
| --- | --- | --- |
| HUMCFX_PEA_1_T1 (SEQ ID NO: 4101) | 880 | 885 |

This segment can be found in the following protein(s): HUMCFX_PEA_1_P39.

Segment cluster HUMCFX_PEA_1_node_25 (SEQ ID NO:5173) according to the present invention is supported by 47 libraries. The number of libraries was determined as previously described. This segment can be found in the following transcript(s): HUMCFX_PEA_1_T1 (SEQ ID NO:4101). Table 4627 below describes the starting and ending position of this segment on each transcript.

TABLE 4627

Segment location on transcripts

| Transcript name | Segment starting position | Segment ending position |
| --- | --- | --- |
| HUMCFX_PEA_1_T1 (SEQ ID NO: 4101) | 886 | 915 |

This segment can be found in the following protein(s): HUMCFX_PEA_1_P39.

Segment cluster HUMCFX_PEA_1_node_26 (SEQ ID NO:5174) according to the present invention can be found in the following transcript(s): HUMCFX_PEA_1_T1 (SEQ ID NO:4101). Table 4628 below describes the starting and ending position of this segment on each transcript.

TABLE 4628

Segment location on transcripts

| Transcript name | Segment starting position | Segment ending position |
| --- | --- | --- |
| HUMCFX_PEA_1_T1 (SEQ ID NO: 4101) | 916 | 937 |

This segment can be found in the following protein(s): HUMCFX_PEA_1_P39.

Segment cluster HUMCFX_PEA_1_node_27 (SEQ ID NO:5175) according to the present invention is supported by 49 libraries. The number of libraries was determined as previously described. This segment can be found in the following transcript(s): HUMCFX_PEA_1_T1 (SEQ ID NO:4101). Table 4629 below describes the starting and ending position of this segment on each transcript.

TABLE 4629

Segment location on transcripts

| Transcript name | Segment starting position | Segment ending position |
| --- | --- | --- |
| HUMCFX_PEA_1_T1 (SEQ ID NO: 4101) | 938 | 987 |

This segment can be found in the following protein(s): HUMCFX_PEA_1_P39.

Segment cluster HUMCFX_PEA_1_node_28 (SEQ ID NO:5176) according to the present invention is supported by 48 libraries. The number of libraries was determined as previously described. This segment can be found in the following transcript(s): HUMCFX_PEA_1_T1 (SEQ ID NO:4101). Table 4630 below describes the starting and ending position of this segment on each transcript.

TABLE 4630

Segment location on transcripts

| Transcript name | Segment starting position | Segment ending position |
| --- | --- | --- |
| HUMCFX_PEA_1_T1 (SEQ ID NO: 4101) | 988 | 1036 |

This segment can be found in the following protein(s): HUMCFX_PEA_1_P39.

Segment cluster HUMCFX_PEA_1_node_31 (SEQ ID NO:5177) according to the present invention can be found in the following transcript(s): HUMCFX_PEA_1_T1 (SEQ ID NO:4101). Table 4631 below describes the starting and ending position of this segment on each transcript.

TABLE 4631

Segment location on transcripts

| Transcript name | Segment starting position | Segment ending position |
| --- | --- | --- |
| HUMCFX_PEA_1_T1 (SEQ ID NO: 4101) | 1037 | 1054 |

This segment can be found in the following protein(s): HUMCFX_PEA_1_P39.

Segment cluster HUMCFX_PEA_1_node_32 (SEQ ID NO:5178) according to the present invention can be found in the following transcript(s): HUMCFX_PEA_1_T1 (SEQ ID NO:4101). Table 4632 below describes the starting and ending position of this segment on each transcript.

TABLE 4632

Segment location on transcripts

| Transcript name | Segment starting position | Segment ending position |
| --- | --- | --- |
| HUMCFX_PEA_1_T1 (SEQ ID NO: 4101) | 1055 | 1060 |

This segment can be found in the following protein(s): HUMCFX_PEA_1_P39.

Segment cluster HUMCFX_PEA_1_node_33 (SEQ ID NO:5179) according to the present invention can be found in the following transcript(s): HUMCFX_PEA_1_T1 (SEQ ID NO:4101). Table 4633 below describes the starting and ending position of this segment on each transcript.

TABLE 4633

Segment location on transcripts

| Transcript name | Segment starting position | Segment ending position |
|---|---|---|
| HUMCFX_PEA_1_T1 (SEQ ID NO: 4101) | 1061 | 1084 |

This segment can be found in the following protein(s): HUMCFX_PEA_1_P39.

Segment cluster HUMCFX_PEA_1_node_34 (SEQ ID NO:5180) according to the present invention can be found in the following transcript(s): HUMCFX_PEA_1_T1 (SEQ ID NO:4101). Table 4634 below describes the starting and ending position of this segment on each transcript.

TABLE 4634

Segment location on transcripts

| Transcript name | Segment starting position | Segment ending position |
|---|---|---|
| HUMCFX_PEA_1_T1 (SEQ ID NO: 4101) | 1085 | 1088 |

This segment can be found in the following protein(s): HUMCFX_PEA_1_P39.

Segment cluster HUMCFX_PEA_1_node_35 (SEQ ID NO:5181) according to the present invention can be found in the following transcript(s): HUMCFX_PEA_1_T1 (SEQ ID NO:4101). Table 4635 below describes the starting and ending position of this segment on each transcript.

TABLE 4635

Segment location on transcripts

| Transcript name | Segment starting position | Segment ending position |
|---|---|---|
| HUMCFX_PEA_1_T1 (SEQ ID NO: 4101) | 1089 | 1102 |

This segment can be found in the following protein(s): HUMCFX_PEA_1_P39.

Segment cluster HUMCFX_PEA_1_node_36 (SEQ ID NO:5182) according to the present invention can be found in the following transcript(s): HUMCFX_PEA_1_T1 (SEQ ID NO:4101). Table 4636 below describes the starting and ending position of this segment on each transcript.

TABLE 4636

Segment location on transcripts

| Transcript name | Segment starting position | Segment ending position |
|---|---|---|
| HUMCFX_PEA_1_T1 (SEQ ID NO: 4101) | 1103 | 1122 |

This segment can be found in the following protein(s): HUMCFX_PEA_1_P39.

Segment cluster HUMCFX_PEA_1_node_38 (SEQ ID NO:5183) according to the present invention can be found in the following transcript(s): HUMCFX_PEA_1_T1 (SEQ ID NO:4101). Table 4637 below describes the starting and ending position of this segment on each transcript.

TABLE 4637

Segment location on transcripts

| Transcript name | Segment starting position | Segment ending position |
|---|---|---|
| HUMCFX_PEA_1_T1 (SEQ ID NO: 4101) | 1123 | 1130 |

This segment can be found in the following protein(s): HUMCFX_PEA_1_P39.

Segment cluster HUMCFX_PEA_1_node_40 (SEQ ID NO:5184) according to the present invention can be found in the following transcript(s): HUMCFX_PEA_1_T1 (SEQ ID NO:4101). Table 4638 below describes the starting and ending position of this segment on each transcript.

TABLE 4638

Segment location on transcripts

| Transcript name | Segment starting position | Segment ending position |
|---|---|---|
| HUMCFX_PEA_1_T1 (SEQ ID NO: 4101) | 1131 | 1144 |

This segment can be found in the following protein(s): HUMCFX_PEA_1_P39.

Segment cluster HUMCFX_PEA_1_node_41 (SEQ ID NO:5185) according to the present invention can be found in the following transcript(s): HUMCFX_PEA_1_T1 (SEQ ID NO:4101). Table 4639 below describes the starting and ending position of this segment on each transcript.

TABLE 4639

Segment location on transcripts

| Transcript name | Segment starting position | Segment ending position |
|---|---|---|
| HUMCFX_PEA_1_T1 (SEQ ID NO: 4101) | 1145 | 1150 |

This segment can be found in the following protein(s): HUMCFX_PEA_1_P39.

Segment cluster HUMCFX_PEA_1_node_42 (SEQ ID NO:5186) according to the present invention can be found in the following transcript(s): HUMCFX_PEA_1_T1 (SEQ ID NO:4101). Table 4640 below describes the starting and ending position of this segment on each transcript.

TABLE 4640

Segment location on transcripts

| Transcript name | Segment starting position | Segment ending position |
|---|---|---|
| HUMCFX_PEA_1_T1 (SEQ ID NO: 4101) | 1151 | 1154 |

This segment can be found in the following protein(s): HUMCFX_PEA_1_P39.

Segment cluster HUMCFX_PEA_1_node_45 (SEQ ID NO:5187) according to the present invention can be found in the following transcript(s): HUMCFX_PEA_1_T1 (SEQ ID NO:4101). Table 4641 below describes the starting and ending position of this segment on each transcript.

TABLE 4641

Segment location on transcripts

| Transcript name | Segment starting position | Segment ending position |
|---|---|---|
| HUMCFX_PEA_1_T1 (SEQ ID NO: 4101) | 1155 | 1171 |

This segment can be found in the following protein(s): HUMCFX_PEA_1_P39.

Segment cluster HUMCFX_PEA_1_node_46 (SEQ ID NO:5188) according to the present invention is supported by 53 libraries. The number of libraries was determined as previously described. This segment can be found in the following transcript(s): HUMCFX_PEA_1_T1 (SEQ ID NO:4101). Table 4642 below describes the starting and ending position of this segment on each transcript.

TABLE 4642

Segment location on transcripts

| Transcript name | Segment starting position | Segment ending position |
|---|---|---|
| HUMCFX_PEA_1_T1 (SEQ ID NO: 4101) | 1172 | 1198 |

This segment can be found in the following protein(s): HUMCFX_PEA_1_P39.

Segment cluster HUMCFX_PEA_1_node_47 (SEQ ID NO:5189) according to the present invention can be found in the following transcript(s): HUMCFX_PEA_1_T1 (SEQ ID NO:4101). Table 4643 below describes the starting and ending position of this segment on each transcript.

TABLE 4643

Segment location on transcripts

| Transcript name | Segment starting position | Segment ending position |
|---|---|---|
| HUMCFX_PEA_1_T1 (SEQ ID NO: 4101) | 1199 | 1207 |

This segment can be found in the following protein(s): HUMCFX_PEA_1_P39.

Segment cluster HUMCFX_PEA_1_node_48 (SEQ ID NO:5190) according to the present invention can be found in the following transcript(s): HUMCFX_PEA_1_T1 (SEQ ID NO:4101). Table 4644 below describes the starting and ending position of this segment on each transcript.

TABLE 4644

Segment location on transcripts

| Transcript name | Segment starting position | Segment ending position |
|---|---|---|
| HUMCFX_PEA_1_T1 (SEQ ID NO: 4101) | 1208 | 1227 |

This segment can be found in the following protein(s): HUMCFX_PEA_1_P39.

Segment cluster HUMCFX_PEA_1_node_49 (SEQ ID NO:5191) according to the present invention can be found in the following transcript(s): HUMCFX_PEA_1_T1 (SEQ ID NO:4101). Table 4645 below describes the starting and ending position of this segment on each transcript.

TABLE 4645

Segment location on transcripts

| Transcript name | Segment starting position | Segment ending position |
|---|---|---|
| HUMCFX_PEA_1_T1 (SEQ ID NO: 4101) | 1228 | 1242 |

This segment can be found in the following protein(s): HUMCFX_PEA_1_P39.

Segment cluster HUMCFX_PEA_1_node_50 (SEQ ID NO:5192) according to the present invention can be found in the following transcript(s): HUMCFX_PEA_1_T1 (SEQ ID NO:4101). Table 4646 below describes the starting and ending position of this segment on each transcript.

TABLE 4646

Segment location on transcripts

| Transcript name | Segment starting position | Segment ending position |
|---|---|---|
| HUMCFX_PEA_1_T1 (SEQ ID NO: 4101) | 1243 | 1258 |

This segment can be found in the following protein(s): HUMCFX_PEA_1_P39.

Segment cluster HUMCFX_PEA_1_node_51 (SEQ ID NO:5193) according to the present invention can be found in the following transcript(s): HUMCFX_PEA_1_T1 (SEQ ID NO:4101). Table 4647 below describes the starting and ending position of this segment on each transcript.

TABLE 4647

Segment location on transcripts

| Transcript name | Segment starting position | Segment ending position |
|---|---|---|
| HUMCFX_PEA_1_T1 (SEQ ID NO: 4101) | 1259 | 1270 |

This segment can be found in the following protein(s): HUMCFX_PEA_1_P39.

Segment cluster HUMCFX_PEA_1_node_52 (SEQ ID NO:5194) according to the present invention can be found in the following transcript(s): HUMCFX_PEA_1_T1 (SEQ ID NO:4101). Table 4648 below describes the starting and ending position of this segment on each transcript.

TABLE 4648

| Segment location on transcripts | | |
|---|---|---|
| Transcript name | Segment starting position | Segment ending position |
| HUMCFX_PEA_1_T1 (SEQ ID NO: 4101) | 1271 | 1278 |

This segment can be found in the following protein(s): HUMCFX_PEA_1_P39.

Segment cluster HUMCFX_PEA_1_node_53 (SEQ ID NO:5195) according to the present invention can be found in the following transcript(s): HUMCFX_PEA_1_T1 (SEQ ID NO:4101). Table 4649 below describes the starting and ending position of this segment on each transcript.

TABLE 4649

| Segment location on transcripts | | |
|---|---|---|
| Transcript name | Segment starting position | Segment ending position |
| HUMCFX_PEA_1_T1 (SEQ ID NO: 4101) | 1279 | 1287 |

This segment can be found in the following protein(s): HUMCFX_PEA_1_P39.

Segment cluster HUMCFX_PEA_1_node_54 (SEQ ID NO:5196) according to the present invention is supported by 63 libraries. The number of libraries was determined as previously described. This segment can be found in the following transcript(s): HUMCFX_PEA_1_T1 (SEQ ID NO:4101). Table 4650 below describes the starting and ending position of this segment on each transcript.

TABLE 4650

| Segment location on transcripts | | |
|---|---|---|
| Transcript name | Segment starting position | Segment ending position |
| HUMCFX_PEA_1_T1 (SEQ ID NO: 4101) | 1288 | 1330 |

This segment can be found in the following protein(s): HUMCFX_PEA_1_P39.

Segment cluster HUMCFX_PEA_1_node_55 (SEQ ID NO:5197) according to the present invention is supported by 67 libraries. The number of libraries was determined as previously described. This segment can be found in the following transcript(s): HUMCFX_PEA_1_T1 (SEQ ID NO:4101). Table 4651 below describes the starting and ending position of this segment on each transcript.

TABLE 4651

| Segment location on transcripts | | |
|---|---|---|
| Transcript name | Segment starting position | Segment ending position |
| HUMCFX_PEA_1_T1 (SEQ ID NO: 4101) | 1331 | 1357 |

This segment can be found in the following protein(s): HUMCFX_PEA_1_P39.

Segment cluster HUMCFX_PEA_1_node_56 (SEQ ID NO:5198) according to the present invention can be found in the following transcript(s): HUMCFX_PEA_1_T1 (SEQ ID NO:4101). Table 4652 below describes the starting and ending position of this segment on each transcript.

TABLE 4652

| Segment location on transcripts | | |
|---|---|---|
| Transcript name | Segment starting position | Segment ending position |
| HUMCFX_PEA_1_T1 (SEQ ID NO: 4101) | 1358 | 1373 |

This segment can be found in the following protein(s): HUMCFX_PEA_1_P39.

Segment cluster HUMCFX_PEA_1_node_57 (SEQ ID NO:5199) according to the present invention can be found in the following transcript(s): HUMCFX_PEA_1_T1 (SEQ ID NO:4101). Table 4653 below describes the starting and ending position of this segment on each transcript.

TABLE 4653

| Segment location on transcripts | | |
|---|---|---|
| Transcript name | Segment starting position | Segment ending position |
| HUMCFX_PEA_1_T1 (SEQ ID NO: 4101) | 1374 | 1393 |

This segment can be found in the following protein(s): HUMCFX_PEA_1_P39.

Segment cluster HUMCFX_PEA_1_node_58 (SEQ ID NO:5200) according to the present invention can be found in the following transcript(s): HUMCFX_PEA_1_T1 (SEQ ID NO:4101). Table 4654 below describes the starting and ending position of this segment on each transcript.

TABLE 4654

| Segment location on transcripts | | |
|---|---|---|
| Transcript name | Segment starting position | Segment ending position |
| HUMCFX_PEA_1_T1 (SEQ ID NO: 4101) | 1394 | 1413 |

This segment can be found in the following protein(s): HUMCFX_PEA_1_P39.

Segment cluster HUMCFX_PEA_1_node_59 (SEQ ID NO:5201) according to the present invention is supported by 69 libraries. The number of libraries was determined as previously described. This segment can be found in the following transcript(s): HUMCFX_PEA_1_T1 (SEQ ID NO:4101). Table 4655 below describes the starting and ending position of this segment on each transcript.

TABLE 4655

| Segment location on transcripts | | |
|---|---|---|
| Transcript name | Segment starting position | Segment ending position |
| HUMCFX_PEA_1_T1 (SEQ ID NO: 4101) | 1414 | 1485 |

This segment can be found in the following protein(s): HUMCFX_PEA_1_P39.

Segment cluster HUMCFX_PEA_1_node_60 (SEQ ID NO:5202) according to the present invention can be found in the following transcript(s): HUMCFX_PEA_1_T1 (SEQ ID NO:4101). Table 4656 below describes the starting and ending position of this segment on each transcript.

TABLE 4656

| | Segment location on transcripts | |
|---|---|---|
| Transcript name | Segment starting position | Segment ending position |
| HUMCFX_PEA_1_T1 (SEQ ID NO: 4101) | 1486 | 1494 |

This segment can be found in the following protein(s): HUMCFX_PEA_1_P39.

Segment cluster HUMCFX_PEA_1_node_61 (SEQ ID NO:5203) according to the present invention can be found in the following transcript(s): HUMCFX_PEA_1_T1 (SEQ ID NO:4101). Table 4657 below describes the starting and ending position of this segment on each transcript.

TABLE 4657

| | Segment location on transcripts | |
|---|---|---|
| Transcript name | Segment starting position | Segment ending position |
| HUMCFX_PEA_1_T1 (SEQ ID NO: 4101) | 1495 | 1506 |

This segment can be found in the following protein(s): HUMCFX_PEA_1_P39.

Segment cluster HUMCFX_PEA_1_node_62 (SEQ ID NO:5204) according to the present invention is supported by 66 libraries. The number of libraries was determined as previously described. This segment can be found in the following transcript(s): HUMCFX_PEA_1_T1 (SEQ ID NO:4101). Table 4658 below describes the starting and ending position of this segment on each transcript.

TABLE 4658

| | Segment location on transcripts | |
|---|---|---|
| Transcript name | Segment starting position | Segment ending position |
| HUMCFX_PEA_1_T1 (SEQ ID NO: 4101) | 1507 | 1616 |

This segment can be found in the following protein(s): HUMCFX_PEA_1_P39.

Segment cluster HUMCFX_PEA_1_node_63 (SEQ ID NO:5205) according to the present invention is supported by 63 libraries. The number of libraries was determined as previously described. This segment can be found in the following transcript(s): HUMCFX_PEA_1_T1 (SEQ ID NO:4101). Table 4659 below describes the starting and ending position of this segment on each transcript.

TABLE 4659

| | Segment location on transcripts | |
|---|---|---|
| Transcript name | Segment starting position | Segment ending position |
| HUMCFX_PEA_1_T1 (SEQ ID NO: 4101) | 1617 | 1663 |

This segment can be found in the following protein(s): HUMCFX_PEA_1_P39.

Segment cluster HUMCFX_PEA_1_node_64 (SEQ ID NO:5206) according to the present invention is supported by 59 libraries. The number of libraries was determined as previously described. This segment can be found in the following transcript(s): HUMCFX_PEA_1_T1 (SEQ ID NO:4101). Table 4660 below describes the starting and ending position of this segment on each transcript.

TABLE 4660

| | Segment location on transcripts | |
|---|---|---|
| Transcript name | Segment starting position | Segment ending position |
| HUMCFX_PEA_1_T1 (SEQ ID NO: 4101) | 1664 | 1773 |

This segment can be found in the following protein(s): HUMCFX_PEA_1_P39.

Description for Cluster HUMEB2CR2

Cluster HUMEB2CR2 features 3 transcript(s) and 23 segment(s) of interest, the names for which are given in Tables 4661 and 4662, respectively, the sequences themselves are given at the end of the application. The selected protein variants are given in Table 4663.

TABLE 4661

| Transcripts of interest Transcript Name |
|---|
| HUMEB2CR2_PEA_1_T4 (SEQ ID NO: 4103) |
| HUMEB2CR2_PEA_1_T5 (SEQ ID NO: 4104) |
| HUMEB2CR2_PEA_1_T8 (SEQ ID NO: 4105) |

TABLE 4662

| Segments of interest Segment Name |
|---|
| HUMEB2CR2_PEA_1_node_2 (SEQ ID NO: 5207) |
| HUMEB2CR2_PEA_1_node_5 (SEQ ID NO: 5208) |
| HUMEB2CR2_PEA_1_node_7 (SEQ ID NO: 5209) |
| HUMEB2CR2_PEA_1_node_8 (SEQ ID NO: 5210) |
| HUMEB2CR2_PEA_1_node_14 (SEQ ID NO: 5211) |
| HUMEB2CR2_PEA_1_node_16 (SEQ ID NO: 5212) |
| HUMEB2CR2_PEA_1_node_23 (SEQ ID NO: 5213) |
| HUMEB2CR2_PEA_1_node_31 (SEQ ID NO: 5214) |

TABLE 4662-continued

Segments of interest
Segment Name

HUMEB2CR2_PEA_1_node_33 (SEQ ID NO: 5215)
HUMEB2CR2_PEA_1_node_35 (SEQ ID NO: 5216)
HUMEB2CR2_PEA_1_node_37 (SEQ ID NO: 5217)
HUMEB2CR2_PEA_1_node_43 (SEQ ID NO: 5218)
HUMEB2CR2_PEA_1_node_47 (SEQ ID NO: 5219)
HUMEB2CR2_PEA_1_node_10 (SEQ ID NO: 5220)
HUMEB2CR2_PEA_1_node_12 (SEQ ID NO: 5221)
HUMEB2CR2_PEA_1_node_18 (SEQ ID NO: 5222)
HUMEB2CR2_PEA_1_node_21 (SEQ ID NO: 5223)
HUMEB2CR2_PEA_1_node_27 (SEQ ID NO: 5224)
HUMEB2CR2_PEA_1_node_29 (SEQ ID NO: 5225)
HUMEB2CR2_PEA_1_node_32 (SEQ ID NO: 5226)
HUMEB2CR2_PEA_1_node_39 (SEQ ID NO: 5227)
HUMEB2CR2_PEA_1_node_41 (SEQ ID NO: 5228)
HUMEB2CR2_PEA_1_node_44 (SEQ ID NO: 5229)

TABLE 4663

Proteins of interest

| Protein Name | Corresponding Transcript(s) |
|---|---|
| HUMEB2CR2_PEA_1_P5 | HUMEB2CR2_PEA_1_T4 (SEQ ID NO: 4103) |
| HUMEB2CR2_PEA_1_P6 | HUMEB2CR2_PEA_1_T5 (SEQ ID NO: 4104) |

These sequences are variants of the known protein Complement receptor type 2 precursor (SwissProt accession identifier CR2_HUMAN; known also according to the synonyms Cr2; Complement C3d receptor; Epstein-Barr virus receptor; EBV receptor; CD21 antigen), referred to herein as the previously known protein.

Protein Complement receptor type 2 precursor is known or believed to have the following function(s): Receptor for complement C3Dd and for the Epstein-Barr virus on human B-cells and T-cells. Participates in B lymphocytes activation. The sequence for protein Complement receptor type 2 precursor is given at the end of the application, as "Complement receptor type 2 precursor amino acid sequence". Known polymorphisms for this sequence are as shown in Table 4664.

TABLE 4664

Amino acid mutations for Known Protein

| SNP position(s) on amino acid sequence | Comment |
|---|---|
| 639 | S -> N (in dbSNP:17615). /FTId = VAR_016164. |
| 993 | I -> V (in dbSNP:17618). /FTId = VAR_016165. |
| 1003 | E -> A (in dbSNP:17617). /FTId = VAR_016166. |
| 457 | Missing |
| 646 | A -> R |

TABLE 4664-continued

Amino acid mutations for Known Protein

| SNP position(s) on amino acid sequence | Comment |
|---|---|
| 667 | Q -> D |
| 759-787 | KLQCRSDSKGHGSWSGPSPQCLRSPPVTR -> NCSAEVIL KAWILERAFPQCLRSL |
| 886 | L -> V |
| 890 | A -> P |
| 902 | Q -> G |
| 906 | H -> L |

Protein Complement receptor type 2 precursor localization is believed to be Type I membrane protein.

The following GO Annotation(s) apply to the previously known protein. The following annotation(s) were found: immune response; complement activation, classical pathway, which are annotation(s) related to Biological Process; complement receptor; transmembrane receptor, which are annotation(s) related to Molecular Function; and plasma membrane; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMEB2CR2 features 23 segment(s), which were listed in Table 4662 above and for which the sequence(s) are given at the end of the application. These segment(s) are portions of nucleic acid sequence(s) which are described herein separately because they are of particular interest. A description of each segment according to the present invention is now provided.

Segment cluster HUMEB2CR2_PEA_1_node_2 (SEQ ID NO:5207) according to the present invention is supported by 1 libraries. The number of libraries was determined as previously described. This segment can be found in the following transcript(s): HUMEB2CR2_PEA_1_T4 (SEQ ID NO:4103). Table 4665 below describes the starting and ending position of this segment on each transcript.

TABLE 4665

Segment location on transcripts

| Transcript name | Segment starting position | Segment ending position |
|---|---|---|
| HUMEB2CR2_PEA_1_T4 (SEQ ID NO: 4103) | 1 | 312 |

This segment can be found in a non-coding region of transcript(s) that are related to the following protein(s): HUMEB2CR2_PEA_1_P5.

Segment cluster HUMEB2CR2_PEA_1_node_5 (SEQ ID NO:5208) according to the present invention is supported by 7 libraries. The number of libraries was determined as previously described. This segment can be found in the following transcript(s): HUMEB2CR2_PEA_1_T4 (SEQ ID NO:4103). Table 4666 below describes the starting and ending position of this segment on each transcript.

TABLE 4666

Segment location on transcripts

| Transcript name | Segment starting position | Segment ending position |
|---|---|---|
| HUMEB2CR2_PEA_1_T4 (SEQ ID NO: 4103) | 313 | 699 |

This segment can be found in the following protein(s): HUMEB2CR2_PEA_1_P5.

Segment cluster HUMEB2CR2_PEA_1_node_7 (SEQ ID NO:5209) according to the present invention is supported by 4 libraries. The number of libraries was determined as previously described. This segment can be found in the following transcript(s): HUMEB2CR2_PEA_1_T5 (SEQ ID NO:4104). Table 4667 below describes the starting and ending position of this segment on each transcript.

TABLE 4667

Segment location on transcripts

| Transcript name | Segment starting position | Segment ending position |
|---|---|---|
| HUMEB2CR2_PEA_1_T5 (SEQ ID NO: 4104) | 1 | 226 |

This segment can be found in a non-coding region of transcript(s) that are related to the following protein(s): HUMEB2CR2_PEA_1_P6.

Segment cluster HUMEB2CR2_PEA_1_node_8 (SEQ ID NO:5210) according to the present invention is supported by 8 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4668 below describes the starting and ending position of this segment on each transcript.

TABLE 4668

Segment location on transcripts

| Transcript name | Segment starting position | Segment ending position |
|---|---|---|
| HUMEB2CR2_PEA_1_T4 (SEQ ID NO: 4103) | 700 | 888 |
| HUMEB2CR2_PEA_1_T5 (SEQ ID NO: 4104) | 227 | 415 |

This segment can be found in the following protein(s): HUMEB2CR2_PEA_1_P5 and HUMEB2CR2_PEA_1_P6.

Segment cluster HUMEB2CR2_PEA_1_node_14 (SEQ ID NO:5211) according to the present invention is supported by 13 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4669 below describes the starting and ending position of this segment on each transcript.

TABLE 4669

Segment location on transcripts

| Transcript name | Segment starting position | Segment ending position |
|---|---|---|
| HUMEB2CR2_PEA_1_T4 (SEQ ID NO: 4103) | 1072 | 1479 |
| HUMEB2CR2_PEA_1_T5 (SEQ ID NO: 4104) | 599 | 1006 |

This segment can be found in the following protein(s): HUMEB2CR2_PEA_1_P5 and HUMEB2CR2_PEA_1_P66.

Segment cluster HUMEB2CR2_PEA_1_node_16 (SEQ ID NO:5212) according to the present invention is supported by 8 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4670 below describes the starting and ending position of this segment on each transcript.

TABLE 4670

Segment location on transcripts

| Transcript name | Segment starting position | Segment ending position |
|---|---|---|
| HUMEB2CR2_PEA_1_T4 (SEQ ID NO: 4103) | 1480 | 1656 |
| HUMEB2CR2_PEA_1_T5 (SEQ ID NO: 4104) | 1007 | 1183 |

This segment can be found in the following protein(s): HUMEB2CR2_PEA_1_P5 and HUMEB2CR2_PEA_1_P6.

Segment cluster HUMEB2CR2_PEA_1_node_23 (SEQ ID NO:5213) according to the present invention is supported by 15 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4671 below describes the starting and ending position of this segment on each transcript.

TABLE 4671

Segment location on transcripts

| Transcript name | Segment starting position | Segment ending position |
|---|---|---|
| HUMEB2CR2_PEA_1_T4 (SEQ ID NO: 4103) | 1825 | 2232 |
| HUMEB2CR2_PEA_1_T5 (SEQ ID NO: 4104) | 1352 | 1759 |

This segment can be found in the following protein(s): HUMEB2CR2_PEA_1_P5 and HUMEB2CR2_PEA_1_P66.

Segment cluster HUMEB2CR2_PEA_1_node_31 (SEQ ID NO:5214) according to the present invention is supported by 18 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4672 below describes the starting and ending position of this segment on each transcript.

TABLE 4672

Segment location on transcripts

| Transcript name | Segment starting position | Segment ending position |
|---|---|---|
| HUMEB2CR2_PEA_1_T4 (SEQ ID NO: 4103) | 2401 | 2604 |
| HUMEB2CR2_PEA_1_T5 (SEQ ID NO: 4104) | 1928 | 2131 |

This segment can be found in the following protein(s): HUMEB2CR2_PEA_1_P5 and HUMEB2CR2_PEA_1_P6.

Segment cluster HUMEB2CR2_PEA_1_node_33 (SEQ ID NO:5215) according to the present invention is supported by 21 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4673 below describes the starting and ending position of this segment on each transcript.

TABLE 4673

Segment location on transcripts

| Transcript name | Segment starting position | Segment ending position |
|---|---|---|
| HUMEB2CR2_PEA_1_T4 (SEQ ID NO: 4103) | 2616 | 2793 |
| HUMEB2CR2_PEA_1_T5 (SEQ ID NO: 4104) | 2143 | 2320 |

This segment can be found in the following protein(s): HUMEB2CR2_PEA_1_P5 and HUMEB2CR2_PEA_1_P6.

Segment cluster HUMEB2CR2_PEA_1_node_35 (SEQ ID NO:5216) according to the present invention is supported by 17 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4674 below describes the starting and ending position of this segment on each transcript.

TABLE 4674

Segment location on transcripts

| Transcript name | Segment starting position | Segment ending position |
|---|---|---|
| HUMEB2CR2_PEA_1_T4 (SEQ ID NO: 4103) | 2794 | 2979 |
| HUMEB2CR2_PEA_1_T5 (SEQ ID NO: 4104) | 2321 | 2506 |

This segment can be found in the following protein(s): HUMEB2CR2_PEA_1_P5 and HUMEB2CR2_PEA_1_P6.

Segment cluster HUMEB2CR2_PEA_1_node_37 (SEQ ID NO:5217) according to the present invention is supported by 22 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4675 below describes the starting and ending position of this segment on each transcript.

TABLE 4675

Segment location on transcripts

| Transcript name | Segment starting position | Segment ending position |
|---|---|---|
| HUMEB2CR2_PEA_1_T4 (SEQ ID NO: 4103) | 2980 | 3165 |
| HUMEB2CR2_PEA_1_T5 (SEQ ID NO: 4104) | 2507 | 2692 |

This segment can be found in the following protein(s): HUMEB2CR2_PEA_1_P5 and HUMEB2CR2_PEA_1_P6.

Segment cluster HUMEB2CR2_PEA_1_node_43 (SEQ ID NO:5218) according to the present invention is supported by 2 libraries. The number of libraries was determined as previously described. This segment can be found in the following transcript(s): HUMEB2CR2_PEA_1_T8 (SEQ ID NO:4105). Table 4676 below describes the starting and ending position of this segment on each transcript.

TABLE 4676

Segment location on transcripts

| Transcript name | Segment starting position | Segment ending position |
|---|---|---|
| HUMEB2CR2_PEA_1_T8 (SEQ ID NO: 4105) | 1 | 278 |

The previously-described transcripts for these segment(s) do not code for protein.

Segment cluster HUMEB2CR2_PEA_1_node_47 (SEQ ID NO:5219) according to the present invention is supported by 41 libraries. The number of libraries was determined as previously described. This segment can be found in the following transcript(s): HUMEB2CR2_PEA_1_T4 (SEQ ID NO:4103), HUMEB2CR2_PEA_1_T5 (SEQ ID NO:4104) and HUMEB2CR2_PEA_1_T8 (SEQ ID NO:4105). Table 4677 below describes the starting and ending position of this segment on each transcript.

TABLE 4677

Segment location on transcripts

| Transcript name | Segment starting position | Segment ending position |
|---|---|---|
| HUMEB2CR2_PEA_1_T4 (SEQ ID NO: 4103) | 3375 | 4134 |
| HUMEB2CR2_PEA_1_T5 (SEQ ID NO: 4104) | 2902 | 3661 |
| HUMEB2CR2_PEA_1_T8 (SEQ ID NO: 4105) | 388 | 1147 |

This segment can be found in a non-coding region of transcript(s) that are related to the following protein(s): HUMEB2CR2_PEA_1_P5 and HUMEB2CR2_PEA_1_P6.

According to an optional embodiment of the present invention, short segments related to the above cluster are also provided. These segments are up to about 120 bp in length, and so are included in a separate description.

Segment cluster HUMEB2CR2_PEA_1_node_10 (SEQ ID NO:5220) according to the present invention is supported by 9 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4678 below describes the starting and ending position of this segment on each transcript.

TABLE 4678

Segment location on transcripts

| Transcript name | Segment starting position | Segment ending position |
|---|---|---|
| HUMEB2CR2_PEA_1_T4 (SEQ ID NO: 4103) | 889 | 988 |
| HUMEB2CR2_PEA_1_T5 (SEQ ID NO: 4104) | 416 | 515 |

This segment can be found in the following protein(s): HUMEB2CR2_PEA_1_P5 and HUMEB2CR2_PEA_1_P6.

Segment cluster HUMEB2CR2_PEA_1_node_12 (SEQ ID NO:5221) according to the present invention is supported by 9 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4679 below describes the starting and ending position of this segment on each transcript.

TABLE 4679

Segment location on transcripts

| Transcript name | Segment starting position | Segment ending position |
|---|---|---|
| HUMEB2CR2_PEA_1_T4 (SEQ ID NO: 4103) | 989 | 1071 |
| HUMEB2CR2_PEA_1_T5 (SEQ ID NO: 4104) | 516 | 598 |

This segment can be found in the following protein(s): HUMEB2CR2_PEA_1_P5 and HUMEB2CR2_PEA_1_P6.

Segment cluster HUMEB2CR2_PEA_1_node_18 (SEQ ID NO:5222) according to the present invention is supported by 7 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4680 below describes the starting and ending position of this segment on each transcript.

TABLE 4680

Segment location on transcripts

| Transcript name | Segment starting position | Segment ending position |
|---|---|---|
| HUMEB2CR2_PEA_1_T4 (SEQ ID NO: 4103) | 1657 | 1747 |
| HUMEB2CR2_PEA_1_T5 (SEQ ID NO: 4104) | 1184 | 1274 |

This segment can be found in the following protein(s): HUMEB2CR2_PEA_1_P5 and HUMEB2CR2_PEA_1_P6.

Segment cluster HUMEB2CR2_PEA_1_node_21 (SEQ ID NO:5223) according to the present invention is supported by 9 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4681 below describes the starting and ending position of this segment on each transcript.

TABLE 4681

Segment location on transcripts

| Transcript name | Segment starting position | Segment ending position |
|---|---|---|
| HUMEB2CR2_PEA_1_T4 (SEQ ID NO: 4103) | 1748 | 1824 |
| HUMEB2CR2_PEA_1_T5 (SEQ ID NO: 4104) | 1275 | 1351 |

This segment can be found in the following protein(s): HUMEB2CR2_PEA_1_P5 and HUMEB2CR2_PEA_1_P6.

Segment cluster HUMEB2CR2_PEA_1_node_27 (SEQ ID NO:5224) according to the present invention is supported by 12 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4682 below describes the starting and ending position of this segment on each transcript.

TABLE 4682

Segment location on transcripts

| Transcript name | Segment starting position | Segment ending position |
|---|---|---|
| HUMEB2CR2_PEA_1_T4 (SEQ ID NO: 4103) | 2233 | 2317 |
| HUMEB2CR2_PEA_1_T5 (SEQ ID NO: 4104) | 1760 | 1844 |

This segment can be found in the following protein(s): HUMEB2CR2_PEA_1_P5 and HUMEB2CR2_PEA_1_P6.

Segment cluster HUMEB2CR2_PEA_1_node_29 (SEQ ID NO:5225) according to the present invention is supported by 12 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4683 below describes the starting and ending position of this segment on each transcript.

TABLE 4683

Segment location on transcripts

| Transcript name | Segment starting position | Segment ending position |
|---|---|---|
| HUMEB2CR2_PEA_1_T4 (SEQ ID NO: 4103) | 2318 | 2400 |
| HUMEB2CR2_PEA_1_T5 (SEQ ID NO: 4104) | 1845 | 1927 |

This segment can be found in the following protein(s): HUMEB2CR2_PEA_1_P5 and HUMEB2CR2_PEA_1_P6.

Segment cluster HUMEB2CR2_PEA_1_node_32 (SEQ ID NO:5226) according to the present invention can be found in the following transcript(s): HUMEB2CR2_PEA_1_T4 (SEQ ID NO:4103) and HUMEB2CR2_PEA_1_T5 (SEQ ID NO:4104). Table 4684 below describes the starting and ending position of this segment on each transcript.

TABLE 4684

Segment location on transcripts

| Transcript name | Segment starting position | Segment ending position |
|---|---|---|
| HUMEB2CR2_PEA_1_T4 (SEQ ID NO: 4103) | 2605 | 2615 |
| HUMEB2CR2_PEA_1_T5 (SEQ ID NO: 4104) | 2132 | 2142 |

This segment can be found in the following protein(s): HUMEB2CR2_PEA_1_P5 and HUMEB2CR2_PEA_1_P6.

Segment cluster HUMEB2CR2_PEA_1_node_39 (SEQ ID NO:5227) according to the present invention can be found in the following transcript(s): HUMEB2CR2_PEA_1_T4 (SEQ ID NO:4103) and HUMEB2CR2_PEA_1_T5 (SEQ ID NO:4104). Table 4685 below describes the starting and ending position of this segment on each transcript.

TABLE 4685

Segment location on transcripts

| Transcript name | Segment starting position | Segment ending position |
|---|---|---|
| HUMEB2CR2_PEA_1_T4 (SEQ ID NO: 4103) | 3166 | 3189 |
| HUMEB2CR2_PEA_1_T5 (SEQ ID NO: 4104) | 2693 | 2716 |

This segment can be found in the following protein(s): HUMEB2CR2_PEA_1_P5 and HUMEB2CR2_PEA_1_P6.

Segment cluster HUMEB2CR2_PEA_1_node_41 (SEQ ID NO:5228) according to the present invention is supported by 17 libraries. The number of libraries was determined as previously described. This segment can be found in the following transcript(s): HUMEB2CR2_PEA_1_T4 (SEQ ID NO:4103) and HUMEB2CR2_PEA_1_T5 (SEQ ID NO:4104). Table 4686 below describes the starting and ending position of this segment on each transcript.

TABLE 4686

Segment location on transcripts

| Transcript name | Segment starting position | Segment ending position |
|---|---|---|
| HUMEB2CR2_PEA_1_T4 (SEQ ID NO: 4103) | 3190 | 3265 |
| HUMEB2CR2_PEA_1_T5 (SEQ ID NO: 4104) | 2717 | 2792 |

This segment can be found in the following protein(s): HUMEB2CR2_PEA_1_P5 and HUMEB2CR2_PEA_1_P6.

Segment cluster HUMEB2CR2_PEA_1_node_44 (SEQ ID NO:5229) according to the present invention is supported by 20 libraries. The number of libraries was determined as previously described. This segment can be found in the following transcript(s): HUMEB2CR2_PEA_1_T4 (SEQ ID NO:4103), HUMEB2CR2_PEA_1_T5 (SEQ ID NO:4104) and HUMEB2CR2_PEA_1_T8 (SEQ ID NO:4105). Table 4687 below describes the starting and ending position of this segment on each transcript.

TABLE 4687

Segment location on transcripts

| Transcript name | Segment starting position | Segment ending position |
|---|---|---|
| HUMEB2CR2_PEA_1_T4 (SEQ ID NO: 4103) | 3266 | 3374 |
| HUMEB2CR2_PEA_1_T5 (SEQ ID NO: 4104) | 2793 | 2901 |
| HUMEB2CR2_PEA_1_T8 (SEQ ID NO: 4105) | 279 | 387 |

This segment can be found in the following protein(s): HUMEB2CR2_PEA_1_P5 and HUMEB2CR2_PEA_1_P6.

Description for Cluster HUMFXI

Cluster HUMFXI features 17 transcript(s) and 28 segment(s) of interest, the names for which are given in Tables 4688 and 4689, respectively, the sequences themselves are given at the end of the application. The selected protein variants are given in Table 4690.

TABLE 4688

Transcripts of interest

| Transcript Name |
|---|
| HUMFXI_PEA_1_T0 (SEQ ID NO: 4106) |
| HUMFXI_PEA_1_T2 (SEQ ID NO: 4107) |
| HUMFXI_PEA_1_T3 (SEQ ID NO: 4108) |
| HUMFXI_PEA_1_T5 (SEQ ID NO: 4109) |
| HUMFXI_PEA_1_T6 (SEQ ID NO: 4110) |
| HUMFXI_PEA_1_T7 (SEQ ID NO: 4111) |
| HUMFXI_PEA_1_T8 (SEQ ID NO: 4112) |
| HUMFXI_PEA_1_T9 (SEQ ID NO: 4113) |
| HUMFXI_PEA_1_T10 (SEQ ID NO: 4114) |
| HUMFXI_PEA_1_T11 (SEQ ID NO: 4115) |
| HUMFXI_PEA_1_T12 (SEQ ID NO: 4116) |
| HUMFXI_PEA_1_T14 (SEQ ID NO: 4117) |
| HUMFXI_PEA_1_T15 (SEQ ID NO: 4118) |
| HUMFXI_PEA_1_T16 (SEQ ID NO: 4119) |
| HUMFXI_PEA_1_T17 (SEQ ID NO: 4120) |
| HUMFXI_PEA_1_T18 (SEQ ID NO: 4121) |
| HUMFXI_PEA_1_T19 (SEQ ID NO: 4122) |

TABLE 4689

Segments of interest

| Segment Name |
|---|
| HUMFXI_PEA_1_node_0 (SEQ ID NO: 5230) |
| HUMFXI_PEA_1_node_3 (SEQ ID NO: 5231) |
| HUMFXI_PEA_1_node_7 (SEQ ID NO: 5232) |
| HUMFXI_PEA_1_node_12 (SEQ ID NO: 5233) |
| HUMFXI_PEA_1_node_13 (SEQ ID NO: 5234) |
| HUMFXI_PEA_1_node_17 (SEQ ID NO: 5235) |
| HUMFXI_PEA_1_node_26 (SEQ ID NO: 5236) |
| HUMFXI_PEA_1_node_30 (SEQ ID NO: 5237) |
| HUMFXI_PEA_1_node_32 (SEQ ID NO: 5238) |
| HUMFXI_PEA_1_node_38 (SEQ ID NO: 5239) |
| HUMFXI_PEA_1_node_40 (SEQ ID NO: 5240) |
| HUMFXI_PEA_1_node_41 (SEQ ID NO: 5241) |
| HUMFXI_PEA_1_node_43 (SEQ ID NO: 5242) |
| HUMFXI_PEA_1_node_1 (SEQ ID NO: 5243) |
| HUMFXI_PEA_1_node_2 (SEQ ID NO: 5244) |
| HUMFXI_PEA_1_node_5 (SEQ ID NO: 5245) |
| HUMFXI_PEA_1_node_10 (SEQ ID NO: 5246) |
| HUMFXI_PEA_1_node_15 (SEQ ID NO: 5247) |
| HUMFXI_PEA_1_node_19 (SEQ ID NO: 5248) |
| HUMFXI_PEA_1_node_21 (SEQ ID NO: 5249) |
| HUMFXI_PEA_1_node_22 (SEQ ID NO: 5250) |
| HUMFXI_PEA_1_node_23 (SEQ ID NO: 5251) |
| HUMFXI_PEA_1_node_24 (SEQ ID NO: 5252) |
| HUMFXI_PEA_1_node_27 (SEQ ID NO: 5253) |
| HUMFXI_PEA_1_node_28 (SEQ ID NO: 5254) |
| HUMFXI_PEA_1_node_34 (SEQ ID NO: 5255) |
| HUMFXI_PEA_1_node_36 (SEQ ID NO: 5256) |
| HUMFXI_PEA_1_node_37 (SEQ ID NO: 5257) |

TABLE 4690

Proteins of interest

| Protein Name | Corresponding Transcript(s) |
|---|---|
| HUMFXI_PEA_1_P1 | HUMFXI_PEA_1_T0 (SEQ ID NO: 4106); HUMFXI_PEA_1_T5 (SEQ ID NO: 4109) |
| HUMFXI_PEA_1_P2 | HUMFXI_PEA_1_T2 (SEQ ID NO: 4107) |
| HUMFXI_PEA_1_P4 | HUMFXI_PEA_1_T6 (SEQ ID NO: 4110); HUMFXI_PEA_1_T10 (SEQ ID NO: 4114) |
| HUMFXI_PEA_1_P6 | HUMFXI_PEA_1_T8 (SEQ ID NO: 4112) |
| HUMFXI_PEA_1_P7 | HUMFXI_PEA_1_T9 (SEQ ID NO: 4113) |
| HUMFXI_PEA_1_P8 | HUMFXI_PEA_1_T11 (SEQ ID NO: 4115) |
| HUMFXI_PEA_1_P11 | HUMFXI_PEA_1_T14 (SEQ ID NO: 4117) |
| HUMFXI_PEA_1_P12 | HUMFXI_PEA_1_T15 (SEQ ID NO: 4118) |
| HUMFXI_PEA_1_P13 | HUMFXI_PEA_1_T16 (SEQ ID NO: 4119) |
| HUMFXI_PEA_1_P14 | HUMFXI_PEA_1_T17 (SEQ ID NO: 4120) |
| HUMFXI_PEA_1_P15 | HUMFXI_PEA_1_T18 (SEQ ID NO: 4121) |
| HUMFXI_PEA_1_P17 | HUMFXI_PEA_1_T3 (SEQ ID NO: 4108) |
| HUMFXI_PEA_1_P18 | HUMFXI_PEA_1_T7 (SEQ ID NO: 4111) |
| HUMFXI_PEA_1_P19 | HUMFXI_PEA_1_T12 (SEQ ID NO: 4116) |

These sequences are variants of the known protein Coagulation factor XI precursor (SwissProt accession identifier FA11_HUMAN; known also according to the synonyms EC 3.4.21.27; Plasma thromboplastin antecedent; PTA; FXI), referred to herein as the previously known protein.

Protein Coagulation factor XI precursor is known or believed to have the following function(s): Factor XI triggers the middle phase of the intrinsic pathway of blood coagulation by activating factor IX. The sequence for protein Coagulation factor XI precursor is given at the end of the application, as "Coagulation factor XI precursor amino acid sequence". Known polymorphisms for this sequence are as shown in Table 4691.

TABLE 4691

Amino acid mutations for Known Protein

| SNP position(s) on amino acid sequence | Comment |
|---|---|
| 34 | D -> H (in F11 deficiency). /FTId = VAR_012085. |
| 66 | P -> L (in dbSNP:5968). /FTId = VAR_011774. |
| 244 | Q -> R (in F11 deficiency; dbSNP:5969). /FTId = VAR_011775. |
| 246 | W -> C (in F11 deficiency). /FTId = VAR_012086. |
| 266 | S -> N (in F11 deficiency). /FTId = VAR_012087. |
| 301 | F -> L (in F11 deficiency; frequent mutation in Ashkenazi patients). /FTId = VAR_006622. |
| 308 | I -> F (in dbSNP:5972). /FTId = VAR_011776. |
| 320 | L -> P (in F11 deficiency). /FTId = VAR_012088. |
| 322 | T -> I (in F11 deficiency). /FTId = VAR_012089. |
| 326 | R -> C (in F11 deficiency). /FTId = VAR_012090. |
| 339 | C -> F (in dbSNP:5967). /FTId = VAR_011777. |
| 341 | E -> K (in F11 deficiency). /FTId = VAR_012091. |
| 399 | W -> R (in dbSNP:1800439). /FTId = VAR_011778. |
| 404 | T -> N (in F11 deficiency). /FTId = VAR_012092. |
| 430 | A -> V (in F11 deficiency). /FTId = VAR_012093. |
| 460 | F -> V (in F11 deficiency). /FTId = VAR_012094. |
| 493 | T -> I (in F11 deficiency). /FTId = VAR_012095. |
| 594 | S -> R (in F11 deficiency). /FTId = VAR_012096. |
| 226 | C -> S |

Protein Coagulation factor XI precursor localization is believed to be Secreted.

The following GO Annotation(s) apply to the previously known protein. The following annotation(s) were found: proteolysis and peptidolysis; blood coagulation, which are annotation(s) related to Biological Process; blood coagulation factor IX; blood coagulation factor XI; chymotrypsin; trypsin; hydrolase, which are annotation(s) related to Molecular Function; and extracellular; membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMFXI features 28 segment(s), which were listed in Table 4689 above and for which the sequence(s) are given at the end of the application. These segment(s) are portions of nucleic acid sequence(s) which are described herein separately because they are of particular interest. A description of each segment according to the present invention is now provided.

Segment cluster HUMFXI_PEA_1_node_0 (SEQ ID NO:5230) according to the present invention is supported by 9 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118), HUMFXI_PEA_1_T18 (SEQ ID NO:4121) and HUMFXI_PEA_1_T19 (SEQ ID NO:4122). Table 4692 below describes the starting and ending position of this segment on each transcript.

TABLE 4692

Segment location on transcripts

| Transcript name | Segment starting position | Segment ending position |
|---|---|---|
| HUMFXI_PEA_1_T0 (SEQ ID NO: 4106) | 1 | 271 |
| HUMFXI_PEA_1_T2 (SEQ ID NO: 4107) | 1 | 271 |
| HUMFXI_PEA_1_T3 (SEQ ID NO: 4108) | 1 | 271 |
| HUMFXI_PEA_1_T5 (SEQ ID NO: 4109) | 1 | 271 |
| HUMFXI_PEA_1_T6 (SEQ ID NO: 4110) | 1 | 271 |
| HUMFXI_PEA_1_T7 (SEQ ID NO: 4111) | 1 | 271 |
| HUMFXI_PEA_1_T8 (SEQ ID NO: 4112) | 1 | 271 |
| HUMFXI_PEA_1_T9 (SEQ ID NO: 4113) | 1 | 271 |
| HUMFXI_PEA_1_T10 (SEQ ID NO: 4114) | 1 | 271 |
| HUMFXI_PEA_1_T11 (SEQ ID NO: 4115) | 1 | 271 |
| HUMFXI_PEA_1_T12 (SEQ ID NO: 4116) | 1 | 271 |
| HUMFXI_PEA_1_T14 (SEQ ID NO: 4117) | 1 | 271 |
| HUMFXI_PEA_1_T15 (SEQ ID NO: 4118) | 1 | 271 |
| HUMFXI_PEA_1_T18 (SEQ ID NO: 4121) | 1 | 271 |
| HUMFXI_PEA_1_T19 (SEQ ID NO: 4122) | 1 | 271 |

This segment can be found in a non-coding region of transcript(s) that are related to the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_3 (SEQ ID NO:5231) according to the present invention is supported by 1 libraries. The number of libraries was determined as previously described. This segment can be found in the following transcript(s): HUMFXI_PEA_1_T19 (SEQ ID NO:4122). Table 4693 below describes the starting and ending position of this segment on each transcript.

TABLE 4693

Segment location on transcripts

| Transcript name | Segment starting position | Segment ending position |
|---|---|---|
| HUMFXI_PEA_1_T19 (SEQ ID NO: 4122) | 325 | 789 |

The previously-described transcripts for these segment(s) do not code for protein.

Segment cluster HUMFXI_PEA_1_node_7 (SEQ ID NO:5232) according to the present invention is supported by 28 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118) and HUMFXI_PEA_1_T18 (SEQ ID NO:4121). Table 4694 below describes the starting and ending position of this segment on each transcript.

TABLE 4694

Segment location on transcripts

| Transcript name | Segment starting position | Segment ending position |
|---|---|---|
| HUMFXI_PEA_1_T0 (SEQ ID NO: 4106) | 381 | 543 |
| HUMFXI_PEA_1_T2 (SEQ ID NO: 4107) | 381 | 543 |
| HUMFXI_PEA_1_T3 (SEQ ID NO: 4108) | 381 | 543 |
| HUMFXI_PEA_1_T5 (SEQ ID NO: 4109) | 358 | 520 |
| HUMFXI_PEA_1_T6 (SEQ ID NO: 4110) | 381 | 543 |
| HUMFXI_PEA_1_T7 (SEQ ID NO: 4111) | 381 | 543 |
| HUMFXI_PEA_1_T8 (SEQ ID NO: 4112) | 381 | 543 |
| HUMFXI_PEA_1_T9 (SEQ ID NO: 4113) | 381 | 543 |
| HUMFXI_PEA_1_T10 (SEQ ID NO: 4114) | 381 | 543 |
| HUMFXI_PEA_1_T11 (SEQ ID NO: 4115) | 381 | 543 |

TABLE 4694-continued

Segment location on transcripts

| Transcript name | Segment starting position | Segment ending position |
|---|---|---|
| HUMFXI_PEA_1_T12 (SEQ ID NO: 4116) | 381 | 543 |
| HUMFXI_PEA_1_T14 (SEQ ID NO: 4117) | 381 | 543 |
| HUMFXI_PEA_1_T15 (SEQ ID NO: 4118) | 381 | 543 |
| HUMFXI_PEA_1_T18 (SEQ ID NO: 4121) | 381 | 543 |

This segment can be found in the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_12 (SEQ ID NO:5233) according to the present invention is supported by 35 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118) and HUMFXI_PEA_1_T18 (SEQ ID NO:4121). Table 4695 below describes the starting and ending position of this segment on each transcript.

TABLE 4695

Segment location on transcripts

| Transcript name | Segment starting position | Segment ending position |
|---|---|---|
| HUMFXI_PEA_1_T0 (SEQ ID NO: 4106) | 651 | 810 |
| HUMFXI_PEA_1_T2 (SEQ ID NO: 4107) | 651 | 810 |
| HUMFXI_PEA_1_T5 (SEQ ID NO: 4109) | 628 | 787 |
| HUMFXI_PEA_1_T6 (SEQ ID NO: 4110) | 651 | 810 |
| HUMFXI_PEA_1_T7 (SEQ ID NO: 4111) | 651 | 810 |
| HUMFXI_PEA_1_T8 (SEQ ID NO: 4112) | 651 | 810 |
| HUMFXI_PEA_1_T9 (SEQ ID NO: 4113) | 651 | 810 |
| HUMFXI_PEA_1_T10 (SEQ ID NO: 4114) | 651 | 810 |
| HUMFXI_PEA_1_T11 (SEQ ID NO: 4115) | 651 | 810 |
| HUMFXI_PEA_1_T12 (SEQ ID NO: 4116) | 651 | 810 |
| HUMFXI_PEA_1_T14 (SEQ ID NO: 4117) | 651 | 810 |
| HUMFXI_PEA_1_T15 (SEQ ID NO: 4118) | 651 | 810 |
| HUMFXI_PEA_1_T18 (SEQ ID NO: 4121) | 651 | 810 |

This segment can be found in the following protein(s): HUMFXI_PEA_1_P1, HUMFXI_PEA_1_P2, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_13 (SEQ ID NO:5234) according to the present invention is supported by 4 libraries. The number of libraries was determined as previously described. This segment can be found in the following transcript(s): HUMFXI_PEA_1_T18 (SEQ ID NO:4121). Table 4696 below describes the starting and ending position of this segment on each transcript.

TABLE 4696

Segment location on transcripts

| Transcript name | Segment starting position | Segment ending position |
|---|---|---|
| HUMFXI_PEA_1_T18 (SEQ ID NO: 4121) | 811 | 1431 |

This segment can be found in the following protein(s): HUMFXI_PEA_1_P15.

Segment cluster HUMFXI_PEA_1_node_17 (SEQ ID NO:5235) according to the present invention is supported by 21 libraries. The number of libraries was determined as previously described. This segment can be found in the following transcript(s): HUMFXI_PEA_1_T0 (SEQ ID NO:4106), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T14 (SEQ ID NO:4117) and HUMFXI_PEA_1_T15 (SEQ ID NO:4118). Table 4697 below describes the starting and ending position of this segment on each transcript.

TABLE 4697

Segment location on transcripts

| Transcript name | Segment starting position | Segment ending position |
|---|---|---|
| HUMFXI_PEA_1_T0 (SEQ ID NO: 4106) | 921 | 1080 |
| HUMFXI_PEA_1_T3 (SEQ ID NO: 4108) | 761 | 920 |
| HUMFXI_PEA_1_T5 (SEQ ID NO: 4109) | 898 | 1057 |
| HUMFXI_PEA_1_T6 (SEQ ID NO: 4110) | 921 | 1080 |
| HUMFXI_PEA_1_T7 (SEQ ID NO: 4111) | 811 | 970 |
| HUMFXI_PEA_1_T8 (SEQ ID NO: 4112) | 921 | 1080 |
| HUMFXI_PEA_1_T9 (SEQ ID NO: 4113) | 921 | 1080 |

TABLE 4697-continued

Segment location on transcripts

| Transcript name | Segment starting position | Segment ending position |
|---|---|---|
| HUMFXI_PEA_1_T10 (SEQ ID NO: 4114) | 921 | 1080 |
| HUMFXI_PEA_1_T14 (SEQ ID NO: 4117) | 921 | 1080 |
| HUMFXI_PEA_1_T15 (SEQ ID NO: 4118) | 921 | 1080 |

This segment can be found in both coding and non-coding regions of transcript(s) as follows. The segment can be found in a non-coding region of transcript(s) that are related to the following protein(s): HUMFXI_PEA_1_P17. This segment can also be found in the following protein(s): HUMFXI_PEA_1_P1, HUMFXI_PEA_1_P4, HUMFXI_PEA_1_P18, HUMFXI_PEA_1_P6, HUMFXI_PEA_1_P7, HUMFXI_PEA_1_P11 and HUMFXI_PEA_1_P12, since it is in the coding region for the corresponding transcript.

Segment cluster HUMFXI_PEA_1_node_26 (SEQ ID NO:5236) according to the present invention is supported by 2 libraries. The number of libraries was determined as previously described. This segment can be found in the following transcript(s): HUMFXI_PEA_1_T16 (SEQ ID NO:4119). Table 4698 below describes the starting and ending position of this segment on each transcript.

TABLE 4698

Segment location on transcripts

| Transcript name | Segment starting position | Segment ending position |
|---|---|---|
| HUMFXI_PEA_1_T16 (SEQ ID NO: 4119) | 1 | 574 |

This segment can be found in a non-coding region of transcript(s) that are related to the following protein(s): HUMFXI_PEA_1_P13.

Segment cluster HUMFXI_PEA_1_node_30 (SEQ ID NO:5237) according to the present invention is supported by 34 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117) and HUMFXI_PEA_1_T16 (SEQ ID NO:4119). Table 4699 below describes the starting and ending position of this segment on each transcript.

TABLE 4699

Segment location on transcripts

| Transcript name | Segment starting position | Segment ending position |
|---|---|---|
| HUMFXI_PEA_1_T0 (SEQ ID NO: 4106) | 1461 | 1629 |
| HUMFXI_PEA_1_T2 (SEQ ID NO: 4107) | 1191 | 1359 |
| HUMFXI_PEA_1_T3 (SEQ ID NO: 4108) | 1301 | 1469 |
| HUMFXI_PEA_1_T5 (SEQ ID NO: 4109) | 1438 | 1606 |
| HUMFXI_PEA_1_T6 (SEQ ID NO: 4110) | 1549 | 1717 |
| HUMFXI_PEA_1_T7 (SEQ ID NO: 4111) | 1351 | 1519 |
| HUMFXI_PEA_1_T8 (SEQ ID NO: 4112) | 1501 | 1669 |
| HUMFXI_PEA_1_T9 (SEQ ID NO: 4113) | 1461 | 1629 |
| HUMFXI_PEA_1_T10 (SEQ ID NO: 4114) | 1602 | 1770 |
| HUMFXI_PEA_1_T11 (SEQ ID NO: 4115) | 1279 | 1447 |
| HUMFXI_PEA_1_T12 (SEQ ID NO: 4116) | 1231 | 1399 |
| HUMFXI_PEA_1_T14 (SEQ ID NO: 4117) | 1461 | 1629 |
| HUMFXI_PEA_1_T16 (SEQ ID NO: 4119) | 628 | 796 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1, HUMFXI_PEA_1_P2, HUMFXI_PEA_1_P7, HUMFXI_PEA_1_P11 and HUMFXI_PEA_1_P13, since it is in the coding region for the corresponding transcript.

Segment cluster HUMFXI_PEA_1_node_32 (SEQ ID NO:5238) according to the present invention is supported by 30 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116) and HUMFXI_PEA_1_T16 (SEQ ID NO:4119). Table 4700 below describes the starting and ending position of this segment on each transcript.

TABLE 4700

Segment location on transcripts

| Transcript name | Segment starting position | Segment ending position |
|---|---|---|
| HUMFXI_PEA_1_T0 (SEQ ID NO: 4106) | 1630 | 1805 |
| HUMFXI_PEA_1_T2 (SEQ ID NO: 4107) | 1360 | 1535 |

TABLE 4700-continued

Segment location on transcripts

| Transcript name | Segment starting position | Segment ending position |
|---|---|---|
| HUMFXI_PEA_1_T3 (SEQ ID NO: 4108) | 1470 | 1645 |
| HUMFXI_PEA_1_T5 (SEQ ID NO: 4109) | 1607 | 1782 |
| HUMFXI_PEA_1_T6 (SEQ ID NO: 4110) | 1718 | 1893 |
| HUMFXI_PEA_1_T7 (SEQ ID NO: 4111) | 1520 | 1695 |
| HUMFXI_PEA_1_T8 (SEQ ID NO: 4112) | 1670 | 1845 |
| HUMFXI_PEA_1_T9 (SEQ ID NO: 4113) | 1630 | 1805 |
| HUMFXI_PEA_1_T10 (SEQ ID NO: 4114) | 1771 | 1946 |
| HUMFXI_PEA_1_T11 (SEQ ID NO: 4115) | 1448 | 1623 |
| HUMFXI_PEA_1_T12 (SEQ ID NO: 4116) | 1400 | 1575 |
| HUMFXI_PEA_1_T16 (SEQ ID NO: 4119) | 797 | 972 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1, HUMFXI_PEA_1_P2, HUMFXI_PEA_1_P7 and HUMFXI_PEA_1_P13, since it is in the coding region for the corresponding transcript.

Segment cluster HUMFXI_PEA_1_node_38 (SEQ ID NO:5239) according to the present invention is supported by 32 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T16 (SEQ ID NO:4119) and HUMFXI_PEA_1_T17 (SEQ ID NO:4120). Table 4701 below describes the starting and ending position of this segment on each transcript.

TABLE 4701

Segment location on transcripts

| Transcript name | Segment starting position | Segment ending position |
|---|---|---|
| HUMFXI_PEA_1_T0 (SEQ ID NO: 4106) | 1919 | 2041 |
| HUMFXI_PEA_1_T2 (SEQ ID NO: 4107) | 1649 | 1771 |
| HUMFXI_PEA_1_T3 (SEQ ID NO: 4108) | 1759 | 1881 |
| HUMFXI_PEA_1_T5 (SEQ ID NO: 4109) | 1896 | 2018 |

TABLE 4701-continued

Segment location on transcripts

| Transcript name | Segment starting position | Segment ending position |
|---|---|---|
| HUMFXI_PEA_1_T6 (SEQ ID NO: 4110) | 2007 | 2129 |
| HUMFXI_PEA_1_T7 (SEQ ID NO: 4111) | 1809 | 1931 |
| HUMFXI_PEA_1_T8 (SEQ ID NO: 4112) | 1959 | 2081 |
| HUMFXI_PEA_1_T9 (SEQ ID NO: 4113) | 1823 | 1945 |
| HUMFXI_PEA_1_T10 (SEQ ID NO: 4114) | 2060 | 2182 |
| HUMFXI_PEA_1_T11 (SEQ ID NO: 4115) | 1737 | 1859 |
| HUMFXI_PEA_1_T12 (SEQ ID NO: 4116) | 1689 | 1811 |
| HUMFXI_PEA_1_T14 (SEQ ID NO: 4117) | 1647 | 1769 |
| HUMFXI_PEA_1_T16 (SEQ ID NO: 4119) | 990 | 1112 |
| HUMFXI_PEA_1_T17 (SEQ ID NO: 4120) | 114 | 236 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1, HUMFXI_PEA_1_P2, HUMFXI_PEA_1_P7, HUMFXI_PEA_1_P11, HUMFXI_PEA_1_P13 and HUMFXI_PEA_1_P14, since it is in the coding region for the corresponding transcript.

Segment cluster HUMFXI_PEA_1_node_40 (SEQ ID NO:5240) according to the present invention is supported by 35 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T16 (SEQ ID NO:4119) and HUMFXI_PEA_1_T17 (SEQ ID NO:4120). Table 4702 below describes the starting and ending position of this segment on each transcript.

TABLE 4702

Segment location on transcripts

| Transcript name | Segment starting position | Segment ending position |
|---|---|---|
| HUMFXI_PEA_1_T0 (SEQ ID NO: 4106) | 2042 | 2444 |
| HUMFXI_PEA_1_T2 (SEQ ID NO: 4107) | 1772 | 2174 |
| HUMFXI_PEA_1_T3 (SEQ ID NO: 4108) | 1882 | 2284 |

TABLE 4702-continued

Segment location on transcripts

| Transcript name | Segment starting position | Segment ending position |
|---|---|---|
| HUMFXI_PEA_1_T5 (SEQ ID NO: 4109) | 2019 | 2421 |
| HUMFXI_PEA_1_T6 (SEQ ID NO: 4110) | 2130 | 2532 |
| HUMFXI_PEA_1_T7 (SEQ ID NO: 4111) | 1932 | 2334 |
| HUMFXI_PEA_1_T8 (SEQ ID NO: 4112) | 2082 | 2484 |
| HUMFXI_PEA_1_T9 (SEQ ID NO: 4113) | 1946 | 2348 |
| HUMFXI_PEA_1_T10 (SEQ ID NO: 4114) | 2183 | 2585 |
| HUMFXI_PEA_1_T11 (SEQ ID NO: 4115) | 1860 | 2262 |
| HUMFXI_PEA_1_T12 (SEQ ID NO: 4116) | 1812 | 2214 |
| HUMFXI_PEA_1_T14 (SEQ ID NO: 4117) | 1770 | 2172 |
| HUMFXI_PEA_1_T16 (SEQ ID NO: 4119) | 1113 | 1515 |
| HUMFXI_PEA_1_T17 (SEQ ID NO: 4120) | 237 | 639 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8, HUMFXI_PEA_1_P19 and HUMFXI_PEA_1_P11. This segment can also be found in the following protein(s): HUMFXI_PEA_1_P1, HUMFXI_PEA_1_P2, HUMFXI_PEA_1_P7, HUMFXI_PEA_1_P13 and HUMFXI_PEA_1_P14, since it is in the coding region for the corresponding transcript.

Segment cluster HUMFXI_PEA_1_node_41 (SEQ ID NO:5241) according to the present invention is supported by 25 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T16 (SEQ ID NO:4119) and HUMFXI_PEA_1_T17 (SEQ ID NO:4120). Table 4703 below describes the starting and ending position of this segment on each transcript.

TABLE 4703

Segment location on transcripts

| Transcript name | Segment starting position | Segment ending position |
|---|---|---|
| HUMFXI_PEA_1_T0 (SEQ ID NO: 4106) | 2445 | 4055 |
| HUMFXI_PEA_1_T2 (SEQ ID NO: 4107) | 2175 | 3785 |
| HUMFXI_PEA_1_T3 (SEQ ID NO: 4108) | 2285 | 3895 |
| HUMFXI_PEA_1_T5 (SEQ ID NO: 4109) | 2422 | 4032 |
| HUMFXI_PEA_1_T6 (SEQ ID NO: 4110) | 2533 | 4143 |
| HUMFXI_PEA_1_T7 (SEQ ID NO: 4111) | 2335 | 3945 |
| HUMFXI_PEA_1_T8 (SEQ ID NO: 4112) | 2485 | 4095 |
| HUMFXI_PEA_1_T9 (SEQ ID NO: 4113) | 2349 | 3959 |
| HUMFXI_PEA_1_T10 (SEQ ID NO: 4114) | 2586 | 4196 |
| HUMFXI_PEA_1_T11 (SEQ ID NO: 4115) | 2263 | 3873 |
| HUMFXI_PEA_1_T12 (SEQ ID NO: 4116) | 2215 | 3825 |
| HUMFXI_PEA_1_T14 (SEQ ID NO: 4117) | 2173 | 3783 |
| HUMFXI_PEA_1_T16 (SEQ ID NO: 4119) | 1516 | 3126 |
| HUMFXI_PEA_1_T17 (SEQ ID NO: 4120) | 640 | 2250 |

This segment can be found in a non-coding region of transcript(s) that are related to the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P13 and HUMFXI_PEA_1_P14.

Segment cluster HUMFXI_PEA_1_node_43 (SEQ ID NO:5242) according to the present invention is supported by 4 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T16 (SEQ ID NO:4119) and HUMFXI_PEA_1_T17 (SEQ ID NO:4120). Table 4704 below describes the starting and ending position of this segment on each transcript.

TABLE 4704

Segment location on transcripts

| Transcript name | Segment starting position | Segment ending position |
|---|---|---|
| HUMFXI_PEA_1_T0 (SEQ ID NO: 4106) | 4056 | 4300 |
| HUMFXI_PEA_1_T2 (SEQ ID NO: 4107) | 3786 | 4030 |
| HUMFXI_PEA_1_T3 (SEQ ID NO: 4108) | 3896 | 4140 |
| HUMFXI_PEA_1_T5 (SEQ ID NO: 4109) | 4033 | 4277 |

TABLE 4704-continued

Segment location on transcripts

| Transcript name | Segment starting position | Segment ending position |
|---|---|---|
| HUMFXI_PEA_1_T6 (SEQ ID NO: 4110) | 4144 | 4388 |
| HUMFXI_PEA_1_T7 (SEQ ID NO: 4111) | 3946 | 4190 |
| HUMFXI_PEA_1_T8 (SEQ ID NO: 4112) | 4096 | 4340 |
| HUMFXI_PEA_1_T9 (SEQ ID NO: 4113) | 3960 | 4204 |
| HUMFXI_PEA_1_T10 (SEQ ID NO: 4114) | 4197 | 4441 |
| HUMFXI_PEA_1_T11 (SEQ ID NO: 4115) | 3874 | 4118 |
| HUMFXI_PEA_1_T12 (SEQ ID NO: 4116) | 3826 | 4070 |
| HUMFXI_PEA_1_T14 (SEQ ID NO: 4117) | 3784 | 4028 |
| HUMFXI_PEA_1_T16 (SEQ ID NO: 4119) | 3127 | 3371 |
| HUMFXI_PEA_1_T17 (SEQ ID NO: 4120) | 2251 | 2495 |

This segment can be found in a non-coding region of transcript(s) that are related to the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P13 and HUMFXI_PEA_1_P14.

According to an optional embodiment of the present invention, short segments related to the above cluster are also provided. These segments are up to about 120 bp in length, and so are included in a separate description.

Segment cluster HUMFXI_PEA_1_node_1 (SEQ ID NO:5243) according to the present invention is supported by 13 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118), HUMFXI_PEA_1_T18 (SEQ ID NO:4121) and HUMFXI_PEA_1_T19 (SEQ ID NO:4122). Table 4705 below describes the starting and ending position of this segment on each transcript.

TABLE 4705

Segment location on transcripts

| Transcript name | Segment starting position | Segment ending position |
|---|---|---|
| HUMFXI_PEA_1_T0 (SEQ ID NO: 4106) | 272 | 301 |
| HUMFXI_PEA_1_T2 (SEQ ID NO: 4107) | 272 | 301 |
| HUMFXI_PEA_1_T3 (SEQ ID NO: 4108) | 272 | 301 |

TABLE 4705-continued

Segment location on transcripts

| Transcript name | Segment starting position | Segment ending position |
|---|---|---|
| HUMFXI_PEA_1_T5 (SEQ ID NO: 4109) | 272 | 301 |
| HUMFXI_PEA_1_T6 (SEQ ID NO: 4110) | 272 | 301 |
| HUMFXI_PEA_1_T7 (SEQ ID NO: 4111) | 272 | 301 |
| HUMFXI_PEA_1_T8 (SEQ ID NO: 4112) | 272 | 301 |
| HUMFXI_PEA_1_T9 (SEQ ID NO: 4113) | 272 | 301 |
| HUMFXI_PEA_1_T10 (SEQ ID NO: 4114) | 272 | 301 |
| HUMFXI_PEA_1_T11 (SEQ ID NO: 4115) | 272 | 301 |
| HUMFXI_PEA_1_T12 (SEQ ID NO: 4116) | 272 | 301 |
| HUMFXI_PEA_1_T14 (SEQ ID NO: 4117) | 272 | 301 |
| HUMFXI_PEA_1_T15 (SEQ ID NO: 4118) | 272 | 301 |
| HUMFXI_PEA_1_T18 (SEQ ID NO: 4121) | 272 | 301 |
| HUMFXI_PEA_1_T19 (SEQ ID NO: 4122) | 272 | 301 |

This segment can be found in a non-coding region of transcript(s) that are related to the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_2 (SEQ ID NO:5244) according to the present invention can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118), HUMFXI_PEA_1_T18 (SEQ ID NO:4121) and HUMFXI_PEA_1_T19(SEQ ID NO:4122). Table 4706 below describes the starting and ending position of this segment on each transcript.

TABLE 4706

Segment location on transcripts

| Transcript name | Segment starting position | Segment ending position |
|---|---|---|
| HUMFXI_PEA_1_T0 (SEQ ID NO: 4106) | 302 | 324 |
| HUMFXI_PEA_1_T2 (SEQ ID NO: 4107) | 302 | 324 |
| HUMFXI_PEA_1_T3 (SEQ ID NO: 4108) | 302 | 324 |
| HUMFXI_PEA_1_T6 (SEQ ID NO: 4110) | 302 | 324 |

TABLE 4706-continued

Segment location on transcripts

| Transcript name | Segment starting position | Segment ending position |
|---|---|---|
| HUMFXI_PEA_1_T7 (SEQ ID NO: 4111) | 302 | 324 |
| HUMFXI_PEA_1_T8 (SEQ ID NO: 4112) | 302 | 324 |
| HUMFXI_PEA_1_T9 (SEQ ID NO: 4113) | 302 | 324 |
| HUMFXI_PEA_1_T10 (SEQ ID NO: 4114) | 302 | 324 |
| HUMFXI_PEA_1_T11 (SEQ ID NO: 4115) | 302 | 324 |
| HUMFXI_PEA_1_T12 (SEQ ID NO: 4116) | 302 | 324 |
| HUMFXI_PEA_1_T14 (SEQ ID NO: 4117) | 302 | 324 |
| HUMFXI_PEA_1_T15 (SEQ ID NO: 4118) | 302 | 324 |
| HUMFXI_PEA_1_T18 (SEQ ID NO: 4121) | 302 | 324 |
| HUMFXI_PEA_1_T19 (SEQ ID NO: 4122) | 302 | 324 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P18 and HUMFXI_PEA_1_P19. This segment can also be found in the following protein(s): HUMFXI_PEA_1_P1, HUMFXI_PEA_1_P2, HUMFXI_PEA_1_P4, HUMFXI_PEA_1_P6, HUMFXI_PEA_1_P7, HUMFXI_PEA_1_P8, HUMFXI_PEA_1_P11, HUMFXI_PEA_1_P12 and HUMFXI_PEA_1_P15, since it is in the coding region for the corresponding transcript.

Segment cluster HUMFXI_PEA_1_node_5 (SEQ ID NO:5245) according to the present invention is supported by 20 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118) and HUMFXI_PEA_1_T18 (SEQ ID NO:4121). Table 4707 below describes the starting and ending position of this segment on each transcript.

TABLE 4707

Segment location on transcripts

| Transcript name | Segment starting position | Segment ending position |
|---|---|---|
| HUMFXI_PEA_1_T0 (SEQ ID NO: 4106) | 325 | 380 |
| HUMFXI_PEA_1_T2 (SEQ ID NO: 4107) | 325 | 380 |
| HUMFXI_PEA_1_T3 (SEQ ID NO: 4108) | 325 | 380 |

TABLE 4707-continued

Segment location on transcripts

| Transcript name | Segment starting position | Segment ending position |
|---|---|---|
| HUMFXI_PEA_1_T5 (SEQ ID NO: 4109) | 302 | 357 |
| HUMFXI_PEA_1_T6 (SEQ ID NO: 4110) | 325 | 380 |
| HUMFXI_PEA_1_T7 (SEQ ID NO: 4111) | 325 | 380 |
| HUMFXI_PEA_1_T8 (SEQ ID NO: 4112) | 325 | 380 |
| HUMFXI_PEA_1_T9 (SEQ ID NO: 4113) | 325 | 380 |
| HUMFXI_PEA_1_T10 (SEQ ID NO: 4114) | 325 | 380 |
| HUMFXI_PEA_1_T11 (SEQ ID NO: 4115) | 325 | 380 |
| HUMFXI_PEA_1_T12 (SEQ ID NO: 4116) | 325 | 380 |
| HUMFXI_PEA_1_T14 (SEQ ID NO: 4117) | 325 | 380 |
| HUMFXI_PEA_1_T15 (SEQ ID NO: 4118) | 325 | 380 |
| HUMFXI_PEA_1_T18 (SEQ ID NO: 4121) | 325 | 380 |

This segment can be found in the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_10 (SEQ ID NO:5246) according to the present invention is supported by 31 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T15 (SEQ ID NO:4118) and HUMFXI_PEA_1_T18 (SEQ ID NO:4121). Table 4708 below describes the starting and ending position of this segment on each transcript.

TABLE 4708

Segment location on transcripts

| Transcript name | Segment starting position | Segment ending position |
|---|---|---|
| HUMFXI_PEA_1_T0 (SEQ ID NO: 4106) | 544 | 650 |
| HUMFXI_PEA_1_T2 (SEQ ID NO: 4107) | 544 | 650 |
| HUMFXI_PEA_1_T3 (SEQ ID NO: 4108) | 544 | 650 |
| HUMFXI_PEA_1_T5 (SEQ ID NO: 4109) | 521 | 627 |
| HUMFXI_PEA_1_T6 (SEQ ID NO: 4110) | 544 | 650 |

TABLE 4708-continued

Segment location on transcripts

| Transcript name | Segment starting position | Segment ending position |
|---|---|---|
| HUMFXI_PEA_1_T7 (SEQ ID NO: 4111) | 544 | 650 |
| HUMFXI_PEA_1_T8 (SEQ ID NO: 4112) | 544 | 650 |
| HUMFXI_PEA_1_T9 (SEQ ID NO: 4113) | 544 | 650 |
| HUMFXI_PEA_1_T10 (SEQ ID NO: 4114) | 544 | 650 |
| HUMFXI_PEA_1_T11 (SEQ ID NO: 4115) | 544 | 650 |
| HUMFXI_PEA_1_T12 (SEQ ID NO: 4116) | 544 | 650 |
| HUMFXI_PEA_1_T14 (SEQ ID NO: 4117) | 544 | 650 |
| HUMFXI_PEA_1_T15 (SEQ ID NO: 4118) | 544 | 650 |
| HUMFXI_PEA_1_T18 (SEQ ID NO: 4121) | 544 | 650 |

This segment can be found in the following protein(s): HUMFXI_PEA_1_P1, HUMFXI_PEA_1_P2, HUMFXI_PEA_1_P17, HUMFXI_PEA_1_P4, HUMFXI_PEA_1_P18, HUMFXI_PEA_1_P6, HUMFXI_PEA_1_P7, HUMFXI_PEA_1_P8, HUMFXI_PEA_1_P19, HUMFXI_PEA_1_P11, HUMFXI_PEA_1_P12 and HUMFXI_PEA_1_P15.

Segment cluster HUMFXI_PEA_1_node_15 (SEQ ID NO:5247) according to the present invention is supported by 22 libraries. The number of libraries was determined as previously described. This segment can be found in the following transcript(s): HUMFXI_PEA_1_T0 (SEQ ID NO:4106), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T14 (SEQ ID NO:4117) and HUMFXI_PEA_1_T15 (SEQ ID NO:4118). Table 4709 below describes the starting and ending position of this segment on each transcript.

TABLE 4709

Segment location on transcripts

| Transcript name | Segment starting position | Segment ending position |
|---|---|---|
| HUMFXI_PEA_1_T0 (SEQ ID NO: 4106) | 811 | 920 |
| HUMFXI_PEA_1_T3 (SEQ ID NO: 4108) | 651 | 760 |
| HUMFXI_PEA_1_T5 (SEQ ID NO: 4109) | 788 | 897 |
| HUMFXI_PEA_1_T6 (SEQ ID NO: 4110) | 811 | 920 |
| HUMFXI_PEA_1_T8 (SEQ ID NO: 4112) | 811 | 920 |
| HUMFXI_PEA_1_T9 (SEQ ID NO: 4113) | 811 | 920 |
| HUMFXI_PEA_1_T10 (SEQ ID NO: 4114) | 811 | 920 |
| HUMFXI_PEA_1_T14 (SEQ ID NO: 4117) | 811 | 920 |
| HUMFXI_PEA_1_T15 (SEQ ID NO: 4118) | 811 | 920 |

This segment can be found in the following protein(s): HUMFXI_PEA_1_P1, HUMFXI_PEA_1_P17, HUMFXI_PEA_1_P4, HUMFXI_PEA_1_P6, HUMFXI_PEA_1_P7, HUMFXI_PEA_1_P11 and HUMFXI_PEA_1_P12.

Segment cluster HUMFXI_PEA_1_node_19 (SEQ ID NO:5248) according to the present invention is supported by 32 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117) and HUMFXI_PEA_1_T15 (SEQ ID NO:4118). Table 4710 below describes the starting and ending position of this segment on each transcript.

TABLE 4710

Segment location on transcripts

| Transcript name | Segment starting position | Segment ending position |
|---|---|---|
| HUMFXI_PEA_1_T0 (SEQ ID NO: 4106) | 1081 | 1190 |
| HUMFXI_PEA_1_T2 (SEQ ID NO: 4107) | 811 | 920 |
| HUMFXI_PEA_1_T3 (SEQ ID NO: 4108) | 921 | 1030 |
| HUMFXI_PEA_1_T5 (SEQ ID NO: 4109) | 1058 | 1167 |
| HUMFXI_PEA_1_T6 (SEQ ID NO: 4110) | 1081 | 1190 |
| HUMFXI_PEA_1_T7 (SEQ ID NO: 4111) | 971 | 1080 |
| HUMFXI_PEA_1_T8 (SEQ ID NO: 4112) | 1081 | 1190 |
| HUMFXI_PEA_1_T9 (SEQ ID NO: 4113) | 1081 | 1190 |
| HUMFXI_PEA_1_T10 (SEQ ID NO: 4114) | 1081 | 1190 |
| HUMFXI_PEA_1_T11 (SEQ ID NO: 4115) | 811 | 920 |
| HUMFXI_PEA_1_T12 (SEQ ID NO: 4116) | 811 | 920 |
| HUMFXI_PEA_1_T14 (SEQ ID NO: 4117) | 1081 | 1190 |
| HUMFXI_PEA_1_T15 (SEQ ID NO: 4118) | 1081 | 1190 |

This segment can be found in both coding and non-coding regions of transcript(s) as follows. The segment can be found in a non-coding region of transcript(s) that are related to the following protein(s): HUMFXI_PEA_1_P17 and HUMFXI_PEA_1_P18. This segment can also be found in the following protein(s): HUMFXI_PEA_1_P1, HUMFXI_PEA_1_P2, HUMFXI_PEA_1_P4, HUMFXI_PEA_1_P6, HUMFXI_PEA_1_P7, HUMFXI_PEA_1_P8, HUMFXI_PEA_1_P19, HUMFXI_PEA_1_P11 and HUMFXI_PEA_1_P12, since it is in the coding region for the corresponding transcript.

Segment cluster HUMFXI_PEA_1_node_21 (SEQ ID NO:5249) according to the present invention is supported by 29 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T14 (SEQ ID NO:4117) and HUMFXI_PEA_1_T15 (SEQ ID NO:4118). Table 4711 below describes the starting and ending position of this segment on each transcript.

TABLE 4711

Segment location on transcripts

| Transcript name | Segment starting position | Segment ending position |
|---|---|---|
| HUMFXI_PEA_1_T0 (SEQ ID NO: 4106) | 1191 | 1238 |
| HUMFXI_PEA_1_T2 (SEQ ID NO: 4107) | 921 | 968 |
| HUMFXI_PEA_1_T3 (SEQ ID NO: 4108) | 1031 | 1078 |
| HUMFXI_PEA_1_T5 (SEQ ID NO: 4109) | 1168 | 1215 |
| HUMFXI_PEA_1_T6 (SEQ ID NO: 4110) | 1191 | 1238 |
| HUMFXI_PEA_1_T7 (SEQ ID NO: 4111) | 1081 | 1128 |
| HUMFXI_PEA_1_T9 (SEQ ID NO: 4113) | 1191 | 1238 |
| HUMFXI_PEA_1_T10 (SEQ ID NO: 4114) | 1191 | 1238 |
| HUMFXI_PEA_1_T11 (SEQ ID NO: 4115) | 921 | 968 |
| HUMFXI_PEA_1_T14 (SEQ ID NO: 4117) | 1191 | 1238 |
| HUMFXI_PEA_1_T15 (SEQ ID NO: 4118) | 1191 | 1238 |

This segment can be found in both coding and non-coding regions of transcript(s) as follows. The segment can be found in a non-coding region of transcript(s) that are related to the following protein(s): HUMFXI_PEA_1_P17 and HUMFXI_PEA_1_P18. This segment can also be found in the following protein(s): HUMFXI_PEA_1_P1, HUMFXI_PEA_1_P2, HUMFXI_PEA_1_P4, HUMFXI_PEA_1_P7, HUMFXI_PEA_1_P8, HUMFXI_PEA_1_P11 and HUMFXI_PEA_1_P12, since it is in the coding region for the corresponding transcript.

Segment cluster HUMFXI_PEA_1_node_22 (SEQ ID NO:5250) according to the present invention is supported by 33 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117) and HUMFXI_PEA_1_T15 (SEQ ID NO:4118). Table 4712 below describes the starting and ending position of this segment on each transcript.

TABLE 4712

Segment location on transcripts

| Transcript name | Segment starting position | Segment ending position |
|---|---|---|
| HUMFXI_PEA_1_T0 (SEQ ID NO: 4106) | 1239 | 1353 |
| HUMFXI_PEA_1_T2 (SEQ ID NO: 4107) | 969 | 1083 |
| HUMFXI_PEA_1_T3 (SEQ ID NO: 4108) | 1079 | 1193 |
| HUMFXI_PEA_1_T5 (SEQ ID NO: 4109) | 1216 | 1330 |
| HUMFXI_PEA_1_T6 (SEQ ID NO: 4110) | 1239 | 1353 |
| HUMFXI_PEA_1_T7 (SEQ ID NO: 4111) | 1129 | 1243 |
| HUMFXI_PEA_1_T8 (SEQ ID NO: 4112) | 1191 | 1305 |
| HUMFXI_PEA_1_T9 (SEQ ID NO: 4113) | 1239 | 1353 |
| HUMFXI_PEA_1_T10 (SEQ ID NO: 4114) | 1239 | 1353 |
| HUMFXI_PEA_1_T11 (SEQ ID NO: 4115) | 969 | 1083 |
| HUMFXI_PEA_1_T12 (SEQ ID NO: 4116) | 921 | 1035 |
| HUMFXI_PEA_1_T14 (SEQ ID NO: 4117) | 1239 | 1353 |
| HUMFXI_PEA_1_T15 (SEQ ID NO: 4118) | 1239 | 1353 |

This segment can be found in both coding and non-coding regions of transcript(s) as follows. The segment can be found in a non-coding region of transcript(s) that are related to the following protein(s): HUMFXI_PEA_1_P17 and HUMFXI_PEA_1_P18. This segment can also be found in the following protein(s): HUMFXI_PEA_1_P1, HUMFXI_PEA_1_P2, HUMFXI_PEA_1_P4, HUMFXI_PEA_1_P6, HUMFXI_PEA_1_P7, HUMFXI_PEA_1_P8, HUMFXI_PEA_1_P19, HUMFXI_PEA_1_P11 and HUMFXI_PEA_1_P12, since it is in the coding region for the corresponding transcript.

Segment cluster HUMFXI_PEA_1_node_23 (SEQ ID NO:5251) according to the present invention is supported by 6 libraries. The number of libraries was determined as previously described. This segment can be found in the following transcript(s): HUMFXI_PEA_1_T6 (SEQ ID NO:4110), HUMFXI_PEA_1_T8 (SEQ ID NO:4112), HUMFXI_PEA_1_T10 (SEQ ID NO:4114), HUMFXI_PEA_1_T11 (SEQ ID NO:4115) and HUMFXI_PEA_1_T12 (SEQ ID NO:4116). Table 4713 below describes the starting and ending position of this segment on each transcript.

TABLE 4713

Segment location on transcripts

| Transcript name | Segment starting position | Segment ending position |
|---|---|---|
| HUMFXI_PEA_1_T6 (SEQ ID NO: 4110) | 1354 | 1441 |
| HUMFXI_PEA_1_T8 (SEQ ID NO: 4112) | 1306 | 1393 |
| HUMFXI_PEA_1_T10 (SEQ ID NO: 4114) | 1354 | 1441 |
| HUMFXI_PEA_1_T11 (SEQ ID NO: 4115) | 1084 | 1171 |
| HUMFXI_PEA_1_T12 (SEQ ID NO: 4116) | 1036 | 1123 |

This segment can be found in the following protein(s): HUMFXI_PEA_1_P4, HUMFXI_PEA_1_P6, HUMFXI_PEA_1_P8 and HUMFXI_PEA_1_P19.

Segment cluster HUMFXI_PEA_1_node_24 (SEQ ID NO:5252) according to the present invention is supported by 32 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117) and HUMFXI_PEA_1_T15 (SEQ ID NO:4118). Table 4714 below describes the starting and ending position of this segment on each transcript.

TABLE 4714

Segment location on transcripts

| Transcript name | Segment starting position | Segment ending position |
| --- | --- | --- |
| HUMFXI_PEA_1_T0 (SEQ ID NO: 4106) | 1354 | 1460 |
| HUMFXI_PEA_1_T2 (SEQ ID NO: 4107) | 1084 | 1190 |
| HUMFXI_PEA_1_T3 (SEQ ID NO: 4108) | 1194 | 1300 |
| HUMFXI_PEA_1_T5 (SEQ ID NO: 4109) | 1331 | 1437 |
| HUMFXI_PEA_1_T6 (SEQ ID NO: 4110) | 1442 | 1548 |
| HUMFXI_PEA_1_T7 (SEQ ID NO: 4111) | 1244 | 1350 |
| HUMFXI_PEA_1_T8 (SEQ ID NO: 4112) | 1394 | 1500 |
| HUMFXI_PEA_1_T9 (SEQ ID NO: 4113) | 1354 | 1460 |
| HUMFXI_PEA_1_T10 (SEQ ID NO: 4114) | 1442 | 1548 |
| HUMFXI_PEA_1_T11 (SEQ ID NO: 4115) | 1172 | 1278 |
| HUMFXI_PEA_1_T12 (SEQ ID NO: 4116) | 1124 | 1230 |
| HUMFXI_PEA_1_T14 (SEQ ID NO: 4117) | 1354 | 1460 |
| HUMFXI_PEA_1_T15 (SEQ ID NO: 4118) | 1354 | 1460 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1, HUMFXI_PEA_1_P2, HUMFXI_PEA_1_P7, HUMFXI_PEA_1_P11 and HUMFXI_PEA_1_P12, since it is in the coding region for the corresponding transcript.

Segment cluster HUMFXI_PEA_1_node_27 (SEQ ID NO:5253) according to the present invention is supported by 5 libraries. The number of libraries was determined as previously described. This segment can be found in the following transcript(s): HUMFXI_PEA_1_T10 (SEQ ID NO:4114), HUMFXI_PEA_1_T15 (SEQ ID NO:4118) and HUMFXI_PEA_1_T16 (SEQ ID NO:4119). Table 4715 below describes the starting and ending position of this segment on each transcript.

TABLE 4715

Segment location on transcripts

| Transcript name | Segment starting position | Segment ending position |
| --- | --- | --- |
| HUMFXI_PEA_1_T10 (SEQ ID NO: 4114) | 1549 | 1601 |
| HUMFXI_PEA_1_T15 (SEQ ID NO: 4118) | 1461 | 1513 |
| HUMFXI_PEA_1_T16 (SEQ ID NO: 4119) | 575 | 627 |

This segment can be found in both coding and non-coding regions of transcript(s) as follows. The segment can be found in a non-coding region of transcript(s) that are related to the following protein(s): HUMFXI_PEA_1_P4. This segment can also be found in the following protein(s): HUMFXI_PEA_1_P12 and HUMFXI_PEA_1_P13, since it is in the coding region for the corresponding transcript.

Segment cluster HUMFXI_PEA_1_node_28 (SEQ ID NO:5254) according to the present invention is supported by 2 libraries. The number of libraries was determined as previously described. This segment can be found in the following transcript(s): HUMFXI_PEA_1_T15 (SEQ ID NO:4118). Table 4716 below describes the starting and ending position of this segment on each transcript.

TABLE 4716

Segment location on transcripts

| Transcript name | Segment starting position | Segment ending position |
| --- | --- | --- |
| HUMFXI_PEA_1_T15 (SEQ ID NO: 4118) | 1514 | 1595 |

This segment can be found in a non-coding region of transcript(s) that are related to the following protein(s): HUMFXI_PEA_1_P12.

Segment cluster HUMFXI_PEA_1_node_34 (SEQ ID NO:5255) according to the present invention is supported by 25 libraries. The number of libraries was determined as previously described. This segment can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T10 (SEQ ID NO:4114), HUMFXI_PEA_1_T1 (SEQ ID NO:4115) and HUMFXI_PEA_1_T12 (SEQ ID NO:4116). Table 4717 below describes the starting and ending position of this segment on each transcript.

TABLE 4717

Segment location on transcripts

| Transcript name | Segment starting position | Segment ending position |
| --- | --- | --- |
| HUMFXI_PEA_1_T0 (SEQ ID NO: 4106) | 1806 | 1901 |
| HUMFXI_PEA_1_T2 (SEQ ID NO: 4107) | 1536 | 1631 |

TABLE 4717-continued

Segment location on transcripts

| Transcript name | Segment starting position | Segment ending position |
|---|---|---|
| HUMFXI_PEA_1_T3 (SEQ ID NO: 4108) | 1646 | 1741 |
| HUMFXI_PEA_1_T5 (SEQ ID NO: 4109) | 1783 | 1878 |
| HUMFXI_PEA_1_T6 (SEQ ID NO: 4110) | 1894 | 1989 |
| HUMFXI_PEA_1_T7 (SEQ ID NO: 4111) | 1696 | 1791 |
| HUMFXI_PEA_1_T8 (SEQ ID NO: 4112) | 1846 | 1941 |
| HUMFXI_PEA_1_T10 (SEQ ID NO: 4114) | 1947 | 2042 |
| HUMFXI_PEA_1_T11 (SEQ ID NO: 4115) | 1624 | 1719 |
| HUMFXI_PEA_1_T12 (SEQ ID NO: 4116) | 1576 | 1671 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1 and HUMFXI_PEA_1_P2, since it is in the coding region for the corresponding transcript.

Segment cluster HUMFXI_PEA_1_node_36 (SEQ ID NO:5256) according to the present invention is supported by 1 libraries. The number of libraries was determined as previously described. This segment can be found in the following transcript(s): HUMFXI_PEA_1_T17 (SEQ ID NO:4120). Table 4718 below describes the starting and ending position of this segment on each transcript.

TABLE 4718

Segment location on transcripts

| Transcript name | Segment starting position | Segment ending position |
|---|---|---|
| HUMFXI_PEA_1_T17 (SEQ ID NO: 4120) | 1 | 96 |

This segment can be found in the following protein(s): HUMFXI_PEA_1_P14.

Segment cluster HUMFXI_PEA_1_node_37 (SEQ ID NO:5257) according to the present invention can be found in the following transcript(s): HUMFXI_PEA_1_T0 (SEQ ID NO:4106), HUMFXI_PEA_1_T2 (SEQ ID NO:4107), HUMFXI_PEA_1_T3 (SEQ ID NO:4108), HUMFXI_PEA_1_T5 (SEQ ID NO:4109), HUMFXI_PEA_1_T6 (SEQ ID NO:4110), HUMFXI_PEA_1_T7 (SEQ ID NO:4111), HUMFXI_PEA_1_T8 (SEQ ID NO:4112), HUMFXI_PEA_1_T9 (SEQ ID NO:4113), HUMFXI_PEA_1_T10 (SEQ ID NO:4114), HUMFXI_PEA_1_T11 (SEQ ID NO:4115), HUMFXI_PEA_1_T12 (SEQ ID NO:4116), HUMFXI_PEA_1_T14 (SEQ ID NO:4117), HUMFXI_PEA_1_T16 (SEQ ID NO:4119) and HUMFXI_PEA_1_T17 (SEQ ID NO:4120). Table 4719 below describes the starting and ending position of this segment on each transcript.

TABLE 4719

Segment location on transcripts

| Transcript name | Segment starting position | Segment ending position |
|---|---|---|
| HUMFXI_PEA_1_T0 (SEQ ID NO: 4106) | 1902 | 1918 |
| HUMFXI_PEA_1_T2 (SEQ ID NO: 4107) | 1632 | 1648 |
| HUMFXI_PEA_1_T3 (SEQ ID NO: 4108) | 1742 | 1758 |
| HUMFXI_PEA_1_T5 (SEQ ID NO: 4109) | 1879 | 1895 |
| HUMFXI_PEA_1_T6 (SEQ ID NO: 4110) | 1990 | 2006 |
| HUMFXI_PEA_1_T7 (SEQ ID NO: 4111) | 1792 | 1808 |
| HUMFXI_PEA_1_T8 (SEQ ID NO: 4112) | 1942 | 1958 |
| HUMFXI_PEA_1_T9 (SEQ ID NO: 4113) | 1806 | 1822 |
| HUMFXI_PEA_1_T10 (SEQ ID NO: 4114) | 2043 | 2059 |
| HUMFXI_PEA_1_T11 (SEQ ID NO: 4115) | 1720 | 1736 |
| HUMFXI_PEA_1_T12 (SEQ ID NO: 4116) | 1672 | 1688 |
| HUMFXI_PEA_1_T14 (SEQ ID NO: 4117) | 1630 | 1646 |
| HUMFXI_PEA_1_T16 (SEQ ID NO: 4119) | 973 | 989 |
| HUMFXI_PEA_1_T17 (SEQ ID NO: 4120) | 97 | 113 |

This segment can be found in both coding and non-coding regions of transcript(s) as follows. The segment can be found in a non-coding region of transcript(s) that are related to the following protein(s): HUMFXI_PEA_1_P17, HUMFXI_PEA_1_P4, HUMFXI_PEA_1_P18, HUMFXI_PEA_1_P6, HUMFXI_PEA_1_P8 and HUMFXI_PEA_1_P19. This segment can also be found in the following protein(s): HUMFXI_PEA_1_P1, HUMFXI_PEA_1_P2, HUMFXI_PEA_1_P7, HUMFXI_PEA_1_P11, HUMFXI_PEA_1_P13 and HUMFXI_PEA_1_P14, since it is in the coding region for the corresponding transcript.

Description for Cluster HUMHOXAB

Cluster HUMHOXAB features 1 transcript(s) and 5 segment(s) of interest, the names for which are given in Tables 4720 and 4721, respectively, the sequences themselves are given at the end of the application. The selected protein variants are given in Table 4722.

TABLE 4720

Transcripts of interest
Transcript Name

HUMHOXAB_PEA_1_T4 (SEQ ID NO: 4123)

TABLE 4721

Segments of interest
Segment Name

HUMHOXAB_PEA_1_node_5 (SEQ ID NO: 5258)
HUMHOXAB_PEA_1_node_12 (SEQ ID NO: 5259)

TABLE 4721-continued

Segments of interest
Segment Name

HUMHOXAB_PEA_1_node_14 (SEQ ID NO: 5260)
HUMHOXAB_PEA_1_node_13 (SEQ ID NO: 5261)
HUMHOXAB_PEA_1_node_15 (SEQ ID NO: 5262)

TABLE 4722

Proteins of interest

| Protein Name | Corresponding Transcript(s) |
|---|---|
| HUMHOXAB_PEA_1_P3 | HUMHOXAB_PEA_1_T4 (SEQ ID NO: 4123) |

These sequences are variants of the known protein Homeobox protein Hox-B7 (SwissProt accession identifier HXB7_HUMAN; known also according to the synonyms Hox-2C; HHO.C1), referred to herein as the previously known protein.

Protein Homeobox protein Hox-B7 is known or believed to have the following function(s): Sequence-specific transcription factor which is part of a developmental regulatory system that provides cells with specific positional identities on the anterior-posterior axis. The sequence for protein Homeobox protein Hox-B7 is given at the end of the application, as "Homeobox protein Hox-B7 amino acid sequence". Known polymorphisms for this sequence are as shown in Table 4723.

TABLE 4723

Amino acid mutations for Known Protein

| SNP position(s) on amino acid sequence | Comment |
|---|---|
| 108 | A -> G |
| 118 | L -> F |
| 129 | W -> S |
| 154 | K -> N |
| 173 | T -> A |
| 194 | K -> N |
| 200-202 | GPG -> APA |

Protein Homeobox protein Hox-B7 localization is believed to be Nuclear.

The following GO Annotation(s) apply to the previously known protein. The following annotation(s) were found: transcription regulation; developmental processes, which are annotation(s) related to Biological Process; transcription factor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMHOXAB can be used as a diagnostic marker according to overexpression of transcripts of this cluster in cancer. Expression of such transcripts in normal tissues is also given according to the previously described methods. The term "number" in the left hand column of the table and the numbers on the y-axis of the FIG. 119 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 119 and Table 4724. This cluster is overexpressed (at least at a minimum level) in the following pathological conditions: epithelial malignant tumors and a mixture of malignant tumors from different tissues.

TABLE 4724

Normal tissue distribution

| Name of Tissue | Number |
|---|---|
| Bladder | 0 |
| Bone | 0 |
| Brain | 0 |
| Colon | 0 |
| Epithelial | 13 |
| General | 7 |
| head and neck | 0 |
| Kidney | 4 |
| Liver | 0 |
| Lung | 0 |
| Breast | 0 |
| Ovary | 0 |
| Pancreas | 0 |
| Skin | 26 |
| Stomach | 0 |
| Uterus | 45 |

TABLE 4725

P values and ratios for expression in cancerous tissue

| Name ef Tissue | P1 | P2 | SP1 | R3 | SP2 | R4 |
|---|---|---|---|---|---|---|
| bladder | 5.4e−01 | 6.0e−01 | 5.6e−01 | 1.8 | 6.8e−01 | 1.5 |
| bone | 1 | 6.7e−01 | 1 | 1.0 | 3.4e−01 | 1.9 |
| brain | 5.1e−01 | 6.0e−01 | 4.8e−02 | 6.8 | 1.1e−01 | 4.2 |
| colon | 3.6e−02 | 4.1e−02 | 2.4e−01 | 3.0 | 2.1e−01 | 3.0 |
| epithelial | 2.0e−03 | 1.2e−03 | 9.4e−02 | 1.7 | 6.8e−03 | 2.1 |
| general | 1.2e−04 | 2.9e−05 | 2.0e−03 | 2.6 | 2.8e−06 | 3.0 |
| head and neck | 3.3e−01 | 5.0e−01 | 4.6e−01 | 2.2 | 7.5e−01 | 1.3 |
| kidney | 5.5e−01 | 6.8e−01 | 3.4e−01 | 2.2 | 4.9e−01 | 1.6 |
| liver | 1 | 6.8e−01 | 1 | 1.0 | 1.6e−01 | 1.9 |
| lung | 5.3e−02 | 5.4e−02 | 4.1e−01 | 3.6 | 2.4e−01 | 3.4 |
| breast | 5.9e−01 | 4.4e−01 | 1 | 1.1 | 3.8e−01 | 1.5 |
| ovary | 4.0e−01 | 4.4e−01 | 6.8e−01 | 1.6 | 7.7e−01 | 1.4 |
| pancreas | 3.3e−01 | 1.8e−01 | 4.2e−01 | 2.4 | 7.7e−02 | 3.7 |
| skin | 9.2e−01 | 4.0e−01 | 1 | 0.3 | 3.2e−01 | 1.3 |
| stomach | 3.6e−01 | 4.7e−01 | 1 | 1.1 | 8.0e−01 | 1.3 |
| uterus | 3.6e−01 | 3.0e−01 | 6.7e−01 | 1.0 | 7.4e−01 | 0.9 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4726.

TABLE 4726

Oligonucleotides related to this cluster

| Oligonucleotide name | Overexpressed in cancers | Chip reference |
|---|---|---|
| HUMHOXAB_0_4_0 | lung malignant tumors | LUN |

As noted above, cluster HUMHOXAB features 5 segment(s), which were listed in Table 4721 above and for which the sequence(s) are given at the end of the application. These segment(s) are portions of nucleic acid sequence(s) which are described herein separately because they are of particular interest. A description of each segment according to the present invention is now provided.

Segment cluster HUMHOXAB_PEA_1_node_5 (SEQ ID NO:5258) according to the present invention is supported by 1 libraries. The number of libraries was determined as previously described. This segment can be found in the following transcript(s): HUMHOXAB_PEA_1_T4 (SEQ ID NO:4123). Table 4727 below describes the starting and ending position of this segment on each transcript.

TABLE 4727

Segment location on transcripts

| Transcript name | Segment starting position | Segment ending position |
|---|---|---|
| HUMHOXAB_PEA_1_T4 (SEQ ID NO: 4123) | 1 | 264 |

This segment can be found in the following protein(s): HUMHOXAB_PEA_1_P3.

Segment cluster HUMHOXAB_PEA_1_node_12 (SEQ ID NO:5259) according to the present invention is supported by 67 libraries. The number of libraries was determined as previously described. This segment can be found in the following transcript(s): HUMHOXAB_PEA_1_T4 (SEQ ID NO:4123). Table 4728 below describes the starting and ending position of this segment on each transcript.

TABLE 4728

Segment location on transcripts

| Transcript name | Segment starting position | Segment ending position |
|---|---|---|
| HUMHOXAB_PEA_1_T4 (SEQ ID NO: 4123) | 265 | 701 |

This segment can be found in a non-coding region of transcript(s) that are related to the following protein(s): HUMHOXAB_PEA_1_P3.

Segment cluster HUMHOXAB_PEA_1_node_14 (SEQ ID NO:5260) according to the present invention is supported by 45 libraries. The number of libraries was determined as previously described. This segment can be found in the following transcript(s): HUMHOXAB_PEA_1_T4 (SEQ ID NO:4123). Table 4729 below describes the starting and ending position of this segment on each transcript.

TABLE 4729

Segment location on transcripts

| Transcript name | Segment starting position | Segment ending position |
|---|---|---|
| HUMHOXAB_PEA_1_T4 (SEQ ID NO: 4123) | 763 | 1060 |

This segment can be found in a non-coding region of transcript(s) that are related to the following protein(s): HUMHOXAB_PEA_1_P3.

According to an optional embodiment of the present invention, short segments related to the above cluster are also provided. These segments are up to about 120 bp in length, and so are included in a separate description.

Segment cluster HUMHOXAB_PEA_1_node_13 (SEQ ID NO:5261) according to the present invention is supported by 33 libraries. The number of libraries was determined as previously described. This segment can be found in the following transcript(s): HUMHOXAB_PEA_1_T4 (SEQ ID NO:4123). Table 4730 below describes the starting and ending position of this segment on each transcript.

TABLE 4730

Segment location on transcripts

| Transcript name | Segment starting position | Segment ending position |
|---|---|---|
| HUMHOXAB_PEA_1_T4 (SEQ ID NO: 4123) | 702 | 762 |

This segment can be found in a non-coding region of transcript(s) that are related to the following protein(s): HUMHOXAB_PEA_1_P3.

Segment cluster HUMHOXAB_PEA_1_node_15 (SEQ ID NO:5262) according to the present invention is supported by 35 libraries. The number of libraries was determined as previously described. This segment can be found in the following transcript(s): HUMHOXAB_PEA_1_T4 (SEQ ID NO:4123). Table 4731 below describes the starting and ending position of this segment on each transcript.

TABLE 4731

Segment location on transcripts

| Transcript name | Segment starting position | Segment ending position |
|---|---|---|
| HUMHOXAB_PEA_1_T4 (SEQ ID NO: 4123) | 1061 | 1139 |

This segment can be found in a non-coding region of transcript(s) that are related to the following protein(s): HUMHOXAB_PEA_1_P3.

Description for Cluster HUMKERMII

Cluster HUMKERMII features 7 transcript(s) and 50 segment(s) of interest, the names for which are given in Tables 4732 and 4733, respectively, the sequences themselves are given at the end of the application. The selected protein variants are given in Table 4734.

TABLE 4732

Transcripts of interest
Transcript Name

HUMKERMII_T16 (SEQ ID NO: 4124)
HUMKERMII_T18 (SEQ ID NO: 4125)
HUMKERMII_T21 (SEQ ID NO: 4126)
HUMKERMII_T22 (SEQ ID NO: 4127)
HUMKERMII_T27 (SEQ ID NO: 4128)
HUMKERMII_T29 (SEQ ID NO: 4129)
HUMKERMII_T35 (SEQ ID NO: 4130)

TABLE 4733

Segments of interest
Segment Name

HUMKERMII_node_2 (SEQ ID NO: 5263)
HUMKERMII_node_6 (SEQ ID NO: 5264)
HUMKERMII_node_15 (SEQ ID NO: 5265)
HUMKERMII_node_21 (SEQ ID NO: 5266)
HUMKERMII_node_26 (SEQ ID NO: 5267)
HUMKERMII_node_28 (SEQ ID NO: 5268)
HUMKERMII_node_69 (SEQ ID NO: 5269)
HUMKERMII_node_71 (SEQ ID NO: 5270)
HUMKERMII_node_0 (SEQ ID NO: 5271)
HUMKERMII_node_4 (SEQ ID NO: 5272)
HUMKERMII_node_7 (SEQ ID NO: 5273)
HUMKERMII_node_8 (SEQ ID NO: 5274)
HUMKERMII_node_9 (SEQ ID NO: 5275)
HUMKERMII_node_10 (SEQ ID NO: 5276)
HUMKERMII_node_11 (SEQ ID NO: 5277)
HUMKERMII_node_12 (SEQ ID NO: 5278)
HUMKERMII_node_13 (SEQ ID NO: 5279)
HUMKERMII_node_16 (SEQ ID NO: 5280)
HUMKERMII_node_17 (SEQ ID NO: 5281)
HUMKERMII_node_18 (SEQ ID NO: 5282)
HUMKERMII_node_19 (SEQ ID NO: 5283)
HUMKERMII_node_20 (SEQ ID NO: 5284)
HUMKERMII_node_22 (SEQ ID NO: 5285)
HUMKERMII_node_23 (SEQ ID NO: 5286)
HUMKERMII_node_24 (SEQ ID NO: 5287)
HUMKERMII_node_25 (SEQ ID NO: 5288)
HUMKERMII_node_29 (SEQ ID NO: 5289)
HUMKERMII_node_30 (SEQ ID NO: 5290)
HUMKERMII_node_31 (SEQ ID NO: 5291)
HUMKERMII_node_34 (SEQ ID NO: 5292)
HUMKERMII_node_35 (SEQ ID NO: 5293)
HUMKERMII_node_36 (SEQ ID NO: 5294)
HUMKERMII_node_37 (SEQ ID NO: 5295)
HUMKERMII_node_38 (SEQ ID NO: 5296)
HUMKERMII_node_40 (SEQ ID NO: 5297)
HUMKERMII_node_41 (SEQ ID NO: 5298)
HUMKERMII_node_43 (SEQ ID NO: 5299)
HUMKERMII_node_44 (SEQ ID NO: 5300)
HUMKERMII_node_51 (SEQ ID NO: 5301)
HUMKERMII_node_52 (SEQ ID NO: 5302)
HUMKERMII_node_53 (SEQ ID NO: 5303)
HUMKERMII_node_54 (SEQ ID NO: 5304)
HUMKERMII_node_55 (SEQ ID NO: 5305)
HUMKERMII_node_56 (SEQ ID NO: 5306)
HUMKERMII_node_57 (SEQ ID NO: 5307)
HUMKERMII_node_58 (SEQ ID NO: 5308)
HUMKERMII_node_62 (SEQ ID NO: 5309)
HUMKERMII_node_66 (SEQ ID NO: 5310)
HUMKERMII_node_67 (SEQ ID NO: 5311)
HUMKERMII_node_68 (SEQ ID NO: 5312)

TABLE 4734

Proteins of interest

| Protein Name | Corresponding Transcript(s) |
| --- | --- |
| HUMKERMII_P5 | HUMKERMII_T18 (SEQ ID NO: 4125) |
| HUMKERMII_P12 | HUMKERMII_T16 (SEQ ID NO: 4124) |
| HUMKERMII_P15 | HUMKERMII_T21 (SEQ ID NO: 4126) |
| HUMKERMII_P16 | HUMKERMII_T22 (SEQ ID NO: 4127) |
| HUMKERMII_P20 | HUMKERMII_T27 (SEQ ID NO: 4128) |
| HUMKERMII_P22 | HUMKERMII_T29 (SEQ ID NO: 4129) |
| HUMKERMII_P25 | HUMKERMII_T35 (SEQ ID NO: 4130) |

These sequences are variants of the known protein Keratin, type II cytoskeletal 7 (SwissProt accession identifier K2C7_HUMAN; known also according to the synonyms Cytokeratin 7; K7; CK 7; Sarcolectin), referred to herein as the previously known protein.

The sequence for protein Keratin, type II cytoskeletal 7 is given at the end of the application, as "Keratin, type II cytoskeletal 7 amino acid sequence". Known polymorphisms for this sequence are as shown in Table 4735.

TABLE 4735

Amino acid mutations for Known Protein

| SNP position(s) on amino acid sequence | Comment |
| --- | --- |
| 363 | A -> G. /FTId = VAR_016321. |
| 78 | D -> G |
| 82-83 | SL -> FS |
| 96 | T -> A |
| 109 | R -> G |
| 154 | L -> M |
| 163-164 | QG -> AE |
| 167 | T -> S |
| 341 | R -> C |
| 410 | V -> A |
| 466 | A -> T |

The following GO Annotation(s) apply to the previously known protein. The following annotation(s) were found: cytoskeleton organization and biogenesis, which are annotation(s) related to Biological Process; structural protein, which are annotation(s) related to Molecular Function; and intermediate filament, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMKERMII can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 120 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 120 and Table 4736. This cluster is overexpressed (at least at a minimum level) in the following pathological conditions: transitional cell carcinoma, a mixture of malignant tumors from different tissues, ovarian carcinoma and pancreas carcinoma.

TABLE 4736

Normal tissue distribution

| Name of Tissue | Number |
|---|---|
| bladder | 164 |
| brain | 0 |
| colon | 0 |
| epithelial | 136 |
| general | 65 |
| head and neck | 10 |
| kidney | 65 |
| liver | 0 |
| lung | 441 |
| breast | 241 |
| bone marrow | 0 |
| ovary | 0 |
| pancreas | 94 |
| prostate | 60 |
| skin | 34 |
| stomach | 293 |
| Thyroid | 657 |
| uterus | 54 |

TABLE 4737

P values and ratios for expression in cancerous tissue

| Name of Tissue | P1 | P2 | SP1 | R3 | SP2 | R4 |
|---|---|---|---|---|---|---|
| bladder | 7.0e−02 | 4.4e−02 | 1.0e−06 | 4.5 | 1.9e−08 | 5.6 |
| brain | 2.4e−01 | 3.3e−01 | 0.0e+00 | 0.0 | 0.0e+00 | 0.0 |
| colon | 2.8e−01 | 8.1e−02 | 7.0e−01 | 1.6 | 2.1e−01 | 2.6 |
| epithelial | 1.9e−02 | 7.5e−02 | 1.0e−13 | 2.0 | 1.3e−19 | 2.3 |
| general | 2.2e−05 | 3.4e−04 | 1.1e−40 | 3.3 | 1.7e−55 | 3.5 |
| head and neck | 3.4e−01 | 3.3e−01 | 1 | 1.2 | 5.6e−01 | 1.6 |
| kidney | 8.2e−01 | 8.5e−01 | 5.1e−01 | 1.0 | 4.6e−01 | 0.9 |
| liver | 9.2e−01 | 5.6e−01 | 1 | 1.0 | 2.3e−01 | 2.8 |
| lung | 6.9e−01 | 7.5e−01 | 9.8e−01 | 0.4 | 9.3e−02 | 0.6 |
| breast | 2.7e−01 | 3.1e−01 | 1.9e−01 | 1.2 | 1.6e−02 | 0.9 |
| bone marrow | 1 | 6.7e−01 | 1 | 1.0 | 5.3e−01 | 1.9 |
| ovary | 3.7e−03 | 3.5e−03 | 4.8e−06 | 10.4 | 1.5e−07 | 11.4 |
| pancreas | 1.6e−01 | 1.1e−01 | 1.8e−06 | 1.8 | 8.8e−12 | 3.7 |
| prostate | 7.4e−01 | 7.9e−01 | 8.1e−06 | 1.0 | 9.1e−07 | 3.0 |
| skin | 6.0e−01 | 8.1e−01 | 3.7e−01 | 2.0 | 9.5e−01 | 0.4 |
| stomach | 3.5e−01 | 7.9e−01 | 9.3e−01 | 0.5 | 1 | 0.3 |
| Thyroid | 3.6e−01 | 3.6e−01 | 9.2e−01 | 0.6 | 9.2e−01 | 0.6 |
| uterus | 2.3e−01 | 1.7e−01 | 2.2e−02 | 1.9 | 1.2e−02 | 2.4 |

As noted above, cluster HUMKERMII features 50 segment(s), which were listed in Table 4733 above and for which the sequence(s) are given at the end of the application. These segment(s) are portions of nucleic acid sequence(s) which are described herein separately because they are of particular interest. A description of each segment according to the present invention is now provided.

Segment cluster HUMKERMII_node_2 (SEQ ID NO:5263) according to the present invention is supported by 1 libraries. The number of libraries was determined as previously described. This segment can be found in the following transcript(s): HUMKERMII_T21 (SEQ ID NO:4126). Table 4738 below describes the starting and ending position of this segment on each transcript.

TABLE 4738

Segment location on transcripts

| Transcript name | Segment starting position | Segment ending position |
|---|---|---|
| HUMKERMII_T21 (SEQ ID NO: 4126) | 34 | 162 |

This segment can be found in the following protein(s): HUMKERMII_P15.

Segment cluster HUMKERMII_node_6 (SEQ ID NO:5264) according to the present invention is supported by 11 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128), and HUMKERMII_T29 (SEQ ID NO:4129). Table 4739 below describes the starting and ending position of this segment on each transcript.

TABLE 4739

Segment location on transcripts

| Transcript name | Segment starting position | Segment ending position |
|---|---|---|
| HUMKERMII_T16 (SEQ ID NO: 4124) | 105 | 557 |
| HUMKERMII_T22 (SEQ ID NO: 4127) | 105 | 557 |
| HUMKERMII_T27 (SEQ ID NO: 4128) | 105 | 557 |
| HUMKERMII_T29 (SEQ ID NO: 4129) | 105 | 557 |

This segment can be found in a non-coding region of transcript(s) that are related to the following protein(s): HUMKERMII_P12, HUMKERMII_P16, HUMKERMII_P20 and HUMKERMII_P22.

Segment cluster HUMKERMII_node_15 (SEQ ID NO:5265) according to the present invention is supported by 2 libraries. The number of libraries was determined as previously described. This segment can be found in the following transcript(s): HUMKERMII_T18 (SEQ ID NO:4125). Table 4740 below describes the starting and ending position of this segment on each transcript.

TABLE 4740

Segment location on transcripts

| Transcript name | Segment starting position | Segment ending position |
|---|---|---|
| HUMKERMII_T18 (SEQ ID NO: 4125) | 1 | 965 |

This segment can be found in a non-coding region of transcript(s) that are related to the following protein(s): HUMKERMII_P5.

Segment cluster HUMKERMII_node_21 (SEQ ID NO:5266) according to the present invention is supported by 31 libraries. The number of libraries was determined as previously described. This segment can be found in the following transcript(s): HUMKERMII_T29 (SEQ ID NO:4129). Table 4741 below describes the starting and ending position of this segment on each transcript.

TABLE 4741

Segment location on transcripts

| Transcript name | Segment starting position | Segment ending position |
|---|---|---|
| HUMKERMII_T29 (SEQ ID NO: 4129) | 1146 | 3168 |

This segment can be found in a non-coding region of transcript(s) that are related to the following protein(s): HUMKERMII_P22.

Segment cluster HUMKERMII_node_26 (SEQ ID NO:5267) according to the present invention is supported by 9 libraries. The number of libraries was determined as previously described. This segment can be found in the following transcript(s): HUMKERMII_T27 (SEQ ID NO:4128) and HUMKERMII_T29 (SEQ ID NO:4129). Table 4742 below describes the starting and ending position of this segment on each transcript.

TABLE 4742

| Segment location on transcripts | | |
|---|---|---|
| Transcript name | Segment starting position | Segment ending position |
| HUMKERMII_T27 (SEQ ID NO: 4128) | 1207 | 1356 |
| HUMKERMII_T29 (SEQ ID NO: 4129) | 3349 | 3498 |

This segment can be found in the following protein(s): HUMKERMII_P20 and HUMKERMII_P22.

Segment cluster HUMKERMII_node_28 (SEQ ID NO:5268) according to the present invention is supported by 5 libraries. The number of libraries was determined as previously described. This segment can be found in the following transcript(s): HUMKERMII_T35 (SEQ ID NO:4130). Table 4743 below describes the starting and ending position of this segment on each transcript.

TABLE 4743

| Segment location on transcripts | | |
|---|---|---|
| Transcript name | Segment starting position | Segment ending position |
| HUMKERMII_T35 (SEQ ID NO: 4130) | 1 | 788 |

This segment can be found in the following protein(s): HUMKERMII_P25.

Segment cluster HUMKERMII_node_69 (SEQ ID NO:5269) according to the present invention is supported by 154 libraries. The number of libraries was determined as previously described. This segment can be found in the following transcript(s): HUMKERMII_T18 (SEQ ID NO:4125), HUMKERMII_T21 (SEQ ID NO:4126), HUMKERMII_T27 (SEQ ID NO:4128), HUMKERMII_T29 (SEQ ID NO:4129) and HUMKERMII_T35 (SEQ ID NO:4130). Table 4744 below describes the starting and ending position of this segment on each transcript.

TABLE 4744

| Segment location on transcripts | | |
|---|---|---|
| Transcript name | Segment starting position | Segment ending position |
| HUMKERMII_T18 (SEQ ID NO: 4125) | 2098 | 2218 |
| HUMKERMII_T21 (SEQ ID NO: 4126) | 1295 | 1415 |
| HUMKERMII_T27 (SEQ ID NO: 4128) | 2216 | 2336 |
| HUMKERMII_T29 (SEQ ID NO: 4129) | 4358 | 4478 |
| HUMKERMII_T35 (SEQ ID NO: 4130) | 1648 | 1768 |

TABLE 4744-continued

This segment can be found in a non-coding region of transcript(s) that are related to the following protein(s): HUMKERMII_P5, HUMKERMII_P15, HUMKERMII_P20, HUMKERMII_P22 and HUMKERMII_P25.

Segment cluster HUMKERMII_node_71 (SEQ ID NO:5270) according to the present invention is supported by 8 libraries. The number of libraries was determined as previously described. This segment can be found in the following transcript(s): HUMKERMII_T16 (SEQ ID NO:4124) and HUMKERMII_T22 (SEQ ID NO:4127) Table 4745 below describes the starting and ending position of this segment on each transcript.

TABLE 4745

| Segment location on transcripts | | |
|---|---|---|
| Transcript name | Segment starting position | Segment ending position |
| HUMKERMII_T16 (SEQ ID NO: 4124) | 1850 | 2739 |
| HUMKERMII_T22 (SEQ ID NO: 4127) | 1815 | 2704 |

This segment can be found in the following protein(s): HUMKERMII_P12 and HUMKERMII_P16.

According to an optional embodiment of the present invention, short segments related to the above cluster are also provided. These segments are up to about 120 bp in length, and so are included in a separate description.

Segment cluster HUMKERMII_node_0 (SEQ ID NO:5271) according to the present invention is supported by 1 libraries. The number of libraries was determined as previously described. This segment can be found in the following transcript(s): HUMKERMII_T21 (SEQ ID NO:4126). Table 4746 below describes the starting and ending position of this segment on each transcript.

TABLE 4746

| Segment location on transcripts | | |
|---|---|---|
| Transcript name | Segment starting position | Segment ending position |
| HUMKERMII_T21 (SEQ ID NO: 4126) | 1 | 33 |

This segment can be found in a non-coding region of transcript(s) that are related to the following protein(s): HUMKERMII_P15.

Segment cluster HUMKERMII_node_4 (SEQ ID NO: 5272) according to the present invention is supported by 5 libraries. The number of libraries was determined as previously described. This segment can be found in the following transcript(s): HUMKERMII_T16 (SEQ ID NO:4124), HUMKERMII_T22 (SEQ ID NO:4127), HUMKER- MII_T27 (SEQ ID NO:4128) and HUMKERMII_T29 (SEQ ID NO:4129). Table 4747 below describes the starting and ending position of this segment on each transcript.

TABLE 4747

Segment location on transcripts

| Transcript name | Segment starting position | Segment ending position |
|---|---|---|
| HUMKERMII_T16 (SEQ ID NO: 4124) | 1 | 104 |
| HUMKERMII_T22 (SEQ ID NO: 4127) | 1 | 104 |
| HUMKERMII_T27 (SEQ ID NO: 4128) | 1 | 104 |
| HUMKERMII_T29 (SEQ ID NO: 4129) | 1 | 104 |

This segment can be found in a non-coding region of transcript(s) that are related to the following protein(s): HUMKERMII_P12, HUMKERMII_P16, HUMKERMII_P20 and HUMKERMII_P22.

Segment cluster HUMKERMII_node_7 (SEQ ID NO:5273) according to the present invention is supported by 47 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4748 below describes the starting and ending position of this segment on each transcript.

TABLE 4748

Segment location on transcripts

| Transcript name | Segment starting position | Segment ending position |
|---|---|---|
| HUMKERMII_T16 (SEQ ID NO: 4124) | 558 | 656 |
| HUMKERMII_T22 (SEQ ID NO: 4127) | 558 | 656 |
| HUMKERMII_T27 (SEQ ID NO: 4128) | 558 | 656 |
| HUMKERMII_T29 (SEQ ID NO: 4129) | 558 | 656 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_8 (SEQ ID NO:5274) according to the present invention is supported by 47 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4749 below describes the starting and ending position of this segment on each transcript.

TABLE 4749

Segment location on transcripts

| Transcript name | Segment starting position | Segment ending position |
|---|---|---|
| HUMKERMII_T16 (SEQ ID NO: 4124) | 657 | 684 |
| HUMKERMII_T22 (SEQ ID NO: 4127) | 657 | 684 |
| HUMKERMII_T27 (SEQ ID NO: 4128) | 657 | 684 |
| HUMKERMII_T29 (SEQ ID NO: 4129) | 657 | 684 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_9 (SEQ ID NO:5275) according to the present invention is supported by 57 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4750 below describes the starting and ending position of this segment on each transcript.

TABLE 4750

Segment location on transcripts

| Transcript name | Segment starting position | Segment ending position |
|---|---|---|
| HUMKERMII_T16 (SEQ ID NO: 4124) | 685 | 759 |
| HUMKERMII_T22 (SEQ ID NO: 4127) | 685 | 759 |
| HUMKERMII_T27 (SEQ ID NO: 4128) | 685 | 759 |
| HUMKERMII_T29 (SEQ ID NO: 4129) | 685 | 759 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_10 (SEQ ID NO:5276) according to the present invention is supported by 68 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4751 below describes the starting and ending position of this segment on each transcript.

TABLE 4751

Segment location on transcripts

| Transcript name | Segment starting position | Segment ending position |
|---|---|---|
| HUMKERMII_T16 (SEQ ID NO: 4124) | 760 | 819 |
| HUMKERMII_T22 (SEQ ID NO: 4127) | 760 | 819 |
| HUMKERMII_T27 (SEQ ID NO: 4128) | 760 | 819 |
| HUMKERMII_T29 (SEQ ID NO: 4129) | 760 | 819 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_11 (SEQ ID NO:5277) according to the present invention can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4752 below describes the starting and ending position of this segment on each transcript.

TABLE 4752

Segment location on transcripts

| Transcript name | Segment starting position | Segment ending position |
|---|---|---|
| HUMKERMII_T16 (SEQ ID NO: 4124) | 820 | 831 |
| HUMKERMII_T22 (SEQ ID NO: 4127) | 820 | 831 |
| HUMKERMII_T27 (SEQ ID NO: 4128) | 820 | 831 |
| HUMKERMII_T29 (SEQ ID NO: 4129) | 820 | 831 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_12 (SEQ ID NO:5278) according to the present invention is supported by 83 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4753 below describes the starting and ending position of this segment on each transcript.

TABLE 4753

Segment location on transcripts

| Transcript name | Segment starting position | Segment ending position |
|---|---|---|
| HUMKERMII_T16 (SEQ ID NO: 4124) | 832 | 891 |
| HUMKERMII_T22 (SEQ ID NO: 4127) | 832 | 891 |
| HUMKERMII_T27 (SEQ ID NO: 4128) | 832 | 891 |
| HUMKERMII_T29 (SEQ ID NO: 4129) | 832 | 891 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_13 (SEQ ID NO:5279) according to the present invention is supported by 98 libraries. The number of libraries was determined as previously described. This segment can be found in the following transcript(s): HUMKERMII_T16 (SEQ ID NO:4124), HUMKERMII_T22 (SEQ ID NO:4127), HUMKERMII_T27 (SEQ ID NO:4128) and HUMKERMII_T29 (SEQ ID NO:4129). Table 4754 below describes the starting and ending position of this segment on each transcript.

TABLE 4754

Segment location on transcripts

| Transcript name | Segment starting position | Segment ending position |
|---|---|---|
| HUMKERMII_T16 (SEQ ID NO: 4124) | 892 | 933 |
| HUMKERMII_T22 (SEQ ID NO: 4127) | 892 | 933 |
| HUMKERMII_T27 (SEQ ID NO: 4128) | 892 | 933 |
| HUMKERMII_T29 (SEQ ID NO: 4129) | 892 | 933 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P16 and HUMKERMII_P20, since it is in the coding region for the corresponding transcript.

Segment cluster HUMKERMII_node_16 (SEQ ID NO:5280) according to the present invention is supported by 111 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4755 below describes the starting and ending position of this segment on each transcript.

TABLE 4755

Segment location on transcripts

| Transcript name | Segment starting position | Segment ending position |
|---|---|---|
| HUMKERMII_T16 (SEQ ID NO: 4124) | 934 | 960 |
| HUMKERMII_T18 (SEQ ID NO: 4125) | 966 | 992 |
| HUMKERMII_T21 (SEQ ID NO: 4126) | 163 | 189 |
| HUMKERMII_T22 (SEQ ID NO: 4127) | 934 | 960 |
| HUMKERMII_T27 (SEQ ID NO: 4128) | 934 | 960 |
| HUMKERMII_T29 (SEQ ID NO: 4129) | 934 | 960 |

This segment can be found in both coding and non-coding regions of transcript(s) as follows. The segment can be found in a non-coding region of transcript(s) that are related to the following protein(s): HUMKERMII_P5 and HUMKERMII_P22. This segment can also be found in the following protein(s): HUMKERMII_P12, HUMKERMII_P15, HUMKERMII_P16 and HUMKERMII_P20, since it is in the coding region for the corresponding transcript.

Segment cluster HUMKERMII_node_17 (SEQ ID NO:5281) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4756 below describes the starting and ending position of this segment on each transcript.

TABLE 4756

Segment location on transcripts

| Transcript name | Segment starting position | Segment ending position |
|---|---|---|
| HUMKERMII_T16 (SEQ ID NO: 4124) | 961 | 980 |
| HUMKERMII_T18 (SEQ ID NO: 4125) | 993 | 1012 |
| HUMKERMII_T21 (SEQ ID NO: 4126) | 190 | 209 |
| HUMKERMII_T22 (SEQ ID NO: 4127) | 961 | 980 |
| HUMKERMII_T27 (SEQ ID NO: 4128) | 961 | 980 |
| HUMKERMII_T29 (SEQ ID NO: 4129) | 961 | 980 |

This segment can be found in both coding and non-coding regions of transcript(s) as follows. The segment can be found in a non-coding region of transcript(s) that are related to the following protein(s): HUMKERMII_P5 and HUMKERMII_P22. This segment can also be found in the following protein(s): HUMKERMII_P12, HUMKERMII_P15, HUMKERMII_P16 and HUMKERMII_P20, since it is in the coding region for the corresponding transcript.

Segment cluster HUMKERMII_node_18 (SEQ ID NO:5282) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4757 below describes the starting and ending position of this segment on each transcript.

TABLE 4757

Segment location on transcripts

| Transcript name | Segment starting position | Segment ending position |
|---|---|---|
| HUMKERMII_T16 (SEQ ID NO: 4124) | 981 | 996 |
| HUMKERMII_T18 (SEQ ID NO: 4125) | 1013 | 1028 |
| HUMKERMII_T21 (SEQ ID NO: 4126) | 210 | 225 |
| HUMKERMII_T22 (SEQ ID NO: 4127) | 981 | 996 |
| HUMKERMII_T27 (SEQ ID NO: 4128) | 981 | 996 |
| HUMKERMII_T29 (SEQ ID NO: 4129) | 981 | 996 |

This segment can be found in both coding and non-coding regions of transcript(s) as follows. The segment can be found in a non-coding region of transcript(s) that are related to the following protein(s): HUMKERMII_P5 and HUMKERMII_P22. This segment can also be found in the following protein(s): HUMKERMII_P12, HUMKERMII_P15, HUMKERMII_P16 and HUMKERMII_P20, since it is in the coding region for the corresponding transcript.

Segment cluster HUMKERMII_node_19 (SEQ ID NO:5283) according to the present invention is supported by 136 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4758 below describes the starting and ending position of this segment on each transcript.

TABLE 4758

Segment location on transcripts

| Transcript name | Segment starting position | Segment ending position |
|---|---|---|
| HUMKERMII_T16 (SEQ ID NO: 4124) | 997 | 1092 |
| HUMKERMII_T18 (SEQ ID NO: 4125) | 1029 | 1124 |
| HUMKERMII_T21 (SEQ ID NO: 4126) | 226 | 321 |
| HUMKERMII_T22 (SEQ ID NO: 4127) | 997 | 1092 |
| HUMKERMII_T27 (SEQ ID NO: 4128) | 997 | 1092 |
| HUMKERMII_T29 (SEQ ID NO: 4129) | 997 | 1092 |

This segment can be found in both coding and non-coding regions of transcript(s) as follows. The segment can be found in a non-coding region of transcript(s) that are related to the following protein(s): HUMKERMII_P5 and HUMKERMII_P22. This segment can also be found in the following protein(s): HUMKERMII_P12, HUMKERMII_P15, HUMKERMII_P16 and HUMKERMII_P20, since it is in the coding region for the corresponding transcript.

Segment cluster HUMKERMII_node_20 (SEQ ID NO: 5284) according to the present invention is supported by 131 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4759 below describes the starting and ending position of this segment on each transcript.

TABLE 4759

Segment location on transcripts

| Transcript name | Segment starting position | Segment ending position |
|---|---|---|
| HUMKERMII_T16 (SEQ ID NO: 4124) | 1093 | 1145 |
| HUMKERMII_T18 (SEQ ID NO: 4125) | 1125 | 1177 |
| HUMKERMII_T21 (SEQ ID NO: 4126) | 322 | 374 |
| HUMKERMII_T22 (SEQ ID NO: 4127) | 1093 | 1145 |
| HUMKERMII_T27 (SEQ ID NO: 4128) | 1093 | 1145 |
| HUMKERMII_T29 (SEQ ID NO: 4129) | 1093 | 1145 |

This segment can be found in both coding and non-coding regions of transcript(s) as follows. The segment can be found in a non-coding region of transcript(s) that are related to the following protein(s): HUMKERMII_P22. This segment can also be found in the following protein(s): HUMKERMII_P12, HUMKERMII_P5, HUMKERMII_P15, HUMKERMII_P16 and HUMKERMII_P20, since it is in the coding region for the corresponding transcript.

Segment cluster HUMKERMII_node_22 (SEQ ID NO:5285) according to the present invention is supported by 3 libraries. The number of libraries was determined as previously described. This segment can be found in the following transcript(s): HUMKERMII_T29 (SEQ ID NO:4129). Table 4760 below describes the starting and ending position of this segment on each transcript.

TABLE 4760

Segment location on transcripts

| Transcript name | Segment starting position | Segment ending position |
|---|---|---|
| HUMKERMII_T29 (SEQ ID NO: 4129) | 3169 | 3287 |

This segment can be found in the following protein(s): HUMKERMII_P22.

Segment cluster HUMKERMII_node_23 (SEQ ID NO:5286) according to the present invention is supported by 138 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4761 below describes the starting and ending position of this segment on each transcript.

TABLE 4761

Segment location on transcripts

| Transcript name | Segment starting position | Segment ending position |
|---|---|---|
| HUMKERMII_T16 (SEQ ID NO: 4124) | 1146 | 1177 |
| HUMKERMII_T18 (SEQ ID NO: 4125) | 1178 | 1209 |
| HUMKERMII_T21 (SEQ ID NO: 4126) | 375 | 406 |
| HUMKERMII_T22 (SEQ ID NO: 4127) | 1146 | 1177 |
| HUMKERMII_T27 (SEQ ID NO: 4128) | 1146 | 1177 |
| HUMKERMII_T29 (SEQ ID NO: 4129) | 3288 | 3319 |

This segment can be found in the following protein(s): HUMKERMII_P12, HUMKERMII_P5, HUMKERMII_P15, HUMKERMII_P16, HUMKERMII_P20 and HUMKERMII_P22.

Segment cluster HUMKERMII_node_24 (SEQ ID NO:5287) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4762 below describes the starting and ending position of this segment on each transcript.

TABLE 4762

Segment location on transcripts

| Transcript name | Segment starting position | Segment ending position |
|---|---|---|
| HUMKERMII_T16 (SEQ ID NO: 4124) | 1178 | 1183 |
| HUMKERMII_T18 (SEQ ID NO: 4125) | 1210 | 1215 |
| HUMKERMII_T21 (SEQ ID NO: 4126) | 407 | 412 |
| HUMKERMII_T22 (SEQ ID NO: 4127) | 1178 | 1183 |
| HUMKERMII_T27 (SEQ ID NO: 4128) | 1178 | 1183 |
| HUMKERMII_T29 (SEQ ID NO: 4129) | 3320 | 3325 |

This segment can be found in the following protein(s): HUMKERMII_P12, HUMKERMII_P5, HUMKERMII_P15, HUMKERMII_P16, HUMKERMII_P20 and HUMKERMII_P22.

Segment cluster HUMKERMII_node_25 (SEQ ID NO:5288) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128) and HUMKERMII_T29 (SEQ ID NO:4129). Table 4763 below describes the starting and ending position of this segment on each transcript.

TABLE 4763

Segment location on transcripts

| Transcript name | Segment starting position | Segment ending position |
|---|---|---|
| HUMKERMII_T16 (SEQ ID NO: 4124) | 1184 | 1206 |
| HUMKERMII_T18 (SEQ ID NO: 4125) | 1216 | 1238 |
| HUMKERMII_T21 (SEQ ID NO: 4126) | 413 | 435 |
| HUMKERMII_T22 (SEQ ID NO: 4127) | 1184 | 1206 |
| HUMKERMII_T27 (SEQ ID NO: 4128) | 1184 | 1206 |
| HUMKERMII_T29 (SEQ ID NO: 4129) | 3326 | 3348 |

This segment can be found in the following protein(s): HUMKERMII_P12, HUMKERMII_P5, HUMKERMII_P15, HUMKERMII_P16, HUMKERMII_P20 and HUMKERMII_P22.

Segment cluster HUMKERMII_node_29 (SEQ ID NO:5289) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4764 below describes the starting and ending position of this segment on each transcript.

TABLE 4764

Segment location on transcripts

| Transcript name | Segment starting position | Segment ending position |
|---|---|---|
| HUMKERMII_T16 (SEQ ID NO: 4124) | 1207 | 1224 |
| HUMKERMII_T18 (SEQ ID NO: 4125) | 1239 | 1256 |
| HUMKERMII_T21 (SEQ ID NO: 4126) | 436 | 453 |
| HUMKERMII_T22 (SEQ ID NO: 4127) | 1207 | 1224 |
| HUMKERMII_T27 (SEQ ID NO: 4128) | 1357 | 1374 |
| HUMKERMII_T29 (SEQ ID NO: 4129) | 3499 | 3516 |
| HUMKERMII_T35 (SEQ ID NO: 4130) | 789 | 806 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_30 (SEQ ID NO:5290) according to the present invention is supported by 166 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4765 below describes the starting and ending position of this segment on each transcript.

TABLE 4765

Segment location on transcripts

| Transcript name | Segment starting position | Segment ending position |
|---|---|---|
| HUMKERMII_T16 (SEQ ID NO: 4124) | 1225 | 1268 |
| HUMKERMII_T18 (SEQ ID NO: 4125) | 1257 | 1300 |
| HUMKERMII_T21 (SEQ ID NO: 4126) | 454 | 497 |
| HUMKERMII_T22 (SEQ ID NO: 4127) | 1225 | 1268 |
| HUMKERMII_T27 (SEQ ID NO: 4128) | 1375 | 1418 |
| HUMKERMII_T29 (SEQ ID NO: 4129) | 3517 | 3560 |
| HUMKERMII_T35 (SEQ ID NO: 4130) | 807 | 850 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_31 (SEQ ID NO:5291) according to the present invention is supported by 161 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4766 below describes the starting and ending position of this segment on each transcript.

TABLE 4766

Segment location on transcripts

| Transcript name | Segment starting position | Segment ending position |
|---|---|---|
| HUMKERMII_T16 (SEQ ID NO: 4124) | 1269 | 1302 |
| HUMKERMII_T18 (SEQ ID NO: 4125) | 1301 | 1334 |
| HUMKERMII_T21 (SEQ ID NO: 4126) | 498 | 531 |
| HUMKERMII_T22 (SEQ ID NO: 4127) | 1269 | 1302 |
| HUMKERMII_T27 (SEQ ID NO: 4128) | 1419 | 1452 |
| HUMKERMII_T29 (SEQ ID NO: 4129) | 3561 | 3594 |
| HUMKERMII_T35 (SEQ ID NO: 4130) | 851 | 884 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_34 (SEQ ID NO:5292) according to the present invention is supported by 178 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4767 below describes the starting and ending position of this segment on each transcript.

TABLE 4767

Segment location on transcripts

| Transcript name | Segment starting position | Segment ending position |
|---|---|---|
| HUMKERMII_T16 (SEQ ID NO: 4124) | 1303 | 1371 |
| HUMKERMII_T18 (SEQ ID NO: 4125) | 1335 | 1403 |
| HUMKERMII_T21 (SEQ ID NO: 4126) | 532 | 600 |
| HUMKERMII_T22 (SEQ ID NO: 4127) | 1303 | 1371 |
| HUMKERMII_T27 (SEQ ID NO: 4128) | 1453 | 1521 |
| HUMKERMII_T29 (SEQ ID NO: 4129) | 3595 | 3663 |
| HUMKERMII_T35 (SEQ ID NO: 4130) | 885 | 953 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_35 (SEQ ID NO:5293) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4768 below describes the starting and ending position of this segment on each transcript.

TABLE 4768

Segment location on transcripts

| Transcript name | Segment starting position | Segment ending position |
|---|---|---|
| HUMKERMII_T16 (SEQ ID NO: 4124) | 1372 | 1393 |
| HUMKERMII_T18 (SEQ ID NO: 4125) | 1404 | 1425 |
| HUMKERMII_T21 (SEQ ID NO: 4126) | 601 | 622 |
| HUMKERMII_T22 (SEQ ID NO: 4127) | 1372 | 1393 |
| HUMKERMII_T27 (SEQ ID NO: 4128) | 1522 | 1543 |
| HUMKERMII_T29 (SEQ ID NO: 4129) | 3664 | 3685 |
| HUMKERMII_T35 (SEQ ID NO: 4130) | 954 | 975 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_36 (SEQ ID NO:5294) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4769 below describes the starting and ending position of this segment on each transcript.

TABLE 4769

Segment location on transcripts

| Transcript name | Segment starting position | Segment ending position |
|---|---|---|
| HUMKERMII_T16 (SEQ ID NO: 4124) | 1394 | 1402 |
| HUMKERMII_T18 (SEQ ID NO: 4125) | 1426 | 1434 |
| HUMKERMII_T21 (SEQ ID NO: 4126) | 623 | 631 |
| HUMKERMII_T22 (SEQ ID NO: 4127) | 1394 | 1402 |
| HUMKERMII_T27 (SEQ ID NO: 4128) | 1544 | 1552 |
| HUMKERMII_T29 (SEQ ID NO: 4129) | 3686 | 3694 |
| HUMKERMII_T35 (SEQ ID NO: 4130) | 976 | 984 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_37 (SEQ ID NO:5295) according to the present invention is supported by 166 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4770 below describes the starting and ending position of this segment on each transcript.

TABLE 4770

Segment location on transcripts

| Transcript name | Segment starting position | Segment ending position |
|---|---|---|
| HUMKERMII_T16 (SEQ ID NO: 4124) | 1403 | 1451 |
| HUMKERMII_T18 (SEQ ID NO: 4125) | 1435 | 1483 |
| HUMKERMII_T21 (SEQ ID NO: 4126) | 632 | 680 |
| HUMKERMII_T22 (SEQ ID NO: 4127) | 1403 | 1451 |
| HUMKERMII_T27 (SEQ ID NO: 4128) | 1553 | 1601 |
| HUMKERMII_T29 (SEQ ID NO: 4129) | 3695 | 3743 |
| HUMKERMII_T35 (SEQ ID NO: 4130) | 985 | 1033 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_38 (SEQ ID NO:5296) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4771 below describes the starting and ending position of this segment on each transcript.

TABLE 4771

Segment location on transcripts

| Transcript name | Segment starting position | Segment ending position |
|---|---|---|
| HUMKERMII_T16 (SEQ ID NO: 4124) | 1452 | 1467 |
| HUMKERMII_T18 (SEQ ID NO: 4125) | 1484 | 1499 |
| HUMKERMII_T21 (SEQ ID NO: 4126) | 681 | 696 |
| HUMKERMII_T22 (SEQ ID NO: 4127) | 1452 | 1467 |
| HUMKERMII_T27 (SEQ ID NO: 4128) | 1602 | 1617 |
| HUMKERMII_T29 (SEQ ID NO: 4129) | 3744 | 3759 |
| HUMKERMII_T35 (SEQ ID NO: 4130) | 1034 | 1049 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_40 (SEQ ID NO:5297) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4772 below describes the starting and ending position of this segment on each transcript.

TABLE 4772

Segment location on transcripts

| Transcript name | Segment starting position | Segment ending position |
|---|---|---|
| HUMKERMII_T16 (SEQ ID NO: 4124) | 1468 | 1476 |
| HUMKERMII_T18 (SEQ ID NO: 4125) | 1500 | 1508 |
| HUMKERMII_T21 (SEQ ID NO: 4126) | 697 | 705 |
| HUMKERMII_T22 (SEQ ID NO: 4127) | 1468 | 1476 |
| HUMKERMII_T27 (SEQ ID NO: 4128) | 1618 | 1626 |
| HUMKERMII_T29 (SEQ ID NO: 4129) | 3760 | 3768 |
| HUMKERMII_T35 (SEQ ID NO: 4130) | 1050 | 1058 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_41 (SEQ ID NO:5298) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4773 below describes the starting and ending position of this segment on each transcript.

TABLE 4773

Segment location on transcripts

| Transcript name | Segment starting position | Segment ending position |
|---|---|---|
| HUMKERMII_T16 (SEQ ID NO: 4124) | 1477 | 1497 |
| HUMKERMII_T18 (SEQ ID NO: 4125) | 1509 | 1529 |
| HUMKERMII_T21 (SEQ ID NO: 4126) | 706 | 726 |
| HUMKERMII_T22 (SEQ ID NO: 4127) | 1477 | 1497 |
| HUMKERMII_T27 (SEQ ID NO: 4128) | 1627 | 1647 |
| HUMKERMII_T29 (SEQ ID NO: 4129) | 3769 | 3789 |
| HUMKERMII_T35 (SEQ ID NO: 4130) | 1059 | 1079 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_43 (SEQ ID NO:5299) according to the present invention is supported by 179 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4774 below describes the starting and ending position of this segment on each transcript.

TABLE 4774

Segment location on transcripts

| Transcript name | Segment starting position | Segment ending position |
|---|---|---|
| HUMKERMII_T16 (SEQ ID NO: 4124) | 1498 | 1566 |
| HUMKERMII_T18 (SEQ ID NO: 4125) | 1530 | 1598 |
| HUMKERMII_T21 (SEQ ID NO: 4126) | 727 | 795 |
| HUMKERMII_T22 (SEQ ID NO: 4127) | 1498 | 1566 |
| HUMKERMII_T27 (SEQ ID NO: 4128) | 1648 | 1716 |
| HUMKERMII_T29 (SEQ ID NO: 4129) | 3790 | 3858 |
| HUMKERMII_T35 (SEQ ID NO: 4130) | 1080 | 1148 |

This segment can be found in the following protein(s): HUMKERMII_P12, HUMKERMII_P5, HUMKER- MII_P15, HUMKERMII_P16, HUMKERMII_P20, HUMKERMII_P22 and HUMKERMII_P25.

Segment cluster HUMKERMII_node_44 (SEQ ID NO:5300) according to the present invention is supported by 154 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4775 below describes the starting and ending position of this segment on each transcript.

TABLE 4775

Segment location on transcripts

| Transcript name | Segment starting position | Segment ending position |
|---|---|---|
| HUMKERMII_T16 (SEQ ID NO: 4124) | 1567 | 1593 |
| HUMKERMII_T18 (SEQ ID NO: 4125) | 1599 | 1625 |
| HUMKERMII_T21 (SEQ ID NO: 4126) | 796 | 822 |
| HUMKERMII_T22 (SEQ ID NO: 4127) | 1567 | 1593 |
| HUMKERMII_T27 (SEQ ID NO: 4128) | 1717 | 1743 |
| HUMKERMII_T29 (SEQ ID NO: 4129) | 3859 | 3885 |
| HUMKERMII_T35 (SEQ ID NO: 4130) | 1149 | 1175 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_51 (SEQ ID NO:5301) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4776 below describes the starting and ending position of this segment on each transcript.

TABLE 4776

Segment location on transcripts

| Transcript name | Segment starting position | Segment ending position |
|---|---|---|
| HUMKERMII_T16 (SEQ ID NO: 4124) | 1594 | 1613 |
| HUMKERMII_T18 (SEQ ID NO: 4125) | 1626 | 1645 |
| HUMKERMII_T21 (SEQ ID NO: 4126) | 823 | 842 |
| HUMKERMII_T22 (SEQ ID NO: 4127) | 1594 | 1613 |
| HUMKERMII_T27 (SEQ ID NO: 4128) | 1744 | 1763 |
| HUMKERMII_T29 (SEQ ID NO: 4129) | 3886 | 3905 |
| HUMKERMII_T35 (SEQ ID NO: 4130) | 1176 | 1195 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_52 (SEQ ID NO:5302) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4777 below describes the starting and ending position of this segment on each transcript.

TABLE 4777

Segment location on transcripts

| Transcript name | Segment starting position | Segment ending position |
|---|---|---|
| HUMKERMII_T16 (SEQ ID NO: 4124) | 1614 | 1624 |
| HUMKERMII_T18 (SEQ ID NO: 4125) | 1646 | 1656 |
| HUMKERMII_T21 (SEQ ID NO: 4126) | 843 | 853 |
| HUMKERMII_T22 (SEQ ID NO: 4127) | 1614 | 1624 |
| HUMKERMII_T27 (SEQ ID NO: 4128) | 1764 | 1774 |
| HUMKERMII_T29 (SEQ ID NO: 4129) | 3906 | 3916 |
| HUMKERMII_T35 (SEQ ID NO: 4130) | 1196 | 1206 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_53 (SEQ ID NO:5303) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4778 below describes the starting and ending position of this segment on each transcript.

TABLE 4778

Segment location on transcripts

| Transcript name | Segment starting position | Segment ending position |
|---|---|---|
| HUMKERMII_T16 (SEQ ID NO: 4124) | 1625 | 1629 |
| HUMKERMII_T18 (SEQ ID NO: 4125) | 1657 | 1661 |

TABLE 4778-continued

Segment location on transcripts

| Transcript name | Segment starting position | Segment ending position |
|---|---|---|
| HUMKERMII_T21 (SEQ ID NO: 4126) | 854 | 858 |
| HUMKERMII_T22 (SEQ ID NO: 4127) | 1625 | 1629 |
| HUMKERMII_T27 (SEQ ID NO: 4128) | 1775 | 1779 |
| HUMKERMII_T29 (SEQ ID NO: 4129) | 3917 | 3921 |
| HUMKERMII_T35 (SEQ ID NO: 4130) | 1207 | 1211 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_54 (SEQ ID NO:5304) according to the present invention is supported by 160 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4779 below describes the starting and ending position of this segment on each transcript.

TABLE 4779

Segment location on transcripts

| Transcript name | Segment starting position | Segment ending position |
|---|---|---|
| HUMKERMII_T16 (SEQ ID NO: 4124) | 1630 | 1668 |
| HUMKERMII_T18 (SEQ ID NO: 4125) | 1662 | 1700 |
| HUMKERMII_T21 (SEQ ID NO: 4126) | 859 | 897 |
| HUMKERMII_T22 (SEQ ID NO: 4127) | 1630 | 1668 |
| HUMKERMII_T27 (SEQ ID NO: 4128) | 1780 | 1818 |
| HUMKERMII_T29 (SEQ ID NO: 4129) | 3922 | 3960 |
| HUMKERMII_T35 (SEQ ID NO: 4130) | 1212 | 1250 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_55 (SEQ ID NO:5305) according to the present invention is supported by 179 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4780 below describes the starting and ending position of this segment on each transcript.

TABLE 4780

Segment location on transcripts

| Transcript name | Segment starting position | Segment ending position |
|---|---|---|
| HUMKERMII_T16 (SEQ ID NO: 4124) | 1669 | 1726 |
| HUMKERMII_T18 (SEQ ID NO: 4125) | 1701 | 1758 |
| HUMKERMII_T21 (SEQ ID NO: 4126) | 898 | 955 |
| HUMKERMII_T22 (SEQ ID NO: 4127) | 1669 | 1726 |
| HUMKERMII_T27 (SEQ ID NO: 4128) | 1819 | 1876 |
| HUMKERMII_T29 (SEQ ID NO: 4129) | 3961 | 4018 |
| HUMKERMII_T35 (SEQ ID NO: 4130) | 1251 | 1308 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_56 (SEQ ID NO:5306) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4781 below describes the starting and ending position of this segment on each transcript.

TABLE 4781

Segment location on transcripts

| Transcript name | Segment starting position | Segment ending position |
|---|---|---|
| HUMKERMII_T16 (SEQ ID NO: 4124) | 1727 | 1745 |
| HUMKERMII_T18 (SEQ ID NO: 4125) | 1759 | 1777 |
| HUMKERMII_T21 (SEQ ID NO: 4126) | 956 | 974 |
| HUMKERMII_T22 (SEQ ID NO: 4127) | 1727 | 1745 |
| HUMKERMII_T27 (SEQ ID NO: 4128) | 1877 | 1895 |
| HUMKERMII_T29 (SEQ ID NO: 4129) | 4019 | 4037 |
| HUMKERMII_T35 (SEQ ID NO: 4130) | 1309 | 1327 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_57 (SEQ ID NO:5307) according to the present invention can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4782 below describes the starting and ending position of this segment on each transcript.

TABLE 4782

Segment location on transcripts

| Transcript name | Segment starting position | Segment ending position |
|---|---|---|
| HUMKERMII_T16 (SEQ ID NO: 4124) | 1746 | 1761 |
| HUMKERMII_T18 (SEQ ID NO: 4125) | 1778 | 1793 |
| HUMKERMII_T21 (SEQ ID NO: 4126) | 975 | 990 |
| HUMKERMII_T22 (SEQ ID NO: 4127) | 1746 | 1761 |
| HUMKERMII_T27 (SEQ ID NO: 4128) | 1896 | 1911 |
| HUMKERMII_T29 (SEQ ID NO: 4129) | 4038 | 4053 |
| HUMKERMII_T35 (SEQ ID NO: 4130) | 1328 | 1343 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_58 (SEQ ID NO:5308) according to the present invention is supported by 181 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T22 (SEQ ID NO:4127), HUMKERMII_T27 (SEQ ID NO:4128), HUMKERMII_T29 (SEQ ID NO:4129) and HUMKERMII_T35 (SEQ ID NO:4130). Table 4783 below describes the starting and ending position of this segment on each transcript.

TABLE 4783

Segment location on transcripts

| Transcript name | Segment starting position | Segment ending position |
|---|---|---|
| HUMKERMII_T16 (SEQ ID NO: 4124) | 1762 | 1814 |
| HUMKERMII_T18 (SEQ ID NO: 4125) | 1794 | 1846 |
| HUMKERMII_T21 (SEQ ID NO: 4126) | 991 | 1043 |
| HUMKERMII_T22 (SEQ ID NO: 4127) | 1762 | 1814 |
| HUMKERMII_T27 (SEQ ID NO: 4128) | 1912 | 1964 |
| HUMKERMII_T29 (SEQ ID NO: 4129) | 4054 | 4106 |
| HUMKERMII_T35 (SEQ ID NO: 4130) | 1344 | 1396 |

This segment can be found in the following protein(s): HUMKERMII_P12, HUMKERMII_P5, HUMKERMII_P15, HUMKERMII_P16, HUMKERMII_P20, HUMKERMII_P22 and HUMKERMII_P25.

Segment cluster HUMKERMII_node_62 (SEQ ID NO:5309) according to the present invention is supported by 184 libraries. The number of libraries was determined as previously described. This segment can be found in the following transcript(s): HUMKERMII_T16 (SEQ ID NO:4124), HUMKERMII_T18 (SEQ ID NO:4125), HUMKERMII_T21 (SEQ ID NO:4126), HUMKERMII_T27 (SEQ ID NO:4128), HUMKERMII_T29 (SEQ ID NO:4129) and HUMKERMII_T35 (SEQ ID NO:4130). Table 4784 below describes the starting and ending position of this segment on each transcript.

TABLE 4784

Segment location on transcripts

| Transcript name | Segment starting position | Segment ending position |
|---|---|---|
| HUMKERMII_T16 (SEQ ID NO: 4124) | 1815 | 1849 |
| HUMKERMII_T18 (SEQ ID NO: 4125) | 1847 | 1881 |
| HUMKERMII_T21 (SEQ ID NO: 4126) | 1044 | 1078 |
| HUMKERMII_T27 (SEQ ID NO: 4128) | 1965 | 1999 |
| HUMKERMII_T29 (SEQ ID NO: 4129) | 4107 | 4141 |
| HUMKERMII_T35 (SEQ ID NO: 4130) | 1397 | 1431 |

This segment can be found in the following protein(s): HUMKERMII_P12, HUMKERMII_P5, HUMKERMII_P15, HUMKERMII_P20, HUMKERMII_P22 and HUMKERMII_P25.

Segment cluster HUMKERMII_node_66 (SEQ ID NO:5310) according to the present invention is supported by 192 libraries. The number of libraries was determined as previously described. This segment can be found in the following transcript(s): HUMKERMII_T18 (SEQ ID NO:4125), HUMKERMII_T21 (SEQ ID NO:4126), HUMKERMII_T27 (SEQ ID NO:4128), HUMKERMII_T29 (SEQ ID NO:4129) and HUMKERMII_T35 (SEQ ID NO:4130). Table 4785 below describes the starting and ending position of this segment on each transcript.

TABLE 4785

Segment location on transcripts

| Transcript name | Segment starting position | Segment ending position |
|---|---|---|
| HUMKERMII_T18 (SEQ ID NO: 4125) | 1882 | 1922 |
| HUMKERMII_T21 (SEQ ID NO: 4126) | 1079 | 1119 |
| HUMKERMII_T27 (SEQ ID NO: 4128) | 2000 | 2040 |
| HUMKERMII_T29 (SEQ ID NO: 4129) | 4142 | 4182 |
| HUMKERMII_T35 (SEQ ID NO: 4130) | 1432 | 1472 |

This segment can be found in the following protein(s): HUMKERMII_P5, HUMKERMII_P15, HUMKERMII_P20, HUMKERMII_P22 and HUMKERMII_P25.

Segment cluster HUMKERMII_node_67 (SEQ ID NO:5311) according to the present invention is supported by 199 libraries. The number of libraries was determined as previously described. This segment can be found in the following transcript(s): HUMKERMII_T18 (SEQ ID NO:4125), HUMKERMII_T21 (SEQ ID NO:4126), HUMKERMII_T27 (SEQ ID NO:4128), HUMKERMII_T29 (SEQ ID NO:4129) and HUMKERMII_T35 (SEQ ID NO:4130). Table 4786 below describes the starting and ending position of this segment on each transcript.

TABLE 4786

Segment location on transcripts

| Transcript name | Segment starting position | Segment ending position |
|---|---|---|
| HUMKERMII_T18 (SEQ ID NO: 4125) | 1923 | 1986 |
| HUMKERMII_T21 (SEQ ID NO: 4126) | 1120 | 1183 |
| HUMKERMII_T27 (SEQ ID NO: 4128) | 2041 | 2104 |
| HUMKERMII_T29 (SEQ ID NO: 4129) | 4183 | 4246 |
| HUMKERMII_T35 (SEQ ID NO: 4130) | 1473 | 1536 |

This segment can be found in the following protein(s): HUMKERMII_P5, HUMKERMII_P15, HUMKERMII_P20, HUMKERMII_P22 and HUMKERMII_P25.

Segment cluster HUMKERMII_node_68 (SEQ ID NO:5312) according to the present invention is supported by 191 libraries. The number of libraries was determined as previously described. This segment can be found in the following transcript(s): HUMKERMII_T18 (SEQ ID NO:4125), HUMKERMII_T21 (SEQ ID NO:4126), HUMKERMII_T27 (SEQ ID NO:4128), HUMKERMII_T29 (SEQ ID NO:4129) and HUMKERMII_T35 (SEQ ID NO:4130). Table 4787 below describes the starting and ending position of this segment on each transcript.

TABLE 4787

Segment location on transcripts

| Transcript name | Segment starting position | Segment ending position |
|---|---|---|
| HUMKERMII_T18 (SEQ ID NO: 4125) | 1987 | 2097 |
| HUMKERMII_T21 (SEQ ID NO: 4126) | 1184 | 1294 |
| HUMKERMII_T27 (SEQ ID NO: 4128) | 2105 | 2215 |
| HUMKERMII_T29 (SEQ ID NO: 4129) | 4247 | 4357 |
| HUMKERMII_T35 (SEQ ID NO: 4130) | 1537 | 1647 |

This segment can be found in the following protein(s): HUMKERMII_P5, HUMKERMII_P15, HUMKERMII_P20, HUMKERMII_P22 and HUMKERMII_P25.

Description for Cluster HUMMHGM

Cluster HUMMHGM features 16 transcript(s) and 104 segment(s) of interest, the names for which are given in Tables 4788 and 4789, respectively, the sequences themselves are given at the end of the application. The selected protein variants are given in Table 4790.

TABLE 4788

Transcripts of interest
Transcript Name

HUMMHGM_T8 (SEQ ID NO: 4131)
HUMMHGM_T12 (SEQ ID NO: 4132)
HUMMHGM_T13 (SEQ ID NO: 4133)
HUMMHGM_T15 (SEQ ID NO: 4134)
HUMMHGM_T17 (SEQ ID NO: 4135)

TABLE 4788-continued

Transcripts of interest
Transcript Name

HUMMHGM_T18 (SEQ ID NO: 4136)
HUMMHGM_T20 (SEQ ID NO: 4137)
HUMMHGM_T28 (SEQ ID NO: 4138)
HUMMHGM_T29 (SEQ ID NO: 4139)
HUMMHGM_T35 (SEQ ID NO: 4140)
HUMMHGM_T36 (SEQ ID NO: 4141)
HUMMHGM_T40 (SEQ ID NO: 4142)
HUMMHGM_T43 (SEQ ID NO: 4143)
HUMMHGM_T44 (SEQ ID NO: 4144)
HUMMHGM_T89 (SEQ ID NO: 4145)
HUMMHGM_T90 (SEQ ID NO: 4146)

TABLE 4789

Segments of interest
Segment Name

HUMMHGM_node_1 (SEQ ID NO: 5313)
HUMMHGM_node_7 (SEQ ID NO: 5314)
HUMMHGM_node_9 (SEQ ID NO: 5315)
HUMMHGM_node_13 (SEQ ID NO: 5316)
HUMMHGM_node_31 (SEQ ID NO: 5317)
HUMMHGM_node_36 (SEQ ID NO: 5318)
HUMMHGM_node_41 (SEQ ID NO: 5319)
HUMMHGM_node_43 (SEQ ID NO: 5320)
HUMMHGM_node_44 (SEQ ID NO: 5321)
HUMMHGM_node_50 (SEQ ID NO: 5322)
HUMMHGM_node_57 (SEQ ID NO: 5323)
HUMMHGM_node_60 (SEQ ID NO: 5324)
HUMMHGM_node_63 (SEQ ID NO: 5325)
HUMMHGM_node_69 (SEQ ID NO: 5326)
HUMMHGM_node_74 (SEQ ID NO: 5327)
HUMMHGM_node_113 (SEQ ID NO: 5328)
HUMMHGM_node_2 (SEQ ID NO: 5329)
HUMMHGM_node_3 (SEQ ID NO: 5330)
HUMMHGM_node_4 (SEQ ID NO: 5331)
HUMMHGM_node_5 (SEQ ID NO: 5332)
HUMMHGM_node_6 (SEQ ID NO: 5333)
HUMMHGM_node_8 (SEQ ID NO: 5334)
HUMMHGM_node_18 (SEQ ID NO: 5335)
HUMMHGM_node_20 (SEQ ID NO: 5336)
HUMMHGM_node_21 (SEQ ID NO: 5337)
HUMMHGM_node_22 (SEQ ID NO: 5338)
HUMMHGM_node_23 (SEQ ID NO: 5339)
HUMMHGM_node_24 (SEQ ID NO: 5340)
HUMMHGM_node_25 (SEQ ID NO: 5341)
HUMMHGM_node_26 (SEQ ID NO: 5342)
HUMMHGM_node_27 (SEQ ID NO: 5343)
HUMMHGM_node_28 (SEQ ID NO: 5344)
HUMMHGM_node_29 (SEQ ID NO: 5345)
HUMMHGM_node_30 (SEQ ID NO: 5346)
HUMMHGM_node_32 (SEQ ID NO: 5347)
HUMMHGM_node_33 (SEQ ID NO: 5348)
HUMMHGM_node_34 (SEQ ID NO: 5349)
HUMMHGM_node_35 (SEQ ID NO: 5350)
HUMMHGM_node_37 (SEQ ID NO: 5351)
HUMMHGM_node_38 (SEQ ID NO: 5352)
HUMMHGM_node_39 (SEQ ID NO: 5353)
HUMMHGM_node_40 (SEQ ID NO: 5354)
HUMMHGM_node_42 (SEQ ID NO: 5355)
HUMMHGM_node_45 (SEQ ID NO: 5356)
HUMMHGM_node_46 (SEQ ID NO: 5357)
HUMMHGM_node_47 (SEQ ID NO: 5358)
HUMMHGM_node_48 (SEQ ID NO: 5359)
HUMMHGM_node_49 (SEQ ID NO: 5360)
HUMMHGM_node_51 (SEQ ID NO: 5361)
HUMMHGM_node_52 (SEQ ID NO: 5362)
HUMMHGM_node_53 (SEQ ID NO: 5363)
HUMMHGM_node_54 (SEQ ID NO: 5364)
HUMMHGM_node_55 (SEQ ID NO: 5365)
HUMMHGM_node_56 (SEQ ID NO: 5366)
HUMMHGM_node_58 (SEQ ID NO: 5367)
HUMMHGM_node_61 (SEQ ID NO: 5368)

TABLE 4789-continued

Segments of interest

Segment Name

HUMMHGM_node_62 (SEQ ID NO: 5369)
HUMMHGM_node_64 (SEQ ID NO: 5370)
HUMMHGM_node_65 (SEQ ID NO: 5371)
HUMMHGM_node_66 (SEQ ID NO: 5372)
HUMMHGM_node_67 (SEQ ID NO: 5373)
HUMMHGM_node_68 (SEQ ID NO: 5374)
HUMMHGM_node_70 (SEQ ID NO: 5375)
HUMMHGM_node_71 (SEQ ID NO: 5376)
HUMMHGM_node_72 (SEQ ID NO: 5377)
HUMMHGM_node_73 (SEQ ID NO: 5378)
HUMMHGM_node_75 (SEQ ID NO: 5379)
HUMMHGM_node_76 (SEQ ID NO: 5380)
HUMMHGM_node_77 (SEQ ID NO: 5381)
HUMMHGM_node_78 (SEQ ID NO: 5382)
HUMMHGM_node_79 (SEQ ID NO: 5383)
HUMMHGM_node_80 (SEQ ID NO: 5384)
HUMMHGM_node_81 (SEQ ID NO: 5385)
HUMMHGM_node_82 (SEQ ID NO: 5386)
HUMMHGM_node_83 (SEQ ID NO: 5387)
HUMMHGM_node_84 (SEQ ID NO: 5388)
HUMMHGM_node_85 (SEQ ID NO: 5389)
HUMMHGM_node_86 (SEQ ID NO: 5390)
HUMMHGM_node_87 (SEQ ID NO: 5391)
HUMMHGM_node_88 (SEQ ID NO: 5392)
HUMMHGM_node_89 (SEQ ID NO: 5393)
HUMMHGM_node_90 (SEQ ID NO: 5394)
HUMMHGM_node_91 (SEQ ID NO: 5395)
HUMMHGM_node_92 (SEQ ID NO: 5396)
HUMMHGM_node_93 (SEQ ID NO: 5397)
HUMMHGM_node_94 (SEQ ID NO: 5398)
HUMMHGM_node_95 (SEQ ID NO: 5399)
HUMMHGM_node_96 (SEQ ID NO: 5400)
HUMMHGM_node_97 (SEQ ID NO: 5401)
HUMMHGM_node_98 (SEQ ID NO: 5402)
HUMMHGM_node_99 (SEQ ID NO: 5403)
HUMMHGM_node_100 (SEQ ID NO: 5404)
HUMMHGM_node_101 (SEQ ID NO: 5405)
HUMMHGM_node_102 (SEQ ID NO: 5406)
HUMMHGM_node_103 (SEQ ID NO: 5407)
HUMMHGM_node_104 (SEQ ID NO: 5408)
HUMMHGM_node_105 (SEQ ID NO: 5409)
HUMMHGM_node_106 (SEQ ID NO: 5410)
HUMMHGM_node_107 (SEQ ID NO: 5411)
HUMMHGM_node_108 (SEQ ID NO: 5412)
HUMMHGM_node_109 (SEQ ID NO: 5413)
HUMMHGM_node_110 (SEQ ID NO: 5414)
HUMMHGM_node_111 (SEQ ID NO: 5415)
HUMMHGM_node_112 (SEQ ID NO: 5416)

TABLE 4790

Proteins of interest

| Protein Name | Corresponding Transcript(s) |
|---|---|
| HUMMHGM_P7 | HUMMHGM_T8 (SEQ ID NO: 4131) |
| HUMMHGM_P9 | HUMMHGM_T12 (SEQ ID NO: 4132); HUMMHGM_T18 (SEQ ID NO: 4136) |
| HUMMHGM_P10 | HUMMHGM_T13 (SEQ ID NO: 4133) |
| HUMMHGM_P12 | HUMMHGM_T15 (SEQ ID NO: 4134); HUMMHGM_T29 (SEQ ID NO: 4139); HUMMHGM_T44 (SEQ ID NO: 4144) |
| HUMMHGM_P14 | HUMMHGM_T17 (SEQ ID NO: 4135); HUMMHGM_T35 (SEQ ID NO: 4140) |
| HUMMHGM_P16 | HUMMHGM_T20 (SEQ ID NO: 4137) |
| HUMMHGM_P21 | HUMMHGM_T28 (SEQ ID NO: 4138) |
| HUMMHGM_P24 | HUMMHGM_T36 (SEQ ID NO: 4141); HUMMHGM_T40 (SEQ ID NO: 4142) |
| HUMMHGM_P26 | HUMMHGM_T43 (SEQ ID NO: 4143) |
| HUMMHGM_P63 | HUMMHGM_T89 (SEQ ID NO: 4145) |
| HUMMHGM_P64 | HUMMHGM_T90 (SEQ ID NO: 4146) |

These sequences are variants of the known protein HLA class II histocompatibility antigen, gamma chain (SwissProt accession identifier HG2A_HUMAN; known also according to the synonyms HLA-DR antigens associated invariant chain; Ia antigen-associated invariant chain; Ii; p33; CD74 antigen), referred to herein as the previously known protein.

Protein HLA class II histocompatibility antigen, gamma chain is known or believed to have the following function(s): Plays a critical role in MHC class II antigen processing by stabilizing peptide-free class II alpha/beta heterodimers in a complex soon after their synthesis and directing transport of the complex from the endoplasmic reticulum to compartments where peptide loading of class II takes place. The sequence for protein HLA class II histocompatibility antigen, gamma chain is given at the end of the application, as "HLA class II histocompatibility antigen, gamma chain amino acid sequence". Known polymorphisms for this sequence are as shown in Table 4791.

TABLE 4791

Amino acid mutations for Known Protein

| SNP position(s) on amino acid sequence | Comment |
|---|---|
| 167 | R -> T |

Protein HLA class II histocompatibility antigen, gamma chain localization is believed to be Type II membrane protein (Potential).

The following GO Annotation(s) apply to the previously known protein. The following annotation(s) were found: immune response, which are annotation(s) related to Biological Process; chaperone, which are annotation(s) related to Molecular Function; and integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMMHGM can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 120 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 121 and Table 4792. This cluster is overexpressed (at least at a minimum level) in the following pathological conditions: brain malignant tumors and pancreas carcinoma.

TABLE 4792

Normal tissue distribution

| Name of Tissue | Number |
|---|---|
| adrenal | 1526 |
| bladder | 2134 |
| Bone | 4113 |
| Brain | 452 |
| Colon | 3199 |

TABLE 4792-continued

Normal tissue distribution

| Name of Tissue | Number |
|---|---|
| epithelial | 1601 |
| general | 1894 |
| head and neck | 1399 |
| kidney | 1108 |
| Liver | 502 |
| Lung | 2607 |
| Lymph nodes | 6866 |
| Breast | 980 |
| bone marrow | 721 |
| muscle | 244 |
| Ovary | 1282 |
| pancreas | 187 |
| prostate | 265 |
| Skin | 518 |
| stomach | 3408 |
| T cells | 5017 |
| Thyroid | 1044 |
| Uterus | 1332 |

TABLE 4793

P values and ratios for expression in cancerous tissue

| Name of Tissue | P1 | P2 | SP1 | R3 | SP2 | R4 |
|---|---|---|---|---|---|---|
| adrenal | 4.6e−01 | 5.0e−01 | 5.0e−02 | 0.6 | 4.1e−01 | 0.5 |
| bladder | 1 | 6.2e−01 | 8.3e−04 | 0.8 | 3.9e−01 | 0.5 |
| Bone | 3.5e−01 | 7.3e−01 | 1 | 0.1 | 1 | 0.1 |
| Brain | 5.5e−01 | 7.0e−01 | 2.4e−51 | 3.1 | 1.4e−23 | 1.8 |
| Colon | 6.5e−01 | 7.1e−01 | 1 | 0.3 | 1 | 0.2 |
| epithelial | 3.4e−01 | 8.3e−01 | 3.6e−27 | 1.4 | 1 | 0.7 |
| general | 8.3e−02 | 8.1e−01 | 1 | 1.3 | 1 | 0.8 |
| head and neck | 6.4e−01 | 6.9e−01 | 1 | 0.3 | 1 | 0.1 |
| kidney | 7.0e−01 | 7.5e−01 | 4.2e−08 | 1.6 | 2.8e−02 | 1.0 |
| Liver | 1.6e−01 | 6.4e−01 | 5.6e−07 | 1.4 | 2.8e−01 | 0.7 |
| Lung | 6.4e−01 | 7.4e−01 | 2.9e−11 | 1.4 | 1 | 0.6 |
| Lymph nodes | 6.1e−01 | 6.5e−01 | 4.9e−04 | 0.3 | 2.8e−04 | 0.8 |
| Breast | 5.2e−01 | 6.6e−01 | 5.2e−03 | 1.3 | 3.7e−01 | 0.9 |
| bone marrow | 5.0e−01 | 6.7e−01 | 9.8e−01 | 0.5 | 1 | 0.2 |
| muscle | 4.8e−01 | 4.4e−01 | 7.7e−03 | 2.1 | 3.1e−01 | 1.0 |
| Ovary | 4.1e−01 | 3.6e−01 | 3.7e−15 | 1.3 | 5.9e−08 | 1.0 |
| pancreas | 1.6e−01 | 2.2e−01 | 5.3e−84 | 13.9 | 6.4e−59 | 9.3 |
| prostate | 4.8e−01 | 6.7e−01 | 3.6e−05 | 2.5 | 2.0e−03 | 2.0 |
| Skin | 1.5e−01 | 5.6e−01 | 5.8e−03 | 1.2 | 1 | 0.3 |
| stomach | 4.9e−01 | 7.2e−01 | 1 | 0.1 | 1 | 0.1 |
| T cells | 1 | 5.0e−01 | 3.3e−01 | 0.3 | 1 | 0.1 |
| Thyroid | 5.1e−01 | 5.1e−01 | 1.8e−07 | 0.4 | 1.8e−07 | 0.4 |
| Uterus | 5.5e−01 | 7.4e−01 | 2.1e−04 | 1.1 | 9.0e−01 | 0.6 |

As noted above, cluster HUMMHGM features 104 segment(s), which were listed in Table 4789 above and for which the sequence(s) are given at the end of the application. These segment(s) are portions of nucleic acid sequence(s) which are described herein separately because they are of particular interest. A description of each segment according to the present invention is now provided.

Segment cluster HUMMHGM_node_1 (SEQ ID NO:5313) according to the present invention is supported by 82 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4794 below describes the starting and ending position of this segment on each transcript.

TABLE 4794

Segment location on transcripts

| Transcript name | Segment starting position | Segment ending position |
|---|---|---|
| HUMMHGM_T8 (SEQ ID NO: 4131) | 1 | 180 |
| HUMMHGM_T12 (SEQ ID NO: 4132) | 1 | 180 |
| HUMMHGM_T13 (SEQ ID NO: 4133) | 1 | 180 |
| HUMMHGM_T15 (SEQ ID NO: 4134) | 1 | 180 |
| HUMMHGM_T17 (SEQ ID NO: 4135) | 1 | 180 |
| HUMMHGM_T18 (SEQ ID NO: 4136) | 1 | 180 |
| HUMMHGM_T20 (SEQ ID NO: 4137) | 1 | 180 |
| HUMMHGM_T28 (SEQ ID NO: 4138) | 1 | 180 |
| HUMMHGM_T29 (SEQ ID NO: 4139) | 1 | 180 |
| HUMMHGM_T35 (SEQ ID NO: 4140) | 1 | 180 |
| HUMMHGM_T36 (SEQ ID NO: 4141) | 1 | 180 |
| HUMMHGM_T40 (SEQ ID NO: 4142) | 1 | 180 |
| HUMMHGM_T43 (SEQ ID NO: 4143) | 1 | 180 |
| HUMMHGM_T44 (SEQ ID NO: 4144) | 1 | 180 |
| HUMMHGM_T89 (SEQ ID NO: 4145) | 1 | 180 |
| HUMMHGM_T90 (SEQ ID NO: 4146) | 1 | 180 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_7 (SEQ ID NO:5314) according to the present invention is supported by 7 libraries. The number of libraries was determined as previously described. This segment can be found in the following transcript(s): HUMMHGM_T89 (SEQ ID NO:4145) and HUMMHGM_T90 (SEQ ID NO:4146). Table 4795 below describes the starting and ending position of this segment on each transcript.

TABLE 4795

Segment location on transcripts

| Transcript name | Segment starting position | Segment ending position |
|---|---|---|
| HUMMHGM_T89 (SEQ ID NO: 4145) | 306 | 654 |
| HUMMHGM_T90 (SEQ ID NO: 4146) | 306 | 654 |

This segment can be found in both coding and non-coding regions of transcript(s) as follows. The segment can be found in a non-coding region of transcript(s) that are related to the following protein(s): HUMMHGM_P63. This segment can also be found in the following protein(s): HUMMHGM_P64, since it is in the coding region for the corresponding transcript.

Segment cluster HUMMHGM_node_9 (SEQ ID NO:5315) according to the present invention is supported by 14 libraries. The number of libraries was determined as previously described. This segment can be found in the following transcript(s): HUMMHGM_T89 (SEQ ID NO:4145). Table 4796 below describes the starting and ending position of this segment on each transcript.

TABLE 4796

Segment location on transcripts

| Transcript name | Segment starting position | Segment ending position |
|---|---|---|
| HUMMHGM_T89 (SEQ ID NO: 4145) | 697 | 3169 |

This segment can be found in the following protein(s): HUMMHGM_P63.

Segment cluster HUMMHGM_node_13 (SEQ ID NO:5316) according to the present invention is supported by 2 libraries. The number of libraries was determined as previously described. This segment can be found in the following transcript(s): HUMMHGM_T90 (SEQ ID NO:4146). Table 4797 below describes the starting and ending position of this segment on each transcript.

TABLE 4797

Segment location on transcripts

| Transcript name | Segment starting position | Segment ending position |
|---|---|---|
| HUMMHGM_T90 (SEQ ID NO: 4146) | 655 | 795 |

This segment can be found in a non-coding region of transcript(s) that are related to the following protein(s): HUMMHGM_P64.

Segment cluster HUMMHGM_node_31 (SEQ ID NO:5317) according to the present invention is supported by 9 libraries. The number of libraries was determined as previously described. This segment can be found in the following transcript(s): HUMMHGM_T8 (SEQ ID NO:4131) and HUMMHGM_T13 (SEQ ID NO:4133). Table 4798 below describes the starting and ending position of this segment on each transcript.

TABLE 4798

Segment location on transcripts

| Transcript name | Segment starting position | Segment ending position |
|---|---|---|
| HUMMHGM_T8 (SEQ ID NO: 4131) | 479 | 669 |
| HUMMHGM_T13 (SEQ ID NO: 4133) | 479 | 669 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P10, since it is in the coding region for the corresponding transcript.

Segment cluster HUMMHGM_node_36 (SEQ ID NO:5318) according to the present invention is supported by 17 libraries. The number of libraries was determined as previously described. This segment can be found in the following transcript(s): HUMMHGM_T12 (SEQ ID NO:4132), HUMMHGM_T13 (SEQ ID NO:4133) and HUMMHGM_T18 (SEQ ID NO:4136). Table 4799 below describes the starting and ending position of this segment on each transcript.

TABLE 4799

Segment location on transcripts

| Transcript name | Segment starting position | Segment ending position |
|---|---|---|
| HUMMHGM_T12 (SEQ ID NO: 4132) | 559 | 1105 |
| HUMMHGM_T13 (SEQ ID NO: 4133) | 750 | 1296 |
| HUMMHGM_T18 (SEQ ID NO: 4136) | 559 | 1105 |

This segment can be found in both coding and non-coding regions of transcript(s) as follows. The segment can be found in a non-coding region of transcript(s) that are related to the following protein(s): HUMMHGM_P10. This segment can also be found in the following protein(s): HUMMHGM_P9, since it is in the coding region for the corresponding transcript.

Segment cluster HUMMHGM_node_41 (SEQ ID NO:5319) according to the present invention is supported by 13 libraries. The number of libraries was determined as previously described. This segment can be found in the following transcript(s): HUMMHGM_T15 (SEQ ID NO:4134), HUMMHGM_T18 (SEQ ID NO:4136), HUMMHGM_T29 (SEQ ID NO:4139) and HUMMHGM_T44 (SEQ ID NO:4144). Table 4800 below describes the starting and ending position of this segment on each transcript.

TABLE 4800

Segment location on transcripts

| Transcript name | Segment starting position | Segment ending position |
|---|---|---|
| HUMMHGM_T15 (SEQ ID NO: 4134) | 622 | 797 |
| HUMMHGM_T18 (SEQ ID NO: 4136) | 1181 | 1356 |
| HUMMHGM_T29 (SEQ ID NO: 4139) | 622 | 797 |
| HUMMHGM_T44 (SEQ ID NO: 4144) | 622 | 797 |

This segment can be found in both coding and non-coding regions of transcript(s) as follows. The segment can be found in a non-coding region of transcript(s) that are related to the following protein(s): HUMMHGM_P9. This segment can also be found in the following protein(s): HUMMHGM_P12, since it is in the coding region for the corresponding transcript.

Segment cluster HUMMHGM_node_43 (SEQ ID NO:5320) according to the present invention is supported by 22 libraries. The number of libraries was determined as previously described. This segment can be found in the following transcript(s): HUMMHGM_T15 (SEQ ID NO:4134), HUMMHGM_T18 (SEQ ID NO:4136), HUMMHGM_T29 (SEQ ID NO:4139) and HUMMHGM_T44 (SEQ ID NO:4144). Table 4801 below describes the starting and ending position of this segment on each transcript.

TABLE 4801

| Transcript name | Segment starting position | Segment ending position |
|---|---|---|
| HUMMHGM_T15 (SEQ ID NO: 4134) | 855 | 1208 |
| HUMMHGM_T18 (SEQ ID NO: 4136) | 1414 | 1767 |
| HUMMHGM_T29 (SEQ ID NO: 4139) | 855 | 1208 |
| HUMMHGM_T44 (SEQ ID NO: 4144) | 855 | 1208 |

This segment can be found in a non-coding region of transcript(s) that are related to the following protein(s): HUMMHGM_P12 and HUMMHGM_P9.

Segment cluster HUMMHGM_node_44 (SEQ ID NO:5321) according to the present invention is supported by 28 libraries. The number of libraries was determined as previously described. This segment can be found in the following transcript(s): HUMMHGM_T15 (SEQ ID NO:4134), HUMMHGM_T18 (SEQ ID NO:4136), HUMMHGM_T20 (SEQ ID NO:4137), HUMMHGM_T29 (SEQ ID NO:4139) and HUMMHGM_T44 (SEQ ID NO:4144). Table 4802 below describes the starting and ending position of this segment on each transcript.

TABLE 4802

| Transcript name | Segment starting position | Segment ending position |
|---|---|---|
| HUMMHGM_T15 (SEQ ID NO: 4134) | 1209 | 1699 |
| HUMMHGM_T18 (SEQ ID NO: 4136) | 1768 | 2258 |
| HUMMHGM_T20 (SEQ ID NO: 4137) | 622 | 1112 |
| HUMMHGM_T29 (SEQ ID NO: 4139) | 1209 | 1699 |
| HUMMHGM_T44 (SEQ ID NO: 4144) | 1209 | 1699 |

This segment can be found in both coding and non-coding regions of transcript(s) as follows. The segment can be found in a non-coding region of transcript(s) that are related to the following protein(s): HUMMHGM_P12 and HUMMHGM_P9. This segment can also be found in the following protein(s): HUMMHGM_P16, since it is in the coding region for the corresponding transcript.

Segment cluster HUMMHGM_node_50 (SEQ ID NO:5322) according to the present invention is supported by 5 libraries. The number of libraries was determined as previously described. This segment can be found in the following transcript(s): HUMMHGM_T36 (SEQ ID NO:4141), HUMMHGM_T40 (SEQ ID NO:4142) and HUMMHGM_T44 (SEQ ID NO:4144). Table 4803 below describes the starting and ending position of this segment on each transcript.

TABLE 4803

| Transcript name | Segment starting position | Segment ending position |
|---|---|---|
| HUMMHGM_T36 (SEQ ID NO: 4141) | 718 | 1034 |
| HUMMHGM_T40 (SEQ ID NO: 4142) | 718 | 1034 |
| HUMMHGM_T44 (SEQ ID NO: 4144) | 1796 | 2112 |

This segment can be found in both coding and non-coding regions of transcript(s) as follows. The segment can be found in a non-coding region of transcript(s) that are related to the following protein(s): HUMMHGM_P12. This segment can also be found in the following protein(s): HUMMHGM_P24, since it is in the coding region for the corresponding transcript.

Segment cluster HUMMHGM_node_57 (SEQ ID NO:5323) according to the present invention is supported by 13 libraries. The number of libraries was determined as previously described. This segment can be found in the following transcript(s): HUMMHGM_T40 (SEQ ID NO:4142). Table 4804 below describes the starting and ending position of this segment on each transcript.

TABLE 4804

| Transcript name | Segment starting position | Segment ending position |
|---|---|---|
| HUMMHGM_T40 (SEQ ID NO: 4142) | 1132 | 1587 |

This segment can be found in a non-coding region of transcript(s) that are related to the following protein(s): HUMMHGM_P24.

Segment cluster HUMMHGM_node_60 (SEQ ID NO:5324) according to the present invention is supported by 13 libraries. The number of libraries was determined as previously described. This segment can be found in the following transcript(s): HUMMHGM_T40 (SEQ ID NO:4142). Table 4805 below describes the starting and ending position of this segment on each transcript.

TABLE 4805

| Transcript name | Segment starting position | Segment ending position |
|---|---|---|
| HUMMHGM_T40 (SEQ ID NO: 4142) | 1610 | 2184 |

This segment can be found in a non-coding region of transcript(s) that are related to the following protein(s): HUMMHGM_P24.

Segment cluster HUMMHGM_node_63 (SEQ ID NO:5325) according to the present invention is supported by 20 libraries. The number of libraries was determined as previously described. This segment can be found in the following transcript(s): HUMMHGM_T40 (SEQ ID NO:4142). Table 4806 below describes the starting and ending position of this segment on each transcript.

TABLE 4806

| Transcript name | Segment starting position | Segment ending position |
|---|---|---|
| HUMMHGM_T40 (SEQ ID NO: 4142) | 2206 | 2489 |

This segment can be found in a non-coding region of transcript(s) that are related to the following protein(s): HUMMHGM_P24.

Segment cluster HUMMHGM_node_69 (SEQ ID NO:5326) according to the present invention is supported by 27 libraries. The number of libraries was determined as previously described. This segment can be found in the following transcript(s): HUMMHGM_T17 (SEQ ID NO:4135) and HUMMHGM_T35 (SEQ ID NO:4140). Table 4807 below describes the starting and ending position of this segment on each transcript.

TABLE 4807

Segment location on transcripts

| Transcript name | Segment starting position | Segment ending position |
|---|---|---|
| HUMMHGM_T17 (SEQ ID NO: 4135) | 998 | 1492 |
| HUMMHGM_T35 (SEQ ID NO: 4140) | 998 | 1492 |

This segment can be found in the following protein(s): HUMMHGM_P14.

Segment cluster HUMMHGM_node_74 (SEQ ID NO:5327) according to the present invention is supported by 30 libraries. The number of libraries was determined as previously described. This segment can be found in the following transcript(s): HUMMHGM_T28 (SEQ ID NO:4138), HUMMHGM_T35 (SEQ ID NO:4140) and HUMMHGM_T43 (SEQ ID NO:4143). Table 4808 below describes the starting and ending position of this segment on each transcript.

TABLE 4808

Segment location on transcripts

| Transcript name | Segment starting position | Segment ending position |
|---|---|---|
| HUMMHGM_T28 (SEQ ID NO: 4138) | 1133 | 1372 |
| HUMMHGM_T35 (SEQ ID NO: 4140) | 1628 | 1867 |
| HUMMHGM_T43 (SEQ ID NO: 4143) | 941 | 1180 |

This segment can be found in both coding and non-coding regions of transcript(s) as follows. The segment can be found in a non-coding region of transcript(s) that are related to the following protein(s): HUMMHGM_P14. This segment can also be found in the following protein(s): HUMMHGM_P21 and HUMMHGM_P26, since it is in the coding region for the corresponding transcript.

Segment cluster HUMMHGM_node_113 (SEQ ID NO:5328) according to the present invention is supported by 141 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4809 below describes the starting and ending position of this segment on each transcript.

TABLE 4809

Segment location on transcripts

| Transcript name | Segment starting position | Segment ending position |
|---|---|---|
| HUMMHGM_T8 (SEQ ID NO: 4131) | 1590 | 1673 |
| HUMMHGM_T12 (SEQ ID NO: 4132) | 1958 | 2041 |
| HUMMHGM_T13 (SEQ ID NO: 4133) | 2149 | 2232 |
| HUMMHGM_T15 (SEQ ID NO: 4134) | 2477 | 2560 |
| HUMMHGM_T17 (SEQ ID NO: 4135) | 2086 | 2169 |
| HUMMHGM_T18 (SEQ ID NO: 4136) | 3036 | 3119 |
| HUMMHGM_T20 (SEQ ID NO: 4137) | 1890 | 1973 |
| HUMMHGM_T28 (SEQ ID NO: 4138) | 1903 | 1986 |
| HUMMHGM_T29 (SEQ ID NO: 4139) | 2669 | 2752 |
| HUMMHGM_T35 (SEQ ID NO: 4140) | 2398 | 2481 |
| HUMMHGM_T36 (SEQ ID NO: 4141) | 1908 | 1991 |
| HUMMHGM_T40 (SEQ ID NO: 4142) | 3275 | 3358 |
| HUMMHGM_T43 (SEQ ID NO: 4143) | 1711 | 1794 |
| HUMMHGM_T44 (SEQ ID NO: 4144) | 2986 | 3069 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

According to an optional embodiment of the present invention, short segments related to the above cluster are also provided. These segments are up to about 120 bp in length, and so are included in a separate description.

Segment cluster HUMMHGM_node_2 (SEQ ID NO:5329) according to the present invention is supported by 234 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4810 below describes the starting and ending position of this segment on each transcript.

TABLE 4810

Segment location on transcripts

| Transcript name | Segment starting position | Segment ending position |
|---|---|---|
| HUMMHGM_T8 (SEQ ID NO: 4131) | 181 | 225 |
| HUMMHGM_T12 (SEQ ID NO: 4132) | 181 | 225 |
| HUMMHGM_T13 (SEQ ID NO: 4133) | 181 | 225 |
| HUMMHGM_T15 (SEQ ID NO: 4134) | 181 | 225 |
| HUMMHGM_T17 (SEQ ID NO: 4135) | 181 | 225 |
| HUMMHGM_T18 (SEQ ID NO: 4136) | 181 | 225 |
| HUMMHGM_T20 (SEQ ID NO: 4137) | 181 | 225 |
| HUMMHGM_T28 (SEQ ID NO: 4138) | 181 | 225 |
| HUMMHGM_T29 (SEQ ID NO: 4139) | 181 | 225 |
| HUMMHGM_T35 (SEQ ID NO: 4140) | 181 | 225 |
| HUMMHGM_T36 (SEQ ID NO: 4141) | 181 | 225 |
| HUMMHGM_T40 (SEQ ID NO: 4142) | 181 | 225 |
| HUMMHGM_T43 (SEQ ID NO: 4143) | 181 | 225 |
| HUMMHGM_T44 (SEQ ID NO: 4144) | 181 | 225 |

TABLE 4810-continued

Segment location on transcripts

| Transcript name | Segment starting position | Segment ending position |
|---|---|---|
| HUMMHGM_T89 (SEQ ID NO: 4145) | 181 | 225 |
| HUMMHGM_T90 (SEQ ID NO: 4146) | 181 | 225 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_3 (SEQ ID NO:5330) according to the present invention is supported by 250 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4811 below describes the starting and ending position of this segment on each transcript.

TABLE 4811

Segment location on transcripts

| Transcript name | Segment starting position | Segment ending position |
|---|---|---|
| HUMMHGM_T8 (SEQ ID NO: 4131) | 226 | 259 |
| HUMMHGM_T12 (SEQ ID NO: 4132) | 226 | 259 |
| HUMMHGM_T13 (SEQ ID NO: 4133) | 226 | 259 |
| HUMMHGM_T15 (SEQ ID NO: 4134) | 226 | 259 |
| HUMMHGM_T17 (SEQ ID NO: 4135) | 226 | 259 |
| HUMMHGM_T18 (SEQ ID NO: 4136) | 226 | 259 |
| HUMMHGM_T20 (SEQ ID NO: 4137) | 226 | 259 |
| HUMMHGM_T28 (SEQ ID NO: 4138) | 226 | 259 |
| HUMMHGM_T29 (SEQ ID NO: 4139) | 226 | 259 |
| HUMMHGM_T35 (SEQ ID NO: 4140) | 226 | 259 |
| HUMMHGM_T36 (SEQ ID NO: 4141) | 226 | 259 |
| HUMMHGM_T40 (SEQ ID NO: 4142) | 226 | 259 |
| HUMMHGM_T43 (SEQ ID NO: 4143) | 226 | 259 |
| HUMMHGM_T44 (SEQ ID NO: 4144) | 226 | 259 |
| HUMMHGM_T89 (SEQ ID NO: 4145) | 226 | 259 |
| HUMMHGM_T90 (SEQ ID NO: 4146) | 226 | 259 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_4 (SEQ ID NO:5331) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4812 below describes the starting and ending position of this segment on each transcript.

TABLE 4812

Segment location on transcripts

| Transcript name | Segment starting position | Segment ending position |
|---|---|---|
| HUMMHGM_T8 (SEQ ID NO: 4131) | 260 | 276 |
| HUMMHGM_T12 (SEQ ID NO: 4132) | 260 | 276 |
| HUMMHGM_T13 (SEQ ID NO: 4133) | 260 | 276 |
| HUMMHGM_T15 (SEQ ID NO: 4134) | 260 | 276 |
| HUMMHGM_T17 (SEQ ID NO: 4135) | 260 | 276 |
| HUMMHGM_T18 (SEQ ID NO: 4136) | 260 | 276 |
| HUMMHGM_T20 (SEQ ID NO: 4137) | 260 | 276 |
| HUMMHGM_T28 (SEQ ID NO: 4138) | 260 | 276 |
| HUMMHGM_T29 (SEQ ID NO: 4139) | 260 | 276 |
| HUMMHGM_T35 (SEQ ID NO: 4140) | 260 | 276 |
| HUMMHGM_T36 (SEQ ID NO: 4141) | 260 | 276 |
| HUMMHGM_T40 (SEQ ID NO: 4142) | 260 | 276 |
| HUMMHGM_T43 (SEQ ID NO: 4143) | 260 | 276 |
| HUMMHGM_T44 (SEQ ID NO: 4144) | 260 | 276 |
| HUMMHGM_T89 (SEQ ID NO: 4145) | 260 | 276 |
| HUMMHGM_T90 (SEQ ID NO: 4146) | 260 | 276 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_5 (SEQ ID NO:5332) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4813 below describes the starting and ending position of this segment on each transcript.

TABLE 4813

Segment location on transcripts

| Transcript name | Segment starting position | Segment ending position |
|---|---|---|
| HUMMHGM_T8 (SEQ ID NO: 4131) | 277 | 294 |
| HUMMHGM_T12 (SEQ ID NO: 4132) | 277 | 294 |
| HUMMHGM_T13 (SEQ ID NO: 4133) | 277 | 294 |
| HUMMHGM_T15 (SEQ ID NO: 4134) | 277 | 294 |
| HUMMHGM_T17 (SEQ ID NO: 4135) | 277 | 294 |
| HUMMHGM_T18 (SEQ ID NO: 4136) | 277 | 294 |
| HUMMHGM_T20 (SEQ ID NO: 4137) | 277 | 294 |
| HUMMHGM_T28 (SEQ ID NO: 4138) | 277 | 294 |
| HUMMHGM_T29 (SEQ ID NO: 4139) | 277 | 294 |
| HUMMHGM_T35 (SEQ ID NO: 4140) | 277 | 294 |
| HUMMHGM_T36 (SEQ ID NO: 4141) | 277 | 294 |
| HUMMHGM_T40 (SEQ ID NO: 4142) | 277 | 294 |
| HUMMHGM_T43 (SEQ ID NO: 4143) | 277 | 294 |
| HUMMHGM_T44 (SEQ ID NO: 4144) | 277 | 294 |
| HUMMHGM_T89 (SEQ ID NO: 4145) | 277 | 294 |
| HUMMHGM_T90 (SEQ ID NO: 4146) | 277 | 294 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_6 (SEQ ID NO:5333) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143), HUMMHGM_T44 (SEQ ID NO:4144), HUMMHGM_T89 (SEQ ID NO:4145) and HUMMHGM_T90 (SEQ ID NO:4146). Table 4814 below describes the starting and ending position of this segment on each transcript.

TABLE 4814

Segment location on transcripts

| Transcript name | Segment starting position | Segment ending position |
|---|---|---|
| HUMMHGM_T8 (SEQ ID NO: 4131) | 295 | 305 |
| HUMMHGM_T12 (SEQ ID NO: 4132) | 295 | 305 |
| HUMMHGM_T13 (SEQ ID NO: 4133) | 295 | 305 |
| HUMMHGM_T15 (SEQ ID NO: 4134) | 295 | 305 |
| HUMMHGM_T17 (SEQ ID NO: 4135) | 295 | 305 |
| HUMMHGM_T18 (SEQ ID NO: 4136) | 295 | 305 |
| HUMMHGM_T20 (SEQ ID NO: 4137) | 295 | 305 |
| HUMMHGM_T28 (SEQ ID NO: 4138) | 295 | 305 |
| HUMMHGM_T29 (SEQ ID NO: 4139) | 295 | 305 |
| HUMMHGM_T35 (SEQ ID NO: 4140) | 295 | 305 |
| HUMMHGM_T36 (SEQ ID NO: 4141) | 295 | 305 |
| HUMMHGM_T40 (SEQ ID NO: 4142) | 295 | 305 |
| HUMMHGM_T43 (SEQ ID NO: 4143) | 295 | 305 |
| HUMMHGM_T44 (SEQ ID NO: 4144) | 295 | 305 |
| HUMMHGM_T89 (SEQ ID NO: 4145) | 295 | 305 |
| HUMMHGM_T90 (SEQ ID NO: 4146) | 295 | 305 |

This segment can be found in both coding and non-coding regions of transcript(s) as follows. The segment can be found in a non-coding region of transcript(s) that are related to the following protein(s): HUMMHGM_P7 and HUMMHGM_P63. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24, HUMMHGM_P26 and HUMMHGM_P64, since it is in the coding region for the corresponding transcript.

Segment cluster HUMMHGM_node_8 (SEQ ID NO:5334) according to the present invention is supported by 5 libraries. The number of libraries was determined as previously described. This segment can be found in the following transcript(s): HUMMHGM_T89 (SEQ ID NO:4145). Table 4815 below describes the starting and ending position of this segment on each transcript.

TABLE 4815

Segment location on transcripts

| Transcript name | Segment starting position | Segment ending position |
|---|---|---|
| HUMMHGM_T89 (SEQ ID NO: 4145) | 655 | 696 |

This segment can be found in a non-coding region of transcript(s) that are related to the following protein(s): HUMMHGM_P63.

Segment cluster HUMMHGM_node_18 (SEQ ID NO:5335) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4816 below describes the starting and ending position of this segment on each transcript.

TABLE 4816

Segment location on transcripts

| Transcript name | Segment starting position | Segment ending position |
|---|---|---|
| HUMMHGM_T8 (SEQ ID NO: 4131) | 306 | 324 |
| HUMMHGM_T12 (SEQ ID NO: 4132) | 306 | 324 |
| HUMMHGM_T13 (SEQ ID NO: 4133) | 306 | 324 |
| HUMMHGM_T15 (SEQ ID NO: 4134) | 306 | 324 |
| HUMMHGM_T17 (SEQ ID NO: 4135) | 306 | 324 |

TABLE 4816-continued

Segment location on transcripts

| Transcript name | Segment starting position | Segment ending position |
|---|---|---|
| HUMMHGM_T18 (SEQ ID NO: 4136) | 306 | 324 |
| HUMMHGM_T20 (SEQ ID NO: 4137) | 306 | 324 |
| HUMMHGM_T28 (SEQ ID NO: 4138) | 306 | 324 |
| HUMMHGM_T29 (SEQ ID NO: 4139) | 306 | 324 |
| HUMMHGM_T35 (SEQ ID NO: 4140) | 306 | 324 |
| HUMMHGM_T36 (SEQ ID NO: 4141) | 306 | 324 |
| HUMMHGM_T40 (SEQ ID NO: 4142) | 306 | 324 |
| HUMMHGM_T43 (SEQ ID NO: 4143) | 306 | 324 |
| HUMMHGM_T44 (SEQ ID NO: 4144) | 306 | 324 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_20 (SEQ ID NO:5336) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4817 below describes the starting and ending position of this segment on each transcript.

TABLE 4817

Segment location on transcripts

| Transcript name | Segment starting position | Segment ending position |
|---|---|---|
| HUMMHGM_T8 (SEQ ID NO: 4131) | 325 | 335 |
| HUMMHGM_T12 (SEQ ID NO: 4132) | 325 | 335 |
| HUMMHGM_T13 (SEQ ID NO: 4133) | 325 | 335 |
| HUMMHGM_T15 (SEQ ID NO: 4134) | 325 | 335 |
| HUMMHGM_T17 (SEQ ID NO: 4135) | 325 | 335 |
| HUMMHGM_T18 (SEQ ID NO: 4136) | 325 | 335 |
| HUMMHGM_T20 (SEQ ID NO: 4137) | 325 | 335 |
| HUMMHGM_T28 (SEQ ID NO: 4138) | 325 | 335 |
| HUMMHGM_T29 (SEQ ID NO: 4139) | 325 | 335 |
| HUMMHGM_T35 (SEQ ID NO: 4140) | 325 | 335 |
| HUMMHGM_T36 (SEQ ID NO: 4141) | 325 | 335 |
| HUMMHGM_T40 (SEQ ID NO: 4142) | 325 | 335 |
| HUMMHGM_T43 (SEQ ID NO: 4143) | 325 | 335 |
| HUMMHGM_T44 (SEQ ID NO: 4144) | 325 | 335 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_21 (SEQ ID NO:5337) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4818 below describes the starting and ending position of this segment on each transcript.

TABLE 4818

Segment location on transcripts

| Transcript name | Segment starting position | Segment ending position |
|---|---|---|
| HUMMHGM_T8 (SEQ ID NO: 4131) | 336 | 354 |
| HUMMHGM_T12 (SEQ ID NO: 4132) | 336 | 354 |
| HUMMHGM_T13 (SEQ ID NO: 4133) | 336 | 354 |
| HUMMHGM_T15 (SEQ ID NO: 4134) | 336 | 354 |
| HUMMHGM_T17 (SEQ ID NO: 4135) | 336 | 354 |
| HUMMHGM_T18 (SEQ ID NO: 4136) | 336 | 354 |
| HUMMHGM_T20 (SEQ ID NO: 4137) | 336 | 354 |
| HUMMHGM_T28 (SEQ ID NO: 4138) | 336 | 354 |
| HUMMHGM_T29 (SEQ ID NO: 4139) | 336 | 354 |
| HUMMHGM_T35 (SEQ ID NO: 4140) | 336 | 354 |
| HUMMHGM_T36 (SEQ ID NO: 4141) | 336 | 354 |
| HUMMHGM_T40 (SEQ ID NO: 4142) | 336 | 354 |
| HUMMHGM_T43 (SEQ ID NO: 4143) | 336 | 354 |
| HUMMHGM_T44 (SEQ ID NO: 4144) | 336 | 354 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_22 (SEQ ID NO:5338) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4819 below describes the starting and ending position of this segment on each transcript.

TABLE 4819

Segment location on transcripts

| Transcript name | Segment starting position | Segment ending position |
|---|---|---|
| HUMMHGM_T8 (SEQ ID NO: 4131) | 355 | 364 |
| HUMMHGM_T12 (SEQ ID NO: 4132) | 355 | 364 |
| HUMMHGM_T13 (SEQ ID NO: 4133) | 355 | 364 |
| HUMMHGM_T15 (SEQ ID NO: 4134) | 355 | 364 |
| HUMMHGM_T17 (SEQ ID NO: 4135) | 355 | 364 |
| HUMMHGM_T18 (SEQ ID NO: 4136) | 355 | 364 |
| HUMMHGM_T20 (SEQ ID NO: 4137) | 355 | 364 |
| HUMMHGM_T28 (SEQ ID NO: 4138) | 355 | 364 |
| HUMMHGM_T29 (SEQ ID NO: 4139) | 355 | 364 |
| HUMMHGM_T35 (SEQ ID NO: 4140) | 355 | 364 |
| HUMMHGM_T36 (SEQ ID NO: 4141) | 355 | 364 |
| HUMMHGM_T40 (SEQ ID NO: 4142) | 355 | 364 |
| HUMMHGM_T43 (SEQ ID NO: 4143) | 355 | 364 |
| HUMMHGM_T44 (SEQ ID NO: 4144) | 355 | 364 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_23 (SEQ ID NO:5339) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4820 below describes the starting and ending position of this segment on each transcript.

TABLE 4820

Segment location on transcripts

| Transcript name | Segment starting position | Segment ending position |
|---|---|---|
| HUMMHGM_T8 (SEQ ID NO: 4131) | 365 | 372 |
| HUMMHGM_T12 (SEQ ID NO: 4132) | 365 | 372 |
| HUMMHGM_T13 (SEQ ID NO: 4133) | 365 | 372 |
| HUMMHGM_T15 (SEQ ID NO: 4134) | 365 | 372 |
| HUMMHGM_T17 (SEQ ID NO: 4135) | 365 | 372 |
| HUMMHGM_T18 (SEQ ID NO: 4136) | 365 | 372 |
| HUMMHGM_T20 (SEQ ID NO: 4137) | 365 | 372 |
| HUMMHGM_T28 (SEQ ID NO: 4138) | 365 | 372 |
| HUMMHGM_T29 (SEQ ID NO: 4139) | 365 | 372 |
| HUMMHGM_T35 (SEQ ID NO: 4140) | 365 | 372 |
| HUMMHGM_T36 (SEQ ID NO: 4141) | 365 | 372 |
| HUMMHGM_T40 (SEQ ID NO: 4142) | 365 | 372 |
| HUMMHGM_T43 (SEQ ID NO: 4143) | 365 | 372 |
| HUMMHGM_T44 (SEQ ID NO: 4144) | 365 | 372 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_24 (SEQ ID NO:5340) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4821 below describes the starting and ending position of this segment on each transcript.

TABLE 4821

Segment location on transcripts

| Transcript name | Segment starting position | Segment ending position |
|---|---|---|
| HUMMHGM_T8 (SEQ ID NO: 4131) | 373 | 383 |
| HUMMHGM_T12 (SEQ ID NO: 4132) | 373 | 383 |
| HUMMHGM_T13 (SEQ ID NO: 4133) | 373 | 383 |
| HUMMHGM_T15 (SEQ ID NO: 4134) | 373 | 383 |
| HUMMHGM_T17 (SEQ ID NO: 4135) | 373 | 383 |
| HUMMHGM_T18 (SEQ ID NO: 4136) | 373 | 383 |
| HUMMHGM_T20 (SEQ ID NO: 4137) | 373 | 383 |
| HUMMHGM_T28 (SEQ ID NO: 4138) | 373 | 383 |
| HUMMHGM_T29 (SEQ ID NO: 4139) | 373 | 383 |
| HUMMHGM_T35 (SEQ ID NO: 4140) | 373 | 383 |
| HUMMHGM_T36 (SEQ ID NO: 4141) | 373 | 383 |
| HUMMHGM_T40 (SEQ ID NO: 4142) | 373 | 383 |
| HUMMHGM_T43 (SEQ ID NO: 4143) | 373 | 383 |
| HUMMHGM_T44 (SEQ ID NO: 4144) | 373 | 383 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_25 (SEQ ID NO:5341) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4822 below describes the starting and ending position of this segment on each transcript.

TABLE 4822

Segment location on transcripts

| Transcript name | Segment starting position | Segment ending position |
|---|---|---|
| HUMMHGM_T8 (SEQ ID NO: 4131) | 384 | 390 |
| HUMMHGM_T12 (SEQ ID NO: 4132) | 384 | 390 |
| HUMMHGM_T13 (SEQ ID NO: 4133) | 384 | 390 |
| HUMMHGM_T15 (SEQ ID NO: 4134) | 384 | 390 |
| HUMMHGM_T17 (SEQ ID NO: 4135) | 384 | 390 |
| HUMMHGM_T18 (SEQ ID NO: 4136) | 384 | 390 |
| HUMMHGM_T20 (SEQ ID NO: 4137) | 384 | 390 |
| HUMMHGM_T28 (SEQ ID NO: 4138) | 384 | 390 |
| HUMMHGM_T29 (SEQ ID NO: 4139) | 384 | 390 |
| HUMMHGM_T35 (SEQ ID NO: 4140) | 384 | 390 |
| HUMMHGM_T36 (SEQ ID NO: 4141) | 384 | 390 |
| HUMMHGM_T40 (SEQ ID NO: 4142) | 384 | 390 |
| HUMMHGM_T43 (SEQ ID NO: 4143) | 384 | 390 |
| HUMMHGM_T44 (SEQ ID NO: 4144) | 384 | 390 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_26 (SEQ ID NO:5342) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4823 below describes the starting and ending position of this segment on each transcript.

TABLE 4823

Segment location on transcripts

| Transcript name | Segment starting position | Segment ending position |
|---|---|---|
| HUMMHGM_T8 (SEQ ID NO: 4131) | 391 | 399 |
| HUMMHGM_T12 (SEQ ID NO: 4132) | 391 | 399 |
| HUMMHGM_T13 (SEQ ID NO: 4133) | 391 | 399 |
| HUMMHGM_T15 (SEQ ID NO: 4134) | 391 | 399 |
| HUMMHGM_T17 (SEQ ID NO: 4135) | 391 | 399 |
| HUMMHGM_T18 (SEQ ID NO: 4136) | 391 | 399 |
| HUMMHGM_T20 (SEQ ID NO: 4137) | 391 | 399 |
| HUMMHGM_T28 (SEQ ID NO: 4138) | 391 | 399 |
| HUMMHGM_T29 (SEQ ID NO: 4139) | 391 | 399 |
| HUMMHGM_T35 (SEQ ID NO: 4140) | 391 | 399 |
| HUMMHGM_T36 (SEQ ID NO: 4141) | 391 | 399 |
| HUMMHGM_T40 (SEQ ID NO: 4142) | 391 | 399 |
| HUMMHGM_T43 (SEQ ID NO: 4143) | 391 | 399 |
| HUMMHGM_T44 (SEQ ID NO: 4144) | 391 | 399 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_27 (SEQ ID NO:5343) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4824 below describes the starting and ending position of this segment on each transcript.

TABLE 4824

Segment location on transcripts

| Transcript name | Segment starting position | Segment ending position |
|---|---|---|
| HUMMHGM_T8 (SEQ ID NO: 4131) | 400 | 411 |
| HUMMHGM_T12 (SEQ ID NO: 4132) | 400 | 411 |
| HUMMHGM_T13 (SEQ ID NO: 4133) | 400 | 411 |
| HUMMHGM_T15 (SEQ ID NO: 4134) | 400 | 411 |
| HUMMHGM_T17 (SEQ ID NO: 4135) | 400 | 411 |
| HUMMHGM_T18 (SEQ ID NO: 4136) | 400 | 411 |
| HUMMHGM_T20 (SEQ ID NO: 4137) | 400 | 411 |
| HUMMHGM_T28 (SEQ ID NO: 4138) | 400 | 411 |
| HUMMHGM_T29 (SEQ ID NO: 4139) | 400 | 411 |
| HUMMHGM_T35 (SEQ ID NO: 4140) | 400 | 411 |
| HUMMHGM_T36 (SEQ ID NO: 4141) | 400 | 411 |
| HUMMHGM_T40 (SEQ ID NO: 4142) | 400 | 411 |
| HUMMHGM_T43 (SEQ ID NO: 4143) | 400 | 411 |
| HUMMHGM_T44 (SEQ ID NO: 4144) | 400 | 411 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_28 (SEQ ID NO:5344) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4825 below describes the starting and ending position of this segment on each transcript.

TABLE 4825

Segment location on transcripts

| Transcript name | Segment starting position | Segment ending position |
| --- | --- | --- |
| HUMMHGM_T8 (SEQ ID NO: 4131) | 412 | 431 |
| HUMMHGM_T12 (SEQ ID NO: 4132) | 412 | 431 |
| HUMMHGM_T13 (SEQ ID NO: 4133) | 412 | 431 |
| HUMMHGM_T15 (SEQ ID NO: 4134) | 412 | 431 |
| HUMMHGM_T17 (SEQ ID NO: 4135) | 412 | 431 |
| HUMMHGM_T18 (SEQ ID NO: 4136) | 412 | 431 |
| HUMMHGM_T20 (SEQ ID NO: 4137) | 412 | 431 |
| HUMMHGM_T28 (SEQ ID NO: 4138) | 412 | 431 |
| HUMMHGM_T29 (SEQ ID NO: 4139) | 412 | 431 |
| HUMMHGM_T35 (SEQ ID NO: 4140) | 412 | 431 |
| HUMMHGM_T36 (SEQ ID NO: 4141) | 412 | 431 |
| HUMMHGM_T40 (SEQ ID NO: 4142) | 412 | 431 |
| HUMMHGM_T43 (SEQ ID NO: 4143) | 412 | 431 |
| HUMMHGM_T44 (SEQ ID NO: 4144) | 412 | 431 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_29 (SEQ ID NO:5345) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4826 below describes the starting and ending position of this segment on each transcript.

TABLE 4826

Segment location on transcripts

| Transcript name | Segment starting position | Segment ending position |
| --- | --- | --- |
| HUMMHGM_T8 (SEQ ID NO: 4131) | 432 | 456 |
| HUMMHGM_T12 (SEQ ID NO: 4132) | 432 | 456 |
| HUMMHGM_T13 (SEQ ID NO: 4133) | 432 | 456 |
| HUMMHGM_T15 (SEQ ID NO: 4134) | 432 | 456 |
| HUMMHGM_T17 (SEQ ID NO: 4135) | 432 | 456 |
| HUMMHGM_T18 (SEQ ID NO: 4136) | 432 | 456 |
| HUMMHGM_T20 (SEQ ID NO: 4137) | 432 | 456 |
| HUMMHGM_T28 (SEQ ID NO: 4138) | 432 | 456 |
| HUMMHGM_T29 (SEQ ID NO: 4139) | 432 | 456 |
| HUMMHGM_T35 (SEQ ID NO: 4140) | 432 | 456 |
| HUMMHGM_T36 (SEQ ID NO: 4141) | 432 | 456 |
| HUMMHGM_T40 (SEQ ID NO: 4142) | 432 | 456 |
| HUMMHGM_T43 (SEQ ID NO: 4143) | 432 | 456 |
| HUMMHGM_T44 (SEQ ID NO: 4144) | 432 | 456 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_30 (SEQ ID NO:5346) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ. ID NO:4141), HUMMHGM_T40 (SEQ ID NO:4142), HUMMHGM_T43 (SEQ ID NO:4143) and HUMMHGM_T44 (SEQ ID NO:4144). Table 4827 below describes the starting and ending position of this segment on each transcript.

TABLE 4827

Segment location on transcripts

| Transcript name | Segment starting position | Segment ending position |
| --- | --- | --- |
| HUMMHGM_T8 (SEQ ID NO: 4131) | 457 | 478 |
| HUMMHGM_T12 (SEQ ID NO: 4132) | 457 | 478 |
| HUMMHGM_T13 (SEQ ID NO: 4133) | 457 | 478 |
| HUMMHGM_T15 (SEQ ID NO: 4134) | 457 | 478 |
| HUMMHGM_T17 (SEQ ID NO: 4135) | 457 | 478 |
| HUMMHGM_T18 (SEQ ID NO: 4136) | 457 | 478 |
| HUMMHGM_T20 (SEQ ID NO: 4137) | 457 | 478 |
| HUMMHGM_T28 (SEQ ID NO: 4138) | 457 | 478 |
| HUMMHGM_T29 (SEQ ID NO: 4139) | 457 | 478 |
| HUMMHGM_T35 (SEQ ID NO: 4140) | 457 | 478 |
| HUMMHGM_T36 (SEQ ID NO: 4141) | 457 | 478 |
| HUMMHGM_T40 (SEQ ID NO: 4142) | 457 | 478 |
| HUMMHGM_T43 (SEQ ID NO: 4143) | 457 | 478 |
| HUMMHGM_T44 (SEQ ID NO: 4144) | 457 | 478 |

This segment can be found in both coding and non-coding regions of transcript(s) as follows. The segment can be found in a non-coding region of transcript(s) that are related to the following protein(s): HUMMHGM_P7. This segment can also be found in the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_32 (SEQ ID NO:5347) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4828 below describes the starting and ending position of this segment on each transcript.

TABLE 4828

Segment location on transcripts

| Transcript name | Segment starting position | Segment ending position |
|---|---|---|
| HUMMHGM_T8 (SEQ ID NO: 4131) | 670 | 689 |
| HUMMHGM_T12 (SEQ ID NO: 4132) | 479 | 498 |
| HUMMHGM_T13 (SEQ ID NO: 4133) | 670 | 689 |
| HUMMHGM_T15 (SEQ ID NO: 4134) | 479 | 498 |
| HUMMHGM_T17 (SEQ ID NO: 4135) | 479 | 498 |
| HUMMHGM_T18 (SEQ ID NO: 4136) | 479 | 498 |
| HUMMHGM_T20 (SEQ ID NO: 4137) | 479 | 498 |
| HUMMHGM_T28 (SEQ ID NO: 4138) | 479 | 498 |
| HUMMHGM_T29 (SEQ ID NO: 4139) | 479 | 498 |
| HUMMHGM_T35 (SEQ ID NO: 4140) | 479 | 498 |
| HUMMHGM_T36 (SEQ ID NO: 4141) | 479 | 498 |
| HUMMHGM_T40 (SEQ ID NO: 4142) | 479 | 498 |
| HUMMHGM_T43 (SEQ ID NO: 4143) | 479 | 498 |
| HUMMHGM_T44 (SEQ ID NO: 4144) | 479 | 498 |

This segment can be found in both coding and non-coding regions of transcript(s) as follows. The segment can be found in a non-coding region of transcript(s) that are related to the following protein(s): HUMMHGM_P10. This segment can also be found in the following protein(s): HUMMHGM_P7, HUMMHGM_P9, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_33 (SEQ ID NO:5348) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4829 below describes the starting and ending position of this segment on each transcript.

TABLE 4829

Segment location on transcripts

| Transcript name | Segment starting position | Segment ending position |
|---|---|---|
| HUMMHGM_T8 (SEQ ID NO: 4131) | 690 | 710 |
| HUMMHGM_T12 (SEQ ID NO: 4132) | 499 | 519 |
| HUMMHGM_T13 (SEQ ID NO: 4133) | 690 | 710 |
| HUMMHGM_T15 (SEQ ID NO: 4134) | 499 | 519 |
| HUMMHGM_T17 (SEQ ID NO: 4135) | 499 | 519 |
| HUMMHGM_T18 (SEQ ID NO: 4136) | 499 | 519 |
| HUMMHGM_T20 (SEQ ID NO: 4137) | 499 | 519 |
| HUMMHGM_T28 (SEQ ID NO: 4138) | 499 | 519 |
| HUMMHGM_T29 (SEQ ID NO: 4139) | 499 | 519 |
| HUMMHGM_T35 (SEQ ID NO: 4140) | 499 | 519 |
| HUMMHGM_T36 (SEQ ID NO: 4141) | 499 | 519 |
| HUMMHGM_T40 (SEQ ID NO: 4142) | 499 | 519 |
| HUMMHGM_T43 (SEQ ID NO: 4143) | 499 | 519 |
| HUMMHGM_T44 (SEQ ID NO: 4144) | 499 | 519 |

This segment can be found in both coding and non-coding regions of transcript(s) as follows. The segment can be found in a non-coding region of transcript(s) that are related to the following protein(s): HUMMHGM_P10. This segment can also be found in the following protein(s): HUMMHGM_P7, HUMMHGM_P9, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_34 (SEQ ID NO:5349) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4830 below describes the starting and ending position of this segment on each transcript.

TABLE 4830

Segment location on transcripts

| Transcript name | Segment starting position | Segment ending position |
|---|---|---|
| HUMMHGM_T8 (SEQ ID NO: 4131) | 711 | 731 |
| HUMMHGM_T12 (SEQ ID NO: 4132) | 520 | 540 |
| HUMMHGM_T13 (SEQ ID NO: 4133) | 711 | 731 |
| HUMMHGM_T15 (SEQ ID NO: 4134) | 520 | 540 |
| HUMMHGM_T17 (SEQ ID NO: 4135) | 520 | 540 |
| HUMMHGM_T18 (SEQ ID NO: 4136) | 520 | 540 |
| HUMMHGM_T20 (SEQ ID NO: 4137) | 520 | 540 |
| HUMMHGM_T28 (SEQ ID NO: 4138) | 520 | 540 |
| HUMMHGM_T29 (SEQ ID NO: 4139) | 520 | 540 |
| HUMMHGM_T35 (SEQ ID NO: 4140) | 520 | 540 |
| HUMMHGM_T36 (SEQ ID NO: 4141) | 520 | 540 |
| HUMMHGM_T40 (SEQ ID NO: 4142) | 520 | 540 |
| HUMMHGM_T43 (SEQ ID NO: 4143) | 520 | 540 |
| HUMMHGM_T44 (SEQ ID NO: 4144) | 520 | 540 |

This segment can be found in both coding and non-coding regions of transcript(s) as follows. The segment can be found in a non-coding region of transcript(s) that are related to the following protein(s): HUMMHGM_P10. This segment can also be found in the following protein(s): HUMMHGM_P7, HUMMHGM_P9, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_35 (SEQ ID NO:5350) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4831 below describes the starting and ending position of this segment on each transcript.

TABLE 4831

Segment location on transcripts

| Transcript name | Segment starting position | Segment ending position |
|---|---|---|
| HUMMHGM_T8 (SEQ ID NO: 4131) | 732 | 749 |
| HUMMHGM_T12 (SEQ ID NO: 4132) | 541 | 558 |
| HUMMHGM_T13 (SEQ ID NO: 4133) | 732 | 749 |
| HUMMHGM_T15 (SEQ ID NO: 4134) | 541 | 558 |
| HUMMHGM_T17 (SEQ ID NO: 4135) | 541 | 558 |
| HUMMHGM_T18 (SEQ ID NO: 4136) | 541 | 558 |
| HUMMHGM_T20 (SEQ ID NO: 4137) | 541 | 558 |
| HUMMHGM_T28 (SEQ ID NO: 4138) | 541 | 558 |
| HUMMHGM_T29 (SEQ ID NO: 4139) | 541 | 558 |
| HUMMHGM_T35 (SEQ ID NO: 4140) | 541 | 558 |
| HUMMHGM_T36 (SEQ ID NO: 4141) | 541 | 558 |
| HUMMHGM_T40 (SEQ ID NO: 4142) | 541 | 558 |
| HUMMHGM_T43 (SEQ ID NO: 4143) | 541 | 558 |
| HUMMHGM_T44 (SEQ ID NO: 4144) | 541 | 558 |

This segment can be found in both coding and non-coding regions of transcript(s) as follows. The segment can be found in a non-coding region of transcript(s) that are related to the following protein(s): HUMMHGM_P10. This segment can also be found in the following protein(s): HUMMHGM_P7, HUMMHGM_P9, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_37 (SEQ ID NO:5351) according to the present invention can be found in the following transcript(s): HUMMHGM_T12 (SEQ ID NO:4132), HUMMHGM_T13 (SEQ ID NO:4133) and HUMMHGM_T18 (SEQ ID NO:4136). Table 4832 below describes the starting and ending position of this segment on each transcript.

TABLE 4832

Segment location on transcripts

| Transcript name | Segment starting position | Segment ending position |
|---|---|---|
| HUMMHGM_T12 (SEQ ID NO: 4132) | 1106 | 1117 |
| HUMMHGM_T13 (SEQ ID NO: 4133) | 1297 | 1308 |
| HUMMHGM_T18 (SEQ ID NO: 4136) | 1106 | 1117 |

This segment can be found in a non-coding region of transcript(s) that are related to the following protein(s): HUMMHGM_P9 and HUMMHGM_P10.

Segment cluster HUMMHGM_node_38 (SEQ ID NO:5352) according to the present invention is supported by 331 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4833 below describes the starting and ending position of this segment on each transcript.

TABLE 4833

Segment location on transcripts

| Transcript name | Segment starting position | Segment ending position |
|---|---|---|
| HUMMHGM_T8 (SEQ ID NO: 4131) | 750 | 779 |
| HUMMHGM_T12 (SEQ ID NO: 4132) | 1118 | 1147 |
| HUMMHGM_T13 (SEQ ID NO: 4133) | 1309 | 1338 |
| HUMMHGM_T15 (SEQ ID NO: 4134) | 559 | 588 |
| HUMMHGM_T17 (SEQ ID NO: 4135) | 559 | 588 |
| HUMMHGM_T18 (SEQ ID NO: 4136) | 1118 | 1147 |
| HUMMHGM_T20 (SEQ ID NO: 4137) | 559 | 588 |
| HUMMHGM_T28 (SEQ ID NO: 4138) | 559 | 588 |
| HUMMHGM_T29 (SEQ ID NO: 4139) | 559 | 588 |
| HUMMHGM_T35 (SEQ ID NO: 4140) | 559 | 588 |
| HUMMHGM_T36 (SEQ ID NO: 4141) | 559 | 588 |
| HUMMHGM_T40 (SEQ ID NO: 4142) | 559 | 588 |
| HUMMHGM_T43 (SEQ ID NO: 4143) | 559 | 588 |
| HUMMHGM_T44 (SEQ ID NO: 4144) | 559 | 588 |

This segment can be found in both coding and non-coding regions of transcript(s) as follows. The segment can be found in a non-coding region of transcript(s) that are related to the following protein(s): HUMMHGM_P9 and HUMMHGM_P10. This segment can also be found in the following protein(s): HUMMHGM_P7, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_39 (SEQ ID NO:5353) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4834 below describes the starting and ending position of this segment on each transcript.

TABLE 4834

Segment location on transcripts

| Transcript name | Segment starting position | Segment ending position |
|---|---|---|
| HUMMHGM_T8 (SEQ ID NO: 4131) | 780 | 788 |
| HUMMHGM_T12 (SEQ ID NO: 4132) | 1148 | 1156 |
| HUMMHGM_T13 (SEQ ID NO: 4133) | 1339 | 1347 |
| HUMMHGM_T15 (SEQ ID NO: 4134) | 589 | 597 |
| HUMMHGM_T17 (SEQ ID NO: 4135) | 589 | 597 |
| HUMMHGM_T18 (SEQ ID NO: 4136) | 1148 | 1156 |
| HUMMHGM_T20 (SEQ ID NO: 4137) | 589 | 597 |
| HUMMHGM_T28 (SEQ ID NO: 4138) | 589 | 597 |
| HUMMHGM_T29 (SEQ ID NO: 4139) | 589 | 597 |
| HUMMHGM_T35 (SEQ ID NO: 4140) | 589 | 597 |
| HUMMHGM_T36 (SEQ ID NO: 4141) | 589 | 597 |
| HUMMHGM_T40 (SEQ ID NO: 4142) | 589 | 597 |
| HUMMHGM_T43 (SEQ ID NO: 4143) | 589 | 597 |
| HUMMHGM_T44 (SEQ ID NO: 4144) | 589 | 597 |

This segment can be found in both coding and non-coding regions of transcript(s) as follows. The segment can be found in a non-coding region of transcript(s) that are related to the following protein(s): HUMMHGM_P9 and HUMMHGM_P10. This segment can also be found in the following protein(s): HUMMHGM_P7, HUMMHGM_P12, HUMMHGM_P14 HUMMHGM_P16, HUMMHGM_P21, HUMMHGM_P24 and HUMMHGM_P26, since it is in the coding region for the corresponding transcript.

Segment cluster HUMMHGM_node_40 (SEQ ID NO:5354) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4835 below describes the starting and ending position of this segment on each transcript.

TABLE 4835

Segment location on transcripts

| Transcript name | Segment starting position | Segment ending position |
|---|---|---|
| HUMMHGM_T8 (SEQ ID NO: 4131) | 789 | 812 |
| HUMMHGM_T12 (SEQ ID NO: 4132) | 1157 | 1180 |
| HUMMHGM_T13 (SEQ ID NO: 4133) | 1348 | 1371 |
| HUMMHGM_T15 (SEQ ID NO: 4134) | 598 | 621 |
| HUMMHGM_T17 (SEQ ID NO: 4135) | 598 | 621 |
| HUMMHGM_T18 (SEQ ID NO: 4136) | 1157 | 1180 |
| HUMMHGM_T20 (SEQ ID NO: 4137) | 598 | 621 |
| HUMMHGM_T28 (SEQ ID NO: 4138) | 598 | 621 |
| HUMMHGM_T29 (SEQ ID NO: 4139) | 598 | 621 |
| HUMMHGM_T35 (SEQ ID NO: 4140) | 598 | 621 |
| HUMMHGM_T36 (SEQ ID NO: 4141) | 598 | 621 |
| HUMMHGM_T40 (SEQ ID NO: 4142) | 598 | 621 |
| HUMMHGM_T43 (SEQ ID NO: 4143) | 598 | 621 |
| HUMMHGM_T44 (SEQ ID NO: 4144) | 598 | 621 |

This segment can be found in both coding and non-coding regions of transcript(s) as follows. The segment can be found in a non-coding region of transcript(s) that are related to the following protein(s): HUMMHGM_P9 and HUMMHGM_P10. This segment can also be found in the following protein(s): HUMMHGM_P7, HUMMHGM_P12, HUMMHGM_P14, HUMMHGM_P16, HUMMHGM_P21, HUMMHGM_P24 and HUMMHGM_P26, since it is in the coding region for the corresponding transcript.

Segment cluster HUMMHGM_node_42 (SEQ ID NO:5355) according to the present invention is supported by 5 libraries. The number of libraries was determined as previously described. This segment can be found in the following transcript(s): HUMMHGM_T15 (SEQ ID NO:4134), HUMMHGM_T18 (SEQ ID NO:4136), HUMMHGM_T29 (SEQ ID NO:4139) and HUMMHGM_T44 (SEQ ID NO:4144). Table 4836 below describes the starting and ending position of this segment on each transcript.

TABLE 4836

Segment location on transcripts

| Transcript name | Segment starting position | Segment ending position |
|---|---|---|
| HUMMHGM_T15 (SEQ ID NO: 4134) | 798 | 854 |
| HUMMHGM_T18 (SEQ ID NO: 4136) | 1357 | 1413 |
| HUMMHGM_T29 (SEQ ID NO: 4139) | 798 | 854 |
| HUMMHGM_T44 (SEQ ID NO: 4144) | 798 | 854 |

This segment can be found in a non-coding region of transcript(s) that are related to the following protein(s): HUMMHGM_P12 and HUMMHGM_P9.

Segment cluster HUMMHGM_node_45 (SEQ ID NO:5356) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4837 below describes the starting and ending position of this segment on each transcript.

TABLE 4837

Segment location on transcripts

| Transcript name | Segment starting position | Segment ending position |
|---|---|---|
| HUMMHGM_T8 (SEQ ID NO: 4131) | 813 | 836 |
| HUMMHGM_T12 (SEQ ID NO: 4132) | 1181 | 1204 |
| HUMMHGM_T13 (SEQ ID NO: 4133) | 1372 | 1395 |
| HUMMHGM_T15 (SEQ ID NO: 4134) | 1700 | 1723 |
| HUMMHGM_T17 (SEQ ID NO: 4135) | 622 | 645 |
| HUMMHGM_T18 (SEQ ID NO: 4136) | 2259 | 2282 |
| HUMMHGM_T20 (SEQ ID NO: 4137) | 1113 | 1136 |
| HUMMHGM_T28 (SEQ ID NO: 4138) | 622 | 645 |
| HUMMHGM_T29 (SEQ ID NO: 4139) | 1700 | 1723 |
| HUMMHGM_T35 (SEQ ID NO: 4140) | 622 | 645 |
| HUMMHGM_T36 (SEQ ID NO: 4141) | 622 | 645 |
| HUMMHGM_T40 (SEQ ID NO: 4142) | 622 | 645 |
| HUMMHGM_T43 (SEQ ID NO: 4143) | 622 | 645 |
| HUMMHGM_T44 (SEQ ID NO: 4144) | 1700 | 1723 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12 and HUMMHGM_P16. This segment can also be found in the following protein(s): HUMMHGM_P7, HUMMHGM_P14, HUMMHGM_P21, HUMMHGM_P24 and HUMMHGM_P26, since it is in the coding region for the corresponding transcript.

Segment cluster HUMMHGM_node_46 (SEQ ID NO:5357) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMH- HGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4838 below describes the starting and ending position of this segment on each transcript.

TABLE 4838

Segment location on transcripts

| Transcript name | Segment starting position | Segment ending position |
|---|---|---|
| HUMMHGM_T8 (SEQ ID NO: 4131) | 837 | 843 |
| HUMMHGM_T12 (SEQ ID NO: 4132) | 1205 | 1211 |
| HUMMHGM_T13 (SEQ ID NO: 4133) | 1396 | 1402 |
| HUMMHGM_T15 (SEQ ID NO: 4134) | 1724 | 1730 |
| HUMMHGM_T17 (SEQ ID NO: 4135) | 646 | 652 |
| HUMMHGM_T18 (SEQ ID NO: 4136) | 2283 | 2289 |
| HUMMHGM_T20 (SEQ ID NO: 4137) | 1137 | 1143 |
| HUMMHGM_T28 (SEQ ID NO: 4138) | 646 | 652 |
| HUMMHGM_T29 (SEQ ID NO: 4139) | 1724 | 1730 |
| HUMMHGM_T35 (SEQ ID NO: 4140) | 646 | 652 |
| HUMMHGM_T36 (SEQ ID NO: 4141) | 646 | 652 |
| HUMMHGM_T40 (SEQ ID NO: 4142) | 646 | 652 |
| HUMMHGM_T43 (SEQ ID NO: 4143) | 646 | 652 |
| HUMMHGM_T44 (SEQ ID NO: 4144) | 1724 | 1730 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12 and HUMMHGM_P16. This segment can also be found in the following protein(s): HUMMHGM_P7, HUMMHGM_P14, HUMMHGM_P21, HUMMHGM_P24 and HUMMHGM_P26, since it is in the coding region for the corresponding transcript.

Segment cluster HUMMHGM_node_47 (SEQ ID NO:5358) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4839 below describes the starting and ending position of this segment on each transcript.

TABLE 4839

Segment location on transcripts

| Transcript name | Segment starting position | Segment ending position |
|---|---|---|
| HUMMHGM_T8 (SEQ ID NO: 4131) | 844 | 866 |
| HUMMHGM_T12 (SEQ ID NO: 4132) | 1212 | 1234 |
| HUMMHGM_T13 (SEQ ID NO: 4133) | 1403 | 1425 |
| HUMMHGM_T15 (SEQ ID NO: 4134) | 1731 | 1753 |
| HUMMHGM_T17 (SEQ ID NO: 4135) | 653 | 675 |
| HUMMHGM_T18 (SEQ ID NO: 4136) | 2290 | 2312 |
| HUMMHGM_T20 (SEQ ID NO: 4137) | 1144 | 1166 |
| HUMMHGM_T28 (SEQ ID NO: 4138) | 653 | 675 |
| HUMMHGM_T29 (SEQ ID NO: 4139) | 1731 | 1753 |
| HUMMHGM_T35 (SEQ ID NO: 4140) | 653 | 675 |
| HUMMHGM_T36 (SEQ ID NO: 4141) | 653 | 675 |
| HUMMHGM_T40 (SEQ ID NO: 4142) | 653 | 675 |
| HUMMHGM_T43 (SEQ ID NO: 4143) | 653 | 675 |
| HUMMHGM_T44 (SEQ ID NO: 4144) | 1731 | 1753 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12 and HUMMHGM_P16. This segment can also be found in the following protein(s): HUMMHGM_P7, HUMMHGM_P14, HUMMHGM_P21, HUMMHGM_P24 and HUMMHGM_P26, since it is in the coding region for the corresponding transcript.

Segment cluster HUMMHGM_node_48 (SEQ ID NO:5359) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4840 below describes the starting and ending position of this segment on each transcript.

TABLE 4840

Segment location on transcripts

| Transcript name | Segment starting position | Segment ending position |
|---|---|---|
| HUMMHGM_T8 (SEQ ID NO: 4131) | 867 | 886 |
| HUMMHGM_T12 (SEQ ID NO: 4132) | 1235 | 1254 |
| HUMMHGM_T13 (SEQ ID NO: 4133) | 1426 | 1445 |
| HUMMHGM_T15 (SEQ ID NO: 4134) | 1754 | 1773 |
| HUMMHGM_T17 (SEQ ID NO: 4135) | 676 | 695 |
| HUMMHGM_T18 (SEQ ID NO: 4136) | 2313 | 2332 |
| HUMMHGM_T20 (SEQ ID NO: 4137) | 1167 | 1186 |
| HUMMHGM_T28 (SEQ ID NO: 4138) | 676 | 695 |
| HUMMHGM_T29 (SEQ ID NO: 4139) | 1754 | 1773 |
| HUMMHGM_T35 (SEQ ID NO: 4140) | 676 | 695 |
| HUMMHGM_T36 (SEQ ID NO: 4141) | 676 | 695 |
| HUMMHGM_T40 (SEQ ID NO: 4142) | 676 | 695 |
| HUMMHGM_T43 (SEQ ID NO: 4143) | 676 | 695 |
| HUMMHGM_T44 (SEQ ID NO: 4144) | 1754 | 1773 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12 and HUMMHGM_P16. This segment can also be found in the following protein(s): HUMMHGM_P7, HUMMHGM_P14, HUMMHGM_P21, HUMMHGM_P24 and HUMMHGM_P26, since it is in the coding region for the corresponding transcript.

Segment cluster HUMMHGM_node_49 (SEQ ID NO:5360) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4841 below describes the starting and ending position of this segment on each transcript.

TABLE 4841

Segment location on transcripts

| Transcript name | Segment starting position | Segment ending position |
|---|---|---|
| HUMMHGM_T8 (SEQ ID NO: 4131) | 887 | 908 |
| HUMMHGM_T12 (SEQ ID NO: 4132) | 1255 | 1276 |
| HUMMHGM_T13 (SEQ ID NO: 4133) | 1446 | 1467 |
| HUMMHGM_T15 (SEQ ID NO: 4134) | 1774 | 1795 |
| HUMMHGM_T17 (SEQ ID NO: 4135) | 696 | 717 |
| HUMMHGM_T18 (SEQ ID NO: 4136) | 2333 | 2354 |
| HUMMHGM_T20 (SEQ ID NO: 4137) | 1187 | 1208 |
| HUMMHGM_T28 (SEQ ID NO: 4138) | 696 | 717 |
| HUMMHGM_T29 (SEQ ID NO: 4139) | 1774 | 1795 |
| HUMMHGM_T35 (SEQ ID NO: 4140) | 696 | 717 |
| HUMMHGM_T36 (SEQ ID NO: 4141) | 696 | 717 |
| HUMMHGM_T40 (SEQ ID NO: 4142) | 696 | 717 |
| HUMMHGM_T43 (SEQ ID NO: 4143) | 696 | 717 |
| HUMMHGM_T44 (SEQ ID NO: 4144) | 1774 | 1795 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12 and HUMMHGM_P16. This segment can also be found in the following protein(s): HUMMHGM_P7, HUMMHGM_P14, HUMMHGM_P21, HUMMHGM_P24 and HUMMHGM_P26, since it is in the coding region for the corresponding transcript.

Segment cluster HUMMHGM_node_51 (SEQ ID NO:5361) according to the present invention is supported by 366 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4842 below describes the starting and ending position of this segment on each transcript.

TABLE 4842

Segment location on transcripts

| Transcript name | Segment starting position | Segment ending position |
|---|---|---|
| HUMMHGM_T8 (SEQ ID NO: 4131) | 909 | 938 |
| HUMMHGM_T12 (SEQ ID NO: 4132) | 1277 | 1306 |
| HUMMHGM_T13 (SEQ ID NO: 4133) | 1468 | 1497 |
| HUMMHGM_T15 (SEQ ID NO: 4134) | 1796 | 1825 |
| HUMMHGM_T17 (SEQ ID NO: 4135) | 718 | 747 |
| HUMMHGM_T18 (SEQ ID NO: 4136) | 2355 | 2384 |
| HUMMHGM_T20 (SEQ ID NO: 4137) | 1209 | 1238 |
| HUMMHGM_T28 (SEQ ID NO: 4138) | 718 | 747 |
| HUMMHGM_T29 (SEQ ID NO: 4139) | 1796 | 1825 |
| HUMMHGM_T35 (SEQ ID NO: 4140) | 718 | 747 |
| HUMMHGM_T36 (SEQ ID NO: 4141) | 1035 | 1064 |
| HUMMHGM_T40 (SEQ ID NO: 4142) | 1035 | 1064 |
| HUMMHGM_T43 (SEQ ID NO: 4143) | 718 | 747 |
| HUMMHGM_T44 (SEQ ID NO: 4144) | 2113 | 2142 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P16 and HUMMHGM_P24. This segment can also be found in the following protein(s): HUMMHGM_P7, HUMMHGM_P14, HUMMHGM_P21 and HUMMHGM_P26, since it is in the coding region for the corresponding transcript.

Segment cluster HUMMHGM_node_52 (SEQ ID NO:5362) according to the present invention is supported by 370 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4843 below describes the starting and ending position of this segment on each transcript.

TABLE 4843

Segment location on transcripts

| Transcript name | Segment starting position | Segment ending position |
|---|---|---|
| HUMMHGM_T8 (SEQ ID NO: 4131) | 939 | 970 |
| HUMMHGM_T12 (SEQ ID NO: 4132) | 1307 | 1338 |
| HUMMHGM_T13 (SEQ ID NO: 4133) | 1498 | 1529 |
| HUMMHGM_T15 (SEQ ID NO: 4134) | 1826 | 1857 |
| HUMMHGM_T17 (SEQ ID NO: 4135) | 748 | 779 |
| HUMMHGM_T18 (SEQ ID NO: 4136) | 2385 | 2416 |
| HUMMHGM_T20 (SEQ ID NO: 4137) | 1239 | 1270 |
| HUMMHGM_T28 (SEQ ID NO: 4138) | 748 | 779 |
| HUMMHGM_T29 (SEQ ID NO: 4139) | 1826 | 1857 |
| HUMMHGM_T35 (SEQ ID NO: 4140) | 748 | 779 |
| HUMMHGM_T36 (SEQ ID NO: 4141) | 1065 | 1096 |
| HUMMHGM_T40 (SEQ ID NO: 4142) | 1065 | 1096 |
| HUMMHGM_T43 (SEQ ID NO: 4143) | 748 | 779 |
| HUMMHGM_T44 (SEQ ID NO: 4144) | 2143 | 2174 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P16 and HUMMHGM_P24. This segment can also be found in the following protein(s): HUMMHGM_P7, HUMMHGM_P14, HUMMHGM_P21 and HUMMHGM_P26, since it is in the coding region for the corresponding transcript.

Segment cluster HUMMHGM_node_53 (SEQ ID NO:5363) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4844 below describes the starting and ending position of this segment on each transcript.

TABLE 4844

Segment location on transcripts

| Transcript name | Segment starting position | Segment ending position |
|---|---|---|
| HUMMHGM_T8 (SEQ ID NO: 4131) | 971 | 984 |
| HUMMHGM_T12 (SEQ ID NO: 4132) | 1339 | 1352 |
| HUMMHGM_T13 (SEQ ID NO: 4133) | 1530 | 1543 |
| HUMMHGM_T15 (SEQ ID NO: 4134) | 1858 | 1871 |
| HUMMHGM_T17 (SEQ ID NO: 4135) | 780 | 793 |
| HUMMHGM_T18 (SEQ ID NO: 4136) | 2417 | 2430 |
| HUMMHGM_T20 (SEQ ID NO: 4137) | 1271 | 1284 |
| HUMMHGM_T28 (SEQ ID NO: 4138) | 780 | 793 |
| HUMMHGM_T29 (SEQ ID NO: 4139) | 1858 | 1871 |
| HUMMHGM_T35 (SEQ ID NO: 4140) | 780 | 793 |
| HUMMHGM_T36 (SEQ ID NO: 4141) | 1097 | 1110 |
| HUMMHGM_T40 (SEQ ID NO: 4142) | 1097 | 1110 |
| HUMMHGM_T43 (SEQ ID NO: 4143) | 780 | 793 |
| HUMMHGM_T44 (SEQ ID NO: 4144) | 2175 | 2188 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P16 and HUMMHGM_P24. This segment can also be found in the following protein(s): HUMMHGM_P7, HUMMHGM_P14, HUMMHGM_P21 and HUMMHGM_P26, since it is in the coding region for the corresponding transcript.

Segment cluster HUMMHGM_node_54 (SEQ ID NO:5364) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4845 below describes the starting and ending position of this segment on each transcript.

TABLE 4845

Segment location on transcripts

| Transcript name | Segment starting position | Segment ending position |
|---|---|---|
| HUMMHGM_T8 (SEQ ID NO: 4131) | 985 | 990 |
| HUMMHGM_T12 (SEQ ID NO: 4132) | 1353 | 1358 |
| HUMMHGM_T13 (SEQ ID NO: 4133) | 1544 | 1549 |
| HUMMHGM_T15 (SEQ ID NO: 4134) | 1872 | 1877 |
| HUMMHGM_T17 (SEQ ID NO: 4135) | 794 | 799 |
| HUMMHGM_T18 (SEQ ID NO: 4136) | 2431 | 2436 |
| HUMMHGM_T20 (SEQ ID NO: 4137) | 1285 | 1290 |
| HUMMHGM_T28 (SEQ ID NO: 4138) | 794 | 799 |
| HUMMHGM_T29 (SEQ ID NO: 4139) | 1872 | 1877 |
| HUMMHGM_T35 (SEQ ID NO: 4140) | 794 | 799 |
| HUMMHGM_T36 (SEQ ID NO: 4141) | 1111 | 1116 |
| HUMMHGM_T40 (SEQ ID NO: 4142) | 1111 | 1116 |
| HUMMHGM_T43 (SEQ ID NO: 4143) | 794 | 799 |
| HUMMHGM_T44 (SEQ ID NO: 4144) | 2189 | 2194 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P16 and HUMMHGM_P24. This segment can also be found in the following protein(s): HUMMHGM_P7, HUMMHGM_P14, HUMMHGM_P21 and HUMMHGM_P26, since it is in the coding region for the corresponding transcript.

Segment cluster HUMMHGM_node_55 (SEQ ID NO:5365) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4846 below describes the starting and ending position of this segment on each transcript.

TABLE 4846

Segment location on transcripts

| Transcript name | Segment starting position | Segment ending position |
|---|---|---|
| HUMMHGM_T8 (SEQ ID NO: 4131) | 991 | 996 |
| HUMMHGM_T12 (SEQ ID NO: 4132) | 1359 | 1364 |
| HUMMHGM_T13 (SEQ ID NO: 4133) | 1550 | 1555 |
| HUMMHGM_T15 (SEQ ID NO: 4134) | 1878 | 1883 |
| HUMMHGM_T17 (SEQ ID NO: 4135) | 800 | 805 |
| HUMMHGM_T18 (SEQ ID NO: 4136) | 2437 | 2442 |
| HUMMHGM_T20 (SEQ ID NO: 4137) | 1291 | 1296 |
| HUMMHGM_T28 (SEQ ID NO: 4138) | 800 | 805 |
| HUMMHGM_T29 (SEQ ID NO: 4139) | 1878 | 1883 |
| HUMMHGM_T35 (SEQ ID NO: 4140) | 800 | 805 |
| HUMMHGM_T36 (SEQ ID NO: 4141) | 1117 | 1122 |
| HUMMHGM_T40 (SEQ ID NO: 4142) | 1117 | 1122 |
| HUMMHGM_T43 (SEQ ID NO: 4143) | 800 | 805 |
| HUMMHGM_T44 (SEQ ID NO: 4144) | 2195 | 2200 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P16 and HUMMHGM_P24. This segment can also be found in the following protein(s): HUMMHGM_P7, HUMMHGM_P14, HUMMHGM_P21 and HUMMHGM_P26, since it is in the coding region for the corresponding transcript.

Segment cluster HUMMHGM_node_56 (SEQ ID NO:5366) according to the present invention can be found in the following transcript(s): HUMMHGM_T40 (SEQ ID NO:4142). Table 4847 below describes the starting and ending position of this segment on each transcript.

TABLE 4847

| | Segment location on transcripts | |
|---|---|---|
| Transcript name | Segment starting position | Segment ending position |
| HUMMHGM_T40 (SEQ ID NO: 4142) | 1123 | 1131 |

This segment can be found in a non-coding region of transcript(s) that are related to the following protein(s): HUMMHGM_P24.

Segment cluster HUMMHGM_node_58 (SEQ ID NO:5367) according to the present invention can be found in the following transcript(s): HUMMHGM_T40 (SEQ ID NO:4142). Table 4848 below describes the starting and ending position of this segment on each transcript.

TABLE 4848

| | Segment location on transcripts | |
|---|---|---|
| Transcript name | Segment starting position | Segment ending position |
| HUMMHGM_T40 (SEQ ID NO: 4142) | 1588 | 1609 |

This segment can be found in a non-coding region of transcript(s) that are related to the following protein(s): HUMMHGM_P24.

Segment cluster HUMMHGM_node_61 (SEQ ID NO:5368) according to the present invention can be found in the following transcript(s): HUMMHGM_T40 (SEQ ID NO:4142). Table 4849 below describes the starting and ending position of this segment on each transcript.

TABLE 4849

| | Segment location on transcripts | |
|---|---|---|
| Transcript name | Segment starting position | Segment ending position |
| HUMMHGM_T40 (SEQ ID NO: 4142) | 2185 | 2196 |

This segment can be found in a non-coding region of transcript(s) that are related to the following protein(s): HUMMHGM_P24.

Segment cluster HUMMHGM_node_62 (SEQ ID NO:5369) according to the present invention can be found in the following transcript(s): HUMMHGM_T40 (SEQ ID NO:4142). Table 4850 below describes the starting and ending position of this segment on each transcript.

TABLE 4850

| | Segment location on transcripts | |
|---|---|---|
| Transcript name | Segment starting position | Segment ending position |
| HUMMHGM_T40 (SEQ ID NO: 4142) | 2197 | 2205 |

This segment can be found in a non-coding region of transcript(s) that are related to the following protein(s): HUMMHGM_P24.

Segment cluster HUMMHGM_node_64 (SEQ ID NO:5370) according to the present invention is supported by 162 libraries. The number of libraries was determined as previously described. This segment can be found in the following transcript(s): HUMMHGM_T17 (SEQ ID NO:4135), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142) and HUMMHGM_T44 (SEQ ID NO:4144). Table 4851 below describes the starting and ending position of this segment on each transcript.

TABLE 4851

| | Segment location on transcripts | |
|---|---|---|
| Transcript name | Segment starting position | Segment ending position |
| HUMMHGM_T17 (SEQ ID NO: 4135) | 806 | 833 |
| HUMMHGM_T28 (SEQ ID NO: 4138) | 806 | 833 |
| HUMMHGM_T29 (SEQ ID NO: 4139) | 1884 | 1911 |
| HUMMHGM_T35 (SEQ ID NO: 4140) | 806 | 833 |
| HUMMHGM_T36 (SEQ ID NO: 4141) | 1123 | 1150 |
| HUMMHGM_T40 (SEQ ID NO: 4142) | 2490 | 2517 |
| HUMMHGM_T44 (SEQ ID NO: 4144) | 2201 | 2228 |

This segment can be found in both coding and non-coding regions of transcript(s) as follows. The segment can be found in a non-coding region of transcript(s) that are related to the following protein(s): HUMMHGM_P12 and HUMMHGM_P24. This segment can also be found in the following protein(s): HUMMHGM_P14 and HUMMHGM_P21, since it is in the coding region for the corresponding transcript.

Segment cluster HUMMHGM_node_65 (SEQ ID NO:5371) according to the present invention is supported by 168 libraries. The number of libraries was determined as previously described. This segment can be found in the following transcript(s): HUMMHGM_T17 (SEQ ID NO:4135), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142) and HUMMHGM_T44 (SEQ ID NO:4144). Table 4852 below describes the starting and ending position of this segment on each transcript.

TABLE 4852

| | Segment location on transcripts | |
|---|---|---|
| Transcript name | Segment starting position | Segment ending position |
| HUMMHGM_T17 (SEQ ID NO: 4135) | 834 | 866 |
| HUMMHGM_T28 (SEQ ID NO: 4138) | 834 | 866 |

TABLE 4852-continued

Segment location on transcripts

| Transcript name | Segment starting position | Segment ending position |
|---|---|---|
| HUMMHGM_T29 (SEQ ID NO: 4139) | 1912 | 1944 |
| HUMMHGM_T35 (SEQ ID NO: 4140) | 834 | 866 |
| HUMMHGM_T36 (SEQ ID NO: 4141) | 1151 | 1183 |
| HUMMHGM_T40 (SEQ ID NO: 4142) | 2518 | 2550 |
| HUMMHGM_T44 (SEQ ID NO: 4144) | 2229 | 2261 |

This segment can be found in both coding and non-coding regions of transcript(s) as follows. The segment can be found in a non-coding region of transcript(s) that are related to the following protein(s): HUMMHGM_P12 and HUMMHGM_P24. This segment can also be found in the following protein(s): HUMMHGM_P14 and HUMMHGM_P21, since it is in the coding region for the corresponding transcript.

Segment cluster HUMMHGM_node_66 (SEQ ID NO:5372) according to the present invention is supported by 169 libraries. The number of libraries was determined as previously described. This segment can be found in the following transcript(s): HUMMHGM_T17 (SEQ ID NO:4135), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142) and HUMMHGM_T44 (SEQ ID NO:4144). Table 4853 below describes the starting and ending position of this segment on each transcript.

TABLE 4853

Segment location on transcripts

| Transcript name | Segment starting position | Segment ending position |
|---|---|---|
| HUMMHGM_T17 (SEQ ID NO: 4135) | 867 | 959 |
| HUMMHGM_T28 (SEQ ID NO: 4138) | 867 | 959 |
| HUMMHGM_T29 (SEQ ID NO: 4139) | 1945 | 2037 |
| HUMMHGM_T35 (SEQ ID NO: 4140) | 867 | 959 |
| HUMMHGM_T36 (SEQ ID NO: 4141) | 1184 | 1276 |
| HUMMHGM_T40 (SEQ ID NO: 4142) | 2551 | 2643 |
| HUMMHGM_T44 (SEQ ID NO: 4144) | 2262 | 2354 |

This segment can be found in both coding and non-coding regions of transcript(s) as follows. The segment can be found in a non-coding region of transcript(s) that are related to the following protein(s): HUMMHGM_P12 and HUMMHGM_P24. This segment can also be found in the following protein(s): HUMMHGM_P14 and HUMMHGM_P21, since it is in the coding region for the corresponding transcript.

Segment cluster HUMMHGM_node_67 (SEQ ID NO:5373) according to the present invention can be found in the following transcript(s): HUMMHGM_T17 (SEQ ID NO:4135), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142) and HUMMHGM_T44 (SEQ ID NO:4144). Table 4854 below describes the starting and ending position of this segment on each transcript.

TABLE 4854

Segment location on transcripts

| Transcript name | Segment starting position | Segment ending position |
|---|---|---|
| HUMMHGM_T17 (SEQ ID NO: 4135) | 960 | 964 |
| HUMMHGM_T28 (SEQ ID NO: 4138) | 960 | 964 |
| HUMMHGM_T29 (SEQ ID NO: 4139) | 2038 | 2042 |
| HUMMHGM_T35 (SEQ ID NO: 4140) | 960 | 964 |
| HUMMHGM_T36 (SEQ ID NO: 4141) | 1277 | 1281 |
| HUMMHGM_T40 (SEQ ID NO: 4142) | 2644 | 2648 |
| HUMMHGM_T44 (SEQ ID NO: 4144) | 2355 | 2359 |

This segment can be found in both coding and non-coding regions of transcript(s) as follows. The segment can be found in a non-coding region of transcript(s) that are related to the following protein(s): HUMMHGM_P12 and HUMMHGM_P24. This segment can also be found in the following protein(s): HUMMHGM_P14 and HUMMHGM_P21, since it is in the coding region for the corresponding transcript.

Segment cluster HUMMHGM_node_68 (SEQ ID NO:5374) according to the present invention is supported by 143 libraries. The number of libraries was determined as previously described. This segment can be found in the following transcript(s): HUMMHGM_T17 (SEQ ID NO:4135), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142) and HUMMHGM_T44 (SEQ ID NO:4144). Table 4855 below describes the starting and ending position of this segment on each transcript.

TABLE 4855

Segment location on transcripts

| Transcript name | Segment starting position | Segment ending position |
|---|---|---|
| HUMMHGM_T17 (SEQ ID NO: 4135) | 965 | 997 |
| HUMMHGM_T28 (SEQ ID NO: 4138) | 965 | 997 |
| HUMMHGM_T29 (SEQ ID NO: 4139) | 2043 | 2075 |
| HUMMHGM_T35 (SEQ ID NO: 4140) | 965 | 997 |
| HUMMHGM_T36 (SEQ ID NO: 4141) | 1282 | 1314 |
| HUMMHGM_T40 (SEQ ID NO: 4142) | 2649 | 2681 |
| HUMMHGM_T44 (SEQ ID NO: 4144) | 2360 | 2392 |

This segment can be found in both coding and non-coding regions of transcript(s) as follows. The segment can be found in a non-coding region of transcript(s) that are related to the following protein(s): HUMMHGM_P12 and HUMMHGM_P24. This segment can also be found in the following protein(s): HUMMHGM_P14 and HUMMHGM_P21, since it is in the coding region for the corresponding transcript.

Segment cluster HUMMHGM_node_70 (SEQ ID NO:5375) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4856 below describes the starting and ending position of this segment on each transcript.

TABLE 4856

Segment location on transcripts

| Transcript name | Segment starting position | Segment ending position |
|---|---|---|
| HUMMHGM_T8 (SEQ ID NO: 4131) | 997 | 1016 |
| HUMMHGM_T12 (SEQ ID NO: 4132) | 1365 | 1384 |
| HUMMHGM_T13 (SEQ ID NO: 4133) | 1556 | 1575 |
| HUMMHGM_T15 (SEQ ID NO: 4134) | 1884 | 1903 |
| HUMMHGM_T17 (SEQ ID NO: 4135) | 1493 | 1512 |
| HUMMHGM_T18 (SEQ ID NO: 4136) | 2443 | 2462 |
| HUMMHGM_T20 (SEQ ID NO: 4137) | 1297 | 1316 |
| HUMMHGM_T28 (SEQ ID NO: 4138) | 998 | 1017 |
| HUMMHGM_T29 (SEQ ID NO: 4139) | 2076 | 2095 |
| HUMMHGM_T35 (SEQ ID NO: 4140) | 1493 | 1512 |
| HUMMHGM_T36 (SEQ ID NO: 4141) | 1315 | 1334 |
| HUMMHGM_T40 (SEQ ID NO: 4142) | 2682 | 2701 |
| HUMMHGM_T43 (SEQ ID NO: 4143) | 806 | 825 |
| HUMMHGM_T44 (SEQ ID NO: 4144) | 2393 | 2412 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P14, HUMMHGM_P16 and HUMMHGM_P24. This segment can also be found in the following protein(s): HUMMHGM_P7, HUMMHGM_P21 and HUMMHGM_P26, since it is in the coding region for the corresponding transcript.

Segment cluster HUMMHGM_node_71 (SEQ ID NO:5376) according to the present invention is supported by 338 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4857 below describes the starting and ending position of this segment on each transcript.

TABLE 4857

Segment location on transcripts

| Transcript name | Segment starting position | Segment ending position |
|---|---|---|
| HUMMHGM_T8 (SEQ ID NO: 4131) | 1017 | 1046 |
| HUMMHGM_T12 (SEQ ID NO: 4132) | 1385 | 1414 |
| HUMMHGM_T13 (SEQ ID NO: 4133) | 1576 | 1605 |
| HUMMHGM_T15 (SEQ ID NO: 4134) | 1904 | 1933 |
| HUMMHGM_T17 (SEQ ID NO: 4135) | 1513 | 1542 |
| HUMMHGM_T18 (SEQ ID NO: 4136) | 2463 | 2492 |
| HUMMHGM_T20 (SEQ ID NO: 4137) | 1317 | 1346 |
| HUMMHGM_T28 (SEQ ID NO: 4138) | 1018 | 1047 |
| HUMMHGM_T29 (SEQ ID NO: 4139) | 2096 | 2125 |
| HUMMHGM_T35 (SEQ ID NO: 4140) | 1513 | 1542 |
| HUMMHGM_T36 (SEQ ID NO: 4141) | 1335 | 1364 |
| HUMMHGM_T40 (SEQ ID NO: 4142) | 2702 | 2731 |
| HUMMHGM_T43 (SEQ ID NO: 4143) | 826 | 855 |
| HUMMHGM_T44 (SEQ ID NO: 4144) | 2413 | 2442 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P14, HUMMHGM_P16 and HUMMHGM_P24. This segment can also be found in the following protein(s): HUMMHGM_P7, HUMMHGM_P21 and HUMMHGM_P26, since it is in the coding region for the corresponding transcript.

Segment cluster HUMMHGM_node_72 (SEQ ID NO:5377) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4858 below describes the starting and ending position of this segment on each transcript.

TABLE 4858

Segment location on transcripts

| Transcript name | Segment starting position | Segment ending position |
|---|---|---|
| HUMMHGM_T8 (SEQ ID NO: 4131) | 1047 | 1059 |
| HUMMHGM_T12 (SEQ ID NO: 4132) | 1415 | 1427 |
| HUMMHGM_T13 (SEQ ID NO: 4133) | 1606 | 1618 |
| HUMMHGM_T15 (SEQ ID NO: 4134) | 1934 | 1946 |
| HUMMHGM_T17 (SEQ ID NO: 4135) | 1543 | 1555 |
| HUMMHGM_T18 (SEQ ID NO: 4136) | 2493 | 2505 |
| HUMMHGM_T20 (SEQ ID NO: 4137) | 1347 | 1359 |
| HUMMHGM_T28 (SEQ ID NO: 4138) | 1048 | 1060 |
| HUMMHGM_T29 (SEQ ID NO: 4139) | 2126 | 2138 |
| HUMMHGM_T35 (SEQ ID NO: 4140) | 1543 | 1555 |
| HUMMHGM_T36 (SEQ ID NO: 4141) | 1365 | 1377 |
| HUMMHGM_T40 (SEQ ID NO: 4142) | 2732 | 2744 |
| HUMMHGM_T43 (SEQ ID NO: 4143) | 856 | 868 |
| HUMMHGM_T44 (SEQ ID NO: 4144) | 2443 | 2455 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P14, HUMMHGM_P16 and HUMMHGM_P24. This segment can also be found in the following protein(s): HUMMHGM_P7, HUMMHGM_P21 and HUMMHGM_P26, since it is in the coding region for the corresponding transcript.

Segment cluster HUMMHGM_node_73 (SEQ ID NO:5378) according to the present invention is supported by 20 libraries. The number of libraries was determined as previously described. This segment can be found in the following transcript(s): HUMMHGM_T28 (SEQ ID NO:4138), HUMMHGM_T35 (SEQ ID NO:4140) and HUMMHGM_T43 (SEQ ID NO:4143). Table 4859 below describes the starting and ending position of this segment on each transcript.

TABLE 4859

Segment location on transcripts

| Transcript name | Segment starting position | Segment ending position |
|---|---|---|
| HUMMHGM_T28 (SEQ ID NO: 4138) | 1061 | 1132 |
| HUMMHGM_T35 (SEQ ID NO: 4140) | 1556 | 1627 |
| HUMMHGM_T43 (SEQ ID NO: 4143) | 869 | 940 |

This segment can be found in both coding and non-coding regions of transcript(s) as follows. The segment can be found in a non-coding region of transcript(s) that are related to the following protein(s): HUMMHGM_P14. This segment can also be found in the following protein(s): HUMMHGM_P21 and HUMMHGM_P26, since it is in the coding region for the corresponding transcript.

Segment cluster HUMMHGM_node__75 (SEQ ID NO:5379) according to the present invention is supported by 329 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4860 below describes the starting and ending position of this segment on each transcript.

TABLE 4860

Segment location on transcripts

| Transcript name | Segment starting position | Segment ending position |
|---|---|---|
| HUMMHGM_T8 (SEQ ID NO: 4131) | 1060 | 1093 |
| HUMMHGM_T12 (SEQ ID NO: 4132) | 1428 | 1461 |
| HUMMHGM_T13 (SEQ ID NO: 4133) | 1619 | 1652 |
| HUMMHGM_T15 (SEQ ID NO: 4134) | 1947 | 1980 |
| HUMMHGM_T17 (SEQ ID NO: 4135) | 1556 | 1589 |
| HUMMHGM_T18 (SEQ ID NO: 4136) | 2506 | 2539 |
| HUMMHGM_T20 (SEQ ID NO: 4137) | 1360 | 1393 |
| HUMMHGM_T28 (SEQ ID NO: 4138) | 1373 | 1406 |
| HUMMHGM_T29 (SEQ ID NO: 4139) | 2139 | 2172 |
| HUMMHGM_T35 (SEQ ID NO: 4140) | 1868 | 1901 |
| HUMMHGM_T36 (SEQ ID NO: 4141) | 1378 | 1411 |
| HUMMHGM_T40 (SEQ ID NO: 4142) | 2745 | 2778 |
| HUMMHGM_T43 (SEQ ID NO: 4143) | 1181 | 1214 |
| HUMMHGM_T44 (SEQ ID NO: 4144) | 2456 | 2489 |

This segment can be found in both coding and non-coding regions of transcript(s) as follows. The segment can be found in a non-coding region of transcript(s) that are related to the following protein(s): HUMMHGM_P9, HUMMHGM_P10, HUMMHGM_P12, HUMMHGM_P14, HUMMHGM_P16, HUMMHGM_P21, HUMMHGM_P24 and HUMMHGM_P26. This segment can also be found in the following protein(s): HUMMHGM_P7, since it is in the coding region for the corresponding transcript.

Segment cluster HUMMHGM_node__76 (SEQ ID NO:5380) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4861 below describes the starting and ending position of this segment on each transcript.

TABLE 4861

Segment location on transcripts

| Transcript name | Segment starting position | Segment ending position |
|---|---|---|
| HUMMHGM_T8 (SEQ ID NO: 4131) | 1094 | 1103 |
| HUMMHGM_T12 (SEQ ID NO: 4132) | 1462 | 1471 |
| HUMMHGM_T13 (SEQ ID NO: 4133) | 1653 | 1662 |
| HUMMHGM_T15 (SEQ ID NO: 4134) | 1981 | 1990 |
| HUMMHGM_T17 (SEQ ID NO: 4135) | 1590 | 1599 |
| HUMMHGM_T18 (SEQ ID NO: 4136) | 2540 | 2549 |
| HUMMHGM_T20 (SEQ ID NO: 4137) | 1394 | 1403 |
| HUMMHGM_T28 (SEQ ID NO: 4138) | 1407 | 1416 |
| HUMMHGM_T29 (SEQ ID NO: 4139) | 2173 | 2182 |
| HUMMHGM_T35 (SEQ ID NO: 4140) | 1902 | 1911 |
| HUMMHGM_T36 (SEQ ID NO: 4141) | 1412 | 1421 |
| HUMMHGM_T40 (SEQ ID NO: 4142) | 2779 | 2788 |
| HUMMHGM_T43 (SEQ ID NO: 4143) | 1215 | 1224 |
| HUMMHGM_T44 (SEQ ID NO: 4144) | 2490 | 2499 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__77 (SEQ ID NO:5381) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4862 below describes the starting and ending position of this segment on each transcript.

TABLE 4862

Segment location on transcripts

| Transcript name | Segment starting position | Segment ending position |
|---|---|---|
| HUMMHGM_T8 (SEQ ID NO: 4131) | 1104 | 1109 |
| HUMMHGM_T12 (SEQ ID NO: 4132) | 1472 | 1477 |

TABLE 4862-continued

Segment location on transcripts

| Transcript name | Segment starting position | Segment ending position |
| --- | --- | --- |
| HUMMHGM_T13 (SEQ ID NO: 4133) | 1663 | 1668 |
| HUMMHGM_T15 (SEQ ID NO: 4134) | 1991 | 1996 |
| HUMMHGM_T17 (SEQ ID NO: 4135) | 1600 | 1605 |
| HUMMHGM_T18 (SEQ ID NO: 4136) | 2550 | 2555 |
| HUMMHGM_T20 (SEQ ID NO: 4137) | 1404 | 1409 |
| HUMMHGM_T28 (SEQ ID NO: 4138) | 1417 | 1422 |
| HUMMHGM_T29 (SEQ ID NO: 4139) | 2183 | 2188 |
| HUMMHGM_T35 (SEQ ID NO: 4140) | 1912 | 1917 |
| HUMMHGM_T36 (SEQ ID NO: 4141) | 1422 | 1427 |
| HUMMHGM_T40 (SEQ ID NO: 4142) | 2789 | 2794 |
| HUMMHGM_T43 (SEQ ID NO: 4143) | 1225 | 1230 |
| HUMMHGM_T44 (SEQ ID NO: 4144) | 2500 | 2505 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_78 (SEQ ID NO:5382) according to the present invention is supported by 309 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4863 below describes the starting and ending position of this segment on each transcript.

TABLE 4863

Segment location on transcripts

| Transcript name | Segment starting position | Segment ending position |
| --- | --- | --- |
| HUMMHGM_T8 (SEQ ID NO: 4131) | 1110 | 1140 |
| HUMMHGM_T12 (SEQ ID NO: 4132) | 1478 | 1508 |
| HUMMHGM_T13 (SEQ ID NO: 4133) | 1669 | 1699 |
| HUMMHGM_T15 (SEQ ID NO: 4134) | 1997 | 2027 |
| HUMMHGM_T17 (SEQ ID NO: 4135) | 1606 | 1636 |
| HUMMHGM_T18 (SEQ ID NO: 4136) | 2556 | 2586 |
| HUMMHGM_T20 (SEQ ID NO: 4137) | 1410 | 1440 |
| HUMMHGM_T28 (SEQ ID NO: 4138) | 1423 | 1453 |
| HUMMHGM_T29 (SEQ ID NO: 4139) | 2189 | 2219 |
| HUMMHGM_T35 (SEQ ID NO: 4140) | 1918 | 1948 |
| HUMMHGM_T36 (SEQ ID NO: 4141) | 1428 | 1458 |
| HUMMHGM_T40 (SEQ ID NO: 4142) | 2795 | 2825 |
| HUMMHGM_T43 (SEQ ID NO: 4143) | 1231 | 1261 |
| HUMMHGM_T44 (SEQ ID NO: 4144) | 2506 | 2536 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_79 (SEQ ID NO:5383) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4864 below describes the starting and ending position of this segment on each transcript.

TABLE 4864

Segment location on transcripts

| Transcript name | Segment starting position | Segment ending position |
| --- | --- | --- |
| HUMMHGM_T8 (SEQ ID NO: 4131) | 1141 | 1147 |
| HUMMHGM_T12 (SEQ ID NO: 4132) | 1509 | 1515 |
| HUMMHGM_T13 (SEQ ID NO: 4133) | 1700 | 1706 |
| HUMMHGM_T15 (SEQ ID NO: 4134) | 2028 | 2034 |
| HUMMHGM_T17 (SEQ ID NO: 4135) | 1637 | 1643 |
| HUMMHGM_T18 (SEQ ID NO: 4136) | 2587 | 2593 |
| HUMMHGM_T20 (SEQ ID NO: 4137) | 1441 | 1447 |
| HUMMHGM_T28 (SEQ ID NO: 4138) | 1454 | 1460 |
| HUMMHGM_T29 (SEQ ID NO: 4139) | 2220 | 2226 |
| HUMMHGM_T35 (SEQ ID NO: 4140) | 1949 | 1955 |
| HUMMHGM_T36 (SEQ ID NO: 4141) | 1459 | 1465 |
| HUMMHGM_T40 (SEQ ID NO: 4142) | 2826 | 2832 |
| HUMMHGM_T43 (SEQ ID NO: 4143) | 1262 | 1268 |
| HUMMHGM_T44 (SEQ ID NO: 4144) | 2537 | 2543 |

This segment can be found in a non-coding region of transcript(s) that are related to the following protein(s): HUMMHGM_P7, HUMMHGM_P9, HUMMHGM_P 10, HUMMHGM_P12, HUMMHGM_P14, HUMMHGM_P16, HUMMHGM_P21, HUMMHGM_P24 and HUMMHGM_P26.

Segment cluster HUMMHGM_node_80 (SEQ ID NO:5384) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4865 below describes the starting and ending position of this segment on each transcript.

TABLE 4865

Segment location on transcripts

| Transcript name | Segment starting position | Segment ending position |
| --- | --- | --- |
| HUMMHGM_T8 (SEQ ID NO: 4131) | 1148 | 1152 |
| HUMMHGM_T12 (SEQ ID NO: 4132) | 1516 | 1520 |
| HUMMHGM_T13 (SEQ ID NO: 4133) | 1707 | 1711 |
| HUMMHGM_T15 (SEQ ID NO: 4134) | 2035 | 2039 |
| HUMMHGM_T17 (SEQ ID NO: 4135) | 1644 | 1648 |

TABLE 4865-continued

Segment location on transcripts

| Transcript name | Segment starting position | Segment ending position |
|---|---|---|
| HUMMHGM_T18 (SEQ ID NO: 4136) | 2594 | 2598 |
| HUMMHGM_T20 (SEQ ID NO: 4137) | 1448 | 1452 |
| HUMMHGM_T28 (SEQ ID NO: 4138) | 1461 | 1465 |
| HUMMHGM_T29 (SEQ ID NO: 4139) | 2227 | 2231 |
| HUMMHGM_T35 (SEQ ID NO: 4140) | 1956 | 1960 |
| HUMMHGM_T36 (SEQ ID NO: 4141) | 1466 | 1470 |
| HUMMHGM_T40 (SEQ ID NO: 4142) | 2833 | 2837 |
| HUMMHGM_T43 (SEQ ID NO: 4143) | 1269 | 1273 |
| HUMMHGM_T44 (SEQ ID NO: 4144) | 2544 | 2548 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_81 (SEQ ID NO:5385) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4866 below describes the starting and ending position of this segment on each transcript.

TABLE 4866

Segment location on transcripts

| Transcript name | Segment starting position | Segment ending position |
|---|---|---|
| HUMMHGM_T8 (SEQ ID NO: 4131) | 1153 | 1156 |
| HUMMHGM_T12 (SEQ ID NO: 4132) | 1521 | 1524 |
| HUMMHGM_T13 (SEQ ID NO: 4133) | 1712 | 1715 |
| HUMMHGM_T15 (SEQ ID NO: 4134) | 2040 | 2043 |
| HUMMHGM_T17 (SEQ ID NO: 4135) | 1649 | 1652 |
| HUMMHGM_T18 (SEQ ID NO: 4136) | 2599 | 2602 |
| HUMMHGM_T20 (SEQ ID NO: 4137) | 1453 | 1456 |
| HUMMHGM_T28 (SEQ ID NO: 4138) | 1466 | 1469 |
| HUMMHGM_T29 (SEQ ID NO: 4139) | 2232 | 2235 |
| HUMMHGM_T35 (SEQ ID NO: 4140) | 1961 | 1964 |
| HUMMHGM_T36 (SEQ ID NO: 4141) | 1471 | 1474 |
| HUMMHGM_T40 (SEQ ID NO: 4142) | 2838 | 2841 |
| HUMMHGM_T43 (SEQ ID NO: 4143) | 1274 | 1277 |
| HUMMHGM_T44 (SEQ ID NO: 4144) | 2549 | 2552 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_82 (SEQ ID NO:5386) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4867 below describes the starting and ending position of this segment on each transcript.

TABLE 4867

Segment location on transcripts

| Transcript name | Segment starting position | Segment ending position |
|---|---|---|
| HUMMHGM_T8 (SEQ ID NO: 4131) | 1157 | 1163 |
| HUMMHGM_T12 (SEQ ID NO: 4132) | 1525 | 1531 |
| HUMMHGM_T13 (SEQ ID NO: 4133) | 1716 | 1722 |
| HUMMHGM_T15 (SEQ ID NO: 4134) | 2044 | 2050 |
| HUMMHGM_T17 (SEQ ID NO: 4135) | 1653 | 1659 |
| HUMMHGM_T18 (SEQ ID NO: 4136) | 2603 | 2609 |
| HUMMHGM_T20 (SEQ ID NO: 4137) | 1457 | 1463 |
| HUMMHGM_T28 (SEQ ID NO: 4138) | 1470 | 1476 |
| HUMMHGM_T29 (SEQ ID NO: 4139) | 2236 | 2242 |
| HUMMHGM_T35 (SEQ ID NO: 4140) | 1965 | 1971 |
| HUMMHGM_T36 (SEQ ID NO: 4141) | 1475 | 1481 |
| HUMMHGM_T40 (SEQ ID NO: 4142) | 2842 | 2848 |
| HUMMHGM_T43 (SEQ ID NO: 4143) | 1278 | 1284 |
| HUMMHGM_T44 (SEQ ID NO: 4144) | 2553 | 2559 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_83 (SEQ ID NO:5387) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID. NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4868 below describes the starting and ending position of this segment on each transcript.

TABLE 4868

Segment location on transcripts

| Transcript name | Segment starting position | Segment ending position |
|---|---|---|
| HUMMHGM_T8 (SEQ ID NO: 4131) | 1164 | 1170 |
| HUMMHGM_T12 (SEQ ID NO: 4132) | 1532 | 1538 |
| HUMMHGM_T13 (SEQ ID NO: 4133) | 1723 | 1729 |
| HUMMHGM_T15 (SEQ ID NO: 4134) | 2051 | 2057 |
| HUMMHGM_T17 (SEQ ID NO: 4135) | 1660 | 1666 |
| HUMMHGM_T18 (SEQ ID NO: 4136) | 2610 | 2616 |
| HUMMHGM_T20 (SEQ ID NO: 4137) | 1464 | 1470 |
| HUMMHGM_T28 (SEQ ID NO: 4138) | 1477 | 1483 |
| HUMMHGM_T29 (SEQ ID NO: 4139) | 2243 | 2249 |
| HUMMHGM_T35 (SEQ ID NO: 4140) | 1972 | 1978 |

TABLE 4868-continued

Segment location on transcripts

| Transcript name | Segment starting position | Segment ending position |
|---|---|---|
| HUMMHGM_T36 (SEQ ID NO: 4141) | 1482 | 1488 |
| HUMMHGM_T40 (SEQ ID NO: 4142) | 2849 | 2855 |
| HUMMHGM_T43 (SEQ ID NO: 4143) | 1285 | 1291 |
| HUMMHGM_T44 (SEQ ID NO: 4144) | 2560 | 2566 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_84 (SEQ ID NO:5388) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4869 below describes the starting and ending position of this segment on each transcript.

TABLE 4869

Segment location on transcripts

| Transcript name | Segment starting position | Segment ending position |
|---|---|---|
| HUMMHGM_T8 (SEQ ID NO: 4131) | 1171 | 1176 |
| HUMMHGM_T12 (SEQ ID NO: 4132) | 1539 | 1544 |
| HUMMHGM_T13 (SEQ ID NO: 4133) | 1730 | 1735 |
| HUMMHGM_T15 (SEQ ID NO: 4134) | 2058 | 2063 |
| HUMMHGM_T17 (SEQ ID NO: 4135) | 1667 | 1672 |
| HUMMHGM_T18 (SEQ ID NO: 4136) | 2617 | 2622 |
| HUMMHGM_T20 (SEQ ID NO: 4137) | 1471 | 1476 |
| HUMMHGM_T28 (SEQ ID NO: 4138) | 1484 | 1489 |
| HUMMHGM_T29 (SEQ ID NO: 4139) | 2250 | 2255 |
| HUMMHGM_T35 (SEQ ID NO: 4140) | 1979 | 1984 |
| HUMMHGM_T36 (SEQ ID NO: 4141) | 1489 | 1494 |
| HUMMHGM_T40 (SEQ ID NO: 4142) | 2856 | 2861 |
| HUMMHGM_T43 (SEQ ID NO: 4143) | 1292 | 1297 |
| HUMMHGM_T44 (SEQ ID NO: 4144) | 2567 | 2572 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_85 (SEQ ID NO:5389) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4870 below describes the starting and ending position of this segment on each transcript.

TABLE 4870

Segment location on transcripts

| Transcript name | Segment starting position | Segment ending position |
|---|---|---|
| HUMMHGM_T8 (SEQ ID NO: 4131) | 1177 | 1183 |
| HUMMHGM_T12 (SEQ ID NO: 4132) | 1545 | 1551 |
| HUMMHGM_T13 (SEQ ID NO: 4133) | 1736 | 1742 |
| HUMMHGM_T15 (SEQ ID NO: 4134) | 2064 | 2070 |
| HUMMHGM_T17 (SEQ ID NO: 4135) | 1673 | 1679 |
| HUMMHGM_T18 (SEQ ID NO: 4136) | 2623 | 2629 |
| HUMMHGM_T20 (SEQ ID NO: 4137) | 1477 | 1483 |
| HUMMHGM_T28 (SEQ ID NO: 4138) | 1490 | 1496 |
| HUMMHGM_T29 (SEQ ID NO: 4139) | 2256 | 2262 |
| HUMMHGM_T35 (SEQ ID NO: 4140) | 1985 | 1991 |
| HUMMHGM_T36 (SEQ ID NO: 4141) | 1495 | 1501 |
| HUMMHGM_T40 (SEQ ID NO: 4142) | 2862 | 2868 |
| HUMMHGM_T43 (SEQ ID NO: 4143) | 1298 | 1304 |
| HUMMHGM_T44 (SEQ ID NO: 4144) | 2573 | 2579 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_86 (SEQ ID NO:5390) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4871 below describes the starting and ending position of this segment on each transcript.

TABLE 4871

Segment location on transcripts

| Transcript name | Segment starting position | Segment ending position |
|---|---|---|
| HUMMHGM_T8 (SEQ ID NO: 4131) | 1184 | 1193 |
| HUMMHGM_T12 (SEQ ID NO: 4132) | 1552 | 1561 |
| HUMMHGM_T13 (SEQ ID NO: 4133) | 1743 | 1752 |
| HUMMHGM_T15 (SEQ ID NO: 4134) | 2071 | 2080 |
| HUMMHGM_T17 (SEQ ID NO: 4135) | 1680 | 1689 |
| HUMMHGM_T18 (SEQ ID NO: 4136) | 2630 | 2639 |
| HUMMHGM_T20 (SEQ ID NO: 4137) | 1484 | 1493 |
| HUMMHGM_T28 (SEQ ID NO: 4138) | 1497 | 1506 |
| HUMMHGM_T29 (SEQ ID NO: 4139) | 2263 | 2272 |
| HUMMHGM_T35 (SEQ ID NO: 4140) | 1992 | 2001 |
| HUMMHGM_T36 (SEQ ID NO: 4141) | 1502 | 1511 |
| HUMMHGM_T40 (SEQ ID NO: 4142) | 2869 | 2878 |
| HUMMHGM_T43 (SEQ ID NO: 4143) | 1305 | 1314 |
| HUMMHGM_T44 (SEQ ID NO: 4144) | 2580 | 2589 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_87 (SEQ ID NO:5391) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4872 below describes the starting and ending position of this segment on each transcript.

TABLE 4872

Segment location on transcripts

| Transcript name | Segment starting position | Segment ending position |
|---|---|---|
| HUMMHGM_T8 (SEQ ID NO: 4131) | 1194 | 1200 |
| HUMMHGM_T12 (SEQ ID NO: 4132) | 1562 | 1568 |
| HUMMHGM_T13 (SEQ ID NO: 4133) | 1753 | 1759 |
| HUMMHGM_T15 (SEQ ID NO: 4134) | 2081 | 2087 |
| HUMMHGM_T17 (SEQ ID NO: 4135) | 1690 | 1696 |
| HUMMHGM_T18 (SEQ ID NO: 4136) | 2640 | 2646 |
| HUMMHGM_T20 (SEQ ID NO: 4137) | 1494 | 1500 |
| HUMMHGM_T28 (SEQ ID NO: 4138) | 1507 | 1513 |
| HUMMHGM_T29 (SEQ ID NO: 4139) | 2273 | 2279 |
| HUMMHGM_T35 (SEQ ID NO: 4140) | 2002 | 2008 |
| HUMMHGM_T36 (SEQ ID NO: 4141) | 1512 | 1518 |
| HUMMHGM_T40 (SEQ ID NO: 4142) | 2879 | 2885 |
| HUMMHGM_T43 (SEQ ID NO: 4143) | 1315 | 1321 |
| HUMMHGM_T44 (SEQ ID NO: 4144) | 2590 | 2596 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_88 (SEQ ID NO:5392) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4873 below describes the starting and ending position of this segment on each transcript.

TABLE 4873

Segment location on transcripts

| Transcript name | Segment starting position | Segment ending position |
|---|---|---|
| HUMMHGM_T8 (SEQ ID NO: 4131) | 1201 | 1210 |
| HUMMHGM_T12 (SEQ ID NO: 4132) | 1569 | 1578 |
| HUMMHGM_T13 (SEQ ID NO: 4133) | 1760 | 1769 |
| HUMMHGM_T15 (SEQ ID NO: 4134) | 2088 | 2097 |
| HUMMHGM_T17 (SEQ ID NO: 4135) | 1697 | 1706 |
| HUMMHGM_T18 (SEQ ID NO: 4136) | 2647 | 2656 |
| HUMMHGM_T20 (SEQ ID NO: 4137) | 1501 | 1510 |
| HUMMHGM_T28 (SEQ ID NO: 4138) | 1514 | 1523 |
| HUMMHGM_T29 (SEQ ID NO: 4139) | 2280 | 2289 |
| HUMMHGM_T35 (SEQ ID NO: 4140) | 2009 | 2018 |
| HUMMHGM_T36 (SEQ ID NO: 4141) | 1519 | 1528 |
| HUMMHGM_T40 (SEQ ID NO: 4142) | 2886 | 2895 |
| HUMMHGM_T43 (SEQ ID NO: 4143) | 1322 | 1331 |
| HUMMHGM_T44 (SEQ ID NO: 4144) | 2597 | 2606 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_89 (SEQ ID NO:5393) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4874 below describes the starting and ending position of this segment on each transcript.

TABLE 4874

Segment location on transcripts

| Transcript name | Segment starting position | Segment ending position |
|---|---|---|
| HUMMHGM_T8 (SEQ ID NO: 4131) | 1211 | 1216 |
| HUMMHGM_T12 (SEQ ID NO: 4132) | 1579 | 1584 |
| HUMMHGM_T13 (SEQ ID NO: 4133) | 1770 | 1775 |
| HUMMHGM_T15 (SEQ ID NO: 4134) | 2098 | 2103 |
| HUMMHGM_T17 (SEQ ID NO: 4135) | 1707 | 1712 |
| HUMMHGM_T18 (SEQ ID NO: 4136) | 2657 | 2662 |
| HUMMHGM_T20 (SEQ ID NO: 4137) | 1511 | 1516 |
| HUMMHGM_T28 (SEQ ID NO: 4138) | 1524 | 1529 |
| HUMMHGM_T29 (SEQ ID NO: 4139) | 2290 | 2295 |
| HUMMHGM_T35 (SEQ ID NO: 4140) | 2019 | 2024 |
| HUMMHGM_T36 (SEQ ID NO: 4141) | 1529 | 1534 |
| HUMMHGM_T40 (SEQ ID NO: 4142) | 2896 | 2901 |
| HUMMHGM_T43 (SEQ ID NO: 4143) | 1332 | 1337 |
| HUMMHGM_T44 (SEQ ID NO: 4144) | 2607 | 2612 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_90 (SEQ ID NO:5394) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4875 below describes the starting and ending position of this segment on each transcript.

TABLE 4875

Segment location on transcripts

| Transcript name | Segment starting position | Segment ending position |
|---|---|---|
| HUMMHGM_T8 (SEQ ID NO: 4131) | 1217 | 1222 |
| HUMMHGM_T12 (SEQ ID NO: 4132) | 1585 | 1590 |
| HUMMHGM_T13 (SEQ ID NO: 4133) | 1776 | 1781 |
| HUMMHGM_T15 (SEQ ID NO: 4134) | 2104 | 2109 |
| HUMMHGM_T17 (SEQ ID NO: 4135) | 1713 | 1718 |
| HUMMHGM_T18 (SEQ ID NO: 4136) | 2663 | 2668 |
| HUMMHGM_T20 (SEQ ID NO: 4137) | 1517 | 1522 |
| HUMMHGM_T28 (SEQ ID NO: 4138) | 1530 | 1535 |
| HUMMHGM_T29 (SEQ ID NO: 4139) | 2296 | 2301 |
| HUMMHGM_T35 (SEQ ID NO: 4140) | 2025 | 2030 |
| HUMMHGM_T36 (SEQ ID NO: 4141) | 1535 | 1540 |
| HUMMHGM_T40 (SEQ ID NO: 4142) | 2902 | 2907 |
| HUMMHGM_T43 (SEQ ID NO: 4143) | 1338 | 1343 |
| HUMMHGM_T44 (SEQ ID NO: 4144) | 2613 | 2618 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_91 (SEQ ID NO:5395) according to the present invention is supported by 282 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4876 below describes the starting and ending position of this segment on each transcript.

TABLE 4876

Segment location on transcripts

| Transcript name | Segment starting position | Segment ending position |
|---|---|---|
| HUMMHGM_T8 (SEQ ID NO: 4131) | 1223 | 1251 |
| HUMMHGM_T12 (SEQ ID NO: 4132) | 1591 | 1619 |
| HUMMHGM_T13 (SEQ ID NO: 4133) | 1782 | 1810 |
| HUMMHGM_T15 (SEQ ID NO: 4134) | 2110 | 2138 |
| HUMMHGM_T17 (SEQ ID NO: 4135) | 1719 | 1747 |
| HUMMHGM_T18 (SEQ ID NO: 4136) | 2669 | 2697 |
| HUMMHGM_T20 (SEQ ID NO: 4137) | 1523 | 1551 |
| HUMMHGM_T28 (SEQ ID NO: 4138) | 1536 | 1564 |
| HUMMHGM_T29 (SEQ ID NO: 4139) | 2302 | 2330 |
| HUMMHGM_T35 (SEQ ID NO: 4140) | 2031 | 2059 |
| HUMMHGM_T36 (SEQ ID NO: 4141) | 1541 | 1569 |
| HUMMHGM_T40 (SEQ ID NO: 4142) | 2908 | 2936 |
| HUMMHGM_T43 (SEQ ID NO: 4143) | 1344 | 1372 |
| HUMMHGM_T44 (SEQ ID NO: 4144) | 2619 | 2647 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_92 (SEQ ID NO:5396) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4877 below describes the starting and ending position of this segment on each transcript.

TABLE 4877

Segment location on transcripts

| Transcript name | Segment starting position | Segment ending position |
|---|---|---|
| HUMMHGM_T8 (SEQ ID NO: 4131) | 1252 | 1261 |
| HUMMHGM_T12 (SEQ ID NO: 4132) | 1620 | 1629 |
| HUMMHGM_T13 (SEQ ID NO: 4133) | 1811 | 1820 |
| HUMMHGM_T15 (SEQ ID NO: 4134) | 2139 | 2148 |
| HUMMHGM_T17 (SEQ ID NO: 4135) | 1748 | 1757 |
| HUMMHGM_T18 (SEQ ID NO: 4136) | 2698 | 2707 |
| HUMMHGM_T20 (SEQ ID NO: 4137) | 1552 | 1561 |
| HUMMHGM_T28 (SEQ ID NO: 4138) | 1565 | 1574 |
| HUMMHGM_T29 (SEQ ID NO: 4139) | 2331 | 2340 |
| HUMMHGM_T35 (SEQ ID NO: 4140) | 2060 | 2069 |
| HUMMHGM_T36 (SEQ ID NO: 4141) | 1570 | 1579 |
| HUMMHGM_T40 (SEQ ID NO: 4142) | 2937 | 2946 |
| HUMMHGM_T43 (SEQ ID NO: 4143) | 1373 | 1382 |
| HUMMHGM_T44 (SEQ ID NO: 4144) | 2648 | 2657 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_93 (SEQ ID NO:5397) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4878 below describes the starting and ending position of this segment on each transcript.

TABLE 4878

Segment location on transcripts

| Transcript name | Segment starting position | Segment ending position |
| --- | --- | --- |
| HUMMHGM_T8 (SEQ ID NO: 4131) | 1262 | 1272 |
| HUMMHGM_T12 (SEQ ID NO: 4132) | 1630 | 1640 |
| HUMMHGM_T13 (SEQ ID NO: 4133) | 1821 | 1831 |
| HUMMHGM_T15 (SEQ ID NO: 4134) | 2149 | 2159 |
| HUMMHGM_T17 (SEQ ID NO: 4135) | 1758 | 1768 |
| HUMMHGM_T18 (SEQ ID NO: 4136) | 2708 | 2718 |
| HUMMHGM_T20 (SEQ ID NO: 4137) | 1562 | 1572 |
| HUMMHGM_T28 (SEQ ID NO: 4138) | 1575 | 1585 |
| HUMMHGM_T29 (SEQ ID NO: 4139) | 2341 | 2351 |
| HUMMHGM_T35 (SEQ ID NO: 4140) | 2070 | 2080 |
| HUMMHGM_T36 (SEQ ID NO: 4141) | 1580 | 1590 |
| HUMMHGM_T40 (SEQ ID NO: 4142) | 2947 | 2957 |
| HUMMHGM_T43 (SEQ ID NO: 4143) | 1383 | 1393 |
| HUMMHGM_T44 (SEQ ID NO: 4144) | 2658 | 2668 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_94 (SEQ ID NO:5398) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4879 below describes the starting and ending position of this segment on each transcript.

TABLE 4879

Segment location on transcripts

| Transcript name | Segment starting position | Segment ending position |
| --- | --- | --- |
| HUMMHGM_T8 (SEQ ID NO: 4131) | 1273 | 1279 |
| HUMMHGM_T12 (SEQ ID NO: 4132) | 1641 | 1647 |
| HUMMHGM_T13 (SEQ ID NO: 4133) | 1832 | 1838 |
| HUMMHGM_T15 (SEQ ID NO: 4134) | 2160 | 2166 |
| HUMMHGM_T17 (SEQ ID NO: 4135) | 1769 | 1775 |
| HUMMHGM_T18 (SEQ ID NO: 4136) | 2719 | 2725 |
| HUMMHGM_T20 (SEQ ID NO: 4137) | 1573 | 1579 |

TABLE 4879-continued

Segment location on transcripts

| Transcript name | Segment starting position | Segment ending position |
| --- | --- | --- |
| HUMMHGM_T28 (SEQ ID NO: 4138) | 1586 | 1592 |
| HUMMHGM_T29 (SEQ ID NO: 4139) | 2352 | 2358 |
| HUMMHGM_T35 (SEQ ID NO: 4140) | 2081 | 2087 |
| HUMMHGM_T36 (SEQ ID NO: 4141) | 1591 | 1597 |
| HUMMHGM_T40 (SEQ ID NO: 4142) | 2958 | 2964 |
| HUMMHGM_T43 (SEQ ID NO: 4143) | 1394 | 1400 |
| HUMMHGM_T44 (SEQ ID NO: 4144) | 2669 | 2675 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_95 (SEQ ID NO:5399) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4880 below describes the starting and ending position of this segment on each transcript.

TABLE 4880

Segment location on transcripts

| Transcript name | Segment starting position | Segment ending position |
| --- | --- | --- |
| HUMMHGM_T8 (SEQ ID NO: 4131) | 1280 | 1289 |
| HUMMHGM_T12 (SEQ ID NO: 4132) | 1648 | 1657 |
| HUMMHGM_T13 (SEQ ID NO: 4133) | 1839 | 1848 |
| HUMMHGM_T15 (SEQ ID NO: 4134) | 2167 | 2176 |
| HUMMHGM_T17 (SEQ ID NO: 4135) | 1776 | 1785 |
| HUMMHGM_T18 (SEQ ID NO: 4136) | 2726 | 2735 |
| HUMMHGM_T20 (SEQ ID NO: 4137) | 1580 | 1589 |
| HUMMHGM_T28 (SEQ ID NO: 4138) | 1593 | 1602 |
| HUMMHGM_T29 (SEQ ID NO: 4139) | 2359 | 2368 |
| HUMMHGM_T35 (SEQ ID NO: 4140) | 2088 | 2097 |
| HUMMHGM_T36 (SEQ ID NO: 4141) | 1598 | 1607 |
| HUMMHGM_T40 (SEQ ID NO: 4142) | 2965 | 2974 |
| HUMMHGM_T43 (SEQ ID NO: 4143) | 1401 | 1410 |
| HUMMHGM_T44 (SEQ ID NO: 4144) | 2676 | 2685 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_96 (SEQ ID NO:5400) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMM- HGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4881 below describes the starting and ending position of this segment on each transcript.

TABLE 4881

Segment location on transcripts

| Transcript name | Segment starting position | Segment ending position |
|---|---|---|
| HUMMHGM_T8 (SEQ ID NO: 4131) | 1290 | 1311 |
| HUMMHGM_T12 (SEQ ID NO: 4132) | 1658 | 1679 |
| HUMMHGM_T13 (SEQ ID NO: 4133) | 1849 | 1870 |
| HUMMHGM_T15 (SEQ ID NO: 4134) | 2177 | 2198 |
| HUMMHGM_T17 (SEQ ID NO: 4135) | 1786 | 1807 |
| HUMMHGM_T18 (SEQ ID NO: 4136) | 2736 | 2757 |
| HUMMHGM_T20 (SEQ ID NO: 4137) | 1590 | 1611 |
| HUMMHGM_T28 (SEQ ID NO: 4138) | 1603 | 1624 |
| HUMMHGM_T29 (SEQ ID NO: 4139) | 2369 | 2390 |
| HUMMHGM_T35 (SEQ ID NO: 4140) | 2098 | 2119 |
| HUMMHGM_T36 (SEQ ID NO: 4141) | 1608 | 1629 |
| HUMMHGM_T40 (SEQ ID NO: 4142) | 2975 | 2996 |
| HUMMHGM_T43 (SEQ ID NO: 4143) | 1411 | 1432 |
| HUMMHGM_T44 (SEQ ID NO: 4144) | 2686 | 2707 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_97 (SEQ ID NO:5401) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4882 below describes the starting and ending position of this segment on each transcript.

TABLE 4882

Segment location on transcripts

| Transcript name | Segment starting position | Segment ending position |
|---|---|---|
| HUMMHGM_T8 (SEQ ID NO: 4131) | 1312 | 1319 |
| HUMMHGM_T12 (SEQ ID NO: 4132) | 1680 | 1687 |
| HUMMHGM_T13 (SEQ ID NO: 4133) | 1871 | 1878 |
| HUMMHGM_T15 (SEQ ID NO: 4134) | 2199 | 2206 |
| HUMMHGM_T17 (SEQ ID NO: 4135) | 1808 | 1815 |
| HUMMHGM_T18 (SEQ ID NO: 4136) | 2758 | 2765 |
| HUMMHGM_T20 (SEQ ID NO: 4137) | 1612 | 1619 |
| HUMMHGM_T28 (SEQ ID NO: 4138) | 1625 | 1632 |
| HUMMHGM_T29 (SEQ ID NO: 4139) | 2391 | 2398 |
| HUMMHGM_T35 (SEQ ID NO: 4140) | 2120 | 2127 |
| HUMMHGM_T36 (SEQ ID NO: 4141) | 1630 | 1637 |
| HUMMHGM_T40 (SEQ ID NO: 4142) | 2997 | 3004 |

TABLE 4882-continued

Segment location on transcripts

| Transcript name | Segment starting position | Segment ending position |
|---|---|---|
| HUMMHGM_T43 (SEQ ID NO: 4143) | 1433 | 1440 |
| HUMMHGM_T44 (SEQ ID NO: 4144) | 2708 | 2715 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_98 (SEQ ID NO:5402) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4883 below describes the starting and ending position of this segment on each transcript.

TABLE 4883

Segment location on transcripts

| Transcript name | Segment starting position | Segment ending position |
|---|---|---|
| HUMMHGM_T8 (SEQ ID NO: 4131) | 1320 | 1325 |
| HUMMHGM_T12 (SEQ ID NO: 4132) | 1688 | 1693 |
| HUMMHGM_T13 (SEQ ID NO: 4133) | 1879 | 1884 |
| HUMMHGM_T15 (SEQ ID NO: 4134) | 2207 | 2212 |
| HUMMHGM_T17 (SEQ ID NO: 4135) | 1816 | 1821 |
| HUMMHGM_T18 (SEQ ID NO: 4136) | 2766 | 2771 |
| HUMMHGM_T20 (SEQ ID NO: 4137) | 1620 | 1625 |
| HUMMHGM_T28 (SEQ ID NO: 4138) | 1633 | 1638 |
| HUMMHGM_T29 (SEQ ID NO: 4139) | 2399 | 2404 |
| HUMMHGM_T35 (SEQ ID NO: 4140) | 2128 | 2133 |
| HUMMHGM_T36 (SEQ ID NO: 4141) | 1638 | 1643 |
| HUMMHGM_T40 (SEQ ID NO: 4142) | 3005 | 3010 |
| HUMMHGM_T43 (SEQ ID NO: 4143) | 1441 | 1446 |
| HUMMHGM_T44 (SEQ ID NO: 4144) | 2716 | 2721 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_99 (SEQ ID NO:5403) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMM- HGM_T40 (SEQ ID NO:4142), HUMMHGM_T43 (SEQ ID NO:4143) and HUMMHGM_T44 (SEQ ID NO:4144). Table 4884 below describes the starting and ending position of this segment on each transcript.

TABLE 4884

Segment location on transcripts

| Transcript name | Segment starting position | Segment ending position |
|---|---|---|
| HUMMHGM_T8 (SEQ ID NO: 4131) | 1326 | 1332 |
| HUMMHGM_T12 (SEQ ID NO: 4132) | 1694 | 1700 |
| HUMMHGM_T13 (SEQ ID NO: 4133) | 1885 | 1891 |
| HUMMHGM_T15 (SEQ ID NO: 4134) | 2213 | 2219 |
| HUMMHGM_T17 (SEQ ID NO: 4135) | 1822 | 1828 |
| HUMMHGM_T18 (SEQ ID NO: 4136) | 2772 | 2778 |
| HUMMHGM_T20 (SEQ ID NO: 4137) | 1626 | 1632 |
| HUMMHGM_T28 (SEQ ID NO: 4138) | 1639 | 1645 |
| HUMMHGM_T29 (SEQ ID NO: 4139) | 2405 | 2411 |
| HUMMHGM_T35 (SEQ ID NO: 4140) | 2134 | 2140 |
| HUMMHGM_T36 (SEQ ID NO: 4141) | 1644 | 1650 |
| HUMMHGM_T40 (SEQ ID NO: 4142) | 3011 | 3017 |
| HUMMHGM_T43 (SEQ ID NO: 4143) | 1447 | 1453 |
| HUMMHGM_T44 (SEQ ID NO: 4144) | 2722 | 2728 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__100 (SEQ ID NO:5404) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4885 below describes the starting and ending position of this segment on each transcript.

TABLE 4885

Segment location on transcripts

| Transcript name | Segment starting position | Segment ending position |
|---|---|---|
| HUMMHGM_T8 (SEQ ID NO: 4131) | 1333 | 1342 |
| HUMMHGM_T12 (SEQ ID NO: 4132) | 1701 | 1710 |
| HUMMHGM_T13 (SEQ ID NO: 4133) | 1892 | 1901 |
| HUMMHGM_T15 (SEQ ID NO: 4134) | 2220 | 2229 |
| HUMMHGM_T17 (SEQ ID NO: 4135) | 1829 | 1838 |
| HUMMHGM_T18 (SEQ ID NO: 4136) | 2779 | 2788 |
| HUMMHGM_T20 (SEQ ID NO: 4137) | 1633 | 1642 |
| HUMMHGM_T28 (SEQ ID NO: 4138) | 1646 | 1655 |
| HUMMHGM_T29 (SEQ ID NO: 4139) | 2412 | 2421 |
| HUMMHGM_T35 (SEQ ID NO: 4140) | 2141 | 2150 |
| HUMMHGM_T36 (SEQ ID NO: 4141) | 1651 | 1660 |
| HUMMHGM_T40 (SEQ ID NO: 4142) | 3018 | 3027 |
| HUMMHGM_T43 (SEQ ID NO: 4143) | 1454 | 1463 |
| HUMMHGM_T44 (SEQ ID NO: 4144) | 2729 | 2738 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__101 (SEQ ID NO:5405) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4886 below describes the starting and ending position of this segment on each transcript.

TABLE 4886

Segment location on transcripts

| Transcript name | Segment starting position | Segment ending position |
|---|---|---|
| HUMMHGM_T8 (SEQ ID NO: 4131) | 1343 | 1349 |
| HUMMHGM_T12 (SEQ ID NO: 4132) | 1711 | 1717 |
| HUMMHGM_T13 (SEQ ID NO: 4133) | 1902 | 1908 |
| HUMMHGM_T15 (SEQ ID NO: 4134) | 2230 | 2236 |
| HUMMHGM_T17 (SEQ ID NO: 4135) | 1839 | 1845 |
| HUMMHGM_T18 (SEQ ID NO: 4136) | 2789 | 2795 |
| HUMMHGM_T20 (SEQ ID NO: 4137) | 1643 | 1649 |
| HUMMHGM_T28 (SEQ ID NO: 4138) | 1656 | 1662 |
| HUMMHGM_T29 (SEQ ID NO: 4139) | 2422 | 2428 |
| HUMMHGM_T35 (SEQ ID NO: 4140) | 2151 | 2157 |
| HUMMHGM_T36 (SEQ ID NO: 4141) | 1661 | 1667 |
| HUMMHGM_T40 (SEQ ID NO: 4142) | 3028 | 3034 |
| HUMMHGM_T43 (SEQ ID NO: 4143) | 1464 | 1470 |
| HUMMHGM_T44 (SEQ ID NO: 4144) | 2739 | 2745 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__102 (SEQ ID NO:5406) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4887 below describes the starting and ending position of this segment on each transcript.

TABLE 4887

Segment location on transcripts

| Transcript name | Segment starting position | Segment ending position |
|---|---|---|
| HUMMHGM_T8 (SEQ ID NO: 4131) | 1350 | 1365 |
| HUMMHGM_T12 (SEQ ID NO: 4132) | 1718 | 1733 |
| HUMMHGM_T13 (SEQ ID NO: 4133) | 1909 | 1924 |
| HUMMHGM_T15 (SEQ ID NO: 4134) | 2237 | 2252 |
| HUMMHGM_T17 (SEQ ID NO: 4135) | 1846 | 1861 |
| HUMMHGM_T18 (SEQ ID NO: 4136) | 2796 | 2811 |
| HUMMHGM_T20 (SEQ ID NO: 4137) | 1650 | 1665 |
| HUMMHGM_T28 (SEQ ID NO: 4138) | 1663 | 1678 |
| HUMMHGM_T29 (SEQ ID NO: 4139) | 2429 | 2444 |
| HUMMHGM_T35 (SEQ ID NO: 4140) | 2158 | 2173 |
| HUMMHGM_T36 (SEQ ID NO: 4141) | 1668 | 1683 |
| HUMMHGM_T40 (SEQ ID NO: 4142) | 3035 | 3050 |
| HUMMHGM_T43 (SEQ ID NO: 4143) | 1471 | 1486 |
| HUMMHGM_T44 (SEQ ID NO: 4144) | 2746 | 2761 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_103 (SEQ ID NO:5407) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4888 below describes the starting and ending position of this segment on each transcript.

TABLE 4888

Segment location on transcripts

| Transcript name | Segment starting position | Segment ending position |
|---|---|---|
| HUMMHGM_T8 (SEQ ID NO: 4131) | 1366 | 1379 |
| HUMMHGM_T12 (SEQ ID NO: 4132) | 1734 | 1747 |
| HUMMHGM_T13 (SEQ ID NO: 4133) | 1925 | 1938 |
| HUMMHGM_T15 (SEQ ID NO: 4134) | 2253 | 2266 |
| HUMMHGM_T17 (SEQ ID NO: 4135) | 1862 | 1875 |
| HUMMHGM_T18 (SEQ ID NO: 4136) | 2812 | 2825 |
| HUMMHGM_T20 (SEQ ID NO: 4137) | 1666 | 1679 |
| HUMMHGM_T28 (SEQ ID NO: 4138) | 1679 | 1692 |
| HUMMHGM_T29 (SEQ ID NO: 4139) | 2445 | 2458 |
| HUMMHGM_T35 (SEQ ID NO: 4140) | 2174 | 2187 |
| HUMMHGM_T36 (SEQ ID NO: 4141) | 1684 | 1697 |
| HUMMHGM_T40 (SEQ ID NO: 4142) | 3051 | 3064 |
| HUMMHGM_T43 (SEQ ID NO: 4143) | 1487 | 1500 |
| HUMMHGM_T44 (SEQ ID NO: 4144) | 2762 | 2775 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_104 (SEQ ID NO:5408) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4889 below describes the starting and ending position of this segment on each transcript.

TABLE 4889

Segment location on transcripts

| Transcript name | Segment starting position | Segment ending position |
|---|---|---|
| HUMMHGM_T8 (SEQ ID NO: 4131) | 1380 | 1392 |
| HUMMHGM_T12 (SEQ ID NO: 4132) | 1748 | 1760 |
| HUMMHGM_T13 (SEQ ID NO: 4133) | 1939 | 1951 |
| HUMMHGM_T15 (SEQ ID NO: 4134) | 2267 | 2279 |
| HUMMHGM_T17 (SEQ ID NO: 4135) | 1876 | 1888 |
| HUMMHGM_T18 (SEQ ID NO: 4136) | 2826 | 2838 |
| HUMMHGM_T20 (SEQ ID NO: 4137) | 1680 | 1692 |
| HUMMHGM_T28 (SEQ ID NO: 4138) | 1693 | 1705 |
| HUMMHGM_T29 (SEQ ID NO: 4139) | 2459 | 2471 |
| HUMMHGM_T35 (SEQ ID NO: 4140) | 2188 | 2200 |
| HUMMHGM_T36 (SEQ ID NO: 4141) | 1698 | 1710 |
| HUMMHGM_T40 (SEQ ID NO: 4142) | 3065 | 3077 |
| HUMMHGM_T43 (SEQ ID NO: 4143) | 1501 | 1513 |
| HUMMHGM_T44 (SEQ ID NO: 4144) | 2776 | 2788 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_105 (SEQ ID NO:5409) according to the present invention is supported by 238 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4890 below describes the starting and ending position of this segment on each transcript.

TABLE 4890

Segment location on transcripts

| Transcript name | Segment starting position | Segment ending position |
|---|---|---|
| HUMMHGM_T8 (SEQ ID NO: 4131) | 1393 | 1439 |
| HUMMHGM_T12 (SEQ ID NO: 4132) | 1761 | 1807 |

TABLE 4890-continued

Segment location on transcripts

| Transcript name | Segment starting position | Segment ending position |
|---|---|---|
| HUMMHGM_T13 (SEQ ID NO: 4133) | 1952 | 1998 |
| HUMMHGM_T15 (SEQ ID NO: 4134) | 2280 | 2326 |
| HUMMHGM_T17 (SEQ ID NO: 4135) | 1889 | 1935 |
| HUMMHGM_T15 (SEQ ID NO: 4136) | 2839 | 2885 |
| HUMMHGM_T20 (SEQ ID NO: 4137) | 1693 | 1739 |
| HUMMHGM_T28 (SEQ ID NO: 4138) | 1706 | 1752 |
| HUMMHGM_T29 (SEQ ID NO: 4139) | 2472 | 2518 |
| HUMMHGM_T35 (SEQ ID NO: 4140) | 2201 | 2247 |
| HUMMHGM_T36 (SEQ ID NO: 4141) | 1711 | 1757 |
| HUMMHGM_T40 (SEQ ID NO: 4142) | 3078 | 3124 |
| HUMMHGM_T43 (SEQ ID NO: 4143) | 1514 | 1560 |
| HUMMHGM_T44 (SEQ ID NO: 4144) | 2789 | 2835 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__106 (SEQ ID NO:5410) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4891 below describes the starting and ending position of this segment on each transcript.

TABLE 4891

Segment location on transcripts

| Transcript name | Segment starting position | Segment ending position |
|---|---|---|
| HUMMHGM_T8 (SEQ ID NO: 4131) | 1440 | 1445 |
| HUMMHGM_T12 (SEQ ID NO: 4132) | 1808 | 1813 |
| HUMMHGM_T13 (SEQ ID NO: 4133) | 1999 | 2004 |
| HUMMHGM_T15 (SEQ ID NO: 4134) | 2327 | 2332 |
| HUMMHGM_T17 (SEQ ID NO: 4135) | 1936 | 1941 |
| HUMMHGM_T18 (SEQ ID NO: 4136) | 2886 | 2891 |
| HUMMHGM_T20 (SEQ ID NO: 4137) | 1740 | 1745 |
| HUMMHGM_T28 (SEQ ID NO: 4138) | 1753 | 1758 |
| HUMMHGM_T29 (SEQ ID NO: 4139) | 2519 | 2524 |
| HUMMHGM_T35 (SEQ ID NO: 4140) | 2248 | 2253 |
| HUMMHGM_T36 (SEQ ID NO: 4141) | 1758 | 1763 |
| HUMMHGM_T40 (SEQ ID NO: 4142) | 3125 | 3130 |
| HUMMHGM_T43 (SEQ ID NO: 4143) | 1561 | 1566 |
| HUMMHGM_T44 (SEQ ID NO: 4144) | 2836 | 2841 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__107 (SEQ ID NO:5411) according to the present invention is supported by 219 libraries. The number of libraries was determined as previously described. This segment can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4892 below describes the starting and ending position of this segment on each transcript.

TABLE 4892

Segment location on transcripts

| Transcript name | Segment starting position | Segment ending position |
|---|---|---|
| HUMMHGM_T8 (SEQ ID NO: 4131) | 1446 | 1530 |
| HUMMHGM_T12 (SEQ ID NO: 4132) | 1814 | 1898 |
| HUMMHGM_T13 (SEQ ID NO: 4133) | 2005 | 2089 |
| HUMMHGM_T15 (SEQ ID NO: 4134) | 2333 | 2417 |
| HUMMHGM_T17 (SEQ ID NO: 4135) | 1942 | 2026 |
| HUMMHGM_T18 (SEQ ID NO: 4136) | 2892 | 2976 |
| HUMMHGM_T20 (SEQ ID NO: 4137) | 1746 | 1830 |
| HUMMHGM_T28 (SEQ ID NO: 4138) | 1759 | 1843 |
| HUMMHGM_T29 (SEQ ID NO: 4139) | 2525 | 2609 |
| HUMMHGM_T35 (SEQ ID NO: 4140) | 2254 | 2338 |
| HUMMHGM_T36 (SEQ ID NO: 4141) | 1764 | 1848 |
| HUMMHGM_T40 (SEQ ID NO: 4142) | 3131 | 3215 |
| HUMMHGM_T43 (SEQ ID NO: 4143) | 1567 | 1651 |
| HUMMHGM_T44 (SEQ ID NO: 4144) | 2842 | 2926 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node__108 (SEQ ID NO:5412) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4893 below describes the starting and ending position of this segment on each transcript.

TABLE 4893

Segment location on transcripts

| Transcript name | Segment starting position | Segment ending position |
|---|---|---|
| HUMMHGM_T8 (SEQ ID NO: 4131) | 1531 | 1535 |
| HUMMHGM_T12 (SEQ ID NO: 4132) | 1899 | 1903 |
| HUMMHGM_T13 (SEQ ID NO: 4133) | 2090 | 2094 |
| HUMMHGM_T15 (SEQ ID NO: 4134) | 2418 | 2422 |
| HUMMHGM_T17 (SEQ ID NO: 4135) | 2027 | 2031 |

TABLE 4893-continued

Segment location on transcripts

| Transcript name | Segment starting position | Segment ending position |
|---|---|---|
| HUMMHGM_T18 (SEQ ID NO: 4136) | 2977 | 2981 |
| HUMMHGM_T20 (SEQ ID NO: 4137) | 1831 | 1835 |
| HUMMHGM_T28 (SEQ ID NO: 4138) | 1844 | 1848 |
| HUMMHGM_T29 (SEQ ID NO: 4139) | 2610 | 2614 |
| HUMMHGM_T35 (SEQ ID NO: 4140) | 2339 | 2343 |
| HUMMHGM_T36 (SEQ ID NO: 4141) | 1849 | 1853 |
| HUMMHGM_T40 (SEQ ID NO: 4142) | 3216 | 3220 |
| HUMMHGM_T43 (SEQ ID NO: 4143) | 1652 | 1656 |
| HUMMHGM_T44 (SEQ ID NO: 4144) | 2927 | 2931 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_109 (SEQ ID NO:5413) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4894 below describes the starting and ending position of this segment on each transcript.

TABLE 4894

Segment location on transcripts

| Transcript name | Segment starting position | Segment ending position |
|---|---|---|
| HUMMHGM_T8 (SEQ ID NO: 4131) | 1536 | 1549 |
| HUMMHGM_T12 (SEQ ID NO: 4132) | 1904 | 1917 |
| HUMMHGM_T13 (SEQ ID NO: 4133) | 2095 | 2108 |
| HUMMHGM_T15 (SEQ ID NO: 4134) | 2423 | 2436 |
| HUMMHGM_T17 (SEQ ID NO: 4135) | 2032 | 2045 |
| HUMMHGM_T18 (SEQ ID NO: 4136) | 2982 | 2995 |
| HUMMHGM_T20 (SEQ ID NO: 4137) | 1836 | 1849 |
| HUMMHGM_T28 (SEQ ID NO: 4138) | 1849 | 1862 |
| HUMMHGM_T29 (SEQ ID NO: 4139) | 2615 | 2628 |
| HUMMHGM_T35 (SEQ ID NO: 4140) | 2344 | 2357 |
| HUMMHGM_T36 (SEQ ID NO: 4141) | 1854 | 1867 |
| HUMMHGM_T40 (SEQ ID NO: 4142) | 3221 | 3234 |
| HUMMHGM_T43 (SEQ ID NO: 4143) | 1657 | 1670 |
| HUMMHGM_T44 (SEQ ID NO: 4144) | 2932 | 2945 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_110 (SEQ ID NO:5414) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4895 below describes the starting and ending position of this segment on each transcript.

TABLE 4895

Segment location on transcripts

| Transcript name | Segment starting position | Segment ending position |
|---|---|---|
| HUMMHGM_T8 (SEQ ID NO: 4131) | 1550 | 1573 |
| HUMMHGM_T12 (SEQ ID NO: 4132) | 1918 | 1941 |
| HUMMHGM_T13 (SEQ ID NO: 4133) | 2109 | 2132 |
| HUMMHGM_T15 (SEQ ID NO: 4134) | 2437 | 2460 |
| HUMMHGM_T17 (SEQ ID NO: 4135) | 2046 | 2069 |
| HUMMHGM_T18 (SEQ ID NO: 4136) | 2996 | 3019 |
| HUMMHGM_T20 (SEQ ID NO: 4137) | 1850 | 1873 |
| HUMMHGM_T28 (SEQ ID NO: 4138) | 1863 | 1886 |
| HUMMHGM_T29 (SEQ ID NO: 4139) | 2629 | 2652 |
| HUMMHGM_T35 (SEQ ID NO: 4140) | 2358 | 2381 |
| HUMMHGM_T36 (SEQ ID NO: 4141) | 1868 | 1891 |
| HUMMHGM_T40 (SEQ ID NO: 4142) | 3235 | 3258 |
| HUMMHGM_T43 (SEQ ID NO: 4143) | 1671 | 1694 |
| HUMMHGM_T44 (SEQ ID NO: 4144) | 2946 | 2969 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_111 (SEQ ID NO:5415) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4896 below describes the starting and ending position of this segment on each transcript.

TABLE 4896

Segment location on transcripts

| Transcript name | Segment starting position | Segment ending position |
|---|---|---|
| HUMMHGM_T8 (SEQ ID NO: 4131) | 1574 | 1582 |
| HUMMHGM_T12 (SEQ ID NO: 4132) | 1942 | 1950 |
| HUMMHGM_T13 (SEQ ID NO: 4133) | 2133 | 2141 |
| HUMMHGM_T15 (SEQ ID NO: 4134) | 2461 | 2469 |
| HUMMHGM_T17 (SEQ ID NO: 4135) | 2070 | 2078 |
| HUMMHGM_T18 (SEQ ID NO: 4136) | 3020 | 3028 |
| HUMMHGM_T20 (SEQ ID NO: 4137) | 1874 | 1882 |
| HUMMHGM_T28 (SEQ ID NO: 4138) | 1887 | 1895 |
| HUMMHGM_T29 (SEQ ID NO: 4139) | 2653 | 2661 |
| HUMMHGM_T35 (SEQ ID NO: 4140) | 2382 | 2390 |

TABLE 4896-continued

Segment location on transcripts

| Transcript name | Segment starting position | Segment ending position |
|---|---|---|
| HUMMHGM_T36 (SEQ ID NO: 4141) | 1892 | 1900 |
| HUMMHGM_T40 (SEQ ID NO: 4142) | 3259 | 3267 |
| HUMMHGM_T43 (SEQ ID NO: 4143) | 1695 | 1703 |
| HUMMHGM_T44 (SEQ ID NO: 4144) | 2970 | 2978 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Segment cluster HUMMHGM_node_112 (SEQ ID NO:5416) according to the present invention can be found in the following transcript(s): HUMMHGM_T8 (SEQ ID NO:4131), HUMMHGM_T12 (SEQ ID NO:4132), HUMMHGM_T13 (SEQ ID NO:4133), HUMMHGM_T15 (SEQ ID NO:4134), HUMMHGM_T17 (SEQ ID NO:4135), HUMMHGM_T18 (SEQ ID NO:4136), HUMMHGM_T20 (SEQ ID NO:4137), HUMMHGM_T28 (SEQ ID NO:4138), HUMMHGM_T29 (SEQ ID NO:4139), HUMMHGM_T35 (SEQ ID NO:4140), HUMMHGM_T36 (SEQ ID NO:4141), HUMMHGM_T40 (SEQ ID NO:4142), HUMMHGM_T43 (SEQ ID NO:4143) and HUMMHGM_T44 (SEQ ID NO:4144). Table 4897 below describes the starting and ending position of this segment on each transcript.

TABLE 4897

Segment location on transcripts

| Transcript name | Segment starting position | Segment ending position |
|---|---|---|
| HUMMHGM_T8 (SEQ ID NO: 4131) | 1583 | 1589 |
| HUMMHGM_T12 (SEQ ID NO: 4132) | 1951 | 1957 |
| HUMMHGM_T13 (SEQ ID NO: 4133) | 2142 | 2148 |
| HUMMHGM_T15 (SEQ ID NO: 4134) | 2470 | 2476 |
| HUMMHGM_T17 (SEQ ID NO: 4135) | 2079 | 2085 |
| HUMMHGM_T18 (SEQ ID NO: 4136) | 3029 | 3035 |
| HUMMHGM_T20 (SEQ ID NO: 4137) | 1883 | 1889 |
| HUMMHGM_T28 (SEQ ID NO: 4138) | 1896 | 1902 |
| HUMMHGM_T29 (SEQ ID NO: 4139) | 2662 | 2668 |
| HUMMHGM_T35 (SEQ ID NO: 4140) | 2391 | 2397 |
| HUMMHGM_T36 (SEQ ID NO: 4141) | 1901 | 1907 |
| HUMMHGM_T40 (SEQ ID NO: 4142) | 3268 | 3274 |
| HUMMHGM_T43 (SEQ ID NO: 4143) | 1704 | 1710 |
| HUMMHGM_T44 (SEQ ID NO: 4144) | 2979 | 2985 |

This segment can be found in a non-coding region of transcript(s) that are related to the following protein(s): HUMMHGM_P7, HUMMHGM_P9, HUMMHGM_P10, HUMMHGM_P12, HUMMHGM_P14, HUMMHGM_P16, HUMMHGM_P21, HUMMHGM_P24 and HUMMHGM_P26.

Description for Cluster HUMPAX8A

Cluster HUMPAX8A features 13 transcript(s) and 29 segment(s) of interest, the names for which are given in Tables 4898 and 4899, respectively, the sequences themselves are given at the end of the application. The selected protein variants are given in Table 4900.

TABLE 4898

Transcripts of interest
Transcript Name

HUMPAX8A_T0 (SEQ ID NO: 4147)
HUMPAX8A_T2 (SEQ ID NO: 4148)
HUMPAX8A_T3 (SEQ ID NO: 4149)
HUMPAX8A_T4 (SEQ ID NO: 4150)
HUMPAX8A_T5 (SEQ ID NO: 4151)
HUMPAX8A_T7 (SEQ ID NO: 4152)
HUMPAX8A_T9 (SEQ ID NO: 4153)
HUMPAX8A_T10 (SEQ ID NO: 4154)
HUMPAX8A_T15 (SEQ ID NO: 4155)
HUMPAX8A_T21 (SEQ ID NO: 4156)
HUMPAX8A_T27 (SEQ ID NO: 4157)
HUMPAX8A_T33 (SEQ ID NO: 4158)
HUMPAX8A_T34 (SEQ ID NO: 4159)

TABLE 4899

Segments of interest
Segment Name

HUMPAX8A_node_4 (SEQ ID NO: 5417)
HUMPAX8A_node_5 (SEQ ID NO: 5418)
HUMPAX8A_node_8 (SEQ ID NO: 5419)
HUMPAX8A_node_15 (SEQ ID NO: 5420)
HUMPAX8A_node_17 (SEQ ID NO: 5421)
HUMPAX8A_node_18 (SEQ ID NO: 5422)
HUMPAX8A_node_20 (SEQ ID NO: 5423)
HUMPAX8A_node_21 (SEQ ID NO: 5424)
HUMPAX8A_node_22 (SEQ ID NO: 5425)
HUMPAX8A_node_32 (SEQ ID NO: 5426)
HUMPAX8A_node_39 (SEQ ID NO: 5427)
HUMPAX8A_node_41 (SEQ ID NO: 5428)
HUMPAX8A_node_42 (SEQ ID NO: 5429)
HUMPAX8A_node_43 (SEQ ID NO: 5430)
HUMPAX8A_node_44 (SEQ ID NO: 5431)
HUMPAX8A_node_49 (SEQ ID NO: 5432)
HUMPAX8A_node_50 (SEQ ID NO: 5433)
HUMPAX8A_node_0 (SEQ ID NO: 5434)
HUMPAX8A_node_2 (SEQ ID NO: 5435)
HUMPAX8A_node_12 (SEQ ID NO: 5436)
HUMPAX8A_node_19 (SEQ ID NO: 5437)
HUMPAX8A_node_24 (SEQ ID NO: 5438)
HUMPAX8A_node_25 (SEQ ID NO: 5439)
HUMPAX8A_node_30 (SEQ ID NO: 5440)
HUMPAX8A_node_31 (SEQ ID NO: 5441)
HUMPAX8A_node_40 (SEQ ID NO: 5442)
HUMPAX8A_node_46 (SEQ ID NO: 5443)
HUMPAX8A_node_47 (SEQ ID NO: 5444)
HUMPAX8A_node_48 (SEQ ID NO: 5445)

TABLE 4900

Proteins of interest

| Protein Name | Corresponding Transcript(s) |
|---|---|
| HUMPAX8A_P1 | HUMPAX8A_T0 (SEQ ID NO: 4147); HUMPAX8A_T2 (SEQ ID NO: 4148); HUMPAX8A_T3 (SEQ ID NO: 4149); HUMPAX8A_T4 (SEQ ID NO: 4150); HUMPAX8A_T7 (SEQ ID NO: 4152); HUMPAX8A_T9 (SEQ ID NO: 4153); HUMPAX8A_T10 (SEQ ID NO: 4154); HUMPAX8A_T21 (SEQ ID NO: 4156); HUMPAX8A_T33 (SEQ ID NO: 4158) |
| HUMPAX8A_P3 | HUMPAX8A_T5 (SEQ ID NO: 4151) |
| HUMPAX8A_P4 | HUMPAX8A_T15 (SEQ ID NO: 4155); HUMPAX8A_T27 (SEQ ID NO: 4157) |
| HUMPAX8A_P10 | HUMPAX8A_T34 (SEQ ID NO: 4159) |

These sequences are variants of the known protein Paired box protein Pax-8 (SwissProt accession identifier PAX8_HUMAN), referred to herein as the previously known protein.

Protein Paired box protein Pax-8 is known or believed to have the following function(s): Transcription factor for the thyroid-specific expression of the genes exclusively expressed in the thyroid cell type, maintaining the functional differentiation of such cells. The sequence for protein Paired box protein Pax-8 is given at the end of the application, as "Paired box protein Pax-8 amino acid sequence". Known polymorphisms for this sequence are as shown in Table 4901.

TABLE 4901

Amino acid mutations for Known Protein

| SNP position(s) on amino acid sequence | Comment |
|---|---|
| 31 | R -> H (in TD; loss of activity). /FTId = VAR_012769. |
| 40 | Q -> P (in TD; loss of activity). /FTId = VAR_012770. |
| 57 | C -> Y (in TD; loss of activity). /FTId = VAR_012771. |
| 62 | L -> R (in TD; loss of activity). /FTId = VAR_012772. |
| 329 | F -> L. /FTId = VAR_012773. |
| 300 | Missing |
| 418 | G -> R |

Protein Paired box protein Pax-8 localization is believed to be Nuclear.

The following GO Annotation(s) apply to the previously known protein. The following annotation(s) were found: transcription regulation; morphogenesis; cell differentiation, which are annotation(s) related to Biological Process; transcription factor; thyroid-stimulating hormone receptor, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMPAX8A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 122 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 122 and Table 4902. This cluster is overexpressed (at least at a minimum level) in the following pathological conditions: epithelial malignant tumors, a mixture of malignant tumors from different tissues, ovarian carcinoma and uterine malignancies.

TABLE 4902

Normal tissue distribution

| Name of Tissue | Number |
|---|---|
| brain | 3 |
| colon | 160 |
| epithelial | 66 |

TABLE 4902-continued

Normal tissue distribution

| Name of Tissue | Number |
|---|---|
| general | 27 |
| head and neck | 0 |
| kidney | 435 |
| lung | 10 |
| breast | 0 |
| bone marrow | 0 |
| ovary | 7 |
| pancreas | 10 |
| skin | 40 |
| stomach | 0 |
| Thyroid | 425 |
| uterus | 100 |

TABLE 4903

P values and ratios for expression in cancerous tissue

| Name of Tissue | P1 | P2 | SP1 | R3 | SP2 | R4 |
|---|---|---|---|---|---|---|
| brain | 7.5e−01 | 4.1e−01 | 3.9e−01 | 2.0 | 2.5e−01 | 2.2 |
| colon | 7.4e−01 | 6.5e−01 | 1 | 0.2 | 1 | 0.2 |
| epithelial | 4.2e−04 | 3.0e−02 | 1.0e−03 | 1.5 | 2.3e−01 | 1.0 |
| general | 5.9e−07 | 3.7e−04 | 2.3e−22 | 3.8 | 1.9e−11 | 2.4 |
| head and neck | 2.1e−01 | 3.3e−01 | 1 | 1.1 | 1 | 1.0 |
| kidney | 6.6e−01 | 7.6e−01 | 9.9e−01 | 0.5 | 9.9e−01 | 0.4 |
| lung | 5.1e−01 | 7.0e−01 | 6.5e−01 | 1.3 | 8.5e−01 | 0.8 |
| breast | 3.6e−01 | 4.5e−01 | 1 | 1.0 | 1 | 1.0 |
| bone marrow | 1 | 6.7e−01 | 1 | 1.0 | 5.3e−01 | 1.9 |
| ovary | 5.6e−02 | 5.2e−02 | 1.0e−02 | 4.8 | 9.9e−04 | 4.4 |
| pancreas | 2.6e−01 | 4.1e−01 | 2.1e−01 | 2.5 | 3.5e−01 | 1.8 |
| skin | 1.9e−01 | 5.8e−01 | 1.5e−01 | 3.3 | 9.4e−01 | 0.5 |
| stomach | 3.0e−01 | 6.7e−01 | 2.5e−01 | 3.0 | 6.4e−01 | 1.5 |
| Thyroid | 2.2e−01 | 2.2e−01 | 6.5e−01 | 0.9 | 6.5e−01 | 0.9 |
| uterus | 2.2e−02 | 1.8e−01 | 4.1e−05 | 3.2 | 1.9e−02 | 1.8 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 4904.

TABLE 4904

Oligonucleotides related to this cluster

| Oligonucleotide name | Overexpressed in cancers | Chip reference |
|---|---|---|
| HUMPAX8A_0_0_18307 | ovarian carcinoma | OVA |

As noted above, cluster HUMPAX8A features 29 segment(s), which were listed in Table 4899 above and for which the sequence(s) are given at the end of the application. These segment(s) are portions of nucleic acid sequence(s) which are described herein separately because they are of particular interest. A description of each segment according to the present invention is now provided.

Segment cluster HUMPAX8A_node_4 (SEQ ID NO:5417) according to the present invention is supported by 6 libraries. The number of libraries was determined as previously described. This segment can be found in the following transcript(s): HUMPAX8A_T5 (SEQ ID NO:4151). Table 4905 below describes the starting and ending position of this segment on each transcript.

TABLE 4905

Segment location on transcripts

| Transcript name | Segment starting position | Segment ending position |
|---|---|---|
| HUMPAX8A_T5 (SEQ ID NO: 4151) | 1 | 769 |

This segment can be found in a non-coding region of transcript(s) that are related to the following protein(s): HUMPAX8A_P3.

Segment cluster HUMPAX8A_node_5 (SEQ ID NO:5418) according to the present invention is supported by 25 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4906 below describes the starting and ending position of this segment on each transcript.

TABLE 4906

Segment location on transcripts

| Transcript name | Segment starting position | Segment ending position |
|---|---|---|
| HUMPAX8A_T0 (SEQ ID NO: 4147) | 196 | 361 |
| HUMPAX8A_T2 (SEQ ID NO: 4148) | 196 | 361 |
| HUMPAX8A_T3 (SEQ ID NO: 4149) | 196 | 361 |
| HUMPAX8A_T4 (SEQ ID NO: 4150) | 196 | 361 |
| HUMPAX8A_T5 (SEQ ID NO: 4151) | 770 | 935 |
| HUMPAX8A_T7 (SEQ ID NO: 4152) | 196 | 361 |
| HUMPAX8A_T9 (SEQ ID NO: 4153) | 196 | 361 |
| HUMPAX8A_T10 (SEQ ID NO: 4154) | 196 | 361 |
| HUMPAX8A_T21 (SEQ ID NO: 4156) | 196 | 361 |
| HUMPAX8A_T33 (SEQ ID NO: 4158) | 196 | 361 |
| HUMPAX8A_T34 (SEQ ID NO: 4159) | 196 | 361 |

This segment can be found in both coding and non-coding regions of transcript(s) as follows. The segment can be found in a non-coding region of transcript(s) that are related to the following protein(s): HUMPAX8A_P3. This segment can also be found in the following protein(s): HUMPAX8A_P1 and HUMPAX8A_P10, since it is in the coding region for the corresponding transcript.

Segment cluster HUMPAX8A_node_8 (SEQ ID NO:5419) according to the present invention is supported by 23 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4907 below describes the starting and ending position of this segment on each transcript.

TABLE 4907

Segment location on transcripts

| Transcript name | Segment starting position | Segment ending position |
|---|---|---|
| HUMPAX8A_T0 (SEQ ID NO: 4147) | 362 | 559 |
| HUMPAX8A_T2 (SEQ ID NO: 4148) | 362 | 559 |
| HUMPAX8A_T3 (SEQ ID NO: 4149) | 362 | 559 |
| HUMPAX8A_T4 (SEQ ID NO: 4150) | 362 | 559 |
| HUMPAX8A_T5 (SEQ ID NO: 4151) | 936 | 1133 |
| HUMPAX8A_T7 (SEQ ID NO: 4152) | 362 | 559 |
| HUMPAX8A_T9 (SEQ ID NO: 4153) | 362 | 559 |
| HUMPAX8A_T10 (SEQ ID NO: 4154) | 362 | 559 |
| HUMPAX8A_T21 (SEQ ID NO: 4156) | 362 | 559 |
| HUMPAX8A_T33 (SEQ ID NO: 4158) | 362 | 559 |
| HUMPAX8A_T34 (SEQ ID NO: 4159) | 362 | 559 |

This segment can be found in the following protein(s): HUMPAX8A_P1, HUMPAX8A_P3 and HUMPAX8A_P10.

Segment cluster HUMPAX8A_node_15 (SEQ ID NO:5420) according to the present invention is supported by 24 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4908 below describes the starting and ending position of this segment on each transcript.

TABLE 4908

Segment location on transcripts

| Transcript name | Segment starting position | Segment ending position |
|---|---|---|
| HUMPAX8A_T0 (SEQ ID NO: 4147) | 649 | 771 |
| HUMPAX8A_T2 (SEQ ID NO: 4148) | 649 | 771 |
| HUMPAX8A_T3 (SEQ ID NO: 4149) | 649 | 771 |
| HUMPAX8A_T4 (SEQ ID NO: 4150) | 649 | 771 |
| HUMPAX8A_T5 (SEQ ID NO: 4151) | 1223 | 1345 |
| HUMPAX8A_T7 (SEQ ID NO: 4152) | 649 | 771 |
| HUMPAX8A_T9 (SEQ ID NO: 4153) | 649 | 771 |
| HUMPAX8A_T10 (SEQ ID NO: 4154) | 649 | 771 |
| HUMPAX8A_T21 (SEQ ID NO: 4156) | 649 | 771 |
| HUMPAX8A_T33 (SEQ ID NO: 4158) | 649 | 771 |
| HUMPAX8A_T34 (SEQ ID NO: 4159) | 649 | 771 |

This segment can be found in the following protein(s): HUMPAX8A_P1, HUMPAX8A_P3 and HUMPAX8A_P10.

Segment cluster HUMPAX8A_node_17 (SEQ ID NO:5421) according to the present invention is supported by 32 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T 0 (SEQ ID NO:4154), HUMPAX8A_T21

(SEQ ID NO:4156), HUMPAX8A_T33 (SEQ ID NO:4158) and HUMPAX8A_T34 (SEQ ID NO:4159). Table 4909 below describes the starting and ending position of this segment on each transcript.

TABLE 4909

Segment location on transcripts

| Transcript name | Segment starting position | Segment ending position |
|---|---|---|
| HUMPAX8A_T0 (SEQ ID NO: 4147) | 772 | 947 |
| HUMPAX8A_T2 (SEQ ID NO: 4148) | 772 | 947 |
| HUMPAX8A_T3 (SEQ ID NO: 4149) | 772 | 947 |
| HUMPAX8A_T4 (SEQ ID NO: 4150) | 772 | 947 |
| HUMPAX8A_T5 (SEQ ID NO: 4151) | 1346 | 1521 |
| HUMPAX8A_T7 (SEQ ID NO: 4152) | 772 | 947 |
| HUMPAX8A_T9 (SEQ ID NO: 4153) | 772 | 947 |
| HUMPAX8A_T10 (SEQ ID NO: 4154) | 772 | 947 |
| HUMPAX8A_T21 (SEQ ID NO: 4156) | 772 | 947 |
| HUMPAX8A_T33 (SEQ ID NO: 4158) | 772 | 947 |
| HUMPAX8A_T34 (SEQ ID NO: 4159) | 772 | 947 |

This segment can be found in the following protein(s): HUMPAX8A_P1, HUMPAX8A_P3 and HUMPAX8A_P10.

Segment cluster HUMPAX8A_node_18 (SEQ ID NO:5422) according to the present invention is supported by 32 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156) and HUMPAX8A_T33 (SEQ ID NO:4158). Table 4910 below describes the starting and ending position of this segment on each transcript.

TABLE 4910

Segment location on transcripts

| Transcript name | Segment starting position | Segment ending position |
|---|---|---|
| HUMPAX8A_T0 (SEQ ID NO: 4147) | 948 | 2056 |
| HUMPAX8A_T2 (SEQ ID NO: 4148) | 948 | 2056 |
| HUMPAX8A_T3 (SEQ ID NO: 4149) | 948 | 2056 |
| HUMPAX8A_T4 (SEQ ID NO: 4150) | 948 | 2056 |
| HUMPAX8A_T5 (SEQ ID NO: 4151) | 1522 | 2630 |
| HUMPAX8A_T7 (SEQ ID NO: 4152) | 948 | 2056 |
| HUMPAX8A_T9 (SEQ ID NO: 4153) | 948 | 2056 |
| HUMPAX8A_T10 (SEQ ID NO: 4154) | 948 | 2056 |
| HUMPAX8A_T21 (SEQ ID NO: 4156) | 948 | 2056 |
| HUMPAX8A_T33 (SEQ ID NO: 4158) | 948 | 2056 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 4911.

TABLE 4911

Oligonucleotides related to this segment

| Oligonucleotide name | Overexpressed in cancers | Chip reference |
|---|---|---|
| HUMPAX8A_0_0_18296 | ovarian carcinoma | OVA |

This segment can be found in the following protein(s): HUMPAX8A_P1 and HUMPAX8A_P3.

Segment cluster HUMPAX8A_node_20 (SEQ ID NO:5423) according to the present invention is supported by 46 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156) and HUMPAX8A_T33 (SEQ ID NO:4158). Table 4912 below describes the starting and ending position of this segment on each transcript.

TABLE 4912

Segment location on transcripts

| Transcript name | Segment starting position | Segment ending position |
|---|---|---|
| HUMPAX8A_T0 (SEQ ID NO: 4147) | 2103 | 4961 |
| HUMPAX8A_T2 (SEQ ID NO: 4148) | 2103 | 4961 |
| HUMPAX8A_T3 (SEQ ID NO: 4149) | 2103 | 4961 |
| HUMPAX8A_T4 (SEQ ID NO: 4150) | 2103 | 4961 |
| HUMPAX8A_T5 (SEQ ID NO: 4151) | 2677 | 5535 |
| HUMPAX8A_T7 (SEQ ID NO: 4152) | 2103 | 4961 |
| HUMPAX8A_T9 (SEQ ID NO: 4153) | 2103 | 4961 |
| HUMPAX8A_T10 (SEQ ID NO: 4154) | 2103 | 4961 |
| HUMPAX8A_T21 (SEQ ID NO: 4156) | 2103 | 4961 |
| HUMPAX8A_T33 (SEQ ID NO: 4158) | 2103 | 4961 |

This segment can be found in a non-coding region of transcript(s) that are related to the following protein(s): HUMPAX8A_P1 and HUMPAX8A_P3.

Segment cluster HUMPAX8A_node_21 (SEQ ID NO:5424) according to the present invention is supported by 26 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156) and HUMPAX8A_T33 (SEQ ID NO:4158). Table 4913 below describes the starting and ending position of this segment on each transcript.

TABLE 4913

Segment location on transcripts

| Transcript name | Segment starting position | Segment ending position |
|---|---|---|
| HUMPAX8A_T0 (SEQ ID NO: 4147) | 4962 | 5777 |
| HUMPAX8A_T2 (SEQ ID NO: 4148) | 4962 | 5777 |

TABLE 4913-continued

Segment location on transcripts

| Transcript name | Segment starting position | Segment ending position |
|---|---|---|
| HUMPAX8A_T3 (SEQ ID NO: 4149) | 4962 | 5777 |
| HUMPAX8A_T4 (SEQ ID NO: 4150) | 4962 | 5777 |
| HUMPAX8A_T5 (SEQ ID NO: 4151) | 5536 | 6351 |
| HUMPAX8A_T7 (SEQ ID NO: 4152) | 4962 | 5777 |
| HUMPAX8A_T9 (SEQ ID NO: 4153) | 4962 | 5777 |
| HUMPAX8A_T10 (SEQ ID NO: 4154) | 4962 | 5777 |
| HUMPAX8A_T21 (SEQ ID NO: 4156) | 4962 | 5777 |
| HUMPAX8A_T33 (SEQ ID NO: 4158) | 4962 | 5777 |

This segment can be found in a non-coding region of transcript(s) that are related to the following protein(s): HUMPAX8A_P1 and HUMPAX8A_P3.

Segment cluster HUMPAX8A_node_22 (SEQ ID NO:5425) according to the present invention is supported by 27 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4914 below describes the starting and ending position of this segment on each transcript.

TABLE 4914

Segment location on transcripts

| Transcript name | Segment starting position | Segment ending position |
|---|---|---|
| HUMPAX8A_T0 (SEQ ID NO: 4147) | 5778 | 5898 |
| HUMPAX8A_T2 (SEQ ID NO: 4148) | 5778 | 5898 |
| HUMPAX8A_T3 (SEQ ID NO: 4149) | 5778 | 5898 |
| HUMPAX8A_T4 (SEQ ID NO: 4150) | 5778 | 5898 |
| HUMPAX8A_T5 (SEQ ID NO: 4151) | 6352 | 6472 |
| HUMPAX8A_T7 (SEQ ID NO: 4152) | 5778 | 5898 |
| HUMPAX8A_T9 (SEQ ID NO: 4153) | 5778 | 5898 |
| HUMPAX8A_T10 (SEQ ID NO: 4154) | 5778 | 5898 |
| HUMPAX8A_T21 (SEQ ID NO: 4156) | 5778 | 5898 |
| HUMPAX8A_T33 (SEQ ID NO: 4158) | 5778 | 5898 |
| HUMPAX8A_T34 (SEQ ID NO: 4159) | 948 | 1068 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P10, since it is in the coding region for the corresponding transcript.

Segment cluster HUMPAX8A_node_32 (SEQ ID NO:5426) according to the present invention is supported by 18 libraries. The number of libraries was determined as previously described. This segment can be found in the following transcript(s): HUMPAX8A_T21 (SEQ ID NO:4156), HUMPAX8A_T33 (SEQ ID NO:4158) and HUMPAX8A_T34 (SEQ ID NO:4159). Table 4915 below describes the starting and ending position of this segment on each transcript.

TABLE 4915

Segment location on transcripts

| Transcript name | Segment starting position | Segment ending position |
|---|---|---|
| HUMPAX8A_T21 (SEQ ID NO: 4156) | 6246 | 7054 |
| HUMPAX8A_T33 (SEQ ID NO: 4158) | 6246 | 7054 |
| HUMPAX8A_T34 (SEQ ID NO: 4159) | 1416 | 2224 |

This segment can be found in both coding and non-coding regions of transcript(s) as follows. The segment can be found in a non-coding region of transcript(s) that are related to the following protein(s): HUMPAX8A_P1. This segment can also be found in the following protein(s): HUMPAX8A_P10, since it is in the coding region for the corresponding transcript.

Segment cluster HUMPAX8A_node_39 (SEQ ID NO:5427) according to the present invention is supported by 51 libraries. The number of libraries was determined as previously described. This segment can be found in the following transcript(s): HUMPAX8A_T15 (SEQ ID NO:4155) and HUMPAX8A_T27 (SEQ ID NO:4157). Table 4916 below describes the starting and ending position of this segment on each transcript.

TABLE 4916

Segment location on transcripts

| Transcript name | Segment starting position | Segment ending position |
|---|---|---|
| HUMPAX8A_T15 (SEQ ID NO: 4155) | 1 | 4254 |
| HUMPAX8A_T27 (SEQ ID NO: 4157) | 1 | 4254 |

This segment can be found in a non-coding region of transcript(s) that are related to the following protein(s): HUMPAX8A_P4.

Segment cluster HUMPAX8A_node_41 (SEQ ID NO:5428) according to the present invention is supported by 5 libraries. The number of libraries was determined as previously described. This segment can be found in the following transcript(s): HUMPAX8A_T4 (SEQ ID NO:4150) and HUMPAX8A_T10 (SEQ ID NO:4154). Table 4917 below describes the starting and ending position of this segment on each transcript.

TABLE 4917

Segment location on transcripts

| Transcript name | Segment starting position | Segment ending position |
|---|---|---|
| HUMPAX8A_T4 (SEQ ID NO: 4150) | 6333 | 7814 |
| HUMPAX8A_T10 (SEQ ID NO: 4154) | 6333 | 7814 |

This segment can be found in a non-coding region of transcript(s) that are related to the following protein(s): HUMPAX8A_P1.

Segment cluster HUMPAX8A_node_42 (SEQ ID NO:5429) according to the present invention is supported by 69 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4918 below describes the starting and ending position of this segment on each transcript.

TABLE 4918

Segment location on transcripts

| Transcript name | Segment starting position | Segment ending position |
|---|---|---|
| HUMPAX8A_T0 (SEQ ID NO: 4147) | 6277 | 6656 |
| HUMPAX8A_T2 (SEQ ID NO: 4148) | 6277 | 6656 |
| HUMPAX8A_T3 (SEQ ID NO: 4149) | 6088 | 6467 |
| HUMPAX8A_T4 (SEQ ID NO: 4150) | 7815 | 8194 |
| HUMPAX8A_T5 (SEQ ID NO: 4151) | 6851 | 7230 |
| HUMPAX8A_T7 (SEQ ID NO: 4152) | 6333 | 6712 |
| HUMPAX8A_T9 (SEQ ID NO: 4153) | 6277 | 6656 |
| HUMPAX8A_T10 (SEQ ID NO: 4154) | 7815 | 8194 |
| HUMPAX8A_T15 (SEQ ID NO: 4155) | 4342 | 4721 |
| HUMPAX8A_T27 (SEQ ID NO: 4157) | 4342 | 4721 |

This segment can be found in a non-coding region of transcript(s) that are related to the following protein(s): HUMPAX8A_P1, HUMPAX8A_P3 and HUMPAX8A_P4.

Segment cluster HUMPAX8A_node_43 (SEQ ID NO:5430) according to the present invention is supported by 60 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4919 below describes the starting and ending position of this segment on each transcript.

TABLE 4919

Segment location on transcripts

| Transcript name | Segment starting position | Segment ending position |
|---|---|---|
| HUMPAX8A_T0 (SEQ ID NO: 4147) | 6657 | 6789 |
| HUMPAX8A_T2 (SEQ ID NO: 4148) | 6657 | 6789 |
| HUMPAX8A_T3 (SEQ ID NO: 4149) | 6468 | 6600 |
| HUMPAX8A_T4 (SEQ ID NO: 4150) | 8195 | 8327 |
| HUMPAX8A_T5 (SEQ ID NO: 4151) | 7231 | 7363 |
| HUMPAX8A_T7 (SEQ ID NO: 4152) | 6713 | 6845 |
| HUMPAX8A_T9 (SEQ ID NO: 4153) | 6657 | 6789 |
| HUMPAX8A_T10 (SEQ ID NO: 4154) | 8195 | 8327 |
| HUMPAX8A_T15 (SEQ ID NO: 4155) | 4722 | 4854 |
| HUMPAX8A_T27 (SEQ ID NO: 4157) | 4722 | 4854 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Segment cluster HUMPAX8A_node_44 (SEQ ID NO:5431) according to the present invention is supported by 93 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4920 below describes the starting and ending position of this segment on each transcript.

TABLE 4920

Segment location on transcripts

| Transcript name | Segment starting position | Segment ending position |
|---|---|---|
| HUMPAX8A_T0 (SEQ ID NO: 4147) | 6790 | 7111 |
| HUMPAX8A_T2 (SEQ ID NO: 4148) | 6790 | 7111 |
| HUMPAX8A_T3 (SEQ ID NO: 4149) | 6601 | 6922 |
| HUMPAX8A_T4 (SEQ ID NO: 4150) | 8328 | 8649 |
| HUMPAX8A_T5 (SEQ ID NO: 4151) | 7364 | 7685 |
| HUMPAX8A_T7 (SEQ ID NO: 4152) | 6846 | 7167 |
| HUMPAX8A_T9 (SEQ ID NO: 4153) | 6790 | 7111 |
| HUMPAX8A_T10 (SEQ ID NO: 4154) | 8328 | 8649 |
| HUMPAX8A_T15 (SEQ ID NO: 4155) | 4855 | 5176 |
| HUMPAX8A_T27 (SEQ ID NO: 4157) | 4855 | 5176 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Segment cluster HUMPAX8A_node_49 (SEQ ID NO:5432) according to the present invention is supported by 85 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4921 below describes the starting and ending position of this segment on each transcript.

TABLE 4921

Segment location on transcripts

| Transcript name | Segment starting position | Segment ending position |
|---|---|---|
| HUMPAX8A_T0 (SEQ ID NO: 4147) | 7168 | 7339 |
| HUMPAX8A_T2 (SEQ ID NO: 4148) | 7168 | 7339 |
| HUMPAX8A_T3 (SEQ ID NO: 4149) | 6979 | 7150 |
| HUMPAX8A_T4 (SEQ ID NO: 4150) | 8706 | 8877 |
| HUMPAX8A_T5 (SEQ ID NO: 4151) | 7742 | 7913 |
| HUMPAX8A_T7 (SEQ ID NO: 4152) | 7224 | 7395 |
| HUMPAX8A_T9 (SEQ ID NO: 4153) | 7168 | 7339 |
| HUMPAX8A_T10 (SEQ ID NO: 4154) | 8706 | 8877 |
| HUMPAX8A_T15 (SEQ ID NO: 4155) | 5233 | 5404 |
| HUMPAX8A_T27 (SEQ ID NO: 4157) | 5233 | 5404 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Segment cluster HUMPAX8A_node_50 (SEQ ID NO:5433) according to the present invention is supported by 103 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155), HUMPAX8A_T21 (SEQ ID NO:4156), HUMPAX8A_T27 (SEQ ID NO:4157), HUMPAX8A_T33 (SEQ ID NO:4158) and HUMPAX8A_T34 (SEQ ID NO:4159). Table 4922 below describes the starting and ending position of this segment on each transcript.

TABLE 4922

Segment location on transcripts

| Transcript name | Segment starting position | Segment ending position |
|---|---|---|
| HUMPAX8A_T0 (SEQ ID NO: 4147) | 7340 | 10373 |
| HUMPAX8A_T2 (SEQ ID NO: 4148) | 7340 | 8889 |
| HUMPAX8A_T3 (SEQ ID NO: 4149) | 7151 | 10184 |
| HUMPAX8A_T4 (SEQ ID NO: 4150) | 8878 | 11911 |
| HUMPAX8A_T5 (SEQ ID NO: 4151) | 7914 | 10947 |
| HUMPAX8A_T7 (SEQ ID NO: 4152) | 7396 | 10429 |
| HUMPAX8A_T9 (SEQ ID NO: 4153) | 7340 | 7524 |
| HUMPAX8A_T10 (SEQ ID NO: 4154) | 8878 | 9062 |
| HUMPAX8A_T15 (SEQ ID NO: 4155) | 5405 | 8438 |
| HUMPAX8A_T21 (SEQ ID NO: 4156) | 7055 | 10088 |
| HUMPAX8A_T27 (SEQ ID NO: 4157) | 5405 | 5589 |
| HUMPAX8A_T33 (SEQ ID NO: 4158) | 7055 | 7239 |
| HUMPAX8A_T34 (SEQ ID NO: 4159) | 2225 | 5258 |

This segment can be found in both coding and non-coding regions of transcript(s) as follows. The segment can be found in a non-coding region of transcript(s) that are related to the following protein(s): HUMPAX8A_P1, HUMPAX8A_P3 and HUMPAX8A_P10. This segment can also be found in the following protein(s): HUMPAX8A_P4, since it is in the coding region for the corresponding transcript.

According to an optional embodiment of the present invention, short segments related to the above cluster are also provided. These segments are up to about 120 bp in length, and so are included in a separate description.

Segment cluster HUMPAX8A_node_0 (SEQ ID NO:5434) according to the present invention is supported by 16 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4923 below describes the starting and ending position of this segment on each transcript.

TABLE 4923

Segment location on transcripts

| Transcript name | Segment starting position | Segment ending position |
|---|---|---|
| HUMPAX8A_T0 (SEQ ID NO: 4147) | 1 | 95 |
| HUMPAX8A_T2 (SEQ ID NO: 4148) | 1 | 95 |
| HUMPAX8A_T3 (SEQ ID NO: 4149) | 1 | 95 |
| HUMPAX8A_T4 (SEQ ID NO: 4150) | 1 | 95 |
| HUMPAX8A_T7 (SEQ ID NO: 4152) | 1 | 95 |
| HUMPAX8A_T9 (SEQ ID NO: 4153) | 1 | 95 |
| HUMPAX8A_T10 (SEQ ID NO: 4154) | 1 | 95 |
| HUMPAX8A_T21 (SEQ ID NO: 4156) | 1 | 95 |
| HUMPAX8A_T33 (SEQ ID NO: 4158) | 1 | 95 |
| HUMPAX8A_T34 (SEQ ID NO: 4159) | 1 | 95 |

This segment can be found in a non-coding region of transcript(s) that are related to the following protein(s): HUMPAX8A_P1 and HUMPAX8A_P10.

Segment cluster HUMPAX8A_node_2 (SEQ ID NO:5435) according to the present invention is supported by 18 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4924 below describes the starting and ending position of this segment on each transcript.

TABLE 4924

Segment location on transcripts

| Transcript name | Segment starting position | Segment ending position |
|---|---|---|
| HUMPAX8A_T0 (SEQ ID NO: 4147) | 96 | 195 |
| HUMPAX8A_T2 (SEQ ID NO: 4148) | 96 | 195 |
| HUMPAX8A_T3 (SEQ ID NO: 4149) | 96 | 195 |
| HUMPAX8A_T4 (SEQ ID NO: 4150) | 96 | 195 |
| HUMPAX8A_T7 (SEQ ID NO: 4152) | 96 | 195 |
| HUMPAX8A_T9 (SEQ ID NO: 4153) | 96 | 195 |
| HUMPAX8A_T10 (SEQ ID NO: 4154) | 96 | 195 |
| HUMPAX8A_T21 (SEQ ID NO: 4156) | 96 | 195 |
| HUMPAX8A_T33 (SEQ ID NO: 4158) | 96 | 195 |
| HUMPAX8A_T34 (SEQ ID NO: 4159) | 96 | 195 |

This segment can be found in the following protein(s): HUMPAX8A_P1 and HUMPAX8A_P10.

Segment cluster HUMPAX8A_node_12 (SEQ ID NO:5436) according to the present invention is supported by 27 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4925 below describes the starting and ending position of this segment on each transcript.

TABLE 4925

Segment location on transcripts

| Transcript name | Segment starting position | Segment ending position |
|---|---|---|
| HUMPAX8A_T0 (SEQ ID NO: 4147) | 560 | 648 |
| HUMPAX8A_T2 (SEQ ID NO: 4148) | 560 | 648 |
| HUMPAX8A_T3 (SEQ ID NO: 4149) | 560 | 648 |
| HUMPAX8A_T4 (SEQ ID NO: 4150) | 560 | 648 |
| HUMPAX8A_T5 (SEQ ID NO: 4151) | 1134 | 1222 |
| HUMPAX8A_T7 (SEQ ID NO: 4152) | 560 | 648 |
| HUMPAX8A_T9 (SEQ ID NO: 4153) | 560 | 648 |
| HUMPAX8A_T10 (SEQ ID NO: 4154) | 560 | 648 |
| HUMPAX8A_T21 (SEQ ID NO: 4156) | 560 | 648 |
| HUMPAX8A_T33 (SEQ ID NO: 4158) | 560 | 648 |
| HUMPAX8A_T34 (SEQ ID NO: 4159) | 560 | 648 |

This segment can be found in the following protein(s): HUMPAX8A_P1, HUMPAX8A_P3 and HUMPAX8A_P10.

Segment cluster HUMPAX8A_node_19 (SEQ ID NO:5437) according to the present invention is supported by 7 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156) and HUMPAX8A_T33 (SEQ ID NO:4158). Table 4926 below describes the starting and ending position of this segment on each transcript.

TABLE 4926

Segment location on transcripts

| Transcript name | Segment starting position | Segment ending position |
|---|---|---|
| HUMPAX8A_T0 (SEQ ID NO: 4147) | 2057 | 2102 |
| HUMPAX8A_T2 (SEQ ID NO: 4148) | 2057 | 2102 |
| HUMPAX8A_T3 (SEQ ID NO: 4149) | 2057 | 2102 |
| HUMPAX8A_T4 (SEQ ID NO: 4150) | 2057 | 2102 |
| HUMPAX8A_T5 (SEQ ID NO: 4151) | 2631 | 2676 |
| HUMPAX8A_T7 (SEQ ID NO: 4152) | 2057 | 2102 |
| HUMPAX8A_T9 (SEQ ID NO: 4153) | 2057 | 2102 |
| HUMPAX8A_T10 (SEQ ID NO: 4154) | 2057 | 2102 |
| HUMPAX8A_T21 (SEQ ID NO: 4156) | 2057 | 2102 |
| HUMPAX8A_T33 (SEQ ID NO: 4158) | 2057 | 2102 |

This segment can be found in a non-coding region of transcript(s) that are related to the following protein(s): HUMPAX8A_P1 and HUMPAX8A_P3.

Segment cluster HUMPAX8A_node_24 (SEQ ID NO:5438) according to the present invention is supported by 19 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4927 below describes the starting and ending position of this segment on each transcript.

TABLE 4927

Segment location on transcripts

| Transcript name | Segment starting position | Segment ending position |
|---|---|---|
| HUMPAX8A_T0 (SEQ ID NO: 4147) | 5899 | 5977 |
| HUMPAX8A_T2 (SEQ ID NO: 4148) | 5899 | 5977 |
| HUMPAX8A_T4 (SEQ ID NO: 4150) | 5899 | 5977 |
| HUMPAX8A_T5 (SEQ ID NO: 4151) | 6473 | 6551 |
| HUMPAX8A_T7 (SEQ ID NO: 4152) | 5899 | 5977 |
| HUMPAX8A_T9 (SEQ ID NO: 4153) | 5899 | 5977 |
| HUMPAX8A_T10 (SEQ ID NO: 4154) | 5899 | 5977 |
| HUMPAX8A_T21 (SEQ ID NO: 4156) | 5899 | 5977 |
| HUMPAX8A_T33 (SEQ ID NO: 4158) | 5899 | 5977 |
| HUMPAX8A_T34 (SEQ ID NO: 4159) | 1069 | 1147 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P10, since it is in the coding region for the corresponding transcript.

Segment cluster HUMPAX8A_node_25 (SEQ ID NO:5439) according to the present invention is supported by 29 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4928 below describes the starting and ending position of this segment on each transcript.

TABLE 4928

Segment location on transcripts

| Transcript name | Segment starting position | Segment ending position |
|---|---|---|
| HUMPAX8A_T0 (SEQ ID NO: 4147) | 5978 | 6087 |
| HUMPAX8A_T2 (SEQ ID NO: 4148) | 5978 | 6087 |
| HUMPAX8A_T4 (SEQ ID NO: 4150) | 5978 | 6087 |
| HUMPAX8A_T5 (SEQ ID NO: 4151) | 6552 | 6661 |
| HUMPAX8A_T7 (SEQ ID NO: 4152) | 5978 | 6087 |
| HUMPAX8A_T9 (SEQ ID NO: 4153) | 5978 | 6087 |
| HUMPAX8A_T10 (SEQ ID NO: 4154) | 5978 | 6087 |
| HUMPAX8A_T21 (SEQ ID NO: 4156) | 5978 | 6087 |
| HUMPAX8A_T33 (SEQ ID NO: 4158) | 5978 | 6087 |
| HUMPAX8A_T34 (SEQ ID NO: 4159) | 1148 | 1257 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P10, since it is in the coding region for the corresponding transcript.

Segment cluster HUMPAX8A_node_30 (SEQ ID NO:5440) according to the present invention is supported by 31 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3

(SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4929 below describes the starting and ending position of this segment on each transcript.

TABLE 4929

Segment location on transcripts

| Transcript name | Segment starting position | Segment ending position |
|---|---|---|
| HUMPAX8A_T0 (SEQ ID NO: 4147) | 6088 | 6189 |
| HUMPAX8A_T2 (SEQ ID NO: 4148) | 6088 | 6189 |
| HUMPAX8A_T3 (SEQ ID NO: 4149) | 5899 | 6000 |
| HUMPAX8A_T4 (SEQ ID NO: 4150) | 6088 | 6189 |
| HUMPAX8A_T5 (SEQ ID NO: 4151) | 6662 | 6763 |
| HUMPAX8A_T7 (SEQ ID NO: 4152) | 6088 | 6189 |
| HUMPAX8A_T9 (SEQ ID NO: 4153) | 6088 | 6189 |
| HUMPAX8A_T10 (SEQ ID NO: 4154) | 6088 | 6189 |
| HUMPAX8A_T21 (SEQ ID NO: 4156) | 6088 | 6189 |
| HUMPAX8A_T33 (SEQ ID NO: 4158) | 6088 | 6189 |
| HUMPAX8A_T34 (SEQ ID NO: 4159) | 1258 | 1359 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P10, since it is in the coding region for the corresponding transcript.

Segment cluster HUMPAX8A_node_31 (SEQ ID NO:5441) according to the present invention is supported by 10 libraries. The number of libraries was determined as previously described. This segment can be found in the following transcript(s): HUMPAX8A_T4 (SEQ ID NO:4150), HUMPAX8A_T7 (SEQ ID NO:4152), HUMPAX8A_T10 (SEQ ID NO:4154), HUMPAX8A_T21 (SEQ ID NO:4156), HUMPAX8A_T33 (SEQ ID NO:4158) and HUMPAX8A_T34 (SEQ ID NO:4159). Table 4930 below describes the starting and ending position of this segment on each transcript.

TABLE 4930

Segment location on transcripts

| Transcript name | Segment starting position | Segment ending position |
|---|---|---|
| HUMPAX8A_T4 (SEQ ID NO: 4150) | 6190 | 6245 |
| HUMPAX8A_T7 (SEQ ID NO: 4152) | 6190 | 6245 |
| HUMPAX8A_T10 (SEQ ID NO: 4154) | 6190 | 6245 |
| HUMPAX8A_T21 (SEQ ID NO: 4156) | 6190 | 6245 |
| HUMPAX8A_T33 (SEQ ID NO: 4158) | 6190 | 6245 |
| HUMPAX8A_T34 (SEQ ID NO: 4159) | 1360 | 1415 |

This segment can be found in both coding and non-coding regions of transcript(s) as follows. The segment can be found in a non-coding region of transcript(s) that are related to the following protein(s): HUMPAX8A_P1. This segment can also be found in the following protein(s): HUMPAX8A_P10, since it is in the coding region for the corresponding transcript.

Segment cluster HUMPAX8A_node_40 (SEQ ID NO:5442) according to the present invention is supported by 41 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4931 below describes the starting and ending position of this segment on each transcript.

TABLE 4931

Segment location on transcripts

| Transcript name | Segment starting position | Segment ending position |
|---|---|---|
| HUMPAX8A_T0 (SEQ ID NO: 4147) | 6190 | 6276 |
| HUMPAX8A_T2 (SEQ ID NO: 4148) | 6190 | 6276 |
| HUMPAX8A_T3 (SEQ ID NO: 4149) | 6001 | 6087 |
| HUMPAX8A_T4 (SEQ ID NO: 4150) | 6246 | 6332 |
| HUMPAX8A_T5 (SEQ ID NO: 4151) | 6764 | 6850 |
| HUMPAX8A_T7 (SEQ ID NO: 4152) | 6246 | 6332 |
| HUMPAX8A_T9 (SEQ ID NO: 4153) | 6190 | 6276 |
| HUMPAX8A_T10 (SEQ ID NO: 4154) | 6246 | 6332 |
| HUMPAX8A_T15 (SEQ ID NO: 4155) | 4255 | 4341 |
| HUMPAX8A_T27 (SEQ ID NO: 4157) | 4255 | 4341 |

This segment can be found in a non-coding region of transcript(s) that are related to the following protein(s): HUMPAX8A_P1, HUMPAX8A_P3 and HUMPAX8A_P4.

Segment cluster HUMPAX8A_node_46 (SEQ ID NO:5443) according to the present invention can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4932 below describes the starting and ending position of this segment on each transcript.

TABLE 4932

Segment location on transcripts

| Transcript name | Segment starting position | Segment ending position |
|---|---|---|
| HUMPAX8A_T0 (SEQ ID NO: 4147) | 7112 | 7121 |
| HUMPAX8A_T2 (SEQ ID NO: 4148) | 7112 | 7121 |
| HUMPAX8A_T3 (SEQ ID NO: 4149) | 6923 | 6932 |
| HUMPAX8A_T4 (SEQ ID NO: 4150) | 8650 | 8659 |
| HUMPAX8A_T5 (SEQ ID NO: 4151) | 7686 | 7695 |
| HUMPAX8A_T7 (SEQ ID NO: 4152) | 7168 | 7177 |
| HUMPAX8A_T9 (SEQ ID NO: 4153) | 7112 | 7121 |
| HUMPAX8A_T10 (SEQ ID NO: 4154) | 8650 | 8659 |
| HUMPAX8A_T15 (SEQ ID NO: 4155) | 5177 | 5186 |
| HUMPAX8A_T27 (SEQ ID NO: 4157) | 5177 | 5186 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Segment cluster HUMPAX8A_node_47 (SEQ ID NO:5444) according to the present invention is supported by 69 libraries. The number of libraries was determined as previously described. This segment can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4933 below describes the starting and ending position of this segment on each transcript.

TABLE 4933

Segment location on transcripts

| Transcript name | Segment starting position | Segment ending position |
| --- | --- | --- |
| HUMPAX8A_T0 (SEQ ID NO: 4147) | 7122 | 7151 |
| HUMPAX8A_T2 (SEQ ID NO: 4148) | 7122 | 7151 |
| HUMPAX8A_T3 (SEQ ID NO: 4149) | 6933 | 6962 |
| HUMPAX8A_T4 (SEQ ID NO: 4150) | 8660 | 8689 |
| HUMPAX8A_T5 (SEQ ID NO: 4151) | 7696 | 7725 |
| HUMPAX8A_T7 (SEQ ID NO: 4152) | 7178 | 7207 |
| HUMPAX8A_T9 (SEQ ID NO: 4153) | 7122 | 7151 |
| HUMPAX8A_T10 (SEQ ID NO: 4154) | 8660 | 8689 |
| HUMPAX8A_T15 (SEQ ID NO: 4155) | 5187 | 5216 |
| HUMPAX8A_T27 (SEQ ID NO: 4157) | 5187 | 5216 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Segment cluster HUMPAX8A_node_48 (SEQ ID NO:5445) according to the present invention can be found in the following transcript(s): HUMPAX8A_T0 (SEQ ID NO:4147), HUMPAX8A_T2 (SEQ ID NO:4148), HUMPAX8A_T3 (SEQ ID NO:4149), HUMPAX8A_T4 (SEQ ID NO:4150), HUMPAX8A_T5 (SEQ ID NO:4151), HUMPAX8A_T7 (SEQ ID NO:4152), HUMPAX8A_T9 (SEQ ID NO:4153), HUMPAX8A_T10 (SEQ ID NO:4154), HUMPAX8A_T15 (SEQ ID NO:4155) and HUMPAX8A_T27 (SEQ ID NO:4157). Table 4934 below describes the starting and ending position of this segment on each transcript.

TABLE 4934

Segment location on transcripts

| Transcript name | Segment starting position | Segment ending position |
| --- | --- | --- |
| HUMPAX8A_T0 (SEQ ID NO: 4147) | 7152 | 7167 |
| HUMPAX8A_T2 (SEQ ID NO: 4148) | 7152 | 7167 |
| HUMPAX8A_T3 (SEQ ID NO: 4149) | 6963 | 6978 |
| HUMPAX8A_T4 (SEQ ID NO: 4150) | 8690 | 8705 |
| HUMPAX8A_T5 (SEQ ID NO: 4151) | 7726 | 7741 |
| HUMPAX8A_T7 (SEQ ID NO: 4152) | 7208 | 7223 |
| HUMPAX8A_T9 (SEQ ID NO: 4153) | 7152 | 7167 |
| HUMPAX8A_T10 (SEQ ID NO: 4154) | 8690 | 8705 |
| HUMPAX8A_T15 (SEQ ID NO: 4155) | 5217 | 5232 |
| HUMPAX8A_T27 (SEQ ID NO: 4157) | 5217 | 5232 |

This segment can be found in both coding and non-coding regions of transcript(s) as follows. The segment can be found in a non-coding region of transcript(s) that are related to the following protein(s): HUMPAX8A_P1 and HUMPAX8A_P3. This segment can also be found in the following protein(s): HUMPAX8A_P4, since it is in the coding region for the corresponding transcript.

Description for Cluster HUMPOMCZ

Cluster HUMPOMCZ features 5 transcript(s) and 53 segment(s) of interest, the names for which are given in Tables 4935 and 4936, respectively, the sequences themselves are given at the end of the application. The selected protein variants are given in Table 4937.

TABLE 4935

Transcripts of interest
Transcript Name

HUMPOMCZ_PEA_1_T3 (SEQ ID NO: 4160)
HUMPOMCZ_PEA_1_T6 (SEQ ID NO: 4161)
HUMPOMCZ_PEA_1_T8 (SEQ ID NO: 4162)
HUMPOMCZ_PEA_1_T9 (SEQ ID NO: 4163)
HUMPOMCZ_PEA_1_T10 (SEQ ID NO: 4164)

TABLE 4936

Segments of interest
Segment Name

HUMPOMCZ_PEA_1_node_0 (SEQ ID NO: 5446)
HUMPOMCZ_PEA_1_node_10 (SEQ ID NO: 5447)
HUMPOMCZ_PEA_1_node_56 (SEQ ID NO: 5448)
HUMPOMCZ_PEA_1_node_57 (SEQ ID NO: 5449)
HUMPOMCZ_PEA_1_node_1 (SEQ ID NO: 5450)
HUMPOMCZ_PEA_1_node_3 (SEQ ID NO: 5451)
HUMPOMCZ_PEA_1_node_4 (SEQ ID NO: 5452)
HUMPOMCZ_PEA_1_node_6 (SEQ ID NO: 5453)
HUMPOMCZ_PEA_1_node_8 (SEQ ID NO: 5454)
HUMPOMCZ_PEA_1_node_12 (SEQ ID NO: 5455)
HUMPOMCZ_PEA_1_node_13 (SEQ ID NO: 5456)
HUMPOMCZ_PEA_1_node_14 (SEQ ID NO: 5457)
HUMPOMCZ_PEA_1_node_15 (SEQ ID NO: 5458)
HUMPOMCZ_PEA_1_node_16 (SEQ ID NO: 5459)
HUMPOMCZ_PEA_1_node_17 (SEQ ID NO: 5460)
HUMPOMCZ_PEA_1_node_18 (SEQ ID NO: 5461)
HUMPOMCZ_PEA_1_node_19 (SEQ ID NO: 5462)
HUMPOMCZ_PEA_1_node_20 (SEQ ID NO: 5463)
HUMPOMCZ_PEA_1_node_21 (SEQ ID NO: 5464)
HUMPOMCZ_PEA_1_node_22 (SEQ ID NO: 5465)
HUMPOMCZ_PEA_1_node_23 (SEQ ID NO: 5466)

TABLE 4936-continued

Segments of interest
Segment Name

HUMPOMCZ_PEA_1_node_24 (SEQ ID NO: 5467)
HUMPOMCZ_PEA_1_node_25 (SEQ ID NO: 5468)
HUMPOMCZ_PEA_1_node_26 (SEQ ID NO: 5469)
HUMPOMCZ_PEA_1_node_27 (SEQ ID NO: 5470)
HUMPOMCZ_PEA_1_node_28 (SEQ ID NO: 5471)
HUMPOMCZ_PEA_1_node_29 (SEQ ID NO: 5472)
HUMPOMCZ_PEA_1_node_30 (SEQ ID NO: 5473)
HUMPOMCZ_PEA_1_node_31 (SEQ ID NO: 5474)
HUMPOMCZ_PEA_1_node_32 (SEQ ID NO: 5475)
HUMPOMCZ_PEA_1_node_33 (SEQ ID NO: 5476)
HUMPOMCZ_PEA_1_node_34 (SEQ ID NO: 5477)
HUMPOMCZ_PEA_1_node_35 (SEQ ID NO: 5478)
HUMPOMCZ_PEA_1_node_36 (SEQ ID NO: 5479)
HUMPOMCZ_PEA_1_node_37 (SEQ ID NO: 5480)
HUMPOMCZ_PEA_1_node_38 (SEQ ID NO: 5481)
HUMPOMCZ_PEA_1_node_39 (SEQ ID NO: 5482)
HUMPOMCZ_PEA_1_node_40 (SEQ ID NO: 5483)
HUMPOMCZ_PEA_1_node_41 (SEQ ID NO: 5484)
HUMPOMCZ_PEA_1_node_42 (SEQ ID NO: 5485)
HUMPOMCZ_PEA_1_node_43 (SEQ ID NO: 5486)
HUMPOMCZ_PEA_1_node_44 (SEQ ID NO: 5487)
HUMPOMCZ_PEA_1_node_45 (SEQ ID NO: 5488)
HUMPOMCZ_PEA_1_node_46 (SEQ ID NO: 5489)
HUMPOMCZ_PEA_1_node_47 (SEQ ID NO: 5490)
HUMPOMCZ_PEA_1_node_48 (SEQ ID NO: 5491)
HUMPOMCZ_PEA_1_node_49 (SEQ ID NO: 5492)
HUMPOMCZ_PEA_1_node_50 (SEQ ID NO: 5493)
HUMPOMCZ_PEA_1_node_51 (SEQ ID NO: 5494)
HUMPOMCZ_PEA_1_node_52 (SEQ ID NO: 5495)
HUMPOMCZ_PEA_1_node_53 (SEQ ID NO: 5496)
HUMPOMCZ_PEA_1_node_54 (SEQ ID NO: 5497)
HUMPOMCZ_PEA_1_node_55 (SEQ ID NO: 5498)

TABLE 4937

Proteins of interest

| Protein Name | Corresponding Transcript(s) |
| --- | --- |
| HUMPOMCZ_PEA_1_P1 | HUMPOMCZ_PEA_1_T3 (SEQ ID NO: 4160); HUMPOMCZ_PEA_1_T6 (SEQ ID NO: 4161); HUMPOMCZ_PEA_1_T8 (SEQ ID NO: 4162); HUMPOMCZ_PEA_1_T10 (SEQ ID NO: 4164); HUMPOMCZ_PEA_1_T9 (SEQ ID NO: 4163) |

These sequences are variants of the known protein Corticotropin-lipotropin precursor (SwissProt accession identifier COLI_HUMAN; known also according to the synonyms Pro-opiomelanocortin; POMC; Gamma-MSH; Adrenocorticotropic hormone; ACTH; Alpha-MSH; CLIP; Beta-LPH; Gamma-LPH; Beta-MSH), referred to herein as the previously known protein.

Protein Corticotropin-lipotropin precursor is known or believed to have the following function(s): ACTH stimulates the adrenal glands to release cortisol; MSH (melanocyte-stimulating hormone) increases the pigmentation of skin by increasing melanin production in melanocytes; Beta-endorphin and Met-enkephalin are endogenous opiates. The sequence for protein Corticotropin-lipotropin precursor is given at the end of the application, as "Corticotropin-lipotropin precursor amino acid sequence". Known polymorphisms for this sequence are as shown in Table 4938.

TABLE 4938

Amino acid mutations for Known Protein

| SNP position(s) on amino acid sequence | Comment |
| --- | --- |
| 7 | S -> T. /FTId = VAR_010699. |
| 9 | S -> L. /FTId = VAR_010700. |
| 97-99 | Missing. /FTId = VAR_010714. |
| 106 | D -> N. /FTId = VAR_010715. |
| 214 | E -> G. /FTId = VAR_010716. |
| 236 | R -> G. /FTId = VAR_010701. |
| 236 | R -> Q. /FTId = VAR_012201. |
| 48 | R -> G |
| 115 | P -> T |

The previously known protein also has the following indication(s) and/or potential therapeutic use(s): Arthritis, rheumatoid; Amnesia; Alzheimer's disease; Pain; Sexual dysfunction, male; Macular degeneration; Multiple sclerosis, chronic progressive; Multiple sclerosis, relapsing-remitting; Multiple sclerosis. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Adenylate cyclase stimulant; Corticotropin releasing factor agonist; Cyclic AMP agonist; Lipocortins synthesis agonist; Melanocortin agonist; Melanocyte stimulating hormone agonist; Opioid agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: ACTH; Diagnostic; Antiarthritic; Cognition enhancer; Symptomatic antidiabetic; Radio/chemoprotective; Neurological; Analgesic; Male sexual dysfunction; Reproductive/gonadal, general; Multiple sclerosis treatment; Hormone; Opthalmological.

The following GO Annotation(s) apply to the previously known protein. The following annotation(s) were found: energy pathways; signal transduction; neuropeptide signaling pathway; cell-cell signaling, which are annotation(s) related to Biological Process; hormone, which are annotation(s) related to Molecular Function; and extracellular; soluble fraction, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMPOMCZ features 53 segment(s), which were listed in Table 4936 above and for which the sequence(s) are given at the end of the application. These segment(s) are portions of nucleic acid sequence(s) which are described herein separately because they are of particular interest. A description of each segment according to the present invention is now provided.

Segment cluster HUMPOMCZ_PEA_1_node_0 (SEQ ID NO:5446) according to the present invention is supported by 31 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4939 below describes the starting and ending position of this segment on each transcript.

TABLE 4939

| Segment location on transcripts | | |
|---|---|---|
| Transcript name | Segment starting position | Segment ending position |
| HUMPOMCZ_PEA_1_T3 (SEQ ID NO: 4160) | 1 | 389 |
| HUMPOMCZ_PEA_1_T6 (SEQ ID NO: 4161) | 1 | 389 |
| HUMPOMCZ_PEA_1_T8 (SEQ ID NO: 4162) | 1 | 389 |
| HUMPOMCZ_PEA_1_T9 (SEQ ID NO: 4163) | 1 | 389 |
| HUMPOMCZ_PEA_1_T10 (SEQ ID NO: 4164) | 1 | 389 |

This segment can be found in a non-coding region of transcript(s) that are related to the following protein(s): HUMPOMCZ_PEA_1_P1.

Segment cluster HUMPOMCZ_PEA_1_node_10 (SEQ ID NO:5447) according to the present invention is supported by 42 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4940 below describes the starting and ending position of this segment on each transcript.

TABLE 4940

| Segment location on transcripts | | |
|---|---|---|
| Transcript name | Segment starting position | Segment ending position |
| HUMPOMCZ_PEA_1_T3 (SEQ ID NO: 4160) | 449 | 600 |
| HUMPOMCZ_PEA_1_T6 (SEQ ID NO: 4161) | 429 | 580 |
| HUMPOMCZ_PEA_1_T8 (SEQ ID NO: 4162) | 479 | 630 |
| HUMPOMCZ_PEA_1_T9 (SEQ ID NO: 4163) | 519 | 670 |
| HUMPOMCZ_PEA_1_T10 (SEQ ID NO: 4164) | 567 | 718 |

This segment can be found in the following protein(s): HUMPOMCZ_PEA_1_P1.

Segment cluster HUMPOMCZ_PEA_1_node_56 (SEQ ID NO:5448) according to the present invention is supported by 55 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4941 below describes the starting and ending position of this segment on each transcript.

TABLE 4941

| Segment location on transcripts | | |
|---|---|---|
| Transcript name | Segment starting position | Segment ending position |
| HUMPOMCZ_PEA_1_T3 (SEQ ID NO: 4160) | 1204 | 1351 |
| HUMPOMCZ_PEA_1_T6 (SEQ ID NO: 4161) | 1184 | 1331 |
| HUMPOMCZ_PEA_1_T8 (SEQ ID NO: 4162) | 1234 | 1381 |
| HUMPOMCZ_PEA_1_T9 (SEQ ID NO: 4163) | 1274 | 1421 |
| HUMPOMCZ_PEA_1_T10 (SEQ ID NO: 4164) | 1322 | 1469 |

This segment can be found in the following protein(s): HUMPOMCZ_PEA_1_P1.

Segment cluster HUMPOMCZ_PEA_1_node_57 (SEQ ID NO:5449) according to the present invention is supported by 49 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4942 below describes the starting and ending position of this segment on each transcript.

TABLE 4942

Segment location on transcripts

| Transcript name | Segment starting position | Segment ending position |
|---|---|---|
| HUMPOMCZ_PEA_1_T3 (SEQ ID NO: 4160) | 1352 | 1438 |
| HUMPOMCZ_PEA_1_T6 (SEQ ID NO: 4161) | 1332 | 1418 |
| HUMPOMCZ_PEA_1_T8 (SEQ ID NO: 4162) | 1382 | 1468 |
| HUMPOMCZ_PEA_1_T9 (SEQ ID NO: 4163) | 1422 | 1508 |
| HUMPOMCZ_PEA_1_T10 (SEQ ID NO: 4164) | 1470 | 1556 |

This segment can be found in a non-coding region of transcript(s) that are related to the following protein(s): HUMPOMCZ_PEA_1_P1.

According to an optional embodiment of the present invention, short segments related to the above cluster are also provided. These segments are up to about 120 bp in length, and so are included in a separate description.

Segment cluster HUMPOMCZ_PEA_1_node_1 (SEQ ID NO:5450) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4943 below describes the starting and ending position of this segment on each transcript.

TABLE 4943

Segment location on transcripts

| Transcript name | Segment starting position | Segment ending position |
|---|---|---|
| HUMPOMCZ_PEA_1_T3 (SEQ ID NO: 4160) | 390 | 398 |
| HUMPOMCZ_PEA_1_T6 (SEQ ID NO: 4161) | 390 | 398 |
| HUMPOMCZ_PEA_1_T8 (SEQ ID NO: 4162) | 390 | 398 |
| HUMPOMCZ_PEA_1_T9 (SEQ ID NO: 4163) | 390 | 398 |
| HUMPOMCZ_PEA_1_T10 (SEQ ID NO: 4164) | 390 | 398 |

This segment can be found in a non-coding region of transcript(s) that are related to the following protein(s): HUMPOMCZ_PEA_1_P1.

Segment cluster HUMPOMCZ_PEA_1_node_3 (SEQ ID NO:5451) according to the present invention is supported by 2 libraries. The number of libraries was determined as previously described. This segment can be found in the following transcript(s): HUMPOMCZ_PEA_1_T9 (SEQ ID NO:4163) and HUMPOMCZ_PEA_1_T10 (SEQ ID NO:4164). Table 4944 below describes the starting and ending position of this segment on each transcript.

TABLE 4944

Segment location on transcripts

| Transcript name | Segment starting position | Segment ending position |
|---|---|---|
| HUMPOMCZ_PEA_1_T9 (SEQ ID NO: 4163) | 399 | 468 |
| HUMPOMCZ_PEA_1_T10 (SEQ ID NO: 4164) | 399 | 468 |

This segment can be found in a non-coding region of transcript(s) that are related to the following protein(s): HUMPOMCZ_PEA_1_P1.

Segment cluster HUMPOMCZ_PEA_1_node_4 (SEQ ID NO:5452) according to the present invention is supported by 1 libraries. The number of libraries was determined as previously described. This segment can be found in the following transcript(s): HUMPOMCZ_PEA_1_T10 (SEQ ID NO:4164). Table 4945 below describes the starting and ending position of this segment on each transcript.

TABLE 4945

Segment location on transcripts

| Transcript name | Segment starting position | Segment ending position |
|---|---|---|
| HUMPOMCZ_PEA_1_T10 (SEQ ID NO: 4164) | 469 | 516 |

This segment can be found in a non-coding region of transcript(s) that are related to the following protein(s): HUMPOMCZ_PEA_1_P1.

Segment cluster HUMPOMCZ_PEA_1_node_6 (SEQ ID NO:5453) according to the present invention is supported by 14 libraries. The number of libraries was determined as previously described. This segment can be found in the following transcript(s): HUMPOMCZ_PEA_1_T3 (SEQ ID NO:4160), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4946 below describes the starting and ending position of this segment on each transcript.

TABLE 4946

Segment location on transcripts

| Transcript name | Segment starting position | Segment ending position |
|---|---|---|
| HUMPOMCZ_PEA_1_T3 (SEQ ID NO: 4160) | 399 | 448 |
| HUMPOMCZ_PEA_1_T8 (SEQ ID NO: 4162) | 399 | 448 |
| HUMPOMCZ_PEA_1_T9 (SEQ ID NO: 4163) | 469 | 518 |
| HUMPOMCZ_PEA_1_T10 (SEQ ID NO: 4164) | 517 | 566 |

This segment can be found in a non-coding region of transcript(s) that are related to the following protein(s): HUMPOMCZ_PEA_1_P1.

Segment cluster HUMPOMCZ_PEA_1_node_8 (SEQ ID NO:5454) according to the present invention is supported by 7 libraries. The number of libraries was determined as previously described. This segment can be found in the following transcript(s): HUMPOMCZ_PEA_1_T6 (SEQ ID NO:4161) and HUMPOMCZ_PEA_1_T8 (SEQ ID NO:4162). Table 4947 below describes the starting and ending position of this segment on each transcript.

TABLE 4947

Segment location on transcripts

| Transcript name | Segment starting position | Segment ending position |
|---|---|---|
| HUMPOMCZ_PEA_1_T6 (SEQ ID NO: 4161) | 399 | 428 |
| HUMPOMCZ_PEA_1_T8 (SEQ ID NO: 4162) | 449 | 478 |

This segment can be found in a non-coding region of transcript(s) that are related to the following protein(s): HUMPOMCZ_PEA_1_P1.

Segment cluster HUMPOMCZ_PEA_1_node_12 (SEQ ID NO:5455) according to the present invention is supported by 38 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4948 below describes the starting and ending position of this segment on each transcript.

TABLE 4948

Segment location on transcripts

| Transcript name | Segment starting position | Segment ending position |
|---|---|---|
| HUMPOMCZ_PEA_1_T3 (SEQ ID NO: 4160) | 601 | 634 |
| HUMPOMCZ_PEA_1_T6 (SEQ ID NO: 4161) | 581 | 614 |
| HUMPOMCZ_PEA_1_T8 (SEQ ID NO: 4162) | 631 | 664 |
| HUMPOMCZ_PEA_1_T9 (SEQ ID NO: 4163) | 671 | 704 |
| HUMPOMCZ_PEA_1_T10 (SEQ ID NO: 4164) | 719 | 752 |

This segment can be found in the following protein(s): HUMPOMCZ_PEA_1_P1.

Segment cluster HUMPOMCZ_PEA_1_node_13 (SEQ ID NO:5456) according to the present invention is supported by 40 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4949 below describes the starting and ending position of this segment on each transcript.

TABLE 4949

Segment location on transcripts

| Transcript name | Segment starting position | Segment ending position |
|---|---|---|
| HUMPOMCZ_PEA_1_T3 (SEQ ID NO: 4160) | 635 | 679 |
| HUMPOMCZ_PEA_1_T6 (SEQ ID NO: 4161) | 615 | 659 |
| HUMPOMCZ_PEA_1_T8 (SEQ ID NO: 4162) | 665 | 709 |
| HUMPOMCZ_PEA_1_T9 (SEQ ID NO: 4163) | 705 | 749 |
| HUMPOMCZ_PEA_1_T10 (SEQ ID NO: 4164) | 753 | 797 |

This segment can be found in the following protein(s): HUMPOMCZ_PEA_1_P1.

Segment cluster HUMPOMCZ_PEA_1_node_14 (SEQ ID NO:5457) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4950 below describes the starting and ending position of this segment on each transcript.

TABLE 4950

Segment location on transcripts

| Transcript name | Segment starting position | Segment ending position |
|---|---|---|
| HUMPOMCZ_PEA_1_T3 (SEQ ID NO: 4160) | 680 | 704 |
| HUMPOMCZ_PEA_1_T6 (SEQ ID NO: 4161) | 660 | 684 |
| HUMPOMCZ_PEA_1_T8 (SEQ ID NO: 4162) | 710 | 734 |
| HUMPOMCZ_PEA_1_T9 (SEQ ID NO: 4163) | 750 | 774 |
| HUMPOMCZ_PEA_1_T10 (SEQ ID NO: 4164) | 798 | 822 |

This segment can be found in the following protein(s): HUMPOMCZ_PEA_1_P1.

Segment cluster HUMPOMCZ_PEA_1_node_15 (SEQ ID NO:5458) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4951 below describes the starting and ending position of this segment on each transcript.

TABLE 4951

Segment location on transcripts

| Transcript name | Segment starting position | Segment ending position |
|---|---|---|
| HUMPOMCZ_PEA_1_T3 (SEQ ID NO: 4160) | 705 | 716 |
| HUMPOMCZ_PEA_1_T6 (SEQ ID NO: 4161) | 685 | 696 |

TABLE 4951-continued

Segment location on transcripts

| Transcript name | Segment starting position | Segment ending position |
|---|---|---|
| HUMPOMCZ_PEA_1_T8 (SEQ ID NO: 4162) | 735 | 746 |
| HUMPOMCZ_PEA_1_T9 (SEQ ID NO: 4163) | 775 | 786 |
| HUMPOMCZ_PEA_1_T10 (SEQ ID NO: 4164) | 823 | 834 |

This segment can be found in the following protein(s): HUMPOMCZ_PEA_1_P1.

Segment cluster HUMPOMCZ_PEA_1_node_16 (SEQ ID NO:5459) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4952 below describes the starting and ending position of this segment on each transcript.

TABLE 4952

Segment location on transcripts

| Transcript name | Segment starting position | Segment ending position |
|---|---|---|
| HUMPOMCZ_PEA_1_T3 (SEQ ID NO: 4160) | 717 | 725 |
| HUMPOMCZ_PEA_1_T6 (SEQ ID NO: 4161) | 697 | 705 |
| HUMPOMCZ_PEA_1_T8 (SEQ ID NO: 4162) | 747 | 755 |
| HUMPOMCZ_PEA_1_T9 (SEQ ID NO: 4163) | 787 | 795 |
| HUMPOMCZ_PEA_1_T10 (SEQ ID NO: 4164) | 835 | 843 |

This segment can be found in the following protein(s): HUMPOMCZ_PEA_1_P1.

Segment cluster HUMPOMCZ_PEA_1_node_17 (SEQ ID NO:5460) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4953 below describes the starting and ending position of this segment on each transcript.

TABLE 4953

Segment location on transcripts

| Transcript name | Segment starting position | Segment ending position |
|---|---|---|
| HUMPOMCZ_PEA_1_T3 (SEQ ID NO: 4160) | 726 | 731 |
| HUMPOMCZ_PEA_1_T6 (SEQ ID NO: 4161) | 706 | 711 |
| HUMPOMCZ_PEA_1_T8 (SEQ ID NO: 4162) | 756 | 761 |

TABLE 4953-continued

Segment location on transcripts

| Transcript name | Segment starting position | Segment ending position |
|---|---|---|
| HUMPOMCZ_PEA_1_T9 (SEQ ID NO: 4163) | 796 | 801 |
| HUMPOMCZ_PEA_1_T10 (SEQ ID NO: 4164) | 844 | 849 |

This segment can be found in the following protein(s): HUMPOMCZ_PEA_1_P1.

Segment cluster HUMPOMCZ_PEA_1_node_18 (SEQ ID NO:5461) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4954 below describes the starting and ending position of this segment on each transcript.

TABLE 4954

Segment location on transcripts

| Transcript name | Segment starting position | Segment ending position |
|---|---|---|
| HUMPOMCZ_PEA_1_T3 (SEQ ID NO: 4160) | 732 | 752 |
| HUMPOMCZ_PEA_1_T6 (SEQ ID NO: 4161) | 712 | 732 |
| HUMPOMCZ_PEA_1_T8 (SEQ ID NO: 4162) | 762 | 782 |
| HUMPOMCZ_PEA_1_T9 (SEQ ID NO: 4163) | 802 | 822 |
| HUMPOMCZ_PEA_1_T10 (SEQ ID NO: 4164) | 850 | 870 |

This segment can be found in the following protein(s): HUMPOMCZ_PEA_1_P1.

Segment cluster HUMPOMCZ_PEA_1_node_19 (SEQ ID NO:5462) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4955 below describes the starting and ending position of this segment on each transcript.

TABLE 4955

Segment location on transcripts

| Transcript name | Segment starting position | Segment ending position |
|---|---|---|
| HUMPOMCZ_PEA_1_T3 (SEQ ID NO: 4160) | 753 | 771 |
| HUMPOMCZ_PEA_1_T6 (SEQ ID NO: 4161) | 733 | 751 |
| HUMPOMCZ_PEA_1_T8 (SEQ ID NO: 4162) | 783 | 801 |
| HUMPOMCZ_PEA_1_T9 (SEQ ID NO: 4163) | 823 | 841 |
| HUMPOMCZ_PEA_1_T10 (SEQ ID NO: 4164) | 871 | 889 |

This segment can be found in the following protein(s): HUMPOMCZ_PEA_1_P1.

Segment cluster HUMPOMCZ_PEA_1_node_20 (SEQ ID NO:5463) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4956 below describes the starting and ending position of this segment on each transcript.

TABLE 4956

| Segment location on transcripts | | |
|---|---|---|
| Transcript name | Segment starting position | Segment ending position |
| HUMPOMCZ_PEA_1_T3 (SEQ ID NO: 4160) | 772 | 778 |
| HUMPOMCZ_PEA_1_T6 (SEQ ID NO: 4161) | 752 | 758 |
| HUMPOMCZ_PEA_1_T8 (SEQ ID NO: 4162) | 802 | 808 |
| HUMPOMCZ_PEA_1_T9 (SEQ ID NO: 4163) | 842 | 848 |
| HUMPOMCZ_PEA_1_T10 (SEQ ID NO: 4164) | 890 | 896 |

This segment can be found in the following protein(s): HUMPOMCZ_PEA_1_P1.

Segment cluster HUMPOMCZ_PEA_1_node_21 (SEQ ID NO:5464) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4957 below describes the starting and ending position of this segment on each transcript.

TABLE 4957

| Segment location on transcripts | | |
|---|---|---|
| Transcript name | Segment starting position | Segment ending position |
| HUMPOMCZ_PEA_1_T3 (SEQ ID NO: 4160) | 779 | 786 |
| HUMPOMCZ_PEA_1_T6 (SEQ ID NO: 4161) | 759 | 766 |
| HUMPOMCZ_PEA_1_T8 (SEQ ID NO: 4162) | 809 | 816 |
| HUMPOMCZ_PEA_1_T9 (SEQ ID NO: 4163) | 849 | 856 |
| HUMPOMCZ_PEA_1_T10 (SEQ ID NO: 4164) | 897 | 904 |

This segment can be found in the following protein(s): HUMPOMCZ_PEA_1_P1.

Segment cluster HUMPOMCZ_PEA_1_node_22 (SEQ ID NO:5465) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4958 below describes the starting and ending position of this segment on each transcript.

TABLE 4958

| Segment location on transcripts | | |
|---|---|---|
| Transcript name | Segment starting position | Segment ending position |
| HUMPOMCZ_PEA_1_T3 (SEQ ID NO: 4160) | 787 | 793 |
| HUMPOMCZ_PEA_1_T6 (SEQ ID NO: 4161) | 767 | 773 |
| HUMPOMCZ_PEA_1_T8 (SEQ ID NO: 4162) | 817 | 823 |
| HUMPOMCZ_PEA_1_T9 (SEQ ID NO: 4163) | 857 | 863 |
| HUMPOMCZ_PEA_1_T10 (SEQ ID NO: 4164) | 905 | 911 |

This segment can be found in the following protein(s): HUMPOMCZ_PEA_1_P1.

Segment cluster HUMPOMCZ_PEA_1_node_23 (SEQ ID NO:5466) according to the present invention is supported by 43 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4959 below describes the starting and ending position of this segment on each transcript.

TABLE 4959

| Segment location on transcripts | | |
|---|---|---|
| Transcript name | Segment starting position | Segment ending position |
| HUMPOMCZ_PEA_1_T3 (SEQ ID NO: 4160) | 794 | 823 |
| HUMPOMCZ_PEA_1_T6 (SEQ ID NO: 4161) | 774 | 803 |
| HUMPOMCZ_PEA_1_T8 (SEQ ID NO: 4162) | 824 | 853 |
| HUMPOMCZ_PEA_1_T9 (SEQ ID NO: 4163) | 864 | 893 |
| HUMPOMCZ_PEA_1_T10 (SEQ ID NO: 4164) | 912 | 941 |

This segment can be found in the following protein(s): HUMPOMCZ_PEA_1_P1.

Segment cluster HUMPOMCZ_PEA_1_node_24 (SEQ ID NO:5467) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4960 below describes the starting and ending position of this segment on each transcript.

TABLE 4960

| Segment location on transcripts | | |
|---|---|---|
| Transcript name | Segment starting position | Segment ending position |
| HUMPOMCZ_PEA_1_T3 (SEQ ID NO: 4160) | 824 | 829 |
| HUMPOMCZ_PEA_1_T6 (SEQ ID NO: 4161) | 804 | 809 |
| HUMPOMCZ_PEA_1_T8 (SEQ ID NO: 4162) | 854 | 859 |
| HUMPOMCZ_PEA_1_T9 (SEQ ID NO: 4163) | 894 | 899 |
| HUMPOMCZ_PEA_1_T10 (SEQ ID NO: 4164) | 942 | 947 |

This segment can be found in the following protein(s): HUMPOMCZ_PEA_1_P1.

Segment cluster HUMPOMCZ_PEA_1_node_25 (SEQ ID NO:5468) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4961 below describes the starting and ending position of this segment on each transcript.

TABLE 4961

| Segment location on transcripts | | |
|---|---|---|
| Transcript name | Segment starting position | Segment ending position |
| HUMPOMCZ_PEA_1_T3 (SEQ ID NO: 4160) | 830 | 834 |
| HUMPOMCZ_PEA_1_T6 (SEQ ID NO: 4161) | 810 | 814 |
| HUMPOMCZ_PEA_1_T8 (SEQ ID NO: 4162) | 860 | 864 |
| HUMPOMCZ_PEA_1_T9 (SEQ ID NO: 4163) | 900 | 904 |
| HUMPOMCZ_PEA_1_T10 (SEQ ID NO: 4164) | 948 | 952 |

This segment can be found in the following protein(s): HUMPOMCZ_PEA_1_P1.

Segment cluster HUMPOMCZ_PEA_1_node_26 (SEQ ID NO:5469) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4962 below describes the starting and ending position of this segment on each transcript.

TABLE 4962

| Segment location on transcripts | | |
|---|---|---|
| Transcript name | Segment starting position | Segment ending position |
| HUMPOMCZ_PEA_1_T3 (SEQ ID NO: 4160) | 835 | 838 |
| HUMPOMCZ_PEA_1_T6 (SEQ ID NO: 4161) | 815 | 818 |

TABLE 4962-continued

| Segment location on transcripts | | |
|---|---|---|
| Transcript name | Segment starting position | Segment ending position |
| HUMPOMCZ_PEA_1_T8 (SEQ ID NO: 4162) | 865 | 868 |
| HUMPOMCZ_PEA_1_T9 (SEQ ID NO: 4163) | 905 | 908 |
| HUMPOMCZ_PEA_1_T10 (SEQ ID NO: 4164) | 953 | 956 |

This segment can be found in the following protein(s): HUMPOMCZ_PEA_1_P1.

Segment cluster HUMPOMCZ_PEA_1_node_27 (SEQ ID NO:5470) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4963 below describes the starting and ending position of this segment on each transcript.

TABLE 4963

| Segment location on transcripts | | |
|---|---|---|
| Transcript name | Segment starting position | Segment ending position |
| HUMPOMCZ_PEA_1_T3 (SEQ ID NO: 4160) | 839 | 842 |
| HUMPOMCZ_PEA_1_T6 (SEQ ID NO: 4161) | 819 | 822 |
| HUMPOMCZ_PEA_1_T8 (SEQ ID NO: 4162) | 869 | 872 |
| HUMPOMCZ_PEA_1_T9 (SEQ ID NO: 4163) | 909 | 912 |
| HUMPOMCZ_PEA_1_T10 (SEQ ID NO: 4164) | 957 | 960 |

This segment can be found in the following protein(s): HUMPOMCZ_PEA_1_P1.

Segment cluster HUMPOMCZ_PEA_1_node_28 (SEQ ID NO:5471) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4964 below describes the starting and ending position of this segment on each transcript.

TABLE 4964

| Segment location on transcripts | | |
|---|---|---|
| Transcript name | Segment starting position | Segment ending position |
| HUMPOMCZ_PEA_1_T3 (SEQ ID NO: 4160) | 843 | 847 |
| HUMPOMCZ_PEA_1_T6 (SEQ ID NO: 4161) | 823 | 827 |
| HUMPOMCZ_PEA_1_T8 (SEQ ID NO: 4162) | 873 | 877 |

TABLE 4964-continued

Segment location on transcripts

| Transcript name | Segment starting position | Segment ending position |
|---|---|---|
| HUMPOMCZ_PEA_1_T9 (SEQ ID NO: 4163) | 913 | 917 |
| HUMPOMCZ_PEA_1_T10 (SEQ ID NO: 4164) | 961 | 965 |

This segment can be found in the following protein(s): HUMPOMCZ_PEA_1_P1.

Segment cluster HUMPOMCZ_PEA_1_node_29 (SEQ ID NO:5472) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4965 below describes the starting and ending position of this segment on each transcript.

TABLE 4965

Segment location on transcripts

| Transcript name | Segment starting position | Segment ending position |
|---|---|---|
| HUMPOMCZ_PEA_1_T3 (SEQ ID NO: 4160) | 848 | 855 |
| HUMPOMCZ_PEA_1_T6 (SEQ ID NO: 4161) | 828 | 835 |
| HUMPOMCZ_PEA_1_T8 (SEQ ID NO: 4162) | 878 | 885 |
| HUMPOMCZ_PEA_1_T9 (SEQ ID NO: 4163) | 918 | 925 |
| HUMPOMCZ_PEA_1_T10 (SEQ ID NO: 4164) | 966 | 973 |

This segment can be found in the following protein(s): HUMPOMCZ_PEA_1_P1.

Segment cluster HUMPOMCZ_PEA_1_node_30 (SEQ ID NO:5473) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4966 below describes the starting and ending position of this segment on each transcript.

TABLE 4966

Segment location on transcripts

| Transcript name | Segment starting position | Segment ending position |
|---|---|---|
| HUMPOMCZ_PEA_1_T3 (SEQ ID NO: 4160) | 856 | 865 |
| HUMPOMCZ_PEA_1_T6 (SEQ ID NO: 4161) | 836 | 845 |
| HUMPOMCZ_PEA_1_T8 (SEQ ID NO: 4162) | 886 | 895 |
| HUMPOMCZ_PEA_1_T9 (SEQ ID NO: 4163) | 926 | 935 |
| HUMPOMCZ_PEA_1_T10 (SEQ ID NO: 4164) | 974 | 983 |

This segment can be found in the following protein(s): HUMPOMCZ_PEA_1_P1.

Segment cluster HUMPOMCZ_PEA_1_node_31 (SEQ ID NO:5474) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4967 below describes the starting and ending position of this segment on each transcript.

TABLE 4967

Segment location on transcripts

| Transcript name | Segment starting position | Segment ending position |
|---|---|---|
| HUMPOMCZ_PEA_1_T3 (SEQ ID NO: 4160) | 866 | 870 |
| HUMPOMCZ_PEA_1_T6 (SEQ ID NO: 4161) | 846 | 850 |
| HUMPOMCZ_PEA_1_T8 (SEQ ID NO: 4162) | 896 | 900 |
| HUMPOMCZ_PEA_1_T9 (SEQ ID NO: 4163) | 936 | 940 |
| HUMPOMCZ_PEA_1_T10 (SEQ ID NO: 4164) | 984 | 988 |

This segment can be found in the following protein(s): HUMPOMCZ_PEA_1_P1.

Segment cluster HUMPOMCZ_PEA_1_node_32 (SEQ ID NO:5475) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4968 below describes the starting and ending position of this segment on each transcript.

TABLE 4968

Segment location on transcripts

| Transcript name | Segment starting position | Segment ending position |
|---|---|---|
| HUMPOMCZ_PEA_1_T3 (SEQ ID NO: 4160) | 871 | 876 |
| HUMPOMCZ_PEA_1_T6 (SEQ ID NO: 4161) | 851 | 856 |
| HUMPOMCZ_PEA_1_T8 (SEQ ID NO: 4162) | 901 | 906 |
| HUMPOMCZ_PEA_1_T9 (SEQ ID NO: 4163) | 941 | 946 |
| HUMPOMCZ_PEA_1_T10 (SEQ ID NO: 4164) | 989 | 994 |

This segment can be found in the following protein(s): HUMPOMCZ_PEA_1_P1.

Segment cluster HUMPOMCZ_PEA_1_node_33 (SEQ ID NO:5476) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4969 below describes the starting and ending position of this segment on each transcript.

TABLE 4969

| Segment location on transcripts | | |
|---|---|---|
| Transcript name | Segment starting position | Segment ending position |
| HUMPOMCZ_PEA_1_T3 (SEQ ID NO: 4160) | 877 | 888 |
| HUMPOMCZ_PEA_1_T6 (SEQ ID NO: 4161) | 857 | 868 |
| HUMPOMCZ_PEA_1_T8 (SEQ ID NO: 4162) | 907 | 918 |
| HUMPOMCZ_PEA_1_T9 (SEQ ID NO: 4163) | 947 | 958 |
| HUMPOMCZ_PEA_1_T10 (SEQ ID NO: 4164) | 995 | 1006 |

This segment can be found in the following protein(s): HUMPOMCZ_PEA_1_P1.

Segment cluster HUMPOMCZ_PEA_1_node_34 (SEQ ID NO:5477) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4970 below describes the starting and ending position of this segment on each transcript.

TABLE 4970

| Segment location on transcripts | | |
|---|---|---|
| Transcript name | Segment starting position | Segment ending position |
| HUMPOMCZ_PEA_1_T3 (SEQ ID NO: 4160) | 889 | 902 |
| HUMPOMCZ_PEA_1_T6 (SEQ ID NO: 4161) | 869 | 882 |
| HUMPOMCZ_PEA_1_T8 (SEQ ID NO: 4162) | 919 | 932 |
| HUMPOMCZ_PEA_1_T9 (SEQ ID NO: 4163) | 959 | 972 |
| HUMPOMCZ_PEA_1_T10 (SEQ ID NO: 4164) | 1007 | 1020 |

This segment can be found in the following protein(s): HUMPOMCZ_PEA_1_P1.

Segment cluster HUMPOMCZ_PEA_1_node_35 (SEQ ID NO:5478) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4971 below describes the starting and ending position of this segment on each transcript.

TABLE 4971

| Segment location on transcripts | | |
|---|---|---|
| Transcript name | Segment starting position | Segment ending position |
| HUMPOMCZ_PEA_1_T3 (SEQ ID NO: 4160) | 903 | 915 |
| HUMPOMCZ_PEA_1_T6 (SEQ ID NO: 4161) | 883 | 895 |
| HUMPOMCZ_PEA_1_T8 (SEQ ID NO: 4162) | 933 | 945 |
| HUMPOMCZ_PEA_1_T9 (SEQ ID NO: 4163) | 973 | 985 |
| HUMPOMCZ_PEA_1_T10 (SEQ ID NO: 4164) | 1021 | 1033 |

This segment can be found in the following protein(s): HUMPOMCZ_PEA_1_P1.

Segment cluster HUMPOMCZ_PEA_1_node_36 (SEQ ID NO:5479) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4972 below describes the starting and ending position of this segment on each transcript.

TABLE 4972

| Segment location on transcripts | | |
|---|---|---|
| Transcript name | Segment starting position | Segment ending position |
| HUMPOMCZ_PEA_1_T3 (SEQ ID NO: 4160) | 916 | 919 |
| HUMPOMCZ_PEA_1_T6 (SEQ ID NO: 4161) | 896 | 899 |
| HUMPOMCZ_PEA_1_T8 (SEQ ID NO: 4162) | 946 | 949 |
| HUMPOMCZ_PEA_1_T9 (SEQ ID NO: 4163) | 986 | 989 |
| HUMPOMCZ_PEA_1_T10 (SEQ ID NO: 4164) | 1034 | 1037 |

This segment can be found in the following protein(s): HUMPOMCZ_PEA_1_P1.

Segment cluster HUMPOMCZ_PEA_1_node_37 (SEQ ID NO:5480) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4973 below describes the starting and ending position of this segment on each transcript.

TABLE 4973

| Segment location on transcripts | | |
|---|---|---|
| Transcript name | Segment starting position | Segment ending position |
| HUMPOMCZ_PEA_1_T3 (SEQ ID NO: 4160) | 920 | 927 |
| HUMPOMCZ_PEA_1_T6 (SEQ ID NO: 4161) | 900 | 907 |

TABLE 4973-continued

Segment location on transcripts

| Transcript name | Segment starting position | Segment ending position |
|---|---|---|
| HUMPOMCZ_PEA_1_T8 (SEQ ID NO: 4162) | 950 | 957 |
| HUMPOMCZ_PEA_1_T9 (SEQ ID NO: 4163) | 990 | 997 |
| HUMPOMCZ_PEA_1_T10 (SEQ ID NO: 4164) | 1038 | 1045 |

This segment can be found in the following protein(s): HUMPOMCZ_PEA_1_P1.

Segment cluster HUMPOMCZ_PEA_1_node_38 (SEQ ID NO:5481) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4974 below describes the starting and ending position of this segment on each transcript.

TABLE 4974

Segment location on transcripts

| Transcript name | Segment starting position | Segment ending position |
|---|---|---|
| HUMPOMCZ_PEA_1_T3 (SEQ ID NO: 4160) | 928 | 942 |
| HUMPOMCZ_PEA_1_T6 (SEQ ID NO: 4161) | 908 | 922 |
| HUMPOMCZ_PEA_1_T8 (SEQ ID NO: 4162) | 958 | 972 |
| HUMPOMCZ_PEA_1_T9 (SEQ ID NO: 4163) | 998 | 1012 |
| HUMPOMCZ_PEA_1_T10 (SEQ ID NO: 4164) | 1046 | 1060 |

This segment can be found in the following protein(s): HUMPOMCZ_PEA_1_P1.

Segment cluster HUMPOMCZ_PEA_1_node_39 (SEQ ID NO:5482) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4975 below describes the starting and ending position of this segment on each transcript.

TABLE 4975

Segment location on transcripts

| Transcript name | Segment starting position | Segment ending position |
|---|---|---|
| HUMPOMCZ_PEA_1_T3 (SEQ ID NO: 4160) | 943 | 966 |
| HUMPOMCZ_PEA_1_T6 (SEQ ID NO: 4161) | 923 | 946 |
| HUMPOMCZ_PEA_1_T8 (SEQ ID NO: 4162) | 973 | 996 |

TABLE 4975-continued

Segment location on transcripts

| Transcript name | Segment starting position | Segment ending position |
|---|---|---|
| HUMPOMCZ_PEA_1_T9 (SEQ ID NO: 4163) | 1013 | 1036 |
| HUMPOMCZ_PEA_1_T10 (SEQ ID NO: 4164) | 1061 | 1084 |

This segment can be found in the following protein(s): HUMPOMCZ_PEA_1_P1.

Segment cluster HUMPOMCZ_PEA_1_node_40 (SEQ ID NO:5483) according to the present invention is supported by 51 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4976 below describes the starting and ending position of this segment on each transcript.

TABLE 4976

Segment location on transcripts

| Transcript name | Segment starting position | Segment ending position |
|---|---|---|
| HUMPOMCZ_PEA_1_T3 (SEQ ID NO: 4160) | 967 | 1005 |
| HUMPOMCZ_PEA_1_T6 (SEQ ID NO: 4161) | 947 | 985 |
| HUMPOMCZ_PEA_1_T8 (SEQ ID NO: 4162) | 997 | 1035 |
| HUMPOMCZ_PEA_1_T9 (SEQ ID NO: 4163) | 1037 | 1075 |
| HUMPOMCZ_PEA_1_T10 (SEQ ID NO: 4164) | 1085 | 1123 |

This segment can be found in the following protein(s): HUMPOMCZ_PEA_1_P1.

Segment cluster HUMPOMCZ_PEA_1_node_41 (SEQ ID NO:5484) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4977 below describes the starting and ending position of this segment on each transcript.

TABLE 4977

Segment location on transcripts

| Transcript name | Segment starting position | Segment ending position |
|---|---|---|
| HUMPOMCZ_PEA_1_T3 (SEQ ID NO: 4160) | 1006 | 1009 |
| HUMPOMCZ_PEA_1_T6 (SEQ ID NO: 4161) | 986 | 989 |
| HUMPOMCZ_PEA_1_T8 (SEQ ID NO: 4162) | 1036 | 1039 |

TABLE 4977-continued

Segment location on transcripts

| Transcript name | Segment starting position | Segment ending position |
|---|---|---|
| HUMPOMCZ_PEA_1_T9 (SEQ ID NO: 4163) | 1076 | 1079 |
| HUMPOMCZ_PEA_1_T10 (SEQ ID NO: 4164) | 1124 | 1127 |

This segment can be found in the following protein(s): HUMPOMCZ_PEA_1_P1.

Segment cluster HUMPOMCZ_PEA_1_node_42 (SEQ ID NO:5485) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4978 below describes the starting and ending position of this segment on each transcript.

TABLE 4978

Segment location on transcripts

| Transcript name | Segment starting position | Segment ending position |
|---|---|---|
| HUMPOMCZ_PEA_1_T3 (SEQ ID NO: 4160) | 1010 | 1017 |
| HUMPOMCZ_PEA_1_T6 (SEQ ID NO: 4161) | 990 | 997 |
| HUMPOMCZ_PEA_1_T8 (SEQ ID NO: 4162) | 1040 | 1047 |
| HUMPOMCZ_PEA_1_T9 (SEQ ID NO: 4163) | 1080 | 1087 |
| HUMPOMCZ_PEA_1_T10 (SEQ ID NO: 4164) | 1128 | 1135 |

This segment can be found in the following protein(s): HUMPOMCZ_PEA_1_P1.

Segment cluster HUMPOMCZ_PEA_1_node_43 (SEQ ID NO:5486) according to the present invention is supported by 50 libraries. The number of libraries was determined as previously described. This segment can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4979 below describes the starting and ending position of this segment on each transcript.

TABLE 4979

Segment location on transcripts

| Transcript name | Segment starting position | Segment ending position |
|---|---|---|
| HUMPOMCZ_PEA_1_T3 (SEQ ID NO: 4160) | 1018 | 1044 |
| HUMPOMCZ_PEA_1_T6 (SEQ ID NO: 4161) | 998 | 1024 |
| HUMPOMCZ_PEA_1_T8 (SEQ ID NO: 4162) | 1048 | 1074 |

TABLE 4979-continued

Segment location on transcripts

| Transcript name | Segment starting position | Segment ending position |
|---|---|---|
| HUMPOMCZ_PEA_1_T9 (SEQ ID NO: 4163) | 1088 | 1114 |
| HUMPOMCZ_PEA_1_T10 (SEQ ID NO: 4164) | 1136 | 1162 |

This segment can be found in the following protein(s): HUMPOMCZ_PEA_1_P1.

Segment cluster HUMPOMCZ_PEA_1_node_44 (SEQ ID NO:5487) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4980 below describes the starting and ending position of this segment on each transcript.

TABLE 4980

Segment location on transcripts

| Transcript name | Segment starting position | Segment ending position |
|---|---|---|
| HUMPOMCZ_PEA_1_T3 (SEQ ID NO: 4160) | 1045 | 1066 |
| HUMPOMCZ_PEA_1_T6 (SEQ ID NO: 4161) | 1025 | 1046 |
| HUMPOMCZ_PEA_1_T8 (SEQ ID NO: 4162) | 1075 | 1096 |
| HUMPOMCZ_PEA_1_T9 (SEQ ID NO: 4163) | 1115 | 1136 |
| HUMPOMCZ_PEA_1_T10 (SEQ ID NO: 4164) | 1163 | 1184 |

This segment can be found in the following protein(s): HUMPOMCZ_PEA_1_P1.

Segment cluster HUMPOMCZ_PEA_1_node_45 (SEQ ID NO:5488) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4981 below describes the starting and ending position of this segment on each transcript.

TABLE 4981

Segment location on transcripts

| Transcript name | Segment starting position | Segment ending position |
|---|---|---|
| HUMPOMCZ_PEA_1_T3 (SEQ ID NO: 4160) | 1067 | 1080 |
| HUMPOMCZ_PEA_1_T6 (SEQ ID NO: 4161) | 1047 | 1060 |
| HUMPOMCZ_PEA_1_T8 (SEQ ID NO: 4162) | 1097 | 1110 |
| HUMPOMCZ_PEA_1_T9 (SEQ ID NO: 4163) | 1137 | 1150 |

TABLE 4981-continued

Segment location on transcripts

| Transcript name | Segment starting position | Segment ending position |
|---|---|---|
| HUMPOMCZ_PEA_1_T10 (SEQ ID NO: 4164) | 1185 | 1198 |

This segment can be found in the following protein(s): HUMPOMCZ_PEA_1_P1.

Segment cluster HUMPOMCZ_PEA_1_node_46 (SEQ ID NO:5489) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4982 below describes the starting and ending position of this segment on each transcript.

TABLE 4982

Segment location on transcripts

| Transcript name | Segment starting position | Segment ending position |
|---|---|---|
| HUMPOMCZ_PEA_1_T3 (SEQ ID NO: 4160) | 1081 | 1086 |
| HUMPOMCZ_PEA_1_T6 (SEQ ID NO: 4161) | 1061 | 1066 |
| HUMPOMCZ_PEA_1_T8 (SEQ ID NO: 4162) | 1111 | 1116 |
| HUMPOMCZ_PEA_1_T9 (SEQ ID NO: 4163) | 1151 | 1156 |
| HUMPOMCZ_PEA_1_T10 (SEQ ID NO: 4164) | 1199 | 1204 |

This segment can be found in the following protein(s): HUMPOMCZ_PEA_1_P1.

Segment cluster HUMPOMCZ_PEA_1_node_47 (SEQ ID NO:5490) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4983 below describes the starting and ending position of this segment on each transcript.

TABLE 4983

Segment location on transcripts

| Transcript name | Segment starting position | Segment ending position |
|---|---|---|
| HUMPOMCZ_PEA_1_T3 (SEQ ID NO: 4160) | 1087 | 1091 |
| HUMPOMCZ_PEA_1_T6 (SEQ ID NO: 4161) | 1067 | 1071 |
| HUMPOMCZ_PEA_1_T8 (SEQ ID NO: 4162) | 1117 | 1121 |
| HUMPOMCZ_PEA_1_T9 (SEQ ID NO: 4163) | 1157 | 1161 |
| HUMPOMCZ_PEA_1_T10 (SEQ ID NO: 4164) | 1205 | 1209 |

This segment can be found in the following protein(s): HUMPOMCZ_PEA_1_P1.

Segment cluster HUMPOMCZ_PEA_1_node_48 (SEQ ID NO:5491) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4984 below describes the starting and ending position of this segment on each transcript.

TABLE 4984

Segment location on transcripts

| Transcript name | Segment starting position | Segment ending position |
|---|---|---|
| HUMPOMCZ_PEA_1_T3 (SEQ ID NO: 4160) | 1092 | 1105 |
| HUMPOMCZ_PEA_1_T6 (SEQ ID NO: 4161) | 1072 | 1085 |
| HUMPOMCZ_PEA_1_T8 (SEQ ID NO: 4162) | 1122 | 1135 |
| HUMPOMCZ_PEA_1_T9 (SEQ ID NO: 4163) | 1162 | 1175 |
| HUMPOMCZ_PEA_1_T10 (SEQ ID NO: 4164) | 1210 | 1223 |

This segment can be found in the following protein(s): HUMPOMCZ_PEA_1_P1.

Segment cluster HUMPOMCZ_PEA_1_node_49 (SEQ ID NO:5492) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4985 below describes the starting and ending position of this segment on each transcript.

TABLE 4985

Segment location on transcripts

| Transcript name | Segment starting position | Segment ending position |
|---|---|---|
| HUMPOMCZ_PEA_1_T3 (SEQ ID NO: 4160) | 1106 | 1116 |
| HUMPOMCZ_PEA_1_T6 (SEQ ID NO: 4161) | 1086 | 1096 |
| HUMPOMCZ_PEA_1_T8 (SEQ ID NO: 4162) | 1136 | 1146 |
| HUMPOMCZ_PEA_1_T9 (SEQ ID NO: 4163) | 1176 | 1186 |
| HUMPOMCZ_PEA_1_T10 (SEQ ID NO: 4164) | 1224 | 1234 |

This segment can be found in the following protein(s): HUMPOMCZ_PEA_1_P1.

Segment cluster HUMPOMCZ_PEA_1_node_50 (SEQ ID NO:5493) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4986 below describes the starting and ending position of this segment on each transcript.

TABLE 4986

| Transcript name | Segment starting position | Segment ending position |
|---|---|---|
| HUMPOMCZ_PEA_1_T3 (SEQ ID NO: 4160) | 1117 | 1133 |
| HUMPOMCZ_PEA_1_T6 (SEQ ID NO: 4161) | 1097 | 1113 |
| HUMPOMCZ_PEA_1_T8 (SEQ ID NO: 4162) | 1147 | 1163 |
| HUMPOMCZ_PEA_1_T9 (SEQ ID NO: 4163) | 1187 | 1203 |
| HUMPOMCZ_PEA_1_T10 (SEQ ID NO: 4164) | 1235 | 1251 |

This segment can be found in the following protein(s): HUMPOMCZ_PEA_1_P1.

Segment cluster HUMPOMCZ_PEA_1_node_51 (SEQ ID NO:5494) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4987 below describes the starting and ending position of this segment on each transcript.

TABLE 4987

| Transcript name | Segment starting position | Segment ending position |
|---|---|---|
| HUMPOMCZ_PEA_1_T3 (SEQ ID NO: 4160) | 1134 | 1148 |
| HUMPOMCZ_PEA_1_T6 (SEQ ID NO: 4161) | 1114 | 1128 |
| HUMPOMCZ_PEA_1_T8 (SEQ ID NO: 4162) | 1164 | 1178 |
| HUMPOMCZ_PEA_1_T9 (SEQ ID NO: 4163) | 1204 | 1218 |
| HUMPOMCZ_PEA_1_T10 (SEQ ID NO: 4164) | 1252 | 1266 |

This segment can be found in the following protein(s): HUMPOMCZ_PEA_1_P1.

Segment cluster HUMPOMCZ_PEA_1_node_52 (SEQ ID NO:5495) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4988 below describes the starting and ending position of this segment on each transcript.

TABLE 4988

| Transcript name | Segment starting position | Segment ending position |
|---|---|---|
| HUMPOMCZ_PEA_1_T3 (SEQ ID NO: 4160) | 1149 | 1157 |
| HUMPOMCZ_PEA_1_T6 (SEQ ID NO: 4161) | 1129 | 1137 |
| HUMPOMCZ_PEA_1_T8 (SEQ ID NO: 4162) | 1179 | 1187 |
| HUMPOMCZ_PEA_1_T9 (SEQ ID NO: 4163) | 1219 | 1227 |
| HUMPOMCZ_PEA_1_T10 (SEQ ID NO: 4164) | 1267 | 1275 |

This segment can be found in the following protein(s): HUMPOMCZ_PEA_1_P1.

Segment cluster HUMPOMCZ_PEA_1_node_53 (SEQ ID NO:5496) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4989 below describes the starting and ending position of this segment on each transcript.

TABLE 4989

| Transcript name | Segment starting position | Segment ending position |
|---|---|---|
| HUMPOMCZ_PEA_1_T3 (SEQ ID NO: 4160) | 1158 | 1170 |
| HUMPOMCZ_PEA_1_T6 (SEQ ID NO: 4161) | 1138 | 1150 |
| HUMPOMCZ_PEA_1_T8 (SEQ ID NO: 4162) | 1188 | 1200 |
| HUMPOMCZ_PEA_1_T9 (SEQ ID NO: 4163) | 1228 | 1240 |
| HUMPOMCZ_PEA_1_T10 (SEQ ID NO: 4164) | 1276 | 1288 |

This segment can be found in the following protein(s): HUMPOMCZ_PEA_1_P1.

Segment cluster HUMPOMCZ_PEA_1_node_54 (SEQ ID NO:5497) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4990 below describes the starting and ending position of this segment on each transcript.

TABLE 4990

| Transcript name | Segment starting position | Segment ending position |
|---|---|---|
| HUMPOMCZ_PEA_1_T3 (SEQ ID NO: 4160) | 1171 | 1181 |
| HUMPOMCZ_PEA_1_T6 (SEQ ID NO: 4161) | 1151 | 1161 |
| HUMPOMCZ_PEA_1_T8 (SEQ ID NO: 4162) | 1201 | 1211 |

TABLE 4990-continued

Segment location on transcripts

| Transcript name | Segment starting position | Segment ending position |
|---|---|---|
| HUMPOMCZ_PEA_1_T9 (SEQ ID NO: 4163) | 1241 | 1251 |
| HUMPOMCZ_PEA_1_T10 (SEQ ID NO: 4164) | 1289 | 1299 |

This segment can be found in the following protein(s): HUMPOMCZ_PEA_1_P1.

Segment cluster HUMPOMCZ_PEA_1_node_55 (SEQ ID NO:5498) according to the present invention can be found in the following transcript(s): HUMPOMCZ_PEA_1_T3 (SEQ ID NO:4160), HUMPOMCZ_PEA_1_T6 (SEQ ID NO:4161), HUMPOMCZ_PEA_1_T8 (SEQ ID NO:4162), HUMPOMCZ_PEA_1_T9 (SEQ ID NO:4163) and HUMPOMCZ_PEA_1_T10 (SEQ ID NO:4164). Table 4991 below describes the starting and ending position of this segment on each transcript.

TABLE 4991

Segment location on transcripts

| Transcript name | Segment starting position | Segment ending position |
|---|---|---|
| HUMPOMCZ_PEA_1_T3 (SEQ ID NO: 4160) | 1182 | 1203 |
| HUMPOMCZ_PEA_1_T6 (SEQ ID NO: 4161) | 1162 | 1183 |
| HUMPOMCZ_PEA_1_T8 (SEQ ID NO: 4162) | 1212 | 1233 |
| HUMPOMCZ_PEA_1_T9 (SEQ ID NO: 4163) | 1252 | 1273 |
| HUMPOMCZ_PEA_1_T10 (SEQ ID NO: 4164) | 1300 | 1321 |

This segment can be found in the following protein(s): HUMPOMCZ_PEA_1_P1.

Description for Cluster HUMRAP1GAP

Cluster HUMRAP1GAP features 17 transcript(s) and 65 segment(s) of interest, the names for which are given in Tables 4992 and 4993, respectively, the sequences themselves are given at the end of the application. The selected protein variants are given in Table 4994.

TABLE 4992

Transcripts of interest
Transcript Name

HUMRAP1GAP_T1 (SEQ ID NO: 4165)
HUMRAP1GAP_T2 (SEQ ID NO: 4166)
HUMRAP1GAP_T3 (SEQ ID NO: 4167)
HUMRAP1GAP_T4 (SEQ ID NO: 4168)
HUMRAP1GAP_T5 (SEQ ID NO: 4169)
HUMRAP1GAP_T6 (SEQ ID NO: 4170)
HUMRAP1GAP_T7 (SEQ ID NO: 4171)
HUMRAP1GAP_T22 (SEQ ID NO: 4172)
HUMRAP1GAP_T33 (SEQ ID NO: 4173)
HUMRAP1GAP_T34 (SEQ ID NO: 4174)
HUMRAP1GAP_T36 (SEQ ID NO: 4175)
HUMRAP1GAP_T37 (SEQ ID NO: 4176)
HUMRAP1GAP_T41 (SEQ ID NO: 4177)

TABLE 4992-continued

Transcripts of interest
Transcript Name

HUMRAP1GAP_T47 (SEQ ID NO: 4178)
HUMRAP1GAP_T52 (SEQ ID NO: 4179)
HUMRAP1GAP_T55 (SEQ ID NO: 4180)
HUMRAP1GAP_T56 (SEQ ID NO: 4181)

TABLE 4993

Segments of interest
Segment Name

HUMRAP1GAP_node_0 (SEQ ID NO: 5499)
HUMRAP1GAP_node_3 (SEQ ID NO: 5500)
HUMRAP1GAP_node_10 (SEQ ID NO: 5501)
HUMRAP1GAP_node_12 (SEQ ID NO: 5502)
HUMRAP1GAP_node_13 (SEQ ID NO: 5503)
HUMRAP1GAP_node_19 (SEQ ID NO: 5504)
HUMRAP1GAP_node_29 (SEQ ID NO: 5505)
HUMRAP1GAP_node_42 (SEQ ID NO: 5506)
HUMRAP1GAP_node_52 (SEQ ID NO: 5507)
HUMRAP1GAP_node_66 (SEQ ID NO: 5508)
HUMRAP1GAP_node_67 (SEQ ID NO: 5509)
HUMRAP1GAP_node_74 (SEQ ID NO: 5510)
HUMRAP1GAP_node_75 (SEQ ID NO: 5511)
HUMRAP1GAP_node_85 (SEQ ID NO: 5512)
HUMRAP1GAP_node_88 (SEQ ID NO: 5513)
HUMRAP1GAP_node_98 (SEQ ID NO: 5514)
HUMRAP1GAP_node_107 (SEQ ID NO: 5515)
HUMRAP1GAP_node_111 (SEQ ID NO: 5516)
HUMRAP1GAP_node_2 (SEQ ID NO: 5517)
HUMRAP1GAP_node_5 (SEQ ID NO: 5518)
HUMRAP1GAP_node_7 (SEQ ID NO: 5519)
HUMRAP1GAP_node_8 (SEQ ID NO: 5520)
HUMRAP1GAP_node_15 (SEQ ID NO: 5521)
HUMRAP1GAP_node_17 (SEQ ID NO: 5522)
HUMRAP1GAP_node_23 (SEQ ID NO: 5523)
HUMRAP1GAP_node_25 (SEQ ID NO: 5524)
HUMRAP1GAP_node_27 (SEQ ID NO: 5525)
HUMRAP1GAP_node_34 (SEQ ID NO: 5526)
HUMRAP1GAP_node_37 (SEQ ID NO: 5527)
HUMRAP1GAP_node_38 (SEQ ID NO: 5528)
HUMRAP1GAP_node_41 (SEQ ID NO: 5529)
HUMRAP1GAP_node_46 (SEQ ID NO: 5530)
HUMRAP1GAP_node_47 (SEQ ID NO: 5531)
HUMRAP1GAP_node_49 (SEQ ID NO: 5532)
HUMRAP1GAP_node_50 (SEQ ID NO: 5533)
HUMRAP1GAP_node_54 (SEQ ID NO: 5534)
HUMRAP1GAP_node_55 (SEQ ID NO: 5535)
HUMRAP1GAP_node_56 (SEQ ID NO: 5536)
HUMRAP1GAP_node_58 (SEQ ID NO: 5537)
HUMRAP1GAP_node_61 (SEQ ID NO: 5538)
HUMRAP1GAP_node_63 (SEQ ID NO: 5539)
HUMRAP1GAP_node_64 (SEQ ID NO: 5540)
HUMRAP1GAP_node_73 (SEQ ID NO: 5541)
HUMRAP1GAP_node_76 (SEQ ID NO: 5542)
HUMRAP1GAP_node_77 (SEQ ID NO: 5543)
HUMRAP1GAP_node_78 (SEQ ID NO: 5544)
HUMRAP1GAP_node_81 (SEQ ID NO: 5545)
HUMRAP1GAP_node_84 (SEQ ID NO: 5546)
HUMRAP1GAP_node_87 (SEQ ID NO: 5547)
HUMRAP1GAP_node_89 (SEQ ID NO: 5548)
HUMRAP1GAP_node_90 (SEQ ID NO: 5549)
HUMRAP1GAP_node_91 (SEQ ID NO: 5550)
HUMRAP1GAP_node_92 (SEQ ID NO: 5551)
HUMRAP1GAP_node_93 (SEQ ID NO: 5552)
HUMRAP1GAP_node_94 (SEQ ID NO: 5553)
HUMRAP1GAP_node_97 (SEQ ID NO: 5554)
HUMRAP1GAP_node_100 (SEQ ID NO: 5555)
HUMRAP1GAP_node_101 (SEQ ID NO: 5556)
HUMRAP1GAP_node_102 (SEQ ID TABLE 4993-continued Segments of interest
Segment Name NO: 5557)
HUMRAP1GAP_node_104 (SEQ ID NO: 5558)
HUMRAP1GAP_node_105 (SEQ ID NO: 5559)
HUMRAP1GAP_node_106 (SEQ ID NO: 5560)
HUMRAP1GAP_node_108 (SEQ ID NO: 5561)
HUMRAP1GAP_node_109 (SEQ ID NO: 5562)
HUMRAP1GAP_node_110 (SEQ ID NO: 5563)

TABLE 4994

Proteins of interest

| Protein Name | Corresponding Transcript(s) |
|---|---|
| HUMRAP1GAP_P1 | HUMRAP1GAP_T33 (SEQ ID NO: 4173) |
| HUMRAP1GAP_P3 | HUMRAP1GAP_T7 (SEQ ID NO: 4171) |
| HUMRAP1GAP_P6 | HUMRAP1GAP_T34 (SEQ ID NO: 4174) |
| HUMRAP1GAP_P16 | HUMRAP1GAP_T22 (SEQ ID NO: 4172) |
| HUMRAP1GAP_P24 | HUMRAP1GAP_T36 (SEQ ID NO: 4175) |
| HUMRAP1GAP_P25 | HUMRAP1GAP_T37 (SEQ ID NO: 4176) |
| HUMRAP1GAP_P29 | HUMRAP1GAP_T41 (SEQ ID NO: 4177) |
| HUMRAP1GAP_P35 | HUMRAP1GAP_T47 (SEQ ID NO: 4178) |
| HUMRAP1GAP_P40 | HUMRAP1GAP_T52 (SEQ ID NO: 4179) |
| HUMRAP1GAP_P43 | HUMRAP1GAP_T55 (SEQ ID NO: 4180) |
| HUMRAP1GAP_P44 | HUMRAP1GAP_T56 (SEQ ID NO: 4181) |
| HUMRAP1GAP_P46 | HUMRAP1GAP_T1 (SEQ ID NO: 4165); HUMRAP1GAP_T2 (SEQ ID NO: 4166); HUMRAP1GAP_T3 (SEQ ID NO: 4167); HUMRAP1GAP_T4 (SEQ ID NO: 4168); HUMRAP1GAP_T5 (SEQ ID NO: 4169); HUMRAP1GAP_T6 (SEQ ID NO: 4170) |

These sequences are variants of the known protein Rap1 GTPase-activating protein 1 (SwissProt accession identifier RGP2_HUMAN; known also according to the synonyms Rap1GAP), referred to herein as the previously known protein.

Protein Rap1 GTPase-activating protein 1 is known or believed to have the following function(s): GTPase activator for the nuclear Ras-related regulatory protein RAP-1A (KREV-1), converting it to the putatively inactive GDP-bound state. The sequence for protein Rap1 GTPase-activating protein 1 is given at the end of the application, as "Rap1 GTPase-activating protein 1 amino acid sequence". Protein Rap1 GTPase-activating protein 1 localization is believed to be Associated with Golgi membranes.

The following GO Annotation(s) apply to the previously known protein. The following annotation(s) were found: signal transduction, which are annotation(s) related to Biological Process; GTPase activator, which are annotation(s) related to Molecular Function; and membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HUMRAP1GAP features 65 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMRAP1GAP_node_0 (SEQ ID NO:5499) according to the present invention is supported by 10 libraries. The number of libraries was determined as previously described. This segment can be found in the following transcript(s): HUMRAP1GAP_T2 (SEQ ID NO:4166), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T47 (SEQ ID NO:4178), HUMRAP1GAP_T52 (SEQ ID NO:4179), HUMRAP1GAP_T55 (SEQ ID NO:4180) and HUMRAP1GAP_T56 (SEQ ID NO:4181). Table 4995 below describes the starting and ending position of this segment on each transcript.

TABLE 4995

Segment location on transcripts

| Transcript name | Segment starting position | Segment ending position |
|---|---|---|
| HUMRAP1GAP_T2 (SEQ ID NO: 4166) | 1 | 530 |
| HUMRAP1GAP_T6 (SEQ ID NO: 4170) | 1 | 530 |
| HUMRAP1GAP_T7 (SEQ ID NO: 4171) | 1 | 530 |
| HUMRAP1GAP_T22 (SEQ ID NO: 4172) | 1 | 530 |
| HUMRAP1GAP_T33 (SEQ ID NO: 4173) | 1 | 530 |
| HUMRAP1GAP_T34 (SEQ ID NO: 4174) | 1 | 530 |
| HUMRAP1GAP_T47 (SEQ ID NO: 4178) | 1 | 530 |
| HUMRAP1GAP_T52 (SEQ ID NO: 4179) | 1 | 530 |
| HUMRAP1GAP_T55 (SEQ ID NO: 4180) | 1 | 530 |
| HUMRAP1GAP_T56 (SEQ ID NO: 4181) | 1 | 530 |

This segment can be found in both coding and non-coding regions of transcript(s) as follows. The segment can be found in a non-coding region of transcript(s) that are related to the following protein(s): HUMRAP1GAP_P46, HUMRAP1GAP_P3 and HUMRAP1GAP_P16. This segment can also be found in the following protein(s): HUMRAP1GAP_P1, HUMRAP1GAP_P6, HUMRAP1GAP_P35, HUMRAP1GAP_P40, HUMRAP1GAP_P43 and HUMRAP1GAP_P44, since it is in the coding region for the corresponding transcript.

Segment cluster HUMRAP1GAP_node_3 (SEQ ID NO:5500) according to the present invention is supported by 3 libraries. The number of libraries was determined as previously described. This segment can be found in the following transcript(s): HUMRAP1GAP_T52 (SEQ ID NO:4179). Table 4996 below describes the starting and ending position of this segment on each transcript.

TABLE 4996

Segment location on transcripts

| Transcript name | Segment starting position | Segment ending position |
|---|---|---|
| HUMRAP1GAP_T52 (SEQ ID NO: 4179) | 614 | 1179 |

This segment can be found in the following protein(s): HUMRAP1GAP_P40.

Segment cluster HUMRAP1GAP_node_10 (SEQ ID NO:5501) according to the present invention is supported by 2 libraries. The number of libraries was determined as previously described. This segment can be found in the following transcript(s): HUMRAP1GAP_T4 (SEQ ID NO:4168). Table 4997 below describes the starting and ending position of this segment on each transcript.

TABLE 4997

Segment location on transcripts

| Transcript name | Segment starting position | Segment ending position |
|---|---|---|
| HUMRAP1GAP_T4 (SEQ ID NO: 4168) | 1 | 172 |

This segment can be found in a non-coding region of transcript(s) that are related to the following protein(s): HUMRAP1GAP_P46.

Segment cluster HUMRAP1GAP_node_12 (SEQ ID NO:5502) according to the present invention is supported by 8 libraries. The number of libraries was determined as previously described. This segment can be found in the following transcript(s): HUMRAP1GAP_T1 (SEQ ID NO:4165) and HUMRAP1GAP_T3 (SEQ ID NO:4167). Table 4998 below describes the starting and ending position of this segment on each transcript.

TABLE 4998

Segment location on transcripts

| Transcript name | Segment starting position | Segment ending position |
|---|---|---|
| HUMRAP1GAP_T1 (SEQ ID NO: 4165) | 1 | 125 |
| HUMRAP1GAP_T3 (SEQ ID NO: 4167) | 1 | 125 |

This segment can be found in a non-coding region of transcript(s) that are related to the following protein(s): HUMRAP1GAP_P46.

Segment cluster HUMRAP1GAP_node_13 (SEQ ID NO:5503) according to the present invention is supported by 3 libraries. The number of libraries was determined as previously described. This segment can be found in the following transcript(s): HUMRAP1GAP_T3 (SEQ ID NO:4167). Table 4999 below describes the starting and ending position of this segment on each transcript.

TABLE 4999

Segment location on transcripts

| Transcript name | Segment starting position | Segment ending position |
|---|---|---|
| HUMRAP1GAP_T3 (SEQ ID NO: 4167) | 126 | 512 |

This segment can be found in a non-coding region of transcript(s) that are related to the following protein(s): HUMRAP1GAP_P46.

Segment cluster HUMRAP1GAP_node_19 (SEQ ID NO:5504) according to the present invention is supported by 2 libraries. The number of libraries was determined as previously described. This segment can be found in the following transcript(s): HUMRAP1GAP_T55 (SEQ ID NO:4180) and HUMRAP1GAP_T56 (SEQ ID NO:4181). Table 5000 below describes the starting and ending position of this segment on each transcript.

TABLE 5000

Segment location on transcripts

| Transcript name | Segment starting position | Segment ending position |
|---|---|---|
| HUMRAP1GAP_T55 (SEQ ID NO: 4180) | 661 | 960 |
| HUMRAP1GAP_T56 (SEQ ID NO: 4181) | 851 | 1150 |

This segment can be found in both coding and non-coding regions of transcript(s) as follows. The segment can be found in a non-coding region of transcript(s) that are related to the following protein(s): HUMRAP1GAP_P44. This segment can also be found in the following protein(s): HUMRAP1GAP_P43, since it is in the coding region for the corresponding transcript.

Segment cluster HUMRAP1GAP_node_29 (SEQ ID NO:5505) according to the present invention is supported by 45 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5001 below describes the starting and ending position of this segment on each transcript.

TABLE 5001

Segment location on transcripts

| Transcript name | Segment starting position | Segment ending position |
|---|---|---|
| HUMRAP1GAP_T1 (SEQ ID NO: 4165) | 379 | 564 |
| HUMRAP1GAP_T2 (SEQ ID NO: 4166) | 891 | 1076 |

TABLE 5001-continued

Segment location on transcripts

| Transcript name | Segment starting position | Segment ending position |
|---|---|---|
| HUMRAP1GAP_T3 (SEQ ID NO: 4167) | 766 | 951 |
| HUMRAP1GAP_T4 (SEQ ID NO: 4168) | 426 | 611 |
| HUMRAP1GAP_T5 (SEQ ID NO: 4169) | 445 | 630 |
| HUMRAP1GAP_T6 (SEQ ID NO: 4170) | 867 | 1052 |
| HUMRAP1GAP_T7 (SEQ ID NO: 4171) | 855 | 1040 |
| HUMRAP1GAP_T33 (SEQ ID NO: 4173) | 784 | 969 |
| HUMRAP1GAP_T34 (SEQ ID NO: 4174) | 784 | 969 |
| HUMRAP1GAP_T47 (SEQ ID NO: 4178) | 784 | 969 |

This segment can be found in the following protein(s). HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_42 (SEQ ID NO:5506) according to the present invention is supported by 5 libraries. The number of libraries was determined as previously described. This segment can be found in the following transcript(s): HUMRAP1GAP_T47 (SEQ ID NO:4178). Table 5002 below describes the starting and ending position of this segment on each transcript.

TABLE 5002

Segment location on transcripts

| Transcript name | Segment starting position | Segment ending position |
|---|---|---|
| HUMRAP1GAP_T47 (SEQ ID NO: 4178) | 1207 | 1999 |

This segment can be found in the following protein(s): HUMRAP1GAP_P35.

Segment cluster HUMRAP1GAP_node_52 (SEQ ID NO:5507) according to the present invention is supported by 60 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and, HUMRAP1GAP_T34 (SEQ ID NO:4174). Table 5003 below describes the starting and ending position of this segment on each transcript.

TABLE 5003

Segment location on transcripts

| Transcript name | Segment starting position | Segment ending position |
|---|---|---|
| HUMRAP1GAP_T1 (SEQ ID NO: 4165) | 987 | 1116 |
| HUMRAP1GAP_T2 (SEQ ID NO: 4166) | 1499 | 1628 |
| HUMRAP1GAP_T3 (SEQ ID NO: 4167) | 1374 | 1503 |
| HUMRAP1GAP_T4 (SEQ ID NO: 4168) | 1034 | 1163 |
| HUMRAP1GAP_T5 (SEQ ID NO: 4169) | 1053 | 1182 |
| HUMRAP1GAP_T6 (SEQ ID NO: 4170) | 1475 | 1604 |
| HUMRAP1GAP_T7 (SEQ ID NO: 4171) | 1463 | 1592 |
| HUMRAP1GAP_T22 (SEQ ID NO: 4172) | 743 | 872 |
| HUMRAP1GAP_T33 (SEQ ID NO: 4173) | 1392 | 1521 |
| HUMRAP1GAP_T34 (SEQ ID NO: 4174) | 1392 | 1521 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_66 (SEQ ID NO:5508) according to the present invention is supported by 13 libraries. The number of libraries was determined as previously described. This segment can be found in the following transcript(s): HUMRAP1GAP_T36 (SEQ ID NO:4175) and HUMRAP1GAP_T37 (SEQ ID NO:4176). Table 5004 below describes the starting and ending position of this segment on each transcript.

TABLE 5004

Segment location on transcripts

| Transcript name | Segment starting position | Segment ending position |
|---|---|---|
| HUMRAP1GAP_T36 (SEQ ID NO: 4175) | 1 | 1472 |
| HUMRAP1GAP_T37 (SEQ ID NO: 4176) | 1 | 1472 |

This segment can be found in the following protein(s): HUMRAP1GAP_P24 and HUMRAP1GAP_P25.

Segment cluster HUMRAP1GAP_node_67 (SEQ ID NO:5509) according to the present invention is supported by 80 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175) and HUMRAP1GAP_T37 (SEQ ID NO:4176). Table 5005 below describes the starting and ending position of this segment on each transcript.

TABLE 5005

Segment location on transcripts

| Transcript name | Segment starting position | Segment ending position |
|---|---|---|
| HUMRAP1GAP_T1 (SEQ ID NO: 4165) | 1570 | 1701 |
| HUMRAP1GAP_T2 (SEQ ID NO: 4166) | 2082 | 2213 |
| HUMRAP1GAP_T3 (SEQ ID NO: 4167) | 1957 | 2088 |
| HUMRAP1GAP_T4 (SEQ ID NO: 4168) | 1617 | 1748 |
| HUMRAP1GAP_T5 (SEQ ID NO: 4169) | 1636 | 1767 |
| HUMRAP1GAP_T6 (SEQ ID NO: 4170) | 2058 | 2189 |
| HUMRAP1GAP_T7 (SEQ ID NO: 4171) | 2046 | 2177 |
| HUMRAP1GAP_T22 (SEQ ID NO: 4172) | 1326 | 1457 |
| HUMRAP1GAP_T33 (SEQ ID NO: 4173) | 1975 | 2106 |
| HUMRAP1GAP_T34 (SEQ ID NO: 4174) | 1975 | 2106 |
| HUMRAP1GAP_T36 (SEQ ID NO: 4175) | 1473 | 1604 |
| HUMRAP1GAP_T37 (SEQ ID NO: 4176) | 1473 | 1604 |

This segment can be found in the following protein(s): HUMRAP1GAP_P46, HUMRAP1GAP_P3, HUMRAP1GAP_P16, HUMRAP1GAP_P1, HUMRAP1GAP_P6, HUMRAP1GAP_P24 and HUMRAP1GAP_P25.

Segment cluster HUMRAP1GAP_node_74 (SEQ ID NO:5510) according to the present invention is supported by 16 libraries. The number of libraries was determined as previously described. This segment can be found in the following transcript(s): HUMRAP1GAP_T36 (SEQ ID NO:4175). Table 5006 below describes the starting and ending position of this segment on each transcript.

TABLE 5006

Segment location on transcripts

| Transcript name | Segment starting position | Segment ending position |
|---|---|---|
| HUMRAP1GAP_T36 (SEQ ID NO: 4175) | 1683 | 1859 |

This segment can be found in the following protein(s): HUMRAP1GAP_P24.

Segment cluster HUMRAP1GAP_node_75 (SEQ ID NO:5511) according to the present invention is supported by 30 libraries. The number of libraries was determined as previously described. This segment can be found in the following transcript(s): HUMRAP1GAP_T36 (SEQ ID NO:4175). Table 5007 below describes the starting and ending position of this segment on each transcript.

TABLE 5007

Segment location on transcripts

| Transcript name | Segment starting position | Segment ending position |
|---|---|---|
| HUMRAP1GAP_T36 (SEQ ID NO: 4175) | 1860 | 2602 |

This segment can be found in the following protein(s): HUMRAP1GAP_P24.

Segment cluster HUMRAP1GAP_node_85 (SEQ ID NO:5512) according to the present invention is supported by 98 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5008 below describes the starting and ending position of this segment on each transcript.

TABLE 5008

Segment location on transcripts

| Transcript name | Segment starting position | Segment ending position |
|---|---|---|
| HUMRAP1GAP_T1 (SEQ ID NO: 4165) | 1926 | 2049 |
| HUMRAP1GAP_T2 (SEQ ID NO: 4166) | 2438 | 2561 |
| HUMRAP1GAP_T3 (SEQ ID NO: 4167) | 2313 | 2436 |
| HUMRAP1GAP_T4 (SEQ ID NO: 4168) | 1973 | 2096 |
| HUMRAP1GAP_T5 (SEQ ID NO: 4169) | 1992 | 2115 |
| HUMRAP1GAP_T6 (SEQ ID NO: 4170) | 2414 | 2537 |
| HUMRAP1GAP_T7 (SEQ ID NO: 4171) | 2402 | 2525 |
| HUMRAP1GAP_T22 (SEQ ID NO: 4172) | 1682 | 1805 |
| HUMRAP1GAP_T33 (SEQ ID NO: 4173) | 2331 | 2454 |
| HUMRAP1GAP_T34 (SEQ ID NO: 4174) | 2331 | 2454 |
| HUMRAP1GAP_T36 (SEQ ID NO: 4175) | 2827 | 2950 |
| HUMRAP1GAP_T37 (SEQ ID NO: 4176) | 1829 | 1952 |
| HUMRAP1GAP_T41 (SEQ ID NO: 4177) | 57 | 180 |

This segment can be found in both coding and non-coding regions of transcript(s) as follows. The segment can be found in a non-coding region of transcript(s) that are related to the following protein(s): HUMRAP1GAP_P24 and HUMRAP1GAP_P29. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node_88 (SEQ ID NO:5513) according to the present invention is supported by 3 libraries. The number of libraries was determined as previously described. This segment can be found in the following transcript(s): HUMRAP1GAP_T41 (SEQ ID NO:4177). Table 5009 below describes the starting and ending position of this segment on each transcript.

TABLE 5009

| Transcript name | Segment location on transcripts | |
|---|---|---|
| | Segment starting position | Segment ending position |
| HUMRAP1GAP_T41 (SEQ ID NO: 4177) | 284 | 587 |

This segment can be found in the following protein(s): HUMRAP1GAP_P29.

Segment cluster HUMRAP1GAP_node_98 (SEQ ID NO:5514) according to the present invention is supported by 6 libraries. The number of libraries was determined as previously described. This segment can be found in the following transcript(s): HUMRAP1GAP_T33 (SEQ ID NO:4173) and HUMRAP1GAP_T34 (SEQ ID NO:4174). Table 5010 below describes the starting and ending position of this segment on each transcript.

TABLE 5010

| Transcript name | Segment location on transcripts | |
|---|---|---|
| | Segment starting position | Segment ending position |
| HUMRAP1GAP_T33 (SEQ ID NO: 4173) | 2705 | 3008 |
| HUMRAP1GAP_T34 (SEQ ID NO: 4174) | 2736 | 3039 |

This segment can be found in a non-coding region of transcript(s) that are related to the following protein(s): HUMRAP1GAP_P1 and HUMRAP1GAP_P6.

Segment cluster HUMRAP1GAP_node_107 (SEQ ID NO:5515) according to the present invention is supported by 127 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5011 below describes the starting and ending position of this segment on each transcript.

TABLE 5011

| Transcript name | Segment location on transcripts | |
|---|---|---|
| | Segment starting position | Segment ending position |
| HUMRAP1GAP_T1 (SEQ ID NO: 4165) | 2819 | 3003 |
| HUMRAP1GAP_T2 (SEQ ID NO: 4166) | 3331 | 3515 |
| HUMRAP1GAP_T3 (SEQ ID NO: 4167) | 3206 | 3390 |
| HUMRAP1GAP_T4 (SEQ ID NO: 4168) | 2866 | 3050 |
| HUMRAP1GAP_T5 (SEQ ID NO: 4169) | 2885 | 3069 |
| HUMRAP1GAP_T6 (SEQ ID NO: 4170) | 3307 | 3491 |
| HUMRAP1GAP_T7 (SEQ ID NO: 4171) | 3295 | 3479 |
| HUMRAP1GAP_T22 (SEQ ID NO: 4172) | 2575 | 2759 |
| HUMRAP1GAP_T36 (SEQ ID NO: 4175) | 3720 | 3904 |
| HUMRAP1GAP_T37 (SEQ ID NO: 4176) | 2722 | 2906 |
| HUMRAP1GAP_T41 (SEQ ID NO: 4177) | 1285 | 1469 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Segment cluster HUMRAP1GAP_node_111 (SEQ ID NO:5516) according to the present invention is supported by 91 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5012 below describes the starting and ending position of this segment on each transcript.

TABLE 5012

| Transcript name | Segment location on transcripts | |
|---|---|---|
| | Segment starting position | Segment ending position |
| HUMRAP1GAP_T1 (SEQ ID NO: 4165) | 3206 | 3356 |
| HUMRAP1GAP_T2 (SEQ ID NO: 4166) | 3718 | 3868 |
| HUMRAP1GAP_T3 (SEQ ID NO: 4167) | 3593 | 3743 |
| HUMRAP1GAP_T4 (SEQ ID NO: 4168) | 3253 | 3403 |
| HUMRAP1GAP_T5 (SEQ ID NO: 4169) | 3272 | 3422 |
| HUMRAP1GAP_T6 (SEQ ID NO: 4170) | 3694 | 3844 |
| HUMRAP1GAP_T7 (SEQ ID NO: 4171) | 3682 | 3832 |

TABLE 5012-continued

Segment location on transcripts

| Transcript name | Segment starting position | Segment ending position |
|---|---|---|
| HUMRAP1GAP_T22 (SEQ ID NO: 4172) | 2962 | 3112 |
| HUMRAP1GAP_T36 (SEQ ID NO: 4175) | 4107 | 4257 |
| HUMRAP1GAP_T37 (SEQ ID NO: 4176) | 3109 | 3259 |
| HUMRAP1GAP_T41 (SEQ ID NO: 4177) | 1672 | 1822 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

According to an optional embodiment of the present invention, short segments related to the above cluster are also provided. These segments are up to about 120 bp in length, and so are included in a separate description.

Segment cluster HUMRAP1GAP_node_2 (SEQ ID NO:5517) according to the present invention is supported by 4 libraries. The number of libraries was determined as previously described. This segment can be found in the following transcript(s): HUMRAP1GAP_T6 (SEQ ID NO:4170), HUMRAP1GAP_T22 (SEQ ID NO:4172) HUMRAP1GAP_T52 (SEQ ID NO:4179) and HUMRAP1GAP_T56 (SEQ ID NO:4181). Table 5013 below describes the starting and ending position of this segment on each transcript.

TABLE 5013

Segment location on transcripts

| Transcript name | Segment starting position | Segment ending position |
|---|---|---|
| HUMRAP1GAP_T6 (SEQ ID NO: 4170) | 531 | 613 |
| HUMRAP1GAP_T22 (SEQ ID NO: 4172) | 531 | 613 |
| HUMRAP1GAP_T52 (SEQ ID NO: 4179) | 531 | 613 |
| HUMRAP1GAP_T56 (SEQ ID NO: 4181) | 531 | 613 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5014.

TABLE 5014

Oligonucleotides related to this segment

| Oligonucleotide name | Overexpressed in cancers | Chip reference |
|---|---|---|
| HUMRAP1GAP_0_0_18843 | colorectal cancer | Colon |
| HUMRAP1GAP_0_0_18843 | lung malignant tumors | LUN |

This segment can be found in both coding and non-coding regions of transcript(s) as follows. The segment can be found in a non-coding region of transcript(s) that are related to the following protein(s): HUMRAP1GAP_P46 and HUMRAP1GAP_P16. This segment can also be found in the following protein(s): HUMRAP1GAP_P40 and HUMRAP1GAP_P44, since it is in the coding region for the corresponding transcript.

Segment cluster HUMRAP1GAP_node_5 (SEQ ID NO:5518) according to the present invention is supported by 2 libraries. The number of libraries was determined as previously described. This segment can be found in the following transcript(s): HUMRAP1GAP_T5 (SEQ ID NO:4169). Table 5015 below describes the starting and ending position of this segment on each transcript.

TABLE 5015

Segment location on transcripts

| Transcript name | Segment starting position | Segment ending position |
|---|---|---|
| HUMRAP1GAP_T5 (SEQ ID NO: 4169) | 1 | 84 |

This segment can be found in a non-coding region of transcript(s) that are related to the following protein(s): HUMRAP1GAP_P46.

Segment cluster HUMRAP1GAP_node_7 (SEQ ID NO:5519) according to the present invention is supported by 8 libraries. The number of libraries was determined as previously described. This segment can be found in the following transcript(s): HUMRAP1GAP_T2 (SEQ ID NO:4166), HUMRAP1GAP_T5 (SEQ ID NO:4169), HUMRAP1GAP_T7 (SEQ ID NO:4171), HUMRAP1GAP_T22 (SEQ ID NO:4172) and HUMRAP1GAP_T56 (SEQ ID NO:4181). Table 5016 below describes the starting and ending position of this segment on each transcript.

TABLE 5016

Segment location on transcripts

| Transcript name | Segment starting position | Segment ending position |
|---|---|---|
| HUMRAP1GAP_T2 (SEQ ID NO: 4166) | 531 | 558 |
| HUMRAP1GAP_T5 (SEQ ID NO: 4169) | 85 | 112 |
| HUMRAP1GAP_T7 (SEQ ID NO: 4171) | 531 | 558 |
| HUMRAP1GAP_T22 (SEQ ID NO: 4172) | 614 | 641 |
| HUMRAP1GAP_T56 (SEQ ID NO: 4181) | 614 | 641 |

This segment can be found in both coding and non-coding regions of transcript(s) as follows. The segment can be found in a non-coding region of transcript(s) that are related to the following protein(s): HUMRAP1GAP_P46, HUMRAP1GAP_P3 and HUMRAP1GAP_P16. This segment can also be found in the following protein(s): HUMRAP1GAP_P44, since it is in the coding region for the corresponding transcript.

Segment cluster HUMRAP1GAP_node_8 (SEQ ID NO:5520) according to the present invention is supported by 6 libraries. The number of libraries was determined as previously described. This segment can be found in the following transcript(s): HUMRAP1GAP_T2 (SEQ ID NO:4166), HUMRAP1GAP_T5 (SEQ ID NO:4169), HUMRAP1GAP_T7 (SEQ ID NO:4171) and HUMRAP1GAP_T56 (SEQ ID NO:4181). Table 5017 below describes the starting and ending position of this segment on each transcript.

TABLE 5017

Segment location on transcripts

| Transcript name | Segment starting position | Segment ending position |
| --- | --- | --- |
| HUMRAP1GAP_T2 (SEQ ID NO: 4166) | 559 | 637 |
| HUMRAP1GAP_T5 (SEQ ID NO: 4169) | 113 | 191 |
| HUMRAP1GAP_T7 (SEQ ID NO: 4171) | 559 | 637 |
| HUMRAP1GAP_T56 (SEQ ID NO: 4181) | 642 | 720 |

This segment can be found in a non-coding region of transcript(s) that are related to the following protein(s): HUMRAP1GAP_P46, HUMRAP1GAP_P3 and HUMRAP1GAP_P44.

Segment cluster HUMRAP1GAP_node_15 (SEQ ID NO:5521) according to the present invention is supported by 27 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T33 (SEQ ID NO:4173), HUMRAP1GAP_T34 (SEQ ID NO:4174), HUMRAP1GAP_T47 (SEQ ID NO:4178), HUMRAP1GAP_T55 (SEQ ID NO:4180) and HUMRAP1GAP_T56 (SEQ ID NO:4181). Table 5018 below describes the starting and ending position of this segment on each transcript.

TABLE 5018

Segment location on transcripts

| Transcript name | Segment starting position | Segment ending position |
| --- | --- | --- |
| HUMRAP1GAP_T1 (SEQ ID NO: 4165) | 126 | 161 |
| HUMRAP1GAP_T2 (SEQ ID NO: 4166) | 638 | 673 |
| HUMRAP1GAP_T3 (SEQ ID NO: 4167) | 513 | 548 |
| HUMRAP1GAP_T4 (SEQ ID NO: 4168) | 173 | 208 |
| HUMRAP1GAP_T5 (SEQ ID NO: 4169) | 192 | 227 |
| HUMRAP1GAP_T6 (SEQ ID NO: 4170) | 614 | 649 |
| HUMRAP1GAP_T33 (SEQ ID NO: 4173) | 531 | 566 |
| HUMRAP1GAP_T34 (SEQ ID NO: 4174) | 531 | 566 |
| HUMRAP1GAP_T47 (SEQ ID NO: 4178) | 531 | 566 |
| HUMRAP1GAP_T55 (SEQ ID NO: 4180) | 531 | 566 |
| HUMRAP1GAP_T56 (SEQ ID NO: 4181) | 721 | 756 |

This segment can be found in both coding and non-coding regions of transcript(s) as follows. The segment can be found in a non-coding region of transcript(s) that are related to the following protein(s): HUMRAP1GAP_P46 and HUMRAP1GAP_P44. This segment can also be found in the following protein(s): HUMRAP1GAP_P1, HUMRAP1GAP_P6, HUMRAP1GAP_P35 and HUMRAP1GAP_P43, since it is in the coding region for the corresponding transcript.

Segment cluster HUMRAP1GAP_node_17 (SEQ ID NO:5522) according to the present invention is supported by 32 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174), HUMRAP1GAP_T47 (SEQ ID NO:4178), HUMRAP1GAP_T55 (SEQ ID NO:4180) and HUMRAP1GAP_T56 (SEQ ID NO:4181). Table 5019 below describes the starting and ending position of this segment on each transcript.

TABLE 5019

Segment location on transcripts

| Transcript name | Segment starting position | Segment ending position |
| --- | --- | --- |
| HUMRAP1GAP_T1 (SEQ ID NO: 4165) | 162 | 255 |
| HUMRAP1GAP_T2 (SEQ ID NO: 4166) | 674 | 767 |
| HUMRAP1GAP_T3 (SEQ ID NO: 4167) | 549 | 642 |
| HUMRAP1GAP_T4 (SEQ ID NO: 4168) | 209 | 302 |
| HUMRAP1GAP_T5 (SEQ ID NO: 4169) | 228 | 321 |
| HUMRAP1GAP_T6 (SEQ ID NO: 4170) | 650 | 743 |
| HUMRAP1GAP_T7 (SEQ ID NO: 4171) | 638 | 731 |
| HUMRAP1GAP_T33 (SEQ ID NO: 4173) | 567 | 660 |
| HUMRAP1GAP_T34 (SEQ ID NO: 4174) | 567 | 660 |
| HUMRAP1GAP_T47 (SEQ ID NO: 4178) | 567 | 660 |
| HUMRAP1GAP_T55 (SEQ ID NO: 4180) | 567 | 660 |
| HUMRAP1GAP_T56 (SEQ ID NO: 4181) | 757 | 850 |

This segment can be found in both coding and non-coding regions of transcript(s) as follows. The segment can be found in a non-coding region of transcript(s) that are related to the following protein(s): HUMRAP1GAP_P46, HUMRAP1GAP_P3 and HUMRAP1GAP_P44. This segment can also be found in the following protein(s): HUMRAP1GAP_P1, HUMRAP1GAP_P6, HUMRAP1GAP_P35 and HUMRAP1GAP_P43, since it is in the coding region for the corresponding transcript.

Segment cluster HUMRAP1GAP_node_23 (SEQ ID NO:5523) according to the present invention is supported by 32 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5020 below describes the starting and ending position of this segment on each transcript.

TABLE 5020

Segment location on transcripts

| Transcript name | Segment starting position | Segment ending position |
|---|---|---|
| HUMRAP1GAP_T1 (SEQ ID NO: 4165) | 256 | 291 |
| HUMRAP1GAP_T2 (SEQ ID NO: 4166) | 768 | 803 |
| HUMRAP1GAP_T3 (SEQ ID NO: 4167) | 643 | 678 |
| HUMRAP1GAP_T4 (SEQ ID NO: 4168) | 303 | 338 |
| HUMRAP1GAP_T5 (SEQ ID NO: 4169) | 322 | 357 |
| HUMRAP1GAP_T6 (SEQ ID NO: 4170) | 744 | 779 |
| HUMRAP1GAP_T7 (SEQ ID NO: 4171) | 732 | 767 |
| HUMRAP1GAP_T33 (SEQ ID NO: 4173) | 661 | 696 |
| HUMRAP1GAP_T34 (SEQ ID NO: 4174) | 661 | 696 |
| HUMRAP1GAP_T47 (SEQ ID NO: 4178) | 661 | 696 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_25 (SEQ ID NO:5524) according to the present invention is supported by 34 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5021 below describes the starting and ending position of this segment on each transcript.

TABLE 5021

Segment location on transcripts

| Transcript name | Segment starting position | Segment ending position |
|---|---|---|
| HUMRAP1GAP_T1 (SEQ ID NO: 4165) | 292 | 339 |
| HUMRAP1GAP_T2 (SEQ ID NO: 4166) | 804 | 851 |
| HUMRAP1GAP_T3 (SEQ ID NO: 4167) | 679 | 726 |
| HUMRAP1GAP_T4 (SEQ ID NO: 4168) | 339 | 386 |
| HUMRAP1GAP_T5 (SEQ ID NO: 4169) | 358 | 405 |
| HUMRAP1GAP_T6 (SEQ ID NO: 4170) | 780 | 827 |
| HUMRAP1GAP_T7 (SEQ ID NO: 4171) | 768 | 815 |
| HUMRAP1GAP_T33 (SEQ ID NO: 4173) | 697 | 744 |
| HUMRAP1GAP_T34 (SEQ ID NO: 4174) | 697 | 744 |
| HUMRAP1GAP_T47 (SEQ ID NO: 4178) | 697 | 744 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_27 (SEQ ID NO:5525) according to the present invention is supported by 34 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5022 below describes the starting and ending position of this segment on each transcript.

TABLE 5022

Segment location on transcripts

| Transcript name | Segment starting position | Segment ending position |
|---|---|---|
| HUMRAP1GAP_T1 (SEQ ID NO: 4165) | 340 | 378 |
| HUMRAP1GAP_T2 (SEQ ID NO: 4166) | 852 | 890 |
| HUMRAP1GAP_T3 (SEQ ID NO: 4167) | 727 | 765 |
| HUMRAP1GAP_T4 (SEQ ID NO: 4168) | 387 | 425 |
| HUMRAP1GAP_T5 (SEQ ID NO: 4169) | 406 | 444 |
| HUMRAP1GAP_T6 (SEQ ID NO: 4170) | 828 | 866 |
| HUMRAP1GAP_T7 (SEQ ID NO: 4171) | 816 | 854 |
| HUMRAP1GAP_T33 (SEQ ID NO: 4173) | 745 | 783 |
| HUMRAP1GAP_T34 (SEQ ID NO: 4174) | 745 | 783 |
| HUMRAP1GAP_T47 (SEQ ID NO: 4178) | 745 | 783 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_34 (SEQ ID NO:5526) according to the present invention is supported by 50 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5023 below describes the starting and ending position of this segment on each transcript.

TABLE 5023

| Segment location on transcripts | | |
|---|---|---|
| Transcript name | Segment starting position | Segment ending position |
| HUMRAP1GAP_T1 (SEQ ID NO: 4165) | 565 | 668 |
| HUMRAP1GAP_T2 (SEQ ID NO: 4166) | 1077 | 1180 |
| HUMRAP1GAP_T3 (SEQ ID NO: 4167) | 952 | 1055 |
| HUMRAP1GAP_T4 (SEQ ID NO: 4168) | 612 | 715 |
| HUMRAP1GAP_T5 (SEQ ID NO: 4169) | 631 | 734 |
| HUMRAP1GAP_T6 (SEQ ID NO: 4170) | 1053 | 1156 |
| HUMRAP1GAP_T7 (SEQ ID NO: 4171) | 1041 | 1144 |
| HUMRAP1GAP_T33 (SEQ ID NO: 4173) | 970 | 1073 |
| HUMRAP1GAP_T34 (SEQ ID NO: 4174) | 970 | 1073 |
| HUMRAP1GAP_T47 (SEQ ID NO: 4178) | 970 | 1073 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_37 (SEQ ID NO:5527) according to the present invention is supported by 43 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5024 below describes the starting and ending position of this segment on each transcript.

TABLE 5024

| Segment location on transcripts | | |
|---|---|---|
| Transcript name | Segment starting position | Segment ending position |
| HUMRAP1GAP_T1 (SEQ ID NO: 4165) | 669 | 716 |
| HUMRAP1GAP_T2 (SEQ ID NO: 4166) | 1181 | 1228 |
| HUMRAP1GAP_T3 (SEQ ID NO: 4167) | 1056 | 1103 |
| HUMRAP1GAP_T4 (SEQ ID NO: 4168) | 716 | 763 |
| HUMRAP1GAP_T5 (SEQ ID NO: 4169) | 735 | 782 |
| HUMRAP1GAP_T6 (SEQ ID NO: 4170) | 1157 | 1204 |
| HUMRAP1GAP_T7 (SEQ ID NO: 4171) | 1145 | 1192 |
| HUMRAP1GAP_T33 (SEQ ID NO: 4173) | 1074 | 1121 |
| HUMRAP1GAP_T34 (SEQ ID NO: 4174) | 1074 | 1121 |
| HUMRAP1GAP_T47 (SEQ ID NO: 4178) | 1074 | 1121 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_38 (SEQ ID NO:5528) according to the present invention is supported by 42 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5025 below describes the starting and ending position of this segment on each transcript.

TABLE 5025

| Segment location on transcripts | | |
|---|---|---|
| Transcript name | Segment starting position | Segment ending position |
| HUMRAP1GAP_T1 (SEQ ID NO: 4165) | 717 | 747 |
| HUMRAP1GAP_T2 (SEQ ID NO: 4166) | 1229 | 1259 |
| HUMRAP1GAP_T3 (SEQ ID NO: 4167) | 1104 | 1134 |
| HUMRAP1GAP_T4 (SEQ ID NO: 4168) | 764 | 794 |
| HUMRAP1GAP_T5 (SEQ ID NO: 4169) | 783 | 813 |
| HUMRAP1GAP_T6 (SEQ ID NO: 4170) | 1205 | 1235 |
| HUMRAP1GAP_T7 (SEQ ID NO: 4171) | 1193 | 1223 |
| HUMRAP1GAP_T33 (SEQ ID NO: 4173) | 1122 | 1152 |
| HUMRAP1GAP_T34 (SEQ ID NO: 4174) | 1122 | 1152 |

TABLE 5025-continued

Segment location on transcripts

| Transcript name | Segment starting position | Segment ending position |
|---|---|---|
| HUMRAP1GAP_T47 (SEQ ID NO: 4178) | 1122 | 1152 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_41 (SEQ ID NO:5529) according to the present invention is supported by 52 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173), HUMRAP1GAP_T34 (SEQ ID NO:4174) and HUMRAP1GAP_T47 (SEQ ID NO:4178). Table 5026 below describes the starting and ending position of this segment on each transcript.

TABLE 5026

Segment location on transcripts

| Transcript name | Segment starting position | Segment ending position |
|---|---|---|
| HUMRAP1GAP_T1 (SEQ ID NO: 4165) | 748 | 801 |
| HUMRAP1GAP_T2 (SEQ ID NO: 4166) | 1260 | 1313 |
| HUMRAP1GAP_T3 (SEQ ID NO: 4167) | 1135 | 1188 |
| HUMRAP1GAP_T4 (SEQ ID NO: 4168) | 795 | 848 |
| HUMRAP1GAP_T5 (SEQ ID NO: 4169) | 814 | 867 |
| HUMRAP1GAP_T6 (SEQ ID NO: 4170) | 1236 | 1289 |
| HUMRAP1GAP_T7 (SEQ ID NO: 4171) | 1224 | 1277 |
| HUMRAP1GAP_T33 (SEQ ID NO: 4173) | 1153 | 1206 |
| HUMRAP1GAP_T34 (SEQ ID NO: 4174) | 1153 | 1206 |
| HUMRAP1GAP_T47 (SEQ ID NO: 4178) | 1153 | 1206 |

This segment can be found in the following protein(s): HUMRAP1GAP_P46, HUMRAP1GAP_P3, HUMRAP1GAP_P1, HUMRAP1GAP_P6 and HUMRAP1GAP_P35.

Segment cluster HUMRAP1GAP_node_46 (SEQ ID NO:5530) according to the present invention is supported by 49 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173) and HUMRAP1GAP_T34 (SEQ ID NO:4174). Table 5027 below describes the starting and ending position of this segment on each transcript.

TABLE 5027

Segment location on transcripts

| Transcript name | Segment starting position | Segment ending position |
|---|---|---|
| HUMRAP1GAP_T1 (SEQ ID NO: 4165) | 802 | 854 |
| HUMRAP1GAP_T2 (SEQ ID NO: 4166) | 1314 | 1366 |
| HUMRAP1GAP_T3 (SEQ ID NO: 4167) | 1189 | 1241 |
| HUMRAP1GAP_T4 (SEQ ID NO: 4168) | 849 | 901 |
| HUMRAP1GAP_T5 (SEQ ID NO: 4169) | 868 | 920 |
| HUMRAP1GAP_T6 (SEQ ID NO: 4170) | 1290 | 1342 |
| HUMRAP1GAP_T7 (SEQ ID NO: 4171) | 1278 | 1330 |
| HUMRAP1GAP_T33 (SEQ ID NO: 4173) | 1207 | 1259 |
| HUMRAP1GAP_T34 (SEQ ID NO: 4174) | 1207 | 1259 |

This segment can be found in the following protein(s): HUMRAP1GAP_P46, HUMRAP1GAP_P3, HUMRAP1GAP_P1 and HUMRAP1GAP_P6.

Segment cluster HUMRAP1GAP_node_47 (SEQ ID NO:5531) according to the present invention is supported by 48 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T33 (SEQ ID NO:4173) and HUMRAP1GAP_T34 (SEQ ID NO:4174). Table 5028 below describes the starting and ending position of this segment on each transcript.

TABLE 5028

Segment location on transcripts

| Transcript name | Segment starting position | Segment ending position |
|---|---|---|
| HUMRAP1GAP_T1 (SEQ ID NO: 4165) | 855 | 885 |
| HUMRAP1GAP_T2 (SEQ ID NO: 4166) | 1367 | 1397 |
| HUMRAP1GAP_T3 (SEQ ID NO: 4167) | 1242 | 1272 |
| HUMRAP1GAP_T4 (SEQ ID NO: 4168) | 902 | 932 |
| HUMRAP1GAP_T5 (SEQ ID NO: 4169) | 921 | 951 |
| HUMRAP1GAP_T6 (SEQ ID NO: 4170) | 1343 | 1373 |
| HUMRAP1GAP_T7 (SEQ ID NO: 4171) | 1331 | 1361 |

TABLE 5028-continued

Segment location on transcripts

| Transcript name | Segment starting position | Segment ending position |
|---|---|---|
| HUMRAP1GAP_T33 (SEQ ID NO: 4173) | 1260 | 1290 |
| HUMRAP1GAP_T34 (SEQ ID NO: 4174) | 1260 | 1290 |

This segment can be found in the following protein(s): HUMRAP1GAP_P46, HUMRAP1GAP_P3, HUMRAP1GAP_P1 and HUMRAP1GAP_P6.

Segment cluster HUMRAP1GAP_node_49 (SEQ ID NO:5532) according to the present invention is supported by 49 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5029 below describes the starting and ending position of this segment on each transcript.

TABLE 5029

Segment location on transcripts

| Transcript name | Segment starting position | Segment ending position |
|---|---|---|
| HUMRAP1GAP_T1 (SEQ ID NO: 4165) | 886 | 911 |
| HUMRAP1GAP_T2 (SEQ ID NO: 4166) | 1398 | 1423 |
| HUMRAP1GAP_T3 (SEQ ID NO: 4167) | 1273 | 1298 |
| HUMRAP1GAP_T4 (SEQ ID NO: 4168) | 933 | 958 |
| HUMRAP1GAP_T5 (SEQ ID NO: 4169) | 952 | 977 |
| HUMRAP1GAP_T6 (SEQ ID NO: 4170) | 1374 | 1399 |
| HUMRAP1GAP_T7 (SEQ ID NO: 4171) | 1362 | 1387 |
| HUMRAP1GAP_T22 (SEQ ID NO: 4172) | 642 | 667 |
| HUMRAP1GAP_T33 (SEQ ID NO: 4173) | 1291 | 1316 |
| HUMRAP1GAP_T34 (SEQ ID NO: 4174) | 1291 | 1316 |

This segment can be found in both coding and non-coding regions of transcript(s) as follows. The segment can be found in a non-coding region of transcript(s) that are related to the following protein(s): HUMRAP1GAP_P16. This segment can also be found in the following protein(s): HUMRAP1GAP_P46, HUMRAP1GAP_P3, HUMRAP1GAP_P1 and HUMRAP1GAP_P6, since it is in the coding region for the corresponding transcript.

Segment cluster HUMRAP1GAP_node_50 (SEQ ID NO:5533) according to the present invention is supported by 56 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5030 below describes the starting and ending position of this segment on each transcript.

TABLE 5030

Segment location on transcripts

| Transcript name | Segment starting position | Segment ending position |
|---|---|---|
| HUMRAP1GAP_T1 (SEQ ID NO: 4165) | 912 | 986 |
| HUMRAP1GAP_T2 (SEQ ID NO: 4166) | 1424 | 1498 |
| HUMRAP1GAP_T3 (SEQ ID NO: 4167) | 1299 | 1373 |
| HUMRAP1GAP_T4 (SEQ ID NO: 4168) | 959 | 1033 |
| HUMRAP1GAP_T5 (SEQ ID NO: 4169) | 978 | 1052 |
| HUMRAP1GAP_T6 (SEQ ID NO: 4170) | 1400 | 1474 |
| HUMRAP1GAP_T7 (SEQ ID NO: 4171) | 1388 | 1462 |
| HUMRAP1GAP_T22 (SEQ ID NO: 4172) | 668 | 742 |
| HUMRAP1GAP_T33 (SEQ ID NO: 4173) | 1317 | 1391 |
| HUMRAP1GAP_T34 (SEQ ID NO: 4174) | 1317 | 1391 |

This segment can be found in both coding and non-coding regions of transcript(s) as follows. The segment can be found in a non-coding region of transcript(s) that are related to the following protein(s): HUMRAP1GAP_P16. This segment can also be found in the following protein(s): HUMRAP1GAP_P46, HUMRAP1GAP_P3, HUMRAP1GAP_P1 and HUMRAP1GAP_P6, since it is in the coding region for the corresponding transcript.

Segment cluster HUMRAP1GAP_node_54 (SEQ ID NO:5534) according to the present invention is supported by 57 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5031 below describes the starting and ending position of this segment on each transcript.

TABLE 5031

Segment location on transcripts

| Transcript name | Segment starting position | Segment ending position |
|---|---|---|
| HUMRAP1GAP_T1 (SEQ ID NO: 4165) | 1117 | 1194 |
| HUMRAP1GAP_T2 (SEQ ID NO: 4166) | 1629 | 1706 |
| HUMRAP1GAP_T3 (SEQ ID NO: 4167) | 1504 | 1581 |
| HUMRAP1GAP_T4 (SEQ ID NO: 4168) | 1164 | 1241 |
| HUMRAP1GAP_T5 (SEQ ID NO: 4169) | 1183 | 1260 |
| HUMRAP1GAP_T6 (SEQ ID NO: 4170) | 1605 | 1682 |
| HUMRAP1GAP_T7 (SEQ ID NO: 4171) | 1593 | 1670 |
| HUMRAP1GAP_T22 (SEQ ID NO: 4172) | 873 | 950 |
| HUMRAP1GAP_T33 (SEQ ID NO: 4173) | 1522 | 1599 |
| HUMRAP1GAP_T34 (SEQ ID NO: 4174) | 1522 | 1599 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_55 (SEQ ID NO:5535) according to the present invention is supported by 53 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5032 below describes the starting and ending position of this segment on each transcript.

TABLE 5032

Segment location on transcripts

| Transcript name | Segment starting position | Segment ending position |
|---|---|---|
| HUMRAP1GAP_T1 (SEQ ID NO: 4165) | 1195 | 1220 |
| HUMRAP1GAP_T2 (SEQ ID NO: 4166) | 1707 | 1732 |
| HUMRAP1GAP_T3 (SEQ ID NO: 4167) | 1582 | 1607 |
| HUMRAP1GAP_T4 (SEQ ID NO: 4168) | 1242 | 1267 |
| HUMRAP1GAP_T5 (SEQ ID NO: 4169) | 1261 | 1286 |
| HUMRAP1GAP_T6 (SEQ ID NO: 4170) | 1683 | 1708 |
| HUMRAP1GAP_T7 (SEQ ID NO: 4171) | 1671 | 1696 |
| HUMRAP1GAP_T22 (SEQ ID NO: 4172) | 951 | 976 |
| HUMRAP1GAP_T33 (SEQ ID NO: 4173) | 1600 | 1625 |
| HUMRAP1GAP_T34 (SEQ ID NO: 4174) | 1600 | 1625 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_56 (SEQ ID NO:5536) according to the present invention is supported by 52 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5033 below describes the starting and ending position of this segment on each transcript.

TABLE 5033

Segment location on transcripts

| Transcript name | Segment starting position | Segment ending position |
|---|---|---|
| HUMRAP1GAP_T1 (SEQ ID NO: 4165) | 1221 | 1272 |
| HUMRAP1GAP_T2 (SEQ ID NO: 4166) | 1733 | 1784 |
| HUMRAP1GAP_T3 (SEQ ID NO: 4167) | 1608 | 1659 |
| HUMRAP1GAP_T4 (SEQ ID NO: 4168) | 1268 | 1319 |
| HUMRAP1GAP_T5 (SEQ ID NO: 4169) | 1287 | 1338 |
| HUMRAP1GAP_T6 (SEQ ID NO: 4170) | 1709 | 1760 |
| HUMRAP1GAP_T7 (SEQ ID NO: 4171) | 1697 | 1748 |
| HUMRAP1GAP_T22 (SEQ ID NO: 4172) | 977 | 1028 |
| HUMRAP1GAP_T33 (SEQ ID NO: 4173) | 1626 | 1677 |
| HUMRAP1GAP_T34 (SEQ ID NO: 4174) | 1626 | 1677 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_58 (SEQ ID NO:5537) according to the present invention is supported by 55 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170),
HUMRAP1GAP_T7 (SEQ ID NO:4171),
HUMRAP1GAP_T22 (SEQ ID NO:4172),
HUMRAP1GAP_T33 (SEQ ID NO:4173) and
HUMRAP1GAP_T34 (SEQ ID NO:4174). Table 5034 below describes the starting and ending position of this segment on each transcript.

TABLE 5034

Segment location on transcripts

| Transcript name | Segment starting position | Segment ending position |
| --- | --- | --- |
| HUMRAP1GAP_T1 (SEQ ID NO: 4165) | 1273 | 1344 |
| HUMRAP1GAP_T2 (SEQ ID NO: 4166) | 1785 | 1856 |
| HUMRAP1GAP_T3 (SEQ ID NO: 4167) | 1660 | 1731 |
| HUMRAP1GAP_T4 (SEQ ID NO: 4168) | 1320 | 1391 |
| HUMRAP1GAP_T5 (SEQ ID NO: 4169) | 1339 | 1410 |
| HUMRAP1GAP_T6 (SEQ ID NO: 4170) | 1761 | 1832 |
| HUMRAP1GAP_T7 (SEQ ID NO: 4171) | 1749 | 1820 |
| HUMRAP1GAP_T22 (SEQ ID NO: 4172) | 1029 | 1100 |
| HUMRAP1GAP_T33 (SEQ ID NO: 4173) | 1678 | 1749 |
| HUMRAP1GAP_T34 (SEQ ID NO: 4174) | 1678 | 1749 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_61 (SEQ ID NO:5538) according to the present invention is supported by 59 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5035 below describes the starting and ending position of this segment on each transcript.

TABLE 5035

Segment location on transcripts

| Transcript name | Segment starting position | Segment ending position |
| --- | --- | --- |
| HUMRAP1GAP_T1 (SEQ ID NO: 4165) | 1345 | 1431 |
| HUMRAP1GAP_T2 (SEQ ID NO: 4166) | 1857 | 1943 |
| HUMRAP1GAP_T3 (SEQ ID NO: 4167) | 1732 | 1818 |
| HUMRAP1GAP_T4 (SEQ ID NO: 4168) | 1392 | 1478 |
| HUMRAP1GAP_T5 (SEQ ID NO: 4169) | 1411 | 1497 |
| HUMRAP1GAP_T6 (SEQ ID NO: 4170) | 1833 | 1919 |
| HUMRAP1GAP_T7 (SEQ ID NO: 4171) | 1821 | 1907 |
| HUMRAP1GAP_T22 (SEQ ID NO: 4172) | 1101 | 1187 |
| HUMRAP1GAP_T33 (SEQ ID NO: 4173) | 1750 | 1836 |
| HUMRAP1GAP_T34 (SEQ ID NO: 4174) | 1750 | 1836 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_63 (SEQ ID NO:5539) according to the present invention is supported by 63 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5036 below describes the starting and ending position of this segment on each transcript.

TABLE 5036

Segment location on transcripts

| Transcript name | Segment starting position | Segment ending position |
| --- | --- | --- |
| HUMRAP1GAP_T1 (SEQ ID NO: 4165) | 1432 | 1494 |
| HUMRAP1GAP_T2 (SEQ ID NO: 4166) | 1944 | 2006 |
| HUMRAP1GAP_T3 (SEQ ID NO: 4167) | 1819 | 1881 |
| HUMRAP1GAP_T4 (SEQ ID NO: 4168) | 1479 | 1541 |
| HUMRAP1GAP_T5 (SEQ ID NO: 4169) | 1498 | 1560 |
| HUMRAP1GAP_T6 (SEQ ID NO: 4170) | 1920 | 1982 |
| HUMRAP1GAP_T7 (SEQ ID NO: 4171) | 1908 | 1970 |
| HUMRAP1GAP_T22 (SEQ ID NO: 4172) | 1188 | 1250 |
| HUMRAP1GAP_T33 (SEQ ID NO: 4173) | 1837 | 1899 |
| HUMRAP1GAP_T34 (SEQ ID NO: 4174) | 1837 | 1899 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node_64 (SEQ ID NO:5540) according to the present invention is supported by 61 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173) and HUMRAP1GAP_T34 (SEQ ID NO:4174). Table 5037 below describes the starting and ending position of this segment on each transcript.

TABLE 5037

Segment location on transcripts

| Transcript name | Segment starting position | Segment ending position |
|---|---|---|
| HUMRAP1GAP_T1 (SEQ ID NO: 4165) | 1495 | 1569 |
| HUMRAP1GAP_T2 (SEQ ID NO: 4166) | 2007 | 2081 |
| HUMRAP1GAP_T3 (SEQ ID NO: 4167) | 1882 | 1956 |
| HUMRAP1GAP_T4 (SEQ ID NO: 4168) | 1542 | 1616 |
| HUMRAP1GAP_T5 (SEQ ID NO: 4169) | 1561 | 1635 |
| HUMRAP1GAP_T6 (SEQ ID NO: 4170) | 1983 | 2057 |
| HUMRAP1GAP_T7 (SEQ ID NO: 4171) | 1971 | 2045 |
| HUMRAP1GAP_T22 (SEQ ID NO: 4172) | 1251 | 1325 |
| HUMRAP1GAP_T33 (SEQ ID NO: 4173) | 1900 | 1974 |
| HUMRAP1GAP_T34 (SEQ ID NO: 4174) | 1900 | 1974 |

This segment can be found in the following protein(s): HUMRAP1GAP_P46, HUMRAP1GAP_P3, HUMRAP1GAP_P16, HUMRAP1GAP_P1 and HUMRAP1GAP_P6.

Segment cluster HUMRAP1GAP_node__73 (SEQ ID NO:5541) according to the present invention is supported by 18 libraries. The number of libraries was determined as previously described. This segment can be found in the following transcript(s): HUMRAP1GAP_T36 (SEQ ID NO:4175). Table 5038 below describes the starting and ending position of this segment on each transcript.

TABLE 5038

Segment location on transcripts

| Transcript name | Segment starting position | Segment ending position |
|---|---|---|
| HUMRAP1GAP_T36 (SEQ ID NO: 4175) | 1605 | 1682 |

This segment can be found in the following protein(s): HUMRAP1GAP_P24.

Segment cluster HUMRAP1GAP_node__76 (SEQ ID NO:5542) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175) and HUMRAP1GAP_T37 (SEQ ID NO:4176). Table 5039 below describes the starting and ending position of this segment on each transcript.

TABLE 5039

Segment location on transcripts

| Transcript name | Segment starting position | Segment ending position |
|---|---|---|
| HUMRAP1GAP_T1 (SEQ ID NO: 4165) | 1702 | 1726 |
| HUMRAP1GAP_T2 (SEQ ID NO: 4166) | 2214 | 2238 |
| HUMRAP1GAP_T3 (SEQ ID NO: 4167) | 2089 | 2113 |
| HUMRAP1GAP_T4 (SEQ ID NO: 4168) | 1749 | 1773 |
| HUMRAP1GAP_T5 (SEQ ID NO: 4169) | 1768 | 1792 |
| HUMRAP1GAP_T6 (SEQ ID NO: 4170) | 2190 | 2214 |
| HUMRAP1GAP_T7 (SEQ ID NO: 4171) | 2178 | 2202 |
| HUMRAP1GAP_T22 (SEQ ID NO: 4172) | 1458 | 1482 |
| HUMRAP1GAP_T33 (SEQ ID NO: 4173) | 2107 | 2131 |
| HUMRAP1GAP_T34 (SEQ ID NO: 4174) | 2107 | 2131 |
| HUMRAP1GAP_T36 (SEQ ID NO: 4175) | 2603 | 2627 |
| HUMRAP1GAP_T37 (SEQ ID NO: 4176) | 1605 | 1629 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node__77 (SEQ ID NO:5543) according to the present invention is supported by 84 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175) and HUMRAP1GAP_T37 (SEQ ID NO:4176). Table 5040 below describes the starting and ending position of this segment on each transcript.

TABLE 5040

Segment location on transcripts

| Transcript name | Segment starting position | Segment ending position |
|---|---|---|
| HUMRAP1GAP_T1 (SEQ ID NO: 4165) | 1727 | 1781 |
| HUMRAP1GAP_T2 (SEQ ID NO: 4166) | 2239 | 2293 |
| HUMRAP1GAP_T3 (SEQ ID NO: 4167) | 2114 | 2168 |
| HUMRAP1GAP_T4 (SEQ ID NO: 4168) | 1774 | 1828 |
| HUMRAP1GAP_T5 (SEQ ID NO: 4169) | 1793 | 1847 |
| HUMRAP1GAP_T6 (SEQ ID NO: 4170) | 2215 | 2269 |
| HUMRAP1GAP_T7 (SEQ ID NO: 4171) | 2203 | 2257 |
| HUMRAP1GAP_T22 (SEQ ID NO: 4172) | 1483 | 1537 |
| HUMRAP1GAP_T33 (SEQ ID NO: 4173) | 2132 | 2186 |
| HUMRAP1GAP_T34 (SEQ ID NO: 4174) | 2132 | 2186 |
| HUMRAP1GAP_T36 (SEQ ID NO: 4175) | 2628 | 2682 |
| HUMRAP1GAP_T37 (SEQ ID NO: 4176) | 1630 | 1684 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node_78 (SEQ ID NO:5544) according to the present invention is supported by 82 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175) and HUMRAP1GAP_T37 (SEQ ID NO:4176). Table 5041 below describes the starting and ending position of this segment on each transcript.

TABLE 5041

Segment location on transcripts

| Transcript name | Segment starting position | Segment ending position |
|---|---|---|
| HUMRAP1GAP_T1 (SEQ ID NO: 4165) | 1782 | 1811 |
| HUMRAP1GAP_T2 (SEQ ID NO: 4166) | 2294 | 2323 |
| HUMRAP1GAP_T3 (SEQ ID NO: 4167) | 2169 | 2198 |
| HUMRAP1GAP_T4 (SEQ ID NO: 4168) | 1829 | 1858 |
| HUMRAP1GAP_T5 (SEQ ID NO: 4169) | 1848 | 1877 |
| HUMRAP1GAP_T6 (SEQ ID NO: 4170) | 2270 | 2299 |
| HUMRAP1GAP_T7 (SEQ ID NO: 4171) | 2258 | 2287 |
| HUMRAP1GAP_T22 (SEQ ID NO: 4172) | 1538 | 1567 |
| HUMRAP1GAP_T33 (SEQ ID NO: 4173) | 2187 | 2216 |
| HUMRAP1GAP_T34 (SEQ ID NO: 4174) | 2187 | 2216 |
| HUMRAP1GAP_T36 (SEQ ID NO: 4175) | 2683 | 2712 |
| HUMRAP1GAP_T37 (SEQ ID NO: 4176) | 1685 | 1714 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node_81 (SEQ ID NO:5545) according to the present invention is supported by 93 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175) and HUMRAP1GAP_T37 (SEQ ID NO:4176). Table 5042 below describes the starting and ending position of this segment on each transcript.

TABLE 5042

Segment location on transcripts

| Transcript name | Segment starting position | Segment ending position |
|---|---|---|
| HUMRAP1GAP_T1 (SEQ ID NO: 4165) | 1812 | 1925 |
| HUMRAP1GAP_T2 (SEQ ID NO: 4166) | 2324 | 2437 |
| HUMRAP1GAP_T3 (SEQ ID NO: 4167) | 2199 | 2312 |
| HUMRAP1GAP_T4 (SEQ ID NO: 4168) | 1859 | 1972 |
| HUMRAP1GAP_T5 (SEQ ID NO: 4169) | 1878 | 1991 |
| HUMRAP1GAP_T6 (SEQ ID NO: 4170) | 2300 | 2413 |

TABLE 5042-continued

Segment location on transcripts

| Transcript name | Segment starting position | Segment ending position |
|---|---|---|
| HUMRAP1GAP_T7 (SEQ ID NO: 4171) | 2288 | 2401 |
| HUMRAP1GAP_T22 (SEQ ID NO: 4172) | 1568 | 1681 |
| HUMRAP1GAP_T33 (SEQ ID NO: 4173) | 2217 | 2330 |
| HUMRAP1GAP_T34 (SEQ ID NO: 4174) | 2217 | 2330 |
| HUMRAP1GAP_T36 (SEQ ID NO: 4175) | 2713 | 2826 |
| HUMRAP1GAP_T37 (SEQ ID NO: 4176) | 1715 | 1828 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node_84 (SEQ ID NO:5546) according to the present invention is supported by 2 libraries. The number of libraries was determined as previously described. This segment can be found in the following transcript(s): HUMRAP1GAP_T41 (SEQ ID NO:4177). Table 5043 below describes the starting and ending position of this segment on each transcript.

TABLE 5043

Segment location on transcripts

| Transcript name | Segment starting position | Segment ending position |
|---|---|---|
| HUMRAP1GAP_T41 (SEQ ID NO: 4177) | 1 | 56 |

This segment can be found in a non-coding region of transcript(s) that are related to the following protein(s): HUMRAP1GAP_P29.

Segment cluster HUMRAP1GAP_node_87 (SEQ ID NO:5547) according to the present invention is supported by 101 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5044 below describes the starting and ending position of this segment on each transcript.

TABLE 5044

Segment location on transcripts

| Transcript name | Segment starting position | Segment ending position |
|---|---|---|
| HUMRAP1GAP_T1 (SEQ ID NO: 4165) | 2050 | 2152 |
| HUMRAP1GAP_T2 (SEQ ID NO: 4166) | 2562 | 2664 |
| HUMRAP1GAP_T3 (SEQ ID NO: 4167) | 2437 | 2539 |
| HUMRAP1GAP_T4 (SEQ ID NO: 4168) | 2097 | 2199 |
| HUMRAP1GAP_T5 (SEQ ID NO: 4169) | 2116 | 2218 |
| HUMRAP1GAP_T6 (SEQ ID NO: 4170) | 2538 | 2640 |
| HUMRAP1GAP_T7 (SEQ ID NO: 4171) | 2526 | 2628 |
| HUMRAP1GAP_T22 (SEQ ID NO: 4172) | 1806 | 1908 |
| HUMRAP1GAP_T33 (SEQ ID NO: 4173) | 2455 | 2557 |
| HUMRAP1GAP_T34 (SEQ ID NO: 4174) | 2455 | 2557 |
| HUMRAP1GAP_T36 (SEQ ID NO: 4175) | 2951 | 3053 |
| HUMRAP1GAP_T37 (SEQ ID NO: 4176) | 1953 | 2055 |
| HUMRAP1GAP_T41 (SEQ ID NO: 4177) | 181 | 283 |

This segment can be found in both coding and non-coding regions of transcript(s) as follows. The segment can be found in a non-coding region of transcript(s) that are related to the following protein(s): HUMRAP1GAP_P24 and HUMRAP1GAP_P29. This segment can also be found in the following protein(s): HUMRAP1GAP_P46, HUMRAP1GAP_P3, HUMRAP1GAP_P16, HUMRAP1GAP_P1, HUMRAP1GAP_P6 and HUMRAP1GAP_P25, since it is in the coding region for the corresponding transcript.

Segment cluster HUMRAP1GAP_node_89 (SEQ ID NO:5548) according to the present invention is supported by 24 libraries. The number of libraries was determined as previously described. This segment can be found in the following transcript(s): HUMRAP1GAP_T34 (SEQ ID NO:4174) and HUMRAP1GAP_T41 (SEQ ID NO:4177). Table 5045 below describes the starting and ending position of this segment on each transcript.

TABLE 5045

Segment location on transcripts

| Transcript name | Segment starting position | Segment ending position |
|---|---|---|
| HUMRAP1GAP_T34 (SEQ ID NO: 4174) | 2558 | 2588 |
| HUMRAP1GAP_T41 (SEQ ID NO: 4177) | 588 | 618 |

This segment can be found in the following protein(s): HUMRAP1GAP_P6 and HUMRAP1GAP_P29.

Segment cluster HUMRAP1GAP_node_90 (SEQ ID NO:5549) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169),
HUMRAP1GAP_T6 (SEQ ID NO:4170),
HUMRAP1GAP_T7 (SEQ ID NO:4171),
HUMRAP1GAP_T22 (SEQ ID NO:4172),
HUMRAP1GAP_T33 (SEQ ID NO:4173),
HUMRAP1GAP_T34 (SEQ ID NO:4174),
HUMRAP1GAP_T36 (SEQ ID NO:4175),
HUMRAP1GAP_T37 (SEQ ID NO:4176) and
HUMRAP1GAP_T41 (SEQ ID NO:4177). Table 5046 below describes the starting and ending position of this segment on each transcript.

TABLE 5046

Segment location on transcripts

| Transcript name | Segment starting position | Segment ending position |
|---|---|---|
| HUMRAP1GAP_T1 (SEQ ID NO: 4165) | 2153 | 2167 |
| HUMRAP1GAP_T2 (SEQ ID NO: 4166) | 2665 | 2679 |
| HUMRAP1GAP_T3 (SEQ ID NO: 4167) | 2540 | 2554 |
| HUMRAP1GAP_T4 (SEQ ID NO: 4168) | 2200 | 2214 |
| HUMRAP1GAP_T5 (SEQ ID NO: 4169) | 2219 | 2233 |
| HUMRAP1GAP_T6 (SEQ ID NO: 4170) | 2641 | 2655 |
| HUMRAP1GAP_T7 (SEQ ID NO: 4171) | 2629 | 2643 |
| HUMRAP1GAP_T22 (SEQ ID NO: 4172) | 1909 | 1923 |
| HUMRAP1GAP_T33 (SEQ ID NO: 4173) | 2558 | 2572 |
| HUMRAP1GAP_T34 (SEQ ID NO: 4174) | 2589 | 2603 |
| HUMRAP1GAP_T36 (SEQ ID NO: 4175) | 3054 | 3068 |
| HUMRAP1GAP_T37 (SEQ ID NO: 4176) | 2056 | 2070 |
| HUMRAP1GAP_T41 (SEQ ID NO: 4177) | 619 | 633 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6, HUMRAP1GAP_P25 and HUMRAP1GAP_P29, since it is in the coding region for the corresponding transcript.

Segment cluster HUMRAP1GAP_node_91 (SEQ ID NO:5550) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5047 below describes the starting and ending position of this segment on each transcript.

TABLE 5047

Segment location on transcripts

| Transcript name | Segment starting position | Segment ending position |
|---|---|---|
| HUMRAP1GAP_T1 (SEQ ID NO: 4165) | 2168 | 2176 |
| HUMRAP1GAP_T2 (SEQ ID NO: 4166) | 2680 | 2688 |
| HUMRAP1GAP_T3 (SEQ ID NO: 4167) | 2555 | 2563 |
| HUMRAP1GAP_T4 (SEQ ID NO: 4168) | 2215 | 2223 |
| HUMRAP1GAP_T5 (SEQ ID NO: 4169) | 2234 | 2242 |
| HUMRAP1GAP_T6 (SEQ ID NO: 4170) | 2656 | 2664 |
| HUMRAP1GAP_T7 (SEQ ID NO: 4171) | 2644 | 2652 |
| HUMRAP1GAP_T22 (SEQ ID NO: 4172) | 1924 | 1932 |
| HUMRAP1GAP_T33 (SEQ ID NO: 4173) | 2573 | 2581 |
| HUMRAP1GAP_T34 (SEQ ID NO: 4174) | 2604 | 2612 |
| HUMRAP1GAP_T36 (SEQ ID NO: 4175) | 3069 | 3077 |
| HUMRAP1GAP_T37 (SEQ ID NO: 4176) | 2071 | 2079 |
| HUMRAP1GAP_T41 (SEQ ID NO: 4177) | 634 | 642 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6, HUMRAP1GAP_P25 and HUMRAP1GAP_P29, since it is in the coding region for the corresponding transcript.

Segment cluster HUMRAP1GAP_node_92 (SEQ ID NO:5551) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5048 below describes the starting and ending position of this segment on each transcript.

TABLE 5048

Segment location on transcripts

| Transcript name | Segment starting position | Segment ending position |
|---|---|---|
| HUMRAP1GAP_T1 (SEQ ID NO: 4165) | 2177 | 2186 |
| HUMRAP1GAP_T2 (SEQ ID NO: 4166) | 2689 | 2698 |

TABLE 5048-continued

Segment location on transcripts

| Transcript name | Segment starting position | Segment ending position |
|---|---|---|
| HUMRAP1GAP_T3 (SEQ ID NO: 4167) | 2564 | 2573 |
| HUMRAP1GAP_T4 (SEQ ID NO: 4168) | 2224 | 2233 |
| HUMRAP1GAP_T5 (SEQ ID NO: 4169) | 2243 | 2252 |
| HUMRAP1GAP_T6 (SEQ ID NO: 4170) | 2665 | 2674 |
| HUMRAP1GAP_T7 (SEQ ID NO: 4171) | 2653 | 2662 |
| HUMRAP1GAP_T22 (SEQ ID NO: 4172) | 1933 | 1942 |
| HUMRAP1GAP_T33 (SEQ ID NO: 4173) | 2582 | 2591 |
| HUMRAP1GAP_T34 (SEQ ID NO: 4174) | 2613 | 2622 |
| HUMRAP1GAP_T36 (SEQ ID NO: 4175) | 3078 | 3087 |
| HUMRAP1GAP_T37 (SEQ ID NO: 4176) | 2080 | 2089 |
| HUMRAP1GAP_T41 (SEQ ID NO: 4177) | 643 | 652 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6, HUMRAP1GAP_P25 and HUMRAP1GAP_P29, since it is in the coding region for the corresponding transcript.

Segment cluster HUMRAP1GAP_node_93 (SEQ ID NO:5552) according to the present invention is supported by 83 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5049 below describes the starting and ending position of this segment on each transcript.

TABLE 5049

Segment location on transcripts

| Transcript name | Segment starting position | Segment ending position |
|---|---|---|
| HUMRAP1GAP_T1 (SEQ ID NO: 4165) | 2187 | 2243 |
| HUMRAP1GAP_T2 (SEQ ID NO: 4166) | 2699 | 2755 |

TABLE 5049-continued

Segment location on transcripts

| Transcript name | Segment starting position | Segment ending position |
|---|---|---|
| HUMRAP1GAP_T3 (SEQ ID NO: 4167) | 2574 | 2630 |
| HUMRAP1GAP_T4 (SEQ ID NO: 4168) | 2234 | 2290 |
| HUMRAP1GAP_T5 (SEQ ID NO: 4169) | 2253 | 2309 |
| HUMRAP1GAP_T6 (SEQ ID NO: 4170) | 2675 | 2731 |
| HUMRAP1GAP_T7 (SEQ ID NO: 4171) | 2663 | 2719 |
| HUMRAP1GAP_T22 (SEQ ID NO: 4172) | 1943 | 1999 |
| HUMRAP1GAP_T33 (SEQ ID NO: 4173) | 2592 | 2648 |
| HUMRAP1GAP_T34 (SEQ ID NO: 4174) | 2623 | 2679 |
| HUMRAP1GAP_T36 (SEQ ID NO: 4175) | 3088 | 3144 |
| HUMRAP1GAP_T37 (SEQ ID NO: 4176) | 2090 | 2146 |
| HUMRAP1GAP_T41 (SEQ ID NO: 4177) | 653 | 709 |

This segment can be found in both coding and non-coding regions of transcript(s) as follows. The segment can be found in a non-coding region of transcript(s) that are related to the following protein(s): HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P6, HUMRAP1GAP_P25 and HUMRAP1GAP_P29, since it is in the coding region for the corresponding transcript.

Segment cluster HUMRAP1GAP_node_94 (SEQ ID NO:5553) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5050 below describes the starting and ending position of this segment on each transcript.

TABLE 5050

Segment location on transcripts

| Transcript name | Segment starting position | Segment ending position |
|---|---|---|
| HUMRAP1GAP_T1 (SEQ ID NO: 4165) | 2244 | 2256 |
| HUMRAP1GAP_T2 (SEQ ID NO: 4166) | 2756 | 2768 |
| HUMRAP1GAP_T3 (SEQ ID NO: 4167) | 2631 | 2643 |
| HUMRAP1GAP_T4 (SEQ ID NO: 4168) | 2291 | 2303 |

TABLE 5050-continued

Segment location on transcripts

| Transcript name | Segment starting position | Segment ending position |
|---|---|---|
| HUMRAP1GAP_T5 (SEQ ID NO: 4169) | 2310 | 2322 |
| HUMRAP1GAP_T6 (SEQ ID NO: 4170) | 2732 | 2744 |
| HUMRAP1GAP_T7 (SEQ ID NO: 4171) | 2720 | 2732 |
| HUMRAP1GAP_T22 (SEQ ID NO: 4172) | 2000 | 2012 |
| HUMRAP1GAP_T33 (SEQ ID NO: 4173) | 2649 | 2661 |
| HUMRAP1GAP_T34 (SEQ ID NO: 4174) | 2680 | 2692 |
| HUMRAP1GAP_T36 (SEQ ID NO: 4175) | 3145 | 3157 |
| HUMRAP1GAP_T37 (SEQ ID NO: 4176) | 2147 | 2159 |
| HUMRAP1GAP_T41 (SEQ ID NO: 4177) | 710 | 722 |

This segment can be found in both coding and non-coding regions of transcript(s) as follows. The segment can be found in a non-coding region of transcript(s) that are related to the following protein(s): HUMRAP1GAP_P6 and HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P25 and HUMRAP1GAP_P29, since it is in the coding region for the corresponding transcript.

Segment cluster HUMRAP1GAP_node_97 (SEQ ID NO:5554) according to the present invention is supported by 72 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T33 (SEQ ID NO:4173), HUMRAP1GAP_T34 (SEQ ID NO:4174), HUMRAP1GAP_T36 (SEQ ID NO:4175), HUMRAP1GAP_T37 (SEQ ID NO:4176) and HUMRAP1GAP_T41 (SEQ ID NO:4177). Table 5051 below describes the starting and ending position of this segment on each transcript.

TABLE 5051

Segment location on transcripts

| Transcript name | Segment starting position | Segment ending position |
|---|---|---|
| HUMRAP1GAP_T1 (SEQ ID NO: 4165) | 2257 | 2299 |
| HUMRAP1GAP_T2 (SEQ ID NO: 4166) | 2769 | 2811 |
| HUMRAP1GAP_T3 (SEQ ID NO: 4167) | 2644 | 2686 |
| HUMRAP1GAP_T4 (SEQ ID NO: 4168) | 2304 | 2346 |

TABLE 5051-continued

Segment location on transcripts

| Transcript name | Segment starting position | Segment ending position |
|---|---|---|
| HUMRAP1GAP_T5 (SEQ ID NO: 4169) | 2323 | 2365 |
| HUMRAP1GAP_T6 (SEQ ID NO: 4170) | 2745 | 2787 |
| HUMRAP1GAP_T7 (SEQ ID NO: 4171) | 2733 | 2775 |
| HUMRAP1GAP_T22 (SEQ ID NO: 4172) | 2013 | 2055 |
| HUMRAP1GAP_T33 (SEQ ID NO: 4173) | 2662 | 2704 |
| HUMRAP1GAP_T34 (SEQ ID NO: 4174) | 2693 | 2735 |
| HUMRAP1GAP_T36 (SEQ ID NO: 4175) | 3158 | 3200 |
| HUMRAP1GAP_T37 (SEQ ID NO: 4176) | 2160 | 2202 |
| HUMRAP1GAP_T41 (SEQ ID NO: 4177) | 723 | 765 |

This segment can be found in both coding and non-coding regions of transcript(s) as follows. The segment can be found in a non-coding region of transcript(s) that are related to the following protein(s): HUMRAP1GAP_P6 and HUMRAP1GAP_P24. This segment can also be found in the following protein(s): HUMRAP1GAP_P46, HUMRAP1GAP_P3, HUMRAP1GAP_P16, HUMRAP1GAP_P1, HUMRAP1GAP_P25 and HUMRAP1GAP_P29, since it is in the coding region for the corresponding transcript.

Segment cluster HUMRAP1GAP_node_100 (SEQ ID NO:5555) according to the present invention is supported by 85 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5052 below describes the starting and ending position of this segment on each transcript.

TABLE 5052

Segment location on transcripts

| Transcript name | Segment starting position | Segment ending position |
|---|---|---|
| HUMRAP1GAP_T1 (SEQ ID NO: 4165) | 2300 | 2397 |
| HUMRAP1GAP_T2 (SEQ ID NO: 4166) | 2812 | 2909 |
| HUMRAP1GAP_T3 (SEQ ID NO: 4167) | 2687 | 2784 |
| HUMRAP1GAP_T4 (SEQ ID NO: 4168) | 2347 | 2444 |
| HUMRAP1GAP_T5 (SEQ ID NO: 4169) | 2366 | 2463 |
| HUMRAP1GAP_T6 (SEQ ID NO: 4170) | 2788 | 2885 |

TABLE 5052-continued

Segment location on transcripts

| Transcript name | Segment starting position | Segment ending position |
|---|---|---|
| HUMRAP1GAP_T7 (SEQ ID NO: 4171) | 2776 | 2873 |
| HUMRAP1GAP_T22 (SEQ ID NO: 4172) | 2056 | 2153 |
| HUMRAP1GAP_T36 (SEQ ID NO: 4175) | 3201 | 3298 |
| HUMRAP1GAP_T37 (SEQ ID NO: 4176) | 2203 | 2300 |
| HUMRAP1GAP_T41 (SEQ ID NO: 4177) | 766 | 863 |

This segment can be found in both coding and non-coding regions of transcript(s) as follows. The segment can be found in a non-coding region of transcript(s) that are related to the following protein(s): HUMRAP1GAP_P46, HUMRAP1GAP_P3, HUMRAP1GAP_P16, HUMRAP1GAP_P24 and HUMRAP1GAP_P25. This segment can also be found in the following protein(s): HUMRAP1GAP_P29, since it is in the coding region for the corresponding transcript.

Segment cluster HUMRAP1GAP_node__101 (SEQ ID NO:5556) according to the present invention is supported by 84 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5053 below describes the starting and ending position of this segment on each transcript.

TABLE 5053

Segment location on transcripts

| Transcript name | Segment starting position | Segment ending position |
|---|---|---|
| HUMRAP1GAP_T1 (SEQ ID NO: 4165) | 2398 | 2485 |
| HUMRAP1GAP_T2 (SEQ ID NO: 4166) | 2910 | 2997 |
| HUMRAP1GAP_T3 (SEQ ID NO: 4167) | 2785 | 2872 |
| HUMRAP1GAP_T4 (SEQ ID NO: 4168) | 2445 | 2532 |
| HUMRAP1GAP_T5 (SEQ ID NO: 4169) | 2464 | 2551 |
| HUMRAP1GAP_T6 (SEQ ID NO: 4170) | 2886 | 2973 |
| HUMRAP1GAP_T7 (SEQ ID NO: 4171) | 2874 | 2961 |
| HUMRAP1GAP_T22 (SEQ ID NO: 4172) | 2154 | 2241 |
| HUMRAP1GAP_T36 (SEQ ID NO: 4175) | 3299 | 3386 |
| HUMRAP1GAP_T37 (SEQ ID NO: 4176) | 2301 | 2388 |
| HUMRAP1GAP_T41 (SEQ ID NO: 4177) | 864 | 951 |

This segment can be found in both coding and non-coding regions of transcript(s) as follows. The segment can be found in a non-coding region of transcript(s) that are related to the following protein(s): HUMRAP1GAP_P46, HUMRAP1GAP_P3, HUMRAP1GAP_P16, HUMRAP1GAP_P24 and HUMRAP1GAP_P25. This segment can also be found in the following protein(s): HUMRAP1GAP_P29, since it is in the coding region for the corresponding transcript.

Segment cluster HUMRAP1GAP_node__102 (SEQ ID NO:5557) according to the present invention is supported by 91 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5054 below describes the starting and ending position of this segment on each transcript.

TABLE 5054

Segment location on transcripts

| Transcript name | Segment starting position | Segment ending position |
|---|---|---|
| HUMRAP1GAP_T1 (SEQ ID NO: 4165) | 2486 | 2562 |
| HUMRAP1GAP_T2 (SEQ ID NO: 4166) | 2998 | 3074 |
| HUMRAP1GAP_T3 (SEQ ID NO: 4167) | 2873 | 2949 |
| HUMRAP1GAP_T4 (SEQ ID NO: 4168) | 2533 | 2609 |
| HUMRAP1GAP_T5 (SEQ ID NO: 4169) | 2552 | 2628 |
| HUMRAP1GAP_T6 (SEQ ID NO: 4170) | 2974 | 3050 |
| HUMRAP1GAP_T7 (SEQ ID NO: 4171) | 2962 | 3038 |
| HUMRAP1GAP_T22 (SEQ ID NO: 4172) | 2242 | 2318 |
| HUMRAP1GAP_T36 (SEQ ID NO: 4175) | 3387 | 3463 |
| HUMRAP1GAP_T37 (SEQ ID NO: 4176) | 2389 | 2465 |
| HUMRAP1GAP_T41 (SEQ ID NO: 4177) | 952 | 1028 |

This segment can be found in both coding and non-coding regions of transcript(s) as follows. The segment can be found in a non-coding region of transcript(s) that are related to the following protein(s): HUMRAP1GAP_P46, HUMRAP1GAP_P3, HUMRAP1GAP_P16, HUMRAP1GAP_P24 and HUMRAP1GAP_P25. This segment can also be found in the following protein(s): HUMRAP1GAP_P29, since it is in the coding region for the corresponding transcript.

Segment cluster HUMRAP1GAP_node__104 (SEQ ID NO:5558) according to the present invention is supported by 92 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5055 below describes the starting and ending position of this segment on each transcript.

TABLE 5055

Segment location on transcripts

| Transcript name | Segment starting position | Segment ending position |
| --- | --- | --- |
| HUMRAP1GAP_T1 (SEQ ID NO: 4165) | 2563 | 2669 |
| HUMRAP1GAP_T2 (SEQ ID NO: 4166) | 3075 | 3181 |
| HUMRAP1GAP_T3 (SEQ ID NO: 4167) | 2950 | 3056 |
| HUMRAP1GAP_T4 (SEQ ID NO: 4168) | 2610 | 2716 |
| HUMRAP1GAP_T5 (SEQ ID NO: 4169) | 2629 | 2735 |
| HUMRAP1GAP_T6 (SEQ ID NO: 4170) | 3051 | 3157 |
| HUMRAP1GAP_T7 (SEQ ID NO: 4171) | 3039 | 3145 |
| HUMRAP1GAP_T22 (SEQ ID NO: 4172) | 2319 | 2425 |
| HUMRAP1GAP_T36 (SEQ ID NO: 4175) | 3464 | 3570 |
| HUMRAP1GAP_T37 (SEQ ID NO: 4176) | 2466 | 2572 |
| HUMRAP1GAP_T41 (SEQ ID NO: 4177) | 1029 | 1135 |

This segment can be found in both coding and non-coding regions of transcript(s) as follows. The segment can be found in a non-coding region of transcript(s) that are related to the following protein(s): HUMRAP1GAP_P46, HUMRAP1GAP_P3, HUMRAP1GAP_P16, HUMRAP1GAP_P24 and HUMRAP1GAP_P25. This segment can also be found in the following protein(s): HUMRAP1GAP_P29, since it is in the coding region for the corresponding transcript.

Segment cluster HUMRAP1GAP_node__105 (SEQ ID NO:5559) according to the present invention is supported by 81 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), (SEQ ID NO:4176) and HUMRAP1GAP_T41 (SEQ ID NO:4177). Table 5056 below describes the starting and ending position of this segment on each transcript.

TABLE 5056

Segment location on transcripts

| Transcript name | Segment starting position | Segment ending position |
| --- | --- | --- |
| HUMRAP1GAP_T1 (SEQ ID NO: 4165) | 2670 | 2707 |
| HUMRAP1GAP_T2 (SEQ ID NO: 4166) | 3182 | 3219 |
| HUMRAP1GAP_T3 (SEQ ID NO: 4167) | 3057 | 3094 |
| HUMRAP1GAP_T4 (SEQ ID NO: 4168) | 2717 | 2754 |
| HUMRAP1GAP_T5 (SEQ ID NO: 4169) | 2736 | 2773 |
| HUMRAP1GAP_T6 (SEQ ID NO: 4170) | 3158 | 3195 |
| HUMRAP1GAP_T7 (SEQ ID NO: 4171) | 3146 | 3183 |
| HUMRAP1GAP_T22 (SEQ ID NO: 4172) | 2426 | 2463 |
| HUMRAP1GAP_T36 (SEQ ID NO: 4175) | 3571 | 3608 |
| HUMRAP1GAP_T37 (SEQ ID NO: 4176) | 2573 | 2610 |
| HUMRAP1GAP_T41 (SEQ ID NO: 4177) | 1136 | 1173 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Segment cluster HUMRAP1GAP_node__106 (SEQ ID NO:5560) according to the present invention is supported by 104 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5057 below describes the starting and ending position of this segment on each transcript.

TABLE 5057

Segment location on transcripts

| Transcript name | Segment starting position | Segment ending position |
| --- | --- | --- |
| HUMRAP1GAP_T1 (SEQ ID NO: 4165) | 2708 | 2818 |
| HUMRAP1GAP_T2 (SEQ ID NO: 4166) | 3220 | 3330 |
| HUMRAP1GAP_T3 (SEQ ID NO: 4167) | 3095 | 3205 |
| HUMRAP1GAP_T4 (SEQ ID NO: 4168) | 2755 | 2865 |

TABLE 5057-continued

Segment location on transcripts

| Transcript name | Segment starting position | Segment ending position |
|---|---|---|
| HUMRAP1GAP_T5 (SEQ ID NO: 4169) | 2774 | 2884 |
| HUMRAP1GAP_T6 (SEQ ID NO: 4170) | 3196 | 3306 |
| HUMRAP1GAP_T7 (SEQ ID NO: 4171) | 3184 | 3294 |
| HUMRAP1GAP_T22 (SEQ ID NO: 4172) | 2464 | 2574 |
| HUMRAP1GAP_T36 (SEQ ID NO: 4175) | 3609 | 3719 |
| HUMRAP1GAP_T37 (SEQ ID NO: 4176) | 2611 | 2721 |
| HUMRAP1GAP_T41 (SEQ ID NO: 4177) | 1174 | 1284 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Segment cluster HUMRAP1GAP_node__108 (SEQ ID NO:5561) according to the present invention is supported by 109 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5058 below describes the starting and ending position of this segment on each transcript.

TABLE 5058

Segment location on transcripts

| Transcript name | Segment starting position | Segment ending position |
|---|---|---|
| HUMRAP1GAP_T1 (SEQ ID NO: 4165) | 3004 | 3074 |
| HUMRAP1GAP_T2 (SEQ ID NO: 4166) | 3516 | 3586 |
| HUMRAP1GAP_T3 (SEQ ID NO: 4167) | 3391 | 3461 |
| HUMRAP1GAP_T4 (SEQ ID NO: 4168) | 3051 | 3121 |
| HUMRAP1GAP_T5 (SEQ ID NO: 4169) | 3070 | 3140 |
| HUMRAP1GAP_T6 (SEQ ID NO: 4170) | 3492 | 3562 |
| HUMRAP1GAP_T7 (SEQ ID NO: 4171) | 3480 | 3550 |
| HUMRAP1GAP_T22 (SEQ ID NO: 4172) | 2760 | 2830 |
| HUMRAP1GAP_T36 (SEQ ID NO: 4175) | 3905 | 3975 |
| HUMRAP1GAP_T37 (SEQ ID NO: 4176) | 2907 | 2977 |
| HUMRAP1GAP_T41 (SEQ ID NO: 4177) | 1470 | 1540 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Segment cluster HUMRAP1GAP_node__109 (SEQ ID NO:5562) according to the present invention is supported by 106 libraries. The number of libraries was determined as previously described. This segment can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169), HUMRAP1GAP_T6 (SEQ ID NO:4170), HUMRAP1GAP_T7 (SEQ ID NO:4171), HUMRAP1GAP_T22 (SEQ ID NO:4172), HUMRAP1GAP_T36 (SEQ ID NO:4175), HUMRAP1GAP_T37 (SEQ ID NO:4176) and HUMRAP1GAP_T41 (SEQ ID NO:4177). Table 5059 below describes the starting and ending position of this segment on each transcript.

TABLE 5059

Segment location on transcripts

| Transcript name | Segment starting position | Segment ending position |
|---|---|---|
| HUMRAP1GAP_T1 (SEQ ID NO: 4165) | 3075 | 3191 |
| HUMRAP1GAP_T2 (SEQ ID NO: 4166) | 3587 | 3703 |
| HUMRAP1GAP_T3 (SEQ ID NO: 4167) | 3462 | 3578 |
| HUMRAP1GAP_T4 (SEQ ID NO: 4168) | 3122 | 3238 |
| HUMRAP1GAP_T5 (SEQ ID NO: 4169) | 3141 | 3257 |
| HUMRAP1GAP_T6 (SEQ ID NO: 4170) | 3563 | 3679 |
| HUMRAP1GAP_T7 (SEQ ID NO: 4171) | 3551 | 3667 |
| HUMRAP1GAP_T22 (SEQ ID NO: 4172) | 2831 | 2947 |
| HUMRAP1GAP_T36 (SEQ ID NO: 4175) | 3976 | 4092 |
| HUMRAP1GAP_T37 (SEQ ID NO: 4176) | 2978 | 3094 |
| HUMRAP1GAP_T41 (SEQ ID NO: 4177) | 1541 | 1657 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Segment cluster HUMRAP1GAP_node__110 (SEQ ID NO:5563) according to the present invention can be found in the following transcript(s): HUMRAP1GAP_T1 (SEQ ID NO:4165), HUMRAP1GAP_T2 (SEQ ID NO:4166), HUMRAP1GAP_T3 (SEQ ID NO:4167), HUMRAP1GAP_T4 (SEQ ID NO:4168), HUMRAP1GAP_T5 (SEQ ID NO:4169),
HUMRAP1GAP_T6 (SEQ ID NO:4170),
HUMRAP1GAP_T7 (SEQ ID NO:4171),
HUMRAP1GAP_T22 (SEQ ID NO:4172),
HUMRAP1GAP_T36 (SEQ ID NO:4175),
HUMRAP1GAP_T37 (SEQ ID NO:4176) and
HUMRAP1GAP_T41 (SEQ ID NO:4177). Table 5060 below describes the starting and ending position of this segment on each transcript.

TABLE 5060

Segment location on transcripts

| Transcript name | Segment starting position | Segment ending position |
|---|---|---|
| HUMRAP1GAP_T1 (SEQ ID NO: 4165) | 3192 | 3205 |
| HUMRAP1GAP_T2 (SEQ ID NO: 4166) | 3704 | 3717 |
| HUMRAP1GAP_T3 (SEQ ID NO: 4167) | 3579 | 3592 |
| HUMRAP1GAP_T4 (SEQ ID NO: 4168) | 3239 | 3252 |
| HUMRAP1GAP_T5 (SEQ ID NO: 4169) | 3258 | 3271 |
| HUMRAP1GAP_T6 (SEQ ID NO: 4170) | 3680 | 3693 |
| HUMRAP1GAP_T7 (SEQ ID NO: 4171) | 3668 | 3681 |
| HUMRAP1GAP_T22 (SEQ ID NO: 4172) | 2948 | 2961 |
| HUMRAP1GAP_T36 (SEQ ID NO: 4175) | 4093 | 4106 |
| HUMRAP1GAP_T37 (SEQ ID NO: 4176) | 3095 | 3108 |
| HUMRAP1GAP_T41 (SEQ ID NO: 4177) | 1658 | 1671 |

This segment can be found in a non-coding region of transcript(s) that are related to the following protein(s): HUMRAP1GAP_P46, HUMRAP1GAP_P3, HUMRAP1GAP_P16, HUMRAP1GAP_P24, HUMRAP1GAP_P25 and HUMRAP1GAP_P29.

Description for Cluster M62096

Cluster M62096 features 7 transcript(s) and 40 segment(s) of interest, the names for which are given in Tables 5061 and 5062, respectively, the sequences themselves are given at the end of the application. The selected protein variants are given in Table 5063.

TABLE 5061

Transcripts of interest
Transcript Name

M62096_PEA_1_T4 (SEQ ID NO: 4182)
M62096_PEA_1_T5 (SEQ ID NO: 4183)
M62096_PEA_1_T6 (SEQ ID NO: 4184)
M62096_PEA_1_T7 (SEQ ID NO: 4185)
M62096_PEA_1_T9 (SEQ ID NO: 4186)
M62096_PEA_1_T13 (SEQ ID NO: 4187)
M62096_PEA_1_T14 (SEQ ID NO: 4188)

TABLE 5062

Segments of interest
Segment Name

M62096_PEA_1_node_0 (SEQ ID NO: 5564)
M62096_PEA_1_node_2 (SEQ ID NO: 5565)
M62096_PEA_1_node_15 (SEQ ID NO: 5566)
M62096_PEA_1_node_17 (SEQ ID NO: 5567)
M62096_PEA_1_node_19 (SEQ ID NO: 5568)
M62096_PEA_1_node_23 (SEQ ID NO: 5569)
M62096_PEA_1_node_27 (SEQ ID NO: 5570)
M62096_PEA_1_node_29 (SEQ ID NO: 5571)
M62096_PEA_1_node_31 (SEQ ID NO: 5572)
M62096_PEA_1_node_34 (SEQ ID NO: 5573)
M62096_PEA_1_node_36 (SEQ ID NO: 5574)
M62096_PEA_1_node_38 (SEQ ID NO: 5575)
M62096_PEA_1_node_40 (SEQ ID NO: 5576)
M62096_PEA_1_node_48 (SEQ ID NO: 5577)
M62096_PEA_1_node_60 (SEQ ID NO: 5578)
M62096_PEA_1_node_65 (SEQ ID NO: 5579)
M62096_PEA_1_node_69 (SEQ ID NO: 5580)
M62096_PEA_1_node_71 (SEQ ID NO: 5581)
M62096_PEA_1_node_1 (SEQ ID NO: 5582)
M62096_PEA_1_node_4 (SEQ ID NO: 5583)
M62096_PEA_1_node_6 (SEQ ID NO: 5584)
M62096_PEA_1_node_7 (SEQ ID NO: 5585)
M62096_PEA_1_node_9 (SEQ ID NO: 5586)
M62096_PEA_1_node_11 (SEQ ID NO: 5587)
M62096_PEA_1_node_13 (SEQ ID NO: 5588)
M62096_PEA_1_node_21 (SEQ ID NO: 5589)
M62096_PEA_1_node_25 (SEQ ID NO: 5590)
M62096_PEA_1_node_33 (SEQ ID NO: 5591)
M62096_PEA_1_node_42 (SEQ ID NO: 5592)
M62096_PEA_1_node_44 (SEQ ID NO: 5593)
M62096_PEA_1_node_47 (SEQ ID NO: 5594)
M62096_PEA_1_node_51 (SEQ ID NO: 5595)
M62096_PEA_1_node_53 (SEQ ID NO: 5596)
M62096_PEA_1_node_55 (SEQ ID NO: 5597)
M62096_PEA_1_node_58 (SEQ ID NO: 5598)
M62096_PEA_1_node_62 (SEQ ID NO: 5599)
M62096_PEA_1_node_66 (SEQ ID NO: 5600)
M62096_PEA_1_node_67 (SEQ ID NO: 5601)
M62096_PEA_1_node_68 (SEQ ID NO: 5602)
M62096_PEA_1_node_70 (SEQ ID NO: 5603)

TABLE 5063

Proteins of interest

| Protein Name | Corresponding Transcript(s) |
|---|---|
| M62096_PEA_1_P4 | M62096_PEA_1_T6 (SEQ ID NO: 4184) |
| M62096_PEA_1_P5 | M62096_PEA_1_T7 (SEQ ID NO: 4185) |
| M62096_PEA_1_P3 | M62096_PEA_1_T9 (SEQ ID NO: 4186) |
| M62096_PEA_1_P8 | M62096_PEA_1_T13 (SEQ ID NO: 4187) |
| M62096_PEA_1_P9 | M62096_PEA_1_T14 (SEQ ID NO: 4188) |
| M62096_PEA_1_P11 | M62096_PEA_1_T4 (SEQ ID NO: 4182) |
| M62096_PEA_1_P12 | M62096_PEA_1_T5 (SEQ ID NO: 4183) |

These sequences are variants of the known protein Kinesin heavy chain isoform 5C (SwissProt accession identifier KF5C_HUMAN; known also according to the synonyms Kinesin heavy chain neuron-specific 2), referred to herein as the previously known protein.

Protein Kinesin heavy chain isoform 5C is known or believed to have the following function(s): Kinesin is a microtubule-associated force-producing protein that may play a role in organelle transport. The sequence for protein Kinesin heavy chain isoform 5C is given at the end of the application, as "Kinesin heavy chain isoform 5C amino acid sequence". Known polymorphisms for this sequence are as shown in Table 5064.

TABLE 5064

Amino acid mutations for Known Protein

| SNP position(s) on amino acid sequence | Comment |
|---|---|
| 355-360 | TLKNVI -> STHASV |
| 583-585 | EFT -> DRV |

The following GO Annotation(s) apply to the previously known protein. The following annotation(s) were found: organelle organization and biogenesis, which are annotation (s) related to Biological Process; microtubule motor; ATP binding, which are annotation(s) related to Molecular Function; and kinesin, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster M62096 features 40 segment(s), which were listed in Table 5062 above and for which the sequence(s) are given at the end of the application. These segment(s) are portions of nucleic acid sequence(s) which are described herein separately because they are of particular interest. A description of each, segment according to the present invention is now provided.

Segment cluster M62096_PEA_1_node_0 (SEQ ID NO:5564) according to the present invention is supported by 14 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5065 below describes the starting and ending position of this segment on each transcript.

TABLE 5065

Segment location on transcripts

| Transcript name | Segment starting position | Segment ending position |
|---|---|---|
| M62096_PEA_1_T4 (SEQ ID NO: 4182) | 1 | 355 |
| M62096_PEA_1_T5 (SEQ ID NO: 4183) | 1 | 355 |
| M62096_PEA_1_T13 (SEQ ID NO: 4187) | 1 | 355 |
| M62096_PEA_1_T14 (SEQ ID NO: 4188) | 1 | 355 |

This segment can be found in a non-coding region of transcript(s) that are related to the following protein(s): M62096_PEA_1_P11, M62096_PEA_1_P12, M62096_PEA_1_P8 and M62096_PEA_1_P9.

Segment cluster M62096_PEA_1_node_2 (SEQ ID NO:5565) according to the present invention is supported by 12 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5066 below describes the starting and ending position of this segment on each transcript.

TABLE 5066

Segment location on transcripts

| Transcript name | Segment starting position | Segment ending position |
|---|---|---|
| M62096_PEA_1_T4 (SEQ ID NO: 4182) | 374 | 521 |
| M62096_PEA_1_T5 (SEQ ID NO: 4183) | 356 | 503 |
| M62096_PEA_1_T13 (SEQ ID NO: 4187) | 374 | 521 |
| M62096_PEA_1_T14 (SEQ ID NO: 4188) | 374 | 521 |

This segment can be found in the following protein(s): M62096_PEA_1_P11, M62096_PEA_1_P12, M62096_PEA_1_P8 and M62096_PEA_1_P9.

Segment cluster M62096_PEA_1_node_15 (SEQ ID NO:5566) according to the present invention is supported by 28 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187)and M62096_PEA_1_T14 (SEQ ID NO:4188). Table 5067 below describes the starting and ending position of this segment on each transcript.

TABLE 5067

Segment location on transcripts

| Transcript name | Segment starting position | Segment ending position |
|---|---|---|
| M62096_PEA_1_T4 (SEQ ID NO: 4182) | 985 | 1109 |
| M62096_PEA_1_T5 (SEQ ID NO: 4183) | 967 | 1091 |
| M62096_PEA_1_T13 (SEQ ID NO: 4187) | 985 | 1109 |
| M62096_PEA_1_T14 (SEQ ID NO: 4188) | 985 | 1109 |

This segment can be found in the following protein(s): M62096_PEA_1_P11, M62096_PEA_1_P12, M62096_PEA_1_P8 and M62096_PEA_1_P9.

Segment cluster M62096_PEA_1_node_17 (SEQ ID NO:5567) according to the present invention is supported by 1 libraries. The number of libraries was determined as previously described. This segment can be found in the following transcript(s): M62096_PEA_1_T7 (SEQ ID NO:4185). Table 5068 below describes the starting and ending position of this segment on each transcript.

TABLE 5068

Segment location on transcripts

| Transcript name | Segment starting position | Segment ending position |
|---|---|---|
| M62096_PEA_1_T7 (SEQ ID NO: 4185) | 1 | 147 |

This segment can be found in a non-coding region of transcript(s) that are related to the following protein(s): M62096_PEA_1_P5.

Segment cluster M62096_PEA_1_node_19 (SEQ ID NO:5568) according to the present invention is supported by 3 libraries. The number of libraries was determined as previously described. This segment can be found in the following transcript(s): M62096_PEA_1_T6 (SEQ ID NO:4184) and M62096_PEA_1_T9 (SEQ ID NO:4186). Table 5069 below describes the starting and ending position of this segment on each transcript.

TABLE 5069

Segment location on transcripts

| Transcript name | Segment starting position | Segment ending position |
| --- | --- | --- |
| M62096_PEA_1_T6 (SEQ ID NO: 4184) | 1 | 125 |
| M62096_PEA_1_T9 (SEQ ID NO: 4186) | 1 | 125 |

This segment can be found in both coding and non-coding regions of transcript(s) as follows. The segment can be found in a non-coding region of transcript(s) that are related to the following protein(s): M62096_PEA_1_P3. This segment can also be found in the following protein(s): M62096_PEA_1_P4, since it is in the coding region for the corresponding transcript.

Segment cluster M62096_PEA_1_node_23 (SEQ ID NO:5569) according to the present invention is supported by 36 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186), M62096_PEA_1_T13 (SEQ ID NO:4187) and M62096_PEA_1_T14 (SEQ ID NO:4188). Table 5070 below describes the starting and ending position of this segment on each transcript.

TABLE 5070

Segment location on transcripts

| Transcript name | Segment starting position | Segment ending position |
| --- | --- | --- |
| M62096_PEA_1_T4 (SEQ ID NO: 4182) | 1215 | 1363 |
| M62096_PEA_1_T5 (SEQ ID NO: 4183) | 1197 | 1345 |
| M62096_PEA_1_T6 (SEQ ID NO: 4184) | 231 | 379 |
| M62096_PEA_1_T7 (SEQ ID NO: 4185) | 253 | 401 |
| M62096_PEA_1_T9 (SEQ ID NO: 4186) | 231 | 379 |
| M62096_PEA_1_T13 (SEQ ID NO: 4187) | 1215 | 1363 |
| M62096_PEA_1_T14 (SEQ ID NO: 4188) | 1215 | 1363 |

This segment can be found in both coding and non-coding regions of transcript(s) as follows. The segment can be found in a non-coding region of transcript(s) that are related to the following protein(s): M62096_PEA_1_P3. This segment can also be found in the following protein(s): M62096_PEA_1_P1, M62096_PEA_1_P12, M62096_PEA_1_P4, M62096_PEA_1_P5, M62096_PEA_1_P8 and M62096_PEA_1_P9, since it is in the coding region for the corresponding transcript.

Segment cluster M62096_PEA_1_node_27 (SEQ ID NO:5570) according to the present invention is supported by 35 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186), M62096_PEA_1_T13 (SEQ ID NO:4187) and M62096_PEA_1_T14 (SEQ ID NO:4188). Table 5071 below describes the starting and ending position of this segment on each transcript.

TABLE 5071

Segment location on transcripts

| Transcript name | Segment starting position | Segment ending position |
| --- | --- | --- |
| M62096_PEA_1_T4 (SEQ ID NO: 4182) | 1364 | 1512 |
| M62096_PEA_1_T5 (SEQ ID NO: 4183) | 1407 | 1555 |
| M62096_PEA_1_T6 (SEQ ID NO: 4184) | 380 | 528 |
| M62096_PEA_1_T7 (SEQ ID NO: 4185) | 402 | 550 |
| M62096_PEA_1_T9 (SEQ ID NO: 4186) | 441 | 589 |
| M62096_PEA_1_T13 (SEQ ID NO: 4187) | 1364 | 1512 |
| M62096_PEA_1_T14 (SEQ ID NO: 4188) | 1364 | 1512 |

This segment can be found in both coding and non-coding regions of transcript(s) as follows. The segment can be found in a non-coding region of transcript(s) that are related to the following protein(s): M62096_PEA_1_P12. This segment can also be found in the following protein(s): M62096_PEA_1_P11, M62096_PEA_1_P4, M62096_PEA_1_P5, M62096_PEA_1_P3, M62096_PEA_1_P8 and M62096_PEA_1_P9, since it is in the coding region for the corresponding transcript.

Segment cluster M62096_PEA_1_node_29 (SEQ ID NO:5571) according to the present invention is supported by 1 libraries. The number of libraries was determined as previously described. This segment can be found in the following transcript(s): M62096_PEA_1_T4 (SEQ ID NO:4182). Table 5072 below describes the starting and ending position of this segment on each transcript.

TABLE 5072

Segment location on transcripts

| Transcript name | Segment starting position | Segment ending position |
| --- | --- | --- |
| M62096_PEA_1_T4 (SEQ ID NO: 4182) | 1513 | 1679 |

This segment can be found in the following protein(s): M62096_PEA_1_P11.

Segment cluster M62096_PEA_1_node_31 (SEQ ID NO:5572) according to the present invention is supported by 24 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186), M62096_PEA_1_T13 (SEQ ID NO:4187) and M62096_PEA_1_T14 (SEQ ID NO:4188). Table 5073 below describes the starting and ending position of this segment on each transcript.

TABLE 5073

Segment location on transcripts

| Transcript name | Segment starting position | Segment ending position |
|---|---|---|
| M62096_PEA_1_T4 (SEQ ID NO: 4182) | 1680 | 1855 |
| M62096_PEA_1_T5 (SEQ ID NO: 4183) | 1556 | 1731 |
| M62096_PEA_1_T6 (SEQ ID NO: 4184) | 529 | 704 |
| M62096_PEA_1_T7 (SEQ ID NO: 4185) | 551 | 726 |
| M62096_PEA_1_T9 (SEQ ID NO: 4186) | 590 | 765 |
| M62096_PEA_1_T13 (SEQ ID NO: 4187) | 1513 | 1688 |
| M62096_PEA_1_T14 (SEQ ID NO: 4188) | 1513 | 1688 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3, M62096_PEA_1_P8 and M62096_PEA_1_P9, since it is in the coding region for the corresponding transcript.

Segment cluster M62096_PEA_1_node_34 (SEQ ID NO:5573) according to the present invention is supported by 3 libraries. The number of libraries was determined as previously described. This segment can be found in the following transcript(s): M62096_PEA_1_T14 (SEQ ID NO:4188). Table 5074 below describes the starting and ending position of this segment on each transcript.

TABLE 5074

Segment location on transcripts

| Transcript name | Segment starting position | Segment ending position |
|---|---|---|
| M62096_PEA_1_T14 (SEQ ID NO: 4188) | 1758 | 2261 |

This segment can be found in the following protein(s): M62096_PEA_1_P9.

Segment cluster M62096_PEA_1_node_36 (SEQ ID NO:5574) according to the present invention is supported by 26 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5075 below describes the starting and ending position of this segment on each transcript.

TABLE 5075

Segment location on transcripts

| Transcript name | Segment starting position | Segment ending position |
|---|---|---|
| M62096_PEA_1_T4 (SEQ ID NO: 4182) | 1925 | 2131 |
| M62096_PEA_1_T5 (SEQ ID NO: 4183) | 1801 | 2007 |
| M62096_PEA_1_T6 (SEQ ID NO: 4184) | 774 | 980 |
| M62096_PEA_1_T7 (SEQ ID NO: 4185) | 796 | 1002 |
| M62096_PEA_1_T9 (SEQ ID NO: 4186) | 835 | 1041 |
| M62096_PEA_1_T13 (SEQ ID NO: 4187) | 1758 | 1964 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_38 (SEQ ID NO:5575) according to the present invention is supported by 24 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5076 below describes the starting and ending position of this segment on each transcript.

TABLE 5076

Segment location on transcripts

| Transcript name | Segment starting position | Segment ending position |
|---|---|---|
| M62096_PEA_1_T4 (SEQ ID NO: 4182) | 2132 | 2278 |
| M62096_PEA_1_T5 (SEQ ID NO: 4183) | 2008 | 2154 |
| M62096_PEA_1_T6 (SEQ ID NO: 4184) | 981 | 1127 |
| M62096_PEA_1_T7 (SEQ ID NO: 4185) | 1003 | 1149 |
| M62096_PEA_1_T9 (SEQ ID NO: 4186) | 1042 | 1188 |
| M62096_PEA_1_T13 (SEQ ID NO: 4187) | 1965 | 2111 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_40 (SEQ ID NO:5576) according to the present invention is supported by 21 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5077 below describes the starting and ending position of this segment on each transcript.

TABLE 5077

Segment location on transcripts

| Transcript name | Segment starting position | Segment ending position |
|---|---|---|
| M62096_PEA_1_T4 (SEQ ID NO: 4182) | 2279 | 2467 |
| M62096_PEA_1_T5 (SEQ ID NO: 4183) | 2155 | 2343 |
| M62096_PEA_1_T6 (SEQ ID NO: 4184) | 1128 | 1316 |
| M62096_PEA_1_T7 (SEQ ID NO: 4185) | 1150 | 1338 |
| M62096_PEA_1_T9 (SEQ ID NO: 4186) | 1189 | 1377 |
| M62096_PEA_1_T13 (SEQ ID NO: 4187) | 2112 | 2300 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_48 (SEQ ID NO:5577) according to the present invention is supported by 7 libraries. The number of libraries was determined as previously described. This segment can be found in the following transcript(s): M62096_PEA_1_T13 (SEQ ID NO:4187). Table 5078 below describes the starting and ending position of this segment on each transcript.

TABLE 5078

Segment location on transcripts

| Transcript name | Segment starting position | Segment ending position |
|---|---|---|
| M62096_PEA_1_T13 (SEQ ID NO: 4187) | 2606 | 2945 |

This segment can be found in the following protein(s): M62096_PEA_1_P8.

Segment cluster M62096_PEA_1_node_60 (SEQ ID NO:5578) according to the present invention is supported by 13 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5079 below describes the starting and ending position of this segment on each transcript.

TABLE 5079

Segment location on transcripts

| Transcript name | Segment starting position | Segment ending position |
|---|---|---|
| M62096_PEA_1_T4 (SEQ ID NO: 4182) | 3113 | 3329 |
| M62096_PEA_1_T5 (SEQ ID NO: 4183) | 2989 | 3205 |
| M62096_PEA_1_T6 (SEQ ID NO: 4184) | 1962 | 2178 |
| M62096_PEA_1_T7 (SEQ ID NO: 4185) | 1984 | 2200 |
| M62096_PEA_1_T9 (SEQ ID NO: 4186) | 2023 | 2239 |

This segment can be found in both coding and non-coding regions of transcript(s) as follows. The segment can be found in a non-coding region of transcript(s) that are related to the following protein(s): M62096_PEA_1_P1 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_65 (SEQ ID NO:5579) according to the present invention is supported by 51 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5080 below describes the starting and ending position of this segment on each transcript.

TABLE 5080

Segment location on transcripts

| Transcript name | Segment starting position | Segment ending position |
|---|---|---|
| M62096_PEA_1_T4 (SEQ ID NO: 4182) | 3444 | 4763 |
| M62096_PEA_1_T5 (SEQ ID NO: 4183) | 3320 | 4639 |
| M62096_PEA_1_T6 (SEQ ID NO: 4184) | 2293 | 3612 |
| M62096_PEA_1_T7 (SEQ ID NO: 4185) | 2315 | 3634 |
| M62096_PEA_1_T9 (SEQ ID NO: 4186) | 2354 | 3673 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Segment cluster M62096_PEA_1_node_69 (SEQ ID NO:5580) according to the present invention is supported by 85 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5081 below describes the starting and ending position of this segment on each transcript.

TABLE 5081

Segment location on transcripts

| Transcript name | Segment starting position | Segment ending position |
|---|---|---|
| M62096_PEA_1_T4 (SEQ ID NO: 4182) | 4894 | 5826 |
| M62096_PEA_1_T5 (SEQ ID NO: 4183) | 4770 | 5702 |
| M62096_PEA_1_T6 (SEQ ID NO: 4184) | 3743 | 4675 |
| M62096_PEA_1_T7 (SEQ ID NO: 4185) | 3765 | 4697 |
| M62096_PEA_1_T9 (SEQ ID NO: 4186) | 3804 | 4736 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Segment cluster M62096_PEA_1_node_71 (SEQ ID NO:5581) according to the present invention is supported by 178 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5082 below describes the starting and ending position of this segment on each transcript.

TABLE 5082

Segment location on transcripts

| Transcript name | Segment starting position | Segment ending position |
|---|---|---|
| M62096_PEA_1_T4 (SEQ ID NO: 4182) | 5882 | 7128 |
| M62096_PEA_1_T5 (SEQ ID NO: 4183) | 5758 | 7004 |
| M62096_PEA_1_T6 (SEQ ID NO: 4184) | 4731 | 5977 |
| M62096_PEA_1_T7 (SEQ ID NO: 4185) | 4753 | 5999 |
| M62096_PEA_1_T9 (SEQ ID NO: 4186) | 4792 | 6038 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

According to an optional embodiment of the present invention, short segments related to the above cluster are also provided. These segments are up to about 120 bp in length, and so are included in a separate description.

Segment cluster M62096_PEA_1_node_1 (SEQ ID NO:5582) according to the present invention can be found in the following transcript(s): M62096_PEA_1_T4 (SEQ ID NO:4182), M62096_PEA_1_T13 (SEQ ID NO:4187) and M62096_PEA_1_T14 (SEQ ID NO:4188). Table 5083 below describes the starting and ending position of this segment on each transcript.

TABLE 5083

Segment location on transcripts

| Transcript name | Segment starting position | Segment ending position |
|---|---|---|
| M62096_PEA_1_T4 (SEQ ID NO: 4182) | 356 | 373 |
| M62096_PEA_1_T13 (SEQ ID NO: 4187) | 356 | 373 |
| M62096_PEA_1_T14 (SEQ ID NO: 4188) | 356 | 373 |

This segment can be found in a non-coding region of transcript(s) that are related to the following protein(s): M62096_PEA_1_P11, M62096_PEA_1_P8 and M62096_PEA_1_P9.

Segment cluster M62096_PEA_1_node_4 (SEQ ID NO:5583) according to the present invention is supported by 12 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5084 below describes the starting and ending position of this segment on each transcript.

TABLE 5084

Segment location on transcripts

| Transcript name | Segment starting position | Segment ending position |
|---|---|---|
| M62096_PEA_1_T4 (SEQ ID NO: 4182) | 522 | 612 |
| M62096_PEA_1_T5 (SEQ ID NO: 4183) | 504 | 594 |
| M62096_PEA_1_T13 (SEQ ID NO: 4187) | 522 | 612 |
| M62096_PEA_1_T14 (SEQ ID NO: 4188) | 522 | 612 |

This segment can be found in the following protein(s): M62096_PEA_1_P11, M62096_PEA_1_P12, M62096_PEA_1_P8 and M62096_PEA_1_P9.

Segment cluster M62096_PEA_1_node_6 (SEQ ID NO:5584) according to the present invention is supported by 13 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5085 below describes the starting and ending position of this segment on each transcript.

TABLE 5085

Segment location on transcripts

| Transcript name | Segment starting position | Segment ending position |
|---|---|---|
| M62096_PEA_1_T4 (SEQ ID NO: 4182) | 613 | 686 |
| M62096_PEA_1_T5 (SEQ ID NO: 4183) | 595 | 668 |
| M62096_PEA_1_T13 (SEQ ID NO: 4187) | 613 | 686 |
| M62096_PEA_1_T14 (SEQ ID NO: 4188) | 613 | 686 |

This segment can be found in the following protein(s): M62096_PEA_1_P11, M62096_PEA_1_P12, M62096_PEA_1_P8 and M62096_PEA_1_P9.

Segment cluster M62096_PEA_1_node_7 (SEQ ID NO:5585) according to the present invention is supported by 19 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5086 below describes the starting and ending position of this segment on each transcript.

TABLE 5086

Segment location on transcripts

| Transcript name | Segment starting position | Segment ending position |
|---|---|---|
| M62096_PEA_1_T4 (SEQ ID NO: 4182) | 687 | 791 |
| M62096_PEA_1_T5 (SEQ ID NO: 4183) | 669 | 773 |
| M62096_PEA_1_T13 (SEQ ID NO: 4187) | 687 | 791 |
| M62096_PEA_1_T14 (SEQ ID NO: 4188) | 687 | 791 |

This segment can be found in the following protein(s): M62096_PEA_1_P11, M62096_PEA_1_P12, M62096_PEA_1_P8 and M62096_PEA_1_P9.

Segment cluster M62096_PEA_1_node_9 (SEQ ID NO:5586) according to the present invention is supported by 18 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5087 below describes the starting and ending position of this segment on each transcript.

TABLE 5087

Segment location on transcripts

| Transcript name | Segment starting position | Segment ending position |
|---|---|---|
| M62096_PEA_1_T4 (SEQ ID NO: 4182) | 792 | 840 |
| M62096_PEA_1_T5 (SEQ ID NO: 4183) | 774 | 822 |
| M62096_PEA_1_T13 (SEQ ID NO: 4187) | 792 | 840 |
| M62096_PEA_1_T14 (SEQ ID NO: 4188) | 792 | 840 |

This segment can be found in the following protein(s): M62096_PEA_1_P11, M62096_PEA_1_P12, M62096_PEA_1_P8 and M62096_PEA_1_P9.

Segment cluster M62096_PEA_1_node_11 (SEQ ID NO:5587) according to the present invention is supported by 22 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5088 below describes the starting and ending position of this segment on each transcript.

TABLE 5088

Segment location on transcripts

| Transcript name | Segment starting position | Segment ending position |
|---|---|---|
| M62096_PEA_1_T4 (SEQ ID NO: 4182) | 841 | 896 |
| M62096_PEA_1_T5 (SEQ ID NO: 4183) | 823 | 878 |
| M62096_PEA_1_T13 (SEQ ID NO: 4187) | 841 | 896 |
| M62096_PEA_1_T14 (SEQ ID NO: 4188) | 841 | 896 |

This segment can be found in the following protein(s): M62096_PEA_1_P11, M62096_PEA_1_P12, M62096_PEA_1_P8 and M62096_PEA_1_P9.

Segment cluster M62096_PEA_1_node_13 (SEQ ID NO:5588) according to the present invention is supported by 24 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T13 (SEQ ID NO:4187) and M62096_PEA_1_T14 (SEQ ID NO:4188). Table 5089 below describes the starting and ending position of this segment on each transcript.

TABLE 5089

Segment location on transcripts

| Transcript name | Segment starting position | Segment ending position |
|---|---|---|
| M62096_PEA_1_T4 (SEQ ID NO: 4182) | 897 | 984 |
| M62096_PEA_1_T5 (SEQ ID NO: 4183) | 879 | 966 |
| M62096_PEA_1_T13 (SEQ ID NO: 4187) | 897 | 984 |
| M62096_PEA_1_T14 (SEQ ID NO: 4188) | 897 | 984 |

This segment can be found in the following protein(s): M62096_PEA_1_P11, M62096_PEA_1_P12, M62096_PEA_1_P8 and M62096_PEA_1_P9.

Segment cluster M62096_PEA_1_node_21 (SEQ ID NO:5589) according to the present invention is supported by 33 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186), M62096_PEA_1_T13 (SEQ ID NO:4187) and M62096_PEA_1_T14 (SEQ ID NO:4188). Table 5090 below describes the starting and ending position of this segment on each transcript.

TABLE 5090

Segment location on transcripts

| Transcript name | Segment starting position | Segment ending position |
|---|---|---|
| M62096_PEA_1_T4 (SEQ ID NO: 4182) | 1110 | 1214 |
| M62096_PEA_1_T5 (SEQ ID NO: 4183) | 1092 | 1196 |

TABLE 5090-continued

Segment location on transcripts

| Transcript name | Segment starting position | Segment ending position |
|---|---|---|
| M62096_PEA_1_T6 (SEQ ID NO: 4184) | 126 | 230 |
| M62096_PEA_1_T7 (SEQ ID NO: 4185) | 148 | 252 |
| M62096_PEA_1_T9 (SEQ ID NO: 4186) | 126 | 230 |
| M62096_PEA_1_T13 (SEQ ID NO: 4187) | 1110 | 1214 |
| M62096_PEA_1_T14 (SEQ ID NO: 4188) | 1110 | 1214 |

This segment can be found in both coding and non-coding regions of transcript(s) as follows. The segment can be found in a non-coding region of transcript(s) that are related to the following protein(s): M62096_PEA_1_P5 and M62096_PEA_1_P3. This segment can also be found in the following protein(s): M62096_PEA_1_P11, M62096_PEA_1_P12, M62096_PEA_1_P4, M62096_PEA_1_P8 and M62096_PEA_1_P9, since it is in the coding region for the corresponding transcript.

Segment cluster M62096_PEA_1_node_25 (SEQ ID NO:5590) according to the present invention is supported by 3 libraries. The number of libraries was determined as previously described. This segment can be found in the following transcript(s): M62096_PEA_1_T5 (SEQ ID NO:4183) and M62096_PEA_1_T9 (SEQ ID NO:4186). Table 5091 below describes the starting and ending position of this segment on each transcript.

TABLE 5091

Segment location on transcripts

| Transcript name | Segment starting position | Segment ending position |
|---|---|---|
| M62096_PEA_1_T5 (SEQ ID NO: 4183) | 1346 | 1406 |
| M62096_PEA_1_T9 (SEQ ID NO: 4186) | 380 | 440 |

This segment can be found in both coding and non-coding regions of transcript(s) as follows. The segment can be found in a non-coding region of transcript(s) that are related to the following protein(s): M62096_PEA_1_P3. This segment can also be found in the following protein(s): M62096_PEA_1_P12, since it is in the coding region for the corresponding transcript.

Segment cluster M62096_PEA_1_node_33 (SEQ ID NO:5591) according to the present invention is supported by 20 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186), M62096_PEA_1_T13 (SEQ ID NO:4187) and M62096_PEA_1_T14 (SEQ ID NO:4188). Table 5092 below describes the starting and ending position of this segment on each transcript.

TABLE 5092

Segment location on transcripts

| Transcript name | Segment starting position | Segment ending position |
|---|---|---|
| M62096_PEA_1_T4 (SEQ ID NO: 4182) | 1856 | 1924 |
| M62096_PEA_1_T5 (SEQ ID NO: 4183) | 1732 | 1800 |
| M62096_PEA_1_T6 (SEQ ID NO: 4184) | 705 | 773 |
| M62096_PEA_1_T7 (SEQ ID NO: 4185) | 727 | 795 |
| M62096_PEA_1_T9 (SEQ ID NO: 4186) | 766 | 834 |
| M62096_PEA_1_T13 (SEQ ID NO: 4187) | 1689 | 1757 |
| M62096_PEA_1_T14 (SEQ ID NO: 4188) | 1689 | 1757 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3, M62096_PEA_1_P8 and M62096_PEA_1_P9, since it is in the coding region for the corresponding transcript.

Segment cluster M62096_PEA_1_node_42 (SEQ ID NO:5592) according to the present invention is supported by 17 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5093 below describes the starting and ending position of this segment on each transcript.

TABLE 5093

Segment location on transcripts

| Transcript name | Segment starting position | Segment ending position |
|---|---|---|
| M62096_PEA_1_T4 (SEQ ID NO: 4182) | 2468 | 2585 |
| M62096_PEA_1_T5 (SEQ ID NO: 4183) | 2344 | 2461 |
| M62096_PEA_1_T6 (SEQ ID NO: 4184) | 1317 | 1434 |
| M62096_PEA_1_T7 (SEQ ID NO: 4185) | 1339 | 1456 |
| M62096_PEA_1_T9 (SEQ ID NO: 4186) | 1378 | 1495 |
| M62096_PEA_1_T13 (SEQ ID NO: 4187) | 2301 | 2418 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_44 (SEQ ID NO:5593) according to the present invention is supported by 19 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5094 below describes the starting and ending position of this segment on each transcript.

TABLE 5094

Segment location on transcripts

| Transcript name | Segment starting position | Segment ending position |
| --- | --- | --- |
| M62096_PEA_1_T4 (SEQ ID NO: 4182) | 2586 | 2662 |
| M62096_PEA_1_T5 (SEQ ID NO: 4183) | 2462 | 2538 |
| M62096_PEA_1_T6 (SEQ ID NO: 4184) | 1435 | 1511 |
| M62096_PEA_1_T7 (SEQ ID NO: 4185) | 1457 | 1533 |
| M62096_PEA_1_T9 (SEQ ID NO: 4186) | 1496 | 1572 |
| M62096_PEA_1_T13 (SEQ ID NO: 4187) | 2419 | 2495 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_47 (SEQ ID NO:5594) according to the present invention is supported by 21 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185), M62096_PEA_1_T9 (SEQ ID NO:4186) and M62096_PEA_1_T13 (SEQ ID NO:4187). Table 5095 below describes the starting and ending position of this segment on each transcript.

TABLE 5095

Segment location on transcripts

| Transcript name | Segment starting position | Segment ending position |
| --- | --- | --- |
| M62096_PEA_1_T4 (SEQ ID NO: 4182) | 2663 | 2772 |
| M62096_PEA_1_T5 (SEQ ID NO: 4183) | 2539 | 2648 |
| M62096_PEA_1_T6 (SEQ ID NO: 4184) | 1512 | 1621 |
| M62096_PEA_1_T7 (SEQ ID NO: 4185) | 1534 | 1643 |
| M62096_PEA_1_T9 (SEQ ID NO: 4186) | 1573 | 1682 |
| M62096_PEA_1_T13 (SEQ ID NO: 4187) | 2496 | 2605 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5096.

TABLE 5096

Oligonucleotides related to this segment

| Oligonucleotides name | Overexpressed in cancers | Chip reference |
| --- | --- | --- |
| M62096_0_7_0 | lung malignant tumors | LUN |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5, M62096_PEA_1_P3 and M62096_PEA_1_P8, since it is in the coding region for the corresponding transcript.

Segment cluster M62096_PEA_1_node_51 (SEQ ID NO:5595) according to the present invention is supported by 11 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5097 below describes the starting and ending position of this segment on each transcript.

TABLE 5097

Segment location on transcripts

| Transcript name | Segment starting position | Segment ending position |
| --- | --- | --- |
| M62096_PEA_1_T4 (SEQ ID NO: 4182) | 2773 | 2874 |
| M62096_PEA_1_T5 (SEQ ID NO: 4183) | 2649 | 2750 |
| M62096_PEA_1_T6 (SEQ ID NO: 4184) | 1622 | 1723 |
| M62096_PEA_1_T7 (SEQ ID NO: 4185) | 1644 | 1745 |
| M62096_PEA_1_T9 (SEQ ID NO: 4186) | 1683 | 1784 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_53 (SEQ ID NO:5596) according to the present invention is supported by 10 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5098 below describes the starting and ending position of this segment on each transcript.

TABLE 5098

Segment location on transcripts

| Transcript name | Segment starting position | Segment ending position |
|---|---|---|
| M62096_PEA_1_T4 (SEQ ID NO: 4182) | 2875 | 2935 |
| M62096_PEA_1_T5 (SEQ ID NO: 4183) | 2751 | 2811 |
| M62096_PEA_1_T6 (SEQ ID NO: 4184) | 1724 | 1784 |
| M62096_PEA_1_T7 (SEQ ID NO: 4185) | 1746 | 1806 |
| M62096_PEA_1_T9 (SEQ ID NO: 4186) | 1785 | 1845 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_55 (SEQ ID NO:5597) according to the present invention is supported by 9 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5099 below describes the starting and ending position of this segment on each transcript.

TABLE 5099

Segment location on transcripts

| Transcript name | Segment starting position | Segment ending position |
|---|---|---|
| M62096_PEA_1_T4 (SEQ ID NO: 4182) | 2936 | 3007 |
| M62096_PEA_1_T5 (SEQ ID NO: 4183) | 2812 | 2883 |
| M62096_PEA_1_T6 (SEQ ID NO: 4184) | 1785 | 1856 |
| M62096_PEA_1_T7 (SEQ ID NO: 4185) | 1807 | 1878 |
| M62096_PEA_1_T9 (SEQ ID NO: 4186) | 1846 | 1917 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_58 (SEQ ID NO:5598) according to the present invention is supported by 9 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5100 below describes the starting and ending position of this segment on each transcript.

TABLE 5100

Segment location on transcripts

| Transcript name | Segment starting position | Segment ending position |
|---|---|---|
| M62096_PEA_1_T4 (SEQ ID NO: 4182) | 3008 | 3112 |
| M62096_PEA_1_T5 (SEQ ID NO: 4183) | 2884 | 2988 |
| M62096_PEA_1_T6 (SEQ ID NO: 4184) | 1857 | 1961 |
| M62096_PEA_1_T7 (SEQ ID NO: 4185) | 1879 | 1983 |
| M62096_PEA_1_T9 (SEQ ID NO: 4186) | 1918 | 2022 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_62 (SEQ ID NO:5599) according to the present invention is supported by 14 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5101 below describes the starting and ending position of this segment on each transcript.

TABLE 5101

Segment location on transcripts

| Transcript name | Segment starting position | Segment ending position |
|---|---|---|
| M62096_PEA_1_T4 (SEQ ID NO: 4182) | 3330 | 3443 |
| M62096_PEA_1_T5 (SEQ ID NO: 4183) | 3206 | 3319 |
| M62096_PEA_1_T6 (SEQ ID NO: 4184) | 2179 | 2292 |
| M62096_PEA_1_T7 (SEQ ID NO: 4185) | 2201 | 2314 |
| M62096_PEA_1_T9 (SEQ ID NO: 4186) | 2240 | 2353 |

This segment can be found in both coding and non-coding regions of transcript(s) as follows. The segment can be found in a non-coding region of transcript(s) that are related to the following protein(s): M62096_PEA_1_P11 and M62096_PEA_1_P12. This segment can also be found in the following protein(s): M62096_PEA_1_P4, M62096_PEA_1_P5 and M62096_PEA_1_P3, since it is in the coding region for the corresponding transcript.

Segment cluster M62096_PEA_1_node_66 (SEQ ID NO:5600) according to the present invention is supported by 23 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_

1_T6 (SEQ ID NO:4184), M62096_PEA_1_T7 (SEQ ID NO:4185) and M62096_PEA_1_T9 (SEQ ID NO:4186). Table 5102 below describes the starting and ending position of this segment on each transcript.

TABLE 5102

Segment location on transcripts

| Transcript name | Segment starting position | Segment ending position |
|---|---|---|
| M62096_PEA_1_T4 (SEQ ID NO: 4182) | 4764 | 4881 |
| M62096_PEA_1_T5 (SEQ ID NO: 4183) | 4640 | 4757 |
| M62096_PEA_1_T6 (SEQ ID NO: 4184) | 3613 | 3730 |
| M62096_PEA_1_T7 (SEQ ID NO: 4185) | 3635 | 3752 |
| M62096_PEA_1_T9 (SEQ ID NO: 4186) | 3674 | 3791 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Segment cluster M62096_PEA_1_node_67 (SEQ ID NO:5601) according to the present invention can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5103 below describes the starting and ending position of this segment on each transcript.

TABLE 5103

Segment location on transcripts

| Transcript name | Segment starting position | Segment ending position |
|---|---|---|
| M62096_PEA_1_T4 (SEQ ID NO: 4182) | 4882 | 4887 |
| M62096_PEA_1_T5 (SEQ ID NO: 4183) | 4758 | 4763 |
| M62096_PEA_1_T6 (SEQ ID NO: 4184) | 3731 | 3736 |
| M62096_PEA_1_T7 (SEQ ID NO: 4185) | 3753 | 3758 |
| M62096_PEA_1_T9 (SEQ ID NO: 4186) | 3792 | 3797 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Segment cluster M62096_PEA_1_node_68 (SEQ ID NO:5602) according to the present invention can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5104 below describes the starting and ending position of this segment on each transcript.

TABLE 5104

Segment location on transcripts

| Transcript name | Segment starting position | Segment ending position |
|---|---|---|
| M62096_PEA_1_T4 (SEQ ID NO: 4182) | 4888 | 4893 |
| M62096_PEA_1_T5 (SEQ ID NO: 4183) | 4764 | 4769 |
| M62096_PEA_1_T6 (SEQ ID NO: 4184) | 3737 | 3742 |
| M62096_PEA_1_T7 (SEQ ID NO: 4185) | 3759 | 3764 |
| M62096_PEA_1_T9 (SEQ ID NO: 4186) | 3798 | 3803 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Segment cluster M62096_PEA_1_node_70 (SEQ ID NO:5603) according to the present invention is supported by 55 libraries. The number of libraries was determined as previously described. This segment can be found in the following transcript(s): M62096_PEA_1_T4 (SEQ ID NO:4182), M62096_PEA_1_T5 (SEQ ID NO:4183), M62096_PEA_1_T6 (SEQ ID NO:4184), M62096_PEA_1_T7 (SEQ ID NO:4185) and M62096_PEA_1_T9 (SEQ ID NO:4186). Table 5105 below describes the starting and ending position of this segment on each transcript.

TABLE 5105

Segment location on transcripts

| Transcript name | Segment starting position | Segment ending position |
|---|---|---|
| M62096_PEA_1_T4 (SEQ ID NO: 4182) | 5827 | 5881 |
| M62096_PEA_1_T5 (SEQ ID NO: 4183) | 5703 | 5757 |
| M62096_PEA_1_T6 (SEQ ID NO: 4184) | 4676 | 4730 |
| M62096_PEA_1_T7 (SEQ ID NO: 4185) | 4698 | 4752 |
| M62096_PEA_1_T9 (SEQ ID NO: 4186) | 4737 | 4791 |

This segment can be found in a non-coding region of transcript(s) that are related to the following protein(s): M62096_PEA_1_P11, M62096_PEA_1_P12, M62096_PEA_1_P4, M62096_PEA_1_P5 and M62096_PEA_1_P3.

Expression of Kinesin heavy chain isoform 5C M62096 transcripts which are detectable by amplicon as depicted in sequence name M62096 seg19 in normal and cancerous lung tissues Expression of Kinesin heavy chain isoform 5C transcripts detectable by or according to M62096 seg19, M62096 seg19 amplicon(s) (SEQ ID NO: 6906) and M62096 seg19F (SEQ ID NO: 6907) and M62096 seg19R (SEQ ID NO: 6908) primers was measured by real time PCR. In parallel the expression of four housekeeping genes—PBGD (GenBank Accession No. BC019323 (SEQ ID NO: 6892); amplicon—PBGD-amplicon (SEQ ID NO: 6893)), HPRT1 (GenBank Accession No. NM_000194 (SEQ ID NO: 6894); amplicon—HPRT1-amplicon (SEQ ID NO: 6895)), Ubiquitin (GenBank Accession No. BC000449; amplicon—Ubiquitin-amplicon) and SDHA (GenBank Accession No. NM_004168 (SEQ ID NO: 6896); amplicon—SDHA-amplicon (SEQ ID NO: 6897)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 1, above), to obtain a value of fold up-regulation for each sample relative to median of the normal PM samples.

FIG. 123 is a histogram showing over expression of the above-indicated KINESIN HEAVY CHAIN ISOFORM 5C transcripts in cancerous lung samples relative to the normal samples. Values represent the average of duplicate experiments. Error bars indicate the minimal and maximal values obtained.

As is evident from FIG. 123, the expression of KINESIN HEAVY CHAIN ISOFORM 5C transcripts detectable by the above amplicon(s) in cancer samples was significantly higher than in the non-cancerous samples (Sample Nos. 47-50, 90-93, 96-99 Table 1). Notably an over-expression of at least 5 fold was found in 2 out of 15 adenocarcinoma samples, and in 8 out of 8 small cell carcinoma samples.

Primer pairs are also optionally and preferably encompassed within the present invention; for example, for the above experiment, the following primer pair was used as a non-limiting illustrative example only of a suitable primer pair: M62096 seg19F forward primer (SEQ ID NO: 6907); and M62096 seg19R reverse primer (SEQ ID NO: 6908).

The present invention also preferably encompasses any amplicon obtained through the use of any suitable primer pair; for example, for the above experiment, the following amplicon was obtained as a non-limiting illustrative example only of a suitable amplicon: M62096 seg19 (SEQ ID NO: 6906).

```
Forward primer-M62096 seg19F (SEQ ID NO: 6907):
GCTGATTGTCCCCATGAAGG

Reverse primer-M62096 seg19 (SEQ ID NO: 6908):
TGGCATACGGGAACTCAGTG

Amplicon (SEQ ID NO: 6906):
GCTGATTGTCCCCATGAAGGCCAGCCTTGAAGCTTGGTCAGTCTCCCTAA

CTGTATGATTGATCCCCACTTATTGCACTACATCACTGAGTTCCCGTATG

C
```

FIG. 1:

Cluster M62117 features 2 transcript(s) and 24 segment(s) of interest, the names for which are given in Tables 5061 and 5062, respectively, the sequences themselves are given at the end of the application. The selected protein variants are given in Table 5063.

TABLE 5106

Transcripts of interest
Transcript Name

M62117_T3 (SEQ ID NO: 4189)
M62117_T12 (SEQ ID NO: 4190)

TABLE 5107

Segments of interest
Segment Name

M62117_node_0 (SEQ ID NO: 5604)
M62117_node_5 (SEQ ID NO: 5605)
M62117_node_9 (SEQ ID NO: 5606)
M62117_node_10 (SEQ ID NO: 5607)
M62117_node_12 (SEQ ID NO: 5608)
M62117_node_15 (SEQ ID NO: 5609)
M62117_node_16 (SEQ ID NO: 5610)
M62117_node_18 (SEQ ID NO: 5611)
M62117_node_20 (SEQ ID NO: 5612)
M62117_node_23 (SEQ ID NO: 5613)
M62117_node_25 (SEQ ID NO: 5614)
M62117_node_26 (SEQ ID NO: 5615)
M62117_node_28 (SEQ ID NO: 5616)
M62117_node_29 (SEQ ID NO: 5617)
M62117_node_2 (SEQ ID NO: 5618)
M62117_node_4 (SEQ ID NO: 5619)
M62117_node_7 (SEQ ID NO: 5620)
M62117_node_13 (SEQ ID NO: 5621)
M62117_node_17 (SEQ ID NO: 5622)
M62117_node_21 (SEQ ID NO: 5623)
M62117_node_22 (SEQ ID NO: 5624)
M62117_node_24 (SEQ ID NO: 5625)
M62117_node_27 (SEQ ID NO: 5626)
M62117_node_30 (SEQ ID NO: 5627)

TABLE 5108

Proteins of interest

| Protein Name | Corresponding Transcript(s) |
| --- | --- |
| M62117_P3 | M62117_T12 (SEQ ID NO: 4190) |
| M62117_P4 | M62117_T3 (SEQ ID NO: 4189) |

These sequences are variants of the known protein Complexin 2 (SwissProt accession identifier CLX2_HUMAN; known also according to the synonyms Synaphin 1; 921-L), referred to herein as the previously known protein.

Protein Complexin 2 is known or believed to have the following function(s): Functions in synaptic vesicle exocytosis. Associated with the docking/fusion complex crucial to transmitter release. Regulate the sequential interactions of alpha-snap and synaptotagmins with the snap receptor during exocytosis. Binds syntaxin. The sequence for protein Complexin 2 is given at the end of the application, as "Complexin 2 amino acid sequence".

The following GO Annotation(s) apply to the previously known protein. The following annotation(s) were found: neurotransmitter transport; non-selective vesicle docking; membrane fusion; vacuole organization and biogenesis, which are annotation(s) related to Biological Process; and SNARE binding, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M62117 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 124 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 124 and Table 5064. This cluster is overexpressed (at least at a minimum level) in the following pathological conditions: lung malignant tumors.

TABLE 5109

Normal tissue distribution

| Name of Tissue | Number |
|---|---|
| Brain | 497 |
| Colon | 0 |
| epithelial | 9 |
| General | 96 |
| Liver | 0 |
| Lung | 0 |
| pancreas | 12 |

TABLE 5110

P values and ratios for expression in cancerous tissue

| Name of Tissue | P1 | P2 | SP1 | R3 | SP2 | R4 |
|---|---|---|---|---|---|---|
| Brain | 6.5e−01 | 6.9e−01 | 1 | 0.2 | 1 | 0.3 |
| Colon | 4.4e−01 | 3.6e−01 | 1 | 1.2 | 1 | 1.1 |
| epithelial | 4.0e−01 | 1.4e−01 | 8.7e−01 | 0.5 | 3.2e−02 | 1.7 |
| General | 9.5e−01 | 9.7e−01 | 1 | 0.2 | 1 | 0.3 |
| Liver | 1 | 4.5e−01 | 1 | 1.0 | 1.1e−01 | 1.9 |
| Lung | 5.0e−01 | 1.5e−01 | 1 | 1.6 | 4.0e−05 | 9.9 |
| pancreas | 6.7e−01 | 7.8e−01 | 1.1e−01 | 1.7 | 2.2e−01 | 1.3 |

As noted above, cluster M62117 features 24 segment(s), which were listed in Table 5062 above and for which the sequence(s) are given at the end of the application. These segment(s) are portions of nucleic acid sequence(s) which are described herein separately because they are of particular interest. A description of each segment according to the present invention is now provided.

Segment cluster M62117_node_0 (SEQ ID NO:5604) according to the present invention is supported by 5 libraries. The number of libraries was determined as previously described. This segment can be found in the following transcript(s): M62117_T3 (SEQ ID NO:4189). Table 5066 below describes the starting and ending position of this segment on each transcript.

TABLE 5111

Segment location on transcripts

| Transcript name | Segment starting position | Segment ending position |
|---|---|---|
| M62117_T3 (SEQ ID NO: 4189) | 1 | 258 |

This segment can be found in a non-coding region of transcript(s) that are related to the following protein(s): M62117_P4.

Segment cluster M62117_node_5 (SEQ ID NO:5605) according to the present invention is supported by 10 libraries. The number of libraries was determined as previously described. This segment can be found in the following transcript(s): M62117_T12 (SEQ ID NO:4190). Table 5067 below describes the starting and ending position of this segment on each transcript.

TABLE 5112

Segment location on transcripts

| Transcript name | Segment starting position | Segment ending position |
|---|---|---|
| M62117_T12 (SEQ ID NO: 4190) | 70 | 248 |

This segment can be found in a non-coding region of transcript(s) that are related to the following protein(s): M62117_P3.

Segment cluster M62117_node_9 (SEQ ID NO:5606) according to the present invention is supported by 25 libraries. The number of libraries was determined as previously described. This segment can be found in the following transcript(s): M62117_T3 (SEQ ID NO:4189) and M62117_T12 (SEQ ID NO:4190). Table 5068 below describes the starting and ending position of this segment on each transcript.

TABLE 5113

Segment location on transcripts

| Transcript name | Segment starting position | Segment ending position |
|---|---|---|
| M62117_T3 (SEQ ID NO: 4189) | 458 | 633 |
| M62117_T12 (SEQ ID NO: 4190) | 368 | 543 |

This segment can be found in the following protein(s): M62117_P4 and M62117_P3.

Segment cluster M62117_node_10 (SEQ ID NO:5607) according to the present invention is supported by 5 libraries. The number of libraries was determined as previously described. This segment can be found in the following transcript(s): M62117_T12 (SEQ ID NO:4190). Table 5069 below describes the starting and ending position of this segment on each transcript.

TABLE 5114

Segment location on transcripts

| Transcript name | Segment starting position | Segment ending position |
|---|---|---|
| M62117_T12 (SEQ ID NO: 4190) | 544 | 983 |

This segment can be found in the following protein(s): M62117_P3.

Segment cluster M62117_node_12 (SEQ ID NO:5608) according to the present invention is supported by 28 libraries. The number of libraries was determined as previously described. This segment can be found in the following transcript(s): M62117_T3 (SEQ ID NO:4189). Table 5070 below describes the starting and ending position of this segment on each transcript.

TABLE 5115

Segment location on transcripts

| Transcript name | Segment starting position | Segment ending position |
|---|---|---|
| M62117_T3 (SEQ ID NO: 4189) | 634 | 1007 |

This segment can be found in the following protein(s): M62117_P4.

Segment cluster M62117_node__15 (SEQ ID NO:5609) according to the present invention is supported by 29 libraries. The number of libraries was determined as previously described. This segment can be found in the following transcript(s): M62117_T3 (SEQ ID NO:4189). Table 5071 below describes the starting and ending position of this segment on each transcript.

TABLE 5116

Segment location on transcripts

| Transcript name | Segment starting position | Segment ending position |
|---|---|---|
| M62117_T3 (SEQ ID NO: 4189) | 1068 | 1400 |

This segment can be found in a non-coding region of transcript(s) that are related to the following protein(s): M62117_P4.

Segment cluster M62117_node__16 (SEQ ID NO:5610) according to the present invention is supported by 26 libraries. The number of libraries was determined as previously described. This segment can be found in the following transcript(s): M62117_T3 (SEQ ID NO:4189). Table 5072 below describes the starting and ending position of this segment on each transcript.

TABLE 5117

Segment location on transcripts

| Transcript name | Segment starting position | Segment ending position |
|---|---|---|
| M62117_T3 (SEQ ID NO: 4189) | 1401 | 1663 |

This segment can be found in a non-coding region of transcript(s) that are related to the following protein(s): M62117_P4.

Segment cluster M62117_node__18 (SEQ ID NO:5611) according to the present invention is supported by 65 libraries. The number of libraries was determined as previously described. This segment can be found in the following transcript(s): M62117_T3 (SEQ ID NO:4189). Table 5073 below describes the starting and ending position of this segment on each transcript.

TABLE 5118

Segment location on transcripts

| Transcript name | Segment starting position | Segment ending position |
|---|---|---|
| M62117_T3 (SEQ ID NO: 4189) | 1670 | 2457 |

This segment can be found in a non-coding region of transcript(s) that are related to the following protein(s): M62117_P4.

Segment cluster M62117_node__20 (SEQ ID NO:5612) according to the present invention is supported by 56 libraries. The number of libraries was determined as previously described. This segment can be found in the following transcript(s): M62117_T3 (SEQ ID NO:4189). Table 5074 below describes the starting and ending position of this segment on each transcript.

TABLE 5119

Segment location on transcripts

| Transcript name | Segment starting position | Segment ending position |
|---|---|---|
| M62117_T3 (SEQ ID NO: 4189) | 2458 | 2658 |

This segment can be found in a non-coding region of transcript(s) that are related to the following protein(s): M62117_P4.

Segment cluster M62117_node__23 (SEQ ID NO:5613) according to the present invention is supported by 82 libraries. The number of libraries was determined as previously described. This segment can be found in the following transcript(s): M62117_T3 (SEQ ID NO:4189). Table 5075 below describes the starting and ending position of this segment on each transcript.

TABLE 5120

Segment location on transcripts

| Transcript name | Segment starting position | Segment ending position |
|---|---|---|
| M62117_T3 (SEQ ID NO: 4189) | 2675 | 3210 |

This segment can be found in a non-coding region of transcript(s) that are related to the following protein(s): M62117_P4.

Segment cluster M62117_node__25 (SEQ ID NO:5614) according to the present invention is supported by 71 libraries. The number of libraries was determined as previously described. This segment can be found in the following transcript(s): M62117_T3 (SEQ ID NO:4189). Table 5076 below describes the starting and ending position of this segment on each transcript.

TABLE 5121

Segment location on transcripts

| Transcript name | Segment starting position | Segment ending position |
|---|---|---|
| M62117_T3 (SEQ ID NO: 4189) | 3217 | 3492 |

This segment can be found in a non-coding region of transcript(s) that are related to the following protein(s): M62117_P4.

Segment cluster M62117_node__26 (SEQ ID NO:5615) according to the present invention is supported by 84 libraries. The number of libraries was determined as previously described. This segment can be found in the following transcript(s): M62117_T3 (SEQ ID NO:4189). Table 5077 below describes the starting and ending position of this segment on each transcript.

TABLE 5122

Segment location on transcripts

| Transcript name | Segment starting position | Segment ending position |
|---|---|---|
| M62117_T3 (SEQ ID NO: 4189) | 3493 | 3822 |

This segment can be found in a non-coding region of transcript(s) that are related to the following protein(s): M62117_P4.

Segment cluster M62117_node_28 (SEQ ID NO:5616) according to the present invention is supported by 97 libraries. The number of libraries was determined as previously described. This segment can be found in the following transcript(s): M62117_T3 (SEQ ID NO:4189). Table 5078 below describes the starting and ending position of this segment on each transcript.

TABLE 5123

Segment location on transcripts

| Transcript name | Segment starting position | Segment ending position |
|---|---|---|
| M62117_T3 (SEQ ID NO: 4189) | 3890 | 4232 |

This segment can be found in a non-coding region of transcript(s) that are related to the following protein(s): M62117_P4.

Segment cluster M62117_node_29 (SEQ ID NO:5617) according to the present invention is supported by 81 libraries. The number of libraries was determined as previously described. This segment can be found in the following transcript(s): M62117_T3 (SEQ ID NO:4189). Table 5079 below describes the starting and ending position of this segment on each transcript.

TABLE 5124

Segment location on transcripts

| Transcript name | Segment starting position | Segment ending position |
|---|---|---|
| M62117_T3 (SEQ ID NO: 4189) | 4233 | 4379 |

This segment can be found in a non-coding region of transcript(s) that are related to the following protein(s): M62117_P4.

According to an optional embodiment of the present invention, short segments related to the above cluster are also provided. These segments are up to about 120 bp in length, and so are included in a separate description.

Segment cluster M62117_node_2 (SEQ ID NO:5618) according to the present invention is supported by 6 libraries. The number of libraries was determined as previously described. This segment can be found in the following transcript(s): M62117_T3 (SEQ ID NO:4189). Table 5080 below describes the starting and ending position of this segment on each transcript.

TABLE 5125

Segment location on transcripts

| Transcript name | Segment starting position | Segment ending position |
|---|---|---|
| M62117_T3 (SEQ ID NO: 4189) | 259 | 338 |

This segment can be found in a non-coding region of transcript(s) that are related to the following protein(s): M62117_P4.

Segment cluster M62117_node_4 (SEQ ID NO:5619) according to the present invention is supported by 2 libraries. The number of libraries was determined as previously described. This segment can be found in the following transcript(s): M62117_T12 (SEQ ID NO:4190). Table 5081 below describes the starting and ending position of this segment on each transcript.

TABLE 5126

Segment location on transcripts

| Transcript name | Segment starting position | Segment ending position |
|---|---|---|
| M62117_T12 (SEQ ID NO: 4190) | 1 | 69 |

This segment can be found in a non-coding region of transcript(s) that are related to the following protein(s): M62117_P3.

Segment cluster M62117_node_7 (SEQ ID NO:5620) according to the present invention is supported by 17 libraries. The number of libraries was determined as previously described. This segment can be found in the following transcript(s): M62117_T3 (SEQ ID NO:4189) and M62117_T12 (SEQ ID NO:4190). Table 5082 below describes the starting and ending position of this segment on each transcript.

TABLE 5127

Segment location on transcripts

| Transcript name | Segment starting position | Segment ending position |
|---|---|---|
| M62117_T3 (SEQ ID NO: 4189) | 339 | 457 |
| M62117_T12 (SEQ ID NO: 4190) | 249 | 367 |

This segment can be found in the following protein(s): M62117_P4 and M62117_P3.

Segment cluster M62117_node_13 (SEQ ID NO:5621) according to the present invention is supported by 25 libraries. The number of libraries was determined as previously described. This segment can be found in the following transcript(s): M62117_T3 (SEQ ID NO:4189). Table 5083 below describes the starting and ending position of this segment on each transcript.

TABLE 5128

Segment location on transcripts

| Transcript name | Segment starting position | Segment ending position |
|---|---|---|
| M62117_T3 (SEQ ID NO: 4189) | 1008 | 1067 |

This segment can be found in a non-coding region of transcript(s) that are related to the following protein(s): M62117_P4.

Segment cluster M62117_node_17 (SEQ ID NO:5622) according to the present invention can be found in the following transcript(s): M62117_T3 (SEQ ID NO:4189). Table 5084 below describes the starting and ending position of this segment on each transcript.

TABLE 5129

Segment location on transcripts

| Transcript name | Segment starting position | Segment ending position |
|---|---|---|
| M62117_T3 (SEQ ID NO: 4189) | 1664 | 1669 |

This segment can be found in a non-coding region of transcript(s) that are related to the following protein(s): M62117_P4.

Segment cluster M62117_node_21 (SEQ ID NO:5623) according to the present invention can be found in the following transcript(s): M62117_T3 (SEQ ID NO:4189). Table 5085 below describes the starting and ending position of this segment on each transcript.

TABLE 5130

Segment location on transcripts

| Transcript name | Segment starting position | Segment ending position |
|---|---|---|
| M62117_T3 (SEQ ID NO: 4189) | 2659 | 2666 |

This segment can be found in a non-coding region of transcript(s) that are related to the following protein(s): M62117_P4.

Segment cluster M62117_node_22 (SEQ ID NO:5624) according to the present invention can be found in the following transcript(s): M62117_T3 (SEQ ID NO:4189). Table 5086 below describes the starting and ending position of this segment on each transcript.

TABLE 5131

Segment location on transcripts

| Transcript name | Segment starting position | Segment ending position |
|---|---|---|
| M62117_T3 (SEQ ID NO: 4189) | 2667 | 2674 |

This segment can be found in a non-coding region of transcript(s) that are related to the following protein(s): M62117_P4.

Segment cluster M62117_node_24 (SEQ ID NO:5625) according to the present invention can be found in the following transcript(s): M62117_T3 (SEQ ID NO:4189). Table 5087 below describes the starting and ending position of this segment on each transcript.

TABLE 5132

Segment location on transcripts

| Transcript name | Segment starting position | Segment ending position |
|---|---|---|
| M62117_T3 (SEQ ID NO: 4189) | 3211 | 3216 |

This segment can be found in a non-coding region of transcript(s) that are related to the following protein(s): M62117_P4.

Segment cluster M62117_node_27 (SEQ ID NO:5626) according to the present invention is supported by 74 libraries. The number of libraries was determined as previously described. This segment can be found in the following transcript(s): M62117_T3 (SEQ ID NO:4189). Table 5088 below describes the starting and ending position of this segment on each transcript.

TABLE 5133

Segment location on transcripts

| Transcript name | Segment starting position | Segment ending position |
|---|---|---|
| M62117_T3 (SEQ ID NO: 4189) | 3823 | 3889 |

This segment can be found in a non-coding region of transcript(s) that are related to the following protein(s): M62117_P4.

Segment cluster M62117_node_30 (SEQ ID NO:5627) according to the present invention is supported by 55 libraries. The number of libraries was determined as previously described. This segment can be found in the following transcript(s): M62117_T3 (SEQ ID NO:4189). Table 5089 below describes the starting and ending position of this segment on each transcript.

TABLE 5134

Segment location on transcripts

| Transcript name | Segment starting position | Segment ending position |
|---|---|---|
| M62117_T3 (SEQ ID NO: 4189) | 4380 | 4449 |

This segment can be found in a non-coding region of transcript(s) that are related to the following protein(s): M62117_P4.

Description for Cluster M62189

Cluster M62189 features 11 transcript(s) and 35 segment(s) of interest, the names for which are given in Tables 5135 and 5136, respectively, the sequences themselves are given at the end of the application. The selected protein variants are given in Table 5137.

TABLE 5135

Transcripts of interest
Transcript Name

M62189_T2 (SEQ ID NO: 4191)
M62189_T4 (SEQ ID NO: 4192)
M62189_T12 (SEQ ID NO: 4193)
M62189_T15 (SEQ ID NO: 4194)
M62189_T19 (SEQ ID NO: 4195)
M62189_T22 (SEQ ID NO: 4196)
M62189_T23 (SEQ ID NO: 4197)
M62189_T24 (SEQ ID NO: 4198)
M62189_T25 (SEQ ID NO: 4199)
M62189_T27 (SEQ ID NO: 4200)
M62189_T28 (SEQ ID NO: 4201)

TABLE 5136

Segments of interest
Segment Name

M62189_node_0 (SEQ ID NO: 5628)
M62189_node_4 (SEQ ID NO: 5629)
M62189_node_6 (SEQ ID NO: 5630)
M62189_node_11 (SEQ ID NO: 5631)

TABLE 5136-continued

Segments of interest
Segment Name

M62189_node_23 (SEQ ID NO: 5632)
M62189_node_25 (SEQ ID NO: 5633)
M62189_node_27 (SEQ ID NO: 5634)
M62189_node_34 (SEQ ID NO: 5635)
M62189_node_36 (SEQ ID NO: 5636)
M62189_node_37 (SEQ ID NO: 5637)
M62189_node_38 (SEQ ID NO: 5638)
M62189_node_46 (SEQ ID NO: 5639)
M62189_node_48 (SEQ ID NO: 5640)
M62189_node_2 (SEQ ID NO: 5641)
M62189_node_5 (SEQ ID NO: 5642)
M62189_node_8 (SEQ ID NO: 5643)
M62189_node_9 (SEQ ID NO: 5644)
M62189_node_12 (SEQ ID NO: 5645)
M62189_node_13 (SEQ ID NO: 5646)
M62189_node_15 (SEQ ID NO: 5647)
M62189_node_16 (SEQ ID NO: 5648)
M62189_node_18 (SEQ ID NO: 5649)
M62189_node_19 (SEQ ID NO: 5650)
M62189_node_22 (SEQ ID NO: 5651)
M62189_node_24 (SEQ ID NO: 5652)
M62189_node_26 (SEQ ID NO: 5653)
M62189_node_28 (SEQ ID NO: 5654)
M62189_node_29 (SEQ ID NO: 5655)
M62189_node_30 (SEQ ID NO: 5656)
M62189_node_32 (SEQ ID NO: 5657)
M62189_node_35 (SEQ ID NO: 5658)
M62189_node_39 (SEQ ID NO: 5659)
M62189_node_40 (SEQ ID NO: 5660)
M62189_node_41 (SEQ ID NO: 5661)
M62189_node_45 (SEQ ID NO: 5662)

TABLE 5137

Proteins of interest

| Protein Name | Corresponding Transcript(s) |
|---|---|
| M62189_P2 | M62189_T2 (SEQ ID NO: 4191) |
| M62189_P3 | M62189_T12 (SEQ ID NO: 4193) |
| M62189_P4 | M62189_T4 (SEQ ID NO: 4192); M62189_T15 (SEQ ID NO: 4194) |
| M62189_P13 | M62189_T19 (SEQ ID NO: 4195) |
| M62189_P16 | M62189_T22 (SEQ ID NO: 4196) |
| M62189_P17 | M62189_T23 (SEQ ID NO: 4197); M62189_T24 (SEQ ID NO: 4198) |
| M62189_P19 | M62189_T27 (SEQ ID NO: 4200) |
| M62189_P20 | M62189_T28 (SEQ ID NO: 4201) |

These sequences are variants of the known protein Asparaginyl-tRNA synthetase, cytoplasmic (SwissProt accession identifier SYN_HUMAN; known also according to the synonyms EC 6.1.1.22; Asparagine-tRNA ligase; AsnRS), referred to herein as the previously known protein.

The sequence for protein Asparaginyl-tRNA synthetase, cytoplasmic is given at the end of the application, as "Asparaginyl-tRNA synthetase, cytoplasmic amino acid sequence". Protein Asparaginyl-tRNA synthetase, cytoplasmic localization is believed to be Cytoplasmic.

The following GO Annotation(s) apply to the previously known protein. The following annotation(s) were found: asparagine-tRNA ligase, which are annotation(s) related to Molecular Function; and soluble fraction; cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M62189 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 125 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 125 and Table 5138. This cluster is overexpressed (at least at a minimum level) in the following pathological conditions: uterine malignancies.

TABLE 5138

Normal tissue distribution

| Name of Tissue | Number |
|---|---|
| Bladder | 82 |
| Bone | 401 |
| Brain | 207 |
| Colon | 31 |
| Epithelial | 125 |
| General | 135 |
| head and neck | 20 |
| Kidney | 213 |
| Liver | 92 |
| Lung | 84 |
| lymph nodes | 122 |
| Breast | 101 |
| bone marrow | 62 |
| Muscle | 96 |
| Ovary | 7 |
| Pancreas | 51 |
| Prostate | 599 |
| Skin | 134 |
| Stomach | 186 |
| T cells | 0 |
| Thyroid | 128 |
| Uterus | 31 |

TABLE 5139

P values and ratios for expression in cancerous tissue

| Name of Tissue | P1 | P2 | SP1 | R3 | SP2 | R4 |
|---|---|---|---|---|---|---|
| Bladder | 5.4e−01 | 3.6e−01 | 4.7e−01 | 1.4 | 1.6e−01 | 1.7 |
| Bone | 6.9e−01 | 3.6e−01 | 9.7e−01 | 0.3 | 9.9e−01 | 0.4 |
| Brain | 7.2e−01 | 7.3e−01 | 1 | 0.4 | 1 | 0.4 |
| Colon | 3.4e−02 | 1.0e−02 | 4.6e−02 | 2.7 | 3.1e−02 | 3.1 |
| Epithelial | 2.1e−01 | 2.2e−02 | 6.1e−01 | 0.9 | 6.6e−02 | 1.2 |
| General | 5.6e−01 | 1.9e−02 | 9.6e−01 | 0.8 | 5.4e−02 | 1.1 |
| head and neck | 6.7e−01 | 6.4e−01 | 1 | 0.8 | 3.2e−01 | 1.4 |
| Kidney | 7.8e−01 | 8.2e−01 | 9.5e−01 | 0.5 | 9.5e−01 | 0.5 |
| Liver | 5.3e−01 | 6.2e−01 | 1 | 0.6 | 4.1e−01 | 1.2 |
| Lung | 8.1e−01 | 7.9e−01 | 6.7e−01 | 0.8 | 1.6e−01 | 1.3 |
| lymph nodes | 4.4e−01 | 6.3e−01 | 3.1e−01 | 1.2 | 8.4e−02 | 1.2 |
| Breast | 6.7e−01 | 5.7e−01 | 8.2e−01 | 0.7 | 6.4e−01 | 0.9 |
| bone marrow | 8.8e−01 | 3.0e−01 | 1 | 0.3 | 3.3e−02 | 2.1 |
| Muscle | 7.7e−01 | 6.7e−01 | 1 | 0.2 | 2.3e−01 | 0.7 |
| Ovary | 2.0e−01 | 1.7e−01 | 4.7e−02 | 3.6 | 7.0e−02 | 3.1 |
| Pancreas | 2.8e−01 | 3.6e−01 | 3.0e−01 | 1.1 | 3.6e−01 | 1.1 |
| Prostate | 8.1e−01 | 7.0e−01 | 1 | 0.2 | 1 | 0.2 |
| Skin | 6.2e−01 | 5.8e−01 | 5.3e−01 | 1.2 | 4.2e−01 | 0.7 |
| Stomach | 5.8e−01 | 4.1e−01 | 9.8e−01 | 0.4 | 2.6e−01 | 1.0 |
| T cells | 5.0e−01 | 3.3e−01 | 3.3e−01 | 3.1 | 3.7e−01 | 2.2 |
| Thyroid | 5.7e−01 | 5.7e−01 | 8.9e−01 | 0.8 | 8.9e−01 | 0.8 |
| Uterus | 7.4e−02 | 4.7e−02 | 1.4e−03 | 3.9 | 2.7e−03 | 3.7 |

As noted above, cluster M62189 features 35 segment(s), which were listed in Table 5136 above and for which the sequence(s) are given at the end of the application. These segment(s) are portions of nucleic acid sequence(s) which are described herein separately because they are of particular interest. A description of each segment according to the present invention is now provided.

Segment cluster M62189_node_0 (SEQ ID NO:5628) according to the present invention is supported by 139 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T22 (SEQ ID NO:4196) and M62189_T27 (SEQ ID NO:4200). Table 5140 below describes the starting and ending position of this segment on each transcript.

TABLE 5140

Segment location on transcripts

| Transcript name | Segment starting position | Segment ending position |
|---|---|---|
| M62189_T2 (SEQ ID NO: 4191) | 1 | 343 |
| M62189_T4 (SEQ ID NO: 4192) | 1 | 343 |
| M62189_T12 (SEQ ID NO: 4193) | 1 | 343 |
| M62189_T15 (SEQ ID NO: 4194) | 1 | 343 |
| M62189_T22 (SEQ ID NO: 4196) | 1 | 343 |
| M62189_T27 (SEQ ID NO: 4200) | 1 | 343 |

This segment can be found in the following protein(s): M62189_P2, M62189_P4, M62189_P3, M62189_P16 and M62189_P19.

Segment cluster M62189_node_4 (SEQ ID NO:5629) according to the present invention is supported by I libraries. The number of libraries was determined as previously described. This segment can be found in the following transcript(s): M62189_T28 (SEQ ID NO:4201). Table 5141 below describes the starting and ending position of this segment on each transcript.

TABLE 5141

Segment location on transcripts

| Transcript name | Segment starting position | Segment ending position |
|---|---|---|
| M62189_T28 (SEQ ID NO: 4201) | 1 | 172 |

This segment can be found in a non-coding region of transcript(s) that are related to the following protein(s): M62189_P20.

Segment cluster M62189_node_6 (SEQ ID NO:5630) according to the present invention is supported by 168 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T22 (SEQ ID NO:4196), M62189_T27 (SEQ ID NO:4200) and M62189_T28 (SEQ ID NO:4201) Table 5142 below describes the starting and ending position of this segment on each transcript.

TABLE 5142

Segment location on transcripts

| Transcript name | Segment starting position | Segment ending position |
|---|---|---|
| M62189_T2 (SEQ ID NO: 4191) | 427 | 585 |
| M62189_T4 (SEQ ID NO: 4192) | 427 | 585 |
| M62189_T12 (SEQ ID NO: 4193) | 427 | 585 |
| M62189_T15 (SEQ ID NO: 4194) | 427 | 585 |
| M62189_T22 (SEQ ID NO: 4196) | 427 | 585 |
| M62189_T27 (SEQ ID NO: 4200) | 427 | 585 |
| M62189_T28 (SEQ ID NO: 4201) | 220 | 378 |

This segment can be found in the following protein(s): M62189_P2, M62189_P4, M62189_P3, M62189_P16, M62189_P19 and M62189_P20.

Segment cluster M62189_node_11 (SEQ ID NO:5631) according to the present invention is supported by 1 libraries. The number of libraries was determined as previously described. This segment can be found in the following transcript(s): M62189_T19 (SEQ ID NO:4195). Table 5143 below describes the starting and ending position of this segment on each transcript.

TABLE 5143

Segment location on transcripts

| Transcript name | Segment starting position | Segment ending position |
|---|---|---|
| M62189_T19 (SEQ ID NO: 4195) | 1 | 165 |

This segment can be found in a non-coding region of transcript(s) that are related to the following protein(s): M62189_P13.

Segment cluster M62189_node_23 (SEQ ID NO:5632) according to the present invention is supported by 143 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5144 below describes the starting and ending position of this segment on each transcript.

TABLE 5144

Segment location on transcripts

| Transcript name | Segment starting position | Segment ending position |
|---|---|---|
| M62189_T2 (SEQ ID NO: 4191) | 939 | 1134 |
| M62189_T4 (SEQ ID NO: 4192) | 939 | 1134 |
| M62189_T12 (SEQ ID NO: 4193) | 939 | 1134 |
| M62189_T15 (SEQ ID NO: 4194) | 939 | 1134 |
| M62189_T19 (SEQ ID NO: 4195) | 429 | 624 |
| M62189_T22 (SEQ ID NO: 4196) | 939 | 1134 |

This segment can be found in the following protein(s): M62189_P2, M62189_P4, M62189_P3, M62189_P13 and M62189_P16.

Segment cluster M62189_node_25 (SEQ ID NO:5633) according to the present invention is supported by 146 libraries. The number of libraries was determined as previously described. This segment can be found in the following transcript(s): M62189_T2 (SEQ ID NO:4191), M62189_T4

(SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5145 below describes the starting and ending position of this segment on each transcript.

TABLE 5145

Segment location on transcripts

| Transcript name | Segment starting position | Segment ending position |
|---|---|---|
| M62189_T2 (SEQ ID NO: 4191) | 1135 | 1330 |
| M62189_T4 (SEQ ID NO: 4192) | 1135 | 1330 |
| M62189_T12 (SEQ ID NO: 4193) | 1245 | 1440 |
| M62189_T15 (SEQ ID NO: 4194) | 1135 | 1330 |
| M62189_T19 (SEQ ID NO: 4195) | 625 | 820 |
| M62189_T22 (SEQ ID NO: 4196) | 1135 | 1330 |

This segment can be found in both coding and non-coding regions of transcript(s) as follows. The segment can be found in a non-coding region of transcript(s) that are related to the following protein(s): M62189_P3. This segment can also be found in the following protein(s): M62189_P2, M62189_P4, M62189_P13 and M62189_P16, since it is in the coding region for the corresponding transcript.

Segment cluster M62189_node_27 (SEQ ID NO:5634) according to the present invention is supported by 6 libraries. The number of libraries was determined as previously described. This segment can be found in the following transcript(s): M62189_T4 (SEQ ID NO:4192), M62189_T12 (SEQ ID NO:4193) and M62189_T15 (SEQ ID NO:4194). Table 5146 below describes the starting and ending position of this segment on each transcript.

TABLE 5146

Segment location on transcripts

| Transcript name | Segment starting position | Segment ending position |
|---|---|---|
| M62189_T4 (SEQ ID NO: 4192) | 1335 | 1716 |
| M62189_T12 (SEQ ID NO: 4193) | 1445 | 1826 |
| M62189_T15 (SEQ ID NO: 4194) | 1335 | 1716 |

This segment can be found in both coding and non-coding regions of transcript(s) as follows. The segment can be found in a non-coding region of transcript(s) that are related to the following protein(s): M62189_P3. This segment can also be found in the following protein(s): M62189_P4, since it is in the coding region for the corresponding transcript.

Segment cluster M62189_node_34 (SEQ ID NO:5635) according to the present invention is supported by 4 libraries. The number of libraries was determined as previously described. This segment can be found in the following transcript(s): M62189_T23 (SEQ ID NO:4197), M62189_T24 (SEQ ID NO:4198) and M62189_T25 (SEQ ID NO:4199). Table 5147 below describes the starting and ending position of this segment on each transcript.

TABLE 5147

Segment location on transcripts

| Transcript name | Segment starting position | Segment ending position |
|---|---|---|
| M62189_T23 (SEQ ID NO: 4197) | 1 | 454 |
| M62189_T24 (SEQ ID NO: 4198) | 1 | 454 |
| M62189_T25 (SEQ ID NO: 4199) | 1 | 454 |

This segment can be found in a non-coding region of transcript(s) that are related to the following protein(s): M62189_P17.

Segment cluster M62189_node_36 (SEQ ID NO:5636) according to the present invention is supported by 14 libraries. The number of libraries was determined as previously described. This segment can be found in the following transcript(s): M62189_T23 (SEQ ID NO:4197), M62189_T24 (SEQ ID NO:4198) and M62189_T25 (SEQ ID NO:4199). Table 5148 below describes the starting and ending position of this segment on each transcript.

TABLE 5148

Segment location on transcripts

| Transcript name | Segment starting position | Segment ending position |
|---|---|---|
| M62189_T23 (SEQ ID NO: 4197) | 506 | 1376 |
| M62189_T24 (SEQ ID NO: 4198) | 455 | 1325 |
| M62189_T25 (SEQ ID NO: 4199) | 506 | 1376 |

This segment can be found in a non-coding region of transcript(s) that are related to the following protein(s): M62189_P17.

Segment cluster M62189_node_37 (SEQ ID NO:5637) according to the present invention is supported by 171 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T23 (SEQ ID NO:4197), M62189_T24 (SEQ ID NO:4198) and M62189_T25 (SEQ ID NO:4199). Table 5149 below describes the starting and ending position of this segment on each transcript.

TABLE 5149

Segment location on transcripts

| Transcript name | Segment starting position | Segment ending position |
|---|---|---|
| M62189_T2 (SEQ ID NO: 4191) | 1585 | 1716 |
| M62189_T4 (SEQ ID NO: 4192) | 1967 | 2098 |
| M62189_T12 (SEQ ID NO: 4193) | 2077 | 2208 |
| M62189_T15 (SEQ ID NO: 4194) | 1967 | 2098 |
| M62189_T19 (SEQ ID NO: 4195) | 1075 | 1206 |
| M62189_T22 (SEQ ID NO: 4196) | 1585 | 1716 |
| M62189_T23 (SEQ ID NO: 4197) | 1377 | 1508 |
| M62189_T24 (SEQ ID NO: 4198) | 1326 | 1457 |
| M62189_T25 (SEQ ID NO: 4199) | 1377 | 1508 |

This segment can be found in both coding and non-coding regions of transcript(s) as follows. The segment can be found in a non-coding region of transcript(s) that are related to the following protein(s): M62189_P4 and M62189_P3. This segment can also be found in the following protein(s):

M62189_P2, M62189_P13, M62189_P16 and M62189_P17, since it is in the coding region for the corresponding transcript.

Segment cluster M62189_node_38 (SEQ ID NO:5638) according to the present invention is supported by 29 libraries. The number of libraries was determined as previously described. This segment can be found in the following transcript(s): M62189_T2 (SEQ ID NO:4191), M62189_T15 (SEQ ID NO:4194) and M62189_T25 (SEQ ID NO:4199). Table 5150 below describes the starting and ending position of this segment on each transcript.

TABLE 5150

Segment location on transcripts

| Transcript name | Segment starting position | Segment ending position |
|---|---|---|
| M62189_T2 (SEQ ID NO: 4191) | 1717 | 2041 |
| M62189_T15 (SEQ ID NO: 4194) | 2099 | 2423 |
| M62189_T25 (SEQ ID NO: 4199) | 1509 | 1833 |

This segment can be found in both coding and non-coding regions of transcript(s) as follows. The segment can be found in a non-coding region of transcript(s) that are related to the following protein(s): M62189_P4. This segment can also be found in the following protein(s): M62189_P2, since it is in the coding region for the corresponding transcript.

Segment cluster M62189_node_46 (SEQ ID NO:5639) according to the present invention is supported by 405 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T23 (SEQ ID NO:4197), M62189_T24 (SEQ ID NO:4198) and M62189_T25 (SEQ ID NO:4199). Table 5151 below describes the starting and ending position of this segment on each transcript.

TABLE 5151

Segment location on transcripts

| Transcript name | Segment starting position | Segment ending position |
|---|---|---|
| M62189_T2 (SEQ ID NO: 4191) | 2248 | 3302 |
| M62189_T4 (SEQ ID NO: 4192) | 2305 | 3359 |
| M62189_T12 (SEQ ID NO: 4193) | 2415 | 3469 |
| M62189_T15 (SEQ ID NO: 4194) | 2630 | 3684 |
| M62189_T19 (SEQ ID NO: 4195) | 1413 | 2467 |
| M62189_T23 (SEQ ID NO: 4197) | 1715 | 2769 |
| M62189_T24 (SEQ ID NO: 4198) | 1664 | 2718 |
| M62189_T25 (SEQ ID NO: 4199) | 2040 | 3094 |

This segment can be found in both coding and non-coding regions of transcript(s) as follows. The segment can be found in a non-coding region of transcript(s) that are related to the following protein(s): M62189_P2, M62189_P4 and M62189_P3. This segment can also be found in the following protein(s): M62189_P13 and M62189_P17, since it is in the coding region for the corresponding transcript.

Segment cluster M62189_node_48 (SEQ ID NO:5640) according to the present invention is supported by 1 libraries. The number of libraries was determined as previously described. This segment can be found in the following transcript(s): M62189_T22 (SEQ ID NO:4196). Table 5152 below describes the starting and ending position of this segment on each transcript.

TABLE 5152

Segment location on transcripts

| Transcript name | Segment starting position | Segment ending position |
|---|---|---|
| M62189_T22 (SEQ ID NO: 4196) | 1923 | 2560 |

This segment can be found in the following protein(s): M62189_P16.

According to an optional embodiment of the present invention, short segments related to the above cluster are also provided. These segments are up to about 120 bp in length, and so are included in a separate description.

Segment cluster M62189_node_2 (SEQ ID NO:5641) according to the present invention is supported by 151 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T22 (SEQ ID NO:4196) and M62189_T27 (SEQ ID NO:4200). Table 5153 below describes the starting and ending position of this segment on each transcript.

TABLE 5153

Segment location on transcripts

| Transcript name | Segment starting position | Segment ending position |
|---|---|---|
| M62189_T2 (SEQ ID NO: 4191) | 344 | 426 |
| M62189_T4 (SEQ ID NO: 4192) | 344 | 426 |
| M62189_T12 (SEQ ID NO: 4193) | 344 | 426 |
| M62189_T15 (SEQ ID NO: 4194) | 344 | 426 |
| M62189_T22 (SEQ ID NO: 4196) | 344 | 426 |
| M62189_T27 (SEQ ID NO: 4200) | 344 | 426 |

This segment can be found in the following protein(s): M62189_P2, M62189_P4, M62189_P3, M62189_P16 and M62189_P19.

Segment cluster M62189_node_5 (SEQ ID NO: 5642) according to the present invention is supported by 3 libraries. The number of libraries was determined as previously described. This segment can be found in the following transcript(s): M62189_T28 (SEQ ID NO:4201). Table 5154 below describes the starting and ending position of this segment on each transcript.

TABLE 5154

Segment location on transcripts

| Transcript name | Segment starting position | Segment ending position |
|---|---|---|
| M62189_T28 (SEQ ID NO: 4201) | 173 | 219 |

This segment can be found in a non-coding region of transcript(s) that are related to the following protein(s): M62189_P20.

Segment cluster M62189_node_8 (SEQ ID NO:5643) according to the present invention is supported by 144 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T22 (SEQ ID NO:4196), M62189_T27 (SEQ ID NO:4200) and M62189_T28 (SEQ ID NO:4201). Table 5155 below describes the starting and ending position of this segment on each transcript.

TABLE 5155

Segment location on transcripts

| Transcript name | Segment starting position | Segment ending position |
|---|---|---|
| M62189_T2 (SEQ ID NO: 4191) | 586 | 666 |
| M62189_T4 (SEQ ID NO: 4192) | 586 | 666 |
| M62189_T12 (SEQ ID NO: 4193) | 586 | 666 |
| M62189_T15 (SEQ ID NO: 4194) | 586 | 666 |
| M62189_T22 (SEQ ID NO: 4196) | 586 | 666 |
| M62189_T27 (SEQ ID NO: 4200) | 586 | 666 |
| M62189_T28 (SEQ ID NO: 4201) | 379 | 459 |

This segment can be found in the following protein(s): M62189_P2, M62189_P4, M62189_P3, M62189_P16, M62189_P19 and M62189_P20.

Segment cluster M62189_node_9 (SEQ ID NO: 5644) according to the present invention can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T22 (SEQ ID NO:4196), M62189_T27 (SEQ ID NO:4200) and M62189_T28 (SEQ ID NO:4201). Table 5156 below describes the starting and ending position of this segment on each transcript.

TABLE 5156

Segment location on transcripts

| Transcript name | Segment starting position | Segment ending position |
|---|---|---|
| M62189_T2 (SEQ ID NO: 4191) | 667 | 675 |
| M62189_T4 (SEQ ID NO: 4192) | 667 | 675 |
| M62189_T12 (SEQ ID NO: 4193) | 667 | 675 |
| M62189_T15 (SEQ ID NO: 4194) | 667 | 675 |
| M62189_T22 (SEQ ID NO: 4196) | 667 | 675 |
| M62189_T27 (SEQ ID NO: 4200) | 667 | 675 |
| M62189_T28 (SEQ ID NO: 4201) | 460 | 468 |

This segment can be found in the following protein(s): M62189_P2, M62189_P4, M62189_P3, M62189_P16, M62189_P19 and M62189_P20.

Segment cluster M62189_node_12 (SEQ ID NO:5645) according to the present invention is supported by 138 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T27 (SEQ ID NO:4200) and M62189_T28 (SEQ ID NO:4201). Table 5157 below describes the starting and ending position of this segment on each transcript.

TABLE 5157

Segment location on transcripts

| Transcript name | Segment starting position | Segment ending position |
|---|---|---|
| M62189_T2 (SEQ ID NO: 4191) | 676 | 720 |
| M62189_T4 (SEQ ID NO: 4192) | 676 | 720 |
| M62189_T12 (SEQ ID NO: 4193) | 676 | 720 |
| M62189_T15 (SEQ ID NO: 4194) | 676 | 720 |
| M62189_T19 (SEQ ID NO: 4195) | 166 | 210 |
| M62189_T22 (SEQ ID NO: 4196) | 676 | 720 |
| M62189_T27 (SEQ ID NO: 4200) | 676 | 720 |
| M62189_T28 (SEQ ID NO: 4201) | 469 | 513 |

This segment can be found in both coding and non-coding regions of transcript(s) as follows. The segment can be found in a non-coding region of transcript(s) that are related to the following protein(s): M62189_P13. This segment can also be found in the following protein(s): M62189_P2, M62189_P4, M62189_P3, M62189_P16, M62189_P19 and M62189_P20, since it is in the coding region for the corresponding transcript.

Segment cluster M62189_node_13 (SEQ ID NO:5646) according to the present invention is supported by 135 libraries. The number of libraries was determined as previously described. This segment can be found in the following transcript(s): M62189_T2 (SEQ ID NO:4191), M62189_T4 (SEQ ID NO:4192), M62189_T2 (SEQ ID NO:4193), M62189_T15 (SEQ ID NO:4194), M62189_T19 (SEQ ID NO:4195), M62189_T22 (SEQ ID NO:4196), M62189_T27 (SEQ ID NO:4200) and M62189_T28 (SEQ ID NO:4201). Table 5158 below describes the starting and ending position of this segment on each transcript.

TABLE 5158

Segment location on transcripts

| Transcript name | Segment starting position | Segment ending position |
|---|---|---|
| M62189_T2 (SEQ ID NO: 4191) | 721 | 754 |
| M62189_T4 (SEQ ID NO: 4192) | 721 | 754 |
| M62189_T12 (SEQ ID NO: 4193) | 721 | 754 |
| M62189_T15 (SEQ ID NO: 4194) | 721 | 754 |
| M62189_T19 (SEQ ID NO: 4195) | 211 | 244 |
| M62189_T22 (SEQ ID NO: 4196) | 721 | 754 |
| M62189_T27 (SEQ ID NO: 4200) | 721 | 754 |
| M62189_T28 (SEQ ID NO: 4201) | 514 | 547 |

This segment can be found in both coding and non-coding regions of transcript(s) as follows. The segment can be found in a non-coding region of transcript(s) that are related to the following protein(s): M62189_P13. This segment can also be found in the following protein(s): M62189_P2, M62189_P4, M62189_P3, M62189_P16, M62189_P19 and M62189_P20, since it is in the coding region for the corresponding transcript.

Segment cluster M62189_node_15 (SEQ ID NO:5647) according to the present invention is supported by 136 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T27 (SEQ ID NO:4200) and M62189_T28 (SEQ ID NO:4201).

Table 5159 below describes the starting and ending position of this segment on each transcript.

TABLE 5159

Segment location on transcripts

| Transcript name | Segment starting position | Segment ending position |
|---|---|---|
| M62189_T2 (SEQ ID NO: 4191) | 755 | 825 |
| M62189_T4 (SEQ ID NO: 4192) | 755 | 825 |
| M62189_T12 (SEQ ID NO: 4193) | 755 | 825 |
| M62189_T15 (SEQ ID NO: 4194) | 755 | 825 |
| M62189_T19 (SEQ ID NO: 4195) | 245 | 315 |
| M62189_T22 (SEQ ID NO: 4196) | 755 | 825 |
| M62189_T27 (SEQ ID NO: 4200) | 755 | 825 |
| M62189_T28 (SEQ ID NO: 4201) | 548 | 618 |

This segment can be found in the following protein(s): M62189_P2, M62189_P4, M62189_P3, M62189_P13, M62189_P16, M62189_P19 and M62189_P20.

Segment cluster M62189_node_16 (SEQ ID NO:5648) according to the present invention is supported by 2 libraries. The number of libraries was determined as previously described. This segment can be found in the following transcript(s): M62189_T27 (SEQ ID NO:4200) and M62189_T28 (SEQ ID NO:4201). Table 5160 below describes the starting and ending position of this segment on each transcript.

TABLE 5160

Segment location on transcripts

| Transcript name | Segment starting position | Segment ending position |
|---|---|---|
| M62189_T27 (SEQ ID NO: 4200) | 826 | 917 |
| M62189_T28 (SEQ ID NO: 4201) | 619 | 710 |

This segment can be found in the following protein(s): M62189_P19 and M62189_P20.

Segment cluster M62189_node_18 (SEQ ID NO:5649) according to the present invention is supported by 127 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5161 below describes the starting and ending position of this segment on each transcript.

TABLE 5161

Segment location on transcripts

| Transcript name | Segment starting position | Segment ending position |
|---|---|---|
| M62189_T2 (SEQ ID NO: 4191) | 826 | 854 |
| M62189_T4 (SEQ ID NO: 4192) | 826 | 854 |
| M62189_T12 (SEQ ID NO: 4193) | 826 | 854 |
| M62189_T15 (SEQ ID NO: 4194) | 826 | 854 |
| M62189_T19 (SEQ ID NO: 4195) | 316 | 344 |
| M62189_T22 (SEQ ID NO: 4196) | 826 | 854 |

This segment can be found in the following protein(s): M62189_P2, M62189_P4, M62189_P3, M62189_P13 and M62189_P16.

Segment cluster M62189_node_19 (SEQ ID NO:5650) according to the present invention is supported by 128 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5162 below describes the starting and ending position of this segment on each transcript.

TABLE 5162

Segment location on transcripts

| Transcript name | Segment starting position | Segment ending position |
|---|---|---|
| M62189_T2 (SEQ ID NO: 4191) | 855 | 912 |
| M62189_T4 (SEQ ID NO: 4192) | 855 | 912 |
| M62189_T12 (SEQ ID NO: 4193) | 855 | 912 |
| M62189_T15 (SEQ ID NO: 4194) | 855 | 912 |
| M62189_T19 (SEQ ID NO: 4195) | 345 | 402 |
| M62189_T22 (SEQ ID NO: 4196) | 855 | 912 |

This segment can be found in the following protein(s): M62189_P2, M62189_P4, M62189_P3, M62189_P13 and M62189_P16.

Segment cluster M62189_node_22 (SEQ ID NO:5651) according to the present invention is supported by 127 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5163 below describes the starting and ending position of this segment on each transcript.

TABLE 5163

Segment location on transcripts

| Transcript name | Segment starting position | Segment ending position |
|---|---|---|
| M62189_T2 (SEQ ID NO: 4191) | 913 | 938 |
| M62189_T4 (SEQ ID NO: 4192) | 913 | 938 |
| M62189_T12 (SEQ ID NO: 4193) | 913 | 938 |
| M62189_T15 (SEQ ID NO: 4194) | 913 | 938 |
| M62189_T19 (SEQ ID NO: 4195) | 403 | 428 |
| M62189_T22 (SEQ ID NO: 4196) | 913 | 938 |

This segment can be found in the following protein(s): M62189_P2, M62189_P4, M62189_P3, M62189_P13 and M62189_P16.

Segment cluster M62189_node_24 (SEQ ID NO:5652) according to the present invention is supported by 4 libraries. The number of libraries was determined as previously described. This segment can be found in the following transcript(s): M62189_T12 (SEQ ID NO:4193). Table 5164 below describes the starting and ending position of this segment on each transcript.

TABLE 5164

Segment location on transcripts

| Transcript name | Segment starting position | Segment ending position |
|---|---|---|
| M62189_T12 (SEQ ID NO: 4193) | 1135 | 1244 |

This segment can be found in the following protein(s): M62189_P3.

Segment cluster M62189_node__26 (SEQ ID NO:5653) according to the present invention can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5165 below describes the starting and ending position of this segment on each transcript.

TABLE 5165

Segment location on transcripts

| Transcript name | Segment starting position | Segment ending position |
|---|---|---|
| M62189_T2 (SEQ ID NO: 4191) | 1331 | 1334 |
| M62189_T4 (SEQ ID NO: 4192) | 1331 | 1334 |
| M62189_T12 (SEQ ID NO: 4193) | 1441 | 1444 |
| M62189_T15 (SEQ ID NO: 4194) | 1331 | 1334 |
| M62189_T19 (SEQ ID NO: 4195) | 821 | 824 |
| M62189_T22 (SEQ ID NO: 4196) | 1331 | 1334 |

This segment can be found in both coding and non-coding regions of transcript(s) as follows. The segment can be found in a non-coding region of transcript(s) that are related to the following protein(s): M62189_P3. This segment can also be found in the following protein(s): M62189_P2, M62189_P4, M62189_P13 and M62189_P16, since it is in the coding region for the corresponding transcript.

Segment cluster M62189_node__28 (SEQ ID NO:5654) according to the present invention can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5166 below describes the starting and ending position of this segment on each transcript.

TABLE 5166

Segment location on transcripts

| Transcript name | Segment starting position | Segment ending position |
|---|---|---|
| M62189_T2 (SEQ ID NO: 4191) | 1335 | 1351 |
| M62189_T4 (SEQ ID NO: 4192) | 1717 | 1733 |
| M62189_T12 (SEQ ID NO: 4193) | 1827 | 1843 |
| M62189_T15 (SEQ ID NO: 4194) | 1717 | 1733 |
| M62189_T19 (SEQ ID NO: 4195) | 825 | 841 |
| M62189_T22 (SEQ ID NO: 4196) | 1335 | 1351 |

This segment can be found in both coding and non-coding regions of transcript(s) as follows. The segment can be found in a non-coding region of transcript(s) that are related to the following protein(s): M62189_P4 and M62189_P3. This segment can also be found in the following protein(s): M62189_P2, M62189_P13 and M62189_P16, since it is in the coding region for the corresponding transcript.

Segment cluster M62189_node__29 (SEQ ID NO:5655) according to the present invention can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5167 below describes the starting and ending position of this segment on each transcript.

TABLE 5167

Segment location on transcripts

| Transcript name | Segment starting position | Segment ending position |
|---|---|---|
| M62189_T2 (SEQ ID NO: 4191) | 1352 | 1360 |
| M62189_T4 (SEQ ID NO: 4192) | 1734 | 1742 |
| M62189_T12 (SEQ ID NO: 4193) | 1844 | 1852 |
| M62189_T15 (SEQ ID NO: 4194) | 1734 | 1742 |
| M62189_T19 (SEQ ID NO: 4195) | 842 | 850 |
| M62189_T22 (SEQ ID NO: 4196) | 1352 | 1360 |

This segment can be found in both coding and non-coding regions of transcript(s) as follows. The segment can be found in a non-coding region of transcript(s) that are related to the following protein(s): M62189_P4 and M62189_P3. This segment can also be found in the following protein(s): M62189_P2, M62189_P13 and M62189_P16, since it is in the coding region for the corresponding transcript.

Segment cluster M62189_node__30 (SEQ ID NO:5656) according to the present invention is supported by 140 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5168 below describes the starting and ending position of this segment on each transcript.

TABLE 5168

Segment location on transcripts

| Transcript name | Segment starting position | Segment ending position |
|---|---|---|
| M62189_T2 (SEQ ID NO: 4191) | 1361 | 1470 |
| M62189_T4 (SEQ ID NO: 4192) | 1743 | 1852 |
| M62189_T12 (SEQ ID NO: 4193) | 1853 | 1962 |
| M62189_T15 (SEQ ID NO: 4194) | 1743 | 1852 |
| M62189_T19 (SEQ ID NO: 4195) | 851 | 960 |
| M62189_T22 (SEQ ID NO: 4196) | 1361 | 1470 |

This segment can be found in both coding and non-coding regions of transcript(s) as follows. The segment can be found in a non-coding region of transcript(s) that are related to the following protein(s): M62189_P4 and M62189_P3. This segment can also be found in the following protein(s): M62189_P2, M62189_P13 and M62189_P16, since it is in the coding region for the corresponding transcript.

Segment cluster M62189_node__32 (SEQ ID NO:5657) according to the present invention is supported by 148 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195) and M62189_T22 (SEQ ID NO:4196). Table 5169 below describes the starting and ending position of this segment on each transcript.

TABLE 5169

Segment location on transcripts

| Transcript name | Segment starting position | Segment ending position |
|---|---|---|
| M62189_T2 (SEQ ID NO: 4191) | 1471 | 1584 |
| M62189_T4 (SEQ ID NO: 4192) | 1853 | 1966 |
| M62189_T12 (SEQ ID NO: 4193) | 1963 | 2076 |
| M62189_T15 (SEQ ID NO: 4194) | 1853 | 1966 |
| M62189_T19 (SEQ ID NO: 4195) | 961 | 1074 |
| M62189_T22 (SEQ ID NO: 4196) | 1471 | 1584 |

This segment can be found in both coding and non-coding regions of transcript(s) as follows. The segment can be found in a non-coding region of transcript(s) that are related to the following protein(s): M62189_P4 and M62189_P3. This segment can also be found in the following protein(s): M62189_P2, M62189_P13 and M62189_P16, since it is in the coding region for the corresponding transcript.

Segment cluster M62189_node_35 (SEQ ID NO:5658) according to the present invention is supported by 3 libraries. The number of libraries was determined as previously described. This segment can be found in the following transcript(s): M62189_T23 (SEQ ID NO:4197) and M62189_T25 (SEQ ID NO:4199). Table 5170 below describes the starting and ending position of this segment on each transcript.

TABLE 5170

Segment location on transcripts

| Transcript name | Segment starting position | Segment ending position |
|---|---|---|
| M62189_T23 (SEQ ID NO: 4197) | 455 | 505 |
| M62189_T25 (SEQ ID NO: 4199) | 455 | 505 |

This segment can be found in a non-coding region of transcript(s) that are related to the following protein(s): M62189_P17.

Segment cluster M62189_node_39 (SEQ ID NO:5659) according to the present invention can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T23 (SEQ ID NO:4197), M62189_T24 (SEQ ID NO:4198) and M62189_T25 (SEQ ID NO:4199). Table 5171 below describes the starting and ending position of this segment on each transcript.

TABLE 5171

Segment location on transcripts

| Transcript name | Segment starting position | Segment ending position |
|---|---|---|
| M62189_T2 (SEQ ID NO: 4191) | 2042 | 2062 |
| M62189_T4 (SEQ ID NO: 4192) | 2099 | 2119 |
| M62189_T12 (SEQ ID NO: 4193) | 2209 | 2229 |
| M62189_T15 (SEQ ID NO: 4194) | 2424 | 2444 |
| M62189_T19 (SEQ ID NO: 4195) | 1207 | 1227 |
| M62189_T22 (SEQ ID NO: 4196) | 1717 | 1737 |

TABLE 5171-continued

Segment location on transcripts

| Transcript name | Segment starting position | Segment ending position |
|---|---|---|
| M62189_T23 (SEQ ID NO: 4197) | 1509 | 1529 |
| M62189_T24 (SEQ ID NO: 4198) | 1458 | 1478 |
| M62189_T25 (SEQ ID NO: 4199) | 1834 | 1854 |

This segment can be found in both coding and non-coding regions of transcript(s) as follows. The segment can be found in a non-coding region of transcript(s) that are related to the following protein(s): M62189_P2, M62189_P4 and M62189_P3. This segment can also be found in the following protein(s): M62189_P13, M62189_P16 and M62189_P17, since it is in the coding region for the corresponding transcript.

Segment cluster M62189_node_40 (SEQ ID NO:5660) according to the present invention is supported by 161 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T23 (SEQ ID NO:4197), M62189_T24 (SEQ ID NO:4198) and M62189_T25 (SEQ ID NO:4199). Table 5172 below describes the starting and ending position of this segment on each transcript.

TABLE 5172

Segment location on transcripts

| Transcript name | Segment starting position | Segment ending position |
|---|---|---|
| M62189_T2 (SEQ ID NO: 4191) | 2063 | 2094 |
| M62189_T4 (SEQ ID NO: 4192) | 2120 | 2151 |
| M62189_T12 (SEQ ID NO: 4193) | 2230 | 2261 |
| M62189_T15 (SEQ ID NO: 4194) | 2445 | 2476 |
| M62189_T19 (SEQ ID NO: 4195) | 1228 | 1259 |
| M62189_T22 (SEQ ID NO: 4196) | 1738 | 1769 |
| M62189_T23 (SEQ ID NO: 4197) | 1530 | 1561 |
| M62189_T24 (SEQ ID NO: 4198) | 1479 | 1510 |
| M62189_T25 (SEQ ID NO: 4199) | 1855 | 1886 |

This segment can be found in both coding and non-coding regions of transcript(s) as follows. The segment can be found in a non-coding region of transcript(s) that are related to the following protein(s): M62189_P2, M62189_P4 and M62189_P3. This segment can also be found in the following protein(s): M62189_P13, M62189_P16 and M62189_P17, since it is in the coding region for the corresponding transcript.

Segment cluster M62189_node_41 (SEQ ID NO:5661) according to the present invention is supported by 166 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T23 (SEQ ID NO:4197), M62189_T24 (SEQ ID NO:4198) and M62189_T25 (SEQ ID NO:4199). Table 5173 below describes the starting and ending position of this segment on each transcript.

TABLE 5173

Segment location on transcripts

| Transcript name | Segment starting position | Segment ending position |
|---|---|---|
| M62189_T2 (SEQ ID NO: 4191) | 2095 | 2173 |
| M62189_T4 (SEQ ID NO: 4192) | 2152 | 2230 |
| M62189_T12 (SEQ ID NO: 4193) | 2262 | 2340 |
| M62189_T15 (SEQ ID NO: 4194) | 2477 | 2555 |
| M62189_T19 (SEQ ID NO: 4195) | 1260 | 1338 |
| M62189_T22 (SEQ ID NO: 4196) | 1770 | 1848 |
| M62189_T23 (SEQ ID NO: 4197) | 1562 | 1640 |
| M62189_T24 (SEQ ID NO: 4198) | 1511 | 1589 |
| M62189_T25 (SEQ ID NO: 4199) | 1887 | 1965 |

This segment can be found in both coding and non-coding regions of transcript(s) as follows. The segment can be found in a non-coding region of transcript(s) that are related to the following protein(s): M62189_P2, M62189_P4 and M62189_P3. This segment can also be found in the following protein(s): M62189_P13, M62189_P16 and M62189_P17, since it is in the coding region for the corresponding transcript.

Segment cluster M62189_node_45 (SEQ ID NO:5662) according to the present invention is supported by 170 libraries. The number of libraries was determined as previously described. This segment can be found in the following transcript(s): M62189_T2 (SEQ ID NO:4191), M62189_T4 (SEQ ID NO:4192), M62189_T12 (SEQ ID NO:4193), M62189_T15 (SEQ ID NO:4194), M62189_T19 (SEQ ID NO:4195), M62189_T22 (SEQ ID NO:4196), M62189_T23 (SEQ ID NO:4197), M62189_T24 (SEQ ID NO:4198) and M62189_T25 (SEQ ID NO:4199). Table 5174 below describes the starting and ending position of this segment on each transcript.

TABLE 5174

Segment location on transcripts

| Transcript name | Segment starting position | Segment ending position |
|---|---|---|
| M62189_T2 (SEQ ID NO: 4191) | 2174 | 2247 |
| M62189_T4 (SEQ ID NO: 4192) | 2231 | 2304 |
| M62189_T12 (SEQ ID NO: 4193) | 2341 | 2414 |
| M62189_T15 (SEQ ID NO: 4194) | 2556 | 2629 |
| M62189_T19 (SEQ ID NO: 4195) | 1339 | 1412 |
| M62189_T22 (SEQ ID NO: 4196) | 1849 | 1922 |
| M62189_T23 (SEQ ID NO: 4197) | 1641 | 1714 |
| M62189_T24 (SEQ ID NO: 4198) | 1590 | 1663 |
| M62189_T25 (SEQ ID NO: 4199) | 1966 | 2039 |

This segment can be found in both coding and non-coding regions of transcript(s) as follows. The segment can be found in a non-coding region of transcript(s) that are related to the following protein(s): M62189_P2, M62189_P4 and M62189_P3. This segment can also be found in the following protein(s): M62189_P13, M62189_P16 and M62189_P17, since it is in the coding region for the corresponding transcript.

Description for Cluster M62246

Cluster M62246 features 5 transcript(s) and 12 segment(s) of interest, the names for which are given in Tables 5175 and 5176, respectively, the sequences themselves are given at the end of the application. The selected protein variants are given in Table 5177.

TABLE 5175

Transcripts of interest
Transcript Name

M62246_T6 (SEQ ID NO: 4202)
M62246_T7 (SEQ ID NO: 4203)
M62246_T8 (SEQ ID NO: 4204)
M62246_T9 (SEQ ID NO: 4205)
M62246_T12 (SEQ ID NO: 4206)

TABLE 5176

Segments of interest
Segment Name

M62246_node_4 (SEQ ID NO: 5663)
M62246_node_5 (SEQ ID NO: 5664)
M62246_node_9 (SEQ ID NO: 5665)
M62246_node_11 (SEQ ID NO: 5666)
M62246_node_13 (SEQ ID NO: 5667)
M62246_node_17 (SEQ ID NO: 5668)
M62246_node_18 (SEQ ID NO: 5669)
M62246_node_24 (SEQ ID NO: 5670)
M62246_node_26 (SEQ ID NO: 5671)
M62246_node_7 (SEQ ID NO: 5672)
M62246_node_15 (SEQ ID NO: 5673)
M62246_node_22 (SEQ ID NO: 5674)

TABLE 5177

Proteins of interest

| Protein Name | Corresponding Transcript(s) |
|---|---|
| M62246_P3 | M62246_T6 (SEQ ID NO: 4202); M62246_T7 (SEQ ID NO: 4203); M62246_T8 (SEQ ID NO: 4204) |
| M62246_P4 | M62246_T9 (SEQ ID NO: 4205) |
| M62246_P6 | M62246_T12 (SEQ ID NO: 4206) |

Cluster M62246 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 126 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 126 and Table 5178. This cluster is overexpressed (at least at a minimum level) in the following pathological conditions: epithelial malignant tumors.

TABLE 5178

Normal tissue distribution

| Name of Tissue | Number |
|---|---|
| adrenal | 0 |
| bladder | 0 |
| Bone | 32 |
| Brain | 42 |
| Colon | 0 |
| epithelial | 6 |
| general | 18 |
| Kidney | 42 |
| Lung | 0 |

TABLE 5178-continued

Normal tissue distribution

| Name of Tissue | Number |
|---|---|
| Lymph nodes | 18 |
| Breast | 0 |
| bone marrow | 0 |
| Ovary | 0 |
| pancreas | 0 |
| prostate | 28 |
| Skin | 2 |
| stomach | 0 |
| Uterus | 4 |

TABLE 5179

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 5.3e−01 | 1.9 |
| bladder | 5.4e−01 | 3.4e−01 | 3.2e−01 | 2.5 | 3.2e−01 | 2.4 |
| Bone | 9.2e−01 | 8.7e−01 | 1 | 0.5 | 9.1e−01 | 0.7 |
| Brain | 5.7e−01 | 7.3e−01 | 9.8e−01 | 0.4 | 1 | 0.3 |
| Colon | 6.3e−02 | 4.1e−02 | 3.4e−01 | 2.6 | 2.7e−01 | 2.7 |
| epithelial | 4.8e−03 | 3.1e−03 | 3.8e−04 | 3.8 | 1.2e−03 | 3.1 |
| general | 3.9e−02 | 2.8e−02 | 9.5e−02 | 1.3 | 2.4e−01 | 1.1 |
| Kidney | 8.9e−01 | 8.9e−01 | 6.2e−01 | 0.8 | 5.3e−01 | 0.9 |
| Lung | 1.1e−01 | 2.5e−01 | 1.2e−02 | 5.6 | 9.0e−02 | 3.0 |
| Lymph nodes | 8.5e−01 | 8.7e−01 | 1 | 0.5 | 8.2e−01 | 0.9 |
| Breast | 3.4e−01 | 2.8e−01 | 4.7e−01 | 1.9 | 5.6e−01 | 1.6 |
| bone marrow | 1 | 6.7e−01 | 1 | 1.0 | 5.3e−01 | 1.9 |
| Ovary | 6.2e−01 | 4.2e−01 | 1 | 1.1 | 7.7e−01 | 1.4 |
| pancreas | 3.8e−01 | 4.7e−01 | 4.2e−01 | 2.4 | 5.3e−01 | 1.9 |
| prostate | 9.0e−01 | 9.0e−01 | 8.9e−01 | 0.6 | 8.4e−01 | 0.7 |
| Skin | 9.2e−01 | 4.0e−01 | 1 | 0.8 | 4.1e−01 | 1.8 |
| stomach | 3.0e−01 | 4.3e−01 | 5.0e−01 | 2.0 | 6.4e−01 | 1.5 |
| Uterus | 4.9e−01 | 7.1e−01 | 6.6e−01 | 1.3 | 8.0e−01 | 1.1 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 5180.

TABLE 5180

Oligonucleotides related to this cluster

| Oligonucleotide name | Overexpressed in cancers | Chip reference |
|---|---|---|
| M62246_0_0_21175 | lung malignant tumors | LUN |

As noted above, cluster M62246 features 12 segment(s), which were listed in Table 5176 above and for which the sequence(s) are given at the end of the application. These segment(s) are portions of nucleic acid sequence(s) which are described herein separately because they are of particular interest. A description of each segment according to the present invention is now provided.

Segment cluster M62246_node_4 (SEQ ID NO:5663) according to the present invention is supported by 32 libraries. The number of libraries was determined as previously described. This segment can be found in the following transcript(s): M62246_T6 (SEQ ID NO:4202), M62246_T7 (SEQ ID NO:4203), M62246_T8 (SEQ ID NO:4204), M62246_T9 (SEQ ID NO:4205) and M62246_T12 (SEQ ID NO:4206). Table 5181 below describes the starting and ending position of this segment on each transcript.

TABLE 5181

Segment location on transcripts

| Transcript name | Segment starting position | Segment ending position |
|---|---|---|
| M62246_T6 (SEQ ID NO: 4202) | 1 | 291 |
| M62246_T7 (SEQ ID NO: 4203) | 1 | 291 |
| M62246_T8 (SEQ ID NO: 4204) | 1 | 291 |
| M62246_T9 (SEQ ID NO: 4205) | 1 | 291 |
| M62246_T12 (SEQ ID NO: 4206) | 1 | 291 |

This segment can be found in a non-coding region of transcript(s) that are related to the following protein(s): M62246_P3, M62246_P4 and M62246_P6.

Segment cluster M62246_node_5 (SEQ ID NO:5664) according to the present invention is supported by 6 libraries. The number of libraries was determined as previously described. This segment can be found in the following transcript(s): M62246_T8 (SEQ ID NO:4204). Table 5182 below describes the starting and ending position of this segment on each transcript.

TABLE 5182

Segment location on transcripts

| Transcript name | Segment starting position | Segment ending position |
|---|---|---|
| M62246_T8 (SEQ ID NO: 4204) | 292 | 771 |

This segment can be found in a non-coding region of transcript(s) that are related to the following protein(s): M62246_P3.

Segment cluster M62246_node_9 (SEQ ID NO:5665) according to the present invention is supported by 1 libraries. The number of libraries was determined as previously described. This segment can be found in the following transcript(s): M62246_T8 (SEQ ID NO:4204). Table 5183 below describes the starting and ending position of this segment on each transcript.

TABLE 5183

Segment location on transcripts

| Transcript name | Segment starting position | Segment ending position |
|---|---|---|
| M62246_T8 (SEQ ID NO: 4204) | 836 | 981 |

This segment can be found in a non-coding region of transcript(s) that are related to the following protein(s): M62246_P3.

Segment cluster M62246_node_11 (SEQ ID NO:5666) according to the present invention is supported by 5 libraries. The number of libraries was determined as previously described. This segment can be found in the following transcript(s): M62246_T6 (SEQ ID NO:4202). Table 5184 below describes the starting and ending position of this segment on each transcript.

TABLE 5184

Segment location on transcripts

| Transcript name | Segment starting position | Segment ending position |
|---|---|---|
| M62246_T6 (SEQ ID NO: 4202) | 356 | 535 |

This segment can be found in a non-coding region of transcript(s) that are related to the following protein(s): M62246_P3.

Segment cluster M62246_node_13 (SEQ ID NO:5667) according to the present invention is supported by 48 libraries. The number of libraries was determined as previously described. This segment can be found in the following transcript(s): M62246_T6 (SEQ ID NO:4202), M62246_T7 (SEQ ID NO:4203), M62246_T8 (SEQ ID NO:4204), M62246_T9 (SEQ ID NO:4205) and M62246_T12 (SEQ ID NO:4206). Table 5185 below describes the starting and ending position of this segment on each transcript.

TABLE 5185

Segment location on transcripts

| Transcript name | Segment starting position | Segment ending position |
|---|---|---|
| M62246_T6 (SEQ ID NO: 4202) | 536 | 677 |
| M62246_T7 (SEQ ID NO: 4203) | 356 | 497 |
| M62246_T8 (SEQ ID NO: 4204) | 982 | 1123 |
| M62246_T9 (SEQ ID NO: 4205) | 356 | 497 |
| M62246_T12 (SEQ ID NO: 4206) | 356 | 497 |

This segment can be found in both coding and non-coding regions of transcript(s) as follows. The segment can be found in a non-coding region of transcript(s) that are related to the following protein(s): M62246_P3. This segment can also be found in the following protein(s): M62246_P4 and M62246_P6, since it is in the coding region for the corresponding transcript.

Segment cluster M62246_node_17 (SEQ ID NO:5668) according to the present invention is supported by 57 libraries. The number of libraries was determined as previously described. This segment can be found in the following transcript(s): M62246_T6 (SEQ ID NO:4202), M62246_T7 (SEQ ID NO:4203), M62246_T8 (SEQ ID NO:4204), M62246_T9 (SEQ ID NO:4205) and M62246_T12 (SEQ ID NO:4206). Table 5186 below describes the starting and ending position of this segment on each transcript.

TABLE 5186

Segment location on transcripts

| Transcript name | Segment starting position | Segment ending position |
|---|---|---|
| M62246_T6 (SEQ ID NO: 4202) | 678 | 891 |
| M62246_T7 (SEQ ID NO: 4203) | 615 | 828 |
| M62246_T8 (SEQ ID NO: 4204) | 1124 | 1337 |
| M62246_T9 (SEQ ID NO: 4205) | 615 | 828 |
| M62246_T12 (SEQ ID NO: 4206) | 498 | 711 |

This segment can be found in both coding and non-coding regions of transcript(s) as follows. The segment can be found in a non-coding region of transcript(s) that are related to the following protein(s): M62246_P4. This segment can also be found in the following protein(s): M62246_P3 and M62246_P6, since it is in the coding region for the corresponding transcript.

Segment cluster M62246_node_18 (SEQ ID NO:5669) according to the present invention is supported by 16 libraries. The number of libraries was determined as previously described. This segment can be found in the following transcript(s): M62246_T9 (SEQ ID NO:4205). Table 5187 below describes the starting and ending position of this segment on each transcript.

TABLE 5187

Segment location on transcripts

| Transcript name | Segment starting position | Segment ending position |
|---|---|---|
| M62246_T9 (SEQ ID NO: 4205) | 829 | 1047 |

This segment can be found in a non-coding region of transcript(s) that are related to the following protein(s): M62246_P4.

Segment cluster M62246_node_24 (SEQ ID NO:5670) according to the present invention is supported by 102 libraries. The number of libraries was determined as previously described. This segment can be found in the following transcript(s): M62246_T6 (SEQ ID NO:4202), M62246_T7 (SEQ ID NO:4203) and M62246_T8 (SEQ ID NO:4204). Table 5188 below describes the starting and ending position of this segment on each transcript.

TABLE 5188

Segment location on transcripts

| Transcript name | Segment starting position | Segment ending position |
|---|---|---|
| M62246_T6 (SEQ ID NO: 4202) | 993 | 3236 |
| M62246_T7 (SEQ ID NO: 4203) | 930 | 3173 |
| M62246_T8 (SEQ ID NO: 4204) | 1439 | 3682 |

This segment can be found in the following protein(s): M62246_P3.

Segment cluster M62246_node_26 (SEQ ID NO:5671) according to the present invention is supported by 2 libraries. The number of libraries was determined as previously described. This segment can be found in the following transcript(s): M62246_T12 (SEQ ID NO:4206). Table 5189 below describes the starting and ending position of this segment on each transcript.

TABLE 5189

Segment location on transcripts

| Transcript name | Segment starting position | Segment ending position |
|---|---|---|
| M62246_T12 (SEQ ID NO: 4206) | 813 | 1341 |

This segment can be found in the following protein(s): M62246_P6.

According to an optional embodiment of the present invention, short segments related to the above cluster are also provided. These segments are up to about 120 bp in length, and so are included in a separate description.

Segment cluster M62246_node_7 (SEQ ID NO:5672) according to the present invention is supported by 39 libraries. The number of libraries was determined as previously described. This segment can be found in the following transcript(s): M62246_T6 (SEQ ID NO:4202), M62246_T7 (SEQ ID NO:4203), M62246_T8 (SEQ ID NO:4204), M62246_T9 (SEQ ID NO:4205) and M62246_T12 (SEQ ID NO:4206). Table 5190 below describes the starting and ending position of this segment on each transcript.

TABLE 5190

Segment location on transcripts

| Transcript name | Segment starting position | Segment ending position |
|---|---|---|
| M62246_T6 (SEQ ID NO: 4202) | 292 | 355 |
| M62246_T7 (SEQ ID NO: 4203) | 292 | 355 |
| M62246_T8 (SEQ ID NO: 4204) | 772 | 835 |
| M62246_T9 (SEQ ID NO: 4205) | 292 | 355 |
| M62246_T12 (SEQ ID NO: 4206) | 292 | 355 |

This segment can be found in both coding and non-coding regions of transcript(s) as follows. The segment can be found in a non-coding region of transcript(s) that are related to the following protein(s): M62246_P3. This segment can also be found in the following protein(s): M62246_P4 and M62246_P6, since it is in the coding region for the corresponding transcript.

Segment cluster M62246_node_15 (SEQ ID NO:5673) according to the present invention is supported by 6 libraries. The number of libraries was determined as previously described. This segment can be found in the following transcript(s): M62246_T7 (SEQ ID NO:4203) and M62246_T9 (SEQ ID NO:4205). Table 5191 below describes the starting and ending position of this segment on each transcript.

TABLE 5191

Segment location on transcripts

| Transcript name | Segment starting position | Segment ending position |
|---|---|---|
| M62246_T7 (SEQ ID NO: 4203) | 498 | 614 |
| M62246_T9 (SEQ ID NO: 4205) | 498 | 614 |

This segment can be found in both coding and non-coding regions of transcript(s) as follows. The segment can be found in a non-coding region of transcript(s) that are related to the following protein(s): M62246_P3. This segment can also be found in the following protein(s): M62246_P4, since it is in the coding region for the corresponding transcript.

Segment cluster M62246_node_22 (SEQ ID NO:5674) according to the present invention is supported by 29 libraries. The number of libraries was determined as previously described. This segment can be found in the following transcript(s): M62246_T6 (SEQ ID NO:4202), M62246_T7 (SEQ ID NO:4203), M62246_T8 (SEQ ID NO:4204) and M62246_T12 (SEQ ID NO:4206). Table 5192 below describes the starting and ending position of this segment on each transcript.

TABLE 5192

Segment location on transcripts

| Transcript name | Segment starting position | Segment ending position |
|---|---|---|
| M62246_T6 (SEQ ID NO: 4202) | 892 | 992 |
| M62246_T7 (SEQ ID NO: 4203) | 829 | 929 |

TABLE 5192-continued

Segment location on transcripts

| Transcript name | Segment starting position | Segment ending position |
|---|---|---|
| M62246_T8 (SEQ ID NO: 4204) | 1338 | 1438 |
| M62246_T12 (SEQ ID NO: 4206) | 712 | 812 |

This segment can be found in the following protein(s): M62246_P3 and M62246_P6.

Description for Cluster M78001

Cluster M78001 features 5 transcript(s) and 35 segment(s) of interest, the names for which are given in Tables 5193 and 5194, respectively, the sequences themselves are given at the end of the application. The selected protein variants are given in Table 5195.

TABLE 5193

Transcripts of interest
Transcript Name

M78001_T13 (SEQ ID NO: 4207)
M78001_T17 (SEQ ID NO: 4208)
M78001_T18 (SEQ ID NO: 4209)
M78001_T21 (SEQ ID NO: 4210)
M78001_T59 (SEQ ID NO: 4211)

TABLE 5194

Segments of interest
Segment Name

M78001_node_0 (SEQ ID NO: 5675)
M78001_node_8 (SEQ ID NO: 5676)
M78001_node_34 (SEQ ID NO: 5677)
M78001_node_50 (SEQ ID NO: 5678)
M78001_node_66 (SEQ ID NO: 5679)
M78001_node_92 (SEQ ID NO: 5680)
M78001_node_95 (SEQ ID NO: 5681)
M78001_node_103 (SEQ ID NO: 5682)
M78001_node_104 (SEQ ID NO: 5683)
M78001_node_1 (SEQ ID NO: 5684)
M78001_node_2 (SEQ ID NO: 5685)
M78001_node_4 (SEQ ID NO: 5686)
M78001_node_6 (SEQ ID NO: 5687)
M78001_node_12 (SEQ ID NO: 5688)
M78001_node_15 (SEQ ID NO: 5689)
M78001_node_19 (SEQ ID NO: 5690)
M78001_node_21 (SEQ ID NO: 5691)
M78001_node_23 (SEQ ID NO: 5692)
M78001_node_58 (SEQ ID NO: 5693)
M78001_node_63 (SEQ ID NO: 5694)
M78001_node_67 (SEQ ID NO: 5695)
M78001_node_71 (SEQ ID NO: 5696)
M78001_node_74 (SEQ ID NO: 5697)
M78001_node_77 (SEQ ID NO: 5698)
M78001_node_78 (SEQ ID NO: 5699)
M78001_node_83 (SEQ ID NO: 5700)
M78001_node_84 (SEQ ID NO: 5701)
M78001_node_88 (SEQ ID NO: 5702)
M78001_node_89 (SEQ ID NO: 5703)
M78001_node_91 (SEQ ID NO: 5704)
M78001_node_96 (SEQ ID NO: 5705)
M78001_node_97 (SEQ ID NO: 5706)
M78001_node_100 (SEQ ID NO: 5707)
M78001_node_101 (SEQ ID NO: 5708)
M78001_node_102 (SEQ ID NO: 5709)

TABLE 5195

Proteins of interest

| Protein Name | Corresponding Transcript(s) |
|---|---|
| M78001_P6 | M78001_T13 (SEQ ID NO: 4207) |
| M78001_P7 | M78001_T17 (SEQ ID NO: 4208) |
| M78001_P8 | M78001_T18 (SEQ ID NO: 4209) |
| M78001_P10 | M78001_T21 (SEQ ID NO: 4210) |
| M78001_P21 | M78001_T59 (SEQ ID NO: 4211) |

These sequences are variants of the known protein T-cell surface glycoprotein E2 precursor (SwissProt accession identifier MIC2_HUMAN; known also according to the synonyms E2 antigen; CD99 antigen; MIC2 protein; 12E7), referred to herein as the previously known protein.

Protein T-cell surface glycoprotein E2 precursor is known or believed to have the following function(s): Involved in T-cell adhesion processes. It is involved in spontaneous rosette formation with erythrocytes. The sequence for protein T-cell surface glycoprotein E2 precursor is given at the end of the application, as "T-cell surface glycoprotein E2 precursor amino acid sequence". Known polymorphisms for this sequence are as shown in Table 5196.

TABLE 5196

Amino acid mutations for Known Protein

| SNP position(s) on amino acid sequence | Comment |
|---|---|
| 166 | M -> V (in dbSNP:4793). /FTId = VAR_014733. |
| 173 | N -> I (in dbSNP:4717). /FTId = VAR_014734. |

Protein T-cell surface glycoprotein E2 precursor localization is believed to be Type I membrane protein (Potential).

The following GO Annotation(s) apply to the previously known protein. The following annotation(s) were found: cytoplasm; integral plasma membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster M78001 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 127 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 127 and Table 5197. This cluster is overexpressed (at least at a minimum level) in the following pathological conditions: brain malignant tumors.

TABLE 5197

Normal tissue distribution

| Name of Tissue | Number |
|---|---|
| adrenal | 44 |
| bladder | 451 |

TABLE 5197-continued

Normal tissue distribution

| Name of Tissue | Number |
|---|---|
| Bone | 375 |
| Brain | 83 |
| Colon | 201 |
| epithelial | 230 |
| general | 235 |
| head and neck | 233 |
| kidney | 141 |
| Liver | 102 |
| Lung | 167 |
| Lymph nodes | 237 |
| Breast | 26 |
| bone marrow | 282 |
| muscle | 112 |
| Ovary | 291 |
| pancreas | 479 |
| prostate | 231 |
| Skin | 373 |
| stomach | 348 |
| T cells | 55 |
| Thyroid | 0 |
| Uterus | 218 |

TABLE 5198

P values and ratios for expression in cancerous tissue

| Name of Tissue | P1 | P2 | SP1 | R3 | SP2 | R4 |
|---|---|---|---|---|---|---|
| adrenal | 2.9e−01 | 2.0e−01 | 2.5e−01 | 2.2 | 5.3e−02 | 2.6 |
| bladder | 6.7e−01 | 7.1e−01 | 4.6e−01 | 0.6 | 8.1e−01 | 0.5 |
| Bone | 2.5e−01 | 5.0e−01 | 1.7e−01 | 1.3 | 4.9e−01 | 1.0 |
| Brain | 5.3e−01 | 4.8e−01 | 3.4e−14 | 4.2 | 4.9e−10 | 3.0 |
| Colon | 1.3e−01 | 7.1e−02 | 9.0e−01 | 0.6 | 9.0e−01 | 0.6 |
| epithelial | 5.6e−01 | 5.9e−01 | 9.8e−01 | 0.7 | 1 | 0.7 |
| general | 7.6e−01 | 8.1e−01 | 7.1e−01 | 0.9 | 1 | 0.7 |
| head and neck | 6.0e−01 | 6.3e−01 | 1 | 0.4 | 8.3e−01 | 0.5 |
| kidney | 7.8e−01 | 7.9e−01 | 8.1e−01 | 0.7 | 7.2e−01 | 0.8 |
| Liver | 8.2e−01 | 4.0e−01 | 1 | 0.3 | 5.3e−01 | 1.3 |
| Lung | 3.3e−01 | 2.7e−01 | 4.9e−01 | 1.0 | 3.3e−01 | 1.1 |
| Lymph nodes | 5.4e−01 | 7.3e−01 | 9.9e−01 | 0.3 | 1 | 0.3 |
| Breast | 1.4e−01 | 2.1e−01 | 2.4e−02 | 3.3 | 7.8e−02 | 2.3 |
| bone marrow | 5.4e−01 | 7.4e−01 | 8.0e−01 | 0.8 | 9.9e−01 | 0.4 |
| muscle | 5.9e−01 | 6.4e−01 | 6.7e−01 | 1.5 | 9.7e−01 | 0.5 |
| Ovary | 8.2e−01 | 8.2e−01 | 1 | 0.3 | 1 | 0.3 |
| pancreas | 4.3e−01 | 5.0e−01 | 1 | 0.3 | 1 | 0.3 |
| prostate | 3.4e−01 | 5.6e−01 | 6.5e−02 | 1.5 | 1.8e−01 | 1.3 |
| Skin | 3.4e−01 | 5.5e−01 | 6.6e−01 | 0.5 | 9.9e−01 | 0.3 |
| stomach | 5.8e−01 | 7.3e−01 | 9.8e−01 | 0.3 | 1 | 0.3 |
| T cells | 6.7e−01 | 6.7e−01 | 1 | 0.8 | 7.2e−01 | 1.5 |
| Thyroid | 3.6e−01 | 3.6e−01 | 1 | 1.0 | 1 | 1.0 |
| Uterus | 7.1e−01 | 6.9e−01 | 1 | 0.3 | 9.7e−01 | 0.4 |

As noted above, cluster M78001 features 35 segment(s), which were listed in Table 5194 above and for which the sequence(s) are given at the end of the application. These segment(s) are portions of nucleic acid sequence(s) which are described herein separately because they are of particular interest. A description of each segment according to the present invention is now provided.

Segment cluster M78001_node_0 (SEQ ID NO:5675) according to the present invention is supported by 2 libraries. The number of libraries was determined as previously described. This segment can be found in the following transcript(s): M78001_T59 (SEQ ID NO:4211). Table 5199 below describes the starting and ending position of this segment on each transcript.

TABLE 5199

Segment location on transcripts

| Transcript name | Segment starting position | Segment ending position |
|---|---|---|
| M78001_T59 (SEQ ID NO: 4211) | 1 | 139 |

This segment can be found in the following protein(s): M78001_P21.

Segment cluster M78001_node_8 (SEQ ID NO:5676) according to the present invention is supported by 12 libraries. The number of libraries was determined as previously described. This segment can be found in the following transcript(s): M78001_T59 (SEQ ID NO:4211). Table 5200 below describes the starting and ending position of this segment on each transcript.

TABLE 5200

Segment location on transcripts

| Transcript name | Segment starting position | Segment ending position |
|---|---|---|
| M78001_T59 (SEQ ID NO: 4211) | 330 | 483 |

This segment can be found in a non-coding region of transcript(s) that are related to the following protein(s): M78001_P21.

Segment cluster M78001_node_34 (SEQ ID NO:5677) according to the present invention is supported by 10 libraries. The number of libraries was determined as previously described. This segment can be found in the following transcript(s): M78001_T59 (SEQ ID NO:4211). Table 5201 below describes the starting and ending position of this segment on each transcript.

TABLE 5201

Segment location on transcripts

| Transcript name | Segment starting position | Segment ending position |
|---|---|---|
| M78001_T59 (SEQ ID NO: 4211) | 758 | 1160 |

This segment can be found in a non-coding region of transcript(s) that are related to the following protein(s): M78001_P21.

Segment cluster M78001_node_50 (SEQ ID NO:5678) according to the present invention is supported by 336 libraries. The number of libraries was determined as previously described. This segment can be found in the following transcript(s): M78001_T17 (SEQ ID NO:4208), M78001_T18 (SEQ ID NO:4209) and M78001_T21 (SEQ ID NO:4210). Table 5202 below describes the starting and ending position of this segment on each transcript.

TABLE 5202

Segment location on transcripts

| Transcript name | Segment starting position | Segment ending position |
|---|---|---|
| M78001_T17 (SEQ ID NO: 4208) | 1 | 261 |
| M78001_T18 (SEQ ID NO: 4209) | 1 | 261 |
| M78001_T21 (SEQ ID NO: 4210) | 1 | 261 |

This segment can be found in the following protein(s): M78001_P7, M78001_P8 and M78001_P10.

Segment cluster M78001_node_66 (SEQ ID NO:5679) according to the present invention is supported by 6 libraries. The number of libraries was determined as previously described. This segment can be found in the following transcript(s): M78001_T13 (SEQ ID NO:4207). Table 5203 below describes the starting and ending position of this segment on each transcript.

TABLE 5203

Segment location on transcripts

| Transcript name | Segment starting position | Segment ending position |
|---|---|---|
| M78001_T13 (SEQ ID NO: 4207) | 1 | 599 |

This segment can be found in the following protein(s): M78001_P6.

Segment cluster M78001_node_92 (SEQ ID NO:5680) according to the present invention is supported by 14 libraries. The number of libraries was determined as previously described. This segment can be found in the following transcript(s): M78001_T17 (SEQ ID NO:4208) and M78001_T21 (SEQ ID NO:4210). Table 5204 below describes the starting and ending position of this segment on each transcript.

TABLE 5204

Segment location on transcripts

| Transcript name | Segment starting position | Segment ending position |
|---|---|---|
| M78001_T17 (SEQ ID NO: 4208) | 688 | 1311 |
| M78001_T21 (SEQ ID NO: 4210) | 743 | 1366 |

This segment can be found in a non-coding region of transcript(s) that are related to the following protein(s): M78001_P7 and M78001_P10.

Segment cluster M78001_node_95 (SEQ ID NO:5681) according to the present invention is supported by 9 libraries. The number of libraries was determined as previously described. This segment can be found in the following transcript(s): M78001_T18 (SEQ ID NO:4209). Table 5205 below describes the starting and ending position of this segment on each transcript.

TABLE 5205

Segment location on transcripts

| Transcript name | Segment starting position | Segment ending position |
|---|---|---|
| M78001_T18 (SEQ ID NO: 4209) | 670 | 988 |

This segment can be found in the following protein(s): M78001_P8.

Segment cluster M78001_node__103 (SEQ ID NO:5682) according to the present invention is supported by 435 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5206 below describes the starting and ending position of this segment on each transcript.

TABLE 5206

Segment location on transcripts

| Transcript name | Segment starting position | Segment ending position |
| --- | --- | --- |
| M78001_T13 (SEQ ID NO: 4207) | 1114 | 1336 |
| M78001_T17 (SEQ ID NO: 4208) | 1499 | 1721 |
| M78001_T18 (SEQ ID NO: 4209) | 1176 | 1398 |
| M78001_T21 (SEQ ID NO: 4210) | 1554 | 1776 |

This segment can be found in a non-coding region of transcript(s) that are related to the following protein(s): M78001_P6, M78001_P7, M78001_P8 and M78001_P10.

Segment cluster M78001_node__104 (SEQ ID NO:5683) according to the present invention is supported by 308 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5207 below describes the starting and ending position of this segment on each transcript.

TABLE 5207

Segment location on transcripts

| Transcript name | Segment starting position | Segment ending position |
| --- | --- | --- |
| M78001_T13 (SEQ ID NO: 4207) | 1337 | 1513 |
| M78001_T17 (SEQ ID NO: 4208) | 1722 | 1898 |
| M78001_T18 (SEQ ID NO: 4209) | 1399 | 1575 |
| M78001_T21 (SEQ ID NO: 4210) | 1777 | 1953 |

This segment can be found in a non-coding region of transcript(s) that are related to the following protein(s): M78001_P6, M78001_P7, M78001_P8 and M78001_P10.

According to an optional embodiment of the present invention, short segments related to the above cluster are also provided. These segments are up to about 120 bp in length, and so are included in a separate description.

Segment cluster M78001_node__1 (SEQ ID NO:5684) according to the present invention can be found in the following transcript(s): M78001_T59 (SEQ ID NO:4211). Table 5208 below describes the starting and ending position of this segment on each transcript.

TABLE 5208

Segment location on transcripts

| Transcript name | Segment starting position | Segment ending position |
| --- | --- | --- |
| M78001_T59 (SEQ ID NO: 4211) | 140 | 150 |

This segment can be found in the following protein(s): M78001_P21.

Segment cluster M78001_node__2 (SEQ ID NO:5685) according to the present invention is supported by 9 libraries. The number of libraries was determined as previously described. This segment can be found in the following transcript(s): M78001_T59 (SEQ ID NO:4211). Table 5209 below describes the starting and ending position of this segment on each transcript.

TABLE 5209

Segment location on transcripts

| Transcript name | Segment starting position | Segment ending position |
| --- | --- | --- |
| M78001_T59 (SEQ ID NO: 4211) | 151 | 217 |

This segment can be found in the following protein(s): M78001_P21.

Segment cluster M78001_node__4 (SEQ ID NO:5686) according to the present invention is supported by 11 libraries. The number of libraries was determined as previously described. This segment can be found in the following transcript(s): M78001_T59 (SEQ ID NO:4211). Table 5210 below describes the starting and ending position of this segment on each transcript.

TABLE 5210

Segment location on transcripts

| Transcript name | Segment starting position | Segment ending position |
| --- | --- | --- |
| M78001_T59 (SEQ ID NO: 4211) | 218 | 260 |

This segment can be found in the following protein(s): M78001_P21.

Segment cluster M78001_node__6 (SEQ ID NO:5687) according to the present invention is supported by 11 libraries. The number of libraries was determined as previously described. This segment can be found in the following transcript(s): M78001_T59 (SEQ ID NO:4211). Table 5211 below describes the starting and ending position of this segment on each transcript.

TABLE 5211

Segment location on transcripts

| Transcript name | Segment starting position | Segment ending position |
| --- | --- | --- |
| M78001_T59 (SEQ ID NO: 4211) | 261 | 329 |

This segment can be found in a non-coding region of transcript(s) that are related to the following protein(s): M78001_P21.

Segment cluster M78001_node__12 (SEQ ID NO:5688) according to the present invention is supported by 15 libraries. The number of libraries was determined as previously described. This segment can be found in the following transcript(s): M78001_T59 (SEQ ID NO:4211). Table 5212 below describes the starting and ending position of this segment on each transcript.

TABLE 5212

Segment location on transcripts

| Transcript name | Segment starting position | Segment ending position |
|---|---|---|
| M78001_T59 (SEQ ID NO: 4211) | 484 | 528 |

This segment can be found in a non-coding region of transcript(s) that are related to the following protein(s): M78001_P21.

Segment cluster M78001_node__15 (SEQ ID NO:5689) according to the present invention is supported by 22 libraries. The number of libraries was determined as previously described. This segment can be found in the following transcript(s): M78001_T59 (SEQ ID NO:4211). Table 5213 below describes the starting and ending position of this segment on each transcript.

TABLE 5213

Segment location on transcripts

| Transcript name | Segment starting position | Segment ending position |
|---|---|---|
| M78001_T59 (SEQ ID NO: 4211) | 529 | 597 |

This segment can be found in a non-coding region of transcript(s) that are related to the following protein(s): M78001_P21.

Segment cluster M78001_node__19 (SEQ ID NO:5690) according to the present invention is supported by 12 libraries. The number of libraries was determined as previously described. This segment can be found in the following transcript(s): M78001_T59 (SEQ ID NO:4211). Table 5214 below describes the starting and ending position of this segment on each transcript.

TABLE 5214

Segment location on transcripts

| Transcript name | Segment starting position | Segment ending position |
|---|---|---|
| M78001_T59 (SEQ ID NO: 4211) | 598 | 642 |

This segment can be found in a non-coding region of transcript(s) that are related to the following protein(s): M78001_P21.

Segment cluster M78001_node__21 (SEQ ID NO:5691) according to the present invention is supported by 25 libraries. The number of libraries was determined as previously described. This segment can be found in the following transcript(s): M78001_T59 (SEQ ID NO:4211). Table 5215 below describes the starting and ending position of this segment on each transcript.

TABLE 5215

Segment location on transcripts

| Transcript name | Segment starting position | Segment ending position |
|---|---|---|
| M78001_T59 (SEQ ID NO: 4211) | 643 | 711 |

This segment can be found in a non-coding region of transcript(s) that are related to the following protein(s): M78001_P21.

Segment cluster M78001_node__23 (SEQ ID NO:5692) according to the present invention is supported by 27 libraries. The number of libraries was determined as previously described. This segment can be found in the following transcript(s): M78001_T59 (SEQ ID NO:4211). Table 5216 below describes the starting and ending position of this segment on each transcript.

TABLE 5216

Segment location on transcripts

| Transcript name | Segment starting position | Segment ending position |
|---|---|---|
| M78001_T59 (SEQ ID NO: 4211) | 712 | 757 |

This segment can be found in a non-coding region of transcript(s) that are related to the following protein(s): M78001_P21.

Segment cluster M78001_node__58 (SEQ ID NO:5693) according to the present invention is supported by 352 libraries. The number of libraries was determined as previously described. This segment can be found in the following transcript(s): M78001_T17 (SEQ ID NO:4208), M78001_T18 (SEQ ID NO:4209) and M78001_T21 (SEQ ID NO:4210). Table 5217 below describes the starting and ending position of this segment on each transcript.

TABLE 5217

Segment location on transcripts

| Transcript name | Segment starting position | Segment ending position |
|---|---|---|
| M78001_T17 (SEQ ID NO: 4208) | 262 | 294 |
| M78001_T18 (SEQ ID NO: 4209) | 262 | 294 |
| M78001_T21 (SEQ ID NO: 4210) | 262 | 294 |

This segment can be found in the following protein(s): M78001_P7, M78001_P8 and M78001_P10.

Segment cluster M78001_node__63 (SEQ ID NO:5694) according to the present invention is supported by 373 libraries. The number of libraries was determined as previously described. This segment can be found in the following transcript(s): M78001_T17 (SEQ ID NO:4208), M78001_T18 (SEQ ID NO:4209) and M78001_T21 (SEQ ID NO:4210). Table 5218 below describes the starting and ending position of this segment on each transcript.

TABLE 5218

Segment location on transcripts

| Transcript name | Segment starting position | Segment ending position |
|---|---|---|
| M78001_T17 (SEQ ID NO: 4208) | 295 | 342 |
| M78001_T18 (SEQ ID NO: 4209) | 295 | 342 |
| M78001_T21 (SEQ ID NO: 4210) | 295 | 342 |

This segment can be found in the following protein(s): M78001_P7, M78001_P8 and M78001_P10.

Segment cluster M78001_node_67 (SEQ ID NO:5695) according to the present invention is supported by 398 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5219 below describes the starting and ending position of this segment on each transcript.

TABLE 5219

Segment location on transcripts

| Transcript name | Segment starting position | Segment ending position |
|---|---|---|
| M78001_T13 (SEQ ID NO: 4207) | 600 | 644 |
| M78001_T17 (SEQ ID NO: 4208) | 343 | 387 |
| M78001_T18 (SEQ ID NO: 4209) | 343 | 387 |
| M78001_T21 (SEQ ID NO: 4210) | 343 | 387 |

This segment can be found in the following protein(s): M78001_P6, M78001_P7, M78001_P8 and M78001_P10.

Segment cluster M78001_node_71 (SEQ ID NO:5696) according to the present invention is supported by 400 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5220 below describes the starting and ending position of this segment on each transcript.

TABLE 5220

Segment location on transcripts

| Transcript name | Segment starting position | Segment ending position |
|---|---|---|
| M78001_T13 (SEQ ID NO: 4207) | 645 | 713 |
| M78001_T17 (SEQ ID NO: 4208) | 388 | 456 |
| M78001_T18 (SEQ ID NO: 4209) | 388 | 456 |
| M78001_T21 (SEQ ID NO: 4210) | 388 | 456 |

This segment can be found in the following protein(s): M78001_P6, M78001_P7, M78001_P8 and M78001_P10.

Segment cluster M78001_node_74 (SEQ ID NO:5697) according to the present invention is supported by 356 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5221 below describes the starting and ending position of this segment on each transcript.

TABLE 5221

Segment location on transcripts

| Transcript name | Segment starting position | Segment ending position |
|---|---|---|
| M78001_T13 (SEQ ID NO: 4207) | 714 | 761 |
| M78001_T17 (SEQ ID NO: 4208) | 457 | 504 |
| M78001_T18 (SEQ ID NO: 4209) | 457 | 504 |
| M78001_T21 (SEQ ID NO: 4210) | 457 | 504 |

This segment can be found in the following protein(s): M78001_P6, M78001_P7, M78001_P8 and M78001_P10.

Segment cluster M78001_node_77 (SEQ ID NO:5698) according to the present invention is supported by 341 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5222 below describes the starting and ending position of this segment on each transcript.

TABLE 5222

Segment location on transcripts

| Transcript name | Segment starting position | Segment ending position |
|---|---|---|
| M78001_T13 (SEQ ID NO: 4207) | 762 | 795 |
| M78001_T17 (SEQ ID NO: 4208) | 505 | 538 |
| M78001_T18 (SEQ ID NO: 4209) | 505 | 538 |
| M78001_T21 (SEQ ID NO: 4210) | 505 | 538 |

This segment can be found in the following protein(s): M78001_P6, M78001_P7, M78001_P8 and M78001_P10.

Segment cluster M78001_node_78 (SEQ ID NO:5699) according to the present invention can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5223 below describes the starting and ending position of this segment on each transcript.

TABLE 5223

Segment location on transcripts

| Transcript name | Segment starting position | Segment ending position |
|---|---|---|
| M78001_T13 (SEQ ID NO: 4207) | 796 | 812 |
| M78001_T17 (SEQ ID NO: 4208) | 539 | 555 |
| M78001_T18 (SEQ ID NO: 4209) | 539 | 555 |
| M78001_T21 (SEQ ID NO: 4210) | 539 | 555 |

This segment can be found in the following protein(s): M78001_P6, M78001_P7, M78001_P8 and M78001_P10.

Segment cluster M78001_node_83 (SEQ ID NO:5700) according to the present invention is supported by 386 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5224 below describes the starting and ending position of this segment on each transcript.

TABLE 5224

| Transcript name | Segment starting position | Segment ending position |
|---|---|---|
| M78001_T13 (SEQ ID NO: 4207) | 813 | 895 |
| M78001_T17 (SEQ ID NO: 4208) | 556 | 638 |
| M78001_T18 (SEQ ID NO: 4209) | 556 | 638 |
| M78001_T21 (SEQ ID NO: 4210) | 556 | 638 |

This segment can be found in the following protein(s): M78001_P6, M78001_P7, M78001_P8 and M78001_P10.

Segment cluster M78001_node_84 (SEQ ID NO:5701) according to the present invention is supported by 352 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5225 below describes the starting and ending position of this segment on each transcript.

TABLE 5225

| Transcript name | Segment starting position | Segment ending position |
|---|---|---|
| M78001_T13 (SEQ ID NO: 4207) | 896 | 926 |
| M78001_T17 (SEQ ID NO: 4208) | 639 | 669 |
| M78001_T18 (SEQ ID NO: 4209) | 639 | 669 |
| M78001_T21 (SEQ ID NO: 4210) | 639 | 669 |

This segment can be found in the following protein(s): M78001_P6, M78001_P7, M78001_P8 and M78001_P10.

Segment cluster M78001_node_88 (SEQ ID NO:5702) according to the present invention is supported by 4 libraries. The number of libraries was determined as previously described. This segment can be found in the following transcript(s): M78001_T21 (SEQ ID NO:4210). Table 5226 below describes the starting and ending position of this segment on each transcript.

TABLE 5226

| Transcript name | Segment starting position | Segment ending position |
|---|---|---|
| M78001_T21 (SEQ ID NO: 4210) | 670 | 720 |

This segment can be found in the following protein(s): M78001_P10.

Segment cluster M78001_node_89 (SEQ ID NO:5703) according to the present invention can be found in the following transcript(s): M78001_T21 (SEQ ID NO:4210). Table 5227 below describes the starting and ending position of this segment on each transcript.

TABLE 5227

| Transcript name | Segment starting position | Segment ending position |
|---|---|---|
| M78001_T21 (SEQ ID NO: 4210) | 721 | 724 |

This segment can be found in the following protein(s): M78001_P10.

Segment cluster M78001_node_91 (SEQ ID NO:5704) according to the present invention can be found in the following transcript(s): M78001_T17 (SEQ ID NO:4208) and M78001_T21 (SEQ ID NO:4210). Table 5228 below describes the starting and ending position of this segment on each transcript.

TABLE 5228

| Transcript name | Segment starting position | Segment ending position |
|---|---|---|
| M78001_T17 (SEQ ID NO: 4208) | 670 | 687 |
| M78001_T21 (SEQ ID NO: 4210) | 725 | 742 |

This segment can be found in the following protein(s): M78001_P7 and M78001_P10.

Segment cluster M78001_node_96 (SEQ ID NO:5705) according to the present invention is supported by 372 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5229 below describes the starting and ending position of this segment on each transcript.

TABLE 5229

| Transcript name | Segment starting position | Segment ending position |
|---|---|---|
| M78001_T13 (SEQ ID NO: 4207) | 927 | 958 |
| M78001_T17 (SEQ ID NO: 4208) | 1312 | 1343 |
| M78001_T18 (SEQ ID NO: 4209) | 989 | 1020 |
| M78001_T21 (SEQ ID NO: 4210) | 1367 | 1398 |

This segment can be found in both coding and non-coding regions of transcript(s) as follows. The segment can be found in a non-coding region of transcript(s) that are related to the following protein(s): M78001_P7, M78001_P8 and M78001_P10. This segment can also be found in the following protein(s): M78001_P6, since it is in the coding region for the corresponding transcript.

Segment cluster M78001_node_97 (SEQ ID NO:5706) according to the present invention can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5230 below describes the starting and ending position of this segment on each transcript.

TABLE 5230

Segment location on transcripts

| Transcript name | Segment starting position | Segment ending position |
|---|---|---|
| M78001_T13 (SEQ ID NO: 4207) | 959 | 983 |
| M78001_T17 (SEQ ID NO: 4208) | 1344 | 1368 |
| M78001_T18 (SEQ ID NO: 4209) | 1021 | 1045 |
| M78001_T21 (SEQ ID NO: 4210) | 1399 | 1423 |

This segment can be found in both coding and non-coding regions of transcript(s) as follows. The segment can be found in a non-coding region of transcript(s) that are related to the following protein(s): M78001_P7, M78001_P8 and M78001_P10. This segment can also be found in the following protein(s): M78001_P6, since it is in the coding region for the corresponding transcript.

Segment cluster M78001_node__100 (SEQ ID NO:5707) according to the present invention is supported by 387 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5231 below describes the starting and ending position of this segment on each transcript.

TABLE 5231

Segment location on transcripts

| Transcript name | Segment starting position | Segment ending position |
|---|---|---|
| M78001_T13 (SEQ ID NO: 4207) | 984 | 1009 |
| M78001_T17 (SEQ ID NO: 4208) | 1369 | 1394 |
| M78001_T18 (SEQ ID NO: 4209) | 1046 | 1071 |
| M78001_T21 (SEQ ID NO: 4210) | 1424 | 1449 |

This segment can be found in both coding and non-coding regions of transcript(s) as follows. The segment can be found in a non-coding region of transcript(s) that are related to the following protein(s): M78001_P7, M78001_P8 and M78001_P10. This segment can also be found in the following protein(s): M78001_P6, since it is in the coding region for the corresponding transcript.

Segment cluster M78001_node__101 (SEQ ID NO:5708) according to the present invention is supported by 404 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5232 below describes the starting and ending position of this segment on each transcript.

TABLE 5232

Segment location on transcripts

| Transcript name | Segment starting position | Segment ending position |
|---|---|---|
| M78001_T13 (SEQ ID NO: 4207) | 1010 | 1075 |
| M78001_T17 (SEQ ID NO: 4208) | 1395 | 1460 |
| M78001_T18 (SEQ ID NO: 4209) | 1072 | 1137 |
| M78001_T21 (SEQ ID NO: 4210) | 1450 | 1515 |

This segment can be found in a non-coding region of transcript(s) that are related to the following protein(s): M78001_P6, M78001_P7, M78001_P8 and M78001_P10.

Segment cluster M78001_node__102 (SEQ ID NO:5709) according to the present invention is supported by 383 libraries. The number of libraries was determined as previously described. This segment can be found in the following transcript(s): M78001_T13 (SEQ ID NO:4207), M78001_T17 (SEQ ID NO:4208), M78001_T18 (SEQ ID NO:4209) and M78001_T21 (SEQ ID NO:4210). Table 5233 below describes the starting and ending position of this segment on each transcript.

TABLE 5233

Segment location on transcripts

| Transcript name | Segment starting position | Segment ending position |
|---|---|---|
| M78001_T13 (SEQ ID NO: 4207) | 1076 | 1113 |
| M78001_T17 (SEQ ID NO: 4208) | 1461 | 1498 |
| M78001_T18 (SEQ ID NO: 4209) | 1138 | 1175 |
| M78001_T21 (SEQ ID NO: 4210) | 1516 | 1553 |

This segment can be found in a non-coding region of transcript(s) that are related to the following protein(s): M78001_P6, M78001_P7, M78001_P8 and M78001_P10.

Description for Cluster M79217

Cluster M79217 features 4 transcript(s) and 30 segment(s) of interest, the names for which are given in Tables 5234 and 5235, respectively, the sequences themselves are given at the end of the application. The selected protein variants are given in Table 5236.

TABLE 5234

Transcripts of interest
Transcript Name

M79217_PEA_1_T1 (SEQ ID NO: 4212)
M79217_PEA_1_T3 (SEQ ID NO: 4213)
M79217_PEA_1_T15 (SEQ ID NO: 4214)
M79217_PEA_1_T18 (SEQ ID NO: 4215)

TABLE 5235

Segments of interest
Segment Name

M79217_PEA_1_node_2 (SEQ ID NO: 5710)
M79217_PEA_1_node_4 (SEQ ID NO: 5711)
M79217_PEA_1_node_9 (SEQ ID NO: 5712)
M79217_PEA_1_node_10 (SEQ ID NO: 5713)
M79217_PEA_1_node_11 (SEQ ID NO: 5714)
M79217_PEA_1_node_13 (SEQ ID NO: 5715)
M79217_PEA_1_node_14 (SEQ ID NO: 5716)
M79217_PEA_1_node_16 (SEQ ID NO: 5717)
M79217_PEA_1_node_23 (SEQ ID NO: 5718)
M79217_PEA_1_node_24 (SEQ ID NO: 5719)
M79217_PEA_1_node_31 (SEQ ID NO: 5720)
M79217_PEA_1_node_33 (SEQ ID NO: 5721)
M79217_PEA_1_node_34 (SEQ ID NO: 5722)
M79217_PEA_1_node_35 (SEQ ID NO: 5723)
M79217_PEA_1_node_37 (SEQ ID NO: 5724)
M79217_PEA_1_node_38 (SEQ ID NO: 5725)
M79217_PEA_1_node_41 (SEQ ID NO: 5726)
M79217_PEA_1_node_44 (SEQ ID NO: 5727)
M79217_PEA_1_node_0 (SEQ ID NO: 5728)
M79217_PEA_1_node_7 (SEQ ID NO: 5729)

TABLE 5235-continued

Segments of interest
Segment Name

M79217_PEA_1_node_12 (SEQ ID NO: 5730)
M79217_PEA_1_node_26 (SEQ ID NO: 5731)
M79217_PEA_1_node_27 (SEQ ID NO: 5732)
M79217_PEA_1_node_30 (SEQ ID NO: 5733)
M79217_PEA_1_node_32 (SEQ ID NO: 5734)
M79217_PEA_1_node_36 (SEQ ID NO: 5735)
M79217_PEA_1_node_39 (SEQ ID NO: 5736)
M79217_PEA_1_node_40 (SEQ ID NO: 5737)
M79217_PEA_1_node_42 (SEQ ID NO: 5738)
M79217_PEA_1_node_43 (SEQ ID NO: 5739)

TABLE 5236

Proteins of interest

| Protein Name | Corresponding Transcript(s) |
|---|---|
| M79217_PEA_1_P1 | M79217_PEA_1_T1 (SEQ ID NO: 4212); M79217_PEA_1_T3 (SEQ ID NO: 4213) |
| M79217_PEA_1_P8 | M79217_PEA_1_T15 (SEQ ID NO: 4214) |
| M79217_PEA_1_P11 | M79217_PEA_1_T18 (SEQ ID NO: 4215) |

These sequences are variants of the known protein Exostosin-like 3 (SwissProt accession identifier EXL3_HUMAN; known also according to the synonyms EC 2.4.1.223; Glucuronyl-galactosyl-proteoglycan 4-alpha-N-acetylglucosaminyltransferase; Putative tumor suppressor protein EXTL3; Multiple exostosis-like protein 3; Hereditary multiple exostoses gene isolog; EXT-related protein 1), referred to herein as the previously known protein.

Protein Exostosin-like 3 is known or believed to have the following function(s): Probable glycosyltransferase (By similarity). The sequence for protein Exostosin-like 3 is given at the end of the application, as "Exostosin-like 3 amino acid sequence". Protein Exostosin-like 3 localization is believed to be Type II membrane protein. Endoplasmic reticulum.

The following GO Annotation(s) apply to the previously known protein. The following annotation(s) were found: cell growth and/or maintenance, which are annotation(s) related to Biological Process; transferase, transferring glycosyl groups, which are annotation(s) related to Molecular Function; and endoplasmic reticulum; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster M79217 features 30 segment(s), which were listed in Table 5235 above and for which the sequence(s) are given at the end of the application. These segment(s) are portions of nucleic acid sequence(s) which are described herein separately because they are of particular interest. A description of each segment according to the present invention is now provided.

Segment cluster M79217_PEA_1_node_2 (SEQ ID NO:5710) according to the present invention is supported by 2 libraries. The number of libraries was determined as previously described. This segment can be found in the following transcript(s): M79217_PEA_1_T3 (SEQ ID NO:4213).

Table 5237 below describes the starting and ending position of this segment on each transcript.

TABLE 5237

Segment location on transcripts

| Transcript name | Segment starting position | Segment ending position |
|---|---|---|
| M79217_PEA_1_T3 (SEQ ID NO: 4213) | 50 | 177 |

This segment can be found in a non-coding region of transcript(s) that are related to the following protein(s): M79217_PEA_1_P1.

Segment cluster M79217_PEA_1_node_4 (SEQ ID NO:5711) according to the present invention is supported by 8 libraries. The number of libraries was determined as previously described. This segment can be found in the following transcript(s): M79217_PEA_1_T15 (SEQ ID NO:4214)and M79217_PEA_1_T18 (SEQ ID NO:4215). Table 5238 below describes the starting and ending position of this segment on each transcript.

TABLE 5238

Segment location on transcripts

| Transcript name | Segment starting position | Segment ending position |
|---|---|---|
| M79217_PEA_1_T15 (SEQ ID NO: 4214) | 1 | 177 |
| M79217_PEA_1_T18 (SEQ ID NO: 4215) | 1 | 177 |

This segment can be found in a non-coding region of transcript(s) that are related to the following protein(s): M79217_PEA_1_P8 and M79217_PEA_1_P11.

Segment cluster M79217_PEA_1_node_9 (SEQ ID NO:5712) according to the present invention is supported by 2 libraries. The number of libraries was determined as previously described. This segment can be found in the following transcript(s): M79217_PEA_1_T1 (SEQ ID NO:4212). Table 5239 below describes the starting and ending position of this segment on each transcript.

TABLE 5239

Segment location on transcripts

| Transcript name | Segment starting position | Segment ending position |
|---|---|---|
| M79217_PEA_1_T1 (SEQ ID NO: 4212) | 1 | 597 |

This segment can be found in a non-coding region of transcript(s) that are related to the following protein(s): M79217_PEA_1_P1.

Segment cluster M79217_PEA_1_node_10 (SEQ ID NO:5713) according to the present invention is supported by 33 libraries. The number of libraries was determined as previously described. This segment can be found in the following transcript(s): M79217_PEA_1_T1 (SEQ ID NO:4212), M79217_PEA_1_T3 (SEQ ID NO:4213), M79217_PEA_1_T15 (SEQ ID NO:4214) and M79217_PEA_1_T18 (SEQ ID NO:4215). Table 5240 below describes the starting and ending position of this segment on each transcript.

TABLE 5240

Segment location on transcripts

| Transcript name | Segment starting position | Segment ending position |
|---|---|---|
| M79217_PEA_1_T1 (SEQ ID NO: 4212) | 598 | 1080 |
| M79217_PEA_1_T3 (SEQ ID NO: 4213) | 272 | 754 |
| M79217_PEA_1_T15 (SEQ ID NO: 4214) | 272 | 754 |
| M79217_PEA_1_T18 (SEQ ID NO: 4215) | 272 | 754 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5241.

TABLE 5241

Oligonucleotides related to this segment

| Oligonucleotide name | Overexpressed in cancers | Chip reference |
|---|---|---|
| M79217_0_9_0 | lung malignant tumors | LUN |

This segment can be found in both coding and non-coding regions of transcript(s) as follows. The segment can be found in a non-coding region of transcript(s) that are related to the following protein(s): M79217_PEA_1_P11. This segment can also be found in the following protein(s): M79217_PEA_1_P1 and M79217_PEA_1_P8, since it is in the coding region for the corresponding transcript.

Segment cluster M79217_PEA_1_node_11 (SEQ ID NO:5714) according to the present invention is supported by 42 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5242 below describes the starting and ending position of this segment on each transcript.

TABLE 5242

Segment location on transcripts

| Transcript name | Segment starting position | Segment ending position |
|---|---|---|
| M79217_PEA_1_T1 (SEQ ID NO: 4212) | 1081 | 1523 |
| M79217_PEA_1_T3 (SEQ ID NO: 4213) | 755 | 1197 |
| M79217_PEA_1_T15 (SEQ ID NO: 4214) | 755 | 1197 |

This segment can be found in the following protein(s): M79217_PEA_1_P1 and M79217_PEA_1_P8.

Segment cluster M79217_PEA_1_node_13 (SEQ ID NO:5715) according to the present invention is supported by 35 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5243 below describes the starting and ending position of this segment on each transcript.

TABLE 5243

Segment location on transcripts

| Transcript name | Segment starting position | Segment ending position |
|---|---|---|
| M79217_PEA_1_T1 (SEQ ID NO: 4212) | 1548 | 2075 |
| M79217_PEA_1_T3 (SEQ ID NO: 4213) | 1222 | 1749 |
| M79217_PEA_1_T15 (SEQ ID NO: 4214) | 1222 | 1749 |

This segment can be found in the following protein(s): M79217_PEA_1_P1 and M79217_PEA_1_P8.

Segment cluster M79217_PEA_1_node_14 (SEQ ID NO:5716) according to the present invention is supported by 65 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5244 below describes the starting and ending position of this segment on each transcript.

TABLE 5244

Segment location on transcripts

| Transcript name | Segment starting position | Segment ending position |
|---|---|---|
| M79217_PEA_1_T1 (SEQ ID NO: 4212) | 2076 | 3221 |
| M79217_PEA_1_T3 (SEQ ID NO: 4213) | 1750 | 2895 |
| M79217_PEA_1_T15 (SEQ ID NO: 4214) | 1750 | 2895 |

This segment can be found in the following protein(s): M79217_PEA_1_P1 and M79217_PEA_1_P8.

Segment cluster M79217_PEA_1_node_16 (SEQ ID NO:5717) according to the present invention is supported by 51 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5245 below describes the starting and ending position of this segment on each transcript.

TABLE 5245

Segment location on transcripts

| Transcript name | Segment starting position | Segment ending position |
|---|---|---|
| M79217_PEA_1_T1 (SEQ ID NO: 4212) | 3222 | 3349 |
| M79217_PEA_1_T3 (SEQ ID NO: 4213) | 2896 | 3023 |
| M79217_PEA_1_T15 (SEQ ID NO: 4214) | 2896 | 3023 |

This segment can be found in the following protein(s): M79217_PEA_1_P1 and M79217_PEA_1_P8.

Segment cluster M79217_PEA_1_node_23 (SEQ ID NO:5718) according to the present invention is supported by 50 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5246 below describes the starting and ending position of this segment on each transcript.

TABLE 5246

Segment location on transcripts

| Transcript name | Segment starting position | Segment ending position |
|---|---|---|
| M79217_PEA_1_T1 (SEQ ID NO: 4212) | 3350 | 3494 |
| M79217_PEA_1_T3 (SEQ ID NO: 4213) | 3024 | 3168 |
| M79217_PEA_1_T15 (SEQ ID NO: 4214) | 3024 | 3168 |

This segment can be found in the following protein(s): M79217_PEA_1_P1 and M79217_PEA_1_P8.

Segment cluster M79217_PEA_1_node_24 (SEQ ID NO:5719) according to the present invention is supported by 2 libraries. The number of libraries was determined as previously described. This segment can be found in the following transcript(s): M79217_PEA_1_T15 (SEQ ID NO:4214). Table 5247 below describes the starting and ending position of this segment on each transcript.

TABLE 5247

Segment location on transcripts

| Transcript name | Segment starting position | Segment ending position |
|---|---|---|
| M79217_PEA_1_T15 (SEQ ID NO: 4214) | 3169 | 3580 |

This segment can be found in the following protein(s): M79217_PEA_1_P8.

Segment cluster M79217_PEA_1_node_31 (SEQ ID NO:5720) according to the present invention is supported by 50 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5248 below describes the starting and ending position of this segment on each transcript.

TABLE 5248

Segment location on transcripts

| Transcript name | Segment starting position | Segment ending position |
|---|---|---|
| M79217_PEA_1_T1 (SEQ ID NO: 4212) | 3716 | 3960 |
| M79217_PEA_1_T3 (SEQ ID NO: 4213) | 3390 | 3634 |

This segment can be found in the following protein(s): M79217_PEA_1_P1.

Segment cluster M79217_PEA_1_node_33 (SEQ ID NO:5721) according to the present invention is supported by 71 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5249 below describes the starting and ending position of this segment on each transcript.

TABLE 5249

Segment location on transcripts

| Transcript name | Segment starting position | Segment ending position |
|---|---|---|
| M79217_PEA_1_T1 (SEQ ID NO: 4212) | 4015 | 4631 |
| M79217_PEA_1_T3 (SEQ ID NO: 4213) | 3689 | 4305 |

This segment can be found in a non-coding region of transcript(s) that are related to the following protein(s): M79217_PEA_1_P1.

Segment cluster M79217_PEA_1_node_34 (SEQ ID NO:5722) according to the present invention is supported by 51 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5250 below describes the starting and ending position of this segment on each transcript.

TABLE 5250

Segment location on transcripts

| Transcript name | Segment starting position | Segment ending position |
|---|---|---|
| M79217_PEA_1_T1 (SEQ ID NO: 4212) | 4632 | 4869 |
| M79217_PEA_1_T3 (SEQ ID NO: 4213) | 4306 | 4543 |

This segment can be found in a non-coding region of transcript(s) that are related to the following protein(s): M79217_PEA_1_P1.

Segment cluster M79217_PEA_1_node_35 (SEQ ID NO:5723) according to the present invention is supported by 53 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5251 below describes the starting and ending position of this segment on each transcript.

TABLE 5251

Segment location on transcripts

| Transcript name | Segment starting position | Segment ending position |
|---|---|---|
| M79217_PEA_1_T1 (SEQ ID NO: 4212) | 4870 | 4997 |
| M79217_PEA_1_T3 (SEQ ID NO: 4213) | 4544 | 4671 |

This segment can be found in a non-coding region of transcript(s) that are related to the following protein(s): M79217_PEA_1_P1.

Segment cluster M79217_PEA_1_node_37 (SEQ ID NO:5724) according to the present invention is supported by 58 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5252 below describes the starting and ending position of this segment on each transcript.

TABLE 5252

Segment location on transcripts

| Transcript name | Segment starting position | Segment ending position |
|---|---|---|
| M79217_PEA_1_T1 (SEQ ID NO: 4212) | 5039 | 5280 |
| M79217_PEA_1_T3 (SEQ ID NO: 4213) | 4713 | 4954 |

This segment can be found in a non-coding region of transcript(s) that are related to the following protein(s): M79217_PEA_1_P1.

Segment cluster M79217_PEA_1_node_38 (SEQ ID NO:5725) according to the present invention is supported by 62 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5253 below describes the starting and ending position of this segment on each transcript.

TABLE 5253

Segment location on transcripts

| Transcript name | Segment starting position | Segment ending position |
|---|---|---|
| M79217_PEA_1_T1 (SEQ ID NO: 4212) | 5281 | 5436 |
| M79217_PEA_1_T3 (SEQ ID NO: 4213) | 4955 | 5110 |

This segment can be found in a non-coding region of transcript(s) that are related to the following protein(s): M79217_PEA_1_P1.

Segment cluster M79217_PEA_1_node_41 (SEQ ID NO:5726) according to the present invention is supported by 171 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T18 (SEQ ID NO:4215). Table 5254 below describes the starting and ending position of this segment on each transcript.

TABLE 5254

Segment location on transcripts

| Transcript name | Segment starting position | Segment ending position |
|---|---|---|
| M79217_PEA_1_T1 (SEQ ID NO: 4212) | 5628 | 6357 |
| M79217_PEA_1_T3 (SEQ ID NO: 4213) | 5302 | 6031 |
| M79217_PEA_1_T18 (SEQ ID NO: 4215) | 755 | 1484 |

This segment can be found in both coding and non-coding regions of transcript(s) as follows. The segment can be found in a non-coding region of transcript(s) that are related to the following protein(s): M79217_PEA_1_P1. This segment can also be found in the following protein(s): M79217_PEA_1_P11, since it is in the coding region for the corresponding transcript.

Segment cluster M79217_PEA_1_node_44 (SEQ ID NO:5727) according to the present invention is supported by 89 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T18 (SEQ ID NO:4215). Table 5255 below describes the starting and ending position of this segment on each transcript.

TABLE 5255

Segment location on transcripts

| Transcript name | Segment starting position | Segment ending position |
|---|---|---|
| M79217_PEA_1_T1 (SEQ ID NO: 4212) | 6472 | 6659 |
| M79217_PEA_1_T3 (SEQ ID NO: 4213) | 6146 | 6333 |
| M79217_PEA_1_T18 (SEQ ID NO: 4215) | 1599 | 1786 |

This segment can be found in both coding and non-coding regions of transcript(s) as follows. The segment can be found in a non-coding region of transcript(s) that are related to the following protein(s): M79217_PEA_1_P1. This segment can also be found in the following protein(s): M79217_PEA_1_P11, since it is in the coding region for the corresponding transcript.

According to an optional embodiment of the present invention, short segments related to the above cluster are also provided. These segments are up to about 120 bp in length, and so are included in a separate description.

Segment cluster M79217_PEA_1_node_0 (SEQ ID NO:5728) according to the present invention is supported by 4 libraries. The number of libraries was determined as previously described. This segment can be found in the following transcript(s): M79217_PEA_1_T3 (SEQ ID NO:4213). Table 5256 below describes the starting and ending position of this segment on each transcript.

TABLE 5256

Segment location on transcripts

| Transcript name | Segment starting position | Segment ending position |
|---|---|---|
| M79217_PEA_1_T3 (SEQ ID NO: 4213) | 1 | 49 |

This segment can be found in a non-coding region of transcript(s) that are related to the following protein(s): M79217_PEA_1_P1.

Segment cluster M79217_PEA_1_node_7 (SEQ ID NO:5729) according to the present invention is supported by 11 libraries. The number of libraries was determined as previously described. This segment can be found in the following transcript(s): M79217_PEA_1_T3 (SEQ ID NO:4213), M79217_PEA_1_T15 (SEQ ID NO:4214) and M79217_PEA_1_T18 (SEQ ID NO:4215). Table 5257 below describes the starting and ending position of this segment on each transcript.

TABLE 5257

| Segment location on transcripts | | |
|---|---|---|
| Transcript name | Segment starting position | Segment ending position |
| M79217_PEA_1_T3 (SEQ ID NO: 4213) | 178 | 271 |
| M79217_PEA_1_T15 (SEQ ID NO: 4214) | 178 | 271 |
| M79217_PEA_1_T18 (SEQ ID NO: 4215) | 178 | 271 |

This segment can be found in a non-coding region of transcript(s) that are related to the following protein(s): M79217_PEA_1_P1, M79217_PEA_1_P8 and M79217_PEA_1_P11.

Segment cluster M79217_PEA_1_node_12 (SEQ ID NO:5730) according to the present invention can be found in the following transcript(s): M79217_PEA_1_T1 (SEQ ID NO:4212), M79217_PEA_1_T3 (SEQ ID NO:4213) and M79217_PEA_1_T15 (SEQ ID NO:4214). Table 5258 below describes the starting and ending position of this segment on each transcript.

TABLE 5258

| Segment location on transcripts | | |
|---|---|---|
| Transcript name | Segment starting position | Segment ending position |
| M79217_PEA_1_T1 (SEQ ID NO: 4212) | 1524 | 1547 |
| M79217_PEA_1_T3 (SEQ ID NO: 4213) | 1198 | 1221 |
| M79217_PEA_1_T15 (SEQ ID NO: 4214) | 1198 | 1221 |

This segment can be found in the following protein(s): M79217_PEA_1_P1 and M79217_PEA_1_P8.

Segment cluster M79217_PEA_1_node_26 (SEQ ID NO:5731) according to the present invention is supported by 40 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5259 below describes the starting and ending position of this segment on each transcript.

TABLE 5259

| Segment location on transcripts | | |
|---|---|---|
| Transcript name | Segment starting position | Segment ending position |
| M79217_PEA_1_T1 (SEQ ID NO: 4212) | 3495 | 3530 |
| M79217_PEA_1_T3 (SEQ ID NO: 4213) | 3169 | 3204 |

This segment can be found in the following protein(s): M79217_PEA_1_P1.

Segment cluster M79217_PEA_1_node_27 (SEQ ID NO:5732) according to the present invention is supported by 46 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5260 below describes the starting and ending position of this segment on each transcript.

TABLE 5260

| Segment location on transcripts | | |
|---|---|---|
| Transcript name | Segment starting position | Segment ending position |
| M79217_PEA_1_T1 (SEQ ID NO: 4212) | 3531 | 3623 |
| M79217_PEA_1_T3 (SEQ ID NO: 4213) | 3205 | 3297 |

This segment can be found in the following protein(s): M79217_PEA_1_P1.

Segment cluster M79217_PEA_1_node_30 (SEQ ID NO:5733) according to the present invention is supported by 47 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5261 below describes the starting and ending position of this segment on each transcript.

TABLE 5261

| Segment location on transcripts | | |
|---|---|---|
| Transcript name | Segment starting position | Segment ending position |
| M79217_PEA_1_T1 (SEQ ID NO: 4212) | 3624 | 3715 |
| M79217_PEA_1_T3 (SEQ ID NO: 4213) | 3298 | 3389 |

This segment can be found in the following protein(s): M79217_PEA_1_P1.

Segment cluster M79217_PEA_1_node_32 (SEQ ID NO:5734) according to the present invention is supported by 40 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5262 below describes the starting and ending position of this segment on each transcript.

TABLE 5262

Segment location on transcripts

| Transcript name | Segment starting position | Segment ending position |
|---|---|---|
| M79217_PEA_1_T1 (SEQ ID NO: 4212) | 3961 | 4014 |
| M79217_PEA_1_T3 (SEQ ID NO: 4213) | 3635 | 3688 |

This segment can be found in a non-coding region of transcript(s) that are related to the following protein(s): M79217_PEA_1_P1.

Segment cluster M79217_PEA_1_node_36 (SEQ ID NO:5735) according to the present invention is supported by 42 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5263 below describes the starting and ending position of this segment on each transcript.

TABLE 5263

Segment location on transcripts

| Transcript name | Segment starting position | Segment ending position |
|---|---|---|
| M79217_PEA_1_T1 (SEQ ID NO: 4212) | 4998 | 5038 |
| M79217_PEA_1_T3 (SEQ ID NO: 4213) | 4672 | 4712 |

This segment can be found in a non-coding region of transcript(s) that are related to the following protein(s): M79217_PEA_1_P1.

Segment cluster M79217_PEA_1_node_39 (SEQ ID NO:5736) according to the present invention is supported by 57 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5264 below describes the starting and ending position of this segment on each transcript.

TABLE 5264

Segment location on transcripts

| Transcript name | Segment starting position | Segment ending position |
|---|---|---|
| M79217_PEA_1_T1 (SEQ ID NO: 4212) | 5437 | 5520 |
| M79217_PEA_1_T3 (SEQ ID NO: 4213) | 5111 | 5194 |

This segment can be found in a non-coding region of transcript(s) that are related to the following protein(s): M79217_PEA_1_P1.

Segment cluster M79217_PEA_1_node_40 (SEQ ID NO:5737) according to the present invention is supported by 59 libraries. The number of libraries was determined as previously described. This segment can be found in the following transcript(s): M79217_PEA_1_T1 (SEQ ID NO:4212) and M79217_PEA_1_T3 (SEQ ID NO:4213). Table 5265 below describes the starting and ending position of this segment on each transcript.

TABLE 5265

Segment location on transcripts

| Transcript name | Segment starting position | Segment ending position |
|---|---|---|
| M79217_PEA_1_T1 (SEQ ID NO: 4212) | 5521 | 5627 |
| M79217_PEA_1_T3 (SEQ ID NO: 4213) | 5195 | 5301 |

This segment can be found in a non-coding region of transcript(s) that are related to the following protein(s): M79217_PEA_1_P1.

Segment cluster M79217_PEA_1_node_42 (SEQ ID NO:5738) according to the present invention is supported by 99 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T18 (SEQ ID NO:4215). Table 5266 below describes the starting and ending position of this segment on each transcript.

TABLE 5266

Segment location on transcripts

| Transcript name | Segment starting position | Segment ending position |
|---|---|---|
| M79217_PEA_1_T1 (SEQ ID NO: 4212) | 6358 | 6443 |
| M79217_PEA_1_T3 (SEQ ID NO: 4213) | 6032 | 6117 |
| M79217_PEA_1_T18 (SEQ ID NO: 4215) | 1485 | 1570 |

This segment can be found in both coding and non-coding regions of transcript(s) as follows. The segment can be found in a non-coding region of transcript(s) that are related to the following protein(s): M79217_PEA_1_P1. This segment can also be found in the following protein(s): M79217_PEA_1_P11, since it is in the coding region for the corresponding transcript.

Segment cluster M79217_PEA_1_node_43 (SEQ ID NO:5739) according to the present invention is supported by 90 libraries. The number of libraries was determined as previously described. This segment can be found in the following transcript(s): M79217_PEA_1_T1 (SEQ ID NO:4212), M79217_PEA_1_T3 (SEQ ID NO:4213) and M79217_PEA_1_T18 (SEQ ID NO:4215). Table 5267 below describes the starting and ending position of this segment on each transcript.

TABLE 5267

Segment location on transcripts

| Transcript name | Segment starting position | Segment ending position |
|---|---|---|
| M79217_PEA_1_T1 (SEQ ID NO: 4212) | 6444 | 6471 |
| M79217_PEA_1_T3 (SEQ ID NO: 4213) | 6118 | 6145 |

TABLE 5267-continued

| Segment location on transcripts | | |
|---|---|---|
| Transcript name | Segment starting position | Segment ending position |
| M79217_PEA_1_T18 (SEQ ID NO: 4215) | 1571 | 1598 |

This segment can be found in both coding and non-coding regions of transcript(s) as follows. The segment can be found in a non-coding region of transcript(s) that are related to the following protein(s): M79217_PEA_1_P1. This segment can also be found in the following protein(s): M79217_PEA_1_P11, since it is in the coding region for the corresponding transcript.

Description for Cluster N23262

Cluster N23262 features 9 transcript(s) and 44 segment(s) of interest, the names for which are given in Tables 5268 and 5269, respectively, the sequences themselves are given at the end of the application. The selected protein variants are given in Table 5270.

TABLE 5268

| Transcripts of interest Transcript Name |
|---|
| N23262_T0 (SEQ ID NO: 4216) |
| N23262_T1 (SEQ ID NO: 4217) |
| N23262_T4 (SEQ ID NO: 4218) |
| N23262_T5 (SEQ ID NO: 4219) |
| N23262_T6 (SEQ ID NO: 4220) |
| N23262_T16 (SEQ ID NO: 4221) |
| N23262_T22 (SEQ ID NO: 4222) |
| N23262_T23 (SEQ ID NO: 4223) |
| N23262_T27 (SEQ ID NO: 4224) |

TABLE 5269

| Segments of interest Segment Name |
|---|
| N23262_node_0 (SEQ ID NO: 5740) |
| N23262_node_2 (SEQ ID NO: 5741) |
| N23262_node_5 (SEQ ID NO: 5742) |
| N23262_node_6 (SEQ ID NO: 5743) |
| N23262_node_8 (SEQ ID NO: 5744) |
| N23262_node_10 (SEQ ID NO: 5745) |
| N23262_node_12 (SEQ ID NO: 5746) |
| N23262_node_15 (SEQ ID NO: 5747) |
| N23262_node_18 (SEQ ID NO: 5748) |
| N23262_node_19 (SEQ ID NO: 5749) |
| N23262_node_21 (SEQ ID NO: 5750) |
| N23262_node_23 (SEQ ID NO: 5751) |
| N23262_node_25 (SEQ ID NO: 5752) |
| N23262_node_27 (SEQ ID NO: 5753) |
| N23262_node_29 (SEQ ID NO: 5754) |
| N23262_node_31 (SEQ ID NO: 5755) |
| N23262_node_34 (SEQ ID NO: 5756) |
| N23262_node_38 (SEQ ID NO: 5757) |
| N23262_node_41 (SEQ ID NO: 5758) |
| N23262_node_44 (SEQ ID NO: 5759) |
| N23262_node_50 (SEQ ID NO: 5760) |
| N23262_node_51 (SEQ ID NO: 5761) |
| N23262_node_53 (SEQ ID NO: 5762) |
| N23262_node_54 (SEQ ID NO: 5763) |
| N23262_node_58 (SEQ ID NO: 5764) |
| N23262_node_59 (SEQ ID NO: 5765) |
| N23262_node_62 (SEQ ID NO: 5766) |

TABLE 5269-continued

| Segments of interest Segment Name |
|---|
| N23262_node_67 (SEQ ID NO: 5767) |
| N23262_node_69 (SEQ ID NO: 5768) |
| N23262_node_74 (SEQ ID NO: 5769) |
| N23262_node_79 (SEQ ID NO: 5770) |
| N23262_node_80 (SEQ ID NO: 5771) |
| N23262_node_81 (SEQ ID NO: 5772) |
| N23262_node_83 (SEQ ID NO: 5773) |
| N23262_node_84 (SEQ ID NO: 5774) |
| N23262_node_85 (SEQ ID NO: 5775) |
| N23262_node_3 (SEQ ID NO: 5776) |
| N23262_node_32 (SEQ ID NO: 5777) |
| N23262_node_47 (SEQ ID NO: 5778) |
| N23262_node_52 (SEQ ID NO: 5779) |
| N23262_node_65 (SEQ ID NO: 5780) |
| N23262_node_71 (SEQ ID NO: 5781) |
| N23262_node_72 (SEQ ID NO: 5782) |
| N23262_node_82 (SEQ ID NO: 5783) |

TABLE 5270

| Proteins of interest | |
|---|---|
| Protein Name | Corresponding Transcript(s) |
| N23262_P1 | N23262_T0 (SEQ ID NO: 4216) |
| N23262_P2 | N23262_T1 (SEQ ID NO: 4217) |
| N23262_P5 | N23262_T4 (SEQ ID NO: 4218); N23262_T5 (SEQ ID NO: 4219) |
| N23262_P6 | N23262_T6 (SEQ ID NO: 4220) |
| N23262_P7 | N23262_T16 (SEQ ID NO: 4221) |
| N23262_P12 | N23262_T22 (SEQ ID NO: 4222) |
| N23262_P14 | N23262_T23 (SEQ ID NO: 4223) |

As noted above, cluster N23262 features 44 segment(s), which were listed in Table 5269 above and for which the sequence(s) are given at the end of the application. These segment(s) are portions of nucleic acid sequence(s) which are described herein separately because they are of particular interest. A description of each segment according to the present invention is now provided.

Segment cluster N23262_node_0 (SEQ ID NO:5740) according to the present invention is supported by I libraries. The number of libraries was determined as previously described. This segment can be found in the following transcript(s): N23262_T0 (SEQ ID NO:4216), N23262_T4 (SEQ ID NO:4218), N23262_T5 (SEQ ID NO:4219) and N23262_T6 (SEQ ID NO:4220). Table 5271 below describes the starting and ending position of this segment on each transcript.

TABLE 5271

| Segment location on transcripts | | |
|---|---|---|
| Transcript name | Segment starting position | Segment ending position |
| N23262_T0 (SEQ ID NO: 4216) | 1 | 123 |
| N23262_T4 (SEQ ID NO: 4218) | 1 | 123 |
| N23262_T5 (SEQ ID NO: 4219) | 1 | 123 |
| N23262_T6 (SEQ ID NO: 4220) | 1 | 123 |

This segment can be found in the following protein(s): N23262_P1, N23262_P5 and N23262_P6.

Segment cluster N23262_node_2 (SEQ ID NO:5741) according to the present invention is supported by 3 libraries. The number of libraries was determined as previously described. This segment can be found in the following transcript(s): N23262_T1 (SEQ ID NO:4217) and N23262_T27 (SEQ ID NO:4224). Table 5272 below describes the starting and ending position of this segment on each transcript.

TABLE 5272

Segment location on transcripts

| Transcript name | Segment starting position | Segment ending position |
|---|---|---|
| N23262_T1 (SEQ ID NO: 4217) | 1 | 371 |
| N23262_T27 (SEQ ID NO: 4224) | 1 | 371 |

This segment can be found in a non-coding region of transcript(s) that are related to the following protein(s): N23262_P2.

Segment cluster N23262_node_5 (SEQ ID NO:5742) according to the present invention is supported by 5 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220) and N23262_T27 (SEQ ID NO:4224). Table 5273 below describes the starting and ending position of this segment on each transcript.

TABLE 5273

Segment location on transcripts

| Transcript name | Segment starting position | Segment ending position |
|---|---|---|
| N23262_T0 (SEQ ID NO: 4216) | 206 | 364 |
| N23262_T1 (SEQ ID NO: 4217) | 454 | 612 |
| N23262_T4 (SEQ ID NO: 4218) | 206 | 364 |
| N23262_T5 (SEQ ID NO: 4219) | 206 | 364 |
| N23262_T6 (SEQ ID NO: 4220) | 206 | 364 |
| N23262_T27 (SEQ ID NO: 4224) | 454 | 612 |

This segment can be found in the following protein(s): N23262_P1, N23262_P2, N23262_P5 and N23262_P6.

Segment cluster N23262_node_6 (SEQ ID NO:5743) according to the present invention is supported by 3 libraries. The number of libraries was determined as previously described. This segment can be found in the following transcript(s): N23262_T27 (SEQ ID NO:4224). Table 5274 below describes the starting and ending position of this segment on each transcript.

TABLE 5274

Segment location on transcripts

| Transcript name | Segment starting position | Segment ending position |
|---|---|---|
| N23262_T27 (SEQ ID NO: 4224) | 613 | 1820 |

The previously-described transcripts for these segment(s) do not code for protein.

Segment cluster N23262_node_8 (SEQ ID NO:5744) according to the present invention is supported by 4 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220).

Table 5275 below describes the starting and ending position of this segment on each transcript.

TABLE 5275

Segment location on transcripts

| Transcript name | Segment starting position | Segment ending position |
|---|---|---|
| N23262_T0 (SEQ ID NO: 4216) | 365 | 511 |
| N23262_T1 (SEQ ID NO: 4217) | 613 | 759 |
| N23262_T4 (SEQ ID NO: 4218) | 365 | 511 |
| N23262_T5 (SEQ ID NO: 4219) | 365 | 511 |
| N23262_T6 (SEQ ID NO: 4220) | 365 | 511 |

This segment can be found in the following protein(s): N23262_P1, N23262_P2, N23262_P5 and N23262_P6.

Segment cluster N23262_node_10 (SEQ ID NO:5745) according to the present invention is supported by 7 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5276 below describes the starting and ending position of this segment on each transcript.

TABLE 5276

Segment location on transcripts

| Transcript name | Segment starting position | Segment ending position |
|---|---|---|
| N23262_T0 (SEQ ID NO: 4216) | 512 | 656 |
| N23262_T1 (SEQ ID NO: 4217) | 760 | 904 |
| N23262_T4 (SEQ ID NO: 4218) | 512 | 656 |
| N23262_T5 (SEQ ID NO: 4219) | 512 | 656 |
| N23262_T6 (SEQ ID NO: 4220) | 512 | 656 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5277.

TABLE 5277

Oligonucleotides related to this segment

| Oligonucleotide name | Overexpressed in cancers | Chip reference |
|---|---|---|
| AA279036_0_0_648 | ovarian carcinoma | OVA |

This segment can be found in the following protein(s): N23262_P1, N23262_P2, N23262_P5 and N23262_P6.

Segment cluster N23262_node_12 (SEQ ID NO:5746) according to the present invention is supported by 7 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5278 below describes the starting and ending position of this segment on each transcript.

TABLE 5278

Segment location on transcripts

| Transcript name | Segment starting position | Segment ending position |
|---|---|---|
| N23262_T0 (SEQ ID NO: 4216) | 657 | 841 |
| N23262_T1 (SEQ ID NO: 4217) | 905 | 1089 |
| N23262_T4 (SEQ ID NO: 4218) | 657 | 841 |
| N23262_T5 (SEQ ID NO: 4219) | 657 | 841 |
| N23262_T6 (SEQ ID NO: 4220) | 657 | 841 |

This segment can be found in the following protein(s): N23262_P1, N23262_P2, N23262_P5 and N23262_P6.

Segment cluster N23262_node_15 (SEQ ID NO:5747) according to the present invention is supported by 9 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5279 below describes the starting and ending position of this segment on each transcript.

TABLE 5279

Segment location on transcripts

| Transcript name | Segment starting position | Segment ending position |
|---|---|---|
| N23262_T0 (SEQ ID NO: 4216) | 842 | 979 |
| N23262_T1 (SEQ ID NO: 4217) | 1090 | 1227 |
| N23262_T4 (SEQ ID NO: 4218) | 842 | 979 |
| N23262_T5 (SEQ ID NO: 4219) | 842 | 979 |
| N23262_T6 (SEQ ID NO: 4220) | 842 | 979 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5280.

TABLE 5280

Oligonucleotides related to this segment

| Oligonucleotide name | Overexpressed in cancers | Chip reference |
|---|---|---|
| AA279036_0_0_644 | ovarian carcinoma | OVA |

This segment can be found in the following protein(s): N23262_P1, N23262_P2, N23262_P5 and N23262_P6.

Segment cluster N23262_node_18 (SEQ ID NO:5748) according to the present invention is supported by 19 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5281 below describes the starting and ending position of this segment on each transcript.

TABLE 5281

Segment location on transcripts

| Transcript name | Segment starting position | Segment ending position |
|---|---|---|
| N23262_T0 (SEQ ID NO: 4216) | 980 | 1471 |
| N23262_T1 (SEQ ID NO: 4217) | 1228 | 1719 |
| N23262_T4 (SEQ ID NO: 4218) | 980 | 1471 |
| N23262_T5 (SEQ ID NO: 4219) | 980 | 1471 |
| N23262_T6 (SEQ ID NO: 4220) | 980 | 1471 |

This segment can be found in the following protein(s): N23262_P1, N23262_P2, N23262_P5 and N23262_P6.

Segment cluster N23262_node_19 (SEQ ID NO:5749) according to the present invention is supported by 13 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5282 below describes the starting and ending position of this segment on each transcript.

TABLE 5282

Segment location on transcripts

| Transcript name | Segment starting position | Segment ending position |
|---|---|---|
| N23262_T0 (SEQ ID NO: 4216) | 1472 | 1597 |
| N23262_T1 (SEQ ID NO: 4217) | 1720 | 1845 |
| N23262_T4 (SEQ ID NO: 4218) | 1472 | 1597 |
| N23262_T5 (SEQ ID NO: 4219) | 1472 | 1597 |
| N23262_T6 (SEQ ID NO: 4220) | 1472 | 1597 |

This segment can be found in the following protein(s): N23262_P1, N23262_P2, N23262_P5 and N23262_P6.

Segment cluster N23262_node_21 (SEQ ID NO:5750) according to the present invention is supported by 17 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5283 below describes the starting and ending position of this segment on each transcript.

TABLE 5283

Segment location on transcripts

| Transcript name | Segment starting position | Segment ending position |
|---|---|---|
| N23262_T0 (SEQ ID NO: 4216) | 1598 | 2050 |
| N23262_T1 (SEQ ID NO: 4217) | 1846 | 2298 |
| N23262_T4 (SEQ ID NO: 4218) | 1598 | 2050 |
| N23262_T5 (SEQ ID NO: 4219) | 1598 | 2050 |
| N23262_T6 (SEQ ID NO: 4220) | 1598 | 2050 |

This segment can be found in the following protein(s): N23262_P1, N23262_P2, N23262_P5 and N23262_P6.

Segment cluster N23262_node_23 (SEQ ID NO:5751) according to the present invention is supported by 14 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5

(SEQ ID NO:4219) and N23262_T6 (SEQ ID NO:4220). Table 5284 below describes the starting and ending position of this segment on each transcript.

TABLE 5284

Segment location on transcripts

| Transcript name | Segment starting position | Segment ending position |
|---|---|---|
| N23262_T0 (SEQ ID NO: 4216) | 2051 | 2178 |
| N23262_T1 (SEQ ID NO: 4217) | 2299 | 2426 |
| N23262_T4 (SEQ ID NO: 4218) | 2051 | 2178 |
| N23262_T5 (SEQ ID NO: 4219) | 2051 | 2178 |
| N23262_T6 (SEQ ID NO: 4220) | 2051 | 2178 |

This segment can be found in the following protein(s): N23262_P1, N23262_P2, N23262_P5 and N23262_P6.

Segment cluster N23262_node_25 (SEQ ID NO:5752) according to the present invention is supported by 13 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5285 below describes the starting and ending position of this segment on each transcript.

TABLE 5285

Segment location on transcripts

| Transcript name | Segment starting position | Segment ending position |
|---|---|---|
| N23262_T0 (SEQ ID NO: 4216) | 2179 | 2320 |
| N23262_T1 (SEQ ID NO: 4217) | 2427 | 2568 |
| N23262_T4 (SEQ ID NO: 4218) | 2179 | 2320 |
| N23262_T5 (SEQ ID NO: 4219) | 2179 | 2320 |
| N23262_T6 (SEQ ID NO: 4220) | 2179 | 2320 |

This segment can be found in the following protein(s): N23262_P1, N23262_P2, N23262_P5 and N23262_P6.

Segment cluster N23262_node_27 (SEQ ID NO:5753) according to the present invention is supported by 15 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5286 below describes the starting and ending position of this segment on each transcript.

TABLE 5286

Segment location on transcripts

| Transcript name | Segment starting position | Segment ending position |
|---|---|---|
| N23262_T0 (SEQ ID NO: 4216) | 2321 | 2509 |
| N23262_T1 (SEQ ID NO: 4217) | 2569 | 2757 |
| N23262_T4 (SEQ ID NO: 4218) | 2321 | 2509 |
| N23262_T5 (SEQ ID NO: 4219) | 2321 | 2509 |
| N23262_T6 (SEQ ID NO: 4220) | 2321 | 2509 |

This segment can be found in the following protein(s): N23262_P1, N23262_P2, N23262_P5 and N23262_P6.

Segment cluster N23262_node_29 (SEQ ID NO:5754) according to the present invention is supported by 14 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5287 below describes the starting and ending position of this segment on each transcript.

TABLE 5287

Segment location on transcripts

| Transcript name | Segment starting position | Segment ending position |
|---|---|---|
| N23262_T0 (SEQ ID NO: 4216) | 2510 | 2671 |
| N23262_T1 (SEQ ID NO: 4217) | 2758 | 2919 |
| N23262_T4 (SEQ ID NO: 4218) | 2510 | 2671 |
| N23262_T5 (SEQ ID NO: 4219) | 2510 | 2671 |
| N23262_T6 (SEQ ID NO: 4220) | 2510 | 2671 |

This segment can be found in the following protein(s): N23262_P1, N23262_P2, N23262_P5 and N23262_P6.

Segment cluster N23262_node_31 (SEQ ID NO:5755) according to the present invention is supported by 15 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5288 below describes the starting and ending position of this segment on each transcript.

TABLE 5288

Segment location on transcripts

| Transcript name | Segment starting position | Segment ending position |
|---|---|---|
| N23262_T0 (SEQ ID NO: 4216) | 2672 | 2815 |
| N23262_T1 (SEQ ID NO: 4217) | 2920 | 3063 |
| N23262_T4 (SEQ ID NO: 4218) | 2672 | 2815 |
| N23262_T5 (SEQ ID NO: 4219) | 2672 | 2815 |
| N23262_T6 (SEQ ID NO: 4220) | 2672 | 2815 |

This segment can be found in the following protein(s): N23262_P1, N23262_P2, N23262_P5 and N23262_P6.

Segment cluster N23262_node_34 (SEQ ID NO:5756) according to the present invention is supported by 10 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5289 below describes the starting and ending position of this segment on each transcript.

TABLE 5289

Segment location on transcripts

| Transcript name | Segment starting position | Segment ending position |
|---|---|---|
| N23262_T0 (SEQ ID NO: 4216) | 2822 | 2949 |
| N23262_T1 (SEQ ID NO: 4217) | 3070 | 3197 |
| N23262_T4 (SEQ ID NO: 4218) | 2822 | 2949 |
| N23262_T5 (SEQ ID NO: 4219) | 2822 | 2949 |
| N23262_T6 (SEQ ID NO: 4220) | 2822 | 2949 |

This segment can be found in the following protein(s): N23262_P1, N23262_P2, N23262_P5 and N23262_P6.

Segment cluster N23262_node__38 (SEQ ID NO:5757) according to the present invention is supported by 11 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5290 below describes the starting and ending position of this segment on each transcript.

TABLE 5290

Segment location on transcripts

| Transcript name | Segment starting position | Segment ending position |
|---|---|---|
| N23262_T0 (SEQ ID NO: 4216) | 2950 | 3093 |
| N23262_T1 (SEQ ID NO: 4217) | 3198 | 3341 |
| N23262_T4 (SEQ ID NO: 4218) | 2950 | 3093 |
| N23262_T5 (SEQ ID NO: 4219) | 2950 | 3093 |
| N23262_T6 (SEQ ID NO: 4220) | 2950 | 3093 |

This segment can be found in the following protein(s): N23262_P1, N23262_P2, N23262_P5 and N23262_P6.

Segment cluster N23262_node__41 (SEQ ID NO:5758) according to the present invention is supported by 13 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5291 below describes the starting and ending position of this segment on each transcript.

TABLE 5291

Segment location on transcripts

| Transcript name | Segment starting position | Segment ending position |
|---|---|---|
| N23262_T0 (SEQ ID NO: 4216) | 3094 | 3280 |
| N23262_T1 (SEQ ID NO: 4217) | 3342 | 3528 |
| N23262_T4 (SEQ ID NO: 4218) | 3094 | 3280 |
| N23262_T5 (SEQ ID NO: 4219) | 3094 | 3280 |
| N23262_T6 (SEQ ID NO: 4220) | 3094 | 3280 |

This segment can be found in the following protein(s): N23262_P1, N23262_P2, N23262_P5 and N23262_P6.

Segment cluster N23262_node__44 (SEQ ID NO:5759) according to the present invention is supported by 9 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5292 below describes the starting and ending position of this segment on each transcript.

TABLE 5292

Segment location on transcripts

| Transcript name | Segment starting position | Segment ending position |
|---|---|---|
| N23262_T0 (SEQ ID NO: 4216) | 3281 | 3426 |
| N23262_T1 (SEQ ID NO: 4217) | 3529 | 3674 |
| N23262_T4 (SEQ ID NO: 4218) | 3281 | 3426 |

TABLE 5292-continued

Segment location on transcripts

| Transcript name | Segment starting position | Segment ending position |
|---|---|---|
| N23262_T5 (SEQ ID NO: 4219) | 3281 | 3426 |
| N23262_T6 (SEQ ID NO: 4220) | 3281 | 3426 |

This segment can be found in the following protein(s): N23262_P1, N23262_P2, N23262_P5 and N23262_P6.

Segment cluster N23262_node__50 (SEQ ID NO:5760) according to the present invention is supported by 7 libraries. The number of libraries was determined as previously described. This segment can be found in the following transcript(s): N23262_T16 (SEQ ID NO:4221) and N23262_T23 (SEQ ID NO:4223). Table 5293 below describes the starting and ending position of this segment on each transcript.

TABLE 5293

Segment location on transcripts

| Transcript name | Segment starting position | Segment ending position |
|---|---|---|
| N23262_T16 (SEQ ID NO: 4221) | 1 | 1056 |
| N23262_T23 (SEQ ID NO: 4223) | 1 | 1056 |

This segment can be found in both coding and non-coding regions of transcript(s) as follows. The segment can be found in a non-coding region of transcript(s) that are related to the following protein(s): N23262_P7. This segment can also be found in the following protein(s): N23262_P14, since it is in the coding region for the corresponding transcript.

Segment cluster N23262_node__51 (SEQ ID NO:5761) according to the present invention is supported by 17 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T23 (SEQ ID NO:4223). Table 5294 below describes the starting and ending position of this segment on each transcript.

TABLE 5294

Segment location on transcripts

| Transcript name | Segment starting position | Segment ending position |
|---|---|---|
| N23262_T0 (SEQ ID NO: 4216) | 3517 | 3741 |
| N23262_T1 (SEQ ID NO: 4217) | 3765 | 3989 |
| N23262_T4 (SEQ ID NO: 4218) | 3517 | 3741 |
| N23262_T5 (SEQ ID NO: 4219) | 3517 | 3741 |
| N23262_T6 (SEQ ID NO: 4220) | 3517 | 3741 |
| N23262_T16 (SEQ ID NO: 4221) | 1057 | 1281 |
| N23262_T23 (SEQ ID NO: 4223) | 1057 | 1281 |

This segment can be found in both coding and non-coding regions of transcript(s) as follows. The segment can be found in a non-coding region of transcript(s) that are related to the following protein(s): N23262_P7. This segment can also be found in the following protein(s): N23262_P1, N23262_P2, N23262_P5, N23262_P6 and N23262_P14, since it is in the coding region for the corresponding transcript.

Segment cluster N23262_node_53 (SEQ ID NO:5762) according to the present invention is supported by 5 libraries. The number of libraries was determined as previously described. This segment can be found in the following transcript(s): N23262_T23 (SEQ ID NO:4223). Table 5295 below describes the starting and ending position of this segment on each transcript.

TABLE 5295

Segment location on transcripts

| Transcript name | Segment starting position | Segment ending position |
|---|---|---|
| N23262_T23 (SEQ ID NO: 4223) | 1296 | 1573 |

This segment can be found in the following protein(s): N23262_P14.

Segment cluster N23262_node_54 (SEQ ID NO:5763) according to the present invention is supported by 25 libraries. The number of libraries was determined as previously described. This segment can be found in the following transcript(s): N23262_T23 (SEQ ID NO:4223). Table 5296 below describes the starting and ending position of this segment on each transcript.

TABLE 5296

Segment location on transcripts

| Transcript name | Segment starting position | Segment ending position |
|---|---|---|
| N23262_T23 (SEQ ID NO: 4223) | 1574 | 2745 |

This segment can be found in a non-coding region of transcript(s) that are related to the following protein(s): N23262_P14.

Segment cluster N23262_node_58 (SEQ ID NO:5764) according to the present invention is supported by 10 libraries. The number of libraries was determined as previously described. This segment can be found in the following transcript(s): N23262_T4 (SEQ ID NO:4218), N23262_T5 (SEQ ID NO:4219), N23262_T6 (SEQ ID NO:4220) and N23262_T16 (SEQ ID NO:4221). Table 5297 below describes the starting and ending position of this segment on each transcript.

TABLE 5297

Segment location on transcripts

| Transcript name | Segment starting position | Segment ending position |
|---|---|---|
| N23262_T4 (SEQ ID NO: 4218) | 3756 | 3930 |
| N23262_T5 (SEQ ID NO: 4219) | 3756 | 3930 |
| N23262_T6 (SEQ ID NO: 4220) | 3742 | 3916 |
| N23262_T16 (SEQ ID NO: 4221) | 1296 | 1470 |

This segment can be found in both coding and non-coding regions of transcript(s) as follows. The segment can be found in a non-coding region of transcript(s) that are related to the following protein(s): N23262_P7. This segment can also be found in the following protein(s): N23262_P5 and N23262_P6, since it is in the coding region for the corresponding transcript.

Segment cluster N23262_node_59 (SEQ ID NO:5765) according to the present invention is supported by 11 libraries. The number of libraries was determined as previously described. This segment can be found in the following transcript(s): N23262_T4 (SEQ ID NO:4218), N23262_T5 (SEQ ID NO:4219), N23262_T6 (SEQ ID NO:4220) and N23262_T16 (SEQ ID NO:4221). Table 5298 below describes the starting and ending position of this segment on each transcript.

TABLE 5298

Segment location on transcripts

| Transcript name | Segment starting position | Segment ending position |
|---|---|---|
| N23262_T4 (SEQ ID NO: 4218) | 3931 | 4196 |
| N23262_T5 (SEQ ID NO: 4219) | 3931 | 4196 |
| N23262_T6 (SEQ ID NO: 4220) | 3917 | 4182 |
| N23262_T16 (SEQ ID NO: 4221) | 1471 | 1736 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P7, since it is in the coding region for the corresponding transcript.

Segment cluster N23262_node_62 (SEQ ID NO:5766) according to the present invention is supported by 11 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220) and N23262_T16 (SEQ ID NO:4221). Table 5299 below describes the starting and ending position of this segment on each transcript.

TABLE 5299

Segment location on transcripts

| Transcript name | Segment starting position | Segment ending position |
|---|---|---|
| N23262_T0 (SEQ ID NO: 4216) | 3756 | 3944 |
| N23262_T1 (SEQ ID NO: 4217) | 4004 | 4192 |
| N23262_T4 (SEQ ID NO: 4218) | 4197 | 4385 |
| N23262_T5 (SEQ ID NO: 4219) | 4197 | 4385 |
| N23262_T6 (SEQ ID NO: 4220) | 4183 | 4371 |
| N23262_T16 (SEQ ID NO: 4221) | 1737 | 1925 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2 and N23262_P7, since it is in the coding region for the corresponding transcript.

Segment cluster N23262_node_67 (SEQ ID NO:5767) according to the present invention is supported by 2 libraries. The number of libraries was determined as previously described. This segment can be found in the following transcript(s): N23262_T5 (SEQ ID NO:4219). Table 5300 below describes the starting and ending position of this segment on each transcript.

TABLE 5300

Segment location on transcripts

| Transcript name | Segment starting position | Segment ending position |
|---|---|---|
| N23262_T5 (SEQ ID NO: 4219) | 4455 | 4601 |

This segment can be found in a non-coding region of transcript(s) that are related to the following protein(s): N23262_P5.

Segment cluster N23262_node__69 (SEQ ID NO:5768) according to the present invention is supported by 3 libraries. The number of libraries was determined as previously described. This segment can be found in the following transcript(s): N23262_T22 (SEQ ID NO:4222). Table 5301 below describes the starting and ending position of this segment on each transcript.

TABLE 5301

Segment location on transcripts

| Transcript name | Segment starting position | Segment ending position |
|---|---|---|
| N23262_T22 (SEQ ID NO: 4222) | 1 | 672 |

This segment can be found in a non-coding region of transcript(s) that are related to the following protein(s): N23262_P12.

Segment cluster N23262_node__74 (SEQ ID NO:5769) according to the present invention is supported by 20 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5302 below describes the starting and ending position of this segment on each transcript.

TABLE 5302

Segment location on transcripts

| Transcript name | Segment starting position | Segment ending position |
|---|---|---|
| N23262_T0 (SEQ ID NO: 4216) | 4083 | 4372 |
| N23262_T1 (SEQ ID NO: 4217) | 4331 | 4620 |
| N23262_T4 (SEQ ID NO: 4218) | 4524 | 4813 |
| N23262_T5 (SEQ ID NO: 4219) | 4671 | 4960 |
| N23262_T6 (SEQ ID NO: 4220) | 4510 | 4799 |
| N23262_T16 (SEQ ID NO: 4221) | 2064 | 2353 |
| N23262_T22 (SEQ ID NO: 4222) | 742 | 1031 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Segment cluster N23262_node__79 (SEQ ID NO:5770) according to the present invention is supported by 27 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5303 below describes the starting and ending position of this segment on each transcript.

TABLE 5303

Segment location on transcripts

| Transcript name | Segment starting position | Segment ending position |
|---|---|---|
| N23262_T0 (SEQ ID NO: 4216) | 4373 | 4672 |
| N23262_T1 (SEQ ID NO: 4217) | 4621 | 4920 |
| N23262_T4 (SEQ ID NO: 4218) | 4814 | 5113 |
| N23262_T5 (SEQ ID NO: 4219) | 4961 | 5260 |
| N23262_T6 (SEQ ID NO: 4220) | 4800 | 5099 |
| N23262_T16 (SEQ ID NO: 4221) | 2354 | 2653 |
| N23262_T22 (SEQ ID NO: 4222) | 1032 | 1331 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Segment cluster N23262_node__80 (SEQ ID NO:5771) according to the present invention is supported by 19 libraries. The number of libraries was determined as previously described. This. segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 37 below describes the starting and ending position of this segment on each transcript.

TABLE 5304

Segment location on transcripts

| Transcript name | Segment starting position | Segment ending position |
|---|---|---|
| N23262_T0 (SEQ ID NO: 4216) | 4673 | 4811 |
| N23262_T1 (SEQ ID NO: 4217) | 4921 | 5059 |
| N23262_T4 (SEQ ID NO: 4218) | 5114 | 5252 |
| N23262_T5 (SEQ ID NO: 4219) | 5261 | 5399 |
| N23262_T6 (SEQ ID NO: 4220) | 5100 | 5238 |
| N23262_T16 (SEQ ID NO: 4221) | 2654 | 2792 |
| N23262_T22 (SEQ ID NO: 4222) | 1332 | 1470 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Segment cluster N23262_node__81 (SEQ ID NO:5772) according to the present invention is supported by 19 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5305 below describes the starting and ending position of this segment on each transcript.

TABLE 5305

Segment location on transcripts

| Transcript name | Segment starting position | Segment ending position |
| --- | --- | --- |
| N23262_T0 (SEQ ID NO: 4216) | 4812 | 5016 |
| N23262_T1 (SEQ ID NO: 4217) | 5060 | 5264 |
| N23262_T4 (SEQ ID NO: 4218) | 5253 | 5457 |
| N23262_T5 (SEQ ID NO: 4219) | 5400 | 5604 |
| N23262_T6 (SEQ ID NO: 4220) | 5239 | 5443 |
| N23262_T16 (SEQ ID NO: 4221) | 2793 | 2997 |
| N23262_T22 (SEQ ID NO: 4222) | 1471 | 1675 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Segment cluster N23262_node_83 (SEQ ID NO:5773) according to the present invention is supported by 29 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5306 below describes the starting and ending position of this segment on each transcript.

TABLE 5306

Segment location on transcripts

| Transcript name | Segment starting position | Segment ending position |
| --- | --- | --- |
| N23262_T0 (SEQ ID NO: 4216) | 5055 | 5836 |
| N23262_T1 (SEQ ID NO: 4217) | 5303 | 6084 |
| N23262_T4 (SEQ ID NO: 4218) | 5496 | 6277 |
| N23262_T5 (SEQ ID NO: 4219) | 5643 | 6424 |
| N23262_T6 (SEQ ID NO: 4220) | 5482 | 6263 |
| N23262_T16 (SEQ ID NO: 4221) | 3036 | 3817 |
| N23262_T22 (SEQ ID NO: 4222) | 1714 | 2495 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Segment cluster N23262_node_84 (SEQ ID NO:5774) according to the present invention is supported by 18 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5307 below describes the starting and ending position of this segment on each transcript.

TABLE 5307

Segment location on transcripts

| Transcript name | Segment starting position | Segment ending position |
| --- | --- | --- |
| N23262_T0 (SEQ ID NO: 4216) | 5837 | 5973 |
| N23262_T1 (SEQ ID NO: 4217) | 6085 | 6221 |
| N23262_T4 (SEQ ID NO: 4218) | 6278 | 6414 |
| N23262_T5 (SEQ ID NO: 4219) | 6425 | 6561 |
| N23262_T6 (SEQ ID NO: 4220) | 6264 | 6400 |
| N23262_T16 (SEQ ID NO: 4221) | 3818 | 3954 |
| N23262_T22 (SEQ ID NO: 4222) | 2496 | 2632 |

This segment can be found in a non-coding region of transcript(s) that are related to the following protein(s): N23262_P1, N23262_P2, N23262_P5, N23262_P6, N23262_P7 and N23262_P12.

Segment cluster N23262_node_85 (SEQ ID NO:5775) according to the present invention is supported by 36 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5308 below describes the starting and ending position of this segment on each transcript.

TABLE 5308

Segment location on transcripts

| Transcript name | Segment starting position | Segment ending position |
| --- | --- | --- |
| N23262_T0 (SEQ ID NO: 4216) | 5974 | 6703 |
| N23262_T1 (SEQ ID NO: 4217) | 6222 | 6951 |
| N23262_T4 (SEQ ID NO: 4218) | 6415 | 7144 |
| N23262_T5 (SEQ ID NO: 4219) | 6562 | 7291 |
| N23262_T6 (SEQ ID NO: 4220) | 6401 | 7130 |
| N23262_T16 (SEQ ID NO: 4221) | 3955 | 4684 |
| N23262_T22 (SEQ ID NO: 4222) | 2633 | 3362 |

This segment can be found in a non-coding region of transcript(s) that are related to the following protein(s): N23262_P1, N23262_P2, N23262_P5, N23262_P6, N23262_P7 and N23262_P12.

According to an optional embodiment of the present invention, short segments related to the above cluster are also provided. These segments are up to about 120 bp in length, and so are included in a separate description.

Segment cluster N23262_node_3 (SEQ ID NO:5776) according to the present invention is supported by 4 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220) and N23262_T27 (SEQ ID NO:4224). Table 5309 below describes the starting and ending position of this segment on each transcript.

TABLE 5309

| Transcript name | Segment starting position | Segment ending position |
|---|---|---|
| N23262_T0 (SEQ ID NO: 4216) | 124 | 205 |
| N23262_T1 (SEQ ID NO: 4217) | 372 | 453 |
| N23262_T4 (SEQ ID NO: 4218) | 124 | 205 |
| N23262_T5 (SEQ ID NO: 4219) | 124 | 205 |
| N23262_T6 (SEQ ID NO: 4220) | 124 | 205 |
| N23262_T27 (SEQ ID NO: 4224) | 372 | 453 |

This segment can be found in both coding and non-coding regions of transcript(s) as follows. The segment can be found in a non-coding region of transcript(s) that are related to the following protein(s): N23262_P2. This segment can also be found in the following protein(s): N23262_P1, N23262_P5 and N23262_P6, since it is in the coding region for the corresponding transcript.

Segment cluster N23262_node_32 (SEQ ID NO:5777) according to the present invention can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5310 below describes the starting and ending position of this segment on each transcript.

TABLE 5310

| Transcript name | Segment starting position | Segment ending position |
|---|---|---|
| N23262_T0 (SEQ ID NO: 4216) | 2816 | 2821 |
| N23262_T1 (SEQ ID NO: 4217) | 3064 | 3069 |
| N23262_T4 (SEQ ID NO: 4218) | 2816 | 2821 |
| N23262_T5 (SEQ ID NO: 4219) | 2816 | 2821 |
| N23262_T6 (SEQ ID NO: 4220) | 2816 | 2821 |

This segment can be found in the following protein(s): N23262_P1, N23262_P2, N23262_P5 and N23262_P6.

Segment cluster N23262_node_47 (SEQ ID NO:5778) according to the present invention is supported by 9 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219) and N23262_T6 (SEQ ID NO:4220). Table 5311 below describes the starting and ending position of this segment on each transcript.

TABLE 5311

| Transcript name | Segment starting position | Segment ending position |
|---|---|---|
| N23262_T0 (SEQ ID NO: 4216) | 3427 | 3516 |
| N23262_T1 (SEQ ID NO: 4217) | 3675 | 3764 |
| N23262_T4 (SEQ ID NO: 4218) | 3427 | 3516 |
| N23262_T5 (SEQ ID NO: 4219) | 3427 | 3516 |
| N23262_T6 (SEQ ID NO: 4220) | 3427 | 3516 |

This segment can be found in the following protein(s): N23262_P1, N23262_P2, N23262_P5 and N23262_P6.

Segment cluster N23262_node_52 (SEQ ID NO:5779) according to the present invention can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T16 (SEQ ID NO:4221) and N23262_T23 (SEQ ID NO:4223). Table 5312 below describes the starting and ending position of this segment on each transcript.

TABLE 5312

| Transcript name | Segment starting position | Segment ending position |
|---|---|---|
| N23262_T0 (SEQ ID NO: 4216) | 3742 | 3755 |
| N23262_T1 (SEQ ID NO: 4217) | 3990 | 4003 |
| N23262_T4 (SEQ ID NO: 4218) | 3742 | 3755 |
| N23262_T5 (SEQ ID NO: 4219) | 3742 | 3755 |
| N23262_T16 (SEQ ID NO: 4221) | 1282 | 1295 |
| N23262_T23 (SEQ ID NO: 4223) | 1282 | 1295 |

This segment can be found in both coding and non-coding regions of transcript(s) as follows. The segment can be found in a non-coding region of transcript(s) that are related to the following protein(s): N23262_P7. This segment can also be found in the following protein(s): N23262_P1, N23262_P2, N23262_P5 and N23262_P14, since it is in the coding region for the corresponding transcript.

Segment cluster N23262_node_65 (SEQ ID NO:5780) according to the present invention is supported by 11 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220) and N23262_T16 (SEQ ID NO:4221). Table 5313 below describes the starting and ending position of this segment on each transcript.

TABLE 5313

| Transcript name | Segment starting position | Segment ending position |
|---|---|---|
| N23262_T0 (SEQ ID NO: 4216) | 3945 | 4013 |
| N23262_T1 (SEQ ID NO: 4217) | 4193 | 4261 |
| N23262_T4 (SEQ ID NO: 4218) | 4386 | 4454 |
| N23262_T5 (SEQ ID NO: 4219) | 4386 | 4454 |
| N23262_T6 (SEQ ID NO: 4220) | 4372 | 4440 |
| N23262_T16 (SEQ ID NO: 4221) | 1926 | 1994 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2 and N23262_P7, since it is in the coding region for the corresponding transcript.

Segment cluster N23262_node_71 (SEQ ID NO:5781) according to the present invention can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5314 below describes the starting and ending position of this segment on each transcript.

TABLE 5314

Segment location on transcripts

| Transcript name | Segment starting position | Segment ending position |
|---|---|---|
| N23262_T0 (SEQ ID NO: 4216) | 4014 | 4034 |
| N23262_T1 (SEQ ID NO: 4217) | 4262 | 4282 |
| N23262_T4 (SEQ ID NO: 4218) | 4455 | 4475 |
| N23262_T5 (SEQ ID NO: 4219) | 4602 | 4622 |
| N23262_T6 (SEQ ID NO: 4220) | 4441 | 4461 |
| N23262_T16 (SEQ ID NO: 4221) | 1995 | 2015 |
| N23262_T22 (SEQ ID NO: 4222) | 673 | 693 |

This segment can be found in both coding and non-coding regions of transcript(s) as follows. The segment can be found in a non-coding region of transcript(s) that are related to the following protein(s): N23262_P5, N23262_P6 and N23262_P12. This segment can also be found in the following protein(s): N23262_P1, N23262_P2 and N23262_P7, since it is in the coding region for the corresponding transcript.

Segment cluster N23262_node_72 (SEQ ID NO:5782) according to the present invention is supported by 14 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5315 below describes the starting and ending position of this segment on each transcript.

TABLE 5315

Segment location on transcripts

| Transcript name | Segment starting position | Segment ending position |
|---|---|---|
| N23262_T0 (SEQ ID NO: 4216) | 4035 | 4082 |
| N23262_T1 (SEQ ID NO: 4217) | 4283 | 4330 |
| N23262_T4 (SEQ ID NO: 4218) | 4476 | 4523 |
| N23262_T5 (SEQ ID NO: 4219) | 4623 | 4670 |
| N23262_T6 (SEQ ID NO: 4220) | 4462 | 4509 |
| N23262_T16 (SEQ ID NO: 4221) | 2016 | 2063 |
| N23262_T22 (SEQ ID NO: 4222) | 694 | 741 |

This segment can be found in both coding and non-coding regions of transcript(s) as follows. The segment can be found in a non-coding region of transcript(s) that are related to the following protein(s): N23262_P5, N23262_P6 and N23262_P12. This segment can also be found in the following protein(s): N23262_P1, N23262_P2 and N23262_P7, since it is in the coding region for the corresponding transcript.

Segment cluster N23262_node_82 (SEQ ID NO:5783) according to the present invention is supported by 12 libraries. The number of libraries was determined as previously described. This segment can be found in the following transcript(s): N23262_T0 (SEQ ID NO:4216), N23262_T1 (SEQ ID NO:4217), N23262_T4 (SEQ ID NO:4218), N23262_T5 (SEQ ID NO:4219), N23262_T6 (SEQ ID NO:4220), N23262_T16 (SEQ ID NO:4221) and N23262_T22 (SEQ ID NO:4222). Table 5316 below describes the starting and ending position of this segment on each transcript.

TABLE 5316

Segment location on transcripts

| Transcript name | Segment starting position | Segment ending position |
|---|---|---|
| N23262_T0 (SEQ ID NO: 4216) | 5017 | 5054 |
| N23262_T1 (SEQ ID NO: 4217) | 5265 | 5302 |
| N23262_T4 (SEQ ID NO: 4218) | 5458 | 5495 |
| N23262_T5 (SEQ ID NO: 4219) | 5605 | 5642 |
| N23262_T6 (SEQ ID NO: 4220) | 5444 | 5481 |
| N23262_T16 (SEQ ID NO: 4221) | 2998 | 3035 |
| N23262_T22 (SEQ ID NO: 4222) | 1676 | 1713 |

This segment can be found in both coding and non-coding regions of transcript(s) as follows. The segment can be found in a non-coding region of transcript(s) that are related to the following protein(s): N23262_P5 and N23262_P6. This segment can also be found in the following protein(s): N23262_P1, N23262_P2, N23262_P7 and N23262_P12, since it is in the coding region for the corresponding transcript.

Description for Cluster R34187

Cluster R34187 features 2 transcript(s) and 7 segment(s) of interest, the names for which are given in Tables 5317 and 5318, respectively, the sequences themselves are given at the end of the application. The selected protein variants are given in Table 5319.

TABLE 5317

Transcripts of interest
Transcript Name

R34187_T9 (SEQ ID NO: 4225)
R34187_T10 (SEQ ID NO: 4226)

TABLE 5318

Segments of interest
Segment Name

R34187_node_0 (SEQ ID NO: 5784)
R34187_node_6 (SEQ ID NO: 5785)
R34187_node_14 (SEQ ID NO: 5786)
R34187_node_4 (SEQ ID NO: 5787)
R34187_node_8 (SEQ ID NO: 5788)
R34187_node_10 (SEQ ID NO: 5789)
R34187_node_12 (SEQ ID NO: 5790)

TABLE 5319

Proteins of interest

| Protein Name | Corresponding Transcript(s) |
|---|---|
| R34187_P4 | R34187_T9 (SEQ ID NO: 4225) |
| R34187_P5 | R34187_T10 (SEQ ID NO: 4226) |

Cluster R34187 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 128 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 128 and Table 5320. This cluster is overexpressed (at least at a minimum level) in the following pathological conditions: brain malignant tumors, epithelial malignant tumors, a mixture of malignant tumors from different tissues and hepatocellular carcinoma.

TABLE 5320

Normal tissue distribution

| Name of Tissue | Number |
|---|---|
| adrenal | 0 |
| Bone | 0 |
| Brain | 5 |
| epithelial | 0 |
| general | 1 |
| kidney | 2 |
| Liver | 0 |
| Lung | 0 |
| Lymph nodes | 18 |
| bone marrow | 0 |
| muscle | 3 |
| pancreas | 0 |
| T cells | 0 |
| uterus | 0 |

TABLE 5321

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 5.3e−01 | 1.9 |
| bone | 3.3e−01 | 4.3e−01 | 4.0e−01 | 2.5 | 4.9e−01 | 1.9 |
| brain | 2.1e−01 | 2.3e−02 | 5.2e−01 | 1.8 | 1.8e−04 | 5.2 |
| epithelial | 4.2e−02 | 1.6e−03 | 2.8e−01 | 3.0 | 2.7e−05 | 8.7 |
| general | 1.5e−04 | 5.7e−10 | 1.8e−03 | 4.6 | 1.2e−20 | 15.7 |
| kidney | 7.1e−01 | 6.8e−01 | 5.8e−01 | 1.8 | 4.9e−01 | 1.8 |
| liver | 1.8e−01 | 1.9e−01 | 1 | 1.3 | 4.1e−03 | 3.3 |
| lung | 1 | 6.3e−01 | 1 | 1.0 | 6.2e−01 | 1.6 |
| lymph nodes | 5.1e−01 | 2.5e−01 | 4.9e−01 | 1.8 | 3.4e−02 | 2.4 |
| bone marrow | 1 | 6.7e−01 | 1 | 1.0 | 5.3e−01 | 1.9 |
| muscle | 9.2e−01 | 4.8e−01 | 1 | 0.8 | 2.3e−02 | 3.4 |
| pancreas | 1 | 4.4e−01 | 1 | 1.0 | 1.5e−01 | 2.8 |
| T cells | 1 | 6.7e−01 | 1 | 1.0 | 7.2e−01 | 1.4 |
| uterus | 4.7e−01 | 1.4e−01 | 6.6e−01 | 1.5 | 4.1e−01 | 2.0 |

As noted above, cluster R34187 features 7 segment(s), which were listed in Table 5318 above and for which the sequence(s) are given at the end of the application. These segment(s) are portions of nucleic acid sequence(s) which are described herein separately because they are of particular interest. A description of each segment according to the present invention is now provided.

Segment cluster R34187_node_0 (SEQ ID NO:5784) according to the present invention is supported by 10 libraries. The number of libraries was determined as previously described. This segment can be found in the following transcript(s): R34187_T9 (SEQ ID NO:4225) and R34187_T10 (SEQ ID NO:4226). Table 5322 below describes the starting and ending position of this segment on each transcript.

TABLE 5322

Segment location on transcripts

| Transcript name | Segment starting position | Segment ending position |
|---|---|---|
| R34187_T9 (SEQ ID NO: 4225) | 1 | 485 |
| R34187_T10 (SEQ ID NO: 4226) | 1 | 485 |

This segment can be found in the following protein(s): R34187_P4 and R34187_P5.

Segment cluster R34187_node_6 (SEQ ID NO:5785) according to the present invention is supported by 1 libraries. The number of libraries was determined as previously described. This segment can be found in the following transcript(s): R34187_T10 (SEQ ID NO:4226). Table 5323 below describes the starting and ending position of this segment on each transcript.

TABLE 5323

Segment location on transcripts

| Transcript name | Segment starting position | Segment ending position |
|---|---|---|
| R34187_T10 (SEQ ID NO: 4226) | 547 | 746 |

This segment can be found in the following protein(s): R34187_P5.

Segment cluster R34187_node_14 (SEQ ID NO:5786) according to the present invention is supported by 1 libraries. The number of libraries was determined as previously described. This segment can be found in the following transcript(s): R34187_T9 (SEQ ID NO:4225). Table 5324 below describes the starting and ending position of this segment on each transcript.

TABLE 5324

Segment location on transcripts

| Transcript name | Segment starting position | Segment ending position |
|---|---|---|
| R34187_T9 (SEQ ID NO: 4225) | 712 | 1096 |

This segment can be found in the following protein(s): R34187_P4.

According to an optional embodiment of the present invention, short segments related to the above cluster are also provided. These segments are up to about 120 bp in length, and so are included in a separate description.

Segment cluster R34187_node_4 (SEQ ID NO:5787) according to the present invention is supported by 9 libraries. The number of libraries was determined as previously described. This segment can be found in the following transcript(s): R34187_T9 (SEQ ID NO:4225) and R34187_T10 (SEQ ID NO:4226). Table 5325 below describes the starting and ending position of this segment on each transcript.

TABLE 5325

| Transcript name | Segment location on transcripts | |
|---|---|---|
| | Segment starting position | Segment ending position |
| R34187_T9 (SEQ ID NO: 4225) | 486 | 546 |
| R34187_T10 (SEQ ID NO: 4226) | 486 | 546 |

This segment can be found in the following protein(s): R34187_P4 and R34187_P5.

Segment cluster R34187_node_8 (SEQ ID NO:5788) according to the present invention is supported by 7 libraries. The number of libraries was determined as previously described. This segment can be found in the following transcript(s): R34187_T9 (SEQ ID NO:4225). Table 5326 below describes the starting and ending position of this segment on each transcript.

TABLE 5326

| Transcript name | Segment location on transcripts | |
|---|---|---|
| | Segment starting position | Segment ending position |
| R34187_T9 (SEQ ID NO: 4225) | 547 | 595 |

This segment can be found in the following protein(s): R34187_P4.

Segment cluster R34187_node_10 (SEQ ID NO:5789) according to the present invention is supported by 7 libraries. The number of libraries was determined as previously described. This segment can be found in the following transcript(s): R34187_T9 (SEQ ID NO:4225). Table 5327 below describes the starting and ending position of this segment on each transcript.

TABLE 5327

| Transcript name | Segment location on transcripts | |
|---|---|---|
| | Segment starting position | Segment ending position |
| R34187_T9 (SEQ ID NO: 4225) | 596 | 647 |

This segment can be found in the following protein(s): R34187_P4.

Segment cluster R34187_node_12 (SEQ ID NO:5790) according to the present invention is supported by 8 libraries. The number of libraries was determined as previously described. This segment can be found in the following transcript(s): R34187_T9 (SEQ ID NO:4225). Table 5328 below describes the starting and ending position of this segment on each transcript.

TABLE 5328

| Transcript name | Segment location on transcripts | |
|---|---|---|
| | Segment starting position | Segment ending position |
| R34187_T9 (SEQ ID NO: 4225) | 648 | 711 |

This segment can be found in the following protein(s): R34187_P4.

Description for Cluster S56200

Cluster S56200 features transcript(s) and 23 segment(s) of interest, the names for which are given in Tables 5329 and 5330, respectively, the sequences themselves are given at the end of the application. The selected protein variants are given in Table 5331.

TABLE 5329

Transcripts of interest
Transcript Name

S56200_PEA_1_T8 (SEQ ID NO: 4227)

TABLE 5330

Segments of interest
Segment Name

S56200_PEA_1_node_1 (SEQ ID NO: 5791)
S56200_PEA_1_node_2 (SEQ ID NO: 5792)
S56200_PEA_1_node_7 (SEQ ID NO: 5793)
S56200_PEA_1_node_11 (SEQ ID NO: 5794)
S56200_PEA_1_node_13 (SEQ ID NO: 5795)
S56200_PEA_1_node_15 (SEQ ID NO: 5796)
S56200_PEA_1_node_17 (SEQ ID NO: 5797)
S56200_PEA_1_node_29 (SEQ ID NO: 5798)
S56200_PEA_1_node_30 (SEQ ID NO: 5799)
S56200_PEA_1_node_35 (SEQ ID NO: 5800)
S56200_PEA_1_node_39 (SEQ ID NO: 5801)
S56200_PEA_1_node_40 (SEQ ID NO: 5802)
S56200_PEA_1_node_43 (SEQ ID NO: 5803)
S56200_PEA_1_node_0 (SEQ ID NO: 5804)
S56200_PEA_1_node_4 (SEQ ID NO: 5805)
S56200_PEA_1_node_21 (SEQ ID NO: 5806)
S56200_PEA_1_node_22 (SEQ ID NO: 5807)
S56200_PEA_1_node_28 (SEQ ID NO: 5808)
S56200_PEA_1_node_31 (SEQ ID NO: 5809)
S56200_PEA_1_node_32 (SEQ ID NO: 5810)
S56200_PEA_1_node_36 (SEQ ID NO: 5811)
S56200_PEA_1_node_38 (SEQ ID NO: 5812)
S56200_PEA_1_node_41 (SEQ ID NO: 5813)

TABLE 5331

Proteins of interest

| Protein Name | Corresponding Transcript(s) |
|---|---|
| S56200_PEA_1_P7 | S56200_PEA_1_T8 (SEQ ID NO: 4227) |

These sequences are variants of the known protein Myeloperoxidase precursor (SwissProt accession identifier PERM_HUMAN; known also according to the synonyms EC 1.11.1.7; MPO), referred to herein as the previously known protein.

Protein Myeloperoxidase precursor is known or believed to have the following function(s): Part of the host defense system of polymorphonuclear leukocytes. It is responsible for microbicidal activity against a wide range of organisms. In the stimulated PMN, MPO catalyzes the production of hypohalous acids, primarily hypochlorous acid in physiologic situations, and other toxic intermediates that greatly enhance PMN microbicidal activity. The sequence for protein Myeloperoxidase precursor is given at the end of the application, as "Myeloperoxidase precursor amino acid sequence". Known polymorphisms for this sequence are as shown in Table 5332.

TABLE 5332

Amino acid mutations for Known Protein

| SNP position(s) on amino acid sequence | Comment |
|---|---|
| 173 | Y -> C (in MPD; affects proteolytic processing and secretion). /FTId = VAR_015377. |
| 251 | M -> T (in MPD). /FTId = VAR_015378. |
| 569 | R -> W (in MPD; suppress posttranslational processing). /FTId = VAR_015379. |
| 717 | I -> V (in dbSNP:2759). /FTId = VAR_012066. |
| 36 | L -> V |

Protein Myeloperoxidase precursor localization is believed to be Lysosomal.

The following GO Annotation(s) apply to the previously known protein. The following annotation(s) were found: anti-apoptosis; defense response; oxidative stress response, which are annotation(s) related to Biological Process; chromatin binding; peroxidase; calcium binding; oxidoreductase, which are annotation(s) related to Molecular Function; and nucleus; lysosome, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 5333.

TABLE 5333

Oligonucleotides related to this cluster

| Oligonucleotide name | Overexpressed in cancers | Chip reference |
|---|---|---|
| S56200_0_0_34634 | colorectal cancer | Colon |
| S56200_0_0_34645 | lung malignant tumors | LUN |

As noted above, cluster S56200 features 23 segment(s), which were listed in Table 5330 above and for which the sequence(s) are given at the end of the application. These segment(s) are portions of nucleic acid sequence(s) which are described herein separately because they are of particular interest. A description of each segment according to the present invention is now provided.

Segment cluster S56200_PEA_1_node_1 (SEQ ID NO:5791) according to the present invention is supported by 19 libraries. The number of libraries was determined as previously described. This segment can be found in the following transcript(s): S56200_PEA_1_T8 (SEQ ID NO:4227). Table 5334 below describes the starting and ending position of this segment on each transcript.

TABLE 5334

Segment location on transcripts

| Transcript name | Segment starting position | Segment ending position |
|---|---|---|
| S56200_PEA_1_T8 (SEQ ID NO: 4227) | 30 | 224 |

This segment can be found in the following protein(s): S56200_PEA_1_P7.

Segment cluster S56200_PEA_1_node_2 (SEQ ID NO:5792) according to the present invention is supported by 23 libraries. The number of libraries was determined as previously described. This segment can be found in the following transcript(s): S56200_PEA_1_T8 (SEQ ID NO:4227). Table 5335 below describes the starting and ending position of this segment on each transcript.

TABLE 5335

Segment location on transcripts

| Transcript name | Segment starting position | Segment ending position |
|---|---|---|
| S56200_PEA_1_T8 (SEQ ID NO: 4227) | 225 | 349 |

This segment can be found in the following protein(s): S56200_PEA_1_P7.

Segment cluster S56200_PEA_1_node_7 (SEQ ID NO:5793) according to the present invention is supported by 37 libraries. The number of libraries was determined as previously described. This segment can be found in the following transcript(s): S56200_PEA_1_T8 (SEQ ID NO:4227). Table 5336 below describes the starting and ending position of this segment on each transcript.

TABLE 5336

Segment location on transcripts

| Transcript name | Segment starting position | Segment ending position |
|---|---|---|
| S56200_PEA_1_T8 (SEQ ID NO: 4227) | 444 | 619 |

This segment can be found in the following protein(s): S56200_PEA_1_P7.

Segment cluster S56200_PEA_1_node_11 (SEQ ID NO:5794) according to the present invention is supported by 34 libraries. The number of libraries was determined as previously described. This segment can be found in the following transcript(s): S56200_PEA_1_T8 (SEQ ID NO:4227). Table 5337 below describes the starting and ending position of this segment on each transcript.

TABLE 5337

Segment location on transcripts

| Transcript name | Segment starting position | Segment ending position |
|---|---|---|
| S56200_PEA_1_T8 (SEQ ID NO: 4227) | 620 | 743 |

This segment can be found in the following protein(s): S56200_PEA_1_P7.

Segment cluster S56200_PEA_1_node_13 (SEQ ID NO:5795) according to the present invention is supported by 39 libraries. The number of libraries was determined as previously described. This segment can be found in the following transcript(s): S56200_PEA_1_T8 (SEQ ID NO:4227). Table 5338 below describes the starting and ending position of this segment on each transcript.

TABLE 5338

| | Segment location on transcripts | |
|---|---|---|
| Transcript name | Segment starting position | Segment ending position |
| S56200_PEA_1_T8 (SEQ ID NO: 4227) | 744 | 873 |

This segment can be found in the following protein(s): S56200_PEA_1_P7.

Segment cluster S56200_PEA_1_node_15 (SEQ ID NO:5796) according to the present invention is supported by 44 libraries. The number of libraries was determined as previously described. This segment can be found in the following transcript(s): S56200_PEA_1_T8 (SEQ ID NO:4227). Table 5339 below describes the starting and ending position of this segment on each transcript.

TABLE 5339

| | Segment location on transcripts | |
|---|---|---|
| Transcript name | Segment starting position | Segment ending position |
| S56200_PEA_1_T8 (SEQ ID NO: 4227) | 874 | 1080 |

This segment can be found in the following protein(s): S56200_PEA_1_P7.

Segment cluster S56200_PEA_1_node_17 (SEQ ID NO:5797) according to the present invention is supported by 46 libraries. The number of libraries was determined as previously described. This segment can be found in the following transcript(s): S56200_PEA_1_T8 (SEQ ID NO:4227). Table 5340 below describes the starting and ending position of this segment on each transcript.

TABLE 5340

| | Segment location on transcripts | |
|---|---|---|
| Transcript name | Segment starting position | Segment ending position |
| S56200_PEA_1_T8 (SEQ ID NO: 4227) | 1081 | 1399 |

This segment can be found in the following protein(s): S56200_PEA_1_P7.

Segment cluster S56200_PEA_1_node_29 (SEQ ID NO:5798) according to the present invention is supported by 42 libraries. The number of libraries was determined as previously described. This segment can be found in the following transcript(s): S56200_PEA_1_T8 (SEQ ID NO:4227). Table 5341 below describes the starting and ending position of this segment on each transcript.

TABLE 5341

| | Segment location on transcripts | |
|---|---|---|
| Transcript name | Segment starting position | Segment ending position |
| S56200_PEA_1_T8 (SEQ ID NO: 4227) | 1591 | 1816 |

This segment can be found in the following protein(s): S56200_PEA_1_P7.

Segment cluster S56200_PEA_1_node_30 (SEQ ID NO:5799) according to the present invention is supported by 7 libraries. The number of libraries was determined as previously described. This segment can be found in the following transcript(s): S56200_PEA_1_T8 (SEQ ID NO:4227). Table 5342 below describes the starting and ending position of this segment on each transcript.

TABLE 5342

| | Segment location on transcripts | |
|---|---|---|
| Transcript name | Segment starting position | Segment ending position |
| S56200_PEA_1_T8 (SEQ ID NO: 4227) | 1817 | 2311 |

This segment can be found in the following protein(s): S56200_PEA_1_P7.

Segment cluster S56200_PEA_1_node_35 (SEQ ID NO:5800) according to the present invention is supported by 37 libraries. The number of libraries was determined as previously described. This segment can be found in the following transcript(s): S56200_PEA_1_T8 (SEQ ID NO:4227). Table 5343 below describes the starting and ending position of this segment on each transcript.

TABLE 5343

| | Segment location on transcripts | |
|---|---|---|
| Transcript name | Segment starting position | Segment ending position |
| S56200_PEA_1_T8 (SEQ ID NO: 4227) | 2483 | 2686 |

This segment can be found in a non-coding region of transcript(s) that are related to the following protein(s): S56200_PEA_1_P7.

Segment cluster S56200_PEA_1_node_39 (SEQ ID NO:5801) according to the present invention is supported by 39 libraries. The number of libraries was determined as previously described. This segment can be found in the following transcript(s): S56200_PEA_1_T8 (SEQ ID NO:4227). Table 5344 below describes the starting and ending position of this segment on each transcript.

TABLE 5344

| | Segment location on transcripts | |
|---|---|---|
| Transcript name | Segment starting position | Segment ending position |
| S56200_PEA_1_T8 (SEQ ID NO: 4227) | 2779 | 2972 |

This segment can be found in a non-coding region of transcript(s) that are related to the following protein(s): S56200_PEA_1_P7.

Segment cluster S56200_PEA_1_node_40 (SEQ ID NO:5802) according to the present invention is supported by 47 libraries. The number of libraries was determined as previously described. This segment can be found in the following transcript(s): S56200_PEA_1_T8 (SEQ ID NO:4227). Table 5345 below describes the starting and ending position of this segment on each transcript.

TABLE 5345

Segment location on transcripts

| Transcript name | Segment starting position | Segment ending position |
| --- | --- | --- |
| S56200_PEA_1_T8 (SEQ ID NO: 4227) | 2973 | 3254 |

This segment can be found in a non-coding region of transcript(s) that are related to the following protein(s): S56200_PEA_1_P7.

Segment cluster S56200_PEA_1_node_43 (SEQ ID NO:5803) according to the present invention is supported by 35 libraries. The number of libraries was determined as previously described. This segment can be found in the following transcript(s): S56200_PEA_1_T8 (SEQ ID NO:4227). Table 5346 below describes the starting and ending position of this segment on each transcript.

TABLE 5346

Segment location on transcripts

| Transcript name | Segment starting position | Segment ending position |
| --- | --- | --- |
| S56200_PEA_1_T8 (SEQ ID NO: 4227) | 3364 | 3723 |

This segment can be found in a non-coding region of transcript(s) that are related to the following protein(s): S56200_PEA_1_P7.

According to an optional embodiment of the present invention, short segments related to the above cluster are also provided. These segments are up to about 120 bp in length, and so are included in a separate description.

Segment cluster S56200_PEA_1_node_0 (SEQ ID NO:5804) according to the present invention is supported by I libraries. The number of libraries was determined as previously described. This segment can be found in the following transcript(s): S56200_PEA_1_T8 (SEQ ID NO:4227). Table 5347 below describes the starting and ending position of this segment on each transcript.

TABLE 5347

Segment location on transcripts

| Transcript name | Segment starting position | Segment ending position |
| --- | --- | --- |
| S56200_PEA_1_T8 (SEQ ID NO: 4227) | 1 | 29 |

This segment can be found in a non-coding region of transcript(s) that are related to the following protein(s): S56200_PEA_1_P7.

Segment cluster S56200_PEA_1_node_4 (SEQ ID NO:5805) according to the present invention is supported by 29 libraries. The number of libraries was determined as previously described. This segment can be found in the following transcript(s): S56200_PEA_1_T8 (SEQ ID NO:4227). Table 5348 below describes the starting and ending position of this segment on each transcript.

TABLE 5348

Segment location on transcripts

| Transcript name | Segment starting position | Segment ending position |
| --- | --- | --- |
| S56200_PEA_1_T8 (SEQ ID NO: 4227) | 350 | 443 |

This segment can be found in the following protein(s): S56200_PEA_1_P7.

Segment cluster S56200_PEA_1_node_21 (SEQ ID NO:5806) according to the present invention is supported by 31 libraries. The number of libraries was determined as previously described. This segment can be found in the following transcript(s): S56200_PEA_1_T8 (SEQ ID NO:4227). Table 5349 below describes the starting and ending position of this segment on each transcript.

TABLE 5349

Segment location on transcripts

| Transcript name | Segment starting position | Segment ending position |
| --- | --- | --- |
| S56200_PEA_1_T8 (SEQ ID NO: 4227) | 1400 | 1470 |

This segment can be found in the following protein(s): S56200_PEA_1_P7.

Segment cluster S56200_PEA_1_node_22 (SEQ ID NO:5807) according to the present invention is supported by 34 libraries. The number of libraries was determined as previously described. This segment can be found in the following transcript(s): S56200_PEA_1_T8 (SEQ ID NO:4227). Table 5350 below describes the starting and ending position of this segment on each transcript.

TABLE 5350

Segment location on transcripts

| Transcript name | Segment starting position | Segment ending position |
| --- | --- | --- |
| S56200_PEA_1_T8 (SEQ ID NO: 4227) | 1471 | 1560 |

This segment can be found in the following protein(s): S56200_PEA_1_P7.

Segment cluster S56200_PEA_1_node_28 (SEQ ID NO:5808) according to the present invention is supported by 34 libraries. The number of libraries was determined as previously described. This segment can be found in the following transcript(s): S56200_PEA_1_T8 (SEQ ID NO:4227). Table 5351 below describes the starting and ending position of this segment on each transcript.

TABLE 5351

Segment location on transcripts

| Transcript name | Segment starting position | Segment ending position |
|---|---|---|
| S56200_PEA_1_T8 (SEQ ID NO: 4227) | 1561 | 1590 |

This segment can be found in the following protein(s): S56200_PEA_1_P7.

Segment cluster S56200_PEA_1_node_31 (SEQ ID NO:5809) according to the present invention is supported by 30 libraries. The number of libraries was determined as previously described. This segment can be found in the following transcript(s): S56200_PEA_1_T8 (SEQ ID NO:4227). Table 5352 below describes the starting and ending position of this segment on each transcript.

TABLE 5352

Segment location on transcripts

| Transcript name | Segment starting position | Segment ending position |
|---|---|---|
| S56200_PEA_1_T8 (SEQ ID NO: 4227) | 2312 | 2415 |

This segment can be found in a non-coding region of transcript(s) that are related to the following protein(s): S56200_PEA_1_P7.

Segment cluster S56200_PEA_1_node_32 (SEQ ID NO:5810) according to the present invention is supported by 25 libraries. The number of libraries was determined as previously described. This segment can be found in the following transcript(s): S56200_PEA_1_T8 (SEQ ID NO:4227). Table 5353 below describes the starting and ending position of this segment on each transcript.

TABLE 5353

Segment location on transcripts

| Transcript name | Segment starting position | Segment ending position |
|---|---|---|
| S56200_PEA_1_T8 (SEQ ID NO: 4227) | 2416 | 2482 |

This segment can be found in a non-coding region of transcript(s) that are related to the following protein(s): S56200_PEA_1_P7.

Segment cluster S56200_PEA_1_node_36 (SEQ ID NO:5811) according to the present invention is supported by 32 libraries. The number of libraries was determined as previously described. This segment can be found in the following transcript(s): S56200_PEA_1_T8 (SEQ ID NO:4227). Table 5354 below describes the starting and ending position of this segment on each transcript.

TABLE 5354

Segment location on transcripts

| Transcript name | Segment starting position | Segment ending position |
|---|---|---|
| S56200_PEA_1_T8 (SEQ ID NO: 4227) | 2687 | 2720 |

This segment can be found in a non-coding region of transcript(s) that are related to the following protein(s): S56200_PEA_1_P7.

Segment cluster S56200_PEA_1_node_38 (SEQ ID NO:5812) according to the present invention is supported by 35 libraries. The number of libraries was determined as previously described. This segment can be found in the following transcript(s): S56200_PEA_1_T8 (SEQ ID NO:4227). Table 5355 below describes the starting and ending position of this segment on each transcript.

TABLE 5355

Segment location on transcripts

| Transcript name | Segment starting position | Segment ending position |
|---|---|---|
| S56200_PEA_1_T8 (SEQ ID NO: 4227) | 2721 | 2778 |

This segment can be found in a non-coding region of transcript(s) that are related to the following protein(s): S56200_PEA_1_P7.

Segment cluster S56200_PEA_1_node_41 (SEQ ID NO:5813) according to the present invention is supported by 31 libraries. The number of libraries was determined as previously described. This segment can be found in the following transcript(s): S56200_PEA_1_T8 (SEQ ID NO:4227). Table 5356 below describes the starting and ending position of this segment on each transcript.

TABLE 5356

Segment location on transcripts

| Transcript name | Segment starting position | Segment ending position |
|---|---|---|
| S56200_PEA_1_T8 (SEQ ID NO: 4227) | 3255 | 3363 |

This segment can be found in a non-coding region of transcript(s) that are related to the following protein(s): S56200_PEA_1_P7.

Description for Cluster S95936

Cluster S95936 features 1 transcript(s) and 64 segment(s) of interest, the names for which are given in Tables 5357 and 5358, respectively, the sequences themselves are given at the end of the application. The selected protein variants are given in Table 5359.

TABLE 5357

Transcripts of interest
Transcript Name

S95936_PEA_1_T10 (SEQ ID NO: 4228)

TABLE 5358

Segments of interest
Segment Name

S95936_PEA_1_node_22 (SEQ ID NO: 5814)
S95936_PEA_1_node_69 (SEQ ID NO: 5815)
S95936_PEA_1_node_104 (SEQ ID NO: 5816)
S95936_PEA_1_node_9 (SEQ ID NO: 5817)
S95936_PEA_1_node_11 (SEQ ID NO: 5818)
S95936_PEA_1_node_12 (SEQ ID NO: 5819)
S95936_PEA_1_node_13 (SEQ ID NO: 5820)
S95936_PEA_1_node_14 (SEQ ID NO: 5821)
S95936_PEA_1_node_15 (SEQ ID NO: 5822)
S95936_PEA_1_node_16 (SEQ ID NO: 5823)
S95936_PEA_1_node_17 (SEQ ID NO: 5824)
S95936_PEA_1_node_19 (SEQ ID NO: 5825)
S95936_PEA_1_node_20 (SEQ ID NO: 5826)
S95936_PEA_1_node_21 (SEQ ID NO: 5827)
S95936_PEA_1_node_23 (SEQ ID NO: 5828)
S95936_PEA_1_node_24 (SEQ ID NO: 5829)
S95936_PEA_1_node_25 (SEQ ID NO: 5830)
S95936_PEA_1_node_26 (SEQ ID NO: 5831)
S95936_PEA_1_node_27 (SEQ ID NO: 5832)
S95936_PEA_1_node_28 (SEQ ID NO: 5833)
S95936_PEA_1_node_29 (SEQ ID NO: 5834)
S95936_PEA_1_node_30 (SEQ ID NO: 5835)
S95936_PEA_1_node_32 (SEQ ID NO: 5836)
S95936_PEA_1_node_33 (SEQ ID NO: 5837)
S95936_PEA_1_node_37 (SEQ ID NO: 5838)
S95936_PEA_1_node_38 (SEQ ID NO: 5839)
S95936_PEA_1_node_40 (SEQ ID NO: 5840)
S95936_PEA_1_node_41 (SEQ ID NO: 5841)
S95936_PEA_1_node_42 (SEQ ID NO: 5842)
S95936_PEA_1_node_45 (SEQ ID NO: 5843)
S95936_PEA_1_node_46 (SEQ ID NO: 5844)
S95936_PEA_1_node_47 (SEQ ID NO: 5845)
S95936_PEA_1_node_48 (SEQ ID NO: 5846)
S95936_PEA_1_node_49 (SEQ ID NO: 5847)
S95936_PEA_1_node_50 (SEQ ID NO: 5848)
S95936_PEA_1_node_51 (SEQ ID NO: 5849)
S95936_PEA_1_node_53 (SEQ ID NO: 5850)
S95936_PEA_1_node_54 (SEQ ID NO: 5851)
S95936_PEA_1_node_55 (SEQ ID NO: 5852)
S95936_PEA_1_node_65 (SEQ ID NO: 5853)
S95936_PEA_1_node_67 (SEQ ID NO: 5854)
S95936_PEA_1_node_70 (SEQ ID NO: 5855)
S95936_PEA_1_node_71 (SEQ ID NO: 5856)
S95936_PEA_1_node_74 (SEQ ID NO: 5857)
S95936_PEA_1_node_75 (SEQ ID NO: 5858)
S95936_PEA_1_node_76 (SEQ ID NO: 5859)
S95936_PEA_1_node_79 (SEQ ID NO: 5860)
S95936_PEA_1_node_80 (SEQ ID NO: 5861)
S95936_PEA_1_node_81 (SEQ ID NO: 5862)
S95936_PEA_1_node_86 (SEQ ID NO: 5863)
S95936_PEA_1_node_87 (SEQ ID NO: 5864)
S95936_PEA_1_node_88 (SEQ ID NO: 5865)
S95936_PEA_1_node_89 (SEQ ID NO: 5866)
S95936_PEA_1_node_90 (SEQ ID NO: 5867)
S95936_PEA_1_node_91 (SEQ ID NO: 5868)
S95936_PEA_1_node_92 (SEQ ID NO: 5869)
S95936_PEA_1_node_93 (SEQ ID NO: 5870)
S95936_PEA_1_node_94 (SEQ ID NO: 5871)
S95936_PEA_1_node_97 (SEQ ID NO: 5872)
S95936_PEA_1_node_98 (SEQ ID NO: 5873)
S95936_PEA_1_node_99 (SEQ ID NO: 5874)
S95936_PEA_1_node_100 (SEQ ID NO: 5875)
S95936_PEA_1_node_102 (SEQ ID NO: 5876)
S95936_PEA_1_node_103 (SEQ ID NO: 5877)

TABLE 5359

Proteins of interest

| Protein Name | Corresponding Transcript(s) |
|---|---|
| S95936_PEA_1_P4 | S95936_PEA_1_T10 (SEQ ID NO: 4228) |

These sequences are variants of the known protein Serotransferrin precursor (SwissProt accession identifier TRFE_HUMAN; known also according to the synonyms Transferrin; Siderophilin; Beta-1-metal binding globulin; PRO1400), referred to herein as the previously known protein.

Protein Serotransferrin precursor is known or believed to have the following function(s): Transferrins are iron binding transport proteins which can bind two atoms of ferric iron in association with the binding of an anion, usually bicarbonate. It is responsible for the transport of iron from sites of absorption and heme degradation to those of storage and utilization. Serum transferrin may also have a further role in stimulating cell proliferation. The sequence for protein Serotransferrin precursor is given at the end of the application, as "Serotransferrin precursor amino acid sequence". Known polymorphisms for this sequence are as shown in Table 5360.

TABLE 5360

Amino acid mutations for Known Protein

| SNP position(s) on amino acid sequence | Comment |
|---|---|
| 142 | G -> S (in dbSNP: 1799830). /FTId = VAR_011997. |
| 277 | G -> S (in allele TF*C3; dbSNP: 1799899; associated with a reduction in total iron binding capacity; risk factor for iron deficiency anemia in menstruating white women). /FTId = VAR_011998. |
| 296 | D -> G (in allele TF*D1). /FTId = VAR_007544. |
| 319 | H -> R (in allele TF*CHI). /FTId = VAR_007545. |
| 377 | W -> C (in dbSNP: 1804498). /FTId = VAR_011999. |
| 477 | A -> P (in atransferrinemia). /FTId = VAR_012997. |
| 589 | P -> S (in allele TF*C2; dbSNP: 1049296). /FTId = VAR_012000. |
| 645 | T -> P (in dbSNP: 1130537). /FTId = VAR_012001. |
| 646 | K -> E (in allele TF*BV). /FTId = VAR_012998. |
| 671 | G -> E (in allele TF*B2). /FTId = VAR_012999. |
| 216 | D -> N |
| 264 | Q -> E |
| 329 | D -> N |
| 351 | P -> Q |
| 380-381 | NS -> SD |
| 436 | N -> D |
| 558-561 | PQNT -> TQNP |
| 591 | E -> Q |
| 672 | E -> Q |
| 691 | E -> G |

Protein Serotransferrin precursor localization is believed to be Secreted.

The following GO Annotation(s) apply to the previously known protein. The following annotation(s) were found: transport; iron transport; iron homeostasis, which are annotation(s) related to Biological Process; ferric iron binding, which are annotation(s) related to Molecular Function; and extracellular space, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster S95936 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 129 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 129 and Table 5361. This cluster is overexpressed (at least at a minimum level) in the following pathological conditions: pancreas carcinoma.

TABLE 5361

Normal tissue distribution

| Name of Tissue | Number |
|---|---|
| brain | 699 |
| epithelial | 190 |
| general | 207 |
| head and neck | 101 |
| liver | 5313 |
| lung | 15 |
| lymph nodes | 0 |
| pancreas | 0 |
| prostate | 42 |
| uterus | 0 |

TABLE 5362

P values and ratios for expression in cancerous tissue

| Name of Tissue | P1 | P2 | SP1 | R3 | SP2 | R4 |
|---|---|---|---|---|---|---|
| brain | 6.4e−01 | 6.3e−01 | 1 | 0.1 | 1 | 0.1 |
| epithelial | 9.3e−01 | 9.6e−01 | 1 | 0.2 | 1 | 0.3 |
| general | 9.3e−01 | 9.3e−01 | 1 | 0.2 | 1 | 0.2 |
| head and neck | 4.6e−01 | 6.2e−01 | 1 | 0.6 | 1 | 0.5 |
| liver | 1 | 6.6e−01 | 9.9e−01 | 0.2 | 1 | 0.2 |
| lung | 7.9e−01 | 9.1e−01 | 1 | 0.9 | 1 | 0.6 |
| lymph nodes | 3.1e−01 | 1.7e−01 | 2.9e−01 | 3.5 | 1.9e−01 | 3.3 |
| pancreas | 3.3e−01 | 4.4e−01 | 1.1e−06 | 3.7 | 3.5e−05 | 2.8 |
| prostate | 9.0e−01 | 9.0e−01 | 9.6e−01 | 0.5 | 7.4e−02 | 0.7 |
| uterus | 4.7e−01 | 6.4e−01 | 6.6e−01 | 1.5 | 8.0e−01 | 1.2 |

As noted above, cluster S95936 features 64 segment(s), which were listed in Table 5358 above and for which the sequence(s) are given at the end of the application. These segment(s) are portions of nucleic acid sequence(s) which are described herein separately because they are of particular interest. A description of each segment according to the present invention is now provided.

Segment cluster S95936_PEA_1_node_22 (SEQ ID NO:5814) according to the present invention is supported by 5 libraries. The number of libraries was determined as previously described. This segment can be found in the following transcript(s): S95936_PEA_1_T10 (SEQ ID NO:4228). Table 5363 below describes the starting and ending position of this segment on each transcript.

TABLE 5363

Segment location on transcripts

| Transcript name | Segment starting position | Segment ending position |
|---|---|---|
| S95936_PEA_1_T10 (SEQ ID NO: 4228) | 359 | 1040 |

This segment can be found in a non-coding region of transcript(s) that are related to the following protein(s): S95936_PEA_1_P4.

Segment cluster S95936_PEA_1_node_69 (SEQ ID NO:5815) according to the present invention is supported by 131 libraries. The number of libraries was determined as previously described. This segment can be found in the following transcript(s): S95936_PEA_1_T10 (SEQ ID NO:4228). Table 5364 below describes the starting and ending position of this segment on each transcript.

TABLE 5364

Segment location on transcripts

| Transcript name | Segment starting position | Segment ending position |
|---|---|---|
| S95936_PEA_1_T10 (SEQ ID NO: 4228) | 2155 | 2290 |

This segment can be found in the following protein(s): S95936_PEA_1_P4.

Segment cluster S95936_PEA_1_node_104 (SEQ ID NO:5816) according to the present invention is supported by 95 libraries. The number of libraries was determined as previously described. This segment can be found in the following transcript(s): S95936_PEA_1_T10 (SEQ ID NO:4228). Table 5365 below describes the starting and ending position of this segment on each transcript.

TABLE 5365

Segment location on transcripts

| Transcript name | Segment starting position | Segment ending position |
|---|---|---|
| S95936_PEA_1_T10 (SEQ ID NO: 4228) | 2972 | 3093 |

This segment can be found in a non-coding region of transcript(s) that are related to the following protein(s): S95936_PEA_1_P4.

According to an optional embodiment of the present invention, short segments related to the above cluster are also provided. These segments are up to about 120 bp in length, and so are included in a separate description.

Segment cluster S95936_PEA_1_node_9 (SEQ ID NO:5817) according to the present invention is supported by 3 libraries. The number of libraries was determined as previously described. This segment can be found in the following transcript(s): S95936_PEA_1_T10 (SEQ ID NO:4228). Table 5366 below describes the starting and ending position of this segment on each transcript.

TABLE 5366

Segment location on transcripts

| Transcript name | Segment starting position | Segment ending position |
|---|---|---|
| S95936_PEA_1_T10 (SEQ ID NO: 4228) | 1 | 76 |

This segment can be found in a non-coding region of transcript(s) that are related to the following protein(s): S95936_PEA_1_P4.

Segment cluster S95936_PEA_1_node_11 (SEQ ID NO:5818) according to the present invention can be found in the following transcript(s): S95936_PEA_1_T10 (SEQ ID NO:4228). Table 5367 below describes the starting and ending position of this segment on each transcript.

TABLE 5367

Segment location on transcripts

| Transcript name | Segment starting position | Segment ending position |
|---|---|---|
| S95936_PEA_1_T10 (SEQ ID NO: 4228) | 77 | 94 |

This segment can be found in a non-coding region of transcript(s) that are related to the following protein(s): S95936_PEA_1_P4.

Segment cluster S95936_PEA_1_node_12 (SEQ ID NO:5819) according to the present invention can be found in the following transcript(s): S95936_PEA_1_T10 (SEQ ID NO:4228). Table 5368 below describes the starting and ending position of this segment on each transcript.

TABLE 5368

Segment location on transcripts

| Transcript name | Segment starting position | Segment ending position |
|---|---|---|
| S95936_PEA_1_T10 (SEQ ID NO: 4228) | 95 | 113 |

This segment can be found in a non-coding region of transcript(s) that are related to the following protein(s): S95936_PEA_1_P4.

Segment cluster S95936_PEA_1_node_13 (SEQ ID NO:5820) according to the present invention is supported by 88 libraries. The number of libraries was determined as previously described. This segment can be found in the following transcript(s): S95936_PEA_1_T10 (SEQ ID NO:4228). Table 5369 below describes the starting and ending position of this segment on each transcript.

TABLE 5369

Segment location on transcripts

| Transcript name | Segment starting position | Segment ending position |
|---|---|---|
| S95936_PEA_1_T10 (SEQ ID NO: 4228) | 114 | 151 |

This segment can be found in a non-coding region of transcript(s) that are related to the following protein(s): S95936_PEA_1_P4.

Segment cluster S95936_PEA_1_node_14 (SEQ ID NO:5821) according to the present invention is supported by 87 libraries. The number of libraries was determined as previously described. This segment can be found in the following transcript(s): S95936_PEA_1_T10 (SEQ ID NO:4228). Table 5370 below describes the starting and ending position of this segment on each transcript.

TABLE 5370

Segment location on transcripts

| Transcript name | Segment starting position | Segment ending position |
|---|---|---|
| S95936_PEA_1_T10 (SEQ ID NO: 4228) | 152 | 187 |

This segment can be found in a non-coding region of transcript(s) that are related to the following protein(s): S95936_PEA_1_P4.

Segment cluster S95936_PEA_1_node_15 (SEQ ID NO:5822) according to the present invention can be found in the following transcript(s): S95936_PEA_1_T10 (SEQ ID NO:4228). Table 5371 below describes the starting and ending position of this segment on each transcript.

TABLE 5371

Segment location on transcripts

| Transcript name | Segment starting position | Segment ending position |
|---|---|---|
| S95936_PEA_1_T10 (SEQ ID NO: 4228) | 188 | 196 |

This segment can be found in a non-coding region of transcript(s) that are related to the following protein(s): S95936_PEA_1_P4.

Segment cluster S95936_PEA_1_node_16 (SEQ ID NO:5823) according to the present invention can be found in the following transcript(s): S95936_PEA_1_T10 (SEQ ID NO:4228). Table 5372 below describes the starting and ending position of this segment on each transcript.

TABLE 5372

Segment location on transcripts

| Transcript name | Segment starting position | Segment ending position |
|---|---|---|
| S95936_PEA_1_T10 (SEQ ID NO: 4228) | 197 | 202 |

This segment can be found in a non-coding region of transcript(s) that are related to the following protein(s): S95936_PEA_1_P4.

Segment cluster S95936_PEA_1_node_17 (SEQ ID NO:5824) according to the present invention is supported by 88 libraries. The number of libraries was determined as previously described. This segment can be found in the following transcript(s): S95936_PEA_1_T10 (SEQ ID NO:4228). Table 5373 below describes the starting and ending position of this segment on each transcript.

TABLE 5373

Segment location on transcripts

| Transcript name | Segment starting position | Segment ending position |
|---|---|---|
| S95936_PEA_1_T10 (SEQ ID NO: 4228) | 203 | 249 |

This segment can be found in a non-coding region of transcript(s) that are related to the following protein(s): S95936_PEA_1_P4.

Segment cluster S95936_PEA_1_node_19 (SEQ ID NO:5825) according to the present invention is supported by 82 libraries. The number of libraries was determined as previously described. This segment can be found in the following transcript(s): S95936_PEA_1_T10 (SEQ ID NO:4228). Table 5374 below describes the starting and ending position of this segment on each transcript.

TABLE 5374

Segment location on transcripts

| Transcript name | Segment starting position | Segment ending position |
|---|---|---|
| S95936_PEA_1_T10 (SEQ ID NO: 4228) | 250 | 318 |

This segment can be found in a non-coding region of transcript(s) that are related to the following protein(s): S95936_PEA_1_P4.

Segment cluster S95936_PEA_1_node_20 (SEQ ID NO:5826) according to the present invention is supported by 72 libraries. The number of libraries was determined as previously described. This segment can be found in the following transcript(s): S95936_PEA_1_T10 (SEQ ID NO:4228). Table 5375 below describes the starting and ending position of this segment on each transcript.

TABLE 5375

Segment location on transcripts

| Transcript name | Segment starting position | Segment ending position |
|---|---|---|
| S95936_PEA_1_T10 (SEQ ID NO: 4228) | 319 | 349 |

This segment can be found in a non-coding region of transcript(s) that are related to the following protein(s): S95936_PEA_1_P4.

Segment cluster S95936_PEA_1_node_21 (SEQ ID NO:5827) according to the present invention can be found in the following transcript(s): S95936_PEA_1_T10 (SEQ ID NO:4228). Table 5376 below describes the starting and ending position of this segment on each transcript.

TABLE 5376

Segment location on transcripts

| Transcript name | Segment starting position | Segment ending position |
|---|---|---|
| S95936_PEA_1_T10 (SEQ ID NO: 4228) | 350 | 358 |

This segment can be found in a non-coding region of transcript(s) that are related to the following protein(s): S95936_PEA_1_P4.

Segment cluster S95936_PEA_1_node_23 (SEQ ID NO:5828) according to the present invention is supported by 3 libraries. The number of libraries was determined as previously described. This segment can be found in the following transcript(s): S95936_PEA_1_T10 (SEQ ID NO:4228). Table 5377 below describes the starting and ending position of this segment on each transcript.

TABLE 5377

Segment location on transcripts

| Transcript name | Segment starting position | Segment ending position |
|---|---|---|
| S95936_PEA_1_T10 (SEQ ID NO: 4228) | 1041 | 1094 |

This segment can be found in a non-coding region of transcript(s) that are related to the following protein(s): S95936_PEA_1_P4.

Segment cluster S95936_PEA_1_node_24 (SEQ ID NO:5829) according to the present invention is supported by 4 libraries. The number of libraries was determined as previously described. This segment can be found in the following transcript(s): S95936_PEA_1_T10 (SEQ ID NO:4228). Table 5378 below describes the starting and ending position of this segment on each transcript.

TABLE 5378

Segment location on transcripts

| Transcript name | Segment starting position | Segment ending position |
|---|---|---|
| S95936_PEA_1_T10 (SEQ ID NO: 4228) | 1095 | 1149 |

This segment can be found in the following protein(s): S95936_PEA_1_P4.

Segment cluster S95936_PEA_1_node_25 (SEQ ID NO:5830) according to the present invention is supported by 74 libraries. The number of libraries was determined as previously described. This segment can be found in the following transcript(s): S95936_PEA_1_T10 (SEQ ID NO:4228). Table 5379 below describes the starting and ending position of this segment on each transcript.

TABLE 5379

Segment location on transcripts

| Transcript name | Segment starting position | Segment ending position |
|---|---|---|
| S95936_PEA_1_T10 (SEQ ID NO: 4228) | 1150 | 1176 |

This segment can be found in the following protein(s): S95936_PEA_1_P4.

Segment cluster S95936_PEA_1_node_26 (SEQ ID NO:5831) according to the present invention can be found in the following transcript(s): S95936_PEA_1_T10 (SEQ ID NO:4228). Table 5380 below describes the starting and ending position of this segment on each transcript.

TABLE 5380

Segment location on transcripts

| Transcript name | Segment starting position | Segment ending position |
|---|---|---|
| S95936_PEA_1_T10 (SEQ ID NO: 4228) | 1177 | 1195 |

This segment can be found in the following protein(s): S95936_PEA_1_P4.

Segment cluster S95936_PEA_1_node_27 (SEQ ID NO:5832) according to the present invention can be found in the following transcript(s): S95936_PEA_1_T10 (SEQ ID NO:4228). Table 5381 below describes the starting and ending position of this segment on each transcript.

TABLE 5381

Segment location on transcripts

| Transcript name | Segment starting position | Segment ending position |
|---|---|---|
| S95936_PEA_1_T10 (SEQ ID NO: 4228) | 1196 | 1214 |

This segment can be found in the following protein(s): S95936_PEA_1_P4.

Segment cluster S95936_PEA_1_node_28 (SEQ ID NO:5833) according to the present invention can be found in the following transcript(s): S95936_PEA_1_T10 (SEQ ID NO:4228). Table 5382 below describes the starting and ending position of this segment on each transcript.

TABLE 5382

Segment location on transcripts

| Transcript name | Segment starting position | Segment ending position |
|---|---|---|
| S95936_PEA_1_T10 (SEQ ID NO: 4228) | 1215 | 1224 |

This segment can be found in the following protein(s): S95936_PEA_1_P4.

Segment cluster S95936_PEA_1_node_29 (SEQ ID NO:5834) according to the present invention can be found in the following transcript(s): S95936_PEA_1_T10 (SEQ ID NO:4228). Table 5383 below describes the starting and ending position of this segment on each transcript.

TABLE 5383

Segment location on transcripts

| Transcript name | Segment starting position | Segment ending position |
|---|---|---|
| S95936_PEA_1_T10 (SEQ ID NO: 4228) | 1225 | 1231 |

This segment can be found in the following protein(s): S95936_PEA_1_P4.

Segment cluster S95936_PEA_1_node_30 (SEQ ID NO:5835) according to the present invention is supported by 82 libraries. The number of libraries was determined as previously described. This segment can be found in the following transcript(s): S95936_PEA_1_T10 (SEQ ID NO:4228). Table 5384 below describes the starting and ending position of this segment on each transcript.

TABLE 5384

Segment location on transcripts

| Transcript name | Segment starting position | Segment ending position |
|---|---|---|
| S95936_PEA_1_T10 (SEQ ID NO: 4228) | 1232 | 1326 |

This segment can be found in the following protein(s): S95936_PEA_1_P4.

Segment cluster S95936_PEA_1_node_32 (SEQ ID NO:5836) according to the present invention is supported by 81 libraries. The number of libraries was determined as previously described. This segment can be found in the following transcript(s): S95936_PEA_1_T10 (SEQ ID NO:4228). Table 5385 below describes the starting and ending position of this segment on each transcript.

TABLE 5385

Segment location on transcripts

| Transcript name | Segment starting position | Segment ending position |
|---|---|---|
| S95936_PEA_1_T10 (SEQ ID NO: 4228) | 1327 | 1407 |

This segment can be found in the following protein(s): S95936_PEA_1_P4.

Segment cluster S95936_PEA_1_node_33 (SEQ ID NO:5837) according to the present invention is supported by 70 libraries. The number of libraries was determined as previously described. This segment can be found in the following transcript(s): S95936_PEA_1_T10 (SEQ ID NO:4228). Table 5386 below describes the starting and ending position of this segment on each transcript.

TABLE 5386

Segment location on transcripts

| Transcript name | Segment starting position | Segment ending position |
|---|---|---|
| S95936_PEA_1_T10 (SEQ ID NO: 4228) | 1408 | 1459 |

This segment can be found in the following protein(s): S95936_PEA_1_P4.

Segment cluster S95936_PEA_1_node_37 (SEQ ID NO:5838) according to the present invention can be found in the following transcript(s): S95936_PEA_1_T10 (SEQ ID NO:4228). Table 5387 below describes the starting and ending position of this segment on each transcript.

TABLE 5387

Segment location on transcripts

| Transcript name | Segment starting position | Segment ending position |
|---|---|---|
| S95936_PEA_1_T10 (SEQ ID NO: 4228) | 1460 | 1478 |

This segment can be found in the following protein(s): S95936_PEA_1_P4.

Segment cluster S95936_PEA_1_node_38 (SEQ ID NO:5839) according to the present invention is supported by 69 libraries. The number of libraries was determined as previously described. This segment can be found in the following transcript(s): S95936_PEA_1_T10 (SEQ ID NO:4228). Table 5388 below describes the starting and ending position of this segment on each transcript.

TABLE 5388

Segment location on transcripts

| Transcript name | Segment starting position | Segment ending position |
| --- | --- | --- |
| S95936_PEA_1_T10 (SEQ ID NO: 4228) | 1479 | 1515 |

This segment can be found in the following protein(s): S95936_PEA_1_P4.

Segment cluster S95936_PEA_1_node_40 (SEQ ID NO:5840) according to the present invention is supported by 85 libraries. The number of libraries was determined as previously described. This segment can be found in the following transcript(s): S95936_PEA_1_T10 (SEQ ID NO:4228). Table 5389 below describes the starting and ending position of this segment on each transcript.

TABLE 5389

Segment location on transcripts

| Transcript name | Segment starting position | Segment ending position |
| --- | --- | --- |
| S95936_PEA_1_T10 (SEQ ID NO: 4228) | 1516 | 1598 |

This segment can be found in the following protein(s): S95936_PEA_1_P4.

Segment cluster S95936_PEA_1_node_41 (SEQ ID NO:5841) according to the present invention is supported by 87 libraries. The number of libraries was determined as previously described. This segment can be found in the following transcript(s): S95936_PEA_1_T10 (SEQ ID NO:4228). Table 5390 below describes the starting and ending position of this segment on each transcript.

TABLE 5390

Segment location on transcripts

| Transcript name | Segment starting position | Segment ending position |
| --- | --- | --- |
| S95936_PEA_1_T10 (SEQ ID NO: 4228) | 1599 | 1630 |

This segment can be found in the following protein(s): S95936_PEA_1_P4.

Segment cluster S95936_PEA_1_node_42 (SEQ ID NO:5842) according to the present invention is supported by 93 libraries. The number of libraries was determined as previously described. This segment can be found in the following transcript(s): S95936_PEA_1_T10 (SEQ ID NO:4228). Table 5391 below describes the starting and ending position of this segment on each transcript.

TABLE 5391

Segment location on transcripts

| Transcript name | Segment starting position | Segment ending position |
| --- | --- | --- |
| S95936_PEA_1_T10 (SEQ ID NO: 4228) | 1631 | 1694 |

This segment can be found in the following protein(s): S95936_PEA_1_P4.

Segment cluster S95936_PEA_1_node_45 (SEQ ID NO:5843) according to the present invention is supported by 95 libraries. The number of libraries was determined as previously described. This segment can be found in the following transcript(s): S95936_PEA_1_T10 (SEQ ID NO:4228). Table 5392 below describes the starting and ending position of this segment on each transcript.

TABLE 5392

Segment location on transcripts

| Transcript name | Segment starting position | Segment ending position |
| --- | --- | --- |
| S95936_PEA_1_T10 (SEQ ID NO: 4228) | 1695 | 1738 |

This segment can be found in the following protein(s): S95936_PEA_1_P4.

Segment cluster S95936_PEA_1_node_46 (SEQ ID NO:5844) according to the present invention can be found in the following transcript(s): S95936_PEA_1_T10 (SEQ ID NO:4228). Table 5393 below describes the starting and ending position of this segment on each transcript.

TABLE 5393

Segment location on transcripts

| Transcript name | Segment starting position | Segment ending position |
| --- | --- | --- |
| S95936_PEA_1_T10 (SEQ ID NO: 4228) | 1739 | 1754 |

This segment can be found in the following protein(s): S95936_PEA_1_P4.

Segment cluster S95936_PEA_1_node_47 (SEQ ID NO:5845) according to the present invention can be found in the following transcript(s): S95936_PEA_1_T10 (SEQ ID NO:4228). Table 5394 below describes the starting and ending position of this segment on each transcript.

TABLE 5394

Segment location on transcripts

| Transcript name | Segment starting position | Segment ending position |
| --- | --- | --- |
| S95936_PEA_1_T10 (SEQ ID NO: 4228) | 1755 | 1773 |

This segment can be found in the following protein(s): S95936_PEA_1_P4.

Segment cluster S95936_PEA_1_node_48 (SEQ ID NO:5846) according to the present invention can be found in the following transcript(s): S95936_PEA_1_T10 (SEQ ID NO:4228). Table 5395 below describes the starting and ending position of this segment on each transcript.

TABLE 5395

Segment location on transcripts

| Transcript name | Segment starting position | Segment ending position |
| --- | --- | --- |
| S95936_PEA_1_T10 (SEQ ID NO: 4228) | 1774 | 1789 |

This segment can be found in the following protein(s): S95936_PEA_1_P4.

Segment cluster S95936_PEA_1_node_49 (SEQ ID NO:5847) according to the present invention is supported by 109 libraries. The number of libraries was determined as previously described. This segment can be found in the following transcript(s): S95936_PEA_1_T10 (SEQ ID NO:4228). Table 5396 below describes the starting and ending position of this segment on each transcript.

TABLE 5396

Segment location on transcripts

| Transcript name | Segment starting position | Segment ending position |
| --- | --- | --- |
| S95936_PEA_1_T10 (SEQ ID NO: 4228) | 1790 | 1843 |

This segment can be found in the following protein(s): S95936_PEA_1_P4.

Segment cluster S95936_PEA_1_node_50 (SEQ ID NO:5848) according to the present invention can be found in the following transcript(s): S95936_PEA_1_T10 (SEQ ID NO:4228). Table 5397 below describes the starting and ending position of this segment on each transcript.

TABLE 5397

Segment location on transcripts

| Transcript name | Segment starting position | Segment ending position |
| --- | --- | --- |
| S95936_PEA_1_T10 (SEQ ID NO: 4228) | 1844 | 1852 |

This segment can be found in the following protein(s): S95936_PEA_1_P4.

Segment cluster S95936_PEA_1_node_51 (SEQ ID NO:5849) according to the present invention can be found in the following transcript(s): S95936_PEA_1_T10 (SEQ ID NO:4228). Table 5398 below describes the starting and ending position of this segment on each transcript.

TABLE 5398

Segment location on transcripts

| Transcript name | Segment starting position | Segment ending position |
| --- | --- | --- |
| S95936_PEA_1_T10 (SEQ ID NO: 4228) | 1853 | 1872 |

This segment can be found in the following protein(s): S95936_PEA_1_P4.

Segment cluster S95936_PEA_1_node_53 (SEQ ID NO:5850) according to the present invention can be found in the following transcript(s): S95936_PEA_1_T10 (SEQ ID NO:4228). Table 5399 below describes the starting and ending position of this segment on each transcript.

TABLE 5399

Segment location on transcripts

| Transcript name | Segment starting position | Segment ending position |
| --- | --- | --- |
| S95936_PEA_1_T10 (SEQ ID NO: 4228) | 1873 | 1887 |

This segment can be found in the following protein(s): S95936_PEA_1_P4.

Segment cluster S95936_PEA_1_node_54 (SEQ ID NO:5851) according to the present invention is supported by 120 libraries. The number of libraries was determined as previously described. This segment can be found in the following transcript(s): S95936_PEA_1_T10 (SEQ ID NO:4228). Table 5400 below describes the starting and ending position of this segment on each transcript.

TABLE 5400

Segment location on transcripts

| Transcript name | Segment starting position | Segment ending position |
| --- | --- | --- |
| S95936_PEA_1_T10 (SEQ ID NO: 4228) | 1888 | 1971 |

This segment can be found in the following protein(s): S95936_PEA_1_P4.

Segment cluster S95936_PEA_1_node_55 (SEQ ID NO:5852) according to the present invention is supported by 126 libraries. The number of libraries was determined as previously described. This segment can be found in the following transcript(s): S95936_PEA_1_T10 (SEQ ID NO:4228). Table 5401 below describes the starting and ending position of this segment on each transcript.

TABLE 5401

Segment location on transcripts

| Transcript name | Segment starting position | Segment ending position |
| --- | --- | --- |
| S95936_PEA_1_T10 (SEQ ID NO: 4228) | 1972 | 2027 |

This segment can be found in the following protein(s): S95936_PEA_1_P4.

Segment cluster S95936_PEA_1_node_65 (SEQ ID NO:5853) according to the present invention is supported by 137 libraries. The number of libraries was determined as previously described. This segment can be found in the following transcript(s): S95936_PEA_1_T10 (SEQ ID NO:4228). Table 5402 below describes the starting and ending position of this segment on each transcript.

TABLE 5402

Segment location on transcripts

| Transcript name | Segment starting position | Segment ending position |
|---|---|---|
| S95936_PEA_1_T10 (SEQ ID NO: 4228) | 2028 | 2121 |

This segment can be found in the following protein(s): S95936_PEA_1_P4.

Segment cluster S95936_PEA_1_node_67 (SEQ ID NO:5854) according to the present invention is supported by 120 libraries. The number of libraries was determined as previously described. This segment can be found in the following transcript(s): S95936_PEA_1_T10 (SEQ ID NO:4228). Table 5403 below describes the starting and ending position of this segment on each transcript.

TABLE 5403

Segment location on transcripts

| Transcript name | Segment starting position | Segment ending position |
|---|---|---|
| S95936_PEA_1_T10 (SEQ ID NO: 4228) | 2122 | 2154 |

This segment can be found in the following protein(s): S95936_PEA_1_P4.

Segment cluster S95936_PEA_1_node_70 (SEQ ID NO:5855) according to the present invention can be found in the following transcript(s): S95936_PEA_1_T10 (SEQ ID NO:4228). Table 5404 below describes the starting and ending position of this segment on each transcript.

TABLE 5404

Segment location on transcripts

| Transcript name | Segment starting position | Segment ending position |
|---|---|---|
| S95936_PEA_1_T10 (SEQ ID NO: 4228) | 2291 | 2299 |

This segment can be. found in the following protein(s): S95936_PEA_1_P4.

Segment cluster S95936_PEA_1_node_71 (SEQ ID NO:5856) according to the present invention can be found in the following transcript(s): S95936_PEA_1_T10 (SEQ ID NO:4228). Table 5405 below describes the starting and ending position of this segment on each transcript.

TABLE 5405

Segment location on transcripts

| Transcript name | Segment starting position | Segment ending position |
|---|---|---|
| S95936_PEA_1_T10 (SEQ ID NO: 4228) | 2300 | 2310 |

This segment can be found in the following protein(s): S95936_PEA_1_P4.

Segment cluster S95936_PEA_1_node_74 (SEQ ID NO:5857) according to the present invention is supported by 118 libraries. The number of libraries was determined as previously described. This segment can be found in the following transcript(s): S95936_PEA_1_T10 (SEQ ID NO:4228). Table 5406 below describes the starting and ending position of this segment on each transcript.

TABLE 5406

Segment location on transcripts

| Transcript name | Segment starting position | Segment ending position |
|---|---|---|
| S95936_PEA_1_T10 (SEQ ID NO: 4228) | 2311 | 2393 |

This segment can be found in the following protein(s): S95936_PEA_1_P4.

Segment cluster S95936_PEA_1_node_75 (SEQ ID NO:5858) according to the present invention is supported by 117 libraries. The number of libraries was determined as previously described. This segment can be found in the following transcript(s): S95936_PEA_1_T10 (SEQ ID NO:4228). Table 5407 below describes the starting and ending position of this segment on each transcript.

TABLE 5407

Segment location on transcripts

| Transcript name | Segment starting position | Segment ending position |
|---|---|---|
| S95936_PEA_1_T10 (SEQ ID NO: 4228) | 2394 | 2422 |

This segment can be found in the following protein(s): S95936_PEA_1_P4.

Segment cluster S95936_PEA_1_node_76 (SEQ ID NO:5859) according to the present invention can be found in the following transcript(s): S95936_PEA_1_T10 (SEQ ID NO:4228). Table 5408 below describes the starting and ending position of this segment on each transcript.

TABLE 5408

Segment location on transcripts

| Transcript name | Segment starting position | Segment ending position |
|---|---|---|
| S95936_PEA_1_T10 (SEQ ID NO: 4228) | 2423 | 2446 |

This segment can be found in the following protein(s): S95936_PEA_1_P4.

Segment cluster S95936_PEA_1_node_79 (SEQ ID NO:5860) according to the present invention can be found in the following transcript(s): S95936_PEA_1_T10 (SEQ ID NO:4228). Table 5409 below describes the starting and ending position of this segment on each transcript.

TABLE 5409

Segment location on transcripts

| Transcript name | Segment starting position | Segment ending position |
|---|---|---|
| S95936_PEA_1_T10 (SEQ ID NO: 4228) | 2447 | 2462 |

This segment can be found in the following protein(s): S95936_PEA_1_P4.

Segment cluster S95936_PEA_1_node_80 (SEQ ID NO:5861) according to the present invention can be found in the following transcript(s): S95936_PEA_1_T10 (SEQ ID NO:4228). Table 5410 below describes the starting and ending position of this segment on each transcript.

TABLE 5410

| | Segment location on transcripts | |
|---|---|---|
| Transcript name | Segment starting position | Segment ending position |
| S95936_PEA_1_T10 (SEQ ID NO: 4228) | 2463 | 2474 |

This segment can be found in the following protein(s): S95936_PEA_1_P4.

Segment cluster S95936_PEA_1_node_81 (SEQ ID NO:5862) according to the present invention is supported by 119 libraries. The number of libraries was determined as previously described. This segment can be found in the following transcript(s): S95936_PEA_1_T10 (SEQ ID NO:4228). Table 5411 below describes the starting and ending position of this segment on each transcript.

TABLE 5411

| | Segment location on transcripts | |
|---|---|---|
| Transcript name | Segment starting position | Segment ending position |
| S95936_PEA_1_T10 (SEQ ID NO: 4228) | 2475 | 2511 |

This segment can be found in the following protein(s): S95936_PEA_1_P4.

Segment cluster S95936_PEA_1_node_86 (SEQ ID NO:5863) according to the present invention can be found in the following transcript(s): S95936_PEA_1_T10 (SEQ ID NO:4228). Table 5412 below describes the starting and ending position of this segment on each transcript.

TABLE 5412

| | Segment location on transcripts | |
|---|---|---|
| Transcript name | Segment starting position | Segment ending position |
| S95936_PEA_1_T10 (SEQ ID NO: 4228) | 2512 | 2515 |

This segment can be found in the following protein(s): S95936_PEA_1_P4.

Segment cluster S95936_PEA_1_node_87 (SEQ ID NO:5864) according to the present invention is supported by 119 libraries. The number of libraries was determined as previously described. This segment can be found in the following transcript(s): S95936_PEA_1_T10 (SEQ ID NO:4228). Table 5413 below describes the starting and ending position of this segment on each transcript.

TABLE 5413

| | Segment location on transcripts | |
|---|---|---|
| Transcript name | Segment starting position | Segment ending position |
| S95936_PEA_1_T10 (SEQ ID NO: 4228) | 2516 | 2546 |

This segment can be found in the following protein(s): S95936_PEA_1_P4.

Segment cluster S95936_PEA_1_node_88 (SEQ ID NO:5865) according to the present invention is supported by 126 libraries. The number of libraries was determined as previously described. This segment can be found in the following transcript(s): S95936_PEA_1_T10 (SEQ ID NO:4228). Table 5414 below describes the starting and ending position of this segment on each transcript.

TABLE 5414

| | Segment location on transcripts | |
|---|---|---|
| Transcript name | Segment starting position | Segment ending position |
| S95936_PEA_1_T10 (SEQ ID NO: 4228) | 2547 | 2584 |

This segment can be found in the following protein(s): S95936_PEA_1_P4.

Segment cluster S95936_PEA_1_node_89 (SEQ ID NO:5866) according to the present invention can be found in the following transcript(s): S95936_PEA_1_T10 (SEQ ID NO:4228). Table 5415 below describes the starting and ending position of this segment on each transcript.

TABLE 5415

| | Segment location on transcripts | |
|---|---|---|
| Transcript name | Segment starting position | Segment ending position |
| S95936_PEA_1_T10 (SEQ ID NO: 4228) | 2585 | 2600 |

This segment can be found in the following protein(s): S95936_PEA_1_P4.

Segment cluster S95936_PEA_1_node_90 (SEQ ID NO:5867) according to the present invention can be found in the following transcript(s): S95936_PEA_1_T10 (SEQ ID NO:4228). Table 5416 below describes the starting and ending position of this segment on each transcript.

TABLE 5416

| | Segment location on transcripts | |
|---|---|---|
| Transcript name | Segment starting position | Segment ending position |
| S95936_PEA_1_T10 (SEQ ID NO: 4228) | 2601 | 2615 |

This segment can be found in the following protein(s): S95936_PEA_1_P4.

Segment cluster S95936_PEA_1_node_91 (SEQ ID NO:5868) according to the present invention can be found in the following transcript(s): S95936_PEA_1_T10 (SEQ ID NO:4228). Table 5417 below describes the starting and ending position of this segment on each transcript.

TABLE 5417

Segment location on transcripts

| Transcript name | Segment starting position | Segment ending position |
|---|---|---|
| S95936_PEA_1_T10 (SEQ ID NO: 4228) | 2616 | 2623 |

This segment can be found in the following protein(s): S95936_PEA_1_P4.

Segment cluster S95936_PEA_1_node_92 (SEQ ID NO:5869) according to the present invention can be found in the following transcript(s): S95936_PEA_1_T10 (SEQ ID NO:4228). Table 5418 below describes the starting and ending position of this segment on each transcript.

TABLE 5418

Segment location on transcripts

| Transcript name | Segment starting position | Segment ending position |
|---|---|---|
| S95936_PEA_1_T10 (SEQ ID NO: 4228) | 2624 | 2636 |

This segment can be found in the following protein(s): S95936_PEA_1_P4.

Segment cluster S95936_PEA_1_node_93 (SEQ ID NO:5870) according to the present invention is supported by 136 libraries. The number of libraries was determined as previously described. This segment can be found in the following transcript(s): S95936_PEA_1_T10 (SEQ ID NO:4228). Table 5419 below describes the starting and ending position of this segment on each transcript.

TABLE 5419

Segment location on transcripts

| Transcript name | Segment starting position | Segment ending position |
|---|---|---|
| S95936_PEA_1_T10 (SEQ ID NO: 4228) | 2637 | 2685 |

This segment can be found in the following protein(s): S95936_PEA_1_P4.

Segment cluster S95936_PEA_1_node_94 (SEQ ID NO:5871) according to the present invention can be found in the following transcript(s): S95936_PEA_1_T10 (SEQ ID NO:4228). Table 5420 below describes the starting and ending position of this segment on each transcript.

TABLE 5420

Segment location on transcripts

| Transcript name | Segment starting position | Segment ending position |
|---|---|---|
| S95936_PEA_1_T10 (SEQ ID NO: 4228) | 2686 | 2696 |

This segment can be found in the following protein(s): S95936_PEA_1_P4.

Segment cluster S95936_PEA_1_node_97 (SEQ ID NO:5872) according to the present invention is supported by 139 libraries. The number of libraries was determined as previously described. This segment can be found in the following transcript(s): S95936_PEA_1_T10 (SEQ ID NO:4228). Table 5421 below describes the starting and ending position of this segment on each transcript.

TABLE 5421

Segment location on transcripts

| Transcript name | Segment starting position | Segment ending position |
|---|---|---|
| S95936_PEA_1_T10 (SEQ ID NO: 4228) | 2697 | 2739 |

This segment can be found in the following protein(s): S95936_PEA_1_P4.

Segment cluster S95936_PEA_1_node_98 (SEQ ID NO:5873) according to the present invention is supported by 134 libraries. The number of libraries was determined as previously described. This segment can be found in the following transcript(s): S95936_PEA_1_T10 (SEQ ID NO:4228). Table 5422 below describes the starting and ending position of this segment on each transcript.

TABLE 5422

Segment location on transcripts

| Transcript name | Segment starting position | Segment ending position |
|---|---|---|
| S95936_PEA_1_T10 (SEQ ID NO: 4228) | 2740 | 2786 |

This segment can be found in the following protein(s): S95936_PEA_1_P4.

Segment cluster S95936_PEA_1_node_99 (SEQ ID NO:5874) according to the present invention is supported by 132 libraries. The number of libraries was determined as previously described. This segment can be found in the following transcript(s): S95936_PEA_1_T10 (SEQ ID NO:4228). Table 5423 below describes the starting and ending position of this segment on each transcript.

TABLE 5423

Segment location on transcripts

| Transcript name | Segment starting position | Segment ending position |
|---|---|---|
| S95936_PEA_1_T10 (SEQ ID NO: 4228) | 2787 | 2830 |

This segment can be found in the following protein(s): S95936_PEA_1_P4.

Segment cluster S95936_PEA_1_node_100 (SEQ ID NO:5875) according to the present invention is supported by 119 libraries. The number of libraries was determined as previously described. This segment can be found in the following transcript(s): S95936_PEA_1_T10 (SEQ ID NO:4228). Table 5424 below describes the starting and ending position of this segment on each transcript.

TABLE 5424

| Segment location on transcripts | | |
|---|---|---|
| Transcript name | Segment starting position | Segment ending position |
| S95936_PEA_1_T10 (SEQ ID NO: 4228) | 2831 | 2886 |

This segment can be found in the following protein(s): S95936_PEA_1_P4.

Segment cluster S95936_PEA_1_node_102 (SEQ ID NO:5876) according to the present invention is supported by 106 libraries. The number of libraries was determined as previously described. This segment can be found in the following transcript(s): S95936_PEA_1_T10 (SEQ ID NO:4228). Table 5425 below describes the starting and ending position of this segment on each transcript.

TABLE 5425

| Segment location on transcripts | | |
|---|---|---|
| Transcript name | Segment starting position | Segment ending position |
| S95936_PEA_1_T10 (SEQ ID NO: 4228) | 2887 | 2916 |

This segment can be found in the following protein(s): S95936_PEA_1_P4.

Segment cluster S95936_PEA_1_node_103 (SEQ ID NO:5877) according to the present invention is supported by 100 libraries. The number of libraries was determined as previously described. This segment can be found in the following transcript(s): S95936_PEA_1_T10 (SEQ ID NO:4228). Table 5426 below describes the starting and ending position of this segment on each transcript.

TABLE 5426

| Segment location on transcripts | | |
|---|---|---|
| Transcript name | Segment starting position | Segment ending position |
| S95936_PEA_1_T10 (SEQ ID NO: 4228) | 2917 | 2971 |

This segment can be found in the following protein(s): S95936_PEA_1_P4.

Description for Cluster T07560

Cluster T07560 features 8 transcript(s) and 69 segment(s) of interest, the names for which are given in Tables 5427 and 5428, respectively, the sequences themselves are given at the end of the application. The selected protein variants are given in Table 5429.

TABLE 5427

| Transcripts of interest Transcript Name |
|---|
| T07560_T10 (SEQ ID NO: 4229) |
| T07560_T18 (SEQ ID NO: 4230) |
| T07560_T19 (SEQ ID NO: 4231) |
| T07560_T20 (SEQ ID NO: 4232) |

TABLE 5427-continued

| Transcripts of interest Transcript Name |
|---|
| T07560_T24 (SEQ ID NO: 4233) |
| T07560_T25 (SEQ ID NO: 4234) |
| T07560_T53 (SEQ ID NO: 4235) |
| T07560_T59 (SEQ ID NO: 4236) |

TABLE 5428

| Segments of interest Segment Name |
|---|
| T07560_node_19 (SEQ ID NO: 5878) |
| T07560_node_23 (SEQ ID NO: 5879) |
| T07560_node_24 (SEQ ID NO: 5880) |
| T07560_node_29 (SEQ ID NO: 5881) |
| T07560_node_30 (SEQ ID NO: 5882) |
| T07560_node_31 (SEQ ID NO: 5883) |
| T07560_node_34 (SEQ ID NO: 5884) |
| T07560_node_37 (SEQ ID NO: 5885) |
| T07560_node_39 (SEQ ID NO: 5886) |
| T07560_node_44 (SEQ ID NO: 5887) |
| T07560_node_45 (SEQ ID NO: 5888) |
| T07560_node_66 (SEQ ID NO: 5889) |
| T07560_node_67 (SEQ ID NO: 5890) |
| T07560_node_80 (SEQ ID NO: 5891) |
| T07560_node_81 (SEQ ID NO: 5892) |
| T07560_node_87 (SEQ ID NO: 5893) |
| T07560_node_96 (SEQ ID NO: 5894) |
| T07560_node_97 (SEQ ID NO: 5895) |
| T07560_node_0 (SEQ ID NO: 5896) |
| T07560_node_6 (SEQ ID NO: 5897) |
| T07560_node_18 (SEQ ID NO: 5898) |
| T07560_node_21 (SEQ ID NO: 5899) |
| T07560_node_22 (SEQ ID NO: 5900) |
| T07560_node_47 (SEQ ID NO: 5901) |
| T07560_node_48 (SEQ ID NO: 5902) |
| T07560_node_50 (SEQ ID NO: 5903) |
| T07560_node_51 (SEQ ID NO: 5904) |
| T07560_node_53 (SEQ ID NO: 5905) |
| T07560_node_54 (SEQ ID NO: 5906) |
| T07560_node_57 (SEQ ID NO: 5907) |
| T07560_node_58 (SEQ ID NO: 5908) |
| T07560_node_60 (SEQ ID NO: 5909) |
| T07560_node_63 (SEQ ID NO: 5910) |
| T07560_node_68 (SEQ ID NO: 5911) |
| T07560_node_73 (SEQ ID NO: 5912) |
| T07560_node_74 (SEQ ID NO: 5913) |
| T07560_node_75 (SEQ ID NO: 5914) |
| T07560_node_76 (SEQ ID NO: 5915) |
| T07560_node_77 (SEQ ID NO: 5916) |
| T07560_node_78 (SEQ ID NO: 5917) |
| T07560_node_79 (SEQ ID NO: 5918) |
| T07560_node_82 (SEQ ID NO: 5919) |
| T07560_node_83 (SEQ ID NO: 5920) |
| T07560_node_84 (SEQ ID NO: 5921) |
| T07560_node_85 (SEQ ID NO: 5922) |
| T07560_node_86 (SEQ ID NO: 5923) |
| T07560_node_88 (SEQ ID NO: 5924) |
| T07560_node_89 (SEQ ID NO: 5925) |
| T07560_node_90 (SEQ ID NO: 5926) |
| T07560_node_91 (SEQ ID NO: 5927) |
| T07560_node_92 (SEQ ID NO: 5928) |
| T07560_node_93 (SEQ ID NO: 5929) |
| T07560_node_95 (SEQ ID NO: 5930) |
| T07560_node_98 (SEQ ID NO: 5931) |
| T07560_node_99 (SEQ ID NO: 5932) |
| T07560_node_100 (SEQ ID NO: 5933) |
| T07560_node_101 (SEQ ID NO: 5934) |
| T07560_node_102 (SEQ ID NO: 5935) |
| T07560_node_103 (SEQ ID NO: 5936) |
| T07560_node_104 (SEQ ID NO: 5937) |
| T07560_node_105 (SEQ ID NO: 5938) |
| T07560_node_106 (SEQ ID NO: 5939) |
| T07560_node_107 (SEQ ID NO: 5940) |

TABLE 5428-continued

Segments of interest
Segment Name

T07560_node_108 (SEQ ID NO: 5941)
T07560_node_109 (SEQ ID NO: 5942)
T07560_node_110 (SEQ ID NO: 5943)
T07560_node_111 (SEQ ID NO: 5944)
T07560_node_112 (SEQ ID NO: 5945)
T07560_node_113 (SEQ ID NO: 5946)

TABLE 5429

Proteins of interest

| Protein Name | Corresponding Transcript(s) |
|---|---|
| T07560_P25 | T07560_T53 (SEQ ID NO: 4235) |
| T07560_P31 | T07560_T59 (SEQ ID NO: 4236) |
| T07560_P34 | T07560_T10 (SEQ ID NO: 4229); |
|  | T07560_T18 (SEQ ID NO: 4230); |
|  | T07560_T19 (SEQ ID NO: 4231); |
|  | T07560_T20 (SEQ ID NO: 4232); |
|  | T07560_T24 (SEQ ID NO: 4233); |
|  | T07560_T25 (SEQ ID NO: 4234) |

Cluster T07560 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 130 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 130 and Table 5430. This cluster is overexpressed (at least at a minimum level) in the following pathological conditions: brain malignant tumors, a mixture of malignant tumors from different tissues, hepatocellular carcinoma, breast malignant tumors, myosarcoma and pancreas carcinoma.

TABLE 5430

Normal tissue distribution

| Name of Tissue | Number |
|---|---|
| Adrenal | 120 |
| Bladder | 123 |
| Bone | 200 |
| Brain | 68 |
| Colon | 485 |
| Epithelial | 108 |
| General | 105 |
| head and neck | 131 |
| Kidney | 78 |
| Liver | 0 |
| Lung | 108 |
| lymph nodes | 260 |
| Breast | 21 |
| bone marrow | 0 |
| Muscle | 0 |
| Ovary | 80 |
| Pancreas | 10 |
| Prostate | 66 |
| Skin | 174 |
| Stomach | 73 |
| T cells | 0 |
| Thyroid | 12 |
| Uterus | 95 |

TABLE 5431

P values and ratios for expression in cancerous tissue

| Name of Tissue | P1 | P2 | SP1 | R3 | SP2 | R4 |
|---|---|---|---|---|---|---|
| Adrenal | 6.9e−01 | 6.2e−01 | 7.6e−01 | 0.8 | 7.2e−01 | 0.9 |
| Bladder | 6.8e−01 | 6.8e−01 | 6.4e−01 | 1.0 | 6.8e−01 | 1.0 |
| Bone | 5.8e−01 | 6.1e−01 | 9.7e−01 | 0.4 | 7.3e−01 | 0.7 |
| Brain | 1.4e−02 | 1.8e−02 | 2.8e−07 | 3.2 | 3.9e−08 | 2.9 |
| Colon | 8.0e−01 | 8.2e−01 | 1 | 0.3 | 1 | 0.3 |
| Epithelial | 1.7e−01 | 5.0e−02 | 1.8e−04 | 1.6 | 1.1e−11 | 2.1 |
| General | 5.4e−03 | 4.4e−04 | 3.6e−09 | 1.7 | 3.2e−31 | 2.3 |
| head and neck | 4.5e−01 | 5.1e−01 | 7.8e−02 | 2.1 | 3.0e−01 | 1.3 |
| Kidney | 6.6e−01 | 6.5e−01 | 9.8e−02 | 1.8 | 6.8e−02 | 1.8 |
| Liver | 1 | 4.3e−02 | 1 | 1.0 | 8.5e−03 | 4.7 |
| Lung | 7.6e−01 | 8.1e−01 | 1.4e−01 | 1.7 | 2.8e−02 | 1.5 |
| lymph nodes | 5.9e−01 | 5.4e−01 | 4.7e−01 | 0.9 | 4.5e−05 | 1.4 |
| Breast | 2.4e−01 | 1.2e−01 | 2.4e−02 | 3.1 | 4.8e−04 | 4.9 |
| bone marrow | 4.3e−01 | 4.2e−01 | 1 | 2.1 | 5.3e−01 | 2.1 |
| Muscle | 2.3e−01 | 6.6e−02 | 2.2e−02 | 12.5 | 2.1e−04 | 7.2 |
| Ovary | 4.9e−01 | 3.7e−01 | 2.1e−01 | 1.5 | 2.1e−02 | 1.6 |
| Pancreas | 1.2e−01 | 1.7e−02 | 2.6e−04 | 3.9 | 3.4e−12 | 14.4 |
| Prostate | 2.5e−01 | 2.4e−01 | 5.7e−01 | 1.1 | 2.2e−01 | 1.2 |
| Skin | 4.9e−01 | 2.0e−01 | 1.8e−01 | 1.4 | 2.9e−02 | 1.0 |
| Stomach | 4.9e−01 | 5.3e−01 | 1.5e−01 | 1.1 | 9.5e−02 | 1.8 |
| T cells | 1 | 6.7e−01 | 1 | 1.0 | 1.4e−01 | 1.8 |
| Thyroid | 4.4e−01 | 4.4e−01 | 4.4e−01 | 1.8 | 4.4e−01 | 1.8 |
| Uterus | 9.5e−02 | 1.2e−01 | 1.1e−02 | 2.2 | 2.5e−02 | 2.0 |

As noted above, cluster T07560 features 69 segment(s), which were listed in Table 5428 above and for which the sequence(s) are given at the end of the application. These segment(s) are portions of nucleic acid sequence(s) which are described herein separately because they are of particular interest. A description of each segment according to the present invention is now provided.

Segment cluster T07560_node_19 (SEQ ID NO:5878) according to the present invention is supported by 53 libraries. The number of libraries was determined as previously described. This segment can be found in the following transcript(s): T07560_T53 (SEQ ID NO:4235). Table 5432 below describes the starting and ending position of this segment on each transcript.

TABLE 5432

Segment location on transcripts

| Transcript name | Segment starting position | Segment ending position |
|---|---|---|
| T07560_T53 (SEQ ID NO: 4235) | 250 | 455 |

This segment can be found in the following protein(s): T07560_P25.

Segment cluster T07560_node_23 (SEQ ID NO:5879) according to the present invention is supported by 55 libraries. The number of libraries was determined as previously described. This segment can be found in the following transcript(s): T07560_T53 (SEQ ID NO:4235). Table 5433 below describes the starting and ending position of this segment on each transcript.

TABLE 5433

| Transcript name | Segment location on transcripts | |
|---|---|---|
| | Segment starting position | Segment ending position |
| T07560_T53 (SEQ ID NO: 4235) | 530 | 669 |

This segment can be found in the following protein(s): T07560_P25.

Segment cluster T07560_node_24 (SEQ ID NO:5880) according to the present invention is supported by 51 libraries. The number of libraries was determined as previously described. This segment can be found in the following transcript(s): T07560_T53 (SEQ ID NO:4235). Table 5434 below describes the starting and ending position of this segment on each transcript.

TABLE 5434

| Transcript name | Segment location on transcripts | |
|---|---|---|
| | Segment starting position | Segment ending position |
| T07560_T53 (SEQ ID NO: 4235) | 670 | 817 |

This segment can be found in the following protein(s): T07560_P25.

Segment cluster T07560_node_29 (SEQ ID NO:5881) according to the present invention is supported by 12 libraries. The number of libraries was determined as previously described. This segment can be found in the following transcript(s): T07560_T10 (SEQ ID NO:4229) and T07560_T59 (SEQ ID NO:4236). Table 5435 below describes the starting and ending position of this segment on each transcript.

TABLE 5435

| Transcript name | Segment location on transcripts | |
|---|---|---|
| | Segment starting position | Segment ending position |
| T07560_T10 (SEQ ID NO: 4229) | 1 | 494 |
| T07560_T59 (SEQ ID NO: 4236) | 1 | 494 |

This segment can be found in a non-coding region of transcript(s) that are related to the following protein(s): T07560_P34 and T07560_P31.

Segment cluster T07560_node_30 (SEQ ID NO:5882) according to the present invention is supported by 5 libraries. The number of libraries was determined as previously described. This segment can be found in the following transcript(s): T07560_T10 (SEQ ID NO:4229) and T07560_T59 (SEQ ID NO:4236). Table 5436 below describes the starting and ending position of this segment on each transcript.

TABLE 5436

| Transcript name | Segment location on transcripts | |
|---|---|---|
| | Segment starting position | Segment ending position |
| T07560_T10 (SEQ ID NO: 4229) | 495 | 686 |
| T07560_T59 (SEQ ID NO: 4236) | 495 | 686 |

This segment can be found in a non-coding region of transcript(s) that are related to the following protein(s): T07560_P34 and T07560_P31.

Segment cluster T07560_node_31 (SEQ ID NO:5883) according to the present invention is supported by 20 libraries. The number of libraries was determined as previously described. This segment can be found in the following transcript(s): T07560_T10 (SEQ ID NO:4229) and T07560_T59 (SEQ ID NO:4236). Table 5437 below describes the starting and ending position of this segment on each transcript.

TABLE 5437

| Transcript name | Segment location on transcripts | |
|---|---|---|
| | Segment starting position | Segment ending position |
| T07560_T10 (SEQ ID NO: 4229) | 687 | 1236 |
| T07560_T59 (SEQ ID NO: 4236) | 687 | 1236 |

This segment can be found in a non-coding region of transcript(s) that are related to the following protein(s): T07560_P34 and T07560_P31.

Segment cluster T07560_node_34 (SEQ ID NO:5884) according to the present invention is supported by 6 libraries. The number of libraries was determined as previously described. This segment can be found in the following transcript(s): T07560_T18 (SEQ ID NO:4230). Table 5438 below describes the starting and ending position of this segment on each transcript.

TABLE 5438

| Transcript name | Segment location on transcripts | |
|---|---|---|
| | Segment starting position | Segment ending position |
| T07560_T18 (SEQ ID NO: 4230) | 1 | 592 |

This segment can be found in a non-coding region of transcript(s) that are related to the following protein(s): T07560_P34.

Segment cluster T07560_node_37 (SEQ ID NO:5885) according to the present invention is supported by 2 libraries. The number of libraries was determined as previously described. This segment can be found in the following transcript(s): T07560_T20 (SEQ ID NO:4232). Table 5439 below describes the starting and ending position of this segment on each transcript.

TABLE 5439

| Transcript name | Segment location on transcripts | |
|---|---|---|
| | Segment starting position | Segment ending position |
| T07560_T20 (SEQ ID NO: 4232) | 1 | 217 |

This segment can be found in a non-coding region of transcript(s) that are related to the following protein(s): T07560_P34.

Segment cluster T07560_node_39 (SEQ ID NO:5886) according to the present invention is supported by 2 libraries. The number of libraries was determined as previously described. This segment can be found in the following transcript(s): T07560_T19 (SEQ ID NO:4231). Table 5440 below describes the starting and ending position of this segment on each transcript.

TABLE 5440

Segment location on transcripts

| Transcript name | Segment starting position | Segment ending position |
|---|---|---|
| T07560_T19 (SEQ ID NO: 4231) | 1 | 169 |

This segment can be found in a non-coding region of transcript(s) that are related to the following protein(s): T07560_P34.

Segment cluster T07560_node_44 (SEQ ID NO:5887) according to the present invention is supported by 87 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T53 (SEQ ID NO:4235) and T07560_T59 (SEQ ID NO:4236). Table 5441 below describes the starting and ending position of this segment on each transcript.

TABLE 5441

Segment location on transcripts

| Transcript name | Segment starting position | Segment ending position |
|---|---|---|
| T07560_T10 (SEQ ID NO: 4229) | 1237 | 1428 |
| T07560_T18 (SEQ ID NO: 4230) | 593 | 784 |
| T07560_T19 (SEQ ID NO: 4231) | 170 | 361 |
| T07560_T20 (SEQ ID NO: 4232) | 218 | 409 |
| T07560_T53 (SEQ ID NO: 4235) | 818 | 1009 |
| T07560_T59 (SEQ ID NO: 4236) | 1237 | 1428 |

This segment can be found in both coding and non-coding regions of transcript(s) as follows. The segment can be found in a non-coding region of transcript(s) that are related to the following protein(s): T07560_P34. This segment can also be found in the following protein(s): T07560_P25 and T07560_P31, since it is in the coding region for the corresponding transcript.

Segment cluster T07560_node_45 (SEQ ID NO:5888) according to the present invention is supported by 2 libraries. The number of libraries was determined as previously described. This segment can be found in the following transcript(s): T07560_T53 (SEQ ID NO:4235) and T07560_T59 (SEQ ID NO:4236). Table 5442 below describes the starting and ending position of this segment on each transcript.

TABLE 5442

Segment location on transcripts

| Transcript name | Segment starting position | Segment ending position |
|---|---|---|
| T07560_T53 (SEQ ID NO: 4235) | 1010 | 1372 |
| T07560_T59 (SEQ ID NO: 4236) | 1429 | 1791 |

This segment can be found in the following protein(s): T07560_P25 and T07560_P31.

Segment cluster T07560_node_66 (SEQ ID NO:5889) according to the present invention is supported by 13 libraries. The number of libraries was determined as previously described. This segment can be found in the following transcript(s): T07560_T24 (SEQ ID NO:4233) and T07560_T25 (SEQ ID NO:4234). Table 5443 below describes the starting and ending position of this segment on each transcript.

TABLE 5443

Segment location on transcripts

| Transcript name | Segment starting position | Segment ending position |
|---|---|---|
| T07560_T24 (SEQ ID NO: 4233) | 1 | 2179 |
| T07560_T25 (SEQ ID NO: 4234) | 1 | 2179 |

This segment can be found in a non-coding region of transcript(s) that are related to the following protein(s): T07560_P34.

Segment cluster T07560_node_67 (SEQ ID NO:5890) according to the present invention is supported by 8 libraries. The number of libraries was determined as previously described. This segment can be found in the following transcript(s): T07560_T24 (SEQ ID NO:4233). Table 5444 below describes the starting and ending position of this segment on each transcript.

TABLE 5444

Segment location on transcripts

| Transcript name | Segment starting position | Segment ending position |
|---|---|---|
| T07560_T24 (SEQ ID NO: 4233) | 2180 | 3106 |

This segment can be found in a non-coding region of transcript(s) that are related to the following protein(s): T07560_P34.

Segment cluster T07560_node_80 (SEQ ID NO:5891) according to the present invention is supported by 108 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5445 below describes the starting and ending position of this segment on each transcript.

TABLE 5445

Segment location on transcripts

| Transcript name | Segment starting position | Segment ending position |
|---|---|---|
| T07560_T10 (SEQ ID NO: 4229) | 2396 | 2517 |
| T07560_T18 (SEQ ID NO: 4230) | 1752 | 1873 |
| T07560_T19 (SEQ ID NO: 4231) | 1329 | 1450 |
| T07560_T20 (SEQ ID NO: 4232) | 1377 | 1498 |
| T07560_T24 (SEQ ID NO: 4233) | 3414 | 3535 |
| T07560_T25 (SEQ ID NO: 4234) | 2487 | 2608 |

This segment can be found in a non-coding region of transcript(s) that are related to the following protein(s): T07560_P34.

Segment cluster T07560_node_81 (SEQ ID NO:5892) according to the present invention is supported by 141 libraries. The number of libraries was determined as previously described. This segment can be found in the following transcript(s): T07560_T10 (SEQ ID NO:4229), T07560_T18

(SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5446 below describes the starting and ending position of this segment on each transcript.

TABLE 5446

Segment location on transcripts

| Transcript name | Segment starting position | Segment ending position |
| --- | --- | --- |
| T07560_T10 (SEQ ID NO: 4229) | 2518 | 2668 |
| T07560_T18 (SEQ ID NO: 4230) | 1874 | 2024 |
| T07560_T19 (SEQ ID NO: 4231) | 1451 | 1601 |
| T07560_T20 (SEQ ID NO: 4232) | 1499 | 1649 |
| T07560_T24 (SEQ ID NO: 4233) | 3536 | 3686 |
| T07560_T25 (SEQ ID NO: 4234) | 2609 | 2759 |

This segment can be found in the following protein(s): T07560_P34.

Segment cluster T07560_node_87 (SEQ ID NO:5893) according to the present invention is supported by 148 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5447 below describes the starting and ending position of this segment on each transcript.

TABLE 5447

Segment location on transcripts

| Transcript name | Segment starting position | Segment ending position |
| --- | --- | --- |
| T07560_T10 (SEQ ID NO: 4229) | 2882 | 3020 |
| T07560_T18 (SEQ ID NO: 4230) | 2238 | 2376 |
| T07560_T19 (SEQ ID NO: 4231) | 1815 | 1953 |
| T07560_T20 (SEQ ID NO: 4232) | 1863 | 2001 |
| T07560_T24 (SEQ ID NO: 4233) | 3900 | 4038 |
| T07560_T25 (SEQ ID NO: 4234) | 2973 | 3111 |

This segment can be found in the following protein(s): T07560_P34.

Segment cluster T07560_node_96 (SEQ ID NO:5894) according to the present invention is supported by 179 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5448 below describes the starting and ending position of this segment on each transcript.

TABLE 5448

Segment location on transcripts

| Transcript name | Segment starting position | Segment ending position |
| --- | --- | --- |
| T07560_T10 (SEQ ID NO: 4229) | 3286 | 3454 |
| T07560_T18 (SEQ ID NO: 4230) | 2642 | 2810 |
| T07560_T19 (SEQ ID NO: 4231) | 2219 | 2387 |
| T07560_T20 (SEQ ID NO: 4232) | 2267 | 2435 |

TABLE 5448-continued

Segment location on transcripts

| Transcript name | Segment starting position | Segment ending position |
| --- | --- | --- |
| T07560_T24 (SEQ ID NO: 4233) | 4304 | 4472 |
| T07560_T25 (SEQ ID NO: 4234) | 3377 | 3545 |

This segment can be found in a non-coding region of transcript(s) that are related to the following protein(s): T07560_P34.

Segment cluster T07560_node_97 (SEQ ID NO:5895) according to the present invention is supported by 171 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5449 below describes the starting and ending position of this segment on each transcript.

TABLE 5449

Segment location on transcripts

| Transcript name | Segment starting position | Segment ending position |
| --- | --- | --- |
| T07560_T10 (SEQ ID NO: 4229) | 3455 | 3579 |
| T07560_T18 (SEQ ID NO: 4230) | 2811 | 2935 |
| T07560_T19 (SEQ ID NO: 4231) | 2388 | 2512 |
| T07560_T20 (SEQ ID NO: 4232) | 2436 | 2560 |
| T07560_T24 (SEQ ID NO: 4233) | 4473 | 4597 |
| T07560_T25 (SEQ ID NO: 4234) | 3546 | 3670 |

This segment can be found in a non-coding region of transcript(s) that are related to the following protein(s): T07560_P34.

According to an optional embodiment of the present invention, short segments related to the above cluster are also provided. These segments are up to about 120 bp in length, and so are included in a separate description.

Segment cluster T07560_node_0 (SEQ ID NO:5896) according to the present invention is supported by 18 libraries. The number of libraries was determined as previously described. This segment can be found in the following transcript(s): T07560_T53 (SEQ ID NO:4235). Table 5450 below describes the starting and ending position of this segment on each transcript.

TABLE 5450

Segment location on transcripts

| Transcript name | Segment starting position | Segment ending position |
| --- | --- | --- |
| T07560_T53 (SEQ ID NO: 4235) | 1 | 115 |

This segment can be found in the following protein(s): T07560_P25.

Segment cluster T07560_node_6 (SEQ ID NO:5897) according to the present invention is supported by 23 libraries. The number of libraries was determined as previously described. This segment can be found in the following transcript(s): T07560_T53 (SEQ ID NO:4235). Table 5451 below describes the starting and ending position of this segment on each transcript.

TABLE 5451

Segment location on transcripts

| Transcript name | Segment starting position | Segment ending position |
|---|---|---|
| T07560_T53 (SEQ ID NO: 4235) | 116 | 172 |

This segment can be found in the following protein(s): T07560_P25.

Segment cluster T07560_node_18 (SEQ ID NO:5898) according to the present invention is supported by 49 libraries. The number of libraries was determined as previously described. This segment can be found in the following transcript(s): T07560_T53 (SEQ ID NO:4235). Table 5452 below describes the starting and ending position of this segment on each transcript.

TABLE 5452

Segment location on transcripts

| Transcript name | Segment starting position | Segment ending position |
|---|---|---|
| T07560_T53 (SEQ ID NO: 4235) | 173 | 249 |

This segment can be found in the following protein(s): T07560_P25.

Segment cluster T07560_node_21 (SEQ ID NO:5899) according to the present invention can be found in the following transcript(s): T07560_T53 (SEQ ID NO:4235). Table 5453 below describes the starting and ending position of this segment on each transcript.

TABLE 5453

Segment location on transcripts

| Transcript name | Segment starting position | Segment ending position |
|---|---|---|
| T07560_T53 (SEQ ID NO: 4235) | 456 | 459 |

This segment can be found in the following protein(s): T07560_P25.

Segment cluster T07560_node_22 (SEQ ID NO:5900) according to the present invention is supported by 57 libraries. The number of libraries was determined as previously described. This segment can be found in the following transcript(s): T07560_T53 (SEQ ID NO:4235). Table 5454 below describes the starting and ending position of this segment on each transcript.

TABLE 5454

Segment location on transcripts

| Transcript name | Segment starting position | Segment ending position |
|---|---|---|
| T07560_T53 (SEQ ID NO: 4235) | 460 | 529 |

This segment can be found in the following protein(s): T07560_P25.

Segment cluster T07560_node_47 (SEQ ID NO:5901) according to the present invention is supported by 85 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5455 below describes the starting and ending position of this segment on each transcript.

TABLE 5455

Segment location on transcripts

| Transcript name | Segment starting position | Segment ending position |
|---|---|---|
| T07560_T10 (SEQ ID NO: 4229) | 1429 | 1492 |
| T07560_T18 (SEQ ID NO: 4230) | 785 | 848 |
| T07560_T19 (SEQ ID NO: 4231) | 362 | 425 |
| T07560_T20 (SEQ ID NO: 4232) | 410 | 473 |

This segment can be found in a non-coding region of transcript(s) that are related to the following protein(s): T07560_P34.

Segment cluster T07560_node_48 (SEQ ID NO:5902) according to the present invention is supported by 83 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5456 below describes the starting and ending position of this segment on each transcript.

TABLE 5456

Segment location on transcripts

| Transcript name | Segment starting position | Segment ending position |
|---|---|---|
| T07560_T10 (SEQ ID NO: 4229) | 1493 | 1557 |
| T07560_T18 (SEQ ID NO: 4230) | 849 | 913 |
| T07560_T19 (SEQ ID NO: 4231) | 426 | 490 |
| T07560_T20 (SEQ ID NO: 4232) | 474 | 538 |

This segment can be found in a non-coding region of transcript(s) that are related to the following protein(s): T07560_P34.

Segment cluster T07560_node_50 (SEQ ID NO:5903) according to the present invention is supported by 86 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5457 below describes the starting and ending position of this segment on each transcript.

TABLE 5457

Segment location on transcripts

| Transcript name | Segment starting position | Segment ending position |
|---|---|---|
| T07560_T10 (SEQ ID NO: 4229) | 1558 | 1596 |
| T07560_T18 (SEQ ID NO: 4230) | 914 | 952 |
| T07560_T19 (SEQ ID NO: 4231) | 491 | 529 |
| T07560_T20 (SEQ ID NO: 4232) | 539 | 577 |

This segment can be found in a non-coding region of transcript(s) that are related to the following protein(s): T07560_P34.

Segment cluster T07560_node__51 (SEQ ID NO:5904) according to the present invention is supported by 91 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5458 below describes the starting and ending position of this segment on each transcript.

TABLE 5458

Segment location on transcripts

| Transcript name | Segment starting position | Segment ending position |
| --- | --- | --- |
| T07560_T10 (SEQ ID NO: 4229) | 1597 | 1639 |
| T07560_T18 (SEQ ID NO: 4230) | 953 | 995 |
| T07560_T19 (SEQ ID NO: 4231) | 530 | 572 |
| T07560_T20 (SEQ ID NO: 4232) | 578 | 620 |

This segment can be found in a non-coding region of transcript(s) that are related to the following protein(s): T07560_P34.

Segment cluster T07560_node__53 (SEQ ID NO:5905) according to the present invention is supported by 91 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5459 below describes the starting and ending position of this segment on each transcript.

TABLE 5459

Segment location on transcripts

| Transcript name | Segment starting position | Segment ending position |
| --- | --- | --- |
| T07560_T10 (SEQ ID NO: 4229) | 1640 | 1685 |
| T07560_T18 (SEQ ID NO: 4230) | 996 | 1041 |
| T07560_T19 (SEQ ID NO: 4231) | 573 | 618 |
| T07560_T20 (SEQ ID NO: 4232) | 621 | 666 |

This segment can be found in a non-coding region of transcript(s) that are related to the following protein(s): T07560_P34.

Segment cluster T07560_node__54 (SEQ ID NO:5906) according to the present invention is supported by 97 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5460 below describes the starting and ending position of this segment on each transcript.

TABLE 5460

Segment location on transcripts

| Transcript name | Segment starting position | Segment ending position |
| --- | --- | --- |
| T07560_T10 (SEQ ID NO: 4229) | 1686 | 1777 |
| T07560_T18 (SEQ ID NO: 4230) | 1042 | 1133 |
| T07560_T19 (SEQ ID NO: 4231) | 619 | 710 |
| T07560_T20 (SEQ ID NO: 4232) | 667 | 758 |

This segment can be found in a non-coding region of transcript(s) that are related to the following protein(s): T07560_P34.

Segment cluster T07560_node__57 (SEQ ID NO:5907) according to the present invention is supported by 102 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5461 below describes the starting and ending position of this segment on each transcript.

TABLE 5461

Segment location on transcripts

| Transcript name | Segment starting position | Segment ending position |
| --- | --- | --- |
| T07560_T10 (SEQ ID NO: 4229) | 1778 | 1865 |
| T07560_T18 (SEQ ID NO: 4230) | 1134 | 1221 |
| T07560_T19 (SEQ ID NO: 4231) | 711 | 798 |
| T07560_T20 (SEQ ID NO: 4232) | 759 | 846 |

This segment can be found in a non-coding region of transcript(s) that are related to the following protein(s): T07560_P34.

Segment cluster T07560_node__58 (SEQ ID NO:5908) according to the present invention is supported by 87 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5462 below describes the starting and ending position of this segment on each transcript.

TABLE 5462

Segment location on transcripts

| Transcript name | Segment starting position | Segment ending position |
| --- | --- | --- |
| T07560_T10 (SEQ ID NO: 4229) | 1866 | 1895 |
| T07560_T18 (SEQ ID NO: 4230) | 1222 | 1251 |
| T07560_T19 (SEQ ID NO: 4231) | 799 | 828 |
| T07560_T20 (SEQ ID NO: 4232) | 847 | 876 |

This segment can be found in a non-coding region of transcript(s) that are related to the following protein(s): T07560_P34.

Segment cluster T07560_node__60 (SEQ ID NO:5909) according to the present invention is supported by 108 libraries. The number of libraries was determined as previously described. This segment can be found in the following transcript(s): T07560_T10 (SEQ ID NO:4229), T07560_T18

(SEQ ID NO:4230), T07560_T19 (SEQ ID NO:4231) and T07560_T20 (SEQ ID NO:4232). Table 5463 below describes the starting and ending position of this segment on each transcript.

TABLE 5463

Segment location on transcripts

| Transcript name | Segment starting position | Segment ending position |
|---|---|---|
| T07560_T10 (SEQ ID NO: 4229) | 1896 | 1991 |
| T07560_T18 (SEQ ID NO: 4230) | 1252 | 1347 |
| T07560_T19 (SEQ ID NO: 4231) | 829 | 924 |
| T07560_T20 (SEQ ID NO: 4232) | 877 | 972 |

This segment can be found in a non-coding region of transcript(s) that are related to the following protein(s): T07560_P34.

Segment cluster T07560_node_63 (SEQ ID NO:5910) according to the present invention is supported by 112 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231) and T07560_T20 (SEQ ID NO:4232). Table 5464 below describes the starting and ending position of this segment on each transcript.

TABLE 5464

Segment location on transcripts

| Transcript name | Segment starting position | Segment ending position |
|---|---|---|
| T07560_T10 (SEQ ID NO: 4229) | 1992 | 2088 |
| T07560_T18 (SEQ ID NO: 4230) | 1348 | 1444 |
| T07560_T19 (SEQ ID NO: 4231) | 925 | 1021 |
| T07560_T20 (SEQ ID NO: 4232) | 973 | 1069 |

This segment can be found in a non-coding region of transcript(s) that are related to the following protein(s): T07560_P34.

Segment cluster T07560_node_68 (SEQ ID NO:5911) according to the present invention is supported by 120 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5465 below describes the starting and ending position of this segment on each transcript.

TABLE 5465

Segment location on transcripts

| Transcript name | Segment starting position | Segment ending position |
|---|---|---|
| T07560_T10 (SEQ ID NO: 4229) | 2089 | 2140 |
| T07560_T18 (SEQ ID NO: 4230) | 1445 | 1496 |
| T07560_T19 (SEQ ID NO: 4231) | 1022 | 1073 |
| T07560_T20 (SEQ ID NO: 4232) | 1070 | 1121 |
| T07560_T24 (SEQ ID NO: 4233) | 3107 | 3158 |
| T07560_T25 (SEQ ID NO: 4234) | 2180 | 2231 |

This segment can be found in a non-coding region of transcript(s) that are related to the following protein(s): T07560_P34.

Segment cluster T07560_node_73 (SEQ ID NO:5912) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5466 below describes the starting and ending position of this segment on each transcript.

TABLE 5466

Segment location on transcripts

| Transcript name | Segment starting position | Segment ending position |
|---|---|---|
| T07560_T10 (SEQ ID NO: 4229) | 2141 | 2147 |
| T07560_T18 (SEQ ID NO: 4230) | 1497 | 1503 |
| T07560_T19 (SEQ ID NO: 4231) | 1074 | 1080 |
| T07560_T20 (SEQ ID NO: 4232) | 1122 | 1128 |
| T07560_T24 (SEQ ID NO: 4233) | 3159 | 3165 |
| T07560_T25 (SEQ ID NO: 4234) | 2232 | 2238 |

This segment can be found in a non-coding region of transcript(s).that are related to the following protein(s): T07560_P34.

Segment cluster T07560_node_74 (SEQ ID NO:5913) according to the present invention is supported by 101 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5467 below describes the starting and ending position of this segment on each transcript.

TABLE 5467

Segment location on transcripts

| Transcript name | Segment starting position | Segment ending position |
|---|---|---|
| T07560_T10 (SEQ ID NO: 4229) | 2148 | 2182 |
| T07560_T18 (SEQ ID NO: 4230) | 1504 | 1538 |
| T07560_T19 (SEQ ID NO: 4231) | 1081 | 1115 |
| T07560_T20 (SEQ ID NO: 4232) | 1129 | 1163 |
| T07560_T24 (SEQ ID NO: 4233) | 3166 | 3200 |
| T07560_T25 (SEQ ID NO: 4234) | 2239 | 2273 |

This segment can be found in a non-coding region of transcript(s) that are related to the following protein(s): T07560_P34.

Segment cluster T07560_node_75 (SEQ ID NO:5914) according to the present invention is supported by 95 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5468 below describes the starting and ending position of this segment on each transcript.

TABLE 5468

Segment location on transcripts

| Transcript name | Segment starting position | Segment ending position |
|---|---|---|
| T07560_T10 (SEQ ID NO: 4229) | 2183 | 2221 |
| T07560_T18 (SEQ ID NO: 4230) | 1539 | 1577 |
| T07560_T19 (SEQ ID NO: 4231) | 1116 | 1154 |
| T07560_T20 (SEQ ID NO: 4232) | 1164 | 1202 |
| T07560_T24 (SEQ ID NO: 4233) | 3201 | 3239 |
| T07560_T25 (SEQ ID NO: 4234) | 2274 | 2312 |

This segment can be found in a non-coding region of transcript(s) that are related to the following protein(s): T07560_P34.

Segment cluster T07560_node__76 (SEQ ID NO:5915) according to the present invention is supported by 93 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5469 below describes the starting and ending position of this segment on each transcript.

TABLE 5469

Segment location on transcripts

| Transcript name | Segment starting position | Segment ending position |
|---|---|---|
| T07560_T10 (SEQ ID NO: 4229) | 2222 | 2284 |
| T07560_T18 (SEQ ID NO: 4230) | 1578 | 1640 |
| T07560_T19 (SEQ ID NO: 4231) | 1155 | 1217 |
| T07560_T20 (SEQ ID NO: 4232) | 1203 | 1265 |
| T07560_T24 (SEQ ID NO: 4233) | 3240 | 3302 |
| T07560_T25 (SEQ ID NO: 4234) | 2313 | 2375 |

This segment can be found in a non-coding region of transcript(s) that are related to the following protein(s): T07560_P34.

Segment cluster T07560_node__77 (SEQ ID NO:5916) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5470 below describes the starting and ending position of this segment on each transcript.

TABLE 5470

Segment location on transcripts

| Transcript name | Segment starting position | Segment ending position |
|---|---|---|
| T07560_T10 (SEQ ID NO: 4229) | 2285 | 2298 |
| T07560_T18 (SEQ ID NO: 4230) | 1641 | 1654 |
| T07560_T19 (SEQ ID NO: 4231) | 1218 | 1231 |
| T07560_T20 (SEQ ID NO: 4232) | 1266 | 1279 |
| T07560_T24 (SEQ ID NO: 4233) | 3303 | 3316 |
| T07560_T25 (SEQ ID NO: 4234) | 2376 | 2389 |

This segment can be found in a non-coding region of transcript(s) that are related to the following protein(s): T07560_P34.

Segment cluster T07560_node__78 (SEQ ID NO:5917) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5471 below describes the starting and ending position of this segment on each transcript.

TABLE 5471

Segment location on transcripts

| Transcript name | Segment starting position | Segment ending position |
|---|---|---|
| T07560_T10 (SEQ ID NO: 4229) | 2299 | 2312 |
| T07560_T18 (SEQ ID NO: 4230) | 1655 | 1668 |
| T07560_T19 (SEQ ID NO: 4231) | 1232 | 1245 |
| T07560_T20 (SEQ ID NO: 4232) | 1280 | 1293 |
| T07560_T24 (SEQ ID NO: 4233) | 3317 | 3330 |
| T07560_T25 (SEQ ID NO: 4234) | 2390 | 2403 |

This segment can be found in a non-coding region of transcript(s) that are related to the following protein(s): T07560_P34.

Segment cluster T07560_node__79 (SEQ ID NO:5918) according to the present invention is supported by 76 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5472 below describes the starting and ending position of this segment on each transcript.

TABLE 5472

Segment location on transcripts

| Transcript name | Segment starting position | Segment ending position |
|---|---|---|
| T07560_T10 (SEQ ID NO: 4229) | 2313 | 2395 |
| T07560_T18 (SEQ ID NO: 4230) | 1669 | 1751 |
| T07560_T19 (SEQ ID NO: 4231) | 1246 | 1328 |
| T07560_T20 (SEQ ID NO: 4232) | 1294 | 1376 |
| T07560_T24 (SEQ ID NO: 4233) | 3331 | 3413 |
| T07560_T25 (SEQ ID NO: 4234) | 2404 | 2486 |

This segment can be found in a non-coding region of transcript(s) that are related to the following protein(s): T07560_P34.

Segment cluster T07560_node__82 (SEQ ID NO:5919) according to the present invention is supported by 128 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5473 below describes the starting and ending position of this segment on each transcript.

TABLE 5473

Segment location on transcripts

| Transcript name | Segment starting position | Segment ending position |
|---|---|---|
| T07560_T10 (SEQ ID NO: 4229) | 2669 | 2736 |
| T07560_T18 (SEQ ID NO: 4230) | 2025 | 2092 |
| T07560_T19 (SEQ ID NO: 4231) | 1602 | 1669 |
| T07560_T20 (SEQ ID NO: 4232) | 1650 | 1717 |
| T07560_T24 (SEQ ID NO: 4233) | 3687 | 3754 |
| T07560_T25 (SEQ ID NO: 4234) | 2760 | 2827 |

This segment can be found in the following protein(s): T07560_P34.

Segment cluster T07560_node_83 (SEQ ID NO:5920) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5474 below describes the starting and ending position of this segment on each transcript.

TABLE 5474

Segment location on transcripts

| Transcript name | Segment starting position | Segment ending position |
|---|---|---|
| T07560_T10 (SEQ ID NO: 4229) | 2737 | 2747 |
| T07560_T18 (SEQ ID NO: 4230) | 2093 | 2103 |
| T07560_T19 (SEQ ID NO: 4231) | 1670 | 1680 |
| T07560_T20 (SEQ ID NO: 4232) | 1718 | 1728 |
| T07560_T24 (SEQ ID NO: 4233) | 3755 | 3765 |
| T07560_T25 (SEQ ID NO: 4234) | 2828 | 2838 |

This segment can be found in the following protein(s): T07560_P34.

Segment cluster T07560_node_84 (SEQ ID NO:5921) according to the present invention is supported by 131 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5475 below describes the starting and ending position of this segment on each transcript.

TABLE 5475

Segment location on transcripts

| Transcript name | Segment starting position | Segment ending position |
|---|---|---|
| T07560_T10 (SEQ ID NO: 4229) | 2748 | 2810 |
| T07560_T18 (SEQ ID NO: 4230) | 2104 | 2166 |
| T07560_T19 (SEQ ID NO: 4231) | 1681 | 1743 |
| T07560_T20 (SEQ ID NO: 4232) | 1729 | 1791 |
| T07560_T24 (SEQ ID NO: 4233) | 3766 | 3828 |
| T07560_T25 (SEQ ID NO: 4234) | 2839 | 2901 |

This segment can be found in the following protein(s): T07560_P34.

Segment cluster T07560_node_85 (SEQ ID NO:5922) according to the present invention is supported by 131 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5476 below describes the starting and ending position of this segment on each transcript.

TABLE 5476

Segment location on transcripts

| Transcript name | Segment starting position | Segment ending position |
|---|---|---|
| T07560_T10 (SEQ ID NO: 4229) | 2811 | 2849 |
| T07560_T18 (SEQ ID NO: 4230) | 2167 | 2205 |
| T07560_T19 (SEQ ID NO: 4231) | 1744 | 1782 |
| T07560_T20 (SEQ ID NO: 4232) | 1792 | 1830 |
| T07560_T24 (SEQ ID NO: 4233) | 3829 | 3867 |
| T07560_T25 (SEQ ID NO: 4234) | 2902 | 2940 |

This segment can be found in the following protein(s): T07560_P34.

Segment cluster T07560_node_86 (SEQ ID NO:5923) according to the present invention is supported by 125 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5477 below describes the starting and ending position of this segment on each transcript.

TABLE 5477

Segment location on transcripts

| Transcript name | Segment starting position | Segment ending position |
|---|---|---|
| T07560_T10 (SEQ ID NO: 4229) | 2850 | 2881 |
| T07560_T18 (SEQ ID NO: 4230) | 2206 | 2237 |
| T07560_T19 (SEQ ID NO: 4231) | 1783 | 1814 |
| T07560_T20 (SEQ ID NO: 4232) | 1831 | 1862 |
| T07560_T24 (SEQ ID NO: 4233) | 3868 | 3899 |
| T07560_T25 (SEQ ID NO: 4234) | 2941 | 2972 |

This segment can be found in the following protein(s): T07560_P34.

Segment cluster T07560_node_88 (SEQ ID NO:5924) according to the present invention is supported by 143 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5478 below describes the starting and ending position of this segment on each transcript.

TABLE 5478

Segment location on transcripts

| Transcript name | Segment starting position | Segment ending position |
|---|---|---|
| T07560_T10 (SEQ ID NO: 4229) | 3021 | 3082 |
| T07560_T18 (SEQ ID NO: 4230) | 2377 | 2438 |
| T07560_T19 (SEQ ID NO: 4231) | 1954 | 2015 |
| T07560_T20 (SEQ ID NO: 4232) | 2002 | 2063 |

TABLE 5478-continued

Segment location on transcripts

| Transcript name | Segment starting position | Segment ending position |
|---|---|---|
| T07560_T24 (SEQ ID NO: 4233) | 4039 | 4100 |
| T07560_T25 (SEQ ID NO: 4234) | 3112 | 3173 |

This segment can be found in the following protein(s): T07560_P34.

Segment cluster T07560_node_89 (SEQ ID NO:5925) according to the present invention is supported by 145 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5479 below describes the starting and ending position of this segment on each transcript.

TABLE 5479

Segment location on transcripts

| Transcript name | Segment starting position | Segment ending position |
|---|---|---|
| T07560_T10 (SEQ ID NO: 4229) | 3083 | 3111 |
| T07560_T18 (SEQ ID NO: 4230) | 2439 | 2467 |
| T07560_T19 (SEQ ID NO: 4231) | 2016 | 2044 |
| T07560_T20 (SEQ ID NO: 4232) | 2064 | 2092 |
| T07560_T24 (SEQ ID NO: 4233) | 4101 | 4129 |
| T07560_T25 (SEQ ID NO: 4234) | 3174 | 3202 |

This segment can be found in the following protein(s): T07560_P34.

Segment cluster T07560_node_90 (SEQ ID NO:5926) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5480 below describes the starting and ending position of this segment on each transcript.

TABLE 5480

Segment location on transcripts

| Transcript name | Segment starting position | Segment ending position |
|---|---|---|
| T07560_T10 (SEQ ID NO: 4229) | 3112 | 3121 |
| T07560_T18 (SEQ ID NO: 4230) | 2468 | 2477 |
| T07560_T19 (SEQ ID NO: 4231) | 2045 | 2054 |
| T07560_T20 (SEQ ID NO: 4232) | 2093 | 2102 |
| T07560_T24 (SEQ ID NO: 4233) | 4130 | 4139 |
| T07560_T25 (SEQ ID NO: 4234) | 3203 | 3212 |

This segment can be found in the following protein(s): T07560_P34.

Segment cluster T07560_node_91 (SEQ ID NO:5927) according to the present invention is supported by 180 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5481 below describes the starting and ending position of this segment on each transcript.

TABLE 5481

Segment location on transcripts

| Transcript name | Segment starting position | Segment ending position |
|---|---|---|
| T07560_T10 (SEQ ID NO: 4229) | 3122 | 3211 |
| T07560_T18 (SEQ ID NO: 4230) | 2478 | 2567 |
| T07560_T19 (SEQ ID NO: 4231) | 2055 | 2144 |
| T07560_T20 (SEQ ID NO: 4232) | 2103 | 2192 |
| T07560_T24 (SEQ ID NO: 4233) | 4140 | 4229 |
| T07560_T25 (SEQ ID NO: 4234) | 3213 | 3302 |

This segment can be found in a non-coding region of transcript(s) that are related to the following protein(s): T07560_P34.

Segment cluster T07560_node_92 (SEQ ID NO:5928) according to the present invention is supported by 167 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5482 below describes the starting and ending position of this segment on each transcript.

TABLE 5482

Segment location on transcripts

| Transcript name | Segment starting position | Segment ending position |
|---|---|---|
| T07560_T10 (SEQ ID NO: 4229) | 3212 | 3248 |
| T07560_T18 (SEQ ID NO: 4230) | 2568 | 2604 |
| T07560_T19 (SEQ ID NO: 4231) | 2145 | 2181 |
| T07560_T20 (SEQ ID NO: 4232) | 2193 | 2229 |
| T07560_T24 (SEQ ID NO: 4233) | 4230 | 4266 |
| T07560_T25 (SEQ ID NO: 4234) | 3303 | 3339 |

This segment can be found in a non-coding region of transcript(s) that are related to the following protein(s): T07560_P34.

Segment cluster T07560_node_93 (SEQ ID NO:5929) according to the present invention is supported by 162 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5483 below describes the starting and ending position of this segment on each transcript.

TABLE 5483

Segment location on transcripts

| Transcript name | Segment starting position | Segment ending position |
|---|---|---|
| T07560_T10 (SEQ ID NO: 4229) | 3249 | 3279 |
| T07560_T18 (SEQ ID NO: 4230) | 2605 | 2635 |
| T07560_T19 (SEQ ID NO: 4231) | 2182 | 2212 |
| T07560_T20 (SEQ ID NO: 4232) | 2230 | 2260 |

TABLE 5483-continued

Segment location on transcripts

| Transcript name | Segment starting position | Segment ending position |
|---|---|---|
| T07560_T24 (SEQ ID NO: 4233) | 4267 | 4297 |
| T07560_T25 (SEQ ID NO: 4234) | 3340 | 3370 |

This segment can be found in a non-coding region of transcript(s) that are related to the following protein(s): T07560_P34.

Segment cluster T07560_node__95 (SEQ ID NO:5930) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5484 below describes the starting and ending position of this segment on each transcript.

TABLE 5484

Segment location on transcripts

| Transcript name | Segment starting position | Segment ending position |
|---|---|---|
| T07560_T10 (SEQ ID NO: 4229) | 3280 | 3285 |
| T07560_T18 (SEQ ID NO: 4230) | 2636 | 2641 |
| T07560_T19 (SEQ ID NO: 4231) | 2213 | 2218 |
| T07560_T20 (SEQ ID NO: 4232) | 2261 | 2266 |
| T07560_T24 (SEQ ID NO: 4233) | 4298 | 4303 |
| T07560_T25 (SEQ ID NO: 4234) | 3371 | 3376 |

This segment can be found in a non-coding region of transcript(s) that are related to the following protein(s): T07560_P34.

Segment cluster T07560_node__98 (SEQ ID NO:5931) according to the present invention is supported by 194 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5485 below describes the starting and ending position of this segment on each transcript.

TABLE 5485

Segment location on transcripts

| Transcript name | Segment starting position | Segment ending position |
|---|---|---|
| T07560_T10 (SEQ ID NO: 4229) | 3580 | 3670 |
| T07560_T18 (SEQ ID NO: 4230) | 2936 | 3026 |
| T07560_T19 (SEQ ID NO: 4231) | 2513 | 2603 |
| T07560_T20 (SEQ ID NO: 4232) | 2561 | 2651 |
| T07560_T24 (SEQ ID NO: 4233) | 4598 | 4688 |
| T07560_T25 (SEQ ID NO: 4234) | 3671 | 3761 |

This segment can be found in a non-coding region of transcript(s) that are related to the following protein(s): T07560_P34.

Segment cluster T07560_node__99 (SEQ ID NO:5932) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5486 below describes the starting and ending position of this segment on each transcript.

TABLE 5486

Segment location on transcripts

| Transcript name | Segment starting position | Segment ending position |
|---|---|---|
| T07560_T10 (SEQ ID NO: 4229) | 3671 | 3682 |
| T07560_T18 (SEQ ID NO: 4230) | 3027 | 3038 |
| T07560_T19 (SEQ ID NO: 4231) | 2604 | 2615 |
| T07560_T20 (SEQ ID NO: 4232) | 2652 | 2663 |
| T07560_T24 (SEQ ID NO: 4233) | 4689 | 4700 |
| T07560_T25 (SEQ ID NO: 4234) | 3762 | 3773 |

This segment can be found in a non-coding region of transcript(s) that are related to the following protein(s): T07560_P34.

Segment cluster T07560_node__100 (SEQ ID NO:5933) according to the present invention is supported by 223 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5487 below describes the starting and ending position of this segment on each transcript.

TABLE 5487

Segment location on transcripts

| Transcript name | Segment starting position | Segment ending position |
|---|---|---|
| T07560_T10 (SEQ ID NO: 4229) | 3683 | 3747 |
| T07560_T18 (SEQ ID NO: 4230) | 3039 | 3103 |
| T07560_T19 (SEQ ID NO: 4231) | 2616 | 2680 |
| T07560_T20 (SEQ ID NO: 4232) | 2664 | 2728 |
| T07560_T24 (SEQ ID NO: 4233) | 4701 | 4765 |
| T07560_T25 (SEQ ID NO: 4234) | 3774 | 3838 |

This segment can be found in a non-coding region of transcript(s) that are related to the following protein(s): T07560_P34.

Segment cluster T07560 node__101 (SEQ ID NO:5934) according to the present invention is supported by 246 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5488 below describes the starting and ending position of this segment on each transcript.

TABLE 5488

Segment location on transcripts

| Transcript name | Segment starting position | Segment ending position |
|---|---|---|
| T07560_T10 (SEQ ID NO: 4229) | 3748 | 3836 |
| T07560_T18 (SEQ ID NO: 4230) | 3104 | 3192 |
| T07560_T19 (SEQ ID NO: 4231) | 2681 | 2769 |
| T07560_T20 (SEQ ID NO: 4232) | 2729 | 2817 |

TABLE 5488-continued

Segment location on transcripts

| Transcript name | Segment starting position | Segment ending position |
|---|---|---|
| T07560_T24 (SEQ ID NO: 4233) | 4766 | 4854 |
| T07560_T25 (SEQ ID NO: 4234) | 3839 | 3927 |

This segment can be found in a non-coding region of transcript(s) that are related to the following protein(s): T07560_P34.

Segment cluster T07560_node_102 (SEQ ID NO:5935) according to the present invention is supported by 219 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5489 below describes the starting and ending position of this segment on each transcript.

TABLE 5489

Segment location on transcripts

| Transcript name | Segment starting position | Segment ending position |
|---|---|---|
| T07560_T10 (SEQ ID NO: 4229) | 3837 | 3883 |
| T07560_T18 (SEQ ID NO: 4230) | 3193 | 3239 |
| T07560_T19 (SEQ ID NO: 4231) | 2770 | 2816 |
| T07560_T20 (SEQ ID NO: 4232) | 2818 | 2864 |
| T07560_T24 (SEQ ID NO: 4233) | 4855 | 4901 |
| T07560_T25 (SEQ ID NO: 4234) | 3928 | 3974 |

This segment can be found in a non-coding region of transcript(s) that are related to the following protein(s): T07560_P34.

Segment cluster T07560_node_103 (SEQ ID NO:5936) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5490 below describes the starting and ending position of this segment on each transcript.

TABLE 5490

Segment location on transcripts

| Transcript name | Segment starting position | Segment ending position |
|---|---|---|
| T07560_T10 (SEQ ID NO: 4229) | 3884 | 3908 |
| T07560_T18 (SEQ ID NO: 4230) | 3240 | 3264 |
| T07560_T19 (SEQ ID NO: 4231) | 2817 | 2841 |
| T07560_T20 (SEQ ID NO: 4232) | 2865 | 2889 |
| T07560_T24 (SEQ ID NO: 4233) | 4902 | 4926 |
| T07560_T25 (SEQ ID NO: 4234) | 3975 | 3999 |

This segment can be found in a non-coding region of transcript(s) that are related to the following protein(s): T07560_P34.

Segment cluster T07560_node_104 (SEQ ID NO:5937) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5491 below describes the starting and ending position of this segment on each transcript.

TABLE 5491

Segment location on transcripts

| Transcript name | Segment starting position | Segment ending position |
|---|---|---|
| T07560_T10 (SEQ ID NO: 4229) | 3909 | 3926 |
| T07560_T18 (SEQ ID NO: 4230) | 3265 | 3282 |
| T07560_T19 (SEQ ID NO: 4231) | 2842 | 2859 |
| T07560_T20 (SEQ ID NO: 4232) | 2890 | 2907 |
| T07560_T24 (SEQ ID NO: 4233) | 4927 | 4944 |
| T07560_T25 (SEQ ID NO: 4234) | 4000 | 4017 |

This segment can be found in a non-coding region of transcript(s) that are related to the following protein(s): T07560_P34.

Segment cluster T07560_node_105 (SEQ ID NO:5938) according to the present invention is supported by 201 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5492 below describes the starting and ending position of this segment on each transcript.

TABLE 5492

Segment location on transcripts

| Transcript name | Segment starting position | Segment ending position |
|---|---|---|
| T07560_T10 (SEQ ID NO:4229) | 3927 | 3981 |
| T07560_T18 (SEQ ID NO:4230) | 3283 | 3337 |
| T07560_T19 (SEQ ID NO:4231) | 2860 | 2914 |
| T07560_T20 (SEQ ID NO:4232) | 2908 | 2962 |
| T07560_T24 (SEQ ID NO:4233) | 4945 | 4999 |
| T07560_T25 (SEQ ID NO:4234) | 4018 | 4072 |

This segment can be found in a non-coding region of transcript(s) that are related to the following protein(s): T07560_P34.

Segment cluster T07560_node_106 (SEQ ID NO:5939) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5493 below describes the starting and ending position of this segment on each transcript.

TABLE 5493

Segment location on transcripts

| Transcript name | Segment starting position | Segment ending position |
|---|---|---|
| T07560_T10 (SEQ ID NO: 4229) | 3982 | 4003 |
| T07560_T18 (SEQ ID NO: 4230) | 3338 | 3359 |
| T07560_T19 (SEQ ID NO: 4231) | 2915 | 2936 |
| T07560_T20 (SEQ ID NO: 4232) | 2963 | 2984 |
| T07560_T24 (SEQ ID NO: 4233) | 5000 | 5021 |
| T07560_T25 (SEQ ID NO: 4234) | 4073 | 4094 |

This segment can be found in a non-coding region of transcript(s) that are related to the following protein(s): T07560_P34.

Segment cluster T07560_node_107 (SEQ ID NO:5940) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5494 below describes the starting and ending position of this segment on each transcript.

TABLE 5494

Segment location on transcripts

| Transcript name | Segment starting position | Segment ending position |
|---|---|---|
| T07560_T10 (SEQ ID NO: 4229) | 4004 | 4026 |
| T07560_T18 (SEQ ID NO: 4230) | 3360 | 3382 |
| T07560_T19 (SEQ ID NO: 4231) | 2937 | 2959 |
| T07560_T20 (SEQ ID NO: 4232) | 2985 | 3007 |
| T07560_T24 (SEQ ID NO: 4233) | 5022 | 5044 |
| T07560_T25 (SEQ ID NO: 4234) | 4095 | 4117 |

This segment can be found in a non-coding region of transcript(s) that are related to the following protein(s): T07560_P34.

Segment cluster T07560_node_108 (SEQ ID NO:5941) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5495 below describes the starting and ending position of this segment on each transcript.

TABLE 5495

Segment location on transcripts

| Transcript name | Segment starting position | Segment ending position |
|---|---|---|
| T07560_T10 (SEQ ID NO: 4229) | 4027 | 4031 |
| T07560_T18 (SEQ ID NO: 4230) | 3383 | 3387 |
| T07560_T19 (SEQ ID NO: 4231) | 2960 | 2964 |
| T07560_T20 (SEQ ID NO: 4232) | 3008 | 3012 |
| T07560_T24 (SEQ ID NO: 4233) | 5045 | 5049 |
| T07560_T25 (SEQ ID NO: 4234) | 4118 | 4122 |

This segment can be found in a non-coding region of transcript(s) that are related to the following protein(s): T07560_P34.

Segment cluster T07560_node_109 (SEQ ID NO:5942) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5496 below describes the starting and ending position of this segment on each transcript.

TABLE 5496

Segment location on transcripts

| Transcript name | Segment starting position | Segment ending position |
|---|---|---|
| T07560_T10 (SEQ ID NO: 4229) | 4032 | 4036 |
| T07560_T18 (SEQ ID NO: 4230) | 3388 | 3392 |
| T07560_T19 (SEQ ID NO: 4231) | 2965 | 2969 |
| T07560_T20 (SEQ ID NO: 4232) | 3013 | 3017 |
| T07560_T24 (SEQ ID NO: 4233) | 5050 | 5054 |
| T07560_T25 (SEQ ID NO: 4234) | 4123 | 4127 |

This segment can be found in a non-coding region of transcript(s) that are related to the following protein(s): T07560_P34.

Segment cluster T07560_node_110 (SEQ ID NO:5943) according to the present invention is supported by 189 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5497 below describes the starting and ending position of this segment on each transcript.

TABLE 5497

Segment location on transcripts

| Transcript name | Segment starting position | Segment ending position |
|---|---|---|
| T07560_T10 (SEQ ID NO: 4229) | 4037 | 4092 |
| T07560_T18 (SEQ ID NO: 4230) | 3393 | 3448 |
| T07560_T19 (SEQ ID NO: 4231) | 2970 | 3025 |
| T07560_T20 (SEQ ID NO: 4232) | 3018 | 3073 |
| T07560_T24 (SEQ ID NO: 4233) | 5055 | 5110 |
| T07560_T25 (SEQ ID NO: 4234) | 4128 | 4183 |

This segment can be found in a non-coding region of transcript(s) that are related to the following protein(s): T07560_P34.

Segment cluster T07560_node_111 (SEQ ID NO:5944) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5498 below describes the starting and ending position of this segment on each transcript.

TABLE 5498

Segment location on transcripts

| Transcript name | Segment starting position | Segment ending position |
|---|---|---|
| T07560_T10 (SEQ ID NO: 4229) | 4093 | 4096 |
| T07560_T18 (SEQ ID NO: 4230) | 3449 | 3452 |
| T07560_T19 (SEQ ID NO: 4231) | 3026 | 3029 |
| T07560_T20 (SEQ ID NO: 4232) | 3074 | 3077 |
| T07560_T24 (SEQ ID NO: 4233) | 5111 | 5114 |
| T07560_T25 (SEQ ID NO: 4234) | 4184 | 4187 |

This segment can be found in a non-coding region of transcript(s) that are related to the following protein(s): T07560_P34.

Segment cluster T07560_node__112 (SEQ ID NO:5945) according to the present invention can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5499 below describes the starting and ending position of this segment on each transcript.

TABLE 5499

Segment location on transcripts

| Transcript name | Segment starting position | Segment ending position |
|---|---|---|
| T07560_T10 (SEQ ID NO: 4229) | 4097 | 4113 |
| T07560_T18 (SEQ ID NO: 4230) | 3453 | 3469 |
| T07560_T19 (SEQ ID NO: 4231) | 3030 | 3046 |
| T07560_T20 (SEQ ID NO: 4232) | 3078 | 3094 |
| T07560_T24 (SEQ ID NO: 4233) | 5115 | 5131 |
| T07560_T25 (SEQ ID NO: 4234) | 4188 | 4204 |

This segment can be found in a non-coding region of transcript(s) that are related to the following protein(s): T07560_P34.

Segment cluster T07560_node__113 (SEQ ID NO:5946) according to the present invention is supported by 183 libraries. The number of libraries was determined as previously described. This segment can be found in the following transcript(s): T07560_T10 (SEQ ID NO:4229), T07560_T18 (SEQ ID NO:4230), T07560_T19 (SEQ ID NO:4231), T07560_T20 (SEQ ID NO:4232), T07560_T24 (SEQ ID NO:4233) and T07560_T25 (SEQ ID NO:4234). Table 5500 below describes the starting and ending position of this segment on each transcript.

TABLE 5500

Segment location on transcripts

| Transcript name | Segment starting position | Segment ending position |
|---|---|---|
| T07560_T10 (SEQ ID NO: 4229) | 4114 | 4221 |
| T07560_T18 (SEQ ID NO: 4230) | 3470 | 3577 |
| T07560_T19 (SEQ ID NO: 4231) | 3047 | 3154 |
| T07560_T20 (SEQ ID NO: 4232) | 3095 | 3202 |
| T07560_T24 (SEQ ID NO: 4233) | 5132 | 5239 |
| T07560_T25 (SEQ ID NO: 4234) | 4205 | 4312 |

This segment can be found in a non-coding region of transcript(s) that are related to the following protein(s): T07560_P34.

Description for Cluster T11628

Cluster T11628 features 5 transcript(s) and 23 segment(s) of interest, the names for which are given in Tables 5501 and 5502, respectively, the sequences themselves are given at the end of the application. The selected protein variants are given in Table 5503.

TABLE 5501

Transcripts of interest
Transcript Name

T11628_PEA_1_T3 (SEQ ID NO: 4237)
T11628_PEA_1_T4 (SEQ ID NO: 4238)
T11628_PEA_1_T5 (SEQ ID NO: 4239)

TABLE 5501-continued

Transcripts of interest
Transcript Name

T11628_PEA_1_T7 (SEQ ID NO: 4240)
T11628_PEA_1_T9 (SEQ ID NO: 4241)

TABLE 5502

Segments of interest
Segment Name

T11628_PEA_1_node_7 (SEQ ID NO: 5947)
T11628_PEA_1_node_11 (SEQ ID NO: 5948)
T11628_PEA_1_node_22 (SEQ ID NO: 5949)
T11628_PEA_1_node_25 (SEQ ID NO: 5950)
T11628_PEA_1_node_31 (SEQ ID NO: 5951)
T11628_PEA_1_node_37 (SEQ ID NO: 5952)
T11628_PEA_1_node_0 (SEQ ID NO: 5953)
T11628_PEA_1_node_4 (SEQ ID NO: 5954)
T11628_PEA_1_node_9 (SEQ ID NO: 5955)
T11628_PEA_1_node_13 (SEQ ID NO: 5956)
T11628_PEA_1_node_14 (SEQ ID NO: 5957)
T11628_PEA_1_node_18 (SEQ ID NO: 5958)
T11628_PEA_1_node_19 (SEQ ID NO: 5959)
T11628_PEA_1_node_24 (SEQ ID NO: 5960)
T11628_PEA_1_node_27 (SEQ ID NO: 5961)
T11628_PEA_1_node_28 (SEQ ID NO: 5962)
T11628_PEA_1_node_29 (SEQ ID NO: 5963)
T11628_PEA_1_node_30 (SEQ ID NO: 5964)
T11628_PEA_1_node_32 (SEQ ID NO: 5965)
T11628_PEA_1_node_33 (SEQ ID NO: 5966)
T11628_PEA_1_node_34 (SEQ ID NO: 5967)
T11628_PEA_1_node_35 (SEQ ID NO: 5968)
T11628_PEA_1_node_36 (SEQ ID NO: 5969)

TABLE 5503

Proteins of interest

| Protein Name | Corresponding Transcript(s) |
|---|---|
| T11628_PEA_1_P2 | T11628_PEA_1_T3 (SEQ ID NO: 4237); T11628_PEA_1_T5 (SEQ ID NO: 4239); T11628_PEA_1_T7 (SEQ ID NO: 4240) |
| T11628_PEA_1_P5 | T11628_PEA_1_T9 (SEQ ID NO: 4241) |
| T11628_PEA_1_P10 | T11628_PEA_1_T4 (SEQ ID NO: 4238) |

These sequences are variants of the known protein Myoglobin (SwissProt accession identifier MYG_HUMAN), referred to herein as the previously known protein.

Protein Myoglobin is known or believed to have the following function(s): Serves as a reserve supply of oxygen and facilitates the movement of oxygen within muscles. The sequence for protein Myoglobin is given at the end of the application, as "Myoglobin amino acid sequence". Known polymorphisms for this sequence are as shown in Table 5504.

TABLE 5504

Amino acid mutations for Known Protein

| SNP position(s) on amino acid sequence | Comment |
|---|---|
| 54 | E -> K. /FTId = VAR_003180. |
| 133 | K -> N. /FTId = VAR_003181. |
| 139 | R -> Q. /FTId = VAR_003182. |
| 139 | R -> W. /FTId = VAR_003183. |
| 128 | Q -> E |

The heart-selective diagnostic marker prediction engine provided the following results with regard to cluster T11628. Predictions were made for selective expression of transcripts of this contig in heart tissue, according to the previously described methods. The numbers on the y-axis of FIG. 131 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 131, concerning the number of heart-specific clones in libraries/sequences; as well as with regard to the histogram in FIG. 132, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 27.1; the ratio of expression of the cluster in heart specific ESTs to the overall expression of the cluster in muscle-specific ESTs which was found to be 1.2; and fisher exact test P-values were computed both for library and weighted clone counts to check that the counts are statistically significant, and were found to be 1.20E-235.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 27.1, which clearly supports specific expression in heart tissue.

As noted above, cluster T11628 features 23 segment(s), which were listed in Table 5502 above and for which the sequence(s) are given at the end of the application. These segment(s) are portions of nucleic acid sequence(s) which are described herein separately because they are of particular interest. A description of each segment according to the present invention is now provided.

Segment cluster T11628_PEA_1_node_7 (SEQ ID NO:5947) according to the present invention is supported by 9 libraries. The number of libraries was determined as previously described. This segment can be found in the following transcript(s): T11628_PEA_1_T3 (SEQ ID NO:4237). Table 5505 below describes the starting and ending position of this segment on each transcript.

TABLE 5505

Segment location on transcripts

| Transcript name | Segment starting position | Segment ending position |
|---|---|---|
| T11628_PEA_1_T3 (SEQ ID NO: 4237) | 1 | 211 |

This segment can be found in a non-coding region of transcript(s) that are related to the following protein(s): T11628_PEA_1_P2.

Segment cluster T11628_PEA_1_node_11 (SEQ ID NO:5948) according to the present invention is supported by 1 libraries. The number of libraries was determined as previously described. This segment can be found in the following transcript(s): T11628_PEA_1_T5 (SEQ ID NO:4239). Table 5506 below describes the starting and ending position of this segment on each transcript.

TABLE 5506

Segment location on transcripts

| Transcript name | Segment starting position | Segment ending position |
|---|---|---|
| T11628_PEA_1_T5 (SEQ ID NO: 4239) | 48 | 178 |

This segment can be found in a non-coding region of transcript(s) that are related to the following protein(s): T11628_PEA_1_P2.

Segment cluster T11628_PEA_1_node_22 (SEQ ID NO:5949) according to the present invention is supported by 1 libraries. The number of libraries was determined as previously described. This segment can be found in the following transcript(s): T11628_PEA_1_T9 (SEQ ID NO:4241). Table 5507 below describes the starting and ending position of this segment on each transcript.

TABLE 5507

Segment location on transcripts

| Transcript name | Segment starting position | Segment ending position |
|---|---|---|
| T11628_PEA_1_T9 (SEQ ID NO: 4241) | 1 | 140 |

This segment can be found in a non-coding region of transcript(s) that are related to the following protein(s): T11628_PEA_1_P5.

Segment cluster T11628_PEA_1_node_25 (SEQ ID NO:5950) according to the present invention is supported by 129 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5508 below describes the starting and ending position of this segment on each transcript.

TABLE 5508

Segment location on transcripts

| Transcript name | Segment starting position | Segment ending position |
|---|---|---|
| T11628_PEA_1_T3 (SEQ ID NO: 4237) | 395 | 537 |
| T11628_PEA_1_T4 (SEQ ID NO: 4238) | 380 | 522 |
| T11628_PEA_1_T5 (SEQ ID NO: 4239) | 362 | 504 |
| T11628_PEA_1_T7 (SEQ ID NO: 4240) | 347 | 489 |
| T11628_PEA_1_T9 (SEQ ID NO: 4241) | 221 | 363 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5509.

TABLE 5509

Oligonucleotides related to this segment

| Oligonucleotide name | Overexpressed in cancers | Chip reference |
|---|---|---|
| T11628_0_9_0 | breast malignant tumors | BRS |
| T11628_0_9_0 | lung malignant tumors | LUN |

This segment can be found in the following protein(s): T11628_PEA_1_P2, T11628_PEA_1_P10 and T11628_PEA_1_P5.

Segment cluster T11628_PEA_1_node_31 (SEQ ID NO:5951) according to the present invention is supported by 137 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5510 below describes the starting and ending position of this segment on each transcript.

TABLE 5510

Segment location on transcripts

| Transcript name | Segment starting position | Segment ending position |
|---|---|---|
| T11628_PEA_1_T3 (SEQ ID NO: 4237) | 702 | 831 |
| T11628_PEA_1_T4 (SEQ ID NO: 4238) | 687 | 816 |
| T11628_PEA_1_T5 (SEQ ID NO: 4239) | 669 | 798 |
| T11628_PEA_1_T7 (SEQ ID NO: 4240) | 654 | 783 |
| T11628_PEA_1_T9 (SEQ ID NO: 4241) | 528 | 657 |

This segment can be found in a non-coding region of transcript(s) that are related to the following protein(s): T11628_PEA_1_P2, T11628_PEA_1_P10 and T11628_PEA_1_P5.

Segment cluster T11628_PEA_1_node_37 (SEQ ID NO:5952) according to the present invention is supported by 99 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5511 below describes the starting and ending position of this segment on each transcript.

TABLE 5511

Segment location on transcripts

| Transcript name | Segment starting position | Segment ending position |
|---|---|---|
| T11628_PEA_1_T3 (SEQ ID NO: 4237) | 1086 | 1225 |
| T11628_PEA_1_T4 (SEQ ID NO: 4238) | 1071 | 1210 |
| T11628_PEA_1_T5 (SEQ ID NO: 4239) | 1053 | 1192 |
| T11628_PEA_1_T7 (SEQ ID NO: 4240) | 1038 | 1177 |
| T11628_PEA_1_T9 (SEQ ID NO: 4241) | 912 | 1051 |

This segment can be found in a non-coding region of transcript(s) that are related to the following protein(s): T11628_PEA_1_P2, T11628_PEA_1_P10 and T11628_PEA_1_P5.

According to an optional embodiment of the present invention, short segments related to the above cluster are also provided. These segments are up to about 120 bp in length, and so are included in a separate description.

Segment cluster T11628_PEA_1_node_0 (SEQ ID NO:5953) according to the present invention is supported by 1 libraries. The number of libraries was determined as previously described. This segment can be found in the following transcript(s): T11628_PEA_1_T4 (SEQ ID NO:4238). Table 5512 below describes the starting and ending position of this segment on each transcript.

TABLE 5512

Segment location on transcripts

| Transcript name | Segment starting position | Segment ending position |
|---|---|---|
| T11628_PEA_1_T4 (SEQ ID NO: 4238) | 1 | 93 |

This segment can be found in a non-coding region of transcript(s) that are related to the following protein(s): T11628_PEA_1_P10.

Segment cluster T11628_PEA_1_node_4 (SEQ ID NO:5954) according to the present invention is supported by 2 libraries. The number of libraries was determined as previously described. This segment can be found in the following transcript(s): T11628_PEA_1_T4 (SEQ ID NO:4238). Table 5513 below describes the starting and ending position of this segment on each transcript.

TABLE 5513

Segment location on transcripts

| Transcript name | Segment starting position | Segment ending position |
|---|---|---|
| T11628_PEA_1_T4 (SEQ ID NO: 4238) | 94 | 196 |

This segment can be found in a non-coding region of transcript(s) that are related to the following protein(s): T11628_PEA_1_P10.

Segment cluster T11628_PEA_1_node_9 (SEQ ID NO:5955) according to the present invention is supported by 16 libraries. The number of libraries was determined as previously described. This segment can be found in the following transcript(s): T11628_PEA_1_T5 (SEQ ID NO:4239) and T11628_PEA_1_T7 (SEQ ID NO:4240). Table 5514 below describes the starting and ending position of this segment on each transcript.

TABLE 5514

Segment location on transcripts

| Transcript name | Segment starting position | Segment ending position |
|---|---|---|
| T11628_PEA_1_T5 (SEQ ID NO: 4239) | 1 | 47 |
| T11628_PEA_1_T7 (SEQ ID NO: 4240) | 1 | 47 |

This segment can be found in a non-coding region of transcript(s) that are related to the following protein(s): T11628_PEA_1_P2.

Segment cluster T11628_PEA_1_node_13 (SEQ ID NO:5956) according to the present invention can be found in the following transcript(s): T11628_PEA_1_T7 (SEQ ID NO:4240). Table 5515 below describes the starting and ending position of this segment on each transcript.

TABLE 5515

Segment location on transcripts

| Transcript name | Segment starting position | Segment ending position |
|---|---|---|
| T11628_PEA_1_T7 (SEQ ID NO: 4240) | 48 | 65 |

This segment can be found in a non-coding region of transcript(s) that are related to the following protein(s): T11628_PEA_1_P2.

Segment cluster T11628_PEA_1_node_14 (SEQ ID NO:5957) according to the present invention is supported by 1 libraries. The number of libraries was determined as previously described. This segment can be found in the following transcript(s): T11628_PEA_1_T7 (SEQ ID NO:4240). Table 5516 below describes the starting and ending position of this segment on each transcript.

TABLE 5516

Segment location on transcripts

| Transcript name | Segment starting position | Segment ending position |
|---|---|---|
| T11628_PEA_1_T7 (SEQ ID NO: 4240) | 66 | 163 |

This segment can be found in a non-coding region of transcript(s) that are related to the following protein(s): T11628_PEA_1_P2.

Segment cluster T11628_PEA_1_node_18 (SEQ ID NO:5958) according to the present invention is supported by 98 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239) and T11628_PEA_1_T7 (SEQ ID NO:4240). Table 5517 below describes the starting and ending position of this segment on each transcript.

TABLE 5517

Segment location on transcripts

| Transcript name | Segment starting position | Segment ending position |
|---|---|---|
| T11628_PEA_1_T3 (SEQ ID NO: 4237) | 212 | 289 |
| T11628_PEA_1_T4 (SEQ ID NO: 4238) | 197 | 274 |
| T11628_PEA_1_T5 (SEQ ID NO: 4239) | 179 | 256 |
| T11628_PEA_1_T7 (SEQ ID NO: 4240) | 164 | 241 |

This segment can be found in the following protein(s): T11628_PEA_1_P2 and T11628_PEA_1_P10.

Segment cluster T11628_PEA_1_node_19 (SEQ ID NO:5959) according to the present invention can be found in the following transcript(s): T11628_PEA_1_T3 (SEQ ID NO:4237), T11628_PEA_1_T4 (SEQ ID NO:4238), T11628_PEA_1_T5 (SEQ ID NO:4239) and T11628_PEA_1_T7 (SEQ ID NO:4240). Table 5518 below describes the starting and ending position of this segment on each transcript.

TABLE 5518

Segment location on transcripts

| Transcript name | Segment starting position | Segment ending position |
|---|---|---|
| T11628_PEA_1_T3 (SEQ ID NO: 4237) | 290 | 314 |
| T11628_PEA_1_T4 (SEQ ID NO: 4238) | 275 | 299 |
| T11628_PEA_1_T5 (SEQ ID NO: 4239) | 257 | 281 |
| T11628_PEA_1_T7 (SEQ ID NO: 4240) | 242 | 266 |

This segment can be found in the following protein(s): T11628_PEA_1_P2 and T11628_PEA_1_P10.

Segment cluster T11628_PEA_1_node_24 (SEQ ID NO:5960) according to the present invention is supported by 112 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5519 below describes the starting and ending position of this segment on each transcript.

TABLE 5519

Segment location on transcripts

| Transcript name | Segment starting position | Segment ending position |
|---|---|---|
| T11628_PEA_1_T3 (SEQ ID NO: 4237) | 315 | 394 |
| T11628_PEA_1_T4 (SEQ ID NO: 4238) | 300 | 379 |
| T11628_PEA_1_T5 (SEQ ID NO: 4239) | 282 | 361 |
| T11628_PEA_1_T7 (SEQ ID NO: 4240) | 267 | 346 |
| T11628_PEA_1_T9 (SEQ ID NO: 4241) | 141 | 220 |

This segment can be found in the following protein(s): T11628_PEA_1_P2, T11628_PEA_1_P10 and T11628_PEA_1_P5.

Segment cluster T11628_PEA_1_node_27 (SEQ ID NO:5961) according to the present invention is supported by 119 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5520 below describes the starting and ending position of this segment on each transcript.

TABLE 5520

Segment location on transcripts

| Transcript name | Segment starting position | Segment ending position |
| --- | --- | --- |
| T11628_PEA_1_T3 (SEQ ID NO: 4237) | 538 | 621 |
| T11628_PEA_1_T4 (SEQ ID NO: 4238) | 523 | 606 |
| T11628_PEA_1_T5 (SEQ ID NO: 4239) | 505 | 588 |
| T11628_PEA_1_T7 (SEQ ID NO: 4240) | 490 | 573 |
| T11628_PEA_1_T9 (SEQ ID NO: 4241) | 364 | 447 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5521.

TABLE 5521

Oligonucleotides related to this segment

| Oligonucleotide name | Overexpressed in cancers | Chip reference |
| --- | --- | --- |
| T11628_0_9_0 | breast malignant tumors | BRS |
| T11628_0_9_0 | lung malignant tumors | LUN |

This segment can be found in the following protein(s): T11628_PEA_1_P2, T11628_PEA_1_P10 and T11628_PEA_1_P5.

Segment cluster T11628_PEA_1_node_28 (SEQ ID NO:5962) according to the present invention is supported by 115 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5522 below describes the starting and ending position of this segment on each transcript.

TABLE 5522

Segment location on transcripts

| Transcript name | Segment starting position | Segment ending position |
| --- | --- | --- |
| T11628_PEA_1_T3 (SEQ ID NO: 4237) | 622 | 650 |

TABLE 5522-continued

Segment location on transcripts

| Transcript name | Segment starting position | Segment ending position |
| --- | --- | --- |
| T11628_PEA_1_T4 (SEQ ID NO: 4238) | 607 | 635 |
| T11628_PEA_1_T5 (SEQ ID NO: 4239) | 589 | 617 |
| T11628_PEA_1_T7 (SEQ ID NO: 4240) | 574 | 602 |
| T11628_PEA_1_T9 (SEQ ID NO: 4241) | 448 | 476 |

This segment can be found in the following protein(s): T11628_PEA_1_P2, T11628_PEA_1_P10 and T11628PEA_1_P5.

Segment cluster T11628_PEA_1_node_29 (SEQ ID NO:5963) according to the present invention is supported by 113 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5523 below describes the starting and ending position of this segment on each transcript.

TABLE 5523

Segment location on transcripts

| Transcript name | Segment starting position | Segment ending position |
| --- | --- | --- |
| T11628_PEA_1_T3 (SEQ ID NO: 4237) | 651 | 678 |
| T11628_PEA_1_T4 (SEQ ID NO: 4238) | 636 | 663 |
| T11628_PEA_1_T5 (SEQ ID NO: 4239) | 618 | 645 |
| T11628_PEA_1_T7 (SEQ ID NO: 4240) | 603 | 630 |
| T11628_PEA_1_T9 (SEQ ID NO: 4241) | 477 | 504 |

This segment can be found in the following protein(s): T11628_PEA_1_P2, T11628_PEA_1_P10 and T11628_PEA_1_P5.

Segment cluster T11628_PEA_1_node_30 (SEQ ID NO:5964) according to the present invention can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5524 below describes the starting and ending position of this segment on each transcript.

TABLE 5524

Segment location on transcripts

| Transcript name | Segment starting position | Segment ending position |
| --- | --- | --- |
| T11628_PEA_1_T3 (SEQ ID NO: 4237) | 679 | 701 |
| T11628_PEA_1_T4 (SEQ ID NO: 4238) | 664 | 686 |

TABLE 5524-continued

Segment location on transcripts

| Transcript name | Segment starting position | Segment ending position |
|---|---|---|
| T11628_PEA_1_T5 (SEQ ID NO: 4239) | 646 | 668 |
| T11628_PEA_1_T7 (SEQ ID NO: 4240) | 631 | 653 |
| T11628_PEA_1_T9 (SEQ ID NO: 4241) | 505 | 527 |

This segment can be found in the following protein(s): T11628_PEA_1_P2, T11628_PEA_1_P10 and T11628_PEA_1_P5.

Segment cluster T11628_PEA_1_node_32 (SEQ ID NO:5965) according to the present invention can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5525 below describes the starting and ending position of this segment on each transcript.

TABLE 5525

Segment location on transcripts

| Transcript name | Segment starting position | Segment ending position |
|---|---|---|
| T11628_PEA_1_T3 (SEQ ID NO: 4237) | 832 | 844 |
| T11628_PEA_1_T4 (SEQ ID NO: 4238) | 817 | 829 |
| T11628_PEA_1_T5 (SEQ ID NO: 4239) | 799 | 811 |
| T11628_PEA_1_T7 (SEQ ID NO: 4240) | 784 | 796 |
| T11628_PEA_1_T9 (SEQ ID NO: 4241) | 658 | 670 |

This segment can be found in a non-coding region of transcript(s) that are related to the following protein(s): T11628PEA_1_P2, T11628_PEA_1_P10 and T11628_PEA_1_P5.

Segment cluster T11628_PEA_1_node_33 (SEQ ID NO:5966) according to the present invention can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5526 below describes the starting and ending position of this segment on each transcript.

TABLE 5526

Segment location on transcripts

| Transcript name | Segment starting position | Segment ending position |
|---|---|---|
| T11628_PEA_1_T3 (SEQ ID NO: 4237) | 845 | 866 |
| T11628_PEA_1_T4 (SEQ ID NO: 4238) | 830 | 851 |
| T11628_PEA_1_T5 (SEQ ID NO: 4239) | 812 | 833 |
| T11628_PEA_1_T7 (SEQ ID NO: 4240) | 797 | 818 |

TABLE 5526-continued

Segment location on transcripts

| Transcript name | Segment starting position | Segment ending position |
|---|---|---|
| T11628_PEA_1_T9 (SEQ ID NO: 4241) | 671 | 692 |

This segment can be found in a non-coding region of transcript(s) that are related to the following protein(s): T11628_PEA_1_P2, T11628_PEA_1_P10 and T11628_PEA_1_P5.

Segment cluster T11628_PEA_1_node_34 (SEQ ID NO:5967) according to the present invention is supported by 122 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5527 below describes the starting and ending position of this segment on each transcript.

TABLE 5527

Segment location on transcripts

| Transcript name | Segment starting position | Segment ending position |
|---|---|---|
| T11628_PEA_1_T3 (SEQ ID NO: 4237) | 867 | 911 |
| T11628_PEA_1_T4 (SEQ ID NO: 4238) | 852 | 896 |
| T11628_PEA_1_T5 (SEQ ID NO: 4239) | 834 | 878 |
| T11628_PEA_1_T7 (SEQ ID NO: 4240) | 819 | 863 |
| T11628_PEA_1_T9 (SEQ ID NO: 4241) | 693 | 737 |

This segment can be found in a non-coding region of transcript(s) that are related to the following protein(s): T11628_PEA_1_P2, T11628_PEA_1_P10 and T11628_PEA_1_P5.

Segment cluster T11628_PEA_1_node_35 (SEQ ID NO:5968) according to the present invention is supported by 126 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5528 below describes the starting and ending position of this segment on each transcript.

TABLE 5528

Segment location on transcripts

| Transcript name | Segment starting position | Segment ending position |
|---|---|---|
| T11628_PEA_1_T3 (SEQ ID NO: 4237) | 912 | 967 |
| T11628_PEA_1_T4 (SEQ ID NO: 4238) | 897 | 952 |
| T11628_PEA_1_T5 (SEQ ID NO: 4239) | 879 | 934 |

TABLE 5528-continued

Segment location on transcripts

| Transcript name | Segment starting position | Segment ending position |
|---|---|---|
| T11628_PEA_1_T7 (SEQ ID NO: 4240) | 864 | 919 |
| T11628_PEA_1_T9 (SEQ ID NO: 4241) | 738 | 793 |

This segment can be found in a non-coding region of transcript(s) that are related to the following protein(s): T11628_PEA_1_P2, T11628_PEA_1_P10 and T11628_PEA_1_P5.

Segment cluster T11628_PEA_1_node_36 (SEQ ID NO:5969) according to the present invention is supported by 122 libraries. The number of libraries was determined as previously described. This segment can be found in the following transcript(s): T11628_PEA_1_T3 (SEQ ID NO:4237), T11628_PEA_1_T4 (SEQ ID NO:4238), T11628_PEA_1_T5 (SEQ ID NO:4239), T11628_PEA_1_T7 (SEQ ID NO:4240) and T11628_PEA_1_T9 (SEQ ID NO:4241). Table 5529 below describes the starting and ending position of this segment on each transcript.

TABLE 5529

Segment location on transcripts

| Transcript name | Segment starting position | Segment ending position |
|---|---|---|
| T11628_PEA_1_T3 (SEQ ID NO: 4237) | 968 | 1085 |
| T11628_PEA_1_T4 (SEQ ID NO: 4238) | 953 | 1070 |
| T11628_PEA_1_T5 (SEQ ID NO: 4239) | 935 | 1052 |
| T11628_PEA_1_T7 (SEQ ID NO: 4240) | 920 | 1037 |
| T11628_PEA_1_T9 (SEQ ID NO: 4241) | 794 | 911 |

This segment can be found in a non-coding region of transcript(s) that are related to the following protein(s): T11628_PEA_1_P2, T11628_PEA_1_P10 and T11628_PEA_1_P5.

Description for Cluster T19724

Cluster T19724 features 2 transcript(s) and 24 segment(s) of interest, the names for which are given in Tables 5530 and 5531, respectively, the sequences themselves are given at the end of the application. The selected protein variants are given in Table 5532.

TABLE 5530

Transcripts of interest
Transcript Name

T19724_T38 (SEQ ID NO: 4242)
T19724_T41 (SEQ ID NO: 4243)

TABLE 5531

Segments of interest
Segment Name

T19724_node_30 (SEQ ID NO: 5970)
T19724_node_48 (SEQ ID NO: 5971)
T19724_node_50 (SEQ ID NO: 5972)
T19724_node_59 (SEQ ID NO: 5973)
T19724_node_62 (SEQ ID NO: 5974)
T19724_node_65 (SEQ ID NO: 5975)
T19724_node_70 (SEQ ID NO: 5976)
T19724_node_72 (SEQ ID NO: 5977)
T19724_node_76 (SEQ ID NO: 5978)
T19724_node_49 (SEQ ID NO: 5979)
T19724_node_52 (SEQ ID NO: 5980)
T19724_node_53 (SEQ ID NO: 5981)
T19724_node_54 (SEQ ID NO: 5982)
T19724_node_60 (SEQ ID NO: 5983)
T19724_node_61 (SEQ ID NO: 5984)
T19724_node_63 (SEQ ID NO: 5985)
T19724_node_66 (SEQ ID NO: 5986)
T19724_node_67 (SEQ ID NO: 5987)
T19724_node_68 (SEQ ID NO: 5988)
T19724_node_69 (SEQ ID NO: 5989)
T19724_node_71 (SEQ ID NO: 5990)
T19724_node_73 (SEQ ID NO: 5991)
T19724_node_74 (SEQ ID NO: 5992)
T19724_node_75 (SEQ ID NO: 5993)

TABLE 5532

Proteins of interest

| Protein Name | Corresponding Transcript(s) |
|---|---|
| T19724_P21 | T19724_T38 (SEQ ID NO: 4242) |
| T19724_P23 | T19724_T41 (SEQ ID NO: 4243) |

These sequences are variants of the known protein DNA replication licensing factor MCM4 (SwissProt accession identifier MCM4_HUMAN; known also according to the synonyms CDC21 homolog; P1-CDC21), referred to herein as the previously known protein.

Protein DNA replication licensing factor MCM4 is known or believed to have the following function(s): Involved in the control of DNA replication. The sequence for protein DNA replication licensing factor MCM4 is given at the end of the application, as "DNA replication licensing factor MCM4 amino acid sequence". Known polymorphisms for this sequence are as shown in Table 5533.

TABLE 5533

Amino acid mutations for Known Protein

| SNP position(s) on amino acid sequence | Comment |
|---|---|
| 62 | T -> P |
| 206 | Q -> P |
| 650 | M -> L |

Protein DNA replication licensing factor MCM4 localization is believed to be Nuclear (By similarity).

The following GO Annotation(s) apply to the previously known protein. The following annotation(s) were found: DNA replication; DNA replication initiation; transcription regulation, which are annotation(s) related to Biological Process; nucleotide binding; DNA binding; ATP binding; DNA dependent adenosinetriphosphatase, which are annotation(s)

related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T19724 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 133 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 133 and Table 5534. This cluster is overexpressed (at least at a minimum level) in the following pathological conditions: epithelial malignant tumors, a mixture of malignant tumors from different tissues, kidney malignant tumors, ovarian carcinoma, skin malignancies and uterine malignancies.

TABLE 5534

Normal tissue distribution

| Name of Tissue | Number |
| --- | --- |
| Adrenal | 0 |
| Bladder | 0 |
| Bone | 0 |
| Brain | 27 |
| Colon | 9 |
| Epithelial | 13 |
| General | 27 |
| head and neck | 10 |
| Kidney | 6 |
| Liver | 4 |
| Lung | 23 |
| Lymph nodes | 165 |
| Breast | 48 |
| bone marrow | 188 |
| Muscle | 22 |
| Ovary | 0 |
| Pancreas | 0 |
| Prostate | 20 |
| Skin | 26 |
| Stomach | 36 |
| Uterus | 4 |

TABLE 5535

P values and ratios for expression in cancerous tissue

| Name of Tissue | P1 | P2 | SP1 | R3 | SP2 | R4 |
| --- | --- | --- | --- | --- | --- | --- |
| adrenal | 1.5e−01 | 7.0e−02 | 9.6e−02 | 4.5 | 4.4e−02 | 5.3 |
| bladder | 2.7e−01 | 1.8e−01 | 1.0e−01 | 3.3 | 1.5e−01 | 2.9 |
| bone | 3.3e−01 | 1.0e−01 | 4.0e−01 | 2.5 | 2.4e−01 | 2.8 |
| brain | 4.2e−01 | 1.1e−01 | 9.2e−01 | 0.7 | 3.3e−04 | 2.4 |
| colon | 2.4e−01 | 8.9e−02 | 5.6e−02 | 3.3 | 3.4e−02 | 3.7 |
| epithelial | 1.1e−04 | 1.4e−09 | 3.1e−10 | 5.1 | 6.5e−21 | 8.3 |
| general | 1.7e−05 | 6.0e−15 | 2.8e−11 | 2.7 | 5.8e−40 | 4.9 |
| head and neck | 1.7e−01 | 8.4e−02 | 9.9e−02 | 3.3 | 7.5e−02 | 3.1 |
| kidney | 4.0e−01 | 3.3e−01 | 2.0e−01 | 2.5 | 6.7e−03 | 3.5 |
| liver | 9.2e−01 | 2.0e−01 | 1 | 0.9 | 2.3e−01 | 2.8 |
| lung | 6.1e−01 | 4.8e−01 | 5.4e−01 | 1.3 | 1.4e−01 | 1.9 |
| lymph nodes | 5.4e−01 | 6.4e−01 | 4.6e−01 | 0.8 | 7.6e−02 | 0.7 |
| breast | 5.4e−01 | 2.2e−01 | 7.7e−01 | 1.0 | 1.2e−01 | 1.7 |
| bone marrow | 7.1e−01 | 8.1e−01 | 1 | 0.1 | 3.2e−01 | 0.8 |
| muscle | 5.2e−01 | 6.1e−01 | 2.7e−01 | 3.1 | 6.3e−01 | 1.2 |
| ovary | 8.2e−02 | 3.6e−02 | 3.2e−02 | 4.3 | 8.3e−03 | 4.7 |

TABLE 5535-continued

P values and ratios for expression in cancerous tissue

| Name of Tissue | P1 | P2 | SP1 | R3 | SP2 | R4 |
| --- | --- | --- | --- | --- | --- | --- |
| pancreas | 3.3e−01 | 1.8e−01 | 4.2e−01 | 2.4 | 7.7e−02 | 3.7 |
| prostate | 8.6e−01 | 7.4e−01 | 2.7e−01 | 1.5 | 2.0e−01 | 1.9 |
| skin | 1.0e−01 | 1.8e−03 | 2.3e−02 | 6.4 | 1.8e−04 | 3.7 |
| stomach | 5.8e−01 | 1.2e−01 | 1 | 0.5 | 2.7e−01 | 1.6 |
| uterus | 6.4e−02 | 5.5e−03 | 1.3e−01 | 3.0 | 3.9e−03 | 4.9 |

As noted above, cluster T19724 features 24 segment(s), which were listed in Table 5531 above and for which the sequence(s) are given at the end of the application. These segment(s) are portions of nucleic acid sequence(s) which are described herein separately because they are of particular interest. A description of each segment according to the present invention is now provided.

Segment cluster T19724_node_30 (SEQ ID NO:5970) according to the present invention is supported by 3 libraries. The number of libraries was determined as previously described. This segment can be found in the following transcript(s): T19724_T41 (SEQ ID NO:4243). Table 5536 below describes the starting and ending position of this segment on each transcript.

TABLE 5536

Segment location on transcripts

| Transcript name | Segment starting position | Segment ending position |
| --- | --- | --- |
| T19724_T41 (SEQ ID NO: 4243) | 1 | 329 |

This segment can be found in the following protein(s): T19724_P23.

Segment cluster T19724_node_48 (SEQ ID NO:5971) according to the present invention is supported by 7 libraries. The number of libraries was determined as previously described. This segment can be found in the following transcript(s): T19724_T38 (SEQ ID NO:4242). Table 5537 below describes the starting and ending position of this segment on each transcript.

TABLE 5537

Segment location on transcripts

| Transcript name | Segment starting position | Segment ending position |
| --- | --- | --- |
| T19724_T38 (SEQ ID NO: 4242) | 1 | 1042 |

This segment can be found in a non-coding region of transcript(s) that are related to the following protein(s): T19724_P21.

Segment cluster T19724_node_50 (SEQ ID NO:5972) according to the present invention is supported by 137 libraries. The number of libraries was determined as previously described. This segment can be found in the following transcript(s): T19724_T38 (SEQ ID NO:4242). Table 5538 below describes the starting and ending position of this segment on each transcript.

TABLE 5538

| Transcript name | Segment location on transcripts | |
|---|---|---|
| | Segment starting position | Segment ending position |
| T19724_T38 (SEQ ID NO: 4242) | 1064 | 1271 |

This segment can be found in the following protein(s): T19724_P21.

Segment cluster T19724_node_59 (SEQ ID NO:5973) according to the present invention is supported by 120 libraries. The number of libraries was determined as previously described. This segment can be found in the following transcript(s): T19724_T38 (SEQ ID NO:4242). Table 5539 below describes the starting and ending position of this segment on each transcript.

TABLE 5539

| Transcript name | Segment location on transcripts | |
|---|---|---|
| | Segment starting position | Segment ending position |
| T19724_T38 (SEQ ID NO: 4242) | 1406 | 1528 |

This segment can be found in the following protein(s): T19724_P21.

Segment cluster T19724_node_62 (SEQ ID NO:5974) according to the present invention is supported by 107 libraries. The number of libraries was determined as previously described. This segment can be found in the following transcript(s): T19724_T38 (SEQ ID NO:4242). Table 5540 below describes the starting and ending position of this segment on each transcript.

TABLE 5540

| Transcript name | Segment location on transcripts | |
|---|---|---|
| | Segment starting position | Segment ending position |
| T19724_T38 (SEQ ID NO: 4242) | 1567 | 1701 |

This segment can be found in a non-coding region of transcript(s) that are related to the following protein(s): T19724_P21.

Segment cluster T19724_node_65 (SEQ ID NO:5975) according to the present invention is supported by 72 libraries. The number of libraries was determined as previously described. This segment can be found in the following transcript(s): T19724_T38 (SEQ ID NO:4242). Table 5541 below describes the starting and ending position of this segment on each transcript.

TABLE 5541

| Transcript name | Segment location on transcripts | |
|---|---|---|
| | Segment starting position | Segment ending position |
| T19724_T38 (SEQ ID NO: 4242) | 1726 | 1872 |

This segment can be found in a non-coding region of transcript(s) that are related to the following protein(s): T19724_P21.

Segment cluster T19724_node_70 (SEQ ID NO:5976) according to the present invention is supported by 45 libraries. The number of libraries was determined as previously described. This segment can be found in the following transcript(s): T19724_T38 (SEQ ID NO:4242) and T19724_T41 (SEQ ID NO:4243). Table 5542 below describes the starting and ending position of this segment on each transcript.

TABLE 5542

| Transcript name | Segment location on transcripts | |
|---|---|---|
| | Segment starting position | Segment ending position |
| T19724_T38 (SEQ ID NO: 4242) | 1997 | 2225 |
| T19724_T41 (SEQ ID NO: 4243) | 433 | 661 |

This segment can be found in a non-coding region of transcript(s) that are related to the following protein(s): T19724_P21 and T19724_P23.

Segment cluster T19724_node_72 (SEQ ID NO:5977) according to the present invention is supported by 53 libraries. The number of libraries was determined as previously described. This segment can be found in the following transcript(s): T19724_T38 (SEQ ID NO:4242) and T19724_T41 (SEQ ID NO:4243). Table 5543 below describes the starting and ending position of this segment on each transcript.

TABLE 5543

| Transcript name | Segment location on transcripts | |
|---|---|---|
| | Segment starting position | Segment ending position |
| T19724_T38 (SEQ ID NO: 4242) | 2322 | 2444 |
| T19724_T41 (SEQ ID NO: 4243) | 758 | 880 |

This segment can be found in a non-coding region of transcript(s) that are related to the following protein(s): T19724_P21 and T19724_P23.

Segment cluster T19724_node_76 (SEQ ID NO:5978) according to the present invention is supported by 70 libraries. The number of libraries was determined as previously described. This segment can be found in the following transcript(s): T19724_T38 (SEQ ID NO:4242) and T19724_T41 (SEQ ID NO:4243). Table 5544 below describes the starting and ending position of this segment on each transcript.

TABLE 5544

| Transcript name | Segment location on transcripts | |
|---|---|---|
| | Segment starting position | Segment ending position |
| T19724_T38 (SEQ ID NO: 4242) | 2473 | 2878 |
| T19724_T41 (SEQ ID NO: 4243) | 909 | 1314 |

This segment can be found in a non-coding region of transcript(s) that are related to the following protein(s): T19724_P21 and T19724_P23.

According to an optional embodiment of the present invention, short segments related to the above cluster are also provided. These segments are up to about 120 bp in length, and so are included in a separate description.

Segment cluster T19724_node_49 (SEQ ID NO:5979) according to the present invention can be found in the following transcript(s): T19724_T38 (SEQ ID NO:4242). Table 5545 below describes the starting and ending position of this segment on each transcript.

TABLE 5545

Segment location on transcripts

| Transcript name | Segment starting position | Segment ending position |
|---|---|---|
| T19724_T38 (SEQ ID NO: 4242) | 1043 | 1063 |

This segment can be found in the following protein(s): T19724_P21.

Segment cluster T19724_node_52 (SEQ ID NO:5980) according to the present invention is supported by 113 libraries. The number of libraries was determined as previously described. This segment can be found in the following transcript(s): T19724_T38 (SEQ ID NO:4242). Table 5546 below describes the starting and ending position of this segment on each transcript.

TABLE 5546

Segment location on transcripts

| Transcript name | Segment starting position | Segment ending position |
|---|---|---|
| T19724_T38 (SEQ ID NO: 4242) | 1272 | 1355 |

This segment can be found in the following protein(s): T19724_P21.

Segment cluster T19724_node_53 (SEQ ID NO:5981) according to the present invention is supported by 110 libraries. The number of libraries was determined as previously described. This segment can be found in the following transcript(s): T19724_T38 (SEQ ID NO:4242). Table 5547 below describes the starting and ending position of this segment on each transcript.

TABLE 5547

Segment location on transcripts

| Transcript name | Segment starting position | Segment ending position |
|---|---|---|
| T19724_T38 (SEQ ID NO: 4242) | 1356 | 1387 |

This segment can be found in the following protein(s): T19724_P21.

Segment cluster T19724_node_54 (SEQ ID NO:5982) according to the present invention can be found in the following transcript(s): T19724_T38 (SEQ ID NO:4242). Table 5548 below describes the starting and ending position of this segment on each transcript.

TABLE 5548

Segment location on transcripts

| Transcript name | Segment starting position | Segment ending position |
|---|---|---|
| T19724_T38 (SEQ ID NO: 4242) | 1388 | 1405 |

This segment can be found in the following protein(s): T19724_P21.

Segment cluster T19724_node_60 (SEQ ID NO:5983) according to the present invention can be found in the following transcript(s): T19724_T38 (SEQ ID NO:4242). Table 5549 below describes the starting and ending position of this segment on each transcript.

TABLE 5549

Segment location on transcripts

| Transcript name | Segment starting position | Segment ending position |
|---|---|---|
| T19724_T38 (SEQ ID NO: 4242) | 1529 | 1553 |

This segment can be found in a non-coding region of transcript(s) that are related to the following protein(s): T19724_P21.

Segment cluster T19724_node_61 (SEQ ID NO:5984) according to the present invention can be found in the following transcript(s): T19724_T38 (SEQ ID NO:4242). Table 5550 below describes the starting and ending position of this segment on each transcript.

TABLE 5550

Segment location on transcripts

| Transcript name | Segment starting position | Segment ending position |
|---|---|---|
| T19724_T38 (SEQ ID NO: 4242) | 1554 | 1566 |

This segment can be found in a non-coding region of transcript(s) that are related to the following protein(s): T19724_P21.

Segment cluster T19724_node_63 (SEQ ID NO:5985) according to the present invention can be found in the following transcript(s): T19724_T38 (SEQ ID NO:4242). Table 5551 below describes the starting and ending position of this segment on each transcript.

TABLE 5551

Segment location on transcripts

| Transcript name | Segment starting position | Segment ending position |
|---|---|---|
| T19724_T38 (SEQ ID NO: 4242) | 1702 | 1725 |

This segment can be found in a non-coding region of transcript(s) that are related to the following protein(s): T19724_P21.

Segment cluster T19724_node_66 (SEQ ID NO:5986) according to the present invention can be found in the following transcript(s): T19724_T38 (SEQ ID NO:4242). Table 5552 below describes the starting and ending position of this segment on each transcript.

TABLE 5552

Segment location on transcripts

| Transcript name | Segment starting position | Segment ending position |
|---|---|---|
| T19724_T38 (SEQ ID NO: 4242) | 1873 | 1876 |

This segment can be found in a non-coding region of transcript(s) that are related to the following protein(s): T19724_P21.

Segment cluster T19724_node_67 (SEQ ID NO:5987) according to the present invention can be found in the following transcript(s): T19724_T38.(SEQ ID NO:4242). Table 5553 below describes the starting and ending position of this segment on each transcript.

TABLE 5553

Segment location on transcripts

| Transcript name | Segment starting position | Segment ending position |
|---|---|---|
| T19724_T38 (SEQ ID NO: 4242) | 1877 | 1893 |

This segment can be found in a non-coding region of transcript(s) that are related to the following protein(s): T19724_P21.

Segment cluster T19724_node_68 (SEQ ID NO:5988) according to the present invention is supported by 53 libraries. The number of libraries was determined as previously described. This segment can be found in the following transcript(s): T19724_T38 (SEQ ID NO:4242) and T19724_T41 (SEQ ID NO:4243). Table 5554 below describes the starting and ending position of this segment on each transcript.

TABLE 5554

Segment location on transcripts

| Transcript name | Segment starting position | Segment ending position |
|---|---|---|
| T19724_T38 (SEQ ID NO: 4242) | 1894 | 1927 |
| T19724_T41 (SEQ ID NO: 4243) | 330 | 363 |

This segment can be found in a non-coding region of transcript(s) that are related to the following protein(s): T19724_P21 and T19724_P23.

Segment cluster T19724_node_69 (SEQ ID NO:5989) according to the present invention is supported by 49 libraries. The number of libraries was determined as previously described. This segment can be found in the following transcript(s): T19724_T38 (SEQ ID NO:4242) and T19724_T41 (SEQ ID NO:4243). Table 5555 below describes the starting and ending position of this segment on each transcript.

TABLE 5555

Segment location on transcripts

| Transcript name | Segment starting position | Segment ending position |
|---|---|---|
| T19724_T38 (SEQ ID NO: 4242) | 1928 | 1996 |
| T19724_T41 (SEQ ID NO: 4243) | 364 | 432 |

This segment can be found in a non-coding region of transcript(s) that are related to the following protein(s): T19724_P21 and T19724_P23.

Segment cluster T19724_node_71 (SEQ ID NO:5990) according to the present invention is supported by 46 libraries. The number of libraries was determined as previously described. This segment can be found in the following transcript(s): T19724_T38 (SEQ ID NO:4242) and T19724_T41 (SEQ ID NO:4243). Table 5556 below describes the starting and ending position of this segment on each transcript.

TABLE 5556

Segment location on transcripts

| Transcript name | Segment starting position | Segment ending position |
|---|---|---|
| T19724_T38 (SEQ ID NO: 4242) | 2226 | 2321 |
| T19724_T41 (SEQ ID NO: 4243) | 662 | 757 |

This segment can be found in a non-coding region of transcript(s) that are related to the following protein(s): T19724_P21 and T19724_P23.

Segment cluster T19724_node_73 (SEQ ID NO:5991) according to the present invention can be found in the following transcript(s): T19724_T38 (SEQ ID NO:4242) and T19724_T41 (SEQ ID NO:4243). Table 5557 below describes the starting and ending position of this segment on each transcript.

TABLE 5557

Segment location on transcripts

| Transcript name | Segment starting position | Segment ending position |
|---|---|---|
| T19724_T38 (SEQ ID NO: 4242) | 2445 | 2456 |
| T19724_T41 (SEQ ID NO: 4243) | 881 | 892 |

This segment can be found in a non-coding region of transcript(s) that are related to the following protein(s): T19724_P21 and T19724_P23.

Segment cluster T19724_node_74 (SEQ ID NO:5992) according to the present invention can be found in the following transcript(s): T19724_T38 (SEQ ID NO:4242) and T19724_T41 (SEQ ID NO:4243). Table 5558 below describes the starting and ending position of this segment on each transcript.

TABLE 5558

Segment location on transcripts

| Transcript name | Segment starting position | Segment ending position |
|---|---|---|
| T19724_T38 (SEQ ID NO: 4242) | 2457 | 2467 |
| T19724_T41 (SEQ ID NO: 4243) | 893 | 903 |

This segment can be found in a non-coding region of transcript(s) that are related to the following protein(s): T19724_P21 and T19724_P23.

Segment cluster T19724_node_75 (SEQ ID NO:5993) according to the present invention can be found in the following transcript(s): T19724_T38 (SEQ ID NO:4242) and T19724_T41 (SEQ ID NO:4243). Table 5559 below describes the starting and ending position of this segment on each transcript.

TABLE 5559

Segment location on transcripts

| Transcript name | Segment starting position | Segment ending position |
|---|---|---|
| T19724_T38 (SEQ ID NO: 4242) | 2468 | 2472 |
| T19724_T41 (SEQ ID NO: 4243) | 904 | 908 |

This segment can be found in a non-coding region of transcript(s) that are related to the following protein(s): T19724_P21 and T19724_P23.

Description for Cluster T46984

Cluster T46984 features 5 transcript(s) and 39 segment(s) of interest, the names for which are given in Tables 5560 and 5561, respectively, the sequences themselves are given at the end of the application. The selected protein variants are given in Table 5562.

TABLE 5560

Transcripts of interest

Transcript Name

T46984_PEA_1_T27 (SEQ ID NO: 4244)
T46984_PEA_1_T46 (SEQ ID NO: 4245)
T46984_PEA_1_T51 (SEQ ID NO: 4246)
T46984_PEA_1_T52 (SEQ ID NO: 4247)
T46984_PEA_1_T54 (SEQ ID NO: 4248)

TABLE 5561

Segments of interest
Segment Name

T46984_PEA_1_node_6 (SEQ ID NO: 5994)
T46984_PEA_1_node_12 (SEQ ID NO: 5995)
T46984_PEA_1_node_25 (SEQ ID NO: 5996)
T46984_PEA_1_node_46 (SEQ ID NO: 5997)
T46984_PEA_1_node_47 (SEQ ID NO: 5998)
T46984_PEA_1_node_65 (SEQ ID NO: 5999)
T46984_PEA_1_node_69 (SEQ ID NO: 6000)
T46984_PEA_1_node_86 (SEQ ID NO: 6001)
T46984_PEA_1_node_9 (SEQ ID NO: 6002)
T46984_PEA_1_node_13 (SEQ ID NO: 6003)
T46984_PEA_1_node_19 (SEQ ID NO: 6004)
T46984_PEA_1_node_21 (SEQ ID NO: 6005)
T46984_PEA_1_node_22 (SEQ ID NO: 6006)
T46984_PEA_1_node_26 (SEQ ID NO: 6007)
T46984_PEA_1_node_28 (SEQ ID NO: 6008)
T46984_PEA_1_node_31 (SEQ ID NO: 6009)
T46984_PEA_1_node_32 (SEQ ID NO: 6010)
T46984_PEA_1_node_38 (SEQ ID NO: 6011)
T46984_PEA_1_node_39 (SEQ ID NO: 6012)
T46984_PEA_1_node_40 (SEQ ID NO: 6013)
T46984_PEA_1_node_42 (SEQ ID NO: 6014)
T46984_PEA_1_node_43 (SEQ ID NO: 6015)
T46984_PEA_1_node_48 (SEQ ID NO: 6016)
T46984_PEA_1_node_49 (SEQ ID NO: 6017)
T46984_PEA_1_node_50 (SEQ ID NO: 6018)
T46984_PEA_1_node_55 (SEQ ID NO: 6019)
T46984_PEA_1_node_57 (SEQ ID NO: 6020)
T46984_PEA_1_node_60 (SEQ ID NO: 6021)
T46984_PEA_1_node_62 (SEQ ID NO: 6022)
T46984_PEA_1_node_66 (SEQ ID NO: 6023)
T46984_PEA_1_node_67 (SEQ ID NO: 6024)
T46984_PEA_1_node_70 (SEQ ID NO: 6025)
T46984_PEA_1_node_71 (SEQ ID NO: 6026)
T46984_PEA_1_node_72 (SEQ ID NO: 6027)
T46984_PEA_1_node_73 (SEQ ID NO: 6028)
T46984_PEA_1_node_74 (SEQ ID NO: 6029)
T46984_PEA_1_node_83 (SEQ ID NO: 6030)
T46984_PEA_1_node_84 (SEQ ID NO: 6031)
T46984_PEA_1_node_85 (SEQ ID NO: 6032)

TABLE 5562

Proteins of interest

| Protein Name | Corresponding Transcript(s) |
|---|---|
| T46984_PEA_1_P21 | T46984_PEA_1_T27 (SEQ ID NO: 4244) |

These sequences are variants of the known protein Dolichyl-diphosphooligosaccharide-protein glycosyltransferase 63 kDa subunit precursor (SwissProt accession identifier RIB2_HUMAN; known also according to the synonyms EC 2.4.1.119; Ribophorin II; RPN-II; RIBIIR), referred to herein as the previously known protein.

Protein Dolichyl-diphosphooligosaccharide-protein glycosyltransferase 63 kDa subunit precursor is known or believed to have the following function(s): Essential subunit of N-oligosaccharyl transferase enzyme which catalyzes the transfer of a high mannose oligosaccharide from a lipid-linked oligosaccharide donor to an asparagine residue within an Asn-X-Ser/Thr consensus motif in nascent polypeptide chains. The sequence for protein Dolichyl-diphosphooligosaccharide-protein glycosyltransferase 63 kDa subunit precursor is given at the end of the application, as "Dolichyl-diphosphooligosaccharide-protein glycosyltransferase 63 kDa subunit precursor amino acid sequence". Known polymorphisms for this sequence are as shown in Table 5563.

TABLE 5563

Amino acid mutations for Known Protein

| SNP position(s) on amino acid sequence | Comment |
|---|---|
| 197 | V -> L |
| 201 | F -> C |
| 260 | A -> S |
| 423 | V -> M |

Protein Dolichyl-diphosphooligosaccharide-protein glycosyltransferase 63 kDa subunit precursor localization is believed to be Type I membrane protein.

Endoplasmic Reticulum.

The following GO Annotation(s) apply to the previously known protein. The following annotation(s) were found: protein modification, which are annotation(s) related to Biological Process; oligosaccharyl transferase; dolichyl-diphosphooligosaccharide-protein glycosyltransferase; transferase, which are annotation(s) related to Molecular Function; and oligosaccharyl transferase complex; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T46984 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 134 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 134 and Table 5564. This cluster is overexpressed (at least at a minimum level) in the following pathological conditions: epithelial malignant tumors, a mixture of malignant tumors from different tissues, breast malignant tumors, ovarian carcinoma and pancreas carcinoma.

TABLE 5564

Normal tissue distribution

| Name of Tissue | Number |
|---|---|
| Adrenal | 240 |
| Bladder | 287 |
| Bone | 592 |
| Brain | 145 |
| Colon | 157 |
| Epithelial | 144 |
| General | 163 |
| head and neck | 50 |
| Kidney | 139 |
| Liver | 156 |
| Lung | 155 |
| lymph nodes | 194 |
| Breast | 105 |
| bone marrow | 62 |
| Muscle | 62 |
| Ovary | 0 |
| Pancreas | 72 |
| Prostate | 201 |
| Skin | 91 |
| Stomach | 219 |
| T cells | 0 |
| Thyroid | 0 |
| Uterus | 200 |

TABLE 5565

P values and ratios for expression in cancerous tissue

| Name of Tissue | P1 | P2 | SP1 | R3 | SP2 | R4 |
|---|---|---|---|---|---|---|
| adrenal | 6.3e−01 | 5.4e−01 | 6.2e−01 | 0.8 | 2.5e−01 | 1.0 |
| bladder | 5.4e−01 | 5.9e−01 | 3.0e−01 | 1.0 | 6.5e−01 | 0.7 |
| bone | 3.9e−01 | 3.7e−01 | 9.8e−01 | 0.4 | 9.9e−01 | 0.4 |
| brain | 3.3e−01 | 2.9e−01 | 1.4e−01 | 1.2 | 2.0e−01 | 1.0 |
| colon | 8.6e−02 | 5.9e−02 | 2.6e−01 | 1.3 | 2.1e−03 | 1.4 |
| epithelial | 5.3e−05 | 6.2e−07 | 2.8e−08 | 1.9 | 3.4e−21 | 2.4 |
| general | 1.0e−04 | 7.3e−08 | 9.3e−12 | 1.7 | 8.0e−33 | 2.0 |
| head and neck | 4.5e−01 | 5.4e−01 | 1 | 0.8 | 7.5e−01 | 0.9 |
| kidney | 6.6e−01 | 6.5e−01 | 3.2e−01 | 1.2 | 5.3e−02 | 1.5 |
| liver | 5.5e−01 | 5.6e−01 | 6.5e−01 | 1.0 | 1.2e−01 | 1.4 |
| lung | 3.0e−01 | 1.7e−01 | 1.5e−01 | 1.4 | 6.0e−02 | 1.4 |
| lymph nodes | 2.9e−01 | 5.5e−01 | 2.9e−01 | 0.8 | 4.3e−01 | 1.0 |
| breast | 2.4e−02 | 5.8e−03 | 3.7e−02 | 2.2 | 1.7e−04 | 2.7 |
| bone marrow | 7.1e−01 | 7.5e−01 | 1 | 0.3 | 1.2e−02 | 1.8 |
| muscle | 5.0e−01 | 3.7e−01 | 4.7e−01 | 1.5 | 2.1e−08 | 1.3 |
| ovary | 1.6e−02 | 7.0e−03 | 1.5e−02 | 6.1 | 4.8e−06 | 7.1 |
| pancreas | 1.4e−02 | 5.4e−02 | 2.2e−05 | 2.9 | 2.4e−07 | 3.9 |
| prostate | 3.4e−01 | 1.9e−01 | 2.2e−01 | 1.2 | 1.4e−01 | 1.3 |
| skin | 3.7e−01 | 1.5e−01 | 4.2e−02 | 2.4 | 1.1e−04 | 1.9 |
| stomach | 6.1e−01 | 1.4e−01 | 7.3e−01 | 0.4 | 6.1e−02 | 1.6 |
| T cells | 1 | 6.7e−01 | 1 | 1.0 | 5.2e−01 | 1.8 |
| Thyroid | 4.8e−02 | 4.8e−02 | 2.0e−01 | 3.4 | 2.0e−01 | 3.4 |
| uterus | 2.3e−01 | 1.3e−01 | 2.2e−02 | 1.5 | 5.0e−02 | 1.4 |

As noted above, cluster T46984 features 39 segment(s), which were listed in Table 5561 above and for which the sequence(s) are given at the end of the application. These segment(s) are portions of nucleic acid sequence(s) which are described herein separately because they are of particular interest. A description of each segment according to the present invention is now provided.

Segment cluster T46984_PEA_1_node_6 (SEQ ID NO:5994) according to the present invention is supported by 3 libraries. The number of libraries was determined as previously described. This segment can be found in the following transcript(s): T46984_PEA_1_T27 (SEQ ID NO:4244). Table 5566 below describes the starting and ending position of this segment on each transcript.

TABLE 5566

Segment location on transcripts

| Transcript name | Segment starting position | Segment ending position |
|---|---|---|
| T46984_PEA_1_T27 (SEQ ID NO: 4244) | 1 | 340 |

This segment can be found in the following protein(s): T46984_PEA_1_P21.

Segment cluster T46984_PEA_1_node_12 (SEQ ID NO:5995) according to the present invention is supported by 262 libraries. The number of libraries was determined as previously described. This segment can be found in the following transcript(s): T46984_PEA_1_T27 (SEQ ID NO:4244). Table 5567 below describes the starting and ending position of this segment on each transcript.

TABLE 5567

Segment location on transcripts

| Transcript name | Segment starting position | Segment ending position |
|---|---|---|
| T46984_PEA_1_T27 (SEQ ID NO: 4244) | 437 | 569 |

This segment can be found in the following protein(s): T46984_PEA_1_P21.

Segment cluster T46984_PEA_1_node_25 (SEQ ID NO:5996) according to the present invention is supported by 257 libraries. The number of libraries was determined as previously described. This segment can be found in the following transcript(s): T46984_PEA_1_T27 (SEQ ID NO:4244). Table 5568 below describes the starting and ending position of this segment on each transcript.

TABLE 5568

Segment location on transcripts

| Transcript name | Segment starting position | Segment ending position |
|---|---|---|
| T46984_PEA_1_T27 (SEQ ID NO: 4244) | 824 | 989 |

This segment can be found in the following protein(s): T46984_PEA_1_P21.

Segment cluster T46984_PEA_1_node_46 (SEQ ID NO:5997) according to the present invention is supported by 1 libraries. The number of libraries was determined as previously described. This segment can be found in the following transcript(s): T46984_PEA_1_T46 (SEQ ID NO:4245). Table 5569 below describes the starting and ending position of this segment on each transcript.

TABLE 5569

Segment location on transcripts

| Transcript name | Segment starting position | Segment ending position |
|---|---|---|
| T46984_PEA_1_T46 (SEQ ID NO: 4245) | 1 | 306 |

The previously-described transcripts for these segment(s) do not code for protein.

Segment cluster T46984_PEA_1_node_47 (SEQ ID NO:5998) according to the present invention is supported by 5 libraries. The number of libraries was determined as previously described. This segment can be found in the following transcript(s): T46984_PEA_1_T46 (SEQ ID NO:4245). Table 5570 below describes the starting and ending position of this segment on each transcript.

TABLE 5570

Segment location on transcripts

| Transcript name | Segment starting position | Segment ending position |
|---|---|---|
| T46984_PEA_1_T46 (SEQ ID NO: 4245) | 307 | 934 |

The previously-described transcripts for these segment(s) do not code for protein.

Segment cluster T46984_PEA_1_node_65 (SEQ ID NO:5999) according to the present invention is supported by 2 libraries. The number of libraries was determined as previously described. This segment can be found in the following transcript(s): T46984_PEA_1_T51 (SEQ ID NO:4246). Table 5571 below describes the starting and ending position of this segment on each transcript.

TABLE 5571

Segment location on transcripts

| Transcript name | Segment starting position | Segment ending position |
|---|---|---|
| T46984_PEA_1_T51 (SEQ ID NO: 4246) | 1 | 348 |

The previously-described transcripts for these segment(s) do not code for protein.

Segment cluster T46984_PEA_1_node_69 (SEQ ID NO:6000) according to the present invention is supported by 8 libraries. The number of libraries was determined as previously described. This segment can be found in the following transcript(s): T46984_PEA_1_T52 (SEQ ID NO:4247) and T46984_PEA_1_T54 (SEQ ID NO:4248). Table 5572 below describes the starting and ending position of this segment on each transcript.

TABLE 5572

Segment location on transcripts

| Transcript name | Segment starting position | Segment ending position |
|---|---|---|
| T46984_PEA_1_T52 (SEQ ID NO: 4247) | 1 | 927 |

TABLE 5572-continued

Segment location on transcripts

| Transcript name | Segment starting position | Segment ending position |
|---|---|---|
| T46984_PEA_1_T54 (SEQ ID NO: 4248) | 1 | 927 |

The previously-described transcripts for these segment(s) do not code for protein.

Segment cluster T46984_PEA_1_node_86 (SEQ ID NO:6001) according to the present invention is supported by 314 libraries. The number of libraries was determined as previously described. This segment can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5573 below describes the starting and ending position of this segment on each transcript.

TABLE 5573

Segment location on transcripts

| Transcript name | Segment starting position | Segment ending position |
|---|---|---|
| T46984_PEA_1_T27 (SEQ ID NO: 4244) | 2076 | 2334 |
| T46984_PEA_1_T46 (SEQ ID NO: 4245) | 1578 | 1836 |
| T46984_PEA_1_T51 (SEQ ID NO: 4246) | 614 | 872 |
| T46984_PEA_1_T52 (SEQ ID NO: 4247) | 1117 | 1375 |
| T46984_PEA_1_T54 (SEQ ID NO: 4248) | 1117 | 1602 |

This segment can be found in a non-coding region of transcript(s) that are related to the following protein(s): T46984_PEA_1_P21.

According to an optional embodiment of the present invention, short segments related to the above cluster are also provided. These segments are up to about 120 bp in length, and so are included in a separate description.

Segment cluster T46984_PEA_1_node_9 (SEQ ID NO:6002) according to the present invention is supported by 304 libraries. The number of libraries was determined as previously described. This segment can be found in the following transcript(s): T46984_PEA_1_T27 (SEQ ID NO:4244). Table 5574 below describes the starting and ending position of this segment on each transcript.

TABLE 5574

Segment location on transcripts

| Transcript name | Segment starting position | Segment ending position |
|---|---|---|
| T46984_PEA_1_T27 (SEQ ID NO: 4244) | 341 | 436 |

This segment can be found in the following protein(s): T46984_PEA_1_P21.

Segment cluster T46984_PEA_1_node_13 (SEQ ID NO:6003) according to the present invention is supported by 232 libraries. The number of libraries was determined as previously described. This segment can be found in the following transcript(s): T46984_PEA_1_T27 (SEQ ID NO:4244). Table 5575 below describes the starting and ending position of this segment on each transcript.

TABLE 5575

Segment location on transcripts

| Transcript name | Segment starting position | Segment ending position |
|---|---|---|
| T46984_PEA_1_T27 (SEQ ID NO: 4244) | 570 | 612 |

This segment can be found in the following protein(s): T46984_PEA_1_P21.

Segment cluster T46984_PEA_1_node_19 (SEQ ID NO:6004) according to the present invention is supported by 237 libraries. The number of libraries was determined as previously described. This segment can be found in the following transcript(s): T46984_PEA_1_T27 (SEQ ID NO:4244). Table 5576 below describes the starting and ending position of this segment on each transcript.

TABLE 5576

Segment location on transcripts

| Transcript name | Segment starting position | Segment ending position |
|---|---|---|
| T46984_PEA_1_T27 (SEQ ID NO: 4244) | 613 | 688 |

This segment can be found in the following protein(s): T46984_PEA_1_P21.

Segment cluster T46984_PEA_1_node_21 (SEQ ID NO:6005) according to the present invention is supported by 242 libraries. The number of libraries was determined as previously described. This segment can be found in the following transcript(s): T46984_PEA_1_T27 (SEQ ID NO:4244). Table 5577 below describes the starting and ending position of this segment on each transcript.

TABLE 5577

Segment location on transcripts

| Transcript name | Segment starting position | Segment ending position |
|---|---|---|
| T46984_PEA_1_T27 (SEQ ID NO: 4244) | 689 | 793 |

This segment can be found in the following protein(s): T46984_PEA_1_P21.

Segment cluster T46984_PEA_1_node_22 (SEQ ID NO:6006) according to the present invention is supported by 205 libraries. The number of libraries was determined as previously described. This segment can be found in the following transcript(s): T46984_PEA_1_T27 (SEQ ID NO:4244). Table 5578 below describes the starting and ending position of this segment on each transcript.

TABLE 5578

Segment location on transcripts

| Transcript name | Segment starting position | Segment ending position |
|---|---|---|
| T46984_PEA_1_T27 (SEQ ID NO: 4244) | 794 | 823 |

This segment can be found in the following protein(s): T46984_PEA_1_P21.

Segment cluster T46984_PEA_1_node_26 (SEQ ID NO:6007) according to the present invention can be found in the following transcript(s): T46984_PEA_1_T27 (SEQ ID NO:4244). Table 5579 below describes the starting and ending position of this segment on each transcript.

TABLE 5579

Segment location on transcripts

| Transcript name | Segment starting position | Segment ending position |
|---|---|---|
| T46984_PEA_1_T27 (SEQ ID NO: 4244) | 990 | 1000 |

This segment can be found in the following protein(s): T46984_PEA_1_P21.

Segment cluster T46984_PEA_1_node_28 (SEQ ID NO:6008) according to the present invention is supported by 242 libraries. The number of libraries was determined as previously described. This segment can be found in the following transcript(s): T46984_PEA_1_T27 (SEQ ID NO:4244). Table 5580 below describes the starting and ending position of this segment on each transcript.

TABLE 5580

Segment location on transcripts

| Transcript name | Segment starting position | Segment ending position |
|---|---|---|
| T46984_PEA_1_T27 (SEQ ID NO: 4244) | 1001 | 1119 |

This segment can be found in the following protein(s): T46984_PEA_1_P21.

Segment cluster T46984_PEA_1_node_31 (SEQ ID NO:6009) according to the present invention is supported by 207 libraries. The number of libraries was determined as previously described. This segment can be found in the following transcript(s): T46984_PEA_1_T27 (SEQ ID NO:4244). Table 5581 below describes the starting and ending position of this segment on each transcript.

TABLE 5581

Segment location on transcripts

| Transcript name | Segment starting position | Segment ending position |
|---|---|---|
| T46984_PEA_1_T27 (SEQ ID NO: 4244) | 1120 | 1147 |

This segment can be found in the following protein(s): T46984_PEA_1_P21.

Segment cluster T46984_PEA_1_node_32 (SEQ ID NO:6010) according to the present invention is supported by 226 libraries. The number of libraries was determined as previously described. This segment can be found in the following transcript(s): T46984_PEA_1_T27 (SEQ ID NO:4244). Table 5582 below describes the starting and ending position of this segment on each transcript.

TABLE 5582

Segment location on transcripts

| Transcript name | Segment starting position | Segment ending position |
|---|---|---|
| T46984_PEA_1_T27 (SEQ ID NO: 4244) | 1148 | 1225 |

This segment can be found in the following protein(s): T46984_PEA_1_P21.

Segment cluster T46984_PEA_1_node_38 (SEQ ID NO:6011) according to the present invention can be found in the following transcript(s): T46984_PEA_1_T27 (SEQ ID NO:4244). Table 5583 below describes the starting and ending position of this segment on each transcript.

TABLE 5583

Segment location on transcripts

| Transcript name | Segment starting position | Segment ending position |
|---|---|---|
| T46984_PEA_1_T27 (SEQ ID NO: 4244) | 1226 | 1230 |

This segment can be found in the following protein(s): T46984_PEA_1_P21.

Segment cluster T46984_PEA_1_node_39 (SEQ ID NO:6012) according to the present invention can be found in the following transcript(s): T46984_PEA_1_T27 (SEQ ID NO:4244). Table 5584 below describes the starting and ending position of this segment on each transcript.

TABLE 5584

Segment location on transcripts

| Transcript name | Segment starting position | Segment ending position |
|---|---|---|
| T46984_PEA_1_T27 (SEQ ID NO: 4244) | 1231 | 1253 |

This segment can be found in the following protein(s): T46984_PEA_1_P21.

Segment cluster T46984_PEA_1_node_40 (SEQ ID NO:6013) according to the present invention is supported by 227 libraries. The number of libraries was determined as previously described. This segment can be found in the following transcript(s): T46984_PEA_1_T27 (SEQ ID NO:4244). Table 5585 below describes the starting and ending position of this segment on each transcript.

TABLE 5585

Segment location on transcripts

| Transcript name | Segment starting position | Segment ending position |
|---|---|---|
| T46984_PEA_1_T27 (SEQ ID NO: 4244) | 1254 | 1317 |

This segment can be found in the following protein(s): T46984_PEA_1_P21.

Segment cluster T46984_PEA_1_node_42 (SEQ ID NO:6014) according to the present invention is supported by 239 libraries. The number of libraries was determined as previously described. This segment can be found in the following transcript(s): T46984_PEA_1_T27 (SEQ ID NO:4244). Table 5586 below describes the starting and ending position of this segment on each transcript.

TABLE 5586

Segment location on transcripts

| Transcript name | Segment starting position | Segment ending position |
|---|---|---|
| T46984_PEA_1_T27 (SEQ ID NO: 4244) | 1318 | 1380 |

This segment can be found in the following protein(s): T46984_PEA_1_P21.

Segment cluster T46984_PEA_1_node_43 (SEQ ID NO:6015) according to the present invention is supported by 235 libraries. The number of libraries was determined as previously described. This segment can be found in the following transcript(s): T46984_PEA_1_T27 (SEQ ID NO:4244). Table 5587 below describes the starting and ending position of this segment on each transcript.

TABLE 5587

Segment location on transcripts

| Transcript name | Segment starting position | Segment ending position |
|---|---|---|
| T46984_PEA_1_T27 (SEQ ID NO: 4244) | 1381 | 1432 |

This segment can be found in the following protein(s): T46984_PEA_1_P21.

Segment cluster T46984_PEA_1_node_48 (SEQ ID NO:6016) according to the present invention is supported by 282 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5588 below describes the starting and ending position of this segment on each transcript.

TABLE 5588

Segment location on transcripts

| Transcript name | Segment starting position | Segment ending position |
|---|---|---|
| T46984_PEA_1_T27 (SEQ ID NO: 4244) | 1433 | 1533 |

TABLE 5588-continued

| | Segment location on transcripts | |
|---|---|---|
| Transcript name | Segment starting position | Segment ending position |
| T46984_PEA_1_T46 (SEQ ID NO: 4245) | 935 | 1035 |

This segment can be found in the following protein(s): T46984_PEA_1_P21.

Segment cluster T46984_PEA_1_node_49 (SEQ ID NO:6017) according to the present invention is supported by 262 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5589 below describes the starting and ending position of this segment on each transcript.

TABLE 5589

| | Segment location on transcripts | |
|---|---|---|
| Transcript name | Segment starting position | Segment ending position |
| T46984_PEA_1_T27 (SEQ ID NO: 4244) | 1534 | 1575 |
| T46984_PEA_1_T46 (SEQ ID NO: 4245) | 1036 | 1077 |

This segment can be found in the following protein(s): T46984_PEA_1_P21.

Segment cluster T46984_PEA_1_node_50 (SEQ ID NO:6018) according to the present invention is supported by 277 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5590 below describes the starting and ending position of this segment on each transcript.

TABLE 5590

| | Segment location on transcripts | |
|---|---|---|
| Transcript name | Segment starting position | Segment ending position |
| T46984_PEA_1_T27 (SEQ ID NO: 4244) | 1576 | 1627 |
| T46984_PEA_1_T46 (SEQ ID NO: 4245) | 1078 | 1129 |

This segment can be found in the following protein(s): T46984_PEA_1_P21.

Segment cluster T46984_PEA_1_node_55 (SEQ ID NO:6019) according to the present invention is supported by 335 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5591 below describes the starting and ending position of this segment on each transcript.

TABLE 5591

| | Segment location on transcripts | |
|---|---|---|
| Transcript name | Segment starting position | Segment ending position |
| T46984_PEA_1_T27 (SEQ ID NO: 4244) | 1628 | 1694 |
| T46984_PEA_1_T46 (SEQ ID NO: 4245) | 1130 | 1196 |

This segment can be found in the following protein(s): T46984_PEA_1_P21.

Segment cluster T46984_PEA_1_node_57 (SEQ ID NO:6020) according to the present invention can be found in the following transcript(s): T46984_PEA_1_T27 (SEQ ID NO:4244) and T46984_PEA_1_T46 (SEQ ID NO:4245). Table 5592 below describes the starting and ending position of this segment on each transcript.

TABLE 5592

| | Segment location on transcripts | |
|---|---|---|
| Transcript name | Segment starting position | Segment ending position |
| T46984_PEA_1_T27 (SEQ ID NO: 4244) | 1695 | 1714 |
| T46984_PEA_1_T46 (SEQ ID NO: 4245) | 1197 | 1216 |

This segment can be found in the following protein(s): T46984_PEA_1_P21.

Segment cluster T46984_PEA_1_node_60 (SEQ ID NO:6021) according to the present invention is supported by 326 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5593 below describes the starting and ending position of this segment on each transcript.

TABLE 5593

| | Segment location on transcripts | |
|---|---|---|
| Transcript name | Segment starting position | Segment ending position |
| T46984_PEA_1_T27 (SEQ ID NO: 4244) | 1715 | 1749 |
| T46984_PEA_1_T46 (SEQ ID NO: 4245) | 1217 | 1251 |

This segment can be found in the following protein(s): T46984_PEA_1_P21.

Segment cluster T46984_PEA_1_node_62 (SEQ ID NO:6022) according to the present invention is supported by 335 libraries. The number of libraries was determined as previously described. This segment can be found in the following transcript(s): T46984_PEA_1_T27 (SEQ ID NO:4244) and T46984_PEA_1_T46 (SEQ ID NO:4245). Table 5594 below describes the starting and ending position of this segment on each transcript.

TABLE 5594

Segment location on transcripts

| Transcript name | Segment starting position | Segment ending position |
|---|---|---|
| T46984_PEA_1_T27 (SEQ ID NO: 4244) | 1750 | 1810 |
| T46984_PEA_1_T46 (SEQ ID NO: 4245) | 1252 | 1312 |

This segment can be found in the following protein(s): T46984_PEA_1_P21.

Segment cluster T46984_PEA_1_node_66 (SEQ ID NO:6023) according to the present invention is supported by 336 libraries. The number of libraries was determined as previously described. This segment can be found in the following transcript(s): T46984_PEA_1_T27 (SEQ ID NO:4244), T46984_PEA_1_T46 (SEQ ID NO:4245) and T46984_PEA_1_T51 (SEQ ID NO:4246). Table 5595 below describes the starting and ending position of this segment on each transcript.

TABLE 5595

Segment location on transcripts

| Transcript name | Segment starting position | Segment ending position |
|---|---|---|
| T46984_PEA_1_T27 (SEQ ID NO: 4244) | 1811 | 1845 |
| T46984_PEA_1_T46 (SEQ ID NO: 4245) | 1313 | 1347 |
| T46984_PEA_1_T51 (SEQ ID NO: 4246) | 349 | 383 |

This segment can be found in the following protein(s): T46984_PEA_1_P21.

Segment cluster T46984_PEA_1_node_67 (SEQ ID NO:6024) according to the present invention is supported by 323 libraries. The number of libraries was determined as previously described. This segment can be found in the following transcript(s): T46984_PEA_1_T27 (SEQ ID NO:4244), T46984_PEA_1_T46 (SEQ ID NO:4245) and T46984_PEA_1_T51 (SEQ ID NO:4246). Table 5596 below describes the starting and ending position of this segment on each transcript.

TABLE 5596

Segment location on transcripts

| Transcript name | Segment starting position | Segment ending position |
|---|---|---|
| T46984_PEA_1_T27 (SEQ ID NO: 4244) | 1846 | 1886 |
| T46984_PEA_1_T46 (SEQ ID NO: 4245) | 1348 | 1388 |
| T46984_PEA_1_T51 (SEQ ID NO: 4246) | 384 | 424 |

This segment can be found in the following protein(s): T46984_PEA_1_P21.

Segment cluster T46984_PEA_1_node_70 (SEQ ID NO:6025) according to the present invention is supported by 337 libraries. The number of libraries was determined as previously described. This segment can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5597 below describes the starting and ending position of this segment on each transcript.

TABLE 5597

Segment location on transcripts

| Transcript name | Segment starting position | Segment ending position |
|---|---|---|
| T46984_PEA_1_T27 (SEQ ID NO: 4244) | 1887 | 1961 |
| T46984_PEA_1_T46 (SEQ ID NO: 4245) | 1389 | 1463 |
| T46984_PEA_1_T51 (SEQ ID NO: 4246) | 425 | 499 |
| T46984_PEA_1_T52 (SEQ ID NO: 4247) | 928 | 1002 |
| T46984_PEA_1_T54 (SEQ ID NO: 4248) | 928 | 1002 |

This segment can be found in the following protein(s): T46984_PEA_1_P21.

Segment cluster T46984_PEA_1_node_71 (SEQ ID NO:6026) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5598 below describes the starting and ending position of this segment on each transcript.

TABLE 5598

Segment location on transcripts

| Transcript name | Segment starting position | Segment ending position |
|---|---|---|
| T46984_PEA_1_T27 (SEQ ID NO: 4244) | 1962 | 1983 |
| T46984_PEA_1_T46 (SEQ ID NO: 4245) | 1464 | 1485 |
| T46984_PEA_1_T51 (SEQ ID NO: 4246) | 500 | 521 |
| T46984_PEA_1_T52 (SEQ ID NO: 4247) | 1003 | 1024 |
| T46984_PEA_1_T54 (SEQ ID NO: 4248) | 1003 | 1024 |

This segment can be found in the following protein(s): T46984_PEA_1_P21.

Segment cluster T46984_PEA_1_node_72 (SEQ ID NO:6027) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5599 below describes the starting and ending position of this segment on each transcript.

TABLE 5599

Segment location on transcripts

| Transcript name | Segment starting position | Segment ending position |
|---|---|---|
| T46984_PEA_1_T27 (SEQ ID NO: 4244) | 1984 | 2005 |

TABLE 5599-continued

Segment location on transcripts

| Transcript name | Segment starting position | Segment ending position |
|---|---|---|
| T46984_PEA_1_T46 (SEQ ID NO: 4245) | 1486 | 1507 |
| T46984_PEA_1_T51 (SEQ ID NO: 4246) | 522 | 543 |
| T46984_PEA_1_T52 (SEQ ID NO: 4247) | 1025 | 1046 |
| T46984_PEA_1_T54 (SEQ ID NO: 4248) | 1025 | 1046 |

This segment can be found in the following protein(s): T46984_PEA_1_P21.

Segment cluster T46984_PEA_1_node_73 (SEQ ID NO:6028) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5600 below describes the starting and ending position of this segment on each transcript.

TABLE 5600

Segment location on transcripts

| Transcript name | Segment starting position | Segment ending position |
|---|---|---|
| T46984_PEA_1_T27 (SEQ ID NO: 4244) | 2006 | 2012 |
| T46984_PEA_1_T46 (SEQ ID NO: 4245) | 1508 | 1514 |
| T46984_PEA_1_T51 (SEQ ID NO: 4246) | 544 | 550 |
| T46984_PEA_1_T52 (SEQ ID NO: 4247) | 1047 | 1053 |
| T46984_PEA_1_T54 (SEQ ID NO: 4248) | 1047 | 1053 |

This segment can be found in the following protein(s): T46984_PEA_1_P21.

Segment cluster T46984_PEA_1_node_74 (SEQ ID NO:6029) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5601 below describes the starting and ending position of this segment on each transcript.

TABLE 5601

Segment location on transcripts

| Transcript name | Segment starting position | Segment ending position |
|---|---|---|
| T46984_PEA_1_T27 (SEQ ID NO: 4244) | 2013 | 2016 |
| T46984_PEA_1_T46 (SEQ ID NO: 4245) | 1515 | 1518 |
| T46984_PEA_1_T51 (SEQ ID NO: 4246) | 551 | 554 |
| T46984_PEA_1_T52 (SEQ ID NO: 4247) | 1054 | 1057 |
| T46984_PEA_1_T54 (SEQ ID NO: 4248) | 1054 | 1057 |

This segment can be found in the following protein(s): T46984_PEA_1_P21.

Segment cluster T46984_PEA_1_node_83 (SEQ ID NO:6030) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5602 below describes the starting and ending position of this segment on each transcript.

TABLE 5602

Segment location on transcripts

| Transcript name | Segment starting position | Segment ending position |
|---|---|---|
| T46984_PEA_1_T27 (SEQ ID NO: 4244) | 2017 | 2021 |
| T46984_PEA_1_T46 (SEQ ID NO: 4245) | 1519 | 1523 |
| T46984_PEA_1_T51 (SEQ ID NO: 4246) | 555 | 559 |
| T46984_PEA_1_T52 (SEQ ID NO: 4247) | 1058 | 1062 |
| T46984_PEA_1_T54 (SEQ ID NO: 4248) | 1058 | 1062 |

This segment can be found in the following protein(s): T46984_PEA_1_P21.

Segment cluster T46984_PEA_1_node_84 (SEQ ID NO:6031) according to the present invention can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5603 below describes the starting and ending position of this segment on each transcript.

TABLE 5603

Segment location on transcripts

| Transcript name | Segment starting position | Segment ending position |
|---|---|---|
| T46984_PEA_1_T27 (SEQ ID NO: 4244) | 2022 | 2035 |
| T46984_PEA_1_T46 (SEQ ID NO: 4245) | 1524 | 1537 |
| T46984_PEA_1_T51 (SEQ ID NO: 4246) | 560 | 573 |
| T46984_PEA_1_T52 (SEQ ID NO: 4247) | 1063 | 1076 |
| T46984_PEA_1_T54 (SEQ ID NO: 4248) | 1063 | 1076 |

This segment can be found in the following protein(s): T46984_PEA_1_P21.

Segment cluster T46984_PEA_1_node_85 (SEQ ID NO:6032) according to the present invention is supported by 295 libraries. The number of libraries was determined as previously described. This segment can be found in the following transcript(s): T46984_PEA_1_T27 (SEQ ID NO:4244), T46984_PEA_1_T46 (SEQ ID NO:4245), T46984_PEA_1_T51 (SEQ ID NO:4246), T46984_PEA_1_T52 (SEQ ID NO:4247) and T46984_PEA_1_T54 (SEQ ID NO:4248). Table 5604 below describes the starting and ending position of this segment on each transcript.

TABLE 5604

Segment location on transcripts

| Transcript name | Segment starting position | Segment ending position |
|---|---|---|
| T46984_PEA_1_T27 (SEQ ID NO: 4244) | 2036 | 2075 |
| T46984_PEA_1_T46 (SEQ ID NO: 4245) | 1538 | 1577 |
| T46984_PEA_1_T51 (SEQ ID NO: 4246) | 574 | 613 |
| T46984_PEA_1_T52 (SEQ ID NO: 4247) | 1077 | 1116 |
| T46984_PEA_1_T54 (SEQ ID NO: 4248) | 1077 | 1116 |

This segment can be found in a non-coding region of transcript(s) that are related to the following protein(s): T46984_PEA_1_P21.

Description for Cluster T47019

Cluster T47019 features 16 transcript(s) and 20 segment(s) of interest, the names for which are given in Tables 5605 and 5606, respectively, the sequences themselves are given at the end of the application. The selected protein variants are given in Table 5607.

TABLE 5605

Transcripts of interest
Transcript Name

T47019_T0 (SEQ ID NO: 4249)
T47019_T1 (SEQ ID NO: 4250)
T47019_T2 (SEQ ID NO: 4251)
T47019_T3 (SEQ ID NO: 4252)
T47019_T4 (SEQ ID NO: 4253)
T47019_T5 (SEQ ID NO: 4254)
T47019_T6 (SEQ ID NO: 4255)
T47019_T7 (SEQ ID NO: 4256)
T47019_T8 (SEQ ID NO: 4257)
T47019_T10 (SEQ ID NO: 4258)
T47019_T11 (SEQ ID NO: 4259)
T47019_T12 (SEQ ID NO: 4260)
T47019_T14 (SEQ ID NO: 4261)
T47019_T15 (SEQ ID NO: 4262)
T47019_T17 (SEQ ID NO: 4263)
T47019_T20 (SEQ ID NO: 4264)

TABLE 5606

Segments of interest
Segment Name

T47019_node_0 (SEQ ID NO: 6033)
T47019_node_3 (SEQ ID NO: 6034)
T47019_node_6 (SEQ ID NO: 6035)
T47019_node_7 (SEQ ID NO: 6036)
T47019_node_16 (SEQ ID NO: 6037)
T47019_node_21 (SEQ ID NO: 6038)
T47019_node_1 (SEQ ID NO: 6039)
T47019_node_2 (SEQ ID NO: 6040)
T47019_node_4 (SEQ ID NO: 6041)
T47019_node_5 (SEQ ID NO: 6042)

TABLE 5606-continued

Segments of interest
Segment Name

T47019_node_8 (SEQ ID NO: 6043)
T47019_node_9 (SEQ ID NO: 6044)
T47019_node_10 (SEQ ID NO: 6045)
T47019_node_11 (SEQ ID NO: 6046)
T47019_node_12 (SEQ ID NO: 6047)
T47019_node_13 (SEQ ID NO: 6048)
T47019_node_14 (SEQ ID NO: 6049)
T47019_node_15 (SEQ ID NO: 6050)
T47019_node_18 (SEQ ID NO: 6051)
T47019_node_20 (SEQ ID NO: 6052)

TABLE 5607

Proteins of interest

| Protein Name | Corresponding Transcript(s) |
|---|---|
| T47019_P2 | T47019_T0 (SEQ ID NO: 4249); T47019_T1 (SEQ ID NO: 4250); T47019_T2 (SEQ ID NO: 4251); T47019_T3 (SEQ ID NO: 4252); T47019_T4 (SEQ ID NO: 4253); T47019_T5 (SEQ ID NO: 4254); T47019_T6 (SEQ ID NO: 4255); T47019_T7 (SEQ ID NO: 4256); T47019_T8 (SEQ ID NO: 4257); T47019_T10 (SEQ ID NO: 4258) |
| T47019_P3 | T47019_T11 (SEQ ID NO: 4259) |
| T47019_P4 | T47019_T12 (SEQ ID NO: 4260); T47019_T15 (SEQ ID NO: 4262); T47019_T17 (SEQ ID NO: 4263) |
| T47019_P6 | T47019_T14 (SEQ ID NO: 4261) |
| T47019_P9 | T47019_T20 (SEQ ID NO: 4264) |

These sequences are variants of the known protein Calcyclin (SwissProt accession identifier S106_HUMAN; known also according to the synonyms Prolactin receptor associated protein; PRA; Growth factor-inducible protein 2A9; S100 calcium-binding protein A6; MLN 4), referred to herein as the previously known protein.

The sequence for protein Calcyclin is given at the end of the application, as "Calcyclin amino acid sequence". Known polymorphisms for this sequence are as shown in Table 5608.

TABLE 5608

Amino acid mutations for Known Protein

| SNP position(s) on amino acid sequence | Comment |
|---|---|
| 27 | H -> R (in dbSNP: 11974). /FTId = VAR_011982. |
| 69 | N -> S (in dbSNP: 1802581). /FTId = VAR_011983. |
| 83 | I -> T (in dbSNP: 1802582). /FTId = VAR_011984. |

The following GO Annotation(s) apply to the previously known protein. The following annotation(s) were found: cell cycle control; cell-cell signaling; axonogenesis, which are annotation(s) related to Biological Process; calcium binding; protein binding; growth factor, which are annotation(s) related to Molecular Function; and nuclear membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster T47019 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 135 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 135 and Table 5609. This cluster is overexpressed (at least at a minimum level) in the following pathological conditions: pancreas carcinoma.

TABLE 5609

Normal tissue distribution

| Name of Tissue | Number |
| --- | --- |
| bladder | 451 |
| bone | 395 |
| brain | 64 |
| colon | 756 |
| epithelial | 811 |
| general | 497 |
| head and neck | 628 |
| kidney | 388 |
| liver | 97 |
| lung | 835 |
| breast | 1257 |
| bone marrow | 62 |
| muscle | 137 |
| ovary | 262 |
| pancreas | 74 |
| prostate | 273 |
| skin | 2470 |
| stomach | 1433 |
| Thyroid | 386 |
| uterus | 541 |

TABLE 5610

P values and ratios for expression in cancerous tissue

| Name of Tissue | P1 | P2 | SP1 | R3 | SP2 | R4 |
| --- | --- | --- | --- | --- | --- | --- |
| bladder | 3.7e−01 | 3.0e−01 | 2.8e−01 | 1.1 | 3.4e−01 | 1.0 |
| bone | 5.8e−01 | 7.0e−01 | 9.4e−01 | 0.3 | 1.4e−01 | 0.7 |
| brain | 3.2e−01 | 1.5e−01 | 1.4e−03 | 2.3 | 3.6e−05 | 2.2 |
| colon | 2.4e−01 | 1.5e−01 | 4.2e−01 | 0.8 | 2.3e−01 | 1.0 |
| epithelial | 6.5e−01 | 7.3e−01 | 1 | 0.5 | 1 | 0.5 |
| general | 7.6e−01 | 8.7e−01 | 1 | 0.8 | 1 | 0.8 |
| head and neck | 6.5e−01 | 7.1e−01 | 1 | 0.2 | 1 | 0.2 |
| kidney | 6.6e−01 | 7.4e−01 | 5.5e−01 | 0.8 | 7.2e−01 | 0.7 |
| liver | 8.3e−01 | 1.7e−01 | 1 | 0.3 | 7.3e−01 | 0.9 |
| lung | 7.1e−01 | 8.0e−01 | 9.2e−01 | 0.7 | 1 | 0.5 |
| breast | 2.1e−01 | 2.1e−01 | 1 | 0.4 | 1 | 0.3 |
| bone marrow | 7.5e−01 | 3.8e−01 | 1 | 0.3 | 2.8e−01 | 1.8 |
| muscle | 5.9e−01 | 6.4e−01 | 7.2e−01 | 0.8 | 9.8e−01 | 0.3 |
| ovary | 5.1e−01 | 5.2e−01 | 3.4e−01 | 1.1 | 4.1e−01 | 0.9 |
| pancreas | 5.6e−02 | 1.4e−02 | 3.5e−09 | 3.6 | 3.0e−15 | 5.3 |
| prostate | 7.8e−01 | 8.2e−01 | 4.8e−03 | 0.8 | 1.9e−02 | 0.9 |
| skin | 3.9e−01 | 5.9e−01 | 1 | 0.1 | 1 | 0.0 |
| stomach | 5.1e−01 | 1.9e−01 | 1 | 0.2 | 9.1e−01 | 0.6 |
| Thyroid | 5.0e−01 | 5.0e−01 | 5.6e−01 | 0.7 | 5.6e−01 | 0.7 |
| uterus | 5.6e−01 | 6.9e−01 | 9.9e−01 | 0.3 | 9.9e−01 | 0.4 |

As noted above, cluster T47019 features 20 segment(s), which were listed in Table 5606 above and for which the sequence(s) are given at the end of the application. These segment(s) are portions of nucleic acid sequence(s) which are described herein separately because they are of particular interest. A description of each segment according to the present invention is now provided.

Segment cluster T47019_node_0 (SEQ ID NO:6033) according to the present invention is supported by 67 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5611 below describes the starting and ending position of this segment on each transcript.

TABLE 5611

Segment location on transcripts

| Transcript name | Segment starting position | Segment ending position |
| --- | --- | --- |
| T47019_T0 (SEQ ID NO: 4249) | 1 | 295 |
| T47019_T1 (SEQ ID NO: 4250) | 1 | 295 |
| T47019_T2 (SEQ ID NO: 4251) | 1 | 295 |
| T47019_T3 (SEQ ID NO: 4252) | 1 | 295 |
| T47019_T4 (SEQ ID NO: 4253) | 1 | 295 |
| T47019_T5 (SEQ ID NO: 4254) | 1 | 295 |
| T47019_T6 (SEQ ID NO: 4255) | 1 | 295 |
| T47019_T7 (SEQ ID NO: 4256) | 1 | 295 |
| T47019_T8 (SEQ ID NO: 4257) | 1 | 295 |
| T47019_T10 (SEQ ID NO: 4258) | 1 | 295 |
| T47019_T11 (SEQ ID NO: 4259) | 1 | 295 |
| T47019_T12 (SEQ ID NO: 4260) | 1 | 295 |
| T47019_T14 (SEQ ID NO: 4261) | 1 | 295 |
| T47019_T15 (SEQ ID NO: 4262) | 1 | 295 |
| T47019_T17 (SEQ ID NO: 4263) | 1 | 295 |
| T47019_T20 (SEQ ID NO: 4264) | 1 | 295 |

This segment can be found in both coding and non-coding regions of transcript(s) as follows. The segment can be found in a non-coding region of transcript(s) that are related to the following protein(s): T47019_P2, T47019_P3, T47019_P4 and T47019_P6. This segment can also be found in the following protein(s): T47019_P9, since it is in the coding region for the corresponding transcript.

Segment cluster T47019_node_3 (SEQ ID NO:6034) according to the present invention is supported by 654 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T5 (SEQ ID NO:4254), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5612 below describes the starting and ending position of this segment on each transcript.

TABLE 5612

Segment location on transcripts

| Transcript name | Segment starting position | Segment ending position |
|---|---|---|
| T47019_T0 (SEQ ID NO: 4249) | 318 | 476 |
| T47019_T1 (SEQ ID NO: 4250) | 318 | 476 |
| T47019_T2 (SEQ ID NO: 4251) | 318 | 476 |
| T47019_T3 (SEQ ID NO: 4252) | 318 | 476 |
| T47019_T5 (SEQ ID NO: 4254) | 318 | 476 |
| T47019_T10 (SEQ ID NO: 4258) | 318 | 476 |
| T47019_T11 (SEQ ID NO: 4259) | 318 | 476 |
| T47019_T12 (SEQ ID NO: 4260) | 318 | 476 |
| T47019_T14 (SEQ ID NO: 4261) | 318 | 476 |
| T47019_T15 (SEQ ID NO: 4262) | 318 | 476 |
| T47019_T17 (SEQ ID NO: 4263) | 318 | 476 |
| T47019_T20 (SEQ ID NO: 4264) | 318 | 476 |

This segment can be found in a non-coding region of transcript(s) that are related to the following protein(s): T47019_P2, T47019_P3, T47019_P4, T47019_P6 and T47019_P9.

Segment cluster T47019_node_6 (SEQ ID NO:6035) according to the present invention is supported by 43 libraries. The number of libraries was determined as previously described. This segment can be found in the following transcript(s): T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T11 (SEQ ID NO:4259) and T47019_T17 (SEQ ID NO:4263). Table 5613 below describes the starting and ending position of this segment on each transcript.

TABLE 5613

Segment location on transcripts

| Transcript name | Segment starting position | Segment ending position |
|---|---|---|
| T47019_T3 (SEQ ID NO: 4252) | 512 | 636 |
| T47019_T4 (SEQ ID NO: 4253) | 329 | 453 |
| T47019_T5 (SEQ ID NO: 4254) | 512 | 636 |
| T47019_T6 (SEQ ID NO: 4255) | 338 | 462 |
| T47019_T7 (SEQ ID NO: 4256) | 309 | 433 |
| T47019_T11 (SEQ ID NO: 4259) | 512 | 636 |
| T47019_T17 (SEQ ID NO: 4263) | 512 | 636 |

This segment can be found in a non-coding region of transcript(s) that are related to the following protein(s): T47019_P2, T47019_P3 and T47019_P4.

Segment cluster T47019_node_7 (SEQ ID NO:6036) according to the present invention is supported by 35 libraries. The number of libraries was determined as previously described. This segment can be found in the following transcript(s): T47019_T3 (SEQ ID NO:4252), T47019_T4 (SEQ ID NO:4253), T47019_T11 (SEQ ID NO:4259) and T47019_T17 (SEQ ID NO:4263). Table 5614 below describes the starting and ending position of this segment on each transcript.

TABLE 5614

Segment location on transcripts

| Transcript name | Segment starting position | Segment ending position |
|---|---|---|
| T47019_T3 (SEQ ID NO: 4252) | 637 | 939 |
| T47019_T4 (SEQ ID NO: 4253) | 454 | 756 |
| T47019_T11 (SEQ ID NO: 4259) | 637 | 939 |
| T47019_T17 (SEQ ID NO: 4263) | 637 | 939 |

This segment can be found in both coding and non-coding regions of transcript(s) as follows. The segment can be found in a non-coding region of transcript(s) that are related to the following protein(s): T47019_P2 and T47019_P4. This segment can also be found in the following protein(s): T47019_P3, since it is in the coding region for the corresponding transcript.

Segment cluster T47019_node_16 (SEQ ID NO:6037) according to the present invention is supported by 30 libraries. The number of libraries was determined as previously described. This segment can be found in the following transcript(s): T47019_T12 (SEQ ID NO:4260), T47019_T15 (SEQ ID NO:4262) and T47019_T17 (SEQ ID NO:4263). Table 5615 below describes the starting and ending position of this segment on each transcript.

TABLE 5615

Segment location on transcripts

| Transcript name | Segment starting position | Segment ending position |
|---|---|---|
| T47019_T12 (SEQ ID NO: 4260) | 636 | 1006 |
| T47019_T15 (SEQ ID NO: 4262) | 636 | 1006 |
| T47019_T17 (SEQ ID NO: 4263) | 1224 | 1594 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5616.

TABLE 5616

Oligonucleotides related to this segment

| Oligonucleotide name | Overexpressed in cancers | Chip reference |
|---|---|---|
| T47019_0_0_48883 | colorectal cancer | Colon |

This segment can be found in the following protein(s): T47019_P4.

Segment cluster T47019_node_21 (SEQ ID NO:6038) according to the present invention is supported by 592 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5617 below describes the starting and ending position of this segment on each transcript.

TABLE 5617

Segment location on transcripts

| Transcript name | Segment starting position | Segment ending position |
|---|---|---|
| T47019_T0 (SEQ ID NO: 4249) | 722 | 867 |
| T47019_T1 (SEQ ID NO: 4250) | 722 | 956 |
| T47019_T2 (SEQ ID NO: 4251) | 737 | 882 |
| T47019_T3 (SEQ ID NO: 4252) | 1310 | 1455 |
| T47019_T4 (SEQ ID NO: 4253) | 1127 | 1272 |
| T47019_T5 (SEQ ID NO: 4254) | 882 | 1027 |
| T47019_T6 (SEQ ID NO: 4255) | 708 | 853 |
| T47019_T7 (SEQ ID NO: 4256) | 679 | 824 |
| T47019_T8 (SEQ ID NO: 4257) | 554 | 699 |
| T47019_T10 (SEQ ID NO: 4258) | 737 | 971 |
| T47019_T11 (SEQ ID NO: 4259) | 1143 | 1288 |
| T47019_T12 (SEQ ID NO: 4260) | 1093 | 1238 |
| T47019_T14 (SEQ ID NO: 4261) | 713 | 858 |
| T47019_T15 (SEQ ID NO: 4262) | 1093 | 1327 |
| T47019_T17 (SEQ ID NO: 4263) | 1681 | 1826 |
| T47019_T20 (SEQ ID NO: 4264) | 563 | 708 |

This segment can be found in both coding and non-coding regions of transcript(s) as follows. The segment can be found in a non-coding region of transcript(s) that are related to the following protein(s): T47019_P3, T47019_P4 and T47019_P9. This segment can also be found in the following protein(s): T47019_P2 and T47019_P6, since it is in the coding region for the corresponding transcript.

According to an optional embodiment of the present invention, short segments related to the above cluster are also provided. These segments are up to about 120 bp in length, and so are included in a separate description.

Segment cluster T47019_node_1 (SEQ ID NO:6039) according to the present invention can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5618 below describes the starting and ending position of this segment on each transcript.

TABLE 5618

Segment location on transcripts

| Transcript name | Segment starting position | Segment ending position |
|---|---|---|
| T47019_T0 (SEQ ID NO: 4249) | 296 | 308 |
| T47019_T1 (SEQ ID NO: 4250) | 296 | 308 |
| T47019_T2 (SEQ ID NO: 4251) | 296 | 308 |
| T47019_T3 (SEQ ID NO: 4252) | 296 | 308 |
| T47019_T4 (SEQ ID NO: 4253) | 296 | 308 |
| T47019_T5 (SEQ ID NO: 4254) | 296 | 308 |
| T47019_T6 (SEQ ID NO: 4255) | 296 | 308 |
| T47019_T7 (SEQ ID NO: 4256) | 296 | 308 |
| T47019_T8 (SEQ ID NO: 4257) | 296 | 308 |
| T47019_T10 (SEQ ID NO: 4258) | 296 | 308 |
| T47019_T11 (SEQ ID NO: 4259) | 296 | 308 |
| T47019_T12 (SEQ ID NO: 4260) | 296 | 308 |
| T47019_T14 (SEQ ID NO: 4261) | 296 | 308 |
| T47019_T15 (SEQ ID NO: 4262) | 296 | 308 |
| T47019_T17 (SEQ ID NO: 4263) | 296 | 308 |
| T47019_T20 (SEQ ID NO: 4264) | 296 | 308 |

This segment can be found in a non-coding region of transcript(s) that are related to the following protein(s): T47019_P2, T47019_P3, T47019_P4, T47019_P6 and T47019_P9.

Segment cluster T47019_node_2 (SEQ ID NO:6040) according to the present invention can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T5 (SEQ ID NO:4254), T47019_T6 (SEQ ID NO:4255), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5619 below describes the starting and ending position of this segment on each transcript.

TABLE 5619

Segment location on transcripts

| Transcript name | Segment starting position | Segment ending position |
|---|---|---|
| T47019_T0 (SEQ ID NO: 4249) | 309 | 317 |
| T47019_T1 (SEQ ID NO: 4250) | 309 | 317 |
| T47019_T2 (SEQ ID NO: 4251) | 309 | 317 |
| T47019_T3 (SEQ ID NO: 4252) | 309 | 317 |
| T47019_T5 (SEQ ID NO: 4254) | 309 | 317 |
| T47019_T6 (SEQ ID NO: 4255) | 309 | 317 |
| T47019_T10 (SEQ ID NO: 4258) | 309 | 317 |
| T47019_T11 (SEQ ID NO: 4259) | 309 | 317 |
| T47019_T12 (SEQ ID NO: 4260) | 309 | 317 |
| T47019_T14 (SEQ ID NO: 4261) | 309 | 317 |
| T47019_T15 (SEQ ID NO: 4262) | 309 | 317 |
| T47019_T17 (SEQ ID NO: 4263) | 309 | 317 |
| T47019_T20 (SEQ ID NO: 4264) | 309 | 317 |

This segment can be found in a non-coding region of transcript(s) that are related to the following protein(s): T47019_P2, T47019_P3, T47019_P4, T47019_P6 and T47019_P9.

Segment cluster T47019_node_4 (SEQ ID NO:6041) according to the present invention can be found in the following transcript(s): T47019_T3 (SEQ ID NO:4252), T47019_T5 (SEQ ID NO:4254), T47019_T11 (SEQ ID NO:4259) and T47019_T17 (SEQ ID NO:4263). Table 5620 below describes the starting and ending position of this segment on each transcript.

TABLE 5620

Segment location on transcripts

| Transcript name | Segment starting position | Segment ending position |
|---|---|---|
| T47019_T3 (SEQ ID NO: 4252) | 477 | 491 |
| T47019_T5 (SEQ ID NO: 4254) | 477 | 491 |

TABLE 5620-continued

Segment location on transcripts

| Transcript name | Segment starting position | Segment ending position |
|---|---|---|
| T47019_T11 (SEQ ID NO: 4259) | 477 | 491 |
| T47019_T17 (SEQ ID NO: 4263) | 477 | 491 |

This segment can be found in a non-coding region of transcript(s) that are related to the following protein(s): T47019_P2, T47019_P3 and T47019_P4.

Segment cluster T47019_node_5 (SEQ ID NO:6042) according to the present invention can be found in the following transcript(s): T47019_T3 (SEQ ID NO:4252), T47019_T4 (SEQ ID NO:4253), T47019_T5 (SEQ ID NO:4254), T47019_T6 (SEQ ID NO:4255), T47019_T11 (SEQ ID NO:4259) and T47019_T17 (SEQ ID NO:4263). Table 5621 below describes the starting and ending position of this segment on each transcript.

TABLE 5621

Segment location on transcripts

| Transcript name | Segment starting position | Segment ending position |
|---|---|---|
| T47019_T3 (SEQ ID NO: 4252) | 492 | 511 |
| T47019_T4 (SEQ ID NO: 4253) | 309 | 328 |
| T47019_T5 (SEQ ID NO: 4254) | 492 | 511 |
| T47019_T6 (SEQ ID NO: 4255) | 318 | 337 |
| T47019_T11 (SEQ ID NO: 4259) | 492 | 511 |
| T47019_T17 (SEQ ID NO: 4263) | 492 | 511 |

This segment can be found in a non-coding region of transcript(s) that are related to the following protein(s): T47019_P2, T47019_P3 and T47019_P4.

Segment cluster T47019_node_8 (SEQ ID NO:6043) according to the present invention is supported by 29 libraries. The number of libraries was determined as previously described. This segment can be found in the following transcript(s): T47019_T3 (SEQ ID NO:4252), T47019_T4 (SEQ ID NO:4253) and T47019_T17 (SEQ ID NO:4263). Table 5622 below describes the starting and ending position of this segment on each transcript.

TABLE 5622

Segment location on transcripts

| Transcript name | Segment starting position | Segment ending position |
|---|---|---|
| T47019_T3 (SEQ ID NO: 4252) | 940 | 1049 |
| T47019_T4 (SEQ ID NO: 4253) | 757 | 866 |
| T47019_T17 (SEQ ID NO: 4263) | 940 | 1049 |

This segment can be found in a non-coding region of transcript(s) that are related to the following protein(s): T47019_P2 and T47019_P4.

Segment cluster T47019_node_9 (SEQ ID NO:6044) according to the present invention can be found in the following transcript(s): T47019_T2 (SEQ ID NO:4251), T47019_T3 (SEQ ID NO:4252), T47019_T4 (SEQ ID NO:4253), T47019_T10 (SEQ ID NO:4258) and T47019_T17 (SEQ ID NO:4263). Table 5623 below describes the starting and ending position of this segment on each transcript.

TABLE 5623

Segment location on transcripts

| Transcript name | Segment starting position | Segment ending position |
|---|---|---|
| T47019_T2 (SEQ ID NO: 4251) | 477 | 491 |
| T47019_T3 (SEQ ID NO: 4252) | 1050 | 1064 |
| T47019_T4 (SEQ ID NO: 4253) | 867 | 881 |
| T47019_T10 (SEQ ID NO: 4258) | 477 | 491 |
| T47019_T17 (SEQ ID NO: 4263) | 1050 | 1064 |

This segment can be found in a non-coding region of transcript(s) that are related to the following protein(s): T47019_P2 and T47019_P4.

Segment cluster T47019_node_10 (SEQ ID NO:6045) according to the present invention is supported by 747 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T12 (SEQ ID NO:4260), T47019_T14 (SEQ ID NO:4261), T47019_T15 (SEQ ID NO:4262) and T47019_T17 (SEQ ID NO:4263). Table 5624 below describes the starting and ending position of this segment on each transcript.

TABLE 5624

Segment location on transcripts

| Transcript name | Segment starting position | Segment ending position |
|---|---|---|
| T47019_T0 (SEQ ID NO: 4249) | 477 | 509 |
| T47019_T1 (SEQ ID NO: 4250) | 477 | 509 |
| T47019_T2 (SEQ ID NO: 4251) | 492 | 524 |
| T47019_T3 (SEQ ID NO: 4252) | 1065 | 1097 |
| T47019_T4 (SEQ ID NO: 4253) | 882 | 914 |
| T47019_T5 (SEQ ID NO: 4254) | 637 | 669 |
| T47019_T6 (SEQ ID NO: 4255) | 463 | 495 |
| T47019_T7 (SEQ ID NO: 4256) | 434 | 466 |
| T47019_T8 (SEQ ID NO: 4257) | 309 | 341 |
| T47019_T10 (SEQ ID NO: 4258) | 492 | 524 |
| T47019_T12 (SEQ ID NO: 4260) | 477 | 509 |
| T47019_T14 (SEQ ID NO: 4261) | 477 | 509 |
| T47019_T15 (SEQ ID NO: 4262) | 477 | 509 |
| T47019_T17 (SEQ ID NO: 4263) | 1065 | 1097 |

This segment can be found in the following protein(s): T47019_P2, T47019_P4 and T47019_P6.

Segment cluster T47019_node_11 (SEQ ID NO:6046) according to the present invention can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T12 (SEQ ID NO:4260), T47019_T14 (SEQ ID NO:4261), T47019_T15 (SEQ ID NO:4262) and T47019_T17 (SEQ ID NO:4263). Table 5625 below describes the starting and ending position of this segment on each transcript.

TABLE 5625

Segment location on transcripts

| Transcript name | Segment starting position | Segment ending position |
|---|---|---|
| T47019_T0 (SEQ ID NO: 4249) | 510 | 518 |
| T47019_T1 (SEQ ID NO: 4250) | 510 | 518 |
| T47019_T2 (SEQ ID NO: 4251) | 525 | 533 |
| T47019_T3 (SEQ ID NO: 4252) | 1098 | 1106 |
| T47019_T4 (SEQ ID NO: 4253) | 915 | 923 |
| T47019_T5 (SEQ ID NO: 4254) | 670 | 678 |
| T47019_T6 (SEQ ID NO: 4255) | 496 | 504 |
| T47019_T7 (SEQ ID NO: 4256) | 467 | 475 |
| T47019_T8 (SEQ ID NO: 4257) | 342 | 350 |
| T47019_T10 (SEQ ID NO: 4258) | 525 | 533 |
| T47019_T12 (SEQ ID NO: 4260) | 510 | 518 |
| T47019_T14 (SEQ ID NO: 4261) | 510 | 518 |
| T47019_T15 (SEQ ID NO: 4262) | 510 | 518 |
| T47019_T17 (SEQ ID NO: 4263) | 1098 | 1106 |

This segment can be found in the following protein(s): T47019_P2, T47019_P4 and T47019_P6.

Segment cluster T47019_node__12 (SEQ ID NO:6047) according to the present invention is supported by 775 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262) and T47019_T17 (SEQ ID NO:4263). Table 5626 below describes the starting and ending position of this segment on each transcript.

TABLE 5626

Segment location on transcripts

| Transcript name | Segment starting position | Segment ending position |
|---|---|---|
| T47019_T0 (SEQ ID NO: 4249) | 519 | 567 |
| T47019_T1 (SEQ ID NO: 4250) | 519 | 567 |
| T47019_T2 (SEQ ID NO: 4251) | 534 | 582 |
| T47019_T3 (SEQ ID NO: 4252) | 1107 | 1155 |
| T47019_T4 (SEQ ID NO: 4253) | 924 | 972 |
| T47019_T5 (SEQ ID NO: 4254) | 679 | 727 |
| T47019_T6 (SEQ ID NO: 4255) | 505 | 553 |
| T47019_T7 (SEQ ID NO: 4256) | 476 | 524 |
| T47019_T8 (SEQ ID NO: 4257) | 351 | 399 |
| T47019_T10 (SEQ ID NO: 4258) | 534 | 582 |
| T47019_T11 (SEQ ID NO: 4259) | 940 | 988 |
| T47019_T12 (SEQ ID NO: 4260) | 519 | 567 |
| T47019_T14 (SEQ ID NO: 4261) | 519 | 567 |
| T47019_T15 (SEQ ID NO: 4262) | 519 | 567 |
| T47019_T17 (SEQ ID NO: 4263) | 1107 | 1155 |

This segment can be found in both coding and non-coding regions of transcript(s) as follows. The segment can be found in a non-coding region of transcript(s) that are related to the following protein(s): T47019_P3. This segment can also be found in the following protein(s): T47019_P2, T47019_P4 and T47019_P6, since it is in the coding region for the corresponding transcript.

Segment cluster T47019_node__13 (SEQ ID NO:6048) according to the present invention can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262) and T47019_T17 (SEQ ID NO:4263). Table 5627 below describes the starting and ending position of this segment on each transcript.

TABLE 5627

Segment location on transcripts

| Transcript name | Segment starting position | Segment ending position |
|---|---|---|
| T47019_T0 (SEQ ID NO: 4249) | 568 | 586 |
| T47019_T1 (SEQ ID NO: 4250) | 568 | 586 |
| T47019_T2 (SEQ ID NO: 4251) | 583 | 601 |
| T47019_T3 (SEQ ID NO: 4252) | 1156 | 1174 |
| T47019_T4 (SEQ ID NO: 4253) | 973 | 991 |
| T47019_T5 (SEQ ID NO: 4254) | 728 | 746 |
| T47019_T6 (SEQ ID NO: 4255) | 554 | 572 |
| T47019_T7 (SEQ ID NO: 4256) | 525 | 543 |
| T47019_T8 (SEQ ID NO: 4257) | 400 | 418 |
| T47019_T10 (SEQ ID NO: 4258) | 583 | 601 |
| T47019_T11 (SEQ ID NO: 4259) | 989 | 1007 |
| T47019_T12 (SEQ ID NO: 4260) | 568 | 586 |
| T47019_T14 (SEQ ID NO: 4261) | 568 | 586 |
| T47019_T15 (SEQ ID NO: 4262) | 568 | 586 |
| T47019_T17 (SEQ ID NO: 4263) | 1156 | 1174 |

This segment can be found in both coding and non-coding regions of transcript(s) as follows. The segment can be found in a non-coding region of transcript(s) that are related to the following protein(s): T47019_P3. This segment can also be found in the following protein(s): T47019_P2, T47019_P4 and T47019_P6, since it is in the coding region for the corresponding transcript.

Segment cluster T47019_node__14 (SEQ ID NO:6049) according to the present invention is supported by 789 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262) and T47019_T17 (SEQ ID NO:4263). Table 5628 below describes the starting and ending position of this segment on each transcript.

TABLE 5628

Segment location on transcripts

| Transcript name | Segment starting position | Segment ending position |
|---|---|---|
| T47019_T0 (SEQ ID NO: 4249) | 587 | 615 |
| T47019_T1 (SEQ ID NO: 4250) | 587 | 615 |
| T47019_T2 (SEQ ID NO: 4251) | 602 | 630 |
| T47019_T3 (SEQ ID NO: 4252) | 1175 | 1203 |
| T47019_T4 (SEQ ID NO: 4253) | 992 | 1020 |
| T47019_T5 (SEQ ID NO: 4254) | 747 | 775 |
| T47019_T6 (SEQ ID NO: 4255) | 573 | 601 |

TABLE 5628-continued

Segment location on transcripts

| Transcript name | Segment starting position | Segment ending position |
|---|---|---|
| T47019_T7 (SEQ ID NO: 4256) | 544 | 572 |
| T47019_T8 (SEQ ID NO: 4257) | 419 | 447 |
| T47019_T10 (SEQ ID NO: 4258) | 602 | 630 |
| T47019_T11 (SEQ ID NO: 4259) | 1008 | 1036 |
| T47019_T12 (SEQ ID NO: 4260) | 587 | 615 |
| T47019_T14 (SEQ ID NO: 4261) | 587 | 615 |
| T47019_T15 (SEQ ID NO: 4262) | 587 | 615 |
| T47019_T17 (SEQ ID NO: 4263) | 1175 | 1203 |

This segment can be found in both coding and non-coding regions of transcript(s) as follows. The segment can be found in a non-coding region of transcript(s) that are related to the following protein(s): T47019_P3. This segment can also be found in the following protein(s): T47019_P2, T47019_P4 and T47019_P6, since it is in the coding region for the corresponding transcript.

Segment cluster T47019_node__15 (SEQ ID NO:6050) according to the present invention can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262) and T47019_T17 (SEQ ID NO:4263). Table 5629 below describes the starting and ending position of this segment on each transcript.

TABLE 5629

Segment location on transcripts

| Transcript name | Segment starting position | Segment ending position |
|---|---|---|
| T47019_T0 (SEQ ID NO: 4249) | 616 | 635 |
| T47019_T1 (SEQ ID NO: 4250) | 616 | 635 |
| T47019_T2 (SEQ ID NO: 4251) | 631 | 650 |
| T47019_T3 (SEQ ID NO: 4252) | 1204 | 1223 |
| T47019_T4 (SEQ ID NO: 4253) | 1021 | 1040 |
| T47019_T5 (SEQ ID NO: 4254) | 776 | 795 |
| T47019_T6 (SEQ ID NO: 4255) | 602 | 621 |
| T47019_T7 (SEQ ID NO: 4256) | 573 | 592 |
| T47019_T8 (SEQ ID NO: 4257) | 448 | 467 |
| T47019_T10 (SEQ ID NO: 4258) | 631 | 650 |
| T47019_T11 (SEQ ID NO: 4259) | 1037 | 1056 |
| T47019_T12 (SEQ ID NO: 4260) | 616 | 635 |
| T47019_T14 (SEQ ID NO: 4261) | 616 | 635 |
| T47019_T15 (SEQ ID NO: 4262) | 616 | 635 |
| T47019_T17 (SEQ ID NO: 4263) | 1204 | 1223 |

This segment can be found in both coding and non-coding regions of transcript(s) as follows. The segment can be found in a non-coding region of transcript(s) that are related to the following protein(s): T47019_P3. This segment can also be found in the following protein(s): T47019_P2, T47019_P4 and T47019_P6, since it is in the coding region for the corresponding transcript.

Segment cluster T47019_node__18 (SEQ ID NO:6051) according to the present invention can be found in the following transcript(s): T47019_T0 (SEQ ID NO:4249) T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T10 (SEQ ID NO:4258), T47019_T11 (SEQ ID NO:4259), T47019_T12 (SEQ ID NO:4260), T47019_T15 (SEQ ID NO:4262), T47019_T17 (SEQ ID NO:4263) and T47019_T20 (SEQ ID NO:4264). Table 5630 below describes the starting and ending position of this segment on each transcript.

TABLE 5630

Segment location on transcripts

| Transcript name | Segment starting position | Segment ending position |
|---|---|---|
| T47019_T0 (SEQ ID NO: 4249) | 636 | 644 |
| T47019_T1 (SEQ ID NO: 4250) | 636 | 644 |
| T47019_T2 (SEQ ID NO: 4251) | 651 | 659 |
| T47019_T3 (SEQ ID NO: 4252) | 1224 | 1232 |
| T47019_T4 (SEQ ID NO: 4253) | 1041 | 1049 |
| T47019_T5 (SEQ ID NO: 4254) | 796 | 804 |
| T47019_T6 (SEQ ID NO: 4255) | 622 | 630 |
| T47019_T7 (SEQ ID NO: 4256) | 593 | 601 |
| T47019_T8 (SEQ ID NO: 4257) | 468 | 476 |
| T47019_T10 (SEQ ID NO: 4258) | 651 | 659 |
| T47019_T11 (SEQ ID NO: 4259) | 1057 | 1065 |
| T47019_T12 (SEQ ID NO: 4260) | 1007 | 1015 |
| T47019_T15 (SEQ ID NO: 4262) | 1007 | 1015 |
| T47019_T17 (SEQ ID NO: 4263) | 1595 | 1603 |
| T47019_T20 (SEQ ID NO: 4264) | 477 | 485 |

This segment can be found in both coding and non-coding regions of transcript(s) as follows. The segment can be found in a non-coding region of transcript(s) that are related to the following protein(s): T47019_P3, T47019_P4 and T47019_P9. This segment can also be found in the following protein(s): T47019_P2, since it is in the coding region for the corresponding transcript.

Segment cluster T47019_node__20 (SEQ ID NO:6052) according to the present invention is supported by 779 libraries. The number of libraries was determined as previously described. This segment can be found in the following transcript(s): T47019_T0 (SEQ ID NO:4249), T47019_T1 (SEQ ID NO:4250), T47019_T2 (SEQ ID NO:4251), T47019_T3 (SEQ ID NO:4252), T47019_T4 (SEQ ID NO:4253), T47019_T5 (SEQ ID NO:4254), T47019_T6 (SEQ ID NO:4255), T47019_T7 (SEQ ID NO:4256), T47019_T8 (SEQ ID NO:4257), T47019_T0 (SEQ ID NO:4258), T47019_T11 (SEQ ID NO:4259), T47019_T12 (SEQ ID NO:4260), T47019_T14 (SEQ ID NO:4261), T47019_T15 (SEQ ID NO:4262), T47019_T17 (SEQ ID NO:4263) and T47019_T20 (SEQ ID NO:4264). Table 5631 below describes the starting and ending position of this segment on each transcript.

TABLE 5631

Segment location on transcripts

| Transcript name | Segment starting position | Segment ending position |
|---|---|---|
| T47019_T0 (SEQ ID NO: 4249) | 645 | 721 |
| T47019_T1 (SEQ ID NO: 4250) | 645 | 721 |
| T47019_T2 (SEQ ID NO: 4251) | 660 | 736 |
| T47019_T3 (SEQ ID NO: 4252) | 1233 | 1309 |
| T47019_T4 (SEQ ID NO: 4253) | 1050 | 1126 |
| T47019_T5 (SEQ ID NO: 4254) | 805 | 881 |
| T47019_T6 (SEQ ID NO: 4255) | 631 | 707 |

TABLE 5631-continued

Segment location on transcripts

| Transcript name | Segment starting position | Segment ending position |
|---|---|---|
| T47019_T7 (SEQ ID NO: 4256) | 602 | 678 |
| T47019_T8 (SEQ ID NO: 4257) | 477 | 553 |
| T47019_T10 (SEQ ID NO: 4258) | 660 | 736 |
| T47019_T11 (SEQ ID NO: 4259) | 1066 | 1142 |
| T47019_T12 (SEQ ID NO: 4260) | 1016 | 1092 |
| T47019_T14 (SEQ ID NO: 4261) | 636 | 712 |
| T47019_T15 (SEQ ID NO: 4262) | 1016 | 1092 |
| T47019_T17 (SEQ ID NO: 4263) | 1604 | 1680 |
| T47019_T20 (SEQ ID NO: 4264) | 486 | 562 |

This segment can be found in both coding and non-coding regions of transcript(s) as follows. The segment can be found in a non-coding region of transcript(s) that are related to the following protein(s): T47019_P3, T47019_P4 and T47019_P9. This segment can also be found in the following protein(s): T47019_P2 and T47019_P6, since it is in the coding region for the corresponding transcript.

Description for Cluster T72188

Cluster T72188 features 5 transcript(s) and 24 segment(s) of interest, the names for which are given in Tables 5632 and 5633, respectively, the sequences themselves are given at the end of the application. The selected protein variants are given in Table 5634.

TABLE 5632

Transcripts of interest
Transcript Name

T72188_T10 (SEQ ID NO: 4265)
T72188_T15 (SEQ ID NO: 4266)
T72188_T19 (SEQ ID NO: 4267)
T72188_T20 (SEQ ID NO: 4268)
T72188_T21 (SEQ ID NO: 4269)

TABLE 5633

Segments of interest
Segment Name

T72188_node_0 (SEQ ID NO: 6053)
T72188_node_1 (SEQ ID NO: 6054)
T72188_node_13 (SEQ ID NO: 6055)
T72188_node_18 (SEQ ID NO: 6056)
T72188_node_20 (SEQ ID NO: 6057)
T72188_node_23 (SEQ ID NO: 6058)
T72188_node_24 (SEQ ID NO: 6059)
T72188_node_27 (SEQ ID NO: 6060)
T72188_node_34 (SEQ ID NO: 6061)
T72188_node_35 (SEQ ID NO: 6062)
T72188_node_41 (SEQ ID NO: 6063)
T72188_node_14 (SEQ ID NO: 6064)
T72188_node_15 (SEQ ID NO: 6065)
T72188_node_16 (SEQ ID NO: 6066)
T72188_node_17 (SEQ ID NO: 6067)
T72188_node_21 (SEQ ID NO: 6068)
T72188_node_22 (SEQ ID NO: 6069)
T72188_node_25 (SEQ ID NO: 6070)
T72188_node_28 (SEQ ID NO: 6071)
T72188_node_29 (SEQ ID NO: 6072)
T72188_node_36 (SEQ ID NO: 6073)
T72188_node_37 (SEQ ID NO: 6074)
T72188_node_38 (SEQ ID NO: 6075)
T72188_node_40 (SEQ ID NO: 6076)

TABLE 5634

Proteins of interest

| Protein Name | Corresponding Transcript(s) |
|---|---|
| T72188_P10 | T72188_T10 (SEQ ID NO: 4265); T72188_T15 (SEQ ID NO: 4266) |
| T72188_P17 | T72188_T19 (SEQ ID NO: 4267) |

These sequences are variants of the known protein Alpha-1B-glycoprotein precursor (SwissProt accession identifier A1BG_HUMAN; known also according to the synonyms Alpha-1-B glycoprotein), referred to herein as the previously known protein.

Protein Alpha-1B-glycoprotein precursor is known or believed to have the following function(s): Not known. The sequence for protein Alpha-1B-glycoprotein precursor is given at the end of the application, as "Alpha-1B-glycoprotein precursor amino acid sequence". Known polymorphisms for this sequence are as shown in Table 5635.

TABLE 5635

Amino acid mutations for Known Protein

| SNP position(s) on amino acid sequence | Comment |
|---|---|
| 105 | G -> S |
| 127 | P -> S |
| 146 | E -> V |
| 413 | A -> V |
| 446-447 | IP -> VR |

Protein Alpha-1B-glycoprotein precursor localization is believed to be Secreted.

The following GO Annotation(s) apply to the previously known protein. The following annotation(s) were found: extracellular, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster T72188 features 24 segment(s), which were listed in Table 5633 above and for which the sequence(s) are given at the end of the application. These segment(s) are portions of nucleic acid sequence(s) which are described herein separately because they are of particular interest. A description of each segment according to the present invention is now provided.

Segment cluster T72188_node_0 (SEQ ID NO:6053) according to the present invention is supported by 7 libraries. The number of libraries was determined as previously described. This segment can be found in the following transcript(s): T72188_T21 (SEQ ID NO:4269). Table 5636 below describes the starting and ending position of this segment on each transcript.

TABLE 5636

Segment location on transcripts

| Transcript name | Segment starting position | Segment ending position |
|---|---|---|
| T72188_T21 (SEQ ID NO: 4269) | 1 | 150 |

The previously-described transcripts for these segment(s) do not code for protein.

Segment cluster T72188_node_1 (SEQ ID NO:6054) according to the present invention is supported by 7 libraries. The number of libraries was determined as previously described. This segment can be found in the following transcript(s): T72188_T21 (SEQ ID NO:4269). Table 5637 below describes the starting and ending position of this segment on each transcript.

TABLE 5637

Segment location on transcripts

| Transcript name | Segment starting position | Segment ending position |
|---|---|---|
| T72188_T21 (SEQ ID NO: 4269) | 151 | 2026 |

The previously-described transcripts for these segment(s) do not code for protein.

Segment cluster T72188_node_13 (SEQ ID NO:6055) according to the present invention is supported by 22 libraries. The number of libraries was determined as previously described. This segment can be found in the following transcript(s): T72188_T10 (SEQ ID NO:4265) and T72188_T15 (SEQ ID NO:4266). Table 5638 below describes the starting and ending position of this segment on each transcript.

TABLE 5638

Segment location on transcripts

| Transcript name | Segment starting position | Segment ending position |
|---|---|---|
| T72188_T10 (SEQ ID NO: 4265) | 1 | 164 |
| T72188_T15 (SEQ ID NO: 4266) | 1 | 164 |

This segment can be found in the following protein(s): T72188_P10.

Segment cluster T72188_node_18 (SEQ ID NO:6056) according to the present invention is supported by 27 libraries. The number of libraries was determined as previously described. This segment can be found in the following transcript(s): T72188_T10 (SEQ ID NO:4265) and T72188_T15 (SEQ ID NO:4266). Table 5639 below describes the starting and ending position of this segment on each transcript.

TABLE 5639

Segment location on transcripts

| Transcript name | Segment starting position | Segment ending position |
|---|---|---|
| T72188_T10 (SEQ ID NO: 4265) | 371 | 640 |
| T72188_T15 (SEQ ID NO: 4266) | 371 | 640 |

This segment can be found in a non-coding region of transcript(s) that are related to the following protein(s): T72188_P10.

Segment cluster T72188_node_20 (SEQ ID NO:6057) according to the present invention is supported by 33 libraries. The number of libraries was determined as previously described. This segment can be found in the following transcript(s): T72188_T10 (SEQ ID NO:4265) and T72188_T15 (SEQ ID NO:4266). Table 5640 below describes the starting and ending position of this segment on each transcript.

TABLE 5640

Segment location on transcripts

| Transcript name | Segment starting position | Segment ending position |
|---|---|---|
| T72188_T10 (SEQ ID NO: 4265) | 641 | 913 |
| T72188_T15 (SEQ ID NO: 4266) | 641 | 913 |

This segment can be found in a non-coding region of transcript(s) that are related to the following protein(s): T72188_P10.

Segment cluster T72188_node_23 (SEQ ID NO:6058) according to the present invention is supported by 5 libraries. The number of libraries was determined as previously described. This segment can be found in the following transcript(s): T72188_T15 (SEQ ID NO:4266). Table 5641 below describes the starting and ending position of this segment on each transcript.

TABLE 5641

Segment location on transcripts

| Transcript name | Segment starting position | Segment ending position |
|---|---|---|
| T72188_T15 (SEQ ID NO: 4266) | 1099 | 1508 |

This segment can be found in a non-coding region of transcript(s) that are related to the following protein(s): T72188_P10.

Segment cluster T72188_node_24 (SEQ ID NO:6059) according to the present invention is supported by 27 libraries. The number of libraries was determined as previously described. This segment can be found in the following transcript(s): T72188_T10 (SEQ ID NO:4265) and T72188_T15 (SEQ ID NO:4266). Table 5642 below describes the starting and ending position of this segment on each transcript.

TABLE 5642

Segment location on transcripts

| Transcript name | Segment starting position | Segment ending position |
|---|---|---|
| T72188_T10 (SEQ ID NO: 4265) | 914 | 1143 |
| T72188_T15 (SEQ ID NO: 4266) | 1509 | 1738 |

This segment can be found in a non-coding region of transcript(s) that are related to the following protein(s): T72188_P10.

Segment cluster T72188_node_27 (SEQ ID NO:6060) according to the present invention is supported by 22 libraries. The number of libraries was determined as previously described. This segment can be found in the following transcript(s): T72188_T10 (SEQ ID NO:4265) and T72188_T15

(SEQ ID NO:4266). Table 5643 below describes the starting and ending position of this segment on each transcript.

TABLE 5643

Segment location on transcripts

| Transcript name | Segment starting position | Segment ending position |
|---|---|---|
| T72188_T10 (SEQ ID NO: 4265) | 1211 | 1481 |
| T72188_T15 (SEQ ID NO: 4266) | 1806 | 2076 |

This segment can be found in a non-coding region of transcript(s) that are related to the following protein(s): T72188_P10.

Segment cluster T72188_node_34 (SEQ ID NO:6061) according to the present invention is supported by 10 libraries. The number of libraries was determined as previously described. This segment can be found in the following transcript(s): T72188_T19 (SEQ ID NO:4267) and T72188_T20 (SEQ ID NO:4268). Table 5644 below describes the starting and ending position of this segment on each transcript.

TABLE 5644

Segment location on transcripts

| Transcript name | Segment starting position | Segment ending position |
|---|---|---|
| T72188_T19 (SEQ ID NO: 4267) | 1 | 524 |
| T72188_T20 (SEQ ID NO: 4268) | 1 | 524 |

This segment can be found in the following protein(s): T72188_P17.

Segment cluster T72188_node_35 (SEQ ID NO:6062) according to the present invention is supported by 58 libraries. The number of libraries was determined as previously described. This segment can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5645 below describes the starting and ending position of this segment on each transcript.

TABLE 5645

Segment location on transcripts

| Transcript name | Segment starting position | Segment ending position |
|---|---|---|
| T72188_T10 (SEQ ID NO: 4265) | 1493 | 1635 |
| T72188_T15 (SEQ ID NO: 4266) | 2088 | 2230 |
| T72188_T19 (SEQ ID NO: 4267) | 525 | 667 |
| T72188_T20 (SEQ ID NO: 4268) | 525 | 667 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

Segment cluster T72188_node_41 (SEQ ID NO:6063) according to the present invention is supported by 53 libraries. The number of libraries was determined as previously described. This segment can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5646 below describes the starting and ending position of this segment on each transcript.

TABLE 5646

Segment location on transcripts

| Transcript name | Segment starting position | Segment ending position |
|---|---|---|
| T72188_T10 (SEQ ID NO: 4265) | 1799 | 1952 |
| T72188_T15 (SEQ ID NO: 4266) | 2394 | 2547 |
| T72188_T19 (SEQ ID NO: 4267) | 831 | 2664 |
| T72188_T20 (SEQ ID NO: 4268) | 831 | 984 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

According to an optional embodiment of the present invention, short segments related to the above cluster are also provided. These segments are up to about 120 bp in length, and so are included in a separate description.

Segment cluster T72188_node_14 (SEQ ID NO:6064) according to the present invention is supported by 2 libraries. The number of libraries was determined as previously described. This segment can be found in the following transcript(s): T72188_T10 (SEQ ID NO:4265) and T72188_T15 (SEQ ID NO:4266). Table 5647 below describes the starting and ending position of this segment on each transcript.

TABLE 5647

Segment location on transcripts

| Transcript name | Segment starting position | Segment ending position |
|---|---|---|
| T72188_T10 (SEQ ID NO: 4265) | 165 | 240 |
| T72188_T15 (SEQ ID NO: 4266) | 165 | 240 |

This segment can be found in the following protein(s): T72188_P10.

Segment cluster T72188_node_15 (SEQ ID NO:6065) according to the present invention is supported by 24 libraries. The number of libraries was determined as previously described. This segment can be found in the following transcript(s): T72188_T10 (SEQ ID NO:4265) and T72188_T15 (SEQ ID NO:4266). Table 5648 below describes the starting and ending position of this segment on each transcript.

TABLE 5648

Segment location on transcripts

| Transcript name | Segment starting position | Segment ending position |
|---|---|---|
| T72188_T10 (SEQ ID NO: 4265) | 241 | 276 |
| T72188_T15 (SEQ ID NO: 4266) | 241 | 276 |

This segment can be found in the following protein(s): T72188_P10.

Segment cluster T72188_node_16 (SEQ ID NO:6066) according to the present invention can be found in the following transcript(s): T72188_T10 (SEQ ID NO:4265) and T72188_T15 (SEQ ID NO:4266). Table 5649 below describes the starting and ending position of this segment on each transcript.

TABLE 5649

Segment location on transcripts

| Transcript name | Segment starting position | Segment ending position |
|---|---|---|
| T72188_T10 (SEQ ID NO: 4265) | 277 | 288 |
| T72188_T15 (SEQ ID NO: 4266) | 277 | 288 |

This segment can be found in the following protein(s): T72188_P10.

Segment cluster T72188_node__17 (SEQ ID NO:6067) according to the present invention is supported by 2 libraries. The number of libraries was determined as previously described. This segment can be found in the following transcript(s): T72188_T10 (SEQ ID NO:4265) and T72188_T15 (SEQ ID NO:4266). Table 5650 below describes the starting and ending position of this segment on each transcript.

TABLE 5650

Segment location on transcripts

| Transcript name | Segment starting position | Segment ending position |
|---|---|---|
| T72188_T10 (SEQ ID NO: 4265) | 289 | 370 |
| T72188_T15 (SEQ ID NO: 4266) | 289 | 370 |

This segment can be found in a non-coding region of transcript(s) that are related to the following protein(s): T72188_P10.

Segment cluster T72188_node__21 (SEQ ID NO:6068) according to the present invention is supported by 5 libraries. The number of libraries was determined as previously described. This segment can be found in the following transcript(s): T72188_T15 (SEQ ID NO:4266). Table 5651 below describes the starting and ending position of this segment on each transcript.

TABLE 5651

Segment location on transcripts

| Transcript name | Segment starting position | Segment ending position |
|---|---|---|
| T72188_T15 (SEQ ID NO: 4266) | 914 | 1011 |

This segment can be found in a non-coding region of transcript(s) that are related to the following protein(s): T72188_P10.

Segment cluster T72188_node__22 (SEQ ID NO:6069) according to the present invention is supported by 7 libraries. The number of libraries was determined as previously described. This segment can be found in the following transcript(s): T72188_T15 (SEQ ID NO:4266). Table 5652 below describes the starting and ending position of this segment on each transcript.

TABLE 5652

Segment location on transcripts

| Transcript name | Segment starting position | Segment ending position |
|---|---|---|
| T72188_T15 (SEQ ID NO: 4266) | 1012 | 1098 |

This segment can be found in a non-coding region of transcript(s) that are related to the following protein(s): T72188_P10.

Segment cluster T72188_node__25 (SEQ ID NO:6070) according to the present invention is supported by 18 libraries. The number of libraries was determined as previously described. This segment can be found in the following transcript(s): T72188_T10 (SEQ ID NO:4265) and T72188_T15 (SEQ ID NO:4266). Table 5653 below describes the starting and ending position of this segment on each transcript.

TABLE 5653

Segment location on transcripts

| Transcript name | Segment starting position | Segment ending position |
|---|---|---|
| T72188_T10 (SEQ ID NO: 4265) | 1144 | 1210 |
| T72188_T15 (SEQ ID NO: 4266) | 1739 | 1805 |

This segment can be found in a non-coding region of transcript(s) that are related to the following protein(s): T72188_P10.

Segment cluster T72188_node__28 (SEQ ID NO:6071) according to the present invention can be found in the following transcript(s): T72188_T10 (SEQ ID NO:4265) and T72188_T15 (SEQ ID NO:4266). Table 5654 below describes the starting and ending position of this segment on each transcript.

TABLE 5654

Segment location on transcripts

| Transcript name | Segment starting position | Segment ending position |
|---|---|---|
| T72188_T10 (SEQ ID NO: 4265) | 1482 | 1485 |
| T72188_T15 (SEQ ID NO: 4266) | 2077 | 2080 |

This segment can be found in a non-coding region of transcript(s) that are related to the following protein(s): T72188_P10.

Segment cluster T72188_node__29 (SEQ ID NO:6072) according to the present invention can be found in the following transcript(s): T72188_T10 (SEQ ID NO:4265) and T72188_T15 (SEQ ID NO:4266). Table 5655 below describes the starting and ending position of this segment on each transcript.

TABLE 5655

Segment location on transcripts

| Transcript name | Segment starting position | Segment ending position |
|---|---|---|
| T72188_T10 (SEQ ID NO: 4265) | 1486 | 1492 |
| T72188_T15 (SEQ ID NO: 4266) | 2081 | 2087 |

This segment can be found in a non-coding region of transcript(s) that are related to the following protein(s): T72188_P10.

Segment cluster T72188_node_36 (SEQ ID NO:6073) according to the present invention is supported by 60 libraries. The number of libraries was determined as previously described. This segment can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5656 below describes the starting and ending position of this segment on each transcript.

TABLE 5656

Segment location on transcripts

| Transcript name | Segment starting position | Segment ending position |
|---|---|---|
| T72188_T10 (SEQ ID NO: 4265) | 1636 | 1706 |
| T72188_T15 (SEQ ID NO: 4266) | 2231 | 2301 |
| T72188_T19 (SEQ ID NO: 4267) | 668 | 738 |
| T72188_T20 (SEQ ID NO: 4268) | 668 | 738 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

Segment cluster T72188_node_37 (SEQ ID NO:6074) according to the present invention can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5657 below describes the starting and ending position of this segment on each transcript.

TABLE 5657

Segment location on transcripts

| Transcript name | Segment starting position | Segment ending position |
|---|---|---|
| T72188_T10 (SEQ ID NO: 4265) | 1707 | 1716 |
| T72188_T15 (SEQ ID NO: 4266) | 2302 | 2311 |
| T72188_T19 (SEQ ID NO: 4267) | 739 | 748 |
| T72188_T20 (SEQ ID NO: 4268) | 739 | 748 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

Segment cluster T72188_node_38 (SEQ ID NO:6075) according to the present invention is supported by 62 libraries. The number of libraries was determined as previously described. This segment can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5658 below describes the starting and ending position of this segment on each transcript.

TABLE 5658

Segment location on transcripts

| Transcript name | Segment starting position | Segment ending position |
|---|---|---|
| T72188_T10 (SEQ ID NO: 4265) | 1717 | 1780 |
| T72188_T15 (SEQ ID NO: 4266) | 2312 | 2375 |
| T72188_T19 (SEQ ID NO: 4267) | 749 | 812 |
| T72188_T20 (SEQ ID NO: 4268) | 749 | 812 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

Segment cluster T72188_node_40 (SEQ ID NO:6076) according to the present invention can be found in the following transcript(s): T72188_T10 (SEQ ID NO:4265), T72188_T15 (SEQ ID NO:4266), T72188_T19 (SEQ ID NO:4267) and T72188_T20 (SEQ ID NO:4268). Table 5659 below describes the starting and ending position of this segment on each transcript.

TABLE 5659

Segment location on transcripts

| Transcript name | Segment starting position | Segment ending position |
|---|---|---|
| T72188_T10 (SEQ ID NO: 4265) | 1781 | 1798 |
| T72188_T15 (SEQ ID NO: 4266) | 2376 | 2393 |
| T72188_T19 (SEQ ID NO: 4267) | 813 | 830 |
| T72188_T20 (SEQ ID NO: 4268) | 813 | 830 |

This segment can be found in both coding and non-coding regions of transcript(s) as follows. The segment can be found in a non-coding region of transcript(s) that are related to the following protein(s): T72188_P10. This segment can also be found in the following protein(s): T72188_P17, since it is in the coding region for the corresponding transcript.

Description for Cluster T99080

Cluster T99080 features 8 transcript(s) and 11 segment(s) of interest, the names for which are given in Tables 5660 and 5661, respectively, the sequences themselves are given at the end of the application. The selected protein variants are given in Table 5662.

TABLE 5660

| Transcripts of interest Transcript Name |
|---|
| T99080_PEA_4_T0 (SEQ ID NO: 4270) |
| T99080_PEA_4_T2 (SEQ ID NO: 4271) |
| T99080_PEA_4_T4 (SEQ ID NO: 4272) |
| T99080_PEA_4_T10 (SEQ ID NO: 4273) |
| T99080_PEA_4_T11 (SEQ ID NO: 4274) |
| T99080_PEA_4_T13 (SEQ ID NO: 4275) |
| T99080_PEA_4_T14 (SEQ ID NO: 4276) |
| T99080_PEA_4_T17 (SEQ ID NO: 4277) |

TABLE 5661

Segments of interest
Segment Name

T99080_PEA_4_node_1 (SEQ ID NO: 6077)
T99080_PEA_4_node_6 (SEQ ID NO: 6078)
T99080_PEA_4_node_11 (SEQ ID NO: 6079)
T99080_PEA_4_node_19 (SEQ ID NO: 6080)
T99080_PEA_4_node_20 (SEQ ID NO: 6081)
T99080_PEA_4_node_3 (SEQ ID NO: 6082)
T99080_PEA_4_node_5 (SEQ ID NO: 6083)
T99080_PEA_4_node_8 (SEQ ID NO: 6084)
T99080_PEA_4_node_13 (SEQ ID NO: 6085)
T99080_PEA_4_node_15 (SEQ ID NO: 6086)
T99080_PEA_4_node_18 (SEQ ID NO: 6087)

TABLE 5662

Proteins of interest

| Protein Name | Corresponding Transcript(s) |
| --- | --- |
| T99080_PEA_4_P1 | T99080_PEA_4_T0 (SEQ ID NO: 4270) |
| T99080_PEA_4_P2 | T99080_PEA_4_T2 (SEQ ID NO: 4271) |
| T99080_PEA_4_P9 | T99080_PEA_4_T10 (SEQ ID NO: 4273) |
| T99080_PEA_4_P10 | T99080_PEA_4_T11 (SEQ ID NO: 4274) |
| T99080_PEA_4_P12 | T99080_PEA_4_T14 (SEQ ID NO: 4276) |
| T99080_PEA_4_P13 | T99080_PEA_4_T17 (SEQ ID NO: 4277) |

These sequences are variants of the known protein Acylphosphatase, organ-common type isozyme (SwissProt accession identifier ACYO_HUMAN; known also according to the synonyms EC 3.6.1.7; Acylphosphate phosphohydrolase; Acylphosphatase, erythrocyte isozyme), referred to herein as the previously known protein.

Protein Acylphosphatase, organ-common type isozyme is known or believed to have the following function(s): Its physiological role is not yet clear. The sequence for protein Acylphosphatase, organ-common type isozyme is given at the end of the application, as "Acylphosphatase, organ-common type isozyme amino acid sequence". Known polymorphisms for this sequence are as shown in Table 5663.

TABLE 5663

Amino acid mutations for Known Protein

| SNP position(s) on amino acid sequence | Comment |
| --- | --- |
| 19 | G -> R |

The following GO Annotation(s) apply to the previously known protein. The following annotation(s) were found: phosphate metabolism, which are annotation(s) related to Biological Process; and acylphosphatase, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster T99080 features 11 segment(s), which were listed in Table 5661 above and for which the sequence(s) are given at the end of the application. These segment(s) are portions of nucleic acid sequence(s) which are described herein separately because they are of particular interest. A description of each segment according to the present invention is now provided.

Segment cluster T99080_PEA_4_node_1 (SEQ ID NO:6077) according to the present invention is supported by 5 libraries. The number of libraries was determined as previously described. This segment can be found in the following transcript(s): T99080_PEA_4_T0 (SEQ ID NO:4270) and T99080_PEA_4_T13 (SEQ ID NO:4275). Table 5664 below describes the starting and ending position of this segment on each transcript.

TABLE 5664

Segment location on transcripts

| Transcript name | Segment starting position | Segment ending position |
| --- | --- | --- |
| T99080_PEA_4_T0 (SEQ ID NO: 4270) | 1 | 307 |
| T99080_PEA_4_T13 (SEQ ID NO: 4275) | 1 | 307 |

This segment can be found in the following protein(s): T99080_PEA_4_P1.

Segment cluster T99080_PEA_4_node_6 (SEQ ID NO:6078) according to the present invention is supported by 3 libraries. The number of libraries was determined as previously described. This segment can be found in the following transcript(s): T99080_PEA_4_T17 (SEQ ID NO:4277). Table 5665 below describes the starting and ending position of this segment on each transcript.

TABLE 5665

Segment location on transcripts

| Transcript name | Segment starting position | Segment ending position |
| --- | --- | --- |
| T99080_PEA_4_T17 (SEQ ID NO: 4277) | 181 | 627 |

This segment can be found in the following protein(s): T99080_PEA_4_P13.

Segment cluster T99080_PEA_4_node_11 (SEQ ID NO:6079) according to the present invention is supported by 7 libraries. The number of libraries was determined as previously described. This segment can be found in the following transcript(s): T99080_PEA_4_T14 (SEQ ID NO:4276). Table 5666 below describes the starting and ending position of this segment on each transcript.

TABLE 5666

Segment location on transcripts

| Transcript name | Segment starting position | Segment ending position |
| --- | --- | --- |
| T99080_PEA_4_T14 (SEQ ID NO: 4276) | 260 | 782 |

This segment can be found in the following protein(s): T99080_PEA_4_P12.

Segment cluster T99080_PEA_4_node_19 (SEQ ID NO:6080) according to the present invention is supported by 59 libraries. The number of libraries was determined as previously described. This segment can be found in the following transcript(s): T99080_PEA_4_T0 (SEQ ID NO:4270), T99080_PEA_4_T2 (SEQ ID NO:4271) and T99080_PEA_4_T4 (SEQ ID NO:4272). Table 5667 below describes the starting and ending position of this segment on each transcript.

TABLE 5667

Segment location on transcripts

| Transcript name | Segment starting position | Segment ending position |
|---|---|---|
| T99080_PEA_4_T0 (SEQ ID NO: 4270) | 449 | 1736 |
| T99080_PEA_4_T2 (SEQ ID NO: 4271) | 230 | 1517 |
| T99080_PEA_4_T4 (SEQ ID NO: 4272) | 78 | 1365 |

This segment can be found in a non-coding region of transcript(s) that are related to the following protein(s): T99080_PEA_4_P1 and T99080_PEA_4_P2.

Segment cluster T99080_PEA_4_node_20 (SEQ ID NO:6081) according to the present invention is supported by 98 libraries. The number of libraries was determined as previously described. This segment can be found in the following transcript(s): T99080_PEA_4_T0 (SEQ ID NO:4270), T99080_PEA_4_T2 (SEQ ID NO:4271), T99080_PEA_4_T4 (SEQ ID NO:4272), T99080_PEA_4_T10 (SEQ ID NO:4273), T99080_PEA_4_T11 (SEQ ID NO:4274) and T99080_PEA_4_T13 (SEQ ID NO:4275). Table 5668 below describes the starting and ending position of this segment on each transcript.

TABLE 5668

Segment location on transcripts

| Transcript name | Segment starting position | Segment ending position |
|---|---|---|
| T99080_PEA_4_T0 (SEQ ID NO: 4270) | 1737 | 2175 |
| T99080_PEA_4_T2 (SEQ ID NO: 4271) | 1518 | 1956 |
| T99080_PEA_4_T4 (SEQ ID NO: 4272) | 1366 | 1804 |
| T99080_PEA_4_T10 (SEQ ID NO: 4273) | 260 | 698 |
| T99080_PEA_4_T11 (SEQ ID NO: 4274) | 295 | 733 |
| T99080_PEA_4_T13 (SEQ ID NO: 4275) | 308 | 746 |

This segment can be found in both coding and non-coding regions of transcript(s) as follows. The segment can be found in a non-coding region of transcript(s) that are related to the following protein(s): T99080_PEA_4_P1, T99080_PEA_4_P2 and T99080_PEA_4_P10. This segment can also be found in the following protein(s): T99080_PEA_4_P9, since it is in the coding region for the corresponding transcript.

According to an optional embodiment of the present invention, short segments related to the above cluster are also provided. These segments are up to about 120 bp in length, and so are included in a separate description.

Segment cluster T99080_PEA_4_node_3 (SEQ ID NO:6082) according to the present invention is supported by 40 libraries. The number of libraries was determined as previously described. This segment can be found in the following transcript(s): T99080_PEA_4_T2 (SEQ ID NO:4271), T99080_PEA_4_T10 (SEQ ID NO:4273), T99080_PEA_4_T11 (SEQ ID NO:4274), T99080_PEA_4_T14 (SEQ ID NO:4276) and T99080_PEA_4_T17 (SEQ ID NO:4277). Table 5669 below describes the starting and ending position of this segment on each transcript.

TABLE 5669

Segment location on transcripts

| Transcript name | Segment starting position | Segment ending position |
|---|---|---|
| T99080_PEA_4_T2 (SEQ ID NO: 4271) | 1 | 88 |
| T99080_PEA_4_T10 (SEQ ID NO: 4273) | 1 | 88 |
| T99080_PEA_4_T11 (SEQ ID NO: 4274) | 1 | 88 |
| T99080_PEA_4_T14 (SEQ ID NO: 4276) | 1 | 88 |
| T99080_PEA_4_T17 (SEQ ID NO: 4277) | 1 | 88 |

This segment can be found in the following protein(s): T99080_PEA_4_P2, T99080_PEA_4_P9, T99080_PEA_4_P10, T99080_PEA_4_P12 and T99080_PEA_4_P13.

Segment cluster T99080_PEA_4_node_5 (SEQ ID NO:6083) according to the present invention is supported by 57 libraries. The number of libraries was determined as previously described. This segment can be found in the following transcript(s): T99080_PEA_4_T0 (SEQ ID NO:4270), T99080_PEA_4_T2 (SEQ ID NO:4271), T99080_PEA_4_T10 (SEQ ID NO:4273), T99080_PEA_4_T11 (SEQ ID NO:4274), T99080_PEA_4_T14 (SEQ ID NO:4276) and T99080_PEA_4_T17 (SEQ ID NO:4277). Table 5670 below describes the starting and ending position of this segment on each transcript.

TABLE 5670

Segment location on transcripts

| Transcript name | Segment starting position | Segment ending position |
|---|---|---|
| T99080_PEA_4_T0 (SEQ ID NO: 4270) | 308 | 399 |
| T99080_PEA_4_T2 (SEQ ID NO: 4271) | 89 | 180 |
| T99080_PEA_4_T10 (SEQ ID NO: 4273) | 89 | 180 |
| T99080_PEA_4_T11 (SEQ ID NO: 4274) | 89 | 180 |
| T99080_PEA_4_T14 (SEQ ID NO: 4276) | 89 | 180 |
| T99080_PEA_4_T17 (SEQ ID NO: 4277) | 89 | 180 |

This segment can be found in the following protein(s): T99080_PEA_4_P1, T99080_PEA_4_P2, T99080_PEA_4_P9, T99080_PEA_4_P10, T99080_PEA_4_P12 and T99080_PEA_4_P13.

Segment cluster T99080_PEA_4_node_8 (SEQ ID NO:6084) according to the present invention is supported by 12 libraries. The number of libraries was determined as previously described. This segment can be found in the following transcript(s): T99080_PEA_4_T10 (SEQ ID NO:4273) and T99080_PEA_4_T14 (SEQ ID NO:4276). Table 5671 below describes the starting and ending position of this segment on each transcript.

TABLE 5671

Segment location on transcripts

| Transcript name | Segment starting position | Segment ending position |
|---|---|---|
| T99080_PEA_4_T10 (SEQ ID NO: 4273) | 181 | 259 |
| T99080_PEA_4_T14 (SEQ ID NO: 4276) | 181 | 259 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5672.

TABLE 5672

Oligonucleotides related to this segment

| Oligonucleotide name | Overexpressed in cancers | Chip reference |
|---|---|---|
| T99080_0_0_58896 | lung malignant tumors | LUN |

This segment can be found in the following protein(s): T99080_PEA_4_P9 and T99080_PEA_4_P12.

Segment cluster T99080_PEA_4_node_13 (SEQ ID NO:6085) according to the present invention is supported by 2 libraries. The number of libraries was determined as previously described. This segment can be found in the following transcript(s): T99080_PEA_4_T4 (SEQ ID NO:4272). Table 5673 below describes the starting and ending position of this segment on each transcript.

TABLE 5673

Segment location on transcripts

| Transcript name | Segment starting position | Segment ending position |
|---|---|---|
| T99080_PEA_4_T4 (SEQ ID NO: 4272) | 1 | 77 |

The previously-described transcripts for these segment(s) do not code for protein.

Segment cluster T99080_PEA_4_node_15 (SEQ ID NO:6086) according to the present invention is supported by 6 libraries. The number of libraries was determined as previously described. This segment can be found in the following transcript(s): T99080_PEA_4_T11 (SEQ ID NO:4274). Table 5674 below describes the starting and ending position of this segment on each transcript.

TABLE 5674

Segment location on transcripts

| Transcript name | Segment starting position | Segment ending position |
|---|---|---|
| T99080_PEA_4_T11 (SEQ ID NO: 4274) | 181 | 294 |

This segment can be found in the following protein(s): T99080_PEA_4_P10.

Segment cluster T99080_PEA_4_node_18 (SEQ ID NO:6087) according to the present invention is supported by 5 libraries. The number of libraries was determined as previously described. This segment can be found in the following transcript(s): T99080_PEA_4_T0 (SEQ ID NO:4270) and T99080_PEA_4_T2 (SEQ ID NO:4271). Table 5675 below describes the starting and ending position of this segment on each transcript.

TABLE 5675

Segment location on transcripts

| Transcript name | Segment starting position | Segment ending position |
|---|---|---|
| T99080_PEA_4_T0 (SEQ ID NO: 4270) | 400 | 448 |
| T99080_PEA_4_T2 (SEQ ID NO: 4271) | 181 | 229 |

This segment can be found in the following protein(s): T99080_PEA_4_P1 and T99080_PEA_4_P2.

Description for Cluster Z20721

Cluster Z20721 features 1 transcript(s) and 6 segment(s) of interest, the names for which are given in Tables 5676 and 5677, respectively, the sequences themselves are given at the end of the application. The selected protein variants are given in Table 5678.

TABLE 5676

Transcripts of interest

| Transcript name |
|---|
| Z20721_T3 (SEQ ID NO: 4278) |

TABLE 5677

Segments of interest

| Segment Name |
|---|
| Z20721_node_5 (SEQ ID NO: 6088) |
| Z20721_node_14 (SEQ ID NO: 6089) |
| Z20721_node_17 (SEQ ID NO: 6090) |
| Z20721_node_18 (SEQ ID NO: 6091) |
| Z20721_node_6 (SEQ ID NO: 6092) |
| Z20721_node_12 (SEQ ID NO: 6093) |

TABLE 5678

Proteins of interest

| Protein Name | Corresponding Transcript(s) |
|---|---|
| Z20721_P3 | Z20721_T3 (SEQ ID NO: 4278) |

These sequences are variants of the known protein Interferon-induced protein 6-16 precursor (SwissProt accession identifier INI2_HUMAN; known also according to the synonyms Ifi-6-16), referred to herein as the previously known protein.

The sequence for protein Interferon-induced protein 6-16 precursor is given at the end of the application, as "Interferon-induced protein 6-16 precursor amino acid sequence". Known polymorphisms for this sequence are as shown in Table 5679.

TABLE 5679

Amino acid mutations for Known Protein

| SNP position(s) on amino acid sequence | Comment |
|---|---|
| 8 | L -> V |
| 116 | G -> R |

The previously known protein also has the following indication(s) and/or potential therapeutic use(s): Infection, hepatitis-C virus; Infection, human papilloma virus; Infection, varicella zoster virus; Cancer, head and neck; Infection, otological; Infection, herpes virus; Inflammation, brain; Cancer, leukaemia, hairy cell; Infection, hepatitis virus; Cancer, sarcoma, Kaposi's; Cancer, melanoma; Cancer, myeloma; Cancer, renal; Infection, hepatitis-B virus; Cancer, leukaemia, chronic myelogenous; Cancer, leukaemia; Cancer, lymphoma, T-cell; Infection, HIV/AIDS; Dysplasia, cervical; Multiple sclerosis; Infection, West Nile encephalitis virus; Infection, coronavirus; Infection, coronavirus, prophylaxis; Arthritis, rheumatoid; Infection; Cancer; Cancer, brain; Infection, herpes simplex virus; Cancer, skin; Cirrhosis, hepatic; Macular degeneration; Keratoconjunctivitis; Cancer, colorectal; Cancer, liver; Cancer, sarcoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Interferon alpha 2 agonist; Interferon alpha 2A agonist; Interferon alpha 2b agonist; Interferon alpha 2c agonist; Interferon alpha N1 agonist; Interferon alpha N3 agonist; Interferon alpha agonist; Interferon beta agonist; Interferon gamma 1a agonist; Interferon gamma agonist; Interleukin 2 agonist; Protein synthesis antagonist; RNA synthesis inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antiviral, interferon; Cytokine; Anticancer; Opthalmological; Antiviral, anti-HIV; Multiple sclerosis treatment; Antiarthritic, immunological; Hepatoprotective.

The following GO Annotation(s) apply to the previously known protein. The following annotation(s) were found: immune response, which are annotation(s) related to Biological Process; and integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z20721 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 136 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 136 and Table 5680. This cluster is overexpressed (at least at a minimum level) in the following pathological conditions: epithelial malignant tumors, a mixture of malignant tumors from different tissues and breast malignant tumors.

TABLE 5680

Normal tissue distribution

| Name of Tissue | Number |
|---|---|
| bladder | 82 |
| bone | 6 |
| brain | 8 |
| colon | 132 |
| epithelial | 69 |
| general | 47 |
| head and neck | 0 |
| kidney | 4 |
| liver | 0 |
| lung | 23 |
| breast | 0 |
| ovary | 0 |
| pancreas | 47 |
| prostate | 10 |
| skin | 201 |
| stomach | 329 |
| Thyroid | 0 |
| uterus | 54 |

TABLE 5681

P values and ratios for expression in cancerous tissue

| Name of Tissue | P1 | P2 | SP1 | R3 | SP2 | R4 |
|---|---|---|---|---|---|---|
| bladder | 5.4e-01 | 6.6e-01 | 4.7e-01 | 1.4 | 7.1e-01 | 1.0 |
| bone | 2.3e-01 | 2.1e-01 | 1.1e-02 | 5.0 | 5.9e-02 | 3.0 |
| brain | 6.5e-01 | 7.8e-01 | 1.1e-05 | 2.5 | 4.7e-04 | 1.5 |
| colon | 5.7e-01 | 6.1e-01 | 9.4e-01 | 0.6 | 9.7e-01 | 0.5 |
| epithelial | 4.6e-03 | 2.7e-02 | 1.4e-01 | 1.1 | 2.3e-01 | 1.0 |
| general | 1.2e-03 | 3.1e-02 | 1.1e-06 | 1.8 | 5.1e-04 | 1.4 |
| head and neck | 1 | 5.0e-01 | 1 | 1.0 | 5.6e-01 | 1.7 |
| kidney | 1.0e-01 | 2.4e-01 | 1.3e-02 | 5.6 | 5.7e-02 | 3.7 |
| liver | 1.8e-01 | 1.9e-01 | 2.3e-01 | 4.3 | 6.9e-01 | 1.7 |
| lung | 5.1e-01 | 6.8e-01 | 7.9e-01 | 0.9 | 9.4e-01 | 0.6 |
| breast | 8.7e-03 | 9.2e-03 | 3.9e-04 | 6.9 | 1.5e-04 | 7.7 |
| ovary | 8.2e-02 | 1.1e-01 | 1.5e-01 | 3.3 | 2.6e-01 | 2.5 |
| pancreas | 2.6e-01 | 5.2e-01 | 4.6e-01 | 1.2 | 6.9e-01 | 0.8 |
| prostate | 9.0e-01 | 8.6e-01 | 6.7e-01 | 1.1 | 2.4e-01 | 1.6 |
| skin | 6.9e-01 | 7.5e-01 | 1 | 0.1 | 9.9e-01 | 0.2 |
| stomach | 4.2e-01 | 8.4e-01 | 9.6e-01 | 0.4 | 1 | 0.2 |
| Thyroid | 5.0e-01 | 5.0e-01 | 3.0e-01 | 2.0 | 3.0e-01 | 2.0 |
| uterus | 4.1e-01 | 2.6e-01 | 5.6e-01 | 0.9 | 3.1e-01 | 1.2 |

As noted above, cluster Z20721 features 6 segment(s), which were listed in Table 5677 above and for which the sequence(s) are given at the end of the application. These segment(s) are portions of nucleic acid sequence(s) which are described herein separately because they are of particular interest. A description of each segment according to the present invention is now provided.

Segment cluster Z20721_node_5 (SEQ ID NO:6088) according to the present invention is supported by 5 libraries. The number of libraries was determined as previously described. This segment can be found in the following transcript(s): Z20721_T3 (SEQ ID NO:4278). Table 5682 below describes the starting and ending position of this segment on each transcript.

TABLE 5682

Segment location on transcripts

| Transcript name | Segment starting position | Segment ending position |
|---|---|---|
| Z20721_T3 (SEQ ID NO: 4278) | 1 | 531 |

This segment can be found in the following protein(s): Z20721_P3.

Segment cluster Z20721_node_14 (SEQ ID NO:6089) according to the present invention is supported by 173 libraries. The number of libraries was determined as previously described. This segment can be found in the following transcript(s): Z20721_T3 (SEQ ID NO:4278). Table 5683 below describes the starting and ending position of this segment on each transcript.

TABLE 5683

Segment location on transcripts

| Transcript name | Segment starting position | Segment ending position |
|---|---|---|
| Z20721_T3 (SEQ ID NO: 4278) | 712 | 861 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5684.

TABLE 5684

Oligonucleotides related to this segment

| Oligonucleotide name | Overexpressed in cancers | Chip reference |
|---|---|---|
| Z20721_0_9_0 | colorectal cancer | Colon |

This segment can be found in the following protein(s): Z20721_P3.

Segment cluster Z20721_node_17 (SEQ ID NO:6090) according to the present invention is supported by 131 libraries. The number of libraries was determined as previously described. This segment can be found in the following transcript(s): Z20721_T3 (SEQ ID NO:4278). Table 5685 below describes the starting and ending position of this segment on each transcript.

TABLE 5685

Segment location on transcripts

| Transcript name | Segment starting position | Segment ending position |
|---|---|---|
| Z20721_T3 (SEQ ID NO: 4278) | 862 | 1089 |

This segment can be found in the following protein(s): Z20721_P3.

Segment cluster Z20721_node_18 (SEQ ID NO:6091) according to the present invention is supported by 107 libraries. The number of libraries was determined as previously described. This segment can be found in the following transcript(s): Z20721_T3 (SEQ ID NO:4278). Table 5686 below describes the starting and ending position of this segment on each transcript.

TABLE 5686

Segment location on transcripts

| Transcript name | Segment starting position | Segment ending position |
|---|---|---|
| Z20721_T3 (SEQ ID NO: 4278) | 1090 | 1284 |

This segment can be found in a non-coding region of transcript(s) that are related to the following protein(s): Z20721_P3.

According to an optional embodiment of the present invention, short segments related to the above cluster are also provided. These segments are up to about 120 bp in length, and so are included in a separate description.

Segment cluster Z20721_node_6 (SEQ ID NO:6092) according to the present invention is supported by 165 libraries. The number of libraries was determined as previously described. This segment can be found in the following transcript(s): Z20721_T3 (SEQ ID NO:4278). Table 5687 below describes the starting and ending position of this segment on each transcript.

TABLE 5687

Segment location on transcripts

| Transcript name | Segment starting position | Segment ending position |
|---|---|---|
| Z20721_T3 (SEQ ID NO: 4278) | 532 | 633 |

This segment can be found in the following protein(s): Z20721_P3.

Segment cluster Z20721_node_12 (SEQ ID NO:6093) according to the present invention is supported by 171 libraries. The number of libraries was determined as previously described. This segment can be found in the following transcript(s): Z20721_T3 (SEQ ID NO:4278). Table 5688 below describes the starting and ending position of this segment on each transcript.

TABLE 5688

Segment location on transcripts

| Transcript name | Segment starting position | Segment ending position |
|---|---|---|
| Z20721_T3 (SEQ ID NO: 4278) | 634 | 711 |

This segment can be found in the following protein(s): Z20721_P3.

Description for Cluster Z28497

Cluster Z28497 features 3 transcript(s) and 21 segment(s) of interest, the names for which are given in Tables 5689 and 5690, respectively, the sequences themselves are given at the end of the application. The selected protein variants are given in Table 5691.

TABLE 5689

Transcripts of interest
Transcript Name

Z28497_PEA_1_T16 (SEQ ID NO: 4279)
Z28497_PEA_1_T19 (SEQ ID NO: 4280)
Z28497_PEA_1_T22 (SEQ ID NO: 4281)

TABLE 5690

Segments of interest
Segment Name

Z28497_PEA_1_node_7 (SEQ ID NO: 6094)
Z28497_PEA_1_node_8 (SEQ ID NO: 6095)
Z28497_PEA_1_node_9 (SEQ ID NO: 6096)
Z28497_PEA_1_node_11 (SEQ ID NO: 6097)
Z28497_PEA_1_node_21 (SEQ ID NO: 6098)
Z28497_PEA_1_node_30 (SEQ ID NO: 6099)
Z28497_PEA_1_node_31 (SEQ ID NO: 6100)
Z28497_PEA_1_node_34 (SEQ ID NO: 6101)
Z28497_PEA_1_node_35 (SEQ ID NO: 6102)
Z28497_PEA_1_node_10 (SEQ ID NO: 6103)
Z28497_PEA_1_node_14 (SEQ ID NO: 6104)
Z28497_PEA_1_node_15 (SEQ ID NO: 6105)
Z28497_PEA_1_node_16 (SEQ ID NO: 6106)
Z28497_PEA_1_node_18 (SEQ ID NO: 6107)
Z28497_PEA_1_node_22 (SEQ ID NO: 6108)
Z28497_PEA_1_node_23 (SEQ ID NO: 6109)
Z28497_PEA_1_node_26 (SEQ ID NO: 6110)
Z28497_PEA_1_node_27 (SEQ ID NO: 6111)
Z28497_PEA_1_node_28 (SEQ ID NO: 6112)
Z28497_PEA_1_node_29 (SEQ ID NO: 6113)
Z28497_PEA_1_node_32 (SEQ ID NO: 6114)

TABLE 5691

Proteins of interest

| Protein Name | Corresponding Transcript(s) |
|---|---|
| _PEA_1_P6 | Z28497_PEA_1_T19 (SEQ ID NO: 4280) |

These sequences are variants of the known protein Calumenin precursor (SwissProt accession identifier CALU_HUMAN; known also according to the synonyms Crocalbin; IEF SSP 9302), referred to herein as the previously known protein.

Protein Calumenin precursor is known or believed to have the following function(s): Not known, binds 7 calcium ions with a low affinity. The sequence for protein Calumenin precursor is given at the end of the application, as "Calumenin precursor amino acid sequence". Known polymorphisms for this sequence are as shown in Table 5692.

TABLE 5692

Amino acid mutations for Known Protein

| SNP position(s) on amino acid sequence | Comment |
|---|---|
| 207 | F -> L |

Protein Calumenin precursor localization is believed to be Endoplasmic reticulum lumen and secreted.

The following GO Annotation(s) apply to the previously known protein. The following annotation(s) were found: calcium binding, which are annotation(s) related to Molecular Function; and endoplasmic reticulum; Golgi apparatus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z28497 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 137 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 137 and Table 5693. This cluster is overexpressed (at least at a minimum level) in the following pathological conditions: adrenal cortical carcinoma, colorectal cancer, epithelial malignant tumors, a mixture of malignant tumors from different tissues, hepatocellular carcinoma and malignant tumors involving the lymph nodes.

TABLE 5693

Normal tissue distribution

| Name of Tissue | Number |
|---|---|
| adrenal | 0 |
| bladder | 533 |
| Bone | 1340 |
| Brain | 76 |
| Colon | 126 |
| epithelial | 223 |
| general | 238 |
| head and neck | 354 |
| kidney | 71 |
| Liver | 0 |
| Lung | 298 |
| Lymph nodes | 35 |
| Breast | 408 |
| bone marrow | 690 |
| muscle | 87 |
| Ovary | 193 |
| pancreas | 51 |
| prostate | 221 |
| Skin | 443 |
| stomach | 219 |
| T cells | 0 |
| Thyroid | 128 |
| Uterus | 386 |

TABLE 5694

P values and ratios for expression in cancerous tissue

| Name of Tissue | P1 | P2 | SP1 | R3 | SP2 | R4 |
|---|---|---|---|---|---|---|
| adrenal | 4.7e-03 | 2.3e-03 | 1.9e-03 | 9.5 | 4.5e-05 | 9.9 |
| bladder | 6.5e-01 | 7.0e-01 | 9.7e-01 | 0.5 | 9.9e-01 | 0.4 |
| Bone | 4.7e-01 | 3.3e-01 | 1 | 0.2 | 1 | 0.3 |
| Brain | 3.0e-01 | 1.6e-01 | 4.4e-01 | 1.2 | 1.9e-01 | 1.2 |
| Colon | 2.7e-03 | 3.7e-03 | 2.7e-01 | 1.5 | 2.6e-01 | 1.4 |
| epithelial | 4.6e-02 | 8.0e-03 | 7.9e-01 | 0.9 | 1.9e-01 | 1.0 |
| general | 1.6e-02 | 1.3e-04 | 9.9e-01 | 0.8 | 6.2e-01 | 0.9 |
| head and neck | 6.0e-01 | 4.9e-01 | 9.2e-01 | 0.5 | 9.6e-01 | 0.4 |
| kidney | 6.9e-01 | 6.1e-01 | 6.7e-01 | 1.0 | 5.4e-02 | 1.5 |
| Liver | 1.8e-01 | 7.0e-03 | 1 | 1.7 | 2.6e-02 | 3.6 |
| Lung | 4.8e-01 | 4.4e-01 | 3.1e-01 | 1.0 | 1.1e-01 | 1.0 |
| Lymph nodes | 3.5e-02 | 7.1e-02 | 9.2e-04 | 5.7 | 1.3e-02 | 3.1 |

TABLE 5694-continued

P values and ratios for expression in cancerous tissue

| Name of Tissue | P1 | P2 | SP1 | R3 | SP2 | R4 |
|---|---|---|---|---|---|---|
| Breast | 7.4e-01 | 8.1e-01 | 1 | 0.2 | 9.9e-01 | 0.3 |
| bone marrow | 7.1e-01 | 7.5e-01 | 1 | 0.0 | 1 | 0.2 |
| muscle | 5.0e-01 | 3.7e-01 | 5.3e-03 | 2.2 | 9.6e-04 | 2.1 |
| Ovary | 7.4e-01 | 7.6e-01 | 3.5e-01 | 1.1 | 5.9e-01 | 0.9 |
| pancreas | 2.8e-01 | 1.9e-01 | 1.8e-02 | 2.0 | 4.5e-03 | 2.4 |
| prostate | 8.2e-01 | 8.3e-01 | 7.9e-01 | 0.6 | 7.2e-01 | 0.7 |
| Skin | 4.9e-01 | 3.7e-01 | 9.0e-01 | 0.6 | 1 | 0.2 |
| stomach | 4.2e-01 | 5.9e-01 | 1.7e-01 | 0.5 | 6.9e-02 | 1.5 |
| T cells | 1 | 6.7e-01 | 1 | 1.0 | 1.0e-01 | 1.8 |
| Thyroid | 5.7e-01 | 5.7e-01 | 8.9e-01 | 0.8 | 8.9e-01 | 0.8 |
| Uterus | 2.8e-01 | 3.7e-01 | 1 | 0.4 | 1 | 0.3 |

As noted above, cluster Z28497 features 21 segment(s), which were listed in Table 5690 above and for which the sequence(s) are given at the end of the application. These segment(s) are portions of nucleic acid sequence(s) which are described herein separately because they are of particular interest. A description of each segment according to the present invention is now provided.

Segment cluster Z28497_PEA_1_node_7 (SEQ ID NO:6094) according to the present invention is supported by 6 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5695 below describes the starting and ending position of this segment on each transcript.

TABLE 5695

Segment location on transcripts

| Transcript name | Segment starting position | Segment ending position |
|---|---|---|
| Z28497_PEA_1_T16 (SEQ ID NO: 4279) | 1 | 1170 |
| Z28497_PEA_1_T19 (SEQ ID NO: 4280) | 1 | 1170 |

This segment can be found in a non-coding region of transcript(s) that are related to the following protein(s): Z28497_PEA_1_P6.

Segment cluster Z28497_PEA_1_node_8 (SEQ ID NO:6095) according to the present invention is supported by 8 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5696 below describes the starting and ending position of this segment on each transcript.

TABLE 5696

Segment location on transcripts

| Transcript name | Segment starting position | Segment ending position |
|---|---|---|
| Z28497_PEA_1_T16 (SEQ ID NO: 4279) | 1171 | 1614 |
| Z28497_PEA_1_T19 (SEQ ID NO: 4280) | 1171 | 1614 |

This segment can be found in a non-coding region of transcript(s) that are related to the following protein(s): Z28497_PEA_1_P6.

Segment cluster Z28497_PEA_1_node_9 (SEQ ID NO:6096) according to the present invention is supported by 182 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5697 below describes the starting and ending position of this segment on each transcript.

TABLE 5697

Segment location on transcripts

| Transcript name | Segment starting position | Segment ending position |
|---|---|---|
| Z28497_PEA_1_T16 (SEQ ID NO: 4279) | 1615 | 1808 |
| Z28497_PEA_1_T19 (SEQ ID NO: 4280) | 1615 | 1808 |

This segment can be found in a non-coding region of transcript(s) that are related to the following protein(s): Z28497_PEA_1_P6.

Segment cluster Z28497_PEA_1_node_11 (SEQ ID NO:6097) according to the present invention is supported by 59 libraries. The number of libraries was determined as previously described. This segment can be found in the following transcript(s): Z28497_PEA_1_T19 (SEQ ID NO:4280). Table 5698 below describes the starting and ending position of this segment on each transcript.

TABLE 5698

Segment location on transcripts

| Transcript name | Segment starting position | Segment ending position |
|---|---|---|
| Z28497_PEA_1_T19 (SEQ ID NO: 4280) | 1882 | 2075 |

This segment can be found in the following protein(s): Z28497_PEA_1_P6.

Segment cluster Z28497_PEA_1_node_21 (SEQ ID NO:6098) according to the present invention is supported by 8 libraries. The number of libraries was determined as previously described. This segment can be found in the following transcript(s): Z28497_PEA_1_T22 (SEQ ID NO:4281). Table 5699 below describes the starting and ending position of this segment on each transcript.

TABLE 5699

Segment location on transcripts

| Transcript name | Segment starting position | Segment ending position |
|---|---|---|
| Z28497_PEA_1_T22 (SEQ ID NO: 4281) | 1 | 1014 |

The previously-described transcripts for these segment(s) do not code for protein.

Segment cluster Z28497_PEA_1_node_30 (SEQ ID NO:6099) according to the present invention is supported by 252 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5700 below describes the starting and ending position of this segment on each transcript.

TABLE 5700

Segment location on transcripts

| Transcript name | Segment starting position | Segment ending position |
|---|---|---|
| Z28497_PEA_1_T16 (SEQ ID NO: 4279) | 2426 | 2829 |
| Z28497_PEA_1_T19 (SEQ ID NO: 4280) | 2693 | 3096 |
| Z28497_PEA_1_T22 (SEQ ID NO: 4281) | 1404 | 1807 |

This segment can be found in a non-coding region of transcript(s) that are related to the following protein(s): Z28497_PEA_1_P6.

Segment cluster Z28497_PEA_1_node_31 (SEQ ID NO:6100) according to the present invention is supported by 281 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5701 below describes the starting and ending position of this segment on each transcript.

TABLE 5701

Segment location on transcripts

| Transcript name | Segment starting position | Segment ending position |
|---|---|---|
| Z28497_PEA_1_T16 (SEQ ID NO: 4279) | 2830 | 3243 |
| Z28497_PEA_1_T19 (SEQ ID NO: 4280) | 3097 | 3510 |
| Z28497_PEA_1_T22 (SEQ ID NO: 4281) | 1808 | 2221 |

This segment can be found in a non-coding region of transcript(s) that are related to the following protein(s): Z28497_PEA_1_P6.

Segment cluster Z28497_PEA_1_node_34 (SEQ ID NO:6101) according to the present invention is supported by 307 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5702 below describes the starting and ending position of this segment on each transcript.

TABLE 5702

Segment location on transcripts

| Transcript name | Segment starting position | Segment ending position |
|---|---|---|
| Z28497_PEA_1_T16 (SEQ ID NO: 4279) | 3278 | 3679 |
| Z28497_PEA_1_T19 (SEQ ID NO: 4280) | 3545 | 3946 |
| Z28497_PEA_1_T22 (SEQ ID NO: 4281) | 2256 | 2657 |

This segment can be found in a non-coding region of transcript(s) that are related to the following protein(s): Z28497_PEA_1_P6.

Segment cluster Z28497_PEA_1_node_35 (SEQ ID NO:6102) according to the present invention is supported by 415 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5703 below describes the starting and ending position of this segment on each transcript.

TABLE 5703

Segment location on transcripts

| Transcript name | Segment starting position | Segment ending position |
|---|---|---|
| Z28497_PEA_1_T16 (SEQ ID NO: 4279) | 3680 | 4649 |
| Z28497_PEA_1_T19 (SEQ ID NO: 4280) | 3947 | 4916 |
| Z28497_PEA_1_T22 (SEQ ID NO: 4281) | 2658 | 3627 |

This segment can be found in a non-coding region of transcript(s) that are related to the following protein(s): Z28497_PEA_1_P6.

According to an optional embodiment of the present invention, short segments related to the above cluster are also provided. These segments are up to about 120 bp in length, and so are included in a separate description.

Segment cluster Z28497_PEA_1_node_10 (SEQ ID NO:6103) according to the present invention is supported by 6 libraries. The number of libraries was determined as previously described. This segment can be found in the following transcript(s): Z28497_PEA_1_T19 (SEQ ID NO:4280). Table 5704 below describes the starting and ending position of this segment on each transcript.

TABLE 5704

Segment location on transcripts

| Transcript name | Segment starting position | Segment ending position |
|---|---|---|
| Z28497_PEA_1_T19 (SEQ ID NO: 4280) | 1809 | 1881 |

This segment can be found in the following protein(s): Z28497_PEA_1_P6.

Segment cluster Z28497_PEA_1_node_14 (SEQ ID NO:6104) according to the present invention is supported by 172 libraries. The number of libraries was determined as previously described. This segment can be found in the following transcript(s): Z28497_PEA_1_T16 (SEQ ID NO:4279) and Z28497_PEA_1_T19 (SEQ ID NO:4280).

Table 5705 below describes the starting and ending position of this segment on each transcript.

TABLE 5705

| | Segment location on transcripts | |
|---|---|---|
| Transcript name | Segment starting position | Segment ending position |
| Z28497_PEA_1_T16 (SEQ ID NO: 4279) | 1809 | 1871 |
| Z28497_PEA_1_T19 (SEQ ID NO: 4280) | 2076 | 2138 |

This segment can be found in the following protein(s): Z28497_PEA_1_P6.

Segment cluster Z28497_PEA_1_node_15 (SEQ ID NO:6105) according to the present invention is supported by 162 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5706 below describes the starting and ending position of this segment on each transcript.

TABLE 5706

| | Segment location on transcripts | |
|---|---|---|
| Transcript name | Segment starting position | Segment ending position |
| Z28497_PEA_1_T16 (SEQ ID NO: 4279) | 1872 | 1925 |
| Z28497_PEA_1_T19 (SEQ ID NO: 4280) | 2139 | 2192 |

This segment can be found in the following protein(s): Z28497_PEA_1_P6.

Segment cluster Z28497_PEA_1_node_16 (SEQ ID NO:6106) according to the present invention is supported by 143 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5707 below describes the starting and ending position of this segment on each transcript.

TABLE 5707

| | Segment location on transcripts | |
|---|---|---|
| Transcript name | Segment starting position | Segment ending position |
| Z28497_PEA_1_T16 (SEQ ID NO: 4279) | 1926 | 1975 |
| Z28497_PEA_1_T19 (SEQ ID NO: 4280) | 2193 | 2242 |

This segment can be found in the following protein(s): Z28497_PEA_1_P6.

Segment cluster Z28497_PEA_1_node_18 (SEQ ID NO:6107) according to the present invention is supported by 123 libraries. The number of libraries was determined as previously described. This segment can be found in the following transcript(s): Z28497_PEA_1_T16 (SEQ ID NO:4279) and Z28497_PEA_1_T19 (SEQ ID NO:4280). Table 5708 below describes the starting and ending position of this segment on each transcript.

TABLE 5708

| | Segment location on transcripts | |
|---|---|---|
| Transcript name | Segment starting position | Segment ending position |
| Z28497_PEA_1_T16 (SEQ ID NO: 4279) | 1976 | 2036 |
| Z28497_PEA_1_T19 (SEQ ID NO: 4280) | 2243 | 2303 |

This segment can be found in the following protein(s): Z28497_PEA_1_P6.

Segment cluster Z28497_PEA_1_node_22 (SEQ ID NO:6108) according to the present invention is supported by 142 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5709 below describes the starting and ending position of this segment on each transcript.

TABLE 5709

| | Segment location on transcripts | |
|---|---|---|
| Transcript name | Segment starting position | Segment ending position |
| Z28497_PEA_1_T16 (SEQ ID NO: 4279) | 2037 | 2154 |
| Z28497_PEA_1_T19 (SEQ ID NO: 4280) | 2304 | 2421 |
| Z28497_PEA_1_T22 (SEQ ID NO: 4281) | 1015 | 1132 |

This segment can be found in the following protein(s): Z28497_PEA_1_P6.

Segment cluster Z28497_PEA_1_node_23 (SEQ ID NO:6109) according to the present invention is supported by 119 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5710 below describes the starting and ending position of this segment on each transcript.

TABLE 5710

| | Segment location on transcripts | |
|---|---|---|
| Transcript name | Segment starting position | Segment ending position |
| Z28497_PEA_1_T16 (SEQ ID NO: 4279) | 2155 | 2236 |
| Z28497_PEA_1_T19 (SEQ ID NO: 4280) | 2422 | 2503 |
| Z28497_PEA_1_T22 (SEQ ID NO: 4281) | 1133 | 1214 |

This segment can be found in the following protein(s): Z28497_PEA_1_P6.

Segment cluster Z28497_PEA_1_node_26 (SEQ ID NO:6110) according to the present invention is supported by 127 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5711 below describes the starting and ending position of this segment on each transcript.

TABLE 5711

Segment location on transcripts

| Transcript name | Segment starting position | Segment ending position |
|---|---|---|
| Z28497_PEA_1_T16 (SEQ ID NO: 4279) | 2237 | 2291 |
| Z28497_PEA_1_T19 (SEQ ID NO: 4280) | 2504 | 2558 |
| Z28497_PEA_1_T22 (SEQ ID NO: 4281) | 1215 | 1269 |

This segment can be found in the following protein(s): Z28497_PEA_1_P6.

Segment cluster Z28497_PEA_1_node_27 (SEQ ID NO:6111) according to the present invention can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5712 below describes the starting and ending position of this segment on each transcript.

TABLE 5712

Segment location on transcripts

| Transcript name | Segment starting position | Segment ending position |
|---|---|---|
| Z28497_PEA_1_T16 (SEQ ID NO: 4279) | 2292 | 2314 |
| Z28497_PEA_1_T19 (SEQ ID NO: 4280) | 2559 | 2581 |
| Z28497_PEA_1_T22 (SEQ ID NO: 4281) | 1270 | 1292 |

This segment can be found in the following protein(s): Z28497_PEA_1_P6.

Segment cluster Z28497_PEA_1_node_28 (SEQ ID NO:6112) according to the present invention is supported by 129 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5713 below describes the starting and ending position of this segment on each transcript.

TABLE 5713

Segment location on transcripts

| Transcript name | Segment starting position | Segment ending position |
|---|---|---|
| Z28497_PEA_1_T16 (SEQ ID NO: 4279) | 2315 | 2370 |
| Z28497_PEA_1_T19 (SEQ ID NO: 4280) | 2582 | 2637 |
| Z28497_PEA_1_T22 (SEQ ID NO: 4281) | 1293 | 1348 |

This segment can be found in the following protein(s): Z28497_PEA_1_P6.

Segment cluster Z28497_PEA_1_node_29 (SEQ ID NO:6113) according to the present invention is supported by 134 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5714 below describes the starting and ending position of this segment on each transcript.

TABLE 5714

Segment location on transcripts

| Transcript name | Segment starting position | Segment ending position |
|---|---|---|
| Z28497_PEA_1_T16 (SEQ ID NO: 4279) | 2371 | 2425 |
| Z28497_PEA_1_T19 (SEQ ID NO: 4280) | 2638 | 2692 |
| Z28497_PEA_1_T22 (SEQ ID NO: 4281) | 1349 | 1403 |

This segment can be found in a non-coding region of transcript(s) that are related to the following protein(s): Z28497_PEA_1_P6.

Segment cluster Z28497_PEA_1_node_32 (SEQ ID NO:6114) according to the present invention is supported by 187 libraries. The number of libraries was determined as previously described. This segment can be found in the following transcript(s): Z28497_PEA_1_T16 (SEQ ID NO:4279), Z28497_PEA_1_T19 (SEQ ID NO:4280) and Z28497_PEA_1_T22 (SEQ ID NO:4281). Table 5715 below describes the starting and ending position of this segment on each transcript.

TABLE 5715

Segment location on transcripts

| Transcript name | Segment starting position | Segment ending position |
|---|---|---|
| Z28497_PEA_1_T16 (SEQ ID NO: 4279) | 3244 | 3277 |
| Z28497_PEA_1_T19 (SEQ ID NO: 4280) | 3511 | 3544 |
| Z28497_PEA_1_T22 (SEQ ID NO: 4281) | 2222 | 2255 |

This segment can be found in a non-coding region of transcript(s) that are related to the following protein(s): Z28497_PEA_1_P6.

Description for Cluster Z38148

Cluster Z38148 features 17 transcript(s) and 29 segment(s) of interest, the names for which are given in Tables 5716 and 5717, respectively, the sequences themselves are given at the end of the application. The selected protein variants are given in Table 5718.

TABLE 5716

Transcripts of interest
Transcript Name

Z38148_PEA_1_T1 (SEQ ID NO: 4282)
Z38148_PEA_1_T2 (SEQ ID NO: 4283)
Z38148_PEA_1_T3 (SEQ ID NO: 4284)
Z38148_PEA_1_T4 (SEQ ID NO: 4285)
Z38148_PEA_1_T5 (SEQ ID NO: 4286)
Z38148_PEA_1_T8 (SEQ ID NO: 4287)

TABLE 5716-continued

Transcripts of interest
Transcript Name

Z38148_PEA_1_T9 (SEQ ID NO: 4288)
Z38148_PEA_1_T10 (SEQ ID NO: 4289)
Z38148_PEA_1_T11 (SEQ ID NO: 4290)
Z38148_PEA_1_T12 (SEQ ID NO: 4291)
Z38148_PEA_1_T13 (SEQ ID NO: 4292)
Z38148_PEA_1_T17 (SEQ ID NO: 4293)
Z38148_PEA_1_T18 (SEQ ID NO: 4294)
Z38148_PEA_1_T20 (SEQ ID NO: 4295)
Z38148_PEA_1_T21 (SEQ ID NO: 4296)
Z38148_PEA_1_T31 (SEQ ID NO: 4297)
Z38148_PEA_1_T34 (SEQ ID NO: 4298)

TABLE 5717

Segments of interest
Segment Name

Z38148_PEA_1_node_1 (SEQ ID NO: 6115)
Z38148_PEA_1_node_2 (SEQ ID NO: 6116)
Z38148_PEA_1_node_3 (SEQ ID NO: 6117)
Z38148_PEA_1_node_4 (SEQ ID NO: 6118)
Z38148_PEA_1_node_9 (SEQ ID NO: 6119)
Z38148_PEA_1_node_10 (SEQ ID NO: 6120)
Z38148_PEA_1_node_13 (SEQ ID NO: 6121)
Z38148_PEA_1_node_14 (SEQ ID NO: 6122)
Z38148_PEA_1_node_16 (SEQ ID NO: 6123)
Z38148_PEA_1_node_20 (SEQ ID NO: 6124)
Z38148_PEA_1_node_22 (SEQ ID NO: 6125)
Z38148_PEA_1_node_26 (SEQ ID NO: 6126)
Z38148_PEA_1_node_29 (SEQ ID NO: 6127)
Z38148_PEA_1_node_30 (SEQ ID NO: 6128)
Z38148_PEA_1_node_31 (SEQ ID NO: 6129)
Z38148_PEA_1_node_34 (SEQ ID NO: 6130)
Z38148_PEA_1_node_38 (SEQ ID NO: 6131)
Z38148_PEA_1_node_40 (SEQ ID NO: 6132)
Z38148_PEA_1_node_41 (SEQ ID NO: 6133)
Z38148_PEA_1_node_43 (SEQ ID NO: 6134)
Z38148_PEA_1_node_46 (SEQ ID NO: 6135)
Z38148_PEA_1_node_0 (SEQ ID NO: 6136)
Z38148_PEA_1_node_5 (SEQ ID NO: 6137)
Z38148_PEA_1_node_6 (SEQ ID NO: 6138)
Z38148_PEA_1_node_12 (SEQ ID NO: 6139)
Z38148_PEA_1_node_15 (SEQ ID NO: 6140)
Z38148_PEA_1_node_21 (SEQ ID NO: 6141)
Z38148_PEA_1_node_37 (SEQ ID NO: 6142)
Z38148_PEA_1_node_39 (SEQ ID NO: 6143)

TABLE 5718

Proteins of interest

| Protein Name | Corresponding Transcript(s) |
| --- | --- |
| Z38148_PEA_1_P2 | Z38148_PEA_1_T1 (SEQ ID NO: 4282); Z38148_PEA_1_T17 (SEQ ID NO: 4293); Z38148_PEA_1_T18 (SEQ ID NO: 4294) |
| Z38148_PEA_1_P3 | Z38148_PEA_1_T2 (SEQ ID NO: 4283); Z38148_PEA_1_T8 (SEQ ID NO: 4287); Z38148_PEA_1_T21 (SEQ ID NO: 4296); Z38148_PEA_1_T31 (SEQ ID NO: 4297) |
| Z38148_PEA_1_P4 | Z38148_PEA_1_T3 (SEQ ID NO: 4284) |
| Z38148_PEA_1_P5 | Z38148_PEA_1_T4 (SEQ ID NO: 4285); Z38148_PEA_1_T5 (SEQ ID NO: 4286); Z38148_PEA_1_T9 (SEQ ID NO: 4288); Z38148_PEA_1_T10 (SEQ ID NO: 4289); Z38148_PEA_1_T11 (SEQ ID NO: 4290); Z38148_PEA_1_T12 (SEQ ID NO: 4291); Z38148_PEA_1_T13 (SEQ ID NO: 4292) |
| Z38148_PEA_1_P8 | Z38148_PEA_1_T20 (SEQ ID NO: 4295) |

As noted above, cluster Z38148 features 29 segment(s), which were listed in Table 5717 above and for which the sequence(s) are given at the end of the application. These segment(s) are portions of nucleic acid sequence(s) which are described herein separately because they are of particular interest. A description of each segment according to the present invention is now provided.

Segment cluster Z38148_PEA_1_node_1 (SEQ ID NO:6115) according to the present invention is supported by 2 libraries. The number of libraries was determined as previously described. This segment can be found in the following transcript(s): Z38148_PEA_1_T2 (SEQ ID NO:4283), Z38148_PEA_1_T4 (SEQ ID NO:4285), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5719 below describes the starting and ending position of this segment on each transcript.

TABLE 5719

Segment location on transcripts

| Transcript name | Segment starting position | Segment ending position |
| --- | --- | --- |
| Z38148_PEA_1_T2 (SEQ ID NO: 4283) | 57 | 326 |
| Z38148_PEA_1_T4 (SEQ ID NO: 4285) | 57 | 326 |
| Z38148_PEA_1_T5 (SEQ ID NO: 4286) | 57 | 326 |
| Z38148_PEA_1_T8 (SEQ ID NO: 4287) | 57 | 326 |
| Z38148_PEA_1_T9 (SEQ ID NO: 4288) | 57 | 326 |
| Z38148_PEA_1_T10 (SEQ ID NO: 4289) | 57 | 326 |
| Z38148_PEA_1_T11 (SEQ ID NO: 4290) | 57 | 326 |
| Z38148_PEA_1_T12 (SEQ ID NO: 4291) | 57 | 326 |
| Z38148_PEA_1_T13 (SEQ ID NO: 4292) | 57 | 326 |
| Z38148_PEA_1_T20 (SEQ ID NO: 4295) | 57 | 326 |
| Z38148_PEA_1_T21 (SEQ ID NO: 4296) | 57 | 326 |
| Z38148_PEA_1_T31 (SEQ ID NO: 4297) | 57 | 326 |

This segment can be found in both coding and non-coding regions of transcript(s) as follows. The segment can be found in a non-coding region of transcript(s) that are related to the following protein(s): Z38148_PEA_1_P5 and Z38148_PEA_1_P8. This segment can also be found in the following protein(s): Z38148_PEA_1_P3, since it is in the coding region for the corresponding transcript.

Segment cluster Z38148_PEA_1_node_2 (SEQ ID NO:6116) according to the present invention is supported by 7 libraries. The number of libraries was determined as previously described. This segment can be found in the following transcript(s): Z38148_PEA_1_T2 (SEQ ID NO:4283), Z38148_PEA_1_T3 (SEQ ID NO:4284), Z38148_PEA_1_T4 (SEQ ID NO:4285), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5720 below describes the starting and ending position of this segment on each transcript.

TABLE 5720

| Segment location on transcripts | | |
|---|---|---|
| Transcript name | Segment starting position | Segment ending position |
| Z38148_PEA_1_T2 (SEQ ID NO: 4283) | 327 | 561 |
| Z38148_PEA_1_T3 (SEQ ID NO: 4284) | 57 | 291 |
| Z38148_PEA_1_T4 (SEQ ID NO: 4285) | 327 | 561 |
| Z38148_PEA_1_T5 (SEQ ID NO: 4286) | 327 | 561 |
| Z38148_PEA_1_T8 (SEQ ID NO: 4287) | 327 | 561 |
| Z38148_PEA_1_T9 (SEQ ID NO: 4288) | 327 | 561 |
| Z38148_PEA_1_T10 (SEQ ID NO: 4289) | 327 | 561 |
| Z38148_PEA_1_T11 (SEQ ID NO: 4290) | 327 | 561 |
| Z38148_PEA_1_T12 (SEQ ID NO: 4291) | 327 | 561 |
| Z38148_PEA_1_T13 (SEQ ID NO: 4292) | 327 | 561 |
| Z38148_PEA_1_T20 (SEQ ID NO: 4295) | 327 | 561 |
| Z38148_PEA_1_T21 (SEQ ID NO: 4296) | 327 | 561 |
| Z38148_PEA_1_T31 (SEQ ID NO: 4297) | 327 | 561 |

This segment can be found in both coding and non-coding regions of transcript(s) as follows. The segment can be found in a non-coding region of transcript(s) that are related to the following protein(s): Z38148_PEA_1_P4, Z38148_PEA_1_P5 and Z38148_PEA_1_P8. This segment can also be found in the following protein(s): Z38148_PEA_1_P3, since it is in the coding region for the corresponding transcript.

Segment cluster Z38148_PEA_1_node_3 (SEQ ID NO:6117) according to the present invention is supported by 3 libraries. The number of libraries was determined as previously described. This segment can be found in the following transcript(s): Z38148_PEA_1_T3 (SEQ ID NO:4284), Z38148_PEA_1_T4 (SEQ ID NO:4285) and Z38148_PEA_1_T5 (SEQ ID NO:4286). Table 5721 below describes the starting and ending position of this segment on each transcript.

TABLE 5721

| Segment location on transcripts | | |
|---|---|---|
| Transcript name | Segment starting position | Segment ending position |
| Z38148_PEA_1_T3 (SEQ ID NO: 4284) | 292 | 513 |
| Z38148_PEA_1_T4 (SEQ ID NO: 4285) | 562 | 783 |
| Z38148_PEA_1_T5 (SEQ ID NO: 4286) | 562 | 783 |

This segment can be found in a non-coding region of transcript(s) that are related to the following protein(s): Z38148_PEA_1_P4 and Z38148_PEA_1_P5.

Segment cluster Z38148_PEA_1_node_4 (SEQ ID NO:6118) according to the present invention is supported by 7 libraries. The number of libraries was determined as previously described. This segment can be found in the following transcript(s): Z38148_PEA_1_T2 (SEQ ID NO:4283), Z38148_PEA_1_T3 (SEQ ID NO:4284), Z38148_PEA_1_T4 (SEQ ID NO:4285), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5722 below describes the starting and ending position of this segment on each transcript.

TABLE 5722

| Segment location on transcripts | | |
|---|---|---|
| Transcript name | Segment starting position | Segment ending position |
| Z38148_PEA_1_T2 (SEQ ID NO: 4283) | 562 | 776 |
| Z38148_PEA_1_T3 (SEQ ID NO: 4284) | 514 | 728 |
| Z38148_PEA_1_T4 (SEQ ID NO: 4285) | 784 | 998 |
| Z38148_PEA_1_T5 (SEQ ID NO: 4286) | 784 | 998 |
| Z38148_PEA_1_T8 (SEQ ID NO: 4287) | 562 | 776 |
| Z38148_PEA_1_T9 (SEQ ID NO: 4288) | 562 | 776 |
| Z38148_PEA_1_T10 (SEQ ID NO: 4289) | 562 | 776 |
| Z38148_PEA_1_T11 (SEQ ID NO: 4290) | 562 | 776 |
| Z38148_PEA_1_T12 (SEQ ID NO: 4291) | 562 | 776 |
| Z38148_PEA_1_T13 (SEQ ID NO: 4292) | 562 | 776 |
| Z38148_PEA_1_T20 (SEQ ID NO: 4295) | 562 | 776 |
| Z38148_PEA_1_T21 (SEQ ID NO: 4296) | 562 | 776 |
| Z38148_PEA_1_T31 (SEQ ID NO: 4297) | 562 | 776 |

This segment can be found in a non-coding region of transcript(s) that are related to the following protein(s): Z38148_PEA_1_P3, Z38148_PEA_1_P4, Z38148_PEA_1_P5 and Z38148_PEA_1_P8.

Segment cluster Z38148_PEA_1_node_9 (SEQ ID NO:6119) according to the present invention is supported by 19 libraries. The number of libraries was determined as previously described. This segment can be found in the following transcript(s): Z38148_PEA_1_T2 (SEQ ID NO:4283), Z38148_PEA_1_T3 (SEQ ID NO:4284), Z38148_PEA_1_T8 (SEQ ID NO:4287), Z38148_PEA_1_T11 (SEQ ID NO:4290), Z38148_PEA_1_T13 (SEQ ID NO:4292), Z38148_PEA_1_T21 (SEQ ID NO:4296) and Z38148_PEA_1_T31 (SEQ ID NO:4297). Table 5723 below describes the starting and ending position of this segment on each transcript.

TABLE 5723

Segment location on transcripts

| Transcript name | Segment starting position | Segment ending position |
|---|---|---|
| Z38148_PEA_1_T2 (SEQ ID NO: 4283) | 887 | 1009 |
| Z38148_PEA_1_T3 (SEQ ID NO: 4284) | 839 | 961 |
| Z38148_PEA_1_T8 (SEQ ID NO: 4287) | 887 | 1009 |
| Z38148_PEA_1_T11 (SEQ ID NO: 4290) | 887 | 1009 |
| Z38148_PEA_1_T13 (SEQ ID NO: 4292) | 887 | 1009 |
| Z38148_PEA_1_T21 (SEQ ID NO: 4296) | 887 | 1009 |
| Z38148_PEA_1_T31 (SEQ ID NO: 4297) | 887 | 1009 |

This segment can be found in a non-coding region of transcript(s) that are related to the following protein(s): Z38148_PEA_1_P3, Z38148_PEA_1_P4 and Z38148_PEA_1_P5.

Segment cluster Z38148_PEA_1_node_10 (SEQ ID NO:6120) according to the present invention is supported by 11 libraries. The number of libraries was determined as previously described. This segment can be found in the following transcript(s): Z38148_PEA_1_T31 (SEQ ID NO:4297). Table 5724 below describes the starting and ending position of this segment on each transcript.

TABLE 5724

Segment location on transcripts

| Transcript name | Segment starting position | Segment ending position |
|---|---|---|
| Z38148_PEA_1_T31 (SEQ ID NO: 4297) | 1010 | 1739 |

This segment can be found in a non-coding region of transcript(s) that are related to the following protein(s): Z38148_PEA_1_P3.

Segment cluster Z38148_PEA_1_node_13 (SEQ ID NO:6121) according to the present invention is supported by 19 libraries. The number of libraries was determined as previously described. This segment can be found in the following transcript(s): Z38148_PEA_1_T2 (SEQ ID NO:4283) and Z38148_PEA_1_T3 (SEQ ID NO:4284). Table 5725 below describes the starting and ending position of this segment on each transcript.

TABLE 5725

Segment location on transcripts

| Transcript name | Segment starting position | Segment ending position |
|---|---|---|
| Z38148_PEA_1_T2 (SEQ ID NO: 4283) | 1084 | 1663 |
| Z38148_PEA_1_T3 (SEQ ID NO: 4284) | 1036 | 1615 |

This segment can be found in both coding and non-coding regions of transcript(s) as follows. The segment can be found in a non-coding region of transcript(s) that are related to the following protein(s): Z38148_PEA_1_P3. This segment can also be found in the following protein(s): Z38148_PEA_1_P4, since it is in the coding region for the corresponding transcript.

Segment cluster Z38148_PEA_1_node_14 (SEQ ID NO:6122) according to the present invention is supported by 40 libraries. The number of libraries was determined as previously described. This segment can be found in the following transcript(s): Z38148_PEA_1_T2 (SEQ ID NO:4283), Z38148_PEA_1_T3 (SEQ ID NO:4284) and Z38148_PEA_1_T8 (SEQ ID NO:4287). Table 5726 below describes the starting and ending position of this segment on each transcript.

TABLE 5726

Segment location on transcripts

| Transcript name | Segment starting position | Segment ending position |
|---|---|---|
| Z38148_PEA_1_T2 (SEQ ID NO: 4283) | 1664 | 2223 |
| Z38148_PEA_1_T3 (SEQ ID NO: 4284) | 1616 | 2175 |
| Z38148_PEA_1_T8 (SEQ ID NO: 4287) | 1010 | 1569 |

This segment can be found in a non-coding region of transcript(s) that are related to the following protein(s): Z38148_PEA_1_P3 and Z38148_PEA_1_P4.

Segment cluster Z38148_PEA_1_node_16 (SEQ ID NO:6123) according to the present invention is supported by 50 libraries. The number of libraries was determined as previously described. This segment can be found in the following transcript(s): Z38148_PEA_1_T2 (SEQ ID NO:4283), Z38148_PEA_1_T3 (SEQ ID NO:4284) and Z38148_PEA_1_T8 (SEQ ID NO:4287). Table 5727 below describes the starting and ending position of this segment on each transcript.

TABLE 5727

Segment location on transcripts

| Transcript name | Segment starting position | Segment ending position |
|---|---|---|
| Z38148_PEA_1_T2 (SEQ ID NO: 4283) | 2300 | 2764 |
| Z38148_PEA_1_T3 (SEQ ID NO: 4284) | 2252 | 2716 |
| Z38148_PEA_1_T8 (SEQ ID NO: 4287) | 1646 | 2110 |

This segment can be found in a non-coding region of transcript(s) that are related to the following protein(s): Z38148_PEA_1_P3 and Z38148_PEA_1_P4.

Segment cluster Z38148_PEA_1_node_20 (SEQ ID NO:6124) according to the present invention is supported by 5 libraries. The number of libraries was determined as previously described. This segment can be found in the following transcript(s): Z38148_PEA_1_T5 (SEQ ID NO:4286), Z38148_PEA_1_T9 (SEQ ID NO:4288), Z38148_PEA_1_T10 (SEQ ID NO:4289) and Z38148_PEA_1_T20 (SEQ ID NO:4295). Table 5728 below describes the starting and ending position of this segment on each transcript.

TABLE 5728

Segment location on transcripts

| Transcript name | Segment starting position | Segment ending position |
|---|---|---|
| Z38148_PEA_1_T5 (SEQ ID NO: 4286) | 1109 | 1248 |
| Z38148_PEA_1_T9 (SEQ ID NO: 4288) | 887 | 1026 |
| Z38148_PEA_1_T10 (SEQ ID NO: 4289) | 887 | 1026 |
| Z38148_PEA_1_T20 (SEQ ID NO: 4295) | 887 | 1026 |

This segment can be found in a non-coding region of transcript(s) that are related to the following protein(s): Z38148_PEA_1_P5 and Z38148_PEA_1_P8.

Segment cluster Z38148_PEA_1_node_22 (SEQ ID NO:6125) according to the present invention is supported by 3 libraries. The number of libraries was determined as previously described. This segment can be found in the following transcript(s): Z38148_PEA_1_T10 (SEQ ID NO:4289) and Z38148_PEA_1_T20 (SEQ ID NO:4295). Table 5729 below describes the starting and ending position of this segment on each transcript.

TABLE 5729

Segment location on transcripts

| Transcript name | Segment starting position | Segment ending position |
|---|---|---|
| Z38148_PEA_1_T10 (SEQ ID NO: 4289) | 1043 | 1347 |
| Z38148_PEA_1_T20 (SEQ ID NO: 4295) | 1043 | 1347 |

This segment can be found in both coding and non-coding regions of transcript(s) as follows. The segment can be found in a non-coding region of transcript(s) that are related to the following protein(s): Z38148_PEA_1_P5. This segment can also be found in the following protein(s): Z38148_PEA_1_P8, since it is in the coding region for the corresponding transcript.

Segment cluster Z38148_PEA_1_node_26 (SEQ ID NO:6126) according to the present invention is supported by 20 libraries. The number of libraries was determined as previously described. This segment can be found in the following transcript(s): Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291) and Z38148_PEA_1_T20 (SEQ ID NO:4295). Table 5730 below describes the starting and ending position of this segment on each transcript.

TABLE 5730

Segment location on transcripts

| Transcript name | Segment starting position | Segment ending position |
|---|---|---|
| Z38148_PEA_1_T4 (SEQ ID NO: 4285) | 1100 | 1259 |
| Z38148_PEA_1_T5 (SEQ ID NO: 4286) | 1249 | 1408 |
| Z38148_PEA_1_T9 (SEQ ID NO: 4288) | 1043 | 1202 |
| Z38148_PEA_1_T10 (SEQ ID NO: 4289) | 1348 | 1507 |
| Z38148_PEA_1_T11 (SEQ ID NO: 4290) | 1010 | 1169 |
| Z38148_PEA_1_T12 (SEQ ID NO: 4291) | 887 | 1046 |
| Z38148_PEA_1_T20 (SEQ ID NO: 4295) | 1348 | 1507 |

This segment can be found in both coding and non-coding regions of transcript(s) as follows. The segment can be found in a non-coding region of transcript(s) that are related to the following protein(s): Z38148_PEA_1_P5. This segment can also be found in the following protein(s): Z38148_PEA_1_P8, since it is in the coding region for the corresponding transcript.

Segment cluster Z38148_PEA_1_node_29 (SEQ ID NO:6127) according to the present invention is supported by 9 libraries. The number of libraries was determined as previously described. This segment can be found in the following transcript(s): Z38148_PEA_1_T1 (SEQ ID NO:4282), Z38148_PEA_1_T17 (SEQ ID NO:4293) and Z38148_PEA_1_T18 (SEQ ID NO:4294). Table 5731 below describes the starting and ending position of this segment on each transcript.

TABLE 5731

Segment location on transcripts

| Transcript name | Segment starting position | Segment ending position |
|---|---|---|
| Z38148_PEA_1_T1 (SEQ ID NO: 4282) | 1 | 2096 |
| Z38148_PEA_1_T17 (SEQ ID NO: 4293) | 1 | 2096 |
| Z38148_PEA_1_T18 (SEQ ID NO: 4294) | 1 | 2096 |

This segment can be found in the following protein(s): Z38148_PEA_1_P2.

Segment cluster Z38148_PEA_1_node_30 (SEQ ID NO:6128) according to the present invention is supported by 3 libraries. The number of libraries was determined 4 as previously described. This segment can be found in the following transcript(s): Z38148_PEA_1_T1 (SEQ ID NO:4282), Z38148_PEA_1_T17 (SEQ ID NO:4293) and Z38148_PEA_1_T18 (SEQ ID NO:4294). Table 5732 below describes the starting and ending position of this segment on each transcript.

TABLE 5732

| Segment location on transcripts | | |
|---|---|---|
| Transcript name | Segment starting position | Segment ending position |
| Z38148_PEA_1_T1 (SEQ ID NO: 4282) | 2097 | 2343 |
| Z38148_PEA_1_T17 (SEQ ID NO: 4293) | 2097 | 2343 |
| Z38148_PEA_1_T18 (SEQ ID NO: 4294) | 2097 | 2343 |

This segment can be found in a non-coding region of transcript(s) that are related to the following protein(s): Z38148_PEA_1_P2.

Segment cluster Z38148_PEA_1_node_31 (SEQ ID NO:6129) according to the present invention is supported by 24 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293) and Z38148_PEA_1_T18 (SEQ ID NO:4294). Table 5733 below describes the starting and ending position of this segment on each transcript.

TABLE 5733

| Segment location on transcripts | | |
|---|---|---|
| Transcript name | Segment starting position | Segment ending position |
| Z38148_PEA_1_T1 (SEQ ID NO: 4282) | 2344 | 2664 |
| Z38148_PEA_1_T4 (SEQ ID NO: 4285) | 1260 | 1580 |
| Z38148_PEA_1_T5 (SEQ ID NO: 4286) | 1409 | 1729 |
| Z38148_PEA_1_T9 (SEQ ID NO: 4288) | 1203 | 1523 |
| Z38148_PEA_1_T10 (SEQ ID NO: 4289) | 1508 | 1828 |
| Z38148_PEA_1_T11 (SEQ ID NO: 4290) | 1170 | 1490 |
| Z38148_PEA_1_T12 (SEQ ID NO: 4291) | 1047 | 1367 |
| Z38148_PEA_1_T13 (SEQ ID NO: 4292) | 1010 | 1330 |
| Z38148_PEA_1_T17 (SEQ ID NO: 4293) | 2344 | 2664 |
| Z38148_PEA_1_T18 (SEQ ID NO: 4294) | 2344 | 2664 |

This segment can be found in both coding and non-coding regions of transcript(s) as follows. The segment can be found in a non-coding region of transcript(s) that are related to the following protein(s): Z38148_PEA_1_P2. This segment can also be found in the following protein(s): Z38148_PEA_1_P5, since it is in the coding region for the corresponding transcript.

Segment cluster Z38148_PEA_1_node_34 (SEQ ID NO:6130) according to the present invention is supported by 28 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T18 (SEQ ID NO:4294), Z38148_PEA_1_T20 (SEQ ID NO:4295) and Z38148_PEA_1_T21 (SEQ ID NO:4296). Table 5734 below describes the starting and ending position of this segment on each transcript.

TABLE 5734

| Segment location on transcripts | | |
|---|---|---|
| Transcript name | Segment starting position | Segment ending position |
| Z38148_PEA_1_T1 (SEQ ID NO: 4282) | 2665 | 2841 |
| Z38148_PEA_1_T4 (SEQ ID NO: 4285) | 1581 | 1757 |
| Z38148_PEA_1_T5 (SEQ ID NO: 4286) | 1730 | 1906 |
| Z38148_PEA_1_T9 (SEQ ID NO: 4288) | 1524 | 1700 |
| Z38148_PEA_1_T10 (SEQ ID NO: 4289) | 1829 | 2005 |
| Z38148_PEA_1_T11 (SEQ ID NO: 4290) | 1491 | 1667 |
| Z38148_PEA_1_T12 (SEQ ID NO: 4291) | 1368 | 1544 |
| Z38148_PEA_1_T13 (SEQ ID NO: 4292) | 1331 | 1507 |
| Z38148_PEA_1_T17 (SEQ ID NO: 4293) | 2665 | 2841 |
| Z38148_PEA_1_T18 (SEQ ID NO: 4294) | 2665 | 2841 |
| Z38148_PEA_1_T20 (SEQ ID NO: 4295) | 1508 | 1684 |
| Z38148_PEA_1_T21 (SEQ ID NO: 4296) | 1010 | 1186 |

This segment can be found in both coding and non-coding regions of transcript(s) as follows. The segment can be found in a non-coding region of transcript(s) that are related to the following protein(s): Z38148_PEA_1_P2 and Z38148_PEA_1_P3. This segment can also be found in the following protein(s): Z38148_PEA_1_P5 and Z38148_PEA_1_P8, since it is in the coding region for the corresponding transcript.

Segment cluster Z38148_PEA_1_node_38 (SEQ ID NO:6131) according to the present invention is supported by 48 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T18 (SEQ ID NO:4294), Z38148_PEA_1_T20 (SEQ ID NO:4295) and Z38148_PEA_1_T21 (SEQ ID NO:4296). Table 5735 below describes the starting and ending position of this segment on each transcript.

TABLE 5735

Segment location on transcripts

| Transcript name | Segment starting position | Segment ending position |
|---|---|---|
| Z38148_PEA_1_T1 (SEQ ID NO: 4282) | 2947 | 3718 |
| Z38148_PEA_1_T4 (SEQ ID NO: 4285) | 1863 | 2634 |
| Z38148_PEA_1_T5 (SEQ ID NO: 4286) | 2012 | 2783 |
| Z38148_PEA_1_T9 (SEQ ID NO: 4288) | 1806 | 2577 |
| Z38148_PEA_1_T10 (SEQ ID NO: 4289) | 2111 | 2882 |
| Z38148_PEA_1_T11 (SEQ ID NO: 4290) | 1773 | 2544 |
| Z38148_PEA_1_T12 (SEQ ID NO: 4291) | 1650 | 2421 |
| Z38148_PEA_1_T13 (SEQ ID NO: 4292) | 1613 | 2384 |
| Z38148_PEA_1_T17 (SEQ ID NO: 4293) | 2947 | 3718 |
| Z38148_PEA_1_T18 (SEQ ID NO: 4294) | 2947 | 3718 |
| Z38148_PEA_1_T20 (SEQ ID NO: 4295) | 1790 | 2561 |
| Z38148_PEA_1_T21 (SEQ ID NO: 4296) | 1292 | 2063 |

This segment can be found in a non-coding region of transcript(s) that are related to the following protein(s): Z38148_PEA_1_P2, Z38148_PEA_1_P5, Z38148_PEA_1_P8 and Z38148_PEA_1_P3.

Segment cluster Z38148_PEA_1_node_40 (SEQ ID NO:6132) according to the present invention is supported by 36 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T18 (SEQ ID NO:4294), Z38148_PEA_1_T20 (SEQ ID NO:4295) and Z38148_PEA_1_T21 (SEQ ID NO:4296). Table 5736 below describes the starting and ending position of this segment on each transcript.

TABLE 5736

Segment location on transcripts

| Transcript name | Segment starting position | Segment ending position |
|---|---|---|
| Z38148_PEA_1_T1 (SEQ ID NO: 4282) | 3771 | 3929 |
| Z38148_PEA_1_T4 (SEQ ID NO: 4285) | 2687 | 2845 |
| Z38148_PEA_1_T5 (SEQ ID NO: 4286) | 2836 | 2994 |
| Z38148_PEA_1_T9 (SEQ ID NO: 4288) | 2630 | 2788 |
| Z38148_PEA_1_T10 (SEQ ID NO: 4289) | 2935 | 3093 |
| Z38148_PEA_1_T11 (SEQ ID NO: 4290) | 2597 | 2755 |
| Z38148_PEA_1_T12 (SEQ ID NO: 4291) | 2474 | 2632 |
| Z38148_PEA_1_T13 (SEQ ID NO: 4292) | 2437 | 2595 |
| Z38148_PEA_1_T17 (SEQ ID NO: 4293) | 3771 | 3929 |
| Z38148_PEA_1_T18 (SEQ ID NO: 4294) | 3719 | 3877 |
| Z38148_PEA_1_T20 (SEQ ID NO: 4295) | 2614 | 2772 |
| Z38148_PEA_1_T21 (SEQ ID NO: 4296) | 2116 | 2274 |

This segment can be found in a non-coding region of transcript(s) that are related to the following protein(s): Z38148_PEA_1_P2, Z38148_PEA_1_P5, Z38148_PEA_1_P8 and Z38148_PEA_1_P3.

Segment cluster Z38148_PEA_1_node_41 (SEQ ID NO:6133) according to the present invention is supported by 47 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T18 (SEQ ID NO:4294), Z38148_PEA_1_T20 (SEQ ID NO:4295) and Z38148_PEA_1_T21 (SEQ ID NO:4296). Table 5737 below describes the starting and ending position of this segment on each transcript.

TABLE 5737

Segment location on transcripts

| Transcript name | Segment starting position | Segment ending position |
|---|---|---|
| Z38148_PEA_1_T1 (SEQ ID NO: 4282) | 3930 | 4389 |
| Z38148_PEA_1_T4 (SEQ ID NO: 4285) | 2846 | 3305 |
| Z38148_PEA_1_T5 (SEQ ID NO: 4286) | 2995 | 3454 |
| Z38148_PEA_1_T9 (SEQ ID NO: 4288) | 2789 | 3248 |
| Z38148_PEA_1_T10 (SEQ ID NO: 4289) | 3094 | 3553 |
| Z38148_PEA_1_T11 (SEQ ID NO: 4290) | 2756 | 3215 |
| Z38148_PEA_1_T12 (SEQ ID NO: 4291) | 2633 | 3092 |
| Z38148_PEA_1_T13 (SEQ ID NO: 4292) | 2596 | 3055 |
| Z38148_PEA_1_T17 (SEQ ID NO: 4293) | 3930 | 4306 |
| Z38148_PEA_1_T18 (SEQ ID NO: 4294) | 3878 | 4337 |
| Z38148_PEA_1_T20 (SEQ ID NO: 4295) | 2773 | 3232 |
| Z38148_PEA_1_T21 (SEQ ID NO: 4296) | 2275 | 2734 |

This segment can be found in a non-coding region of transcript(s) that are related to the following protein(s): Z38148_PEA_1_P2, Z38148_PEA_1_P5, Z38148_PEA_1_P8 and Z38148_PEA_1_P3.

Segment cluster Z38148_PEA_1_node_43 (SEQ ID NO:6134) according to the present invention is supported by 6 libraries. The number of libraries was determined as previously described. This segment can be found in the following transcript(s): Z38148_PEA_1_T34 (SEQ ID NO:4298). Table 5738 below describes the starting and ending position of this segment on each transcript.

TABLE 5738

Segment location on transcripts

| Transcript name | Segment starting position | Segment ending position |
|---|---|---|
| Z38148_PEA_1_T34 (SEQ ID NO: 4298) | 1 | 1579 |

The previously-described transcripts for these segment(s) do not code for protein.

Segment cluster Z38148_PEA_1_node_46 (SEQ ID NO:6135) according to the present invention is supported by 11 libraries. The number of libraries was determined as previously described. This segment can be found in the following transcript(s): Z38148_PEA_1_T34 (SEQ ID NO:4298). Table 5739 below describes the starting and ending position of this segment on each transcript.

TABLE 5739

Segment location on transcripts

| Transcript name | Segment starting position | Segment ending position |
|---|---|---|
| Z38148_PEA_1_T34 (SEQ ID NO: 4298) | 1580 | 2056 |

The previously-described transcripts for these segment(s) do not code for protein.

According to an optional embodiment of the present invention, short segments related to the above cluster are also provided. These segments are up to about 120 bp in length, and so are included in a separate description.

Segment cluster Z38148_PEA_1_node_0 (SEQ ID NO:6136) according to the present invention is supported by 9 libraries. The number of libraries was determined as previously described. This segment can be found in the following transcript(s): Z38148_PEA_1_T2 (SEQ ID NO:4283), Z38148_PEA_1_T3 (SEQ ID NO:4284), Z38148_PEA_1_T4 (SEQ ID NO:4285), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5740 below describes the starting and ending position of this segment on each transcript.

TABLE 5740

Segment location on transcripts

| Transcript name | Segment starting position | Segment ending position |
|---|---|---|
| Z38148_PEA_1_T2 (SEQ ID NO: 4283) | 1 | 56 |
| Z38148_PEA_1_T3 (SEQ ID NO: 4284) | 1 | 56 |

TABLE 5740-continued

Segment location on transcripts

| Transcript name | Segment starting position | Segment ending position |
|---|---|---|
| Z38148_PEA_1_T4 (SEQ ID NO: 4285) | 1 | 56 |
| Z38148_PEA_1_T5 (SEQ ID NO: 4286) | 1 | 56 |
| Z38148_PEA_1_T8 (SEQ ID NO: 4287) | 1 | 56 |
| Z38148_PEA_1_T9 (SEQ ID NO: 4288) | 1 | 56 |
| Z38148_PEA_1_T10 (SEQ ID NO: 4289) | 1 | 56 |
| Z38148_PEA_1_T11 (SEQ ID NO: 4290) | 1 | 56 |
| Z38148_PEA_1_T12 (SEQ ID NO: 4291) | 1 | 56 |
| Z38148_PEA_1_T13 (SEQ ID NO: 4292) | 1 | 56 |
| Z38148_PEA_1_T20 (SEQ ID NO: 4295) | 1 | 56 |
| Z38148_PEA_1_T21 (SEQ ID NO: 4296) | 1 | 56 |
| Z38148_PEA_1_T31 (SEQ ID NO: 4297) | 1 | 56 |

This segment can be found in a non-coding region of transcript(s) that are related to the following protein(s): Z38148_PEA_1_P3, Z38148_PEA_1_P4, Z38148_PEA_1_P5 and Z38148_PEA_1_P8.

Segment cluster Z38148_PEA_1_node_5 (SEQ ID NO:6137) according to the present invention is supported by 12 libraries. The number of libraries was determined as previously described. This segment can be found in the following transcript(s): Z38148_PEA_1_T2 (SEQ ID NO:4283), Z38148_PEA_1_T3 (SEQ ID NO:4284), Z38148_PEA_1_T4 (SEQ ID NO:4285), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5741 below describes the starting and ending position of this segment on each transcript.

TABLE 5741

Segment location on transcripts

| Transcript name | Segment starting position | Segment ending position |
|---|---|---|
| Z38148_PEA_1_T2 (SEQ ID NO: 4283) | 777 | 877 |
| Z38148_PEA_1_T3 (SEQ ID NO: 4284) | 729 | 829 |
| Z38148_PEA_1_T4 (SEQ ID NO: 4285) | 999 | 1099 |
| Z38148_PEA_1_T5 (SEQ ID NO: 4286) | 999 | 1099 |
| Z38148_PEA_1_T8 (SEQ ID NO: 4287) | 777 | 877 |
| Z38148_PEA_1_T9 (SEQ ID NO: 4288) | 777 | 877 |
| Z38148_PEA_1_T10 (SEQ ID NO: 4289) | 777 | 877 |
| Z38148_PEA_1_T11 (SEQ ID NO: 4290) | 777 | 877 |

TABLE 5741-continued

| Transcript name | Segment location on transcripts | |
|---|---|---|
| | Segment starting position | Segment ending position |
| Z38148_PEA_1_T12 (SEQ ID NO: 4291) | 777 | 877 |
| Z38148_PEA_1_T13 (SEQ ID NO: 4292) | 777 | 877 |
| Z38148_PEA_1_T20 (SEQ ID NO: 4295) | 777 | 877 |
| Z38148_PEA_1_T21 (SEQ ID NO: 4296) | 777 | 877 |
| Z38148_PEA_1_T31 (SEQ ID NO: 4297) | 777 | 877 |

This segment can be found in a non-coding region of transcript(s) that are related to the following protein(s): Z38148_PEA_1_P3, Z38148_PEA_1_P4, Z38148_PEA_1_P5 and Z38148_PEA_1_P8.

Segment cluster Z38148_PEA_1_node_6 (SEQ ID NO:6138) according to the present invention can be found in the following transcript(s): Z38148_PEA_1_T2 (SEQ ID NO:4283), Z38148_PEA_1_T3 (SEQ ID NO:4284), Z38148_PEA_1_T5 (SEQ ID NO:4286), Z38148_PEA_1_T8 (SEQ ID NO:4287), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T20 (SEQ ID NO:4295), Z38148_PEA_1_T21 (SEQ ID NO:4296) and Z38148_PEA_1_T31 (SEQ ID NO:4297). Table 5742 below describes the starting and ending position of this segment on each transcript.

TABLE 5742

| Transcript name | Segment location on transcripts | |
|---|---|---|
| | Segment starting position | Segment ending position |
| Z38148_PEA_1_T2 (SEQ ID NO: 4283) | 878 | 886 |
| Z38148_PEA_1_T3 (SEQ ID NO: 4284) | 830 | 838 |
| Z38148_PEA_1_T5 (SEQ ID NO: 4286) | 1100 | 1108 |
| Z38148_PEA_1_T8 (SEQ ID NO: 4287) | 878 | 886 |
| Z38148_PEA_1_T9 (SEQ ID NO: 4288) | 878 | 886 |
| Z38148_PEA_1_T10 (SEQ ID NO: 4289) | 878 | 886 |
| Z38148_PEA_1_T11 (SEQ ID NO: 4290) | 878 | 886 |
| Z38148_PEA_1_T12 (SEQ ID NO: 4291) | 878 | 886 |
| Z38148_PEA_1_T13 (SEQ ID NO: 4292) | 878 | 886 |
| Z38148_PEA_1_T20 (SEQ ID NO: 4295) | 878 | 886 |
| Z38148_PEA_1_T21 (SEQ ID NO: 4296) | 878 | 886 |
| Z38148_PEA_1_T31 (SEQ ID NO: 4297) | 878 | 886 |

This segment can be found in a non-coding region of transcript(s) that are related to the following protein(s): Z38148_PEA_1_P3, Z38148_PEA_1_P4, Z38148_PEA_1_P5 and Z38148_PEA_1_P8.

Segment cluster Z38148_PEA_1_node_12 (SEQ ID NO:6139) according to the present invention is supported by 7 libraries. The number of libraries was determined as previously described. This segment can be found in the following transcript(s): Z38148_PEA_1_T2 (SEQ ID NO:4283) and Z38148_PEA_1_T3 (SEQ ID NO:4284). Table 5743 below describes the starting and ending position of this segment on each transcript.

TABLE 5743

| Transcript name | Segment location on transcripts | |
|---|---|---|
| | Segment starting position | Segment ending position |
| Z38148_PEA_1_T2 (SEQ ID NO: 4283) | 1010 | 1083 |
| Z38148_PEA_1_T3 (SEQ ID NO: 4284) | 962 | 1035 |

This segment can be found in a non-coding region of transcript(s) that are related to the following protein(s): Z38148_PEA_1_P3 and Z38148_PEA_1_P4.

Segment cluster Z38148_PEA_1_node_15 (SEQ ID NO:6140) according to the present invention is supported by 31 libraries. The number of libraries was determined as previously described. This segment can be found in the following transcript(s): Z38148_PEA_1_T2 (SEQ ID NO:4283), Z38148_PEA_1_T3 (SEQ ID NO:4284) and Z38148_PEA_1_T8 (SEQ ID NO:4287). Table 5744 below describes the starting and ending position of this segment on each transcript.

TABLE 5744

| Transcript name | Segment location on transcripts | |
|---|---|---|
| | Segment starting position | Segment ending position |
| Z38148_PEA_1_T2 (SEQ ID NO: 4283) | 2224 | 2299 |
| Z38148_PEA_1_T3 (SEQ ID NO: 4284) | 2176 | 2251 |
| Z38148_PEA_1_T8 (SEQ ID NO: 4287) | 1570 | 1645 |

This segment can be found in a non-coding region of transcript(s) that are related to the following protein(s): Z38148_PEA_1_P3 and Z38148_PEA_1_P4.

Segment cluster Z38148_PEA_1_node_21 (SEQ ID NO:6141) according to the present invention can be found in the following transcript(s): Z38148_PEA_1_T9 (SEQ ID NO:4288), Z38148_PEA_1_T10 (SEQ ID NO:4289) and Z38148_PEA_1_T20 (SEQ ID NO:4295). Table 5745 below describes the starting and ending position of this segment on each transcript.

TABLE 5745

| Transcript name | Segment location on transcripts | |
|---|---|---|
| | Segment starting position | Segment ending position |
| Z38148_PEA_1_T9 (SEQ ID NO: 4288) | 1027 | 1042 |
| Z38148_PEA_1_T10 (SEQ ID NO: 4289) | 1027 | 1042 |
| Z38148_PEA_1_T20 (SEQ ID NO: 4295) | 1027 | 1042 |

This segment can be found in a non-coding region of transcript(s) that are related to the following protein(s): Z38148_PEA_1_P5 and Z38148_PEA_1_P8.

Segment cluster Z38148_PEA_1_node_37 (SEQ ID NO:6142) according to the present invention is supported by 23 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T18 (SEQ ID NO:4294), Z38148_PEA_1_T20 (SEQ ID NO:4295) and Z38148_PEA_1_T21 (SEQ ID NO:4296). Table 5746 below describes the starting and ending position of this segment on each transcript.

TABLE 5746

Segment location on transcripts

| Transcript name | Segment starting position | Segment ending position |
|---|---|---|
| Z38148_PEA_1_T1 (SEQ ID NO: 4282) | 2842 | 2946 |
| Z38148_PEA_1_T4 (SEQ ID NO: 4285) | 1758 | 1862 |
| Z38148_PEA_1_T5 (SEQ ID NO: 4286) | 1907 | 2011 |
| Z38148_PEA_1_T9 (SEQ ID NO: 4288) | 1701 | 1805 |
| Z38148_PEA_1_T10 (SEQ ID NO: 4289) | 2006 | 2110 |
| Z38148_PEA_1_T11 (SEQ ID NO: 4290) | 1668 | 1772 |
| Z38148_PEA_1_T12 (SEQ ID NO: 4291) | 1545 | 1649 |
| Z38148_PEA_1_T13 (SEQ ID NO: 4292) | 1508 | 1612 |
| Z38148_PEA_1_T17 (SEQ ID NO: 4293) | 2842 | 2946 |
| Z38148_PEA_1_T18 (SEQ ID NO: 4294) | 2842 | 2946 |
| Z38148_PEA_1_T20 (SEQ ID NO: 4295) | 1685 | 1789 |
| Z38148_PEA_1_T21 (SEQ ID NO: 4296) | 1187 | 1291 |

This segment can be found in a non-coding region of transcript(s) that are related to the following protein(s): Z38148_PEA_1_P2, Z38148_PEA_1_P5, Z38148_PEA_1_P8 and Z38148_PEA_1_P3.

Segment cluster Z38148_PEA_1_node_39 (SEQ ID NO:6143) according to the present invention is supported by 28 libraries. The number of libraries was determined as previously described. This segment can be found in the following transcript(s): Z38148_PEA_1_T1 (SEQ ID NO:4282), Z38148_PEA_1_T4 (SEQ ID NO:4285), Z38148_PEA_1_T5 (SEQ ID NO:4286), Z38148_PEA_1_T9 (SEQ ID NO:4288), Z38148_PEA_1_T10 (SEQ ID NO:4289), Z38148_PEA_1_T11 (SEQ ID NO:4290), Z38148_PEA_1_T12 (SEQ ID NO:4291), Z38148_PEA_1_T13 (SEQ ID NO:4292), Z38148_PEA_1_T17 (SEQ ID NO:4293), Z38148_PEA_1_T20 (SEQ ID NO:4295) and Z38148_PEA_1_T21 (SEQ ID NO:4296). Table 5747 below describes the starting and ending position of this segment on each transcript.

TABLE 5747

Segment location on transcripts

| Transcript name | Sgment starting position | Segment ending position |
|---|---|---|
| Z38148_PEA_1_T1 (SEQ ID NO: 4282) | 3719 | 3770 |
| Z38148_PEA_1_T4 (SEQ ID NO: 4285) | 2635 | 2686 |
| Z38148_PEA_1_T5 (SEQ ID NO: 4286) | 2784 | 2835 |
| Z38148_PEA_1_T9 (SEQ ID NO: 4288) | 2578 | 2629 |
| Z38148_PEA_1_T10 (SEQ ID NO: 4289) | 2883 | 2934 |
| Z38148_PEA_1_T11 (SEQ ID NO: 4290) | 2545 | 2596 |
| Z38148_PEA_1_T12 (SEQ ID NO: 4291) | 2422 | 2473 |
| Z38148_PEA_1_T13 (SEQ ID NO: 4292) | 2385 | 2436 |
| Z38148_PEA_1_T17 (SEQ ID NO: 4293) | 3719 | 3770 |
| Z38148_PEA_1_T20 (SEQ ID NO: 4295) | 2562 | 2613 |
| Z38148_PEA_1_T21 (SEQ ID NO: 4296) | 2064 | 2115 |

This segment can be found in a non-coding region of transcript(s) that are related to the following protein(s): Z38148_PEA_1_P2, Z38148_PEA_1_P5, Z38148_PEA_1_P8 and Z38148_PEA_1_P3.

Description for Cluster Z38219

Cluster Z38219 features 3 transcript(s) and 48 segment(s) of interest, the names for which are given in Tables 5748 and 5749, respectively, the sequences themselves are given at the end of the application. The selected protein variants are given in Table 5750.

TABLE 5748

Transcripts of interest
Transcript Name

Z38219_PEA_1_T28 (SEQ ID NO: 4299)
Z38219_PEA_1_T33 (SEQ ID NO: 4300)
Z38219_PEA_1_T43 (SEQ ID NO: 4301)

TABLE 5749

Segments of interest
Segment Name

Z38219_PEA_1_node_0 (SEQ ID NO: 6144)
Z38219_PEA_1_node_7 (SEQ ID NO: 6145)
Z38219_PEA_1_node_15 (SEQ ID NO: 6146)
Z38219_PEA_1_node_18 (SEQ ID NO: 6147)
Z38219_PEA_1_node_19 (SEQ ID NO: 6148)
Z38219_PEA_1_node_53 (SEQ ID NO: 6149)
Z38219_PEA_1_node_55 (SEQ ID NO: 6150)
Z38219_PEA_1_node_59 (SEQ ID NO: 6151)
Z38219_PEA_1_node_84 (SEQ ID NO: 6152)
Z38219_PEA_1_node_8 (SEQ ID NO: 6153)
Z38219_PEA_1_node_9 (SEQ ID NO: 6154)
Z38219_PEA_1_node_11 (SEQ ID NO: 6155)
Z38219_PEA_1_node_12 (SEQ ID NO: 6156)
Z38219_PEA_1_node_13 (SEQ ID NO: 6157)
Z38219_PEA_1_node_17 (SEQ ID NO: 6158)
Z38219_PEA_1_node_20 (SEQ ID NO: 6159)
Z38219_PEA_1_node_21 (SEQ ID NO: 6160)

TABLE 5749-continued

Segments of interest
Segment Name

Z38219_PEA_1_node_28 (SEQ ID NO: 6161)
Z38219_PEA_1_node_30 (SEQ ID NO: 6162)
Z38219_PEA_1_node_34 (SEQ ID NO: 6163)
Z38219_PEA_1_node_35 (SEQ ID NO: 6164)
Z38219_PEA_1_node_36 (SEQ ID NO: 6165)
Z38219_PEA_1_node_37 (SEQ ID NO: 6166)
Z38219_PEA_1_node_38 (SEQ ID NO: 6167)

TABLE 5749-continued

Segments of interest
Segment Name

Z38219_PEA_1_node_39 (SEQ ID NO: 6168)
Z38219_PEA_1_node_41 (SEQ ID NO: 6169)
Z38219_PEA_1_node_42 (SEQ ID NO: 6170)
Z38219_PEA_1_node_43 (SEQ ID NO: 6171)
Z38219_PEA_1_node_44 (SEQ ID NO: 6172)
Z38219_PEA_1_node_47 (SEQ ID NO: 6173)
Z38219_PEA_1_node_48 (SEQ ID NO: 6174)
Z38219_PEA_1_node_54 (SEQ ID NO: 6175)
Z38219_PEA_1_node_62 (SEQ ID NO: 6176)
Z38219_PEA_1_node_63 (SEQ ID NO: 6177)
Z38219_PEA_1_node_64 (SEQ ID NO: 6178)
Z38219_PEA_1_node_65 (SEQ ID NO: 6179)
Z38219_PEA_1_node_68 (SEQ ID NO: 6180)
Z38219_PEA_1_node_72 (SEQ ID NO: 6181)
Z38219_PEA_1_node_73 (SEQ ID NO: 6182)
Z38219_PEA_1_node_74 (SEQ ID NO: 6183)
Z38219_PEA_1_node_75 (SEQ ID NO: 6184)
Z38219_PEA_1_node_76 (SEQ ID NO: 6185)
Z38219_PEA_1_node_77 (SEQ ID NO: 6186)
Z38219_PEA_1_node_79 (SEQ ID NO: 6187)
Z38219_PEA_1_node_80 (SEQ ID NO: 6188)
Z38219_PEA_1_node_82 (SEQ ID NO: 6189)
Z38219_PEA_1_node_85 (SEQ ID NO: 6190)
Z38219_PEA_1_node_86 (SEQ ID NO: 6191)

TABLE 5750

Proteins of interest

| Protein Name | Corresponding Transcript(s) |
|---|---|
| Z38219_PEA_1_P32 | Z38219_PEA_1_T43 (SEQ ID NO: 4301) |
| Z38219_PEA_1_P61 | Z38219_PEA_1_T28 (SEQ ID NO: 4299); Z38219_PEA_1_T33 (SEQ ID NO: 4300) |

These sequences are variants of the known protein Heat shock protein 75 kDa, mitochondrial precursor (SwissProt accession identifier TRAL_HUMAN; known also according to the synonyms HSP 75; Tumor necrosis factor type 1 receptor associated protein; TRAP-1; TNFR-associated protein 1), referred to herein as the previously known protein.

Protein Heat shock protein 75 kDa, mitochondrial precursor is known or believed to have the following function(s): Chaperone that expresses an ATPase activity. The sequence for protein Heat shock protein 75 kDa, mitochondrial precursor is given at the end of the application, as "Heat shock protein 75 kDa, mitochondrial precursor amino acid sequence". Known polymorphisms for this sequence are as shown in Table 5751.

TABLE 5751

Amino acid mutations for Known Protein

| SNP position(s) on amino acid sequence | Comment |
|---|---|
| 307 | G -> R (in dbSNP:740860). /FTId = VAR_016108. |
| 17-19 | PLL -> ALR |
| 53 | L -> M |
| 395 | D -> E |
| 475-476 | Missing |
| 488-491 | SRMR -> AHW |
| 656-704 | QLRASEPGLAQLLVDQIYENAMIAAGLVDDPRAMVGRLNEL LVKALERH -> HCAQASLAWLSCWWIRYTRTP |

Protein Heat shock protein 75 kDa, mitochondrial precursor localization is believed to be Mitochondrial.

The following GO Annotation(s) apply to the previously known protein. The following annotation(s) were found: protein folding, which are annotation(s) related to Biological Process; chaperone; tumor necrosis factor receptor ligand; ATP binding, which are annotation(s) related to Molecular Function; and mitochondrion, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z38219 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 138 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 138 and Table 5752. This cluster is overexpressed (at least at a minimum level) in the following pathological conditions: colorectal cancer, epithelial malignant tumors, a mixture of malignant tumors from different tissues, lung malignant tumors, malignant tumors involving the lymph nodes, ovarian carcinoma and skin malignancies.

TABLE 5752

Normal tissue distribution

| Name of Tissue | Number |
|---|---|
| adrenal | 40 |
| bladder | 41 |
| Bone | 51 |
| Brain | 121 |
| Colon | 31 |
| epithelial | 43 |
| general | 70 |
| head and neck | 0 |
| kidney | 47 |
| Liver | 4 |
| Lung | 14 |
| Lymph nodes | 18 |
| Breast | 35 |
| bone marrow | 156 |
| muscle | 129 |
| Ovary | 14 |
| pancreas | 88 |
| prostate | 60 |
| skin | 43 |
| stomach | 36 |
| T cells | 278 |
| uterus | 136 |

TABLE 5753

P values and ratios for expression in cancerous tissue

| Name of Tissue | P1 | P2 | SP1 | R3 | SP2 | R4 |
|---|---|---|---|---|---|---|
| adrenal | 3.5e−01 | 4.2e−01 | 4.4e−01 | 1.7 | 5.5e−01 | 1.4 |
| bladder | 5.4e−01 | 4.5e−01 | 2.8e−01 | 2.0 | 3.8e−01 | 1.7 |
| bone | 7.0e−01 | 6.3e−01 | 6.4e−01 | 1.0 | 2.6e−01 | 1.7 |
| brain | 5.5e−01 | 1.7e−01 | 3.2e−02 | 1.0 | 7.4e−07 | 1.9 |
| colon | 7.3e−02 | 1.5e−02 | 4.6e−02 | 2.7 | 4.1e−03 | 3.8 |
| epithelial | 3.0e−03 | 3.7e−07 | 1.3e−06 | 2.5 | 6.9e−29 | 5.1 |
| general | 4.1e−03 | 2.5e−09 | 2.7e−07 | 1.7 | 7.4e−58 | 3.5 |
| head and neck | 2.1e−01 | 1.7e−01 | 1 | 1.9 | 7.5e−01 | 1.6 |
| kidney | 4.7e−01 | 5.2e−01 | 6.6e−02 | 2.2 | 2.7e−02 | 2.3 |
| liver | 9.1e−01 | 1.3e−01 | 1 | 0.9 | 1.6e−01 | 2.9 |
| lung | 1.1e−01 | 1.5e−02 | 4.6e−02 | 3.7 | 4.1e−12 | 11.4 |
| lymph nodes | 2.0e−01 | 1.0e−02 | 2.0e−01 | 3.3 | 1.4e−14 | 7.1 |
| breast | 6.7e−01 | 4.3e−01 | 2.2e−01 | 1.7 | 3.6e−02 | 2.3 |
| bone marrow | 8.6e−01 | 5.7e−01 | 1 | 0.2 | 8.1e−01 | 0.8 |
| muscle | 5.6e−01 | 4.7e−01 | 1.7e−01 | 1.6 | 2.8e−01 | 1.1 |
| ovary | 3.8e−01 | 2.2e−01 | 1.0e−01 | 1.8 | 6.4e−03 | 3.8 |
| pancreas | 3.8e−01 | 2.3e−01 | 4.6e−01 | 1.1 | 1.2e−02 | 1.2 |
| prostate | 4.9e−01 | 3.5e−01 | 4.9e−01 | 1.0 | 1.6e−01 | 1.6 |
| skin | 6.9e−01 | 4.7e−01 | 1 | 0.2 | 2.4e−10 | 5.8 |
| stomach | 1.5e−01 | 5.9e−02 | 5.0e−01 | 1.5 | 6.7e−03 | 2.7 |
| T cells | 6.7e−01 | 5.0e−01 | 5.5e−01 | 1.5 | 8.1e−01 | 0.9 |
| uterus | 5.3e−01 | 1.1e−01 | 4.6e−01 | 0.9 | 1.6e−01 | 1.3 |

As noted above, cluster Z38219 features 48 segment(s), which were listed in Table 5749 above and for which the sequence(s) are given at the end of the application. These segment(s) are portions of nucleic acid sequence(s) which are described herein separately because they are of particular interest. A description of each segment according to the present invention is now provided.

Segment cluster Z38219_PEA_1_node_0 (SEQ ID NO:6144) according to the present invention is supported by 154 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5754 below describes the starting and ending position of this segment on each transcript.

TABLE 5754

Segment location on transcripts

| Transcript name | Segment starting position | Segment ending position |
|---|---|---|
| Z38219_PEA_1_T28 (SEQ ID NO: 4299) | 1 | 164 |
| Z38219_PEA_1_T33 (SEQ ID NO: 4300) | 1 | 164 |

This segment can be found in the following protein(s): Z38219_PEA_1_P61.

Segment cluster Z38219_PEA_1_node_7 (SEQ ID NO:6145) according to the present invention is supported by 170 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5755 below describes the starting and ending position of this segment on each transcript.

TABLE 5755

Segment location on transcripts

| Transcript name | Segment starting position | Segment ending position |
|---|---|---|
| Z38219_PEA_1_T28 (SEQ ID NO: 4299) | 165 | 310 |
| Z38219_PEA_1_T33 (SEQ ID NO: 4300) | 165 | 310 |

This segment can be found in the following protein(s): Z38219_PEA_1_P61.

Segment cluster Z38219_PEA_1_node_15 (SEQ ID NO:6146) according to the present invention is supported by 157 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5756 below describes the starting and ending position of this segment on each transcript.

TABLE 5756

Segment location on transcripts

| Transcript name | Segment starting position | Segment ending position |
|---|---|---|
| Z38219_PEA_1_T28 (SEQ ID NO: 4299) | 407 | 547 |
| Z38219_PEA_1_T33 (SEQ ID NO: 4300) | 407 | 547 |

This segment can be found in the following protein(s): Z38219_PEA_1_P61.

Segment cluster Z38219_PEA_1_node_18 (SEQ ID NO:6147) according to the present invention is supported by 13 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5757 below describes the starting and ending position of this segment on each transcript.

TABLE 5757

Segment location on transcripts

| Transcript name | Segment starting position | Segment ending position |
|---|---|---|
| Z38219_PEA_1_T28 (SEQ ID NO: 4299) | 620 | 1786 |
| Z38219_PEA_1_T33 (SEQ ID NO: 4300) | 620 | 1786 |

This segment can be found in the following protein(s): Z38219_PEA_1_P61.

Segment cluster Z38219_PEA_1_node_19 (SEQ ID NO:6148) according to the present invention is supported by 30 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5758 below describes the starting and ending position of this segment on each transcript.

TABLE 5758

Segment location on transcripts

| Transcript name | Segment starting position | Segment ending position |
|---|---|---|
| Z38219_PEA_1_T28 (SEQ ID NO: 4299) | 1787 | 2679 |
| Z38219_PEA_1_T33 (SEQ ID NO: 4300) | 1787 | 2679 |

This segment can be found in a non-coding region of transcript(s) that are related to the following protein(s): Z38219_PEA_1_P61.

Segment cluster Z38219_PEA_1_node_53 (SEQ ID NO:6149) according to the present invention is supported by 16 libraries. The number of libraries was determined as previously described. This segment can be found in the following transcript(s): Z38219_PEA_1_T43 (SEQ ID NO:4301). Table 5759 below describes the starting and ending position of this segment on each transcript.

TABLE 5759

Segment location on transcripts

| Transcript name | Segment starting position | Segment ending position |
|---|---|---|
| Z38219_PEA_1_T43 (SEQ ID NO: 4301) | 1 | 857 |

This segment can be found in a non-coding region of transcript(s) that are related to the following protein(s): Z38219_PEA_1_P32.

Segment cluster Z38219_PEA_1_node_55 (SEQ ID NO:6150) according to the present invention is supported by 169 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5760 below describes the starting and ending position of this segment on each transcript.

TABLE 5760

Segment location on transcripts

| Transcript name | Segment starting position | Segment ending position |
|---|---|---|
| Z38219_PEA_1_T28 (SEQ ID NO: 4299) | 3399 | 3519 |
| Z38219_PEA_1_T33 (SEQ ID NO: 4300) | 3502 | 3622 |
| Z38219_PEA_1_T43 (SEQ ID NO: 4301) | 885 | 1005 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_59 (SEQ ID NO:6151) according to the present invention is supported by 205 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5761 below describes the starting and ending position of this segment on each transcript.

TABLE 5761

Segment location on transcripts

| Transcript name | Segment starting position | Segment ending position |
|---|---|---|
| Z38219_PEA_1_T28 (SEQ ID NO: 4299) | 3520 | 3705 |
| Z38219_PEA_1_T33 (SEQ ID NO: 4300) | 3623 | 3808 |
| Z38219_PEA_1_T43 (SEQ ID NO: 4301) | 1006 | 1191 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_84 (SEQ ID NO:6152) according to the present invention is supported by 184 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5762 below describes the starting and ending position of this segment on each transcript.

TABLE 5762

Segment location on transcripts

| Transcript name | Segment starting position | Segment ending position |
|---|---|---|
| Z38219_PEA_1_T28 (SEQ ID NO: 4299) | 4150 | 4269 |
| Z38219_PEA_1_T33 (SEQ ID NO: 4300) | 4253 | 4372 |
| Z38219_PEA_1_T43 (SEQ ID NO: 4301) | 1636 | 1755 |

This segment can be found in both coding and non-coding regions of transcript(s) as follows. The segment can be found in a non-coding region of transcript(s) that are related to the following protein(s): Z38219_PEA_1_P61. This segment can also be found in the following 5 protein(s): Z38219_PEA_1_P32, since it is in the coding region for the corresponding transcript.

According to an optional embodiment of the present invention, short segments related to the above cluster are also provided. These segments are up to about 120 bp in length, and so are included in a separate description.

Segment cluster Z38219_PEA_1_node_8 (SEQ ID NO:6153) according to the present invention can be found in the following transcript(s): Z38219_PEA_1_T28 (SEQ ID NO:4299) and Z38219_PEA_1_T33 (SEQ ID NO:4300). Table 5763 below describes the starting and ending position of this segment on each transcript.

TABLE 5763

Segment location on transcripts

| Transcript name | Segment starting position | Segment ending position |
|---|---|---|
| Z38219_PEA_1_T28 (SEQ ID NO: 4299) | 311 | 314 |
| Z38219_PEA_1_T33 (SEQ ID NO: 4300) | 311 | 314 |

This segment can be found in the following protein(s): Z38219_PEA_1_P61.

Segment cluster Z38219_PEA_1_node_9 (SEQ ID NO:6154) according to the present invention can be found in the following transcript(s): Z38219_PEA_1_T28 (SEQ ID NO:4299) and Z38219_PEA_1_T33 (SEQ ID NO:4300). Table 5764 below describes the starting and ending position of this segment on each transcript.

TABLE 5764

Segment location on transcripts

| Transcript name | Segment starting position | Segment ending position |
|---|---|---|
| Z38219_PEA_1_T28 (SEQ ID NO: 4299) | 315 | 323 |
| Z38219_PEA_1_T33 (SEQ ID NO: 4300) | 315 | 323 |

This segment can be found in the following protein(s): Z38219_PEA_1_P61.

Segment cluster Z38219_PEA_1_node_11 (SEQ ID NO:6155) according to the present invention can be found in the following transcript(s): Z38219_PEA_1_T28 (SEQ ID NO:4299) and Z38219_PEA_1_T33 (SEQ ID NO:4300). Table 5765 below describes the starting and ending position of this segment on each transcript.

TABLE 5765

Segment location on transcripts

| Transcript name | Segment starting position | Segment ending position |
|---|---|---|
| Z38219_PEA_1_T28 (SEQ ID NO: 4299) | 324 | 330 |
| Z38219_PEA_1_T33 (SEQ ID NO: 4300) | 324 | 330 |

This segment can be found in the following protein(s): Z38219_PEA_1_P61.

Segment cluster Z38219_PEA_1_node_12 (SEQ ID NO:6156) according to the present invention can be found in the following transcript(s): Z38219_PEA_1_T28 (SEQ ID NO:4299) and Z38219_PEA_1_T33 (SEQ ID NO:4300). Table 5766 below describes the starting and ending position of this segment on each transcript.

TABLE 5766

Segment location on transcripts

| Transcript name | Segment starting position | Segment ending position |
|---|---|---|
| Z38219_PEA_1_T28 (SEQ ID NO: 4299) | 331 | 350 |
| Z38219_PEA_1_T33 (SEQ ID NO: 4300) | 331 | 350 |

This segment can be found in the following protein(s): Z38219_PEA_1_P61.

Segment cluster Z38219_PEA_1_node_13 (SEQ ID NO:6157) according to the present 5 invention is supported by 155 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5767 below describes the starting and ending position of this segment on each transcript.

TABLE 5767

Segment location on transcripts

| Transcript name | Segment starting position | Segment ending position |
|---|---|---|
| Z38219_PEA_1_T28 (SEQ ID NO: 4299) | 351 | 406 |
| Z38219_PEA_1_T33 (SEQ ID NO: 4300) | 351 | 406 |

This segment can be found in the following protein(s): Z38219_PEA_1_P61.

Segment cluster Z38219_PEA_1_node_17 (SEQ ID NO:6158) according to the present invention is supported by 150 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5768 below describes the starting and ending position of this segment on each transcript.

TABLE 5768

| Segment location on transcripts | | |
|---|---|---|
| Transcript name | Segment starting position | Segment ending position |
| Z38219_PEA_1_T28 (SEQ ID NO: 4299) | 548 | 619 |
| Z38219_PEA_1_T33 (SEQ ID NO: 4300) | 548 | 619 |

This segment can be found in the following protein(s): Z38219_PEA_1_P61.

Segment cluster Z38219_PEA_1_node_20 (SEQ ID NO:6159) according to the present invention is supported by 161 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5769 below describes the starting and ending position of this segment on each transcript.

TABLE 5769

| Segment location on transcripts | | |
|---|---|---|
| Transcript name | Segment starting position | Segment ending position |
| Z38219_PEA_1_T28 (SEQ ID NO: 4299) | 2680 | 2784 |
| Z38219_PEA_1_T33 (SEQ ID NO: 4300) | 2680 | 2784 |

This segment can be found in a non-coding region of transcript(s) that are related to the following protein(s): Z38219_PEA_1_P61.

Segment cluster Z38219_PEA_1_node_21 (SEQ ID NO:6160) according to the present invention is supported by 149 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5770 below describes the starting and ending position of this segment on each transcript.

TABLE 5770

| Segment location on transcripts | | |
|---|---|---|
| Transcript name | Segment starting position | Segment ending position |
| Z38219_PEA_1_T28 (SEQ ID NO: 4299) | 2785 | 2840 |
| Z38219_PEA_1_T33 (SEQ ID NO: 4300) | 2785 | 2840 |

This segment can be found in a non-coding region of transcript(s) that are related to the following protein(s): Z38219_PEA_1_P61.

Segment cluster Z38219_PEA_1_node_28 (SEQ ID NO:6161) according to the present invention is supported by 167 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5771 below describes the starting and ending position of this segment on each transcript.

TABLE 5771

| Segment location on transcripts | | |
|---|---|---|
| Transcript name | Segment starting position | Segment ending position |
| Z38219_PEA_1_T28 (SEQ ID NO: 4299) | 2841 | 2950 |
| Z38219_PEA_1_T33 (SEQ ID NO: 4300) | 2841 | 2950 |

This segment can be found in a non-coding region of transcript(s) that are related to the following protein(s): Z38219_PEA_1_P61.

Segment cluster Z38219_PEA_1_node_30 (SEQ ID NO:6162) according to the present invention is supported by 152 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5772 below describes the starting and ending position of this segment on each transcript.

TABLE 5772

| Segment location on transcripts | | |
|---|---|---|
| Transcript name | Segment starting position | Segment ending position |
| Z38219_PEA_1_T28 (SEQ ID NO: 4299) | 2951 | 3024 |
| Z38219_PEA_1_T33 (SEQ ID NO: 4300) | 2951 | 3024 |

This segment can be found in a non-coding region of transcript(s) that are related to the following protein(s): Z38219_PEA_1_P61.

Segment cluster Z38219_PEA_1_node_34 (SEQ ID NO:6163) according to the present invention is supported by 7 libraries. The number of libraries was determined as previously described. This segment can be found in the following transcript(s): Z38219_PEA_1_T33 (SEQ ID NO:4300). Table 5773 below describes the starting and ending position of this segment on each transcript.

TABLE 5773

| Segment location on transcripts | | |
|---|---|---|
| Transcript name | Segment starting position | Segment ending position |
| Z38219_PEA_1_T33 (SEQ ID NO: 4300) | 3025 | 3127 |

This segment can be found in a non-coding region of transcript(s) that are related to the following protein(s): Z38219_PEA_1_P61.

Segment cluster Z38219_PEA_1_node_35 (SEQ ID NO:6164) according to the present invention is supported by 148 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5774 below describes the starting and ending position of this segment on each transcript.

TABLE 5774

| Segment location on transcripts | | |
|---|---|---|
| Transcript name | Segment starting position | Segment ending position |
| Z38219_PEA_1_T28 (SEQ ID NO: 4299) | 3025 | 3055 |
| Z38219_PEA_1_T33 (SEQ ID NO: 4300) | 3128 | 3158 |

This segment can be found in a non-coding region of transcript(s) that are related to the following protein(s): Z38219_PEA_1_P61.

Segment cluster Z38219_PEA_1_node_36 (SEQ ID NO:6165) according to the present invention is supported by 147 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5775 below describes the starting and ending position of this segment on each transcript.

TABLE 5775

| Segment location on transcripts | | |
|---|---|---|
| Transcript name | Segment starting position | Segment ending position |
| Z38219_PEA_1_T28 (SEQ ID NO: 4299) | 3056 | 3087 |
| Z38219_PEA_1_T33 (SEQ ID NO: 4300) | 3159 | 3190 |

This segment can be found in a non-coding region of transcript(s) that are related to the following protein(s): Z38219_PEA_1_P61.

Segment cluster Z38219_PEA_1_node_37 (SEQ ID NO:6166) according to the present invention is supported by 140 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5776 below describes the starting and ending position of this segment on each transcript.

TABLE 5776

| Segment location on transcripts | | |
|---|---|---|
| Transcript name | Segment starting position | Segment ending position |
| Z38219_PEA_1_T28 (SEQ ID NO: 4299) | 3088 | 3117 |
| Z38219_PEA_1_T33 (SEQ ID NO: 4300) | 3191 | 3220 |

This segment can be found in a non-coding region of transcript(s) that are related to the following protein(s): Z38219_PEA_1_P61.

Segment cluster Z38219_PEA_1_node_38 (SEQ ID NO:6167) according to the present invention is supported by 140 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5777 below describes the starting and ending position of this segment on each transcript.

TABLE 5777

| Segment location on transcripts | | |
|---|---|---|
| Transcript name | Segment starting position | Segment ending position |
| Z38219_PEA_1_T28 (SEQ ID NO: 4299) | 3118 | 3164 |
| Z38219_PEA_1_T33 (SEQ ID NO: 4300) | 3221 | 3267 |

This segment can be found in a non-coding region of transcript(s) that are related to the following protein(s): Z38219_PEA_1_P61.

Segment cluster Z38219_PEA_1_node_39 (SEQ ID NO:6168) according to the present invention can be found in the following transcript(s): Z38219_PEA_1_T28 (SEQ ID NO:4299) and Z38219_PEA_1_T33 (SEQ ID NO:4300). Table 5778 below describes the starting and ending position of this segment on each transcript.

TABLE 5778

| Segment location on transcripts | | |
|---|---|---|
| Transcript name | Segment starting position | Segment ending position |
| Z38219_PEA_1_T28 (SEQ ID NO: 4299) | 3165 | 3180 |
| Z38219_PEA_1_T33 (SEQ ID NO: 4300) | 3268 | 3283 |

This segment can be found in a non-coding region of transcript(s) that are related to the following protein(s): Z38219_PEA_1_P61.

Segment cluster Z38219_PEA_1_node_41 (SEQ ID NO:6169) according to the present invention is supported by 134 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5779 below describes the starting and ending position of this segment on each transcript.

TABLE 5779

| Segment location on transcripts | | |
|---|---|---|
| Transcript name | Segment starting position | Segment ending position |
| Z38219_PEA_1_T28 (SEQ ID NO: 4299) | 3181 | 3230 |
| Z38219_PEA_1_T33 (SEQ ID NO: 4300) | 3284 | 3333 |

This segment can be found in a non-coding region of transcript(s) that are related to the following protein(s): Z38219_PEA_1_P61.

Segment cluster Z38219_PEA_1_node_42 (SEQ ID NO:6170) according to the present invention is supported by 130 libraries. The number of libraries was determined as previously described. This segment can be found in the following transcript(s): Z38219_PEA_1_T28 (SEQ ID NO:4299) and Z38219_PEA_1_T33 (SEQ ID NO:4300).

Table 5780 below describes the starting and ending position of this segment on each transcript.

TABLE 5780

| Segment location on transcripts | | |
|---|---|---|
| Transcript name | Segment starting position | Segment ending position |
| Z38219_PEA_1_T28 (SEQ ID NO: 4299) | 3231 | 3266 |
| Z38219_PEA_1_T33 (SEQ ID NO: 4300) | 3334 | 3369 |

This segment can be found in a non-coding region of transcript(s) that are related to the following protein(s): Z38219_PEA_1_P61.

Segment cluster Z38219_PEA_1_node_43 (SEQ ID NO:6171) according to the present invention can be found in the following transcript(s): Z38219_PEA_1_T28 (SEQ ID NO:4299) and Z38219_PEA_1_T33 (SEQ ID NO:4300). Table 5781 below describes the starting and ending position of this segment on each transcript.

TABLE 5781

| Segment location on transcripts | | |
|---|---|---|
| Transcript name | Segment starting position | Segment ending position |
| Z38219_PEA_1_T28 (SEQ ID NO: 4299) | 3267 | 3282 |
| Z38219_PEA_1_T33 (SEQ ID NO: 4300) | 3370 | 3385 |

This segment can be found in a non-coding region of transcript(s) that are related to the following protein(s): Z38219_PEA_1_P61.

Segment cluster Z38219_PEA_1_node_44 (SEQ ID NO:6172) according to the present invention can be found in the following transcript(s): Z38219_PEA_1_T28 (SEQ ID NO:4299) and Z38219_PEA_1_T33 (SEQ ID NO:4300). Table 5782 below describes the starting and ending position of this segment on each transcript.

TABLE 5782

| Segment location on transcripts | | |
|---|---|---|
| Transcript name | Segment starting position | Segment ending position |
| Z38219_PEA_1_T28 (SEQ ID NO: 4299) | 3283 | 3301 |
| Z38219_PEA_1_T33 (SEQ ID NO: 4300) | 3386 | 3404 |

This segment can be found in a non-coding region of transcript(s) that are related to the following protein(s): Z38219_PEA_1_P61.

Segment cluster Z38219_PEA_1_node_47 (SEQ ID NO:6173) according to the present invention is supported by 126 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5783 below describes the starting and ending position of this segment on each transcript.

TABLE 5783

| Segment location on transcripts | | |
|---|---|---|
| Transcript name | Segment starting position | Segment ending position |
| Z38219_PEA_1_T28 (SEQ ID NO: 4299) | 3302 | 3327 |
| Z38219_PEA_1_T33 (SEQ ID NO: 4300) | 3405 | 3430 |

This segment can be found in a non-coding region of transcript(s) that are related to the following protein(s): Z38219_PEA_1_P61.

Segment cluster Z38219_PEA_1_node_48 (SEQ ID NO:6174) according to the present invention is supported by 131 libraries. The number of libraries was determined as previously described. This segment can be found in the following transcript(s): Z38219_PEA_1_T28 (SEQ ID NO:4299) and Z38219_PEA_1_T33 (SEQ ID NO:4300). Table 5784 below describes the starting and ending position of this segment on each transcript.

TABLE 5784

| Segment location on transcripts | | |
|---|---|---|
| Transcript name | Segment starting position | Segment ending position |
| Z38219_PEA_1_T28 (SEQ ID NO: 4299) | 3328 | 3371 |
| Z38219_PEA_1_T33 (SEQ ID NO: 4300) | 3431 | 3474 |

This segment can be found in a non-coding region of transcript(s) that are related to the following protein(s): Z38219_PEA_1_P61.

Segment cluster Z38219_PEA_1_node_54 (SEQ ID NO:6175) according to the present invention is supported by 137 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5785 below describes the starting and ending position of this segment on each transcript.

TABLE 5785

| Segment location on transcripts | | |
|---|---|---|
| Transcript name | Segment starting position | Segment ending position |
| Z38219_PEA_1_T28 (SEQ ID NO: 4299) | 3372 | 3398 |
| Z38219_PEA_1_T33 (SEQ ID NO: 4300) | 3475 | 3501 |
| Z38219_PEA_1_T43 (SEQ ID NO: 4301) | 858 | 884 |

This segment can be found in a non-coding region of transcript(s) that are related to the following protein(s): Z38219_PEA_1_P61 and Z38219_PEA_1_P32.

Segment cluster Z38219_PEA_1_node_62 (SEQ ID NO:6176) according to the present invention is supported by 185 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5786 below describes the starting and ending position of this segment on each transcript.

TABLE 5786

Segment location on transcripts

| Transcript name | Segment starting position | Segment ending position |
|---|---|---|
| Z38219_PEA_1_T28 (SEQ ID NO: 4299) | 3706 | 3801 |
| Z38219_PEA_1_T33 (SEQ ID NO: 4300) | 3809 | 3904 |
| Z38219_PEA_1_T43 (SEQ ID NO: 4301) | 1192 | 1287 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_63 (SEQ ID NO:6177) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5787 below describes the starting and ending position of this segment on each transcript.

TABLE 5787

Segment location on transcripts

| Transcript name | Segment starting position | Segment ending position |
|---|---|---|
| Z38219_PEA_1_T28 (SEQ ID NO: 4299) | 3802 | 3816 |
| Z38219_PEA_1_T33 (SEQ ID NO: 4300) | 3905 | 3919 |
| Z38219_PEA_1_T43 (SEQ ID NO: 4301) | 1288 | 1302 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_64 (SEQ ID NO:6178) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5788 below describes the starting and ending position of this segment on each transcript.

TABLE 5788

Segment location on transcripts

| Transcript name | Segment starting position | Segment ending position |
|---|---|---|
| Z38219_PEA_1_T28 (SEQ ID NO: 4299) | 3817 | 3831 |
| Z38219_PEA_1_T33 (SEQ ID NO: 4300) | 3920 | 3934 |
| Z38219_PEA_1_T43 (SEQ ID NO: 4301) | 1303 | 1317 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_65 (SEQ ID NO:6179) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5789 below describes the starting and ending position of this segment on each transcript.

TABLE 5789

Segment location on transcripts

| Transcript name | Segment starting position | Segment ending position |
|---|---|---|
| Z38219_PEA_1_T28 (SEQ ID NO: 4299) | 3832 | 3844 |
| Z38219_PEA_1_T33 (SEQ ID NO: 4300) | 3935 | 3947 |
| Z38219_PEA_1_T43 (SEQ ID NO: 4301) | 1318 | 1330 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_68 (SEQ ID NO:6180) according to the present invention is supported by 196 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5790 below describes the starting and ending position of this segment on each transcript.

TABLE 5790

Segment location on transcripts

| Transcript name | Segment starting position | Segment ending position |
|---|---|---|
| Z38219_PEA_1_T28 (SEQ ID NO: 4299) | 3845 | 3930 |
| Z38219_PEA_1_T33 (SEQ ID NO: 4300) | 3948 | 4033 |

TABLE 5790-continued

Segment location on transcripts

| Transcript name | Segment starting position | Segment ending position |
|---|---|---|
| Z38219_PEA_1_T43 (SEQ ID NO: 4301) | 1331 | 1416 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_72 (SEQ ID NO:6181) according to the present invention is supported by 194 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5791 below describes the starting and ending position of this segment on each transcript.

TABLE 5791

Segment location on transcripts

| Transcript name | Segment starting position | Segment ending position |
|---|---|---|
| Z38219_PEA_1_T28 (SEQ ID NO: 4299) | 3931 | 3964 |
| Z38219_PEA_1_T33 (SEQ ID NO: 4300) | 4034 | 4067 |
| Z38219_PEA_1_T43 (SEQ ID NO: 4301) | 1417 | 1450 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_73 (SEQ ID NO:6182) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5792 below describes the starting and ending position of this segment on each transcript.

TABLE 5792

Segment location on transcripts

| Transcript name | Segment starting position | Segment ending position |
|---|---|---|
| Z38219_PEA_1_T28 (SEQ ID NO: 4299) | 3965 | 3970 |
| Z38219_PEA_1_T33 (SEQ ID NO: 4300) | 4068 | 4073 |
| Z38219_PEA_1_T43 (SEQ ID NO: 4301) | 1451 | 1456 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_74 (SEQ ID NO:6183) according to the present invention is supported by 192 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5793 below describes the starting and ending position of this segment on each transcript.

TABLE 5793

Segment location on transcripts

| Transcript name | Segment starting position | Segment ending position |
|---|---|---|
| Z38219_PEA_1_T28 (SEQ ID NO: 4299) | 3971 | 3999 |
| Z38219_PEA_1_T33 (SEQ ID NO: 4300) | 4074 | 4102 |
| Z38219_PEA_1_T43 (SEQ ID NO: 4301) | 1457 | 1485 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_75 (SEQ ID NO:6184) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5794 below describes the starting and ending position of this segment on each transcript.

TABLE 5794

Segment location on transcripts

| Transcript name | Segment starting position | Segment ending position |
|---|---|---|
| Z38219_PEA_1_T28 (SEQ ID NO: 4299) | 4000 | 4014 |
| Z38219_PEA_1_T33 (SEQ ID NO: 4300) | 4103 | 4117 |
| Z38219_PEA_1_T43 (SEQ ID NO: 4301) | 1486 | 1500 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_76 (SEQ ID NO:6185) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5795 below describes the starting and ending position of this segment on each transcript.

TABLE 5795

Segment location on transcripts

| Transcript name | Segment starting position | Segment ending position |
|---|---|---|
| Z38219_PEA_1_T28 (SEQ ID NO: 4299) | 4015 | 4029 |
| Z38219_PEA_1_T33 (SEQ ID NO: 4300) | 4118 | 4132 |
| Z38219_PEA_1_T43 (SEQ ID NO: 4301) | 1501 | 1515 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_77 (SEQ ID NO:6186) according to the present invention is supported by 182 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5796 below describes the starting and ending position of this segment on each transcript.

TABLE 5796

Segment location on transcripts

| Transcript name | Segment starting position | Segment ending position |
|---|---|---|
| Z38219_PEA_1_T28 (SEQ ID NO: 4299) | 4030 | 4076 |
| Z38219_PEA_1_T33 (SEQ ID NO: 4300) | 4133 | 4179 |
| Z38219_PEA_1_T43 (SEQ ID NO: 4301) | 1516 | 1562 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_79 (SEQ ID NO:6187) according to the present invention is supported by 169 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5797 below describes the starting and ending position of this segment on each transcript.

TABLE 5797

Segment location on transcripts

| Transcript name | Segment starting position | Segment ending position |
|---|---|---|
| Z38219_PEA_1_T28 (SEQ ID NO: 4299) | 4077 | 4125 |
| Z38219_PEA_1_T33 (SEQ ID NO: 4300) | 4180 | 4228 |
| Z38219_PEA_1_T43 (SEQ ID NO: 4301) | 1563 | 1611 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_80 (SEQ ID NO:6188) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5798 below describes the starting and ending position of this segment on each transcript.

TABLE 5798

Segment location on transcripts

| Transcript name | Segment starting position | Segment ending position |
|---|---|---|
| Z38219_PEA_1_T28 (SEQ ID NO: 4299) | 4126 | 4134 |
| Z38219_PEA_1_T33 (SEQ ID NO: 4300) | 4229 | 4237 |
| Z38219_PEA_1_T43 (SEQ ID NO: 4301) | 1612 | 1620 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_82 (SEQ ID NO:6189) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5799 below describes the starting and ending position of this segment on each transcript.

TABLE 5799

Segment location on transcripts

| Transcript name | Segment starting position | Segment ending position |
|---|---|---|
| Z38219_PEA_1_T28 (SEQ ID NO: 4299) | 4135 | 4149 |
| Z38219_PEA_1_T33 (SEQ ID NO: 4300) | 4238 | 4252 |
| Z38219_PEA_1_T43 (SEQ ID NO: 4301) | 1621 | 1635 |

This segment can be found in both coding and non-coding regions of transcript(s) as follows. The segment can be found in a non-coding region of transcript(s) that are related to the following protein(s): Z38219_PEA_1_P61. This segment can also be found in the following protein(s): Z38219_PEA_1_P32, since it is in the coding region for the corresponding transcript.

Segment cluster Z38219_PEA_1_node_85 (SEQ ID NO:6190) according to the present invention is supported by 152 libraries. The number of libraries was determined as previously described. This segment can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5800 below describes the starting and ending position of this segment on each transcript.

TABLE 5800

Segment location on transcripts

| Transcript name | Segment starting position | Segment ending position |
|---|---|---|
| Z38219_PEA_1_T28 (SEQ ID NO: 4299) | 4270 | 4327 |
| Z38219_PEA_1_T33 (SEQ ID NO: 4300) | 4373 | 4430 |
| Z38219_PEA_1_T43 (SEQ ID NO: 4301) | 1756 | 1813 |

This segment can be found in a non-coding region of transcript(s) that are related to the following protein(s): Z38219_PEA_1_P61 and Z38219_PEA_1_P32.

Segment cluster Z38219_PEA_1_node_86 (SEQ ID NO:6191) according to the present invention can be found in the following transcript(s): Z38219_PEA_1_T28 (SEQ ID NO:4299), Z38219_PEA_1_T33 (SEQ ID NO:4300) and Z38219_PEA_1_T43 (SEQ ID NO:4301). Table 5801 below describes the starting and ending position of this segment on each transcript.

TABLE 5801

Segment location on transcripts

| Transcript name | Segment starting position | Segment ending position |
|---|---|---|
| Z38219_PEA_1_T28 (SEQ ID NO: 4299) | 4328 | 4344 |
| Z38219_PEA_1_T33 (SEQ ID NO: 4300) | 4431 | 4447 |
| Z38219_PEA_1_T43 (SEQ ID NO: 4301) | 1814 | 1830 |

This segment can be found in a non-coding region of transcript(s) that are related to the following protein(s): Z38219_PEA_1_P61 and Z38219_PEA_1_P32.

Description for Cluster R00317

Cluster R00317 features 2 transcript(s) and 19 segment(s) of interest, the names for which are given in Tables 5802 and 5803, respectively, the sequences themselves are given at the end of the application. The selected protein variants are given in Table 5804.

TABLE 5802

Transcripts of interest
Transcript Name

R00317_PEA_1_T0 (SEQ ID NO: 4302)
R00317_PEA_1_T4 (SEQ ID NO: 4303)

TABLE 5803

Segments of interest
Segment Name

R00317_PEA_1_node_0 (SEQ ID NO: 6192)
R00317_PEA_1_node_2 (SEQ ID NO: 6193)
R00317_PEA_1_node_3 (SEQ ID NO: 6194)
R00317_PEA_1_node_4 (SEQ ID NO: 6195)
R00317_PEA_1_node_5 (SEQ ID NO: 6196)
R00317_PEA_1_node_7 (SEQ ID NO: 6197)
R00317_PEA_1_node_14 (SEQ ID NO: 6198)
R00317_PEA_1_node_19 (SEQ ID NO: 6199)
R00317_PEA_1_node_23 (SEQ ID NO: 6200)
R00317_PEA_1_node_25 (SEQ ID NO: 6201)
R00317_PEA_1_node_26 (SEQ ID NO: 6202)
R00317_PEA_1_node_27 (SEQ ID NO: 6203)
R00317_PEA_1_node_30 (SEQ ID NO: 6204)
R00317_PEA_1_node_1 (SEQ ID NO: 6205)
R00317_PEA_1_node_11 (SEQ ID NO: 6206)
R00317_PEA_1_node_12 (SEQ ID NO: 6207)
R00317_PEA_1_node_17 (SEQ ID NO: 6208)
R00317_PEA_1_node_21 (SEQ ID NO: 6209)
R00317_PEA_1_node_28 (SEQ ID NO: 6210)

TABLE 5804

Proteins of interest

| Protein Name | Corresponding Transcript(s) |
|---|---|
| R00317_PEA_1_P6 | R00317_PEA_1_T0 (SEQ ID NO: 4302); R00317_PEA_1_T4 (SEQ ID NO: 4303) |

Cluster R00317 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 139 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 139 and Table 5805. This cluster is overexpressed (at least at a minimum level) in the following pathological conditions: colorectal cancer, epithelial malignant tumors and a mixture of malignant tumors from different tissues.

TABLE 5805

Normal tissue distribution

| Name of Tissue | Number |
|---|---|
| Colon | 0 |
| Epithelial | 11 |
| General | 6 |
| Kidney | 22 |
| Liver | 9 |
| Lung | 2 |
| lymph nodes | 0 |

TABLE 5805-continued

Normal tissue distribution

| Name of Tissue | Number |
|---|---|
| Breast | 0 |
| Ovary | 0 |
| Pancreas | 10 |
| Prostate | 10 |
| Stomach | 36 |
| Uterus | 22 |

TABLE 5806

P values and ratios for expression in cancerous tissue

| Name of Tissue | P1 | P2 | SP1 | R3 | SP2 | R4 |
|---|---|---|---|---|---|---|
| colon | 3.5e−04 | 2.6e−04 | 2.7e−02 | 5.6 | 1.2e−02 | 5.2 |
| epithelial | 4.3e−04 | 1.6e−03 | 3.5e−04 | 3.3 | 1.6e−05 | 3.0 |
| general | 4.7e−08 | 3.2e−07 | 1.1e−09 | 5.7 | 2.8e−12 | 4.6 |
| kidney | 6.1e−01 | 4.9e−01 | 8.2e−01 | 0.9 | 6.5e−01 | 1.1 |
| liver | 8.3e−01 | 7.6e−01 | 1 | 0.8 | 1.6e−01 | 2.0 |
| lung | 5.1e−01 | 7.0e−01 | 4.1e−01 | 2.2 | 6.2e−01 | 1.4 |
| lymph nodes | 3.1e−01 | 3.4e−01 | 2.9e−01 | 3.5 | 5.8e−01 | 1.8 |
| breast | 4.0e−01 | 3.9e−01 | 3.3e−01 | 2.4 | 4.6e−01 | 1.9 |
| ovary | 8.2e−02 | 1.1e−01 | 3.2e−01 | 2.5 | 4.5e−01 | 2.0 |
| pancreas | 2.6e−01 | 4.1e−01 | 2.1e−01 | 2.5 | 3.5e−01 | 1.8 |
| prostate | 7.0e−01 | 5.9e−01 | 4.5e−01 | 1.4 | 1.0e−01 | 1.8 |
| stomach | 5.8e−01 | 6.1e−01 | 1 | 0.5 | 9.6e−02 | 0.9 |
| uterus | 2.4e−01 | 5.3e−01 | 2.6e−01 | 1.8 | 5.8e−01 | 1.1 |

As noted above, cluster R00317 features 19 segment(s), which were listed in Table 5803 above and for which the sequence(s) are given at the end of the application. These segment(s) are portions of nucleic acid sequence(s) which are described herein separately because they are of particular interest. A description of each segment according to the present invention is now provided.

Segment cluster R00317_PEA_1_node_0 (SEQ ID NO:6192) according to the present invention is supported by 9 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5807 below describes the starting and ending position of this segment on each transcript.

TABLE 5807

Segment location on transcripts

| Transcript name | Segment starting position | Segment ending position |
|---|---|---|
| R00317_PEA_1_T0 (SEQ ID NO: 4302) | 1 | 314 |
| R00317_PEA_1_T4 (SEQ ID NO: 4303) | 1 | 314 |

This segment can be found in a non-coding region of transcript(s) that are related to the following protein(s): R00317_PEA_1_P6.

Segment cluster R00317_PEA_1_node_2 (SEQ ID NO:6193) according to the present invention is supported by 9 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5808 below describes the starting and ending position of this segment on each transcript.

TABLE 5808

Segment location on transcripts

| Transcript name | Segment starting position | Segment ending position |
|---|---|---|
| R00317_PEA_1_T0 (SEQ ID NO: 4302) | 401 | 582 |
| R00317_PEA_1_T4 (SEQ ID NO: 4303) | 401 | 582 |

This segment can be found in a non-coding region of transcript(s) that are related to the following protein(s): R00317_PEA_1_P6.

Segment cluster R00317_PEA_1_node_3 (SEQ ID NO:6194) according to the present invention is supported by 14 libraries. The number of libraries was determined as previously described. This segment can be found in the following transcript(s): R00317_PEA_1_T0 (SEQ ID NO:4302). Table 5809 below describes the starting and ending position of this segment on each transcript.

TABLE 5809

Segment location on transcripts

| Transcript name | Segment starting position | Segment ending position |
|---|---|---|
| R00317_PEA_1_T0 (SEQ ID NO: 4302) | 583 | 1636 |

This segment can be found in a non-coding region of transcript(s) that are related to the following protein(s): R00317_PEA_1_P6.

Segment cluster R00317_PEA_1_node_4 (SEQ ID NO:6195) according to the present invention is supported by 5 libraries. The number of libraries was determined as previously described. This segment can be found in the following transcript(s): R00317_PEA_1_T0 (SEQ ID NO:4302). Table 5810 below describes the starting and ending position of this segment on each transcript.

TABLE 5810

Segment location on transcripts

| Transcript name | Segment starting position | Segment ending position |
|---|---|---|
| R00317_PEA_1_T0 (SEQ ID NO: 4302) | 1637 | 1839 |

This segment can be found in a non-coding region of transcript(s) that are related to the following protein(s): R00317_PEA_1_P6.

Segment cluster R00317_PEA_1_node_5 (SEQ ID NO:6196) according to the present invention is supported by 6 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5811 below describes the starting and ending position of this segment on each transcript.

TABLE 5811

Segment location on transcripts

| Transcript name | Segment starting position | Segment ending position |
|---|---|---|
| R00317_PEA_1_T0 (SEQ ID NO: 4302) | 1840 | 2273 |
| R00317_PEA_1_T4 (SEQ ID NO: 4303) | 583 | 1016 |

This segment can be found in the following protein(s): R00317_PEA_1_P6.

Segment cluster R00317_PEA_1_node_7 (SEQ ID NO:6197) according to the present invention is supported by 7 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5812 below describes the starting and ending position of this segment on each transcript.

TABLE 5812

Segment location on transcripts

| Transcript name | Segment starting position | Segment ending position |
|---|---|---|
| R00317_PEA_1_T0 (SEQ ID NO: 4302) | 2274 | 2396 |
| R00317_PEA_1_T4 (SEQ ID NO: 4303) | 1017 | 1139 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5813.

TABLE 5813

Oligonucleotides related to this segment

| Oligonucleotide name | Overexpressed in cancers | Chip reference |
|---|---|---|
| R00317_0_4_0 | colorectal cancer | Colon |

This segment can be found in the following protein(s): R00317_PEA_1_P6.

Segment cluster R00317_PEA_1_node_14 (SEQ ID NO:6198) according to the present invention is supported by 12 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5814 below describes the starting and ending position of this segment on each transcript.

TABLE 5814

Segment location on transcripts

| Transcript name | Segment starting position | Segment ending position |
|---|---|---|
| R00317_PEA_1_T0 (SEQ ID NO: 4302) | 2472 | 2603 |

TABLE 5814-continued

Segment location on transcripts

| Transcript name | Segment starting position | Segment ending position |
|---|---|---|
| R00317_PEA_1_T4 (SEQ ID NO: 4303) | 1215 | 1346 |

This segment can be found in the following protein(s): R00317_PEA_1_P6.

Segment cluster R00317_PEA_1_node_19 (SEQ ID NO:6199) according to the present invention is supported by 7 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5815 below describes the starting and ending position of this segment on each transcript.

TABLE 5815

Segment location on transcripts

| Transcript name | Segment starting position | Segment ending position |
|---|---|---|
| R00317_PEA_1_T0 (SEQ ID NO: 4302) | 2709 | 2870 |
| R00317_PEA_1_T4 (SEQ ID NO: 4303) | 1452 | 1613 |

This segment can be found in the following protein(s): R00317_PEA_1_P6.

Segment cluster R00317_PEA_1_node_23 (SEQ ID NO:6200) according to the present invention is supported by 38 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5816 below describes the starting and ending position of this segment on each transcript.

TABLE 5816

Segment location on transcripts

| Transcript name | Segment starting position | Segment ending position |
|---|---|---|
| R00317_PEA_1_T0 (SEQ ID NO: 4302) | 2974 | 4329 |
| R00317_PEA_1_T4 (SEQ ID NO: 4303) | 1717 | 3072 |

This segment can be found in the following protein(s): R00317_PEA_1_P6.

Segment cluster R00317_PEA_1_node_25 (SEQ ID NO:6201) according to the present invention is supported by 40 libraries. The number of libraries was determined as previously described. This segment can be found in the following transcript(s): R00317_PEA_1_T0 (SEQ ID NO:4302) and R00317_PEA_1_4 (SEQ ID NO:4303). Table 5817 below describes the starting and ending position of this segment on each transcript.

TABLE 5817

Segment location on transcripts

| Transcript name | Segment starting position | Segment ending position |
|---|---|---|
| R00317_PEA_1_T0 (SEQ ID NO: 4302) | 4330 | 4688 |
| R00317_PEA_1_T4 (SEQ ID NO: 4303) | 3073 | 3431 |

This segment can be found in the following protein(s): R00317_PEA_1_P6.

Segment cluster R00317_PEA_1_node_26 (SEQ ID NO:6202) according to the present invention is supported by 38 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5818 below describes the starting and ending position of this segment on each transcript.

TABLE 5818

Segment location on transcripts

| Transcript name | Segment starting position | Segment ending position |
|---|---|---|
| R00317_PEA_1_T0 (SEQ ID NO: 4302) | 4689 | 4841 |
| R00317_PEA_1_T4 (SEQ ID NO: 4303) | 3432 | 3584 |

This segment can be found in a non-coding region of transcript(s) that are related to the following protein(s): R00317_PEA_1_P6.

Segment cluster R00317_PEA_1_node_27 (SEQ ID NO:6203) according to the present invention is supported by 69 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5819 below describes the starting and ending position of this segment on each transcript.

TABLE 5819

Segment location on transcripts

| Transcript name | Segment starting position | Segment ending position |
|---|---|---|
| R00317_PEA_1_T0 (SEQ ID NO: 4302) | 4842 | 5296 |
| R00317_PEA_1_T4 (SEQ ID NO: 4303) | 3585 | 4039 |

This segment can be found in a non-coding region of transcript(s) that are related to the following protein(s): R00317_PEA_1_P6.

Segment cluster R00317_PEA_1_node_30 (SEQ ID NO:6204) according to the present invention is supported by 52 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5820 below describes the starting and ending position of this segment on each transcript.

TABLE 5820

Segment location on transcripts

| Transcript name | Segment starting position | Segment ending position |
|---|---|---|
| R00317_PEA_1_T0 (SEQ ID NO: 4302) | 5352 | 5640 |
| R00317_PEA_1_T4 (SEQ ID NO: 4303) | 4095 | 4383 |

This segment can be found in a non-coding region of transcript(s) that are related to the following protein(s): R00317_PEA_1_P6.

According to an optional embodiment of the present invention, short segments related to the above cluster are also provided. These segments are up to about 120 bp in length, and so are included in a separate description.

Segment cluster R00317_PEA_1_node_1 (SEQ ID NO:6205) according to the present invention is supported by 7 libraries. The number of libraries was determined as previously described. This segment can be found in the following transcript(s): R00317_PEA_1_T0 (SEQ ID NO:4302) and R00317_PEA_1_T4. Table 5821 below describes the starting and ending position of this segment on each transcript.

TABLE 5821

Segment location on transcripts

| Transcript name | Segment starting position | Segment ending position |
|---|---|---|
| R00317_PEA_1_T0 (SEQ ID NO: 4302) | 315 | 400 |
| R00317_PEA_1_T4 (SEQ ID NO: 4303) | 315 | 400 |

This segment can be found in a non-coding region of transcript(s) that are related to the following protein(s): R00317_PEA_1_P6.

Segment cluster R00317_PEA_1_node_11 (SEQ ID NO:6206) according to the present invention is supported by 8 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5822 below describes the starting and ending position of this segment on each transcript.

TABLE 5822

Segment location on transcripts

| Transcript name | Segment starting position | Segment ending position |
|---|---|---|
| R00317_PEA_1_T0 (SEQ ID NO: 4302) | 2397 | 2432 |
| R00317_PEA_1_T4 (SEQ ID NO: 4303) | 1140 | 1175 |

This segment can be found in the following protein(s): R00317_PEA_1_P6.

Segment cluster R00317_PEA_1_node_12 (SEQ ID NO:6207) according to the present invention is supported by 8 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5823 below describes the starting and ending position of this segment on each transcript.

TABLE 5823

Segment location on transcripts

| Transcript name | Segment starting position | Segment ending position |
|---|---|---|
| R00317_PEA_1_T0 (SEQ ID NO: 4302) | 2433 | 2471 |
| R00317_PEA_1_T4 (SEQ ID NO: 4303) | 1176 | 1214 |

This segment can be found in the following protein(s): R00317_PEA_1_P6.

Segment cluster R00317_PEA_1_node_17 (SEQ ID NO:6208) according to the present invention is supported by 10 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5824 below describes the starting and ending position of this segment on each transcript.

TABLE 5824

Segment location on transcripts

| Transcript name | Segment starting position | Segment ending position |
|---|---|---|
| R00317_PEA_1_T0 (SEQ ID NO: 4302) | 2604 | 2708 |
| R00317_PEA_1_T4 (SEQ ID NO: 4303) | 1347 | 1451 |

This segment can be found in the following protein(s): R00317_PEA_1_P6.

Segment cluster R00317_PEA_1_node_21 (SEQ ID NO:6209) according to the present invention is supported by 7 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5825 below describes the starting and ending position of this segment on each transcript.

TABLE 5825

Segment location on transcripts

| Transcript name | Segment starting position | Segment ending position |
|---|---|---|
| R00317_PEA_1_T0 (SEQ ID NO: 4302) | 2871 | 2973 |
| R00317_PEA_1_T4 (SEQ ID NO: 4303) | 1614 | 1716 |

This segment can be found in the following protein(s): R00317_PEA_1_P6.

Segment cluster R00317_PEA_1_node_28 (SEQ ID NO:6210) according to the present invention is supported by 48 libraries. The number of libraries was determined as previously described. This segment can be found in the following transcript(s): R00317_PEA_1_T0 (SEQ ID NO:4302) and R00317_PEA_1_T4 (SEQ ID NO:4303). Table 5826 below describes the starting and ending position of this segment on each transcript.

TABLE 5826

Segment location on transcripts

| Transcript name | Segment starting position | Segment ending position |
|---|---|---|
| R00317_PEA_1_T0 (SEQ ID NO: 4302) | 5297 | 5351 |
| R00317_PEA_1_T4 (SEQ ID NO: 4303) | 4040 | 4094 |

This segment can be found in a non-coding region of transcript(s) that are related to the following protein(s): R00317_PEA_1_P6.

Description for Cluster D12335

Cluster D12335 features 26 transcript(s) and 57 segment(s) of interest, the names for which are given in Tables 5827 and 5828, respectively, the sequences themselves are given at the end of the application. The selected protein variants are given in Table 5829.

TABLE 5827

Transcripts of interest
Transcript Name

D12335_PEA_1_T0 (SEQ ID NO: 4304)
D12335_PEA_1_T1 (SEQ ID NO: 4305)
D12335_PEA_1_T2 (SEQ ID NO: 4306)
D12335_PEA_1_T3 (SEQ ID NO: 4307)
D12335_PEA_1_T4 (SEQ ID NO: 4308)
D12335_PEA_1_T5 (SEQ ID NO: 4309)
D12335_PEA_1_T6 (SEQ ID NO: 4310)
D12335_PEA_1_T7 (SEQ ID NO: 4311)
D12335_PEA_1_T16 (SEQ ID NO: 4312)
D12335_PEA_1_T17 (SEQ ID NO: 4313)
D12335_PEA_1_T18 (SEQ ID NO: 4314)
D12335_PEA_1_T22 (SEQ ID NO: 4315)
D12335_PEA_1_T25 (SEQ ID NO: 4316)
D12335_PEA_1_T26 (SEQ ID NO: 4317)
D12335_PEA_1_T28 (SEQ ID NO: 4318)
D12335_PEA_1_T29 (SEQ ID NO: 4319)
D12335_PEA_1_T30 (SEQ ID NO: 4320)
D12335_PEA_1_T31 (SEQ ID NO: 4321)
D12335_PEA_1_T32 (SEQ ID NO: 4322)
D12335_PEA_1_T34 (SEQ ID NO: 4323)
D12335_PEA_1_T35 (SEQ ID NO: 4324)
D12335_PEA_1_T36 (SEQ ID NO: 4325)
D12335_PEA_1_T38 (SEQ ID NO: 4326)
D12335_PEA_1_T39 (SEQ ID NO: 4327)
D12335_PEA_1_T40 (SEQ ID NO: 4328)
D12335_PEA_1_T42 (SEQ ID NO: 4329)

TABLE 5828

Segments of interest
Segment Name

D12335_PEA_1_node_0 (SEQ ID NO: 6211)
D12335_PEA_1_node_2 (SEQ ID NO: 6212)
D12335_PEA_1_node_4 (SEQ ID NO: 6213)
D12335_PEA_1_node_7 (SEQ ID NO: 6214)
D12335_PEA_1_node_9 (SEQ ID NO: 6215)
D12335_PEA_1_node_10 (SEQ ID NO: 6216)
D12335_PEA_1_node_17 (SEQ ID NO: 6217)
D12335_PEA_1_node_25 (SEQ ID NO: 6218)
D12335_PEA_1_node_28 (SEQ ID NO: 6219)
D12335_PEA_1_node_29 (SEQ ID NO: 6220)

TABLE 5828-continued

Segments of interest
Segment Name

D12335_PEA_1_node_32 (SEQ ID NO: 6221)
D12335_PEA_1_node_34 (SEQ ID NO: 6222)
D12335_PEA_1_node_35 (SEQ ID NO: 6223)
D12335_PEA_1_node_39 (SEQ ID NO: 6224)
D12335_PEA_1_node_66 (SEQ ID NO: 6225)
D12335_PEA_1_node_67 (SEQ ID NO: 6226)
D12335_PEA_1_node_5 (SEQ ID NO: 6227)
D12335_PEA_1_node_8 (SEQ ID NO: 6228)
D12335_PEA_1_node_12 (SEQ ID NO: 6229)
D12335_PEA_1_node_13 (SEQ ID NO: 6230)
D12335_PEA_1_node_14 (SEQ ID NO: 6231)
D12335_PEA_1_node_15 (SEQ ID NO: 6232)
D12335_PEA_1_node_16 (SEQ ID NO: 6233)
D12335_PEA_1_node_18 (SEQ ID NO: 6234)
D12335_PEA_1_node_19 (SEQ ID NO: 6235)
D12335_PEA_1_node_21 (SEQ ID NO: 6236)
D12335_PEA_1_node_23 (SEQ ID NO: 6237)
D12335_PEA_1_node_26 (SEQ ID NO: 6238)
D12335_PEA_1_node_27 (SEQ ID NO: 6239)
D12335_PEA_1_node_31 (SEQ ID NO: 6240)
D12335_PEA_1_node_37 (SEQ ID NO: 6241)
D12335_PEA_1_node_38 (SEQ ID NO: 6242)
D12335_PEA_1_node_40 (SEQ ID NO: 6243)
D12335_PEA_1_node_41 (SEQ ID NO: 6244)
D12335_PEA_1_node_42 (SEQ ID NO: 6245)
D12335_PEA_1_node_43 (SEQ ID NO: 6246)
D12335_PEA_1_node_44 (SEQ ID NO: 6247)
D12335_PEA_1_node_45 (SEQ ID NO: 6248)
D12335_PEA_1_node_46 (SEQ ID NO: 6249)
D12335_PEA_1_node_47 (SEQ ID NO: 6250)
D12335_PEA_1_node_48 (SEQ ID NO: 6251)
D12335_PEA_1_node_49 (SEQ ID NO: 6252)
D12335_PEA_1_node_50 (SEQ ID NO: 6253)
D12335_PEA_1_node_51 (SEQ ID NO: 6254)
D12335_PEA_1_node_52 (SEQ ID NO: 6255)
D12335_PEA_1_node_53 (SEQ ID NO: 6256)
D12335_PEA_1_node_54 (SEQ ID NO: 6257)
D12335_PEA_1_node_55 (SEQ ID NO: 6258)
D12335_PEA_1_node_56 (SEQ ID NO: 6259)
D12335_PEA_1_node_57 (SEQ ID NO: 6260)
D12335_PEA_1_node_58 (SEQ ID NO: 6261)
D12335_PEA_1_node_59 (SEQ ID NO: 6262)
D12335_PEA_1_node_60 (SEQ ID NO: 6263)
D12335_PEA_1_node_61 (SEQ ID NO: 6264)
D12335_PEA_1_node_62 (SEQ ID NO: 6265)
D12335_PEA_1_node_63 (SEQ ID NO: 6266)
D12335_PEA_1_node_65 (SEQ ID NO: 6267)

TABLE 5829

Proteins of interest

| Protein Name | Corresponding Transcript(s) |
|---|---|
| D12335_PEA_1_P20 | D12335_PEA_1_T1 (SEQ ID NO: 4305); |
| | D12335_PEA_1_T2 (SEQ ID NO: 4306); |
| | D12335_PEA_1_T3 (SEQ ID NO: 4307); |
| | D12335_PEA_1_T4 (SEQ ID NO: 4308); |
| | D12335_PEA_1_T5 (SEQ ID NO: 4309); |
| | D12335_PEA_1_T6 (SEQ ID NO: 4310) |
| D12335_PEA_1_P1 | D12335_PEA_1_T0 (SEQ ID NO: 4304); |
| | D12335_PEA_1_T7 (SEQ ID NO: 4311); |
| | D12335_PEA_1_T16 (SEQ ID NO: 4312); |
| | D12335_PEA_1_T17 (SEQ ID NO: 4313); |
| | D12335_PEA_1_T18 (SEQ ID NO: 4314); |
| | D12335_PEA_1_T22 (SEQ ID NO: 4315) |
| D12335_PEA_1_P5 | D12335_PEA_1_T25 (SEQ ID NO: 4316); |
| | D12335_PEA_1_T30 (SEQ ID NO: 4320) |
| D12335_PEA_1_P6 | D12335_PEA_1_T26 (SEQ ID NO: 4317) |
| D12335_PEA_1_P7 | D12335_PEA_1_T28 (SEQ ID NO: 4318); |
| | D12335_PEA_1_T29 (SEQ ID NO: 4319) |
| D12335_PEA_1_P8 | D12335_PEA_1_T31 (SEQ ID NO: 4321) |
| D12335_PEA_1_P11 | D12335_PEA_1_T34 (SEQ ID NO: 4323) |

TABLE 5829-continued

Proteins of interest

| Protein Name | Corresponding Transcript(s) |
|---|---|
| D12335_PEA_1_P12 | D12335_PEA_1_T35 (SEQ ID NO: 4324) |
| D12335_PEA_1_P13 | D12335_PEA_1_T36 (SEQ ID NO: 4325) |
| D12335_PEA_1_P15 | D12335_PEA_1_T38 (SEQ ID NO: 4326) |
| D12335_PEA_1_P16 | D12335_PEA_1_T39 (SEQ ID NO: 4327) |
| D12335_PEA_1_P17 | D12335_PEA_1_T40 (SEQ ID NO: 4328) |
| D12335_PEA_1_P19 | D12335_PEA_1_T42 (SEQ ID NO: 4329) |
| D12335_PEA_1_P21 | D12335_PEA_1_T32 (SEQ ID NO: 4322) |

These sequences are variants of the known protein Pyrroline-5-carboxylate reductase (SwissProt accession identifier PROC_HUMAN; known also according to the synonyms EC 1.5.1.2; P5CR; P5C reductase), referred to herein as the previously known protein.

The sequence for protein Pyrroline-5-carboxylate reductase is given at the end of the application, as "Pyrroline-5-carboxylate reductase amino acid sequence". Known polymorphisms for this sequence are as shown in Table 5830.

TABLE 5830

Amino acid mutations for Known Protein

| SNP position(s) on amino acid sequence | Comment |
|---|---|
| 155 | T -> S |

The following GO Annotation(s) apply to the previously known protein. The following annotation(s) were found: proline biosynthesis, which are annotation(s) related to Biological Process; and pyrroline 5-carboxylate reductase; oxidoreductase, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster D12335 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 140 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 140 and Table 5831. This cluster is overexpressed (at least at a minimum level) in the following pathological conditions: brain malignant tumors, epithelial malignant tumors, a mixture of malignant tumors from different tissues, kidney malignant tumors, hepatocellular carcinoma, lung malignant tumors, malignant tumors involving the lymph nodes and gastric carcinoma.

TABLE 5831

Normal tissue distribution

| Name of Tissue | Number |
|---|---|
| adrenal | 0 |
| bladder | 41 |
| bone | 64 |
| brain | 15 |
| colon | 31 |
| epithelial | 23 |
| general | 26 |
| head and neck | 0 |
| kidney | 4 |
| liver | 4 |
| lung | 22 |
| lymph nodes | 22 |
| breast | 39 |
| bone marrow | 31 |
| muscle | 27 |
| ovary | 7 |
| pancreas | 20 |
| prostate | 28 |
| skin | 34 |
| stomach | 73 |
| uterus | 31 |

TABLE 5832

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 2.1e−01 | 3.4 | 1.5e−01 | 3.6 |
| bladder | 3.3e−01 | 4.5e−01 | 1.8e−01 | 2.4 | 3.8e−01 | 1.7 |
| bone | 5.5e−01 | 2.1e−01 | 7.9e−01 | 1.1 | 5.6e−01 | 1.3 |
| brain | 4.9e−02 | 4.7e−03 | 7.7e−04 | 5.3 | 1.1e−12 | 7.8 |
| colon | 3.1e−02 | 1.4e−02 | 2.5e−01 | 2.2 | 1.6e−02 | 2.2 |
| epithelial | 1.4e−05 | 2.4e−09 | 2.6e−07 | 3.4 | 2.0e−31 | 6.9 |
| general | 3.4e−07 | 8.4e−16 | 1.5e−12 | 3.2 | 1.6e−80 | 7.5 |
| head and neck | 1.4e−01 | 4.0e−01 | 4.6e−01 | 2.2 | 4.2e−01 | 2.0 |
| kidney | 5.5e−01 | 2.4e−01 | 3.4e−01 | 2.1 | 1.6e−03 | 4.4 |
| liver | 9.1e−01 | 4.7e−01 | 1 | 0.9 | 4.5e−04 | 5.3 |
| lung | 1.3e−01 | 6.8e−02 | 1.1e−01 | 2.9 | 3.7e−07 | 4.7 |
| lymph nodes | 6.3e−01 | 1.1e−01 | 4.9e−01 | 1.6 | 8.6e−12 | 8.6 |
| breast | 2.8e−01 | 1.6e−01 | 2.2e−01 | 1.6 | 2.5e−01 | 1.4 |
| bone marrow | 8.8e−01 | 3.0e−01 | 1 | 0.5 | 2.3e−01 | 2.4 |
| muscle | 5.2e−01 | 2.9e−01 | 1 | 0.9 | 2.2e−07 | 1.8 |
| ovary | 5.3e−01 | 3.2e−01 | 6.8e−01 | 1.3 | 7.0e−02 | 1.9 |
| pancreas | 5.2e−01 | 1.7e−01 | 8.1e−01 | 0.8 | 1.8e−02 | 1.5 |
| prostate | 5.3e−01 | 4.3e−01 | 3.0e−02 | 2.9 | 1.1e−02 | 3.1 |
| skin | 9.2e−01 | 2.0e−01 | 1 | 0.3 | 1.4e−02 | 2.0 |
| stomach | 3.7e−01 | 7.5e−02 | 5.0e−01 | 1.0 | 1.9e−07 | 3.8 |
| uterus | 1.1e−01 | 1.1e−01 | 7.1e−02 | 2.3 | 8.4e−02 | 2.1 |

As noted above, cluster D12335 features 57 segment(s), which were listed in Table 5828 above and for which the sequence(s) are given at the end of the application. These segment(s) are portions of nucleic acid sequence(s) which are described herein separately because they are of particular interest. A description of each segment according to the present invention is now provided.

Segment cluster D12335_PEA_1_node_0 (SEQ ID NO:6211) according to the present invention is supported by 1 libraries. The number of libraries was determined as previously described. This segment can be found in the following transcript(s): D12335_PEA_1_T42 (SEQ ID NO:4329). Table 5833 below describes the starting and ending position of this segment on each transcript.

TABLE 5833

Segment location on transcripts

| Transcript name | Segment starting position | Segment ending position |
|---|---|---|
| D12335_PEA_1_T42 (SEQ ID NO: 4329) | 1 | 216 |

This segment can be found in the following protein(s): D12335_PEA_1_P19.

Segment cluster D12335_PEA_1_node_2 (SEQ ID NO:6212) according to the present invention is supported by 1 libraries. The number of libraries was determined as previously described. This segment can be found in the following transcript(s): D12335_PEA_1_T28 (SEQ ID NO:4318) and D12335_PEA_1_T40 (SEQ ID NO:4328). Table 5834 below describes the starting and ending position of this segment on each transcript.

TABLE 5834

Segment location on transcripts

| Transcript name | Segment starting position | Segment ending position |
|---|---|---|
| D12335_PEA_1_T28 (SEQ ID NO: 4318) | 1 | 175 |
| D12335_PEA_1_T40 (SEQ ID NO: 4328) | 1 | 175 |

This segment can be found in a non-coding region of transcript(s) that are related to the following protein(s): D12335_PEA_1_P7 and D12335_PEA_1_P17.

Segment cluster D12335_PEA_1_node_4 (SEQ ID NO:6213) according to the present invention is supported by 2 libraries. The number of libraries was determined as previously described. This segment can be found in the following transcript(s): D12335_PEA_1_T29 (SEQ ID NO:4319). Table 5835 below describes the starting and ending position of this segment on each transcript.

TABLE 5835

Segment location on transcripts

| Transcript name | Segment starting position | Segment ending position |
|---|---|---|
| D12335_PEA_1_T29 (SEQ ID NO: 4319) | 1 | 167 |

This segment can be found in a non-coding region of transcript(s) that are related to the following protein(s): D12335_PEA_1_P7.

Segment cluster D12335_PEA_1_node_7 (SEQ ID NO:6214) according to the present invention is supported by 8 libraries. The number of libraries was determined as previously described. This segment can be found in the following transcript(s): D12335_PEA_1_T28 (SEQ ID NO:4318) and D12335_PEA_1_T40 (SEQ ID NO:4328). Table 5836 below describes the starting and ending position of this segment on each transcript.

TABLE 5836

| Segment location on transcripts | | |
|---|---|---|
| Transcript name | Segment starting position | Segment ending position |
| D12335_PEA_1_T28 (SEQ ID NO: 4318) | 254 | 1248 |
| D12335_PEA_1_T40 (SEQ ID NO: 4328) | 254 | 1248 |

This segment can be found in both coding and non-coding regions of transcript(s) as follows. The segment can be found in a non-coding region of transcript(s) that are related to the following protein(s): D12335_PEA_1_P7. This segment can also be found in the following protein(s): D12335_PEA_1_P17, since it is in the coding region for the corresponding transcript.

Segment cluster D12335_PEA_1_node_9 (SEQ ID NO:6215) according to the present invention is supported by 10 libraries. The number of libraries was determined as previously described. This segment can be found in the following transcript(s): D12335_PEA_1_T40 (SEQ ID NO:4328). Table 5837 below describes the starting and ending position of this segment on each transcript.

TABLE 5837

| Segment location on transcripts | | |
|---|---|---|
| Transcript name | Segment starting position | Segment ending position |
| D12335_PEA_1_T40 (SEQ ID NO: 4328) | 1347 | 2116 |

This segment can be found in a non-coding region of transcript(s) that are related to the following protein(s): D12335_PEA_1_P17.

Segment cluster D12335_PEA_1_node_10 (SEQ ID NO:6216) according to the present invention is supported by 9 libraries. The number of libraries was determined as previously described. This segment can be found in the following transcript(s): D12335_PEA_1_T40 (SEQ ID NO:4328). Table 5838 below describes the starting and ending position of this segment on each transcript.

TABLE 5838

| Segment location on transcripts | | |
|---|---|---|
| Transcript name | Segment starting position | Segment ending position |
| D12335_PEA_1_T40 (SEQ ID NO: 4328) | 2117 | 2451 |

This segment can be found in a non-coding region of transcript(s) that are related to the following protein(s): D12335_PEA_1_P17.

Segment cluster D12335_PEA_1_node_17 (SEQ ID NO:6217) according to the present invention is supported by 22 libraries. The number of libraries was determined as previously described. This segment can be found in the following transcript(s): D12335_PEA_1_T0 (SEQ ID NO:4304), D12335_PEA_1_T5 (SEQ ID NO:4309), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5839 below describes the starting and ending position of this segment on each transcript.

TABLE 5839

| Segment location on transcripts | | |
|---|---|---|
| Transcript name | Segment starting position | Segment ending position |
| D12335_PEA_1_T0 (SEQ ID NO: 4304) | 149 | 358 |
| D12335_PEA_1_T5 (SEQ ID NO: 4309) | 149 | 358 |
| D12335_PEA_1_T7 (SEQ ID NO: 4311) | 149 | 358 |
| D12335_PEA_1_T16 (SEQ ID NO: 4312) | 149 | 358 |
| D12335_PEA_1_T17 (SEQ ID NO: 4313) | 149 | 358 |
| D12335_PEA_1_T18 (SEQ ID NO: 4314) | 149 | 358 |
| D12335_PEA_1_T22 (SEQ ID NO: 4315) | 149 | 358 |
| D12335_PEA_1_T25 (SEQ ID NO: 4316) | 149 | 358 |
| D12335_PEA_1_T26 (SEQ ID NO: 4317) | 149 | 358 |
| D12335_PEA_1_T30 (SEQ ID NO: 4320) | 149 | 358 |
| D12335_PEA_1_T31 (SEQ ID NO: 4321) | 149 | 358 |
| D12335_PEA_1_T32 (SEQ ID NO: 4322) | 149 | 358 |
| D12335_PEA_1_T34 (SEQ ID NO: 4323) | 149 | 358 |
| D12335_PEA_1_T35 (SEQ ID NO: 4324) | 149 | 358 |
| D12335_PEA_1_T38 (SEQ ID NO: 4326) | 149 | 358 |
| D12335_PEA_1_T39 (SEQ ID NO: 4327) | 149 | 358 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_25 (SEQ ID NO:6218) according to the present invention is supported by 155 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5840 below describes the starting and ending position of this segment on each transcript.

TABLE 5840

Segment location on transcripts

| Transcript name | Segment starting position | Segment ending position |
|---|---|---|
| D12335_PEA_1_T0 (SEQ ID NO: 4304) | 652 | 786 |
| D12335_PEA_1_T1 (SEQ ID NO: 4305) | 252 | 386 |
| D12335_PEA_1_T2 (SEQ ID NO: 4306) | 334 | 468 |
| D12335_PEA_1_T3 (SEQ ID NO: 4307) | 272 | 406 |
| D12335_PEA_1_T4 (SEQ ID NO: 4308) | 256 | 390 |
| D12335_PEA_1_T5 (SEQ ID NO: 4309) | 544 | 678 |
| D12335_PEA_1_T6 (SEQ ID NO: 4310) | 321 | 455 |
| D12335_PEA_1_T7 (SEQ ID NO: 4311) | 652 | 786 |
| D12335_PEA_1_T16 (SEQ ID NO: 4312) | 652 | 786 |
| D12335_PEA_1_T17 (SEQ ID NO: 4313) | 652 | 786 |
| D12335_PEA_1_T18 (SEQ ID NO: 4314) | 652 | 786 |
| D12335_PEA_1_T22 (SEQ ID NO: 4315) | 652 | 786 |
| D12335_PEA_1_T25 (SEQ ID NO: 4316) | 652 | 786 |
| D12335_PEA_1_T26 (SEQ ID NO: 4317) | 652 | 786 |
| D12335_PEA_1_T28 (SEQ ID NO: 4318) | 1418 | 1552 |
| D12335_PEA_1_T29 (SEQ ID NO: 4319) | 317 | 451 |
| D12335_PEA_1_T30 (SEQ ID NO: 4320) | 652 | 786 |
| D12335_PEA_1_T31 (SEQ ID NO: 4321) | 652 | 786 |
| D12335_PEA_1_T32 (SEQ ID NO: 4322) | 652 | 786 |
| D12335_PEA_1_T34 (SEQ ID NO: 4323) | 652 | 786 |
| D12335_PEA_1_T35 (SEQ ID NO: 4324) | 652 | 786 |
| D12335_PEA_1_T38 (SEQ ID NO: 4326) | 652 | 786 |
| D12335_PEA_1_T39 (SEQ ID NO: 4327) | 652 | 786 |

This segment can be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_28 (SEQ ID NO:6219) according to the present invention is supported by 1 libraries. The number of libraries was determined as previously described. This segment can be found in the following transcript(s): D12335_PEA_1_T32 (SEQ ID NO:4322). Table 5841 below describes the starting and ending position of this segment on each transcript.

TABLE 5841

Segment location on transcripts

| Transcript name | Segment starting position | Segment ending position |
|---|---|---|
| D12335_PEA_1_T32 (SEQ ID NO: 4322) | 832 | 1020 |

This segment can be found in the following protein(s): D12335_PEA_1_P21.

Segment cluster D12335_PEA_1_node_29 (SEQ ID NO:6220) according to the present invention is supported by 166 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T36 (SEQ ID NO:4325) and D12335_PEA_1_T38 (SEQ ID NO:4326). Table 5842 below describes the starting and ending position of this segment on each transcript.

TABLE 5842

Segment location on transcripts

| Transcript name | Segment starting position | Segment ending position |
|---|---|---|
| D12335_PEA_1_T0 (SEQ ID NO: 4304) | 832 | 1053 |
| D12335_PEA_1_T1 (SEQ ID NO: 4305) | 432 | 653 |
| D12335_PEA_1_T2 (SEQ ID NO: 4306) | 514 | 735 |
| D12335_PEA_1_T3 (SEQ ID NO: 4307) | 452 | 673 |
| D12335_PEA_1_T4 (SEQ ID NO: 4308) | 436 | 657 |
| D12335_PEA_1_T5 (SEQ ID NO: 4309) | 724 | 945 |
| D12335_PEA_1_T6 (SEQ ID NO: 4310) | 501 | 722 |
| D12335_PEA_1_T7 (SEQ ID NO: 4311) | 832 | 1053 |
| D12335_PEA_1_T16 (SEQ ID NO: 4312) | 832 | 1053 |
| D12335_PEA_1_T17 (SEQ ID NO: 4313) | 832 | 1053 |
| D12335_PEA_1_T18 (SEQ ID NO: 4314) | 832 | 1053 |
| D12335_PEA_1_T22 (SEQ ID NO: 4315) | 832 | 1053 |
| D12335_PEA_1_T25 (SEQ ID NO: 4316) | 832 | 1053 |
| D12335_PEA_1_T26 (SEQ ID NO: 4317) | 832 | 1053 |

TABLE 5842-continued

Segment location on transcripts

| Transcript name | Segment starting position | Segment ending position |
|---|---|---|
| D12335_PEA_1_T28 (SEQ ID NO: 4318) | 1598 | 1819 |
| D12335_PEA_1_T29 (SEQ ID NO: 4319) | 497 | 718 |
| D12335_PEA_1_T30 (SEQ ID NO: 4320) | 832 | 1053 |
| D12335_PEA_1_T31 (SEQ ID NO: 4321) | 832 | 1053 |
| D12335_PEA_1_T32 (SEQ ID NO: 4322) | 1021 | 1242 |
| D12335_PEA_1_T34 (SEQ ID NO: 4323) | 832 | 1053 |
| D12335_PEA_1_T35 (SEQ ID NO: 4324) | 832 | 1053 |
| D12335_PEA_1_T36 (SEQ ID NO: 4325) | 252 | 473 |
| D12335_PEA_1_T38 (SEQ ID NO: 4326) | 832 | 1053 |

This segment can be found in both coding and non-coding regions of transcript(s) as follows. The segment can be found in a non-coding region of transcript(s) that are related to the following protein(s): D12335_PEA_1_P21. This segment can also be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P11, D12335_PEA_1_P12, D12335_PEA_1_P13 and D12335_PEA_1_P15, since it is in the coding region for the corresponding transcript.

Segment cluster D12335_PEA_1_node_32 (SEQ ID NO:6221) according to the present invention is supported by 1 libraries. The number of libraries was determined as previously described. This segment can be found in the following transcript(s): D12335_PEA_1_T38 (SEQ ID NO:4326). Table 5843 below describes the starting and ending position of this segment on each transcript.

TABLE 5843

Segment location on transcripts

| Transcript name | Segment starting position | Segment ending position |
|---|---|---|
| D12335_PEA_1_T38 (SEQ ID NO: 4326) | 1147 | 1307 |

This segment can be found in the following protein(s): D12335_PEA_1_P15.

Segment cluster D12335_PEA_1_node_34 (SEQ ID NO:6222) according to the present invention is supported by 115 libraries. The number of libraries was determined as previously described. This segment can be found in the following transcript(s): D12335_PEA-1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T35 (SEQ ID NO:4324) and D12335_PEA_1_T36 (SEQ ID NO:4325). Table 5844 below describes the starting and ending position of this segment on each transcript.

TABLE 5844

Segment location on transcripts

| Transcript name | Segment starting position | Segment ending position |
|---|---|---|
| D12335_PEA_1_T0 (SEQ ID NO: 4304) | 1147 | 1310 |
| D12335_PEA_1_T1 (SEQ ID NO: 4305) | 747 | 910 |
| D12335_PEA_1_T2 (SEQ ID NO: 4306) | 829 | 992 |
| D12335_PEA_1_T3 (SEQ ID NO: 4307) | 767 | 930 |
| D12335_PEA_1_T4 (SEQ ID NO: 4308) | 751 | 914 |
| D12335_PEA_1_T5 (SEQ ID NO: 4309) | 1039 | 1202 |
| D12335_PEA_1_T6 (SEQ ID NO: 4310) | 816 | 979 |
| D12335_PEA_1_T7 (SEQ ID NO: 4311) | 1147 | 1310 |
| D12335_PEA_1_T16 (SEQ ID NO: 4312) | 1147 | 1310 |
| D12335_PEA_1_T17 (SEQ ID NO: 4313) | 1147 | 1310 |
| D12335_PEA_1_T18 (SEQ ID NO: 4314) | 1147 | 1310 |
| D12335_PEA_1_T22 (SEQ ID NO: 4315) | 1147 | 1310 |
| D12335_PEA_1_T25 (SEQ ID NO: 4316) | 1147 | 1310 |
| D12335_PEA_1_T28 (SEQ ID NO: 4318) | 1913 | 2076 |
| D12335_PEA_1_T29 (SEQ ID NO: 4319) | 812 | 975 |
| D12335_PEA_1_T30 (SEQ ID NO: 4320) | 1147 | 1310 |
| D12335_PEA_1_T31 (SEQ ID NO: 4321) | 1054 | 1217 |
| D12335_PEA_1_T32 (SEQ ID NO: 4322) | 1336 | 1499 |
| D12335_PEA_1_T35 (SEQ ID NO: 4324) | 1147 | 1310 |
| D12335_PEA_1_T36 (SEQ ID NO: 4325) | 567 | 730 |

This segment can be found in both coding and non-coding regions of transcript(s) as follows. The segment can be found in a non-coding region of transcript(s) that are related to the following protein(s): D12335_PEA_1_P21. This segment can also be found in the following protein(s): D12335_PEA_1_P1, D12335_PEA_1_P20, D12335_PEA_1_P5, D12335_PEA_1_P7, D12335_PEA_1_P8, D12335_PEA_1_P12 and D12335_PEA_1_P13, since it is in the coding region for the corresponding transcript.

Segment cluster D12335_PEA_1_node_35 (SEQ ID NO:6223) according to the present invention is supported by 6 libraries. The number of libraries was determined as previously described. This segment can be found in the following transcript(s): D12335_PEA_1_T35 (SEQ ID NO:4324). Table 5845 below describes the starting and ending position of this segment on each transcript.

TABLE 5845

Segment location on transcripts

| Transcript name | Segment starting position | Segment ending position |
|---|---|---|
| D12335_PEA_1_T35 (SEQ ID NO: 4324) | 1311 | 1951 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5846.

TABLE 5846

Oligonucleotides related to this segment

| Oligonucleotide name | Overexpressed in cancers | Chip reference |
|---|---|---|
| D12335_0_0_3895 | colorectal cancer | Colon |

This segment can be found in the following protein(s): D12335_PEA_1_P12.

Segment cluster D12335_PEA_1_node_39 (SEQ ID NO:6224) according to the present invention is supported by 126 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323) and D12335_PEA_1_T36 (SEQ ID NO:4325). Table 5847 below describes the starting and ending position of this segment on each transcript.

TABLE 5847

Segment location on transcripts

| Transcript name | Segment starting position | Segment ending position |
|---|---|---|
| D12335_PEA_1_T0 (SEQ ID NO: 4304) | 1449 | 1580 |
| D12335_PEA_1_T1 (SEQ ID NO: 4305) | 1049 | 1180 |
| D12335_PEA_1_T2 (SEQ ID NO: 4306) | 1131 | 1262 |
| D12335_PEA_1_T3 (SEQ ID NO: 4307) | 1069 | 1200 |
| D12335_PEA_1_T4 (SEQ ID NO: 4308) | 1053 | 1184 |
| D12335_PEA_1_T5 (SEQ ID NO: 4309) | 1341 | 1472 |
| D12335_PEA_1_T6 (SEQ ID NO: 4310) | 1118 | 1249 |
| D12335_PEA_1_T7 (SEQ ID NO: 4311) | 1449 | 1580 |
| D12335_PEA_1_T16 (SEQ ID NO: 4312) | 1449 | 1580 |
| D12335_PEA_1_T17 (SEQ ID NO: 4313) | 1449 | 1580 |
| D12335_PEA_1_T18 (SEQ ID NO: 4314) | 1449 | 1580 |
| D12335_PEA_1_T22 (SEQ ID NO: 4315) | 1449 | 1580 |
| D12335_PEA_1_T26 (SEQ ID NO: 4317) | 1285 | 1416 |
| D12335_PEA_1_T28 (SEQ ID NO: 4318) | 2215 | 2346 |
| D12335_PEA_1_T29 (SEQ ID NO: 4319) | 1114 | 1245 |
| D12335_PEA_1_T31 (SEQ ID NO: 4321) | 1356 | 1487 |
| D12335_PEA_1_T32 (SEQ ID NO: 4322) | 1638 | 1769 |
| D12335_PEA_1_T34 (SEQ ID NO: 4323) | 1192 | 1323 |
| D12335_PEA_1_T36 (SEQ ID NO: 4325) | 869 | 1000 |

This segment can be found in both coding and non-coding regions of transcript(s) as follows. The segment can be found in a non-coding region of transcript(s) that are related to the following protein(s): D12335_PEA_1_P6, D12335_PEA_1_P21 and D12335_PEA_1_P11. This segment can also be found in the following protein(s): D12335_PEA_1_P1, D12335_PEA_1_P20, D12335_PEA_1_P7, D12335_PEA_1_P8 and D12335_PEA_1_P13, since it is in the coding region for the corresponding transcript.

Segment cluster D12335_PEA_1_node_66 (SEQ ID NO:6225) according to the present invention is supported by 140 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5848 below describes the starting and ending position of this segment on each transcript.

TABLE 5848

Segment location on transcripts

| Transcript name | Segment starting position | Segment ending position |
|---|---|---|
| D12335_PEA_1_T0 (SEQ ID NO: 4304) | 2179 | 2295 |
| D12335_PEA_1_T1 (SEQ ID NO: 4305) | 1779 | 1895 |
| D12335_PEA_1_T2 (SEQ ID NO: 4306) | 1861 | 1977 |
| D12335_PEA_1_T3 (SEQ ID NO: 4307) | 1799 | 1915 |
| D12335_PEA_1_T4 (SEQ ID NO: 4308) | 1783 | 1899 |
| D12335_PEA_1_T5 (SEQ ID NO: 4309) | 2071 | 2187 |
| D12335_PEA_1_T6 (SEQ ID NO: 4310) | 1848 | 1964 |
| D12335_PEA_1_T7 (SEQ ID NO: 4311) | 2179 | 2609 |
| D12335_PEA_1_T16 (SEQ ID NO: 4312) | 2029 | 2145 |
| D12335_PEA_1_T17 (SEQ ID NO: 4313) | 1771 | 1887 |
| D12335_PEA_1_T18 (SEQ ID NO: 4314) | 1771 | 2201 |
| D12335_PEA_1_T22 (SEQ ID NO: 4315) | 1708 | 1824 |
| D12335_PEA_1_T25 (SEQ ID NO: 4316) | 1836 | 1952 |
| D12335_PEA_1_T26 (SEQ ID NO: 4317) | 2015 | 2131 |
| D12335_PEA_1_T28 (SEQ ID NO: 4318) | 2945 | 3061 |
| D12335_PEA_1_T29 (SEQ ID NO: 4319) | 1844 | 1960 |
| D12335_PEA_1_T30 (SEQ ID NO: 4320) | 1836 | 2266 |
| D12335_PEA_1_T31 (SEQ ID NO: 4321) | 2086 | 2202 |
| D12335_PEA_1_T32 (SEQ ID NO: 4322) | 2368 | 2484 |
| D12335_PEA_1_T34 (SEQ ID NO: 4323) | 1922 | 2038 |
| D12335_PEA_1_T36 (SEQ ID NO: 4325) | 1599 | 1715 |
| D12335_PEA_1_T39 (SEQ ID NO: 4327) | 1430 | 1546 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_67 (SEQ ID NO:6226) according to the present invention is supported by 2 libraries. The number of libraries was determined as previously described. This segment can be found in the following transcript(s): D12335_PEA_1_T7 (SEQ ID NO:4311), D12335_PEA_1_T18 (SEQ ID NO:4314), D12335_PEA_1_T30 (SEQ ID NO:4320) and D12335_PEA_1_T42 (SEQ ID NO:4329). Table 5849 below describes the starting and ending position of this segment on each transcript.

TABLE 5849

Segment location on transcripts

| Transcript name | Segment starting position | Segment ending position |
|---|---|---|
| D12335_PEA_1_T7 (SEQ ID NO: 4311) | 2610 | 2854 |
| D12335_PEA_1_T18 (SEQ ID NO: 4314) | 2202 | 2446 |
| D12335_PEA_1_T30 (SEQ ID NO: 4320) | 2267 | 2511 |
| D12335_PEA_1_T42 (SEQ ID NO: 4329) | 217 | 461 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 5850.

TABLE 5850

Oligonucleotides related to this segment

| Oligonucleotide name | Overexpressed in cancers | Chip reference |
|---|---|---|
| D12335_0_1_3906 | colorectal cancer | Colon |

This segment can be found in both coding and non-coding regions of transcript(s) as follows. The segment can be found in a non-coding region of transcript(s) that are related to the following protein(s): D12335_PEA_1_P1 and D12335_PEA_1_P5. This segment can also be found in the following protein(s): D12335_PEA_1_P19, since it is in the coding region for the corresponding transcript.

According to an optional embodiment of the present invention, short segments related to the above cluster are also provided. These segments are up to about 120 bp in length, and so are included in a separate description.

Segment cluster D12335_PEA_1_node_5 (SEQ ID NO:6227) according to the present invention is supported by 5 libraries. The number of libraries was determined as previously described. This segment can be found in the following transcript(s): D12335_PEA_1_T28 (SEQ ID NO:4318), D12335_PEA_1_T29 (SEQ ID NO:4319) and D12335_PEA_1_T40 (SEQ ID NO:4328). Table 5851 below describes the starting and ending position of this segment on each transcript.

TABLE 5851

Segment location on transcripts

| Transcript name | Segment starting position | Segment ending position |
|---|---|---|
| D12335_PEA_1_T28 (SEQ ID NO: 4318) | 176 | 253 |
| D12335_PEA_1_T29 (SEQ ID NO: 4319) | 168 | 245 |
| D12335_PEA_1_T40 (SEQ ID NO: 4328) | 176 | 253 |

This segment can be found in a non-coding region of transcript(s) that are related to the following protein(s): D12335_PEA_1_P7 and D12335_PEA_1_P17.

Segment cluster D12335_PEA_1_node_8 (SEQ ID NO:6228) according to the present invention is supported by 4 libraries. The number of libraries was determined as previously described. This segment can be found in the following transcript(s): D12335_PEA_1_T28 (SEQ ID NO:4318) and D12335_PEA_1_T40 (SEQ ID NO:4328). Table 5852 below describes the starting and ending position of this segment on each transcript.

TABLE 5852

Segment location on transcripts

| Transcript name | Segment starting position | Segment ending position |
| --- | --- | --- |
| D12335_PEA_1_T28 (SEQ ID NO: 4318) | 1249 | 1346 |
| D12335_PEA_1_T40 (SEQ ID NO: 4328) | 1249 | 1346 |

This segment can be found in both coding and non-coding regions of transcript(s) as follows. The segment can be found in a non-coding region of transcript(s) that are related to the following protein(s): D12335_PEA_1_P7. This segment can also be found in the following protein(s): D12335_PEA_1_P17, since it is in the coding region for the corresponding transcript.

Segment cluster D12335_PEA_1_node_12 (SEQ ID NO:6229) according to the present invention is supported by 15 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T36 (SEQ ID NO:4325), D12335_PEA_1_T38 (SEQ ID NO:4326) and D12335_PEA_1_T39 (SEQ ID NO:4327). Table 5853 below describes the starting and ending position of this segment on each transcript.

TABLE 5853

Segment location on transcripts

| Transcript name | Segment starting position | Segment ending position |
| --- | --- | --- |
| D12335_PEA_1_T0 (SEQ ID NO: 4304) | 1 | 66 |
| D12335_PEA_1_T1 (SEQ ID NO: 4305) | 1 | 66 |
| D12335_PEA_1_T2 (SEQ ID NO: 4306) | 1 | 66 |
| D12335_PEA_1_T3 (SEQ ID NO: 4307) | 1 | 66 |
| D12335_PEA_1_T4 (SEQ ID NO: 4308) | 1 | 66 |
| D12335_PEA_1_T5 (SEQ ID NO: 4309) | 1 | 66 |
| D12335_PEA_1_T6 (SEQ ID NO: 4310) | 1 | 66 |
| D12335_PEA_1_T7 (SEQ ID NO: 4311) | 1 | 66 |
| D12335_PEA_1_T16 (SEQ ID NO: 4312) | 1 | 66 |
| D12335_PEA_1_T17 (SEQ ID NO: 4313) | 1 | 66 |
| D12335_PEA_1_T18 (SEQ ID NO: 4314) | 1 | 66 |
| D12335_PEA_1_T22 (SEQ ID NO: 4315) | 1 | 66 |
| D12335_PEA_1_T25 (SEQ ID NO: 4316) | 1 | 66 |
| D12335_PEA_1_T26 (SEQ ID NO: 4317) | 1 | 66 |
| D12335_PEA_1_T30 (SEQ ID NO: 4320) | 1 | 66 |
| D12335_PEA_1_T31 (SEQ ID NO: 4321) | 1 | 66 |
| D12335_PEA_1_T32 (SEQ ID NO: 4322) | 1 | 66 |
| D12335_PEA_1_T34 (SEQ ID NO: 4323) | 1 | 66 |
| D12335_PEA_1_T35 (SEQ ID NO: 4324) | 1 | 66 |
| D12335_PEA_1_T36 (SEQ ID NO: 4325) | 1 | 66 |
| D12335_PEA_1_T38 (SEQ ID NO: 4326) | 1 | 66 |
| D12335_PEA_1_T39 (SEQ ID NO: 4327) | 1 | 66 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P13, D12335_PEA_1_P15 and D123352PEA_1_P16.

Segment cluster D12335_PEA_1_node_13 (SEQ ID NO:6230) according to the present invention can be found in the following transcript(s): D12335_PEA_1_T0 (SEQ ID NO:4304), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5854 below describes the starting and ending position of this segment on each transcript.

TABLE 5854

Segment location on transcripts

| Transcript name | Segment starting position | Segment ending position |
|---|---|---|
| D12335_PEA_1_T0 (SEQ ID NO: 4304) | 67 | 70 |
| D12335_PEA_1_T2 (SEQ ID NO: 4306) | 67 | 70 |
| D12335_PEA_1_T3 (SEQ ID NO: 4307) | 67 | 70 |
| D12335_PEA_1_T4 (SEQ ID NO: 4308) | 67 | 70 |
| D12335_PEA_1_T5 (SEQ ID NO: 4309) | 67 | 70 |
| D12335_PEA_1_T6 (SEQ ID NO: 4310) | 67 | 70 |
| D12335_PEA_1_T7 (SEQ ID NO: 4311) | 67 | 70 |
| D12335_PEA_1_T16 (SEQ ID NO: 4312) | 67 | 70 |
| D12335_PEA_1_T17 (SEQ ID NO: 4313) | 67 | 70 |
| D12335_PEA_1_T18 (SEQ ID NO: 4314) | 67 | 70 |
| D12335_PEA_1_T22 (SEQ ID NO: 4315) | 67 | 70 |
| D12335_PEA_1_T25 (SEQ ID NO: 4316) | 67 | 70 |
| D12335_PEA_1_T26 (SEQ ID NO: 4317) | 67 | 70 |
| D12335_PEA_1_T30 (SEQ ID NO: 4320) | 67 | 70 |
| D12335_PEA_1_T31 (SEQ ID NO: 4321) | 67 | 70 |
| D12335_PEA_1_T32 (SEQ ID NO: 4322) | 67 | 70 |
| D12335_PEA_1_T34 (SEQ ID NO: 4323) | 67 | 70 |
| D12335_PEA_1_T35 (SEQ ID NO: 4324) | 67 | 70 |
| D12335_PEA_1_T38 (SEQ ID NO: 4326) | 67 | 70 |
| D12335_PEA_1_T39 (SEQ ID NO: 4327) | 67 | 70 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_14 (SEQ ID NO:6231) according to the present invention can be found in the following transcript(s): D12335_PEA_1_T0 (SEQ ID NO:4304), D12335_PEA_1_T2 (SEQ ID NO:4306), D12335_PEA_1_T3 (SEQ ID NO:4307), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5855 below describes the starting and ending position of this segment on each transcript.

TABLE 5855

Segment location on transcripts

| Transcript name | Segment starting position | Segment ending position |
|---|---|---|
| D12335_PEA_1_T0 (SEQ ID NO: 4304) | 71 | 86 |
| D12335_PEA_1_T2 (SEQ ID NO: 4306) | 71 | 86 |
| D12335_PEA_1_T3 (SEQ ID NO: 4307) | 71 | 86 |
| D12335_PEA_1_T5 (SEQ ID NO: 4309) | 71 | 86 |
| D12335_PEA_1_T6 (SEQ ID NO: 4310) | 71 | 86 |
| D12335_PEA_1_T7 (SEQ ID NO: 4311) | 71 | 86 |
| D12335_PEA_1_T16 (SEQ ID NO: 4312) | 71 | 86 |
| D12335_PEA_1_T17 (SEQ ID NO: 4313) | 71 | 86 |
| D12335_PEA_1_T18 (SEQ ID NO: 4314) | 71 | 86 |
| D12335_PEA_1_T22 (SEQ ID NO: 4315) | 71 | 86 |
| D12335_PEA_1_T25 (SEQ ID NO: 4316) | 71 | 86 |
| D12335_PEA_1_T26 (SEQ ID NO: 4317) | 71 | 86 |
| D12335_PEA_1_T30 (SEQ ID NO: 4320) | 71 | 86 |
| D12335_PEA_1_T31 (SEQ ID NO: 4321) | 71 | 86 |
| D12335_PEA_1_T32 (SEQ ID NO: 4322) | 71 | 86 |
| D12335_PEA_1_T34 (SEQ ID NO: 4323) | 71 | 86 |
| D12335_PEA_1_T35 (SEQ ID NO: 4324) | 71 | 86 |
| D12335_PEA_1_T38 (SEQ ID NO: 4326) | 71 | 86 |
| D12335_PEA_1_T39 (SEQ ID NO: 4327) | 71 | 86 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_15 (SEQ ID NO:6232) according to the present invention is supported by 20 libraries. The number of libraries was determined as previously described. This segment can be found in the following transcript(s): D12335_PEA_1_T0 (SEQ ID NO:4304), D12335_PEA_1_T2 (SEQ ID NO:4306), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5856 below describes the starting and ending position of this segment on each transcript.

TABLE 5856

Segment location on transcripts

| Transcript name | Segment starting position | Segment ending position |
|---|---|---|
| D12335_PEA_1_T0 (SEQ ID NO: 4304) | 87 | 135 |
| D12335_PEA_1_T2 (SEQ ID NO: 4306) | 87 | 135 |
| D12335_PEA_1_T5 (SEQ ID NO: 4309) | 87 | 135 |
| D12335_PEA_1_T6 (SEQ ID NO: 4310) | 87 | 135 |
| D12335_PEA_1_T7 (SEQ ID NO: 4311) | 87 | 135 |
| D12335_PEA_1_T16 (SEQ ID NO: 4312) | 87 | 135 |
| D12335_PEA_1_T17 (SEQ ID NO: 4313) | 87 | 135 |
| D12335_PEA_1_T18 (SEQ ID NO: 4314) | 87 | 135 |
| D12335_PEA_1_T22 (SEQ ID NO: 4315) | 87 | 135 |
| D12335_PEA_1_T25 (SEQ ID NO: 4316) | 87 | 135 |
| D12335_PEA_1_T26 (SEQ ID NO: 4317) | 87 | 135 |
| D12335_PEA_1_T30 (SEQ ID NO: 4320) | 87 | 135 |
| D12335_PEA_1_T31 (SEQ ID NO: 4321) | 87 | 135 |
| D12335_PEA_1_T32 (SEQ ID NO: 4322) | 87 | 135 |
| D12335_PEA_1_T34 (SEQ ID NO: 4323) | 87 | 135 |
| D12335_PEA_1_T35 (SEQ ID NO: 4324) | 87 | 135 |
| D12335_PEA_1_T38 (SEQ ID NO: 4326) | 87 | 135 |
| D12335_PEA_1_T39 (SEQ ID NO: 4327) | 87 | 135 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_16 (SEQ ID NO:6233) according to the present invention can be found in the following transcript(s): D12335_PEA_1_T0 (SEQ ID NO:4304), D12335_PEA_1_T2 (SEQ ID NO:4306), D12335_PEA_1_T5 (SEQ ID NO:4309), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5857 below describes the starting and ending position of this segment on each transcript.

TABLE 5857

Segment location on transcripts

| Transcript name | Segment starting position | Segment ending position |
|---|---|---|
| D12335_PEA_1_T0 (SEQ ID NO: 4304) | 136 | 148 |
| D12335_PEA_1_T2 (SEQ ID NO: 4306) | 136 | 148 |
| D12335_PEA_1_T5 (SEQ ID NO: 4309) | 136 | 148 |
| D12335_PEA_1_T7 (SEQ ID NO: 4311) | 136 | 148 |
| D12335_PEA_1_T16 (SEQ ID NO: 4312) | 136 | 148 |
| D12335_PEA_1_T17 (SEQ ID NO: 4313) | 136 | 148 |
| D12335_PEA_1_T18 (SEQ ID NO: 4314) | 136 | 148 |
| D12335_PEA_1_T22 (SEQ ID NO: 4315) | 136 | 148 |
| D12335_PEA_1_T25 (SEQ ID NO: 4316) | 136 | 148 |
| D12335_PEA_1_T26 (SEQ ID NO: 4317) | 136 | 148 |
| D12335_PEA_1_T30 (SEQ ID NO: 4320) | 136 | 148 |
| D12335_PEA_1_T31 (SEQ ID NO: 4321) | 136 | 148 |
| D12335_PEA_1_T32 (SEQ ID NO: 4322) | 136 | 148 |
| D12335_PEA_1_T34 (SEQ ID NO: 4323) | 136 | 148 |
| D12335_PEA_1_T35 (SEQ ID NO: 4324) | 136 | 148 |
| D12335_PEA_1_T38 (SEQ ID NO: 4326) | 136 | 148 |
| D12335_PEA_1_T39 (SEQ ID NO: 4327) | 136 | 148 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_18 (SEQ ID NO:6234) according to the present invention is supported by 20 libraries. The number of libraries was determined as previously described. This segment can be found in the following transcript(s): D12335_PEA_1_T0 (SEQ ID NO:4304), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5858 below describes the starting and ending position of this segment on each transcript.

TABLE 5858

Segment location on transcripts

| Transcript name | Segment starting position | Segment ending position |
|---|---|---|
| D12335_PEA_1_T0 (SEQ ID NO: 4304) | 359 | 466 |
| D12335_PEA_1_T7 (SEQ ID NO: 4311) | 359 | 466 |
| D12335_PEA_1_T16 (SEQ ID NO: 4312) | 359 | 466 |
| D12335_PEA_1_T17 (SEQ ID NO: 4313) | 359 | 466 |
| D12335_PEA_1_T18 (SEQ ID NO: 4314) | 359 | 466 |
| D12335_PEA_1_T22 (SEQ ID NO: 4315) | 359 | 466 |
| D12335_PEA_1_T25 (SEQ ID NO: 4316) | 359 | 466 |
| D12335_PEA_1_T26 (SEQ ID NO: 4317) | 359 | 466 |
| D12335_PEA_1_T30 (SEQ ID NO: 4320) | 359 | 466 |
| D12335_PEA_1_T31 (SEQ ID NO: 4321) | 359 | 466 |
| D12335_PEA_1_T32 (SEQ ID NO: 4322) | 359 | 466 |
| D12335_PEA_1_T34 (SEQ ID NO: 4323) | 359 | 466 |
| D12335_PEA_1_T35 (SEQ ID NO: 4324) | 359 | 466 |
| D12335_PEA_1_T38 (SEQ ID NO: 4326) | 359 | 466 |
| D12335_PEA_1_T39 (SEQ ID NO: 4327) | 359 | 466 |

This segment can be found in a non-coding region of transcript(s) that are related to the following protein(s): D12335_PEA_1_P1, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_19 (SEQ ID NO:6235) according to the present invention is supported by 121 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T36 (SEQ ID NO:4325), D12335_PEA_1_T38 (SEQ ID NO:4326) and D12335_PEA_1_T39 (SEQ ID NO:4327). Table 5859 below describes the starting and ending position of this segment on each transcript.

TABLE 5859

Segment location on transcripts

| Transcript name | Segment starting position | Segment ending position |
|---|---|---|
| D12335_PEA_1_T0 (SEQ ID NO: 4304) | 467 | 498 |
| D12335_PEA_1_T1 (SEQ ID NO: 4305) | 67 | 98 |
| D12335_PEA_1_T2 (SEQ ID NO: 4306) | 149 | 180 |
| D12335_PEA_1_T3 (SEQ ID NO: 4307) | 87 | 118 |
| D12335_PEA_1_T4 (SEQ ID NO: 4308) | 71 | 102 |
| D12335_PEA_1_T5 (SEQ ID NO: 4309) | 359 | 390 |
| D12335_PEA_1_T6 (SEQ ID NO: 4310) | 136 | 167 |
| D12335_PEA_1_T7 (SEQ ID NO: 4311) | 467 | 498 |
| D12335_PEA_1_T16 (SEQ ID NO: 4312) | 467 | 498 |
| D12335_PEA_1_T17 (SEQ ID NO: 4313) | 467 | 498 |
| D12335_PEA_1_T18 (SEQ ID NO: 4314) | 467 | 498 |
| D12335_PEA_1_T22 (SEQ ID NO: 4315) | 467 | 498 |
| D12335_PEA_1_T25 (SEQ ID NO: 4316) | 467 | 498 |
| D12335_PEA_1_T26 (SEQ ID NO: 4317) | 467 | 498 |
| D12335_PEA_1_T30 (SEQ ID NO: 4320) | 467 | 498 |
| D12335_PEA_1_T31 (SEQ ID NO: 4321) | 467 | 498 |
| D12335_PEA_1_T32 (SEQ ID NO: 4322) | 467 | 498 |
| D12335_PEA_1_T34 (SEQ ID NO: 4323) | 467 | 498 |
| D12335_PEA_1_T35 (SEQ ID NO: 4324) | 467 | 498 |
| D12335_PEA_1_T36 (SEQ ID NO: 4325) | 67 | 98 |
| D12335_PEA_1_T38 (SEQ ID NO: 4326) | 467 | 498 |
| D12335_PEA_1_T39 (SEQ ID NO: 4327) | 467 | 498 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P13, D12335_PEA_1_P15 and D12335_PEA_1_P16.

Segment cluster D12335_PEA_1_node_21 (SEQ ID NO:6236) according to the present invention is supported by 140 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T36 (SEQ ID NO:4325), D12335_PEA_1_T38 (SEQ ID NO:4326) and D12335_PEA_1_T39 (SEQ ID NO:4327). Table 5860 below describes the starting and ending position of this segment on each transcript.

TABLE 5860

Segment location on transcripts

| Transcript name | Segment starting position | Segment ending position |
| --- | --- | --- |
| D12335_PEA_1_T0 (SEQ ID NO: 4304) | 499 | 580 |
| D12335_PEA_1_T1 (SEQ ID NO: 4305) | 99 | 180 |
| D12335_PEA_1_T2 (SEQ ID NO: 4306) | 181 | 262 |
| D12335_PEA_1_T3 (SEQ ID NO: 4307) | 119 | 200 |
| D12335_PEA_1_T4 (SEQ ID NO: 4308) | 103 | 184 |
| D12335_PEA_1_T5 (SEQ ID NO: 4309) | 391 | 472 |
| D12335_PEA_1_T6 (SEQ ID NO: 4310) | 168 | 249 |
| D12335_PEA_1_T7 (SEQ ID NO: 4311) | 499 | 580 |
| D12335_PEA_1_T16 (SEQ ID NO: 4312) | 499 | 580 |
| D12335_PEA_1_T17 (SEQ ID NO: 4313) | 499 | 580 |
| D12335_PEA_1_T18 (SEQ ID NO: 4314) | 499 | 580 |
| D12335_PEA_1_T22 (SEQ ID NO: 4315) | 499 | 580 |
| D12335_PEA_1_T25 (SEQ ID NO: 4316) | 499 | 580 |
| D12335_PEA_1_T26 (SEQ ID NO: 4317) | 499 | 580 |
| D12335_PEA_1_T30 (SEQ ID NO: 4320) | 499 | 580 |
| D12335_PEA_1_T31 (SEQ ID NO: 4321) | 499 | 580 |
| D12335_PEA_1_T32 (SEQ ID NO: 4322) | 499 | 580 |
| D12335_PEA_1_T34 (SEQ ID NO: 4323) | 499 | 580 |
| D12335_PEA_1_T35 (SEQ ID NO: 4324) | 499 | 580 |
| D12335_PEA_1_T36 (SEQ ID NO: 4325) | 99 | 180 |
| D12335_PEA_1_T38 (SEQ ID NO: 4326) | 499 | 580 |
| D12335_PEA_1_T39 (SEQ ID NO: 4327) | 499 | 580 |

This segment can be found in the following protein(s): D12335_PEA_1_P1, D12335_PEA_1_P20, D12335_PEA_1_P5, D12335_PEA_1_P6, D12335_PEA_1_P8, D12335_PEA_1_P21, D12335_PEA_1_P11, D12335_PEA_1_P12, D12335_PEA_1_P13, D12335_PEA_1_P15 and D12335_PEA_1_P16.

Segment cluster D12335_PEA_1_node_23 (SEQ ID NO:6237) according to the present invention is supported by 146 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T36 (SEQ ID NO:4325), D12335_PEA_1_T38 (SEQ ID NO:4326) and D12335_PEA_1_T39 (SEQ ID NO:4327). Table 5861 below describes the starting and ending position of this segment on each transcript.

TABLE 5861

Segment location on transcripts

| Transcript name | Segment starting position | Segment ending position |
| --- | --- | --- |
| D12335_PEA_1_T0 (SEQ ID NO: 4304) | 581 | 651 |
| D12335_PEA_1_T1 (SEQ ID NO: 4305) | 181 | 251 |
| D12335_PEA_1_T2 (SEQ ID NO: 4306) | 263 | 333 |
| D12335_PEA_1_T3 (SEQ ID NO: 4307) | 201 | 271 |
| D12335_PEA_1_T4 (SEQ ID NO: 4308) | 185 | 255 |
| D12335_PEA_1_T5 (SEQ ID NO: 4309) | 473 | 543 |
| D12335_PEA_1_T6 (SEQ ID NO: 4310) | 250 | 320 |
| D12335_PEA_1_T7 (SEQ ID NO: 4311) | 581 | 651 |
| D12335_PEA_1_T16 (SEQ ID NO: 4312) | 581 | 651 |
| D12335_PEA_1_T17 (SEQ ID NO: 4313) | 581 | 651 |
| D12335_PEA_1_T18 (SEQ ID NO: 4314) | 581 | 651 |
| D12335_PEA_1_T22 (SEQ ID NO: 4315) | 581 | 651 |
| D12335_PEA_1_T25 (SEQ ID NO: 4316) | 581 | 651 |
| D12335_PEA_1_T26 (SEQ ID NO: 4317) | 581 | 651 |
| D12335_PEA_1_T28 (SEQ ID NO: 4318) | 1347 | 1417 |
| D12335_PEA_1_T29 (SEQ ID NO: 4319) | 246 | 316 |
| D12335_PEA_1_T30 (SEQ ID NO: 4320) | 581 | 651 |
| D12335_PEA_1_T31 (SEQ ID NO: 4321) | 581 | 651 |
| D12335_PEA_1_T32 (SEQ ID NO: 4322) | 581 | 651 |
| D12335_PEA_1_T34 (SEQ ID NO: 4323) | 581 | 651 |
| D12335_PEA_1_T35 (SEQ ID NO: 4324) | 581 | 651 |
| D12335_PEA_1_T36 (SEQ ID NO: 4325) | 181 | 251 |
| D12335_PEA_1_T38 (SEQ ID NO: 4326) | 581 | 651 |
| D12335_PEA_1_T39 (SEQ ID NO: 4327) | 581 | 651 |

This segment can be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P12, D12335_PEA_1_P13, D12335_PEA_1_P15 and D12335_PEA_1_P16.

Segment cluster D12335_PEA_1_node_26 (SEQ ID NO:6238) according to the present invention is supported by 137 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5862 below describes the starting and ending position of this segment on each transcript.

TABLE 5862

Segment location on transcripts

| Transcript name | Segment starting position | Segment ending position |
| --- | --- | --- |
| D12335_PEA_1_T0 (SEQ ID NO: 4304) | 787 | 812 |
| D12335_PEA_1_T1 (SEQ ID NO: 4305) | 387 | 412 |
| D12335_PEA_1_T2 (SEQ ID NO: 4306) | 469 | 494 |
| D12335_PEA_1_T3 (SEQ ID NO: 4307) | 407 | 432 |
| D12335_PEA_1_T4 (SEQ ID NO: 4308) | 391 | 416 |
| D12335_PEA_1_T5 (SEQ ID NO: 4309) | 679 | 704 |
| D12335_PEA_1_T6 (SEQ ID NO: 4310) | 456 | 481 |
| D12335_PEA_1_T7 (SEQ ID NO: 4311) | 787 | 812 |
| D12335_PEA_1_T16 (SEQ ID NO: 4312) | 787 | 812 |
| D12335_PEA_1_T17 (SEQ ID NO: 4313) | 787 | 812 |
| D12335_PEA_1_T18 (SEQ ID NO: 4314) | 787 | 812 |
| D12335_PEA_1_T22 (SEQ ID NO: 4315) | 787 | 812 |
| D12335_PEA_1_T25 (SEQ ID NO: 4316) | 787 | 812 |
| D12335_PEA_1_T26 (SEQ ID NO: 4317) | 787 | 812 |
| D12335_PEA_1_T28 (SEQ ID NO: 4318) | 1553 | 1578 |
| D12335_PEA_1_T29 (SEQ ID NO: 4319) | 452 | 477 |
| D12335_PEA_1_T30 (SEQ ID NO: 4320) | 787 | 812 |
| D12335_PEA_1_T31 (SEQ ID NO: 4321) | 787 | 812 |
| D12335_PEA_1_T32 (SEQ ID NO: 4322) | 787 | 812 |
| D12335_PEA_1_T34 (SEQ ID NO: 4323) | 787 | 812 |
| D12335_PEA_1_T35 (SEQ ID NO: 4324) | 787 | 812 |
| D12335_PEA_1_T38 (SEQ ID NO: 4326) | 787 | 812 |
| D12335_PEA_1_T39 (SEQ ID NO: 4327) | 787 | 812 |

This segment can be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_27 (SEQ ID NO:6239) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T35 (SEQ ID NO:4324), D12335_PEA_1_T38 (SEQ ID NO:4326) and D12335_PEA_1_T39 (SEQ ID NO:4327). Table 5863 below describes the starting and ending position of this segment on each transcript.

TABLE 5863

Segment location on transcripts

| Transcript name | Segment starting position | Segment ending position |
| --- | --- | --- |
| D12335_PEA_1_T0 (SEQ ID NO: 4304) | 813 | 831 |
| D12335_PEA_1_T1 (SEQ ID NO: 4305) | 413 | 431 |
| D12335_PEA_1_T2 (SEQ ID NO: 4306) | 495 | 513 |
| D12335_PEA_1_T3 (SEQ ID NO: 4307) | 433 | 451 |
| D12335_PEA_1_T4 (SEQ ID NO: 4308) | 417 | 435 |
| D12335_PEA_1_T5 (SEQ ID NO: 4309) | 705 | 723 |
| D12335_PEA_1_T6 (SEQ ID NO: 4310) | 482 | 500 |
| D12335_PEA_1_T7 (SEQ ID NO: 4311) | 813 | 831 |
| D12335_PEA_1_T16 (SEQ ID NO: 4312) | 813 | 831 |
| D12335_PEA_1_T17 (SEQ ID NO: 4313) | 813 | 831 |

TABLE 5863-continued

Segment location on transcripts

| Transcript name | Segment starting position | Segment ending position |
|---|---|---|
| D12335_PEA_1_T18 (SEQ ID NO: 4314) | 813 | 831 |
| D12335_PEA_1_T22 (SEQ ID NO: 4315) | 813 | 831 |
| D12335_PEA_1_T25 (SEQ ID NO: 4316) | 813 | 831 |
| D12335_PEA_1_T26 (SEQ ID NO: 4317) | 813 | 831 |
| D12335_PEA_1_T28 (SEQ ID NO: 4318) | 1579 | 1597 |
| D12335_PEA_1_T29 (SEQ ID NO: 4319) | 478 | 496 |
| D12335_PEA_1_T30 (SEQ ID NO: 4320) | 813 | 831 |
| D12335_PEA_1_T31 (SEQ ID NO: 4321) | 813 | 831 |
| D12335_PEA_1_T32 (SEQ ID NO: 4322) | 813 | 831 |
| D12335_PEA_1_T34 (SEQ ID NO: 4323) | 813 | 831 |
| D12335_PEA_1_T35 (SEQ ID NO: 4324) | 813 | 831 |
| D12335_PEA_1_T38 (SEQ ID NO: 4326) | 813 | 831 |
| D12335_PEA_1_T39 (SEQ ID NO: 4327) | 813 | 831 |

This segment can be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P12, D12335_PEA_1_P15 and D12335_PEA_1_P16.

Segment cluster D12335_PEA_1_node_31 (SEQ ID NO:6240) according to the present invention is supported by 128 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T32 (SEQ ID NO:4322), D12335_PEA_1_T35 (SEQ ID NO:4324), D12335_PEA_1_T36 (SEQ ID NO:4325) and D12335_PEA_1_T38 (SEQ ID NO:4326). Table 5864 below describes the starting and ending position of this segment on each transcript.

TABLE 5864

Segment location on transcripts

| Transcript name | Segment starting position | Segment ending position |
|---|---|---|
| D12335_PEA_1_T0 (SEQ ID NO: 4304) | 1054 | 1146 |
| D12335_PEA_1_T1 (SEQ ID NO: 4305) | 654 | 746 |

TABLE 5864-continued

Segment location on transcripts

| Transcript name | Segment starting position | Segment ending position |
|---|---|---|
| D12335_PEA_1_T2 (SEQ ID NO: 4306) | 736 | 828 |
| D12335_PEA_1_T3 (SEQ ID NO: 4307) | 674 | 766 |
| D12335_PEA_1_T4 (SEQ ID NO: 4308) | 658 | 750 |
| D12335_PEA_1_T5 (SEQ ID NO: 4309) | 946 | 1038 |
| D12335_PEA_1_T6 (SEQ ID NO: 4310) | 723 | 815 |
| D12335_PEA_1_T7 (SEQ ID NO: 4311) | 1054 | 1146 |
| D12335_PEA_1_T16 (SEQ ID NO: 4312) | 1054 | 1146 |
| D12335_PEA_1_T17 (SEQ ID NO: 4313) | 1054 | 1146 |
| D12335_PEA_1_T18 (SEQ ID NO: 4314) | 1054 | 1146 |
| D12335_PEA_1_T22 (SEQ ID NO: 4315) | 1054 | 1146 |
| D12335_PEA_1_T25 (SEQ ID NO: 4316) | 1054 | 1146 |
| D12335_PEA_1_T26 (SEQ ID NO: 4317) | 1054 | 1146 |
| D12335_PEA_1_T28 (SEQ ID NO: 4318) | 1820 | 1912 |
| D12335_PEA_1_T29 (SEQ ID NO: 4319) | 719 | 811 |
| D12335_PEA_1_T30 (SEQ ID NO: 4320) | 1054 | 1146 |
| D12335_PEA_1_T32 (SEQ ID NO: 4322) | 1243 | 1335 |
| D12335_PEA_1_T35 (SEQ ID NO: 4324) | 1054 | 1146 |
| D12335_PEA_1_T36 (SEQ ID NO: 4325) | 474 | 566 |
| D12335_PEA_1_T38 (SEQ ID NO: 4326) | 1054 | 1146 |

This segment can be found in both coding and non-coding regions of transcript(s) as follows. The segment can be found in a non-coding region of transcript(s) that are related to the following protein(s): D12335_PEA_1_P21. This segment can also be found in the following protein(s): D12335_PEA_1_P1, D12335_PEA_1_P20, D12335_PEA_1_P5, D12335_PEA_1_P6, D12335_PEA_1_P7, D12335_PEA_1_P12, D12335_PEA_1_P13 and D12335_PEA_1_P15, since it is in the coding region for the corresponding transcript.

Segment cluster D12335_PEA_1_node_37 (SEQ ID NO:6241) according to the present invention is supported by 10 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323) and D12335_PEA_1_T36 (SEQ ID NO:4325). Table 5865 below describes the starting and ending position of this segment on each transcript.

TABLE 5865

Segment location on transcripts

| Transcript name | Segment starting position | Segment ending position |
|---|---|---|
| D12335_PEA_1_T0 (SEQ ID NO: 4304) | 1311 | 1380 |
| D12335_PEA_1_T1 (SEQ ID NO: 4305) | 911 | 980 |
| D12335_PEA_1_T2 (SEQ ID NO: 4306) | 993 | 1062 |
| D12335_PEA_1_T3 (SEQ ID NO: 4307) | 931 | 1000 |
| D12335_PEA_1_T4 (SEQ ID NO: 4308) | 915 | 984 |
| D12335_PEA_1_T5 (SEQ ID NO: 4309) | 1203 | 1272 |
| D12335_PEA_1_T6 (SEQ ID NO: 4310) | 980 | 1049 |
| D12335_PEA_1_T7 (SEQ ID NO: 4311) | 1311 | 1380 |
| D12335_PEA_1_T16 (SEQ ID NO: 4312) | 1311 | 1380 |
| D12335_PEA_1_T17 (SEQ ID NO: 4313) | 1311 | 1380 |
| D12335_PEA_1_T18 (SEQ ID NO: 4314) | 1311 | 1380 |
| D12335_PEA_1_T22 (SEQ ID NO: 4315) | 1311 | 1380 |
| D12335_PEA_1_T25 (SEQ ID NO: 4316) | 1311 | 1380 |
| D12335_PEA_1_T26 (SEQ ID NO: 4317) | 1147 | 1216 |
| D12335_PEA_1_T28 (SEQ ID NO: 4318) | 2077 | 2146 |
| D12335_PEA_1_T29 (SEQ ID NO: 4319) | 976 | 1045 |
| D12335_PEA_1_T30 (SEQ ID NO: 4320) | 1311 | 1380 |
| D12335_PEA_1_T31 (SEQ ID NO: 4321) | 1218 | 1287 |
| D12335_PEA_1_T32 (SEQ ID NO: 4322) | 1500 | 1569 |
| D12335_PEA_1_T34 (SEQ ID NO: 4323) | 1054 | 1123 |
| D12335_PEA_1_T36 (SEQ ID NO: 4325) | 731 | 800 |

This segment can be found in both coding and non-coding regions of transcript(s) as follows. The segment can be found in a non-coding region of transcript(s) that are related to the following protein(s): D12335_PEA_1_P21. This segment can also be found in the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P11 and D12335_PEA_1_P13, since it is in the coding region for the corresponding transcript.

Segment cluster D12335_PEA_1_node_38 (SEQ ID NO:6242) according to the present invention is supported by 104 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), (SEQ ID NO:4323) and D12335_PEA_1_T36 (SEQ ID NO:4325). Table 5866 below describes the starting and ending position of this segment on each transcript.

TABLE 5866

Segment location on transcripts

| Transcript name | Segment starting position | Segment ending position |
|---|---|---|
| D12335_PEA_1_T0 (SEQ ID NO: 4304) | 1381 | 1448 |
| D12335_PEA_1_T1 (SEQ ID NO: 4305) | 981 | 1048 |
| D12335_PEA_1_T2 (SEQ ID NO: 4306) | 1063 | 1130 |
| D12335_PEA_1_T3 (SEQ ID NO: 4307) | 1001 | 1068 |
| D12335_PEA_1_T4 (SEQ ID NO: 4308) | 985 | 1052 |
| D12335_PEA_1_T5 (SEQ ID NO: 4309) | 1273 | 1340 |
| D12335_PEA_1_T6 (SEQ ID NO: 4310) | 1050 | 1117 |
| D12335_PEA_1_T7 (SEQ ID NO: 4311) | 1381 | 1448 |
| D12335_PEA_1_T16 (SEQ ID NO: 4312) | 1381 | 1448 |
| D12335_PEA_1_T17 (SEQ ID NO: 4313) | 1381 | 1448 |
| D12335_PEA_1_T18 (SEQ ID NO: 4314) | 1381 | 1448 |
| D12335_PEA_1_T22 (SEQ ID NO: 4315) | 1381 | 1448 |
| D12335_PEA_1_T26 (SEQ ID NO: 4317) | 1217 | 1284 |
| D12335_PEA_1_T28 (SEQ ID NO: 4318) | 2147 | 2214 |
| D12335_PEA_1_T29 (SEQ ID NO: 4319) | 1046 | 1113 |
| D12335_PEA_1_T31 (SEQ ID NO: 4321) | 1288 | 1355 |
| D12335_PEA_1_T32 (SEQ ID NO: 4322) | 1570 | 1637 |
| D12335_PEA_1_T34 (SEQ ID NO: 4323) | 1124 | 1191 |
| D12335_PEA_1_T36 (SEQ ID NO: 4325) | 801 | 868 |

This segment can be found in both coding and non-coding regions of transcript(s) as follows. The segment can be found in a non-coding region of transcript(s) that are related to the following protein(s): D12335_PEA_1_P6, D12335_PEA_1_P21 and D12335_PEA_1_P11. This segment can also be found in the following protein(s): D12335_PEA_1_P1, D12335_PEA_1_P20, D12335_PEA_1_P7, D12335_PEA_1_P8 and D12335_PEA_1_P13, since it is in the coding region for the corresponding transcript.

Segment cluster D12335_PEA_1_node_40 (SEQ ID NO:6243) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_

1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5867 below describes the starting and ending position of this segment on each transcript.

TABLE 5867

Segment location on transcripts

| Transcript name | Segment starting position | Segment ending position |
|---|---|---|
| D12335_PEA_1_T0 (SEQ ID NO: 4304) | 1581 | 1588 |
| D12335_PEA_1_T1 (SEQ ID NO: 4305) | 1181 | 1188 |
| D12335_PEA_1_T2 (SEQ ID NO: 4306) | 1263 | 1270 |
| D12335_PEA_1_T3 (SEQ ID NO: 4307) | 1201 | 1208 |
| D12335_PEA_1_T4 (SEQ ID NO: 4308) | 1185 | 1192 |
| D12335_PEA_1_T5 (SEQ ID NO: 4309) | 1473 | 1480 |
| D12335_PEA_1_T6 (SEQ ID NO: 4310) | 1250 | 1257 |
| D12335_PEA_1_T7 (SEQ ID NO: 4311) | 1581 | 1588 |
| D12335_PEA_1_T16 (SEQ ID NO: 4312) | 1581 | 1588 |
| D12335_PEA_1_T17 (SEQ ID NO: 4313) | 1581 | 1588 |
| D12335_PEA_1_T18 (SEQ ID NO: 4314) | 1581 | 1588 |
| D12335_PEA_1_T22 (SEQ ID NO: 4315) | 1581 | 1588 |
| D12335_PEA_1_T26 (SEQ ID NO: 4317) | 1417 | 1424 |
| D12335_PEA_1_T28 (SEQ ID NO: 4318) | 2347 | 2354 |
| D12335_PEA_1_T29 (SEQ ID NO: 4319) | 1246 | 1253 |
| D12335_PEA_1_T31 (SEQ ID NO: 4321) | 1488 | 1495 |
| D12335_PEA_1_T32 (SEQ ID NO: 4322) | 1770 | 1777 |
| D12335_PEA_1_T34 (SEQ ID NO: 4323) | 1324 | 1331 |
| D12335_PEA_1_T36 (SEQ ID NO: 4325) | 1001 | 1008 |
| D12335_PEA_1_T39 (SEQ ID NO: 4327) | 832 | 839 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_41 (SEQ ID NO:6244) according to the present invention is supported by 101 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5868 below describes the starting and ending position of this segment on each transcript.

TABLE 5868

Segment location on transcripts

| Transcript name | Segment starting position | Segment ending position |
|---|---|---|
| D12335_PEA_1_T0 (SEQ ID NO: 4304) | 1589 | 1614 |
| D12335_PEA_1_T1 (SEQ ID NO: 4305) | 1189 | 1214 |
| D12335_PEA_1_T2 (SEQ ID NO: 4306) | 1271 | 1296 |
| D12335_PEA_1_T3 (SEQ ID NO: 4307) | 1209 | 1234 |
| D12335_PEA_1_T4 (SEQ ID NO: 4308) | 1193 | 1218 |
| D12335_PEA_1_T5 (SEQ ID NO: 4309) | 1481 | 1506 |
| D12335_PEA_1_T6 (SEQ ID NO: 4310) | 1258 | 1283 |
| D12335_PEA_1_T7 (SEQ ID NO: 4311) | 1589 | 1614 |
| D12335_PEA_1_T16 (SEQ ID NO: 4312) | 1589 | 1614 |
| D12335_PEA_1_T17 (SEQ ID NO: 4313) | 1589 | 1614 |
| D12335_PEA_1_T18 (SEQ ID NO: 4314) | 1589 | 1614 |
| D12335_PEA_1_T22 (SEQ ID NO: 4315) | 1589 | 1614 |
| D12335_PEA_1_T26 (SEQ ID NO: 4317) | 1425 | 1450 |
| D12335_PEA_1_T28 (SEQ ID NO: 4318) | 2355 | 2380 |
| D12335_PEA_1_T29 (SEQ ID NO: 4319) | 1254 | 1279 |
| D12335_PEA_1_T31 (SEQ ID NO: 4321) | 1496 | 1521 |
| D12335_PEA_1_T32 (SEQ ID NO: 4322) | 1778 | 1803 |
| D12335_PEA_1_T34 (SEQ ID NO: 4323) | 1332 | 1357 |
| D12335_PEA_1_T36 (SEQ ID NO: 4325) | 1009 | 1034 |
| D12335_PEA_1_T39 (SEQ ID NO: 4327) | 840 | 865 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_42 (SEQ ID NO:6245) according to the present invention is supported by 124 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5869 below describes the starting and ending position of this segment on each transcript.

TABLE 5869

Segment location on transcripts

| Transcript name | Segment starting position | Segment ending position |
| --- | --- | --- |
| D12335_PEA_1_T0 (SEQ ID NO: 4304) | 1615 | 1694 |
| D12335_PEA_1_T1 (SEQ ID NO: 4305) | 1215 | 1294 |
| D12335_PEA_1_T2 (SEQ ID NO: 4306) | 1297 | 1376 |
| D12335_PEA_1_T3 (SEQ ID NO: 4307) | 1235 | 1314 |
| D12335_PEA_1_T4 (SEQ ID NO: 4308) | 1219 | 1298 |
| D12335_PEA_1_T5 (SEQ ID NO: 4309) | 1507 | 1586 |
| D12335_PEA_1_T6 (SEQ ID NO: 4310) | 1284 | 1363 |
| D12335_PEA_1_T7 (SEQ ID NO: 4311) | 1615 | 1694 |
| D12335_PEA_1_T16 (SEQ ID NO: 4312) | 1615 | 1694 |
| D12335_PEA_1_T17 (SEQ ID NO: 4313) | 1615 | 1694 |
| D12335_PEA_1_T18 (SEQ ID NO: 4314) | 1615 | 1694 |
| D12335_PEA_1_T22 (SEQ ID NO: 4315) | 1615 | 1694 |
| D12335_PEA_1_T26 (SEQ ID NO: 4317) | 1451 | 1530 |
| D12335_PEA_1_T28 (SEQ ID NO: 4318) | 2381 | 2460 |
| D12335_PEA_1_T29 (SEQ ID NO: 4319) | 1280 | 1359 |
| D12335_PEA_1_T31 (SEQ ID NO: 4321) | 1522 | 1601 |
| D12335_PEA_1_T32 (SEQ ID NO: 4322) | 1804 | 1883 |
| D12335_PEA_1_T34 (SEQ ID NO: 4323) | 1358 | 1437 |
| D12335_PEA_1_T36 (SEQ ID NO: 4325) | 1035 | 1114 |
| D12335_PEA_1_T39 (SEQ ID NO: 4327) | 866 | 945 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_43 (SEQ ID NO:6246) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5870 below describes the starting and ending position of this segment on each transcript.

TABLE 5870

Segment location on transcripts

| Transcript name | Segment starting position | Segment ending position |
| --- | --- | --- |
| D12335_PEA_1_T0 (SEQ ID NO: 4304) | 1695 | 1703 |
| D12335_PEA_1_T1 (SEQ ID NO: 4305) | 1295 | 1303 |
| D12335_PEA_1_T2 (SEQ ID NO: 4306) | 1377 | 1385 |
| D12335_PEA_1_T3 (SEQ ID NO: 4307) | 1315 | 1323 |
| D12335_PEA_1_T4 (SEQ ID NO: 4308) | 1299 | 1307 |
| D12335_PEA_1_T5 (SEQ ID NO: 4309) | 1587 | 1595 |
| D12335_PEA_1_T6 (SEQ ID NO: 4310) | 1364 | 1372 |
| D12335_PEA_1_T7 (SEQ ID NO: 4311) | 1695 | 1703 |
| D12335_PEA_1_T16 (SEQ ID NO: 4312) | 1695 | 1703 |
| D12335_PEA_1_T17 (SEQ ID NO: 4313) | 1695 | 1703 |
| D12335_PEA_1_T18 (SEQ ID NO: 4314) | 1695 | 1703 |
| D12335_PEA_1_T22 (SEQ ID NO: 4315) | 1695 | 1703 |
| D12335_PEA_1_T26 (SEQ ID NO: 4317) | 1531 | 1539 |
| D12335_PEA_1_T28 (SEQ ID NO: 4318) | 2461 | 2469 |
| D12335_PEA_1_T29 (SEQ ID NO: 4319) | 1360 | 1368 |
| D12335_PEA_1_T31 (SEQ ID NO: 4321) | 1602 | 1610 |
| D12335_PEA_1_T32 (SEQ ID NO: 4322) | 1884 | 1892 |
| D12335_PEA_1_T34 (SEQ ID NO: 4323) | 1438 | 1446 |

TABLE 5870-continued

Segment location on transcripts

| Transcript name | Segment starting position | Segment ending position |
|---|---|---|
| D12335_PEA_1_T36 (SEQ ID NO: 4325) | 1115 | 1123 |
| D12335_PEA_1_T39 (SEQ ID NO: 4327) | 946 | 954 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_44 (SEQ ID NO:6247) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T26 (SEQ ID NO:4317), D12335_PEA_1_T28 (SEQ ID NO:4318), D12335_PEA_1_T29 (SEQ ID NO:4319), D12335PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5871 below describes the starting and ending position of this segment on each transcript.

TABLE 5871

Segment location on transcripts

| Transcript name | Segment starting position | Segment ending position |
|---|---|---|
| D12335_PEA_1_T0 (SEQ ID NO: 4304) | 1704 | 1709 |
| D12335_PEA_1_T1 (SEQ ID NO: 4305) | 1304 | 1309 |
| D12335_PEA_1_T2 (SEQ ID NO: 4306) | 1386 | 1391 |
| D12335_PEA_1_T3 (SEQ ID NO: 4307) | 1324 | 1329 |
| D12335_PEA_1_T4 (SEQ ID NO: 4308) | 1308 | 1313 |
| D12335_PEA_1_T5 (SEQ ID NO: 4309) | 1596 | 1601 |
| D12335_PEA_1_T6 (SEQ ID NO: 4310) | 1373 | 1378 |
| D12335_PEA_1_T7 (SEQ ID NO: 4311) | 1704 | 1709 |
| D12335_PEA_1_T16 (SEQ ID NO: 4312) | 1704 | 1709 |
| D12335_PEA_1_T17 (SEQ ID NO: 4313) | 1704 | 1709 |
| D12335_PEA_1_T18 (SEQ ID NO: 4314) | 1704 | 1709 |
| D12335_PEA_1_T26 (SEQ ID NO: 4317) | 1540 | 1545 |
| D12335_PEA_1_T28 (SEQ ID NO: 4318) | 2470 | 2475 |
| D12335_PEA_1_T29 (SEQ ID NO: 4319) | 1369 | 1374 |
| D12335_PEA_1_T31 (SEQ ID NO: 4321) | 1611 | 1616 |
| D12335_PEA_1_T32 (SEQ ID NO: 4322) | 1893 | 1898 |
| D12335_PEA_1_T34 (SEQ ID NO: 4323) | 1447 | 1452 |
| D12335_PEA_1_T36 (SEQ ID NO: 4325) | 1124 | 1129 |
| D12335_PEA_1_T39 (SEQ ID NO: 4327) | 955 | 960 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_45 (SEQ ID NO:6248) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5872 below describes the starting and ending position of this segment on each transcript.

TABLE 5872

Segment location on transcripts

| Transcript name | Segment starting position | Segment ending position |
|---|---|---|
| D12335_PEA_1_T0 (SEQ ID NO: 4304) | 1710 | 1723 |
| D12335_PEA_1_T1 (SEQ ID NO: 4305) | 1310 | 1323 |
| D12335_PEA_1_T2 (SEQ ID NO: 4306) | 1392 | 1405 |
| D12335_PEA_1_T3 (SEQ ID NO: 4307) | 1330 | 1343 |
| D12335_PEA_1_T4 (SEQ ID NO: 4308) | 1314 | 1327 |
| D12335_PEA_1_T5 (SEQ ID NO: 4309) | 1602 | 1615 |

TABLE 5872-continued

Segment location on transcripts

| Transcript name | Segment starting position | Segment ending position |
|---|---|---|
| D12335_PEA_1_T6 (SEQ ID NO: 4310) | 1379 | 1392 |
| D12335_PEA_1_T7 (SEQ ID NO: 4311) | 1710 | 1723 |
| D12335_PEA_1_T16 (SEQ ID NO: 4312) | 1710 | 1723 |
| D12335_PEA_1_T17 (SEQ ID NO: 4313) | 1710 | 1723 |
| D12335_PEA_1_T18 (SEQ ID NO: 4314) | 1710 | 1723 |
| D12335_PEA_1_T26 (SEQ ID NO: 4317) | 1546 | 1559 |
| D12335_PEA_1_T28 (SEQ ID NO: 4318) | 2476 | 2489 |
| D12335_PEA_1_T29 (SEQ ID NO: 4319) | 1375 | 1388 |
| D12335_PEA_1_T31 (SEQ ID NO: 4321) | 1617 | 1630 |
| D12335_PEA_1_T32 (SEQ ID NO: 4322) | 1899 | 1912 |
| D12335_PEA_1_T34 (SEQ ID NO: 4323) | 1453 | 1466 |
| D12335_PEA_1_T36 (SEQ ID NO: 4325) | 1130 | 1143 |
| D12335_PEA_1_T39 (SEQ ID NO: 4327) | 961 | 974 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P16, since it is in the coding region for the corresponding transcript.

Segment cluster D12335_PEA_1_node_46 (SEQ ID NO:6249) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5873 below describes the starting and ending position of this segment on each transcript.

TABLE 5873

Segment location on transcripts

| Transcript name | Segment starting position | Segment ending position |
|---|---|---|
| D12335_PEA_1_T0 (SEQ ID NO: 4304) | 1724 | 1729 |
| D12335_PEA_1_T1 (SEQ ID NO: 4305) | 1324 | 1329 |
| D12335_PEA_1_T2 (SEQ ID NO: 4306) | 1406 | 1411 |
| D12335_PEA_1_T3 (SEQ ID NO: 4307) | 1344 | 1349 |
| D12335_PEA_1_T4 (SEQ ID NO: 4308) | 1328 | 1333 |
| D12335_PEA_1_T5 (SEQ ID NO: 4309) | 1616 | 1621 |
| D12335_PEA_1_T6 (SEQ ID NO: 4310) | 1393 | 1398 |
| D12335_PEA_1_T7 (SEQ ID NO: 4311) | 1724 | 1729 |
| D12335_PEA_1_T16 (SEQ ID NO: 4312) | 1724 | 1729 |
| D12335_PEA_1_T17 (SEQ ID NO: 4313) | 1724 | 1729 |
| D12335_PEA_1_T18 (SEQ ID NO: 4314) | 1724 | 1729 |
| D12335_PEA_1_T25 (SEQ ID NO: 4316) | 1381 | 1386 |
| D12335_PEA_1_T26 (SEQ ID NO: 4317) | 1560 | 1565 |
| D12335_PEA_1_T28 (SEQ ID NO: 4318) | 2490 | 2495 |
| D12335_PEA_1_T29 (SEQ ID NO: 4319) | 1389 | 1394 |
| D12335_PEA_1_T30 (SEQ ID NO: 4320) | 1381 | 1386 |
| D12335_PEA_1_T31 (SEQ ID NO: 4321) | 1631 | 1636 |
| D12335_PEA_1_T32 (SEQ ID NO: 4322) | 1913 | 1918 |
| D12335_PEA_1_T34 (SEQ ID NO: 4323) | 1467 | 1472 |
| D12335_PEA_1_T36 (SEQ ID NO: 4325) | 1144 | 1149 |
| D12335_PEA_1_T39 (SEQ ID NO: 4327) | 975 | 980 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P5 and D12335_PEA_1_P16, since it is in the coding region for the corresponding transcript.

Segment cluster D12335_PEA_1_node_47 (SEQ ID NO:6250) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T17 (SEQ ID NO:4313), D12335_PEA_1_T18 (SEQ ID NO:4314), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5874 below describes the starting and ending position of this segment on each transcript.

TABLE 5874

Segment location on transcripts

| Transcript name | Segment starting position | Segment ending position |
|---|---|---|
| D12335_PEA_1_T0 (SEQ ID NO: 4304) | 1730 | 1733 |
| D12335_PEA_1_T1 (SEQ ID NO: 4305) | 1330 | 1333 |
| D12335_PEA_1_T2 (SEQ ID NO: 4306) | 1412 | 1415 |
| D12335_PEA_1_T3 (SEQ ID NO: 4307) | 1350 | 1353 |
| D12335_PEA_1_T4 (SEQ ID NO: 4308) | 1334 | 1337 |
| D12335_PEA_1_T5 (SEQ ID NO: 4309) | 1622 | 1625 |
| D12335_PEA_1_T6 (SEQ ID NO: 4310) | 1399 | 1402 |
| D12335_PEA_1_T7 (SEQ ID NO: 4311) | 1730 | 1733 |
| D12335_PEA_1_T17 (SEQ ID NO: 4313) | 1730 | 1733 |
| D12335_PEA_1_T18 (SEQ ID NO: 4314) | 1730 | 1733 |
| D12335_PEA_1_T25 (SEQ ID NO: 4316) | 1387 | 1390 |
| D12335_PEA_1_T26 (SEQ ID NO: 4317) | 1566 | 1569 |
| D12335_PEA_1_T28 (SEQ ID NO: 4318) | 2496 | 2499 |
| D12335_PEA_1_T29 (SEQ ID NO: 4319) | 1395 | 1398 |
| D12335_PEA_1_T30 (SEQ ID NO: 4320) | 1387 | 1390 |
| D12335_PEA_1_T31 (SEQ ID NO: 4321) | 1637 | 1640 |
| D12335_PEA_1_T32 (SEQ ID NO: 4322) | 1919 | 1922 |
| D12335_PEA_1_T34 (SEQ ID NO: 4323) | 1473 | 1476 |
| D12335_PEA_1_T36 (SEQ ID NO: 4325) | 1150 | 1153 |
| D12335_PEA_1_T39 (SEQ ID NO: 4327) | 981 | 984 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P5 and D12335_PEA_1_P16, since it is in the coding region for the corresponding transcript.

Segment cluster D12335_PEA_1_node_48 (SEQ ID NO:6251) according to the present invention is supported by 133 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5875 below describes the starting and ending position of this segment on each transcript.

TABLE 5875

Segment location on transcripts

| Transcript name | Segment starting position | Segment ending position |
|---|---|---|
| D12335_PEA_1_T0 (SEQ ID NO: 4304) | 1734 | 1786 |
| D12335_PEA_1_T1 (SEQ ID NO: 4305) | 1334 | 1386 |
| D12335_PEA_1_T2 (SEQ ID NO: 4306) | 1416 | 1468 |
| D12335_PEA_1_T3 (SEQ ID NO: 4307) | 1354 | 1406 |
| D12335_PEA_1_T4 (SEQ ID NO: 4308) | 1338 | 1390 |
| D12335_PEA_1_T5 (SEQ ID NO: 4309) | 1626 | 1678 |
| D12335_PEA_1_T6 (SEQ ID NO: 4310) | 1403 | 1455 |
| D12335_PEA_1_T7 (SEQ ID NO: 4311) | 1734 | 1786 |
| D12335_PEA_1_T25 (SEQ ID NO: 4316) | 1391 | 1443 |
| D12335_PEA_1_T26 (SEQ ID NO: 4317) | 1570 | 1622 |
| D12335_PEA_1_T28 (SEQ ID NO: 4318) | 2500 | 2552 |
| D12335_PEA_1_T29 (SEQ ID NO: 4319) | 1399 | 1451 |
| D12335_PEA_1_T30 (SEQ ID NO: 4320) | 1391 | 1443 |
| D12335_PEA_1_T31 (SEQ ID NO: 4321) | 1641 | 1693 |
| D12335_PEA_1_T32 (SEQ ID NO: 4322) | 1923 | 1975 |
| D12335_PEA_1_T34 (SEQ ID NO: 4323) | 1477 | 1529 |
| D12335_PEA_1_T36 (SEQ ID NO: 4325) | 1154 | 1206 |
| D12335_PEA_1_T39 (SEQ ID NO: 4327) | 985 | 1037 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11 and D12335_PEA_1_P13. This segment can also be found in the following protein(s): D12335_PEA_1_P5 and D12335_PEA_1_P16, since it is in the coding region for the corresponding transcript.

Segment cluster D12335_PEA_1_node_49 (SEQ ID NO:6252) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_

1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5876 below describes the starting and ending position of this segment on each transcript.

TABLE 5876

Segment location on transcripts

| Transcript name | Segment starting position | Segment ending position |
|---|---|---|
| D12335_PEA_1_T0 (SEQ ID NO: 4304) | 1787 | 1799 |
| D12335_PEA_1_T1 (SEQ ID NO: 4305) | 1387 | 1399 |
| D12335_PEA_1_T2 (SEQ ID NO: 4306) | 1469 | 1481 |
| D12335_PEA_1_T3 (SEQ ID NO: 4307) | 1407 | 1419 |
| D12335_PEA_1_T4 (SEQ ID NO: 4308) | 1391 | 1403 |
| D12335_PEA_1_T5 (SEQ ID NO: 4309) | 1679 | 1691 |
| D12335_PEA_1_T6 (SEQ ID NO: 4310) | 1456 | 1468 |
| D12335_PEA_1_T7 (SEQ ID NO: 4311) | 1787 | 1799 |
| D12335_PEA_1_T25 (SEQ ID NO: 4316) | 1444 | 1456 |
| D12335_PEA_1_T26 (SEQ ID NO: 4317) | 1623 | 1635 |
| D12335_PEA_1_T28 (SEQ ID NO: 4318) | 2553 | 2565 |
| D12335_PEA_1_T29 (SEQ ID NO: 4319) | 1452 | 1464 |
| D12335_PEA_1_T30 (SEQ ID NO: 4320) | 1444 | 1456 |
| D12335_PEA_1_T31 (SEQ ID NO: 4321) | 1694 | 1706 |
| D12335_PEA_1_T32 (SEQ ID NO: 4322) | 1976 | 1988 |
| D12335_PEA_1_T34 (SEQ ID NO: 4323) | 1530 | 1542 |
| D12335_PEA_1_T36 (SEQ ID NO: 4325) | 1207 | 1219 |
| D12335_PEA_1_T39 (SEQ ID NO: 4327) | 1038 | 1050 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P1_D12335_PEA_1_P13 and D12335_PEA_1_P16. This segment can also be found in the following protein(s): D12335_PEA_1_P5, since it is in the coding region for the corresponding transcript.

Segment cluster D12335_PEA_1_node_50 (SEQ ID NO:6253) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5877 below describes the starting and ending position of this segment on each transcript.

TABLE 5877

Segment location on transcripts

| Transcript name | Segment starting position | Segment ending position |
|---|---|---|
| D12335_PEA_1_T0 (SEQ ID NO: 4304) | 1800 | 1803 |
| D12335_PEA_1_T1 (SEQ ID NO: 4305) | 1400 | 1403 |
| D12335_PEA_1_T2 (SEQ ID NO: 4306) | 1482 | 1485 |
| D12335_PEA_1_T3 (SEQ ID NO: 4307) | 1420 | 1423 |
| D12335_PEA_1_T4 (SEQ ID NO: 4308) | 1404 | 1407 |
| D12335_PEA_1_T5 (SEQ ID NO: 4309) | 1692 | 1695 |
| D12335_PEA_1_T6 (SEQ ID NO: 4310) | 1469 | 1472 |
| D12335_PEA_1_T7 (SEQ ID NO: 4311) | 1800 | 1803 |
| D12335_PEA_1_T25 (SEQ ID NO: 4316) | 1457 | 1460 |
| D12335_PEA_1_T26 (SEQ ID NO: 4317) | 1636 | 1639 |
| D12335_PEA_1_T28 (SEQ ID NO: 4318) | 2566 | 2569 |
| D12335_PEA_1_T29 (SEQ ID NO: 4319) | 1465 | 1468 |
| D12335_PEA_1_T30 (SEQ ID NO: 4320) | 1457 | 1460 |
| D12335_PEA_1_T31 (SEQ ID NO: 4321) | 1707 | 1710 |
| D12335_PEA_1_T32 (SEQ ID NO: 4322) | 1989 | 1992 |
| D12335_PEA_1_T34 (SEQ ID NO: 4323) | 1543 | 1546 |
| D12335_PEA_1_T36 (SEQ ID NO: 4325) | 1220 | 1223 |
| D12335_PEA_1_T39 (SEQ ID NO: 4327) | 1051 | 1054 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16. This segment can also be found in the following protein(s): D12335_PEA_1_P5, since it is in the coding region for the corresponding transcript.

Segment cluster D12335_PEA_1_node_51 (SEQ ID NO:6254) according to the present invention is supported by 149 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5878 below describes the starting and ending position of this segment on each transcript.

TABLE 5878

Segment location on transcripts

| Transcript name | Segment starting position | Segment ending position |
|---|---|---|
| D12335_PEA_1_T0 (SEQ ID NO: 4304) | 1804 | 1856 |
| D12335_PEA_1_T1 (SEQ ID NO: 4305) | 1404 | 1456 |
| D12335_PEA_1_T2 (SEQ ID NO: 4306) | 1486 | 1538 |
| D12335_PEA_1_T3 (SEQ ID NO: 4307) | 1424 | 1476 |
| D12335_PEA_1_T4 (SEQ ID NO: 4308) | 1408 | 1460 |
| D12335_PEA_1_T5 (SEQ ID NO: 4309) | 1696 | 1748 |
| D12335_PEA_1_T6 (SEQ ID NO: 4310) | 1473 | 1525 |
| D12335_PEA_1_T7 (SEQ ID NO: 4311) | 1804 | 1856 |
| D12335_PEA_1_T25 (SEQ ID NO: 4316) | 1461 | 1513 |
| D12335_PEA_1_T26 (SEQ ID NO: 4317) | 1640 | 1692 |
| D12335_PEA_1_T28 (SEQ ID NO: 4318) | 2570 | 2622 |
| D12335_PEA_1_T29 (SEQ ID NO: 4319) | 1469 | 1521 |
| D12335_PEA_1_T30 (SEQ ID NO: 4320) | 1461 | 1513 |
| D12335_PEA_1_T31 (SEQ ID NO: 4321) | 1711 | 1763 |
| D12335_PEA_1_T32 (SEQ ID NO: 4322) | 1993 | 2045 |
| D12335_PEA_1_T34 (SEQ ID NO: 4323) | 1547 | 1599 |
| D12335_PEA_1_T36 (SEQ ID NO: 4325) | 1224 | 1276 |
| D12335_PEA_1_T39 (SEQ ID NO: 4327) | 1055 | 1107 |

This segment can be found in both coding and non-coding regions of transcript(s) as follows. The segment can be found in a non-coding region of transcript(s) that are related to the following protein(s): D12335_PEA_1_P1, D12335_PEA_1_P20, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16. This segment can also be found in the following protein(s): D12335_PEA_1_P5, since it is in the coding region for the corresponding transcript.

Segment cluster D12335_PEA_1_node_52 (SEQ ID NO:6255) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5879 below describes the starting and ending position of this segment on each transcript.

TABLE 5879

Segment location on transcripts

| Transcript name | Segment starting position | Segment ending position |
|---|---|---|
| D12335_PEA_1_T0 (SEQ ID NO: 4304) | 1857 | 1868 |
| D12335_PEA_1_T1 (SEQ ID NO: 4305) | 1457 | 1468 |
| D12335_PEA_1_T2 (SEQ ID NO: 4306) | 1539 | 1550 |
| D12335_PEA_1_T3 (SEQ ID NO: 4307) | 1477 | 1488 |
| D12335_PEA_1_T4 (SEQ ID NO: 4308) | 1461 | 1472 |
| D12335_PEA_1_T5 (SEQ ID NO: 4309) | 1749 | 1760 |
| D12335_PEA_1_T6 (SEQ ID NO: 4310) | 1526 | 1537 |
| D12335_PEA_1_T7 (SEQ ID NO: 4311) | 1857 | 1868 |
| D12335_PEA_1_T25 (SEQ ID NO: 4316) | 1514 | 1525 |
| D12335_PEA_1_T26 (SEQ ID NO: 4317) | 1693 | 1704 |
| D12335_PEA_1_T28 (SEQ ID NO: 4318) | 2623 | 2634 |
| D12335_PEA_1_T29 (SEQ ID NO: 4319) | 1522 | 1533 |
| D12335_PEA_1_T30 (SEQ ID NO: 4320) | 1514 | 1525 |
| D12335_PEA_1_T31 (SEQ ID NO: 4321) | 1764 | 1775 |
| D12335_PEA_1_T32 (SEQ ID NO: 4322) | 2046 | 2057 |
| D12335_PEA_1_T34 (SEQ ID NO: 4323) | 1600 | 1611 |
| D12335_PEA_1_T36 (SEQ ID NO: 4325) | 1277 | 1288 |
| D12335_PEA_1_T39 (SEQ ID NO: 4327) | 1108 | 1119 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_53 (SEQ ID NO:6256) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5880 below describes the starting and ending position of this segment on each transcript.

TABLE 5880

Segment location on transcripts

| Transcript name | Segment starting position | Segment ending position |
|---|---|---|
| D12335_PEA_1_T0 (SEQ ID NO: 4304) | 1869 | 1879 |
| D12335_PEA_1_T1 (SEQ ID NO: 4305) | 1469 | 1479 |
| D12335_PEA_1_T2 (SEQ ID NO: 4306) | 1551 | 1561 |
| D12335_PEA_1_T3 (SEQ ID NO: 4307) | 1489 | 1499 |
| D12335_PEA_1_T4 (SEQ ID NO: 4308) | 1473 | 1483 |
| D12335_PEA_1_T5 (SEQ ID NO: 4309) | 1761 | 1771 |
| D12335_PEA_1_T6 (SEQ ID NO: 4310) | 1538 | 1548 |
| D12335_PEA_1_T7 (SEQ ID NO: 4311) | 1869 | 1879 |
| D12335_PEA_1_T25 (SEQ ID NO: 4316) | 1526 | 1536 |
| D12335_PEA_1_T26 (SEQ ID NO: 4317) | 1705 | 1715 |
| D12335_PEA_1_T28 (SEQ ID NO: 4318) | 2635 | 2645 |
| D12335_PEA_1_T29 (SEQ ID NO: 4319) | 1534 | 1544 |
| D12335_PEA_1_T30 (SEQ ID NO: 4320) | 1526 | 1536 |
| D12335_PEA_1_T31 (SEQ ID NO: 4321) | 1776 | 1786 |
| D12335_PEA_1_T32 (SEQ ID NO: 4322) | 2058 | 2068 |
| D12335_PEA_1_T34 (SEQ ID NO: 4323) | 1612 | 1622 |
| D12335_PEA_1_T36 (SEQ ID NO: 4325) | 1289 | 1299 |
| D12335_PEA_1_T39 (SEQ ID NO: 4327) | 1120 | 1130 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_54 (SEQ ID NO:6257) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5881 below describes the starting and ending position of this segment on each transcript.

TABLE 5881

Segment location on transcripts

| Transcript name | Segment starting position | Segment ending position |
|---|---|---|
| D12335_PEA_1_T0 (SEQ ID NO: 4304) | 1880 | 1883 |
| D12335_PEA_1_T1 (SEQ ID NO: 4305) | 1480 | 1483 |
| D12335_PEA_1_T2 (SEQ ID NO: 4306) | 1562 | 1565 |
| D12335_PEA_1_T3 (SEQ ID NO: 4307) | 1500 | 1503 |
| D12335_PEA_1_T4 (SEQ ID NO: 4308) | 1484 | 1487 |
| D12335_PEA_1_T5 (SEQ ID NO: 4309) | 1772 | 1775 |
| D12335_PEA_1_T6 (SEQ ID NO: 4310) | 1549 | 1552 |
| D12335_PEA_1_T7 (SEQ ID NO: 4311) | 1880 | 1883 |
| D12335_PEA_1_T16 (SEQ ID NO: 4312) | 1730 | 1733 |
| D12335_PEA_1_T25 (SEQ ID NO: 4316) | 1537 | 1540 |
| D12335_PEA_1_T26 (SEQ ID NO: 4317) | 1716 | 1719 |
| D12335_PEA_1_T28 (SEQ ID NO: 4318) | 2646 | 2649 |
| D12335_PEA_1_T29 (SEQ ID NO: 4319) | 1545 | 1548 |
| D12335_PEA_1_T30 (SEQ ID NO: 4320) | 1537 | 1540 |
| D12335_PEA_1_T31 (SEQ ID NO: 4321) | 1787 | 1790 |
| D12335_PEA_1_T32 (SEQ ID NO: 4322) | 2069 | 2072 |
| D12335_PEA_1_T34 (SEQ ID NO: 4323) | 1623 | 1626 |
| D12335_PEA_1_T36 (SEQ ID NO: 4325) | 1300 | 1303 |
| D12335_PEA_1_T39 (SEQ ID NO: 4327) | 1131 | 1134 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_55 (SEQ ID NO:6258) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), (SEQ ID NO:4325) and D12335_PEA_1_T39 (SEQ ID NO:4327). Table 5882 below describes the starting and ending position of this segment on each transcript.

TABLE 5882

Segment location on transcripts

| Transcript name | Segment starting position | Segment ending position |
|---|---|---|
| D12335_PEA_1_T0 (SEQ ID NO: 4304) | 1884 | 1907 |
| D12335_PEA_1_T1 (SEQ ID NO: 4305) | 1484 | 1507 |
| D12335_PEA_1_T2 (SEQ ID NO: 4306) | 1566 | 1589 |
| D12335_PEA_1_T3 (SEQ ID NO: 4307) | 1504 | 1527 |
| D12335_PEA_1_T4 (SEQ ID NO: 4308) | 1488 | 1511 |
| D12335_PEA_1_T5 (SEQ ID NO: 4309) | 1776 | 1799 |
| D12335_PEA_1_T6 (SEQ ID NO: 4310) | 1553 | 1576 |
| D12335_PEA_1_T7 (SEQ ID NO: 4311) | 1884 | 1907 |
| D12335_PEA_1_T16 (SEQ ID NO: 4312) | 1734 | 1757 |
| D12335_PEA_1_T25 (SEQ ID NO: 4316) | 1541 | 1564 |
| D12335_PEA_1_T26 (SEQ ID NO: 4317) | 1720 | 1743 |
| D12335_PEA_1_T28 (SEQ ID NO: 4318) | 2650 | 2673 |
| D12335_PEA_1_T29 (SEQ ID NO: 4319) | 1549 | 1572 |
| D12335_PEA_1_T30 (SEQ ID NO: 4320) | 1541 | 1564 |
| D12335_PEA_1_T31 (SEQ ID NO: 4321) | 1791 | 1814 |
| D12335_PEA_1_T32 (SEQ ID NO: 4322) | 2073 | 2096 |
| D12335_PEA_1_T34 (SEQ ID NO: 4323) | 1627 | 1650 |
| D12335_PEA_1_T36 (SEQ ID NO: 4325) | 1304 | 1327 |
| D12335_PEA_1_T39 (SEQ ID NO: 4327) | 1135 | 1158 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_56 (SEQ ID NO:6259) according to the present invention is supported by 152 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5883 below describes the starting and ending position of this segment on each transcript.

TABLE 5883

Segment location on transcripts

| Transcript name | Segment starting position | Segment ending position |
|---|---|---|
| D12335_PEA_1_T0 (SEQ ID NO: 4304) | 1908 | 1965 |
| D12335_PEA_1_T1 (SEQ ID NO: 4305) | 1508 | 1565 |
| D12335_PEA_1_T2 (SEQ ID NO: 4306) | 1590 | 1647 |
| D12335_PEA_1_T3 (SEQ ID NO: 4307) | 1528 | 1585 |
| D12335_PEA_1_T4 (SEQ ID NO: 4308) | 1512 | 1569 |
| D12335_PEA_1_T5 (SEQ ID NO: 4309) | 1800 | 1857 |
| D12335_PEA_1_T6 (SEQ ID NO: 4310) | 1577 | 1634 |
| D12335_PEA_1_T7 (SEQ ID NO: 4311) | 1908 | 1965 |
| D12335_PEA_1_T16 (SEQ ID NO: 4312) | 1758 | 1815 |
| D12335_PEA_1_T25 (SEQ ID NO: 4316) | 1565 | 1622 |
| D12335_PEA_1_T26 (SEQ ID NO: 4317) | 1744 | 1801 |
| D12335_PEA_1_T28 (SEQ ID NO: 4318) | 2674 | 2731 |
| D12335_PEA_1_T29 (SEQ ID NO: 4319) | 1573 | 1630 |
| D12335_PEA_1_T30 (SEQ ID NO: 4320) | 1565 | 1622 |
| D12335_PEA_1_T31 (SEQ ID NO: 4321) | 1815 | 1872 |
| D12335_PEA_1_T32 (SEQ ID NO: 4322) | 2097 | 2154 |
| D12335_PEA_1_T34 (SEQ ID NO: 4323) | 1651 | 1708 |
| D12335_PEA_1_T36 (SEQ ID NO: 4325) | 1328 | 1385 |
| D12335_PEA_1_T39 (SEQ ID NO: 4327) | 1159 | 1216 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P1, D12335_PEA_1_P13 and D12335_PEA_1_P16.

Segment cluster D12335_PEA_1_node_57 (SEQ ID NO:6260) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5884 below describes the starting and ending position of this segment on each transcript.

TABLE 5884

Segment location on transcripts

| Transcript name | Segment starting position | Segment ending position |
| --- | --- | --- |
| D12335_PEA_1_T0 (SEQ ID NO: 4304) | 1966 | 1986 |
| D12335_PEA_1_T1 (SEQ ID NO: 4305) | 1566 | 1586 |
| D12335_PEA_1_T2 (SEQ ID NO: 4306) | 1648 | 1668 |
| D12335_PEA_1_T3 (SEQ ID NO: 4307) | 1586 | 1606 |
| D12335_PEA_1_T4 (SEQ ID NO: 4308) | 1570 | 1590 |
| D12335_PEA_1_T5 (SEQ ID NO: 4309) | 1858 | 1878 |
| D12335_PEA_1_T6 (SEQ ID NO: 4310) | 1635 | 1655 |
| D12335_PEA_1_T7 (SEQ ID NO: 4311) | 1966 | 1986 |
| D12335_PEA_1_T16 (SEQ ID NO: 4312) | 1816 | 1836 |
| D12335_PEA_1_T25 (SEQ ID NO: 4316) | 1623 | 1643 |
| D12335_PEA_1_T26 (SEQ ID NO: 4317) | 1802 | 1822 |
| D12335_PEA_1_T28 (SEQ ID NO: 4318) | 2732 | 2752 |
| D12335_PEA_1_T29 (SEQ ID NO: 4319) | 1631 | 1651 |
| D12335_PEA_1_T30 (SEQ ID NO: 4320) | 1623 | 1643 |
| D12335_PEA_1_T31 (SEQ ID NO: 4321) | 1873 | 1893 |
| D12335_PEA_1_T32 (SEQ ID NO: 4322) | 2155 | 2175 |
| D12335_PEA_1_T34 (SEQ ID NO: 4323) | 1709 | 1729 |
| D12335_PEA_1_T36 (SEQ ID NO: 4325) | 1386 | 1406 |
| D12335_PEA_1_T39 (SEQ ID NO: 4327) | 1217 | 1237 |

This segment can be found in a non-coding region of transcript(s) that are related to the following protein(s): D12335_PEA_1_P1, D12335_PEA_1_P20, D12335_PEA_1_P5 D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_58 (SEQ ID NO:6261) according to the present invention is supported by 153 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5885 below describes the starting and ending position of this segment on each transcript.

TABLE 5885

Segment location on transcripts

| Transcript name | Segment starting position | Segment ending position |
| --- | --- | --- |
| D12335_PEA_1_T0 (SEQ ID NO: 4304) | 1987 | 2051 |
| D12335_PEA_1_T1 (SEQ ID NO: 4305) | 1587 | 1651 |
| D12335_PEA_1_T2 (SEQ ID NO: 4306) | 1669 | 1733 |
| D12335_PEA_1_T3 (SEQ ID NO: 4307) | 1607 | 1671 |
| D12335_PEA_1_T4 (SEQ ID NO: 4308) | 1591 | 1655 |
| D12335_PEA_1_T5 (SEQ ID NO: 4309) | 1879 | 1943 |
| D12335_PEA_1_T6 (SEQ ID NO: 4310) | 1656 | 1720 |
| D12335_PEA_1_T7 (SEQ ID NO: 4311) | 1987 | 2051 |
| D12335_PEA_1_T16 (SEQ ID NO: 4312) | 1837 | 1901 |
| D12335_PEA_1_T25 (SEQ ID NO: 4316) | 1644 | 1708 |
| D12335_PEA_1_T26 (SEQ ID NO: 4317) | 1823 | 1887 |
| D12335_PEA_1_T28 (SEQ ID NO: 4318) | 2753 | 2817 |
| D12335_PEA_1_T29 (SEQ ID NO: 4319) | 1652 | 1716 |
| D12335_PEA_1_T30 (SEQ ID NO: 4320) | 1644 | 1708 |
| D12335_PEA_1_T31 (SEQ ID NO: 4321) | 1894 | 1958 |
| D12335_PEA_1_T32 (SEQ ID NO: 4322) | 2176 | 2240 |
| D12335_PEA_1_T34 (SEQ ID NO: 4323) | 1730 | 1794 |
| D12335_PEA_1_T36 (SEQ ID NO: 4325) | 1407 | 1471 |
| D12335_PEA_1_T39 (SEQ ID NO: 4327) | 1238 | 1302 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_59 (SEQ ID NO:6262) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5886 below describes the starting and ending position of this segment on each transcript.

TABLE 5886

Segment location on transcripts

| Transcript name | Segment starting position | Segment ending position |
|---|---|---|
| D12335_PEA_1_T0 (SEQ ID NO: 4304) | 2052 | 2057 |
| D12335_PEA_1_T1 (SEQ ID NO: 4305) | 1652 | 1657 |
| D12335_PEA_1_T2 (SEQ ID NO: 4306) | 1734 | 1739 |
| D12335_PEA_1_T3 (SEQ ID NO: 4307) | 1672 | 1677 |
| D12335_PEA_1_T4 (SEQ ID NO: 4308) | 1656 | 1661 |
| D12335_PEA_1_T5 (SEQ ID NO: 4309) | 1944 | 1949 |
| D12335_PEA_1_T6 (SEQ ID NO: 4310) | 1721 | 1726 |
| D12335_PEA_1_T7 (SEQ ID NO: 4311) | 2052 | 2057 |
| D12335_PEA_1_T16 (SEQ ID NO: 4312) | 1902 | 1907 |
| D12335_PEA_1_T25 (SEQ ID NO: 4316) | 1709 | 1714 |
| D12335_PEA_1_T26 (SEQ ID NO: 4317) | 1888 | 1893 |
| D12335_PEA_1_T28 (SEQ ID NO: 4318) | 2818 | 2823 |
| D12335_PEA_1_T29 (SEQ ID NO: 4319) | 1717 | 1722 |
| D12335_PEA_1_T30 (SEQ ID NO: 4320) | 1709 | 1714 |
| D12335_PEA_1_T31 (SEQ ID NO: 4321) | 1959 | 1964 |
| D12335_PEA_1_T32 (SEQ ID NO: 4322) | 2241 | 2246 |
| D12335_PEA_1_T34 (SEQ ID NO: 4323) | 1795 | 1800 |
| D12335_PEA_1_T36 (SEQ ID NO: 4325) | 1472 | 1477 |
| D12335_PEA_1_T39 (SEQ ID NO: 4327) | 1303 | 1308 |

This segment can be found in a non-coding region of transcript(s) that are related to the following protein(s): D12335_PEA_1_P1, D12335_PEA_1_P20, D12335_PEA_1_P5 D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_60 (SEQ ID NO:6263) according to the present invention is supported by 149 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5887 below describes the starting and ending position of this segment on each transcript.

TABLE 5887

Segment location on transcripts

| Transcript name | Segment starting position | Segment ending position |
|---|---|---|
| D12335_PEA_1_T0 (SEQ ID NO: 4304) | 2058 | 2102 |
| D12335_PEA_1_T1 (SEQ ID NO: 4305) | 1658 | 1702 |
| D12335_PEA_1_T2 (SEQ ID NO: 4306) | 1740 | 1784 |
| D12335_PEA_1_T3 (SEQ ID NO: 4307) | 1678 | 1722 |
| D12335_PEA_1_T4 (SEQ ID NO: 4308) | 1662 | 1706 |
| D12335_PEA_1_T5 (SEQ ID NO: 4309) | 1950 | 1994 |
| D12335_PEA_1_T6 (SEQ ID NO: 4310) | 1727 | 1771 |
| D12335_PEA_1_T7 (SEQ ID NO: 4311) | 2058 | 2102 |
| D12335_PEA_1_T16 (SEQ ID NO: 4312) | 1908 | 1952 |
| D12335_PEA_1_T25 (SEQ ID NO: 4316) | 1715 | 1759 |
| D12335_PEA_1_T26 (SEQ ID NO: 4317) | 1894 | 1938 |
| D12335_PEA_1_T28 (SEQ ID NO: 4318) | 2824 | 2868 |
| D12335_PEA_1_T29 (SEQ ID NO: 4319) | 1723 | 1767 |
| D12335_PEA_1_T30 (SEQ ID NO: 4320) | 1715 | 1759 |
| D12335_PEA_1_T31 (SEQ ID NO: 4321) | 1965 | 2009 |
| D12335_PEA_1_T32 (SEQ ID NO: 4322) | 2247 | 2291 |
| D12335_PEA_1_T34 (SEQ ID NO: 4323) | 1801 | 1845 |
| D12335_PEA_1_T36 (SEQ ID NO: 4325) | 1478 | 1522 |
| D12335_PEA_1_T39 (SEQ ID NO: 4327) | 1309 | 1353 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_61 (SEQ ID NO:6264) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5888 below describes the starting and ending position of this segment on each transcript.

TABLE 5888

Segment location on transcripts

| Transcript name | Segment starting position | Segment ending position |
|---|---|---|
| D12335_PEA_1_T0 (SEQ ID NO: 4304) | 2103 | 2108 |
| D12335_PEA_1_T1 (SEQ ID NO: 4305) | 1703 | 1708 |
| D12335_PEA_1_T2 (SEQ ID NO: 4306) | 1785 | 1790 |
| D12335_PEA_1_T3 (SEQ ID NO: 4307) | 1723 | 1728 |
| D12335_PEA_1_T4 (SEQ ID NO: 4308) | 1707 | 1712 |
| D12335_PEA_1_T5 (SEQ ID NO: 4309) | 1995 | 2000 |
| D12335_PEA_1_T6 (SEQ ID NO: 4310) | 1772 | 1777 |
| D12335_PEA_1_T7 (SEQ ID NO: 4311) | 2103 | 2108 |
| D12335_PEA_1_T16 (SEQ ID NO: 4312) | 1953 | 1958 |
| D12335_PEA_1_T25 (SEQ ID NO: 4316) | 1760 | 1765 |
| D12335_PEA_1_T26 (SEQ ID NO: 4317) | 1939 | 1944 |
| D12335_PEA_1_T28 (SEQ ID NO: 4318) | 2869 | 2874 |
| D12335_PEA_1_T29 (SEQ ID NO: 4319) | 1768 | 1773 |
| D12335_PEA_1_T30 (SEQ ID NO: 4320) | 1760 | 1765 |
| D12335_PEA_1_T31 (SEQ ID NO: 4321) | 2010 | 2015 |
| D12335_PEA_1_T32 (SEQ ID NO: 4322) | 2292 | 2297 |
| D12335_PEA_1_T34 (SEQ ID NO: 4323) | 1846 | 1851 |
| D12335_PEA_1_T36 (SEQ ID NO: 4325) | 1523 | 1528 |
| D12335_PEA_1_T39 (SEQ ID NO: 4327) | 1354 | 1359 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_62 (SEQ ID NO:6265) according to the present invention is supported by 145 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5889 below describes the starting and ending position of this segment on each transcript.

TABLE 5889

Segment location on transcripts

| Transcript name | Segment starting position | Segment ending position |
|---|---|---|
| D12335_PEA_1_T0 (SEQ ID NO: 4304) | 2109 | 2141 |
| D12335_PEA_1_T1 (SEQ ID NO: 4305) | 1709 | 1741 |
| D12335_PEA_1_T2 (SEQ ID NO: 4306) | 1791 | 1823 |
| D12335_PEA_1_T3 (SEQ ID NO: 4307) | 1729 | 1761 |
| D12335_PEA_1_T4 (SEQ ID NO: 4308) | 1713 | 1745 |
| D12335_PEA_1_T5 (SEQ ID NO: 4309) | 2001 | 2033 |
| D12335_PEA_1_T6 (SEQ ID NO: 4310) | 1778 | 1810 |
| D12335_PEA_1_T7 (SEQ ID NO: 4311) | 2109 | 2141 |
| D12335_PEA_1_T16 (SEQ ID NO: 4312) | 1959 | 1991 |
| D12335_PEA_1_T25 (SEQ ID NO: 4316) | 1766 | 1798 |
| D12335_PEA_1_T26 (SEQ ID NO: 4317) | 1945 | 1977 |
| D12335_PEA_1_T28 (SEQ ID NO: 4318) | 2875 | 2907 |
| D12335_PEA_1_T29 (SEQ ID NO: 4319) | 1774 | 1806 |
| D12335_PEA_1_T30 (SEQ ID NO: 4320) | 1766 | 1798 |
| D12335_PEA_1_T31 (SEQ ID NO: 4321) | 2016 | 2048 |
| D12335_PEA_1_T32 (SEQ ID NO: 4322) | 2298 | 2330 |
| D12335_PEA_1_T34 (SEQ ID NO: 4323) | 1852 | 1884 |
| D12335_PEA_1_T36 (SEQ ID NO: 4325) | 1529 | 1561 |
| D12335_PEA_1_T39 (SEQ ID NO: 4327) | 1360 | 1392 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_63 (SEQ ID NO:6266) according to the present invention is supported by 143 libraries. The number of libraries was determined as previously described. This segment can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5890 below describes the starting and ending position of this segment on each transcript.

TABLE 5890

Segment location on transcripts

| Transcript name | Segment starting position | Segment ending position |
|---|---|---|
| D12335_PEA_1_T0 (SEQ ID NO: 4304) | 2142 | 2174 |
| D12335_PEA_1_T1 (SEQ ID NO: 4305) | 1742 | 1774 |
| D12335_PEA_1_T2 (SEQ ID NO: 4306) | 1824 | 1856 |
| D12335_PEA_1_T3 (SEQ ID NO: 4307) | 1762 | 1794 |
| D12335_PEA_1_T4 (SEQ ID NO: 4308) | 1746 | 1778 |
| D12335_PEA_1_T5 (SEQ ID NO: 4309) | 2034 | 2066 |
| D12335_PEA_1_T6 (SEQ ID NO: 4310) | 1811 | 1843 |
| D12335_PEA_1_T7 (SEQ ID NO: 4311) | 2142 | 2174 |
| D12335_PEA_1_T16 (SEQ ID NO: 4312) | 1992 | 2024 |
| D12335_PEA_1_T17 (SEQ ID NO: 4313) | 1734 | 1766 |
| D12335_PEA_1_T18 (SEQ ID NO: 4314) | 1734 | 1766 |
| D12335_PEA_1_T25 (SEQ ID NO: 4316) | 1799 | 1831 |
| D12335_PEA_1_T26 (SEQ ID NO: 4317) | 1978 | 2010 |
| D12335_PEA_1_T28 (SEQ ID NO: 4318) | 2908 | 2940 |
| D12335_PEA_1_T29 (SEQ ID NO: 4319) | 1807 | 1839 |
| D12335_PEA_1_T30 (SEQ ID NO: 4320) | 1799 | 1831 |
| D12335_PEA_1_T31 (SEQ ID NO: 4321) | 2049 | 2081 |
| D12335_PEA_1_T32 (SEQ ID NO: 4322) | 2331 | 2363 |
| D12335_PEA_1_T34 (SEQ ID NO: 4323) | 1885 | 1917 |
| D12335_PEA_1_T36 (SEQ ID NO: 4325) | 1562 | 1594 |
| D12335_PEA_1_T39 (SEQ ID NO: 4327) | 1393 | 1425 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Segment cluster D12335_PEA_1_node_65 (SEQ ID NO:6267) according to the present invention can be found in the following transcript(s): D12335_PEA_1_T0 (SEQ ID NO:4304), D12335_PEA_1_T1 (SEQ ID NO:4305), D12335_PEA_1_T2 (SEQ ID NO:4306), D12335_PEA_1_T3 (SEQ ID NO:4307), D12335_PEA_1_T4 (SEQ ID NO:4308), D12335_PEA_1_T5 (SEQ ID NO:4309), D12335_PEA_1_T6 (SEQ ID NO:4310), D12335_PEA_1_T7 (SEQ ID NO:4311), D12335_PEA_1_T16 (SEQ ID NO:4312), D12335_PEA_1_T17 (SEQ ID NO:4313), D12335_PEA_1_T18 (SEQ ID NO:4314), D12335_PEA_1_T22 (SEQ ID NO:4315), D12335_PEA_1_T25 (SEQ ID NO:4316), D12335_PEA_1_T26 (SEQ ID NO:4317), D12335_PEA_1_T28 (SEQ ID NO:4318), D12335_PEA_1_T29 (SEQ ID NO:4319), D12335_PEA_1_T30 (SEQ ID NO:4320), D12335_PEA_1_T31 (SEQ ID NO:4321), D12335_PEA_1_T32 (SEQ ID NO:4322), D12335_PEA_1_T34 (SEQ ID NO:4323), D12335_PEA_1_T36 (SEQ ID NO:4325) and D12335_PEA_1_T39 (SEQ ID NO:4327). Table 5891 below describes the starting and ending position of this segment on each transcript.

TABLE 5891

Segment location on transcripts

| Transcript name | Segment starting position | Segment ending position |
|---|---|---|
| D12335_PEA_1_T0 (SEQ ID NO: 4304) | 2175 | 2178 |
| D12335_PEA_1_T1 (SEQ ID NO: 4305) | 1775 | 1778 |
| D12335_PEA_1_T2 (SEQ ID NO: 4306) | 1857 | 1860 |
| D12335_PEA_1_T3 (SEQ ID NO: 4307) | 1795 | 1798 |
| D12335_PEA_1_T4 (SEQ ID NO: 4308) | 1779 | 1782 |
| D12335_PEA_1_T5 (SEQ ID NO: 4309) | 2067 | 2070 |
| D12335_PEA_1_T6 (SEQ ID NO: 4310) | 1844 | 1847 |
| D12335_PEA_1_T7 (SEQ ID NO: 4311) | 2175 | 2178 |
| D12335_PEA_1_T16 (SEQ ID NO: 4312) | 2025 | 2028 |
| D12335_PEA_1_T17 (SEQ ID NO: 4313) | 1767 | 1770 |
| D12335_PEA_1_T18 (SEQ ID NO: 4314) | 1767 | 1770 |
| D12335_PEA_1_T22 (SEQ ID NO: 4315) | 1704 | 1707 |
| D12335_PEA_1_T25 (SEQ ID NO: 4316) | 1832 | 1835 |
| D12335_PEA_1_T26 (SEQ ID NO: 4317) | 2011 | 2014 |
| D12335_PEA_1_T28 (SEQ ID NO: 4318) | 2941 | 2944 |
| D12335_PEA_1_T29 (SEQ ID NO: 4319) | 1840 | 1843 |
| D12335_PEA_1_T30 (SEQ ID NO: 4320) | 1832 | 1835 |
| D12335_PEA_1_T31 (SEQ ID NO: 4321) | 2082 | 2085 |
| D12335_PEA_1_T32 (SEQ ID NO: 4322) | 2364 | 2367 |
| D12335_PEA_1_T34 (SEQ ID NO: 4323) | 1918 | 1921 |
| D12335_PEA_1_T36 (SEQ ID NO: 4325) | 1595 | 1598 |
| D12335_PEA_1_T39 (SEQ ID NO: 4327) | 1426 | 1429 |

This segment can be found in a non-coding region of transcript(s) that are related to the following protein(s): D12335_PEA_1_P1, D12335_PEA_1_P20, D12335_PEA_1_P5, D12335_PEA_1_P6, D12335_PEA_1_P7, D12335_PEA_1_P8, D12335_PEA_1_P21, D12335_PEA_1_P11, D12335_PEA_1_P13 and D12335_PEA_1_P16.

Description for Cluster HUMGGTX

Cluster HUMGGTX features 5 transcript(s) and 31 segment(s) of interest, the names for which are given in Tables 5892 and 5893, respectively, the sequences themselves are given at the end of the application. The selected protein variants are given in Table 5894.

TABLE 5892

Transcripts of interest
Transcript Name

HUMGGTX_PEA_1_T7 (SEQ ID NO: 4330)
HUMGGTX_PEA_1_T8 (SEQ ID NO: 4331)
HUMGGTX_PEA_1_T17 (SEQ ID NO: 4332)
HUMGGTX_PEA_1_T50 (SEQ ID NO: 4333)
HUMGGTX_PEA_1_T52 (SEQ ID NO: 4334)

TABLE 5893

Segments of interest
Segment Name

HUMGGTX_PEA_1_node_2 (SEQ ID NO: 6268)
HUMGGTX_PEA_1_node_3 (SEQ ID NO: 6269)
HUMGGTX_PEA_1_node_7 (SEQ ID NO: 6270)
HUMGGTX_PEA_1_node_8 (SEQ ID NO: 6271)
HUMGGTX_PEA_1_node_17 (SEQ ID NO: 6272)
HUMGGTX_PEA_1_node_18 (SEQ ID NO: 6273)
HUMGGTX_PEA_1_node_19 (SEQ ID NO: 6274)
HUMGGTX_PEA_1_node_28 (SEQ ID NO: 6275)
HUMGGTX_PEA_1_node_31 (SEQ ID NO: 6276)
HUMGGTX_PEA_1_node_37 (SEQ ID NO: 6277)
HUMGGTX_PEA_1_node_40 (SEQ ID NO: 6278)
HUMGGTX_PEA_1_node_45 (SEQ ID NO: 6279)
HUMGGTX_PEA_1_node_48 (SEQ ID NO: 6280)
HUMGGTX_PEA_1_node_54 (SEQ ID NO: 6281)
HUMGGTX_PEA_1_node_56 (SEQ ID NO: 6282)
HUMGGTX_PEA_1_node_64 (SEQ ID NO: 6283)
HUMGGTX_PEA_1_node_65 (SEQ ID NO: 6284)
HUMGGTX_PEA_1_node_16 (SEQ ID NO: 6285)
HUMGGTX_PEA_1_node_20 (SEQ ID NO: 6286)
HUMGGTX_PEA_1_node_22 (SEQ ID NO: 6287)
HUMGGTX_PEA_1_node_23 (SEQ ID NO: 6288)
HUMGGTX_PEA_1_node_24 (SEQ ID NO: 6289)
HUMGGTX_PEA_1_node_25 (SEQ ID NO: 6290)
HUMGGTX_PEA_1_node_26 (SEQ ID NO: 6291)
HUMGGTX_PEA_1_node_33 (SEQ ID NO: 6292)
HUMGGTX_PEA_1_node_38 (SEQ ID NO: 6293)
HUMGGTX_PEA_1_node_53 (SEQ ID NO: 6294)
HUMGGTX_PEA_1_node_58 (SEQ ID NO: 6295)
HUMGGTX_PEA_1_node_59 (SEQ ID NO: 6296)
HUMGGTX_PEA_1_node_61 (SEQ ID NO: 6297)
HUMGGTX_PEA_1_node_62 (SEQ ID NO: 6298)

TABLE 5894

Proteins of interest

| Protein Name | Corresponding Transcript(s) |
|---|---|
| HUMGGTX_PEA_1_P1 | HUMGGTX_PEA_1_T17 (SEQ ID NO: 4332) |
| HUMGGTX_PEA_1_P21 | HUMGGTX_PEA_1_T50 (SEQ ID NO: 4333) |
| HUMGGTX_PEA_1_P26 | HUMGGTX_PEA_1_T7 (SEQ ID NO: 4330); HUMGGTX_PEA_1_T8 (SEQ ID NO: 4331) |

These sequences are variants of the known protein Gamma-glutamyltranspeptidase 1 precursor (SwissProt accession identifier GGT1_HUMAN; known also according to the synonyms EC 2.3.2.2; Gamma-glutamyltransferase 1; CD224 antigen), referred to herein as the previously known protein.

Protein Gamma-glutamyltranspeptidase 1 precursor is known or believed to have the following function(s): Initiates extracellular gluthatione (GSH) breakdown, provides cells with a local cysteine supply and contributes to maintain intracelular GSH level. It is part of the cell antioxidant defense mechanism. Catalyzes the transfer of the glutamyl moiety of glutathione to amino acids and dipeptide acceptors. Alternatively, glutathione can be hydrolyzed to give Cys-Gly and gamma glutamate. Isoform 3 seems to be inactive. The sequence for protein Gamma-glutamyltranspeptidase 1 precursor is given at the end of the application, as "Gamma-glutamyltranspeptidase 1 precursor amino acid sequence". Known polymorphisms for this sequence are as shown in Table 5895.

TABLE 5895

Amino acid mutations for Known Protein

| SNP position(s) on amino acid sequence | Comment |
|---|---|
| 100 | K->N: NO EFFECT ON ACTIVITY. |
| 102 | E->Q: NO EFFECT ON ACTIVITY. |
| 107 | R->Q, H: ABOLISHES ENZYME ACTIVITY. |
| 107 | R->K: REDUCES ENZYME ACTIVITY BY 99%. |
| 108 | E->Q: REDUCES ENZYME ACTIVITY BY 98%. |
| 112 | R->Q: NO EFFECT ON ACTIVITY. |
| 139 | R->Q: NO EFFECT ON ACTIVITY. |
| 147 | R->Q: NO EFFECT ON ACTIVITY. |
| 150 | R->Q: NO EFFECT ON ACTIVITY. |
| 383 | H->A: REDUCES ENZYME ACTIVITY BY 66%. |
| 385 | S->A: NO EFFECT ON ACTIVITY. |
| 413 | S->A: NO EFFECT ON ACTIVITY. |
| 422 | D->A: REDUCES ENZYME ACTIVITY BY 90%. |
| 423 | D->A: ABOLISHES ENZYME ACTIVITY. INCREASES KM BY OVER 1000-FOLD. |
| 425 | S->A: NO EFFECT ON ACTIVITY. |
| 451 | S->A: REDUCES ENZYME ACTIVITY BY 99%; ABOLISHES ACTIVITY; WHEN COMBINED WITH A-452. |

TABLE 5895-continued

Amino acid mutations for Known Protein

| SNP position(s) on amino acid sequence | Comment |
|---|---|
| 452 | S->A: REDUCES ENZYME ACTIVITY BY 99%; ABOLISHES ACTIVITY; WHEN COMBINED WITH A-451. |
| 454 | C->A: No effect on activity. |
| 505 | H->A: REDUCES ENZYME ACTIVITY BY 90%. |
| 30-31 | SK -> KS |
| 47 | A -> K |
| 139 | R -> E |
| 272 | A -> V |
| 372 | E -> D |

Protein Gamma-glutamyltranspeptidase 1 precursor localization is believed to be Type II membrane protein.

The following GO Annotation(s) apply to the previously known protein. The following annotation(s) were found: amino acid metabolism; glutathione biosynthesis, which are annotation(s) related to Biological Process; gamma-glutamyl transferase; acyltransferase; transferase, which are annotation(s) related to Molecular Function; and membrane fraction; membrane; integral membrane protein, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMGGTX can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 141 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 141 and Table 5896. This cluster is overexpressed (at least at a minimum level) in the following pathological conditions: a mixture of malignant tumors from different tissues.

TABLE 5896

Normal tissue distribution

| Name of Tissue | Number |
|---|---|
| bladder | 0 |
| brain | 13 |
| colon | 37 |
| epithelial | 19 |
| general | 14 |
| head and neck | 0 |
| kidney | 26 |
| liver | 4 |
| lung | 12 |
| lymph nodes | 18 |
| breast | 13 |
| pancreas | 41 |
| prostate | 24 |
| uterus | 0 |

TABLE 5897

P values and ratios for expression in cancerous tissue

| Name of Tissue | P1 | P2 | SP1 | R3 | SP2 | R4 |
|---|---|---|---|---|---|---|
| bladder | 5.4e−01 | 6.0e−01 | 5.6e−01 | 1.8 | 6.8e−01 | 1.5 |
| brain | 8.4e−01 | 8.9e−01 | 7.1e−01 | 0.8 | 8.6e−01 | 0.6 |
| colon | 6.1e−01 | 7.0e−01 | 9.1e−01 | 0.7 | 9.5e−01 | 0.6 |
| epithelial | 1.8e−02 | 1.5e−01 | 5.7e−03 | 2.1 | 1.8e−01 | 1.3 |
| general | 2.6e−03 | 4.0e−02 | 7.0e−04 | 2.2 | 7.0e−02 | 1.4 |
| head and neck | 1.2e−01 | 2.1e−01 | 4.6e−01 | 2.2 | 7.5e−01 | 1.3 |
| kidney | 7.4e−01 | 7.7e−01 | 1.4e−01 | 2.1 | 2.5e−01 | 1.6 |
| liver | 9.1e−01 | 8.8e−01 | 1 | 0.9 | 6.9e−01 | 1.3 |
| lung | 4.9e−01 | 4.8e−01 | 1 | 0.6 | 5.1e−01 | 1.4 |
| lymph nodes | 9.2e−01 | 6.0e−01 | 1 | 0.5 | 8.2e−01 | 0.9 |
| breast | 7.2e−01 | 7.5e−01 | 6.9e−01 | 1.1 | 6.8e−01 | 1.1 |
| pancreas | 5.9e−01 | 7.5e−01 | 8.0e−01 | 0.7 | 9.1e−01 | 0.6 |
| prostate | 2.1e−01 | 2.7e−01 | 1.5e−02 | 3.6 | 5.0e−02 | 2.7 |
| uterus | 1.5e−02 | 9.4e−02 | 1.9e−01 | 3.1 | 4.1e−01 | 2.0 |

As noted above, cluster HUMGGTX features 31 segment(s), which were listed in Table 5893 above and for which the sequence(s) are given at the end of the application. These segment(s) are portions of nucleic acid sequence(s) which are described herein separately because they are of particular interest. A description of each segment according to the present invention is now provided.

Segment cluster HUMGGTX_PEA_1_node_2 (SEQ ID NO:6268) according to the present invention is supported by 18 libraries. The number of libraries was determined as previously described. This segment can be found in the following transcript(s): HUMGGTX_PEA_1_T50 (SEQ ID NO:4333). Table 5898 below describes the starting and ending position of this segment on each transcript.

TABLE 5898

Segment location on transcripts

| Transcript name | Segment starting position | Segment ending position |
|---|---|---|
| HUMGGTX_PEA_1_T50 (SEQ ID NO: 4333) | 1 | 789 |

This segment can be found in the following protein(s): HUMGGTX_PEA_1_P21.

Segment cluster HUMGGTX_PEA_1_node_3 (SEQ ID NO:6269) according to the present invention is supported by 7 libraries. The number of libraries was determined as previously described. This segment can be found in the following transcript(s): HUMGGTX_PEA_1_T50 (SEQ ID NO:4333). Table 5899 below describes the starting and ending position of this segment on each transcript.

TABLE 5899

Segment location on transcripts

| Transcript name | Segment starting position | Segment ending position |
|---|---|---|
| HUMGGTX_PEA_1_T50 (SEQ ID NO: 4333) | 790 | 1037 |

This segment can be found in the following protein(s): HUMGGTX_PEA_1_P21.

Segment cluster HUMGGTX_PEA_1_node_7 (SEQ ID NO:6270) according to the present invention is supported by 7 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331), HUMGGTX_PEA_1_T17 (SEQ ID NO:4332) and HUMGGTX_PEA_1_T52 (SEQ ID NO:4334). Table 5900 below describes the starting and ending position of this segment on each transcript.

TABLE 5900

Segment location on transcripts

| Transcript name | Segment starting position | Segment ending position |
|---|---|---|
| HUMGGTX_PEA_1_T7 (SEQ ID NO: 4330) | 1 | 394 |
| HUMGGTX_PEA_1_T8 (SEQ ID NO: 4331) | 1 | 394 |
| HUMGGTX_PEA_1_T17 (SEQ ID NO: 4332) | 1 | 394 |
| HUMGGTX_PEA_1_T52 (SEQ ID NO: 4334) | 1 | 394 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_8 (SEQ ID NO:6271) according to the present invention is supported by 3 libraries. The number of libraries was determined as previously described. This segment can be found in the following transcript(s): HUMGGTX_PEA_1_T52 (SEQ ID NO:4334). Table 5901 below describes the starting and ending position of this segment on each transcript.

TABLE 5901

Segment location on transcripts

| Transcript name | Segment starting position | Segment ending position |
|---|---|---|
| HUMGGTX_PEA_1_T52 (SEQ ID NO: 4334) | 395 | 2250 |

This segment can be found in the following transcript(s), which do not code for proteins: HUMGGTX_PEA_1_T52 (SEQ ID NO:4334).

Segment cluster HUMGGTX_PEA_1_node_17 (SEQ ID NO:6272) according to the present invention is supported by 2 libraries. The number of libraries was determined as previously described. This segment can be found in the following transcript(s): HUMGGTX_PEA_1_T7 (SEQ ID NO:4330). Table 5902 below describes the starting and ending position of this segment on each transcript.

TABLE 5902

Segment location on transcripts

| Transcript name | Segment starting position | Segment ending position |
|---|---|---|
| HUMGGTX_PEA_1_T7 (SEQ ID NO: 4330) | 465 | 1429 |

This segment can be found in a non-coding region of transcript(s) that are related to the following protein(s): HUMGGTX_PEA_1_P26.

Segment cluster HUMGGTX_PEA_1_node_18 (SEQ ID NO:6273) according to the present invention is supported by 4 libraries. The number of libraries was determined as previously described. This segment can be found in the following transcript(s): HUMGGTX_PEA_1_T7 (SEQ ID NO:4330). Table 5903 below describes the starting and ending position of this segment on each transcript.

TABLE 5903

Segment location on transcripts

| Transcript name | Segment starting position | Segment ending position |
|---|---|---|
| HUMGGTX_PEA_1_T7 (SEQ ID NO: 4330) | 1430 | 1671 |

This segment can be found in a non-coding region of transcript(s) that are related to the following protein(s): HUMGGTX_PEA_1_P26.

Segment cluster HUMGGTX_PEA_1_node_19 (SEQ ID NO:6274) according to the present invention is supported by 3 libraries. The number of libraries was determined as previously described. This segment can be found in the following transcript(s): HUMGGTX_PEA_1_T7 (SEQ ID NO:4330). Table 5904 below describes the starting and ending position of this segment on each transcript.

TABLE 5904

Segment location on transcripts

| Transcript name | Segment starting position | Segment ending position |
|---|---|---|
| HUMGGTX_PEA_1_T7 (SEQ ID NO: 4330) | 1672 | 2404 |

This segment can be found in a non-coding region of transcript(s) that are related to the following protein(s): HUMGGTX_PEA_1_P26.

Segment cluster HUMGGTX_PEA_1_node_28 (SEQ ID NO:6275) according to the present invention is supported by 50 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5905 below describes the starting and ending position of this segment on each transcript.

TABLE 5905

Segment location on transcripts

| Transcript name | Segment starting position | Segment ending position |
|---|---|---|
| HUMGGTX_PEA_1_T7 (SEQ ID NO: 4330) | 2756 | 2926 |
| HUMGGTX_PEA_1_T8 (SEQ ID NO: 4331) | 816 | 986 |
| HUMGGTX_PEA_1_T17 (SEQ ID NO: 4332) | 708 | 878 |

This segment can be found in the following protein(s): HUMGGTX_PEA_1_P26 and HUMGGTX_PEA_1_P1.

Segment cluster HUMGGTX_PEA_1_node_31 (SEQ ID NO:6276) according to the present invention is supported by 51 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5906 below describes the starting and ending position of this segment on each transcript.

TABLE 5906

Segment location on transcripts

| Transcript name | Segment starting position | Segment ending position |
|---|---|---|
| HUMGGTX_PEA_1_T7 (SEQ ID NO: 4330) | 2927 | 3057 |
| HUMGGTX_PEA_1_T8 (SEQ ID NO: 4331) | 987 | 1117 |
| HUMGGTX_PEA_1_T17 (SEQ ID NO: 4332) | 879 | 1009 |

This segment can be found in the following protein(s): HUMGGTX_PEA_1_P26 and HUMGGTX_PEA_1_P1.

Segment cluster HUMGGTX_PEA_1_node_37 (SEQ ID NO:6277) according to the present invention is supported by 53 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5907 below describes the starting and ending position of this segment on each transcript.

TABLE 5907

Segment location on transcripts

| Transcript name | Segment starting position | Segment ending position |
|---|---|---|
| HUMGGTX_PEA_1_T7 (SEQ ID NO: 4330) | 3145 | 3313 |
| HUMGGTX_PEA_1_T8 (SEQ ID NO: 4331) | 1205 | 1373 |
| HUMGGTX_PEA_1_T17 (SEQ ID NO: 4332) | 1097 | 1265 |

This segment can be found in the following protein(s): HUMGGTX_PEA_1_P26 and HUMGGTX_PEA_1_P1.

Segment cluster HUMGGTX_PEA_1_node_40 (SEQ ID NO:6278) according to the present invention is supported by 50 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5908 below describes the starting and ending position of this segment on each transcript.

TABLE 5908

Segment location on transcripts

| Transcript name | Segment starting position | Segment ending position |
|---|---|---|
| HUMGGTX_PEA_1_T7 (SEQ ID NO: 4330) | 3338 | 3495 |
| HUMGGTX_PEA_1_T8 (SEQ ID NO: 4331) | 1398 | 1555 |
| HUMGGTX_PEA_1_T17 (SEQ ID NO: 4332) | 1290 | 1447 |

This segment can be found in the following protein(s): HUMGGTX_PEA_1_P26 and HUMGGTX_PEA_1_P1.

Segment cluster HUMGGTX_PEA_1_node_45 (SEQ ID NO:6279) according to the present invention is supported by 45 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5909 below describes the starting and ending position of this segment on each transcript.

TABLE 5909

Segment location on transcripts

| Transcript name | Segment starting position | Segment ending position |
|---|---|---|
| HUMGGTX_PEA_1_T7 (SEQ ID NO: 4330) | 3496 | 3645 |
| HUMGGTX_PEA_1_T8 (SEQ ID NO: 4331) | 1556 | 1705 |
| HUMGGTX_PEA_1_T17 (SEQ ID NO: 4332) | 1448 | 1597 |

This segment can be found in the following protein(s): HUMGGTX_PEA_1_P26 and HUMGGTX_PEA_1_P1.

Segment cluster HUMGGTX_PEA_1_node_48 (SEQ ID NO:6280) according to the present invention is supported by 47 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5910 below describes the starting and ending position of this segment on each transcript.

TABLE 5910

Segment location on transcripts

| Transcript name | Segment starting position | Segment ending position |
|---|---|---|
| HUMGGTX_PEA_1_T7 (SEQ ID NO: 4330) | 3646 | 3782 |
| HUMGGTX_PEA_1_T8 (SEQ ID NO: 4331) | 1706 | 1842 |
| HUMGGTX_PEA_1_T17 (SEQ ID NO: 4332) | 1598 | 1734 |

This segment can be found in the following protein(s): HUMGGTX_PEA_1_P26 and HUMGGTX_PEA_1_P1.

Segment cluster HUMGGTX_PEA_1_node_54 (SEQ ID NO:6281) according to the present invention is supported by 63 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5911 below describes the starting and ending position of this segment on each transcript.

TABLE 5911

Segment location on transcripts

| Transcript name | Segment starting position | Segment ending position |
| --- | --- | --- |
| HUMGGTX_PEA_1_T7 (SEQ ID NO: 4330) | 3822 | 3970 |
| HUMGGTX_PEA_1_T8 (SEQ ID NO: 4331) | 1882 | 2030 |
| HUMGGTX_PEA_1_T17 (SEQ ID NO: 4332) | 1774 | 1922 |

This segment can be found in the following protein(s): HUMGGTX_PEA_1_P26 and HUMGGTX_PEA_1_P1.

Segment cluster HUMGGTX_PEA_1_node_56 (SEQ ID NO:6282) according to the present invention is supported by 85 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5912 below describes the starting and ending position of this segment on each transcript.

TABLE 5912

Segment location on transcripts

| Transcript name | Segment starting position | Segment ending position |
| --- | --- | --- |
| HUMGGTX_PEA_1_T7 (SEQ ID NO: 4330) | 3971 | 4098 |
| HUMGGTX_PEA_1_T8 (SEQ ID NO: 4331) | 2031 | 2158 |
| HUMGGTX_PEA_1_T17 (SEQ ID NO: 4332) | 1923 | 2050 |

This segment can be found in the following protein(s): HUMGGTX_PEA_1_P26 and HUMGGTX_PEA_1_P1.

Segment cluster HUMGGTX_PEA_1_node_64 (SEQ ID NO:6283) according to the present invention is supported by 68 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5913 below describes the starting and ending position of this segment on each transcript.

TABLE 5913

Segment location on transcripts

| Transcript name | Segment starting position | Segment ending position |
| --- | --- | --- |
| HUMGGTX_PEA_1_T7 (SEQ ID NO: 4330) | 4326 | 4469 |
| HUMGGTX_PEA_1_T8 (SEQ ID NO: 4331) | 2386 | 2529 |
| HUMGGTX_PEA_1_T17 (SEQ ID NO: 4332) | 2278 | 2421 |

This segment can be found in the following protein(s): HUMGGTX_PEA_1_P26 and HUMGGTX_PEA_1_P1.

Segment cluster HUMGGTX_PEA_1_node_65 (SEQ ID NO:6284) according to the present invention is supported by 63 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5914 below describes the starting and ending position of this segment on each transcript.

TABLE 5914

Segment location on transcripts

| Transcript name | Segment starting position | Segment ending position |
| --- | --- | --- |
| HUMGGTX_PEA_1_T7 (SEQ ID NO: 4330) | 4470 | 4641 |
| HUMGGTX_PEA_1_T8 (SEQ ID NO: 4331) | 2530 | 2701 |
| HUMGGTX_PEA_1_T17 (SEQ ID NO: 4332) | 2422 | 2593 |

This segment can be found in both coding and non-coding regions of transcript(s) as follows. The segment can be found in a non-coding region of transcript(s) that are related to the following protein(s): HUMGGTX_PEA_1_P26. This segment can also be found in the following protein(s): HUMGGTX_PEA_1_P1, since it is in the coding region for the corresponding transcript.

According to an optional embodiment of the present invention, short segments related to the above cluster are also provided. These segments are up to about 120 bp in length, and so are included in a separate description.

Segment cluster HUMGGTX_PEA_1_node_16 (SEQ ID NO:6285) according to the present invention is supported by 31 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5915 below describes the starting and ending position of this segment on each transcript.

TABLE 5915

Segment location on transcripts

| Transcript name | Segment starting position | Segment ending position |
| --- | --- | --- |
| HUMGGTX_PEA_1_T7 (SEQ ID NO: 4330) | 395 | 464 |

TABLE 5915-continued

Segment location on transcripts

| Transcript name | Segment starting position | Segment ending position |
|---|---|---|
| HUMGGTX_PEA_1_T8 (SEQ ID NO: 4331) | 395 | 464 |
| HUMGGTX_PEA_1_T17 (SEQ ID NO: 4332) | 395 | 464 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_20 (SEQ ID NO:6286) according to the present invention is supported by 30 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5916 below describes the starting and ending position of this segment on each transcript.

TABLE 5916

Segment location on transcripts

| Transcript name | Segment starting position | Segment ending position |
|---|---|---|
| HUMGGTX_PEA_1_T7 (SEQ ID NO: 4330) | 2405 | 2473 |
| HUMGGTX_PEA_1_T8 (SEQ ID NO: 4331) | 465 | 533 |
| HUMGGTX_PEA_1_T17 (SEQ ID NO: 4332) | 465 | 533 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_22 (SEQ ID NO:6287) according to the present invention is supported by 18 libraries. The number of libraries was determined as previously described. This segment can be found in the following transcript(s): HUMGGTX_PEA_1_T7 (SEQ ID NO:4330) and HUMGGTX_PEA_1_T8 (SEQ ID NO:4331). Table 5917 below describes the starting and ending position of this segment on each transcript.

TABLE 5917

Segment location on transcripts

| Transcript name | Segment starting position | Segment ending position |
|---|---|---|
| HUMGGTX_PEA_1_T7 (SEQ ID NO: 4330) | 2474 | 2560 |
| HUMGGTX_PEA_1_T8 (SEQ ID NO: 4331) | 534 | 620 |

This segment can be found in a non-coding region of transcript(s) that are related to the following protein(s): HUMGGTX_PEA_1_P26.

Segment cluster HUMGGTX_PEA_1_node_23 (SEQ ID NO:6288) according to the present invention can be found in the following transcript(s): HUMGGTX_PEA_1_T7 (SEQ ID NO:4330) and HUMGGTX_PEA_1_T8 (SEQ ID NO:4331). Table 5918 below describes the starting and ending position of this segment on each transcript.

TABLE 5918

Segment location on transcripts

| Transcript name | Segment starting position | Segment ending position |
|---|---|---|
| HUMGGTX_PEA_1_T7 (SEQ ID NO: 4330) | 2561 | 2581 |
| HUMGGTX_PEA_1_T8 (SEQ ID NO: 4331) | 621 | 641 |

This segment can be found in a non-coding region of transcript(s) that are related to the following protein(s): HUMGGTX_PEA_1_P26.

Segment cluster HUMGGTX_PEA_1_node_24 (SEQ ID NO:6289) according to the present invention is supported by 37 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5919 below describes the starting and ending position of this segment on each transcript.

TABLE 5919

Segment location on transcripts

| Transcript name | Segment starting position | Segment ending position |
|---|---|---|
| HUMGGTX_PEA_1_T7 (SEQ ID NO: 4330) | 2582 | 2637 |
| HUMGGTX_PEA_1_T8 (SEQ ID NO: 4331) | 642 | 697 |
| HUMGGTX_PEA_1_T17 (SEQ ID NO: 4332) | 534 | 589 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_25 (SEQ ID NO:6290) according to the present invention is supported by 40 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5920 below describes the starting and ending position of this segment on each transcript.

TABLE 5920

Segment location on transcripts

| Transcript name | Segment starting position | Segment ending position |
|---|---|---|
| HUMGGTX_PEA_1_T7 (SEQ ID NO: 4330) | 2638 | 2678 |
| HUMGGTX_PEA_1_T8 (SEQ ID NO: 4331) | 698 | 738 |
| HUMGGTX_PEA_1_T17 (SEQ ID NO: 4332) | 590 | 630 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_26 (SEQ ID NO:6291) according to the present invention is supported by 42 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5921 below describes the starting and ending position of this segment on each transcript.

TABLE 5921

| | Segment location on transcripts | |
|---|---|---|
| Transcript name | Segment starting position | Segment ending position |
| HUMGGTX_PEA_1_T7 (SEQ ID NO: 4330) | 2679 | 2755 |
| HUMGGTX_PEA_1_T8 (SEQ ID NO: 4331) | 739 | 815 |
| HUMGGTX_PEA_1_T17 (SEQ ID NO: 4332) | 631 | 707 |

This segment can be found in a non-coding region of transcript(s) that are related to the following protein(s): HUMGGTX_PEA_1_P26 and HUMGGTX_PEA_1_P1.

Segment cluster HUMGGTX_PEA_1_node_33 (SEQ ID NO:6292) according to the present invention is supported by 54 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5922 below describes the starting and ending position of this segment on each transcript.

TABLE 5922

| | Segment location on transcripts | |
|---|---|---|
| Transcript name | Segment starting position | Segment ending position |
| HUMGGTX_PEA_1_T7 (SEQ ID NO: 4330) | 3058 | 3144 |
| HUMGGTX_PEA_1_T8 (SEQ ID NO: 4331) | 1118 | 1204 |
| HUMGGTX_PEA_1_T17 (SEQ ID NO: 4332) | 1010 | 1096 |

This segment can be found in the following protein(s): HUMGGTX_PEA_1_P26 and HUMGGTX_PEA_1_P1.

Segment cluster HUMGGTX_PEA_1_node_38 (SEQ ID NO:6293) according to the present invention can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5923 below describes the starting and ending position of this segment on each transcript.

TABLE 5923

| | Segment location on transcripts | |
|---|---|---|
| Transcript name | Segment starting position | Segment ending position |
| HUMGGTX_PEA_1_T7 (SEQ ID NO: 4330) | 3314 | 3337 |
| HUMGGTX_PEA_1_T8 (SEQ ID NO: 4331) | 1374 | 1397 |

TABLE 5923-continued

| | Segment location on transcripts | |
|---|---|---|
| Transcript name | Segment starting position | Segment ending position |
| HUMGGTX_PEA_1_T17 (SEQ ID NO: 4332) | 1266 | 1289 |

This segment can be found in the following protein(s): HUMGGTX_PEA_1_P26 and HUMGGTX_PEA_1_P1.

Segment cluster HUMGGTX_PEA_1_node_53 (SEQ ID NO:6294) according to the present invention is supported by 48 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5924 below describes the starting and ending position of this segment on each transcript.

TABLE 5924

| | Segment location on transcripts | |
|---|---|---|
| Transcript name | Segment starting position | Segment ending position |
| HUMGGTX_PEA_1_T7 (SEQ ID NO: 4330) | 3783 | 3821 |
| HUMGGTX_PEA_1_T8 (SEQ ID NO: 4331) | 1843 | 1881 |
| HUMGGTX_PEA_1_T17 (SEQ ID NO: 4332) | 1735 | 1773 |

This segment can be found in the following protein(s): HUMGGTX_PEA_1_P26 and HUMGGTX_PEA_1_P1.

Segment cluster HUMGGTX_PEA_1_node_58 (SEQ ID NO:6295) according to the present invention is supported by 74 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T17 (SEQ ID NO:4332). Table 5925 below describes the starting and ending position of this segment on each transcript.

TABLE 5925

| | Segment location on transcripts | |
|---|---|---|
| Transcript name | Segment starting position | Segment ending position |
| HUMGGTX_PEA_1_T7 (SEQ ID NO: 4330) | 4099 | 4125 |
| HUMGGTX_PEA_1_T8 (SEQ ID NO: 4331) | 2159 | 2185 |
| HUMGGTX_PEA_1_T17 (SEQ ID NO: 4332) | 2051 | 2077 |

This segment can be found in the following protein(s): HUMGGTX_PEA_1_P26 and HUMGGTX_PEA_1_P1.

Segment cluster HUMGGTX_PEA_1_node_59 (SEQ ID NO:6296) according to the present invention is supported by 78 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331)

and HUMGGTX_PEA_1_T17 (SEQ ID NO:4332). Table 5926 below describes the starting and ending position of this segment on each transcript.

TABLE 5926

Segment location on transcripts

| Transcript name | Segment starting position | Segment ending position |
|---|---|---|
| HUMGGTX_PEA_1_T7 (SEQ ID NO: 4330) | 4126 | 4211 |
| HUMGGTX_PEA_1_T8 (SEQ ID NO: 4331) | 2186 | 2271 |
| HUMGGTX_PEA_1_T17 (SEQ ID NO: 4332) | 2078 | 2163 |

This segment can be found in the following protein(s): HUMGGTX_PEA_1_P26 and HUMGGTX_PEA_1_P1.

Segment cluster HUMGGTX_PEA_1_node_61 (SEQ ID NO:6297) according to the present invention is supported by 73 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T117 (SEQ ID NO:4332). Table 5927 below describes the starting and ending position of this segment on each transcript.

TABLE 5927

Segment location on transcripts

| Transcript name | Segment starting position | Segment ending position |
|---|---|---|
| HUMGGTX_PEA_1_T7 (SEQ ID NO: 4330) | 4212 | 4291 |
| HUMGGTX_PEA_1_T8 (SEQ ID NO: 4331) | 2272 | 2351 |
| HUMGGTX_PEA_1_T17 (SEQ ID NO: 4332) | 2164 | 2243 |

This segment can be found in the following protein(s): HUMGGTX_PEA_1_P26 and HUMGGTX_PEA_1_P1.

Segment cluster HUMGGTX_PEA_1_node_62 (SEQ ID NO:6298) according to the present invention is supported by 68 libraries. The number of libraries was determined as previously described. This segment can be found in the following transcript(s): HUMGGTX_PEA_1_T7 (SEQ ID NO:4330), HUMGGTX_PEA_1_T8 (SEQ ID NO:4331) and HUMGGTX_PEA_1_T117 (SEQ ID NO:4332). Table 5928 below describes the starting and ending position of this segment on each transcript.

TABLE 5928

Segment location on transcripts

| Transcript name | Segment starting position | Segment ending position |
|---|---|---|
| HUMGGTX_PEA_1_T7 (SEQ ID NO: 4330) | 4292 | 4325 |
| HUMGGTX_PEA_1_T8 (SEQ ID NO: 4331) | 2352 | 2385 |
| HUMGGTX_PEA_1_T17 (SEQ ID NO: 4332) | 2244 | 2277 |

This segment can be found in the following protein(s): HUMGGTX_PEA_1_P26 and HUMGGTX_PEA_1_P1.

Description for Cluster HUMVWF

Cluster HUMVWF features 12 transcript(s) and 82 segment(s) of interest, the names for which are given in Tables 5929 and 5930, respectively, the sequences themselves are given at the end of the application. The selected protein variants are given in Table 5931.

TABLE 5929

Transcripts of interest
Transcript Name

HUMVWF_PEA_1_T1 (SEQ ID NO: 4335)
HUMVWF_PEA_1_T5 (SEQ ID NO: 4336)
HUMVWF_PEA_1_T25 (SEQ ID NO: 4337)
HUMVWF_PEA_1_T27 (SEQ ID NO: 4338)
HUMVWF_PEA_1_T28 (SEQ ID NO: 4339)
HUMVWF_PEA_1_T32 (SEQ ID NO: 4340)
HUMVWF_PEA_1_T34 (SEQ ID NO: 4341)
HUMVWF_PEA_1_T37 (SEQ ID NO: 4342)
HUMVWF_PEA_1_T38 (SEQ ID NO: 4343)
HUMVWF_PEA_1_T45 (SEQ ID NO: 4344)
HUMVWF_PEA_1_T46 (SEQ ID NO: 4345)
HUMVWF_PEA_1_T49 (SEQ ID NO: 4346)

TABLE 5930

Segments of interest
Segment Name

HUMVWF_PEA_1_node_0 (SEQ ID NO: 6299)
HUMVWF_PEA_1_node_7 (SEQ ID NO: 6300)
HUMVWF_PEA_1_node_8 (SEQ ID NO: 6301)
HUMVWF_PEA_1_node_16 (SEQ ID NO: 6302)
HUMVWF_PEA_1_node_20 (SEQ ID NO: 6303)
HUMVWF_PEA_1_node_22 (SEQ ID NO: 6304)
HUMVWF_PEA_1_node_24 (SEQ ID NO: 6305)
HUMVWF_PEA_1_node_30 (SEQ ID NO: 6306)
HUMVWF_PEA_1_node_32 (SEQ ID NO: 6307)
HUMVWF_PEA_1_node_37 (SEQ ID NO: 6308)
HUMVWF_PEA_1_node_38 (SEQ ID NO: 6309)
HUMVWF_PEA_1_node_39 (SEQ ID NO: 6310)
HUMVWF_PEA_1_node_41 (SEQ ID NO: 6311)
HUMVWF_PEA_1_node_43 (SEQ ID NO: 6312)
HUMVWF_PEA_1_node_47 (SEQ ID NO: 6313)
HUMVWF_PEA_1_node_51 (SEQ ID NO: 6314)
HUMVWF_PEA_1_node_53 (SEQ ID NO: 6315)
HUMVWF_PEA_1_node_55 (SEQ ID NO: 6316)
HUMVWF_PEA_1_node_57 (SEQ ID NO: 6317)
HUMVWF_PEA_1_node_60 (SEQ ID NO: 6318)
HUMVWF_PEA_1_node_61 (SEQ ID NO: 6319)
HUMVWF_PEA_1_node_62 (SEQ ID NO: 6320)
HUMVWF_PEA_1_node_63 (SEQ ID NO: 6321)

TABLE 5930-continued

Segments of interest
Segment Name

HUMVWF_PEA_1_node_65 (SEQ ID NO: 6322)
HUMVWF_PEA_1_node_67 (SEQ ID NO: 6323)
HUMVWF_PEA_1_node_69 (SEQ ID NO: 6324)
HUMVWF_PEA_1_node_71 (SEQ ID NO: 6325)
HUMVWF_PEA_1_node_75 (SEQ ID NO: 6326)
HUMVWF_PEA_1_node_81 (SEQ ID NO: 6327)
HUMVWF_PEA_1_node_93 (SEQ ID NO: 6328)
HUMVWF_PEA_1_node_95 (SEQ ID NO: 6329)
HUMVWF_PEA_1_node_98 (SEQ ID NO: 6330)
HUMVWF_PEA_1_node_100 (SEQ ID NO: 6331)
HUMVWF_PEA_1_node_110 (SEQ ID NO: 6332)
HUMVWF_PEA_1_node_112 (SEQ ID NO: 6333)
HUMVWF_PEA_1_node_118 (SEQ ID NO: 6334)
HUMVWF_PEA_1_node_129 (SEQ ID NO: 6335)
HUMVWF_PEA_1_node_130 (SEQ ID NO: 6336)
HUMVWF_PEA_1_node_131 (SEQ ID NO: 6337)
HUMVWF_PEA_1_node_133 (SEQ ID NO: 6338)
HUMVWF_PEA_1_node_139 (SEQ ID NO: 6339)
HUMVWF_PEA_1_node_140 (SEQ ID NO: 6340)
HUMVWF_PEA_1_node_141 (SEQ ID NO: 6341)
HUMVWF_PEA_1_node_1 (SEQ ID NO: 6342)
HUMVWF_PEA_1_node_6 (SEQ ID NO: 6343)
HUMVWF_PEA_1_node_10 (SEQ ID NO: 6344)
HUMVWF_PEA_1_node_11 (SEQ ID NO: 6345)
HUMVWF_PEA_1_node_13 (SEQ ID NO: 6346)
HUMVWF_PEA_1_node_14 (SEQ ID NO: 6347)
HUMVWF_PEA_1_node_18 (SEQ ID NO: 6348)
HUMVWF_PEA_1_node_19 (SEQ ID NO: 6349)
HUMVWF_PEA_1_node_26 (SEQ ID NO: 6350)
HUMVWF_PEA_1_node_28 (SEQ ID NO: 6351)
HUMVWF_PEA_1_node_34 (SEQ ID NO: 6352)
HUMVWF_PEA_1_node_45 (SEQ ID NO: 6353)
HUMVWF_PEA_1_node_49 (SEQ ID NO: 6354)
HUMVWF_PEA_1_node_59 (SEQ ID NO: 6355)
HUMVWF_PEA_1_node_73 (SEQ ID NO: 6356)
HUMVWF_PEA_1_node_77 (SEQ ID NO: 6357)
HUMVWF_PEA_1_node_78 (SEQ ID NO: 6358)
HUMVWF_PEA_1_node_79 (SEQ ID NO: 6359)
HUMVWF_PEA_1_node_83 (SEQ ID NO: 6360)
HUMVWF_PEA_1_node_86 (SEQ ID NO: 6361)
HUMVWF_PEA_1_node_87 (SEQ ID NO: 6362)
HUMVWF_PEA_1_node_88 (SEQ ID NO: 6363)
HUMVWF_PEA_1_node_92 (SEQ ID NO: 6364)
HUMVWF_PEA_1_node_96 (SEQ ID NO: 6365)
HUMVWF_PEA_1_node_104 (SEQ ID NO: 6366)
HUMVWF_PEA_1_node_106 (SEQ ID NO: 6367)
HUMVWF_PEA_1_node_108 (SEQ ID NO: 6368)
HUMVWF_PEA_1_node_114 (SEQ ID NO: 6369)
HUMVWF_PEA_1_node_117 (SEQ ID NO: 6370)
HUMVWF_PEA_1_node_119 (SEQ ID NO: 6371)
HUMVWF_PEA_1_node_122 (SEQ ID NO: 6372)
HUMVWF_PEA_1_node_125 (SEQ ID NO: 6373)
HUMVWF_PEA_1_node_127 (SEQ ID NO: 6374)
HUMVWF_PEA_1_node_132 (SEQ ID NO: 6375)
HUMVWF_PEA_1_node_134 (SEQ ID NO: 6376)
HUMVWF_PEA_1_node_135 (SEQ ID NO: 6377)
HUMVWF_PEA_1_node_136 (SEQ ID NO: 6378)
HUMVWF_PEA_1_node_137 (SEQ ID NO: 6379)
HUMVWF_PEA_1_node_138 (SEQ ID NO: 6380)

TABLE 5931

Proteins of interest

| Protein Name | Corresponding Transcript(s) |
| --- | --- |
| HUMVWF_PEA_1_P1 | HUMVWF_PEA_1_T1 (SEQ ID NO: 4335) |
| HUMVWF_PEA_1_P2 | HUMVWF_PEA_1_T37 (SEQ ID NO: 4342); HUMVWF_PEA_1_T38 (SEQ ID NO: 4343); HUMVWF_PEA_1_T5 (SEQ ID NO: 4336) |
| HUMVWF_PEA_1_P19 | HUMVWF_PEA_1_T25 (SEQ ID NO: 4337) |
| HUMVWF_PEA_1_P20 | HUMVWF_PEA_1_T27 (SEQ ID NO: 4338) |
| HUMVWF_PEA_1_P21 | HUMVWF_PEA_1_T28 (SEQ ID NO: 4339) |
| HUMVWF_PEA_1_P25 | HUMVWF_PEA_1_T32 (SEQ ID NO: 4340) |
| HUMVWF_PEA_1_P27 | HUMVWF_PEA_1_T34 (SEQ ID NO: 4341) |
| HUMVWF_PEA_1_P30 | HUMVWF_PEA_1_T46 (SEQ ID NO: 4345) |
| HUMVWF_PEA_1_P32 | HUMVWF_PEA_1_T45 (SEQ ID NO: 4344) |
| HUMVWF_PEA_1_P33 | HUMVWF_PEA_1_T49 (SEQ ID NO: 4346) |

These sequences are variants of the known protein Von Willebrand factor precursor (SwissProt accession identifier VWF_HUMAN; known also according to the synonyms vWF), referred to herein as the previously known protein.

Protein Von Willebrand factor precursor is known or believed to have the following function(s): Important in the maintenance of homeostasis, it participates in platelet-vessel wall interactions by forming a noncovalent complex with coagulation factor VIII at the site of vascular injury. The sequence for protein Von Willebrand factor precursor is given at the end of the application, as "Von Willebrand factor precursor amino acid sequence". Known polymorphisms for this sequence are as shown in Table 5932.

TABLE 5932

Amino acid mutations for Known Protein

| SNP position(s) on amino acid sequence | Comment |
|---|---|
| 273 | R -> W (in VWD; type I/III; defect in secretion and formation of multimers). /FTId = VAR_010242. |
| 377 | W -> C (in VWD; type III). /FTId = VAR_005782. |
| 528 | N -> S (in VWD; type IIC). /FTId = VAR_005783. |
| 550 | G -> R (in VWD; type IIC). /FTId = VAR_005784. |
| 788 | C -> Y (in VWD; type II). /FTId = VAR_009141. |
| 789 | T -> A (in dbSNP:1063856). /FTId = VAR_005785. |
| 791 | T -> M (in Normandy-1). /FTId = VAR_005786. |
| 816 | R -> W (in Normandy-2). /FTId = VAR_005787. |
| 852 | R -> Q (in dbSNP:216321). /FTId = VAR_005788. |
| 854 | R -> Q (in Normandy-3). /FTId = VAR_005789. |
| 857 | N -> D. /FTId = VAR_005790. |
| 1266 | P -> L (in VWD; type I). /FTId = VAR_005791. |
| 1268 | H -> D (in VWD; type IIB). /FTId = VAR_005792. |
| 1272 | C -> R (in VWD; type IIA). /FTId = VAR_005793. |
| 1306 | R -> W (in VWD; type IIB). /FTId = VAR_005794. |
| 1308 | R -> C (in VWD; type IIB). /FTId = VAR_005795. |
| 1313 | W -> C (in VWD; type IIB). /FTId = VAR_005796. |
| 1314 | V -> L (in VWD; type IIB). /FTId = VAR_005797. |
| 1316 | V -> M (in VWD; type IIB). /FTId = VAR_005798. |
| 1318 | V -> L (in VWD; type IIB). /FTId = VAR_005799. |
| 1324 | G -> S (in VWD; type IIB). /FTId = VAR_005800. |
| 1341 | R -> Q (in VWD; type IIB). /FTId = VAR_005801. |
| 1374 | R -> C (in VWD). /FTId = VAR_005802. |
| 1374 | R -> H (in VWD). /FTId = VAR_005803. |
| 1381 | A -> T (in dbSNP:216311). /FTId = VAR_005804. |
| 1399 | R -> H (in dbSNP:216312). /FTId = VAR_005805. |
| 1460 | L -> V (in VWD; type IIB). /FTId = VAR_005806. |
| 1461 | A -> V (in VWD; type IIB). /FTId = VAR_005807. |
| 1514 | F -> C (in VWD; type IIA). /FTId = VAR_005808. |
| 1540 | L -> P (in VWD; type IIA). /FTId = VAR_005809. |
| 1565 | V -> L (in dbSNP:1800385). /FTId = VAR_014630. |
| 1584 | Y -> C (in dbSNP:1800386). /FTId = VAR_005810. |
| 1597 | R -> G (in VWD; type IIA). /FTId = VAR_005811. |
| 1597 | R -> Q (in VWD; type IIA). /FTId = VAR_005812. |
| 1597 | R -> W (in VWD; type IIA). /FTId = VAR_005813. |
| 1607 | V -> D (in VWD; type IIA). /FTId = VAR_005814. |
| 1609 | G -> R (in VWD; type IIA). /FTId = VAR_005815. |
| 1613 | S -> P (in VWD; type IIA). /FTId = VAR_005816. |
| 1628 | I -> T (in VWD; type IIA). /FTId = VAR_005817. |
| 1638 | E -> K (in VWD; type IIA). /FTId = VAR_005818. |
| 1648 | P -> S (in VWD; type IIA). /FTId = VAR_005819. |
| 1665 | V -> E (in VWD; type IIA). /FTId = VAR_005820. |
| 2063 | P -> S (in VWD; type III). /FTId = VAR_009142. |
| 2362 | C -> F (in VWD; type III). /FTId = VAR_009143. |
| 2546 | N -> Y (in VWD; type III). /FTId = VAR_009144. |
| 2739 | C -> Y (in VWD; type III). /FTId = VAR_005821. |
| 2773 | C -> R (in VWD; type IID). /FTId = VAR_005822. |
| 471 | I -> V |
| 484 | H -> R |
| 770 | P -> H |
| 804 | C -> S |
| 1472 | H -> D |
| 1914 | S -> T |
| 2168 | C -> S |

The previously known protein also has the following indication(s) and/or potential therapeutic use(s): von Willebrand's disease. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Factor VIII modulator. A therapeutic role for a protein represented by the cluster has been predicted. The cluster was assigned this field because there was information in the drug database or the public databases (e.g., described herein above) that this protein, or part thereof, is used or can be used for a potential therapeutic indication: Haemostatic; Antithrombotic.

The following GO Annotation(s) apply to the previously known protein. The following annotation(s) were found: cell adhesion; blood coagulation, which are annotation(s) related to Biological Process; protein binding, which are annotation(s) related to Molecular Function; and extracellular matrix; extracellular space, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HUMVWF can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 142 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 142 and Table 5933. This cluster is overexpressed (at least at a minimum level) in the following pathological conditions: kidney malignant tumors and pancreas carcinoma.

TABLE 5933

Normal tissue distribution

| Name of Tissue | Number |
|---|---|
| adrenal | 40 |
| bladder | 123 |
| Bone | 97 |
| Brain | 82 |
| Colon | 94 |
| epithelial | 97 |
| general | 155 |
| head and neck | 131 |
| kidney | 8 |
| Liver | 0 |

TABLE 5933-continued

Normal tissue distribution

| Name of Tissue | Number |
|---|---|
| Lung | 150 |
| Lymph nodes | 75 |
| Breast | 334 |
| muscle | 151 |
| Ovary | 123 |
| pancreas | 0 |
| prostate | 32 |
| Skin | 80 |
| stomach | 73 |
| Thyroid | 167 |
| Uterus | 95 |

TABLE 5934

P values and ratios for expression in cancerous tissue

| Name of Tissue | P1 | P2 | SP1 | R3 | SP2 | R4 |
|---|---|---|---|---|---|---|
| adrenal | 3.5e-01 | 4.2e-01 | 1.4e-01 | 2.9 | 2.3e-01 | 2.2 |
| bladder | 7.6e-01 | 8.0e-01 | 7.7e-01 | 0.8 | 9.1e-01 | 0.6 |
| Bone | 2.3e-01 | 5.8e-01 | 6.7e-01 | 1.1 | 9.3e-01 | 0.6 |
| Brain | 2.7e-01 | 5.6e-01 | 1.6e-02 | 1.3 | 3.2e-01 | 0.8 |
| Colon | 3.0e-01 | 3.6e-01 | 9.3e-01 | 0.6 | 9.7e-01 | 0.5 |
| epithelial | 5.1e-02 | 8.4e-01 | 1.8e-01 | 1.1 | 1 | 0.6 |
| general | 2.0e-01 | 9.2e-01 | 1 | 0.7 | 1 | 0.3 |
| head and neck | 6.0e-01 | 7.2e-01 | 1 | 0.6 | 1 | 0.5 |
| kidney | 5.7e-02 | 1.7e-01 | 5.8e-05 | 8.6 | 1.6e-03 | 5.4 |
| Liver | 1.8e-02 | 4.5e-01 | 2.3e-01 | 4.6 | 6.9e-01 | 1.5 |
| Lung | 3.5e-01 | 8.1e-01 | 4.6e-01 | 0.9 | 9.8e-01 | 0.4 |
| Lymph nodes | 6.9e-01 | 8.6e-01 | 8.1e-01 | 0.7 | 9.9e-01 | 0.3 |
| Breast | 7.8e-01 | 8.3e-01 | 9.9e-01 | 0.3 | 1 | 0.2 |
| muscle | 4.9e-01 | 5.5e-01 | 3.2e-02 | 1.5 | 6.2e-01 | 0.5 |
| Ovary | 8.4e-01 | 8.6e-01 | 9.6e-01 | 0.4 | 9.9e-01 | 0.4 |
| pancreas | 1.4e-03 | 1.1e-02 | 1.0e-03 | 9.2 | 5.9e-03 | 6.4 |
| prostate | 3.7e-01 | 5.0e-01 | 2.7e-01 | 1.6 | 4.4e-01 | 1.2 |
| Skin | 6.0e-01 | 8.1e-01 | 6.6e-01 | 1.0 | 1 | 0.2 |
| stomach | 4.2e-01 | 8.6e-01 | 1.5e-01 | 1.0 | 7.9e-01 | 0.5 |
| Thyroid | 7.4e-01 | 7.4e-01 | 1 | 0.5 | 1 | 0.5 |
| Uterus | 6.3e-01 | 8.4e-01 | 7.0e-01 | 0.8 | 9.5e-01 | 0.5 |

As noted above, cluster HUMVWF features 82 segment(s), which were listed in Table 5930 above and for which the sequence(s) are given at the end of the application. These segment(s) are portions of nucleic acid sequence(s) which are described herein separately because they are of particular interest. A description of each segment according to the present invention is now provided.

Segment cluster HUMVWF_PEA_1_node_0 (SEQ ID NO:6299) according to the present invention is supported by 15 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5935 below describes the starting and ending position of this segment on each transcript.

TABLE 5935

Segment location on transcripts

| Transcript name | Segment starting position | Segment ending position |
|---|---|---|
| HUMVWF_PEA_1_T1 (SEQ ID NO: 4335) | 1 | 174 |
| HUMVWF_PEA_1_T5 (SEQ ID NO: 4336) | 1 | 174 |
| HUMVWF_PEA_1_T25 (SEQ ID NO: 4337) | 1 | 174 |
| HUMVWF_PEA_1_T28 (SEQ ID NO: 4339) | 1 | 174 |
| HUMVWF_PEA_1_T32 (SEQ ID NO: 4340) | 1 | 174 |
| HUMVWF_PEA_1_T37 (SEQ ID NO: 4342) | 1 | 174 |
| HUMVWF_PEA_1_T38 (SEQ ID NO: 4343) | 1 | 174 |
| HUMVWF_PEA_1_T45 (SEQ ID NO: 4344) | 1 | 174 |
| HUMVWF_PEA_1_T46 (SEQ ID NO: 4345) | 1 | 174 |
| HUMVWF_PEA_1_T49 (SEQ ID NO: 4346) | 1 | 174 |

This segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P25, HUMVWF_PEA_1_P32, HUMVWF_PEA_1_P30 and HUMVWF_PEA_1_P33.

Segment cluster HUMVWF_PEA_1_node_7 (SEQ ID NO:6300) according to the present invention is supported by 3 libraries. The number of libraries was determined as previously described. This segment can be found in the following transcript(s): HUMVWF_PEA_1_T1 (SEQ ID NO:4335) and HUMVWF_PEA_1_T37 (SEQ ID NO:4342). Table 5936 below describes the starting and ending position of this segment on each transcript.

TABLE 5936

Segment location on transcripts

| Transcript name | Segment starting position | Segment ending position |
|---|---|---|
| HUMVWF_PEA_1_T1 (SEQ ID NO: 4335) | 307 | 481 |
| HUMVWF_PEA_1_T37 (SEQ ID NO: 4342) | 307 | 481 |

This segment can be found in a non-coding region of transcript(s) that are related to the following protein(s): HUMVWF_PEA_1_P1 and HUMVWF_PEA_1_P2.

Segment cluster HUMVWF_PEA_1_node_8 (SEQ ID NO:6301) according to the present invention is supported by 4 libraries. The number of libraries was determined as previously described. This segment can be found in the following transcript(s): HUMVWF_PEA_1_T1 (SEQ ID NO:4335), HUMVWF_PEA_1_T37 (SEQ ID NO:4342) and HUMVWF_PEA_1_T38 (SEQ ID NO:4343). Table 5937 below describes the starting and ending position of this segment on each transcript.

TABLE 5937

Segment location on transcripts

| Transcript name | Segment starting position | Segment ending position |
|---|---|---|
| HUMVWF_PEA_1_T1 (SEQ ID NO: 4335) | 482 | 723 |
| HUMVWF_PEA_1_T37 (SEQ ID NO: 4342) | 482 | 723 |
| HUMVWF_PEA_1_T38 (SEQ ID NO: 4343) | 307 | 548 |

This segment can be found in a non-coding region of transcript(s) that are related to the following protein(s): HUMVWF_PEA_1_P1 and HUMVWF_PEA_1_P2.

Segment cluster HUMVWF_PEA_1_node_16 (SEQ ID NO:6302) according to the present invention is supported by 8 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5938 below describes the starting and ending position of this segment on each transcript.

TABLE 5938

Segment location on transcripts

| Transcript name | Segment starting position | Segment ending position |
|---|---|---|
| HUMVWF_PEA_1_T1 (SEQ ID NO: 4335) | 992 | 1200 |
| HUMVWF_PEA_1_T5 (SEQ ID NO: 4336) | 575 | 783 |
| HUMVWF_PEA_1_T25 (SEQ ID NO: 4337) | 575 | 783 |
| HUMVWF_PEA_1_T28 (SEQ ID NO: 4339) | 575 | 783 |
| HUMVWF_PEA_1_T32 (SEQ ID NO: 4340) | 575 | 783 |
| HUMVWF_PEA_1_T37 (SEQ ID NO: 4342) | 992 | 1200 |
| HUMVWF_PEA_1_T38 (SEQ ID NO: 4343) | 817 | 1025 |
| HUMVWF_PEA_1_T45 (SEQ ID NO: 4344) | 575 | 783 |
| HUMVWF_PEA_1_T46 (SEQ ID NO: 4345) | 575 | 783 |
| HUMVWF_PEA_1_T49 (SEQ ID NO: 4346) | 575 | 783 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_20 (SEQ ID NO:6303) according to the present invention is supported by 2 libraries. The number of libraries was determined as previously described. This segment can be found in the following transcript(s): HUMVWF_PEA_1_T32 (SEQ ID NO:4340). Table 5939 below describes the starting and ending position of this segment on each transcript.

TABLE 5939

Segment location on transcripts

| Transcript name | Segment starting position | Segment ending position |
|---|---|---|
| HUMVWF_PEA_1_T32 (SEQ ID NO: 4340) | 909 | 1086 |

This segment can be found in the following protein(s): HUMVWF_PEA_1_P25.

Segment cluster HUMVWF_PEA_1_node_22 (SEQ ID NO:6304) according to the present invention is supported by 11 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5940 below describes the starting and ending position of this segment on each transcript.

TABLE 5940

Segment location on transcripts

| Transcript name | Segment starting position | Segment ending position |
|---|---|---|
| HUMVWF_PEA_1_T1 (SEQ ID NO: 4335) | 1326 | 1543 |
| HUMVWF_PEA_1_T5 (SEQ ID NO: 4336) | 909 | 1126 |
| HUMVWF_PEA_1_T25 (SEQ ID NO: 4337) | 909 | 1126 |
| HUMVWF_PEA_1_T28 (SEQ ID NO: 4339) | 909 | 1126 |
| HUMVWF_PEA_1_T37 (SEQ ID NO: 4342) | 1326 | 1543 |
| HUMVWF_PEA_1_T38 (SEQ ID NO: 4343) | 1151 | 1368 |
| HUMVWF_PEA_1_T45 (SEQ ID NO: 4344) | 909 | 1126 |
| HUMVWF_PEA_1_T46 (SEQ ID NO: 4345) | 909 | 1126 |
| HUMVWF_PEA_1_T49 (SEQ ID NO: 4346) | 909 | 1126 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_24 (SEQ ID NO:6305) according to the present invention is supported by 13 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5941 below describes the starting and ending position of this segment on each transcript.

TABLE 5941

Segment location on transcripts

| Transcript name | Segment starting position | Segment ending position |
| --- | --- | --- |
| HUMVWF_PEA_1_T1 (SEQ ID NO: 4335) | 1544 | 1666 |
| HUMVWF_PEA_1_T5 (SEQ ID NO: 4336) | 1127 | 1249 |
| HUMVWF_PEA_1_T25 (SEQ ID NO: 4337) | 1127 | 1249 |
| HUMVWF_PEA_1_T28 (SEQ ID NO: 4339) | 1127 | 1249 |
| HUMVWF_PEA_1_T37 (SEQ ID NO: 4342) | 1544 | 1666 |
| HUMVWF_PEA_1_T38 (SEQ ID NO: 4343) | 1369 | 1491 |
| HUMVWF_PEA_1_T45 (SEQ ID NO: 4344) | 1127 | 1249 |
| HUMVWF_PEA_1_T46 (SEQ ID NO: 4345) | 1127 | 1249 |
| HUMVWF_PEA_1_T49 (SEQ ID NO: 4346) | 1127 | 1249 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_30 (SEQ ID NO:6306) according to the present invention is supported by 11 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5942 below describes the starting and ending position of this segment on each transcript.

TABLE 5942

Segment location on transcripts

| Transcript name | Segment starting position | Segment ending position |
| --- | --- | --- |
| HUMVWF_PEA_1_T1 (SEQ ID NO: 4335) | 1826 | 1962 |
| HUMVWF_PEA_1_T5 (SEQ ID NO: 4336) | 1409 | 1545 |
| HUMVWF_PEA_1_T25 (SEQ ID NO: 4337) | 1409 | 1545 |
| HUMVWF_PEA_1_T28 (SEQ ID NO: 4339) | 1409 | 1545 |
| HUMVWF_PEA_1_T37 (SEQ ID NO: 4342) | 1826 | 1962 |
| HUMVWF_PEA_1_T38 (SEQ ID NO: 4343) | 1651 | 1787 |
| HUMVWF_PEA_1_T45 (SEQ ID NO: 4344) | 1409 | 1545 |
| HUMVWF_PEA_1_T46 (SEQ ID NO: 4345) | 1409 | 1545 |
| HUMVWF_PEA_1_T49 (SEQ ID NO: 4346) | 1409 | 1545 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_32 (SEQ ID NO:6307) according to the present invention is supported by 11 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5943 below describes the starting and ending position of this segment on each transcript.

TABLE 5943

Segment location on transcripts

| Transcript name | Segment starting position | Segment ending position |
| --- | --- | --- |
| HUMVWF_PEA_1_T1 (SEQ ID NO: 4335) | 1963 | 2101 |
| HUMVWF_PEA_1_T5 (SEQ ID NO: 4336) | 1546 | 1684 |
| HUMVWF_PEA_1_T25 (SEQ ID NO: 4337) | 1546 | 1684 |
| HUMVWF_PEA_1_T28 (SEQ ID NO: 4339) | 1546 | 1684 |
| HUMVWF_PEA_1_T37 (SEQ ID NO: 4342) | 1963 | 2101 |
| HUMVWF_PEA_1_T38 (SEQ ID NO: 4343) | 1788 | 1926 |
| HUMVWF_PEA_1_T45 (SEQ ID NO: 4344) | 1546 | 1684 |
| HUMVWF_PEA_1_T46 (SEQ ID NO: 4345) | 1546 | 1684 |
| HUMVWF_PEA_1_T49 (SEQ ID NO: 4346) | 1546 | 1684 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_37 (SEQ ID NO:6308) according to the present invention is supported by 3 libraries. The number of libraries was determined as previously described. This segment can be found in the following transcript(s): HUMVWF_PEA_1_T34 (SEQ ID NO:4341). Table 5944 below describes the starting and ending position of this segment on each transcript.

TABLE 5944

Segment location on transcripts

| Transcript name | Segment starting position | Segment ending position |
|---|---|---|
| HUMVWF_PEA_1_T34 (SEQ ID NO: 4341) | 1 | 1321 |

This segment can be found in the following protein(s): HUMVWF_PEA_1_P27.

Segment cluster HUMVWF_PEA_1_node_38 (SEQ ID NO:6309) according to the present invention is supported by 11 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T34 (SEQ ID NO:4341), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5945 below describes the starting and ending position of this segment on each transcript.

TABLE 5945

Segment location on transcripts

| Transcript name | Segment starting position | Segment ending position |
|---|---|---|
| HUMVWF_PEA_1_T1 (SEQ ID NO: 4335) | 2203 | 2398 |
| HUMVWF_PEA_1_T5 (SEQ ID NO: 4336) | 1786 | 1981 |
| HUMVWF_PEA_1_T25 (SEQ ID NO: 4337) | 1786 | 1981 |
| HUMVWF_PEA_1_T28 (SEQ ID NO: 4339) | 1786 | 1981 |
| HUMVWF_PEA_1_T34 (SEQ ID NO: 4341) | 1322 | 1517 |
| HUMVWF_PEA_1_T37 (SEQ ID NO: 4342) | 2203 | 2398 |
| HUMVWF_PEA_1_T38 (SEQ ID NO: 4343) | 2028 | 2223 |
| HUMVWF_PEA_1_T45 (SEQ ID NO: 4344) | 1786 | 1981 |
| HUMVWF_PEA_1_T46 (SEQ ID NO: 4345) | 1786 | 1981 |
| HUMVWF_PEA_1_T49 (SEQ ID NO: 4346) | 1786 | 1981 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P27, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_39 (SEQ ID NO:6310) according to the present invention is supported by 4 libraries. The number of libraries was determined as previously described. This segment can be found in the following transcript(s): HUMVWF_PEA_1_T28 (SEQ ID NO:4339) and HUMVWF_PEA_1_T34 (SEQ ID NO:4341). Table 5946 below describes the starting and ending position of this segment on each transcript.

TABLE 5946

Segment location on transcripts

| Transcript name | Segment starting position | Segment ending position |
|---|---|---|
| HUMVWF_PEA_1_T28 (SEQ ID NO: 4339) | 1982 | 2222 |
| HUMVWF_PEA_1_T34 (SEQ ID NO: 4341) | 1518 | 1758 |

This segment can be found in both coding and non-coding regions of transcript(s) as follows. The segment can be found in a non-coding region of transcript(s) that are related to the following protein(s): HUMVWF_PEA_1_P27. This segment can also be found in the following protein(s): HUMVWF_PEA_1_P21, since it is in the coding region for the corresponding transcript.

Segment cluster HUMVWF_PEA_1_node_41 (SEQ ID NO:6311) according to the present invention is supported by 7 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5947 below describes the starting and ending position of this segment on each transcript.

TABLE 5947

Segment location on transcripts

| Transcript name | Segment starting position | Segment ending position |
|---|---|---|
| HUMVWF_PEA_1_T1 (SEQ ID NO: 4335) | 2399 | 2614 |

TABLE 5947-continued

Segment location on transcripts

| Transcript name | Segment starting position | Segment ending position |
|---|---|---|
| HUMVWF_PEA_1_T5 (SEQ ID NO: 4336) | 1982 | 2197 |
| HUMVWF_PEA_1_T25 (SEQ ID NO: 4337) | 1982 | 2197 |
| HUMVWF_PEA_1_T37 (SEQ ID NO: 4342) | 2399 | 2614 |
| HUMVWF_PEA_1_T38 (SEQ ID NO: 4343) | 2224 | 2439 |
| HUMVWF_PEA_1_T45 (SEQ ID NO: 4344) | 1982 | 2197 |
| HUMVWF_PEA_1_T46 (SEQ ID NO: 4345) | 1982 | 2197 |
| HUMVWF_PEA_1_T49 (SEQ ID NO: 4346) | 1982 | 2197 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_43 (SEQ ID NO:6312) according to the present invention is supported by 8 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5948 below describes the starting and ending position of this segment on each transcript.

TABLE 5948

Segment location on transcripts

| Transcript name | Segment starting position | Segment ending position |
|---|---|---|
| HUMVWF_PEA_1_T1 (SEQ ID NO: 4335) | 2615 | 2855 |
| HUMVWF_PEA_1_T5 (SEQ ID NO: 4336) | 2198 | 2438 |
| HUMVWF_PEA_1_T25 (SEQ ID NO: 4337) | 2198 | 2438 |
| HUMVWF_PEA_1_T37 (SEQ ID NO: 4342) | 2615 | 2855 |
| HUMVWF_PEA_1_T38 (SEQ ID NO: 4343) | 2440 | 2680 |
| HUMVWF_PEA_1_T45 (SEQ ID NO: 4344) | 2198 | 2438 |
| HUMVWF_PEA_1_T46 (SEQ ID NO: 4345) | 2198 | 2438 |
| HUMVWF_PEA_1_T49 (SEQ ID NO: 4346) | 2198 | 2438 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1,HUMVWF_PEA_1_P19 and HUMVWF_PEA_1_P30, since it is in the coding region for the corresponding transcript.

Segment cluster HUMVWF_PEA_1_node_47 (SEQ ID NO:6313) according to the present invention is supported by 9 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5949 below describes the starting and ending position of this segment on each transcript.

TABLE 5949

Segment location on transcripts

| Transcript name | Segment starting position | Segment ending position |
|---|---|---|
| HUMVWF_PEA_1_T1 (SEQ ID NO: 4335) | 2951 | 3111 |
| HUMVWF_PEA_1_T5 (SEQ ID NO: 4336) | 2534 | 2694 |
| HUMVWF_PEA_1_T25 (SEQ ID NO: 4337) | 2534 | 2694 |
| HUMVWF_PEA_1_T37 (SEQ ID NO: 4342) | 2951 | 3111 |
| HUMVWF_PEA_1_T38 (SEQ ID NO: 4343) | 2776 | 2936 |
| HUMVWF_PEA_1_T45 (SEQ ID NO: 4344) | 2534 | 2694 |
| HUMVWF_PEA_1_T46 (SEQ ID NO: 4345) | 2534 | 2694 |
| HUMVWF_PEA_1_T49 (SEQ ID NO: 4346) | 2534 | 2694 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_51 (SEQ ID NO:6314) according to the present invention is supported by 11 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5950 below describes the starting and ending position of this segment on each transcript.

TABLE 5950

| Transcript name | Segment starting position | Segment ending position |
|---|---|---|
| HUMVWF_PEA_1_T1 (SEQ ID NO: 4335) | 3216 | 3354 |
| HUMVWF_PEA_1_T5 (SEQ ID NO: 4336) | 2799 | 2937 |
| HUMVWF_PEA_1_T25 (SEQ ID NO: 4337) | 2799 | 2937 |
| HUMVWF_PEA_1_T37 (SEQ ID NO: 4342) | 3216 | 3354 |
| HUMVWF_PEA_1_T38 (SEQ ID NO: 4343) | 3041 | 3179 |
| HUMVWF_PEA_1_T45 (SEQ ID NO: 4344) | 2799 | 2937 |
| HUMVWF_PEA_1_T46 (SEQ ID NO: 4345) | 2799 | 2937 |
| HUMVWF_PEA_1_T49 (SEQ ID NO: 4346) | 2799 | 2937 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_53 (SEQ ID NO:6315) according to the present invention is supported by 13 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5951 below describes the starting and ending position of this segment on each transcript.

TABLE 5951

| Transcript name | Segment starting position | Segment ending position |
|---|---|---|
| HUMVWF_PEA_1_T1 (SEQ ID NO: 4335) | 3355 | 3489 |
| HUMVWF_PEA_1_T5 (SEQ ID NO: 4336) | 2938 | 3072 |
| HUMVWF_PEA_1_T25 (SEQ ID NO: 4337) | 2938 | 3072 |
| HUMVWF_PEA_1_T37 (SEQ ID NO: 4342) | 3355 | 3489 |
| HUMVWF_PEA_1_T38 (SEQ ID NO: 4343) | 3180 | 3314 |
| HUMVWF_PEA_1_T45 (SEQ ID NO: 4344) | 2938 | 3072 |
| HUMVWF_PEA_1_T46 (SEQ ID NO: 4345) | 2938 | 3072 |
| HUMVWF_PEA_1_T49 (SEQ ID NO: 4346) | 2938 | 3072 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_55 (SEQ ID NO:6316) according to the present invention is supported by 19 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5952 below describes the starting and ending position of this segment on each transcript.

TABLE 5952

| Transcript name | Segment starting position | Segment ending position |
|---|---|---|
| HUMVWF_PEA_1_T1 (SEQ ID NO: 4335) | 3490 | 3636 |
| HUMVWF_PEA_1_T5 (SEQ ID NO: 4336) | 3073 | 3219 |
| HUMVWF_PEA_1_T25 (SEQ ID NO: 4337) | 3073 | 3219 |
| HUMVWF_PEA_1_T37 (SEQ ID NO: 4342) | 3490 | 3636 |
| HUMVWF_PEA_1_T38 (SEQ ID NO: 4343) | 3315 | 3461 |
| HUMVWF_PEA_1_T45 (SEQ ID NO: 4344) | 3073 | 3219 |
| HUMVWF_PEA_1_T46 (SEQ ID NO: 4345) | 3073 | 3219 |
| HUMVWF_PEA_1_T49 (SEQ ID NO: 4346) | 3073 | 3219 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_57 (SEQ ID NO:6317) according to the present invention is supported by 16 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5953 below describes the starting and ending position of this segment on each transcript.

TABLE 5953

Segment location on transcripts

| Transcript name | Segment starting position | Segment ending position |
|---|---|---|
| HUMVWF_PEA_1_T1 (SEQ ID NO: 4335) | 3637 | 3777 |
| HUMVWF_PEA_1_T5 (SEQ ID NO: 4336) | 3220 | 3360 |
| HUMVWF_PEA_1_T25 (SEQ ID NO: 4337) | 3220 | 3360 |
| HUMVWF_PEA_1_T37 (SEQ ID NO: 4342) | 3637 | 3777 |
| HUMVWF_PEA_1_T38 (SEQ ID NO: 4343) | 3462 | 3602 |
| HUMVWF_PEA_1_T45 (SEQ ID NO: 4344) | 3220 | 3360 |
| HUMVWF_PEA_1_T46 (SEQ ID NO: 4345) | 3220 | 3360 |
| HUMVWF_PEA_1_T49 (SEQ ID NO: 4346) | 3220 | 3360 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_60 (SEQ ID NO:6318) according to the present invention is supported by 6 libraries. The number of libraries was determined as previously described. This segment can be found in the following transcript(s): HUMVWF_PEA_1_T5 (SEQ ID NO:4336) and HUMVWF_PEA_1_T25 (SEQ ID NO:4337). Table 5954 below describes the starting and ending position of this segment on each transcript.

TABLE 5954

Segment location on transcripts

| Transcript name | Segment starting position | Segment ending position |
|---|---|---|
| HUMVWF_PEA_1_T5 (SEQ ID NO: 4336) | 3475 | 4451 |
| HUMVWF_PEA_1_T25 (SEQ ID NO: 4337) | 3475 | 4451 |

This segment can be found in both coding and non-coding regions of transcript(s) as follows. The segment can be found in a non-coding region of transcript(s) that are related to the following protein(s): HUMVWF_PEA_1_P2. This segment can also be found in the following protein(s): HUMVWF_PEA_1_P19, since it is in the coding region for the corresponding transcript.

Segment cluster HUMVWF_PEA_1_node_61 (SEQ ID NO:6319) according to the present invention is supported by 8 libraries. The number of libraries was determined as previously described. This segment can be found in the following transcript(s): HUMVWF_PEA_1_T5 (SEQ ID NO:4336) and HUMVWF_PEA_1_T25 (SEQ ID NO:4337). Table 5955 below describes the starting and ending position of this segment on each transcript.

TABLE 5955

Segment location on transcripts

| Transcript name | Segment starting position | Segment ending position |
|---|---|---|
| HUMVWF_PEA_1_T5 (SEQ ID NO: 4336) | 4452 | 5266 |
| HUMVWF_PEA_1_T25 (SEQ ID NO: 4337) | 4452 | 5266 |

This segment can be found in a non-coding region of transcript(s) that are related to the following protein(s): HUMVWF_PEA_1_P2 and HUMVWF_PEA_1_P19.

Segment cluster HUMVWF_PEA_1_node_62 (SEQ ID NO:6320) according to the present invention is supported by 19 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5956 below describes the starting and ending position of this segment on each transcript.

TABLE 5956

Segment location on transcripts

| Transcript name | Segment starting position | Segment ending position |
|---|---|---|
| HUMVWF_PEA_1_T1 (SEQ ID NO: 4335) | 3892 | 4048 |
| HUMVWF_PEA_1_T5 (SEQ ID NO: 4336) | 5267 | 5423 |
| HUMVWF_PEA_1_T25 (SEQ ID NO: 4337) | 5267 | 5423 |
| HUMVWF_PEA_1_T37 (SEQ ID NO: 4342) | 3892 | 4048 |
| HUMVWF_PEA_1_T38 (SEQ ID NO: 4343) | 3717 | 3873 |
| HUMVWF_PEA_1_T45 (SEQ ID NO: 4344) | 3475 | 3631 |
| HUMVWF_PEA_1_T46 (SEQ ID NO: 4345) | 3475 | 3631 |
| HUMVWF_PEA_1_T49 (SEQ ID NO: 4346) | 3475 | 3631 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P19, HUMVWF_PEA_1_P32 and HUMVWF_PEA_1_P33. This segment can also be found in the following protein(s): HUMVWF_PEA_1_P1 and HUMVWF_PEA_1_P30, since it is in the coding region for the corresponding transcript.

Segment cluster HUMVWF_PEA_1_node_63 (SEQ ID NO:6321) according to the present invention is supported by 2 libraries. The number of libraries was determined as previously described. This segment can be found in the following transcript(s): HUMVWF_PEA_1_T25 (SEQ ID NO:4337). Table 5957 below describes the starting and ending position of this segment on each transcript.

TABLE 5957

Segment location on transcripts

| Transcript name | Segment starting position | Segment ending position |
| --- | --- | --- |
| HUMVWF_PEA_1_T25 (SEQ ID NO: 4337) | 5424 | 5849 |

This segment can be found in a non-coding region of transcript(s) that are related to the following protein(s): HUMVWF_PEA_1_P19.

Segment cluster HUMVWF_PEA_1_node_65 (SEQ ID NO:6322) according to the present invention is supported by 12 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5958 below describes the starting and ending position of this segment on each transcript.

TABLE 5958

Segment location on transcripts

| Transcript name | Segment starting position | Segment ending position |
| --- | --- | --- |
| HUMVWF_PEA_1_T1 (SEQ ID NO: 4335) | 4049 | 4207 |
| HUMVWF_PEA_1_T5 (SEQ ID NO: 4336) | 5424 | 5582 |
| HUMVWF_PEA_1_T37 (SEQ ID NO: 4342) | 4049 | 4207 |
| HUMVWF_PEA_1_T38 (SEQ ID NO: 4343) | 3874 | 4032 |
| HUMVWF_PEA_1_T45 (SEQ ID NO: 4344) | 3632 | 3790 |
| HUMVWF_PEA_1_T46 (SEQ ID NO: 4345) | 3632 | 3790 |
| HUMVWF_PEA_1_T49 (SEQ ID NO: 4346) | 3632 | 3790 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1 and HUMVWF_PEA_1_P30, since it is in the coding region for the corresponding transcript.

Segment cluster HUMVWF_PEA_1_node_67 (SEQ ID NO:6323) according to the present invention is supported by 13 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5959 below describes the starting and ending position of this segment on each transcript.

TABLE 5959

Segment location on transcripts

| Transcript name | Segment starting position | Segment ending position |
| --- | --- | --- |
| HUMVWF_PEA_1_T1 (SEQ ID NO: 4335) | 4208 | 4343 |
| HUMVWF_PEA_1_T5 (SEQ ID NO: 4336) | 5583 | 5718 |
| HUMVWF_PEA_1_T37 (SEQ ID NO: 4342) | 4208 | 4343 |
| HUMVWF_PEA_1_T38 (SEQ ID NO: 4343) | 4033 | 4168 |
| HUMVWF_PEA_1_T45 (SEQ ID NO: 4344) | 3791 | 3926 |
| HUMVWF_PEA_1_T46 (SEQ ID NO: 4345) | 3791 | 3926 |
| HUMVWF_PEA_1_T49 (SEQ ID NO: 4346) | 3791 | 3926 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1 and HUMVWF_PEA_1_P30, since it is in the coding region for the corresponding transcript.

Segment cluster HUMVWF_PEA_1_node_69 (SEQ ID NO:6324) according to the present invention is supported by 2 libraries. The number of libraries was determined as previously described. This segment can be found in the following transcript(s): HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5960 below describes the starting and ending position of this segment on each transcript.

TABLE 5960

Segment location on transcripts

| Transcript name | Segment starting position | Segment ending position |
| --- | --- | --- |
| HUMVWF_PEA_1_T5 (SEQ ID NO: 4336) | 5719 | 6163 |
| HUMVWF_PEA_1_T37 (SEQ ID NO: 4342) | 4344 | 4788 |
| HUMVWF_PEA_1_T38 (SEQ ID NO: 4343) | 4169 | 4613 |
| HUMVWF_PEA_1_T45 (SEQ ID NO: 4344) | 3927 | 4371 |
| HUMVWF_PEA_1_T46 (SEQ ID NO: 4345) | 3927 | 4371 |
| HUMVWF_PEA_1_T49 (SEQ ID NO: 4346) | 3927 | 4371 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P30, since it is in the coding region for the corresponding transcript.

Segment cluster HUMVWF_PEA_1_node_71 (SEQ ID NO:6325) according to the present invention is supported by 41 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5961 below describes the starting and ending position of this segment on each transcript.

TABLE 5961

Segment location on transcripts

| Transcript name | Segment starting position | Segment ending position |
|---|---|---|
| HUMVWF_PEA_1_T1 (SEQ ID NO: 4335) | 4344 | 5722 |
| HUMVWF_PEA_1_T5 (SEQ ID NO: 4336) | 6164 | 7542 |
| HUMVWF_PEA_1_T37 (SEQ ID NO: 4342) | 4789 | 6167 |
| HUMVWF_PEA_1_T38 (SEQ ID NO: 4343) | 4614 | 5992 |
| HUMVWF_PEA_1_T45 (SEQ ID NO: 4344) | 4372 | 5750 |
| HUMVWF_PEA_1_T46 (SEQ ID NO: 4345) | 4372 | 5750 |
| HUMVWF_PEA_1_T49 (SEQ ID NO: 4346) | 4372 | 5750 |

This segment can be found in both coding and non-coding regions of transcript(s) as follows. The segment can be found in a non-coding region of transcript(s) that are related to the following protein(s): HUMVWF_PEA_1_P30. This segment can also be found in the following protein(s): HUMVWF_PEA_1_P1, HUMVWF_PEA_1_P2, HUMVWF_PEA_1_P32 and HUMVWF_PEA_1_P33, since it is in the coding region for the corresponding transcript.

Segment cluster HUMVWF_PEA_1_node_75 (SEQ ID NO:6326) according to the present invention is supported by 28 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5962 below describes the starting and ending position of this segment on each transcript.

TABLE 5962

Segment location on transcripts

| Transcript name | Segment starting position | Segment ending position |
|---|---|---|
| HUMVWF_PEA_1_T1 (SEQ ID NO: 4335) | 5840 | 5980 |
| HUMVWF_PEA_1_T5 (SEQ ID NO: 4336) | 7660 | 7800 |
| HUMVWF_PEA_1_T37 (SEQ ID NO: 4342) | 6285 | 6425 |
| HUMVWF_PEA_1_T38 (SEQ ID NO: 4343) | 6110 | 6250 |
| HUMVWF_PEA_1_T45 (SEQ ID NO: 4344) | 5868 | 6008 |
| HUMVWF_PEA_1_T46 (SEQ ID NO: 4345) | 5868 | 6008 |

TABLE 5962-continued

Segment location on transcripts

| Transcript name | Segment starting position | Segment ending position |
|---|---|---|
| HUMVWF_PEA_1_T49 (SEQ ID NO: 4346) | 5868 | 6008 |

This segment can be found in both coding and non-coding regions of transcript(s) as follows. The segment can be found in a non-coding region of transcript(s) that are related to the following protein(s): HUMVWF_PEA_1_P30. This segment can also be found in the following protein(s): HUMVWF_PEA_1_P1, HUMVWF_PEA_1_P2, HUMVWF_PEA_1_P32 and HUMVWF_PEA_1_P33, since it is in the coding region for the corresponding transcript.

Segment cluster HUMVWF_PEA_1_node_81 (SEQ ID NO:6327) according to the present invention is supported by 33 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5963 below describes the starting and ending position of this segment on each transcript.

TABLE 5963

Segment location on transcripts

| Transcript name | Segment starting position | Segment ending position |
|---|---|---|
| HUMVWF_PEA_1_T1 (SEQ ID NO: 4335) | 6125 | 6289 |
| HUMVWF_PEA_1_T5 (SEQ ID NO: 4336) | 7945 | 8109 |
| HUMVWF_PEA_1_T37 (SEQ ID NO: 4342) | 6570 | 6734 |
| HUMVWF_PEA_1_T38 (SEQ ID NO: 4343) | 6395 | 6559 |
| HUMVWF_PEA_1_T45 (SEQ ID NO: 4344) | 6153 | 6317 |
| HUMVWF_PEA_1_T49 (SEQ ID NO: 4346) | 6153 | 6317 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_93 (SEQ ID NO:6328) according to the present invention is supported by 57 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346) Table 5964 below describes the starting and ending position of this segment on each transcript.

TABLE 5964

Segment location on transcripts

| Transcript name | Segment starting position | Segment ending position |
|---|---|---|
| HUMVWF_PEA_1_T1 (SEQ ID NO: 4335) | 6562 | 6732 |
| HUMVWF_PEA_1_T5 (SEQ ID NO: 4336) | 8382 | 8552 |
| HUMVWF_PEA_1_T37 (SEQ ID NO: 4342) | 7007 | 7177 |
| HUMVWF_PEA_1_T38 (SEQ ID NO: 4343) | 6832 | 7002 |
| HUMVWF_PEA_1_T45 (SEQ ID NO: 4344) | 6590 | 6760 |
| HUMVWF_PEA_1_T49 (SEQ ID NO: 4346) | 6590 | 6760 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_95 (SEQ ID NO:6329) according to the present invention is supported by 70 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5965 below describes the starting and ending position of this segment on each transcript.

TABLE 5965

Segment location on transcripts

| Transcript name | Segment starting position | Segment ending position |
|---|---|---|
| HUMVWF_PEA_1_T1 (SEQ ID NO: 4335) | 6733 | 6870 |
| HUMVWF_PEA_1_T5 (SEQ ID NO: 4336) | 8553 | 8690 |
| HUMVWF_PEA_1_T37 (SEQ ID NO: 4342) | 7178 | 7315 |
| HUMVWF_PEA_1_T38 (SEQ ID NO: 4343) | 7003 | 7140 |
| HUMVWF_PEA_1_T45 (SEQ ID NO: 4344) | 6761 | 6898 |
| HUMVWF_PEA_1_T49 (SEQ ID NO: 4346) | 6761 | 6898 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_98 (SEQ ID NO:6330) according to the present invention is supported by 91 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5966 below describes the starting and ending position of this segment on each transcript.

TABLE 5966

Segment location on transcripts

| Transcript name | Segment starting position | Segment ending position |
|---|---|---|
| HUMVWF_PEA_1_T1 (SEQ ID NO: 4335) | 6926 | 7267 |
| HUMVWF_PEA_1_T5 (SEQ ID NO: 4336) | 8746 | 9087 |
| HUMVWF_PEA_1_T37 (SEQ ID NO: 4342) | 7371 | 7712 |
| HUMVWF_PEA_1_T38 (SEQ ID NO: 4343) | 7196 | 7537 |
| HUMVWF_PEA_1_T45 (SEQ ID NO: 4344) | 6954 | 7295 |
| HUMVWF_PEA_1_T49 (SEQ ID NO: 4346) | 6954 | 7295 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_100 (SEQ ID NO:6331) according to the present invention is supported by 85 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5967 below describes the starting and ending position of this segment on each transcript.

TABLE 5967

Segment location on transcripts

| Transcript name | Segment starting position | Segment ending position |
|---|---|---|
| HUMVWF_PEA_1_T1 (SEQ ID NO: 4335) | 7268 | 7467 |
| HUMVWF_PEA_1_T5 (SEQ ID NO: 4336) | 9088 | 9287 |
| HUMVWF_PEA_1_T37 (SEQ ID NO: 4342) | 7713 | 7912 |
| HUMVWF_PEA_1_T38 (SEQ ID NO: 4343) | 7538 | 7737 |
| HUMVWF_PEA_1_T45 (SEQ ID NO: 4344) | 7296 | 7495 |
| HUMVWF_PEA_1_T49 (SEQ ID NO: 4346) | 7296 | 7495 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_110 (SEQ ID NO:6332) according to the present invention is supported by 94 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5968 below describes the starting and ending position of this segment on each transcript.

TABLE 5968

Segment location on transcripts

| Transcript name | Segment starting position | Segment ending position |
|---|---|---|
| HUMVWF_PEA_1_T1 (SEQ ID NO: 4335) | 7751 | 7956 |
| HUMVWF_PEA_1_T5 (SEQ ID NO: 4336) | 9571 | 9776 |
| HUMVWF_PEA_1_T37 (SEQ ID NO: 4342) | 8196 | 8401 |
| HUMVWF_PEA_1_T38 (SEQ ID NO: 4343) | 8021 | 8226 |
| HUMVWF_PEA_1_T45 (SEQ ID NO: 4344) | 7779 | 7984 |
| HUMVWF_PEA_1_T49 (SEQ ID NO: 4346) | 7779 | 7984 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_112 (SEQ ID NO:6333) according to the present invention is supported by 91 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5969 below describes the starting and ending position of this segment on each transcript.

TABLE 5969

Segment location on transcripts

| Transcript name | Segment starting position | Segment ending position |
|---|---|---|
| HUMVWF_PEA_1_T1 (SEQ ID NO: 4335) | 7957 | 8106 |
| HUMVWF_PEA_1_T5 (SEQ ID NO: 4336) | 9777 | 9926 |
| HUMVWF_PEA_1_T37 (SEQ ID NO: 4342) | 8402 | 8551 |
| HUMVWF_PEA_1_T38 (SEQ ID NO: 4343) | 8227 | 8376 |
| HUMVWF_PEA_1_T45 (SEQ ID NO: 4344) | 7985 | 8134 |
| HUMVWF_PEA_1_T49 (SEQ ID NO: 4346) | 7985 | 8134 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_118 (SEQ ID NO:6334) according to the present invention is supported by 140 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5970 below describes the starting and ending position of this segment on each transcript.

TABLE 5970

Segment location on transcripts

| Transcript name | Segment starting position | Segment ending position |
|---|---|---|
| HUMVWF_PEA_1_T1 (SEQ ID NO: 4335) | 8259 | 8398 |
| HUMVWF_PEA_1_T5 (SEQ ID NO: 4336) | 10079 | 10218 |
| HUMVWF_PEA_1_T37 (SEQ ID NO: 4342) | 8704 | 8843 |
| HUMVWF_PEA_1_T38 (SEQ ID NO: 4343) | 8529 | 8668 |
| HUMVWF_PEA_1_T45 (SEQ ID NO: 4344) | 8287 | 8426 |
| HUMVWF_PEA_1_T49 (SEQ ID NO: 4346) | 8287 | 8426 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_129 (SEQ ID NO:6335) according to the present invention is supported by 1 libraries. The number of libraries was determined as previously described. This segment can be found in the following transcript(s): HUMVWF_PEA_1_T27 (SEQ ID NO:4338). Table 5971 below describes the starting and ending position of this segment on each transcript.

TABLE 5971

Segment location on transcripts

| Transcript name | Segment starting position | Segment ending position |
|---|---|---|
| HUMVWF_PEA_1_T27 (SEQ ID NO: 4338) | 1 | 791 |

This segment can be found in a non-coding region of transcript(s) that are related to the following protein(s): HUMVWF_PEA_1_P20.

Segment cluster HUMVWF_PEA_1_node_130 (SEQ ID NO:6336) according to the present invention is supported by 194 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5972 below describes the starting and ending position of this segment on each transcript.

TABLE 5972

Segment location on transcripts

| Transcript name | Segment starting position | Segment ending position |
|---|---|---|
| HUMVWF_PEA_1_T1 (SEQ ID NO: 4335) | 8656 | 8784 |
| HUMVWF_PEA_1_T5 (SEQ ID NO: 4336) | 10476 | 10604 |
| HUMVWF_PEA_1_T27 (SEQ ID NO: 4338) | 792 | 920 |
| HUMVWF_PEA_1_T37 (SEQ ID NO: 4342) | 9101 | 9229 |

TABLE 5972-continued

Segment location on transcripts

| Transcript name | Segment starting position | Segment ending position |
|---|---|---|
| HUMVWF_PEA_1_T38 (SEQ ID NO: 4343) | 8926 | 9054 |
| HUMVWF_PEA_1_T45 (SEQ ID NO: 4344) | 8684 | 8812 |
| HUMVWF_PEA_1_T49 (SEQ ID NO: 4346) | 8689 | 8817 |

This segment can be found in both coding and non-coding regions of transcript(s) as follows. The segment can be found in a non-coding region of transcript(s) that are related to the following protein(s): HUMVWF_PEA_1_P20 and HUMVWF_PEA_1_P33. This segment can also be found in the following protein(s): HUMVWF_PEA_1_P1, HUMVWF_PEA_1_P2 and HUMVWF_PEA_1_P32, since it is in the coding region for the corresponding transcript.

Segment cluster HUMVWF_PEA_1_node_131 (SEQ ID NO:6337) according to the present invention is supported by 4 libraries. The number of libraries was determined as previously described. This segment can be found in the following transcript(s): HUMVWF_PEA_1_T27 (SEQ ID NO:4338) and HUMVWF_PEA_1_T45 (SEQ ID NO:4344). Table 5973 below describes the starting and ending position of this segment on each transcript.

TABLE 5973

Segment location on transcripts

| Transcript name | Segment starting position | Segment ending position |
|---|---|---|
| HUMVWF_PEA_1_T27 (SEQ ID NO: 4338) | 921 | 1427 |
| HUMVWF_PEA_1_T45 (SEQ ID NO: 4344) | 8813 | 9319 |

This segment can be found in both coding and non-coding regions of transcript(s) as follows. The segment can be found in a non-coding region of transcript(s) that are related to the following protein(s): HUMVWF_PEA_1_P20. This segment can also be found in the following protein(s): HUMVWF_PEA_1_P32, since it is in the coding region for the corresponding transcript.

Segment cluster HUMVWF_PEA_1_node_133 (SEQ ID NO:6338) according to the present invention is supported by 7 libraries. The number of libraries was determined as previously described. This segment can be found in the following transcript(s): HUMVWF_PEA_1_T27 (SEQ ID NO:4338). Table 5974 below describes the starting and ending position of this segment on each transcript.

TABLE 5974

Segment location on transcripts

| Transcript name | Segment starting position | Segment ending position |
|---|---|---|
| HUMVWF_PEA_1_T27 (SEQ ID NO: 4338) | 1468 | 3427 |

This segment can be found in a non-coding region of transcript(s) that are related to the following protein(s): HUMVWF_PEA_1_P20.

Segment cluster HUMVWF_PEA_1_node_139 (SEQ ID NO:6339) according to the present invention is supported by 16 libraries. The number of libraries was determined as previously described. This segment can be found in the following transcript(s): HUMVWF_PEA_1_T27 (SEQ ID NO:4338). Table 5975 below describes the starting and ending position of this segment on each transcript.

TABLE 5975

Segment location on transcripts

| Transcript name | Segment starting position | Segment ending position |
|---|---|---|
| HUMVWF_PEA_1_T27 (SEQ ID NO: 4338) | 3516 | 4097 |

This segment can be found in the following protein(s): HUMVWF_PEA_1_P20.

Segment cluster HUMVWF_PEA_1_node_140 (SEQ ID NO:6340) according to the present invention is supported by 195 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5976 below describes the starting and ending position of this segment on each transcript.

TABLE 5976

Segment location on transcripts

| Transcript name | Segment starting position | Segment ending position |
|---|---|---|
| HUMVWF_PEA_1_T1 (SEQ ID NO: 4335) | 8923 | 9083 |
| HUMVWF_PEA_1_T5 (SEQ ID NO: 4336) | 10743 | 10903 |
| HUMVWF_PEA_1_T27 (SEQ ID NO: 4338) | 4098 | 4258 |
| HUMVWF_PEA_1_T37 (SEQ ID NO: 4342) | 9368 | 9528 |
| HUMVWF_PEA_1_T38 (SEQ ID NO: 4343) | 9193 | 9353 |
| HUMVWF_PEA_1_T45 (SEQ ID NO: 4344) | 9458 | 9618 |
| HUMVWF_PEA_1_T49 (SEQ ID NO: 4346) | 8956 | 9116 |

This segment can be found in both coding and non-coding regions of transcript(s) as follows. The segment can be found in a non-coding region of transcript(s) that are related to the following protein(s): HUMVWF_PEA_1_P32 and HUMVWF_PEA_1_P33. This segment can also be found in the following protein(s): HUMVWF_PEA_1_P1, HUMVWF_PEA_1_P2 and HUMVWF_PEA_1_P20, since it is in the coding region for the corresponding transcript.

Segment cluster HUMVWF_PEA_1_node_141 (SEQ ID NO:6341) according to the present invention is supported by 172 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5977 below describes the starting and ending position of this segment on each transcript.

TABLE 5977

Segment location on transcripts

| Transcript name | Segment starting position | Segment ending position |
|---|---|---|
| HUMVWF_PEA_1_T1 (SEQ ID NO: 4335) | 9084 | 9245 |
| HUMVWF_PEA_1_T5 (SEQ ID NO: 4336) | 10904 | 11065 |
| HUMVWF_PEA_1_T27 (SEQ ID NO: 4338) | 4259 | 4420 |
| HUMVWF_PEA_1_T37 (SEQ ID NO: 4342) | 9529 | 9690 |
| HUMVWF_PEA_1_T38 (SEQ ID NO: 4343) | 9354 | 9515 |
| HUMVWF_PEA_1_T45 (SEQ ID NO: 4344) | 9619 | 9780 |
| HUMVWF_PEA_1_T49 (SEQ ID NO: 4346) | 9117 | 9278 |

This segment can be found in both coding and non-coding regions of transcript(s) as follows. The segment can be found in a non-coding region of transcript(s) that are related to the following protein(s): HUMVWF_PEA_1_P32 and HUMVWF_PEA_1_P33. This segment can also be found in the following protein(s): HUMVWF_PEA_1_P1, HUMVWF_PEA_1_P2 and HUMVWF_PEA_1_P20, since it is in the coding region for the corresponding transcript.

According to an optional embodiment of the present invention, short segments related to the above cluster are also provided. These segments are up to about 120 bp in length, and so are included in a separate description.

Segment cluster HUMVWF_PEA_1_node_1 (SEQ ID NO:6342) according to the present invention is supported by 15 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5978 below describes the starting and ending position of this segment on each transcript.

TABLE 5978

Segment location on transcripts

| Transcript name | Segment starting position | Segment ending position |
|---|---|---|
| HUMVWF_PEA_1_T1 (SEQ ID NO: 4335) | 175 | 251 |
| HUMVWF_PEA_1_T5 (SEQ ID NO: 4336) | 175 | 251 |
| HUMVWF_PEA_1_T25 (SEQ ID NO: 4337) | 175 | 251 |

TABLE 5978-continued

Segment location on transcripts

| Transcript name | Segment starting position | Segment ending position |
|---|---|---|
| HUMVWF_PEA_1_T28 (SEQ ID NO: 4339) | 175 | 251 |
| HUMVWF_PEA_1_T32 (SEQ ID NO: 4340) | 175 | 251 |
| HUMVWF_PEA_1_T37 (SEQ ID NO: 4342) | 175 | 251 |
| HUMVWF_PEA_1_T38 (SEQ ID NO: 4343) | 175 | 251 |
| HUMVWF_PEA_1_T45 (SEQ ID NO: 4344) | 175 | 251 |
| HUMVWF_PEA_1_T46 (SEQ ID NO: 4345) | 175 | 251 |
| HUMVWF_PEA_1_T49 (SEQ ID NO: 4346) | 175 | 251 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_6 (SEQ ID NO:6343) according to the present invention is supported by 14 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5979 below describes the starting and ending position of this segment on each transcript.

TABLE 5979

Segment location on transcripts

| Transcript name | Segment starting position | Segment ending position |
|---|---|---|
| HUMVWF_PEA_1_T1 (SEQ ID NO: 4335) | 252 | 306 |
| HUMVWF_PEA_1_T5 (SEQ ID NO: 4336) | 252 | 306 |
| HUMVWF_PEA_1_T25 (SEQ ID NO: 4337) | 252 | 306 |
| HUMVWF_PEA_1_T28 (SEQ ID NO: 4339) | 252 | 306 |
| HUMVWF_PEA_1_T32 (SEQ ID NO: 4340) | 252 | 306 |
| HUMVWF_PEA_1_T37 (SEQ ID NO: 4342) | 252 | 306 |
| HUMVWF_PEA_1_T38 (SEQ ID NO: 4343) | 252 | 306 |
| HUMVWF_PEA_1_T45 (SEQ ID NO: 4344) | 252 | 306 |
| HUMVWF_PEA_1_T46 (SEQ ID NO: 4345) | 252 | 306 |

TABLE 5979-continued

Segment location on transcripts

| Transcript name | Segment starting position | Segment ending position |
|---|---|---|
| HUMVWF_PEA_1_T49 (SEQ ID NO: 4346) | 252 | 306 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_10 (SEQ ID NO:6344) according to the present invention is supported by 12 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5980 below describes the starting and ending position of this segment on each transcript.

TABLE 5980

Segment location on transcripts

| Transcript name | Segment starting position | Segment ending position |
|---|---|---|
| HUMVWF_PEA_1_T1 (SEQ ID NO: 4335) | 724 | 823 |
| HUMVWF_PEA_1_T5 (SEQ ID NO: 4336) | 307 | 406 |
| HUMVWF_PEA_1_T25 (SEQ ID NO: 4337) | 307 | 406 |
| HUMVWF_PEA_1_T28 (SEQ ID NO: 4339) | 307 | 406 |
| HUMVWF_PEA_1_T32 (SEQ ID NO: 4340) | 307 | 406 |
| HUMVWF_PEA_1_T37 (SEQ ID NO: 4342) | 724 | 823 |
| HUMVWF_PEA_1_T38 (SEQ ID NO: 4343) | 549 | 648 |
| HUMVWF_PEA_1_T45 (SEQ ID NO: 4344) | 307 | 406 |
| HUMVWF_PEA_1_T46 (SEQ ID NO: 4345) | 307 | 406 |
| HUMVWF_PEA_1_T49 (SEQ ID NO: 4346) | 307 | 406 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_11 (SEQ ID NO:6345) according to the present invention is supported by 9 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5981 below describes the starting and ending position of this segment on each transcript.

TABLE 5981

Segment location on transcripts

| Transcript name | Segment starting position | Segment ending position |
|---|---|---|
| HUMVWF_PEA_1_T1 (SEQ ID NO: 4335) | 824 | 888 |
| HUMVWF_PEA_1_T5 (SEQ ID NO: 4336) | 407 | 471 |
| HUMVWF_PEA_1_T25 (SEQ ID NO: 4337) | 407 | 471 |
| HUMVWF_PEA_1_T28 (SEQ ID NO: 4339) | 407 | 471 |
| HUMVWF_PEA_1_T32 (SEQ ID NO: 4340) | 407 | 471 |
| HUMVWF_PEA_1_T37 (SEQ ID NO: 4342) | 824 | 888 |
| HUMVWF_PEA_1_T38 (SEQ ID NO: 4343) | 649 | 713 |
| HUMVWF_PEA_1_T45 (SEQ ID NO: 4344) | 407 | 471 |
| HUMVWF_PEA_1_T46 (SEQ ID NO: 4345) | 407 | 471 |
| HUMVWF_PEA_1_T49 (SEQ ID NO: 4346) | 407 | 471 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_13 (SEQ ID NO:6346) according to the present invention is supported by 9 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_

1_T49 (SEQ ID NO:4346). Table 5982 below describes the starting and ending position of this segment on each transcript.

TABLE 5982

Segment location on transcripts

| Transcript name | Segment starting position | Segment ending position |
|---|---|---|
| HUMVWF_PEA_1_T1 (SEQ ID NO: 4335) | 889 | 966 |
| HUMVWF_PEA_1_T5 (SEQ ID NO: 4336) | 472 | 549 |
| HUMVWF_PEA_1_T25 (SEQ ID NO: 4337) | 472 | 549 |
| HUMVWF_PEA_1_T28 (SEQ ID NO: 4339) | 472 | 549 |
| HUMVWF_PEA_1_T32 (SEQ ID NO: 4340) | 472 | 549 |
| HUMVWF_PEA_1_T37 (SEQ ID NO: 4342) | 889 | 966 |
| HUMVWF_PEA_1_T38 (SEQ ID NO: 4343) | 714 | 791 |
| HUMVWF_PEA_1_T45 (SEQ ID NO: 4344) | 472 | 549 |
| HUMVWF_PEA_1_T46 (SEQ ID NO: 4345) | 472 | 549 |
| HUMVWF_PEA_1_T49 (SEQ ID NO: 4346) | 472 | 549 |

This segment can be found in both coding and non-coding regions of transcript(s) as follows. The segment can be found in a non-coding region of transcript(s) that are related to the following protein(s): HUMVWF_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_14 (SEQ ID NO:6347) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5983 below describes the starting and ending position of this segment on each transcript.

TABLE 5983

Segment location on transcripts

| Transcript name | Segment starting position | Segment ending position |
|---|---|---|
| HUMVWF_PEA_1_T1 (SEQ ID NO: 4335) | 967 | 991 |
| HUMVWF_PEA_1_T5 (SEQ ID NO: 4336) | 550 | 574 |
| HUMVWF_PEA_1_T25 (SEQ ID NO: 4337) | 550 | 574 |
| HUMVWF_PEA_1_T28 (SEQ ID NO: 4339) | 550 | 574 |
| HUMVWF_PEA_1_T32 (SEQ ID NO: 4340) | 550 | 574 |

TABLE 5983-continued

Segment location on transcripts

| Transcript name | Segment starting position | Segment ending position |
|---|---|---|
| HUMVWF_PEA_1_T37 (SEQ ID NO: 4342) | 967 | 991 |
| HUMVWF_PEA_1_T38 (SEQ ID NO: 4343) | 792 | 816 |
| HUMVWF_PEA_1_T45 (SEQ ID NO: 4344) | 550 | 574 |
| HUMVWF_PEA_1_T46 (SEQ ID NO: 4345) | 550 | 574 |
| HUMVWF_PEA_1_T49 (SEQ ID NO: 4346) | 550 | 574 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_18 (SEQ ID NO:6348) according to the present invention is supported by 8 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5984 below describes the starting and ending position of this segment on each transcript.

TABLE 5984

Segment location on transcripts

| Transcript name | Segment starting position | Segment ending position |
|---|---|---|
| HUMVWF_PEA_1_T1 (SEQ ID NO: 4335) | 1201 | 1316 |
| HUMVWF_PEA_1_T5 (SEQ ID NO: 4336) | 784 | 899 |
| HUMVWF_PEA_1_T25 (SEQ ID NO: 4337) | 784 | 899 |
| HUMVWF_PEA_1_T28 (SEQ ID NO: 4339) | 784 | 899 |
| HUMVWF_PEA_1_T32 (SEQ ID NO: 4340) | 784 | 899 |
| HUMVWF_PEA_1_T37 (SEQ ID NO: 4342) | 1201 | 1316 |
| HUMVWF_PEA_1_T38 (SEQ ID NO: 4343) | 1026 | 1141 |
| HUMVWF_PEA_1_T45 (SEQ ID NO: 4344) | 784 | 899 |
| HUMVWF_PEA_1_T46 (SEQ ID NO: 4345) | 784 | 899 |
| HUMVWF_PEA_1_T49 (SEQ ID NO: 4346) | 784 | 899 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_19 (SEQ ID NO:6349) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T32 (SEQ ID NO:4340), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5985 below describes the starting and ending position of this segment on each transcript.

TABLE 5985

Segment location on transcripts

| Transcript name | Segment starting position | Segment ending position |
|---|---|---|
| HUMVWF_PEA_1_T1 (SEQ ID NO: 4335) | 1317 | 1325 |
| HUMVWF_PEA_1_T5 (SEQ ID NO: 4336) | 900 | 908 |
| HUMVWF_PEA_1_T25 (SEQ ID NO: 4337) | 900 | 908 |
| HUMVWF_PEA_1_T28 (SEQ ID NO: 4339) | 900 | 908 |
| HUMVWF_PEA_1_T32 (SEQ ID NO: 4340) | 900 | 908 |
| HUMVWF_PEA_1_T37 (SEQ ID NO: 4342) | 1317 | 1325 |
| HUMVWF_PEA_1_T38 (SEQ ID NO: 4343) | 1142 | 1150 |
| HUMVWF_PEA_1_T45 (SEQ ID NO: 4344) | 900 | 908 |
| HUMVWF_PEA_1_T46 (SEQ ID NO: 4345) | 900 | 908 |
| HUMVWF_PEA_1_T49 (SEQ ID NO: 4346) | 900 | 908 |

This segment can be found in both coding and non-coding regions of transcript(s) as follows. The segment can be found in a non-coding region of transcript(s) that are related to the following protein(s): HUMVWF_PEA_1_P1, HUMVWF_PEA_1_P2, HUMVWF_PEA_1_P19, HUMVWF_PEA_1_P21, HUMVWF_PEA_1_P32, HUMVWF_PEA_1_P30 and HUMVWF_PEA_1_P33. This segment can also be found in the following protein(s): HUMVWF_PEA_1_P25, since it is in the coding region for the corresponding transcript.

Segment cluster HUMVWF_PEA_1_node_26 (SEQ ID NO:6350) according to the present invention is supported by 12 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5986 below describes the starting and ending position of this segment on each transcript.

TABLE 5986

Segment location on transcripts

| Transcript name | Segment starting position | Segment ending position |
|---|---|---|
| HUMVWF_PEA_1_T1 (SEQ ID NO: 4335) | 1667 | 1778 |
| HUMVWF_PEA_1_T5 (SEQ ID NO: 4336) | 1250 | 1361 |
| HUMVWF_PEA_1_T25 (SEQ ID NO: 4337) | 1250 | 1361 |
| HUMVWF_PEA_1_T28 (SEQ ID NO: 4339) | 1250 | 1361 |
| HUMVWF_PEA_1_T37 (SEQ ID NO: 4342) | 1667 | 1778 |
| HUMVWF_PEA_1_T38 (SEQ ID NO: 4343) | 1492 | 1603 |
| HUMVWF_PEA_1_T45 (SEQ ID NO: 4344) | 1250 | 1361 |
| HUMVWF_PEA_1_T46 (SEQ ID NO: 4345) | 1250 | 1361 |
| HUMVWF_PEA_1_T49 (SEQ ID NO: 4346) | 1250 | 1361 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_28 (SEQ ID NO:6351) according to the present invention is supported by 12 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5987 below describes the starting and ending position of this segment on each transcript.

TABLE 5987

Segment location on transcripts

| Transcript name | Segment starting position | Segment ending position |
|---|---|---|
| HUMVWF_PEA_1_T1 (SEQ ID NO: 4335) | 1779 | 1825 |
| HUMVWF_PEA_1_T5 (SEQ ID NO: 4336) | 1362 | 1408 |
| HUMVWF_PEA_1_T25 (SEQ ID NO: 4337) | 1362 | 1408 |
| HUMVWF_PEA_1_T28 (SEQ ID NO: 4339) | 1362 | 1408 |
| HUMVWF_PEA_1_T37 (SEQ ID NO: 4342) | 1779 | 1825 |

TABLE 5987-continued

Segment location on transcripts

| Transcript name | Segment starting position | Segment ending position |
|---|---|---|
| HUMVWF_PEA_1_T38 (SEQ ID NO: 4343) | 1604 | 1650 |
| HUMVWF_PEA_1_T45 (SEQ ID NO: 4344) | 1362 | 1408 |
| HUMVWF_PEA_1_T46 (SEQ ID NO: 4345) | 1362 | 1408 |
| HUMVWF_PEA_1_T49 (SEQ ID NO: 4346) | 1362 | 1408 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_34 (SEQ ID NO:6352) according to the present invention is supported by 9 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T28 (SEQ ID NO:4339), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5988 below describes the starting and ending position of this segment on each transcript.

TABLE 5988

Segment location on transcripts

| Transcript name | Segment starting position | Segment ending position |
|---|---|---|
| HUMVWF_PEA_1_T1 (SEQ ID NO: 4335) | 2102 | 2202 |
| HUMVWF_PEA_1_T5 (SEQ ID NO: 4336) | 1685 | 1785 |
| HUMVWF_PEA_1_T25 (SEQ ID NO: 4337) | 1685 | 1785 |
| HUMVWF_PEA_1_T28 (SEQ ID NO: 4339) | 1685 | 1785 |
| HUMVWF_PEA_1_T37 (SEQ ID NO: 4342) | 2102 | 2202 |
| HUMVWF_PEA_1_T38 (SEQ ID NO: 4343) | 1927 | 2027 |
| HUMVWF_PEA_1_T45 (SEQ ID NO: 4344) | 1685 | 1785 |
| HUMVWF_PEA_1_T46 (SEQ ID NO: 4345) | 1685 | 1785 |
| HUMVWF_PEA_1_T49 (SEQ ID NO: 4346) | 1685 | 1785 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19, HUMVWF_PEA_1_P21 and HUMVWF_PEA_1_P30, since it is in the coding region for the corresponding transcript.

Segment cluster HUMVWF_PEA_1_node_45 (SEQ ID NO:6353) according to the present invention is supported by 7 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5989 below describes the starting and ending position of this segment on each transcript.

TABLE 5989

Segment location on transcripts

| Transcript name | Segment starting position | Segment ending position |
|---|---|---|
| HUMVWF_PEA_1_T1 (SEQ ID NO: 4335) | 2856 | 2950 |
| HUMVWF_PEA_1_T5 (SEQ ID NO: 4336) | 2439 | 2533 |
| HUMVWF_PEA_1_T25 (SEQ ID NO: 4337) | 2439 | 2533 |
| HUMVWF_PEA_1_T37 (SEQ ID NO: 4342) | 2856 | 2950 |
| HUMVWF_PEA_1_T38 (SEQ ID NO: 4343) | 2681 | 2775 |
| HUMVWF_PEA_1_T45 (SEQ ID NO: 4344) | 2439 | 2533 |
| HUMVWF_PEA_1_T46 (SEQ ID NO: 4345) | 2439 | 2533 |
| HUMVWF_PEA_1_T49 (SEQ ID NO: 4346) | 2439 | 2533 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_49 (SEQ ID NO:6354) according to the present invention is supported by 9 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5990 below describes the starting and ending position of this segment on each transcript.

TABLE 5990

Segment location on transcripts

| Transcript name | Segment starting position | Segment ending position |
|---|---|---|
| HUMVWF_PEA_1_T1 (SEQ ID NO: 4335) | 3112 | 3215 |
| HUMVWF_PEA_1_T5 (SEQ ID NO: 4336) | 2695 | 2798 |
| HUMVWF_PEA_1_T25 (SEQ ID NO: 4337) | 2695 | 2798 |
| HUMVWF_PEA_1_T37 (SEQ ID NO: 4342) | 3112 | 3215 |
| HUMVWF_PEA_1_T38 (SEQ ID NO: 4343) | 2937 | 3040 |
| HUMVWF_PEA_1_T45 (SEQ ID NO: 4344) | 2695 | 2798 |
| HUMVWF_PEA_1_T46 (SEQ ID NO: 4345) | 2695 | 2798 |
| HUMVWF_PEA_1_T49 (SEQ ID NO: 4346) | 2695 | 2798 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_59 (SEQ ID NO:6355) according to the present invention is supported by 18 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T25 (SEQ ID NO:4337), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5991 below describes the starting and ending position of this segment on each transcript.

TABLE 5991

Segment location on transcripts

| Transcript name | Segment starting position | Segment ending position |
|---|---|---|
| HUMVWF_PEA_1_T1 (SEQ ID NO: 4335) | 3778 | 3891 |
| HUMVWF_PEA_1_T5 (SEQ ID NO: 4336) | 3361 | 3474 |
| HUMVWF_PEA_1_T25 (SEQ ID NO: 4337) | 3361 | 3474 |
| HUMVWF_PEA_1_T37 (SEQ ID NO: 4342) | 3778 | 3891 |
| HUMVWF_PEA_1_T38 (SEQ ID NO: 4343) | 3603 | 3716 |
| HUMVWF_PEA_1_T45 (SEQ ID NO: 4344) | 3361 | 3474 |
| HUMVWF_PEA_1_T46 (SEQ ID NO: 4345) | 3361 | 3474 |
| HUMVWF_PEA_1_T49 (SEQ ID NO: 4346) | 3361 | 3474 |

This segment can be found in both coding and non-coding regions of transcript(s) as follows. The segment can be found in a non-coding region of transcript(s) that are related to the following protein(s): HUMVWF_PEA_1_P2, HUMVWF_PEA_1_P32 and HUMVWF_PEA_1_P33. This segment can also be found in the following protein(s): HUMVWF_PEA_1_P1, HUMVWF_PEA_1_P19 and HUMVWF_PEA_1_P30, since it is in the coding region for the corresponding transcript.

Segment cluster HUMVWF_PEA_1_node_73 (SEQ ID NO:6356) according to the present invention is supported by 28 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5992 below describes the starting and ending position of this segment on each transcript.

TABLE 5992

Segment location on transcripts

| Transcript name | Segment starting position | Segment ending position |
|---|---|---|
| HUMVWF_PEA_1_T1 (SEQ ID NO: 4335) | 5723 | 5839 |
| HUMVWF_PEA_1_T5 (SEQ ID NO: 4336) | 7543 | 7659 |
| HUMVWF_PEA_1_T37 (SEQ ID NO: 4342) | 6168 | 6284 |
| HUMVWF_PEA_1_T38 (SEQ ID NO: 4343) | 5993 | 6109 |
| HUMVWF_PEA_1_T45 (SEQ ID NO: 4344) | 5751 | 5867 |
| HUMVWF_PEA_1_T46 (SEQ ID NO: 4345) | 5751 | 5867 |
| HUMVWF_PEA_1_T49 (SEQ ID NO: 4346) | 5751 | 5867 |

This segment can be found in both coding and non-coding regions of transcript(s) as follows. The segment can be found in a non-coding region of transcript(s) that are related to the following protein(s): HUMVWF_PEA_1_P30. This segment can also be found in the following protein(s): HUMVWF_PEA_1_P1, HUMVWF_PEA_1_P2, HUMVWF_PEA_1_P32 and HUMVWF_PEA_1_P33, since it is in the coding region for the corresponding transcript.

Segment cluster HUMVWF_PEA_1_node_77 (SEQ ID NO:6357) according to the present invention is supported by 32 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5993 below describes the starting and ending position of this segment on each transcript.

TABLE 5993

Segment location on transcripts

| Transcript name | Segment starting position | Segment ending position |
|---|---|---|
| HUMVWF_PEA_1_T1 (SEQ ID NO: 4335) | 5981 | 6066 |

TABLE 5993-continued

Segment location on transcripts

| Transcript name | Segment starting position | Segment ending position |
|---|---|---|
| HUMVWF_PEA_1_T5 (SEQ ID NO: 4336) | 7801 | 7886 |
| HUMVWF_PEA_1_T37 (SEQ ID NO: 4342) | 6426 | 6511 |
| HUMVWF_PEA_1_T38 (SEQ ID NO: 4343) | 6251 | 6336 |
| HUMVWF_PEA_1_T45 (SEQ ID NO: 4344) | 6009 | 6094 |
| HUMVWF_PEA_1_T46 (SEQ ID NO: 4345) | 6009 | 6094 |
| HUMVWF_PEA_1_T49 (SEQ ID NO: 4346) | 6009 | 6094 |

This segment can be found in both coding and non-coding regions of transcript(s) as follows. The segment can be found in a non-coding region of transcript(s) that are related to the following protein(s): HUMVWF_PEA_1_P30. This segment can also be found in the following protein(s): HUMVWF_PEA_1_P1, HUMVWF_PEA_1_P2, HUMVWF_PEA_1_P32 and HUMVWF_PEA_1_P33, since it is in the coding region for the corresponding transcript.

Segment cluster HUMVWF_PEA_1_node_78 (SEQ ID NO:6358) according to the present invention is supported by 30 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344), HUMVWF_PEA_1_T46 (SEQ ID NO:4345) and HUMVWF_PEA_1_T49 (SEQ ID NO:4346). Table 5994 below describes the starting and ending position of this segment on each transcript.

TABLE 5994

Segment location on transcripts

| Transcript name | Segment starting position | Segment ending position |
|---|---|---|
| HUMVWF_PEA_1_T1 (SEQ ID NO: 4335) | 6067 | 6124 |
| HUMVWF_PEA_1_T5 (SEQ ID NO: 4336) | 7887 | 7944 |
| HUMVWF_PEA_1_T37 (SEQ ID NO: 4342) | 6512 | 6569 |
| HUMVWF_PEA_1_T38 (SEQ ID NO: 4343) | 6337 | 6394 |
| HUMVWF_PEA_1_T45 (SEQ ID NO: 4344) | 6095 | 6152 |
| HUMVWF_PEA_1_T46 (SEQ ID NO: 4345) | 6095 | 6152 |
| HUMVWF_PEA_1_T49 (SEQ ID NO: 4346) | 6095 | 6152 |

This segment can be found in both coding and non-coding regions of transcript(s) as follows. The segment can be found in a non-coding region of transcript(s) that are related to the following protein(s): HUMVWF_PEA_1_P30. This segment can also be found in the following protein(s): HUMVWF_PEA_1_P1, HUMVWF_PEA_1_P2, HUMVWF_PEA_1_P32 and HUMVWF_PEA_1_P33, since it is in the coding region for the corresponding transcript.

Segment cluster HUMVWF_PEA_1_node_79 (SEQ ID NO:6359) according to the present invention is supported by 1 libraries. The number of libraries was determined as previously described. This segment can be found in the following transcript(s): HUMVWF_PEA_1_T46 (SEQ ID NO:4345). Table 5995 below describes the starting and ending position of this segment on each transcript.

TABLE 5995

Segment location on transcripts

| Transcript name | Segment starting position | Segment ending position |
|---|---|---|
| HUMVWF_PEA_1_T46 (SEQ ID NO: 4345) | 6153 | 6194 |

This segment can be found in a non-coding region of transcript(s) that are related to the following protein(s): HUMVWF_PEA_1_P30.

Segment cluster HUMVWF_PEA_1_node_83 (SEQ ID NO:6360) according to the present invention is supported by 28 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5996 below describes the starting and ending position of this segment on each transcript.

TABLE 5996

Segment location on transcripts

| Transcript name | Segment starting position | Segment ending position |
|---|---|---|
| HUMVWF_PEA_1_T1 (SEQ ID NO: 4335) | 6290 | 6333 |
| HUMVWF_PEA_1_T5 (SEQ ID NO: 4336) | 8110 | 8153 |
| HUMVWF_PEA_1_T37 (SEQ ID NO: 4342) | 6735 | 6778 |
| HUMVWF_PEA_1_T38 (SEQ ID NO: 4343) | 6560 | 6603 |
| HUMVWF_PEA_1_T45 (SEQ ID NO: 4344) | 6318 | 6361 |
| HUMVWF_PEA_1_T49 (SEQ ID NO: 4346) | 6318 | 6361 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_86 (SEQ ID NO:6361) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5997 below describes the starting and ending position of this segment on each transcript.

TABLE 5997

| Segment location on transcripts | | |
|---|---|---|
| Transcript name | Segment starting position | Segment ending position |
| HUMVWF_PEA_1_T1 (SEQ ID NO: 4335) | 6334 | 6347 |
| HUMVWF_PEA_1_T5 (SEQ ID NO: 4336) | 8154 | 8167 |
| HUMVWF_PEA_1_T37 (SEQ ID NO: 4342) | 6779 | 6792 |
| HUMVWF_PEA_1_T38 (SEQ ID NO: 4343) | 6604 | 6617 |
| HUMVWF_PEA_1_T45 (SEQ ID NO: 4344) | 6362 | 6375 |
| HUMVWF_PEA_1_T49 (SEQ ID NO: 4346) | 6362 | 6375 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_87 (SEQ ID NO:6362) according to the present invention is supported by 34 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5998 below describes the starting and ending position of this segment on each transcript.

TABLE 5998

| Segment location on transcripts | | |
|---|---|---|
| Transcript name | Segment starting position | Segment ending position |
| HUMVWF_PEA_1_T1 (SEQ ID NO: 4335) | 6348 | 6398 |
| HUMVWF_PEA_1_T5 (SEQ ID NO: 4336) | 8168 | 8218 |
| HUMVWF_PEA_1_T37 (SEQ ID NO: 4342) | 6793 | 6843 |
| HUMVWF_PEA_1_T38 (SEQ ID NO: 4343) | 6618 | 6668 |
| HUMVWF_PEA_1_T45 (SEQ ID NO: 4344) | 6376 | 6426 |
| HUMVWF_PEA_1_T49 (SEQ ID NO: 4346) | 6376 | 6426 |

This segment can be found in the following protein(s): HUMVWF_PEA_1_P1, HUMVWF_PEA_1_P2, HUMVWF_PEA_1_P32 and HUMVWF_PEA_1_P33P.

Segment cluster HUMVWF_PEA_1_node_88 (SEQ ID NO:6363) according to the present invention is supported by 39 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 5999 below describes the starting and ending position of this segment on each transcript.

TABLE 5999

| Segment location on transcripts | | |
|---|---|---|
| Transcript name | Segment starting position | Segment ending position |
| HUMVWF_PEA_1_T1 (SEQ ID NO: 4335) | 6399 | 6511 |
| HUMVWF_PEA_1_T5 (SEQ ID NO: 4336) | 8219 | 8331 |
| HUMVWF_PEA_1_T37 (SEQ ID NO: 4342) | 6844 | 6956 |
| HUMVWF_PEA_1_T38 (SEQ ID NO: 4343) | 6669 | 6781 |
| HUMVWF_PEA_1_T45 (SEQ ID NO: 4344) | 6427 | 6539 |
| HUMVWF_PEA_1_T49 (SEQ ID NO: 4346) | 6427 | 6539 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_92 (SEQ ID NO:6364) according to the present invention is supported by 38 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6000 below describes the starting and ending position of this segment on each transcript.

TABLE 6000

| Segment location on transcripts | | |
|---|---|---|
| Transcript name | Segment starting position | Segment ending position |
| HUMVWF_PEA_1_T1 (SEQ ID NO: 4335) | 6512 | 6561 |
| HUMVWF_PEA_1_T5 (SEQ ID NO: 4336) | 8332 | 8381 |
| HUMVWF_PEA_1_T37 (SEQ ID NO: 4342) | 6957 | 7006 |
| HUMVWF_PEA_1_T38 (SEQ ID NO: 4343) | 6782 | 6831 |
| HUMVWF_PEA_1_T45 (SEQ ID NO: 4344) | 6540 | 6589 |
| HUMVWF_PEA_1_T49 (SEQ ID NO: 4346) | 6540 | 6589 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_96 (SEQ ID NO:6365) according to the present invention is supported by 50 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6001 below describes the starting and ending position of this segment on each transcript.

TABLE 6001

Segment location on transcripts

| Transcript name | Segment starting position | Segment ending position |
|---|---|---|
| HUMVWF_PEA_1_T1 (SEQ ID NO: 4335) | 6871 | 6925 |
| HUMVWF_PEA_1_T5 (SEQ ID NO: 4336) | 8691 | 8745 |
| HUMVWF_PEA_1_T37 (SEQ ID NO: 4342) | 7316 | 7370 |
| HUMVWF_PEA_1_T38 (SEQ ID NO: 4343) | 7141 | 7195 |
| HUMVWF_PEA_1_T45 (SEQ ID NO: 4344) | 6899 | 6953 |
| HUMVWF_PEA_1_T49 (SEQ ID NO: 4346) | 6899 | 6953 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_104 (SEQ ID NO:6366) according to the present invention is supported by 72 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6002 below describes the starting and ending position of this segment on each transcript.

TABLE 6002

Segment location on transcripts

| Transcript name | Segment starting position | Segment ending position |
|---|---|---|
| HUMVWF_PEA_1_T1 (SEQ ID NO: 4335) | 7468 | 7570 |
| HUMVWF_PEA_1_T5 (SEQ ID NO: 4336) | 9288 | 9390 |
| HUMVWF_PEA_1_T37 (SEQ ID NO: 4342) | 7913 | 8015 |
| HUMVWF_PEA_1_T38 (SEQ ID NO: 4343) | 7738 | 7840 |
| HUMVWF_PEA_1_T45 (SEQ ID NO: 4344) | 7496 | 7598 |
| HUMVWF_PEA_1_T49 (SEQ ID NO: 4346) | 7496 | 7598 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_106 (SEQ ID NO:6367) according to the present invention is supported by 75 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), (SEQ ID NO:4344) and HUMVWF_PEA_1_T49 (SEQ ID NO:4346) Table 6003 below describes the starting and ending position of this segment on each transcript.

TABLE 6003

Segment location on transcripts

| Transcript name | Segment starting position | Segment ending position |
|---|---|---|
| HUMVWF_PEA_1_T1 (SEQ ID NO: 4335) | 7571 | 7645 |
| HUMVWF_PEA_1_T5 (SEQ ID NO: 4336) | 9391 | 9465 |
| HUMVWF_PEA_1_T37 (SEQ ID NO: 4342) | 8016 | 8090 |
| HUMVWF_PEA_1_T38 (SEQ ID NO: 4343) | 7841 | 7915 |
| HUMVWF_PEA_1_T45 (SEQ ID NO: 4344) | 7599 | 7673 |
| HUMVWF_PEA_1_T49 (SEQ ID NO: 4346) | 7599 | 7673 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_108 (SEQ ID NO:6368) according to the present invention is supported by 73 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6004 below describes the starting and ending position of this segment on each transcript.

TABLE 6004

Segment location on transcripts

| Transcript name | Segment starting position | Segment ending position |
|---|---|---|
| HUMVWF_PEA_1_T1 (SEQ ID NO: 4335) | 7646 | 7750 |
| HUMVWF_PEA_1_T5 (SEQ ID NO: 4336) | 9466 | 9570 |
| HUMVWF_PEA_1_T37 (SEQ ID NO: 4342) | 8091 | 8195 |
| HUMVWF_PEA_1_T38 (SEQ ID NO: 4343) | 7916 | 8020 |
| HUMVWF_PEA_1_T45 (SEQ ID NO: 4344) | 7674 | 7778 |
| HUMVWF_PEA_1_T49 (SEQ ID NO: 4346) | 7674 | 7778 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_114 (SEQ ID NO:6369) according to the present invention is supported by 103 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6005 below describes the starting and ending position of this segment on each transcript.

TABLE 6005

Segment location on transcripts

| Transcript name | Segment starting position | Segment ending position |
|---|---|---|
| HUMVWF_PEA_1_T1 (SEQ ID NO: 4335) | 8107 | 8217 |
| HUMVWF_PEA_1_T5 (SEQ ID NO: 4336) | 9927 | 10037 |
| HUMVWF_PEA_1_T37 (SEQ ID NO: 4342) | 8552 | 8662 |
| HUMVWF_PEA_1_T38 (SEQ ID NO: 4343) | 8377 | 8487 |
| HUMVWF_PEA_1_T45 (SEQ ID NO: 4344) | 8135 | 8245 |
| HUMVWF_PEA_1_T49 (SEQ ID NO: 4346) | 8135 | 8245 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_117 (SEQ ID NO:6370) according to the present invention is supported by 92 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6006 below describes the starting and ending position of this segment on each transcript.

TABLE 6006

Segment location on transcripts

| Transcript name | Segment starting position | Segment ending position |
|---|---|---|
| HUMVWF_PEA_1_T1 (SEQ ID NO: 4335) | 8218 | 8258 |
| HUMVWF_PEA_1_T5 (SEQ ID NO: 4336) | 10038 | 10078 |
| HUMVWF_PEA_1_T37 (SEQ ID NO: 4342) | 8663 | 8703 |
| HUMVWF_PEA_1_T38 (SEQ ID NO: 4343) | 8488 | 8528 |
| HUMVWF_PEA_1_T45 (SEQ ID NO: 4344) | 8246 | 8286 |
| HUMVWF_PEA_1_T49 (SEQ ID NO: 4346) | 8246 | 8286 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_119 (SEQ ID NO:6371) according to the present invention can be found in the following transcript(s): HUMVWF_PEA_1_T49 (SEQ ID NO:4346). Table 6007 below describes the starting and ending position of this segment on each transcript.

TABLE 6007

Segment location on transcripts

| Transcript name | Segment starting position | Segment ending position |
|---|---|---|
| HUMVWF_PEA_1_T49 (SEQ ID NO: 4346) | 8427 | 8431 |

This segment can be found in the following protein(s): HUMVWF_PEA_1_P33.

Segment cluster HUMVWF_PEA_1_node_122 (SEQ ID NO:6372) according to the present invention is supported by 114 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6008 below describes the starting and ending position of this segment on each transcript.

TABLE 6008

Segment location on transcripts

| Transcript name | Segment starting position | Segment ending position |
|---|---|---|
| HUMVWF_PEA_1_T1 (SEQ ID NO: 4335) | 8399 | 8439 |
| HUMVWF_PEA_1_T5 (SEQ ID NO: 4336) | 10219 | 10259 |
| HUMVWF_PEA_1_T37 (SEQ ID NO: 4342) | 8844 | 8884 |
| HUMVWF_PEA_1_T38 (SEQ ID NO: 4343) | 8669 | 8709 |
| HUMVWF_PEA_1_T45 (SEQ ID NO: 4344) | 8427 | 8467 |
| HUMVWF_PEA_1_T49 (SEQ ID NO: 4346) | 8432 | 8472 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_125 (SEQ ID NO:6373) according to the present invention is supported by 134 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), (SEQ ID NO:4344) and HUMVWF_PEA_1_T49 (SEQ ID NO:4346). Table 6009 below describes the starting and ending position of this segment on each transcript.

TABLE 6009

Segment location on transcripts

| Transcript name | Segment starting position | Segment ending position |
|---|---|---|
| HUMVWF_PEA_1_T1 (SEQ ID NO: 4335) | 8440 | 8556 |
| HUMVWF_PEA_1_T5 (SEQ ID NO: 4336) | 10260 | 10376 |
| HUMVWF_PEA_1_T37 (SEQ ID NO: 4342) | 8885 | 9001 |

TABLE 6009-continued

Segment location on transcripts

| Transcript name | Segment starting position | Segment ending position |
|---|---|---|
| HUMVWF_PEA_1_T38 (SEQ ID NO: 4343) | 8710 | 8826 |
| HUMVWF_PEA_1_T45 (SEQ ID NO: 4344) | 8468 | 8584 |
| HUMVWF_PEA_1_T49 (SEQ ID NO: 4346) | 8473 | 8589 |

This segment can be found in the following protein(s): HUMVWF_PEA_1_P1, HUMVWF_PEA_1_P2, HUMVWF_PEA_1_P32 and HUMVWF_PEA_1_P33.

Segment cluster HUMVWF_PEA_1_node_127 (SEQ ID NO:6374) according to the present invention is supported by 145 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6010 below describes the starting and ending position of this segment on each transcript.

TABLE 6010

Segment location on transcripts

| Transcript name | Segment starting position | Segment ending position |
|---|---|---|
| HUMVWF_PEA_1_T1 (SEQ ID NO: 4335) | 8557 | 8655 |
| HUMVWF_PEA_1_T5 (SEQ ID NO: 4336) | 10377 | 10475 |
| HUMVWF_PEA_1_T37 (SEQ ID NO: 4342) | 9002 | 9100 |
| HUMVWF_PEA_1_T38 (SEQ ID NO: 4343) | 8827 | 8925 |
| HUMVWF_PEA_1_T45 (SEQ ID NO: 4344) | 8585 | 8683 |
| HUMVWF_PEA_1_T49 (SEQ ID NO: 4346) | 8590 | 8688 |

This segment can be found in both coding and non-coding regions of transcript(s) as follows. The segment can be found in a non-coding region of transcript(s) that are related to the following protein(s): HUMVWF_PEA_1_P33. This segment can also be found in the following protein(s): HUMVWF_PEA_1_P1, HUMVWF_PEA_1_P2 and HUMVWF_PEA_1_P32, since it is in the coding region for the corresponding transcript.

Segment cluster HUMVWF_PEA_1_node_132 (SEQ ID NO:6375) according to the present invention is supported by 172 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6011 below describes the starting and ending position of this segment on each transcript.

TABLE 6011

Segment location on transcripts

| Transcript name | Segment starting position | Segment ending position |
|---|---|---|
| HUMVWF_PEA_1_T1 (SEQ ID NO: 4335) | 8785 | 8824 |
| HUMVWF_PEA_1_T5 (SEQ ID NO: 4336) | 10605 | 10644 |
| HUMVWF_PEA_1_T27 (SEQ ID NO: 4338) | 1428 | 1467 |
| HUMVWF_PEA_1_T37 (SEQ ID NO: 4342) | 9230 | 9269 |
| HUMVWF_PEA_1_T38 (SEQ ID NO: 4343) | 9055 | 9094 |
| HUMVWF_PEA_1_T45 (SEQ ID NO: 4344) | 9320 | 9359 |
| HUMVWF_PEA_1_T49 (SEQ ID NO: 4346) | 8818 | 8857 |

This segment can be found in both coding and non-coding regions of transcript(s) as follows. The segment can be found in a non-coding region of transcript(s) that are related to the following protein(s): HUMVWF_PEA_1_P20, HUMVWF_PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Segment cluster HUMVWF_PEA_1_node_134 (SEQ ID NO:6376) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6012 below describes the starting and ending position of this segment on each transcript.

TABLE 6012

Segment location on transcripts

| Transcript name | Segment starting position | Segment ending position |
|---|---|---|
| HUMVWF_PEA_1_T1 (SEQ ID NO: 4335) | 8825 | 8838 |
| HUMVWF_PEA_1_T5 (SEQ ID NO: 4336) | 10645 | 10658 |
| HUMVWF_PEA_1_T27 (SEQ ID NO: 4338) | 3428 | 3441 |
| HUMVWF_PEA_1_T37 (SEQ ID NO: 4342) | 9270 | 9283 |
| HUMVWF_PEA_1_T38 (SEQ ID NO: 4343) | 9095 | 9108 |
| HUMVWF_PEA_1_T45 (SEQ ID NO: 4344) | 9360 | 9373 |
| HUMVWF_PEA_1_T49 (SEQ ID NO: 4346) | 8858 | 8871 |

This segment can be found in both coding and non-coding regions of transcript(s) as follows. The segment can be found in a non-coding region of transcript(s) that are related to the following protein(s): HUMVWF_PEA_1_P20, HUMVWF_PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Segment cluster HUMVWF_PEA_1_node_135 (SEQ ID NO:6377) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6013 below describes the starting and ending position of this segment on each transcript.

TABLE 6013

Segment location on transcripts

| Transcript name | Segment starting position | Segment ending position |
|---|---|---|
| HUMVWF_PEA_1_T1 (SEQ ID NO: 4335) | 8839 | 8858 |
| HUMVWF_PEA_1_T5 (SEQ ID NO: 4336) | 10659 | 10678 |
| HUMVWF_PEA_1_T27 (SEQ ID NO: 4338) | 3442 | 3461 |
| HUMVWF_PEA_1_T37 (SEQ ID NO: 4342) | 9284 | 9303 |
| HUMVWF_PEA_1_T38 (SEQ ID NO: 4343) | 9109 | 9128 |
| HUMVWF_PEA_1_T45 (SEQ ID NO: 4344) | 9374 | 9393 |
| HUMVWF_PEA_1_T49 (SEQ ID NO: 4346) | 8872 | 8891 |

This segment can be found in both coding and non-coding regions of transcript(s) as follows. The segment can be found in a non-coding region of transcript(s) that are related to the following protein(s): HUMVWF_PEA_1_P20, HUMVWF_PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Segment cluster HUMVWF_PEA_1_node_136 (SEQ ID NO:6378) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6014 below describes the starting and ending position of this segment on each transcript.

TABLE 6014

Segment location on transcripts

| Transcript name | Segment starting position | Segment ending position |
|---|---|---|
| HUMVWF_PEA_1_T1 (SEQ ID NO: 4335) | 8859 | 8864 |
| HUMVWF_PEA_1_T5 (SEQ ID NO: 4336) | 10679 | 10684 |
| HUMVWF_PEA_1_T27 (SEQ ID NO: 4338) | 3462 | 3467 |
| HUMVWF_PEA_1_T37 (SEQ ID NO: 4342) | 9304 | 9309 |
| HUMVWF_PEA_1_T38 (SEQ ID NO: 4343) | 9129 | 9134 |
| HUMVWF_PEA_1_T45 (SEQ ID NO: 4344) | 9394 | 9399 |
| HUMVWF_PEA_1_T49 (SEQ ID NO: 4346) | 8892 | 8897 |

This segment can be found in both coding and non-coding regions of transcript(s) as follows. The segment can be found in a non-coding region of transcript(s) that are related to the following protein(s): HUMVWF_PEA_1_P20, HUMVWF_PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Segment cluster HUMVWF_PEA_1_node_137 (SEQ ID NO:6379) according to the present invention can be found in the following transcript(s): HUMVWF_PEA_1_T1 (SEQ ID NO:4335), HUMVWF_PEA_1_T5 (SEQ ID NO:4336), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6015 below describes the starting and ending position of this segment on each transcript.

TABLE 6015

Segment location on transcripts

| Transcript name | Segment starting position | Segment ending position |
|---|---|---|
| HUMVWF_PEA_1_T1 (SEQ ID NO: 4335) | 8865 | 8874 |
| HUMVWF_PEA_1_T5 (SEQ ID NO: 4336) | 10685 | 10694 |
| HUMVWF_PEA_1_T37 (SEQ ID NO: 4342) | 9310 | 9319 |
| HUMVWF_PEA_1_T38 (SEQ ID NO: 4343) | 9135 | 9144 |
| HUMVWF_PEA_1_T45 (SEQ ID NO: 4344) | 9400 | 9409 |
| HUMVWF_PEA_1_T49 (SEQ ID NO: 4346) | 8898 | 8907 |

This segment can be found in both coding and non-coding regions of transcript(s) as follows. The segment can be found in a non-coding region of transcript(s) that are related to the following protein(s): HUMVWF_PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Segment cluster HUMVWF_PEA_1_node_138 (SEQ ID NO:6380) according to the present invention is supported by 186 libraries. The number of libraries was determined as previously described. This segment can be found in the following transcript(s): HUMVWF_PEA_1_T1 (SEQ ID NO:4335), HUMVWF_PEA_1_T5 (SEQ ID NO:4336), HUMVWF_PEA_1_T27 (SEQ ID NO:4338), HUMVWF_PEA_1_T37 (SEQ ID NO:4342), HUMVWF_PEA_1_T38 (SEQ ID NO:4343), HUMVWF_PEA_1_T45 (SEQ ID NO:4344) and HUMVWF_PEA_1_T49 (SEQ ID NO:4346). Table 6016 below describes the starting and ending position of this segment on each transcript.

TABLE 6016

Segment location on transcripts

| Transcript name | Segment starting position | Segment ending position |
|---|---|---|
| HUMVWF_PEA_1_T1 (SEQ ID NO: 4335) | 8875 | 8922 |
| HUMVWF_PEA_1_T5 (SEQ ID NO: 4336) | 10695 | 10742 |
| HUMVWF_PEA_1_T27 (SEQ ID NO: 4338) | 3468 | 3515 |
| HUMVWF_PEA_1_T37 (SEQ ID NO: 4342) | 9320 | 9367 |

TABLE 6016-continued

Segment location on transcripts

| Transcript name | Segment starting position | Segment ending position |
| --- | --- | --- |
| HUMVWF_PEA_1_T38 (SEQ ID NO: 4343) | 9145 | 9192 |
| HUMVWF_PEA_1_T45 (SEQ ID NO: 4344) | 9410 | 9457 |
| HUMVWF_PEA_1_T49 (SEQ ID NO: 4346) | 8908 | 8955 |

This segment can be found in both coding and non-coding regions of transcript(s) as follows. The segment can be found in a non-coding region of transcript(s) that are related to the following protein(s): HUMVWF_PEA_1_P20, HUMVWF_ PEA_1_P32 and HUMVWF_PEA_1_P33. This segment can also be found in the following protein(s): HUMVWF_PEA_1_P1 and HUMVWF_PEA_1_P2, since it is in the coding region for the corresponding transcript.

Description for Cluster T79260

Cluster T79260 features 7 transcript(s) and 38 segment(s) of interest, the names for which are given in Tables 6017 and 6018, respectively, the sequences themselves are given at the end of the application. The selected protein variants are given in Table 6019.

TABLE 6017

Transcripts of interest
Transcript Name

T79260_PEA_1_T10 (SEQ ID NO: 4347)
T79260_PEA_1_T15 (SEQ ID NO: 4348)
T79260_PEA_1_T20 (SEQ ID NO: 4349)
T79260_PEA_1_T22 (SEQ ID NO: 4350)
T79260_PEA_1_T23 (SEQ ID NO: 4351)
T79260_PEA_1_T24 (SEQ ID NO: 4352)
T79260_PEA_1_T27 (SEQ ID NO: 4353)

TABLE 6018

Segments of interest
Segment Name

T79260_PEA_1_node_0 (SEQ ID NO: 6381)
T79260_PEA_1_node_7 (SEQ ID NO: 6382)
T79260_PEA_1_node_14 (SEQ ID NO: 6383)
T79260_PEA_1_node_15 (SEQ ID NO: 6384)
T79260_PEA_1_node_17 (SEQ ID NO: 6385)
T79260_PEA_1_node_25 (SEQ ID NO: 6386)
T79260_PEA_1_node_26 (SEQ ID NO: 6387)
T79260_PEA_1_node_30 (SEQ ID NO: 6388)
T79260_PEA_1_node_43 (SEQ ID NO: 6389)
T79260_PEA_1_node_45 (SEQ ID NO: 6390)
T79260_PEA_1_node_48 (SEQ ID NO: 6391)
T79260_PEA_1_node_51 (SEQ ID NO: 6392)
T79260_PEA_1_node_63 (SEQ ID NO: 6393)
T79260_PEA_1_node_65 (SEQ ID NO: 6394)
T79260_PEA_1_node_66 (SEQ ID NO: 6395)
T79260_PEA_1_node_67 (SEQ ID NO: 6396)
T79260_PEA_1_node_69 (SEQ ID NO: 6397)
T79260_PEA_1_node_4 (SEQ ID NO: 6398)
T79260_PEA_1_node_9 (SEQ ID NO: 6399)
T79260_PEA_1_node_10 (SEQ ID NO: 6400)
T79260_PEA_1_node_12 (SEQ ID NO: 6401)
T79260_PEA_1_node_19 (SEQ ID NO: 6402)
T79260_PEA_1_node_20 (SEQ ID NO: 6403)
T79260_PEA_1_node_23 (SEQ ID NO: 6404)

TABLE 6018-continued

Segments of interest
Segment Name

T79260_PEA_1_node_27 (SEQ ID NO: 6405)
T79260_PEA_1_node_32 (SEQ ID NO: 6406)
T79260_PEA_1_node_34 (SEQ ID NO: 6407)
T79260_PEA_1_node_36 (SEQ ID NO: 6408)
T79260_PEA_1_node_46 (SEQ ID NO: 6409)
T79260_PEA_1_node_47 (SEQ ID NO: 6410)
T79260_PEA_1_node_50 (SEQ ID NO: 6411)
T79260_PEA_1_node_53 (SEQ ID NO: 6412)
T79260_PEA_1_node_54 (SEQ ID NO: 6413)
T79260_PEA_1_node_55 (SEQ ID NO: 6414)
T79260_PEA_1_node_56 (SEQ ID NO: 6415)
T79260_PEA_1_node_57 (SEQ ID NO: 6416)
T79260_PEA_1_node_59 (SEQ ID NO: 6417)
T79260_PEA_1_node_68 (SEQ ID NO: 6418)

TABLE 6019

Proteins of interest

| Protein Name | Corresponding Transcript(s) |
| --- | --- |
| T79260_PEA_1_P10 | T79260_PEA_1_T10 (SEQ ID NO: 4347) |
| T79260_PEA_1_P14 | T79260_PEA_1_T15 (SEQ ID NO: 4348) |
| T79260_PEA_1_P18 | T79260_PEA_1_T20 (SEQ ID NO: 4349) |
| T79260_PEA_1_P20 | T79260_PEA_1_T22 (SEQ ID NO: 4350); T79260_PEA_1_T23 (SEQ ID NO: 4351) |
| T79260_PEA_1_P21 | T79260_PEA_1_T24 (SEQ ID NO: 4352) |
| T79260_PEA_1_P23 | T79260_PEA_1_T27 (SEQ ID NO: 4353) |

These sequences are variants of the known protein Kinesin-like protein KIF2C (SwissProt accession identifier KF2C_HUMAN; known also according to the synonyms Mitotic centromere-associated kinesin; MCAK; Kinesin-like protein 6), referred to herein as the previously known protein.

Protein Kinesin-like protein KIF2C is known or believed to have the following function(s): Present throughout the cell cycle, associates with centromeres at early prophase, and remains associated with the centromere until after telophase (By similarity). The sequence for protein Kinesin-like protein KIF2C is given at the end of the application, as "Kinesin-like protein KIF2C amino acid sequence". Known polymorphisms for this sequence are as shown in Table 6020.

TABLE 6020

Amino acid mutations for Known Protein

| SNP position(s) on amino acid sequence | Comment |
| --- | --- |
| 449 | I -> L |
| 698 | R -> P |

Protein Kinesin-like protein KIF2C localization is believed to be Cytoplasmic and nuclear (By similarity).

The following GO Annotation(s) apply to the previously known protein. The following annotation(s) were found: mitosis; cell proliferation, which are annotation(s) related to Biological Process; microtubule motor; ATP binding; centromeric DNA binding, which are annotation(s) related to Molecular Function; and nucleus; kinesin, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster T79260 features 38 segment(s), which were listed in Table 6018 above and for which the sequence(s) are given at the end of the application. These segment(s) are portions of nucleic acid sequence(s) which are described herein separately because they are of particular interest. A description of each segment according to the present invention is now provided.

Segment cluster T79260_PEA_1_node_0 (SEQ ID NO:6381) according to the present invention is supported by 64 libraries. The number of libraries was determined as previously described. This segment can be found in the following transcript(s): T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6021 below describes the starting and ending position of this segment on each transcript.

TABLE 6021

| | Segment location on transcripts | |
|---|---|---|
| Transcript name | Segment starting position | Segment ending position |
| T79260_PEA_1_T20 (SEQ ID NO: 4349) | 1 | 226 |
| T79260_PEA_1_T22 (SEQ ID NO: 4350) | 1 | 226 |
| T79260_PEA_1_T23 (SEQ ID NO: 4351) | 1 | 226 |
| T79260_PEA_1_T24 (SEQ ID NO: 4352) | 1 | 226 |

This segment can be found in the following protein(s): T79260_PEA_1_P18, T79260_PEA_1_P20 and T79260_PEA_1_P21.

Segment cluster T79260_PEA_1_node_7 (SEQ ID NO:6382) according to the present invention is supported by 3 libraries. The number of libraries was determined as previously described. This segment can be found in the following transcript(s): T79260_PEA_1_T10 (SEQ ID NO:4347). Table 6022 below describes the starting and ending position of this segment on each transcript.

TABLE 6022

| | Segment location on transcripts | |
|---|---|---|
| Transcript name | Segment starting position | Segment ending position |
| T79260_PEA_1_T10 (SEQ ID NO: 4347) | 1 | 358 |

This segment can be found in a non-coding region of transcript(s) that are related to the following protein(s): T79260_PEA_1_P10.

Segment cluster T79260_PEA_1_node_14 (SEQ ID NO:6383) according to the present invention is supported by 2 libraries. The number of libraries was determined as previously described. This segment can be found in the following transcript(s): T79260_PEA_1_T10 (SEQ ID NO:4347). Table 6023 below describes the starting and ending position of this segment on each transcript.

TABLE 6023

| | Segment location on transcripts | |
|---|---|---|
| Transcript name | Segment starting position | Segment ending position |
| T79260_PEA_1_T10 (SEQ ID NO: 4347) | 510 | 642 |

This segment can be found in a non-coding region of transcript(s) that are related to the following protein(s): T79260_PEA_1_P10.

Segment cluster T79260_PEA_1_node_15 (SEQ ID NO:6384) according to the present invention is supported by 63 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6024 below describes the starting and ending position of this segment on each transcript.

TABLE 6024

| | Segment location on transcripts | |
|---|---|---|
| Transcript name | Segment starting position | Segment ending position |
| T79260_PEA_1_T10 (SEQ ID NO: 4347) | 643 | 765 |
| T79260_PEA_1_T20 (SEQ ID NO: 4349) | 473 | 595 |
| T79260_PEA_1_T22 (SEQ ID NO: 4350) | 473 | 595 |
| T79260_PEA_1_T23 (SEQ ID NO: 4351) | 473 | 595 |
| T79260_PEA_1_T24 (SEQ ID NO: 4352) | 473 | 595 |

This segment can be found in the following protein(s): T79260_PEA_1_P10, T79260_PEA_1_P18, T79260_PEA_1_P20 and T79260_PEA_1_P21.

Segment cluster T79260_PEA_1_node_17 (SEQ ID NO:6385) according to the present invention is supported by 64 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6025 below describes the starting and ending position of this segment on each transcript.

TABLE 6025

| | Segment location on transcripts | |
|---|---|---|
| Transcript name | Segment starting position | Segment ending position |
| T79260_PEA_1_T10 (SEQ ID NO: 4347) | 766 | 888 |
| T79260_PEA_1_T20 (SEQ ID NO: 4349) | 596 | 718 |
| T79260_PEA_1_T22 (SEQ ID NO: 4350) | 596 | 718 |
| T79260_PEA_1_T23 (SEQ ID NO: 4351) | 596 | 718 |
| T79260_PEA_1_T24 (SEQ ID NO: 4352) | 596 | 718 |

This segment can be found in the following protein(s): T79260_PEA_1_P10, T79260_PEA_1_P18, T79260_PEA_1_P20 and T79260_PEA_1_P21.

Segment cluster T79260_PEA_1_node_25 (SEQ ID NO:6386) according to the present invention is supported by 3 libraries. The number of libraries was determined as previously described. This segment can be found in the following transcript(s): T79260_PEA_1_T15 (SEQ ID NO:4348). Table 6026 below describes the starting and ending position of this segment on each transcript.

TABLE 6026

Segment location on transcripts

| Transcript name | Segment starting position | Segment ending position |
|---|---|---|
| T79260_PEA_1_T15 (SEQ ID NO: 4348) | 1 | 332 |

This segment can be found in a non-coding region of transcript(s) that are related to the following protein(s): T79260_PEA_1_P14.

Segment cluster T79260_PEA_1_node_26 (SEQ ID NO:6387) according to the present invention is supported by 6 libraries. The number of libraries was determined as previously described. This segment can be found in the following transcript(s): T79260_PEA_1_T15 (SEQ ID NO:4348). Table 6027 below describes the starting and ending position of this segment on each transcript.

TABLE 6027

Segment location on transcripts

| Transcript name | Segment starting position | Segment ending position |
|---|---|---|
| T79260_PEA_1_T15 (SEQ ID NO: 4348) | 333 | 900 |

This segment can be found in the following protein(s): T79260_PEA_1_P14.

Segment cluster T79260_PEA_1_node_30 (SEQ ID NO:6388) according to the present invention is supported by 49 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6028 below describes the starting and ending position of this segment on each transcript.

TABLE 6028

Segment location on transcripts

| Transcript name | Segment starting position | Segment ending position |
|---|---|---|
| T79260_PEA_1_T10 (SEQ ID NO: 4347) | 1141 | 1303 |
| T79260_PEA_1_T15 (SEQ ID NO: 4348) | 956 | 1118 |
| T79260_PEA_1_T20 (SEQ ID NO: 4349) | 971 | 1133 |
| T79260_PEA_1_T22 (SEQ ID NO: 4350) | 971 | 1133 |
| T79260_PEA_1_T23 (SEQ ID NO: 4351) | 971 | 1133 |
| T79260_PEA_1_T24 (SEQ ID NO: 4352) | 971 | 1133 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_43 (SEQ ID NO:6389) according to the present invention is supported by 45 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6029 below describes the starting and ending position of this segment on each transcript.

TABLE 6029

Segment location on transcripts

| Transcript name | Segment starting position | Segment ending position |
|---|---|---|
| T79260_PEA_1_T10 (SEQ ID NO: 4347) | 1551 | 1693 |
| T79260_PEA_1_T15 (SEQ ID NO: 4348) | 1366 | 1508 |
| T79260_PEA_1_T20 (SEQ ID NO: 4349) | 1381 | 1523 |
| T79260_PEA_1_T22 (SEQ ID NO: 4350) | 1381 | 1523 |
| T79260_PEA_1_T23 (SEQ ID NO: 4351) | 1381 | 1523 |
| T79260_PEA_1_T24 (SEQ ID NO: 4352) | 1381 | 1523 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_45 (SEQ ID NO:6390) according to the present invention is supported by 52 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6030 below describes the starting and ending position of this segment on each transcript.

TABLE 6030

Segment location on transcripts

| Transcript name | Segment starting position | Segment ending position |
| --- | --- | --- |
| T79260_PEA_1_T10 (SEQ ID NO: 4347) | 1694 | 1898 |
| T79260_PEA_1_T15 (SEQ ID NO: 4348) | 1509 | 1713 |
| T79260_PEA_1_T20 (SEQ ID NO: 4349) | 1524 | 1728 |
| T79260_PEA_1_T22 (SEQ ID NO: 4350) | 1524 | 1728 |
| T79260_PEA_1_T23 (SEQ ID NO: 4351) | 1524 | 1728 |
| T79260_PEA_1_T24 (SEQ ID NO: 4352) | 1524 | 1728 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_48 (SEQ ID NO:6391) according to the present invention is supported by 4 libraries. The number of libraries was determined as previously described. This segment can be found in the following transcript(s): T79260_PEA_1_T20 (SEQ ID NO:4349) and T79260_PEA_1_T22 (SEQ ID NO:4350). Table 6031 below describes the starting and ending position of this segment on each transcript.

TABLE 6031

Segment location on transcripts

| Transcript name | Segment starting position | Segment ending position |
| --- | --- | --- |
| T79260_PEA_1_T20 (SEQ ID NO: 4349) | 1840 | 2360 |
| T79260_PEA_1_T22 (SEQ ID NO: 4350) | 1947 | 2467 |

This segment can be found in both coding and non-coding regions of transcript(s) as follows. The segment can be found in a non-coding region of transcript(s) that are related to the following protein(s): T79260_PEA_1_P20. This segment can also be found in the following 15 protein(s): T79260_PEA_1_P18, since it is in the coding region for the corresponding transcript.

Segment cluster T79260_PEA_1_node_51 (SEQ ID NO:6392) according to the present invention is supported by 2 libraries. The number of libraries was determined as previously described. This segment can be found in the following transcript(s): T79260_PEA_1_T23 (SEQ ID NO:4351) and T79260_PEA_1_T24 (SEQ ID NO:4352). Table 6032 below describes the starting and ending position of this segment on each transcript.

TABLE 6032

Segment location on transcripts

| Transcript name | Segment starting position | Segment ending position |
| --- | --- | --- |
| T79260_PEA_1_T23 (SEQ ID NO: 4351) | 2015 | 2140 |
| T79260_PEA_1_T24 (SEQ ID NO: 4352) | 1797 | 1922 |

This segment can be found in both coding and non-coding regions of transcript(s) as follows. The segment can be found in a non-coding region of transcript(s) that are related to the following protein(s): T79260_PEA_1_P20. This segment can also be found in the following protein(s): T79260_PEA_1_P21, since it is in the coding region for the corresponding transcript.

Segment cluster T79260_PEA_1_node_63 (SEQ ID NO:6393) according to the present invention is supported by 62 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6033 below describes the starting and ending position of this segment on each transcript.

TABLE 6033

Segment location on transcripts

| Transcript name | Segment starting position | Segment ending position |
| --- | --- | --- |
| T79260_PEA_1_T10 (SEQ ID NO: 4347) | 2298 | 2421 |
| T79260_PEA_1_T15 (SEQ ID NO: 4348) | 2113 | 2236 |
| T79260_PEA_1_T27 (SEQ ID NO: 4353) | 427 | 550 |

This segment can be found in the following protein(s): T79260_PEA_1_P10, T79260_PEA_1_P14 and T79260_PEA_1_P23.

Segment cluster T79260_PEA_1_node_65 (SEQ ID NO:6394) according to the present invention is supported by 85 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6034 below describes the starting and ending position of this segment on each transcript.

TABLE 6034

Segment location on transcripts

| Transcript name | Segment starting position | Segment ending position |
| --- | --- | --- |
| T79260_PEA_1_T10 (SEQ ID NO: 4347) | 2422 | 2650 |
| T79260_PEA_1_T15 (SEQ ID NO: 4348) | 2237 | 2465 |
| T79260_PEA_1_T27 (SEQ ID NO: 4353) | 551 | 779 |

This segment can be found in the following protein(s): T79260_PEA_1_P10, T79260_PEA_1_P14 and T79260_PEA_1_P23.

Segment cluster T79260_PEA_1_node_66 (SEQ ID NO:6395) according to the present invention is supported by 82 libraries. The number of libraries was determined as previously described. This segment can be found in the following transcript(s): T79260_PEA_1_T10 (SEQ ID NO:4347), T79260_PEA_1_T5 (SEQ ID NO:4348) and T79260_PEA_1_T27 (SEQ ID NO:4353). Table 6035 below describes the starting and ending position of this segment on each transcript.

TABLE 6035

| | Segment location on transcripts | |
|---|---|---|
| Transcript name | Segment starting position | Segment ending position |
| T79260_PEA_1_T10 (SEQ ID NO: 4347) | 2651 | 2818 |
| T79260_PEA_1_T15 (SEQ ID NO: 4348) | 2466 | 2633 |
| T79260_PEA_1_T27 (SEQ ID NO: 4353) | 780 | 947 |

This segment can be found in a non-coding region of transcript(s) that are related to the following protein(s): T79260_PEA_1_P10, T79260_PEA_1_P14 and T79260_PEA_1_P23.

Segment cluster T79260_PEA_1_node_67 (SEQ ID NO:6396) according to the present invention is supported by 74 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6036 below describes the starting and ending position of this segment on each transcript.

TABLE 6036

| | Segment location on transcripts | |
|---|---|---|
| Transcript name | Segment starting position | Segment ending position |
| T79260_PEA_1_T10 (SEQ ID NO: 4347) | 2819 | 2944 |
| T79260_PEA_1_T15 (SEQ ID NO: 4348) | 2634 | 2759 |
| T79260_PEA_1_T27 (SEQ ID NO: 4353) | 948 | 1073 |

This segment can be found in a non-coding region of transcript(s) that are related to the following protein(s): T79260_PEA_1_P10, T79260_PEA_1_P14 and T79260_PEA_1_P23.

Segment cluster T79260_PEA_1_node_69 (SEQ ID NO:6397) according to the present invention is supported by 64 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6037 below describes the starting and ending position of this segment on each transcript.

TABLE 6037

| | Segment location on transcripts | |
|---|---|---|
| Transcript name | Segment starting position | Segment ending position |
| T79260_PEA_1_T10 (SEQ ID NO: 4347) | 2966 | 3093 |
| T79260_PEA_1_T15 (SEQ ID NO: 4348) | 2781 | 2908 |
| T79260_PEA_1_T27 (SEQ ID NO: 4353) | 1095 | 1222 |

This segment can be found in a non-coding region of transcript(s) that are related to the following protein(s): T79260_PEA_1_P10, T79260_PEA_1_P14 and T79260_PEA_1_P23.

According to an optional embodiment of the present invention, short segments related to the above cluster are also provided. These segments are up to about 120 bp in length, and so are included in a separate description.

Segment cluster T79260_PEA_1_node_4 (SEQ ID NO:6398) according to the present invention is supported by 67 libraries. The number of libraries was determined as previously described. This segment can be found in the following transcript(s): T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6038 below describes the starting and ending position of this segment on each transcript.

TABLE 6038

| | Segment location on transcripts | |
|---|---|---|
| Transcript name | Segment starting position | Segment ending position |
| T79260_PEA_1_T20 (SEQ ID NO: 4349) | 227 | 321 |
| T79260_PEA_1_T22 (SEQ ID NO: 4350) | 227 | 321 |
| T79260_PEA_1_T23 (SEQ ID NO: 4351) | 227 | 321 |
| T79260_PEA_1_T24 (SEQ ID NO: 4352) | 227 | 321 |

This segment can be found in the following protein(s): T79260_PEA_1_P18, T79260_PEA_1_P20 and T79260_PEA_1_P21.

Segment cluster T79260_PEA_1_node_9 (SEQ ID NO:6399) according to the present invention is supported by 67 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6039 below describes the starting and ending position of this segment on each transcript.

TABLE 6039

| | Segment location on transcripts | |
|---|---|---|
| Transcript name | Segment starting position | Segment ending position |
| T79260_PEA_1_T10 (SEQ ID NO: 4347) | 359 | 424 |

TABLE 6039-continued

Segment location on transcripts

| Transcript name | Segment starting position | Segment ending position |
|---|---|---|
| T79260_PEA_1_T20 (SEQ ID NO: 4349) | 322 | 387 |
| T79260_PEA_1_T22 (SEQ ID NO: 4350) | 322 | 387 |
| T79260_PEA_1_T23 (SEQ ID NO: 4351) | 322 | 387 |
| T79260_PEA_1_T24 (SEQ ID NO: 4352) | 322 | 387 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 6040.

TABLE 6040

Oligonucleotides related to this segment

| Oligonucleotide name | Overexpressed in cancers | Chip reference |
|---|---|---|
| T79260_0_21_0 | lung malignant tumors | LUN |
| T79260_0_21_0 | ovarian carcinoma | OVA |

This segment can be found in both coding and non-coding regions of transcript(s) as follows. The segment can be found in a non-coding region of transcript(s) that are related to the following protein(s): T79260_PEA_1_P10. This segment can also be found in the following 15 protein(s): T79260_PEA_1_P18, T79260_PEA_1_P20 and T79260_PEA_1_P21, since it is in the coding region for the corresponding transcript.

Segment cluster T79260_PEA_1_node_10 (SEQ ID NO:6400) according to the present invention is supported by 61 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6041 below describes the starting and ending position of this segment on each transcript.

TABLE 6041

Segment location on transcripts

| Transcript name | Segment starting position | Segment ending position |
|---|---|---|
| T79260_PEA_1_T10 (SEQ ID NO: 4347) | 425 | 460 |
| T79260_PEA_1_T20 (SEQ ID NO: 4349) | 388 | 423 |
| T79260_PEA_1_T22 (SEQ ID NO: 4350) | 388 | 423 |
| T79260_PEA_1_T23 (SEQ ID NO: 4351) | 388 | 423 |
| T79260_PEA_1_T24 (SEQ ID NO: 4352) | 388 | 423 |

This segment can be found in both coding and non-coding regions of transcript(s) as follows. The segment can be found in a non-coding region of transcript(s) that are related to the following protein(s): T79260_PEA_1_P10. This segment can also be found in the following protein(s): T79260_PEA_1_P18, T79260_PEA_1_P20 and T79260_PEA_1_P21, since it is in the coding region for the corresponding transcript.

Segment cluster T79260_PEA_1_node_12 (SEQ ID NO:6401) according to the present invention is supported by 63 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6042 below describes the starting and ending position of this segment on each transcript.

TABLE 6042

Segment location on transcripts

| Transcript name | Segment starting position | Segment ending position |
|---|---|---|
| T79260_PEA_1_T10 (SEQ ID NO: 4347) | 461 | 509 |
| T79260_PEA_1_T20 (SEQ ID NO: 4349) | 424 | 472 |
| T79260_PEA_1_T22 (SEQ ID NO: 4350) | 424 | 472 |
| T79260_PEA_1_T23 (SEQ ID NO: 4351) | 424 | 472 |
| T79260_PEA_1_T24 (SEQ ID NO: 4352) | 424 | 472 |

This segment can be found in both coding and non-coding regions of transcript(s) as follows. The segment can be found in a non-coding region of transcript(s) that are related to the following protein(s): T79260_PEA_1_P10. This segment can also be found in the following protein(s): T79260_PEA_1_P18, T79260_PEA_1_P20 and T79260_PEA_1_P21, since it is in the coding region for the corresponding transcript.

Segment cluster T79260_PEA_1_node_19 (SEQ ID NO:6402) according to the present invention is supported by 62 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6043 below describes the starting and ending position of this segment on each transcript.

TABLE 6043

Segment location on transcripts

| Transcript name | Segment starting position | Segment ending position |
|---|---|---|
| T79260_PEA_1_T10 (SEQ ID NO: 4347) | 889 | 914 |
| T79260_PEA_1_T20 (SEQ ID NO: 4349) | 719 | 744 |
| T79260_PEA_1_T22 (SEQ ID NO: 4350) | 719 | 744 |
| T79260_PEA_1_T23 (SEQ ID NO: 4351) | 719 | 744 |
| T79260_PEA_1_T24 (SEQ ID NO: 4352) | 719 | 744 |

This segment can be found in the following protein(s): T79260_PEA_1_P10, T79260_PEA_1_P18, T79260_PEA_1_P20 and T79260_PEA_1_P21.

Segment cluster T79260_PEA_1_node_20 (SEQ ID NO:6403) according to the present invention is supported by 60 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6044 below describes the starting and ending position of this segment on each transcript.

TABLE 6044

Segment location on transcripts

| Transcript name | Segment starting position | Segment ending position |
| --- | --- | --- |
| T79260_PEA_1_T10 (SEQ ID NO: 4347) | 915 | 989 |
| T79260_PEA_1_T20 (SEQ ID NO: 4349) | 745 | 819 |
| T79260_PEA_1_T22 (SEQ ID NO: 4350) | 745 | 819 |
| T79260_PEA_1_T23 (SEQ ID NO: 4351) | 745 | 819 |
| T79260_PEA_1_T24 (SEQ ID NO: 4352) | 745 | 819 |

This segment can be found in the following protein(s): T79260_PEA_1_P10, T79260_PEA_1_P18, T79260_PEA_1_P20 and T79260_PEA_1_P21.

Segment cluster T79260_PEA_1_node_23 (SEQ ID NO:6404) according to the present invention is supported by 48 libraries. The number of libraries was determined as previously described. This segment can be found in the following transcript(s): T79260_PEA_1_T10 (SEQ ID NO:4347), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6045 below describes the starting and ending position of this segment on each transcript.

TABLE 6045

Segment location on transcripts

| Transcript name | Segment starting position | Segment ending position |
| --- | --- | --- |
| T79260_PEA_1_T10 (SEQ ID NO: 4347) | 990 | 1085 |
| T79260_PEA_1_T20 (SEQ ID NO: 4349) | 820 | 915 |
| T79260_PEA_1_T22 (SEQ ID NO: 4350) | 820 | 915 |
| T79260_PEA_1_T23 (SEQ ID NO: 4351) | 820 | 915 |
| T79260_PEA_1_T24 (SEQ ID NO: 4352) | 820 | 915 |

This segment can be found in the following protein(s): T79260_PEA_1_P10, T79260_PEA_1_P18, T79260_PEA_1_P20 and T79260_PEA_1_P21.

Segment cluster T79260_PEA_1_node_27 (SEQ ID NO:6405) according to the present invention is supported by 47 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6046 below describes the starting and ending position of this segment on each transcript.

TABLE 6046

Segment location on transcripts

| Transcript name | Segment starting position | Segment ending position |
| --- | --- | --- |
| T79260_PEA_1_T10 (SEQ ID NO: 4347) | 1086 | 1140 |
| T79260_PEA_1_T15 (SEQ ID NO: 4348) | 901 | 955 |
| T79260_PEA_1_T20 (SEQ ID NO: 4349) | 916 | 970 |
| T79260_PEA_1_T22 (SEQ ID NO: 4350) | 916 | 970 |
| T79260_PEA_1_T23 (SEQ ID NO: 4351) | 916 | 970 |
| T79260_PEA_1_T24 (SEQ ID NO: 4352) | 916 | 970 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_32 (SEQ ID NO:6406) according to the present invention is supported by 43 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6047 below describes the starting and ending position of this segment on each transcript.

TABLE 6047

Segment location on transcripts

| Transcript name | Segment starting position | Segment ending position |
| --- | --- | --- |
| T79260_PEA_1_T10 (SEQ ID NO: 4347) | 1304 | 1394 |
| T79260_PEA_1_T15 (SEQ ID NO: 4348) | 1119 | 1209 |
| T79260_PEA_1_T20 (SEQ ID NO: 4349) | 1134 | 1224 |
| T79260_PEA_1_T22 (SEQ ID NO: 4350) | 1134 | 1224 |
| T79260_PEA_1_T23 (SEQ ID NO: 4351) | 1134 | 1224 |
| T79260_PEA_1_T24 (SEQ ID NO: 4352) | 1134 | 1224 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_34 (SEQ ID NO:6407) according to the present invention is supported by 47 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_

1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6048 below describes the starting and ending position of this segment on each transcript.

TABLE 6048

Segment location on transcripts

| Transcript name | Segment starting position | Segment ending position |
|---|---|---|
| T79260_PEA_1_T10 (SEQ ID NO: 4347) | 1395 | 1458 |
| T79260_PEA_1_T15 (SEQ ID NO: 4348) | 1210 | 1273 |
| T79260_PEA_1_T20 (SEQ ID NO: 4349) | 1225 | 1288 |
| T79260_PEA_1_T22 (SEQ ID NO: 4350) | 1225 | 1288 |
| T79260_PEA_1_T23 (SEQ ID NO: 4351) | 1225 | 1288 |
| T79260_PEA_1_T24 (SEQ ID NO: 4352) | 1225 | 1288 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_36 (SEQ ID NO:6408) according to the present invention is supported by 41 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350), T79260_PEA_1_T23 (SEQ ID NO:4351) and T79260_PEA_1_T24 (SEQ ID NO:4352). Table 6049 below describes the starting and ending position of this segment on each transcript.

TABLE 6049

Segment location on transcripts

| Transcript name | Segment starting position | Segment ending position |
|---|---|---|
| T79260_PEA_1_T10 (SEQ ID NO: 4347) | 1459 | 1550 |
| T79260_PEA_1_T15 (SEQ ID NO: 4348) | 1274 | 1365 |
| T79260_PEA_1_T20 (SEQ ID NO: 4349) | 1289 | 1380 |
| T79260_PEA_1_T22 (SEQ ID NO: 4350) | 1289 | 1380 |
| T79260_PEA_1_T23 (SEQ ID NO: 4351) | 1289 | 1380 |
| T79260_PEA_1_T24 (SEQ ID NO: 4352) | 1289 | 1380 |

This segment can be found in the following protein(s): T79260_PEA_1_P10, T79260_PEA_1_P14, T79260_PEA_1_P18, T79260_PEA_1_P20 and T79260_PEA_1_P21.

Segment cluster T79260_PEA_1_node_46 (SEQ ID NO:6409) according to the present invention is supported by 2 libraries. The number of libraries was determined as previously described. This segment can be found in the following transcript(s): T79260_PEA_1_T22 (SEQ ID NO:4350) and T79260_PEA_1_T23 (SEQ ID NO:4351). Table 6050 below describes the starting and ending position of this segment on each transcript.

TABLE 6050

Segment location on transcripts

| Transcript name | Segment starting position | Segment ending position |
|---|---|---|
| T79260_PEA_1_T22 (SEQ ID NO: 4350) | 1729 | 1835 |
| T79260_PEA_1_T23 (SEQ ID NO: 4351) | 1729 | 1835 |

This segment can be found in the following protein(s): T79260_PEA_1_P20.

Segment cluster T79260_PEA_1_node_47 (SEQ ID NO:6410) according to the present invention is supported by 50 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T20 (SEQ ID NO:4349), T79260_PEA_1_T22 (SEQ ID NO:4350) and T79260_PEA_1_T23 (SEQ ID NO:4351). Table 6051 below describes the starting and ending position of this segment on each transcript.

TABLE 6051

Segment location on transcripts

| Transcript name | Segment starting position | Segment ending position |
|---|---|---|
| T79260_PEA_1_T10 (SEQ ID NO: 4347) | 1899 | 2009 |
| T79260_PEA_1_T15 (SEQ ID NO: 4348) | 1714 | 1824 |
| T79260_PEA_1_T20 (SEQ ID NO: 4349) | 1729 | 1839 |
| T79260_PEA_1_T22 (SEQ ID NO: 4350) | 1836 | 1946 |
| T79260_PEA_1_T23 (SEQ ID NO: 4351) | 1836 | 1946 |

This segment can be found in the following protein(s): T79260_PEA_1_P10, T79260_PEA_1_P14, T79260_PEA_1_P18 and T79260_PEA_1_P20.

Segment cluster T79260_PEA_1_node_50 (SEQ ID NO:6411) according to the present invention is supported by 50 libraries. The number of libraries was determined as previously described. This segment can be found in the following transcript(s): T79260_PEA_1_T10 (SEQ ID NO:4347), T79260_PEA_1_T15 (SEQ ID NO:4348), T79260_PEA_1_T23 (SEQ ID NO:4351) and T79260_PEA_1_T24 (SEQ ID NO:4352). Table 6052 below describes the starting and ending position of this segment on each transcript.

TABLE 6052

Segment location on transcripts

| Transcript name | Segment starting position | Segment ending position |
|---|---|---|
| T79260_PEA_1_T10 (SEQ ID NO: 4347) | 2010 | 2077 |
| T79260_PEA_1_T15 (SEQ ID NO: 4348) | 1825 | 1892 |

TABLE 6052-continued

Segment location on transcripts

| Transcript name | Segment starting position | Segment ending position |
|---|---|---|
| T79260_PEA_1_T23 (SEQ ID NO: 4351) | 1947 | 2014 |
| T79260_PEA_1_T24 (SEQ ID NO: 4352) | 1729 | 1796 |

This segment can be found in both coding and non-coding regions of transcript(s) as follows. The segment can be found in a non-coding region of transcript(s) that are related to the following protein(s): T79260_PEA_1_P20. This segment can also be found in the following protein(s): T79260_PEA_1_P10, T79260_PEA_1_P14 and T79260_PEA_1_P21, since it is in the coding region for the corresponding transcript.

Segment cluster T79260_PEA_1_node_53 (SEQ ID NO:6412) according to the present invention is supported by 2 libraries. The number of libraries was determined as previously described. This segment can be found in the following transcript(s): T79260_PEA_1_T27 (SEQ ID NO:4353). Table 6053 below describes the starting and ending position of this segment on each transcript.

TABLE 6053

Segment location on transcripts

| Transcript name | Segment starting position | Segment ending position |
|---|---|---|
| T79260_PEA_1_T27 (SEQ ID NO: 4353) | 1 | 89 |

This segment can be found in a non-coding region of transcript(s) that are related to the following protein(s): T79260_PEA_1_P23.

Segment cluster T79260_PEA_1_node_54 (SEQ ID NO:6413) according to the present invention is supported by 3 libraries. The number of libraries was determined as previously described. This segment can be found in the following transcript(s): T79260_PEA_1_T27 (SEQ ID NO:4353). Table 6054 below describes the starting and ending position of this segment on each transcript.

TABLE 6054

Segment location on transcripts

| Transcript name | Segment starting position | Segment ending position |
|---|---|---|
| T79260_PEA_1_T27 (SEQ ID NO: 4353) | 90 | 156 |

This segment can be found in a non-coding region of transcript(s) that are related to the following protein(s): T79260_PEA_1_P23.

Segment cluster T79260_PEA_1_node_55 (SEQ ID NO:6414) according to the present invention is supported by 2 libraries. The number of libraries was determined as previously described. This segment can be found in the following transcript(s): T79260_PEA_1_T27 (SEQ ID NO:4353). Table 6055 below describes the starting and ending position of this segment on each transcript.

TABLE 6055

Segment location on transcripts

| Transcript name | Segment starting position | Segment ending position |
|---|---|---|
| T79260_PEA_1_T27 (SEQ ID NO: 4353) | 157 | 206 |

This segment can be found in a non-coding region of transcript(s) that are related to the following protein(s): T79260_PEA_1_P23.

Segment cluster T79260_PEA_1_node_56 (SEQ ID NO:6415) according to the present invention is supported by 54 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6056 below describes the starting and ending position of this segment on each transcript.

TABLE 6056

Segment location on transcripts

| Transcript name | Segment starting position | Segment ending position |
|---|---|---|
| T79260_PEA_1_T10 (SEQ ID NO: 4347) | 2078 | 2178 |
| T79260_PEA_1_T15 (SEQ ID NO: 4348) | 1893 | 1993 |
| T79260_PEA_1_T27 (SEQ ID NO: 4353) | 207 | 307 |

This segment can be found in the following protein(s): T79260_PEA_1_P10, T79260_PEA_1_P14 and T79260_PEA_1_P23.

Segment cluster T79260_PEA_1_node_57 (SEQ ID NO:6416) according to the present invention can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6057 below describes the starting and ending position of this segment on each transcript.

TABLE 6057

Segment location on transcripts

| Transcript name | Segment starting position | Segment ending position |
|---|---|---|
| T79260_PEA_1_T10 (SEQ ID NO: 4347) | 2179 | 2183 |
| T79260_PEA_1_T15 (SEQ ID NO: 4348) | 1994 | 1998 |
| T79260_PEA_1_T27 (SEQ ID NO: 4353) | 308 | 312 |

This segment can be found in the following protein(s): T79260_PEA_1_P10, T79260_PEA_1_P14 and T79260_PEA_1_P23.

Segment cluster T79260_PEA_1_node_59 (SEQ ID NO:6417) according to the present invention is supported by 62 libraries. The number of libraries was determined as previously described. This segment can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6058 below describes the starting and ending position of this segment on each transcript.

TABLE 6058

Segment location on transcripts

| Transcript name | Segment starting position | Segment ending position |
|---|---|---|
| T79260_PEA_1_T10 (SEQ ID NO: 4347) | 2184 | 2297 |
| T79260_PEA_1_T15 (SEQ ID NO: 4348) | 1999 | 2112 |
| T79260_PEA_1_T27 (SEQ ID NO: 4353) | 313 | 426 |

This segment can be found in the following protein(s): T79260_PEA_1_P10, T79260_PEA_1_P14 and T79260_PEA_1_P23.

Segment cluster T79260_PEA_1_node_68 (SEQ ID NO:6418) according to the present invention can be found in the following transcript(s): T79260_PEA_1_T10 (SEQ ID NO:4347), T79260_PEA_1_T15 (SEQ ID NO:4348) and T79260_PEA_1_T27 (SEQ ID NO:4353). Table 6059 below describes the starting and ending position of this segment on each transcript.

TABLE 6059

Segment location on transcripts

| Transcript name | Segment starting position | Segment ending position |
|---|---|---|
| T79260_PEA_1_T10 (SEQ ID NO: 4347) | 2945 | 2965 |
| T79260_PEA_1_T15 (SEQ ID NO: 4348) | 2760 | 2780 |
| T79260_PEA_1_T27 (SEQ ID NO: 4353) | 1074 | 1094 |

This segment can be found in a non-coding region of transcript(s) that are related to the following protein(s): T79260_PEA_1_P10, T79260_PEA_1_P14 and T79260_PEA_1_P23.

Description for Cluster Z17844

Cluster Z17844 features 2 transcript(s) and 54 segment(s) of interest, the names for which are given in Tables 6060 and 6061, respectively, the sequences themselves are given at the end of the application. The selected protein variants are given in Table 6062.

TABLE 6060

Transcripts of interest
Transcript Name

Z17844_PEA_1_T5 (SEQ ID NO: 4354)
Z17844_PEA_1_T31 (SEQ ID NO: 4355)

TABLE 6061

Segments of interest
Segment Name

Z17844_PEA_1_node_11 (SEQ ID NO: 6419)
Z17844_PEA_1_node_13 (SEQ ID NO: 6420)

TABLE 6061-continued

Segments of interest
Segment Name

Z17844_PEA_1_node_16 (SEQ ID NO: 6421)
Z17844_PEA_1_node_33 (SEQ ID NO: 6422)
Z17844_PEA_1_node_35 (SEQ ID NO: 6423)
Z17844_PEA_1_node_59 (SEQ ID NO: 6424)
Z17844_PEA_1_node_83 (SEQ ID NO: 6425)
Z17844_PEA_1_node_0 (SEQ ID NO: 6426)
Z17844_PEA_1_node_7 (SEQ ID NO: 6427)
Z17844_PEA_1_node_8 (SEQ ID NO: 6428)
Z17844_PEA_1_node_20 (SEQ ID NO: 6429)
Z17844_PEA_1_node_23 (SEQ ID NO: 6430)
Z17844_PEA_1_node_24 (SEQ ID NO: 6431)
Z17844_PEA_1_node_25 (SEQ ID NO: 6432)
Z17844_PEA_1_node_29 (SEQ ID NO: 6433)
Z17844_PEA_1_node_30 (SEQ ID NO: 6434)
Z17844_PEA_1_node_31 (SEQ ID NO: 6435)
Z17844_PEA_1_node_32 (SEQ ID NO: 6436)
Z17844_PEA_1_node_34 (SEQ ID NO: 6437)
Z17844_PEA_1_node_38 (SEQ ID NO: 6438)
Z17844_PEA_1_node_39 (SEQ ID NO: 6439)
Z17844_PEA_1_node_40 (SEQ ID NO: 6440)
Z17844_PEA_1_node_43 (SEQ ID NO: 6441)
Z17844_PEA_1_node_44 (SEQ ID NO: 6442)
Z17844_PEA_1_node_45 (SEQ ID NO: 6443)
Z17844_PEA_1_node_46 (SEQ ID NO: 6444)
Z17844_PEA_1_node_47 (SEQ ID NO: 6445)
Z17844_PEA_1_node_48 (SEQ ID NO: 6446)
Z17844_PEA_1_node_49 (SEQ ID NO: 6447)
Z17844_PEA_1_node_50 (SEQ ID NO: 6448)
Z17844_PEA_1_node_51 (SEQ ID NO: 6449)
Z17844_PEA_1_node_52 (SEQ ID NO: 6450)
Z17844_PEA_1_node_53 (SEQ ID NO: 6451)
Z17844_PEA_1_node_54 (SEQ ID NO: 6452)
Z17844_PEA_1_node_55 (SEQ ID NO: 6453)
Z17844_PEA_1_node_56 (SEQ ID NO: 6454)
Z17844_PEA_1_node_60 (SEQ ID NO: 6455)
Z17844_PEA_1_node_61 (SEQ ID NO: 6456)
Z17844_PEA_1_node_62 (SEQ ID NO: 6457)
Z17844_PEA_1_node_63 (SEQ ID NO: 6458)
Z17844_PEA_1_node_65 (SEQ ID NO: 6459)
Z17844_PEA_1_node_66 (SEQ ID NO: 6460)
Z17844_PEA_1_node_69 (SEQ ID NO: 6461)
Z17844_PEA_1_node_70 (SEQ ID NO: 6462)
Z17844_PEA_1_node_71 (SEQ ID NO: 6463)
Z17844_PEA_1_node_72 (SEQ ID NO: 6464)
Z17844_PEA_1_node_73 (SEQ ID NO: 6465)
Z17844_PEA_1_node_74 (SEQ ID NO: 6466)
Z17844_PEA_1_node_75 (SEQ ID NO: 6467)
Z17844_PEA_1_node_76 (SEQ ID NO: 6468)
Z17844_PEA_1_node_79 (SEQ ID NO: 6469)
Z17844_PEA_1_node_80 (SEQ ID NO: 6470)
Z17844_PEA_1_node_81 (SEQ ID NO: 6471)
Z17844_PEA_1_node_82 (SEQ ID NO: 6472)

TABLE 6062

Proteins of interest

| Protein Name | Corresponding Transcript(s) |
|---|---|
| Z17844_PEA_1_P24 | Z17844_PEA_1_T31 (SEQ ID NO: 4355) |
| Z17844_PEA_1_P32 | Z17844_PEA_1_T5 (SEQ ID NO: 4354) |

These sequences are variants of the known protein Major vault protein (SwissProt accession identifier MVP_HUMAN; known also according to the synonyms MVP; Lung resistance-related protein), referred to herein as the previously known protein.

Protein Major vault protein is known or believed to have the following function(s): Unknown, though MVP is required for normal vault structure. Vaults are multi-subunit structures that may be involved in nucleo-cytoplasmic transport. The sequence for protein Major vault protein is given at the end of the application, as "Major vault protein amino acid sequence". Protein Major vault protein localization is believed to be CYTOPLASMIC, 5% ARE NUCLEUS ASSOCIATED AND LOCALIZE TO THE NUCLEAR PORE COMPLEXES.

The following GO Annotation(s) apply to the previously known protein. The following annotation(s) were found: nucleus; cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster Z17844 features 54 segment(s), which were listed in Table 6061 above and for which the sequence(s) are given at the end of the application. These segment(s) are portions of nucleic acid sequence(s) which are described herein separately because they are of particular interest. A description of each segment according to the present invention is now provided.

Segment cluster Z17844_PEA_1_node_11 (SEQ ID NO:6419) according to the present invention is supported by 163 libraries. The number of libraries was determined as previously described. This segment can be found in the following transcript(s): Z17844_PEA_1_T5 (SEQ ID NO:4354). Table 6063 below describes the starting and ending position of this segment on each transcript.

TABLE 6063

Segment location on transcripts

| Transcript name | Segment starting position | Segment ending position |
|---|---|---|
| Z17844_PEA_1_T5 (SEQ ID NO: 4354) | 265 | 460 |

This segment can be found in the following protein(s): Z17844_PEA_1_P32.

Segment cluster Z17844_PEA_1_node_13 (SEQ ID NO:6420) according to the present invention is supported by 126 libraries. The number of libraries was determined as previously described. This segment can be found in the following transcript(s): Z17844_PEA_1_T5 (SEQ ID NO:4354). Table 6064 below describes the starting and ending position of this segment on each transcript.

TABLE 6064

Segment location on transcripts

| Transcript name | Segment starting position | Segment ending position |
|---|---|---|
| Z17844_PEA_1_T5 (SEQ ID NO: 4354) | 461 | 584 |

This segment can be found in the following protein(s): Z17844_PEA_1_P32.

Segment cluster Z17844_PEA_1_node_16 (SEQ ID NO:6421) according to the present invention is supported by 121 libraries. The number of libraries was determined as previously described. This segment can be found in the following transcript(s): Z17844_PEA_1_T5 (SEQ ID NO:4354). Table 6065 below describes the starting and ending position of this segment on each transcript.

TABLE 6065

Segment location on transcripts

| Transcript name | Segment starting position | Segment ending position |
|---|---|---|
| Z17844_PEA_1_T5 (SEQ ID NO: 4354) | 585 | 716 |

This segment can be found in the following protein(s): Z17844_PEA_1_P32.

Segment cluster Z17844_PEA_1_node_33 (SEQ ID NO:6422) according to the present invention is supported by 8 libraries. The number of libraries was determined as previously described. This segment can be found in the following transcript(s): Z17844_PEA_1_T5 (SEQ ID NO:4354). Table 6066 below describes the starting and ending position of this segment on each transcript.

TABLE 6066

Segment location on transcripts

| Transcript name | Segment starting position | Segment ending position |
|---|---|---|
| Z17844_PEA_1_T5 (SEQ ID NO: 4354) | 1331 | 2466 |

This segment can be found in the following protein(s): Z17844_PEA_1_P32.

Segment cluster Z17844_PEA_1_node_35 (SEQ ID NO:6423) according to the present invention is supported by 124 libraries. The number of libraries was determined as previously described. This segment can be found in the following transcript(s): Z17844_PEA_1_T5 (SEQ ID NO:4354). Table 6067 below describes the starting and ending position of this segment on each transcript.

TABLE 6067

Segment location on transcripts

| Transcript name | Segment starting position | Segment ending position |
|---|---|---|
| Z17844_PEA_1_T5 (SEQ ID NO: 4354) | 2575 | 2711 |

This segment can be found in a non-coding region of transcript(s) that are related to the following protein(s): Z17844_PEA_1_P32.

Segment cluster Z17844_PEA_1_node_59 (SEQ ID NO:6424) according to the present invention is supported by 2 libraries. The number of libraries was determined as previously described. This segment can be found in the following transcript(s): Z17844_PEA_1_T31 (SEQ ID NO:4355). Table 6068 below describes the starting and ending position of this segment on each transcript.

TABLE 6068

Segment location on transcripts

| Transcript name | Segment starting position | Segment ending position |
|---|---|---|
| Z17844_PEA_1_T31 (SEQ ID NO: 4355) | 1 | 541 |

This segment can be found in the following protein(s): Z17844_PEA_1_P24.

Segment cluster Z17844_PEA_1_node_83 (SEQ ID NO:6425) according to the present invention is supported by 183 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6069 below describes the starting and ending position of this segment on each transcript.

TABLE 6069

Segment location on transcripts

| Transcript name | Segment starting position | Segment ending position |
|---|---|---|
| Z17844_PEA_1_T5 (SEQ ID NO: 4354) | 3858 | 4011 |
| Z17844_PEA_1_T31 (SEQ ID NO: 4355) | 1103 | 1256 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

According to an optional embodiment of the present invention, short segments related to the above cluster are also provided. These segments are up to about 120 bp in length, and so are included in a separate description.

Segment cluster Z17844_PEA_1_node_0 (SEQ ID NO:6426) according to the present invention is supported by 124 libraries. The number of libraries was determined as previously described. This segment can be found in the following transcript(s): Z17844_PEA_1_T5 (SEQ ID NO:4354). Table 6070 below describes the starting and ending position of this segment on each transcript.

TABLE 6070

Segment location on transcripts

| Transcript name | Segment starting position | Segment ending position |
|---|---|---|
| Z17844_PEA_1_T5 (SEQ ID NO: 4354) | 1 | 104 |

This segment can be found in a non-coding region of transcript(s) that are related to the following protein(s): Z17844_PEA_1_P32.

Segment cluster Z17844_PEA_1_node_7 (SEQ ID NO:6427) according to the present invention is supported by 152 libraries. The number of libraries was determined as previously described. This segment can be found in the following transcript(s): Z17844_PEA_1_T5 (SEQ ID NO:4354). Table 6071 below describes the starting and ending position of this segment on each transcript.

TABLE 6071

Segment location on transcripts

| Transcript name | Segment starting position | Segment ending position |
|---|---|---|
| Z17844_PEA_1_T5 (SEQ ID NO: 4354) | 105 | 170 |

This segment can be found in the following protein(s): Z17844_PEA_1_P32.

Segment cluster Z17844_PEA_1_node_8 (SEQ ID NO:6428) according to the present invention is supported by 161 libraries. The number of libraries was determined as previously described. This segment can be found in the following transcript(s): Z17844_PEA_1_T5 (SEQ ID NO:4354). Table 6072 below describes the starting and ending position of this segment on each transcript.

TABLE 6072

Segment location on transcripts

| Transcript name | Segment starting position | Segment ending position |
|---|---|---|
| Z17844_PEA_1_T5 (SEQ ID NO: 4354) | 171 | 264 |

This segment can be found in the following protein(s): Z17844_PEA_1_P32.

Segment cluster Z17844_PEA_1_node_20 (SEQ ID NO:6429) according to the present invention is supported by 100 libraries. The number of libraries was determined as previously described. This segment can be found in the following transcript(s): Z17844_PEA_1_T5 (SEQ ID NO:4354). Table 6073 below describes the starting and ending position of this segment on each transcript.

TABLE 6073

Segment location on transcripts

| Transcript name | Segment starting position | Segment ending position |
|---|---|---|
| Z17844_PEA_1_T5 (SEQ ID NO: 4354) | 717 | 811 |

This segment can be found in the following protein(s): Z17844_PEA_1_P32.

Segment cluster Z17844_PEA_1_node_23 (SEQ ID NO:6430) according to the present invention is supported by 90 libraries. The number of libraries was determined as previously described. This segment can be found in the following transcript(s): Z17844_PEA_1_T5 (SEQ ID NO:4354). Table 6074 below describes the starting and ending position of this segment on each transcript.

TABLE 6074

Segment location on transcripts

| Transcript name | Segment starting position | Segment ending position |
|---|---|---|
| Z17844_PEA_1_T5 (SEQ ID NO: 4354) | 812 | 882 |

This segment can be found in the following protein(s): Z17844_PEA_1_P32.

Segment cluster Z17844_PEA_1_node_24 (SEQ ID NO:6431) according to the present invention is supported by 86 libraries. The number of libraries was determined as previously described. This segment can be found in the following transcript(s): Z17844_PEA_1_T5 (SEQ ID NO:4354). Table 6075 below describes the starting and ending position of this segment on each transcript.

TABLE 6075

Segment location on transcripts

| Transcript name | Segment starting position | Segment ending position |
|---|---|---|
| Z17844_PEA_1_T5 (SEQ ID NO: 4354) | 883 | 985 |

This segment can be found in the following protein(s): Z17844_PEA_1_P32.

Segment cluster Z17844_PEA_1_node_25 (SEQ ID NO:6432) according to the present invention is supported by 78 libraries. The number of libraries was determined as previously described. This segment can be found in the following transcript(s): Z17844_PEA_1_T5 (SEQ ID NO:4354). Table 6076 below describes the starting and ending position of this segment on each transcript.

TABLE 6076

Segment location on transcripts

| Transcript name | Segment starting position | Segment ending position |
|---|---|---|
| Z17844_PEA_1_T5 (SEQ ID NO: 4354) | 986 | 1048 |

This segment can be found in the following protein(s): Z17844_PEA_1_P32.

Segment cluster Z17844_PEA_1_node_29 (SEQ ID NO:6433) according to the present invention is supported by 86 libraries. The number of libraries was determined as previously described. This segment can be found in the following transcript(s): Z17844_PEA_1_T5 (SEQ ID NO:4354). Table 6077 below describes the starting and ending position of this segment on each transcript.

TABLE 6077

Segment location on transcripts

| Transcript name | Segment starting position | Segment ending position |
|---|---|---|
| Z17844_PEA_1_T5 (SEQ ID NO: 4354) | 1049 | 1153 |

This segment can be found in the following protein(s): Z17844_PEA_1_P32.

Segment cluster Z17844_PEA_1_node_30 (SEQ ID NO:6434) according to the present invention is supported by 89 libraries. The number of libraries was determined as previously described. This segment can be found in the following transcript(s): Z17844_PEA_1_T5 (SEQ ID NO:4354). Table 6078 below describes the starting and ending position of this segment on each transcript.

TABLE 6078

Segment location on transcripts

| Transcript name | Segment starting position | Segment ending position |
|---|---|---|
| Z17844_PEA_1_T5 (SEQ ID NO: 4354) | 1154 | 1225 |

This segment can be found in the following protein(s): Z17844_PEA_1_P32.

Segment cluster Z17844_PEA_1_node_31 (SEQ ID NO:6435) according to the present invention can be found in the following transcript(s): Z17844_PEA_1_T5 (SEQ ID NO:4354). Table 6079 below describes the starting and ending position of this segment on each transcript.

TABLE 6079

Segment location on transcripts

| Transcript name | Segment starting position | Segment ending position |
|---|---|---|
| Z17844_PEA_1_T5 (SEQ ID NO: 4354) | 1226 | 1241 |

This segment can be found in the following protein(s): Z17844_PEA_1_P32.

Segment cluster Z17844_PEA_1_node_32 (SEQ ID NO:6436) according to the present invention is supported by 96 libraries. The number of libraries was determined as previously described. This segment can be found in the following transcript(s): Z17844_PEA_1_T5 (SEQ ID NO:4354). Table 6080 below describes the starting and ending position of this segment on each transcript.

TABLE 6080

Segment location on transcripts

| Transcript name | Segment starting position | Segment ending position |
|---|---|---|
| Z17844_PEA_1_T5 (SEQ ID NO: 4354) | 1242 | 1330 |

This segment can be found in the following protein(s): Z17844_PEA_1_P32.

Segment cluster Z17844_PEA_1_node_34 (SEQ ID NO:6437) according to the present invention is supported by 110 libraries. The number of libraries was determined as previously described. This segment can be found in the following transcript(s): Z17844_PEA_1_T5 (SEQ ID NO:4354). Table 6081 below describes the starting and ending position of this segment on each transcript.

TABLE 6081

Segment location on transcripts

| Transcript name | Segment starting position | Segment ending position |
|---|---|---|
| Z17844_PEA_1_T5 (SEQ ID NO: 4354) | 2467 | 2574 |

This segment can be found in a non-coding region of transcript(s) that are related to the following protein(s): Z17844_PEA_1_P32.

Segment cluster Z17844_PEA_1_node_38 (SEQ ID NO:6438) according to the present invention is supported by 124 libraries. The number of libraries was determined as previously described. This segment can be found in the following transcript(s): Z17844_PEA_1_T5 (SEQ ID NO:4354). Table 6082 below describes the starting and ending position of this segment on each transcript.

TABLE 6082

Segment location on transcripts

| Transcript name | Segment starting position | Segment ending position |
|---|---|---|
| Z17844_PEA_1_T5 (SEQ ID NO: 4354) | 2712 | 2816 |

This segment can be found in a non-coding region of transcript(s) that are related to the following protein(s): Z17844_PEA_1_P32.

Segment cluster Z17844_PEA_1_node_39 (SEQ ID NO:6439) according to the present invention is supported by 132 libraries. The number of libraries was determined as previously described. This segment can be found in the following transcript(s): Z17844_PEA_1_T5 (SEQ ID NO:4354). Table 6083 below describes the starting and ending position of this segment on each transcript.

TABLE 6083

Segment location on transcripts

| Transcript name | Segment starting position | Segment ending position |
|---|---|---|
| Z17844_PEA_1_T5 (SEQ ID NO: 4354) | 2817 | 2883 |

This segment can be found in a non-coding region of transcript(s) that are related to the following protein(s): Z17844_PEA_1_P32.

Segment cluster Z17844_PEA_1_node_40 (SEQ ID NO:6440) according to the present invention is supported by 118 libraries. The number of libraries was determined as previously described. This segment can be found in the following transcript(s): Z17844_PEA_1_T5 (SEQ ID NO:4354). Table 6084 below describes the starting and ending position of this segment on each transcript.

TABLE 6084

Segment location on transcripts

| Transcript name | Segment starting position | Segment ending position |
|---|---|---|
| Z17844_PEA_1_T5 (SEQ ID NO: 4354) | 2884 | 2909 |

This segment can be found in a non-coding region of transcript(s) that are related to the following protein(s): Z17844_PEA_1_P32.

Segment cluster Z17844_PEA_1_node_43 (SEQ ID NO:6441) according to the present invention is supported by 132 libraries. The number of libraries was determined as previously described. This segment can be found in the following transcript(s): Z17844_PEA_1_T5 (SEQ ID NO:4354). Table 6085 below describes the starting and ending position of this segment on each transcript.

TABLE 6085

Segment location on transcripts

| Transcript name | Segment starting position | Segment ending position |
|---|---|---|
| Z17844_PEA_1_T5 (SEQ ID NO: 4354) | 2910 | 2949 |

This segment can be found in a non-coding region of transcript(s) that are related to the following protein(s): Z17844_PEA_1_P32.

Segment cluster Z17844_PEA_1_node_44 (SEQ ID NO:6442) according to the present invention can be found in the following transcript(s): Z17844_PEA_1_T5 (SEQ ID NO:4354). Table 6086 below describes the starting and ending position of this segment on each transcript.

TABLE 6086

Segment location on transcripts

| Transcript name | Segment starting position | Segment ending position |
|---|---|---|
| Z17844_PEA_1_T5 (SEQ ID NO: 4354) | 2950 | 2955 |

This segment can be found in a non-coding region of transcript(s) that are related to the following protein(s): Z17844_PEA_1_P32.

Segment cluster Z17844_PEA_1_node_45 (SEQ ID NO:6443) according to the present invention is supported by 135 libraries. The number of libraries was determined as previously described. This segment can be found in the following transcript(s): Z17844_PEA_1_T5 (SEQ ID NO:4354). Table 6087 below describes the starting and ending position of this segment on each transcript.

TABLE 6087

Segment location on transcripts

| Transcript name | Segment starting position | Segment ending position |
|---|---|---|
| Z17844_PEA_1_T5 (SEQ ID NO: 4354) | 2956 | 2994 |

This segment can be found in a non-coding region of transcript(s) that are related to the following protein(s): Z17844_PEA_1_P32.

Segment cluster Z17844_PEA_1_node_46 (SEQ ID NO:6444) according to the present invention is supported by 152 libraries. The number of libraries was determined as previously described. This segment can be found in the following transcript(s): Z17844_PEA_1_T5 (SEQ ID NO:4354). Table 6088 below describes the starting and ending position of this segment on each transcript.

TABLE 6088

Segment location on transcripts

| Transcript name | Segment starting position | Segment ending position |
|---|---|---|
| Z17844_PEA_1_T5 (SEQ ID NO: 4354) | 2995 | 3079 |

This segment can be found in a non-coding region of transcript(s) that are related to the following protein(s): Z17844_PEA_1_P32.

Segment cluster Z17844_PEA_1_node_47 (SEQ ID NO:6445) according to the present invention can be found in the following transcript(s): Z17844_PEA_1_T5 (SEQ ID NO:4354). Table 6089 below describes the starting and ending position of this segment on each transcript.

TABLE 6089

Segment location on transcripts

| Transcript name | Segment starting position | Segment ending position |
|---|---|---|
| Z17844_PEA_1_T5 (SEQ ID NO: 4354) | 3080 | 3098 |

This segment can be found in a non-coding region of transcript(s) that are related to the following protein(s): Z17844_PEA_1_P32.

Segment cluster Z17844_PEA_1_node_48 (SEQ ID NO:6446) according to the present invention is supported by 145 libraries. The number of libraries was determined as previously described. This segment can be found in the following transcript(s): Z17844_PEA_1_T5 (SEQ ID NO:4354). Table 6090 below describes the starting and ending position of this segment on each transcript.

TABLE 6090

Segment location on transcripts

| Transcript name | Segment starting position | Segment ending position |
|---|---|---|
| Z17844_PEA_1_T5 (SEQ ID NO: 4354) | 3099 | 3150 |

This segment can be found in a non-coding region of transcript(s) that are related to the following protein(s): Z17844_PEA_1_P32.

Segment cluster Z17844_PEA_1_node_49 (SEQ ID NO:6447) according to the present invention can be found in the following transcript(s): Z17844_PEA_1_T5 (SEQ ID NO:4354). Table 6091 below describes the starting and ending position of this segment on each transcript.

TABLE 6091

Segment location on transcripts

| Transcript name | Segment starting position | Segment ending position |
|---|---|---|
| Z17844_PEA_1_T5 (SEQ ID NO: 4354) | 3151 | 3162 |

This segment can be found in a non-coding region of transcript(s) that are related to the following protein(s): Z17844_PEA_1_P32.

Segment cluster Z17844_PEA_1_node_50 (SEQ ID NO:6448) according to the present invention can be found in the following transcript(s): Z17844_PEA_1_T5 (SEQ ID NO:4354). Table 6092 below describes the starting and ending position of this segment on each transcript.

TABLE 6092

Segment location on transcripts

| Transcript name | Segment starting position | Segment ending position |
|---|---|---|
| Z17844_PEA_1_T5 (SEQ ID NO: 4354) | 3163 | 3170 |

This segment can be found in a non-coding region of transcript(s) that are related to the following protein(s): Z17844_PEA_1_P32.

Segment cluster Z17844_PEA_1_node_51 (SEQ ID NO:6449) according to the present invention is supported by 131 libraries. The number of libraries was determined as previously described. This segment can be found in the following transcript(s): Z17844_PEA_1_T5 (SEQ ID NO:4354). Table 6093 below describes the starting and ending position of this segment on each transcript.

TABLE 6093

Segment location on transcripts

| Transcript name | Segment starting position | Segment ending position |
|---|---|---|
| Z17844_PEA_1_T5 (SEQ ID NO: 4354) | 3171 | 3208 |

This segment can be found in a non-coding region of transcript(s) that are related to the following protein(s): Z17844_PEA_1_P32.

Segment cluster Z17844_PEA_1_node_52 (SEQ ID NO:6450) according to the present invention can be found in the following transcript(s): Z17844_PEA_1_T5 (SEQ ID NO:4354). Table 6094 below describes the starting and ending position of this segment on each transcript.

TABLE 6094

Segment location on transcripts

| Transcript name | Segment starting position | Segment ending position |
|---|---|---|
| Z17844_PEA_1_T5 (SEQ ID NO: 4354) | 3209 | 3226 |

This segment can be found in a non-coding region of transcript(s) that are related to the following protein(s): Z17844_PEA_1_P32.

Segment cluster Z17844_PEA_1_node_53 (SEQ ID NO:6451) according to the present invention can be found in the following transcript(s): Z17844_PEA_1_T5 (SEQ ID NO:4354). Table 6095 below describes the starting and ending position of this segment on each transcript.

TABLE 6095

Segment location on transcripts

| Transcript name | Segment starting position | Segment ending position |
|---|---|---|
| Z17844_PEA_1_T5 (SEQ ID NO: 4354) | 3227 | 3245 |

This segment can be found in a non-coding region of transcript(s) that are related to the following protein(s): Z17844_PEA_1_P32.

Segment cluster Z17844_PEA_1_node_54 (SEQ ID NO:6452) according to the present invention is supported by 141 libraries. The number of libraries was determined as previously described. This segment can be found in the following transcript(s): Z17844_PEA_1_T5 (SEQ ID NO:4354). Table 6096 below describes the starting and ending position of this segment on each transcript.

TABLE 6096

Segment location on transcripts

| Transcript name | Segment starting position | Segment ending position |
|---|---|---|
| Z17844_PEA_1_T5 (SEQ ID NO: 4354) | 3246 | 3275 |

This segment can be found in a non-coding region of transcript(s) that are related to the following protein(s): Z17844_PEA_1_P32.

Segment cluster Z17844_PEA_1_node_55 (SEQ ID NO:6453) according to the present invention can be found in the following transcript(s): Z17844_PEA_1_T5 (SEQ ID NO:4354). Table 6097 below describes the starting and ending position of this segment on each transcript.

TABLE 6097

Segment location on transcripts

| Transcript name | Segment starting position | Segment ending position |
|---|---|---|
| Z17844_PEA_1_T5 (SEQ ID NO: 4354) | 3276 | 3282 |

This segment can be found in a non-coding region of transcript(s) that are related to the following protein(s): Z17844_PEA_1_P32.

Segment cluster Z17844_PEA_1_node_56 (SEQ ID NO:6454) according to the present invention can be found in the following transcript(s): Z17844_PEA_1_T5 (SEQ ID NO:4354). Table 6098 below describes the starting and ending position of this segment on each transcript.

TABLE 6098

Segment location on transcripts

| Transcript name | Segment starting position | Segment ending position |
|---|---|---|
| Z17844_PEA_1_T5 (SEQ ID NO: 4354) | 3283 | 3296 |

This segment can be found in a non-coding region of transcript(s) that are related to the following protein(s): Z17844_PEA_1_P32.

Segment cluster Z17844_PEA_1_node_60 (SEQ ID NO:6455) according to the present invention is supported by 147 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6099 below describes the starting and ending position of this segment on each transcript.

TABLE 6099

Segment location on transcripts

| Transcript name | Segment starting position | Segment ending position |
|---|---|---|
| Z17844_PEA_1_T5 (SEQ ID NO: 4354) | 3297 | 3330 |
| Z17844_PEA_1_T31 (SEQ ID NO: 4355) | 542 | 575 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_61 (SEQ ID NO:6456) according to the present invention can be found in the following transcript(s): Z17844_PEA_1_T5 (SEQ ID NO:4354) and Z17844_PEA_1_T31 (SEQ ID NO:4355). Table 6100 below describes the starting and ending position of this segment on each transcript.

TABLE 6100

Segment location on transcripts

| Transcript name | Segment starting position | Segment ending position |
|---|---|---|
| Z17844_PEA_1_T5 (SEQ ID NO: 4354) | 3331 | 3354 |
| Z17844_PEA_1_T31 (SEQ ID NO: 4355) | 576 | 599 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_62 (SEQ ID NO:6457) according to the present invention is supported by 170 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6101 below describes the starting and ending position of this segment on each transcript.

TABLE 6101

Segment location on transcripts

| Transcript name | Segment starting position | Segment ending position |
|---|---|---|
| Z17844_PEA_1_T5 (SEQ ID NO: 4354) | 3355 | 3399 |
| Z17844_PEA_1_T31 (SEQ ID NO: 4355) | 600 | 644 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_63 (SEQ ID NO:6458) according to the present invention can be found in the following transcript(s): Z17844_PEA_1_T5 (SEQ ID NO:4354) and Z17844_PEA_1_T31 (SEQ ID NO:4355). Table 6102 below describes the starting and ending position of this segment on each transcript.

TABLE 6102

Segment location on transcripts

| Transcript name | Segment starting position | Segment ending position |
|---|---|---|
| Z17844_PEA_1_T5 (SEQ ID NO: 4354) | 3400 | 3413 |
| Z17844_PEA_1_T31 (SEQ ID NO: 4355) | 645 | 658 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_65 (SEQ ID NO:6459) according to the present invention can be found in the following transcript(s): Z17844_PEA_1_T5 (SEQ ID NO:4354) and Z17844_PEA_1_T31 (SEQ ID NO:4355). Table 6103 below describes the starting and ending position of this segment on each transcript.

TABLE 6103

Segment location on transcripts

| Transcript name | Segment starting position | Segment ending position |
|---|---|---|
| Z17844_PEA_1_T5 (SEQ ID NO: 4354) | 3414 | 3437 |
| Z17844_PEA_1_T31 (SEQ ID NO: 4355) | 659 | 682 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_66 (SEQ ID NO:6460) according to the present invention is supported by 202 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6104 below describes the starting and ending position of this segment on each transcript.

TABLE 6104

Segment location on transcripts

| Transcript name | Segment starting position | Segment ending position |
|---|---|---|
| Z17844_PEA_1_T5 (SEQ ID NO: 4354) | 3438 | 3540 |
| Z17844_PEA_1_T31 (SEQ ID NO: 4355) | 683 | 785 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_69 (SEQ ID NO:6461) according to the present invention is supported by 193 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6105 below describes the starting and ending position of this segment on each transcript.

TABLE 6105

Segment location on transcripts

| Transcript name | Segment starting position | Segment ending position |
|---|---|---|
| Z17844_PEA_1_T5 (SEQ ID NO: 4354) | 3541 | 3576 |
| Z17844_PEA_1_T31 (SEQ ID NO: 4355) | 786 | 821 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_70 (SEQ ID NO:6462) according to the present invention can be found in the following transcript(s): Z17844_PEA_1_T5 (SEQ ID NO:4354) and Z17844_PEA_1_T31 (SEQ ID NO:4355). Table 6106 below describes the starting and ending position of this segment on each transcript.

TABLE 6106

Segment location on transcripts

| Transcript name | Segment starting position | Segment ending position |
|---|---|---|
| Z17844_PEA_1_T5 (SEQ ID NO: 4354) | 3577 | 3592 |
| Z17844_PEA_1_T31 (SEQ ID NO: 4355) | 822 | 837 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_71 (SEQ ID NO:6463) according to the present invention can be found in the following transcript(s): Z17844_PEA_1_T5 (SEQ ID NO:4354) and Z17844_PEA_1_T31 (SEQ ID NO:4355). Table 6107 below describes the starting and ending position of this segment on each transcript.

TABLE 6107

Segment location on transcripts

| Transcript name | Segment starting position | Segment ending position |
|---|---|---|
| Z17844_PEA_1_T5 (SEQ ID NO: 4354) | 3593 | 3615 |
| Z17844_PEA_1_T31 (SEQ ID NO: 4355) | 838 | 860 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_72 (SEQ ID NO:6464) according to the present invention can be found in the following transcript(s): Z17844_PEA_1_T5 (SEQ ID NO:4354) and Z17844_PEA_1_T31 (SEQ ID NO:4355). Table 6108 below describes the starting and ending position of this segment on each transcript.

TABLE 6108

Segment location on transcripts

| Transcript name | Segment starting position | Segment ending position |
|---|---|---|
| Z17844_PEA_1_T5 (SEQ ID NO: 4354) | 3616 | 3633 |
| Z17844_PEA_1_T31 (SEQ ID NO: 4355) | 861 | 878 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_73 (SEQ ID NO:6465) according to the present invention can be found in the following transcript(s): Z17844_PEA_1_T5 (SEQ ID NO:4354) and Z17844_PEA_1_T31 (SEQ ID NO:4355). Table 6109 below describes the starting and ending position of this segment on each transcript.

TABLE 6109

Segment location on transcripts

| Transcript name | Segment starting position | Segment ending position |
|---|---|---|
| Z17844_PEA_1_T5 (SEQ ID NO: 4354) | 3634 | 3648 |
| Z17844_PEA_1_T31 (SEQ ID NO: 4355) | 879 | 893 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_74 (SEQ ID NO:6466) according to the present invention is supported by 195 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6110 below describes the starting and ending position of this segment on each transcript.

TABLE 6110

Segment location on transcripts

| Transcript name | Segment starting position | Segment ending position |
|---|---|---|
| Z17844_PEA_1_T5 (SEQ ID NO: 4354) | 3649 | 3675 |
| Z17844_PEA_1_T31 (SEQ ID NO: 4355) | 894 | 920 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_75 (SEQ ID NO:6467) according to the present invention can be found in the following transcript(s): Z17844_PEA_1_T5 (SEQ ID NO:4354) and Z17844_PEA_1_T31 (SEQ ID NO:4355). Table 6111 below describes the starting and ending position of this segment on each transcript.

TABLE 6111

| | Segment location on transcripts | |
|---|---|---|
| Transcript name | Segment starting position | Segment ending position |
| Z17844_PEA_1_T5 (SEQ ID NO: 4354) | 3676 | 3686 |
| Z17844_PEA_1_T31 (SEQ ID NO: 4355) | 921 | 931 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_76 (SEQ ID NO:6468) according to the present invention is supported by 194 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6112 below describes the starting and ending position of this segment on each transcript.

TABLE 6112

| | Segment location on transcripts | |
|---|---|---|
| Transcript name | Segment starting position | Segment ending position |
| Z17844_PEA_1_T5 (SEQ ID NO: 4354) | 3687 | 3729 |
| Z17844_PEA_1_T31 (SEQ ID NO: 4355) | 932 | 974 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_79 (SEQ ID NO:6469) according to the present invention can be found in the following transcript(s): Z17844_PEA_1_T5 (SEQ ID NO:4354) and Z17844_PEA_1_T31 (SEQ ID NO:4355). Table 6113 below describes the starting and ending position of this segment on each transcript.

TABLE 6113

| | Segment location on transcripts | |
|---|---|---|
| Transcript name | Segment starting position | Segment ending position |
| Z17844_PEA_1_T5 (SEQ ID NO: 4354) | 3730 | 3739 |
| Z17844_PEA_1_T31 (SEQ ID NO: 4355) | 975 | 984 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_80 (SEQ ID NO:6470) according to the present invention can be found in the following transcript(s): Z17844_PEA_1_T5 (SEQ ID NO:4354) and Z17844_PEA_1_T31 (SEQ ID NO:4355). Table 6114 below describes the starting and ending position of this segment on each transcript.

TABLE 6114

| | Segment location on transcripts | |
|---|---|---|
| Transcript name | Segment starting position | Segment ending position |
| Z17844_PEA_1_T5 (SEQ ID NO: 4354) | 3740 | 3744 |
| Z17844_PEA_1_T31 (SEQ ID NO: 4355) | 985 | 989 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_81 (SEQ ID NO:6471) according to the present invention is supported by 211 libraries. The number of libraries was determined as previously described. This segment can be found in the following transcript(s): Z17844_PEA_1_T5 (SEQ ID NO:4354) and Z17844_PEA_1_T31 (SEQ ID NO:4355). Table 6115 below describes the starting and ending position of this segment on each transcript.

TABLE 6115

| | Segment location on transcripts | |
|---|---|---|
| Transcript name | Segment starting position | Segment ending position |
| Z17844_PEA_1_T5 (SEQ ID NO: 4354) | 3745 | 3846 |
| Z17844_PEA_1_T31 (SEQ ID NO: 4355) | 990 | 1091 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Segment cluster Z17844_PEA_1_node_82 (SEQ ID NO:6472) according to the present invention can be found in the following transcript(s): Z17844_PEA_1_T5 (SEQ ID NO:4354) and Z17844_PEA_1_T31 (SEQ ID NO:4355). Table 6116 below describes the starting and ending position of this segment on each transcript.

TABLE 6116

Segment location on transcripts

| Transcript name | Segment starting position | Segment ending position |
|---|---|---|
| Z17844_PEA_1_T5 (SEQ ID NO: 4354) | 3847 | 3857 |
| Z17844_PEA_1_T31 (SEQ ID NO: 4355) | 1092 | 1102 |

This segment can be found in both coding and non-coding regions of transcript(s) as follows. The segment can be found in a non-coding region of transcript(s) that are related to the following protein(s): Z17844_PEA_1_P32. This segment can also be found in the following protein(s): Z17844_PEA_1_P24, since it is in the coding region for the corresponding transcript.

Description for Cluster Z18303

Cluster Z18303 features 6 transcript(s) and 46 segment(s) of interest, the names for which are given in Tables 6117 and 6118, respectively, the sequences themselves are given at the end of the application. The selected protein variants are given in Table 6119.

TABLE 6117

Transcripts of interest
Transcript Name

Z18303_PEA_1_T2 (SEQ ID NO: 4356)
Z18303_PEA_1_T8 (SEQ ID NO: 4357)
Z18303_PEA_1_T10 (SEQ ID NO: 4358)
Z18303_PEA_1_T12 (SEQ ID NO: 4359)
Z18303_PEA_1_T24 (SEQ ID NO: 4360)
Z18303_PEA_1_T39 (SEQ ID NO: 4361)

TABLE 6118

Segments of interest
Segment Name

Z18303_PEA_1_node_3 (SEQ ID NO: 6473)
Z18303_PEA_1_node_10 (SEQ ID NO: 6474)
Z18303_PEA_1_node_29 (SEQ ID NO: 6475)
Z18303_PEA_1_node_30 (SEQ ID NO: 6476)
Z18303_PEA_1_node_31 (SEQ ID NO: 6477)
Z18303_PEA_1_node_33 (SEQ ID NO: 6478)
Z18303_PEA_1_node_34 (SEQ ID NO: 6479)
Z18303_PEA_1_node_39 (SEQ ID NO: 6480)
Z18303_PEA_1_node_49 (SEQ ID NO: 6481)
Z18303_PEA_1_node_58 (SEQ ID NO: 6482)
Z18303_PEA_1_node_66 (SEQ ID NO: 6483)
Z18303_PEA_1_node_67 (SEQ ID NO: 6484)
Z18303_PEA_1_node_73 (SEQ ID NO: 6485)
Z18303_PEA_1_node_77 (SEQ ID NO: 6486)
Z18303_PEA_1_node_80 (SEQ ID NO: 6487)
Z18303_PEA_1_node_86 (SEQ ID NO: 6488)
Z18303_PEA_1_node_89 (SEQ ID NO: 6489)
Z18303_PEA_1_node_95 (SEQ ID NO: 6490)
Z18303_PEA_1_node_99 (SEQ ID NO: 6491)
Z18303_PEA_1_node_102 (SEQ ID NO: 6492)
Z18303_PEA_1_node_104 (SEQ ID NO: 6493)
Z18303_PEA_1_node_107 (SEQ ID NO: 6494)
Z18303_PEA_1_node_0 (SEQ ID NO: 6495)
Z18303_PEA_1_node_1 (SEQ ID NO: 6496)
Z18303_PEA_1_node_6 (SEQ ID NO: 6497)
Z18303_PEA_1_node_8 (SEQ ID NO: 6498)
Z18303_PEA_1_node_13 (SEQ ID NO: 6499)
Z18303_PEA_1_node_16 (SEQ ID NO: 6500)

TABLE 6118-continued

Segments of interest
Segment Name

Z18303_PEA_1_node_18 (SEQ ID NO: 6501)
Z18303_PEA_1_node_22 (SEQ ID NO: 6502)
Z18303_PEA_1_node_27 (SEQ ID NO: 6503)
Z18303_PEA_1_node_28 (SEQ ID NO: 6504)
Z18303_PEA_1_node_35 (SEQ ID NO: 6505)
Z18303_PEA_1_node_36 (SEQ ID NO: 6506)
Z18303_PEA_1_node_42 (SEQ ID NO: 6507)
Z18303_PEA_1_node_45 (SEQ ID NO: 6508)
Z18303_PEA_1_node_46 (SEQ ID NO: 6509)
Z18303_PEA_1_node_52 (SEQ ID NO: 6510)
Z18303_PEA_1_node_54 (SEQ ID NO: 6511)
Z18303_PEA_1_node_62 (SEQ ID NO: 6512)
Z18303_PEA_1_node_63 (SEQ ID NO: 6513)
Z18303_PEA_1_node_65 (SEQ ID NO: 6514)
Z18303_PEA_1_node_71 (SEQ ID NO: 6515)
Z18303_PEA_1_node_82 (SEQ ID NO: 6516)
Z18303_PEA_1_node_103 (SEQ ID NO: 6517)
Z18303_PEA_1_node_105 (SEQ ID NO: 6518)

TABLE 6119

Proteins of interest

| Protein Name | Corresponding Transcript(s) |
|---|---|
| Z18303_PEA_1_P3 | Z18303_PEA_1_T2 (SEQ ID NO: 4356) |
| Z18303_PEA_1_P8 | Z18303_PEA_1_T8 (SEQ ID NO: 4357) |
| Z18303_PEA_1_P10 | Z18303_PEA_1_T10 (SEQ ID NO: 4358) |
| Z18303_PEA_1_P12 | Z18303_PEA_1_T12 (SEQ ID NO: 4359) |
| Z18303_PEA_1_P20 | Z18303_PEA_1_T24 (SEQ ID NO: 4360) |
| Z18303_PEA_1_P35 | Z18303_PEA_1_T39 (SEQ ID NO: 4361) |

These sequences are variants of the known protein Myosin-binding protein C, cardiac-type (SwissProt accession identifier MYPC_HUMAN; known also according to the synonyms Cardiac MyBP-C; C-protein, cardiac muscle isoform), referred to herein as the previously known protein.

Protein Myosin-binding protein C, cardiac-type is known or believed to have the following function(s): Thick filament-associated protein located in the crossbridge region of vertebrate striated muscle a bands. In vitro it binds MHC, F-actin and native thin filaments, and modifies the activity of actin-active myosin ATPase. It may modulate muscle contraction or may play a more structural role. The sequence for protein Myosin-binding protein C, cardiac-type is given at the end of the application, as "Myosin-binding protein C, cardiac-type amino acid sequence". Known polymorphisms for this sequence are as shown in Table 6120.

TABLE 6120

Amino acid mutations for Known Protein

| SNP position(s) on amino acid sequence | Comment |
|---|---|
| 542 | E -> Q (in CMH4). /FTId = VAR_003917. |
| 654 | R -> H (in CMH4; dbSNP:1800565). /FTId = VAR_003918. |
| 755 | N -> K (in CMH4). /FTId = VAR_003919. |
| 536 | R -> A |

The following GO Annotation(s) apply to the previously known protein. The following annotation(s) were found: muscle contraction; striated muscle contraction regulation; cell adhesion; muscle development, which are annotation(s) related to Biological Process; actin binding; protein binding;

structural protein of muscle, which are annotation(s) related to Molecular Function; and muscle thick filament; actin cytoskeleton, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster Z18303. Predictions were made for selective expression of transcripts of this contig in heart tissue, according to the previously described methods. The numbers on the y-axis of FIG. 143 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 143, concerning the number of heart-specific clones in libraries/sequences; as well as with regard to the histogram in FIG. 144, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 27.2; the ratio of expression of the cluster in heart specific ESTs to the overall expression of the cluster in muscle-specific ESTs which was found to be 58.7; and fisher exact test P-values were computed both for library and weighted clone counts to check that the counts are statistically significant, and were found to be 1.30E-61.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 27.2, which clearly supports specific expression in heart tissue.

As noted above, cluster Z18303 features 46 segment(s), which were listed in Table 6118 above and for which the sequence(s) are given at the end of the application. These segment(s) are portions of nucleic acid sequence(s) which are described herein separately because they are of particular interest. A description of each segment according to the present invention is now provided.

Segment cluster Z18303_PEA_1_node_3 (SEQ ID NO:6473) according to the present invention is supported by 11 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6121 below describes the starting and ending position of this segment on each transcript.

TABLE 6121

Segment location on transcripts

| Transcript name | Segment starting position | Segment ending position |
|---|---|---|
| Z18303_PEA_1_T2 (SEQ ID NO: 4356) | 81 | 347 |
| Z18303_PEA_1_T10 (SEQ ID NO: 4358) | 81 | 347 |
| Z18303_PEA_1_T12 (SEQ ID NO: 4359) | 81 | 347 |
| Z18303_PEA_1_T39 (SEQ ID NO: 4361) | 81 | 347 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_10 (SEQ ID NO:6474) according to the present invention is supported by 8 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6122 below describes the starting and ending position of this segment on each transcript.

TABLE 6122

Segment location on transcripts

| Transcript name | Segment starting position | Segment ending position |
|---|---|---|
| Z18303_PEA_1_T2 (SEQ ID NO: 4356) | 561 | 709 |
| Z18303_PEA_1_T10 (SEQ ID NO: 4358) | 561 | 709 |
| Z18303_PEA_1_T12 (SEQ ID NO: 4359) | 561 | 709 |
| Z18303_PEA_1_T39 (SEQ ID NO: 4361) | 561 | 709 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_29 (SEQ ID NO:6475) according to the present invention is supported by 3 libraries. The number of libraries was determined as previously described. This segment can be found in the following transcript(s): Z18303_PEA_1_T2 (SEQ ID NO:4356) and Z18303_PEA_1_T39 (SEQ ID NO:4361). Table 6123 below describes the starting and ending position of this segment on each transcript.

TABLE 6123

Segment location on transcripts

| Transcript name | Segment starting position | Segment ending position |
|---|---|---|
| Z18303_PEA_1_T2 (SEQ ID NO: 4356) | 982 | 1237 |
| Z18303_PEA_1_T39 (SEQ ID NO: 4361) | 982 | 1237 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P35, since it is in the coding region for the corresponding transcript.

Segment cluster Z18303_PEA_1_node_30 (SEQ ID NO:6476) according to the present invention is supported by 11 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6124 below describes the starting and ending position of this segment on each transcript.

TABLE 6124

Segment location on transcripts

| Transcript name | Segment starting position | Segment ending position |
|---|---|---|
| Z18303_PEA_1_T2 (SEQ ID NO: 4356) | 1238 | 1401 |
| Z18303_PEA_1_T10 (SEQ ID NO: 4358) | 982 | 1145 |
| Z18303_PEA_1_T12 (SEQ ID NO: 4359) | 982 | 1145 |
| Z18303_PEA_1_T39 (SEQ ID NO: 4361) | 1238 | 1401 |

This segment can be found in both coding and non-coding regions of transcript(s) as follows. The segment can be found in a non-coding region of transcript(s) that are related to the following protein(s): Z18303_PEA_1_P35. This segment can also be found in the following protein(s): Z18303_PEA_1_P3, Z18303_PEA_1_P10 and Z18303_PEA_1_P12, since it is in the coding region for the corresponding transcript.

Segment cluster Z18303_PEA_1_node_31 (SEQ ID NO:6477) according to the present invention is supported by 14 libraries. The number of libraries was determined as previously described. This segment can be found in the following transcript(s): Z18303_PEA_1_T39 (SEQ ID NO:4361). Table 6125 below describes the starting and ending position of this segment on each transcript.

TABLE 6125

Segment location on transcripts

| Transcript name | Segment starting position | Segment ending position |
|---|---|---|
| Z18303_PEA_1_T39 (SEQ ID NO: 4361) | 1402 | 3545 |

This segment can be found in a non-coding region of transcript(s) that are related to the following protein(s): Z18303_PEA_1_P35.

Segment cluster Z18303_PEA_1_node_33 (SEQ ID NO:6478) according to the present invention is supported by 3 libraries. The number of libraries was determined as previously described. This segment can be found in the following transcript(s): Z18303_PEA_1_T8 (SEQ ID NO:4357). Table 6126 below describes the starting and ending position of this segment on each transcript.

TABLE 6126

Segment location on transcripts

| Transcript name | Segment starting position | Segment ending position |
|---|---|---|
| Z18303_PEA_1_T8 (SEQ ID NO: 4357) | 1 | 306 |

This segment can be found in a non-coding region of transcript(s) that are related to the following protein(s): Z18303_PEA_1_P8.

Segment cluster Z18303_PEA_1_node_34 (SEQ ID NO:6479) according to the present invention is supported by 6 libraries. The number of libraries was determined as previously described. This segment can be found in the following transcript(s): Z18303_PEA_1_T8 (SEQ ID NO:4357). Table 6127 below describes the starting and ending position of this segment on each transcript.

TABLE 6127

Segment location on transcripts

| Transcript name | Segment starting position | Segment ending position |
|---|---|---|
| Z18303_PEA_1_T8 (SEQ ID NO: 4357) | 307 | 433 |

This segment can be found in a non-coding region of transcript(s) that are related to the following protein(s): Z18303_PEA_1_P8.

Segment cluster Z18303_PEA_1_node_39 (SEQ ID NO:6480) according to the present invention is supported by 17 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6128 below describes the starting and ending position of this segment on each transcript.

TABLE 6128

Segment location on transcripts

| Transcript name | Segment starting position | Segment ending position |
|---|---|---|
| Z18303_PEA_1_T2 (SEQ ID NO: 4356) | 1535 | 1662 |
| Z18303_PEA_1_T8 (SEQ ID NO: 4357) | 567 | 694 |
| Z18303_PEA_1_T10 (SEQ ID NO: 4358) | 1279 | 1406 |
| Z18303_PEA_1_T12 (SEQ ID NO: 4359) | 1279 | 1406 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_49 (SEQ ID NO:6481) according to the present invention is supported by 16 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6129 below describes the starting and ending position of this segment on each transcript.

TABLE 6129

Segment location on transcripts

| Transcript name | Segment starting position | Segment ending position |
|---|---|---|
| Z18303_PEA_1_T2 (SEQ ID NO: 4356) | 1936 | 2101 |
| Z18303_PEA_1_T8 (SEQ ID NO: 4357) | 968 | 1133 |
| Z18303_PEA_1_T10 (SEQ ID NO: 4358) | 1680 | 1845 |
| Z18303_PEA_1_T12 (SEQ ID NO: 4359) | 1680 | 1845 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_58 (SEQ ID NO:6482) according to the present invention is supported by 21 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6130 below describes the starting and ending position of this segment on each transcript.

TABLE 6130

Segment location on transcripts

| Transcript name | Segment starting position | Segment ending position |
|---|---|---|
| Z18303_PEA_1_T2 (SEQ ID NO: 4356) | 2239 | 2378 |
| Z18303_PEA_1_T8 (SEQ ID NO: 4357) | 1271 | 1410 |
| Z18303_PEA_1_T10 (SEQ ID NO: 4358) | 1983 | 2122 |
| Z18303_PEA_1_T12 (SEQ ID NO: 4359) | 1983 | 2122 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_66 (SEQ ID NO:6483) according to the present invention is supported by 20 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_L_T24 (SEQ ID NO:4360). Table 6131 below describes the starting and ending position of this segment on each transcript.

TABLE 6131

Segment location on transcripts

| Transcript name | Segment starting position | Segment ending position |
|---|---|---|
| Z18303_PEA_1_T2 (SEQ ID NO: 4356) | 2460 | 2619 |
| Z18303_PEA_1_T8 (SEQ ID NO: 4357) | 1492 | 1651 |
| Z18303_PEA_1_T10 (SEQ ID NO: 4358) | 2204 | 2363 |
| Z18303_PEA_1_T12 (SEQ ID NO: 4359) | 2204 | 2363 |
| Z18303_PEA_1_T24 (SEQ ID NO: 4360) | 38 | 197 |

This segment can be found in both coding and non-coding regions of transcript(s) as follows. The segment can be found in a non-coding region of transcript(s) that are related to the following protein(s): Z18303_PEA_1_P20. This segment can also be found in the following protein(s): Z18303_PEA_1_P3, Z18303_PEA_1_P8, Z18303_PEA_1_P10 and Z18303_PEA_1_P12, since it is in the coding region for the corresponding transcript.

Segment cluster Z18303_PEA_1_node_67 (SEQ ID NO:6484) according to the present invention is supported by 6 libraries. The number of libraries was determined as previously described. This segment can be found in the following transcript(s): Z18303_PEA_1_T10 (SEQ ID NO:4358) and Z18303_PEA_1_T24 (SEQ ID NO:4360). Table 6132 below describes the starting and ending position of this segment on each transcript.

TABLE 6132

Segment location on transcripts

| Transcript name | Segment starting position | Segment ending position |
|---|---|---|
| Z18303_PEA_1_T10 (SEQ ID NO: 4358) | 2364 | 2661 |
| Z18303_PEA_1_T24 (SEQ ID NO: 4360) | 198 | 495 |

This segment can be found in both coding and non-coding regions of transcript(s) as follows. The segment can be found in a non-coding region of transcript(s) that are related to the following protein(s): Z18303_PEA_1_P20. This segment can also be found in the following protein(s): Z18303_PEA_1_P10, since it is in the coding region for the corresponding transcript.

Segment cluster Z18303_PEA_1_node_73 (SEQ ID NO:6485) according to the present invention is supported by 26 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6133 below describes the starting and ending position of this segment on each transcript.

TABLE 6133

Segment location on transcripts

| Transcript name | Segment starting position | Segment ending position |
|---|---|---|
| Z18303_PEA_1_T2 (SEQ ID NO: 4356) | 2725 | 2913 |
| Z18303_PEA_1_T8 (SEQ ID NO: 4357) | 1757 | 1945 |
| Z18303_PEA_1_T10 (SEQ ID NO: 4358) | 2767 | 2955 |
| Z18303_PEA_1_T12 (SEQ ID NO: 4359) | 2469 | 2657 |
| Z18303_PEA_1_T24 (SEQ ID NO: 4360) | 601 | 789 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_77 (SEQ ID NO:6486) according to the present invention is supported by 28 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6134 below describes the starting and ending position of this segment on each transcript.

TABLE 6134

Segment location on transcripts

| Transcript name | Segment starting position | Segment ending position |
|---|---|---|
| Z18303_PEA_1_T2 (SEQ ID NO: 4356) | 2914 | 3048 |
| Z18303_PEA_1_T8 (SEQ ID NO: 4357) | 1946 | 2080 |
| Z18303_PEA_1_T10 (SEQ ID NO: 4358) | 2956 | 3090 |
| Z18303_PEA_1_T12 (SEQ ID NO: 4359) | 2658 | 2792 |
| Z18303_PEA_1_T24 (SEQ ID NO: 4360) | 790 | 924 |

This segment can be found in both coding and non-coding regions of transcript(s) as follows. The segment can be found in a non-coding region of transcript(s) that are related to the following protein(s): Z18303_PEA_1_P10. This segment can also be found in the following 20 protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_80 (SEQ ID NO:6487) according to the present invention is supported by 32 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6135 below describes the starting and ending position of this segment on each transcript.

TABLE 6135

Segment location on transcripts

| Transcript name | Segment starting position | Segment ending position |
|---|---|---|
| Z18303_PEA_1_T2 (SEQ ID NO: 4356) | 3049 | 3216 |
| Z18303_PEA_1_T8 (SEQ ID NO: 4357) | 2081 | 2248 |
| Z18303_PEA_1_T10 (SEQ ID NO: 4358) | 3091 | 3258 |
| Z18303_PEA_1_T12 (SEQ ID NO: 4359) | 2793 | 2960 |
| Z18303_PEA_1_T24 (SEQ ID NO: 4360) | 925 | 1092 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_86 (SEQ ID NO:6488) according to the present invention is supported by 35 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6136 below describes the starting and ending position of this segment on each transcript.

TABLE 6136

Segment location on transcripts

| Transcript name | Segment starting position | Segment ending position |
|---|---|---|
| Z18303_PEA_1_T2 (SEQ ID NO: 4356) | 3306 | 3501 |
| Z18303_PEA_1_T8 (SEQ ID NO: 4357) | 2338 | 2533 |
| Z18303_PEA_1_T10 (SEQ ID NO: 4358) | 3348 | 3543 |
| Z18303_PEA_1_T12 (SEQ ID NO: 4359) | 3050 | 3245 |

TABLE 6136-continued

Segment location on transcripts

| Transcript name | Segment starting position | Segment ending position |
|---|---|---|
| Z18303_PEA_1_T24 (SEQ ID NO: 4360) | 1182 | 1377 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_89 (SEQ ID NO:6489) according to the present invention is supported by 31 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6137 below describes the starting and ending position of this segment on each transcript.

TABLE 6137

Segment location on transcripts

| Transcript name | Segment starting position | Segment ending position |
|---|---|---|
| Z18303_PEA_1_T2 (SEQ ID NO: 4356) | 3502 | 3641 |
| Z18303_PEA_1_T8 (SEQ ID NO: 4357) | 2534 | 2673 |
| Z18303_PEA_1_T10 (SEQ ID NO: 4358) | 3544 | 3683 |
| Z18303_PEA_1_T12 (SEQ ID NO: 4359) | 3246 | 3385 |
| Z18303_PEA_1_T24 (SEQ ID NO: 4360) | 1378 | 1517 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_95 (SEQ ID NO:6490) according to the present invention is supported by 35 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359)and Z18303_PEA_1_T24 (SEQ ID NO:4360). Table 6138 below describes the starting and ending position of this segment on each transcript.

TABLE 6138

Segment location on transcripts

| Transcript name | Segment starting position | Segment ending position |
|---|---|---|
| Z18303_PEA_1_T2 (SEQ ID NO: 4356) | 3642 | 3801 |
| Z18303_PEA_1_T8 (SEQ ID NO: 4357) | 2674 | 2833 |
| Z18303_PEA_1_T10 (SEQ ID NO: 4358) | 3684 | 3843 |
| Z18303_PEA_1_T12 (SEQ ID NO: 4359) | 3386 | 3545 |
| Z18303_PEA_1_T24 (SEQ ID NO: 4360) | 1518 | 1677 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_99 (SEQ ID NO:6491) according to the present invention is supported by 32 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6139 below describes the starting and ending position of this segment on each transcript.

TABLE 6139

Segment location on transcripts

| Transcript name | Segment starting position | Segment ending position |
|---|---|---|
| Z18303_PEA_1_T2 (SEQ ID NO: 4356) | 3802 | 3938 |
| Z18303_PEA_1_T8 (SEQ ID NO: 4357) | 2834 | 2970 |
| Z18303_PEA_1_T10 (SEQ ID NO: 4358) | 3844 | 3980 |
| Z18303_PEA_1_T12 (SEQ ID NO: 4359) | 3546 | 3682 |
| Z18303_PEA_1_T24 (SEQ ID NO: 4360) | 1678 | 1814 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_102 (SEQ ID NO:6492) according to the present invention is supported by 35 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360).

Table 6140 below describes the starting and ending position of this segment on each transcript.

TABLE 6140

Segment location on transcripts

| Transcript name | Segment starting position | Segment ending position |
|---|---|---|
| Z18303_PEA_1_T2 (SEQ ID NO: 4356) | 3939 | 4072 |
| Z18303_PEA_1_T8 (SEQ ID NO: 4357) | 2971 | 3104 |
| Z18303_PEA_1_T10 (SEQ ID NO: 4358) | 3981 | 4114 |
| Z18303_PEA_1_T12 (SEQ ID NO: 4359) | 3683 | 3816 |
| Z18303_PEA_1_T24 (SEQ ID NO: 4360) | 1815 | 1948 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_104 (SEQ ID NO:6493) according to the present invention is supported by 7 libraries. The number of libraries was determined as previously described. This segment can be found in the following transcript(s): Z18303_PEA_1_T12 (SEQ ID NO:4359). Table 6141 below describes the starting and ending position of this segment on each transcript.

TABLE 6141

Segment location on transcripts

| Transcript name | Segment starting position | Segment ending position |
|---|---|---|
| Z18303_PEA_1_T12 (SEQ ID NO: 4359) | 3870 | 4059 |

This segment can be found in the following protein(s): Z18303_PEA_1_P12.

Segment cluster Z18303_PEA_1_node_107 (SEQ ID NO:6494) according to the present invention is supported by 33 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6142 below describes the starting and ending position of this segment on each transcript.

TABLE 6142

Segment location on transcripts

| Transcript name | Segment starting position | Segment ending position |
|---|---|---|
| Z18303_PEA_1_T2 (SEQ ID NO: 4356) | 4163 | 4483 |
| Z18303_PEA_1_T8 (SEQ ID NO: 4357) | 3195 | 3515 |
| Z18303_PEA_1_T10 (SEQ ID NO: 4358) | 4205 | 4525 |
| Z18303_PEA_1_T12 (SEQ ID NO: 4359) | 4097 | 4417 |
| Z18303_PEA_1_T24 (SEQ ID NO: 4360) | 2039 | 2359 |

This segment can be found in a non-coding region of transcript(s) that are related to the following protein(s): Z18303_PEA_1_P3, Z18303_PEA_1_P8, Z18303_PEA_1_P10, Z18303_PEA_1_P12 and Z18303_PEA_1_P20.

According to an optional embodiment of the present invention, short segments related to the above cluster are also provided. These segments are up to about 120 bp in length, and so are included in a separate description.

Segment cluster Z18303_PEA_1_node_0 (SEQ ID NO:6495) according to the present invention is supported by 9 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6143 below describes the starting and ending position of this segment on each transcript.

TABLE 6143

Segment location on transcripts

| Transcript name | Segment starting position | Segment ending position |
|---|---|---|
| Z18303_PEA_1_T2 (SEQ ID NO: 4356) | 1 | 65 |
| Z18303_PEA_1_T10 (SEQ ID NO: 4358) | 1 | 65 |
| Z18303_PEA_1_T12 (SEQ ID NO: 4359) | 1 | 65 |
| Z18303_PEA_1_T39 (SEQ ID NO: 4361) | 1 | 65 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_1 (SEQ ID NO:6496) according to the present invention can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6144 below describes the starting and ending position of this segment on each transcript.

TABLE 6144

Segment location on transcripts

| Transcript name | Segment starting position | Segment ending position |
|---|---|---|
| Z18303_PEA_1_T2 (SEQ ID NO: 4356) | 66 | 80 |
| Z18303_PEA_1_T10 (SEQ ID NO: 4358) | 66 | 80 |
| Z18303_PEA_1_T12 (SEQ ID NO: 4359) | 66 | 80 |
| Z18303_PEA_1_T39 (SEQ ID NO: 4361) | 66 | 80 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_6 (SEQ ID NO:6497) according to the present invention is supported by 7 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6145 below describes the starting and ending position of this segment on each transcript.

TABLE 6145

Segment location on transcripts

| Transcript name | Segment starting position | Segment ending position |
|---|---|---|
| Z18303_PEA_1_T2 (SEQ ID NO: 4356) | 348 | 461 |
| Z18303_PEA_1_T10 (SEQ ID NO: 4358) | 348 | 461 |
| Z18303_PEA_1_T12 (SEQ ID NO: 4359) | 348 | 461 |
| Z18303_PEA_1_T39 (SEQ ID NO: 4361) | 348 | 461 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_8 (SEQ ID NO:6498) according to the present invention is supported by 7 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6146 below describes the starting and ending position of this segment on each transcript.

TABLE 6146

Segment location on transcripts

| Transcript name | Segment starting position | Segment ending position |
|---|---|---|
| Z18303_PEA_1_T2 (SEQ ID NO: 4356) | 462 | 560 |
| Z18303_PEA_1_T10 (SEQ ID NO: 4358) | 462 | 560 |
| Z18303_PEA_1_T12 (SEQ ID NO: 4359) | 462 | 560 |
| Z18303_PEA_1_T39 (SEQ ID NO: 4361) | 462 | 560 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_13 (SEQ ID NO:6499) according to the present invention is supported by 7 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6147 below describes the starting and ending position of this segment on each transcript.

TABLE 6147

Segment location on transcripts

| Transcript name | Segment starting position | Segment ending position |
|---|---|---|
| Z18303_PEA_1_T2 (SEQ ID NO: 4356) | 710 | 827 |
| Z18303_PEA_1_T10 (SEQ ID NO: 4358) | 710 | 827 |
| Z18303_PEA_1_T12 (SEQ ID NO: 4359) | 710 | 827 |
| Z18303_PEA_1_T39 (SEQ ID NO: 4361) | 710 | 827 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_16 (SEQ ID NO:6500) according to the present invention is supported by 9 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6148 below describes the starting and ending position of this segment on each transcript.

TABLE 6148

| Transcript name | Segment starting position | Segment ending position |
|---|---|---|
| Z18303_PEA_1_T2 (SEQ ID NO: 4356) | 828 | 876 |
| Z18303_PEA_1_T10 (SEQ ID NO: 4358) | 828 | 876 |
| Z18303_PEA_1_T12 (SEQ ID NO: 4359) | 828 | 876 |
| Z18303_PEA_1_T39 (SEQ ID NO: 4361) | 828 | 876 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_18 (SEQ ID NO:6501) according to the present invention is supported by 10 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6149 below describes the starting and ending position of this segment on each transcript.

TABLE 6149

| Transcript name | Segment starting position | Segment ending position |
|---|---|---|
| Z18303_PEA_1_T2 (SEQ ID NO: 4356) | 877 | 906 |
| Z18303_PEA_1_T10 (SEQ ID NO: 4358) | 877 | 906 |
| Z18303_PEA_1_T12 (SEQ ID NO: 4359) | 877 | 906 |
| Z18303_PEA_1_T39 (SEQ ID NO: 4361) | 877 | 906 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_22 (SEQ ID NO:6502) according to the present invention is supported by 10 libraries. The number of libraries was determined as previously described. This segment can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6150 below describes the starting and ending position of this segment on each transcript.

TABLE 6150

| Transcript name | Segment starting position | Segment ending position |
|---|---|---|
| Z18303_PEA_1_T2 (SEQ ID NO: 4356) | 907 | 960 |
| Z18303_PEA_1_T10 (SEQ ID NO: 4358) | 907 | 960 |
| Z18303_PEA_1_T12 (SEQ ID NO: 4359) | 907 | 960 |
| Z18303_PEA_1_T39 (SEQ ID NO: 4361) | 907 | 960 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_27 (SEQ ID NO:6503) according to the present invention can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359) and Z18303_PEA_1_T39 (SEQ ID NO:4361). Table 6151 below describes the starting and ending position of this segment on each transcript.

TABLE 6151

| Transcript name | Segment starting position | Segment ending position |
|---|---|---|
| Z18303_PEA_1_T2 (SEQ ID NO: 4356) | 961 | 963 |
| Z18303_PEA_1_T10 (SEQ ID NO: 4358) | 961 | 963 |
| Z18303_PEA_1_T12 (SEQ ID NO: 4359) | 961 | 963 |
| Z18303_PEA_1_T39 (SEQ ID NO: 4361) | 961 | 963 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_28 (SEQ ID NO:6504) according to the present invention can be found in the following transcript(s): Z18303_PEA_1_T2 (SEQ ID NO:4356), Z18303_PEA_1_T10 (SEQ ID NO:4358), Z18303_PEA_1_T12 (SEQ ID NO:4359)and Z18303_PEA_1_T39 (SEQ ID NO:4361). Table 6152 below describes the starting and ending position of this segment on each transcript.

TABLE 6152

Segment location on transcripts

| Transcript name | Segment starting position | Segment ending position |
|---|---|---|
| Z18303_PEA_1_T2 (SEQ ID NO: 4356) | 964 | 981 |
| Z18303_PEA_1_T10 (SEQ ID NO: 4358) | 964 | 981 |
| Z18303_PEA_1_T12 (SEQ ID NO: 4359) | 964 | 981 |
| Z18303_PEA_1_T39 (SEQ ID NO: 4361) | 964 | 981 |

This segment can be found in both coding and non-coding regions of transcript(s) as follows. The segment can be found in a non-coding region of transcript(s) that are related to the following protein(s): Z18303_PEA_1_P3. This segment can also be found in the following protein(s): Z18303_PEA_1_P10, Z18303_PEA_1_P12 and Z18303_PEA_1_P35, since it is in the coding region for the corresponding transcript.

Segment cluster Z18303_PEA_1_node_35 (SEQ ID NO:6505) according to the present invention is supported by 14 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6153 below describes the starting and ending position of this segment on each transcript.

TABLE 6153

Segment location on transcripts

| Transcript name | Segment starting position | Segment ending position |
|---|---|---|
| Z18303_PEA_1_T2 (SEQ ID NO: 4356) | 1402 | 1462 |
| Z18303_PEA_1_T8 (SEQ ID NO: 4357) | 434 | 494 |
| Z18303_PEA_1_T10 (SEQ ID NO: 4358) | 1146 | 1206 |
| Z18303_PEA_1_T12 (SEQ ID NO: 4359) | 1146 | 1206 |

This segment can be found in both coding and non-coding regions of transcript(s) as follows. The segment can be found in a non-coding region of transcript(s) that are related to the following protein(s): Z18303_PEA_1_P8. This segment can also be found in the following protein(s): Z18303_PEA_1_P3, Z18303_PEA_1_P10 and Z18303_PEA_1_P12, since it is in the coding region for the corresponding transcript.

Segment cluster Z18303_PEA_1_node_36 (SEQ ID NO:6506) according to the present invention is supported by 16 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6154 below describes the starting and ending position of this segment on each transcript.

TABLE 6154

Segment location on transcripts

| Transcript name | Segment starting position | Segment ending position |
|---|---|---|
| Z18303_PEA_1_T2 (SEQ ID NO: 4356) | 1463 | 1534 |
| Z18303_PEA_1_T8 (SEQ ID NO: 4357) | 495 | 566 |
| Z18303_PEA_1_T10 (SEQ ID NO: 4358) | 1207 | 1278 |
| Z18303_PEA_1_T12 (SEQ ID NO: 4359) | 1207 | 1278 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_42 (SEQ ID NO:6507) according to the present invention is supported by 14 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6155 below describes the starting and ending position of this segment on each transcript.

TABLE 6155

Segment location on transcripts

| Transcript name | Segment starting position | Segment ending position |
|---|---|---|
| Z18303_PEA_1_T2 (SEQ ID NO: 4356) | 1663 | 1768 |
| Z18303_PEA_1_T8 (SEQ ID NO: 4357) | 695 | 800 |
| Z18303_PEA_1_T10 (SEQ ID NO: 4358) | 1407 | 1512 |
| Z18303_PEA_1_T12 (SEQ ID NO: 4359) | 1407 | 1512 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_45 (SEQ ID NO:6508) according to the present invention is supported by 13 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6156 below describes the starting and ending position of this segment on each transcript.

TABLE 6156

Segment location on transcripts

| Transcript name | Segment starting position | Segment ending position |
|---|---|---|
| Z18303_PEA_1_T2 (SEQ ID NO: 4356) | 1769 | 1839 |
| Z18303_PEA_1_T8 (SEQ ID NO: 4357) | 801 | 871 |
| Z18303_PEA_1_T10 (SEQ ID NO: 4358) | 1513 | 1583 |
| Z18303_PEA_1_T12 (SEQ ID NO: 4359) | 1513 | 1583 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_46 (SEQ ID NO:6509) according to the present invention is supported by 14 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6157 below describes the starting and ending position of this segment on each transcript.

TABLE 6157

Segment location on transcripts

| Transcript name | Segment starting position | Segment ending position |
| --- | --- | --- |
| Z18303_PEA_1_T2 (SEQ ID NO: 4356) | 1840 | 1935 |
| Z18303_PEA_1_T8 (SEQ ID NO: 4357) | 872 | 967 |
| Z18303_PEA_1_T10 (SEQ ID NO: 4358) | 1584 | 1679 |
| Z18303_PEA_1_T12 (SEQ ID NO: 4359) | 1584 | 1679 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_52 (SEQ ID NO:6510) according to the present invention is supported by 19 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6158 below describes the starting and ending position of this segment on each transcript.

TABLE 6158

Segment location on transcripts

| Transcript name | Segment starting position | Segment ending position |
| --- | --- | --- |
| Z18303_PEA_1_T2 (SEQ ID NO: 4356) | 2102 | 2208 |
| Z18303_PEA_1_T8 (SEQ ID NO: 4357) | 1134 | 1240 |
| Z18303_PEA_1_T10 (SEQ ID NO: 4358) | 1846 | 1952 |
| Z18303_PEA_1_T12 (SEQ ID NO: 4359) | 1846 | 1952 |

This segment can be found in the following protein(s): Z18303_PEA_1_P3, P8, Z18303_PEA_1_P10 and Z18303_PEA_1_P12.

Segment cluster Z18303_PEA_1_node_54 (SEQ ID NO:6511) according to the present invention is supported by 16 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6159 below describes the starting and ending position of this segment on each transcript.

TABLE 6159

Segment location on transcripts

| Transcript name | Segment starting position | Segment ending position |
| --- | --- | --- |
| Z18303_PEA_1_T2 (SEQ ID NO: 4356) | 2209 | 2238 |
| Z18303_PEA_1_T8 (SEQ ID NO: 4357) | 1241 | 1270 |
| Z18303_PEA_1_T10 (SEQ ID NO: 4358) | 1953 | 1982 |
| Z18303_PEA_1_T12 (SEQ ID NO: 4359) | 1953 | 1982 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_62 (SEQ ID NO:6512) according to the present invention can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6160 below describes the starting and ending position of this segment on each transcript.

TABLE 6160

Segment location on transcripts

| Transcript name | Segment starting position | Segment ending position |
| --- | --- | --- |
| Z18303_PEA_1_T2 (SEQ ID NO: 4356) | 2379 | 2387 |
| Z18303_PEA_1_T8 (SEQ ID NO: 4357) | 1411 | 1419 |
| Z18303_PEA_1_T10 (SEQ ID NO: 4358) | 2123 | 2131 |
| Z18303_PEA_1_T12 (SEQ ID NO: 4359) | 2123 | 2131 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_63 (SEQ ID NO:6513) according to the present invention is supported by 17 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358) and Z18303_PEA_1_T12 (SEQ ID NO:4359). Table 6161 below describes the starting and ending position of this segment on each transcript.

TABLE 6161

Segment location on transcripts

| Transcript name | Segment starting position | Segment ending position |
| --- | --- | --- |
| Z18303_PEA_1_T2 (SEQ ID NO: 4356) | 2388 | 2459 |
| Z18303_PEA_1_T8 (SEQ ID NO: 4357) | 1420 | 1491 |
| Z18303_PEA_1_T10 (SEQ ID NO: 4358) | 2132 | 2203 |
| Z18303_PEA_1_T12 (SEQ ID NO: 4359) | 2132 | 2203 |

This segment can be found in the following protein(s): Z18303_PEA_1_P3, Z18303_PEA_1_P8, Z18303_PEA_1_P10 and Z18303_PEA_1_P12.

Segment cluster Z18303_PEA_1_node_65 (SEQ ID NO:6514) according to the present invention is supported by 1 libraries. The number of libraries was determined as previously described. This segment can be found in the following transcript(s): Z18303_PEA_1_T24 (SEQ ID NO:4360). Table 6162 below describes the starting and ending position of this segment on each transcript.

TABLE 6162

| | Segment location on transcripts | |
| --- | --- | --- |
| Transcript name | Segment starting position | Segment ending position |
| Z18303_PEA_1_T24 (SEQ ID NO: 4360) | 1 | 37 |

This segment can be found in a non-coding region of transcript(s) that are related to the following protein(s): Z18303_PEA_1_P20.

Segment cluster Z18303_PEA_1_node_71 (SEQ ID NO:6515) according to the present invention is supported by 24 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6163 below describes the starting and ending position of this segment on each transcript.

TABLE 6163

| | Segment location on transcripts | |
| --- | --- | --- |
| Transcript name | Segment starting position | Segment ending position |
| Z18303_PEA_1_T2 (SEQ ID NO: 4356) | 2620 | 2724 |
| Z18303_PEA_1_T8 (SEQ ID NO: 4357) | 1652 | 1756 |
| Z18303_PEA_1_T10 (SEQ ID NO: 4358) | 2662 | 2766 |
| Z18303_PEA_1_T12 (SEQ ID NO: 4359) | 2364 | 2468 |
| Z18303_PEA_1_T24 (SEQ ID NO: 4360) | 496 | 600 |

This segment can be found in both coding and non-coding regions of transcript(s) as follows. The segment can be found in a non-coding region of transcript(s) that are related to the following protein(s): Z18303_PEA_1_P20. This segment can also be found in the following protein(s): Z18303_PEA_1_P3, Z18303_PEA_1_P8, Z18303_PEA_1_P10 and Z18303_PEA_1_P12, since it is in the coding region for the corresponding transcript.

Segment cluster Z18303_PEA_1_node_82 (SEQ ID NO:6516) according to the present invention is supported by 29 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360). Table 6164 below describes the starting and ending position of this segment on each transcript.

TABLE 6164

| | Segment location on transcripts | |
| --- | --- | --- |
| Transcript name | Segment starting position | Segment ending position |
| Z18303_PEA_1_T2 (SEQ ID NO: 4356) | 3217 | 3305 |
| Z18303_PEA_1_T8 (SEQ ID NO: 4357) | 2249 | 2337 |
| Z18303_PEA_1_T10 (SEQ ID NO: 4358) | 3259 | 3347 |
| Z18303_PEA_1_T12 (SEQ ID NO: 4359) | 2961 | 3049 |
| Z18303_PEA_1_T24 (SEQ ID NO: 4360) | 1093 | 1181 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_103 (SEQ ID NO:6517) according to the present invention is supported by 30 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359)and Z18303_PEA_1_T24 (SEQ ID NO:4360). Table 6165 below describes the starting and ending position of this segment on each transcript.

TABLE 6165

| | Segment location on transcripts | |
| --- | --- | --- |
| Transcript name | Segment starting position | Segment ending position |
| Z18303_PEA_1_T2 (SEQ ID NO: 4356) | 4073 | 4125 |
| Z18303_PEA_1_T8 (SEQ ID NO: 4357) | 3105 | 3157 |
| Z18303_PEA_1_T10 (SEQ ID NO: 4358) | 4115 | 4167 |
| Z18303_PEA_1_T12 (SEQ ID NO: 4359) | 3817 | 3869 |
| Z18303_PEA_1_T24 (SEQ ID NO: 4360) | 1949 | 2001 |

This segment can be found in both coding and non-coding regions of transcript(s) as follows. The segment can be found in a non-coding region of transcript(s) that are related to the following protein(s): Z18303_PEA_1_P10. This segment can also be found in the following protein(s): Z18303_PEA_1_P3, Z18303_PEA_1_P8, Z18303_PEA_1_P12 and Z18303_PEA_1_P20, since it is in the coding region for the corresponding transcript.

Segment cluster Z18303_PEA_1_node_105 (SEQ ID NO:6518) according to the present invention is supported by 28 libraries. The number of libraries was determined as previously described. This segment can be found in the following transcript(s): Z18303_PEA_1_T2 (SEQ ID NO:4356), Z18303_PEA_1_T8 (SEQ ID NO:4357), Z18303_PEA_1_T10 (SEQ ID NO:4358), Z18303_PEA_1_T12 (SEQ ID NO:4359) and Z18303_PEA_1_T24 (SEQ ID NO:4360).

Table 6166 below describes the starting and ending position of this segment on each transcript.

TABLE 6166

Segment location on transcripts

| Transcript name | Segment starting position | Segment ending position |
|---|---|---|
| Z18303_PEA_1_T2 (SEQ ID NO: 4356) | 4126 | 4162 |
| Z18303_PEA_1_T8 (SEQ ID NO: 4357) | 3158 | 3194 |
| Z18303_PEA_1_T10 (SEQ ID NO: 4358) | 4168 | 4204 |
| Z18303_PEA_1_T12 (SEQ ID NO: 4359) | 4060 | 4096 |
| Z18303_PEA_1_T24 (SEQ ID NO: 4360) | 2002 | 2038 |

This segment can be found in both coding and non-coding regions of transcript(s) as follows. The segment can be found in a non-coding region of transcript(s) that are related to the following protein(s): Z18303_PEA_1_P10 and Z18303_PEA_1_P12. This segment can also be found in the following protein(s): Z18303_PEA_1_P3, Z18303_PEA_1_P8 and Z18303_PEA_1_P20, since it is in the coding region for the corresponding transcript.

Description for Cluster Z30117

Cluster Z30117 features 6 transcript(s) and 47 segment(s) of interest, the names for which are given in Tables 6167 and 6168, respectively, the sequences themselves are given at the end of the application. The selected protein variants are given in Table 6169.

TABLE 6167

Transcripts of interest
Transcript Name

Z30117_PEA_1_T9 (SEQ ID NO: 4362)
Z30117_PEA_1_T11 (SEQ ID NO: 4363)
Z30117_PEA_1_T12 (SEQ ID NO: 4364)
Z30117_PEA_1_T13 (SEQ ID NO: 4365)
Z30117_PEA_1_T15 (SEQ ID NO: 4366)
Z30117_PEA_1_T16 (SEQ ID NO: 4367)

TABLE 6168

Segments of interest
Segment Name

Z30117_PEA_1_node_0 (SEQ ID NO: 6519)
Z30117_PEA_1_node_5 (SEQ ID NO: 6520)
Z30117_PEA_1_node_7 (SEQ ID NO: 6521)
Z30117_PEA_1_node_9 (SEQ ID NO: 6522)
Z30117_PEA_1_node_19 (SEQ ID NO: 6523)
Z30117_PEA_1_node_21 (SEQ ID NO: 6524)
Z30117_PEA_1_node_23 (SEQ ID NO: 6525)
Z30117_PEA_1_node_25 (SEQ ID NO: 6526)
Z30117_PEA_1_node_32 (SEQ ID NO: 6527)
Z30117_PEA_1_node_34 (SEQ ID NO: 6528)
Z30117_PEA_1_node_36 (SEQ ID NO: 6529)
Z30117_PEA_1_node_38 (SEQ ID NO: 6530)
Z30117_PEA_1_node_43 (SEQ ID NO: 6531)
Z30117_PEA_1_node_47 (SEQ ID NO: 6532)
Z30117_PEA_1_node_54 (SEQ ID NO: 6533)
Z30117_PEA_1_node_56 (SEQ ID NO: 6534)
Z30117_PEA_1_node_62 (SEQ ID NO: 6535)
Z30117_PEA_1_node_64 (SEQ ID NO: 6536)
Z30117_PEA_1_node_72 (SEQ ID NO: 6537)

TABLE 6168-continued

Segments of interest
Segment Name

Z30117_PEA_1_node_79 (SEQ ID NO: 6538)
Z30117_PEA_1_node_82 (SEQ ID NO: 6539)
Z30117_PEA_1_node_86 (SEQ ID NO: 6540)
Z30117_PEA_1_node_93 (SEQ ID NO: 6541)
Z30117_PEA_1_node_95 (SEQ ID NO: 6542)
Z30117_PEA_1_node_2 (SEQ ID NO: 6543)
Z30117_PEA_1_node_11 (SEQ ID NO: 6544)
Z30117_PEA_1_node_15 (SEQ ID NO: 6545)
Z30117_PEA_1_node_17 (SEQ ID NO: 6546)
Z30117_PEA_1_node_27 (SEQ ID NO: 6547)
Z30117_PEA_1_node_29 (SEQ ID NO: 6548)
Z30117_PEA_1_node_30 (SEQ ID NO: 6549)
Z30117_PEA_1_node_40 (SEQ ID NO: 6550)
Z30117_PEA_1_node_41 (SEQ ID NO: 6551)
Z30117_PEA_1_node_45 (SEQ ID NO: 6552)
Z30117_PEA_1_node_49 (SEQ ID NO: 6553)
Z30117_PEA_1_node_50 (SEQ ID NO: 6554)
Z30117_PEA_1_node_52 (SEQ ID NO: 6555)
Z30117_PEA_1_node_58 (SEQ ID NO: 6556)
Z30117_PEA_1_node_60 (SEQ ID NO: 6557)
Z30117_PEA_1_node_66 (SEQ ID NO: 6558)
Z30117_PEA_1_node_68 (SEQ ID NO: 6559)
Z30117_PEA_1_node_70 (SEQ ID NO: 6560)
Z30117_PEA_1_node_74 (SEQ ID NO: 6561)
Z30117_PEA_1_node_81 (SEQ ID NO: 6562)
Z30117_PEA_1_node_83 (SEQ ID NO: 6563)
Z30117_PEA_1_node_87 (SEQ ID NO: 6564)
Z30117_PEA_1_node_92 (SEQ ID NO: 6565)

TABLE 6169

Proteins of interest

| Protein Name | Corresponding Transcript(s) |
|---|---|
| Z30117_PEA_1_P4 | Z30117_PEA_1_T9 (SEQ ID NO: 4362) |
| Z30117_PEA_1_P11 | Z30117_PEA_1_T11 (SEQ ID NO: 4363) |
| Z30117_PEA_1_P12 | Z30117_PEA_1_T12 (SEQ ID NO: 4364) |
| Z30117_PEA_1_P13 | Z30117_PEA_1_T13 (SEQ ID NO: 4365) |
| Z30117_PEA_1_P15 | Z30117_PEA_1_T15 (SEQ ID NO: 4366); Z30117_PEA_1_T16 (SEQ ID NO: 4367) |

These sequences are variants of the known protein Myomesin 2 (SwissProt accession identifier MYM2_HUMAN; known also according to the synonyms M-protein; 165 kDa titin-associated protein; 165 kDa connectin-associated protein), referred to herein as the previously known protein.

Protein Myomesin 2 is known or believed to have the following function(s): Major component of the vertebrate myofibrillar M band. Binds myosin, titin, and light meromyosin. This binding is dose dependent. The sequence for protein Myomesin 2 is given at the end of the application, as "Myomesin 2 amino acid sequence".

The following GO Annotation(s) apply to the previously known protein. The following annotation(s) were found: muscle contraction; striated muscle contraction; muscle development, which are annotation(s) related to Biological Process; structural protein of muscle, which are annotation(s) related to Molecular Function; and muscle thick filament, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster Z30117.

Predictions were made for selective expression of transcripts of this contig in heart tissue, according to the previously described methods. The numbers on the y-axis of FIG. 145 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 145, concerning the number of heart-specific clones in libraries/sequences; as well as with regard to the histogram in FIG. 146, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 9.7; the ratio of expression of the cluster in heart specific ESTs to the overall expression of the cluster in muscle-specific ESTs which was found to be 3.7; and fisher exact test P-values were computed both for library and weighted clone counts to check that the counts are statistically significant, and were found to be 5.30E-14.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 9.7, which clearly supports specific expression in heart tissue.

As noted above, cluster Z30117 features 47 segment(s), which were listed in Table 6168 above and for which the sequence(s) are given at the end of the application. These segment(s) are portions of nucleic acid sequence(s) which are described herein separately because they are of particular interest. A description of each segment according to the present invention is now provided.

Segment cluster Z30117_PEA_1_node_0 (SEQ ID NO:6519) according to the present invention is supported by 10 libraries. The number of libraries was determined as previously described. This segment can be found in the following transcript(s): Z30117_PEA_1_T9 (SEQ ID NO:4362). Table 6170 below describes the starting and ending position of this segment on each transcript.

TABLE 6170

Segment location on transcripts

| Transcript name | Segment starting position | Segment ending position |
|---|---|---|
| Z30117_PEA_1_T9 (SEQ ID NO: 4362) | 1 | 125 |

This segment can be found in a non-coding region of transcript(s) that are related to the following protein(s): Z30117_PEA_1_P4.

Segment cluster Z30117_PEA_1_node_5 (SEQ ID NO:6520) according to the present invention is supported by 11 libraries. The number of libraries was determined as previously described. This segment can be found in the following transcript(s): Z30117_PEA_1_T9 (SEQ ID NO:4362). Table 6171 below describes the starting and ending position of this segment on each transcript.

TABLE 6171

Segment location on transcripts

| Transcript name | Segment starting position | Segment ending position |
|---|---|---|
| Z30117_PEA_1_T9 (SEQ ID NO: 4362) | 245 | 400 |

This segment can be found in the following protein(s): Z30117_PEA_1_P4.

Segment cluster Z30117_PEA_1_node_7 (SEQ ID NO:6521) according to the present invention is supported by 9 libraries. The number of libraries was determined as previously described. This segment can be found in the following transcript(s): Z30117_PEA_1_T9 (SEQ ID NO:4362). Table 6172 below describes the starting and ending position of this segment on each transcript.

TABLE 6172

Segment location on transcripts

| Transcript name | Segment starting position | Segment ending position |
|---|---|---|
| Z30117_PEA_1_T9 (SEQ ID NO: 4362) | 401 | 539 |

This segment can be found in the following protein(s): Z30117_PEA_1_P4.

Segment cluster Z30117_PEA_1_node_9 (SEQ ID NO:6522) according to the present invention is supported by 11 libraries. The number of libraries was determined as previously described. This segment can be found in the following transcript(s): Z30117_PEA_1_T9 (SEQ ID NO:4362). Table 6173 below describes the starting and ending position of this segment on each transcript.

TABLE 6173

Segment location on transcripts

| Transcript name | Segment starting position | Segment ending position |
|---|---|---|
| Z30117_PEA_1_T9 (SEQ ID NO: 4362) | 540 | 697 |

This segment can be found in the following protein(s): Z30117_PEA_1_P4.

Segment cluster Z30117_PEA_1_node_19 (SEQ ID NO:6523) according to the present invention is supported by 8 libraries. The number of libraries was determined as previously described. This segment can be found in the following transcript(s): Z30117_PEA_1_T9 (SEQ ID NO:4362). Table 6174 below describes the starting and ending position of this segment on each transcript.

TABLE 6174

Segment location on transcripts

| Transcript name | Segment starting position | Segment ending position |
|---|---|---|
| Z30117_PEA_1_T9 (SEQ ID NO: 4362) | 931 | 1095 |

This segment can be found in the following protein(s): Z30117_PEA_1_P4.

Segment cluster Z30117_PEA_1_node_21 (SEQ ID NO:6524) according to the present invention is supported by 7 libraries. The number of libraries was determined as previously described. This segment can be found in the following transcript(s): Z30117_PEA_1_T9 (SEQ ID NO:4362). Table 6175 below describes the starting and ending position of this segment on each transcript.

TABLE 6175

Segment location on transcripts

| Transcript name | Segment starting position | Segment ending position |
|---|---|---|
| Z30117_PEA_1_T9 (SEQ ID NO: 4362) | 1096 | 1257 |

This segment can be found in the following protein(s): Z30117_PEA_1_P4.

Segment cluster Z30117_PEA_1_node_23 (SEQ ID NO:6525) according to the present invention is supported by 9 libraries. The number of libraries was determined as previously described. This segment can be found in the following transcript(s): Z30117_PEA_1_T9 (SEQ ID NO:4362). Table 6176 below describes the starting and ending position of this segment on each transcript.

TABLE 6176

Segment location on transcripts

| Transcript name | Segment starting position | Segment ending position |
|---|---|---|
| Z30117_PEA_1_T9 (SEQ ID NO: 4362) | 1258 | 1399 |

This segment can be found in the following protein(s): Z30117_PEA_1_P4.

Segment cluster Z30117_PEA_1_node_25 (SEQ ID NO:6526) according to the present invention is supported by 11 libraries. The number of libraries was determined as previously described. This segment can be found in the following transcript(s): Z30117_PEA_1_T9 (SEQ ID NO:4362). Table 6177 below describes the starting and ending position of this segment on each transcript.

TABLE 6177

Segment location on transcripts

| Transcript name | Segment starting position | Segment ending position |
|---|---|---|
| Z30117_PEA_1_T9 (SEQ ID NO: 4362) | 1400 | 1599 |

This segment can be found in the following protein(s): Z30117_PEA_1_P4.

Segment cluster Z30117_PEA_1_node_32 (SEQ ID NO:6527) according to the present invention is supported by 14 libraries. The number of libraries was determined as previously described. This segment can be found in the following transcript(s): Z30117_PEA_1_T9 (SEQ ID NO:4362). Table 6178 below describes the starting and ending position of this segment on each transcript.

TABLE 6178

Segment location on transcripts

| Transcript name | Segment starting position | Segment ending position |
|---|---|---|
| Z30117_PEA_1_T9 (SEQ ID NO: 4362) | 1782 | 1965 |

This segment can be found in the following protein(s): Z30117_PEA_1_P4.

Segment cluster Z30117_PEA_1_node_34 (SEQ ID NO:6528) according to the present invention is supported by 14 libraries. The number of libraries was determined as previously described. This segment can be found in the following transcript(s): Z30117_PEA_1_T9 (SEQ ID NO:4362). Table 6179 below describes the starting and ending position of this segment on each transcript.

TABLE 6179

Segment location on transcripts

| Transcript name | Segment starting position | Segment ending position |
|---|---|---|
| Z30117_PEA_1_T9 (SEQ ID NO: 4362) | 1966 | 2140 |

This segment can be found in the following protein(s): Z30117_PEA_1_P4.

Segment cluster Z30117_PEA_1_node_36 (SEQ ID NO:6529) according to the present invention is supported by 15 libraries. The number of libraries was determined as previously described. This segment can be found in the following transcript(s): Z30117_PEA_1_T9 (SEQ ID NO:4362). Table 6180 below describes the starting and ending position of this segment on each transcript.

TABLE 6180

Segment location on transcripts

| Transcript name | Segment starting position | Segment ending position |
|---|---|---|
| Z30117_PEA_1_T9 (SEQ ID NO: 4362) | 2141 | 2262 |

This segment can be found in the following protein(s): Z30117_PEA_1_P4.

Segment cluster Z30117_PEA_1_node_38 (SEQ ID NO:6530) according to the present invention is supported by 12 libraries. The number of libraries was determined as previously described. This segment can be found in the following transcript(s): Z30117_PEA_1_T9 (SEQ ID NO:4362). Table 6181 below describes the starting and ending position of this segment on each transcript.

TABLE 6181

Segment location on transcripts

| Transcript name | Segment starting position | Segment ending position |
|---|---|---|
| Z30117_PEA_1_T9 (SEQ ID NO: 4362) | 2263 | 2450 |

This segment can be found in the following protein(s): Z30117_PEA_1_P4.

Segment cluster Z30117_PEA_1_node_43 (SEQ ID NO:6531) according to the present invention is supported by 15 libraries. The number of libraries was determined as previously described. This segment can be found in the following transcript(s): Z30117_PEA_1_T9 (SEQ ID NO:4362). Table 6182 below describes the starting and ending position of this segment on each transcript.

TABLE 6182

Segment location on transcripts

| Transcript name | Segment starting position | Segment ending position |
|---|---|---|
| Z30117_PEA_1_T9 (SEQ ID NO: 4362) | 2578 | 2756 |

This segment can be found in the following protein(s): Z30117_PEA_1_P4.

Segment cluster Z30117_PEA_1_node_47 (SEQ ID NO:6532) according to the present invention is supported by 14 libraries. The number of libraries was determined as previously described. This segment can be found in the following transcript(s): Z30117_PEA_1_T9 (SEQ ID NO:4362). Table 6183 below describes the starting and ending position of this segment on each transcript.

TABLE 6183

Segment location on transcripts

| Transcript name | Segment starting position | Segment ending position |
|---|---|---|
| Z30117_PEA_1_T9 (SEQ ID NO: 4362) | 2872 | 3028 |

This segment can be found in the following protein(s): Z30117_PEA_1_P4.

Segment cluster Z30117_PEA_1_node_54 (SEQ ID NO:6533) according to the present invention is supported by 17 libraries. The number of libraries was determined as previously described. This segment can be found in the following transcript(s): Z30117_PEA_1_T9 (SEQ ID NO:4362). Table 6184 below describes the starting and ending position of this segment on each transcript.

TABLE 6184

Segment location on transcripts

| Transcript name | Segment starting position | Segment ending position |
|---|---|---|
| Z30117_PEA_1_T9 (SEQ ID NO: 4362) | 3181 | 3317 |

This segment can be found in the following protein(s): Z30117_PEA_1_P4.

Segment cluster Z30117_PEA_1_node_56 (SEQ ID NO:6534) according to the present invention is supported by 25 libraries. The number of libraries was determined as previously described. This segment can be found in the following transcript(s): Z30117_PEA_1_T9 (SEQ ID NO:4362). Table 6185 below describes the starting and ending position of this segment on each transcript.

TABLE 6185

Segment location on transcripts

| Transcript name | Segment starting position | Segment ending position |
|---|---|---|
| Z30117_PEA_1_T9 (SEQ ID NO: 4362) | 3318 | 3462 |

This segment can be found in the following protein(s): Z30117_PEA_1_P4.

Segment cluster Z30117_PEA_1_node_62 (SEQ ID NO:6535) according to the present invention is supported by 1 libraries. The number of libraries was determined as previously described. This segment can be found in the following transcript(s): Z30117_PEA_1_T11 (SEQ ID NO:4363). Table 6186 below describes the starting and ending position of this segment on each transcript.

TABLE 6186

Segment location on transcripts

| Transcript name | Segment starting position | Segment ending position |
|---|---|---|
| Z30117_PEA_1_T11 (SEQ ID NO: 4363) | 1 | 347 |

This segment can be found in the following protein(s): Z30117_PEA_1_P11.

Segment cluster Z30117_PEA_1_node_64 (SEQ ID NO:6536) according to the present invention is supported by 1 libraries. The number of libraries was determined as previously described. This segment can be found in the following transcript(s): Z30117_PEA_1_T12 (SEQ ID NO:4364). Table 6187 below describes the starting and ending position of this segment on each transcript.

TABLE 6187

Segment location on transcripts

| Transcript name | Segment starting position | Segment ending position |
|---|---|---|
| Z30117_PEA_1_T12 (SEQ ID NO: 4364) | 1 | 197 |

This segment can be found in a non-coding region of transcript(s) that are related to the following protein(s): Z30117_PEA_1_P12.

Segment cluster Z30117_PEA_1_node_72 (SEQ ID NO:6537) according to the present invention is supported by 12 libraries. The number of libraries was determined as previously described. This segment can be found in the following transcript(s): Z30117_PEA_1_T13 (SEQ ID NO:4365) and Z30117_PEA_1_T15 (SEQ ID NO:4366). Table 6188 below describes the starting and ending position of this segment on each transcript.

TABLE 6188

Segment location on transcripts

| Transcript name | Segment starting position | Segment ending position |
|---|---|---|
| Z30117_PEA_1_T13 (SEQ ID NO: 4365) | 1 | 151 |
| Z30117_PEA_1_T15 (SEQ ID NO: 4366) | 1 | 151 |

This segment can be found in a non-coding region of transcript(s) that are related to the following protein(s): Z30117_PEA_1_P13 and Z30117_PEA_1_P15.

Segment cluster Z30117_PEA_1_node_79 (SEQ ID NO:6538) according to the present invention is supported by 51 libraries. The number of libraries was determined as previously described. This segment can be found in the following transcript(s): Z30117_PEA_1_T9 (SEQ ID NO:4362), Z30117_PEA_1_T11 (SEQ ID NO:4363), Z30117_PEA_1_T12 (SEQ ID NO:4364), Z30117_PEA_1_T13 (SEQ ID NO:4365) and Z30117_PEA_1_T15 (SEQ ID NO:4366). Table 6189 below describes the starting and ending position of this segment on each transcript.

TABLE 6189

Segment location on transcripts

| Transcript name | Segment starting position | Segment ending position |
|---|---|---|
| Z30117_PEA_1_T9 (SEQ ID NO: 4362) | 3938 | 4101 |
| Z30117_PEA_1_T11 (SEQ ID NO: 4363) | 695 | 858 |
| Z30117_PEA_1_T12 (SEQ ID NO: 4364) | 545 | 708 |
| Z30117_PEA_1_T13 (SEQ ID NO: 4365) | 258 | 421 |
| Z30117_PEA_1_T15 (SEQ ID NO: 4366) | 258 | 421 |

This segment can be found in both coding and non-coding regions of transcript(s) as follows. The segment can be found in a non-coding region of transcript(s) that are related to the following protein(s): Z30117_PEA_1_P15. This segment can also be found in the following protein(s): Z30117_PEA_1_P4, Z30117_PEA_1_P11, Z30117_PEA_1_P12 and Z30117_PEA_1_P13, since it is in the coding region for the corresponding transcript.

Segment cluster Z30117_PEA_1_node_82 (SEQ ID NO:6539) according to the present invention is supported by 8 libraries. The number of libraries was determined as previously described. This segment can be found in the following transcript(s): Z30117_PEA_1_T9 (SEQ ID NO:4362). Table 6190 below describes the starting and ending position of this segment on each transcript.

TABLE 6190

Segment location on transcripts

| Transcript name | Segment starting position | Segment ending position |
|---|---|---|
| Z30117_PEA_1_T9 (SEQ ID NO: 4362) | 4139 | 5335 |

This segment can be found in the following protein(s): Z30117_PEA_1_P4.

Segment cluster Z30117_PEA_1_node_86 (SEQ ID NO:6540) according to the present invention is supported by 6 libraries. The number of libraries was determined as previously described. This segment can be found in the following transcript(s): Z30117_PEA_1_T16 (SEQ ID NO:4367). Table 6191 below describes the starting and ending position of this segment on each transcript.

TABLE 6191

Segment location on transcripts

| Transcript name | Segment starting position | Segment ending position |
|---|---|---|
| Z30117_PEA_1_T16 (SEQ ID NO: 4367) | 1 | 503 |

This segment can be found in a non-coding region of transcript(s) that are related to the following protein(s): Z30117_PEA_1_P15.

Segment cluster Z30117_PEA_1_node_93 (SEQ ID NO:6541) according to the present invention is supported by 80 libraries. The number of libraries was determined as previously described. This segment can be found in the following transcript(s): Z30117_PEA_1_T11 (SEQ ID NO:4363), Z30117_PEA_1_T12 (SEQ ID NO:4364), Z30117_PEA_1_T13 (SEQ ID NO:4365), Z30117_PEA_1_T15 (SEQ ID NO:4366)and Z30117_PEA_1_T16 (SEQ ID NO:4367). Table 6192 below describes the starting and ending position of this segment on each transcript.

TABLE 6192

Segment location on transcripts

| Transcript name | Segment starting position | Segment ending position |
|---|---|---|
| Z30117_PEA_1_T11 (SEQ ID NO: 4363) | 1014 | 1767 |
| Z30117_PEA_1_T12 (SEQ ID NO: 4364) | 864 | 1617 |
| Z30117_PEA_1_T13 (SEQ ID NO: 4365) | 577 | 1330 |
| Z30117_PEA_1_T15 (SEQ ID NO: 4366) | 540 | 1293 |
| Z30117_PEA_1_T16 (SEQ ID NO: 4367) | 599 | 1352 |

This segment can be found in the following protein(s): Z30117_PEA_1_P11, Z30117_PEA_1_P12, Z30117_PEA_1_P13 and Z30117_PEA_1_P15.

Segment cluster Z30117_PEA_1_node_95 (SEQ ID NO:6542) according to the present invention is supported by 1 libraries. The number of libraries was determined as previously described. This segment can be found in the following transcript(s): Z30117_PEA_1_T9 (SEQ ID NO:4362). Table 6193 below describes the starting and ending position of this segment on each transcript.

TABLE 6193

Segment location on transcripts

| Transcript name | Segment starting position | Segment ending position |
|---|---|---|
| Z30117_PEA_1_T9 (SEQ ID NO: 4362) | 5415 | 5807 |

This segment can be found in a non-coding region of transcript(s) that are related to the following protein(s): Z30117_PEA_1_P4.

According to an optional embodiment of the present invention, short segments related to the above cluster are also provided. These segments are up to about 120 bp in length, and so are included in a separate description.

Segment cluster Z30117_PEA_1_node_2 (SEQ ID NO:6543) according to the present invention is supported by 10 libraries. The number of libraries was determined as previously described. This segment can be found in the following transcript(s): Z30117_PEA_1_T9 (SEQ ID NO:4362). Table 6194 below describes the starting and ending position of this segment on each transcript.

TABLE 6194

Segment location on transcripts

| Transcript name | Segment starting position | Segment ending position |
|---|---|---|
| Z30117_PEA_1_T9 (SEQ ID NO: 4362) | 126 | 244 |

This segment can be found in the following protein(s): Z30117_PEA_1_P4.

Segment cluster Z30117_PEA_1_node_11 (SEQ ID NO:6544) according to the present invention is supported by 10 libraries. The number of libraries was determined as previously described. This segment can be found in the following transcript(s): Z30117_PEA_1_T9 (SEQ ID NO:4362). Table 6195 below describes the starting and ending position of this segment on each transcript.

TABLE 6195

Segment location on transcripts

| Transcript name | Segment starting position | Segment ending position |
|---|---|---|
| Z30117_PEA_1_T9 (SEQ ID NO: 4362) | 698 | 790 |

This segment can be found in the following protein(s): Z30117_PEA_1_P4.

Segment cluster Z30117_PEA_1_node_15 (SEQ ID NO:6545) according to the present invention is supported by 8 libraries. The number of libraries was determined as previously described. This segment can be found in the following transcript(s): Z30117_PEA_1_T9 (SEQ ID NO:4362). Table 6196 below describes the starting and ending position of this segment on each transcript.

TABLE 6196

Segment location on transcripts

| Transcript name | Segment starting position | Segment ending position |
|---|---|---|
| Z30117_PEA_1_T9 (SEQ ID NO: 4362) | 791 | 879 |

This segment can be found in the following protein(s): Z30117_PEA_1_P4.

Segment cluster Z30117_PEA_1_node_17 (SEQ ID NO:6546) according to the present invention is supported by 8 libraries. The number of libraries was determined as previously described. This segment can be found in the following transcript(s): Z30117_PEA_1_T9 (SEQ ID NO:4362). Table 6197 below describes the starting and ending position of this segment on each transcript.

TABLE 6197

Segment location on transcripts

| Transcript name | Segment starting position | Segment ending position |
|---|---|---|
| Z30117_PEA_1_T9 (SEQ ID NO: 4362) | 880 | 930 |

This segment can be found in the following protein(s): Z30117_PEA_1_P4.

Segment cluster Z30117_PEA_1_node_27 (SEQ ID NO:6547) according to the present invention is supported by 11 libraries. The number of libraries was determined as previously described. This segment can be found in the following transcript(s): Z30117_PEA_1_T9 (SEQ ID NO:4362). Table 6198 below describes the starting and ending position of this segment on each transcript.

TABLE 6198

Segment location on transcripts

| Transcript name | Segment starting position | Segment ending position |
|---|---|---|
| Z30117_PEA_1_T9 (SEQ ID NO: 4362) | 1600 | 1653 |

This segment can be found in the following protein(s): Z30117_PEA_1_P4.

Segment cluster Z30117_PEA_1_node_29 (SEQ ID NO:6548) according to the present invention is supported by 12 libraries. The number of libraries was determined as previously described. This segment can be found in the following transcript(s): Z30117_PEA_1_T9 (SEQ ID NO:4362). Table 6199 below describes the starting and ending position of this segment on each transcript.

TABLE 6199

Segment location on transcripts

| Transcript name | Segment starting position | Segment ending position |
|---|---|---|
| Z30117_PEA_1_T9 (SEQ ID NO: 4362) | 1654 | 1754 |

This segment can be found in the following protein(s): Z30117_PEA_1_P4.

Segment cluster Z30117_PEA_1_node_30 (SEQ ID NO:6549) according to the present invention is supported by 12 libraries. The number of libraries was determined as previously described. This segment can be found in the following transcript(s): Z30117_PEA_1_T9 (SEQ ID NO:4362). Table 6200 below describes the starting and ending position of this segment on each transcript.

TABLE 6200

| Segment location on transcripts | | |
|---|---|---|
| Transcript name | Segment starting position | Segment ending position |
| Z30117_PEA_1_T9 (SEQ ID NO: 4362) | 1755 | 1781 |

This segment can be found in the following protein(s): Z30117_PEA_1_P4.

Segment cluster Z30117_PEA_1_node_40 (SEQ ID NO:6550) according to the present invention is supported by 13 libraries. The number of libraries was determined as previously described. This segment can be found in the following transcript(s): Z30117_PEA_1_T9 (SEQ ID NO:4362). Table 6201 below describes the starting and ending position of this segment on each transcript.

TABLE 6201

| Segment location on transcripts | | |
|---|---|---|
| Transcript name | Segment starting position | Segment ending position |
| Z30117_PEA_1_T9 (SEQ ID NO: 4362) | 2451 | 2549 |

This segment can be found in the following protein(s): Z30117_PEA_1_P4.

Segment cluster Z30117_PEA_1_node_41 (SEQ ID NO:6551) according to the present invention is supported by 14 libraries. The number of libraries was determined as previously described. This segment can be found in the following transcript(s): Z30117_PEA_1_T9 (SEQ ID NO:4362). Table 6202 below describes the starting and ending position of this segment on each transcript.

TABLE 6202

| Segment location on transcripts | | |
|---|---|---|
| Transcript name | Segment starting position | Segment ending position |
| Z30117_PEA_1_T9 (SEQ ID NO: 4362) | 2550 | 2577 |

This segment can be found in the following protein(s): Z30117_PEA_1_P4.

Segment cluster Z30117_PEA_1_node_45 (SEQ ID NO:6552) according to the present invention is supported by 13 libraries. The number of libraries was determined as previously described. This segment can be found in the following transcript(s): Z30117_PEA_1_T9 (SEQ ID NO:4362). Table 6203 below describes the starting and ending position of this segment on each transcript.

TABLE 6203

| Segment location on transcripts | | |
|---|---|---|
| Transcript name | Segment starting position | Segment ending position |
| Z30117_PEA_1_T9 (SEQ ID NO: 4362) | 2757 | 2871 |

This segment can be found in the following protein(s): Z30117_PEA_1_P4.

Segment cluster Z30117_PEA_1_node_49 (SEQ ID NO:6553) according to the present invention is supported by 15 libraries. The number of libraries was determined as previously described. This segment can be found in the following transcript(s): Z30117_PEA_1_T9 (SEQ ID NO:4362). Table 6204 below describes the starting and ending position of this segment on each transcript.

TABLE 6204

| Segment location on transcripts | | |
|---|---|---|
| Transcript name | Segment starting position | Segment ending position |
| Z30117_PEA_1_T9 (SEQ ID NO: 4362) | 3029 | 3129 |

This segment can be found in the following protein(s): Z30117_PEA_1_P4.

Segment cluster Z30117_PEA_1_node_50 (SEQ ID NO:6554) according to the present invention can be found in the following transcript(s): Z30117_PEA_1_T9 (SEQ ID NO:4362). Table 6205 below describes the starting and ending position of this segment on each transcript.

TABLE 6205

| Segment location on transcripts | | |
|---|---|---|
| Transcript name | Segment starting position | Segment ending position |
| Z30117_PEA_1_T9 (SEQ ID NO: 4362) | 3130 | 3135 |

This segment can be found in the following protein(s): Z30117_PEA_1_P4.

Segment cluster Z30117_PEA_1_node_52 (SEQ ID NO:6555) according to the present invention is supported by 13 libraries. The number of libraries was determined as previously described. This segment can be found in the following transcript(s): Z30117_PEA_1_T9 (SEQ ID NO:4362). Table 6206 below describes the starting and ending position of this segment on each transcript.

TABLE 6206

| Segment location on transcripts | | |
|---|---|---|
| Transcript name | Segment starting position | Segment ending position |
| Z30117_PEA_1_T9 (SEQ ID NO: 4362) | 3136 | 3180 |

This segment can be found in the following protein(s): Z30117_PEA_1_P4.

Segment cluster Z30117_PEA_1_node_58 (SEQ ID NO:6556) according to the present invention is supported by 26 libraries. The number of libraries was determined as previously described. This segment can be found in the following transcript(s): Z30117_PEA_1_T9 (SEQ ID NO:4362). Table 6207 below describes the starting and ending position of this segment on each transcript.

TABLE 6207

Segment location on transcripts

| Transcript name | Segment starting position | Segment ending position |
| --- | --- | --- |
| Z30117_PEA_1_T9 (SEQ ID NO: 4362) | 3463 | 3522 |

This segment can be found in the following protein(s): Z30117_PEA_1_P4.

Segment cluster Z30117_PEA_1_node_60 (SEQ ID NO:6557) according to the present invention is supported by 22 libraries. The number of libraries was determined as previously described. This segment can be found in the following transcript(s): Z30117_PEA_1_T9 (SEQ ID NO:4362). Table 6208 below describes the starting and ending position of this segment on each transcript.

TABLE 6208

Segment location on transcripts

| Transcript name | Segment starting position | Segment ending position |
| --- | --- | --- |
| Z30117_PEA_1_T9 (SEQ ID NO: 4362) | 3523 | 3590 |

This segment can be found in the following protein(s): Z30117_PEA_1_P4.

Segment cluster Z30117_PEA_1_node_66 (SEQ ID NO:6558) according to the present invention is supported by 21 libraries. The number of libraries was determined as previously described. This segment can be found in the following transcript(s): Z30117_PEA_1_T9 (SEQ ID NO:4362), Z30117_PEA_1_T11 (SEQ ID NO:4363) and Z30117_PEA_1_T12 (SEQ ID NO:4364). Table 6209 below describes the starting and ending position of this segment on each transcript.

TABLE 6209

Segment location on transcripts

| Transcript name | Segment starting position | Segment ending position |
| --- | --- | --- |
| Z30117_PEA_1_T9 (SEQ ID NO: 4362) | 3591 | 3704 |
| Z30117_PEA_1_T11 (SEQ ID NO: 4363) | 348 | 461 |
| Z30117_PEA_1_T12 (SEQ ID NO: 4364) | 198 | 311 |

This segment can be found in both coding and non-coding regions of transcript(s) as follows. The segment can be found in a non-coding region of transcript(s) that are related to the following protein(s): Z30117_PEA_1_P12. This segment can also be found in the following protein(s): Z30117_PEA_1_P4 and Z30117_PEA_1_P11, since it is in the coding region for the corresponding transcript.

Segment cluster Z30117_PEA_1_node_68 (SEQ ID NO:6559) according to the present invention is supported by 24 libraries. The number of libraries was determined as previously described. This segment can be found in the following transcript(s): Z30117_PEA_1_T9 (SEQ ID NO:4362), Z30117_PEA_1_T11 (SEQ ID NO:4363)and Z30117_PEA_1_T12 (SEQ ID NO:4364). Table 6210 below describes the starting and ending position of this segment on each transcript.

TABLE 6210

Segment location on transcripts

| Transcript name | Segment starting position | Segment ending position |
| --- | --- | --- |
| Z30117_PEA_1_T9 (SEQ ID NO: 4362) | 3705 | 3792 |
| Z30117_PEA_1_T11 (SEQ ID NO: 4363) | 462 | 549 |
| Z30117_PEA_1_T12 (SEQ ID NO: 4364) | 312 | 399 |

This segment can be found in both coding and non-coding regions of transcript(s) as follows. The segment can be found in a non-coding region of transcript(s) that are related to the following protein(s): Z30117_PEA_1_P12. This segment can also be found in the following protein(s): Z30117_PEA_1_P4 and Z30117_PEA_1_P11, since it is in the coding region for the corresponding transcript.

Segment cluster Z30117_PEA_1_node_70 (SEQ ID NO:6560) according to the present invention is supported by 23 libraries. The number of libraries was determined as previously described. This segment can be found in the following transcript(s): Z30117_PEA_1_T9 (SEQ ID NO:4362), Z30117_PEA_1_T11 (SEQ ID NO:4363) and Z30117_PEA_1_T12 (SEQ ID NO:4364). Table 6211 below describes the starting and ending position of this segment on each transcript.

TABLE 6211

Segment location on transcripts

| Transcript name | Segment starting position | Segment ending position |
| --- | --- | --- |
| Z30117_PEA_1_T9 (SEQ ID NO: 4362) | 3793 | 3831 |
| Z30117_PEA_1_T11 (SEQ ID NO: 4363) | 550 | 588 |
| Z30117_PEA_1_T12 (SEQ ID NO: 4364) | 400 | 438 |

This segment can be found in the following protein(s): Z30117_PEA_1_P4, Z30117_PEA_1_P11 and Z30117_PEA_1_P12.

Segment cluster Z30117_PEA_1_node_74 (SEQ ID NO:6561) according to the present invention is supported by 40 libraries. The number of libraries was determined as previously described. This segment can be found in the following transcript(s): Z30117_PEA_1_T9 (SEQ ID NO:4362), Z30117_PEA_1_T11 (SEQ ID NO:4363), Z30117_PEA_1_T12 (SEQ ID NO:4364), Z30117_PEA_1_T13 (SEQ ID NO:4365) and Z30117_PEA_1_T15 (SEQ ID NO:4366). Table 6212 below describes the starting and ending position of this segment on each transcript.

TABLE 6212

| Transcript name | Segment location on transcripts | |
|---|---|---|
| | Segment starting position | Segment ending position |
| Z30117_PEA_1_T9 (SEQ ID NO: 4362) | 3832 | 3937 |
| Z30117_PEA_1_T11 (SEQ ID NO: 4363) | 589 | 694 |
| Z30117_PEA_1_T12 (SEQ ID NO: 4364) | 439 | 544 |
| Z30117_PEA_1_T13 (SEQ ID NO: 4365) | 152 | 257 |
| Z30117_PEA_1_T15 (SEQ ID NO: 4366) | 152 | 257 |

This segment can be found in both coding and non-coding regions of transcript(s) as follows. The segment can be found in a non-coding region of transcript(s) that are related to the following protein(s): Z30117_PEA_1_P15. This segment can also be found in the following protein(s): Z30117_PEA_1_P4, Z30117_PEA_1_P11, Z30117_PEA_1_P12 and Z30117_PEA_1_P13, since it is in the coding region for the corresponding transcript.

Segment cluster Z30117_PEA_1_node_81 (SEQ ID NO:6562) according to the present invention is supported by 38 libraries. The number of libraries was determined as previously described. This segment can be found in the following transcript(s): Z30117_PEA_1_T9 (SEQ ID NO:4362), Z30117_PEA_1_T11 (SEQ ID NO:4363), Z30117_PEA_1_T12 (SEQ ID NO:4364) and Z30117_PEA_1_T13 (SEQ ID NO:4365). Table 6213 below describes the starting and ending position of this segment on each transcript.

TABLE 6213

| Transcript name | Segment location on transcripts | |
|---|---|---|
| | Segment starting position | Segment ending position |
| Z30117_PEA_1_T9 (SEQ ID NO: 4362) | 4102 | 4138 |
| Z30117_PEA_1_T11 (SEQ ID NO: 4363) | 859 | 895 |
| Z30117_PEA_1_T12 (SEQ ID NO: 4364) | 709 | 745 |
| Z30117_PEA_1_T13 (SEQ ID NO: 4365) | 422 | 458 |

This segment can be found in the following protein(s): Z30117_PEA_1_P4, Z30117_PEA_1_P11, Z30117_PEA_1_P12 and Z30117_PEA_1_P13.

Segment cluster Z30117_PEA_1_node_83 (SEQ ID NO:6563) according to the present invention can be found in the following transcript(s): Z30117_PEA_1_T9 (SEQ ID NO:4362), Z30117_PEA_1_T11 (SEQ ID NO:4363), Z30117_PEA_1_T12 (SEQ ID NO:4364), Z30117_PEA_1_T13 (SEQ ID NO:4365) and Z30117_PEA_1_T15 (SEQ ID NO:4366). Table 6214 below describes the starting and ending position of this segment on each transcript.

TABLE 6214

| Transcript name | Segment location on transcripts | |
|---|---|---|
| | Segment starting position | Segment ending position |
| Z30117_PEA_1_T9 (SEQ ID NO: 4362) | 5336 | 5358 |
| Z30117_PEA_1_T11 (SEQ ID NO: 4363) | 896 | 918 |
| Z30117_PEA_1_T12 (SEQ ID NO: 4364) | 746 | 768 |
| Z30117_PEA_1_T13 (SEQ ID NO: 4365) | 459 | 481 |
| Z30117_PEA_1_T15 (SEQ ID NO: 4366) | 422 | 444 |

This segment can be found in both coding and non-coding regions of transcript(s) as follows. The segment can be found in a non-coding region of transcript(s) that are related to the following protein(s): Z30117_PEA_1_P4 and Z30117_PEA_1_P15. This segment can also be found in the following protein(s): Z30117_PEA_1_P11, Z30117_PEA_1_P12 and Z30117_PEA_1_P13, since it is in the coding region for the corresponding transcript.

Segment cluster Z30117_PEA_1_node_87 (SEQ ID NO:6564) according to the present invention is supported by 48 libraries. The number of libraries was determined as previously described. This segment can be found in the following transcript(s): Z30117_PEA_1_T9 (SEQ ID NO:4362), Z30117_PEA_1_T11 (SEQ ID NO:4363), Z30117_PEA_1_T12 (SEQ ID NO:4364), Z30117_PEA_1_T13 (SEQ ID NO:4365), Z30117_PEA_1_T15 (SEQ ID NO:4366) and Z30117_PEA_1_T16 (SEQ ID NO:4367). Table 6215 below describes the starting and ending position of this segment on each transcript.

TABLE 6215

| Transcript name | Segment location on transcripts | |
|---|---|---|
| | Segment starting position | Segment ending position |
| Z30117_PEA_1_T9 (SEQ ID NO: 4362) | 5359 | 5414 |
| Z30117_PEA_1_T11 (SEQ ID NO: 4363) | 919 | 974 |
| Z30117_PEA_1_T12 (SEQ ID NO: 4364) | 769 | 824 |
| Z30117_PEA_1_T13 (SEQ ID NO: 4365) | 482 | 537 |
| Z30117_PEA_1_T15 (SEQ ID NO: 4366) | 445 | 500 |
| Z30117_PEA_1_T16 (SEQ ID NO: 4367) | 504 | 559 |

This segment can be found in both coding and non-coding regions of transcript(s) as follows. The segment can be found in a non-coding region of transcript(s) that are related to the following protein(s): Z30117_PEA_1_P4. This segment can also be found in the following protein(s): Z30117_PEA_1_P11, Z30117_PEA_1_P12, Z30117_PEA_1_P13 and Z30117_PEA_1_P15, since it is in the coding region for the corresponding transcript.

Segment cluster Z30117_PEA_1_node_92 (SEQ ID NO:6565) according to the present invention is supported by 47 libraries. The number of libraries was determined as previously described. This segment can be found in the following transcript(s): Z30117_PEA_1_T11 (SEQ ID NO:4363), Z30117_PEA_1_T12 (SEQ ID NO:4364), Z30117_PEA_

1_T13 (SEQ ID NO:4365), Z30117_PEA_1_T15 (SEQ ID NO:4366)and Z30117_PEA_1_T16 (SEQ ID NO:4367). Table 6216 below describes the starting and ending position of this segment on each transcript.

TABLE 6216

Segment location on transcripts

| Transcript name | Segment starting position | Segment ending position |
|---|---|---|
| Z30117_PEA_1_T11 (SEQ ID NO: 4363) | 975 | 1013 |
| Z30117_PEA_1_T12 (SEQ ID NO: 4364) | 825 | 863 |
| Z30117_PEA_1_T13 (SEQ ID NO: 4365) | 538 | 576 |
| Z30117_PEA_1_T15 (SEQ ID NO: 4366) | 501 | 539 |
| Z30117_PEA_1_T16 (SEQ ID NO: 4367) | 560 | 598 |

This segment can be found in the following protein(s): Z30117_PEA_1_P11, Z30117_PEA_1_P12, Z30117_PEA_1_P13 and Z30117_PEA_1_P15.

Description for Cluster H38064

Cluster H38064 features 4 transcript(s) and 46 segment(s) of interest, the names for which are given in Tables 6217 and 6218, respectively, the sequences themselves are given at the end of the application. The selected protein variants are given in Table 6219.

TABLE 6217

Transcripts of interest
Transcript Name

H38064_PEA_1_T19 (SEQ ID NO: 4368)
H38064_PEA_1_T20 (SEQ ID NO: 4369)
H38064_PEA_1_T21 (SEQ ID NO: 4370)
H38064_PEA_1_T32 (SEQ ID NO: 4371)

TABLE 6218

Segments of interest
Segment Name

H38064_PEA_1_node_7 (SEQ ID NO: 6566)
H38064_PEA_1_node_21 (SEQ ID NO: 6567)
H38064_PEA_1_node_44 (SEQ ID NO: 6568)
H38064_PEA_1_node_57 (SEQ ID NO: 6569)
H38064_PEA_1_node_81 (SEQ ID NO: 6570)
H38064_PEA_1_node_91 (SEQ ID NO: 6571)
H38064_PEA_1_node_2 (SEQ ID NO: 6572)
H38064_PEA_1_node_4 (SEQ ID NO: 6573)
H38064_PEA_1_node_9 (SEQ ID NO: 6574)
H38064_PEA_1_node_10 (SEQ ID NO: 6575)
H38064_PEA_1_node_11 (SEQ ID NO: 6576)
H38064_PEA_1_node_12 (SEQ ID NO: 6577)
H38064_PEA_1_node_13 (SEQ ID NO: 6578)
H38064_PEA_1_node_16 (SEQ ID NO: 6579)
H38064_PEA_1_node_18 (SEQ ID NO: 6580)
H38064_PEA_1_node_19 (SEQ ID NO: 6581)
H38064_PEA_1_node_25 (SEQ ID NO: 6582)
H38064_PEA_1_node_26 (SEQ ID NO: 6583)
H38064_PEA_1_node_27 (SEQ ID NO: 6584)
H38064_PEA_1_node_28 (SEQ ID NO: 6585)
H38064_PEA_1_node_30 (SEQ ID NO: 6586)
H38064_PEA_1_node_32 (SEQ ID NO: 6587)
H38064_PEA_1_node_46 (SEQ ID NO: 6588)
H38064_PEA_1_node_61 (SEQ ID NO: 6589)

TABLE 6218-continued

Segments of interest
Segment Name

H38064_PEA_1_node_62 (SEQ ID NO: 6590)
H38064_PEA_1_node_69 (SEQ ID NO: 6591)
H38064_PEA_1_node_70 (SEQ ID NO: 6592)
H38064_PEA_1_node_71 (SEQ ID NO: 6593)
H38064_PEA_1_node_72 (SEQ ID NO: 6594)
H38064_PEA_1_node_73 (SEQ ID NO: 6595)
H38064_PEA_1_node_74 (SEQ ID NO: 6596)
H38064_PEA_1_node_75 (SEQ ID NO: 6597)
H38064_PEA_1_node_76 (SEQ ID NO: 6598)
H38064_PEA_1_node_77 (SEQ ID NO: 6599)
H38064_PEA_1_node_78 (SEQ ID NO: 6600)
H38064_PEA_1_node_79 (SEQ ID NO: 6601)
H38064_PEA_1_node_80 (SEQ ID NO: 6602)
H38064_PEA_1_node_82 (SEQ ID NO: 6603)
H38064_PEA_1_node_83 (SEQ ID NO: 6604)
H38064_PEA_1_node_84 (SEQ ID NO: 6605)
H38064_PEA_1_node_85 (SEQ ID NO: 6606)
H38064_PEA_1_node_86 (SEQ ID NO: 6607)
H38064_PEA_1_node_87 (SEQ ID NO: 6608)
H38064_PEA_1_node_88 (SEQ ID NO: 6609)
H38064_PEA_1_node_89 (SEQ ID NO: 6610)
H38064_PEA_1_node_90 (SEQ ID NO: 6611)

TABLE 6219

Proteins of interest

| Protein Name | Corresponding Transcript(s) |
|---|---|
| H38064_PEA_1_P2 | H38064_PEA_1_T19 (SEQ ID NO: 4368); H38064_PEA_1_T20 (SEQ ID NO: 4369) |
| H38064_PEA_1_P30 | H38064_PEA_1_T21 (SEQ ID NO: 4370) |
| H38064_PEA_1_P36 | H38064_PEA_1_T32 (SEQ ID NO: 4371) |

These sequences are variants of the known protein Ubiquitin-like 1 activating enzyme E1A (SwissProt accession identifier SAE1_HUMAN; known also according to the synonyms SUMO-1 activating enzyme subunit 1), referred to herein as the previously known protein.

Protein Ubiquitin-like 1 activating enzyme E1A is known or believed to have the following function(s): The dimeric enzyme acts as a UBL1 E1 ligase. It mediates ATP-dependent activation of UBL1 and formation of a thiolester with a conserved cysteine residue on SAE2. The sequence for protein Ubiquitin-like 1 activating enzyme E1A is given at the end of the application, as "Ubiquitin-like 1 activating enzyme E1A amino acid sequence". Known polymorphisms for this sequence are as shown in Table 6220.

TABLE 6220

Amino acid mutations for Known Protein

| SNP position(s) on amino acid sequence | Comment |
|---|---|
| 158 | V -> A |
| 178-180 | KTK -> ETD |
| 186 | Q -> H |
| 273 | R -> G |

The following GO Annotation(s) apply to the previously known protein. The following annotation(s) were found: protein ubiquitylation, which are annotation(s) related to Biological Process; ubiquitin activating enzyme; protein C-terminus binding; enzyme activator; ubiquitin-like conjugating enzyme; ligase, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster H38064 features 46 segment(s), which were listed in Table 6218 above and for which the sequence(s) are given at the end of the application. These segment(s) are portions of nucleic acid sequence(s) which are described herein separately because they are of particular interest. A description of each segment according to the present invention is now provided.

Segment cluster H38064_PEA_1_node_7 (SEQ ID NO:6566) according to the present invention is supported by 2 libraries. The number of libraries was determined as previously described. This segment can be found in the following transcript(s): H38064_PEA_1_T20 (SEQ ID NO:4369). Table 6221 below describes the starting and ending position of this segment on each transcript.

TABLE 6221

Segment location on transcripts

| Transcript name | Segment starting position | Segment ending position |
| --- | --- | --- |
| H38064_PEA_1_T20 (SEQ ID NO: 4369) | 95 | 329 |

This segment can be found in a non-coding region of transcript(s) that are related to the following protein(s): H38064_PEA_1_P2.

Segment cluster H38064_PEA_1_node_21 (SEQ ID NO:6567) according to the present invention is supported by 93 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6222 below describes the starting and ending position of this segment on each transcript.

TABLE 6222

Segment location on transcripts

| Transcript name | Segment starting position | Segment ending position |
| --- | --- | --- |
| H38064_PEA_1_T19 (SEQ ID NO: 4368) | 271 | 444 |
| H38064_PEA_1_T20 (SEQ ID NO: 4369) | 442 | 615 |
| H38064_PEA_1_T21 (SEQ ID NO: 4370) | 322 | 495 |
| H38064_PEA_1_T32 (SEQ ID NO: 4371) | 322 | 495 |

This segment can be found in the following protein(s): H38064_PEA_1_P2, H38064_PEA_1_P30 and H38064_PEA_1_P36.

Segment cluster H38064_PEA_1_node_44 (SEQ ID NO:6568) according to the present invention is supported by 8 libraries. The number of libraries was determined as previously described. This segment can be found in the following transcript(s): H38064_PEA_1_T32 (SEQ ID NO:4371). Table 6223 below describes the starting and ending position of this segment on each transcript.

TABLE 6223

Segment location on transcripts

| Transcript name | Segment starting position | Segment ending position |
| --- | --- | --- |
| H38064_PEA_1_T32 (SEQ ID NO: 4371) | 845 | 1992 |

This segment can be found in the following protein(s): H38064_PEA_1_P36.

Segment cluster H38064_PEA_1_node_57 (SEQ ID NO:6569) according to the present invention is supported by 73 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6224 below describes the starting and ending position of this segment on each transcript.

TABLE 6224

Segment location on transcripts

| Transcript name | Segment starting position | Segment ending position |
| --- | --- | --- |
| H38064_PEA_1_T19 (SEQ ID NO: 4368) | 794 | 938 |
| H38064_PEA_1_T20 (SEQ ID NO: 4369) | 965 | 1109 |
| H38064_PEA_1_T21 (SEQ ID NO: 4370) | 927 | 1071 |

This segment can be found in both coding and non-coding regions of transcript(s) as follows. The segment can be found in a non-coding region of transcript(s) that are related to the following protein(s): H38064_PEA_1_P30. This segment can also be found in the following protein(s): H38064_PEA_1_P2, since it is in the coding region for the corresponding transcript.

Segment cluster H38064_PEA_1_node_81 (SEQ ID NO:6570) according to the present invention is supported by 62 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6225 below describes the starting and ending position of this segment on each transcript.

TABLE 6225

Segment location on transcripts

| Transcript name | Segment starting position | Segment ending position |
| --- | --- | --- |
| H38064_PEA_1_T19 (SEQ ID NO: 4368) | 1409 | 1610 |
| H38064_PEA_1_T20 (SEQ ID NO: 4369) | 1580 | 1781 |
| H38064_PEA_1_T21 (SEQ ID NO: 4370) | 1542 | 1743 |

This segment can be found in a non-coding region of transcript(s) that are related to the following protein(s): H38064_PEA_1_P2 and H38064_PEA_1_P30.

Segment cluster H38064_PEA_1_node_91 (SEQ ID NO:6571) according to the present invention is supported by 45 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6226 below describes the starting and ending position of this segment on each transcript.

TABLE 6226

| | Segment location on transcripts | |
|---|---|---|
| Transcript name | Segment starting position | Segment ending position |
| H38064_PEA_1_T19 (SEQ ID NO: 4368) | 1867 | 2481 |
| H38064_PEA_1_T20 (SEQ ID NO: 4369) | 2038 | 2652 |
| H38064_PEA_1_T21 (SEQ ID NO: 4370) | 2000 | 2614 |

This segment can be found in a non-coding region of transcript(s) that are related to the following protein(s): H38064_PEA_1_P2 and H38064_PEA_1_P30.

According to an optional embodiment of the present invention, short segments related to the above cluster are also provided. These segments are up to about 120 bp in length, and so are included in a separate description.

Segment cluster H38064_PEA_1_node_2 (SEQ ID NO:6572) according to the present invention is supported by 1 libraries. The number of libraries was determined as previously described. This segment can be found in the following transcript(s): H38064_PEA_1_T19 (SEQ ID NO:4368). Table 6227 below describes the starting and ending position of this segment on each transcript.

TABLE 6227

| | Segment location on transcripts | |
|---|---|---|
| Transcript name | Segment starting position | Segment ending position |
| H38064_PEA_1_T19 (SEQ ID NO: 4368) | 1 | 80 |

This segment can be found in a non-coding region of transcript(s) that are related to the following protein(s): H38064_PEA_1_P2.

Segment cluster H38064_PEA_1_node_4 (SEQ ID NO:6573) according to the present invention is supported by 3 libraries. The number of libraries was determined as previously described. This segment can be found in the following transcript(s): H38064_PEA_1_T20 (SEQ ID NO:4369). Table 6228 below describes the starting and ending position of this segment on each transcript.

TABLE 6228

| | Segment location on transcripts | |
|---|---|---|
| Transcript name | Segment starting position | Segment ending position |
| H38064_PEA_1_T20 (SEQ ID NO: 4369) | 1 | 94 |

This segment can be found in a non-coding region of transcript(s) that are related to the following protein(s): H38064_PEA_1_P2.

Segment cluster H38064_PEA_1_node_9 (SEQ ID NO:6574) according to the present invention is supported by 12 libraries. The number of libraries was determined as previously described. This segment can be found in the following transcript(s): H38064_PEA_1_T21 (SEQ ID NO:4370) and H38064_PEA_1_T32 (SEQ ID NO:4371). Table 6229 below describes the starting and ending position of this segment on each transcript.

TABLE 6229

| | Segment location on transcripts | |
|---|---|---|
| Transcript name | Segment starting position | Segment ending position |
| H38064_PEA_1_T21 (SEQ ID NO: 4370) | 1 | 39 |
| H38064_PEA_1_T32 (SEQ ID NO: 4371) | 1 | 39 |

This segment can be found in a non-coding region of transcript(s) that are related to the following protein(s): H38064_PEA_1_P30 and H38064_PEA_1_P36.

Segment cluster H38064_PEA_1_node_10 (SEQ ID NO:6575) according to the present invention is supported by 68 libraries. The number of libraries was determined as previously described. This segment can be found in the following transcript(s): H38064_PEA_1_T21 (SEQ ID NO:4370) and H38064_PEA_1_T32 (SEQ ID NO:4371). Table 6230 below describes the starting and ending position of this segment on each transcript.

TABLE 6230

| | Segment location on transcripts | |
|---|---|---|
| Transcript name | Segment starting position | Segment ending position |
| H38064_PEA_1_T21 (SEQ ID NO: 4370) | 40 | 123 |
| H38064_PEA_1_T32 (SEQ ID NO: 4371) | 40 | 123 |

This segment can be found in the following protein(s): H38064_PEA_1_P30 and H38064_PEA_1_P36.

Segment cluster H38064_PEA_1_node_11 (SEQ ID NO:6576) according to the present invention can be found in the following transcript(s): H38064_PEA_1_T21 (SEQ ID NO:4370) and H38064_PEA_1_T32 (SEQ ID NO:4371). Table 6231 below describes the starting and ending position of this segment on each transcript.

TABLE 6231

| Segment location on transcripts | | |
|---|---|---|
| Transcript name | Segment starting position | Segment ending position |
| H38064_PEA_1_T21 (SEQ ID NO: 4370) | 124 | 138 |
| H38064_PEA_1_T32 (SEQ ID NO: 4371) | 124 | 138 |

This segment can be found in the following protein(s): H38064_PEA_1_P30 and H38064_PEA_1_P36.

Segment cluster H38064_PEA_1_node_12 (SEQ ID NO:6577) according to the present invention is supported by 79 libraries. The number of libraries was determined as previously described. This segment can be found in the following transcript(s): H38064_PEA_1_T21 (SEQ ID NO:4370) and H38064_PEA_1_T32 (SEQ ID NO:4371). Table 6232 below describes the starting and ending position of this segment on each transcript.

TABLE 6232

| Segment location on transcripts | | |
|---|---|---|
| Transcript name | Segment starting position | Segment ending position |
| H38064_PEA_1_T21 (SEQ ID NO: 4370) | 139 | 201 |
| H38064_PEA_1_T32 (SEQ ID NO: 4371) | 139 | 201 |

This segment can be found in the following protein(s): H38064_PEA_1_P30 and H38064_PEA_1_P36.

Segment cluster H38064_PEA_1_node_13 (SEQ ID NO:6578) according to the present invention can be found in the following transcript(s): H38064_PEA_1_T21 (SEQ ID NO:4370) and H38064_PEA_1_T32 (SEQ ID NO:4371). Table 6233 below describes the starting and ending position of this segment on each transcript.

TABLE 6233

| Segment location on transcripts | | |
|---|---|---|
| Transcript name | Segment starting position | Segment ending position |
| H38064_PEA_1_T21 (SEQ ID NO: 4370) | 202 | 209 |
| H38064_PEA_1_T32 (SEQ ID NO: 4371) | 202 | 209 |

This segment can be found in the following protein(s): H38064_PEA_1_P30 and H38064_PEA_1_P36.

Segment cluster H38064_PEA_1_node_16 (SEQ ID NO:6579) according to the present invention is supported by 2 libraries. The number of libraries was determined as previously described. This segment can be found in the following transcript(s): H38064_PEA_1_T19 (SEQ ID NO:4368). Table 6234 below describes the starting and ending position of this segment on each transcript.

TABLE 6234

| Segment location on transcripts | | |
|---|---|---|
| Transcript name | Segment starting position | Segment ending position |
| H38064_PEA_1_T19 (SEQ ID NO: 4368) | 81 | 158 |

This segment can be found in a non-coding region of transcript(s) that are related to the following protein(s): H38064_PEA_1_P2.

Segment cluster H38064_PEA_1_node_18 (SEQ ID NO:6580) according to the present invention is supported by 88 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6235 below describes the starting and ending position of this segment on each transcript.

TABLE 6235

| Segment location on transcripts | | |
|---|---|---|
| Transcript name | Segment starting position | Segment ending position |
| H38064_PEA_1_T19 (SEQ ID NO: 4368) | 159 | 187 |
| H38064_PEA_1_T20 (SEQ ID NO: 4369) | 330 | 358 |
| H38064_PEA_1_T21 (SEQ ID NO: 4370) | 210 | 238 |
| H38064_PEA_1_T32 (SEQ ID NO: 4371) | 210 | 238 |

This segment can be found in both coding and non-coding regions of transcript(s) as follows. The segment can be found in a non-coding region of transcript(s) that are related to the following protein(s): H38064_PEA_1_P2. This segment can also be found in the following protein(s): H38064_PEA_1_P30 and H38064_PEA_1_P36, since it is in the coding region for the corresponding transcript.

Segment cluster H38064_PEA_1_node_19 (SEQ ID NO:6581) according to the present invention is supported by 89 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6236 below describes the starting and ending position of this segment on each transcript.

TABLE 6236

| Segment location on transcripts | | |
|---|---|---|
| Transcript name | Segment starting position | Segment ending position |
| H38064_PEA_1_T19 (SEQ ID NO: 4368) | 188 | 270 |
| H38064_PEA_1_T20 (SEQ ID NO: 4369) | 359 | 441 |
| H38064_PEA_1_T21 (SEQ ID NO: 4370) | 239 | 321 |
| H38064_PEA_1_T32 (SEQ ID NO: 4371) | 239 | 321 |

This segment can be found in the following protein(s): H38064_PEA_1_P2, H38064_PEA_1_P30 and H38064_PEA_1_P36.

Segment cluster H38064_PEA_1_node_25 (SEQ ID NO:6582) according to the present invention is supported by 81 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6237 below describes the starting and ending position of this segment on each transcript.

TABLE 6237

Segment location on transcripts

| Transcript name | Segment starting position | Segment ending position |
| --- | --- | --- |
| H38064_PEA_1_T19 (SEQ ID NO: 4368) | 445 | 477 |
| H38064_PEA_1_T20 (SEQ ID NO: 4369) | 616 | 648 |
| H38064_PEA_1_T21 (SEQ ID NO: 4370) | 496 | 528 |
| H38064_PEA_1_T32 (SEQ ID NO: 4371) | 496 | 528 |

This segment can be found in the following protein(s): H38064_PEA_1_P2, H38064_PEA_1_P30 and H38064_PEA_1_P36.

Segment cluster H38064_PEA_1_node_26 (SEQ ID NO:6583) according to the present invention can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6238 below describes the starting and ending position of this segment on each transcript.

TABLE 6238

Segment location on transcripts

| Transcript name | Segment starting position | Segment ending position |
| --- | --- | --- |
| H38064_PEA_1_T19 (SEQ ID NO: 4368) | 478 | 492 |
| H38064_PEA_1_T20 (SEQ ID NO: 4369) | 649 | 663 |
| H38064_PEA_1_T21 (SEQ ID NO: 4370) | 529 | 543 |
| H38064_PEA_1_T32 (SEQ ID NO: 4371) | 529 | 543 |

This segment can be found in the following protein(s): H38064_PEA_1_P2, H38064_PEA_1_P30 and H38064_PEA_1_P36.

Segment cluster H38064_PEA_1_node_27 (SEQ ID NO:6584) according to the present invention is supported by 79 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6239 below describes the starting and ending position of this segment on each transcript.

TABLE 6239

Segment location on transcripts

| Transcript name | Segment starting position | Segment ending position |
| --- | --- | --- |
| H38064_PEA_1_T19 (SEQ ID NO: 4368) | 493 | 554 |
| H38064_PEA_1_T20 (SEQ ID NO: 4369) | 664 | 725 |
| H38064_PEA_1_T21 (SEQ ID NO: 4370) | 544 | 605 |
| H38064_PEA_1_T32 (SEQ ID NO: 4371) | 544 | 605 |

This segment can be found in the following protein(s): H38064_PEA_1_P2, H38064_PEA_1_P30 and H38064_PEA_1_P36.

Segment cluster H38064_PEA_1_node_28 (SEQ ID NO:6585) according to the present invention is supported by 78 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6240 below describes the starting and ending position of this segment on each transcript.

TABLE 6240

Segment location on transcripts

| Transcript name | Segment starting position | Segment ending position |
| --- | --- | --- |
| H38064_PEA_1_T19 (SEQ ID NO: 4368) | 555 | 587 |
| H38064_PEA_1_T20 (SEQ ID NO: 4369) | 726 | 758 |
| H38064_PEA_1_T21 (SEQ ID NO: 4370) | 606 | 638 |
| H38064_PEA_1_T32 (SEQ ID NO: 4371) | 606 | 638 |

This segment can be found in the following protein(s): H38064_PEA_1_P2, H38064_PEA_1_P30 and H38064_PEA_1_P36.

Segment cluster H38064_PEA_1_node_30 (SEQ ID NO:6586) according to the present invention is supported by 74 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6241 below describes the starting and ending position of this segment on each transcript.

TABLE 6241

Segment location on transcripts

| Transcript name | Segment starting position | Segment ending position |
| --- | --- | --- |
| H38064_PEA_1_T19 (SEQ ID NO: 4368) | 588 | 687 |
| H38064_PEA_1_T20 (SEQ ID NO: 4369) | 759 | 858 |
| H38064_PEA_1_T21 (SEQ ID NO: 4370) | 639 | 738 |

TABLE 6241-continued

Segment location on transcripts

| Transcript name | Segment starting position | Segment ending position |
|---|---|---|
| H38064_PEA_1_T32 (SEQ ID NO: 4371) | 639 | 738 |

This segment can be found in the following protein(s): H38064_PEA_1_P2, H38064_PEA_1_P30 and H38064_PEA_1_P36.

Segment cluster H38064_PEA_1_node_32 (SEQ ID NO:6587) according to the present invention is supported by 80 libraries. The number of libraries was determined as previously described. This segment can be found in the following transcript(s): H38064_PEA_1_T19 (SEQ ID NO:4368), H38064_PEA_1_T20 (SEQ ID NO:4369), H38064_PEA_1_T21 (SEQ ID NO:4370) and H38064_PEA_1_T32 (SEQ ID NO:4371). Table 6242 below describes the starting and ending position of this segment on each transcript.

TABLE 6242

Segment location on transcripts

| Transcript name | Segment starting position | Segment ending position |
|---|---|---|
| H38064_PEA_1_T19 (SEQ ID NO: 4368) | 688 | 793 |
| H38064_PEA_1_T20 (SEQ ID NO: 4369) | 859 | 964 |
| H38064_PEA_1_T21 (SEQ ID NO: 4370) | 739 | 844 |
| H38064_PEA_1_T32 (SEQ ID NO: 4371) | 739 | 844 |

This segment can be found in the following protein(s): H38064_PEA_1_P2, H38064_PEA_1_P30 and H38064_PEA_1_P36.

Segment cluster H38064_PEA_1_node_46 (SEQ ID NO:6588) according to the present invention is supported by 1 libraries. The number of libraries was determined as previously described. This segment can be found in the following transcript(s): H38064_PEA_1_T21 (SEQ ID NO:4370). Table 6243 below describes the starting and ending position of this segment on each transcript.

TABLE 6243

Segment location on transcripts

| Transcript name | Segment starting position | Segment ending position |
|---|---|---|
| H38064_PEA_1_T21 (SEQ ID NO: 4370) | 845 | 926 |

This segment can be found in the following protein(s): H38064_PEA_1_P30.

Segment cluster H38064_PEA_1_node_61 (SEQ ID NO:6589) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6244 below describes the starting and ending position of this segment on each transcript.

TABLE 6244

Segment location on transcripts

| Transcript name | Segment starting position | Segment ending position |
|---|---|---|
| H38064_PEA_1_T19 (SEQ ID NO: 4368) | 939 | 961 |
| H38064_PEA_1_T20 (SEQ ID NO: 4369) | 1110 | 1132 |
| H38064_PEA_1_T21 (SEQ ID NO: 4370) | 1072 | 1094 |

This segment can be found in both coding and non-coding regions of transcript(s) as follows. The segment can be found in a non-coding region of transcript(s) that are related to the following protein(s): H38064_PEA_1_P30. This segment can also be found in the following protein(s): H38064_PEA_1_P2, since it is in the coding region for the corresponding transcript.

Segment cluster H38064_PEA_1_node_62 (SEQ ID NO:6590) according to the present invention is supported by 66 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6245 below describes the starting and ending position of this segment on each transcript.

TABLE 6245

Segment location on transcripts

| Transcript name | Segment starting position | Segment ending position |
|---|---|---|
| H38064_PEA_1_T19 (SEQ ID NO: 4368) | 962 | 1008 |
| H38064_PEA_1_T20 (SEQ ID NO: 4369) | 1133 | 1179 |
| H38064_PEA_1_T21 (SEQ ID NO: 4370) | 1095 | 1141 |

This segment can be found in both coding and non-coding regions of transcript(s) as follows. The segment can be found in a non-coding region of transcript(s) that are related to the following protein(s): H38064_PEA_1_P30. This segment can also be found in the following protein(s): H38064_PEA_1_P2, since it is in the coding region for the corresponding transcript.

Segment cluster H38064_PEA_1_node_69 (SEQ ID NO:6591) according to the present invention is supported by 67 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6246 below describes the starting and ending position of this segment on each transcript.

TABLE 6246

Segment location on transcripts

| Transcript name | Segment starting position | Segment ending position |
|---|---|---|
| H38064_PEA_1_T19 (SEQ ID NO: 4368) | 1009 | 1038 |
| H38064_PEA_1_T20 (SEQ ID NO: 4369) | 1180 | 1209 |
| H38064_PEA_1_T21 (SEQ ID NO: 4370) | 1142 | 1171 |

This segment can be found in both coding and non-coding regions of transcript(s) as follows. The segment can be found in a non-coding region of transcript(s) that are related to the following protein(s): H38064_PEA_1_P30. This segment can also be found in the following protein(s): H38064_PEA_1_P2, since it is in the coding region for the corresponding transcript.

Segment cluster H38064_PEA_1_node_70 (SEQ ID NO:6592) according to the present invention is supported by 68 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6247 below describes the starting and ending position of this segment on each transcript.

TABLE 6247

Segment location on transcripts

| Transcript name | Segment starting position | Segment ending position |
|---|---|---|
| H38064_PEA_1_T19 (SEQ ID NO: 4368) | 1039 | 1117 |
| H38064_PEA_1_T20 (SEQ ID NO: 4369) | 1210 | 1288 |
| H38064_PEA_1_T21 (SEQ ID NO: 4370) | 1172 | 1250 |

This segment can be found in both coding and non-coding regions of transcript(s) as follows. The segment can be found in a non-coding region of transcript(s) that are related to the following protein(s): H38064_PEA_1_P30. This segment can also be found in the following protein(s): H38064_PEA_1_P2, since it is in the coding region for the corresponding transcript.

Segment cluster H38064_PEA_1_node_71 (SEQ ID NO:6593) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6248 below describes the starting and ending position of this segment on each transcript.

TABLE 6248

Segment location on transcripts

| Transcript name | Segment starting position | Segment ending position |
|---|---|---|
| H38064_PEA_1_T19 (SEQ ID NO: 4368) | 1118 | 1132 |
| H38064_PEA_1_T20 (SEQ ID NO: 4369) | 1289 | 1303 |
| H38064_PEA_1_T21 (SEQ ID NO: 4370) | 1251 | 1265 |

This segment can be found in a non-coding region of transcript(s) that are related to the following protein(s): H38064_PEA_1_P2 and H38064_PEA_1_P30.

Segment cluster H38064_PEA_1_node_72 (SEQ ID NO:6594) according to the present invention is supported by 61 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6249 below describes the starting and ending position of this segment on each transcript.

TABLE 6249

Segment location on transcripts

| Transcript name | Segment starting position | Segment ending position |
|---|---|---|
| H38064_PEA_1_T19 (SEQ ID NO: 4368) | 1133 | 1177 |
| H38064_PEA_1_T20 (SEQ ID NO: 4369) | 1304 | 1348 |
| H38064_PEA_1_T21 (SEQ ID NO: 4370) | 1266 | 1310 |

This segment can be found in a non-coding region of transcript(s) that are related to the following protein(s): H38064_PEA_1_P2 and H38064_PEA_1_P30.

Segment cluster H38064_PEA_1_node_73 (SEQ ID NO:6595) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6250 below describes the starting and ending position of this segment on each transcript.

TABLE 6250

Segment location on transcripts

| Transcript name | Segment starting position | Segment ending position |
|---|---|---|
| H38064_PEA_1_T19 (SEQ ID NO: 4368) | 1178 | 1192 |
| H38064_PEA_1_T20 (SEQ ID NO: 4369) | 1349 | 1363 |
| H38064_PEA_1_T21 (SEQ ID NO: 4370) | 1311 | 1325 |

This segment can be found in a non-coding region of transcript(s) that are related to the following protein(s): H38064_PEA_1_P2 and H38064_PEA_1_P30.

Segment cluster H38064_PEA_1_node_74 (SEQ ID NO:6596) according to the present invention is supported by 58 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6251 below describes the starting and ending position of this segment on each transcript.

TABLE 6251

Segment location on transcripts

| Transcript name | Segment starting position | Segment ending position |
|---|---|---|
| H38064_PEA_1_T19 (SEQ ID NO: 4368) | 1193 | 1253 |
| H38064_PEA_1_T20 (SEQ ID NO: 4369) | 1364 | 1424 |
| H38064_PEA_1_T21 (SEQ ID NO: 4370) | 1326 | 1386 |

This segment can be found in a non-coding region of transcript(s) that are related to the following protein(s): H38064_PEA_1_P2 and H38064_PEA_1_P30.

Segment cluster H38064_PEA_1_node_75 (SEQ ID NO:6597) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6252 below describes the starting and ending position of this segment on each transcript.

TABLE 6252

Segment location on transcripts

| Transcript name | Segment starting position | Segment ending position |
|---|---|---|
| H38064_PEA_1_T19 (SEQ ID NO: 4368) | 1254 | 1257 |
| H38064_PEA_1_T20 (SEQ ID NO: 4369) | 1425 | 1428 |
| H38064_PEA_1_T21 (SEQ ID NO: 4370) | 1387 | 1390 |

This segment can be found in a non-coding region of transcript(s) that are related to the following protein(s): H38064_PEA_1_P2 and H38064_PEA_1_P30.

Segment cluster H38064_PEA_1_node_76 (SEQ ID NO:6598) according to the present invention is supported by 57 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6253 below describes the starting and ending position of this segment on each transcript.

TABLE 6253

Segment location on transcripts

| Transcript name | Segment starting position | Segment ending position |
|---|---|---|
| H38064_PEA_1_T19 (SEQ ID NO: 4368) | 1258 | 1318 |
| H38064_PEA_1_T20 (SEQ ID NO: 4369) | 1429 | 1489 |
| H38064_PEA_1_T21 (SEQ ID NO: 4370) | 1391 | 1451 |

This segment can be found in a non-coding region of transcript(s) that are related to the following protein(s): H38064_PEA_1_P2 and H38064_PEA_1_P30.

Segment cluster H38064_PEA_1_node_77 (SEQ ID NO:6599) according to the present invention is supported by 57 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6254 below describes the starting and ending position of this segment on each transcript.

TABLE 6254

Segment location on transcripts

| Transcript name | Segment starting position | Segment ending position |
|---|---|---|
| H38064_PEA_1_T19 (SEQ ID NO: 4368) | 1319 | 1345 |
| H38064_PEA_1_T20 (SEQ ID NO: 4369) | 1490 | 1516 |
| H38064_PEA_1_T21 (SEQ ID NO: 4370) | 1452 | 1478 |

This segment can be found in a non-coding region of transcript(s) that are related to the following protein(s): H38064_PEA_1_P2 and H38064_PEA_1_P30.

Segment cluster H38064_PEA_1_node_78 (SEQ ID NO:6600) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6255 below describes the starting and ending position of this segment on each transcript.

TABLE 6255

Segment location on transcripts

| Transcript name | Segment starting position | Segment ending position |
|---|---|---|
| H38064_PEA_1_T19 (SEQ ID NO: 4368) | 1346 | 1352 |
| H38064_PEA_1_T20 (SEQ ID NO: 4369) | 1517 | 1523 |
| H38064_PEA_1_T21 (SEQ ID NO: 4370) | 1479 | 1485 |

This segment can be found in a non-coding region of transcript(s) that are related to the following protein(s): H38064_PEA_1_P2 and H38064_PEA_1_P30.

Segment cluster H38064_PEA_1_node_79 (SEQ ID NO:6601) according to the present invention is supported by 57 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6256 below describes the starting and ending position of this segment on each transcript.

TABLE 6256

Segment location on transcripts

| Transcript name | Segment starting position | Segment ending position |
|---|---|---|
| H38064_PEA_1_T19 (SEQ ID NO: 4368) | 1353 | 1386 |

TABLE 6256-continued

Segment location on transcripts

| Transcript name | Segment starting position | Segment ending position |
|---|---|---|
| H38064_PEA_1_T20 (SEQ ID NO: 4369) | 1524 | 1557 |
| H38064_PEA_1_T21 (SEQ ID NO: 4370) | 1486 | 1519 |

This segment can be found in a non-coding region of transcript(s) that are related to the following protein(s): H38064_PEA_1_P2 and H38064_PEA_1_P30.

Segment cluster H38064_PEA_1_node_80 (SEQ ID NO:6602) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6257 below describes the starting and ending position of this segment on each transcript.

TABLE 6257

Segment location on transcripts

| Transcript name | Segment starting position | Segment ending position |
|---|---|---|
| H38064_PEA_1_T19 (SEQ ID NO: 4368) | 1387 | 1408 |
| H38064_PEA_1_T20 (SEQ ID NO: 4369) | 1558 | 1579 |
| H38064_PEA_1_T21 (SEQ ID NO: 4370) | 1520 | 1541 |

This segment can be found in a non-coding region of transcript(s) that are related to the following protein(s): H38064_PEA_1_P2 and H38064_PEA_1_P30.

Segment cluster H38064_PEA_1_node_82 (SEQ ID NO:6603) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6258 below describes the starting and ending position of this segment on each transcript.

TABLE 6258

Segment location on transcripts

| Transcript name | Segment starting position | Segment ending position |
|---|---|---|
| H38064_PEA_1_T19 (SEQ ID NO: 4368) | 1611 | 1624 |
| H38064_PEA_1_T20 (SEQ ID NO: 4369) | 1782 | 1795 |
| H38064_PEA_1_T21 (SEQ ID NO: 4370) | 1744 | 1757 |

This segment can be found in a non-coding region of transcript(s) that are related to the following protein(s): H38064_PEA_1_P2 and H38064_PEA_1_P30.

Segment cluster H38064_PEA_1_node_83 (SEQ ID NO:6604) according to the present invention is supported by 42 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6259 below describes the starting and ending position of this segment on each transcript.

TABLE 6259

Segment location on transcripts

| Transcript name | Segment starting position | Segment ending position |
|---|---|---|
| H38064_PEA_1_T19 (SEQ ID NO: 4368) | 1625 | 1668 |
| H38064_PEA_1_T20 (SEQ ID NO: 4369) | 1796 | 1839 |
| H38064_PEA_1_T21 (SEQ ID NO: 4370) | 1758 | 1801 |

This segment can be found in a non-coding region of transcript(s) that are related to the following protein(s): H38064_PEA_1_P2 and H38064_PEA_1_P30.

Segment cluster H38064_PEA_1_node_84 (SEQ ID NO:6605) according to the present invention is supported by 38 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6260 below describes the starting and ending position of this segment on each transcript.

TABLE 6260

Segment location on transcripts

| Transcript name | Segment starting position | Segment ending position |
|---|---|---|
| H38064_PEA_1_T19 (SEQ ID NO: 4368) | 1669 | 1729 |
| H38064_PEA_1_T20 (SEQ ID NO: 4369) | 1840 | 1900 |
| H38064_PEA_1_T21 (SEQ ID NO: 4370) | 1802 | 1862 |

This segment can be found in a non-coding region of transcript(s) that are related to the following protein(s): H38064_PEA_1_P2 and H38064_PEA_1_P30.

Segment cluster H38064_PEA_1_node_85 (SEQ ID NO:6606) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6261 below describes the starting and ending position of this segment on each transcript.

TABLE 6261

Segment location on transcripts

| Transcript name | Segment starting position | Segment ending position |
|---|---|---|
| H38064_PEA_1_T19 (SEQ ID NO: 4368) | 1730 | 1736 |
| H38064_PEA_1_T20 (SEQ ID NO: 4369) | 1901 | 1907 |
| H38064_PEA_1_T21 (SEQ ID NO: 4370) | 1863 | 1869 |

This segment can be found in a non-coding region of transcript(s) that are related to the following protein(s): H38064_PEA_1_P2 and H38064_PEA_1_P30.

Segment cluster H38064_PEA_1_node_86 (SEQ ID NO:6607) according to the present invention is supported by 39 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6262 below describes the starting and ending position of this segment on each transcript.

TABLE 6262

| | Segment location on transcripts | |
|---|---|---|
| Transcript name | Segment starting position | Segment ending position |
| H38064_PEA_1_T19 (SEQ ID NO: 4368) | 1737 | 1789 |
| H38064_PEA_1_T20 (SEQ ID NO: 4369) | 1908 | 1960 |
| H38064_PEA_1_T21 (SEQ ID NO: 4370) | 1870 | 1922 |

This segment can be found in a non-coding region of transcript(s) that are related to the following protein(s): H38064_PEA_1_P2 and H38064_PEA_1_P30.

Segment cluster H38064_PEA_1_node_87 (SEQ ID NO:6608) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6263 below describes the starting and ending position of this segment on each transcript.

TABLE 6263

| | Segment location on transcripts | |
|---|---|---|
| Transcript name | Segment starting position | Segment ending position |
| H38064_PEA_1_T19 (SEQ ID NO: 4368) | 1790 | 1808 |
| H38064_PEA_1_T20 (SEQ ID NO: 4369) | 1961 | 1979 |
| H38064_PEA_1_T21 (SEQ ID NO: 4370) | 1923 | 1941 |

This segment can be found in a non-coding region of transcript(s) that are related to the following protein(s): H38064_PEA_1_P2 and H38064_PEA_1_P30.

Segment cluster H38064_PEA_1_node_88 (SEQ ID NO:6609) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6264 below describes the starting and ending position of this segment on each transcript.

TABLE 6264

| | Segment location on transcripts | |
|---|---|---|
| Transcript name | Segment starting position | Segment ending position |
| H38064_PEA_1_T19 (SEQ ID NO: 4368) | 1809 | 1817 |
| H38064_PEA_1_T20 (SEQ ID NO: 4369) | 1980 | 1988 |
| H38064_PEA_1_T21 (SEQ ID NO: 4370) | 1942 | 1950 |

This segment can be found in a non-coding region of transcript(s) that are related to the following protein(s): H38064_PEA_1_P2 and H38064_PEA_1_P30.

Segment cluster H38064_PEA_1_node_89 (SEQ ID NO:6610) according to the present invention can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6265 below describes the starting and ending position of this segment on each transcript.

TABLE 6265

| | Segment location on transcripts | |
|---|---|---|
| Transcript name | Segment starting position | Segment ending position |
| H38064_PEA_1_T19 (SEQ ID NO: 4368) | 1818 | 1829 |
| H38064_PEA_1_T20 (SEQ ID NO: 4369) | 1989 | 2000 |
| H38064_PEA_1_T21 (SEQ ID NO: 4370) | 1951 | 1962 |

This segment can be found in a non-coding region of transcript(s) that are related to the following protein(s): H38064_PEA_1_P2 and H38064_PEA_1_P30.

Segment cluster H38064_PEA_1_node_90 (SEQ ID NO:6611) according to the present invention is supported by 39 libraries. The number of libraries was determined as previously described. This segment can be found in the following transcript(s): H38064_PEA_1_T19 (SEQ ID NO:4368), H38064_PEA_1_T20 (SEQ ID NO:4369) and H38064_PEA_1_T21 (SEQ ID NO:4370). Table 6266 below describes the starting and ending position of this segment on each transcript.

TABLE 6266

| | Segment location on transcripts | |
|---|---|---|
| Transcript name | Segment starting position | Segment ending position |
| H38064_PEA_1_T19 (SEQ ID NO: 4368) | 1830 | 1866 |
| H38064_PEA_1_T20 (SEQ ID NO: 4369) | 2001 | 2037 |
| H38064_PEA_1_T21 (SEQ ID NO: 4370) | 1963 | 1999 |

This segment can be found in a non-coding region of transcript(s) that are related to the following protein(s): H38064_PEA_1_P2 and H38064_PEA_1_P30.

Description for Cluster HSLDHAR

Cluster HSLDHAR features 18 transcript(s) and 40 segment(s) of interest, the names for which are given in Tables 6267 and 6268, respectively, the sequences themselves are given at the end of the application. The selected protein variants are given in Table 6269.

TABLE 6267

Transcripts of interest
Transcript Name

HSLDHAR_PEA_3_T0 (SEQ ID NO: 4372)
HSLDHAR_PEA_3_T1 (SEQ ID NO: 4373)
HSLDHAR_PEA_3_T2 (SEQ ID NO: 4374)
HSLDHAR_PEA_3_T3 (SEQ ID NO: 4375)
HSLDHAR_PEA_3_T4 (SEQ ID NO: 4376)
HSLDHAR_PEA_3_T5 (SEQ ID NO: 4377)
HSLDHAR_PEA_3_T7 (SEQ ID NO: 4378)
HSLDHAR_PEA_3_T11 (SEQ ID NO: 4379)
HSLDHAR_PEA_3_T13 (SEQ ID NO: 4380)
HSLDHAR_PEA_3_T19 (SEQ ID NO: 4381)
HSLDHAR_PEA_3_T20 (SEQ ID NO: 4382)
HSLDHAR_PEA_3_T21 (SEQ ID NO: 4383)
HSLDHAR_PEA_3_T22 (SEQ ID NO: 4384)
HSLDHAR_PEA_3_T25 (SEQ ID NO: 4385)
HSLDHAR_PEA_3_T28 (SEQ ID NO: 4386)
HSLDHAR_PEA_3_T29 (SEQ ID NO: 4387)
HSLDHAR_PEA_3_T34 (SEQ ID NO: 4388)
HSLDHAR_PEA_3_T37 (SEQ ID NO: 4389)

TABLE 6268

Segments of interest
Segment Name

HSLDHAR_PEA_3_node_0 (SEQ ID NO: 6612)
HSLDHAR_PEA_3_node_2 (SEQ ID NO: 6613)
HSLDHAR_PEA_3_node_4 (SEQ ID NO: 6614)
HSLDHAR_PEA_3_node_5 (SEQ ID NO: 6615)
HSLDHAR_PEA_3_node_7 (SEQ ID NO: 6616)
HSLDHAR_PEA_3_node_12 (SEQ ID NO: 6617)
HSLDHAR_PEA_3_node_17 (SEQ ID NO: 6618)
HSLDHAR_PEA_3_node_20 (SEQ ID NO: 6619)
HSLDHAR_PEA_3_node_21 (SEQ ID NO: 6620)
HSLDHAR_PEA_3_node_25 (SEQ ID NO: 6621)
HSLDHAR_PEA_3_node_38 (SEQ IDNO: 6622)
HSLDHAR_PEA_3_node_41 (SEQ ID NO: 6623)
HSLDHAR_PEA_3_node_49 (SEQ ID NO: 6624)
HSLDHAR_PEA_3_node_59 (SEQ ID NO: 6625)
HSLDHAR_PEA_3_node_60 (SEQ ID NO: 6626)
HSLDHAR_PEA_3_node_1 (SEQ ID NO: 6627)
HSLDHAR_PEA_3_node_15 (SEQ ID NO: 6628)
HSLDHAR_PEA_3_node_16 (SEQ ID NO: 6629)
HSLDHAR_PEA_3_node_22 (SEQ ID NO: 6630)
HSLDHAR_PEA_3_node_23 (SEQ ID NO: 6631)
HSLDHAR_PEA_3_node_26 (SEQ ID NO: 6632)
HSLDHAR_PEA_3_node_27 (SEQ ID NO: 6633)
HSLDHAR_PEA_3_node_28 (SEQ ID NO: 6634)
HSLDHAR_PEA_3_node_29 (SEQ ID NO: 6635)
HSLDHAR_PEA_3_node_30 (SEQ ID NO: 6636)
HSLDHAR_PEA_3_node_33 (SEQ ID NO: 6637)
HSLDHAR_PEA_3_node_34 (SEQ ID NO: 6638)
HSLDHAR_PEA_3_node_35 (SEQ ID NO: 6639)
HSLDHAR_PEA_3_node_37 (SEQ ID NO: 6640)
HSLDHAR_PEA_3_node_42 (SEQ ID NO: 6641)
HSLDHAR_PEA_3_node_47 (SEQ ID NO: 6642)
HSLDHAR_PEA_3_node_48 (SEQ ID NO: 6643)
HSLDHAR_PEA_3_node_50 (SEQ ID NO: 6644)
HSLDHAR_PEA_3_node_51 (SEQ ID NO: 6645)
HSLDHAR_PEA_3_node_52 (SEQ ID NO: 6646)
HSLDHAR_PEA_3_node_53 (SEQ ID NO: 6647)
HSLDHAR_PEA_3_node_54 (SEQ ID NO: 6648)
HSLDHAR_PEA_3_node_55 (SEQ ID NO: 6649)
HSLDHAR_PEA_3_node_57 (SEQ ID NO: 6650)
HSLDHAR_PEA_3_node_58 (SEQ ID NO: 6651)

TABLE 6269

Proteins of interest

| Protein Name | Corresponding Transcript(s) |
| --- | --- |
| HSLDHAR_PEA_3_P2 | HSLDHAR_PEA_3_T0 (SEQ ID NO: 4372); HSLDHAR_PEA_3_T1 (SEQ ID NO: 4373); HSLDHAR_PEA_3_T3 (SEQ ID NO: 4375); HSLDHAR_PEA_3_T7 (SEQ ID NO: 4378) |
| HSLDHAR_PEA_3_P4 | HSLDHAR_PEA_3_T11 (SEQ ID NO: 4379) |
| HSLDHAR_PEA_3_P6 | HSLDHAR_PEA_3_T22 (SEQ ID NO: 4384) |
| HSLDHAR_PEA_3_P7 | HSLDHAR_PEA_3_T20 (SEQ ID NO: 4382) |
| HSLDHAR_PEA_3_P8 | HSLDHAR_PEA_3_T21 (SEQ ID NO: 4383) |
| HSLDHAR_PEA_3_P11 | HSLDHAR_PEA_3_T25 (SEQ ID NO: 4385) |
| HSLDHAR_PEA_3_P14 | HSLDHAR_PEA_3_T28 (SEQ ID NO: 4386) |
| HSLDHAR_PEA_3_P15 | HSLDHAR_PEA_3_T29 (SEQ ID NO: 4387) |
| HSLDHAR_PEA_3_P19 | HSLDHAR_PEA_3_T34 (SEQ ID NO: 4388) |
| HSLDHAR_PEA_3_P22 | HSLDHAR_PEA_3_T37 (SEQ ID NO: 4389) |
| HSLDHAR_PEA_3_P27 | HSLDHAR_PEA_3_T2 (SEQ ID NO: 4374); HSLDHAR_PEA_3_T4 (SEQ ID NO: 4376); HSLDHAR_PEA_3_T5 (SEQ ID NO: 4377) |
| HSLDHAR_PEA_3_P28 | HSLDHAR_PEA_3_T13 (SEQ ID NO: 4380) |
| HSLDHAR_PEA_3_P29 | HSLDHAR_PEA_3_T19 (SEQ ID NO: 4381) |

These sequences are variants of the known protein L-lactate dehydrogenase A chain (SwissProt accession identifier LDHA_HUMAN; known also according to the synonyms EC 1.1.1.27; LDH-A; LDH muscle subunit; LDH-M), referred to herein as the previously known protein.

The sequence for protein L-lactate dehydrogenase A chain is given at the end of the application, as "L-lactate dehydrogenase A chain amino acid sequence". Known polymorphisms for this sequence are as shown in Table 6270.

TABLE 6270

| SNP position(s) on amino acid sequence | Comment |
| --- | --- |
| 221 | K -> E./FTId=VAR_004180. |
| 314 | R -> C (in LDHA deficiency)./ FTId=VAR_004181. |

Protein L-lactate dehydrogenase A chain localization is believed to be Cytoplasmic.

The following GO Annotation(s) apply to the previously known protein. The following annotation(s) were found: L-lactate dehydrogenase, which are annotation(s) related to Molecular Function; and cytosol, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSLDHAR can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 147 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 147 and Table 6271. This cluster is overexpressed (at least at a minimum level) in the following pathological conditions: a mixture of malignant tumors from different tissues, ovarian carcinoma and gastric carcinoma.

TABLE 6271

Normal tissue distribution

| Name of Tissue | Number |
| --- | --- |
| adrenal | 500 |
| bladder | 738 |
| bone | 1020 |
| brain | 362 |
| colon | 535 |
| epithelial | 515 |
| general | 514 |
| head and neck | 233 |
| kidney | 399 |
| liver | 502 |
| lung | 602 |
| lymph nodes | 380 |
| breast | 532 |
| bone marrow | 784 |
| muscle | 420 |
| ovary | 58 |
| pancreas | 133 |
| prostate | 237 |
| skin | 728 |
| stomach | 623 |
| T cells | 1393 |
| Thyroid | 0 |
| uterus | 536 |

TABLE 6272

P values and ratios for expression in cancerous tissue

| Name of Tissue | P1 | P2 | SP1 | R3 | SP2 | R4 |
| --- | --- | --- | --- | --- | --- | --- |
| adrenal | 5.6e−01 | 5.3e−01 | 7.7e−01 | 0.8 | 4.9e−01 | 0.7 |
| bladder | 5.4e−01 | 6.0e−01 | 9.0e−01 | 0.6 | 9.2e−01 | 0.5 |
| bone | 2.9e−01 | 2.1e−01 | 1 | 0.3 | 7.4e−01 | 0.7 |
| brain | 6.7e−01 | 6.5e−01 | 1 | 0.4 | 5.6e−01 | 0.7 |
| colon | 5.7e−02 | 3.0e−02 | 4.8e−02 | 1.3 | 1.1e−01 | 1.2 |
| epithelial | 2.1e−01 | 1.5e−02 | 2.6e−01 | 1.0 | 2.3e−49 | 2.0 |
| general | 1.5e−01 | 4.4e−04 | 2.4e−01 | 0.9 | 9.8e−80 | 1.8 |
| head and neck | 3.7e−01 | 2.7e−01 | 2.8e−01 | 1.8 | 6.1e−02 | 1.5 |
| kidney | 5.8e−01 | 6.2e−01 | 3.3e−05 | 1.8 | 1.2e−05 | 1.9 |
| liver | 5.5e−01 | 1.3e−02 | 8.1e−01 | 0.7 | 2.3e−08 | 2.2 |
| lung | 6.3e−01 | 7.2e−01 | 9.8e−01 | 0.6 | 3.5e−01 | 0.8 |
| lymph nodes | 4.8e−01 | 1.8e−01 | 3.4e−01 | 0.7 | 2.2e−03 | 1.2 |
| breast | 3.8e−01 | 3.1e−01 | 7.6e−01 | 0.7 | 3.6e−02 | 0.7 |
| bone marrow | 5.0e−01 | 7.2e−01 | 1 | 0.0 | 9.9e−01 | 0.4 |
| muscle | 4.2e−01 | 3.5e−01 | 5.5e−01 | 1.0 | 7.3e−01 | 0.4 |
| ovary | 5.1e−02 | 3.2e−02 | 2.2e−06 | 5.4 | 6.4e−07 | 5.6 |
| pancreas | 2.9e−02 | 2.3e−02 | 5.4e−07 | 2.7 | 4.7e−10 | 3.0 |
| prostate | 7.9e−01 | 7.1e−01 | 8.2e−01 | 0.6 | 1.2e−01 | 1.1 |
| skin | 3.2e−01 | 5.7e−01 | 3.2e−01 | 0.2 | 1.5e−02 | 0.6 |
| stomach | 3.2e−01 | 1.4e−02 | 8.7e−01 | 0.4 | 2.8e−38 | 5.8 |
| T cells | 1 | 1 | 7.2e−01 | 0.9 | 8.3e−01 | 0.4 |
| Thyroid | 2.9e−01 | 2.9e−01 | 2.0e−01 | 2.3 | 2.0e−01 | 2.3 |
| uterus | 2.5e−01 | 2.0e−01 | 9.2e−01 | 0.6 | 1.5e−03 | 1.2 |

As noted above, cluster HSLDHAR features 40 segment(s), which were listed in Table 6268 above and for which the sequence(s) are given at the end of the application. These segment(s) are portions of nucleic acid sequence(s) which are described herein separately because they are of particular interest. A description of each segment according to the present invention is now provided.

Segment cluster HSLDHAR_PEA_3_node_0 (SEQ ID NO:6612) according to the present invention is supported by 160 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6273 below describes the starting and ending position of this segment on each transcript.

TABLE 6273

Segment location on transcripts

| Transcript name | Segment starting position | Segment ending position |
| --- | --- | --- |
| HSLDHAR_PEA_3_T0 (SEQ ID NO: 4372) | 1 | 252 |
| HSLDHAR_PEA_3_T1 (SEQ ID NO: 4373) | 1 | 252 |
| HSLDHAR_PEA_3_T3 (SEQ ID NO: 4375) | 1 | 252 |
| HSLDHAR_PEA_3_T4 (SEQ ID NO: 4376) | 1 | 252 |
| HSLDHAR_PEA_3_T5 (SEQ ID NO: 4377) | 1 | 252 |
| HSLDHAR_PEA_3_T7 (SEQ ID NO: 4378) | 1 | 252 |
| HSLDHAR_PEA_3_T13 (SEQ ID NO: 4380) | 1 | 252 |
| HSLDHAR_PEA_3_T19 (SEQ ID NO: 4381) | 1 | 252 |
| HSLDHAR_PEA_3_T20 (SEQ ID NO: 4382) | 1 | 252 |
| HSLDHAR_PEA_3_T21 (SEQ ID NO: 4383) | 1 | 252 |
| HSLDHAR_PEA_3_T25 (SEQ ID NO: 4385) | 1 | 252 |
| HSLDHAR_PEA_3_T28 (SEQ ID NO: 4386) | 1 | 252 |
| HSLDHAR_PEA_3_T29 (SEQ ID NO: 4387) | 1 | 252 |
| HSLDHAR_PEA_3_T34 (SEQ ID NO: 4388) | 1 | 252 |
| HSLDHAR_PEA_3_T37 (SEQ ID NO: 4389) | 1 | 252 |

This segment can be found in a non-coding region of transcript(s) that are related to the following protein(s): HSLDHAR_PEA_3_P2, HSLDHAR_PEA_3_P27, HSLDHAR_PEA_3_P28, HSLDHAR_PEA_3_P29, HSLDHAR_PEA_3_P7, HSLDHAR_PEA_3_P8, HSLDHAR_PEA_3_P11, HSLDHAR_PEA_3_P14, HSLDHAR_PEA_3_P15, HSLDHAR_PEA_3_P19 and HSLDHAR_PEA_3_P22.

Segment cluster HSLDHAR_PEA_3_node_2 (SEQ ID NO:6613) according to the present invention is supported by 3 libraries. The number of libraries was determined as previously described. This segment can be found in the following transcript(s): HSLDHAR_PEA_3_T3 (SEQ ID NO:4375) and HSLDHAR_PEA_3_T4 (SEQ ID NO:4376). Table 6274 below describes the starting and ending position of this segment on each transcript.

TABLE 6274

| | Segment location on transcripts | |
|---|---|---|
| Transcript name | Segment starting position | Segment ending position |
| HSLDHAR_PEA_3_T3 (SEQ ID NO: 4375) | 258 | 502 |
| HSLDHAR_PEA_3_T4 (SEQ ID NO: 4376) | 258 | 502 |

This segment can be found in a non-coding region of transcript(s) that are related to the following protein(s): HSLDHAR_PEA_3_P2 and HSLDHAR_PEA_3_P27.

Segment cluster HSLDHAR_PEA_3_node_4 (SEQ ID NO:6614) according to the present invention is supported by 18 libraries. The number of libraries was determined as previously described. This segment can be found in the following transcript(s): HSLDHAR_PEA_3_T2 (SEQ ID NO:4374). Table 6275 below describes the starting and ending position of this segment on each transcript.

TABLE 6275

| | Segment location on transcripts | |
|---|---|---|
| Transcript name | Segment starting position | Segment ending position |
| HSLDHAR_PEA_3_T2 (SEQ ID NO: 4374) | 1 | 1152 |

This segment can be found in a non-coding region of transcript(s) that are related to the following protein(s): HSLDHAR_PEA_3_P27.

Segment cluster HSLDHAR_PEA_3_node_5 (SEQ ID NO:6615) according to the present invention is supported by 21 libraries. The number of libraries was determined as previously described. This segment can be found in the following transcript(s): HSLDHAR_PEA_3_T2 (SEQ ID NO:4374), HSLDHAR_PEA_3_T4 (SEQ ID NO:4376) and HSLDHAR_PEA_3_T5 (SEQ ID NO:4377). Table 6276 below describes the starting and ending position of this segment on each transcript.

TABLE 6276

| | Segment location on transcripts | |
|---|---|---|
| Transcript name | Segment starting position | Segment ending position |
| HSLDHAR_PEA_3_T2 (SEQ ID NO: 4374) | 1153 | 1283 |
| HSLDHAR_PEA_3_T4 (SEQ ID NO: 4376) | 503 | 633 |
| HSLDHAR_PEA_3_T5 (SEQ ID NO: 4377) | 253 | 383 |

This segment can be found in a non-coding region of transcript(s) that are related to the following protein(s): HSLDHAR_PEA_3_P27.

Segment cluster HSLDHAR_PEA_3_node_7 (SEQ ID NO:6616) according to the present invention is supported by 240 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6277 below describes the starting and ending position of this segment on each transcript.

TABLE 6277

| | Segment location on transcripts | |
|---|---|---|
| Transcript name | Segment starting position | Segment ending position |
| HSLDHAR_PEA_3_T0 (SEQ ID NO: 4372) | 253 | 402 |
| HSLDHAR_PEA_3_T1 (SEQ ID NO: 4373) | 253 | 402 |
| HSLDHAR_PEA_3_T2 (SEQ ID NO: 4374) | 1284 | 1433 |
| HSLDHAR_PEA_3_T3 (SEQ ID NO: 4375) | 503 | 652 |
| HSLDHAR_PEA_3_T4 (SEQ ID NO: 4376) | 634 | 783 |
| HSLDHAR_PEA_3_T5 (SEQ ID NO: 4377) | 384 | 533 |
| HSLDHAR_PEA_3_T7 (SEQ ID NO: 4378) | 258 | 407 |
| HSLDHAR_PEA_3_T13 (SEQ ID NO: 4380) | 253 | 402 |
| HSLDHAR_PEA_3_T19 (SEQ ID NO: 4381) | 253 | 402 |
| HSLDHAR_PEA_3_T20 (SEQ ID NO: 4382) | 253 | 402 |
| HSLDHAR_PEA_3_T21 (SEQ ID NO: 4383) | 253 | 402 |
| HSLDHAR_PEA_3_T25 (SEQ ID NO: 4385) | 253 | 402 |
| HSLDHAR_PEA_3_T28 (SEQ ID NO: 4386) | 253 | 402 |
| HSLDHAR_PEA_3_T29 (SEQ ID NO: 4387) | 253 | 402 |
| HSLDHAR_PEA_3_T34 (SEQ ID | 253 | 402 |

TABLE 6277-continued

Segment location on transcripts

| Transcript name | Segment starting position | Segment ending position |
|---|---|---|
| NO: 4388) | | |
| HSLDHAR_PEA_3_T37 (SEQ ID NO: 4389) | 253 | 402 |

This segment can be found in the following protein(s): HSLDHAR_PEA_3_P2, HSLDHAR_PEA_3_P27, HSLDHAR_PEA_3_P28, HSLDHAR_PEA_3_P29, HSLDHAR_PEA_3_P7, HSLDHAR_PEA_3_P8, HSLDHAR_PEA_3_P11, HSLDHAR_PEA_3_P14, HSLDHAR_PEA_3_P15, HSLDHAR_PEA_3_P19 and HSLDHAR_PEA_3_P22.

Segment cluster HSLDHAR_PEA_3_node_12 (SEQ ID NO:6617) according to the present invention is supported by 3 libraries. The number of libraries was determined as previously described. This segment can be found in the following transcript(s): HSLDHAR_PEA_3_T11 (SEQ ID NO:4379). Table 6278 below describes the starting and ending position of this segment on each transcript.

TABLE 6278

Segment location on transcripts

| Transcript name | Segment starting position | Segment ending position |
|---|---|---|
| HSLDHAR_PEA_3_T11 (SEQ ID NO: 4379) | 1 | 125 |

This segment can be found in the following protein(s): HSLDHAR_PEA_3_P4.

Segment cluster HSLDHAR_PEA_3_node_17 (SEQ ID NO:6618) according to the present invention is supported by 21 libraries. The number of libraries was determined as previously described. This segment can be found in the following transcript(s): HSLDHAR_PEA_3_T13 (SEQ ID NO:4380) and HSLDHAR_PEA_3_T37 (SEQ ID NO:4389). Table 6279 below describes the starting and ending position of this segment on each transcript.

TABLE 6279

Segment location on transcripts

| Transcript name | Segment starting position | Segment ending position |
|---|---|---|
| HSLDHAR_PEA_3_T13 (SEQ ID NO: 4380) | 521 | 1416 |
| HSLDHAR_PEA_3_T37 (SEQ ID NO: 4389) | 521 | 1416 |

This segment can be found in the following protein(s): HSLDHAR_PEA_3_P28 and HSLDHAR_PEA_3_P22.

Segment cluster HSLDHAR_PEA_3_node_20 (SEQ ID NO:6619) according to the present invention is supported by 15 libraries. The number of libraries was determined as previously described. This segment can be found in the following transcript(s): HSLDHAR_PEA_3_T13 (SEQ ID NO:4380) and HSLDHAR_PEA_3_T37 (SEQ ID NO:4389). Table 6280 below describes the starting and ending position of this segment on each transcript.

TABLE 6280

Segment location on transcripts

| Transcript name | Segment starting position | Segment ending position |
|---|---|---|
| HSLDHAR_PEA_3_T13 (SEQ ID NO: 4380) | 1417 | 1773 |
| HSLDHAR_PEA_3_T37 (SEQ ID NO: 4389) | 1417 | 1773 |

This segment can be found in a non-coding region of transcript(s) that are related to the following protein(s): HSLDHAR_PEA_3_P28 and HSLDHAR_PEA_3_P22.

Segment cluster HSLDHAR_PEA_3_node_21 (SEQ ID NO:6620) according to the present invention is supported by 335 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6281 below describes the starting and ending position of this segment on each transcript.

TABLE 6281

Segment location on transcripts

| Transcript name | Segment starting position | Segment ending position |
|---|---|---|
| HSLDHAR_PEA_3_T0 (SEQ ID NO: 4372) | 521 | 653 |
| HSLDHAR_PEA_3_T1 (SEQ ID NO: 4373) | 521 | 653 |
| HSLDHAR_PEA_3_T2 (SEQ ID NO: 4374) | 1552 | 1684 |
| HSLDHAR_PEA_3_T3 (SEQ ID NO: 4375) | 771 | 903 |
| HSLDHAR_PEA_3_T4 (SEQ ID NO: 4376) | 902 | 1034 |
| HSLDHAR_PEA_3_T5 (SEQ ID NO: 4377) | 652 | 784 |
| HSLDHAR_PEA_3_T7 (SEQ ID NO: 4378) | 526 | 658 |
| HSLDHAR_PEA_3_T11 (SEQ ID NO: 4379) | 244 | 376 |
| HSLDHAR_PEA_3_T13 (SEQ ID NO: 4380) | 1774 | 1906 |
| HSLDHAR_PEA_3_T19 (SEQ ID NO: 4381) | 403 | 535 |
| HSLDHAR_PEA_3_T20 (SEQ ID NO: 4382) | 521 | 653 |
| HSLDHAR_PEA_3_T25 (SEQ ID NO: 4385) | 521 | 653 |
| HSLDHAR_PEA_3_T28 (SEQ ID NO: 4386) | 521 | 653 |
| HSLDHAR_PEA_3_T29 (SEQ ID NO: 4387) | 521 | 653 |
| HSLDHAR_PEA_3_T34 (SEQ ID NO: 4388) | 521 | 653 |
| HSLDHAR_PEA_3_T37 (SEQ ID NO: 4389) | 1774 | 1906 |

This segment can be found in both coding and non-coding regions of transcript(s) as follows. The segment can be found in a non-coding region of transcript(s) that are related to the following protein(s): HSLDHAR_PEA_3_P28 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P29, HSLDHAR_PEA_3_P7, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_25 (SEQ ID NO:6621) according to the present invention is supported by 3 libraries. The number of libraries was determined as previously described. This segment can be found in the following transcript(s): HSLDHAR_PEA_3_T22 (SEQ ID NO:4384). Table 6282 below describes the starting and ending position of this segment on each transcript.

TABLE 6282

Segment location on transcripts

| Transcript name | Segment starting position | Segment ending position |
|---|---|---|
| HSLDHAR_PEA_3_T22 (SEQ ID NO: 4384) | 1 | 305 |

This segment can be found in a non-coding region of transcript(s) that are related to the following protein(s): HSLDHAR_PEA_3_P6.

Segment cluster HSLDHAR_PEA_3_node_38 (SEQ ID NO:6622) according to the present invention is supported by 4 libraries. The number of libraries was determined as previously described. This segment can be found in the following transcript(s): HSLDHAR_PEA_3_T34 (SEQ ID NO:4388) and HSLDHAR_PEA_3_T37 (SEQ ID NO:4389). Table 6283 below describes the starting and ending position of this segment on each transcript.

TABLE 6283

Segment location on transcripts

| Transcript name | Segment starting position | Segment ending position |
|---|---|---|
| HSLDHAR_PEA_3_T34 (SEQ ID NO: 4388) | 987 | 1320 |
| HSLDHAR_PEA_3_T37 (SEQ ID NO: 4389) | 2240 | 2573 |

This segment can be found in both coding and non-coding regions of transcript(s) as follows. The segment can be found in a non-coding region of transcript(s) that are related to the following protein(s): HSLDHAR_PEA_3_P22. This segment can also be found in the following protein(s): HSLDHAR_PEA_3_P19, since it is in the coding region for the corresponding transcript.

Segment cluster HSLDHAR_PEA_3_node_41 (SEQ ID NO:6623) according to the present invention is supported by 321 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383) and HSLDHAR_PEA_3_T22 (SEQ ID NO:4384). Table 6284 below describes the starting and ending position of this segment on each transcript.

TABLE 6284

Segment location on transcripts

| Transcript name | Segment starting position | Segment ending position |
|---|---|---|
| HSLDHAR_PEA_3_T0 (SEQ ID NO: 4372) | 987 | 1110 |
| HSLDHAR_PEA_3_T1 (SEQ ID NO: 4373) | 987 | 1110 |
| HSLDHAR_PEA_3_T2 (SEQ ID NO: 4374) | 2018 | 2141 |
| HSLDHAR_PEA_3_T3 (SEQ ID NO: 4375) | 1237 | 1360 |
| HSLDHAR_PEA_3_T4 (SEQ ID NO: 4376) | 1368 | 1491 |
| HSLDHAR_PEA_3_T5 (SEQ ID NO: 4377) | 1118 | 1241 |
| HSLDHAR_PEA_3_T7 (SEQ ID NO: 4378) | 992 | 1115 |
| HSLDHAR_PEA_3_T11 (SEQ ID NO: 4379) | 710 | 833 |
| HSLDHAR_PEA_3_T13 (SEQ ID NO: 4380) | 2240 | 2363 |
| HSLDHAR_PEA_3_T19 (SEQ ID NO: 4381) | 869 | 992 |
| HSLDHAR_PEA_3_T20 (SEQ ID NO: 4382) | 987 | 1110 |
| HSLDHAR_PEA_3_T21 (SEQ ID NO: 4383) | 813 | 936 |
| HSLDHAR_PEA_3_T22 (SEQ ID NO: 4384) | 598 | 721 |

This segment can be found in both coding and non-coding regions of transcript(s) as follows. The segment can be found in a non-coding region of transcript(s) that are related to the following protein(s): HSLDHAR_PEA_3_P28 and HSLDHAR_PEA_3_P29. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8 and HSLDHAR_PEA_3_P6, since it is in the coding region for the corresponding transcript.

Segment cluster HSLDHAR_PEA_3_node_49 (SEQ ID NO:6624) according to the present invention is supported by 270 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_

3_T29 (SEQ ID NO:4387). Table 6285 below describes the starting and ending position of this segment on each transcript.

TABLE 6285

Segment location on transcripts

| Transcript name | Segment starting position | Segment ending position |
|---|---|---|
| HSLDHAR_PEA_3_T0 (SEQ ID NO: 4372) | 1233 | 1366 |
| HSLDHAR_PEA_3_T1 (SEQ ID NO: 4373) | 1233 | 1366 |
| HSLDHAR_PEA_3_T2 (SEQ ID NO: 4374) | 2264 | 2397 |
| HSLDHAR_PEA_3_T3 (SEQ ID NO: 4375) | 1483 | 1616 |
| HSLDHAR_PEA_3_T4 (SEQ ID NO: 4376) | 1614 | 1747 |
| HSLDHAR_PEA_3_T5 (SEQ ID NO: 4377) | 1364 | 1497 |
| HSLDHAR_PEA_3_T7 (SEQ ID NO: 4378) | 1238 | 1371 |
| HSLDHAR_PEA_3_T11 (SEQ ID NO: 4379) | 956 | 1089 |
| HSLDHAR_PEA_3_T13 (SEQ ID NO: 4380) | 2486 | 2619 |
| HSLDHAR_PEA_3_T19 (SEQ ID NO: 4381) | 1115 | 1248 |
| HSLDHAR_PEA_3_T20 (SEQ ID NO: 4382) | 1237 | 1370 |
| HSLDHAR_PEA_3_T21 (SEQ ID NO: 4383) | 1059 | 1192 |
| HSLDHAR_PEA_3_T22 (SEQ ID NO: 4384) | 844 | 977 |
| HSLDHAR_PEA_3_T25 (SEQ ID NO: 4385) | 1109 | 1242 |
| HSLDHAR_PEA_3_T28 (SEQ ID NO: 4386) | 987 | 1120 |
| HSLDHAR_PEA_3_T29 (SEQ ID NO: 4387) | 964 | 1097 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29, HSLDHAR_PEA_3_P7 and HSLDHAR_PEA_3_P11. This segment can also be found in the following protein(s): HSLDHAR_PEA_3_P2, HSLDHAR_PEA_3_P27, HSLDHAR_PEA_3_P4, HSLDHAR_PEA_3_P8, HSLDHAR_PEA_3_P6, HSLDHAR_PEA_3_P14 and HSLDHAR_PEA_3_P15, since it is in the coding region for the corresponding transcript.

Segment cluster HSLDHAR_PEA_3_node_59 (SEQ ID NO:6625) according to the present invention is supported by 238 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6286 below describes the starting and ending position of this segment on each transcript.

TABLE 6286

Segment location on transcripts

| Transcript name | Segment starting position | Segment ending position |
|---|---|---|
| HSLDHAR_PEA_3_T0 (SEQ ID NO: 4372) | 1700 | 1820 |
| HSLDHAR_PEA_3_T1 (SEQ ID NO: 4373) | 1700 | 1820 |
| HSLDHAR_PEA_3_T2 (SEQ ID NO: 4374) | 2731 | 2851 |
| HSLDHAR_PEA_3_T3 (SEQ ID NO: 4375) | 1950 | 2070 |
| HSLDHAR_PEA_3_T4 (SEQ ID NO: 4376) | 2081 | 2201 |
| HSLDHAR_PEA_3_T5 (SEQ ID NO: 4377) | 1831 | 1951 |
| HSLDHAR_PEA_3_T7 (SEQ ID NO: 4378) | 1705 | 1825 |
| HSLDHAR_PEA_3_T11 (SEQ ID NO: 4379) | 1423 | 1543 |
| HSLDHAR_PEA_3_T13 (SEQ ID NO: 4380) | 2953 | 3073 |
| HSLDHAR_PEA_3_T19 (SEQ ID NO: 4381) | 1582 | 1702 |
| HSLDHAR_PEA_3_T20 (SEQ ID NO: 4382) | 1704 | 1824 |
| HSLDHAR_PEA_3_T21 (SEQ ID NO: 4383) | 1526 | 1646 |
| HSLDHAR_PEA_3_T22 (SEQ ID NO: 4384) | 1311 | 1431 |
| HSLDHAR_PEA_3_T25 (SEQ ID NO: 4385) | 1576 | 1696 |
| HSLDHAR_PEA_3_T28 (SEQ ID NO: 4386) | 1454 | 1574 |
| HSLDHAR_PEA_3_T29 (SEQ ID NO: 4387) | 1431 | 1551 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_60 (SEQ ID NO:6626) according to the present invention is supported by 105 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6287 below describes the starting and ending position of this segment on each transcript.

TABLE 6287

Segment location on transcripts

| Transcript name | Segment starting position | Segment ending position |
|---|---|---|
| HSLDHAR_PEA_3_T0 (SEQ ID NO: 4372) | 1821 | 2209 |
| HSLDHAR_PEA_3_T1 (SEQ ID NO: 4373) | 1821 | 2419 |
| HSLDHAR_PEA_3_T2 (SEQ ID NO: 4374) | 2852 | 3240 |
| HSLDHAR_PEA_3_T3 (SEQ ID NO: 4375) | 2071 | 2459 |
| HSLDHAR_PEA_3_T4 (SEQ ID NO: 4376) | 2202 | 2590 |
| HSLDHAR_PEA_3_T5 (SEQ ID NO: 4377) | 1952 | 2340 |
| HSLDHAR_PEA_3_T7 (SEQ ID NO: 4378) | 1826 | 2214 |
| HSLDHAR_PEA_3_T11 (SEQ ID NO: 4379) | 1544 | 1932 |
| HSLDHAR_PEA_3_T13 (SEQ ID NO: 4380) | 3074 | 3462 |
| HSLDHAR_PEA_3_T19 (SEQ ID NO: 4381) | 1703 | 2091 |
| HSLDHAR_PEA_3_T20 (SEQ ID NO: 4382) | 1825 | 2213 |
| HSLDHAR_PEA_3_T21 (SEQ ID NO: 4383) | 1647 | 2035 |
| HSLDHAR_PEA_3_T22 (SEQ ID NO: 4384) | 1432 | 1820 |
| HSLDHAR_PEA_3_T25 (SEQ ID NO: 4385) | 1697 | 2085 |
| HSLDHAR_PEA_3_T28 (SEQ ID NO: 4386) | 1575 | 1963 |
| HSLDHAR_PEA_3_T29 (SEQ ID NO: 4387) | 1552 | 1940 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

According to an optional embodiment of the present invention, short segments related to the above cluster are also provided. These segments are up to about 120 bp in length, and so are included in a separate description.

Segment cluster HSLDHAR_PEA_3_node_1 (SEQ ID NO:6627) according to the present invention can be found in the following transcript(s): HSLDHAR_PEA_3_T3 (SEQ ID NO:4375), HSLDHAR_PEA_3_T4 (SEQ ID NO:4376) and HSLDHAR_PEA_3_T7 (SEQ ID NO:4378). Table 6288 below describes the starting and ending position of this segment on each transcript.

TABLE 6288

Segment location on transcripts

| Transcript name | Segment starting position | Segment ending position |
|---|---|---|
| HSLDHAR_PEA_3_T3 (SEQ ID NO: 4375) | 253 | 257 |
| HSLDHAR_PEA_3_T4 (SEQ ID NO: 4376) | 253 | 257 |
| HSLDHAR_PEA_3_T7 (SEQ ID NO: 4378) | 253 | 257 |

This segment can be found in a non-coding region of transcript(s) that are related to the following protein(s): HSLDHAR_PEA_3_P2 and HSLDHAR_PEA_3_P27.

Segment cluster HSLDHAR_PEA_3_node_15 (SEQ ID NO:6628) according to the present invention is supported by 231 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T20 (SEQ ID NO:4382), HSLDHAR_PEA_3_T21 (SEQ ID NO:4383), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6289 below describes the starting and ending position of this segment on each transcript.

TABLE 6289

Segment location on transcripts

| Transcript name | Segment starting position | Segment ending position |
|---|---|---|
| HSLDHAR_PEA_3_T0 (SEQ ID NO: 4372) | 403 | 453 |
| HSLDHAR_PEA_3_T1 (SEQ ID NO: 4373) | 403 | 453 |
| HSLDHAR_PEA_3_T2 (SEQ ID NO: 4374) | 1434 | 1484 |
| HSLDHAR_PEA_3_T3 (SEQ ID NO: 4375) | 653 | 703 |
| HSLDHAR_PEA_3_T4 (SEQ ID NO: 4376) | 784 | 834 |
| HSLDHAR_PEA_3_T5 (SEQ ID NO: 4377) | 534 | 584 |
| HSLDHAR_PEA_3_T7 (SEQ ID NO: 4378) | 408 | 458 |
| HSLDHAR_PEA_3_T11 (SEQ ID NO: 4379) | 126 | 176 |
| HSLDHAR_PEA_3_T13 (SEQ ID NO: 4380) | 403 | 453 |
| HSLDHAR_PEA_3_T20 (SEQ ID NO: 4382) | 403 | 453 |
| HSLDHAR_PEA_3_T21 (SEQ ID NO: 4383) | 403 | 453 |
| HSLDHAR_PEA_3_T25 (SEQ ID NO: 4385) | 403 | 453 |
| HSLDHAR_PEA_3_T28 (SEQ ID NO: 4386) | 403 | 453 |
| HSLDHAR_PEA_3_T29 (SEQ ID NO: 4387) | 403 | 453 |
| HSLDHAR_PEA_3_T34 (SEQ ID NO: 4388) | 403 | 453 |
| HSLDHAR_PEA_3_T37 (SEQ ID NO: 4389) | 403 | 453 |

This segment can be found in the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P7, HSLDHAR_PEA_3_P8, HSLDHAR_PEA_3_P11, HSLDHAR_PEA_3_P14, HSLDHAR_PEA_3_P15, HSLDHAR_PEA_3_P19 and HSLDHAR_PEA_3_P22.

Segment cluster HSLDHAR_PEA_3_node_16 (SEQ ID NO:6629) according to the present invention is supported by 235 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T20 (SEQ ID NO:4382), HSLDHAR_PEA_3_T21 (SEQ ID NO:4383), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6290 below describes the starting and ending position of this segment on each transcript.

TABLE 6290

Segment location on transcripts

| Transcript name | Segment starting position | Segment ending position |
| --- | --- | --- |
| HSLDHAR_PEA_3_T0 (SEQ ID NO: 4372) | 454 | 520 |
| HSLDHAR_PEA_3_T1 (SEQ ID NO: 4373) | 454 | 520 |
| HSLDHAR_PEA_3_T2 (SEQ ID NO: 4374) | 1485 | 1551 |
| HSLDHAR_PEA_3_T3 (SEQ ID NO: 4375) | 704 | 770 |
| HSLDHAR_PEA_3_T4 (SEQ ID NO: 4376) | 835 | 901 |
| HSLDHAR_PEA_3_T5 (SEQ ID NO: 4377) | 585 | 651 |
| HSLDHAR_PEA_3_T7 (SEQ ID NO: 4378) | 459 | 525 |
| HSLDHAR_PEA_3_T11 (SEQ ID NO: 4379) | 177 | 243 |
| HSLDHAR_PEA_3_T13 (SEQ ID NO: 4380) | 454 | 520 |
| HSLDHAR_PEA_3_T20 (SEQ ID NO: 4382) | 454 | 520 |
| HSLDHAR_PEA_3_T21 (SEQ ID NO: 4383) | 454 | 520 |
| HSLDHAR_PEA_3_T25 (SEQ ID NO: 4385) | 454 | 520 |
| HSLDHAR_PEA_3_T28 (SEQ ID NO: 4386) | 454 | 520 |
| HSLDHAR_PEA_3_T29 (SEQ ID NO: 4387) | 454 | 520 |
| HSLDHAR_PEA_3_T34 (SEQ ID NO: 4388) | 454 | 520 |
| HSLDHAR_PEA_3_T37 (SEQ ID NO: 4389) | 454 | 520 |

This segment can be found in the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P7, HSLDHAR_PEA_3_P8, HSLDHAR_PEA_3_P11, HSLDHAR_PEA_3_P14, HSLDHAR_PEA_3_P15, HSLDHAR_PEA_3_P19 and HSLDHAR_PEA_3_P22.

Segment cluster HSLDHAR_PEA_3_node_22 (SEQ ID NO:6630) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6291 below describes the starting and ending position of this segment on each transcript.

TABLE 6291

Segment location on transcripts

| Transcript name | Segment starting position | Segment ending position |
| --- | --- | --- |
| HSLDHAR_PEA_3_T0 (SEQ ID NO: 4372) | 654 | 672 |
| HSLDHAR_PEA_3_T1 (SEQ ID NO: 4373) | 654 | 672 |
| HSLDHAR_PEA_3_T2 (SEQ ID NO: 4374) | 1685 | 1703 |
| HSLDHAR_PEA_3_T3 (SEQ ID NO: 4375) | 904 | 922 |
| HSLDHAR_PEA_3_T4 (SEQ ID NO: 4376) | 1035 | 1053 |
| HSLDHAR_PEA_3_T5 (SEQ ID NO: 4377) | 785 | 803 |
| HSLDHAR_PEA_3_T7 (SEQ ID NO: 4378) | 659 | 677 |
| HSLDHAR_PEA_3_T11 (SEQ ID NO: 4379) | 377 | 395 |
| HSLDHAR_PEA_3_T13 (SEQ ID NO: 4380) | 1907 | 1925 |
| HSLDHAR_PEA_3_T19 (SEQ ID NO: 4381) | 536 | 554 |
| HSLDHAR_PEA_3_T20 (SEQ ID NO: 4382) | 654 | 672 |
| HSLDHAR_PEA_3_T25 (SEQ ID NO: 4385) | 654 | 672 |
| HSLDHAR_PEA_3_T28 (SEQ ID NO: 4386) | 654 | 672 |
| HSLDHAR_PEA_3_T29 (SEQ ID NO: 4387) | 654 | 672 |
| HSLDHAR_PEA_3_T34 (SEQ ID NO: 4388) | 654 | 672 |
| HSLDHAR_PEA_3_T37 (SEQ ID NO: 4389) | 1907 | 1925 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_23 (SEQ ID NO:6631) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T1 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6292 below describes the starting and ending position of this segment on each transcript.

TABLE 6292

Segment location on transcripts

| Transcript name | Segment starting position | Segment ending position |
|---|---|---|
| HSLDHAR_PEA_3_T0 (SEQ ID NO: 4372) | 673 | 694 |
| HSLDHAR_PEA_3_T1 (SEQ ID NO: 4373) | 673 | 694 |
| HSLDHAR_PEA_3_T2 (SEQ ID NO: 4374) | 1704 | 1725 |
| HSLDHAR_PEA_3_T3 (SEQ ID NO: 4375) | 923 | 944 |
| HSLDHAR_PEA_3_T4 (SEQ ID NO: 4376) | 1054 | 1075 |
| HSLDHAR_PEA_3_T5 (SEQ ID NO: 4377) | 804 | 825 |
| HSLDHAR_PEA_3_T7 (SEQ ID NO: 4378) | 678 | 699 |
| HSLDHAR_PEA_3_T11 (SEQ ID NO: 4379) | 396 | 417 |
| HSLDHAR_PEA_3_T13 (SEQ ID NO: 4380) | 1926 | 1947 |
| HSLDHAR_PEA_3_T19 (SEQ ID NO: 4381) | 555 | 576 |
| HSLDHAR_PEA_3_T20 (SEQ ID NO: 4382) | 673 | 694 |
| HSLDHAR_PEA_3_T25 (SEQ ID NO: 4385) | 673 | 694 |
| HSLDHAR_PEA_3_T28 (SEQ ID NO: 4386) | 673 | 694 |
| HSLDHAR_PEA_3_T29 (SEQ ID NO: 4387) | 673 | 694 |
| HSLDHAR_PEA_3_T34 (SEQ ID NO: 4388) | 673 | 694 |
| HSLDHAR_PEA_3_T37 (SEQ ID NO: 4389) | 1926 | 1947 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P1, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_26 (SEQ ID NO:6632) according to the present invention is supported by 345 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6293 below describes the starting and ending position of this segment on each transcript.

TABLE 6293

Segment location on transcripts

| Transcript name | Segment starting position | Segment ending position |
|---|---|---|
| HSLDHAR_PEA_3_T0 (SEQ ID NO: 4372) | 695 | 723 |
| HSLDHAR_PEA_3_T1 (SEQ ID NO: 4373) | 695 | 723 |
| HSLDHAR_PEA_3_T2 (SEQ ID NO: 4374) | 1726 | 1754 |
| HSLDHAR_PEA_3_T3 (SEQ ID NO: 4375) | 945 | 973 |
| HSLDHAR_PEA_3_T4 (SEQ ID NO: 4376) | 1076 | 1104 |
| HSLDHAR_PEA_3_T5 (SEQ ID NO: 4377) | 826 | 854 |
| HSLDHAR_PEA_3_T7 (SEQ ID NO: 4378) | 700 | 728 |
| HSLDHAR_PEA_3_T11 (SEQ ID NO: 4379) | 418 | 446 |
| HSLDHAR_PEA_3_T13 (SEQ ID NO: 4380) | 1948 | 1976 |
| HSLDHAR_PEA_3_T19 (SEQ ID NO: 4381) | 577 | 605 |
| HSLDHAR_PEA_3_T20 (SEQ ID NO: 4382) | 695 | 723 |
| HSLDHAR_PEA_3_T21 (SEQ ID NO: 4383) | 521 | 549 |
| HSLDHAR_PEA_3_T22 (SEQ ID NO: 4384) | 306 | 334 |
| HSLDHAR_PEA_3_T25 (SEQ ID NO: 4385) | 695 | 723 |
| HSLDHAR_PEA_3_T28 (SEQ ID NO: 4386) | 695 | 723 |
| HSLDHAR_PEA_3_T29 (SEQ ID NO: 4387) | 695 | 723 |
| HSLDHAR_PEA_3_T34 (SEQ ID NO: 4388) | 695 | 723 |
| HSLDHAR_PEA_3_T37 (SEQ ID NO: 4389) | 1948 | 1976 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29, HSLDHAR_PEA_3_P6 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3P7, HSLDHAR_PEA_3_P8, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_27 (SEQ ID NO:6633) according to the present invention is supported by 384 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR- _PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6294 below describes the starting and ending position of this segment on each transcript.

TABLE 6294

Segment location on transcripts

| Transcript name | Segment starting position | Segment ending position |
| --- | --- | --- |
| HSLDHAR_PEA_3_T0 (SEQ ID NO: 4372) | 724 | 772 |
| HSLDHAR_PEA_3_T1 (SEQ ID NO: 4373) | 724 | 772 |
| HSLDHAR_PEA_3_T2 (SEQ ID NO: 4374) | 1755 | 1803 |
| HSLDHAR_PEA_3_T3 (SEQ ID NO: 4375) | 974 | 1022 |
| HSLDHAR_PEA_3_T4 (SEQ ID NO: 4376) | 1105 | 1153 |
| HSLDHAR_PEA_3_T5 (SEQ ID NO: 4377) | 855 | 903 |
| HSLDHAR_PEA_3_T7 (SEQ ID NO: 4378) | 729 | 777 |
| HSLDHAR_PEA_3_T11 (SEQ ID NO: 4379) | 447 | 495 |
| HSLDHAR_PEA_3_T13 (SEQ ID NO: 4380) | 1977 | 2025 |
| HSLDHAR_PEA_3_T19 (SEQ ID NO: 4381) | 606 | 654 |
| HSLDHAR_PEA_3_T20 (SEQ ID NO: 4382) | 724 | 772 |
| HSLDHAR_PEA_3_T21 (SEQ ID NO: 4383) | 550 | 598 |
| HSLDHAR_PEA_3_T22 (SEQ ID NO: 4384) | 335 | 383 |
| HSLDHAR_PEA_3_T25 (SEQ ID NO: 4385) | 724 | 772 |
| HSLDHAR_PEA_3_T28 (SEQ ID NO: 4386) | 724 | 772 |
| HSLDHAR_PEA_3_T29 (SEQ ID NO: 4387) | 724 | 772 |
| HSLDHAR_PEA_3_T34 (SEQ ID NO: 4388) | 724 | 772 |
| HSLDHAR_PEA_3_T37 (SEQ ID NO: 4389) | 1977 | 2025 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29, HSLDHAR_PEA_3_P6 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_28 (SEQ ID NO:6634) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6295 below describes the starting and ending position of this segment on each transcript.

TABLE 6295

Segment location on transcripts

| Transcript name | Segment starting position | Segment ending position |
| --- | --- | --- |
| HSLDHAR_PEA_3_T0 (SEQ ID NO: 4372) | 773 | 792 |
| HSLDHAR_PEA_3_T1 (SEQ ID NO: 4373) | 773 | 792 |
| HSLDHAR_PEA_3_T2 (SEQ ID NO: 4374) | 1804 | 1823 |
| HSLDHAR_PEA_3_T3 (SEQ ID NO: 4375) | 1023 | 1042 |
| HSLDHAR_PEA_3_T4 (SEQ ID NO: 4376) | 1154 | 1173 |
| HSLDHAR_PEA_3_T5 (SEQ ID NO: 4377) | 904 | 923 |
| HSLDHAR_PEA_3_T7 (SEQ ID NO: 4378) | 778 | 797 |
| HSLDHAR_PEA_3_T11 (SEQ ID NO: 4379) | 496 | 515 |
| HSLDHAR_PEA_3_T13 (SEQ ID NO: 4380) | 2026 | 2045 |
| HSLDHAR_PEA_3_T19 (SEQ ID NO: 4381) | 655 | 674 |
| HSLDHAR_PEA_3_T20 (SEQ ID NO: 4382) | 773 | 792 |
| HSLDHAR_PEA_3_T21 (SEQ ID NO: 4383) | 599 | 618 |
| HSLDHAR_PEA_3_T22 (SEQ ID NO: 4384) | 384 | 403 |
| HSLDHAR_PEA_3_T25 (SEQ ID NO: 4385) | 773 | 792 |
| HSLDHAR_PEA_3_T28 (SEQ ID NO: 4386) | 773 | 792 |
| HSLDHAR_PEA_3_T29 (SEQ ID NO: 4387) | 773 | 792 |
| HSLDHAR_PEA_3_T34 (SEQ ID NO: 4388) | 773 | 792 |
| HSLDHAR_PEA_3_T37 (SEQ ID NO: 4389) | 2026 | 2045 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29, HSLDHAR_PEA_3_P6 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_29 (SEQ ID NO:6635) according to the present invention can be found in the following transcript(s): HSLDHAR_PEA_3_T0 (SEQ ID NO:4372), HSLDHAR_PEA_3T1 (SEQ ID NO:4373), HSLDHAR_PEA_3_T2 (SEQ ID NO:4374), HSLDHAR_

PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_ PEA_ 3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6296 below describes the starting and ending position of this segment on each transcript.

TABLE 6296

Segment location on transcripts

| Transcript name | Segment starting position | Segment ending position |
|---|---|---|
| HSLDHAR_PEA_3_T0 (SEQ ID NO: 4372) | 793 | 801 |
| HSLDHAR_PEA_3_T1 (SEQ ID NO: 4373) | 793 | 801 |
| HSLDHAR_PEA_3_T2 (SEQ ID NO: 4374) | 1824 | 1832 |
| HSLDHAR_PEA_3_T3 (SEQ ID NO: 4375) | 1043 | 1051 |
| HSLDHAR_PEA_3_T4 (SEQ ID NO: 4376) | 1174 | 1182 |
| HSLDHAR_PEA_3_T5 (SEQ ID NO: 4377) | 924 | 932 |
| HSLDHAR_PEA_3_T7 (SEQ ID NO: 4378) | 798 | 806 |
| HSLDHAR_PEA_3_T11 (SEQ ID NO: 4379) | 516 | 524 |
| HSLDHAR_PEA_3_T13 (SEQ ID NO: 4380) | 2046 | 2054 |
| HSLDHAR_PEA_3_T19 (SEQ ID NO: 4381) | 675 | 683 |
| HSLDHAR_PEA_3_T20 (SEQ ID NO: 4382) | 793 | 801 |
| HSLDHAR_PEA_3_T21 (SEQ ID NO: 4383) | 619 | 627 |
| HSLDHAR_PEA_3_T22 (SEQ ID NO: 4384) | 404 | 412 |
| HSLDHAR_PEA_3_T25 (SEQ ID NO: 4385) | 793 | 801 |
| HSLDHAR_PEA_3_T28 (SEQ ID NO: 4386) | 793 | 801 |
| HSLDHAR_PEA_3_T29 (SEQ ID NO: 4387) | 793 | 801 |
| HSLDHAR_PEA_3_T34 (SEQ ID NO: 4388) | 793 | 801 |
| HSLDHAR_PEA_3_T37 (SEQ ID NO: 4389) | 2046 | 2054 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_30 (SEQ ID NO:6636) according to the present invention is supported by 403 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_ PEA_ 3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6297 below describes the starting and ending position of this segment on each transcript.

TABLE 6297

Segment location on transcripts

| Transcript name | Segment starting position | Segment ending position |
|---|---|---|
| HSLDHAR_PEA_3_T0 (SEQ ID NO: 4372) | 802 | 868 |
| HSLDHAR_PEA_3_T1 (SEQ ID NO: 4373) | 802 | 868 |
| HSLDHAR_PEA_3_T2 (SEQ ID NO: 4374) | 1833 | 1899 |
| HSLDHAR_PEA_3_T3 (SEQ ID NO: 4375) | 1052 | 1118 |
| HSLDHAR_PEA_3_T4 (SEQ ID NO: 4376) | 1183 | 1249 |
| HSLDHAR_PEA_3_T5 (SEQ ID NO: 4377) | 933 | 999 |
| HSLDHAR_PEA_3_T7 (SEQ ID NO: 4378) | 807 | 873 |
| HSLDHAR_PEA_3_T11 (SEQ ID NO: 4379) | 525 | 591 |
| HSLDHAR_PEA_3_T13 (SEQ ID NO: 4380) | 2055 | 2121 |
| HSLDHAR_PEA_3_T19 (SEQ ID NO: 4381) | 684 | 750 |
| HSLDHAR_PEA_3_T20 (SEQ ID NO: 4382) | 802 | 868 |
| HSLDHAR_PEA_3_T21 (SEQ ID NO: 4383) | 628 | 694 |
| HSLDHAR_PEA_3_T22 (SEQ ID NO: 4384) | 413 | 479 |
| HSLDHAR_PEA_3_T25 (SEQ ID NO: 4385) | 802 | 868 |
| HSLDHAR_PEA_3_T28 (SEQ ID NO: 4386) | 802 | 868 |
| HSLDHAR_PEA_3_T29 (SEQ ID NO: 4387) | 802 | 868 |
| HSLDHAR_PEA_3_T34 (SEQ ID NO: 4388) | 802 | 868 |
| HSLDHAR_PEA_3_T37 (SEQ ID NO: 4389) | 2055 | 2121 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_33 (SEQ ID NO:6637) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6298 below describes the starting and ending position of this segment on each transcript.

TABLE 6298

Segment location on transcripts

| Transcript name | Segment starting position | Segment ending position |
|---|---|---|
| HSLDHAR_PEA_3_T0 (SEQ ID NO: 4372) | 869 | 877 |
| HSLDHAR_PEA_3_T1 (SEQ ID NO: 4373) | 869 | 877 |
| HSLDHAR_PEA_3_T2 (SEQ ID NO: 4374) | 1900 | 1908 |
| HSLDHAR_PEA_3_T3 (SEQ ID NO: 4375) | 1119 | 1127 |
| HSLDHAR_PEA_3_T4 (SEQ ID NO: 4376) | 1250 | 1258 |
| HSLDHAR_PEA_3_T5 (SEQ ID NO: 4377) | 1000 | 1008 |
| HSLDHAR_PEA_3_T7 (SEQ ID NO: 4378) | 874 | 882 |
| HSLDHAR_PEA_3_T11 (SEQ ID NO: 4379) | 592 | 600 |
| HSLDHAR_PEA_3_T13 (SEQ ID NO: 4380) | 2122 | 2130 |
| HSLDHAR_PEA_3_T19 (SEQ ID NO: 4381) | 751 | 759 |
| HSLDHAR_PEA_3_T20 (SEQ ID NO: 4382) | 869 | 877 |
| HSLDHAR_PEA_3_T21 (SEQ ID NO: 4383) | 695 | 703 |
| HSLDHAR_PEA_3_T22 (SEQ ID NO: 4384) | 480 | 488 |
| HSLDHAR_PEA_3_T25 (SEQ ID NO: 4385) | 869 | 877 |
| HSLDHAR_PEA_3_T28 (SEQ ID NO: 4386) | 869 | 877 |
| HSLDHAR_PEA_3_T29 (SEQ ID NO: 4387) | 869 | 877 |
| HSLDHAR_PEA_3_T34 (SEQ ID NO: 4388) | 869 | 877 |
| HSLDHAR_PEA_3_T37 (SEQ ID NO: 4389) | 2122 | 2130 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_34 (SEQ ID NO:6638) according to the present invention is supported by 381 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6299 below describes the starting and ending position of this segment on each transcript.

TABLE 6299

Segment location on transcripts

| Transcript name | Segment starting position | Segment ending position |
|---|---|---|
| HSLDHAR_PEA_3_T0 (SEQ ID NO: 4372) | 878 | 943 |
| HSLDHAR_PEA_3_T1 (SEQ ID NO: 4373) | 878 | 943 |
| HSLDHAR_PEA_3_T2 (SEQ ID NO: 4374) | 1909 | 1974 |
| HSLDHAR_PEA_3_T3 (SEQ ID NO: 4375) | 1128 | 1193 |
| HSLDHAR_PEA_3_T4 (SEQ ID NO: 4376) | 1259 | 1324 |
| HSLDHAR_PEA_3_T5 (SEQ ID NO: 4377) | 1009 | 1074 |
| HSLDHAR_PEA_3_T7 (SEQ ID NO: 4378) | 883 | 948 |
| HSLDHAR_PEA_3_T11 (SEQ ID NO: 4379) | 601 | 666 |
| HSLDHAR_PEA_3_T13 (SEQ ID NO: 4380) | 2131 | 2196 |
| HSLDHAR_PEA_3_T19 (SEQ ID NO: 4381) | 760 | 825 |
| HSLDHAR_PEA_3_T20 (SEQ ID NO: 4382) | 878 | 943 |
| HSLDHAR_PEA_3_T21 (SEQ ID NO: 4383) | 704 | 769 |
| HSLDHAR_PEA_3_T22 (SEQ ID NO: 4384) | 489 | 554 |
| HSLDHAR_PEA_3_T25 (SEQ ID NO: 4385) | 878 | 943 |
| HSLDHAR_PEA_3_T28 (SEQ ID NO: 4386) | 878 | 943 |
| HSLDHAR_PEA_3_T29 (SEQ ID NO: 4387) | 878 | 943 |
| HSLDHAR_PEA_3_T34 (SEQ ID NO: 4388) | 878 | 943 |
| HSLDHAR_PEA_3_T37 (SEQ ID NO: 4389) | 2131 | 2196 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_35 (SEQ ID NO:6639) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T29 (SEQ ID NO:4387), HSLDHAR_PEA_3_T34 (SEQ ID NO:4388) and HSLDHAR_PEA_3_T37 (SEQ ID NO:4389). Table 6300 below describes the starting and ending position of this segment on each transcript.

TABLE 6300

Segment location on transcripts

| Transcript name | Segment starting position | Segment ending position |
| --- | --- | --- |
| HSLDHAR_PEA_3_T0 (SEQ ID NO: 4372) | 944 | 963 |
| HSLDHAR_PEA_3_T1 (SEQ ID NO: 4373) | 944 | 963 |
| HSLDHAR_PEA_3_T2 (SEQ ID NO: 4374) | 1975 | 1994 |
| HSLDHAR_PEA_3_T3 (SEQ ID NO: 4375) | 1194 | 1213 |
| HSLDHAR_PEA_3_T4 (SEQ ID NO: 4376) | 1325 | 1344 |
| HSLDHAR_PEA_3_T5 (SEQ ID NO: 4377) | 1075 | 1094 |
| HSLDHAR_PEA_3_T7 (SEQ ID NO: 4378) | 949 | 968 |
| HSLDHAR_PEA_3_T11 (SEQ ID NO: 4379) | 667 | 686 |
| HSLDHAR_PEA_3_T13 (SEQ ID NO: 4380) | 2197 | 2216 |
| HSLDHAR_PEA_3_T19 (SEQ ID NO: 4381) | 826 | 845 |
| HSLDHAR_PEA_3_T20 (SEQ ID NO: 4382) | 944 | 963 |
| HSLDHAR_PEA_3_T21 (SEQ ID NO: 4383) | 770 | 789 |
| HSLDHAR_PEA_3_T22 (SEQ ID NO: 4384) | 555 | 574 |
| HSLDHAR_PEA_3_T25 (SEQ ID NO: 4385) | 944 | 963 |
| HSLDHAR_PEA_3_T28 (SEQ ID NO: 4386) | 944 | 963 |
| HSLDHAR_PEA_3_T29 (SEQ ID NO: 4387) | 944 | 963 |
| HSLDHAR_PEA_3_T34 (SEQ ID NO: 4388) | 944 | 963 |
| HSLDHAR_PEA_3_T37 (SEQ ID NO: 4389) | 2197 | 2216 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P11, HSLDHAR_PEA_3_P14, HSLDHAR_PEA_3_P15 and HSLDHAR_PEA_3_P19, since it is in the coding region for the corresponding transcript.

Segment cluster HSLDHAR_PEA_3_node_37 (SEQ ID NO:6640) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386), HSLDHAR_PEA_3_T34 (SEQ ID NO:4388) and HSLDHAR_PEA_3_T37 (SEQ ID NO:4389). Table 6301 below describes the starting and ending position of this segment on each transcript.

TABLE 6301

Segment location on transcripts

| Transcript name | Segment starting position | Segment ending position |
| --- | --- | --- |
| HSLDHAR_PEA_3_T0 (SEQ ID NO: 4372) | 964 | 986 |
| HSLDHAR_PEA_3_T1 (SEQ ID NO: 4373) | 964 | 986 |
| HSLDHAR_PEA_3_T2 (SEQ ID NO: 4374) | 1995 | 2017 |
| HSLDHAR_PEA_3_T3 (SEQ ID NO: 4375) | 1214 | 1236 |
| HSLDHAR_PEA_3_T4 (SEQ ID NO: 4376) | 1345 | 1367 |
| HSLDHAR_PEA_3_T5 (SEQ ID NO: 4377) | 1095 | 1117 |
| HSLDHAR_PEA_3_T7 (SEQ ID NO: 4378) | 969 | 991 |
| HSLDHAR_PEA_3_T11 (SEQ ID NO: 4379) | 687 | 709 |
| HSLDHAR_PEA_3_T13 (SEQ ID NO: 4380) | 2217 | 2239 |
| HSLDHAR_PEA_3_T19 (SEQ ID NO: 4381) | 846 | 868 |
| HSLDHAR_PEA_3_T20 (SEQ ID NO: 4382) | 964 | 986 |
| HSLDHAR_PEA_3_T21 (SEQ ID NO: 4383) | 790 | 812 |
| HSLDHAR_PEA_3_T22 (SEQ ID NO: 4384) | 575 | 597 |
| HSLDHAR_PEA_3_T25 (SEQ ID NO: 4385) | 964 | 986 |
| HSLDHAR_PEA_3_T28 (SEQ ID NO: 4386) | 964 | 986 |
| HSLDHAR_PEA_3_T34 (SEQ ID NO: 4388) | 964 | 986 |
| HSLDHAR_PEA_3_T37 (SEQ ID NO: 4389) | 2217 | 2239 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29 and HSLDHAR_PEA_3_P22. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6, HSLDHAR_PEA_3_P1, HSLDHAR_PEA_3_P14 and HSLDHAR_PEA_3_P19, since it is in the coding region for the corresponding transcript.

Segment cluster HSLDHAR_PEA_3_node_42 (SEQ ID NO:6641) according to the present invention can be found in the following transcript(s): HSLDHAR_PEA_3_T20 (SEQ ID NO:4382). Table 6302 below describes the starting and ending position of this segment on each transcript.

TABLE 6302

| Segment location on transcripts | | |
|---|---|---|
| Transcript name | Segment starting position | Segment ending position |
| HSLDHAR_PEA_3_T20 (SEQ ID NO: 4382) | 1111 | 1114 |

This segment can be found in the following protein(s): HSLDHAR_PEA_3_P7.

Segment cluster HSLDHAR_PEA_3_node_47 (SEQ ID NO:6642) according to the present invention is supported by 255 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384) and HSLDHAR_PEA_3_T25 (SEQ ID NO:4385). Table 6303 below describes the starting and ending position of this segment on each transcript.

TABLE 6303

| Segment location on transcripts | | |
|---|---|---|
| Transcript name | Segment starting position | Segment ending position |
| HSLDHAR_PEA_3_T0 (SEQ ID NO: 4372) | 1111 | 1170 |
| HSLDHAR_PEA_3_T1 (SEQ ID NO: 4373) | 1111 | 1170 |
| HSLDHAR_PEA_3_T2 (SEQ ID NO: 4374) | 2142 | 2201 |
| HSLDHAR_PEA_3_T3 (SEQ ID NO: 4375) | 1361 | 1420 |
| HSLDHAR_PEA_3_T4 (SEQ ID NO: 4376) | 1492 | 1551 |
| HSLDHAR_PEA_3_T5 (SEQ ID NO: 4377) | 1242 | 1301 |
| HSLDHAR_PEA_3_T7 (SEQ ID NO: 4378) | 1116 | 1175 |
| HSLDHAR_PEA_3_T11 (SEQ ID NO: 4379) | 834 | 893 |
| HSLDHAR_PEA_3_T13 (SEQ ID NO: 4380) | 2364 | 2423 |
| HSLDHAR_PEA_3_T19 (SEQ ID NO: 4381) | 993 | 1052 |
| HSLDHAR_PEA_3_T20 (SEQ ID NO: 4382) | 1115 | 1174 |
| HSLDHAR_PEA_3_T21 (SEQ ID NO: 4383) | 937 | 996 |
| HSLDHAR_PEA_3_T22 (SEQ ID NO: 4384) | 722 | 781 |
| HSLDHAR_PEA_3_T25 (SEQ ID NO: 4385) | 987 | 1046 |

This segment can be found in both coding and non-coding regions of transcript(s) as follows. The segment can be found in a non-coding region of transcript(s) that are related to the following protein(s): HSLDHAR_PEA_3_P28 and HSLDHAR_PEA_3_P29. This segment can also be found in the following protein(s): HSLDHAR_PEA_3_P2, HSLDHAR_PEA_3_P27, HSLDHAR_PEA_3_P4, HSLDHAR_PEA_3_P7, HSLDHAR_PEA_3_P8, HSLDHAR_PEA_3_P6 and HSLDHAR_PEA_3_P11, since it is in the coding region for the corresponding transcript.

Segment cluster HSLDHAR_PEA_3_node_48 (SEQ ID NO:6643) according to the present invention is supported by 254 libraries. The number of libraries was determined as previously described. This segment can be found in the following transcript(s): HSLDHAR_PEA_3T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384) and HSLDHAR_PEA_3_T25 (SEQ ID NO:4385). Table 6304 below describes the starting and ending position of this segment on each transcript.

TABLE 6304

| Segment location on transcripts | | |
|---|---|---|
| Transcript name | Segment starting position | Segment ending position |
| HSLDHAR_PEA_3_T0 (SEQ ID NO: 4372) | 1171 | 1232 |
| HSLDHAR_PEA_3_T1 (SEQ ID NO: 4373) | 1171 | 1232 |
| HSLDHAR_PEA_3_T2 (SEQ ID NO: 4374) | 2202 | 2263 |
| HSLDHAR_PEA_3_T3 (SEQ ID NO: 4375) | 1421 | 1482 |
| HSLDHAR_PEA_3_T4 (SEQ ID NO: 4376) | 1552 | 1613 |
| HSLDHAR_PEA_3_T5 (SEQ ID NO: 4377) | 1302 | 1363 |
| HSLDHAR_PEA_3_T7 (SEQ ID NO: 4378) | 1176 | 1237 |
| HSLDHAR_PEA_3_T11 (SEQ ID NO: 4379) | 894 | 955 |

TABLE 6304-continued

Segment location on transcripts

| Transcript name | Segment starting position | Segment ending position |
|---|---|---|
| HSLDHAR_PEA_3_T13 (SEQ ID NO: 4380) | 2424 | 2485 |
| HSLDHAR_PEA_3_T19 (SEQ ID NO: 4381) | 1053 | 1114 |
| HSLDHAR_PEA_3_T20 (SEQ ID NO: 4382) | 1175 | 1236 |
| HSLDHAR_PEA_3_T21 (SEQ ID NO: 4383) | 997 | 1058 |
| HSLDHAR_PEA_3_T22 (SEQ ID NO: 4384) | 782 | 843 |
| HSLDHAR_PEA_3_T25 (SEQ ID NO: 4385) | 1047 | 1108 |

This segment can be found in both coding and non-coding regions of transcript(s) as follows. The segment can be found in a non-coding region of transcript(s) that are related to the following protein(s): HSLDHAR_PEA_3_P28, HSLDHAR_PEA_3_P29, HSLDHAR_PEA_3_P7 and HSLDHAR_PEA_3_P11. This segment can also be found in the following protein(s): HSLDHAR_PEA_3_P2, HSLDHAR_PEA_3_P27, HSLDHAR_PEA_3_P4, HSLDHAR_PEA_3_P8 and HSLDHAR_PEA_3_P6, since it is in the coding region for the corresponding transcript.

Segment cluster HSLDHAR_PEA_3_node_50 (SEQ ID NO:6644) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6305 below describes the starting and ending position of this segment on each transcript.

TABLE 6305

Segment location on transcripts

| Transcript name | Segment starting position | Segment ending position |
|---|---|---|
| HSLDHAR_PEA_3_T0 (SEQ ID NO: 4372) | 1367 | 1372 |
| HSLDHAR_PEA_3_T1 (SEQ ID NO: 4373) | 1367 | 1372 |
| HSLDHAR_PEA_3_T2 (SEQ ID NO: 4374) | 2398 | 2403 |
| HSLDHAR_PEA_3_T3 (SEQ ID NO: 4375) | 1617 | 1622 |
| HSLDHAR_PEA_3_T4 (SEQ ID NO: 4376) | 1748 | 1753 |
| HSLDHAR_PEA_3_T5 (SEQ ID NO: 4377) | 1498 | 1503 |
| HSLDHAR_PEA_3_T7 (SEQ ID NO: 4378) | 1372 | 1377 |

TABLE 6305-continued

Segment location on transcripts

| Transcript name | Segment starting position | Segment ending position |
|---|---|---|
| HSLDHAR_PEA_3_T11 (SEQ ID NO: 4379) | 1090 | 1095 |
| HSLDHAR_PEA_3_T13 (SEQ ID NO: 4380) | 2620 | 2625 |
| HSLDHAR_PEA_3_T19 (SEQ ID NO: 4381) | 1249 | 1254 |
| HSLDHAR_PEA_3_T20 (SEQ ID NO: 4382) | 1371 | 1376 |
| HSLDHAR_PEA_3_T21 (SEQ ID NO: 4383) | 1193 | 1198 |
| HSLDHAR_PEA_3_T22 (SEQ ID NO: 4384) | 978 | 983 |
| HSLDHAR_PEA_3_T25 (SEQ ID NO: 4385) | 1243 | 1248 |
| HSLDHAR_PEA_3_T28 (SEQ ID NO: 4386) | 1121 | 1126 |
| HSLDHAR_PEA_3_T29 (SEQ ID NO: 4387) | 1098 | 1103 |

This segment can be found in both coding and non-coding regions of transcript(s) as follows. The segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11 and HSLDHAR_PEA_3_P14. This segment can also be found in the following protein(s): HSLDHAR_PEA_3_P15, since it is in the coding region for the corresponding transcript.

Segment cluster HSLDHAR_PEA_3_node_51 (SEQ ID NO:6645) according to the present invention is supported by 264 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6306 below describes the starting and ending position of this segment on each transcript.

TABLE 6306

Segment location on transcripts

| Transcript name | Segment starting position | Segment ending position |
|---|---|---|
| HSLDHAR_PEA_3_T0 (SEQ ID NO: 4372) | 1373 | 1449 |
| HSLDHAR_PEA_3_T1 (SEQ ID NO: 4373) | 1373 | 1449 |
| HSLDHAR_PEA_3_T2 (SEQ ID NO: 4374) | 2404 | 2480 |
| HSLDHAR_PEA_3_T3 (SEQ ID NO: 4375) | 1623 | 1699 |

TABLE 6306-continued

Segment location on transcripts

| Transcript name | Segment starting position | Segment ending position |
|---|---|---|
| HSLDHAR_PEA_3_T4 (SEQ ID NO: 4376) | 1754 | 1830 |
| HSLDHAR_PEA_3_T5 (SEQ ID NO: 4377) | 1504 | 1580 |
| HSLDHAR_PEA_3_T7 (SEQ ID NO: 4378) | 1378 | 1454 |
| HSLDHAR_PEA_3_T11 (SEQ ID NO: 4379) | 1096 | 1172 |
| HSLDHAR_PEA_3_T13 (SEQ ID NO: 4380) | 2626 | 2702 |
| HSLDHAR_PEA_3_T19 (SEQ ID NO: 4381) | 1255 | 1331 |
| HSLDHAR_PEA_3_T20 (SEQ ID NO: 4382) | 1377 | 1453 |
| HSLDHAR_PEA_3_T21 (SEQ ID NO: 4383) | 1199 | 1275 |
| HSLDHAR_PEA_3_T22 (SEQ ID NO: 4384) | 984 | 1060 |
| HSLDHAR_PEA_3_T25 (SEQ ID NO: 4385) | 1249 | 1325 |
| HSLDHAR_PEA_3_T28 (SEQ ID NO: 4386) | 1127 | 1203 |
| HSLDHAR_PEA_3_T29 (SEQ ID NO: 4387) | 1104 | 1180 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_52 (SEQ ID NO:6646) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6307 below describes the starting and ending position of this segment on each transcript.

TABLE 6307

Segment location on transcripts

| Transcript name | Segment starting position | Segment ending position |
|---|---|---|
| HSLDHAR_PEA_3_T0 (SEQ ID NO: 4372) | 1450 | 1456 |
| HSLDHAR_PEA_3_T1 (SEQ ID NO: 4373) | 1450 | 1456 |
| HSLDHAR_PEA_3_T2 (SEQ ID NO: 4374) | 2481 | 2487 |

TABLE 6307-continued

Segment location on transcripts

| Transcript name | Segment starting position | Segment ending position |
|---|---|---|
| HSLDHAR_PEA_3_T3 (SEQ ID NO: 4375) | 1700 | 1706 |
| HSLDHAR_PEA_3_T4 (SEQ ID NO: 4376) | 1831 | 1837 |
| HSLDHAR_PEA_3_T5 (SEQ ID NO: 4377) | 1581 | 1587 |
| HSLDHAR_PEA_3_T7 (SEQ ID NO: 4378) | 1455 | 1461 |
| HSLDHAR_PEA_3_T11 (SEQ ID NO: 4379) | 1173 | 1179 |
| HSLDHAR_PEA_3_T13 (SEQ ID NO: 4380) | 2703 | 2709 |
| HSLDHAR_PEA_3_T19 (SEQ ID NO: 4381) | 1332 | 1338 |
| HSLDHAR_PEA_3_T20 (SEQ ID NO: 4382) | 1454 | 1460 |
| HSLDHAR_PEA_3_T21 (SEQ ID NO: 4383) | 1276 | 1282 |
| HSLDHAR_PEA_3_T22 (SEQ ID NO: 4384) | 1061 | 1067 |
| HSLDHAR_PEA_3_T25 (SEQ ID NO: 4385) | 1326 | 1332 |
| HSLDHAR_PEA_3_T28 (SEQ ID NO: 4386) | 1204 | 1210 |
| HSLDHAR_PEA_3_T29 (SEQ ID NO: 4387) | 1181 | 1187 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_53 (SEQ ID NO:6647) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T9 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6308 below describes the starting and ending position of this segment on each transcript.

TABLE 6308

Segment location on transcripts

| Transcript name | Segment starting position | Segment ending position |
|---|---|---|
| HSLDHAR_PEA_3_T0 (SEQ ID NO: 4372) | 1457 | 1477 |
| HSLDHAR_PEA_3_T1 (SEQ ID NO: 4373) | 1457 | 1477 |
| HSLDHAR_PEA_3_T2 (SEQ ID NO: 4374) | 2488 | 2508 |

TABLE 6308-continued

Segment location on transcripts

| Transcript name | Segment starting position | Segment ending position |
|---|---|---|
| HSLDHAR_PEA_3_T3 (SEQ ID NO: 4375) | 1707 | 1727 |
| HSLDHAR_PEA_3_T4 (SEQ ID NO: 4376) | 1838 | 1858 |
| HSLDHAR_PEA_3_T5 (SEQ ID NO: 4377) | 1588 | 1608 |
| HSLDHAR_PEA_3_T7 (SEQ ID NO: 4378) | 1462 | 1482 |
| HSLDHAR_PEA_3_T11 (SEQ ID NO: 4379) | 1180 | 1200 |
| HSLDHAR_PEA_3_T13 (SEQ ID NO: 4380) | 2710 | 2730 |
| HSLDHAR_PEA_3_T19 (SEQ ID NO: 4381) | 1339 | 1359 |
| HSLDHAR_PEA_3_T20 (SEQ ID NO: 4382) | 1461 | 1481 |
| HSLDHAR_PEA_3_T21 (SEQ ID NO: 4383) | 1283 | 1303 |
| HSLDHAR_PEA_3_T22 (SEQ ID NO: 4384) | 1068 | 1088 |
| HSLDHAR_PEA_3_T25 (SEQ ID NO: 4385) | 1333 | 1353 |
| HSLDHAR_PEA_3_T28 (SEQ ID NO: 4386) | 1211 | 1231 |
| HSLDHAR_PEA_3_T29 (SEQ ID NO: 4387) | 1188 | 1208 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_54 (SEQ ID NO:6648) according to the present invention is supported by 276 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6309 below describes the starting and ending position of this segment on each transcript.

TABLE 6309

Segment location on transcripts

| Transcript name | Segment starting position | Segment ending position |
|---|---|---|
| HSLDHAR_PEA_3_T0 (SEQ ID NO: 4372) | 1478 | 1558 |
| HSLDHAR_PEA_3_T1 (SEQ ID NO: 4373) | 1478 | 1558 |
| HSLDHAR_PEA_3_T2 (SEQ ID NO: 4374) | 2509 | 2589 |
| HSLDHAR_PEA_3_T3 (SEQ ID NO: 4375) | 1728 | 1808 |
| HSLDHAR_PEA_3_T4 (SEQ ID NO: 4376) | 1859 | 1939 |
| HSLDHAR_PEA_3_T5 (SEQ ID NO: 4377) | 1609 | 1689 |
| HSLDHAR_PEA_3_T7 (SEQ ID NO: 4378) | 1483 | 1563 |
| HSLDHAR_PEA_3_T11 (SEQ ID NO: 4379) | 1201 | 1281 |
| HSLDHAR_PEA_3_T13 (SEQ ID NO: 4380) | 2731 | 2811 |
| HSLDHAR_PEA_3_T19 (SEQ ID NO: 4381) | 1360 | 1440 |
| HSLDHAR_PEA_3_T20 (SEQ ID NO: 4382) | 1482 | 1562 |
| HSLDHAR_PEA_3_T21 (SEQ ID NO: 4383) | 1304 | 1384 |
| HSLDHAR_PEA_3_T22 (SEQ ID NO: 4384) | 1089 | 1169 |
| HSLDHAR_PEA_3_T25 (SEQ ID NO: 4385) | 1354 | 1434 |
| HSLDHAR_PEA_3_T28 (SEQ ID NO: 4386) | 1232 | 1312 |
| HSLDHAR_PEA_3_T29 (SEQ ID NO: 4387) | 1209 | 1289 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_55 (SEQ ID NO:6649) according to the present invention is supported by 269 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_PEA_3_T28 (SEQ ID NO:4386) and HSLDHAR_PEA_3_T29 (SEQ ID NO:4387). Table 6310 below describes the starting and ending position of this segment on each transcript.

TABLE 6310

Segment location on transcripts

| Transcript name | Segment starting position | Segment ending position |
|---|---|---|
| HSLDHAR_PEA_3_T0 (SEQ ID NO: 4372) | 1559 | 1616 |
| HSLDHAR_PEA_3_T1 (SEQ ID NO: 4373) | 1559 | 1616 |
| HSLDHAR_PEA_3_T2 (SEQ ID NO: 4374) | 2590 | 2647 |
| HSLDHAR_PEA_3_T3 (SEQ ID NO: 4375) | 1809 | 1866 |
| HSLDHAR_PEA_3_T4 (SEQ ID NO: 4376) | 1940 | 1997 |
| HSLDHAR_PEA_3_T5 (SEQ ID NO: 4377) | 1690 | 1747 |
| HSLDHAR_PEA_3_T7 (SEQ ID NO: 4378) | 1564 | 1621 |
| HSLDHAR_PEA_3_T11 (SEQ ID NO: 4379) | 1282 | 1339 |
| HSLDHAR_PEA_3_T13 (SEQ ID NO: 4380) | 2812 | 2869 |
| HSLDHAR_PEA_3_T19 (SEQ ID NO: 4381) | 1441 | 1498 |
| HSLDHAR_PEA_3_T20 (SEQ ID NO: 4382) | 1563 | 1620 |
| HSLDHAR_PEA_3_T21 (SEQ ID NO: 4383) | 1385 | 1442 |
| HSLDHAR_PEA_3_T22 (SEQ ID NO: 4384) | 1170 | 1227 |
| HSLDHAR_PEA_3_T25 (SEQ ID NO: 4385) | 1435 | 1492 |
| HSLDHAR_PEA_3_T28 (SEQ ID NO: 4386) | 1313 | 1370 |
| HSLDHAR_PEA_3_T29 (SEQ ID NO: 4387) | 1290 | 1347 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_57 (SEQ ID NO:6650) according to the present invention is supported by 265 libraries. The number of libraries was determined as previously described. This segment can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_ PEA_ 3_T28 (SEQ ID NO:4386) and HSLDHAR_PEA_3_T29 (SEQ ID NO:4387). Table 6311 below describes the starting and ending position of this segment on each transcript.

TABLE 6311

Segment location on transcripts

| Transcript name | Segment starting position | Segment ending position |
|---|---|---|
| HSLDHAR_PEA_3_T0 (SEQ ID NO: 4372) | 1617 | 1688 |
| HSLDHAR_PEA_3_T1 (SEQ ID NO: 4373) | 1617 | 1688 |
| HSLDHAR_PEA_3_T2 (SEQ ID NO: 4374) | 2648 | 2719 |
| HSLDHAR_PEA_3_T3 (SEQ ID NO: 4375) | 1867 | 1938 |
| HSLDHAR_PEA_3_T4 (SEQ ID NO: 4376) | 1998 | 2069 |
| HSLDHAR_PEA_3_T5 (SEQ ID NO: 4377) | 1748 | 1819 |
| HSLDHAR_PEA_3_T7 (SEQ ID NO: 4378) | 1622 | 1693 |
| HSLDHAR_PEA_3_T11 (SEQ ID NO: 4379) | 1340 | 1411 |
| HSLDHAR_PEA_3_T13 (SEQ ID NO: 4380) | 2870 | 2941 |
| HSLDHAR_PEA_3_T19 (SEQ ID NO: 4381) | 1499 | 1570 |
| HSLDHAR_PEA_3_T20 (SEQ ID NO: 4382) | 1621 | 1692 |
| HSLDHAR_PEA_3_T21 (SEQ ID NO: 4383) | 1443 | 1514 |
| HSLDHAR_PEA_3_T22 (SEQ ID NO: 4384) | 1228 | 1299 |
| HSLDHAR_PEA_3_T25 (SEQ ID NO: 4385) | 1493 | 1564 |
| HSLDHAR_PEA_3_T28 (SEQ ID NO: 4386) | 1371 | 1442 |
| HSLDHAR_PEA_3_T29 (SEQ ID NO: 4387) | 1348 | 1419 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Segment cluster HSLDHAR_PEA_3_node_58 (SEQ ID NO:6651) according to the present invention can be found in the following transcript(s): HSLDHAR_PEA_3_T0 (SEQ ID NO:4372), HSLDHAR_PEA_3_T1 (SEQ ID NO:4373), HSLDHAR_PEA_3_T2 (SEQ ID NO:4374), HSLDHAR_PEA_3_T3 (SEQ ID NO:4375), HSLDHAR_PEA_3_T4 (SEQ ID NO:4376), HSLDHAR_PEA_3_T5 (SEQ ID NO:4377), HSLDHAR_PEA_3_T7 (SEQ ID NO:4378), HSLDHAR_PEA_3_T11 (SEQ ID NO:4379), HSLDHAR_PEA_3_T13 (SEQ ID NO:4380), HSLDHAR_PEA_3_T19 (SEQ ID NO:4381), HSLDHAR_PEA_3_T20 (SEQ ID NO:4382), HSLDHAR_PEA_3_T21 (SEQ ID NO:4383), HSLDHAR_PEA_3_T22 (SEQ ID NO:4384), HSLDHAR_PEA_3_T25 (SEQ ID NO:4385), HSLDHAR_ PEA_ 3_T28 (SEQ ID NO:4386) and HSLDHAR_PEA_3_T29 (SEQ ID NO:4387). Table 6312 below describes the starting and ending position of this segment on each transcript.

TABLE 6312

Segment location on transcripts

| Transcript name | Segment starting position | Segment ending position |
|---|---|---|
| HSLDHAR_PEA_3_T0 (SEQ ID NO: 4372) | 1689 | 1699 |
| HSLDHAR_PEA_3_T1 (SEQ ID NO: 4373) | 1689 | 1699 |
| HSLDHAR_PEA_3_T2 (SEQ ID NO: 4374) | 2720 | 2730 |
| HSLDHAR_PEA_3_T3 (SEQ ID NO: 4375) | 1939 | 1949 |
| HSLDHAR_PEA_3_T4 (SEQ ID NO: 4376) | 2070 | 2080 |
| HSLDHAR_PEA_3_T5 (SEQ ID NO: 4377) | 1820 | 1830 |
| HSLDHAR_PEA_3_T7 (SEQ ID NO: 4378) | 1694 | 1704 |
| HSLDHAR_PEA_3_T11 (SEQ ID NO: 4379) | 1412 | 1422 |
| HSLDHAR_PEA_3_T13 (SEQ ID NO: 4380) | 2942 | 2952 |
| HSLDHAR_PEA_3_T19 (SEQ ID NO: 4381) | 1571 | 1581 |
| HSLDHAR_PEA_3_T20 (SEQ ID NO: 4382) | 1693 | 1703 |
| HSLDHAR_PEA_3_T21 (SEQ ID NO: 4383) | 1515 | 1525 |
| HSLDHAR_PEA_3_T22 (SEQ ID NO: 4384) | 1300 | 1310 |
| HSLDHAR_PEA_3_T25 (SEQ ID NO: 4385) | 1565 | 1575 |
| HSLDHAR_PEA_3_T28 (SEQ ID NO: 4386) | 1443 | 1453 |
| HSLDHAR_PEA_3_T29 (SEQ ID NO: 4387) | 1420 | 1430 |

This segment can be found in a non-coding region of transcript(s) that are related to the following protein(s): HSLDHAR_PEA_3_P2, HSLDHAR_PEA_3_P27, HSLDHAR_PEA_3_P4, HSLDHAR_PEA_3_P28, HSLDHAR_PEA_3_P29, HSLDHAR_PEA_3_P7, HSLDHAR_PEA_3_P8, HSLDHAR_PEA_3_P6, HSLDHAR_PEA_3_P11, HSLDHAR_PEA_3_P14 and HSLDHAR_PEA_3_P15.

Description for Cluster HSPRO204

Cluster HSPRO204 features 2 transcript(s) and 16 segment(s) of interest, the names for which are given in Tables 6313 and 6314, respectively, the sequences themselves are given at the end of the application. The selected protein variants are given in Table 6315.

TABLE 6313

Transcripts of interest

Transcript Name

HSPRO204_PEA_1_T17 (SEQ ID NO: 4390)
HSPRO204_PEA_1_T22 (SEQ ID NO: 4391)

TABLE 6314

Segments of interest

Segment Name

HSPRO204_PEA_1_node_2 (SEQ ID NO: 6652)
HSPRO204_PEA_1_node_20 (SEQ ID NO: 6653)
HSPRO204_PEA_1_node_40 (SEQ ID NO: 6654)
HSPRO204_PEA_1_node_41 (SEQ ID NO: 6655)
HSPRO204_PEA_1_node_0 (SEQ ID NO: 6656)
HSPRO204_PEA_1_node_22 (SEQ ID NO: 6657)
HSPRO204_PEA_1_node_23 (SEQ ID NO: 6658)
HSPRO204_PEA_1_node_24 (SEQ ID NO: 6659)
HSPRO204_PEA_1_node_25 (SEQ ID NO: 6660)
HSPRO204_PEA_1_node_26 (SEQ ID NO: 6661)
HSPRO204_PEA_1_node_30 (SEQ ID NO: 6662)
HSPRO204_PEA_1_node_31 (SEQ ID NO: 6663)
HSPRO204_PEA_1_node_32 (SEQ ID NO: 6664)
HSPRO204_PEA_1_node_33 (SEQ ID NO: 6665)
HSPRO204_PEA_1_node_34 (SEQ ID NO: 6666)
HSPRO204_PEA_1_node_39 (SEQ ID NO: 6667)

TABLE 6315

Proteins of interest

| Protein Name | Corresponding Transcript(s) |
|---|---|
| HSPRO204_PEA_1_P16 | HSPRO204_PEA_1_T17 (SEQ ID NO: 4390) |

These sequences are variants of the known protein Prolactin precursor (SwissProt accession identifier PRL_HUMAN; known also according to the synonyms PRL), referred to herein as the previously known protein.

Protein Prolactin precursor is known or believed to have the following function(s): Prolactin acts primarily on the mammary gland by promoting lactation. The sequence for protein Prolactin precursor is given at the end of the application, as "Prolactin precursor amino acid sequence". Known polymorphisms for this sequence are as shown in Table 6316.

TABLE 6316

Amino acid mutations for Known Protein

| SNP position(s) on amino acid sequence | Comment |
|---|---|
| 42 | T -> A |
| 110-111 | SL -> VS |
| 113-114 | VS -> L |
| 118 | S -> P |
| 148 | E -> Q |
| 172 | N -> D |
| 190-191 | ES -> SE |
| 206 | D -> H |

Protein Prolactin precursor localization is believed to be Secreted.

The previously known protein also has the following indication(s) and/or potential therapeutic use(s): Cancer; Immunodeficiency; Vaccine adjunct. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Natural killer cell stimulant; T cell stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Immunostimulant.

The following GO Annotation(s) apply to the previously known protein. The following annotation(s) were found: cell surface receptor linked signal transduction; hemocyte development; pregnancy; lactation; cell proliferation, which are annotation(s) related to Biological Process; prolactin receptor ligand; hormone, which are annotation(s) related to Molecular Function; and extracellular space; soluble fraction, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HSPRO204 features 16 segment(s), which were listed in Table 6314 above and for which the sequence(s) are given at the end of the application. These segment(s) are portions of nucleic acid sequence(s) which are described herein separately because they are of particular interest. A description of each segment according to the present invention is now provided.

Segment cluster HSPRO204_PEA_1_node_2 (SEQ ID NO:6652) according to the present invention is supported by 2 libraries. The number of libraries was determined as previously described. This segment can be found in the following transcript(s): HSPRO204_PEA_1_T22 (SEQ ID NO:4391). Table 6317 below describes the starting and ending position of this segment on each transcript.

TABLE 6317

| | Segment location on transcripts | |
|---|---|---|
| Transcript name | Segment starting position | Segment ending position |
| HSPRO204_PEA_1_T22 (SEQ ID NO: 4391) | 95 | 915 |

The previously-described transcripts for these segment(s) do not code for protein.

Segment cluster HSPRO204_PEA_1_node_20 (SEQ ID NO:6653) according to the present invention is supported by 1 libraries. The number of libraries was determined as previously described. This segment can be found in the following transcript(s): HSPRO204_PEA_1_T17 (SEQ ID NO:4390). Table 6318 below describes the starting and ending position of this segment on each transcript.

TABLE 6318

| | Segment location on transcripts | |
|---|---|---|
| Transcript name | Segment starting position | Segment ending position |
| HSPRO204_PEA_1_T17 (SEQ ID NO: 4390) | 1 | 194 |

This segment can be found in the following protein(s): HSPRO204_PEA_1_P16.

Segment cluster HSPRO204_PEA_1_node_40 (SEQ ID NO:6654) according to the present invention is supported by 71 libraries. The number of libraries was determined as previously described. This segment can be found in the following transcript(s): HSPRO204_PEA_1_T17 (SEQ ID NO:4390). Table 6319 below describes the starting and ending position of this segment on each transcript.

TABLE 6319

| | Segment location on transcripts | |
|---|---|---|
| Transcript name | Segment starting position | Segment ending position |
| HSPRO204_PEA_1_T17 (SEQ ID NO: 4390) | 546 | 689 |

This segment can be found in the following protein(s): HSPRO204_PEA_1_P16.

Segment cluster HSPRO204_PEA_1_node_41 (SEQ ID NO:6655) according to the present invention is supported by 56 libraries. The number of libraries was determined as previously described. This segment can be found in the following transcript(s): HSPRO204_PEA_1_T17 (SEQ ID NO:4390). Table 6320 below describes the starting and ending position of this segment on each transcript.

TABLE 6320

| | Segment location on transcripts | |
|---|---|---|
| Transcript name | Segment starting position | Segment ending position |
| HSPRO204_PEA_1_T17 (SEQ ID NO: 4390) | 690 | 836 |

This segment can be found in a non-coding region of transcript(s) that are related to the following protein(s): HSPRO204_PEA_1_P16.

According to an optional embodiment of the present invention, short segments related to the above cluster are also provided. These segments are up to about 120 bp in length, and so are included in a separate description.

Segment cluster HSPRO204_PEA_1_node_0 (SEQ ID NO:6656) according to the present invention is supported by 15 libraries. The number of libraries was determined as previously described. This segment can be found in the following transcript(s): HSPRO204_PEA_1_T22 (SEQ ID NO:4391). Table 6321 below describes the starting and ending position of this segment on each transcript.

TABLE 6321

Segment location on transcripts

| Transcript name | Segment starting position | Segment ending position |
|---|---|---|
| HSPRO204_PEA_1_T22 (SEQ ID NO: 4391) | 1 | 94 |

The previously-described transcripts for these segment(s) do not code for protein.

Segment cluster HSPRO204_PEA_1_node_22 (SEQ ID NO:6657) according to the present invention can be found in the following transcript(s): HSPRO204_PEA_3_T17 (SEQ ID NO:4390). Table 6322 below describes the starting and ending position of this segment on each transcript.

TABLE 6322

Segment location on transcripts

| Transcript name | Segment starting position | Segment ending position |
|---|---|---|
| HSPRO204_PEA_1_T17 (SEQ ID NO: 4390) | 195 | 208 |

This segment can be found in the following protein(s): HSPRO204_PEA_1_P16.

Segment cluster HSPRO204_PEA_1_node_23 (SEQ ID NO:6658) according to the present invention is supported by 68 libraries. The number of libraries was determined as previously described. This segment can be found in the following transcript(s): HSPRO204_PEA_1_T17 (SEQ ID NO:4390). Table 6323 below describes the starting and ending position of this segment on each transcript.

TABLE 6323

Segment location on transcripts

| Transcript name | Segment starting position | Segment ending position |
|---|---|---|
| HSPRO204_PEA_1_T17 (SEQ ID NO: 4390) | 209 | 244 |

This segment can be found in the following protein(s): HSPRO204_PEA_1_P16.

Segment cluster HSPRO204_PEA_1_node_24 (SEQ ID NO:6659) according to the present invention can be found in the following transcript(s): HSPRO204_PEA_1_T117 (SEQ ID NO:4390). Table 6324 below describes the starting and ending position of this segment on each transcript.

TABLE 6324

Segment location on transcripts

| Transcript name | Segment starting position | Segment ending position |
|---|---|---|
| HSPRO204_PEA_1_T17 (SEQ ID NO: 4390) | 245 | 268 |

This segment can be found in the following protein(s): HSPRO204_PEA_1_P16.

Segment cluster HSPRO204_PEA_1_node_25 (SEQ ID NO:6660) according to the present invention can be found in the following transcript(s): HSPRO204_PEA_3_T17 (SEQ ID NO:4390). Table 6325 below describes the starting and ending position of this segment on each transcript.

TABLE 6325

Segment location on transcripts

| Transcript name | Segment starting position | Segment ending position |
|---|---|---|
| HSPRO204_PEA_1_T17 (SEQ ID NO: 4390) | 269 | 281 |

This segment can be found in the following protein(s): HSPRO204_PEA_1_P16.

Segment cluster HSPRO204_PEA_1_node_26 (SEQ ID NO:6661) according to the present invention can be found in the following transcript(s): HSPRO204_PEA_1_T17 (SEQ ID NO:4390). Table 6326 below describes the starting and ending position of this segment on each transcript.

TABLE 6326

Segment location on transcripts

| Transcript name | Segment starting position | Segment ending position |
|---|---|---|
| HSPRO204_PEA_1_T17 (SEQ ID NO: 4390) | 282 | 302 |

This segment can be found in the following protein(s): HSPRO204_PEA_1_P16.

Segment cluster HSPRO204_PEA_1_node_30 (SEQ ID NO:6662) according to the present invention can be found in the following transcript(s): HSPRO204_PEA_3_T17 (SEQ ID NO:4390). Table 6327 below describes the starting and ending position of this segment on each transcript.

TABLE 6327

Segment location on transcripts

| Transcript name | Segment starting position | Segment ending position |
|---|---|---|
| HSPRO204_PEA_1_T17 (SEQ ID NO: 4390) | 303 | 306 |

This segment can be found in the following protein(s): HSPRO204_PEA_1_P16.

Segment cluster HSPRO204_PEA_1_node_31 (SEQ ID NO:6663) according to the present invention is supported by 67 libraries. The number of libraries was determined as previously described. This segment can be found in the following transcript(s): HSPRO204_PEA_1_T17 (SEQ ID NO:4390). Table 6328 below describes the starting and ending position of this segment on each transcript.

TABLE 6328

Segment location on transcripts

| Transcript name | Segment starting position | Segment ending position |
|---|---|---|
| HSPRO204_PEA_1_T17 (SEQ ID NO: 4390) | 307 | 388 |

This segment can be found in the following protein(s): HSPRO204_PEA_1_P16.

Segment cluster HSPRO204_PEA_1_node_32 (SEQ ID NO:6664) according to the present invention is supported by 66 libraries. The number of libraries was determined as previously described. This segment can be found in the following transcript(s): HSPRO204_PEA_1_T17 (SEQ ID NO:4390). Table 6329 below describes the starting and ending position of this segment on each transcript.

TABLE 6329

Segment location on transcripts

| Transcript name | Segment starting position | Segment ending position |
|---|---|---|
| HSPRO204_PEA_1_T17 (SEQ ID NO: 4390) | 389 | 434 |

This segment can be found in the following protein(s): HSPRO204_PEA_1_P16.

Segment cluster HSPRO204_PEA_1_node_33 (SEQ ID NO:6665) according to the present invention can be found in the following transcript(s): HSPRO204_PEA_1_T17 (SEQ ID NO:4390). Table 6330 below describes the starting and ending position of this segment on each transcript.

TABLE 6330

Segment location on transcripts

| Transcript name | Segment starting position | Segment ending position |
|---|---|---|
| HSPRO204_PEA_1_T17 (SEQ ID NO: 4390) | 435 | 449 |

This segment can be found in the following protein(s): HSPRO204_PEA_1_P16.

Segment cluster HSPRO204_PEA_1_node_34 (SEQ ID NO:6666) according to the present invention is supported by 65 libraries. The number of libraries was determined as previously described. This segment can be found in the following transcript(s): HSPRO204_PEA_1_T17 (SEQ ID NO:4390). Table 6331 below describes the starting and ending position of this segment on each transcript.

TABLE 6331

Segment location on transcripts

| Transcript name | Segment starting position | Segment ending position |
|---|---|---|
| HSPRO204_PEA_1_T17 (SEQ ID NO: 4390) | 450 | 482 |

This segment can be found in the following protein(s): HSPRO204_PEA_1_P16.

Segment cluster HSPRO204_PEA_1_node_39 (SEQ ID NO:6667) according to the present invention is supported by 69 libraries. The number of libraries was determined as previously described. This segment can be found in the following transcript(s): HSPRO204_PEA_1_T17 (SEQ ID NO:4390). Table 6332 below describes the starting and ending position of this segment on each transcript.

TABLE 6332

Segment location on transcripts

| Transcript name | Segment starting position | Segment ending position |
|---|---|---|
| HSPRO204_PEA_1_T17 (SEQ ID NO: 4390) | 483 | 545 |

This segment can be found in the following protein(s): HSPRO204_PEA_1_P16.

Description for Cluster HSPSTI

Cluster HSPSTI features 3 transcript(s) and 12 segment(s) of interest, the names for which are given in Tables 6333 and 6334, respectively, the sequences themselves are given at the end of the application. The selected protein variants are given in Table 6335.

TABLE 6333

Transcripts of interest
Transcript Name

HSPSTI_PEA_1_T5 (SEQ ID NO: 4392)
HSPSTI_PEA_1_T6 (SEQ ID NO: 4393)
HSPSTI_PEA_1_T7 (SEQ ID NO: 4394)

TABLE 6334

Segments of interest
Segment Name

HSPSTI_PEA_1_node_6 (SEQ ID NO: 6668)
HSPSTI_PEA_1_node_11 (SEQ ID NO: 6669)
HSPSTI_PEA_1_node_17 (SEQ ID NO: 6670)
HSPSTI_PEA_1_node_18 (SEQ ID NO: 6671)
HSPSTI_PEA_1_node_0 (SEQ ID NO: 6672)
HSPSTI_PEA_1_node_12 (SEQ ID NO: 6673)
HSPSTI_PEA_1_node_14 (SEQ ID NO: 6674)
HSPSTI_PEA_1_node_15 (SEQ ID NO: 6675)
HSPSTI_PEA_1_node_16 (SEQ ID NO: 6676)
HSPSTI_PEA_1_node_21 (SEQ ID NO: 6677)
HSPSTI_PEA_1_node_22 (SEQ ID NO: 6678)
HSPSTI_PEA_1_node_23 (SEQ ID NO: 6679)

TABLE 6335

Proteins of interest

| Protein Name | Corresponding Transcript(s) |
|---|---|
| HSPSTI_PEA_1_P4 | HSPSTI_PEA_1_T5 (SEQ ID NO: 4392) |
| HSPSTI_PEA_1_P5 | HSPSTI_PEA_1_T6 (SEQ ID NO: 4393) |

These sequences are variants of the known protein Pancreatic secretory trypsin inhibitor precursor (SwissProt accession identifier IPK1_HUMAN; known also according to the synonyms Tumor-associated trypsin inhibitor; TATI; Serine protease inhibitor Kazal-type 1), referred to herein as the previously known protein.

Protein Pancreatic secretory trypsin inhibitor precursor is known or believed to have the following function(s): This is a trypsin inhibitor, its physiological function is to prevent the trypsin-catalyzed premature activation of zymogens within the pancreas. The sequence for protein Pancreatic secretory trypsin inhibitor precursor is given at the end of the application, as "Pancreatic secretory trypsin inhibitor precursor amino acid sequence". Known polymorphisms for this sequence are as shown in Table 6336.

TABLE 6336

Amino acid mutations for Known Protein

| SNP position(s) on amino acid sequence | Comment |
|---|---|
| 14 | L -> P (in HPC). /FTId = VAR_011688. |
| 34 | N -> S (in HPC). /FTId = VAR_011689. |
| 55 | P -> S. /FTId = VAR_011690. |
| 44 | D -> N |
| 52 | N -> D |
| 64 | N -> G |

Protein Pancreatic secretory trypsin inhibitor precursor localization is believed to be Secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Trypsin inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Alimentary/Metabolic; GI inflammatory/bowel disorders.

The following GO Annotation(s) apply to the previously known protein. The following annotation(s) were found: proteinase inhibitor; serine protease inhibitor, which are annotation(s) related to Molecular Function.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster HSPSTI features 12 segment(s), which were listed in Table 6334 above and for which the sequence(s) are given at the end of the application. These segment(s) are portions of nucleic acid sequence(s) which are described herein separately because they are of particular interest. A description of each segment according to the present invention is now provided.

Segment cluster HSPSTI_PEA_1_node_6 (SEQ ID NO:6668) according to the present invention is supported by 80 libraries. The number of libraries was determined as previously described. This segment can be found in the following transcript(s): HSPSTI_PEA_1_T5 (SEQ ID NO:4392) and HSPSTI_PEA_1_T6 (SEQ ID NO:4393). Table 6337 below describes the starting and ending position of this segment on each transcript.

TABLE 6337

Segment location on transcripts

| Transcript name | Segment starting position | Segment ending position |
|---|---|---|
| HSPSTI_PEA_1_T5 (SEQ ID NO: 4392) | 109 | 354 |
| HSPSTI_PEA_1_T6 (SEQ ID NO: 4393) | 109 | 354 |

This segment can be found in the following protein(s): HSPSTI_PEA_1_P4 and HSPSTI_PEA_1_P5.

Segment cluster HSPSTI_PEA_1_node_11 (SEQ ID NO:6669) according to the present invention is supported by 11 libraries. The number of libraries was determined as previously described. This segment can be found in the following transcript(s): HSPSTI_PEA_1_T7 (SEQ ID NO:4394). Table 6338 below describes the starting and ending position of this segment on each transcript.

TABLE 6338

Segment location on transcripts

| Transcript name | Segment starting position | Segment ending position |
|---|---|---|
| HSPSTI_PEA_1_T7 (SEQ ID NO: 4394) | 1 | 1369 |

The previously-described transcripts for these segment(s) do not code for protein.

Segment cluster HSPSTI_PEA_1_node_17 (SEQ ID NO:6670) according to the present invention is supported by 7 libraries. The number of libraries was determined as previously described. This segment can be found in the following transcript(s): HSPSTI_PEA_1_T5 (SEQ ID NO:4392). Table 6339 below describes the starting and ending position of this segment on each transcript.

TABLE 6339

Segment location on transcripts

| Transcript name | Segment starting position | Segment ending position |
|---|---|---|
| HSPSTI_PEA_1_T5 (SEQ ID NO: 4392) | 494 | 1148 |

This segment can be found in the following protein(s): HSPSTI_PEA_1_P4.

Segment cluster HSPSTI_PEA_1_node_18 (SEQ ID NO:6671) according to the present invention is supported by 7 libraries. The number of libraries was determined as previously described. This segment can be found in the following transcript(s): HSPSTI_PEA_1_T5 (SEQ ID NO:4392) and HSPSTI_PEA_1_T6 (SEQ ID NO:4393). Table 6340 below describes the starting and ending position of this segment on each transcript.

TABLE 6340

Segment location on transcripts

| Transcript name | Segment starting position | Segment ending position |
|---|---|---|
| HSPSTI_PEA_1_T5 (SEQ ID NO: 4392) | 1149 | 3056 |
| HSPSTI_PEA_1_T6 (SEQ ID NO: 4393) | 494 | 2401 |

This segment can be found in both coding and non-coding regions of transcript(s) as follows. The segment can be found in a non-coding region of transcript(s) that are related to the following protein(s): HSPSTI_PEA_1_P4. This segment can also be found in the following protein(s): HSPSTI_PEA_1_P5, since it is in the coding region for the corresponding transcript.

According to an optional embodiment of the present invention, short segments related to the above cluster are also provided. These segments are up to about 120 bp in length, and so are included in a separate description.

Segment cluster HSPSTI_PEA_1_node_0 (SEQ ID NO:6672) according to the present invention is supported by 12 libraries. The number of libraries was determined as previously described. This segment can be found in the following transcript(s): HSPSTI_PEA_1_T5 (SEQ ID NO:4392) and HSPSTI_PEA_1_T6 (SEQ ID NO:4393). Table 6341 below describes the starting and ending position of this segment on each transcript.

TABLE 6341

| Segment location on transcripts | | |
|---|---|---|
| Transcript name | Segment starting position | Segment ending position |
| HSPSTI_PEA_1_T5 (SEQ ID NO: 4392) | 1 | 108 |
| HSPSTI_PEA_1_T6 (SEQ ID NO: 4393) | 1 | 108 |

This segment can be found in a non-coding region of transcript(s) that are related to the following protein(s): HSPSTI_PEA_1_P4 and HSPSTI_PEA_1_P5.

Segment cluster HSPSTI_PEA_1_node_12 (SEQ ID NO:6673) according to the present invention is supported by 78 libraries. The number of libraries was determined as previously described. This segment can be found in the following transcript(s): HSPSTI_PEA_1_T5 (SEQ ID NO:4392), HSPSTI_PEA_1_T6 (SEQ ID NO:4393) and HSPSTI_PEA_1_T7 (SEQ ID NO:4394). Table 6342 below describes the starting and ending position of this segment on each transcript.

TABLE 6342

| Segment location on transcripts | | |
|---|---|---|
| Transcript name | Segment starting position | Segment ending position |
| HSPSTI_PEA_1_T5 (SEQ ID NO: 4392) | 355 | 386 |
| HSPSTI_PEA_1_T6 (SEQ ID NO: 4393) | 355 | 386 |
| HSPSTI_PEA_1_T7 (SEQ ID NO: 4394) | 1370 | 1401 |

This segment can be found in the following protein(s): HSPSTI_PEA_1_P4 and HSPSTI_PEA_1_P5.

Segment cluster HSPSTI_PEA_1_node_14 (SEQ ID NO:6674) according to the present invention is supported by 81 libraries. The number of libraries was determined as previously described. This segment can be found in the following transcript(s): HSPSTI_PEA_1_T5 (SEQ ID NO:4392), HSPSTI_PEA_1_T6 (SEQ ID NO:4393) and HSPSTI_PEA_1_T7 (SEQ ID NO:4394). Table 6343 below describes the starting and ending position of this segment on each transcript.

TABLE 6343

| Segment location on transcripts | | |
|---|---|---|
| Transcript name | Segment starting position | Segment ending position |
| HSPSTI_PEA_1_T5 (SEQ ID NO: 4392) | 387 | 456 |
| HSPSTI_PEA_1_T6 (SEQ ID NO: 4393) | 387 | 456 |
| HSPSTI_PEA_1_T7 (SEQ ID NO: 4394) | 1402 | 1471 |

This segment can be found in the following protein(s): HSPSTI_PEA_1_P4 and HSPSTI_PEA_1_P5.

Segment cluster HSPSTI_PEA_1_node_15 (SEQ ID NO:6675) according to the present invention can be found in the following transcript(s): HSPSTI_PEA_1_T5 (SEQ ID NO:4392), HSPSTI_PEA_1_T6 (SEQ ID NO:4393) and HSPSTI_PEA_1_T7 (SEQ ID NO:4394). Table 6344 below describes the starting and ending position of this segment on each transcript.

TABLE 6344

| Segment location on transcripts | | |
|---|---|---|
| Transcript name | Segment starting position | Segment ending position |
| HSPSTI_PEA_1_T5 (SEQ ID NO: 4392) | 457 | 468 |
| HSPSTI_PEA_1_T6 (SEQ ID NO: 4393) | 457 | 468 |
| HSPSTI_PEA_1_T7 (SEQ ID NO: 4394) | 1472 | 1483 |

This segment can be found in the following protein(s): HSPSTI_PEA_1_P4 and HSPSTI_PEA_1_P5.

Segment cluster HSPSTI_PEA_1_node_16 (SEQ ID NO:6676) according to the present invention can be found in the following transcript(s): HSPSTI_PEA_1_T5 (SEQ ID NO:4392), HSPSTI_PEA_1_T6 (SEQ ID NO:4393) and HSPSTI_PEA_1_T7 (SEQ ID NO:4394). Table 6345 below describes the starting and ending position of this segment on each transcript.

TABLE 6345

| Segment location on transcripts | | |
|---|---|---|
| Transcript name | Segment starting position | Segment ending position |
| HSPSTI_PEA_1_T5 (SEQ ID NO: 4392) | 469 | 493 |
| HSPSTI_PEA_1_T6 (SEQ ID NO: 4393) | 469 | 493 |
| HSPSTI_PEA_1_T7 (SEQ ID NO: 4394) | 1484 | 1508 |

This segment can be found in the following protein(s): HSPSTI_PEA_1_P4 and HSPSTI_PEA_1_P5.

Segment cluster HSPSTI_PEA_1_node_21 (SEQ ID NO:6677) according to the present invention is supported by 66 libraries. The number of libraries was determined as previously described. This segment can be found in the following transcript(s): HSPSTI_PEA_1_T7 (SEQ ID NO:4394). Table 6346 below describes the starting and ending position of this segment on each transcript.

TABLE 6346

| Segment location on transcripts | | |
|---|---|---|
| Transcript name | Segment starting position | Segment ending position |
| HSPSTI_PEA_1_T7 (SEQ ID NO: 4394) | 1509 | 1593 |

The previously-described transcripts for these segment(s) do not code for protein.

Segment cluster HSPSTI_PEA_1_node_22 (SEQ ID NO:6678) according to the present invention can be found in the following transcript(s): HSPSTI_PEA_1_T7 (SEQ ID NO:4394). Table 6347 below describes the starting and ending position of this segment on each transcript.

TABLE 6347

| Segment location on transcripts | | |
|---|---|---|
| Transcript name | Segment starting position | Segment ending position |
| HSPSTI_PEA_1_T7 (SEQ ID NO: 4394) | 1594 | 1602 |

The previously-described transcripts for these segment(s) do not code for protein.

Segment cluster HSPSTI_PEA_1_node_23 (SEQ ID NO:6679) according to the present invention is supported by 53 libraries. The number of libraries was determined as previously described. This segment can be found in the following transcript(s): HSPSTI_PEA_1_T7 (SEQ ID NO:4394). Table 6348 below describes the starting and ending position of this segment on each transcript.

TABLE 6348

| Segment location on transcripts | | |
|---|---|---|
| Transcript name | Segment starting position | Segment ending position |
| HSPSTI_PEA_1_T7 (SEQ ID NO: 4394) | 1603 | 1640 |

The previously-described transcripts for these segment(s) do not code for protein.

Description for Cluster HSUDGM

Cluster HSUDGM features 1 transcript(s) and 9 segment(s) of interest, the names for which are given in Tables 6349 and 6350, respectively, the sequences themselves are given at the end of the application. The selected protein variants are given in Table 6351.

TABLE 6349

Transcripts of interest
Transcript Name

HSUDGM_PEA_1_T2 (SEQ ID NO: 4395)

TABLE 6350

Segments of interest
Segment Name

HSUDGM_PEA_1_node_0 (SEQ ID NO: 6680)
HSUDGM_PEA_1_node_1 (SEQ ID NO: 6681)
HSUDGM_PEA_1_node_3 (SEQ ID NO: 6682)
HSUDGM_PEA_1_node_4 (SEQ ID NO: 6683)
HSUDGM_PEA_1_node_5 (SEQ ID NO: 6684)
HSUDGM_PEA_1_node_6 (SEQ ID NO: 6685)
HSUDGM_PEA_1_node_7 (SEQ ID NO: 6686)
HSUDGM_PEA_1_node_8 (SEQ ID NO: 6687)
HSUDGM_PEA_1_node_2 (SEQ ID NO: 6688)

TABLE 6351

| Proteins of interest | |
|---|---|
| Protein Name | Corresponding Transcript(s) |
| HSUDGM_PEA_1_P4 | HSUDGM_PEA_1_T2 (SEQ ID NO: 4395) |

These sequences are variants of the known protein Uracil-DNA glycosylase 2 (SwissProt accession identifier UNG2_HUMAN; known also according to the synonyms EC 3.2.2.-; UDG 2), referred to herein as the previously known protein.

Protein Uracil-DNA glycosylase 2 is known or believed to have the following function(s): Excises uracil residues from the DNA which can arise as a result of misincorporation of dUMP residues by DNA polymerase or due to deamination of cytosine. The sequence for protein Uracil-DNA glycosylase 2 is given at the end of the application, as "Uracil-DNA glycosylase 2 amino acid sequence". Protein Uracil-DNA glycosylase 2 localization is believed to be Nuclear.

The following GO Annotation(s) apply to the previously known protein. The following annotation(s) were found: carbohydrate metabolism; base-excision repair, which are annotation(s) related to Biological Process; uracil-DNA glycosylase; hydrolase, acting on glycosyl bonds, which are annotation(s) related to Molecular Function; and nucleus, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSUDGM can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 148 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 148 and Table 6352. This cluster is overexpressed (at least at a minimum level) in the following pathological conditions: epithelial malignant tumors and a mixture of malignant tumors from different tissues.

TABLE 6352

Normal tissue distribution

| Name of Tissue | Number |
|---|---|
| Bone | 0 |
| Colon | 31 |
| epithelial | 3 |
| general | 2 |
| Liver | 0 |
| Lung | 7 |
| Breast | 0 |
| muscle | 0 |
| Ovary | 0 |
| pancreas | 0 |
| prostate | 0 |
| Skin | 0 |
| stomach | 0 |
| Uterus | 4 |

TABLE 6353

P values and ratios for expression in cancerous tissue

| Name of Tissue | P1 | P2 | SP1 | R3 | SP2 | R4 |
|---|---|---|---|---|---|---|
| bone | 1 | 2.8e−01 | 1 | 1.0 | 7.0e−01 | 1.6 |
| colon | 4.1e−01 | 3.9e−01 | 9.1e−01 | 0.8 | 7.7e−01 | 1.0 |
| epithelial | 1.5e−03 | 3.6e−04 | 9.3e−06 | 6.5 | 1.7e−06 | 6.4 |
| general | 2.3e−05 | 4.6e−07 | 7.3e−09 | 7.6 | 2.8e−10 | 7.3 |
| liver | 1 | 4.7e−01 | 1 | 1.0 | 1 | 1.1 |
| lung | 7.0e−01 | 6.2e−01 | 1.7e−01 | 2.3 | 3.4e−02 | 2.4 |
| breast | 9.8e−02 | 1.7e−01 | 2.2e−01 | 2.8 | 4.6e−01 | 1.9 |
| muscle | 2.3e−01 | 2.9e−01 | 1.5e−01 | 6.8 | 3.9e−01 | 2.6 |
| ovary | 3.8e−01 | 4.2e−01 | 1.5e−01 | 2.4 | 2.6e−01 | 1.9 |
| pancreas | 1 | 1.8e−01 | 1 | 1.0 | 2.8e−01 | 2.8 |
| prostate | 1 | 6.1e−01 | 1 | 1.0 | 5.6e−01 | 1.7 |
| skin | 1 | 4.4e−01 | 1 | 1.0 | 6.4e−01 | 1.6 |
| stomach | 3.0e−01 | 3.0e−01 | 5.0e−01 | 2.0 | 1.3e−01 | 2.3 |
| uterus | 4.2e−02 | 1.7e−01 | 2.5e−02 | 3.4 | 1.1e−01 | 2.3 |

As noted above, cluster HSUDGM features 9 segment(s), which were listed in Table 6350 above and for which the sequence(s) are given at the end of the application. These segment(s) are portions of nucleic acid sequence(s) which are described herein separately because they are of particular interest. A description of each segment according to the present invention is now provided.

Segment cluster HSUDGM_PEA_1_node_0 (SEQ ID NO:6680) according to the present invention is supported by 20 libraries. The number of libraries was determined as previously described. This segment can be found in the following transcript(s): HSUDGM_PEA_1_T2 (SEQ ID NO:4395). Table 6354 below describes the starting and ending position of this segment on each transcript.

TABLE 6354

Segment location on transcripts

| Transcript name | Segment starting position | Segment ending position |
|---|---|---|
| HSUDGM_PEA_1_T2 (SEQ ID NO: 4395) | 1 | 577 |

This segment can be found in a non-coding region of transcript(s) that are related to the following protein(s): HSUDG-M_PEA_1_P4.

Segment cluster HSUDGM_PEA_1_node_1 (SEQ ID NO:6681) according to the present invention is supported by 21 libraries. The number of libraries was determined as previously described. This segment can be found in the following transcript(s): HSUDGM_PEA_1_T2 (SEQ ID NO:4395). Table 6355 below describes the starting and ending position of this segment on each transcript.

TABLE 6355

Segment location on transcripts

| Transcript name | Segment starting position | Segment ending position |
|---|---|---|
| HSUDGM_PEA_1_T2 (SEQ ID NO: 4395) | 578 | 864 |

This segment can be found in a non-coding region of transcript(s) that are related to the following protein(s): HSUDG-M_PEA_1_P4.

Segment cluster HSUDGM_PEA_1_node_3 (SEQ ID NO:6682) according to the present invention is supported by 21 libraries. The number of libraries was determined as previously described. This segment can be found in the following transcript(s): HSUDGM_PEA_1_T2 (SEQ ID NO:4395). Table 6356 below describes the starting and ending position of this segment on each transcript.

TABLE 6356

Segment location on transcripts

| Transcript name | Segment starting position | Segment ending position |
|---|---|---|
| HSUDGM_PEA_1_T2 (SEQ ID NO: 4395) | 954 | 1173 |

This segment can be found in a non-coding region of transcript(s) that are related to the following protein(s): HSUDG-M_PEA_1_P4.

Segment cluster HSUDGM_PEA_1_node_4 (SEQ ID NO:6683) according to the present invention is supported by 36 libraries. The number of libraries was determined as previously described. This segment can be found in the following transcript(s): HSUDGM_PEA_1_T2 (SEQ ID NO:4395). Table 6357 below describes the starting and ending position of this segment on each transcript.

TABLE 6357

Segment location on transcripts

| Transcript name | Segment starting position | Segment ending position |
|---|---|---|
| HSUDGM_PEA_1_T2 (SEQ ID NO: 4395) | 1174 | 1359 |

This segment can be found in a non-coding region of transcript(s) that are related to the following protein(s): HSUDG-M_PEA_1_P4.

Segment cluster HSUDGM_PEA_1_node_5 (SEQ ID NO:6684) according to the present invention is supported by 10 libraries. The number of libraries was determined as previously described. This segment can be found in the following transcript(s): HSUDGM_PEA_1_T2 (SEQ ID NO:4395). Table 6358 below describes the starting and ending position of this segment on each transcript.

TABLE 6358

Segment location on transcripts

| Transcript name | Segment starting position | Segment ending position |
|---|---|---|
| HSUDGM_PEA_1_T2 (SEQ ID NO: 4395) | 1360 | 1859 |

This segment can be found in a non-coding region of transcript(s) that are related to the following protein(s): HSUDGM_PEA_1_P4.

Segment cluster HSUDGM_PEA_1_node_6 (SEQ ID NO:6685) according to the present invention is supported by 47 libraries. The number of libraries was determined as previously described. This segment can be found in the following transcript(s): HSUDGM_PEA_1_T2 (SEQ ID NO:4395). Table 6359 below describes the starting and ending position of this segment on each transcript.

TABLE 6359

Segment location on transcripts

| Transcript name | Segment starting position | Segment ending position |
|---|---|---|
| HSUDGM_PEA_1_T2 (SEQ ID NO: 4395) | 1860 | 2244 |

This segment can be found in a non-coding region of transcript(s) that are related to the following protein(s): HSUDGM_PEA_1_P4.

Segment cluster HSUDGM_PEA_1_node_7 (SEQ ID NO:6686) according to the present invention is supported by 39 libraries. The number of libraries was determined as previously described. This segment can be found in the following transcript(s): HSUDGM_PEA_1_T2 (SEQ ID NO:4395). Table 6360 below describes the starting and ending position of this segment on each transcript.

TABLE 6360

Segment location on transcripts

| Transcript name | Segment starting position | Segment ending position |
|---|---|---|
| HSUDGM_PEA_1_T2 (SEQ ID NO: 4395) | 2245 | 2369 |

This segment can be found in a non-coding region of transcript(s) that are related to the following protein(s): HSUDGM_PEA_1_P4.

Segment cluster HSUDGM_PEA_1_node_8 (SEQ ID NO:6687) according to the present invention is supported by 36 libraries. The number of libraries was determined as previously described. This segment can be found in the following transcript(s): HSUDGM_PEA_1_T2 (SEQ ID NO:4395). Table 6361 below describes the starting and ending position of this segment on each transcript.

TABLE 6361

Segment location on transcripts

| Transcript name | Segment starting position | Segment ending position |
|---|---|---|
| HSUDGM_PEA_1_T2 (SEQ ID NO: 4395) | 2370 | 2575 |

This segment can be found in a non-coding region of transcript(s) that are related to the following protein(s): HSUDGM_PEA_1_P4.

According to an optional embodiment of the present invention, short segments related to the above cluster are also provided. These segments are up to about 120 bp in length, and so are included in a separate description.

Segment cluster HSUDGM_PEA_1_node_2 (SEQ ID NO:6688) according to the present invention is supported by 19 libraries. The number of libraries was determined as previously described. This segment can be found in the following transcript(s): HSUDGM_PEA_1_T2 (SEQ ID NO:4395). Table 6362 below describes the starting and ending position of this segment on each transcript.

TABLE 6362

Segment location on transcripts

| Transcript name | Segment starting position | Segment ending position |
|---|---|---|
| HSUDGM_PEA_1_T2 (SEQ ID NO: 4395) | 865 | 953 |

This segment can be found in the following protein(s): HSUDGM_PEA_1_P4.

Description for Cluster M62205

Cluster M62205 features 2 transcript(s) and 92 segment(s) of interest, the names for which are given in Tables 6363 and 6364, respectively, the sequences themselves are given at the end of the application. The selected protein variants are given in Table 6365.

TABLE 6363

Transcripts of interest
Transcript Name

M62205_PEA_1_T3 (SEQ ID NO: 4396)
M62205_PEA_1_T17 (SEQ ID NO: 4397)

TABLE 6364

Segments of interest
Segment Name

M62205_PEA_1_node_4 (SEQ ID NO: 6689)
M62205_PEA_1_node_40 (SEQ ID NO: 6690)
M62205_PEA_1_node_51 (SEQ ID NO: 6691)
M62205_PEA_1_node_52 (SEQ ID NO: 6692)
M62205_PEA_1_node_53 (SEQ ID NO: 6693)
M62205_PEA_1_node_54 (SEQ ID NO: 6694)
M62205_PEA_1_node_56 (SEQ ID NO: 6695)
M62205_PEA_1_node_73 (SEQ ID NO: 6696)
M62205_PEA_1_node_76 (SEQ ID NO: 6697)
M62205_PEA_1_node_104 (SEQ ID NO: 6698)

TABLE 6364-continued

Segments of interest
Segment Name

M62205_PEA_1_node_5 (SEQ ID NO: 6699)
M62205_PEA_1_node_6 (SEQ ID NO: 6700)
M62205_PEA_1_node_7 (SEQ ID NO: 6701)
M62205_PEA_1_node_8 (SEQ ID NO: 6702)
M62205_PEA_1_node_9 (SEQ ID NO: 6703)
M62205_PEA_1_node_10 (SEQ ID NO: 6704)
M62205_PEA_1_node_11 (SEQ ID NO: 6705)
M62205_PEA_1_node_12 (SEQ ID NO: 6706)
M62205_PEA_1_node_13 (SEQ ID NO: 6707)
M62205_PEA_1_node_14 (SEQ ID NO: 6708)
M62205_PEA_1_node_15 (SEQ ID NO: 6709)
M62205_PEA_1_node_16 (SEQ ID NO: 6710)
M62205_PEA_1_node_17 (SEQ ID NO: 6711)
M62205_PEA_1_node_19 (SEQ ID NO: 6712)
M62205_PEA_1_node_20 (SEQ ID NO: 6713)
M62205_PEA_1_node_21 (SEQ ID NO: 6714)
M62205_PEA_1_node_23 (SEQ ID NO: 6715)
M62205_PEA_1_node_24 (SEQ ID NO: 6716)
M62205_PEA_1_node_25 (SEQ ID NO: 6717)
M62205_PEA_1_node_26 (SEQ ID NO: 6718)
M62205_PEA_1_node_27 (SEQ ID NO: 6719)
M62205_PEA_1_node_29 (SEQ ID NO: 6720)
M62205_PEA_1_node_30 (SEQ ID NO: 6721)
M62205_PEA_1_node_31 (SEQ ID NO: 6722)
M62205_PEA_1_node_32 (SEQ ID NO: 6723)
M62205_PEA_1_node_36 (SEQ ID NO: 6724)
M62205_PEA_1_node_37 (SEQ ID NO: 6725)
M62205_PEA_1_node_38 (SEQ ID NO: 6726)
M62205_PEA_1_node_39 (SEQ ID NO: 6727)
M62205_PEA_1_node_41 (SEQ ID NO: 6728)
M62205_PEA_1_node_42 (SEQ ID NO: 6729)
M62205_PEA_1_node_43 (SEQ ID NO: 6730)
M62205_PEA_1_node_44 (SEQ ID NO: 6731)
M62205_PEA_1_node_45 (SEQ ID NO: 6732)
M62205_PEA_1_node_46 (SEQ ID NO: 6733)
M62205_PEA_1_node_47 (SEQ ID NO: 6734)
M62205_PEA_1_node_48 (SEQ ID NO: 6735)
M62205_PEA_1_node_50 (SEQ ID NO: 6736)
M62205_PEA_1_node_57 (SEQ ID NO: 6737)
M62205_PEA_1_node_58 (SEQ ID NO: 6738)
M62205_PEA_1_node_59 (SEQ ID NO: 6739)
M62205_PEA_1_node_60 (SEQ ID NO: 6740)
M62205_PEA_1_node_61 (SEQ ID NO: 6741)
M62205_PEA_1_node_63 (SEQ ID NO: 6742)
M62205_PEA_1_node_64 (SEQ ID NO: 6743)
M62205_PEA_1_node_65 (SEQ ID NO: 6744)
M62205_PEA_1_node_66 (SEQ ID NO: 6745)
M62205_PEA_1_node_67 (SEQ ID NO: 6746)
M62205_PEA_1_node_68 (SEQ ID NO: 6747)
M62205_PEA_1_node_69 (SEQ ID NO: 6748)
M62205_PEA_1_node_70 (SEQ ID NO: 6749)
M62205_PEA_1_node_71 (SEQ ID NO: 6750)
M62205_PEA_1_node_72 (SEQ ID NO: 6751)
M62205_PEA_1_node_74 (SEQ ID NO: 6752)
M62205_PEA_1_node_75 (SEQ ID NO: 6753)
M62205_PEA_1_node_77 (SEQ ID NO: 6754)
M62205_PEA_1_node_78 (SEQ ID NO: 6755)
M62205_PEA_1_node_79 (SEQ ID NO: 6756)
M62205_PEA_1_node_80 (SEQ ID NO: 6757)
M62205_PEA_1_node_81 (SEQ ID NO: 6758)
M62205_PEA_1_node_82 (SEQ ID NO: 6759)
M62205_PEA_1_node_83 (SEQ ID NO: 6760)
M62205_PEA_1_node_84 (SEQ ID NO: 6761)
M62205_PEA_1_node_85 (SEQ ID NO: 6762)
M62205_PEA_1_node_86 (SEQ ID NO: 6763)
M62205_PEA_1_node_87 (SEQ ID NO: 6764)
M62205_PEA_1_node_88 (SEQ ID NO: 6765)
M62205_PEA_1_node_89 (SEQ ID NO: 6766)
M62205_PEA_1_node_90 (SEQ ID NO: 6767)
M62205_PEA_1_node_91 (SEQ ID NO: 6768)
M62205_PEA_1_node_92 (SEQ ID NO: 6769)
M62205_PEA_1_node_93 (SEQ ID NO: 6770)
M62205_PEA_1_node_94 (SEQ ID NO: 6771)
M62205_PEA_1_node_95 (SEQ ID NO: 6772)
M62205_PEA_1_node_96 (SEQ ID NO: 6773)
M62205_PEA_1_node_97 (SEQ ID NO: 6774)

TABLE 6364-continued

Segments of interest
Segment Name

M62205_PEA_1_node_98 (SEQ ID NO: 6775)
M62205_PEA_1_node_99 (SEQ ID NO: 6776)
M62205_PEA_1_node_100 (SEQ ID NO: 6777)
M62205_PEA_1_node_101 (SEQ ID NO: 6778)
M62205_PEA_1_node_102 (SEQ ID NO: 6779)
M62205_PEA_1_node_103 (SEQ ID NO: 6780)

TABLE 6365

Proteins of interest

| Protein Name | Corresponding Transcript(s) |
|---|---|
| M62205_PEA_1_P40 | M62205_PEA_1_T3 (SEQ ID NO: 4396); M62205_PEA_1_T17 (SEQ ID NO: 4397) |

These sequences are variants of the known protein Glial fibrillary acidic protein, astrocyte (SwissProt accession identifier GFAP_HUMAN; known also according to the synonyms GFAP), referred to herein as the previously known protein.

Protein Glial fibrillary acidic protein, astrocyte is known or believed to have the following function(s): GFAP, a class-III intermediate filament, is a cell-specific marker that, during the development of the central nervous system, distinguishes astrocytes from other glial cells. The sequence for protein Glial fibrillary acidic protein, astrocyte is given at the end of the application, as "Glial fibrillary acidic protein, astrocyte amino acid sequence". Known polymorphisms for this sequence are as shown in Table 6366.

TABLE 6366

Amino acid mutations for Known Protein

| SNP position(s) on amino acid sequence | Comment |
|---|---|
| 47 | P -> L (in Alexander disease; could be a polymorphism). /FTId = VAR_017464. |
| 76 | L -> F (in Alexander disease). /FTId = VAR_017465. |
| 77 | N -> Y (in Alexander disease). /FTId = VAR_017466. |
| 78 | D -> E (in Alexander disease; adult form). /FTId = VAR_017477. |
| 79 | R -> C (in Alexander disease). /FTId = VAR_017467. |
| 79 | R -> H (in Alexander disease). /FTId = VAR_017468. |
| 88 | R -> C (in Alexander disease). /FTId = VAR_017469. |
| 88 | R -> S (in Alexander disease). /FTId = VAR_017470. |
| 223 | E -> Q (in Alexander disease; adult form). /FTId = VAR_017478. |
| 239 | R -> C (in Alexander disease). /FTId = VAR_017471. |
| 239 | R -> H (in Alexander disease). /FTId = VAR_017472. |
| 244 | A -> V (in Alexander disease). /FTId = VAR_017473. |
| 258 | R -> P (in Alexander disease). /FTId = VAR_017474. |
| 295 | D -> N. /FTId = VAR_017479. |
| 362 | E -> D (in Alexander disease). /FTId = VAR_017475. |
| 416 | R -> W (in Alexander disease). /FTId = VAR_017476. |

The following GO Annotation(s) apply to the previously known protein. The following annotation(s) were found: structural protein of cytoskeleton, which are annotation(s) related to Molecular Function; and intermediate filament, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

As noted above, cluster M62205 features 92 segment(s), which were listed in Table 6364 above and for which the sequence(s) are given at the end of the application. These segment(s) are portions of nucleic acid sequence(s) which are described herein separately because they are of particular interest. A description of each segment according to the present invention is now provided.

Segment cluster M62205_PEA_1_node_4 (SEQ ID NO:6689) according to the present invention is supported by 116 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6367 below describes the starting and ending position of this segment on each transcript.

TABLE 6367

| | Segment location on transcripts | |
|---|---|---|
| Transcript name | Segment starting position | Segment ending position |
| M62205_PEA_1_T3 (SEQ ID NO: 4396) | 1 | 172 |
| M62205_PEA_1_T17 (SEQ ID NO: 4397) | 1 | 172 |

This segment can be found in the following protein(s): M62205_PEA_1_P40.

Segment cluster M62205_PEA_1_node_40 (SEQ ID NO:6690) according to the present invention is supported by 7 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6368 below describes the starting and ending position of this segment on each transcript.

TABLE 6368

| | Segment location on transcripts | |
|---|---|---|
| Transcript name | Segment starting position | Segment ending position |
| M62205_PEA_1_T3 (SEQ ID NO: 4396) | 941 | 1155 |
| M62205_PEA_1_T17 (SEQ ID NO: 4397) | 941 | 1155 |

This segment can be found in the following protein(s): M62205_PEA_1_P40.

Segment cluster M62205_PEA_1_node_51 (SEQ ID NO:6691) according to the present invention is supported by 20 libraries. The number of libraries was determined as previously described. This segment can be found in the following transcript(s): M62205_PEA_1_T17 (SEQ ID NO:4397). Table 6369 below describes the starting and ending position of this segment on each transcript.

TABLE 6369

| | Segment location on transcripts | |
|---|---|---|
| Transcript name | Segment starting position | Segment ending position |
| M62205_PEA_1_T17 (SEQ ID NO: 4397) | 1421 | 1774 |

This segment can be found in a non-coding region of transcript(s) that are related to the following protein(s): M62205_PEA_1_P40.

Segment cluster M62205_PEA_1_node_52 (SEQ ID NO:6692) according to the present invention is supported by 33 libraries. The number of libraries was determined as previously described. This segment can be found in the following transcript(s): M62205_PEA_1_T17 (SEQ ID NO:4397). Table 6370 below describes the starting and ending position of this segment on each transcript.

TABLE 6370

| | Segment location on transcripts | |
|---|---|---|
| Transcript name | Segment starting position | Segment ending position |
| M62205_PEA_1_T17 (SEQ ID NO: 4397) | 1775 | 1894 |

This segment can be found in a non-coding region of transcript(s) that are related to the following protein(s): M62205_PEA_1_P40.

Segment cluster M62205_PEA_1_node_53 (SEQ ID NO:6693) according to the present invention is supported by 26 libraries. The number of libraries was determined as previously described. This segment can be found in the following transcript(s): M62205_PEA_1_T17 (SEQ ID NO:4397). Table 6371 below describes the starting and ending position of this segment on each transcript.

TABLE 6371

| | Segment location on transcripts | |
|---|---|---|
| Transcript name | Segment starting position | Segment ending position |
| M62205_PEA_1_T17 (SEQ ID NO: 4397) | 1895 | 2136 |

This segment can be found in a non-coding region of transcript(s) that are related to the following protein(s): M62205_PEA_1_P40.

Segment cluster M62205_PEA_1_node_54 (SEQ ID NO:6694) according to the present invention is supported by 25 libraries. The number of libraries was determined as previously described. This segment can be found in the following transcript(s): M62205_PEA_1_T17 (SEQ ID NO:4397). Table 6372 below describes the starting and ending position of this segment on each transcript.

TABLE 6372

Segment location on transcripts

| Transcript name | Segment starting position | Segment ending position |
|---|---|---|
| M62205_PEA_1_T17 (SEQ ID NO: 4397) | 2137 | 3699 |

This segment can be found in a non-coding region of transcript(s) that are related to the following protein(s): M62205_PEA_1_P40.

Segment cluster M62205_PEA_1_node_56 (SEQ ID NO:6695) according to the present invention is supported by 8 libraries. The number of libraries was determined as previously described. This segment can be found in the following transcript(s): M62205_PEA_1_T17 (SEQ ID NO:4397). Table 6373 below describes the starting and ending position of this segment on each transcript.

TABLE 6373

Segment location on transcripts

| Transcript name | Segment starting position | Segment ending position |
|---|---|---|
| M62205_PEA_1_T17 (SEQ ID NO: 4397) | 3700 | 3885 |

This segment can be found in a non-coding region of transcript(s) that are related to the following protein(s): M62205_PEA_1_P40.

Segment cluster M62205_PEA_1_node_73 (SEQ ID NO:6696) according to the present invention is supported by 141 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6374 below describes the starting and ending position of this segment on each transcript.

TABLE 6374

Segment location on transcripts

| Transcript name | Segment starting position | Segment ending position |
|---|---|---|
| M62205_PEA_1_T3 (SEQ ID NO: 4396) | 1817 | 1952 |
| M62205_PEA_1_T17 (SEQ ID NO: 4397) | 4282 | 4417 |

This segment can be found in a non-coding region of transcript(s) that are related to the following protein(s): M62205_PEA_1_P40.

Segment cluster M62205_PEA_1_node_76 (SEQ ID NO:6697) according to the present invention is supported by 175 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6375 below describes the starting and ending position of this segment on each transcript.

TABLE 6375

Segment location on transcripts

| Transcript name | Segment starting position | Segment ending position |
|---|---|---|
| M62205_PEA_1_T3 (SEQ ID NO: 4396) | 2024 | 2319 |
| M62205_PEA_1_T17 (SEQ ID NO: 4397) | 4489 | 4784 |

This segment can be found in a non-coding region of transcript(s) that are related to the following protein(s): M62205_PEA_1_P40.

Segment cluster M62205_PEA_1_node_104 (SEQ ID NO:6698) according to the present invention is supported by 92 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6376 below describes the starting and ending position of this segment on each transcript.

TABLE 6376

Segment location on transcripts

| Transcript name | Segment starting position | Segment ending position |
|---|---|---|
| M62205_PEA_1_T3 (SEQ ID NO: 4396) | 3214 | 3265 |
| M62205_PEA_1_T17 (SEQ ID NO: 4397) | 5679 | 5730 |

This segment can be found in a non-coding region of transcript(s) that are related to the following protein(s): M62205_PEA_1_P40.

According to an optional embodiment of the present invention, short segments related to the above cluster are also provided. These segments are up to about 120 bp in length, and so are included in a separate description.

Segment cluster M62205_PEA_1_node_5 (SEQ ID NO:6699) according to the present invention is supported by 117 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6377 below describes the starting and ending position of this segment on each transcript.

TABLE 6377

Segment location on transcripts

| Transcript name | Segment starting position | Segment ending position |
|---|---|---|
| M62205_PEA_1_T3 (SEQ ID NO: 4396) | 173 | 212 |
| M62205_PEA_1_T17 (SEQ ID NO: 4397) | 173 | 212 |

This segment can be found in the following protein(s): M62205_PEA_1_P40.

Segment cluster M62205_PEA_1_node_6 (SEQ ID NO:6700) according to the present invention is supported by 120 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6378 below describes the starting and ending position of this segment on each transcript.

TABLE 6378

Segment location on transcripts

| Transcript name | Segment starting position | Segment ending position |
|---|---|---|
| M62205_PEA_1_T3 (SEQ ID NO: 4396) | 213 | 259 |
| M62205_PEA_1_T17 (SEQ ID NO: 4397) | 213 | 259 |

This segment can be found in the following protein(s): M62205_PEA_1_P40.

Segment cluster M62205_PEA_1_node_7 (SEQ ID NO:6701) according to the present invention can be found in the following transcript(s): M62205_PEA_1_T3 (SEQ ID NO:4396) and M62205_PEA_1_T17 (SEQ ID NO:4397). Table 6379 below describes the starting and ending position of this segment on each transcript.

TABLE 6379

Segment location on transcripts

| Transcript name | Segment starting position | Segment ending position |
|---|---|---|
| M62205_PEA_1_T3 (SEQ ID NO: 4396) | 260 | 279 |
| M62205_PEA_1_T17 (SEQ ID NO: 4397) | 260 | 279 |

This segment can be found in the following protein(s): M62205_PEA_1_P40.

Segment cluster M62205_PEA_1_node_8 (SEQ ID NO:6702) according to the present invention can be found in the following transcript(s): M62205_PEA_1_T3 (SEQ ID NO:4396) and M62205_PEA_1_T17 (SEQ ID NO:4397). Table 6380 below describes the starting and ending position of this segment on each transcript.

TABLE 6380

Segment location on transcripts

| Transcript name | Segment starting position | Segment ending position |
|---|---|---|
| M62205_PEA_1_T3 (SEQ ID NO: 4396) | 280 | 292 |
| M62205_PEA_1_T17 (SEQ ID NO: 4397) | 280 | 292 |

This segment can be found in the following protein(s): M62205_PEA_1_P40.

Segment cluster M62205_PEA_1_node_9 (SEQ ID NO:6703) according to the present invention is supported by 123 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6381 below describes the starting and ending position of this segment on each transcript.

TABLE 6381

Segment location on transcripts

| Transcript name | Segment starting position | Segment ending position |
|---|---|---|
| M62205_PEA_1_T3 (SEQ ID NO: 4396) | 293 | 322 |
| M62205_PEA_1_T17 (SEQ ID NO: 4397) | 293 | 322 |

This segment can be found in the following protein(s): M62205_PEA_1_P40.

Segment cluster M62205_PEA_1_node_10 (SEQ ID NO:6704) according to the present invention can be found in the following transcript(s): M62205_PEA_1_T3 (SEQ ID NO:4396) and M62205_PEA_1_T17 (SEQ ID NO:4397). Table 6382 below describes the starting and ending position of this segment on each transcript.

TABLE 6382

Segment location on transcripts

| Transcript name | Segment starting position | Segment ending position |
|---|---|---|
| M62205_PEA_1_T3 (SEQ ID NO: 4396) | 323 | 329 |
| M62205_PEA_1_T17 (SEQ ID NO: 4397) | 323 | 329 |

This segment can be found in the following protein(s): M62205_PEA_1_P40.

Segment cluster M62205_PEA_1_node_11 (SEQ ID NO:6705) according to the present invention can be found in the following transcript(s): M62205_PEA_1_T3 (SEQ ID NO:4396) and M62205_PEA_1_T17 (SEQ ID NO:4397). Table 6383 below describes the starting and ending position of this segment on each transcript.

TABLE 6383

Segment location on transcripts

| Transcript name | Segment starting position | Segment ending position |
|---|---|---|
| M62205_PEA_1_T3 (SEQ ID NO: 4396) | 330 | 343 |
| M62205_PEA_1_T17 (SEQ ID NO: 4397) | 330 | 343 |

This segment can be found in the following protein(s): M62205_PEA_1_P40.

Segment cluster M62205_PEA_1_node_12 (SEQ ID NO:6706) according to the present invention can be found in the following transcript(s): M62205_PEA_1_T3 (SEQ ID NO:4396) and M62205_PEA_1_T17 (SEQ ID NO:4397). Table 6384 below describes the starting and ending position of this segment on each transcript.

TABLE 6384

| Segment location on transcripts | | |
|---|---|---|
| Transcript name | Segment starting position | Segment ending position |
| M62205_PEA_1_T3 (SEQ ID NO: 4396) | 344 | 363 |
| M62205_PEA_1_T17 (SEQ ID NO: 4397) | 344 | 363 |

This segment can be found in the following protein(s): M62205_PEA_1_P40.

Segment cluster M62205_PEA_1_node_13 (SEQ ID NO:6707) according to the present invention can be found in the following transcript(s): M62205_PEA_1_T3 (SEQ ID NO:4396) and M62205_PEA_1_T17 (SEQ ID NO:4397). Table 6385 below describes the starting and ending position of this segment on each transcript.

TABLE 6385

| Segment location on transcripts | | |
|---|---|---|
| Transcript name | Segment starting position | Segment ending position |
| M62205_PEA_1_T3 (SEQ ID NO: 4396) | 364 | 367 |
| M62205_PEA_1_T17 (SEQ ID NO: 4397) | 364 | 367 |

This segment can be found in the following protein(s): M62205_PEA_1_P40.

Segment cluster M62205_PEA_1_node_14 (SEQ ID NO:6708) according to the present invention can be found in the following transcript(s): M62205_PEA_1_T3 (SEQ ID NO:4396) and M62205_PEA_1_T17 (SEQ ID NO:4397). Table 6386 below describes the starting and ending position of this segment on each transcript.

TABLE 6386

| Segment location on transcripts | | |
|---|---|---|
| Transcript name | Segment starting position | Segment ending position |
| M62205_PEA_1_T3 (SEQ ID NO: 4396) | 368 | 391 |
| M62205_PEA_1_T17 (SEQ ID NO: 4397) | 368 | 391 |

This segment can be found in the following protein(s): M62205_PEA_1_P40.

Segment cluster M62205_PEA_1_node_15 (SEQ ID NO:6709) according to the present invention is supported by 119 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6387 below describes the starting and ending position of this segment on each transcript.

TABLE 6387

| Segment location on transcripts | | |
|---|---|---|
| Transcript name | Segment starting position | Segment ending position |
| M62205_PEA_1_T3 (SEQ ID NO: 4396) | 392 | 421 |
| M62205_PEA_1_T17 (SEQ ID NO: 4397) | 392 | 421 |

This segment can be found in the following protein(s): M62205_PEA_1_P40.

Segment cluster M62205_PEA_1_node_16 (SEQ ID NO:6710) according to the present invention is supported by 117 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6388 below describes the starting and ending position of this segment on each transcript.

TABLE 6388

| Segment location on transcripts | | |
|---|---|---|
| Transcript name | Segment starting position | Segment ending position |
| M62205_PEA_1_T3 (SEQ ID NO: 4396) | 422 | 475 |
| M62205_PEA_1_T17 (SEQ ID NO: 4397) | 422 | 475 |

This segment can be found in the following protein(s): M62205_PEA_1_P40.

Segment cluster M62205_PEA_1_node_17 (SEQ ID NO:6711) according to the present invention can be found in the following transcript(s): M62205_PEA_1_T3 (SEQ ID NO:4396) and M62205_PEA_1_T17 (SEQ ID NO:4397). Table 6389 below describes the starting and ending position of this segment on each transcript.

TABLE 6389

| Segment location on transcripts | | |
|---|---|---|
| Transcript name | Segment starting position | Segment ending position |
| M62205_PEA_1_T3 (SEQ ID NO: 4396) | 476 | 495 |
| M62205_PEA_1_T17 (SEQ ID NO: 4397) | 476 | 495 |

This segment can be found in the following protein(s): M62205_PEA_1_P40.

Segment cluster M62205_PEA_1_node_19 (SEQ ID NO:6712) according to the present invention is supported by 117 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6390 below describes the starting and ending position of this segment on each transcript.

TABLE 6390

| Segment location on transcripts | | |
|---|---|---|
| Transcript name | Segment starting position | Segment ending position |
| M62205_PEA_1_T3 (SEQ ID NO: 4396) | 496 | 527 |
| M62205_PEA_1_T17 (SEQ ID NO: 4397) | 496 | 527 |

This segment can be found in the following protein(s): M62205_PEA_1_P40.

Segment cluster M62205_PEA_1_node_20 (SEQ ID NO:6713) according to the present invention can be found in the following transcript(s): M62205_PEA_1_T3 (SEQ ID NO:4396) and M62205_PEA_1_T17 (SEQ ID NO:4397). Table 6391 below describes the starting and ending position of this segment on each transcript.

TABLE 6391

| Segment location on transcripts | | |
|---|---|---|
| Transcript name | Segment starting position | Segment ending position |
| M62205_PEA_1_T3 (SEQ ID NO: 4396) | 528 | 538 |
| M62205_PEA_1_T17 (SEQ ID NO: 4397) | 528 | 538 |

This segment can be found in the following protein(s): M62205_PEA_1_P40.

Segment cluster M62205_PEA_1_node_21 (SEQ ID NO:6714) according to the present invention can be found in the following transcript(s): M62205_PEA_1_T3 (SEQ ID NO:4396) and M62205_PEA_1_T17 (SEQ ID NO:4397). Table 6392 below describes the starting and ending position of this segment on each transcript.

TABLE 6392

| Segment location on transcripts | | |
|---|---|---|
| Transcript name | Segment starting position | Segment ending position |
| M62205_PEA_1_T3 (SEQ ID NO: 4396) | 539 | 556 |
| M62205_PEA_1_T17 (SEQ ID NO: 4397) | 539 | 556 |

This segment can be found in the following protein(s): M62205_PEA_1_P40.

Segment cluster M62205_PEA_1_node_23 (SEQ ID NO:6715) according to the present invention is supported by 119 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6393 below describes the starting and ending position of this segment on each transcript.

TABLE 6393

| Segment location on transcripts | | |
|---|---|---|
| Transcript name | Segment starting position | Segment ending position |
| M62205_PEA_1_T3 (SEQ ID NO: 4396) | 557 | 589 |
| M62205_PEA_1_T17 (SEQ ID NO: 4397) | 557 | 589 |

This segment can be found in the following protein(s): M62205_PEA_1_P40.

Segment cluster M62205_PEA_1_node_24 (SEQ ID NO:6716) according to the present invention can be found in the following transcript(s): M62205_PEA_1_T3 (SEQ ID NO:4396) and M62205_PEA_1_T17 (SEQ ID NO:4397). Table 6394 below describes the starting and ending position of this segment on each transcript.

TABLE 6394

| Segment location on transcripts | | |
|---|---|---|
| Transcript name | Segment starting position | Segment ending position |
| M62205_PEA_1_T3 (SEQ ID NO: 4396) | 590 | 601 |
| M62205_PEA_1_T17 (SEQ ID NO: 4397) | 590 | 601 |

This segment can be found in the following protein(s): M62205_PEA_1_P40.

Segment cluster M62205_PEA_1_node_25 (SEQ ID NO:6717) according to the present invention can be found in the following transcript(s): M62205_PEA_1_T3 (SEQ ID NO:4396) and M62205_PEA_1_T17 (SEQ ID NO:4397). Table 6395 below describes the starting and ending position of this segment on each transcript.

TABLE 6395

| Segment location on transcripts | | |
|---|---|---|
| Transcript name | Segment starting position | Segment ending position |
| M62205_PEA_1_T3 (SEQ ID NO: 4396) | 602 | 610 |
| M62205_PEA_1_T17 (SEQ ID NO: 4397) | 602 | 610 |

This segment can be found in the following protein(s): M62205_PEA_1_P40.

Segment cluster M62205_PEA_1_node_26 (SEQ ID NO:6718) according to the present invention can be found in the following transcript(s): M62205_PEA_1_T3 (SEQ ID NO:4396) and M62205_PEA_1_T17 (SEQ ID NO:4397). Table 6396 below describes the starting and ending position of this segment on each transcript.

TABLE 6396

| Segment location on transcripts | | |
|---|---|---|
| Transcript name | Segment starting position | Segment ending position |
| M62205_PEA_1_T3 (SEQ ID NO: 4396) | 611 | 616 |
| M62205_PEA_1_T17 (SEQ ID NO: 4397) | 611 | 616 |

This segment can be found in the following protein(s): M62205_PEA_1_P40.

Segment cluster M62205_PEA_1_node_27 (SEQ ID NO:6719) according to the present invention is supported by 113 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6397 below describes the starting and ending position of this segment on each transcript.

TABLE 6397

| Segment location on transcripts | | |
|---|---|---|
| Transcript name | Segment starting position | Segment ending position |
| M62205_PEA_1_T3 (SEQ ID NO: 4396) | 617 | 652 |
| M62205_PEA_1_T17 (SEQ ID NO: 4397) | 617 | 652 |

This segment can be found in the following protein(s): M62205_PEA_1_P40.

Segment cluster M62205_PEA_1_node_29 (SEQ ID NO:6720) according to the present invention can be found in the following transcript(s): M62205_PEA_1_T3 (SEQ ID NO:4396) and M62205_PEA_1_T17 (SEQ ID NO:4397). Table 6398 below describes the starting and ending position of this segment on each transcript.

TABLE 6398

| Segment location on transcripts | | |
|---|---|---|
| Transcript name | Segment starting position | Segment ending position |
| M62205_PEA_1_T3 (SEQ ID NO: 4396) | 653 | 676 |
| M62205_PEA_1_T17 (SEQ ID NO: 4397) | 653 | 676 |

This segment can be found in the following protein(s): M62205_PEA_1_P40.

Segment cluster M62205_PEA_1_node_30 (SEQ ID NO:6721) according to the present invention is supported by 122 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6399 below describes the starting and ending position of this segment on each transcript.

TABLE 6399

| Segment location on transcripts | | |
|---|---|---|
| Transcript name | Segment starting position | Segment ending position |
| M62205_PEA_1_T3 (SEQ ID NO: 4396) | 677 | 724 |
| M62205_PEA_1_T17 (SEQ ID NO: 4397) | 677 | 724 |

This segment can be found in the following protein(s): M62205_PEA_1_P40.

Segment cluster M62205_PEA_1_node_31 (SEQ ID NO:6722) according to the present invention can be found in the following transcript(s): M62205_PEA_1_T3 (SEQ ID NO:4396) and M62205_PEA_1_T117 (SEQ ID NO:4397). Table 6400 below describes the starting and ending position of this segment on each transcript.

TABLE 6400

| Segment location on transcripts | | |
|---|---|---|
| Transcript name | Segment starting position | Segment ending position |
| M62205_PEA_1_T3 (SEQ ID NO: 4396) | 725 | 745 |
| M62205_PEA_1_T17 (SEQ ID NO: 4397) | 725 | 745 |

This segment can be found in the following protein(s): M62205_PEA_1_P40.

Segment cluster M62205_PEA_1_node_32 (SEQ ID NO:6723) according to the present invention is supported by 119 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6401 below describes the starting and ending position of this segment on each transcript.

TABLE 6401

| Segment location on transcripts | | |
|---|---|---|
| Transcript name | Segment starting position | Segment ending position |
| M62205_PEA_1_T3 (SEQ ID NO: 4396) | 746 | 814 |
| M62205_PEA_1_T17 (SEQ ID NO: 4397) | 746 | 814 |

This segment can be found in the following protein(s): M62205_PEA_1_P40.

Segment cluster M62205_PEA_1_node_36 (SEQ ID NO:6724) according to the present invention is supported by 111 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6402 below describes the starting and ending position of this segment on each transcript.

TABLE 6402

| Segment location on transcripts | | |
|---|---|---|
| Transcript name | Segment starting position | Segment ending position |
| M62205_PEA_1_T3 (SEQ ID NO: 4396) | 815 | 847 |
| M62205_PEA_1_T17 (SEQ ID NO: 4397) | 815 | 847 |

This segment can be found in the following protein(s): M62205_PEA_1_P40.

Segment cluster M62205_PEA_1_node_37 (SEQ ID NO:6725) according to the present invention can be found in the following transcript(s): M62205_PEA_1_T3 (SEQ ID NO:4396) and M62205_PEA_1_T17 (SEQ ID NO:4397). Table 6403 below describes the starting and ending position of this segment on each transcript.

TABLE 6403

| Segment location on transcripts | | |
|---|---|---|
| Transcript name | Segment starting position | Segment ending position |
| M62205_PEA_1_T3 (SEQ ID NO: 4396) | 848 | 853 |
| M62205_PEA_1_T17 (SEQ ID NO: 4397) | 848 | 853 |

This segment can be found in the following protein(s): M62205_PEA_1_P40.

Segment cluster M62205_PEA_1_node_38 (SEQ ID NO:6726) according to the present invention is supported by 122 libraries. The number of libraries was determined as previously ? described. This segment can be found in the following transcript(s): M62205_PEA_1_T3 (SEQ ID NO:4396) and M62205_PEA_1_T17 (SEQ ID NO:4397). Table 6404 below describes the starting and ending position of this segment on each transcript.

TABLE 6404

| Segment location on transcripts | | |
|---|---|---|
| Transcript name | Segment starting position | Segment ending position |
| M62205_PEA_1_T3 (SEQ ID NO: 4396) | 854 | 928 |
| M62205_PEA_1_T17 (SEQ ID NO: 4397) | 854 | 928 |

This segment can be found in the following protein(s): M62205_PEA_1_P40.

Segment cluster M62205_PEA_1_node_39 (SEQ ID NO:6727) according to the present invention can be found in the following transcript(s): M62205_PEA_1_T3 (SEQ ID NO:4396) and M62205_PEA_1_T17 (SEQ ID NO:4397). Table 6405 below describes the starting and ending position of this segment on each transcript.

TABLE 6405

| Segment location on transcripts | | |
|---|---|---|
| Transcript name | Segment starting position | Segment ending position |
| M62205_PEA_1_T3 (SEQ ID NO: 4396) | 929 | 940 |
| M62205_PEA_1_T17 (SEQ ID NO: 4397) | 929 | 940 |

This segment can be found in the following protein(s): M62205_PEA_1_P40.

Segment cluster M62205_PEA_1_node_41 (SEQ ID NO:6728) according to the present invention is supported by 121 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6406 below describes the starting and ending position of this segment on each transcript.

TABLE 6406

| Segment location on transcripts | | |
|---|---|---|
| Transcript name | Segment starting position | Segment ending position |
| M62205_PEA_1_T3 (SEQ ID NO: 4396) | 1156 | 1188 |
| M62205_PEA_1_T17 (SEQ ID NO: 4397) | 1156 | 1188 |

This segment can be found in the following protein(s): M62205_PEA_1_P40.

Segment cluster M62205_PEA_1_node_42 (SEQ ID NO:6729) according to the present invention can be found in the following transcript(s): M62205_PEA_1_T3 (SEQ ID NO:4396) and M62205_PEA_1_T17 (SEQ ID NO:4397). Table 6407 below describes the starting and ending position of this segment on each transcript.

TABLE 6407

| Segment location on transcripts | | |
|---|---|---|
| Transcript name | Segment starting position | Segment ending position |
| M62205_PEA_1_T3 (SEQ ID NO: 4396) | 1189 | 1200 |
| M62205_PEA_1_T17 (SEQ ID NO: 4397) | 1189 | 1200 |

This segment can be found in the following protein(s): M62205_PEA_1_P40.

Segment cluster M62205_PEA_1_node_43 (SEQ ID NO:6730) according to the present invention can be found in the following transcript(s): M62205_PEA_1_T3 (SEQ ID NO:4396) and M62205_PEA_1_T17 (SEQ ID NO:4397). Table 6408 below describes the starting and ending position of this segment on each transcript.

TABLE 6408

| Transcript name | Segment location on transcripts | |
|---|---|---|
| | Segment starting position | Segment ending position |
| M62205_PEA_1_T3 (SEQ ID NO: 4396) | 1201 | 1209 |
| M62205_PEA_1_T17 (SEQ ID NO: 4397) | 1201 | 1209 |

This segment can be found in the following protein(s): M62205_PEA_1_P40.

Segment cluster M62205_PEA_1_node_44 (SEQ ID NO:6731) according to the present invention is supported by 125 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6409 below describes the starting and ending position of this segment on each transcript.

TABLE 6409

| Transcript name | Segment location on transcripts | |
|---|---|---|
| | Segment starting position | Segment ending position |
| M62205_PEA_1_T3 (SEQ ID NO: 4396) | 1210 | 1239 |
| M62205_PEA_1_T17 (SEQ ID NO: 4397) | 1210 | 1239 |

This segment can be found in the following protein(s): M62205_PEA_1_P40.

Segment cluster M62205_PEA_1_node_45 (SEQ ID NO:6732) according to the present invention is supported by 133 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6410 below describes the starting and ending position of this segment on each transcript.

TABLE 6410

| Transcript name | Segment location on transcripts | |
|---|---|---|
| | Segment starting position | Segment ending position |
| M62205_PEA_1_T3 (SEQ ID NO: 4396) | 1240 | 1290 |
| M62205_PEA_1_T17 (SEQ ID NO: 4397) | 1240 | 1290 |

This segment can be found in the following protein(s): M62205_PEA_1_P40.

Segment cluster M62205_PEA_1_node_46 (SEQ ID NO:6733) according to the present invention can be found in the following transcript(s): M62205_PEA_1_T3 (SEQ ID NO:4396) and M62205_PEA_1_T17 (SEQ ID NO:4397). Table 6411 below describes the starting and ending position of this segment on each transcript.

TABLE 6411

| Transcript name | Segment location on transcripts | |
|---|---|---|
| | Segment starting position | Segment ending position |
| M62205_PEA_1_T3 (SEQ ID NO: 4396) | 1291 | 1305 |
| M62205_PEA_1_T17 (SEQ ID NO: 4397) | 1291 | 1305 |

This segment can be found in the following protein(s): M62205_PEA_1_P40.

Segment cluster M62205_PEA_1_node_47 (SEQ ID NO:6734) according to the present invention is supported by 138 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6412 below describes the starting and ending position of this segment on each transcript.

TABLE 6412

| Transcript name | Segment location on transcripts | |
|---|---|---|
| | Segment starting position | Segment ending position |
| M62205_PEA_1_T3 (SEQ ID NO: 4396) | 1306 | 1353 |
| M62205_PEA_1_T17 (SEQ ID NO: 4397) | 1306 | 1353 |

This segment can be found in the following protein(s): M62205_PEA_1_P40.

Segment cluster M62205_PEA_1_node_48 (SEQ ID NO:6735) according to the present invention can be found in the following transcript(s): M62205_PEA_1_T3 (SEQ ID NO:4396) and M62205_PEA_1_T17 (SEQ ID NO:4397). Table 6413 below describes the starting and ending position of this segment on each transcript.

TABLE 6413

| Transcript name | Segment location on transcripts | |
|---|---|---|
| | Segment starting position | Segment ending position |
| M62205_PEA_1_T3 (SEQ ID NO: 4396) | 1354 | 1376 |
| M62205_PEA_1_T17 (SEQ ID NO: 4397) | 1354 | 1376 |

This segment can be found in the following protein(s): M62205_PEA_1_P40.

Segment cluster M62205_PEA_1_node_50 (SEQ ID NO:6736) according to the present invention is supported by 144 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6414 below describes the starting and ending position of this segment on each transcript.

TABLE 6414

| Transcript name | Segment location on transcripts | |
|---|---|---|
| | Segment starting position | Segment ending position |
| M62205_PEA_1_T3 (SEQ ID NO: 4396) | 1377 | 1420 |
| M62205_PEA_1_T17 (SEQ ID NO: 4397) | 1377 | 1420 |

This segment can be found in a non-coding region of transcript(s) that are related to the following protein(s): M62205_PEA_1_P40.

Segment cluster M62205_PEA_1_node_57 (SEQ ID NO:6737) according to the present invention is supported by 134 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6415 below describes the starting and ending position of this segment on each transcript.

TABLE 6415

| Transcript name | Segment location on transcripts | |
|---|---|---|
| | Segment starting position | Segment ending position |
| M62205_PEA_1_T3 (SEQ ID NO: 4396) | 1421 | 1453 |
| M62205_PEA_1_T17 (SEQ ID NO: 4397) | 3886 | 3918 |

This segment can be found in a non-coding region of transcript(s) that are related to the following protein(s): M62205_PEA_1_P40.

Segment cluster M62205_PEA_1_node_58 (SEQ ID NO:6738) according to the present invention can be found in the following transcript(s): M62205_PEA_1_T3 (SEQ ID NO:4396) and M62205_PEA_1_T17 (SEQ ID NO:4397). Table 6416 below describes the starting and ending position of this segment on each transcript.

TABLE 6416

| Transcript name | Segment location on transcripts | |
|---|---|---|
| | Segment starting position | Segment ending position |
| M62205_PEA_1_T3 (SEQ ID NO: 4396) | 1454 | 1466 |
| M62205_PEA_1_T17 (SEQ ID NO: 4397) | 3919 | 3931 |

This segment can be found in a non-coding region of transcript(s) that are related to the following protein(s): M62205_PEA_1_P40.

Segment cluster M62205_PEA_1_node_59 (SEQ ID NO:6739) according to the present invention can be found in the following transcript(s): M62205_PEA_1_T3 (SEQ ID NO:4396) and M62205_PEA_1_T17 (SEQ ID NO:4397). Table 6417 below describes the starting and ending position of this segment on each transcript.

TABLE 6417

| Transcript name | Segment location on transcripts | |
|---|---|---|
| | Segment starting position | Segment ending position |
| M62205_PEA_1_T3 (SEQ ID NO: 4396) | 1467 | 1476 |
| M62205_PEA_1_T17 (SEQ ID NO: 4397) | 3932 | 3941 |

This segment can be found in a non-coding region of transcript(s) that are related to the following protein(s): M62205_PEA_1_P40.

Segment cluster M62205_PEA_1_node_60 (SEQ ID NO:6740) according to the present invention can be found in the following transcript(s): M62205_PEA_1_T3 (SEQ ID NO:4396) and M62205_PEA_1_T17 (SEQ ID NO:4397). Table 6418 below describes the starting and ending position of this segment on each transcript.

TABLE 6418

| Transcript name | Segment location on transcripts | |
|---|---|---|
| | Segment starting position | Segment ending position |
| M62205_PEA_1_T3 (SEQ ID NO: 4396) | 1477 | 1491 |
| M62205_PEA_1_T17 (SEQ ID NO: 4397) | 3942 | 3956 |

This segment can be found in a non-coding region of transcript(s) that are related to the following protein(s): M62205_PEA_1_P40.

Segment cluster M62205_PEA_1_node_61 (SEQ ID NO:6741) according to the present invention can be found in the following transcript(s): M62205_PEA_1_T3 (SEQ ID NO:4396) and M62205_PEA_1_T17 (SEQ ID NO:4397). Table 6419 below describes the starting and ending position of this segment on each transcript.

TABLE 6419

| Transcript name | Segment location on transcripts | |
|---|---|---|
| | Segment starting position | Segment ending position |
| M62205_PEA_1_T3 (SEQ ID NO: 4396) | 1492 | 1506 |
| M62205_PEA_1_T17 (SEQ ID NO: 4397) | 3957 | 3971 |

This segment can be found in a non-coding region of transcript(s) that are related to the following protein(s): M62205_PEA_1_P40.

Segment cluster M62205_PEA_1_node_63 (SEQ ID NO:6742) according to the present invention can be found in the following transcript(s): M62205_PEA_1_T3 (SEQ ID NO:4396) and M62205_PEA_1_T17 (SEQ ID NO:4397). Table 6420 below describes the starting and ending position of this segment on each transcript.

TABLE 6420

| Transcript name | Segment starting position | Segment ending position |
|---|---|---|
| M62205_PEA_1_T3 (SEQ ID NO: 4396) | 1507 | 1524 |
| M62205_PEA_1_T17 (SEQ ID NO: 4397) | 3972 | 3989 |

This segment can be found in a non-coding region of transcript(s) that are related to the following protein(s): M62205_PEA_1_P40.

Segment cluster M62205_PEA_1_node_64 (SEQ ID NO:6743) according to the present invention is supported by 139 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6421 below describes the starting and ending position of this segment on each transcript.

TABLE 6421

| Transcript name | Segment starting position | Segment ending position |
|---|---|---|
| M62205_PEA_1_T3 (SEQ ID NO: 4396) | 1525 | 1587 |
| M62205_PEA_1_T17 (SEQ ID NO: 4397) | 3990 | 4052 |

This segment can be found in a non-coding region of transcript(s) that are related to the following protein(s): M62205_PEA_1_P40.

Segment cluster M62205_PEA_1_node_65 (SEQ ID NO:6744) according to the present invention can be found in the following transcript(s): M62205_PEA_1_T3 (SEQ ID NO:4396) and M62205_PEA_1_T17 (SEQ ID NO:4397). Table 6422 below describes the starting and ending position of this segment on each transcript.

TABLE 6422

| Transcript name | Segment starting position | Segment ending position |
|---|---|---|
| M62205_PEA_1_T3 (SEQ ID NO: 4396) | 1588 | 1599 |
| M62205_PEA_1_T17 (SEQ ID NO: 4397) | 4053 | 4064 |

This segment can be found in a non-coding region of transcript(s) that are related to the following protein(s): M62205_PEA_1_P40.

Segment cluster M62205_PEA_1_node_66 (SEQ ID NO:6745) according to the present invention is supported by 138 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6423 below describes the starting and ending position of this segment on each transcript.

TABLE 6423

| Transcript name | Segment starting position | Segment ending position |
|---|---|---|
| M62205_PEA_1_T3 (SEQ ID NO: 4396) | 1600 | 1659 |
| M62205_PEA_1_T17 (SEQ ID NO: 4397) | 4065 | 4124 |

This segment can be found in a non-coding region of transcript(s) that are related to the following protein(s): M62205_PEA_1_P40.

Segment cluster M62205_PEA_1_node_67 (SEQ ID NO:6746) according to the present invention is supported by 128 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6424 below describes the starting and ending position of this segment on each transcript.

TABLE 6424

| Transcript name | Segment starting position | Segment ending position |
|---|---|---|
| M62205_PEA_1_T3 (SEQ ID NO: 4396) | 1660 | 1714 |
| M62205_PEA_1_T17 (SEQ ID NO: 4397) | 4125 | 4179 |

This segment can be found in a non-coding region of transcript(s) that are related to the following protein(s): M62205_PEA_1_P40.

Segment cluster M62205_PEA_1_node_68 (SEQ ID NO:6747) according to the present invention is supported by 131 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6425 below describes the starting and ending position of this segment on each transcript.

TABLE 6425

| Transcript name | Segment starting position | Segment ending position |
|---|---|---|
| M62205_PEA_1_T3 (SEQ ID NO: 4396) | 1715 | 1783 |
| M62205_PEA_1_T17 (SEQ ID NO: 4397) | 4180 | 4248 |

This segment can be found in a non-coding region of transcript(s) that are related to the following protein(s): M62205_PEA_1_P40.

Segment cluster M62205_PEA_1_node_69 (SEQ ID NO:6748) according to the present invention can be found in the following transcript(s): M62205_PEA_1_T3 (SEQ ID NO:4396) and M62205_PEA_1_T17 (SEQ ID NO:4397). Table 6426 below describes the starting and ending position of this segment on each transcript.

TABLE 6426

Segment location on transcripts

| Transcript name | Segment starting position | Segment ending position |
|---|---|---|
| M62205_PEA_1_T3 (SEQ ID NO: 4396) | 1784 | 1788 |
| M62205_PEA_1_T17 (SEQ ID NO: 4397) | 4249 | 4253 |

This segment can be found in a non-coding region of transcript(s) that are related to the following protein(s): M62205_PEA_1_P40.

Segment cluster M62205_PEA_1_node_70 (SEQ ID NO:6749) according to the present invention can be found in the following transcript(s): M62205_PEA_1_T3 (SEQ ID NO:4396) and M62205_PEA_1_T117 (SEQ ID NO:4397). Table 6427 below describes the starting and ending position of this segment on each transcript.

TABLE 6427

Segment location on transcripts

| Transcript name | Segment starting position | Segment ending position |
|---|---|---|
| M62205_PEA_1_T3 (SEQ ID NO: 4396) | 1789 | 1795 |
| M62205_PEA_1_T17 (SEQ ID NO: 4397) | 4254 | 4260 |

This segment can be found in a non-coding region of transcript(s) that are related to the following protein(s): M62205_PEA_1_P40.

Segment cluster M62205_PEA_1_node_71 (SEQ ID NO:6750) according to the present invention can be found in the following transcript(s): M62205_PEA_1_T3 (SEQ ID NO:4396) and M62205_PEA_1_T17 (SEQ ID NO:4397). Table 6428 below describes the starting and ending position of this segment on each transcript.

TABLE 6428

Segment location on transcripts

| Transcript name | Segment starting position | Segment ending position |
|---|---|---|
| M62205_PEA_1_T3 (SEQ ID NO: 4396) | 1796 | 1801 |
| M62205_PEA_1_T17 (SEQ ID NO: 4397) | 4261 | 4266 |

This segment can be found in a non-coding region of transcript(s) that are related to the following protein(s): M62205_PEA_1_P40.

Segment cluster M62205_PEA_1_node_72 (SEQ ID NO:6751) according to the present invention can be found in the following transcript(s): M62205_PEA_1_T3 (SEQ ID NO:4396) and M62205_PEA_1_T17 (SEQ ID NO:4397). Table 6429 below describes the starting and ending position of this segment on each transcript.

TABLE 6429

Segment location on transcripts

| Transcript name | Segment starting position | Segment ending position |
|---|---|---|
| M62205_PEA_1_T3 (SEQ ID NO: 4396) | 1802 | 1816 |
| M62205_PEA_1_T17 (SEQ ID NO: 4397) | 4267 | 4281 |

This segment can be found in a non-coding region of transcript(s) that are related to the following protein(s): M62205_PEA_1_P40.

Segment cluster M62205_PEA_1_node_74 (SEQ ID NO:6752) according to the present invention is supported by 130 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6430 below describes the starting and ending position of this segment on each transcript.

TABLE 6430

Segment location on transcripts

| Transcript name | Segment starting position | Segment ending position |
|---|---|---|
| M62205_PEA_1_T3 (SEQ ID NO: 4396) | 1953 | 1978 |
| M62205_PEA_1_T17 (SEQ ID NO: 4397) | 4418 | 4443 |

This segment can be found in a non-coding region of transcript(s) that are related to the following protein(s): M62205_PEA_1_P40.

Segment cluster M62205_PEA_1_node_75 (SEQ ID NO:6753) according to the present invention is supported by 139 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6431 below describes the starting and ending position of this segment on each transcript.

TABLE 6431

Segment location on transcripts

| Transcript name | Segment starting position | Segment ending position |
|---|---|---|
| M62205_PEA_1_T3 (SEQ ID NO: 4396) | 1979 | 2023 |
| M62205_PEA_1_T17 (SEQ ID NO: 4397) | 4444 | 4488 |

This segment can be found in a non-coding region of transcript(s) that are related to the following protein(s): M62205_PEA_1_P40.

Segment cluster M62205_PEA_1_node_77 (SEQ ID NO:6754) according to the present invention can be found in the following transcript(s): M62205_PEA_1_T3 (SEQ ID NO:4396) and M62205_PEA_1_T17 (SEQ ID NO:4397). Table 6432 below describes the starting and ending position of this segment on each transcript.

TABLE 6432

| Segment location on transcripts | | |
|---|---|---|
| Transcript name | Segment starting position | Segment ending position |
| M62205_PEA_1_T3 (SEQ ID NO: 4396) | 2320 | 2339 |
| M62205_PEA_1_T17 (SEQ ID NO: 4397) | 4785 | 4804 |

This segment can be found in a non-coding region of transcript(s) that are related to the following protein(s): M62205_PEA_1_P40.

Segment cluster M62205_PEA_1_node_78 (SEQ ID NO:6755) according to the present invention can be found in the following transcript(s): M62205_PEA_1_T3 (SEQ ID NO:4396) and M62205_PEA_1_T17 (SEQ ID NO:4397). Table 6433 below describes the starting and ending position of this segment on each transcript.

TABLE 6433

| Segment location on transcripts | | |
|---|---|---|
| Transcript name | Segment starting position | Segment ending position |
| M62205_PEA_1_T3 (SEQ ID NO: 4396) | 2340 | 2360 |
| M62205_PEA_1_T17 (SEQ ID NO: 4397) | 4805 | 4825 |

This segment can be found in a non-coding region of transcript(s) that are related to the following protein(s): M62205_PEA_1_P40.

Segment cluster M62205_PEA_1_node_79 (SEQ ID NO:6756) according to the present invention can be found in the following transcript(s): M62205_PEA_1_T3 (SEQ ID NO:4396) and M62205_PEA_1_T17 (SEQ ID NO:4397). Table 6434 below describes the starting and ending position of this segment on each transcript.

TABLE 6434

| Segment location on transcripts | | |
|---|---|---|
| Transcript name | Segment starting position | Segment ending position |
| M62205_PEA_1_T3 (SEQ ID NO: 4396) | 2361 | 2367 |
| M62205_PEA_1_T17 (SEQ ID NO: 4397) | 4826 | 4832 |

This segment can be found in a non-coding region of transcript(s) that are related to the following protein(s): M62205_PEA_1_P40.

Segment cluster M62205_PEA_1_node_80 (SEQ ID NO:6757) according to the present invention can be found in the following transcript(s): M62205_PEA_1_T3 (SEQ ID NO:4396) and M62205_PEA_1_T17 (SEQ ID NO:4397). Table 6435 below describes the starting and ending position of this segment on each transcript.

TABLE 6435

| Segment location on transcripts | | |
|---|---|---|
| Transcript name | Segment starting position | Segment ending position |
| M62205_PEA_1_T3 (SEQ ID NO: 4396) | 2368 | 2391 |
| M62205_PEA_1_T17 (SEQ ID NO: 4397) | 4833 | 4856 |

This segment can be found in a non-coding region of transcript(s) that are related to the following protein(s): M62205_PEA_1_P40.

Segment cluster M62205_PEA_1_node_81 (SEQ ID NO:6758) according to the present invention is supported by 153 libraries. The number of libraries was determined as previously described. This segment. can be found in the following transcript(s): M62205_PEA_1_T3 (SEQ ID NO:4396) and M62205_PEA_1_T17 (SEQ ID NO:4397). Table 6436 below describes the starting and ending position of this segment on each transcript.

TABLE 6436

| Segment location on transcripts | | |
|---|---|---|
| Transcript name | Segment starting position | Segment ending position |
| M62205_PEA_1_T3 (SEQ ID NO: 4396) | 2392 | 2427 |
| M62205_PEA_1_T17 (SEQ ID NO: 4397) | 4857 | 4892 |

This segment can be found in a non-coding region of transcript(s) that are related to the following protein(s): M62205_PEA_1_P40.

Segment cluster M62205_PEA_1_node_82 (SEQ ID NO:6759) according to the present invention can be found in the following transcript(s): M62205_PEA_1_T3 (SEQ ID NO:4396) and M62205_PEA_1_T17 (SEQ ID NO:4397). Table 6437 below describes the starting and ending position of this segment on each transcript.

TABLE 6437

| Segment location on transcripts | | |
|---|---|---|
| Transcript name | Segment starting position | Segment ending position |
| M62205_PEA_1_T3 (SEQ ID NO: 4396) | 2428 | 2444 |
| M62205_PEA_1_T17 (SEQ ID NO: 4397) | 4893 | 4909 |

This segment can be found in a non-coding region of transcript(s) that are related to the following protein(s): M62205_PEA_1_P40.

Segment cluster M62205_PEA_1_node_83 (SEQ ID NO:6760) according to the present invention can be found in the following transcript(s): M62205_PEA_1_T3 (SEQ ID NO:4396) and M62205_PEA_1_T17 (SEQ ID NO:4397). Table 6438 below describes the starting and ending position of this segment on each transcript.

TABLE 6438

| Segment location on transcripts | | |
|---|---|---|
| Transcript name | Segment starting position | Segment ending position |
| M62205_PEA_1_T3 (SEQ ID NO: 4396) | 2445 | 2455 |
| M62205_PEA_1_T17 (SEQ ID NO: 4397) | 4910 | 4920 |

This segment can be found in a non-coding region of transcript(s) that are related to the following protein(s): M62205_PEA_1_P40.

Segment cluster M62205_PEA_1_node_84 (SEQ ID NO:6761) according to the present invention is supported by 164 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6439 below describes the starting and ending position of this segment on each transcript.

TABLE 6439

| Segment location on transcripts | | |
|---|---|---|
| Transcript name | Segment starting position | Segment ending position |
| M62205_PEA_1_T3 (SEQ ID NO: 4396) | 2456 | 2488 |
| M62205_PEA_1_T17 (SEQ ID NO: 4397) | 4921 | 4953 |

This segment can be found in a non-coding region of transcript(s) that are related to the following protein(s): M62205_PEA_1_P40.

Segment cluster M62205_PEA_1_node_85 (SEQ ID NO:6762) according to the present invention can be found in the following transcript(s): M62205_PEA_1_T3 (SEQ ID NO:4396) and M62205_PEA_1_T17 (SEQ ID NO:4397). Table 6440 below describes the starting and ending position of this segment on each transcript.

TABLE 6440

| Segment location on transcripts | | |
|---|---|---|
| Transcript name | Segment starting position | Segment ending position |
| M62205_PEA_1_T3 (SEQ ID NO: 4396) | 2489 | 2492 |
| M62205_PEA_1_T17 (SEQ ID NO: 4397) | 4954 | 4957 |

This segment can be found in a non-coding region of transcript(s) that are related to the following protein(s): M62205_PEA_1_P40.

Segment cluster M62205_PEA_1_node_86 (SEQ ID NO:6763) according to the present invention can be found in the following transcript(s): M62205_PEA_1_T3 (SEQ ID NO:4396) and M62205_PEA_1_T17 (SEQ ID NO:4397). Table 6441 below describes the starting and ending position of this segment on each transcript.

TABLE 6441

| Segment location on transcripts | | |
|---|---|---|
| Transcript name | Segment starting position | Segment ending position |
| M62205_PEA_1_T3 (SEQ ID NO: 4396) | 2493 | 2513 |
| M62205_PEA_1_T17 (SEQ ID NO: 4397) | 4958 | 4978 |

This segment can be found in a non-coding region of transcript(s) that are related to the following protein(s): M62205_PEA_1_P40.

Segment cluster M62205_PEA_1_node_87 (SEQ ID NO:6764) according to the present invention can be found in the following transcript(s): M62205_PEA_1_T3 (SEQ ID NO:4396) and M62205_PEA_1_T17 (SEQ ID NO:4397). Table 6442 below describes the starting and ending position of this segment on each transcript.

TABLE 6442

| Segment location on transcripts | | |
|---|---|---|
| Transcript name | Segment starting position | Segment ending position |
| M62205_PEA_1_T3 (SEQ ID NO: 4396) | 2514 | 2522 |
| M62205_PEA_1_T17 (SEQ ID NO: 4397) | 4979 | 4987 |

This segment can be found in a non-coding region of transcript(s) that are related to the following protein(s): M62205_PEA_1_P40.

Segment cluster M62205_PEA_1_node_88 (SEQ ID NO:6765) according to the present invention is supported by 179 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6443 below describes the starting and ending position of this segment on each transcript.

TABLE 6443

| Segment location on transcripts | | |
|---|---|---|
| Transcript name | Segment starting position | Segment ending position |
| M62205_PEA_1_T3 (SEQ ID NO: 4396) | 2523 | 2582 |
| M62205_PEA_1_T17 (SEQ ID NO: 4397) | 4988 | 5047 |

This segment can be found in a non-coding region of transcript(s) that are related to the following protein(s): M62205_PEA_1_P40.

Segment cluster M62205_PEA_1_node_89 (SEQ ID NO:6766) according to the present invention is supported by 182 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6444 below describes the starting and ending position of this segment on each transcript.

TABLE 6444

| Transcript name | Segment location on transcripts | |
|---|---|---|
| | Segment starting position | Segment ending position |
| M62205_PEA_1_T3 (SEQ ID NO: 4396) | 2583 | 2639 |
| M62205_PEA_1_T17 (SEQ ID NO: 4397) | 5048 | 5104 |

This segment can be found in a non-coding region of transcript(s) that are related to the following protein(s): M62205_PEA_1_P40.

Segment cluster M62205_PEA_1_node_90 (SEQ ID NO:6767) according to the present invention is supported by 201 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6445 below describes the starting and ending position of this segment on each transcript.

TABLE 6445

| Transcript name | Segment location on transcripts | |
|---|---|---|
| | Segment starting position | Segment ending position |
| M62205_PEA_1_T3 (SEQ ID NO: 4396) | 2640 | 2730 |
| M62205_PEA_1_T17 (SEQ ID NO: 4397) | 5105 | 5195 |

This segment can be found in a non-coding region of transcript(s) that are related to the following protein(s): M62205_PEA_1_P40.

Segment cluster M62205_PEA_1_node_91 (SEQ ID NO:6768) according to the present invention can be found in the following transcript(s): M62205_PEA_1_T3 (SEQ ID NO:4396) and M62205_PEA_1_T17 (SEQ ID NO:4397). Table 6446 below describes the starting and ending position of this segment on each transcript.

TABLE 6446

| Transcript name | Segment location on transcripts | |
|---|---|---|
| | Segment starting position | Segment ending position |
| M62205_PEA_1_T3 (SEQ ID NO: 4396) | 2731 | 2734 |
| M62205_PEA_1_T17 (SEQ ID NO: 4397) | 5196 | 5199 |

This segment can be found in a non-coding region of transcript(s) that are related to the following protein(s): M62205_PEA_1_P40.

Segment cluster M62205_PEA_1_node_92 (SEQ ID NO:6769) according to the present invention is supported by 194 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6447 below describes the starting and ending position of this segment on each transcript.

TABLE 6447

| Transcript name | Segment location on transcripts | |
|---|---|---|
| | Segment starting position | Segment ending position |
| M62205_PEA_1_T3 (SEQ ID NO: 4396) | 2735 | 2763 |
| M62205_PEA_1_T17 (SEQ ID NO: 4397) | 5200 | 5228 |

This segment can be found in a non-coding region of transcript(s) that are related to the following protein(s): M62205_PEA_1_P40.

Segment cluster M62205_PEA_1_node_93 (SEQ ID NO:6770) according to the present invention can be found in the following transcript(s): M62205_PEA_1_T3 (SEQ ID NO:4396) and M62205_PEA_1_T17 (SEQ ID NO:4397). Table 6448 below describes the starting and ending position of this segment on each transcript.

TABLE 6448

| Transcript name | Segment location on transcripts | |
|---|---|---|
| | Segment starting position | Segment ending position |
| M62205_PEA_1_T3 (SEQ ID NO: 4396) | 2764 | 2777 |
| M62205_PEA_1_T17 (SEQ ID NO: 4397) | 5229 | 5242 |

This segment can be found in a non-coding region of transcript(s) that are related to the following protein(s): M62205_PEA_1_P40.

Segment cluster M62205_PEA_1_node_94 (SEQ ID NO:6771) according to the present invention is supported by 196 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6449 below describes the starting and ending position of this segment on each transcript.

TABLE 6449

| Transcript name | Segment location on transcripts | |
|---|---|---|
| | Segment starting position | Segment ending position |
| M62205_PEA_1_T3 (SEQ ID NO: 4396) | 2778 | 2809 |
| M62205_PEA_1_T17 (SEQ ID NO: 4397) | 5243 | 5274 |

This segment can be found in a non-coding region of transcript(s) that are related to the following protein(s): M62205_PEA_1_P40.

Segment cluster M62205_PEA_1_node_95 (SEQ ID NO:6772) according to the present invention can be found in the following transcript(s): M62205_PEA_1_T3 (SEQ ID NO:4396) and M62205_PEA_1_T17 (SEQ ID NO:4397). Table 6450 below describes the starting and ending position of this segment on each transcript.

TABLE 6450

| Transcript name | Segment location on transcripts | |
|---|---|---|
| | Segment starting position | Segment ending position |
| M62205_PEA_1_T3 (SEQ ID NO: 4396) | 2810 | 2820 |
| M62205_PEA_1_T17 (SEQ ID NO: 4397) | 5275 | 5285 |

This segment can be found in a non-coding region of transcript(s) that are related to the following protein(s): M62205_PEA_1_P40.

Segment cluster M62205_PEA_1_node_96 (SEQ ID NO:6773) according to the present invention can be found in the following transcript(s): M62205_PEA_1_T3 (SEQ ID NO:4396) and M62205_PEA_1_T17 (SEQ ID NO:4397). Table 6451 below describes the starting and ending position of this segment on each transcript.

TABLE 6451

| Transcript name | Segment location on transcripts | |
|---|---|---|
| | Segment starting position | Segment ending position |
| M62205_PEA_1_T3 (SEQ ID NO: 4396) | 2821 | 2843 |
| M62205_PEA_1_T17 (SEQ ID NO: 4397) | 5286 | 5308 |

This segment can be found in a non-coding region of transcript(s) that are related to the following protein(s): M62205_PEA_1_P40.

Segment cluster M62205_PEA_1_node_97 (SEQ ID NO:6774) according to the present invention is supported by 189 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6452 below describes the starting and ending position of this segment on each transcript.

TABLE 6452

| Transcript name | Segment location on transcripts | |
|---|---|---|
| | Segment starting position | Segment ending position |
| M62205_PEA_1_T3 (SEQ ID NO: 4396) | 2844 | 2960 |
| M62205_PEA_1_T17 (SEQ ID NO: 4397) | 5309 | 5425 |

This segment can be found in a non-coding region of transcript(s) that are related to the following protein(s): M62205_PEA_1_P40.

Segment cluster M62205_PEA_1_node_98 (SEQ ID NO:6775) according to the present invention is supported by 175 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6453 below describes the starting and ending position of this segment on each transcript.

TABLE 6453

| Transcript name | Segment location on transcripts | |
|---|---|---|
| | Segment starting position | Segment ending position |
| M62205_PEA_1_T3 (SEQ ID NO: 4396) | 2961 | 3011 |
| M62205_PEA_1_T17 (SEQ ID NO: 4397) | 5426 | 5476 |

This segment can be found in a non-coding region of transcript(s) that are related to the following protein(s): M62205_PEA_1_P40.

Segment cluster M62205_PEA_1_node_99 (SEQ ID NO:6776) according to the present invention is supported by 166 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6454 below describes the starting and ending position of this segment on each transcript.

TABLE 6454

| Transcript name | Segment location on transcripts | |
|---|---|---|
| | Segment starting position | Segment ending position |
| M62205_PEA_1_T3 (SEQ ID NO: 4396) | 3012 | 3081 |
| M62205_PEA_1_T17 (SEQ ID NO: 4397) | 5477 | 5546 |

This segment can be found in a non-coding region of transcript(s) that are related to the following protein(s): M62205_PEA_1_P40.

Segment cluster M62205_PEA_1_node_100 (SEQ ID NO:6777) according to the present invention is supported by 157 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6455 below describes the starting and ending position of this segment on each transcript.

TABLE 6455

| Transcript name | Segment location on transcripts | |
|---|---|---|
| | Segment starting position | Segment ending position |
| M62205_PEA_1_T3 (SEQ ID NO: 4396) | 3082 | 3114 |
| M62205_PEA_1_T17 (SEQ ID NO: 4397) | 5547 | 5579 |

This segment can be found in a non-coding region of transcript(s) that are related to the following protein(s): M62205_PEA_1_P40.

Segment cluster M62205_PEA_1_node_101 (SEQ ID NO:6778) according to the present invention is supported by 147 libraries. The number of libraries was determined as previously described. This segment can be found in the following transcript(s): M62205_PEA_1_T3 (SEQ ID NO:4396) and M62205_PEA_1_T17 (SEQ ID NO:4397).

Table 6456 below describes the starting and ending position of this segment on each transcript.

TABLE 6456

Segment location on transcripts

| Transcript name | Segment starting position | Segment ending position |
|---|---|---|
| M62205_PEA_1_T3 (SEQ ID NO: 4396) | 3115 | 3159 |
| M62205_PEA_1_T17 (SEQ ID NO: 4397) | 5580 | 5624 |

This segment can be found in a non-coding region of transcript(s) that are related to the following protein(s): M62205_PEA_1_P40.

Segment cluster M62205_PEA_1_node_102 (SEQ ID NO:6779) according to the present invention can be found in the following transcript(s): M62205_PEA_1_T3 (SEQ ID NO:4396) and M62205_PEA_1_T17 (SEQ ID NO:4397). Table 6457 below describes the starting and ending position of this segment on each transcript.

TABLE 6457

Segment location on transcripts

| Transcript name | Segment starting position | Segment ending position |
|---|---|---|
| M62205_PEA_1_T3 (SEQ ID NO: 4396) | 3160 | 3179 |
| M62205_PEA_1_T17 (SEQ ID NO: 4397) | 5625 | 5644 |

This segment can be found in a non-coding region of transcript(s) that are related to the following protein(s): M62205_PEA_1_P40.

Segment cluster M62205_PEA_1_node_103 (SEQ ID NO:6780) according to the present invention is supported by 114 libraries. The number of libraries was determined as previously described. This segment can be found in the following transcript(s): M62205_PEA_1_T3 (SEQ ID NO:4396) and M62205_PEA_1_T17 (SEQ ID NO:4397). Table 6458 below describes the starting and ending position of this segment on each transcript.

TABLE 6458

Segment location on transcripts

| Transcript name | Segment starting position | Segment ending position |
|---|---|---|
| M62205_PEA_1_T3 (SEQ ID NO: 4396) | 3180 | 3213 |
| M62205_PEA_1_T17 (SEQ ID NO: 4397) | 5645 | 5678 |

This segment can be found in a non-coding region of transcript(s) that are related to the following protein(s): M62205_PEA_1_P40.

Description for Cluster M78228

Cluster M78228 features 8 transcript(s) and 22 segment(s) of interest, the names for which are given in Tables 6459 and 6460, respectively, the sequences themselves are given at the end of the application. The selected protein variants are given in Table 6461.

TABLE 6459

Transcripts of interest

Transcript Name

M78228_PEA_1_T0 (SEQ ID NO: 4398)
M78228_PEA_1_T1 (SEQ ID NO: 4399)
M78228_PEA_1_T12 (SEQ ID NO: 4400)
M78228_PEA_1_T15 (SEQ ID NO: 4401)
M78228_PEA_1_T16 (SEQ ID NO: 4402)
M78228_PEA_1_T18 (SEQ ID NO: 4403)
M78228_PEA_1_T24 (SEQ ID NO: 4404)
M78228_PEA_1_T25 (SEQ ID NO: 4405)

TABLE 6460

Segments of interest
Segment Name

M78228_PEA_1_node_0 (SEQ ID NO: 6781)
M78228_PEA_1_node_1 (SEQ ID NO: 6782)
M78228_PEA_1_node_6 (SEQ ID NO: 6783)
M78228_PEA_1_node_10 (SEQ ID NO: 6784)
M78228_PEA_1_node_17 (SEQ ID NO: 6785)
M78228_PEA_1_node_19 (SEQ ID NO: 6786)
M78228_PEA_1_node_25 (SEQ ID NO: 6787)
M78228_PEA_1_node_26 (SEQ ID NO: 6788)
M78228_PEA_1_node_29 (SEQ ID NO: 6789)
M78228_PEA_1_node_36 (SEQ ID NO: 6790)
M78228_PEA_1_node_2 (SEQ ID NO: 6791)
M78228_PEA_1_node_12 (SEQ ID NO: 6792)
M78228_PEA_1_node_14 (SEQ ID NO: 6793)
M78228_PEA_1_node_18 (SEQ ID NO: 6794)
M78228_PEA_1_node_20 (SEQ ID NO: 6795)
M78228_PEA_1_node_21 (SEQ ID NO: 6796)
M78228_PEA_1_node_22 (SEQ ID NO: 6797)
M78228_PEA_1_node_23 (SEQ ID NO: 6798)
M78228_PEA_1_node_32 (SEQ ID NO: 6799)
M78228_PEA_1_node_33 (SEQ ID NO: 6800)
M78228_PEA_1_node_34 (SEQ ID NO: 6801)
M78228_PEA_1_node_35 (SEQ ID NO: 6802)

TABLE 6461

Proteins of interest

| Protein Name | Corresponding Transcript(s) |
|---|---|
| M78228_PEA_1_P1 | M78228_PEA_1_T0 (SEQ ID NO: 4398); M78228_PEA_1_T1 (SEQ ID NO: 4399) |
| M78228_PEA_1_P8 | M78228_PEA_1_T12 (SEQ ID NO: 4400) |
| M78228_PEA_1_P11 | M78228_PEA_1_T15 (SEQ ID NO: 4401); M78228_PEA_1_T16 (SEQ ID NO: 4402) |
| M78228_PEA_1_P2 | M78228_PEA_1_T18 (SEQ ID NO: 4403) |

These sequences are variants of the known protein Aspartate aminotransferase, cytoplasmic (SwissProt accession identifier AATC_HUMAN; known also according to the synonyms EC 2.6.1.1; Transaminase A; Glutamate oxaloacetate transaminase-1), referred to herein as the previously known protein.

The sequence for protein Aspartate aminotransferase, cytoplasmic is given at the end of the application, as "Aspartate aminotransferase, cytoplasmic amino acid sequence". Known polymorphisms for this sequence are as shown in Table 6462.

TABLE 6462

Amino acid mutations for Known Protein

| SNP position(s) on amino acid sequence | Comment |
|---|---|
| 214 | H -> R |

Protein Aspartate aminotransferase, cytoplasmic localization is believed to be Cytoplasmic.

The following GO Annotation(s) apply to the previously known protein. The following annotation(s) were found: aspartate catabolism, which are annotation(s) related to Biological Process.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

The heart-selective diagnostic marker prediction engine provided the following results with regard to cluster M78228. Predictions were made for selective expression of transcripts of this contig in heart tissue, according to the previously described methods. The numbers on the y-axis of FIG. 149 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 149, concerning the number of heart-specific clones in libraries/sequences; as well as with regard to the histogram in FIG. 150, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 2.4; the ratio of expression of the cluster in heart specific ESTs to the overall expression of the cluster in muscle-specific ESTs which was found to be 2.6; and fisher exact test P-values were computed both for library and weighted clone counts to check that the counts are statistically significant, and were found to be 3.70E-04.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 2.4, which clearly supports specific expression in heart tissue.

As noted above, cluster M78228 features 22 segment(s), which were listed in Table 6460 above and for which the sequence(s) are given at the end of the application. These segment(s) are portions of nucleic acid sequence(s) which are described herein separately because they are of particular interest. A description of each segment according to the present invention is now provided.

Segment cluster M78228_PEA_1_node_0 (SEQ ID NO:6781) according to the present invention is supported by 12 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6463 below describes the starting and ending position of this segment on each transcript.

TABLE 6463

Segment location on transcripts

| Transcript name | Segment starting position | Segment ending position |
|---|---|---|
| M78228_PEA_1_T0 (SEQ ID NO: 4398) | 1 | 815 |
| M78228_PEA_1_T1 (SEQ ID NO: 4399) | 1 | 815 |
| M78228_PEA_1_T12 (SEQ ID NO: 4400) | 1 | 815 |
| M78228_PEA_1_T18 (SEQ ID NO: 4403) | 1 | 815 |

This segment can be found in a non-coding region of transcript(s) that are related to the following protein(s): M78228_PEA_1_P1, M78228_PEA_1_P8 and M78228_PEA_1_P2.

Segment cluster M78228_PEA_1_node_1 (SEQ ID NO:6782) according to the present invention is supported by 183 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6464 below describes the starting and ending position of this segment on each transcript.

TABLE 6464

Segment location on transcripts

| Transcript name | Segment starting position | Segment ending position |
|---|---|---|
| M78228_PEA_1_T0 (SEQ ID NO: 4398) | 816 | 989 |
| M78228_PEA_1_T1 (SEQ ID NO: 4399) | 816 | 989 |
| M78228_PEA_1_T12 (SEQ ID NO: 4400) | 816 | 989 |
| M78228_PEA_1_T18 (SEQ ID NO: 4403) | 816 | 989 |

This segment can be found in the following protein(s): M78228_PEA_1_P1, M78228_PEA_1_P8 and M78228_PEA_1_P2.

Segment cluster M78228_PEA_1_node_6 (SEQ ID NO:6783) according to the present invention is supported by 199 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6465 below describes the starting and ending position of this segment on each transcript.

TABLE 6465

Segment location on transcripts

| Transcript name | Segment starting position | Segment ending position |
|---|---|---|
| M78228_PEA_1_T0 (SEQ ID NO: 4398) | 1021 | 1202 |
| M78228_PEA_1_T1 (SEQ ID NO: 4399) | 1021 | 1202 |
| M78228_PEA_1_T12 (SEQ ID NO: 4400) | 1021 | 1202 |
| M78228_PEA_1_T18 (SEQ ID NO: 4403) | 1021 | 1202 |

This segment can be found in the following protein(s): M78228_PEA_1_P1, M78228_PEA_1_P8 and M78228_PEA_1_P2.

Segment cluster M78228_PEA_1_node_10 (SEQ ID NO:6784) according to the present invention is supported by 169 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6466 below describes the starting and ending position of this segment on each transcript.

TABLE 6466

Segment location on transcripts

| Transcript name | Segment starting position | Segment ending position |
|---|---|---|
| M78228_PEA_1_T0 (SEQ ID NO: 4398) | 1203 | 1326 |
| M78228_PEA_1_T1 (SEQ ID NO: 4399) | 1203 | 1326 |
| M78228_PEA_1_T12 (SEQ ID NO: 4400) | 1203 | 1326 |
| M78228_PEA_1_T18 (SEQ ID NO: 4403) | 1203 | 1326 |

This segment can be found in the following protein(s): M78228_PEA_1_P1, M78228_PEA_1_P8 and M78228_PEA_1_P2.

Segment cluster M78228_PEA_1_node_17 (SEQ ID NO:6785) according to the present invention is supported by 19 libraries. The number of libraries was determined as previously described. This segment can be found in the following transcript(s): M78228_PEA_1_T15 (SEQ ID NO:4401), M78228_PEA_1_T16 (SEQ ID NO:4402), M78228_PEA_1_T24 (SEQ ID NO:4404) and M78228_PEA_1_T25 (SEQ ID NO:4405). Table 6467 below describes the starting and ending position of this segment on each transcript.

TABLE 6467

Segment location on transcripts

| Transcript name | Segment starting position | Segment ending position |
|---|---|---|
| M78228_PEA_1_T15 (SEQ ID NO: 4401) | 1 | 1621 |
| M78228_PEA_1_T16 (SEQ ID NO: 4402) | 1 | 1621 |
| M78228_PEA_1_T24 (SEQ ID NO: 4404) | 1 | 1621 |
| M78228_PEA_1_T25 (SEQ ID NO: 4405) | 1 | 1621 |

This segment can be found in a non-coding region of transcript(s) that are related to the following protein(s): M78228_PEA_1_P11.

Segment cluster M78228_PEA_1_node_19 (SEQ ID NO:6786) according to the present invention is supported by 159 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T15 (SEQ ID NO:4401), M78228_PEA_1_T16 (SEQ ID NO:4402), M78228_PEA_1_T18 (SEQ ID NO:4403), M78228_PEA_1_T24 (SEQ ID NO:4404) and M78228_PEA_1_T25 (SEQ ID NO:4405). Table 6468 below describes the starting and ending position of this segment on each transcript.

TABLE 6468

Segment location on transcripts

| Transcript name | Segment starting position | Segment ending position |
|---|---|---|
| M78228_PEA_1_T0 (SEQ ID NO: 4398) | 1576 | 1695 |
| M78228_PEA_1_T1 (SEQ ID NO: 4399) | 1576 | 1695 |
| M78228_PEA_1_T15 (SEQ ID NO: 4401) | 1653 | 1772 |
| M78228_PEA_1_T16 (SEQ ID NO: 4402) | 1653 | 1772 |
| M78228_PEA_1_T18 (SEQ ID NO: 4403) | 1576 | 1695 |
| M78228_PEA_1_T24 (SEQ ID NO: 4404) | 1653 | 1772 |
| M78228_PEA_1_T25 (SEQ ID NO: 4405) | 1653 | 1772 |

This segment can be found in both coding and non-coding regions of transcript(s) as follows. The segment can be found in a non-coding region of transcript(s) that are related to the following protein(s): M78228_PEA_1_P11. This segment can also be found in the following protein(s): M78228_PEA_1_P1 and M78228_PEA_1_P2, since it is in the coding region for the corresponding transcript.

Segment cluster M78228_PEA_1_node_25 (SEQ ID NO:6787) according to the present invention is supported by 157 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401), M78228_PEA_1_T16 (SEQ ID NO:4402), M78228_PEA_1_T18 (SEQ ID NO:4403) and M78228_PEA_1_T24 (SEQ ID NO:4404). Table 6469 below describes the starting and ending position of this segment on each transcript.

TABLE 6469

Segment location on transcripts

| Transcript name | Segment starting position | Segment ending position |
|---|---|---|
| M78228_PEA_1_T0 (SEQ ID NO: 4398) | 1862 | 2004 |
| M78228_PEA_1_T1 (SEQ ID NO: 4399) | 1862 | 2004 |
| M78228_PEA_1_T12 (SEQ ID NO: 4400) | 1632 | 1774 |
| M78228_PEA_1_T15 (SEQ ID NO: 4401) | 1939 | 2081 |
| M78228_PEA_1_T16 (SEQ ID NO: 4402) | 2028 | 2170 |
| M78228_PEA_1_T18 (SEQ ID NO: 4403) | 1951 | 2093 |
| M78228_PEA_1_T24 (SEQ ID NO: 4404) | 2028 | 2170 |

This segment can be found in both coding and non-coding regions of transcript(s) as follows. The segment can be found in a non-coding region of transcript(s) that are related to the following protein(s): M78228_PEA_1_P8 and M78228_PEA_1_P2. This segment can also be found in the following protein(s): M78228_PEA_1_P1 and M78228_PEA_1_P11, since it is in the coding region for the corresponding transcript.

Segment cluster M78228_PEA_1_node_26 (SEQ ID NO:6788) according to the present invention is supported by 2 libraries. The number of libraries was determined as previously described. This segment can be found in the following transcript(s): M78228_PEA_1_T18 (SEQ ID NO:4403) and M78228_PEA_1_T24 (SEQ ID NO:4404). Table 6470 below describes the starting and ending position of this segment on each transcript.

TABLE 6470

Segment location on transcripts

| Transcript name | Segment starting position | Segment ending position |
|---|---|---|
| M78228_PEA_1_T18 (SEQ ID NO: 4403) | 2094 | 2601 |
| M78228_PEA_1_T24 (SEQ ID NO: 4404) | 2171 | 2678 |

This segment can be found in a non-coding region of transcript(s) that are related to the following protein(s): M78228_PEA_1_P2.

Segment cluster M78228_PEA_1_node_29 (SEQ ID NO:6789) according to the present invention is supported by 4 libraries. The number of libraries was determined as previously described. This segment can be found in the following transcript(s): M78228_PEA_1_T18 (SEQ ID NO:4403) and M78228_PEA_1_T24 (SEQ ID NO:4404). Table 6471 below describes the starting and ending position of this segment on each transcript.

TABLE 6471

Segment location on transcripts

| Transcript name | Segment starting position | Segment ending position |
|---|---|---|
| M78228_PEA_1_T18 (SEQ ID NO: 4403) | 2602 | 3162 |
| M78228_PEA_1_T24 (SEQ ID NO: 4404) | 2679 | 3239 |

This segment can be found in a non-coding region of transcript(s) that are related to the following protein(s): M78228_PEA_1_P2.

Segment cluster M78228_PEA_1_node_36 (SEQ ID NO:6790) according to the present invention is supported by 247 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401) and M78228_PEA_1_T16 (SEQ ID NO:4402). Table 6472 below describes the starting and ending position of this segment on each transcript.

TABLE 6472

Segment location on transcripts

| Transcript name | Segment starting position | Segment ending position |
|---|---|---|
| M78228_PEA_1_T0 (SEQ ID NO: 4398) | 2132 | 2829 |
| M78228_PEA_1_T1 (SEQ ID NO: 4399) | 2132 | 2406 |
| M78228_PEA_1_T12 (SEQ ID NO: 4400) | 1902 | 2599 |
| M78228_PEA_1_T15 (SEQ ID NO: 4401) | 2209 | 2906 |
| M78228_PEA_1_T16 (SEQ ID NO: 4402) | 2298 | 2995 |

This segment can be found in both coding and non-coding regions of transcript(s) as follows. The segment can be found in a non-coding region of transcript(s) that are related to the following protein(s): M78228_PEA_1_P8. This segment can also be found in the following protein(s): M78228_PEA_1_P1 and M78228_PEA_1_P11, since it is in the coding region for the corresponding transcript.

According to an optional embodiment of the present invention, short segments related to the above cluster are also provided. These segments are up to about 120 bp in length, and so are included in a separate description.

Segment cluster M78228_PEA_1_node_2 (SEQ ID NO:6791) according to the present invention is supported by 181 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6473 below describes the starting and ending position of this segment on each transcript.

TABLE 6473

Segment location on transcripts

| Transcript name | Segment starting position | Segment ending position |
|---|---|---|
| M78228_PEA_1_T0 (SEQ ID NO: 4398) | 990 | 1020 |
| M78228_PEA_1_T1 (SEQ ID NO: 4399) | 990 | 1020 |
| M78228_PEA_1_T12 (SEQ ID NO: 4400) | 990 | 1020 |
| M78228_PEA_1_T18 (SEQ ID NO: 4403) | 990 | 1020 |

This segment can be found in the following protein(s): M78228_PEA_1_P1, M78228_PEA_1_P8 and M78228_PEA_1_P2.

Segment cluster M78228_PEA_1_node_12 (SEQ ID NO:6792) according to the present invention is supported by 168 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6474 below describes the starting and ending position of this segment on each transcript.

TABLE 6474

Segment location on transcripts

| Transcript name | Segment starting position | Segment ending position |
|---|---|---|
| M78228_PEA_1_T0 (SEQ ID NO: 4398) | 1327 | 1439 |
| M78228_PEA_1_T1 (SEQ ID NO: 4399) | 1327 | 1439 |
| M78228_PEA_1_T12 (SEQ ID NO: 4400) | 1327 | 1439 |
| M78228_PEA_1_T18 (SEQ ID NO: 4403) | 1327 | 1439 |

This segment can be found in the following protein(s): M78228_PEA_1_P1, M78228_PEA_1_P8 and M78228_PEA_1_P2.

Segment cluster M78228_PEA_1_node_14 (SEQ ID NO:6793) according to the present invention is supported by 156 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400) and M78228_PEA_1_T18 (SEQ ID NO:4403). Table 6475 below describes the starting and ending position of this segment on each transcript.

TABLE 6475

Segment location on transcripts

| Transcript name | Segment starting position | Segment ending position |
|---|---|---|
| M78228_PEA_1_T0 (SEQ ID NO: 4398) | 1440 | 1544 |
| M78228_PEA_1_T1 (SEQ ID NO: 4399) | 1440 | 1544 |

TABLE 6475-continued

Segment location on transcripts

| Transcript name | Segment starting position | Segment ending position |
|---|---|---|
| M78228_PEA_1_T12 (SEQ ID NO: 4400) | 1440 | 1544 |
| M78228_PEA_1_T18 (SEQ ID NO: 4403) | 1440 | 1544 |

This segment can be found in the following protein(s): M78228_PEA_1_P1, M78228_PEA_1_P8 and M78228_PEA_1_P2.

Segment cluster M78228_PEA_1_node_18 (SEQ ID NO:6794) according to the present invention is supported by 139 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T15 (SEQ ID NO:4401), M78228_PEA_1_T16 (SEQ ID NO:4402), M78228_PEA_1_T18 (SEQ ID NO:4403), M78228_PEA_1_T24 (SEQ ID NO:4404) and M78228_PEA_1_T25 (SEQ ID NO:4405). Table 6476 below describes the starting and ending position of this segment on each transcript.

TABLE 6476

Segment location on transcripts

| Transcript name | Segment starting position | Segment ending position |
|---|---|---|
| M78228_PEA_1_T0 (SEQ ID NO: 4398) | 1545 | 1575 |
| M78228_PEA_1_T1 (SEQ ID NO: 4399) | 1545 | 1575 |
| M78228_PEA_1_T15 (SEQ ID NO: 4401) | 1622 | 1652 |
| M78228_PEA_1_T16 (SEQ ID NO: 4402) | 1622 | 1652 |
| M78228_PEA_1_T18 (SEQ ID NO: 4403) | 1545 | 1575 |
| M78228_PEA_1_T24 (SEQ ID NO: 4404) | 1622 | 1652 |
| M78228_PEA_1_T25 (SEQ ID NO: 4405) | 1622 | 1652 |

This segment can be found in both coding and non-coding regions of transcript(s) as follows. The segment can be found in a non-coding region of transcript(s) that are related to the following protein(s): M78228_PEA_1_P11. This segment can also be found in the following protein(s): M78228_PEA_1_P1 and M78228_PEA_1_P2, since it is in the coding region for the corresponding transcript.

Segment cluster M78228_PEA_1_node_20 (SEQ ID NO:6795) according to the present invention is supported by 9 libraries. The number of libraries was determined as previously described. This segment can be found in the following transcript(s): M78228_PEA_1_T16 (SEQ ID NO:4402), M78228_PEA_1_T18 (SEQ ID NO:4403) and M78228_PEA_1_T24 (SEQ ID NO:4404). Table 6477 below describes the starting and ending position of this segment on each transcript.

TABLE 6477

Segment location on transcripts

| Transcript name | Segment starting position | Segment ending position |
|---|---|---|
| M78228_PEA_1_T16 (SEQ ID NO: 4402) | 1773 | 1861 |
| M78228_PEA_1_T18 (SEQ ID NO: 4403) | 1696 | 1784 |
| M78228_PEA_1_T24 (SEQ ID NO: 4404) | 1773 | 1861 |

This segment can be found in both coding and non-coding regions of transcript(s) as follows. The segment can be found in a non-coding region of transcript(s) that are related to the following protein(s): M78228_PEA_1_P11. This segment can also be found in the following protein(s): M78228_PEA_1_P2, since it is in the coding region for the corresponding transcript.

Segment cluster M78228_PEA_1_node_21 (SEQ ID NO:6796) according to the present invention is supported by 147 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T15 (SEQ ID NO:4401), M78228_PEA_1_T16 (SEQ ID NO:4402), M78228_PEA_1_T18 (SEQ ID NO:4403), M78228_PEA_1_T24 (SEQ ID NO:4404) and M78228_PEA_1_T25 (SEQ ID NO:4405). Table 6478 below describes the starting and ending position of this segment on each transcript.

TABLE 6478

Segment location on transcripts

| Transcript name | Segment starting position | Segment ending position |
|---|---|---|
| M78228_PEA_1_T0 (SEQ ID NO: 4398) | 1696 | 1774 |
| M78228_PEA_1_T1 (SEQ ID NO: 4399) | 1696 | 1774 |
| M78228_PEA_1_T15 (SEQ ID NO: 4401) | 1773 | 1851 |
| M78228_PEA_1_T16 (SEQ ID NO: 4402) | 1862 | 1940 |
| M78228_PEA_1_T18 (SEQ ID NO: 4403) | 1785 | 1863 |
| M78228_PEA_1_T24 (SEQ ID NO: 4404) | 1862 | 1940 |
| M78228_PEA_1_T25 (SEQ ID NO: 4405) | 1773 | 1851 |

This segment can be found in both coding and non-coding regions of transcript(s) as follows. The segment can be found in a non-coding region of transcript(s) that are related to the following protein(s): M78228_PEA_1_P2. This segment can also be found in the following protein(s): M78228_PEA_1_P1 and M78228_PEA_1_P11, since it is in the coding region for the corresponding transcript.

Segment cluster M78228_PEA_1_node_22 (SEQ ID NO:6797) according to the present invention is supported by 147 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401), M78228_PEA_1_T16 (SEQ ID NO:4402), M78228_PEA_1_T18 (SEQ ID NO:4403), M78228_PEA_1_T24 (SEQ ID NO:4404) and M78228_PEA_1_T25 (SEQ ID NO:4405). Table 6479 below describes the starting and ending position of this segment on each transcript.

TABLE 6479

Segment location on transcripts

| Transcript name | Segment starting position | Segment ending position |
|---|---|---|
| M78228_PEA_1_T0 (SEQ ID NO: 4398) | 1775 | 1861 |
| M78228_PEA_1_T1 (SEQ ID NO: 4399) | 1775 | 1861 |
| M78228_PEA_1_T12 (SEQ ID NO: 4400) | 1545 | 1631 |
| M78228_PEA_1_T15 (SEQ ID NO: 4401) | 1852 | 1938 |
| M78228_PEA_1_T16 (SEQ ID NO: 4402) | 1941 | 2027 |
| M78228_PEA_1_T18 (SEQ ID NO: 4403) | 1864 | 1950 |
| M78228_PEA_1_T24 (SEQ ID NO: 4404) | 1941 | 2027 |
| M78228_PEA_1_T25 (SEQ ID NO: 4405) | 1852 | 1938 |

This segment can be found in both coding and non-coding regions of transcript(s) as follows. The segment can be found in a non-coding region of transcript(s) that are related to the following protein(s): M78228_PEA_1_P2. This segment can also be found in the following protein(s): M78228_PEA_1_P1, M78228_PEA_1_P8 and M78228_PEA_1_P1, since it is in the coding region for the corresponding transcript.

Segment cluster M78228_PEA_1_node_23 (SEQ ID NO:6798) according to the present invention is supported by 1 libraries. The number of libraries was determined as previously described. This segment can be found in the following transcript(s): M78228_PEA_1_T25 (SEQ ID NO:4405). Table 6480 below describes the starting and ending position of this segment on each transcript.

TABLE 6480

Segment location on transcripts

| Transcript name | Segment starting position | Segment ending position |
|---|---|---|
| M78228_PEA_1_T25 (SEQ ID NO: 4405) | 1939 | 1977 |

The previously-described transcripts for these segment(s) do not code for protein.

Segment cluster M78228_PEA_1_node_32 (SEQ ID NO:6799) according to the present invention is supported by 144 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401) and M78228_PEA_1_T16 (SEQ ID NO:4402). Table 6481 below describes the starting and ending position of this segment on each transcript.

TABLE 6481

Segment location on transcripts

| Transcript name | Segment starting position | Segment ending position |
|---|---|---|
| M78228_PEA_1_T0 (SEQ ID NO: 4398) | 2005 | 2036 |
| M78228_PEA_1_T1 (SEQ ID NO: 4399) | 2005 | 2036 |
| M78228_PEA_1_T12 (SEQ ID NO: 4400) | 1775 | 1806 |
| M78228_PEA_1_T15 (SEQ ID NO: 4401) | 2082 | 2113 |
| M78228_PEA_1_T16 (SEQ ID NO: 4402) | 2171 | 2202 |

This segment can be found in both coding and non-coding regions of transcript(s) as follows. The segment can be found in a non-coding region of transcript(s) that are related to the following protein(s): M78228_PEA_1_P8. This segment can also be found in the following protein(s): M78228_PEA_1_P1 and M78228_PEA_1_P11, since it is in the coding region for the corresponding transcript.

Segment cluster M78228_PEA_1_node_33 (SEQ ID NO:6800) according to the present invention is supported by 148 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401) and M78228_PEA_1_T16 (SEQ ID NO:4402). Table 6482 below describes the starting and ending position of this segment on each transcript.

TABLE 6482

Segment location on transcripts

| Transcript name | Segment starting position | Segment ending position |
|---|---|---|
| M78228_PEA_1_T0 (SEQ ID NO: 4398) | 2037 | 2086 |
| M78228_PEA_1_T1 (SEQ ID NO: 4399) | 2037 | 2086 |
| M78228_PEA_1_T12 (SEQ ID NO: 4400) | 1807 | 1856 |
| M78228_PEA_1_T15 (SEQ ID NO: 4401) | 2114 | 2163 |
| M78228_PEA_1_T16 (SEQ ID NO: 4402) | 2203 | 2252 |

This segment can be found in both coding and non-coding regions of transcript(s) as follows. The segment can be found in a non-coding region of transcript(s) that are related to the following protein(s): M78228_PEA_1_P8. This segment can also be found in the following protein(s): M78228_PEA_1_P1 and M78228_PEA_1_P11, since it is in the coding region for the corresponding transcript.

Segment cluster M78228_PEA_1_node_34 (SEQ ID NO:6801) according to the present invention is supported by 151 libraries. The number of libraries was determined as previously described. This segment can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401) and M78228_PEA_1_T16 (SEQ ID NO:4402). Table 6483 below describes the starting and ending position of this segment on each transcript.

TABLE 6483

Segment location on transcripts

| Transcript name | Segment starting position | Segment ending position |
|---|---|---|
| M78228_PEA_1_T0 (SEQ ID NO: 4398) | 2087 | 2127 |
| M78228_PEA_1_T1 (SEQ ID NO: 4399) | 2087 | 2127 |
| M78228_PEA_1_T12 (SEQ ID NO: 4400) | 1857 | 1897 |
| M78228_PEA_1_T15 (SEQ ID NO: 4401) | 2164 | 2204 |
| M78228_PEA_1_T16 (SEQ ID NO: 4402) | 2253 | 2293 |

This segment can be found in both coding and non-coding regions of transcript(s) as follows. The segment can be found in a non-coding region of transcript(s) that are related to the following protein(s): M78228_PEA_1_P8. This segment can also be found in the following protein(s): M78228_PEA_1_P1 and M78228_PEA_1_P11, since it is in the coding region for the corresponding transcript.

Segment cluster M78228_PEA_1_node_35 (SEQ ID NO:6802) according to the present invention can be found in the following transcript(s): M78228_PEA_1_T0 (SEQ ID NO:4398), M78228_PEA_1_T1 (SEQ ID NO:4399), M78228_PEA_1_T12 (SEQ ID NO:4400), M78228_PEA_1_T15 (SEQ ID NO:4401) and M78228_PEA_1_T16 (SEQ ID NO:4402). Table 6484 below describes the starting and ending position of this segment on each transcript.

TABLE 6484

Segment location on transcripts

| Transcript name | Segment starting position | Segment ending position |
|---|---|---|
| M78228_PEA_1_T0 (SEQ ID NO: 4398) | 2128 | 2131 |
| M78228_PEA_1_T1 (SEQ ID NO: 4399) | 2128 | 2131 |
| M78228_PEA_1_T12 (SEQ ID NO: 4400) | 1898 | 1901 |
| M78228_PEA_1_T15 (SEQ ID NO: 4401) | 2205 | 2208 |
| M78228_PEA_1_T16 (SEQ ID NO: 4402) | 2294 | 2297 |

This segment can be found in both coding and non-coding regions of transcript(s) as follows. The segment can be found in a non-coding region of transcript(s) that are related to the following protein(s): M78228_PEA_1_P8. This segment can also be found in the following protein(s): M78228_PEA_1_P1 and M78228_PEA_1_P11, since it is in the coding region for the corresponding transcript.

TCAC

Description for Cluster R31990

Cluster R31990 features 10 transcript(s) and 38 segment(s) of interest, the names for which are given in Tables 6485 and 6486, respectively, the sequences themselves are given at the end of the application. The selected protein variants are given in Table 6487.

TABLE 6485

Transcripts of interest
Transcript Name

R31990_PEA_1_T2 (SEQ ID NO: 4406)
R31990_PEA_1_T3 (SEQ ID NO: 4407)
R31990_PEA_1_T4 (SEQ ID NO: 4408)
R31990_PEA_1_T6 (SEQ ID NO: 4409)
R31990_PEA_1_T11 (SEQ ID NO: 4410)
R31990_PEA_1_T12 (SEQ ID NO: 4411)
R31990_PEA_1_T14 (SEQ ID NO: 4412)
R31990_PEA_1_T20 (SEQ ID NO: 4413)
R31990_PEA_1_T21 (SEQ ID NO: 4414)
R31990_PEA_1_T23 (SEQ ID NO: 4415)

TABLE 6486

Segments of interest
Segment Name

R31990_PEA_1_node_2 (SEQ ID NO: 6803)
R31990_PEA_1_node_4 (SEQ ID NO: 6804)
R31990_PEA_1_node_6 (SEQ ID NO: 6805)
R31990_PEA_1_node_8 (SEQ ID NO: 6806)
R31990_PEA_1_node_9 (SEQ ID NO: 6807)
R31990_PEA_1_node_14 (SEQ ID NO: 6808)
R31990_PEA_1_node_16 (SEQ ID NO: 6809)
R31990_PEA_1_node_19 (SEQ ID NO: 6810)
R31990_PEA_1_node_22 (SEQ ID NO: 6811)
R31990_PEA_1_node_25 (SEQ ID NO: 6812)
R31990_PEA_1_node_34 (SEQ ID NO: 6813)
R31990_PEA_1_node_42 (SEQ ID NO: 6814)
R31990_PEA_1_node_47 (SEQ ID NO: 6815)
R31990_PEA_1_node_49 (SEQ ID NO: 6816)
R31990_PEA_1_node_52 (SEQ ID NO: 6817)
R31990_PEA_1_node_53 (SEQ ID NO: 6818)
R31990_PEA_1_node_54 (SEQ ID NO: 6819)
R31990_PEA_1_node_57 (SEQ ID NO: 6820)
R31990_PEA_1_node_59 (SEQ ID NO: 6821)
R31990_PEA_1_node_60 (SEQ ID NO: 6822)
R31990_PEA_1_node_11 (SEQ ID NO: 6823)
R31990_PEA_1_node_12 (SEQ ID NO: 6824)
R31990_PEA_1_node_17 (SEQ ID NO: 6825)
R31990_PEA_1_node_18 (SEQ ID NO: 6826)
R31990_PEA_1_node_20 (SEQ ID NO: 6827)
R31990_PEA_1_node_21 (SEQ ID NO: 6828)
R31990_PEA_1_node_24 (SEQ ID NO: 6829)
R31990_PEA_1_node_29 (SEQ ID NO: 6830)
R31990_PEA_1_node_33 (SEQ ID NO: 6831)
R31990_PEA_1_node_36 (SEQ ID NO: 6832)
R31990_PEA_1_node_37 (SEQ ID NO: 6833)
R31990_PEA_1_node_39 (SEQ ID NO: 6834)
R31990_PEA_1_node_44 (SEQ ID NO: 6835)
R31990_PEA_1_node_46 (SEQ ID NO: 6836)
R31990_PEA_1_node_50 (SEQ ID NO: 6837)
R31990_PEA_1_node_55 (SEQ ID NO: 6838)
R31990_PEA_1_node_56 (SEQ ID NO: 6839)
R31990_PEA_1_node_58 (SEQ ID NO: 6840)

TABLE 6487

Proteins of interest

| Protein Name | Corresponding Transcript(s) |
|---|---|
| R31990_PEA_1_P1 | R31990_PEA_1_T2 (SEQ ID NO: 4406); R31990_PEA_1_T3 (SEQ ID NO: 4407); R31990_PEA_1_T4 (SEQ ID NO: 4408) |
| R31990_PEA_1_P4 | R31990_PEA_1_T6 (SEQ ID NO: 4409) |
| R31990_PEA_1_P7 | R31990_PEA_1_T11 (SEQ ID NO: 4410); R31990_PEA_1_T12 (SEQ ID NO: 4411) |
| R31990_PEA_1_P6 | R31990_PEA_1_T14 (SEQ ID NO: 4412) |
| R31990_PEA_1_P9 | R31990_PEA_1_T20 (SEQ ID NO: 4413) |
| R31990_PEA_1_P10 | R31990_PEA_1_T21 (SEQ ID NO: 4414) |
| R31990_PEA_1_P12 | R31990_PEA_1_T23 (SEQ ID NO: 4415) |

Cluster R31990 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 151 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 151 and Table 6488. This cluster is overexpressed (at least at a minimum level) in the following pathological conditions: epithelial malignant tumors and a mixture of malignant tumors from different tissues.

TABLE 6488

Normal tissue distribution

| Name of Tissue | Number |
|---|---|
| adrenal | 0 |
| bladder | 41 |
| bone | 0 |
| brain | 21 |
| colon | 0 |
| epithelial | 9 |
| general | 15 |
| kidney | 0 |
| liver | 0 |
| lung | 0 |
| lymph nodes | 47 |
| breast | 8 |
| bone marrow | 0 |
| ovary | 43 |
| pancreas | 2 |
| prostate | 4 |
| skin | 16 |
| stomach | 3 |
| T cells | 278 |
| uterus | 4 |

TABLE 6489

P values and ratios for expression in cancerous tissue

| Name of Tissue | P1 | P2 | SP1 | R3 | SP2 | R4 |
|---|---|---|---|---|---|---|
| adrenal | 4.2e-01 | 1.9e-01 | 4.6e-01 | 2.2 | 2.9e-01 | 2.7 |
| bladder | 7.6e-01 | 8.1e-01 | 8.1e-01 | 0.9 | 9.0e-01 | 0.7 |
| bone | 1 | 1.7e-02 | 1 | 1.0 | 1.2e-01 | 3.9 |
| brain | 3.4e-01 | 2.3e-01 | 4.5e-02 | 2.2 | 8.2e-02 | 1.8 |
| colon | 9.4e-02 | 5.7e-02 | 7.0e-01 | 1.7 | 4.6e-01 | 2.1 |
| epithelial | 4.0e-02 | 1.3e-03 | 2.3e-02 | 2.4 | 1.4e-05 | 3.7 |
| general | 2.6e-02 | 7.3e-06 | 1.9e-02 | 1.7 | 1.2e-07 | 2.6 |
| kidney | 2.5e-01 | 2.4e-01 | 2.0e-01 | 3.3 | 2.4e-01 | 2.8 |
| liver | 1 | 4.5e-01 | 1 | 1.0 | 6.9e-01 | 1.5 |
| lung | 1.1e-01 | 3.2e-02 | 2.8e-02 | 6.8 | 2.1e-02 | 6.0 |
| lymph nodes | 8.5e-01 | 4.6e-01 | 1 | 0.3 | 7.9e-01 | 0.8 |
| breast | 9.5e-01 | 7.3e-01 | 1 | 0.8 | 3.8e-01 | 1.6 |
| bone marrow | 1 | 6.7e-01 | 1 | 1.0 | 1.5e-01 | 2.8 |
| ovary | 8.2e-01 | 8.5e-01 | 9.0e-01 | 0.7 | 9.5e-01 | 0.6 |
| pancreas | 2.3e-01 | 2.0e-01 | 1.8e-01 | 3.1 | 7.7e-02 | 3.8 |
| prostate | 8.2e-01 | 6.8e-01 | 4.5e-01 | 1.6 | 4.2e-02 | 2.8 |
| skin | 8.5e-01 | 3.6e-01 | 1 | 0.5 | 7.8e-02 | 2.0 |
| stomach | 9.1e-01 | 5.5e-01 | 1 | 0.9 | 2.6e-01 | 2.1 |
| T cells | 1 | 6.7e-01 | 5.5e-01 | 1.5 | 9.2e-01 | 0.7 |
| uterus | 3.3e-01 | 1.5e-01 | 6.6e-01 | 1.3 | 2.6e-01 | 2.1 |

As noted above, cluster R31990 features 38 segment(s), which were listed in Table 6486 above and for which the sequence(s) are given at the end of the application. These segment(s) are portions of nucleic acid sequence(s) which are described herein separately because they are of particular interest. A description of each segment according to the present invention is now provided.

Segment cluster R31990_PEA_1_node_2 (SEQ ID NO:6803) according to the present invention is supported by 2 libraries. The number of libraries was determined as previously described. This segment can be found in the following transcript(s): R31990_PEA_1_T4 (SEQ ID NO:4408) and R31990_PEA_1_T6 (SEQ ID NO:4409). Table 6490 below describes the starting and ending position of this segment on each transcript.

TABLE 6490

Segment location on transcripts

| Transcript name | Segment starting position | Segment ending position |
|---|---|---|
| R31990_PEA_1_T4 (SEQ ID NO: 4408) | 1 | 202 |
| R31990_PEA_1_T6 (SEQ ID NO: 4409) | 1 | 202 |

This segment can be found in a non-coding region of transcript(s) that are related to the following protein(s): R31990_PEA_1_P1 and R31990_PEA_1_P4.

Segment cluster R31990_PEA_1_node_4 (SEQ ID NO:6804) according to the present invention is supported by 30 libraries. The number of libraries was determined as previously described. This segment can be found in the following transcript(s): R31990_PEA_1_T20 (SEQ ID NO:4413), R31990_PEA_1_T21 (SEQ ID NO:4414) and R31990_PEA_1_T23 (SEQ ID NO:4415). Table 6491 below describes the starting and ending position of this segment on each transcript.

TABLE 6491

Segment location on transcripts

| Transcript name | Segment starting position | Segment ending position |
|---|---|---|
| R31990_PEA_1_T20 (SEQ ID NO: 4413) | 1 | 302 |
| R31990_PEA_1_T21 (SEQ ID NO: 4414) | 1 | 302 |
| R31990_PEA_1_T23 (SEQ ID NO: 4415) | 1 | 302 |

This segment can be found in a non-coding region of transcript(s) that are related to the following protein(s): R31990_PEA_1_P9, R31990_PEA_1_P10 and R31990_PEA_1_P12.

Segment cluster R31990_PEA_1_node_6 (SEQ ID NO:6805) according to the present invention is supported by 4 libraries. The number of libraries was determined as previously described. This segment can be found in the following transcript(s): R31990_PEA_1_T2 (SEQ ID NO:4406). Table 6492 below describes the starting and ending position of this segment on each transcript.

TABLE 6492

Segment location on transcripts

| Transcript name | Segment starting position | Segment ending position |
|---|---|---|
| R31990_PEA_1_T2 (SEQ ID NO: 4406) | 1 | 553 |

This segment can be found in a non-coding region of transcript(s) that are related to the following protein(s): R31990_PEA_1_P1.

Segment cluster R31990_PEA_1_node_8 (SEQ ID NO:6806) according to the present invention is supported by 1 libraries. The number of libraries was determined as previously described. This segment can be found in the following transcript(s): R31990_PEA_1_T3 (SEQ ID NO:4407). Table 6493 below describes the starting and ending position of this segment on each transcript.

TABLE 6493

Segment location on transcripts

| Transcript name | Segment starting position | Segment ending position |
|---|---|---|
| R31990_PEA_1_T3 (SEQ ID NO: 4407) | 1 | 381 |

This segment can be found in a non-coding region of transcript(s) that are related to the following protein(s): R31990_PEA_1_P1.

Segment cluster R31990_PEA_1_node_9 (SEQ ID NO:6807) according to the present invention is supported by 50 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T20 (SEQ ID NO:4413), R31990_PEA_1_T21 (SEQ ID NO:4414) and R31990_PEA_1_T23 (SEQ ID NO:4415). Table 6494 below describes the starting and ending position of this segment on each transcript.

TABLE 6494

Segment location on transcripts

| Transcript name | Segment starting position | Segment ending position |
|---|---|---|
| R31990_PEA_1_T2 (SEQ ID NO: 4406) | 554 | 754 |
| R31990_PEA_1_T3 (SEQ ID NO: 4407) | 382 | 582 |
| R31990_PEA_1_T4 (SEQ ID NO: 4408) | 203 | 403 |
| R31990_PEA_1_T6 (SEQ ID NO: 4409) | 203 | 403 |
| R31990_PEA_1_T20 (SEQ ID NO: 4413) | 303 | 503 |
| R31990_PEA_1_T21 (SEQ ID NO: 4414) | 303 | 503 |
| R31990_PEA_1_T23 (SEQ ID NO: 4415) | 303 | 503 |

This segment can be found in both coding and non-coding regions of transcript(s) as follows. The segment can be found in a non-coding region of transcript(s) that are related to the following protein(s): R31990_PEA_1_P4. This segment can also be found in the following protein(s): R31990_PEA_1_P1, R31990_PEA_1_P9, R31990_PEA_1_P10 and R31990_PEA_1_P12, since it is in the coding region for the corresponding transcript.

Segment cluster R31990_PEA_1_node_14 (SEQ ID NO:6808) according to the present invention is supported by 3 libraries. The number of libraries was determined as previously described. This segment can be found in the following transcript(s): R31990_PEA_1_T12 (SEQ ID NO:4411). Table 6495 below describes the starting and ending position of this segment on each transcript.

TABLE 6495

Segment location on transcripts

| Transcript name | Segment starting position | Segment ending position |
|---|---|---|
| R31990_PEA_1_T12 (SEQ ID NO: 4411) | 1 | 127 |

This segment can be found in a non-coding region of transcript(s) that are related to the following protein(s): R31990_PEA_1_P7.

Segment cluster R31990_PEA_1_node_16 (SEQ ID NO:6809) according to the present invention is supported by 3 libraries. The number of libraries was determined as previously described. This segment can be found in the following transcript(s): R31990_PEA_1_T11 (SEQ ID NO:4410). Table 6496 below describes the starting and ending position of this segment on each transcript.

TABLE 6496

Segment location on transcripts

| Transcript name | Segment starting position | Segment ending position |
|---|---|---|
| R31990_PEA_1_T11 (SEQ ID NO: 4410) | 1 | 351 |

This segment can be found in a non-coding region of transcript(s) that are related to the following protein(s): R31990_PEA_1_P7.

Segment cluster R31990_PEA_1_node_19 (SEQ ID NO:6810) according to the present invention is supported by 3 libraries. The number of libraries was determined as previously described. This segment can be found in the following transcript(s): R31990_PEA_1_T11 (SEQ ID NO:4410), R31990_PEA_1_T12 (SEQ ID NO:4411)and R31990_PEA_1_T23 (SEQ ID NO:4415). Table 6497 below describes the starting and ending position of this segment on each transcript.

TABLE 6497

Segment location on transcripts

| Transcript name | Segment starting position | Segment ending position |
|---|---|---|
| R31990_PEA_1_T11 (SEQ ID NO: 4410) | 448 | 944 |
| R31990_PEA_1_T12 (SEQ ID NO: 4411) | 224 | 720 |
| R31990_PEA_1_T23 (SEQ ID NO: 4415) | 682 | 1178 |

This segment can be found in the following protein(s): R31990_PEA_1_P7 and R31990_PEA_1_P12.

Segment cluster R31990_PEA_1_node_22 (SEQ ID NO:6811) according to the present invention is supported by 49 libraries. The number of libraries was determined as previously described. This segment can be found in the following transcript(s): R31990_PEA_1_T23 (SEQ ID NO:4415). Table 6498 below describes the starting and ending position of this segment on each transcript.

TABLE 6498

Segment location on transcripts

| Transcript name | Segment starting position | Segment ending position |
|---|---|---|
| R31990_PEA_1_T23 (SEQ ID NO: 4415) | 1280 | 1551 |

This segment can be found in a non-coding region of transcript(s) that are related to the following protein(s): R31990_PEA_1_P12.

Segment cluster R31990_PEA_1_node_25 (SEQ ID NO:6812) according to the present invention is supported by 12 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413) and R31990_PEA_1_T21 (SEQ ID NO:4414). Table 6499 below describes the starting and ending position of this segment on each transcript.

TABLE 6499

Segment location on transcripts

| Transcript name | Segment starting position | Segment ending position |
|---|---|---|
| R31990_PEA_1_T2 (SEQ ID NO: 4406) | 1038 | 1182 |
| R31990_PEA_1_T3 (SEQ ID NO: 4407) | 866 | 1010 |
| R31990_PEA_1_T4 (SEQ ID NO: 4408) | 687 | 831 |
| R31990_PEA_1_T6 (SEQ ID NO: 4409) | 704 | 848 |
| R31990_PEA_1_T11 (SEQ ID NO: 4410) | 1050 | 1194 |
| R31990_PEA_1_T12 (SEQ ID NO: 4411) | 826 | 970 |
| R31990_PEA_1_T20 (SEQ ID NO: 4413) | 787 | 931 |
| R31990_PEA_1_T21 (SEQ ID NO: 4414) | 787 | 931 |

This segment can be found in the following protein(s): R31990_PEA_1_P1, R31990_PEA_1_P4, R31990_PEA_1_P7, R31990_PEA_1_P9 and R31990_PEA_1_P10.

Segment cluster R31990_PEA_1_node_34 (SEQ ID NO:6813) according to the present invention is supported by 1 libraries. The number of libraries was determined as previously described. This segment can be found in the following transcript(s): R31990_PEA_1_T21 (SEQ ID NO:4414). Table 6500 below describes the starting and ending position of this segment on each transcript.

TABLE 6500

Segment location on transcripts

| Transcript name | Segment starting position | Segment ending position |
|---|---|---|
| R31990_PEA_1_T21 (SEQ ID NO: 4414) | 1097 | 1252 |

This segment can be found in the following protein(s): R31990_PEA_1_P10.

Segment cluster R31990_PEA_1_node_42 (SEQ ID NO:6814) according to the present invention is supported by 10 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T20 (SEQ ID NO:4413). Table 6501 below describes the starting and ending position of this segment on each transcript.

TABLE 6501

Segment location on transcripts

| Transcript name | Segment starting position | Segment ending position |
| --- | --- | --- |
| R31990_PEA_1_T2 (SEQ ID NO: 4406) | 1537 | 1698 |
| R31990_PEA_1_T3 (SEQ ID NO: 4407) | 1365 | 1526 |
| R31990_PEA_1_T4 (SEQ ID NO: 4408) | 1186 | 1347 |
| R31990_PEA_1_T6 (SEQ ID NO: 4409) | 1203 | 1364 |
| R31990_PEA_1_T11 (SEQ ID NO: 4410) | 1549 | 1710 |
| R31990_PEA_1_T12 (SEQ ID NO: 4411) | 1325 | 1486 |
| R31990_PEA_1_T20 (SEQ ID NO: 4413) | 1286 | 1447 |

This segment can be found in the following protein(s): R31990_PEA_1_P1, R31990_PEA_1_P4, R31990_PEA_1_P7 and R31990PEA_1_P9.

Segment cluster R31990_PEA_1_node_47 (SEQ ID NO:6815) according to the present invention is supported by 3 libraries. The number of libraries was determined as previously described. This segment can be found in the following transcript(s): R31990_PEA_1_T20 (SEQ ID NO:4413). Table 6502 below describes the starting and ending position of this segment on each transcript.

TABLE 6502

Segment location on transcripts

| Transcript name | Segment starting position | Segment ending position |
| --- | --- | --- |
| R31990_PEA_1_T20 (SEQ ID NO: 4413) | 1622 | 2168 |

This segment can be found in the following protein(s): R31990_PEA_1_P9.

Segment cluster R31990_PEA_1_node_49 (SEQ ID NO:6816) according to the present invention is supported by 1 libraries. The number of libraries was determined as previously described. This segment can be found in the following transcript(s): R31990_PEA_1_T14 (SEQ ID NO:4412). Table 6503 below describes the starting and ending position of this segment on each transcript.

TABLE 6503

Segment location on transcripts

| Transcript name | Segment starting position | Segment ending position |
| --- | --- | --- |
| R31990_PEA_1_T14 (SEQ ID NO: 4412) | 1 | 194 |

This segment can be found in a non-coding region of transcript(s) that are related to the following protein(s): R31990_PEA_1_P6.

Segment cluster R31990_PEA_1_node_52 (SEQ ID NO:6817) according to the present invention is supported by 23 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6504 below describes the starting and ending position of this segment on each transcript.

TABLE 6504

Segment location on transcripts

| Transcript name | Segment starting position | Segment ending position |
| --- | --- | --- |
| R31990_PEA_1_T2 (SEQ ID NO: 4406) | 1969 | 2538 |
| R31990_PEA_1_T3 (SEQ ID NO: 4407) | 1797 | 2366 |
| R31990_PEA_1_T4 (SEQ ID NO: 4408) | 1618 | 2187 |
| R31990_PEA_1_T6 (SEQ ID NO: 4409) | 1635 | 2204 |
| R31990_PEA_1_T11 (SEQ ID NO: 4410) | 1981 | 2550 |
| R31990_PEA_1_T12 (SEQ ID NO: 4411) | 1757 | 2326 |
| R31990_PEA_1_T14 (SEQ ID NO: 4412) | 291 | 860 |

This segment can be found in both coding and non-coding regions of transcript(s) as follows. The segment can be found in a non-coding region of transcript(s) that are related to the following protein(s): R31990_PEA_1_P6. This segment can also be found in the following protein(s): R31990_PEA_1_P1, R31990_PEA_1_P4 and R31990_PEA_1_P7, since it is in the coding region for the corresponding transcript.

Segment cluster R31990_PEA_1_node_53 (SEQ ID NO:6818) according to the present invention is supported by 77 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6505 below describes the starting and ending position of this segment on each transcript.

TABLE 6505

Segment location on transcripts

| Transcript name | Segment starting position | Segment ending position |
|---|---|---|
| R31990_PEA_1_T2 (SEQ ID NO: 4406) | 2539 | 3701 |
| R31990_PEA_1_T3 (SEQ ID NO: 4407) | 2367 | 3529 |
| R31990_PEA_1_T4 (SEQ ID NO: 4408) | 2188 | 3350 |
| R31990_PEA_1_T6 (SEQ ID NO: 4409) | 2205 | 3367 |
| R31990_PEA_1_T11 (SEQ ID NO: 4410) | 2551 | 3713 |
| R31990_PEA_1_T12 (SEQ ID NO: 4411) | 2327 | 3489 |
| R31990_PEA_1_T14 (SEQ ID NO: 4412) | 861 | 2023 |

This segment can be found in both coding and non-coding regions of transcript(s) as follows. The segment can be found in a non-coding region of transcript(s) that are related to the following protein(s): R31990_PEA_1_P1, R31990_PEA_1_P4 and R31990_PEA_1_P7. This segment can also be found in the following protein(s): R31990_PEA_1_P6, since it is in the coding region for the corresponding transcript.

Segment cluster R31990_PEA_1_node_54 (SEQ ID NO:6819) according to the present invention is supported by 51 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6506 below describes the starting and ending position of this segment on each transcript.

TABLE 6506

Segment location on transcripts

| Transcript name | Segment starting position | Segment ending position |
|---|---|---|
| R31990_PEA_1_T2 (SEQ ID NO: 4406) | 3702 | 3879 |
| R31990_PEA_1_T3 (SEQ ID NO: 4407) | 3530 | 3707 |
| R31990_PEA_1_T4 (SEQ ID NO: 4408) | 3351 | 3528 |
| R31990_PEA_1_T6 (SEQ ID NO: 4409) | 3368 | 3545 |
| R31990_PEA_1_T11 (SEQ ID NO: 4410) | 3714 | 3891 |
| R31990_PEA_1_T12 (SEQ ID NO: 4411) | 3490 | 3667 |
| R31990_PEA_1_T14 (SEQ ID NO: 4412) | 2024 | 2201 |

This segment can be found in both coding and non-coding regions of transcript(s) as follows. The segment can be found in a non-coding region of transcript(s) that are related to the following protein(s): R31990_PEA_1_P1, R31990_PEA_1_P4 and R31990_PEA_1_P7. This segment can also be found in the following protein(s): R31990_PEA_1_P6, since it is in the coding region for the corresponding transcript.

Segment cluster R31990_PEA_1_node_57 (SEQ ID NO:6820) according to the present invention is supported by 78 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6507 below describes the starting and ending position of this segment on each transcript.

TABLE 6507

Segment location on transcripts

| Transcript name | Segment starting position | Segment ending position |
|---|---|---|
| R31990_PEA_1_T2 (SEQ ID NO: 4406) | 4000 | 4161 |
| R31990_PEA_1_T3 (SEQ ID NO: 4407) | 3828 | 3989 |
| R31990_PEA_1_T4 (SEQ ID NO: 4408) | 3649 | 3810 |
| R31990_PEA_1_T6 (SEQ ID NO: 4409) | 3666 | 3827 |
| R31990_PEA_1_T11 (SEQ ID NO: 4410) | 4012 | 4173 |
| R31990_PEA_1_T12 (SEQ ID NO: 4411) | 3788 | 3949 |
| R31990_PEA_1_T14 (SEQ ID NO: 4412) | 2322 | 2483 |

This segment can be found in a non-coding region of transcript(s) that are related to the following protein(s): R31990_PEA_1_P1, R31990_PEA_1_P4, R31990_PEA_1_P7 and R31990_PEA_1_P6.

Segment cluster R31990_PEA_1_node_59 (SEQ ID NO:6821) according to the present invention is supported by 84 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6508 below describes the starting and ending position of this segment on each transcript.

TABLE 6508

Segment location on transcripts

| Transcript name | Segment starting position | Segment ending position |
|---|---|---|
| R31990_PEA_1_T2 (SEQ ID NO: 4406) | 4177 | 4380 |
| R31990_PEA_1_T3 (SEQ ID NO: 4407) | 4005 | 4208 |
| R31990_PEA_1_T4 (SEQ ID NO: 4408) | 3826 | 4029 |
| R31990_PEA_1_T6 (SEQ ID NO: 4409) | 3843 | 4046 |
| R31990_PEA_1_T11 (SEQ ID NO: 4410) | 4189 | 4392 |
| R31990_PEA_1_T12 (SEQ ID NO: 4411) | 3965 | 4168 |
| R31990_PEA_1_T14 (SEQ ID NO: 4412) | 2499 | 2702 |

This segment can be found in a non-coding region of transcript(s) that are related to the following protein(s):

R31990_PEA_1_P1, R31990_PEA_1_P4, R31990_PEA_1_P7 and R31990_PEA_1_P6.

Segment cluster R31990_PEA_1_node_60 (SEQ ID NO:6822) according to the present invention is supported by 70 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6509 below describes the starting and ending position of this segment on each transcript.

TABLE 6509

| Segment location on transcripts | | |
|---|---|---|
| Transcript name | Segment starting position | Segment ending position |
| R31990_PEA_1_T2 (SEQ ID NO: 4406) | 4381 | 5805 |
| R31990_PEA_1_T3 (SEQ ID NO: 4407) | 4209 | 5633 |
| R31990_PEA_1_T4 (SEQ ID NO: 4408) | 4030 | 5454 |
| R31990_PEA_1_T6 (SEQ ID NO: 4409) | 4047 | 5471 |
| R31990_PEA_1_T11 (SEQ ID NO: 4410) | 4393 | 5817 |
| R31990_PEA_1_T12 (SEQ ID NO: 4411) | 4169 | 5593 |
| R31990_PEA_1_T14 (SEQ ID NO: 4412) | 2703 | 4127 |

This segment can be found in a non-coding region of transcript(s) that are related to the following protein(s): R31990_PEA_1_P1, R31990_PEA_1_P4, R31990_PEA_1_P7 and R31990_PEA_1_P6.

According to an optional embodiment of the present invention, short segments related to the above cluster are also provided. These segments are up to about 120 bp in length, and so are included in a separate description.

Segment cluster R31990_PEA_1_node_11 (SEQ ID NO:6823) according to the present invention is supported by 52 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T20 (SEQ ID NO:4413), R31990_PEA_1_T21 (SEQ ID NO:4414) and R31990_PEA_1_T23 (SEQ ID NO:4415). Table 6510 below describes the starting and ending position of this segment on each transcript.

TABLE 6510

| Segment location on transcripts | | |
|---|---|---|
| Transcript name | Segment starting position | Segment ending position |
| R31990_PEA_1_T2 (SEQ ID NO: 4406) | 755 | 836 |
| R31990_PEA_1_T3 (SEQ ID NO: 4407) | 583 | 664 |
| R31990_PEA_1_T4 (SEQ ID NO: 4408) | 404 | 485 |
| R31990_PEA_1_T20 (SEQ ID NO: 4413) | 504 | 585 |

TABLE 6510-continued

| Segment location on transcripts | | |
|---|---|---|
| Transcript name | Segment starting position | Segment ending position |
| R31990_PEA_1_T21 (SEQ ID NO: 4414) | 504 | 585 |
| R31990_PEA_1_T23 (SEQ ID NO: 4415) | 504 | 585 |

This segment can be found in the following protein(s): R31990_PEA_1_P1, R31990_PEA_1_P9, R31990_PEA_1_P10 and R31990PEA_1_P12.

Segment cluster R31990_PEA_1_node_12 (SEQ ID NO:6824) according to the present invention is supported by 1 libraries. The number of libraries was determined as previously described. This segment can be found in the following transcript(s): R31990_PEA_1_T6 (SEQ ID NO:4409). Table 6511 below describes the starting and ending position of this segment on each transcript.

TABLE 6511

| Segment location on transcripts | | |
|---|---|---|
| Transcript name | Segment starting position | Segment ending position |
| R31990_PEA_1_T6 (SEQ ID NO: 4409) | 404 | 502 |

This segment can be found in the following protein(s): R31990_PEA_1_P4.

Segment cluster R31990_PEA_1_node_17 (SEQ ID NO:6825) according to the present invention is supported by 63 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413), R31990_PEA_1_T21 (SEQ ID NO:4414) and R31990_PEA_1_T23 (SEQ ID NO:4415). Table 6512 below describes the starting and ending position of this segment on each transcript.

TABLE 6512

| Segment location on transcripts | | |
|---|---|---|
| Transcript name | Segment starting position | Segment ending position |
| R31990_PEA_1_T2 (SEQ ID NO: 4406) | 837 | 921 |
| R31990_PEA_1_T3 (SEQ ID NO: 4407) | 665 | 749 |
| R31990_PEA_1_T4 (SEQ ID NO: 4408) | 486 | 570 |
| R31990_PEA_1_T6 (SEQ ID NO: 4409) | 503 | 587 |
| R31990_PEA_1_T11 (SEQ ID NO: 4410) | 352 | 436 |
| R31990_PEA_1_T12 (SEQ ID NO: 4411) | 128 | 212 |
| R31990_PEA_1_T20 (SEQ ID NO: 4413) | 586 | 670 |
| R31990_PEA_1_T21 (SEQ ID NO: 4414) | 586 | 670 |

TABLE 6512-continued

Segment location on transcripts

| Transcript name | Segment starting position | Segment ending position |
| --- | --- | --- |
| R31990_PEA_1_T23 (SEQ ID NO: 4415) | 586 | 670 |

This segment can be found in both coding and non-coding regions of transcript(s) as follows. The segment can be found in a non-coding region of transcript(s) that are related to the following protein(s): R31990_PEA_1_P7. This segment can also be found in the following protein(s): R31990_PEA_1_P1, R31990_PEA_1_P4, R31990_PEA_1_P9, R31990_PEA_1_P10 and R31990_PEA_1_P12, since it is in the coding region for the corresponding transcript.

Segment cluster R31990_PEA_1_node_18 (SEQ ID NO:6826) according to the present invention can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413), R31990_PEA_1_T21 (SEQ ID NO:4414) and R31990_PEA_1_T23 (SEQ ID NO:4415). Table 6513 below describes the starting and ending position of this segment on each transcript.

TABLE 6513

Segment location on transcripts

| Transcript name | Segment starting position | Segment ending position |
| --- | --- | --- |
| R31990_PEA_1_T2 (SEQ ID NO: 4406) | 922 | 932 |
| R31990_PEA_1_T3 (SEQ ID NO: 4407) | 750 | 760 |
| R31990_PEA_1_T4 (SEQ ID NO: 4408) | 571 | 581 |
| R31990_PEA_1_T6 (SEQ ID NO: 4409) | 588 | 598 |
| R31990_PEA_1_T11 (SEQ ID NO: 4410) | 437 | 447 |
| R31990_PEA_1_T12 (SEQ ID NO: 4411) | 213 | 223 |
| R31990_PEA_1_T20 (SEQ ID NO: 4413) | 671 | 681 |
| R31990_PEA_1_T21 (SEQ ID NO: 4414) | 671 | 681 |
| R31990_PEA_1_T23 (SEQ ID NO: 4415) | 671 | 681 |

This segment can be found in both coding and non-coding regions of transcript(s) as follows. The segment can be found in a non-coding region of transcript(s) that are related to the following protein(s): R31990_PEA_1_P7. This segment can also be found in the following protein(s): R31990_PEA_1_P1, R31990_PEA_1_P4, R31990_PEA_1_P9, R31990_PEA_1_P10 and R31990_PEA_1_P12, since it is in the coding region for the corresponding transcript.

Segment cluster R31990_PEA_1_node_20 (SEQ ID NO:6827) according to the present invention can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413), R31990_PEA_1_T21 (SEQ ID NO:4414) and R31990_PEA_1_T23 (SEQ ID NO:4415). Table 6514 below describes the starting and ending position of this segment on each transcript.

TABLE 6514

Segment location on transcripts

| Transcript name | Segment starting position | Segment ending position |
| --- | --- | --- |
| R31990_PEA_1_T2 (SEQ ID NO: 4406) | 933 | 946 |
| R31990_PEA_1_T3 (SEQ ID NO: 4407) | 761 | 774 |
| R31990_PEA_1_T4 (SEQ ID NO: 4408) | 582 | 595 |
| R31990_PEA_1_T6 (SEQ ID NO: 4409) | 599 | 612 |
| R31990_PEA_1_T11 (SEQ ID NO: 4410) | 945 | 958 |
| R31990_PEA_1_T12 (SEQ ID NO: 4411) | 721 | 734 |
| R31990_PEA_1_T20 (SEQ ID NO: 4413) | 682 | 695 |
| R31990_PEA_1_T21 (SEQ ID NO: 4414) | 682 | 695 |
| R31990_PEA_1_T23 (SEQ ID NO: 4415) | 1179 | 1192 |

This segment can be found in both coding and non-coding regions of transcript(s) as follows. The segment can be found in a non-coding region of transcript(s) that are related to the following protein(s): R31990_PEA_1_P12. This segment can also be found in the following protein(s): R31990_PEA_1_P1, R31990_PEA_1_P4, R31990_PEA_1_P7, R31990_PEA_1_P9 and R31990_PEA_1_P10, since it is in the coding region for the corresponding transcript.

Segment cluster R31990_PEA_1_node_21 (SEQ ID NO:6828) according to the present invention is supported by 62 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413), (SEQ ID NO:4414) and R31990_PEA_1_T23 (SEQ ID NO:4415). Table 6515 below describes the starting and ending position of this segment on each transcript.

TABLE 6515

Segment location on transcripts

| Transcript name | Segment starting position | Segment ending position |
| --- | --- | --- |
| R31990_PEA_1_T2 (SEQ ID NO: 4406) | 947 | 1033 |
| R31990_PEA_1_T3 (SEQ ID NO: 4407) | 775 | 861 |
| R31990_PEA_1_T4 (SEQ ID NO: 4408) | 596 | 682 |
| R31990_PEA_1_T6 (SEQ ID NO: 4409) | 613 | 699 |
| R31990_PEA_1_T11 (SEQ ID NO: 4410) | 959 | 1045 |
| R31990_PEA_1_T12 (SEQ ID NO: 4411) | 735 | 821 |
| R31990_PEA_1_T20 (SEQ ID NO: 4413) | 696 | 782 |

TABLE 6515-continued

Segment location on transcripts

| Transcript name | Segment starting position | Segment ending position |
|---|---|---|
| R31990_PEA_1_T21 (SEQ ID NO: 4414) | 696 | 782 |
| R31990_PEA_1_T23 (SEQ ID NO: 4415) | 1193 | 1279 |

This segment can be found in both coding and non-coding regions of transcript(s) as follows. The segment can be found in a non-coding region of transcript(s) that are related to the following protein(s): R31990_PEA_1_P12. This segment can also be found in the following protein(s): R31990_PEA_1_P1, R31990_PEA_1_P4, R31990_PEA_1_P7, R31990_PEA_1_P9 and R31990_PEA_1_P10, since it is in the coding region for the corresponding transcript.

Segment cluster R31990_PEA_1_node_24 (SEQ ID NO:6829) according to the present invention can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_L_T11 (SEQ ID NO:4410), R31990_PEA_1_T12 (SEQ ID NO:4411), R31990_PEA_1_T20 (SEQ ID NO:4413) and R31990_PEA_1_T21 (SEQ ID NO:4414). Table 6516 below describes the starting and ending position of this segment on each transcript.

TABLE 6516

Segment location on transcripts

| Transcript name | Segment starting position | Segment ending position |
|---|---|---|
| R31990_PEA_1_T2 (SEQ ID NO: 4406) | 1034 | 1037 |
| R31990_PEA_1_T3 (SEQ ID NO: 4407) | 862 | 865 |
| R31990_PEA_1_T4 (SEQ ID NO: 4408) | 683 | 686 |
| R31990_PEA_1_T6 (SEQ ID NO: 4409) | 700 | 703 |
| R31990_PEA_1_T11 (SEQ ID NO: 4410) | 1046 | 1049 |
| R31990_PEA_1_T12 (SEQ ID NO: 4411) | 822 | 825 |
| R31990_PEA_1_T20 (SEQ ID NO: 4413) | 783 | 786 |
| R31990_PEA_1_T21 (SEQ ID NO: 4414) | 783 | 786 |

This segment can be found in the following protein(s): R31990_PEA_1_P1, R31990_PEA_1_P4, R31990_PEA_1_P7, R31990_PEA_1_P9 and R31990_PEA_1_P10.

Segment cluster R31990_PEA_1_node_29 (SEQ ID NO:6830) according to the present invention is supported by 11 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413) and R31990_PEA_1_T21 (SEQ ID NO:4414). Table 6517 below describes the starting and ending position of this segment on each transcript.

TABLE 6517

Segment location on transcripts

| Transcript name | Segment starting position | Segment ending position |
|---|---|---|
| R31990_PEA_1_T2 (SEQ ID NO: 4406) | 1183 | 1278 |
| R31990_PEA_1_T3 (SEQ ID NO: 4407) | 1011 | 1106 |
| R31990_PEA_1_T4 (SEQ ID NO: 4408) | 832 | 927 |
| R31990_PEA_1_T6 (SEQ ID NO: 4409) | 849 | 944 |
| R31990_PEA_1_T11 (SEQ ID NO: 4410) | 1195 | 1290 |
| R31990_PEA_1_T12 (SEQ ID NO: 4411) | 971 | 1066 |
| R31990_PEA_1_T20 (SEQ ID NO: 4413) | 932 | 1027 |
| R31990_PEA_1_T21 (SEQ ID NO: 4414) | 932 | 1027 |

This segment can be found in the following protein(s): R31990_PEA_1_P1, R31990_PEA_1_P4, R31990_PEA_1_P7, R31990_PEA_1_P9 and R31990_PEA_1_P10.

Segment cluster R31990_PEA_1_node_33 (SEQ ID NO:6831) according to the present invention is supported by 9 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411), R31990_PEA_1_T20 (SEQ ID NO:4413) and R31990_PEA_1_T21 (SEQ ID NO:4414). Table 6518 below describes the starting and ending position of this segment on each transcript.

TABLE 6518

Segment location on transcripts

| Transcript name | Segment starting position | Segment ending position |
|---|---|---|
| R31990_PEA_1_T2 (SEQ ID NO: 4406) | 1279 | 1347 |
| R31990_PEA_1_T3 (SEQ ID NO: 4407) | 1107 | 1175 |
| R31990_PEA_1_T4 (SEQ ID NO: 4408) | 928 | 996 |
| R31990_PEA_1_T6 (SEQ ID NO: 4409) | 945 | 1013 |
| R31990_PEA_1_T11 (SEQ ID NO: 4410) | 1291 | 1359 |
| R31990_PEA_1_T12 (SEQ ID NO: 4411) | 1067 | 1135 |
| R31990_PEA_1_T20 (SEQ ID NO: 4413) | 1028 | 1096 |
| R31990_PEA_1_T21 (SEQ ID NO: 4414) | 1028 | 1096 |

This segment can be found in the following protein(s): R31990_PEA_1_P1, R31990_PEA_1_P4, R31990_PEA_1_P7, R31990_PEA_1_P9 and R31990_PEA_1_P10.

Segment cluster R31990_PEA_1_node_36 (SEQ ID NO:6832) according to the present invention is supported by 7 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T20 (SEQ ID NO:4413). Table 6519 below describes the starting and ending position of this segment on each transcript.

TABLE 6519

Segment location on transcripts

| Transcript name | Segment starting position | Segment ending position |
|---|---|---|
| R31990_PEA_1_T2 (SEQ ID NO: 4406) | 1348 | 1390 |
| R31990_PEA_1_T3 (SEQ ID NO: 4407) | 1176 | 1218 |
| R31990_PEA_1_T4 (SEQ ID NO: 4408) | 997 | 1039 |
| R31990_PEA_1_T6 (SEQ ID NO: 4409) | 1014 | 1056 |
| R31990_PEA_1_T11 (SEQ ID NO: 4410) | 1360 | 1402 |
| R31990_PEA_1_T12 (SEQ ID NO: 4411) | 1136 | 1178 |
| R31990_PEA_1_T20 (SEQ ID NO: 4413) | 1097 | 1139 |

This segment can be found in the following protein(s): R31990_PEA_1_P1, R31990PEA_1_P4, R31990_PEA_1_P7 and R31990_PEA_1_P9.

Segment cluster R31990_PEA_1_node_37 (SEQ ID NO:6833) according to the present invention is supported by 9 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_L_T11 (SEQ ID NO:4410), R31990_PEA_1_T12 (SEQ ID NO:4411) and R31990_PEA_1_T20 (SEQ ID NO:4413). Table 6520 below describes the starting and ending position of this segment on each transcript.

TABLE 6520

Segment location on transcripts

| Transcript name | Segment starting position | Segment ending position |
|---|---|---|
| R31990_PEA_1_T2 (SEQ ID NO: 4406) | 1391 | 1468 |
| R31990_PEA_1_T3 (SEQ ID NO: 4407) | 1219 | 1296 |
| R31990_PEA_1_T4 (SEQ ID NO: 4408) | 1040 | 1117 |
| R31990_PEA_1_T6 (SEQ ID NO: 4409) | 1057 | 1134 |
| R31990_PEA_1_T11 (SEQ ID NO: 4410) | 1403 | 1480 |
| R31990_PEA_1_T12 (SEQ ID NO: 4411) | 1179 | 1256 |
| R31990_PEA_1_T20 (SEQ ID NO: 4413) | 1140 | 1217 |

This segment can be found in the following protein(s): R31990_PEA_1_P1, R31990_PEA_1_P4, R31990_PEA_1_P7 and R31990_PEA_1_P9.

Segment cluster R31990_PEA_1_node_39 (SEQ ID NO:6834) according to the present invention is supported by 8 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T20 (SEQ ID NO:4413). Table 6521 below describes the starting and ending position of this segment on each transcript.

TABLE 6521

Segment location on transcripts

| Transcript name | Segment starting position | Segment ending position |
|---|---|---|
| R31990_PEA_1_T2 (SEQ ID NO: 4406) | 1469 | 1536 |
| R31990_PEA_1_T3 (SEQ ID NO: 4407) | 1297 | 1364 |
| R31990_PEA_1_T4 (SEQ ID NO: 4408) | 1118 | 1185 |
| R31990_PEA_1_T6 (SEQ ID NO: 4409) | 1135 | 1202 |
| R31990_PEA_1_T11 (SEQ ID NO: 4410) | 1481 | 1548 |
| R31990_PEA_1_T12 (SEQ ID NO: 4411) | 1257 | 1324 |
| R31990_PEA_1_T20 (SEQ ID NO: 4413) | 1218 | 1285 |

This segment can be found in the following protein(s): R31990_PEA_1_P1, R31990_PEA_1_P4, R31990_PEA_1_P7 and R31990_PEA_1_P9.

Segment cluster R31990_PEA_1_node_44 (SEQ ID NO:6835) according to the present invention is supported by 9 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410) R31990_PEA_1_T12 (SEQ ID NO:4411) and R31990_PEA_1_T20 (SEQ ID NO:4413). Table 6522 below describes the starting and ending position of this segment on each transcript.

TABLE 6522

Segment location on transcripts

| Transcript name | Segment starting position | Segment ending position |
|---|---|---|
| R31990_PEA_1_T2 (SEQ ID NO: 4406) | 1699 | 1786 |
| R31990_PEA_1_T3 (SEQ ID NO: 4407) | 1527 | 1614 |
| R31990_PEA_1_T4 (SEQ ID NO: 4408) | 1348 | 1435 |
| R31990_PEA_1_T6 (SEQ ID NO: 4409) | 1365 | 1452 |
| R31990_PEA_1_T11 (SEQ ID NO: 4410) | 1711 | 1798 |
| R31990_PEA_1_T12 (SEQ ID NO: 4411) | 1487 | 1574 |
| R31990_PEA_1_T20 (SEQ ID NO: 4413) | 1448 | 1535 |

This segment can be found in the following protein(s): R31990_PEA_1_P1, R31990_PEA_1_P4, R31990_PEA_1_P7 and R31990_PEA_1_P9.

Segment cluster R31990_PEA_1_node_46 (SEQ ID NO:6836) according to the present invention is supported by 12 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T20 (SEQ ID NO:4413). Table 6523 below describes the starting and ending position of this segment on each transcript.

TABLE 6523

Segment location on transcripts

| Transcript name | Segment starting position | Segment ending position |
|---|---|---|
| R31990_PEA_1_T2 (SEQ ID NO: 4406) | 1787 | 1872 |
| R31990_PEA_1_T3 (SEQ ID NO: 4407) | 1615 | 1700 |
| R31990_PEA_1_T4 (SEQ ID NO: 4408) | 1436 | 1521 |
| R31990_PEA_1_T6 (SEQ ID NO: 4409) | 1453 | 1538 |
| R31990_PEA_1_T11 (SEQ ID NO: 4410) | 1799 | 1884 |
| R31990_PEA_1_T12 (SEQ ID NO: 4411) | 1575 | 1660 |
| R31990_PEA_1_T20 (SEQ ID NO: 4413) | 1536 | 1621 |

This segment can be found in the following protein(s): R31990_PEA_1_P1, R31990_PEA_1_P4, R31990_PEA_1_P7 and R31990_PEA_1_P9.

Segment cluster R31990_PEA_1_node_50 (SEQ ID NO:6837) according to the present invention is supported by 13 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411)and R31990_PEA_1_T14 (SEQ ID NO:4412). Table 6524 below describes the starting and ending position of this segment on each transcript.

TABLE 6524

Segment location on transcripts

| Transcript name | Segment starting position | Segment ending position |
|---|---|---|
| R31990_PEA_1_T2 (SEQ ID NO: 4406) | 1873 | 1968 |
| R31990_PEA_1_T3 (SEQ ID NO: 4407) | 1701 | 1796 |
| R31990_PEA_1_T4 (SEQ ID NO: 4408) | 1522 | 1617 |
| R31990_PEA_1_T6 (SEQ ID NO: 4409) | 1539 | 1634 |
| R31990_PEA_1_T11 (SEQ ID NO: 4410) | 1885 | 1980 |
| R31990_PEA_1_T12 (SEQ ID NO: 4411) | 1661 | 1756 |
| R31990_PEA_1_T14 (SEQ ID NO: 4412) | 195 | 290 |

This segment can be found in both coding and non-coding regions of transcript(s) as follows. The segment can be found in a non-coding region of transcript(s) that are related to the following protein(s): R31990_PEA_1_P6. This segment can also be found in the following protein(s): R31990_PEA_1_P1, R31990_PEA_1_P4 and R31990_PEA_1_P7, since it is in the coding region for the corresponding transcript.

Segment cluster R31990_PEA_1_node_55 (SEQ ID NO:6838) according to the present invention is supported by 50 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6525 below describes the starting and ending position of this segment on each transcript.

TABLE 6525

Segment location on transcripts

| Transcript name | Segment starting position | Segment ending position |
|---|---|---|
| R31990_PEA_1_T2 (SEQ ID NO: 4406) | 3880 | 3949 |
| R31990_PEA_1_T3 (SEQ ID NO: 4407) | 3708 | 3777 |
| R31990_PEA_1_T4 (SEQ ID NO: 4408) | 3529 | 3598 |
| R31990_PEA_1_T6 (SEQ ID NO: 4409) | 3546 | 3615 |
| R31990_PEA_1_T11 (SEQ ID NO: 4410) | 3892 | 3961 |
| R31990_PEA_1_T12 (SEQ ID NO: 4411) | 3668 | 3737 |
| R31990_PEA_1_T14 (SEQ ID NO: 4412) | 2202 | 2271 |

This segment can be found in both coding and non-coding regions of transcript(s) as follows. The segment can be found in a non-coding region of transcript(s) that are related to the following protein(s): R31990_PEA_1_P1, R31990_PEA_1_P4 and R31990_PEA_1_P7. This segment can also be found in the following protein(s): R31990_PEA_1_P6, since it is in the coding region for the corresponding transcript.

Segment cluster R31990_PEA_1_node_56 (SEQ ID NO:6839) according to the present invention is supported by 52 libraries. The number of libraries was determined as previously described. This segment can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6526 below describes the starting and ending position of this segment on each transcript.

TABLE 6526

Segment location on transcripts

| Transcript name | Segment starting position | Segment ending position |
|---|---|---|
| R31990_PEA_1_T2 (SEQ ID NO: 4406) | 3950 | 3999 |
| R31990_PEA_1_T3 (SEQ ID NO: 4407) | 3778 | 3827 |
| R31990_PEA_1_T4 (SEQ ID NO: 4408) | 3599 | 3648 |

TABLE 6526-continued

Segment location on transcripts

| Transcript name | Segment starting position | Segment ending position |
|---|---|---|
| R31990_PEA_1_T6 (SEQ ID NO: 4409) | 3616 | 3665 |
| R31990_PEA_1_T11 (SEQ ID NO: 4410) | 3962 | 4011 |
| R31990_PEA_1_T12 (SEQ ID NO: 4411) | 3738 | 3787 |
| R31990_PEA_1_T14 (SEQ ID NO: 4412) | 2272 | 2321 |

This segment can be found in a non-coding region of transcript(s) that are related to the following protein(s): R31990_PEA_1_P1, R31990_PEA_1_P4, R31990_PEA_1_P7 and R31990_PEA_1_P6.

Segment cluster R31990_PEA_1_node_58 (SEQ ID NO:6840) according to the present invention can be found in the following transcript(s): R31990_PEA_1_T2 (SEQ ID NO:4406), R31990_PEA_1_T3 (SEQ ID NO:4407), R31990_PEA_1_T4 (SEQ ID NO:4408), R31990_PEA_1_T6 (SEQ ID NO:4409), R31990_PEA_1_T11 (SEQ ID NO:4410), R31990_PEA_1_T12 (SEQ ID NO:4411) and R31990_PEA_1_T14 (SEQ ID NO:4412). Table 6527 below describes the starting and ending position of this segment on each transcript.

TABLE 6527

Segment location on transcripts

| Transcript name | Segment starting position | Segment ending position |
|---|---|---|
| R31990_PEA_1_T2 (SEQ ID NO: 4406) | 4162 | 4176 |
| R31990_PEA_1_T3 (SEQ ID NO: 4407) | 3990 | 4004 |
| R31990_PEA_1_T4 (SEQ ID NO: 4408) | 3811 | 3825 |
| R31990_PEA_1_T6 (SEQ ID NO: 4409) | 3828 | 3842 |
| R31990_PEA_1_T11 (SEQ ID NO: 4410) | 4174 | 4188 |
| R31990_PEA_1_T12 (SEQ ID NO: 4411) | 3950 | 3964 |
| R31990_PEA_1_T14 (SEQ ID NO: 4412) | 2484 | 2498 |

This segment can be found in a non-coding region of transcript(s) that are related to the following protein(s): R31990_PEA_1_P1, R31990_PEA_1_P4, R31990_PEA_1_P7 and R31990_PEA_1_P6.

Description for Cluster Z39337

Cluster Z39337 features 1 transcript(s) and 8 segment(s) of interest, the names for which are given in Tables 6528 and 6529, respectively, the sequences themselves are given at the end of the application. The selected protein variants are given in Table 6530.

TABLE 6528

Transcripts of interest

| Transcript Name |
|---|
| Z39337_PEA_2_PEA_1_T6 (SEQ ID NO: 4416) |

TABLE 6529

Segments of interest

| Segment Name |
|---|
| Z39337_PEA_2_PEA_1_node_2 (SEQ ID NO: 6841) |
| Z39337_PEA_2_PEA_1_node_15 (SEQ ID NO: 6842) |
| Z39337_PEA_2_PEA_1_node_18 (SEQ ID NO: 6843) |
| Z39337_PEA_2_PEA_1_node_21 (SEQ ID NO: 6844) |
| Z39337_PEA_2_PEA_1_node_22 (SEQ ID NO: 6845) |
| Z39337_PEA_2_PEA_1_node_3 (SEQ ID NO: 6846) |
| Z39337_PEA_2_PEA_1_node_6 (SEQ ID NO: 6847) |
| Z39337_PEA_2_PEA_1_node_14 (SEQ ID NO: 6848) |

TABLE 6530

Proteins of interest

| Protein Name | Corresponding Transcript(s) |
|---|---|
| Z39337_PEA_2_PEA_1_P13 | Z39337_PEA_2_PEA_1_T6 (SEQ ID NO: 4416) |

These sequences are variants of the known protein Kallikrein 6 precursor (SwissProt accession identifier KLK6_HUMAN; known also according to the synonyms EC 3.4.21.-; Protease M; Neurosin; Zyme; SP59), referred to herein as the previously known protein.

The sequence for protein Kallikrein 6 precursor is given at the end of the application, as "Kallikrein 6 precursor amino acid sequence". Protein Kallikrein 6 precursor localization is believed to be Secreted.

The following GO Annotation(s) apply to the previously known protein. The following annotation(s) were found: central nervous system development; response to wounding; protein autoprocessing, which are annotation(s) related to Biological Process; chymotrypsin; tissue kallikrein; trypsin; protein binding; hydrolase, which are annotation(s) related to Molecular Function; and extracellular; cytoplasm, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster Z39337 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 152 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 152 and Table 6531. This cluster is overexpressed (at least at a minimum level) in the following pathological conditions: epithelial malignant tumors and gastric carcinoma.

TABLE 6531

Normal tissue distribution

| Name of Tissue | Number |
|---|---|
| brain | 56 |
| colon | 0 |
| epithelial | 3 |
| general | 11 |
| head and neck | 0 |
| kidney | 26 |
| breast | 52 |
| ovary | 0 |
| prostate | 0 |
| stomach | 0 |
| uterus | 0 |

TABLE 6532

P values and ratios for expression in cancerous tissue

| Name of Tissue | P1 | P2 | SP1 | R3 | SP2 | R4 |
|---|---|---|---|---|---|---|
| brain | 8.0e−01 | 8.4e−01 | 9.6e−01 | 0.5 | 1 | 0 3 |
| colon | 1.2e−01 | 8.1e−02 | 4.9e−01 | 1.9 | 7.4e−02 | 2.2 |
| epithelial | 2.0e−02 | 1.8e−02 | 1.0e−05 | 4.3 | 7.8e−15 | 6.9 |
| general | 4.1e−02 | 1.1e−01 | 4.3e−06 | 2.3 | 1.6e−16 | 2.6 |
| head and neck | 2.1e−01 | 3.3e−01 | 1 | 1.7 | 1 | 1.2 |
| kidney | 8.9e−01 | 9.2e−01 | 8.2e−01 | 0.8 | 9.1e−01 | 0.6 |
| breast | 9.1e−01 | 9.1e−01 | 1 | 0.5 | 9.7e−01 | 0.6 |
| ovary | 1.4e−01 | 1.7e−01 | 4.7e−03 | 2.9 | 2.4e−02 | 2.2 |
| prostate | 7.3e−01 | 7.8e−01 | 4.5e−01 | 2.0 | 5.6e−01 | 1.7 |
| stomach | 3.6e−01 | 1.1e−01 | 1 | 1.0 | 8.9e−08 | 5.3 |
| uterus | 4.7e−01 | 4.0e−01 | 1.9e−01 | 2.0 | 3.3e−01 | 1.7 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 6533.

TABLE 6533

Oligonucleotides related to this cluster

| Oligonucleotide name | Overexpressed in cancers | Chip reference |
|---|---|---|
| Z39337_0_9_0 | ovarian carcinoma | OVA |

As noted above, cluster Z39337 features 8 segment(s), which were listed in Table 6529 above and for which the sequence(s) are given at the end of the application. These segment(s) are portions of nucleic acid sequence(s) which are described herein separately because they are of particular interest. A description of each segment according to the present invention is now provided.

Segment cluster Z39337_PEA_2_PEA_1_node_2 (SEQ ID NO:6841) according to the present invention is supported by 23 libraries. The number of libraries was determined as previously described. This segment can be found in the following transcript(s): Z39337_PEA_2_PEA_1_T6 (SEQ ID NO:4416). Table 6534 below describes the starting and ending position of this segment on each transcript.

TABLE 6534

Segment location on transcripts

| Transcript name | Segment starting position | Segment ending position |
|---|---|---|
| Z39337_PEA_2_PEA_1_T6 (SEQ ID NO: 4416) | 1 | 237 |

This segment can be found in a non-coding region of transcript(s) that are related to the following protein(s): Z39337_PEA_2_PEA_1_P13.

Segment cluster Z39337_PEA_2_PEA_1_node_15 (SEQ ID NO:6842) according to the present invention is supported by 54 libraries. The number of libraries was determined as previously described. This segment can be found in the following transcript(s): Z39337_PEA_2_PEA_1_T6 (SEQ ID NO:4416). Table 6535 below describes the starting and ending position of this segment on each transcript.

TABLE 6535

Segment location on transcripts

| Transcript name | Segment starting position | Segment ending position |
|---|---|---|
| Z39337_PEA_2_PEA_1_T6 (SEQ ID NO: 4416) | 390 | 585 |

This segment can be found in the following protein(s): Z39337_PEA_2_PEA_1_P13.

Segment cluster Z39337_PEA_2_PEA_1_node_18 (SEQ ID NO:6843) according to the present invention is supported by 53 libraries. The number of libraries was determined as previously described. This segment can be found in the following transcript(s): Z39337_PEA_2_PEA_1_T6 (SEQ ID NO:4416). Table 6536 below describes the starting and ending position of this segment on each transcript.

TABLE 6536

Segment location on transcripts

| Transcript name | Segment starting position | Segment ending position |
|---|---|---|
| Z39337_PEA_2_PEA_1_T6 (SEQ ID NO: 4416) | 586 | 722 |

This segment can be found in a non-coding region of transcript(s) that are related to the following protein(s): Z39337_PEA_2_PEA_1_P13.

Segment cluster Z39337_PEA_2_PEA_1_node_21 (SEQ ID NO:6844) according to the present invention is supported by 81 libraries. The number of libraries was determined as previously described. This segment can be found in the following transcript(s): Z39337_PEA_2_PEA_1_T6 (SEQ ID NO:4416). Table 6537 below describes the starting and ending position of this segment on each transcript.

TABLE 6537

Segment location on transcripts

| Transcript name | Segment starting position | Segment ending position |
|---|---|---|
| Z39337_PEA_2_PEA_1_T6 (SEQ ID NO: 4416) | 723 | 1139 |

This segment can be found in a non-coding region of transcript(s) that are related to the following protein(s): Z39337_PEA_2_PEA_1_P13.

Segment cluster Z39337_PEA_2_PEA_1_node_22 (SEQ ID NO:6845) according to the present invention is supported by 58 libraries. The number of libraries was determined as previously described. This segment can be found in the following transcript(s): Z39337_PEA_2_PEA_1_T6 (SEQ ID NO:4416). Table 6538 below describes the starting and ending position of this segment on each transcript.

TABLE 6538

Segment location on transcripts

| Transcript name | Segment starting position | Segment ending position |
|---|---|---|
| Z39337_PEA_2_PEA_1_T6 (SEQ ID NO: 4416) | 1140 | 1414 |

This segment can be found in a non-coding region of transcript(s) that are related to the following protein(s): Z39337_PEA_2_PEA_1_P13.

According to an optional embodiment of the present invention, short segments related to the above cluster are also provided. These segments are up to about 120 bp in length, and so are included in a separate description.

Segment cluster Z39337_PEA_2_PEA_1_node_3 (SEQ ID NO:6846) according to the present invention is supported by 55 libraries. The number of libraries was determined as previously described. This segment can be found in the following transcript(s): Z39337_PEA_2_PEA_1_T6 (SEQ ID NO:4416). Table 6539 below describes the starting and ending position of this segment on each transcript.

TABLE 6539

Segment location on transcripts

| Transcript name | Segment starting position | Segment ending position |
|---|---|---|
| Z39337_PEA_2_PEA_1_T6 (SEQ ID NO: 4416) | 238 | 289 |

This segment can be found in a non-coding region of transcript(s) that are related to the following protein(s): Z39337_PEA_2_PEA_1_P13.

Segment cluster Z39337_PEA_2_PEA_1_node_6 (SEQ ID NO:6847) according to the present invention is supported by 56 libraries. The number of libraries was determined as previously described. This segment can be found in the following transcript(s): Z39337_PEA_2_PEA_1_T6 (SEQ ID NO:4416). Table 6540 below describes the starting and ending position of this segment on each transcript.

TABLE 6540

Segment location on transcripts

| Transcript name | Segment starting position | Segment ending position |
|---|---|---|
| Z39337_PEA_2_PEA_1_T6 (SEQ ID NO: 4416) | 290 | 337 |

This segment can be found in the following protein(s): Z39337_PEA_2_PEA_1_P13.

Segment cluster Z39337_PEA_2_PEA_1_node_14 (SEQ ID NO:6848) according to the present invention is supported by 49 libraries. The number of libraries was determined as previously described. This segment can be found in the following transcript(s): Z39337_PEA_2_PEA_1_T6 (SEQ ID NO:4416). Table 6541 below describes the starting and ending position of this segment on each transcript.

TABLE 6541

Segment location on transcripts

| Transcript name | Segment starting position | Segment ending position |
|---|---|---|
| Z39337_PEA_2_PEA_1_T6 (SEQ ID NO: 4416) | 338 | 389 |

This segment can be found in the following protein(s): Z39337_PEA_2_PEA_1_P13.

Description for Cluster Z43749

Cluster Z43749 features 15 transcript(s) and 40 segment(s) of interest, the names for which are given in Tables 6542 and 6543, respectively, the sequences themselves are given at the end of the application. The selected protein variants are given in Table 6544.

TABLE 6542

Transcripts of interest
Transcript Name

Z43749_PEA_1_T1 (SEQ ID NO: 4417)
Z43749_PEA_1_T3 (SEQ ID NO: 4418)
Z43749_PEA_1_T4 (SEQ ID NO: 4419)
Z43749_PEA_1_T5 (SEQ ID NO: 4420)
Z43749_PEA_1_T6 (SEQ ID NO: 4421)
Z43749_PEA_1_T8 (SEQ ID NO: 4422)
Z43749_PEA_1_T12 (SEQ ID NO: 4423)
Z43749_PEA_1_T16 (SEQ ID NO: 4424)
Z43749_PEA_1_T17 (SEQ ID NO: 4425)
Z43749_PEA_1_T18 (SEQ ID NO: 4426)
Z43749_PEA_1_T22 (SEQ ID NO: 4427)
Z43749_PEA_1_T24 (SEQ ID NO: 4428)
Z43749_PEA_1_T30 (SEQ ID NO: 4429)
Z43749_PEA_1_T31 (SEQ ID NO: 4430)
Z43749_PEA_1_T32 (SEQ ID NO: 4431)

TABLE 6543

Segments of interest
Segment Name

Z43749_PEA_1_node_0 (SEQ ID NO: 6849)
Z43749_PEA_1_node_2 (SEQ ID NO: 6850)
Z43749_PEA_1_node_6 (SEQ ID NO: 6851)
Z43749_PEA_1_node_11 (SEQ ID NO: 6852)

TABLE 6543-continued

Segments of interest
Segment Name

Z43749_PEA_1_node_14 (SEQ ID NO: 6853)
Z43749_PEA_1_node_16 (SEQ ID NO: 6854)
Z43749_PEA_1_node_19 (SEQ ID NO: 6855)
Z43749_PEA_1_node_21 (SEQ ID NO: 6856)
Z43749_PEA_1_node_30 (SEQ ID NO: 6857)
Z43749_PEA_1_node_32 (SEQ ID NO: 6858)
Z43749_PEA_1_node_34 (SEQ ID NO: 6859)
Z43749_PEA_1_node_35 (SEQ ID NO: 6860)
Z43749_PEA_1_node_37 (SEQ ID NO: 6861)
Z43749_PEA_1_node_42 (SEQ ID NO: 6862)
Z43749_PEA_1_node_44 (SEQ ID NO: 6863)
Z43749_PEA_1_node_53 (SEQ ID NO: 6864)
Z43749_PEA_1_node_8 (SEQ ID NO: 6865)
Z43749_PEA_1_node_9 (SEQ ID NO: 6866)
Z43749_PEA_1_node_12 (SEQ ID NO: 6867)
Z43749_PEA_1_node_13 (SEQ ID NO: 6868)
Z43749_PEA_1_node_15 (SEQ ID NO: 6869)
Z43749_PEA_1_node_20 (SEQ ID NO: 6870)
Z43749_PEA_1_node_22 (SEQ ID NO: 6871)
Z43749_PEA_1_node_23 (SEQ ID NO: 6872)
Z43749_PEA_1_node_24 (SEQ ID NO: 6873)
Z43749_PEA_1_node_25 (SEQ ID NO: 6874)
Z43749_PEA_1_node_27 (SEQ ID NO: 6875)
Z43749_PEA_1_node_28 (SEQ ID NO: 6876)
Z43749_PEA_1_node_33 (SEQ ID NO: 6877)
Z43749_PEA_1_node_36 (SEQ ID NO: 6878)
Z43749_PEA_1_node_40 (SEQ ID NO: 6879)
Z43749_PEA_1_node_41 (SEQ ID NO: 6880)
Z43749_PEA_1_node_43 (SEQ ID NO: 6881)
Z43749_PEA_1_node_46 (SEQ ID NO: 6882)
Z43749_PEA_1_node_47 (SEQ ID NO: 6883)
Z43749_PEA_1_node_48 (SEQ ID NO: 6884)
Z43749_PEA_1_node_49 (SEQ ID NO: 6885)
Z43749_PEA_1_node_50 (SEQ ID NO: 6886)
Z43749_PEA_1_node_51 (SEQ ID NO: 6887)
Z43749_PEA_1_node_52 (SEQ ID NO: 6888)

TABLE 6544

Proteins of interest

| Protein Name | Corresponding Transcript(s) |
|---|---|
| Z43749_PEA_1_P2 | Z43749_PEA_1_T1 (SEQ ID NO: 4417); Z43749_PEA_1_T8 (SEQ ID NO: 4422); Z43749_PEA_1_T12 (SEQ ID NO: 4423); Z43749_PEA_1_T17 (SEQ ID NO: 4425) |
| Z43749_PEA_1_P4 | Z43749_PEA_1_T4 (SEQ ID NO: 4419) |
| Z43749_PEA_1_P5 | Z43749_PEA_1_T5 (SEQ ID NO: 4420) |
| Z43749_PEA_1_P6 | Z43749_PEA_1_T6 (SEQ ID NO: 4421) |
| Z43749_PEA_1_P14 | Z43749_PEA_1_T22 (SEQ ID NO: 4427) |
| Z43749_PEA_1_P16 | Z43749_PEA_1_T24 (SEQ ID NO: 4428) |

TABLE 6544-continued

Proteins of interest

| Protein Name | Corresponding Transcript(s) |
|---|---|
| Z43749_PEA_1_P20 | Z43749_PEA_1_T31 (SEQ ID NO: 4430) |
| Z43749_PEA_1_P21 | Z43749_PEA_1_T16 (SEQ ID NO: 4424) |
| Z43749_PEA_1_P22 | Z43749_PEA_1_T3 (SEQ ID NO: 4418) |
| Z43749_PEA_1_P26 | Z43749_PEA_1_T18 (SEQ ID NO: 4426) |

These sequences are variants of the known protein Kinesin-like protein KIF22 (SwissProt accession identifier KF22_HUMAN; known also according to the synonyms Kinesin-like DNA-binding protein; Kinesin-like protein 4), referred to herein as the previously known protein.

Protein Kinesin-like protein KIF22 is known or believed to have the following function(s): KINESIN FAMILY THAT IS INVOLVED 1N SPINDLE FORMATION AND THE MOVEMENTS OF CHROMOSOMES DURING MITOSIS AND MEIOSIS. BINDS TO MICROTUBULES AND TO DNA. The sequence for protein Kinesin-like protein KIF22 is given at the end of the application, as "Kinesin-like protein KIF22 amino acid sequence". Known polymorphisms for this sequence are as shown in Table 6545.

TABLE 6545

Amino acid mutations for Known Protein

| SNP position(s) on amino acid sequence | Comment |
|---|---|
| 24 | Missing |
| 122 | S -> KV |
| 135-169 | HTMLGSPEQPGVIPRALMDLLQLTREEGAEGRPWA -> THAGQPRATWGDPAGSHGPPAAHKGGGCRGPAMG |
| 303 | V -> A |
| 418-456 | APASASQKLSPLQKLSSMDPAMLERLLSLDRLLASQGSQ -> SSSLCLPETQPPTEAKAAWTRPCGAPPQLGPSACLPGE P |
| 505-513 | ENHCPTMLR -> RTIVPQCSG |

Protein Kinesin-like protein KIF22 localization is believed to be Nuclear.

The following GO Annotation(s) apply to the previously known protein. The following annotation(s) were found: mitosis, which are annotation(s) related to Biological Process; DNA binding; motor; microtubule motor; ATP binding, which are annotation(s) related to Molecular Function; and nucleus; microtubule associated protein, which are annotation(s) related to Cellular Component.

The GO assignment relies on information from one or more of the SwissProt/TremBl Protein knowledgebase, available from <http://www.expasy.ch/sprot/>; or Locuslink, available from <http://www.ncbi.nlm.nih.gov/projects/LocusLink/>.

Cluster Z43749 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 153 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 153 and Table 6546. This cluster is overexpressed (at least at a minimum level) in the following pathological conditions: epithelial malignant tumors, a mixture of malignant tumors from different tissues and uterine malignancies.

TABLE 6546

Normal tissue distribution

| Name of Tissue | Number |
| --- | --- |
| adrenal | 40 |
| bladder | 0 |
| bone | 32 |
| brain | 42 |
| colon | 0 |
| epithelial | 32 |
| general | 48 |
| head and neck | 0 |
| kidney | 8 |
| liver | 0 |
| lung | 36 |
| lymph nodes | 75 |
| breast | 17 |
| bone marrow | 31 |
| muscle | 120 |
| ovary | 21 |
| pancreas | 20 |
| prostate | 86 |
| skin | 40 |
| stomach | 0 |
| Thyroid | 38 |
| uterus | 22 |

TABLE 6547

P values and ratios for expression in cancerous tissue

| Name of Tissue | P1 | P2 | SP1 | R3 | SP2 | R4 |
| --- | --- | --- | --- | --- | --- | --- |
| adrenal | 3.5e−01 | 2.1e−01 | 2.5e−01 | 2.3 | 2.3e−01 | 2.2 |
| bladder | 5.4e−01 | 6.0e−01 | 5.6e−01 | 1.8 | 6.8e−01 | 1.5 |
| bone | 6.5e−02 | 5.0e−02 | 9.0e−02 | 3.5 | 8.7e−02 | 2.9 |
| brain | 3.4e−01 | 1.5e−01 | 8.7e−02 | 1.5 | 6.2e−05 | 2.3 |
| colon | 2.2e−01 | 2.5e−01 | 4.9e−01 | 2.1 | 2.7e−01 | 2.4 |
| epithelial | 2.7e−02 | 4.5e−04 | 7.2e−03 | 1.8 | 4.2e−07 | 2.5 |
| general | 5.0e−03 | 1.2e−06 | 7.0e−03 | 1.5 | 6.1e−12 | 2.1 |
| head and neck | 2.1e−01 | 1.7e−01 | 1 | 1.3 | 7.5e−01 | 1.4 |
| kidney | 4.3e−01 | 3.6e−01 | 1.1e−01 | 2.9 | 8.2e−02 | 2.9 |
| liver | 1.8e−02 | 2.4e−02 | 2.3e−01 | 4.6 | 1.1e−01 | 3.0 |
| lung | 5.9e−01 | 4.8e−01 | 3.1e−01 | 1.5 | 1.2e−02 | 1.3 |
| lymph nodes | 6.3e−01 | 1.1e−01 | 1 | 0.3 | 3.3e−02 | 2.1 |
| breast | 6.5e−01 | 2.7e−01 | 4.7e−01 | 1.4 | 2.5e−01 | 1.8 |
| bone marrow | 6.4e−01 | 5.7e−01 | 2.8e−01 | 3.4 | 3.6e−01 | 1.8 |
| muscle | 7.1e−01 | 6.8e−01 | 1 | 0.1 | 3.1e−01 | 0.5 |
| ovary | 4.8e−01 | 4.4e−01 | 3.2e−02 | 2.7 | 4.1e−02 | 2.5 |
| pancreas | 5.7e−01 | 2.1e−01 | 8.1e−01 | 0.8 | 2.7e−01 | 1.5 |
| prostate | 8.1e−01 | 8.5e−01 | 8.6e−01 | 0.7 | 7.9e−01 | 0.7 |
| skin | 5.2e−01 | 8.5e−02 | 1.5e−01 | 3.3 | 4.0e−01 | 1.1 |
| stomach | 4.6e−01 | 4.1e−01 | 2.5e−01 | 3.0 | 5.3e−02 | 3.5 |
| Thyroid | 3.2e−01 | 3.2e−01 | 6.7e−01 | 1.4 | 6.7e−01 | 1.4 |
| uterus | 9.0e−02 | 8.7e−03 | 3.4e−01 | 1.6 | 8.8e−03 | 3.4 |

As noted above, cluster Z43749 features 40 segment(s), which were listed in Table 6543 above and for which the sequence(s) are given at the end of the application. These segment(s) are portions of nucleic acid sequence(s) which are described herein separately because they are of particular interest. A description of each segment according to the present invention is now provided.

Segment cluster Z43749_PEA_1_node_0 (SEQ ID NO:6849) according to the present invention is supported by 101 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T17 (SEQ ID NO:4425), Z43749_PEA_1_T18 (SEQ ID NO:4426), Z43749_PEA_1_T22 (SEQ ID NO:4427), Z43749_PEA_1_T24 (SEQ ID NO:4428) and Z43749_PEA_1_T31 (SEQ ID NO:4430). Table 6548 below describes the starting and ending position of this segment on each transcript.

TABLE 6548

Segment location on transcripts

| Transcript name | Segment starting position | Segment ending position |
| --- | --- | --- |
| Z43749_PEA_1_T1 (SEQ ID NO: 4417) | 1 | 1148 |
| Z43749_PEA_1_T3 (SEQ ID NO: 4418) | 1 | 1148 |
| Z43749_PEA_1_T4 (SEQ ID NO: 4419) | 1 | 1148 |
| Z43749_PEA_1_T5 (SEQ ID NO: 4420) | 1 | 1148 |
| Z43749_PEA_1_T6 (SEQ ID NO: 4421) | 1 | 1148 |
| Z43749_PEA_1_T8 (SEQ ID NO: 4422) | 1 | 1148 |
| Z43749_PEA_1_T12 (SEQ ID NO: 4423) | 1 | 1148 |
| Z43749_PEA_1_T17 (SEQ ID NO: 4425) | 1 | 1148 |
| Z43749_PEA_1_T18 (SEQ ID NO: 4426) | 1 | 1148 |
| Z43749_PEA_1_T22 (SEQ ID NO: 4427) | 1 | 1148 |
| Z43749_PEA_1_T24 (SEQ ID NO: 4428) | 1 | 1148 |
| Z43749_PEA_1_T31 (SEQ ID NO: 4430) | 1 | 1148 |

This segment can be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14, Z43749_PEA_1_P16 and Z43749_PEA_1_P20.

Segment cluster Z43749_PEA_1_node_2 (SEQ ID NO:6850) according to the present invention is supported by 1 libraries. The number of libraries was determined as previously described. This segment can be found in the following transcript(s): Z43749_PEA_1_T16 (SEQ ID NO:4424). Table 6549 below describes the starting and ending position of this segment on each transcript.

TABLE 6549

Segment location on transcripts

| Transcript name | Segment starting position | Segment ending position |
|---|---|---|
| Z43749_PEA_1_T16 (SEQ ID NO: 4424) | 1 | 227 |

This segment can be found in a non-coding region of transcript(s) that are related to the following protein(s): Z43749_PEA_1_P21.

Segment cluster Z43749_PEA_1_node_6 (SEQ ID NO:6851) according to the present invention is supported by 118 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427), Z43749_PEA_1_T24 (SEQ ID NO:4428) and Z43749_PEA_1_T31 (SEQ ID NO:4430). Table 6550 below describes the starting and ending position of this segment on each transcript.

TABLE 6550

Segment location on transcripts

| Transcript name | Segment starting position | Segment ending position |
|---|---|---|
| Z43749_PEA_1_T1 (SEQ ID NO: 4417) | 1149 | 1344 |
| Z43749_PEA_1_T3 (SEQ ID NO: 4418) | 1149 | 1344 |
| Z43749_PEA_1_T4 (SEQ ID NO: 4419) | 1149 | 1344 |
| Z43749_PEA_1_T5 (SEQ ID NO: 4420) | 1149 | 1344 |
| Z43749_PEA_1_T6 (SEQ ID NO: 4421) | 1149 | 1344 |
| Z43749_PEA_1_T8 (SEQ ID NO: 4422) | 1149 | 1344 |
| Z43749_PEA_1_T12 (SEQ ID NO: 4423) | 1149 | 1344 |
| Z43749_PEA_1_T16 (SEQ ID NO: 4424) | 228 | 423 |
| Z43749_PEA_1_T17 (SEQ ID NO: 4425) | 1149 | 1344 |
| Z43749_PEA_1_T18 (SEQ ID NO: 4426) | 1149 | 1344 |
| Z43749_PEA_1_T22 (SEQ ID NO: 4427) | 1149 | 1344 |
| Z43749_PEA_1_T24 (SEQ ID NO: 4428) | 1149 | 1344 |
| Z43749_PEA_1_T31 (SEQ ID NO: 4430) | 1149 | 1344 |

This segment can be found in both coding and non-coding regions of transcript(s) as follows. The segment can be found in a non-coding region of transcript(s) that are related to the following protein(s): Z43749_PEA_1_P21. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14, Z43749_PEA_1_P16 and Z43749_PEA_1_P20, since it is in the coding region for the corresponding transcript.

Segment cluster Z43749_PEA_1_node_11 (SEQ ID NO:6852) according to the present invention is supported by 116 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6551 below describes the starting and ending position of this segment on each transcript.

TABLE 6551

Segment location on transcripts

| Transcript name | Segment starting position | Segment ending position |
|---|---|---|
| Z43749_PEA_1_T1 (SEQ ID NO: 4417) | 1473 | 1621 |
| Z43749_PEA_1_T3 (SEQ ID NO: 4418) | 1473 | 1621 |
| Z43749_PEA_1_T4 (SEQ ID NO: 4419) | 1473 | 1621 |
| Z43749_PEA_1_T5 (SEQ ID NO: 4420) | 1473 | 1621 |
| Z43749_PEA_1_T6 (SEQ ID NO: 4421) | 1473 | 1621 |
| Z43749_PEA_1_T8 (SEQ ID NO: 4422) | 1473 | 1621 |
| Z43749_PEA_1_T12 (SEQ ID NO: 4423) | 1473 | 1621 |
| Z43749_PEA_1_T16 (SEQ ID NO: 4424) | 552 | 700 |
| Z43749_PEA_1_T17 (SEQ ID NO: 4425) | 1473 | 1621 |
| Z43749_PEA_1_T18 (SEQ ID NO: 4426) | 1473 | 1621 |
| Z43749_PEA_1_T22 (SEQ ID NO: 4427) | 1473 | 1621 |
| Z43749_PEA_1_T24 (SEQ ID NO: 4428) | 1473 | 1621 |

This segment can be found in both coding and non-coding regions of transcript(s) as follows. The segment can be found in a non-coding region of transcript(s) that are related to the following protein(s): Z43749_PEA_1_P21. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14 and Z43749_PEA_1_P16, since it is in the coding region for the corresponding transcript.

Segment cluster Z43749_PEA_1_node_14 (SEQ ID NO:6853) according to the present invention is supported by 3 libraries. The number of libraries was determined as previously described. This segment can be found in the following transcript(s): Z43749_PEA_1_T18 (SEQ ID NO:4426). Table 6552 below describes the starting and ending position of this segment on each transcript.

TABLE 6552

Segment location on transcripts

| Transcript name | Segment starting position | Segment ending position |
|---|---|---|
| Z43749_PEA_1_T18 (SEQ ID NO: 4426) | 1641 | 1854 |

This segment can be found in the following protein(s): Z43749_PEA_1_P26.

Segment cluster Z43749_PEA_1_node_16 (SEQ ID NO:6854) according to the present invention is supported by 112 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6553 below describes the starting and ending position of this segment on each transcript.

TABLE 6553

Segment location on transcripts

| Transcript name | Segment starting position | Segment ending position |
|---|---|---|
| Z43749_PEA_1_T1 (SEQ ID NO: 4417) | 1715 | 1837 |
| Z43749_PEA_1_T3 (SEQ ID NO: 4418) | 1715 | 1837 |
| Z43749_PEA_1_T4 (SEQ ID NO: 4419) | 1715 | 1837 |
| Z43749_PEA_1_T5 (SEQ ID NO: 4420) | 1715 | 1837 |
| Z43749_PEA_1_T6 (SEQ ID NO: 4421) | 1715 | 1837 |
| Z43749_PEA_1_T8 (SEQ ID NO: 4422) | 1715 | 1837 |
| Z43749_PEA_1_T12 (SEQ ID NO: 4423) | 1715 | 1837 |
| Z43749_PEA_1_T16 (SEQ ID NO: 4424) | 794 | 916 |
| Z43749_PEA_1_T17 (SEQ ID NO: 4425) | 1715 | 1837 |
| Z43749_PEA_1_T18 (SEQ ID NO: 4426) | 1942 | 2064 |
| Z43749_PEA_1_T22 (SEQ ID NO: 4427) | 1715 | 1837 |
| Z43749_PEA_1_T24 (SEQ ID NO: 4428) | 1715 | 1837 |

This segment can be found in both coding and non-coding regions of transcript(s) as follows. The segment can be found in a non-coding region of transcript(s) that are related to the following protein(s): Z43749_PEA_1_P21 and Z43749_PEA_1_P26. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_19 (SEQ ID NO:6855) according to the present invention is supported by 120 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6554 below describes the starting and ending position of this segment on each transcript.

TABLE 6554

Segment location on transcripts

| Transcript name | Segment starting position | Segment ending position |
|---|---|---|
| Z43749_PEA_1_T1 (SEQ ID NO: 4417) | 1838 | 2027 |
| Z43749_PEA_1_T3 (SEQ ID NO: 4418) | 1838 | 2027 |
| Z43749_PEA_1_T4 (SEQ ID NO: 4419) | 1838 | 2027 |
| Z43749_PEA_1_T5 (SEQ ID NO: 4420) | 1838 | 2027 |
| Z43749_PEA_1_T6 (SEQ ID NO: 4421) | 1838 | 2027 |
| Z43749_PEA_1_T8 (SEQ ID NO: 4422) | 1838 | 2027 |
| Z43749_PEA_1_T12 (SEQ ID NO: 4423) | 1838 | 2027 |
| Z43749_PEA_1_T16 (SEQ ID NO: 4424) | 917 | 1106 |
| Z43749_PEA_1_T17 (SEQ ID NO: 4425) | 1838 | 2027 |
| Z43749_PEA_1_T18 (SEQ ID NO: 4426) | 2065 | 2254 |
| Z43749_PEA_1_T22 (SEQ ID NO: 4427) | 1838 | 2027 |
| Z43749_PEA_1_T24 (SEQ ID NO: 4428) | 1838 | 2027 |

This segment can be found in both coding and non-coding regions of transcript(s) as follows. The segment can be found in a non-coding region of transcript(s) that are related to the following protein(s): Z43749_PEA_1_P21 and Z43749_PEA_1_P26. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_21 (SEQ ID NO:6856) according to the present invention is supported by 3 libraries. The number of libraries was determined as previously described. This segment can be found in the following transcript(s): Z43749_PEA_1_T3 (SEQ ID NO:4418). Table 6555 below describes the starting and ending position of this segment on each transcript.

TABLE 6555

| | Segment location on transcripts | |
|---|---|---|
| Transcript name | Segment starting position | Segment ending position |
| Z43749_PEA_1_T3 (SEQ ID NO: 4418) | 2069 | 2201 |

This segment can be found in the following protein(s): Z43749_PEA_1_P22.

Segment cluster Z43749_PEA_1_node_30 (SEQ ID NO:6857) according to the present invention is supported by 4 libraries. The number of libraries was determined as previously described. This segment can be found in the following transcript(s): Z43749_PEA_1_T22 (SEQ ID NO:4427) and Z43749_PEA_1_T24 (SEQ ID NO:4428). Table 6556 below describes the starting and ending position of this segment on each transcript.

TABLE 6556

| | Segment location on transcripts | |
|---|---|---|
| Transcript name | Segment starting position | Segment ending position |
| Z43749_PEA_1_T22 (SEQ ID NO: 4427) | 2359 | 2962 |
| Z43749_PEA_1_T24 (SEQ ID NO: 4428) | 2261 | 2864 |

This segment can be found in both coding and non-coding regions of transcript(s) as follows. The segment can be found in a non-coding region of transcript(s) that are related to the following protein(s): Z43749_PEA_1_P16. This segment can also be found in the following protein(s): Z43749_PEA_1_P14, since it is in the coding region for the corresponding transcript.

Segment cluster Z43749_PEA_1_node_32 (SEQ ID NO:6858) according to the present invention is supported by 9 libraries. The number of libraries was determined as previously described. This segment can be found in the following transcript(s): Z43749_PEA_1_T30 (SEQ ID NO:4429) and Z43749_PEA_1_T32 (SEQ ID NO:4431). Table 6557 below describes the starting and ending position of this segment on each transcript.

TABLE 6557

| | Segment location on transcripts | |
|---|---|---|
| Transcript name | Segment starting position | Segment ending position |
| Z43749_PEA_1_T30 (SEQ ID NO: 4429) | 1 | 1420 |
| Z43749_PEA_1_T32 (SEQ ID NO: 4431) | 1 | 1420 |

The previously-described transcripts for these segment(s) do not code for protein.

Segment cluster Z43749_PEA_1_node_34 (SEQ ID NO:6859) according to the present invention is supported by 99 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6558 below describes the starting and ending position of this segment on each transcript.

TABLE 6558

| | Segment location on transcripts | |
|---|---|---|
| Transcript name | Segment starting position | Segment ending position |
| Z43749_PEA_1_T1 (SEQ ID NO: 4417) | 2359 | 2527 |
| Z43749_PEA_1_T3 (SEQ ID NO: 4418) | 2492 | 2660 |
| Z43749_PEA_1_T4 (SEQ ID NO: 4419) | 2359 | 2527 |
| Z43749_PEA_1_T5 (SEQ ID NO: 4420) | 2359 | 2527 |
| Z43749_PEA_1_T6 (SEQ ID NO: 4421) | 2359 | 2527 |
| Z43749_PEA_1_T8 (SEQ ID NO: 4422) | 2359 | 2527 |
| Z43749_PEA_1_T12 (SEQ ID NO: 4423) | 2359 | 2527 |
| Z43749_PEA_1_T16 (SEQ ID NO: 4424) | 1438 | 1606 |
| Z43749_PEA_1_T17 (SEQ ID NO: 4425) | 2359 | 2527 |
| Z43749_PEA_1_T18 (SEQ ID NO: 4426) | 2586 | 2754 |
| Z43749_PEA_1_T30 (SEQ ID NO: 4429) | 1426 | 1594 |
| Z43749_PEA_1_T31 (SEQ ID NO: 4430) | 1444 | 1612 |
| Z43749_PEA_1_T32 (SEQ ID NO: 4431) | 1426 | 1594 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 6559.

TABLE 6559

| Oligonucleotides related to this segment | | |
|---|---|---|
| Oligonucleotide name | Overexpressed in cancers | Chip reference |
| Z43749_0_33_0 | lung malignant tumors | LUN |
| Z43749_0_33_0 | ovarian carcinoma | OVA |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6 and Z43749_PEA_1_P20, since it is in the coding region for the corresponding transcript.

Segment cluster Z43749_PEA_1_node_35 (SEQ ID NO:6860) according to the present invention is supported by 5 libraries. The number of libraries was determined as previously described. This segment can be found in the following transcript(s): Z43749_PEA_1_T4 (SEQ ID NO:4419), Z43749_PEA_1_T30 (SEQ ID NO:4429) and Z43749_PEA_1_T32 (SEQ ID NO:4431). Table 6560 below describes the starting and ending position of this segment on each transcript.

TABLE 6560

Segment location on transcripts

| Transcript name | Segment starting position | Segment ending position |
|---|---|---|
| Z43749_PEA_1_T4 (SEQ ID NO: 4419) | 2528 | 2988 |
| Z43749_PEA_1_T30 (SEQ ID NO: 4429) | 1595 | 2055 |
| Z43749_PEA_1_T32 (SEQ ID NO: 4431) | 1595 | 2055 |

This segment can be found in the following protein(s): Z43749_PEA_1_P4.

Segment cluster Z43749_PEA_1_node_37 (SEQ ID NO:6861) according to the present invention is supported by 110 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6561 below describes the starting and ending position of this segment on each transcript.

TABLE 6561

Segment location on transcripts

| Transcript name | Segment starting position | Segment ending position |
|---|---|---|
| Z43749_PEA_1_T1 (SEQ ID NO: 4417) | 2528 | 2687 |
| Z43749_PEA_1_T3 (SEQ ID NO: 4418) | 2661 | 2820 |
| Z43749_PEA_1_T4 (SEQ ID NO: 4419) | 3039 | 3198 |
| Z43749_PEA_1_T5 (SEQ ID NO: 4420) | 2528 | 2687 |
| Z43749_PEA_1_T6 (SEQ ID NO: 4421) | 2578 | 2737 |
| Z43749_PEA_1_T8 (SEQ ID NO: 4422) | 2528 | 2687 |
| Z43749_PEA_1_T12 (SEQ ID NO: 4423) | 2528 | 2687 |
| Z43749_PEA_1_T16 (SEQ ID NO: 4424) | 1607 | 1766 |
| Z43749_PEA_1_T17 (SEQ ID NO: 4425) | 2528 | 2687 |
| Z43749_PEA_1_T18 (SEQ ID NO: 4426) | 2755 | 2914 |
| Z43749_PEA_1_T30 (SEQ ID NO: 4429) | 2106 | 2265 |
| Z43749_PEA_1_T31 (SEQ ID NO: 4430) | 1663 | 1822 |
| Z43749_PEA_1_T32 (SEQ ID NO: 4431) | 2106 | 2265 |

This segment can be found in both coding and non-coding regions of transcript(s) as follows. The segment can be found in a non-coding region of transcript(s) that are related to the following protein(s): Z43749_PEA_1_P22, Z43749_PEA_1_P4 and Z43749_PEA_1_P26. This segment can also be found in the following protein(s): Z43749_PEA_1_P2, Z43749_PEA_1_P5, Z43749_PEA_1_P6, Z43749_PEA_1_P21 and Z43749_PEA_1_P20, since it is in the coding region for the corresponding transcript.

Segment cluster Z43749_PEA_1_node_42 (SEQ ID NO:6862) according to the present invention is supported by 43 libraries. The number of libraries was determined as previously described. This segment can be found in the following transcript(s): Z43749_PEA_1_T1 (SEQ ID NO:4417), Z43749_PEA_1_T4 (SEQ ID NO:4419), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T17 (SEQ ID NO:4425), Z43749_PEA_1_T30 (SEQ ID NO:4429), Z43749_PEA_1_T31 (SEQ ID NO:4430) and Z43749_PEA_1_T32 (SEQ ID NO:4431). Table 6562 below describes the starting and ending position of this segment on each transcript.

TABLE 6562

Segment location on transcripts

| Transcript name | Segment starting position | Segment ending position |
|---|---|---|
| Z43749_PEA_1_T1 (SEQ ID NO: 4417) | 2798 | 3265 |
| Z43749_PEA_1_T4 (SEQ ID NO: 4419) | 3309 | 3776 |
| Z43749_PEA_1_T6 (SEQ ID NO: 4421) | 2848 | 3315 |
| Z43749_PEA_1_T8 (SEQ ID NO: 4422) | 2798 | 3265 |
| Z43749_PEA_1_T12 (SEQ ID NO: 4423) | 2798 | 3265 |
| Z43749_PEA_1_T17 (SEQ ID NO: 4425) | 2798 | 3265 |
| Z43749_PEA_1_T30 (SEQ ID NO: 4429) | 2376 | 2843 |
| Z43749_PEA_1_T31 (SEQ ID NO: 4430) | 1933 | 2400 |
| Z43749_PEA_1_T32 (SEQ ID NO: 4431) | 2376 | 2843 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 6563.

TABLE 6563

Oligonucleotides related to this segment

| Oligonucleotide name | Overexpressed in cancers | Chip reference |
|---|---|---|
| Z43749_0_1_71789 | lung malignant tumors | LUN |

This segment can be found in both coding and non-coding regions of transcript(s) as follows. The segment can be found in a non-coding region of transcript(s) that are related to the following protein(s): Z43749_PEA_1_P4, Z43749_PEA_1_P6 and Z43749_PEA_1_P20. This segment can also be found in the following protein(s): Z43749_PEA_1_P2, since it is in the coding region for the corresponding transcript.

Segment cluster Z43749_PEA_1_node_44 (SEQ ID NO:6863) according to the present invention is supported by 69 libraries. The number of libraries was determined as previously described. This segment can be found in the following transcript(s): Z43749_PEA_1_T1 (SEQ ID NO:4417), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T17 (SEQ ID NO:4425), Z43749_PEA_1_T30 (SEQ ID NO:4429), Z43749_PEA_1_T31 (SEQ ID NO:4430) and Z43749_PEA_1_T32 (SEQ ID NO:4431). Table 6564 below describes the starting and ending position of this segment on each transcript.

TABLE 6564

Segment location on transcripts

| Transcript name | Segment starting position | Segment ending position |
|---|---|---|
| Z43749_PEA_1_T1 (SEQ ID NO: 4417) | 3368 | 3503 |
| Z43749_PEA_1_T4 (SEQ ID NO: 4419) | 3879 | 4014 |
| Z43749_PEA_1_T5 (SEQ ID NO: 4420) | 2858 | 2993 |
| Z43749_PEA_1_T6 (SEQ ID NO: 4421) | 3418 | 3553 |
| Z43749_PEA_1_T8 (SEQ ID NO: 4422) | 3368 | 3503 |
| Z43749_PEA_1_T12 (SEQ ID NO: 4423) | 3368 | 3503 |
| Z43749_PEA_1_T17 (SEQ ID NO: 4425) | 3368 | 3503 |
| Z43749_PEA_1_T30 (SEQ ID NO: 4429) | 2946 | 3081 |
| Z43749_PEA_1_T31 (SEQ ID NO: 4430) | 2503 | 2638 |
| Z43749_PEA_1_T32 (SEQ ID NO: 4431) | 2946 | 3081 |

This segment can be found in a non-coding region of transcript(s) that are related to the following protein(s): Z43749_PEA_1_P2, Z43749_PEA_1_P4, Z43749_PEA_1_P5, Z43749_PEA_1_P6 and Z43749_PEA_1_P20.

Segment cluster Z43749_PEA_1_node_53 (SEQ ID NO:6864) according to the present invention is supported by 161 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6565 below describes the starting and ending position of this segment on each transcript.

TABLE 6565

Segment location on transcripts

| Transcript name | Segment starting position | Segment ending position |
|---|---|---|
| Z43749_PEA_1_T1 (SEQ ID NO: 4417) | 3777 | 3896 |
| Z43749_PEA_1_T3 (SEQ ID NO: 4418) | 3162 | 3281 |
| Z43749_PEA_1_T4 (SEQ ID NO: 4419) | 4288 | 4407 |

TABLE 6565-continued

Segment location on transcripts

| Transcript name | Segment starting position | Segment ending position |
|---|---|---|
| Z43749_PEA_1_T5 (SEQ ID NO: 4420) | 3267 | 3386 |
| Z43749_PEA_1_T6 (SEQ ID NO: 4421) | 3827 | 3946 |
| Z43749_PEA_1_T8 (SEQ ID NO: 4422) | 3865 | 3984 |
| Z43749_PEA_1_T12 (SEQ ID NO: 4423) | 3953 | 4682 |
| Z43749_PEA_1_T16 (SEQ ID NO: 4424) | 2108 | 2227 |
| Z43749_PEA_1_T17 (SEQ ID NO: 4425) | 3657 | 3776 |
| Z43749_PEA_1_T18 (SEQ ID NO: 4426) | 3256 | 3375 |
| Z43749_PEA_1_T30 (SEQ ID NO: 4429) | 3355 | 3474 |
| Z43749_PEA_1_T31 (SEQ ID NO: 4430) | 2912 | 3031 |
| Z43749_PEA_1_T32 (SEQ ID NO: 4431) | 3443 | 3562 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

According to an optional embodiment of the present invention, short segments related to the above cluster are also provided. These segments are up to about 120 bp in length, and so are included in a separate description.

Segment cluster Z43749_PEA_1_node_8 (SEQ ID NO:6865) according to the present invention is supported by 113 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427), Z43749_PEA_1_T24 (SEQ ID NO:4428) and Z43749_PEA_1_T31 (SEQ ID NO:4430). Table 6566 below describes the starting and ending position of this segment on each transcript.

TABLE 6566

Segment location on transcripts

| Transcript name | Segment starting position | Segment ending position |
|---|---|---|
| Z43749_PEA_1_T1 (SEQ ID NO: 4417) | 1345 | 1438 |
| Z43749_PEA_1_T3 (SEQ ID NO: 4418) | 1345 | 1438 |
| Z43749_PEA_1_T4 (SEQ ID NO: 4419) | 1345 | 1438 |

TABLE 6566-continued

Segment location on transcripts

| Transcript name | Segment starting position | Segment ending position |
|---|---|---|
| Z43749_PEA_1_T5 (SEQ ID NO: 4420) | 1345 | 1438 |
| Z43749_PEA_1_T6 (SEQ ID NO: 4421) | 1345 | 1438 |
| Z43749_PEA_1_T8 (SEQ ID NO: 4422) | 1345 | 1438 |
| Z43749_PEA_1_T12 (SEQ ID NO: 4423) | 1345 | 1438 |
| Z43749_PEA_1_T16 (SEQ ID NO: 4424) | 424 | 517 |
| Z43749_PEA_1_T17 (SEQ ID NO: 4425) | 1345 | 1438 |
| Z43749_PEA_1_T18 (SEQ ID NO: 4426) | 1345 | 1438 |
| Z43749_PEA_1_T22 (SEQ ID NO: 4427) | 1345 | 1438 |
| Z43749_PEA_1_T24 (SEQ ID NO: 4428) | 1345 | 1438 |
| Z43749_PEA_1_T31 (SEQ ID NO: 4430) | 1345 | 1438 |

This segment can be found in both coding and non-coding regions of transcript(s) as follows. The segment can be found in a non-coding region of transcript(s) that are related to the following protein(s): Z43749_PEA_1_P21. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14, Z43749_PEA_1_P16 and Z43749_PEA_1_P20, since it is in the coding region for the corresponding transcript.

Segment cluster Z43749_PEA_1_node_9 (SEQ ID NO:6866) according to the present invention is supported by 105 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6567 below describes the starting and ending position of this segment on each transcript.

TABLE 6567

Segment location on transcripts

| Transcript name | Segment starting position | Segment ending position |
|---|---|---|
| Z43749_PEA_1_T1 (SEQ ID NO: 4417) | 1439 | 1472 |
| Z43749_PEA_1_T3 (SEQ ID NO: 4418) | 1439 | 1472 |
| Z43749_PEA_1_T4 (SEQ ID NO: 4419) | 1439 | 1472 |
| Z43749_PEA_1_T5 (SEQ ID NO: 4420) | 1439 | 1472 |
| Z43749_PEA_1_T6 (SEQ ID NO: 4421) | 1439 | 1472 |

TABLE 6567-continued

Segment location on transcripts

| Transcript name | Segment starting position | Segment ending position |
|---|---|---|
| Z43749_PEA_1_T8 (SEQ ID NO: 4422) | 1439 | 1472 |
| Z43749_PEA_1_T12 (SEQ ID NO: 4423) | 1439 | 1472 |
| Z43749_PEA_1_T16 (SEQ ID NO: 4424) | 518 | 551 |
| Z43749_PEA_1_T17 (SEQ ID NO: 4425) | 1439 | 1472 |
| Z43749_PEA_1_T18 (SEQ ID NO: 4426) | 1439 | 1472 |
| Z43749_PEA_1_T22 (SEQ ID NO: 4427) | 1439 | 1472 |
| Z43749_PEA_1_T24 (SEQ ID NO: 4428) | 1439 | 1472 |

This segment can be found in both coding and non-coding regions of transcript(s) as follows. The segment can be found in a non-coding region of transcript(s) that are related to the following protein(s): Z43749_PEA_1_P21. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14 and Z43749_PEA_1_P16, since it is in the coding region for the corresponding transcript.

Segment cluster Z43749_PEA_1_node_12 (SEQ ID NO:6867) according to the present invention can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6568 below describes the starting and ending position of this segment on each transcript.

TABLE 6568

Segment location on transcripts

| Transcript name | Segment starting position | Segment ending position |
|---|---|---|
| Z43749_PEA_1_T1 (SEQ ID NO: 4417) | 1622 | 1627 |
| Z43749_PEA_1_T3 (SEQ ID NO: 4418) | 1622 | 1627 |
| Z43749_PEA_1_T4 (SEQ ID NO: 4419) | 1622 | 1627 |
| Z43749_PEA_1_T5 (SEQ ID NO: 4420) | 1622 | 1627 |
| Z43749_PEA_1_T6 (SEQ ID NO: 4421) | 1622 | 1627 |
| Z43749_PEA_1_T8 (SEQ ID NO: 4422) | 1622 | 1627 |
| Z43749_PEA_1_T12 (SEQ ID NO: 4423) | 1622 | 1627 |
| Z43749_PEA_1_T16 (SEQ ID NO: 4424) | 701 | 706 |
| Z43749_PEA_1_T17 (SEQ ID NO: 4425) | 1622 | 1627 |
| Z43749_PEA_1_T18 (SEQ ID NO: 4426) | 1622 | 1627 |

TABLE 6568-continued

Segment location on transcripts

| Transcript name | Segment starting position | Segment ending position |
|---|---|---|
| Z43749_PEA_1_T22 (SEQ ID NO: 4427) | 1622 | 1627 |
| Z43749_PEA_1_T24 (SEQ ID NO: 4428) | 1622 | 1627 |

This segment can be found in both coding and non-coding regions of transcript(s) as follows. The segment can be found in a non-coding region of transcript(s) that are related to the following protein(s): Z43749_PEA_1_P21. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26, Z43749_PEA_1_P14 and Z43749_PEA_1_P16, since it is in the coding region for the corresponding transcript.

Segment cluster Z43749_PEA_1_node_13 (SEQ ID NO:6868) according to the present invention can be found in the following transcript(s): Z43749_PEA_1_T18 (SEQ ID NO:4426). Table 6569 below describes the starting and ending position of this segment on each transcript.

TABLE 6569

Segment location on transcripts

| Transcript name | Segment starting position | Segment ending position |
|---|---|---|
| Z43749_PEA_1_T18 (SEQ ID NO: 4426) | 1628 | 1640 |

This segment can be found in the following protein(s): Z43749_PEA_1_P26.

Segment cluster Z43749_PEA_1_node_15 (SEQ ID NO:6869) according to the present invention is supported by 105 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6570 below describes the starting and ending position of this segment on each transcript.

TABLE 6570

Segment location on transcripts

| Transcript name | Segment starting position | Segment ending position |
|---|---|---|
| Z43749_PEA_1_T1 (SEQ ID NO: 4417) | 1628 | 1714 |
| Z43749_PEA_1_T3 (SEQ ID NO: 4418) | 1628 | 1714 |
| Z43749_PEA_1_T4 (SEQ ID NO: 4419) | 1628 | 1714 |
| Z43749_PEA_1_T5 (SEQ ID NO: 4420) | 1628 | 1714 |
| Z43749_PEA_1_T6 (SEQ ID NO: 4421) | 1628 | 1714 |
| Z43749_PEA_1_T8 (SEQ ID NO: 4422) | 1628 | 1714 |
| Z43749_PEA_1_T12 (SEQ ID NO: 4423) | 1628 | 1714 |
| Z43749_PEA_1_T16 (SEQ ID NO: 4424) | 707 | 793 |
| Z43749_PEA_1_T17 (SEQ ID NO: 4425) | 1628 | 1714 |
| Z43749_PEA_1_T18 (SEQ ID NO: 4426) | 1855 | 1941 |
| Z43749_PEA_1_T22 (SEQ ID NO: 4427) | 1628 | 1714 |
| Z43749_PEA_1_T24 (SEQ ID NO: 4428) | 1628 | 1714 |

This segment can be found in both coding and non-coding regions of transcript(s) as follows. The segment can be found in a non-coding region of transcript(s) that are related to the following protein(s): Z43749_PEA_1_P21 and Z43749_PEA_1_P26. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_20 (SEQ ID NO:6870) according to the present invention is supported by 79 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6571 below describes the starting and ending position of this segment on each transcript.

TABLE 6571

Segment location on transcripts

| Transcript name | Segment starting position | Segment ending position |
|---|---|---|
| Z43749_PEA_1_T1 (SEQ ID NO: 4417) | 2028 | 2068 |
| Z43749_PEA_1_T3 (SEQ ID NO: 4418) | 2028 | 2068 |
| Z43749_PEA_1_T4 (SEQ ID NO: 4419) | 2028 | 2068 |
| Z43749_PEA_1_T5 (SEQ ID NO: 4420) | 2028 | 2068 |
| Z43749_PEA_1_T6 (SEQ ID NO: 4421) | 2028 | 2068 |
| Z43749_PEA_1_T8 (SEQ ID NO: 4422) | 2028 | 2068 |
| Z43749_PEA_1_T12 (SEQ ID NO: 4423) | 2028 | 2068 |

TABLE 6571-continued

Segment location on transcripts

| Transcript name | Segment starting position | Segment ending position |
|---|---|---|
| Z43749_PEA_1_T16 (SEQ ID NO: 4424) | 1107 | 1147 |
| Z43749_PEA_1_T17 (SEQ ID NO: 4425) | 2028 | 2068 |
| Z43749_PEA_1_T18 (SEQ ID NO: 4426) | 2255 | 2295 |
| Z43749_PEA_1_T22 (SEQ ID NO: 4427) | 2028 | 2068 |
| Z43749_PEA_1_T24 (SEQ ID NO: 4428) | 2028 | 2068 |

This segment can be found in both coding and non-coding regions of transcript(s) as follows. The segment can be found in a non-coding region of transcript(s) that are related to the following protein(s): Z43749_PEA_1_P21 and Z43749_PEA_1_P26. This segment can also be found in the following protein(s): Z43749_PEA_1_P2, Z43749_PEA_1_P22, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_22 (SEQ ID NO:6871) according to the present invention can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6572 below describes the starting and ending position of this segment on each transcript.

TABLE 6572

Segment location on transcripts

| Transcript name | Segment starting position | Segment ending position |
|---|---|---|
| Z43749_PEA_1_T1 (SEQ ID NO: 4417) | 2069 | 2092 |
| Z43749_PEA_1_T3 (SEQ ID NO: 4418) | 2202 | 2225 |
| Z43749_PEA_1_T4 (SEQ ID NO: 4419) | 2069 | 2092 |
| Z43749_PEA_1_T5 (SEQ ID NO: 4420) | 2069 | 2092 |
| Z43749_PEA_1_T6 (SEQ ID NO: 4421) | 2069 | 2092 |
| Z43749_PEA_1_T8 (SEQ ID NO: 4422) | 2069 | 2092 |
| Z43749_PEA_1_T12 (SEQ ID NO: 4423) | 2069 | 2092 |
| Z43749_PEA_1_T16 (SEQ ID NO: 4424) | 1148 | 1171 |
| Z43749_PEA_1_T17 (SEQ ID NO: 4425) | 2069 | 2092 |
| Z43749_PEA_1_T18 (SEQ ID NO: 4426) | 2296 | 2319 |
| Z43749_PEA_1_T22 (SEQ ID NO: 4427) | 2069 | 2092 |
| Z43749_PEA_1_T24 (SEQ ID NO: 4428) | 2069 | 2092 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_23 (SEQ ID NO:6872) according to the present invention is supported by 83 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6573 below describes the starting and ending position of this segment on each transcript.

TABLE 6573

Segment location on transcripts

| Transcript name | Segment starting position | Segment ending position |
|---|---|---|
| Z43749_PEA_1_T1 (SEQ ID NO: 4417) | 2093 | 2176 |
| Z43749_PEA_1_T3 (SEQ ID NO: 4418) | 2226 | 2309 |
| Z43749_PEA_1_T4 (SEQ ID NO: 4419) | 2093 | 2176 |
| Z43749_PEA_1_T5 (SEQ ID NO: 4420) | 2093 | 2176 |
| Z43749_PEA_1_T6 (SEQ ID NO: 4421) | 2093 | 2176 |
| Z43749_PEA_1_T8 (SEQ ID NO: 4422) | 2093 | 2176 |
| Z43749_PEA_1_T12 (SEQ ID NO: 4423) | 2093 | 2176 |
| Z43749_PEA_1_T16 (SEQ ID NO: 4424) | 1172 | 1255 |
| Z43749_PEA_1_T17 (SEQ ID NO: 4425) | 2093 | 2176 |
| Z43749_PEA_1_T18 (SEQ ID NO: 4426) | 2320 | 2403 |
| Z43749_PEA_1_T22 (SEQ ID NO: 4427) | 2093 | 2176 |
| Z43749_PEA_1_T24 (SEQ ID NO: 4428) | 2093 | 2176 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_24 (SEQ ID NO:6873) according to the present invention is supported by 78 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6574 below describes the starting and ending position of this segment on each transcript.

TABLE 6574

Segment location on transcripts

| Transcript name | Segment starting position | Segment ending position |
|---|---|---|
| Z43749_PEA_1_T1 (SEQ ID NO: 4417) | 2177 | 2209 |
| Z43749_PEA_1_T3 (SEQ ID NO: 4418) | 2310 | 2342 |
| Z43749_PEA_1_T4 (SEQ ID NO: 4419) | 2177 | 2209 |
| Z43749_PEA_1_T5 (SEQ ID NO: 4420) | 2177 | 2209 |
| Z43749_PEA_1_T6 (SEQ ID NO: 4421) | 2177 | 2209 |
| Z43749_PEA_1_T8 (SEQ ID NO: 4422) | 2177 | 2209 |
| Z43749_PEA_1_T12 (SEQ ID NO: 4423) | 2177 | 2209 |
| Z43749_PEA_1_T16 (SEQ ID NO: 4424) | 1256 | 1288 |
| Z43749_PEA_1_T17 (SEQ ID NO: 4425) | 2177 | 2209 |
| Z43749_PEA_1_T18 (SEQ ID NO: 4426) | 2404 | 2436 |
| Z43749_PEA_1_T22 (SEQ ID NO: 4427) | 2177 | 2209 |
| Z43749_PEA_1_T24 (SEQ ID NO: 4428) | 2177 | 2209 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_25 (SEQ ID NO:6874) according to the present invention can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426) and Z43749_PEA_1_T22 (SEQ ID NO:4427). Table 6575 below describes the starting and ending position of this segment on each transcript.

TABLE 6575

Segment location on transcripts

| Transcript name | Segment starting position | Segment ending position |
|---|---|---|
| Z43749_PEA_1_T1 (SEQ ID NO: 4417) | 2210 | 2222 |
| Z43749_PEA_1_T3 (SEQ ID NO: 4418) | 2343 | 2355 |
| Z43749_PEA_1_T4 (SEQ ID NO: 4419) | 2210 | 2222 |
| Z43749_PEA_1_T5 (SEQ ID NO: 4420) | 2210 | 2222 |
| Z43749_PEA_1_T6 (SEQ ID NO: 4421) | 2210 | 2222 |
| Z43749_PEA_1_T8 (SEQ ID NO: 4422) | 2210 | 2222 |
| Z43749_PEA_1_T12 (SEQ ID NO: 4423) | 2210 | 2222 |
| Z43749_PEA_1_T16 (SEQ ID NO: 4424) | 1289 | 1301 |
| Z43749_PEA_1_T17 (SEQ ID NO: 4425) | 2210 | 2222 |
| Z43749_PEA_1_T18 (SEQ ID NO: 4426) | 2437 | 2449 |
| Z43749_PEA_1_T22 (SEQ ID NO: 4427) | 2210 | 2222 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6 and Z43749_PEA_1_P14, since it is in the coding region for the corresponding transcript.

Segment cluster Z43749_PEA_1_node_27 (SEQ ID NO:6875) according to the present invention is supported by 88 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426) and Z43749_PEA_1_T22 (SEQ ID NO:4427). Table 6576 below describes the starting and ending position of this segment on each transcript.

TABLE 6576

Segment location on transcripts

| Transcript name | Segment starting position | Segment ending position |
|---|---|---|
| Z43749_PEA_1_T1 (SEQ ID NO: 4417) | 2223 | 2307 |
| Z43749_PEA_1_T3 (SEQ ID NO: 4418) | 2356 | 2440 |
| Z43749_PEA_1_T4 (SEQ ID NO: 4419) | 2223 | 2307 |
| Z43749_PEA_1_T5 (SEQ ID NO: 4420) | 2223 | 2307 |
| Z43749_PEA_1_T6 (SEQ ID NO: 4421) | 2223 | 2307 |

TABLE 6576-continued

Segment location on transcripts

| Transcript name | Segment starting position | Segment ending position |
|---|---|---|
| Z43749_PEA_1_T8 (SEQ ID NO: 4422) | 2223 | 2307 |
| Z43749_PEA_1_T12 (SEQ ID NO: 4423) | 2223 | 2307 |
| Z43749_PEA_1_T16 (SEQ ID NO: 4424) | 1302 | 1386 |
| Z43749_PEA_1_T17 (SEQ ID NO: 4425) | 2223 | 2307 |
| Z43749_PEA_1_T18 (SEQ ID NO: 4426) | 2450 | 2534 |
| Z43749_PEA_1_T22 (SEQ ID NO: 4427) | 2223 | 2307 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6 and Z43749_PEA_1_P14, since it is in the coding region for the corresponding transcript.

Segment cluster Z43749_PEA_1_node_28 (SEQ ID NO:6876) according to the present invention is supported by 81 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T22 (SEQ ID NO:4427) and Z43749_PEA_1_T24 (SEQ ID NO:4428). Table 6577 below describes the starting and ending position of this segment on each transcript.

TABLE 6577

Segment location on transcripts

| Transcript name | Segment starting position | Segment ending position |
|---|---|---|
| Z43749_PEA_1_T1 (SEQ ID NO: 4417) | 2308 | 2358 |
| Z43749_PEA_1_T3 (SEQ ID NO: 4418) | 2441 | 2491 |
| Z43749_PEA_1_T4 (SEQ ID NO: 4419) | 2308 | 2358 |
| Z43749_PEA_1_T5 (SEQ ID NO: 4420) | 2308 | 2358 |
| Z43749_PEA_1_T6 (SEQ ID NO: 4421) | 2308 | 2358 |
| Z43749_PEA_1_T8 (SEQ ID NO: 4422) | 2308 | 2358 |
| Z43749_PEA_1_T12 (SEQ ID NO: 4423) | 2308 | 2358 |
| Z43749_PEA_1_T16 (SEQ ID NO: 4424) | 1387 | 1437 |
| Z43749_PEA_1_T17 (SEQ ID NO: 4425) | 2308 | 2358 |
| Z43749_PEA_1_T18 (SEQ ID NO: 4426) | 2535 | 2585 |

TABLE 6577-continued

Segment location on transcripts

| Transcript name | Segment starting position | Segment ending position |
|---|---|---|
| Z43749_PEA_1_T22 (SEQ ID NO: 4427) | 2308 | 2358 |
| Z43749_PEA_1_T24 (SEQ ID NO: 4428) | 2210 | 2260 |

This segment can be found in both coding and non-coding regions of transcript(s) as follows. The segment can be found in a non-coding region of transcript(s) that are related to the following protein(s): Z43749_PEA_1_P22, Z43749_PEA_1_P21 and Z43749_PEA_1_P26. This segment can also be found in the following protein(s): Z43749_PEA_1_P2, Z43749_PEA_1_P4, Z43749_PEA_1_P5, Z43749_PEA_1_P6, Z43749_PEA_1_P14 and Z43749_PEA_1_P16, since it is in the coding region for the corresponding transcript.

Segment cluster Z43749_PEA_1_node_33 (SEQ ID NO:6877) according to the present invention can be found in the following transcript(s): Z43749_PEA_1_T30 (SEQ ID NO:4429), Z43749_PEA_1_T31 (SEQ ID NO:4430) and Z43749_PEA_1_T32 (SEQ ID NO:4431). Table 6578 below describes the starting and ending position of this segment on each transcript.

TABLE 6578

Segment location on transcripts

| Transcript name | Segment starting position | Segment ending position |
|---|---|---|
| Z43749_PEA_1_T30 (SEQ ID NO: 4429) | 1421 | 1425 |
| Z43749_PEA_1_T31 (SEQ ID NO: 4430) | 1439 | 1443 |
| Z43749_PEA_1_T32 (SEQ ID NO: 4431) | 1421 | 1425 |

This segment can be found in the following protein(s): Z43749_PEA_1_P20.

Segment cluster Z43749_PEA_1_node_36 (SEQ ID NO:6878) according to the present invention is supported by 9 libraries. The number of libraries was determined as previously described. This segment can be found in the following transcript(s): Z43749_PEA_1_T4 (SEQ ID NO:4419), Z43749_PEA_1_T6 (SEQ ID NO:4421), Z43749_PEA_1_T30 (SEQ ID NO:4429), Z43749_PEA_1_T31 (SEQ ID NO:4430) and Z43749_PEA_1_T32 (SEQ ID NO:4431). Table 6579 below describes the starting and ending position of this segment on each transcript.

TABLE 6579

Segment location on transcripts

| Transcript name | Segment starting position | Segment ending position |
|---|---|---|
| Z43749_PEA_1_T4 (SEQ ID NO: 4419) | 2989 | 3038 |
| Z43749_PEA_1_T6 (SEQ ID NO: 4421) | 2528 | 2577 |
| Z43749_PEA_1_T30 (SEQ ID NO: 4429) | 2056 | 2105 |
| Z43749_PEA_1_T31 (SEQ ID NO: 4430) | 1613 | 1662 |

TABLE 6579-continued

Segment location on transcripts

| Transcript name | Segment starting position | Segment ending position |
|---|---|---|
| Z43749_PEA_1_T32 (SEQ ID NO: 4431) | 2056 | 2105 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 6580.

TABLE 6580

Oligonucleotides related to this segment

| Oligonucleotide name | Overexpressed in cancers | Chip reference |
|---|---|---|
| Z43749_0_0_71786 | lung malignant tumors | LUN |

This segment can be found in both coding and non-coding regions of transcript(s) as follows. The segment can be found in a non-coding region of transcript(s) that are related to the following protein(s): Z43749_PEA_1_P4. This segment can also be found in the following protein(s): Z43749_PEA_1_P6 and Z43749_PEA_1_P20, since it is in the coding region for the corresponding transcript.

Segment cluster Z43749_PEA_1_node_40 (SEQ ID NO:6879) according to the present invention is supported by 109 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6581 below describes the starting and ending position of this segment on each transcript.

TABLE 6581

Segment location on transcripts

| Transcript name | Segment starting position | Segment ending position |
|---|---|---|
| Z43749_PEA_1_T1 (SEQ ID NO: 4417) | 2688 | 2755 |
| Z43749_PEA_1_T3 (SEQ ID NO: 4418) | 2821 | 2888 |
| Z43749_PEA_1_T4 (SEQ ID NO: 4419) | 3199 | 3266 |
| Z43749_PEA_1_T5 (SEQ ID NO: 4420) | 2688 | 2755 |
| Z43749_PEA_1_T6 (SEQ ID NO: 4421) | 2738 | 2805 |
| Z43749_PEA_1_T8 (SEQ ID NO: 4422) | 2688 | 2755 |
| Z43749_PEA_1_T12 (SEQ ID NO: 4423) | 2688 | 2755 |

TABLE 6581-continued

Segment location on transcripts

| Transcript name | Segment starting position | Segment ending position |
|---|---|---|
| Z43749_PEA_1_T16 (SEQ ID NO: 4424) | 1767 | 1834 |
| Z43749_PEA_1_T17 (SEQ ID NO: 4425) | 2688 | 2755 |
| Z43749_PEA_1_T18 (SEQ ID NO: 4426) | 2915 | 2982 |
| Z43749_PEA_1_T30 (SEQ ID NO: 4429) | 2266 | 2333 |
| Z43749_PEA_1_T31 (SEQ ID NO: 4430) | 1823 | 1890 |
| Z43749_PEA_1_T32 (SEQ ID NO: 4431) | 2266 | 2333 |

This segment can be found in both coding and non-coding regions of transcript(s) as follows. The segment can be found in a non-coding region of transcript(s) that are related to the following protein(s): Z43749_PEA_1_P22, Z43749_PEA_1_P4, Z43749_PEA_1_P6, Z43749_PEA_1_P26 and Z43749_PEA_1_P20. This segment can also be found in the following protein(s): Z43749_PEA_1_P2, Z43749_PEA_1_P5 and Z43749_PEA_1_P21, since it is in the coding region for the corresponding transcript.

Segment cluster Z43749_PEA_1_node_41 (SEQ ID NO:6880) according to the present invention is supported by 16 libraries. The number of libraries was determined as previously described. This segment can be found in the following transcript(s): Z43749_PEA_1_T1 (SEQ ID NO:4417), Z43749_PEA_1_T4 (SEQ ID NO:4419), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T17 (SEQ ID NO:4425), Z43749_PEA_1_T30 (SEQ ID NO:4429), Z43749_PEA_1_T31 (SEQ ID NO:4430) and Z43749_PEA_1_T32 (SEQ ID NO:4431). Table 6582 below describes the starting and ending position of this segment on each transcript.

TABLE 6582

Segment location on transcripts

| Transcript name | Segment starting position | Segment ending position |
|---|---|---|
| Z43749_PEA_1_T1 (SEQ ID NO: 4417) | 2756 | 2797 |
| Z43749_PEA_1_T4 (SEQ ID NO: 4419) | 3267 | 3308 |
| Z43749_PEA_1_T6 (SEQ ID NO: 4421) | 2806 | 2847 |
| Z43749_PEA_1_T8 (SEQ ID NO: 4422) | 2756 | 2797 |
| Z43749_PEA_1_T12 (SEQ ID NO: 4423) | 2756 | 2797 |
| Z43749_PEA_1_T17 (SEQ ID NO: 4425) | 2756 | 2797 |
| Z43749_PEA_1_T30 (SEQ ID NO: 4429) | 2334 | 2375 |
| Z43749_PEA_1_T31 (SEQ ID NO: 4430) | 1891 | 1932 |
| Z43749_PEA_1_T32 (SEQ ID NO: 4431) | 2334 | 2375 |

This segment can be found in both coding and non-coding regions of transcript(s) as follows. The segment can be found in a non-coding region of transcript(s) that are related to the following protein(s): Z43749_PEA_1_P4, Z43749_PEA_

1_P6 and Z43749_PEA_1_P20. This segment can also be found in the following protein(s): Z43749_PEA_1_P2, since it is in the coding region for the corresponding transcript.

Segment cluster Z43749_PEA_1_node_43 (SEQ ID NO:6881) according to the present invention is supported by 41 libraries. The number of libraries was determined as previously described. This segment can be found in the following transcript(s): Z43749_PEA_1_T1 (SEQ ID NO:4417), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T17 (SEQ ID NO:4425), Z43749_PEA_1_T30 (SEQ ID NO:4429), Z43749_PEA_1_T31 (SEQ ID NO:4430) and Z43749_PEA_1_T32 (SEQ ID NO:4431). Table 6583 below describes the starting and ending position of this segment on each transcript.

TABLE 6583

Segment location on transcripts

| Transcript name | Segment starting position | Segment ending position |
|---|---|---|
| Z43749_PEA_1_T1 (SEQ ID NO: 4417) | 3266 | 3367 |
| Z43749_PEA_1_T4 (SEQ ID NO: 4419) | 3777 | 3878 |
| Z43749_PEA_1_T5 (SEQ ID NO: 4420) | 2756 | 2857 |
| Z43749_PEA_1_T6 (SEQ ID NO: 4421) | 3316 | 3417 |
| Z43749_PEA_1_T8 (SEQ ID NO: 4422) | 3266 | 3367 |
| Z43749_PEA_1_T12 (SEQ ID NO: 4423) | 3266 | 3367 |
| Z43749_PEA_1_T17 (SEQ ID NO: 4425) | 3266 | 3367 |
| Z43749_PEA_1_T30 (SEQ ID NO: 4429) | 2844 | 2945 |
| Z43749_PEA_1_T31 (SEQ ID NO: 4430) | 2401 | 2502 |
| Z43749_PEA_1_T32 (SEQ ID NO: 4431) | 2844 | 2945 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 6584.

TABLE 6584

Oligonucleotides related to this segment

| Oligonucleotide name | Overexpressed in cancers | Chip reference |
|---|---|---|
| Z43749_0_0_71790 | lung malignant tumors | LUN |

This segment can be found in both coding and non-coding regions of transcript(s) as follows. The segment can be found in a non-coding region of transcript(s) that are related to the following protein(s): Z43749_PEA_1_P2, Z43749_PEA_1_P4, Z43749_PEA_1_P6 and Z43749_PEA_1_P20. This segment can also be found in the following protein(s): Z43749_PEA_1_P5, since it is in the coding region for the corresponding transcript.

Segment cluster Z43749_PEA_1_node_46 (SEQ ID NO:6882) according to the present invention is supported by 209 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6585 below describes the starting and ending position of this segment on each transcript.

TABLE 6585

Segment location on transcripts

| Transcript name | Segment starting position | Segment ending position |
|---|---|---|
| Z43749_PEA_1_T1 (SEQ ID NO: 4417) | 3504 | 3617 |
| Z43749_PEA_1_T3 (SEQ ID NO: 4418) | 2889 | 3002 |
| Z43749_PEA_1_T4 (SEQ ID NO: 4419) | 4015 | 4128 |
| Z43749_PEA_1_T5 (SEQ ID NO: 4420) | 2994 | 3107 |
| Z43749_PEA_1_T6 (SEQ ID NO: 4421) | 3554 | 3667 |
| Z43749_PEA_1_T8 (SEQ ID NO: 4422) | 3504 | 3617 |
| Z43749_PEA_1_T12 (SEQ ID NO: 4423) | 3504 | 3617 |
| Z43749_PEA_1_T16 (SEQ ID NO: 4424) | 1835 | 1948 |
| Z43749_PEA_1_T17 (SEQ ID NO: 4425) | 3504 | 3617 |
| Z43749_PEA_1_T18 (SEQ ID NO: 4426) | 2983 | 3096 |
| Z43749_PEA_1_T30 (SEQ ID NO: 4429) | 3082 | 3195 |
| Z43749_PEA_1_T31 (SEQ ID NO: 4430) | 2639 | 2752 |
| Z43749_PEA_1_T32 (SEQ ID NO: 4431) | 3082 | 3195 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

Segment cluster Z43749_PEA_1_node_47 (SEQ ID NO:6883) according to the present invention is supported by 203 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6586 below describes the starting and ending position of this segment on each transcript.

TABLE 6586

Segment location on transcripts

| Transcript name | Segment starting position | Segment ending position |
|---|---|---|
| Z43749_PEA_1_T1 (SEQ ID NO: 4417) | 3618 | 3674 |
| Z43749_PEA_1_T3 (SEQ ID NO: 4418) | 3003 | 3059 |
| Z43749_PEA_1_T4 (SEQ ID NO: 4419) | 4129 | 4185 |
| Z43749_PEA_1_T5 (SEQ ID NO: 4420) | 3108 | 3164 |
| Z43749_PEA_1_T6 (SEQ ID NO: 4421) | 3668 | 3724 |
| Z43749_PEA_1_T8 (SEQ ID NO: 4422) | 3618 | 3674 |
| Z43749_PEA_1_T12 (SEQ ID NO: 4423) | 3618 | 3674 |
| Z43749_PEA_1_T16 (SEQ ID NO: 4424) | 1949 | 2005 |
| Z43749_PEA_1_T18 (SEQ ID NO: 4426) | 3097 | 3153 |
| Z43749_PEA_1_T30 (SEQ ID NO: 4429) | 3196 | 3252 |
| Z43749_PEA_1_T31 (SEQ ID NO: 4430) | 2753 | 2809 |
| Z43749_PEA_1_T32 (SEQ ID NO: 4431) | 3196 | 3252 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

Segment cluster Z43749_PEA_1_node_48 (SEQ ID NO:6884) according to the present invention is supported by 194 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6587 below describes the starting and ending position of this segment on each transcript.

TABLE 6587

Segment location on transcripts

| Transcript name | Segment starting position | Segment ending position |
|---|---|---|
| Z43749_PEA_1_T1 (SEQ ID NO: 4417) | 3675 | 3716 |
| Z43749_PEA_1_T3 (SEQ ID NO: 4418) | 3060 | 3101 |
| Z43749_PEA_1_T4 (SEQ ID NO: 4419) | 4186 | 4227 |
| Z43749_PEA_1_T5 (SEQ ID NO: 4420) | 3165 | 3206 |

TABLE 6587-continued

Segment location on transcripts

| Transcript name | Segment starting position | Segment ending position |
|---|---|---|
| Z43749_PEA_1_T6 (SEQ ID NO: 4421) | 3725 | 3766 |
| Z43749_PEA_1_T8 (SEQ ID NO: 4422) | 3675 | 3716 |
| Z43749_PEA_1_T12 (SEQ ID NO: 4423) | 3675 | 3716 |
| Z43749_PEA_1_T16 (SEQ ID NO: 4424) | 2006 | 2047 |
| Z43749_PEA_1_T18 (SEQ ID NO: 4426) | 3154 | 3195 |
| Z43749_PEA_1_T30 (SEQ ID NO: 4429) | 3253 | 3294 |
| Z43749_PEA_1_T31 (SEQ ID NO: 4430) | 2810 | 2851 |
| Z43749_PEA_1_T32 (SEQ ID NO: 4431) | 3253 | 3294 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

Segment cluster Z43749_PEA_1_node_49 (SEQ ID NO:6885) according to the present invention is supported by 24 libraries. The number of libraries was determined as previously described. This segment can be found in the following transcript(s): Z43749_PEA_1_T8 (SEQ ID NO:4422), Z43749_PEA_1_T12 (SEQ ID NO:4423) and Z43749_PEA_1_T32 (SEQ ID NO:4431). Table 6588 below describes the starting and ending position of this segment on each transcript.

TABLE 6588

Segment location on transcripts

| Transcript name | Segment starting position | Segment ending position |
|---|---|---|
| Z43749_PEA_1_T8 (SEQ ID NO: 4422) | 3717 | 3804 |
| Z43749_PEA_1_T12 (SEQ ID NO: 4423) | 3717 | 3804 |
| Z43749_PEA_1_T32 (SEQ ID NO: 4431) | 3295 | 3382 |

This segment can be found in a non-coding region of transcript(s) that are related to the following protein(s): Z43749_PEA_1_P2.

Segment cluster Z43749_PEA_1_node_50 (SEQ ID NO:6886) according to the present invention can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6589 below describes the starting and ending position of this segment on each transcript.

TABLE 6589

Segment location on transcripts

| Transcript name | Segment starting position | Segment ending position |
| --- | --- | --- |
| Z43749_PEA_1_T1 (SEQ ID NO: 4417) | 3717 | 3737 |
| Z43749_PEA_1_T3 (SEQ ID NO: 4418) | 3102 | 3122 |
| Z43749_PEA_1_T4 (SEQ ID NO: 4419) | 4228 | 4248 |
| Z43749_PEA_1_T5 (SEQ ID NO: 4420) | 3207 | 3227 |
| Z43749_PEA_1_T6 (SEQ ID NO: 4421) | 3767 | 3787 |
| Z43749_PEA_1_T8 (SEQ ID NO: 4422) | 3805 | 3825 |
| Z43749_PEA_1_T12 (SEQ ID NO: 4423) | 3805 | 3825 |
| Z43749_PEA_1_T16 (SEQ ID NO: 4424) | 2048 | 2068 |
| Z43749_PEA_1_T18 (SEQ ID NO: 4426) | 3196 | 3216 |
| Z43749_PEA_1_T30 (SEQ ID NO: 4429) | 3295 | 3315 |
| Z43749_PEA_1_T31 (SEQ ID NO: 4430) | 2852 | 2872 |
| Z43749_PEA_1_T32 (SEQ ID NO: 4431) | 3383 | 3403 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

Segment cluster Z43749_PEA_1_node_51 (SEQ ID NO:6887) according to the present invention is supported by 176 libraries. The number of libraries was determined as previously described. This segment can be found in the following transcript(s): Z43749_PEA_1_T1 (SEQ ID NO:4417), Z43749_PEA_1_T3 (SEQ ID NO:4418), Z43749_PEA_1_T4 (SEQ ID NO:4419), Z43749_PEA_1_T5 (SEQ ID NO:4420), Z43749_PEA_1_T6 (SEQ ID NO:4421), Z43749_PEA_1_T8 (SEQ ID NO:4422), Z43749_PEA_1_T12 (SEQ ID NO:4423), Z43749_PEA_1_T16 (SEQ ID NO:4424), Z43749_PEA_1_T17 (SEQ ID NO:4425), Z43749_PEA_1_T18 (SEQ ID NO:4426), Z43749_PEA_1_T30 (SEQ ID NO:4429), Z43749_PEA_1_T31 (SEQ ID NO:4430) and Z43749_PEA_1_T32 (SEQ ID NO:4431). Table 6590 below describes the starting and ending position of this segment on each transcript.

TABLE 6590

Segment location on transcripts

| Transcript name | Segment starting position | Segment ending position |
| --- | --- | --- |
| Z43749_PEA_1_T1 (SEQ ID NO: 4417) | 3738 | 3776 |
| Z43749_PEA_1_T3 (SEQ ID NO: 4418) | 3123 | 3161 |
| Z43749_PEA_1_T4 (SEQ ID NO: 4419) | 4249 | 4287 |
| Z43749_PEA_1_T5 (SEQ ID NO: 4420) | 3228 | 3266 |
| Z43749_PEA_1_T6 (SEQ ID NO: 4421) | 3788 | 3826 |
| Z43749_PEA_1_T8 (SEQ ID NO: 4422) | 3826 | 3864 |
| Z43749_PEA_1_T12 (SEQ ID NO: 4423) | 3826 | 3864 |
| Z43749_PEA_1_T16 (SEQ ID NO: 4424) | 2069 | 2107 |
| Z43749_PEA_1_T17 (SEQ ID NO: 4425) | 3618 | 3656 |
| Z43749_PEA_1_T18 (SEQ ID NO: 4426) | 3217 | 3255 |
| Z43749_PEA_1_T30 (SEQ ID NO: 4429) | 3316 | 3354 |
| Z43749_PEA_1_T31 (SEQ ID NO: 4430) | 2873 | 2911 |
| Z43749_PEA_1_T32 (SEQ ID NO: 4431) | 3404 | 3442 |

This segment can be found in both coding and non-coding regions of transcript(s) as follows. The segment can be found in a non-coding region of transcript(s) that are related to the following protein(s): Z43749_PEA_1_P2, Z43749_PEA_1_P22, Z43749_PEA_1_P4, Z43749_PEA_1_P5, Z43749_PEA_1_P6, Z43749_PEA_1_P26 and Z43749_PEA_1_P20. This segment can also be found in the following protein(s): Z43749_PEA_1_P21, since it is in the coding region for the corresponding transcript.

Segment cluster Z43749_PEA_1_node_52 (SEQ ID NO:6888) according to the present invention is supported by 6 libraries. The number of libraries was determined as previously described. This segment can be found in the following transcript(s): Z43749_PEA_1_T12 (SEQ ID NO:4423). Table 6591 below describes the starting and ending position of this segment on each transcript.

TABLE 6591

Segment location on transcripts

| Transcript name | Segment starting position | Segment ending position |
| --- | --- | --- |
| Z43749_PEA_1_T12 (SEQ ID NO: 4423) | 3865 | 3952 |

This segment can be found in a non-coding region of transcript(s) that are related to the following protein(s): Z43749_PEA_1_P2.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall

SEQUENCE LISTING (6908 sequences)

SEQ ID NO: 1 - DNA, 4552 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 2 - DNA, 4683 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctcaggtactttgggttcataccacaagggagggttctcatgcacatgtgcctaataataacaactatcacaaaagactgcaaaaaccacaactttacacaaaggctatcgtaaccttcctcaa

SEQ ID NO: 3 - DNA, 4524 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 4 - DNA, 4494 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 5 - DNA, 4350 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 6 - DNA, 4439 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 7 - DNA, 4139 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 8 - DNA, 4428 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 9 - DNA, 3156 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccacacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 10 - DNA, 3553 bp, Homo sapiens
atttcttctgcagtgcctaacagctgtgaagcccatccagttaactttgtttctaacataatagtttccccttatttcttctcatggtacttgggttttcttttacatcctcgtgagcaaattgataatggttttagggtctacgattcttctcataccatcttccccatcattttggggtctgtttcgactgactaattttgtttccgggttttggcctcattttcctgcctctacatttttcacaagtttttcttggttgttggatattgtcaggtgtacacttttgaatgtctggattttgttgtctttctctgaggagttgggttgggcttggcaggcagttaaggtgcagatcatccttccgaggctttttatgctttgaagtggtgggtctagcatagcctttccgcctcccgccaccggcgtccttcccaaggcctctgctgcacacccgtgtgtcccgcaaggcccgcgagacccctgcactcctgctgctgcaagatgacaccttctcggccctgtgagctccgctcgttgctccctggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 11 - DNA, 3676 bp, Homo sapiens
aggaggaggaaccatggagccagtgtctgggggcgtggtggcgggactggacctctggggcctgtgttgggccttagctcggtaactggtgacccctttgccctctgagcctgcttttcatcctgttgtgaatatcagatgagatcatacacatggaaatgcttgtcaactaaaacagcacaaacacagtgtaatgaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttaggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 12 - DNA, 2321 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggtgggcagaacgggcgcagctgggttctgttagctgagattcctggaggctgctcgggaagcccgtggaacccagggctgtggctggcggagttccctgccatgcttcatcctggggccagtgcctccgtgccaagcaacccaaagggaggcagtcaggacttccaggcctccaggggagaaagccctgcatttgactaaggcaagggtcagggatcaaagctgaggaagcgggaagcagggtggcaggagctggtggctgctggtgagcgggtatggaca

SEQ ID NO: 13 - DNA, 2209 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgagtaatagatacattttaatgtgtctttaaaaaatactgaagaaattgcatttaaagttttaaacaattattgatggcattgatggtgtttttagttctttcctccaacagtgctttcaggtgtgacccgctgtcttctcgcccacgttgttttggggggtcactggaggctccctgaatgtcttacgttcgttcctgtgtgtgtgacaccccaatgctcgtaggctgcttgtaaggttttctctttagtgttactgtcgggaatttgattattatgtgctttgaggtggctttctttgcctttatcccgctgagggtttcttaagcttctttgatctgtgggttggtttttttcagcaaatttggaaaacgttggccattatttcttcagctatcttttcctctttccactttatttcctaggactctaatcacatctatttcaggcctcttgacgttgtctcacaggacaccgaagctctgttcttttttttatttcagccttttttctttttcttatcttttttcttttctttctttctttttttttgttttttgttttttgagacggagtctcgctctgtcacccagggtggaatgcagtggcgcgatctcagcgcactgtaacctccacctaccgagttcaagcaattctcctgc

SEQ ID NO: 14 - DNA, 2095 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattgtgctttcaggtgtgacccgctgtcttctcgcccacgttgttttggggggtcactggaggctccctgaatgtcttacgttcgttcctgtgtgtgtgacaccccaatgctcgtaggctgcttgtaaggttttctctttagtgttactgtcgggaatttgattattatgtgctttgaggtggctttctttgcctttatcccgctgagggtttcttaagcttctttgatctgtgggttggtttttttcagcaaatttggaaaacgttggccattatttcttcagctatcttttcctctttccactttatttcctaggactctaatcacatctatttcaggcctcttgacgttgtctcacaggacaccgaagctctgttcttttttttatttcagccttttttctttttcttatcttttttcttttctttctttctttttttttgttttttgttttttgagacggagtctcgctctgtcacccagggtggaatgcagtggcgcgatctcagcgcactgtaacctccacctaccgagttcaagcaattctcctgc

SEQ ID NO: 15 - DNA, 1074 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattga

SEQ ID NO: 16 - DNA, 1604 bp, Homo sapiens
aggaggaggaaccatggagccagtgtctgggggcgtggtggcgggactggacctctggggcctgtgttgggccttagctcggtaactggtgacccctttgccctctgagcctgcttttcatcctgttgtgaatatcagatgagatcatacacatggaaatgcttgtcaactaaaacagcacaaacacagtgtaatgaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttaggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgaggtaagacacgaaggtggtaataaattggtctcaaattcctaggcttgctgtcccagacagtgacatacctttttcttgccttgctccaggttttagtgaagtaaatagtatttggaaagtttgtttgttttttttttcattgcaaagagaaaatgcaatagacatgagcatagaggaaaattaaaggtattacaaggaaatactgcgtgtaattctctgataatcaatttgaaaacctaatggttttctaaaatttgcaagttattggccaggtgtggtggctcacgcctgtaatcccagcactttgggaggccgaggcaggcagactgcctgagctcaggagtttgagatcaacctgggtaacatggcaaaaccccatctctacaaaaaatacaaaaataagctaggtgtggtggcgtgcactgtagtcccagctatttagggggctgaggtgggaggatcacttgagctcaggaggttgaggctgcagtgagctgagattgccccgttgcactccagcctgggggacagagtgagaccccgtctgtaaaaattaaaataaataaaataaataaaataaaatttatctaaattgacccagaacacatgaagtaagccatagctggagctcagaaatgatta

SEQ ID NO: 17 - DNA, 800 bp, Homo sapiens
cctctgcctttcgggttcaagcgattctcctgcctcagcctcccgagtagctgggattacaggcacccgccaccacacctggctgatttttgtatttttagtagagatggggttttaccatgttggccaggctggtctcaaactcctgacctcaggtgatccacctgcctaggcctcccaaagtactgggattacaggcgtgagccaccgtgcccagccaaaaaccccttacttttgcagacacaagtaataggtaaataacgagatctttgctgattctgttttttcacattttgccccagttggggctgaagaagaccctgttaaaagcacccggctctaccagcaatctcgcaaggaagtcctcctcggggcctgtttggagcggggcatccagtgcgtgcacatccccagcagtgggcaaaggtgaggcagccggcatcatgcttggacccacatctggccaggtgaggcctggagtgctgctcaggccttggagactgtttctgcagaaccacttaggcttggcaggacgtcccggagggcgtgctgtgtgcggtggaccaggctgtggactgagttgctgtacctgccctcagtgcctctgtcccatgaggagggcacactcagatgggtggcttcagtctacggggtacacatggccagaaagcatgtatgataccccgtgcctgagaacatggacactggaatcaccctcatgtccatgtcatgagacaccagttttaaaataggactattccagataatgtagggcatatggccccataactcctgggtgc

SEQ ID NO: 18 - DNA, 197 bp, Artificial Sequence
  Synthetic oligonucleotide
cctctgcctttcgggttcaagcgattctcctgcctcagcctcccgagtagctgggattacaggcacccgccaccacacctggctgatttttgtatttttagtagagatggggttttaccatgttggccaggctggtctcaaactcctgacctcaggtgatccacctgcctaggcctcccaaagtactgggattacag

SEQ ID NO: 19 - DNA, 207 bp, Artificial Sequence
  Synthetic oligonucleotide
tgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcag

SEQ ID NO: 20 - DNA, 418 bp, Artificial Sequence
  Synthetic oligonucleotide
cagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaag

SEQ ID NO: 21 - DNA, 165 bp, Artificial Sequence
  Synthetic oligonucleotide
cccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaag

SEQ ID NO: 22 - DNA, 124 bp, Artificial Sequence
  Synthetic oligonucleotide
ttggggctgaagaagaccctgttaaaagcacccggctctaccagcaatctcgcaaggaagtcctcctcggggcctgtttggagcggggcatccagtgcgtgcacatccccagcagtgggcaaag

SEQ ID NO: 23 - DNA, 374 bp, Artificial Sequence
  Synthetic oligonucleotide
gtgaggcagccggcatcatgcttggacccacatctggccaggtgaggcctggagtgctgctcaggccttggagactgtttctgcagaaccacttaggcttggcaggacgtcccggagggcgtgctgtgtgcggtggaccaggctgtggactgagttgctgtacctgccctcagtgcctctgtcccatgaggagggcacactcagatgggtggcttcagtctacggggtacacatggccagaaagcatgtatgataccccgtgcctgagaacatggacactggaatcaccctcatgtccatgtcatgagacaccagttttaaaataggactattccagataatgtagggcatatggccccataactcctgggtgc

SEQ ID NO: 24 - DNA, 146 bp, Artificial Sequence
  Synthetic oligonucleotide
ctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgg

SEQ ID NO: 25 - DNA, 122 bp, Artificial Sequence
  Synthetic oligonucleotide
gtcagaatcttctcaattgaataagactagaagtatcagacggcgagattcctgtctaaattccaagacaaaggttatgcctactcctacaaatcaatttaaaattcctaagttttctattg

SEQ ID NO: 26 - DNA, 476 bp, Artificial Sequence
  Synthetic oligonucleotide
tgctttcaggtgtgacccgctgtcttctcgcccacgttgttttggggggtcactggaggctccctgaatgtcttacgttcgttcctgtgtgtgtgacaccccaatgctcgtaggctgcttgtaaggttttctctttagtgttactgtcgggaatttgattattatgtgctttgaggtggctttctttgcctttatcccgctgagggtttcttaagcttctttgatctgtgggttggtttttttcagcaaatttggaaaacgttggccattatttcttcagctatcttttcctctttccactttatttcctaggactctaatcacatctatttcaggcctcttgacgttgtctcacaggacaccgaagctctgttcttttttttatttcagccttttttctttttcttatcttttttcttttctttctttctttttttttgttttttgttttttgagacggagtctcgctctgtcac

SEQ ID NO: 27 - DNA, 547 bp, Artificial Sequence
  Synthetic oligonucleotide
atttcttctgcagtgcctaacagctgtgaagcccatccagttaactttgtttctaacataatagtttccccttatttcttctcatggtacttgggttttcttttacatcctcgtgagcaaattgataatggttttagggtctacgattcttctcataccatcttccccatcattttggggtctgtttcgactgactaattttgtttccgggttttggcctcattttcctgcctctacatttttcacaagtttttcttggttgttggatattgtcaggtgtacacttttgaatgtctggattttgttgtctttctctgaggagttgggttgggcttggcaggcagttaaggtgcagatcatccttccgaggctttttatgctttgaagtggtgggtctagcatagcctttccgcctcccgccaccggcgtccttcccaaggcctctgctgcacacccgtgtgtcccgcaaggcccgcgagacccctgcactcctgctgctgcaagatgacaccttctcggccctgtgagctccgctcgttgctccctg

SEQ ID NO: 28 - DNA, 670 bp, Artificial Sequence
  Synthetic oligonucleotide
aggaggaggaaccatggagccagtgtctgggggcgtggtggcgggactggacctctggggcctgtgttgggccttagctcggtaactggtgacccctttgccctctgagcctgcttttcatcctgttgtgaatatcagatgagatcatacacatggaaatgcttgtcaactaaaacagcacaaacacagtgtaatgaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttag

SEQ ID NO: 29 - DNA, 219 bp, Artificial Sequence
  Synthetic oligonucleotide
ggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgag

SEQ ID NO: 30 - DNA, 642 bp, Artificial Sequence
  Synthetic oligonucleotide
gtaagacacgaaggtggtaataaattggtctcaaattcctaggcttgctgtcccagacagtgacatacctttttcttgccttgctccaggttttagtgaagtaaatagtatttggaaagtttgtttgttttttttttcattgcaaagagaaaatgcaatagacatgagcatagaggaaaattaaaggtattacaaggaaatactgcgtgtaattctctgataatcaatttgaaaacctaatggttttctaaaatttgcaagttattggccaggtgtggtggctcacgcctgtaatcccagcactttgggaggccgaggcaggcagactgcctgagctcaggagtttgagatcaacctgggtaacatggcaaaaccccatctctacaaaaaatacaaaaataagctaggtgtggtggcgtgcactgtagtcccagctatttagggggctgaggtgggaggatcacttgagctcaggaggttgaggctgcagtgagctgagattgccccgttgcactccagcctgggggacagagtgagaccccgtctgtaaaaattaaaataaataaaataaataaaataaaatttatctaaattgacccagaacacatgaagtaagccatagctggagctcagaaatgatta

SEQ ID NO: 31 - DNA, 143 bp, Artificial Sequence
  Synthetic oligonucleotide
aactgaaccaacaagggagagcaacagaaagacagattccaggctggtggatgtgtcccctgacaggggttctcctccttcccgtgtgcctcaggcacttaacttttctccagaggaaagcgattctactttctccaaaagta

SEQ ID NO: 32 - DNA, 281 bp, Artificial Sequence
  Synthetic oligonucleotide
gtgggcagaacgggcgcagctgggttctgttagctgagattcctggaggctgctcgggaagcccgtggaacccagggctgtggctggcggagttccctgccatgcttcatcctggggccagtgcctccgtgccaagcaacccaaagggaggcagtcaggacttccaggcctccaggggagaaagccctgcatttgactaaggcaagggtcagggatcaaagctgaggaagcgggaagcagggtggcaggagctggtggctgctggtgagcgggtatggaca

SEQ ID NO: 33 - DNA, 138 bp, Artificial Sequence
  Synthetic oligonucleotide
cttcctctcatcgacttctgcgataccccagaagcacacgtggctgtaggatctgaaagcaggcctctgatcgacctcatgacaaacactccagacatgaataaaaatgtggccaaaccttcaccggtggtgggacag

SEQ ID NO: 34 - DNA, 203 bp, Artificial Sequence
  Synthetic oligonucleotide
ctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgag

SEQ ID NO: 35 - DNA, 195 bp, Artificial Sequence
  Synthetic oligonucleotide
gtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccac

SEQ ID NO: 36 - DNA, 148 bp, Artificial Sequence
  Synthetic oligonucleotide
tgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccag

SEQ ID NO: 37 - DNA, 1140 bp, Artificial Sequence
  Synthetic oligonucleotide
cacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccag

SEQ ID NO: 38 - DNA, 123 bp, Artificial Sequence
  Synthetic oligonucleotide
ctcctcctggcaccagtccccagggctctcctgttggtagttcctgcttttcttcttggaaattcctcgtggacctcgagatctttaccctaaaatagttctgttgaatttcaccctggcaat

SEQ ID NO: 39 - DNA, 249 bp, Artificial Sequence
  Synthetic oligonucleotide
ccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccag

SEQ ID NO: 40 - DNA, 300 bp, Artificial Sequence
  Synthetic oligonucleotide
acagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctcaggtactttgggttcataccacaagggagggttctcatgcacatgtgcctaataataacaactatcacaaaagactgcaaaaaccacaactttacacaaaggctatcgtaaccttcctcaa

SEQ ID NO: 41 - DNA, 93 bp, Artificial Sequence
  Synthetic oligonucleotide
cccttttcaaaccgaccaatcggcaacccgcgtctcccggcgccgcgtttaaatccgtgccggaggcgcgtcctgcatcgtctgccgctttgg

SEQ ID NO: 42 - DNA, 100 bp, Artificial Sequence
  Synthetic oligonucleotide
tgacttctgacagctctctccatggaaggaggcggcggccgcgatgagccttcagcctgccgggcaggggacgtgaacatggatgaccctaagaaggaag

SEQ ID NO: 43 - DNA, 58 bp, Artificial Sequence
  Synthetic oligonucleotide
acattcttcttttggccgatgaaaaatttgacttcgatctttcattgtcttcttcgag

SEQ ID NO: 44 - DNA, 105 bp, Artificial Sequence
  Synthetic oligonucleotide
gcgtgagccaccgtgcccagccaaaaaccccttacttttgcagacacaagtaataggtaaataacgagatctttgctgattctgttttttcacattttgccccag

SEQ ID NO: 45 - DNA, 89 bp, Artificial Sequence
  Synthetic oligonucleotide
gtcgatgtttctgagctggcagcggagcagctcacggcacccccctcagcatcccccacccaaccccagactccggaaggtggcggcca

SEQ ID NO: 46 - DNA, 24 bp, Artificial Sequence
  Synthetic oligonucleotide
gtggctgaactccagttgcgcttg

SEQ ID NO: 47 - DNA, 114 bp, Artificial Sequence
  Synthetic oligonucleotide
gtgagtaatagatacattttaatgtgtctttaaaaaatactgaagaaattgcatttaaagttttaaacaattattgatggcattgatggtgtttttagttctttcctccaacag

SEQ ID NO: 48 - DNA, 5 bp, Artificial Sequence
  Synthetic oligonucleotide
ccagg

SEQ ID NO: 49 - DNA, 68 bp, Artificial Sequence
  Synthetic oligonucleotide
gtggaatgcagtggcgcgatctcagcgcactgtaacctccacctaccgagttcaagcaattctcctgc

SEQ ID NO: 50 - DNA, 73 bp, Artificial Sequence
  Synthetic oligonucleotide
gtgactccccggacagctcaacaccaaagctttcgcgggcacagcggccgcagtcgtgcacgtcagttggcag

SEQ ID NO: 51 - DNA, 59 bp, Artificial Sequence
  Synthetic oligonucleotide
ctgccacagaagtagctcgggaggaagccaagccgggtggagatgcagcccctagtgag

SEQ ID NO: 52 - DNA, 72 bp, Artificial Sequence
  Synthetic oligonucleotide
gctcttcttgtagatatcaaactggaaccactcgcggtcactccagatgctgcaagccagcccctcattgac

SEQ ID NO: 53 - DNA, 28 bp, Artificial Sequence
  Synthetic oligonucleotide
gccctgtgacctccctcctgtcttgcag

SEQ ID NO: 54 - DNA, 47 bp, Artificial Sequence
  Synthetic oligonucleotide
gtaaattgatagcttatcttcacagatgccagacaatggacaactca

SEQ ID NO: 55 - DNA, 860 bp, Homo sapiens
atggatgcattcatttactcattcatccaacatgcatttgatgttggtaaccagttaatatctgaaagctgggggatataaactgaacatagagtcccatctccatcctcaggaaactcatgccctccggtgatggggggcaggacaaatagcagagagaccgccttattttacaagatgtcattgttctctgagaggctgaaaagattttctatcaccactagcctcctcctctccacggccatttacagaatgggcaaaccagcctcccagcggaagaccaagcttgctagcggtcaacgttgccggcagctctgcaagcgcttccagcgggcgtcgctctcctttcgggggtggtactttcattcggtcatcctgtgagtgttccacttcccgacggaggccgagcactcacaccgcggcggaggtacccgtcaccgcagaaccgggtggctggctctcctccagggagaaagcctgtcacttattcctcaacactgttgggaagttacctagaaaagtacagacagaagacctaggcttgcgttttagaatcgtggagtgttagcgctggccaaatcgttggacacaatgtaagcttgatcaggaaaatgagctccagggtctcacaggcggggcctggaatcttggcgcaatctgcgaccctcactgcctcctacagtcggggctgagcgttctttcaaacagccaaagtaatcacttaagtccagcaatgatctccttggagaaatcaaaagatcctccctaagagacggccttggagggcatcgcccctggggctgggcacagcacgtcttcccggccccggcgcgggaggagggtttggggacagcggccgc

SEQ ID NO: 56 - DNA, 860 bp, Artificial Sequence; identical to SEQ ID NO: 55
  Synthetic oligonucleotide

SEQ ID NO: 57 - DNA, 1833 bp, Homo sapiens
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttga

SEQ ID NO: 58 - DNA, 2157 bp, Homo sapiens
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctggtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatttccgggtctgatcttgtgtagctcaggctgggagggccctctcagagcccaccacacccagtggcatcaatccctccccttctctctagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttga

SEQ ID NO: 59 - DNA, 1908 bp, Homo sapiens
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctgtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttga

SEQ ID NO: 60 - DNA, 2095 bp, Homo sapiens
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctggtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatttccgggtctgatcttgtgtagctcaggctgggagggccctctcagagcccaccacacccagtggcatcaatccctccccttctctctagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttga

SEQ ID NO: 61 - DNA, 148 bp, Artificial Sequence
  Synthetic oligonucleotide
ggtctagtggacagagaagactcttggccaggcagatggcttctcggtggcagaacatggggacctccgtgcgccggagatctctccagcaccaggagcagctggaggacagcaaggagctgcagcctgtggtcagccatcaggagac

SEQ ID NO: 62 - DNA, 140 bp, Artificial Sequence
  Synthetic oligonucleotide
tcagccgcagacccctgggagaaggagcatcaccgcctctctgtccggatgggctcacatgcccacccattacggcgatcaaggcgggaggctgccttccggagcccctactcctcaacagagcccctctgctctcccag

SEQ ID NO: 63 - DNA, 249 bp, Artificial Sequence
  Synthetic oligonucleotide
gtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatttccgggtctgatcttgtgtagctcaggctgggagggccctctcagagcccaccacacccagtggcatcaatccctccccttctctctag

SEQ ID NO: 64 - DNA, 289 bp, Artificial Sequence
  Synthetic oligonucleotide
gtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaag

SEQ ID NO: 65 - DNA, 192 bp, Artificial Sequence
  Synthetic oligonucleotide
gaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgag

SEQ ID NO: 66 - DNA, 194 bp, Artificial Sequence
  Synthetic oligonucleotide
ctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgc

SEQ ID NO: 67 - DNA, 500 bp, Artificial Sequence
  Synthetic oligonucleotide
ctgttcaagagcaatttctgccctttgtaaattatttaagaaacctgctttgtcattttattagaaagaaaccagcatgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagc

SEQ ID NO: 68 - DNA, 74 bp, Artificial Sequence
  Synthetic oligonucleotide
cgcagagtttcaaatcggctgcggtgggcgaggagcagctgtgctgcggctgtgctcggccttagtggtgtcgg

SEQ ID NO: 69 - DNA, 100 bp, Artificial Sequence
  Synthetic oligonucleotide
ctctgtaggggccctggggtccctgtgcagacagttccaaaggaggctgcccctgagagccgtcaacctcaacctccgcgcagggccctcctggaaacgc

SEQ ID NO: 70 - DNA, 19 bp, Artificial Sequence
  Synthetic oligonucleotide
ctggaaaccccagagccag

SEQ ID NO: 71 - DNA, 39 bp, Artificial Sequence
  Synthetic oligonucleotide
gtcagcagggcctccaggctgcagctcgctcagctaaga

SEQ ID NO: 72 - DNA, 23 bp, Artificial Sequence
  Synthetic oligonucleotide
gtgctttgggtgccgtgtcccag

SEQ ID NO: 73 - DNA, 47 bp, Artificial Sequence
  Synthetic oligonucleotide
agaatccaggagtcctgccaaagtggcaccaagtggctggtggagac

SEQ ID NO: 74 - DNA, 36 bp, Artificial Sequence
  Synthetic oligonucleotide
ccaggtgaaggccaggaggcggaagagaggagcaca

SEQ ID NO: 75 - DNA, 34 bp, Artificial Sequence
  Synthetic oligonucleotide
gaagggcagtggatccccaactcacagcctgagc

SEQ ID NO: 76 - DNA, 39 bp, Artificial Sequence
  Synthetic oligonucleotide
cagaagagcacccggctgtctggagccgcccctgcccac

SEQ ID NO: 77 - DNA, 96 bp, Artificial Sequence
  Synthetic oligonucleotide
cgagtctgacagtgacctagagcctgtgggggcgggaattcagcatctccagaagctgtcccaagagctagatgaagccattatggcggaagagag

SEQ ID NO: 78 - DNA, 75 bp, Artificial Sequence
  Synthetic oligonucleotide
aactctccgtggctcgtctgtgccctgcctgcctatggaattgggaaaagcaacctgactgctatggagttcctg

SEQ ID NO: 79 - DNA, 45 bp, Artificial Sequence
  Synthetic oligonucleotide
tggtgacatcgtctctctcattcatgactgaggaagtgcctgcag

SEQ ID NO: 80 - DNA, 54 bp, Artificial Sequence
  Synthetic oligonucleotide
agtgtcttggggagaccttgcagagggggagaattgttccttctgctttcctag

SEQ ID NO: 81 - DNA, 119 bp, Artificial Sequence
  Synthetic oligonucleotide
gggactcttgagcttagaaactcatcgtacacttgaccttgagccttctatttgcctcatctataacatgaagtgctagcatcagatatttgagagctcttagctctgtacccgggtgc

SEQ ID NO: 82 - DNA, 14 bp, Artificial Sequence
  Synthetic oligonucleotide
caggaggggtagcc

SEQ ID NO: 83 - DNA, 2410 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcacccagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggt

SEQ ID NO: 84 - DNA, 2426 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgagattttatgtcatagaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcacccagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggt

SEQ ID NO: 85 - DNA, 2538 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaaagattttatgtcatagaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcacccagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggt

SEQ ID NO: 86 - DNA, 1779 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgagattttatgtcatagaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaagacctgtatttaattatttttgtgaagaatactcaatgtatactgactgcacctgggtttttagtcttaaccaaatcatataccagttttatgacctggcaaaaatgtttttctctctctctagaggtcactttcttcatctgttaaacgaggtaattaatttagatgatctttaaaatgtccactagatttcatacatctatcacatatgatttcatgtatatgtaatgaaaacaaattttatatatatacaaaatttattttcacttgcatttatgaaacaggagaaacaaaataaaattacatttatttattttaatttaatcttgaaagtaaattcatgttatcttctaaaaatgtttcagtttacaattcatcca

SEQ ID NO: 87 - DNA, 943 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctggtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaagacctgtatttaattatttttgtgaagaatactcaatgtatactgactgcacctgggtttttagtcttaaccaaatcatataccagttttatgacctggcaaaaatgtttttctctctctctagaggtcactttcttcatctgttaaacgaggtaattaatttagatgatctttaaaatgtccactagatttcatacatctatcacatatgatttcatgtatatgtaatgaaaacaaattttatatatatacaaaatttattttcacttgcatttatgaaacaggagaaacaaaataaaattacatttatttattttaatttaatcttgaaagtaaattcatgttatcttctaaaaatgtttcagtttacaattcatcca

SEQ ID NO: 88 - DNA, 1058 bp, Homo sapiens
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgaccctcattggattttcctggaagtacggagagttacatccagagaactctgaacattttggaaggaccccaatcctgcaaacaatgaatggcaataaatcctgggactggaaaggtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaagacctgtatttaattatttttgtgaagaatactcaatgtatactgactgcacctgggtttttagtcttaaccaaatcatataccagttttatgacctggcaaaaatgtttttctctctctctagaggtcactttcttcatctgttaaacgaggtaattaatttagatgatctttaaaatgtccactagatttcatacatctatcacatatgatttcatgtatatgtaatgaaaacaaattttatatatatacaaaatttattttcacttgcatttatgaaacaggagaaacaaaataaaattacatttatttattttaatttaatcttgaaagtaaattcatgttatcttctaaaaatgtttcagtttacaattcatcca

SEQ ID NO: 89 - DNA, 174 bp, Artificial Sequence
  Synthetic oligonucleotide
ggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctg

SEQ ID NO: 90 - DNA, 705 bp, Artificial Sequence
  Synthetic oligonucleotide
gggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaag

SEQ ID NO: 91 - DNA, 1416 bp, Artificial Sequence
  Synthetic oligonucleotide
gtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcacccagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggt

SEQ ID NO: 92 - DNA, 769 bp, Artificial Sequence
  Synthetic oligonucleotide
gtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaagacctgtatttaattatttttgtgaagaatactcaatgtatactgactgcacctgggtttttagtcttaaccaaatcatataccagttttatgacctggcaaaaatgtttttctctctctctagaggtcactttcttcatctgttaaacgaggtaattaatttagatgatctttaaaatgtccactagatttcatacatctatcacatatgatttcatgtatatgtaatgaaaacaaattttatatatatacaaaatttattttcacttgcatttatgaaacaggagaaacaaaataaaattacatttatttattttaatttaatcttgaaagtaaattcatgttatcttctaaaaatgtttcagtttacaattcatcca

SEQ ID NO: 93 - DNA, 112 bp, Artificial Sequence
  Synthetic oligonucleotide
acaaagcacgcaatgtggggacaacacagaaatccaagaaaggcaagaccaatttcaaggcactaaataagtggactgagacaagaagtacacagatacttcccagaacaaa

SEQ ID NO: 94 - DNA, 16 bp, Artificial Sequence
  Synthetic oligonucleotide
agattttatgtcatag

SEQ ID NO: 95 - DNA, 115 bp, Artificial Sequence
  Synthetic oligonucleotide
accctcattggattttcctggaagtacggagagttacatccagagaactctgaacattttggaaggaccccaatcctgcaaacaatgaatggcaataaatcctgggactggaaag

SEQ ID NO: 96 - DNA, 3341 bp, Homo sapiens
cttgaaaacaggtctatgtagttttaacagctcttttgtgaacttcggatgtaactgaatcattttctagatttatctgttaaataaatggtccatgaaagtatgtatgggtagataattgatggaagcaaataatcctattgaaacatttgctatttatttttgatacagttcttttaaacagactgattagttccctttatgatttcaccctcgaaagcacacacgattttgttctttatcattgttgcatgacattccatttggcagttgggcttatttttagccagactatcaaagtatttttcaactggactgtcacggcacttgaacttggaatcttataacttgaagaactgccctggagaaaggaagaaacttataataaatgggaaattataaatctagaccaacccaaacttgtactgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 97 - DNA, 2306 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaactcttagtttaag

SEQ ID NO: 98 - DNA, 2762 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaagcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgttcactgctataacactaacatctaaagctggatgcttaagaatgtttgttgagtaaatgaatgaataccagtaattgccta

SEQ ID NO: 99 - DNA, 2343 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggtatgggtcttttgttctgatttatccttggacattccgtagaaactactcttgcaatacttcagagggtttcccattggatgagccttcaccttttgaaatctgagtgctgctagcaagtgtgtcatttttaatatcgctaataatttatgcctaataactgtgtttcaatgaatagaaatactttatgctttcttagcagaaattcagttgaagataacaaatttaaggaatttaaattggaaactggagcttaaaataattaggctaaatttgaaatactgataaagaagatatatgtaagctcagaataaaataaacttttaaaaaagtg

SEQ ID NO: 100 - DNA, 1232 bp, Homo sapiens
aagcagtggtatcaacgcagagtggccattatggccgggggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttgggtaatggattggtgacaggaagaaatgaagaaaaagagaaggcaggaggagaaagaaagacagaaagggcaccttagagtaccattgtctgattatatcctcctctgtgctgcctctaatctttatcaacataacagcacttactacatggtgttgtttttatccatttataggtctatctccccactagtatatgtgttcattaaaggcagctttttttcttatttagccttatttatatttgtacttatttgtaaaacaaactaataacttagggcttaccatatgccagaaatgcttctacgtatctttttgtgcatcagcttatataatcctaatggtgtatatgtaaagtgctttagcacagtgtctggcacatggcaaaccctcaaaaatgttagttaacacttaatcattattgtttatgttaacaaccctctgaagtaagtgttgcaattgccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaa

SEQ ID NO: 101 - DNA, 168 bp, Artificial Sequence
  Synthetic oligonucleotide
gcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattg

SEQ ID NO: 102 - DNA, 428 bp, Artificial Sequence
  Synthetic oligonucleotide
cttgaaaacaggtctatgtagttttaacagctcttttgtgaacttcggatgtaactgaatcattttctagatttatctgttaaataaatggtccatgaaagtatgtatgggtagataattgatggaagcaaataatcctattgaaacatttgctatttatttttgatacagttcttttaaacagactgattagttccctttatgatttcaccctcgaaagcacacacgattttgttctttatcattgttgcatgacattccatttggcagttgggcttatttttagccagactatcaaagtatttttcaactggactgtcacggcacttgaacttggaatcttataacttgaagaactgccctggagaaaggaagaaacttataataaatgggaaattataaatctagaccaacccaaacttgtactg

SEQ ID NO: 103 - DNA, 728 bp, Artificial Sequence
  Synthetic oligonucleotide
gtaatggattggtgacaggaagaaatgaagaaaaagagaaggcaggaggagaaagaaagacagaaagggcaccttagagtaccattgtctgattatatcctcctctgtgctgcctctaatctttatcaacataacagcacttactacatggtgttgtttttatccatttataggtctatctccccactagtatatgtgttcattaaaggcagctttttttcttatttagccttatttatatttgtacttatttgtaaaacaaactaataacttagggcttaccatatgccagaaatgcttctacgtatctttttgtgcatcagcttatataatcctaatggtgtatatgtaaagtgctttagcacagtgtctggcacatggcaaaccctcaaaaatgttagttaacacttaatcattattgtttatgttaacaaccctctgaagtaagtgttgcaattgccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaa

SEQ ID NO: 104 - DNA, 139 bp, Artificial Sequence
  Synthetic oligonucleotide
gtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatg

SEQ ID NO: 105 - DNA, 145 bp, Artificial Sequence
  Synthetic oligonucleotide
tgaatgctcaagataatgaagaccatgtcccactccatttctgttctcgatttggacaccatgatatagttaagtatctgctgcaaagtgatttggaagttcaacctcatgttgttaatatctatggagatacccccttacacct

SEQ ID NO: 106 - DNA, 150 bp, Artificial Sequence
  Synthetic oligonucleotide
gattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaag

SEQ ID NO: 107 - DNA, 195 bp, Artificial Sequence
  Synthetic oligonucleotide
ttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagag

SEQ ID NO: 108 - DNA, 334 bp, Artificial Sequence
  Synthetic oligonucleotide
gtatgggtcttttgttctgatttatccttggacattccgtagaaactactcttgcaatacttcagagggtttcccattggatgagccttcaccttttgaaatctgagtgctgctagcaagtgtgtcatttttaatatcgctaataatttatgcctaataactgtgtttcaatgaatagaaatactttatgctttcttagcagaaattcagttgaagataacaaatttaaggaatttaaattggaaactggagcttaaaataattaggctaaatttgaaatactgataaagaagatatatgtaagctcagaataaaataaacttttaaaaaagtg

SEQ ID NO: 109 - DNA, 192 bp, Artificial Sequence
  Synthetic oligonucleotide
ggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaactcttagtttaag

SEQ ID NO: 110 - DNA, 133 bp, Artificial Sequence
  Synthetic oligonucleotide
aacctccgttggatggctcctgaggtgttcacgcagtgcactcggtacaccatcaaagcagatgtcttcagctatgctctgtgtctgtgggaaattctcactggcgaaattccattcgctcatctcaagccag

SEQ ID NO: 111 - DNA, 299 bp, Artificial Sequence
  Synthetic oligonucleotide
gcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgttcactgctataacactaacatctaaagctggatgcttaagaatgtttgttgagtaaatgaatgaataccagtaattgccta

SEQ ID NO: 112 - DNA, 170 bp, Artificial Sequence
  Synthetic oligonucleotide
ctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaag

SEQ ID NO: 113 - DNA, 523 bp, Artificial Sequence
  Synthetic oligonucleotide
gctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 114 - DNA, 39 bp, Artificial Sequence
  Synthetic oligonucleotide
aagcagtggtatcaacgcagagtggccattatggccggg

SEQ ID NO: 115 - DNA, 26 bp, Artificial Sequence
  Synthetic oligonucleotide
atgcgtgctgtgcggcgcggtctcag

SEQ ID NO: 116 - DNA, 95 bp, Artificial Sequence
  Synthetic oligonucleotide
ggaaggtggggctatggcagctgctagggaccctccggaagtatcgctgcgagaagccacccagcgaaaattgcggaggttttccgagctaagag

SEQ ID NO: 117 - DNA, 93 bp, Artificial Sequence
  Synthetic oligonucleotide
gaaatggaggatcaacactttgtgcccttcaatgtttggaaaagctatatggagataaatggaattcttttaccatcttattaattcactctg

SEQ ID NO: 118 - DNA, 109 bp, Artificial Sequence
  Synthetic oligonucleotide
atgaatggaagaaaaaagtcagtgaatcatatgttatcacaatagaaagattagaagatgacctgcagatcaaggaaaaagaactgacagaactaaggaatatatttgg

SEQ ID NO: 119 - DNA, 86 bp, Artificial Sequence
  Synthetic oligonucleotide
ctctgatgaagccttcagtaaagtcaatttaaattaccgcactgaaaatgggctgtctctacttcatttatgttgcatttgtggag

SEQ ID NO: 120 - DNA, 98 bp, Artificial Sequence
  Synthetic oligonucleotide
gcaagaaatcacatattcgaactcttatgttgaaagggctccgcccatctcgactgacaagaaatggatttacagccttgcatttagcagtttacaag

SEQ ID NO: 121 - DNA, 111 bp, Artificial Sequence
  Synthetic oligonucleotide
gataatgcagaattgatcacttctctgcttcacagtggagctgatatacagcaggttggatacggtggcctcactgccctccatattgctacaatagctggccacctagag

SEQ ID NO: 122 - DNA, 99 bp, Artificial Sequence
  Synthetic oligonucleotide
gctgctgatgtgctgttgcaacatggagctaatgtcaatattcaagatgcagtttttttcactccattgcatattgcagcgtactatggacatgaacag

SEQ ID NO: 123 - DNA, 105 bp, Artificial Sequence
  Synthetic oligonucleotide
ggcatgctacaatggcaaatttgaagttgccaaggaaatcatccaaatatcaggaacagaaagtctgactaaggaaaacatcttcagtgaaacagcttttcatag

SEQ ID NO: 124 - DNA, 95 bp, Artificial Sequence
  Synthetic oligonucleotide
tgcttgtacctatggcaagagcattgacctagtcaaatttcttcttgatcagaatgtcataaacatcaaccaccaaggaagggatgggcacactg

SEQ ID NO: 125 - DNA, 87 bp, Artificial Sequence
  Synthetic oligonucleotide
ggcatgatgccattgtcacactcctgaagcattataagagaccacaagatgaattgccctgtaatgaatattctcagcctggaggag

SEQ ID NO: 126 - DNA, 57 bp, Artificial Sequence
  Synthetic oligonucleotide
atggctcctatgtgtctgttccatcacccttggggaagattaaaagcatgacaaaag

SEQ ID NO: 127 - DNA, 93 bp, Artificial Sequence
  Synthetic oligonucleotide
agaaggcagatattctcctcctaagagctggattgccttcacatttccatcttcagctctcagaaattgagttccatgagattattggctcag

SEQ ID NO: 128 - DNA, 58 bp, Artificial Sequence
  Synthetic oligonucleotide
gttcttttgggaaagtatataaaggacgatgcagaaataaaatagtggctataaaacg

SEQ ID NO: 129 - DNA, 105 bp, Artificial Sequence
  Synthetic oligonucleotide
gattcttgatttgcagtctaaattaattattgcagtagatgttgccaaaggcatggagtaccttcacaacctgacacagccaattatacatcgtgacttgaacag

SEQ ID NO: 130 - DNA, 53 bp, Artificial Sequence
  Synthetic oligonucleotide
tcacaatattcttctctatgaggatgggcatgctgtggtggcagattttggag

SEQ ID NO: 131 - DNA, 53 bp, Artificial Sequence
  Synthetic oligonucleotide
aatcaagatttctacagtctctggatgaagacaacatgacaaaacaacctggg

SEQ ID NO: 132 - DNA, 110 bp, Artificial Sequence
  Synthetic oligonucleotide
cggctgcggcagcagacatggcttaccaccacatcagacctcccattggctattccattcccaagcccatatcatctctgctgatacgagggtggaacgcatgtcctgaa

SEQ ID NO: 133 - DNA, 60 bp, Artificial Sequence
  Synthetic oligonucleotide
ggaagacccgaattttctgaagttgtcatgaagttagaagagtgtctctgcaacattgag

SEQ ID NO: 134 - DNA, 79 bp, Artificial Sequence
  Synthetic oligonucleotide
tgctggacaatattcctctcaggtctgtctttggaggagatgaaaagaagtcttcaatacacacccattgacaaatatg

SEQ ID NO: 135 - DNA, 2662 bp, Homo sapiens
acacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 136 - DNA, 1222 bp, Homo sapiens
acacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 137 - DNA, 2148 bp, Homo sapiens
agaacttccagccttcttggcaaaggatccaggttggcacagtttcaaggtttatgcatttaaagaagaacacacctgagaaggctaaaattggtaacggctaggtagagggtaagagagagacgctagctctgaactgattctctagtgtgcctgaggcctccttatcagagtgtcttactgagaagcccagaccaacttctgttgtttatagtacaactgcatggaattggttgacttacctctctgtgctttctgtatcctcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 138 - DNA, 1490 bp, Homo sapiens
acacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagtttcttctccatctcctgaacttgatgtctgaaacatggtagtgccaggggttgcaacctgctgtgtggtagttgtagaagtttcatttccagaaactgcaggaggagaagaaaacaattcacactgcatttgcatatcctcattggtagacaatgcactcatcatgtgagaagtctgctggtaaactggcgattgctgaaggtttccatttgctgaagcagttgaagggaataactctgactgaatctgggcagctgcctggcagatactctgttgcatctccatcaccattgcggctgaagattccatcacttgctgttgctgctgctgctgctgctgttgattagataacgtgttttcagactgtggatgaacactttcagctcttccaggtaataaattatctggtctggtatggactgttggctctgttgaggaaaacattccagggcttacaccactctgaatttgactgacttgttgaaaaatatctgcactaagctgctcttgaacattctcattaccatctggagcagaaaataaaactgaagataactgctgctgtgcctctaaaacttgttggaccaagtcaacacttccactgctgccactagcagtactgcctgtgaaactccctgcttgcagctgctgaatagtattctgaagctgactcacactatttggtgatggaaaaatatttgatgaaatctgctgctgtaaagtctgtgcttgttcttgtagtggtgactgctgctgttgttgtgatgcctcagtcagttgtgacaaattaaccactgtaccatctgactgtaatatctctct

SEQ ID NO: 139 - DNA, 841 bp, Homo sapiens
acacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccaggtatggggggacatcggaaggggtgtcagggacatttgcgtgcttattgtcctagacatgtacctaattagctatgagatcttaaacagttacccactttactgcattctctgcaaataagggtgattactttaaaggtgcagtattacatggatttcacagatattgggaatc

SEQ ID NO: 140 - DNA, 708 bp, Homo sapiens
agaacttccagccttcttggcaaaggatccaggttggcacagtttcaaggtttatgcatttaaagaagaacacacctgagaaggctaaaattggtaacggctaggtagagggtaagagagagacgctagctctgaactgattctctagtgtgcctgaggcctccttatcagagtgtcttactgagaagcccagaccaacttctgttgtttatagtacaactgcatggaattggttgacttacctctctgtgctttctgtatcctcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 141 - DNA, 367 bp, Artificial Sequence
  Synthetic oligonucleotide
acacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatg

SEQ ID NO: 142 - DNA, 122 bp, Artificial Sequence
  Synthetic oligonucleotide
cttcaactatgccatgaaggaggctgctgcagcggctttgaagaagaaaggatgggaggtggtggagtcggacctctatgccatgaacttcaatcccatcatttccagaaaggacatcacag

SEQ ID NO: 143 - DNA, 174 bp, Artificial Sequence
  Synthetic oligonucleotide
gtatggggggacatcggaaggggtgtcagggacatttgcgtgcttattgtcctagacatgtacctaattagctatgagatcttaaacagttacccactttactgcattctctgcaaataagggtgattactttaaaggtgcagtattacatggatttcacagatattgggaatc

SEQ ID NO: 144 - DNA, 267 bp, Artificial Sequence
  Synthetic oligonucleotide
agaacttccagccttcttggcaaaggatccaggttggcacagtttcaaggtttatgcatttaaagaagaacacacctgagaaggctaaaattggtaacggctaggtagagggtaagagagagacgctagctctgaactgattctctagtgtgcctgaggcctccttatcagagtgtcttactgagaagcccagaccaacttctgttgtttatagtacaactgcatggaattggttgacttacctctctgtgctttctgtatcctcag

SEQ ID NO: 145 - DNA, 481 bp, Artificial Sequence
  Synthetic oligonucleotide
cttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaa

SEQ ID NO: 146 - DNA, 1361 bp, Artificial Sequence
  Synthetic oligonucleotide
gaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 147 - DNA, 823 bp, Artificial Sequence
  Synthetic oligonucleotide
tttcttctccatctcctgaacttgatgtctgaaacatggtagtgccaggggttgcaacctgctgtgtggtagttgtagaagtttcatttccagaaactgcaggaggagaagaaaacaattcacactgcatttgcatatcctcattggtagacaatgcactcatcatgtgagaagtctgctggtaaactggcgattgctgaaggtttccatttgctgaagcagttgaagggaataactctgactgaatctgggcagctgcctggcagatactctgttgcatctccatcaccattgcggctgaagattccatcacttgctgttgctgctgctgctgctgctgttgattagataacgtgttttcagactgtggatgaacactttcagctcttccaggtaataaattatctggtctggtatggactgttggctctgttgaggaaaacattccagggcttacaccactctgaatttgactgacttgttgaaaaatatctgcactaagctgctcttgaacattctcattaccatctggagcagaaaataaaactgaagataactgctgctgtgcctctaaaacttgttggaccaagtcaacacttccactgctgccactagcagtactgcctgtgaaactccctgcttgcagctgctgaatagtattctgaagctgactcacactatttggtgatggaaaaatatttgatgaaatctgctgctgtaaagtctgtgcttgttcttgtagtggtgactgctgctgttgttgtgatgcctcagtcagttgtgacaaattaaccactgtaccatctgactgtaatatctctct

SEQ ID NO: 148 - DNA, 4 bp, Artificial Sequence
  Synthetic oligonucleotide
gtcg

SEQ ID NO: 149 - DNA, 7 bp, Artificial Sequence
  Synthetic oligonucleotide
gcagaag

SEQ ID NO: 150 - DNA, 36 bp, Artificial Sequence
  Synthetic oligonucleotide
agcactgatcgtactggctcactcagagaggacgtc

SEQ ID NO: 151 - DNA, 78 bp, Artificial Sequence
  Synthetic oligonucleotide
gtaaactgaaggaccctgcgaactttcagtatcctgccgagtctgttctggcttataaagaaggccatctgagcccag

SEQ ID NO: 152 - DNA, 9 bp, Artificial Sequence
  Synthetic oligonucleotide
atattgtgg

SEQ ID NO: 153 - DNA, 27 bp, Artificial Sequence
  Synthetic oligonucleotide
ctgaacaaaagaagctggaagccgcag

SEQ ID NO: 154 - DNA, 17 bp, Artificial Sequence
  Synthetic oligonucleotide
accttgtgatattccag

SEQ ID NO: 155 - DNA, 12 bp, Artificial Sequence
  Synthetic oligonucleotide
ttccccctgcag

SEQ ID NO: 156 - DNA, 32 bp, Artificial Sequence
  Synthetic oligonucleotide
tggtttggagtccctgccattctgaaaggctg

SEQ ID NO: 157 - DNA, 48 bp, Artificial Sequence
  Synthetic oligonucleotide
gtttgagcgagtgttcataggagagtttgcttacacttacgctgccat

SEQ ID NO: 158 - DNA, 22 bp, Artificial Sequence
  Synthetic oligonucleotide
gtatgacaaaggacccttccgg

SEQ ID NO: 159 - DNA, 23 bp, Artificial Sequence
  Synthetic oligonucleotide
agtggcattctgcatttctgtgg

SEQ ID NO: 160 - DNA, 16 bp, Artificial Sequence
  Synthetic oligonucleotide
atccgactgggctcaa

SEQ ID NO: 161 - DNA, 3777 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagaggggttgtaagaagggtgtgagaaaggaaaactggtacttagcaaatggaaatacctatatgtattaccattaggtataaagaatctatgaggacatccatctgcatctcaacaaagaagagcaggttgcgaagaatatgccctgcctgagcctggggacagggcggttaactggtgaagggctgaggccagatgaaaggaagccttatcgtgtgctcccaaaagacttctgttgaaaggagttatccgggtccccgtgcgggagggggtgcg

SEQ ID NO: 162 - DNA, 3417 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagat

SEQ ID NO: 163 - DNA, 2735 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtggtacgggcatggccctgccctcctccccactccctgagccctggccttcttcccactctgagccaccctcaccttccctccggtccccccagtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 164 - DNA, 3233 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 165 - DNA, 3325 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtggtacgggcatggccctgccctcctccccactccctgagccctggccttcttcccactctgagccaccctcaccttccctccggtccccccagtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 166 - DNA, 2978 bp, Homo sapiens
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 167 - DNA, 3476 bp, Homo sapiens
agtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggtaagtaggagaggtcctggcactgcccttggagggcccatgccctcctgcccagggagtcccagatggggtgggaggtaggggagacttatctgcctgttccagggtattacctctgacccagcccctcggagcccaaggaatgtgggcactggcctgacctgtgaccccgtccccaggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaa

SEQ ID NO: 168 - DNA, 1072 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttatttgtaggttgaaaccgcgtcctctccctgaaggccctgtggcagtcaaagcagaaatggcgtcttgccctagggagccacagggggtgaaggtctgtgctgg

SEQ ID NO: 169 - DNA, 3065 bp, Homo sapiens
ggtgatccgcccacctcggcctcccaaagtgctgggattacaggtgtgagccaccgcgcctggcctagctgtgttttttttttaaagatgctttcttctccacatgcctgtctgtgccatcctccacccaccccaaatgagcaggaatccccagacacaggacttgccatgccataggagcctgaaagttggattagacgtaacttgacaactgaaactctactgtgaatggaaacaaaacactagatgttcccactaaactctgaccttgaagaagtggctttccttggagccttggtttccttctcagtaaatagagacttggctacccccagtggatgtggtgagactggccccgtgccctaaattagagaagtggctattttaagtggaaagaccctttgtaaggccagtctgggtgtacaaatgatgtaaacagccccaagatgatccttgtctagtaccgagccatccagggattcgaccctatttgccccggagctgggccagcctcaaatcccccgtaatcagcttgtgacttcaaggagctcagctttgcccagtgcctcctggtcacggggtgtcggcccagagctctgctcaagtaccaagggtacagccatccagctccctgcttccccaagactggcaaagctggggaggcctggaacaaagaggaaagtgtgcagtgttggcttggggcctgcaacctcaccccttcccccacctcactcctgggcataaaggtgataaagccgctcactcagtctgcagtctggtaaccgacgtccccatgatggcggaggctgggaggcctcctgaccagattcatgggctcagagaggctgtgtccaggcctgcaggcccagccctggctaccctaacaagcctccaattgttacctctctccacgggaggggtggactggagcctgaggctctgtcttccagccaccaggcctggcagtagctgatgcataaacattagggttttgcagtaactgagcagggctcccaggccttgaacctgggcagaaagaagacagcatctcctctctttgtgaccacactgacttgcctccctgaggcttctgcaccctggaatgggagagagctcttgccaggcctcagctgatggagcctttggctactgaggcctctgctggacaggaagtctgcctatgtctcctagcccagtttatctccccctgccctggcatttgggagtggggaggaaacggctccatcagaaacagctctaccattggaccttaggccagccacacttcttgttggagcttgtgtcctcagctgtactggggatgagagctagctgtctgggtcagcggcactgaggctccaggggagcatgtggtctgtgcagcaggcttggggagtgctgagcagcacagattgggtttcatagcacagtgggagcccagacaggccagctagccataagcacctctgctggaggaagaggtggactctcttgggctggagggcccagttcaaggaaagaaacaaacagctacactgggctccttgatcacccagctgtggcagttcttcttgaggacttcctgcccctaggtgggggctgccttcagctccctgctgcgtgtgataacttgggtgtggccctcacagctgtgcagaagctattcccagagggttctggccccaggtaaacagattctgctctgggctcgccttgcctccatcccacagccctgtgtgctgtctgtggcacagcctagagcagcactgcctcgtggccctggcccttatgcggctggagctgatcctgaagtccagtgtcccagcggtcatggctggcatcatcaccatctacaacctggtgatggaagtccttatccccaactcgctgatcgactgcatcagcctctacgggaatctcctccagccaagcgctaggctgagtgtgggcctgagtggcccggcagccagctatgtcatcagcactgtgggggacacagtgctgcctagaagcccgggctatttgtgggcttgatcctgatcctcattttcactgcatggtctcattctctccacaaagtagcctttgagcccaccagccacagaatgtgatataaagatcacccctgcttattccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctggccccctgaccagtgaggatgccccctcccatctagggtactctgcgtctaaggatgaattccagtgtaattttctctcttctgtaggtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaattggattaaaaaaaagcttcagaagttacagagccaactacagagaagcataataaatgaaagagtgtcttctagttttgacagtttggtgtttaccctaaagacttctctttgtgcatgtgtagatacatgcctataaatagaatatttgtgtagttggatcccactttctgcatagttctttgcaacccattctgttcaccaaaccaacccttagaggtaaatactggcagtgtttctctctgcacatacaaccaagtgccactatacaagttcactaactccctgttccttacacaatatgtacatcctattgctttttttcccccctgaacaatctaccctggtactcttcataacacatacatgttatgtgaaacacagatgtgtttcattctttccaatagctgcataatacttcattacaggcatgtcccaccatgattaa

SEQ ID NO: 170 - DNA, 991 bp, Homo sapiens
caccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaattggattaaaaaaaagcttcagaagttacagagccaactacagagaagcataataaatgaaagagtgtcttctagttttgacagtttggtgtttaccctaaagacttctctttgtgcatgtgtagatacatgcctataaatagaatatttgtgtagttggatcccactttctgcatagttctttgcaacccattctgttcaccaaaccaacccttagaggtaaatactggcagtgtttctctctgcacatacaaccaagtgccactatacaagttcactaactccctgttccttacacaatatgtacatcctattgctttttttcccccctgaacaatctaccctggtactcttcataacacatacatgttatgtgaaacacagatgtgtttcattctttccaatagctgcataatacttcattacaggcatgtcccaccatgattaa

SEQ ID NO: 171 - DNA, 1407 bp, Homo sapiens
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttatttgtaggttgaaaccgcgtcctctccctgaaggccctgtggcagtcaaagcagaaatggcgtcttgccctagggagccacagggggtgaaggtctgtgctgg

SEQ ID NO: 172 - DNA, 134 bp, Artificial Sequence
  Synthetic oligonucleotide
caccggcgtcgccagccaatggccggggtcctataaacgctacggtccgcgcgctctctggcaagaggcaagaggtagcaacagcgagcgtgccggtcgctagtcgcgggtccccgagtgagcacgccagggag

SEQ ID NO: 173 - DNA, 136 bp, Artificial Sequence
  Synthetic oligonucleotide
tcagagtcgcagtgggagtccccggaccggagcacgagcctgagcgggagagcgccgctcgcacgcccgtcgccacccgcgtacccggcgcagccagagccaccagcgcagcgctgccatggagcccagcagcaag

SEQ ID NO: 174 - DNA, 2371 bp, Artificial Sequence
  Synthetic oligonucleotide
ggtgatccgcccacctcggcctcccaaagtgctgggattacaggtgtgagccaccgcgcctggcctagctgtgttttttttttaaagatgctttcttctccacatgcctgtctgtgccatcctccacccaccccaaatgagcaggaatccccagacacaggacttgccatgccataggagcctgaaagttggattagacgtaacttgacaactgaaactctactgtgaatggaaacaaaacactagatgttcccactaaactctgaccttgaagaagtggctttccttggagccttggtttccttctcagtaaatagagacttggctacccccagtggatgtggtgagactggccccgtgccctaaattagagaagtggctattttaagtggaaagaccctttgtaaggccagtctgggtgtacaaatgatgtaaacagccccaagatgatccttgtctagtaccgagccatccagggattcgaccctatttgccccggagctgggccagcctcaaatcccccgtaatcagcttgtgacttcaaggagctcagctttgcccagtgcctcctggtcacggggtgtcggcccagagctctgctcaagtaccaagggtacagccatccagctccctgcttccccaagactggcaaagctggggaggcctggaacaaagaggaaagtgtgcagtgttggcttggggcctgcaacctcaccccttcccccacctcactcctgggcataaaggtgataaagccgctcactcagtctgcagtctggtaaccgacgtccccatgatggcggaggctgggaggcctcctgaccagattcatgggctcagagaggctgtgtccaggcctgcaggcccagccctggctaccctaacaagcctccaattgttacctctctccacgggaggggtggactggagcctgaggctctgtcttccagccaccaggcctggcagtagctgatgcataaacattagggttttgcagtaactgagcagggctcccaggccttgaacctgggcagaaagaagacagcatctcctctctttgtgaccacactgacttgcctccctgaggcttctgcaccctggaatgggagagagctcttgccaggcctcagctgatggagcctttggctactgaggcctctgctggacaggaagtctgcctatgtctcctagcccagtttatctccccctgccctggcatttgggagtggggaggaaacggctccatcagaaacagctctaccattggaccttaggccagccacacttcttgttggagcttgtgtcctcagctgtactggggatgagagctagctgtctgggtcagcggcactgaggctccaggggagcatgtggtctgtgcagcaggcttggggagtgctgagcagcacagattgggtttcatagcacagtgggagcccagacaggccagctagccataagcacctctgctggaggaagaggtggactctcttgggctggagggcccagttcaaggaaagaaacaaacagctacactgggctccttgatcacccagctgtggcagttcttcttgaggacttcctgcccctaggtgggggctgccttcagctccctgctgcgtgtgataacttgggtgtggccctcacagctgtgcagaagctattcccagagggttctggccccaggtaaacagattctgctctgggctcgccttgcctccatcccacagccctgtgtgctgtctgtggcacagcctagagcagcactgcctcgtggccctggcccttatgcggctggagctgatcctgaagtccagtgtcccagcggtcatggctggcatcatcaccatctacaacctggtgatggaagtccttatccccaactcgctgatcgactgcatcagcctctacgggaatctcctccagccaagcgctaggctgagtgtgggcctgagtggcccggcagccagctatgtcatcagcactgtgggggacacagtgctgcctagaagcccgggctatttgtgggcttgatcctgatcctcattttcactgcatggtctcattctctccacaaagtagcctttgagcccaccagccacagaatgtgatataaagatcacccctgcttattccagaatgaacagcctgagacacatatcccttcagtagttggtcttgtgaatgcagtgtcctagtgcaaatgcccatcatctgttgaccccatccttgcccctgcctgccccatgctgtggatatctgggccccctcatcacccatcctggccccctgaccagtgaggatgccccctcccatctagggtactctgcgtctaaggatgaattccagtgtaattttctctcttctgtag

SEQ ID NO: 175 - DNA, 694 bp, Artificial Sequence
  Synthetic oligonucleotide
gtttatttatggaagattggacctgttcatacatctgtggggcagccctccatctcccagctatataaagtctctaaccacagtgttgcattgtggggttaccatgtggtctgacacttccttgcatgaactaccctcactccagccctggacagtccagggcctagcaggcagtgtgtggggcctaccaggtcctggcatccaagctgtgtccaataaagttcttagatgtgactggaaaaaaaattggattaaaaaaaagcttcagaagttacagagccaactacagagaagcataataaatgaaagagtgtcttctagttttgacagtttggtgtttaccctaaagacttctctttgtgcatgtgtagatacatgcctataaatagaatatttgtgtagttggatcccactttctgcatagttctttgcaacccattctgttcaccaaaccaacccttagaggtaaatactggcagtgtttctctctgcacatacaaccaagtgccactatacaagttcactaactccctgttccttacacaatatgtacatcctattgctttttttcccccctgaacaatctaccctggtactcttcataacacatacatgttatgtgaaacacagatgtgtttcattctttccaatagctgcataatacttcattacaggcatgtcccaccatgattaa

SEQ ID NO: 176 - DNA, 632 bp, Artificial Sequence
  Synthetic oligonucleotide
tcctgccctgtgaacagcaggaagggtagggcaaggtgggatcacatctccaatgtgacaaacgaagctgttgccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcag

SEQ ID NO: 177 - DNA, 679 bp, Artificial Sequence
  Synthetic oligonucleotide
gtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttatttgtaggttgaaaccgcgtcctctccctgaaggccctgtggcagtcaaagcagaaatggcgtcttgccctagggagccacagggggtgaaggtctgtgctgg

SEQ ID NO: 178 - DNA, 457 bp, Artificial Sequence
  Synthetic oligonucleotide
agtagagatagggtttcaccatgttggtctggctggtctcgaactcctgatctccagtgatctgcttgccttgatctcccaaagtgctgggattacaggcgtgagccaccacacctggtcttgtacctctctgttctatgcctgaacttccaccactgatcacttgccatcatcccagcaagtcacactgagcctgtgaaaccacagggcactggaaaccacacgttaggggaagtgggagagttggcggggctctcagatgaactccaaccccttgtttctcgcctggggaaagtgaggcccacaaaaatagagggacttggctcaagaacatgcagtgaatctgtggcagagccaggccctggccctctcttagggaggggtgcaaggggaaaggaaaaggaagactgggtcctggcccctggcttgctcacccaggctgcatctccccctgcag

SEQ ID NO: 179 - DNA, 123 bp, Artificial Sequence
  Synthetic oligonucleotide
ctatggggagagcatcctgcccaccacgctcaccacgctctggtccctctcagtggccatcttttctgttgggggcatgattggctccttctctgtgggccttttcgttaaccgctttggccg

SEQ ID NO: 180 - DNA, 121 bp, Artificial Sequence
  Synthetic oligonucleotide
ctgcggcctgaccacaggcttcgtgcccatgtatgtgggtgaagtgtcacccacagcccttcgtggggccctgggcaccctgcaccagctgggcatcgtcgtcggcatcctcatcgcccag

SEQ ID NO: 181 - DNA, 590 bp, Artificial Sequence
  Synthetic oligonucleotide
gtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgtccccaaaaccctcttgtggcagagtagcagcccccattctctgtgctggacacatctgtggccttgtcatttgtcctcccagcaacactgtggggtaggtcctacttttcccatgtgaccgatgaggaaactgagaaacagggctcatgctagtggcagagcctctagaactggggcccttccctgaagcagcagctgacacaaagtagggaaggccactctggcaggacggggtgggaaagggggtcagggcagaggcgctcacggcccctgcttcccccag

SEQ ID NO: 182 - DNA, 177 bp, Artificial Sequence
  Synthetic oligonucleotide
gagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcatt

SEQ ID NO: 183 - DNA, 1298 bp, Artificial Sequence
  Synthetic oligonucleotide
tcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtctctagaggctcagctgacaaaatctgggagaagtttgcttttgtaactacaggcaggcttttttctccctgacatgaagaggggttgtaagaagggtgtgagaaaggaaaactggtacttagcaaatggaaatacctatatgtattaccattaggtataaagaatctatgaggacatccatctgcatctcaacaaagaagagcaggttgcgaagaatatgccctgcctgagcctggggacagggcggttaactggtgaagggctgaggccagatgaaaggaagccttatcgtgtgctcccaaaagacttctgttgaaaggagttatccgggtccccgtgcgggagggggtgcg

SEQ ID NO: 184 - DNA, 27 bp, Artificial Sequence
  Synthetic oligonucleotide
caggagaccaaacgacgggggtcggag

SEQ ID NO: 185 - DNA, 96 bp, Artificial Sequence
  Synthetic oligonucleotide
aagctgacgggtcgcctcatgctggccgtgggaggagcagtgcttggctccctgcagtttggctacaacactggagtcatcaatgccccccagaag

SEQ ID NO: 186 - DNA, 38 bp, Artificial Sequence
  Synthetic oligonucleotide
gtgatcgaggagttctacaaccagacatgggtccaccg

SEQ ID NO: 187 - DNA, 105 bp, Artificial Sequence
  Synthetic oligonucleotide
gtaagtaggagaggtcctggcactgcccttggagggcccatgccctcctgcccagggagtcccagatggggtgggaggtaggggagacttatctgcctgttccag

SEQ ID NO: 188 - DNA, 74 bp, Artificial Sequence
  Synthetic oligonucleotide
ggtattacctctgacccagcccctcggagcccaaggaatgtgggcactggcctgacctgtgaccccgtccccag

SEQ ID NO: 189 - DNA, 75 bp, Artificial Sequence
  Synthetic oligonucleotide
gcggaattcaatgctgatgatgaacctgctggccttcgtgtccgccgtgctcatgggcttctcgaaactgggcaa

SEQ ID NO: 190 - DNA, 45 bp, Artificial Sequence
  Synthetic oligonucleotide
gtcctttgagatgctgatcctgggccgcttcatcatcggtgtgta

SEQ ID NO: 191 - DNA, 25 bp, Artificial Sequence
  Synthetic oligonucleotide
gtgttcggcctggactccatcatgg

SEQ ID NO: 192 - DNA, 73 bp, Artificial Sequence
  Synthetic oligonucleotide
gcaacaaggacctgtggcccctgctgctgagcatcatcttcatcccggccctgctgcagtgcatcgtgctgcc

SEQ ID NO: 193 - DNA, 9 bp, Artificial Sequence
  Synthetic oligonucleotide
cttctgccc

SEQ ID NO: 194 - DNA, 56 bp, Artificial Sequence
  Synthetic oligonucleotide
cgagagtccccgcttcctgctcatcaaccgcaacgaggagaaccgggccaagagtg

SEQ ID NO: 195 - DNA, 92 bp, Artificial Sequence
  Synthetic oligonucleotide
gtacgggcatggccctgccctcctccccactccctgagccctggccttcttcccactctgagccaccctcaccttccctccggtccccccag

SEQ ID NO: 196 - DNA, 77 bp, Artificial Sequence
  Synthetic oligonucleotide
tgctaaagaagctgcgcgggacagctgacgtgacccatgacctgcaggagatgaaggaagagagtcggcagatgatg

SEQ ID NO: 197 - DNA, 27 bp, Artificial Sequence
  Synthetic oligonucleotide
cgggagaagaaggtcaccatcctggag

SEQ ID NO: 198 - DNA, 66 bp, Artificial Sequence
  Synthetic oligonucleotide
ctgttccgctcccccgcctaccgccagcccatcctcatcgctgtggtgctgcagctgtcccagcag

SEQ ID NO: 199 - DNA, 18 bp, Artificial Sequence
  Synthetic oligonucleotide
ctgtctggcatcaacgct

SEQ ID NO: 200 - DNA, 105 bp, Artificial Sequence
  Synthetic oligonucleotide
gtcttctattactccacgagcatcttcgagaaggcgggggtgcagcagcctgtgtatgccaccattggctccggtatcgtcaacacggccttcactgtcgtgtcg

SEQ ID NO: 201 - DNA, 102 bp, Artificial Sequence
  Synthetic oligonucleotide
ctgtttgtggtggagcgagcaggccggcggaccctgcacctcataggcctcgctggcatggcgggttgtgccatactcatgaccatcgcgctagcactgctg

SEQ ID NO: 202 - DNA, 27 bp, Artificial Sequence
  Synthetic oligonucleotide
gtgggcatgtgcttccagtatgtggag

SEQ ID NO: 203 - DNA, 48 bp, Artificial Sequence
  Synthetic oligonucleotide
caactgtgtggtccctacgtcttcatcatcttcactgtgctcctggtt

SEQ ID NO: 204 - DNA, 17 bp, Artificial Sequence
  Synthetic oligonucleotide
ctgttcttcatcttcac

SEQ ID NO: 205 - DNA, 33 bp, Artificial Sequence
  Synthetic oligonucleotide
ctacttcaaagttcctgagactaaaggccggac

SEQ ID NO: 206 - DNA, 21 bp, Artificial Sequence
  Synthetic oligonucleotide
cttcgatgagatcgcttccgg

SEQ ID NO: 207 - DNA, 36 bp, Artificial Sequence
  Synthetic oligonucleotide
cttccggcaggggggagccagccaaagtgacaagac

SEQ ID NO: 208 - DNA, 70 bp, Artificial Sequence
  Synthetic oligonucleotide
acccgaggagctgttccatcccctgggggctgattcccaagtgtgagtcgccccagatcaccagcccggc

SEQ ID NO: 209 - DNA, 10 bp, Artificial Sequence
  Synthetic oligonucleotide
ctgctcccag

SEQ ID NO: 210 - DNA, 28 bp, Artificial Sequence
  Synthetic oligonucleotide
cagccctaaggatctctcaggagcacag

SEQ ID NO: 211 - DNA, 4 bp, Artificial Sequence
  Synthetic oligonucleotide
gcag

SEQ ID NO: 212 - DNA, 44 bp, Artificial Sequence
  Synthetic oligonucleotide
ctggatgagacttccaaacctgacagatgtcagccgagccgggc

SEQ ID NO: 213 - DNA, 64 bp, Artificial Sequence
  Synthetic oligonucleotide
ctggggctcctttctccagccagcaatgatgtccagaagaatattcaggacttaacggctccag

SEQ ID NO: 214 - DNA, 70 bp, Artificial Sequence
  Synthetic oligonucleotide
gattttaacaaaagcaagactgttgctcaaatctattcagacaagcaacaggttttataatttttttatt

SEQ ID NO: 215 - DNA, 52 bp, Artificial Sequence
  Synthetic oligonucleotide
actgattttgttatttttatatcagcctgagtctcctgtgcccacatcccag

SEQ ID NO: 216 - DNA, 24 bp, Artificial Sequence
  Synthetic oligonucleotide
gcttcaccctgaatggttccatgc

SEQ ID NO: 217 - DNA, 19 bp, Artificial Sequence
  Synthetic oligonucleotide
ctgagggtggagactaagc

SEQ ID NO: 218 - DNA, 49 bp, Artificial Sequence
  Synthetic oligonucleotide
cctgtcgagacacttgccttcttcacccagctaatctgtagggctggac

SEQ ID NO: 219 - DNA, 103 bp, Artificial Sequence
  Synthetic oligonucleotide
ctatgtcctaaggacacactaatcgaactatgaactacaaagcttctatcccaggaggtggctatggccacccgttctgctggcctggatctccccactctag

SEQ ID NO: 220 - DNA, 82 bp, Artificial Sequence
  Synthetic oligonucleotide
gggtcaggctccattaggatttgccccttcccatctcttcctacccaaccactcaaattaatctttctttacctgagaccag

SEQ ID NO: 221 - DNA, 54 bp, Artificial Sequence
  Synthetic oligonucleotide
ttgggagcactggagtgcagggaggagaggggaagggccagtctgggctgccgg

SEQ ID NO: 222 - DNA, 51 bp, Artificial Sequence
  Synthetic oligonucleotide
gttctagtctcctttgcactgagggccacactattaccatgagaagagggc

SEQ ID NO: 223 - DNA, 33 bp, Artificial Sequence
  Synthetic oligonucleotide
ctgtgggagcctgcaaactcactgctcaagaag

SEQ ID NO: 224 - DNA, 10 bp, Artificial Sequence
  Synthetic oligonucleotide
acatggagac

SEQ ID NO: 225 - DNA, 5097 bp, Homo sapiens
ttccttcttgcctttggagctgatcttattcctgataaagaagtccccatcccatttatgttagcacctctcctacttcagctattattttactccagacacttgtctctgacttgaaaaaagccattattgctcagtgagtgtgtgactgggaggttagggagtagtgggatgatgtggagttgtggtttttcttggaggtcacttccttcttctacaactagtttggaacaagtaagaatatgctttttccaacttggaaagacagttttttcaaaaacaactttcttgaggtataattgacatacagaaaatcacacttatttaaaaatgtatattttgataaattttgacatatatatgtgtgtgtatatatacatacacacacacacacagctgtggaactatggttacaatcaagataataaatatatccaccacccccaaaagttcctcatgctgctttgtaatcatccaccctcaccaggtcccaagaaaccagcatgcccagctttgcatatttttcgtcttcagttggttgtatctacggttatggaacccatggacacagagagctaactgttttagaaaacagttcagtgtatatccagatatttaacatttcattttctttagaagcacaactttaagccatctcaattacttcaattagtcacaactggaactttgcttttgaagctgcagatttattgaatagtttaaaattatctttgctcataggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 226 - DNA, 4747 bp, Homo sapiens
accgcagcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaaggtcagagagtttggaaaacttttcagtataagaatatttaagtaaattgtattttaaggctcattgaatttatgcatggtattaatacctttttaagccaatcacataaaaagatagtacattactcaacatttatatgtacgtataaa

SEQ ID NO: 227 - DNA, 3602 bp, Homo sapiens
gcgtgcaccatgcccggcgaagcagtgggattctaaggataggaaacagattctagttgaagagatactaaatgataaagtatactgtcttagctgtgaaatcaatgagtcttgtaggctggaagtaatcttaagggcaagctacctcatctaattccattaacattagtggtcaggttgctgatctgatgtcacagagctggaattcaaactattgatttctattgaggccgagtatgtattgtttaaatgctaagaacagaattgggaatatgtttatgttaaaatacatagatggagaaagagtaaagcattttcttcctaatacagcaatgaactgctaacagtttagtaacacagaagacttttgtatggttaaagaatagaatgaatgtataaatttgcatactgggttcaataagttgttgtttcaacagacactctgcttttctttatcaatcagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 228 - DNA, 3910 bp, Homo sapiens
accgcagcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacaggtgagaataggcattggagtgcaagagaatgctcactgaacgttagagacagcctctaaagttgagtctcagcttttgctttgtgatagctataatctctgttgacgatataacatttcatgaatgttgatgaagattgaatgcaaacttaagttgtctagagttttattctctaatattcattgtagagctccttatcattaaattataggatttttaatttaaatactcatttttatgctgtaaatttttaggacttttc

SEQ ID NO: 229 - DNA, 1562 bp, Homo sapiens
caactttgctattcccctcattaactctccaggaatattttatagggctactacataattgttattgaagacaaacctcattttgaagtagacatgctttaaaaattagcattcacaactgggagaaattttaatacttgttggctgggcccggtggctcacacctgtaatcccagcactttgggaggccgaggtgggtggactgcttgaggccaggagtttgagaccagcctggccaacatggcgaaaccccgtctctactaaaattacacaaattagctgggcatggtggcacacgcctgtaattccagctacactaggaggctggggcacgagaattgcttgagcccgggaggcagaggttgcaatgagccaagatagtgccactgtactccatcctgggtgacagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 230 - DNA, 1855 bp, Homo sapiens
caactttgctattcccctcattaactctccaggaatattttatagggctactacataattgttattgaagacaaacctcattttgaagtagacatgctttaaaaattagcattcacaactgggagaaattttaatacttgttggctgggcccggtggctcacacctgtaatcccagcactttgggaggccgaggtgggtggactgcttgaggccaggagtttgagaccagcctggccaacatggcgaaaccccgtctctactaaaattacacaaattagctgggcatggtggcacacgcctgtaattccagctacactaggaggctggggcacgagaattgcttgagcccgggaggcagaggttgcaatgagccaagatagtgccactgtactccatcctgggtgacagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaaaaaagtttttgtattcatttgtttctgaaaaatgtgcattatgtactatgaggaaatttctacaaagagatgaagacaattgaaagccagatatctgttattgatctaagcactcccaacatgtctcagaccctgaaccgccagttataccctacactgataggtctcgaagcactttctttccatagctcctaatacagaatctgaaattgtcctaaatctttctgtttaaaaaacaaagcaaacccacaaatggaaaaagcaacaataataaagatttcccttgaacttc

SEQ ID NO: 231 - DNA, 1663 bp, Homo sapiens
caactttgctattcccctcattaactctccaggaatattttatagggctactacataattgttattgaagacaaacctcattttgaagtagacatgctttaaaaattagcattcacaactgggagaaattttaatacttgttggctgggcccggtggctcacacctgtaatcccagcactttgggaggccgaggtgggtggactgcttgaggccaggagtttgagaccagcctggccaacatggcgaaaccccgtctctactaaaattacacaaattagctgggcatggtggcacacgcctgtaattccagctacactaggaggctggggcacgagaattgcttgagcccgggaggcagaggttgcaatgagccaagatagtgccactgtactccatcctgggtgacagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 232 - DNA, 172 bp, Artificial Sequence
  Synthetic oligonucleotide
accgcagcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcgg

SEQ ID NO: 233 - DNA, 149 bp, Artificial Sequence
  Synthetic oligonucleotide
cgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctag

SEQ ID NO: 234 - DNA, 741 bp, Artificial Sequence
  Synthetic oligonucleotide
ttccttcttgcctttggagctgatcttattcctgataaagaagtccccatcccatttatgttagcacctctcctacttcagctattattttactccagacacttgtctctgacttgaaaaaagccattattgctcagtgagtgtgtgactgggaggttagggagtagtgggatgatgtggagttgtggtttttcttggaggtcacttccttcttctacaactagtttggaacaagtaagaatatgctttttccaacttggaaagacagttttttcaaaaacaactttcttgaggtataattgacatacagaaaatcacacttatttaaaaatgtatattttgataaattttgacatatatatgtgtgtgtatatatacatacacacacacacacagctgtggaactatggttacaatcaagataataaatatatccaccacccccaaaagttcctcatgctgctttgtaatcatccaccctcaccaggtcccaagaaaccagcatgcccagctttgcatatttttcgtcttcagttggttgtatctacggttatggaacccatggacacagagagctaactgttttagaaaacagttcagtgtatatccagatatttaacatttcattttctttagaagcacaactttaagccatctcaattacttcaattagtcacaactggaactttgcttttgaagctgcagatttattgaatagtttaaaattatctttgctcatag

SEQ ID NO: 235 - DNA, 127 bp, Artificial Sequence
  Synthetic oligonucleotide
ttacttacacattgggcatgcaaaagctgctcttctgaaccagcactaccaggttaactttaaagggaaactgatcatgagatttgatgacacaaatcctgaaaaagaaaaggaagattttgagaag

SEQ ID NO: 236 - DNA, 193 bp, Artificial Sequence
  Synthetic oligonucleotide
gttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaacc

SEQ ID NO: 237 - DNA, 172 bp, Artificial Sequence
  Synthetic oligonucleotide
ctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaa

SEQ ID NO: 238 - DNA, 234 bp, Artificial Sequence
  Synthetic oligonucleotide
tgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatg

SEQ ID NO: 239 - DNA, 463 bp, Artificial Sequence
  Synthetic oligonucleotide
gcgtgcaccatgcccggcgaagcagtgggattctaaggataggaaacagattctagttgaagagatactaaatgataaagtatactgtcttagctgtgaaatcaatgagtcttgtaggctggaagtaatcttaagggcaagctacctcatctaattccattaacattagtggtcaggttgctgatctgatgtcacagagctggaattcaaactattgatttctattgaggccgagtatgtattgtttaaatgctaagaacagaattgggaatatgtttatgttaaaatacatagatggagaaagagtaaagcattttcttcctaatacagcaatgaactgctaacagtttagtaacacagaagacttttgtatggttaaagaatagaatgaatgtataaatttgcatactgggttcaataagttgttgtttcaacagacactctgcttttctttatcaatcag

SEQ ID NO: 240 - DNA, 137 bp, Artificial Sequence
  Synthetic oligonucleotide
aatcctgaggttggcttgaagcctgtgtggtatagtcccaaagttttcattgaaggtgctgatgcagagactttttcggagggtgagatggttacatttataaattggggcaacctcaacattacaaaaatacacaa

SEQ ID NO: 241 - DNA, 208 bp, Artificial Sequence
  Synthetic oligonucleotide
aaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaag

SEQ ID NO: 242 - DNA, 264 bp, Artificial Sequence
  Synthetic oligonucleotide
acctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaat

SEQ ID NO: 243 - DNA, 234 bp, Artificial Sequence
  Synthetic oligonucleotide
gctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaag

SEQ ID NO: 244 - DNA, 263 bp, Artificial Sequence
  Synthetic oligonucleotide
gatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccag

SEQ ID NO: 245 - DNA, 210 bp, Artificial Sequence
  Synthetic oligonucleotide
gtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagag

SEQ ID NO: 246 - DNA, 262 bp, Artificial Sequence
  Synthetic oligonucleotide
gtgagaataggcattggagtgcaagagaatgctcactgaacgttagagacagcctctaaagttgagtctcagcttttgctttgtgatagctataatctctgttgacgatataacatttcatgaatgttgatgaagattgaatgcaaacttaagttgtctagagttttattctctaatattcattgtagagctccttatcattaaattataggatttttaatttaaatactcatttttatgctgtaaatttttaggacttttc

SEQ ID NO: 247 - DNA, 156 bp, Artificial Sequence
  Synthetic oligonucleotide
gtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccag

SEQ ID NO: 248 - DNA, 170 bp, Artificial Sequence
  Synthetic oligonucleotide
atttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcag

SEQ ID NO: 249 - DNA, 174 bp, Artificial Sequence
  Synthetic oligonucleotide
gtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaag

SEQ ID NO: 250 - DNA, 161 bp, Artificial Sequence
  Synthetic oligonucleotide
ggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaag

SEQ ID NO: 251 - DNA, 149 bp, Artificial Sequence
  Synthetic oligonucleotide
gtcagagagtttggaaaacttttcagtataagaatatttaagtaaattgtattttaaggctcattgaatttatgcatggtattaatacctttttaagccaatcacataaaaagatagtacattactcaacatttatatgtacgtataaa

SEQ ID NO: 252 - DNA, 1141 bp, Artificial Sequence
  Synthetic oligonucleotide
caactttgctattcccctcattaactctccaggaatattttatagggctactacataattgttattgaagacaaacctcattttgaagtagacatgctttaaaaattagcattcacaactgggagaaattttaatacttgttggctgggcccggtggctcacacctgtaatcccagcactttgggaggccgaggtgggtggactgcttgaggccaggagtttgagaccagcctggccaacatggcgaaaccccgtctctactaaaattacacaaattagctgggcatggtggcacacgcctgtaattccagctacactaggaggctggggcacgagaattgcttgagcccgggaggcagaggttgcaatgagccaagatagtgccactgtactccatcctgggtgacagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattag

SEQ ID NO: 253 - DNA, 356 bp, Artificial Sequence
  Synthetic oligonucleotide
ggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 254 - DNA, 288 bp, Artificial Sequence
  Synthetic oligonucleotide
gtttttgtattcatttgtttctgaaaaatgtgcattatgtactatgaggaaatttctacaaagagatgaagacaattgaaagccagatatctgttattgatctaagcactcccaacatgtctcagaccctgaaccgccagttataccctacactgataggtctcgaagcactttctttccatagctcctaatacagaatctgaaattgtcctaaatctttctgtttaaaaaacaaagcaaacccacaaatggaaaaagcaacaataataaagatttcccttgaacttc

SEQ ID NO: 255 - DNA, 18 bp, Artificial Sequence
  Synthetic oligonucleotide
gagctttgctggcagtag

SEQ ID NO: 256 - DNA, 67 bp, Artificial Sequence
  Synthetic oligonucleotide
aacacgtgaaagacgatgtcagcatttccgttgaagaagggaaagagaatattcttcatgtttctga

SEQ ID NO: 257 - DNA, 100 bp, Artificial Sequence
  Synthetic oligonucleotide
aaatgtgatattcacagatgtgaattctatacttcgctacttggctagagttgcaactacagctgggttatatggctctaatctgatggaacatactgag

SEQ ID NO: 258 - DNA, 77 bp, Artificial Sequence
  Synthetic oligonucleotide
attgatcactggttggagttcagtgctacaaaattatcttcatgtgattcctttacttctacaattaatgaactcaa

SEQ ID NO: 259 - DNA, 80 bp, Artificial Sequence
  Synthetic oligonucleotide
tcattgcctgtctctgagaacatacttagttggaaactccttgagtttagcagatttatgtgtttgggccaccctaaaag

SEQ ID NO: 260 - DNA, 20 bp, Artificial Sequence
  Synthetic oligonucleotide
gaaatgctgcctggcaagaa

SEQ ID NO: 261 - DNA, 103 bp, Artificial Sequence
  Synthetic oligonucleotide
cagttgaaacagaagaaagctccagttcatgtaaaacgttggtttggctttcttgaagcccagcaggccttccagtcagtaggtaccaagtgggatgtttcaa

SEQ ID NO: 262 - DNA, 17 bp, Artificial Sequence
  Synthetic oligonucleotide
caaccaaagctcgagtg

SEQ ID NO: 263 - DNA, 95 bp, Artificial Sequence
  Synthetic oligonucleotide
gcacctgagaaaaagcaagatgttgggaaatttgttgagcttccaggtgcggagatgggaaaggttaccgtcagatttcctccagaggccagtgg

SEQ ID NO: 264 - DNA, 85 bp, Artificial Sequence
  Synthetic oligonucleotide
ggatgacccaagatttcctacggttcgtggtgtactgagaagagggatgacagttgaaggactgaaacagtttattgctgctcag

SEQ ID NO: 265 - DNA, 60 bp, Artificial Sequence
  Synthetic oligonucleotide
ggctcctcacgttcagtcgtgaacatggagtgggacaaaatctgggcgtttaacaaaaag

SEQ ID NO: 266 - DNA, 111 bp, Artificial Sequence
  Synthetic oligonucleotide
gttattgacccagtggctccacgatatgttgcattactgaagaaagaagtgatcccagtgaatgtacctgaagctcaggaggagatgaaagaagtagccaaacacccaaag

SEQ ID NO: 267 - DNA, 113 bp, Artificial Sequence
  Synthetic oligonucleotide
catgaagagctaatgctaggggatccctgccttaaggatttgaaaaaaggagatattatacaactccagagaagaggattcttcatatgtgatcaaccttatgaacctgttag

SEQ ID NO: 268 - DNA, 118 bp, Artificial Sequence
  Synthetic oligonucleotide
cccatatagttgcaaggaagccccgtgtgttttgatatacattcctgatgggcacacaaaggaaatgccaacatcagggtcaaaggaaaagaccaaagtagaagccacaaaaaatgag

SEQ ID NO: 269 - DNA, 96 bp, Artificial Sequence
  Synthetic oligonucleotide
tcctcagcaagtattctggaaagtaaatctctgtatgatgaagttgctgcacaaggggaggtggttcgtaagctaaaagctgaaaaatcccctaag

SEQ ID NO: 270 - DNA, 52 bp, Artificial Sequence
  Synthetic oligonucleotide
gttgggtcttgaggcaaaaaaagaagaaaatcttgctgattggtattctcag

SEQ ID NO: 271 - DNA, 73 bp, Artificial Sequence
  Synthetic oligonucleotide
gttgcttgggttacaagatctggcaaaaccgagctggcagaaccaattgccattcgtcctactagtgaaacag

SEQ ID NO: 272 - DNA, 80 bp, Artificial Sequence
  Synthetic oligonucleotide
taatgtatcctgcatatgcaaaatgggtacagtcacacagagacctgcccatcaagctcaatcagtggtgcaatgtggtg

SEQ ID NO: 273 - DNA, 102 bp, Artificial Sequence
  Synthetic oligonucleotide
cgttgggaattcaagcatcctcagcctttcctacgtactcgtgaatttctttggcaggaagggcacagtgcttttgctaccatggaagaggcagcggaagag

SEQ ID NO: 274 - DNA, 23 bp, Artificial Sequence
  Synthetic oligonucleotide
ggaggaacatcacatcatttagg

SEQ ID NO: 275 - DNA, 5 bp, Artificial Sequence
  Synthetic oligonucleotide
gcaga

SEQ ID NO: 276 - DNA, 79 bp, Artificial Sequence
  Synthetic oligonucleotide
ggcttctgaagaccttaagactcatatggttgtggctaatacaatggaagactttcagaagatactagattctggaaag

SEQ ID NO: 277 - DNA, 65 bp, Artificial Sequence
  Synthetic oligonucleotide
attgttcagattccattctgtggggaaattgactgtgaggactggatcaaaaagaccactgccag

SEQ ID NO: 278 - DNA, 101 bp, Artificial Sequence
  Synthetic oligonucleotide
gtaaacctaattaactggcaaaacttttgaaaaattgcaatggaaaggaatagcaatttgcagcataaatgagtggaattcttatttgttattaatttcag

SEQ ID NO: 279 - DNA, 5 bp, Artificial Sequence
  Synthetic oligonucleotide
aaaaa

SEQ ID NO: 280 - DNA, 4182 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgaggtgagtgtctgctggcaggcggaggctggagttgcaggggccaggagtccagcatgggcactgcccaaggccagccaggagggaggatgggaccctggggctagggacagacctggagtctggggaagaaaaaggggaccactgcgggtaggtgggggagtttaggtagaggtggatgaggcaacttatgacagagagagctttttatgtgattatattgtattgtatttaccatgtcccctgcaccttcttggagtattgggcctcaggaagcagcctctgttctgaatcccaaactctgaaagcaggagtgtccttggggacctggcttcaggagcatctcataccacctgccctctaagacacccacagcccattgtctgtttggcacattgccaagccccaccttgacttgctgtcctctggaacacctccagtttgctggagcaagatgttggatgcacgtttggaaaaaaatgccaaatcttagcaaagccaaacaatgaaaagaacgagctcttagggcactctgccattttgacattagtaatacgcagatcgggtggctttccaaccccagagagcagagaaacacacgataatgatgcattaggaaagcaagtcggagtccttggcagcttctcctttcctagatcaaaccttttctatcttcgatgtacatttccatcaggaaaaaaaacacgctgcgctccagcgagtcacaacattcatcacaggctggttgctagctaaggaaattcgtaagcaccaaactcataataccaaggacctccatttgacctttcctacacaactcagagcctctcttttcagttagttgtttatacagacaccaagtatgagtcttgcatttaaaacttcatagtacaaaaaactccacccacattgcacagtgcttttccaaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtcttgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagggctctcctggggcctgggggtggagaggaactaggagggatggggaatgtcagtgctgtgcagcctgggcctcaggtgtcccctaccctcctgcaccatcctgcacatggagcaaatctgttggctcctgagaccatctaaactatgggacaggcgctggggactgcagaaccacctgctgggtgctgggctgaaggaaaggtgttaaagtcttgaagaagtaacaagcctgtcttgaggggggttggggtctgctagggctctgcccaatgtggccccagatggactcccagcccctggtatagcccagcctggacttggtcaggctgagtgtgcgatggaccctgttacagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagccaaaaaaacggccgctgttgtcttga

SEQ ID NO: 281 - DNA, 138 bp, Artificial Sequence
  Synthetic oligonucleotide
ctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcac

SEQ ID NO: 282 - DNA, 1723 bp, Artificial Sequence
  Synthetic oligonucleotide
gtgagtgtctgctggcaggcggaggctggagttgcaggggccaggagtccagcatgggcactgcccaaggccagccaggagggaggatgggaccctggggctagggacagacctggagtctggggaagaaaaaggggaccactgcgggtaggtgggggagtttaggtagaggtggatgaggcaacttatgacagagagagctttttatgtgattatattgtattgtatttaccatgtcccctgcaccttcttggagtattgggcctcaggaagcagcctctgttctgaatcccaaactctgaaagcaggagtgtccttggggacctggcttcaggagcatctcataccacctgccctctaagacacccacagcccattgtctgtttggcacattgccaagccccaccttgacttgctgtcctctggaacacctccagtttgctggagcaagatgttggatgcacgtttggaaaaaaatgccaaatcttagcaaagccaaacaatgaaaagaacgagctcttagggcactctgccattttgacattagtaatacgcagatcgggtggctttccaaccccagagagcagagaaacacacgataatgatgcattaggaaagcaagtcggagtccttggcagcttctcctttcctagatcaaaccttttctatcttcgatgtacatttccatcaggaaaaaaaacacgctgcgctccagcgagtcacaacattcatcacaggctggttgctagctaaggaaattcgtaagcaccaaactcataataccaaggacctccatttgacctttcctacacaactcagagcctctcttttcagttagttgtttatacagacaccaagtatgagtcttgcatttaaaacttcatagtacaaaaaactccacccacattgcacagtgcttttccaaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtcttgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagggctctcctggggcctgggggtggagaggaactaggagggatggggaatgtcagtgctgtgcagcctgggcctcaggtgtcccctaccctcctgcaccatcctgcacatggagcaaatctgttggctcctgagaccatctaaactatgggacaggcgctggggactgcagaaccacctgctgggtgctgggctgaaggaaaggtgttaaagtcttgaagaagtaacaagc

SEQ ID NO: 283 - DNA, 111 bp, Artificial Sequence
  Synthetic oligonucleotide
aggggaggggaggcgggggctgatgtcaggagggatacaaatagtgccgacggctgggggccctgtctcccctcgccgcatccactctccggccggccgcctgcccgccgc

SEQ ID NO: 284 - DNA, 21 bp, Artificial Sequence
  Synthetic oligonucleotide
ctcctccgtgcgcccgccagc

SEQ ID NO: 285 - DNA, 48 bp, Artificial Sequence
  Synthetic oligonucleotide
ctcgcccgcgccgtcaccatgagccaggcctactcgtccagccagcgc

SEQ ID NO: 286 - DNA, 8 bp, Artificial Sequence
  Synthetic oligonucleotide
gtgtcctc

SEQ ID NO: 287 - DNA, 43 bp, Artificial Sequence
  Synthetic oligonucleotide
gtcgggcggggccgggggcctggggtcgctgcgggccagccgg

SEQ ID NO: 288 - DNA, 17 bp, Artificial Sequence
  Synthetic oligonucleotide
ctggggaccacccgcac

SEQ ID NO: 289 - DNA, 6 bp, Artificial Sequence
  Synthetic oligonucleotide
gccctc

SEQ ID NO: 290 - DNA, 57 bp, Artificial Sequence
  Synthetic oligonucleotide
ctcctacggcgcaggcgagctgctggacttctcactggccgacgcggtgaaccagga

SEQ ID NO: 291 - DNA, 43 bp, Artificial Sequence
  Synthetic oligonucleotide
gtttctgaccacgcgcaccaacgagaaggtggagctgcaggag

SEQ ID NO: 292 - DNA, 33 bp, Artificial Sequence
  Synthetic oligonucleotide
ctcaatgaccgcttcgccaactacatcgagaag

SEQ ID NO: 293 - DNA, 6 bp, Artificial Sequence
  Synthetic oligonucleotide
gtgcgc

SEQ ID NO: 294 - DNA, 78 bp, Artificial Sequence
  Synthetic oligonucleotide
ttcctggagcagcagaacgcggcgctcgccgccgaagtgaaccggctcaagggccgcgagccgacgcgagtggccgag

SEQ ID NO: 295 - DNA, 9 bp, Artificial Sequence
  Synthetic oligonucleotide
ctctacgag

SEQ ID NO: 296 - DNA, 6 bp, Artificial Sequence
  Synthetic oligonucleotide
gaggag

SEQ ID NO: 297 - DNA, 4 bp, Artificial Sequence
  Synthetic oligonucleotide
ctgc

SEQ ID NO: 298 - DNA, 100 bp, Artificial Sequence
  Synthetic oligonucleotide
gggagctgcggcgccaggtggaggtgctcactaaccagcgcgcgcgcgtcgacgtcgagcgcgacaacctgctcgacgacctgcagcggctcaaggccaa

SEQ ID NO: 299 - DNA, 61 bp, Artificial Sequence
  Synthetic oligonucleotide
gctgcaggaggagattcagttgaaggaagaagcagagaacaatttggctgccttccgagcg

SEQ ID NO: 300 - DNA, 22 bp, Artificial Sequence
  Synthetic oligonucleotide
gacgtggatgcagctactctag

SEQ ID NO: 301 - DNA, 74 bp, Artificial Sequence
  Synthetic oligonucleotide
ctcgcattgacctggagcgcagaattgaatctctcaacgaggagatcgcgttccttaagaaagtgcatgaagag

SEQ ID NO: 302 - DNA, 45 bp, Artificial Sequence
  Synthetic oligonucleotide
gagatccgtgagttgcaggctcagcttcaggaacagcaggtccag

SEQ ID NO: 303 - DNA, 44 bp, Artificial Sequence
  Synthetic oligonucleotide
gtggagatggacatgtctaagccagacctcactgccgccctcag

SEQ ID NO: 304 - DNA, 55 bp, Artificial Sequence
  Synthetic oligonucleotide
ggacatccgggctcagtatgagaccatcgcggctaagaacatttctgaagctgag

SEQ ID NO: 305 - DNA, 18 bp, Artificial Sequence
  Synthetic oligonucleotide
gagtggtacaagtcgaag

SEQ ID NO: 306 - DNA, 51 bp, Artificial Sequence
  Synthetic oligonucleotide
gtgtcagacctgacccaggcagccaacaagaacaacgacgccctgcgccag

SEQ ID NO: 307 - DNA, 75 bp, Artificial Sequence
  Synthetic oligonucleotide
gccaagcaggagatgatggaataccgacaccagatccagtcctacacctgcgagattgacgccctgaagggcact

SEQ ID NO: 308 - DNA, 117 bp, Artificial Sequence
  Synthetic oligonucleotide
aacgattccctgatgaggcagatgcgggaattggaggaccgatttgccagtgaggccagtggctaccaggacaacattgcgcgcctggaggaggaaatccggcacctcaaggatgag

SEQ ID NO: 309 - DNA, 39 bp, Artificial Sequence
  Synthetic oligonucleotide
atggcccgccatctgcgcgagtaccaggacctgctcaac

SEQ ID NO: 310 - DNA, 52 bp, Artificial Sequence
  Synthetic oligonucleotide
gtgaagatggccctggatgtggagattgccacctaccggaagctgctggagg

SEQ ID NO: 311 - DNA, 13 bp, Artificial Sequence
  Synthetic oligonucleotide
gagaggagagccg

SEQ ID NO: 312 - DNA, 44 bp, Artificial Sequence
  Synthetic oligonucleotide
gatcaatctccccatccagacctactctgccctcaacttccgag

SEQ ID NO: 313 - DNA, 76 bp, Artificial Sequence
  Synthetic oligonucleotide
ctgtcttgaggggggttggggtctgctagggctctgcccaatgtggccccagatggactcccagcccctggtatag

SEQ ID NO: 314 - DNA, 48 bp, Artificial Sequence
  Synthetic oligonucleotide
cccagcctggacttggtcaggctgagtgtgcgatggaccctgttacag

SEQ ID NO: 315 - DNA, 83 bp, Artificial Sequence
  Synthetic oligonucleotide
aaaccagccctgagcaaaggggttctgaggtccataccaagaagacggtgatgatcaagaccatcgagacacgggatggggag

SEQ ID NO: 316 - DNA, 33 bp, Artificial Sequence
  Synthetic oligonucleotide
gtcgtcagtgaggccacacagcagcagcatgaa

SEQ ID NO: 317 - DNA, 15 bp, Artificial Sequence
  Synthetic oligonucleotide
gtgctctaaagacag

SEQ ID NO: 318 - DNA, 7 bp, Artificial Sequence
  Synthetic oligonucleotide
agaccct

SEQ ID NO: 319 - DNA, 7 bp, Artificial Sequence
  Synthetic oligonucleotide
ctgccac

SEQ ID NO: 320 - DNA, 18 bp, Artificial Sequence
  Synthetic oligonucleotide
cagagaccgtcctcaccc

SEQ ID NO: 321 - DNA, 16 bp, Artificial Sequence
  Synthetic oligonucleotide
ctgtcctcactgctcc

SEQ ID NO: 322 - DNA, 6 bp, Artificial Sequence
  Synthetic oligonucleotide
ctgaag

SEQ ID NO: 323 - DNA, 17 bp, Artificial Sequence
  Synthetic oligonucleotide
ccagccttcttccatcc

SEQ ID NO: 324 - DNA, 22 bp, Artificial Sequence
  Synthetic oligonucleotide
caggacaccacacccagcctca

SEQ ID NO: 325 - DNA, 8 bp, Artificial Sequence
  Synthetic oligonucleotide
gtcctccc

SEQ ID NO: 326 - DNA, 27 bp, Artificial Sequence
  Synthetic oligonucleotide
ctcacagcctctgacccctcctcactg

SEQ ID NO: 327 - DNA, 10 bp, Artificial Sequence
  Synthetic oligonucleotide
gccatccctc

SEQ ID NO: 328 - DNA, 11 bp, Artificial Sequence
  Synthetic oligonucleotide
gtggtccccaa

SEQ ID NO: 329 - DNA, 7 bp, Artificial Sequence
  Synthetic oligonucleotide
cagcgac

SEQ ID NO: 330 - DNA, 18 bp, Artificial Sequence
  Synthetic oligonucleotide
atagcccatccctgcctg

SEQ ID NO: 331 - DNA, 33 bp, Artificial Sequence
  Synthetic oligonucleotide
gtcacagggcatgccccggccacctctgcggac

SEQ ID NO: 332 - DNA, 13 bp, Artificial Sequence
  Synthetic oligonucleotide
cccagctgtgagc

SEQ ID NO: 333 - DNA, 36 bp, Artificial Sequence
  Synthetic oligonucleotide
cttggctgttggcagtgagtgagcctggctcttgtg

SEQ ID NO: 334 - DNA, 4 bp, Artificial Sequence
  Synthetic oligonucleotide
ctgg

SEQ ID NO: 335 - DNA, 23 bp, Artificial Sequence
  Synthetic oligonucleotide
atggagcccaggcgggagcggtg

SEQ ID NO: 336 - DNA, 16 bp, Artificial Sequence
  Synthetic oligonucleotide
gccctgtccctcccac

SEQ ID NO: 337 - DNA, 22 bp, Artificial Sequence
  Synthetic oligonucleotide
ctctgtgacctcaggcactagc

SEQ ID NO: 338 - DNA, 47 bp, Artificial Sequence
  Synthetic oligonucleotide
ctttggctctggagacagccccagagcagggtgttgggatactgcag

SEQ ID NO: 339 - DNA, 43 bp, Artificial Sequence
  Synthetic oligonucleotide
ggccaggactgagccccgcagacctccccagcccctagcccag

SEQ ID NO: 340 - DNA, 31 bp, Artificial Sequence
  Synthetic oligonucleotide
gagagagaaagccaggcaggtagccaggggg

SEQ ID NO: 341 - DNA, 96 bp, Artificial Sequence
  Synthetic oligonucleotide
actagcccctgtggagactggggggcttgaaattgtccccgtggtctcttactttcctttccccagcccagggtggacttagaaagcaggggctac

SEQ ID NO: 342 - DNA, 4 bp, Artificial Sequence
  Synthetic oligonucleotide
aaga

SEQ ID NO: 343 - DNA, 8 bp, Artificial Sequence
  Synthetic oligonucleotide
gggaatcc

SEQ ID NO: 344 - DNA, 6 bp, Artificial Sequence
  Synthetic oligonucleotide
ccgaag

SEQ ID NO: 345 - DNA, 57 bp, Artificial Sequence
  Synthetic oligonucleotide
gtgctggaggtgggagcaggagattgagaaggagagaaagtgggtgagatgctggag

SEQ ID NO: 346 - DNA, 7 bp, Artificial Sequence
  Synthetic oligonucleotide
aagagag

SEQ ID NO: 347 - DNA, 16 bp, Artificial Sequence
  Synthetic oligonucleotide
gagaggagagaggcag

SEQ ID NO: 348 - DNA, 10 bp, Artificial Sequence
  Synthetic oligonucleotide
agagcggtct

SEQ ID NO: 349 - DNA, 14 bp, Artificial Sequence
  Synthetic oligonucleotide
caggctggtgggag

SEQ ID NO: 350 - DNA, 14 bp, Artificial Sequence
  Synthetic oligonucleotide
gggcgcccacctcc

SEQ ID NO: 351 - DNA, 4 bp, Artificial Sequence
  Synthetic oligonucleotide
ccac

SEQ ID NO: 352 - DNA, 22 bp, Artificial Sequence
  Synthetic oligonucleotide
gccctcccctcccctgctgcag

SEQ ID NO: 353 - DNA, 66 bp, Artificial Sequence
  Synthetic oligonucleotide
gggctctggagagaaacaataaagagattcacacacaagccaaaaaaacggccgctgttgtcttga

SEQ ID NO: 354 - DNA, 8600 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 355 - DNA, 8681 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 356 - DNA, 10915 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 357 - DNA, 8726 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgcccgcgactgtgtttcttacgagcttctgcctgcctgggttcagaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 358 - DNA, 9154 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgcccgcgactgtgtttcttacgagcttctgcctgcctgggttcaggtaaagagatgcagaggcgtgctggctcgctgctaacacggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaattaacagctgccccagagataccaatagcactcgcattttgcatttggagctcagatcaaaatacgggctgagctaagagcatatgtgcgtttctgagcatttccaggaataacttggccttaaccttctcttggtttctctggatggtttggtcataaacagatcagcctcacgatgtcttctgtttttcttttctttcacctatgaaaagaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 359 - DNA, 8545 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 360 - DNA, 8708 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagctccctacgttcctcttgtgtcgccagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 361 - DNA, 3873 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 362 - DNA, 11027 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactttggtgatcttttaaaaatccttttaattcttggatgtgttgttgattgaatgtgttctactgaatgatcagcacggattagagccagtaggaaagcagttatcctgtttgactcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 363 - DNA, 8497 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactgtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 364 - DNA, 11652 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactgtaagtagggctgttttccttaatttgggatgttgggattatgaaacactcaagagagatctgagattgttctggcccaaagaagcttctgtaaattacataaataaaggctttaattatctacaggagtagtaaaggctaatgatgtagctgtctttgagtaataattctgccttaaaattgtttgtgtagaactgggtcatttatcaaactctgtgtttatgtggcctttagaatattatccctcagtaagttagaggcacagattaatggagtttgaaggttgtcacttggtttgacacagtttcttccaaaaaagtggatctaggtatttcattcacatatcaggaaaaagactcagattaggcaacatgcccaggttgttctgctaatggctgagtttaaacaaaaaccataaacacctccctgtgtttattcatttgtttccctcgataatatttgtctttgctcacaagcatgtaaaacctataatgtatatgcacagtagattcattcatacatcactttttataatcagttagtgcaaactgaatgaattcattaaaaacaaagacctggtttattatcaacagaaaccacacaatgctcttttttcttttaccagttggtgatcttttaaaaatccttttaattcttggatgtgttgttgattgaatgtgttctactgaatgatcagcacggattagagccagtaggaaagcagttatcctgtttgactcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 365 - DNA, 10929 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatgtgatgggattctaggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 366 - DNA, 5756 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggtaagcattgtcctcccatgcgtggaaa

SEQ ID NO: 367 - DNA, 5691 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttggtacgtgaggctcagtgtgggggcttctcttttgccagcagc

SEQ ID NO: 368 - DNA, 3273 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacatatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 369 - DNA, 5476 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatggactgtaaaagcaaaggaaaaagaatgggggaatcggcatcagtagcctactctggtggcattgtagaccttggttgtggtgatgcagcagcaaatg

SEQ ID NO: 370 - DNA, 4695 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaaggtctcccccctgaagaacccgcagggcgctgccctgaagattccacctgctaatacaccttccgagaacttctgcctcagtcaactaacc

SEQ ID NO: 371 - DNA, 3247 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagtaaggagggttaacaaggt

SEQ ID NO: 372 - DNA, 3020 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaa

SEQ ID NO: 373 - DNA, 2112 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaa

SEQ ID NO: 374 - DNA, 10239 bp, Homo sapiens
cttttcctggtccttcctcttatcccggttaatccacgaaatgtagaagttccatcttatttcaacgattagtgctaatcattaataatttagacctgtctggaggagggaatccataggtttaggtctcctagcatcctggcactagccagcagctgctctgtaggagccttctggaaacagcaggaaggagcggcttccccacgagttccccaagtgctttcgttggcccaagtgctttcgttggcccaagtgacctgtttgagtttgctcttcagtttaccccaggcgggaaggcagcctgtctgcgggttggtggccatgttggcagagaaggggttaatctcttgttgctgtaggagccgaggttgcgagctagattgaaagcaggcgctgcagtgccatcgccagcgccgaaggagtaagacgatcttctccgcaacagtgttgaatccggctgaaattttttttcctccccgcctcctttcttgtttttctttaaccagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 375 - DNA, 7772 bp, Homo sapiens
agagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 376 - DNA, 10072 bp, Homo sapiens
agagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggaggtaggagccgcatatgtccatccgtgcattcccaccgtcagcgcgcaggggtgctgtagatcaccgctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcagccatgcttggtaatttgcatatcggccctggctgctttcaggctacagagtcagaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 377 - DNA, 5465 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 378 - DNA, 5330 bp, Homo sapiens
cttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 379 - DNA, 4859 bp, Homo sapiens
gccagtttccaggagttaggagatatctctgtttccattgctagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

(The sequence listing continues in the following parts.)

What is claimed is:

1. An isolated polynucleotide consisting of the sequence selected from the group consisting of SEQ ID NOs 869, and 876 or a polynucleotide at least 95% identical thereto.

2. An isolated polynucleotide consisting of SEQ ID NO. 6889.

3. A method for diagnosing lung cancer, comprising:
providing a test sample from a subject;
detecting in said test sample the polynucleotide of detecting in said test sample the polynucleotide of ;
comparing levels of said polynucleotide in said test sample to levels of said polynucleotide in a control sample, wherein an elevated level of said polynucleotide in said test sample compared to the level of said polynucleotide in a control sample is indicative of lung cancer in said subject,
thereby diagnosing lung cancer in said subject.

4. The method of 4. The method of , wherein said detecting expression is performed with a Nucleic Acid Testing (NAT)-based technology.

5. An isolated polynucleotide, wherein the sequence of said polynucleotide comprises SEQ ID NO:869.

* * * * *

UNITED STATES PATENT AND TRADEMARK OFFICE
CERTIFICATE OF CORRECTION

PATENT NO. : 7,842,459 B2  
APPLICATION NO. : 11/051646  
DATED : November 30, 2010  
INVENTOR(S) : Michal Ayalon-Soffer It is certified that error appears in the above-identified patent and that said Letters Patent is hereby corrected as shown below:

In the claims:

Column 2921, line 28, claim 3, the phrase "detecting in said test sample the polynucleotide of detecting in said test sample the polynucleotide of" should read --detecting in said test sample the polynucleotide of claim 1--.

Column 2922, line 25, claim 4, the phrase "The method of 4. The method of" should read --The method of claim 3--.

Signed and Sealed this  
Eighth Day of February, 2011

David J. Kappos  
*Director of the United States Patent and Trademark Office*